United States Patent
Nioi et al.

(10) Patent No.: US 11,066,472 B2
(45) Date of Patent: Jul. 20, 2021

(54) METHODS OF TREATING CARDIOVASCULAR DISEASE WITH AN ANTI-ASGR ANTIBODY OR BINDING FRAGMENTS THEREOF

(71) Applicant: Amgen Inc., Thousand Oaks, CA (US)

(72) Inventors: Paul Nioi, Wellesley, MA (US); Peter Coward, San Francisco, CA (US); Christopher Murawsky, Vancouver (CA)

(73) Assignee: Amgen Inc., Thousand Oaks, CA (US)

( * ) Notice: Subject to any disclaimer, the term of this patent is extended or adjusted under 35 U.S.C. 154(b) by 156 days.

(21) Appl. No.: 16/230,356

(22) Filed: Dec. 21, 2018

(65) Prior Publication Data
US 2019/0248902 A1 Aug. 15, 2019

Related U.S. Application Data

(62) Division of application No. 15/279,162, filed on Sep. 28, 2016, now Pat. No. 10,358,497.

(60) Provisional application No. 62/234,546, filed on Sep. 29, 2015, provisional application No. 62/259,553, filed on Nov. 24, 2015, provisional application No. 62/319,740, filed on Apr. 7, 2016.

(51) Int. Cl.
| | |
|---|---|
| *A61P 9/10* | (2006.01) |
| *A61P 3/06* | (2006.01) |
| *A61K 39/395* | (2006.01) |
| *C07K 16/28* | (2006.01) |
| *A61P 9/04* | (2006.01) |
| *C12N 15/113* | (2010.01) |
| *C07H 21/02* | (2006.01) |
| *A61K 45/06* | (2006.01) |
| *C07K 14/705* | (2006.01) |
| *A61K 39/00* | (2006.01) |

(52) U.S. Cl.
CPC ...... *C07K 16/2851* (2013.01); *A61K 39/3955* (2013.01); *A61K 45/06* (2013.01); *A61P 3/06* (2018.01); *A61P 9/04* (2018.01); *A61P 9/10* (2018.01); *C07H 21/02* (2013.01); *C07K 16/28* (2013.01); *C12N 15/1138* (2013.01); *A61K 2039/505* (2013.01); *A61K 2039/507* (2013.01); *C07K 14/705* (2013.01); *C07K 14/7056* (2013.01); *C07K 2317/30* (2013.01); *C07K 2317/76* (2013.01); *C07K 2317/77* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | |
|---|---|---|
| 3,720,760 A | 3/1973 | Wide et al. |
| 4,179,337 A | 12/1979 | Davis et al. |
| 4,301,144 A | 11/1981 | Iwashita et al. |
| 4,331,647 A | 5/1982 | Goldenberg |
| 4,496,689 A | 1/1985 | Mitra |
| 4,518,584 A | 5/1985 | Mark et al. |
| 4,522,811 A | 6/1985 | Eppstein et al. |
| 4,640,835 A | 2/1987 | Shimizu et al. |
| 4,670,417 A | 6/1987 | Iwasaki et al. |
| 4,737,456 A | 4/1988 | Weng et al. |
| 4,737,462 A | 4/1988 | Mark et al. |
| 4,751,180 A | 6/1988 | Cousens et al. |
| 4,791,192 A | 12/1988 | Nakagawa et al. |
| 4,935,233 A | 6/1990 | Bell et al. |
| 5,011,912 A | 4/1991 | Hopp et al. |
| 5,208,020 A | 5/1993 | Chari et al. |
| 5,223,409 A | 6/1993 | Ladner et al. |
| 5,225,539 A | 7/1993 | Winter |
| 5,416,064 A | 6/1995 | Chari et al. |
| 5,457,035 A | 10/1995 | Baum et al. |
| 5,474,981 A | 12/1995 | Leder et al. |
| 5,475,092 A | 12/1995 | Chari et al. |
| 5,539,082 A | 7/1996 | Nielson et al. |
| 5,545,806 A | 8/1996 | Lonberg et al. |
| 5,569,825 A | 10/1996 | Lonberg et al. |
| 5,585,499 A | 12/1996 | Chari et al. |
| 5,624,821 A | 4/1997 | Winter et al. |
| 5,627,052 A | 5/1997 | Schrader |

(Continued)

FOREIGN PATENT DOCUMENTS

| | | |
|---|---|---|
| EP | 404097 | 10/1991 |
| EP | 1144623 | 10/2001 |

(Continued)

OTHER PUBLICATIONS

Spiess et al, 1985. Proc Natl Acad Sci USA. 82:6465-6469.*

(Continued)

*Primary Examiner* — Zachary C Howard

(74) *Attorney, Agent, or Firm* — Knobbe, Martens, Olson & Bear, LLP

(57) ABSTRACT

Antigen binding proteins that interact with ASGR, ASGR-1 and/or ASGR-2 are described as well as methods of making and using such antigen binding proteins. Methods of treating and preventing cardiovascular disease by administering a pharmaceutically effective amount of ASGR, ASGR-1 and/or ASGR-2 antigen binding proteins. Methods of treating and preventing cardiovascular disease by administering a pharmaceutically effective amount of interfering RNA compositions that reduce expression of ASGR, ASGR-1 and/or ASGR-2 are described.

47 Claims, 4126 Drawing Sheets

Specification includes a Sequence Listing.

(56) References Cited

U.S. PATENT DOCUMENTS

| | | | |
|---|---|---|---|
| 5,698,426 | A | 12/1997 | Husebird |
| 5,714,331 | A | 2/1998 | Buchardt et al. |
| 5,719,262 | A | 2/1998 | Buchardt et al. |
| 5,814,318 | A | 9/1998 | Lonberg et al. |
| 5,821,337 | A | 10/1998 | Carter et al. |
| 5,859,205 | A | 1/1999 | Adair et al. |
| 5,869,619 | A | 2/1999 | Studnicka |
| 5,877,293 | A | 3/1999 | Adair et al. |
| 5,877,397 | A | 3/1999 | Lonberg et al. |
| 5,886,152 | A | 3/1999 | Nakatani et al. |
| 5,898,031 | A | 4/1999 | Crooke |
| 6,054,297 | A | 4/2000 | Carter et al. |
| 6,107,094 | A | 8/2000 | Crooke |
| 6,133,426 | A | 10/2000 | Gonzalez et al. |
| 6,168,587 | B1 | 1/2001 | Bellhouse et al. |
| 6,194,389 | B1 | 2/2001 | Johnston et al. |
| 6,210,924 | B1 | 4/2001 | Hu et al. |
| 6,277,375 | B1 | 8/2001 | Ward |
| 6,340,701 | B1 | 1/2002 | Chari et al. |
| 6,372,738 | B2 | 4/2002 | Chari et al. |
| 6,395,272 | B1 | 5/2002 | Deo et al. |
| 6,436,931 | B1 | 8/2002 | Chari et al. |
| 6,471,996 | B1 | 10/2002 | Sokoll et al. |
| 6,472,375 | B1 | 10/2002 | Hoon et al. |
| 6,506,559 | B1 | 1/2003 | Fire et al. |
| 6,573,099 | B2 | 6/2003 | Graham |
| 6,602,684 | B1 | 8/2003 | Umana et al. |
| 6,693,187 | B1 | 2/2004 | Dellinger |
| 6,696,245 | B2 | 2/2004 | Winter et al. |
| 6,703,199 | B1 | 3/2004 | Koide |
| 6,846,634 | B1 | 1/2005 | Tomlinson et al. |
| 6,881,557 | B2 | 4/2005 | Foote |
| 7,029,872 | B2 | 4/2006 | Gerngross |
| 7,056,704 | B2 | 6/2006 | Tuschl et al. |
| 7,064,244 | B2 | 6/2006 | Jakobovits et al. |
| 7,078,196 | B2 | 7/2006 | Tuschl et al. |
| 7,563,459 | B2 | 7/2009 | Phillips |
| 7,579,451 | B2 | 8/2009 | Manoharan et al. |
| 7,695,963 | B2 | 4/2010 | Agulnick et al. |
| 8,030,457 | B2 | 10/2011 | Jackson et al. |
| 8,394,628 | B2 | 3/2013 | Tuschl et al. |
| 8,502,014 | B2 | 8/2013 | Grosveld |
| 8,507,455 | B2 | 8/2013 | Manoharan et al. |
| 8,507,748 | B2 | 8/2013 | Grosveld |
| 8,877,917 | B2 | 11/2014 | Forst et al. |
| 9,181,551 | B2 | 11/2015 | McSwiggen et al. |
| 10,358,497 | B2 | 7/2019 | Nioi et al. |
| 2001/0036459 | A1 | 11/2001 | Ravetch |
| 2003/0039958 | A1 | 2/2003 | Holt et al. |
| 2003/0133939 | A1 | 7/2003 | Ledbetter et al. |
| 2004/0009507 | A1 | 1/2004 | Winter et al. |
| 2004/0038291 | A2 | 2/2004 | Tomlinson et al. |
| 2004/0072290 | A1 | 4/2004 | Umana et al. |
| 2004/0185045 | A1 | 9/2004 | Koenig et al. |
| 2004/0202995 | A1 | 10/2004 | De Wildt et al. |
| 2004/0261148 | A1 | 12/2004 | Dickey et al. |
| 2005/0079605 | A1 | 4/2005 | Umana et al. |
| 2005/0118643 | A1 | 6/2005 | Burgess et al. |
| 2005/0202512 | A1 | 9/2005 | Tomlinson et al. |
| 2005/0238646 | A1 | 10/2005 | Ledbetter et al. |
| 2005/0272128 | A1 | 12/2005 | Umana et al. |
| 2006/0039904 | A1 | 2/2006 | Wu et al. |
| 2006/0040325 | A1 | 2/2006 | Wu et al. |
| 2006/0067930 | A1 | 3/2006 | Adams et al. |
| 2006/0257399 | A1 | 11/2006 | Gerngross et al. |
| 2007/0031402 | A1 | 2/2007 | Zhang et al. |
| 2007/0092521 | A1 | 4/2007 | McPherson et al. |
| 2009/0028856 | A1 | 1/2009 | Chen et al. |
| 2009/0169548 | A1 | 7/2009 | Grosveld et al. |
| 2009/0274713 | A1 | 11/2009 | Chari et al. |
| 2009/0285805 | A1 | 11/2009 | Grosveld et al. |
| 2009/0307787 | A1 | 12/2009 | Grosveld et al. |
| 2011/0092565 | A1 | 4/2011 | Bumcrot et al. |
| 2011/0314563 | A1 | 12/2011 | Craig et al. |
| 2012/0028596 | A1 | 2/2012 | Yamada et al. |
| 2012/0151610 | A1 | 6/2012 | Craig et al. |
| 2013/0024961 | A1 | 1/2013 | Burlak et al. |
| 2015/0135344 | A1 | 5/2015 | Tector et al. |
| 2015/0197746 | A1 | 7/2015 | Rajeev et al. |
| 2015/0259689 | A1 | 9/2015 | Kowalik et al. |
| 2016/0122761 | A1 | 5/2016 | Prakash et al. |
| 2019/0309306 | A1 | 10/2019 | Ollmann et al. |

FOREIGN PATENT DOCUMENTS

| | | |
|---|---|---|
| EP | 439095 | 12/2004 |
| WO | WO 87/05330 | 9/1987 |
| WO | WO 92/02551 | 2/1992 |
| WO | WO 93/10151 | 5/1993 |
| WO | WO 93/11161 | 6/1993 |
| WO | WO 93/21232 | 10/1993 |
| WO | WO 94/10308 | 5/1994 |
| WO | WO 97/34631 | 9/1997 |
| WO | WO 98/23289 | 6/1998 |
| WO | WO 98/24838 | 6/1998 |
| WO | WO 99/51642 | 10/1999 |
| WO | WO 99/58572 | 11/1999 |
| WO | WO 00/76310 | 12/2000 |
| WO | WO 01/79299 | 10/2001 |
| WO | WO 03/011878 | 2/2003 |
| WO | WO 2004/016750 | 2/2004 |
| WO | WO 2004/029207 | 4/2004 |
| WO | WO 2004/063351 | 7/2004 |
| WO | WO 2005/044859 | 5/2005 |
| WO | WO 2005/084390 | 9/2005 |
| WO | WO 2005/694879 | 10/2005 |
| WO | WO 2006/071280 | 7/2006 |
| WO | WO 2006/071856 | 7/2006 |
| WO | WO 2008/122886 | 10/2008 |
| WO | WO 2009/013620 | 1/2009 |
| WO | WO 2009/089004 | 7/2009 |
| WO | WO 2009/099728 | 8/2009 |
| WO | WO 2011/068798 A1 | 6/2011 |
| WO | WO 2014/023709 A1 | 2/2014 |
| WO | WO 2017/058944 A1 | 4/2017 |
| WO | WO 2018/039647 | 3/2018 |

OTHER PUBLICATIONS

Rudikoff et al (Proc Natl Acad Sci USA 1982 vol. 79 pp. 1979-1983).*
File History of U.S. Appl. No. 15/279,162, filed Sep. 28, 2016.
Adams et al., PHENIX: a comprehensive Python-based system for macromolecular structure solution, Acta crystallographica vol. 66, pp. 213-221 (2010).
Albert et al., The B-cell Epitope of the Monoclonal Anti-Factor VIII Antibody ESH8 Characterized by Peptide Array Analysis, Thromb Haemost vol. 99, pp. 634-637 (2008).
Alting-Mees et al., Monoclonal Antibody Expression Libraries: A Rapid Alternative to Hybridisms Strategies in Molecular Biology vol. 3, 1990).
Andrews et all Fragmentation of Immunoglobulin G, Current Protocols in Immunology, Unit 2.10A John Wiley & Sons (1997).
Aoki et al., Potential tumor-targeting peptide vector of histidylated oligolysine conjugated to a tumor-homing RGD motif, Cancer Gene Therapy vol. 8, pp. 783-787 (2001).
Aplin et al., Preparation, Properties, and Applications of Carbohydrate Conjugates of Proteins and Lipids, CRC Critical Reviews in Biochemistry, pp. 259-306, May 1981.
Arbones et al., Lymphocyte Homing and Leukocyte Rolling and Migration Are Impaired in L-Selectin-Deficient Mice, Immunity. vol. 1, pp. 247-260 (1994).
Ashkenazi et al., Protection Against Endotoxic Shock by a Tumor Necrosis Factor Receptor Immunoadhesin, Proceedings of the National Academy of Sciences USA, vol. 88, pp. 10535-10539, Dec. 1991.
Ashwell et al., "Carbohydrate-Specific Receptors of the Liver," Annual Review of Biochemistry, vol. 51, pp. 531-554. 1982.
Ausubel et al., Table of Contents of "Current Protocols in Molecular Biology," Book: Short Protocols in Molecular Biology, 2 ed., Greene Publishing Associates and John Wiley & Sons, 1992.

(56) References Cited

OTHER PUBLICATIONS

Babcock et al., A novel strategy for generating monoclonal antibodies from single, isolated lymphocytes producing antibodies of defined specificities, Proc. Nat. Acad. Sc. USA vol. 93, pp. 843-848 (1996).
Baines et al., Purification of Immunoglobulin G (IgG), Methods in Molecular Biology vol. 10, pp. 79-104, The Human Press Inc. (1992).
Baron et al., Co-regulation of two gene activities by tetracycline via a bidirectional promoter, Nucleic Acids Res. vol. 23, pp. 3605-3606 (1995).
Baum et al., "Molecular Characterization of Murine and Human OX40/OX40 Ligand Systems: Identification of a Human OX40 Ligand as the HTLV-1-Regulated Protein GP34," The Embo Journal, vol. 13, No. 17, pp. 3992-4001, 1994.
Battye et al., iMOSFLM: a new graphical interface for diffraction-image processing with MOSFLM, Acta crystallographica vol. 67, pp. 271-281 (2011).
Bauer et al., a genetic enrichment for mutations constructed by oligodeoxynucleotide-directed mutagenesis Gene vol. 37, pp. 73 (1985).
Bebbington et al., The use of vectors based on gene amplification for the expression of cloned genes in mammalian cells, DNA Cloning, vol. 3. Academic Press (1987).
Bird et al., "Single-Chain Antigen-Binding Proteins," Science, vol. 242, pp. 423-426, 1988.
Bishop, Table of Contents of Guide to Huge Computers, ed., Academic Press, (1994).
Bowie et al., "A Method to Identify Protein Sequences That Fold Into a Known Three-Dimensional Structure," Science, vol. 253, pp. 164-170, Jul. 12, 1991.
Bloom et al., "Intrachain Disulfide Bond in the Core Hinge Region of Human IgG4," Protein Science, vol. 6, pp. 407-415, 1997.
Boerner et al., Production of antigen-specific human monoclonal antibodies from in vitro-primed human splenocytes Journal or Immunology vol. 147, pp. 86-95 (1991).
Born, R., Benefit and Application of Antibodies Against the HI Carbohydrate Recognition Domain of the Human Hepatic Asialoglycoprotein Receptor High Yield Recombinant Production of the HI Carbohydrate Recognition Domain and Production and Characterization of Murine Monoclonal and Chicken Polyclonal Antibodies, Thesis, (2005).
Branden et al., Table of Contents of "Introduction to Protein Structure," Garland Publishing, Inc., 6 pages, 1991.
Bruggemann et al., Production of human antibody repertoires in transgenic mice Current Opinions in Biotechnology vol. 8, pp, 455-458 (1997).
Burger et al., Human plasma R-type vitamin B12-binding proteins II. The role of transcobalamin I, transcobalamin III, and the normal granulocyte vitamin B12-binding protein in the plasma transport of vitamin B12, The Journal of Biological Chemistry vol. 250, pp. 7707-7713 (1975).
Burton et al., "Human Antibodies from Combinatorial Libraries," Advances in Immunology, vol. 57, pp. 191-280, 1994.
Byrn et al., "Biological Properties of a CD4 Immunoadhesion," Nature, vol. 344, pp. 667-670, Apr. 12, 1990.
Cao et al, "Characterization of a Single-Chain Variable Fragment (scFv) Antibody Directed Against the Human Asialoglycoprotein Receptor," Biotechnology and Applied Biochemistry, vol. 44, No. 2, pp. 65-72, 2006.
Carrillo, et al., "The Multiple Sequence Alignment Problem in Biology," SIAM Journal on Applied Mathematics, vol. 48,, No. 5, pp. 1073-1082, Oct. 5, 1988.
CCP4, The CCP4 suite: programs for protein crystallography, Acta crystallographica vol. 50, pp. 760-763 (1994).
Chambers et al., Genome-wide association study identifies loci influencing concentrations of liver enzymes in plasma, Nature genetics vol. 43, pp. 1131-1138 (2011).

Chen et al., Immunoglobulin gene rearrangement in B-cell deficient mice generated by targeted deletion of the JH locus, International Immunology vol. 5, pp. 647-656 (1993).
Cheung et al., Epitope-Specific Antibody Response to the Surface Antigen of Duck Hepatitis 6 Virus in Infected Ducks Virology vol. 176, pp. 546-552 (1990).
Choi et al., Transgenic mice containing a human heavy chain immunoglobulin gene fragment cloned in a yeast artificial chromosome, Nature Genetics vol. 4, pp. 117-123 (1993).
Chothia, C et al., Canonical Structures for the Hypervariable Regions of Immunoglobulins, Journal of Molecular Biology vol. 196, pp. 901-917 (1987).
Chothia et al., Conformations of Immunoglobulin hypervariable regions, Nature vol. 342, pp. 878-883 (1989).
Chou et al., Prediction of the secondary structure of proteins from their amino acid sequence, Adv. Enzymol, Relat. Areas Mol. Biol. vol. 47, pp. 45-148 (1978).
Chou et al., Empirical predictions of protein conformation, Ann. Rev. Biochem. vol. 47, pp. 251-276.
Chou et al., Prediction of protein conformation, Biochemistry vol. 13(2), pp. 222-245 (1974).
Chou et al. Prediction of A-Turns, Biophys J. vol. 26, pp. 367-384 (1979).
Chou et al., Conformational Parameters for amino acids in helical b-sheet, and random coil regions calculated from proteins, Biochemistry vol. 113(2), pp. 211-222 (1974).
Clark, M., Antibody humanization: a case of the 'Emperor's new clothes'? Immunology Today vol. 21(8), pp. 397-402 (2000).
Coates et al., Epitope mapping by amide hydrogen/deuterium exchange coupled with immobilization of antibody, on-line proteolysis, liquid chromatography and mass spectrometry, Rapid Communication Mass Pectrometry vol. 23, pp. 639-647 (2009).
Cockett et al., High level of tissue inhibitor of metalloproteinases in Chinese hamster ovary cells using glutamine synthetase gene amplification, Bio/Technology vol. 8, pp. 2 (1990).
Colberre-Garapin et al., A New Dominant Hybrid Selective Marker for Higher Eukaryotic Cells J. Mol. Biol. vol. 150, pp. 1 (1981).
Cortez-Retamozo et al., Efficient Cancer Therapy with a Nanobody-Based Conjugate, Cancer Research vol. 64, pp. 2853-2857 (2004).
Courtenay-Luck, Genetic Manipulation of Monoclonal Antibodies, Monoclonal Antibodies: Production, Engineering and Clinical Application, Ritter et al. (ads.), pp. 166, Cambridge University Press (1995).
Craik, Use of oligonucleotides for site-specific mutagenesis, BioTechniques, 12-19 (1985).
Crameri et al., DNA shuffling of a family of genes from diverse species accelerates directed evolution, Nature vol. 391, pp. 288-291 (1998).
Creighton, Ed., Proteins, Structures, and Molecular Principles, W.H. Freeman and Company (1984).
Creighton, Proteins: Structure and Molecular Properties, W.H. Freeman & Co., pp. 79-86 (1983).
Crouse et al., Expression and Amplification of Engineered Mouse Dihydrofolate Reductase Minigenes, Mol. Cell. Biol, vol. 3, pp. 257 (1983).
Cunningham and Wells, High-resolution epitope mapping og HGH-receptor interactions by alanine-scanning mutagenesis, Science vol. 244, pp. 1081085 (1989).
D'Souza et al., Asialoglycoprotein receptor mediated hepatocyte targeting—Strategies and applications Journal of Control Release vol. 203, pp. 126-139 (2015).
Dall'Acqua et al., Antibody humanization by framework shuffling, Methods vol. 36(1), pp. 43-60 (2005).
Davis et al., Transgenic mice as a source of fully human antibodies for the treatment of cancer, Cancer Metastasis Rev. vol. 18, pp. 421-425 (1999).
Davis et al., Production of human antibodies from transgenic mice in Lo, ed. Antibody Engineering: Methods and Protocols, Humana Press, NJ, pp. 191-200 (2003).
Deleavey et al., Designing Chemically Modified Oligonucleotides for Targeted Gene Silencing Chemistry and Biology, vol. 19, pp. 937-954 (2012).

(56) References Cited

OTHER PUBLICATIONS

Devereux et al., A comprehensive set of sequence analysis programs for the VAX, Nucl. Acids Res. vol. 12(1), pp. 387 (1984).
Di Angelantonio et al., Major lipids, apolipoproteins, and risk of vascular disease, Jama vol. 302, pp. 1993-2000 (2009).
Do et al,, Common variants associated with plasma triglycerides and risk for coronary artery disease, Nature genetics vol. 45, pp. 1345-1352 (2013).
Dracopoli et al. (eds), Table of Contents of Current Protocols in Human Genetics, John Wiley & Sons (1994).
Emsley et al., Features and development of Coot, Acta crystallographica vol. 66, pp. 486-501 (2010).
Evans, Scaling and assessment of data quality, Acta crystallographica vol. 62, pp. 72-82 (2006).
Fanslow et al., Structural characteristics of CD40 ligand that determine biological function, Semin. Immunol. vol. 6, pp. 267-278 (1994).
Fell et al., Genetic construction and characterization of a fusion protein consisting of a chimeric F(ab') with specificity for carcinomas and human IL-2., J. Immunol. vol. 146, pp. 2446-2452 (1991).
Fieser et al., Table of Contents of Fieser and Fieser's Reagents for Organic Synthesis, John Wiley and Sons (1994).
Fishwild et al., High-avidity human IgGk monoclonal antibodies from a novel strain of miniolocus transgenic mice Nature Biotechnology vol. 14, pp. 845-851 (1996).
Foecking et al., Powerful and versatile enhancer-promoter unit for mammalian expression vectors Gene vol. 45, pp. 101 (1986).
Fredericks et al., Identification of potent human anti-IL-1RI antagonist antibodies, Protein Engineering, Design, & Selection vol. 17, pp. 95-106 (2004).
Friedewald et al., Estimation of the concentration of low-density lipoprotein cholesterol in plasma, without use of the preparative ultracentrifuge. Clin. Chem. vol. 18, pp. 499-502 (1972).
Furger et al., Comparison of recombinant human haptocorrin expressed in human embryonic kidney cells and native haptocorrin PloS one vol. 7, e37421 (2012).
Gallo et al., The human immunoglobulin loci introduced into mice: V (D) and J gene segment usage similar to that of adult humans European Journal of Immunology vol. 30, pp. 534-540 (2000).
Gentz et al., Bioassay for trans-activation using purified human immunodeficiency virus tat-encoded protein: Trans-activation requires mRNA synthesis Proc. Natl. Acad. Sci. USA vol. 86, pp. 821-824 (1989).
Gerhardt et al. Structure of IL-17A in complex with a potent, fully human neutralizing antibody, Journal of Molecular Biology vol. 394, pp. 905-921 (2009).
Gibskov et al, Profile analysis: Detection of distantly related proteins. Proc. Nat. Acad. Sci. vol. 84(13), pp. 4355-4358 (1987).
Gillies et al., Antibody-targeted interleukin 2 stimulates T-cell killing of autologous tumor cells, Proc. Natl. Acad. Sci. vol. 89, pp. 1428-1432 (1992).
Glasky et al., Stability of Specific Immunoglobulin Secretion by EBV-Transformed Lymphoblastoid Cells and Human-Murine Heterohybridomas, Hybridoma vol. 8, pp. 377-389 (1989).
Gluzman et al., SV40-Transformed Simian Cells Support the Replication of Early SV40 Mutants, Cell vol. 23, pp. 175 (1981).
Goeddel, Gene Expression Technology: Methods in Enzymology vol. 185, Academic Press, (1990).
Gold et al., Aptamer-based multiplexed proteomic technology for biomarker discovery, PLoS One 5, e15004, doi:10.1371/journal.pone.0015004 (2010).
Green et al., Antigen-specific human monoclonal antibodies from mice engineered with human Ig heavy and light chain YACs Nat Genet. vol. 7, pp. 13-21 (1994).
Green et al., Regulation of B Cell Development by Variable Gene Complexity in Mice Reconstituted with Human Immunoglobulin Yeast Artificial Chromosomes, Journal of Experimental Medicine vol. 188, pp. 483-495 (1998).
Green, Antibody engineering via genetic engineering of the mouse: XenoMouse strains are a vehicle for the facile generation of therapeutic human monoclonal antibodies, Journal of Immunological Methods vol. 231, pp. 11-23 (1999).
Greene et al., Protection for the hydroxyl group, including 1, 2- and 1,3-diols, Protective Groups in Organic Synthesis, 2d. Ed., John Wiley and Sons (1991).
Gretarsdottir et al., Genome-wide association study identifies a sequence variant within the DAB2IP gene conferring susceptibility to abdominal aortic aneurysm, Nature genetics vol. 42, pp. 692 (2010).
Gretarsdottir et al., the gene encoding phosphodiesterase 4D confers risk of ischemic stroke, Nature genetics vol. 35, pp. 131-138 (2003).
Grewal, The Ashwell—Morell Receptor, Methods in Enzymology vol. 479, chapter 13, pp. 223-241 (2010).
Gribskov et al., Profile Analysis, Meth. Enzym. vol. 183, pp. 146-159 (1990).
Gribskov et al., Sequence analysis primer, eds., M Stockton Press, (1991).
Griffin, et al., Computer analysis of sequence data, part I, eds., Humana Press, (1994).
Gu et al. The asialoglycoprotein receptor suppresses the metastasis of hepatocellular carcinoma via LASS2-mediated inhibition of V-ATPase activity, Cancer Letters, vol. 379, pp. 107-116, (2016).
Gudbartssoon et al., Large Scale whole-genome sequencing of the Icelandic population, Nature Genetics vol. 47(5), pp. 435-444 (2015).
Haddad et al., Evidence for a third genetic locus causing familial hypercholesterolemia. A non-LDLR, non-APOB kindred, Journal of lipid research vol. 40, pp. 1113-1122 (1999).
Hamajima et al. Intranasal Administration of HIV-DNA vaccine formulated with a polymer, carboxymethycellulose, augments mucosal antibody production and cell-mediated immune response, Clin. Immunol. Immunopathol. vol. 88(2), pp. 205-10 (1998).
Harding et al., "Class Switching in Human Immunoglobulin Transgenic Mice," Annals of the New York Academy of Sciences, vol. 764, pp. 536-546, 1995.
Hardonk al., A Histochemical Study about the zonal distribution of galactose-biding protein in rat liver, Histochemistry vol. 69(3), pp. 289-297 (1980).
Harlow and Lane, Antibodies: A Laboratory Manual, Cold Spring Laboratory Press (1988 and 1990).
Harris, Processing of C-terminal lysine and arginine residues of proteins isolated from mammalian cell culture Journal of Chromatography vol. 705, pp. 129-134 (1995).
Haubner et al. Glycosylated RGD-Containing Peptides: Tracer for Tumor Targeting and Angiogenesis Imaging with Improved Biokinetics, Jour. Nucl. Med. vol. 42, pp. 326-336 (2001).
Hollenbaugh et al., Construction of Immunoglobulin Fusion Proteins, Current Protocols in Immunology, Suppl. 4, pp. 10.19.1-10.19.11. (1992).
Hollinger and Hudson, Engineered antibody fragments and the rise of single domains, Nature Biotechnology vol. 23(9), pp. 1126-1136 (2005).
Hollinger et al. "Diabodies": Small bivalent and bispecific antibody fragments, Proc. Natl. Acad. Sci. USA vol. 90, pp. 6444-6448 (1993).
Holm et al., Protein folds and families: sequence and structure alignments, Nucl. Acid. Res. vol. 27(1), pp. 244-247 (1999).
Honegger and Pluckthun, Yet another numbering scheme for immunoglobulin variable domains: An automatic modeling and analysis tool, Journal of Molecular Biology vol. 309(3), pp. 657-670 (2001).
Hoogenboom et al., Human antibodies from synthetic repertories of germline $V_H$ Gene Segments Rearranged in vitro Journal of Molecular Biology vol. 227, pp. 381-388 (1992).
Hoogendoorn et al., Thyroid function and prevalence of anti-thyroperoxidase antibodies in a population with borderline sufficient iodine intake: influences of age and sex, Clinical chemistry vol. 52, pp. 104-111 (2006).
Hopp et al. A Short Polypeptide Marker Sequence useful for recombinant protein identification and purification, Bio/Technology vol. 6, pp. 1204 (1988).
Hoppe et al., A parallel three stranded α-helical bundle at the nucleation site of collagen triple-helix formation, FEBS Letters vol. 344, pp. 191 (1994).

(56) References Cited

OTHER PUBLICATIONS

Hudson et al., Sodium-coupled glycine uptake by Ehrlich ascites tumor cells results in an increase in cell volume and plasma membrane channel activities, Proc. Natl. Acad. Sci. USA vol. 85, pp. 5879-5883 (1988).
Hunt et al., Genetic localization to chromosome 1p32 of the third locus for familial hypercholesterolemia in a Utah kindred, Arterioscler Thromb Vasc Biol vol. 20, pp. 1089-1093 (2000).
Huse et al., Generation of a Large Combinatorial Library of the Immunoglobulin Repertoire in Phage Lambda, Science vol. 246, pp. 1275-1281 (1989).
Hwang et al., Use of human germline genes in a CDR homology-based approach to antibody humanization, Methods vol. 36(1), pp. 35-42 (2005).
International Preliminary Report on Patentability received in International Patent Application No. PCT/US2016/054222, dated Apr. 3, 2018.
International Search Report and Written Opinion received in International Patent Application No. PCT/US2016/054222, dated Mar. 10, 2017.
International Search Report and Written Opinion, dated Feb. 5, 2018, received in International Patent Application No. PCT/US2017/048757.
Jakobovits et al., Analysis of homozygousmutant chimeric mice: Deletion of the immunoglobulin heavy-chain joining region blocks B-cell development and antibody production, Proc. Natl. Acad. Sci. USA vol. 90, pp. 2551-2555 (1993).
Jakobovits et al., Germ-line transmission and expression of a human-derived yeast artificial chromosome, Nature vol. 362, pp. 255-258 (1993).
Jakobovits, A., The long-awaited magic bullets: therapeutic human monoclonal antibodies from transgenic mice, Exp. Opin. Invest. Drugs vol. 7, pp. 607-614 (1998).
Jakobovits, A., Production and Selection of antigen-specific fully human monoclonal antibodies from mice engineered with human Ig loci, Advanced Drug Delivery Reviews vol. 31, pp. 33-42 (1998).
Jakobovits, A., Humanizing the mouse genome, Curr. Biol. vol. 4, pp. 761-763 (1994).
Janssens et al. Generation of heavy-chain-only antibodies in mice, PNAS vol. 103, pp. 15130-15135; Harbour Biologics, Rotterdam, Netherlands 2006.
Jia et al., A novel method of Multiplexed Competitive Antibody Binning for the characterization of monoclonal antibodies, Journal of immunological Methods vol. 288, pp. 91-98 (2004).
Jones, D., Progress in protein structure prediction, Current Opinions on Structural Biology vol. 7(3), pp. 377-387 (1997).
Jorgensen et al., Loss-of-function mutations in APOC3 and risk of ischemic vascular disease, The New England journal of medicine vol. 371, pp. 32-41 (2014).
Kabat, E.A. et al., Sequences of Proteins of Immunological Interest, NIH, Bethesda, MD (1987 and 1991).
Kabat E.A. et al., Sequences of Proteins of Immunological Interest, NIH, Bethesda, MD (1991).
Kang et al., Linkage of recognition and replication functions by assembling combinatorial antibody Fab libraries along phase surfaces, Proc Natl. Acad Sci. USA vol. 88, pp. 363-366 (1991).
Kellerman et al., Antibody discovery: the use of transgenic mice to generate human monoclonal antibodies for therapeutics, Current Opinion in Biotechnology vol. 13, pp. 593-597 (2002).
Kenneth et al., Monoclonal Antibodies, Hybridomas: A New Dimension in Biological Analyses, Plenum Press (1980).
Kohgo, Y., et al., Production and Characterization of Specific Asialoglycoprotein Receptor Antibodies, HYBRIDOMA, vol. 12, No. 5, pp. 591-598, (1993).
Kirkland et al., Analysis of the Fine Specificity and Cross-Reactivity of Monoclonal Anti-lipid a Antibodies, Journal of Immunology vol. 137, pp. 3614-3619 (1986).
Kohler, Immunoglobulin chain loss in hybridoma lines, Proc. Natl. Acad. Sci. USA vol. 77, pp. 2197 (1980).
Korndorfer et al., Crystallographic Analysis of an "Anticalin" with Tailored Specificity for Fluorescein Reveals High Structural Plasticity of the Lipocalin Loop Region, Proteins: Structure, Function, and Bioinformatics vol. 53(1), pp. 121-129 (2003).
Kortt et al. Dimeric and trimeric antibodies: high avidity scFvs for cancer targeting, Biomol. Eng. vol. 18, pp. 95-108 (2001).
Kortt et al., Single-chain Fv fragments of anti-neuraminidase antibody NC10 containing five- and ten-residue linkers form dimers and with zero-residue linker a trimer, Protein Engineering vol. 10, pp. 423 (1997).
Kostelny et al., Formation of a Bispecific Antibody by the Use of Leucine Zippers, Journal of Immunology vol. 148, pp. 1547-1553 (1992).
Kriegler, M., Table of Contents of Gene Transfer and Expression, A Laboratory Manual, Stockton Press (1990).
Kriangkum et al., Bispecific and bifunctional single chain recombinant antibodies, Biomol. Eng. vol. 18, pp. 31-40 (2001).
Lam et al., A new type of synthetic peptide library for identifying ligand-binding activity, Nature vol. 354, pp. 82-84 (1991).
Landschulz et al., The Leucine Zipper: A Hypothetical Structural Common to a New Class of DNA Binding Proteins, Science vol. 240, pp. 1759 (1988).
Lanitto et al., Chain Shuffling to Modify Properties of Recombinant Immunoglobulins, Methods in Molecular Biology vol. 178, pp. 303-316 (2002).
Larock, Comprehensive Organic Transformations, VCH Publishers (1989).
Larrick et al., Polymerase Chain Reaction Using Mixed Primers: Cloning of Human Monoclonal Antibody Variable Region Genes from Single Hybridoma Cells, Bio/Technology vol. 7, pp. 934 (1989).
Larrick et al., Methods: A Companion to Methods in Enzymology vol. 2, pp. 106 (1991).
Lefranc et al., IMGT unique numbering for immunoglobulin and T cell receptor constant domains and Ig superfamily C-like domains, Dev. Comp. Immunol. vol. 29, pp. 185-203 (2005).
Lesk, Computational molecular biology, A. M., ed., Oxford University Press, (1988).
Lim et al., A diversity of antibody epitopes can induce signaling through the erythropoietin receptor, Biochemistry vol. 49, pp. 3797-3804 (2010).
Liu et al., Chimeric mouse-human IgG1 antibody that can mediate lysis of cancer cells, Proc. Nat. Acad. Sci. USA vol. 84, pp. 3439 (1987).
Lonberg et al., Human Antibodies from.Transgenic Mice, Internal Review of Immunology vol. 13, pp. 65-93 (1995).
Lonberg et al., Antigen-specific human antibodies from mice comprising four distinct genetic modifications, Nature vol. 368, pp. 856-859 (1994).
Lonberg, Transgenic Approaches to Human Monoclonal Antibodies in Handbook of Experimental Pharmacology vol. 113, pp. 49-101 (1994).
Low et al., Mimicking Somatic Hypermutation: Affinity Maturation of Antibodies Displayed on Bacteriophae Using a Bacterial Mutator Strain, Journal of Molecular Biology vol. 250, pp. 350-368 (1996).
Lowy et al., Isolation of Transforming DNA: Cloning the Hamster aprt Gene, Cell vol. 22, pp. 817 (1980).
Liu et al., A new splice variant of the major subunit of human asialogycoprotein receptor encodes a secreted form in hepatocytes PloS one, vol. 5, e12934 (2010).
Maniatis et al., Regulation of Inducible and Tissue-Specific Gene Expression, Science vol. 236, pp. 1237 (1987).
Manoharan, Oligonucleotide Conjugates in Antisense Technology, Antisense Drug Technology, ed. S. T. Crooke, Marcel Dekker, Inc. (2001).
Marks et al., By-passing Immunication: Building High Affinity Human Antibodies by Chain Shuffling, Bio/Technology vol. 10, pp. 779-783 (1992).
Massarelli et al., "Three-Dimensional Models of the Oligomeric Human Asialoglycoprotein Receptor (ASGP-R)", International Journal of Molecular Sciences, vol. 11, No. 10, pp. 3867-3884, 2010.
McCoy et al., Phaser crystallographic software, Journal of applied crystallography vol. 40, pp. 658-674 (2007).

(56) References Cited

OTHER PUBLICATIONS

McMahan et al., A novel IL-1 receptor, cloned from B cells by mammalian expression, is expressed in many cell types, EMBO J. vol. 10, pp. 2821 (1991).
Meier et al., Crystal structure of the carbohydrate recognition domain of the H1 subunit of the asialoglycoprotein receptor. Journal of molecular biology vol. 300, 857-865 (2000).
Mendez et al., Functional transplant of megabase human immunoglobulin loci recapitulates human antibody response in mice, Nat Gen. vol. 15, pp. 146-156 (1997).
Miller et al., Epitope binning of murine monoclonal antibodies by a multiplexed pairing assay, Journal of Immunological Methods vol. 365, pp. 118-125 (2011).
Moldenhauer et al., Identity of HML-1 Antigen on Intestinal Intraepithelial T Cells and B-1y7 Antigen on Hairy Cell Leukaemia, Scandinavian Journal of Immunology vol. 32, pp. 7-82 (1990).
Molecular Operating Environment (MOE), 08, Chemical Computing Group, Inc., (2013).
Morel et al., Monoclonal Antibodies to Bovine Serum Albumin: Affinity and Specificity Determinations, Molecular Immunology vol. 25, pp. 7-15 (1988).
Morell et al., The role of sialic acid in determining the survival of glycoproteins in the circulation, The Journal of biological chemistry vol. 246, pp. 1461-1467 (1971).
Morgan et al., Precise epitope mapping of malaria parasite inhibitory antibodies by TROSY NMR cross-saturation, Biochemistry vol. 44, pp. 518-523 (2005).
Moult, J., The current state of the art in protein structure prediction, Current Operations in Biotechnology vol. 7(4), pp. 422-427 (1996).
Mulligan et al., Selection for animal cells that express the *Escherichia coli* gene coding for xanthine-guanine phosphoribosyltransferase, Proc. Natl. Acad. Sci, USA vol. 78, pp. 2072 (1981).
Nanevicz et al., Mechanisms of Thrombin Receptor Agonist Specificity, Journal of Biological Chemistry vol. 270(37), pp. 21619-21625 (1995).
Naramura et al., Mechanisms of cellular cytotoxicity mediated by a recombinant antibody-IL2 fusion protein against human melanoma cells, Immunol. Lett. vol. 39, pp. 91-99 (1994).
Neuberger, Generating high-avidity human Mabs in mice, Nature Biotechnology vol. 14, pp. 826 (1996).
Nioi et al., Variant ASGR1 Associated with a Reduced Risk of Coronary Artery Disease, The New England journal of medicine vol. 374, pp. 2131-2141, doi:10.1056/NEJMoa1508419 (2016).
Nisonoff et al., Separation of Univalent Fragments from the Bivalent Rabbit Antibody Molecule by Reduction of Disulfide Bonds, Arch. Biochem. Biophys. vol. 89, pp. 230 (1960).
Nygren and Uhlen, Scaffolds for engineering novel binding sites in proteins, Current Opinion in Structural Biology vol. 7, pp. 463-469 (1997).
O'Hare et al., Transformation of mouse fibroblasts to methotrexate resistance by a recombinant plasmid expressing a prokaryotic dihydrofolate reductase, Proc. Natl. Acad. Sci. USA vol. 78, pp. 1527 (1981).
Olafsen et al., Characterization of engineered anti-p185-$^{HER-2}$ (scFv-$C_H3)_2$ antibody fragments (minibodies) for tumor targeting, Protein Eng Des Sel. vol. 17, pp. 315-323 (2004).
Olsen et al., N-terminal pro-brain natriuretic peptide, but not high sensitivity C-reactive protein, improves cardiovascular risk prediction in the general population, European heart journal vol. 28, pp. 1374-1381 (2007).
Padlan et al., Identification of specificity-determining residues in antibodies, FASEB J. vol. 9, pp. 133-139 (1995).
Paquette, ed., Encyclopedia of Reagents for Organic Synthesis, John Wiley and Sons (1995).
Paris et al. ASGR1 expressed by porcine enriched liver sinusoidal endothelial cells mediates human platelet phagocytosis in vitro, Xenotransplantation vol. 18, pp. 245-251, (2011).
Park et al, "Detection of Surface Asialoglycoprotein Receptor Expression in Hepatic and Extra-Hepatic Cells Using a Novel Monoclonal Aantibody," Biotechnology Letters, vol. 28, No. 14, pp. 1061-1069, 2006.
Patten et al., Applications of DNA shuffling to pharmaceuticals and vaccines, Current Opinions in Biotechnology vol. 8, pp. 724-733 (1997).
Paul, ed., Fundamental Immunology, 4$^{th}$ ed., Lippincott-Raven, Philadelphia (1999).
Paul, W., Fundamental Immunology Ch. 7, 2d ed., Raven Press, N.Y. (1989).
Poljak et al., Production and structure of diabodies, Structure vol. 2, pp. 1121-1123 (1994).
Porter, The Hydrolysis of Rabbit γ-Globulin and Antibodies with Crystalline Papain, Biochemistry Journal vol. 73, pp. 119 (1959).
Pouwels et al., Cloning Vectors: A Laboratory Manual, Elsevier (1985).
Powers et al., Expression of single-chain Fv-Fc fusions in *Pichia pastoris*, Journal of Immunological Methods vol. 251, pp. 123-135 (2001).
Proudfoot, Transcriptional interference and termination between duplicated α-globin gene constructs suggests a novel mechanism for gene regulation, Nature vol. 322, pp. 52 (1986).
Rajeev et al., Hepatocyte-Specific Delivery of siRNAs Conjugated to Novel Non-nucleosidic Trivalent N-Acetylgalactosamine Elicits Robust Gene Silencing in Vivo, ChemBiochem vol. 16(6), pp. 903-908 (2015).
Rasmussen et al., Isolation, characterization and recombinant protein expression in Veggie-CHO: A serum-free CHO host cell line, Cytotechnology vol. 28, pp. 31 (1998).
Rathanaswami et al., High-affinity binding measurements of antibodies to cell-surface-expressed antigens, Analytical Biochemistry vol. 373, pp. 52-60 (2008).
Riechmann et al., Reshaping human antibodies for therapy, Nature vol. 332, pp. 323 (1988).
Roggenbuck et al., Asialoglycoprotein receptor (ASGPR): a peculiar target of liver-specific autoimmunity, Autoimmune Highlights vol. 3, pp. 119-125 (2012).
Roque et al., Antibodies and Genetically Engineered Related Molecules: Production and Purification, Biotechnology Progress vol. 20, pp. 639-654 (2004).
Rotundo et al., Circulating Cellular Fibronectin May be a Natural Ligand for the Hepatic Asialoglycoprotein Receptor: Possible Pathway for Fibronectin Deposition and Turnover in the Rat Liver, Hepatology vol. 28, pp. 475-485 (1998).
Russel et al., Production of Protective Human Antipneumococcal Antibodies by Transgenic Mice with Human Immunoglobulin Loci, Infect Immun. vol. 68, pp. 1820-1826 (2000).
Sabrautzki et al., "New Mouse Models for Metabolic Bone Disease Generated by ENU Mutagenesis Genome-Wide ENU Mutagenesis," Mammalian Genome, vol. 23, pp. 416-430, 2012.
Saitou and Nei, The Neighbor-joining Method: A New Method for Reconstructing Phylogenetic Trees Molecular Biology and Evolution vol. 4, pp. 406-425 (1987).
Samani et al., Genomewide association analysis of coronary artery disease, The New England journal of medicine vol. 357, pp. 443-453 (2007).
Sambrook et al., Molecular Cloning: A Laboratory Manual, 2d ed., Cold Spring Harbor Laboratory Press. (1989).
Santerre et al., Expression of prokaryotic genes for hygromycin B and G418 resistance as dominant-selection markers in mouse L cells, Gene vol. 30, pp. 147 (1984).
Sastry et al., Cloning of the immunological repertoire in *Escherichia coli* for generation of monoclonal catalytic antibodies: Construction of a heavy chain variable region-specific cDNA library, Proc. Natl. Acad. Sci. USA vol. 86, pp. 5728-5732 (1989).
Schier et al., Isolation of Picomolar Affinity Anti-c-erbB-2 Single-chain Fv by Molecular Evolution of the Complementarity Determining Regions in the Center of the Antibody Binding Site, Journal of Molecular Biology vol. 263, pp. 551 (1996).
Scholtens et al., A histochemical study on the distribution of injected canine intestinal alkaline phosphatase in rat liver, Liver vol. 2(1), pp. 14-21 (1982).

(56) References Cited

OTHER PUBLICATIONS

Sclebusch et al., Production of a Single-Chain Fragment of the Murine Anti-Idiotypic Antibody ACA125 as Phage-Displayed and Soluble Antibody by Recombinant Phage Antibody Technique, Hybridoma vol. 16, pp. 47-52 (1997).
Sham et al., Statistical power and significance testing in large-scale genetic studies, Nature reviews, Genetics vol. 15, 335-346, doi:10.1038/nrg3706 (2014).
Shimada, M. A monoclonal antibody to rat asialoglycoprotein receptor that recognizes an epitope specific to its major subunit, Hepatology Research, vol. 26, No. 1, pp. 55-60, (2003).
Simeoni et al., Insight into the mechanism of the peptide-based gene delivery system MPG: implications for delivery of siRNA into mammalian cells, Nucl. Acids Res. vol. 31, pp. 2717-2724 (2003).
Sippl et al., Threading thrills and threats, Structure vol. 4(1), pp. 15-19 (1996).
Smith et al., Genetic Engineering: Principles and Methods, Plenum Press (1981).
Smith, Biocomputing: informatics and genome projects, ed., Academic Press, (1993).
Song et al., Epitope Mapping of Ibalizumab, a Humanized Anti-CD4 Monoclonal Antibody with Anti-HIV-1 Activity in Infected Patients, Journal of Virology vol. 84, pp. 6935-6942 (2010).
Songsivilai and Lachmann, Bispecific antibody: a tool for diagnosis and treatment of disease, Clinical Experimental Immunology vol. 79, pp. 315-321 (1990).
Stahli et al., Distinction of Epitopes by Monoclonal Antibodies, Methods in Enzymology vol. 9, pp. 242-253 (1983).
Stefanescu, R. et al., Epitope Structure of the Carbohydrate Recognition Domain of Asialoglycoprotein Receptor to a Monoclonal Antibody Revealed by High-Resolution Proteolytic Excision Mass Spectrometry, Journal of the American Society for Mass Spectrometry, vol. 22, No. 1, pp. 148-157, 2011.
Steinthorsdottir et al., Identification of low-frequency and rare sequence variants associated with elevated or reduced risk of type 2 diabetes. Nature genetics vol. 46, pp. 294-298 (2014).
Steirer et al., The asialoglycoprotein receptor regulates levels of plasma glycoproteins terminating with sialic acid alpha2,6-galactose., The Journal of Biological Chemistry vol. 284, pp. 3777-3783 (2009).
Stocked et al., IgA interaction with asialoglycoprotein receptor, PNAS vol. 79, pp. 6229-6231 (1982).
Stocked et al., Hepatic Binding Protein: The Protective Role of its Sialic Acid Residues, Science vol. 197, pp. 667-668 (1977).
Subbarao et al., pH-Dependent Bilayer Destabilization by an Amphipathic Peptide, Biochemistry vol. 26, pp. 2964-2972 (1987).
Szybalska & Szybalski, Genetics of Human Cell Lines, IV. DNA-Mediated Heritable Transformation of a Biochemical Trait, Proc. Natl. Acad. Sci. USA vol. 48, pp. 202 (1992).
Tamura et al., "Structural Correlates of an Anticarcinoma Antibody: Identification of Specificity-Determining Residues (SDRs) and Development of a Minimally Immunogenic Antibody Variant by Retention of SDRs Only," The Journal of Immunology, vol. 164, No. 3, pp. 1432-1441, 2000.
Taylor et al., Human immunoglobuline transgenes undergo rearrangement, somatic mutation and class switching in mice that lack endogenous IgM, International Immunology vol. 6, pp. 579-591 (1994).
Taylor et al., A transgenic mouse that expresses a diversity of human sequence heavy and light chain immunoglobulins, Nucleic Acid Research vol. 20, pp. 6287-6295 (1992).
Thompson et al, CLUSTAL W: improving the sensitivity of progressive multiple sequence alignment through sequence weighting, position-specific gap penalties and weight matrix choice, Nucleic Acids Res. vol. 22, pp. 4673-4680 (1994).
Thompson et al., Affinity Maturation of a High-Affinity Human Monoclonal Antibody Against the Third Hypervariable Loop of Human Immunodeficiency Virus: Use of Phase Display to Improve Affinity and Broaden Strain Reactivity, Journal of Molecular Biology vol. 256, pp. 7-88 (1996).
Thornton et al., Prediction of progress at last, Nature vol. 354, pp. 105 (1991).
Timms KM, Wagner S, Samuels ME, et al. A mutation in PCSK9 causing autosomal-dominant hypercholesterolemia in a Utah pedigree. Human genetics vol. 114, pp. 349-353 (2004).
Tomizuka et al,, Functional expression and germline transmission of a human chromosome fragment in chimaeric mice, Nature Genetics vol. 16, pp. 133-143 (1997).
Tomizuka et al., Double trans-chromosomic mice: Maintenance of two individual human chromosome fragments containing Ig heavy and κ loci and expression of fully human antibodies, Proceedings of the National Academy of Sciences USA vol. 97, pp. 722-727 (2000).
Tozawa et al., Asialoglycoprotein receptor deficiency in mice lacking the major receptor subunit. It's obligate requirement for the stable expression of oligomeric receptor, The Journal of Biological Chemistry vol. 276, pp. 12624-12628 (2001).
Trahtenherts et al., "An Internalizing Antibody Specific for the Human Asialoglycoprotein Receptor", Hybridoma, vol. 28, No. 4, pp. 225-233, Nov. 4, 2009.
Trufert et al., Synthesis, Purification and Characterization of Two Peptide-Oligonucleotide Conjugates as Potential Artificial Nucleases, Tetrahedron vol. 52, pp. 3005 (1996).
Tsuda et al., Inactivation of the Mouse HPR Locus by a 203-bp Retroposon Insertion and a 55-kb Gene-Targeted Deletion: Establishment of New HPRT-Deficient Mouse Embryonic Stem Cell Lines, Genomics vol. 42, pp. 413-421 (1997).
Tuaillon et al., Biased Utilization of $D_{HQ52}$ and $J_H4$ Gene Segments in a Human Ig Transgenic Minilocus is Independent of Antigenic Selection, Journal of Immunology vol. 152, pp. 2912-2920 (1994).
Tuaillon et al., Human immunoglobulin heavy-chain minilocus recombination in transgenic mice: Gene-segment use in and γ transcripts, Proceedings of the National Academy of Sciences USA vol. 90, pp. 3720-3724 (1993).
Tuin et al., On the role and fate of LPS-dephosphorylating activity in the rat liver, American Journal of Physiology Gastrointestinal and Liver Physiology vol. 290, pp. 377-385 (2006).
Turk et al., Characterization of a novel pH-sensitive peptide that enhances drug release from folate-targeted liposomes at endosomal pHs, Biochem, Biophys. Acta, vol. 1559, pp. 56-68 (2002).
Urlaub et al., Isolation of Chinese hamster cell mutants deficient in dihydrofolate reductase activity, Proc. Natl. Acad. Sci. USA vol. 77, pp. 4216-4220 (1980).
Van Den Hamer et al., Physical and chemical studies on ceruloplasmin. IX. The role of galactosyl residues in the clearance of ceruloplasmin from the circulation, The Journal of biological chemistry vol. 245, pp. 4397-4402 (1970).
Verret et al., A third major locus for autosomal dominant hypercholesterolemia maps to 1p34.1-p32, American journal of human genetics vol. 64, pp. 1378-1387 (1999).
Vaughan et al., Human antibodies by design, Nature Biotechnology vol. 16, pp. 535-539 (1998).
Vogel et al., Peptide-Mediated Release of Folate-Targeted Liposome Contents from Endosomal Compartments, J. Am. Chem. Soc. vol. 118, pp. 1581-1586 (1996).
von Heinje, Sequence analysis in molecular biology, Academic Press, (1987).
Voss et al., The role of enhancers in the regulation of cell-type-specific transcriptional control, Trends Biochem. Sci, vol. 11, pp. 287 (1986).
Welder et al., Oligodeoxynucleotide-directed mutagenesis using the yeast transformation system, Gene vol. 42, pp. 133 (1986).
Ward et al., Binding activities of a repertoire of single immunoglobulin variable domains secreted from Escherichia coli Nature vol. 341, pp. 544-546 (1989).
Wang et al., "Screening of Specific Single-Chain Variable-Fragment (scFv) Antibody Against Human Asialoglycoprotein Receptor by Capture Phage Enzyme-Linked Immunosorbent Assay," African Journal of Biotechnology, pp. 1919-1925, 2011.
Ward, E. et al, Chapter 3, Genetic Manipulation and Expression of Antibodies, Monoclonal Antibodies: Principles and Applications, Birch et al., (eds.), pp. 137-185, Wiley-Liss, Inc. (1995).

(56) References Cited

OTHER PUBLICATIONS

Wei et al., Lactoferrin-modified PEGylated liposomes loaded with doxorubicin for targeting delivery to hepatocellular carcinoma, International Journal of Nanomedicine vol. 10, pp. 5123-5137 (2015).
Weigel et al., Galactosyl and N-acetylgalactosaminyl homeostasis: a function for mammalian asialoglycoprotein receptors, BioEssays: news and reviews in molecular, cellular and developmental biology vol. 16, pp. 519-524 (1994).
Weigel et al., Glycans as endocytosis signals: the cases of the asiaglycoprotein and hyaluronan/chondroitin sulfate receptors, Biochimica et biophysica acta vol. 1572, pp. 341-363 (2002).
Wigler et al., Transfer of Purified Herpes Virus Thymidine Kinase Gene to Cultured Mouse Cells, Cell vol. 11, pp. 223 (1977).
Wigler et al., "Transformation of Mammalian Cells with an Amplifiable Dominant-Acting Gene," Proceedings of the National Academy of Sciences USA, vol. 77, No. 6, pp. 3567-3570, Jun. 1980.
Willer et al., Discovery and refinement of loci associated with lipid levels, Nature genetics vol. 45, pp. 1274-1283 (2013).
Willer et al., METAL: fast and efficient meta-analysis of genome wide association scans, Bioinformatics vol. 26, pp. 2190-2191 (2010).
Wilson et al. The Structure of a Antigenic Determinant in a Protein, Cell vol. 37, pp. 767 (1984).
Windier et al., The human asialoglycoprotein receptor is a possible binding site for low-density lipoproteins and chylomicron remnants, Biochem J vol. 276, pp. 79-87 (1991).
Winter et al., Making Antibodies by Phase Display Technology, Annu. Rev. Immunol, vol. 12, pp. 433-455 (1994).
Winter et al., Humanized antibodies, TIPS vol. 14, pp. 139 (1993).
Wu et al., Delivery systems for gene therapy, Biotherapy vol. 3, pp. 87-95 (1991).
Yamamato, T et al,, Serial incorporation of a monovalent GalNAc phosphoramidite unit into hepatocyte-targeting antisense oligonucleotides, Bioorganic & Medicinal Chemistry, vol. 24, pp. 26-32, (2016).
Yang et al., Hypomorphic sialidase expression decreases serum cholesterol by downregulation of VLDL production in mice, Journal of Lipid Research vol. 53, pp. 2573-2585 (2012).
Yang et al., CDR Walking Mutagenesis for the Affinity Maturation of a Potent Human Anti-HIV-1 Antibody into the Picomolar Range, Journal of Molecular Biology vol. 254, pp. 392-403 (1995).
Yang, et al. Kukoamine B promotes TLR4-independent lipopolysaccharide uptake in murine hepatocytes, Oncotarget, vol. 7, No. 36, pp. 57948-57510, (2016).
Yang et al. Antisense oligonucleotides targeted against asialoglycoprotein receptor 1 block human hepatitis B virus replication, Journal of Viral Hepatitis, vol. 13, pp. 158-165, (2006).
Zapata et al., Engineering linear F(ab')2 fragments for efficient production in *Escherichia coli* and enhanced antiproliferative activity, Protein Eng. vol. 8, pp. 1057-1062 (1995).
Zeng et al., "A Specific Antibody to the Carbohydrate Recognition Domain of the Asialoglycoprotein Receptor RHL1 Subunit Does Not React with RHL2/3 But Blocks Ligand Binding," Biochemical and Biophysical Research Communications, vol. 249, No. 1, pp. 236-240, 1998.
Zhang et al., Humanization of an anti-human TNF-α antibody by variable region resurfacing with the aid of molecular modeling, Molecular Immunology vol. 42(12), pp. 1445-1451 (2005).
Zupnick et al., Mutational Analysis of the p53 Core Domain L1 Loop, Journal of Biological Chemistry vol. 281(29), pp. 20464-20473 (2006).
EPO Communication under Rule 164(2)(a) EPC dated Dec. 6, 2019 in European Application No. 16 781 931.7.
Abin754108: "Asialoglycoprotein Receptor 1 antibody (ASGR1) (AA 250-290)" in: Asialoglycoprotein Receptor 1 antibody (ASGR1) (AA 250-290). This may be a reference to a website: https://www.antibodies-online.com/antibody/754108/anti-Asialoglycoprotein+Receptor+1+ASGR1+AA+250-290+antibody/;anitbodies-online.com; Product information for ABIN754108. It is not clear from the source of the reference (the ISR and EPO communication). No date of publication is immediately apparent in the document. It may be that this reference was cited in a Communication under Rule 164(2)(a) EPC ("Communication") issued by the European Patent Office with regard to European Application No. 16781931.7, which is a counterpart application of the instant U.S. Application. The Communication listed a date for a reference noting this "abin#" of "Jan. 1, 2014 (Jan. 1, 2014)"; however, no copy of this reference is available to the Applicant, and Applicant cannot verify the listed date or that this is actually the reference in question. The copy of the webpage provided herewith has a printed on date of Feb. 26, 2020. Exhibits A—1/2 from Response to Office Action, filed Feb. 27, 2020 in U.S. Appl. No. 16/230,356.
Office Action dated Jun. 24, 2020 in European Application No. 16 781 931.7.
Wittrup et al., "Knocking down disease: a progress report on siRNA therapeutics", Nature Reviews, Genetics, vol. 16, Sep. 2015, pp. 543-552.
Schwartz, A. L., et al., Antibody-Induced Receptor Loss, The Journal of Biological Chemistry, vol. 261, No. 32, Issue of Nov. 15, pp. 15225-15232, 1986.
Office Action received in Japanese Application No. 2018-515951, Dated Oct. 27, 2020.

\* cited by examiner

Figure 1A

ASGR1 Full Seq Multiple Sequence Alignment

Figure 1B

Human ASGR1 Sequence Alignment

ASGR2 Full Seq Multiple Sequence Alignment

Figure 2

Human ASGR1 vs Human ASGR2v2 Alignment

Figure 5
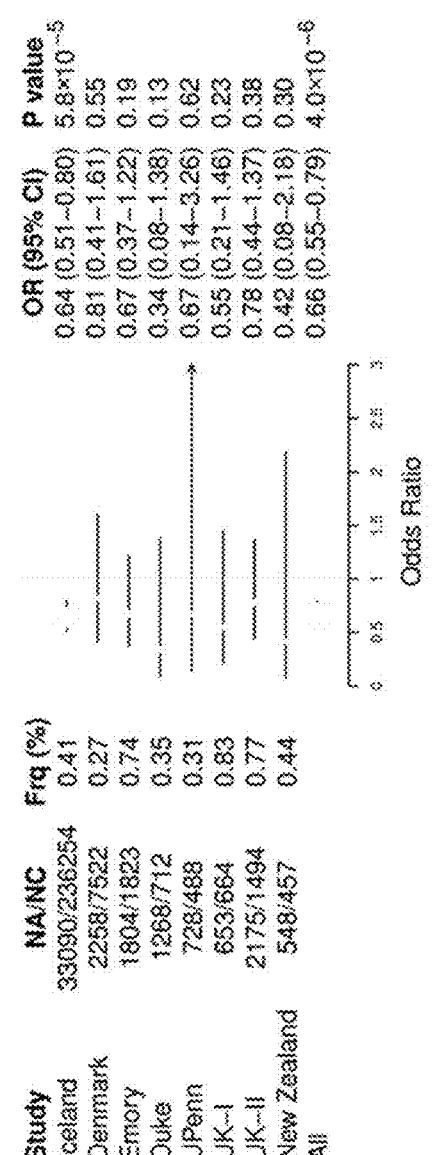
A.
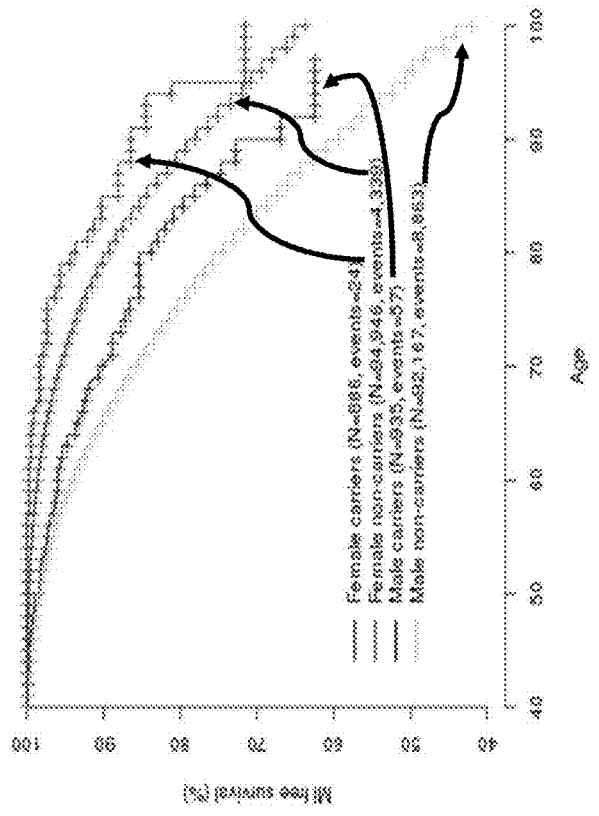
B.

Figure 8
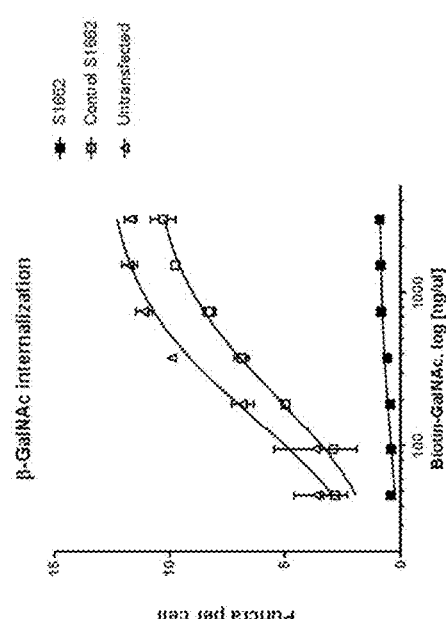
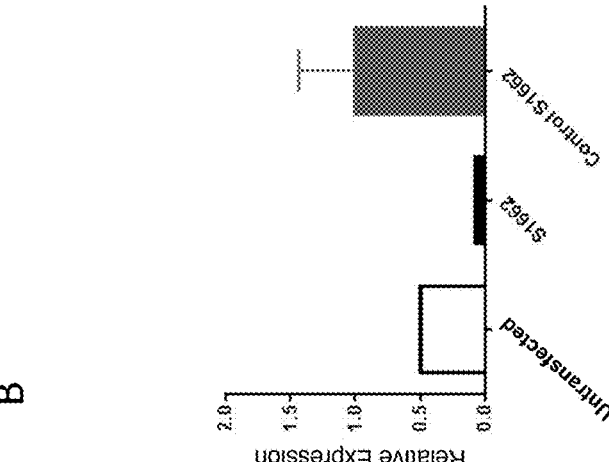

Figure 9
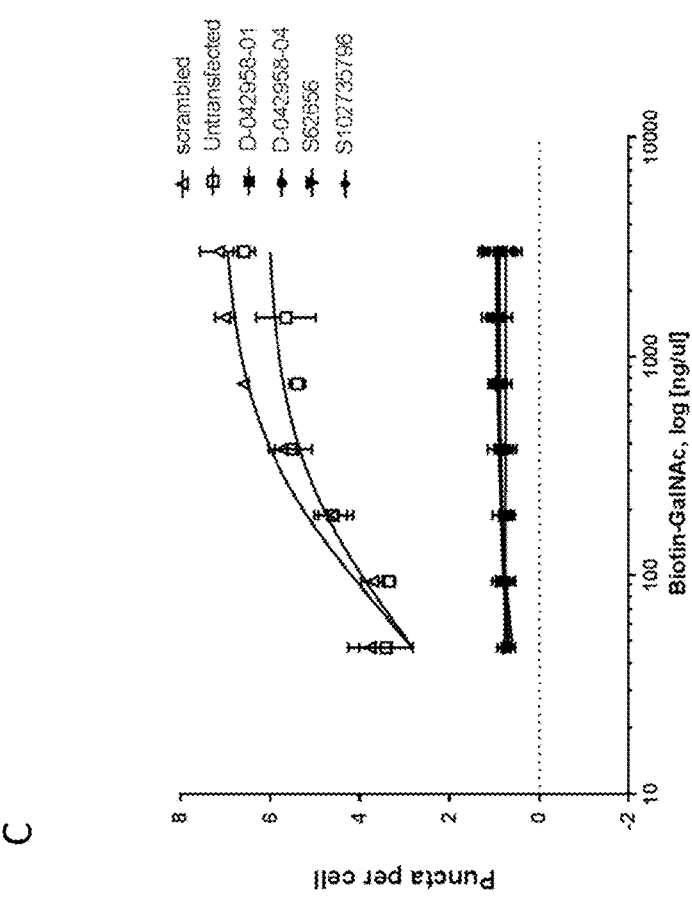
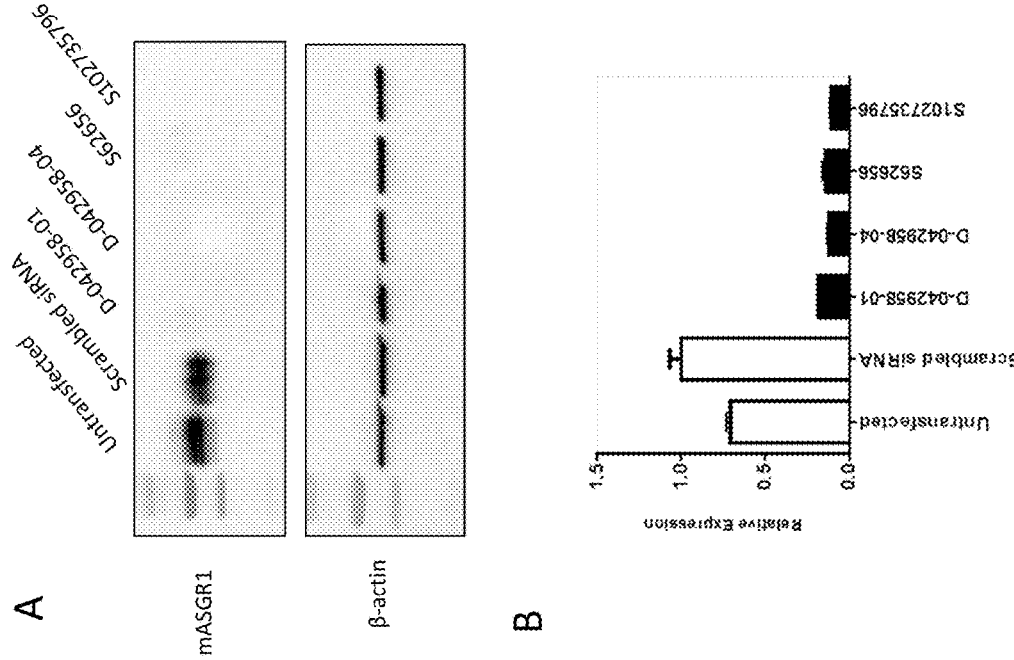

Figure 10
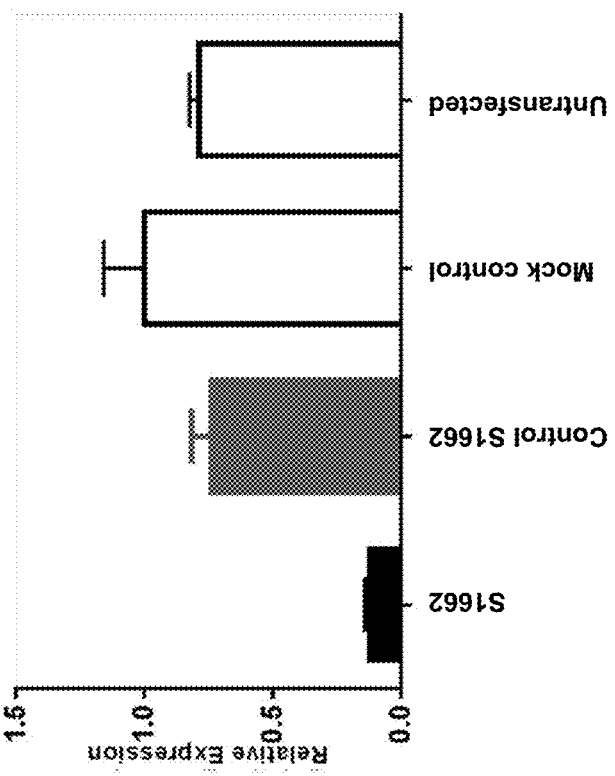
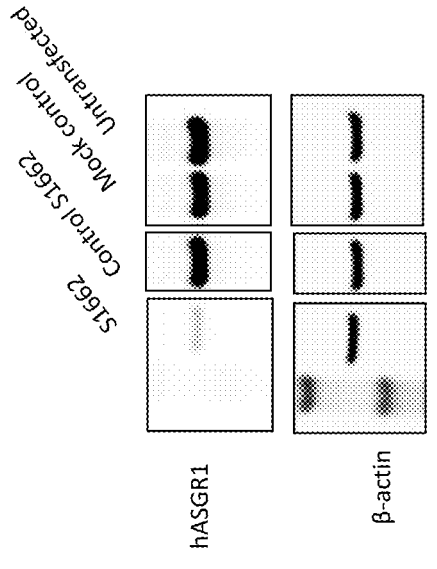

Figure 11
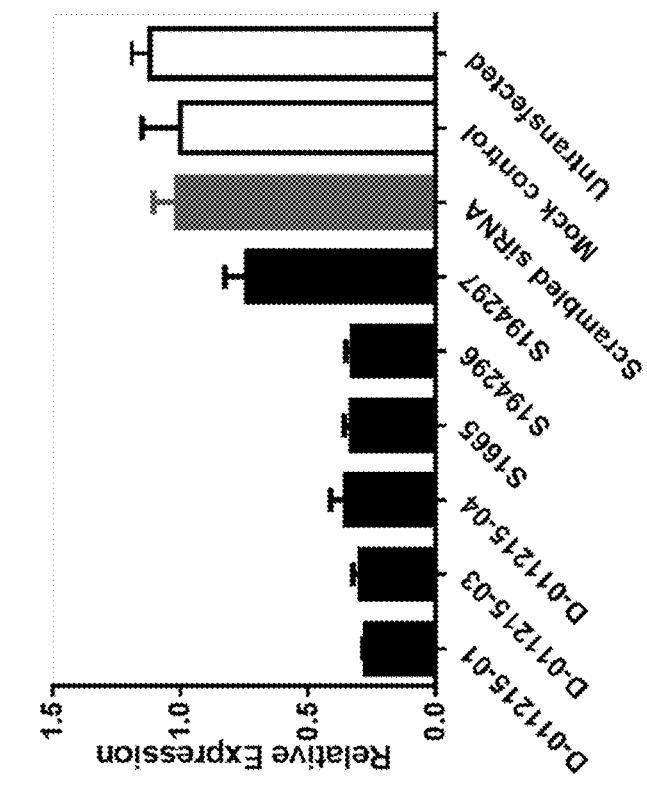
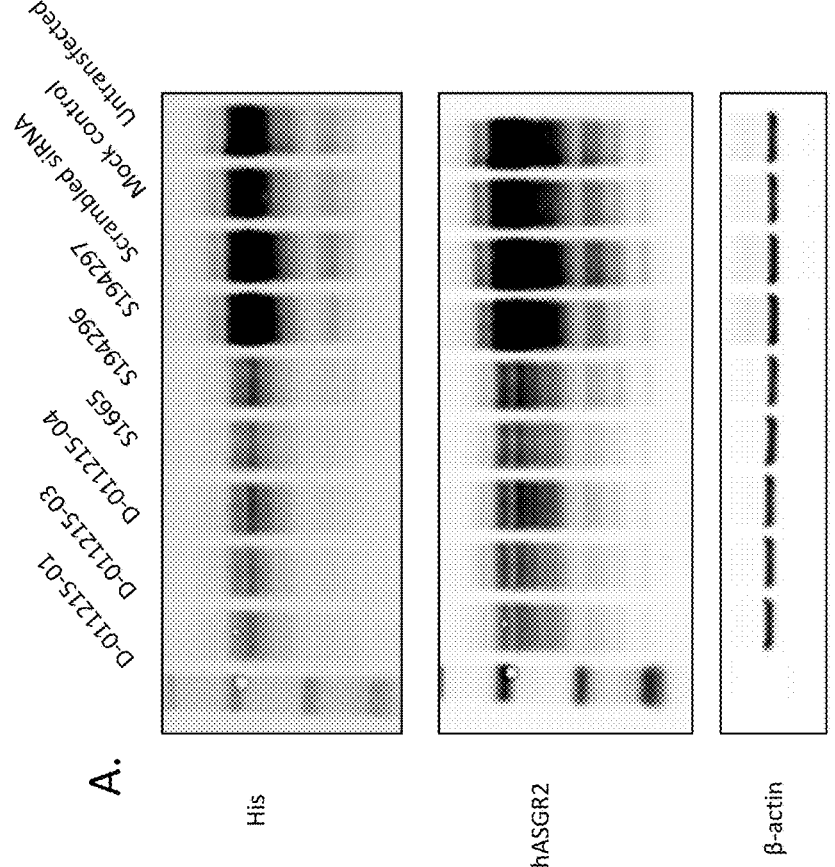

Figure 12
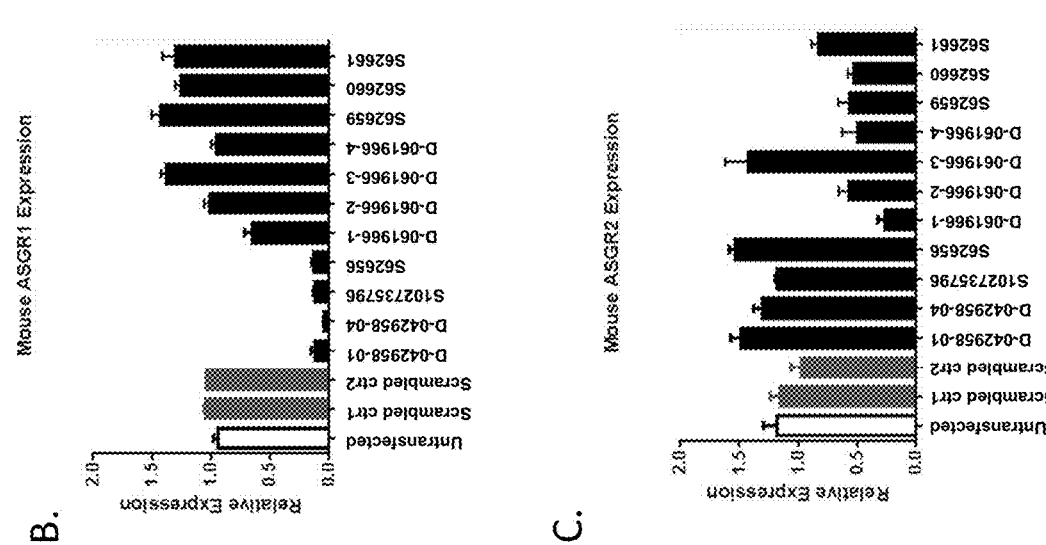
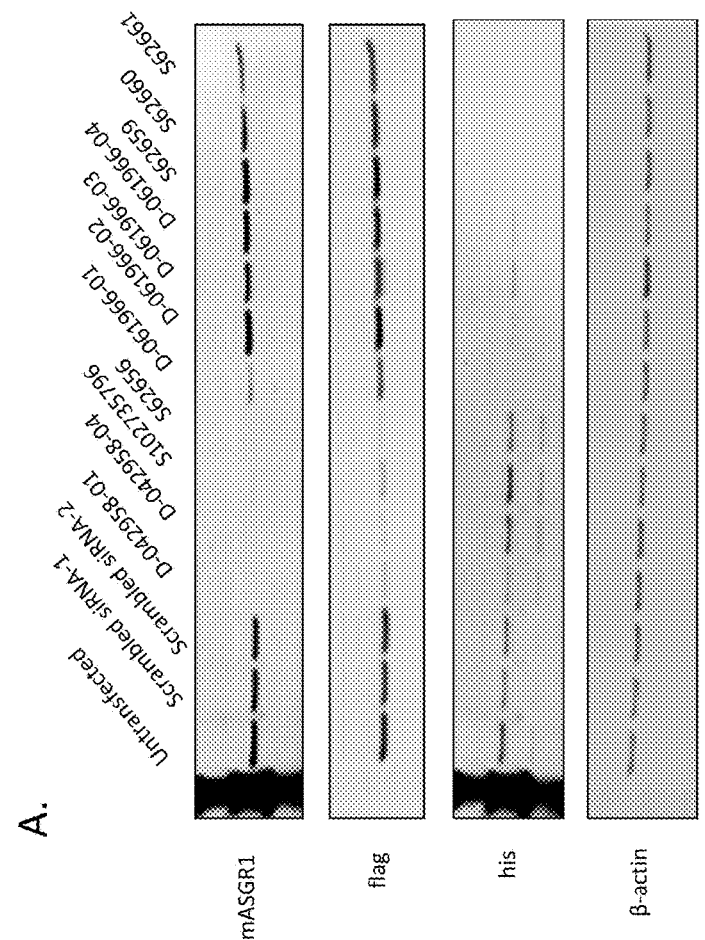

Figure 13
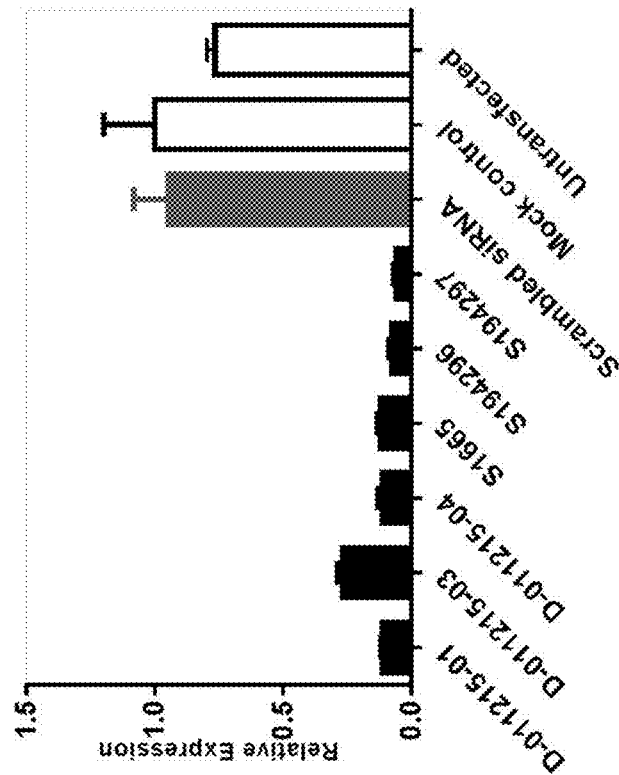
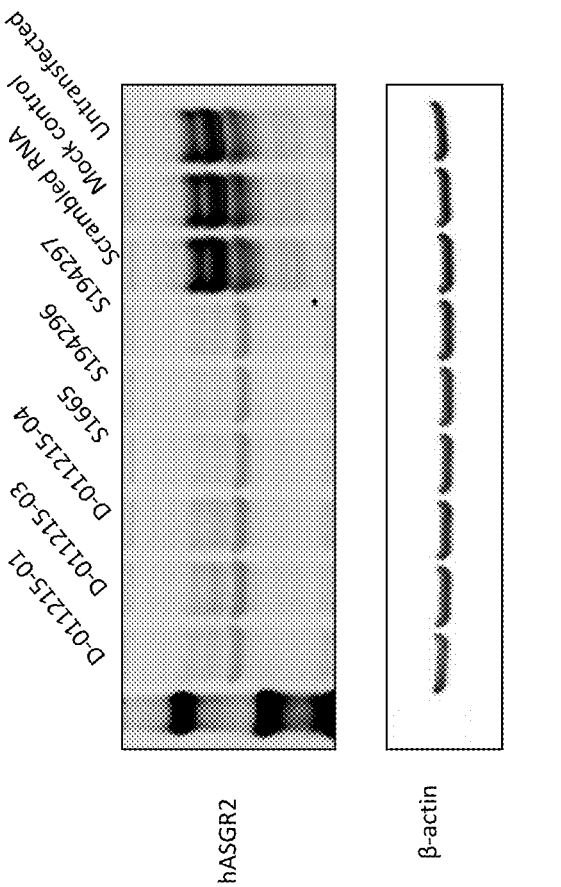

Figure 14
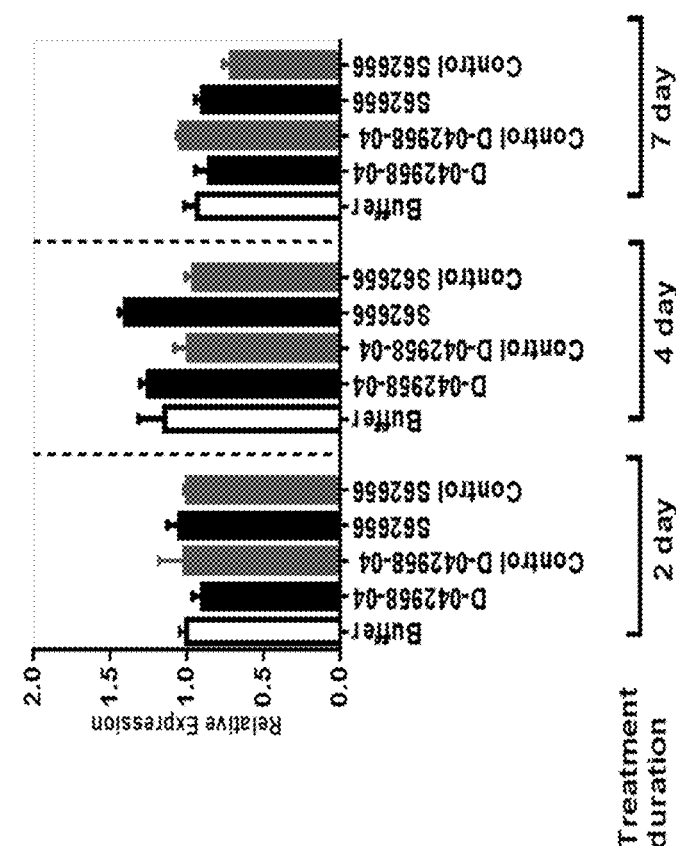
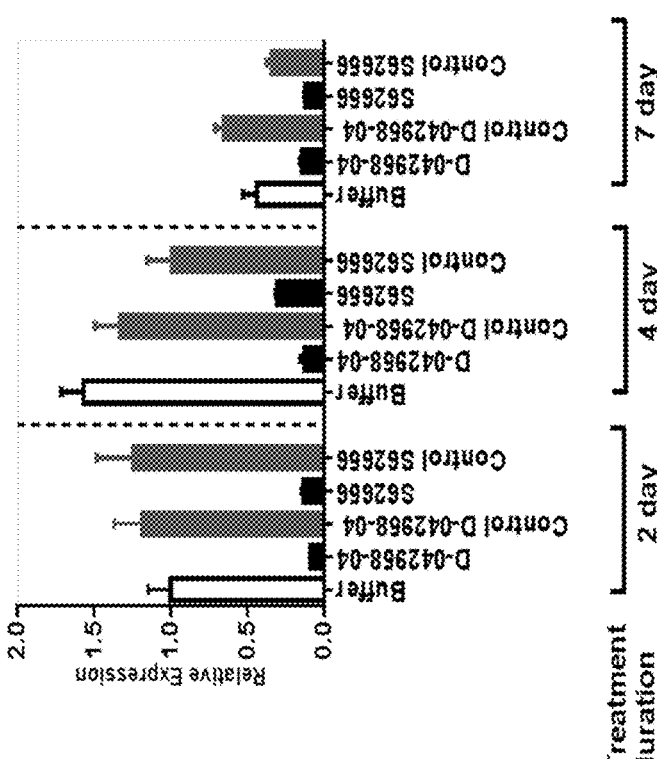

Figure 15
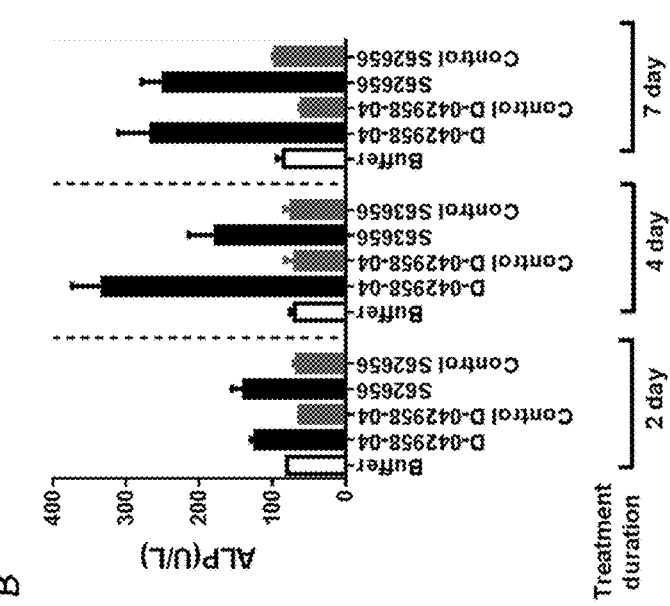
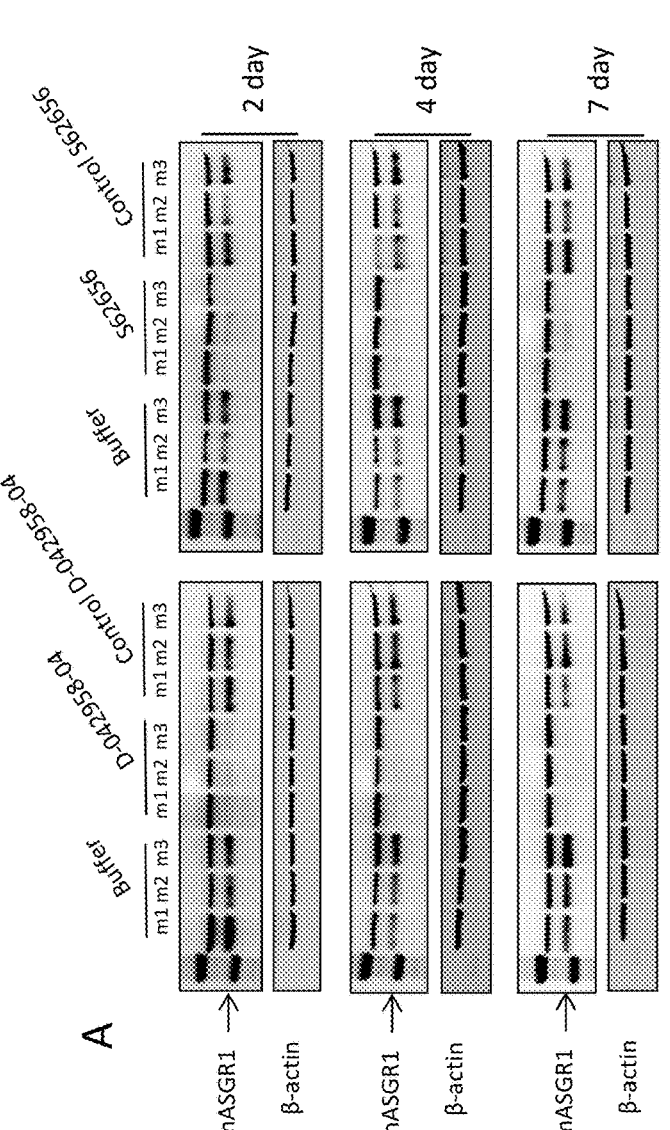

Figure 16
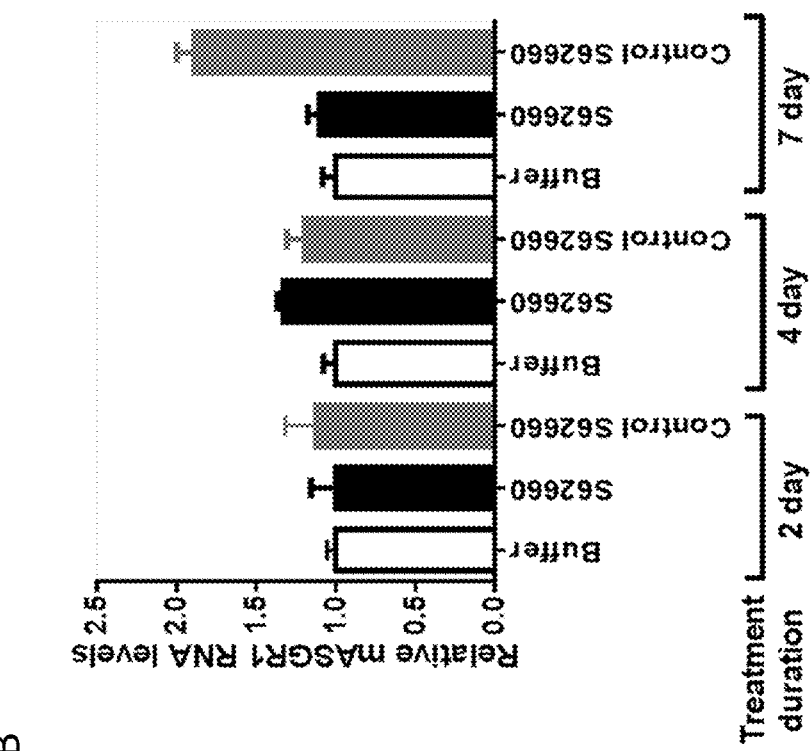
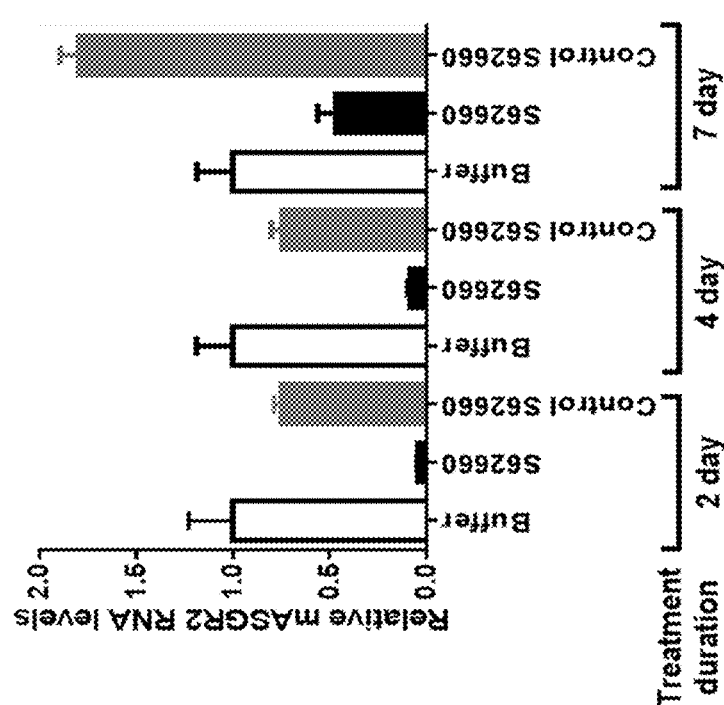

Figure 18
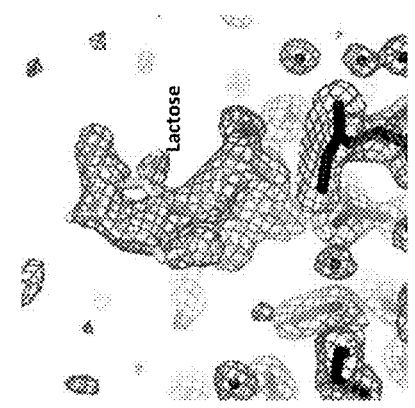
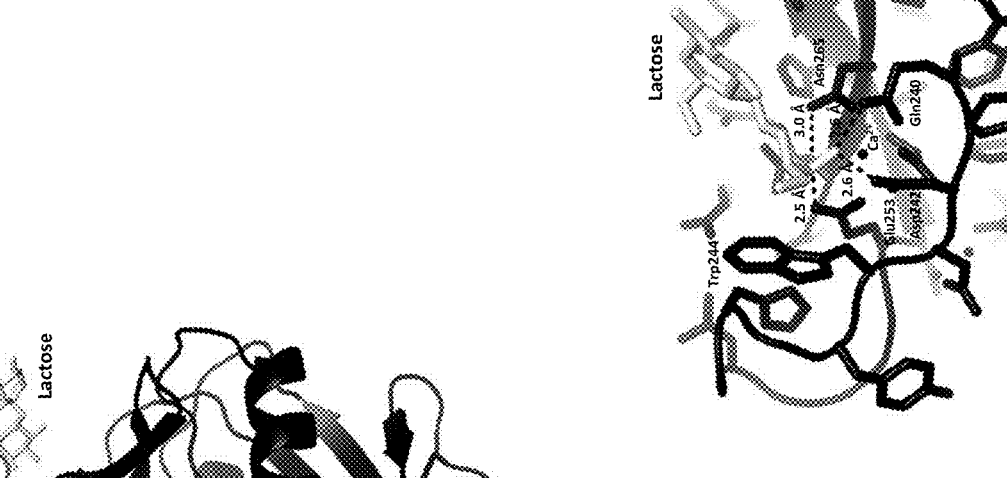

Figure 19
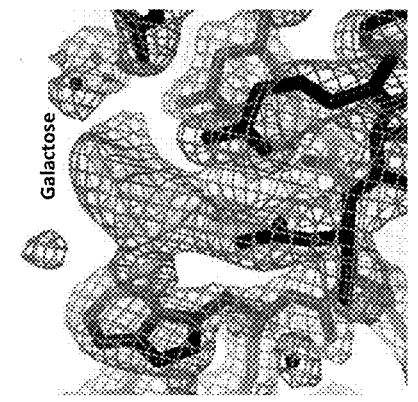
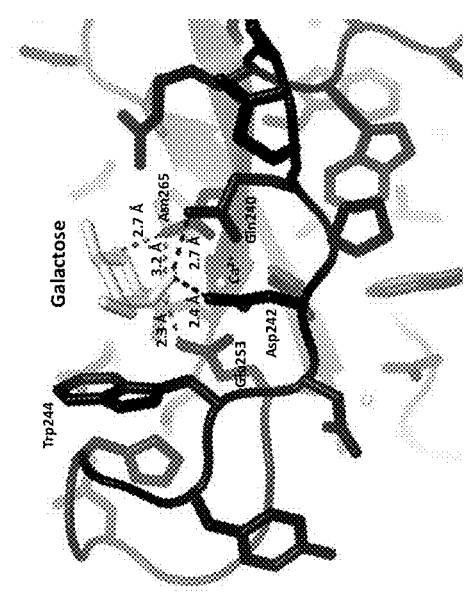
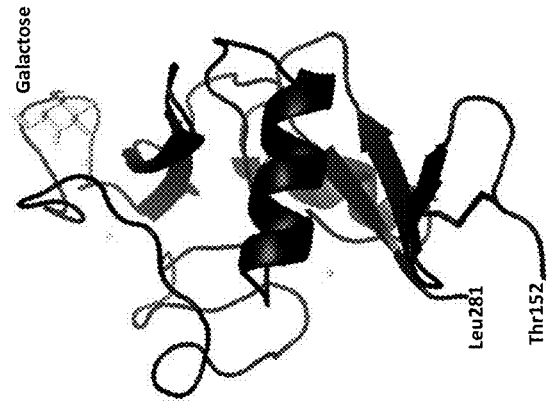

Figure 21
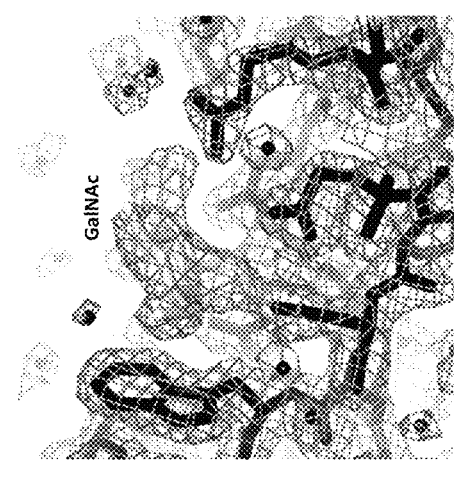
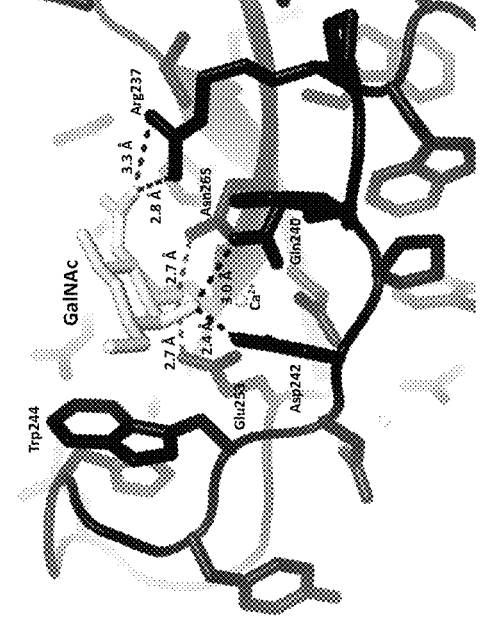

Figure 22
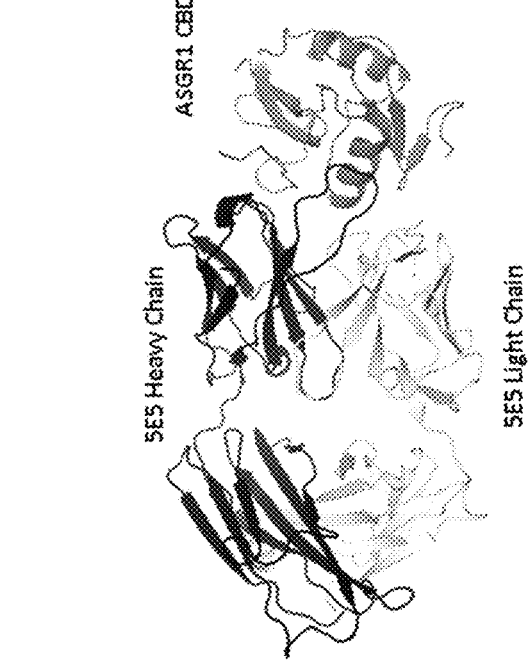
A
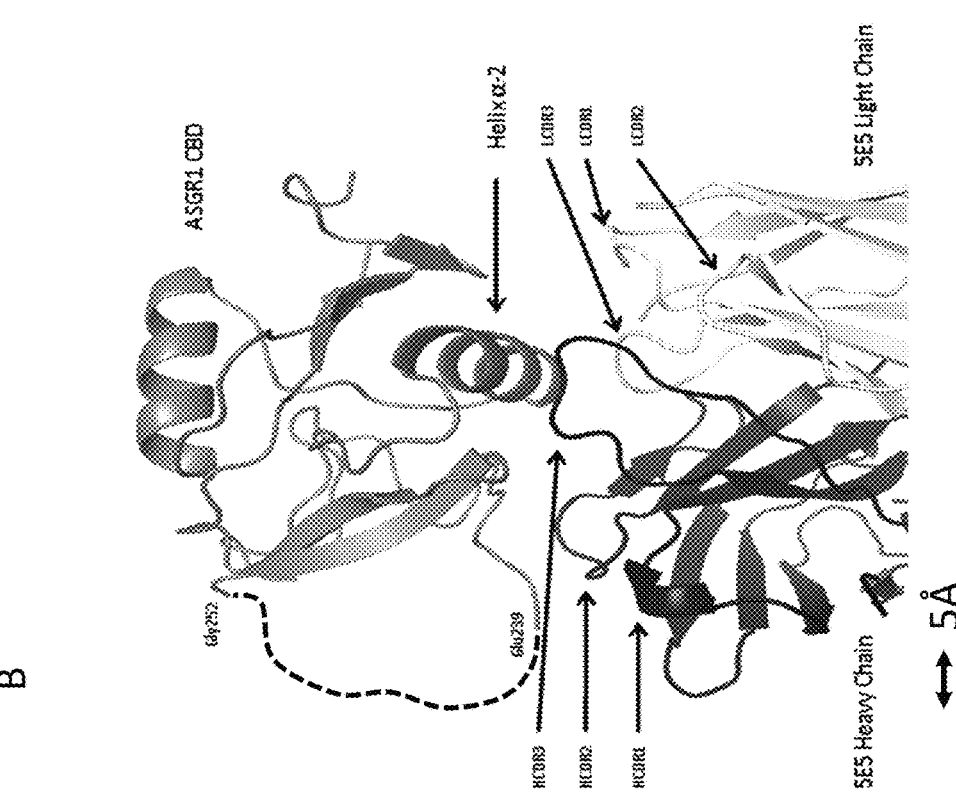
B

Figure 35
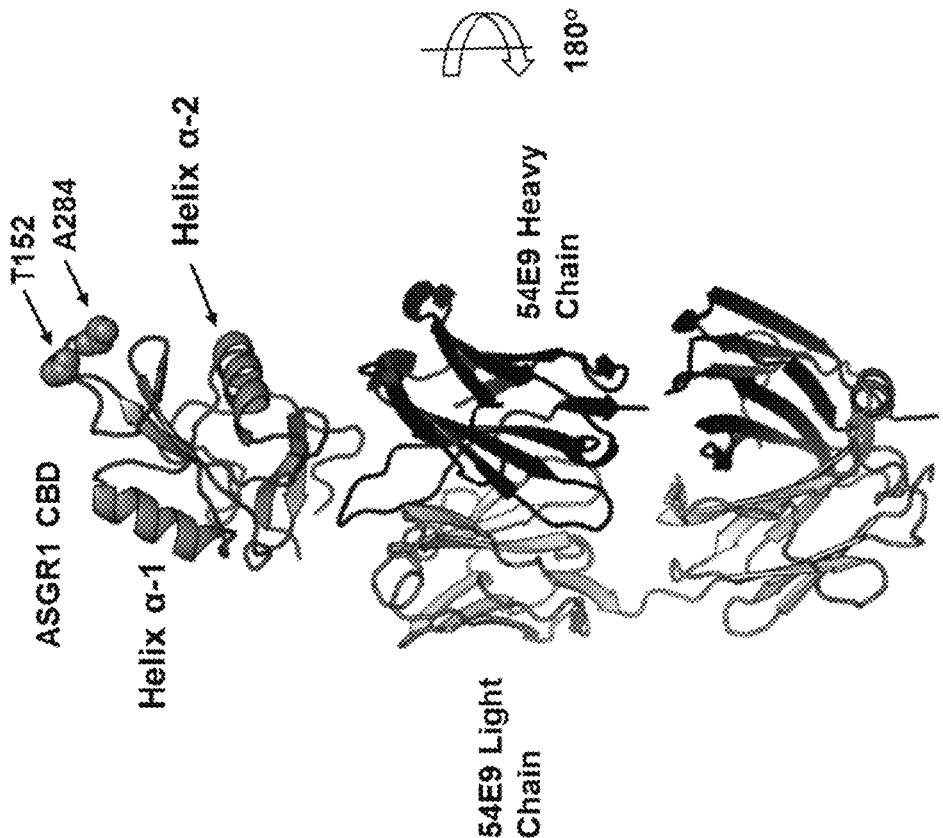

Figure 37
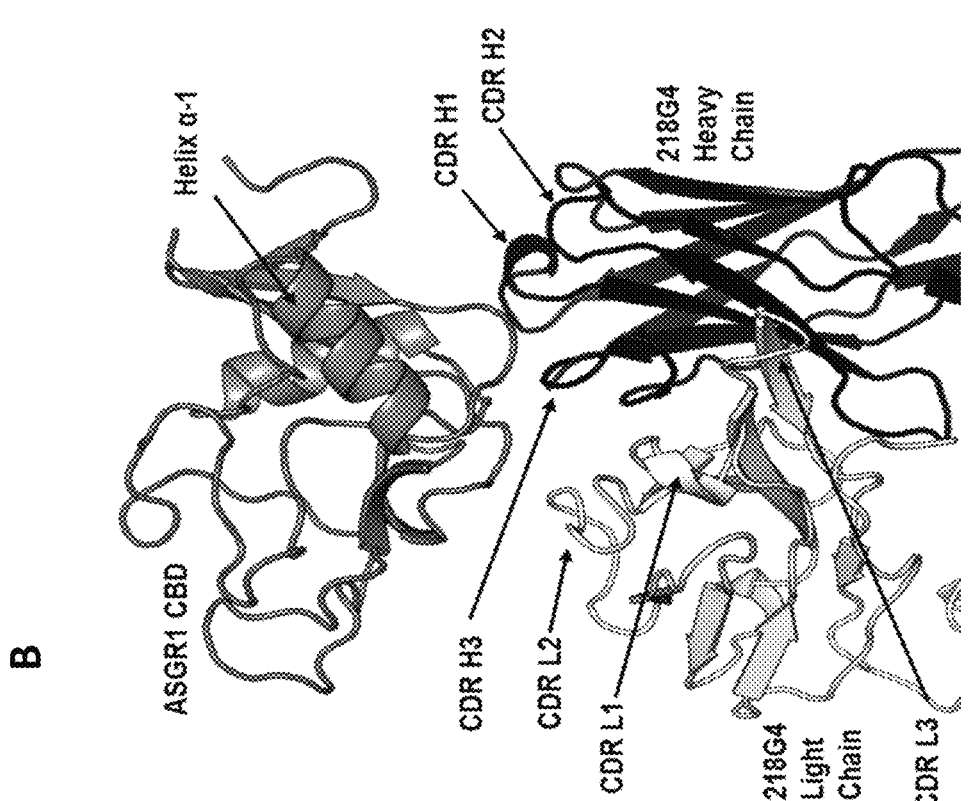
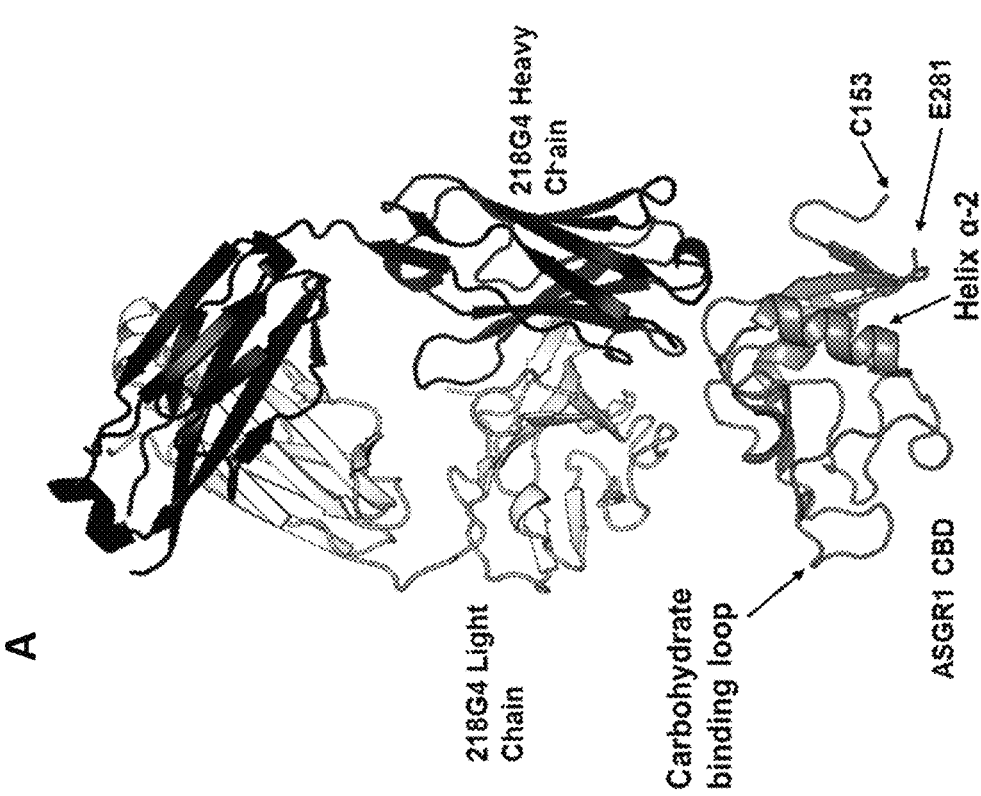

Binding of antibody 7F4 to parental and ASGR-expressing CHO-S cells

FIGURE 48

Table 1

Immunogens

| Name | Sequence Range | Tags | Amino Acid Sequence | Vector | SEQ ID NO: |
|---|---|---|---|---|---|
| muASGR1 | 1-284 | TCE | MTKDYQDFOHLDNDNDHHQLRRGPPPTPRLLQRLCSGRLLLSSSLSILLLVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pTT5 | 1 |
| muAsgr2 | 1-301 | TCE | MEKDCQDIQQLDSEENDHQLSGDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAQLEEKQQQLKADHSTLLFHLKHFPMDLRTLTCQLAYFQSNGTECCPVNWVEFGSCYWFSRDGLTWAEADQYCQLENAHLLVINSREEQDFVKHRSQFHIWIGLTDRDGSWKWVDGTDYRSNYRNWAFTQPDNWQGHEQGGGEDCAEILSDGHWNDNFCQQVNRWVCEKRRNITH | pTT5 | 2 |
| muASGR1(ECD) | 63-284 | TCE | SQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pSLX235a | 3 |
| muASGR1(CBD) | 153-284 | TCE | CPINWVEYEGSCYWFSSSVRPWTEADKYCQLENAHLVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN | pSLX235a | 4 |
| huASGR1 | 1-291 | TCE | MTKEYQDLQHLDNEESDHHQLRKGPPPPQPLLQRLCSGPRLLLSLGLSLLLLVVCVIGSQNSQLQEEELRGLRETFSNFTASTEAQVKGLSTQGGNVGRKMKLSESQLEKQOKDLSEDHSSLLLHVKQFVSDLRSLSCQMAALQGNGSERTCCPVNWVEHERSCYWFSRSGKAWADADNYCRLEDAHLVVTSWEEQKFVQHHIGPVNTWMGLHDQNGPWKWVDGTDYETGFKNWRPEGPDDWYGHGLGGGEDCAHFTDDGRWNDDVCQRPYRWVCETELDKASQEPPLL | pTT5 | 5 |
| huASGR2 | 1-287 | TCE | MAKDFQDIQQLSSEENDHPFHOGPPPAQPLAQRLCSMVCFSLLALSFNILLVVICVTGSQSAQLQAELRSLKEAFSNFSSSTLTEVQAISTHGGSVGDKITSLGAKLEKQQODLKADHDALLFHLKHFPVDLRFVACQMELLHSNGSQRTCCPVNWVEHQGSCYWFSHSGKAWAAEAEKYCQLENAHLVVINSWEEGKFIVGHTNPFNTWIGLTDSDGSWKWVDGTDYRHNYKNWAVTQPDNWHGHELGGSEDCVEVQPDGRWNDDFCLQYYRWVCEKRRNATGEVA | pTT5 | 6 |
| huASGR1(ECD) | 64-291 | TCE | SQLQEEELRGLRETFSNFTASTEAQVKGLSTQGGNVGRKMKSCYWFSRSGKAWADADNYCRLEDAHLVVTSWEEQKFVQHHIGPVNTWMGLHDQNGPWKWVDGTDYETGFKNWRPEGPDDWYGHGLGGGEDCAHFTDDGRWNDDVCQRPYRWVCETELDKASQEPPLL | pSLX235a | 7 |
| huASGR1(CBD) | 154-291 | TCE | CPVNWVEHERSCYWFSRSGKAWADADNYCRLEDAHLVVTSWEEQKFVQHHIGPVNTWMGLHDQNGPWKWVDGTDYETGFKNWRPEGPDDWYGHGLGGGEDCAHFTDDGRWNDDVCQRPYRWVCETELDKASQEPPLL | pSLX235a | 8 |

FIGURE 48
(Continued)

| Name | Sequence Range | Tags | Amino Acid Sequence | | |
|---|---|---|---|---|---|
| huASGR2(ECD) | 61-287 | TCE | QSAQLQAELRSLKEAFSNFSSSTLTEVQAISTHGGSVGDKTSLGAKLEKQQQDLKADHDALLFHLKHFPVDLRFV ACQMELLHSNGSQRTCCPVNWVEHQGSCYWFSHSGKAWAEAEKYCQLENAHLVVINSWEEQKFIVQHTNPFN TWIGLTDSDGSWKWVDGTDYRHNYKNWAVTQPDNWHGHELGGSEDCVEVQPDGRWNDDFCLQVYRWVCEK RRNATGEVA | pSLX235a | 9 |
| huASGR2(CBD) | 153-267 | TCE | CPVNWVEHQGSCYWFSHSGKAWAEAEKYCQLENAHLVVINSWEEQKFIVQHTNPFNTWIGLTDSDGSWKWVD GTDYRHNYKNWAVTQPDNWHGHELGGSEDCVEVQPDGRWNDDFCLQVYRWVCEKRRNATGEVA | pSLX235a | 10 |
| Structural Work | | | | | |
| Name | Sequence Range | Tags | Amino Acid Sequence | Vector | |
| M::huASGR1(154-281) | 154-281 | None | MCPVNWVEHERSCYWFSRSGKAWADADNYCRLEDAHLVVVTSWEEEQKFVQHHIGPVNTWMGLHDQNGPWK WVDGTDYETGFKNWRPEQPDEWYGHGLGGGEDCAHFTDDGRWNDDVCQRPYRWVCETEL | pET21a | 11 |
| M::huASGR1(148-291) | 148-291 | None | MGSSERTCCPVNWVEHERSCYWFSRSGKAWADADNYCRLEDAHLVVVTSWEEEQKFVQHHIGPVNTWMGLHDQ NGPWKWVDGTDYETGFKNWRPEQPDDWYGHGLGGGEDCAHFTDDGRWNDDVCQRPYRWVCETELDKASQ EPPLL | pET21a | 12 |
| MA::huASGR1(148-291) | 148-291 | None | MAGSERTCCPVNWVEHERSCYWFSRSGKAWADADNYCRLEDAHLVVVTSWEEEQKFVQHHIGPVNTWMGLHD QNGPWKWVDGTDYETGFKNWRPEQPDDWYGHGLGGGEDCAHFTDDGRWNDDVCQRPYRWVCETELDKAS QEPPLL | pET21a | 13 |
| MA::huASGR1(154-281) | 154-281 | None | MACPVNWVEHERSCYWFSRSGKAWADADNYCRLEDAHLVVVTSWEEEQKFVQHHIGPVNTWMGLHDQNGPW KWVDGTDYETGFKNWRPEQPDDWYGHGLGGGEDCAHFTDDGRWNDDVCQRPYRWVCETEL | pET21a | 14 |
| MA::huASGR1(60-153) | 60-153 | None | MAGSQNSQLQEELRGLRETFSNFTASTEAQVKGLSTQGGNVGRKMKSLESQLEKQQKDLSEDHSSLLLHVKQF VSDLRSLSCQMAALQGNGSSERTC | pET21a | 15 |
| MA::huASGR1(60-291) | 60-291 | None | MAGSQNSQLQEELRGLRETFSNFTASTEAQVKGLSTQGGNVGRKMKSLESQLEKQQKDLSEDHSSLLLHVKQF QHHIGPVNTWMGLHDQNGPWKWVDGTDYETGFKNWRPEQPDDWYGHGLGGGEDCAHFTDDGRWNDDVCQ RPYRWVCETELDKASQEPPLL | pET21a | 16 |
| MA::huASGR1(62-153) | 62-153 | None | MAQNSQLQEELRGLRETFSNFTASTEAQVKGLSTQGGNVGRKMKSLESQLEKQQKDLSEDHSSLLLHVKQFVS DLRSLSCQMAALQGNGSSERTC | pET21a | 17 |
| MA::huASGR1(58-153) | 58-153 | None | MAVIGSQNSQLQEELRGLRETFSNFTASTEAQVKGLSTQGGNVGRKMKSLESQLEKQQKDLSEDHSSLLLHVKQ FVSDLRSLSCQMAALQGNGSSERTC | pET21a | 18 |
| MA::huASGR1(58-143) | 58-143 | None | MAVIGSQNSQLQEELRGLRETFSNFTASTEAQVKGLSTQGGNVGRKMKSLESQLEKQQKDLSEDHSSLLLHVKQ FVSDLRSLSCQMAA | pET21a | 19 |
| MA::huASGR1(62-143) | 62-143 | None | MAQNSQLQEELRGLRETFSNFTASTEAQVKGLSTQGGNVGRKMKSLESQLEKQQKDLSEDHSSLLLHVKQFVS DLRSLSCQMAA | pET21a | 20 |
| MA::huASGR1(60-143) | 60-143 | None | MAGSQNSQLQEELRGLRETFSNFTASTEAQVKGLSTQGGNVGRKMKSLESQLEKQQKDLSEDHSSLLLHVKQF VSDLRSLSCQMAA | pET21a | 21 |

FIGURE 48
(Continued)

| | | | | |
|---|---|---|---|---|
| MA::huASGR1(60-282) | 60-282 | None | MAGSQNSQLQEELRGLRETFSNFTASTEAQVKGLSTQGGNVGRKMKSLESQLEKQKDLSEDHSSLLLHVKQF VSDLRSLSCQMAALQGNGSERTCCPVNWVEHERSCYWFSRSGKAWADADNYCRLEDAHLVVVTSWEEQKFV QHHIGPVNTWMGLHDQNGPWKWVDGTDYETGFKNWRPEQPDEWYGHGLGGEDCAHFTDDGRWNDDVCQ RPYRWVCETELD | pET21a | 22 |
| MA::huASGR1(62-291) | 62-291 | None | MAGNSQLQEELRGLRETFSNFTASTEAQVKGLSTQGGNVEHERSCYWFSRSGKAWADADNYCRLEDAHLVVVTSWEEQKFVQH DLRSLSCQMAALQGNGSERTCCPVNWVEHERSCYWFSRSGKAWADADNYCRLEDAHLVVVTSWEEQKFVQH HIGPVNTWMGLHDQNGPWKWVDGTDYETGFKNWRPEQPDDWYGHGLGGEDCAHFTDDGRWNDDVCQRP YRWVCETELDKASQEPPLL | pET21a | 23 |
| MA::huASGR1(61-291) | 62-291 | None | MASQNSQLQEELRGLRETFSNFTASTEAQVKGLSTQGGNVGRKMKSLESQLEKQKDLSEDHSSLLLHVKQFV SDLRSLSCQMAALQGNGSERTCCPVNWVEHERSCYWFSRSGKAWADADNYCRLEDAHLVVVTSWEEQKFVQ HHIGPVNTWMGLHDQNGPWKWVDGTDYETGFKNWRPEQPDDWYGHGLGGEDCAHFTDDGRWNDDVCQR PYRWVCETELDKASQEPPLL | pET21a | 24 |
| MA::huASGR1(58-291) | 58-291 | None | MAVIGSNSQLQEELRGLRETFSNFTASTEAQVKGLSTQGGNVGRKMKSLESQLEKQKDLSEDHSSLLLHVKQ FVSDLRSLSCQMAALQGNGSERTCCPVNWVEHERSCYWFSRSGKAWADADNYCRLEDAHLVVVTSWEEQKF VQHHIGPVNTWMGLHDQNGPWKWVDGTDYETGFKNWRPEQPDDWYGHGLGGEDCAHFTDDGRWNDDVC QRPYRWVCETELDKASQEPPLL | pET21a | 25 |
| MA::huASGR1(63-291) | 63-291 | None | MANSQLQEELRGLRETFSNFTASTEAQVKGLSTQGGNVGRKMKSLESQLEKQKDLSEDHSSLLLHVKQFVSDL RSLSCQMAALQGNGSERTCCPVNWVEHERSCYWFSRSGKAWADADNYCRLEDAHLVVVTSWEEQKFVQHHI GPVNTWMGLHDQNGPWKWVDGTDYETGFKNWRPEQPDDWYGHGLGGEDCAHFTDDGRWNDDVCQRPYR WVCETELDKASQEPPLL | pET21a | 26 |
| MA::huASGR2(59-287) | 59-287 | None | MAGSQSAQLQAELRSLKEAFSNFSSSTLTEVQAISTHGGSVGDKITSLGAKLEKQQQDLKADHDALLFHLKHFPV DLRFVACQMELLHSNGSQRTCCPVNWVEHQGSCYWFSHSGKAWAEAEKYCQLENAHLVVINSWEEQKFIVQH TNPFNTWIGLTDSDGSWKWVDGTDYRHNYKNWAVTQPDNWHGHELGGSSEDCVEVQPDGRWNDFCLQVYR WVCEKRRNATGEVA | pET21a | 27 |
| MA::huASGR2(57-287) | 57-287 | None | MAVTGSQSAQLQAELRSLKEAFSNFSSSTLTEVQAISTHGGSVGDKITSLGAKLEKQQQDLKADHDALLFHLKHF PVDLRFVACQMELLHSNGSQRTCCPVNWVEHQGSCYWFSHSGKAWAEAEKYCQLENAHLVVINSWEEQKFIV QHTNPFNTWIGLTDSDGSWKWVDGTDYRHNYKNWAVTQPDNWHGHELGGSSEDCVEVQPDGRWNDFCLQV YRWVCEKRRNATGEVA | pET21a | 28 |
| MA::huASGR2(60-287) | 60-287 | None | MASQSAQLQAELRSLKEAFSNFSSSTLTEVQAISTHGGSVGDKITSLGAKLEKQQQDLKADHDALLFHLKHFPVDL RFVACQMELLHSNGSQRTCCPVNWVEHQGSCYWFSHSGKAWAEAEKYCQLENAHLVVINSWEEQKFIVQHTN PFNTWIGLTDSDGSWKWVDGTDYRHNYKNWAVTQPDNWHGHELGGSSEDCVEVQPDGRWNDFCLQVYRWV CEKRRNATGEVA | pET21a | 29 |
| MA::huASGR2(61-287) | 61-287 | None | MAQSAQLQAELRSLKEAFSNFSSSTLTEVQAISTHGGSVGDKITSLGAKLEKQQQDLKADHDALLFHLKHFPVDL RFVACQMELLHSNGSQRTCCPVNWVEHQGSCYWFSHSGKAWAEAEKYCQLENAHLVVINSWEEQKFIVQHTN PFNTWIGLTDSDGSWKWVDGTDYRHNYKNWAVTQPDNWHGHELGGSSEDCVEVQPDGRWNDFCLQVYRWV CEKRRNATGEVA | pET21a | 30 |
| MA::huASGR2(62-287) | 62-287 | None | MASAQLQAELRSLKEAFSNFSSSTLTEVQAISTHGGSVGDKITSLGAKLEKQQQDLKADHDALLFHLKHFPVDLRF VACQMELLHSNGSQRTCCPVNWVEHQGSCYWFSHSGKAWAEAEKYCQLENAHLVVINSWEEQKFIVQHTNPF NTWIGLTDSDGSWKWVDGTDYRHNYKNWAVTQPDNWHGHELGGSSEDCVEVQPDGRWNDFCLQVYRWVCE KRRNATGEVA | pET21a | 31 |

FIGURE 48
(Continued)

Complex Formation Assays

| Name | Sequence Range | Tags | Amino Acid Sequence | Vector | |
|---|---|---|---|---|---|
| huASGR1::GS::SNAP26f | 1-291 | SNAP26f | MTKEYQDLQHLDNEESDHHGLRKGPPPPQPLLQRLCSGPRLLLLSLGLSLLLLVVVCVIGSQNSLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKADADNYCRLEDAHLVVTSWEEQKFVQHHIGPVNTWMGLHDONG PWKWVDGTDYETGFKNWRPEQPDDWYGHGLGGGEDCAHFTDDGRWNDDVCQRPYRWVCETELDKASQEP PLLGSSMDKDCEMKRTTLDSPLGKLELSGCEQGLHRIIFLGKGTSAADAVEPAPAAVLGGPEPLMQATAWLNAYF HQPEAIEEFPVPALHHPVFQQESFTRQVLWKLLKVVKFGEVISYSHLAALAGNPAATAAVKTALSGNPVPILIPCHR VVQGDLDVGGYEGGLAVKEWLLAHEGHRLGKPGLG | piRES_puro3.1 | 32 |
| huASGR1::GS::(G4S)3::SNAP26f | 1-291 | SNAP26f | MTKEYQDLQHLDNEESDHHGLRKGPPPPQPLLQRLCSGPRLLLLSLGLSLLLLVVVCVIGSQNSLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVTSWEEQKFVQHHIGPVNTWMGLHDONG PWKWVDGTDYETGFKNWRPEQPDDWYGHGLGGGEDCAHFTDDGRWNDDVCQRPYRWVCETELDKASQEP PLLGSSGGGGSGGGGSGGGGSMDKDCEMKRTTLDSPLGKLELSGCEQGLHRIIFLGKGTSAADAVEPAPAAVL GGPEPLMQATAWLNAYFHQPEAIEEFPVPALHHPVFQQESFTRQVLWKLLKVVKFGEVISYSHLAALAGNPAATA AVKTALSGNPVPILIPCHRVVQGDLDVGGYEGGLAVKEWLLAHEGHRLGKPGLG | piRES_puro3.1, pJif1 | 33 |
| huASGR1::GS::CLIP | 1-291 | CLIP | MTKEYQDLQHLDNEESDHHGLRKGPPPPQPLLQRLCSGPRLLLLSLGLSLLLLVVVCVIGSQNSLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVTSWEEQKFVQHHIGPVNTWMGLHDONG PWKWVDGTDYETGFKNWRPEQPDDWYGHGLGGGEDCAHFTDDGRWNDDVCQRPYRWVCETELDKASQEP PLLGSSMDKDCEMKRTTLDSPLGKLELSGCEQGLHRIIFLGKGT SAADAVEPAPAAVLGGPEPLIQATAWLNAYF HQPEAIEEFPVPALHHPVFQQESFTRQVLWKLLKVVKFGEVISESHLAALVGNPAATAAVNTALDGNPVPILIPCH RVVQGDSDVGPYLGGLAVKEWLLAHEGHRLGKPGLG | piRES_puro3.1, pJif1 | 34 |
| huASGR1::GS::(G4S)3::CLIP | 1-291 | CLIP | MTKEYQDLQHLDNEESDHHGLRKGPPPPQPLLQRLCSGPRLLLLSLGLSLLLLVVVCVIGSQNSLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLLGSGGGGSGGGGSGGGGSMDKDCEMKRTTLDSPLGKLELSGCEQGLHRIIFLGKGTSAADAVEVPAPAAVL GGPEPLIQATAWLNAYFHQPEAIEEFPVPALHHPVFQQESFTRQVLWKLLKVVKFGEVISESHLAALVGNPAATAA VNTALDGNPVPYLGGLAVKEWLLAHEGHRLGKPGLG | piRES_puro3.1 | 35 |
| huASGR2::GS::SNAP26f | 1-287 | SNAP26f | MAKDFQDIQQLSSEENDHPFHQGPPPAQPLAGRLCSMVCFSLLALSFNILLLVVICVTGSQSAGLQAELRSLKEAF SMFSSSTLTEVQAISTHGGSVGDKITSLGAKLEKQQGDLKADHDALLFHLKHFPVDLRFVACQMELLHSNGSQRT CCPVNWVEHQGSCYWFSHSGKAWAEAEKYCQLENAHLVVINSWEEQKFIVQHTNPFNTWIGLTDSDGSWKWV DGTDYRHNYKNWAVTQPDNWHGHELGGSEDCVEVQPDGRWNDDFCLQVYRWVCEKRRNATGEVAGSMDKD CEMKRTTLDSPLGKLELSGCEQGLHRIIFLGKGTSAADAVEPAPAAVLGGPEPLMQATAWLNAYFHQPEAIEEF PVPALHHPVFQQESFTRQVLWKLLKVVKFGEVISYSHLAALAGNPAATAAVKTALSGNPVPILIPCHRVVQGDLDV GGYEGGLAVKEWLLAHEGHRLGKPGLG | piRES_puro3.1, pJif1 | 36 |

FIGURE 48
(Continued)

| | | | | |
|---|---|---|---|---|
| huASGR2::GS::(G4S)3::SNAP26f | 1-287 | SNAP26f | MAKDFQDIQQLSSEENDHPFHQGPPPAAQPLAQRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG SGGGGSGGGGSGGGGS MAKDFQDIQQLSSEENDHPFHQGPPPAAQPLAQRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWV | pIRES_puro3.1 | 37 |
| huASGR2::GS::CLIP | 1-287 | CLIP | MAKDFQDIQQLSSEENDHPFHQGPPPAAQPLAQRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDV GPYLGGLAVKEWLLAHEGHRLGKPGLG | pIRES_puro3.1_pJff1 | 38 |
| huASGR2::GS::(G4S)3::CLIP | 1-287 | CLIP | MAKDFQDIQQLSSEENDHPFHQGPPPAAQPLAQRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQAT AWLNAYFHQPEAIEEFPVPALHHPVFQQESFTRQVLWKLLKVVKFGEVISESHLAALVGNPAATAAVNTALDGNP VPILIPCHRVVQGDSDVGPYLGGLAVKEWLLAHEGHRLGKPGLG | pIRES_puro3.1 | 39 |
| huASGR2(v4)::GS::SNAP26f | 1-306 | SNAP26f | MAKDFQDIQQLSSEENDHPFHQGEGPGTRRLNPRRGNPFLKGPPPAAQPLAGRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHT NPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTAL SGNPVPILIPCHRVVQGDLDVGGYEGGLAVKEWLLAHEGHRLGKPGLG | pIRES_puro3.1_pJff1 | 40 |
| huASGR2(v4)::GS::SNAP26f | 1-306 | SNAP26f | MAKDFQDIQQLSSEENDHPFHQGEGPGTRRLNPRRGNPFLKGPPPAAQPLAGRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISYSHLA | pIRES_puro3.1 | 41 |
| huASGR2(v4)::GS::CLIP | 1-306 | CLIP | MAKDFQDIQQLSSEENDHPFHQGEGPGTRRLNPRRGNPFLKGPPPAAQPLAGRLCSMVCFSLLALSFNILLLVVICVTGSQSAGLQAELRSLKEAFSNFSSSTLTEVQAISTHGGSVGDKITSLGAKLEKQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALD GNPVPILIPCHRVVQGDSDVGPYLGGLAVKEWLLAHEGHRLGKPGLG | pIRES_puro3.1 | 42 |

FIGURE 48
(Continued)

| | | | | |
|---|---|---|---|---|
| huASGR2(v4)::GS::(G4S)3::CLIP | 1-306 | CLIP | MAKDFQDIQLSSEENDHPFHQGEGPGTRRLNPRRGNPFLKGPPPAQPLAQRLCSMVCFSLLALSFNILLVVIC VTGSQSSAQLQAELRSLKEAFSNFSSSTLTEVQAISTHGGSVGDKITSLGAKLEKQQQDLKADHDALLFHLKHFPVD LRFVACQMELLHSNGSQRTCCPVNWVEHQGSCYWFSHSGKAWAEAEKYCQLENAHLVVINSWEEGKFVQHT NPFNTWIGLTDSDGSWKWVDGTDYRHNYKNWAVTQPDNWHGHELGGSEDCVEVQPDGRWNDDFCLQYYRW VCEKRRNATGEVAGSGGGSGGGGSGGGGSMDKDCEMKRTTLDSPLGKLELSGEQGLHRIIFLGKGTSAADA VEVPAPAAVLGGPEPLIQATAWLNAYFHQPEAIEEFPVPAALHHPVFQQESFTRQVLWKLLKVVKFGEVISESHLAA ILVGNPAATAAVNTALDGNPVPILIPCHRVVQGSDSDVGPYLGGLAVKEWLLAHEGHRLGKPGLG | pIRES_puro3.1 | 43 |

Mammalian Expression

| | | | | |
|---|---|---|---|---|
| huASGR1 | 1-291 | None | MTKEYQDLQHLDNEESDHHQLRKGPPPPOPLLQRLCSGPRLLLLSLGLSLILLLVVVCVIGSQNSOLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLL | pTT5, pSLX235a, pJiF1 | 44 |
| huASGR1(Y273C) | 1-291 | None | MTKEYQDLQHLDNEESDHHQLRKGPPPPOPLLQRLCSGPRLLLLSLGLSLILLLVVVCVIGSQNSOLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRCWNDDVCQRPCRWVCETELDKASQEP PLL | pTT5, pSLX235a, pJiF1 | 45 |
| huASGR1::Flag | 1-291 | Flag | MTKEYQDLQHLDNEESDHHQLRKGPPPPOPLLQRLCSGPRLLLLSLGLSLILLLVVVCVIGSQNSOLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPYRWVCETELDKASQEP PLLDYKDDDDK | pTT5, pSLX235a | 46 |
| huASGR1(Y273C)::Flag | 1-291 | Flag | MTKEYQDLQHLDNEESDHHQLRKGPPPPOPLLQRLCSGPRLLLLSLGLSLILLLVVVCVIGSQNSOLQEELRGLRE TFSNFTASTEAQVKGLSTQGGNVGRKMKSLESQLEKQQKDLSEDHSSLLLHVKQFVSDLRSLSCQMAALQGNG SERTCCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRCWNDDVCQRPCRWVCETELDKASQEP PLLDYKDDDDK | pTT5, pSLX235a | 47 |
| cyASGR1 | 1-291 | None | MTKEYQDLQHLDNEESDHHQLGKGPPPPOQSLLRRLCSGPRLLLLSLGLSLILLLVVVCVIGSQNAQLQRELRGLRE TLSNFTASTEAQVKGLSTQGGNVGRKMKSLESQLEKQQKDLSEDHVVTSWEEQKFVQHHIGPVNTWMGLHDQNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPCRWVCETELDKASQEP PLL | pTT5, pSLX235a | 48 |
| cyASGR1(Y273C) | 1-291 | None | MTKEYQDLQHLDNEESDHHQLGKGPPPPOQSLLRRLCSGPRLLLLSLGLSLILLLVVVCVIGSQNAQLQRELRGLRE TLSNFTASTEAQVKGLSTQGGNVGRKMKSLESQLEKQQKDLSEDHVVTSWEEQKFVQHHIGPVNTWMGLHDQNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRCWNDDVCQRPCRWVCETELDKASQEP PLL | pTT5, pSLX235a | 49 |
| cyASGR1::Flag | 1-291 | Flag | MTKEYQDLQHLDNEESDHHQLGKGPPPPOQSLLRRLCSGPRLLLLSLGLSLILLLVVVCVIGSQNAQLQRELRGLRE TLSNFTASTEAQVKGLSTQGGNVGRKMKSLESQLEKQQKDLSEDHVVTSWEEQKFVQHHIGPVNTWMGLHDQNG SERACCPVNWVEHERSCYWFSRSGKAWADADNYCRLEDAHLVVVTSWEEQKFVQHHIGPVNTWMGLHDQNG PWKWVDGTDYETGFKNWRPEQPDDWYGHGLGGGEDCAHFTDDGRWNDDVCQRPCRWVCETELDKASQEP PLLDYKDDDDK | pTT5, pSLX235a | 50 |

FIGURE 48
(Continued)

| Name | Range | Tag | Sequence | Vector | SEQ ID |
|---|---|---|---|---|---|
| cyASGR1(Y273C)::Flag | 1-291 | Flag | MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQIEPPLLDYKDDDDK | pTT5, pSLX235a | 51 |
| muASGR1 | 1-284 | None | MTKDYQDFQHLDNDNDHHQLRRGPPPTPRLLQRLCSGSRLLLLSSSLSILLLHVKQLVSDYRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTDDGRWNDDVCRRPYRWVCETKLDKAN | pTT5, pJiF1 | 52 |
| muASGR1(Y272C) | 1-284 | None | MTKDYQDFQHLDNDNDHHQLRRGPPPTPRLLQRLCSGSRLLLLSSSLSILLLHVKQLVSDYRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTDDGRWNDDVCRRPCRWVCETKLDKAN | pTT5, pSLX235a, pJiF1 | 53 |
| ratASGR1 | 1-284 | None | MTKDYQDFQHLDNENDHHQLQRGPPAPRLLQRLCSGFRLFLLSGLSILLLVVVCVITSQNSQLREDLRVLRQNFSNFTVSTEDQVKALTQGERVGRKMKLVESGLEKHQEDLREDHSRLLLHVKQLVSDRFVQQHMGPLNTWIGLTDQNGPWKRICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKAN | pTT5, pSLX235a | 54 |
| ratASGR1(Y272C) | 1-284 | None | MTKDYQDFQHLDNENDHHQLQRGPPAPRLLQRLCSGFRLFLLSGLSILLLHVKQLVSDVRSLSCQMAALRGNGSESNFTVSTEDQVKALTQGERVGRKMKLVESQLEKHQEDLREDHSRLLLHVKQLVSDRFVQQHMGPLNTWIGLTDQNGPWKRICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPCRWVCETELGKAN | pTT5, pSLX235a | 55 |
| muASGR1::Flag | 1-284 | Flag | MTKDYQDFQHLDNDNDHHQLRRGPPPTPRLLQRLCSGSRLLLLSSSLSILLLHVKQLVSDYRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTDDGRWNDDVCRRPYRWVCETKLDKANDYKDDDDK | pTT5, pSLX235a | 56 |
| muASGR1(Y272C)::Flag | 1-284 | Flag | MTKDYQDFQHLDNDNDHHQLRRGPPPTPRLLQRLCSGSRLLLLSSSLSILLLHVKQLVSDYRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTDDGRWNDDVCRRPCRWVCETKLDKANDYKDDDDK | pTT5, pSLX235a | 57 |
| ratASGR1::Flag | 1-284 | Flag | MTKDYQDFQHLDNENDHHQLQRGPPAPRLLQRLCSGFRLFLLSGLSILLLHVKQLVSDVRSLSCQMAALRGNGSESNFTVSTEDQVKALTQGERVGRKMKLVESQLEKHQEDLREDHSRLLLHVKQLVSDRFVQQHMGPLNTWIGLTDQNGPWKRICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKANDYKDDDDK | pTT5, pSLX235a | 58 |

FIGURE 48
(Continued)

| | | | | | |
|---|---|---|---|---|---|
| ratASGR1(Y27C)::Flag | 1-284 | Flag | MTKDYQDFQHLDNENDHHQLQRGPPPAPRLLQRLCSGFRLFLLSLGLSILLLVVCVITSQNSQLREDLRVLRQNF SNFTVSTEDQVKALTTQGERVGRKMKLVESSQLEKHQEDLREDHSRLLLHVKQLVSDVRSLSCQMAALRGNGSE RICCPINWLVEYEGSCYWFSSSVKPWTEADKYCQLENAHLVVTSWEEQRFVQQHMGPLNTWIGLTDQNGPWK WVDGTDYETGFKNWRPGQPDDWYGHGLGGGEDCAHFTTDGHWNDDVCRRPCRWVCETELGKANDYKDDDD K | pTT5, pSLX235a | 59 |
| huASGR2 | 1-306 | None | MAKDFQDIQQLSSEENDHPFHQGPPPAQPLAQRLCSMVCFSLLALSFNILLLVVICVTGSQSAGLQAELRSLKEAF SNFSSSTLTEVQAISTHGGSVGDKITSLGAKLEKQQQDLKADHDALLFHLKHFPVDLRFVACCMELLHSNGSQRT CCPVNWVEHQGSCYWFSHSGKAWAEEAEKYCQLENAHLVVINSWEEQKFIVQHTNPFNTWIGLTDSDGSWKWV DGTDYRHNYKNWAVTQPDNWHGHELGSSEDCVEVQPDGRWNDDFCLQVYRWVCEKRRNATGEVA | pTT5, pSLX235a. pJiF1 | 60 |
| muASGR2 | 1-301 | None | MEKDFQDIQQLDSEENDHQLSGDDEHGSHVQDPRIENPHWKGQPLSRPFPQRLCSTFRLSLLALAFNILLLVVIC VVSSQSIQLQEEFRTLKETFSNFSSSTLMEFGALDTLGGSTNAILTSWLAQLEEKQQQLKADHSTLLFHLKHFPMD LRTLTCQLAYFQSNGTECCPVNWVEFGGSCYWFSRDGLTWAEADQYCQLENAHLLVINSREEQDFVVKHRSQF HIWIGLTDRDGSWKWVDGTDYRSNYRNWAFTQPDNWQGHEQGGGEDCAEILSDGHWNDNFCQQVNRWVCE KRRNITH | pTT5, pJiF1 | 61 |
| ratASGR2 | 1-301 | None | MEKDFQDIQQLDSEENDHQLIGDEEQGSHVQNLRTENPRWGGQPPSRPFPQRLCSKFRLSLLALAFNILLLVVIC VVSSQSMQLQKEFWTLKETLSNFSTTTLMEFKALDSHGGSRNDNLTSWETILEKKQKDIKADHSTLLFHLKHFPL DLRTLTCQLAFFLSNGTECCPVNWVEFGGSCYWFSRNDNLTSWETILEKKQKDIKADHSTLLFHLKHFPL DLRTLTCQLAFFLSNGTECCPVNWVEFGGSCYWFSRDGLTWAEADQYCQMENAHLLVINSREEQEFVVKHRGA FHIWIGLTDKDGSWKWVDGTEYRSNFKNWAFTQPDNWQGHEEGSSEDCAEILSDGLWNDNFCQQVNRWACE RKRDITY | pTT5, pSLX235a | 62 |
| huASGR2::6xHis | 1-306 | 6xHis | MAKDFQDIQQLSSEENDHPFHQGPPPAQPLAQRLCSMVCFSLLALSFNILLLVVICVTGSQSAGLQAELRSLKEAF SNFSSSTLTEVQAISTHGGSVGDKITSLGAKLEKQQQDLKADHDALLFHLKHFPVDLRFVACCMELLHSNGSQRT CCPVNWVEHQGSCYWFSHSGKAWAEEAEKYCQLENAHLVVINSWEEQKFIVQHTNPFNTWIGLTDSDGSWKWV DGTDYRHNYKNWAVTQPDNWHGHELGSSEDCVEVQPDGRWNDDFCLQVYRWVCEKRRNATGEVAHHHHHH | pTT5, pSLX235a | 63 |
| muASGR2::6xHis | 1-301 | 6xHis | MEKDFQDIQQLDSEENDHQLSGDDEHGSHVQDPRIENPHWKGQPLSRPFPQRLCSTFRLSLLALAFNILLLVVIC VVSSQSIQLQEEFRTLKETFSNFSSSTLMEFGALDTLGGSTNAILTSWLAQLEEKQQQLKADHSTLLFHLKHFPMD LRTLTCQLAYFQSNGTECCPVNWVEFGGSCYWFSRDGLTWAEADQYCQLENAHLLVINSREEQDFVVKHRSQF HIWIGLTDRDGSWKWVDGTDYRSNYRNWAFTQPDNWQGHEQGGGEDCAEILSDGHWNDNFCQQVNRWVCE KRRNITHHHHHH | pTT5, pSLX235a | 64 |
| ratA::6xHis | 1-301 | 6xHis | MEKDFQDIQQLDSEENDHQLIGDEEQGSHVQNLRTENPRWGGQPPSRPFPQRLCSKFRLSLLALAFNILLLVVIC VVSSQSMQLQKEFWTLKETLSNFSTTTLMEFKALDSHGGSRNDNLTSWETILEKKQKDIKADHSTLLFHLKHFPL DLRTLTCQLAFFLSNGTECCPVNWVEFGGSCYWFSRDGLTWAEADQYCQMENAHLLVINSREEQEFVVKHRGA FHIWIGLTDKDGSWKWVDGTEYRSNFKNWAFTQPDNWQGHEEGSSEDCAEILSDGLWNDNFCQQVNRWACE RKRDITYHHHHHH | pTT5, pSLX235a | 65 |
| dogASGR2::6xHis | 1-302 | 6xHis | MAKDFQDIQQLDSEDSDQOLGRGEGPGRPGHGPRREDRFCRRLPPHQPLLLQRLCSGYRLNLLVLGFNVLMLV AICVIGSQRAQLEEELRILKENFSHFSSGVLMELGVLLSDGGGASSQLTSLEAKLEKQORDVKADHATLLLHLKHF PSDLRILTCQVAFFQSNGTDCCPVNWLEYEGSCYWFSRSGKTWEEAEKYCQLESAHLVVNSREEQKFILQHTN PFDTWIGLTDSDGSWRWVDGTDYQQSYKNWAATQPDDWQGHEVGGGEDCAEVRANGRWMNDFCKQVQRW VCEMRRNVTGHHHHHH | pTT5, pSLX235a | 66 |

FIGURE 48
(Continued)

| | | | | | |
|---|---|---|---|---|---|
| dogASGR2 | 1-302 | None | MAKDCGDIQQLDSEDSDQQLGRGEGPGRGHGPRREIDRFCRRLPPHQPLLLQRLCSGYRLNLLVLGFNVLMLV AICVIGSQRAQLEEELRILKENFSHFSSGVLMELGVLLSDGGASSQLTSLEAKLEKQORDVKADHATLLLHLKHF PSDLRILTCQVAFFQSNGTDCCPVNWLEYEGSCYWFSRSGKTWEEAEKYCQLESAHLVVNSREEQKFILQHTN PFDTWIGLTDSDGSWRWVDGTDYQQSYKNWAATQPDDWQGHEVGGGEDCAEVRANGRWNDNFCKQVQRW VCEMRRNVTG | pTT5, pSLX235a | 67 |
| cyASGR2 | 1-306 | None | MAKDFQDIQQLSSEENDHPFHRGEGPGPRGLNLRRGNPSLKGPPAQPLAQRLCSMVRFSLLALSFNILLLVAIC VIGSQSAQLQAELWSLKEAFSNFSSSTLMEVHALGTHGGSVGDKITSLGDKLEKQGQDLKACHDILLLHLKHFPV DLRFVACQMELLHSNGSQRTCCPVNWVEHQGSCYWFSRSGKAWAEAEKYCQLENSHLVVINSWEEQKFIVQH TNLFNTWIGLTDSDGSWKWVDGTDYRHNYKNWAVTQPDDWHGHELGGSEDCVEVRPDGRWNDDFCLQVHR WVCEKRRNATGEAA | pTT5, pSLX235a | 68 |
| cyASGR2(L225P)::6xHis | 1-306 | 6xHis | MAKDFQDIQQLSSEENDHPFHRGEGPGPRGLNLRRGNPSLKGPPAQPLAQRLCSMVRFSLLALSFNILLLVAIC VIGSQSAQLQAELWSLKEAFSNFSSSTLMEVHALGTHGGSVGDKITSLGDKLEKQQDLKADHDILLLHLKHFPV DLRFVACQMELLHSNGSQRTCCPVNWVEHQGSCYWFSRSGKAWAEAEKYCQLENSHLVVINSWEEQKFIVQH TNPFNTWIGLTDSDGSWKWVDGTDYRHNYKNWAVTQPDDWHGHELGGSEDCVEVRPDGRWNDDFCLQVHR WVCEKRRNATGEAAHHHHHH | pTT5, pSLX235a | 69 |
| pigASGR2::6xHis | 1-283 | 6xHis | MARDFQDIQQLSEEENDHQLGRGTPLPQPLVLQRLCSKLRLSLLVLGFNVLMLVAVCVVGSQRTQLQMELQTLK ETFSNFSSSLLMEMLTSTRGGSAGDKVTSLEAKMEKQQQDLKADHATLRLHLKHFPDVRTLTCRLVFLQSNG TECCPVNWVDYEGSCYWFSRSGKAWAEAEKYCQLENAHLVVINSREEQKFIAQRTNPFQTWIGLTDSDGSWK WVDGTDYGNGYKNWGALQPDDWQGHELGGSEDCVEIQGDGRWNDFCQQVKRWVCEMKQNITMHHHHHH | pTT5, pSLX235a | 70 |
| cyASGR2(L225P) | 1-306 | None | MAKDFQDIQQLSSEENDHPFHRGEGPGPRGLNLRRGNPSLKGPPAQPLAQRLCSMVRFSLLALSFNILLLVAIC VIGSQSAQLQAELWSLKEAFSNFSSSTLMEVHALGTHGGSVGDKITSLGDKLEKQQDLKADHDILLLHLKHFPV DLRFVACQMELLHSNGSQRTCCPVNWVEHQGSCYWFSRSGKAWAEAEKYCQLENSHLVVINSWEEQKFIVQH TNPFNTWIGLTDSDGSWKWVDGTDYRHNYKNWAVTQPDDWHGHELGGSEDCVEVRPDGRWNDDFCLQVHR WVCEKRRNATGEAA | pTT5, pSLX235a | 71 |
| pigASGR2 | 1-283 | None | MARDFQDIQQLSEEENDHQLGRGTPLPQPLVLQRLCSKLRLSLLVLGFNVLMLVAVCVVGSQRTQLQMELQTLK ETFSNFSSSLLMEMLTSTRGGSAGDKVTSLEAKMEKQQQDLKADHATLRLHLKHFPDVRTLTCRLVFLQSNG TECCPVNWVDYEGSCYWFSRSGKAWAEAEKYCQLENAHLVVINSREEQKFIAQRTNPFQTWIGLTDSDGSWK WVDGTDYGNGYKNWGALQPDDWQGHELGGSEDCVEIQGDGRWNDFCQQVKRWVCEMKQNITM | pTT5, pSLX235a | 72 |
| dogASGR1 | 1-284 | None | MTNDYQDLQHLDNEDNDHHLRQVPPAPGQPLLRRLCSGPCLLLLSLGLSVLLLVVVCVIGSQNSKLRGELQALRET FSNFTASTEVEVKALSSQGGNVGRKMKSLESQLEKQQOKDLSEDHSDLLHVKQFVSDLRSLSCQIAALHGNGSTL TCCPVNWLEVEGSCYWFSRSGKSWPEADKYCQLESAHLVVVNSREEQKFIQHHMGPVNTWMGLTDQSGPWK WVDGTDYETGFKNWRPEQPDDWYGHGLGGGEDCAHFTDDGRWNDDVCQRPYRWVCEAARDPAT | pTT5, pSLX235a | 73 |
| pigASGR1 | 1-286 | None | MTKEYQDLQHLDNEENDQCHRKGPPPPQPSLLRRLCSGPLLLRRLCSGPCLLLLLSMGLSLLLLHVKQFVSGNSKLQEELQALRET FSNLTASTDEAKVKTLSMQGGNVGRKMKSLESQLEKQQKDLSEDHSSLLLHVKQFVSDLRSLSCQMAVLQGNGS ERTCCPVNWVGYEGSCYWFSRSGKPWPEAEKYCQLENAHLVVVGSWEEQKFIQHHVGPVNSWIGLTDQSGP WKWVDGTDYESSGFKNWRPEQPDDWYGHGLGGGEDCAHFTEDGGWNDDICQRPYRWVCETQRDRDSGS | pTT5, pSLX235a | 74 |
| dogASGR1::Flag | 1-284 | Flag | MTNDYQDLQHLDNEDNDHHLRQVPPAPGQPLLRRLCSGPCLLLLSLGLSVLLLVVVCVIGSQNSKLRGELQALRET FSNFTASTEVEVKALSSQGGNVGRKMKSLESQLEKQQKDLSEDHSDLLLHVKQFVSDLRSLSCQIAALHGNGSTL TCCPVNWLEYEGSCYWFSRSGKSWPEADKYCQLESAHLVVNSREEQKFIQHHMGPVNTWMGLTDQSGPWK WVDGTDYETGFKNWRPEQPDDWYGHGLGGGEDCAHFTDDGRWNDDVCQRPYRWVCEAARDPATDYKDDD DK | pTT5, pSLX235a | 75 |

FIGURE 48
(Continued)

| | | | | |
|---|---|---|---|---|
| pigASGR1::Flag | 1-286 | Flag | MTKEYQDLQHLDNEENDQQHRKGPPPQPSLLRRLCSGPCLLLISMGLSLLLLVVVCVIGSQNSKLQEELQALRET FSNLTASTDAKVKTLSMQGGNVGRKMKSLESQLEKQQQDLSEDHSSLLLHVKQFVSDLRSLSCQMAVLQGNGS ERTCCPVNWVGYEGSCYWFSRSGKPWPEAEKYCQLENAHLVVVGSWEEQKFIQHHVGPVNSWIGLTDQSGP WKWVDGTDYESGFKNWRPEQPDDWYGHGLGGGEDCAHFTEDGGWNDDICQRPYRWVCETQRDRDSGSDY KDDDDK | pTT5, pSLX235a | 76 |
| huASGR1(deCODE) | 1-94. | None | MTKEYQDLQHLDNEESDHHQLRKGPPPPQPLLQRLCSGPRLLLLSLGLSLLLLVVVCVIGSQNSQLQEELRGLRE TFSNFTASTEAQEAMWEER | pJF1 | 77 |
| huASGR1(deCODE)::Myc | 1-94. | Myc | MTKEYQDLQHLDNEESDHHQLRKGPPPPQPLLQRLCSGPRLLLLSLGLSLLLLVVVCVIGSQNSQLQEELRGLRE TFSNFTASTEAQEAMWEERGQQKLISEEDL | pTT5 | 0 |

FIGURE 49

Table 2A
Standard
IgG Antibody
VL CDRs

| iPS# | Ab | Type | CDR1 | CDR2 | CDR3 |
|---|---|---|---|---|---|
| iPS:451135 | 21-225_64A11 | NA | CGGGCAAGTCGGAGCGTTAGCAGATATTTAAAT<br>SEQ ID NO:79 | GTTGCATCCGTTTGCAAAGT<br>SEQ ID NO:8091 | CAACAGAGTGACAGTTTCCTCTCACT<br>SEQ ID NO:16103 |
| | | AA | RASRSVSRYLN<br>SEQ ID NO:80 | VASRLQS<br>SEQ ID NO:8092 | QQSDSFPLT<br>SEQ ID NO:16104 |
| iPS:451141 | 21-225_164B11 | NA | AAGTCCAGCCAGAGTCTTTAAAGAGCTCCAACAATAAGAGCTACTTAGCT<br>SEQ ID NO:81 | TGGGCATCTTCCCGGGAATCC<br>SEQ ID NO:8093 | CAGCAATATTATAGTATTCCTCCCACT<br>SEQ ID NO:16105 |
| | | AA | KSSQSLLKSSNNKSYLA<br>SEQ ID NO:82 | WASSRES<br>SEQ ID NO:8094 | QQYYSIPPT<br>SEQ ID NO:16106 |
| iPS:451137 | 21-225_74A7 | NA | AAGTCCAGCCAGAGTGTTTATTCAGCTCCAACAATTATAACTACTTAGCT<br>SEQ ID NO:83 | TGGGCATCTACCCGGGAATCC<br>SEQ ID NO:8095 | CAGCAATATCATAGTTCTCCTCCGACG<br>SEQ ID NO:16107 |
| | | AA | KSSQSVLFSSNNYNYLA<br>SEQ ID NO:84 | WASTRES<br>SEQ ID NO:8096 | QQYHSSPPT<br>SEQ ID NO:16108 |
| iPS:451139 | 21-225_71A6 | NA | AAGTCTAGTCAGAGCCTCCTGCGTAGTGATGGAAAGACCCTATTTGTAT<br>SEQ ID NO:85 | GAAGTTCCAACGGTTCTCT<br>SEQ ID NO:8097 | ATGCAAAGTAAACAGCTTCCTCTCACT<br>SEQ ID NO:16109 |
| | | AA | KSSQSLLRSDGKTHLY<br>SEQ ID NO:86 | EVSNRFS<br>SEQ ID NO:8098 | MQSKQLPLT<br>SEQ ID NO:16110 |

FIGURE 49
(Continued)

| | | | | | |
|---|---|---|---|---|---|
| iPS:451143 | | NA | CCGGGGAGTCAGGGCATTAG CAATTATTAGCT SEQ ID NO:87 | GGTGCATTCAATTTGCAC AGT SEQ ID NO:8099 | CAACAGTATAGTTGTTACCC ATTCACT SEQ ID NO:16111 |
| | 21-225_66H11 | AA | PASQGISNYLA SEQ ID NO:88 | GAFNLHS SEQ ID NO:8100 | QQYSCYPFT SEQ ID NO:16112 |
| iPS:453445 | | NA | TCTGGAGATAAATGGGTAA TAAATATGTTGT SEQ ID NO:89 | CAAGATAGCAAGCGGCC CTCA SEQ ID NO:8101 | CAGGGGTGGGACAGGAACAC TTATGTGGTG SEQ ID NO:16113 |
| | 21-225_148E10 | AA | SGDKLGNKYVC SEQ ID NO:90 | QDSKRPS SEQ ID NO:8102 | QAWDRNTYVV SEQ ID NO:16114 |
| iPS:453447 | | NA | CGGGGGGTCAGGGTATTAG CACATGGTTAGCA SEQ ID NO:91 | GCTGCATCCATTTTGCAA AGT SEQ ID NO:8103 | CAACAGGGTAACATTTCCC ATTCACT SEQ ID NO:16115 |
| | 21-225_65F10 | AA | RGGQGISTWLA SEQ ID NO:92 | AASILQS SEQ ID NO:8104 | QQGNIPFT SEQ ID NO:16116 |
| iPS:453449 | | NA | CGGACAAGTCAGGGCATTAG AAATGATTTAGGC SEQ ID NO:93 | GCTGCATCCAGTTTGCTT AGT SEQ ID NO:8105 | CTACAGTATAATAGTTACCC TCCCACC SEQ ID NO:16117 |
| | 21-225_208A2 | AA | RTSQGIRNDLG SEQ ID NO:94 | AASSLLS SEQ ID NO:8106 | LQYNSYPPT SEQ ID NO:16118 |
| iPS:453451 | | NA | CGGGCGAGTCAGGGTATTAG CAAATGGTTAGCC SEQ ID NO:95 | GCTGCATCCAGTTTGCAA AGT SEQ ID NO:8107 | CAACAGGCTAACAGTTTCCC ATTCACT SEQ ID NO:16119 |
| | 21-225_52G11 | AA | RASQGISKWLA SEQ ID NO:96 | AASSLQS SEQ ID NO:8108 | QQANSFPFT SEQ ID NO:16120 |
| iPS:453453 | | NA | CGGGCGAGTCAGGGTATTAG CAAGTGGTTAGCC SEQ ID NO:97 | GCTGCATCCAGTTTGCAA AGT SEQ ID NO:8109 | CAACAGGCTAACAGTTTCCC ATTCACT SEQ ID NO:16121 |
| | 21-225_53F2 | AA | RASQGISKWLA SEQ ID NO:98 | AASSLQS SEQ ID NO:8110 | QQANSFPFT SEQ ID NO:16122 |

FIGURE 49
(Continued)

| | | | | | |
|---|---|---|---|---|---|
| iPS:468810 | 21-225_74D5 | NA | AGGGCCAGTCAGAGTGTTAACAGCAACTACTTAGCC SEQ ID NO:99 | GGTGCATCCAGCAGGGCCACT SEQ ID NO:8111 | CAGCAGTATGAAAGCTCGCCGTGGACG SEQ ID NO:16123 |
| | | AA | RASQSVNSNYLA SEQ ID NO:100 | GASSRAT SEQ ID NO:8112 | QQYESSPWT SEQ ID NO:16124 |
| iPS:468812 | 21-225_48H4 | NA | CGGGCAAGTCAGTCGAGACATTAGAAATGATTTAGGC SEQ ID NO:101 | GCTGCATCCAGTCAGTTTGCAAAGT SEQ ID NO:8113 | CTACAACATTATAGTTACCGCTCACT SEQ ID NO:16125 |
| | | AA | RASRDIRNDLG SEQ ID NO:102 | AASSLQS SEQ ID NO:8114 | LQHYSYPLT SEQ ID NO:16126 |
| iPS:468816 | 21-225_52G8 | NA | AAGTCTAGTCAGAGCCTCCTGCATAGTGAAGGAAAGACCTATTTGTAT SEQ ID NO:103 | GAAGTTTCCAAGCGGCTCTCT SEQ ID NO:8115 | ATGCAAAGTATGCAGCTTCCGATTATC SEQ ID NO:16127 |
| | | AA | KSSQSLLHSEGKTYLY SEQ ID NO:104 | EVSKRLS SEQ ID NO:8116 | MQSMQLPII SEQ ID NO:16128 |
| iPS:468814 | 21-225_223D11 | NA | CGGGCGAGTCAGGGCATTAGCAATTATTTAGCC SEQ ID NO:105 | GCTGCATCCACTTTGCAAAGT SEQ ID NO:8117 | CAACAGTATAGTGGTTACCATTCACT SEQ ID NO:16129 |
| | | AA | RASQGISNYLA SEQ ID NO:106 | AASTLQS SEQ ID NO:8118 | QQYSGYPFT SEQ ID NO:16130 |
| iPS:468822 | 21-225_147E10 | NA | AAGTCTAGTCAGGCGCTCCTGCATGGTGATGGAAAGACCTTCT SEQ ID NO:107 | GAAGTTTCCAACCGGTCTCT SEQ ID NO:8119 | ATGCAAAGTATACAGGTTCCGTGGACG SEQ ID NO:16131 |
| | | AA | KSSQRLLHGDGKTYLY SEQ ID NO:108 | EVSNRFS SEQ ID NO:8120 | MQSIQVPWT SEQ ID NO:16132 |
| iPS:468824 | 21-225_73G6 | NA | CGGGCAAGTCAGGGCATTAGAAATGATTTAGGC SEQ ID NO:109 | GCTGCATCCAGTTTGCAAAGT SEQ ID NO:8121 | CTACAGCATAATAGTTACCGCTCACT SEQ ID NO:16133 |

FIGURE 49
(Continued)

| | | | | | | |
|---|---|---|---|---|---|---|
| iPS:468818 | 21-225_190C8 | AA | RASQGIRNDLG | AASSLQS | LQHNSYPLT | |
| | | | SEQ ID NO:110 | SEQ ID NO:8122 | SEQ ID NO:16134 | |
| | | NA | CGGGCAAGTCAGGGCATTAG AAATGATTTAGGC | GCTGCATCCAGTTTGCAA AGT | CTACAGCATAATGATTACC GTTCACT | |
| | | | SEQ ID NO:111 | SEQ ID NO:8123 | SEQ ID NO:16135 | |
| iPS:468826 | 21-225_201C5 | AA | RASQGIRNDLG | AASSLQS | LQHNDYPFT | |
| | | | SEQ ID NO:112 | SEQ ID NO:8124 | SEQ ID NO:16136 | |
| | | NA | CGGGCAAGTCAGGGCATTAG ACATGATTTAGGC | GCTGCATCCAGTTTGCAA AGT | CTACAGCATTATAGTTTCCCT CGGACG | |
| | | | SEQ ID NO:113 | SEQ ID NO:8125 | SEQ ID NO:16137 | |
| iPS:468828 | 21-225_162A10 | AA | RASQGIRHDLG | AASSLQS | LQHYSFPRT | |
| | | | SEQ ID NO:114 | SEQ ID NO:8126 | SEQ ID NO:16138 | |
| | | NA | AGGGCCAGTCAGAGTGTTAA CAGCAACTTAGCC | GGTGCATCCACCAGGGC CACT | CAGCAGTATAATGACTGGCC GTGCAGT | |
| | | | SEQ ID NO:115 | SEQ ID NO:8127 | SEQ ID NO:16139 | |
| iPS:468830 | 21-225_191G11 | AA | RASQTVNSNLA | GASTRAT | QQYNDWPCS | |
| | | | SEQ ID NO:116 | SEQ ID NO:8128 | SEQ ID NO:16140 | |
| | | NA | AGGACCAGTCAGAGTGTTTG GATTAGCGTAGCC | GGTGCAGCCACCAGGGC CACT | CAGCAGTATAATTACTGGCC GCTCACT | |
| | | | SEQ ID NO:117 | SEQ ID NO:8129 | SEQ ID NO:16141 | |
| iPS:468832 | 21-225_76H10 | AA | RTSQSVWISVA | GAATRAT | QQYNYWPLT | |
| | | | SEQ ID NO:118 | SEQ ID NO:8130 | SEQ ID NO:16142 | |
| | | NA | CGGGCAAGTCAGGACATTAG AAATTATTTAGGC | GGTGCATCCAGTTTGCA AAGT | CTACAGTATAATAGTTACC ATTCACT | |
| | | | SEQ ID NO:119 | SEQ ID NO:8131 | SEQ ID NO:16143 | |
| iPS:468834 | 21-225_94G10 | AA | RASQDIRNYLG | GASSLQS | LQYNSYPFT | |
| | | | SEQ ID NO:120 | SEQ ID NO:8132 | SEQ ID NO:16144 | |
| | | NA | AGGGCCAGTCAGAGTGTTAA CAGCAACTACTTAGCC | GGTGCATCCAGCAGGGC CACT | CAGCAGTATGAAAGCTCGCC GTGGACG | |
| | | | SEQ ID NO:121 | SEQ ID NO:8133 | SEQ ID NO:16145 | |

FIGURE 49
(Continued)

| | | | RASQSVNSNYLA | GASSRAT | QQYESSPWT |
|---|---|---|---|---|---|
| iPS:468836 | | AA | SEQ ID NO:122 | SEQ ID NO:8134 | SEQ ID NO:16146 |
| | 21-225_198E3 | NA | CGGGCAAGTCAGGGCATAA GAAAAGATTTAGGC | GCTGCATCCAGTTTGCAA AGT | CTACAACATTATCGTTACCC TTTCACT |
| | | | SEQ ID NO:123 | SEQ ID NO:8135 | SEQ ID NO:16147 |
| iPS:468838 | | AA | RASQGIRKDLG | AASSLQS | LQHYRYPFT |
| | | | SEQ ID NO:124 | SEQ ID NO:8136 | SEQ ID NO:16148 |
| | 21-225_80E12 | NA | AGGGCCAGTCAGAGCGTTAA CAGCAACTACTAGCC | GGTGCATCCAGCAGGGC CACT | CAGCAGTATGAAAGCTCGCC GTGGACG |
| | | | SEQ ID NO:125 | SEQ ID NO:8137 | SEQ ID NO:16149 |
| iPS:468840 | | AA | RASQSVNSNYLA | GASSRAT | QQYESSPWT |
| | | | SEQ ID NO:126 | SEQ ID NO:8138 | SEQ ID NO:16150 |
| | 21-225_200H9 | NA | CGGGCAAGTCAGGGCATTAG AAATGATTTAGGC | GCTGCATCCAGTTTGCAA AGT | CTACAGCATAATAGTTACCC TCTCACT |
| | | | SEQ ID NO:127 | SEQ ID NO:8139 | SEQ ID NO:16151 |
| iPS:468820 | | AA | RASQGIRNDLG | AASSLQS | LQHNSYPLT |
| | | | SEQ ID NO:128 | SEQ ID NO:8140 | SEQ ID NO:16152 |
| | 21-225_76E10 | NA | AGGGCCAGTCAGAGTGTTAA CAGCAACTACTAGCC | GGTGCATCCAGCAGGGC CACT | CAGCAGTATGAAAGCTCGCC GTGGACG |
| | | | SEQ ID NO:129 | SEQ ID NO:8141 | SEQ ID NO:16153 |
| iPS:468842 | | AA | RASQSVNSNYLA | GASSRAT | QQYESSPWT |
| | | | SEQ ID NO:130 | SEQ ID NO:8142 | SEQ ID NO:16154 |
| | 21-225_50H4 | NA | CGGGCAAGTCAGGGCATTAG AAATGATTTAGGC | GCTGCATCCAGTTTGCAA AGT | CTACAACATTATAGTTACCC TCGGACG |
| | | | SEQ ID NO:131 | SEQ ID NO:8143 | SEQ ID NO:16155 |
| iPS:468844 | | AA | RASQGIRNDLG | AASSLQS | LQHYSYPRT |
| | | | SEQ ID NO:132 | SEQ ID NO:8144 | SEQ ID NO:16156 |
| | 21-225_48E10 | NA | CGGGCAAGTCAGGGCATTAG AAGTGATTTAGGC | ACTGCATCCAGTTTGCAA AGT | CTACAGTATAATAGTTACCC ATTCACT |
| | | | SEQ ID NO:133 | SEQ ID NO:8145 | SEQ ID NO:16157 |

FIGURE 49
(Continued)

| | | | | | | |
|---|---|---|---|---|---|---|
| iPS:468846 | | AA | RASQGIRSDLG<br>SEQ ID NO:134 | TASSLQS<br>SEQ ID NO:8146 | LQYNSYPFT<br>SEQ ID NO:16158 | |
| | 21-225_53B10 | NA | CGGGCAAGTCAGGACATTAG<br>AAATTATTTAGGC<br>SEQ ID NO:135 | GGTGCATCCAGTTTGCA<br>AAGT<br>SEQ ID NO:8147 | CTACAGTATAATAGTTACCC<br>ATTCACT<br>SEQ ID NO:16159 | |
| iPS:468848 | | AA | RASQDIRNYLG<br>SEQ ID NO:136 | GASSLQS<br>SEQ ID NO:8148 | LQYNSYPFT<br>SEQ ID NO:16160 | |
| | 21-225_54B1 | NA | CGGGCAAGTCAGAACATTAG<br>CAGCTATTTAAAT<br>SEQ ID NO:137 | GCTGCATCCAGTTTGCAT<br>AGT<br>SEQ ID NO:8149 | CAACAGAGTTACAGAACCCC<br>TCTGTGGACG<br>SEQ ID NO:16161 | |
| iPS:468850 | | AA | RASQNISSYLN<br>SEQ ID NO:138 | AASSLHS<br>SEQ ID NO:8150 | QQSYRTPLWT<br>SEQ ID NO:16162 | |
| | 21-225_63F4 | NA | AAGTCCAGCCAGAGTGTTT<br>ATCCAGTCCAACAATAACA<br>ACTACTTAGCT<br>SEQ ID NO:139 | TGGGCATCTACCCGGGA<br>ATCC<br>SEQ ID NO:8151 | CAGCAATATATTATACTACTCC<br>GTGCAGT<br>SEQ ID NO:16163 | |
| iPS:468852 | | AA | KSSQSVLSSSNNNNYLA<br>SEQ ID NO:140 | WASTRES<br>SEQ ID NO:8152 | QQYYTTPCS<br>SEQ ID NO:16164 | |
| | 21-225_71F3 | NA | AAGTCCAGCCAGAGTGTTT<br>ATCCAACTCCAACAATAACA<br>ACTACTTAGCT<br>SEQ ID NO:141 | TGGGCATCTACCCGGGA<br>ATCC<br>SEQ ID NO:8153 | CAGCAATATATTATACTACTCC<br>GTGCAGT<br>SEQ ID NO:16165 | |
| iPS:468854 | | AA | KSSQSVLSNSNNNNYLA<br>SEQ ID NO:142 | WASTRES<br>SEQ ID NO:8154 | QQYYTTPCS<br>SEQ ID NO:16166 | |
| | 21-225_72C4 | NA | AGGTCTGGTCAAAGCCTCGT<br>ATACAGTGATGAAACACCT<br>ACTTGAAT<br>SEQ ID NO:143 | GAGGTTTCTAAGTGGGA<br>CTCT<br>SEQ ID NO:8155 | ATGCAAGGTACACACTGGCC<br>GCTCACT<br>SEQ ID NO:16167 | |
| | | AA | RSGQSLVYSDGNTYLN<br>SEQ ID NO:144 | EVSKWDS<br>SEQ ID NO:8156 | MQGTHWPLT<br>SEQ ID NO:16168 | |

FIGURE 49
(Continued)

| | | | | | |
|---|---|---|---|---|---|
| iPS:468856 | 21-225_77C9 | NA | AGGTCTAGTCAAAGCCTCGTTTACAGTGTTGGAAACACCTCCTTGAGT<br>SEQ ID NO:145<br>RSSQSLVSVGNTSLS<br>SEQ ID NO:146 | AAGGTTTCTAACTGGGACTCT<br>SEQ ID NO:8157<br>KVSNWDS<br>SEQ ID NO:8158 | ATGCAAGGTACACACTGGCCATTCACT<br>SEQ ID NO:16169<br>MQGTHWPFT<br>SEQ ID NO:16170 |
| iPS:468858 | 21-225_148C9 | AA | CGGGCAAGTCGGGGCATTAGAGATGATTTAGGC<br>SEQ ID NO:147<br>RASRGIRDDLG<br>SEQ ID NO:148 | GCTGCATCCAGTTTGCAGAGT<br>SEQ ID NO:8159<br>AASSLQS<br>SEQ ID NO:8160 | CTACAGCATTATAGTTATCCTCGGACG<br>SEQ ID NO:16171<br>LQHYSYPRT<br>SEQ ID NO:16172 |
| iPS:468860 | 21-225_224E7 | AA | CGGGCAAGTCAGGGCATTAGAAATGATTTAGGC<br>SEQ ID NO:149<br>RASQGIRNDLG<br>SEQ ID NO:150 | GCTGCATCCAGTTTGCAAAGT<br>SEQ ID NO:8161<br>AASSLQS<br>SEQ ID NO:8162 | CTACAACATTATAGTTACCCTCGGACG<br>SEQ ID NO:16173<br>LQHYSYPRT<br>SEQ ID NO:16174 |
| iPS:468862 | 21-225_178H8 | NA | ACTGGAACCAGCAGTGACGTTGGTGGTTATAATTTTGTCTCC<br>SEQ ID NO:151<br>TGTSSDVGGYNFVS<br>SEQ ID NO:152 | GAGGTCAGTAATCGGCCCTCA<br>SEQ ID NO:8163<br>EVSNRPS<br>SEQ ID NO:8164 | AGCTCATATACAAGCAGCTACACTTGGGTG<br>SEQ ID NO:16175<br>SSYTSSYTWV<br>SEQ ID NO:16176 |
| iPS:468864 | 21-225_60D6 | AA | TCTGGAAGCAGCTCCAACATCGGAAGTAATACTGTAAAC<br>SEQ ID NO:153<br>SGSSSNIGSNTVN<br>SEQ ID NO:154 | AGTAATAATCAGCGGCCCTCA<br>SEQ ID NO:8165<br>SNNQRPS<br>SEQ ID NO:8166 | GCAGCATGGGATGACAGCCTGAATGGTCCG<br>SEQ ID NO:16177<br>AAWDDSLNGP<br>SEQ ID NO:16178 |
| iPS:468866 | | NA | ACTGGAGATGCAATGCCGAAAAAATATGCTTAT | GAGGACAAGCGACCCTCC | AACTCAACAGACAGCAGTGGTAATCGGGTG |

FIGURE 49
(Continued)

| | | | | | | |
|---|---|---|---|---|---|---|
| iPS:468868 | 21-225_190C1 | AA | SEQ ID NO:155<br>TGIDAMPKKYAY | SEQ ID NO:8167<br>EDSKRPS | SEQ ID NO:16179<br>NSTDSSGNRV | |
| iPS:468870 | 21-225_74A1 | NA | SEQ ID NO:156<br>CGGGCAAGTCAGGGCATTAG<br>AAATGATTAGGC | SEQ ID NO:8168<br>GCTGCATCCAGTTTGCAA<br>AGT | SEQ ID NO:16180<br>CTACAGCATGATAGTTACCC<br>TCTCACT | |
| | 21-225_74A8 | AA | SEQ ID NO:157<br>RASQGIRNDLG | SEQ ID NO:8169<br>AASSLQS | SEQ ID NO:16181<br>LQHDSYPLT | |
| | | NA | SEQ ID NO:158<br>AAGTCCAGCAGAGAGTGTTT<br>GTACAGCTCCAACAGTCACA<br>ACTACTTAGCT | SEQ ID NO:8170<br>TGGGCATCTACCCGGGA<br>ATCC | SEQ ID NO:16182<br>CAGCAATATTATAGTACTCC<br>GTGCAGT | |
| | | AA | SEQ ID NO:159<br>KSSQSVLYSSNSHNYLA | SEQ ID NO:8171<br>WASTRES | SEQ ID NO:16183<br>QQYYSTPCS | |
| iPS:472730 | 21-225_14B1_LC1 | NA | SEQ ID NO:160<br>CGGGCAAGTCAGGACATTAG<br>AGATAATTTAGGC | SEQ ID NO:8172<br>ACTGCATACAGTTTGCA<br>AAGT | SEQ ID NO:16184<br>CTACAACATTATAATTACCC<br>GCTCACT | |
| | | AA | SEQ ID NO:161<br>RASQDIRDNLG | SEQ ID NO:8173<br>TAYSLQS | SEQ ID NO:16185<br>LQHYNYPLT | |
| iPS:472731 | 21-225_14B1_LC2 | NA | SEQ ID NO:162<br>TCTGGAGATAAATTGGGGA<br>TAAATATGCTTAC | SEQ ID NO:8174<br>CAAGATAGGAAGCGCCC<br>CTCA | SEQ ID NO:16186<br>CAGGCGTGGGACAACAGCAC<br>TGTGGTG | |
| | | AA | SEQ ID NO:163<br>SGDKLGDKYAY | SEQ ID NO:8175<br>QDRKRPS | SEQ ID NO:16187<br>QAWDNSTVV | |
| iPS:472732 | 21-225_2B10_LC1 | NA | SEQ ID NO:164<br>AGGTCTAGTCAAAGGCCTCGT<br>ATACAGTGATGGAAACACCT<br>TCTTGAAT | SEQ ID NO:8176<br>AAGGTTTCTAACTGGGA<br>CTCT | SEQ ID NO:16188<br>ATACAAGGTACGGCACTGGCC<br>TTTCCCC | |
| | | AA | SEQ ID NO:165<br>RSSQSLVYSDGNTFLN | SEQ ID NO:8177<br>KVSNWDS | SEQ ID NO:16189<br>IQGTHWPFP | |
| | | | SEQ ID NO:166 | SEQ ID NO:8178 | SEQ ID NO:16190 | |

FIGURE 49
(Continued)

| | | | | | |
|---|---|---|---|---|---|
| iPS:472733 | 21-225_2B10_LC2 | NA | ACTGGAACCAGCAGTGACGTTGGTGGTTATAATTTGTCTCC<br>SEQ ID NO:167 | GAGGTCAGTAATCGGCCCTCA<br>SEQ ID NO:8179 | AGCTCATATACAAGCACCGGCACGTGGTA<br>SEQ ID NO:16191 |
| | | AA | TGTSSDVGGYNFVS<br>SEQ ID NO:168 | EVSNRPS<br>SEQ ID NO:8180 | SSYTSTGTVV<br>SEQ ID NO:16192 |
| iPS:473253 | 21-225_7C3_LC1 | NA | CGGGCAAGTCAGGGCATTAGAAGTGATTTAGGC<br>SEQ ID NO:169 | GCTGCATCCAGTTTGCAAAGT<br>SEQ ID NO:8181 | CTACAGCATAATAGTTACCTCCCCATCACC<br>SEQ ID NO:16193 |
| | | AA | RASQGIRSDLG<br>SEQ ID NO:170 | AASSLQS<br>SEQ ID NO:8182 | LQHNSYLPIT<br>SEQ ID NO:16194 |
| iPS:473254 | 21-225_7C3_LC2 | NA | CGGGCGAGTCAGGGTATTAGCAGCTGGTTAGCC<br>SEQ ID NO:171 | GCTGCATCCAGGTTGCAAAGT<br>SEQ ID NO:8183 | CAACAGGCTAACAGTTTCCCATTCACT<br>SEQ ID NO:16195 |
| | | AA | RASQGISSWLA<br>SEQ ID NO:172 | AASRLQS<br>SEQ ID NO:8184 | QQANSFPFT<br>SEQ ID NO:16196 |
| iPS:473255 | 21-225_9F12_LC1 | NA | CGGGCGAGTCAGGGTATTAGCAGCTGGTTAGCC<br>SEQ ID NO:173 | GCTGCATCCAGGTTGCAAAGT<br>SEQ ID NO:8185 | CAACAGGCTAACAGTTTCCCATTCACT<br>SEQ ID NO:16197 |
| | | AA | RASQGISRWLA<br>SEQ ID NO:174 | AASRLQS<br>SEQ ID NO:8186 | QQANSFPFT<br>SEQ ID NO:16198 |
| iPS:473256 | 21-225_9F12_LC2 | NA | CGGGCAAGTCAGGGCATTAGAAATGATTTAGGC<br>SEQ ID NO:175 | GCTGCATCCAGTTTGCAAAGT<br>SEQ ID NO:8187 | CTACAGCATAATAGTTACCTCCCCATCACC<br>SEQ ID NO:16199 |
| | | AA | RASQGIRNDLG<br>SEQ ID NO:176 | AASSLQS<br>SEQ ID NO:8188 | LQHNSYLPIT<br>SEQ ID NO:16200 |
| iPS:472742 | 21-225_30D9_LC2 | NA | TCTGGAGATAAATTGGGGATAAATATGTTTAC<br>SEQ ID NO:177 | CAAGATAGGAAGCGGCCCTCA<br>SEQ ID NO:8189 | CAGGCGTGGACAACAGCACTGCGGTA<br>SEQ ID NO:16201 |
| | | AA | SGDKLGDKYVY | QDRKRPS | QAWDNSTAV |

FIGURE 49
(Continued)

| | | | | | | |
|---|---|---|---|---|---|---|
| iPS:472741 | 21-225_30D9_LC1 | NA | SEQ ID NO:178 AGGTCTAGTCAAAGCCTCGTATCCAGTGATGGAAACACCTTCTTGAAT | SEQ ID NO:8190 AAGGTTTCTAACTGGGACTCT | SEQ ID NO:16202 TTGCAAGGTACACACTGGCCTCTCACC |
| | | AA | SEQ ID NO:179 RSSQSLVSSDGNTFLN | SEQ ID NO:8191 KVSNWDS | SEQ ID NO:16203 LQGTHWPLT |
| iPS:472743 | 21-225_68G6 | NA | SEQ ID NO:180 TCTGGAGATAAATTGGGGGATAAATATACTTAC | SEQ ID NO:8192 CAAGATAGGAAGCGGCCCTCA | SEQ ID NO:16204 CAGGCGTGGACAATAGTACTGCGGTA |
| | | AA | SEQ ID NO:181 SGDKLGDKYTY | SEQ ID NO:8193 QDRKRPS | SEQ ID NO:16205 QAWDNSTAV |
| iPS:392573 | 21-225_15G2 | NA | SEQ ID NO:182 ACTGGAACCAGCAGTGACGTTGGTGGTTATAACTATGTCTCC | SEQ ID NO:8194 GAGGTCAGTAATCGGCCCTCA | SEQ ID NO:16206 ACCTCATATACAAGCACCAGCACTGTGGTC |
| | | AA | SEQ ID NO:183 TGTSSDVGGYNYVS | SEQ ID NO:8195 EVSNRPS | SEQ ID NO:16207 TSYTSTSTVV |
| iPS:392583 | 21-225_10B10 | NA | SEQ ID NO:184 TCTGGAGATAAATTGGGGAATAAATATGCTTGG | SEQ ID NO:8196 CAAGATAGGAAGCGGCCCTCA | SEQ ID NO:16208 CAGGCGTGGGACAACAGCACTGTGGTT |
| | | AA | SEQ ID NO:185 SGDKLGNKYAW | SEQ ID NO:8197 QDRKRPS | SEQ ID NO:16209 QAWDNSTVV |
| iPS:392585 | 21-225_14H11 | NA | SEQ ID NO:186 TCTGGAGATAAATTGGGGGAAAAATATGTTTGC | SEQ ID NO:8198 CAAGATACCAAGCGGCCCTCA | SEQ ID NO:16210 CAGGCGTGGGACAGCAGCACTATA |
| | | AA | SEQ ID NO:187 SGDKLGEKYVC | SEQ ID NO:8199 QDTKRPS | SEQ ID NO:16211 QAWDSSTI |
| iPS:392587 | | NA | SEQ ID NO:188 TCTGGAGAGAAATTGGGGGATAAATATGTTTGT | SEQ ID NO:8200 CAAGATAGCAAGCGGCCCTCA | SEQ ID NO:16212 CAGGCGTGGAACAGCAGCAATGTGGTA |

FIGURE 49
(Continued)

| | | | | | | |
|---|---|---|---|---|---|---|
| iPS:392589 | 21-225_18G5 | AA | SEQ ID NO:189<br>SGEKLGDKYVC | | SEQ ID NO:8201<br>QDSKRPS | | SEQ ID NO:16213<br>QAWNSSNVV |
| iPS:392593 | 21-225_27H2 | NA | SEQ ID NO:190<br>TCTGGAGATAAATTGGGGA<br>TAAATATGCTTCC | SEQ ID NO:8202<br>CAAGATGGCAAGCGGCC<br>CTCA | SEQ ID NO:16214<br>CAGGCGTGGGACAGCAGCAC<br>TTATGTGGTA |
| | | AA | SEQ ID NO:191<br>SGDKLGDKYAS | SEQ ID NO:8203<br>QDGKRPS | SEQ ID NO:16215<br>QAWDSSTYVV |
| iPS:392596 | 21-225_3E10 | NA | SEQ ID NO:192<br>GGGGAAACAACATTGGAA<br>GTAAAGCTGTGCAC | SEQ ID NO:8204<br>AGCGATAGCAACCGGCC<br>CTCA | SEQ ID NO:16216<br>CAGGTGTGGGACAGTAGTAG<br>TGATCATGTGGTA |
| | | AA | SEQ ID NO:193<br>GGNNIGSKAVH | SEQ ID NO:8205<br>SDSNRPS | SEQ ID NO:16217<br>QVWDSSSDHVV |
| iPS:392598 | 21-225_12D8 | NA | SEQ ID NO:194<br>ACCCTAAGCAGTGAGCACAG<br>CACCTACCACCATCGAA | SEQ ID NO:8206<br>GTTAAGAGTGATGGCAG<br>CCACAGCAAGGGGGAC | SEQ ID NO:16218<br>GGAGAGAGCCACACGATTGA<br>TGGCCAAGTCGGTGTGTGGTA |
| | | AA | SEQ ID NO:195<br>TLSSEHSTYTIE | SEQ ID NO:8207<br>VKSDGSHSKGD | SEQ ID NO:16219<br>GESHTIDGQVGVV |
| iPS:392618 | 21-225_18E10 | NA | SEQ ID NO:196<br>TCTGGAGATAGATTGGGGA<br>TAAATATGCTTGG | SEQ ID NO:8208<br>CAAGATCGCAAGCGGCC<br>CTCA | SEQ ID NO:16220<br>CAGGCGTGGGACAGCAGCAC<br>AGTGGTA |
| | | AA | SEQ ID NO:197<br>SGDRLGDKYAW | SEQ ID NO:8209<br>QDRKRPS | SEQ ID NO:16221<br>QAWDSSTVV |
| | 21-225_16F10 | NA | SEQ ID NO:198<br>AAGTCTAGTCAGAGCCTCCT<br>GCATAGTGATGGAAAGACCCTCT<br>AITTGAAT | SEQ ID NO:8210<br>GAAGTTTCCTACCGGTTC<br>TCT | SEQ ID NO:16222<br>TTTCAAAGTATACAGCTTCC<br>GCTCACT |
| | | AA | SEQ ID NO:199<br>KSSQSLLHSDGKTHLN | SEQ ID NO:8211<br>EVSYRFS | SEQ ID NO:16223<br>FQSIQLPLT |
| | | | SEQ ID NO:200 | SEQ ID NO:8212 | SEQ ID NO:16224 |

FIGURE 49
(Continued)

| | | | | | |
|---|---|---|---|---|---|
| iPS:392620 | NA | CGGGGGAGTCAGGGCATTAG CAATTATTAGCC | GCTGCAICCAGTTTACAA AGT | CAACAGTATCATAGTTACCC ATTCACT |
| | | SEQ ID NO:201 | SEQ ID NO:8213 | SEQ ID NO:16225 |
| 21-225_17H5 | AA | RASQGISNYLA | AASSLQS | QQYHSYPFT |
| | | SEQ ID NO:202 | SEQ ID NO:8214 | SEQ ID NO:16226 |
| iPS:392622 | NA | CGGGCAAGTCAGGGCATTAG AAATGATTTAGGC | GGTGCATCCAGTTTGCA AAGT | CTACAGCATAATAGTTACCC ACTCACT |
| | | SEQ ID NO:203 | SEQ ID NO:8215 | SEQ ID NO:16227 |
| 21-225_17H8 | AA | RASQGIRNDLG | GASSLQS | LQHNSYPLT |
| | | SEQ ID NO:204 | SEQ ID NO:8216 | SEQ ID NO:16228 |
| iPS:392624 | NA | CGGGCAAGTCAGGACATTAG AAATGATTTAGGC | GCTGCATCCAGTTTGCAA AGT | CTACAGCATTATAGTTATAT GTTCACT |
| | | SEQ ID NO:205 | SEQ ID NO:8217 | SEQ ID NO:16229 |
| 21-225_17H12 | AA | RASQGIRNDLG | AASSLQS | LQHYSYMFT |
| | | SEQ ID NO:206 | SEQ ID NO:8218 | SEQ ID NO:16230 |
| iPS:392626 | NA | CGGGCAAGTCAGGGCATTAG AAATGATTTAGGC | GCTGCATCCAGTTTGCAA AGT | CTACAGCATAATAGTTACCC GTGGACG |
| | | SEQ ID NO:207 | SEQ ID NO:8219 | SEQ ID NO:16231 |
| 21-225_18A5 | AA | RASQGIRNDLG | AASSLQS | LQHNSYPWT |
| | | SEQ ID NO:208 | SEQ ID NO:8220 | SEQ ID NO:16232 |
| iPS:392628 | NA | CGGGCAAGTCAGGGCATTAG AAATGATTTAGGC | GCTGCATCCAGTTTGCAA AGT | CTTCAACATGCTAGTTACCC GCTCACT |
| | | SEQ ID NO:209 | SEQ ID NO:8221 | SEQ ID NO:16233 |
| 21-225_20C2 | AA | RASQGIRNDLG | AASSLQS | LQHASYPLT |
| | | SEQ ID NO:210 | SEQ ID NO:8222 | SEQ ID NO:16234 |
| iPS:392630 | NA | CGGGCAAGTCAGGGCATTAG AAATGATTTAGGC | GCTGCATCCAGTTTGCAA AGT | CTACAGGCATAATAGTTACCC GCTCACT |
| | | SEQ ID NO:211 | SEQ ID NO:8223 | SEQ ID NO:16235 |
| 21-225_20E5 | AA | RASQGIRNDLG | AASSLQS | LQHNSYPLT |
| | | SEQ ID NO:212 | SEQ ID NO:8224 | SEQ ID NO:16236 |

FIGURE 49
(Continued)

| | | | | | |
|---|---|---|---|---|---|
| iPS:392632 | 21-225_16A11 | NA | CGGGCAAGTCAGGACATTAG AAATCATTAGGC | GCTGCATCCAGTTTGCAA AGT | CTACAGTATAATAGTTATCC ATTCACT |
| | | | SEQ ID NO:213 | SEQ ID NO:8225 | SEQ ID NO:16237 |
| | | AA | RASQDIRNHLG | AASSLQS | LQYNSYPFT |
| | | | SEQ ID NO:214 | SEQ ID NO:8226 | SEQ ID NO:16238 |
| iPS:392634 | 21-225_17H3 | NA | CGGGCAAGTCAGGGCATTAG AAGTGATTAGGC | GCTGCATCCAGTTTGCAA AGT | CTACAGCAATATAGTTACC TCGGACG |
| | | | SEQ ID NO:215 | SEQ ID NO:8227 | SEQ ID NO:16239 |
| | | AA | RASQGIRSDLG | AASSLQS | LQQYSYPRT |
| | | | SEQ ID NO:216 | SEQ ID NO:8228 | SEQ ID NO:16240 |
| iPS:392636 | 21-225_17A6 | NA | CGGGCAAGTCAGAGACCATTAG CAACTATTTAAAT | GCTGCTTCCAGTTTGCAA AGT | CAACAGAGTCACACTTCCCC GCTCACT |
| | | | SEQ ID NO:217 | SEQ ID NO:8229 | SEQ ID NO:16241 |
| | | AA | RASQTISNYLN | AASSLQS | QQSHTSPLT |
| | | | SEQ ID NO:218 | SEQ ID NO:8230 | SEQ ID NO:16242 |
| iPS:392638 | 21-225_17F9 | NA | CGGGCAAGTCAGGGCATTAG AAATGATTAGGC | GCTGTATCCAGTTTGCAA AGT | CTACAACATAATACTTATCC GCTCACT |
| | | | SEQ ID NO:219 | SEQ ID NO:8231 | SEQ ID NO:16243 |
| | | AA | RASQVIRNDLG | AVSSLQS | LQHNTYPLT |
| | | | SEQ ID NO:220 | SEQ ID NO:8232 | SEQ ID NO:16244 |
| iPS:392640 | 21-225_18A1 | NA | CGGGCAAGTCAGGGCATTAG AAATGATTTAGGC | GCTGCATCCAGTTTACAA AGT | CTACAGCATAATAGTTACC GCTCACT |
| | | | SEQ ID NO:221 | SEQ ID NO:8233 | SEQ ID NO:16245 |
| | | AA | RASQGIRNDLG | AASSLQS | LQHNSYPLT |
| | | | SEQ ID NO:222 | SEQ ID NO:8234 | SEQ ID NO:16246 |
| iPS:392642 | 21-225_18C6 | NA | CGGACAAGTCAGGGCATTAG AAATGATTTAGGC | GCTGCATCCAGTTTGCAA AGT | CTACAGGATAGTTCTTACC GCTCACT |
| | | | SEQ ID NO:223 | SEQ ID NO:8235 | SEQ ID NO:16247 |
| | | AA | RTSQGIRNDLG | AASSLQS | LQHSSYPLT |
| | | | SEQ ID NO:224 | SEQ ID NO:8236 | SEQ ID NO:16248 |

FIGURE 49
(Continued)

| | | | | | |
|---|---|---|---|---|---|
| iPS:392644 | 21-225_19E1 | NA | CGGGCAAGTCAGGGCATTAG AAATGATTAGGC SEQ ID NO:225 | GCTGCATCCAATTTACAA AGT SEQ ID NO:8237 | CTACAGCATAATAGTTTCCC GCTCACT SEQ ID NO:16249 |
| | | AA | RASQGIRNDLG SEQ ID NO:226 | AASNLQS SEQ ID NO:8238 | LQHNSFPLT SEQ ID NO:16250 |
| iPS:392646 | 21-225_20G2 | NA | CGGGCAAGTCAGGGCATTAG AAATGATTAGGC SEQ ID NO:227 | GCTGCATCCAGTTTCCAA AGT SEQ ID NO:8239 | CTACAGCATAATAGTTACCC GCTCACT SEQ ID NO:16251 |
| | | AA | RASQGIRNDLG SEQ ID NO:228 | AASSFQS SEQ ID NO:8240 | LQHNSYPLT SEQ ID NO:16252 |
| iPS:392648 | 21-225_16D11 | NA | CGGGCAAGTCAGAGACCATTAG CAACTATTTAAAT SEQ ID NO:229 | GCTGCATCCAGTTTGCAA AGT SEQ ID NO:8241 | CAACAGAGTCACAGTTCCCC GCTCACT SEQ ID NO:16253 |
| | | AA | RASQTISNYLN SEQ ID NO:230 | AASSLQS SEQ ID NO:8242 | QQSHSSPLT SEQ ID NO:16254 |
| iPS:392650 | 21-225_17A4 | NA | CGGGGAGTCAGGGTATTGG CAACTGGTTAGCC SEQ ID NO:231 | GCTGCATCCAGTTTGCAA AGT SEQ ID NO:8243 | CAACAGGCTAACAGTTTCCC TCGGACG SEQ ID NO:16255 |
| | | AA | RASQGIGNWLA SEQ ID NO:232 | AASSLQS SEQ ID NO:8244 | QQANSFPRT SEQ ID NO:16256 |
| iPS:392652 | 21-225_17C6 | NA | CGGGCAAGTCAGAGCATTAA TACTTATTTAAAT SEQ ID NO:233 | GCTGCATCCAGTTTGCAA AGT SEQ ID NO:8245 | CAACAGAGTTACAGAACCC CTTTTTCACT SEQ ID NO:16257 |
| | | AA | RASQSINTYLN SEQ ID NO:234 | AASSLQS SEQ ID NO:8246 | QQSYRTPFFT SEQ ID NO:16258 |
| iPS:392654 | 21-225_17A10 | NA | CGGGCAAGTCAGGGCATTAG AAATGATTAGGC SEQ ID NO:235 | GCTGCATCCAGTTTACAA AGT SEQ ID NO:8247 | CTACAGCATAATAGTTACCC GCTCACT SEQ ID NO:16259 |
| | | AA | RASQGIRNDLG SEQ ID NO:236 | AASSLQS SEQ ID NO:8248 | LQHNSYPLT SEQ ID NO:16260 |

FIGURE 49
(Continued)

| | | | | |
|---|---|---|---|---|
| iPS:392656 | 21-225_1F2 | NA | CGGGCAAGTCAGGGCATTAG AAATGATTAGGC | GCTGCATCCAGTGTGCA AAGT | CTACAGCATAATAGTTACCC GCTCACT |
| | | | SEQ ID NO:237 | SEQ ID NO:8249 | SEQ ID NO:16261 |
| | | AA | RASQGIRNDLG | AASSVQS | LQHNSYPLT |
| | | | SEQ ID NO:238 | SEQ ID NO:8250 | SEQ ID NO:16262 |
| iPS:392658 | 21-225_18E8 | NA | CGGGCAAGTCAGGGCATTAG AAATGATTAGGC | GCTGCATCCAGTTTGCAA AGT | CTACAGCATAATAGTTACCC GCTCACT |
| | | | SEQ ID NO:239 | SEQ ID NO:8251 | SEQ ID NO:16263 |
| | | AA | RASQGIRNDLG | AASSLQS | LQHNSYPLT |
| | | | SEQ ID NO:240 | SEQ ID NO:8252 | SEQ ID NO:16264 |
| iPS:392660 | 21-225_19B3 | NA | CGGGCAAGTCAGAGACATTAT CAACTATTTAAAT | GTTGCATCCAGTTTGCAA AGT | CAACAGAGTTACAGTACCCC TTTCACT |
| | | | SEQ ID NO:241 | SEQ ID NO:8253 | SEQ ID NO:16265 |
| | | AA | RAGQNIINYLN | VASSLQS | QQSYSTPFT |
| | | | SEQ ID NO:242 | SEQ ID NO:8254 | SEQ ID NO:16266 |
| iPS:392664 | 21-225_20F6 | NA | CGGGCAAGTCAGAGCATTAG CACCTATTTAAAT | ACTGCATCCAGTTTGCAA AGT | CAACAGACTTACAGTCCCCC GCTCACT |
| | | | SEQ ID NO:243 | SEQ ID NO:8255 | SEQ ID NO:16267 |
| | | AA | RASQSIITYLN | TASSLQS | QQTYSPPLT |
| | | | SEQ ID NO:244 | SEQ ID NO:8256 | SEQ ID NO:16268 |
| iPS:392666 | 21-225_16F11 | NA | CGGGCAAGTCAGGGCATTAG AAATGATTAGGC | GCTGCATCCAGTGTACA AAGT | CTACAGCATAATAGTTACCC GCTCACT |
| | | | SEQ ID NO:245 | SEQ ID NO:8257 | SEQ ID NO:16269 |
| | | AA | RASQGIRNDLG | AASSVQS | LQHNSYPLT |
| | | | SEQ ID NO:246 | SEQ ID NO:8258 | SEQ ID NO:16270 |
| iPS:392668 | 21-225_17B4 | NA | CGGGCAAGTCAGAACATTAG TAGTTATTTAAAT | GGTGCATCCAGTTTGCA AACT | CAACAGAGTTACAGAACCCC CTTTTTCACT |
| | | | SEQ ID NO:247 | SEQ ID NO:8259 | SEQ ID NO:16271 |
| | | AA | RASQNISSYLN | GASSLQT | QQSYRTPFFT |
| | | | SEQ ID NO:248 | SEQ ID NO:8260 | SEQ ID NO:16272 |

FIGURE 49
(Continued)

| | | | | | |
|---|---|---|---|---|---|
| iPS:392674 | | NA | CGGGCAAGTCAGGGCATTAG AAATGATTAGGC | ACTGCATCCAGTTTGCAA AGT | CTACAACATAATAGTTACCC GTGGACG |
| | 21-225_18C2 | | SEQ ID NO:249 | SEQ ID NO:8261 | SEQ ID NO:16273 |
| | | AA | RASQGIRNDLG | TASSLQS | LQHNSYPWT |
| | | | SEQ ID NO:250 | SEQ ID NO:8262 | SEQ ID NO:16274 |
| iPS:392676 | | NA | CGGGCAAGTCAGGGCATAA GAAATGATTAGGC | GCTGTTTCCAGTTTGCAA AGT | CTACAGCATGCCAGTTACCC GCTCACT |
| | 21-225_19F3 | | SEQ ID NO:251 | SEQ ID NO:8263 | SEQ ID NO:16275 |
| | | AA | RASQGIRNDLG | AVSSLQS | LQHASYPLT |
| | | | SEQ ID NO:252 | SEQ ID NO:8264 | SEQ ID NO:16276 |
| iPS:392678 | | NA | CGGGCAAGTCAGAGCATTAG TAGTTATTTATAT | GCTGCATCCAGTTTGCAA AGT | CAACAGAGTTACAGTGCCCC TCCATTCACT |
| | 21-225_20F3 | | SEQ ID NO:253 | SEQ ID NO:8265 | SEQ ID NO:16277 |
| | | AA | RASQSISSYLY | AASSLQS | QQSYSAPPFT |
| | | | SEQ ID NO:254 | SEQ ID NO:8266 | SEQ ID NO:16278 |
| iPS:392680 | | NA | CGGGCAAGTCAGGGCATTAG AAATGATTAGGC | GCTGCATCCAGTTTGCAA AGT | CTACAGCATAATAGTTACCC GCTCACT |
| | 21-225_20A7 | | SEQ ID NO:255 | SEQ ID NO:8267 | SEQ ID NO:16279 |
| | | AA | RASQGIRNDLG | AASSLQS | LQHNSYPLT |
| | | | SEQ ID NO:256 | SEQ ID NO:8268 | SEQ ID NO:16280 |
| iPS:392682 | | NA | CGGGCGAGTCAGGGCATTAA CACTTATTTAGCC | GCTGCATCCAGTTTGCAA AGT | CAACAGTATTATAGTTATATCC GCTCACT |
| | 21-225_16A12 | | SEQ ID NO:257 | SEQ ID NO:8269 | SEQ ID NO:16281 |
| | | AA | RASQAINTYLA | AASSLQS | QQYYSYPLT |
| | | | SEQ ID NO:258 | SEQ ID NO:8270 | SEQ ID NO:16282 |
| iPS:392684 | | NA | CGGGCAAGTCAGGGCATTAG AAATGATTAGGC | GCTGCATCCAGTTTGCAA AGT | CTACAGGCATAATAGTTACCC ATTCACT |
| | 21-225_17F4 | | SEQ ID NO:259 | SEQ ID NO:8271 | SEQ ID NO:16283 |
| | | AA | RASQGIRNDLG | AASSLQS | LQHNSYPFT |
| | | | SEQ ID NO:260 | SEQ ID NO:8272 | SEQ ID NO:16284 |

FIGURE 49
(Continued)

| | | | | | | |
|---|---|---|---|---|---|---|
| iPS:392686 | 21-225_17C7 | NA | CGGGCAAGTCAGGGCATTAG AAATGATTAGGC | GCTGCATCCAGTTTGCAA AGT | CTACAGGCATAATAGTTACCC GTGGACG | |
| | | | SEQ ID NO:261 | SEQ ID NO:8273 | SEQ ID NO:16285 | |
| | | AA | RASQGIRNDLG | AASSLQS | LQHNSYPWT | |
| | | | SEQ ID NO:262 | SEQ ID NO:8274 | SEQ ID NO:16286 | |
| iPS:392690 | 21-225_18F2 | NA | CGGGCAAGTCAGGGCATTAG AAATGATTAGGC | GCTGCATCCAGTTTGCAA AGT | CTACAGGCATAATAGTTACCC GTGGACG | |
| | | | SEQ ID NO:263 | SEQ ID NO:8275 | SEQ ID NO:16287 | |
| | | AA | RASQGIRNDLG | AASSLQS | LQHNSYPWT | |
| | | | SEQ ID NO:264 | SEQ ID NO:8276 | SEQ ID NO:16288 | |
| iPS:392692 | 21-225_18G10 | NA | CGGGCGAGTCAGGACATTAG CTATTATTAGCC | GTTGCATCCAGTTTGCAA AGT | TTACAGTATAATAGTTACCC ATTCACT | |
| | | | SEQ ID NO:265 | SEQ ID NO:8277 | SEQ ID NO:16289 | |
| | | AA | RASQDISYYLA | VASSLQS | LQYNSYPFT | |
| | | | SEQ ID NO:266 | SEQ ID NO:8278 | SEQ ID NO:16290 | |
| iPS:392694 | 21-225_19A5 | NA | CGGGCAAGTCAGAACATTAT CAACTATTTAAAT | GTTGCATCCAATTACAA GGT | CAACAGAGTTACAGTACCC TTTCACT | |
| | | | SEQ ID NO:267 | SEQ ID NO:8279 | SEQ ID NO:16291 | |
| | | AA | RASQNIINYLN | VASNLQG | QQSYSTPFT | |
| | | | SEQ ID NO:268 | SEQ ID NO:8280 | SEQ ID NO:16292 | |
| iPS:392696 | 21-225_20A4 | NA | CGGGCAAGTCAGAGCATTAT CAACTATTTAAAT | GCTGCATCCAGTTTGCAC AGT | CAACAGAGTTACAGAACCC CTTATTCACT | |
| | | | SEQ ID NO:269 | SEQ ID NO:8281 | SEQ ID NO:16293 | |
| | | AA | RASQSIINYLN | AASSLHS | QQSYRTPLFT | |
| | | | SEQ ID NO:270 | SEQ ID NO:8282 | SEQ ID NO:16294 | |
| iPS:392700 | 21-225_16E12 | NA | CGGGCAAGTCAGGGCATTAG AAATGATTAGGC | GCTGCATCCAGTTTACAA AGT | CTACAGGCATAATAGTTACCC GCTCACT | |
| | | | SEQ ID NO:271 | SEQ ID NO:8283 | SEQ ID NO:16295 | |
| | | AA | RASQGIRNDLG | AASSLQS | LQHNSYPLT | |
| | | | SEQ ID NO:272 | SEQ ID NO:8284 | SEQ ID NO:16296 | |

FIGURE 49
(Continued)

| | | | | | | | |
|---|---|---|---|---|---|---|---|
| iPS:392702 | 21-225_17F7 | NA | CGGGCAAGTCAGAGACCATTAG TAGTTTTTAAAT | | GCTGCTTCCAGTTTGCAA AGT | | CAACAGAGTTACAGAACCCC CTTTTTCACT |
| | | | SEQ ID NO:273 | | SEQ ID NO:8285 | | SEQ ID NO:16297 |
| | | AA | RASQTISSFLN | | AASSLQS | | QQSYRTPFT |
| | | | SEQ ID NO:274 | | SEQ ID NO:8286 | | SEQ ID NO:16298 |
| iPS:392704 | 21-225_17F11 | NA | CGGGCAAGTCGGAGACCATTAA CAACTATTTAAAT | | GCTACATCCAGTTTACAA AGT | | CAACAGAGACTTACAGTACTACCC CTTATTCGCT |
| | | | SEQ ID NO:275 | | SEQ ID NO:8287 | | SEQ ID NO:16299 |
| | | AA | RASRTINNYLN | | ATSSLQS | | QQTYSTPLFA |
| | | | SEQ ID NO:276 | | SEQ ID NO:8288 | | SEQ ID NO:16300 |
| iPS:392706 | 21-225_18A3 | NA | CGGGCAAGTCAGGGCATTAG AAATGATTTAGGC | | GTTGCATCCAGTTTGCAA AGT | | CTACAGCAGTAGTAGTTACCC GCTCACT |
| | | | SEQ ID NO:277 | | SEQ ID NO:8289 | | SEQ ID NO:16301 |
| | | AA | RASQGIRNDLG | | VASSLQS | | LQHSSYPLT |
| | | | SEQ ID NO:278 | | SEQ ID NO:8290 | | SEQ ID NO:16302 |
| iPS:392708 | 21-225_18D11 | NA | CGGGGAGTCAGGGCATTAG CTATTATTTAGCC | | GTTGCATCCAGTTTGCAA AGT | | CAACAGTATAATACTTACCC ATTCACT |
| | | | SEQ ID NO:279 | | SEQ ID NO:8291 | | SEQ ID NO:16303 |
| | | AA | RASQGISYYLA | | VASSLQS | | QQYNTYPFT |
| | | | SEQ ID NO:280 | | SEQ ID NO:8292 | | SEQ ID NO:16304 |
| iPS:392710 | 21-225_19A10 | NA | CGGGCAAGTCAGGGCATTAG AACTGATTTAGGC | | ACTGCATCCAGTTTGCAA AGT | | CTACAGCAGTAATGGTTACCC GTGGACG |
| | | | SEQ ID NO:281 | | SEQ ID NO:8293 | | SEQ ID NO:16305 |
| | | AA | RASQGIRTDLG | | TASSLQS | | LQHNGYPWT |
| | | | SEQ ID NO:282 | | SEQ ID NO:8294 | | SEQ ID NO:16306 |
| iPS:392714 | 21-225_16G12 | NA | CGGGGCGGAGTCAGGAGACATTAG CAATTATTTAGCC | | GCTGCATCCAGTTTGCAA AGT | | CAACAGTATCATAGTTCCC ATTCACT |
| | | | SEQ ID NO:283 | | SEQ ID NO:8295 | | SEQ ID NO:16307 |
| | | AA | RASQDISNYLA | | AASSLQS | | QQYHSFPFT |
| | | | SEQ ID NO:284 | | SEQ ID NO:8296 | | SEQ ID NO:16308 |

FIGURE 49
(Continued)

| | | | | | |
|---|---|---|---|---|---|
| iPS:392716 | 21-225_17B5 | NA | CGGGCAAGTCAGGGCATTAG AAATGATTAGGC SEQ ID NO:285 | GCTGCATCCAATTGCAA AGT SEQ ID NO:8297 | CTACAGGCATAATAGTTACCC GCTCACT SEQ ID NO:16309 |
| | | AA | RASQGIRNDLG SEQ ID NO:286 | AASNLQS SEQ ID NO:8298 | LQHNSYPLT SEQ ID NO:16310 |
| iPS:392718 | 21-225_17B8 | NA | AGGTCTAGTCAGAGCCTCCT GCATAGTAATGGGAACAACT CTTTGGAT SEQ ID NO:287 | TTGGGTTCTCATCGGGC TCC SEQ ID NO:8299 | ATGCAAGTTCTACAAACTCC TCCCCTCACT SEQ ID NO:16311 |
| | | AA | RSSQSLLHSNGNNSLD SEQ ID NO:288 | LGSHRAS SEQ ID NO:8300 | MQVLQTPPLT SEQ ID NO:16312 |
| iPS:392720 | 21-225_17A12 | NA | CGGGCAAGTCAGAGCATTAG TAGTTATTTAAAT SEQ ID NO:289 | GCTGCATCCAGTTTGCAA AGT SEQ ID NO:8301 | CAACAGAGTTACAATACCCC CTTATTCACT SEQ ID NO:16313 |
| | | AA | RASQSISSYLN SEQ ID NO:290 | AASSLQS SEQ ID NO:8302 | QQSYNTPLFT SEQ ID NO:16314 |
| iPS:392722 | 21-225_18E12 | NA | CGGGCAAGTCAGAGCATTAG TAGTTATTTAAAT SEQ ID NO:291 | GCTGCATCCAGTTACAA AGT SEQ ID NO:8303 | CAACAGAGTTACAGAACCCC CTTTTTCACT SEQ ID NO:16315 |
| | | AA | RASQSISSYLN SEQ ID NO:292 | AASSLQS SEQ ID NO:8304 | QQSYRTPFFT SEQ ID NO:16316 |
| iPS:392726 | 21-225_20B5 | NA | CGGGCAAGTCAGGGCATTAA CAATTATTAGCC SEQ ID NO:293 | GCTGCATCCACTTTGCAA TCA SEQ ID NO:8305 | CAAAAGTATAACAGTGCCCC TCCGATCACC SEQ ID NO:16317 |
| | | AA | RASQGINNYLA SEQ ID NO:294 | AASTLQS SEQ ID NO:8306 | QKYNSAPPIT SEQ ID NO:16318 |
| iPS:392728 | 21-225_20F7 | NA | CGGGCGAGTCAGGGTATTAG CAGCTGGTTAGCC SEQ ID NO:295 | GCTGCATCCAGTTTGCAA AGT SEQ ID NO:8307 | CAACAGGCTAACAGTTTCCC TCGGACG SEQ ID NO:16319 |
| | | AA | RASQGISSWLA | AASSLQS | QQANSFPRT |

FIGURE 49
(Continued)

| | | | | | | |
|---|---|---|---|---|---|---|
| iPS:392730 | 21-225_17A1 | NA | SEQ ID NO:296<br>CGGGCAAGTCAGAACATTAA<br>CAATTATTTAAAT | SEQ ID NO:8308<br>ACTACATCTAGTTTACAA<br>AGT | SEQ ID NO:16320<br>CAACAGAGTTACACTACCCC<br>CACGTGGACG |
| | | AA | SEQ ID NO:297<br>RASQNINNYLN | SEQ ID NO:8309<br>TTSSLQS | SEQ ID NO:16321<br>QQSYTTPTWT |
| iPS:392732 | 21-225_17E5 | NA | SEQ ID NO:298<br>CGGGCAAGTCAGGGCATTAG<br>AAATGATTTAGGC | SEQ ID NO:8310<br>ACTGCATCCAGTTTGCAA<br>AGT | SEQ ID NO:16322<br>CTACAACATAATAGTTACCC<br>GTTGACG |
| | | AA | SEQ ID NO:299<br>RASQGIRNDLG | SEQ ID NO:8311<br>TASSLQS | SEQ ID NO:16323<br>LQHNSYPLT |
| iPS:392734 | 21-225_17D8 | NA | SEQ ID NO:300<br>AGGGCCAGTCAGAGAGTGTTAG<br>CAGCAACTTAGCC | SEQ ID NO:8312<br>GGTGCATCCACCAGGGC<br>CAGT | SEQ ID NO:16324<br>CAGCAGTATAATAACTGGCC<br>TCTGACG |
| | | AA | SEQ ID NO:301<br>RASQSVSSNLA | SEQ ID NO:8313<br>GASTRAS | SEQ ID NO:16325<br>QQYNNWPLT |
| iPS:392736 | 21-225_17B12 | NA | SEQ ID NO:302<br>CGGGCAAGTCAGAATATTAA<br>CAACTATTTAAAT | SEQ ID NO:8314<br>ACTGCATCCAGTTTGCAA<br>AGT | SEQ ID NO:16326<br>CAACAGACTTACACTACCCC<br>CACGTGGACG |
| | | AA | SEQ ID NO:303<br>RASQNINNYLN | SEQ ID NO:8315<br>TASSLQS | SEQ ID NO:16327<br>QQTYTTPTWT |
| iPS:392738 | 21-225_18G4 | NA | SEQ ID NO:304<br>CGGGCAAGTCAGGGCATTAT<br>CAGCTATTTAAAT | SEQ ID NO:8316<br>ACTGCATCCAGTTTGCAA<br>ACT | SEQ ID NO:16328<br>CAACAGACTTACAGTCCCCC<br>GCTCACT |
| | | AA | SEQ ID NO:305<br>RASQSIISYLN | SEQ ID NO:8317<br>TASSLQT | SEQ ID NO:16329<br>QQTYSPPLT |
| iPS:392740 | 21-225_18H12 | NA | SEQ ID NO:306<br>CGGGCAAGTCAGGGCATTAG<br>AAATGATTTAGGC | SEQ ID NO:8318<br>ACTGCATCCAATTTGCAA<br>AGT | SEQ ID NO:16330<br>CTACAACATAATAATTACCC<br>GTGGACG |
| | | AA | SEQ ID NO:307<br>RASQGIRNDLG | SEQ ID NO:8319<br>TASNLQS | SEQ ID NO:16331<br>LQHNNYPWT |

FIGURE 49
(Continued)

| | | | | | | |
|---|---|---|---|---|---|---|
| iPS:392742 | | NA | SEQ ID NO:308 CGGGCAAGTCAGGACATTAG AAATGATTTAGGC | SEQ ID NO:8320 GCTGCATCCAGTTTGCAA AGT | SEQ ID NO:16332 CTACAGCATTATAATTACCC TCGGGCG |
| | 21-225_20B2 | AA | SEQ ID NO:309 RASQDIRNDLG | SEQ ID NO:8321 AASSLQS | SEQ ID NO:16333 LQHYNYPRA |
| iPS:392744 | | NA | SEQ ID NO:310 CGGGCAAGTCAGGGCATTAG AAATGATTTAGGC | SEQ ID NO:8322 GCTGCATCCAGTTTGCAA AGT | SEQ ID NO:16334 CTACAGCATAATAGTTACCC GTTCACT |
| | 21-225_20D5 | AA | SEQ ID NO:311 RASQGIRNDLG | SEQ ID NO:8323 AASSLQS | SEQ ID NO:16335 LQHNSYPFT |
| iPS:392746 | | NA | SEQ ID NO:312 CGGACGAGTCAGGGCATTAA CAATTATTAGTC | SEQ ID NO:8324 GCTGCATCCAGTTTGCAA AGT | SEQ ID NO:16336 CAACAGTATTATAGTTACCC ATTCACT |
| | 21-225_20H7 | AA | SEQ ID NO:313 RTSQGINNYLV | SEQ ID NO:8325 AASSLQS | SEQ ID NO:16337 QQYYSYPFT |
| iPS:392748 | | NA | SEQ ID NO:314 CGGGCGAGTCAGGGCATTAA TAATTATTAGTC | SEQ ID NO:8326 GCTGCATCCAGTTTGCTG AGT | SEQ ID NO:16338 CAACAGTATAATAGTTACCC GATCACC |
| | 21-225_20A8 | AA | SEQ ID NO:315 RASQGINNYLV | SEQ ID NO:8327 AASSLLS | SEQ ID NO:16339 QQYNSYPIT |
| iPS:392750 | | NA | SEQ ID NO:316 CGGGCAAGTCAGGACATTAG AAATGATTTAGGC | SEQ ID NO:8328 GCTGCATCCAGTTTGCAA AGT | SEQ ID NO:16340 CTACAGCATAATAGATACCC GCTCACT |
| | 21-225_20A10 | AA | SEQ ID NO:317 RASQGIRNDLG | SEQ ID NO:8329 AASSLQS | SEQ ID NO:16341 LQHNRYPLT |
| iPS:392754 | | NA | SEQ ID NO:318 CGGGCAAGTCAGAGCATTAC TGGTTATTCAAAT | SEQ ID NO:8330 GCTACATACAGTTTGGA AAGT | SEQ ID NO:16342 CAACAGAGTTACAGTACCTC GATCACC |
| | 21-225_21D3 | AA | SEQ ID NO:319 RASQSITGYSN | SEQ ID NO:8331 ATYSLES | SEQ ID NO:16343 QQSYSTSIT |

FIGURE 49
(Continued)

| | | | | | | |
|---|---|---|---|---|---|---|
| iPS:392758 | 21-225_21G11 | NA | SEQ ID NO:320 CGGGCAAGTCAGGGCATTAG AAATGATTTAGGC | SEQ ID NO:8332 ACTGCATCCAGTTTGCAA AGT | SEQ ID NO:16344 CTACAACATAATAATTACCC GTGGACG |
| | | AA | SEQ ID NO:321 RASQGIRNDLG | SEQ ID NO:8333 TASSLQS | SEQ ID NO:16345 LQHNNYPWT |
| iPS:392760 | 21-225_22G3 | NA | SEQ ID NO:322 CGGGCAAGTCAGAGCATTAG TAATTATTTAAAT | SEQ ID NO:8334 GCTGCTTCCAGTTTGCAA AGT | SEQ ID NO:16346 CAACAGAGTTCAGAACCCC CTTTTTCACT |
| | | AA | SEQ ID NO:323 RASQSISNYLN | SEQ ID NO:8335 AASSLQS | SEQ ID NO:16347 QQSFRTPFFT |
| iPS:392762 | 21-225_22G5 | NA | SEQ ID NO:324 CGGGCAAGTCAGAACATTAG CAGCTATTTAAAT | SEQ ID NO:8336 GCTGCATCCAGTTTGCAA AAT | SEQ ID NO:16348 CAACAGAGTTACAGAACCCC CTTATTCACT |
| | | AA | SEQ ID NO:325 RASQNISSYLN | SEQ ID NO:8337 AASSLQN | SEQ ID NO:16349 QQSYRTPLFT |
| iPS:392764 | 21-225_22G10 | NA | SEQ ID NO:326 CGGGCAAGTCAGAGCATTTT CAGCTATTTAAAT | SEQ ID NO:8338 GCTGCATCCAGTTTACAA AGT | SEQ ID NO:16350 CAACAGAGTTCAGAACCCC CTTATTCACT |
| | | AA | SEQ ID NO:327 RASQSIFSYLN | SEQ ID NO:8339 AASSLQS | SEQ ID NO:16351 QQSFRTPLFT |
| iPS:392766 | 21-225_23H4 | NA | SEQ ID NO:328 CGGGCAAGTCAGAGCATTAG CAGGTATTTAAAT | SEQ ID NO:8340 TCTACATCCAGTTTGCAA AGT | SEQ ID NO:16352 CAACAGAGTTACAGTACCCC CACGTGGACG |
| | | AA | SEQ ID NO:329 RASQSISRYLN | SEQ ID NO:8341 STSSLQS | SEQ ID NO:16353 QQSYSTPTWT |
| iPS:392768 | 21-225_20B8 | NA | SEQ ID NO:330 AGGGCCAGTCAGAGTGTTAG CAGCAACTTAGCC | SEQ ID NO:8342 GGTGCATCCACCAGGGC CAGT | SEQ ID NO:16354 CAGCAGTATAATAACTGTCC TCTGACG |
| | | AA | SEQ ID NO:331 RASQSVSSNLA | SEQ ID NO:8343 GASTRAS | SEQ ID NO:16355 QQYNNCPLT |

FIGURE 49
(Continued)

| | | | | | | |
|---|---|---|---|---|---|---|
| iPS:392770 | 21-225_20C10 | NA | SEQ ID NO:332 CGGGCAAGTCAGGCACCATATTAG CAACTATTTAAAT | SEQ ID NO:8344 ACTGCATCCAGTTTGCAA AGT | SEQ ID NO:16356 CAACAGAGTTACACTACCCC CACGTGGACG |
| | | AA | SEQ ID NO:333 RASHHISNYLN | SEQ ID NO:8345 TASSLQS | SEQ ID NO:16357 QQSYTTPTWT |
| iPS:392772 | 21-225_20E12 | NA | SEQ ID NO:334 CGGGCAAGTCAGGGCATTAG AAATGATTTAGGC | SEQ ID NO:8346 GCTGCATCCAGTTTACAA AGT | SEQ ID NO:16358 CTACAGCATAATAGTTACCC GTTCACT |
| | | AA | SEQ ID NO:335 RASQGIRNDLG | SEQ ID NO:8347 AASSLQS | SEQ ID NO:16359 LQHNSYPFT |
| iPS:392774 | 21-225_21F3 | NA | SEQ ID NO:336 CGGGCAAGTCAGGGCATTAG AAATGATTTAGGC | SEQ ID NO:8348 GCTGCATCCAGTTTGCAA AGT | SEQ ID NO:16360 CTACAGCATAGTAGTTACCC CCTCACT |
| | | AA | SEQ ID NO:337 RASQGIRNDLG | SEQ ID NO:8349 AASSLQS | SEQ ID NO:16361 LQHSSYPLT |
| iPS:392776 | 21-225_21A12 | NA | SEQ ID NO:338 CGGGCGAGTCAAGGCATTAG CAAATATTTAGCC | SEQ ID NO:8350 GCTGCATCCAGTTTGCAA AGT | SEQ ID NO:16362 CAACAGTATAATAGTTACCC GTTCAGG |
| | | AA | SEQ ID NO:339 RASQGISKYLA | SEQ ID NO:8351 AASSLQS | SEQ ID NO:16363 QQYNSYPFR |
| iPS:392778 | 21-225_22H3 | NA | SEQ ID NO:340 CGGGCAAGTCAGGACATTAG AAATAATTTAGGC | SEQ ID NO:8352 CCTGCATCCAGTTTGCAA ACT | SEQ ID NO:16364 CTACAGGATAATAGTTACCC ATTCACT |
| | | AA | SEQ ID NO:341 RASQDIRNNLG | SEQ ID NO:8353 PASSLQT | SEQ ID NO:16365 LQDNSYPFT |
| iPS:392780 | 21-225_22B7 | NA | SEQ ID NO:342 CGGGCAAGTCAGGGCATTAG AAATGATTTAGGC | SEQ ID NO:8354 ACTGCATCCAGTTTGCAA AGT | SEQ ID NO:16366 CTACAGCATAATACTTACCC GCTCACT |
| | | AA | SEQ ID NO:343 RASQGIRNDLG | SEQ ID NO:8355 TASSLQS | SEQ ID NO:16367 LQHNTYPLT |

FIGURE 49
(Continued)

| | | | | | | |
|---|---|---|---|---|---|---|
| iPS:392782 | 21-225_22B12 | NA | SEQ ID NO:344 CGGGCGAGTCAGGGACATTAG CAATTATTTAGCC | SEQ ID NO:8356 GGTGCATCCAGTTTGCG GAGT | SEQ ID NO:16368 CAACAGTATCATAGTTACCC ATTCACT |
| | | AA | SEQ ID NO:345 RASQDISNYLA | SEQ ID NO:8357 GASSLRS | SEQ ID NO:16369 QQYHSYPFT |
| iPS:392784 | 21-225_23C7 | NA | SEQ ID NO:346 CGGGCGAGTCAGGGCATTGG CATTTATTTAGCC | SEQ ID NO:8358 GCTGCATCCAGTTTGCAA AGT | SEQ ID NO:16370 CAACAGTATAATAGTTACCC ATTCACT |
| | | AA | SEQ ID NO:347 RASQGIGIYLA | SEQ ID NO:8359 AASSLQS | SEQ ID NO:16371 QQYNSYPFT |
| iPS:392786 | 21-225_24E1 | NA | SEQ ID NO:348 AAGTCCAGCCAGAGAGTGTTT ATACACCTCCAACAATAACA ACTACTTAACT | SEQ ID NO:8360 TGGGCATCTACCCGGGA ATCC | SEQ ID NO:16372 CAGCAATTTTATAGTACTCC TCCGACG |
| | | AA | SEQ ID NO:349 KSSQSVLYTSNNNNYLT | SEQ ID NO:8361 WASTRES | SEQ ID NO:16373 QQFYSTPPT |
| iPS:392788 | 21-225_20C8 | NA | SEQ ID NO:350 CGGGCAAGTCAGGGCATTAG AAATGATTTAGGC | SEQ ID NO:8362 GCTGCATCCAGTTTGCAA AGT | SEQ ID NO:16374 CTACAAGATAATAGTTACCC GTTCACT |
| | | AA | SEQ ID NO:351 RASQGIRNDLG | SEQ ID NO:8363 AASSLQS | SEQ ID NO:16375 LQDNSYPFT |
| iPS:392790 | 21-225_20D10 | NA | SEQ ID NO:352 CGGGCAAGTCAGGGCATTAG AAATGATTTAGGC | SEQ ID NO:8364 GTTGCATACAGTTTGCAA AGT | SEQ ID NO:16376 ATACAGCAAATAGTTACCC GTGGACG |
| | | AA | SEQ ID NO:353 RASQGIRNDLG | SEQ ID NO:8365 VAYSLQS | SEQ ID NO:16377 IQQNSYPWT |
| iPS:392792 | 21-225_20G12 | NA | SEQ ID NO:354 CGGGCGAGTCAGGGCATTAG CAATTATTTAGCC | SEQ ID NO:8366 ACTGCATCCATCCACTTTGCAA TCA | SEQ ID NO:16378 CAAAGTATAACAGTGCCCC TCCGATCACC |
| | | | SEQ ID NO:355 | SEQ ID NO:8367 | SEQ ID NO:16379 |

FIGURE 49
(Continued)

| | | | RASQGISNYLA | TASTLQS | QKYNSAPPIT |
|---|---|---|---|---|---|
| iPS:392794 | 21-225_21H3 | AA | RASQGISNYLA<br>SEQ ID NO:356 | TASTLQS<br>SEQ ID NO:8368 | QKYNSAPPIT<br>SEQ ID NO:16380 |
| | | NA | CGGGCAAGTCAGGGCATTAG<br>AAATGATTAGGC<br>SEQ ID NO:357 | GCTGCGTCCAGTGTGCA<br>AACT<br>SEQ ID NO:8369 | CTACAGCATAATAGTTATCC<br>GCTCACT<br>SEQ ID NO:16381 |
| iPS:392796 | 21-225_22A4 | AA | RASQGIRNDLG<br>SEQ ID NO:358 | AASSVQT<br>SEQ ID NO:8370 | LQHNSYPLT<br>SEQ ID NO:16382 |
| | | NA | CGGGCAAGTCAGGGCATTAG<br>AAATGATTAGGC<br>SEQ ID NO:359 | GCTGCATCCAGTTTGCAA<br>AGT<br>SEQ ID NO:8371 | CTTCAGCATAATAGTTACCC<br>GTGGACG<br>SEQ ID NO:16383 |
| iPS:392798 | 21-225_22C7 | AA | RASQGIRNDLG<br>SEQ ID NO:360 | AASSLQS<br>SEQ ID NO:8372 | LQHNSYPWT<br>SEQ ID NO:16384 |
| | | NA | CGGGCAAGTCAGAACATTAT<br>CAGCTATTAAAT<br>SEQ ID NO:361 | ATTGCATCCAGTTTGCAA<br>AGT<br>SEQ ID NO:8373 | CAACAGACTTACAGTACCCC<br>GCTCACT<br>SEQ ID NO:16385 |
| iPS:392800 | 21-225_22D12 | AA | RASQNIISYLN<br>SEQ ID NO:362 | IASSLQS<br>SEQ ID NO:8374 | QQTYSTPLT<br>SEQ ID NO:16386 |
| | | NA | CGGGCAAGTCAGGGCATTAG<br>AAATGATTAGGC<br>SEQ ID NO:363 | GCTGCATCCAGTTTGCAG<br>AGT<br>SEQ ID NO:8375 | CTACAGCATAGTACTTACCC<br>TCTCACT<br>SEQ ID NO:16387 |
| iPS:392802 | 21-225_23E7 | AA | RASQGIRNDLG<br>SEQ ID NO:364 | AASSLQS<br>SEQ ID NO:8376 | LQHSTYPLT<br>SEQ ID NO:16388 |
| | | NA | CGGGCAAGTCAGGGCATTAG<br>CAATTATTAGGC<br>SEQ ID NO:365 | GCTGCATCCAGTTTGCAA<br>AGT<br>SEQ ID NO:8377 | CAACAGTTTTATAGTTACCC<br>ATTCACT<br>SEQ ID NO:16389 |
| iPS:392806 | 21-225_24H3 | AA | RASQGISNYLA<br>SEQ ID NO:366 | AASSLQS<br>SEQ ID NO:8378 | QQFYSYPFT<br>SEQ ID NO:16390 |
| | | NA | AGGGCCAGTCAGAGTGTTAG<br>CAGCAACTTAGCC<br>SEQ ID NO:367 | TTTGCATCCATCAGGGCC<br>ACT<br>SEQ ID NO:8379 | CAGCAGTATAAACTGGCC<br>CATGTGCAGT<br>SEQ ID NO:16391 |

FIGURE 49
(Continued)

| | | | | | | | |
|---|---|---|---|---|---|---|---|
| iPS:392808 | | AA | RASQSVSSNLA | | FASIRAT | | QQYNNWPMCS |
| | | | SEQ ID NO:368 | | SEQ ID NO:8380 | | SEQ ID NO:16392 |
| | 21-225_20F8 | NA | CGGGCAAGTCAGAGCATTAG CAGGTATTTAAAT | GCTGCTTCCAGTTTGCAA AGT | | CAACAGAGTTACAATACCCC CACGTGGACG | |
| | | | SEQ ID NO:369 | SEQ ID NO:8381 | | SEQ ID NO:16393 | |
| iPS:392810 | | AA | RASQSISRYLN | | AASSLQS | | QQSYNTPTWT |
| | | | SEQ ID NO:370 | | SEQ ID NO:8382 | | SEQ ID NO:16394 |
| | 21-225_20H12 | NA | CGGGCAAGTCAGGGCATTAG AAATGATTAGAC | GCTGCATCCAGTTTGCAA AGT | | CTACAGCATAATAGTTACCC GCTCACT | |
| | | | SEQ ID NO:371 | SEQ ID NO:8383 | | SEQ ID NO:16395 | |
| iPS:392812 | | AA | RASQGIRNDLD | | AASSLQS | | LQHNSYPLT |
| | | | SEQ ID NO:372 | | SEQ ID NO:8384 | | SEQ ID NO:16396 |
| | 21-225_21F4 | NA | CGGGCAAGTCAGAACATTGG TAGTTATTTAAAT | GCTGCATCCAGTTTGCAA AGT | | CAACAGAGTTACAGAACCCC CTTTTTCACT | |
| | | | SEQ ID NO:373 | SEQ ID NO:8385 | | SEQ ID NO:16397 | |
| iPS:392814 | | AA | RASQNIGSYLN | | AASSLQS | | QQSYRTPFFT |
| | | | SEQ ID NO:374 | | SEQ ID NO:8386 | | SEQ ID NO:16398 |
| | 21-225_22A1 | NA | AAGTCTAGTCAGAGCCTCCT GCATAGTGGTGGAAAGAGACCTTCT ATTTATAT | GAAGTTTCCAACCGGTTC TCT | | ATGCAAACTTTACACCTTCC GTGGACG | |
| | | | SEQ ID NO:375 | SEQ ID NO:8387 | | SEQ ID NO:16399 | |
| iPS:392816 | | AA | KSSQSLLHSGGKTYLY | | EVSNRFS | | MQTLHLPWT |
| | | | SEQ ID NO:376 | | SEQ ID NO:8388 | | SEQ ID NO:16400 |
| | 21-225_22E4 | NA | CGGGCAAGTCAGAACATTAG TAGTTATTTAAAT | GCTGCATCCAGTTTGCAA AGT | | CAACAGAGTTACAATACCCC CTTATTCACT | |
| | | | SEQ ID NO:377 | SEQ ID NO:8389 | | SEQ ID NO:16401 | |
| iPS:392818 | | AA | RASQNISSYLN | | AASSLQS | | QQSYNTPLFT |
| | | | SEQ ID NO:378 | | SEQ ID NO:8390 | | SEQ ID NO:16402 |
| | | NA | CGGACAAGTCAGAACAGTA ACAGTTATTTAAAT | GCTGCATACAGTTGGA AAGT | | CAACAGACTTACGGTACCTC GATCACC | |

FIGURE 49
(Continued)

| | | | | | | |
|---|---|---|---|---|---|---|
| 21-225_22D8 | | AA | SEQ ID NO:379<br>RTSQNSNSYLN | SEQ ID NO:8391<br>AAYSLES | SEQ ID NO:16403<br>QQTYGTSIT | |
| iPS:392820 | | NA | SEQ ID NO:380<br>CGGGCAAGTCAGGGCATCA<br>GAAATGATTTAGGC | SEQ ID NO:8392<br>GCTGCATCCAGTTTACAA<br>AGT | SEQ ID NO:16404<br>CTACAGCATAGTAGTTACCC<br>TCTCACT | |
| 21-225_23D1 | | AA | SEQ ID NO:381<br>RASQGIRNDLG | SEQ ID NO:8393<br>AASSLQS | SEQ ID NO:16405<br>LQHSSYPLT | |
| iPS:392822 | | NA | SEQ ID NO:382<br>CGGGCAAGTCAGGACATTAG<br>AAATGATTTAGGC | SEQ ID NO:8394<br>GGTGCATCCAGTGTGCA<br>AAGT | SEQ ID NO:16406<br>CTACAGCATAATAGTTACCC<br>GCTCACT | |
| 21-225_23C8 | | AA | SEQ ID NO:383<br>RASQDIRNDLG | SEQ ID NO:8395<br>GASSVQS | SEQ ID NO:16407<br>LQHNSYPLT | |
| iPS:392824 | | NA | SEQ ID NO:384<br>CGGGCAAGTCAGGGCATTAG<br>AAATGATTTAGGC | SEQ ID NO:8396<br>GCTGCATCCAGTTGCAA<br>AGT | SEQ ID NO:16408<br>CTACAGCATAGTAATTACCC<br>GCTCACT | |
| 21-225_24E5 | | AA | SEQ ID NO:385<br>RASQGIRNDLG | SEQ ID NO:8397<br>AASSLQS | SEQ ID NO:16409<br>LQHSNYPLT | |
| iPS:392826 | | NA | SEQ ID NO:386<br>CGGGCGAGTCAGGGCATTAG<br>CAATTATTTAGCC | SEQ ID NO:8398<br>GTTGCATCCAGTTGCAA<br>AGT | SEQ ID NO:16410<br>CAACAGTATAATACTTATCC<br>ATTCACT | |
| 21-225_20B9 | | AA | SEQ ID NO:387<br>RASQGISNYLA | SEQ ID NO:8399<br>VASSLQS | SEQ ID NO:16411<br>QQYNTYPFT | |
| iPS:392830 | | NA | SEQ ID NO:388<br>CGGGCAAGTCAGACCATTAG<br>CAGCCATTTAAAT | SEQ ID NO:8400<br>GCTGCATCCAGTTGCAA<br>AGT | SEQ ID NO:16412<br>CAACAGTTACAATATCTC<br>ATTCACT | |
| 21-225_21A5 | | AA | SEQ ID NO:389<br>RASQTISSHLN | SEQ ID NO:8401<br>AASSLQS | SEQ ID NO:16413<br>QQSYNISFT | |
| iPS:392832 | | NA | SEQ ID NO:390<br>CGGGCAAGTCAGGGCATTAG<br>AAATGATTTAGGC | SEQ ID NO:8402<br>GCTGCATCCAGTTACAA<br>AGT | SEQ ID NO:16414<br>CTACAGCATAATAGTTACCC<br>GTGGACG | |

FIGURE 49
(Continued)

| | | | | | | |
|---|---|---|---|---|---|---|
| iPS:392834 | 21-225_21H8 | AA | SEQ ID NO:391<br>RASQGIRNDLG<br>SEQ ID NO:392 | SEQ ID NO:8403<br>AASSLQS<br>SEQ ID NO:8404 | SEQ ID NO:16415<br>LQHNSYPWT<br>SEQ ID NO:16416 |
| iPS:392836 | 21-225_22C1 | NA | CGGACAAGTCAGGGCATTAG<br>AAATGATTTAGGC<br>SEQ ID NO:393<br>RTSQGIRNDLG<br>SEQ ID NO:394 | GCTGCATCCAGTTGCAA<br>AGT<br>SEQ ID NO:8405<br>AASSLQS<br>SEQ ID NO:8406 | CTACAGCATAGTACTTACCC<br>GCTCACT<br>SEQ ID NO:16417<br>LQHSTYPLT<br>SEQ ID NO:16418 |
| iPS:392838 | 21-225_22F4 | AA | CGGCAAGTCAAGGTCATTAG<br>AGATGATTTAGGC<br>SEQ ID NO:395<br>RASQVIRDDLG<br>SEQ ID NO:396 | GCTGCATCCAGTTGCAA<br>AGT<br>SEQ ID NO:8407<br>AASSLQS<br>SEQ ID NO:8408 | CTACACCACTATAGTTATCC<br>TCGGACG<br>SEQ ID NO:16419<br>LHHYSYPRT<br>SEQ ID NO:16420 |
| iPS:392840 | 21-225_22G8 | NA | CGGACAAGTCAGGGCATTAG<br>AAATGATTTAGGC<br>SEQ ID NO:397<br>RTSQGIRNDLG<br>SEQ ID NO:398 | GCTGCATCCAGTTGCAA<br>AGT<br>SEQ ID NO:8409<br>AASSLQS<br>SEQ ID NO:8410 | CTACAGCATAATAGTTACCC<br>GCTCACT<br>SEQ ID NO:16421<br>LQHNSYPLT<br>SEQ ID NO:16422 |
| iPS:392842 | 21-225_23G1 | AA | CGGGCGAGTCAGGGCATTAG<br>CAATTATTTAGCC<br>SEQ ID NO:399<br>RASQGISNYLA<br>SEQ ID NO:400 | GCTGCATCCAGTTACAG<br>AGT<br>SEQ ID NO:8411<br>AASSLQS<br>SEQ ID NO:8412 | CAACAGTATAATAGTTACCC<br>ATTCACT<br>SEQ ID NO:16423<br>QQYNSYPFT<br>SEQ ID NO:16424 |
| iPS:392844 | 21-225_23G8 | NA | CGGGCGAGTCAGGGCATTAG<br>AAATTATTTAGCC<br>SEQ ID NO:401<br>RASQGIRNYLA<br>SEQ ID NO:402 | GCTGCATCCAGTTGCAA<br>AGT<br>SEQ ID NO:8413<br>AASSLQS<br>SEQ ID NO:8414 | CAACAGTATAATAGTTACCC<br>TTTCACT<br>SEQ ID NO:16425<br>QQYNSYPFT<br>SEQ ID NO:16426 |
| | | | CGGGCAAGTCAGGGCATTAG<br>AAATGATTTAGGC | CCTGCATCCAGTTGCAA<br>AGT | CTACAGCATAATAGTTACCC<br>GTGGACG |

FIGURE 49
(Continued)

| | | | | | | |
|---|---|---|---|---|---|---|
| 21-225_23E11 | AA | SEQ ID NO:403<br>RASQGIRNDLG | | SEQ ID NO:8415<br>PASSLQS | | SEQ ID NO:16427<br>LQHNSYPWT |
| iPS:392846 | NA | SEQ ID NO:404<br>CGGGCAAGTCAGGACATTAG<br>AAATGATTTAGGC | | SEQ ID NO:8416<br>GCTGCATCCAGTTTGCAC<br>AGT | | SEQ ID NO:16428<br>CTACAGCATTATAGTTACCC<br>TCGGACG |
| 21-225_24B6 | AA | SEQ ID NO:405<br>RASQDIRNDLG | | SEQ ID NO:8417<br>AASSLHS | | SEQ ID NO:16429<br>LQHYSYPRT |
| iPS:392848 | NA | SEQ ID NO:406<br>CGGGCAAGTCAGGGCATTAG<br>CAATTATTTAGCC | | SEQ ID NO:8418<br>GCTGCATCCAGTTTGCAA<br>AGT | | SEQ ID NO:16430<br>CAACAGTATCATAGTTACCC<br>GTGGACG |
| 21-225_20F9 | AA | SEQ ID NO:407<br>RASQGISNYLA | | SEQ ID NO:8419<br>AASSLQS | | SEQ ID NO:16431<br>QQYHSYPWT |
| iPS:392850 | NA | SEQ ID NO:408<br>CGGGCAAGTCAGAGCATTAA<br>AAATAATTTAGGC | | SEQ ID NO:8420<br>GCTGCATCCAGTTTGCAA<br>AGT | | SEQ ID NO:16432<br>CTACAGCATAATAGTTACCC<br>GCTCACT |
| 21-225_20H10 | AA | SEQ ID NO:409<br>RASQGIKNNLG | | SEQ ID NO:8421<br>AASSLQS | | SEQ ID NO:16433<br>LQHNSYPLT |
| iPS:392852 | NA | SEQ ID NO:410<br>CGGGCAAGTCAGGGCATTAA<br>TAGTTATTTAAAT | | SEQ ID NO:8422<br>GCTGCATCCAGTTTGCAA<br>AGT | | SEQ ID NO:16434<br>CAACAGTTACAGAACCCC<br>CTTTTTCACT |
| 21-225_21A2 | AA | SEQ ID NO:411<br>RASQSISSYLN | | SEQ ID NO:8423<br>AASSLQS | | SEQ ID NO:16435<br>QQSYRTPFFT |
| iPS:392854 | NA | SEQ ID NO:412<br>CGGGCAAGTCAGGGCATTAG<br>AAATGATTTAGGC | | SEQ ID NO:8424<br>GCTACATCCAGTTTGCAA<br>AGT | | SEQ ID NO:16436<br>CTACAGCATAATAGTTACCC<br>CCTCACT |
| 21-225_21E5 | AA | SEQ ID NO:413<br>RASQGIRNDLG | | SEQ ID NO:8425<br>ATSSLQS | | SEQ ID NO:16437<br>LQHNSYPLT |
| iPS:392856 | NA | SEQ ID NO:414<br>CGGGCGAGTCAGGACATTAG<br>CAATTATTTAGCC | | SEQ ID NO:8426<br>GCTGCATCCAGTTTGCAA<br>AGT | | SEQ ID NO:16438<br>CAACAGTATAATAGTTTCCC<br>GCTCACT |

FIGURE 49
(Continued)

| | | | | | | | |
|---|---|---|---|---|---|---|---|
| iPS:392858 | 21-225_22A2 | AA | SEQ ID NO:415 RASQDISNYLA SEQ ID NO:416 | | SEQ ID NO:8427 AASSLQS SEQ ID NO:8428 | | SEQ ID NO:16439 QQYNSFPLT SEQ ID NO:16440 |
| | | NA | CGGGCAAGTCAGGGCATTAG AAATGATTAGGC SEQ ID NO:417 | | GCTGCATCCAGTGTGCA AAGT SEQ ID NO:8429 | | CTACAGCATAATAGTTACC GCTCACT SEQ ID NO:16441 |
| iPS:392860 | 21-225_22H4 | AA | RASQGIRNDLG SEQ ID NO:418 | | AASSVQS SEQ ID NO:8430 | | LQHNSYPLT SEQ ID NO:16442 |
| | | NA | AAGTCTAGTCAGAGCCTCCT GCATAGTGATGGAAAGACCT TTTTGTAT SEQ ID NO:419 | | GAAGTTCCAACCGGTTC TCT SEQ ID NO:8431 | | ATGCAAAGTATACAGCTTCC GCTCTCA SEQ ID NO:16443 |
| iPS:392864 | 21-225_22H8 | AA | KSSQSLLHSDGKTFLY SEQ ID NO:420 | | EVSNRFS SEQ ID NO:8432 | | MQSIQLPLS SEQ ID NO:16444 |
| | | NA | AGGGCCAGTCAGAATGTTTA CAGCAGCTACTTAGCC SEQ ID NO:421 | | GGTGCATCCAGCAGGGC CAGT SEQ ID NO:8433 | | CAGCAGTATGGTAGCTCACC TCGGACG SEQ ID NO:16445 |
| iPS:392866 | 21-225_23B9 | AA | RASQNVYSSYLA SEQ ID NO:422 | | GASSRAS SEQ ID NO:8434 | | QQYGSSPRT SEQ ID NO:16446 |
| | | NA | CGGGCAAGTCAGGGCATTAG AAATGATTAGAC SEQ ID NO:423 | | GCTGCATCCAGTTGCAA AGT SEQ ID NO:8435 | | CTACAGCATAATCGTTACC GCTCACT SEQ ID NO:16447 |
| iPS:392868 | 21-225_23H11 | AA | RASQGIRNDLD SEQ ID NO:424 | | AASSLQS SEQ ID NO:8436 | | LQHNRYPLT SEQ ID NO:16448 |
| | | NA | CAGGCGAGTCAGGACATTAA CAACTATTTAAAT SEQ ID NO:425 | | GATGCATCCGATTGGA AACA SEQ ID NO:8437 | | CAACAGTATGAAAATCTCCC GATCACC SEQ ID NO:16449 |
| | 21-225_24D6 | AA | QASQDINNYLN SEQ ID NO:426 | | DASDLET SEQ ID NO:8438 | | QQYENLPIT SEQ ID NO:16450 |

FIGURE 49
(Continued)

| | | | | | |
|---|---|---|---|---|---|
| iPS:3928870 | 21-225_20G9 | NA | CGGGCAAGTCAGGGCATTAG AAATGATTTAGGC<br>SEQ ID NO:427 | GCTGCATCCAGTTTGCAA AGT<br>SEQ ID NO:8439 | CTACAGGCATAGTACTTACCC TCTCACT<br>SEQ ID NO:16451 |
| | | AA | RASQGIRNDLG<br>SEQ ID NO:428 | AASSLQS<br>SEQ ID NO:8440 | LQHSTYPLT<br>SEQ ID NO:16452 |
| iPS:3928872 | 21-225_20B11 | NA | CGGGCAAGTCAGGGCATTGG AAATGATTTAGGC<br>SEQ ID NO:429 | GCTGCATCCAGTTTGCAT AGT<br>SEQ ID NO:8441 | CTACAGCATTATAGTTACCC TCGGACG<br>SEQ ID NO:16453 |
| | | AA | RASQGIGNDLG<br>SEQ ID NO:430 | AASSLHS<br>SEQ ID NO:8442 | LQHYSYPRT<br>SEQ ID NO:16454 |
| iPS:3928874 | 21-225_21D2 | NA | CGGGCAAGTCAGAGCATTAG CGACTATTTAAAT<br>SEQ ID NO:431 | GATACATCCAGTTTGCA AAGT<br>SEQ ID NO:8443 | CAACAGACTTACAATATTCT TCCGGAGCGCAGT<br>SEQ ID NO:16455 |
| | | AA | RASQSISDYLN<br>SEQ ID NO:432 | DTSSLQS<br>SEQ ID NO:8444 | QQTYNILPERS<br>SEQ ID NO:16456 |
| iPS:3928876 | 21-225_21F7 | NA | CGGGCAAGTCAGGACATTAG AAATGATTTAGGC<br>SEQ ID NO:433 | GCTGCATCCAGTTTCAA AGT<br>SEQ ID NO:8445 | CTACAGCATAATAATTACCC GTGGACG<br>SEQ ID NO:16457 |
| | | AA | RASQDIRNDLG<br>SEQ ID NO:434 | AASNFQS<br>SEQ ID NO:8446 | LQHNNYPWT<br>SEQ ID NO:16458 |
| iPS:3928878 | 21-225_22C5 | NA | CGGGCAAGTCAGAACATTAG CAGTATTTAAAT<br>SEQ ID NO:435 | GCTGCATCCGTTTGCAA CAT<br>SEQ ID NO:8447 | CAACAGAGTTACAGAACCC CTTATTCACT<br>SEQ ID NO:16459 |
| | | AA | RASQNISSYLN<br>SEQ ID NO:436 | AASVLQH<br>SEQ ID NO:8448 | QQSYRTPLFT<br>SEQ ID NO:16460 |
| iPS:3928880 | 21-225_22F9 | NA | CGGGCAAGTCAGGGCATTAG AAATGATTTAGGC<br>SEQ ID NO:437 | GCTGCATCCAGTTTACAA AGT<br>SEQ ID NO:8449 | CTACAGCATAATAGTTACCC GCTCACT<br>SEQ ID NO:16461 |
| | | AA | RASQGIRNDLG<br>SEQ ID NO:438 | AASSLQS<br>SEQ ID NO:8450 | LQHNSYPLT<br>SEQ ID NO:16462 |

FIGURE 49
(Continued)

| | | | | |
|---|---|---|---|---|
| iPS:392882 | 21-225_23A3 | NA | CGGGCAAGTCAGGGCATTAG AAATGATTAGGC<br>SEQ ID NO:439 | GCTGCATCCAGTGTGCA AAGT<br>SEQ ID NO:8451 | CTACAGCATAATAGTTACCC GCTCACT<br>SEQ ID NO:16463 |
| | | AA | RASQGIRNDLG<br>SEQ ID NO:440 | AASSVQS<br>SEQ ID NO:8452 | LQHNSYPLT<br>SEQ ID NO:16464 |
| iPS:392884 | 21-225_23A10 | NA | CGGGCAAGTCAGGGCATTAG AAATGATTAGGC<br>SEQ ID NO:441 | GCTGCATCCAGTTTGCAA AGT<br>SEQ ID NO:8453 | CTGCAACATTATAGTTACCC TCGGACG<br>SEQ ID NO:16465 |
| | | AA | RASQGIRNDLG<br>SEQ ID NO:442 | AASSLQS<br>SEQ ID NO:8454 | LQHYSYPRT<br>SEQ ID NO:16466 |
| iPS:392886 | 21-225_23A12 | NA | AAGTCCAGCCAGAGTGTTTT ATACAGCTCCAACAATAACA ATTATTAGCT<br>SEQ ID NO:443 | TGGACATCTACCCGGGA ATCC<br>SEQ ID NO:8455 | CAGCAGTATTATGATACTCC TCCGACG<br>SEQ ID NO:16467 |
| | | AA | KSSQSVLYSSNNNNYLA<br>SEQ ID NO:444 | WTSTRES<br>SEQ ID NO:8456 | QQYYDTPPT<br>SEQ ID NO:16468 |
| iPS:392888 | 21-225_25A2 | NA | AAGTCTAGTCAGAGCCTCCT ACATAGTGAAGGAAAGACC TATTGTAT<br>SEQ ID NO:445 | GAAATTTCCAACCGGTTC TCT<br>SEQ ID NO:8457 | ATGCAAAGTACACAGTTTCC GCTCACT<br>SEQ ID NO:16469 |
| | | AA | KSSQSLLHSEGKTYLY<br>SEQ ID NO:446 | EISNRFS<br>SEQ ID NO:8458 | MQSTQFPLT<br>SEQ ID NO:16470 |
| iPS:392890 | 21-225_20H9 | NA | CGGGCGAGTCAGGGCATTAG CAATTATTAGCC<br>SEQ ID NO:447 | GCTGCATCCAGTTGCAA AGT<br>SEQ ID NO:8459 | CAACAGTATAATAGTTACCC ATTCACT<br>SEQ ID NO:16471 |
| | | AA | RASQGISNYLA<br>SEQ ID NO:448 | AASSLQS<br>SEQ ID NO:8460 | QQYNSYPFT<br>SEQ ID NO:16472 |
| iPS:392892 | 21-225_20C11 | NA | CGGGCGAGTCAGGACATTAG CAATTATTAGCC<br>SEQ ID NO:449 | GCTGCATCCAGTTGCAA AGT<br>SEQ ID NO:8461 | CAACAGTATCATAGTTTCCC ATTCACT<br>SEQ ID NO:16473 |

FIGURE 49
(Continued)

| | | | | | |
|---|---|---|---|---|---|
| iPS:392894 | 21-225_21G2 | AA | RASQDISNYLA<br>SEQ ID NO:450 | AASSLQS<br>SEQ ID NO:8462 | QQYHSFPFT<br>SEQ ID NO:16474 |
| | | NA | CGGGCAAGTCAGGGCATTAG<br>AAATGATTTAGGC<br>SEQ ID NO:451 | ACTTCATCCAGTTTGCAA<br>AGT<br>SEQ ID NO:8463 | CTACAACATAATAGTTACCC<br>GTGGACG<br>SEQ ID NO:16475 |
| iPS:392896 | 21-225_21G7 | AA | RASQGIRNDLG<br>SEQ ID NO:452 | TSSSLQS<br>SEQ ID NO:8464 | LQHNSYPWT<br>SEQ ID NO:16476 |
| | | NA | CGGGCAAGTCAGGGCGTTAG<br>AAATGATTAGGC<br>SEQ ID NO:453 | GCTGCATCCAGTTTGCAA<br>AGT<br>SEQ ID NO:8465 | CTACAGCATAGTAGTTACCC<br>GCTCACT<br>SEQ ID NO:16477 |
| iPS:392898 | 21-225_21H10 | AA | RASQGVRNDLG<br>SEQ ID NO:454 | AASSLQS<br>SEQ ID NO:8466 | LQHSSYPLT<br>SEQ ID NO:16478 |
| | | NA | AGGGCCAGTCAGAGTTTTAG<br>CAGCAGCTACTTAGCC<br>SEQ ID NO:455 | GGTGCATCCAGCAGGGC<br>CACT<br>SEQ ID NO:8467 | CAGCAGTATGGTAGCTCACG<br>CAGT<br>SEQ ID NO:16479 |
| iPS:392900 | 21-225_22F2 | AA | RASQSFSSSYLA<br>SEQ ID NO:456 | GASSRAT<br>SEQ ID NO:8468 | QQYGSSRS<br>SEQ ID NO:16480 |
| | | NA | CGGGCAAGTCAGGGCATTAG<br>AAATGATTAGGC<br>SEQ ID NO:457 | GCTGCATCCAGTTACAA<br>AGT<br>SEQ ID NO:8469 | CTACAGCATAATAGTTACCC<br>GCTCACT<br>SEQ ID NO:16481 |
| iPS:392902 | 21-225_22D5 | AA | RASQGIRNDLG<br>SEQ ID NO:458 | AASSLQS<br>SEQ ID NO:8470 | LQHNSYPLT<br>SEQ ID NO:16482 |
| | | NA | CGGGCAAGTCAGAACATTT<br>TAGTTATTTAAAT<br>SEQ ID NO:459 | GCTGCATCCAGTTGCAA<br>AGT<br>SEQ ID NO:8471 | CAACAGAGTTACAGTACCCC<br>CTTATTCACT<br>SEQ ID NO:16483 |
| iPS:392904 | 21-225_22G9 | AA | RASQNIFSYLN<br>SEQ ID NO:460 | AASSLQS<br>SEQ ID NO:8472 | QQSYSTPLFT<br>SEQ ID NO:16484 |
| | | NA | CGGGCAAGTCAGGGCATTAG<br>AAATGATTAGGC<br>SEQ ID NO:461 | GCTGCTTCCAGTTTGCAA<br>AGT<br>SEQ ID NO:8473 | CTACAGCATGCCAGTTACCC<br>GCTCACT<br>SEQ ID NO:16485 |

FIGURE 49
(Continued)

| ID | sub-ID | | | | |
|---|---|---|---|---|---|
| iPS:392908 | 21-225_23F12 | AA | RASQGIRNDLG SEQ ID NO:462 | AASSLQS SEQ ID NO:8474 | LQHASYPLT SEQ ID NO:16486 |
| | | NA | CGGGCAAGTCAGGGCATTAG AAATGATTAGGC SEQ ID NO:463 | GTTGCATCCAGTTTGCAA AGT SEQ ID NO:8475 | CTACAGCATAATAGTTACCC GTGGACG SEQ ID NO:16487 |
| iPS:392912 | 21-225_25A9 | AA | RASQGIRNDLG SEQ ID NO:464 | VASSLQS SEQ ID NO:8476 | LQHNSYPWT SEQ ID NO:16488 |
| | | NA | CGGGCAAGTCAGGGCATTAG AAATGATTAGGC SEQ ID NO:465 | GCTGCATCCAGTTTGCAA AGT SEQ ID NO:8477 | CTACAGCATAATAGTTACCC ATTCACT SEQ ID NO:16489 |
| iPS:392914 | 21-225_25D12 | AA | RASQGIRNDLG SEQ ID NO:466 | AASSLQS SEQ ID NO:8478 | LQHNSYPFT SEQ ID NO:16490 |
| | | NA | CGGACAAGTCAGGGCATTAG AAATGATTAGGC SEQ ID NO:467 | GCTGCATCCAGTTTACAA AGT SEQ ID NO:8479 | CTACAGCATTATAGTTTCCT CGGACG SEQ ID NO:16491 |
| iPS:392916 | 21-225_27C5 | AA | RTSQGIRNDLG SEQ ID NO:468 | AASSLQS SEQ ID NO:8480 | LQHYSFPRT SEQ ID NO:16492 |
| | | NA | CGGGCGAGTCAGGGTATTAG CAGCTGGTTAGCC SEQ ID NO:469 | GGTGCATCCAGTTTGCA AAGT SEQ ID NO:8481 | CAACAGTATGACAGTTTCCC TCGGACG SEQ ID NO:16493 |
| iPS:392918 | 21-225_28F5 | AA | RASQGISSWLA SEQ ID NO:470 | GASSLQS SEQ ID NO:8482 | QQYDSFPRT SEQ ID NO:16494 |
| | | NA | CGGGCAAGTCAGGGCATTAG AAATGATTAGGC SEQ ID NO:471 | ACTGCATCCAGTTTGCAA AGT SEQ ID NO:8483 | CTACAGCATAATACTTACCC GTGGACG SEQ ID NO:16495 |
| iPS:392920 | 21-225_29G4 | AA | RASQGIRNDLG SEQ ID NO:472 | TASSLQS SEQ ID NO:8484 | LQHNTYPWT SEQ ID NO:16496 |
| | | NA | CGGGCAAGTCAGGGCATTAG AAATGATTAGGC SEQ ID NO:473 | GCTGCATCCAGTTTGCAA AGT SEQ ID NO:8485 | CTACAGCATAATAGTTACCC GCTCACT SEQ ID NO:16497 |

FIGURE 49
(Continued)

| | | AA/NA | CDR1 | CDR2 | CDR3 |
|---|---|---|---|---|---|
| iPS:392922 | 21-225_30G4 | AA | RASQGIRNDLG<br>SEQ ID NO:474 | AASSLQS<br>SEQ ID NO:8486 | LQHNSYPLT<br>SEQ ID NO:16498 |
| | | NA | CGGGCAACTCAGAGAACATTTT CAGCTATTTAAAT<br>SEQ ID NO:475 | ACTGCATCCAGTTGCAA GGT<br>SEQ ID NO:8487 | CAACTCAGCTACAGTCCCCC GTACACT<br>SEQ ID NO:16499 |
| iPS:392924 | 21-225_32H2 | AA | RATQNIFSYLN<br>SEQ ID NO:476 | TASSLQG<br>SEQ ID NO:8488 | QLSYSPPYT<br>SEQ ID NO:16500 |
| | | NA | AGGTCTAGTCAGAGCCTCCT CCATAGTGATGGAAGGACCT TCATTTGTAT<br>SEQ ID NO:477 | GAACTTTCCAACCGGTTC TCT<br>SEQ ID NO:8489 | TTGCAAAGTATACAATATCC CATCACC<br>SEQ ID NO:16501 |
| iPS:392928 | 21-225_25A4 | AA | RSSQSLLHSDGRTYLY<br>SEQ ID NO:478 | ELSNRFS<br>SEQ ID NO:8490 | LQSIQYPIT<br>SEQ ID NO:16502 |
| | | NA | AAGTCCAGCCAGAGTGTTT ATACAGTCCCACAATAACA ACTACTTAGCT<br>SEQ ID NO:479 | TGGGCATCTACCCGGGA ATCC<br>SEQ ID NO:8491 | CAGCAGTATTATAGTACTCC TCCGACG<br>SEQ ID NO:16503 |
| iPS:392930 | 21-225_25H9 | AA | KSSQSVLYSSHNNNYLA<br>SEQ ID NO:480 | WASTRES<br>SEQ ID NO:8492 | QQYYSTPPT<br>SEQ ID NO:16504 |
| | | NA | AAGTCTAGTCAGAGCCTCCT GCATGGTGATGGAAGACCT ATTTGTTT<br>SEQ ID NO:481 | GAAGTTTCCAATCGGTTC TCT<br>SEQ ID NO:8493 | ATGCAAAGTATACAGCTTCC GTGGACG<br>SEQ ID NO:16505 |
| iPS:392934 | 21-225_27D5 | AA | KSSQSLLHGDGKTYLF<br>SEQ ID NO:482 | EVSNRFS<br>SEQ ID NO:8494 | MQSIQLPWT<br>SEQ ID NO:16506 |
| | | NA | CGGGCAAGTCAGGGCATTAG AAATGATTTAGGC<br>SEQ ID NO:483 | GCTGCATCCAGTTGCAA AGT<br>SEQ ID NO:8495 | CTACAGCATAATAGTTACCC ATTCACT<br>SEQ ID NO:16507 |
| | | AA | RASQGIRNDLG<br>SEQ ID NO:484 | AASSLQS<br>SEQ ID NO:8496 | LQHNSYPFT<br>SEQ ID NO:16508 |

FIGURE 49
(Continued)

| | | | | |
|---|---|---|---|---|
| iPS:392936 | 21-225_28B6 | NA | CGGTCTAGTCAAAGCCTCGTATATAGTGATGGAGACACCTACTTGAAT<br>SEQ ID NO:485 | AAGGTTTCTAACTGGGACTCT<br>SEQ ID NO:8497 | ATGCATTGTTACACACTGGCTCCTT<br>SEQ ID NO:16509 |
| | | AA | RSSQSLVYSDGDTYLN<br>SEQ ID NO:486 | KVSNWDS<br>SEQ ID NO:8498 | MHCTHWLL<br>SEQ ID NO:16510 |
| iPS:392938 | 21-225_29H4 | NA | AAGTCTAGTCAGAGCCTCCTGCATAGTGATGGAAAGACCTTCTATTTGTAT<br>SEQ ID NO:487 | GAGGTTTCCCACCGGTTCTCT<br>SEQ ID NO:8499 | ATGCAAAGTATACAGCATCCGTTCACT<br>SEQ ID NO:16511 |
| | | AA | KSSQSLLHSDGKTYLY<br>SEQ ID NO:488 | EVSHRFS<br>SEQ ID NO:8500 | MQSIQHPFT<br>SEQ ID NO:16512 |
| iPS:392940 | 21-225_29D9 | NA | CGGGCAAGTCAGGGCATTAGAAATGATTAGGC<br>SEQ ID NO:489 | GCTGCATCCAGTTTGCAAAGT<br>SEQ ID NO:8501 | CTACAGCATAATACTTACCCATTCACT<br>SEQ ID NO:16513 |
| | | AA | RASGIRNDLG<br>SEQ ID NO:490 | AASSLQS<br>SEQ ID NO:8502 | LQHNTYPFT<br>SEQ ID NO:16514 |
| iPS:392942 | 21-225_30E9 | NA | CGGGCAAGTCAGGACATTAGAGATGATTAGGC<br>SEQ ID NO:491 | GGTGCATTCAGCTTGCAAAGT<br>SEQ ID NO:8503 | CTACAGCATACTAGTTACCTCCTACT<br>SEQ ID NO:16515 |
| | | AA | RASQDIRDDLG<br>SEQ ID NO:492 | GAFSLQS<br>SEQ ID NO:8504 | LQHTSYPPT<br>SEQ ID NO:16516 |
| iPS:392944 | 21-225_31H5 | NA | CGGGCAAGTCAGGACATTAGAAGTGATTAGGC<br>SEQ ID NO:493 | GCTGCATCCAGTTTGCAAAGT<br>SEQ ID NO:8505 | ATACAACATATTATTTACCTCCTACT<br>SEQ ID NO:16517 |
| | | AA | RASQDIRSDLG<br>SEQ ID NO:494 | AASSLQS<br>SEQ ID NO:8506 | IQHIIYPPT<br>SEQ ID NO:16518 |
| iPS:392948 | 21-225_25G5 | NA | CGGGCAAGTCAGGACATTAGAAATGATTAGGC<br>SEQ ID NO:495 | GCTGCATCCAGTTTGCAAAGT<br>SEQ ID NO:8507 | CTACAGCATAATAGTTACCCTTCACT<br>SEQ ID NO:16519 |

FIGURE 49 (Continued)

| | | | | | | | |
|---|---|---|---|---|---|---|---|
| iPS:392950 | | AA | RASQDIRNDLG<br>SEQ ID NO:496 | | AASSLQS<br>SEQ ID NO:8508 | | LQHNSYPFT<br>SEQ ID NO:16520 |
| | 21-225_25C10 | NA | CGGGCGAGTCAGGGCATTAG<br>CAATTATTAGCC<br>SEQ ID NO:497 | | GCTGCATCCAGTTTGCAA<br>AGT<br>SEQ ID NO:8509 | | CAACAGTATCATAGTTACCC<br>ATTCACT<br>SEQ ID NO:16521 |
| iPS:392952 | | AA | RASQGISNYLA<br>SEQ ID NO:498 | | AASSLQS<br>SEQ ID NO:8510 | | QQYHSYPFT<br>SEQ ID NO:16522 |
| | 21-225_26G1 | NA | CGGGCGAGTCAGGACATTAG<br>CAATTATTAGCC<br>SEQ ID NO:499 | | GCTGCATCCAGTTTGCGA<br>AGT<br>SEQ ID NO:8511 | | CAACAGTATCATAGTTACCC<br>ATTCACT<br>SEQ ID NO:16523 |
| iPS:392954 | | AA | RASQDISNYLA<br>SEQ ID NO:500 | | AASSIRS<br>SEQ ID NO:8512 | | QQYHSYPFT<br>SEQ ID NO:16524 |
| | 21-225_26A10 | NA | CGGGCAAGTCAGAGCATTAG<br>CAGCTATTTAAAT<br>SEQ ID NO:501 | | GCTGCATCCAGTTGCA<br>AAGT<br>SEQ ID NO:8513 | | CAACAGAGTTACAGTACCCC<br>TACGTGGACG<br>SEQ ID NO:16525 |
| iPS:392956 | | AA | RASQSISSYLN<br>SEQ ID NO:502 | | AASSLQS<br>SEQ ID NO:8514 | | QQSYSTPTWT<br>SEQ ID NO:16526 |
| | 21-225_27A11 | NA | CGGGCGAGTCAGGGTATTAG<br>TAGTTGGTTAGCC<br>SEQ ID NO:503 | | GGTGCATCCAGTTGCA<br>AAGT<br>SEQ ID NO:8515 | | CAACAGTCTGACAGTTCCC<br>TCGGACG<br>SEQ ID NO:16527 |
| iPS:392958 | | AA | RASQGISSWLA<br>SEQ ID NO:504 | | GASSLQS<br>SEQ ID NO:8516 | | QQSDSFPRT<br>SEQ ID NO:16528 |
| | 21-225_28C7 | NA | CGGGCAAGTCAGGGCATTAG<br>AAATGATTTAGGC<br>SEQ ID NO:505 | | ATTGCATCCAGTTGCAA<br>AGT<br>SEQ ID NO:8517 | | CTACAGCATAATACTTACCC<br>GTGGACG<br>SEQ ID NO:16529 |
| iPS:392960 | | AA | RASQGIRNDLG<br>SEQ ID NO:506 | | IASSLQS<br>SEQ ID NO:8518 | | LQHNTYPWT<br>SEQ ID NO:16530 |
| | 21-225_29E6 | NA | AAGTCCAGCCAGAGTGTTTT<br>ATACAGCTCCCACAATAACT<br>ACTACTTAACT | | TGGGCATCTTCCCGGGA<br>ATCC | | CAGCAGTATTATAGTACTCC<br>TCCGACG |

FIGURE 49
(Continued)

| | | | | | | |
|---|---|---|---|---|---|---|
| iPS:392962 | 21-225_29E6 | AA | SEQ ID NO:507<br>KSSQSVLYSSHNNYLT | SEQ ID NO:8519<br>WASSRES | SEQ ID NO:16531<br>QQYYSTPPT | |
| iPS:392964 | 21-225_30A1 | NA | SEQ ID NO:508<br>CGGGCGAGTCAGGGCATTAG<br>CAATTATTAGCC | SEQ ID NO:8520<br>GCTGCATCCAGTTGCAA<br>ACT | SEQ ID NO:16532<br>CAACAGTATAATAGTTACCC<br>ATTCACT | |
| | | AA | SEQ ID NO:509<br>RASQGISNYLA | SEQ ID NO:8521<br>AASSLQT | SEQ ID NO:16533<br>QQYNSYPFT | |
| iPS:392966 | 21-225_31A8 | NA | SEQ ID NO:510<br>CGGGCAAGTCAGGACATTAG<br>AAGTGATTTAGGC | SEQ ID NO:8522<br>GCTGTATCCAGTTGCAA<br>AGT | SEQ ID NO:16534<br>CTACAGCATACTATTACCC<br>TCCTACT | |
| | | AA | SEQ ID NO:511<br>RASQDIRSDLG | SEQ ID NO:8523<br>AVSSLQS | SEQ ID NO:16535<br>LQHTIYPPT | |
| iPS:392968 | 21-225_32G3 | NA | SEQ ID NO:512<br>CGGGCGAGTCAGGCAGCATTAG<br>CAATTATTAGCC | SEQ ID NO:8524<br>GATACATCCAGTTGCA<br>AAGT | SEQ ID NO:16536<br>CAACAGTATCATAGTTACCC<br>GCTCACT | |
| | | AA | SEQ ID NO:513<br>RASQAISNYLA | SEQ ID NO:8525<br>DTSSLQS | SEQ ID NO:16537<br>QQYHSYPLT | |
| iPS:392972 | 21-225_25B6 | NA | SEQ ID NO:514<br>CGGGCAAGTCAGGGCATTAG<br>AAATGATTTAGGC | SEQ ID NO:8526<br>CGTGCATCCAGTTGCAA<br>AGT | SEQ ID NO:16538<br>CTACAGCATAATAGTTACCC<br>ATTCACT | |
| | | AA | SEQ ID NO:515<br>RASQGIRNDLG | SEQ ID NO:8527<br>RASSLQS | SEQ ID NO:16539<br>LQHNSYPFT | |
| iPS:392974 | 21-225_26A2 | NA | SEQ ID NO:516<br>CGGGCAAGTCAGGGCATTAG<br>AAGTGATTTAGGC | SEQ ID NO:8528<br>ACTGCATCCAGTTGCAG<br>AGT | SEQ ID NO:16540<br>CTACAGCATAATCGTTACCC<br>GTGGACG | |
| | | AA | SEQ ID NO:517<br>RASQGIRSDLG | SEQ ID NO:8529<br>TASSLQS | SEQ ID NO:16541<br>LQHNRYPWT | |
| | | NA | SEQ ID NO:518<br>CGGGCAAGTCAGGCCATTAG<br>AAATGATTTAGGC | SEQ ID NO:8530<br>GCTGCATCCAGTTGCAA<br>AGT | SEQ ID NO:16542<br>CTACAGCATTATAATTACCC<br>TCGCAGT | |

FIGURE 49
(Continued)

| | | | | | |
|---|---|---|---|---|---|
| iPS:392976 | 21-225_26A11 | | SEQ ID NO:519 RASQAIRNDLG | SEQ ID NO:8531 AASSLQS | SEQ ID NO:16543 LQHYNYPRS |
| | | AA | SEQ ID NO:520 | SEQ ID NO:8532 | SEQ ID NO:16544 |
| iPS:392978 | 21-225_27H12 | NA | CGGGCGAGTCAGGGCATTAG CAATTATTTAGCC | GGTGCATCCAGTTGCA AAGT | CAACAGTATTATAGTTACCC ATTCACT |
| | | | SEQ ID NO:521 RASQGISNYLA | SEQ ID NO:8533 GASSLQS | SEQ ID NO:16545 QQYYSYPFT |
| | | AA | SEQ ID NO:522 | SEQ ID NO:8534 | SEQ ID NO:16546 |
| iPS:392980 | 21-225_28B8 | NA | CGGGCAAGTCAGGGCATTAG AAATGATTTAGGC | GCTGCATCCAGTTGCAA AGT | CTACAGCATAATAGTTACCC ATTCACT |
| | | | SEQ ID NO:523 RASQGIRNDLG | SEQ ID NO:8535 AASSLQS | SEQ ID NO:16547 LQHNSYPFT |
| | | AA | SEQ ID NO:524 | SEQ ID NO:8536 | SEQ ID NO:16548 |
| iPS:392982 | 21-225_29H6 | NA | CGGGCAAGTCAGGGCATTAG AAATGATTTAGGC | GCTGCATCCAGTTGCAA AGT | CTACAGCATAATAGTTACCC GCTCACT |
| | | | SEQ ID NO:525 RASQGIRNDLG | SEQ ID NO:8537 AASSLQS | SEQ ID NO:16549 LQHNSYPLT |
| | | AA | SEQ ID NO:526 | SEQ ID NO:8538 | SEQ ID NO:16550 |
| iPS:392984 | 21-225_30D1 | NA | CGGGCAAGTCAGGACATTAG AAGTGATTTAGGC | GCTGCATCCAGTTGCAA AGT | CTACAGCATACTATTACCC TCCTACT |
| | | | SEQ ID NO:527 RASQDIRSDLG | SEQ ID NO:8539 AASSLQS | SEQ ID NO:16551 LQHTIYPPT |
| | | AA | SEQ ID NO:528 | SEQ ID NO:8540 | SEQ ID NO:16552 |
| iPS:392986 | 21-225_30E11 | NA | CGGGCAAGTCAGGACATTAG CAACTATTTAAAT | GCTGCATCCAGTTGCAA AGT | CAACAGAGTTACAGTACCC ATTCACT |
| | | | SEQ ID NO:529 RASQSISNYLN | SEQ ID NO:8541 AASSLQS | SEQ ID NO:16553 QQSYSTPFT |
| | | AA | SEQ ID NO:530 | SEQ ID NO:8542 | SEQ ID NO:16554 |
| | | NA | CGGGCAAGTCAGGACATTAG AAGTGATTTAGGC | GGTGCATCCAGTTGCA AAGT | CTACAGCATATTATTACCCT CCTACT |

FIGURE 49
(Continued)

| | | | | | | |
|---|---|---|---|---|---|---|
| iPS:392988 | 21-225_31B8 | AA | SEQ ID NO:531<br>RASQDIRSDLG | SEQ ID NO:8543<br>GASSLQS | SEQ ID NO:16555<br>LQHIYPPT | |
| | | NA | SEQ ID NO:532<br>CGGGCAAGTCAGGGCATTAGAAATGATTTAGGC | SEQ ID NO:8544<br>GCTGCATCCAGTTTGCAAAGT | SEQ ID NO:16556<br>CTACAGCATAATAGTTACCCGCTCACT | |
| iPS:392990 | 21-225_25E6 | AA | SEQ ID NO:533<br>RASQGIRNDLG | SEQ ID NO:8545<br>AASSLQS | SEQ ID NO:16557<br>LQHNSYPLT | |
| | | NA | SEQ ID NO:534<br>CGGGCAAGTCAGGGCATTAGAAATGATTTAGGC | SEQ ID NO:8546<br>GCTGCATCCAGTTTGCAAAGT | SEQ ID NO:16558<br>CTACAGCATAATAGTTACCCGCTCACT | |
| iPS:392992 | 21-225_25H10 | AA | SEQ ID NO:535<br>RASRGIRNDLG | SEQ ID NO:8547<br>AAFSLQS | SEQ ID NO:16559<br>LQHNSYPLT | |
| | | NA | SEQ ID NO:536<br>AAGTCCAGCCAGAGTGTTTTATACCGCTCCAACAATTACAACTACTTAGCT | SEQ ID NO:8548<br>TGGGCATCTACCCGGAATCC | SEQ ID NO:16560<br>CAGCAATATATAGTACTCCTCCGACG | |
| | 21-225_26C4 | AA | SEQ ID NO:537<br>KSSQSVLYRSNNYNYLA | SEQ ID NO:8549<br>WASTRES | SEQ ID NO:16561<br>QQYYSTPPT | |
| iPS:392994 | 21-225_26G11 | NA | SEQ ID NO:538<br>AAGTCTAGTCAGACCCTCCTGCATGGTGAAGGAAAGACCTATTTGTAT | SEQ ID NO:8550<br>GAAGTTTCCAACCGGTTCTCT | SEQ ID NO:16562<br>ATGCAAAGTATAAAGCTTCCGCTCACT | |
| | | AA | SEQ ID NO:539<br>KSSQTLLHGEGKTYLY | SEQ ID NO:8551<br>EVSNRFS | SEQ ID NO:16563<br>MQSIKLPLT | |
| iPS:392996 | 21-225_28B1 | NA | SEQ ID NO:540<br>CGGGCGAGTCAGGCTATCAATGACTGGTTAGCC | SEQ ID NO:8552<br>GCTGCATCCAGTTTCCAAAGT | SEQ ID NO:16564<br>CAACAGGCTAGCAGTTTCCATTCACT | |
| | | AA | SEQ ID NO:541<br>RASQAINDWLA | SEQ ID NO:8553<br>AASSFQS | SEQ ID NO:16565<br>QQASSFPFT | |
| | | | SEQ ID NO:542 | SEQ ID NO:8554 | SEQ ID NO:16566 | |

FIGURE 49
(Continued)

| | | | | | | |
|---|---|---|---|---|---|---|
| iPS:392998 | 21-225_28A9 | NA | CGGGCAAGTCAGGGCATTAG AAATGATTAGGC | GCTGCTTCTAGTTTGCAA AAT | CTACAGCATAATCGTTACCC ATTCACT | |
| | | | SEQ ID NO:543 | SEQ ID NO:8555 | SEQ ID NO:16567 | |
| | | AA | RASQGIRNDLG | AASSLQN | LQHNRYPFT | |
| | | | SEQ ID NO:544 | SEQ ID NO:8556 | SEQ ID NO:16568 | |
| iPS:393000 | 21-225_29D7 | NA | CGGGCAAGTCAGGGCATTAG AAATGATTAGGC | GCTGCATCCAGTTTACAA AGT | CTACAGCATAATAGTTACCC ATTCACT | |
| | | | SEQ ID NO:545 | SEQ ID NO:8557 | SEQ ID NO:16569 | |
| | | AA | RASQGIRNDLG | AASSLQS | LQHNSYPFT | |
| | | | SEQ ID NO:546 | SEQ ID NO:8558 | SEQ ID NO:16570 | |
| iPS:393002 | 21-225_30G1 | NA | CGGGCAAGTCAGAACATTTA CAGCTATTTAAAT | GCTGCATCCAGTTTGCAT AGT | CAACAGAGTTACAGTACTCC GCTCACT | |
| | | | SEQ ID NO:547 | SEQ ID NO:8559 | SEQ ID NO:16571 | |
| | | AA | RASQNIYSYLN | AASSLHS | QQSYSTPLT | |
| | | | SEQ ID NO:548 | SEQ ID NO:8560 | SEQ ID NO:16572 | |
| iPS:393004 | 21-225_30G11 | NA | CGGGCAAGTCAGGACATTAG AAGTGATTAGGC | GCTGCATCCAGTTTGCAA AGT | CTACAGCATACTATTACCC TCCTACT | |
| | | | SEQ ID NO:549 | SEQ ID NO:8561 | SEQ ID NO:16573 | |
| | | AA | RASQDIRSDLG | AASSLQS | LQHTYPPT | |
| | | | SEQ ID NO:550 | SEQ ID NO:8562 | SEQ ID NO:16574 | |
| iPS:393006 | 21-225_31G9 | NA | CGGGCAAGTCAGGGCATTAG AAATGATTAGGC | CCTGCATCCAGTTTGCAA AGT | CTACAGGATAATAGTTACCC TTTCACT | |
| | | | SEQ ID NO:551 | SEQ ID NO:8563 | SEQ ID NO:16575 | |
| | | AA | RASQGIRNDLG | PASSLQS | LQDNSYPFT | |
| | | | SEQ ID NO:552 | SEQ ID NO:8564 | SEQ ID NO:16576 | |
| iPS:393010 | 21-225_25E11 | NA | CGGGCGAGTCAGGGTATTAG CAACTGGTTAGCC | ACTGCATCCAGTTTGCAA GGT | CAACAGGCTAACAGTTTCC AATCACT | |
| | | | SEQ ID NO:553 | SEQ ID NO:8565 | SEQ ID NO:16577 | |
| | | AA | RASQGISNWLA | TASSLQG | QQANSFPIT | |
| | | | SEQ ID NO:554 | SEQ ID NO:8566 | SEQ ID NO:16578 | |

FIGURE 49
(Continued)

| | | | | | | |
|---|---|---|---|---|---|---|
| iPS:393012 | 21-225_26G7 | NA | AAGTCTAGTCAGAGCCTCCT GCATAGTGAGGGAAAGACC TATTTGTAT SEQ ID NO:555 | GAAGTTCCCACCGGCTC TCT SEQ ID NO:8567 | ATGCAAAGTATACAGCTTCC GCTCACT SEQ ID NO:16579 |
| | | AA | KSSQSLLHSEGKTYLY SEQ ID NO:556 | EVSHRLS SEQ ID NO:8568 | MQSIQLPLT SEQ ID NO:16580 |
| iPS:393014 | 21-225_26D12 | NA | CGGGCGAGTCAGGGTATTAG TAGTTGGTTAGCC SEQ ID NO:557 | GGTGCATCCAGTTTGCA AAGT SEQ ID NO:8569 | CAACAGTCTGACAGTTTCC TCGGACG SEQ ID NO:16581 |
| | | AA | RASQGISSWLA SEQ ID NO:558 | GASSLQS SEQ ID NO:8570 | QQSDSFPRT SEQ ID NO:16582 |
| iPS:393016 | 21-225_28F11 | NA | CGGGCGAGTCAGGGTATTAG CAACTGGTTAGCC SEQ ID NO:559 | GCTGCATCCAATTTGCAA AGT SEQ ID NO:8571 | CAACAGGCTAACAGTCTCC ATTCACT SEQ ID NO:16583 |
| | | AA | RASQGISNWLA SEQ ID NO:560 | AASNLQS SEQ ID NO:8572 | QQANSLPFT SEQ ID NO:16584 |
| iPS:393018 | 21-225_29B8 | NA | CGGGCAAGTCAGGGCATTAG AAATGATTTAGGC SEQ ID NO:561 | GCTGCATCCAGTTTGCAA AGT SEQ ID NO:8573 | CTACAGCATAATAGTTACCC GCTCACT SEQ ID NO:16585 |
| | | AA | RASQGIRNDLG SEQ ID NO:562 | AASSLQS SEQ ID NO:8574 | LQHNSYPLT SEQ ID NO:16586 |
| iPS:393020 | 21-225_30E2 | NA | CAGGCAAGTCAGTACATTAG CAACTATTTAAAT SEQ ID NO:563 | GATGGATCCAGTTTGGA AACA SEQ ID NO:8575 | CAACAGTATGATAATCTCCC GATCACC SEQ ID NO:16587 |
| | | AA | QASQYISNYLN SEQ ID NO:564 | DGSSLET SEQ ID NO:8576 | QQYDNLPIT SEQ ID NO:16588 |
| iPS:393022 | 21-225_30H11 | NA | CGGGCAAGTCAGGGCATTAG AAATGATTTAGGC SEQ ID NO:565 | CCTGCATCCAGTTTGCAA AGT SEQ ID NO:8577 | CTACAGGATAATAGTCATCC ATTCACT SEQ ID NO:16589 |
| | | AA | RASQGIRNDLG | PASSLQS | LQDNSHPFT |

FIGURE 49
(Continued)

| | | | | | | |
|---|---|---|---|---|---|---|
| iPS:393024 | 21-225_31H9 | NA | SEQ ID NO:566 CGGGCGAGTCAGGGTATTAC CAGCTGGTTAACT | SEQ ID NO:8578 GATACATCCAGTTTGCA AAGT | SEQ ID NO:16590 CAACAGGGTAACAGTTTCC ATTCACT |
| | | AA | SEQ ID NO:567 RASQGITSWLT | SEQ ID NO:8579 DTSSLQS | SEQ ID NO:16591 QQGNSFPPT |
| iPS:393026 | 21-225_32B6 | NA | SEQ ID NO:568 CGGGCAAGTCAGGGCATTAG AAATGATTAGGC | SEQ ID NO:8580 ATTGCATCCAGTTTGCAA AGT | SEQ ID NO:16592 CTACAGCATAATAGTTACCC GTGGACG |
| | | AA | SEQ ID NO:569 RASQGIRNDLG | SEQ ID NO:8581 IASSLQS | SEQ ID NO:16593 LQHNSYPWT |
| iPS:393028 | 21-225_25D7 | NA | SEQ ID NO:570 CGGGCAAGTCAGGGCATTAG CGACTGGTTAGCC | SEQ ID NO:8582 GCTGCATCCAGTTTGCAA AGT | SEQ ID NO:16594 CAACAGGCTTACAGTTTCC GTGGACG |
| | | AA | SEQ ID NO:571 RASQDIFDWLA | SEQ ID NO:8583 AASSLQS | SEQ ID NO:16595 QQAYSFPWT |
| iPS:393030 | 21-225_25H11 | NA | SEQ ID NO:572 CGGGCAAGTCAGGGCATTAG AACTGATTAGGC | SEQ ID NO:8584 GCTGCATCCAGTTTACAA AGT | SEQ ID NO:16596 CTACAGCATAATAGTTACCC GCTCACT |
| | | AA | SEQ ID NO:573 RASQGIRTDLG | SEQ ID NO:8585 AASSLQS | SEQ ID NO:16597 LQHNSYPLT |
| iPS:393032 | 21-225_26F8 | NA | SEQ ID NO:574 AAGTCTAGTCAGAGCCTCCT GCATGGTGATGGAAAGACCT ATTTGTAT | SEQ ID NO:8586 GAAGTTTCCAACCGGTTC TCT | SEQ ID NO:16598 ATGCAAAGTATACAGCTTCC GTGGACG |
| | | AA | SEQ ID NO:575 KSSQSLLHGDGKTYLY | SEQ ID NO:8587 EVSNRFS | SEQ ID NO:16599 MQSIQLPWT |
| iPS:393034 | 21-225_27F2 | NA | SEQ ID NO:576 CGGGCAAGTCAGGGCATTAG AAATGATTAGGC | SEQ ID NO:8588 GTTGCATCCAGTTTGCAA AGT | SEQ ID NO:16600 CTACAGCATAATAGTTACCC GCTCACT |
| | | | SEQ ID NO:577 | SEQ ID NO:8589 | SEQ ID NO:16601 |

FIGURE 49
(Continued)

| | | | | | |
|---|---|---|---|---|---|
| iPS:393036 | 21-225_28G3 | AA | RASQGIRNDLG SEQ ID NO:578 | VASSLQS SEQ ID NO:8590 | LQHNSYPLT SEQ ID NO:16602 |
| | | NA | AAGTCTAGTCAGAGCCTCCT ACATGGTGATGGAAAGACCT TCT ATTTGTAT SEQ ID NO:579 | GAAGTTTCCAACCGGTTC TCT SEQ ID NO:8591 | ATGCAAAGTATACAGATTCC GTGGACG SEQ ID NO:16603 |
| iPS:393038 | | AA | KSSQSLLHGDGKTYLY SEQ ID NO:580 | EVSNRFS SEQ ID NO:8592 | MQSIQIPWT SEQ ID NO:16604 |
| | 21-225_29D8 | NA | CGGGCAAGTCAGGGCATTAG AAATGATTTAGGC SEQ ID NO:581 | ACTGCATCAGTTGCAA AGT SEQ ID NO:8593 | CTACAGCATAATAGTTACCC ATTCACT SEQ ID NO:16605 |
| iPS:393040 | | AA | RASQGIRNDLG SEQ ID NO:582 | TASSLQS SEQ ID NO:8594 | LQHNSYPFT SEQ ID NO:16606 |
| | 21-225_30E3 | NA | CGGGCAAGTCAGGACATTAG AGATGATTTAGGC SEQ ID NO:583 | GCTGCATCAGTCAGTTGCAA AGT SEQ ID NO:8595 | CTACAGCATACTAGTTACCC TCCTACT SEQ ID NO:16607 |
| iPS:393042 | | AA | RASQDIRDDLG SEQ ID NO:584 | AAFSLQS SEQ ID NO:8596 | LQHTSYPPT SEQ ID NO:16608 |
| | 21-225_31F1 | NA | CGGGCAAGTCAGAGAGGATTA GCAGCTATTTAAAT SEQ ID NO:585 | GCTGCATCAGTCAGTTCGCA AAGT SEQ ID NO:8597 | CAACAGAGTTACATTACCCC GCTCACT SEQ ID NO:16609 |
| iPS:393044 | 21-225_25B8 | AA | RASQRISSYLN SEQ ID NO:586 | AASSSQS SEQ ID NO:8598 | QQSYITPLT SEQ ID NO:16610 |
| | | NA | AGGGCCAGTCAGAGTGTAG AAGTAATTTAGCC SEQ ID NO:587 | GGTGCATCCATCCACCAGGGC CACT SEQ ID NO:8599 | CAGCAGTATAATAATTGGCC TCCGTGGCCG SEQ ID NO:16611 |
| | | AA | RASQSVRSNLA SEQ ID NO:588 | GASTRAT SEQ ID NO:8600 | QQYNNWPPWP SEQ ID NO:16612 |
| iPS:393046 | | NA | CGGGCAAGTCAGGCCATTAG AGATGATTTAGGC | GCTGCATCCAGTTGCAA AGT | CTACAGCATTATAATTACCC TCGCAGT |

FIGURE 49
(Continued)

| | | | | | | | |
|---|---|---|---|---|---|---|---|
| iPS:393048 | 21-225_25A12 | AA | SEQ ID NO:589<br>RASQAIRDDLG<br>SEQ ID NO:590 | | SEQ ID NO:8601<br>AASSLQS<br>SEQ ID NO:8602 | | SEQ ID NO:16613<br>LQHYNYPRS<br>SEQ ID NO:16614 |
| iPS:393050 | 21-225_27C3 | NA | CGGGCAAGTCAGGGCATTAG<br>AAATGATTTAGGC<br>SEQ ID NO:591 | | GCTGCATCCAGTTGCAA<br>AGT<br>SEQ ID NO:8603 | | CTACAGCATAATCGTTACCC<br>GCTCACT<br>SEQ ID NO:16615 |
| | | AA | RASQGIRNDLG<br>SEQ ID NO:592 | | AASSLQS<br>SEQ ID NO:8604 | | LQHNRYPLT<br>SEQ ID NO:16616 |
| iPS:393054 | 21-225_28C5 | NA | AGGGCAAGTCAGAGTGTTAG<br>CAGCAACTTAGCC<br>SEQ ID NO:593 | | GGTGCATCCACCAGGGC<br>CACT<br>SEQ ID NO:8605 | | CAGCAGTATAATAATTGGCC<br>TCCGTGGCCG<br>SEQ ID NO:16617 |
| | | AA | RASQSVSSNLA<br>SEQ ID NO:594 | | GASTRAT<br>SEQ ID NO:8606 | | QQYNWPPWP<br>SEQ ID NO:16618 |
| iPS:393056 | 21-225_29G8 | NA | CGGGCAAGTCAGGGCATTAG<br>AAATGATTTAGGC<br>SEQ ID NO:595 | | GCTGCATCCAGTTGCAA<br>AGT<br>SEQ ID NO:8607 | | CTACAGCATAATAGTTATCC<br>GCTCACT<br>SEQ ID NO:16619 |
| | | AA | RASQGIRNDLG<br>SEQ ID NO:596 | | AASSLQS<br>SEQ ID NO:8608 | | LQHNSYPLT<br>SEQ ID NO:16620 |
| iPS:393058 | 21-225_30F3 | NA | CGGGCAAGTCAGGGCATTAG<br>AAATGATTTAGGC<br>SEQ ID NO:597 | | ACTGCATCCAGTTACAA<br>AGT<br>SEQ ID NO:8609 | | CTACAGCATAATAGTTACCC<br>GTTCACT<br>SEQ ID NO:16621 |
| | | AA | RASQGIRNDLG<br>SEQ ID NO:598 | | TASSLQS<br>SEQ ID NO:8610 | | LQHNSYPFT<br>SEQ ID NO:16622 |
| iPS:393060 | 21-225_31H3 | NA | CGGGCAAGTCAGGACATTAG<br>AGATGATTTAGGC<br>SEQ ID NO:599 | | GCTGCATTCAGCTTGCAA<br>AGT<br>SEQ ID NO:8611 | | CTACAGCATACTAGTTACCC<br>TCCTACT<br>SEQ ID NO:16623 |
| | | AA | RASQDIRDDLG<br>SEQ ID NO:600 | | AAFSLQS<br>SEQ ID NO:8612 | | LQHTSYPPT<br>SEQ ID NO:16624 |
| | | NA | CGGGCAAGTCAGGACATTAG<br>AAGTGATTTAGGC | | GCTGCATCCAGTTGCAA<br>AGT | | CTGCAGCATACTACTATTACCC<br>TCCTACT |

FIGURE 49
(Continued)

| | | | | | | |
|---|---|---|---|---|---|---|
| iPS:393062 | 21-225_32G12 | AA | SEQ ID NO:601<br>RASQDIRSDLG | SEQ ID NO:8613<br>AASSLQS | | SEQ ID NO:16625<br>LQHTIYPPT |
| iPS:393064 | 21-225_33H3 | NA | SEQ ID NO:602<br>CAGGCGAGTCAGGACATTTC<br>CAACTTTTTAAAT | SEQ ID NO:8614<br>GATGCATCCAATTTGGTA<br>ACA | | SEQ ID NO:16626<br>CAACAGTATGATAATCTCCC<br>GATCACC |
| | | AA | SEQ ID NO:603<br>QASQDISNFLN | SEQ ID NO:8615<br>DASNLVT | | SEQ ID NO:16627<br>QQYDNLPIT |
| iPS:393066 | 21-225_33A9 | NA | SEQ ID NO:604<br>CGGGCAAGTCAGAGCATTAG<br>CAGTTATTTAAGT | SEQ ID NO:8616<br>GCTGCATCCAGTTTGCAA<br>AGT | | SEQ ID NO:16628<br>CAACAGAGTTACAATATCCC<br>GATCACC |
| | | AA | SEQ ID NO:605<br>RASQSISRYLS | SEQ ID NO:8617<br>AASSLQS | | SEQ ID NO:16629<br>QQSYNIPIT |
| iPS:393068 | 21-225_34D3 | NA | SEQ ID NO:606<br>CGGGCAAGTCAGAGCATTAG<br>CAGTATTTAAAT | SEQ ID NO:8618<br>GCTGCATCCAGTTTGCAT<br>AGT | | SEQ ID NO:16630<br>CAACAGAGTTACAGTACTCC<br>GCTCACT |
| | | AA | SEQ ID NO:607<br>RASQNIYSYLN | SEQ ID NO:8619<br>AASSLHS | | SEQ ID NO:16631<br>QQSYSTPLT |
| iPS:393070 | 21-225_34G9 | NA | SEQ ID NO:608<br>CGGGCAAGTCAGGACATTAG<br>AAGTGATTTAGGC | SEQ ID NO:8620<br>GCTGCATCCAGTTTGCAA<br>AGT | | SEQ ID NO:16632<br>CTCCAGCATACTATTTACCCT<br>CCTACT |
| | | AA | SEQ ID NO:609<br>RASQDIRSDLG | SEQ ID NO:8621<br>AASSLQS | | SEQ ID NO:16633<br>LQHTIYPPT |
| iPS:393072 | 21-225_36C5 | NA | SEQ ID NO:610<br>CGGGCAAGTCAGGACATTAG<br>AAGTGATTTAGGC | SEQ ID NO:8622<br>GCTGCATCCAGTTTGCAA<br>AGT | | SEQ ID NO:16634<br>CTCCATCATCCTATTTACCCT<br>CCTACT |
| | | AA | SEQ ID NO:611<br>RASQDIRSDLG | SEQ ID NO:8623<br>AASSLQS | | SEQ ID NO:16635<br>LHHPIYPPT |
| iPS:393074 | | NA | SEQ ID NO:612<br>CGGACAAGTCAGGGCATTAG<br>AAATGATTTAGGC | SEQ ID NO:8624<br>ACTGCATCCAGTTTGCAA<br>AGT | | SEQ ID NO:16636<br>CTACAGCATAATAGTTACCC<br>GCTCACT |

FIGURE 49
(Continued)

| | | | | | | |
|---|---|---|---|---|---|---|
| iPS:393076 | 21-225_33B1 | AA | SEQ ID NO:613<br>RTSQGIRNDLG | SEQ ID NO:8625<br>TASSLQS | SEQ ID NO:16637<br>LQHNSYPLT | |
| iPS:393078 | 21-225_33A4 | NA | SEQ ID NO:614<br>CGGGCAAGTCAGGACATTAG<br>AAATGATGTAGGC | SEQ ID NO:8626<br>GCTGCATCCAGTTGCAA<br>CGT | SEQ ID NO:16638<br>CTACAGCATTATAGTTACCC<br>TCCTACT | |
| | | AA | SEQ ID NO:615<br>RASQDIRNDVG | SEQ ID NO:8627<br>AASSLQR | SEQ ID NO:16639<br>LQHYSYPPT | |
| iPS:393080 | 21-225_33H11 | NA | SEQ ID NO:616<br>TGGGCGAGTCAGGGCATTAA<br>CAGTTATTTAGCC | SEQ ID NO:8628<br>GCTGCATCCAGTTGCAA<br>GGT | SEQ ID NO:16640<br>CAACAGTTTAATAGTTACCC<br>TCTGACG | |
| | | AA | SEQ ID NO:617<br>WASQGINSYLA | SEQ ID NO:8629<br>AASSLQG | SEQ ID NO:16641<br>QQFNSYPLT | |
| iPS:393082 | 21-225_34F3 | NA | SEQ ID NO:618<br>CGGGCGAGTCAGGGCATTAG<br>TAAGTGGTTAGCC | SEQ ID NO:8630<br>GCTGCATCCAGTTGCAA<br>AGT | SEQ ID NO:16642<br>CAACAGGCTAACAGTTCCC<br>TTTCACT | |
| | | AA | SEQ ID NO:619<br>RASQGISKWLA | SEQ ID NO:8631<br>AASSLQS | SEQ ID NO:16643<br>QQANSFPFT | |
| iPS:393084 | 21-225_34C11 | NA | SEQ ID NO:620<br>CGGGCAAGTCAGAACATTAG<br>GAACTTTTAAAT | SEQ ID NO:8632<br>GGTGCATCCACTTGCAA<br>AGT | SEQ ID NO:16644<br>CAACAGACTTGCAGTACCC<br>GCTCACT | |
| | | AA | SEQ ID NO:621<br>RASQNIRNFLN | SEQ ID NO:8633<br>GASTLQS | SEQ ID NO:16645<br>QQTCSTPLT | |
| iPS:393086 | 21-225_35C6 | NA | SEQ ID NO:622<br>CGGGCGAGTCAGGGTATTAG<br>CAAATGGTTAGCC | SEQ ID NO:8634<br>GCTGCATCCAGTTGCAG<br>AGT | SEQ ID NO:16646<br>CAACAGGCTAACAGTTCCC<br>ATTCACT | |
| | | AA | SEQ ID NO:623<br>RASQGISKWLA | SEQ ID NO:8635<br>AASSLQS | SEQ ID NO:16647<br>QQANSFPFT | |
| | | NA | SEQ ID NO:624<br>CGGGCGAGTCAGGGTATTAG<br>CAGATGGTTAGCC | SEQ ID NO:8636<br>GCTGCATCCCGTTGCAA<br>AGT | SEQ ID NO:16648<br>CAACAGGCTAACAGTTCCC<br>TTTCACT | |

FIGURE 49
(Continued)

| | | | | | | |
|---|---|---|---|---|---|---|
| iPS:393088 | 21-225_36H5 | AA | SEQ ID NO:625<br>RASQGISRWLA<br>SEQ ID NO:626 | SEQ ID NO:8637<br>AASRLQS<br>SEQ ID NO:8638 | SEQ ID NO:16649<br>QQANSFPFT<br>SEQ ID NO:16650 |
| | | NA | AAGTCCATCCAGAGTGTTTT<br>ATACAGATCCAACAATAAGAA<br>ACTACTTAACT | TGGGCATCTACCGGGA<br>ATCC | CAGCAATATTATAGTTCTCC<br>GTGCAGT |
| iPS:393090 | 21-225_33D1 | AA | SEQ ID NO:627<br>KSIQSVLYRSNNKNYLT<br>SEQ ID NO:628 | SEQ ID NO:8639<br>WASTRES<br>SEQ ID NO:8640 | SEQ ID NO:16651<br>QQYYSSPCS<br>SEQ ID NO:16652 |
| | | NA | CGGGCAAGTCAGAGGCATTAG<br>CAATTACTTAGCC | GCTGCATCCAGTTGCAA<br>AGT | CAACAGTATAATAGTTACCC<br>ATTCACT |
| iPS:393092 | 21-225_33A5 | AA | SEQ ID NO:629<br>RASQGISNYLA<br>SEQ ID NO:630 | SEQ ID NO:8641<br>AASSLQS<br>SEQ ID NO:8642 | SEQ ID NO:16653<br>QQYNSYPFT<br>SEQ ID NO:16654 |
| | | NA | CGGGCAAGTCAGAGAGCATTAT<br>CAGCTATTTAAAT | GTTGCATCCAGTTGCAA<br>GGT | CAACAGAGTTACAGTACCCC<br>GTACACT |
| iPS:393094 | 21-225_33C12 | AA | SEQ ID NO:631<br>RASQSIISYLN<br>SEQ ID NO:632 | SEQ ID NO:8643<br>VASSLQG<br>SEQ ID NO:8644 | SEQ ID NO:16655<br>QQSYSTPYT<br>SEQ ID NO:16656 |
| | | NA | CGGGCAAGTCAGAGGCATTAG<br>AAATGATTAGGC | ACTGCATCCAATTGCAA<br>AGT | CTACAACATAGTTCTTACCC<br>CATCACC |
| iPS:393094 | 21-225_34C4 | AA | SEQ ID NO:633<br>RASQGIRNDLG<br>SEQ ID NO:634 | SEQ ID NO:8645<br>TASNLQS<br>SEQ ID NO:8646 | SEQ ID NO:16657<br>LQHSSYPIT<br>SEQ ID NO:16658 |
| | | NA | CGGGCAAGTCAGGACATTAG<br>AAGTGATTAGGC | GCTGCATCCAGTTGCAA<br>AGT | CTACAGCATACTATTTACCC<br>TCCTACT |
| iPS:393096 | 21-225_34D11 | AA | SEQ ID NO:635<br>RASQDIRSDLG<br>SEQ ID NO:636 | SEQ ID NO:8647<br>AASSLQS<br>SEQ ID NO:8648 | SEQ ID NO:16659<br>LQHTYPPT<br>SEQ ID NO:16660 |

FIGURE 49
(Continued)

| | | | | | |
|---|---|---|---|---|---|
| iPS:393098 | 21-225_35G6 | NA | CGGGGGAGTCAGGGTATTAG CCGGTGGTTAGGCC SEQ ID NO:637 | GCTGCATCCAGGTTGCA AAGT SEQ ID NO:8649 | CAACAGGCTAACAGTTTCCC GTTCACT SEQ ID NO:16661 |
| | | AA | RASQGISRWLA SEQ ID NO:638 | AASRLQS SEQ ID NO:8650 | QQANSFPFT SEQ ID NO:16662 |
| iPS:393100 | 21-225_36B8 | NA | CGGGCAAGTCAGGAGACATTAT CAGCTATTTAAAT SEQ ID NO:639 | GTTGCATCCAGTTTGCAA AGT SEQ ID NO:8651 | CAACAGAGTTACAGTACCCC GTACACT SEQ ID NO:16663 |
| | | AA | RASQSIISYLN SEQ ID NO:640 | VASSLQS SEQ ID NO:8652 | QQSYSTPYT SEQ ID NO:16664 |
| iPS:393102 | 21-225_33F1 | NA | CGGACAAGTCAGGACATTAG AAGTGATTTAGGC SEQ ID NO:641 | GCTGCATCCAGTTTGCAA AGT SEQ ID NO:8653 | CTACAGCATACTATTTACCC TCCTACT SEQ ID NO:16665 |
| | | AA | RTSQDIRSDLG SEQ ID NO:642 | AASSLQS SEQ ID NO:8654 | LQHTIYPPT SEQ ID NO:16666 |
| iPS:393104 | 21-225_33A7 | NA | CGGGCAAGTCAGGACATTAG AAGTGATTTAGGC SEQ ID NO:643 | GTTGCATCCAGTTTGCAA AGT SEQ ID NO:8655 | CTACAGCATACTATTTACCC TCCTACT SEQ ID NO:16667 |
| | | AA | RASQDIRSDLG SEQ ID NO:644 | VASSLQS SEQ ID NO:8656 | LQHTIYPPT SEQ ID NO:16668 |
| iPS:393106 | 21-225_34A6 | NA | CGGACAAGTCAGGACATCA GAAATGATTTAGGC SEQ ID NO:645 | GCTGCATCCAGTTTGCAA AGT SEQ ID NO:8657 | CTACAGCATAATAGTTACCC TCCTACT SEQ ID NO:16669 |
| | | AA | RTSQDIRNDLG SEQ ID NO:646 | AASSLQS SEQ ID NO:8658 | LQHNSYPPT SEQ ID NO:16670 |
| iPS:393108 | 21-225_34G11 | NA | CGGGCAAGTCAGAACATTAA CAGGTATTTAAAT SEQ ID NO:647 | GGTGCATCCAGTTTGCA AAGT SEQ ID NO:8659 | CAACAGACTTACATTACCCC GCTCACT SEQ ID NO:16671 |
| | | AA | RASQNINRYLN SEQ ID NO:648 | GASSLQS SEQ ID NO:8660 | QQTYIPLT SEQ ID NO:16672 |

FIGURE 49
(Continued)

| | | | | | |
|---|---|---|---|---|---|
| iPS:393110 | 21-225_35B7 | NA | CGGGCAAGTCAGGACATTAG AAGTGATTAGGC<br>SEQ ID NO:649 | GCTGCATCCAGTTTGCAA AGT<br>SEQ ID NO:8661 | CTACAGGCATACTATTTACCC TCCTACT<br>SEQ ID NO:16673 |
| | | AA | RASQDIRSDLG<br>SEQ ID NO:650 | AASSLQS<br>SEQ ID NO:8662 | LQHTIYPPT<br>SEQ ID NO:16674 |
| iPS:393112 | 21-225_33G1 | NA | CGGGCGAGTCAGGGTATTAG CAGGTGGTTAGCC<br>SEQ ID NO:651 | GGTGCATACAGTCTGCA AAGT<br>SEQ ID NO:8663 | CAACAGGCTAACAGTTTCCC ATTCACT<br>SEQ ID NO:16675 |
| | | AA | RASQGISRWLA<br>SEQ ID NO:652 | GAYSLQS<br>SEQ ID NO:8664 | QQANSFPFT<br>SEQ ID NO:16676 |
| iPS:393114 | 21-225_33G12 | NA | CGGGCAAGTCAGAGACATTAG CAACTATTTAAAT<br>SEQ ID NO:653 | GCTGCATCCAGTTTGCAA AGT<br>SEQ ID NO:8665 | CAACAGAGTTACACAGTACCCC ATTCACT<br>SEQ ID NO:16677 |
| | | AA | RASQSISNYLN<br>SEQ ID NO:654 | AASSLQS<br>SEQ ID NO:8666 | QQSYSPFT<br>SEQ ID NO:16678 |
| iPS:393116 | 21-225_34G7 | NA | CGGGCGAGTCAGAGCTTATTAG CAAGTGGTTAGCC<br>SEQ ID NO:655 | GCTGCATCCAGTTTGCAA AGT<br>SEQ ID NO:8667 | CAACAGGCTAACAGTTTCCC ATTCACT<br>SEQ ID NO:16679 |
| | | AA | RASQLISKWLA<br>SEQ ID NO:656 | AASSLQS<br>SEQ ID NO:8668 | QQANSFPFT<br>SEQ ID NO:16680 |
| iPS:393118 | 21-225_34H11 | NA | CGGGCAAGTCAGGACATTAG AAATGATTAGGC<br>SEQ ID NO:657 | GCTACATCCAGTTTGCAA AGT<br>SEQ ID NO:8669 | CTACAGCATAATAGTTACCC TCCTACT<br>SEQ ID NO:16681 |
| | | AA | RASQDIRNDLG<br>SEQ ID NO:658 | ATSSLQS<br>SEQ ID NO:8670 | LQHNSYPPT<br>SEQ ID NO:16682 |
| iPS:393120 | 21-225_35H8 | NA | CGGGCGAGTCAGGCCATTAG TAATTATTTAGCC<br>SEQ ID NO:659 | GGTGCGTCCGGTTTGCA AAGT<br>SEQ ID NO:8671 | CAACAGTATAATAGTTACCC ATTCACT<br>SEQ ID NO:16683 |
| | | AA | RASQAISNYLA<br>SEQ ID NO:660 | GASGLQS<br>SEQ ID NO:8672 | QQYNSYPFT<br>SEQ ID NO:16684 |

FIGURE 49
(Continued)

| | | | | | | |
|---|---|---|---|---|---|---|
| iPS:393122 | 21-225_33B2 | NA | CGGGCAAGTCAGAGCATTAT CAGCTATTTAAAT SEQ ID NO:661 | GTTGCATCCAGTTTGCAA AGT SEQ ID NO:8673 | CAACAGAGTTACAGTACCCC GTACACT SEQ ID NO:16685 | |
| | | AA | RASQSIISYLN SEQ ID NO:662 | VASSLQS SEQ ID NO:8674 | QQSYSTPYT SEQ ID NO:16686 | |
| iPS:393124 | 21-225_33G7 | NA | CGGGCAAGTCAGGACATTAG AAATGATTTAGGC SEQ ID NO:663 | GCTGCATCCAGTTTGCAA AGT SEQ ID NO:8675 | CTACAGCATTATAGTTACCC TCCTACT SEQ ID NO:16687 | |
| | | AA | RASQGIRNDLG SEQ ID NO:664 | AASSLQS SEQ ID NO:8676 | LQHYSYPPT SEQ ID NO:16688 | |
| iPS:393126 | 21-225_35D1 | NA | CGGGCAAGTCAGGACATTAG AAGTGATTTAGGC SEQ ID NO:665 | GCTGCATCCAGTTTGCAA AGT SEQ ID NO:8677 | CTACAGCATACTATTTACCC TCCCACT SEQ ID NO:16689 | |
| | | AA | RASQDIRSDLG SEQ ID NO:666 | AASSLQS SEQ ID NO:8678 | LQHTYPPT SEQ ID NO:16690 | |
| iPS:393128 | 21-225_35F11 | NA | CGGGCAAGTCAGGACATTAG AAGTGATTTAGGC SEQ ID NO:667 | GCTGCATCCAGTTTGCAA AGT SEQ ID NO:8679 | CTACAGCATACTGTTTACCC TCCTACT SEQ ID NO:16691 | |
| | | AA | RASQDIRSDLG SEQ ID NO:668 | AASSLQS SEQ ID NO:8680 | LQHTVPPT SEQ ID NO:16692 | |
| iPS:393130 | 21-225_33C2 | NA | CGGGCAAGTCAGGGCATTAG AAATGATTTAGGC SEQ ID NO:669 | GCTGCACCCAGTTGCA AAGT SEQ ID NO:8681 | CTACAGCATAATAGTTACCC GTGGACG SEQ ID NO:16693 | |
| | | AA | RASQGIRNDLG SEQ ID NO:670 | AAPSLQS SEQ ID NO:8682 | LQHNSYPWT SEQ ID NO:16694 | |
| iPS:393132 | 21-225_33H7 | NA | CGGGCGAGTCAGGGTATTAG CCGGTGGTTAGCC SEQ ID NO:671 | GCTGCATCCAGGTTGCA AAGT SEQ ID NO:8683 | CAACAGGCTAACATTTCCC GTTCACT SEQ ID NO:16695 | |
| | | AA | RASQGISRWLA SEQ ID NO:672 | AASRLQS SEQ ID NO:8684 | QQANIFPFT SEQ ID NO:16696 | |

FIGURE 49
(Continued)

| | | | | | |
|---|---|---|---|---|---|
| iPS:393134 | 21-225_34C2 | NA | CGGGCAAGTCAGAGAATTAT CAGCTATTTAAAT SEQ ID NO:673 | GTTGCATCCAGTTTGCAA AGT SEQ ID NO:8685 | CAACAGAGTTACAGTACCCC GTACACT SEQ ID NO:16697 |
| | | AA | RASQRIISYLN SEQ ID NO:674 | VASSLQS SEQ ID NO:8686 | QQSYSTPYT SEQ ID NO:16698 |
| iPS:393136 | 21-225_34D8 | NA | CGGGCAAGTCAGAGATCATTAT CAGCTATTTAAAT SEQ ID NO:675 | GTTGCATCCAGTTTGCAA AGT SEQ ID NO:8687 | CAACAGAGTTACAGTACCCC GTACACT SEQ ID NO:16699 |
| | | AA | RASQIISYLN SEQ ID NO:676 | VASSLQS SEQ ID NO:8688 | QQSYSTPYT SEQ ID NO:16700 |
| iPS:393138 | 21-225_35E3 | NA | CAGGCGAGTCAGGACACATTTT CAACTATTTAAAT SEQ ID NO:677 | GATGCCTCCAATTGGA AACA SEQ ID NO:8689 | CAACAGTATGATAATCTCCC GATCACC SEQ ID NO:16701 |
| | | AA | QASQDIFNYLN SEQ ID NO:678 | DASNLET SEQ ID NO:8690 | QQYDNLPIT SEQ ID NO:16702 |
| iPS:393140 | 21-225_35H12 | NA | CGGGCGAGTCAGGGTATTAG CAGATGGTTAGCC SEQ ID NO:679 | GCTGCATCCCGTTTGCAA AGT SEQ ID NO:8691 | CAACAGGCTAACAGTTTCCC ATTCACT SEQ ID NO:16703 |
| | | AA | RASQGISRWLA SEQ ID NO:680 | AASRLQS SEQ ID NO:8692 | QQANSFPFT SEQ ID NO:16704 |
| iPS:393142 | 21-225_33A3 | NA | CGGGCGAGTCAGGGCATTAA CAATTATTTAGCC SEQ ID NO:681 | GCTGCATCCAGTTTGCAA AGT SEQ ID NO:8693 | CAACAGTTAATAGTTACCC TCCGACG SEQ ID NO:16705 |
| | | AA | RASQGINNYLA SEQ ID NO:682 | AASSLQS SEQ ID NO:8694 | QQFNSYPPT SEQ ID NO:16706 |
| iPS:393144 | 21-225_34D2 | NA | AAGTCTAGTCAGAGCCTCCT GCATAGTGATGGAAAGACCT ATTTGTAT SEQ ID NO:683 | GAAGTTCCAACCGGTTC TCT SEQ ID NO:8695 | ATGCAAAGTAAACAGCTTCC TCCT SEQ ID NO:16707 |
| | | AA | KSSQSLLHSDGKTYLY | EVSNRFS | MQSKQLPP |

FIGURE 49
(Continued)

| | | | | | | |
|---|---|---|---|---|---|---|
| iPS:393146 | 21-225_34G8 | NA | SEQ ID NO:684 CGGGCAAGTCAGGACATTAG AAGTGATTTAGGC | SEQ ID NO:8696 GCTGCATCCAGTTTGCAA AGT | SEQ ID NO:16708 CTACAGCATACTATTTACCC TCCTACT |
| | | AA | SEQ ID NO:685 RASQDIRSDLG | SEQ ID NO:8697 AASSLQS | SEQ ID NO:16709 LQHTIYPPT |
| iPS:393148 | 21-225_35E5 | NA | SEQ ID NO:686 CGGGCAAGTCAGAGACATTAG CAGCTATTTAAAT | SEQ ID NO:8698 GGTGCATCCAGTTCCAA AGT | SEQ ID NO:16710 CACCAGAGTTACAATCTCCC GATCACC |
| | | AA | SEQ ID NO:687 RASQSISSYLN | SEQ ID NO:8699 GASSFQS | SEQ ID NO:16711 HQSYNLPIT |
| iPS:393150 | 21-225_36A5 | NA | SEQ ID NO:688 CGGACAAGTCAGGACATTAG AAATGATTTAGGC | SEQ ID NO:8700 GCTGCATCCAGTTTGCAA AGT | SEQ ID NO:16712 CTACACCACAATAGTTACCC TCCTAAG |
| | | AA | SEQ ID NO:689 RTSQDIRNDLG | SEQ ID NO:8701 AASSLQS | SEQ ID NO:16713 LHHNSYPPK |
| iPS:393152 | 21-225_25B3 | NA | SEQ ID NO:690 CGGGCGAGTCAGGGTATTAG CAGCTGGTTAGCC | SEQ ID NO:8702 GGTGCATCCAGTTTGCA AAGT | SEQ ID NO:16714 CAACAGTCTGACAGTTTCCC TCGGACG |
| | | AA | SEQ ID NO:691 RASQGISSWLA | SEQ ID NO:8703 GASSLQS | SEQ ID NO:16715 QQSDSFPRT |
| iPS:393166 | 21-225_27G6 | NA | SEQ ID NO:692 TCTGGAGATAAATTGGGGGA TAAATATGCTTGC | SEQ ID NO:8704 CAAGATAGGAAGCGGCC CTCA | SEQ ID NO:16716 CAGGCGTGGGACAGCAGCTC TTATGTGGTA |
| | | AA | SEQ ID NO:693 SGDKLGDKYAC | SEQ ID NO:8705 QDRKRPS | SEQ ID NO:16717 QAWDSSSYVV |
| iPS:393168 | 21-225_32B11 | NA | SEQ ID NO:694 TCTGGAGATAAATTGGGGGA TAAATATGCTTAC | SEQ ID NO:8706 CAAGATAGTAAGCGGTC CTCA | SEQ ID NO:16718 CAGGCGTGGGACAACAGCAC TGTGGTA |
| | | AA | SEQ ID NO:695 SGDKLGDKYAY | SEQ ID NO:8707 QDSKRSS | SEQ ID NO:16719 QAWDNSTVV |

FIGURE 49
(Continued)

| | | | | | |
|---|---|---|---|---|---|
| iPS:393172 | 21-225_3B12 | NA | SEQ ID NO:696 TCTGGAGATAAATTGGGGA AAATATGCTTGC | SEQ ID NO:8708 CAAGATAGGAAGCGGCC CTCA | SEQ ID NO:16720 CAGGCGTGGGTCAACAACAC TATGATA |
| | | AA | SEQ ID NO:697 SGDKLGEKYAC | SEQ ID NO:8709 QDRKRPS | SEQ ID NO:16721 QAWVNNTMI |
| iPS:393174 | 21-225_15D8 | NA | SEQ ID NO:698 ACCCTAAGCAGTGAGCACAG CACCTACACCATCGAA | SEQ ID NO:8710 GTTAAGAGTGATGGCAG CCACAGCAAGGGGAC | SEQ ID NO:16722 GGAGAGAGCCACAGATCGA TGGCCAAGTCGGTGTGTA |
| | | AA | SEQ ID NO:699 TLSSEHSTYTIE | SEQ ID NO:8711 VKSDGSHSKGD | SEQ ID NO:16723 GESHTIDGQVGVV |
| iPS:393176 | 21-225_27E7 | NA | SEQ ID NO:700 TCTGGAGATAAATTGGGGAA TAAATATGCTTGC | SEQ ID NO:8712 CAAGATAGCAAGCGGCC CTTA | SEQ ID NO:16724 CAGGCGTGGGACAGTAGTAC TGTGGTA |
| | | AA | SEQ ID NO:701 SGDKLGNKYAC | SEQ ID NO:8713 QDSKRPL | SEQ ID NO:16725 QAWDSSTVV |
| iPS:393178 | 21-225_34D7 | NA | SEQ ID NO:702 TCTGGAGATAAATTGGGGGA GAAATATGCTTAC | SEQ ID NO:8714 CAAGATAGCAAGCGGCC CTCA | SEQ ID NO:16726 CAGGCGTGGGACAACACAC TGTGGTA |
| | | AA | SEQ ID NO:703 SGDKLGEKYAY | SEQ ID NO:8715 QDSKRPS | SEQ ID NO:16727 QAWDNTTVV |
| iPS:393180 | 21-225_4G12 | NA | SEQ ID NO:704 TCTGGAACCAACTCCAACAT CGGAAGTTATACTGTAAAC | SEQ ID NO:8716 ATTAATAATCAGCGGCC CTCA | SEQ ID NO:16728 GCAGCATGGATGGATGACAGCCT GAATGGTCATGTGGTA |
| | | AA | SEQ ID NO:705 SGTNSNIGSYTVN | SEQ ID NO:8717 INNQRPS | SEQ ID NO:16729 AAWDDSLNGHVV |
| iPS:393182 | | NA | SEQ ID NO:706 TCTGGAGATAAATTGGGGGA TAAATATGCTTGC | SEQ ID NO:8718 CAAGATCGCAAGCGGCC CTCA | SEQ ID NO:16730 CAGGCGTGGGACAACAACAC TGTGATA |

FIGURE 49
(Continued)

| | | | | | |
|---|---|---|---|---|---|
| iPS:393184 | 21-225_4B3 | AA | SEQ ID NO:707 SGDKLGDKYAC | SEQ ID NO:8719 QDRKRPS | SEQ ID NO:16731 QAWDNNTVI |
| | | NA | SEQ ID NO:708 TCTGGAGATAAATTGGGGGA GAAATATGCTTGC | SEQ ID NO:8720 CAAGATAGGAAGCGGCC CTCA | SEQ ID NO:16732 CAGGCGTGGGACAGCAGCAC TGCGGTA |
| iPS:393186 | 21-225_15H11 | AA | SEQ ID NO:709 SGDKLGEKYAC | SEQ ID NO:8721 QDRKRPS | SEQ ID NO:16733 QAWDSSTAV |
| | | NA | SEQ ID NO:710 TCTGGAGATAAATTGGGGGA TAAATATGCTTGC | SEQ ID NO:8722 CAAGATAGCAAGCGGCC CTCA | SEQ ID NO:16734 CAGGCGTGGGGTCAACAACAC TGTA |
| iPS:393188 | 21-225_27D9 | AA | SEQ ID NO:711 SGYKLGDKYAC | SEQ ID NO:8723 QDSKRPS | SEQ ID NO:16735 QAWVNNTV |
| | | NA | SEQ ID NO:712 TCTGGAGATAAATTGGGGGA GAAATATGTTTCC | SEQ ID NO:8724 CAAGATAGTAAGCGGCC CTCA | SEQ ID NO:16736 CAGGCGTGGGACAGCAGCAC TGTA |
| iPS:393190 | 21-225_34B9 | AA | SEQ ID NO:713 SGDKLGEKYVS | SEQ ID NO:8725 QDSKRPS | SEQ ID NO:16737 QAWDSSTV |
| | | NA | SEQ ID NO:714 TCTGGAGATAAATTGGGGGA TAAATATGCTTGC | SEQ ID NO:8726 CAAGATCGCAAGCGGCC CTCA | SEQ ID NO:16738 CAGGCGTGGGACAACAACAC TGTGATA |
| iPS:393192 | 21-225_12B1 | AA | SEQ ID NO:715 SGDKLGDKYAC | SEQ ID NO:8727 QDRKRPS | SEQ ID NO:16739 QAWDNNTVI |
| | | NA | SEQ ID NO:716 TCTGGAGATAAATTGGGGGA TAAATATGCTTGC | SEQ ID NO:8728 CAAGATAGGAAGCGGCC CTCA | SEQ ID NO:16740 CAGGCGTGGGACAGCAGCAC TTATGTGGTA |
| iPS:393194 | 21-225_16D2 | AA | SEQ ID NO:717 SGDKLGDKYAC | SEQ ID NO:8729 QDRKRPS | SEQ ID NO:16741 QAWDSSTYVV |
| | | NA | SEQ ID NO:718 TCTGGAGATAAATTGGGGGA AAAATATGCTTGC | SEQ ID NO:8730 CAAGATAGGAAGCGGCC CTCA | SEQ ID NO:16742 CAGGCGTGGGGTCAATAACAC TATGATA |
| iPS:393196 | | | | | |

FIGURE 49
(Continued)

| | | | | | | | |
|---|---|---|---|---|---|---|---|
| iPS:393198 | 21-225_16C8 | AA | SEQ ID NO:719 SGDKLGEKYAC | SEQ ID NO:8731 QDRKRPS | SEQ ID NO:6743 QAWVNNTMI | | |
| iPS:393200 | 21-225_28A11 | NA | SEQ ID NO:720 TCTGGAGATAAATTGGGGGA AAAATATGCTTAC | SEQ ID NO:8732 CAAGATAGCAAGCGGCC CTCA | SEQ ID NO:6744 CAGGCGTGGGACAGTAGCAC TTATGTGGTA | | |
| | | AA | SEQ ID NO:721 SGDKLGDKYAC | SEQ ID NO:8733 QDSKRPS | SEQ ID NO:6745 QAWDSSTYVV | | |
| iPS:393202 | 21-225_35E1 | NA | SEQ ID NO:722 TCTGGAGATAAATTGGGGGA TAAATATGCTTGC | SEQ ID NO:8734 CAAGATAGGAAGCGGCC CTCA | SEQ ID NO:6746 CAGGCGTGGGACAACAGCAC TGCGGTA | | |
| | | AA | SEQ ID NO:723 SGDKLGEKYAY | SEQ ID NO:8735 QDRKRPS | SEQ ID NO:6747 QAWDNSTAV | | |
| iPS:393204 | 21-225_6B4 | NA | SEQ ID NO:724 TCTGGAGATAAATTGGGGGA TAAATATGCTTGC | SEQ ID NO:8736 CAAGATCGCAAGCGGCC CTCA | SEQ ID NO:6748 CAGGCGTGGGACAACAACAC TGTGATA | | |
| | | AA | SEQ ID NO:725 SGDKLGDKYAC | SEQ ID NO:8737 QDRKRPS | SEQ ID NO:6749 QAWDNNTVI | | |
| iPS:393206 | 21-225_8C12 | NA | SEQ ID NO:726 GGGGGAAACAACATTGGAA GTAAAGCTGTGCAC | SEQ ID NO:8738 AGCGATAGCAACCGGCC CTCA | SEQ ID NO:6750 CAGGTGTGGGACAGTAGTAG TGATCATGTGGTA | | |
| | | AA | SEQ ID NO:727 GGNNIGSKAVH | SEQ ID NO:8739 SDSNRPS | SEQ ID NO:6751 QVWDSSSDHVV | | |
| iPS:393208 | 21-225_13F6 | NA | SEQ ID NO:728 TCTGGAGATAAATTGGGGGA TAAATATGCTTGC | SEQ ID NO:8740 CAAGATAGCAAGCGGCC CTCA | SEQ ID NO:6752 CAGGCGTGGGGCAACAGCAC TGCTGTGGTA | | |
| | | AA | SEQ ID NO:729 SGDKLGDKYAC | SEQ ID NO:8741 QDSKRPS | SEQ ID NO:6753 QAWGNSTAVV | | |
| | | NA | SEQ ID NO:730 GGGGGAAACAACATTGGAA GTAAAGTGTGCAC | SEQ ID NO:8742 GATGATACCGACCGGCC CTCA | SEQ ID NO:6754 CAGGTGTGGGATATAGTCAG TGATCATGTGGTA | | |

FIGURE 49
(Continued)

| | | | | | | | | |
|---|---|---|---|---|---|---|---|---|
| iPS:393210 | 21-225_16F3 | AA | SEQ ID NO:731 | GGNNIGSKSVH | SEQ ID NO:8743 | DDTDRPS | SEQ ID NO:6755 | QVWDSSSDHVV |
| iPS:393212 | 21-225_17D3 | NA | SEQ ID NO:732 | TCTGGAGATAAATTGGGGATAAATATGTTTAC | SEQ ID NO:8744 | CAAGATAGGAAGCGGCCCTCA | SEQ ID NO:6756 | CAGGCGTGGGACAGCATCACTGCAGTA |
| | | AA | SEQ ID NO:733 | SGDKLGDKYVY | SEQ ID NO:8745 | QDRKRPS | SEQ ID NO:6757 | QAWDSITAV |
| iPS:393214 | 21-225_30H6 | NA | SEQ ID NO:734 | TCTGGAGATAAATTGGGTAATAAATATGCTTGC | SEQ ID NO:8746 | CAAGATAGCAAGCGGCCCTCA | SEQ ID NO:6758 | CAGGCGTGGGACAGCAGCACTGTT |
| | | AA | SEQ ID NO:735 | SGDKLGNKYAC | SEQ ID NO:8747 | QDSKRPS | SEQ ID NO:6759 | QAWDSSTV |
| iPS:393216 | 21-225_33A1 | NA | SEQ ID NO:736 | TCTGGAGATAAATTGGGGATAAATTGTTTAT | SEQ ID NO:8748 | CAAGATAGAAGCGGCCCTCA | SEQ ID NO:6760 | CAGGCGTGGGACAGCACCACCGTGGTA |
| | | AA | SEQ ID NO:737 | SGDKLGDKFVY | SEQ ID NO:8749 | QDSKRPS | SEQ ID NO:6761 | QAWDSTTVV |
| iPS:393218 | 21-225_14G3 | NA | SEQ ID NO:738 | TCTGGAGATAAATTGGGGATAAATATGCTTGC | SEQ ID NO:8750 | CAAGATCGCAAGCGGCCCTCA | SEQ ID NO:6762 | CAGGCGTGGGGCAACAGCACTGCTGTGGTA |
| | | AA | SEQ ID NO:739 | SGDKLGDKYVC | SEQ ID NO:8751 | QDRKRPS | SEQ ID NO:6763 | QAWGNSTAVV |
| iPS:393222 | 21-225_17F5 | NA | SEQ ID NO:740 | TCTGGAGATAAATTGGGGAAAAATATGCTTGC | SEQ ID NO:8752 | CAAGATAGAAAGCGGCCCTCA | SEQ ID NO:6764 | CAGGCGTGGGACAGCAGCACGGTA |
| | | AA | SEQ ID NO:741 | SGDKLGEKYAC | SEQ ID NO:8753 | QDRKRPS | SEQ ID NO:6765 | QAWDSSTV |
| iPS:393224 | | NA | SEQ ID NO:742 | TCTGGAGATAAATTGGGAAATAAATATGCTTGC | SEQ ID NO:8754 | CAAGATTCCAAGCGGCCCTCA | SEQ ID NO:6766 | CAGGCGTGGGACAGCAGCACTGTA |

FIGURE 49
(Continued)

| | | | | | | |
|---|---|---|---|---|---|---|
| iPS:393226 | 21-225_31C2 | AA | SEQ ID NO:743<br>SGDKLGNKYAC | SEQ ID NO:8755<br>QDSKRPS | SEQ ID NO:16767<br>QAWDSSTV | |
| | | NA | SEQ ID NO:744<br>TCTGGAGATAAATTGGGGATAAATATGCTTAC | SEQ ID NO:8756<br>CAAGATAGGAAGCGGCCCTCA | SEQ ID NO:16768<br>CAGGCGTGGGACAACAGCACTGCGGTA | |
| iPS:393230 | 21-225_33E6 | AA | SEQ ID NO:745<br>SGDKLGDKYAY | SEQ ID NO:8757<br>QDRKRPS | SEQ ID NO:16769<br>QAWDNSTAV | |
| | | NA | SEQ ID NO:746<br>TCTGGAACCAACTCCAACATCGGAAGTTATACTGTAAAC | SEQ ID NO:8758<br>ATTAATAATCAGCGGCCCTCA | SEQ ID NO:16770<br>GCAGCAGGGATGACAGCCTGAATGGTCATGTGGTA | |
| iPS:393232 | 21-225_9G9 | AA | SEQ ID NO:747<br>SGTNSNIGSYTVN | SEQ ID NO:8759<br>INNQRPS | SEQ ID NO:16771<br>AAWDDSLNGHVV | |
| | | NA | SEQ ID NO:748<br>ACTGGAGCCAGCAGTGACGTTGGTGATTATAACTCTGTCTCC | SEQ ID NO:8760<br>GAGGTCAGTAATCGGCCCTCA | SEQ ID NO:16772<br>AGCTCATATACAAGCAGCATCACTGTGGTA | |
| | 21-225_17F12 | AA | SEQ ID NO:749<br>TGASSDVGDYNSVS | SEQ ID NO:8761<br>EVSNRPS | SEQ ID NO:16773<br>SSYTSSITVV | |
| iPS:393234 | | NA | SEQ ID NO:750<br>TCTGGAGATAAATTGGGGATAAATATGTTTGC | SEQ ID NO:8762<br>CAAGATAGCAAGCGGCCCTCA | SEQ ID NO:16774<br>CAGGCGTGGGTCAACAACACTGTA | |
| | 21-225_26C10 | AA | SEQ ID NO:751<br>SGDKLGDKYVC | SEQ ID NO:8763<br>QDSKRPS | SEQ ID NO:16775<br>QAWVNNTV | |
| iPS:393345 | | NA | SEQ ID NO:752<br>TCTGGAGATAAATTGGGGATAAATATGCTTGG | SEQ ID NO:8764<br>CAAGATAGGAAGCGGCCCTCA | SEQ ID NO:16776<br>CAGGCGTGGGACAACAGCACTGTGGTT | |
| | 21-225_5G7 | AA | SEQ ID NO:753<br>SGDKLGNKYAW | SEQ ID NO:8765<br>QDRKRPS | SEQ ID NO:16777<br>QAWDNSTVV | |
| | | | SEQ ID NO:754 | SEQ ID NO:8766 | SEQ ID NO:16778 | |

FIGURE 49
(Continued)

| | | | | | | |
|---|---|---|---|---|---|---|
| iPS:393368 | 21-225_29H8 | NA | AGGTCCAGCCAGAGACTATTTT ACACAGCTCCAACAATTACA ACTACTTAGCT SEQ ID NO:755 | TGGGCATCTACCCGGGA ATCC SEQ ID NO:8767 | CAGCAATATTATTGTACTCC TCCGACG SEQ ID NO:16779 | |
| | | AA | RSSQTILHSSNNYNYLA ACTACTTAGCT | WASTRES | QQYYCTPPT SEQ ID NO:16780 | |
| iPS:393565 | 21-225_34B11 | NA | TCTGGAGATAAATTGGGGGA TAAATATGCTTGC SEQ ID NO:757 | CAAGATATGAAGCGGCC CTCA SEQ ID NO:8769 | CAGGCGTGGACAACAGCAC TGCGGTA SEQ ID NO:16781 | |
| | | AA | SGDKLGDKYAC | QDMKRPS | QAWDNSTAV SEQ ID NO:16782 | |
| iPS:393802 | 21-225_3D12 | NA | AGGGCCAGTCAGAGTGTTAG CAGCAGCTACTTAGCC SEQ ID NO:759 | GGTACATCCAGCAGGGC CACT SEQ ID NO:8771 | CAGCAGTATGGTAGTTCACG CAGT SEQ ID NO:16783 | |
| | | AA | RASQSVSSSYLA | GTSSRAT | QQYGSSRS SEQ ID NO:16784 | |
| iPS:393804 | 21-225_5H7 | NA | CGGGCAAGTCAGGGCATTAG AAATGATTTAGGC SEQ ID NO:761 | GTTACATCCAGTTTGCAA GGT SEQ ID NO:8773 | CTACAACATAATAGTTACCC GCTCACT SEQ ID NO:16785 | |
| | | AA | RASQGIRNDLG | VTSSLQG | LQHNSYPLT SEQ ID NO:16786 | |
| iPS:393806 | 21-225_6A6 | NA | CGGGCAAGTCAGGGCATTAG AAATGATTTAGGC SEQ ID NO:763 | GCTGCATCCAGTTTGCAA AGT SEQ ID NO:8775 | CTACAGCATAGTAGTTACCC GCTCACT SEQ ID NO:16787 | |
| | | AA | RASQGIRNDLG | AASSLQS | LQHSSYPLT SEQ ID NO:16788 | |
| iPS:393808 | 21-225_1A2 | NA | CGGGCAAGTCAGGGCATTAG AAATGATTTAGGC SEQ ID NO:765 | GCTGCATCCAGTTTGCAA AGT SEQ ID NO:8777 | CTACAGCATAATAGTCACCC TCTCACT SEQ ID NO:16789 | |
| | | AA | RASQGIRNDLG | AASSLQS | LQHNSHPLT | |

FIGURE 49
(Continued)

| | | | | | | | |
|---|---|---|---|---|---|---|---|
| iPS:393810 | 21-225_5A4 | NA | SEQ ID NO:766 CGGGCGAGTCAGGGTATTAG CACCTGGTTAGCC | SEQ ID NO:8778 GATGCATCCAGTTTGCA AAGT | SEQ ID NO:16790 CAACAGGCTAACAGTTCCC GTGGACG |
| | | AA | SEQ ID NO:767 RASQGISTWLA | SEQ ID NO:8779 DASSLQS | SEQ ID NO:16791 QQANSFPWT |
| iPS:393812 | 21-225_6A11 | NA | SEQ ID NO:768 CGGGCAAGTCAGGGCATTAG AAATGATTTAGGC | SEQ ID NO:8780 GCTGCATCCAGTTTGCAA AGT | SEQ ID NO:16792 CTACAGCATAATAGTTACCC GTGGACG |
| | | AA | SEQ ID NO:769 RASQGIRNDLG | SEQ ID NO:8781 AASSLQS | SEQ ID NO:16793 LQHNSYPWT |
| iPS:393814 | 21-225_7F4 | NA | SEQ ID NO:770 CGGGCAAGTCAGGGCATTAG AAATGATTTAGGC | SEQ ID NO:8782 GCTGCATCCAATTTGCAA AGT | SEQ ID NO:16794 CTACAGCATAGTGCTTACCC GCTCACT |
| | | AA | SEQ ID NO:771 RTSQGIRNDLG | SEQ ID NO:8783 AASNLQS | SEQ ID NO:16795 LQHSAYPLT |
| iPS:393816 | 21-225_6D4 | NA | SEQ ID NO:772 CGGGCAAGTCAGGGCCATTAG AAATGATTTAGGC | SEQ ID NO:8784 GCTGCATCCAGTTTGCAA AGT | SEQ ID NO:16796 CTACAGCATAGTAGTTACCC GCTCACT |
| | | AA | SEQ ID NO:773 RASQAIRNDLG | SEQ ID NO:8785 AASSLQS | SEQ ID NO:16797 LQHSSYPLT |
| iPS:393818 | 21-225_6G12 | NA | SEQ ID NO:774 CGGGCAAGTCAGGGCATTAG AAATGATTTAGGC | SEQ ID NO:8786 GCTGCATCCACTTTGCAA AGT | SEQ ID NO:16798 CTACAGCATAATAGTTACCC GCTCACT |
| | | AA | SEQ ID NO:775 RASQGIRNDLG | SEQ ID NO:8787 AASTLQS | SEQ ID NO:16799 LQHNSYPLT |
| iPS:393820 | 21-225_8H7 | NA | SEQ ID NO:776 CGGGCAAGTCAGGGCATTAG AAATGATTTAGGC | SEQ ID NO:8788 GCTGCATCCAGTTTGCAA AGT | SEQ ID NO:16800 CTACAGCATAATAGTTACCC GTTCACT |
| | | AA | SEQ ID NO:777 RASQGIRNDLG | SEQ ID NO:8789 AASSLQS | SEQ ID NO:16801 LQHNSYPFT |

FIGURE 49
(Continued)

| | | | | | | |
|---|---|---|---|---|---|---|
| iPS:393822 | 21-225_15B11 | NA | SEQ ID NO:778 CGGGCAAGTCAGGGCATTAG AAATGATTTAGGC | SEQ ID NO:8790 GCTGCATCCAGTTTGCAA AGT | SEQ ID NO:16802 CTACAGCATAATAGTTACCC ATTCACT |
| | | AA | SEQ ID NO:779 RASQGIRNDLG | SEQ ID NO:8791 AASSLQS | SEQ ID NO:16803 LQHNSYPFT |
| iPS:393824 | 21-225_10F12 | NA | SEQ ID NO:780 CGGGCAAGTCAGAACATTAG TAGTTATTTAAAT | SEQ ID NO:8792 GCTGCATCCAGTTTGCAA AGT | SEQ ID NO:16804 CAACAGAGTTACAATACCCC CTTCTTCACT |
| | | AA | SEQ ID NO:781 RASQNISSYLN | SEQ ID NO:8793 AASSLQS | SEQ ID NO:16805 QQSYNTPFT |
| iPS:393826 | 21-225_10G5 | NA | SEQ ID NO:782 CGGGCAAGTCAGGGCATTAG AAATGATTTAGGC | SEQ ID NO:8794 GCTGCATCCAGTTTGCAA AGT | SEQ ID NO:16806 CTACAGCATAATAGTTACCC GCTCACT |
| | | AA | SEQ ID NO:783 RASQGIRNDLG | SEQ ID NO:8795 AASSLQS | SEQ ID NO:16807 LQHNSYPLT |
| iPS:393828 | 21-225_10H12 | NA | SEQ ID NO:784 CGGGCAAGTCAGGGCATTAG AAATGATTTAGGC | SEQ ID NO:8796 GGTGCATCCAGTTTGCA AAGT | SEQ ID NO:16808 CTACAGCATAATAGTTACCC GCTCACT |
| | | AA | SEQ ID NO:785 RASQGIRNDLG | SEQ ID NO:8797 GASSLQS | SEQ ID NO:16809 LQHNSYPLT |
| iPS:393830 | 21-225_12A1 | NA | SEQ ID NO:786 CGGGCAAGTCAGGGCATTAG AAATGATTTAGGC | SEQ ID NO:8798 GCTGCATCCAGTTTGCAA AGT | SEQ ID NO:16810 CTACAGCATAATAGTTACCC GCTCACT |
| | | AA | SEQ ID NO:787 RASQGIRNDLG | SEQ ID NO:8799 AASSLQS | SEQ ID NO:16811 LQHNSYPLT |
| iPS:393832 | 21-225_14B2 | NA | SEQ ID NO:788 CGGGCAAGTCAGGGCATTAG AAATGATTTAGGC | SEQ ID NO:8800 GTTACATCCAGTTTGCAA GGT | SEQ ID NO:16812 CTACAACATAATAGTTACCC GCTCACT |
| | | AA | SEQ ID NO:789 RASQGIRNDLG | SEQ ID NO:8801 VTSSLQG | SEQ ID NO:16813 LQHNSYPLT |

FIGURE 49
(Continued)

| | | | | | | |
|---|---|---|---|---|---|---|
| iPS:393836 | 21-225_15A2 | NA | SEQ ID NO:790 CGGGCGAGTCAGGGCATTAG CAATTATTTAGCC | SEQ ID NO:8802 GCTGCATCCAGTTTGCAA AGT | SEQ ID NO:16814 CAACAGTATTATAGTTACCC ATTCACT |
| | | AA | SEQ ID NO:791 RASQGISNYLA | SEQ ID NO:8803 AASSLQS | SEQ ID NO:16815 QQYYSYPFT |
| iPS:393838 | 21-225_6G2 | NA | SEQ ID NO:792 CGGGCAAGTCAGGGCATTAG AAATGATTTAGGC | SEQ ID NO:8804 GCTGCATCCAGTCTGCA AAGT | SEQ ID NO:16816 ATACAGCATAATAGTTACCT GTGGACG |
| | | AA | SEQ ID NO:793 RASQGIRNDLG | SEQ ID NO:8805 AASSLQS | SEQ ID NO:16817 IQHNSYLWT |
| iPS:393840 | 21-225_3F8 | NA | SEQ ID NO:794 CGGGCAAGTCAGAGTATTCT CAGCTATTTAAAT | SEQ ID NO:8806 ACTACATCCAGTTTGCAA AGT | SEQ ID NO:16818 CAACAGACTTACAGTACCCC GCTCACT |
| | | AA | SEQ ID NO:795 RASQSILSYLN | SEQ ID NO:8807 TTSSLQS | SEQ ID NO:16819 QQTYSTPLT |
| iPS:393844 | 21-225_3G7 | NA | SEQ ID NO:796 CGGGCAAGTCAGAACATTTA CAGGTATTTAAAT | SEQ ID NO:8808 GCTGCATCCAGTTCGCA AAGT | SEQ ID NO:16820 CAACAGAGTTACAGTCCCCA TTTCACT |
| | | AA | SEQ ID NO:797 RASQNIYRYLN | SEQ ID NO:8809 AASSSQS | SEQ ID NO:16821 QQSYSPPFT |
| iPS:393848 | 21-225_4H2 | NA | SEQ ID NO:798 CGGGCAATTCAGAACATTAG CAGGTATTTAAAT | SEQ ID NO:8810 GCTGCATCCAGCTTGCA AAGT | SEQ ID NO:16822 CAACAGAGTTACAGAACCCC CTTATTCACT |
| | | AA | SEQ ID NO:799 RAIQNISSYLN | SEQ ID NO:8811 AASSLQS | SEQ ID NO:16823 QQSYRTPLFT |
| iPS:393852 | 21-225_12A10 | NA | SEQ ID NO:800 CGGGCAAGTCAGAACATTTA CAGCTATTTAAAT | SEQ ID NO:8812 ACTGCATCCAGTTTGCAA AGT | SEQ ID NO:16824 CAGCAGAGTTACAGTCCCCA TCTCACT |
| | | AA | SEQ ID NO:801 RASQNIYSYLN | SEQ ID NO:8813 TASSLQS | SEQ ID NO:16825 QQSYSPPLT |

FIGURE 49
(Continued)

| | | | | | | |
|---|---|---|---|---|---|---|
| iPS:393854 | | NA | SEQ ID NO:802 CTGGCAAGTCAGGGCATTAG AAATGATTTAGGC | SEQ ID NO:8814 GTTGCATGTAGTTAGTTTCCAA AGT | SEQ ID NO:16826 CTACAACATAATCTTACCC GCTCACT |
| | 21-225_7H11 | AA | SEQ ID NO:803 LASQGIRNDLG | SEQ ID NO:8815 VACSFQS | SEQ ID NO:16827 LQHNLYPLT |
| iPS:393856 | | NA | SEQ ID NO:804 CGGGCAAGTCAGGGCATTAG AAATGATTTAGAC | SEQ ID NO:8816 GCTGCATCCAGTTTGCAA AGT | SEQ ID NO:16828 GTACAGCATAATAGTTACC GCTCACT |
| | 21-225_14C2 | AA | SEQ ID NO:805 RASQGIRNDLD | SEQ ID NO:8817 AASSLQS | SEQ ID NO:16829 VQHNSYPLT |
| iPS:393862 | | NA | SEQ ID NO:806 CGGGCAAGTCAGAACATTAT TAGTTATTTAAAT | SEQ ID NO:8818 GGTGCATCCAGTTTGCA AAGT | SEQ ID NO:16830 CAACAGAGTACAGTACTCC CTTATTCACT |
| | 21-225_5G2 | AA | SEQ ID NO:807 RASQNIISYLN | SEQ ID NO:8819 GASSLQS | SEQ ID NO:16831 QQSYSTPLFT |
| iPS:393864 | | NA | SEQ ID NO:808 CGGGCAAGTCGGGGCATCA GAGGTGATTTAGGT | SEQ ID NO:8820 GCTGCATCCAATTTGCAA AGT | SEQ ID NO:16832 CTACAGCATTATAGTTACC TCGGACG |
| | 21-225_4C5 | AA | SEQ ID NO:809 RASRGIRGDLG | SEQ ID NO:8821 AASNLQS | SEQ ID NO:16833 LQHYSYPRT |
| iPS:393866 | | NA | SEQ ID NO:810 CGGGCAAGTCAGGGCATTAG AAATGATTTAGGC | SEQ ID NO:8822 TCTGCATCCAGTTTGCAA AGT | SEQ ID NO:16834 GTACAGCATTATAGTTACC GTTCACT |
| | 21-225_14E3 | AA | SEQ ID NO:811 RASQGIRNDLG | SEQ ID NO:8823 SASSLQS | SEQ ID NO:16835 VQHYSYPFT |
| iPS:393868 | | NA | SEQ ID NO:812 CGGGCAAGTCAGAACATTAT AAATTATTTAAAT | SEQ ID NO:8824 GTTGCATCCAGTTTGCAA AGT | SEQ ID NO:16836 CATCAGAGTAACAGTACTCC TCTCACG |
| | 21-225_9C11 | AA | SEQ ID NO:813 RASQNIRNYLN | SEQ ID NO:8825 VASSLQS | SEQ ID NO:16837 HQSNSTPLT |

FIGURE 49
(Continued)

| | | | SEQ ID NO:814 | SEQ ID NO:8826 | SEQ ID NO:16838 |
|---|---|---|---|---|---|
| iPS:393870 | 21-225_7B1 | NA | CGGGCGAAGTCAGGACATTAG CAATCATTTAGTC | GCTGCATCCAGTTTACAA AGT | CACCAGTATAATAGTTACCC CTTCACT |
| | | AA | SEQ ID NO:815 RASQDISNHLV | SEQ ID NO:8827 AASSLQS | SEQ ID NO:16839 HQYNSYPFT |
| iPS:393872 | 21-225_2A11 | NA | SEQ ID NO:816 CGGGCAAGTCAGGGCATTAG AAATGATTTAGGC | SEQ ID NO:8828 GCTGCATCCAGTTGCAA AGT | SEQ ID NO:16840 CTACAGCATAATAGTTACCC GCTCACT |
| | | AA | SEQ ID NO:817 RASQGIRNDLG | SEQ ID NO:8829 AASSLQS | SEQ ID NO:16841 LQHNSYPLT |
| iPS:393874 | 21-225_4C8 | NA | SEQ ID NO:818 CGGGCAAGTCAGGGCATTAG AAATGATTTAGGC | SEQ ID NO:8830 GCTGCATCCAGTTGCAA AGT | SEQ ID NO:16842 CTACAGCATAATAGTTACCC GCTCACT |
| | | AA | SEQ ID NO:819 RASQGIRNDLG | SEQ ID NO:8831 AASSLQS | SEQ ID NO:16843 LQHNSYPLT |
| iPS:393876 | 21-225_9A1 | NA | SEQ ID NO:820 CGGGCAAGTCAGGGCATTAG AAATGATTTAGGG | SEQ ID NO:8832 ACTGCATCCAGTTGCAA AGT | SEQ ID NO:16844 ATACAGCATAATAGTTACCT GTGGACG |
| | | AA | SEQ ID NO:821 RASQGIRNDLG | SEQ ID NO:8833 TASSLQS | SEQ ID NO:16845 IQHNSYLWT |
| iPS:393878 | 21-225_7G12 | NA | SEQ ID NO:822 CGGGCAAGTCAGAATATTAA CAACTATTTAAAT | SEQ ID NO:8834 ACTGCATCCAGTTGCAA AGT | SEQ ID NO:16846 CAACAGAGTTACACTACCCC CACGTGGACG |
| | | AA | SEQ ID NO:823 RASQNINNYLN | SEQ ID NO:8835 TASSLQS | SEQ ID NO:16847 QQSYTTPTWT |
| iPS:393880 | 21-225_15A1 | NA | SEQ ID NO:824 CGGGCAAGTCAGGGCATTAG AAATGATTTAGGC | SEQ ID NO:8836 GCTGCATCCAGTTACAA AGT | SEQ ID NO:16848 CTACACAACAGTAGTTACCC TGTTAAG |
| | | AA | SEQ ID NO:825 RASQGIRNDLG | SEQ ID NO:8837 AASSLQS | SEQ ID NO:16849 LHNSSYPVK |

FIGURE 49
(Continued)

| | | | | | |
|---|---|---|---|---|---|
| iPS:393882 | | NA | SEQ ID NO:826 CGGGCAAGTCAGGGCATTAG AAATGATTTAGGC | SEQ ID NO:8838 GCTGCATCCAGTTTGCA AAGT | SEQ ID NO:16850 CTACAGCATCATAGTTACCC GCTCACT |
| | 21-225_15E3 | AA | SEQ ID NO:827 RASQGIRNDLG | SEQ ID NO:8839 AASSSQS | SEQ ID NO:16851 LQHHSYPLT |
| iPS:393884 | | NA | SEQ ID NO:828 CGGGCAAGTCAGGGCATTAG AAATGATTTAGGC | SEQ ID NO:8840 GTTGCATCCAGTTTGCAA AGT | SEQ ID NO:16852 ATACAGCATAATAGTTATCC GTTCACT |
| | 21-225_16F4 | AA | SEQ ID NO:829 RASQGIRNDLG | SEQ ID NO:8841 VASSLQS | SEQ ID NO:16853 IQHNSYPFT |
| iPS:393886 | | NA | SEQ ID NO:830 CGGGCAAGTCAGGGCATTAG AAATGATTTAGGT | SEQ ID NO:8842 GCTGCATCCAGTTTGCA AGT | SEQ ID NO:16854 TTACAGCATGAAAGTTACCC TCTCACT |
| | 21-225_2G9 | AA | SEQ ID NO:831 RASQGIRNDLG | SEQ ID NO:8843 AASSLQS | SEQ ID NO:16855 LQHESYPLT |
| iPS:393888 | | NA | SEQ ID NO:832 CGGGCAAGTCAGAGACATTAG AAGTTATTTAAAT | SEQ ID NO:8844 GGTACATCCAGTTTGCA AAGT | SEQ ID NO:16856 CAACAGAGTTACAGTACCCC CTTGTTCACT |
| | 21-225_3E3 | AA | SEQ ID NO:833 RASQSIRSYLN | SEQ ID NO:8845 GTSSLQS | SEQ ID NO:16857 QQSYSTPLFT |
| iPS:393890 | | NA | SEQ ID NO:834 CGGGCAAGTCATACCATTAG AACCTATTTAAAC | SEQ ID NO:8846 GCTGCATCCAGTTTGCAA AGT | SEQ ID NO:16858 CAACAGAGTTACAATATCTC ATTCACT |
| | 21-225_4B1 | AA | SEQ ID NO:835 RASHTIRTYLN | SEQ ID NO:8847 AASSLQS | SEQ ID NO:16859 QQSYNISFT |
| iPS:393892 | | NA | SEQ ID NO:836 CAGGCGAGTCAGGACATTAG CAACTATTTAAAT | SEQ ID NO:8848 GATGCATCCACTTTGGA AACA | SEQ ID NO:16860 CAACAGTATGATAATGTCCC GATCACC |
| | 21-225_6G7 | AA | SEQ ID NO:837 QASQDISNYLN | SEQ ID NO:8849 DASTLET | SEQ ID NO:16861 QQYDNVPIT |

FIGURE 49
(Continued)

| | | | | | | |
|---|---|---|---|---|---|---|
| iPS:393894 | 21-225_5E11 | NA | SEQ ID NO:838 CGGGGCGAGTCAGGGCATTAG CAATTATTTAGCC | SEQ ID NO:8850 GCTGCATCCAGTGTGCA GAGT | SEQ ID NO:16862 CACCAGTATCACAGTTACCC ATTCACT |
| | | AA | SEQ ID NO:839 RASQGISNYLA | SEQ ID NO:8851 AASSVQS | SEQ ID NO:16863 HQYHSYPFT |
| iPS:393896 | 21-225_2A4 | NA | SEQ ID NO:840 CGGGGCGAGTCAGGGCATTAG CAATTATTTAGCC | SEQ ID NO:8852 ACTGCATCCAGTTGCAA AGT | SEQ ID NO:16864 CAACAGTATATAGTTACCC ATTCACT |
| | | AA | SEQ ID NO:841 RASQGISNYLA | SEQ ID NO:8853 TASSLQS | SEQ ID NO:16865 QQYNSYPFT |
| iPS:393898 | 21-225_5F7 | NA | SEQ ID NO:842 CGGGCAAGTCAGAACCATTAG TAGTTATTTAAAT | SEQ ID NO:8854 GCTGCATCCAGTTGCAA AGT | SEQ ID NO:16866 CAACAGAGTTACAATACCC CTTATTCACT |
| | | AA | SEQ ID NO:843 RASQTISSYLN | SEQ ID NO:8855 AASSLQS | SEQ ID NO:16867 QQSYNTPLFT |
| iPS:393900 | 21-225_10E12 | NA | SEQ ID NO:844 CGGGCAAGTCAGAACATTTA CAGTTATTTAAAT | SEQ ID NO:8856 GCTACATCCAGTTGCAA AGT | SEQ ID NO:16868 CAACAGAATTACAGTCCCC TCTCACT |
| | | AA | SEQ ID NO:845 RASQNIYSYLN | SEQ ID NO:8857 ATSSLQS | SEQ ID NO:16869 QQNYSPPLT |
| iPS:393902 | 21-225_14E10 | NA | SEQ ID NO:846 CGGGACAAGTCAGAGGGCATTAGGC AAATGATTTAGGC | SEQ ID NO:8858 GCTGCATCCAGTTACAA AGT | SEQ ID NO:16870 CTGCAGCATTATAGTTACCC TCGGACG |
| | | AA | SEQ ID NO:847 RTSQGIRNDLG | SEQ ID NO:8859 AASSLQS | SEQ ID NO:16871 LQHYSYPRT |
| iPS:393904 | 21-225_8H11 | NA | SEQ ID NO:848 CGGGCAAGTCAGAACATTAT CAGCTATTTAAAT | SEQ ID NO:8860 GTTACATCCAGTTGCAC AGT | SEQ ID NO:16872 CAACAGAGTTACAGTACCC TTTCACT |
| | | AA | SEQ ID NO:849 RASQNIISYLN | SEQ ID NO:8861 VTSSLHS | SEQ ID NO:16873 QQSYSTPFT |

FIGURE 49
(Continued)

| | | | | | | |
|---|---|---|---|---|---|---|
| iPS:393906 | 21-225_13D3 | NA | SEQ ID NO:850 CGGGCCAAGTCAGGACACTGTTAG CAGCAACTTAGCC | SEQ ID NO:8862 GGTGCATCCATCCACCAGGGC CACT | SEQ ID NO:16874 CAGCAGTATCATGACTGGCC TCCGACG | |
| | | AA | SEQ ID NO:851 RASQTVSSNLA | SEQ ID NO:8863 GASTRAT | SEQ ID NO:16875 QQYHDWPPT | |
| iPS:393908 | 21-225_10E9 | NA | SEQ ID NO:852 CGGGCAAGTCAGGACACATTAG AAGTGATTTAGGC | SEQ ID NO:8864 GCTGCATCCAGTTTGCAA AGT | SEQ ID NO:16876 CTACACAGCATTATAGTTACCC TCGGACG | |
| | | AA | SEQ ID NO:853 RASQDIRSDLG | SEQ ID NO:8865 AASSLQS | SEQ ID NO:16877 LQHYSYPRT | |
| iPS:393910 | 21-225_15F10 | NA | SEQ ID NO:854 CAGGCGAATCAGGACACATTAC CAACTTTTAAAT | SEQ ID NO:8866 GATGCATCCAATTGGA AACA | SEQ ID NO:16878 CAACAGTATGATAATCTCCC GATCACC | |
| | | AA | SEQ ID NO:855 QANQDITNFLN | SEQ ID NO:8867 DASNLET | SEQ ID NO:16879 QQYDNLPIT | |
| iPS:393912 | 21-225_16F6 | NA | SEQ ID NO:856 CAGGCGAATCAGGACACATTAC CAACTTTTAAAT | SEQ ID NO:8868 GATGCATCCAATTGGA AACA | SEQ ID NO:16880 CAACAGTATGATAATCTCCC GATCACC | |
| | | AA | SEQ ID NO:857 QANQDITNFLN | SEQ ID NO:8869 DASNLET | SEQ ID NO:16881 QQYDNLPIT | |
| iPS:393914 | 21-225_16B8 | NA | SEQ ID NO:858 CGGGCGAGTCAGGGCATTAA CAATTATTAGCC | SEQ ID NO:8870 GCTGCATCCAGTGTGCA GAGT | SEQ ID NO:16882 CACCAGTATCACAGTTACCC ATTCACT | |
| | | AA | SEQ ID NO:859 RASQGINNYLA | SEQ ID NO:8871 AASSVQS | SEQ ID NO:16883 HQYHSYPFT | |
| iPS:393916 | 21-225_2G4 | NA | SEQ ID NO:860 CGGGCAAGTCAGGGCATTAG AAATGATTTAGGC | SEQ ID NO:8872 GCTGCATCCAGTTTGCAC AGT | SEQ ID NO:16884 CTACAACAGTTATAGTTTCCCT CGGACG | |
| | | AA | SEQ ID NO:861 RASQGIRNDLG | SEQ ID NO:8873 AASSLHS | SEQ ID NO:16885 LQHYSFPRT | |

FIGURE 49
(Continued)

| | | | | | | |
|---|---|---|---|---|---|---|
| iPS:393920 | 21-225_1H12 | NA | SEQ ID NO:862 CGGGCAAGTCAGAGAACATTTA CAGGTATTTAAAT | SEQ ID NO:8874 ACTGCATCCAGTTTACAA AGT | SEQ ID NO:16886 CAACAGAGTTACAGTCCCCC TCTCACT |
| | | AA | SEQ ID NO:863 RASQNIYRYLN | SEQ ID NO:8875 TASSLQS | SEQ ID NO:16887 QQSYSPPLT |
| iPS:393922 | 21-225_2B2 | NA | SEQ ID NO:864 CGGGCAAGTCAGGGCATTAG AAATGATTTAGGC | SEQ ID NO:8876 GCTGCATCCAGTTTACAA AGT | SEQ ID NO:16888 CTACAGCATAATAGTTACCC GCTCACT |
| | | AA | SEQ ID NO:865 RASQGIRNDLG | SEQ ID NO:8877 AASSLQS | SEQ ID NO:16889 LQHNSYPLT |
| iPS:393926 | 21-225_4G4 | NA | SEQ ID NO:866 CGGGCAAGTCAGAGACCATTAT CAGCTATTTAAAT | SEQ ID NO:8878 ACTGCATCCAGTTTGCAA AGT | SEQ ID NO:16890 CAACAGACTTACAGTCCCCC GCTCACT |
| | | AA | SEQ ID NO:867 RASQTIISYLN | SEQ ID NO:8879 TASSLQS | SEQ ID NO:16891 QQTYSTPLT |
| iPS:393928 | 21-225_4E10 | NA | SEQ ID NO:868 CGGGCAAGTCAGGGCATTAG AAATGATTTAGGC | SEQ ID NO:8880 GCTGCATCCAGTTTGCAA AGT | SEQ ID NO:16892 TTACAGCATGATAATTACCC TCTCACT |
| | | AA | SEQ ID NO:869 RASQGIRNDLG | SEQ ID NO:8881 AASSLQS | SEQ ID NO:16893 LQHDNYPLT |
| iPS:393930 | 21-225_7E11 | NA | SEQ ID NO:870 CGGGCAAGTCAAAACATTAT CAGGTATTTAAAT | SEQ ID NO:8882 ACTGCATCCAGTTTGCAA AGT | SEQ ID NO:16894 CAACAGACTTACAGTCCCCC GCTCACT |
| | | AA | SEQ ID NO:871 RASQNIISYLN | SEQ ID NO:8883 TASSLQS | SEQ ID NO:16895 QQTYSTPLT |
| iPS:393932 | 21-225_10F5 | NA | SEQ ID NO:872 CGGGCAAGTCAGAGAACATTTA CAGGTATTTAAAT | SEQ ID NO:8884 ACTGCATCCAGTTTGCAA AGT | SEQ ID NO:16896 CAACAGAGTTACAGTCCCCC TCTCACT |
| | | AA | SEQ ID NO:873 RASQNIYRYLN | SEQ ID NO:8885 TASSLQS | SEQ ID NO:16897 QQSYSPPLT |

FIGURE 49
(Continued)

| | | | | | | |
|---|---|---|---|---|---|---|
| iPS:393934 | 21-225_13E6 | NA | SEQ ID NO:874 CGGGCAAGTCAGGGCATTAG AAATGATTTAGGC | SEQ ID NO:8886 GCTGCATCCAGTTTGCAA AGT | SEQ ID NO:16898 GTACAGCATAATAGTTACCC GCTCACT |
| | | AA | SEQ ID NO:875 RASQGIRNDLG | SEQ ID NO:8887 AASSLQS | SEQ ID NO:16899 VQHNSYPLT |
| iPS:393936 | 21-225_14A11 | NA | SEQ ID NO:876 CGGGCAAGTCAGAGCATTAG CAGTTATTTAAAT | SEQ ID NO:8888 GCTGCATCCAGTTTGCAA AAT | SEQ ID NO:16900 CAACAGACTTACAGTAGCC TCCATTCACT |
| | | AA | SEQ ID NO:877 RASQSISSYLN | SEQ ID NO:8889 AASSLQN | SEQ ID NO:16901 QQTYSSPPFT |
| iPS:393940 | 21-225_16B2 | NA | SEQ ID NO:878 CGGGCAAGTCAGAGCATTAG CGGCTATTTAAAT | SEQ ID NO:8890 GCTGCATCCAGTTTGCAA AGT | SEQ ID NO:16902 CAACAGACTTACAATACCCC TCCGGAGCGCAGT |
| | | AA | SEQ ID NO:879 RASQSISGYLN | SEQ ID NO:8891 AASSLQS | SEQ ID NO:16903 QQTYNTPPERS |
| iPS:393942 | 21-225_11E5 | NA | SEQ ID NO:880 AAGTCCAGCCAGAGTGTTTT ATACAGCTCCAACAATAACA ACTACTTAACT | SEQ ID NO:8892 TGGGCATCTACCCGGGA ATCC | SEQ ID NO:16904 CAGCAATATTATAGTACTCC TCCGACG |
| | | AA | SEQ ID NO:881 KSSQSVLYSSNNNYLT | SEQ ID NO:8893 WASTRES | SEQ ID NO:16905 QQYYSTPPT |
| iPS:393944 | 21-225_14D6 | NA | SEQ ID NO:882 CGGGCAAGTCAGGACATTAG AAATCATTTAGGC | SEQ ID NO:8894 GCTGCATCCAGTTTGCAA AGT | SEQ ID NO:16906 CTACAGTATAATAGTTACCC ATTCACT |
| | | AA | SEQ ID NO:883 RASQDIRNHLG | SEQ ID NO:8895 AASSLQS | SEQ ID NO:16907 LQYNSYPFT |
| iPS:393946 | 21-225_16A4 | NA | SEQ ID NO:884 CGGGCGAGTCAGGACATTAG TAATTATTTAGCC | SEQ ID NO:8896 GCTGCATCCAGTTTGCAA AGT | SEQ ID NO:16908 CAACAGTATCATAGTTACCC GTGGACG |
| | | | SEQ ID NO:885 | SEQ ID NO:8897 | SEQ ID NO:16909 |

FIGURE 49
(Continued)

| | | AA/NA | | | | |
|---|---|---|---|---|---|---|
| iPS:393948 | 21-225_16A5 | AA | RASQDISNYLA SEQ ID NO:886 | AASSLQS SEQ ID NO:8898 | QQYHSYPWT SEQ ID NO:16910 | |
| | | NA | CGGGCAAGTCAGGGCATTAG AAATGATTAGGC SEQ ID NO:887 | GCTGCATCCAGTTTGCAA AGT SEQ ID NO:8899 | CTACAGCATAATAGTTACCC GTGGACG SEQ ID NO:16911 | |
| iPS:393950 | 21-225_3H10 | AA | RASQGIRNDLG SEQ ID NO:888 | AASSLQS SEQ ID NO:8900 | LQHNSYPWT SEQ ID NO:16912 | |
| | | NA | TCTGGAGATAAATTGGGGGA AAAATATGCTTGC SEQ ID NO:889 | CAAGATAGGAAGCGGCC CTCA SEQ ID NO:8901 | CAGGCGTGGGTCAACAACAC TATGATA SEQ ID NO:16913 | |
| iPS:393952 | 21-225_1F1 | AA | SGDKLGEKYAC SEQ ID NO:890 | QDRKRPS SEQ ID NO:8902 | QAWVNNTMI SEQ ID NO:16914 | |
| | | NA | CGGGCGAGTCAGGGCATTAA CAATTATTAGCC SEQ ID NO:891 | GTTGCATCCAGTTTGCAA ACT SEQ ID NO:8903 | CAACAGTATAATAGTTACCC TCTCACT SEQ ID NO:16915 | |
| iPS:393954 | 21-225_4H6 | AA | RASQGINNYLA SEQ ID NO:892 | VASSLQT SEQ ID NO:8904 | QQYNSYPLT SEQ ID NO:16916 | |
| | | NA | CGGGCGAGTCAGGGTATTAG CAGGTGGTTAGCC SEQ ID NO:893 | GGTGCATCCAGTTTGCA AAGT SEQ ID NO:8905 | CAACAGGCTAACAGTTCCC ATTCACT SEQ ID NO:16917 | |
| iPS:393956 | 21-225_4D7 | AA | RASQGISRWLA SEQ ID NO:894 | GASSLQS SEQ ID NO:8906 | QQANSFPFT SEQ ID NO:16918 | |
| | | NA | CGGGCAAGTCAGAGCATTAG CGACTATTAAAT SEQ ID NO:895 | GATACAACCAGTTTGCA AAGT SEQ ID NO:8907 | CAACAGACTTACAATACCCC TCCGGAGCGCAGT SEQ ID NO:16919 | |
| iPS:393958 | 21-225_5H2 | AA | RASQSISDYLN SEQ ID NO:896 | DTTSLQS SEQ ID NO:8908 | QQTYNTPPERS SEQ ID NO:16920 | |
| | | NA | CGGGCAAGTCAGGGCATTAG AAATGATTAGGC SEQ ID NO:897 | GCTGCATCCAGTTTGCAA AGT SEQ ID NO:8909 | CTACAGCATAATAGTTACCC TCTCACT SEQ ID NO:16921 | |

FIGURE 49
(Continued)

| | | | | | | | |
|---|---|---|---|---|---|---|---|
| iPS:393960 | 21-225_7G2 | AA | RASQGIRNDLG SEQ ID NO:898 | CGGGCAAGTCAGGGCATTAG AAATGATTAGGC SEQ ID NO:899 | AASSLQS SEQ ID NO:8910 | ACTGCATCCAGTTTGCAA AGT SEQ ID NO:8911 | LQHNSYPLT SEQ ID NO:16922 CTACAACATAATAGTTACCC GTGGACG SEQ ID NO:16923 |
| iPS:393962 | 21-225_7H7 | NA AA | RASQGIRNDLG SEQ ID NO:900 RASQGIRNDLG SEQ ID NO:902 | CGGGCAAGTCAGGGCATTAG AAATGATTAGGC SEQ ID NO:901 | TASSLQS SEQ ID NO:8912 AASSLQS SEQ ID NO:8914 | GCTGCATCCAGTTTGCAA AGT SEQ ID NO:8913 | LQHNSYPWT SEQ ID NO:16924 CTACAGCATAGTAGTTACCC GTTCACT SEQ ID NO:16925 LQHSSYPFT SEQ ID NO:16926 |
| iPS:393964 | 21-225_6G1 | NA AA | RTSQNIISYLN CAGCTATTAAAT SEQ ID NO:903 RASQGIGNDLG SEQ ID NO:906 | | TASNLQT SEQ ID NO:8915 AASSLQS SEQ ID NO:8916 | ACTGCATCCAATTTGCAA ACT SEQ ID NO:8917 | CAACAGCCTCACAGTCCCC GCTCACT SEQ ID NO:16927 QQPHSPPLT SEQ ID NO:16928 |
| iPS:393966 | 21-225_7F8 | NA AA | CGGGCGAGTCAGGGCATTGG AAATGATTAGGC SEQ ID NO:905 RASQGIGNDLG SEQ ID NO:906 | | AASSLQS SEQ ID NO:8918 | GCTGCATCCAGTTTGCAA AGT SEQ ID NO:8917 | CTACAACATTATACTTACCC TCGGACG SEQ ID NO:16929 LQHYTYPRT SEQ ID NO:16930 |
| iPS:393968 | 21-225_5A5 | NA AA | CGGGCGAGTCAGGGCATTAG CAATTATTAGGC SEQ ID NO:907 RASQGISNYLA SEQ ID NO:908 | | AASSLQS SEQ ID NO:8919 | GCTGCATCCAGTTTGCAA AGT | CAACAGTATAATAGTTACC ATTCACT SEQ ID NO:16931 QQYNSYPFT SEQ ID NO:16932 |
| iPS:393972 | 21-225_7C9 | NA | CGGGCAAGTCAGGGCATTAG AAACGATTAGGC SEQ ID NO:909 | | AASSLQS SEQ ID NO:8920 | GCTGCATCCAGTTTGCAA AGT SEQ ID NO:8921 | CTACAGTTTATAGTTACCCT CGGACG SEQ ID NO:16933 |

FIGURE 49
(Continued)

| | | | | | | |
|---|---|---|---|---|---|---|
| | | AA | RASQGIRNDLG | AASSLQS | LQLYSYPRT | |
| | | | SEQ ID NO:910 | SEQ ID NO:8922 | SEQ ID NO:16934 | |
| iPS:393974 | 21-225_7C4 | NA | CGGGCAAGTCAGGGCATTAG AAATGATTTAGGC | GCTGCATCCAGTTTGCAA AGT | CTACAGCATAATAGTTACCC GCTCACT | |
| | | | SEQ ID NO:911 | SEQ ID NO:8923 | SEQ ID NO:16935 | |
| | | AA | RASQGIRNDLG | AASSLQS | LQHNSYPLT | |
| | | | SEQ ID NO:912 | SEQ ID NO:8924 | SEQ ID NO:16936 | |
| iPS:393976 | 21-225_7E9 | NA | CGGGCAAGTCAGGGCATTAG AAATGATTTAGGC | ACTGCATCCAGTTTGCAA AGT | CTACAGCATAATAGTTACCC GCTCACT | |
| | | | SEQ ID NO:913 | SEQ ID NO:8925 | SEQ ID NO:16937 | |
| | | AA | RASQGIRNDLG | TASSLQS | LQHNSYPLT | |
| | | | SEQ ID NO:914 | SEQ ID NO:8926 | SEQ ID NO:16938 | |
| iPS:393978 | 21-225_4C12 | NA | CGGGCAAGTCAGGGCATTAG AAATGATTTAGGC | GCTGCATCCAGTTTGCAC AGT | CTACAACATTATAGTTTCCCT CGGACG | |
| | | | SEQ ID NO:915 | SEQ ID NO:8927 | SEQ ID NO:16939 | |
| | | AA | RASQGIRNDLG | AASSLHS | LQHYSFPRT | |
| | | | SEQ ID NO:916 | SEQ ID NO:8928 | SEQ ID NO:16940 | |
| iPS:393980 | 21-225_6D3 | NA | CGGACAAGTCAGAGCATTAG TACTTATTTAAAT | GCTGCATCCAGTTTGCAA AGT | CAACAGAGTTACAGAACCCC CTTTTTCACT | |
| | | | SEQ ID NO:917 | SEQ ID NO:8929 | SEQ ID NO:16941 | |
| | | AA | RTSQSISTYLN | AASSLQS | QQSYRTPFFT | |
| | | | SEQ ID NO:918 | SEQ ID NO:8930 | SEQ ID NO:16942 | |
| iPS:393982 | 21-225_6C12 | NA | CGGGCAAGTCAGGGCATTAG AAGTAATTTAGGC | GCTGCATCCAGTTTGGA AAGT | CTACAGGATAATAGTTATCC GTTCACT | |
| | | | SEQ ID NO:919 | SEQ ID NO:8931 | SEQ ID NO:16943 | |
| | | AA | RASQGIRSNLG | AASSLES | LQDNSYPFT | |
| | | | SEQ ID NO:920 | SEQ ID NO:8932 | SEQ ID NO:16944 | |
| iPS:393984 | 21-225_4F12 | NA | CGGGCAAGTCAGGGCATTAG AAATGATTTAGGC | GCTGCATCCAGTTTGCAA AGT | CTACAGCATAATAGTTACGC GCTCACT | |
| | | | SEQ ID NO:921 | SEQ ID NO:8933 | SEQ ID NO:16945 | |

FIGURE 49
(Continued)

| | | | | | | |
|---|---|---|---|---|---|---|
| iPS:393986 | | AA | RASQGIRNDLG<br>SEQ ID NO:922 | AASSLQS<br>SEQ ID NO:8934 | LQHNSYALT<br>SEQ ID NO:16946 |
| | 21-225_7G4 | NA | CGGGCAAGTCAGGGCATTAG<br>AAATGATTTAGGC<br>SEQ ID NO:923 | GCTGCATCCAGTTTGCAA<br>AGT<br>SEQ ID NO:8935 | CTACATCAATATAGTTACC<br>TCGGACG<br>SEQ ID NO:16947 |
| iPS:393988 | | AA | RASQGIRNDLG<br>SEQ ID NO:924 | AASSLQS<br>SEQ ID NO:8936 | LHQYSYPRT<br>SEQ ID NO:16948 |
| | 21-225_7F10 | NA | CGGGCGAGTCAGGACATTAG<br>GAATTATTTAGCC<br>SEQ ID NO:925 | GTTGCATCCAGTTTGCAA<br>AGT<br>SEQ ID NO:8937 | CAACAGTATAATAGTTACC<br>TCTCACT<br>SEQ ID NO:16949 |
| iPS:393990 | | AA | RASQDIRNYLA<br>SEQ ID NO:926 | VASSLQS<br>SEQ ID NO:8938 | QQYNSYPLT<br>SEQ ID NO:16950 |
| | 21-225_11G7 | NA | CGGGCAAGTCAGGGCATTAG<br>AAATGATTTAGGC<br>SEQ ID NO:927 | GCTGCATCCAGTTTGCAA<br>AGT<br>SEQ ID NO:8939 | CTACAGCATAGTAATTACC<br>TCTCACT<br>SEQ ID NO:16951 |
| iPS:393992 | | AA | RASQGIRNDLG<br>SEQ ID NO:928 | AASSLQS<br>SEQ ID NO:8940 | LQHSNYPLT<br>SEQ ID NO:16952 |
| | 21-225_14H8 | NA | CGGGCGAGTCAGGGCATTAG<br>CTATTATTTAGCC<br>SEQ ID NO:929 | GTTGCATCCAGTTTGCAA<br>AGT<br>SEQ ID NO:8941 | CAACAGTATAATAGTTACC<br>ATTCACT<br>SEQ ID NO:16953 |
| iPS:393994 | | AA | RASQGISYYLA<br>SEQ ID NO:930 | VASSLQS<br>SEQ ID NO:8942 | QQYNSYPFT<br>SEQ ID NO:16954 |
| | 21-225_8C9 | NA | CGGGCAAGTCAGGGCATTAG<br>AAATGATTTAGAC<br>SEQ ID NO:931 | GCTGCATCCAGTTTGCAA<br>AGT<br>SEQ ID NO:8943 | CTACAGCATAATAGTTATCC<br>GCTCACT<br>SEQ ID NO:16955 |
| iPS:393996 | | AA | RASQAIRNDLD<br>SEQ ID NO:932 | AASSLQS<br>SEQ ID NO:8944 | LQHNSYPLT<br>SEQ ID NO:16956 |
| | 21-225_15C11 | NA | CGGGCAAGTCAGGGCATTAG<br>AAATGATTTAGGC<br>SEQ ID NO:933 | GCTGCATCCAGTTTGCAA<br>AGT<br>SEQ ID NO:8945 | CTACTGCATTATAGTTACCCT<br>CGGACG<br>SEQ ID NO:16957 |

FIGURE 49
(Continued)

| | | | | | |
|---|---|---|---|---|---|
| iPS:393998 | 21-225_12B12 | AA | RASQGIRNDLG SEQ ID NO:934 | AASSLQS SEQ ID NO:8946 | LLHYSYPRT SEQ ID NO:16958 |
| | | NA | CGGGCAAGTCAGGGCATTAG AAATGATTAGGC SEQ ID NO:935 | ACTGCATCCAGTTTGCAA AGT SEQ ID NO:8947 | CTACAACATAATAGTTACCC GTGGACG SEQ ID NO:16959 |
| iPS:394000 | 21-225_11A2 | AA | RASQGIRNDLG SEQ ID NO:936 | TASSLQS SEQ ID NO:8948 | LQHNSYPWT SEQ ID NO:16960 |
| | | NA | CAGGCGAGTCAGGACATTAG CAACTATTAAAT SEQ ID NO:937 | GATGCATCCAATTGGA AACA SEQ ID NO:8949 | CAACAGTATGATAATCTCCC GATCACC SEQ ID NO:16961 |
| iPS:394002 | 21-225_15G7 | AA | QASQDISNYLN SEQ ID NO:938 | DASNLET SEQ ID NO:8950 | QQYDNLPIT SEQ ID NO:16962 |
| | | NA | CGGGCAAGTCAGGGCATTAG AAATGATTAGGC SEQ ID NO:939 | GCTGCATCCAGTTTGCAA AGT SEQ ID NO:8951 | CTACAGCATAGTAATTACCC TCTCACT SEQ ID NO:16963 |
| iPS:394004 | 21-225_13A1 | AA | RASQGIRNDLG SEQ ID NO:940 | AASSLQS SEQ ID NO:8952 | LQHSNYPLT SEQ ID NO:16964 |
| | | NA | CAGGCGAGTCAGGACATTAA CAACTATTAAAT SEQ ID NO:941 | GATGGATCCAATTGGA AACA SEQ ID NO:8953 | CAACAGTATGAAAATCTCCC GATCACT SEQ ID NO:16965 |
| iPS:394006 | 21-225_15C2 | AA | QASQDINNYLN SEQ ID NO:942 | DGSNLET SEQ ID NO:8954 | QQYENLPIT SEQ ID NO:16966 |
| | | NA | CAGGCGAGTCAGGACATTAC CAACTATTAAAT SEQ ID NO:943 | GATGCATCCAATTGGA AACA SEQ ID NO:8955 | CAACAGTATGATAATCTCCC GATCACC SEQ ID NO:16967 |
| iPS:394008 | 21-225_15H8 | AA | QASQDITNYLN SEQ ID NO:944 | DASNLET SEQ ID NO:8956 | QQYDNLPIT SEQ ID NO:16968 |
| | | NA | CGGGCAAGTCAGGGCATTAG AAATGATTAGGC SEQ ID NO:945 | GCTGCATCCAGTTTGCAA AGT SEQ ID NO:8957 | CTACAGCATAATAGTTACCC GCTCACT SEQ ID NO:16969 |

FIGURE 49
(Continued)

| | | | | | | |
|---|---|---|---|---|---|---|
| iPS:394010 | 21-225_12G5 | AA | RASQGIRNDLG<br>SEQ ID NO:946 | AASSLQS<br>SEQ ID NO:8958 | LQHNSYPLT<br>SEQ ID NO:16970 | |
| | | NA | CGGGCAAGTCAGGGACATTAG<br>CAATTATTAGCC<br>SEQ ID NO:947 | GCTGCATACACATTTGCAA<br>TCA<br>SEQ ID NO:8959 | CAAAGTATGACAGTGCCCC<br>ATTCACT<br>SEQ ID NO:16971 | |
| iPS:394012 | 21-225_15A3 | AA | RASQDISNYLA<br>SEQ ID NO:948 | AAYILQS<br>SEQ ID NO:8960 | QKYDSAPFT<br>SEQ ID NO:16972 | |
| | | NA | CGGGCAAGTCAGAGCATTAT<br>CAGCTATTTAAAT<br>SEQ ID NO:949 | ACTGCATCCAGTTTGCAA<br>AGT<br>SEQ ID NO:8961 | CAACAGACTTACAGTACCC<br>GCTCACT<br>SEQ ID NO:16973 | |
| iPS:394014 | 21-225_8G6 | AA | RASQSIISYLN<br>SEQ ID NO:950 | TASSLQS<br>SEQ ID NO:8962 | QQTYSTPLT<br>SEQ ID NO:16974 | |
| | | NA | CGGGCAAGTCAGAGCATTAG<br>TAGTTATTTAAAT<br>SEQ ID NO:951 | GCTGCATCCAGTTTGCAA<br>AGT<br>SEQ ID NO:8963 | CAACAGAGTTACAGAACCC<br>CTTTTTCACT<br>SEQ ID NO:16975 | |
| iPS:394016 | 21-225_13D4 | AA | RASQSIFSYLN<br>SEQ ID NO:952 | AASSLQS<br>SEQ ID NO:8964 | QQSYRTPFFT<br>SEQ ID NO:16976 | |
| | | NA | CGGGCAAGTCAGAGCATTTT<br>CAGCTACTTAAAT<br>SEQ ID NO:953 | ACTGCATCCAGTTTGCAA<br>AAT<br>SEQ ID NO:8965 | CAACAGACTTACAGTCTTCC<br>GCTCACT<br>SEQ ID NO:16977 | |
| iPS:394018 | 21-225_15B1 | AA | RASQSISYLN<br>SEQ ID NO:954 | TASSLQN<br>SEQ ID NO:8966 | QQTYSLPLT<br>SEQ ID NO:16978 | |
| | | NA | CGGGCAAGTCAGGGCATTAG<br>CAATTATTAGCC<br>SEQ ID NO:955 | GCTGCATCCAGTTTGCAA<br>AGT<br>SEQ ID NO:8967 | CAACAGTATCATAGTTACC<br>ATTCACT<br>SEQ ID NO:16979 | |
| iPS:394020 | 21-225_15H10 | AA | RASQGISNYLA<br>SEQ ID NO:956 | AASSLQS<br>SEQ ID NO:8968 | QQYHSYPFT<br>SEQ ID NO:16980 | |
| | | NA | CGGGCAAGTCAGGGCATTAG<br>AAATGATTTAGGC<br>SEQ ID NO:957 | GCTGCATCCAGTTTGCAA<br>AGT<br>SEQ ID NO:8969 | CTACAGCATAATAGTTACC<br>GCTCACT<br>SEQ ID NO:16981 | |

FIGURE 49
(Continued)

| | | | | | | |
|---|---|---|---|---|---|---|
| iPS:394022 | 21-225_16H6 | AA | RASQGIRNDLG | | AASSLQS | LQHNSYPLT |
| | | | SEQ ID NO:958 | | SEQ ID NO:8970 | SEQ ID NO:16982 |
| | | NA | CGGGCAAGTCAGAGAACATTAG CAGCTATTTAAAT | | GCTGCATCCAGTTTGCAA AGT | CAACAGAGTTACAGAACCCC CTTATTCACT |
| | | | SEQ ID NO:959 | | SEQ ID NO:8971 | SEQ ID NO:16983 |
| iPS:394024 | 21-225_16B7 | AA | RASQNISSYLN | | AASSLQS | QQSYRTPLFT |
| | | | SEQ ID NO:960 | | SEQ ID NO:8972 | SEQ ID NO:16984 |
| | | NA | CGGGCAAGTCAGGGCATTAG AAATGATTAGGC | | GCTGCATCCAGTTTGCAA AGT | CTACAGCATAATAGTTACC GCTCACT |
| | | | SEQ ID NO:961 | | SEQ ID NO:8973 | SEQ ID NO:16985 |
| iPS:394026 | 21-225_16C7 | AA | RASQGIRNDLG | | AASSLQS | LQHNSYPLT |
| | | | SEQ ID NO:962 | | SEQ ID NO:8974 | SEQ ID NO:16986 |
| | | NA | CGGGCGAGTCAGGGCATTAG CAATTATTAGCC | | GCTGCATCCAGTTTGCAA AGT | CAACAGTATAATAGTTACC ATTCACT |
| | | | SEQ ID NO:963 | | SEQ ID NO:8975 | SEQ ID NO:16987 |
| iPS:394029 | 21-225_1B12 | AA | RASQGISNYLA | | AASSLQS | QQYNSYPFT |
| | | | SEQ ID NO:964 | | SEQ ID NO:8976 | SEQ ID NO:16988 |
| | | NA | CAGGCGAGTCAGGACATTAA CAACTATTTAAAT | | GATGCATCCAATTGGA AACA | CAACAGTATGAAAATCTCCC GATCACC |
| | | | SEQ ID NO:965 | | SEQ ID NO:8977 | SEQ ID NO:16989 |
| iPS:394033 | 21-225_5F4 | AA | QASQDINNYLN | | DASNLET | QQYENLPIT |
| | | | SEQ ID NO:966 | | SEQ ID NO:8978 | SEQ ID NO:16990 |
| | | NA | CGGGCAAGTCAGGGCATTAG AAATCATTAGGC | | GCTGCCTCCAGTTTGCAA AGT | CTACAGTATAATGGTTACC ATTCACT |
| | | | SEQ ID NO:967 | | SEQ ID NO:8979 | SEQ ID NO:16991 |
| iPS:394035 | 21-225_5G9 | AA | RASQGIRNHLG | | AASSLQS | LQYNGYPFT |
| | | | SEQ ID NO:968 | | SEQ ID NO:8980 | SEQ ID NO:16992 |
| | | NA | CAGGCGAGTCAGGGCATTGGA CAACTCTTTAAAT | | GATGCATCCAATTGGA AACA | CAACAATATGATAATCTCCC GCTCACT |
| | | | SEQ ID NO:969 | | SEQ ID NO:8981 | SEQ ID NO:16993 |

FIGURE 49
(Continued)

| | | | | | | |
|---|---|---|---|---|---|---|
| | | | QASQGISNSLN | | DASNLET | QQYDNLPLT |
| | | AA | SEQ ID NO:970 | | SEQ ID NO:8982 | SEQ ID NO:16994 |
| iPS:394037 | 21-225_4F4 | NA | CGGGCAAGTCAGGGCATTAG AAATGATTAGGC SEQ ID NO:971 | | GCTGCGTCCAGTGTGCA AACT SEQ ID NO:8983 | CTACAGCATAATAGTTACCC GCTCACT SEQ ID NO:16995 |
| | | AA | RASQGIRNDLG SEQ ID NO:972 | | AASSVQT SEQ ID NO:8984 | LQHNSYPLT SEQ ID NO:16996 |
| iPS:394041 | 21-225_5E5 | NA | CGGGCAAGTCAGGGCATTAG AAATGATTAGGC SEQ ID NO:973 | | GCTGCATCCAGTTTGCAA AGT SEQ ID NO:8985 | CTACAGCATTATAGTTACCC TCGGACG SEQ ID NO:16997 |
| | | AA | RASQGIRNDLG SEQ ID NO:974 | | AASSLQS SEQ ID NO:8986 | LQHYSYPRT SEQ ID NO:16998 |
| iPS:394043 | 21-225_3B1 | NA | CGGGCAAGTCAGAGTATTAA TAATTATTAAAT SEQ ID NO:975 | | GCTACATCCAGTTTGCAA AAT SEQ ID NO:8987 | CAACAGAGTTACAGTACCC CTTATTCACT SEQ ID NO:16999 |
| | | AA | RASQSINNYLN SEQ ID NO:976 | | ATSSLQN SEQ ID NO:8988 | QQSYSTPLFT SEQ ID NO:17000 |
| iPS:394045 | 21-225_4H4 | NA | CGGGCAAGTCAGGGCATTAG AAATGATTAGGC SEQ ID NO:977 | | GCTGCATCCAGTGTGCA AAGT SEQ ID NO:8989 | CTACAGCATAATAGTTACCC GCTCACT SEQ ID NO:17001 |
| | | AA | RASQGIRNDLG SEQ ID NO:978 | | AASSVQS SEQ ID NO:8990 | LQHNSYPLT SEQ ID NO:17002 |
| iPS:394047 | 21-225_5E6 | NA | CAGGCGAGTCAGGACATTAA CAACTATTTAAAT SEQ ID NO:979 | | GATGCATCCAATTGGA AACA SEQ ID NO:8991 | CAACAGTATGATAATCTCCC GATCACC SEQ ID NO:17003 |
| | | AA | QASQDINNYLN SEQ ID NO:980 | | DASNLET SEQ ID NO:8992 | QQYDNLPIT SEQ ID NO:17004 |
| iPS:394049 | 21-225_13H5 | NA | CGGGCAAGTCAGGGCATTAG AAATGATTAGGC SEQ ID NO:981 | | GCTGCATCCAGTTTGCAA ACT SEQ ID NO:8993 | CTACAGCATAATAGTTACCC TCTCACT SEQ ID NO:17005 |

FIGURE 49 (Continued)

| | | | | | | | |
|---|---|---|---|---|---|---|---|
| iPS:394051 | 21-225_9E5 | AA | RASQGIRNDLG<br>SEQ ID NO:982 | CGGGCAAGTCAGAGCATTGC<br>CAGTTATTAAAT<br>SEQ ID NO:983 | AASSLQT<br>SEQ ID NO:8994 | GGTGCATCCAGTTTGCA<br>AAGT<br>SEQ ID NO:8995 | LQHNSYPLT<br>SEQ ID NO:17006 | CAACAGAGTTACAGTACCCC<br>CTTATTCAGT<br>SEQ ID NO:17007 |
| iPS:394053 | 21-225_11F10 | NA | RASQSIASYLN<br>SEQ ID NO:984 | CGGGCAAGTCAGGGCATTAG<br>AAATGATTTAGGC<br>SEQ ID NO:985 | GASSLQS<br>SEQ ID NO:8996 | GCTGCATCCAGTTACAA<br>AGT<br>SEQ ID NO:8997 | QQSYSTPLFS<br>SEQ ID NO:17008 | CTACAGCATAGTAGTTACC<br>TCTCACT<br>SEQ ID NO:17009 |
| iPS:394055 | 21-225_9C8 | AA | RASQGIRNDLG<br>SEQ ID NO:986 | CGGGGAGTCAGGGCATTAG<br>CTATTATTTAGCC<br>SEQ ID NO:987 | AASSLQS<br>SEQ ID NO:8998 | GTTGCATCCAGTTTGCAA<br>AGT<br>SEQ ID NO:8999 | LQHSSYPLT<br>SEQ ID NO:17010 | CAACAGTATGATAGTTACCC<br>ATTCACT<br>SEQ ID NO:17011 |
| iPS:394057 | 21-225_15H1 | NA | RASQGISYYLA<br>SEQ ID NO:988 | CGGGCAAGTCAGGGCATTAG<br>AAATGATTTAGGC<br>SEQ ID NO:989 | VASSLQS<br>SEQ ID NO:9000 | ACTGCATCCAGTTGCAA<br>AGT<br>SEQ ID NO:9001 | QQYDSYPFT<br>SEQ ID NO:17012 | CTACAGCAGATAGTAGTTACCC<br>GCTCACT<br>SEQ ID NO:17013 |
| iPS:394059 | 21-225_9E8 | AA | RASQGIRNDLG<br>SEQ ID NO:990 | CGGGCAAGTCAGGGCATTAG<br>AAATGATTTAGGC<br>SEQ ID NO:991 | TASSLQS<br>SEQ ID NO:9002 | GCTGCATCCAGTTGCAA<br>AGT<br>SEQ ID NO:9003 | LQHSSYPLT<br>SEQ ID NO:17014 | CTACAGCATAATAGTTACCC<br>GCTCACT<br>SEQ ID NO:17015 |
| iPS:394061 | 21-225_12D2 | NA | RASQGIRNDLG<br>SEQ ID NO:992 | AGGTCTAGTCAGAGCCTCCT<br>CCATAGTAATGGATACAACT<br>ATTTGGAT | AASSLQS<br>SEQ ID NO:9004 | TTGGGTTCTAATCGGGCC<br>TCC | LQHNSYPLT<br>SEQ ID NO:17016 | ATGCAAGCTCTACAAACTCC<br>TATCACC |

FIGURE 49
(Continued)

| | | | | | | |
|---|---|---|---|---|---|---|
| iPS:394063 | 21-225_12D2 | AA | SEQ ID NO:993<br>RSSQSLLHSNGYNYLD | SEQ ID NO:9005<br>LGSNRAS | SEQ ID NO:17017<br>MQALQTPIT |
| | | NA | SEQ ID NO:994<br>CGGGCAAGTCAGGGCATTAG<br>AAATGATTTAGGC | SEQ ID NO:9006<br>GCTGCGTCCAGTTTGCAA<br>AGT | SEQ ID NO:17018<br>CTACACCATAGTAATTACCC<br>TCTCACT |
| iPS:394065 | 21-225_16A1 | AA | SEQ ID NO:995<br>RASQGIRNDLG | SEQ ID NO:9007<br>AASSLQS | SEQ ID NO:17019<br>LHHSNYPLT |
| | | NA | SEQ ID NO:996<br>AAGTCCAACCAGAGAGTTT<br>ATCCAGTCCCAACAATCACA<br>ACTACTAGCT | SEQ ID NO:9008<br>TGGGCATCTACCGGGA<br>ATCC | SEQ ID NO:17020<br>CAGCAATATTTTAGTACTCC<br>ATTCACT |
| iPS:394067 | 21-225_11E2 | AA | SEQ ID NO:997<br>KSNQRVLSSSNHNYLA | SEQ ID NO:9009<br>WASTRES | SEQ ID NO:17021<br>QQYFSTPFT |
| | | NA | SEQ ID NO:998<br>CGGGCAAGTCAGGGCATTAG<br>AAATGATTTAGGC | SEQ ID NO:9010<br>GCTGCATCCAGTTTGCAA<br>AGT | SEQ ID NO:17022<br>CTACACCATAATAGTTATCC<br>GTGGACG |
| iPS:394069 | 21-225_12F2 | AA | SEQ ID NO:999<br>RASQGIRNDLG | SEQ ID NO:9011<br>AASSLQS | SEQ ID NO:17023<br>LQHNSYPWT |
| | | NA | SEQ ID NO:1000<br>CGGGCAAGTCAGGGCATTAG<br>AGATATTTAGGC | SEQ ID NO:9012<br>GCTGCATCCAGTTTGCAA<br>AAT | SEQ ID NO:17024<br>CTACAGTATCATAGTTACCC<br>ATTCACT |
| iPS:394071 | 21-225_16H1 | AA | SEQ ID NO:1001<br>RASQGIRDILG | SEQ ID NO:9013<br>AASSLQN | SEQ ID NO:17025<br>LQYHSYPFT |
| | | NA | SEQ ID NO:1002<br>AGGTCTAGTCAGAGCCTCCT<br>GCATAGTAAGGATACAACT<br>ATTTGGAT | SEQ ID NO:9014<br>TTGGGTTCTAATCGGGCC<br>TCC | SEQ ID NO:17026<br>ATGCAAGCTCTACAAACTCC<br>TCTCACC |
| iPS:394073 | 21-225_10C7 | AA | SEQ ID NO:1003<br>RSSQSLLHSKGYNYLD | SEQ ID NO:9015<br>LGSNRAS | SEQ ID NO:17027<br>MQALQTPLT |
| | | | SEQ ID NO:1004 | SEQ ID NO:9016 | SEQ ID NO:17028 |

FIGURE 49
(Continued)

| | | | | | |
|---|---|---|---|---|---|
| iPS:394073 | 21-225_15C9 | NA | CGGGCAAGTCAGGGCATTAG AAATGATTAGGC<br>SEQ ID NO:1005 | GCTGCATCCAGTTTGCAA AGT<br>SEQ ID NO:9017 | CTACAACATACTAGTTACCC GCTCACT<br>SEQ ID NO:17029 |
| | | AA | RASQGIRNDLG<br>SEQ ID NO:1006 | AASSLQS<br>SEQ ID NO:9018 | LQHTSYPLT<br>SEQ ID NO:17030 |
| iPS:394075 | 21-225_8D12 | NA | CGGGCAAGTCAGGGCATTAG AAATGATTAGGC<br>SEQ ID NO:1007 | GCTGCATCCAGTTTGCAA AGT<br>SEQ ID NO:9019 | CTACAGCATAGTAGTTACCC GCTCACT<br>SEQ ID NO:17031 |
| | | AA | RASQGIRNDLG<br>SEQ ID NO:1008 | AASSLQS<br>SEQ ID NO:9020 | LQHSSYPLT<br>SEQ ID NO:17032 |
| iPS:394077 | 21-225_8E12 | NA | CGGGCAAGTCAGAGCATTAG TAATTATTAAAT<br>SEQ ID NO:1009 | GCTGCATCCAGTTTACAA AGT<br>SEQ ID NO:9021 | CAACAGAGTTACAGAACCCC CTTTTTCACT<br>SEQ ID NO:17033 |
| | | AA | RASQSISNYLN<br>SEQ ID NO:1010 | AASSLQS<br>SEQ ID NO:9022 | QQSYRTPFFT<br>SEQ ID NO:17034 |
| iPS:394079 | 21-225_11F5 | NA | CGGGCAAGTCAGGGCATTAG AAATGATTAGGC<br>SEQ ID NO:1011 | GCTGCATCCAGTGTGCA AAGT<br>SEQ ID NO:9023 | CTACAGCATAATAGTTACCC GCTCACT<br>SEQ ID NO:17035 |
| | | AA | RASQGIRNDLG<br>SEQ ID NO:1012 | AASSVQS<br>SEQ ID NO:9024 | LQHNSYPLT<br>SEQ ID NO:17036 |
| iPS:394081 | 21-225_16B3 | NA | CAGGGGAGTCAGGACACATTAA CAACTATTTAAAT<br>SEQ ID NO:1013 | GATGCATCCAATTGGA AACA<br>SEQ ID NO:9025 | CAACAGTTTGATAATCTCCC GATCACC<br>SEQ ID NO:17037 |
| | | AA | QASQDINNYLN<br>SEQ ID NO:1014 | DASNLET<br>SEQ ID NO:9026 | QQFDNLPIT<br>SEQ ID NO:17038 |
| iPS:394083 | 21-225_16E6 | NA | CGGGCAAGTCAGAGCATTAT CAGCTATTTAAAT<br>SEQ ID NO:1015 | ACTACATCCAGTTTGCAA AGT<br>SEQ ID NO:9027 | CAGGAGAGACTTACAGTACCCC GCTCACT<br>SEQ ID NO:17039 |
| | | AA | RASQSIISYLN<br>SEQ ID NO:1016 | TTSSLQS<br>SEQ ID NO:9028 | QQTYSTPLT<br>SEQ ID NO:17040 |

FIGURE 49
(Continued)

| | | | | | |
|---|---|---|---|---|---|
| iPS:394085 | 21-225_8B11 | NA | AAGTCCAGCCAGAATGTTTTATACAACTCCAACAATAACAACTACTTAGCT SEQ ID NO:1017 | TGGGCATCTACCCGGAAATCC SEQ ID NO:9029 | CAGCAATATTATACTACTCCGTGCAGT SEQ ID NO:17041 |
| | | AA | KSSQNVLYNSNNNYLA SEQ ID NO:1018 | WASTRKS SEQ ID NO:9030 | QQYYTTPCS SEQ ID NO:17042 |
| iPS:394087 | 21-225_11A5 | NA | CGGGCAAGTCAGAACATTTATAGTTATTTAAAT SEQ ID NO:1019 | GCTGCATCCAGTTTGCAAAGT SEQ ID NO:9031 | CAACAGAGTTACAATACCCCCTTATTCACT SEQ ID NO:17043 |
| | | AA | RASQNIYSYLN SEQ ID NO:1020 | AASSLQS SEQ ID NO:9032 | QQSYNTPLFT SEQ ID NO:17044 |
| iPS:394089 | 21-225_12E6 | NA | CGGGCAAGTCAGGGCATTAGAAGTGATTTAGGC SEQ ID NO:1021 | GCTGCATCCAGTTTGCAAAGT SEQ ID NO:9033 | CTACAGCATAATAGTTACCCGTGGACG SEQ ID NO:17045 |
| | | AA | RASQGIRSDLG SEQ ID NO:1022 | AASSLQS SEQ ID NO:9034 | LQHNSYPWT SEQ ID NO:17046 |
| iPS:394091 | 21-225_13H3 | NA | CGGGCAAGTCAGGGCATTAGAAATGATTTAGGC SEQ ID NO:1023 | GCTGCATCCAGTTTACAAAGT SEQ ID NO:9035 | CTACAGCATAATAGTTACCCGCTCACT SEQ ID NO:17047 |
| | | AA | RASQGIRNDLG SEQ ID NO:1024 | AASSLQS SEQ ID NO:9036 | LQHNSYPLT SEQ ID NO:17048 |
| iPS:394093 | 21-225_9D12 | NA | CGGGCAAGTCAGGGCATTAGAAATGATTTAGGC SEQ ID NO:1025 | GCTGCATCCAGTTTGCAAAGT SEQ ID NO:9037 | CTACAGCATAATAGTTACCCGTGGACG SEQ ID NO:17049 |
| | | AA | RASQGIRNDLG SEQ ID NO:1026 | AASSLQS SEQ ID NO:9038 | LQHNSYPWT SEQ ID NO:17050 |
| iPS:394095 | 21-225_16H4 | NA | CGGGCAAGTCAGGGCATTAGAAATGATTTAGGC SEQ ID NO:1027 | ACTGCATCCAGTTTGCAAAGT SEQ ID NO:9039 | CTACAGCATAATAGTTACCCGTGGACG SEQ ID NO:17051 |
| | | AA | RASQGIRNDLG | TASSLQS | LQHNSYPWT |

FIGURE 49
(Continued)

| | | | | | | |
|---|---|---|---|---|---|---|
| iPS:398097 | 21-225_16G7 | NA | SEQ ID NO:1028 CGGGCAAGTCAGGGCATTAG AAATGATTTAGGC | SEQ ID NO:9040 GCTGCATCCAGTTTGCAA AGT | SEQ ID NO:17052 CTACAACATAATAGTTACCC GTGGACG | |
| | | AA | SEQ ID NO:1029 RASQGIRNDLG | SEQ ID NO:9041 AASSLQS | SEQ ID NO:17053 LQHNSYPWT | |
| iPS:398470 | 21-225_14B7 | NA | SEQ ID NO:1030 TCTGGAGATAAATTGGGGAA TAAATATGCTTAC | SEQ ID NO:9042 CAAGATAGAAAGCGGCC CTCA | SEQ ID NO:17054 CAGGCGTGGAACAACAGCAC TGTGGTA | |
| | | AA | SEQ ID NO:1031 SGDKLGNKYAY | SEQ ID NO:9043 QDRKRPS | SEQ ID NO:17055 QAWNNSTVV | |
| iPS:398472 | 21-225_16E4 | NA | SEQ ID NO:1032 TCTGGAGATAAATTGGGGGA TAAATATGTTTAC | SEQ ID NO:9044 CAAGATAGCAAGCGGCC CTCA | SEQ ID NO:17056 CAGGCGTGGGACAGCAGCAC TGTGGTT | |
| | | AA | SEQ ID NO:1033 SGDKLGDKYVY | SEQ ID NO:9045 QDSKRPS | SEQ ID NO:17057 QAWDSSTVV | |
| iPS:398474 | 21-225_17B10 | NA | SEQ ID NO:1034 CGGTCAAGTCAGAGCATTAA CAGCTATTTAAAT | SEQ ID NO:9046 GCTGCATCCAGTTTGCAC AGT | SEQ ID NO:17058 CAACAGGTTACAATACCCC CACGTGGACG | |
| | | AA | SEQ ID NO:1035 RSSQSINSYLN | SEQ ID NO:9047 AASSLHS | SEQ ID NO:17059 QQGYNTPTWT | |
| iPS:398476 | 21-225_17C1 | NA | SEQ ID NO:1036 CGGGCAAGTCAGAACATTAA CGACTATTTAAAT | SEQ ID NO:9048 GCTGCATCCAATTTGCAA AGT | SEQ ID NO:17060 CAACAGACTTACAATACCCC TCCGGAGCGCAGT | |
| | | AA | SEQ ID NO:1037 RASQNINDYLN | SEQ ID NO:9049 AASNLQS | SEQ ID NO:17061 QQTYNTPPERS | |
| iPS:398478 | 21-225_17C10 | NA | SEQ ID NO:1038 CGGGCGAGTCAGGGCATTAG CAATTATTTAGCC | SEQ ID NO:9050 GCTGCATCCACTTTGCAA TCA | SEQ ID NO:17062 CAAAAGTATAACAGTGCCCC TCCGCTCACC | |
| | | AA | SEQ ID NO:1039 RASQGISNYLA | SEQ ID NO:9051 AASTLQS | SEQ ID NO:17063 QKYNSAPPLT | |

FIGURE 49
(Continued)

| | | | | | | |
|---|---|---|---|---|---|---|
| iPS:398480 | 21-225_17G4 | NA | SEQ ID NO:1040 CGGACAAGTCAGAGAATATTAG CAACTATTTAAAT | SEQ ID NO:9052 GTTGCGTCCAGTTTCCCA AGT | SEQ ID NO:17064 CAACAGAGTAACTTTTTCCC GCTCACT |
| | | AA | SEQ ID NO:1041 RTSQNISNYLN | SEQ ID NO:9053 VASSFPS | SEQ ID NO:17065 QQSNFFPLT |
| iPS:398482 | 21-225_17H6 | NA | SEQ ID NO:1042 CGGGCGAGTCGGGACATTAG CAATTATTTAGCC | SEQ ID NO:9054 ACTGCATCCAGTTTGCAA AGT | SEQ ID NO:17066 CAACAGTATCATAGTTACCC ATTCACT |
| | | AA | SEQ ID NO:1043 RASRDISNYLA | SEQ ID NO:9055 TASSLQS | SEQ ID NO:17067 QQYHSYPFT |
| iPS:398484 | 21-225_18D4 | NA | SEQ ID NO:1044 CGGGCAAGTCAGGGCATTAG AAATGATTTAGGC | SEQ ID NO:9056 GCTGCATCCAGTTTGGA AAGT | SEQ ID NO:17068 CTACATCATAATAATTACCT CCCCATCACC |
| | | AA | SEQ ID NO:1045 RASQGIRNDLG | SEQ ID NO:9057 AASSLES | SEQ ID NO:17069 LHHNNYLPIT |
| iPS:398486 | 21-225_19A1 | NA | SEQ ID NO:1046 CGGGCAAGTCATACCATTAC CAGCTATTTAAAT | SEQ ID NO:9058 GCTACATCCAATCTCCAA AGT | SEQ ID NO:17070 CAACAGAGTTACAACTTCCC GCTCACT |
| | | AA | SEQ ID NO:1047 RASHTITSYLN | SEQ ID NO:9059 ATSNLQS | SEQ ID NO:17071 QQSYNFPLT |
| iPS:398488 | 21-225_19F6 | NA | SEQ ID NO:1048 TCTGGAGATAAATTGGGGGA TAAATATGCTTGC | SEQ ID NO:9060 CAAGATAGCAAGCGGCC CTCA | SEQ ID NO:17072 CAGGCGTGGGACAACAACAC TGTGGTA |
| | | AA | SEQ ID NO:1049 SGDKLGDKYAC | SEQ ID NO:9061 QDSKRPS | SEQ ID NO:17073 QAWDNNTVV |
| iPS:398490 | 21-225_21D12 | NA | SEQ ID NO:1050 TCTGGAGATAAATTGGGGAA TAAATATGCTTAC | SEQ ID NO:9062 CAAGATAGAAAGAGGCC CTCA | SEQ ID NO:17074 CAGGCGTGGGACAACAGCAC TGTGGTA |
| | | AA | SEQ ID NO:1051 SGDKLGNKYAY | SEQ ID NO:9063 QDRKRPS | SEQ ID NO:17075 QAWDNSTVV |

FIGURE 49
(Continued)

| | | | | | | |
|---|---|---|---|---|---|---|
| iPS:398492 | 21-225_21F12 | NA | SEQ ID NO:1052 CGGGCGAGTCAGGCATTAGGAATTTTTAGCC | SEQ ID NO:9064 GCTGCATCCAGTTTGCAAACT | SEQ ID NO:17076 CAACAGTATAATAGTTCCCATTCACT |
| | | AA | SEQ ID NO:1053 RASQGIRNFLA | SEQ ID NO:9065 AASSLQT | SEQ ID NO:17077 QQYNSFPPT |
| iPS:398494 | 21-225_21H4 | NA | SEQ ID NO:1054 ACTGGAACCAGCAGTGACGTTGGTGGTTATAACTCTGTCTCC | SEQ ID NO:9066 GAGGTCAGTAATCGGCCCTCA | SEQ ID NO:17078 AGCTCATATACAAGGAGCAGCACTGTGGTA |
| | | AA | SEQ ID NO:1055 TGTSSDVGGYNSVS | SEQ ID NO:9067 EVSNRPS | SEQ ID NO:17079 SSYTRSSTVV |
| iPS:398496 | 21-225_22D2 | NA | SEQ ID NO:1056 AAGTCCAGCAGTGTTTTACACAGCTCCAACAATAACAACTACTTAGCT | SEQ ID NO:9068 TGGGCATCTACCCGGAAATCC | SEQ ID NO:17080 CAGCAATATTATAGTACTCCGTGCAGT |
| | | AA | SEQ ID NO:1057 KSSQSVLHSSNNNNYLA | SEQ ID NO:9069 WASTRKS | SEQ ID NO:17081 QQYYSTPCS |
| iPS:398498 | 21-225_22E6 | NA | SEQ ID NO:1058 TCTGGAGATAAATTGGGGGAGAAATATGCTTGC | SEQ ID NO:9070 CAAGATAGAAAGCGGCCCTCA | SEQ ID NO:17082 CAGGCGTGGGACAGCAGCACTGCGGTA |
| | | AA | SEQ ID NO:1059 SGDKLGEKYAC | SEQ ID NO:9071 QDRKRPS | SEQ ID NO:17083 QAWDSSTAV |
| iPS:398500 | 21-225_23A11 | NA | SEQ ID NO:1060 CGGGCGAGTCAGGACATTAGCAATTATTTAGCC | SEQ ID NO:9072 GCTGCATCCACTTTGCAAAGT | SEQ ID NO:17084 CAACAGTATAATAGTTACCATTCACT |
| | | AA | SEQ ID NO:1061 RASQDISNYLA | SEQ ID NO:9073 AASTLQS | SEQ ID NO:17085 QQYNSYPFT |
| iPS:398502 | | NA | SEQ ID NO:1062 CGGGCGAGTCAGGGTATTACCAAGTGGTTAGCC | SEQ ID NO:9074 GCTGCATCCAGTTTGCAAAGT | SEQ ID NO:17086 CAACAGGCTAACAGTTCCCATTCACT |

FIGURE 49
(Continued)

| | | | | | | | |
|---|---|---|---|---|---|---|---|
| iPS:398504 | 21-225_23B11 | AA | SEQ ID NO:1063<br>RASQGITKWLA | | SEQ ID NO:9075<br>AASSLQS | | SEQ ID NO:17087<br>QQANSFPFT |
| | | | SEQ ID NO:1064 | | SEQ ID NO:9076 | | SEQ ID NO:17088 |
| iPS:398506 | 21-225_23D7 | NA | TCTGGAGAAAAATTGGGGG<br>ATAAATATGTTTGT | | CAAGATAGCAAGCGGCC<br>CTCA | | CAGGCGTGGAACAGCAGCAA<br>TGTGGTA |
| | | | SEQ ID NO:1065 | | SEQ ID NO:9077 | | SEQ ID NO:17089 |
| | | AA | SGEKLGDKYVC | | QDSKRPS | | QAWNSSNVV |
| | | | SEQ ID NO:1066 | | SEQ ID NO:9078 | | SEQ ID NO:17090 |
| iPS:398508 | 21-225_23G12 | NA | AAGTCCAGCCAGAGTATTT<br>ATTCAGTCCAACAATAACA<br>ACTACTTAGCT | | TGGGCATCTACCCGGGA<br>ATCC | | CAGCAATATTCTAGTACTCC<br>GTGGACG |
| | | | SEQ ID NO:1067 | | SEQ ID NO:9079 | | SEQ ID NO:17091 |
| | | AA | KSSQSILFSSNNNNYLA | | WASTRES | | QQYSSTPWT |
| | | | SEQ ID NO:1068 | | SEQ ID NO:9080 | | SEQ ID NO:17092 |
| iPS:398508 | 21-225_24B1 | NA | AGGTCTAGTCAAAGCCTCGT<br>ATACAGTGATGGAAACACCT<br>ACTTGAAT | | AAGGTTTCTAACTGGGA<br>CTCT | | ATGCAAGGTGCACACTGGCC<br>TCCGATCACC |
| | | | SEQ ID NO:1069 | | SEQ ID NO:9081 | | SEQ ID NO:17093 |
| | | AA | RSSQSLVYSDGNTYLN | | KVSNWDS | | MQGAHWPPIT |
| | | | SEQ ID NO:1070 | | SEQ ID NO:9082 | | SEQ ID NO:17094 |
| iPS:398510 | 21-225_25A3 | NA | AAGTCCAGCCAGAGTGTTTT<br>ATACAGTCCAACAATAAGA<br>ACTACTTAGCT | | TGGGCATCTACCCGGGA<br>ATCC | | CAGCAATATTATAGTACTCC<br>GTGCAGT |
| | | | SEQ ID NO:1071 | | SEQ ID NO:9083 | | SEQ ID NO:17095 |
| | | AA | KSSQSVLYSSNNKNYLA | | WASTRES | | QQYYSTPCS |
| | | | SEQ ID NO:1072 | | SEQ ID NO:9084 | | SEQ ID NO:17096 |
| iPS:398512 | 21-225_25E12 | NA | AAGTCCAGCCAGAGTGTTTT<br>ATACCACTCCAACAATTACA<br>ACTACTTAGCT | | TGGGCATCTACCCGGGA<br>GTCC | | CAGCAATATTACAGTACTCC<br>GTGCAGT |
| | | | SEQ ID NO:1073 | | SEQ ID NO:9085 | | SEQ ID NO:17097 |

FIGURE 49
(Continued)

| | | | | | | |
|---|---|---|---|---|---|---|
| iPS:398516 | 21-225_26A9 | AA | KSSQSVLYHSNNYNYLA<br>SEQ ID NO:1074 | WASTRES<br>SEQ ID NO:9086 | QQYYSTPCS<br>SEQ ID NO:17098 |
| | | NA | AAGTCCAGCCAGAGTGTTT<br>ATACAGCTCCAACAATAAGA<br>ACTACTTAGCT<br>SEQ ID NO:1075 | TGGGCATCTACCCGGA<br>ATCC<br>SEQ ID NO:9087 | CAGCAATATTATAGTAGTCC<br>GTGCAGT<br>SEQ ID NO:17099 |
| iPS:398520 | 21-225_31C4 | AA | KSSQSVLYSSNNKNYLA<br>SEQ ID NO:1076 | WASTRES<br>SEQ ID NO:9088 | QQYYSSPCS<br>SEQ ID NO:17100 |
| | | NA | CGGGGCGAGTCAGGGTATTAG<br>CAAATGGTTAGCC<br>SEQ ID NO:1077 | GCTGCATCCAGTTGCAG<br>AGT<br>SEQ ID NO:9089 | CAACAGGCTAACAGTTTCC<br>ATTCACT<br>SEQ ID NO:17101 |
| iPS:398522 | 21-225_32A1 | AA | RASQGISKWLA<br>SEQ ID NO:1078 | AASSLQS<br>SEQ ID NO:9090 | QQANSFPFT<br>SEQ ID NO:17102 |
| | | NA | AAGTCCAGCCAGAGTGTTT<br>ATACAGCTCCAACAATACA<br>ACTACTTAGCT<br>SEQ ID NO:1079 | TGGGCATCTACCCGAA<br>ATCC<br>SEQ ID NO:9091 | CAACAATATTATACTTCTCC<br>GTGCAGT<br>SEQ ID NO:17103 |
| iPS:398524 | 21-225_32A5 | AA | KSSQSVLYSSNNYNYLA<br>SEQ ID NO:1080 | WASTRKS<br>SEQ ID NO:9092 | QQYYTSPCS<br>SEQ ID NO:17104 |
| | | NA | AAGTCCAGCCAGAGTGTTT<br>ACACAGCTCCAACAATAAGA<br>ACTACTTAGCT<br>SEQ ID NO:1081 | TGGGCATCTACCCGGGA<br>ATCC<br>SEQ ID NO:9093 | CAGCAATATTATAGTTCTCC<br>GTGCAGT<br>SEQ ID NO:17105 |
| iPS:398526 | 21-225_32B3 | AA | KSSQSVLHSSNNKNYLA<br>SEQ ID NO:1082 | WASTRES<br>SEQ ID NO:9094 | QQYSSPCS<br>SEQ ID NO:17106 |
| | | NA | CGGGGCGAGTCAGGGCATTAG<br>CAATTATTTAGCC<br>SEQ ID NO:1083 | GCTGCATCCAGTTTACAA<br>AGT<br>SEQ ID NO:9095 | CAACAGTATAATAGTTATCC<br>ATTCACT<br>SEQ ID NO:17107 |
| | | AA | RASQGISNYLA<br>SEQ ID NO:1084 | AASSLQS<br>SEQ ID NO:9096 | QQYNSYPFT<br>SEQ ID NO:17108 |

FIGURE 49
(Continued)

| | | | | | |
|---|---|---|---|---|---|
| iPS:398528 | 21-225_32G1 | NA | CGGGCAAGTCAGGAGACATGA GAAGTGATTTAGGC<br>SEQ ID NO:1085 | GCTGCATCCAGTTTGCAA AGT<br>SEQ ID NO:9097 | CTACAGCATACTATTTCCCT CCTACT<br>SEQ ID NO:17109 |
| | | AA | RASQDMRSDLG<br>SEQ ID NO:1086 | AASSLQS<br>SEQ ID NO:9098 | LQHTISPPT<br>SEQ ID NO:17110 |
| iPS:398530 | 21-225_32G4 | NA | AGGTCAAGTCAAAGCCTCGT ATACAGTGATGGAAACACCT ACTTGAAT<br>SEQ ID NO:1087 | AAGGTTTCTAACTGGGA CTCT<br>SEQ ID NO:9099 | ATGCAAGGTATACACTGGCT CACT<br>SEQ ID NO:17111 |
| | | AA | RSSQSLVYSDGNTYLN<br>SEQ ID NO:1088 | KVSNWDS<br>SEQ ID NO:9100 | MQGIHWLT<br>SEQ ID NO:17112 |
| iPS:398532 | 21-225_33B7 | NA | CGGGGCGAGTCAGGACATTAG CAATTATTTGGCC<br>SEQ ID NO:1089 | GCTGCATCTAGTTTGCAA AGT<br>SEQ ID NO:9101 | CAACAGTATCATAGTTACCC GCTCACC<br>SEQ ID NO:17113 |
| | | AA | RASQDISNYLA<br>SEQ ID NO:1090 | AASSLQS<br>SEQ ID NO:9102 | QQYHSYPLT<br>SEQ ID NO:17114 |
| iPS:398534 | 21-225_33B8 | NA | CGGGCAAGTCAGGACATTAG AAGTGATTTAGGC<br>SEQ ID NO:1091 | GCTGCATCCAGTTTGCAA AGT<br>SEQ ID NO:9103 | CTACAGCATACTATTTACCC TCCTACT<br>SEQ ID NO:17115 |
| | | AA | RASQDIRSDLG<br>SEQ ID NO:1092 | AASSLQS<br>SEQ ID NO:9104 | LQHTIYPPT<br>SEQ ID NO:17116 |
| iPS:398536 | 21-225_33D12 | NA | CGGGCAAGTCAGGACATTAG AAGCTATTTAAAT<br>SEQ ID NO:1093 | AGTGCATCCAGTTTGCA AAGT<br>SEQ ID NO:9105 | CAACAGAGTTACAGTATCCC GATCACC<br>SEQ ID NO:17117 |
| | | AA | RASQSIRSYLN<br>SEQ ID NO:1094 | SASSLQS<br>SEQ ID NO:9106 | QQSYSIPIT<br>SEQ ID NO:17118 |
| iPS:398538 | 21-225_34H7 | NA | AAGTCCAGCCAGAGTGTTTT ATACAGCTCCAACAATTACA ACTACTTAGCT<br>SEQ ID NO:1095 | TGGGCATCTACCCGGAA ATCC<br>SEQ ID NO:9107 | CAGCAATATTATACTTCTCC GTGCAGT<br>SEQ ID NO:17119 |

FIGURE 49
(Continued)

| | | | | | |
|---|---|---|---|---|---|
| iPS:398540 | 21-225_35A6 | AA | KSSQSVLYSSNNYNYLA SEQ ID NO:1096 | WASTRKS SEQ ID NO:9108 | QQYYTSPCS SEQ ID NO:17120 |
| | | NA | CGGGCAAGTCAGGACATTAG AAGTGATTTAGGC SEQ ID NO:1097 | GCTACATCCAGTTGCA AGT SEQ ID NO:9109 | CTACAGATACTATTTACCC TCCTACT SEQ ID NO:17121 |
| iPS:398544 | 21-225_7C8 | AA | RASQDIRSDLG SEQ ID NO:1098 | ATSSLQS SEQ ID NO:9110 | LQHTIYPPT SEQ ID NO:17122 |
| | | NA | ACCCTAAGCAGTCAGTGAGCACAG CACCTACACCATCGAA | GTTAAGAGTGATGGCAG CCACAGCAAGGGGGAC | GGAGAGAGCCACCGATTGA TGGCCAAGTGGGTGGTA |
| iPS:398546 | 21-225_9H10 | AA | TLSSEHSTYTE SEQ ID NO:1099 | VKSDGSHSKGD SEQ ID NO:9111 | GESHPIDGQVGVV SEQ ID NO:17123 |
| | | NA | TCTGGAGATAAATGGGGA TAAATATGCTTGC SEQ ID NO:1100 | CAAGATAGCAAGCGGCC CTCA SEQ ID NO:9112 | CAGGCGTGGGACAGCAGCAC TTATGTGGTA SEQ ID NO:17124 |
| iPS:402219 | 21-225_1C12 | AA | SGDKLGDKYAC SEQ ID NO:1101 | QDSKRPS SEQ ID NO:9113 | QAWDSSTYVV SEQ ID NO:17125 |
| | | NA | CGGGCAAGTCAGGGCATTAG AAATGATTTAGGC SEQ ID NO:1102 | GCTGCATCCAGTTGCAA AGT SEQ ID NO:9114 | CTACAACATAATAGTTACCC GCTCACT SEQ ID NO:17126 |
| iPS:402221 | 21-225_2C12 | AA | RASQGIRNDLG SEQ ID NO:1103 | AASSLQS SEQ ID NO:9115 | LQHNSYPLT SEQ ID NO:17127 |
| | | NA | CGGGCGAGTCAGGGCATTAG CAATTATTAGCC SEQ ID NO:1104 | GCTGCAACCAGTTGCA AAGT SEQ ID NO:9116 | CAACAGTATTATAGTTACCC GATCACC SEQ ID NO:17128 |
| iPS:402223 | | AA | RASQGISNYLA SEQ ID NO:1105 | AATSLQS SEQ ID NO:9117 | QQYYSYPIT SEQ ID NO:17129 |
| | | NA | CGGGCGAGTCAGGGTATTAG CAGATGGTTAGCC SEQ ID NO:1106 | GCTGCATCCCGTTGCAA AGT SEQ ID NO:9118 | CAACAGGCTAACAGTTCCC ATTCACT SEQ ID NO:17130 |

FIGURE 49
(Continued)

| | | | | | | | |
|---|---|---|---|---|---|---|---|
| iPS:402225 | 21-225_30A11 | AA | SEQ ID NO:1107<br>RASQGISRWLA | SEQ ID NO:9119<br>AASRLQS | SEQ ID NO:17131<br>QQANSFPFT | | |
| iPS:402229 | 21-225_2B1 | NA | SEQ ID NO:1108<br>TCTGGAGATAAATTGGGGA<br>TAAATATGCTTGC | SEQ ID NO:9120<br>CAAGATCGCAAGCGGCC<br>CTCA | SEQ ID NO:17132<br>CAGGCGTGGGACAACAACAC<br>TGTGGTA | | |
| | | AA | SEQ ID NO:1109<br>SGDKLGDKYAC | SEQ ID NO:9121<br>QDRKRPS | SEQ ID NO:17133<br>QAWDNNTVV | | |
| iPS:402231 | 21-225_16H9 | NA | SEQ ID NO:1110<br>CGGGCAAGTCAGGGCATTAG<br>AAATTATTTAGGC | SEQ ID NO:9122<br>GGTGCATCCAGTTGCA<br>AAGT | SEQ ID NO:17134<br>CTACAGTATCATAGTTATCT<br>ATTCACT | | |
| | | AA | SEQ ID NO:1111<br>RASQGIRNYLG | SEQ ID NO:9123<br>GASSLQS | SEQ ID NO:17135<br>LQYHSYLFT | | |
| iPS:402231 | 21-225_6D9 | NA | SEQ ID NO:1112<br>TCTGGAGATAAATTGGGGGA<br>AAAATATGCTTGC | SEQ ID NO:9124<br>CAAGATAAGAAGCGGCC<br>CTCA | SEQ ID NO:17136<br>CAGGCGTGGGACAGCAGCAC<br>TGTA | | |
| | | AA | SEQ ID NO:1113<br>SGDKLGEKYAC | SEQ ID NO:9125<br>QDKKRPS | SEQ ID NO:17137<br>QAWDSSTV | | |
| iPS:402233 | 21-225_16D10 | NA | SEQ ID NO:1114<br>CGGGCGAGTCAGGACATAA<br>GTAATTATTAGCC | SEQ ID NO:9126<br>GCTACACCCAGTTGCA<br>GAGT | SEQ ID NO:17138<br>CAACAGTATAATAGTTACCC<br>GCTCACT | | |
| | | AA | SEQ ID NO:1115<br>RASQDISNYLA | SEQ ID NO:9127<br>ATPSLQS | SEQ ID NO:17139<br>QQYNSYPLT | | |
| iPS:402235 | 21-225_20F10 | NA | SEQ ID NO:1116<br>CGGGCGAGTCAGGGCATTAA<br>CAATTATTTAGCC | SEQ ID NO:9128<br>GCTGCATCCAGTTGCAA<br>AGT | SEQ ID NO:17140<br>CAGCAATATATAGTTACCC<br>ATTCACT | | |
| | | AA | SEQ ID NO:1117<br>RASQGINNYLA | SEQ ID NO:9129<br>AASSLQS | SEQ ID NO:17141<br>QQYNSYPFT | | |
| iPS:402237 | | NA | SEQ ID NO:1118<br>CGGGCGAGTCAGGGCATTGC<br>CAATTATTTAGCC | SEQ ID NO:9130<br>GCTGCATCCAGTTGCAA<br>AGT | SEQ ID NO:17142<br>CAACAGTATCATAGTTACCC<br>GCTCACT | | |

FIGURE 49
(Continued)

| | | | | | | |
|---|---|---|---|---|---|---|
| iPS:403868 | 21-225_23D11 | NA | SEQ ID NO:1119 RASQGIANYLA | SEQ ID NO:9131 AASSLQS | SEQ ID NO:17143 QQYHSYPLT | |
| | | AA | SEQ ID NO:1120 CGGGCAAGTCAGGGCATTAG AAATGATTTAGGC | SEQ ID NO:9132 GCTACATCCAGTTTGCAA AGT | SEQ ID NO:17144 CTACACAGTATTATAGTTACCC GCTCACT | |
| iPS:403870 | 21-225_19D11 | NA | SEQ ID NO:1121 RASQGIRNDLG | SEQ ID NO:9133 ATSSLQS | SEQ ID NO:17145 LQYYSYPLT | |
| | | AA | SEQ ID NO:1122 CGGGCAAGTCAGAACATTTA CAGCTATTTAAAT | SEQ ID NO:9134 GCTGCATCCAGTTTGCAA AGT | SEQ ID NO:17146 CAACAGAGTTACAATACCCC TCCGGAGTGCAAT | |
| iPS:403872 | 21-225_23G4 | NA | SEQ ID NO:1123 RASQNIYSYLN | SEQ ID NO:9135 AASSLQS | SEQ ID NO:17147 QQSYNTPPECN | |
| | | AA | SEQ ID NO:1124 CGGGCAAGTCAGGGCATTAG GAGTGATTTAGGC | SEQ ID NO:9136 GATGCATCCAGTGTGCA AAGT | SEQ ID NO:17148 CTACAACATTATACTTACCC GCTCACT | |
| iPS:404090 | 21-225_8F11 | NA | SEQ ID NO:1125 RASQGIRSDLG | SEQ ID NO:9137 DASSVQS | SEQ ID NO:17149 LQHYTYPLT | |
| | | AA | SEQ ID NO:1126 TCTGGAGATAAATTGGGGGA GAAATATGCTTGC | SEQ ID NO:9138 CAAGATAGGAAGCGGCC CTCA | SEQ ID NO:17150 CAGGGCGTGGGACAGCAGCAC TGCGGTA | |
| iPS:403088 | 21-225_8D8 | NA | SEQ ID NO:1127 SGDKLGEKYAC | SEQ ID NO:9139 QDRKRPS | SEQ ID NO:17151 QAWDSSTAV | |
| | | AA | SEQ ID NO:1128 AAGTCCAGCCAGAGTATTT ACACAGTCCAACAATAACA ACTACTTAGCT | SEQ ID NO:9140 TGGGCATCTACCCGGGA ATCC | SEQ ID NO:17152 CAGCAATATTATAATACTCC AGTCACT | |
| iPS:412232 | 21-225_4A2 | NA | SEQ ID NO:1129 KSSQSILHSSNNNNYLA | SEQ ID NO:9141 WASTRES | SEQ ID NO:17153 QQYYNTPVT | |
| | | AA | SEQ ID NO:1130 | SEQ ID NO:9142 | SEQ ID NO:17154 | |

FIGURE 49
(Continued)

| | | | | | |
|---|---|---|---|---|---|
| iPS:422894 | 21-225_4A2.001 | NA | AAGTCCAGCCAGAGTATTT ACACAGCTCCAACAATAACA ACTACTTAGCT SEQ ID NO:1131 | TGGGCATCTACCCGGGA ATCC SEQ ID NO:9143 | CAGCAATATTATAATACTCC AGTCACT SEQ ID NO:17155 |
| | | AA | KSSQSILHSSNNNYLA SEQ ID NO:1132 | WASTRES SEQ ID NO:9144 | QQYYNTPVT SEQ ID NO:17156 |
| iPS:423018 | 21-225_31D12_LC2 | NA | TCTGGAGATAAATTGGGGA TAAATATGCTTAC SEQ ID NO:1133 | CAAGATAGGAAGCGGCC CTCA SEQ ID NO:9145 | CAGGGGTGGGACAACAGCAC TGCGGTA SEQ ID NO:17157 |
| | | AA | SGDKLGDKYAY SEQ ID NO:1134 | QDRKRPS SEQ ID NO:9146 | QAWDNSTAV SEQ ID NO:17158 |
| iPS:423019 | 21-225_31D12_LC1 | NA | AGGTCTAGTCAAAGCCTCAT ATACAGTGATGGAAACACCT TCTGAAT SEQ ID NO:1135 | AAGGTTTCTAATTGGGA CTCT SEQ ID NO:9147 | ATGCAAGGTACACACTGGCC TCTCACC SEQ ID NO:17159 |
| | | AA | RSSQSLIYSDGNTFLN SEQ ID NO:1136 | KVSNWDS SEQ ID NO:9148 | MQGTHWPLT SEQ ID NO:17160 |
| iPS:423314 | 21-225_12F11 | NA | AAGTCCAGCCAGAGTGTTTT ACACAGCTCCAACAATAACA ACTACTTAGCT SEQ ID NO:1137 | TGGGCATCTACCCGGGA ATCC SEQ ID NO:9149 | CAGCAATATTATGATACTCC ATTCACT SEQ ID NO:17161 |
| | | AA | KSSQSVLHSSNNYNYLA SEQ ID NO:1138 | WASTRES SEQ ID NO:9150 | QQYYDTPFT SEQ ID NO:17162 |
| iPS:424419 | 21-225_25A4.001 | NA | AAGTCCAGCCAGAGTGTTTT ATACAGCTCCACAATAACA ACTACTTAGCT SEQ ID NO:1139 | TGGGCATCTACCCGGGA ATCC SEQ ID NO:9151 | CAGCAGTATTATAGTACTCC TCCGACG SEQ ID NO:17163 |
| | | AA | KSSQSVLYSSHNNNYLA SEQ ID NO:1140 | WASTRES SEQ ID NO:9152 | QQYYSTPPT SEQ ID NO:17164 |

FIGURE 49
(Continued)

| | | | | | | |
|---|---|---|---|---|---|---|
| iPS:424460 | 21-225_7E11.001 | NA | CGGGCAAGTCAAAACATTAT CAGCTATTAAAT | ACTGCATCCAGTTTGCAA AGT | CAACAGACTTACAGTACCCC GCTCACT |
| | | | SEQ ID NO:1141 | SEQ ID NO:9153 | SEQ ID NO:17165 |
| | | AA | RASQNIISYLN | TASSLQS | QQTYSTPLT |
| | | | SEQ ID NO:1142 | SEQ ID NO:9154 | SEQ ID NO:17166 |
| iPS:426108 | 21-225_10G6 | NA | CGGGCGAGTCAGGGTATTAG CAAATGGTTAGCC | GCTGCATATAGTTTACAA AGT | CAACAGGCTAACAGTTCCC ATTCACT |
| | | | SEQ ID NO:1143 | SEQ ID NO:9155 | SEQ ID NO:17167 |
| | | AA | RASQGISKWLA | AAYSLQS | QQANSFPFT |
| | | | SEQ ID NO:1144 | SEQ ID NO:9156 | SEQ ID NO:17168 |
| iPS:426110 | 21-225_12E9 | NA | CGGGCGAGTCAGGGTATTAG CAGCTGGTTAGCC | GCTGCATCCAGGTTGCA AAGT | CAACAGGCTAACAGTTCCC ATTCACT |
| | | | SEQ ID NO:1145 | SEQ ID NO:9157 | SEQ ID NO:17169 |
| | | AA | RASQGISSWLA | AASRLQS | QQANSFPFT |
| | | | SEQ ID NO:1146 | SEQ ID NO:9158 | SEQ ID NO:17170 |
| iPS:426112 | 21-225_12F12 | NA | AAGTCAGCCAGACTGTTT ATTCAGCTCCAACAATAACC ACTACTTAGCA | TGGGCATCTACCGGGC ATCC | CAGCAATATTATAGTAGTCC GTGGACG |
| | | | SEQ ID NO:1147 | SEQ ID NO:9159 | SEQ ID NO:17171 |
| | | AA | KSSQTVLFSSNNNHYLA | WASTRAS | QQYYSSPWT |
| | | | SEQ ID NO:1148 | SEQ ID NO:9160 | SEQ ID NO:17172 |
| iPS:426114 | 21-225_28H2 | NA | CGGGCAAGTCAGGGCATTAG AAATGATTTAGGC | GCTGCATCCAGTTTGCAA AGT | CTACAACATTATAGTTACC TCGCAGT |
| | | | SEQ ID NO:1149 | SEQ ID NO:9161 | SEQ ID NO:17173 |
| | | AA | RASQGIRNDLG | AASSLQS | LQHYSYPRS |
| | | | SEQ ID NO:1150 | SEQ ID NO:9162 | SEQ ID NO:17174 |
| iPS:426116 | 21-225_29E2 | NA | CGGGCAAGTCAGGGCATTAG AAATGATTTAGGC | GCTGCATCCAGTTTGCAA AGT | TTACAGCATTATAATTACC TCGCAGT |
| | | | SEQ ID NO:1151 | SEQ ID NO:9163 | SEQ ID NO:17175 |
| | | AA | RASQAIRNDLG | AASSLQS | LQHYNYPRS |

FIGURE 49
(Continued)

| | | | | | | | |
|---|---|---|---|---|---|---|---|
| iPS:426118 | 21-225_7A10 | NA | SEQ ID NO:1152<br>CGGGCAAGTCAGGGACATTA<br>CAGCTATTTAAAT | SEQ ID NO:9164<br>TCTACATCCAGTTTGCAA<br>AGT | SEQ ID NO:17176<br>CAACAGAGTTACAGTCCCC<br>TCTCACT |
| | | AA | SEQ ID NO:1153<br>RASQNIYSYLN | SEQ ID NO:9165<br>STSSLQS | SEQ ID NO:17177<br>QQSYSPPLT |
| iPS:426124 | 21-225_32D6 | NA | SEQ ID NO:1154<br>CGGGCAAGTCAGGGACATTA<br>CAGCTATTTAAAT | SEQ ID NO:9166<br>GTTGCATCCAGTTTGCAA<br>AGT | SEQ ID NO:17178<br>CAACAGAGTTACAGTACCC<br>GTACACT |
| | | AA | SEQ ID NO:1155<br>RASQNIISYLN | SEQ ID NO:9167<br>VASRLQS | SEQ ID NO:17179<br>QQSYSTPYT |
| iPS:426126 | 21-225_6G6 | NA | SEQ ID NO:1156<br>AAGTCCAGCCAGAGTGTTT<br>ACACAACTCCAACAATTATA<br>ACTATTTAGCT | SEQ ID NO:9168<br>TGGGCATCTACCCGGGA<br>ATCC | SEQ ID NO:17180<br>CAGCAATATTATGATACTCC<br>ATTCACT |
| | | AA | SEQ ID NO:1157<br>KSSQSVLHNSNNYNYLA | SEQ ID NO:9169<br>WASTRES | SEQ ID NO:17181<br>QQYYDTPFT |
| iPS:433895 | 21-225_43E1 | NA | SEQ ID NO:1158<br>CGGGCAAGTCAGGGCATTAG<br>AAATGATTTAGGC | SEQ ID NO:9170<br>GCTGCATCCAGTTGCAA<br>AGT | SEQ ID NO:17182<br>CTACAGCATAATAGTTACC<br>ATTCACT |
| | | AA | SEQ ID NO:1159<br>RASQGIRNDLG | SEQ ID NO:9171<br>AASSLQS | SEQ ID NO:17183<br>LQHNSYPFT |
| iPS:433897 | 21-225_43C2 | NA | SEQ ID NO:1160<br>CGGGCAAGTCAGGGTATTAG<br>CGACTGGTTAGCC | SEQ ID NO:9172<br>GCTGCATCCAGTTGCAA<br>AGT | SEQ ID NO:17184<br>CAACAGACTAACAGTTCCC<br>GTGGACG |
| | | AA | SEQ ID NO:1161<br>RASQGISDWLA | SEQ ID NO:9173<br>AASSLQS | SEQ ID NO:17185<br>QQTNSFPWT |
| iPS:433899 | 21-225_43C3 | NA | SEQ ID NO:1162<br>CGGGCAAGTCAGGGCATTAG<br>AAATGATTTAGGC | SEQ ID NO:9174<br>GCTGCATCCAGTTGCAA<br>AGT | SEQ ID NO:17186<br>CTACAGCATAATAGTTACC<br>TCTCACT |
| | | | SEQ ID NO:1163 | SEQ ID NO:9175 | SEQ ID NO:17187 |

FIGURE 49
(Continued)

| | | | | | | | |
|---|---|---|---|---|---|---|---|
| iPS:433901 | | AA | RASQGIRNDLG | | AASSLQS | | LQHNSYPLT |
| | | | SEQ ID NO:1164 | | SEQ ID NO:9176 | | SEQ ID NO:17188 |
| | 21-225_43A4 | NA | CGGGCGAGTCAGGGCATTAA CAATTATTTAGCC | | GCTGCATCCAGTTTGCAA AGT | | CAACAGTATTATAGTTTACCC ATTCACT |
| | | | SEQ ID NO:1165 | | SEQ ID NO:9177 | | SEQ ID NO:17189 |
| iPS:433903 | | AA | RASQGINNYLA | | AASSLQS | | QQYYSYPFT |
| | | | SEQ ID NO:1166 | | SEQ ID NO:9178 | | SEQ ID NO:17190 |
| | 21-225_43H4 | NA | CGGGCGAGTCAGGGTATTAT CAACTGGTTAGCC | | GCTGCATCCAGTTTGCAA AGT | | CAACAGACTAACAGTTTCCC GTGGACG |
| | | | SEQ ID NO:1167 | | SEQ ID NO:9179 | | SEQ ID NO:17191 |
| iPS:433905 | | AA | RASQGIINWLA | | AASSLQS | | QQTNSFPWT |
| | | | SEQ ID NO:1168 | | SEQ ID NO:9180 | | SEQ ID NO:17192 |
| | 21-225_43E5 | NA | CGGGCAAGTCAGGGCATTAG AAATGATTTAGGC | | GGTGCATCCAATTTGCA AAGT | | CTACAGCATACTAGTTTCCC ATTCACT |
| | | | SEQ ID NO:1169 | | SEQ ID NO:9181 | | SEQ ID NO:17193 |
| iPS:433909 | | AA | RASQGIRNDLG | | GASNLQS | | LQHTSFPFT |
| | | | SEQ ID NO:1170 | | SEQ ID NO:9182 | | SEQ ID NO:17194 |
| | 21-225_43D8 | NA | AAGTCCAGCCAGAGTGTTT AATGACCTCCAACGATAAGA ACTACTTAACT | | TGGGCTTCTACCCGGGA ATCC | | CAGCAATATTATAGTACTCC TCCGACG |
| | | | SEQ ID NO:1171 | | SEQ ID NO:9183 | | SEQ ID NO:17195 |
| iPS:433911 | | AA | KSSQSVLMTSNDKNYLT | | WASTRES | | QQYYSTPPT |
| | | | SEQ ID NO:1172 | | SEQ ID NO:9184 | | SEQ ID NO:17196 |
| | 21-225_43E8 | NA | CGGGCGAGTCAGGGTATTAG CAACTGGTTAGCC | | GCTGCATCCAGTTTGCAA AGT | | CAACAGACTAACAGTTTCCC GTGGACG |
| | | | SEQ ID NO:1173 | | SEQ ID NO:9185 | | SEQ ID NO:17197 |
| iPS:433913 | | AA | RASQGISNWLA | | AASSLQS | | QQTNSFPWT |
| | | | SEQ ID NO:1174 | | SEQ ID NO:9186 | | SEQ ID NO:17198 |
| | | NA | CGGGCAAGTCAGGGCATTAG AAATGATTTAGGC | | GCTGCATCCAGTTTGCAA AGT | | CTACAGCATAATAGTTTCCC ATTCACT |

FIGURE 49
(Continued)

| | | | | | | |
|---|---|---|---|---|---|---|
| iPS:433915 | 21-225_43H8 | AA | SEQ ID NO:1175 RASQGIRNDLG | SEQ ID NO:9187 AASSLQS | SEQ ID NO:17199 LQHNSFPFT | |
| | | NA | SEQ ID NO:1176 CGGGCGAGTCAGGAGGATATTAG CAGCTGGTTAGCC | SEQ ID NO:9188 GATGCATCCAGTTTGCA AAGT | SEQ ID NO:17200 CAACAGGCTAACAGTCTCC ATTCACT | |
| iPS:433917 | 21-225_43H9 | AA | SEQ ID NO:1177 RASQDISSWLA | SEQ ID NO:9189 DASSLQS | SEQ ID NO:17201 QQANSLPFT | |
| | | NA | SEQ ID NO:1178 AAGTCTAGTCAGAGCCTCCT GCACAGTGATGGAAGGACCT ATTTGTAT | SEQ ID NO:9190 GAAGTTCCAACCGGTTC TCT | SEQ ID NO:17202 ATGCAAAGTATACAGCTTCC GTGGACG | |
| iPS:433919 | 21-225_43E11 | AA | SEQ ID NO:1179 KSSQSLLHSDGRTYLY | SEQ ID NO:9191 EVSNRFS | SEQ ID NO:17203 MQSIQLPWT | |
| | | NA | SEQ ID NO:1180 CGGGCAAGTCAGGGCATTAG AAATGATTAGGC | SEQ ID NO:9192 GCTGCATCCAGTTTGCAA AGT | SEQ ID NO:17204 CTACTGCATTATAATTACCCT CGGACG | |
| iPS:433921 | 21-225_44B3 | AA | SEQ ID NO:1181 RASQGIRNDLG | SEQ ID NO:9193 AASSLQS | SEQ ID NO:17205 LLHYNYPRT | |
| | | NA | SEQ ID NO:1182 CGGGCAAGTCAGGGCATTAG AAATGATTAGGC | SEQ ID NO:9194 GCTGCATCCAGTTGCAA AGT | SEQ ID NO:17206 CTACAGCATAGTAGTTACC TCTCACT | |
| iPS:433923 | 21-225_44C3 | AA | SEQ ID NO:1183 RASQGIRNDLG | SEQ ID NO:9195 AASSLQS | SEQ ID NO:17207 LQHSSYPLT | |
| | | NA | SEQ ID NO:1184 CGGGCAAGTCAGGGCATTAG AGATGATTAGGC | SEQ ID NO:9196 GCTGCATCCAGTTTGCAA AGT | SEQ ID NO:17208 CTACAGCATTAGTTACC TCGGACG | |
| iPS:433923 | 21-225_44D3 | AA | SEQ ID NO:1185 RASQGIRDDLG | SEQ ID NO:9197 AASSLQS | SEQ ID NO:17209 LQHYSYPRT | |
| | | | SEQ ID NO:1186 | SEQ ID NO:9198 | SEQ ID NO:17210 | |

FIGURE 49
(Continued)

| | | | | | |
|---|---|---|---|---|---|
| iPS:433925 | 21-225_44F3 | NA | CGGGGGAGTCAGGGTATTAG CGACTGGTTAGCC SEQ ID NO:1187 | GCTGCATCCAGTTTACAA AGT SEQ ID NO:9199 | CAACAGGCTAACAGTTTCCC ATTCACT SEQ ID NO:17211 |
| | | AA | RASQGISDWLA SEQ ID NO:1188 | AASSLQS SEQ ID NO:9200 | QQANSFPFT SEQ ID NO:17212 |
| iPS:433929 | 21-225_44D5 | NA | CGGGCAAGTCAGGACATTAG AAAAGATTTAGGC SEQ ID NO:1189 | GCTGCATCCACTTTGGAA AGT SEQ ID NO:9201 | CTACAGCATTATAGTTTCCC GTGGACG SEQ ID NO:17213 |
| | | AA | RASQDIRKDLG SEQ ID NO:1190 | AASTLES SEQ ID NO:9202 | LQHYSFPWT SEQ ID NO:17214 |
| iPS:433931 | 21-225_44F6 | NA | AGGGCCAGTCAGAGTGTTAG TGGAAGTACTTAGCC SEQ ID NO:1191 | GGTGCATCCAGCAGGGC CACT SEQ ID NO:9203 | CAGCAGTATGGTAGTTCACC GTGGACG SEQ ID NO:17215 |
| | | AA | RASQSVSGSYLA SEQ ID NO:1192 | GASSRAT SEQ ID NO:9204 | QQYGSSPWT SEQ ID NO:17216 |
| iPS:433933 | 21-225_44C8 | NA | CGGGCAAGTCAGGGCATTAG AAATGATTTAGGC SEQ ID NO:1193 | GCTGCATCCAATTGCAA AGT SEQ ID NO:9205 | CTACAGCATAATAGTTACCG ATTCACT SEQ ID NO:17217 |
| | | AA | RASQGIRNDLG SEQ ID NO:1194 | AASNLQS SEQ ID NO:9206 | LQHNSYPFT SEQ ID NO:17218 |
| iPS:433935 | 21-225_44F9 | NA | CGGGCAAGTCAGGGCATTAG AAATGATTTAGGC SEQ ID NO:1195 | GCTGCATCCAGTTTGCAA AGT SEQ ID NO:9207 | CTCCACCATTATAATTACCCT CGGACG SEQ ID NO:17219 |
| | | AA | RASQGIRNDLG SEQ ID NO:1196 | AASSLQS SEQ ID NO:9208 | LHHYNYPRT SEQ ID NO:17220 |
| iPS:433937 | 21-225_44B10 | NA | AAGTCTAGTCAGAGCCTCCT GCATAGTGAGGGAAGGACC TATTTGTAT SEQ ID NO:1197 | GAAATTTCCACCGGTTC TCT SEQ ID NO:9209 | ATGCAAAGTATCCACCTTCC GTTCACT SEQ ID NO:17221 |
| | | AA | KSSQSLLHSEGRTYLY | EISHRFS | MQSIHLPFT |

FIGURE 49
(Continued)

| | | | | | | |
|---|---|---|---|---|---|---|
| iPS:433939 | | NA | SEQ ID NO:1198 CGGGCAAGTCAGGGCATTAG AGATGATTTAGGC | SEQ ID NO:9210 GCTACATCCAGTTTGCAA AGT | SEQ ID NO:17222 CTACAGCATTATAGTTACCC TCGGACG |
| | 21-225_44C10 | AA | SEQ ID NO:1199 RASQGIRDDLG | SEQ ID NO:9211 ATSSLQS | SEQ ID NO:17223 LQHYSYPRT |
| iPS:433941 | | NA | SEQ ID NO:1200 CGGGCGAGTCAGGGTATTAG CGACTGGTTAGCC | SEQ ID NO:9212 GCTGCATCCAGTTTGCAA AGT | SEQ ID NO:17224 CAACAGACTAACAGTTTCC GTGGACG |
| | 21-225_44D10 | AA | SEQ ID NO:1201 RASQGISDWLA | SEQ ID NO:9213 AASSLQS | SEQ ID NO:17225 QQTNSFPWT |
| iPS:433943 | | NA | SEQ ID NO:1202 AGGTCTAGTCAGAGCCTCCT GCATAGTAATGGATACAGCT ATTTGGAG | SEQ ID NO:9214 TTGGGTTCTAATCGGGCC TCC | SEQ ID NO:17226 ATGCAAACTCTACAAACTCC ATTCACT |
| | 21-225_44E10 | AA | SEQ ID NO:1203 RSSQSLLHSNGYSYLE | SEQ ID NO:9215 LGSNRAS | SEQ ID NO:17227 MQTLQTPFT |
| iPS:433945 | | NA | SEQ ID NO:1204 CGGGCGAGTCAGGGTATTAG CAACTGGTTAGCC | SEQ ID NO:9216 GCTGCATTCAGTTTGCAA AGT | SEQ ID NO:17228 CAACAGTCTAACAGTTTCC GTGGACG |
| | 21-225_44C12 | AA | SEQ ID NO:1205 RASQGISNWLA | SEQ ID NO:9217 AAFSLQS | SEQ ID NO:17229 QQSNSFPWT |
| iPS:433947 | | NA | SEQ ID NO:1206 CGGACAAGTCAGGGCATTAG AAATGATTTAGGC | SEQ ID NO:9218 GCTGCATCCAGTTTGCAA AGT | SEQ ID NO:17230 CTACAACATAATAGTTACCC GCTCACT |
| | 21-225_44E12 | AA | SEQ ID NO:1207 RTSQGIRNDLG | SEQ ID NO:9219 AASSLQS | SEQ ID NO:17231 LQHNSYPLT |
| iPS:433949 | | NA | SEQ ID NO:1208 CGGGCAAGTCAGGGCATTAG AAATGATTTAGGC | SEQ ID NO:9220 GGTGCATCCAATTTGCA AAGT | SEQ ID NO:17232 CTACAGCATACTAGTTTCC ATTCACT |
| | 21-225_45H2 | | SEQ ID NO:1209 | SEQ ID NO:9221 | SEQ ID NO:17233 |

FIGURE 49
(Continued)

| | | | | | | | |
|---|---|---|---|---|---|---|---|
| iPS:433951 | | AA | RASQGIRNDLG<br>SEQ ID NO:1210 | GASNLQS<br>SEQ ID NO:9222 | | LQHTSFPFT<br>SEQ ID NO:17234 | |
| | 21-225_45B4 | NA | CGGGCAAGTCAGGGCATTAG<br>AGATGATTTAGGC<br>SEQ ID NO:1211 | GCTGCATCCAGTTTGCAA<br>AGT<br>SEQ ID NO:9223 | | CTACAGGCATTATAGTTACC<br>TCGGACG<br>SEQ ID NO:17235 | |
| iPS:433953 | | AA | RASQGIRDDLG<br>SEQ ID NO:1212 | AASSLQS<br>SEQ ID NO:9224 | | LQHYSYPRT<br>SEQ ID NO:17236 | |
| | 21-225_45H4 | NA | CGGGCGAGTCAGGATATTAG<br>CAGCTGGTTAGCC<br>SEQ ID NO:1213 | GATGCATCCAGTTTGCA<br>AAGT<br>SEQ ID NO:9225 | | CAACAGGCTAACAGTCTCCC<br>TTTCACT<br>SEQ ID NO:17237 | |
| iPS:433955 | | AA | RASQDISSWLA<br>SEQ ID NO:1214 | DASSLQS<br>SEQ ID NO:9226 | | QQANSLPFT<br>SEQ ID NO:17238 | |
| | 21-225_45B8 | NA | CGGGCAAGTCAGGGACATTAG<br>AGATGATTTAGGC<br>SEQ ID NO:1215 | GCTGCATCCAGTTTGCAA<br>AGT<br>SEQ ID NO:9227 | | CTACAGGCATTATAATTACC<br>TCGGACG<br>SEQ ID NO:17239 | |
| iPS:433957 | | AA | RASQDIRDDLG<br>SEQ ID NO:1216 | AASSLQS<br>SEQ ID NO:9228 | | LQHYNYPRT<br>SEQ ID NO:17240 | |
| | 21-225_45F8 | NA | CGGGCGAGTCAGGGTATTAG<br>CGACTGGTTAGCC<br>SEQ ID NO:1217 | GGTGCATCCAGTTTGCA<br>AAGT<br>SEQ ID NO:9229 | | CAACAGACTAACAGTTTCCC<br>GTGGACG<br>SEQ ID NO:17241 | |
| iPS:433959 | | AA | RASQGISDWLA<br>SEQ ID NO:1218 | GASSLQS<br>SEQ ID NO:9230 | | QQTNSFPWT<br>SEQ ID NO:17242 | |
| | 21-225_45C9 | NA | CGGGCGAGTCAGGGCATTAG<br>CGACTGGTTAGCT<br>SEQ ID NO:1219 | GCTGCATCCAGTTTGGA<br>AAGT<br>SEQ ID NO:9231 | | CAACAGGCTAACAGTTTCCC<br>ATTCACT<br>SEQ ID NO:17243 | |
| iPS:433961 | | AA | RASQDISDWLA<br>SEQ ID NO:1220 | AASSLES<br>SEQ ID NO:9232 | | QQANSFPFT<br>SEQ ID NO:17244 | |
| | 21-225_45D9 | NA | CGGGCGAGTCAGGGCATTAA<br>CAATTATTTAGCC<br>SEQ ID NO:1221 | GCTGCATCCAGTTTGCAA<br>AGT<br>SEQ ID NO:9233 | | CAACACTATTATAGTTACC<br>ATTCACT<br>SEQ ID NO:17245 | |

FIGURE 49
(Continued)

| | | | | | | | |
|---|---|---|---|---|---|---|---|
| iPS:433963 | | AA | RASQGINNYLA | AASSLQS | QHYYSYPFT | | |
| | | | SEQ ID NO:1222 | SEQ ID NO:9234 | SEQ ID NO:17246 | | |
| | 21-225_46B1 | NA | CGGGCAAGTCAGGGCATTAG AATGATTTAGGC | GCTGCATCCAGTTGCAA GGT | CTACAGCATAATAGTTACCC GCTCACT | | |
| | | | SEQ ID NO:1223 | SEQ ID NO:9235 | SEQ ID NO:17247 | | |
| iPS:433965 | | AA | RASQGIRNDLG | AASSLQG | LQHNSYPLT | | |
| | | | SEQ ID NO:1224 | SEQ ID NO:9236 | SEQ ID NO:17248 | | |
| | 21-225_46F2 | NA | AAGTCTAGTCAGAGCCTCCT GCATGGTGATGGAAAGACATTCT ATTTGTAT | GAAGTTTCCAATCGGTTC TCT | ATGCAAAGTATACAGTTTCC GTGGACG | | |
| | | | SEQ ID NO:1225 | SEQ ID NO:9237 | SEQ ID NO:17249 | | |
| iPS:433967 | | AA | KSSQSLLHGDGKTYLY | EVSNRFS | MQSIQLPWT | | |
| | | | SEQ ID NO:1226 | SEQ ID NO:9238 | SEQ ID NO:17250 | | |
| | 21-225_46C3 | NA | CGGGCAAGTCAGGGCATTAG AGATGATTTAGGC | GCTGCATCCAGTTGCAA AGT | CTACAGCATTATAGTTACCC TCGGACG | | |
| | | | SEQ ID NO:1227 | SEQ ID NO:9239 | SEQ ID NO:17251 | | |
| iPS:433969 | | AA | RASQGIRDDLG | AASSLQS | LQHYSYPRT | | |
| | | | SEQ ID NO:1228 | SEQ ID NO:9240 | SEQ ID NO:17252 | | |
| | 21-225_46F3 | NA | CGGGCAAGTCAGGGCATTAG AAAAGATTTAGGC | GCTGCATCCAGTTGCAA AGT | CTACAGCATAATAGTTACCC TCTCACT | | |
| | | | SEQ ID NO:1229 | SEQ ID NO:9241 | SEQ ID NO:17253 | | |
| iPS:433971 | | AA | RASQGIRKDLG | AASSLQS | LQHNSYPLT | | |
| | | | SEQ ID NO:1230 | SEQ ID NO:9242 | SEQ ID NO:17254 | | |
| | 21-225_46D4 | NA | CGGGCAAGTCAGGGCATTAG AAAAGATTTAGGC | GCTGCATCCAGTTGGA AAGT | CTACAGCATTATAGTTTCCC GTGGACG | | |
| | | | SEQ ID NO:1231 | SEQ ID NO:9243 | SEQ ID NO:17255 | | |
| iPS:433973 | | AA | RTSQDIRKDLG | AASSLES | LQHYSFPWT | | |
| | | | SEQ ID NO:1232 | SEQ ID NO:9244 | SEQ ID NO:17256 | | |
| | | NA | CGGGCGAGTCAGGGTATTAG CAACTGGTTAGCC | GCTGCATCCAGTTGCAA AGT | CAACAGACTAACAGTTCC GTGGACG | | |

FIGURE 49 (Continued)

| | | | | | | |
|---|---|---|---|---|---|---|
| iPS:433975 | 21-225_46A6 | AA | SEQ ID NO:1233<br>RASQGISNWLA<br>SEQ ID NO:1234 | SEQ ID NO:9245<br>AASSLQS<br>SEQ ID NO:9246 | SEQ ID NO:17257<br>QQTNSFPWT<br>SEQ ID NO:17258 | |
| | | NA | CGGGCAAGTCAGGGCATTAG<br>AAATGATTTAGGC | GCTGCATCCAGTTTGCAA<br>AGT | CTACAGCATAATAGTTACCC<br>TCTCACT | |
| iPS:433977 | 21-225_46C6 | AA | SEQ ID NO:1235<br>RASQGIRNDLG<br>SEQ ID NO:1236 | SEQ ID NO:9247<br>AASSLQS<br>SEQ ID NO:9248 | SEQ ID NO:17259<br>LQHNSYPLT<br>SEQ ID NO:17260 | |
| | | NA | CGGGCAAGTCAGGGCATTAG<br>AAAGATTTAGGC | GCTGCATCCAGTTTGCAA<br>AGT | CTACAGCATAATAGTTACCC<br>TCTCACT | |
| iPS:433979 | 21-225_46D8 | AA | SEQ ID NO:1237<br>RASQGIRKDLG<br>SEQ ID NO:1238 | SEQ ID NO:9249<br>AASSLQS<br>SEQ ID NO:9250 | SEQ ID NO:17261<br>LQHNSYPLT<br>SEQ ID NO:17262 | |
| | | NA | AAGTCTAGTCAGAGCCTCCT<br>GCATAGTGAGGGAAAGACC<br>TATTTGTAT | GAAGTTTCTTACCGGTTC<br>TCT | ATGCACAGTATACAGTATCC<br>GCTCACG | |
| iPS:433981 | 21-225_46B9 | AA | SEQ ID NO:1239<br>KSSQSLLHSEGKTYLY<br>SEQ ID NO:1240 | SEQ ID NO:9251<br>EVSYRFS<br>SEQ ID NO:9252 | SEQ ID NO:17263<br>MHSIQYPLT<br>SEQ ID NO:17264 | |
| | | NA | CGGGCAAGTCAGGGCATTAG<br>AAATGATTTAGGC | GCTGCATCCAGTTTGCAA<br>AGT | CTTCAGCATACTAGTTTCCC<br>ATTCACT | |
| iPS:433983 | 21-225_46E9 | AA | SEQ ID NO:1241<br>RASQGIRNDLG<br>SEQ ID NO:1242 | SEQ ID NO:9253<br>AASSLQS<br>SEQ ID NO:9254 | SEQ ID NO:17265<br>LQHTSFPFT<br>SEQ ID NO:17266 | |
| | | NA | CGGGCAAGTCAGGACATTAG<br>AAATGATTTAGGC | GCTGCATTCAGTTTGCAA<br>AGT | CTGCAACATAATAGTTACCC<br>GCTCACG | |
| | 21-225_47A1 | AA | SEQ ID NO:1243<br>RASQDIRNDLG<br>SEQ ID NO:1244 | SEQ ID NO:9255<br>AAFSLQS<br>SEQ ID NO:9256 | SEQ ID NO:17267<br>LQHNSYPLT<br>SEQ ID NO:17268 | |

FIGURE 49
(Continued)

| | | | | | |
|---|---|---|---|---|---|
| iPS:433985 | 21-225_47C1 | NA | ACGTCTAGTGTCAGAGAGCCTCCT GCATAGTGAAGGAAAAGACC TATTTGTAT SEQ ID NO:1245 | GAAGTTTCCAACCGGTTC TCT SEQ ID NO:9257 | ATGCAAAGTATACAGCTTCC GTGGACG SEQ ID NO:17269 |
| | | AA | TSSQSLLHSEGKTYLY SEQ ID NO:1246 | EVSNRFS SEQ ID NO:9258 | MQSIQLPWT SEQ ID NO:17270 |
| iPS:433987 | 21-225_47A5 | NA | CGGGCAAGTCAGGGCATTAG AAATGATTTAGGC SEQ ID NO:1247 | GCTGCATCCAGTTTGCAA AGT SEQ ID NO:9259 | CTACAGCATAATAGTTACC GCTCACT SEQ ID NO:17271 |
| | | AA | RASQGIRNDLG SEQ ID NO:1248 | AASSLQS SEQ ID NO:9260 | LQHNSYPLT SEQ ID NO:17272 |
| iPS:433989 | 21-225_47C7 | NA | AGGTCTAGTCAGAGCCTCCT GCATAGTAATGGATACAACT ATTGGAA SEQ ID NO:1249 | TTGGGTTTTAATCGGGCC TCC SEQ ID NO:9261 | ATGCAAGTTCTACAAACTCC ATTCACT SEQ ID NO:17273 |
| | | AA | RSSQSLLHSNGYNYLE SEQ ID NO:1250 | LGFNRAS SEQ ID NO:9262 | MQVLQTPFT SEQ ID NO:17274 |
| iPS:433991 | 21-225_47E7 | NA | AAGTCTAGTCAGAGCCTCCT GCATAGTGATGGAAGGACCT ATTTGTAT SEQ ID NO:1251 | GAAGTTTCCAGCCGGTTC TCT SEQ ID NO:9263 | ATGCAAAGTACACAACTTCC GTGGACG SEQ ID NO:17275 |
| | | AA | KSSQSLLHSDGRTYLY SEQ ID NO:1252 | EVSSRFS SEQ ID NO:9264 | MQSTQLPWT SEQ ID NO:17276 |
| iPS:433993 | 21-225_47G7 | NA | CGGGCGAGTCAGGGTATTAG CAACTGGTTAGCC SEQ ID NO:1253 | GCTGCCTCCAATTTGCAA AGT SEQ ID NO:9265 | CAACAGGTTAACAGTTTCCC GTGGACG SEQ ID NO:17277 |
| | | AA | RASQGISNWLA SEQ ID NO:1254 | AASNLQS SEQ ID NO:9266 | QQVNSFPWT SEQ ID NO:17278 |
| iPS:433995 | | NA | CGGACAAGTCAGGGCATTAG AAATGATTTAGGC | GCTGCATCCAGTTTGCAA AGT | CTACAACAATACTAGTTTCCC ATTCACT |

FIGURE 49
(Continued)

| | | | | | | |
|---|---|---|---|---|---|---|
| iPS:433997 | 21-225_47H7 | | | AA | SEQ ID NO:1255 RTSQGIRNDLG | SEQ ID NO:9267 AASSLQS | SEQ ID NO:17279 LQHTSPFT |
| iPS:433999 | 21-225_48C1 | NA | SEQ ID NO:1256 CGGACAAGTCAGGGCATTAG AAATGATTTAGGC | SEQ ID NO:9268 AGAGCATCCAGTTGCA AAGT | SEQ ID NO:17280 CTACAGCATAATTTTACCC GTGGACG |
| | | AA | SEQ ID NO:1257 RTSQGIRNDLG | SEQ ID NO:9269 RASSLQS | SEQ ID NO:17281 LQHNFYPWT |
| iPS:433999 | 21-225_48D1 | NA | SEQ ID NO:1258 CGGGCAAGTCAGAGCATTAG CAGCTATTTAATT | SEQ ID NO:9270 GCTGCATCCAGTTGCAA AGT | SEQ ID NO:17282 CAACAGAGTAACAGTATTCC ATTCACT |
| | | AA | SEQ ID NO:1259 RASQSISSYLI | SEQ ID NO:9271 AASSLQS | SEQ ID NO:17283 QQSNSIPFT |
| iPS:434001 | 21-225_48F2 | NA | SEQ ID NO:1260 CGGGCAAGTCGGGGCATTAG AGATGATTTAGGC | SEQ ID NO:9272 GCTGCATCCAGTTGCAA AGT | SEQ ID NO:17284 CTACAGCAATATAGTTATCC TCGGACG |
| | | AA | SEQ ID NO:1261 RASRGIRDDLG | SEQ ID NO:9273 AASSLQS | SEQ ID NO:17285 LQQYSYPRT |
| iPS:434003 | 21-225_48C3 | NA | SEQ ID NO:1262 CGGGCAAGTCAGAGCATTAT CAGCTATTTAATT | SEQ ID NO:9274 GCTGCATCCAGTTGCAA AGT | SEQ ID NO:17286 CAACAGACTAACAGTATTCC ATTCACT |
| | | AA | SEQ ID NO:1263 RASQSISYLI | SEQ ID NO:9275 AASSLQS | SEQ ID NO:17287 QQTNSIPFT |
| iPS:434007 | 21-225_48D7 | NA | SEQ ID NO:1264 CGGGCGAGTCAAAATATTAC CAGCTGTTAGCC | SEQ ID NO:9276 AGTGCATCCAGTTGCA AAAT | SEQ ID NO:17288 CAACAGGTAACAGTTTCCC GTGGACG |
| | | AA | SEQ ID NO:1265 RASQNITSWLA | SEQ ID NO:9277 SASSLQN | SEQ ID NO:17289 QQANSFPWT |
| iPS:434009 | | NA | SEQ ID NO:1266 CGGGCAAGTCAGGGCATTAG AAATGATTTAGGC | SEQ ID NO:9278 ATTGCATCCAGTTGCAA AGT | SEQ ID NO:17290 CTACAGCATAATCGTTACCC GTGGACG |

FIGURE 49
(Continued)

| | | | | | | |
|---|---|---|---|---|---|---|
| iPS:434011 | 21-225_48A9 | AA | SEQ ID NO:1267 RASQGIRNDLG | SEQ ID NO:9279 IASSLQS | SEQ ID NO:17291 LQHNRYPWT | |
| iPS:434013 | 21-225_48B10 | NA | SEQ ID NO:1268 CGGGCAAGTCAGAGCATTAG GAAGTATTTAAAT | SEQ ID NO:9280 GCTGCTTCCAGTTGCAA AGT | SEQ ID NO:17292 CAACAGACTTACAGTAACCC ACTCACT | |
| | | AA | SEQ ID NO:1269 RASQSIRKYLN | SEQ ID NO:9281 AASSLQS | SEQ ID NO:17293 QQTYSNPLT | |
| iPS:434015 | 21-225_48D12 | NA | SEQ ID NO:1270 CGGGCAAGTCAGAGCATTAG AAATGATTTAGGC | SEQ ID NO:9282 GCTGCATCCACTTGCAA AGT | SEQ ID NO:17294 CTACAGCATAATAGTTACCC GCTCACT | |
| | | AA | SEQ ID NO:1271 RASQGIRNDLG | SEQ ID NO:9283 AASTLQS | SEQ ID NO:17295 LQHNSYPLT | |
| iPS:434017 | 21-225_48F12 | NA | SEQ ID NO:1272 CGGGCAAGTCAGAGCATTAG GAAGTATTTAAAT | SEQ ID NO:9284 GCTGCTTCCAGTTTGCAA AGT | SEQ ID NO:17296 CAACAGACTTACAGTAACCC GCTCACT | |
| | | AA | SEQ ID NO:1273 RASQSIRKYLN | SEQ ID NO:9285 AASSLQS | SEQ ID NO:17297 QQTYSNPLT | |
| iPS:434019 | 21-225_48G12 | NA | SEQ ID NO:1274 CGGGCAAGTCAGAGCATTAG GAAGTATTTAAAT | SEQ ID NO:9286 GCTGCTTCCAGTTTGCAA AGT | SEQ ID NO:17298 CAACAGACTTACAGTAACCC GCTCACT | |
| | | AA | SEQ ID NO:1275 RASQSIRKYLN | SEQ ID NO:9287 AASSLQS | SEQ ID NO:17299 QQTYSNPLT | |
| iPS:434019 | 21-225_49A1 | NA | SEQ ID NO:1276 CGGGCAAGTCAGGGCATTAG AAATGATTAGAC | SEQ ID NO:9288 GCTGCATCCAGTTGCAA AGT | SEQ ID NO:17300 CTACAGCATAATAGTTACCC GCTCACT | |
| | | AA | SEQ ID NO:1277 RASQGIRNDLD | SEQ ID NO:9289 AASSLQS | SEQ ID NO:17301 LQHNSYPLT | |
| | | | SEQ ID NO:1278 | SEQ ID NO:9290 | SEQ ID NO:17302 | |

FIGURE 49 (Continued)

| | | | | | |
|---|---|---|---|---|---|
| iPS:434021 | 21-225_49C1 | NA | AAGTCTAGTCAGAGCCTCCT GCATAGGGAAGGAAAGACC TATTTGTAC SEQ ID NO:1279 | GAAGTTTCCACCGGTTC TCT SEQ ID NO:9291 | ATGCAAAGTATACAGATTCC GATCACC SEQ ID NO:17303 |
| | | AA | KSSQSLLHREGKTYLY SEQ ID NO:1280 | EVSHRFS SEQ ID NO:9292 | MQSIQIPIT SEQ ID NO:17304 |
| iPS:434023 | 21-225_49F1 | NA | CGGGCGAGTCGGGATATTAA CGGCTGGTTAGCC SEQ ID NO:1281 | ACTGTCTCCAGTTTGCAA AGT SEQ ID NO:9293 | CAACAGTCTAACAGTTTCCC ATTCACT SEQ ID NO:17305 |
| | | AA | RASRDINGWLA SEQ ID NO:1282 | TVSSLQS SEQ ID NO:9294 | QQSNSFPFT SEQ ID NO:17306 |
| iPS:434025 | 21-225_49G3 | NA | AAGTCTAGTCAGAGCCTCCT GCATAGTGAAGGAAAGACC TATTTGTAT SEQ ID NO:1283 | GAAGTTTCCAACCGGCT CTCT SEQ ID NO:9295 | ATGCAAAGTATGCAGCTTCC GATCACC SEQ ID NO:17307 |
| | | AA | KSSQSLLHSEGKTYLY SEQ ID NO:1284 | EVSNRLS SEQ ID NO:9296 | MQSMQLPIT SEQ ID NO:17308 |
| iPS:434027 | 21-225_49H5 | NA | CGGGCGAGTCAGGGTTTAG CACCTGGTTAGCC SEQ ID NO:1285 | GCTGCATCCAGTTTGCAA GAT SEQ ID NO:9297 | CAACAGACTAACAGTTTCCC GTTCACT SEQ ID NO:17309 |
| | | AA | RASQGFSTWLA SEQ ID NO:1286 | AASSLQD SEQ ID NO:9298 | QQTNSFPFT SEQ ID NO:17310 |
| iPS:434029 | 21-225_49G6 | NA | CGGGCAAGTCAGGGCATTAG AAATGATTAGGC SEQ ID NO:1287 | GCTGCATCCAGTTTGCAA AGT SEQ ID NO:9299 | CTACAGCATAATAGTTACCC TCTCACT SEQ ID NO:17311 |
| | | AA | RASQGIRNDLG SEQ ID NO:1288 | AASSLQS SEQ ID NO:9300 | LQHNSYPLT SEQ ID NO:17312 |
| iPS:434031 | 21-225_49E7 | NA | AAGTCTAGTCAGATCTTCTT GCATAGTGAAGGAAAGACC TATTTGTAT | GAAGTTTCCAAGCGGCT CTCT | ATGCAAAGTATGCAGCTTCC GATTATC |

FIGURE 49
(Continued)

| | | | | | | |
|---|---|---|---|---|---|---|
| iPS:434033 | 21-225_49E7 | AA | SEQ ID NO:1289<br>KSSQIFLHSEGKTYLY | SEQ ID NO:1289<br>AAGTCTAATCAGAGCCTGT<br>GCATAATGAAGGAAAGACC<br>TATTTGTAT | SEQ ID NO:9301<br>EVSKRLS | SEQ ID NO:9301<br>GAAGTTTCCAAACCGGTTC<br>TCT | SEQ ID NO:17313<br>MQSMQLPH | SEQ ID NO:17313<br>ATGCAAAGTATACAGTATCC<br>GATCACC |
| iPS:434035 | 21-225_49F9 | AA | SEQ ID NO:1291<br>KSNQSLVHNEGKTYLY | SEQ ID NO:1292 | SEQ ID NO:9303<br>EVSNRFS | SEQ ID NO:9304 | SEQ ID NO:17315<br>MQSIQYPIT | SEQ ID NO:17316 |
| iPS:434037 | 21-225_49F10 | NA | SEQ ID NO:1293<br>RASQGISRWLA | SEQ ID NO:1293<br>CGGGCGAGTCAGGGTATTAG<br>CAGGTGGTTAGCC | SEQ ID NO:9305<br>AASTLQS | SEQ ID NO:9305<br>GCTGCATCCACTTTGCAA<br>AGT | SEQ ID NO:17317<br>QQANSFPFT | SEQ ID NO:17317<br>CAACAGGCTAACAGTTTCCC<br>ATTCACT |
| iPS:434037 | 21-225_49G12 | NA | SEQ ID NO:1295<br>RSSQSISTYLM | SEQ ID NO:1295<br>CGGTCAAGTCAGAGCATTAG<br>TACCTATTTAATG | SEQ ID NO:9307<br>AASSLQI | SEQ ID NO:9307<br>GCTGCATCCAGTTTGCAA<br>ATT | SEQ ID NO:17319<br>QQSYSIPFT | SEQ ID NO:17319<br>CAACAGAGTTACAGTATCC<br>ATTCACT |
| iPS:434039 | 21-225_43B1 | NA | SEQ ID NO:1297<br>RASQGIRNDLG | SEQ ID NO:1297<br>CGGGCAAGTCAGGGCATTAG<br>AAATGATTTAGGC | SEQ ID NO:9309<br>AASSLQS | SEQ ID NO:9309<br>GCTGCATCCAGTTTGCAA<br>AGT | SEQ ID NO:17321<br>LQHTSFPFT | SEQ ID NO:17321<br>CTACAGCATACTAGTTTCCC<br>ATTCACT |
| iPS:434041 | 21-225_50H8 | NA | SEQ ID NO:1299<br>RASQSISSYLI | SEQ ID NO:1299<br>CGGGCAAGTCAGAGCATTAG<br>CAGCTATTTAATT | SEQ ID NO:9311<br>AASSLQS | SEQ ID NO:9311<br>GCTGCATCCAGTCTGCA<br>AAGT | SEQ ID NO:17323<br>QQSNSLPFT | SEQ ID NO:17323<br>CAACAGAGTAACAGTCTTCC<br>ATTCACT |

FIGURE 49
(Continued)

| | | | | | |
|---|---|---|---|---|---|
| iPS:434043 | 21-225_50G10 | NA | CGGGCAAGTCAGGGCATTAG AAATAATTAGGC SEQ ID NO:1301 | GCTGCATCCAGTTTGCAA AGT SEQ ID NO:9313 | CTACAGTATAATAGTTACCC GTTCACT SEQ ID NO:17325 |
| | | AA | RASQGIRNNLG SEQ ID NO:1302 | AASSLQS SEQ ID NO:9314 | LQYNSYPFT SEQ ID NO:17326 |
| iPS:434045 | 21-225_50H10 | NA | CGGGCAAGTCAGAGCATTA CAGCTATTTAATT SEQ ID NO:1303 | GCTGCATCCAGTTTGCAA AGT SEQ ID NO:9315 | CAACAGAGTAACAGTATTCC ATTCACT SEQ ID NO:17327 |
| | | AA | RASQSIYSYLI SEQ ID NO:1304 | AASSLQS SEQ ID NO:9316 | QQSNSIPFT SEQ ID NO:17328 |
| iPS:434047 | 21-225_50A12 | NA | CGGGCAAGTCAGGGCATTAG AAATGATTAGGC SEQ ID NO:1305 | ACTGCATCCAATTTACAA AGT SEQ ID NO:9317 | CTACAGCATAATAGTTACCC GTGGACG SEQ ID NO:17329 |
| | | AA | RASQGIRNDLG SEQ ID NO:1306 | TASNLQS SEQ ID NO:9318 | LQHNSYPWT SEQ ID NO:17330 |
| iPS:434049 | 21-225_50B12 | NA | CGGGCAAGTCAGGGCATTAG TAGTTATTTAAAT SEQ ID NO:1307 | GCTGCATCCAGTTTGCAA AGT SEQ ID NO:9319 | CAACAGAGTTACATTGCCCC ATTCACT SEQ ID NO:17331 |
| | | AA | RASQSISSYLN SEQ ID NO:1308 | AASSLQS SEQ ID NO:9320 | QQSYIAPFT SEQ ID NO:17332 |
| iPS:434053 | 21-225_51E1 | NA | AAGTCTAGTCAGAGCCTCCT GCATAGTGAGGGAAAGACC TATTTGTAT SEQ ID NO:1309 | GAAGTTCCAACCGGTTC TCT SEQ ID NO:9321 | ATGCAAGTATACAGCTTCC ATTCACT SEQ ID NO:17333 |
| | | AA | KSSQSLLHSEGKTYLY SEQ ID NO:1310 | EVSNRFS SEQ ID NO:9322 | MQSIQLPFT SEQ ID NO:17334 |
| iPS:434055 | 21-225_51B4 | NA | CAGGCGAGTCGGACATTAC CTTCTATTTAAAT SEQ ID NO:1311 | GATGCATCCAATTTGGA AACA SEQ ID NO:9323 | CAACAGTATGATAATCTTCC ATTCACT SEQ ID NO:17335 |
| | | AA | QASRDITFYLN | DASNLET | QQYDNLPFT |

FIGURE 49
(Continued)

| | | | | | | |
|---|---|---|---|---|---|---|
| iPS:434057 | 21-225_51E4 | NA | SEQ ID NO:1312<br>CGGGCAAGTCAGGGCATTAG<br>AAATGATTTAGGC | SEQ ID NO:9324<br>GCTGCATCCAGTTTGCAA<br>AGT | SEQ ID NO:17336<br>CTACAGCATAATAGTTACCC<br>ATTCACT |
| | | AA | SEQ ID NO:1313<br>RASQGIRNDLG | SEQ ID NO:9325<br>AASSLQS | SEQ ID NO:17337<br>LQHNSYPFT |
| iPS:434059 | 21-225_51C5 | NA | SEQ ID NO:1314<br>CGGGCGAGTCAGGGCATTAG<br>CAATTATTTAGCC | SEQ ID NO:9326<br>GCTGCATCCAGTTTGCGA<br>AGT | SEQ ID NO:17338<br>CAACAGTATTATAGTTACCC<br>ATTCACT |
| | | AA | SEQ ID NO:1315<br>RASQGISNYLA | SEQ ID NO:9327<br>AASSLRS | SEQ ID NO:17339<br>QQYYSYPFT |
| iPS:434061 | 21-225_51C7 | NA | SEQ ID NO:1316<br>CGGGCGAGTCAGGATGTTAA<br>CAACTACTTAGCC | SEQ ID NO:9328<br>GCTGCATCCAGTTTGCAA<br>AAT | SEQ ID NO:17340<br>CAACAAACTAACAGTTTCCC<br>ATTCACT |
| | | AA | SEQ ID NO:1317<br>RASQDVNNYLA | SEQ ID NO:9329<br>AASSLQN | SEQ ID NO:17341<br>QQTNSFPFT |
| iPS:434063 | 21-225_51G7 | NA | SEQ ID NO:1318<br>CGGGCGAGTCAGGATATTAG<br>CAGTTGGTTAGCC | SEQ ID NO:9330<br>GCTCCATCCAATTTGCAA<br>AGT | SEQ ID NO:17342<br>CAACAGGCTCACAGTTTCCC<br>GTGGACG |
| | | AA | SEQ ID NO:1319<br>RASQDISSWLA | SEQ ID NO:9331<br>APSNLQS | SEQ ID NO:17343<br>QQAHSFPWT |
| iPS:434065 | 21-225_50D4 | NA | SEQ ID NO:1320<br>CGGGCGAGTCAGGGTATTAG<br>CAGTGGTTAGCC | SEQ ID NO:9332<br>GCTGCATCCACTTTGCAA<br>AGT | SEQ ID NO:17344<br>CAACAGGCTAACAGTTTCCC<br>ATTCACT |
| | | AA | SEQ ID NO:1321<br>RASQGISRWLA | SEQ ID NO:9333<br>AASTLQS | SEQ ID NO:17345<br>QQANSFPFT |
| iPS:434067 | 21-225_51H8 | NA | SEQ ID NO:1322<br>CGGGCAAGTCAGGGCATTAG<br>AAATGATTTGGGC | SEQ ID NO:9334<br>GCTGCTTCCAGTTTGCAA<br>AGT | SEQ ID NO:17346<br>CTACAGCATAATAGTTACCC<br>GTGGACG |
| | | AA | SEQ ID NO:1323<br>RASQGIRNDLG | SEQ ID NO:9335<br>AASSLQS | SEQ ID NO:17347<br>LQHNSYPWT |

FIGURE 49
(Continued)

| | | | | | | | |
|---|---|---|---|---|---|---|---|
| iPS:434069 | 21-225_51E9 | NA | SEQ ID NO:1324 | CGGGCGAGTCAGGGTATTAG CAGTTGGTTAGCC | SEQ ID NO:9336 | GTTGCATCCAGTTTGCAA AGT | SEQ ID NO:17348 | CAACAGGCTAAAAGTTTCCC ATTCACT |
| | | AA | SEQ ID NO:1325 | RASQGISSWLA | SEQ ID NO:9337 | VASSLQS | SEQ ID NO:17349 | QQAKSFPFT |
| iPS:434071 | 21-225_51F9 | NA | SEQ ID NO:1326 | CGGGCAAGTCAGGGCATTAG GACTGATTTAGGC | SEQ ID NO:9338 | GCTGCATCCAGTTTGCAA CGT | SEQ ID NO:17350 | CTACAGCAGTATAATAGTTACCC ATTCACT |
| | | AA | SEQ ID NO:1327 | RASQGIRTDLG | SEQ ID NO:9339 | AASSLQR | SEQ ID NO:17351 | LQHNSYPFT |
| iPS:434073 | 21-225_51H10 | NA | SEQ ID NO:1328 | CGGGCAAGTCAGAGAGCATTAG TACCTATTTAATG | SEQ ID NO:9340 | GCTGCATCCAGTTTGCAA AGT | SEQ ID NO:17352 | CAACAGAGTTACAGTATCC ATTCACT |
| | | AA | SEQ ID NO:1329 | RASQSISTYLM | SEQ ID NO:9341 | AASSLQS | SEQ ID NO:17353 | QQSYSIPFT |
| iPS:434075 | 21-225_51B11 | NA | SEQ ID NO:1330 | CGGACAAGTCAGGGCATTAG AAATGATTTAGGC | SEQ ID NO:9342 | GCTGCATCCAGTTTGCAA AGT | SEQ ID NO:17354 | CTACAGCAGTATAATAGTTACCC ATTCACT |
| | | AA | SEQ ID NO:1331 | RTSQGIRNDLG | SEQ ID NO:9343 | AASSLQS | SEQ ID NO:17355 | LQHNSYPFT |
| iPS:434077 | 21-225_51F11 | NA | SEQ ID NO:1332 | CGGGCAAGTCAGGGCATTAG AAATGATTTAGGC | SEQ ID NO:9344 | GCTGCATCCAGTTTGCAA AGT | SEQ ID NO:17356 | CTACAGCATAATAGTTACCC GTTCACT |
| | | AA | SEQ ID NO:1333 | RASQGIRNDLG | SEQ ID NO:9345 | AASSLQS | SEQ ID NO:17357 | LQHNSYPFT |
| iPS:434079 | 21-225_52B1 | NA | SEQ ID NO:1334 | CGGGCGAGTCAGGATATTCG CACCTGGTTAGCC | SEQ ID NO:9346 | GCTGCATCCAGTTTGCAA AAT | SEQ ID NO:17358 | CAACAGGCTAAAAGTTTCCC ATTCACT |
| | | AA | SEQ ID NO:1335 | RASQDIRTWLA | SEQ ID NO:9347 | AASSLQN | SEQ ID NO:17359 | QQAKSFPFT |

FIGURE 49
(Continued)

| | | | | | |
|---|---|---|---|---|---|
| iPS:434081 | 21-225_52B2 | NA | SEQ ID NO:1336 CGGGCAAGTCAGGGCATTAG AAATGATTTAGGC | SEQ ID NO:9348 GCTGCATCCTTTTGCAA AGT | SEQ ID NO:17360 CTGCAGCATAATAGCTACCC TCTCACT |
| | | AA | SEQ ID NO:1337 RASQGIRNDLG | SEQ ID NO:9349 AASFLQS | SEQ ID NO:17361 LQHNSYPLT |
| iPS:434083 | 21-225_52H2 | NA | SEQ ID NO:1338 CGGGCGAGTCAGAATATTAC CAACTGGTTAGCC | SEQ ID NO:9350 ACTACATCCAGTTTGCAA AGT | SEQ ID NO:17362 CAACAGACTAACAGTTTCCC GTGGACG |
| | | AA | SEQ ID NO:1339 RASQNITNWLA | SEQ ID NO:9351 TTSSLQS | SEQ ID NO:17363 QQTNSFPWT |
| iPS:434085 | 21-225_52E3 | NA | SEQ ID NO:1340 CGGGCGAGTCAGGGCATTAG CAATTATTTAGCC | SEQ ID NO:9352 GCTGCATCCAGTTTACAA AGT | SEQ ID NO:17364 CAACAGTATAATAGTTTCCC TTTCACT |
| | | AA | SEQ ID NO:1341 RASQGISNYLA | SEQ ID NO:9353 AASSLQS | SEQ ID NO:17365 QQYNSFPFT |
| iPS:434087 | 21-225_52F6 | NA | SEQ ID NO:1342 CAGGGCGAGTCAGGACATTAG TAACTATTTACAT | SEQ ID NO:9354 GATGCATCCACTTTGGG AACA | SEQ ID NO:17366 CAACAGTGTGATAATCTCCC GCTCACT |
| | | AA | SEQ ID NO:1343 QASQDISNYLH | SEQ ID NO:9355 DASTLGT | SEQ ID NO:17367 QQCDNLPLT |
| iPS:434091 | 21-225_52B9 | NA | SEQ ID NO:1344 CGGGCAAGTCAGGGCATTAG AAATGATTTAGGC | SEQ ID NO:9356 GCTGCATCCAGTTTGCAA AGT | SEQ ID NO:17368 CTACAGCATAATAGTTACCC ATTCACT |
| | | AA | SEQ ID NO:1345 RASQGIRNDLG | SEQ ID NO:9357 AASSLQS | SEQ ID NO:17369 LQHNSYPFT |
| iPS:434093 | 21-225_52D10 | NA | SEQ ID NO:1346 AAGTCTAGTCAGAGCCTCCT GCATAGTGAAGGAAAGACC TATTTGTAT | SEQ ID NO:9358 GAAGTTTCCAACCGGGT CTCT | SEQ ID NO:17370 ATGCAAGTATACAGTATCC GATCACC |
| | | | SEQ ID NO:1347 | SEQ ID NO:9359 | SEQ ID NO:17371 |

FIGURE 49
(Continued)

| | | | KSSQSLLHSEGKTYLY | EVS:NRVS | MQSIQYPIT |
|---|---|---|---|---|---|
| | | AA | SEQ ID NO:1348 | SEQ ID NO:9360 | SEQ ID NO:17372 |
| iPS:434095 | 21-225_52F10 | NA | CGGGCGAGTCAGGGTATTAG TAATTATTAGGC<br>SEQ ID NO:1349 | GCTGCATCTAGTTTGCAA AGT<br>SEQ ID NO:9361 | CAACAGTATAATAGTTATCC TCCGACG<br>SEQ ID NO:17373 |
| | | AA | RASQGISNYLG<br>SEQ ID NO:1350 | AASSLQS<br>SEQ ID NO:9362 | QQYNSYPPT<br>SEQ ID NO:17374 |
| iPS:434097 | 21-225_52H10 | NA | CGGGCGAGTCAGGATATTAA CAGTTGGTTAGCC<br>SEQ ID NO:1351 | GTTGCATCCAGTTTGCA AGT<br>SEQ ID NO:9363 | CAACAGGCTAAAAGTTCCC ATTCACT<br>SEQ ID NO:17375 |
| | | AA | RASQDINSWLA<br>SEQ ID NO:1352 | VASSLQS<br>SEQ ID NO:9364 | QQAKSFPFT<br>SEQ ID NO:17376 |
| iPS:434101 | 21-225_52H12 | NA | CGGGCAAGTCAGGGCATAA GAAATAATTAGGC<br>SEQ ID NO:1353 | GGTGCATCCAGTTTGCA AAGT<br>SEQ ID NO:9365 | CTACAGTATAATAGTTACCC ATTCACT<br>SEQ ID NO:17377 |
| | | AA | RASQGIRNNLG<br>SEQ ID NO:1354 | GASSLQS<br>SEQ ID NO:9366 | LQYNSYPFT<br>SEQ ID NO:17378 |
| iPS:434103 | 21-225_53G1 | NA | CGGGCAAGTCAGGGCATTAG AAATGATTAGGC<br>SEQ ID NO:1355 | CCTGCATCCAGTTTACA AGT<br>SEQ ID NO:9367 | CTACAGGATAATAGTTACA ATTCACT<br>SEQ ID NO:17379 |
| | | AA | RASQGIRNDLG<br>SEQ ID NO:1356 | PASSLQS<br>SEQ ID NO:9368 | LQDNSYPFT<br>SEQ ID NO:17380 |
| iPS:434105 | 21-225_53D2 | NA | CGGGCAAGTCAGGGCATTAG AAATGATTAGGC<br>SEQ ID NO:1357 | GCTGCATCCAGTTTGCAA AGT<br>SEQ ID NO:9369 | CTACAACATAATAGATACCC GCTCACT<br>SEQ ID NO:17381 |
| | | AA | RASQGIRNDLG<br>SEQ ID NO:1358 | AASSLQS<br>SEQ ID NO:9370 | LQHNRYPLT<br>SEQ ID NO:17382 |
| iPS:434107 | 21-225_53E2 | NA | CGGGCAAGTCAGAGTTTTAG CCACTATTTAAAT<br>SEQ ID NO:1359 | GCTGTATCCAGTTTGCAA AGT<br>SEQ ID NO:9371 | CAACAGAGTTCAGTACCCC ATTCACT<br>SEQ ID NO:17383 |

FIGURE 49
(Continued)

| | | | | | |
|---|---|---|---|---|---|
| iPS:434111 | 21-225_53H2 | AA | RASQSFSHYLN SEQ ID NO:1360 | AVSSLQS SEQ ID NO:9372 | QQSFSTPFT SEQ ID NO:17384 |
| | | NA | CAGGCGAGTCAGGACATTAG CAACTATTTACAT SEQ ID NO:1361 | GATGCATCCAATTGGA AACA SEQ ID NO:9373 | CATCAGTATGATAATCTCCC GCTCACT SEQ ID NO:17385 |
| iPS:434115 | 21-225_53E4 | AA | QASQDISNYLH SEQ ID NO:1362 | DASNLET SEQ ID NO:9374 | HQYDNLPLT SEQ ID NO:17386 |
| | | NA | CGGGCGAGTCAGGTCAGTACAGTAG CAATTATTTAGCC SEQ ID NO:1363 | GCTGCATCCAGTTTGCAA AGT SEQ ID NO:9375 | CAACAGTATCATAGTTACC ACTCACT SEQ ID NO:17387 |
| iPS:434117 | 21-225_53C6 | AA | RASQVISNYLA SEQ ID NO:1364 | AASSLQS SEQ ID NO:9376 | QQYHSYPLT SEQ ID NO:17388 |
| | | NA | CGGGCAAGTCAGTCAGTACAGTAG CGACTATTTAAAT SEQ ID NO:1365 | GCTGCATCCAGTTTGAA AAGT SEQ ID NO:9377 | CAACAGAGTTACAGTACCC GTTCACC SEQ ID NO:17389 |
| iPS:434119 | 21-225_53E6 | AA | RASQYSSDYLN SEQ ID NO:1366 | AASSLKS SEQ ID NO:9378 | QQSYSTPFT SEQ ID NO:17390 |
| | | NA | CGGGCAAGTCAGGGCATTAG AAATGATTAGGC SEQ ID NO:1367 | GCTGCATCCAATTGCAA AGT SEQ ID NO:9379 | CTACAACATAATCGTTACC GCTCACT SEQ ID NO:17391 |
| iPS:434121 | 21-225_53F6 | AA | RASQGIRNDLG SEQ ID NO:1368 | AASNLQS SEQ ID NO:9380 | LQHNRYPLT SEQ ID NO:17392 |
| | | NA | CAGGCGAGTCAAGACATTAC CAACTATTTAGAT SEQ ID NO:1369 | GATGCATCCAATTGGG AACA SEQ ID NO:9381 | CAACAGTGTGATAATCTCCC GCTCACT SEQ ID NO:17393 |
| iPS:434123 | 21-225_53F7 | AA | QASQDITNYLD SEQ ID NO:1370 | DASNLGT SEQ ID NO:9382 | QQCDNLPLT SEQ ID NO:17394 |
| | | NA | CGGGCGAGTCAGGGTATTAG CAGGTGGTTAGCC SEQ ID NO:1371 | GCTGCATCCAGTTTGCAA AGT SEQ ID NO:9383 | CAGCAGGCTAACAGTTCCC ATTCACT SEQ ID NO:17395 |

FIGURE 49 (Continued)

| | | | | | | |
|---|---|---|---|---|---|---|
| iPS:434127 | 21-225_53H8 | AA | RASQGISRWLA SEQ ID NO:1372 | AASSLQS SEQ ID NO:9384 | QQANSFPFT SEQ ID NO:17396 | |
| | | NA | AGGGCCAGTCAGAGTATTAC AAGCAGCTACTTAGCC SEQ ID NO:1373 | GGTGCGTCCGGCAGGGC CACT SEQ ID NO:9385 | CAGCAGTTTGAAAGCTCACC CATGTGCAGT SEQ ID NO:17397 | |
| iPS:434129 | 21-225_53B12 | AA | RASQSITSSYLA SEQ ID NO:1374 | GASGRAT SEQ ID NO:9386 | QQFESSPMCS SEQ ID NO:17398 | |
| | | NA | CGGGCAAGTCAGGGCATTAG AAATGATTTAGGC SEQ ID NO:1375 | GCTGCATCCAGTTGCAA AGT SEQ ID NO:9387 | CTACAGCATAATAGTTACCC ATTCACT SEQ ID NO:17399 | |
| iPS:434131 | 21-225_54D3 | AA | RASQGIRNDLG SEQ ID NO:1376 | AASSLQS SEQ ID NO:9388 | LQHNSYPFT SEQ ID NO:17400 | |
| | | NA | CGGGCAAGTCAGGGCATTAG AAATGATTTAGGC SEQ ID NO:1377 | GCTGCATCCAGTTGCAA AGT SEQ ID NO:9389 | CTACAACATATAGTTACCC ATTCACT SEQ ID NO:17401 | |
| iPS:434133 | 21-225_54G3 | AA | RASQGIRNDLG SEQ ID NO:1378 | AASSLQS SEQ ID NO:9390 | LQHNSYPFT SEQ ID NO:17402 | |
| | | NA | CGGGCGAGTCAGGGTATTAG CAGCTGGTTAGCC SEQ ID NO:1379 | GATGCATCCAATTGCA AAGT SEQ ID NO:9391 | CAACAGGCTAACAGTTTCC GTGGACG SEQ ID NO:17403 | |
| iPS:434135 | 21-225_54H3 | AA | RASQGISSWLA SEQ ID NO:1380 | DASSLQS SEQ ID NO:9392 | QQANSFPWT SEQ ID NO:17404 | |
| | | NA | CGGGCAAGTCAGGACATTAG AAATATTTAGGC SEQ ID NO:1381 | GCTGCATCCAATTGCAA AGT SEQ ID NO:9393 | CTACAGTATATAGTTACCC GTGGACG SEQ ID NO:17405 | |
| iPS:434137 | 21-225_54D4 | AA | RASQDIRNILG SEQ ID NO:1382 | AASNLQS SEQ ID NO:9394 | LQYNSYPWT SEQ ID NO:17406 | |
| | | NA | AAGTCTAGTCAGAGCCTCCT GCATAGTGAGGGAAAGACC TATTTGTAT | GAAGTTTCCAACCGGTTC TCT | ATGCAAGTATACAGTTTCC ATTCACT | |

FIGURE 49 (Continued)

| | | | | | | |
|---|---|---|---|---|---|---|
| iPS:434141 | 21-225_54D4 | AA | SEQ ID NO:1383<br>KSSQSLLHSEGKTYLY<br>SEQ ID NO:1384 | SEQ ID NO:9395<br>EVSNRFS<br>SEQ ID NO:9396 | SEQ ID NO:17407<br>MQSIQFPFT<br>SEQ ID NO:17408 | |
| iPS:434143 | 21-225_54C6 | NA | CGGGCAAGTCAGGGCATTAG<br>AAATGATTAGGC<br>SEQ ID NO:1385 | GCTGCATCCAATTGCAA<br>AGT<br>SEQ ID NO:9397 | CTACAGGCATAATGTTACCC<br>GCTCACT<br>SEQ ID NO:17409 | |
| | | AA | RASQGIRNDLG<br>SEQ ID NO:1386 | AASNLQS<br>SEQ ID NO:9398 | LQHNRYPLT<br>SEQ ID NO:17410 | |
| iPS:434145 | 21-225_54G7 | NA | CGGGCAAGTCAGGGCATTAG<br>AAATGATTAGGC<br>SEQ ID NO:1387 | GCTGCATCCAGTTGCAA<br>AGT<br>SEQ ID NO:9399 | CTACATCATATACTTACCC<br>ATTCACT<br>SEQ ID NO:17411 | |
| | | AA | RASQGIRNDLG<br>SEQ ID NO:1388 | AASSLQS<br>SEQ ID NO:9400 | LHHNTYPFT<br>SEQ ID NO:17412 | |
| iPS:434147 | 21-225_55B1 | NA | CGGGCGAGTCAGGTTATTAG<br>CCGCTGGTTAGCC<br>SEQ ID NO:1389 | GCTGCATCCAGTTGCAA<br>AGT<br>SEQ ID NO:9401 | CAACAGGCTAACAGTTCCC<br>ATTCACT<br>SEQ ID NO:17413 | |
| | | AA | RASQVISRWLA<br>SEQ ID NO:1390 | AASSLQS<br>SEQ ID NO:9402 | QQANSFPFT<br>SEQ ID NO:17414 | |
| iPS:434149 | 21-225_55E1 | NA | AGGGCCAGTCAGAGTGTTAG<br>CAGCGACTTAGCC<br>SEQ ID NO:1391 | GATGCATCCGCCAGGGC<br>CACT<br>SEQ ID NO:9403 | CAGCAGTATTATAACTGGCC<br>TCTCACT<br>SEQ ID NO:17415 | |
| | | AA | RASQSVSSDLA<br>SEQ ID NO:1392 | DASARAT<br>SEQ ID NO:9404 | QQYYNWPLT<br>SEQ ID NO:17416 | |
| iPS:434149 | 21-225_55H1 | NA | AAATCTAGTCAGAGCCTCCT<br>GCATAGTGAAGGAAAGACC<br>TATTTGTAT<br>SEQ ID NO:1393 | GAAGTTTCCCACCGGTTC<br>TCT<br>SEQ ID NO:9405 | ATGCAAAGTATACAGCTTCC<br>ATTCACT<br>SEQ ID NO:17417 | |
| | | AA | KSSQSLLHSEGKTYLY<br>SEQ ID NO:1394 | EVSHRFS<br>SEQ ID NO:9406 | MQSIQLPFT<br>SEQ ID NO:17418 | |

FIGURE 49
(Continued)

| | | | | |
|---|---|---|---|---|
| iPS:434151 | 21-225_55C2 | NA | AAGTCTAGTCAGAGCCTCGT GCATAGTGAAGGAAAGACC TATTTGTAT<br>SEQ ID NO:1395 | GAAGTTTCCAACCGGGT CTCT<br>SEQ ID NO:9407 | ATGCAAAGTATACTGTATCC GATCACC<br>SEQ ID NO:17419 |
| | | AA | KSSQSLVHSEGKTYLY<br>SEQ ID NO:1396 | EVSNRVS<br>SEQ ID NO:9408 | MQSILYPIT<br>SEQ ID NO:17420 |
| iPS:434155 | 21-225_55B3 | NA | CGGGCAAGTCAGGGCATTAG AAATGATTTAGGC<br>SEQ ID NO:1397 | GCTGCATCCAGTTTGCAA AGT<br>SEQ ID NO:9409 | CTACAACATAATAGTTACCC ATTCACT<br>SEQ ID NO:17421 |
| | | AA | RASQGIRNDLG<br>SEQ ID NO:1398 | AASSLQS<br>SEQ ID NO:9410 | LQHNSYPFT<br>SEQ ID NO:17422 |
| iPS:434157 | 21-225_55D4 | NA | CGGGCGAGTCAGGACATTAG CAATTATTTAATC<br>SEQ ID NO:1399 | ACTGCATCCAGTTTGCAA AGT<br>SEQ ID NO:9411 | CAACAGTATCATAGTTTCCC TCTCACT<br>SEQ ID NO:17423 |
| | | AA | RASQDISNYLI<br>SEQ ID NO:1400 | TASSLQS<br>SEQ ID NO:9412 | QQYHSFPLT<br>SEQ ID NO:17424 |
| iPS:434159 | 21-225_55B8 | NA | CGGGCAAGTCAGGCCATTAG AAATGATTTAGGC<br>SEQ ID NO:1401 | GCTGCATTCAGGTTGCA AAGT<br>SEQ ID NO:9413 | CTACAGCATAATAGTTACCC TCTCACT<br>SEQ ID NO:17425 |
| | | AA | RASQAIRNDLG<br>SEQ ID NO:1402 | AAFRLQS<br>SEQ ID NO:9414 | LQHNSYPLT<br>SEQ ID NO:17426 |
| iPS:434161 | 21-225_55F9 | NA | AAGTCTAGTCAAAGCCTCCT GCATAGTGAAGGAAAGACC TATTTGTAT<br>SEQ ID NO:1403 | GAAGTTTCCAACCGGTC TCT<br>SEQ ID NO:9415 | ATACAAAGTATACAACTTCC GATCACC<br>SEQ ID NO:17427 |
| | | AA | KSSQSLLHSEGKTYLY<br>SEQ ID NO:1404 | EVSNRFS<br>SEQ ID NO:9416 | IQSIQLPIT<br>SEQ ID NO:17428 |
| iPS:434163 | 21-225_50H1 | NA | CAGGCGAGTCAAGACATTAG CAACTATTTAGAT<br>SEQ ID NO:1405 | GATGCATCCAATTTGGA AACA<br>SEQ ID NO:9417 | CAACAGTGTGATAATCTCCC GCTCACT<br>SEQ ID NO:17429 |

FIGURE 49 (Continued)

| | | | QASQDISNYLD | DASNLET | QQCDNLPLT |
|---|---|---|---|---|---|
| iPS:434165 | | AA | SEQ ID NO:1406 | SEQ ID NO:9418 | SEQ ID NO:17430 |
| | 21-225_50F2 | NA | CGGGCAAGTCAGAGCATTCT CAGCTATTTGAAT | GTTGCATCCAGTTCCAA AGT | CAACAGAGTTACAGTCCCC TCTCACT |
| | | | SEQ ID NO:1407 | SEQ ID NO:9419 | SEQ ID NO:17431 |
| | | AA | RASQSILSYLN | VASSFQS | QQSYSPPLT |
| | | | SEQ ID NO:1408 | SEQ ID NO:9420 | SEQ ID NO:17432 |
| iPS:434167 | | NA | CGGGCGAGTCAGGATATTAG CAGCTGGTTGGCC | GCTGCATCCAGTTGCAA AAT | CAACAGACTAACAGTTTCC ATTCACT |
| | | | SEQ ID NO:1409 | SEQ ID NO:9421 | SEQ ID NO:17433 |
| | | AA | RASQDISSWLA | AASSLQN | QQTNSFPFT |
| | | | SEQ ID NO:1410 | SEQ ID NO:9422 | SEQ ID NO:17434 |
| iPS:434169 | | NA | CGGGCAAGTCAGGGCATTAG AAATGATTTAGGC | GCTGCATCCAGTTGCAA AGT | CTACAGCATAATGTTACC ATTCACT |
| | | | SEQ ID NO:1411 | SEQ ID NO:9423 | SEQ ID NO:17435 |
| | | AA | RASQGIRNDLG | AASSLQS | LQHNRYPFT |
| | | | SEQ ID NO:1412 | SEQ ID NO:9424 | SEQ ID NO:17436 |
| iPS:434171 | 21-225_50C4 | NA | CAGGCGAGTCAGGACATTAA CAACTTTTAAAT | GATGCCTCCAATTGGA AACA | CAACAGTATGATAATCTGAT CACC |
| | | | SEQ ID NO:1413 | SEQ ID NO:9425 | SEQ ID NO:17437 |
| | 21-225_50G4 | AA | QASQDITNFLN | DASNLET | QQYDNLIT |
| | | | SEQ ID NO:1414 | SEQ ID NO:9426 | SEQ ID NO:17438 |
| iPS:434175 | | NA | CGGGCGAGTCAGGACATTAA CATTTATTTAGCC | GCTGCATCCAGTTGCAA AGT | CAACAGTATAATAGTTATCC TCTCACT |
| | | | SEQ ID NO:1415 | SEQ ID NO:9427 | SEQ ID NO:17439 |
| | 21-225_55A1 | AA | RASQDINIYLA | AASSLQS | QQYNSYPLT |
| | | | SEQ ID NO:1416 | SEQ ID NO:9428 | SEQ ID NO:17440 |
| iPS:434177 | 21-225_56A1 | NA | AAGTCCAGCCAGAGTGTTT ACATAGTTCCAACAATAAGA ACTACTTAGTT | TGGGCATCTACCCGGGA ATCC | CAGCAATATTATAGTACTCC TCCGACG |

FIGURE 49
(Continued)

| | | | | | | |
|---|---|---|---|---|---|---|
| iPS:434179 | 21-225_56A1 | AA | SEQ ID NO:1417<br>KSSQSVLHSSNKNYLV<br>SEQ ID NO:1418 | SEQ ID NO:9429<br>WASTRES<br>SEQ ID NO:9430 | SEQ ID NO:17441<br>QQYYSTPPT<br>SEQ ID NO:17442 |
| iPS:434181 | 21-225_56F1 | NA | CGGGCAAGTCAGGACATTAG<br>AAATAATTTAGGC<br>SEQ ID NO:1419 | GCTGCATCCAGTTTACAA<br>AGT<br>SEQ ID NO:9431 | CTACAGGATAATAGTCACC<br>GTTCACT<br>SEQ ID NO:17443 |
| | | AA | RASQDIRNLG<br>SEQ ID NO:1420 | AASSLQS<br>SEQ ID NO:9432 | LQDNSHPFT<br>SEQ ID NO:17444 |
| iPS:434187 | 21-225_56B2 | NA | CGGGCAAGTCAGAGTTTTAG<br>CCACTATTTAAAT<br>SEQ ID NO:1421 | GCTGTATCCAGTTTGCAA<br>AGT<br>SEQ ID NO:9433 | CAACAGAGTTACAGTACCC<br>ATTCACT<br>SEQ ID NO:17445 |
| | | AA | RASQSFSHYLN<br>SEQ ID NO:1422 | AVSSLQS<br>SEQ ID NO:9434 | QQSYSTPFT<br>SEQ ID NO:17446 |
| iPS:434189 | 21-225_56A5 | NA | CGGGCAAGTCAGGACATTAG<br>AAATCTTTAAAT<br>SEQ ID NO:1423 | GCTGCATCCAGTTTGCAA<br>AGT<br>SEQ ID NO:9435 | CTACAGTATAATAGTTACCC<br>ATTCACT<br>SEQ ID NO:17447 |
| | | AA | RASQDIRNLLG<br>SEQ ID NO:1424 | AASSLQS<br>SEQ ID NO:9436 | LQYNSYPFT<br>SEQ ID NO:17448 |
| iPS:434191 | 21-225_56E5 | NA | CGGGCGAGTCAGGGTATTAG<br>GAAGTGGTTAGCC<br>SEQ ID NO:1425 | GCTGCATCCAGTTTGCAA<br>AGT<br>SEQ ID NO:9437 | CAACAGGCTAACAGTTCCCC<br>ATTCACT<br>SEQ ID NO:17449 |
| | | AA | RASGIRKWLA<br>SEQ ID NO:1426 | AASSLQS<br>SEQ ID NO:9438 | QQANSFPFT<br>SEQ ID NO:17450 |
| iPS:434193 | 21-225_56B6 | NA | CGGGCAAGTCAGAGCATTTT<br>CAGATATTAAAT<br>SEQ ID NO:1427 | GCTGCATCCAGTTTCCAA<br>AGT<br>SEQ ID NO:9439 | CAACAGGCTACAGTCCCCC<br>TCTCACT<br>SEQ ID NO:17451 |
| | | AA | RASQSIFRYLN<br>SEQ ID NO:1428 | AASSFQS<br>SEQ ID NO:9440 | QQTYSPPLT<br>SEQ ID NO:17452 |
| | | NA | CGGGCGAGTCAGGGTATTAG<br>CAGCTGGTTAGCC | GCTGCATCCAGATTGCA<br>AAGT | CAACAGGCTAACAGTTCCC<br>ATTCACT |

FIGURE 49 (Continued)

| | | | | | |
|---|---|---|---|---|---|
| 21-225_56C6 | | | SEQ ID NO:1429 | SEQ ID NO:9441 | SEQ ID NO:17453 |
| | | AA | RASQGISSWLA | AASRLQS | QQANSFPFT |
| iPS:434195 | | NA | SEQ ID NO:1430 | SEQ ID NO:9442 | SEQ ID NO:17454 |
| 21-225_56F6 | | | CGGGTGAGTCAGGATATTAG CAAATGGTTAGCC | GTTGCATCCGGTTGCAA AGT | CAACAGGCTAACAGTTTCCC ATTCACT |
| | | AA | SEQ ID NO:1431 | SEQ ID NO:9443 | SEQ ID NO:17455 |
| iPS:434197 | | NA | RVSQDISKWLA | VASGLQS | QQANSFPFT |
| 21-225_56C7 | | | SEQ ID NO:1432 | SEQ ID NO:9444 | SEQ ID NO:17456 |
| | | | CGGGCAAGTCAGGGCATTAG AAATGATTAGGC | ACTGCATCCAATTTACAA AGT | CTACAGCATAATAGTTATCC GTGGACG |
| | | AA | SEQ ID NO:1433 | SEQ ID NO:9445 | SEQ ID NO:17457 |
| iPS:434199 | | NA | RASQGIRNDLG | TASNLQS | LQHNSYPWT |
| 21-225_59F11 | | | SEQ ID NO:1434 | SEQ ID NO:9446 | SEQ ID NO:17458 |
| | | | CGGGCAAGTCAGGGCATTAG AAATGATTAGGC | GCTGCATCCAGTTGCAA AGT | CTACAGCATAATGTTACC TTTCACT |
| | | AA | SEQ ID NO:1435 | SEQ ID NO:9447 | SEQ ID NO:17459 |
| iPS:434201 | | NA | RASQGIRNDLG | AASSLQS | LQHNRYPFT |
| 21-225_59A12 | | | SEQ ID NO:1436 | SEQ ID NO:9448 | SEQ ID NO:17460 |
| | | | AAGTCTAGTCAGAGCCTCCA GCATGGTGAAGGAAAGACC TATTTGTAT | GAAGTTTCCTATCGGTTT TCT | ATGCAAAGTACACAGCTTCC GCTCACC |
| | | AA | SEQ ID NO:1437 | SEQ ID NO:9449 | SEQ ID NO:17461 |
| iPS:434203 | | NA | KSSQSLQHGEGKTYLY | EVSYRFS | MQSTQLPLT |
| 21-225_60E2 | | | SEQ ID NO:1438 | SEQ ID NO:9450 | SEQ ID NO:17462 |
| | | | CGGGCAAGTCAGGGCATTAG AAAAGATTAGGC | GCTGCATCCAGTTGCAA AGT | CTACAGCATAATAGTTACC GTGGACG |
| | | AA | SEQ ID NO:1439 | SEQ ID NO:9451 | SEQ ID NO:17463 |
| | | | RASQGIRKDLG | AASSLQS | LQHNSYPWT |
| | | NA | SEQ ID NO:1440 | SEQ ID NO:9452 | SEQ ID NO:17464 |

FIGURE 49
(Continued)

| | | | | | |
|---|---|---|---|---|---|
| iPS:434205 | 21-225_60G2 | NA | AAGTCTAGTGTCAGAGAGCCTCCTGCATAGTGAAGGAAAGACCTATTTGTAT SEQ ID NO:1441 | GAAGTTTCCAACCGGATCTCT SEQ ID NO:9453 | ATGCAAAGTATACAGCTTCCGCTCACT SEQ ID NO:17465 |
| | | AA | KSSQSLLHSEGKTYLY SEQ ID NO:1442 | EVSNRIS SEQ ID NO:9454 | MQSIQLPLT SEQ ID NO:17466 |
| iPS:434207 | 21-225_60A3 | NA | CGGGCAAGTCAGGGCATTAGAAATGATTTAGGC SEQ ID NO:1443 | GCTGCATTAGTTTGCAAAGT SEQ ID NO:9455 | CTACAGCATAATAGTTACCTTTCACT SEQ ID NO:17467 |
| | | AA | RASQGIRNDLG SEQ ID NO:1444 | AAFSLQS SEQ ID NO:9456 | LQHNSYPFT SEQ ID NO:17468 |
| iPS:434209 | 21-225_60C3 | NA | CGGGCAAGTCAGGGCATTAGAAATGATTTAGGC SEQ ID NO:1445 | TCTGCATCCAGTTTACAAAGT SEQ ID NO:9457 | CTACAGCATAATAGTTACCGTGGACG SEQ ID NO:17469 |
| | | AA | RASQGIRNDLG SEQ ID NO:1446 | SASSLQS SEQ ID NO:9458 | LQHNSYPWT SEQ ID NO:17470 |
| iPS:434211 | 21-225_60F3 | NA | AAGTCCAGCCAGAGTGTTTATACAGCTCCAACAATAAGAACTACTTAGCT SEQ ID NO:1447 | TGGGCATCTACCCGGGAATCC SEQ ID NO:9459 | CAGCAATATTATAGTACTCCGTGCAGT SEQ ID NO:17471 |
| | | AA | KSSQSVLYSSNNKNYLA SEQ ID NO:1448 | WASTRES SEQ ID NO:9460 | QQYYSTPCS SEQ ID NO:17472 |
| iPS:434213 | 21-225_60A4 | NA | CGGGCGAGTCAGGGCATTAGCAATTACTTAGCC SEQ ID NO:1449 | GCTGCATCCAGTTTGCAAAGT SEQ ID NO:9461 | CAACAATATAAAAGTCACCATTCACT SEQ ID NO:17473 |
| | | AA | RASQGISNYLA SEQ ID NO:1450 | AASSLQS SEQ ID NO:9462 | QQYKSHPFT SEQ ID NO:17474 |
| iPS:434215 | 21-225_60F7 | NA | CGGGCGAGTCAGGTCATTAAGAATTATTTAGTC SEQ ID NO:1451 | GCTGCGTCCAGTTTGCAAAGT SEQ ID NO:9463 | CTACAGTTCATAGTTACCATTCACT SEQ ID NO:17475 |

FIGURE 49
(Continued)

| ID | Clone | | CDR | | | | | |
|---|---|---|---|---|---|---|---|---|
| iPS:434217 | | AA | RASQVIKNYLV | SEQ ID NO:1452 | AASSLQS | SEQ ID NO:9464 | LQFHSYPFT | SEQ ID NO:17476 |
| | 21-225_60E8 | NA | CGGGCAAGTCAGGGCATTAG AAATGATTTAGGC | SEQ ID NO:1453 | GCTGCATCCAGTTGCAA AGT | SEQ ID NO:9465 | CTACAGCATAGTAGTTACCC GCTCACT | SEQ ID NO:17477 |
| iPS:434219 | | AA | RASQGIRNDLG | SEQ ID NO:1454 | AASSLQS | SEQ ID NO:9466 | LQHSSYPLT | SEQ ID NO:17478 |
| | 21-225_60E9 | NA | AGGGCCAGTCAGAGTGTTAG CAGTTCCTTAGCC | SEQ ID NO:1455 | GGTGCATCCACCAGGGC CACT | SEQ ID NO:9467 | CAGCAGTATAATAACTGGCC ATTCACT | SEQ ID NO:17479 |
| iPS:434221 | | AA | RASQSVSSSLA | SEQ ID NO:1456 | GASTRAT | SEQ ID NO:9468 | QQYNWPFT | SEQ ID NO:17480 |
| | 21-225_60A11 | NA | CGGGCGAGTCAGAGTGTTAG CAACTGGTTAGCC | SEQ ID NO:1457 | ACTGCATCCAGTTGCAA AGT | SEQ ID NO:9469 | CAACAGGCTAACAGTTTCCC GTGGACG | SEQ ID NO:17481 |
| iPS:434223 | | AA | RASQVISNWLA | SEQ ID NO:1458 | TASSLQS | SEQ ID NO:9470 | QQANSFPWT | SEQ ID NO:17482 |
| | 21-225_60C12 | NA | AAGTCTAGTCAGAGCCTCCT GCATAGTGAGGGAAAGACC TATTTGTAT | SEQ ID NO:1459 | GAAGTTTCCAACCGGTTC TCT | SEQ ID NO:9471 | ATGCAAAGTATAAAGTATCC GCTCACT | SEQ ID NO:17483 |
| iPS:434225 | | AA | KSSQSLLHSEGKTYLY | SEQ ID NO:1460 | EVSNRFS | SEQ ID NO:9472 | MQSIKYPLT | SEQ ID NO:17484 |
| | 21-225_60E12 | NA | CGGGCAAGTCAGAGCATTAG CAGCTATTTAAAT | SEQ ID NO:1461 | GCTGCATCCAGTTGCAA AGT | SEQ ID NO:9473 | CAACAGAGTTACAATATTC ATTCACT | SEQ ID NO:17485 |
| iPS:434227 | | AA | RASQSISSYLN | SEQ ID NO:1462 | AASSLQS | SEQ ID NO:9474 | QQSYNISFT | SEQ ID NO:17486 |
| | | NA | CGGGCAAGTCAGAGCATTAG CAGCTATTTAAAT | | GCTGCATCCAGTTGCAA AGT | | CAACAGAGTTACAATATTC ATTCACT | |

FIGURE 49
(Continued)

| | | | | | | |
|---|---|---|---|---|---|---|
| iPS:434229 | 21-225_61A1 | AA | SEQ ID NO:1463<br>RASQSISSYLN | SEQ ID NO:9475<br>AASSLQS | SEQ ID NO:17487<br>QQSYNISFT | |
| iPS:434231 | 21-225_61H1 | NA | SEQ ID NO:1464<br>CGGGCAAGTCAGGGCATTAG<br>AAAAGATTTAGGC | SEQ ID NO:9476<br>GCTGCATCCAGTTTGCAA<br>AGT | SEQ ID NO:17488<br>CTACAGCATAATAGTTACCC<br>GTGGACG | |
| | | AA | SEQ ID NO:1465<br>RASQGIRKDLG | SEQ ID NO:9477<br>AASSLQS | SEQ ID NO:17489<br>LQHNSYPWT | |
| iPS:434233 | 21-225_61F2 | NA | SEQ ID NO:1466<br>CGGGCAAGTCAGGGCATTAG<br>AGATGATTTAGGC | SEQ ID NO:9478<br>GCTGCATCCAGTTTGCAA<br>AGT | SEQ ID NO:17490<br>CTACAGCATTATAGTTACCC<br>TCGCAGT | |
| | | AA | SEQ ID NO:1467<br>RASQGIRDDLG | SEQ ID NO:9479<br>AASSLQS | SEQ ID NO:17491<br>LQHYSYPRS | |
| iPS:434235 | 21-225_61B3 | NA | SEQ ID NO:1468<br>AAGTCTAGTCAGAGCCTCCT<br>GCATAGTAGTGAAGGAAAGACC<br>TATTTGTAT | SEQ ID NO:9480<br>GAAGTTCCAACGGAT<br>CTCT | SEQ ID NO:17492<br>ATGCAAAGTATACAGCTTCC<br>GCTCACT | |
| | | AA | SEQ ID NO:1469<br>KSSQSLLHSEGKTYLY | SEQ ID NO:9481<br>EVSNRIS | SEQ ID NO:17493<br>MQSIQLPLT | |
| iPS:434237 | 21-225_61E3 | NA | SEQ ID NO:1470<br>AAGTCCAGCCAGAGTGTTTT<br>ACACACTCCAACATAACA<br>ATTACTTAGCT | SEQ ID NO:9482<br>TGGGCATCTATCCGGGA<br>ATCC | SEQ ID NO:17494<br>CAGCAATATTATAGTATTCC<br>GTGCAGT | |
| | | AA | SEQ ID NO:1471<br>KSSQSVLHSNNNNYLA | SEQ ID NO:9483<br>WASIRES | SEQ ID NO:17495<br>QQYYSIPCS | |
| | 21-225_61B5 | NA | SEQ ID NO:1472<br>AAGTCCAGCCAGAGTGTTTT<br>ATACAGTTCCAACAATAACA<br>ACTCCTTAACT | SEQ ID NO:9484<br>TGGGCATCTACCCGGGA<br>ATCC | SEQ ID NO:17496<br>CAGCAATATTATAGTACTCC<br>TCCGACG | |
| | | AA | SEQ ID NO:1473<br>KSSQSVLYSSNNNNSLT | SEQ ID NO:9485<br>WASTRES | SEQ ID NO:17497<br>QQYYSTPPT | |

FIGURE 49
(Continued)

| | | | | | | | |
|---|---|---|---|---|---|---|---|
| iPS:434239 | | NA | CGGGCAAGTCAGAGCATTAC CAACTTTTTAAAT | SEQ ID NO:1474 | GCTGCATCCAGTTGCAA AGT | SEQ ID NO:9486 | CAACAGAGTTACAGTATCCC GTGGACG | SEQ ID NO:17498 |
| | 21-225_58F1 | AA | RASQSITNFLN | SEQ ID NO:1475 | AASSLQS | SEQ ID NO:9487 | QQSYSIPWT | SEQ ID NO:17499 |
| iPS:434241 | | NA | CGGGCAAGTCAGGGCATTGG AAATGATTTAGGC | SEQ ID NO:1476 | GCTGCATCCAGTTGCAA AGT | SEQ ID NO:9488 | CTACAACATAATAGTTTCCC TCCGTGGACG | SEQ ID NO:17500 |
| | 21-225_61E6 | AA | RASQGIGNDLG | SEQ ID NO:1477 | AASSLQS | SEQ ID NO:9489 | LQHNSFPPWT | SEQ ID NO:17501 |
| iPS:434243 | | NA | AGGTCTAGTCAGAGCCTCCT ACATAGTAATGGATACAACT ATTTGGAT | SEQ ID NO:1478 | TTGGTTTCTAATCGGGCC TCC | SEQ ID NO:9490 | CTGCAAGCTCTACAAACTCC TCTCACC | SEQ ID NO:17502 |
| | 21-225_62C1 | AA | RSSQSLLHSNGYNYLD | SEQ ID NO:1479 | LVSNRAS | SEQ ID NO:9491 | LQALQTPLT | SEQ ID NO:17503 |
| iPS:434245 | | NA | CGGGCAAGTCAGAGCATTAT CAGCTATTTAAAT | SEQ ID NO:1480 | GCTGTATTTAGTTTGCAA AGT | SEQ ID NO:9492 | CAACAGAGTTACAGTACCCC ATTCACT | SEQ ID NO:17504 |
| | 21-225_62H1 | AA | RASQNIFSYLN | SEQ ID NO:1481 | AVFSLQS | SEQ ID NO:9493 | QQSYSTPFT | SEQ ID NO:17505 |
| iPS:434247 | | NA | CGGGCAAGTCAGAGCATTAT CAGTTATTTAAAT | SEQ ID NO:1482 | GCTACATCCAGTTGCAA AGT | SEQ ID NO:9494 | CAACAGACTTACAGTCCCCC GCTCACT | SEQ ID NO:17506 |
| | 21-225_62D2 | AA | RASQSIISYLN | SEQ ID NO:1483 | ATSSLQS | SEQ ID NO:9495 | QQTYSPPLT | SEQ ID NO:17507 |
| iPS:434249 | | NA | CGGGCAAGTCAGGGCATTAG AAATGATTTAGGC | SEQ ID NO:1484 | GCTGCATCCGGTTGCAA AGT | SEQ ID NO:9496 | CTACAGCATAGTAATTACCC TCTCACT | SEQ ID NO:17508 |
| | 21-225_62E2 | | | SEQ ID NO:1485 | | SEQ ID NO:9497 | | SEQ ID NO:17509 |

FIGURE 49
(Continued)

| | | | | | | | |
|---|---|---|---|---|---|---|---|
| iPS:434251 | | AA | RASQGIRNDLG | | AASRLQS | | LQHSNYPLT |
| | 21-225_62G3 | | SEQ ID NO:1486 | | SEQ ID NO:9498 | | SEQ ID NO:17510 |
| | | NA | CGGGCAAGTCAGGGACATTAG AAATAATTTAGGC | | ACTGCATCCAGTTTGCAA AGT | | CTACAGTATAATAGTTACCC ATTCACT |
| | | | SEQ ID NO:1487 | | SEQ ID NO:9499 | | SEQ ID NO:17511 |
| iPS:434253 | | AA | RASQDIRNNLG | | TASSLQS | | LQYNSYPFT |
| | 21-225_62E4 | | SEQ ID NO:1488 | | SEQ ID NO:9500 | | SEQ ID NO:17512 |
| | | NA | CGGGCAAGTCAGGGCATTAG AAATGATTTAGGC | | GCTGCATTCAGTTTGCAA AGT | | CTACAGCATAATAGTTATCC GCTCACT |
| | | | SEQ ID NO:1489 | | SEQ ID NO:9501 | | SEQ ID NO:17513 |
| iPS:434255 | | AA | RASQGIRNDLG | | AAFSLQS | | LQHNSYPLT |
| | 21-225_62E6 | | SEQ ID NO:1490 | | SEQ ID NO:9502 | | SEQ ID NO:17514 |
| | | NA | AGGGCCAGTCAGAGTGTTAA CAGCAACTTAGCC | | GTTGCATCCACCAGGGC CACT | | CAGCAGTATAATGACTGGCC GTGTAGT |
| | | | SEQ ID NO:1491 | | SEQ ID NO:9503 | | SEQ ID NO:17515 |
| iPS:434257 | | AA | RASQSVNSNLA | | VASTRAT | | QQYNDWPCS |
| | 21-225_62F7 | | SEQ ID NO:1492 | | SEQ ID NO:9504 | | SEQ ID NO:17516 |
| | | NA | CGGGCAAGTCAGGGCATTAG AAATGATTTAGGC | | CCTGCATCCCGTTTGCAA AGT | | CTACAGTATAATAGTTACCC TCCGTGGACG |
| | | | SEQ ID NO:1493 | | SEQ ID NO:9505 | | SEQ ID NO:17517 |
| iPS:434259 | | AA | RASQAIRNDLG | | PASRLQS | | LQYNSYPPWT |
| | 21-225_62G7 | | SEQ ID NO:1494 | | SEQ ID NO:9506 | | SEQ ID NO:17518 |
| | | NA | CGGGCGAGTCAGGATATTAG CAGCTGGTTAGCC | | GCTGCATCCAGTTTGCAA AGT | | CAACAGTATAACAGTTTCCC TCTCACT |
| | | | SEQ ID NO:1495 | | SEQ ID NO:9507 | | SEQ ID NO:17519 |
| iPS:434261 | | AA | RASQDISSWLA | | AASSLQS | | QQTNSFPLT |
| | 21-225_56F7 | | SEQ ID NO:1496 | | SEQ ID NO:9508 | | SEQ ID NO:17520 |
| | | NA | CGGGCGAGTCAGGGCATTAG CACTTATTTAGCC | | GCTGCATCCAGTTTGCAA GGT | | CATCAGTATAATAGTTTCCC ATTTAAG |
| | | | SEQ ID NO:1497 | | SEQ ID NO:9509 | | SEQ ID NO:17521 |

FIGURE 49
(Continued)

| | | | | | |
|---|---|---|---|---|---|
| iPS:434263 | | AA | RASQGISTYLA SEQ ID NO:1498 | AASSLQG SEQ ID NO:9510 | HQYNSFPFK SEQ ID NO:17522 |
| | 21-225_56H7 | NA | CGGGCAAGTCAGGGACATTAG AAATGATTTAGGC SEQ ID NO:1499 | CCTGCATCCAGTTTGCTA AGT SEQ ID NO:9511 | CTACAGGATAATAGTTACCC ATTCACT SEQ ID NO:17523 |
| iPS:434265 | | AA | RASQDIRNDLG SEQ ID NO:1500 | PASSLLS SEQ ID NO:9512 | LQDNSYPFT SEQ ID NO:17524 |
| | 21-225_57B2 | NA | CGGGCAAGTCAGGGCATTAG AAATGCTTTAGGC SEQ ID NO:1501 | GCTGCATCCAGTTTGCAA AGT SEQ ID NO:9513 | CTACAGCATAATAGTTACCC ATTCACT SEQ ID NO:17525 |
| iPS:434267 | | AA | RASQGIRNALG SEQ ID NO:1502 | AASSLQS SEQ ID NO:9514 | LQHNSYPFT SEQ ID NO:17526 |
| | 21-225_57F2 | NA | CGGGCAAGTCAGAGAGCATTAG CAGCTATTTAAAT SEQ ID NO:1503 | GCTGCATCCAGTTTGCAA AGT SEQ ID NO:9515 | CAACAGAGTTACAATATTTC ATTCACT SEQ ID NO:17527 |
| iPS:434269 | | AA | RASQSISSYLN SEQ ID NO:1504 | AASSLQS SEQ ID NO:9516 | QQSYNISFT SEQ ID NO:17528 |
| | 21-225_57H3 | NA | AGGGCCAGTCAGAGTGTTAG CAGCAGTTAGGC SEQ ID NO:1505 | GGTGCATCCACCAGGGC CACT SEQ ID NO:9517 | CAGCAGTATAATGACTGGCC GTGCAGT SEQ ID NO:17529 |
| iPS:434271 | | AA | RASQSVSSSLA SEQ ID NO:1506 | GASTRAT SEQ ID NO:9518 | QQYNDWPCS SEQ ID NO:17530 |
| | 21-225_57A4 | NA | CGGGCAAGTCAGGGCATTAG AAATGATTTAGGC SEQ ID NO:1507 | GCTGCATCCAGTTTGCTA AGT SEQ ID NO:9519 | CTACAGCATAATAGTTACCC ATTCACT SEQ ID NO:17531 |
| iPS:434273 | | AA | RASQGIRNDLG SEQ ID NO:1508 | AASSLLS SEQ ID NO:9520 | LQHNSYPFT SEQ ID NO:17532 |
| | 21-225_57E4 | NA | CGGGCGAGTCAGGATATTAG CAACTGGTTAGCC SEQ ID NO:1509 | GCTGCATCCAGTTTGCAA AGT SEQ ID NO:9521 | CAACAGGGTAACAGTTCCC ATTCACT SEQ ID NO:17533 |

FIGURE 49 (Continued)

| | | | | | |
|---|---|---|---|---|---|
| iPS:434275 | 21-225_57F4 | AA | RASQDISNWLA<br>SEQ ID NO:1510 | AASSLQS<br>SEQ ID NO:9521 | QQGNSFPFT<br>SEQ ID NO:17534 |
| | | NA | CGGGCAAGTCAGGTCATTAG<br>AAATGATTAGGC<br>SEQ ID NO:1511 | GCTGCATCCAGTTTGCAA<br>AGT<br>SEQ ID NO:9522 | CTACAGTATGGTAGTTTCCC<br>ATTCACT<br>SEQ ID NO:17535 |
| iPS:434277 | 21-225_57A7 | AA | RASQVIRNDLG<br>SEQ ID NO:1512 | AASSLQS<br>SEQ ID NO:9523 | LQYGSFPFT<br>SEQ ID NO:17536 |
| | | NA | CGGGGAGTCAGGGTATTAG<br>CAGGTGGTTAGCC<br>SEQ ID NO:1513 | GCTGCATCCAATTTGCAA<br>AGT<br>SEQ ID NO:9524 | CAACAGGCTAACAGTTTCCC<br>ATTCACT<br>SEQ ID NO:17537 |
| iPS:434279 | 21-225_57F7 | AA | RASQGISRWLA<br>SEQ ID NO:1514 | AASNLQS<br>SEQ ID NO:9525 | QQANSFPFT<br>SEQ ID NO:17538 |
| | | NA | AGGGCCAGTCAGAGTGTTAG<br>CAGCGACTTAGCC<br>SEQ ID NO:1515 | GGTGCATCCACCAGGGC<br>CACT<br>SEQ ID NO:9526 | CAGCAGTATAGTAACTGGCC<br>ATTCACT<br>SEQ ID NO:17539 |
| iPS:434281 | 21-225_57F8 | AA | RASQSVSSDLA<br>SEQ ID NO:1516 | GASTRAT<br>SEQ ID NO:9527 | QQYSNWPFT<br>SEQ ID NO:17540 |
| | | NA | CGGGCAAGTCAGGGCATTGG<br>AAATGATTAGGC<br>SEQ ID NO:1517 | GCTGCATCCAGTTTGCAA<br>AGT<br>SEQ ID NO:9528 | CTACAACATAATAGTTTCCC<br>TCCGTGGACG<br>SEQ ID NO:17541 |
| iPS:434283 | 21-225_57F8 | AA | RASQGIGNDLG<br>SEQ ID NO:1518 | AASSLQS<br>SEQ ID NO:9529 | LQHNSFPPWT<br>SEQ ID NO:17542 |
| | | NA | CGGGCAAGTCAGGGTATTAG<br>CAACTGGTTAGCC<br>SEQ ID NO:1519 | ACTGCATCCAGTTTGCAA<br>AGT<br>SEQ ID NO:9530 | CAACAGGCTAACAGTTTCCC<br>GTGGACG<br>SEQ ID NO:17543 |
| iPS:434285 | 21-225_57A11 | AA | RASQGISNWLA<br>SEQ ID NO:1520 | TASSLQS<br>SEQ ID NO:9531 | QQANSFPWT<br>SEQ ID NO:17544 |
| | | NA | AAGTCCAGCCAAAGTGTTTT<br>ACACAGCTCCAACAATTATA<br>ACTACTTAGCT | TGGGCATCTACCCGGGC<br>ATCC<br>SEQ ID NO:9532 | CAGCAATATTATAGTACTCC<br>GTGGACG |

FIGURE 49
(Continued)

| | | | | | | | |
|---|---|---|---|---|---|---|---|
| iPS:434287 | 21-225_57A11 | AA | SEQ ID NO:1521<br>KSSQSVLHSSNNYNYLA | | SEQ ID NO:9533<br>WASTRAS | | SEQ ID NO:17545<br>QQYYSTPWT |
| iPS:434289 | 21-225_57F12 | NA | SEQ ID NO:1522<br>AAGTCCAGCCAGAGTGTTTT<br>ATTCAGCTCCAACAATTACA<br>ATTACTTAGCT | | SEQ ID NO:9534<br>TGGGCATCTACCCGGGA<br>ATCC | | SEQ ID NO:17546<br>CAGCAATATTATAGTAATCC<br>GTGTAGT |
| | | AA | SEQ ID NO:1523<br>KSSQSVLFSSNNYNYLA | | SEQ ID NO:9535<br>WASTRES | | SEQ ID NO:17547<br>QQYYSNPCS |
| iPS:434291 | 21-225_57H12 | NA | SEQ ID NO:1524<br>AGGGCCAGTCAGAGTGTTAG<br>CAGCGACTTAGCC | | SEQ ID NO:9536<br>GCTGCATCTACCAGGGC<br>CACT | | SEQ ID NO:17548<br>CAGCAGTATGATAACTGGCC<br>ATTCACT |
| | | AA | SEQ ID NO:1525<br>RASQSVSSDLA | | SEQ ID NO:9537<br>AASTRAT | | SEQ ID NO:17549<br>QQYDNWPFT |
| iPS:434293 | 21-225_58A4 | NA | SEQ ID NO:1526<br>AGGGCCAGTCAGAGTGTTAG<br>CAGCGACTTAGCC | | SEQ ID NO:9538<br>GCTGCATCTACCAGGGC<br>CACT | | SEQ ID NO:17550<br>CAGCAGTTTAATAACTGGCC<br>ATTCACT |
| | | AA | SEQ ID NO:1527<br>RASQSVSSDLA | | SEQ ID NO:9539<br>AASTRAT | | SEQ ID NO:17551<br>QQFNNWPFT |
| iPS:434295 | 21-225_58F5 | NA | SEQ ID NO:1528<br>CGGGCAAGTCAGGGCATTAG<br>AAATGATTTAGGC | | SEQ ID NO:9540<br>GCTGCATCCAGTTTGCTA<br>AGT | | SEQ ID NO:17552<br>CTACAGCATAATAGTACTCC<br>ATTCACT |
| | | AA | SEQ ID NO:1529<br>RASQGIRNDLG | | SEQ ID NO:9541<br>AASSLLS | | SEQ ID NO:17553<br>LQHNSYPFT |
| | 21-225_58B9 | NA | SEQ ID NO:1530<br>AAGTCCGGCCAGAGTATTTT<br>ATACAGCTCCAACAATAACA<br>ACTACTTAGCT | | SEQ ID NO:9542<br>TGGGCATCTACCCGGGA<br>TTCC | | SEQ ID NO:17554<br>CAGCAATATTATAGTACTCC<br>TCCGACG |
| | | AA | SEQ ID NO:1531<br>KSGQSILYSSNNNNYLA | | SEQ ID NO:9543<br>WASTRDS | | SEQ ID NO:17555<br>QQYYSTPPT |
| | | | SEQ ID NO:1532 | | SEQ ID NO:9544 | | SEQ ID NO:17556 |

FIGURE 49
(Continued)

| | | | | | |
|---|---|---|---|---|---|
| iPS:434297 | 21-225_58A10 | NA | AGGGCCAGTCAGAGTGTTAG CAGCTCCTTAGCC SEQ ID NO:1533 | GGTGCATCCACCAGGGC CACT SEQ ID NO:9545 | CAGCAGTATAATAACTGGCC ATTCACT SEQ ID NO:17557 |
| | | AA | RASQSVSSSLA SEQ ID NO:1534 | GASTRAT SEQ ID NO:9546 | QQYNNWPFT SEQ ID NO:17558 |
| iPS:434299 | 21-225_58D11 | NA | CGGGCAAGTCAGAGGCATTAG AAGTGATTAGAC SEQ ID NO:1535 | GCTGCATCCAGTTGCAA AGT SEQ ID NO:9547 | CTCCAGCATAATAATTTCC ATTCACT SEQ ID NO:17559 |
| | | AA | RASQGIRSDLD SEQ ID NO:1536 | AASSLQS SEQ ID NO:9548 | LQHNNFPFT SEQ ID NO:17560 |
| iPS:434301 | 21-225_58F11 | NA | AGGGCCAGTCAGAGTGTTAG CAGCGACTAGTC SEQ ID NO:1537 | GGTGTATCCACCAGGGC CACT SEQ ID NO:9549 | CAGCAGTATAATAACTGGCC ATTCACT SEQ ID NO:17561 |
| | | AA | RASQSVSSDLV SEQ ID NO:1538 | GVSTRAT SEQ ID NO:9550 | QQYNNWPFT SEQ ID NO:17562 |
| iPS:434303 | 21-225_58H11 | NA | AAGTCAGTCAGAGCCTCCT GCATAGTGAGGGAAAGACC TATTTGTAT SEQ ID NO:1539 | GAAGTTTCCTATCGGTTT TCT SEQ ID NO:9551 | ATGCAAAGTATACAGCTTCC GCTCACT SEQ ID NO:17563 |
| | | AA | KSSQSLLHSEGKTYLY SEQ ID NO:1540 | EVSYRFS SEQ ID NO:9552 | MQSIQLPLT SEQ ID NO:17564 |
| iPS:434305 | 21-225_59E1 | NA | AAGTCCAGCCAGAGTGTTT ATACAGTCCAACAATAACA ACTACTTAGCT SEQ ID NO:1541 | TGGTCATCTACCGGGA ATCC SEQ ID NO:9553 | CAGCAATATTTAGTATTCC GTGCAGT SEQ ID NO:17565 |
| | | AA | KSSQSVLYSSNNNNYLA SEQ ID NO:1542 | WSSTRES SEQ ID NO:9554 | QQYFSIPCS SEQ ID NO:17566 |
| iPS:434307 | 21-225_59B2 | NA | TGGGCCAGTCAGAGTGTTA CAGCAGTTCTTAGCC SEQ ID NO:1543 | GGTGCATCCAGCAGGGC CACT SEQ ID NO:9555 | CAGCAATATGGTACCTCACC GTGGACG SEQ ID NO:17567 |

FIGURE 49
(Continued)

| | | | | |
|---|---|---|---|---|
| iPS:434309 | AA | WASQSVYSSFLA SEQ ID NO:1544 | GASSRAT SEQ ID NO:9556 | QQYGTSPWT SEQ ID NO:17568 |
| 21-225_59B5 | NA | CGGGCAAGTCAGAGCATTAT CAGCTATTTAAAT SEQ ID NO:1545 | GGTGCATCCAGTTTGCA GAGT SEQ ID NO:9557 | CAACAGAGTTACAGTACCCC TATGTTCAGT SEQ ID NO:17569 |
| iPS:434311 | AA | RASQSISYLN SEQ ID NO:1546 | GASSLQS SEQ ID NO:9558 | QQSYSTPMFS SEQ ID NO:17570 |
| 21-225_59H5 | NA | AGGGCCAGTCAGAGTGTTAG CAGCATCTACTTAGCC SEQ ID NO:1547 | GGTGCATCCAGCAGGGC CACT SEQ ID NO:9559 | CACCAGTATGGTAACTCACC ATTCACT SEQ ID NO:17571 |
| iPS:434313 | AA | RASQSVSSIYLA SEQ ID NO:1548 | GASSRAT SEQ ID NO:9560 | HQYGNSPFT SEQ ID NO:17572 |
| 21-225_59E6 | NA | CGGGCAAGTCAGGGCATTAG AAATGATTAGGC SEQ ID NO:1549 | GCTGCATCCAGTTTGCAA AGT SEQ ID NO:9561 | CTACAGCATAATAGTTACCC GCTCACT SEQ ID NO:17573 |
| iPS:434315 | AA | RASQGIRNDLG SEQ ID NO:1550 | AASSLQS SEQ ID NO:9562 | LQHNSYPLT SEQ ID NO:17574 |
| 21-225_59G7 | NA | CGGGCAAGTCAGGGCATTAG AAATGATTAGGC SEQ ID NO:1551 | TCTGCATCCAGTTTACAA AGT SEQ ID NO:9563 | CTACAGCATAATAGTTACAA GTGGACG SEQ ID NO:17575 |
| iPS:434317 | AA | RASQGIRNDLG SEQ ID NO:1552 | SASSLQS SEQ ID NO:9564 | LQHNSYPWT SEQ ID NO:17576 |
| 21-225_59E8 | NA | CGGGCAAGTCAGAGCATTAG CAGCTATTTAAAT SEQ ID NO:1553 | GCTGCATCCAGTTTGCAA AGT SEQ ID NO:9565 | CAACAGAGTTCAGTAATTC GATCACC SEQ ID NO:17577 |
| iPS:434319 | AA | RASQSISSYLN SEQ ID NO:1554 | AASSLQS SEQ ID NO:9566 | QQSFSNSIT SEQ ID NO:17578 |
| 21-225_59B9 | NA | CGGGCAAGTCAGGACATTAG AAATGATTAGGC SEQ ID NO:1555 | GCTGCATCCAGTTACAA AGT SEQ ID NO:9567 | CTACAGCATAATAGTTACCC GTGGACG SEQ ID NO:17579 |

FIGURE 49
(Continued)

| | | | | | | |
|---|---|---|---|---|---|---|
| iPS:434321 | | AA | RASQDIRNDLG<br>SEQ ID NO:1556 | AASSLQS<br>SEQ ID NO:9568 | LQHNSYPWT<br>SEQ ID NO:17580 |
| iPS:434323 | 21-225_59F10 | NA | AAGTCCAGCCAGACTGTTTT<br>ATACAGGTCCAACAATTACA<br>ACTACTTAGCT<br>SEQ ID NO:1557 | TGGGCATCTACCCGGGA<br>ATCC<br>SEQ ID NO:9569 | CAGCAATATTTTAGTACTCC<br>TCCGACG<br>SEQ ID NO:17581 |
| | | AA | KSSQTVLYRSNNYNYLA<br>SEQ ID NO:1558 | WASTRES<br>SEQ ID NO:9570 | QQYFSTPPT<br>SEQ ID NO:17582 |
| iPS:434327 | 21-225_62H8 | NA | CGGGCAAGTCAGAGCATTTT<br>CAGCTATTTAAAT<br>SEQ ID NO:1559 | GGGTCATCCAGTTTGCAA<br>AGT<br>SEQ ID NO:9571 | CAACAGAGTTACAGTACCCC<br>ATTCACT<br>SEQ ID NO:17583 |
| | | AA | RASQSIFSYLN<br>SEQ ID NO:1560 | AASSLQS<br>SEQ ID NO:9572 | QQSYSTPFT<br>SEQ ID NO:17584 |
| iPS:434331 | 21-225_63G6 | NA | CGGGCAAGTCAGAGCATTTT<br>CAGCTATTTAAAT<br>SEQ ID NO:1561 | GATACATCCACTTGCAA<br>ACT<br>SEQ ID NO:9573 | CAACAGAGTTACGGTATCC<br>CATCACC<br>SEQ ID NO:17585 |
| | | AA | RASQSIFSYLN<br>SEQ ID NO:1562 | DTSTLQT<br>SEQ ID NO:9574 | QQSYGIPIT<br>SEQ ID NO:17586 |
| iPS:434333 | 21-225_63H8 | NA | CGGGCGAGTCAGGGCATTAG<br>CAATTATTTAGCC<br>SEQ ID NO:1563 | GCTGCATCCAGTTTGCAA<br>AGT<br>SEQ ID NO:9575 | CAACAATATCATAGTTACCC<br>ATTCACT<br>SEQ ID NO:17587 |
| | | AA | RASQGISNYLA<br>SEQ ID NO:1564 | AASSLQS<br>SEQ ID NO:9576 | QQYHSYPFT<br>SEQ ID NO:17588 |
| iPS:434335 | 21-225_63C9 | NA | CGGGCGAGTCAGGGTATTAG<br>CAGCTGGTTAGCC<br>SEQ ID NO:1565 | GCTGCATCCAGTTTGCAA<br>AGT<br>SEQ ID NO:9577 | CAACAGATTAACAGTTTCCC<br>TCTCACT<br>SEQ ID NO:17589 |
| | | AA | RASQGISSWLA<br>SEQ ID NO:1566 | AASSLQS<br>SEQ ID NO:9578 | QQINSFPLT<br>SEQ ID NO:17590 |
| | | NA | CGGGCAAGTCAGAGCATTTT<br>CAGCTATTTACAT | GCTGCATCCAGTTTACAA<br>AGT | CAACAGACTTACAGTCCCCC<br>GCTCACT |

FIGURE 49
(Continued)

| | | | | | | |
|---|---|---|---|---|---|---|
| iPS:434337 | 21-225_63C10 | AA | SEQ ID NO:1567<br>RASQSIFSYLH<br>SEQ ID NO:1568 | SEQ ID NO:9579<br>AASSLQS<br>SEQ ID NO:9580 | SEQ ID NO:17591<br>QQTYSPPLT<br>SEQ ID NO:17592 | |
| iPS:434339 | 21-225_64E1 | NA | CGGGCAAGTCAGGGCATTAG<br>AAATGATTAGGC<br>SEQ ID NO:1569 | GCTGCATCCAGTTGCAA<br>AGT<br>SEQ ID NO:9581 | CTACAGCATAATAGTTACCC<br>GCTCACT<br>SEQ ID NO:17593 | |
| | | AA | RASQGIRNDLG<br>SEQ ID NO:1570 | AASSLQS<br>SEQ ID NO:9582 | LQHNSYPLT<br>SEQ ID NO:17594 | |
| iPS:434341 | 21-225_64A4 | NA | CGGGCAAGTCAGGGCATTAG<br>AAATGATTAGGC<br>SEQ ID NO:1571 | GCTGCATCCAGTTGCAA<br>AGT<br>SEQ ID NO:9583 | CTACAGCATTATAGTTACCC<br>TCGGACG<br>SEQ ID NO:17595 | |
| | | AA | RASQGIRNDLG<br>SEQ ID NO:1572 | AASSLQS<br>SEQ ID NO:9584 | LQHYSYPRT<br>SEQ ID NO:17596 | |
| iPS:434343 | 21-225_64F7 | NA | CGGGCAAGTCAGAACATTAA<br>GAAATATTTAAAT<br>SEQ ID NO:1573 | GGTGCATCCAGTTGCA<br>AAGT<br>SEQ ID NO:9585 | CAACAGAGTTACAATATTTC<br>GTTCACT<br>SEQ ID NO:17597 | |
| | | AA | RASQNIKKYLN<br>SEQ ID NO:1574 | GASSLQS<br>SEQ ID NO:9586 | QQSYNISFT<br>SEQ ID NO:17598 | |
| iPS:434345 | 21-225_64C8 | NA | CGGGCAAGTCAGGGCATTAG<br>AAATGATTAGGC<br>SEQ ID NO:1575 | GCTGCATCCAGTTGCAA<br>AGT<br>SEQ ID NO:9587 | CTACACCATTATAGTTACCC<br>TCGGACG<br>SEQ ID NO:17599 | |
| | | AA | RASQGIRNDLG<br>SEQ ID NO:1576 | AASSLQS<br>SEQ ID NO:9588 | LHHYSYPRT<br>SEQ ID NO:17600 | |
| iPS:434347 | 21-225_64H9 | NA | AAGTCTAGTCAGAGCCTCCT<br>TCATGGTGATGGAAAGACCT<br>ATTTGTTT<br>SEQ ID NO:1577 | GAAGTTTCCAACCGGTT<br>GTGT<br>SEQ ID NO:9589 | ATGCAAAGTATACAGGTTCC<br>GTGGACG<br>SEQ ID NO:17601 | |
| | | AA | KSSQSLLHGDGKTYLF<br>SEQ ID NO:1578 | EVSNRLC<br>SEQ ID NO:9590 | MQSIQVPWT<br>SEQ ID NO:17602 | |

FIGURE 49
(Continued)

| | | | | | |
|---|---|---|---|---|---|
| iPS:434347 | 21-225_64H10 | NA | CGGGGGAGTCAGGGTATTAG CAGCTGGTTAGCC SEQ ID NO:1579 | GCTGCATCCAGTTTGCAA AGT SEQ ID NO:9591 | CAACAGATTAACAGTTTCCC TCTCACT SEQ ID NO:17603 |
| | | AA | RASQGISSWLA SEQ ID NO:1580 | AASSLQS SEQ ID NO:9592 | QQINSFPLT SEQ ID NO:17604 |
| iPS:434351 | 21-225_64A12 | NA | CGGGCAAGTCAGGGCATTAG AAATGATTTAGGC SEQ ID NO:1581 | ACTGCATCCACTTTGCAA AGT SEQ ID NO:9593 | CTACAGCATAATGGTTACCC ATTCACT SEQ ID NO:17605 |
| | | AA | RASQGIRNDLG SEQ ID NO:1582 | TASTLQS SEQ ID NO:9594 | LQHNGYPFT SEQ ID NO:17606 |
| iPS:434353 | 21-225_64B12 | NA | CGGGCGAGTCAGGACATTAG CAATTATTTAAAT SEQ ID NO:1583 | GATGCATCCATTTTGAAA ACA SEQ ID NO:9595 | CAACAGAGTGATAATCTCCC GTGCAGT SEQ ID NO:17607 |
| | | AA | RASQDISNYLN SEQ ID NO:1584 | DASILET SEQ ID NO:9596 | QQSDNLPCS SEQ ID NO:17608 |
| iPS:434355 | 21-225_64G12 | NA | CGGGCGAGTCAGAATATTAC CACCTGGTTAGCC SEQ ID NO:1585 | GCTGCATCCAGTTGCAA AGT SEQ ID NO:9597 | CAACAGGCTAACAGTTTCC ATTCACT SEQ ID NO:17609 |
| | | AA | RASQNITTWLA SEQ ID NO:1586 | AASSLQS SEQ ID NO:9598 | QQANSFPFT SEQ ID NO:17610 |
| iPS:434357 | 21-225_65C1 | NA | CGGGCGAGTCAGGTCATTAG CAGTTATTTACAT SEQ ID NO:1587 | AGTGCATCCAATTGCA ATGT SEQ ID NO:9599 | CAACGGCCTTACAATGCCC GCTCACT SEQ ID NO:17611 |
| | | AA | RASQVISSYLH SEQ ID NO:1588 | SASNLQC SEQ ID NO:9600 | QRPYNAPLT SEQ ID NO:17612 |
| iPS:434359 | 21-225_65G3 | NA | CGGGCGAGTCAGGGTATTAG CAGCTGGTTAGCC SEQ ID NO:1589 | GCTGCATCCAGTTTGCAA AGT SEQ ID NO:9601 | CAACAGGTTAACAGTTTCCC TCTCACT SEQ ID NO:17613 |
| | | AA | RASQGISSWLA SEQ ID NO:1590 | AASSLQS SEQ ID NO:9602 | QQVNSFPLT SEQ ID NO:17614 |

FIGURE 49
(Continued)

| | | | | | |
|---|---|---|---|---|---|
| iPS:434361 | 21-225_65D5 | NA | CGGGGGAGTCAGGACATTAA CAATTATTAGCC SEQ ID NO:1591 | GCTGCATCCAGTTTGCAC AGT SEQ ID NO:9603 | CCACTGTATAAAAGTTATCC ACTCACT SEQ ID NO:17615 |
| | | AA | RASQDINNYLA SEQ ID NO:1592 | AASSLHS SEQ ID NO:9604 | PLYKSYPLT SEQ ID NO:17616 |
| iPS:434363 | 21-225_65A6 | NA | AGGGCCAGTCAGAGTGTTAA CAGCAACTTAGCC SEQ ID NO:1593 | GGTGCATCCACCAGGGC CACT SEQ ID NO:9605 | CAGCAGTATAATGACTGGCC GTGCAGT SEQ ID NO:17617 |
| | | AA | RASQSVNSNLA SEQ ID NO:1594 | GASTRAT SEQ ID NO:9606 | QQYNDWPCS SEQ ID NO:17618 |
| iPS:434367 | 21-225_65H11 | NA | CGGGCGAGTCAGGACATTAG CACTTATTAGCC SEQ ID NO:1595 | GCTGCATCCAGTTTGCAA AGT SEQ ID NO:9607 | CAACAGTATAATAGTTTCCC TCTCACT SEQ ID NO:17619 |
| | | AA | RASQDISTYLA SEQ ID NO:1596 | AASSLQS SEQ ID NO:9608 | QQYNSFPLT SEQ ID NO:17620 |
| iPS:434369 | 21-225_66B1 | NA | CGGGCGAGTCAGGGTATTAG CAGCTGGTTAGCC SEQ ID NO:1597 | GCTGCATCCAGTTTGCAA AGT SEQ ID NO:9609 | CAACAGACTAACAGTTTCCC TCTCACT SEQ ID NO:17621 |
| | | AA | RASQGISSWLA SEQ ID NO:1598 | AASSLQS SEQ ID NO:9610 | QQTNSFPLT SEQ ID NO:17622 |
| iPS:434373 | 21-225_66A7 | NA | CGGGCGAGTCAGGGTATTAG CAGCTGGTTAGCC SEQ ID NO:1599 | GCTGCATCCAGTTTGCAA AGT SEQ ID NO:9611 | CAACAGATTAATAGTTTCCC TCTCACT SEQ ID NO:17623 |
| | | AA | RASQGISSWLA SEQ ID NO:1600 | AASSLQS SEQ ID NO:9612 | QQINSFPLT SEQ ID NO:17624 |
| iPS:434375 | 21-225_66C7 | NA | CGGGCGAGTCAGGGCATTAG CAATTATTTACAT SEQ ID NO:1601 | TGTTGCATCCAATTACAA TGT SEQ ID NO:9613 | CAACAGCATAATAATTCCCC GCTCACT SEQ ID NO:17625 |
| | | AA | RASQGISNYLH SEQ ID NO:1602 | CASNLQC SEQ ID NO:9614 | QQHNNSPLT SEQ ID NO:17626 |

FIGURE 49
(Continued)

| | | | | | |
|---|---|---|---|---|---|
| iPS:434379 | 21-225_66A9 | NA | CGGGCAAGTCAGAGAACATTTTCAGCTATTAAAT SEQ ID NO:1603 | GCTGCATCCAGTTTACAA AGT SEQ ID NO:9615 | CAACAGACTTACAGTGTCCC TTTCACT SEQ ID NO:17627 |
| | | AA | RASQNIFSYLN SEQ ID NO:1604 | AASSLQS SEQ ID NO:9616 | QQTYSVPFT SEQ ID NO:17628 |
| iPS:434383 | 21-225_66F9 | NA | CGGGCAAGTCAGGAGACATTAGAAATGTTTTAGGC SEQ ID NO:1605 | ACTGCATCCAGTTTACAA AGT SEQ ID NO:9617 | CTACAGTATAATAGTTACCC ATTCACT SEQ ID NO:17629 |
| | | AA | RASQDIRNVLG SEQ ID NO:1606 | TASSLQS SEQ ID NO:9618 | LQYNSYPFT SEQ ID NO:17630 |
| iPS:434385 | 21-225_66C10 | NA | CGGGCAAGTCAGGGCCATTAGAAATGATTTAGGC SEQ ID NO:1607 | CCTGCATCCAGTTTGCAA AGT SEQ ID NO:9619 | CTACAGTATAATAGTTACCC TCCGTGGACG SEQ ID NO:17631 |
| | | AA | RASQAIRNDLG SEQ ID NO:1608 | PASSLQS SEQ ID NO:9620 | LQYNSYPPWT SEQ ID NO:17632 |
| iPS:434387 | 21-225_66D11 | NA | CGGGCAAGTCAGGGCATTAGAAATGATTTAGGT SEQ ID NO:1609 | GCTGCATCCAGTGTCAA AGT SEQ ID NO:9621 | ATAGTGCATAATAGTTACCA TCGGACG SEQ ID NO:17633 |
| | | AA | RASQGIRNDLG SEQ ID NO:1610 | AASSCQS SEQ ID NO:9622 | IVHNSYPRT SEQ ID NO:17634 |
| iPS:434389 | 21-225_66F11 | NA | CGGGAGAGTCAGGGTATTAACATCTGGTTAGCC SEQ ID NO:1611 | GCTGCATCCAGTTTGCAA AGT SEQ ID NO:9623 | CAACAGGCTAACAGTTTCCC ATTCACT SEQ ID NO:17635 |
| | | AA | RESQGISIWLA SEQ ID NO:1612 | AASSLQS SEQ ID NO:9624 | QQANSFPFT SEQ ID NO:17636 |
| iPS:434393 | 21-225_67C3 | NA | AGGGCCAGTCAGAGTGTTAACAGCAACTTAGCC SEQ ID NO:1613 | ATTGCATCCACCAGGGC CACT SEQ ID NO:9625 | CAGCAGTATAATGACTGGCC GTGTAGT SEQ ID NO:17637 |
| | | AA | RASQSVNSNLA SEQ ID NO:1614 | IASTRAT SEQ ID NO:9626 | QQYNDWPCS SEQ ID NO:17638 |

FIGURE 49
(Continued)

| | | | | |
|---|---|---|---|---|
| iPS:434397 | 21-225_67H4 | NA | CGGGCGAGTCAGGGTATTAG CAGCTGGTTAGCC SEQ ID NO:1615 | GCTGCATCCAGTTTGCAA AGT SEQ ID NO:9627 | CAACAGATTAACAGTTTCCC TCTCACT SEQ ID NO:17639 |
| | | AA | RASQGISSWLA SEQ ID NO:1616 | AASSLQS SEQ ID NO:9628 | QQINSFPLT SEQ ID NO:17640 |
| iPS:434399 | 21-225_67B7 | NA | CGGGCAAGTCAGGGCATTAG AAATGATTTAGGC SEQ ID NO:1617 | GCTGCATCCAGTTTGCAA AGT SEQ ID NO:9629 | CTACACCATAATAGTTATCC ATTCAAA SEQ ID NO:17641 |
| | | AA | RASQGIRNDLG SEQ ID NO:1618 | AASSLQS SEQ ID NO:9630 | LHHNSYPFK SEQ ID NO:17642 |
| iPS:434405 | 21-225_68E6 | NA | CGGGCGAGTCAGGGCATTAG CTATTATTAGGC SEQ ID NO:1619 | GTTGCATCCAGTTTGCAA AGT SEQ ID NO:9631 | CAACAGTATGATAGTTACCC ATTCACT SEQ ID NO:17643 |
| | | AA | RASQGISYYLA SEQ ID NO:1620 | VASSLQS SEQ ID NO:9632 | QQYDSYPFT SEQ ID NO:17644 |
| iPS:434407 | 21-225_68C8 | NA | CGGGCAAGTCAGGGCATTAG AAATAATTTAGGC SEQ ID NO:1621 | GCTGCATCCAGTGTGCA AAGT SEQ ID NO:9633 | CTACAGTATAATAGTTACCC ATTCACT SEQ ID NO:17645 |
| | | AA | RASQGIRNNLG SEQ ID NO:1622 | AASSVQS SEQ ID NO:9634 | LQYNSYPFT SEQ ID NO:17646 |
| iPS:434411 | 21-225_68F11 | NA | CGGGCAAGTCAGGGCATTAG AAATGATTTAGGC SEQ ID NO:1623 | GCTGCATCCAGTTTGCAA AGT SEQ ID NO:9635 | CTACAGCATAATAGTTATCC GTTCACT SEQ ID NO:17647 |
| | | AA | RASQGIRNDLG SEQ ID NO:1624 | AASSLQS SEQ ID NO:9636 | LQHNSYPFT SEQ ID NO:17648 |
| iPS:434413 | 21-225_68D12 | NA | CGGGCAAGTCAGGGCATTAG AAATGATTTAGGC SEQ ID NO:1625 | GCTGCATCCAGTTTGCAA AGT SEQ ID NO:9637 | CTACAGGATATAGTTACTTACC GCTCACT SEQ ID NO:17649 |
| | | AA | RASQGIRNDLG SEQ ID NO:1626 | AASSLQS SEQ ID NO:9638 | LQHSTYPLT SEQ ID NO:17650 |

FIGURE 49
(Continued)

| | | | | | |
|---|---|---|---|---|---|
| iPS:434417 | | NA | CGGGCAGGTCAGAGACCATTA CAATTATTTAAAT | GTTGGCGTCCAGTTTGCAA AGT | CAACAGAGTTACAGTACCCC ATTCACT |
| | 21-225_69C8 | | SEQ ID NO:1627 | SEQ ID NO:9639 | SEQ ID NO:17651 |
| | | AA | RAGQTIYNYLN | VASSLQS | QQSYSTPFT |
| | | | SEQ ID NO:1628 | SEQ ID NO:9640 | SEQ ID NO:17652 |
| iPS:434423 | | NA | CGGGGAGTCAGGGTGTTAG CAGGTGGTTAGCC | GCTGCATCCAGTTTGCAA AGT | CAACAGGCTAACAGTTCCC ATTCACT |
| | 21-225_70D1 | | SEQ ID NO:1629 | SEQ ID NO:9641 | SEQ ID NO:17653 |
| | | AA | RASQGVSRWLA | AASSLQS | QQANSFPFT |
| | | | SEQ ID NO:1630 | SEQ ID NO:9642 | SEQ ID NO:17654 |
| iPS:434425 | | NA | AGGGCCAGTCAGAGAGTGTTAA CAGCAACTTAGCC | ATTGCATCCACCAGGGC CACT | CAGCAGTATAATGACTGGCC GTGTAGT |
| | 21-225_70A5 | | SEQ ID NO:1631 | SEQ ID NO:9643 | SEQ ID NO:17655 |
| | | AA | RASQSVNSNLA | IASTRAT | QQYNDWPCS |
| | | | SEQ ID NO:1632 | SEQ ID NO:9644 | SEQ ID NO:17656 |
| iPS:434427 | | NA | CGGGGAGTCAGGGTATTAG CAAATGGTTAGCC | GCTGCATCCAGTTTGCAA AGT | CAACAGAGACTAACAGTTCCC TCTCACT |
| | 21-225_70D6 | | SEQ ID NO:1633 | SEQ ID NO:9645 | SEQ ID NO:17657 |
| | | AA | RASQGISKWLA | AASSLQS | QQTNSFPLT |
| | | | SEQ ID NO:1634 | SEQ ID NO:9646 | SEQ ID NO:17658 |
| iPS:434429 | | NA | CGGACAAGTCAGAGCATTTT CAACTATTTAAAT | ACTGCATCCAGTTTGCAA AGT | CAACAGAGTTACAGTATCC GCTCACT |
| | 21-225_70H6 | | SEQ ID NO:1635 | SEQ ID NO:9647 | SEQ ID NO:17659 |
| | | AA | RTSQSIFNYLN | TASSLQS | QQSYSIPLT |
| | | | SEQ ID NO:1636 | SEQ ID NO:9648 | SEQ ID NO:17660 |
| iPS:434431 | | NA | AAGTCCAGCAGGAGAGTGTTT ATACAGCTCCAACAATAACA ACTACTTGGCT | TGGGCATCTACCCGGGA ATCC | CAGCAATATTATAATATTCC TCCGACG |
| | 21-225_70E7 | | SEQ ID NO:1637 | SEQ ID NO:9649 | SEQ ID NO:17661 |
| | | AA | KSSQSVLYSSNNNNYLA | WASTRES | QQYYNIPPT |

FIGURE 49
(Continued)

| | | | | | | |
|---|---|---|---|---|---|---|
| iPS:434433 | 21-225_70E8 | NA | SEQ ID NO:1638 CGGGCAAGTCAGGGCATTAG AAAGGATTTAGGC | SEQ ID NO:9650 GCTGCATCCAGTTTGCAA AGT | SEQ ID NO:17662 CTACAGCATAATCGTTACCC GCTCACT |
| | | AA | SEQ ID NO:1639 RASQGIRKDLG | SEQ ID NO:9651 AASSLQS | SEQ ID NO:17663 LQHNRYPLT |
| iPS:434435 | 21-225_70C9 | NA | SEQ ID NO:1640 CGGGCGAGTCAGGATATTAG CAGCTGGTTAGCC | SEQ ID NO:9652 GCTGCATCCAGTTTGCAA AGT | SEQ ID NO:17664 CAACAGACTAACAGTTTCCC TCTCACT |
| | | AA | SEQ ID NO:1641 RASQDISSWLA | SEQ ID NO:9653 AASSLQS | SEQ ID NO:17665 QQTNSFPLT |
| iPS:434437 | 21-225_70A12 | NA | SEQ ID NO:1642 CGGGCGAGTCAGGGTATTAG CAGCTGGTTAGCC | SEQ ID NO:9654 GCTGCATCCAGTTTGCAA AGT | SEQ ID NO:17666 CAACAGATTAACAGTTTCCC TCTCACT |
| | | AA | SEQ ID NO:1643 RASQGISSWLA | SEQ ID NO:9655 AASSLQS | SEQ ID NO:17667 QQINSFPLT |
| iPS:434439 | 21-225_70E12 | NA | SEQ ID NO:1644 CGGGCAAGTCAGGGCATTAA CAATAATTTAAAC | SEQ ID NO:9656 GCTGCATCCAGTTTGCAA AGT | SEQ ID NO:17668 CTACAGCATAATAGTTACCC GCTCACT |
| | | AA | SEQ ID NO:1645 RASQGINNNLN | SEQ ID NO:9657 AASSLQS | SEQ ID NO:17669 LQHNSYPLT |
| iPS:434441 | 21-225_71A2 | NA | SEQ ID NO:1646 CGTGCAAGTCAGGGCATTAG AAATGATTTAGGA | SEQ ID NO:9658 ATTGCATTCAGATTGCAA ATT | SEQ ID NO:17670 ATACACCATAATAGTTACCC GTGGACG |
| | | AA | SEQ ID NO:1647 RASQGIRNDLG | SEQ ID NO:9659 IAFRLQI | SEQ ID NO:17671 IHHNSYPWT |
| iPS:434443 | 21-225_71G3 | NA | SEQ ID NO:1648 AAGTCCAGCCAGAGTGTTTT ACACAGCTCCAACAATAACA ACTACTTAGAT | SEQ ID NO:9660 TGGGCATCTACCCGGGA ATTC | SEQ ID NO:17672 CAACAATATTATATTACTCC GTGCAGT |
| | | | SEQ ID NO:1649 | SEQ ID NO:9661 | SEQ ID NO:17673 |

FIGURE 49
(Continued)

| | | | KSSQSVLHSSNNNYLD | WASTREF | QQYYITPCS |
|---|---|---|---|---|---|
| | | AA | | | SEQ ID NO:1674 |
| iPS:434447 | 21-225_71B6 | NA | CGGGCAAGTCAGGGCATTAG AAATGATTTAGAT | GCTTGCATCCAGTTTGCAA AGT | CTACAGCATAATAGTTACC ATTCACT |
| | | | SEQ ID NO:1651 | SEQ ID NO:9662 | SEQ ID NO:17675 |
| | | | RASQGIRNDLD | AASSLQS | LQHNSYPFT |
| | | AA | SEQ ID NO:1652 | SEQ ID NO:9663 | SEQ ID NO:17676 |
| iPS:434449 | 21-225_71H6 | NA | CGGGCAAGTCAGGGCATTAG AAATGTTTTAGGC | GCTTGCATCCAGTTTACAA AGT | CTACAGTATAATAGTTACC ATTCACT |
| | | | SEQ ID NO:1653 | SEQ ID NO:9664 | SEQ ID NO:17677 |
| | | | RASQGIRNVLG | AASSLQS | LQYNSYPFT |
| | | AA | SEQ ID NO:1654 | SEQ ID NO:9665 | SEQ ID NO:17678 |
| iPS:434451 | 21-225_71B7 | NA | CGGGCGAGTCAGGGTATTAG CAGCTGGTTAGCC | GCTTGCATCCAGTTTGCAA GGT | CAACAGACTAATAGTTTCCC TCTCACT |
| | | | SEQ ID NO:1655 | SEQ ID NO:9666 | SEQ ID NO:17679 |
| | | | RASQGISSWLA | AASSLQG | QQTNSFPLT |
| | | AA | SEQ ID NO:1656 | SEQ ID NO:9667 | SEQ ID NO:17680 |
| iPS:434453 | 21-225_71B11 | NA | CGGGCAAGTCAGGGCATTAG AAATGATTTAGAT | GCTTGCATCCAGTTTGCAA AGT | CTACAGCATAATAGTTACC ATTCACT |
| | | | SEQ ID NO:1657 | SEQ ID NO:9668 | SEQ ID NO:17681 |
| | | | RASQGIRNDLD | AASSLQS | LQHNTYPFT |
| | | AA | SEQ ID NO:1658 | SEQ ID NO:9669 | SEQ ID NO:17682 |
| iPS:434455 | 21-225_72F5 | NA | CGGGCAAGTCAGAACATTAG CAGCTATTTAAAT | GCTTGCATCCAGTTTGCAA AGT | CAACAGCTTACAGTACCC CACC |
| | | | SEQ ID NO:1659 | SEQ ID NO:9670 | SEQ ID NO:17683 |
| | | | RASQNISSYLN | AASSLQS | QQTYSTPT |
| | | AA | SEQ ID NO:1660 | SEQ ID NO:9671 | SEQ ID NO:17684 |
| iPS:434457 | 21-225_72G12 | NA | CGGGCGAGTCAGGGCATTAG CAGTTATTTAAAT | GGTGCTTCCAATTTGCAA TCT | CAACAGAATTACAATGCCC GCTCACT |
| | | | SEQ ID NO:1661 | SEQ ID NO:9672 | SEQ ID NO:17685 |
| | | | | SEQ ID NO:9673 | |

FIGURE 49
(Continued)

| | | | | | |
|---|---|---|---|---|---|
| iPS:434459 | 21-225_71A7 | AA | RASQGISSYLN<br>SEQ ID NO:1662 | GASNLQS<br>SEQ ID NO:9674 | QQNYNAPLT<br>SEQ ID NO:17686 |
| | | NA | CGGGCGAGTCAGGGTATTAG<br>CAGCTGGTTAGCC<br>SEQ ID NO:1663 | GCTGCATCCAGTTTGCAA<br>AGT<br>SEQ ID NO:9675 | CAACAGGTTAACAGTTTCCC<br>TCTCACT<br>SEQ ID NO:17687 |
| iPS:434461 | 21-225_73A3 | AA | RASQGISSWLA<br>SEQ ID NO:1664 | AASSLQS<br>SEQ ID NO:9676 | QQVNSFPLT<br>SEQ ID NO:17688 |
| | | NA | CGGGCGAGTCAGGGTATTAG<br>CAACTGGTTAGCC<br>SEQ ID NO:1665 | GCTGCATCCAGTTTGCAA<br>AGT<br>SEQ ID NO:9677 | CAACAGGTTAACAGTTTCCC<br>TCTCACT<br>SEQ ID NO:17689 |
| iPS:434463 | 21-225_73A6 | AA | RASQGISNWLA<br>SEQ ID NO:1666 | AASSLQS<br>SEQ ID NO:9678 | QQVNSFPLT<br>SEQ ID NO:17690 |
| | | NA | CGGGCAAGTCAGGGCATTAG<br>AAATGATTAGGC<br>SEQ ID NO:1667 | GCTGCATCCAGTTTGCAA<br>AGT<br>SEQ ID NO:9679 | CTACAGCATAATAGTTACC<br>ATTCACT<br>SEQ ID NO:17691 |
| iPS:434467 | 21-225_73H8 | AA | RASQGIRNDLG<br>SEQ ID NO:1668 | AASNLQS<br>SEQ ID NO:9680 | LQHNSYPPIT<br>SEQ ID NO:17692 |
| | | NA | CGGGCAAGTCAGGACATCA<br>GAAATGATTAGGC<br>SEQ ID NO:1669 | GCTGCATCCAGTTTGCAA<br>AGT<br>SEQ ID NO:9681 | ATACAGCATAATAGTTACC<br>TCCGATCACC<br>SEQ ID NO:17693 |
| iPS:434469 | 21-225_73C9 | AA | RASQDIRNDLG<br>SEQ ID NO:1670 | AASSLQS<br>SEQ ID NO:9682 | IQHNSYPPIT<br>SEQ ID NO:17694 |
| | | NA | CGGGCAAGTCAGGGCATTAG<br>AAATGATTAGGC<br>SEQ ID NO:1671 | GCTGCATCCAGTTTGCAA<br>AGT<br>SEQ ID NO:9683 | CTACAGCATTATAGTTACC<br>TCGGACG<br>SEQ ID NO:17695 |
| iPS:434471 | 21-225_75G3 | AA | RASQGIRNDLG<br>SEQ ID NO:1672 | AASSLQS<br>SEQ ID NO:9684 | LQHYSYPRT<br>SEQ ID NO:17696 |
| | | NA | AGGGCCCGTCAGAATGTTGA<br>CAGCAGCTACTTAGCC<br>SEQ ID NO:1673 | GGTGCATCCAGCAGGGC<br>CACT<br>SEQ ID NO:9685 | CAGCAGTATGAACGCTCACC<br>GTGGACG<br>SEQ ID NO:17697 |

FIGURE 49
(Continued)

| | | | | | | |
|---|---|---|---|---|---|---|
| | | | RARQNVDSSYLA | GASSRAT | QQYERSPWT | |
| | | AA | SEQ ID NO:1674 | SEQ ID NO:9686 | SEQ ID NO:17698 | |
| iPS:434473 | 21-225_76D1 | NA | AGGGCCAGTCAGAATATTTA CAGCAACTACCTAGCC SEQ ID NO:1675 | GGTGCATCCAGCAGGGC CACT SEQ ID NO:9687 | CAGCAGTATGAAAGTTCACC GTGGACG SEQ ID NO:17699 | |
| | | AA | RASQNIYSNYLA SEQ ID NO:1676 | GASSRAT SEQ ID NO:9688 | QQYESSPWT SEQ ID NO:17700 | |
| iPS:434475 | 21-225_74F9 | NA | AAGTCCAGCCAGAGTGTTT ATACAGCTCCAACAATTACA ACTACTTAGCT SEQ ID NO:1677 | TGGGCATCTACCCGGGA ATCC SEQ ID NO:9689 | CAGCAATATTATAGTAGTCC TCCGACG SEQ ID NO:17701 | |
| | | AA | KSSQSVLYSSNNYNYLA SEQ ID NO:1678 | WASTRES SEQ ID NO:9690 | QQYYSSPPT SEQ ID NO:17702 | |
| iPS:434477 | 21-225_74A6 | NA | AAGTCCAGCCAGAGTGTTT ACACAGCTCCAACAATAACA ATTACTTAGCC SEQ ID NO:1679 | TGGGCATCAACCCGGGA ATCC SEQ ID NO:9691 | CAGCAATATTTTAGTACTCC GTGGACG SEQ ID NO:17703 | |
| | | AA | KSSQSVLHSSNNNNYLA SEQ ID NO:1680 | WASTRES SEQ ID NO:9692 | QQYFSTPWT SEQ ID NO:17704 | |
| iPS:434479 | 21-225_76H1 | NA | AGGGCCAGTCAGAGTGTTAG CAGCAGTACTTAGTC SEQ ID NO:1681 | GGTGCATCCACCAGGGC CACT SEQ ID NO:9693 | CAGCAGTATGGTTGCTCACC GCTCACT SEQ ID NO:17705 | |
| | | AA | RASQSVSSSYLV SEQ ID NO:1682 | GASTRAT SEQ ID NO:9694 | QQYGCSPLT SEQ ID NO:17706 | |
| iPS:434481 | 21-225_74B10 | NA | AAGTCCAGCCAGAGTGTTT ACACAGCTCCAACAATAAGA ACTACTTAACT SEQ ID NO:1683 | TGGGCATCTACTCGGGA ATCC SEQ ID NO:9695 | CAGCAATATTATAGTATTCC TCCGACG SEQ ID NO:17707 | |
| | | AA | KSSQSVLHSSNNKNYLT SEQ ID NO:1684 | WASTRES SEQ ID NO:9696 | QQYYSIPPT SEQ ID NO:17708 | |

FIGURE 49
(Continued)

| | | | | | |
|---|---|---|---|---|---|
| iPS:434483 | 21-225_74C12 | NA | AAGTCCAGCCAGAGTGTTTT ATACAGTCCAACAATGCGA ACTACTTAGCT<br>SEQ ID NO:1685 | TGGGCATCTACCCGGGA ATCC<br>SEQ ID NO:9697 | CAGCAATATTATAGTACTCC GTGCAGT<br>SEQ ID NO:17709 |
| | | AA | KSSQSVLYSSNNANYLA<br>SEQ ID NO:1686 | WASTRES<br>SEQ ID NO:9698 | QQYYSTPCS<br>SEQ ID NO:17710 |
| iPS:434485 | 21-225_76D2 | NA | AGGGCCAGTGTGAGTGTGT CAACAGCTTAGCC<br>SEQ ID NO:1687 | GGTGCATCCACCAGGGC CACT<br>SEQ ID NO:9699 | CAGCAATATATGACTGGCC GTGCAGT<br>SEQ ID NO:17711 |
| | | AA | RASVSVVNSLA<br>SEQ ID NO:1688 | GASTRAT<br>SEQ ID NO:9700 | QQYNDWPCS<br>SEQ ID NO:17712 |
| iPS:434487 | 21-225_76G2 | NA | AAGTCCAGCCAGAGTGTTT ACACAGTCCAACAATTACA ACTACTTAGCT<br>SEQ ID NO:1689 | TGGGCATCTACCCGGGA ATCC<br>SEQ ID NO:9701 | CAGCAATATTATAGTTCTCC TCCGACG<br>SEQ ID NO:17713 |
| | | AA | KSSQSVLHSSNNYNYLA<br>SEQ ID NO:1690 | WASTRES<br>SEQ ID NO:9702 | QQYYSSPPT<br>SEQ ID NO:17714 |
| iPS:434489 | 21-225_74E4 | NA | CGGGCAAGTCAGGGCATTAG AAATGATTAGGC<br>SEQ ID NO:1691 | GCTGCATCCACTTTGCAA AGT<br>SEQ ID NO:9703 | CTACAGCATAGTAATTACC GCTCACT<br>SEQ ID NO:17715 |
| | | AA | RASQGIRNDLG<br>SEQ ID NO:1692 | AASTLQS<br>SEQ ID NO:9704 | LQHSNYPLT<br>SEQ ID NO:17716 |
| iPS:434493 | 21-225_76F3 | NA | AAGTCCAGCCAGAGTGTTT ATTCAGTCCAACAATTATA ATTACTTAGCT<br>SEQ ID NO:1693 | TGGGCATCTACCCGGGA ATCC<br>SEQ ID NO:9705 | CAGCAATATCATAGTTCTCC TCTGACG<br>SEQ ID NO:17717 |
| | | AA | KSSQSVLFSSNNYNYLA<br>SEQ ID NO:1694 | WASTRES<br>SEQ ID NO:9706 | QQYHSSPLT<br>SEQ ID NO:17718 |
| iPS:434495 | | NA | AGGGCCAGTCAGAATATTTA CAGCAGTTACTTAGCC | GGTGCATCCAGCAGGGC CACT | CAGCAGTATGAAAGCTCACC GTGGACC |

FIGURE 49
(Continued)

| | | | | | | |
|---|---|---|---|---|---|---|
| iPS:434497 | 21-225_74B2 | AA | SEQ ID NO:1695<br>RASQNIYSSYLA<br>SEQ ID NO:1696 | SEQ ID NO:9707<br>GASSRAT<br>SEQ ID NO:9708 | SEQ ID NO:17719<br>QQYESSPWT<br>SEQ ID NO:17720 | |
| iPS:434501 | 21-225_76A4 | NA | AGGGCCAGTCAGAGTGTTTA<br>CAGCAGTACTTAGCC<br>SEQ ID NO:1697 | GGTGCATCCAGCCGGGC<br>CACT<br>SEQ ID NO:9709 | CAGCACTCTGATAACTCACC<br>GTGGACG<br>SEQ ID NO:17721 |
| | | AA | RASQSVYSSYLA<br>SEQ ID NO:1698 | GASSRAT<br>SEQ ID NO:9710 | QHSDNSPWT<br>SEQ ID NO:17722 |
| iPS:434501 | 21-225_76G4 | NA | AGGGCCAGTCAGAGTGTTTA<br>CAGCAGTACTTAGCC<br>SEQ ID NO:1699 | GGTGCATCCAGCCGGGC<br>CACT<br>SEQ ID NO:9711 | CAGCACTCTGATAACTCACC<br>GTGGACG<br>SEQ ID NO:17723 |
| | | AA | RASQSVYSSYLA<br>SEQ ID NO:1700 | GASSRAT<br>SEQ ID NO:9712 | QHSDNSPWT<br>SEQ ID NO:17724 |
| iPS:434503 | 21-225_74D7 | NA | CGGGCAAGTCAGAGGCATTAG<br>AAATGATTTAGGC<br>SEQ ID NO:1701 | GCTGCATCCAGTTGCAA<br>AGT<br>SEQ ID NO:9713 | CTTCAGCATAGTAATTACCC<br>GCTCACT<br>SEQ ID NO:17725 |
| | | AA | RASQGIRNDLG<br>SEQ ID NO:1702 | AASSLQS<br>SEQ ID NO:9714 | LQHSNYPLT<br>SEQ ID NO:17726 |
| iPS:434507 | 21-225_74C5 | NA | AGGGCCAGTCAGAGTGTTAA<br>CAGCAACTACTTAGCC<br>SEQ ID NO:1703 | GGTGCATTCAGCAGGGC<br>CACT<br>SEQ ID NO:9715 | CAGCAGTATGAAAGCTCACC<br>GTGGACG<br>SEQ ID NO:17727 |
| | | AA | RASQSVNSNYLA<br>SEQ ID NO:1704 | GAFSRAT<br>SEQ ID NO:9716 | QQYESSPWT<br>SEQ ID NO:17728 |
| iPS:434509 | 21-225_76F5 | NA | AAGTCCAGCAGTCAGAGTATT<br>ACACAGTCCAACAGTTACA<br>ACTACTTAGCT<br>SEQ ID NO:1705 | TGGACATCTACCCGGGA<br>ATCC<br>SEQ ID NO:9717 | CAGCAATATTATAGTAGTCC<br>TCCGACG<br>SEQ ID NO:17729 |
| | | AA | KSSQSVLHSSNSYNYLA<br>SEQ ID NO:1706 | WTSTRES<br>SEQ ID NO:9718 | QQYYSSPPT<br>SEQ ID NO:17730 |

FIGURE 49
(Continued)

| | | | | | | |
|---|---|---|---|---|---|---|
| iPS:434511 | 21-225_74B11 | NA | AAGTCCAGCCAGAGTATTTT ATACAACTCCAACAATAACA ACTACTTAGCT SEQ ID NO:1707 | TGGGCATCTACCCGGGA ATCC SEQ ID NO:9719 | CAGCAATATTATAGCACTCC TCCTACT SEQ ID NO:17731 |
| | | AA | KSSQSILYNSNNNNYLA SEQ ID NO:1708 | WASTRES SEQ ID NO:9720 | QQYYSTPPT SEQ ID NO:17732 |
| iPS:434513 | 21-225_76A6 | NA | AGGGCCAGTCAGAGTGTTAG CAGCAGCTACTTAGCC SEQ ID NO:1709 | GGTGCATCCACCAGGGC CACT SEQ ID NO:9721 | CAGCAGTATGGTAACTCACC GCTCACT SEQ ID NO:17733 |
| | | AA | RASQSVSSSYLA SEQ ID NO:1710 | GASTRAT SEQ ID NO:9722 | QQYGNSPLT SEQ ID NO:17734 |
| iPS:434515 | 21-225_74A5 | NA | AGGGCCAGTCAGAGTGTTAG CAGCAGCTACTTAGTC SEQ ID NO:1711 | GGTGCATCCACCAGGGC CACT SEQ ID NO:9723 | CAGCAGTATGGTTGCTCACC GCTCACT SEQ ID NO:17735 |
| | | AA | RASQSVSSSYLV SEQ ID NO:1712 | GASTRAT SEQ ID NO:9724 | QQYGCSPLT SEQ ID NO:17736 |
| iPS:434517 | 21-225_76A7 | NA | AGGGCCAGTCCGAGTGTGA CAGCAGCTACTTAGCC SEQ ID NO:1713 | GGTGCATCCAGCAGGGC CCCT SEQ ID NO:9725 | CAGCAGTATGAAAGTTCACC GTGGACG SEQ ID NO:17737 |
| | | AA | RASPSVDSSYLA SEQ ID NO:1714 | GASSRAP SEQ ID NO:9726 | QQYESSPWT SEQ ID NO:17738 |
| iPS:434519 | 21-225_74C7 | NA | AGGACCAGTCCGAGTGTGA CAGCAGCTACTTAGCC SEQ ID NO:1715 | GGTGCATCCAGCAGGGC CACT SEQ ID NO:9727 | CAGCAGTATGAACGCTCACC GTGGACG SEQ ID NO:17739 |
| | | AA | RTSPNVDSSYLA SEQ ID NO:1716 | GASSRAT SEQ ID NO:9728 | QQYERSPWT SEQ ID NO:17740 |
| iPS:434523 | 21-225_75C3 | NA | AGGGCCAGTCAGAGTGTTAG CAGCAGGTACTTAGCC SEQ ID NO:1717 | GGTGCATCCAGCAGGGC CACT SEQ ID NO:9729 | CAGCATTATGATAGTCCACC GTGGACG SEQ ID NO:17741 |
| | | AA | RASQSVSSRYLA | GASSRAT | QHYDSSPWT |

FIGURE 49
(Continued)

| | | | | | | |
|---|---|---|---|---|---|---|
| iPS:434525 | 21-225_76E8 | NA | SEQ ID NO:1718 AAGTCCAGCCAGAGACTGTTTT ACACAGCTCCAACAATTATA ACTACTTAGCT | SEQ ID NO:9730 TGGACATCTACCCGGGA ATCC | SEQ ID NO:17742 CAGCAATATTTAGTAGTCC TCTGACG |
| | | AA | SEQ ID NO:1719 KSSQTVLHSSNNYNYLA | SEQ ID NO:9731 WTSTRES | SEQ ID NO:17743 QQYFSSPLT |
| iPS:434529 | 21-225_76B9 | NA | SEQ ID NO:1720 AGGGCCAGTCAGAGTGTTAG CAGCAGCTACTTAGTC | SEQ ID NO:9732 GGTGCATCCACCAGGGC CACT | SEQ ID NO:17744 CAGCAGTATGGTTGCTCACC GCTCACT |
| | | AA | SEQ ID NO:1721 RASQSVSSSYLV | SEQ ID NO:9733 GASTRAT | SEQ ID NO:17745 QQYGCSPLT |
| iPS:434531 | 21-225_76C9 | NA | SEQ ID NO:1722 AGGGCCAGTCAGAGTGTTAG CAGTTACTTATCC | SEQ ID NO:9734 GGTGCATCCAGCAGGGC CACT | SEQ ID NO:17746 CAGCAGTATGGTAGGTCACG GACG |
| | | AA | SEQ ID NO:1723 RASQVSSSYLS | SEQ ID NO:9735 GASSRAT | SEQ ID NO:17747 QQYGRSRT |
| iPS:434533 | 21-225_85F7 | NA | SEQ ID NO:1724 AGGGCCAGTCAGAATATTTA CAGCAACTACTTAGCC | SEQ ID NO:9736 GGTGCATCCAGCAGGGC CACT | SEQ ID NO:17748 CAGCAGTATGAAAGCTCACC GTGGACC |
| | | AA | SEQ ID NO:1725 RASQNIYSNYLA | SEQ ID NO:9737 GASSRAT | SEQ ID NO:17749 QQYESSPWT |
| iPS:434535 | 21-225_74C8 | NA | SEQ ID NO:1726 CGGGCGAGTCAGGGCATTGG CAAGTATTTAGCC | SEQ ID NO:9738 ACTACATCCAATTACAA AGT | SEQ ID NO:17750 CAACAGTACAGTAATTACC GCTCACT |
| | | AA | SEQ ID NO:1727 RASQGIGKYLA | SEQ ID NO:9739 TTSNLQS | SEQ ID NO:17751 QQYSNYPLT |
| iPS:434537 | 21-225_74E11 | NA | SEQ ID NO:1728 AGGGCCAGTCTGAGTGTTGT CAACAGCTTAGCC | SEQ ID NO:9740 GGTGCATCCACCAGGGC CACT | SEQ ID NO:17752 CAGCAGTATAATGACTGGCC GTGCAGT |
| | | | SEQ ID NO:1729 | SEQ ID NO:9741 | SEQ ID NO:17753 |

FIGURE 49
(Continued)

| | | | | | | |
|---|---|---|---|---|---|---|
| iPS:434539 | 21-225_74A2 | AA | RASLSVVNSLA | | GASTRAT | QQYNDWPCS |
| | | | SEQ ID NO:1730 | | SEQ ID NO:9742 | SEQ ID NO:17754 |
| | | NA | AGGTCTAGTCAGAGCCTCCTGCATAGTAATGGACACAACTTATTTGGAT | | TTGGGTTCTAATCGGGCCTCC | ATGCAACCTCTACAAACTCCGTTCACT |
| | | | SEQ ID NO:1731 | | SEQ ID NO:9743 | SEQ ID NO:17755 |
| iPS:434547 | 21-225_74H5 | AA | RSSQSLLHSNGHNYLD | | LGSNRAS | MQPLQTPFT |
| | | | SEQ ID NO:1732 | | SEQ ID NO:9744 | SEQ ID NO:17756 |
| | | NA | AGGGCCAGTCAGAGTGTTAACAGCAACTACTTAGCC | | GGTGCATCCAGCAGGGCCACT | CAGCAGTATGAAAGTCGCCGTGGACG |
| | | | SEQ ID NO:1733 | | SEQ ID NO:9745 | SEQ ID NO:17757 |
| iPS:434549 | 21-225_76E11 | AA | RASQSVNSNYLA | | GASSRAT | QQYESSPWT |
| | | | SEQ ID NO:1734 | | SEQ ID NO:9746 | SEQ ID NO:17758 |
| | | NA | AAGTCCGCCAGTCAGAGTGTTTTACACAGTCCAACAATTACAACTACTTAGCT | | TGGGCTTCTACCCGGAATCC | CAGCAATATATTAGTACTCCTCCGACG |
| | | | SEQ ID NO:1735 | | SEQ ID NO:9747 | SEQ ID NO:17759 |
| iPS:434551 | 21-225_75C4 | AA | KSRQSVLHSSNNYNYLA | | WASTRES | QQYSTPPT |
| | | | SEQ ID NO:1736 | | SEQ ID NO:9748 | SEQ ID NO:17760 |
| | | NA | AAGTCCAGCCAGAGTATTTTATACAGTCCAACAATAATAACTACTTAGCT | | TGGGCATCTACCCGGGAATCC | CAGCAATATATTATTACTCCTCCGACG |
| | | | SEQ ID NO:1737 | | SEQ ID NO:9749 | SEQ ID NO:17761 |
| | | AA | KSSQSILYSSNNNNYLA | | WASTRES | QQYYITPPT |
| | | | SEQ ID NO:1738 | | SEQ ID NO:9750 | SEQ ID NO:17762 |
| iPS:434559 | 21-225_74D11 | NA | AGGGCCAGTCAGAGTGTTTACAGCAGTACTTAGCC | | GGTGCATCCAGCAGGGCCACT | CAGCACTATGATAACTCACGGTGGACG |
| | | | SEQ ID NO:1739 | | SEQ ID NO:9751 | SEQ ID NO:17763 |
| | | AA | RASQSVYSSYLA | | GASSRAT | QHYDNSPWT |
| | | | SEQ ID NO:1740 | | SEQ ID NO:9752 | SEQ ID NO:17764 |

FIGURE 49
(Continued)

| | | | | | |
|---|---|---|---|---|---|
| iPS:434561 | 21-225_77G1 | NA | AGGGCCAGTCAGAGTGTTTACAGCAGCTACTTAGCC SEQ ID NO:1741 | GGTGCATCCAGCCGGGCCACT SEQ ID NO:9753 | CAGCACTATGATAACTCACCGTGGACG SEQ ID NO:17765 |
| | | AA | RASQSVYSSYLA SEQ ID NO:1742 | GASSRAT SEQ ID NO:9754 | QHYDNSPWT SEQ ID NO:17766 |
| iPS:434563 | 21-225_75D8 | NA | AGGTCTAGTCAGAGCCTCCTGCATAGTAGTGGATACAACTATTGGAT SEQ ID NO:1743 | TTGGGTTCTAATCGGGCTCC SEQ ID NO:9755 | ATGCAAGCTCTACACCCTCCTCTCACT SEQ ID NO:17767 |
| | | AA | RSSQSLLHSSGYNYLD SEQ ID NO:1744 | LGSNRAS SEQ ID NO:9756 | MQALHPPLT SEQ ID NO:17768 |
| iPS:434565 | 21-225_75B10 | NA | AGGGCCAGTCCGAGTGTTAACAGCTACTACTTAGCC SEQ ID NO:1745 | GGTGCAACCAGCAGGGCCACT SEQ ID NO:9757 | CAGCAGTATGAAGACTCACCGTGGACG SEQ ID NO:17769 |
| | | AA | RASPSVNSYYLA SEQ ID NO:1746 | GATSRAT SEQ ID NO:9758 | QQYEDSPWT SEQ ID NO:17770 |
| iPS:434569 | 21-225_77H5 | NA | AGGGCCAGTCAGAGTGTTAGCAGCAGCTTAGCC SEQ ID NO:1747 | GGTGCATCCACCAGGGCCACT SEQ ID NO:9759 | CAGCAGTATAATGACTGGCCGTGCAGT SEQ ID NO:17771 |
| | | AA | RASQSVSSSLA SEQ ID NO:1748 | GASTRAT SEQ ID NO:9760 | QQYNDWPCS SEQ ID NO:17772 |
| iPS:434571 | 21-225_74D2 | NA | AGGGCCAGTCAGAGTGTTGACAGCAACTACTTAGCC SEQ ID NO:1749 | GGTGCATCCAGCAGGGCCCCT SEQ ID NO:9761 | CAGCAGTATGAAAGCTCACCGTGGACG SEQ ID NO:17773 |
| | | AA | RASQSVDSNYLA SEQ ID NO:1750 | GASSRAP SEQ ID NO:9762 | QQYESSPWT SEQ ID NO:17774 |
| iPS:434573 | 21-225_77E6 | NA | CGGGCGAGTCAGGGCATTAGCAAGTATTTAGCC SEQ ID NO:1751 | GCTGCATCCAGTTTGCAAGGT SEQ ID NO:9763 | CAACAGTACAGTAATTACCGCTCACT SEQ ID NO:17775 |
| | | AA | RASQGISKYLA | AASSLQG | QQYSNYPLT |

FIGURE 49
(Continued)

| | | | | | | |
|---|---|---|---|---|---|---|
| iPS:434575 | 21-225_77C7 | NA | SEQ ID NO:1752 AAGTCCAGCCAGAGTGTTTT ACACAGCTCCAACAATTATA ACTACTTAGCT | SEQ ID NO:9764 TGGACATCTACCGGGA ATCC | SEQ ID NO:17776 CAGCAATATTTAGTAGTCC TCCGACG |
| | | AA | SEQ ID NO:1753 KSSQTVLHSSNNYNYLA | SEQ ID NO:9765 WTSTRES | SEQ ID NO:17777 QQYFSSPPT |
| iPS:434579 | 21-225_77F7 | NA | SEQ ID NO:1754 AGGGCCAGTCAGAGTGTTA CAGCAGCTACTTAGCG | SEQ ID NO:9766 GGTGCATCCAGCCGGGC CACT | SEQ ID NO:17778 CAGCACTATGATAACTCACC GTGGACG |
| | | AA | SEQ ID NO:1755 RASQSVYSSYLA | SEQ ID NO:9767 GASSRAT | SEQ ID NO:17779 QHYDNSPWT |
| iPS:434581 | 21-225_74B12 | NA | SEQ ID NO:1756 AGGGCCAGTCAGAGTGTTA CAGCAGCTACTTAGCC | SEQ ID NO:9768 GGTGCATCCAGCCGGTC CACT | SEQ ID NO:17780 CAGCACTATGATAACTCACC GTGGACG |
| | | AA | SEQ ID NO:1757 RASQSVYSSYLA | SEQ ID NO:9769 GASSRST | SEQ ID NO:17781 QHYDNSPWT |
| iPS:434583 | 21-225_74B6 | NA | SEQ ID NO:1758 AGGGCCAGTCAGAGTGTTAG CAGCAGCTACTTAGCG | SEQ ID NO:9770 GGTGCATCCACCAGGGC CACT | SEQ ID NO:17782 CAGCAGTATGGTAACTCACC GCTCACT |
| | | AA | SEQ ID NO:1759 RASQSVSSSYLA | SEQ ID NO:9771 GASTRAT | SEQ ID NO:17783 QQYGNSPLT |
| iPS:434585 | 21-225_75A12 | NA | SEQ ID NO:1760 AGGGCCAGTCAGAGTGTTAG CAGCAGCTACTTAGCG | SEQ ID NO:9772 GGTGCATCCAGCAGGGC CACT | SEQ ID NO:17784 CAGCATTATGATAGCTCACC GTGGACG |
| | | AA | SEQ ID NO:1761 RASQSVSSRYLA | SEQ ID NO:9773 GASSRAT | SEQ ID NO:17785 QHYDSSPWT |
| iPS:434587 | 21-225_74G3 | NA | SEQ ID NO:1762 AGGGCCAGTCAGAGTGTTAG CAGCAGCTACTTAGTC | SEQ ID NO:9774 GGTGCATCCACCAGGGC CACT | SEQ ID NO:17786 CAGCAGTATGGTTGCTCACC GCTCACT |
| | | | SEQ ID NO:1763 | SEQ ID NO:9775 | SEQ ID NO:17787 |

FIGURE 49
(Continued)

| | | | | | | | QQYGCSPLT |
|---|---|---|---|---|---|---|---|
| | | | RASQSVSSSYLV | GASTRAT | | | SEQ ID NO:17788 |
| iPS:434595 | | AA | SEQ ID NO:1764 | SEQ ID NO:9776 | | | |
| | 21-225_77A10 | NA | AGGGCCAGTCAGAGTGTTCA CAGCAGGTACTTAGCC SEQ ID NO:1765 | GGTGCATCCAGCCAGGGC CACT SEQ ID NO:9777 | | | CAGCATTATGATAGCTCACC GTGGACG SEQ ID NO:17789 |
| | | AA | RASQSVHSRYLA SEQ ID NO:1766 | GASSRAT SEQ ID NO:9778 | | | QHYDSSPWT SEQ ID NO:17790 |
| iPS:434597 | 21-225_77C10 | NA | AAGTCCAGCCAGAGTGTTT ATACACCTCCAACAATAACA ACTACTTAGCT SEQ ID NO:1767 | TGGGCATCTACCCGGGA ATCC SEQ ID NO:9779 | | | CAGCACTATTATAATACTCC GTGGAAG SEQ ID NO:17791 |
| | | AA | KSSQSVLYTSNNNYLA SEQ ID NO:1768 | WASTRES SEQ ID NO:9780 | | | QHYNTPWK SEQ ID NO:17792 |
| iPS:434603 | 21-225_77D11 | NA | AGGGCCAGTCAGAGTGTTAG CAGCAGTCACTTAGTC SEQ ID NO:1769 | GGTGCATCCACCAGGGC GCTCACT SEQ ID NO:9781 | | | CAGCAGTATGGTTGCTCACC SEQ ID NO:17793 |
| | | AA | RASQSVSSSYLV SEQ ID NO:1770 | GASTRAT SEQ ID NO:9782 | | | QQYGCSPLT SEQ ID NO:17794 |
| iPS:434611 | 21-225_77C12 | NA | AGGGCCAGGCAGAGTGTTG ACAGCAGTTATTAGCC SEQ ID NO:1771 | GGTGCATCCAGCAGGGC CACT SEQ ID NO:9783 | | | CAGCAGTATGAAAGCTCACC GTGGACG SEQ ID NO:17795 |
| | | AA | RARQSVDSSYLA SEQ ID NO:1772 | GASSRAT SEQ ID NO:9784 | | | QQYESSPWT SEQ ID NO:17796 |
| iPS:434613 | 21-225_77D12 | NA | AGGTCCAGCCAGAGTGTTTT ATACAGCTCCAACAATTATA ACTACTTAGCT SEQ ID NO:1773 | TGGGCATCTACCCGGGA TTCC SEQ ID NO:9785 | | | CAGCAATATTATACTACTCC GTGCAGT SEQ ID NO:17797 |
| | | AA | RSSQSVLYSSNNYNYLA SEQ ID NO:1774 | WASTRDS SEQ ID NO:9786 | | | QQYYTPCS SEQ ID NO:17798 |

FIGURE 49
(Continued)

| | | | | | |
|---|---|---|---|---|---|
| iPS:434615 | 21-225_76C5 | NA | CGGGGGAGTCAGGTCATTAG CAAGTATTTAGCC SEQ ID NO:1775 | GCTGCATCCAGTTTGCAA AGT SEQ ID NO:9787 | CAACAGTACAGTAATTACCC GCTCACT SEQ ID NO:17799 |
| | | AA | RASQVISKYLA SEQ ID NO:1776 | AASSLQS SEQ ID NO:9788 | QQYSNYPLT SEQ ID NO:17800 |
| iPS:434617 | 21-225_74B8 | NA | AAGTCCAGCCAGAGTGTTT ACACAGTCTAATAAAAAGA ACTACTTAGCT SEQ ID NO:1777 | TGGGCATCTACCCGGGA ATCC SEQ ID NO:9789 | CAGCAATATTATAGGACTCC GTGGACG SEQ ID NO:17801 |
| | | AA | KSSQSVLHSSNKKNYLA SEQ ID NO:1778 | WASTRES SEQ ID NO:9790 | QQYYRTPWT SEQ ID NO:17802 |
| iPS:434619 | 21-225_78C1 | NA | AAGTCCAGCCAGAGTGTTT ATACACCTCCAACAATAACA ACTACTTAGCT SEQ ID NO:1779 | TGGGCATCTACCCGGGA ATCC SEQ ID NO:9791 | CAGCACTATTATAATACTCC GTGGAAG SEQ ID NO:17803 |
| | | AA | KSSQSVLYTSNNNNYLA SEQ ID NO:1780 | WASTRES SEQ ID NO:9792 | QHYNTPWK SEQ ID NO:17804 |
| iPS:434621 | 21-225_74D1 | NA | AGGGCCAGTCAGAGTGTTAG CAGAAATTTAGCC SEQ ID NO:1781 | GGTGCATCCATCAGGGC CACT SEQ ID NO:9793 | CAGCAGTATAATAACTGGCC TCCGCTCACT SEQ ID NO:17805 |
| | | AA | RASQSVSRNLA SEQ ID NO:1782 | GASIRAT SEQ ID NO:9794 | QQYNNWPPLT SEQ ID NO:17806 |
| iPS:434629 | 21-225_74C3 | NA | AGGGCCAGTCAGAGTGTTGC CAGCAGTTAGCC SEQ ID NO:1783 | GGTACATCCACCAGGGC CACT SEQ ID NO:9795 | CAGCAGTATAATGACTGGCC GTGCAGT SEQ ID NO:17807 |
| | | AA | RASQSVASSLA SEQ ID NO:1784 | GTSTRAT SEQ ID NO:9796 | QQYNDWPCS SEQ ID NO:17808 |
| iPS:434633 | 21-225_74G8 | NA | AGGGCCAGTCAGAGTTTAG CAGCGGCCTACTTAGCC SEQ ID NO:1785 | GGTACTTCCAGCAGGGC CACT SEQ ID NO:9797 | CAACAGTATGGTAACTCAAG GACG SEQ ID NO:17809 |

FIGURE 49
(Continued)

| | | | | | | | |
|---|---|---|---|---|---|---|---|
| iPS:434635 | 21-225_78E6 | AA | RASQSFSSAYLA SEQ ID NO:1786 | GTSSRAT SEQ ID NO:9798 | QQYGNSRT SEQ ID NO:17810 |
| | | NA | AAGTCCAGCCAGAGTGTTTT GTACAGCTCCAACAGTCACA GTACAGCTCCAACAGTCACA ACTACTTAGCT SEQ ID NO:1787 | TGGGCATCTATCCGGGA ATCC SEQ ID NO:9799 | CAGCAATATTATAGTACTCC GTGCAGT SEQ ID NO:17811 |
| iPS:434637 | 21-225_78E7 | AA | KSSQSVLYSSNSHNYLA SEQ ID NO:1788 | WASIRES SEQ ID NO:9800 | QQYYSTPCS SEQ ID NO:17812 |
| | | NA | AGGGCCAGTCAGAATGTTGA CAGCAACTACTTAGCC SEQ ID NO:1789 | GGTGCATCCAGCAGGGC CACT SEQ ID NO:9801 | CAGCAGTATGAACGCTCACC GTGGACG SEQ ID NO:17813 |
| iPS:434639 | 21-225_74B7 | AA | RASQNVDSNYLA SEQ ID NO:1790 | GASSRAT SEQ ID NO:9802 | QQYERSPWT SEQ ID NO:17814 |
| | | NA | AAGTCCAGCCAGAGTGTTTT ACACAGCTCCAACAATTATA ACTACTTAGCT SEQ ID NO:1791 | TGGACATCTACCCGGGA ATCC SEQ ID NO:9803 | CAGCAATATTTTAGTAGTCC TCCGACG SEQ ID NO:17815 |
| iPS:434649 | 21-225_78E11 | AA | KSSQTVLHSSNNYNYLA SEQ ID NO:1792 | WTSTRES SEQ ID NO:9804 | QQYFSSPPT SEQ ID NO:17816 |
| | | NA | AAGTCCAGCCAGAGTGTTTT ATACAGCTCAACAATTACA ACTACTTAGCT SEQ ID NO:1793 | TGGGCATCTACCCGGGA ATCC SEQ ID NO:9805 | CAGCAATATTATAGTAGTCC TCCGACG SEQ ID NO:17817 |
| iPS:434653 | 21-225_74B5 | AA | KSSQSVLYSFNNYNYLA SEQ ID NO:1794 | WASTRES SEQ ID NO:9806 | QQYYSSPPT SEQ ID NO:17818 |
| | | NA | AAGTCCAGCCAGAGTGTTTT ATTCAGCTCCAACAATTATA ACTACTTAGCT SEQ ID NO:1795 | TGGGCATCTACCCGGGA ATCC SEQ ID NO:9807 | CAGCAATATTATAGTTCTCC TCCGACG SEQ ID NO:17819 |
| | | AA | KSSQSVLFSSNNYNYLA | WASTRES | QQYYSSPPT |

FIGURE 49
(Continued)

| | | | | |
|---|---|---|---|---|
| iPS:434655 | 21-225_78H12 | NA | SEQ ID NO:1796 AAGTCCAGCCAGAGACTGTTT ACACAGTTCAACAATTATA ACTACTTAGCT | SEQ ID NO:9808 TGGACATCTACCGGA ATCC | SEQ ID NO:17820 CAGCAATATTTAGTAGTCC TCCGACG |
| | | AA | SEQ ID NO:1797 KSSQTVLHSFNNYNYLA | SEQ ID NO:9809 WTSTRES | SEQ ID NO:17821 QQYFSSPPT |
| iPS:434657 | 21-225_79G1 | NA | SEQ ID NO:1798 AGGGCCAGTCAGAGTGTTTA CAGCAGTACTTAGCC | SEQ ID NO:9810 GGTGCATCCAGCCGGTC CACT | SEQ ID NO:17822 CAGCACTATGATAACTCACC GTGGACG |
| | | AA | SEQ ID NO:1799 RASQSVYSSYLA | SEQ ID NO:9811 GASSRST | SEQ ID NO:17823 QHYDNSPWT |
| iPS:434663 | 21-225_79F3 | NA | SEQ ID NO:1800 AGGGCCAGTCAGAGTGTTTA CAGCAGTACTTAGCC | SEQ ID NO:9812 GGTGCATCCAGCCGGTC CACT | SEQ ID NO:17824 CAGCACTATGATAACTCACC GTGGACG |
| | | AA | SEQ ID NO:1801 RASQSVYSSYLA | SEQ ID NO:9813 GASSRST | SEQ ID NO:17825 QHYDNSPWT |
| iPS:434665 | 21-225_74G4 | NA | SEQ ID NO:1802 AAGTCCAGCCAGAGTGTTTT ATACAGTTCCAACAATAATA ACTACTTAGCT | SEQ ID NO:9814 TGGGCATCTACCCGGGA ATCC | SEQ ID NO:17826 CAGCAATATTATAGTATTCC TCCGACG |
| | | AA | SEQ ID NO:1803 KSSQSVLYSSNNNNYLA | SEQ ID NO:9815 WASTRES | SEQ ID NO:17827 QQYYSIPPT |
| iPS:434669 | 21-225_79F4 | NA | SEQ ID NO:1804 CGGGCGAGTCAGGGCATTAG CAAGTATTTAGCC | SEQ ID NO:9816 GCTGCATCCAGTTGCAA GGT | SEQ ID NO:17828 CAACAGTACAGTAATTACCC ACTCACT |
| | | AA | SEQ ID NO:1805 RASQGISKYLA | SEQ ID NO:9817 AASSLQG | SEQ ID NO:17829 QQYSNYPLT |
| iPS:434671 | | NA | SEQ ID NO:1806 AGGGCCAGTCAGATTTTAG CAGCAGTACTTAGCC | SEQ ID NO:9818 GGTGCATCCAGCAGGGC CACT | SEQ ID NO:17830 CAGCAGTATGGTAGCTCACG GACG |

FIGURE 49
(Continued)

| | | | | | | |
|---|---|---|---|---|---|---|
| iPS:434673 | 21-225_74F4 | AA | SEQ ID NO:1807<br>RASQIFSSSYLA | SEQ ID NO:9819<br>GASSRAT | SEQ ID NO:17831<br>QQYGSSRT | |
| | | NA | SEQ ID NO:1808<br>AGGGCCAGTCTGAGTGTTGT<br>CAACAGCTTAGCC | SEQ ID NO:9820<br>GGTGCATCCACCAGGGC<br>CACT | SEQ ID NO:17832<br>CAGCAGTATAATGACTGGCC<br>GTGCAGT | |
| iPS:434675 | 21-225_74E3 | AA | SEQ ID NO:1809<br>RASLSVVNSLA | SEQ ID NO:9821<br>GASTRAT | SEQ ID NO:17833<br>QQYNIDWPCS | |
| | | NA | SEQ ID NO:1810<br>ATGTCCAGCAGAGTGTTTT<br>ACACAGCTTCAACAATAAGA<br>ACTACTTAACT | SEQ ID NO:9822<br>TGGGCATCTACTTGGA<br>ATCC | SEQ ID NO:17834<br>CAGCAATATATTATAGTATTCC<br>TCCGACG | |
| iPS:434679 | 21-225_79G6 | AA | SEQ ID NO:1811<br>MSSQSVLHSFNKNYLT | SEQ ID NO:9823<br>WASTWES | SEQ ID NO:17835<br>QQYYSIPPT | |
| | | NA | SEQ ID NO:1812<br>AAGTCCAGCCAGAGTGTTTT<br>GTACAGTCCAACAGTCACA<br>ACTACTTAGCT | SEQ ID NO:9824<br>TGGGCATCTATCCGGGA<br>ATCC | SEQ ID NO:17836<br>CAGCAATATATTATAGTACTCC<br>GTGCAGT | |
| iPS:434685 | 21-225_79G7 | AA | SEQ ID NO:1813<br>KSSQSVLYSSNSHNYLA | SEQ ID NO:9825<br>WASIRES | SEQ ID NO:17837<br>QQYYSTPCS | |
| | | NA | SEQ ID NO:1814<br>AAGTCCAGCCAGAGTGTATTT<br>ATACAGTCCAACAATAATA<br>ACTACTTAGCT | SEQ ID NO:9826<br>TGGGCATCTACCCGGGA<br>ATCC | SEQ ID NO:17838<br>CAGCAATATATTATATTACTCC<br>TCCGACG | |
| iPS:434685 | 21-225_79E9 | AA | SEQ ID NO:1815<br>KSSQSILYSSNNNNYLA | SEQ ID NO:9827<br>WASTRES | SEQ ID NO:17839<br>QQYYITPPT | |
| | | NA | SEQ ID NO:1816<br>AGGGCCAGTCAGAGTGTTTA<br>CAGCAGCTACTTAGCC | SEQ ID NO:9828<br>GGTGCATCCAGCCGGGC<br>CACT | SEQ ID NO:17840<br>CAGCACTATGATAACTCACC<br>GTGGACG | |
| iPS:434687 | 21-225_75A5 | AA | SEQ ID NO:1817<br>RASQSVYSSYLA | SEQ ID NO:9829<br>GASSRAT | SEQ ID NO:17841<br>QHYDNSPWT | |

FIGURE 49
(Continued)

| | | | | | | |
|---|---|---|---|---|---|---|
| iPS:434689 | 21-225_79G10 | NA | SEQ ID NO:1818 AAGTCCAGGCAGAGTGTTT ATTCAGTCCAACAATTATA ATTACTTAGCT | SEQ ID NO:9830 TGGGCATCTACCCGGA ATCC | SEQ ID NO:17842 CAGCAATATCATAGTTCTCC TCTGACG |
| | | AA | SEQ ID NO:1819 KSSQSVLFSSNNYNYLA | SEQ ID NO:9831 WASTRES | SEQ ID NO:17843 QQYHSSPLT |
| iPS:434691 | 21-225_75G7 | NA | SEQ ID NO:1820 AGGGCCAGTCAGAGTGTTG ACAGCAGTATTAGCC | SEQ ID NO:9832 GGTGCATCCAGCAGGGC CACT | SEQ ID NO:17844 CAGCAGTATGAAAGCTCACC GTGGACG |
| | | AA | SEQ ID NO:1821 RARQSVDSSYLA | SEQ ID NO:9833 GASSRAT | SEQ ID NO:17845 QQYESSPWT |
| iPS:434693 | 21-225_79F11 | NA | SEQ ID NO:1822 AGGGCCAGTCAGAGTGTTTA CAGCAGTACTTAGCC | SEQ ID NO:9834 GGTGCATCCAGCCGGGC CACT | SEQ ID NO:17846 CAGCACTCTGATAACTCACC GTGGACG |
| | | AA | SEQ ID NO:1823 RASQSVYSSYLA | SEQ ID NO:9835 GASSRAT | SEQ ID NO:17847 QHSDNSPWT |
| iPS:434697 | 21-225_79F12 | NA | SEQ ID NO:1824 AAGTCCAGGCAGAGTATTTT ATACAGTCCAACAATTACA ACTACTTAGCT | SEQ ID NO:9836 TGGGCATCTACCCGGGA ATCC | SEQ ID NO:17848 CAGCAATATTATAGTACTCC GTGGACG |
| | | AA | SEQ ID NO:1825 KSSQSILYSSNNYNYLA | SEQ ID NO:9837 WASTRES | SEQ ID NO:17849 QQYYSTPWT |
| iPS:434699 | 21-225_79G12 | NA | SEQ ID NO:1826 AGGGCCAGTCAGAGTGTTTA CAGCAGTACTTAGCC | SEQ ID NO:9838 GGTGCATCCAGCCGGTC CACT | SEQ ID NO:17850 CAGCACTCTGATAACTCACC GTGGACG |
| | | AA | SEQ ID NO:1827 RASQSVYSSYLA | SEQ ID NO:9839 GASSRST | SEQ ID NO:17851 QHSDNSPWT |
| iPS:434701 | | NA | SEQ ID NO:1828 AGGGCCAGTCAGAGTGTTTA CAGCAGTACTTAGCC | SEQ ID NO:9840 GGTGCATCCAGCCGGTC CACT | SEQ ID NO:17852 CAGCACTCTGATAACTCACC GTGGACG |

FIGURE 49
(Continued)

| | | | | | | |
|---|---|---|---|---|---|---|
| iPS:434703 | 21-225_80A1 | | SEQ ID NO:1829 AGGGCCAGTCAGAGTGTTA CAGCAGTCTACTTAGCC | SEQ ID NO:9841 GASSRST | | SEQ ID NO:17853 QHSDNSPWT |
| | | AA | SEQ ID NO:1830 RASQSVYSSYLA | SEQ ID NO:9842 GASSRST | | SEQ ID NO:17854 CAGCACTCTGATAACTCACC GTGGACG |
| iPS:434705 | 21-225_80C1 | NA | SEQ ID NO:1831 AGGGCCAGTCAGAGTGTTAG CAGCAGTCTACTTAGTC | SEQ ID NO:9843 GASSRST | | SEQ ID NO:17855 QHSDNSPWT |
| | | AA | SEQ ID NO:1832 RASQSVYSSYLA | SEQ ID NO:9844 GASSRST | | SEQ ID NO:17856 CAGCAGTATGGTTGCTCACC GCTCACT |
| iPS:434707 | 21-225_80A2 | NA | SEQ ID NO:1833 RASQSVSSSYLV | SEQ ID NO:9845 GASTRAT | | SEQ ID NO:17857 QQYGCSPLT |
| | | AA | SEQ ID NO:1834 | SEQ ID NO:9846 | | SEQ ID NO:17858 |
| iPS:434709 | 21-225_80D3 | NA | AAGTCCAGCCAGAGTGTTTT ATACACCTCCAACAATAACA ACTACTTAGCT SEQ ID NO:1835 | TGGGCATCTACCGGGA ATCC SEQ ID NO:9847 | | CAGCACTACAATGAAACTCC AGGGAAG SEQ ID NO:17859 |
| | | AA | KSSQSVLYTSNNNNYLA SEQ ID NO:1836 | WASTRES SEQ ID NO:9848 | | QHYNETPGK SEQ ID NO:17860 |
| iPS:434709 | 21-225_80E3 | NA | AGGGCCAGTCAGAGTGTTTA CAGCAGTCTACTTAGCC SEQ ID NO:1837 | GGTGCATCCAGCCGGTC CACT SEQ ID NO:9849 | | CAGCATTCTGATAACTCACC GTGGACG SEQ ID NO:17861 |
| | | AA | RASQSVYSSYLA SEQ ID NO:1838 | GASSRST SEQ ID NO:9850 | | QHSDNSPWT SEQ ID NO:17862 |
| iPS:434711 | 21-225_80H3 | NA | AAGTCCAGCCAGAGTGTTTT ACACAGGTCCAACAATTACA ACTACTTAGCG SEQ ID NO:1839 | TGGGCATCTACCCGGGA ATCC SEQ ID NO:9851 | | CAGCAATATTATAGTACTCC TCCGACG SEQ ID NO:17863 |
| | | AA | KSSQSVLHRSNNYNYLA SEQ ID NO:1840 | WASTRES SEQ ID NO:9852 | | QQYYSTPPT SEQ ID NO:17864 |

FIGURE 49
(Continued)

| | | | | |
|---|---|---|---|---|
| iPS:434715 | 21-225_80D5 | NA | AGGGCCAGTCAGAGAATATTTA CAGCAGCTACTTAGCC SEQ ID NO:1841 | GGTGCATCCAGCAGGGC CACT SEQ ID NO:9853 | CAGCAGTATGAAAGCTCACC GTGGACC SEQ ID NO:17865 |
| | | AA | RASQNIYSSYLA SEQ ID NO:1842 | GASSRAT SEQ ID NO:9854 | QQYESSPWT SEQ ID NO:17866 |
| iPS:434717 | 21-225_80A6 | NA | AGGGCCAGTCAGAGTGTTGA CAGCGGCTACTTAGCC SEQ ID NO:1843 | GGTGCATCCAGCAGGGC CCCT SEQ ID NO:9855 | CAGCAGTATGAAAGCTCACC GTGGACG SEQ ID NO:17867 |
| | | AA | RASQSVDSGYLA SEQ ID NO:1844 | GASSRAP SEQ ID NO:9856 | QQYESSPWT SEQ ID NO:17868 |
| iPS:434725 | 21-225_80H7 | NA | AGGGCCAGTCAGAGTATTAA CAGCAACTACTTAGCC SEQ ID NO:1845 | GGTGCATCCAGCAGGGC CACT SEQ ID NO:9857 | CAGCAGTATGAGAGCTCACC GTGGACG SEQ ID NO:17869 |
| | | AA | RASQSINSNYLA SEQ ID NO:1846 | GASSRAT SEQ ID NO:9858 | QQYESSPWT SEQ ID NO:17870 |
| iPS:434729 | 21-225_80B12 | NA | AAGTCCAGACAGAGAGTGTTT ATACAGTCCAACAATTACA ACTACTTAACT SEQ ID NO:1847 | TGGGCATCTACCCGGGA ATCC SEQ ID NO:9859 | CAGCAATATTATATAGTTCTCC TCCTACT SEQ ID NO:17871 |
| | | AA | KSRQSVLYSSNNYNYLT SEQ ID NO:1848 | WASTRES SEQ ID NO:9860 | QQYYSSPPT SEQ ID NO:17872 |
| iPS:434731 | 21-225_80E9 | NA | AAGTCCAGCCAGAGTGTTT ATACACTCCAACAATAACA ACTACTTAGCT SEQ ID NO:1849 | TGGGCATCTACCCGGGA ATCC SEQ ID NO:9861 | CAGCAATATTATATAATACTCC GTGGACG SEQ ID NO:17873 |
| | | AA | KSSQSVLYTSNNNNYLA SEQ ID NO:1850 | WASTRES SEQ ID NO:9862 | QQYYNTPWT SEQ ID NO:17874 |
| iPS:434735 | 21-225_80B10 | NA | AGGGCCAGTCAGAGTGTTGA CAGCAGCTACTTAGCC SEQ ID NO:1851 | GGTGCATCCAGCAGGGC CCCT SEQ ID NO:9863 | CAGCAGTATGAAAGCTCACC GTGGACG SEQ ID NO:17875 |

FIGURE 49
(Continued)

| | | | | | | |
|---|---|---|---|---|---|---|
| iPS:434737 | 21-225_74G6 | AA | RASQSVDSSYLA SEQ ID NO:1852 | GASSRAP SEQ ID NO:9864 | QQYESSPWT SEQ ID NO:17876 | |
| | | NA | CGGGGCGAGTCAGGGCATTGG CAAGTATTAGCC SEQ ID NO:1853 | ACTACATCCAGTTGCAA AGT SEQ ID NO:9865 | CAACAGTACAGTAATTACC GCTCACT SEQ ID NO:17877 | |
| iPS:434741 | 21-225_80C11 | AA | RASQGIGKYLA SEQ ID NO:1854 | TTSSLQS SEQ ID NO:9866 | QQYSNYPLT SEQ ID NO:17878 | |
| | | NA | CGGGGCGAGTCAGGGCATTGG CAGGTATTAGCC SEQ ID NO:1855 | ACTGCATCCAGTTGCAA AGT SEQ ID NO:9867 | CAACAGTACAGTAATTACC GCTCACT SEQ ID NO:17879 | |
| iPS:434743 | 21-225_74A4 | AA | RASQGIGRYLA SEQ ID NO:1856 | TASSLQS SEQ ID NO:9868 | QQYSNYPLT SEQ ID NO:17880 | |
| | | NA | AGGGCCAGTCAGAGTGTTTA CAGCAGCTACTTAGCC SEQ ID NO:1857 | GGTGCATCCAGCCGGTC CACT SEQ ID NO:9869 | CAGCACTCTGATAACTCAC GTGGACG SEQ ID NO:17881 | |
| iPS:434747 | 21-225_80C12 | AA | RASQSVYSSYLA SEQ ID NO:1858 | GASSRST SEQ ID NO:9870 | QHSDNSPWT SEQ ID NO:17882 | |
| | | NA | AGGGCCAGTCAGAGTGTTAG CAGCAGCTACTTAGCC SEQ ID NO:1859 | GGTGCATCCACCAGGGC CACT SEQ ID NO:9871 | CAGCAGTATGGTAACTCAC GCTCACT SEQ ID NO:17883 | |
| iPS:434751 | 21-225_80H12 | AA | RASQSVSSSYLA SEQ ID NO:1860 | GASTRAT SEQ ID NO:9872 | QQYGNSPLT SEQ ID NO:17884 | |
| | | NA | AGGGCCAGTCAGAGTGTTTA CAGCAGCTACTTAGCC SEQ ID NO:1861 | GGTGCATCCAGCCGGTC CACT SEQ ID NO:9873 | CAGCACTCTGATAACTCAC GTGGACG SEQ ID NO:17885 | |
| iPS:434759 | 21-225_81C5 | AA | RASQSVYSSYLA SEQ ID NO:1862 | GASSRST SEQ ID NO:9874 | QHSDNSPWT SEQ ID NO:17886 | |
| | | NA | AGGGCCAGTCAGAGTGTTTA CAGCAGCTACTTAGCC SEQ ID NO:1863 | GGTGCATCCAGCCGGTC CACT SEQ ID NO:9875 | CAGCATTCTGATAACTCAC GTGGACG SEQ ID NO:17887 | |

FIGURE 49
(Continued)

| | | | | | | |
|---|---|---|---|---|---|---|
| iPS:434761 | | AA | RASQSVYSSYLA SEQ ID NO:1864 | GASSRST SEQ ID NO:9876 | QHSDNSPWT SEQ ID NO:17888 | |
| | 21-225_81E5 | NA | AAGTCCAGCCAGAGTGTTTT ATTCAGCTCCAACAATTATA ATTACTTAGCT SEQ ID NO:1865 | TGGGCATCTACCCGGGA ATCC SEQ ID NO:9877 | CAGCAATATTATAGTTCTCC TCTGACG SEQ ID NO:17889 | |
| iPS:434771 | | AA | KSSQSVLFSSNNYNYLA SEQ ID NO:1866 | WASTRES SEQ ID NO:9878 | QQYYSSPLT SEQ ID NO:17890 | |
| | 21-225_81F9 | NA | AAGTCCAGCCAGAGTGTTTT ATACACCTCCAACAATAACA ACTACTTAGCT SEQ ID NO:1867 | TGGGCATCTACCCGGGA ATCC SEQ ID NO:9879 | CAGCACTACAATGATACTCC AGGGAAG SEQ ID NO:17891 | |
| iPS:434773 | | AA | KSSQSVLYTSNNNNYLA SEQ ID NO:1868 | WASTRES SEQ ID NO:9880 | QHYNDTPGK SEQ ID NO:17892 | |
| | 21-225_75D9 | NA | AGGGCCAGTCAGAGTGTTAG CAGCAGCTACTTAGCC SEQ ID NO:1869 | GGTGCATCCAGCAGGGC CACT SEQ ID NO:9881 | CAGCAGTATGAAAGCTCACC GTGGACG SEQ ID NO:17893 | |
| iPS:434777 | | AA | RASQSVSSSYLA SEQ ID NO:1870 | GASSRAT SEQ ID NO:9882 | QQYESSPWT SEQ ID NO:17894 | |
| | 21-225_81C11 | NA | AGGGCCAGTCAGAGTGTTTA CAGCAGCTACTTAGCC SEQ ID NO:1871 | GGTGCATCCAGCCGGTC CACT SEQ ID NO:9883 | CAGCATTCTGATAACTCACC GTGGACG SEQ ID NO:17895 | |
| iPS:434793 | | AA | RASQSVSSSYLA SEQ ID NO:1872 | GASSRST SEQ ID NO:9884 | QHSDNSPWT SEQ ID NO:17896 | |
| | 21-225_82A5 | NA | AGGGCCAGTCAGAGTGTTAG CAGCAGCTACTTAGCC SEQ ID NO:1873 | GGTGCATCCACCAGGGC CACT SEQ ID NO:9885 | CAGCAGTATGGTAACTCACC GCTCACT SEQ ID NO:17897 | |
| | | AA | RASQSVSSSYLA SEQ ID NO:1874 | GASTRAT SEQ ID NO:9886 | QQYGNSPLT SEQ ID NO:17898 | |

FIGURE 49
(Continued)

| | | | | | | |
|---|---|---|---|---|---|---|
| iPS:434797 | 21-225_82G5 | NA | AGGGCCAGTGAGAGTGTTAG CAGCAGCTACTTAGTC SEQ ID NO:1875 | GGTGCATCCACCAGGGC CACT SEQ ID NO:9887 | CAGCAGTATGGTTGCTCACC GCTCACT SEQ ID NO:17899 |
| | | AA | RASESVSSSYLV SEQ ID NO:1876 | GASTRAT SEQ ID NO:9888 | QQYGCSPLT SEQ ID NO:17900 |
| iPS:434805 | 21-225_82D9 | NA | AGGGCCAGTGAGAGTGTTAG CAGCAGCTACTTAGTC SEQ ID NO:1877 | GGTGCATCCACCAGGGC CACT SEQ ID NO:9889 | CAGCAGTATGGTTGCTCACC GCTCACT SEQ ID NO:17901 |
| | | AA | RASESVSSSYLV SEQ ID NO:1878 | GASTRAT SEQ ID NO:9890 | QQYGCSPLT SEQ ID NO:17902 |
| iPS:434809 | 21-225_74F5 | NA | AGGGCCAGTCAGAGTGTTTA CAGCAGCTACTTAGCC SEQ ID NO:1879 | GGTGCATCCAGCCGGTC CACT SEQ ID NO:9891 | CAGCACTCTGATAACTCACC GTGGACG SEQ ID NO:17903 |
| | | AA | RASQSVYSSYLA SEQ ID NO:1880 | GASSRST SEQ ID NO:9892 | QHSDNSPWT SEQ ID NO:17904 |
| iPS:434813 | 21-225_82C12 | NA | AGGGCCAGTGAGAGTGTTAG CAGCAGCTACTTAGCC SEQ ID NO:1881 | GGTGCATCCACCAGGGC CTCT SEQ ID NO:9893 | CAGCAGTATGGTTGCTCACC GCTCACT SEQ ID NO:17905 |
| | | AA | RASQSVSSSYLA SEQ ID NO:1882 | GASTRAS SEQ ID NO:9894 | QQYGNSPLT SEQ ID NO:17906 |
| iPS:434815 | 21-225_74A11 | NA | CGGGCAAGTCAGGACATTAG AAATGATTTAGGC SEQ ID NO:1883 | GCTGCATCCAGTTGCAA AGT SEQ ID NO:9895 | CTACAGCATAATGATTACCC ATTCACT SEQ ID NO:17907 |
| | | AA | RASQDIRNDLG SEQ ID NO:1884 | AASSLQS SEQ ID NO:9896 | LQHNDYPFT SEQ ID NO:17908 |
| iPS:434821 | 21-225_83G1 | NA | AGGGCCAGTCAGAGTGTTTA CAGCAGCTACTTAGCC SEQ ID NO:1885 | GGTGCATCCAGCCGGTC CACG SEQ ID NO:9897 | CAGCACTCTGATAACTCACC GTGGACG SEQ ID NO:17909 |
| | | AA | RASQSVYSSYLA SEQ ID NO:1886 | GASSRST SEQ ID NO:9898 | QHSDNSPWT SEQ ID NO:17910 |

FIGURE 49
(Continued)

| | | | | | |
|---|---|---|---|---|---|
| iPS:434825 | 21-225_83C2 | NA | AGGGCCAGTCAGAGTGTTAG CAGCAGCTACTTAGTC SEQ ID NO:1887 | GGTGCATCCACCAGGGC CACT SEQ ID NO:9899 | CAGCAGTATGGTTGCTCACC GCTCACT SEQ ID NO:17911 |
| | | AA | RASQSVSSSYLV SEQ ID NO:1888 | GASTRAT SEQ ID NO:9900 | QQYGCSPLT SEQ ID NO:17912 |
| iPS:434827 | 21-225_83F3 | NA | AAGTCCAGCCAGAGTGTTT ATACACCTCCAACAATAACA ACTACTTAGCT SEQ ID NO:1889 | TGGGCATCTACCCGGGA ATCC SEQ ID NO:9901 | CAGCACTATAATGATACTCC ATGGAAG SEQ ID NO:17913 |
| | | AA | KSSQSVLYTSNNNNYLA SEQ ID NO:1890 | WASTRES SEQ ID NO:9902 | QHYNDTPWK SEQ ID NO:17914 |
| iPS:434829 | 21-225_83G3 | NA | AAGTCCAGCCAGAGTGTTT ATACACCTCCAACAATAACA ACTACTTAGCT SEQ ID NO:1891 | TGGGCATCTACCCGGGA ATCC SEQ ID NO:9903 | CAGCACTATTATAATACTCC GTGGACG SEQ ID NO:17915 |
| | | AA | KSSQSVLYTSNNNNYLA SEQ ID NO:1892 | WASTRES SEQ ID NO:9904 | QHYYNTPWT SEQ ID NO:17916 |
| iPS:434833 | 21-225_83C5 | NA | AGGGCCAGTGAGAGTGTTAG CAGCAGCTACTTAGTC SEQ ID NO:1893 | GGTGCATCCACCAGGGC CACT SEQ ID NO:9905 | CAGCAGTATGGTTGCTCACC GCTCACT SEQ ID NO:17917 |
| | | AA | RASESVSSSYLV SEQ ID NO:1894 | GASTRAT SEQ ID NO:9906 | QQYGCSPLT SEQ ID NO:17918 |
| iPS:434835 | 21-225_83B6 | NA | AGGGCCAGTCAGAGTGTTGA CAGCGGCTACTTAGCC SEQ ID NO:1895 | GGTGCATCCAGCAGGAC CCCT SEQ ID NO:9907 | CAGCAGTATGAAAGCTCACC GTGGACG SEQ ID NO:17919 |
| | | AA | RASQSVDSGYLA SEQ ID NO:1896 | GASSRTP SEQ ID NO:9908 | QQYESSPWT SEQ ID NO:17920 |
| iPS:434839 | 21-225_83B7 | NA | AGGGCCAGTCAGAGTGTTTA CAGCAGCTACTTAGCG SEQ ID NO:1897 | GGTGCATCCAGCCGGTC CACT SEQ ID NO:9909 | CAGCACTCTGATAACTCACC GTGGACG SEQ ID NO:17921 |

FIGURE 49
(Continued)

| | | | | | | | |
|---|---|---|---|---|---|---|---|
| iPS:434841 | 21-225_83G7 | AA | RASQSVYSSYLA<br>SEQ ID NO:1898 | GASSRST<br>SEQ ID NO:9910 | QHSDNSPWT<br>SEQ ID NO:17922 |
| | | NA | AAGTCCAGCCAGAGTGTTT<br>ACACAGCTCCAACAATTATA<br>ACTACTTAGCT<br>SEQ ID NO:1899 | TGGACATCTACCCGGGA<br>ATCC<br>SEQ ID NO:9911 | CAGCAATATTTTAGTAGTCC<br>TCTGACG<br>SEQ ID NO:17923 |
| iPS:434849 | 21-225_83C10 | AA | KSSQTVLHSSNNYNYLA<br>SEQ ID NO:1900 | WTSTRES<br>SEQ ID NO:9912 | QQYFSSPLT<br>SEQ ID NO:17924 |
| | | NA | AGGGCCAGGTCCGAGTGTCA<br>CAGCAACTACTACTACT<br>CAGCAACTACTTAGCC<br>SEQ ID NO:1901 | GGTGCATCCAGCAGGC<br>CACT<br>SEQ ID NO:9913 | CAGCAGTATGAAAGTTCACC<br>GTGGACG<br>SEQ ID NO:17925 |
| iPS:434851 | 21-225_75A6 | AA | RASPSVHSNYLA<br>SEQ ID NO:1902 | GASSRAT<br>SEQ ID NO:9914 | QQYESSPWT<br>SEQ ID NO:17926 |
| | | NA | AAGTCCAGACAGAGTGTTTT<br>ACACAGCTCCAACAATTACA<br>ACTACTTAGCT<br>SEQ ID NO:1903 | TGGGCATCTACCCGGGA<br>ATCC<br>SEQ ID NO:9915 | CAGCAATATATAGTACTCC<br>TCCTACT<br>SEQ ID NO:17927 |
| iPS:434863 | 21-225_84G7 | AA | KSRQSVLHSSNNYNYLA<br>SEQ ID NO:1904 | WASTRES<br>SEQ ID NO:9916 | QQYSTPPT<br>SEQ ID NO:17928 |
| | | NA | AAGTCCAGCCAGAGTGTTT<br>ACACAGCTCCAACAATTATA<br>ACTACTTAGCT<br>SEQ ID NO:1905 | TGGACATCTACCCGGGA<br>ATCC<br>SEQ ID NO:9917 | CAGCAATATTTTAGTAGTCC<br>TCCGACG<br>SEQ ID NO:17929 |
| iPS:434867 | 21-225_79A12 | AA | KSSQTVLHSSNNYNYLA<br>SEQ ID NO:1906 | WTSTRES<br>SEQ ID NO:9918 | QQYFSSPPT<br>SEQ ID NO:17930 |
| | | NA | CGGGGCGAGTCAGGTCATTAG<br>CAAGTATTTAGCC<br>SEQ ID NO:1907 | GCTGCATCCAGTTGCAA<br>AGT<br>SEQ ID NO:9919 | CAACAGTACAGTAATTACCC<br>GCTCACT<br>SEQ ID NO:17931 |
| | | AA | RASQVISKYLA<br>SEQ ID NO:1908 | AASSLQS<br>SEQ ID NO:9920 | QQYSNYPLT<br>SEQ ID NO:17932 |

FIGURE 49
(Continued)

| | | | | | |
|---|---|---|---|---|---|
| iPS:434869 | 21-225_84E12 | NA | AGGGCCAGTCAGAGTATTAACAGCAACTACTTAGCC SEQ ID NO:1909 | GGTGCATCCAGCAGGGCCACT SEQ ID NO:9921 | CAGCAGTATGAGAGCTCACCGTGGACG SEQ ID NO:17933 |
| | | AA | RASQSINSNYLA SEQ ID NO:1910 | GASSRAT SEQ ID NO:9922 | QQYESSPWT SEQ ID NO:17934 |
| iPS:434871 | 21-225_85H1 | NA | AGGGCCAGTCAGAGTGTTATCACCTACTTAGCC SEQ ID NO:1911 | GGTGCATCCACCAGGGCCACT SEQ ID NO:9923 | CAGGAGTATAATGACTGGCCGTGCAGT SEQ ID NO:17935 |
| | | AA | RASQDVITYLA SEQ ID NO:1912 | GASTRAT SEQ ID NO:9924 | QEYNDWPCS SEQ ID NO:17936 |
| iPS:434877 | 21-225_85H2 | NA | AAGTCCAGCCAGAGTGTTTTACACAGCTCTAATAAAAAGAACTACTTAGCT SEQ ID NO:1913 | TGGGCATCTACCCGGGAATCC SEQ ID NO:9925 | CAGCAATATTATAGGACTCCGTGGACG SEQ ID NO:17937 |
| | | AA | KSSQSVLHSSNKKNYLA SEQ ID NO:1914 | WASTRES SEQ ID NO:9926 | QQYYRTPWT SEQ ID NO:17938 |
| iPS:434879 | 21-225_85A3 | NA | AGGGCCAGTCAGAGTGTTTACAGCAGCTACTTAGCC SEQ ID NO:1915 | GGTGCATCCAGCCGGGCCAGT SEQ ID NO:9927 | CAGCACTATGATAACTCACCGTGGACG SEQ ID NO:17939 |
| | | AA | RASQSVYSSYLA SEQ ID NO:1916 | GASSRAS SEQ ID NO:9928 | QHYDNSPWT SEQ ID NO:17940 |
| iPS:434881 | 21-225_85B4 | NA | AGGGCCAGTCAGAGTGTTTACAGCAGCTACTTAGCC SEQ ID NO:1917 | GGTGCATCCAGCCGGGCCACT SEQ ID NO:9929 | CAGCACTATGATAACTCACCGTGGACG SEQ ID NO:17941 |
| | | AA | RASQSVYSSYLA SEQ ID NO:1918 | GASSRAT SEQ ID NO:9930 | QHYDNSPWT SEQ ID NO:17942 |
| iPS:434883 | 21-225_85B5 | NA | AGGTCCAGTCAGAGTGTTAGCAGCAGCTACTTAGTC SEQ ID NO:1919 | GGTGCATCCACCAGGGCCACT SEQ ID NO:9931 | CAGCAGTATGGTTGCTCACCGCTCACT SEQ ID NO:17943 |
| | | AA | RSSQSVSSSYLV | GASTRAT | QQYGCSPLT |

FIGURE 49
(Continued)

| | | | | | |
|---|---|---|---|---|---|
| iPS:434887 | 21-225_85D6 | NA | SEQ ID NO:1920<br>AGGGCCAGTCAGAGTGTTAG<br>CAGCAGGTACTTAGCC | SEQ ID NO:9932<br>GGTGCATCCAGCAGGGC<br>CACT | SEQ ID NO:17944<br>CAGCATTATGATAGCTCACC<br>GTGGACG |
| | | AA | SEQ ID NO:1921<br>RASQSVSSRYLA | SEQ ID NO:9933<br>GASSRAT | SEQ ID NO:17945<br>QHYDSSPWT |
| iPS:434891 | 21-225_85G6 | NA | SEQ ID NO:1922<br>AGGGCCAGTCCGAGTGTGA<br>CAGCAGCTACTTAGCC | SEQ ID NO:9934<br>GGTGCAGCCAGCAGGGC<br>CCCT | SEQ ID NO:17946<br>CAGCAGTATGAAAGTTCACC<br>GTGGACG |
| | | AA | SEQ ID NO:1923<br>RASPSVDSSYLA | SEQ ID NO:9935<br>GAASRAP | SEQ ID NO:17947<br>QQYESSPWT |
| iPS:434895 | 21-225_74H7 | NA | SEQ ID NO:1924<br>AGGGCCAGTCAGAATATTTA<br>CAGCAGCTACTTAGCC | SEQ ID NO:9936<br>GGTGCATCCAGCAGGGC<br>CACT | SEQ ID NO:17948<br>CAGCAGTATGAAAGTTCACC<br>GTGGACC |
| | | AA | SEQ ID NO:1925<br>RASQNIYSSYLA | SEQ ID NO:9937<br>GASSRAT | SEQ ID NO:17949<br>QQYESSPWT |
| iPS:434899 | 21-225_85B9 | NA | SEQ ID NO:1926<br>AGGGCCAGTCAGAGTGTTAA<br>CAGCAACTACTTAGCC | SEQ ID NO:9938<br>GGTGCATCCAGCAGGGC<br>CACT | SEQ ID NO:17950<br>CAGCAGTATGAAAGCTCGCC<br>GTGGACG |
| | | AA | SEQ ID NO:1927<br>RASQSVNSNYLA | SEQ ID NO:9939<br>GASSRAT | SEQ ID NO:17951<br>QQYESSPWT |
| iPS:434901 | 21-225_85H9 | NA | SEQ ID NO:1928<br>AAGTCCAGCAGTCAGAGTGTTTT<br>ACACAGGTCCAACAATTACA<br>ACTACTTAGCG | SEQ ID NO:9940<br>TGGGCATCTACCCGGGA<br>ATCC | SEQ ID NO:17952<br>CAGCAATATTATAGTACTCC<br>TCCGACG |
| | | AA | SEQ ID NO:1929<br>KSSQSVLHRSNNYNYLA | SEQ ID NO:9941<br>WASTRES | SEQ ID NO:17953<br>QQYYSTPPT |
| iPS:434907 | 21-225_85G10 | NA | SEQ ID NO:1930<br>AGGGCCAGTCAGAGTGTTTG<br>GAGCGGGTACTTAGCC | SEQ ID NO:9942<br>GGTGCATCTAGCAGGGC<br>CACT | SEQ ID NO:17954<br>CAGCAGTATGAGAGTTCACC<br>GTGGACG |
| | | | SEQ ID NO:1931 | SEQ ID NO:9943 | SEQ ID NO:17955 |

FIGURE 49
(Continued)

| | | | | | | | |
|---|---|---|---|---|---|---|---|
| iPS:434909 | 21-225_85C11 | AA | RASQSVWSGYLA SEQ ID NO:1932 | GASSRAT SEQ ID NO:9944 | QQYESSPWT SEQ ID NO:17956 |
| | | NA | AAGTCCAGCCAGAGTGTTT GTACAGTCCAAACAGTCACA ACTTCTTAGCT SEQ ID NO:1933 | TGGGCATTTATCCGGGA ATCC SEQ ID NO:9945 | CAGCAATATTATAGTACTCC GTGCAGT SEQ ID NO:17957 |
| iPS:434911 | 21-225_85D11 | AA | KSSQSVLYSSNSHNFLA SEQ ID NO:1934 | WAFIRES SEQ ID NO:9946 | QQYYSTPCS SEQ ID NO:17958 |
| | | NA | AGGTCCAGTCAGAGTGTTAG CAGCAGTACTTAGTC SEQ ID NO:1935 | GGTGCATCCACCAGGGC CACT SEQ ID NO:9947 | CAGCAGTATGGTGCTCACC GCTCACT SEQ ID NO:17959 |
| iPS:434913 | 21-225_86C1 | AA | RSSQSVSSSYLV SEQ ID NO:1936 | GASTRAT SEQ ID NO:9948 | QQYGCSPLT SEQ ID NO:17960 |
| | | NA | AGGGCCAGTCAGAGTGTTTA CAGCAGTACTTAGCC SEQ ID NO:1937 | GGTGCATCCAGCCGGGC CACT SEQ ID NO:9949 | CAGCACTATGATAACTCACC GTGGACG SEQ ID NO:17961 |
| iPS:434921 | 21-225_86E4 | AA | RASQSVYSSYLA SEQ ID NO:1938 | GASSRAT SEQ ID NO:9950 | QHYDNSPWT SEQ ID NO:17962 |
| | | NA | AGGGCCAGTCAGAGTGTTTA CAGCAGTACTTAGCC SEQ ID NO:1939 | GGTGCATCCAGCCGGTC CACT SEQ ID NO:9951 | CAGCACTCTGATAACTCACC GTGGACG SEQ ID NO:17963 |
| | | AA | RASQSVYSSYLA SEQ ID NO:1940 | GASSRST SEQ ID NO:9952 | QHSDNSPWT SEQ ID NO:17964 |
| iPS:434935 | 21-225_86E9 | NA | AAGTCCAGCCAGAGTGTTT GCACAGATCCAACAATTATA ATTACTTAGCT SEQ ID NO:1941 | TGGGCATCTACCCGGGA ATCC SEQ ID NO:9953 | CAGCAATATCATAGTAGTCC ACTGACG SEQ ID NO:17965 |
| | | AA | KSSQSVLHRSNNYNYLA SEQ ID NO:1942 | WASTRES SEQ ID NO:9954 | QQYHSSPLT SEQ ID NO:17966 |

FIGURE 49
(Continued)

| | | | | | |
|---|---|---|---|---|---|
| iPS:434939 | 21-225_86C11 | NA | AGGGCCAGTCAGAGTGTTTA CAGCAGTACTTAGCC SEQ ID NO:1943 | GGTGCATCCAGCCGGTC CACT SEQ ID NO:9955 | CAGCACTCTGATAACTCACC GTGGACG SEQ ID NO:17967 |
| | | AA | RASQSVYSSYLA SEQ ID NO:1944 | GASSRST SEQ ID NO:9956 | QHSDNSPWT SEQ ID NO:17968 |
| iPS:434943 | 21-225_87H1 | NA | AGGGCCAGTCAGAGTGTTGA CAGCAACTACTTAGCC SEQ ID NO:1945 | GGTGCATCTGCCAGGAC CACT SEQ ID NO:9957 | CAGCAGTATGAAAGCTCACC GTGGACG SEQ ID NO:17969 |
| | | AA | RASQSVDSNYLA SEQ ID NO:1946 | GASARTT SEQ ID NO:9958 | QQYESSPWT SEQ ID NO:17970 |
| iPS:434945 | 21-225_87E5 | NA | AGGGCCAGTCAGAGTGTTTA CAGCAGTACTTAGCC SEQ ID NO:1947 | GGTGCATCCAGCCGGTC CACT SEQ ID NO:9959 | CAGCATTCTGATAACTCACC GTGGACG SEQ ID NO:17971 |
| | | AA | RASQSVYSSYLA SEQ ID NO:1948 | GASSRST SEQ ID NO:9960 | QHSDNSPWT SEQ ID NO:17972 |
| iPS:434947 | 21-225_87B7 | NA | CGGGCGAGTCAGGGCATTAG CAATTATTTAGCC SEQ ID NO:1949 | GCTGCATCCAGTTGCAC AGT SEQ ID NO:9961 | CTACTCTATCTTACTTACCCG CTCACC SEQ ID NO:17973 |
| | | AA | RASQGISNYLA SEQ ID NO:1950 | AASSLHS SEQ ID NO:9962 | LLYLTYPLT SEQ ID NO:17974 |
| iPS:434955 | 21-225_87C9 | NA | AGGGCCAGTCAGAGTGTTTA CAGCAGTACTTAGCC SEQ ID NO:1951 | GGTGCATCCAGCCGGTC CACT SEQ ID NO:9963 | CAGCATTCTGATAACTCACC GTGGACG SEQ ID NO:17975 |
| | | AA | RASQSVYSSYLA SEQ ID NO:1952 | GASSRST SEQ ID NO:9964 | QHSDNSPWT SEQ ID NO:17976 |
| iPS:434957 | 21-225_87A10 | NA | AGGGCCAGTCAGAGTGTTAG CAGCAGTACTTAGCC SEQ ID NO:1953 | GGTGCATCCACCAGGGC CTCT SEQ ID NO:9965 | CAGCAGTATGGTAACTCACC GCTCACT SEQ ID NO:17977 |
| | | AA | RASQSVSSSYLA SEQ ID NO:1954 | GASTRAS SEQ ID NO:9966 | QQYGNSPLT SEQ ID NO:17978 |

FIGURE 49
(Continued)

| | | | | | | |
|---|---|---|---|---|---|---|
| iPS:434959 | 21-225_87E10 | NA | AAGTCCAGCCAGAGTGTTT ACACAGCTCCAACAATATGA ACTACTTAGCT SEQ ID NO:1955 | TGGGCATCTACCCGGAA ATCC SEQ ID NO:9967 | CAGCAATATTATAGTAGTCC GTGCAGT SEQ ID NO:17979 | |
| | | AA | KSSQSVLHSSNNMNYLA SEQ ID NO:1956 | WASTRKS SEQ ID NO:9968 | QQYYSSPCS SEQ ID NO:17980 | |
| iPS:434961 | 21-225_87A12 | NA | AGGGCCAGTCAGAGTGTTTA CAGCAGCTACTTAGCC SEQ ID NO:1957 | GGTGCATCCAGCCGGTC CACT SEQ ID NO:9969 | CAGCACTCTGATAACTCACC GTGGACG SEQ ID NO:17981 | |
| | | AA | RASQSVYSSYLA SEQ ID NO:1958 | GASSRST SEQ ID NO:9970 | QHSDNSPWT SEQ ID NO:17982 | |
| iPS:434965 | 21-225_88A1 | NA | AAGTCCAGCCAGAGTGTTT ACACAGCTCCAACAATTACA ACTACTTAACT SEQ ID NO:1959 | TGGGCATCTACCCGGAA ATCC SEQ ID NO:9971 | CAGCAATATTATAGTTCTCC TCCGACG SEQ ID NO:17983 | |
| | | AA | KSSQSVLHSSNNYNYLT SEQ ID NO:1960 | WASTRKS SEQ ID NO:9972 | QQYYSSPPT SEQ ID NO:17984 | |
| iPS:434969 | 21-225_88H1 | NA | AGGGCCAGTCAGAGTGTTTA CAGCAGCTACTTAGCC SEQ ID NO:1961 | GGTGCATCCAGCCGGTC CACG SEQ ID NO:9973 | CAGCATTCTGATAACTCACC GTGGACG SEQ ID NO:17985 | |
| | | AA | RASQSVYSSYLA SEQ ID NO:1962 | GASSRST SEQ ID NO:9974 | QHSDNSPWT SEQ ID NO:17986 | |
| iPS:434971 | 21-225_88G2 | NA | AAGTCCAGCCAGAGTGTTT ATACACCTCCAACAATAACA ACTACTTAGCT SEQ ID NO:1963 | TGGGCATCTACCCGGGA ATCC SEQ ID NO:9975 | CAGCAATATTATAATACTCC GTGGACG SEQ ID NO:17987 | |
| | | AA | KSSQSVLYTSNNNNYLA SEQ ID NO:1964 | WASTRES SEQ ID NO:9976 | QQYNTPWT SEQ ID NO:17988 | |

FIGURE 49
(Continued)

| | | | | | |
|---|---|---|---|---|---|
| iPS:434973 | 21-225_88B4 | NA | AAGTCCAGCCAGAGTGTTTT ATACATCTCAACAATAATA ATTACTTAGCT SEQ ID NO:1965 | TGGGCATCTACCCGGGA ATCC SEQ ID NO:9977 | CAGCAATATTATAGTACTCC TCCGACG SEQ ID NO:17989 |
| | | AA | KSSQSVLYISNNNNYLA SEQ ID NO:1966 | WASTRES SEQ ID NO:9978 | QQYYSTPPT SEQ ID NO:17990 |
| iPS:434977 | 21-225_88A5 | NA | CGGGCAAGTCAGGGCATTAG AAATGATTAGGC SEQ ID NO:1967 | GCTGCATCCAGTTTGCAA AGT SEQ ID NO:9979 | CTACAGCATAATGATTACCC ATTCACT SEQ ID NO:17991 |
| | | AA | RASQGIRNDLG SEQ ID NO:1968 | AASSLQS SEQ ID NO:9980 | LQHNDYPFT SEQ ID NO:17992 |
| iPS:434981 | 21-225_88E7 | NA | AGGGCCAGTCAGAGTGTTTA CAGCAGCTACTTAGCC SEQ ID NO:1969 | GGTGCATCCAGCCGGTC CACT SEQ ID NO:9981 | CAGCACTCTGATAACTCACC GTGGACG SEQ ID NO:17993 |
| | | AA | RASQSVYSSYLA SEQ ID NO:1970 | GASSRST SEQ ID NO:9982 | QHSDNSPWT SEQ ID NO:17994 |
| iPS:434983 | 21-225_88F7 | NA | AGGGCCAGTCAGAGTGTTTA CAGCAGCTACTTAGCC SEQ ID NO:1971 | GGTGCATCCAGCCGGTC CACT SEQ ID NO:9983 | CAGCACTCTGATAACTCACC GTGGACG SEQ ID NO:17995 |
| | | AA | RASQSVYSSYLA SEQ ID NO:1972 | GASSRST SEQ ID NO:9984 | QHSDNSPWT SEQ ID NO:17996 |
| iPS:434995 | 21-225_88G9 | NA | AGGGCCAGTCAGAGTGTTTA CAGCAGCTACTTAGCC SEQ ID NO:1973 | GGTGCATCCAGCCGGTC CACT SEQ ID NO:9985 | CAGCACTCTGATAACTCACC GTGGACG SEQ ID NO:17997 |
| | | AA | RASQSVYSSYLA SEQ ID NO:1974 | GASSRST SEQ ID NO:9986 | QHSDNSPWT SEQ ID NO:17998 |
| iPS:434997 | 21-225_88C10 | NA | AAGTCCAGCCAGAGTGTTTT ACACAGCTCAACAATTGGA ATTACTTAGCT SEQ ID NO:1975 | TGGGCATTTACTCGGAA ATCC SEQ ID NO:9987 | CAGCAATATTATAGAGCTCC TCCGACG SEQ ID NO:17999 |

FIGURE 49
(Continued)

| iPS | Clone | AA/NA | LC CDR1 | LC CDR2 | LC CDR3 |
|---|---|---|---|---|---|
| iPS:434999 | 21-225_75A8 | AA | KSSQSVLHSSNNWNYLA | WAFTRKS | QQYYRAPPT |
| | | NA | AGGGCCAGTCAGAGTGTTTACAGCAGCTACTTAGCC<br>SEQ ID NO:1976 | GGTGCATCCAGCCGGGCCACT<br>SEQ ID NO:9988 | CAGCACTCTGATAACTCACCGTGGACG<br>SEQ ID NO:18000 |
| iPS:435009 | 21-225_89G4 | AA | RASQSVYSSYLA<br>SEQ ID NO:1977 | GASSRAT<br>SEQ ID NO:9989 | QHSDNSPWT<br>SEQ ID NO:18001 |
| | | NA | AGGTCTAGTCAGAGCCTCTGCATAGTAGTGGATACAACTATTTGGAT<br>SEQ ID NO:1978 | TTGGGTTCTAATCGGGCTCC<br>SEQ ID NO:9990 | ATGCAAGCTCTACATATTCCTCTCACT<br>SEQ ID NO:18002 |
| iPS:435013 | 21-225_89D5 | AA | RSSQSLLHSSGYNYLD<br>SEQ ID NO:1979 | LGSNRAS<br>SEQ ID NO:9991 | MQALHIPLT<br>SEQ ID NO:18003 |
| | | NA | AGGGCCAGTCAGAGTGTTTACAGCAGCTACTTAGCC<br>SEQ ID NO:1980 | GGTGCATCCAGCCGGTCCACT<br>SEQ ID NO:9992 | CAGCACTATGATAACTCACCGTGGACG<br>SEQ ID NO:18004 |
| iPS:435015 | 21-225_89H5 | AA | RASQSVYSSYLA<br>SEQ ID NO:1981 | GASSRST<br>SEQ ID NO:9993 | QHYDNSPWT<br>SEQ ID NO:18005 |
| | | NA | AGGGCCAGTCAGAGTGTTAACAGCAACTACTTAGCC<br>SEQ ID NO:1982 | GGTGCATTCAGCAGGGCCACT<br>SEQ ID NO:9994 | CAGCAGTATGAAAGCTCAGTGTGGACG<br>SEQ ID NO:18006 |
| iPS:435025 | 21-225_89E10 | AA | RASQSVNSNYLA<br>SEQ ID NO:1983 | GAFSRAT<br>SEQ ID NO:9995 | QQYESSVWT<br>SEQ ID NO:18007 |
| | | NA | AGGGCCAGTCAGAGTGTTTACAGCAACTACTTAGCC<br>SEQ ID NO:1984 | GGTGCATCCAGCCGGTCCACT<br>SEQ ID NO:9996 | CAGCATTCTGATAACTCTCCGTGGACG<br>SEQ ID NO:18008 |
| iPS:435029 | | AA | RASQSVYSSYLA<br>SEQ ID NO:1985 | GASSRST<br>SEQ ID NO:9997 | QHSDNSPWT<br>SEQ ID NO:18009 |
| | | NA | AGGGCCAGTCAGAGTGTTGACAGCAACTTCTTAGCC<br>SEQ ID NO:1986 | GGTGCATCCTGCCAGGACCACT<br>SEQ ID NO:9998 | CAGCAGTATGAAATCTCACCGTGGACG<br>SEQ ID NO:18010 |

FIGURE 49
(Continued)

| | | | | | | |
|---|---|---|---|---|---|---|
| | 21-225_89A11 | AA | SEQ ID NO:1987<br>RASQSVDSNFLA<br>SEQ ID NO:1988 | SEQ ID NO:9999<br>GASARTT<br>SEQ ID NO:10000 | SEQ ID NO:18011<br>QQYEISPWT<br>SEQ ID NO:18012 |
| iPS:435039 | 21-225_90G4 | NA | AGGGCCAGTCAGAGTGTTTA<br>CAGCAGCTACTTAGCC<br>SEQ ID NO:1989 | GGTGCATCCAGCCGTC<br>CACT<br>SEQ ID NO:10001 | CAGCACTCTGATAACTCACC<br>GTGGACG<br>SEQ ID NO:18013 |
| iPS:435041 | 21-225_90A5 | AA | RASQSVYSSYLA<br>SEQ ID NO:1990 | GASSRST<br>SEQ ID NO:10002 | QHSDNSPWT<br>SEQ ID NO:18014 |
| iPS:435041 | 21-225_90A5 | NA | AGGGCCAGTCAGAGTGTTTA<br>CAGCAGCTACTTAGCC<br>SEQ ID NO:1991 | GGTGCATCCAGCGGGC<br>CACT<br>SEQ ID NO:10003 | CAGCACTATGATAACTCACC<br>GTGGACG<br>SEQ ID NO:18015 |
| iPS:435043 | 21-225_90G5 | AA | RASQSVYSSYLA<br>SEQ ID NO:1992 | GASSRAT<br>SEQ ID NO:10004 | QHYDNSPWT<br>SEQ ID NO:18016 |
| iPS:435043 | 21-225_90G5 | NA | AGGGCCAGTCAGAGTGTTTA<br>CAGCAGCTACTTAGCC<br>SEQ ID NO:1993 | GGTGCATCCAGCGGGC<br>CACT<br>SEQ ID NO:10005 | CAGCACTATGATAACTCACC<br>GTGGACG<br>SEQ ID NO:18017 |
| iPS:435045 | 21-225_90H5 | AA | RASQSVYSSYLA<br>SEQ ID NO:1994 | GASSRAT<br>SEQ ID NO:10006 | QHYDNSPWT<br>SEQ ID NO:18018 |
| iPS:435045 | 21-225_90H5 | NA | CGGGCAAGTCAGGGCATTAG<br>AAATGATTAGGC<br>SEQ ID NO:1995 | ATTGCATCCAGTTGCAA<br>AGT<br>SEQ ID NO:10007 | CTACAGCATAATAGTTACCC<br>GATCACC<br>SEQ ID NO:18019 |
| iPS:435051 | 21-225_90D9 | AA | RASQGIRNDLG<br>SEQ ID NO:1996 | IASSLQS<br>SEQ ID NO:10008 | LQHNSYPIT<br>SEQ ID NO:18020 |
| iPS:435051 | 21-225_90D9 | NA | AAGTCCAGCAGCCAGACTGTTT<br>ACACAGCTCCAACAATTATA<br>ACTACTTAGCT<br>SEQ ID NO:1997 | TGGACATCTACCCGGGA<br>ATCC<br>SEQ ID NO:10009 | CAGCAATATCTTAGTAGTCC<br>TCTGAGG<br>SEQ ID NO:18021 |
| iPS:435051 | 21-225_90D9 | AA | KSSQTVLHSSNNYNYLA<br>SEQ ID NO:1998 | WTSTRES<br>SEQ ID NO:10010 | QQYLSSPLT<br>SEQ ID NO:18022 |

FIGURE 49
(Continued)

| | | | | | | |
|---|---|---|---|---|---|---|
| iPS:435053 | 21-225_75F9 | NA | AAGTCCAGCCAGAGTGTTTT ACACAACTCCAACAATAATA ACTACTTGGCT SEQ ID NO:1999 | TGGGCATCTACGCGGGA GTCC SEQ ID NO:10011 | CAACAATATTATAGTAGTCC TCCGACG SEQ ID NO:18023 |
| | | AA | KSSQSVLHNSNNNNYLA SEQ ID NO:2000 | WASTRES SEQ ID NO:10012 | QQYYSSPPT SEQ ID NO:18024 |
| iPS:435055 | 21-225_90F10 | NA | AGGGCCAGTCAGAGTGTTTA CAGCAGCTACTTAGCC SEQ ID NO:2001 | GGTGCATCCAGCCGGTC CACT SEQ ID NO:10013 | CAGCACTATGATAACTCACC GTGGACG SEQ ID NO:18025 |
| | | AA | RASQSVYSSYLA SEQ ID NO:2002 | GASSRST SEQ ID NO:10014 | QHYDNSPWT SEQ ID NO:18026 |
| iPS:435059 | 21-225_90C11 | NA | AGGTATAGTCAGAGCCTCGT GCATAGTAGTGGATACAACT ATTTGGAT SEQ ID NO:2003 | TTGGGTTCTAATCGGGCC TCC SEQ ID NO:10015 | ATGCAAGCTCTACACCCTCC TCTCACT SEQ ID NO:18027 |
| | | AA | RYSQSLVHSSGYNYLD SEQ ID NO:2004 | LGSNRAS SEQ ID NO:10016 | MQALHPPLT SEQ ID NO:18028 |
| iPS:435071 | 21-225_91F1 | NA | AAGTCCAGCCAGAGTGTTTT ATACACCTCCAACAATAACA ACTACTTAGCT SEQ ID NO:2005 | TGGGCATCTACCGGGA ATCC SEQ ID NO:10017 | CAGCACTATTATAATACTCC GTGGAAG SEQ ID NO:18029 |
| | | AA | KSSQSVLYTSNNNNYLA SEQ ID NO:2006 | WASTRES SEQ ID NO:10018 | QHYYNTPWK SEQ ID NO:18030 |
| iPS:435073 | 21-225_91B2 | NA | AGGGCCAGTCAGAGTGTTTA CAGCAGCTACTTAGCC SEQ ID NO:2007 | GGTGCATCCAGCCGGTC CACT SEQ ID NO:10019 | CAGCACTATGATAACTCACC GTGGACG SEQ ID NO:18031 |
| | | AA | RASQSVYSSYLA SEQ ID NO:2008 | GASSRST SEQ ID NO:10020 | QHYDNSPWT SEQ ID NO:18032 |
| iPS:435075 | | NA | AGGGCCAGTCAGAGTGTTTA CAGCAGCTACTTAGCC | GGTGCATCCAGCCGGTC CACT | CAGCACTATGATAACTCACC GTGGACG |

FIGURE 49
(Continued)

| | | | | | | |
|---|---|---|---|---|---|---|
| iPS:435077 | 21-225_91B3 | | SEQ ID NO:2009 | | SEQ ID NO:10021 | | SEQ ID NO:18033 |
| | | AA | RASQSVYSSYLA | | GASSRST | | QHYDNSPWT |
| | | NA | SEQ ID NO:2010 | | SEQ ID NO:10022 | | SEQ ID NO:18034 |
| | | | AGGGCCAGTCAGAGTGTTTACAGCAGCTACTTAGCC | | GGTGCATCCAGCCGGTCCACT | | CAGCATTCTGATAACTCACCGTGGACG |
| iPS:435079 | 21-225_91F3 | | SEQ ID NO:2011 | | SEQ ID NO:10023 | | SEQ ID NO:18035 |
| | | AA | RASQSVYSSYLA | | GASSRST | | QHSDNSPWT |
| | | NA | SEQ ID NO:2012 | | SEQ ID NO:10024 | | SEQ ID NO:18036 |
| | | | AGGGCCAGTCAGAGTGTTTACAGCAGCTACTTAGCC | | GGTGCATCCAGCCGGTCCACT | | CAGCACTATGATAACTCACCGTGGACG |
| iPS:435087 | 21-225_91B4 | | SEQ ID NO:2013 | | SEQ ID NO:10025 | | SEQ ID NO:18037 |
| | | AA | RASQSVYSSYLA | | GASSRST | | QHYDNSPWT |
| | | NA | SEQ ID NO:2014 | | SEQ ID NO:10026 | | SEQ ID NO:18038 |
| | | | AAGTCCAGCAGTCAGAGTGTTTTATACACCTCCAACAATAACAACTACTTAGCT | | TGGGCATCTACCCGGGAATCC | | CAGCAATATTATACTACTCCGTGGACG |
| | 21-225_91G8 | | SEQ ID NO:2015 | | SEQ ID NO:10027 | | SEQ ID NO:18039 |
| | | AA | KSSQSVLYTSNNNNYLA | | WASTRES | | QQYYTTPWT |
| | | NA | SEQ ID NO:2016 | | SEQ ID NO:10028 | | SEQ ID NO:18040 |
| | | | AGGGCCAGTCAGAGTGTTTACAGCAGCTACTTAGCG | | GGTGCATCCAGCCGGGCCACG | | CAGCACTCTGATAACTCACCGTGGACG |
| iPS:435089 | 21-225_91E9 | | SEQ ID NO:2017 | | SEQ ID NO:10029 | | SEQ ID NO:18041 |
| | | AA | RASQSVYSSYLA | | GASSRAT | | QHSDNSPWT |
| | | NA | SEQ ID NO:2018 | | SEQ ID NO:10030 | | SEQ ID NO:18042 |
| | | | AGGGCCAGTCAGAGTGTTGGCAGCAACTACTTAGCC | | GGTGCATCCAGCAGGGCCACT | | CAGCAGTATGAAAGTTCACCGTGGACG |
| iPS:435097 | 21-225_92B1 | | SEQ ID NO:2019 | | SEQ ID NO:10031 | | SEQ ID NO:18043 |
| | | AA | RASQSVGSNYLA | | GASSRAT | | QQYESSPWT |
| | | | SEQ ID NO:2020 | | SEQ ID NO:10032 | | SEQ ID NO:18044 |

FIGURE 49 (Continued)

| | | | | |
|---|---|---|---|---|
| iPS:435103 | 21-225_92B2 | NA | AGGTCTAGTCAGAGCCTCGT GCATAGTAGTGGATACAACT ATTTGGAT SEQ ID NO:2021 | TTGGGTTCTAATCGGGCC TCC SEQ ID NO:10033 | ATGCAAGCTCTACATATTCC TCTCACT SEQ ID NO:18045 |
| | | AA | RSSQSLVHSSGYNYLD SEQ ID NO:2022 | LGSNRAS SEQ ID NO:10034 | MQALHIPLT SEQ ID NO:18046 |
| iPS:435109 | 21-225_92H5 | NA | CGGGCCAGTCAGGATGTTAT CACCTACTTAGCC SEQ ID NO:2023 | GGTGCATCCACCAGGGC CACT SEQ ID NO:10035 | CAGGAGTATAATGACTGGCC GTGCAGT SEQ ID NO:18047 |
| | | AA | RASQDVITYLA SEQ ID NO:2024 | GASTRAT SEQ ID NO:10036 | QEYNDWPCS SEQ ID NO:18048 |
| iPS:435111 | 21-225_92D6 | NA | AGGGCCAGTCAGAGTGTTTA CAGCAGCTACTTAGCC SEQ ID NO:2025 | GGTGCATCCAGCCGGTC CACT SEQ ID NO:10037 | CAGCATTATGATAACTCTCC GTGGACG SEQ ID NO:18049 |
| | | AA | RASQSVYSSYLA SEQ ID NO:2026 | GASSRST SEQ ID NO:10038 | QHYDNSPWT SEQ ID NO:18050 |
| iPS:435113 | 21-225_92E6 | NA | AAGTCCAGTCAGAATATTTT ATCCAGCTCCAACAATAAGA ACTACTTAACT SEQ ID NO:2027 | TGGACATCTACCCGGGA ATCC SEQ ID NO:10039 | CAGCAATATATTTTAGTGTTCCT CCGACG SEQ ID NO:18051 |
| | | AA | KSSQNILSSSNNKNYLT SEQ ID NO:2028 | WTSTRES SEQ ID NO:10040 | QQYFSVPPT SEQ ID NO:18052 |
| iPS:435115 | 21-225_77C5 | NA | AGGGCCAGTCAGAGTGTTTA CAGCAGCTACTTAGCC SEQ ID NO:2029 | GGTGCATCCAGCCGGTC CACT SEQ ID NO:10041 | CAGCACTATGATAACTCACC GTGGACG SEQ ID NO:18053 |
| | | AA | RASQSVYSSYLA SEQ ID NO:2030 | GASSRST SEQ ID NO:10042 | QHYDNSPWT SEQ ID NO:18054 |
| iPS:435167 | 21-225_92F12 | NA | AAGTCCAGCCAGAGTGTTTT ACACAGGTCCAACAATTACA ACTACTTAGCG | TGGGCATCTACCCGGGA ATCC | CAGCAATATTATAGTACTCC TCCGACG |

FIGURE 49
(Continued)

| | | | | | | |
|---|---|---|---|---|---|---|
| iPS:435171 | 21-225_92F12 | AA | SEQ ID NO:2031<br>KSSQSVLHRSNNYNYLA | SEQ ID NO:2031<br>WASTRES | SEQ ID NO:10043 | SEQ ID NO:18055<br>QQYYSTPPT |
| iPS:435177 | 21-225_93C2 | NA | SEQ ID NO:2032<br>AGGGCCAGTCAGAGTGTTTA<br>CAGCAGTACTTAGCC | SEQ ID NO:10044<br>GGTGCATCCAGCCGGGC<br>CACT | SEQ ID NO:18056<br>CAGCACTATGATAACTCACC<br>GTGGACG |
| | | AA | SEQ ID NO:2033<br>RASQSVYSSYLA | SEQ ID NO:10045<br>GASSRAT | SEQ ID NO:18057<br>QHYDNSPWT |
| iPS:435183 | 21-225_93E4 | NA | SEQ ID NO:2034<br>AGGGCCAGTCAGAGTGTTTA<br>CAGCAGTACTTAGCC | SEQ ID NO:10046<br>GGTGCATCCAGCCGGTC<br>CACT | SEQ ID NO:18058<br>CAGCACTCTGATAACTCACC<br>GTGGACG |
| | | AA | SEQ ID NO:2035<br>RASQSVYSSYLA | SEQ ID NO:10047<br>GASSRST | SEQ ID NO:18059<br>QHSDNSPWT |
| iPS:435189 | 21-225_93E9 | NA | SEQ ID NO:2036<br>AGGGCCAGTCAGAGTGTTGA<br>CAGCAGTACCTAGCC | SEQ ID NO:10048<br>GGTGCATCCAGCAGGGC<br>CCCT | SEQ ID NO:18060<br>CAGCAGTATGAAAGCTCACC<br>GTGGACG |
| | | AA | SEQ ID NO:2037<br>RASQSVDSSYLA | SEQ ID NO:10049<br>GASSRAP | SEQ ID NO:18061<br>QQYESSPWT |
| iPS:435195 | 21-225_94D3 | NA | SEQ ID NO:2038<br>AGGGCCAGTCAGAGTGTTAG<br>CAGCAGTACTTAGCC | SEQ ID NO:10050<br>GGTGCATCCAGCAGGGC<br>CACT | SEQ ID NO:18062<br>CAGCATTATGATAGCTCACC<br>GTGGACG |
| | | AA | SEQ ID NO:2039<br>RASQSVSSRYLA | SEQ ID NO:10051<br>GASSRAT | SEQ ID NO:18063<br>QHYDSSPWT |
| iPS:435197 | 21-225_94F3 | NA | SEQ ID NO:2040<br>CGGGCAAGTCAGGCCATTAG<br>AGATGATTAGGC | SEQ ID NO:10052<br>GCTGCATCCAGTTGCAA<br>AGT | SEQ ID NO:18064<br>CTCCAGCATTATAGTTACCC<br>TCGGACG |
| | | AA | SEQ ID NO:2041<br>RASQAIRDDLG | SEQ ID NO:10053<br>AASSLQS | SEQ ID NO:18065<br>LQHYSYPRT |
| | | | SEQ ID NO:2042 | SEQ ID NO:10054 | SEQ ID NO:18066 |

FIGURE 49
(Continued)

| | | | | | |
|---|---|---|---|---|---|
| iPS:435203 | 21-225_75A7 | NA | AAGTCCAGCCAGAGACTGTTTT ACACAGCTCCAACAATTATA ACTACTTAGCT SEQ ID NO:2043 | TGGACATCTACCCGGGA ATCC SEQ ID NO:10055 | CAGCAATATTTAGTAGTCC TCCGACG SEQ ID NO:18067 |
| | | AA | KSSQTVLHSSNNYNYLA SEQ ID NO:2044 | WTSTRES SEQ ID NO:10056 | QQYFSSPPT SEQ ID NO:18068 |
| iPS:435209 | 21-225_75A10 | NA | AAGTCCAGCCAGAGAGTGTTT ACACAACTCCAACAATTACA ACTACTAACT SEQ ID NO:2045 | TGGGCATCTACCCGGAA ATCC SEQ ID NO:10057 | CAGCAATATTATAGTTCTCC TCCGACG SEQ ID NO:18069 |
| | | AA | KSSQVLHNSNNYNYLT SEQ ID NO:2046 | WASTRKS SEQ ID NO:10058 | QQYYSSPPT SEQ ID NO:18070 |
| iPS:435211 | 21-225_94E11 | NA | AAGTCCAGCCAGAGAGTGTTT ATTCAGTCCAACAATTATA ATTACTTAGCT SEQ ID NO:2047 | TGGGCATCTACCCGGGA ATCC SEQ ID NO:10059 | CAGCAATATCATAGTTCTCC TCTGACG SEQ ID NO:18071 |
| | | AA | KSSQSVLFSSNNYNYLA SEQ ID NO:2048 | WASTRES SEQ ID NO:10060 | QQYHSSPLT SEQ ID NO:18072 |
| iPS:435215 | 21-225_94E12 | NA | AAGTCCAGCCAGAGAGTGTTT ACACAGGTCCAACAATTACA ACTACTTAGCG SEQ ID NO:2049 | TGGGCATCTACCCGGGA ATCC SEQ ID NO:10061 | CAGCAATATTATAGTACTCC TCCGACG SEQ ID NO:18073 |
| | | AA | KSSQSVLHRSNNYNYLA SEQ ID NO:2050 | WASTRES SEQ ID NO:10062 | QQYSTPPT SEQ ID NO:18074 |
| iPS:435217 | 21-225_94F12 | NA | AGGGCCAGTCAGAGTGTTTA CAGCAGCTACTTAGCG SEQ ID NO:2051 | GGTGCATCCAGCCGGTC CACT SEQ ID NO:10063 | CAGCATTATGATAACTCACC GTGGACG SEQ ID NO:18075 |
| | | AA | RASQSVYSSYLA SEQ ID NO:2052 | GASSRST SEQ ID NO:10064 | QHYDNSPWT SEQ ID NO:18076 |

FIGURE 49
(Continued)

| | | | | | |
|---|---|---|---|---|---|
| iPS:435219 | 21-225_95D2 | NA | AGGGCCAGTCAGAGTGTTTACAGCAGCTACTTAGCC SEQ ID NO:2053 | GGTGCATCCAGCCGGGC CACT SEQ ID NO:10065 | CAGCACTATGATAACTCACC GTGGACG SEQ ID NO:18077 |
| | | AA | RASQSVYSSYLA SEQ ID NO:2054 | GASSRAT SEQ ID NO:10066 | QHYDNSPWT SEQ ID NO:18078 |
| iPS:435221 | 21-225_95G2 | NA | AGGGCCAGTCAGTATGAGTGTGT CAACAGCTTAGCC SEQ ID NO:2055 | GGTGCATCCACCAGGGC CACT SEQ ID NO:10067 | CAGCAGTATAATGACTGGCC GTGCAGT SEQ ID NO:18079 |
| | | AA | RASMSVVNSLA SEQ ID NO:2056 | GASTRAT SEQ ID NO:10068 | QQYNDWPCS SEQ ID NO:18080 |
| iPS:435227 | 21-225_95G4 | NA | AAGTCCAGCCAGAGTGTTTT ATTCAGATCCAACAATTATA ATTACTTAGCT SEQ ID NO:2057 | TGGGCATCTACCCGGGA ATCC SEQ ID NO:10069 | CAGCAATATCATAGTTCTCC TCTGACG SEQ ID NO:18081 |
| | | AA | KSSQSVLFRSNNYNYLA SEQ ID NO:2058 | WASTRES SEQ ID NO:10070 | QQYHSSPLT SEQ ID NO:18082 |
| iPS:435235 | 21-225_95F9 | NA | AGGGCCAGTCAGAGTGTTTA CAGCAGCTACTTAGCC SEQ ID NO:2059 | GGTGCATCCAGCCGGTC CACT SEQ ID NO:10071 | CAGCACTATGATAACTCACC GTGGACG SEQ ID NO:18083 |
| | | AA | RASQSVYSSYLA SEQ ID NO:2060 | GASSRST SEQ ID NO:10072 | QHYDNSPWT SEQ ID NO:18084 |
| iPS:435237 | 21-225_95G9 | NA | AGGGCCAGTCAGAGTGTTTA CAGCAGCTACTTAGCG SEQ ID NO:2061 | GGTGCATCCAGCCGGTC CACT SEQ ID NO:10073 | CAGCACTATGATAACTCACC GTGGACG SEQ ID NO:18085 |
| | | AA | RASQSVYSSYLA SEQ ID NO:2062 | GASSRST SEQ ID NO:10074 | QHYDNSPWT SEQ ID NO:18086 |
| iPS:435239 | 21-225_95H10 | NA | AGGGCCAGTCAGAGTGTTTA CAGCAGCTACTTAGCC SEQ ID NO:2063 | GGTGCATCCAGCCGGGC CACT SEQ ID NO:10075 | CAGCACTATGATAACTCTCC GTGGACG SEQ ID NO:18087 |
| | | AA | RASQSVYSSYLA | GASSRAT | QHYDNSPWT |

FIGURE 49
(Continued)

| | | | | | | |
|---|---|---|---|---|---|---|
| iPS:435245 | 21-225_95E12 | NA | SEQ ID NO:2064 AAGTCCAGCAGTCCAACAATGCGA ATACAGCTCCAACAATGCGA ACTACTTAGCT | SEQ ID NO:10076 TGGGCATCTACCGGGA ATCC | SEQ ID NO:18088 CAGCAATATTATAGTACTCC GTGCAGT |
| | | AA | SEQ ID NO:2065 KSSQSVLYSSNNANYLA | SEQ ID NO:10077 WASTRES | SEQ ID NO:18089 QQYYSTPCS |
| iPS:435247 | 21-225_96G1 | NA | SEQ ID NO:2066 AGGGCCAGTCAGAGCGTTAG CAGCAGCTACTTAGCT | SEQ ID NO:10078 GGTGCATCCACCAGGGC CTCT | SEQ ID NO:18090 CAGCAGTATGGTAACTCACC GCTCACT |
| | | AA | SEQ ID NO:2067 RASQSVSSSYLA | SEQ ID NO:10079 GASTRAS | SEQ ID NO:18091 QQYGNSPLT |
| iPS:435249 | 21-225_96E2 | NA | SEQ ID NO:2068 AAGTCCAGCAGTCCAACAATGCGA ACACAGCTCTAATAAAAGA ACTACTTAGCT | SEQ ID NO:10080 TGGGCATCTACCTGGGA ATCC | SEQ ID NO:18092 CAGCAATATTATAGGACTCC GTGGACG |
| | | AA | SEQ ID NO:2069 KSSQSVLHSSNKKNYLA | SEQ ID NO:10081 WASTWES | SEQ ID NO:18093 QQYYRTPWT |
| iPS:435251 | 21-225_96A3 | NA | SEQ ID NO:2070 CGGGCAAGTCAGGGCATTAG AAATGATTAGGC | SEQ ID NO:10082 GCTGCATCCACTTTGCAA AGT | SEQ ID NO:18094 CTACAGCATAGTAATTACCC GCTCACT |
| | | AA | SEQ ID NO:2071 RASQGIRNDLG | SEQ ID NO:10083 AASTLQS | SEQ ID NO:18095 LQHSNYPLT |
| iPS:435253 | 21-225_96A4 | NA | SEQ ID NO:2072 CGGGCAAGTCAGGACATTAG AAATGATTAGGC | SEQ ID NO:10084 GGTGTATCCAGTTGCAA AGT | SEQ ID NO:18096 CTACAGCATAATGATTACCC ATTCACT |
| | | AA | SEQ ID NO:2073 RASQDIRNDLG | SEQ ID NO:10085 GVSSLQS | SEQ ID NO:18097 LQHNDYPFT |
| | | | SEQ ID NO:2074 RASQDIRNDLG | SEQ ID NO:10086 | SEQ ID NO:18098 |

FIGURE 49
(Continued)

| iPS | | | | | | |
|---|---|---|---|---|---|---|
| iPS:435255 | 21-225_96D5 | NA | AAGTCCAGCCAGAGTGTTT GCACAGTCCAACAATATA ATTACTTAGCT SEQ ID NO:2075 | TGGGCATCTACCCGGGA ATCC SEQ ID NO:10087 | CAGCAATATTATAGTAGTCC ACCGACG SEQ ID NO:18099 |
| | | AA | KSSQSVLHSSNNYNYLA SEQ ID NO:2076 | WASTRES SEQ ID NO:10088 | QQYYSSPPT SEQ ID NO:18100 |
| iPS:435257 | 21-225_96H5 | NA | AAGTCCAGCCAGAGTGTTT GTACAGTCCAACAGTCACA ACTACTTAGCT SEQ ID NO:2077 | TGGGCATCTATCCGGGA ATCC SEQ ID NO:10089 | CAGCAATATTATAGTACTCC GTGCAGT SEQ ID NO:18101 |
| | | AA | KSSQSVLYSSSNSHNYLA SEQ ID NO:2078 | WASIRES SEQ ID NO:10090 | QQYSTPCS SEQ ID NO:18102 |
| iPS:435259 | 21-225_96C6 | NA | CGGGCGAGTCAGGGCATTAG CAATTATTAGCC SEQ ID NO:2079 | GCTGCTCCAGTTGCAA AGT SEQ ID NO:10091 | CACCAGTATAATGATTACCC ATTCACT SEQ ID NO:18103 |
| | | AA | RASQGISNYLA SEQ ID NO:2080 | AASSLQS SEQ ID NO:10092 | HQYNDYPFT SEQ ID NO:18104 |
| iPS:435267 | 21-225_96D10 | NA | AAGTCCAGTCAGAATATTTT ATCCAGTCCAACAATAAGA ACTAACT SEQ ID NO:2081 | TGGACATCTACCCGGGA ATCC SEQ ID NO:10093 | CAGCAATATTTAGTGTTCCT CCGACG SEQ ID NO:18105 |
| | | AA | KSSQNILSSSNNKNYLT SEQ ID NO:2082 | WTSTRES SEQ ID NO:10094 | QQYFSVPPT SEQ ID NO:18106 |
| iPS:435273 | 21-225_97A2 | NA | AGGGCCAGTCAGAGTGTTTA CAGCAGTCACTTAGCC SEQ ID NO:2083 | GGTGCATCCAGCCGGTC CACT SEQ ID NO:10095 | CAGCATTCTGATAACTCACC GTGGACG SEQ ID NO:18107 |
| | | AA | RASQSVYSSYLA SEQ ID NO:2084 | GASSRST SEQ ID NO:10096 | QHSDNSPWT SEQ ID NO:18108 |

FIGURE 49
(Continued)

| | | | | | |
|---|---|---|---|---|---|
| iPS:435279 | 21-225_97H4 | NA | AAGTCCAGCCAGAGTGTTTT ATACACCTCCAACAATAACA ACTACTTAGCT SEQ ID NO:2085 | TGGGCATCTACCCGGGA ATCC SEQ ID NO:10097 | CAGCACTACAATGATACTCC ATGGAAG SEQ ID NO:18109 |
| | | AA | KSSQSVLYTSNNNNYLA SEQ ID NO:2086 | WASTRES SEQ ID NO:10098 | QHYNDTPWK SEQ ID NO:18110 |
| iPS:435281 | 21-225_97E5 | NA | AGGGCCAGTCAGTCAGAGTGTTTA CAGCAGCTACTTAGCC SEQ ID NO:2087 | GGTGCATCCAGCCGGGC CACT SEQ ID NO:10099 | CAGCACTCTGATAACTCACC GTGGACG SEQ ID NO:18111 |
| | | AA | RASQSVYSSYLA SEQ ID NO:2088 | GASSRAT SEQ ID NO:10100 | QHSDNSPWT SEQ ID NO:18112 |
| iPS:435291 | 21-225_146E1 | NA | CGGGCGAGTCAGGGTATTAA CAACTGGTTAGTC SEQ ID NO:2089 | GCTGCATCCAGTTTGCAA AGT SEQ ID NO:10101 | CAACAGGCTAACAGTTTCCC ATTCACT SEQ ID NO:18113 |
| | | AA | RASQGINNWLV SEQ ID NO:2090 | AASSLQS SEQ ID NO:10102 | QQANSFPFT SEQ ID NO:18114 |
| iPS:435293 | 21-225_146F1 | NA | CGGGCAAGTCAGGGCATTAG AAATGATTTAGGC SEQ ID NO:2091 | GCTGCATCCAGTTTGCAA AGT SEQ ID NO:10103 | CTTCAGCATAGTAGTACTTACCC GCTCACT SEQ ID NO:18115 |
| | | AA | RASQGIRNDLG SEQ ID NO:2092 | AASSLQS SEQ ID NO:10104 | LQHSTYPLT SEQ ID NO:18116 |
| iPS:435295 | 21-225_146H1 | NA | CGGGCAAGTCAGAGCATTAG CGACTATTTAAAT SEQ ID NO:2093 | ACTACATCCAGTTTGCAA AGT SEQ ID NO:10105 | CAACAGAGTTACAGTACCCC CACT SEQ ID NO:18117 |
| | | AA | RASQSISDYLN SEQ ID NO:2094 | TTSSLQS SEQ ID NO:10106 | QQSYSTPT SEQ ID NO:18118 |
| iPS:435297 | 21-225_146B3 | NA | AAGTCTAGTCAGAGCCTCCT GCATGGTGATGGAAAGACCT TATTTGTAT SEQ ID NO:2095 | GAAGTTTCCAACCGGTTC TCT SEQ ID NO:10107 | ATGCAAAGTATACAGTTCC GTGGACG SEQ ID NO:18119 |

FIGURE 49
(Continued)

| | | | | | | MQSIQLPWT |
|---|---|---|---|---|---|---|
| iPS:435299 | | AA | KSSQSLLHGDGKTYLY SEQ ID NO:2096 | AAGTCCAGCCAGAGTGTTT ATACAGTCCAACAATAACA ACTACTTAGCT SEQ ID NO:2097 | EVSNRFS SEQ ID NO:10108 | TGGGCATCTACCCGGGA ATCC SEQ ID NO:10109 | SEQ ID NO:18120 CAGCAATATTATAGTACTCC GTGCAGT SEQ ID NO:18121 |
| iPS:435301 | 21-225_146D4 | NA | KSSQSVLYSSNNNYLA SEQ ID NO:2098 | AGGGCCAGTCAGAGTATTAT CAGCAGCTATTTAGCC SEQ ID NO:2099 | WASTRES SEQ ID NO:10110 | GGTGTATCTAGTCGGGC CACT SEQ ID NO:10111 | QQYYSTPCS SEQ ID NO:18122 CAACAATATGGTAGGTCACC ATTCAAT SEQ ID NO:18123 |
| iPS:435303 | 21-225_146G4 | AA | RASQNIISSYLA SEQ ID NO:2100 | CGGGCGAGTCAGGGTATTAG CAACTGGTTAGCC SEQ ID NO:2101 | GVSSRAT SEQ ID NO:10112 | GCTGCATCCAGTTGCAA GGT SEQ ID NO:10113 | QQYGRSPFN SEQ ID NO:18124 CAACAGACTGACAGTTCCA ATTCACT SEQ ID NO:18125 |
| iPS:435305 | 21-225_146A6 | NA | RASQGISNWLA SEQ ID NO:2102 | AAGTCCAGCCAGAGTGTTT ACACAGTCCAACAATTATA ATTACTTAGCT SEQ ID NO:2103 | AASSLQG SEQ ID NO:10114 | TGGGCATCTACCCGGAA ATCC SEQ ID NO:10115 | QQTDSFPFT SEQ ID NO:18126 CAGCAATATTATAGTACTCC GTGCAGT SEQ ID NO:18127 |
| iPS:435307 | 21-225_146C9 | AA | KSSQSVLHSSNNYNYLA SEQ ID NO:2104 | CGGGCAAGTCAGAGCATTAG CGACTATTTAAAT SEQ ID NO:2105 | WASTRKS SEQ ID NO:10116 | ACTACATCCAGTTGCAA AGT SEQ ID NO:10117 | QQYYSTPCS SEQ ID NO:18128 CAACAGAGTTACAGTACCCC CACT SEQ ID NO:18129 |
| | 21-225_146E9 | AA | RASQSISDYLN SEQ ID NO:2106 | | TTSSLQS SEQ ID NO:10118 | | QQSYSTPT SEQ ID NO:18130 |

FIGURE 49
(Continued)

| | | | | | |
|---|---|---|---|---|---|
| iPS:435309 | 21-225_146F9 | NA | AAGTCCAGCCAGAATATTT ACACAGTCCAACAATAACA ACTACTTAGCT SEQ ID NO:2107 | TGGGCATCTACCCGGA ATCC SEQ ID NO:10119 | CAGCAATATTATACTACTCC GTGCAGT SEQ ID NO:18131 |
| | | AA | KSSQNILHSSNNNYLA SEQ ID NO:2108 | WASTRES SEQ ID NO:10120 | QQYYTTPCS SEQ ID NO:18132 |
| iPS:435311 | 21-225_146H9 | NA | CGGGCAAGTCAGGGCATTAG AAATGATTTAGGC SEQ ID NO:2109 | GCTGCATCCAGTTTGCAA AGT SEQ ID NO:10121 | CTACAGCATAATAGTTACCC GCTCACT SEQ ID NO:18133 |
| | | AA | RASQGIRNDLG SEQ ID NO:2110 | AASSLQS SEQ ID NO:10122 | LQHNSYPLT SEQ ID NO:18134 |
| iPS:435313 | 21-225_146G11 | NA | CGGGCAAGTCAGGACATTAG AAATAATTTTGGG SEQ ID NO:2111 | GCTGCATCCAGTTTGCAA AGT SEQ ID NO:10123 | CTCCAACATGATAGTTACCC GCTCACT SEQ ID NO:18135 |
| | | AA | RASQDIRNNFG SEQ ID NO:2112 | AASSLQS SEQ ID NO:10124 | LQHDSYPLT SEQ ID NO:18136 |
| iPS:435315 | 21-225_147B2 | NA | AAGTCTAGTCAGAGCCTCCT GCATAGTGAAGGAAAGACC TATTTGTAT SEQ ID NO:2113 | GAAGTTTCCCACCGGGT CTCT SEQ ID NO:10125 | ATGCAAAGTACACAGTTTCC TCCCACT SEQ ID NO:18137 |
| | | AA | KSSQSLLHSEGKTYLY SEQ ID NO:2114 | EVSHRVS SEQ ID NO:10126 | MQSTQFPT SEQ ID NO:18138 |
| iPS:435317 | 21-225_147D2 | NA | AGGGCCAGTCAGAGTGTTGG CAGCAGTACTTAGCC SEQ ID NO:2115 | GGTGCATCCAGCAGGGC CACT SEQ ID NO:10127 | CAGCAGTATGGTAGCTTATT CACT SEQ ID NO:18139 |
| | | AA | RASQSVGSSYLA SEQ ID NO:2116 | GASSRAT SEQ ID NO:10128 | QQYGSLFT SEQ ID NO:18140 |
| iPS:435319 | 21-225_147E3 | NA | AGGGCCAGTCAGAGTGTTAT CAGTAGTACTTAGCC SEQ ID NO:2117 | GGTGCATCCAGCAGGGC CACT SEQ ID NO:10129 | CAACAATATGGTAGGTCACC ATTCAAT SEQ ID NO:18141 |

FIGURE 49
(Continued)

| | | | | | | |
|---|---|---|---|---|---|---|
| | | | RASQSVISSYLA | | GASSRAT | QQYGRSPFN |
| | | AA | SEQ ID NO:2118 | | SEQ ID NO:10130 | SEQ ID NO:18142 |
| iPS:435321 | 21-225_147E4 | NA | AAGTCCAGCCAGAGTGTTTT ACACAGCTCCAACAATTACA ACTACTTAGCT | | TGGGCATCTACCCGGGA ATCC | CAGCAATATTATAGTACTCC ATCCACT |
| | | | SEQ ID NO:2119 | | SEQ ID NO:10131 | SEQ ID NO:18143 |
| | | AA | KSSQSVLHSSNNYNYLA | | WASTRES | QQYYSTPST |
| | | | SEQ ID NO:2120 | | SEQ ID NO:10132 | SEQ ID NO:18144 |
| iPS:435323 | 21-225_147D5 | NA | AAGTCCAGCCAGAGTGTTTT ATACAGCTCCAACAATAACA ACTACTTAGCT | | TGGGCATCTACCCGGGA ATCC | CACCAATATTATAGTACTCC GTGCAGT |
| | | | SEQ ID NO:2121 | | SEQ ID NO:10133 | SEQ ID NO:18145 |
| | | AA | KSSQSVLYSSNNNNYLA | | WASTRES | HQYYSTPCS |
| | | | SEQ ID NO:2122 | | SEQ ID NO:10134 | SEQ ID NO:18146 |
| iPS:435325 | 21-225_147H5 | NA | CGGGCAAGTCGGGGCATTAG AGATGATTAGGC | | GCTGCATCCAGTTTGCAG AGT | CTACAGCATTATAGTTATCC TCGGACG |
| | | | SEQ ID NO:2123 | | SEQ ID NO:10135 | SEQ ID NO:18147 |
| | | AA | RASRGIRDDLG | | AASSLQS | LQHYSYPRT |
| | | | SEQ ID NO:2124 | | SEQ ID NO:10136 | SEQ ID NO:18148 |
| iPS:435327 | 21-225_147G6 | NA | AAGTCCAGCCAGAGTGTTTT ATACAGCTCCAACAACA ACTACTTAGCT | | TGGGCATCTGCCCGGGA ATCC | CAGCAATATTATACTACTCC TCCCACT |
| | | | SEQ ID NO:2125 | | SEQ ID NO:10137 | SEQ ID NO:18149 |
| | | AA | KSSQSVLYSSNSNNYLA | | WASARES | QQYYTPPT |
| | | | SEQ ID NO:2126 | | SEQ ID NO:10138 | SEQ ID NO:18150 |
| iPS:435329 | 21-225_147A8 | NA | AAGACTAGTCAGAGCCTCCT GCATAGTGAAGGAAAGACC TATTTGTAT | | GAAGTTCCAACCGGTTC TCT | ATGCAAAGTATACAGCTAAT CACC |
| | | | SEQ ID NO:2127 | | SEQ ID NO:10139 | SEQ ID NO:18151 |
| | | AA | KTSQSLLHSEGKTYLY | | EVSNRFS | MQSIQLIT |

FIGURE 49
(Continued)

| | | | | | |
|---|---|---|---|---|---|
| iPS:435331 | 21-225_147G8 | NA | SEQ ID NO:2128 AGGGCCAGTCAGAGAATTT CAGCAACTACTTAGCC | SEQ ID NO:10140 GGTGCATCCAGCAGGGC CACT | SEQ ID NO:18152 CAGCAGTATGATAGCTCACC GTGGACG |
| | | AA | SEQ ID NO:2129 RASQRIFSNYLA | SEQ ID NO:10141 GASSRAT | SEQ ID NO:18153 QQYDSSPWT |
| iPS:435333 | 21-225_147E9 | NA | SEQ ID NO:2130 CGGGCGAGTCAGGACATTAA CAATTATTTAGCC | SEQ ID NO:10142 GCTGCATCCAGTTGCAA AGT | SEQ ID NO:18154 CAACAGTATAATAGTTACCC TCTCACT |
| | | AA | SEQ ID NO:2131 RASQDINNYLA | SEQ ID NO:10143 AASSLQS | SEQ ID NO:18155 QQYNSYPLT |
| iPS:435335 | 21-225_147D10 | NA | SEQ ID NO:2132 CGGGCGAGTCAGAATATTAG CAACTGGTTAACC | SEQ ID NO:10144 GCTGCATCCAGTTGCAA AGT | SEQ ID NO:18156 CAACAGACTGACAGTTTCCC ATTCACT |
| | | AA | SEQ ID NO:2133 RASQNISNWLT | SEQ ID NO:10145 AASSLQS | SEQ ID NO:18157 QQTDSFPFT |
| iPS:435339 | 21-225_147D12 | NA | SEQ ID NO:2134 CGGGCGAGTCAGGGTATTAG CAACTGGTTAGCC | SEQ ID NO:10146 GCTGCATCCAGTTGCAA AGT | SEQ ID NO:18158 CAACAGACTGACAGTTTCCC ATTCACT |
| | | AA | SEQ ID NO:2135 RASQGISNWLA | SEQ ID NO:10147 AASSLQS | SEQ ID NO:18159 QQTDSFPFT |
| iPS:435341 | 21-225_148B2 | NA | SEQ ID NO:2136 AAGTCTAGTCAGAGCCTCCT GCATGGTGATGGAAAGACCT ATTTTAT | SEQ ID NO:10148 GAAGTTTCCCACCGGTTC TCT | SEQ ID NO:18160 ATGCAAAGTATACAGATTCC GTGGACG |
| | | AA | SEQ ID NO:2137 KSSQSLLHGDGKTYFY | SEQ ID NO:10149 EVSHRFS | SEQ ID NO:18161 MQSIQIPWT |
| iPS:435343 | 21-225_148E2 | NA | SEQ ID NO:2138 CGGGCGAGTCAGGGTATTAG CAACTGGTTAGCC | SEQ ID NO:10150 GCTGCATCCAGTTGCAA AGT | SEQ ID NO:18162 CAACAGACTGACAGTTTCCC ATTCACT |
| | | | SEQ ID NO:2139 | SEQ ID NO:10151 | SEQ ID NO:18163 |

FIGURE 49
(Continued)

| | | | | | | |
|---|---|---|---|---|---|---|
| iPS:435345 | | AA | RASQGISNWLA | | AASSLQS | QQTDSFPFT |
| | | | SEQ ID NO:2140 | | SEQ ID NO:10152 | SEQ ID NO:18164 |
| | 21-225_148G3 | NA | AAGTCCAGCCAACGTGTTT ACACAGTCCAACAATTATA ACTACTTAGCT | | TGGGCATCTACCCGGGA TTCC | CAGCAATATTATAGTACTCC ATTCACT |
| | | | SEQ ID NO:2141 | | SEQ ID NO:10153 | SEQ ID NO:18165 |
| iPS:435347 | | AA | KSSQRVLHSSNNYNYLA | | WASTRDS | QQYYSTPFT |
| | | | SEQ ID NO:2142 | | SEQ ID NO:10154 | SEQ ID NO:18166 |
| | 21-225_148C4 | NA | CGGGCAAGTCAGAGCATTAT CAACTATTTAAAT | | ACTGCATCCAGTTTACAG AGT | CAACAGAGTTACAGTACCCC CACT |
| | | | SEQ ID NO:2143 | | SEQ ID NO:10155 | SEQ ID NO:18167 |
| iPS:435349 | | AA | RASQSIINYLN | | TASSLQS | QQSYSTPT |
| | | | SEQ ID NO:2144 | | SEQ ID NO:10156 | SEQ ID NO:18168 |
| | 21-225_148F5 | NA | AAGTCTAGTCAGAGCCTCCT GCATAGTAGTGAAGGAAAGACC TATTTGTAT | | GAAGTTCCTACCGGGTC TCT | ATGCAAAGTATACAGCTTCC GCTCACT |
| | | | SEQ ID NO:2145 | | SEQ ID NO:10157 | SEQ ID NO:18169 |
| iPS:435351 | | AA | KSSQSLLHSEGKTYLY | | EVSYRVS | MQSIQLPLT |
| | | | SEQ ID NO:2146 | | SEQ ID NO:10158 | SEQ ID NO:18170 |
| | 21-225_148B6 | NA | CGGGCGAGTCAGGGCATTAG CAAATATTAGCC | | GCTGCATCCAGTTTGCAA AGT | CAACAGTATAATAGTTCCC ATTCACT |
| | | | SEQ ID NO:2147 | | SEQ ID NO:10159 | SEQ ID NO:18171 |
| iPS:435353 | | AA | RASQGISKYLA | | AASSLQS | QQYNSFPFT |
| | | | SEQ ID NO:2148 | | SEQ ID NO:10160 | SEQ ID NO:18172 |
| | 21-225_148F8 | NA | AAGTCCAGCCAGAGTGCTTT ACACAGCTCCAACAATTACA ACTACTTAGCT | | TGGGCATCTACCCGGAA ATCC | CAGCAATATTATAGTATTCC TCCGACG |
| | | | SEQ ID NO:2149 | | SEQ ID NO:10161 | SEQ ID NO:18173 |
| | | AA | KSSQSALHSSNNYNYLA | | WASTRKS | QQYYSIPPT |
| | | | SEQ ID NO:2150 | | SEQ ID NO:10162 | SEQ ID NO:18174 |

FIGURE 49 (Continued)

| | | | | | |
|---|---|---|---|---|---|
| iPS:435355 | 21-225_148H9 | NA | CGGGCAAGTCAGAGCATTAG TAACTATTAAAT SEQ ID NO:2151 | ATTGCATCCAGTTTGCAA AGT SEQ ID NO:10163 | CAACAGAGTTACAGTACCCC CACT SEQ ID NO:18175 |
| | | AA | RASQSISNYLN SEQ ID NO:2152 | IASSLQS SEQ ID NO:10164 | QQSYSTPT SEQ ID NO:18176 |
| iPS:435357 | 21-225_148G10 | NA | AAGTCTAGTCAGAGCCTCCT GCATGGTGATGGAAAGACCT ATTTGTAT SEQ ID NO:2153 | GAAGTTTCCAACGGTTC TCT SEQ ID NO:10165 | ATGCAAAGTATACAGCTTCC GTGGACG SEQ ID NO:18177 |
| | | AA | KSSQSLLHGDGKTYLY SEQ ID NO:2154 | EVSNRFS SEQ ID NO:10166 | MQSIQLPWT SEQ ID NO:18178 |
| iPS:435359 | 21-225_148H10 | NA | AAGTCTAGTCAGAGCCTCCT GCATAGTGAGGGAAAGACC TATTTGTAT SEQ ID NO:2155 | GAAGTTTCCTACGGGTC TCT SEQ ID NO:10167 | ATGCAGAGTATACAGCTTCC GCTCACT SEQ ID NO:18179 |
| | | AA | KSSQSLLHSEGKTYLY SEQ ID NO:2156 | EVSYRVS SEQ ID NO:10168 | MQSIQLPLT SEQ ID NO:18180 |
| iPS:435361 | 21-225_148E11 | NA | CGGGCAAGTCAGGGCATTAG AAATGATTTAGGC SEQ ID NO:2157 | GCTGCATCCAGTTTGCAA AGT SEQ ID NO:10169 | CTACAGCATCGTAATTACC GCTCACT SEQ ID NO:18181 |
| | | AA | RASQGIRNDLG SEQ ID NO:2158 | AASSLQS SEQ ID NO:10170 | LQHRNYPLT SEQ ID NO:18182 |
| iPS:435363 | 21-225_148F12 | NA | CGGGCAAGTCAGGGCATTAG AAATGCCTTAGGC SEQ ID NO:2159 | GCTGCATCCAGTTTGCAA AGT SEQ ID NO:10171 | CTACAGCATAATAGTTACC TCTCATT SEQ ID NO:18183 |
| | | AA | RASQGIRNALG SEQ ID NO:2160 | AASSLQS SEQ ID NO:10172 | LQHNSYPLI SEQ ID NO:18184 |
| iPS:435365 | 21-225_149F1 | NA | AAGTCTAGTCAGAGCCTCCT GCATGGTGATGGAAAGACCT ATTTTTAT | GAAGTTTCCCACCGGTTC TCT | ATGCAAAGTATACAGATTCC GTGGACG |

FIGURE 49
(Continued)

| | | | | | | |
|---|---|---|---|---|---|---|
| iPS:435367 | 21-225_149F1 | AA | SEQ ID NO:2161<br>KSSQSLLHGDGKTYFY | SEQ ID NO:10173<br>EVSHRFS | SEQ ID NO:18185<br>MQSIQIPWT | |
| | | NA | SEQ ID NO:2162<br>CGGGCAAGTCAGGGCATTAG<br>AAATGATTTAGGC | SEQ ID NO:10174<br>GCTGCATCCAATTGCAA<br>AGT | SEQ ID NO:18186<br>CTACAGCATAATAGTTACCC<br>GCTCACT | |
| iPS:435369 | 21-225_149G1 | AA | SEQ ID NO:2163<br>RASQGIRNDLG | SEQ ID NO:10175<br>AASNLQS | SEQ ID NO:18187<br>LQHNSYPLT | |
| | | NA | SEQ ID NO:2164<br>AAGTCCAGCCAGAGTGTTT<br>ATACAGTCCCAACAATAACA<br>ACTACTTAGCT | SEQ ID NO:10176<br>TGGGCATCTACCCGGGA<br>ATCC | SEQ ID NO:18188<br>CAGCAATATTATAGTACTCC<br>GTGCAGT | |
| iPS:435371 | 21-225_149A2 | AA | SEQ ID NO:2165<br>KSSQSVLYSPNNNNYLA | SEQ ID NO:10177<br>WASTRES | SEQ ID NO:18189<br>QQYYSTPCS | |
| | | NA | SEQ ID NO:2166<br>CGGGCAAGTCAGAGCATTAG<br>CAGTTATTTAAAT | SEQ ID NO:10178<br>ACTGCATCCAGTTGCAA<br>AGT | SEQ ID NO:18190<br>CAACAGAGTTACAGTATCCC<br>CACT | |
| iPS:435373 | 21-225_149A3 | AA | SEQ ID NO:2167<br>RASQSISSYLN | SEQ ID NO:10179<br>TASSLQS | SEQ ID NO:18191<br>QQSYSIPT | |
| | | NA | SEQ ID NO:2168<br>AAGTCCAGCCAGAGTGTTTT<br>ACACAACTCCAATAATCACA<br>ATTACTTTGCT | SEQ ID NO:10180<br>TGGGCATCTACCCTGAG<br>ATCC | SEQ ID NO:18192<br>CAGCAATATTATAGTACTCC<br>TCCGACG | |
| iPS:435375 | 21-225_149E3 | AA | SEQ ID NO:2169<br>KSSQTVLHNSNNHNYFA | SEQ ID NO:10181<br>WASTLRS | SEQ ID NO:18193<br>QQYYSTPPT | |
| | | NA | SEQ ID NO:2170<br>AAGTCCAGCCAGAGTGTTTT<br>ATCCAGCTCCAACGATAACA<br>ACTACTTAGCT | SEQ ID NO:10182<br>TGGTCATCTACCCGGGA<br>ATCC | SEQ ID NO:18194<br>CACCAATATTATAGTTATCC<br>TCCGACG | |
| | 21-225_149H4 | AA | SEQ ID NO:2171<br>KSSQSVLSSSNDNNYLA | SEQ ID NO:10183<br>WSSTRES | SEQ ID NO:18195<br>HQYYSYPPT | |

FIGURE 49
(Continued)

| | | | | | | |
|---|---|---|---|---|---|---|
| iPS:435377 | 21-225_149G5 | NA | SEQ ID NO:2172 CGGGCAAGTCAGGGCATTAG AAATGCCTTAGGC | SEQ ID NO:10184 GCTGCATCCAGTTGCAA AGT | SEQ ID NO:8196 CTACAGCATATAGTTACCC TCTCACT |
| | | AA | SEQ ID NO:2173 RASQGIRNALG | SEQ ID NO:10185 AASSLQS | SEQ ID NO:8197 LQHNSYPLT |
| iPS:435379 | 21-225_149B6 | NA | SEQ ID NO:2174 CGGGCGAGTCAGGGCATTAT CAGTTGGTTAGCC | SEQ ID NO:10186 GCTGCATCCAGTTGCAA AGT | SEQ ID NO:8198 CAACAGGGTAACAGTTCC ATTCACT |
| | | AA | SEQ ID NO:2175 RASQGIISWLA | SEQ ID NO:10187 AASSLQS | SEQ ID NO:8199 QQGNSFPFT |
| iPS:435381 | 21-225_149C6 | NA | SEQ ID NO:2176 CGGGCGAGTCAGGGCATTAG CAACTGGTTAGCC | SEQ ID NO:10188 GCTGCATCCAGTTGCAA GGT | SEQ ID NO:8200 CAACAGACTGACAGTTCC ATTCACT |
| | | AA | SEQ ID NO:2177 RASQGISNWLA | SEQ ID NO:10189 AASSLQG | SEQ ID NO:8201 QQTDSFPFT |
| iPS:435383 | 21-225_149D7 | NA | SEQ ID NO:2178 AGGGCCAGTCAGAGTATTAT CAGCAACTACTTAGCC | SEQ ID NO:10190 GGTGTATCTAGTAGGGC CACT | SEQ ID NO:8202 CAACAATATGGTCGGTCACC ATTCAAT |
| | | AA | SEQ ID NO:2179 RASQSIISNYLA | SEQ ID NO:10191 GVSSRAT | SEQ ID NO:8203 QQYGRSPFN |
| iPS:435391 | 21-225_149F8 | NA | SEQ ID NO:2180 CGGGCGAGTCAGGGCATTAG CAACTGGTTAGCC | SEQ ID NO:10192 GCTGCATCCAGTTGCAA AGT | SEQ ID NO:8204 CAACAGACTGACAGTTCC ATTCACT |
| | | AA | SEQ ID NO:2181 RASQGISNWLA | SEQ ID NO:10193 AASSLQS | SEQ ID NO:8205 QQTDSFPFT |
| iPS:435393 | 21-225_149D10 | NA | SEQ ID NO:2182 CGGGCAAGTCGGGGCATTAG AAATGATTTAGGC | SEQ ID NO:10194 GCTGCATCCAGTTGCAG AGT | SEQ ID NO:8206 CTACAGCATTATAGTTATCC TCGGACG |
| | | AA | SEQ ID NO:2183 RASRGIRNDLG | SEQ ID NO:10195 AASSLQS | SEQ ID NO:8207 LQHYSYPRT |

FIGURE 49 (Continued)

| | | | | | |
|---|---|---|---|---|---|
| iPS:435395 | 21-225_149D11 | NA | SEQ ID NO:2184 CGGGCAAGTCGAGTCAGAATATTAG CAACTGGTTAACC | SEQ ID NO:10196 GCTGCATCCAGTTTGCAA AGT | SEQ ID NO:18208 CAACAGACTGACAGTTCCC ATTCACT |
| | | | SEQ ID NO:2185 RASQNISNWLT | SEQ ID NO:10197 AASSLQS | SEQ ID NO:18209 QQTDSFPFT |
| iPS:435397 | 21-225_149F12 | AA | SEQ ID NO:2186 CGGGCAAGTCAGGGCATTAG AAATGATTAGGC | SEQ ID NO:10198 GCTGCATCCAGTTTGCAA AGT | SEQ ID NO:18210 CTACAGCATAATAGTACC GCTCACT |
| | | | SEQ ID NO:2187 RASQGIRNDLG | SEQ ID NO:10199 AASNLQS | SEQ ID NO:18211 LQHNSYPLT |
| iPS:435399 | 21-225_150D2 | NA | SEQ ID NO:2188 AAGTCCAGCCAGAGTGTTTT ATACAGATCCAACAGTAAGA AATACTTAACT | SEQ ID NO:10200 TGGGCATCTACCCGGAA ATCC | SEQ ID NO:18212 CAGCAATATATTTAGTACTCC GTACAAT |
| | | | SEQ ID NO:2189 KSSQSVLYRSNSKKYLT | SEQ ID NO:10201 WASTRKS | SEQ ID NO:18213 QQYFSTPYN |
| iPS:435401 | 21-225_150E2 | AA | SEQ ID NO:2190 CGGGCAAGTCAGGGCATTGG AAATGATTAGGC | SEQ ID NO:10202 GCTGCATCCAGTTTGCAA AGT | SEQ ID NO:18214 CTACAACATTATAGTTCCC GTACAGT |
| | | | SEQ ID NO:2191 RASQGIGNDLG | SEQ ID NO:10203 AASSLQS | SEQ ID NO:18215 LQHYSFPYS |
| iPS:435403 | 21-225_150C5 | NA | SEQ ID NO:2192 CGGGCAAGTCAGGGTATTAA CAACTGGTTAGCC | SEQ ID NO:10204 GCTGCATCCAGTTTGCAA GGT | SEQ ID NO:18216 CAACAGACTGACAGTTCCC ATTCACT |
| | | | SEQ ID NO:2193 RASQGINNWLA | SEQ ID NO:10205 AASSLQG | SEQ ID NO:18217 QQTDSFPFT |
| iPS:435405 | 21-225_150B7 | AA | SEQ ID NO:2194 AAGTCCAGCCAGAATGTTTT ATACAGTCCCACAATAACA ACTACTTAGCT | SEQ ID NO:10206 TGGGCATCTACCCGGAA ATCC | SEQ ID NO:18218 CAGCAATATATATAGTACTCC ATTCACT |

FIGURE 49
(Continued)

| | | | | | | |
|---|---|---|---|---|---|---|
| iPS:435407 | 21-225_150B7 | AA | SEQ ID NO:2195<br>KSSQNVLYSSHNNNYLA | SEQ ID NO:10207<br>WASTRKS | SEQ ID NO:18219<br>QQYYSTPFT | |
| iPS:435409 | 21-225_150E7 | NA | SEQ ID NO:2196<br>CGGGCAAGTCAGGGCATTAGC<br>AAATGATTTAGGC | SEQ ID NO:10208<br>GCTGCATCCAATTGCAA<br>AGT | SEQ ID NO:18220<br>CTACAGCATATAGTTACC<br>GCTCACT | |
| | | AA | SEQ ID NO:2197<br>RASQGIRNDLG | SEQ ID NO:10209<br>AASNLQS | SEQ ID NO:18221<br>LQHNSYPLT | |
| iPS:435413 | 21-225_150G8 | NA | SEQ ID NO:2198<br>CGGGGAGTCAGGGCATTAGC<br>CCATTATTTAGCC | SEQ ID NO:10210<br>GTTGCATCCAGTTGCAA<br>AAT | SEQ ID NO:18222<br>CAACAGTATAATAATTACC<br>GCTCACT | |
| | | AA | SEQ ID NO:2199<br>RASQGISHYLA | SEQ ID NO:10211<br>VASSLQN | SEQ ID NO:18223<br>QQYNNYPLT | |
| iPS:435413 | 21-225_150B11 | NA | SEQ ID NO:2200<br>AAGTCTAGTCAGAGCCTCGT<br>GCATAGTGATGGAAAGACCT<br>ATTTGTAT | SEQ ID NO:10212<br>GAAGTTCCAACCGGTTC<br>TCT | SEQ ID NO:18224<br>ATGCAAAGTATACAGCTTCC<br>GTGGACG | |
| | | AA | SEQ ID NO:2201<br>KSSQSLVHGDGKTYLY | SEQ ID NO:10213<br>EVSNRFS | SEQ ID NO:18225<br>MQSIQLPWT | |
| iPS:435415 | 21-225_150C11 | NA | SEQ ID NO:2202<br>CGGGCAAGTCAGAGCATTAG<br>CAGCTATTTAAAT | SEQ ID NO:10214<br>ACTGCATCCAGTTGCAA<br>AGT | SEQ ID NO:18226<br>CAACAGAGTTACAGTATTTA<br>CACT | |
| | | AA | SEQ ID NO:2203<br>RASQSISSYLN | SEQ ID NO:10215<br>TASSLQS | SEQ ID NO:18227<br>QQSYSIYT | |
| iPS:435417 | 21-225_150D11 | NA | SEQ ID NO:2204<br>AAGTCTAGTCAGAGCCTCCT<br>GCATAGTGAGGGAAAGACC<br>TATTTGTAT | SEQ ID NO:10216<br>GAAGTTCCTACCGGTTC<br>TCT | SEQ ID NO:18228<br>ATGCAAGGTATACAGCTTCC<br>GCTCACT | |
| | | AA | SEQ ID NO:2205<br>KSSQSLLHSEGKTYLY | SEQ ID NO:10217<br>EVSYRFS | SEQ ID NO:18229<br>MQGIQLPLT | |
| | | | SEQ ID NO:2206 | SEQ ID NO:10218 | SEQ ID NO:18230 | |

FIGURE 49
(Continued)

| | | | | |
|---|---|---|---|---|
| iPS:435419 | 21-225_150C12 | NA | CGGGCAAGTCAGAGCATTAG CGACTATTTAAAT SEQ ID NO:2207 | ACTACATCCAGTTTGCAA AGT SEQ ID NO:10219 | CAACAGAGTTCAGTACCCC CACT SEQ ID NO:18231 |
| | | AA | RASQSISDYLN SEQ ID NO:2208 | TTSSLQS SEQ ID NO:10220 | QQSFSTPT SEQ ID NO:18232 |
| iPS:435421 | 21-225_151F1 | NA | AGGGCCAGTCAGAGTATTAA CATCAATATAGCC SEQ ID NO:2209 | GGTGCATCCACCAGGGC CACT SEQ ID NO:10221 | CAGCAGTATAATGACTGGCC TCCGTGGACG SEQ ID NO:18233 |
| | | AA | RASQSINNIA SEQ ID NO:2210 | GASTRAT SEQ ID NO:10222 | QQYNDWPPWT SEQ ID NO:18234 |
| iPS:435423 | 21-225_151G5 | NA | AAGTCTAGTCAGGCGCCTCCT GCATGGTGATGGAAAGACCT ATTTGTAT SEQ ID NO:2211 | GAAGTTTCCAACCGGTTC TCT SEQ ID NO:10223 | ATGCAAAGTATACAGGTTCC GTGGACG SEQ ID NO:18235 |
| | | AA | KSSQRLLHGDGKTYLY SEQ ID NO:2212 | EVSNRFS SEQ ID NO:10224 | MQSIQVPWT SEQ ID NO:18236 |
| iPS:435425 | 21-225_151B12 | NA | CGGGCAAGTCAGAGCATTAG CAACTTTTAAAT SEQ ID NO:2213 | ACTGCATCCAGTTTGGA AAGT SEQ ID NO:10225 | CAACAGAGTTACAGTACCCC CACT SEQ ID NO:18237 |
| | | AA | RASQSISNFLN SEQ ID NO:2214 | TASSLES SEQ ID NO:10226 | QQSYSTPT SEQ ID NO:18238 |
| iPS:435427 | 21-225_151C9 | NA | CGGGCGAGTCAGGGCATTAG CAAGTATTTAGCC SEQ ID NO:2215 | GATGCATCCAGGTTGCA AAGT SEQ ID NO:10227 | CATCAGTATAAACATTACCC GATCACC SEQ ID NO:18239 |
| | | AA | RASQGISKYLA SEQ ID NO:2216 | DASRLQS SEQ ID NO:10228 | HQYKHYPIT SEQ ID NO:18240 |
| iPS:435429 | 21-225_151A10 | NA | AAGTCTAGTCAGAGCCTCCT GCATGGTGATGGAAAGACCT ATTTGTAT SEQ ID NO:2217 | GAAGTTTCCCACCGGTTC TCT SEQ ID NO:10229 | ATGCAAAGTATACAGATTCC GTGGACG SEQ ID NO:18241 |

FIGURE 49
(Continued)

| | | | | | | |
|---|---|---|---|---|---|---|
| iPS:435431 | 21-225_152D2 | AA | KSSQSLLHGDGKTYLY<br>SEQ ID NO:2218 | EVSHRFS<br>SEQ ID NO:10030 | MQSIQIPWT<br>SEQ ID NO:18242 |
| | | NA | CGGGCAAGTCAGAGCATTAG<br>CGACTATTTAAAT<br>SEQ ID NO:2219 | ACTACATCCAGTTTGCAA<br>AGT<br>SEQ ID NO:10031 | CAACAGAGTTACAGTACCCC<br>CACT<br>SEQ ID NO:18243 |
| iPS:435433 | 21-225_152E3 | AA | RASQSISDYLN<br>SEQ ID NO:2220 | TTSSLQS<br>SEQ ID NO:10032 | QQSYSTPT<br>SEQ ID NO:18244 |
| | | NA | AAGTCCAGCCAGAGTGTTT<br>ACACAGCTCCAACAATTACA<br>ACTACTTAGTT<br>SEQ ID NO:2221 | TGGGCATCTACCCGGGA<br>ATCC<br>SEQ ID NO:10033 | CAGCAATATTACAGTACTCC<br>ATTCACT<br>SEQ ID NO:18245 |
| iPS:435435 | 21-225_153H3 | AA | KSSQSVLHSSNNYNYLV<br>SEQ ID NO:2222 | WASTRES<br>SEQ ID NO:10034 | QQYYSTPFT<br>SEQ ID NO:18246 |
| | | NA | AAGTCCAGCCAGAGTGTTT<br>GCACAGCTCCAACAATTACA<br>ACTACTTAACT<br>SEQ ID NO:2223 | TGGGCATCTACCCGGAA<br>ATCC<br>SEQ ID NO:10035 | CAGCAATATTATAGTACTCC<br>GTGCAGT<br>SEQ ID NO:18247 |
| iPS:435437 | 21-225_152F4 | AA | KSSQSVLHSSNNYNYLT<br>SEQ ID NO:2224 | WASTRKS<br>SEQ ID NO:10036 | QQYYSTPCS<br>SEQ ID NO:18248 |
| | | NA | AAGTCCAGCCAGAGTGTTT<br>ATACAGCTCCAACAATTACA<br>ACTACTTAGCT<br>SEQ ID NO:2225 | TGGGCATCTACCCGGAA<br>ATCC<br>SEQ ID NO:10037 | CAGCAATATTTTAATACTCC<br>TCCCACT<br>SEQ ID NO:18249 |
| iPS:435439 | 21-225_152G4 | AA | KSSQSVLYSSNNYNYLA<br>SEQ ID NO:2226 | WASTRKS<br>SEQ ID NO:10038 | QQFNTPPT<br>SEQ ID NO:18250 |
| | | NA | CGGGCAAGTCAGAGCATTAG<br>CGACTATTTAAAT<br>SEQ ID NO:2227 | ACTACATCCAGTTTGCAA<br>AGT<br>SEQ ID NO:10039 | CAACAGAGTTACAGTACCCC<br>CACT<br>SEQ ID NO:18251 |
| | | AA | RASQSISDYLN<br>SEQ ID NO:2228 | TTSSLQS<br>SEQ ID NO:10040 | QQSYSTPT<br>SEQ ID NO:18252 |

FIGURE 49
(Continued)

| | | | | | |
|---|---|---|---|---|---|
| iPS:435441 | 21-225_152F6 | NA | AAGTCTAGTCAGAGCCTCCG GCATGGTGATGGAAAGACCT ATTTGACT<br>SEQ ID NO:2229 | GAAATTTCCAAGCGGTT CACT<br>SEQ ID NO:10241 | ATGCAAAGTATACAGGTTCC GTGGACG<br>SEQ ID NO:18253 |
| | | AA | KSSQSLRHGDGKTYLT<br>SEQ ID NO:2230 | EISKRFT<br>SEQ ID NO:10242 | MQSIQVPWT<br>SEQ ID NO:18254 |
| iPS:435443 | 21-225_152E7 | NA | AGGGCCAGTCAGAGTGTTAT CAGCAGCTACTTAGCC<br>SEQ ID NO:2231 | GGTGTATCTAGTAGGGC CACT<br>SEQ ID NO:10243 | CAACAATATGGTAGGTCACC ATTCAAT<br>SEQ ID NO:18255 |
| | | AA | RASQSVISSYLA<br>SEQ ID NO:2232 | GVSSRAT<br>SEQ ID NO:10244 | QQYGRSPFN<br>SEQ ID NO:18256 |
| iPS:435445 | 21-225_152F7 | NA | CGGGCAAGTCAGGGCATTAG AAATGATTTAGGC<br>SEQ ID NO:2233 | GCTACATCCAGTTTGCAA AGT<br>SEQ ID NO:10245 | CTACAGCATTATAATTTCC GTACAGT<br>SEQ ID NO:18257 |
| | | AA | RASQGIRNDLG<br>SEQ ID NO:2234 | ATSSLQS<br>SEQ ID NO:10246 | LQHYNFPYS<br>SEQ ID NO:18258 |
| iPS:435447 | 21-225_152H7 | NA | CGGGCGAGTCAGGATATTAG CAACTGGTTAGCC<br>SEQ ID NO:2235 | GCTGCATCCAGTTTGCAA GGT<br>SEQ ID NO:10247 | CAACAGACTGACAGTTTCC ATTCACT<br>SEQ ID NO:18259 |
| | | AA | RASQDISNWLA<br>SEQ ID NO:2236 | AASSLQG<br>SEQ ID NO:10248 | QQTDSFPFT<br>SEQ ID NO:18260 |
| iPS:435449 | 21-225_152H9 | NA | CGGGCAAGTCAGGGCATTAG AAATGATTTAGGC<br>SEQ ID NO:2237 | GCTGCATCCAGTTTGCAA AGT<br>SEQ ID NO:10249 | CTACAGCATAGTAATTACC GCTCACT<br>SEQ ID NO:18261 |
| | | AA | RASQGIRNDLG<br>SEQ ID NO:2238 | AASSLQS<br>SEQ ID NO:10250 | LQHSNYPLT<br>SEQ ID NO:18262 |
| iPS:435451 | 21-225_152D10 | NA | AAGTCCAGCCAGAGTGTTTT ATACAGCTCCAACAATAAGA ACTACTTAGCT<br>SEQ ID NO:2239 | TGGGCATCTACCCGGGA ATCC<br>SEQ ID NO:10251 | CAGCAATATTATCGTAGTCC TAGT<br>SEQ ID NO:18263 |

FIGURE 49 (Continued)

| | | | | | | |
|---|---|---|---|---|---|---|
| iPS:435453 | | AA | KSSQSVLYSSNNKNYLA<br>SEQ ID NO:2240 | WASTRES<br>SEQ ID NO:10252 | QQYYRSPS<br>SEQ ID NO:18264 |
| | 21-225_152G10 | NA | CGGGCGAGTCAGGGTATTAG<br>CAACTGGTTAGCC<br>SEQ ID NO:2241 | GCTGCATCCAGTTTGCAA<br>AGT<br>SEQ ID NO:10253 | CAACAGACTGACAGTTCCC<br>ATTCACT<br>SEQ ID NO:18265 |
| | | AA | RASQGISNWLA<br>SEQ ID NO:2242 | AASSLQS<br>SEQ ID NO:10254 | QQTDSFPFT<br>SEQ ID NO:18266 |
| iPS:435455 | 21-225_152B11 | NA | CGGGCAAGTCAGAGCATTAG<br>CGACTATTTAAAT<br>SEQ ID NO:2243 | ACTACACATCCAGTTTGCAA<br>AGT<br>SEQ ID NO:10255 | CAACAGAGTTACAGTACCCC<br>CACT<br>SEQ ID NO:18267 |
| | | AA | RASQSISDYLN<br>SEQ ID NO:2244 | TTSSLQS<br>SEQ ID NO:10256 | QQSYSTPT<br>SEQ ID NO:18268 |
| iPS:435457 | 21-225_152C11 | NA | AAGTCTAGTCAGAGCCTCCT<br>GCATGGTGATGGAAAGACCT<br>ATTTATAT<br>SEQ ID NO:2245 | GAAGTTCCAACCGGTTC<br>TCT<br>SEQ ID NO:10257 | ATGCAAAGTATACAGATTCC<br>GTGGACG<br>SEQ ID NO:18269 |
| | | AA | KSSQSLLHGDGKTYLY<br>SEQ ID NO:2246 | EVSNRFS<br>SEQ ID NO:10258 | MQSIQIPWT<br>SEQ ID NO:18270 |
| iPS:435459 | 21-225_152E12 | NA | ACGTCCAGCCAGAGTATTT<br>ACACAGCTCCAATAATTACA<br>ACTACTTAGCT<br>SEQ ID NO:2247 | TGGGCATCTACCCGGGA<br>ATCC<br>SEQ ID NO:10259 | CAACAATATTATAGTGGTCC<br>GTGCAGT<br>SEQ ID NO:18271 |
| | | AA | TSSQSILHSSNNYNYLA<br>SEQ ID NO:2248 | WASTRES<br>SEQ ID NO:10260 | QQYYSGPCS<br>SEQ ID NO:18272 |
| iPS:435461 | 21-225_153A1 | NA | CGGGGAGTCAGGTCATTAG<br>CAATTATTTAGCC<br>SEQ ID NO:2249 | GCTGCATCCAGTTTGCGA<br>AGT<br>SEQ ID NO:10261 | CAACAGTATCATAGTTACCC<br>ATTCACT<br>SEQ ID NO:18273 |
| | | AA | RASQVISNYLA<br>SEQ ID NO:2250 | AASSLRS<br>SEQ ID NO:10262 | QQYHSYPFT<br>SEQ ID NO:18274 |

FIGURE 49
(Continued)

| | | | | | |
|---|---|---|---|---|---|
| iPS:435463 | 21-225_153D2 | NA | AAGTCTAGTCAGAGCCTCCGGCATGGTGATGGAAAGACCTATTTGACT SEQ ID NO:2251 | GAAGTTCCAAGCGGTTCACT SEQ ID NO:10263 | ATGCAAAGTATACAGGTTCCGTGGACG SEQ ID NO:18275 |
| | | AA | KSSQSLRHGDGKTYLT SEQ ID NO:2252 | EVSKRFT SEQ ID NO:10264 | MQSIQVPWT SEQ ID NO:18276 |
| iPS:435465 | 21-225_153A6 | NA | AGGGCCAGTCAGAGTGTTATCAGCAGCTACTTAGCC SEQ ID NO:2253 | GGTGTATCTAGTAGGGCCACT SEQ ID NO:10265 | CAACAATATGGTAGGTCACCATTCAAT SEQ ID NO:18277 |
| | | AA | RASQSVISSYLA SEQ ID NO:2254 | GVSSRAT SEQ ID NO:10266 | QQYGRSPFN SEQ ID NO:18278 |
| iPS:435467 | 21-225_153B9 | NA | AAGTCCAGCCAGAGTGTTTTATACAGCTCCAACAATAAGAACTACTTAGCT SEQ ID NO:2255 | TGGGCATCTACCCGGGAATTT SEQ ID NO:10267 | CAGCAATATAATCGTAGTCTTAGT SEQ ID NO:18279 |
| | | AA | KSSQSVLYSSNNKNYLA SEQ ID NO:2256 | WASTREF SEQ ID NO:10268 | QQYNRSLS SEQ ID NO:18280 |
| iPS:435469 | 21-225_153G9 | NA | AAGTCTAGTCAGAGCCTCCTGCATAGTGATGGAAAGACCTATTTGTAT SEQ ID NO:2257 | GAAGTTCCAACCGGTTCT SEQ ID NO:10269 | ATGCAAAATATAAAGTATCCGCTCACT SEQ ID NO:18281 |
| | | AA | KSSQSLLHSDGKTYLY SEQ ID NO:2258 | EVSNRFS SEQ ID NO:10270 | MQNIKYPLT SEQ ID NO:18282 |
| iPS:435471 | 21-225_153F11 | NA | AAGTCCAGCCAGAGTGTTTTATACAGCTCCAACAATTACAAGTACTTAGCT SEQ ID NO:2259 | TGGGCATCTACCCGGAAATCC SEQ ID NO:10271 | CAGCAATATTATAGTACTCCGTGCAGT SEQ ID NO:18283 |
| | | AA | KSSQSVLYSSNNYKYLA SEQ ID NO:2260 | WASTRKS SEQ ID NO:10272 | QQYYSTPCS SEQ ID NO:18284 |

FIGURE 49
(Continued)

| | | | | | |
|---|---|---|---|---|---|
| iPS:435475 | 21-225_154H6 | NA | AAGTCCAGCCAGAGTGTTT ACACAGTTCCAACAATTACA ACTATTTAGCT SEQ ID NO:2261 | TGGACATCTACCCGGAA ATCC SEQ ID NO:10273 | CAGCATTATTATAGTACTCC GTGCAGT SEQ ID NO:18285 |
| | | AA | KSSQSVLHSSNNYNYLA SEQ ID NO:2262 | WTSTRKS SEQ ID NO:10274 | QHYYSTPCS SEQ ID NO:18286 |
| iPS:435479 | 21-225_154E9 | NA | CGGGCGAGTCAGGATATTAG CAACTGGTTAGCC SEQ ID NO:2263 | GCTGCATCCAGTTTGCAA AGT SEQ ID NO:10275 | CAACAGGGTAACAGTTCCC GCTCACT SEQ ID NO:18287 |
| | | AA | RASQDISNWLA SEQ ID NO:2264 | AASSLQS SEQ ID NO:10276 | QQGNSFPLT SEQ ID NO:18288 |
| iPS:435481 | 21-225_154A11 | NA | AGGTCAAGCCAGAGTGTTT ACACAGTCCAACAATTATA ACTACTTAGCT SEQ ID NO:2265 | TGGGCATCTAAACGGGA TTCC SEQ ID NO:10277 | CAGCAATATTTTAGTTCTCCT CGGACG SEQ ID NO:18289 |
| | | AA | RSSQSVLHSSNNYNYLA SEQ ID NO:2266 | WASKRDS SEQ ID NO:10278 | QQYFSSPRT SEQ ID NO:18290 |
| iPS:435483 | 21-225_155A4 | NA | CGGGCGAGTCAGGGTATTAG CAACTGGTTAGCC SEQ ID NO:2267 | GCTGCATCCAGTTTGCAA GGT SEQ ID NO:10279 | CACCAGACTGACAGTTTCCC ATTCACT SEQ ID NO:18291 |
| | | AA | RASQGISNWLA SEQ ID NO:2268 | AASSLQG SEQ ID NO:10280 | HQTDSFPFT SEQ ID NO:18292 |
| iPS:435485 | 21-225_155B4 | NA | CGGGCGAGTCAGGATATTAG CAACTGGTTAGCC SEQ ID NO:2269 | GCTGCATCCAGTTTGCAA GGT SEQ ID NO:10281 | CACCAGACTGACAGTTTCCC ATTCACT SEQ ID NO:18293 |
| | | AA | RASQDISNWLA SEQ ID NO:2270 | AASSLQG SEQ ID NO:10282 | HQTDSFPFT SEQ ID NO:18294 |
| iPS:435487 | 21-225_155C4 | NA | CGGGCAAGTCAGAGCATTAG CAGTATTTAAAT SEQ ID NO:2271 | ACTGCATCCAGTTTGCAA AGT SEQ ID NO:10283 | CAACAGAGTTACAGTACCCC CACT SEQ ID NO:18295 |

FIGURE 49
(Continued)

| | | | | RASQSISSYLN | TASSLQS | QQSYSTPT |
|---|---|---|---|---|---|---|
| | | | AA | SEQ ID NO:2272 | SEQ ID NO:10284 | SEQ ID NO:18296 |
| iPS:435489 | 21-225_155A5 | | NA | AAGTCTAGTCAGAGCCTCCTGCATGGTGATGGAAAGACCTATTTGTAT | GAAGTTTCCAATCGGTTCTCT | ATGCAAAGTATACAGGTTCCGTGGACG |
| | | | | SEQ ID NO:2273 | SEQ ID NO:10285 | SEQ ID NO:18297 |
| | | | AA | KSSQSLLHGDGKTYLY | EVSNRFS | MQSIQVPWT |
| | | | | SEQ ID NO:2274 | SEQ ID NO:10286 | SEQ ID NO:18298 |
| iPS:435491 | 21-225_155E5 | | NA | AAGTCCAGCCAGAGTGTTTATCCAGTCCAACAATAATAATTATTTAGCT | TGGGCATCTACCCGGAAATCC | CAGCAATATTATAGTACTCCGTGCAGT |
| | | | | SEQ ID NO:2275 | SEQ ID NO:10287 | SEQ ID NO:18299 |
| | | | AA | KSSQSVLSSSNNNYLA | WASTRKS | QQYYSTPCS |
| | | | | SEQ ID NO:2276 | SEQ ID NO:10288 | SEQ ID NO:18300 |
| iPS:435495 | 21-225_155B6 | | NA | AAGTCCAGCCAGAGTGTTTACACAGTCCAATAATTACAACTACTTAGCT | TGGACATCTACCCGGGAATCC | CAACAATATTATAGTACTCCGTGCAGT |
| | | | | SEQ ID NO:2277 | SEQ ID NO:10289 | SEQ ID NO:18301 |
| | | | AA | KSSQSVLHSSNNYNYLA | WTSTRES | QQYYSTPCS |
| | | | | SEQ ID NO:2278 | SEQ ID NO:10290 | SEQ ID NO:18302 |
| iPS:435497 | 21-225_155H9 | | NA | AGGGCAAGTCAGAGTGTTAGTAGTAACTTAGCC | GGTGCATCCACCAGGGCCACT | CAGCAGTATGATGACTGGCCTCCGTGGACG |
| | | | | SEQ ID NO:2279 | SEQ ID NO:10291 | SEQ ID NO:18303 |
| | | | AA | RASQSVSSNLA | GASTRAT | QQYDDWPPWT |
| | | | | SEQ ID NO:2280 | SEQ ID NO:10292 | SEQ ID NO:18304 |
| iPS:435499 | 21-225_156G1 | | NA | CGGGCAAGTCAGGGCATTAGAAATGATTTAGGC | GCTGCATCCAGTTTGCAAAGT | CTACAGCATAGTAATTACCCGCTCACT |
| | | | | SEQ ID NO:2281 | SEQ ID NO:10293 | SEQ ID NO:18305 |
| | | | AA | RASQGIRNDLG | AASSLQS | LQHSNYPLT |
| | | | | SEQ ID NO:2282 | SEQ ID NO:10294 | SEQ ID NO:18306 |

FIGURE 49
(Continued)

| | | | | | |
|---|---|---|---|---|---|
| iPS:435501 | 21-225_156H1 | NA | AAGTCCAGCCAGAGTGTTTT ATACAGCTCCAACAATAACA ACTACTTAGCT SEQ ID NO:2283 | TGGGCATCTACCCGGGA ATCC SEQ ID NO:10295 | CACCAATATTATAGTACTCC GTGCAGT SEQ ID NO:18307 |
| | | AA | KSSQSVLYSSNNNNYLA SEQ ID NO:2284 | WASTRES SEQ ID NO:10296 | HQYYSTPCS SEQ ID NO:18308 |
| iPS:435503 | 21-225_156E4 | NA | CGGGCAAGTCAGAGAGCATTAG CAGCTATTTAAAT SEQ ID NO:2285 | ACTGCATCCAGTTTGCAA AGT SEQ ID NO:10297 | CAACAGAGTTACAGTGCCCC CACT SEQ ID NO:18309 |
| | | AA | RASQSISSYLN SEQ ID NO:2286 | TASSLQS SEQ ID NO:10298 | QQSYSAPT SEQ ID NO:18310 |
| iPS:435505 | 21-225_157C1 | NA | CGGGCGAGTCAGGGGCATTAG CAATTATTTAGCC SEQ ID NO:2287 | GCTGCATCCAGTTTGCTA AGT SEQ ID NO:10299 | CAACAGTATAATAGTTTTCC ATTCACT SEQ ID NO:18311 |
| | | AA | RASQGISNYLA SEQ ID NO:2288 | AASSLLS SEQ ID NO:10300 | QQYNSFPFT SEQ ID NO:18312 |
| iPS:435509 | 21-225_157H1 | NA | CGGGCGAGTCAGGACATTAG CAATTATTTAGTC SEQ ID NO:2289 | GCTGCATCCAGTTTGCAA AGT SEQ ID NO:10301 | CAACAATATCATAGTTACCC ATTCACT SEQ ID NO:18313 |
| | | AA | RASQDISNYLV SEQ ID NO:2290 | AASSLQS SEQ ID NO:10302 | QQYHSYPFT SEQ ID NO:18314 |
| iPS:435511 | 21-225_157C3 | NA | CGGGCAAGTCAGGGCATTAG AAATGATTTAGGC SEQ ID NO:2291 | GCTGCATCCAGTTTGCAA AGT SEQ ID NO:10303 | CTACAGCATAATAGTTACCC ATTCACT SEQ ID NO:18315 |
| | | AA | RASQGIRNDLG SEQ ID NO:2292 | AASSLQS SEQ ID NO:10304 | LQHNSYPFT SEQ ID NO:18316 |
| iPS:435513 | 21-225_157F3 | NA | CGGGCAAGTCAGAACATTAG CAGTTATTTAAAT SEQ ID NO:2293 | ACTGCATCCAGTTTGCAA AGT SEQ ID NO:10305 | CAACAGAGTTACAATACCCC CACGTGGACG SEQ ID NO:18317 |
| | | AA | RASQNISSYLN | TASSLQS | QQSYNTPTWT |

FIGURE 49
(Continued)

| | | | | | | |
|---|---|---|---|---|---|---|
| iPS:435515 | 21-225_157E4 | NA | SEQ ID NO:2294 CGGGCGAGTCAGGGCATTAG CAATTATTTAGCC | SEQ ID NO:10306 GCTGCATCCAGTTTGCGA AGT | SEQ ID NO:18318 CAACAGTATCATAGTTATCC ATTCACT |
| | | AA | SEQ ID NO:2295 RASQGISNYLA | SEQ ID NO:10307 AASSLRS | SEQ ID NO:18319 QQYHSYPFT |
| iPS:435521 | 21-225_157H4 | NA | SEQ ID NO:2296 CGGGCAAGTCAGGGCATTAG AAATGATTTAGGC | SEQ ID NO:10308 CCTGCATCCAGTTTACAA ACT | SEQ ID NO:18320 CTACAGGATAATAGTTACCC ATTCACT |
| | | AA | SEQ ID NO:2297 RASQGIRNDLG | SEQ ID NO:10309 PASSLQT | SEQ ID NO:18321 LQDNSYPFT |
| iPS:435523 | 21-225_157G5 | NA | SEQ ID NO:2298 CGGGCGAGTCAGGGCATTAA CAATTATTTAGCC | SEQ ID NO:10310 GCTGCATCCAGTTTACAA AGT | SEQ ID NO:18322 CAACAGTATAATAGTTATCC ATTCACT |
| | | AA | SEQ ID NO:2299 RASQGINNYLA | SEQ ID NO:10311 AASSLQS | SEQ ID NO:18323 QQYNSYPFT |
| iPS:435525 | 21-225_157E7 | NA | SEQ ID NO:2300 CGGGCAAGTCAGAGCTTTAG CAGCTATTTAAAT | SEQ ID NO:10312 GCTGCATCCAGTTTGCAA AGT | SEQ ID NO:18324 CAAGAGTATATAGTATCCG CTTCGCC |
| | | AA | SEQ ID NO:2301 RASQSFSSYLN | SEQ ID NO:10313 AASSLQS | SEQ ID NO:18325 QESYSIRFA |
| iPS:435527 | 21-225_157G7 | NA | SEQ ID NO:2302 CGGGCAAGTCAGGGCATTAG AAATGATTTAGGC | SEQ ID NO:10314 GTTGCATCCAGTTTGCAA AGT | SEQ ID NO:18326 ATACAGGATAATAGTCACCC ATTCACT |
| | | AA | SEQ ID NO:2303 RASQGIRNDLG | SEQ ID NO:10315 VASSLQS | SEQ ID NO:18327 IQDNSHPFT |
| iPS:435529 | 21-225_157H7 | NA | SEQ ID NO:2304 CGGGCGAGTCAGGACATTAG CAATTTTTAGCC | SEQ ID NO:10316 ACTGCATCCAGTTTGCAA AGT | SEQ ID NO:18328 CAACAGTATCATAGTTACCC GATCACC |
| | | AA | SEQ ID NO:2305 RASQDISNFLA | SEQ ID NO:10317 TASSLQS | SEQ ID NO:18329 QQYHSYPFT |

FIGURE 49
(Continued)

| | | | | | |
|---|---|---|---|---|---|
| iPS:435531 | 21-225_157G8 | NA | SEQ ID NO:2306 AAGTCTAGTCAGAGCCTCCT GCATGGTGATGGAAAGACCT ATTTATAT | SEQ ID NO:10318 GAAATTTCCAAGCGGTT CTCT | SEQ ID NO:18330 ATGCAAAGTATACAGGTTCC GTGGACG |
| | | AA | SEQ ID NO:2307 KSSQSLLHGDGKTYLY | SEQ ID NO:10319 EISKRFS | SEQ ID NO:18331 MQSIQVPWT |
| iPS:435533 | 21-225_157H8 | NA | SEQ ID NO:2308 CGGGCAAGTCAGGGCATTAG AAATGATTAGGC | SEQ ID NO:10320 GCTGCATCCAGTTTGCAA AGT | SEQ ID NO:18332 CTACAGCATAATAGTTACC ATTCACT |
| | | AA | SEQ ID NO:2309 RASQGIRNDLG | SEQ ID NO:10321 AASSLQS | SEQ ID NO:18333 LQHNSYPFT |
| iPS:435535 | 21-225_157H10 | NA | SEQ ID NO:2310 CGGGCGAGTCAGGGCATTAC CAATTATTAGCC | SEQ ID NO:10322 ACTGCATCCAATTGCAA AGT | SEQ ID NO:18334 CAACAGTATCATAGTTACC ATTCACT |
| | | AA | SEQ ID NO:2311 RASQGITNYLA | SEQ ID NO:10323 TASNLQS | SEQ ID NO:18335 QQYHSYPFT |
| iPS:435537 | 21-225_157H12 | NA | SEQ ID NO:2312 CGGGCAAGTCAGGGCATTAG AAATGATTAGGC | SEQ ID NO:10324 GCTGCATCCAGTTTGCAA AGT | SEQ ID NO:18336 CTACAGCATTATAGTTACAG ATTCACT |
| | | AA | SEQ ID NO:2313 RASQGIRNDFG | SEQ ID NO:10325 AASSLQS | SEQ ID NO:18337 LQHYSYPFT |
| iPS:435539 | 21-225_158G1 | NA | SEQ ID NO:2314 CGGGCAAGTCAGGGCATTAG AAATGATTAGGC | SEQ ID NO:10326 ACTGCATCCAATTGCAA AGT | SEQ ID NO:18338 CTACAGCATAATAGTTACC GTGGACG |
| | | AA | SEQ ID NO:2315 RASQGIRNDLG | SEQ ID NO:10327 TASNLQS | SEQ ID NO:18339 LQHNSYPWT |
| iPS:435543 | 21-225_158D4 | NA | SEQ ID NO:2316 CGGGCAAGTCAGGACATTAG AAAGGATTAGGC | SEQ ID NO:10328 GCTGCATCCAGTTGCAA AGT | SEQ ID NO:18340 CTACAGCATTATAGTTACC TCGGACG |
| | | | SEQ ID NO:2317 | SEQ ID NO:10329 | SEQ ID NO:18341 |

FIGURE 49 (Continued)

| | | | | AASSLQS | | LQHYSYPRT | |
|---|---|---|---|---|---|---|---|
| iPS:435545 | | | RASQDIRKDLG | AA | | | |
| | 21-225_158F4 | | SEQ ID NO:2318 | | SEQ ID NO:10330 | | SEQ ID NO:18342 |
| | | | CGGGCAAGTCAGGAACATTAG AAAGTATTACAT | NA | ACTGCATCCACTTTACAA AGT | | CAACAGAGTTACAATATTTC ATTCACT |
| | | | SEQ ID NO:2319 | | SEQ ID NO:10331 | | SEQ ID NO:18343 |
| iPS:435547 | | | RASQNIRKYLH | AA | TASTLQS | | QQSYNISFT |
| | 21-225_158F5 | | SEQ ID NO:2320 | | SEQ ID NO:10332 | | SEQ ID NO:18344 |
| | | | CGGGCAAGTCAGGGCATTAG AAATGATTAGGC | NA | GCTGCATCCAGTTTGCAA AGT | | CTACAGGATAATAGTCACCC ATTCACT |
| | | | SEQ ID NO:2321 | | SEQ ID NO:10333 | | SEQ ID NO:18345 |
| iPS:435549 | | | RASQGIRNDLG | AA | AASSLQS | | LQDNSHPFT |
| | 21-225_158H5 | | SEQ ID NO:2322 | | SEQ ID NO:10334 | | SEQ ID NO:18346 |
| | | | CGGGCAAGTCAGGGCATGA GAATTGATTTAGGG | NA | CGTGCATCCAGTTTGCAA AGT | | GTACAGCATAATAGTTACCC TCTCACT |
| | | | SEQ ID NO:2323 | | SEQ ID NO:10335 | | SEQ ID NO:18347 |
| iPS:435551 | | | RASQGMRIDLG | AA | RASSLQS | | VQHNSYPLT |
| | 21-225_158H6 | | SEQ ID NO:2324 | | SEQ ID NO:10336 | | SEQ ID NO:18348 |
| | | | CGGGCAAGTCAGGGCATTAG AAGTGATTAGGC | NA | ACTGCATCCAGTTTGCAA AGT | | CTACAGCATAATAGTTACCC ATTCACT |
| | | | SEQ ID NO:2325 | | SEQ ID NO:10337 | | SEQ ID NO:18349 |
| iPS:435553 | | | RASQGIRSDLG | AA | TASSLQS | | LQHNSYPFT |
| | 21-225_158G8 | | SEQ ID NO:2326 | | SEQ ID NO:10338 | | SEQ ID NO:18350 |
| | | | CGGGCAAGTCAGGACATTAG AAATGATTAGGC | NA | ACTGCATCCAGTTTGCAA AGT | | CTACAGCATAATAGTTACCC ATTCACT |
| | | | SEQ ID NO:2327 | | SEQ ID NO:10339 | | SEQ ID NO:18351 |
| iPS:435557 | | | RASQDIRNDLG | AA | TASSLQS | | LQHNSYPFT |
| | 21-225_158B12 | | SEQ ID NO:2328 | | SEQ ID NO:10340 | | SEQ ID NO:18352 |
| | | | AAGTCCAGCTCCAGAGAATGTTTT ACACAGCTCCAACAATAACA ACTACTTAACT | NA | TGGGCATCTACCCGGGA ATCC | | CAGCAATATTATAGTACTCC TCCGACG |

FIGURE 49
(Continued)

| | | | | | | |
|---|---|---|---|---|---|---|
| | 21-225_158B12 | AA | SEQ ID NO:2329 KSSQNVLHSSNNNNYLT | SEQ ID NO:10341 WASTRES | SEQ ID NO:18353 QQYYSTPPT | |
| iPS:435559 | 21-225_158H12 | NA | SEQ ID NO:2330 CGGGCGAGTCAGGGCATTAA CAATTATTTAGCC | SEQ ID NO:10342 GCTGCATCCAGTTTACAA AGT | SEQ ID NO:18354 CAACAGTATCATAGTTACCC ATTCACT | |
| iPS:435561 | 21-225_159F1 | AA | SEQ ID NO:2331 RASQGINNYLA | SEQ ID NO:10343 AASSLQS | SEQ ID NO:18355 QQYHSYPFT | |
| | | NA | SEQ ID NO:2332 CGGGCAAGTCAGCGCGTCAG AAATGATTAGGC | SEQ ID NO:10344 GATGCATCCAATTGCA AAGT | SEQ ID NO:18356 CTACAGCATCATAGTTCCC GATCACC | |
| iPS:435563 | 21-225_159H2 | AA | SEQ ID NO:2333 RASQRVRNDLG | SEQ ID NO:10345 DASNLQS | SEQ ID NO:18357 LQHHSFPIT | |
| | | NA | SEQ ID NO:2334 CGGGCAAGTCAGAGCATTAG CAAATATTTAAAT | SEQ ID NO:10346 GCTACACATCCAATTGCAA AGT | SEQ ID NO:18358 CAACAGAGTTACAGTCTCCC GGTCACT | |
| iPS:435565 | 21-225_159C4 | AA | SEQ ID NO:2335 RASQSISKYLN | SEQ ID NO:10347 ATSNLQS | SEQ ID NO:18359 QQSYSLPVT | |
| | | NA | SEQ ID NO:2336 CAGGCGAGTCAGGACATTAG CGACTATTTAAAT | SEQ ID NO:10348 GATGCCTCCACTTTGGAA ACA | SEQ ID NO:18360 CAACAATATGATAATCTCCC GATCACC | |
| iPS:435569 | 21-225_159C5 | AA | SEQ ID NO:2337 QASQDISDYLN | SEQ ID NO:10349 DASTLET | SEQ ID NO:18361 QQYDNLPIT | |
| | | NA | SEQ ID NO:2338 CGGACAAGTCAGGGCATTAG AAATGATTAGGC | SEQ ID NO:10350 GCTGCATCCAGTTGCAA AGT | SEQ ID NO:18362 CTACAGCATAATAGTTATCC ATTCACT | |
| iPS:435571 | | AA | SEQ ID NO:2339 RTSQGIRNDLG | SEQ ID NO:10351 AASSLQS | SEQ ID NO:18363 LQHNSYPFT | |
| | | NA | SEQ ID NO:2340 CGGGCAAGTCAGGACATTAG AAAGGATTAGG | SEQ ID NO:10352 GCTGCATCCAGTTGCAA AGT | SEQ ID NO:18364 CTACAGCATCATAGTTATCC TCGGACG | |

FIGURE 49
(Continued)

| | | | | | | |
|---|---|---|---|---|---|---|
| iPS:435573 | 21-225_159C8 | AA | SEQ ID NO:2341 RASQDIRKDLG | SEQ ID NO:2341 | SEQ ID NO:10353 AASSLQS | SEQ ID NO:18365 LQHHSYPRT |
| | | NA | SEQ ID NO:2342 CGGGCAAGTCGGGACATTAGG AAATGATTAGGC | SEQ ID NO:10354 GCTGCATCCAGTTGCAA AGT | SEQ ID NO:18366 CTACAGCATTATAGTTACC TCGGACG |
| iPS:435575 | 21-225_159D8 | AA | SEQ ID NO:2343 RASRDIGNDLG | SEQ ID NO:10355 AASSLQS | SEQ ID NO:18367 LQHYSYPRT |
| | | NA | SEQ ID NO:2344 CGGGCGAGTCAGGGCATTAG CAAATATTTAGTC | SEQ ID NO:10356 GCTGCATCCAGTCTGCA AAGT | SEQ ID NO:18368 CAACAGTATAATAGTTACC ATTCACT |
| iPS:435577 | 21-225_159H11 | AA | SEQ ID NO:2345 RASQGISKYLV | SEQ ID NO:10357 AASSLQS | SEQ ID NO:18369 QQYNSYPFT |
| | | NA | SEQ ID NO:2346 AAGTCTAGTCAGAGCCTCCT GCATGGTGATGGGAAGACCT ATTTCTAT | SEQ ID NO:10358 GAAGTATCCAAGCGGTT CTCT | SEQ ID NO:18370 ATGCAAAGTATACAGATTCC GTGGACG |
| iPS:435579 | 21-225_160B1 | AA | SEQ ID NO:2347 KSSQSLLHGDGKTYFY | SEQ ID NO:10359 EVSKRFS | SEQ ID NO:18371 MQSIQIPWT |
| | | NA | SEQ ID NO:2348 CGGGCGAGTCAGGACATTAA CAATTATTAGCC | SEQ ID NO:10360 GCTTCATCCAGTTGCAA AGT | SEQ ID NO:18372 CAACAATATCATAGTTACC ATTCACT |
| iPS:435581 | 21-225_160G1 | AA | SEQ ID NO:2349 RASQDINNYLA | SEQ ID NO:10361 ASSSLQS | SEQ ID NO:18373 QQYHSYPFT |
| | | NA | SEQ ID NO:2350 CGGGCAAGTCAGGACATTAG AAATGATTAGGC | SEQ ID NO:10362 GCTGCATCCAGTTGCAG AAT | SEQ ID NO:18374 CTACAGCATAATAGTTTCCC GTGGACG |
| | 21-225_160H1 | AA | SEQ ID NO:2351 RASQDIRNDLG | SEQ ID NO:10363 AASSLQN | SEQ ID NO:18375 LQHNSFPWT |
| | | NA | SEQ ID NO:2352 | SEQ ID NO:10364 | SEQ ID NO:18376 |

FIGURE 49
(Continued)

| ID | subID | Type | Col1 | Col2 | Col3 |
|---|---|---|---|---|---|
| iPS:435583 | 21-225_160F2 | NA | CGGGCAAGTCAGGGCATTAGAAATGATTTAGGC SEQ ID NO:2353 | ACTGCATCCAATTTGCAA AGT SEQ ID NO:10365 | CTACAGCATAATAGTTACCC GTGGACG SEQ ID NO:18377 |
| | | AA | RASQGIRNDLG SEQ ID NO:2354 | TASNLQS SEQ ID NO:10366 | LQHNSYPWT SEQ ID NO:18378 |
| iPS:435585 | 21-225_160G3 | NA | CGGGCGAGTCAGGACATTAA CAATTATTAGCC SEQ ID NO:2355 | GCTTCATCCAGTTTGCAA AGT SEQ ID NO:10367 | CAACAATATCATAGTTACCC ATTCACT SEQ ID NO:18379 |
| | | AA | RASQDINNYLA SEQ ID NO:2356 | ASSSLQS SEQ ID NO:10368 | QQYHSYPFT SEQ ID NO:18380 |
| iPS:435587 | 21-225_160H3 | NA | CGGGCAAGTCAGGGCATTAG AAATGATTTAGGC SEQ ID NO:2357 | GCTGCATCCAGTTTGCAA AGT SEQ ID NO:10369 | CTACAGCATAGTAATTACCC GCTCACT SEQ ID NO:18381 |
| | | AA | RASQGIRNDLG SEQ ID NO:2358 | AASSLQS SEQ ID NO:10370 | LQHSNYPLT SEQ ID NO:18382 |
| iPS:435589 | 21-225_160A4 | NA | AAGTCCAGCAGGCCAGAGTGTTTT ACACAGCTCCAACAATAATA ACTACTTAGCT SEQ ID NO:2359 | TGGGCATCTACCGGGA ATCC SEQ ID NO:10371 | CAGCAATATTATAATAGTCC GTGCAGT SEQ ID NO:18383 |
| | | AA | KSSQSVLHSSNNNNYLA SEQ ID NO:2360 | WASTRES SEQ ID NO:10372 | QQYYNSPCS SEQ ID NO:18384 |
| iPS:435591 | 21-225_160C4 | NA | CGGGCAAGTCAGGGCATTAG AAAGGATTTAGGC SEQ ID NO:2361 | GCTGCATCCAGTTTGCAA AGT SEQ ID NO:10373 | CTACAGCATTATAGTTATCC TCGGACG SEQ ID NO:18385 |
| | | AA | RASQDIRKDLG SEQ ID NO:2362 | AASSLQS SEQ ID NO:10374 | LQHYSYPRT SEQ ID NO:18386 |
| iPS:435593 | 21-225_160F4 | NA | CGGGCAAGTCAGGGCATTAG AAATGATTTAGGG SEQ ID NO:2363 | GTTGCATCCAGTTTGCAA AGT SEQ ID NO:10375 | ATACAGGATAATAGTCACCC ATTCACT SEQ ID NO:18387 |
| | | AA | RASQGIRNDLG | VASSLQS | IQDNSHPFT |

FIGURE 49
(Continued)

| | | | | | |
|---|---|---|---|---|---|
| iPS:435595 | 21-225_160H4 | NA | SEQ ID NO:2364 CGGGCGAGTCAGGACATTAG TAATTATTAGTC | SEQ ID NO:10376 GTTGCATCCAGTTGCAA AGT | SEQ ID NO:18388 CAACAGTATAATAGTTACCC TCTCACT |
| | | AA | SEQ ID NO:2365 RASQDISNYLV | SEQ ID NO:10377 VASSLQS | SEQ ID NO:18389 QQYNSYPLT |
| iPS:435599 | 21-225_160B10 | NA | SEQ ID NO:2366 CGGGCAAGTCAGGGCATTAG AAATGATTTAGGC | SEQ ID NO:10378 GCTGCATCCAGTTGCAA AGT | SEQ ID NO:18390 CTACAGCATAGTAGTTACCC GCTCACT |
| | | AA | SEQ ID NO:2367 RASQGIRNDLG | SEQ ID NO:10379 AASSLQS | SEQ ID NO:18391 LQHSSYPLT |
| iPS:435601 | 21-225_160G10 | NA | SEQ ID NO:2368 AAGTCTAGTCAGAGCCTCCT GCACGGTGATGGAAAGACCT ATTTGTAT | SEQ ID NO:10380 GAAGTTTCCAAACGGTT CTCT | SEQ ID NO:18392 ATGCAAAGTATACAGCTTCC GTGGACG |
| | | AA | SEQ ID NO:2369 KSSQSLLHGDGKTYLY | SEQ ID NO:10381 EVSKRFS | SEQ ID NO:18393 MQSIQLPWT |
| iPS:435605 | 21-225_161A4 | NA | SEQ ID NO:2370 AGGTCCAGTCAGAGTGTTAA CAGCAACTTAGCC | SEQ ID NO:10382 GGTGCATCCATCAGGGC CACT | SEQ ID NO:18394 CAGCAGTATAATAACTGGTG GACG |
| | | AA | SEQ ID NO:2371 RSSQSVNSNLA | SEQ ID NO:10383 GASIRAT | SEQ ID NO:18395 QQYNNWWT |
| iPS:435607 | 21-225_161G4 | NA | SEQ ID NO:2372 CAGGCGAGTCAGGACATTTA CAATTATTTAAAT | SEQ ID NO:10384 GATGCATCCAATTGGA AACA | SEQ ID NO:18396 CAACAGTATGATATTCTCCC GATCACC |
| | | AA | SEQ ID NO:2373 QASQDIYNYLN | SEQ ID NO:10385 DASNLET | SEQ ID NO:18397 QQYDILPIT |
| iPS:435609 | 21-225_161F7 | NA | SEQ ID NO:2374 CGGGCAAGTCAGGGCATTAG AAATGATTTGGGC | SEQ ID NO:10386 GCTGCATCCACTTTGCAA AGT | SEQ ID NO:18398 CTACTATATATTCGTTACCA TTCACT |
| | | | SEQ ID NO:2375 | SEQ ID NO:10387 | SEQ ID NO:18399 |

FIGURE 49 (Continued)

| | | | | | | |
|---|---|---|---|---|---|---|
| iPS:435611 | 21-225_161F10 | AA | RASQGIRNDLG<br>SEQ ID NO:2376 | AASTLQS<br>SEQ ID NO:10388 | LLYIRYPFT<br>SEQ ID NO:18400 | |
| | | NA | CAGGCGAGTCAGGGACATTTA<br>CAACCATTAAGT<br>SEQ ID NO:2377 | GATGCATCCAATTGGGA<br>AACA<br>SEQ ID NO:10389 | CAACAGTATGAAAATCTCCC<br>GCTCACC<br>SEQ ID NO:18401 | |
| iPS:435613 | 21-225_161D11 | AA | QASQDIYNHLS<br>SEQ ID NO:2378 | DASNWET<br>SEQ ID NO:10390 | QQYENLPLT<br>SEQ ID NO:18402 | |
| | | NA | CGGGCAAGTCAGGGCATTAG<br>AAATGATTTGGGC<br>SEQ ID NO:2379 | GCTGCATCCACCTTGCAA<br>AGT<br>SEQ ID NO:10391 | CTACAATATAATCGTTACC<br>ATTCACT<br>SEQ ID NO:18403 | |
| iPS:435615 | 21-225_161G12 | AA | RASQGIRNDLG<br>SEQ ID NO:2380 | AASTLQS<br>SEQ ID NO:10392 | LQYNRYPFT<br>SEQ ID NO:18404 | |
| | | NA | CGGGCAAGTCAGGACATCAG<br>AAAGGATTTAGGG<br>SEQ ID NO:2381 | GCTGCATCCAGTTGCAA<br>AGT<br>SEQ ID NO:10393 | CTACAGCATCATAGTTATCC<br>TCGGACG<br>SEQ ID NO:18405 | |
| iPS:435617 | 21-225_162F2 | AA | RASQDIRKDLG<br>SEQ ID NO:2382 | AASSLQS<br>SEQ ID NO:10394 | LQHHSYPRT<br>SEQ ID NO:18406 | |
| | | NA | CGGGCAAGTCAGGGCATTAG<br>AAATGATTTAGGC<br>SEQ ID NO:2383 | GCTGCATCCAGTTGCAA<br>AGT<br>SEQ ID NO:10395 | ATACAGGATAATAGTCACC<br>ATTCACT<br>SEQ ID NO:18407 | |
| iPS:435621 | 21-225_162H3 | AA | RASQGIRNDLG<br>SEQ ID NO:2384 | AASSLQS<br>SEQ ID NO:10396 | IQDNSHPFT<br>SEQ ID NO:18408 | |
| | | NA | CGGGCAAGTCAGGGCATTAG<br>AAATGATTAGGC<br>SEQ ID NO:2385 | GCTGCATCCAGTTGCAA<br>AGT<br>SEQ ID NO:10397 | CTACAGGATAATAGTCACC<br>ATTCACT<br>SEQ ID NO:18409 | |
| iPS:435623 | 21-225_162D5 | AA | RASQGIRNDLG<br>SEQ ID NO:2386 | AASSLQS<br>SEQ ID NO:10398 | LQDNSHPFT<br>SEQ ID NO:18410 | |
| | | NA | AAGTCCAACCATAGTGTTTT<br>ATACAGGTCCAACAATAATC<br>AATACTTAGCT | CGGACATCTATCCGGAA<br>ATCC | CAGCAATATTATAGTACTCC<br>TCCCACT | |

FIGURE 49
(Continued)

| | | | | | | |
|---|---|---|---|---|---|---|
| iPS:435627 | 21-225_162D5 | AA | SEQ ID NO:2387<br>KSNHSVLYRSNNNQYLA<br>SEQ ID NO:2388 | SEQ ID NO:10399<br>RTSIRKS<br>SEQ ID NO:10400 | SEQ ID NO:18411<br>QQYYSTPPT<br>SEQ ID NO:18412 |
| iPS:435629 | 21-225_162F6 | NA | AAGTCCAGCAGAATGTTT<br>ACACAGCTCCAACAATAACA<br>ACTACTTAACT<br>SEQ ID NO:2389<br>KSSQNVLHSSNNNNYLT<br>SEQ ID NO:2390 | TGGGCATCTACCCGGGA<br>ATCC<br>SEQ ID NO:10401<br>WASTRES<br>SEQ ID NO:10402 | CAGCAATATTATAGTACTCC<br>TCCGACG<br>SEQ ID NO:18413<br>QQYYSTPPT<br>SEQ ID NO:18414 |
| iPS:435635 | 21-225_162H6 | NA | AAGTCTACTCAGAGCCTCCT<br>GCATGGTGATGGAAAGACCT<br>ATTTGTAT<br>SEQ ID NO:2391<br>KSTQSLLHGDGKTYLY<br>SEQ ID NO:2392 | GAAGTTTCCAAGCGGTT<br>CTCT<br>SEQ ID NO:10403<br>EVSKRFS<br>SEQ ID NO:10404 | AAGCAAAGTATACAGCTTCC<br>GTGGACG<br>SEQ ID NO:18415<br>KQSIQLPWT<br>SEQ ID NO:18416 |
| iPS:435635 | 21-225_163F1 | NA | CGGGCAAGTCAGGACATTAG<br>CAATTATTTAGCC<br>SEQ ID NO:2393<br>RASQDISNYLA<br>SEQ ID NO:2394 | GCTGCATCCAGTTTGCAA<br>AGT<br>SEQ ID NO:10405<br>AASSLQS<br>SEQ ID NO:10406 | CAACAGTATAATAGTTACCC<br>ATTCACT<br>SEQ ID NO:18417<br>QQYNSYPFT<br>SEQ ID NO:18418 |
| iPS:435637 | 21-225_163E2 | AA | CGGGCAAGTCAGGACATTAG<br>AAATGATTTAGGC<br>SEQ ID NO:2395<br>RASQDIRNDLG<br>SEQ ID NO:2396 | CCTGCATCCAGTTTGCAA<br>AGT<br>SEQ ID NO:10407<br>PASSLQS<br>SEQ ID NO:10408 | CTACAGCATAATAGTCACCC<br>ATTCACT<br>SEQ ID NO:18419<br>LQHNSHPFT<br>SEQ ID NO:18420 |
| iPS:435639 | 21-225_163G6 | NA | CGGGCGAGTCAGGACATTAG<br>CAATTATTTAGTC<br>SEQ ID NO:2397<br>RASQDISNYLV<br>SEQ ID NO:2398 | GCTGCATCCAGTTTGCTA<br>AGT<br>SEQ ID NO:10409<br>AASSLLS<br>SEQ ID NO:10410 | CAACAGTATCATAGTTACCC<br>GCTCACT<br>SEQ ID NO:18421<br>QQYHSYPLT<br>SEQ ID NO:18422 |

FIGURE 49 (Continued)

| | | | | |
|---|---|---|---|---|
| iPS:435641 | 21-225_163F9 | NA | CGGGCAAGTCAGGACATTAG AGATGATTAGGC SEQ ID NO:2399 | CCTGCATCCAGTTGCAA AGT SEQ ID NO:10411 | CTACAGGATAATAGTTACCC ATTCACT SEQ ID NO:18423 |
| | | AA | RASQDIRDDLG SEQ ID NO:2400 | PASSLQS SEQ ID NO:10412 | LQDNSYPFT SEQ ID NO:18424 |
| iPS:435643 | 21-225_163G10 | NA | CGGGCAAGTCAGGACATTAG AAATAATTTAGGC SEQ ID NO:2401 | CCTGCATCCAGTTGCAA AGT SEQ ID NO:10413 | CTACAGGATTATAGTTACCC ATTCACT SEQ ID NO:18425 |
| | | AA | RASQDIRNNLG SEQ ID NO:2402 | PASSLQS SEQ ID NO:10414 | LQDYSYPFT SEQ ID NO:18426 |
| iPS:435649 | 21-225_165H2 | NA | AAGTCCAGCCAGAGTGTTTT ACACAGCTCCAACAATAAGA ACTACTTAACT SEQ ID NO:2403 | TGGGCATCTACCCGAGA ATCC SEQ ID NO:10415 | CAGCAATCTTATAGTATTCC TCCCACT SEQ ID NO:18427 |
| | | AA | KSSQSVLHSSNNKNYLT SEQ ID NO:2404 | WASTRES SEQ ID NO:10416 | QQSYSIPPT SEQ ID NO:18428 |
| iPS:435653 | 21-225_166H12 | NA | CGGGCGAGTCAGGACATTAG CCATTATTAGCC SEQ ID NO:2405 | GCTGCATCCAGTTGCAA AGT SEQ ID NO:10417 | CAACAGTATAATAGTTTCCC GCTCACT SEQ ID NO:18429 |
| | | AA | RASQDISHYLA SEQ ID NO:2406 | AASSLQS SEQ ID NO:10418 | QQYNSFPLT SEQ ID NO:18430 |
| iPS:435655 | 21-225_167E2 | NA | AAGTCTAGTCAGAGCCTCCT GCACGGTGATGGGAAGACCT ATTTGTAT SEQ ID NO:2407 | GAAGTTCCAAAACGGTT CTCT SEQ ID NO:10419 | ATGCAAAGCATACAGCTTCC GTGGACG SEQ ID NO:18431 |
| | | AA | KSSQSLLHGDGKTYLY SEQ ID NO:2408 | EVSKRFS SEQ ID NO:10420 | MQSIQLPWT SEQ ID NO:18432 |
| iPS:435657 | 21-225_167H10 | NA | AAGTCTAGTCAGAGCCTCCT GCACGGTGATGGAAAGACCT ATTTGTAT | GAAGTTCCAAACGGTT CTCT | ATGCAAAGCATACAGCTTCC GTGGACG |

FIGURE 49
(Continued)

| | | | | | | |
|---|---|---|---|---|---|---|
| iPS:435659 | 21-225_167H10 | AA | SEQ ID NO:2409<br>KSSQSLLHGDGKTYLY | SEQ ID NO:10421<br>EVSKRFS | SEQ ID NO:18433<br>MQSIQLPWT | |
| iPS:435663 | 21-225_167D12 | NA | SEQ ID NO:2410<br>CGGGGAGTCAGGGCATTAA<br>CAATTATTAGGC | SEQ ID NO:10422<br>GCTGCATCCAGTTTGCAA<br>AGT | SEQ ID NO:18434<br>CAACAGTATAATAGTTATCC<br>ATTCACT | |
| | | AA | SEQ ID NO:2411<br>RASQGINNYLA | SEQ ID NO:10423<br>AASSLQS | SEQ ID NO:18435<br>QQYNSYPFT | |
| iPS:435665 | 21-225_169B1 | NA | SEQ ID NO:2412<br>CGGGCTAGTCAGGGCATTAG<br>AAATGATTTAGGC | SEQ ID NO:10424<br>GCTGAATCCAGTTTGCA<br>AAGT | SEQ ID NO:18436<br>CTACAGCATTATAGTTACC<br>GCTCACT | |
| | | AA | SEQ ID NO:2413<br>RASQGIRNDLG | SEQ ID NO:10425<br>AESSLQS | SEQ ID NO:18437<br>LQHYSYPLT | |
| iPS:435667 | 21-225_169F2 | NA | SEQ ID NO:2414<br>AAGTCCAGCCAGAGTGTTT<br>ATACATCTCCAACAATAAAA<br>ACTACTTAGCT | SEQ ID NO:10426<br>TGGGCATCTACCCGGA<br>ATCC | SEQ ID NO:18438<br>CAGCAATATATGTGCTCC<br>CACC | |
| | | AA | SEQ ID NO:2415<br>KSSQSVLYTSNNKNYLA | SEQ ID NO:10427<br>WASTRES | SEQ ID NO:18439<br>QQYYRAPT | |
| iPS:435669 | 21-225_169E3 | NA | SEQ ID NO:2416<br>AGGTCTAGTCAGAGCCTCCT<br>GCATAATAATGGATACAAGT<br>ATTTGGAT | SEQ ID NO:10428<br>TTGGGTTCTAATCGGGCC<br>TCC | SEQ ID NO:18440<br>ATGCAAGTTCTACAAACTCC<br>GTGGACG | |
| | | AA | SEQ ID NO:2417<br>RSSQSLLHNNGYKYLD | SEQ ID NO:10429<br>LGSNRAS | SEQ ID NO:18441<br>MQVLQTPWT | |
| iPS:435669 | 21-225_169F9 | NA | SEQ ID NO:2418<br>CGGGCAAGTCAGGGCATTAG<br>AAATGATTTAGGC | SEQ ID NO:10430<br>GCTGCATCCAGTTTGCAA<br>AGT | SEQ ID NO:18442<br>CTACAGCATTATAGTTACC<br>GCTCACT | |
| | | AA | SEQ ID NO:2419<br>RASQGIRNDLG | SEQ ID NO:10431<br>AASSLQS | SEQ ID NO:18443<br>LQHYSYPLT | |
| | | | SEQ ID NO:2420 | SEQ ID NO:10432 | SEQ ID NO:18444 | |

FIGURE 49
(Continued)

| | | | | | | |
|---|---|---|---|---|---|---|
| iPS:435671 | 21-225_169H5 | NA | AAGTCCAGCCAGAGTGTTTT ATACATCCAACAATAAAA ACTACTTAGCT SEQ ID NO:2421 | TGGGCATCTACCCGGGA ATCC SEQ ID NO:10433 | CAGCAATATTATCGTGCTCC CACC SEQ ID NO:18445 |
| | | AA | KSSQSVLYISNKNYLA SEQ ID NO:2422 | WASTRES SEQ ID NO:10434 | QQYYRAPT SEQ ID NO:18446 |
| iPS:435673 | 21-225_169E6 | NA | AGGTCTAGTCAGGAGCCTCCT GCATAATAATGGATACAAAGT ATTTGGAT SEQ ID NO:2423 | TTGGGTTCTAATCGGGCC TCC SEQ ID NO:10435 | ATGCAAGTTCTACAAACTCC GTGGACG SEQ ID NO:18447 |
| | | AA | RSSQSLLHNNGYKYLD SEQ ID NO:2424 | LGSNRAS SEQ ID NO:10436 | MQVLQTPWT SEQ ID NO:18448 |
| iPS:435675 | 21-225_169D7 | NA | CGGGCAAGTCAGGGCATTAG AAATGATTAGGC SEQ ID NO:2425 | GCTGCATCCAGTTTGCAA AGT SEQ ID NO:10437 | CTACAGCATCATAGTTGCCC GTGGACG SEQ ID NO:18449 |
| | | AA | RASQGIRNDLG SEQ ID NO:2426 | AASSLQS SEQ ID NO:10438 | LQHHSCPWT SEQ ID NO:18450 |
| iPS:435677 | 21-225_169C10 | NA | CGGGCGAGTCAGGACATTAG CAATTATTAGCC SEQ ID NO:2427 | TCTGCATCCAGTTTGCAA AGT SEQ ID NO:10439 | CAACAATCTGATAGTTACCC TCTCACT SEQ ID NO:18451 |
| | | AA | RASQDISNYLA SEQ ID NO:2428 | SASSLQS SEQ ID NO:10440 | QQSDSYPLT SEQ ID NO:18452 |
| iPS:435679 | 21-225_169D10 | NA | CGGGCGAGTCAGGACATTAG CAATTATTAGCC SEQ ID NO:2429 | GCTGCATCCAGTTTGCAA AGT SEQ ID NO:10441 | CAACAGTATCATAGTTACCC ATTCACT SEQ ID NO:18453 |
| | | AA | RASQDISNYLA SEQ ID NO:2430 | AASSLQS SEQ ID NO:10442 | QQYHSYPFT SEQ ID NO:18454 |
| iPS:435681 | 21-225_169D11 | NA | CGGGCAAGTCAGGGCATTAG AGATGATTAGGC SEQ ID NO:2431 | GCTGCATCCAGTTTGCAA AGT SEQ ID NO:10443 | CTTCAGCATTATAGTTACCCT CGGACG SEQ ID NO:18455 |

FIGURE 49
(Continued)

| | | | | | | |
|---|---|---|---|---|---|---|
| iPS:435683 | 21-225_170A1 | AA | RASQGIRDDLG SEQ ID NO:2432 | AASSLQS SEQ ID NO:10444 | LQHYSYPRT SEQ ID NO:18456 |
| | | NA | AAGTCTAGTCAGAGCCTCCT GCATGGTGATGGAAAGACCT TCT ATTTGTTT SEQ ID NO:2433 | GAAGTTTCCAACCGGTTC SEQ ID NO:10445 | ATGCAAAGTATTCAGCTTCC GTGGACG SEQ ID NO:18457 |
| iPS:435685 | | AA | KSSQSLLHGDGKTYLF SEQ ID NO:2434 | EVSNRFS SEQ ID NO:10446 | MQSIQLPWT SEQ ID NO:18458 |
| | | NA | CGGGGCGAGTCAGGGCATTAG CAATTATTTAGCC SEQ ID NO:2435 | GCTGCATCCAGTTGCAA AGT SEQ ID NO:10447 | CAACAGTATCATAGTTACC ATTCACT SEQ ID NO:18459 |
| iPS:435687 | 21-225_170E1 | AA | RASQGISNYLA SEQ ID NO:2436 | AASSLQS SEQ ID NO:10448 | QQYHSYPFT SEQ ID NO:18460 |
| | | NA | CGGGCAAGTCAGGGCATTAG AAATGATTTAGGC SEQ ID NO:2437 | GCTACACATCCAGTTGCAA AGT SEQ ID NO:10449 | CTACAGCATAGTAGTAACC GTGGACG SEQ ID NO:18461 |
| iPS:435689 | 21-225_170H1 | AA | RASQGIRNDLG SEQ ID NO:2438 | ATSSLQS SEQ ID NO:10450 | LQHSSNPWT SEQ ID NO:18462 |
| | | NA | CGGGCAAGTCGGGGCATTAG AAATGATTTAGGC SEQ ID NO:2439 | GCTGCATCCAGTTGCAA AGT SEQ ID NO:10451 | CTACAGCATTATAGTTACC TCGGACG SEQ ID NO:18463 |
| iPS:435693 | 21-225_170F3 | AA | RASRGIRNDLG SEQ ID NO:2440 | AASSLQS SEQ ID NO:10452 | LQHYSYPRT SEQ ID NO:18464 |
| | | NA | CGGGCAAGTCAGGGCATTAG AAATGATTTAGGC SEQ ID NO:2441 | GCTGCATCCACTTGCAA AGT SEQ ID NO:10453 | CTACAGCATTATAGTTACC GCTCACT SEQ ID NO:18465 |
| iPS:435695 | 21-225_170G4 | AA | RASQGIRNDLG SEQ ID NO:2442 | AASTLQS SEQ ID NO:10454 | LQHYSYPLT SEQ ID NO:18466 |
| | | NA | CGGGCAAGTCAGGGCATTAG AAATGATTTAGGC | GCTGCATCCAGTTGCAA AAT | CTACAGCATTATAGTTCCC GCTCACT |

FIGURE 49
(Continued)

| | | | | | | | |
|---|---|---|---|---|---|---|---|
| iPS:435697 | 21-225_170D5 | AA | SEQ ID NO:2443<br>RASQGIRNDLG<br>SEQ ID NO:2444 | | SEQ ID NO:10455<br>AASSLQN<br>SEQ ID NO:10456 | | SEQ ID NO:18467<br>LQHYSFPLT<br>SEQ ID NO:18468 |
| | | NA | CGGGCAAGTCAGGGCATTAG<br>AACTGATTAGGC<br>SEQ ID NO:2445 | | ACTGCATCCAGTTGCAA<br>AGT<br>SEQ ID NO:10457 | | CTACAGCATTATAGTTACCC<br>GCTCACT<br>SEQ ID NO:18469 |
| iPS:435699 | 21-225_170G5 | AA | RASQGIRTDLG<br>SEQ ID NO:2446 | | TASSLQS<br>SEQ ID NO:10458 | | LQHYSYPLT<br>SEQ ID NO:18470 |
| | | NA | CGGGCGAGTCAGGGACATTGG<br>CAATTGTTAGCC<br>SEQ ID NO:2447 | | TCTGCGTCCAGTTGCAA<br>AGT<br>SEQ ID NO:10459 | | CAACAATCTGATAGTTACTCC<br>TCTCACT<br>SEQ ID NO:18471 |
| iPS:435701 | 21-225_170D6 | AA | RASQDIGNCLA<br>SEQ ID NO:2448 | | SASSLQS<br>SEQ ID NO:10460 | | QQSDSYPLT<br>SEQ ID NO:18472 |
| | | NA | AAGTCCAGCAGCCAGAGTGTTT<br>ACACAGTCCAACACAATTACA<br>ACTACTTAGCT<br>SEQ ID NO:2449 | | TGGGCATCTACCCGGAA<br>ATCC<br>SEQ ID NO:10461 | | CAGCAATATATTATAGTACTCC<br>GTGGACG<br>SEQ ID NO:18473 |
| iPS:435703 | 21-225_170F6 | AA | KSSQSVLHSSNNYNYLA<br>SEQ ID NO:2450 | | WASTRKS<br>SEQ ID NO:10462 | | QQYYSTPWT<br>SEQ ID NO:18474 |
| | | NA | CGGGCAAGTCAGGGCATTAG<br>AAATGATTAGGC<br>SEQ ID NO:2451 | | GCTGCATCCAGTTGCAA<br>AAT<br>SEQ ID NO:10463 | | CTACAGCATTATAGTTACCC<br>GCTCACT<br>SEQ ID NO:18475 |
| iPS:435705 | 21-225_170D11 | AA | RASQGIRNDLG<br>SEQ ID NO:2452 | | AASSLQN<br>SEQ ID NO:10464 | | LQHYSFPLT<br>SEQ ID NO:18476 |
| | | NA | CGGGCAAGTCAGGGCATTAG<br>AACTGATTAGGC<br>SEQ ID NO:2453 | | ACTGCATCCAGTTGCAA<br>AGT<br>SEQ ID NO:10465 | | CTACAGCATTATAGTTACCC<br>GCTCACT<br>SEQ ID NO:18477 |
| | 21-225_171C3 | AA | RASQGIRTDLG<br>SEQ ID NO:2454 | | TASSLQS<br>SEQ ID NO:10466 | | LQHYSYPLT<br>SEQ ID NO:18478 |

FIGURE 49
(Continued)

| | | | | | |
|---|---|---|---|---|---|
| iPS:435709 | 21-225_171A4 | NA | CGGGCAAGTCAGGGCATTAG AAATGATTAGGC<br>SEQ ID NO:2455 | ACTGCATCCAGTTTGCAA AGT<br>SEQ ID NO:10467 | CTACAGGCATTATAGTTACCC GCTCACT<br>SEQ ID NO:18479 |
| | | AA | RASQGIRNDLG<br>SEQ ID NO:2456 | TASSLQS<br>SEQ ID NO:10468 | LQHYSYPLT<br>SEQ ID NO:18480 |
| iPS:435711 | 21-225_171G4 | NA | CGGGCGAGTCAGGGTGTTAA CGACTGGTTAGCC<br>SEQ ID NO:2457 | GATGCATCAAGTTTGCA AAGT<br>SEQ ID NO:10469 | CAACAGGCTAACAGTTTCCC GTGGACG<br>SEQ ID NO:18481 |
| | | AA | RASQGVNDWLA<br>SEQ ID NO:2458 | DASSLQS<br>SEQ ID NO:10470 | QQANSFPWT<br>SEQ ID NO:18482 |
| iPS:435713 | 21-225_171D7 | NA | AGGTCTAGTCAGAGCCTCCT GTATCATAATGGATACAACT ATTTGGAT<br>SEQ ID NO:2459 | GTGGGTTCTAATCGGGC CTCC<br>SEQ ID NO:10471 | ATGCAAACTCTACAAACTCC GCTCACT<br>SEQ ID NO:18483 |
| | | AA | RSSQSLLYHNGYNYLD<br>SEQ ID NO:2460 | VGSNRAS<br>SEQ ID NO:10472 | MQTLQTPLT<br>SEQ ID NO:18484 |
| iPS:435715 | 21-225_171A8 | NA | CGGGCGAGTCAGGGTATTAG CAACTGGTTAGCC<br>SEQ ID NO:2461 | GCTGCATTCAGTTTGCAA GGT<br>SEQ ID NO:10473 | CAACAGACTAACAGTTTCCC GTGGACG<br>SEQ ID NO:18485 |
| | | AA | RASQGISNWLA<br>SEQ ID NO:2462 | AAFSLQG<br>SEQ ID NO:10474 | QQTNSFPWT<br>SEQ ID NO:18486 |
| iPS:435717 | 21-225_171A9 | NA | CGGGCGAGTCAGGATATTAC CACCTGGTTAGCC<br>SEQ ID NO:2463 | GATGCATCCAGTTTGCA AAGT<br>SEQ ID NO:10475 | CTACAGACTAACAGTTTCCC GTGGACG<br>SEQ ID NO:18487 |
| | | AA | RASQDITTWLA<br>SEQ ID NO:2464 | DASSLQS<br>SEQ ID NO:10476 | LQTNSFPWT<br>SEQ ID NO:18488 |
| iPS:435719 | 21-225_171A11 | NA | CGGGCAAGTCAGGGCATTAG AAATAATTTAGGC<br>SEQ ID NO:2465 | CCTGCATCCAGTTTGCAA AGT<br>SEQ ID NO:10477 | CTACAGGATCATAGTTACCC ATTCACT<br>SEQ ID NO:18489 |
| | | AA | RASQGIRNNLG | PASSLQS | LQDHSYPFT |

FIGURE 49
(Continued)

| | | | | | | |
|---|---|---|---|---|---|---|
| iPS:435723 | 21-225_172B3 | NA | SEQ ID NO:2466 CGGGCTAGTCAGGGCATTAG AAATGATTAGGC | SEQ ID NO:10478 GCTGAATCCAGTTGCA AAGT | SEQ ID NO:18490 CTACAGCATTATAGTTACCC GCTCACT |
| | | AA | SEQ ID NO:2467 RASQGIRNDLG | SEQ ID NO:10479 AESSLQS | SEQ ID NO:18491 LQHYSYPLT |
| iPS:435723 | 21-225_172B7 | NA | SEQ ID NO:2468 AAGTCTAGTCAGAGCCTCCT GCATGGTGATGGAAAGACCTT ATTTCTAT | SEQ ID NO:10480 GAAGTTTCCCACCGGGTC TCT | SEQ ID NO:18492 ATGCAAAGTATACAGTTTCC GTGGACG |
| | | AA | SEQ ID NO:2469 KSSQSLLHGDGKTYFY | SEQ ID NO:10481 EVSHRFS | SEQ ID NO:18493 MQSIQFPWT |
| iPS:435725 | 21-225_172G8 | NA | SEQ ID NO:2470 CGGGCAAGTCAGGGCGTTAG AAATGATTAGGC | SEQ ID NO:10482 GCTGCATCCAGTTGCAA AAT | SEQ ID NO:18494 CTACACCATTATAGTTTCCC GCTCACT |
| | | AA | SEQ ID NO:2471 RASQGVRNDLG | SEQ ID NO:10483 AASSLQN | SEQ ID NO:18495 LHHYSFPLT |
| iPS:435727 | 21-225_172E11 | NA | SEQ ID NO:2472 AAGTCCAGCAGAGTGTTT ACACAGTCCAACAATAACA ACTACTTAGCT | SEQ ID NO:10484 TGGGCATCTACTCGGGA ATCC | SEQ ID NO:18496 CAGCAATATTTACTACTACTCC GTGCAGT |
| | | AA | SEQ ID NO:2473 KSSQSVLHSSNNNNYLA | SEQ ID NO:10485 WASTRES | SEQ ID NO:18497 QQYFTTPCS |
| iPS:435729 | 21-225_173E7 | NA | SEQ ID NO:2474 CGTGCAAGTCAGAGACCATTAG CAACTATTTAAAT | SEQ ID NO:10486 GCTGCATCCAGTTGCAA ATT | SEQ ID NO:18498 CAACAGAGTTACAGAACCCC TCAGTGGACG |
| | | AA | SEQ ID NO:2475 RASQTISNYLN | SEQ ID NO:10487 AASSLQI | SEQ ID NO:18499 QQSYRTPQWT |
| | | | SEQ ID NO:2476 | SEQ ID NO:10488 | SEQ ID NO:18500 |

FIGURE 49
(Continued)

| | | | | |
|---|---|---|---|---|
| iPS:435731 | 21-225_173A11 | NA | AAGTCTAGTCAGAGCCTCCTGCATGGTGATGGAAAGACCTATTTGTAT SEQ ID NO:2477 | GAAGTTTCCAACCGGTTCTCT SEQ ID NO:10489 | ATGCAAAGTATACAGGTTCCGTGGACG SEQ ID NO:18501 |
| | | AA | KSSQSLLHGDGKTYLY SEQ ID NO:2478 | EVSNRFS SEQ ID NO:10490 | MQSIQVPWT SEQ ID NO:18502 |
| iPS:435733 | 21-225_173C11 | NA | AAGTCTAGTCAGAGCCTCCTGCATAGTGAGGGAAAGACCTACTTGTAT SEQ ID NO:2479 | GAAGTTTCCCACCGGTTCTCT SEQ ID NO:10491 | ATGCAAAGTATACAGCTTCTCACT SEQ ID NO:18503 |
| | | AA | KSSQSLLHSEGKTYLY SEQ ID NO:2480 | EVSHRFS SEQ ID NO:10492 | MQSIQLLT SEQ ID NO:18504 |
| iPS:435735 | 21-225_173H12 | NA | CGGGCAAGTCAGGGCATTAGAAATGATTAGGC SEQ ID NO:2481 | ACTACATCCAGTTTGCAAAGT SEQ ID NO:10493 | CTACAGCATTATAGTTTCCCGAACACT SEQ ID NO:18505 |
| | | AA | RASQGIRNDLG SEQ ID NO:2482 | TTSSLQS SEQ ID NO:10494 | LQHYSFPNT SEQ ID NO:18506 |
| iPS:435737 | 21-225_174G5 | NA | AAGTCCAGCCAGAGTGTATTACACAGCTCCAACAATTACAACTACTTAACT SEQ ID NO:2483 | TGGGCATCTACCCGGGAATCC SEQ ID NO:10495 | CAGCAATATTATCGTACTCCGTGGACG SEQ ID NO:18507 |
| | | AA | KSSQSVLHSSNNYNYLT SEQ ID NO:2484 | WASTRES SEQ ID NO:10496 | QQYYRTPWT SEQ ID NO:18508 |
| iPS:435739 | 21-225_174G7 | NA | CGGGCGAGTCAGGGTATTAGCAACTGGTTAGCC SEQ ID NO:2485 | GCTGCATTCAGTTTGCAAGGT SEQ ID NO:10497 | CAACAGACTAACAGTTTCCCGTGGACG SEQ ID NO:18509 |
| | | AA | RASQGISNWLA SEQ ID NO:2486 | AAFSLQG SEQ ID NO:10498 | QQTNSFPWT SEQ ID NO:18510 |
| iPS:435741 | | NA | CGGGCAAGTCAGGGCATTAGAGATGATTAGGC | GCTGCATCCAGTTTGCAAAGT | CTTCAGCATCATAGTTACCCTCGGACG |

FIGURE 49
(Continued)

| | | | | | | | |
|---|---|---|---|---|---|---|---|
| iPS:435743 | 21-225_174G10 | AA | SEQ ID NO:2487 RASQGIRDDLG SEQ ID NO:2488 | | SEQ ID NO:10499 AASSLQS SEQ ID NO:10500 | | SEQ ID NO:18511 LQHHSYPRT SEQ ID NO:18512 |
| iPS:435745 | 21-225_175G1 | NA | SEQ ID NO:2489 RASQGIRTDLG SEQ ID NO:2490 | CGGGCAAGTCAGGGCATTAG AACTGATTAGGC | SEQ ID NO:10501 TASSLQS SEQ ID NO:10502 | ACTGCATCCAGTTTGCAA AGT | SEQ ID NO:18513 LQHYSYPLT SEQ ID NO:18514 | CTACAGCATTATAGTTACCC GCTCACT |
| iPS:435747 | 21-225_175G3 | AA | SEQ ID NO:2491 RASQDISNDLA SEQ ID NO:2492 | CGGGGAGTCAGGACATTAG CAATGATTAGGC | SEQ ID NO:10503 SASSLQS SEQ ID NO:10504 | TCTGCATCCAGTTTGCAA AGT | SEQ ID NO:18515 QQSDSYPLT SEQ ID NO:18516 | CAACAATCTGATAGTTACCC TCTCACT |
| iPS:435749 | 21-225_175C4 | NA | SEQ ID NO:2493 RASQGIGNYLA SEQ ID NO:2494 | CGGGGAGTCAGGGCATTGG GAATTATTAGCC | SEQ ID NO:10505 AASGLQS SEQ ID NO:10506 | GCTGCATCCGGTTTGCAA AGT | SEQ ID NO:18517 QQYYSYPFT SEQ ID NO:18518 | CAACAGTATTATAGTTACCC ATTCACT |
| iPS:435751 | 21-225_175C10 | AA | SEQ ID NO:2495 RASQGITDWLA SEQ ID NO:2496 | CGGGGAGTCAGGGGTATTAC CGACTGGTTAGCC | SEQ ID NO:10507 AASSLQS SEQ ID NO:10508 | GCTGCATCCAGTTTGCAA AGT | SEQ ID NO:18519 QQTNSFPWT SEQ ID NO:18520 | CAACAGACTAACAGTTTCCC GTGGACG |
| iPS:435753 | 21-225_175D10 | NA AA | SEQ ID NO:2497 KSSQSVLYSSNNNNYLA SEQ ID NO:2498 | AAGTCCAGCCAGAGTGTTT ATACAGCTCCAACAATAACA ACTACTTAGCT | SEQ ID NO:10509 WTSTRES SEQ ID NO:10510 | TGGACATCTACCCGGGA ATCC | SEQ ID NO:18521 QQYYSTPPT SEQ ID NO:18522 | CAGCAATATTATAGTACTCC TCCGACG |

FIGURE 49
(Continued)

| | | | | | |
|---|---|---|---|---|---|
| iPS:435753 | 21-225_175G18 | NA | CGGGCAAGTCAGAGACCATTGG CAACTATTTAAAT SEQ ID NO:2499 | GCTGCATCCAGTTTGCAC AGT SEQ ID NO:10511 | CAACAGAGTTACAGAACCCC TCAGTGGACG SEQ ID NO:18523 |
| | | AA | RASQTIGNYLN SEQ ID NO:2500 | AASSLHS SEQ ID NO:10512 | QQSYRTPQWT SEQ ID NO:18524 |
| iPS:435755 | 21-225_176H4 | NA | AAGTCTAGTCAGAGCCTCCT GCATGGTGATGGAAAGACCT ATTTGTAT SEQ ID NO:2501 | GAAGTTTCCAACCGGTTC TCT SEQ ID NO:10513 | ATGCAAAGTATACAGATTCC GTGGACG SEQ ID NO:18525 |
| | | AA | KSSQSLLHGDGKTYLY SEQ ID NO:2502 | EVSNRFS SEQ ID NO:10514 | MQSIQIPWT SEQ ID NO:18526 |
| iPS:435759 | 21-225_176E6 | NA | AGGTCTAGTCAGAGCCTCCT GCATAATAATGGATACAAGT ATTTGGAT SEQ ID NO:2503 | TTGGGTTCTAATCGGGCC TCC SEQ ID NO:10515 | ATGCAAGTTCTACAAACTCC GTGGACG SEQ ID NO:18527 |
| | | AA | RSSQSLLHNNGYKYLD SEQ ID NO:2504 | LGSNRAS SEQ ID NO:10516 | MQVLQTPWT SEQ ID NO:18528 |
| iPS:435761 | 21-225_176B11 | NA | CGGGCAAGTCAGGGCATTAG AAATGATTTAGGC SEQ ID NO:2505 | GCTGCATCCAGTTGCAA AGT SEQ ID NO:10517 | CTACAGCATTATAGTTACC GCTCACT SEQ ID NO:18529 |
| | | AA | RASQGIRNDLG SEQ ID NO:2506 | AASSLQS SEQ ID NO:10518 | LQHYSYPLT SEQ ID NO:18530 |
| iPS:435763 | 21-225_176H12 | NA | CGGGCAAGTCAGGGCATTAG AAATGATTTAGGC SEQ ID NO:2507 | GCTGCATCCAGTTGCAA AGT SEQ ID NO:10519 | CTACAGCATATAGTTACC TCGCAGT SEQ ID NO:18531 |
| | | AA | RASQGIRNDLG SEQ ID NO:2508 | AASSLQS SEQ ID NO:10520 | LQHNSYPRS SEQ ID NO:18532 |
| iPS:435765 | 21-225_177D3 | NA | CGGGCGAGTCAGGGCATTAC CAATTATTTAGCC SEQ ID NO:2509 | GCTGCATCCAGTTGCAA AGT SEQ ID NO:10521 | CAACAGTATAATAGTTACC ATTCACT SEQ ID NO:18533 |

FIGURE 49
(Continued)

| | | | RASQGITNYLA | AASSLQS | QQYNSYPFT |
|---|---|---|---|---|---|
| iPS:435767 | | AA | SEQ ID NO:2510 | SEQ ID NO:10522 | SEQ ID NO:18534 |
| | 21-225_177B4 | NA | CGGGCAAGTCAGGGCATTAG AAATGATTTAGGC | GCTGCATCCAGTTTGCAA AGT | CTACAGCATTATAGTTTCCCT CGCAGT |
| | | | SEQ ID NO:2511 | SEQ ID NO:10523 | SEQ ID NO:18535 |
| iPS:435769 | | AA | RASQGIRNDLG | AASSLQS | LQHYSFPRS |
| | | | SEQ ID NO:2512 | SEQ ID NO:10524 | SEQ ID NO:18536 |
| | 21-225_177B6 | NA | CGGGCAAGTCAGGACATTAG CAATGATTTAGGC | GCTGCATCCAGTTTGCAA AGT | CTACAGCAGTTAATAGTTACCC ATTCACT |
| | | | SEQ ID NO:2513 | SEQ ID NO:10525 | SEQ ID NO:18537 |
| iPS:435771 | | AA | RASQDISNDLG | AASSLQS | LQLNSYPFT |
| | | | SEQ ID NO:2514 | SEQ ID NO:10526 | SEQ ID NO:18538 |
| | 21-225_177B11 | NA | AAGTCTAGTCAGGCCCTCCT GCATGGTGATGGAAAGACCT ATTTGTAT | GAAGTTCCAACCGGTTC TCT | ATGCAAAGTATACAGATTCC GTGGACG |
| | | | SEQ ID NO:2515 | SEQ ID NO:10527 | SEQ ID NO:18539 |
| iPS:435773 | | AA | KSSQRLLHGDGKTYLY | EVSNRFS | MQSIQIPWT |
| | | | SEQ ID NO:2516 | SEQ ID NO:10528 | SEQ ID NO:18540 |
| | 21-225_177B12 | NA | AAGTCCAGCCAGAGTGTTT ACACAGCTCCAACAATAACA ACTACTTAACT | TGGGCATCTACCCGGGA ATCC | CAGCAATATTATAGTAGTCC TCCGACG |
| | | | SEQ ID NO:2517 | SEQ ID NO:10529 | SEQ ID NO:18541 |
| iPS:435775 | | AA | KSSQSVLHSSNNNNYLT | WASTRES | QQYYSSPPT |
| | | | SEQ ID NO:2518 | SEQ ID NO:10530 | SEQ ID NO:18542 |
| | 21-225_178A5 | NA | CGGGCGAGTCAGGGTATTAG CAACTGGTTAGCC | GCTGCTTCCAGTTTGCAA AGT | CAACAGGCTAACAGTTTACC GTGGACG |
| | | | SEQ ID NO:2519 | SEQ ID NO:10531 | SEQ ID NO:18543 |
| | | AA | RASQGISNWLA | AASSLQS | QQANSLPWT |
| | | | SEQ ID NO:2520 | SEQ ID NO:10532 | SEQ ID NO:18544 |

FIGURE 49
(Continued)

| | | | | | |
|---|---|---|---|---|---|
| iPS:435777 | 21-225_178F7 | NA | CGGGCGAGTCAGGATATTAC TGACTGGTTAGCC SEQ ID NO:2521 | GCTGCATCCAGTTTGCAG AGT SEQ ID NO:10533 | CAACAGGCTAACAGTTACC GTGGACG SEQ ID NO:18545 |
| | | AA | RASQDITDWLA SEQ ID NO:2522 | AASSLQS SEQ ID NO:10534 | QQANSLPWT SEQ ID NO:18546 |
| iPS:435779 | 21-225_178B10 | NA | CGGGCAAGTCAGGGCATTAG AAATGATTAGGC SEQ ID NO:2523 | GCTGCATCCAGTTTGCAA AAT SEQ ID NO:10535 | CTACACCATTATAGTTTCC GCTCACT SEQ ID NO:18547 |
| | | AA | RASQGIRNDLG SEQ ID NO:2524 | AASSLQN SEQ ID NO:10536 | LHHYSFPLT SEQ ID NO:18548 |
| iPS:435781 | 21-225_178G10 | NA | AAGTCTAGTCAGAGCCTCCT GCATAGTGATGGAAAGACCT ATTTGTAT SEQ ID NO:2525 | GAAGTTTCCAACCGGTTT TCT SEQ ID NO:10537 | ATGCAAAGTATACAGGTTCC GTGGACG SEQ ID NO:18549 |
| | | AA | KSSQSLLHGDGKTYLY SEQ ID NO:2526 | EVSNRFS SEQ ID NO:10538 | MQSIQVPWT SEQ ID NO:18550 |
| iPS:435783 | 21-225_179G1 | NA | CGGGCGAGTCAGGATATTAG CGACTGGTTAGCC SEQ ID NO:2527 | GCTGCATCCAGTTTGCAA AGT SEQ ID NO:10539 | CAACAGGCTAACAGTTACC GTGGACG SEQ ID NO:18551 |
| | | AA | RASQDISDWLA SEQ ID NO:2528 | AASSLQS SEQ ID NO:10540 | QQANSLPWT SEQ ID NO:18552 |
| iPS:435785 | 21-225_179C2 | NA | AAATCTAGTCAGAGCCTCCT GCATAGTGAGGGAAAGACC TACTTGTAT SEQ ID NO:2529 | GAGGTTTCCCACCGGTTC TCT SEQ ID NO:10541 | ATGCAAAGTATACAGGTTCT CACT SEQ ID NO:18553 |
| | | AA | KSSQSLLHSEGKTYLY SEQ ID NO:2530 | EVSHRFS SEQ ID NO:10542 | MQSIQVLT SEQ ID NO:18554 |
| iPS:435787 | 21-225_180A3 | NA | CGGGCGAGTCAGGATATTAC CAGCTGGTTAGCC SEQ ID NO:2531 | GCTGCATCCAGTTTGCAA AGT SEQ ID NO:10543 | CAACAGGCTAACAGTATCC ATTCACT SEQ ID NO:18555 |

FIGURE 49
(Continued)

| | | | | | | | |
|---|---|---|---|---|---|---|---|
| iPS:435789 | 21-225_180C4 | AA | RASQDITSWLA<br>SEQ ID NO:2532 | AAGTCTAGTCAGAGACCTCCT<br>GCATGGTGATGGAAAGACCT<br>ATTTGTAT<br>SEQ ID NO:2533 | AASSLQS<br>SEQ ID NO:10544 | GCAACTTCCAACCGGTTC<br>CCT<br>SEQ ID NO:10545 | QQANSIPFT<br>SEQ ID NO:18556<br>ATGCAAAGTATACAGGTTCC<br>GTGGACG<br>SEQ ID NO:18557 |
| iPS:435791 | 21-225_180H7 | AA | KSSQSLLHGDGKTYLY<br>SEQ ID NO:2534 | CGGGCAAGTCAGGGCATTAG<br>AAATGATTTAGGC<br>SEQ ID NO:2535 | ATSNRFP<br>SEQ ID NO:10546 | ACTGCATCCAGTTGCAA<br>AGT<br>SEQ ID NO:10547 | MQSIQVPWT<br>SEQ ID NO:18558<br>CTACAGCATAATAGTTACC<br>ATTCACT<br>SEQ ID NO:18559 |
| iPS:435793 | 21-225_180F8 | AA | RASQGIRNDLG<br>SEQ ID NO:2536 | CGGGCAAGTCAGAGACCATTCT<br>CAGCTATTTAAAT<br>SEQ ID NO:2537 | TASSLQS<br>SEQ ID NO:10548 | GGTGTATCCAGTTACAA<br>AGT<br>SEQ ID NO:10549 | LQHNSYPFT<br>SEQ ID NO:18560<br>CAGCAGAGTTACAGGTACCC<br>ATTCACT<br>SEQ ID NO:18561 |
| iPS:435795 | 21-225_181C2 | AA | RASQTILSYLN<br>SEQ ID NO:2538 | AAGTCTAGTCAGAGACCTCCT<br>GCATGGTGATGGAAAGACCT<br>ATTTGTAT<br>SEQ ID NO:2539 | GVSSLQS<br>SEQ ID NO:10550 | GAAGTTTCCAACCGGTTC<br>TCT<br>SEQ ID NO:10551 | QQSYSTPFT<br>SEQ ID NO:18562<br>ATGCAAAGTATACAGGTTCC<br>CTGGACG<br>SEQ ID NO:18563 |
| iPS:435797 | 21-225_181G2 | NA | KSSQSLLHGDGKTYLY<br>SEQ ID NO:2540 | CGGGGAGTCAGGGCATTAG<br>CAATTATTTAGCC<br>SEQ ID NO:2541 | EVSNRFS<br>SEQ ID NO:10552 | GCTGCATCCAGTTGCAA<br>AGT<br>SEQ ID NO:10553 | MQSIQVPWT<br>SEQ ID NO:18564<br>CAACAGTATAATGGTTACC<br>ATTCACT<br>SEQ ID NO:18565 |
| | | AA | RASQGISNYLA<br>SEQ ID NO:2542 | | AASSLQS<br>SEQ ID NO:10554 | | QQYNGYPFT<br>SEQ ID NO:18566 |

FIGURE 49
(Continued)

| | | | | | |
|---|---|---|---|---|---|
| iPS:435799 | 21-225_181G3 | NA | CGGGCAAGTCACAGCATTAG CAACTATTAAAT SEQ ID NO:2543 | ACTACATTGAATTGCAA AGT SEQ ID NO:10555 | CAACAGAGTTACAGTTCTCC TCCGTGGACG SEQ ID NO:18567 |
| | | AA | RASHSISNYLN SEQ ID NO:2544 | TTLNLQS SEQ ID NO:10556 | QQSYSSPPWT SEQ ID NO:18568 |
| iPS:435801 | 21-225_181E5 | NA | AAGTCCAGCAGGCAGAGTGTTT ACACAGTCCAACAATTACA ACTACTTAACT SEQ ID NO:2545 | TGGGCATCTACCCGGA ATCC SEQ ID NO:10557 | CATCAGTATTTTATTACTCCG TGGACG SEQ ID NO:18569 |
| | | AA | KSSQSVLHSSNNYNYLT SEQ ID NO:2546 | WASTRES SEQ ID NO:10558 | HQYFITPWT SEQ ID NO:18570 |
| iPS:435805 | 21-225_181A8 | NA | CGGGCAAGTCAGGGCATTAG AAATGATTTAGGC SEQ ID NO:2547 | ACTGCATCCAGTTGCAA AGT SEQ ID NO:10559 | CTACAGCATAATAGTTACCC ATTCACT SEQ ID NO:18571 |
| | | AA | RASQGIRNDLG SEQ ID NO:2548 | TASSLQS SEQ ID NO:10560 | LQHNSYPFT SEQ ID NO:18572 |
| iPS:435807 | 21-225_181C10 | NA | AAGTCTAGTCAGAGCCTCCT GCATGGTGATGGAAAGACCT ATTGTAT SEQ ID NO:2549 | GAAGTTTCCAATCGGTC TCT SEQ ID NO:10561 | ATGCAAAGTATACAGATTCC CTGGACG SEQ ID NO:18573 |
| | | AA | KSSQSLLHGDGKTYLY SEQ ID NO:2550 | EVSNRFS SEQ ID NO:10562 | MQSIQIPWT SEQ ID NO:18574 |
| iPS:435809 | 21-225_182H5 | NA | CGGGCGAGTCAGGATATTAC CAGCTGGTTAGCC SEQ ID NO:2551 | GCTGCATCCAGTTACAA AGT SEQ ID NO:10563 | CAACAGGTTAACAGTTTCCC ATTCACT SEQ ID NO:18575 |
| | | AA | RASQDITSWLA SEQ ID NO:2552 | AASSLQS SEQ ID NO:10564 | QQVNSFPFT SEQ ID NO:18576 |
| iPS:435811 | 21-225_183H6 | NA | CAGGGCGAGTCAGGACATTAG CAACTATTTAAAT SEQ ID NO:2553 | GATGCATCCAATTGGA AACA SEQ ID NO:10565 | CAACAGTATGATAATCTCCC TCTCACT SEQ ID NO:18577 |

FIGURE 49
(Continued)

| | | | | | | | |
|---|---|---|---|---|---|---|---|
| iPS:435813 | 21-225_183A12 | AA | QASQDISNYLN<br>SEQ ID NO:2554 | | DASNLET<br>SEQ ID NO:10566 | | QQYDNLPLT<br>SEQ ID NO:18578 |
| | | NA | CGGGCAAGTCGGAACATCA<br>GCAACTATTTAAAT<br>SEQ ID NO:2555 | | GTTGTATCCAGTTTGCAA<br>AGT<br>SEQ ID NO:10567 | | CAACAGAGTTACAGTTCCC<br>TCCGTGGACG<br>SEQ ID NO:18579 |
| iPS:435815 | 21-225_190G10 | AA | RASRNISNYLN<br>SEQ ID NO:2556 | | VVSSLQS<br>SEQ ID NO:10568 | | QQSYSSPPWT<br>SEQ ID NO:18580 |
| | | NA | AGGGCCAGTCCGAGTGTTAG<br>CAGCAGATTCTTAGCC<br>SEQ ID NO:2557 | | GGTGCATCCAGCAGGGC<br>CACT<br>SEQ ID NO:10569 | | CAGCAGTATGGTAGCTCACC<br>TCCGTGGACG<br>SEQ ID NO:18581 |
| iPS:435817 | 21-225_190B11 | AA | RASPSVSSRFLA<br>SEQ ID NO:2558 | | GASSRAT<br>SEQ ID NO:10570 | | QQYGSSPPWT<br>SEQ ID NO:18582 |
| | | NA | CGGGCCAGTCAGAGTATTGG<br>TAGTAACTTACAC<br>SEQ ID NO:2559 | | TCTGCTTCCCAGTCCTTC<br>TCA<br>SEQ ID NO:10571 | | CAGCAGAGTAGTAGTTACC<br>GTGGACG<br>SEQ ID NO:18583 |
| iPS:435819 | 21-225_190C11 | AA | RASQSIGNLH<br>SEQ ID NO:2560 | | SASQSFS<br>SEQ ID NO:10572 | | QQSSSLPWT<br>SEQ ID NO:18584 |
| | | NA | CGGACGAGTCAGGGCATTGG<br>CAATTATTAGCC<br>SEQ ID NO:2561 | | AAAACATCCAGTTACA<br>AAGT<br>SEQ ID NO:10573 | | CAACAGTATATGACTTACCC<br>GCTCACT<br>SEQ ID NO:18585 |
| iPS:435821 | 21-225_190E11 | AA | RTSQGIGNYLA<br>SEQ ID NO:2562 | | KTSSLQS<br>SEQ ID NO:10574 | | QQYMTYPLT<br>SEQ ID NO:18586 |
| | | NA | AGGGCCAGTCAGAGTTTTCG<br>CATCAACTTAGCC<br>SEQ ID NO:2563 | | GGTGCATCCACCAGGGC<br>CACT<br>SEQ ID NO:10575 | | CAGCAGTATAATAACTGGCC<br>GCTCACT<br>SEQ ID NO:18587 |
| iPS:435823 | 21-225_190F11 | AA | RASQSFRINLA<br>SEQ ID NO:2564 | | GASTRAT<br>SEQ ID NO:10576 | | QQYNWPLT<br>SEQ ID NO:18588 |
| | | NA | CGGGCCAGTCAGAACATTGG<br>TAGTAGCTTACAC<br>SEQ ID NO:2565 | | TATGCTTCCCAGTCCTTC<br>TCA<br>SEQ ID NO:10577 | | CATCAGAGTAGTAGTTTCCC<br>TCGGACG<br>SEQ ID NO:18589 |

FIGURE 49
(Continued)

| | | | | | | |
|---|---|---|---|---|---|---|
| iPS:435825 | | AA | RASQNIGSSLH SEQ ID NO:2566 | YASQSFS SEQ ID NO:10578 | HQSSSFPRT SEQ ID NO:18590 | |
| | 21-225_190G11 | NA | CGGACGAGTCAGGGCATTGG CAATTATTTAGCC SEQ ID NO:2567 | AAAGCATCCAGTTGCA AAGT SEQ ID NO:10579 | CAACAGTATATGACTTACCC GCTCACT SEQ ID NO:18591 | |
| iPS:435827 | | AA | RTSQGIGNYLA SEQ ID NO:2568 | KASSLQS SEQ ID NO:10580 | QQYMTYPLT SEQ ID NO:18592 | |
| | 21-225_190H11 | NA | AAGTCTAGTCAGAGCCTCCT CCATAGTGATGGAAGGACCT ATTTGTAT SEQ ID NO:2569 | GAGGTTTCCAACCGGTTC GCT SEQ ID NO:10581 | ATGCAAAGTATACAGTTTCC CTGGACG SEQ ID NO:18593 | |
| iPS:435829 | | AA | KSSQSLLHSDGRTYLY SEQ ID NO:2570 | EVSNRFA SEQ ID NO:10582 | MQSIQFPWT SEQ ID NO:18594 | |
| | 21-225_190B12 | NA | CGGGCCAGTCAGAGTATTGG TAGTAGCTTACAC SEQ ID NO:2571 | TATGCTTCCCAGTCCTTC TCA SEQ ID NO:10583 | CATCAGACTAGAAGTTACC TCTCACT SEQ ID NO:18595 | |
| iPS:435831 | | AA | RASQSIGSSLH SEQ ID NO:2572 | YASQSFS SEQ ID NO:10584 | HQTRSLPLT SEQ ID NO:18596 | |
| | 21-225_190C12 | NA | CGGGCAAGTCAGGGCATTAG AAAAGATTTAGCC SEQ ID NO:2573 | ACTGCATCCAGTTTGCAA AGT SEQ ID NO:10585 | CTACAGACATAATAGTTGCAA GTGGACG SEQ ID NO:18597 | |
| iPS:435833 | | AA | RASQGIRKDLG SEQ ID NO:2574 | TASSLQS SEQ ID NO:10586 | LQHNSYPWT SEQ ID NO:18598 | |
| | 21-225_190D12 | NA | CGGGCGAGTCAGGGCATTAG GTTGCATCCAGTTGCAA CAATTATTTAGCC SEQ ID NO:2575 | TCA SEQ ID NO:10587 | CAAAAGTATAACAGTGCCCC ATTCACT SEQ ID NO:18599 | |
| iPS:435835 | | AA | RASQGISNYLA SEQ ID NO:2576 | VASTLQS SEQ ID NO:10588 | QKYNSAPFT SEQ ID NO:18600 | |
| | | NA | CGGGCGAGTCAGGGCATTGG CAAGTATTTAGCC | GCTGCATCCAGTTGCAA AGT | CAACGATATGATACTTACCC ATTCACT | |

FIGURE 49
(Continued)

| | | | | | | |
|---|---|---|---|---|---|---|
| iPS:435837 | 21-225_190F12 | AA | SEQ ID NO:2577<br>RASQGIGKYLA | SEQ ID NO:10589<br>AASSLQS | SEQ ID NO:18601<br>QRYDTYPFT | |
| | | NA | SEQ ID NO:2578<br>CGGAGGAGTCAGGGCATTGG<br>CAAGTATTTAGCC | SEQ ID NO:10590<br>AAAGCATCCAGTTGCA<br>AGGT | SEQ ID NO:18602<br>CAACAGTATATGACTTACCC<br>GCTCACT | |
| iPS:435839 | 21-225_198G3 | AA | SEQ ID NO:2579<br>RTSQGIGKYLA | SEQ ID NO:10591<br>KASSLQG | SEQ ID NO:18603<br>QQYMTYPLT | |
| | | NA | SEQ ID NO:2580<br>AGGTCTAGTCAGAGCCTCCT<br>GCATAGTGATGGAAAGACCT<br>ATTTGTTT | SEQ ID NO:10592<br>GAACTTCCAACGGTTC<br>TCT | SEQ ID NO:18604<br>ATGCAAAGTTTCCAGCTTCC<br>CTGGACG | |
| iPS:435841 | 21-225_191B1 | AA | SEQ ID NO:2581<br>RSSQSLLHSDGKTYLF | SEQ ID NO:10593<br>ELSNRFS | SEQ ID NO:18605<br>MQSFQLPWT | |
| | | NA | SEQ ID NO:2582<br>AGGTCCAGCCAGAGTGTTTT<br>ACACAGCTCCAACAATTACA<br>ACTACTTAGCT | SEQ ID NO:10594<br>TGGGCATCTACCCGGGA<br>ATCC | SEQ ID NO:18606<br>CAACAATATTATAGTACTCC<br>TCCGACG | |
| iPS:435843 | 21-225_191D8 | AA | SEQ ID NO:2583<br>RSSQSVLHSSNNYNYLA | SEQ ID NO:10595<br>WASTRES | SEQ ID NO:18607<br>QQYYSTPPT | |
| | | NA | SEQ ID NO:2584<br>AGGGCCAGTCAGAGTATTAG<br>CCTCAACTTCTTAGCC | SEQ ID NO:10596<br>GGTGCATCCAGCAGGGC<br>CACT | SEQ ID NO:18608<br>CAGCAGTATGGTAGGTCACC<br>GTGGACG | |
| iPS:435845 | 21-225_191F1 | AA | SEQ ID NO:2585<br>RASQSISLNFLA | SEQ ID NO:10597<br>GASSRAT | SEQ ID NO:18609<br>QQYGRSPWT | |
| | | NA | SEQ ID NO:2586<br>CGGGCCAGTCAGGGCATTAG<br>CAATTATTTAGCC | SEQ ID NO:10598<br>GCTGCATCCAGTTGCAA<br>AGT | SEQ ID NO:18610<br>CAACAATTATCTTACTTACCCT<br>CTCACT | |
| | 21-225_191G1 | AA | SEQ ID NO:2587<br>RASQGISNYLA | SEQ ID NO:10599<br>AASSLQS | SEQ ID NO:18611<br>QHYLTYPLT | |
| | | | SEQ ID NO:2588 | SEQ ID NO:10600 | SEQ ID NO:18612 | |

FIGURE 49
(Continued)

| | | | | |
|---|---|---|---|---|
| iPS:435847 | | NA | AGGGCCAGTCAGAGTATTCG CAGCAGCTTCTTAGCC SEQ ID NO:2589 | GGTGCATCCAGCAGGGC CACT SEQ ID NO:10601 | CAGCAATATGGTAACTCACC GTGGGCG SEQ ID NO:18613 |
| | 21-225_191A3 | AA | RASQSIRSSFLA SEQ ID NO:2590 | GASSRAT SEQ ID NO:10602 | QQYGNSPWA SEQ ID NO:18614 |
| iPS:435849 | | NA | AGGGCCAGTCAGAGTATTCG CAGCAGCTTCTTAGCC SEQ ID NO:2591 | GGTGCATCCAGCAGGGC CACT SEQ ID NO:10603 | CAGCAGTATGGTAACTCACC GTGGGCG SEQ ID NO:18615 |
| | 21-225_191C3 | AA | RASQSIRSSFLA SEQ ID NO:2592 | GASSRAT SEQ ID NO:10604 | QQYGNSPWA SEQ ID NO:18616 |
| iPS:435851 | | NA | AGGGCCGGTCAAAGTATTAG AACCAACTTCTTAGCC SEQ ID NO:2593 | GGTGCATCCAGCAGGGC CACT SEQ ID NO:10605 | CAGCAGTATGGTAGCTCACC GTGGACG SEQ ID NO:18617 |
| | 21-225_191D3 | AA | RAGQSIRTNFLA SEQ ID NO:2594 | GASSRAT SEQ ID NO:10606 | QQYGSSPWT SEQ ID NO:18618 |
| iPS:435853 | | NA | AAGTCTAGTCAGAGCCTCCT CCATAGTGATGGAAGGACCT ATTTGTAT SEQ ID NO:2595 | GAGGTTTCCAACCGGTTC GCT SEQ ID NO:10607 | ATGCAAAGTATACAACTTCC CTGGACG SEQ ID NO:18619 |
| | 21-225_191E3 | AA | KSSQSLLHSDGRTYLY SEQ ID NO:2596 | EVSNRFA SEQ ID NO:10608 | MQSIQLPWT SEQ ID NO:18620 |
| iPS:435855 | | NA | AAGTCCAGCCAGGAGTGTTT ACACAGCTCCAACAGTTACA ACTACTTAGCT SEQ ID NO:2597 | TGGGCATCTACCCGAAA ATCC SEQ ID NO:10609 | CAGCAATATTATAGTAGTCC TCCCACT SEQ ID NO:18621 |
| | 21-225_191G3 | AA | KSSQSVLHSSNSYNYLA SEQ ID NO:2598 | WASTRKS SEQ ID NO:10610 | QQYYSSPPT SEQ ID NO:18622 |
| iPS:435857 | 21-225_191A4 | NA | CGGGCAAGTCAGGGCATTAG AAAAGATTTAGGC SEQ ID NO:2599 | ACTGCATCCAGTTGCAA AAT SEQ ID NO:10611 | CTACAGCATAATAGTTACC GTGGACG SEQ ID NO:18623 |

FIGURE 49
(Continued)

| | | | | RASQGIRKDLG | | TASSLQN | | LQHNSYPWT | |
|---|---|---|---|---|---|---|---|---|---|
| | | | AA | SEQ ID NO:2600 | | SEQ ID NO:10612 | | SEQ ID NO:18624 | |
| iPS:435859 | | 21-225_190E6 | NA | CGGACGAGTCAGGGCATTGG CAATTATTAGCC SEQ ID NO:2601 | | AAAGCATCCAGTTTGCA AAGT SEQ ID NO:10613 | | CAACAGTATATGACTTACCC GCTCACT SEQ ID NO:18625 | |
| iPS:435861 | | 21-225_190A5 | AA | RTSQGIGNYLA SEQ ID NO:2602 | | KASSLQS SEQ ID NO:10614 | | QQYMTYPLT SEQ ID NO:18626 | |
| | | | NA | CGGGCGAGTCAGGGGATTG GCAATCATTTAGCC SEQ ID NO:2603 | | GCTGCATCCAGTTTGCAA AGT SEQ ID NO:10615 | | CAACAGTATAGTAATTACCC AGTCACT SEQ ID NO:18627 | |
| iPS:435863 | | 21-225_191H4 | AA | RASQGIGNHLA SEQ ID NO:2604 | | AASSLQS SEQ ID NO:10616 | | QQYSNYPVT SEQ ID NO:18628 | |
| | | | NA | CGGGCCAATCAGAGCATTGG TAGTAGTTACAC SEQ ID NO:2605 | | TATGCTTCCCAGTCCCTC TCA SEQ ID NO:10617 | | CATCAGACTGGTAGGTTACC TCTCACT SEQ ID NO:18629 | |
| iPS:435865 | | 21-225_191A5 | AA | RANQSIGSSLH SEQ ID NO:2606 | | YASQSLS SEQ ID NO:10618 | | HQTGRLPLT SEQ ID NO:18630 | |
| | | | NA | AGGGCCAGTCAGAGTGTTAG CAGCAGGTTCTTAGCC SEQ ID NO:2607 | | GGTGCTTCCAACAGGGC CACT SEQ ID NO:10619 | | CAGCAGTATGGTGGTTCAC TCCGTGGACG SEQ ID NO:18631 | |
| iPS:435867 | | 21-225_191E5 | AA | RASQSVSSRFLA SEQ ID NO:2608 | | GASNRAT SEQ ID NO:10620 | | QQYGGSPPWT SEQ ID NO:18632 | |
| | | | NA | CGGGCCAGTCAGAGCATTGG TAGTAGTTACAC SEQ ID NO:2609 | | TATGCTTCCCAGTCCTTC TCA SEQ ID NO:10621 | | CATCAGAGTAGTAGTTTCCC TCGGACG SEQ ID NO:18633 | |
| iPS:435869 | | 21-225_190B1 | AA | RASQSIGSSLH SEQ ID NO:2610 | | YASQSFS SEQ ID NO:10622 | | HQSSSFPRT SEQ ID NO:18634 | |
| | | | NA | CGGGCGAGTCAGGGCATTAG AAATTATTTAGCC SEQ ID NO:2611 | | GTTGCATCCAGTTTGGAA AGT SEQ ID NO:10623 | | CAACAGTATCTTAATTACCC AGTCACT SEQ ID NO:18635 | |

FIGURE 49
(Continued)

| | | | | | | |
|---|---|---|---|---|---|---|
| iPS:435871 | 21-225_191E6 | AA | RASQGIRNYLA | VASSLES | QQYLNYPVT | |
| | | | SEQ ID NO:2612 | SEQ ID NO:10624 | SEQ ID NO:18636 | |
| | | NA | AAGTCTAGTCAGAGCCTCCT CCATAGTGATGGAAGGACCT ATTTGTAT | GAGGTTTCCAACCGGTTC GCT | ATGCAAAGTATACATTTTCC CTGGACG | |
| | | | SEQ ID NO:2613 | SEQ ID NO:10625 | SEQ ID NO:18637 | |
| iPS:435873 | 21-225_190G4 | AA | KSSQSLLHSDGRTYLY | EVSNRFA | MQSIHFPWT | |
| | | | SEQ ID NO:2614 | SEQ ID NO:10626 | SEQ ID NO:18638 | |
| | | NA | CGGGGGAGTCAGGACATTGG CAGATATTTAGCC | GCTGCATCCAGTTGCAA AGT | CAACAATATAGTACTTACCC GCTCACT | |
| | | | SEQ ID NO:2615 | SEQ ID NO:10627 | SEQ ID NO:18639 | |
| iPS:435875 | 21-225_190B9 | AA | RASQDIGRYLA | AASSLQS | QQYSTYPLT | |
| | | | SEQ ID NO:2616 | SEQ ID NO:10628 | SEQ ID NO:18640 | |
| | | NA | CGGGCGAGTCAGGGTATTAA CAACTGGTTAGCC | GGTGTTTCCAGTTGCAG AGT | CAACAGGCTAACAGTTCCC GTGGACG | |
| | | | SEQ ID NO:2617 | SEQ ID NO:10629 | SEQ ID NO:18641 | |
| iPS:435877 | 21-225_184E7 | AA | RASQGINNWLA | GVSSLQS | QQANSFPWT | |
| | | | SEQ ID NO:2618 | SEQ ID NO:10630 | SEQ ID NO:18642 | |
| | | NA | CGGGCGAGTCAGGGCATTAG CAATTATTTAGCC | GCTGCATCCAGTTGCAA AGT | CAACAGTATAATGGTTACCC ATTCACT | |
| | | | SEQ ID NO:2619 | SEQ ID NO:10631 | SEQ ID NO:18643 | |
| iPS:435879 | 21-225_184H10 | AA | RASQGISNYLA | AASSLQS | QQYNGYPFT | |
| | | | SEQ ID NO:2620 | SEQ ID NO:10632 | SEQ ID NO:18644 | |
| | | NA | CGGGCAAGTCAGGGCATTAG AAATGATTTAGGC | ATTGCATCCAGTTGCAA AGT | CTACAGCATAATAGTTACCC ATTCACT | |
| | | | SEQ ID NO:2621 | SEQ ID NO:10633 | SEQ ID NO:18645 | |
| iPS:435881 | | AA | RASQGIRNDLG | IASSLQS | LQHNSYPFT | |
| | | | SEQ ID NO:2622 | SEQ ID NO:10634 | SEQ ID NO:18646 | |
| | | NA | CGGGCAAGTCAGGGCATTAG AAATGATTTAGGC | ATTGCATCCAGTTGCAA AGT | CTACAGCATAATAGTTACCC ATTCACT | |

FIGURE 49
(Continued)

| | | | | | | |
|---|---|---|---|---|---|---|
| iPS:435883 | 21-225_184D11 | AA | SEQ ID NO:2623<br>RASQGIRNDLG<br>SEQ ID NO:2624 | SEQ ID NO:10635<br>IASSLQS<br>SEQ ID NO:10636 | SEQ ID NO:18647<br>LQHNSYPFT<br>SEQ ID NO:18648 |
| | 21-225_185A1 | NA | CGGGCGAGTCAGGGCATTAG<br>CAATTATTAGCC<br>SEQ ID NO:2625 | GTTGCATCCAGTTTGCAA<br>AGT<br>SEQ ID NO:10637 | CGACAATATCATAGTTACCC<br>ATTCACT<br>SEQ ID NO:18649 |
| | | AA | RASQGISNYLA<br>SEQ ID NO:2626 | VASSLQS<br>SEQ ID NO:10638 | RQYHSYPFT<br>SEQ ID NO:18650 |
| iPS:435885 | 21-225_185E10 | NA | CGGGCGAGTCAGGGCATTAG<br>CAATTATTAGCC<br>SEQ ID NO:2627 | GCTGCATCCAGTTTGCAA<br>AGT<br>SEQ ID NO:10639 | CAACAGTATAATGGTTACCC<br>ATTCACT<br>SEQ ID NO:18651 |
| | | AA | RASQGISNYLA<br>SEQ ID NO:2628 | AASSLQS<br>SEQ ID NO:10640 | QQYNGYPFT<br>SEQ ID NO:18652 |
| iPS:435887 | 21-225_186F7 | NA | AAGTCTAGTCAGAGCCTCCT<br>GCATGGTGATGGAAAGACCT<br>ATTTGTGT<br>SEQ ID NO:2629 | GAAGTTTCCAAGCGGTT<br>CTCT<br>SEQ ID NO:10641 | ATGCAAAGTATACAGGTTCC<br>CTGGACG<br>SEQ ID NO:18653 |
| | | AA | KSSQSLLHGDGKTYLC<br>SEQ ID NO:2630 | EVSKRFS<br>SEQ ID NO:10642 | MQSIQVPWT<br>SEQ ID NO:18654 |
| iPS:435889 | 21-225_186A11 | NA | CGGGCGAGTCAGGATATTAC<br>CAGCTGGTTAGCC<br>SEQ ID NO:2631 | GCTGCATCCAGTTTACAA<br>AGT<br>SEQ ID NO:10643 | CAACAGGTTAACAGTTTCCC<br>ATTCACT<br>SEQ ID NO:18655 |
| | | AA | RASQDITSWLA<br>SEQ ID NO:2632 | AASSLQS<br>SEQ ID NO:10644 | QQVNSFPFT<br>SEQ ID NO:18656 |
| iPS:435891 | 21-225_188H5 | NA | CGGGCGAGTCAGGGCATTAG<br>CAATTATTAGCC<br>SEQ ID NO:2633 | GCTGCTTCCAGTTTGCAA<br>AGT<br>SEQ ID NO:10645 | CAACAGTATAATAGTTATCC<br>ATTCACT<br>SEQ ID NO:18657 |
| | | AA | RASQGISNYLA<br>SEQ ID NO:2634 | AASSLQS<br>SEQ ID NO:10646 | QQYNSYPFT<br>SEQ ID NO:18658 |

FIGURE 49
(Continued)

| | | | | | |
|---|---|---|---|---|---|
| iPS:435895 | 21-225_188E8 | NA | CGGGCGAATCAGGATATTTC CAGCTGGTTAGCC<br>SEQ ID NO:2635 | GCTGCATCCAATTGCAA AGT<br>SEQ ID NO:10647 | CAGCAGGCTAACAGTTCC GTGGACG<br>SEQ ID NO:18659 |
| | | AA | RANQDISSWLA<br>SEQ ID NO:2636 | AASNLQS<br>SEQ ID NO:10648 | QQANSFPWT<br>SEQ ID NO:18660 |
| iPS:435897 | 21-225_188B9 | NA | CGGGCGAGTCAGGCATTAG CAATTATTAGCC<br>SEQ ID NO:2637 | GCTGCATCCAGTTTGCAA AGT<br>SEQ ID NO:10649 | CAACAGTATAATAGTTACC ATTCACT<br>SEQ ID NO:18661 |
| | | AA | RASQGISNYLA<br>SEQ ID NO:2638 | AASSLQS<br>SEQ ID NO:10650 | QQYNSYPFT<br>SEQ ID NO:18662 |
| iPS:435899 | 21-225_188G11 | NA | ATGTCTAGTCAGAGCCTCCT GCATGGTGATGGAAAGACCT ATTTATAT<br>SEQ ID NO:2639 | GAAGTTTCCAACCGGTTC TCT<br>SEQ ID NO:10651 | ATGCAAAGTATACAGATTCC TTGGACG<br>SEQ ID NO:18663 |
| | | AA | MSSQSLLHGDGKTYLY<br>SEQ ID NO:2640 | EVSNRFS<br>SEQ ID NO:10652 | MQSIQIPWT<br>SEQ ID NO:18664 |
| iPS:435901 | 21-225_189G2 | NA | AAGTCTAGTCAGAGCCTCCT GCATGGTGATGGAAAGACCT ATTTGTTT<br>SEQ ID NO:2641 | GAAGTTTCCAACCGGTTC TCT<br>SEQ ID NO:10653 | ATGCAAAGTATACAGATTCC GTGGACG<br>SEQ ID NO:18665 |
| | | AA | KSSQSLLHGDGKTYLF<br>SEQ ID NO:2642 | EVSNRFS<br>SEQ ID NO:10654 | MQSIQIPWT<br>SEQ ID NO:18666 |
| iPS:435903 | 21-225_190E2 | NA | AAGTCCAGCCAGAGTGTTTT ATTCAACTCCAACAATAAGA ACTACTTAGCT<br>SEQ ID NO:2643 | TGGGCATCTACCCGGGA ATCC<br>SEQ ID NO:10655 | CAGCAATATTGTAGTCTCC ATTCACT<br>SEQ ID NO:18667 |
| | | AA | KSSQSVLFNSNNKNYLA<br>SEQ ID NO:2644 | WASTRES<br>SEQ ID NO:10656 | QQYCSLPFT<br>SEQ ID NO:18668 |
| iPS:435905 | | NA | AGGGCCAGTCAGAATATAA GGAGCAACTTCTTAGCC | GGTGCATCCAGCAGGGC CACT | CAGCAGTATGGTAACTCACC GTGGACG |

FIGURE 49
(Continued)

| | | | SEQ ID NO:2645 | SEQ ID NO:10657 | SEQ ID NO:18669 |
|---|---|---|---|---|---|
| iPS:435907 | 21-225_190A3 | AA | RASQNIRSNFLA | GASSRAT | QQYGNSPWT |
| | | | SEQ ID NO:2646 | SEQ ID NO:10658 | SEQ ID NO:18670 |
| iPS:435909 | 21-225_190G3 | NA | CGGGCAAGTCAGGGCATTAG AAAAGATTTAGGC | ACTGCATCCAGTTGCAA AGT | CTACAGCACATAATAGTTACC GTGGACG |
| | | | SEQ ID NO:2647 | SEQ ID NO:10659 | SEQ ID NO:18671 |
| | | AA | RASQGIRKDLG | TASSLQS | LQHNSYPWT |
| | | | SEQ ID NO:2648 | SEQ ID NO:10660 | SEQ ID NO:18672 |
| iPS:435911 | 21-225_190H3 | NA | CGGGGAGTCAGGGTCTTAA CAACTGGTTAGCC | GCTGTGTCCAGTTGCAA AGT | CAACAGGCTAACAGTCTCCC GTGGACG |
| | | | SEQ ID NO:2649 | SEQ ID NO:10661 | SEQ ID NO:18673 |
| | | AA | RASQGLNNWLA | AVSSLQS | QQANSLPWT |
| | | | SEQ ID NO:2650 | SEQ ID NO:10662 | SEQ ID NO:18674 |
| iPS:435913 | 21-225_190B4 | NA | AGGGCCAGTCAGAGTATTCG CAGCAGCTTCTTAGCC | GGTGCATCCAGCAGGGC CACT | CAGCAGTATGGTAACTCACC GTGGGCG |
| | | | SEQ ID NO:2651 | SEQ ID NO:10663 | SEQ ID NO:18675 |
| | | AA | RASQSIRSSFLA | GASSRAT | QQYGNSPWA |
| | | | SEQ ID NO:2652 | SEQ ID NO:10664 | SEQ ID NO:18676 |
| iPS:435913 | 21-225_190A7 | NA | AGGGCCAGTCAGAGTGTTAG AAGCAACTTCTTAGCC | GGTGCATACCGCCAGGGC CACT | CAGCAGTATGGTAACTCACC GTGGACG |
| | | | SEQ ID NO:2653 | SEQ ID NO:10665 | SEQ ID NO:18677 |
| | | AA | RASQSVRSNFLA | GAYRRAT | QQYGNSPWT |
| | | | SEQ ID NO:2654 | SEQ ID NO:10666 | SEQ ID NO:18678 |
| iPS:435915 | 21-225_190H4 | NA | AAGTCCAGCAGCAGAGTGTTTT ACACAGTCCAACAATTACA ACTACTTAGCT | TGGGCATCTACCCGGGA ATCC | CAGCAATATTATAGTATTCC TCCCACT |
| | | | SEQ ID NO:2655 | SEQ ID NO:10667 | SEQ ID NO:18679 |
| | | AA | KSSQSVLHSSNNYNYLA | WASTRES | QQYYSIPPT |
| | | | SEQ ID NO:2656 | SEQ ID NO:10668 | SEQ ID NO:18680 |

FIGURE 49 (Continued)

| | | | | | |
|---|---|---|---|---|---|
| iPS:435917 | 21-225_190D5 | NA | CGGGCCAAGTCAGAGTATTGG TAGTAACTTACAC SEQ ID NO:2657 | TCTGCTTCCCAGTCCTTC TCA SEQ ID NO:10669 | CAGCAGAGTAGTAGTTTACC GTGGACG SEQ ID NO:18681 |
| | | AA | RASQSIGSNLH SEQ ID NO:2658 | SASQSFS SEQ ID NO:10670 | QQSSSLPWT SEQ ID NO:18682 |
| iPS:435919 | 21-225_190H5 | NA | CGGGCAAGTCAGGGCATTAG AAAAGATTTAGGC SEQ ID NO:2659 | ACTGCATCCAGTTGCAA AGT SEQ ID NO:10671 | CTACAGCATAATAATTACCC GTGGACG SEQ ID NO:18683 |
| | | AA | RASQGIRKDLG SEQ ID NO:2660 | TASSLQS SEQ ID NO:10672 | LQHNNYPWT SEQ ID NO:18684 |
| iPS:435921 | 21-225_190D6 | NA | CGGGCAAGTCAGGGCATTAG AAATGATTTAGGC SEQ ID NO:2661 | GCTGCATCCAGTTGCAA AGT SEQ ID NO:10673 | CTACAGCATTATAGTTTCCC ATTCACT SEQ ID NO:18685 |
| | | AA | RASQGIRNDLG SEQ ID NO:2662 | AASSLQS SEQ ID NO:10674 | LQHYSFPFT SEQ ID NO:18686 |
| iPS:435923 | 21-225_190H6 | NA | AAGTCCAGCAGAGTGTTT ATTCAACTCCAACAATAAGA ACTACTTAGCT SEQ ID NO:2663 | TGGGCATCTACCCGGGA ATCC SEQ ID NO:10675 | CAGCAATATTGTAGTCTTCC ATTCACT SEQ ID NO:18687 |
| | | AA | KSSQSVLFNSNKNYLA SEQ ID NO:2664 | WASTRES SEQ ID NO:10676 | QQYCSLPFT SEQ ID NO:18688 |
| iPS:435925 | 21-225_190D7 | NA | AAGTCCAGCAGAGTGTTT ATCCAGCTCCAACAATTACA ACTATTTAGTT SEQ ID NO:2665 | TGGGCATCTACCCGGAA ATCC SEQ ID NO:10677 | CAACAATATTATGTACTCC GTGGACG SEQ ID NO:18689 |
| | | AA | KSSQSVLSSSNNYNYLV SEQ ID NO:2666 | WASTRKS SEQ ID NO:10678 | QQYYRTPWT SEQ ID NO:18690 |
| iPS:435927 | 21-225_190E7 | NA | AAGTCTAGTCAGAGCCTCCT CCATAGTGATGGAAGGACCT ATTTGTAT | GAGGTTTCCAACCGGTTC TCT | ATGCAAAGTATACAGCTTCC CTGGACG |

FIGURE 49
(Continued)

| | | | | | | |
|---|---|---|---|---|---|---|
| iPS:435929 | 21-225_190E7 | AA | SEQ ID NO:2667<br>KSSQSLLHSDGRTYLY | SEQ ID NO:2667<br>EVSNRFS | SEQ ID NO:8691<br>MQSIQLPWT |
| iPS:435933 | 21-225_190D9 | NA | SEQ ID NO:2668<br>CGGGCCAGTCAGAGCATTGG<br>TAGTAGCTTACAC | SEQ ID NO:10679<br>TATGCTTCCCAGTCCTTC<br>TCA | SEQ ID NO:8692<br>CATCAGAGTAGTAGTTCCC<br>TCGGACG |
| | | AA | SEQ ID NO:2669<br>RASQSIGSSLH | SEQ ID NO:10680<br>YASQSFS | SEQ ID NO:8693<br>HQSSSFPRT |
| iPS:435935 | 21-225_190F8 | NA | SEQ ID NO:2670<br>CGGAGAGTCAGGGCATTGG<br>CAATTATTTAGCC | SEQ ID NO:10681<br>AAAGCATCCAGTTTACA<br>AAGT | SEQ ID NO:8694<br>CAACAGTATATGACTTACCC<br>ACTCACT |
| | | AA | SEQ ID NO:2671<br>RTSQGIGNYLA | SEQ ID NO:10682<br>KASSLQS | SEQ ID NO:8695<br>QQYMTYPLT |
| iPS:435937 | 21-225_190H8 | NA | SEQ ID NO:2672<br>CGGGCCAGTCAGAGCATTGG<br>TAGTAGCTTACAC | SEQ ID NO:10683<br>TATGCTTCCCAGTCCTTC<br>TCA | SEQ ID NO:8696<br>CATCAGAGTAGTAGTTCCC<br>TCGGACG |
| | | AA | SEQ ID NO:2673<br>RASQSIGSSLH | SEQ ID NO:10684<br>YASQSFS | SEQ ID NO:8697<br>HQSSSFPRT |
| iPS:435939 | 21-225_190H9 | NA | SEQ ID NO:2674<br>CGGGGCGAGTCAGGGCATTGG<br>CAAGTATTTAGCC | SEQ ID NO:10685<br>GCTGCATCCAGTTGCAA<br>AGT | SEQ ID NO:8698<br>CAACAGTATGATACTTACCC<br>ATTCACT |
| | | AA | SEQ ID NO:2675<br>RASQGIGKYLA | SEQ ID NO:10686<br>AASSLQS | SEQ ID NO:8699<br>QRYDTYPFT |
| iPS:435941 | 21-225_191H7 | NA | SEQ ID NO:2676<br>AGGGCCGGTCAAAGTATTAG<br>AACCGACTTCTTAGCC | SEQ ID NO:10687<br>GGTCCATCCAGCAGGGC<br>CACT | SEQ ID NO:8700<br>CAGCAGTATGGTAGCTCACC<br>GTGGACG |
| | | AA | SEQ ID NO:2677<br>RAGQSIRTDFLA | SEQ ID NO:10688<br>GPSSRAT | SEQ ID NO:8701<br>QQYGSSPWT |
| | | NA | SEQ ID NO:2678<br>AGGCCCAGTCAGAGTTTAG<br>CAGAAACTTAGCC | SEQ ID NO:10689<br>GGTGCATCCACTAGGGC<br>CACT | SEQ ID NO:8702<br>CAGCAGTATAATAACTGGCC<br>GCTCACT |

FIGURE 49
(Continued)

| | | | | | |
|---|---|---|---|---|---|
| iPS:435943 | 21-225_191E8 | AA | SEQ ID NO:2679 RPSQSFSRNLA | SEQ ID NO:10691 GASTRAT | SEQ ID NO:18703 QQYNNWPLT |
| iPS:435945 | 21-225_191C9 | NA | SEQ ID NO:2680 CGGGCCAGTCAGAGTATTGG TAGTAGTTTACAC | SEQ ID NO:10692 TATGCTTCCAGTCCTTC TCA | SEQ ID NO:18704 CATCAGACTAGAAGTTTACC TCTCACT |
| | | AA | SEQ ID NO:2681 RASQSIGSSLH | SEQ ID NO:10693 YASQSFS | SEQ ID NO:18705 HQTRSLPLT |
| iPS:435947 | 21-225_191A10 | NA | SEQ ID NO:2682 CGGGGAGTCAGGGCATTGG CAAGTATTTAGCC | SEQ ID NO:10694 GCTGCATCCAGTTGCAA AGT | SEQ ID NO:18706 CAACAGTATAGTACTTACC GCTCACT |
| | | AA | SEQ ID NO:2683 RASQGIGKYLA | SEQ ID NO:10695 AASSLQS | SEQ ID NO:18707 QQYSTYPLT |
| iPS:435947 | 21-225_191E10 | NA | SEQ ID NO:2684 CGGGCGAGTCAGGGCATTGG CAAGTATTTAGCC | SEQ ID NO:10696 GCTGCATCCAGTTGCAA AGT | SEQ ID NO:18708 CAACAGTATAGTACTTACC GCTCACT |
| | | AA | SEQ ID NO:2685 RASQGIGKYLA | SEQ ID NO:10697 AASSLQS | SEQ ID NO:18709 QQYSTYPLT |
| iPS:435953 | 21-225_191B12 | NA | SEQ ID NO:2686 AAGTCCAGCAGTCAGAGTGTTT ATTCAACTCCAACAATAAGA ACTACTTAGCT | SEQ ID NO:10698 TGGGCCTCTACCCGGGA ATCC | SEQ ID NO:18710 CAGCAATATTCTAGTCTTCC ATTCACT |
| | | AA | SEQ ID NO:2687 KSSQSVLFNSNNKNYLA | SEQ ID NO:10699 WASTRES | SEQ ID NO:18711 QQYSSLPFT |
| iPS:435957 | 21-225_191G12 | NA | SEQ ID NO:2688 CGGAGCGAGTCAGGGCATTGG CAATTATTTAGCC | SEQ ID NO:10700 AAAGCATCCAGTTGCA AAGT | SEQ ID NO:18712 CAACAGTATATCACTTACC GCTCACT |
| | | AA | SEQ ID NO:2689 RTSQGIGNYLA | SEQ ID NO:10701 KASSLQS | SEQ ID NO:18713 QQYITYPLT |
| | | | SEQ ID NO:2690 | SEQ ID NO:10702 | SEQ ID NO:18714 |

FIGURE 49
(Continued)

| | | | | | |
|---|---|---|---|---|---|
| iPS:435961 | 21-225_192A2 | NA | CGGGGGAATCAGGGCATTAA CAATTATTAGCC<br>SEQ ID NO:2691 | GCTGCATCCAGTTTGCAA AGT<br>SEQ ID NO:10703 | CAACAGTATAATAGTTACCC ATTCACT<br>SEQ ID NO:18715 |
| | | AA | RANQGINNYLA<br>SEQ ID NO:2692 | AASSLQS<br>SEQ ID NO:10704 | QQYNSYPFT<br>SEQ ID NO:18716 |
| iPS:435963 | 21-225_192D2 | NA | CGGGCGAGTCAGGGCATTAG CAATTATTAGCC<br>SEQ ID NO:2693 | GCTGCATCCAGTTTGCAA AGT<br>SEQ ID NO:10705 | CAACATTATGTTACTTACCC GAACACT<br>SEQ ID NO:18717 |
| | | AA | RASQGISNYLA<br>SEQ ID NO:2694 | AASSLQS<br>SEQ ID NO:10706 | QHYVTYPNT<br>SEQ ID NO:18718 |
| iPS:435965 | 21-225_192H2 | NA | CGGGCGAGTCAGGGCTATAA GTAGTTGGATAGCC<br>SEQ ID NO:2695 | GGTGCATCCAGTTTGCA AAGT<br>SEQ ID NO:10707 | CAACAGTCTAACAGTTTCCC ATTCACT<br>SEQ ID NO:18719 |
| | | AA | RASQGISSWIA<br>SEQ ID NO:2696 | GASSLQS<br>SEQ ID NO:10708 | QQSNSFPFT<br>SEQ ID NO:18720 |
| iPS:435967 | 21-225_192B3 | NA | AGGGCCAGTCAGAGTGTTCG CAGCAGTTCCTTGCC<br>SEQ ID NO:2697 | GGTGCATCTAGCAGGGC CACT<br>SEQ ID NO:10709 | CAGCAGTATGGTAACTCACC GTGGGCG<br>SEQ ID NO:18721 |
| | | AA | RASQSVRSSFLA<br>SEQ ID NO:2698 | GASSRAT<br>SEQ ID NO:10710 | QQYGNSPWA<br>SEQ ID NO:18722 |
| iPS:435971 | 21-225_192D3 | NA | CGGGCGAGTCAGGGCATTAG CAATTATTAGCC<br>SEQ ID NO:2699 | GCTGCATCCAGTTTGCAA AGT<br>SEQ ID NO:10711 | CTACATTATCTTACTTACCCT CTCACT<br>SEQ ID NO:18723 |
| | | AA | RASQGISNYLA<br>SEQ ID NO:2700 | AASSLQS<br>SEQ ID NO:10712 | LHYLTYPLT<br>SEQ ID NO:18724 |
| iPS:435973 | 21-225_192H3 | NA | AGGGCCAGTCAGAGTGTTAG CAGCAACTTCTTAGCC<br>SEQ ID NO:2701 | GGTGCATCCAGCAGGGC CACT<br>SEQ ID NO:10713 | CAGCAATATGGTATCTCACC GTGGACG<br>SEQ ID NO:18725 |
| | | AA | RASQSVSSNFLA<br>SEQ ID NO:2702 | GASSRAT<br>SEQ ID NO:10714 | QQYGISPWT<br>SEQ ID NO:18726 |

FIGURE 49
(Continued)

| | | | | | |
|---|---|---|---|---|---|
| iPS:435977 | 21-225_192E4 | NA | CGGGGAGTCAGGGCATTGG CAATTATTAGCC SEQ ID NO:2703 | GTTGTATCCAGTTTACAA AGT SEQ ID NO:10715 | CAACGGTATGATACTTACCC ATTCACT SEQ ID NO:18727 |
| | | AA | RASQGIGNYLA SEQ ID NO:2704 | VVSSLQS SEQ ID NO:10716 | QRYDTYPFT SEQ ID NO:18728 |
| iPS:435979 | 21-225_192H4 | NA | CGGGGAGTCAGGGACATTAG CAATTATTAGCC SEQ ID NO:2705 | GCTGCATCCAGTTTGCAA AGT SEQ ID NO:10717 | CTACATTATCTCAATTACCC GCTCACT SEQ ID NO:18729 |
| | | AA | RASQDISNYLA SEQ ID NO:2706 | AASSLQS SEQ ID NO:10718 | LHYLNYPLT SEQ ID NO:18730 |
| iPS:435983 | 21-225_192E5 | NA | CGGGCCAGTCAGAGCATTGG TAGGAGTTTACAC SEQ ID NO:2707 | TATGCTTCCCAGTCATTC TCA SEQ ID NO:10719 | CATCAGAGTAGTCGTTTACC GCTCACT SEQ ID NO:18731 |
| | | AA | RASQSIGRSLH SEQ ID NO:2708 | YASQSFS SEQ ID NO:10720 | HQSSRLPLT SEQ ID NO:18732 |
| iPS:435985 | 21-225_192F6 | NA | CGGGCAAGTCAGGGCATTAG AAATGATTTAGGC SEQ ID NO:2709 | GCTGCATCCAGTTTGCAA AGT SEQ ID NO:10721 | CTACAGCATTATAGTTTCCC ATTCACT SEQ ID NO:18733 |
| | | AA | RASQGIRNDLG SEQ ID NO:2710 | AASSLQS SEQ ID NO:10722 | LQHYSFPFT SEQ ID NO:18734 |
| iPS:435987 | 21-225_192G6 | NA | CGGACGAGTCAGGGCATTGG CAATTATTAGCC SEQ ID NO:2711 | AAAGCATCCAGTTTGCA AAGT SEQ ID NO:10723 | CAACAGTATATGACTTACCC GCTCACT SEQ ID NO:18735 |
| | | AA | RTSQGIGNYLA SEQ ID NO:2712 | KASSLQS SEQ ID NO:10724 | QQYMTYPLT SEQ ID NO:18736 |
| iPS:435989 | 21-225_192F7 | NA | CGGGCAAGTCAGGGCATTAG AAAAGATTTAGGC SEQ ID NO:2713 | ACTGCATCCAGTTTGCAA AGT SEQ ID NO:10725 | CTACAGGATACTAGTTACCC GTGGACG SEQ ID NO:18737 |
| | | AA | RASQGIRKDLG SEQ ID NO:2714 | TASSLQS SEQ ID NO:10726 | LQHTSYPWT SEQ ID NO:18738 |

FIGURE 49
(Continued)

| | | | | | |
|---|---|---|---|---|---|
| iPS:435993 | 21-225_192C8 | NA | CGGGGGAGTCAGGGCATTAG CAATTATTAGCC SEQ ID NO:2715 | GCTGCATCCAGTTTGCAA AGT SEQ ID NO:10727 | CAACATTATCTTACTTACCCT CTCACT SEQ ID NO:18739 |
| | | AA | RASQGISNYLA SEQ ID NO:2716 | AASSLQS SEQ ID NO:10728 | QHYLTYPLT SEQ ID NO:18740 |
| iPS:435995 | 21-225_192F8 | NA | AGGGCAGTCAGAGTATTAG CAGCAGTACTTAGCC SEQ ID NO:2717 | GGTGCATCCAGCAGGGC CACT SEQ ID NO:10729 | CAGCAGTATGAGAGTTCACC GTGGACG SEQ ID NO:18741 |
| | | AA | RASQSISSSYLA SEQ ID NO:2718 | GASSRAT SEQ ID NO:10730 | QQYESSPWT SEQ ID NO:18742 |
| iPS:435997 | 21-225_192G8 | NA | CGGACGAGTCAGGGCATTGG CAATTATTAGCC SEQ ID NO:2719 | AAAGCATCCAGTTTGCA AAGT SEQ ID NO:10731 | CAACAGTATATCACTTACCC GCTCACT SEQ ID NO:18743 |
| | | AA | RTSQGIGNYLA SEQ ID NO:2720 | KASSLQS SEQ ID NO:10732 | QQYITYPLT SEQ ID NO:18744 |
| iPS:435999 | 21-225_192F9 | NA | AAGTAGTCAGAGCCTCT CCATAGTGATGGAAGGACCT ATTIGTAT SEQ ID NO:2721 | GAGGTTCCAACCGGTTC GCT SEQ ID NO:10733 | ATGCAAAGTATACAGTTCC CTGGACG SEQ ID NO:18745 |
| | | AA | KSSQSLLHSDGRTYLY SEQ ID NO:2722 | EVSNRFA SEQ ID NO:10734 | MQSIQLPWT SEQ ID NO:18746 |
| iPS:436001 | 21-225_192C10 | NA | CGGGCGAGTCAGGGCATTGG CAAGTATTAGCC SEQ ID NO:2723 | GCTGCATCCAGTTTGCAA AGT SEQ ID NO:10735 | CAACGATATGATACTTACCC ATTCACT SEQ ID NO:18747 |
| | | AA | RASQGIGKYLA SEQ ID NO:2724 | AASSLQS SEQ ID NO:10736 | QRYDTYPFT SEQ ID NO:18748 |
| iPS:436003 | 21-225_192G10 | NA | CGGGCAAGTCAGAGCATTAG CAACTATTTAAAT SEQ ID NO:2725 | GCTGAATCCAGTTTACA AAGT SEQ ID NO:10737 | CAACAGAGTTACAGTTCCCC TCCGTGGACG SEQ ID NO:18749 |
| | | AA | RASQSISNYLN | AESSLQS | QQSYSSPWT |

FIGURE 49
(Continued)

| | | | | | | |
|---|---|---|---|---|---|---|
| iPS:436005 | 21-225_192H10 | NA | SEQ ID NO:2726 CGGGCGAGTCAGGGCATTGG CAAGTATTTAGCC | SEQ ID NO:10738 GCTGCATCCAGTTTGCAA AGT | SEQ ID NO:18750 CAACAGTATAGTACTTACCC GCTCACT |
| | | AA | SEQ ID NO:2727 RASQGIGKYLA | SEQ ID NO:10739 AASSLQS | SEQ ID NO:18751 QQYSTYPLT |
| iPS:436007 | 21-225_192G12 | NA | SEQ ID NO:2728 AGGGCCAGTCAGAGTGTCAG AAGCGACTTCTTAGCC | SEQ ID NO:10740 GGTGTATCCCGCAGGGC CACT | SEQ ID NO:18752 CAGCAGTATGGTAACTCACC GTGGACG |
| | | AA | SEQ ID NO:2729 RASQSVRSDFLA | SEQ ID NO:10741 GVSRRAT | SEQ ID NO:18753 QQYGNSPWT |
| iPS:436009 | 21-225_193A1 | NA | SEQ ID NO:2730 AGGGCCAGTCAGAGTGTTAG AAGCAACTTCTTAGCC | SEQ ID NO:10742 GGTGCATCCCGCAGGGC CACT | SEQ ID NO:18754 CAGCAGTATGGTAACTCACC GTGGACG |
| | | AA | SEQ ID NO:2731 RASQSVRSNFLA | SEQ ID NO:10743 GASRRAT | SEQ ID NO:18755 QQYGNSPWT |
| iPS:436011 | 21-225_193B1 | NA | SEQ ID NO:2732 AGGGCCAGTCAGAGTGTTAG AAGCAACTTCTTAGCC | SEQ ID NO:10744 GGTGCATCCCGCAGGGC CACT | SEQ ID NO:18756 CAGCAGTATGGTAACTCACC GTGGACG |
| | | AA | SEQ ID NO:2733 RASQSVRSNFLA | SEQ ID NO:10745 GASRRAT | SEQ ID NO:18757 QQYGNSPWT |
| iPS:436013 | 21-225_193F2 | NA | SEQ ID NO:2734 CGGGCGAGTCAGGGTATTAA CAACTGGTTAGCC | SEQ ID NO:10746 GGTGTTTCCAGTTTGCAA AGT | SEQ ID NO:18758 CAACAGGCTAACAGTTTCCC GTGGACG |
| | | AA | SEQ ID NO:2735 RASQGINNWLA | SEQ ID NO:10747 GVSSLQS | SEQ ID NO:18759 QQANSFPWT |
| iPS:436015 | 21-225_193D3 | NA | SEQ ID NO:2736 AGGGCCAGTCAGAGTATTCG CAGCAGTTCTTAGCC | SEQ ID NO:10748 GGTGCATCCAACAGGGC CACT | SEQ ID NO:18760 CAGCAGTATGGTAACTCACC GTGGGCG |
| | | AA | SEQ ID NO:2737 RASQSIRSSFLA | SEQ ID NO:10749 GASNRAT | SEQ ID NO:18761 QQYGNSPWA |

FIGURE 49
(Continued)

| | | | | | | |
|---|---|---|---|---|---|---|
| iPS:436017 | 21-225_193F3 | NA | SEQ ID NO:2738 AGGGCCGGTCAAAGTATTAG AACCGACTTCTTAGTC | SEQ ID NO:10750 GGTGCATCCAGCAGGGC CACT | SEQ ID NO:18762 CAGCAGTATGGAAGCTCACC GTGGACG |
| | | AA | SEQ ID NO:2739 RAGQSIRTDFLV | SEQ ID NO:10751 GASSRAT | SEQ ID NO:18763 QQYGSSPWT |
| iPS:436019 | 21-225_193C4 | NA | SEQ ID NO:2740 CGGGCCGAGTCAGGCATTAG CATTTATTAGCC | SEQ ID NO:10752 GCTGCATCCACTTTACAA TCA | SEQ ID NO:18764 CAAAAGTATAACAGTGCCCC ATTCACT |
| | | AA | SEQ ID NO:2741 RPSQGISIYLA | SEQ ID NO:10753 AASTLQS | SEQ ID NO:18765 QKYNSAPFT |
| iPS:436021 | 21-225_193G4 | NA | SEQ ID NO:2742 AAGTCCAGCCAGAGTGTTTT ATACAGCTCCAACAATTATA ACTACTTGACT | SEQ ID NO:10754 TGGGCATCTACCCGAAA ATCC | SEQ ID NO:18766 CAGCAATATATTATTACTCC GTGGACG |
| | | AA | SEQ ID NO:2743 KSSQSVLYSSNNYNYLT | SEQ ID NO:10755 WASTRKS | SEQ ID NO:18767 QQYYITPWT |
| iPS:436023 | 21-225_193A5 | NA | SEQ ID NO:2744 CGGGCAAGTCAGGGCATTAG AAATGATTAGGG | SEQ ID NO:10756 GCTGCATCCAGTTGCAA AGT | SEQ ID NO:18768 CTACAGCATAATGATTTCCC GTTCACT |
| | | AA | SEQ ID NO:2745 RASQGIRNDLG | SEQ ID NO:10757 AASSLQS | SEQ ID NO:18769 LQHNDFPFT |
| iPS:436025 | 21-225_193B5 | NA | SEQ ID NO:2746 CGGGCCAGTCAGAGCATTGG TAGTAGCTTACAC | SEQ ID NO:10758 TATGCTTCCCAGTCCTTC TCA | SEQ ID NO:18770 CATCAGAGTAGTCGTTTACC ATTCACT |
| | | AA | SEQ ID NO:2747 RASQSIGSSLH | SEQ ID NO:10759 YASQSFS | SEQ ID NO:18771 HQSSRLPFT |
| iPS:436027 | 21-225_193E6 | NA | SEQ ID NO:2748 AGGGCCAGTCAGAGTGTTAG GAGCGGTTACTTAGCC | SEQ ID NO:10760 GGTGCATCCAGCAGGGC CACT | SEQ ID NO:18772 CAGCAGTATGAGAGTTCACC GTGGACG |
| | | | SEQ ID NO:2749 | SEQ ID NO:10761 | SEQ ID NO:18773 |

FIGURE 49
(Continued)

| | | | | | | |
|---|---|---|---|---|---|---|
| iPS:436029 | | AA | RASQSVRSGYLA SEQ ID NO:2750 | GASSRAT SEQ ID NO:10762 | QQYESSPWT SEQ ID NO:18774 | |
| iPS:436031 | 21-225_193H6 | NA | AGGGCCGGTCAAAGTATTAG AACCAACTTCTTAGCC SEQ ID NO:2751 | GGTGCATCCAGCAGGGC CACT SEQ ID NO:10763 | CAGCAGTATGGTAGCTCACC GTGGACG SEQ ID NO:18775 | |
| iPS:436033 | 21-225_193C7 | AA | RAGQSIRTNFLA SEQ ID NO:2752 | GASSRAT SEQ ID NO:10764 | QQYGSSPWT SEQ ID NO:18776 | |
| | | NA | CGGGCGAGTCAGGGCATTGG CAAGTATTTAGCC SEQ ID NO:2753 | GCTGCATCCAGTTTGCAA AGT SEQ ID NO:10765 | CAACAGTATAGTACTTACCC GCTCACT SEQ ID NO:18777 | |
| iPS:436035 | 21-225_193E7 | AA | RASQGIGKYLA SEQ ID NO:2754 | AASSLQS SEQ ID NO:10766 | QQYSTYPLT SEQ ID NO:18778 | |
| | | NA | CGGGCAAGTCAGGGCATTAG AAATGATTAGCC SEQ ID NO:2755 | TCTGCATCCAGTTTGCAA AGG SEQ ID NO:10767 | CTACAGCATAAAAGGTACCC GCTCACT SEQ ID NO:18779 | |
| iPS:436037 | 21-225_193C8 | AA | RASQGIRNDLG SEQ ID NO:2756 | SASSLQR SEQ ID NO:10768 | LQHKRYPLT SEQ ID NO:18780 | |
| | | NA | AGGGCCAGTCAGAGTATTCG CAGCAGCTTCTTAGCC SEQ ID NO:2757 | GGTGCATCCAGCAGGGC CACT SEQ ID NO:10769 | CAGCAATATGGTAACTCACC GTGGGCG SEQ ID NO:18781 | |
| iPS:436039 | 21-225_193D8 | AA | RASQSIRSSFLA SEQ ID NO:2758 | GASSRAT SEQ ID NO:10770 | QQYGNSPWA SEQ ID NO:18782 | |
| | | NA | AGGGCCAGTCAGAGTATAA GGACCAACTTCTTAGCC SEQ ID NO:2759 | GGTGCATCCAGCAGGGC CACT SEQ ID NO:10771 | CAGCAGTATGGTAACTCACC GTGGACG SEQ ID NO:18783 | |
| | 21-225_193F8 | AA | RASQSIRTNFLA SEQ ID NO:2760 | GASSRAT SEQ ID NO:10772 | QQYGNSPWT SEQ ID NO:18784 | |
| | | NA | CGGGCGAGTCAGGGCGTTAG CAATCATTAGCC SEQ ID NO:2761 | GCTGCATCCAGTTTGCAA AGT SEQ ID NO:10773 | CAACAGTATAATAGTTACCC ATTCACT SEQ ID NO:18785 | |

FIGURE 49
(Continued)

| | | | RASQGVSNHLA | AASSLQS | QQYNSYPFT |
|---|---|---|---|---|---|
| iPS:436041 | | AA | SEQ ID NO:2762 | SEQ ID NO:10774 | SEQ ID NO:18786 |
| | 21-225_193G8 | NA | AGGGCCAGTCAGAGTGTTAG AACCAACTTCTTAGCC | GGTGCATCCCGCAGGGC CACT | CAGCAGTATGGTAACTCACC GTGGACG |
| | | | SEQ ID NO:2763 | SEQ ID NO:10775 | SEQ ID NO:18787 |
| iPS:436043 | | AA | RASQSVRTNFLA | GASRRAT | QQYGNSPWT |
| | | | SEQ ID NO:2764 | SEQ ID NO:10776 | SEQ ID NO:18788 |
| | 21-225_193G9 | NA | CGGGCCAGTCAGAGCATTGG TAGGAGTTACAC | TATGCTTCCAGTCATTC TCA | CATCAGAGTAGTCGTTTACC GCTCACT |
| | | | SEQ ID NO:2765 | SEQ ID NO:10777 | SEQ ID NO:18789 |
| iPS:436045 | | AA | RASQSIGRSLH | YASQSFS | HQSSRLPLT |
| | | | SEQ ID NO:2766 | SEQ ID NO:10778 | SEQ ID NO:18790 |
| | 21-225_193A10 | NA | CGGGCCGAGTCAGGGCATTAG CAATTATTAGCC | GCTGCATCCAGTTTGCAA AGT | CAACATTATCTTACTTACCCT CTCACT |
| | | | SEQ ID NO:2767 | SEQ ID NO:10779 | SEQ ID NO:18791 |
| iPS:436047 | | AA | RASQGISNYLA | AASSLQS | QHYLTYPLT |
| | | | SEQ ID NO:2768 | SEQ ID NO:10780 | SEQ ID NO:18792 |
| | 21-225_193B10 | NA | AGGGCCAGTCCGAGTGTTAG CAGCAGCTACTTAGCC | GGTGCATCCAGGAGGGC CACT | CAGCAGTATGGTAGCTCACC TCCGTGGACG |
| | | | SEQ ID NO:2769 | SEQ ID NO:10781 | SEQ ID NO:18793 |
| iPS:436049 | | AA | RASPSVSSSYLA | GASRRAT | QQYGSSPPWT |
| | | | SEQ ID NO:2770 | SEQ ID NO:10782 | SEQ ID NO:18794 |
| | 21-225_193B12 | NA | AGGGCCAGTCAGAGTATTCG CAGCAGCTTCTTAGCC | GATGCATCCAGCAGGGC CACT | CAGCAGTATGGTAACTCACC GTGGCG |
| | | | SEQ ID NO:2771 | SEQ ID NO:10783 | SEQ ID NO:18795 |
| iPS:436051 | | AA | RASQSIRSSFLA | DASSRAT | QQYGNSPWA |
| | | | SEQ ID NO:2772 | SEQ ID NO:10784 | SEQ ID NO:18796 |
| | 21-225_193G12 | NA | AGGGCCAGTCAGAGTGTTAG CAGCAGTTAGCC | GGTGCATCCACCAGGGC CACT | CAGCAGTATAATAACTGGCC GTGCAGT |
| | | | SEQ ID NO:2773 | SEQ ID NO:10785 | SEQ ID NO:18797 |

FIGURE 49
(Continued)

| | | AA/NA | | | | |
|---|---|---|---|---|---|---|
| iPS:436054 | | AA | RASQSVSSSLA SEQ ID NO:2774 | | GASTRAT SEQ ID NO:10786 | QQYNNWPCS SEQ ID NO:18798 |
| iPS:436056 | 21-225_194C1 | NA | CGGGCGAGTCAGGGCATTAG CAATTATTAGCC SEQ ID NO:2775 | GCTGCATCCAGTTGCAA AGT SEQ ID NO:10787 | CTACATTATCTTACTTACCCT CTCACT SEQ ID NO:18799 |
| | | AA | RASQGISNYLA SEQ ID NO:2776 | | AASSLQS SEQ ID NO:10788 | LHYLTYPLT SEQ ID NO:18800 |
| iPS:436058 | 21-225_194C3 | NA | CGGGCCAGTCAGAGTATTGG TAGTAACTTACAC SEQ ID NO:2777 | TCTGCTTCCCAGTCCTTC TCA SEQ ID NO:10789 | CAGCAGAGTAGTAGTTACC GTGGACG SEQ ID NO:18801 |
| | | AA | RASQSIGSNLH SEQ ID NO:2778 | | SASQSFS SEQ ID NO:10790 | QQSSSLPWT SEQ ID NO:18802 |
| iPS:436060 | 21-225_194A4 | NA | AGGGCCAGTCGGGGTGTTAG CAACACTACTTAGCC SEQ ID NO:2779 | GGTGCTTCCAACAGGGC CACT SEQ ID NO:10791 | CAGCACAATGATTACTCAAT GTTCACT SEQ ID NO:18803 |
| | | AA | RASRGVSNIYLA SEQ ID NO:2780 | | GASNRAT SEQ ID NO:10792 | QHNDYSMFT SEQ ID NO:18804 |
| iPS:436062 | 21-225_194F4 | NA | AAGTCTAGTCAGAGCCTCCT CCATAGTGATGGAAGGACCT ATTTGTAT SEQ ID NO:2781 | GAGGTTTCCAACCGGTTC TCT SEQ ID NO:10793 | ATGCAAAGTATACAGCTTCC CTGGACG SEQ ID NO:18805 |
| | | AA | KSSQSLLHSDGRTYLY SEQ ID NO:2782 | | EVSNRFS SEQ ID NO:10794 | MQSIQLPWT SEQ ID NO:18806 |
| iPS:436064 | 21-225_194E5 | NA | AGGGCCGGTCAAAGTATTAG AACCAACTTCTTAGCC SEQ ID NO:2783 | GGTGCATCCAGCAGGGC CACT SEQ ID NO:10795 | CAGCAGTATGGTAGTTCACC GTGGACG SEQ ID NO:18807 |
| | | AA | RAGQSIRTNFLA SEQ ID NO:2784 | | GASSRAT SEQ ID NO:10796 | QQYGSSPWT SEQ ID NO:18808 |
| | | NA | AGGGCCAGTCAGAGTATTAG AAGCAACTTCTTAGCC | GGTGCATCCAGCAGGGC CACT | CAGCAGTATGGTAGCTCACC GTGGACG |

FIGURE 49
(Continued)

| | | | | | | |
|---|---|---|---|---|---|---|
| | 21-225_194E6 | | SEQ ID NO:2785 | | SEQ ID NO:10797 | SEQ ID NO:18809 |
| iPS:436066 | | AA | RASQSIRSNFLA | | GASSRAT | QQYGSSPWT |
| | | | SEQ ID NO:2786 | | SEQ ID NO:10798 | SEQ ID NO:18810 |
| | 21-225_194B7 | NA | CGGGCGAGTCAGGGCATTAG CAAATATTTAGCC | | GGTGCATCCAGGTTGCA AAGT | CAACAATATCTTAATTACCCT CTCACC |
| | | | SEQ ID NO:2787 | | SEQ ID NO:10799 | SEQ ID NO:18811 |
| iPS:436068 | | AA | RASQGISKYLA | | GASRLQS | QHYLNYPLT |
| | | | SEQ ID NO:2788 | | SEQ ID NO:10800 | SEQ ID NO:18812 |
| | 21-225_194F7 | NA | CGGGCGAGTCAGGGTATTAG CAGGTGGTTAGCC | | GCTGCATCCAGTTTGCAA AGT | CAACAGGCTAACAGTTTCCC GTGGACG |
| | | | SEQ ID NO:2789 | | SEQ ID NO:10801 | SEQ ID NO:18813 |
| iPS:436072 | | AA | RASQGISRWLA | | AASSLQS | QQANSFPWT |
| | | | SEQ ID NO:2790 | | SEQ ID NO:10802 | SEQ ID NO:18814 |
| | 21-225_194C10 | NA | AGGGCCAAGTCAGGTCCGAGTGTAA CAGCGGCTACTTAGCC | | GGTGCATCCAGTTTACAA CACT | CAGCAGTATGAAAGCTCACC GTGGACG |
| | | | SEQ ID NO:2791 | | SEQ ID NO:10803 | SEQ ID NO:18815 |
| iPS:436074 | | AA | RASPSVNSGYLA | | GASSRAT | QQYESSPWT |
| | | | SEQ ID NO:2792 | | SEQ ID NO:10804 | SEQ ID NO:18816 |
| | 21-225_194F10 | NA | CGGGCAAGTCAGGGCATTAG AAATGATTTAGGC | | GCTGCATCCAGTTTACAA AGT | CTACAGCATTATAGTTTCC ATTCACT |
| | | | SEQ ID NO:2793 | | SEQ ID NO:10805 | SEQ ID NO:18817 |
| iPS:436076 | | AA | RASQGIRNDLG | | AASSLQS | LQHYSFPFT |
| | | | SEQ ID NO:2794 | | SEQ ID NO:10806 | SEQ ID NO:18818 |
| | 21-225_194H11 | NA | CGGGCGAGTCAGGGCATTAG CAATTATTTAGCC | | GCTGCATCCAGTTTACAA AGT | CAACAATATCTTACTTACCCT CTCACC |
| | | | SEQ ID NO:2795 | | SEQ ID NO:10807 | SEQ ID NO:18819 |
| iPS:436078 | | AA | RASQGISNYLA | | AASSLQS | QHYLTYPLT |
| | | | SEQ ID NO:2796 | | SEQ ID NO:10808 | SEQ ID NO:18820 |
| | | NA | CGGGCGAGTCAGGGCATTGG CAAGTATTTAGCA | | GCTGCATCCAGTTTGCAA AGT | CAACGATATGATACTTACC ATTCACT |

FIGURE 49
(Continued)

| | | | | | | |
|---|---|---|---|---|---|---|
| iPS:436080 | 21-225_194H12 | AA | SEQ ID NO:2797 RASQGIGKYLA | SEQ ID NO:10809 AASSLQS | SEQ ID NO:18821 QRYDTYPFT | |
| iPS:436082 | 21-225_195B1 | NA | SEQ ID NO:2798 AGGGCCAGTCCGAGTGTTAACAGTAACTACTTAGCC | SEQ ID NO:10810 GGTGCATCCAACAGGGCCACT | SEQ ID NO:18822 CAGCAGTATGAAAGCTCACCGTGGACG | |
| | | AA | SEQ ID NO:2799 RASPSVNSNYLA | SEQ ID NO:10811 GASNRAT | SEQ ID NO:18823 QQYESSPWT | |
| iPS:436084 | 21-225_195D9 | NA | SEQ ID NO:2800 CGGGCGAGTCAGGGTATTAGCAGGTGGTTAGCC | SEQ ID NO:10812 GCTGCATCCAGTTGCTAGGT | SEQ ID NO:18824 CAACGGGCTAACAGTTTCCCGTGCAGT | |
| | | AA | SEQ ID NO:2801 RASQGISRWLA | SEQ ID NO:10813 AASSLLG | SEQ ID NO:18825 QRANSFPCS | |
| iPS:436086 | 21-225_195F2 | NA | SEQ ID NO:2802 CGGGCCAGTCAGAGCATTGGTAGTAGCTTACAC | SEQ ID NO:10814 TATGCTTCCCAGTCCTTCTCA | SEQ ID NO:18826 CATCAGAGTAGAACTTTACCGCTCACT | |
| | | AA | SEQ ID NO:2803 RASQSIGSSLH | SEQ ID NO:10815 YASQSFS | SEQ ID NO:18827 HQSRTLPLT | |
| iPS:436088 | 21-225_191G10 | NA | SEQ ID NO:2804 CGGACGAGTCAGGGCATTGGCAAGTATTTAGCC | SEQ ID NO:10816 AAAGTATCCAGTTGCAAAGT | SEQ ID NO:18828 CAACAGTATATGACTTACCGCTCACT | |
| | | AA | SEQ ID NO:2805 RTSQGIGKYLA | SEQ ID NO:10817 KVSSLQS | SEQ ID NO:18829 QQYMTYPLT | |
| iPS:436090 | 21-225_195C8 | NA | SEQ ID NO:2806 AGGGCCAGTCAGAGTATTCGCAGCAGTTCTTAGCC | SEQ ID NO:10818 GGTGCATTAGTAGGGCCACT | SEQ ID NO:18830 CAGCAGTATGGTAACTCACCGTGGGCG | |
| | | AA | SEQ ID NO:2807 RASQSIRSSFLA | SEQ ID NO:10819 GAFSRAT | SEQ ID NO:18831 QQYGNSPWA | |
| | | NA | SEQ ID NO:2808 CGGGCGAGTCAGGGCATTAGCAATTATTTAGCC | SEQ ID NO:10820 GCTGCATCCAGTTGCAAAGT | SEQ ID NO:18832 CAACATTATCTTACTTACCCTCTCACT | |

FIGURE 49
(Continued)

| | | | | | | | |
|---|---|---|---|---|---|---|---|
| iPS:436092 | 21-225_195A9 | AA | SEQ ID NO:2809<br>RASQGISNYLA | SEQ ID NO:2810 | SEQ ID NO:10821<br>AASSLQS | SEQ ID NO:10822 | SEQ ID NO:18833<br>QHYLTYPLT | SEQ ID NO:18834 |
| iPS:436094 | 21-225_195B9 | NA | SEQ ID NO:2811<br>RASQGIRKDLG | CGGCAAGTCAGGGCATAA<br>GAAAAGATTAGGC<br>SEQ ID NO:2812 | SEQ ID NO:10823<br>AASDLQS | GCTGCATCCGATTTGCAA<br>AGT<br>SEQ ID NO:10824 | SEQ ID NO:18835<br>LQHYRYPFT | CTACAGCATTATCGTTACC<br>ATTCACT<br>SEQ ID NO:18836 |
| iPS:436096 | 21-225_195B10 | NA | SEQ ID NO:2813<br>RASQSIGSSLH | CGGGCCAGTCAGAGCATTGG<br>TAGTAGCTTACAC<br>SEQ ID NO:2814 | SEQ ID NO:10825<br>YASQSFS | TATGCTTCCCAGTCCTTC<br>TCA<br>SEQ ID NO:10826 | SEQ ID NO:18837<br>HQSGRLPLT | CATCAGAGTGGTCGTTACC<br>GCTCACT<br>SEQ ID NO:18838 |
| iPS:436098 | 21-225_195E10 | AA | SEQ ID NO:2815<br>RASQSIGSSLH | CGGGCCAGTCAGAGCATTGG<br>TAGTAGCTTACAC<br>SEQ ID NO:2816 | SEQ ID NO:10827<br>YASQSFS | TATGCTTCCCAGTCCTTC<br>TCA<br>SEQ ID NO:10828 | SEQ ID NO:18839<br>HQSSRLPFT | CATCAGAGTAGTCGTTACC<br>ATTCACT<br>SEQ ID NO:18840 |
| iPS:436100 | 21-225_195G11 | NA | SEQ ID NO:2817<br>KSSQSVLFNSNKNYLA | AAGTCCAGCCAGAGTGTTT<br>ATTCAACTCCAACAATAAGA<br>ACTACTTAGCT<br>SEQ ID NO:2818 | SEQ ID NO:10829<br>WASTLES | TGGGCATCTACCCTGGA<br>ATCT<br>SEQ ID NO:10830 | SEQ ID NO:18841<br>QQYCSFPFT | CAGCAATATTGTAGTTTCC<br>ATTCACT<br>SEQ ID NO:18842 |
| | 21-225_195G12 | AA | SEQ ID NO:2819<br>RASQGINNWLA | CGGGCGAGTCAGGGTATTAA<br>CAACTGGTTAGCC<br>SEQ ID NO:2820 | SEQ ID NO:10831<br>GVSSLQS | GGTGTTTCCAGTTTGCAG<br>AGT<br>SEQ ID NO:10832 | SEQ ID NO:18843<br>QQANSFPWT | CAACAGGCTAACAGTTTCCC<br>GTGGACG<br>SEQ ID NO:18844 |

FIGURE 49
(Continued)

| | | | | | |
|---|---|---|---|---|---|
| iPS:436102 | 21-225_196B1 | NA | AAGTCCAGCCAGAGTATTTTATTCAGCTCCAACAATAAGAGGTACTTAGCT SEQ ID NO:2821 | TGGGCATCTATCCGGGAATCC SEQ ID NO:10833 | CAGCAATATTCTAGTCTTCCATTCACT SEQ ID NO:18845 |
| | | AA | KSSQSILFSSNNKRYLA SEQ ID NO:2822 | WASIRES SEQ ID NO:10834 | QQYSSLPFT SEQ ID NO:18846 |
| iPS:436104 | 21-225_196C1 | NA | AAGTCCAGCCAGAGTGTTTATTCAACTCCAACAATAAGAACTACTTAGCT SEQ ID NO:2823 | TGGGCATCTACCCTGGAATCT SEQ ID NO:10835 | CAGCAATATTGTAGTTTTCCATTCACT SEQ ID NO:18847 |
| | | AA | KSSQSVLFNSNNKNYLA SEQ ID NO:2824 | WASTLES SEQ ID NO:10836 | QQYCSFPFT SEQ ID NO:18848 |
| iPS:436106 | 21-225_196F2 | NA | CGGGCGAGTCAGGGTATTAGCAGCTGGTTAGCC SEQ ID NO:2825 | GCTGCATCCAGTTTGCAAAGT SEQ ID NO:10837 | CAACAGACTAACAGTGTCCCATTCACT SEQ ID NO:18849 |
| | | AA | RASQGISSWLA SEQ ID NO:2826 | AASSLQS SEQ ID NO:10838 | QQTNSVPFT SEQ ID NO:18850 |
| iPS:436110 | 21-225_196F4 | NA | CGGGCAAGTCAGGCCATTCACAGCTATTAAAT SEQ ID NO:2827 | ACTGCATCCAGTTTGCAAGGT SEQ ID NO:10839 | CAACAGAGCTACGGTTCCCTCTCACT SEQ ID NO:18851 |
| | | AA | RASQRIHSYLN SEQ ID NO:2828 | TASSLQG SEQ ID NO:10840 | QQSYGSPLT SEQ ID NO:18852 |
| iPS:436112 | 21-225_196C7 | NA | CGGGCGAATCAGGCCATTAGCAATTATTAGCC SEQ ID NO:2829 | GCTGCATCCAGTTTGCAAAGT SEQ ID NO:10841 | CAACATTATCTCACTTACCCTCTCACT SEQ ID NO:18853 |
| | | AA | RANQAISNYLA SEQ ID NO:2830 | AASSLQS SEQ ID NO:10842 | QHYLTYPLT SEQ ID NO:18854 |
| iPS:436114 | 21-225_196G8 | NA | AAGTCCAGCCAGAGTGTTTTACACAGCTCCAACAATAACAACTACTTAGCT | TGGGCATCTACCCGGGAATCC | CAGCAATATTATAATACTCCTCCGACA |

FIGURE 49
(Continued)

| | | | | | | |
|---|---|---|---|---|---|---|
| iPS:436116 | 21-225_196G8 | AA | SEQ ID NO:2831 KSSQSVLHSSNNNYLA | SEQ ID NO:10843 WASTRES | SEQ ID NO:18855 QQYYNTPPT | |
| | | NA | SEQ ID NO:2832 CGGGCGAGTCAGGGTATTAG CAACTGCTTAGCC | SEQ ID NO:10844 GCTGCATCCAGTTGCAA AGT | SEQ ID NO:18856 CAACAGGGTGACAGTTCCC TCCGACG | |
| iPS:436118 | 21-225_196B9 | AA | SEQ ID NO:2833 RASQGISNCLA | SEQ ID NO:10845 AASSLQS | SEQ ID NO:18857 QQGDSFPPT | |
| | | NA | SEQ ID NO:2834 CGGGCGAGTCAGGGTATTAG CAGGTGGTTAGCC | SEQ ID NO:10846 GCTGCATCCAGTTGCTA GGT | SEQ ID NO:18858 CAACGGGATAACAGTTACC GTGCAGT | |
| iPS:436120 | 21-225_196A10 | AA | SEQ ID NO:2835 RASQGISRWLA | SEQ ID NO:10847 AASSLLG | SEQ ID NO:18859 QRDNSLPCS | |
| | | NA | SEQ ID NO:2836 CGGGCAAGTCAGGCATTAG AAATGATTTAGGC | SEQ ID NO:10848 GCTGCATCCAGTTGCAA AGT | SEQ ID NO:18860 CTACAATATAATAGTTACC TCTCACT | |
| iPS:436122 | 21-225_196C10 | AA | SEQ ID NO:2837 RASQGIRNDLG | SEQ ID NO:10849 AASSLQS | SEQ ID NO:18861 LQYNSYPLT | |
| | | NA | SEQ ID NO:2838 AGGGCCAGTCCGAGTGTTAG CAACAGCTTCTTAGCC | SEQ ID NO:10850 GGTGCATCCAGCAGGGC CACT | SEQ ID NO:18862 CAGCAGTATGGTAGCTCACC TCCGTGGACG | |
| iPS:436132 | 21-225_196C12 | AA | SEQ ID NO:2839 RASPSVSNSFLA | SEQ ID NO:10851 GASSRAT | SEQ ID NO:18863 QQYGSPPWT | |
| | | NA | SEQ ID NO:2840 CGGGCAAGTCAGGGCATTAG AAATGATCTAGGC | SEQ ID NO:10852 GCTGCATCCAGTTGCAA AGT | SEQ ID NO:18864 CTACAGCATAATGATTCCC GTTCACT | |
| iPS:436134 | | AA | SEQ ID NO:2841 RASQGIRNDLG | SEQ ID NO:10853 AASSLQS | SEQ ID NO:18865 LQHNDFPFT | |
| | | NA | SEQ ID NO:2842 AGGGCCAGTCAGAGAGTGTTAG AAGCAACTTCTTAGCC | SEQ ID NO:10854 GGTGCATACCGCAGGGC CACT | SEQ ID NO:18866 CAGCAGTATGGTAACTCACC GTGGACG | |

FIGURE 49
(Continued)

| | | | | | | |
|---|---|---|---|---|---|---|
| iPS:436138 | 21-225_196H12 | AA | SEQ ID NO:2843 RASQSVRSNFLA | SEQ ID NO:10855 GAYRRAT | SEQ ID NO:18867 QQYGNSPWT | |
| iPS:436140 | 21-225_197F2 | NA | SEQ ID NO:2844 CGGACGAGTCAGGGCATTGG CAATTATTAGCC | SEQ ID NO:10856 AAAACATCCAGTTTGCA AAGT | SEQ ID NO:18868 CAACAATATATCACTACCC GCTCACT | |
| | | AA | SEQ ID NO:2845 RTSQGIGNYLA | SEQ ID NO:10857 KTSSLQS | SEQ ID NO:18869 QQYITYPLT | |
| iPS:436146 | 21-225_197G3 | NA | SEQ ID NO:2846 CGGGGAGTCAGGGCATTGG CAATCATTAGCC | SEQ ID NO:10858 GCTGCATCCAGTTTGCAA AGT | SEQ ID NO:18870 CAACAGTATAGTAATTACCC GGTCACT | |
| | | AA | SEQ ID NO:2847 RASQGIGNHLA | SEQ ID NO:10859 AASSLQS | SEQ ID NO:18871 QQYSNYPVT | |
| iPS:436148 | 21-225_197F4 | NA | SEQ ID NO:2848 AGGGCCAGTCAGAGTATTCG CAGCAGTTCTTAGCC | SEQ ID NO:10860 GGTGCATCCAGCAGGGC CACT | SEQ ID NO:18872 CAGCAGTATGGAAACTCACC GTGGGCG | |
| | | AA | SEQ ID NO:2849 RASQSIRSSFLA | SEQ ID NO:10861 GASSRAT | SEQ ID NO:18873 QQYGNSPWA | |
| iPS:436150 | 21-225_197H4 | NA | SEQ ID NO:2850 AGGTCCAGCCAGAGTGTTT ACACAGTTCAACAATTACA ACTACTTAGCT | SEQ ID NO:10862 TGGGCATCTACCCGGGA ATCC | SEQ ID NO:18874 CAACAATATTATAGTACTCC TCCGACG | |
| | | AA | SEQ ID NO:2851 RSSQSVLHSFNNYNYLA | SEQ ID NO:10863 WASTRES | SEQ ID NO:18875 QQYSTPPT | |
| iPS:436152 | 21-225_197B6 | NA | SEQ ID NO:2852 CGGGGAGTCAGGGCATTGG CAAATATTAGCC | SEQ ID NO:10864 GGTGCATCCAGTTTGCA AAGT | SEQ ID NO:18876 CAACAATATAGTACTTACCC GCTCACT | |
| | | AA | SEQ ID NO:2853 RASQGIGKYLA | SEQ ID NO:10865 GASSLQS | SEQ ID NO:18877 QQYSTYPLT | |
| | | | SEQ ID NO:2854 | SEQ ID NO:10866 | SEQ ID NO:18878 | |

FIGURE 49
(Continued)

| | | | | |
|---|---|---|---|---|
| iPS:436154 | 21-225_197C6 | NA | AGGTCCAGCCAGAGTGTTTT ACACAGTTCCAACAATTACA ACTACTTAGCT SEQ ID NO:2855 | TGGGCATCTACCCGGA ATCC SEQ ID NO:10867 | CAACAATATTATAGTACTCC TCCGACG SEQ ID NO:18879 |
| | | AA | RSSQSVLHSSNNYNYLA SEQ ID NO:2856 | WASTRES SEQ ID NO:10868 | QQYYSTPPT SEQ ID NO:18880 |
| iPS:436156 | 21-225_197C8 | NA | AAGTCCAGCCAGAGTGTTTT ACACAGTTCCAACAATAAGA ACTACTTAGCT SEQ ID NO:2857 | TGGGCATCTACCCGGA ATCC SEQ ID NO:10869 | CAGCAGTCTTATACTATTCC ATTCACT SEQ ID NO:18881 |
| | | AA | KSSQSVLHSSNNKNYLA SEQ ID NO:2858 | WASTRES SEQ ID NO:10870 | QQSYTIPFT SEQ ID NO:18882 |
| iPS:436158 | 21-225_197G8 | NA | AAGTCTAGTCAGAACCTCCT GCATAGTGATGGAAAGACCT ATTTGTAT SEQ ID NO:2859 | GAAGTTTCCAACCGGTTC TCT SEQ ID NO:10871 | ATGCAAAGTATACAGTTTCC CTGGACG SEQ ID NO:18883 |
| | | AA | KSSQNLLHSDGKTYLY SEQ ID NO:2860 | EVSNRFS SEQ ID NO:10872 | MQSIQLPWT SEQ ID NO:18884 |
| iPS:436160 | 21-225_197C9 | NA | CGGGCGAGTCAGGGTATTAG CAACTGGTTAGCC SEQ ID NO:2861 | GCTGCATCCAGTTTGCAA AGT SEQ ID NO:10873 | CAACAGGCTAACAGTTTCCC GTGGACG SEQ ID NO:18885 |
| | | AA | RASQGISNWLA SEQ ID NO:2862 | AASSLQS SEQ ID NO:10874 | QQANSFPWT SEQ ID NO:18886 |
| iPS:436164 | 21-225_197G10 | NA | CGGGCAAGTCAGGGCATTAG AAATGATTTAGGC SEQ ID NO:2863 | GGTGCATCCAGTTACA AAGT SEQ ID NO:10875 | CTACAGCATTATAGGTACCC ATTCACT SEQ ID NO:18887 |
| | | AA | RASQGIRNDLG SEQ ID NO:2864 | GASSLQS SEQ ID NO:10876 | LQHYRYPFT SEQ ID NO:18888 |
| iPS:436167 | | NA | CGGGCGAGTCAGGGCATTAA CAAGTATTTATCC | GCTGCATCCAGTGTGCA AAGT | CAAGATATGACACTTACCC ATTCACT |

FIGURE 49
(Continued)

| | | | | | | |
|---|---|---|---|---|---|---|
| iPS:436173 | 21-225_197E11 | AA | SEQ ID NO:2865 RASQGINKYLS | SEQ ID NO:10877 AASSVQS | SEQ ID NO:18889 QRYDTYPFT | |
| iPS:436177 | 21-225_197G12 | NA | SEQ ID NO:2866 CGGAGGAGTCAGGGCATTGG CAATTATTTAGCC | SEQ ID NO:10878 AAAACATCCAGTTGCA AAGT | SEQ ID NO:18890 CAACAATATATGACTTACCC GCTCACT | |
| | | AA | SEQ ID NO:2867 RTSQGIGNYLA | SEQ ID NO:10879 KTSSLQS | SEQ ID NO:18891 QQYMTYPLT | |
| iPS:436179 | 21-225_198B1 | NA | SEQ ID NO:2868 AGGGCCGGTCAAAGTATTAG AACCAACTTCTTAGCC | SEQ ID NO:10880 GGTGCATCCAGCAGGGC CACT | SEQ ID NO:18892 CAGCAGTATGGTAGCTCACC GTGGACG | |
| | | AA | SEQ ID NO:2869 RAGQSIRTNFLA | SEQ ID NO:10881 GASSRAT | SEQ ID NO:18893 QQYGSSPWT | |
| iPS:436181 | 21-225_198E1 | NA | SEQ ID NO:2870 AGGGCCAGTCAGAGTATAA GGAGCAACTTCTTAGCC | SEQ ID NO:10882 GGTGCATTCAGTAGGGC CACT | SEQ ID NO:18894 CAGCAGTATGGTAATTCACC GTGGACG | |
| | | AA | SEQ ID NO:2871 RASQSIRSNFLA | SEQ ID NO:10883 GAFSRAT | SEQ ID NO:18895 QQYGNSPWT | |
| iPS:436189 | 21-225_198C2 | NA | SEQ ID NO:2872 AGGGCCAGTCAGAGTGTTAG AAGCAGTACTTAGCC | SEQ ID NO:10884 GGTGCATTCAGTAGGGC CAGT | SEQ ID NO:18896 CAGCAGTATGGTAACTCACC GTGGACG | |
| | | AA | SEQ ID NO:2873 RASQSVRSSYLA | SEQ ID NO:10885 GAFSRAS | SEQ ID NO:18897 QQYGNSPWT | |
| iPS:436189 | 21-225_198B6 | NA | SEQ ID NO:2874 CGGGCGAGTCAGGGCATTGG CAATTATTTAGCC | SEQ ID NO:10886 GCTGCATCCAGTTTGCAA AGT | SEQ ID NO:18898 CAACAATATAGTACTTACCC GCTCACT | |
| | | AA | SEQ ID NO:2875 RASQGIGNYLA | SEQ ID NO:10887 AASSLQS | SEQ ID NO:18899 QQYSTYPLT | |
| iPS:436191 | | NA | SEQ ID NO:2876 CGGGCAAGTCAGGGCATAA GAAAAGATTTAGGC | SEQ ID NO:10888 GCTGCATCCAGTTGCAA AGT | SEQ ID NO:18900 CTACAACATTATCGTTACCC TTTCACT | |

FIGURE 49
(Continued)

| | | | | | | |
|---|---|---|---|---|---|---|
| iPS:436193 | 21-225_198B9 | AA | SEQ ID NO:2877<br>RASQGIRKDLG<br>SEQ ID NO:2878 | SEQ ID NO:10889<br>AASSLQS<br>SEQ ID NO:10890 | SEQ ID NO:18901<br>LQHYRYPFT<br>SEQ ID NO:18902 | |
| iPS:436195 | 21-225_198A10 | NA | AAGTCTAGTCAGAGCCTCCT<br>CTATAGTGATGGAAGGACCT<br>ATTTGTAT<br>SEQ ID NO:2879 | GAGGTTCCAACCGGTTC<br>TCT<br>SEQ ID NO:10891 | ATGCAAAGTATACAGCTTCC<br>CTGGACG<br>SEQ ID NO:18903 | |
| | | AA | KSSQSLLYSDGRTYLY<br>SEQ ID NO:2880 | EVSNRFS<br>SEQ ID NO:10892 | MQSIQLPWT<br>SEQ ID NO:18904 | |
| iPS:436197 | 21-225_198G10 | NA | AGGGCCAGTCAGAGTATTCG<br>CAGCAGCTTCTTAGCC<br>SEQ ID NO:2881 | GGTGCATCCAGCAGGGC<br>CACT<br>SEQ ID NO:10893 | CAGCAGTATGGTAACTCACC<br>GTGGGCG<br>SEQ ID NO:18905 | |
| | | AA | RASQSIRSSFLA<br>SEQ ID NO:2882 | GASSRAT<br>SEQ ID NO:10894 | QQYGNSPWA<br>SEQ ID NO:18906 | |
| iPS:436199 | 21-225_199C2 | NA | AGGGCCAGTCAGAGTATTCG<br>CAGCAGCTTCTTAGCC<br>SEQ ID NO:2883 | GGTGCATCCAGCAGGGC<br>CACT<br>SEQ ID NO:10895 | CAGCAGTATGGTAACTCACC<br>GTGGGCG<br>SEQ ID NO:18907 | |
| | | AA | RASQSIRSSFLA<br>SEQ ID NO:2884 | GASSRAT<br>SEQ ID NO:10896 | QQYGNSPWA<br>SEQ ID NO:18908 | |
| iPS:436199 | 21-225_199E3 | NA | CGGGCAAGTCAGGGCATTAG<br>AAATGATTAGGC<br>SEQ ID NO:2885 | TCTGCATCCAGTTGCAA<br>AGG<br>SEQ ID NO:10897 | CTACAGCATAAAAGGTACCC<br>GCTCACT<br>SEQ ID NO:18909 | |
| | | AA | RASQGIRNDLG<br>SEQ ID NO:2886 | SASSLQR<br>SEQ ID NO:10898 | LQHKRYPLT<br>SEQ ID NO:18910 | |
| iPS:436201 | 21-225_199C5 | NA | CGGGGAGTCAGGGCATTAG<br>CAAGTATTTAGCC<br>SEQ ID NO:2887 | GCTGCATCCAGTTGCAA<br>AGT<br>SEQ ID NO:10899 | CAACAGTATCTTACTTACCC<br>GCTCACT<br>SEQ ID NO:18911 | |
| | | AA | RASQGISKYLA<br>SEQ ID NO:2888 | AASSLQS<br>SEQ ID NO:10900 | QQYLTYPLT<br>SEQ ID NO:18912 | |

FIGURE 49
(Continued)

| | | | | | | |
|---|---|---|---|---|---|---|
| iPS:436203 | 21-225_199A6 | NA | AGGGCCCAGTCAGAGTTTTAG CAGAAACTTAGCC | GGTGCATCCACTAGGGC CACT | CAGCAGTATAATAACTGGCC GCTCACT |
| | | | SEQ ID NO:2889 | SEQ ID NO:10901 | SEQ ID NO:18913 |
| | | AA | RPSQSFSRNLA | GASTRAT | QQYNNWPLT |
| | | | SEQ ID NO:2890 | SEQ ID NO:10902 | SEQ ID NO:18914 |
| iPS:436205 | 21-225_199A7 | NA | CGGGCAAGTCAGGGCATAA GAAAAGATTAGGC | GCTGCATCCAGTTGCAA AGT | CTACAACATTATCGTTACC TTTCACT |
| | | | SEQ ID NO:2891 | SEQ ID NO:10903 | SEQ ID NO:18915 |
| | | AA | RASQGIRKDLG | AASSLQS | LQHYRYPFT |
| | | | SEQ ID NO:2892 | SEQ ID NO:10904 | SEQ ID NO:18916 |
| iPS:436207 | 21-225_199C7 | NA | AGGGCCAGTCAGAGTATAA GGACCAACTTCTTAGCC | GGTGCATCCAGCAGGGC CACT | CAGCAGTATGGTAACTCACC GTGGACG |
| | | | SEQ ID NO:2893 | SEQ ID NO:10905 | SEQ ID NO:18917 |
| | | AA | RASQSIRTNFLA | GASSRAT | QQYGNSPWT |
| | | | SEQ ID NO:2894 | SEQ ID NO:10906 | SEQ ID NO:18918 |
| iPS:436210 | 21-225_199G11 | NA | AGGGCCAGTCAGAGTGTTAG AAGCAGTACTTAGCC | GGTGCATTCAGCAGGGC CACT | CAGCAGTATGGTAACTCACC GTGGACG |
| | | | SEQ ID NO:2895 | SEQ ID NO:10907 | SEQ ID NO:18919 |
| | | AA | RASQSVRSSYLA | GAFSRAT | QQYGNSPWT |
| | | | SEQ ID NO:2896 | SEQ ID NO:10908 | SEQ ID NO:18920 |
| iPS:436212 | 21-225_200G1 | NA | CGGGCAAGTCAGAGCATTAG CAGCTATTTAAAT | GCTGAGTCCAGTTACA AAGT | CAACAGAGTTACAGTTCCCC TCCGTGGACG |
| | | | SEQ ID NO:2897 | SEQ ID NO:10909 | SEQ ID NO:18921 |
| | | AA | RASQSISSYLN | AESSLQS | QQSYSSPWT |
| | | | SEQ ID NO:2898 | SEQ ID NO:10910 | SEQ ID NO:18922 |
| iPS:436214 | 21-225_200F6 | NA | CGGGCAAGTCAGGACATTAG AAATGATTTAGGC | GCTGCATCCAGTTGCAA AGT | CTACACAGGCATTATCGTTACC ATTCACT |
| | | | SEQ ID NO:2899 | SEQ ID NO:10911 | SEQ ID NO:18923 |
| | | AA | RASQDIRNDLG | AASSLQS | LQHYRYPFT |
| | | | SEQ ID NO:2900 | SEQ ID NO:10912 | SEQ ID NO:18924 |

FIGURE 49
(Continued)

| | | | | | | |
|---|---|---|---|---|---|---|
| iPS:436216 | 21-225_200B7 | NA | CGGGCCAGTCAGAGAACATTGGTAATACCTTGCAC SEQ ID NO:2901 | TATGCTTCCCAGTCCTTC TCA SEQ ID NO:10913 | CATCAGAGTGGTAGTTTACC TCAGACG SEQ ID NO:18925 |
| | | AA | RASQNIGNTLH SEQ ID NO:2902 | YASQSFS SEQ ID NO:10914 | HQSGSLPQT SEQ ID NO:18926 |
| iPS:436218 | 21-225_200G7 | NA | AAGTCCAGCCAGAGTGTTT ACACAGCTCCAACAATAACA ACTACTTAGCT SEQ ID NO:2903 | TGGGCATCTACCCGGGA ATCC SEQ ID NO:10915 | CAGCAATATTATAATACTCC TCCGACA SEQ ID NO:18927 |
| | | AA | KSSQSVLHSSNNNNYLA SEQ ID NO:2904 | WASTRES SEQ ID NO:10916 | QQYYNTPPT SEQ ID NO:18928 |
| iPS:436220 | 21-225_200F8 | NA | CGGGCCAGTCAGAGTATTGG TAGTAACTTACAC SEQ ID NO:2905 | TCTGCTTCCCAGTCCTTC TCA SEQ ID NO:10917 | CAGCAGAGTAGTAGTTTACC GTGGACG SEQ ID NO:18929 |
| | | AA | RASQSIGSNLH SEQ ID NO:2906 | SASQSFS SEQ ID NO:10918 | QQSSSLPWT SEQ ID NO:18930 |
| iPS:436222 | 21-225_200C9 | NA | CGGGCAACTCAGGGCATTAG AAAAGATTAGGC SEQ ID NO:2907 | ACTGCATCCAGTTTGCAA AGT SEQ ID NO:10919 | CTACAGCATAATAGTTACC TGGACG SEQ ID NO:18931 |
| | | AA | RATQGIRKDLG SEQ ID NO:2908 | TASSLQS SEQ ID NO:10920 | LQHNSYPWT SEQ ID NO:18932 |
| iPS:436226 | 21-225_200F10 | NA | AGGGCCAGTCAGAATATTCG CAGCAGCTTCTTAGCC SEQ ID NO:2909 | GGTGCATCCAGCAGGGC CACT SEQ ID NO:10921 | CAGCAGTATGGTAACTCACC GTGGGG SEQ ID NO:18933 |
| | | AA | RASQNIRSSFLA SEQ ID NO:2910 | GASSRAT SEQ ID NO:10922 | QQYGNSPWA SEQ ID NO:18934 |
| iPS:436228 | 21-225_200F12 | NA | CGGGCAAGTCAGGGCATTAG AAATGATTTAGGC SEQ ID NO:2911 | TCTGCATCCAGTTTGCAT ACT SEQ ID NO:10923 | CTACAGCATAAGAGTTACC GCTCACT SEQ ID NO:18935 |
| | | AA | RASQGIRNDLG | SASSLHT | LQHKSYPLT |

FIGURE 49
(Continued)

| | | | | | | |
|---|---|---|---|---|---|---|
| iPS:436230 | | | SEQ ID NO:2912 CGGGCAAGTCAGGGCATTAG GAATGATTTAGGC | SEQ ID NO:10924 TCTGCATCCATTTTACAA AGG | SEQ ID NO:18936 CTACAGCATAAAAGTTACC TCTCACT |
| | 21-225_201A1 | NA | SEQ ID NO:2913 RASQGIRNDLG | SEQ ID NO:10925 SASILQR | SEQ ID NO:18937 LQHKSYPLT |
| | | AA | SEQ ID NO:2914 AGGGCCAGTCCAGTATTAA CAGCGGCTTCTTAGCC | SEQ ID NO:10926 GGTGCATCCAGCAGGGC CACT | SEQ ID NO:18938 CACCAGTATGAGACCTCACC GTGGACG |
| iPS:436232 | 21-225_201E1 | NA | SEQ ID NO:2915 RASPSINSGFLA | SEQ ID NO:10927 GASSRAT | SEQ ID NO:18939 HQYETSPWT |
| | | AA | SEQ ID NO:2916 TCTGGAAGCAACTCCAACAT CGGAAGTAATATTGTAACC | SEQ ID NO:10928 AGTAATGATCAGGGCC CTCA | SEQ ID NO:18940 ACAGCATGGATGACAGCCT GAATGGTTGGGTG |
| iPS:436234 | 21-225_51E3 | NA | SEQ ID NO:2917 SGSNSNIGSNIVT | SEQ ID NO:10929 SNDQRPS | SEQ ID NO:18941 TAWDDSLNGWV |
| | | AA | SEQ ID NO:2918 AGGGCCAGTCAGAATATTAA AAACAACTTAGCC | SEQ ID NO:10930 GGTGCATCCACCAGGGC CACT | SEQ ID NO:18942 CAGCAGTTTATAACTGGCT GTGCAGT |
| iPS:436236 | 21-225_201F7 | NA | SEQ ID NO:2919 RASQNIKNNLA | SEQ ID NO:10931 GASTRAT | SEQ ID NO:18943 QQFYNWLCS |
| | | AA | SEQ ID NO:2920 AGGGCCAGTCAGAGTGTTAG CAGCAACTACTTAGCC | SEQ ID NO:10932 GGTGCATCCAGCAGGGC CACT | SEQ ID NO:18944 CAGCAGTATGAAAACTCACC GTGGACG |
| iPS:436238 | 21-225_201B2 | NA | SEQ ID NO:2921 RASQSVSSNYLA | SEQ ID NO:10933 GASSRAT | SEQ ID NO:18945 QQYENSPWT |
| | | AA | SEQ ID NO:2922 CGGGCCAGTCAGAACATTGG TCGTAGTTTACAC | SEQ ID NO:10934 TATGCTTCCCAGTCCTTC TCA | SEQ ID NO:18946 CATCAGAGTCGAAGTTACC GCTCACT |
| iPS:436240 | 21-225_201E8 | NA | SEQ ID NO:2923 | SEQ ID NO:10935 | SEQ ID NO:18947 |

FIGURE 49
(Continued)

| | | | | | | |
|---|---|---|---|---|---|---|
| | | | RASQNIGRSLH SEQ ID NO:2924 | YASQSFS SEQ ID NO:10936 | HQSRSLPLT SEQ ID NO:18948 | |
| iPS:436242 | 21-225_201A10 | AA | CGGGCAAGTCAGGGCATTAG AAATGATTTAGGC SEQ ID NO:2925 | TCTACATCCAGTTTGCAT TCT SEQ ID NO:10937 | CTACAGCATAATAGTTACCC GCTCACT SEQ ID NO:18949 | |
| iPS:436244 | 21-225_201H10 | AA | RASQGIRNDLG SEQ ID NO:2926 | STSSLHS SEQ ID NO:10938 | LQHNSYPLT SEQ ID NO:18950 | |
| | | NA | CGGGCAAGTCACAACATTAA CAGCTATTTAAAT SEQ ID NO:2927 | GCTGCATCCAGTTTGCAA AGT SEQ ID NO:10939 | CAACAGAGTTACAGTTTCCC GCTCACT SEQ ID NO:18951 | |
| iPS:436246 | 21-225_201G6 | AA | RASHNINSYLN SEQ ID NO:2928 | AASSLQS SEQ ID NO:10940 | QQSYSFPLT SEQ ID NO:18952 | |
| | | NA | AGGTCTAGTCAGAGCCTCCT CCATATAATAGATACAACC ATTTGGAT SEQ ID NO:2929 | TTGGGTTCTAATCGGGCC TCC SEQ ID NO:10941 | ATGCAAGCTCTACAAACTCC CACT SEQ ID NO:18953 | |
| iPS:436248 | 21-225_202A3 | AA | RSSQSLLHNNRYNHLD SEQ ID NO:2930 | LGSNRAS SEQ ID NO:10942 | MQALQTPT SEQ ID NO:18954 | |
| | | NA | CGGGCAAGTCAGGGCATTAG AAATGATTTAGGC SEQ ID NO:2931 | GCTGCATCCAGTTGCA AAGT SEQ ID NO:10943 | CTACAGCATCATGACTACCC ATTCACT SEQ ID NO:18955 | |
| iPS:436250 | 21-225_201A4 | AA | RASQGIRNDLG SEQ ID NO:2932 | AASRLQS SEQ ID NO:10944 | LQHHDYPFT SEQ ID NO:18956 | |
| | | NA | AGGTCCAGTCAGAATATTAA AAGCAACTTAGCC SEQ ID NO:2933 | GGTGCATCCACCAGGGC CACT SEQ ID NO:10945 | CAGCAGTTTTATAACTGGCT GTGCAGT SEQ ID NO:18957 | |
| iPS:436252 | | AA | RSSQNIKSNLA SEQ ID NO:2934 | GASTRAT SEQ ID NO:10946 | QQFYNWLCS SEQ ID NO:18958 | |
| | | NA | AGGGCCAGTCAGAGAATTA ACAACAACTTAGCC | GGTGCATCCACCAGGGC CACT | CAGCAGTATTATAACTGGCT GTGCAGT | |

FIGURE 49
(Continued)

| | | | | | |
|---|---|---|---|---|---|
| | 21-225_202A8 | AA | SEQ ID NO:2935<br>RASQRINNLA<br>SEQ ID NO:2936 | SEQ ID NO:10947<br>GASTRAT<br>SEQ ID NO:10948 | SEQ ID NO:18959<br>QQYYNWLCS<br>SEQ ID NO:18960 |
| iPS:436254 | 21-225_202C12 | NA | AGGTCTAGTCAGAGAGCCTCCT<br>GCATAATAATAATACAACC<br>ATTTGGAT | TTGGGTTCTAATCGGGCC<br>TCC | ATGCAAGCTCTACAAACTCC<br>CACT |
| | | AA | SEQ ID NO:2937<br>RSSQSLLHNNKYNHLD<br>SEQ ID NO:2938 | SEQ ID NO:10949<br>LGSNRAS<br>SEQ ID NO:10950 | SEQ ID NO:18961<br>MQALQTPT<br>SEQ ID NO:18962 |
| iPS:436256 | 21-225_202D9 | NA | AGGGCCAGTCAGAGTGTTAA<br>CAGCGGCTACTTAGCC | GGTGCATCCAGCAGGGC<br>CACT | CAACAATATGAGACCTCACC<br>GTGGACG |
| | | AA | SEQ ID NO:2939<br>RASQSVNSGYLA<br>SEQ ID NO:2940 | SEQ ID NO:10951<br>GASSRAT<br>SEQ ID NO:10952 | SEQ ID NO:18963<br>QQYETSPWT<br>SEQ ID NO:18964 |
| iPS:436258 | 21-225_202F12 | NA | AGGGCCAGTCAGAGTGTTCT<br>GAACAACTTAGCC | GGTGCATCCACTAGGGC<br>CACT | CAGCAGTATGATAACTGGCC<br>TCCGTGCAGT |
| | | AA | SEQ ID NO:2941<br>RASQSVLNNLA<br>SEQ ID NO:2942 | SEQ ID NO:10953<br>GASTRAT<br>SEQ ID NO:10954 | SEQ ID NO:18965<br>QQYDNWPPCS<br>SEQ ID NO:18966 |
| iPS:436260 | 21-225_203H1 | NA | CGGGCGAGTCAGGGCATTGG<br>CAATTATTAGCC | GTTGCATCCAGGTTGCA<br>AAGT | CAACGGTATCATACTTACC<br>GCTCACT |
| | | AA | SEQ ID NO:2943<br>RASQGIGNYLA<br>SEQ ID NO:2944 | SEQ ID NO:10955<br>VASRLQS<br>SEQ ID NO:10956 | SEQ ID NO:18967<br>QRYHTYPLT<br>SEQ ID NO:18968 |
| iPS:436262 | 21-225_203E3 | NA | CGGGCAAGTCACAACATTAA<br>CAGCTATTTAAAT | GCTGCATCCAGTTGCAA<br>AGT | CAACAGAGTTACAGTTTCCC<br>GCTCACT |
| | | AA | SEQ ID NO:2945<br>RASHNINSYLN<br>SEQ ID NO:2946 | SEQ ID NO:10957<br>AASSLQS<br>SEQ ID NO:10958 | SEQ ID NO:18969<br>QQSYSFPLT<br>SEQ ID NO:18970 |

FIGURE 49
(Continued)

| | | | | |
|---|---|---|---|---|
| iPS:436264 | NA | CGGGCAAGTCAGGGCATTAG ACATGATTAGGC SEQ ID NO:2947 | GCTGCATCCAGTTTGCAA AGT SEQ ID NO:10959 | CTACAGCATTATAGTTTCCCT CGGACG SEQ ID NO:18971 |
| 21-225_203F7 | AA | RASQGIRHDLG SEQ ID NO:2948 | AASSLQS SEQ ID NO:10960 | LQHYSFPRT SEQ ID NO:18972 |
| iPS:436268 | NA | CGGGCAAGTCAGGGCATTAG AAATGATTAGGC SEQ ID NO:2949 | AGGGCATCCAGTGTGCA AAAT SEQ ID NO:10961 | CTACAGCATAATAGTTACCC ATTCACT SEQ ID NO:18973 |
| 21-225_203B9 | AA | RASQGIRNDLG SEQ ID NO:2950 | RASSVQN SEQ ID NO:10962 | LQHNSYPFT SEQ ID NO:18974 |
| iPS:436270 | NA | AAGTCCAGCCAGAGTGTTT TTTCCACTCGAACAATAAGA ACTACTTAGCT SEQ ID NO:2951 | TGGGCATCTACCCGGGA ATCC SEQ ID NO:10963 | CAACAATATTTTAGTCTTCC ATTCACT SEQ ID NO:18975 |
| 21-225_203F10 | AA | KSSQSVFFHSNNKNYLA SEQ ID NO:2952 | WASTRES SEQ ID NO:10964 | QQYFSLPFT SEQ ID NO:18976 |
| iPS:436272 | NA | AAGTCCAGCCAGAGTGTTT ATACAGTTCCAACAATAAGA ACTACTTAGTT SEQ ID NO:2953 | TGGGCATCTACCCGGGA ATCC SEQ ID NO:10965 | CAGCAATATTATAGTACTCC TCCGACG SEQ ID NO:18977 |
| 21-225_201F5 | AA | KSSQSVLYSSNNKNYLV SEQ ID NO:2954 | WASTRES SEQ ID NO:10966 | QQYYSTPPT SEQ ID NO:18978 |
| iPS:436274 | NA | CGGGCAAGTCAGGGCATTAG AAATGATTAGGC SEQ ID NO:2955 | GCTGCAGCCAGTTTGCA AGGT SEQ ID NO:10967 | CTACAGCATTATAGTTACCC TCGGACG SEQ ID NO:18979 |
| 21-225_204H3 | AA | RASQGIRNDLG SEQ ID NO:2956 | AAASLQG SEQ ID NO:10968 | LQHYSYPRT SEQ ID NO:18980 |
| iPS:436276 | NA | CGGGCAAGTCACAACATTAA CAGTATTTAAAT SEQ ID NO:2957 | GCTGCATCCAGTTTGCAA AGT SEQ ID NO:10969 | CAACAGAGTTACAGTTTCCC GCTCACT SEQ ID NO:18981 |
| 21-225_204H4 | NA | | | |

FIGURE 49
(Continued)

| | | | | | |
|---|---|---|---|---|---|
| iPS:436278 | 21-225_201F2 | AA | RASHNINSYLN SEQ ID NO:2958 | AASSLQS SEQ ID NO:10970 | QQSYSPPLT SEQ ID NO:18982 |
| | | NA | AGGGCCAGTCAGAATATTAA AAGCAACTTAGCC SEQ ID NO:2959 | GGTGCATCCACCAGGGC CACT SEQ ID NO:10971 | CAGCAGTTTTATAACTGGCT GTGCAGT SEQ ID NO:18983 |
| iPS:436280 | 21-225_204D6 | AA | RASQNIKSNLA SEQ ID NO:2960 | GASTRAT SEQ ID NO:10972 | QQFYNWLCS SEQ ID NO:18984 |
| | | NA | CGGGCAAGTCGGAGGGTTCA CACCTATTTAAAT SEQ ID NO:2961 | GGTGCATCCAGTTTGCA ACGT SEQ ID NO:10973 | CAACAGAGTTACAGTTCCC GCTCACT SEQ ID NO:18985 |
| iPS:436282 | 21-225_204G6 | AA | RASRSVHTYLN SEQ ID NO:2962 | GASSLQR SEQ ID NO:10974 | QQSYSSPLT SEQ ID NO:18986 |
| | | NA | CGGACGAGTCAGGGCATTGG CAATTATTTAGCC SEQ ID NO:2963 | GCTGCATCCAGTTTGCAA AGT SEQ ID NO:10975 | CAACACTATCTTAGTTACCT TCTCACT SEQ ID NO:18987 |
| iPS:436284 | 21-225_204G8 | AA | RTSQGIGNYLA SEQ ID NO:2964 | AASSLQS SEQ ID NO:10976 | QHYLSYPLT SEQ ID NO:18988 |
| | | NA | CGGGCGAGTCAGGGCATAA GTAATCATTAGCC SEQ ID NO:2965 | GCTGCATCCAGTTTGCAA AGT SEQ ID NO:10977 | CAACAGTATAGTAATTACC GGTCACT SEQ ID NO:18989 |
| iPS:436286 | 21-225_204H8 | AA | RASQGISNHLA SEQ ID NO:2966 | AASSLQS SEQ ID NO:10978 | QQYSNYPVT SEQ ID NO:18990 |
| | | NA | CGGGCAAGTCAGGGCATTAG AAATGATTTAGGC SEQ ID NO:2967 | TCTGCATCCAGTTTGCAA AGT SEQ ID NO:10979 | CTACAACATAATAGTTACC TCTCACT SEQ ID NO:18991 |
| iPS:436290 | 21-225_205G3 | AA | RASQGIRNDLG SEQ ID NO:2968 | SASSLQS SEQ ID NO:10980 | LQHNSYPLT SEQ ID NO:18992 |
| | | NA | AGGGCCAGTCAGAATGTTAG TTACACAGTACTTAGCC SEQ ID NO:2969 | GGTGCATCCAGGAGGGC CACT SEQ ID NO:10981 | CAGCAGTATGGTAGCTCACC GTGCAGT SEQ ID NO:18993 |

FIGURE 49
(Continued)

| | | | | | |
|---|---|---|---|---|---|
| iPS:436292 | | AA | RASQNVSYSYLA | GASRRAT | QQYGSSPCS |
| | | | SEQ ID NO:2970 | SEQ ID NO:10982 | SEQ ID NO:18994 |
| | 21-225_205H3 | NA | CGGGCGAGTCAGGCCATTAGTAATCATTAGCC | GCTGCATCCAGTTTGCAAAGT | CAACAATATAGTAATTACCCACTCACT |
| | | | SEQ ID NO:2971 | SEQ ID NO:10983 | SEQ ID NO:18995 |
| iPS:436294 | | AA | RASQAISNHLA | AASSLQS | QQYSNYPLT |
| | | | SEQ ID NO:2972 | SEQ ID NO:10984 | SEQ ID NO:18996 |
| | 21-225_205G4 | NA | AGGGCCAGTCAGAATATTAAAAGCAACTTAGCC | GGTGCATCCACCAGGGCCACT | CAGCAGTTTTATAACTGGCTGTGCAGT |
| | | | SEQ ID NO:2973 | SEQ ID NO:10985 | SEQ ID NO:18997 |
| iPS:436296 | | AA | RASQNIKSNLA | GASTRAT | QQFYNWLCS |
| | | | SEQ ID NO:2974 | SEQ ID NO:10986 | SEQ ID NO:18998 |
| | 21-225_205F5 | NA | CGGGCGAGTCAGGGCATTGGCAATTATTAGCC | GGTGTCTCCAGTTTGCAAAGT | CAACAATATAGTAATTACCCTCTCACT |
| | | | SEQ ID NO:2975 | SEQ ID NO:10987 | SEQ ID NO:18999 |
| iPS:436302 | | AA | RASQGIGNYLA | GVSSLQS | QQYSNYPLT |
| | | | SEQ ID NO:2976 | SEQ ID NO:10988 | SEQ ID NO:19000 |
| | 21-225_205G7 | NA | AGGGCCAGTCAGAGTGTTTTCAGCAACTACTTAGCC | GGTGCATCCAGCAGGGCCGCT | CAGCAGTATGAAAGTTCACCGTGGACG |
| | | | SEQ ID NO:2977 | SEQ ID NO:10989 | SEQ ID NO:19001 |
| iPS:436304 | | AA | RASQSVFSNYLA | GASSRAA | QQYESSPWT |
| | | | SEQ ID NO:2978 | SEQ ID NO:10990 | SEQ ID NO:19002 |
| | 21-225_201E3 | NA | AGTCTAGTCAGAGCCTCCTGCATAATATAGATACAACCATTTGGAT | TTGGGTTCTAATCGGGCCTCC | ATGCAAGCTCTACAAACTCCCACT |
| | | | SEQ ID NO:2979 | SEQ ID NO:10991 | SEQ ID NO:19003 |
| iPS:436306 | | AA | RSSQSLLHNNRYNHLD | LGSNRAS | MQALQTPT |
| | | | SEQ ID NO:2980 | SEQ ID NO:10992 | SEQ ID NO:19004 |
| | | NA | AGGGCCAGTCAGAGTGTTAATAGCTACTTAGCC | GGTGCATCCACCAGGGCCACT | CAAGAGTATAATGACTGGCGTGCAGT |

FIGURE 49
(Continued)

| | | | | | | |
|---|---|---|---|---|---|---|
| iPS:436308 | 21-225_201H4 | AA | SEQ ID NO:2981<br>RASQSVNSYLA | SEQ ID NO:10993<br>GASTRAT | SEQ ID NO:19005<br>QEYNDWPCS | |
| iPS:436310 | 21-225_205H8 | NA | SEQ ID NO:2982<br>CGGGCAAGTCAGGGCATTAG<br>AAATGATTTAGGC | SEQ ID NO:10994<br>TCTGCATCCTTTTGCAA<br>AGA | SEQ ID NO:19006<br>CTACAGCATAATAGTTACCC<br>GCTCACT | |
| | | AA | SEQ ID NO:2983<br>RASQGIRNDLG | SEQ ID NO:10995<br>SASFLQR | SEQ ID NO:19007<br>LQHNSYPLT | |
| iPS:436312 | 21-225_202D11 | NA | SEQ ID NO:2984<br>AGGGCCAGTCAGAGTATTAA<br>CAGCAACTACTTAGCC | SEQ ID NO:10996<br>GGTGCATCCAGCAGGGC<br>CACT | SEQ ID NO:19008<br>CAGCAGTATGAAAACTCACC<br>GTGGACG | |
| | | AA | SEQ ID NO:2985<br>RASQSINSNYLA | SEQ ID NO:10997<br>GASSRAT | SEQ ID NO:19009<br>QQYENSPWT | |
| iPS:436314 | 21-225_206A4 | NA | SEQ ID NO:2986<br>CGGGCAAGTCACAACATTAA<br>CAGCTATTTAAAT | SEQ ID NO:10998<br>GCTGCATCCAGTTGCAA<br>AGT | SEQ ID NO:19010<br>CAACAGAGTTACAGTTTCCC<br>GCTCACT | |
| | | AA | SEQ ID NO:2987<br>RASHNINSYLN | SEQ ID NO:10999<br>AASSLQS | SEQ ID NO:19011<br>QQSYSFPLT | |
| iPS:436316 | 21-225_206G4 | NA | SEQ ID NO:2988<br>CGGGCCAGTCAGAGCATTGG<br>TCGTAGCTTACAC | SEQ ID NO:11000<br>TATGCTTCCCAGTCCTTC<br>TCA | SEQ ID NO:19012<br>CATCAGAGTAGAAGTTACC<br>GCTCACT | |
| | | AA | SEQ ID NO:2989<br>RASQSIGRSLH | SEQ ID NO:11001<br>YASQSFS | SEQ ID NO:19013<br>HQSRSLPLT | |
| iPS:436324 | 21-225_206A5 | NA | SEQ ID NO:2990<br>CGGGCAAGTCACAACATTAA<br>CAGCTATTTAAAT | SEQ ID NO:11002<br>GCTGCATCCAGTTGCAA<br>AGT | SEQ ID NO:19014<br>CAACAGAGTTACAGTTTCCC<br>GCTCACT | |
| | | AA | SEQ ID NO:2991<br>RASHNINSYLN | SEQ ID NO:11003<br>AASSLQS | SEQ ID NO:19015<br>QQSYSFPLT | |
| | | NA | SEQ ID NO:2992<br>CGGGCCAGTCAGGGCATTAG<br>AAATTATTTAGCC | SEQ ID NO:11004<br>GCTGCATCCAGTTGCAA<br>AGT | SEQ ID NO:19016<br>CAACAGTACACAGTAATTACCC<br>TCTCACT | |

FIGURE 49
(Continued)

| | | | | | |
|---|---|---|---|---|---|
| iPS:436328 | 21-225_207G6 | AA | SEQ ID NO:2993<br>RASQGIRNYLA<br>SEQ ID NO:2994 | SEQ ID NO:11005<br>AASSLQS<br>SEQ ID NO:11006 | SEQ ID NO:19017<br>QQYSNYPLT<br>SEQ ID NO:19018 |
| iPS:436332 | 21-225_207F12 | NA | CGGGCAAGTCAGGGCATTAG<br>AAATGATTTAGGC<br>SEQ ID NO:2995 | GCTGCATCCAGTTGCAA<br>AGT<br>SEQ ID NO:11007 | CTACAGCATAATAGTTACCC<br>TCTCACC<br>SEQ ID NO:19019 |
|  |  | AA | RASQGIRNDLG<br>SEQ ID NO:2996 | AASSLQS<br>SEQ ID NO:11008 | LQHNSYPLT<br>SEQ ID NO:19020 |
| iPS:436334 | 21-225_208B2 | NA | CGGGCAAGTCAGGGCATTAG<br>ACATGATTTAGGC<br>SEQ ID NO:2997 | GCTGCATCCAGTTGCAA<br>AGT<br>SEQ ID NO:11009 | CTACAGCATTATAGTTACCC<br>TCGGACG<br>SEQ ID NO:19021 |
|  |  | AA | RASQGIRHDLG<br>SEQ ID NO:2998 | AASSLQS<br>SEQ ID NO:11010 | LQHYSYPRT<br>SEQ ID NO:19022 |
| iPS:436336 | 21-225_208G3 | NA | AGGTCTAGTCAGAGCCTCCT<br>GCATAATAATAAATACAACC<br>ATTTGGAT<br>SEQ ID NO:2999 | TTGGGTTCTAATCGGGCC<br>TCC<br>SEQ ID NO:11011 | ATGCAAGCTCTACAAACTCC<br>CACT<br>SEQ ID NO:19023 |
|  |  | AA | RSSQSLLHNNKYNHLD<br>SEQ ID NO:3000 | LGSNRAS<br>SEQ ID NO:11012 | MQALQTPT<br>SEQ ID NO:19024 |
| iPS:436336 | 21-225_208B5 | NA | AGGGCCAGTCAGAGTGTTAG<br>CAGCAACTACTTAGCC<br>SEQ ID NO:3001 | GGTGCATCCAGCAGGGC<br>CACT<br>SEQ ID NO:11013 | CAGCACTACGAAAACTCACC<br>GTGGACG<br>SEQ ID NO:19025 |
|  |  | AA | RASQSVSSNYLA<br>SEQ ID NO:3002 | GASSRAT<br>SEQ ID NO:11014 | QHYENSPWT<br>SEQ ID NO:19026 |
| iPS:436338 | 21-225_208E8 | NA | CGGGCAAGTCACAACATTAA<br>CAGCTATTTAAAT<br>SEQ ID NO:3003 | GCTGCATCCAGTTGCAA<br>AGT<br>SEQ ID NO:11015 | CAACAGAGTTACAGTTTCCC<br>GCTCACT<br>SEQ ID NO:19027 |
|  |  | AA | RASHNINSYLN<br>SEQ ID NO:3004 | AASSLQS<br>SEQ ID NO:11016 | QQSYSFPLT<br>SEQ ID NO:19028 |

FIGURE 49
(Continued)

| | | | | | |
|---|---|---|---|---|---|
| iPS:436340 | 21-225_208A9 | NA | AGGGCCAGTCAGAGTGTTAG CAACAACTACTTAGCC SEQ ID NO:3005 | GGTGCATCCAGCAGGGC CACT SEQ ID NO:11017 | CAGCACTATCATAGCTCACC GTGGACG SEQ ID NO:19029 |
| | | AA | RASQSVSNNYLA SEQ ID NO:3006 | GASSRAT SEQ ID NO:11018 | QHYHSSPWT SEQ ID NO:19030 |
| iPS:436344 | 21-225_208B11 | NA | CGGGCAAGTCACAACATTAA CAGCTATTTAAAT SEQ ID NO:3007 | GCTGCATCCAGTTGCAA AGT SEQ ID NO:11019 | CAACAGAGTTACAGTTTCCC GCTCACT SEQ ID NO:19031 |
| | | AA | RASHNINSYLN SEQ ID NO:3008 | AASSLQS SEQ ID NO:11020 | QQSYSFPLT SEQ ID NO:19032 |
| iPS:436350 | 21-225_210E4 | NA | CGGGCAAGTCAGGGCATTAG AAATGATTTAGGC SEQ ID NO:3009 | GCTGCATCCAGTTTGCAA AGT SEQ ID NO:11021 | CTACACAGCATAATAGTTACC ATTCACT SEQ ID NO:19033 |
| | | AA | RASQGIRNDLG SEQ ID NO:3010 | AASSLQS SEQ ID NO:11022 | LQHNSYPFT SEQ ID NO:19034 |
| iPS:436352 | 21-225_210G5 | NA | CGGGCAAGTCAGGGCATTAG ACATGATTTAGGC SEQ ID NO:3011 | GCTGCATCCAGTTGCAA AGT SEQ ID NO:11023 | CTACACCATTATAGTTACCC TCGGACG SEQ ID NO:19035 |
| | | AA | RASQGIRHDLG SEQ ID NO:3012 | AASSLQS SEQ ID NO:11024 | LHHYSYPRT SEQ ID NO:19036 |
| iPS:436354 | 21-225_210G10 | NA | CGGACAAGTCAGGGCATTAG AAATGATTTAGGC SEQ ID NO:3013 | GCTGCATCCAGTTTGTTT AGT SEQ ID NO:11025 | CTACAGTATAATAGTTACCC TCCCACC SEQ ID NO:19037 |
| | | AA | RTSQGIRNDLG SEQ ID NO:3014 | AASSLFS SEQ ID NO:11026 | LQYNSYPPT SEQ ID NO:19038 |
| iPS:436356 | 21-225_210H10 | NA | AGGGCCAGTCAGAGTGTTAA AGCAACTTAGCC SEQ ID NO:3015 | GGTGCATCCACCAGGGC CACT SEQ ID NO:11027 | CAGCAGTATTATAACTGGCT GTGCAGT SEQ ID NO:19039 |
| | | AA | RASQSVKSNLA SEQ ID NO:3016 | GASTRAT SEQ ID NO:11028 | QQYYNWLCS SEQ ID NO:19040 |

FIGURE 49
(Continued)

| | | | | | |
|---|---|---|---|---|---|
| iPS:436358 | 21-225_210D11 | NA | CGGGCAAGTCACAACATTAA CAGTATTAAAT SEQ ID NO:3017 RASHNINSYLN | GCTGCATCCAGTTTGCAA AGT SEQ ID NO:11029 AASSLQS | CAACAGAGTTACAGTTTCCC GCTCACT SEQ ID NO:19041 QQSYSFPLT |
| | | AA | SEQ ID NO:3018 | SEQ ID NO:11030 | SEQ ID NO:19042 |
| iPS:436360 | 21-225_210H11 | NA | CGGGCGAGTCAGGGTATTAG CATCTGTTAGCC SEQ ID NO:3019 RASQGISIWLA | GCTGCATCCAGTTTGCAA AGT SEQ ID NO:11031 AASSLQS | CAACAGGCTAAAGTTTCCC ATTCACT SEQ ID NO:19043 QQAKSFPFT |
| | | AA | SEQ ID NO:3020 | SEQ ID NO:11032 | SEQ ID NO:19044 |
| iPS:436362 | 21-225_210C12 | NA | AGGTCTAGTCAGAGCCTCCT GCATTATAATGGACACAACT TTTTGGAT SEQ ID NO:3021 RSSQSLLHYNGHNFLD | TTGGTTTCTAATCGGGCC TCC SEQ ID NO:11033 LVSNRAS | ATGCAAGCTCTACAAACTCC CATGTGCAGT SEQ ID NO:19045 MQALQTPMCS |
| | | AA | SEQ ID NO:3022 | SEQ ID NO:11034 | SEQ ID NO:19046 |
| iPS:436364 | 21-225_211A11 | NA | CGGGCGAGTCAGGGCATTGG CAATTATTTAGCC SEQ ID NO:3023 RASQGIGNYLA | GATGCATCCAGTTTGGA AAGT SEQ ID NO:11035 DASSLES | CAACACTATATGACTTACCC GCTCACT SEQ ID NO:19047 QHYMTYPLT |
| | | AA | SEQ ID NO:3024 | SEQ ID NO:11036 | SEQ ID NO:19048 |
| iPS:436366 | 21-225_211A3 | NA | CGGGCGAGTCAGGCCATTGG GAAACATTAGCC SEQ ID NO:3025 RASQAIGKHLA | GCTGCATCCAGATTGCA AAGT SEQ ID NO:11037 AASRLQS | CAACAGTATAGTAATTATCC GCTCACT SEQ ID NO:19049 QQYSNYPLT |
| | | AA | SEQ ID NO:3026 | SEQ ID NO:11038 | SEQ ID NO:19050 |
| iPS:436368 | 21-225_211G3 | NA | AGGGCCAGTCAGAGTGTTAG CAGCAGCTTCTTAGCC SEQ ID NO:3027 RASQSVSSFLA | GGTGCATCCAGCAGGGC CACT SEQ ID NO:11039 GASSRAT | CAGCAGTATGTTAGCTCACC GCTCACT SEQ ID NO:19051 QQYVSSPLT |

FIGURE 49
(Continued)

| | | | | | | |
|---|---|---|---|---|---|---|
| iPS:436370 | 21-225_211A6 | NA | SEQ ID NO:3028 CGGGCGAGTCAGGGCATTAG CAAGTATTTAGCC | SEQ ID NO:11040 GCTGCATCCAGTTGCTA AGT | SEQ ID NO:19052 CAAAAGTATGATACTTACCC ATTCACT |
| | | AA | SEQ ID NO:3029 RASQGIGKYLA | SEQ ID NO:11041 AASSLS | SEQ ID NO:19053 QKYDTYPFT |
| iPS:436372 | 21-225_211A8 | NA | SEQ ID NO:3030 CGGGCGAGTCAGGGCATTAG CAGATATTTAGCC | SEQ ID NO:11042 GCTGCATCCAGTTGCAA AGT | SEQ ID NO:19054 CTACGGTATGATACTTACCC TCTCATT |
| | | AA | SEQ ID NO:3031 RASQGISRYLA | SEQ ID NO:11043 AASSLQS | SEQ ID NO:19055 LRYDTYPLI |
| iPS:436374 | 21-225_211C10 | NA | SEQ ID NO:3032 AGGTCTAGTCAGAGCCTCCT CCATAGTAATGGATACAACT ATTTGGAT | SEQ ID NO:11044 TTGGGTTCTAATCGGGCC TCC | SEQ ID NO:19056 ATGCAAGCTCTACTAACTCC CGTGTGCAGT |
| | | AA | SEQ ID NO:3033 RSSQSLLHSNGYNYLD | SEQ ID NO:11045 LGSNRAS | SEQ ID NO:19057 MQALLTPVCS |
| iPS:436376 | 21-225_212E6 | NA | SEQ ID NO:3034 CGGGCGAGTCAGGGCATTAG CAATCATTAGCC | SEQ ID NO:11046 GCTGCATCCAGTTGCAA AGT | SEQ ID NO:19058 CAACAGTATGTTACTTACCC TCTCACT |
| | | AA | SEQ ID NO:3035 RASQGISNHLA | SEQ ID NO:11047 AASSLQS | SEQ ID NO:19059 QQYVIYPLT |
| iPS:436378 | 21-225_212D7 | NA | SEQ ID NO:3036 CGGGCGAGTCAGGGCATTAG CAATCATTAGCC | SEQ ID NO:11048 GCTGCATCCAGTTGCAA AGT | SEQ ID NO:19060 CAGCAGTATAGTAATTACCC TCTCACT |
| | | AA | SEQ ID NO:3037 RASQGISNHLA | SEQ ID NO:11049 AASSLQS | SEQ ID NO:19061 QQYSNYPLT |
| iPS:436380 | 21-225_212H9 | NA | SEQ ID NO:3038 CGGGCGAGTCAGGGCATTAG CAGTTATTAGCC | SEQ ID NO:11050 GCTGCATCCAGTTGCAA AGT | SEQ ID NO:19062 CTACGGTATGATACTTACCC TCTCACT |
| | | | SEQ ID NO:3039 | SEQ ID NO:11051 | SEQ ID NO:19063 |

FIGURE 49
(Continued)

| | | | | AA | RASQGISSYLA | AASSLQS | LRYDTYPLT |
|---|---|---|---|---|---|---|---|
| iPS:436382 | | | | | SEQ ID NO:3040 | SEQ ID NO:11052 | SEQ ID NO:19064 |
| | 21-225_212C10 | | | NA | AGGGCCAGTCAGAGTGTTGC CAGCAGCTTAGCC | GGTACATCCACCAGGGC CACT | CAGCAGTATAATGACTGGCC GTGCAGT |
| iPS:436384 | | | | | SEQ ID NO:3041 | SEQ ID NO:11053 | SEQ ID NO:19065 |
| | | | | AA | RASQSVASSLA | GTSTRAT | QQYNDWPCS |
| iPS:436384 | | | | | SEQ ID NO:3042 | SEQ ID NO:11054 | SEQ ID NO:19066 |
| | 21-225_212F10 | | | NA | CGGGCGAGTCAGGGCATTAG CAATTATTAGAC | TCTGCATCCAATTTGCAA AGT | CAACACTATAGTAATTACC GCTCACT |
| iPS:436384 | | | | | SEQ ID NO:3043 | SEQ ID NO:11055 | SEQ ID NO:19067 |
| | | | | AA | RASQGISNYLD | SASNLQS | QHYSNYPLT |
| iPS:436386 | | | | | SEQ ID NO:3044 | SEQ ID NO:11056 | SEQ ID NO:19068 |
| | 21-225_212B11 | | | NA | CGGGCAAGTCAGGGCATTAG AAATGATTAGGC | GCTGCATCCAGTTTGCAA AGT | CTACTGCATTATAGTTACCCT CGGACG |
| iPS:436386 | | | | | SEQ ID NO:3045 | SEQ ID NO:11057 | SEQ ID NO:19069 |
| | | | | AA | RASQGIRNDLG | AASSLQS | LLHYSYPRT |
| iPS:436388 | | | | | SEQ ID NO:3046 | SEQ ID NO:11058 | SEQ ID NO:19070 |
| | 21-225_212H11 | | | NA | CGGGCGAGTCAGGGCCATTGG GAAACATTAGCC | GCTGCATCCAGATTGCA AAGT | CAACACTATAGTAATTATCC GCTCACT |
| iPS:436388 | | | | | SEQ ID NO:3047 | SEQ ID NO:11059 | SEQ ID NO:19071 |
| | | | | AA | RASQAIGKHLA | AASRLQS | QHYSNYPLT |
| iPS:436390 | | | | | SEQ ID NO:3048 | SEQ ID NO:11060 | SEQ ID NO:19072 |
| | 21-225_213D2 | | | NA | CGGGCGAGTCAGGGCATTAG CAATCATTAGCC | GCTGCATCCAGTTTGCAA AGT | CACCAGTATAGTAATTACC TCTCACT |
| iPS:436390 | | | | | SEQ ID NO:3049 | SEQ ID NO:11061 | SEQ ID NO:19073 |
| | | | | AA | RASQGISNHLA | AASSLQS | HQYSNYPLT |
| iPS:436392 | | | | | SEQ ID NO:3050 | SEQ ID NO:11062 | SEQ ID NO:19074 |
| | 21-225_213B3 | | | NA | CGGGCGAGTCAGGGCATTGG CAAGTATTTAGCC | GCTGCATCCAGTGTGCTA AGT | CAAAAGTATGATACTTACCC ATTCACT |
| iPS:436392 | | | | | SEQ ID NO:3051 | SEQ ID NO:11063 | SEQ ID NO:19075 |

FIGURE 49
(Continued)

| | | | | AA | RASQGIGKYLA | AASSVLS | QKYDTYPFT |
|---|---|---|---|---|---|---|---|
| | | | | | SEQ ID NO:3052 | SEQ ID NO:11064 | SEQ ID NO:19076 |
| iPS:436394 | 21-225_213C4 | | | NA | CGGGCGAGTCAGGCCATTAG GAATTATTTAGCC | GCTGCATCCAGTTTGCAA AGT | CAACAGTATAGTAATTACCC TCTCACT |
| | | | | | SEQ ID NO:3053 | SEQ ID NO:11065 | SEQ ID NO:19077 |
| | | | | AA | RASQAIRNYLA | AASSLQS | QQYSNYPLT |
| | | | | | SEQ ID NO:3054 | SEQ ID NO:11066 | SEQ ID NO:19078 |
| iPS:436396 | 21-225_213E5 | | | NA | CGGGCGAGTCAGGCCATTGG GAAACATTTAGCC | GCTGCATCCAGATTGCA AAGT | CAACACTATAGTAATTACCC GCTCACT |
| | | | | | SEQ ID NO:3055 | SEQ ID NO:11067 | SEQ ID NO:19079 |
| | | | | AA | RASQAIGKHLA | AASRLQS | QHYSNYPLT |
| | | | | | SEQ ID NO:3056 | SEQ ID NO:11068 | SEQ ID NO:19080 |
| iPS:436398 | 21-225_213B8 | | | NA | CGGGCGAGTCAGGCCATTAG CAATCATTTAGCC | GCTGCATCCAGTTTGCAA AGT | CAACAGTATAGTAATTACCC TCTCACT |
| | | | | | SEQ ID NO:3057 | SEQ ID NO:11069 | SEQ ID NO:19081 |
| | | | | AA | RASQGISNHLA | AASSLQS | QQYSNYPLT |
| | | | | | SEQ ID NO:3058 | SEQ ID NO:11070 | SEQ ID NO:19082 |
| iPS:436400 | 21-225_213H7 | | | NA | AAGTCCAGCCAGAATGTTTT AGACATCTCCAACAATAAGA ATTCCTTAGGT | TGGGCATCTACCCGGGA ATCC | CAGCAATATTATAACATTCC TCCGACG |
| | | | | | SEQ ID NO:3059 | SEQ ID NO:11071 | SEQ ID NO:19083 |
| | | | | AA | KSSQNVLDISNNKNSLG | WASTRES | QQYYNIPPT |
| | | | | | SEQ ID NO:3060 | SEQ ID NO:11072 | SEQ ID NO:19084 |
| iPS:436402 | 21-225_213H12 | | | NA | AAGTCCAGCCAGAATGTTTT AAAGACCTCCAACAATAGG AACTACTTAGCT | TGGGCATCTACCCGGGA ATCC | CACCAATATTATAGTATTCC GTGGACC |
| | | | | | SEQ ID NO:3061 | SEQ ID NO:11073 | SEQ ID NO:19085 |
| | | | | AA | KSSQNVLKTSNNRNYLA | WASTRES | HQYYSIPWT |
| | | | | | SEQ ID NO:3062 | SEQ ID NO:11074 | SEQ ID NO:19086 |

FIGURE 49
(Continued)

| | | | | | |
|---|---|---|---|---|---|
| iPS:436404 | 21-225_214C3 | NA | CGGGGGAGTCAGGGCATTGG CAATTATTAGCC SEQ ID NO:3063 | GCTGCATCCAGTTTGCAA AGT SEQ ID NO:11075 | CAACAATATATGACTTACCC AATCACT SEQ ID NO:19087 |
| | | AA | RASQGIGNYLA SEQ ID NO:3064 | AASSLQS SEQ ID NO:11076 | QQYMTYPIT SEQ ID NO:19088 |
| iPS:436406 | 21-225_214E4 | NA | CGGGCGAGTCAGGGCATTAG CAATTATTAGCC SEQ ID NO:3065 | GCTGCATCCAGTTTGCAA AGT SEQ ID NO:11077 | CAACAGTATCTTACTTACCC ATTCACT SEQ ID NO:19089 |
| | | AA | RASQGISNYLA SEQ ID NO:3066 | AASSLQS SEQ ID NO:11078 | QQYLYPFT SEQ ID NO:19090 |
| iPS:436408 | 21-225_214H8 | NA | CGGGCCAGTCAGAGCATTGG TGTTAGTTACAC SEQ ID NO:3067 | TATGCTTCCCAGTCCTTC TCA SEQ ID NO:11079 | CATCAGAGTCGTAGTTTACC ATTCACT SEQ ID NO:19091 |
| | | AA | RASQSIGVSLH SEQ ID NO:3068 | YASQSFS SEQ ID NO:11080 | HQSRSLPFT SEQ ID NO:19092 |
| iPS:436410 | 21-225_212E10 | NA | CGGGCGAGTCAGGGCATTAG CAATCATTAGCC SEQ ID NO:3069 | GCTGCATCCAGTTTGCAA AGT SEQ ID NO:11081 | CAACAGTATAGTAATTACCC TCTCACT SEQ ID NO:19093 |
| | | AA | RASQGISNHLA SEQ ID NO:3070 | AASSLQS SEQ ID NO:11082 | QQYSNYPLT SEQ ID NO:19094 |
| iPS:436412 | 21-225_214H9 | NA | CGGGCAAGTCAGGGCATTAG AAATGATTTAGGC SEQ ID NO:3071 | GCTGCATCCAGTTTGCAA AGT SEQ ID NO:11083 | CTACAGCATTATAGTTACCC TCGGACG SEQ ID NO:19095 |
| | | AA | RASQGIRNDLG SEQ ID NO:3072 | AASSLQS SEQ ID NO:11084 | LQHYSYPRT SEQ ID NO:19096 |
| iPS:436414 | 21-225_214G10 | NA | CGGGCAAGTCAGGGCATTAG AAATGATTTAGGC SEQ ID NO:3073 | GCTGCATCCAGTTTGCAA AGT SEQ ID NO:11085 | CTACTGCATAATAGTTACCC TCGGACG SEQ ID NO:19097 |
| | | AA | RASQGIRNDLG SEQ ID NO:3074 | AASSLQS SEQ ID NO:11086 | LLHNSYPRT SEQ ID NO:19098 |

FIGURE 49
(Continued)

| | | | | | |
|---|---|---|---|---|---|
| iPS:436416 | 21-225_214G12 | NA | CGGGCAAGTCAGGGCATTAG AAATGATTAGGC<br>SEQ ID NO:3075 | GCTGCATCCAGTTTGCAA AGT<br>SEQ ID NO:11087 | GTAATGCATTATAGTTACCC TCGGACG<br>SEQ ID NO:19099 |
| | | AA | RASQGIRNDLG<br>SEQ ID NO:3076 | AASSLQS<br>SEQ ID NO:11088 | VMHYSYPRT<br>SEQ ID NO:19100 |
| iPS:436418 | 21-225_215E3 | NA | CGGGCAAGTCAGGGCATTAG AAATGATTAGGC<br>SEQ ID NO:3077 | GCTGCATCCAGTTTGCAA AGT<br>SEQ ID NO:11089 | GTAATGCATAATAGTTACCC TCGGACG<br>SEQ ID NO:19101 |
| | | AA | RASQGIRNDLG<br>SEQ ID NO:3078 | AASSLQS<br>SEQ ID NO:11090 | VMHNSYPRT<br>SEQ ID NO:19102 |
| iPS:436420 | 21-225_215B5 | NA | CGGGCGAGTCAGGGCATTAG CAATCATTTAGCT<br>SEQ ID NO:3079 | GCTGCATCCAGTTTGCAA AGT<br>SEQ ID NO:11091 | CAGCAGTATATTAATTACCC TCTCACT<br>SEQ ID NO:19103 |
| | | AA | RASQGISNHLA<br>SEQ ID NO:3080 | AASSLQS<br>SEQ ID NO:11092 | QQYINYPLT<br>SEQ ID NO:19104 |
| iPS:436422 | 21-225_215D6 | NA | CGGGCGAGTCAGGGCATTAG CAATCATTTAGCC<br>SEQ ID NO:3081 | GCTGCATCCAGTTTGCAT AGT<br>SEQ ID NO:11093 | CAACAGTATGTTACTTACCC TCTCACT<br>SEQ ID NO:19105 |
| | | AA | RASQGISNHLA<br>SEQ ID NO:3082 | AASSLHS<br>SEQ ID NO:11094 | QQYVTYPLT<br>SEQ ID NO:19106 |
| iPS:436424 | 21-225_215H6 | NA | CGGGCCAGTCAGAGACATCGG TGTTAGTTACAC<br>SEQ ID NO:3083 | TATGCTTCCAGTCCCTC TCA<br>SEQ ID NO:11095 | CATCAGAGTCGCAGTTACC ATTCACT<br>SEQ ID NO:19107 |
| | | AA | RASQSIGVSLH<br>SEQ ID NO:3084 | YASQSLS<br>SEQ ID NO:11096 | HQSRSLPFT<br>SEQ ID NO:19108 |
| iPS:436426 | 21-225_215C7 | NA | AGGGCCAGTCAGAGGATTAC CACCAACTTCTTAGCT<br>SEQ ID NO:3085 | GGTGCATCCAGCAGGGC CACT<br>SEQ ID NO:11097 | CAGCAGTATGTTAGTTCATT GCTCACT<br>SEQ ID NO:19109 |
| | | AA | RASQRITNFLA<br>SEQ ID NO:3086 | GASSRAT<br>SEQ ID NO:11098 | QQYVSSLLT<br>SEQ ID NO:19110 |

FIGURE 49
(Continued)

| | | | | |
|---|---|---|---|---|
| iPS:436428 | | NA | CGGGCAAGTCAGGGCATTAG AAATGATTTAGGC SEQ ID NO:3087 | GCTGCATCCAGTTTGCAA AGT SEQ ID NO:11099 | GTAATGCATTATAGTTACCC TCGGACG SEQ ID NO:19111 |
| | 21-225_215E11 | AA | RASQGIRNDLG SEQ ID NO:3088 | AASSLQS SEQ ID NO:11100 | VMHYSYPRT SEQ ID NO:19112 |
| iPS:436430 | | NA | CGGAGAGTCAGGAGACATTGG CAATTATTTAGCC SEQ ID NO:3089 | GCTGCATCCAGTTTACAG AGT SEQ ID NO:11101 | CAACAGTATGTTACTTACCC GCTCACT SEQ ID NO:19113 |
| | 21-225_215A12 | AA | RTSQDIGNYLA SEQ ID NO:3090 | AASSLQS SEQ ID NO:11102 | QQYVTYPLT SEQ ID NO:19114 |
| iPS:436432 | | NA | AGGGCCAGTCAGAGAGTGTTAG CAGCAGTTCTTAGCT SEQ ID NO:3091 | GGTGCATCCAGCAGGGC CATT SEQ ID NO:11103 | CAGCAGTATGTTAGCTCACC GCTCACT SEQ ID NO:19115 |
| | 21-225_215H12 | AA | RASQSVSSSFLA SEQ ID NO:3092 | GASSRAI SEQ ID NO:11104 | QQYVSSPLT SEQ ID NO:19116 |
| iPS:436434 | | NA | AGGGCCAGTCAGAGAGTGTTAA CAACAACTTAGCC SEQ ID NO:3093 | GGTGCATCCACCAGGGC CACT SEQ ID NO:11105 | CAGCAGTATAATGACTGGCC GTGCAGT SEQ ID NO:19117 |
| | 21-225_216B10 | AA | RASQSVNNNLA SEQ ID NO:3094 | GASTRAT SEQ ID NO:11106 | QQYNDWPCS SEQ ID NO:19118 |
| iPS:436436 | | NA | AGGGCCAGTCAGAGAGTGTTAG CAGCAGTTCTTAGCC SEQ ID NO:3095 | GGTACACCACCACCAGGGC CACT SEQ ID NO:11107 | CAACAGTATGATAGGTCACC ATTCACT SEQ ID NO:19119 |
| | 21-225_216F10 | AA | RASQSVSSSFLA SEQ ID NO:3096 | GTSTRAT SEQ ID NO:11108 | QQYDRSPFT SEQ ID NO:19120 |
| iPS:436438 | | NA | CGGGCAAGTCAGGGCATTAG AAATGATTTAGGC SEQ ID NO:3097 | GCTGCATCCAGTTTGCAA AGT SEQ ID NO:11109 | CTAATGCATTATAGTTACCC TCGGACG SEQ ID NO:19121 |
| | 21-225_216E8 | AA | RASQGIRNDLG SEQ ID NO:3098 | AASSLQS SEQ ID NO:11110 | LMHYSYPRT SEQ ID NO:19122 |

FIGURE 49
(Continued)

| | | | | | |
|---|---|---|---|---|---|
| iPS:436440 | 21-225_216H12 | NA | CGGGCAAGTCAGGGCATTAG AAATGATTTAGGC SEQ ID NO:3099 | GGTGCATCCAGTTTGCA AAGT SEQ ID NO:11111 | GTAATGCATAATAGTTACCC TCGGACG SEQ ID NO:19123 |
| | | AA | RASQGIRNDLG SEQ ID NO:3100 | GASSLQS SEQ ID NO:11112 | VMHNSYPRT SEQ ID NO:19124 |
| iPS:436448 | 21-225_217A3 | NA | CGGGCCAGTCAGAGCATTGG TAGTAGTTACAC SEQ ID NO:3101 | TATGCTTCCAGTCCTTC TCA SEQ ID NO:11113 | CATCAGAGTAGAAGTTTACC GTGGACG SEQ ID NO:19125 |
| | | AA | RASQSIGSSLH SEQ ID NO:3102 | YASQSFS SEQ ID NO:11114 | HQSRSLPWT SEQ ID NO:19126 |
| iPS:436450 | 21-225_217E5 | NA | CGGGCAAGTCAGGGCATTAG AAATGATTTAGGC SEQ ID NO:3103 | GCTGCATCCAGTTTGCAA AGT SEQ ID NO:11115 | GTAATGCATAATAGTTACCC TCGGACG SEQ ID NO:19127 |
| | | AA | RASQGIRNDLG SEQ ID NO:3104 | AASSLQS SEQ ID NO:11116 | VMHNSYPRT SEQ ID NO:19128 |
| iPS:436452 | 21-225_217G5 | NA | CGGGCGAGTCAGAGCATTGG CAATTATTTAGCC SEQ ID NO:3105 | GCTGCATCCAGTTGCAA AGT SEQ ID NO:11117 | CAACAGTATGTTAATTACCC TCTCACT SEQ ID NO:19129 |
| | | AA | RASQGIGNYLA SEQ ID NO:3106 | AASSLQS SEQ ID NO:11118 | QQYVNYPLT SEQ ID NO:19130 |
| iPS:436454 | 21-225_217B10 | NA | CGGGCAAGTCAGGGCATTGG GAAACATTTAGCC SEQ ID NO:3107 | GCTGCATCCAGATTGCA AAGT SEQ ID NO:11119 | CAACACACCAGTAAATCTCC AGTGCAG SEQ ID NO:19131 |
| | | AA | RASQAIGKHLA SEQ ID NO:3108 | AASRLQS SEQ ID NO:11120 | QHTSKSPVQ SEQ ID NO:19132 |
| iPS:436456 | 21-225_217G10 | NA | CGGGCAAGTCAGGGCATTAG AAATGATTTAGGC SEQ ID NO:3109 | GCTGCATCCAGTTGCAA AGT SEQ ID NO:11121 | GTAATGCATAATAGTTACCC TCGGACG SEQ ID NO:19133 |
| | | AA | RASQGIRNDLG SEQ ID NO:3110 | AASSLQS SEQ ID NO:11122 | VMHNSYPRT SEQ ID NO:19134 |

FIGURE 49
(Continued)

| | | | | | |
|---|---|---|---|---|---|
| iPS:436458 | 21-225_217H12 | NA | CGGGCAAGTCAGGGCATTAG AAATGATTAGGC<br>SEQ ID NO:3111 | GCTGCATCCAGTTTGCAA AGT<br>SEQ ID NO:11123 | CTAATGCATTATAGTTACC TCGGACG<br>SEQ ID NO:19135 |
| | | AA | RASQGIRNDLG<br>SEQ ID NO:3112 | AASSLQS<br>SEQ ID NO:11124 | LMHYSYPRT<br>SEQ ID NO:19136 |
| iPS:436462 | 21-225_218C4 | NA | CGGGCAAGTCAGGGCATTAG AAATGATTAGGC<br>SEQ ID NO:3113 | GCTGCATCCAGTTTGCAA AGT<br>SEQ ID NO:11125 | GTAATGCATTATAGTTACC TCGGACG<br>SEQ ID NO:19137 |
| | | AA | RASQGIRNDLG<br>SEQ ID NO:3114 | AASSLQS<br>SEQ ID NO:11126 | VMHYSYPRT<br>SEQ ID NO:19138 |
| iPS:436464 | 21-225_219H1 | NA | CGGGCGAGTCAGGGCATTAG CAATTATTAGAC<br>SEQ ID NO:3115 | TCTGCATCCAATTTGCAA AGT<br>SEQ ID NO:11127 | CAACACTATAGTAATTACC GCTCACT<br>SEQ ID NO:19139 |
| | | AA | RASQGISNYLD<br>SEQ ID NO:3116 | SASNLQS<br>SEQ ID NO:11128 | QHYSNYPLT<br>SEQ ID NO:19140 |
| iPS:436472 | 21-225_220E1 | NA | AGGGCCAGTCAGAGTATTAG CCGCAGCCACTTAGTC<br>SEQ ID NO:3117 | GTTACATCCAGCAGGGC CACT<br>SEQ ID NO:11129 | CAGCAGTATGGTAGCTCACC GTGGACG<br>SEQ ID NO:19141 |
| | | AA | RASQSISRSHLV<br>SEQ ID NO:3118 | VTSSRAT<br>SEQ ID NO:11130 | QQYGSSPWT<br>SEQ ID NO:19142 |
| iPS:436480 | 21-225_220F8 | NA | CGGGCAAGTCAGGGCATTAG AAATGATTAGGC<br>SEQ ID NO:3119 | GGTGCATCCAGTTGCA AAGT<br>SEQ ID NO:11131 | GTAATGCATAATAGTTACC TCGGACG<br>SEQ ID NO:19143 |
| | | AA | RASQGIRNDLG<br>SEQ ID NO:3120 | GASSLQS<br>SEQ ID NO:11132 | VMHNSYPRT<br>SEQ ID NO:19144 |
| iPS:436488 | 21-225_221A6 | NA | CGGGCGGAGTCAGGGTATTAG CAGCTGGTTAGCC<br>SEQ ID NO:3121 | ACTGCATCCAATTTGCAA AGT<br>SEQ ID NO:11133 | CAACAGGCTAACAGTTCC ATTCACT<br>SEQ ID NO:19145 |
| | | AA | RASQGISSWLA<br>SEQ ID NO:3122 | TASNLQS<br>SEQ ID NO:11134 | QQANSFPFT<br>SEQ ID NO:19146 |

FIGURE 49
(Continued)

| | | | | | |
|---|---|---|---|---|---|
| iPS:436490 | 21-225_221F6 | NA | CGGGCGAGTCAGGGCATTAG CAATTATTAGCC SEQ ID NO:3123 | GCTGCATCCAATTTACAA AGT SEQ ID NO:11135 | CAACAGTATATGACTTACCC GCTCACT SEQ ID NO:19147 |
| | | AA | RASQGISNYLA SEQ ID NO:3124 | AASNLQS SEQ ID NO:11136 | QQYMYPLT SEQ ID NO:19148 |
| iPS:436494 | 21-225_221F12 | NA | CGGGCGAGTCAGGGTATTAG CAGCTGGTTAGCC SEQ ID NO:3125 | ACTGCATCCAATTGCAA AGT SEQ ID NO:11137 | CAACAGGCTAACAGTTTCCC ATTCACT SEQ ID NO:19149 |
| | | AA | RASQGISSWLA SEQ ID NO:3126 | TASNLQS SEQ ID NO:11138 | QQANSFPFT SEQ ID NO:19150 |
| iPS:436496 | 21-225_222E1 | NA | CGGGCGAGTCAGGGTATTAG CAGCTGGTTAGCC SEQ ID NO:3127 | ACTGCATCCAATTGCAA AGT SEQ ID NO:11139 | CAACAGGCTAACAGTTTCCC ATTCACT SEQ ID NO:19151 |
| | | AA | RASQGISSWLA SEQ ID NO:3128 | TASNLQS SEQ ID NO:11140 | QQANSFPFT SEQ ID NO:19152 |
| iPS:436500 | 21-225_222H3 | NA | AAGTCAGTCCAGAGTGTTTT GAAAAGTTCCAACCATAGGA ACTACTTAGCT SEQ ID NO:3129 | TGGGCATCTACCGGGA AACC SEQ ID NO:11141 | CAGCAATATTCTTCTATTCCG TGGACG SEQ ID NO:19153 |
| | | AA | KSSQSVLKSSNHRNYLA SEQ ID NO:3130 | WASTRET SEQ ID NO:11142 | QQYSSIPWT SEQ ID NO:19154 |
| iPS:436502 | 21-225_222A11 | NA | CGGGCGAGTCAGGGCATTAG CAATTATTGGCC SEQ ID NO:3131 | GCTGCATCCAGTTTGCAA AGT SEQ ID NO:11143 | CTATATTATCTTAATTATCCG CTCACT SEQ ID NO:19155 |
| | | AA | RASQGISNYLA SEQ ID NO:3132 | AASSLQS SEQ ID NO:11144 | LYYLNYPLT SEQ ID NO:19156 |
| iPS:436504 | 21-225_222H4 | NA | CGGGCAAGTCAGAACATTAG TAATTATGTTAAT SEQ ID NO:3133 | ACTGCATCGAGTTTGCA AAGT SEQ ID NO:11145 | CAGCAGTATTACTTTACCCC ATTCACT SEQ ID NO:19157 |
| | | AA | RASQNISNYVN | TASSLQS | QQYYFPFT |

FIGURE 49
(Continued)

| | | | | | |
|---|---|---|---|---|---|
| iPS:436506 | 21-225_222C7 | NA | SEQ ID NO:3134 AGGGCCAGTCAGAGTGTTA GCAACTACTTAGCC | SEQ ID NO:11146 GGTGCATCAAGCAGGGC CACT | SEQ ID NO:19158 CAGCAGTATGAAGACTCACC GTGGACG |
| | | AA | SEQ ID NO:3135 RASQSVYSNYLA | SEQ ID NO:11147 GASSRAT | SEQ ID NO:19159 QQYEDSPWT |
| iPS:436508 | 21-225_222F7 | NA | SEQ ID NO:3136 CGGGCGAGTCAGGGTATTAG CAGCTGGTTAGCC | SEQ ID NO:11148 ACTGCATCCAATTGCAA AGT | SEQ ID NO:19160 CAACAGGCTAACAGTTTCCC ATTCACT |
| | | AA | SEQ ID NO:3137 RASQGISSWLA | SEQ ID NO:11149 TASNLQS | SEQ ID NO:19161 QQANSFPFT |
| iPS:436510 | 21-225_222H8 | NA | SEQ ID NO:3138 CGGGCAAGTCAGAACATTAG TAATTATGTTAAT | SEQ ID NO:11150 ATTGCATCGAGTTGCAA AGT | SEQ ID NO:19162 CAGCAGTATTACTTACCCC ATTCACT |
| | | AA | SEQ ID NO:3139 RASQNISNYVN | SEQ ID NO:11151 IASSLQS | SEQ ID NO:19163 QQYYFPFT |
| iPS:436514 | 21-225_222D10 | NA | SEQ ID NO:3140 CGGGCGAGTCAGGGCATTAG CAATTATTTGGCC | SEQ ID NO:11152 GCTGCATCCAGTTGCAA AGT | SEQ ID NO:19164 CTACACATTATCTTAATTACCCG CTCACT |
| | | AA | SEQ ID NO:3141 RASQGISNYLA | SEQ ID NO:11153 AASSLQS | SEQ ID NO:19165 LHYLNYPLT |
| iPS:436516 | 21-225_222C12 | NA | SEQ ID NO:3142 CGGGTGAGTCAGGGTATTAG CAGCTGGTTAGCC | SEQ ID NO:11154 ACTGCATCCAATTGCAA AGT | SEQ ID NO:19166 CAACAGGATAACAGTTTCCC ATTCACT |
| | | AA | SEQ ID NO:3143 RVSQGISSWLA | SEQ ID NO:11155 TASNLQS | SEQ ID NO:19167 QQDNSFPFT |
| iPS:436520 | 21-225_223G10 | NA | SEQ ID NO:3144 AAGTCCAGCCAGAGTATTTT ACTCAGTCCAACAATAAGA ACTACTTAGCT | SEQ ID NO:11156 TGGGCATCTACCCGGGA ATCC | SEQ ID NO:19168 CTGCAATATTTTAGTACTCC GTGGACG |
| | | | SEQ ID NO:3145 | SEQ ID NO:11157 | SEQ ID NO:19169 |

FIGURE 49
(Continued)

| | | | | | |
|---|---|---|---|---|---|
| | | AA | KSSQSILLSSNNKNYLA | WASTRES | LQYFSTPWT |
| iPS:436522 | 21-225_223H10 | NA | CGGGCAAGTCAGGGCATTAG TAATTATTTGGCC SEQ ID NO:3146 | GCTGCATCCAATTGCAA AGT SEQ ID NO:11158 | CTACATTATCTTAATTACCCA CTCACT SEQ ID NO:19170 |
| | | AA | RASQGISNYLA SEQ ID NO:3147 | AASNLQS SEQ ID NO:11159 | LHYLNYPLT SEQ ID NO:19171 |
| iPS:436526 | 21-225_224A1 | NA | CGGGCAAGTCAGGGCATTGA AAATGATTAGGC SEQ ID NO:3148 | GCTGCATCCAGTTGCAA AGT SEQ ID NO:11160 | CTACAGCATAATAGTTACCC GCTCACT SEQ ID NO:19172 |
| | | AA | RASQGIENDLG SEQ ID NO:3149 | AASSLQS SEQ ID NO:11161 | LQHNSYPLT SEQ ID NO:19173 |
| iPS:436528 | 21-225_224B1 | NA | CGGGCAAGTCAGGGCATTAG TAATGATTAGGC SEQ ID NO:3150 | GCTGCATCCAGTTGCAA AGT SEQ ID NO:11162 | CTACAGCATAATAGTTACCC GCTCACT SEQ ID NO:19174 |
| | | AA | RASQGISNDLG SEQ ID NO:3151 | AASSLQS SEQ ID NO:11163 | LQHNSYPPT SEQ ID NO:19175 |
| iPS:436534 | 21-225_224F1 | NA | CGGGCAAGTCAGGGCATTAG AGATGATTAGGC SEQ ID NO:3152 | GCTGCATCCAGTTGCAA AGT SEQ ID NO:11164 | CTACAGCATTATAGTTACCC TCCTACT SEQ ID NO:19176 |
| | | AA | RASQGIRDDLG SEQ ID NO:3153 | AASSLQS SEQ ID NO:11165 | LQHYSYPRT SEQ ID NO:19177 |
| iPS:436536 | 21-225_224G1 | NA | AAGTCTGGTCAGAGCCTCCT GCATAGTGATGGAAAGACCT TTTTGTCT SEQ ID NO:3154 | GAAATTCCAACCGGTTC TCT SEQ ID NO:11166 | ATGCAAAGTACACAGTTACC TCGGACG SEQ ID NO:19178 |
| | | AA | KSGQSLLHSDGKTFLS SEQ ID NO:3155 | EISNRFS SEQ ID NO:11167 | MQSTQLPRT SEQ ID NO:19179 |
| iPS:436538 | | NA | CGGGCAAGTCAGGACATTAG AAATGATTAGGC SEQ ID NO:3156 | GCTACATCCAGTTGCAA AGT SEQ ID NO:11168 | CTACAGCATAATAGTTACCC GCTCACT SEQ ID NO:19180 |

FIGURE 49
(Continued)

| | | | | | | |
|---|---|---|---|---|---|---|
| iPS:436540 | 21-225_224C3 | | SEQ ID NO:3157<br>RASQDIRNDLG | SEQ ID NO:11169<br>ATSSLQS | SEQ ID NO:19181<br>LQHNSYPLT |
| | | AA | SEQ ID NO:3158 | SEQ ID NO:11170 | SEQ ID NO:19182 |
| iPS:436544 | 21-225_224F3 | NA | CGGGCAAGTCAGGGCATTAG<br>AAATGATTTAGGC | GCTGCATCCAGTTTGCAA<br>AGT | CTTCAGCATTATAATTACCCT<br>CGGGCG |
| | | | SEQ ID NO:3159 | SEQ ID NO:11171 | SEQ ID NO:19183 |
| | | AA | RASQGIRNDLG | AASSLQS | LQHYNYPRA |
| iPS:436544 | 21-225_224H5 | | SEQ ID NO:3160 | SEQ ID NO:11172 | SEQ ID NO:19184 |
| | | NA | AAGTCCAGCCAGAGTGTTT<br>ATACAGCTCCAACAATTTCA<br>ACTACTTAACT | TGGGCATCTACCCGGGA<br>ATCC | CAGCAATATTATAGTACTCC<br>TCCGACG |
| | | | SEQ ID NO:3161 | SEQ ID NO:11173 | SEQ ID NO:19185 |
| | | AA | KSSQSVLYSSNNFNYLT | WASTRES | QQYYSTPPT |
| iPS:436546 | 21-225_224D6 | | SEQ ID NO:3162 | SEQ ID NO:11174 | SEQ ID NO:19186 |
| | | NA | CGGGCGAGTCAGGGTATTAG<br>CAGCTGGTTAGCC | GCTGCATCCAGTTTGCAA<br>AGT | CAACAGGCTAACAGTTTCCC<br>GTGGACG |
| | | | SEQ ID NO:3163 | SEQ ID NO:11175 | SEQ ID NO:19187 |
| | | AA | RASQGISSWLA | AASSLQS | QQANSFPWT |
| iPS:436548 | 21-225_224A7 | | SEQ ID NO:3164 | SEQ ID NO:11176 | SEQ ID NO:19188 |
| | | NA | AAGTCTAGTCAGAGCCTCCT<br>GCATAGTGATGAAAGACCT<br>TTTTGTAT | GAAATTTCCAACCGGTTC<br>TCT | ATGCAAAGTACACAGTTCC<br>TCGGACG |
| | | | SEQ ID NO:3165 | SEQ ID NO:11177 | SEQ ID NO:19189 |
| | | AA | KSSQSLLHSDGKTFLY | EISNRFS | MQSTQLPRT |
| iPS:436550 | 21-225_224D8 | | SEQ ID NO:3166 | SEQ ID NO:11178 | SEQ ID NO:19190 |
| | | NA | AAGTCCAGCCAGAGTGTTT<br>ATACAGTCCAACAATAAGA<br>ACTACTTAGCT | TGGTCGTCTACCCGGAA<br>ATCC | CAGCAATATTTAGTACTCC<br>TCCGACG |
| | | | SEQ ID NO:3167 | SEQ ID NO:11179 | SEQ ID NO:19191 |
| | | AA | KSSQSVLYSSNNKNYLA | WSSTRKS | QQYFSTPPT |

FIGURE 49
(Continued)

| iPS: | | | | | |
|---|---|---|---|---|---|
| iPS:436554 | 21-225_224C10 | NA | SEQ ID NO:3168 AAGTCCAGCCAGAGTGTTT ATACAATTCCAACAATAAGA ACTACTTAGCT | SEQ ID NO:11180 TGGGCATCTACCCGGGA GTCC | SEQ ID NO:19192 CAACAATATATATTAATCC GTGCAGT |
| | | AA | SEQ ID NO:3169 KSSQSVLYNSNKNYLA | SEQ ID NO:11181 WASTRES | SEQ ID NO:19193 QQYYINPCS |
| iPS:436556 | 21-225_224D10 | NA | SEQ ID NO:3170 CGGGCAAGTCAGGGCATTAG AAATGATTAGGC | SEQ ID NO:11182 GCTGCATCCAGTTTACAA AGT | SEQ ID NO:19194 CTACAACATAATAGTTACC GCTCACT |
| | | AA | SEQ ID NO:3171 RASQGIRNDLG | SEQ ID NO:11183 AASSLQS | SEQ ID NO:19195 LQHNSYPLT |
| iPS:436558 | 21-225_224C11 | NA | SEQ ID NO:3172 AAGTCTAGTCAGAGCCTCCT GCATAGTGATGGAAAGACCT TTTTGTAT | SEQ ID NO:11184 GAAATTTCCAACCGGTTC TCT | SEQ ID NO:19196 ATGCAAAGTACACAGCTTCC TCGGACG |
| | | AA | SEQ ID NO:3173 KSSQSLLHSDGKTFLY | SEQ ID NO:11185 EISNRFS | SEQ ID NO:19197 MQSTQLPRT |
| iPS:436560 | 21-225_224F11 | NA | SEQ ID NO:3174 AAGTCCAGCCAGAGTGTTT ATCCAGCTCCAACAATCACA ACTACTTAGCT | SEQ ID NO:11186 TGGGCATCTACCCGGGA ATCC | SEQ ID NO:19198 CAGCAATATATTACTACTCC GTGCAGT |
| | | AA | SEQ ID NO:3175 KSSQSVLSSSNNHNYLA | SEQ ID NO:11187 WASTRES | SEQ ID NO:19199 QQYYTTPCS |
| iPS:436562 | 21-225_224H11 | NA | SEQ ID NO:3176 AAGTCTAGTCAGAGCCTCCT GCATAGTGATGGAAAGACCT TTTTGTAT | SEQ ID NO:11188 GAAATTTCCAACCGGTTC TCT | SEQ ID NO:19200 ATGCAAAGTACACAGCTTCC TCGGACG |
| | | AA | SEQ ID NO:3177 KSSQSLLHSDGKTFLY | SEQ ID NO:11189 EISNRFS | SEQ ID NO:19201 MQSTQLPRT |
| | | | SEQ ID NO:3178 | SEQ ID NO:11190 | SEQ ID NO:19202 |

FIGURE 49
(Continued)

| | | | | | |
|---|---|---|---|---|---|
| iPS:436564 | | NA | CGGGCAAGTCAGGGCATTAG AGATGATTAGGC | GCTGCATCCAGTTGCAA AGT | CTGCAGCATTATAGTTACCC TCGGACG |
| | 21-225_225A1 | | SEQ ID NO:3179 | SEQ ID NO:11191 | SEQ ID NO:19203 |
| | | AA | RASQGIRDDLG | AASSLQS | LQHYSYPRT |
| | | | SEQ ID NO:3180 | SEQ ID NO:11192 | SEQ ID NO:19204 |
| iPS:436568 | | NA | AGGGCCAGTCAGAATCTTAG CAGCAGCTACTTAGGC | GATACATCCAGCAGCAGGGC CACT | CAGGAGTATGGTAGCTCACT CATGTGCAGT |
| | 21-225_225B3 | | SEQ ID NO:3181 | SEQ ID NO:11193 | SEQ ID NO:19205 |
| | | AA | RASQNLSSSYLG | DTSSRAT | QEYGSSLMCS |
| | | | SEQ ID NO:3182 | SEQ ID NO:11194 | SEQ ID NO:19206 |
| iPS:436570 | | NA | AAGTCCAGCCAGAGTGTTTT ATATAGCTCCAACAATAAGA ACTACTTAGCT | TGGGCATCTACCCGGGA ATCC | CACCAATATCATAATTCTCC TCCCACT |
| | 21-225_225F4 | | SEQ ID NO:3183 | SEQ ID NO:11195 | SEQ ID NO:19207 |
| | | AA | KSSQSVLYSSNNKNYLA | WASTRES | HQYHNSPPT |
| | | | SEQ ID NO:3184 | SEQ ID NO:11196 | SEQ ID NO:19208 |
| iPS:436572 | | NA | AAGTCTAGTCAGAGCCTCCT GCATAGTAGTGATGGAAAGACCT TTTTGTAT | GAAAATTTCCAACCGGTTC TCT | ATGCAAAGTACACAGCTTCC TCGGACG |
| | 21-225_225G4 | | SEQ ID NO:3185 | SEQ ID NO:11197 | SEQ ID NO:19209 |
| | | AA | KSSQSLLHSDGKTFLY | EISNRFS | MQSIQLPRT |
| | | | SEQ ID NO:3186 | SEQ ID NO:11198 | SEQ ID NO:19210 |
| iPS:436574 | | NA | AAGTCCAGCCAGAATGTTTT ATACAACTCCAACAATAACA ACTACTTAGCT | TGGGCATCTACCCGGGA ATCC | CAGCAATATTATAGTTCTCC TCCGACG |
| | 21-225_225F5 | | SEQ ID NO:3187 | SEQ ID NO:11199 | SEQ ID NO:19211 |
| | | AA | KSSQNVLYNSNNNNYLA | WASTRES | QQYYSSPPT |
| | | | SEQ ID NO:3188 | SEQ ID NO:11200 | SEQ ID NO:19212 |
| iPS:436576 | | NA | CGGGCAAGTCAGGGCATTGA GAAAAGATTTAGGC | GCTGCAACCAGTTTGCA AAGT | CTACAGCATAATAGTTATCC ATTCACT |

FIGURE 49
(Continued)

| | | | | | | | |
|---|---|---|---|---|---|---|---|
| iPS:436578 | 21-225_225B6 | AA | SEQ ID NO:3189<br>RASQGMRKDLG<br>SEQ ID NO:3190 | SEQ ID NO:11201<br>AATSLQS<br>SEQ ID NO:11202 | CGGGCAAGTCAGGGCATTAG<br>AAATGATTAGGC | SEQ ID NO:19213<br>LQHNSYPFT<br>SEQ ID NO:19214 | GCTGCATCCAGTTACAA<br>AGT | CTTCAGCATAATACTTACC<br>ATTCACT |
| iPS:436580 | 21-225_225D6 | NA | SEQ ID NO:3191<br>RASQGIRNDLG<br>SEQ ID NO:3192 | SEQ ID NO:11203<br>AASSLQS<br>SEQ ID NO:11204 | AGGGCCAGTCAGGTCAGAGTGTTTA<br>CAGCAGTCTACTTAGCC | SEQ ID NO:19215<br>LQHNTYPFT<br>SEQ ID NO:19216 | GGTGCATCCAGCAGGGC<br>CACT | CAGCAGTATGGTACCTCACC<br>TCGGACG |
| iPS:436582 | 21-225_225E7 | AA | SEQ ID NO:3193<br>RASQSVYSSYLA<br>SEQ ID NO:3194 | SEQ ID NO:11205<br>GASSRAT<br>SEQ ID NO:11206 | CGGGCAAGTCAGGGCATTAG<br>AAATGATTAGGC | SEQ ID NO:19217<br>QQYGTSPRT<br>SEQ ID NO:19218 | GCTGCATCCAGTTGCTA<br>GGT | CTACAACATATAGTTACC<br>ATTCACT |
| iPS:436584 | 21-225_225F8 | AA | SEQ ID NO:3195<br>RASQGIRNDLG<br>SEQ ID NO:3196 | SEQ ID NO:11207<br>AASSLLG<br>SEQ ID NO:11208 | | SEQ ID NO:19219<br>LQHNSYPFT<br>SEQ ID NO:19220 | | |
| iPS:436584 | 21-225_225B9 | NA | SEQ ID NO:3197<br>KSSQSVLYSSNNNYLA<br>SEQ ID NO:3198 | SEQ ID NO:11209<br>WASTRES<br>SEQ ID NO:11210 | AAGTCCAGCCAGAGTGTTTT<br>ATACAGCTCCAACAATAACA<br>ACTACTTAGCT | SEQ ID NO:19221<br>QHSKSIPGK<br>SEQ ID NO:19222 | TGGGCATCTACCCGGGA<br>ATCC | CAACACTCCAAGAGTATTCC<br>TGGTAAG |
| iPS:436586 | 21-225_225F11 | AA | SEQ ID NO:3199<br>KSSQSVLYSSNNNYLA<br>SEQ ID NO:3200 | SEQ ID NO:11211<br>WASTRES<br>SEQ ID NO:11212 | AAGTCCAGCCAGAGTGTTTT<br>ATACAGCTCCAACAATTACA<br>ACTACTTAGCT | SEQ ID NO:19223<br>QQYTTPPT<br>SEQ ID NO:19224 | TGGGCTTCTACCCGGGA<br>ATCC | CAGCAATATTATACTCC<br>TCCGACG |

FIGURE 49 (Continued)

| | | | | | |
|---|---|---|---|---|---|
| iPS:436588 | 21-225_225F12 | NA | AAGTCCAGCCAGAGTGTTTATACAGCTCCAACAATCAGAACTACTTAGCT<br>SEQ ID NO:3201 | TGGACATCTACCCGGGAATCC<br>SEQ ID NO:11213 | CAGCAATATATATTACTCCGTGCAGT<br>SEQ ID NO:19225 |
| | | AA | KSSQSVLYSSNNQNYLA<br>SEQ ID NO:3202 | WTSTRES<br>SEQ ID NO:11214 | QQYYITPCS<br>SEQ ID NO:19226 |
| iPS:436590 | 21-225_225H12 | NA | AAGTCCAGCCAGAGTGTTTATACAACTCCAACAATAACAACTACTTAGCT<br>SEQ ID NO:3203 | TGGGCATCTACCCGGGAATCC<br>SEQ ID NO:11215 | CAGCAATATATATTACTCCGTGCAGT<br>SEQ ID NO:19227 |
| | | AA | KSSQSVLYNSNNNNYLA<br>SEQ ID NO:3204 | WASTRES<br>SEQ ID NO:11216 | QQYYITPCS<br>SEQ ID NO:19228 |
| iPS:436592 | 21-225_226B1 | NA | AAGTCTAGTCAGAGCCTCCTGCATGGTGATGGAAAGACCTTATTTGTAT<br>SEQ ID NO:3205 | GAAGTTTCCATCCGGTTCTCT<br>SEQ ID NO:11217 | ATGCAAAGTATACAGATTCCGTGGACG<br>SEQ ID NO:19229 |
| | | AA | KSSQSLLHGDGKTYLY<br>SEQ ID NO:3206 | EVSIRFS<br>SEQ ID NO:11218 | MQSIQIPWT<br>SEQ ID NO:19230 |
| iPS:436594 | 21-225_226A5 | NA | AAGTCTAGTCAGAGCCTCCTACATGGTGATGGAAAGACCTTATTTGTAT<br>SEQ ID NO:3207 | GAAGTTTCCAACCGGTTCTCT<br>SEQ ID NO:11219 | ATGCAAAGTATACAGATTCCGTGGACG<br>SEQ ID NO:19231 |
| | | AA | KSSQSLLHGDGKTYLY<br>SEQ ID NO:3208 | EVSNRFS<br>SEQ ID NO:11220 | MQSIQIPWT<br>SEQ ID NO:19232 |
| iPS:436596 | 21-225_226C6 | NA | CGGGCAAGTCAGGGCATTAGAAATGATTTAGGC<br>SEQ ID NO:3209 | GCTGCATCCAGTTGCAAAGT<br>SEQ ID NO:11221 | CTACAGCATTATAATTACCCTCGGGCG<br>SEQ ID NO:19233 |
| | | AA | RASQGIRNDLG<br>SEQ ID NO:3210 | AASSLQS<br>SEQ ID NO:11222 | LQHYNYPRA<br>SEQ ID NO:19234 |

FIGURE 49
(Continued)

| | | | | | |
|---|---|---|---|---|---|
| iPS:436598 | 21-225_226D6 | NA | AAGTCCAGCCAGAGTATTT ATACATCTCCAACAATAAGA ACTACTTAGCT SEQ ID NO:3211 | TGGGCATCTACCCGGGA ATCC SEQ ID NO:11223 | CAGCAATATTATAGTTCTCC GTGCAGT SEQ ID NO:19235 |
| | | AA | RSSQSILYISNNKNYLA SEQ ID NO:3212 | WASTRES SEQ ID NO:11224 | QQYYSSPCS SEQ ID NO:19236 |
| iPS:436600 | 21-225_226F6 | NA | AAGTCCAGCCAGAGTATTT ATACAGCTCCAACAATTACA ACTACTTAGCT SEQ ID NO:3213 | TGGGCTTCTACCCGGGA ATCC SEQ ID NO:11225 | CAGCAATATTATACTACTCC TCCGACG SEQ ID NO:19237 |
| | | AA | KSSQSILYSSNNYNYLA SEQ ID NO:3214 | WASTRES SEQ ID NO:11226 | QQYYTPPT SEQ ID NO:19238 |
| iPS:436602 | 21-225_226E7 | NA | AAGTCTAGTCAGAGCCTCCT GCATGGTGATGGAAAGACCT ATTTGTAT SEQ ID NO:3215 | GAAGTTTCCAACCGGTTC TCT SEQ ID NO:11227 | ATGCAAAGTATACAGGTTCC GTGGACG SEQ ID NO:19239 |
| | | AA | KSSQSLLHGDGKTYLY SEQ ID NO:3216 | EVSNRFS SEQ ID NO:11228 | MQSIQVPWT SEQ ID NO:19240 |
| iPS:436604 | 21-225_226F7 | NA | CGGGCAAGTCAGGGCATTGG GAATGATTTAGGC SEQ ID NO:3217 | GCTGCCTCCAGTTTGCAA AGT SEQ ID NO:11229 | CTACATCATTATAGTTACCCT CGGACG SEQ ID NO:19241 |
| | | AA | RASQGIGNDLG SEQ ID NO:3218 | AASSLQS SEQ ID NO:11230 | LHHYSYPRT SEQ ID NO:19242 |
| iPS:436606 | 21-225_226G8 | NA | AAGTCTAGTCAGAGCCTCCT GCATAGTGATGGAAAGACCT TTTTGTAT SEQ ID NO:3219 | GAAATTTCCAACCGGTTC TCT SEQ ID NO:11231 | ATGCAAAGTACACAGCTTCC TCCGACG SEQ ID NO:19243 |
| | | AA | KSSQSLLHSDGKTFLY SEQ ID NO:3220 | EISNRFS SEQ ID NO:11232 | MQSTQLPRT SEQ ID NO:19244 |

FIGURE 49
(Continued)

| | | | | | |
|---|---|---|---|---|---|
| iPS:436608 | 21-225_226A9 | NA | CGGGCAAGTCAGGGCATTAG AAATGATTTAGGC SEQ ID NO:3221 | GCTGCATCCAGTTTGCAA AGT SEQ ID NO:11233 | CTACAGCATAATAGTTACCC ATTCACT SEQ ID NO:19245 |
| | | AA | RASQGIRNDLG SEQ ID NO:3222 | AASSLQS SEQ ID NO:11234 | LQHNSYPFT SEQ ID NO:19246 |
| iPS:436610 | 21-225_226F9 | NA | AAGTCTAGTCAGAGCCTCCT GCATAGTGATGGAAAGACCT TCT TTTTGTAT SEQ ID NO:3223 | GAAATTTCCAACCGGTTC TCT SEQ ID NO:11235 | ATGCAAAGTACACAGCTTCC TCGGACG SEQ ID NO:19247 |
| | | AA | KSSQSLLHSDGKTFLY SEQ ID NO:3224 | EISNRFS SEQ ID NO:11236 | MQSTQLPRT SEQ ID NO:19248 |
| iPS:436612 | 21-225_226H9 | NA | AAGTCTAGTCAGAGCCTCCT GCATAGTGATGGAAAGACCT TCT TTTTGTAT SEQ ID NO:3225 | GAAGTTTCCAACCGGTTC TCT SEQ ID NO:11237 | ATGCAAAGTACACAGCTTCC TCGGACG SEQ ID NO:19249 |
| | | AA | KSSQSLLHSDGKTFLY SEQ ID NO:3226 | EVSNRFS SEQ ID NO:11238 | MQSTQLPRT SEQ ID NO:19250 |
| iPS:436614 | 21-225_226F10 | NA | AAGTCTAGTCAGAGCCTCCT GCATAGTGATGGAAAGACCT TCT TTTTGTAT SEQ ID NO:3227 | GAAATTTCCAACCGGTTC TCT SEQ ID NO:11239 | ATGCAAAGTACACAGCTTCC TCGGACG SEQ ID NO:19251 |
| | | AA | KSSQSLLHSDGKTFLY SEQ ID NO:3228 | EISNRFS SEQ ID NO:11240 | MQSTQLPRT SEQ ID NO:19252 |
| iPS:436616 | 21-225_226D11 | NA | AAGTCCAGCCAGAATGTTTT ACACAGCTCCAACAGTAATA ACTACTTAGTT SEQ ID NO:3229 | TGGGCATCTACCCGGGA ATCC SEQ ID NO:11241 | CAGCAATATTATAAAACTCC GTGGACG SEQ ID NO:19253 |
| | | AA | KSSQNVLHSSNSNNYLV SEQ ID NO:3230 | WASTRES SEQ ID NO:11242 | QQYYKTPWT SEQ ID NO:19254 |

FIGURE 49
(Continued)

| | | | | | |
|---|---|---|---|---|---|
| iPS:436618 | 21-225_226E11 | NA | AAGTCTAGTCAGAGCCTCCTGCATAGTGATGGAAAGACCTTTTTGTAT SEQ ID NO:3231 | GAAATTTCCAACCGGTTCTCT SEQ ID NO:11243 | ATGCAAAGTACACAGCTTCCTCGGACG SEQ ID NO:19255 |
| | | AA | KSSQSLLHSDGKTFLY SEQ ID NO:3232 | EISNRFS SEQ ID NO:11244 | MQSTQLPRT SEQ ID NO:19256 |
| iPS:436620 | 21-225_226H11 | NA | CGGACAAGTCAGGGCATTAGAAATGATTTAGGC SEQ ID NO:3233 | GCTGCATCCAGTTTGCAAAGT SEQ ID NO:11245 | CTACAGCATTATAGTTACCTCGGACG SEQ ID NO:19257 |
| | | AA | RTSQGIRNDLG SEQ ID NO:3234 | AASSLQS SEQ ID NO:11246 | LQHYSYPRT SEQ ID NO:19258 |
| iPS:436622 | 21-225_226A12 | NA | AAGTCCAGCCAGAATGTTTTATACAGTTCCAACAATAACAACTACTAGCT SEQ ID NO:3235 | TGGGCATCTACCCGGAAATCC SEQ ID NO:11247 | CAGCAATAATTATAGTAGTCCTCGGACG SEQ ID NO:19259 |
| | | AA | KSSQNVLYSSNNNNYLA SEQ ID NO:3236 | WASTRKS SEQ ID NO:11248 | QQYYSSPPT SEQ ID NO:19260 |
| iPS:436624 | 21-225_226H12 | NA | AAGTCTAGTAAGACCCTCCTGCATAGTGATGGAAAGACCTTTTTGTAT SEQ ID NO:3237 | GAAATTTCCAACCGGTTCTCT SEQ ID NO:11249 | ATGCAAAGTACACAGCTTCCTCGGACG SEQ ID NO:19261 |
| | | AA | KSSKTLLHSDGKTFLY SEQ ID NO:3238 | EISNRFS SEQ ID NO:11250 | MQSTQLPRT SEQ ID NO:19262 |
| iPS:436626 | 21-225_227C1 | NA | AAGTCTAGTCAGAGCCTCCTGCATAGTGATGGAAAGACCTTTTTGTAT SEQ ID NO:3239 | GAAATTTCCAACCGGTTCTCT SEQ ID NO:11251 | ATGCAAAGTACACAGCTTCCTCGGACG SEQ ID NO:19263 |
| | | AA | KSSQSLLHSDGKTFLY SEQ ID NO:3240 | EISNRFS SEQ ID NO:11252 | MQSTQLPRT SEQ ID NO:19264 |

FIGURE 49
(Continued)

| | | | | | |
|---|---|---|---|---|---|
| iPS:436628 | 21-225_227F2 | NA | AAGTCTAGTCAGAGCCTCCT GCATAGTGATGAAAGACCT TTTTGTAT SEQ ID NO:3241 | GAAATTTCCAACCGGTTC TCT SEQ ID NO:11253 | ATGCAAAGTACACAGCTTCC TCGGACG SEQ ID NO:19265 |
| | | AA | KSSQSLLHSDGKTFLY SEQ ID NO:3242 | EISNRFS SEQ ID NO:11254 | MQSTQLPRT SEQ ID NO:19266 |
| iPS:436630 | 21-225_227G3 | NA | CGGGCAAGTCAGGGCATTAG AAATGATTTAGGC SEQ ID NO:3243 | GCTGCATCCAGTTTGCAA AGT SEQ ID NO:11255 | CTACACCATAATAGTTACC ATTCACT SEQ ID NO:19267 |
| | | AA | RASQGIRNDLG SEQ ID NO:3244 | AASSLQS SEQ ID NO:11256 | LHHNSYPFT SEQ ID NO:19268 |
| iPS:436632 | 21-225_227E4 | NA | CGGGCGAGTCAGGGTATTAT CAACTGGTTAGCC SEQ ID NO:3245 | GCTGCATCCAGTTTGCAA AGT SEQ ID NO:11257 | CAACAGGCTAACAGTTCCC GTGGACG SEQ ID NO:19269 |
| | | AA | RASQGIINWLA SEQ ID NO:3246 | AASSLQS SEQ ID NO:11258 | QQANSFPWT SEQ ID NO:19270 |
| iPS:436634 | 21-225_227H5 | NA | CGGGCAAGTCAGGACATTAG AAATGATTTAGGC SEQ ID NO:3247 | GCTGCATCCAGTTTGCAA AGT SEQ ID NO:11259 | CTACAGCATAATAGTTACC ATTCACT SEQ ID NO:19271 |
| | | AA | RASQDIRNDLG SEQ ID NO:3248 | AASSLQS SEQ ID NO:11260 | LQHNSYPFT SEQ ID NO:19272 |
| iPS:436636 | 21-225_227E6 | NA | AAGTCCAGCCAGAGTGTTTT ATACAGCTCCAACGATAAGA ACTACTTAGCT SEQ ID NO:3249 | TGGGCATCTACCCGGGA ATCC SEQ ID NO:11261 | CAGCAATATTATATTACTCC GTGCAGT SEQ ID NO:19273 |
| | | AA | KSSQSVLYSSNDKNYLA SEQ ID NO:3250 | WASTRES SEQ ID NO:11262 | QQYYITPCS SEQ ID NO:19274 |
| iPS:436638 | 21_225_227C7 | NA | AGGTCCAGCCAGATTGTTTT ATCCGACTCCAACAATAACA ACTACTTAGCT | TGGGCATCTACCCGGGA ATCC | CAGCAATATTATAGTTCTCC TCCGACG |

FIGURE 49
(Continued)

| iPS | 21-225_ | AA/NA | Seq 1 | Seq 2 | Seq 3 |
|---|---|---|---|---|---|
| iPS:436640 | 21-225_227C7 | AA | SEQ ID NO:3251 RSSQIVLSDSNNNNYLA | SEQ ID NO:11263 WASTRES | SEQ ID NO:19275 QQYYSSPPT |
|  |  | NA | SEQ ID NO:3252 AAGTCTAGTCAGAGCCTCCTGCATAGTGATGGAAAGACCTTCTTTTGTAT | SEQ ID NO:11264 GAAATTCCAACCGGTCTCT | SEQ ID NO:19276 ATGCAAAGTACACAGCTTCCTCGGACG |
| iPS:436644 | 21-225_227A8 | AA | SEQ ID NO:3253 KSSQSLLHSDGKTFLY | SEQ ID NO:11265 EISNRFS | SEQ ID NO:19277 MQSTQLPRT |
|  |  | NA | SEQ ID NO:3254 | SEQ ID NO:11266 | SEQ ID NO:19278 |
| iPS:436646 | 21-225_227G9 | AA | SEQ ID NO:3255 KSSQSVLHSSNNNNYLA | SEQ ID NO:11267 WGSTRES | SEQ ID NO:19279 QQYYSAPYS |
|  |  | NA | SEQ ID NO:3256 AAGTCCAGCCAGAGTGTTTTACACAGTTCCAACAATAATAACTACTTAGCT | SEQ ID NO:11268 TGGGCATCTACCCGGGAATCC | SEQ ID NO:19280 CAGCAATATTATAATACTCCGTGCAGT |
| iPS:436648 | 21-225_227D11 | AA | SEQ ID NO:3257 KSSQSVLHSSNNNNYLA | SEQ ID NO:11269 WASTRES | SEQ ID NO:19281 QQYYNTPCS |
|  |  | NA | SEQ ID NO:3258 TGGTCTAGTCAGAGCCTCCTGCATAGTAATGGATACAACTATTGGAT | SEQ ID NO:11270 TTGGGTTCTAATCGGGCCTCC | SEQ ID NO:19282 ATGCAAGCTCTACAAACTCCTCTCACC |
| iPS:436650 | 21-225_227F11 | AA | SEQ ID NO:3259 WSSQSLLHSNGYNYLD | SEQ ID NO:11271 LGSNRAS | SEQ ID NO:19283 MQALQTPLT |
|  | 21-225_227C12 | NA | SEQ ID NO:3260 CGGGCAAGTCAGGGCATTAGAAATGATTAGGC | SEQ ID NO:11272 GCTGCATCCAGTTGCAAAGT | SEQ ID NO:19284 CTACAGCAATAATAGTTACCATTCACT |
|  |  |  | SEQ ID NO:3261 |  | SEQ ID NO:19285 |

FIGURE 49
(Continued)

| | | | | | | | |
|---|---|---|---|---|---|---|---|
| iPS:436652 | 21-225_146B11 | AA | RASQGIRNDLG | | AASSLQS | | LQHNSYPFT |
| | | | SEQ ID NO:3262 | | SEQ ID NO:11274 | | SEQ ID NO:19286 |
| | | NA | TCTGGAGATAAATTGGGGGA TAAATATGCTTCC | | CAAGATAGCAAGCGGCC CTCA | | CAGGCGTGGGACAGCAGCAC TGTGGTA |
| | | | SEQ ID NO:3263 | | SEQ ID NO:11275 | | SEQ ID NO:19287 |
| iPS:436654 | 21-225_146C11 | AA | SGDKLGDKYAS | | QDSKRPS | | QAWDSSTVV |
| | | | SEQ ID NO:3264 | | SEQ ID NO:11276 | | SEQ ID NO:19288 |
| | | NA | TCTGGAGATAAATTGGGGGA TAAATATGCTTCC | | CAAGATAGCAAGCGGCC CTCA | | CAGGCGTGGGACAGCAGCAC TGTGGTA |
| | | | SEQ ID NO:3265 | | SEQ ID NO:11277 | | SEQ ID NO:19289 |
| iPS:436658 | 21-225_146A2 | AA | SGDKLGDKYAS | | QDSKRPS | | QAWDSSTVV |
| | | | SEQ ID NO:3266 | | SEQ ID NO:11278 | | SEQ ID NO:19290 |
| | | NA | TCTGGAGATAAATTGGGGGA TAAATATGCTTCC | | CAAGATAGCAAGCGGCC CTCA | | CAGGCGTGGGACAGCAGCAC TGTGGTA |
| | | | SEQ ID NO:3267 | | SEQ ID NO:11279 | | SEQ ID NO:19291 |
| iPS:436660 | 21-225_146D8 | AA | SGDKLGDKYAS | | QDSKRPS | | QAWDSSTVV |
| | | | SEQ ID NO:3268 | | SEQ ID NO:11280 | | SEQ ID NO:19292 |
| | | NA | TCTGGAAGCAGCTCCTACAT CGGAAGTAATACTGTAGAC | | AGTAATAATCAGCGGCC CTCA | | GCAGCATGGGATGACAGCCT TAATGGCGTGGTA |
| | | | SEQ ID NO:3269 | | SEQ ID NO:11281 | | SEQ ID NO:19293 |
| iPS:436662 | 21-225_147D7 | AA | SGSSSYIGSNTVD | | SNNQRPS | | AAWDDSLNGVV |
| | | | SEQ ID NO:3270 | | SEQ ID NO:11282 | | SEQ ID NO:19294 |
| | | NA | TCTGGAGATAAATTGGGGGA TAAATTGCTTGC | | CAAGATAGGAAGCGGCC CTCA | | CAGGCGTGGGACACAGGAACAC CGCTGTC |
| | | | SEQ ID NO:3271 | | SEQ ID NO:11283 | | SEQ ID NO:19295 |
| iPS:436664 | | AA | SGDKLGDKFAC | | QDRKRPS | | QAWDRNTAV |
| | | | SEQ ID NO:3272 | | SEQ ID NO:11284 | | SEQ ID NO:19296 |
| | | NA | TCTGGAGATAAATTGGGGGA TAAATATGCTTCC | | CAAGATAGCAAGCGCCC CTCA | | CAGGCGTGGGACAGCAGCAC TGTGGTA |

FIGURE 49
(Continued)

| | | | | | | | |
|---|---|---|---|---|---|---|---|
| iPS:436666 | 21-225_147E7 | AA | SEQ ID NO:3273 SGDKLGDKYAS | SEQ ID NO:11285 QDSKRPS | SEQ ID NO:19297 QAWDSSTVV | | |
| | | NA | SEQ ID NO:3274 TCTGGAGATAAATTGGGGATAAATATGTTTGC | SEQ ID NO:11286 CAAGATAGGAAGCGGCCCTCA | SEQ ID NO:19298 CAGGCGTGGGCAGTAACACTGCTGTGGTA | | |
| iPS:436668 | 21-225_147B8 | AA | SEQ ID NO:3275 SGDKLGDKYVC | SEQ ID NO:11287 QDRKRPS | SEQ ID NO:19299 QAWGSNTAVV | | |
| | | NA | SEQ ID NO:3276 TCTGGAGATAAATTGGGGATAAATATGTTTCC | SEQ ID NO:11288 CAAGATAGGAAGCGGCCCTCA | SEQ ID NO:19300 CTGGCGTGGGACAGCAGCACTTTTGTGGTA | | |
| iPS:436670 | 21-225_147B9 | AA | SEQ ID NO:3277 SGDKLGDKYVS | SEQ ID NO:11289 QDSKRPS | SEQ ID NO:19301 LAWDSSTFVV | | |
| | | NA | SEQ ID NO:3278 TCTGGAGATAAATTGGGTAATAAATATGTTGC | SEQ ID NO:11290 CAAGATAGCAAGCGGCCCTCA | SEQ ID NO:19302 CAGGCGTGGGACAGGAACACTTATGTGGTG | | |
| iPS:436672 | 21-225_147D9 | AA | SEQ ID NO:3279 SGDKLGNKYVC | SEQ ID NO:11291 QDSKRPS | SEQ ID NO:19303 QAWDRNTYVV | | |
| | | NA | SEQ ID NO:3280 TCTGGAGATAAATTGGGGATAAATATGTTTGC | SEQ ID NO:11292 CAAGATAGCAAGCGGCCCTCA | SEQ ID NO:19304 CAGGCGTGGGACAGCAGCACTGTGGTA | | |
| iPS:436674 | 21-225_147F9 | AA | SEQ ID NO:3281 SGDELGNKYAC | SEQ ID NO:11293 QDSKRPS | SEQ ID NO:19305 QAWHSSTVV | | |
| | | NA | SEQ ID NO:3282 TCTGGAGATGAATTGGGGATAAATATGCTTGC | SEQ ID NO:11294 CAAGATAGCAAGCGGCCCTCA | SEQ ID NO:19306 CAGGCGTGGCACAGCAGCACTGTGGTA | | |
| iPS:436676 | 21-225_147G9 | AA | SEQ ID NO:3283 SGDKLGDKYAC | SEQ ID NO:11295 QDRKRPS | SEQ ID NO:19307 QAWHSSTVV | | |
| | | NA | SEQ ID NO:3284 TCTGGAGATAAATTGGGGATAAATATGCTTCC | SEQ ID NO:11296 CAAGATAGCAAGCGGCCCTCA | SEQ ID NO:19308 CAGGCGTGGGACAGCAGCACTGTGGTA | | |

FIGURE 49
(Continued)

| | | | | | | |
|---|---|---|---|---|---|---|
| iPS:436678 | 21-225_147E11 | AA | SEQ ID NO:3285<br>SGDKLGDKYAS | | SEQ ID NO:11297<br>QDSKRPS | SEQ ID NO:19309<br>QAWDSSTVV |
| iPS:436680 | 21-225_147B12 | NA | SEQ ID NO:3286<br>TCTGGAGATAAATTGGGGGA<br>TAAATATGCTTCC | SEQ ID NO:11298<br>CAAGATAGCAAGCGGCC<br>CTCA | SEQ ID NO:19310<br>CAGGCGTGGACAGCAGCAC<br>TGTGGTA |
| | | AA | SEQ ID NO:3287<br>SGDKLGDKYAS | | SEQ ID NO:11299<br>QDSKRPS | SEQ ID NO:19311<br>QAWDSSTVV |
| iPS:436682 | 21-225_147H12 | NA | SEQ ID NO:3288<br>TCTGGAAGCAGCTCCAACAT<br>CGGAAGTTATGCTGTAAAC | SEQ ID NO:11300<br>AGTAATAATCACCGGC<br>CTCA | SEQ ID NO:19312<br>GAAGCATGGATGACAGCCT<br>GAATGGTCCGGTA |
| | | AA | SEQ ID NO:3289<br>SGSSSNIGSYAVN | | SEQ ID NO:11301<br>SNNHRPS | SEQ ID NO:19313<br>EAWDDSLNGPV |
| iPS:436684 | 21-225_146A8 | NA | SEQ ID NO:3290<br>TCTGGAAGCAGCTCCAACAT<br>CGGAAGTAATTCTATAAAC | SEQ ID NO:11302<br>AGTAATGATCAGCGGCC<br>CTCA | SEQ ID NO:19314<br>GCAGCATGGATGACAGCCT<br>GAACGGCGTGGTA |
| | | AA | SEQ ID NO:3291<br>SGSSSNIGSNSIN | | SEQ ID NO:11303<br>SNDQRPS | SEQ ID NO:19315<br>AAWDDSLNGVV |
| iPS:436686 | 21-225_146B6 | NA | SEQ ID NO:3292<br>TCTGGAAGCAGCTCCAACAT<br>CGGAAGTAATGCTGTAAAC | SEQ ID NO:11304<br>AGTAATAATCAGCGGCC<br>CTCA | SEQ ID NO:19316<br>GCAGCATGGATGACAGCCT<br>GAATGGCGTGGTA |
| | | AA | SEQ ID NO:3293<br>SGSSSNIGSNAVN | | SEQ ID NO:11305<br>SNNQRPS | SEQ ID NO:19317<br>AAWDDSLNGVV |
| iPS:436688 | 21-225_148G6 | NA | SEQ ID NO:3294<br>TCTGGAGATAAATTGGGGGA<br>TAAATATGCTTCC | SEQ ID NO:11306<br>CAAGATAGCAAGCGGCC<br>CTCA | SEQ ID NO:19318<br>CAGGCGTGGACAGCAGCAC<br>TGTGGTA |
| | | AA | SEQ ID NO:3295<br>SGDKLGDKYAS | | SEQ ID NO:11307<br>QDSKRPS | SEQ ID NO:19319<br>QAWDSSTVV |

FIGURE 49
(Continued)

| | | | | | | |
|---|---|---|---|---|---|---|
| iPS:436688 | 21-225_148C8 | NA | SEQ ID NO:3296 | TCTGGAGATAAATTGGGGGA TAAATATGTTTCC | SEQ ID NO:11308 | CAAGATAGGAAGCGGCC CTCA | SEQ ID NO:19320 | CTGGCGTGGGACAGCAGCAC TTTTGTGGTA |
| | | AA | SEQ ID NO:3297 | SGDKLGDKYVS | SEQ ID NO:11309 | QDRKRPS | SEQ ID NO:19321 | LAWDSSTFV |
| iPS:436690 | 21-225_148A9 | NA | SEQ ID NO:3298 | TCTGGAGATAAATTGGGGGA TAAATATGTTTGC | SEQ ID NO:11310 | CAAGATAGCAAGCGGCC CTCA | SEQ ID NO:19322 | CAGGCGTGGCACAGCAGCAC TGTGGTA |
| | | AA | SEQ ID NO:3299 | SGDKLGNKYVC | SEQ ID NO:11311 | QDSKRPS | SEQ ID NO:19323 | QAWHSSTV |
| iPS:436694 | 21-225_148G11 | NA | SEQ ID NO:3300 | TCTGGAGATAAATTGGGGGA TAAATTGCTTCC | SEQ ID NO:11312 | CAAGATAGCAAGCGGCC CTCA | SEQ ID NO:19324 | CAGGCGTGGGACAGCAGCAC TGTGGTA |
| | | AA | SEQ ID NO:3301 | SGDKLGDKFAS | SEQ ID NO:11313 | QDSKRPS | SEQ ID NO:19325 | QAWDSSTV |
| iPS:436696 | 21-225_149A1 | NA | SEQ ID NO:3302 | TCTGGAAGCAGCTCCAACAT CGGAAGTAATGCTGTAAAC | SEQ ID NO:11314 | AGTAATAATCAGCGGCC CTCA | SEQ ID NO:19326 | GCAGCATGGGATGACAGCCT GAATGGCGTGGTA |
| | | AA | SEQ ID NO:3303 | SGSSSNIGSNAVN | SEQ ID NO:11315 | SNNQRPS | SEQ ID NO:19327 | AAWDDSLNGVV |
| iPS:436698 | 21-225_149B5 | NA | SEQ ID NO:3304 | TCTGGATATAAATTGGGGTA TAAATATGTTTGC | SEQ ID NO:11316 | CAAAATAACCAGCGGCC CTCA | SEQ ID NO:19328 | CAGGCGTGGGACAGCAGCAC TGTGGTA |
| | | AA | SEQ ID NO:3305 | SGYKLGYKYVC | SEQ ID NO:11317 | QNNQRPS | SEQ ID NO:19329 | QAWDSSTV |
| iPS:436700 | 21-225_149C7 | NA | SEQ ID NO:3306 | TCTGGAAATAAATTGGGGGA TAAATATGCTTCC | SEQ ID NO:11318 | CAAGATAGCAAGCGGCC CTCA | SEQ ID NO:19330 | CAGGCGTGGGACAGCAGCAC TGTGGTA |
| | | | SEQ ID NO:3307 | | SEQ ID NO:11319 | | SEQ ID NO:19331 | |

FIGURE 49
(Continued)

| | | | | | | | |
|---|---|---|---|---|---|---|---|
| iPS:436702 | 21-225_149E8 | AA | SGNKLGDKYAS | | QDSKRPS | | QAWDSSTVV |
| | | | SEQ ID NO:3308 | | SEQ ID NO:11320 | | SEQ ID NO:19332 |
| | | NA | ACCTTACGCAGTGGCATCAC TGTTACTACCTATAGGATAT AC | | TACACATCAGACTCAGA TAAACACCAGGGCTCT | | ATGATTTGGCACAGCAGCGC TTGGGTG |
| | | | SEQ ID NO:3309 | | SEQ ID NO:11321 | | SEQ ID NO:19333 |
| iPS:436704 | 21-225_149C10 | AA | TLRSGITVTTYRIY | | YTSDSDKHQGS | | MIWHSSAWV |
| | | | SEQ ID NO:3310 | | SEQ ID NO:11322 | | SEQ ID NO:19334 |
| | | NA | TCTGGAGATAAATTGGGGA TAAATATGCTTCC | | CAAGATAACAAGCGGCC CTCA | | CAGGCGTGGGACAGCAGCAC TGTGGTA |
| | | | SEQ ID NO:3311 | | SEQ ID NO:11323 | | SEQ ID NO:19335 |
| iPS:436706 | 21-225_149A11 | AA | SGDKLGDKYAS | | QDNKRPS | | QAWDSSTVV |
| | | | SEQ ID NO:3312 | | SEQ ID NO:11324 | | SEQ ID NO:19336 |
| | | NA | TCTGGAGATAAATTGGGGAA TAAATATGTTTCC | | CAAGATAGCAGGCGGCC CTCA | | CTGGCGTGGGACAGCAGCAC TTTTGTGGTC |
| | | | SEQ ID NO:3313 | | SEQ ID NO:11325 | | SEQ ID NO:19337 |
| iPS:436708 | 21-225_150D3 | AA | SGDKLGNKYVS | | QDSRRPS | | LAWDSSTFVV |
| | | | SEQ ID NO:3314 | | SEQ ID NO:11326 | | SEQ ID NO:19338 |
| | | NA | TCTGGAGATGAATTGGGGAA TAAATATGCTTGC | | CAAGATAACAAGCGGCC CTCA | | CAGGCGTGGCACAGCAGCAC TGTGGTA |
| | | | SEQ ID NO:3315 | | SEQ ID NO:11327 | | SEQ ID NO:19339 |
| iPS:436710 | 21-225_150F6 | AA | SGDELGNKYAC | | QDNKRPS | | QAWHSSTVV |
| | | | SEQ ID NO:3316 | | SEQ ID NO:11328 | | SEQ ID NO:19340 |
| | | NA | TCTGGAGATAAATTGGGGGA TAAATATGCTTCC | | CAAGATAGCAAGCGGCC CTCA | | CAGGCGTGGGACAGCAGCAC TGTGGTA |
| | | | SEQ ID NO:3317 | | SEQ ID NO:11329 | | SEQ ID NO:19341 |
| | | AA | SGDKLGDKYAS | | QDSKRPS | | QAWDSSTVV |
| | | | SEQ ID NO:3318 | | SEQ ID NO:11330 | | SEQ ID NO:19342 |

FIGURE 49
(Continued)

| | | | | | |
|---|---|---|---|---|---|
| iPS:436712 | 21-225_150F9 | NA | TCTGGAAGCAGCTCCAACAT CGGAAGTAATGCTGTAAAC SEQ ID NO:3319 | AGTAATAGTCAGCGGCC CTCA SEQ ID NO:11331 | GCAGCATGGGATGACAGCCT GAATGGCGTGGTA SEQ ID NO:19343 |
| | | AA | SGSSSNIGSNAVN SEQ ID NO:3320 | SNSQRPS SEQ ID NO:11332 | AAWDDSLNGVV SEQ ID NO:19344 |
| iPS:436714 | 21-225_150H11 | NA | TCTGGAGATAAATTGGGGGA TAAATATGCTTCC SEQ ID NO:3321 | CAAGATAGCAAGCGGCC CTCA SEQ ID NO:11333 | CAGGCGTGGGACAGCAGCAC TGTGGTA SEQ ID NO:19345 |
| | | AA | SGDKLGDKYAS SEQ ID NO:3322 | QDSKRPS SEQ ID NO:11334 | QAWDSSTVV SEQ ID NO:19346 |
| iPS:436716 | 21-225_151F3 | NA | TCTGGAGATAAATTGGGGGA TAAATATGTTTGC SEQ ID NO:3323 | CAAGATCGCAAGCGGCC CTCA SEQ ID NO:11335 | CAGGCGTGGCACAGCAGCAC TGTGGTA SEQ ID NO:19347 |
| | | AA | SGDKLGDKYVC SEQ ID NO:3324 | QDRKRPS SEQ ID NO:11336 | QAWHSSTVV SEQ ID NO:19348 |
| iPS:436718 | 21-225_151H5 | NA | TCTGGAGATAAATTGGGGGA TAAATATGCTTCC SEQ ID NO:3325 | CAAGATAGCAAGCGGCC CTCA SEQ ID NO:11337 | CAGGCGTGGGACAGCAGCAC TGTGGTA SEQ ID NO:19349 |
| | | AA | SGDKLGDKYAS SEQ ID NO:3326 | QDSKRPS SEQ ID NO:11338 | QAWDSSTVV SEQ ID NO:19350 |
| iPS:436720 | 21-225_151H6 | NA | TCTGGAGATAAATTGGGGGA TAAATATGCTTGC SEQ ID NO:3327 | CAAGATACCAAGCGGCC CTCA SEQ ID NO:11339 | CAGGCGTGGGACAGCAGCAC TTATGTC SEQ ID NO:19351 |
| | | AA | SGDKLGDKYAC SEQ ID NO:3328 | QDTKRPS SEQ ID NO:11340 | QAWDSSTYV SEQ ID NO:19352 |
| iPS:436722 | 21-225_151H7 | NA | TCTGGAGATAAATTGGGGGA TAAATATGCTTCC SEQ ID NO:3329 | CAAGATAGCAAGCGGCC CTCA SEQ ID NO:11341 | CAGGCGTGGGACAGCAGCAC TGTGGTA SEQ ID NO:19353 |
| | | AA | SGDKLGDKYAS | QDSKRPS | QAWDSSTVV |

FIGURE 49
(Continued)

| | | | | | |
|---|---|---|---|---|---|
| iPS:436724 | 21-225_151B9 | NA | SEQ ID NO:3330 TCTGGAGATAAATTGGGGGA TAAATATGCTTCC | SEQ ID NO:11342 CAAGATAGCAAGCGGCC CTCA | SEQ ID NO:19354 CAGGCGTGGGACAGCAGCAC TGTGGTA |
| | | AA | SEQ ID NO:3331 SGDNLGDKYAS | SEQ ID NO:11343 QDSKRPS | SEQ ID NO:19355 QAWDSSTYV |
| iPS:436726 | 21-225_152G5 | NA | SEQ ID NO:3332 TCTGGAGATAAATTGGGGGA TAAATATGCTTGC | SEQ ID NO:11344 CAAGATTCCAAGCGGCC CTCA | SEQ ID NO:19356 CAGGCGTGGGACAGCAGCAC TTATGTC |
| | | AA | SEQ ID NO:3333 SGDKLGDKYAC | SEQ ID NO:11345 QDSKRPS | SEQ ID NO:19357 QAWDSSTYV |
| iPS:436728 | 21-225_152G6 | NA | SEQ ID NO:3334 TCTGGAGATAAATTGGGGGA TAAATATGCTTCC | SEQ ID NO:11346 CAAGATAGCAAGCGGCC CTCA | SEQ ID NO:19358 CAGGCGTGGGACAACAGCAC TGTGGTA |
| | | AA | SEQ ID NO:3335 SGDKLGDKYAS | SEQ ID NO:11347 QDSKRPS | SEQ ID NO:19359 QAWDNSTVV |
| iPS:436730 | 21-225_152D7 | NA | SEQ ID NO:3336 TCTGGAGATAAATTGGGGGA TAAATATGCTTGC | SEQ ID NO:11348 CAAGATAGCAAGCGGCC CTCA | SEQ ID NO:19360 CAGGCGTGGGACAGCAGCAC TGTGGTA |
| | | AA | SEQ ID NO:3337 SGDKLGDKYAS | SEQ ID NO:11349 QDSKRPS | SEQ ID NO:19361 QAWDSSTVV |
| iPS:436732 | 21-225_152B12 | NA | SEQ ID NO:3338 TCTGGCGATAAATTGGGAAA TAAATATGCTTGC | SEQ ID NO:11350 CAAGATACCAAGCGGCC CTCA | SEQ ID NO:19362 CAGGCGTGGGACAGCAGCAC TTATGTC |
| | | AA | SEQ ID NO:3339 SGDKLGNKYAC | SEQ ID NO:11351 QDTKRPS | SEQ ID NO:19363 QAWDSSTYV |
| iPS:436734 | 21-225_153A8 | NA | SEQ ID NO:3340 TCTGGAGATAAATTGGGGGA TAAATATGCTTGC | SEQ ID NO:11352 CAAGATACCAAGCGGCC CTCA | SEQ ID NO:19364 CAGGCGTGGGACAGCAGCAC TTATGTC |
| | | AA | SEQ ID NO:3341 SGDKLGDKYAC | SEQ ID NO:11353 QDTKRPS | SEQ ID NO:19365 QAWDSSTYV |

FIGURE 49
(Continued)

| | | | | | | |
|---|---|---|---|---|---|---|
| iPS:436736 | 21-225_153E8 | NA | SEQ ID NO:3342 | TCTGGAGATAAATTGGGTAA TAAATATGTTTGC | SEQ ID NO:11354 | CAAGATAACAAGCGGCC CTCA | SEQ ID NO:19366 | CAGGCGTGGACAGCAGCAC TTATGTGATA |
| | | AA | SEQ ID NO:3343 SGSKLGNKYVC | | SEQ ID NO:11355 QDNKRPS | | SEQ ID NO:19367 QAWDSSTYVI |
| iPS:436738 | 21-225_153D9 | NA | SEQ ID NO:3344 | TCTGGAGATAAATTGGGGGA TAAATATGCTTGC | SEQ ID NO:11356 | CAAGATAGGAAGCGGCC CTCA | SEQ ID NO:19368 | CAGGCGTGGCACAGCAGTAC TGTGGTA |
| | | AA | SEQ ID NO:3345 SGDKLGDKYAC | | SEQ ID NO:11357 QDRKRPS | | SEQ ID NO:19369 QAWHSSTVV |
| iPS:436740 | 21-225_153C3 | NA | SEQ ID NO:3346 | TCTGGAGATAAATTGGGGGA TAAATATGTTTGC | SEQ ID NO:11358 | CAAGATAGGAAGCGGCC CTCA | SEQ ID NO:19370 | CAGGCGTGGCACAGCAGCAC TGTGGTA |
| | | AA | SEQ ID NO:3347 SGDKLGDKYVC | | SEQ ID NO:11359 QDRKRPS | | SEQ ID NO:19371 QAWHSSTVV |
| iPS:436742 | 21-225_154C4 | NA | SEQ ID NO:3348 | TCTGGAGATAAATTGGGGGA TAAATATGCTTCC | SEQ ID NO:11360 | CAAGATAGCAAGCGGCC CTCA | SEQ ID NO:19372 | CAGGCGTGGACAGCAGCAC TGTGGTA |
| | | AA | SEQ ID NO:3349 SGDKLGDKYAS | | SEQ ID NO:11361 QDSKRPS | | SEQ ID NO:19373 QAWDSSTVV |
| iPS:436744 | 21-225_154F4 | NA | SEQ ID NO:3350 | TCTGGAGATAAATTGGGAAA TAAATATGTTTGT | SEQ ID NO:11362 | AAAGATAGTAAGCGGCC CTCA | SEQ ID NO:19374 | CAGGCGTGGGACAACAGTAC TTTAGTA |
| | | AA | SEQ ID NO:3351 SGDKLGNKYVC | | SEQ ID NO:11363 KDSKRPS | | SEQ ID NO:19375 QAWDNSTLV |
| iPS:436746 | 21-225_154E10 | NA | SEQ ID NO:3352 | TCTGGAGATAAATTGGGGGA TAAATATGCTTCC | SEQ ID NO:11364 | CAAGATAGCAAGCGGCC CTCA | SEQ ID NO:19376 | CAGGCGTGGGACAACAGCAC TGTGGTA |
| | | AA | SEQ ID NO:3353 SGDKLGDKYAS | | SEQ ID NO:11365 QDSKRPS | | SEQ ID NO:19377 QAWDNSTVV |

FIGURE 49
(Continued)

| | | | | | | |
|---|---|---|---|---|---|---|
| iPS:436748 | 21-225_154D11 | NA | SEQ ID NO:3354 | TCTGGAGATAAATTGGGGGA TAAATATGCTTGC | SEQ ID NO:11366 | CAAGATAAGAAGCGGCC CTCA | SEQ ID NO:19378 | CAGGCGTGGCACAGCAGTAT TGTGGTA |
| | | AA | SEQ ID NO:3355 SGDKLGDKYAC | SEQ ID NO:11367 QDKKRPS | SEQ ID NO:19379 QAWHSSIYV |
| iPS:436750 | 21-225_154G12 | NA | SEQ ID NO:3356 TCTGGAAGCAGCTCCAACAT CGGAAATAATGCTGTAAGC | SEQ ID NO:11368 AGTAATGATCACCGGCC CTCA | SEQ ID NO:19380 GCAGCATGGATGACAGCCT GAAGGGTCCGGTA |
| | | AA | SEQ ID NO:3357 SGSSSNIGNNAVS | SEQ ID NO:11369 SNDHRPS | SEQ ID NO:19381 AAWDDSLKGPV |
| iPS:436752 | 21-225_155H1 | NA | SEQ ID NO:3358 ACTGGGAGCAGCTCCAATAT CGGGGCAGGTTATGATGTAC AC | SEQ ID NO:11370 GGTAACAGCAATCGGCC CTCA | SEQ ID NO:19382 CAGTCCTATGACAGCAGCCT GAGTGGTCCTGTGATA |
| | | AA | SEQ ID NO:3359 TGSSSNIGAGYDVH | SEQ ID NO:11371 GNSNRPS | SEQ ID NO:19383 QSYDSSLSGPVI |
| iPS:436754 | 21-225_155G3 | NA | SEQ ID NO:3360 TCTGGAGATAAGTTGGGGGA TAAATATGTTTGC | SEQ ID NO:11372 CAAGATAGTAAGCGGCC CTCA | SEQ ID NO:19384 CAGGCGTGGGACAATAGTAT TTATGTC |
| | | AA | SEQ ID NO:3361 SGDKLGDKYVC | SEQ ID NO:11373 QDSKRPS | SEQ ID NO:19385 QAWDNSIYV |
| iPS:436756 | 21-225_146A10 | NA | SEQ ID NO:3362 TCTGGAGATAAATTGGGGGA TAAATATGTTTGC | SEQ ID NO:11374 CAAGATAGAAAGCGGCC CTCA | SEQ ID NO:19386 CAGGCGTGGGACAGCAGCAC TGTGGTG |
| | | AA | SEQ ID NO:3363 SGDKLGDKYVC | SEQ ID NO:11375 QDRKRPS | SEQ ID NO:19387 QAWDSSTV |
| iPS:436758 | | NA | SEQ ID NO:3364 TCTGGAGATAAATTGGGGGA TAAATATGTTTCC | SEQ ID NO:11376 CAAGATAGCAAGCGGCC CTCA | SEQ ID NO:19388 CAGGCGTGGGACAGCAGCAC TGTGGTA |

FIGURE 49
(Continued)

| | | | | | | |
|---|---|---|---|---|---|---|
| iPS:436760 | 21-225_155C10 | NA | SEQ ID NO:3365 TCTGGAGATAAATTGGGGGATAAATATGTTTCC | SEQ ID NO:11377 CAAGATAGGAAGCGGCCTCA | SEQ ID NO:19389 CTGGCGTGGGACAGCAGCACTTTGTGGTA | |
| | | AA | SEQ ID NO:3366 SGDKLGDKYVS | SEQ ID NO:11378 QDSKRPS | SEQ ID NO:19390 QAWDSSTVV | |
| iPS:436762 | 21-225_155E10 | NA | SEQ ID NO:3367 TCTGGAAGCAGCTCCAACATCGGAAGTAATACTGTAAAT | SEQ ID NO:11379 AGTAGTAATCAGCGGCCCTCA | SEQ ID NO:19391 GCAGCATGGAGGATGACAGCCTGAATGGCGTGGTA | |
| | | AA | SEQ ID NO:3368 SGSSSNIGSNTVN | SEQ ID NO:11380 SSNQRPS | SEQ ID NO:19392 LAWDSSTFVV | |
| iPS:436764 | 21-225_156H2 | NA | SEQ ID NO:3369 TCTGGAGATAAATTGGGGGATAAATATGTTTGC | SEQ ID NO:11381 CAAGATAGTAAGCGGCCCTCA | SEQ ID NO:19393 CAGGCGTGGGACAACAGCAGCTTTGTGCTA | |
| | | AA | SEQ ID NO:3370 SGDKLGDKYVC | SEQ ID NO:11382 QDSKRPS | SEQ ID NO:19394 AAWDDSLNGVV | |
| iPS:436766 | 21-225_158E9 | NA | SEQ ID NO:3371 TCTGGAGATAAATTGGGGGATAAATATGTTTGC | SEQ ID NO:11383 CAAGATCGCAAGCGGCCCTCA | SEQ ID NO:19395 CAGGCGTGGGACAACAGCAGCTTTGTGCTA | |
| | | AA | SEQ ID NO:3372 SGDKLGDKYVC | SEQ ID NO:11384 QDRKRPS | SEQ ID NO:19396 QAWDNSSFVL | |
| iPS:436768 | 21-225_158D10 | NA | SEQ ID NO:3373 TCTGGAGATAAATTGGGGGATAAATATGTTTGC | SEQ ID NO:11385 CAAGATAGGAAGCGGCCCTCA | SEQ ID NO:19397 CAGGCGTGGGGACAACAGCAGCTTGTGGTA | |
| | | AA | SEQ ID NO:3374 SGDKLGDKYVC | SEQ ID NO:11386 QDRKRPS | SEQ ID NO:19398 QAWGNSSFVV | |
| iPS:436770 | 21-225_159H8 | NA | SEQ ID NO:3375 TCTGGAGATAAATTGGGGGATAAATATGTTTGC | SEQ ID NO:11387 CAAGATAGGAAGCGGCCCTCA | SEQ ID NO:19399 CAGGCGTGGGGACAACAGCAGCTTGTGGTA | |
| | | AA | SEQ ID NO:3376 SGDKLGDKYVC | SEQ ID NO:11388 QDRKRPS | SEQ ID NO:19400 QAWGNSSFVV | |

FIGURE 49
(Continued)

| iPS ID | Clone | Type | Sequence 1 | Sequence 2 | Sequence 3 |
|---|---|---|---|---|---|
| iPS:436770 | 21-225_160B12 | NA | TCTGGAGATAAATTGGGGGA TAAATATGTTTGC SEQ ID NO:3377 | CAAGATAGCAAGCGGCC CTCA SEQ ID NO:11389 | CAGGGGTGTGGGCAACAGCAG CTTTGTGGTA SEQ ID NO:19401 |
| | | AA | SGDKLGDKYVC SEQ ID NO:3378 | QDSKRPS SEQ ID NO:11390 | QAWGNSSFVV SEQ ID NO:19402 |
| iPS:436772 | 21-225_161H3 | NA | TCTGGAGATAGATTGGGGGA TAAATATGTTTGC SEQ ID NO:3379 | CAAGATAACAAGCGGCC CTCA SEQ ID NO:11391 | CAGGGGTGGGTCAACAACAC TGCAGTGGTT SEQ ID NO:19403 |
| | | AA | SGDRLGDKYVC SEQ ID NO:3380 | QDNKRPS SEQ ID NO:11392 | QAWVNNTAVV SEQ ID NO:19404 |
| iPS:436774 | 21-225_161E10 | NA | TCTGGAGATAAATTGGGGGA TAAATATGTTTGC SEQ ID NO:3381 | CAAGATAGCAAGCGGCC CTCA SEQ ID NO:11393 | CAGACGTGGGACAACAGTAG TTTTGCGGTT SEQ ID NO:19405 |
| | | AA | SGDKLGDKYVC SEQ ID NO:3382 | QDSKRPS SEQ ID NO:11394 | QTWDNSSFAL SEQ ID NO:19406 |
| iPS:436776 | 21-225_161F12 | NA | TCTGGAGATAAATTGGGGTGA TAAATATGCTTGC SEQ ID NO:3383 | CAAGATACCAAGCGGCC CTCA SEQ ID NO:11395 | CAGGGGTGGGACAGCAGCAC TCTGGTT SEQ ID NO:19407 |
| | | AA | SGDKLGDKYAC SEQ ID NO:3384 | QDTKRPS SEQ ID NO:11396 | QAWDSTTLV SEQ ID NO:19408 |
| iPS:436780 | 21-225_165H3 | NA | TCTGGAGATAAATTGGGGTGA TAAATATGCTTGC SEQ ID NO:3385 | CAAGATAGCAAGCGGCC CTCA SEQ ID NO:11397 | CAGGGCGTGGGACAGCACCAC TCTGGTT SEQ ID NO:19409 |
| | | AA | SGDKLGDKYAC SEQ ID NO:3386 | QDSKRPS SEQ ID NO:11398 | QAWDSTTLV SEQ ID NO:19410 |
| iPS:436782 | 21-225_166G11 | NA | TCTGGAGATAAATGTTCAC TAAATATGTTTCAC SEQ ID NO:3387 | CAAGATAGCAAGCGGCC CTCA SEQ ID NO:11399 | CAGGCGTGGACAACAGCAC TGCGGTA SEQ ID NO:19411 |
| | | AA | SGDKLGDKYVH SEQ ID NO:3388 | QDSKRPS SEQ ID NO:11400 | QAWDNSTAV SEQ ID NO:19412 |

FIGURE 49
(Continued)

| | | | | | |
|---|---|---|---|---|---|
| iPS:436784 | 21-225_169C1 | NA | TCTGGAGATAAATTGGGGA TAAATATGTTTGT | AAAGATATCAAGCGGCC CTCA | CAGGGCGTGGGACACCAACAC TGTGATA |
| | | | SEQ ID NO:3389 | SEQ ID NO:11401 | SEQ ID NO:19413 |
| | | AA | SGDKLGDKYVC | KDIKRPS | QAWDTNTVL |
| | | | SEQ ID NO:3390 | SEQ ID NO:11402 | SEQ ID NO:19414 |
| iPS:436786 | 21-225_169A6 | NA | TCTGGAGATAAATTGGGGA TAAATATGTTTGT | CAGGATTACAAGCGGCC CTCA | CAGGGCGTGGGACACCAACAC TGTGCTT |
| | | | SEQ ID NO:3391 | SEQ ID NO:11403 | SEQ ID NO:19415 |
| | | AA | SGDKLGDKYVC | QDYKRPS | QAWDTNTVL |
| | | | SEQ ID NO:3392 | SEQ ID NO:11404 | SEQ ID NO:19416 |
| iPS:436788 | 21-225_169B7 | NA | TCTGGAGATAAATTGGGGG AAAATATGCTTCC | CAAGATAGGAAGCGGCC CTCA | CAGGGCGTGGGACAAGAACAC TGTGGTA |
| | | | SEQ ID NO:3393 | SEQ ID NO:11405 | SEQ ID NO:19417 |
| | | AA | SGDKLGDKYAS | QDRKRPS | QAWDKNTVV |
| | | | SEQ ID NO:3394 | SEQ ID NO:11406 | SEQ ID NO:19418 |
| iPS:436790 | 21-225_169G11 | NA | TCTGGAGATAAATTGGGGA TAAATATGTGCAG | CAAGATAGTAAGCGGCC CTCA | CAGGGCGTGGGACAACAGCAC TGCGGTA |
| | | | SEQ ID NO:3395 | SEQ ID NO:11407 | SEQ ID NO:19419 |
| | | AA | SGDKLGDKYAC | QDSKRPS | QAWDNSTAV |
| | | | SEQ ID NO:3396 | SEQ ID NO:11408 | SEQ ID NO:19420 |
| iPS:436792 | 21-225_169D12 | NA | ACCCGCAGCAGTGGCAGCAT TACCGGCAACTATGTGCAG | GAGGATAAAAAAAGACC CTCT | CAGTCTTATTATAGCGGCAA TTGGGTG |
| | | | SEQ ID NO:3397 | SEQ ID NO:11409 | SEQ ID NO:19421 |
| | | AA | TRSSGSHFGNYVQ | EDKKRPS | QSYYSGNWV |
| | | | SEQ ID NO:3398 | SEQ ID NO:11410 | SEQ ID NO:19422 |
| iPS:436794 | 21-225_170F1 | NA | TCTGGAGATAAATTGGGGA TAAATATTCTTGC | CAAGATAGTAAGCGGCC CTCA | CAGGGCGTGGGACAGCAACAC TGCGGTA |
| | | | SEQ ID NO:3399 | SEQ ID NO:11411 | SEQ ID NO:19423 |
| | | AA | SGDKLGDKYSC | QDSKRPS | QAWDSNTAV |

FIGURE 49
(Continued)

| | | | | | | |
|---|---|---|---|---|---|---|
| iPS:436796 | | NA | SEQ ID NO:3400 TCTGGAGATAAATTGGGGGA TAAATATGCTTGT | SEQ ID NO:11412 CAAGATTACAAGCGGCC CTCA | SEQ ID NO:19424 CAGGCGTGGGACAACAGCAC TATGGTA |
| | 21-225_170A5 | AA | SEQ ID NO:3401 SGDKLGDKYAC | SEQ ID NO:11413 QDYKRPS | SEQ ID NO:19425 QAWDNSTMV |
| iPS:436798 | | NA | SEQ ID NO:3402 TCTGGAGATAAATTGGGGGG AAAATATGCTTCC | SEQ ID NO:11414 CAAGATAGGAAGCGGCC CTCA | SEQ ID NO:19426 CAGGCGTGGGACAAGAACAC TGTGGTA |
| | 21-225_171F5 | AA | SEQ ID NO:3403 SGDKLGGKYAS | SEQ ID NO:11415 QDRKRPS | SEQ ID NO:19427 QAWDKNTVV |
| iPS:436800 | | NA | SEQ ID NO:3404 CAAGGAGACAGCCTCAGAA GCTATTATGCAAGC | SEQ ID NO:11416 GCTAAAAACAACCGGCC CTCA | SEQ ID NO:19428 AACTCCCGGGACAGCAGTGG CAGCCATGTGGTA |
| | 21-225_171D12 | AA | SEQ ID NO:3405 QGDSLRSYYAS | SEQ ID NO:11417 AKNNRPS | SEQ ID NO:19429 NSRDSSGSHVV |
| iPS:436802 | | NA | SEQ ID NO:3406 TCTGGAGATAAATTGGGGGA TAAATATGCTTGC | SEQ ID NO:11418 CAAGATCGCAAGCGGCC CTCA | SEQ ID NO:19430 CAGGCGTGGGACATCAGCAC TTATGTGGTA |
| | 21-225_171E12 | AA | SEQ ID NO:3407 SGDKLGDKYAC | SEQ ID NO:11419 QDRKRPS | SEQ ID NO:19431 QAWDISTYVV |
| iPS:436804 | | NA | SEQ ID NO:3408 CAAGGAGACAGCCTCAGAA ACTATTATGCAAGC | SEQ ID NO:11420 ACTAAAAACAGCCGGCC CTCA | SEQ ID NO:19432 AACTCCCGGGACAGCAGTGG CAACCATGTGGTA |
| | 21-225_172C3 | AA | SEQ ID NO:3409 QGDSLRNYYVS | SEQ ID NO:11421 TKNSRPS | SEQ ID NO:19433 NSRDSSGNHVV |
| iPS:436806 | | NA | SEQ ID NO:3410 CAAGGAGACAGCCTCAGAA ACTATTATGCAAGC | SEQ ID NO:11422 ACTAAAAACAGCCGGCC CTCA | SEQ ID NO:19434 AACTCCCGGGACAGCAGTGG CAACCATGTGGTA |
| | 21-225_172B12 | AA | SEQ ID NO:3411 QGDSLRNYYAS | SEQ ID NO:11423 TKNSRPS | SEQ ID NO:19435 NSRDSSGNHVV |

FIGURE 49
(Continued)

| | | | SEQ ID NO:3412 TCTGGAGATAAATTGGGGAA TAAATATGTTTGC | SEQ ID NO:11424 CAAGATAGCAGGCGGCC CTCA | SEQ ID NO:19436 CAGGCGTGGGACAGCTTCAC TGTGGTA |
|---|---|---|---|---|---|
| iPS:436808 | 21-225_173F8 | AA | SEQ ID NO:3413 SGNKLGNKYVC | SEQ ID NO:11425 QDSRRPS | SEQ ID NO:19437 QAWDSFTVV |
| iPS:436810 | 21-225_175F4 | NA | SEQ ID NO:3414 ACTGGAACCAGCAGTGATGT TGGACGTTTTAACCTTGTCT CC | SEQ ID NO:11426 GAGGTCAGTAAGCGGCC CTCA | SEQ ID NO:19438 TGCTCATATGCAGGTAGTAG CACCTATGTGGTA |
| | | AA | SEQ ID NO:3415 TGTSSDVGRFNLVS | SEQ ID NO:11427 EVSKRPS | SEQ ID NO:19439 CSYAGSSTYVV |
| iPS:436812 | 21-225_175C6 | NA | SEQ ID NO:3416 TCTGGAGATAAATTGGGGGA TAAATATGCTTGT | SEQ ID NO:11428 CAAGATTACAAGCGGCC CTCA | SEQ ID NO:19440 CAGGCGTGGGACAACAGCAC TATGGTA |
| | | AA | SEQ ID NO:3417 SGDKLGDKYAC | SEQ ID NO:11429 QDYKRPS | SEQ ID NO:19441 QAWDNSTMV |
| iPS:436814 | 21-225_178H10 | NA | SEQ ID NO:3418 ACTGGAACCAGCAGTGATGT TGGACGTTTTAACCTTGTCT CC | SEQ ID NO:11430 GAAGTCAGTAAGCGGCC CTCA | SEQ ID NO:19442 TGCTCATATGCAGGTAGTAG CACCTTTGTAGTA |
| | | AA | SEQ ID NO:3419 TGTSSDVGRFNLVS | SEQ ID NO:11431 EVSKRPS | SEQ ID NO:19443 CSYAGSSTFVV |
| iPS:436816 | 21-225_179H5 | NA | SEQ ID NO:3420 CAAGGAGACAGTCTCAGAA ACTATTATGCAAGC | SEQ ID NO:11432 GGTAAAAACAACCGGCC CTCA | SEQ ID NO:19444 AACTCCCGGACAGCAGTGG TAACCATTGGGTG |
| | | AA | SEQ ID NO:3421 QGDSLRNYYAS | SEQ ID NO:11433 GKNNRPS | SEQ ID NO:19445 NSRDSSGNHWV |
| iPS:436818 | | NA | SEQ ID NO:3422 TCTGGAGATAAATTGGGGGA TAAATATGTTTGC | SEQ ID NO:11434 CAGGATAGTAGTAAGCGGCC CTCA | SEQ ID NO:19446 CAGGCGTGGGACAGCAACAC TGCAGTGGTA |

FIGURE 49
(Continued)

| | | | | | | | |
|---|---|---|---|---|---|---|---|
| iPS:436820 | 21-225_179C7 | NA | SEQ ID NO:3423 ACTGGGAGCAGCAGCTCCAACTT CGGGACAGATTATGATGTAC AC | SEQ ID NO:11435 GGTCACAGCAACCGGCC CTCA | SEQ ID NO:19447 CAGTCCTATGATAGAAGCCT GAATGTGGTC |
| | | AA | SEQ ID NO:3424 SGDKLGDKYVC | SEQ ID NO:11436 QDSKRPS | SEQ ID NO:19448 QAWDSNTAVV |
| iPS:436822 | 21-225_179D10 | NA | SEQ ID NO:3425 TGSSSNFGTDYDVH | SEQ ID NO:11437 GHSNRPS | SEQ ID NO:19449 QSYDRSLNVV |
| | | AA | SEQ ID NO:3426 SGDRLGDKYAC | SEQ ID NO:11438 EDRKRPS | SEQ ID NO:19450 CAGGGGTGTGGGACAGTAGGAA AGTGGTA |
| iPS:436824 | 21-225_180D4 | NA | SEQ ID NO:3427 TCTGGAGATAGATTGGGGGA TAAATATGCTTGC | SEQ ID NO:11439 GAAGATAGGAAGCGGCC CTCA | SEQ ID NO:19451 QAWDSRKVV |
| | | AA | SEQ ID NO:3428 SGDKLGEKYAC | SEQ ID NO:11440 EDRKRPS | SEQ ID NO:19452 CAGGGGTGTGGGACAGCAGCAC TGCGGTA |
| iPS:436826 | 21-225_180C5 | NA | SEQ ID NO:3429 TCTGGAGATAAATTGGGGGA AAAATATGCTTGC | SEQ ID NO:11441 CAAGATAGAAAGCGGCC CTCA | SEQ ID NO:19453 QAWDSSTAV |
| | | AA | SEQ ID NO:3430 SGDKLGEKYAC | SEQ ID NO:11442 QDRKRPS | SEQ ID NO:19454 CAGGGGTGTGGGACATCACCAC TGCGGTA |
| iPS:436828 | 21-225_180G5 | NA | SEQ ID NO:3431 TCTGGAGATAAATTGGGGGA TAAATATGTTAGC | SEQ ID NO:11443 CAAGATAGCAAGCGGCC CTCA | SEQ ID NO:19455 QAWDITTAV |
| | | AA | SEQ ID NO:3432 SGDKLGDKYVS | SEQ ID NO:11444 QDSKRPS | SEQ ID NO:19456 CAGGGGTGTGGGACAGCAGGA AAGTGGTA |
| | 21-225_181H1 | NA | SEQ ID NO:3433 TCTGGAGATAAATTGGGGGA TAAATATGCTTGC | SEQ ID NO:11445 GAAGATAGGAAGCGGCC CTCA | SEQ ID NO:19457 QAWDSRKVV |
| | | AA | SEQ ID NO:3434 SGDKLGDKYAC | SEQ ID NO:11446 EDRKRPS | SEQ ID NO:19458 |

FIGURE 49
(Continued)

| | | | | | |
|---|---|---|---|---|---|
| iPS:436830 | 21-225_51F4 | NA | TCTGGAAGCAGCTCCAACATCGGAAGTAATATTGTGACC SEQ ID NO:3435 | AGTAATGATCAGCGGCCCTCA SEQ ID NO:11447 | ACAGCATGGGATGACAGCCTGAATGGTTGGGTG SEQ ID NO:19459 |
| | | AA | SGSSSNIGSNIVT SEQ ID NO:3436 | SNDQRPS SEQ ID NO:11448 | TAWDDSLNGWV SEQ ID NO:19460 |
| iPS:436832 | 21-225_51D8 | NA | ACTGGGAGCAGCTCCAACATCGGGGCAGGTTTTGAAGTACAC SEQ ID NO:3437 | GGTAACAGCAATCGCCCTCA SEQ ID NO:11449 | CAGTCCTATGACAGCAGCCTGAGTGGTTATGTC SEQ ID NO:19461 |
| | | AA | TGSSSNIGAGFEVH SEQ ID NO:3438 | GNSNRPS SEQ ID NO:11450 | QSYDSSLSGYV SEQ ID NO:19462 |
| iPS:436834 | 21-225_52F1 | NA | TCTGGAAGCAGCTCCAACATCGGAAGTAATATTGTGACC SEQ ID NO:3439 | AGTAATGATCAGCGGCCCTCA SEQ ID NO:11451 | GCAGCATGGGATGACAGCCTGAATGGTTGGGTG SEQ ID NO:19463 |
| | | AA | SGSSSNIGSNIVT SEQ ID NO:3440 | SNDQRPS SEQ ID NO:11452 | AAWDDSLNGWV SEQ ID NO:19464 |
| iPS:436836 | 21-225_52H3 | NA | TCTGGAGATAAATTGGGGGATAAATATGTTTCC SEQ ID NO:3441 | CAAGATAGAAAGCGGCCCTCA SEQ ID NO:11453 | CAGGCGTGGGACAACAGCACTGTGGTA SEQ ID NO:19465 |
| | | AA | SGDKLGDKYVS SEQ ID NO:3442 | QDRKRPS SEQ ID NO:11454 | QAWDNSTVV SEQ ID NO:19466 |
| iPS:436838 | 21-225_52H4 | NA | ACTGGAACCAGCAGTGACGTTGGTGGTTATAACTATGTCTCC SEQ ID NO:3443 | GAGGTCAGTAATCGGCCCTCA SEQ ID NO:11455 | AACTCATATACAAGCAACATCACTTGGGTG SEQ ID NO:19467 |
| | | AA | TGTSSDVGGYNYVS SEQ ID NO:3444 | EVSNRPS SEQ ID NO:11456 | NSYTSNITWV SEQ ID NO:19468 |

FIGURE 49
(Continued)

| | | | | | |
|---|---|---|---|---|---|
| iPS:436840 | 21-225_53E9 | NA | TCTGGAACTAAATTGGGGA TAAATATGTTTGC | CAAGATACAATGCGGCC CTCA | CAGACGTGGGACAGCAC TGCGGTT |
| | | | SEQ ID NO:3445 | SEQ ID NO:11457 | SEQ ID NO:19469 |
| | | AA | SGTKLGDKYVC | QDTMRPS | QTWDSSTAV |
| | | | SEQ ID NO:3446 | SEQ ID NO:11458 | SEQ ID NO:19470 |
| iPS:436842 | 21-225_54E9 | NA | TCTGAAGCAACTCCAACAT CGGAAATAATATTGTCACC | GTTAATGATCAGCGGCC CTCA | GCAGTATGGGATGACAGCCT GAATGGTTGGGTG |
| | | | SEQ ID NO:3447 | SEQ ID NO:11459 | SEQ ID NO:19471 |
| | | AA | SGSNSNIGNNIVT | VNDQRPS | AAWDDSLNGWV |
| | | | SEQ ID NO:3448 | SEQ ID NO:11460 | SEQ ID NO:19472 |
| iPS:436844 | 21-225_56G1 | NA | TCTGGAAGCAGCTCCAACAT CGGAAGTCATATTGTTACC | AGTAATGATCAGCGGCC CTCA | GCAGTATGGGATGACAGCCT GATTGGTTGGGTG |
| | | | SEQ ID NO:3449 | SEQ ID NO:11461 | SEQ ID NO:19473 |
| | | AA | SGSSSNIGSHIVT | SNDQRPS | AVWDSLIGWV |
| | | | SEQ ID NO:3450 | SEQ ID NO:11462 | SEQ ID NO:19474 |
| iPS:436846 | 21-225_56E3 | NA | TCTGGAAGCAGCTCCAACAT CGGAAGTAATATTGTTACC | AGTAATAATCAGCGGCC CTCA | GCAGCATGGGATGACAGCCT GAATGGTTGGGTG |
| | | | SEQ ID NO:3451 | SEQ ID NO:11463 | SEQ ID NO:19475 |
| | | AA | SGSSSNIGSNIVT | SNNQRPS | AAWDDSLNGWV |
| | | | SEQ ID NO:3452 | SEQ ID NO:11464 | SEQ ID NO:19476 |
| iPS:436848 | 21-225_57F1 | NA | TCTGGAGATAAACTGGGGA AAAATATGCTTGC | CAAGATAGGAAGCGGCC CTCA | CAGGCGTGGGACAGCAGCAC TGTGGTA |
| | | | SEQ ID NO:3453 | SEQ ID NO:11465 | SEQ ID NO:19477 |
| | | AA | SGDKLGEKYAC | QDRKRPS | QAWDSSTVV |
| | | | SEQ ID NO:3454 | SEQ ID NO:11466 | SEQ ID NO:19478 |
| iPS:436850 | | NA | TCTGGAGAGAAATTGGGGG AAAAATTTGCTTGC | CAAGATAGCAAGCGGCC CTCA | CAGGCGTGGGACAGCAGCAC TGTGGTA |

FIGURE 49
(Continued)

| | | | | | | | |
|---|---|---|---|---|---|---|---|
| iPS:436852 | 21-225_57D9 | AA | SEQ ID NO:3455 SGEKLGEKFAC | SEQ ID NO:11467 QDSKRPS | SEQ ID NO:19479 QAWDSSTVV | | |
| iPS:436854 | 21-225_57H11 | NA | SEQ ID NO:3456 TCTGGAGATAAACTGGGGGA AAATATGCTTGC | SEQ ID NO:11468 CAAGATAGGAAGCGGCC CTCA | SEQ ID NO:19480 CAGGCGTGGGACAGCAGCAC TGTGGTA | | |
| | | AA | SEQ ID NO:3457 SGDKLGEKYAC | SEQ ID NO:11469 QDRKRPS | SEQ ID NO:19481 QAWDSSTVV | | |
| | | NA | SEQ ID NO:3458 TCTGGAGATAAATTGGGGAA TAAATATGCTTGC | SEQ ID NO:11470 CAAGATAGGAAGCGGCC CTCA | SEQ ID NO:19482 CAGGCGTGGGACAGCAGCAC TGCA | | |
| iPS:436856 | 21-225_58C1 | AA | SEQ ID NO:3459 SGDKLGNKYAC | SEQ ID NO:11471 QDRKRPS | SEQ ID NO:19483 QAWDSSTA | | |
| | | NA | SEQ ID NO:3460 TCTGGAAGCAGCTCCAACAT TGGGAATAATTATGTATCC | SEQ ID NO:11472 GACAATAATAAGCGACC CTCA | SEQ ID NO:19484 GGAACATGGGATATCAGTCT GAGTGTTGGGGTA | | |
| iPS:436858 | 21-225_58C5 | AA | SEQ ID NO:3461 SGSSSNIGNNYVS | SEQ ID NO:11473 DNNKRPS | SEQ ID NO:19485 GTWDISLSVGV | | |
| | | NA | SEQ ID NO:3462 TCTGGAGATAAATTGGGGGA TAAATATACTTGC | SEQ ID NO:11474 CAAGATAACAAGCGGCC CTCA | SEQ ID NO:19486 CAGGCGTGAACAACTACAC TGTGGTA | | |
| iPS:436860 | 21-225_58E7 | AA | SEQ ID NO:3463 SGDKLGDKYTC | SEQ ID NO:11475 QDNKRPS | SEQ ID NO:19487 QAWNNYTVV | | |
| | | NA | SEQ ID NO:3464 TCTGGAGATAAATTGGGGGA TAAATATGCTTGC | SEQ ID NO:11476 CAAGATAGGAAGCGGCC CTCA | SEQ ID NO:19488 CAGGCGTGGGACAGCAGCAC TGTGGTA | | |
| | 21-225_58F7 | AA | SEQ ID NO:3465 SGDKLGDKYAC | SEQ ID NO:11477 QDRKRPS | SEQ ID NO:19489 QAWDSSTVV | | |
| | | | SEQ ID NO:3466 | SEQ ID NO:11478 | SEQ ID NO:19490 | | |

FIGURE 49
(Continued)

| | | | | | |
|---|---|---|---|---|---|
| iPS:436862 | 21-225_58F8 | NA | TCTGGAGAGATAAATTGGGAAA TAAATATGCTTGC SEQ ID NO:3467 | CAAGATAGCAAGCGGCC CTCA SEQ ID NO:11479 | CAGGGCGTGGACAGCAGCAC TGTGGTA SEQ ID NO:19491 |
| | | AA | SGDKLGNKYAC SEQ ID NO:3468 | QDSKRPS SEQ ID NO:11480 | QAWDSSTVV SEQ ID NO:19492 |
| iPS:436864 | 21-225_58G11 | NA | TCTGGAGAGATAAATTGGGGGA TAAATATGCTTCC SEQ ID NO:3469 | CAAGATAACAAGCGGCC CTCA SEQ ID NO:11481 | CAGGGCGTGGAACAACAACAC TGTAATG SEQ ID NO:19493 |
| | | AA | SGDKLGDKYAS SEQ ID NO:3470 | QDNKRPS SEQ ID NO:11482 | QAWNNNTVM SEQ ID NO:19494 |
| iPS:436866 | 21-225_59F2 | NA | TCTGGAGAGATAAATTGGGGGA TAAATATGCTTCT SEQ ID NO:3471 | CAAGATAACAAGCGGCC CTCA SEQ ID NO:11483 | CAGGGCGTGGACAGCAGCAC TGTGGTC SEQ ID NO:19495 |
| | | AA | SGDKLGDKYAS SEQ ID NO:3472 | QDNKRPS SEQ ID NO:11484 | QAWDNNTVV SEQ ID NO:19496 |
| iPS:436868 | 21-225_59B11 | NA | TCTGGAGAGATAAATTGGGGGA TAAATATGCTTGC SEQ ID NO:3473 | CAAGATAGCAAGCGGCC CTCA SEQ ID NO:11485 | CAGGGCGTGGACAGCAGCAC TTATGTGGTA SEQ ID NO:19497 |
| | | AA | SGDKLGDKYAC SEQ ID NO:3474 | QDSKRPS SEQ ID NO:11486 | QAWDSSTYVV SEQ ID NO:19498 |
| iPS:436870 | 21-225_60B1 | NA | TCTGGAGAATAAACTGGGGGA AAAATATGCTTGC SEQ ID NO:3475 | CAAGATAGGAAGCGGCC CTCA SEQ ID NO:11487 | CAGGGCGTGGGACAGCAGCAC TGTGGTA SEQ ID NO:19499 |
| | | AA | SGDKLGEKYAC SEQ ID NO:3476 | QDRKRPS SEQ ID NO:11488 | QAWDSSTVV SEQ ID NO:19500 |
| iPS:436872 | 21-225_60D2 | NA | TCTGGAAATAAATTGGGGGA TAAATATGCTTCT SEQ ID NO:3477 | CAAGATAACAAGCGGCC CTCA SEQ ID NO:11489 | CAGGGCGTrGGACAACAACAC TGTGGTC SEQ ID NO:19501 |
| | | AA | SGNKLGDKYAS SEQ ID NO:3478 | QDNKRPS SEQ ID NO:11490 | QAWDNNTVV SEQ ID NO:19502 |

FIGURE 49
(Continued)

| | | | | | | |
|---|---|---|---|---|---|---|
| iPS:436874 | 21-225_60A12 | NA | TCTGGAGATAAATTGGGGAA TAAATATGCTTGC | SEQ ID NO:3479 | CAAGATAGGAAGCGGCC CTCA | SEQ ID NO:11491 | CAGGGCGTGGGACACAGCAGCAC TGCT | SEQ ID NO:19503 |
| | | AA | SGDKLGNKYAC | SEQ ID NO:3480 | QDRKRPS | SEQ ID NO:11492 | QAWDSSTA | SEQ ID NO:19504 |
| iPS:436876 | 21-225_61F5 | NA | TCTGGAGATAGAATTGGGGAA AAAATATGCTTGC | SEQ ID NO:3481 | CAAGATAGCAAGCGGCC CTCA | SEQ ID NO:11493 | CAGGGCGTGGGACACAGCAGCAC TGTGGTT | SEQ ID NO:19505 |
| | | AA | SGDKLGEKYAC | SEQ ID NO:3482 | QDSKRPS | SEQ ID NO:11494 | QAWDSSTVV | SEQ ID NO:19506 |
| iPS:436878 | 21-225_62E3 | NA | TCTGGAGATAAATTGGGGAA TAAATATGCTTGC | SEQ ID NO:3483 | CAAGATAGGAAGCGGCC CTCA | SEQ ID NO:11495 | CAGGGCGTGGGACACAGCAGCAC TGCGGTA | SEQ ID NO:19507 |
| | | AA | SGDKLGNKYAC | SEQ ID NO:3484 | QDRKRPS | SEQ ID NO:11496 | QAWDSSTAV | SEQ ID NO:19508 |
| iPS:436880 | 21-225_62E8 | NA | TCTGGAGATAGAATTGGGGAA TAAATATGCTTCC | SEQ ID NO:3485 | CAAGATAGGAAGCGGCC CTCA | SEQ ID NO:11497 | CAGGGCGTGGGACACAGCAGCAC TGCGGTA | SEQ ID NO:19509 |
| | | AA | SGDRLGNKYAS | SEQ ID NO:3486 | QDRKRPS | SEQ ID NO:11498 | QAWDSSTAV | SEQ ID NO:19510 |
| iPS:436882 | 21-225_62D10 | NA | TCTGGAGATAAATTGGGGAA TAAATATGCTTGC | SEQ ID NO:3487 | CAAGATAGGAAGCGGCC CTCA | SEQ ID NO:11499 | CAGGGCGTGGGACACAGCAGCAC TGCGGTA | SEQ ID NO:19511 |
| | | AA | SGDKLGNKYAC | SEQ ID NO:3488 | QDRKRPS | SEQ ID NO:11500 | QAWDSSTAV | SEQ ID NO:19512 |
| iPS:436884 | 21-225_62A12 | NA | TCTGGAGATAAATTGGGGAA TAAATATGCTTGC | SEQ ID NO:3489 | CAAGATAGGAAGCGGCC CTCA | SEQ ID NO:11501 | CAGGGCGTGGGACACAGCAGCAC TGCGGTA | SEQ ID NO:19513 |
| | | AA | SGDKLGNKYAC | SEQ ID NO:3490 | QDRKRPS | SEQ ID NO:11502 | QAWDSSTAV | SEQ ID NO:19514 |

FIGURE 49
(Continued)

| | | | | | |
|---|---|---|---|---|---|
| iPS:436886 | 21-225_62B12 | NA | TCTGGAGATAAATTGGGAA TAAATATACTTGC SEQ ID NO:3491 | CAAGATAGGAAGCGCC CTCA SEQ ID NO:11503 | CAGGGCGTGGGACAGCAGCAC TGCGGTA SEQ ID NO:19515 |
| | | AA | SGDKLGNKYTC SEQ ID NO:3492 | QDRKRPS SEQ ID NO:11504 | QAWDSSTAV SEQ ID NO:19516 |
| iPS:436888 | 21-225_63G7 | NA | ACCCGCAGCAATGGCAGCAT TGTCAGCAACTATGTGCAG SEQ ID NO:3493 | GAGGATAGCCGAAGACC CTCT SEQ ID NO:11505 | CAGTCTTATGATGGCATCAA TGTGGTA SEQ ID NO:19517 |
| | | AA | TRSNGSIVSNYVQ SEQ ID NO:3494 | EDSRRPS SEQ ID NO:11506 | QSYDGINVV SEQ ID NO:19518 |
| iPS:436890 | 21-225_63A10 | NA | ACCCGCAGCAATGGCAGCAT TGTCAGCAACTATGTGCAG SEQ ID NO:3495 | GAGGATAAAAGAAGACC CTCA SEQ ID NO:11507 | CAGTCTTATGATAGCATCAA TGTGGTA SEQ ID NO:19519 |
| | | AA | TRSNGSIVSNYVQ SEQ ID NO:3496 | EDKRRPS SEQ ID NO:11508 | QSYDSINVV SEQ ID NO:19520 |
| iPS:436892 | 21-225_65E9 | NA | TCTGGAGATAAATTGGGGAA TAAATATGATTAC SEQ ID NO:3497 | CAAGATAGAAAGCGGCC CTCA SEQ ID NO:11509 | CAGGGCGTGGGACAACAGCAC TGTGGTA SEQ ID NO:19521 |
| | | AA | SGDKLGNKYDY SEQ ID NO:3498 | QDRKRPS SEQ ID NO:11510 | QAWDNSTVV SEQ ID NO:19522 |
| iPS:436894 | 21-225_66G9 | NA | TCTGGAGATAAATTGGGGAA TAAATATGCTGC SEQ ID NO:3499 | CAAGATAGGAAGCGGCC CTCA SEQ ID NO:11511 | CAGGGCGTGGGACATCAACAC TGCGGTA SEQ ID NO:19523 |
| | | AA | SGDKLGNKYAC SEQ ID NO:3500 | QDRKRPS SEQ ID NO:11512 | QAWDINTAV SEQ ID NO:19524 |
| iPS:436896 | 21-225_67F10 | NA | TCTGGAGATAAATTGGGGTA TAAATATGCTGG SEQ ID NO:3501 | GAAGATAGGAAGCGGCC CTCA SEQ ID NO:11513 | CAGGGCGTGGGACAACAGCAC TGTGGTA SEQ ID NO:19525 |

FIGURE 49
(Continued)

| | | | SGDKLGYKYAW<br>SEQ ID NO:3502 | | EDRKRPS<br>SEQ ID NO:11514 | | QAWDNSTVV<br>SEQ ID NO:19526 |
|---|---|---|---|---|---|---|---|
| iPS:436898 | | AA | | | | | |
| | 21-225_68D8 | NA | TCTGGAGATAAATTGGGGGA<br>TAAATATGCTTGC<br>SEQ ID NO:3503 | | CAAGATAGCAAGCGGCC<br>CTCA<br>SEQ ID NO:11515 | | CAGGCGTGGACAACAGCAC<br>TGTGGTA<br>SEQ ID NO:19527 |
| iPS:436900 | | AA | SGDKLGDKYAC<br>SEQ ID NO:3504 | | QDSKRPS<br>SEQ ID NO:11516 | | QAWDNSTVV<br>SEQ ID NO:19528 |
| | 21-225_69B9 | NA | TCTGGAGATAAATTGGGGGA<br>TAAATATGATTAC<br>SEQ ID NO:3505 | | CAAGATAGAAAGCGGCC<br>CTCA<br>SEQ ID NO:11517 | | CAGGCGTGGACAACAGCAC<br>TGTGGTA<br>SEQ ID NO:19529 |
| iPS:436902 | | AA | SGDKLGNKYDY<br>SEQ ID NO:3506 | | QDRKRPS<br>SEQ ID NO:11518 | | QAWDNSTVV<br>SEQ ID NO:19530 |
| | 21-225_69B11 | NA | TCTGGAGATAAATTGGGGGA<br>TAAATATGCTTGG<br>SEQ ID NO:3507 | | GAAGATAGGAAGCGGCC<br>CTCA<br>SEQ ID NO:11519 | | CAGGCGTGGACAACAGCAC<br>TGTGGTA<br>SEQ ID NO:19531 |
| iPS:436904 | | AA | SGDKLGDKYAW<br>SEQ ID NO:3508 | | EDRKRPS<br>SEQ ID NO:11520 | | QAWDNSTVV<br>SEQ ID NO:19532 |
| | 21-225_71D4 | NA | TCTGGAGATAAATTGGGGGA<br>TAAATATGCTTAC<br>SEQ ID NO:3509 | | CAAGATAGGAAGCGGCC<br>CTCA<br>SEQ ID NO:11521 | | CAGGCGTGGGTCAACAGCAC<br>TGTGGTA<br>SEQ ID NO:19533 |
| iPS:436906 | | AA | SGDKLGDKYAY<br>SEQ ID NO:3510 | | QDRKRPS<br>SEQ ID NO:11522 | | QAWVNSTVV<br>SEQ ID NO:19534 |
| | 21-225_72B4 | NA | TCTGGAGATAAATTGGGGGA<br>TAAATATGCTTGG<br>SEQ ID NO:3511 | | GAAGATAGGAAGCGGCC<br>CTCA<br>SEQ ID NO:11523 | | CAGGCGTGGACAACAGCAC<br>TGTGGTA<br>SEQ ID NO:19535 |
| iPS:436908 | | AA | SGDKLGDKYAW<br>SEQ ID NO:3512 | | EDRKRPS<br>SEQ ID NO:11524 | | QAWDNSTVV<br>SEQ ID NO:19536 |
| | 21-225_72D5 | NA | TCTGGAGATAAATTGGGGGA<br>TAAATATGCTTGC<br>SEQ ID NO:3513 | | CAAGATAGGAAGCGGCC<br>CTCA<br>SEQ ID NO:11525 | | CAGGCGTGGACAGCAGCAC<br>TGCGGTA<br>SEQ ID NO:19537 |

FIGURE 49
(Continued)

| | | | | | | | |
|---|---|---|---|---|---|---|---|
| iPS:436910 | 21-225_73G1 | AA | SGDKLGNKYAC SEQ ID NO:3514 | NA | GGCTTGAGCTCTGGCTCAGTCTCTACTAGTTACTACCCCAGC | QDRKRPS SEQ ID NO:11526 | AACACAAACACTCGCTCTTCT | QAWDSSTAV SEQ ID NO:19538 | GTTCTATATGGGTAGTGCCATTTGGGTG |
| | 21-225_73C4 | NA | | | | | SEQ ID NO:11527 | SEQ ID NO:19539 |
| iPS:436912 | | AA | GLSSGSVSTSYYPS SEQ ID NO:3515 | | | NTNTRSS | | VLYMGSAIWV SEQ ID NO:19540 |
| | 21-225_76B4 | NA | SGDKLGNKYAC SEQ ID NO:3516 | | TCTGGAGATAAATTGGGGAA TAAATATGCTTGC SEQ ID NO:3517 | CAAGATATGAAGCGGCC CTCA SEQ ID NO:11528 | | CAGGGCGTGGGACAGCAGCAC TGCGGTA SEQ ID NO:19541 |
| iPS:436914 | | AA | SGDKLGNKYAC SEQ ID NO:3518 | | | QDMKRPS SEQ ID NO:11529 | | QAWDSSTAV SEQ ID NO:19542 |
| | 21-225_74A9 | NA | | | TCTGGAGATAGATTGGGGAC TAAATTGCTTGC SEQ ID NO:3519 | CAAGATAACAGGCGGCC CTCA SEQ ID NO:11530 | | CAGGGCGTGGGACAGCAGCAC TGTA SEQ ID NO:19543 |
| iPS:436916 | | AA | SGDRLGTKFAC SEQ ID NO:3520 | | | QDSKRPS SEQ ID NO:11531 | | QAWDSSTV SEQ ID NO:19544 |
| | 21-225_77A2 | NA | | | TCTGGAGATAAATTGGGTAA TAAATATGTTTGT SEQ ID NO:3521 | CAAGATAACAGGCGGCC CTCA SEQ ID NO:11532 | | CAGGGCGTGGGACAGCAGTCC TGTGATA SEQ ID NO:19545 |
| iPS:436918 | | AA | SGDKLGNKYVC SEQ ID NO:3522 | | | QDNRRPS SEQ ID NO:11533 | | QAWDSSPVI SEQ ID NO:19546 |
| | | NA | | | TCTGGAGATAGATTGGGGGA TAAATATGCTTGC SEQ ID NO:3523 | CAAGATAGGAAGCGGCC CTCA SEQ ID NO:11534 | | CAGGGCGTGGGACAGCAGTAC TGCGGTA SEQ ID NO:19547 |
| | | AA | SGDRLGDKYAC SEQ ID NO:3524 | | | QDRKRPS SEQ ID NO:11535 | | QAWDSSTAV SEQ ID NO:19548 |
| | | | | | | SEQ ID NO:11536 | | |

FIGURE 49
(Continued)

| | | | | | |
|---|---|---|---|---|---|
| iPS:436920 | 21-225_74E5 | NA | GCTTCCAGCACTGAAACAGTCACCAGTGGTTCTTATCCGAAC<br>SEQ ID NO:3525 | AGTACAAGCAACAAACACTCC<br>SEQ ID NO:11537 | CTGCTCTACTATGGTGGTGCTCAACTGGTA<br>SEQ ID NO:19549 |
| | | AA | ASSTETVTSGSYPN<br>SEQ ID NO:3526 | STSNKHS<br>SEQ ID NO:11538 | LLYYGGAQLV<br>SEQ ID NO:19550 |
| iPS:436922 | 21-225_78E9 | NA | TCAGGAGATAAATTGGGGAATAAATATGTTTCC<br>SEQ ID NO:3527 | CAAGATAACAGGCGGCCGTCA<br>SEQ ID NO:11539 | CAGGCGTGGGACAGCAGCCCTGTGATA<br>SEQ ID NO:19551 |
| | | AA | SGDKLGNKYVS<br>SEQ ID NO:3528 | QDNRRPS<br>SEQ ID NO:11540 | QAWDSSPVI<br>SEQ ID NO:19552 |
| iPS:436924 | 21-225_74B3 | NA | TCTGGAGATAAATTGGGGGATAAATATGCTTGC<br>SEQ ID NO:3529 | CAAGATAGCAAGCGGCCCTCA<br>SEQ ID NO:11541 | CAGGCGTGGGACAGCAGCCACTGTGGTA<br>SEQ ID NO:19553 |
| | | AA | SGDKLGDKYAC<br>SEQ ID NO:3530 | QDSKRPS<br>SEQ ID NO:11542 | QAWDSTTVV<br>SEQ ID NO:19554 |
| iPS:436926 | 21-225_78D10 | NA | GCTTCCAGCACTGGAGCAGTCACCAGTGGTTACTTTCCAAC<br>SEQ ID NO:3531 | AGTACAGACAACAAACACTCC<br>SEQ ID NO:11543 | CTCCTCTACTATGGTGGTGCTCAGCTGATG<br>SEQ ID NO:19555 |
| | | AA | ASSTGAVTSGYFPN<br>SEQ ID NO:3532 | STDNKHS<br>SEQ ID NO:11544 | LLYYGGAQLM<br>SEQ ID NO:19556 |
| iPS:436928 | 21-225_79E7 | NA | TCAGGAGATAAATTGGGGAATAAATATGTTTCC<br>SEQ ID NO:3533 | CAAGATAACAGGCGGCCCTCA<br>SEQ ID NO:11545 | CAGGCGTGGGACAGCAGCCCTGTGATA<br>SEQ ID NO:19557 |
| | | AA | SGDKLGNKYVS<br>SEQ ID NO:3534 | QDNRRPS<br>SEQ ID NO:11546 | QAWDSSPVI<br>SEQ ID NO:19558 |
| iPS:436932 | 21-225_92A4 | NA | TCTGGAGATAAATTGGGGAATAAATATGTTTGC<br>SEQ ID NO:3535 | CAAGATAACAGGCGGCCCTCA<br>SEQ ID NO:11547 | CAGGCGTGGGACAGCAGCCCTGTGATA<br>SEQ ID NO:19559 |

FIGURE 49
(Continued)

| | | | | | | |
|---|---|---|---|---|---|---|
| iPS:436934 | 21-225_96B5 | AA | SGDKLGNKYVC<br>SEQ ID NO:3536 | QDNRRPS<br>SEQ ID NO:11548 | QAWDSSPVI<br>SEQ ID NO:19560 |
| | | NA | TCTGGAGATAAATTGGGGAC<br>TAAATTTGCTTGC<br>SEQ ID NO:3537 | CAAGATAGCAAGCGGCC<br>CTCA<br>SEQ ID NO:11549 | CAGGCGTGGACAGCAGCAC<br>TGTA<br>SEQ ID NO:19561 |
| iPS:436936 | 21-225_97E6 | AA | SGDRLGTKFAC<br>SEQ ID NO:3538 | QDSKRPS<br>SEQ ID NO:11550 | QAWDSSTV<br>SEQ ID NO:19562 |
| | | NA | TCTGGAGATAAATTGGGGAA<br>TAAATATGTTTCC<br>SEQ ID NO:3539 | CAAGATAACAGGCGGCC<br>GTCA<br>SEQ ID NO:11551 | CAGGCGTGGACAGCACCCC<br>TGTGATA<br>SEQ ID NO:19563 |
| iPS:436938 | 21-225_146A3 | AA | SGDKLGNKYVS<br>SEQ ID NO:3540 | QDNRRPS<br>SEQ ID NO:11552 | QAWDSTPVI<br>SEQ ID NO:19564 |
| | | NA | TCTGGAGATAAATTGGGGAA<br>TAGATATGCTTGC<br>SEQ ID NO:3541 | CAAGATAGCAAGCGGCC<br>CTCA<br>SEQ ID NO:11553 | CAGGCGTGGACAGCAGCAC<br>TGTGGTA<br>SEQ ID NO:19565 |
| iPS:436940 | 21-225_146B8 | AA | SGNKLGNRYAC<br>SEQ ID NO:3542 | QDSKRPS<br>SEQ ID NO:11554 | QAWDSSTVV<br>SEQ ID NO:19566 |
| | | NA | TCTGGAGATAAATTGGGGAA<br>TAAATATGTTTGC<br>SEQ ID NO:3543 | CAAGATAGGAAGCGGCC<br>CTCA<br>SEQ ID NO:11555 | CAGGCGTGGCACAGCAGCAC<br>TGTGGTA<br>SEQ ID NO:19567 |
| iPS:436942 | 21-225_146H8 | AA | SGDKLGDKYVC<br>SEQ ID NO:3544 | QDRKRPS<br>SEQ ID NO:11556 | QAWHSSTVV<br>SEQ ID NO:19568 |
| | | NA | TCTGGAGATAAATTGGGGGA<br>TAAATATGCTTGC<br>SEQ ID NO:3545 | CAAGATAGAAGCGGCC<br>CTCA<br>SEQ ID NO:11557 | CAGGCGTGGACATCAGAAC<br>TGTGGTA<br>SEQ ID NO:19569 |
| iPS:436944 | 21-225_182D12 | AA | SGDKLGDKYAC<br>SEQ ID NO:3546 | QDKKRPS<br>SEQ ID NO:11558 | QAWDIRTVV<br>SEQ ID NO:19570 |
| | | NA | TCTGGAGATAAATTGGGGGA<br>GAAATATGCTTGC<br>SEQ ID NO:3547 | CAAGATAGAAAGCGGCC<br>CTCA<br>SEQ ID NO:11559 | CAGGCGTGGACAGTAGAAC<br>TGCGGTA<br>SEQ ID NO:19571 |

FIGURE 49
(Continued)

| | | | | | | | |
|---|---|---|---|---|---|---|---|
| iPS:436946 | | AA | SGDKLGEKYAC | | QDRKRPS | | QAWDSRTAV |
| | | | SEQ ID NO:3548 | | SEQ ID NO:11560 | | SEQ ID NO:19572 |
| | 21-225_183F4 | NA | TCTGGAGATAAATTGGGGGA TAAATATGCTTGT | | CAAGATAAGAAACGGCC CTCA | | CAGGCGTGGGACAACAGCAC TGCTGTGGTA |
| | | | SEQ ID NO:3549 | | SEQ ID NO:11561 | | SEQ ID NO:19573 |
| iPS:436948 | | AA | SGDKLGDKYAC | | QDKKRPS | | QAWDNSTAVV |
| | | | SEQ ID NO:3550 | | SEQ ID NO:11562 | | SEQ ID NO:19574 |
| | 21-225_183F5 | NA | GGCTTGAGCTCTGGCTCAGT CTCTACTACTTCTACCCCA GC | | AACACAAACACTCGCTC TTCT | | GTGCTTTATATGGGTAGTGG CATTTGGGTG |
| | | | SEQ ID NO:3551 | | SEQ ID NO:11563 | | SEQ ID NO:19575 |
| | | AA | GLSSGSVSTTFYPS | | NTNTRSS | | VLYMGSGIWV |
| | | | SEQ ID NO:3552 | | SEQ ID NO:11564 | | SEQ ID NO:19576 |
| iPS:436950 | 21-225_184G4 | NA | TCTGGAGATAAATTGGGGGA TAAATTGCTTGC | | GAAGATAGGAAGCGGCC CTCA | | CAGGCGTGGGACAGCGCAC TGTGGTA |
| | | | SEQ ID NO:3553 | | SEQ ID NO:11565 | | SEQ ID NO:19577 |
| | | AA | SGDKLGDKFAC | | EDRKRPS | | QAWDSRTVV |
| | | | SEQ ID NO:3554 | | SEQ ID NO:11566 | | SEQ ID NO:19578 |
| iPS:436952 | 21-225_185D2 | NA | TCTGGAGATAAATTGGGGGA TAAATATGCTTGC | | GAAGATAGGAAGCGGCC CTCA | | CAGGCGTGGGACAGCAGGA AAGTGGTA |
| | | | SEQ ID NO:3555 | | SEQ ID NO:11567 | | SEQ ID NO:19579 |
| | | AA | SGDKLGDKYAC | | EDRKRPS | | QAWDSRKVV |
| | | | SEQ ID NO:3556 | | SEQ ID NO:11568 | | SEQ ID NO:19580 |
| iPS:436954 | 21-225_185G7 | NA | TCTGGAGATAAATTGGGGGA TAAATTGTTTGC | | CAAGATCCGCAAGCGGCC CTCA | | CAGGCGTGGGACAGCAGCAC GGTA |
| | | | SEQ ID NO:3557 | | SEQ ID NO:11569 | | SEQ ID NO:19581 |
| | | AA | SGDKLGHKFVC | | QDRKRPS | | QAWDSSTV |
| | | | SEQ ID NO:3558 | | SEQ ID NO:11570 | | SEQ ID NO:19582 |
| iPS:436956 | | NA | TCTGGAGATAAATGGGGG AAAAATATGCTTGC | | CAAGATAGAAAGCGGCC CTCA | | CAGGCGTGGGACAGCAGCAC TGCGGTA |

FIGURE 49
(Continued)

| | | | | | | |
|---|---|---|---|---|---|---|
| | | | SEQ ID NO:3559 SGDKMGEKYAC | SEQ ID NO:11571 QDRKRPS | SEQ ID NO:19583 QAWDSSTAV | |
| iPS:436958 | 21-225_186H6 | AA | SEQ ID NO:3560 | SEQ ID NO:11572 | SEQ ID NO:19584 | |
| | | NA | GCTTCCAGCACTGGAGCAGTCACCAGTGGTTCCTATCCAAAC | AGTACAAGTAACAAACACTCC | CTGCTCTACTATGGTGGTGCTCAGGTGGCA | |
| iPS:436960 | 21-225_190D1 | AA | SEQ ID NO:3561 ASSTGAVTSGSYPN | SEQ ID NO:11573 STSNKHS | SEQ ID NO:19585 LLYYGGAQVA | |
| | | | SEQ ID NO:3562 | SEQ ID NO:11574 | SEQ ID NO:19586 | |
| iPS:436960 | 21-225_198D2 | NA | TCTGGAAGCAGCTCCAACATTGGGAGTAATTATGTTTCC | GACAATAATAAGCGACCCTCA | GGAACATGGGATAGCAGACTGAATGTGGGGTA | |
| | | AA | SEQ ID NO:3563 SGSSSNIGSNYVS | SEQ ID NO:11575 DNNKRPS | SEQ ID NO:19587 GTWDSRLNVGV | |
| | | | SEQ ID NO:3564 | SEQ ID NO:11576 | SEQ ID NO:19588 | |
| iPS:436962 | 21-225_190H1 | NA | TCTGGAGATAAATTGGGGATAGATTGCTTAC | CAAGATAGCAAGCGCCCTCA | AAGGCGTGGGACAGCAGCACTGTGGTA | |
| | | AA | SEQ ID NO:3565 SGDKLGDRFAY | SEQ ID NO:11577 QDSKRPS | SEQ ID NO:19589 KAWDSSTVV | |
| | | | SEQ ID NO:3566 | SEQ ID NO:11578 | SEQ ID NO:19590 | |
| iPS:436964 | 21-225_190B3 | NA | CAAGGAGACAAACTCAGAACCTATTATGCAAGC | GGAAAAACAACCGGCCCTCA | AACTCCCGGGACAGCAGTGGTAACCATCTTGTACTA | |
| | | AA | SEQ ID NO:3567 QGDKLRTYYAS | SEQ ID NO:11579 GKNNRPS | SEQ ID NO:19591 NSRDSSGNHLVL | |
| | | | SEQ ID NO:3568 | SEQ ID NO:11580 | SEQ ID NO:19592 | |
| iPS:436966 | 21-225_190C3 | NA | TCTGGAAGCAGCTCCAACATTGGAAATAATTATGTATCC | GACAGTAATAAGCGACCCTCA | GGAACATGGGATAGCAGCCTGAGTACTGTGGTA | |
| | | AA | SEQ ID NO:3569 SGSSSNIGNNYVS | SEQ ID NO:11581 DSNKRPS | SEQ ID NO:19593 GTWDSSLSTVV | |
| | | | SEQ ID NO:3570 | SEQ ID NO:11582 | SEQ ID NO:19594 | |

FIGURE 49 (Continued)

| | | | | | |
|---|---|---|---|---|---|
| iPS:436968 | 21-225_190B10 | NA | TCTGGAAGCAGCTCCAACAT TGGGAATAATTATGTATCC SEQ ID NO:3571 | GACAATAATAAGCGACC CTCA SEQ ID NO:11583 | GGAACATGGGATAGCAGCCT GAGTGCTGGGGTT SEQ ID NO:19595 |
| | | AA | SGSSSNIGNNYVS SEQ ID NO:3572 | DNNKRPS SEQ ID NO:11584 | GTWDSSLSAGV SEQ ID NO:19596 |
| iPS:436970 | 21-225_190B8 | NA | CAAGGAGACACCCTCAGACC CTATTATGTAAGC SEQ ID NO:3573 | GGTAAAAACAACCGGCC CTCA SEQ ID NO:11585 | AACTCCCGGGACAGCAGTGG TAACCATCTGTGGTA SEQ ID NO:19597 |
| | | AA | QGDTLRPYYVS SEQ ID NO:3574 | GKNNRPS SEQ ID NO:11586 | NSRDSSGNHLVV SEQ ID NO:19598 |
| iPS:436972 | 21-225_190C7 | NA | TCTGGAGGCAGCTCCAACAT TGGGAATAATTATGTATCC SEQ ID NO:3575 | GACAATAATAAGCGACC CTCA SEQ ID NO:11587 | GGAACATGGGATCGCACCCT GAGTGATTGGGTA SEQ ID NO:19599 |
| | | AA | SGSSSNIGNNYVS SEQ ID NO:3576 | DNNKRPS SEQ ID NO:11588 | GTWDRTLSDWV SEQ ID NO:19600 |
| iPS:436974 | 21-225_190H7 | NA | TCTGGAAGCAGCTCCAACAT TGGGAGTAATTATGTTTCC SEQ ID NO:3577 | GACAATAATAAGCGACC CTCA SEQ ID NO:11589 | GGAACATGGGATGGCAGACT GAATGTTGGGGTA SEQ ID NO:19601 |
| | | AA | SGSSSNIGSNYVS SEQ ID NO:3578 | DNNKRPS SEQ ID NO:11590 | GTWDGRLNVGV SEQ ID NO:19602 |
| iPS:436976 | 21-225_190D8 | NA | TCTGGAAGCAGCTCCAACAT TGGGAATCATTATGTCTCC SEQ ID NO:3579 | GACAGTAGTAAGCGACC CTCA SEQ ID NO:11591 | GGAACATGGGATAGTAGTCT GAGTACTGTGGTA SEQ ID NO:19603 |
| | | AA | SGSSSNIGNHYVS SEQ ID NO:3580 | DSSKRPS SEQ ID NO:11592 | GTWDSSLSTVV SEQ ID NO:19604 |
| iPS:436978 | 21-225_190G9 | NA | TCTGGAGATAAATTGGGGGA TAGATTTGCTTAC SEQ ID NO:3581 | CAAGATAACAAGCGGCC CTCA SEQ ID NO:11593 | CAGGCGTGGACAAGCAGCAC TGTGGTA SEQ ID NO:19605 |

FIGURE 49
(Continued)

| | | | | | | | QAWDSSTV |
|---|---|---|---|---|---|---|---|
| | | AA | SGDKLGDRFAY | | QDNKRPS | | SEQ ID NO:19606 |
| iPS:436980 | 21-225_190C10 | | SEQ ID NO:3582 | | SEQ ID NO:11594 | | AACTCCCGGGACAGCAGTGG |
| | | NA | CAAGGAGACAGCCTCAGAC CCTATTATGCAAGC | | GGTAAAAACAACCGGCC CTCA | | TAACCATCTTGTGGTA |
| | | | SEQ ID NO:3583 | | SEQ ID NO:11595 | | SEQ ID NO:19607 |
| iPS:436982 | 21-225_190D10 | AA | QGDSLRPYYAS | | GKNNRPS | | NSRDSSGNHLVV |
| | | | SEQ ID NO:3584 | | SEQ ID NO:11596 | | SEQ ID NO:19608 |
| | | NA | TCTGGAAGCAGCTCCAACAT TGGGAGTAATTATGTTTCC | | GACAATAATAAGCGACC CTCA | | GGAACATGGGATAGCAGACT GAATGTTGGGGTA |
| | | | SEQ ID NO:3585 | | SEQ ID NO:11597 | | SEQ ID NO:19609 |
| iPS:436984 | 21-225_190F10 | AA | SGSSSNIGSNYVS | | DNKRPS | | GTWDSRLNVGV |
| | | | SEQ ID NO:3586 | | SEQ ID NO:11598 | | SEQ ID NO:19610 |
| | | NA | GTTTTTAGCACTGGAGCAGT CACCAGTGGTTCCTTCCAA AC | | AGTACAAGCAACAAACA CTCC | | CTGCTCTACTGTGGTGGTGC TCAGCTGGTG |
| | | | SEQ ID NO:3587 | | SEQ ID NO:11599 | | SEQ ID NO:19611 |
| iPS:436986 | 21-225_191A1 | AA | VFSTGAVTSGSFPN | | STSNKHS | | LLYCGGAQLV |
| | | | SEQ ID NO:3588 | | SEQ ID NO:11600 | | SEQ ID NO:19612 |
| | | NA | TCTGGAAGCAGCTCCAACCT TGGAAATAATTTTGTATCC | | GACAATTATAAGCGACC CTCA | | GGAACATGGGATAGCAGCCT GAATACTGGGGTA |
| | | | SEQ ID NO:3589 | | SEQ ID NO:11601 | | SEQ ID NO:19613 |
| iPS:436988 | 21-225_191A2 | AA | SGSSSNLGNNFVS | | DNYKRPS | | GTWDSSLNTGV |
| | | | SEQ ID NO:3590 | | SEQ ID NO:11602 | | SEQ ID NO:19614 |
| | | NA | GTTCTTAGCACTGGAGCAGT CACCAGTGGTTCCTTCCAA AC | | AGTACAAGCAACAAACA CTCC | | ATGCTCTACTGTGGTGGTGC TCAGCTGGTG |
| | | | SEQ ID NO:3591 | | SEQ ID NO:11603 | | SEQ ID NO:19615 |
| | | AA | VLSTGAVTSGSFPN | | STSNKHS | | MLYCGGAQLV |
| | | | SEQ ID NO:3592 | | SEQ ID NO:11604 | | SEQ ID NO:19616 |

FIGURE 49
(Continued)

| | | | | | |
|---|---|---|---|---|---|
| iPS:436992 | 21-225_191B8 | NA | CAAGGAGACACCCTCAGACC CTATTATGCAAGT SEQ ID NO:3593 | GGTAAAAACAACCGGCC CTCA SEQ ID NO:11605 | AACTCCCGGGACAGCAGTGG TAACCATCTGTGGTA SEQ ID NO:19617 |
| | | AA | QGDTLRPYYAS SEQ ID NO:3594 | GKNNRPS SEQ ID NO:11606 | NSRDSSGNHLVV SEQ ID NO:19618 |
| iPS:436994 | 21-225_191A9 | NA | CAAGGAGACAGCCTCAGAC CCTATTATGCAAGC SEQ ID NO:3595 | GGTAAAAACAACCGGCC CTCA SEQ ID NO:11607 | AACTCCCGGGACAGCAGTGTGG TAACCATCTGTGGTA SEQ ID NO:19619 |
| | | AA | QGDSLRPYYAS SEQ ID NO:3596 | GKNNRPS SEQ ID NO:11608 | NSRDSCGNHLVV SEQ ID NO:19620 |
| iPS:436996 | 21-225_191B9 | NA | TCTGGAAGCAGCTCCAACAT CGGGAATAATTATGTATCC SEQ ID NO:3597 | GACAATAAAAGCGACC CTCA SEQ ID NO:11609 | GGAACATGGATAGCAGCCT GAGTGTTTGTGTC SEQ ID NO:19621 |
| | | AA | SGSSSNIGNNYVS SEQ ID NO:3598 | DNKKRPS SEQ ID NO:11610 | GTWDSSLSVCV SEQ ID NO:19622 |
| iPS:437080 | 21-225_191G9 | NA | ACCTTACGCAGTGGCATCAA TGTTGGTACCTACAGGATAT AC SEQ ID NO:3599 | TACAAATCAGACTCAGA TAAGCAGCAGGGCTCT SEQ ID NO:11611 | ATGATTTGGCACAGCAGCGC TGTGGTA SEQ ID NO:19623 |
| | | AA | TLRSGINVGTYRIY SEQ ID NO:3600 | YKSDSDKQQGS SEQ ID NO:11612 | MIWHSSAVV SEQ ID NO:19624 |
| iPS:437082 | 21-225_191H9 | NA | GCTTCCAGCACTGGAGCAGT CACCAGTGCTTACTATCCAA AC SEQ ID NO:3601 | AGTACAACAACAAACA CTCC SEQ ID NO:11613 | CTGATCTTCTATGGTGGTGT ACATGTGATA SEQ ID NO:19625 |
| | | AA | ASSTGAVTSAYYPN SEQ ID NO:3602 | STNNKHS SEQ ID NO:11614 | LIFYGGVHVI SEQ ID NO:19626 |

FIGURE 49
(Continued)

| | | | | | |
|---|---|---|---|---|---|
| iPS:437006 | 21-225_192G2 | NA | TCTGGAAGCAGCTCCAACAT TGGGAATAATTATGTATCC | GACAATAATAAGCGACC CTCA | GGAACATGGGATAGCAGCCT GAGTGCTGGGGTA |
| | | | SEQ ID NO:3603 | SEQ ID NO:1615 | SEQ ID NO:19627 |
| | | AA | SGSSSNIGNNYVS | DNNKRPS | GTWDSSLSAGV |
| | | | SEQ ID NO:3604 | SEQ ID NO:1616 | SEQ ID NO:19628 |
| iPS:437008 | 21-225_192E3 | NA | GCTTTCAGCACTGGATCAGT CACCAGTGGTTCCTATCCAA AC | AGTACAAACAACAAACA CTCC | CTGCTATACTATGGTGGTGC TCAGCTGGTG |
| | | | SEQ ID NO:3605 | SEQ ID NO:1617 | SEQ ID NO:19629 |
| | | AA | AFSTGSVTSGSYPN | STNNKHS | LLYYGGAQLV |
| | | | SEQ ID NO:3606 | SEQ ID NO:1618 | SEQ ID NO:19630 |
| iPS:437010 | 21-225_192G3 | NA | TCTGGAAGCAGCTCCAACAT CGGAAGTAATACTGTAAAC | GGTAATAAGCAGCGGCC CTCA | GCAGCGTGGGATGACAGCCT GAATGGTTGGGTG |
| | | | SEQ ID NO:3607 | SEQ ID NO:1619 | SEQ ID NO:19631 |
| | | AA | SGSSSNIGSNTVN | GNKQRPS | AAWDDSLNGWV |
| | | | SEQ ID NO:3608 | SEQ ID NO:1620 | SEQ ID NO:19632 |
| iPS:437012 | 21-225_192G7 | NA | GCTTCCAGCACTGGAGCAGT CACCAGTGGTAACTATCCAC AG | AGTACAACCAACAAGACA TTCC | CTGTTCTACTATGGTGGTGCT CAGGTGATA |
| | | | SEQ ID NO:3609 | SEQ ID NO:1621 | SEQ ID NO:19633 |
| | | AA | ASSTGAVTSGNYPQ | STTNRHS | LFYYGGAQVI |
| | | | SEQ ID NO:3610 | SEQ ID NO:1622 | SEQ ID NO:19634 |
| iPS:437014 | 21-225_192H8 | NA | GCTTTCAGCACTGGAACAGT CACCAGTGGTTTCTATCCAA AC | AATACAAGCAACAAGACA CTCC | CTGCTGTACTATGGTGGTGC TCAGCTGATG |
| | | | SEQ ID NO:3611 | SEQ ID NO:1623 | SEQ ID NO:19635 |
| | | AA | AFSTGTVTSGFYPN | NTSNRHS | LLYYGGAQLM |
| | | | SEQ ID NO:3612 | SEQ ID NO:1624 | SEQ ID NO:19636 |

FIGURE 49
(Continued)

| | | | | | | |
|---|---|---|---|---|---|---|
| iPS:437016 | 21-225_193A6 | NA | CAAGGAGACAGCCTCAGAAGCTATTATGCAAAC | | GCTAAGAACAACCGGCCCTCA | | AATTCCCGGGACAGCAGTGGTAACCATCTGGTA |
| | | | SEQ ID NO:3613 | | SEQ ID NO:11625 | | SEQ ID NO:19637 |
| | | AA | QGDSLRSYYAN | | AKNNRPS | | NSRDSSGNHLV |
| | | | SEQ ID NO:3614 | | SEQ ID NO:11626 | | SEQ ID NO:19638 |
| iPS:437018 | 21-225_193H5 | NA | TCTGGAGATAAATTGGGGGATAGATTTGCTTGC | | CAAGATAGCAAGCGGCCCTCA | | CAGGCGTGGGACAGCAGCACTGCGGTA |
| | | | SEQ ID NO:3615 | | SEQ ID NO:11627 | | SEQ ID NO:19639 |
| | | AA | SGDKLGDRFAC | | QDSKRPS | | QAWDSSTAV |
| | | | SEQ ID NO:3616 | | SEQ ID NO:11628 | | SEQ ID NO:19640 |
| iPS:437020 | 21-225_193F11 | NA | TTCGGAGGCAGCTCCAACATTGGGAATAATTATGTATCC | | GACAATAATAAGCGACCCTCA | | GGAACATGGGATCGCACCATGAGTGATTGGGTA |
| | | | SEQ ID NO:3617 | | SEQ ID NO:11629 | | SEQ ID NO:19641 |
| | | AA | FGGSSNIGNNYVS | | DNNKRPS | | GTWDRTMSDWV |
| | | | SEQ ID NO:3618 | | SEQ ID NO:11630 | | SEQ ID NO:19642 |
| iPS:437022 | 21-225_194G5 | NA | GCTTCCAGCACTGGAGCAGTCACCAGTGGTAACTATCCAAC | | AGTACAAGCAACAAACACTCC | | CTGATCTACTATGGTGGTGCTCAGCTGATG |
| | | | SEQ ID NO:3619 | | SEQ ID NO:11631 | | SEQ ID NO:19643 |
| | | AA | ASSTGAVTSGNYPN | | STSNKHS | | LIYYGGAQLM |
| | | | SEQ ID NO:3620 | | SEQ ID NO:11632 | | SEQ ID NO:19644 |
| iPS:437024 | 21-225_194F11 | NA | TCTGGAAGCAGCTCCAACATTGGGAATAATTATGTATCC | | GACAATAATAAGCGACCCTCA | | GGAACATGGGATAGCAGCCTGAGTGCTGGGGTT |
| | | | SEQ ID NO:3621 | | SEQ ID NO:11633 | | SEQ ID NO:19645 |
| | | AA | SGSSSNIGNNYVS | | DNNKRPS | | GTWDSSLSAGV |
| | | | SEQ ID NO:3622 | | SEQ ID NO:11634 | | SEQ ID NO:19646 |

FIGURE 49
(Continued)

| | | | GCTTCCAGCACTGGAGCAGT CACCAGTGGTTCCTTCCAAGC | AGTACAAGCAACAGACACTCC | CTGATCTACTACTATGGTGGTGCTCAGCTGGCA |
|---|---|---|---|---|---|
| iPS:437026 | 21-225_194D12 | NA | SEQ ID NO:3623 | SEQ ID NO:11635 | SEQ ID NO:19647 |
| | | AA | ASSTGAVTSGSFPS | STSNRHS | LIYYGGAQLA |
| | | | SEQ ID NO:3624 | SEQ ID NO:11636 | SEQ ID NO:19648 |
| iPS:437028 | 21-225_194G12 | NA | TCTGGAAGCAGCTCCAACATTGGGAATAATTATGTATCC | GACAATAATAAGCGACCCTCA | GGAACATGGGATAGCAGCCTGAGTGTTGGGGTA |
| | | | SEQ ID NO:3625 | SEQ ID NO:11637 | SEQ ID NO:19649 |
| | | AA | SGSSSNIGNNYVS | DNNKRPS | GTWDSSLSVGV |
| | | | SEQ ID NO:3626 | SEQ ID NO:11638 | SEQ ID NO:19650 |
| iPS:437030 | 21-225_195E3 | NA | TCTGGAGATAAATTGGGGTATAGATCTGTTTGC | GAAGATAGCAAGCGACCCTCA | CAGGCGTGGGACAGTGTCACTGTGGTA |
| | | | SEQ ID NO:3627 | SEQ ID NO:11639 | SEQ ID NO:19651 |
| | | AA | SGDKLGYRSVC | EDSKRPS | QAWDSVTVV |
| | | | SEQ ID NO:3628 | SEQ ID NO:11640 | SEQ ID NO:19652 |
| iPS:437032 | 21-225_195H6 | NA | TCTGGAAGCAGCTCCAACATCGGAAGTCATACTGTAAAC | AATAATTATCAGCGGCCCTCA | GCAACATGGATGACAGCCTGAGTGTTTGGGTG |
| | | | SEQ ID NO:3629 | SEQ ID NO:11641 | SEQ ID NO:19653 |
| | | AA | SGSSSNIGSHFVN | NNYQRPS | ATWDDSLSVWV |
| | | | SEQ ID NO:3630 | SEQ ID NO:11642 | SEQ ID NO:19654 |
| iPS:437034 | 21-225_195E9 | NA | TCAGGAGATAAATTGGGGAATAAATATGCTTAC | CAAGATAGGAAGCGGCCCTCA | CAGGCGTGGGACAGAGGAATTGTGGTA |
| | | | SEQ ID NO:3631 | SEQ ID NO:11643 | SEQ ID NO:19655 |
| | | AA | SGDKLGNKYAY | QDRKRPS | QAWDRGIVV |
| | | | SEQ ID NO:3632 | SEQ ID NO:11644 | SEQ ID NO:19656 |

FIGURE 49
(Continued)

| | | | | | |
|---|---|---|---|---|---|
| iPS:437036 | 21-225_195H9 | NA | TCTGGAGGCAGCTCCAACAT TGGGAATAATTATGTATCC | GACAATAATAAGCGACC CTCA | GGAACATGGGATCGCACCAT GAGTGATTGGGTA |
| | | | SEQ ID NO:3633 | SEQ ID NO:11645 | SEQ ID NO:19657 |
| | | AA | SGGSSNIGNNYVS | DNNKRPS | GTWDRTMSDWV |
| | | | SEQ ID NO:3634 | SEQ ID NO:11646 | SEQ ID NO:19658 |
| iPS:437040 | 21-225_196E7 | NA | GCTTCCAGCACTGGAGCAGT CACCAGTGCTTACTACTCCAA AC | AGTACAAACAACAAACA CTCC | CTGATTTCTATGGTGGTGTA CATGTGATA |
| | | | SEQ ID NO:3635 | SEQ ID NO:11647 | SEQ ID NO:19659 |
| | | AA | ASSTGAVTSAYYPN | STNNKHS | LIFYGGVHVI |
| | | | SEQ ID NO:3636 | SEQ ID NO:11648 | SEQ ID NO:19660 |
| iPS:437042 | 21-225_197E8 | NA | TCTGGAAGCAGCTCCAACAT TGGGAATAATATGTATCC | GACAATAATAAGCGACC CTCA | GGAATATGGGATCGCAGTCT GAGTGTTATGGTG |
| | | | SEQ ID NO:3637 | SEQ ID NO:11649 | SEQ ID NO:19661 |
| | | AA | SGSSSNIGNKYVS | DNNKRPS | GIWDRSLSVMV |
| | | | SEQ ID NO:3638 | SEQ ID NO:11650 | SEQ ID NO:19662 |
| iPS:437044 | 21-225_197F9 | NA | TCTGGAAGCAGCAGCTCCAACAT CGGAAGTAATACTGTAAAC | AGTAATAATCAGCGGCC CTCA | GCAGCATGGGATGACAGTAT GAATGGTCCGGTG |
| | | | SEQ ID NO:3639 | SEQ ID NO:11651 | SEQ ID NO:19663 |
| | | AA | SGSSSNIGSNTVN | SNNQRPS | AAWDDSMNGPV |
| | | | SEQ ID NO:3640 | SEQ ID NO:11652 | SEQ ID NO:19664 |
| iPS:437048 | 21-225_197B11 | NA | GCTTTCAGCAGCTGGATCAGT CACCAGTGGTTCCTATCCAA AC | AGTACAAACAACAAACA CTCC | CTGCTCTACTATGGTGGTGC TCAGCTGGTG |
| | | | SEQ ID NO:3641 | SEQ ID NO:11653 | SEQ ID NO:19665 |
| | | AA | AFSTGSVTSGSYPN | STNNKHS | LLYYGGAQLV |
| | | | SEQ ID NO:3642 | SEQ ID NO:11654 | SEQ ID NO:19666 |

FIGURE 49
(Continued)

| | | | | | |
|---|---|---|---|---|---|
| iPS:437050 | 21-225_197C11 | NA | GCTTCCAGCACTGGAGCAGTCACCAGTGCTTACTATCCAAC<br>SEQ ID NO:3643 | AGTACAAGCAACAAACACTCC<br>SEQ ID NO:11655 | CTGATCTTCTATGGTGGTGTACATGTGATA<br>SEQ ID NO:19667 |
| | | AA | ASSTGAVTSAYYPN<br>SEQ ID NO:3644 | STSNKHS<br>SEQ ID NO:11656 | LIFYGGVHVI<br>SEQ ID NO:19668 |
| iPS:437054 | 21-225_194G3 | NA | TCTGGAAGCAGCTCCAACATCGGGAATAATTATATATCC<br>SEQ ID NO:3645 | GACAATAAAAAGCGACCCTCA<br>SEQ ID NO:11657 | GGAACATGGGATAGCAGCCTGAGTGTTTGTGTC<br>SEQ ID NO:19669 |
| | | AA | SGSSSNIGNNYIS<br>SEQ ID NO:3646 | DNKKRPS<br>SEQ ID NO:11658 | GTWDSSLSVCV<br>SEQ ID NO:19670 |
| iPS:437056 | 21-225_198B8 | NA | GTTCTTAGCACTGGAGCAGTCACCAGTGGTTCCTTCCAAC<br>SEQ ID NO:3647 | AGTACAAGCAACAAACATTCC<br>SEQ ID NO:11659 | ATGCTTTACAGTGGTGGAGCTCAGATGGTG<br>SEQ ID NO:19671 |
| | | AA | VLSTGAVTSGSFPN<br>SEQ ID NO:3648 | STSNKHS<br>SEQ ID NO:11660 | MLYSGGAQMV<br>SEQ ID NO:19672 |
| iPS:437058 | 21-225_199F3 | NA | TCTGGAAGCAGCTCCAACATTGGGAATAATTATGTATCC<br>SEQ ID NO:3649 | GACAATAATAAGCGCCCCTCA<br>SEQ ID NO:11661 | GGAACATGGGATAGCAGCCTGAGTGCTTGTGTC<br>SEQ ID NO:19673 |
| | | AA | SGSSSNIGNNYVS<br>SEQ ID NO:3650 | DNNKRPS<br>SEQ ID NO:11662 | GTWDSSLSACV<br>SEQ ID NO:19674 |
| iPS:437060 | 21-225_199C3 | NA | TCTGGAAGCAGCTCCAACATCGGAAGTAATACTGTAAAC<br>SEQ ID NO:3651 | AGTAATAATCAGGGCCCTCA<br>SEQ ID NO:11663 | GCAGCATGGGATGACAGCCTGAATGGTCCGGTG<br>SEQ ID NO:19675 |
| | | AA | SGSSSNIGSNTVN<br>SEQ ID NO:3652 | SNNQRPS<br>SEQ ID NO:11664 | AAWDDSLNGPV<br>SEQ ID NO:19676 |

FIGURE 49
(Continued)

| | | | | | |
|---|---|---|---|---|---|
| iPS:437062 | 21-225_200H1 | NA | GCTTCCAACACTGGAGCAGTCACCAGTGGTTCCTATCCAAAC | CATACAAACAACAAACACTCC | CTGATCTACTATGGTGGTGCTCAGCTGGTG |
| | | | SEQ ID NO:3653 | SEQ ID NO:11665 | SEQ ID NO:19677 |
| | | AA | ASNIGAVTSGSYPN | HTNNKHS | LIYYGGAQLV |
| | | | SEQ ID NO:3654 | SEQ ID NO:11666 | SEQ ID NO:19678 |
| iPS:437064 | 21-225_200G8 | NA | TCTGGAAGCAGCTCCAACCTTGGAAATAATTTTGTATCC | GACAATTATAAGCGACCCTCA | GGAACTTGGGATAGCAGCCTGAATACTGGGGTA |
| | | | SEQ ID NO:3655 | SEQ ID NO:11667 | SEQ ID NO:19679 |
| | | AA | SGSSSNLGNNFVS | DNYKRPS | GTWDSSLNTGV |
| | | | SEQ ID NO:3656 | SEQ ID NO:11668 | SEQ ID NO:19680 |
| iPS:437066 | 21-225_200G9 | NA | GCTTCCAACACTGGAGCAGTCACCAGTGGTTCCTATCCAAAT | CATACAGACAACAACAAACACTCC | CTGATCTACTATGGTGGTGCTCAGCTGGTG |
| | | | SEQ ID NO:3657 | SEQ ID NO:11669 | SEQ ID NO:19681 |
| | | AA | ASNIGAVTSGSYPN | HTDNKHS | LIYYGGAQLV |
| | | | SEQ ID NO:3658 | SEQ ID NO:11670 | SEQ ID NO:19682 |
| iPS:437068 | 21-225_200A11 | NA | GCTTCCAGCACTGGAGCAGTCACCAGTGGTTACTATCCAAAC | AGTACAAACAACAAACACTCC | CTGCTCTATTATGGTGGTGCTCACCTGGCA |
| | | | SEQ ID NO:3659 | SEQ ID NO:11671 | SEQ ID NO:19683 |
| | | AA | ASSTGAVTSGYYPN | STNNKHS | LLYYGGAHLA |
| | | | SEQ ID NO:3660 | SEQ ID NO:11672 | SEQ ID NO:19684 |
| iPS:437070 | 21-225_201G11 | NA | TCTGGAGATAAATTGGGGGATAGATTTGCTTGC | CAAGATAGCAGCGGCCCTCA | CAGGGTGGGACAGCAGCACTGTGGTA |
| | | | SEQ ID NO:3661 | SEQ ID NO:11673 | SEQ ID NO:19685 |
| | | AA | SGDKLGDRFAC | QDSKRPS | QAWDSSTVV |
| | | | SEQ ID NO:3662 | SEQ ID NO:11674 | SEQ ID NO:19686 |

FIGURE 49
(Continued)

| | | | | | |
|---|---|---|---|---|---|
| iPS:437074 | 21-225_203B2 | NA | GGGGGAAACAACATTGGAA GAAAAATGTGCAC SEQ ID NO:3663 | AGGGATAGCGACCGGCC CTCT SEQ ID NO:11675 | CAGGTGTGGGACAGGCAC TGCGGTA SEQ ID NO:19687 |
| | | AA | GGNNIGRKNVH SEQ ID NO:3664 | RDSDRPS SEQ ID NO:11676 | QVWDSGTAV SEQ ID NO:19688 |
| iPS:437076 | 21-225_203G6 | NA | TCTGGAGATAAATTGGGGGA TAGATTTGCTTGC SEQ ID NO:3665 | CAAGATAACAAGCGGCC CTCA SEQ ID NO:11677 | CAGGGGTGGGACACAGCAC TGTGGTA SEQ ID NO:19689 |
| | | AA | SGDKLGDRFAC SEQ ID NO:3666 | QDNKRPS SEQ ID NO:11678 | QAWDSSTVV SEQ ID NO:19690 |
| iPS:437082 | 21-225_205E12 | NA | GGGGGAAACAACATTGGAA GAAAAATGTGCAC SEQ ID NO:3667 | AGGGATAGCGACCGGCC CTCT SEQ ID NO:11679 | CAGGTGTGGGACAGGCAC TGCGGTA SEQ ID NO:19691 |
| | | AA | GGNNIGRKNVH SEQ ID NO:3668 | RDSDRPS SEQ ID NO:11680 | QVWDSGTAV SEQ ID NO:19692 |
| iPS:437084 | 21-225_206B5 | NA | GGGGGAAACAACATTGGAA GAAAAATGTGCAC SEQ ID NO:3669 | AGGGATAGCTACCGATC TTCT SEQ ID NO:11681 | CAGGATTGGGACAGCAGCAC TGTGGTG SEQ ID NO:19693 |
| | | AA | GGNNIGRKNVH SEQ ID NO:3670 | RDSYRSS SEQ ID NO:11682 | QDWDSSTVV SEQ ID NO:19694 |
| iPS:437086 | 21-225_209A8 | NA | TCTGGAAGCAGTCCAACAT TGGGAGTAATTTTTTATCC SEQ ID NO:3671 | GACAATAATAAGCGACC CTCA SEQ ID NO:11683 | GGAACATGGAGATAGCAGCT GAGTGCTGGGGTA SEQ ID NO:19695 |
| | | AA | SGSSSNIGSNFLS SEQ ID NO:3672 | DNNKRPS SEQ ID NO:11684 | GTWDSSLSAGV SEQ ID NO:19696 |
| iPS:437088 | 21-225_209H10 | NA | GGGGGAAACAACATTGGAA GAAAAATGTGCAC SEQ ID NO:3673 | AGGGATAGCTACCGGTC TTCT SEQ ID NO:11685 | CAGGATTGGGACAGCAGCAC TGTGGTG SEQ ID NO:19697 |
| | | AA | GGNNIGRKNVH SEQ ID NO:3674 | RDSYRSS SEQ ID NO:11686 | QDWDSSTVV SEQ ID NO:19698 |

FIGURE 49
(Continued)

| | | | | | |
|---|---|---|---|---|---|
| iPS:437090 | 21-225_210F11 | NA | GCTTTCAGCACTGGAGCAGTCACCAGTGGTAATTATCCAAAC | AGTACAAGCAACAAACACTCC | CTGCTCTACTATGGTGGTGCTCAGCTGGTG |
| | | | SEQ ID NO:3675 | SEQ ID NO:11687 | SEQ ID NO:19699 |
| | | AA | AFSTGAVTSGNYPN | STSNKHS | LLYYGGAQLV |
| | | | SEQ ID NO:3676 | SEQ ID NO:11688 | SEQ ID NO:19700 |
| iPS:437092 | 21-225_210B12 | NA | ACTGGAACCAGCAGTGACGTTGGTGGTTATAACTATGTCTCC | GAGGTCAGTAATCGGCCCTCA | AGTCATATACCAGCAGCCGCACTCTGGTA |
| | | | SEQ ID NO:3677 | SEQ ID NO:11689 | SEQ ID NO:19701 |
| | | AA | TGTSSDVGGYNYVS | EVSNRPS | SSYTSSRILV |
| | | | SEQ ID NO:3678 | SEQ ID NO:11690 | SEQ ID NO:19702 |
| iPS:437094 | 21-225_210D12 | NA | ACTGGAACCAGCAGTGACGTTGGTGGTTATAACTATGTCTCC | GAGGTCAGTAATCGGCCCTCA | AACTCATATACAAGCAGCATCACTTGGGTG |
| | | | SEQ ID NO:3679 | SEQ ID NO:11691 | SEQ ID NO:19703 |
| | | AA | TGTSSDVGGYNYVS | EVSNRPS | NSYTSSITWV |
| | | | SEQ ID NO:3680 | SEQ ID NO:11692 | SEQ ID NO:19704 |
| iPS:437096 | 21-225_210E12 | NA | ACTGGAACCAGCAGTGACGTTGGTGGTTATAACTATGTCTCC | GAGGTCAGTAATCGGCCCTCA | GGCTCATATATGTAAAGGCATCACTTGGGTG |
| | | | SEQ ID NO:3681 | SEQ ID NO:11693 | SEQ ID NO:19705 |
| | | AA | TGTSSDVGGYNYVS | EVSNRPS | GSYVKGITWV |
| | | | SEQ ID NO:3682 | SEQ ID NO:11694 | SEQ ID NO:19706 |
| iPS:437098 | 21-225_211C1 | NA | ACTGGAACCAGCAGTGACGTTGGTAGTTATAACTATGTCTCC | GAGGTCAGTAATCGGCCCTCA | AACTCATATACAAGCAGCATCACTTGGGTG |
| | | | SEQ ID NO:3683 | SEQ ID NO:11695 | SEQ ID NO:19707 |
| | | AA | TGTSSDVGSYNYVS | EVSNRPS | NSYTSSITWV |
| | | | SEQ ID NO:3684 | SEQ ID NO:11696 | SEQ ID NO:19708 |

FIGURE 49
(Continued)

| | | | | | |
|---|---|---|---|---|---|
| iPS:437100 | 21-225_211H2 | NA | GGGGGAAACAACATTGGAC GTAGAAATGTGCAC SEQ ID NO:3685 | AGAGATCGGACCCGCC CTCT SEQ ID NO:11697 | CAGGTGTGGGACAGCAGTAC TGCGGTG SEQ ID NO:19709 |
| | | AA | GGNNIGRRNVH SEQ ID NO:3686 | RDRDRPS SEQ ID NO:11698 | QVWDSSTAV SEQ ID NO:19710 |
| iPS:437102 | 21-225_211E5 | NA | TCTGGAGATGCATTGCCAAA GCAATATGCTTAT SEQ ID NO:3687 | AAAGACAGTGCGAGGCC CTCA SEQ ID NO:11699 | CAATTAGTGTACAGCAGTGA TACTTATGTC SEQ ID NO:19711 |
| | | AA | SGDALPKQYAY SEQ ID NO:3688 | KDSARPS SEQ ID NO:11700 | QLVYSSDTYV SEQ ID NO:19712 |
| iPS:437104 | 21-225_211G5 | NA | ACTGGAACCAGCAGTGACGT TGGTGGTTATAACTATGTCT CC SEQ ID NO:3689 | GAGGTCAGTAATCGGCC CTCA SEQ ID NO:11701 | AACTCATATACAAGAAGCAT CACTTGGGTG SEQ ID NO:19713 |
| | | AA | TGTSSDVGGYNYVS SEQ ID NO:3690 | EVSNRPS SEQ ID NO:11702 | NSYTRSITWV SEQ ID NO:19714 |
| iPS:437106 | 21-225_211H7 | NA | GCTTTCAGCACTGGAGCAGT CACCAGTGGTAACTATCCAA GT SEQ ID NO:3691 | AGTACAAGCAACAACAGACA CTCC SEQ ID NO:11703 | CTGCTCTACTATGGTGGTGC TCAGCTGGTG SEQ ID NO:19715 |
| | | AA | AFSTGAVTSGNYPS SEQ ID NO:3692 | STSNRHS SEQ ID NO:11704 | LLYYGGAQLV SEQ ID NO:19716 |
| iPS:437108 | 21-225_211C9 | NA | GGTTCCAGCACTGGATCAGT CACCAGTGGTTACTTTCCAA AC SEQ ID NO:3693 | AGTACAAACAACAAGCA CTCC SEQ ID NO:11705 | CTGCTCTACTATGTGGTGC TCAGCTGGCA SEQ ID NO:19717 |
| | | AA | GSSTGSVTSGYFPN SEQ ID NO:3694 | STNNKHS SEQ ID NO:11706 | LLYYGGAQLA SEQ ID NO:19718 |

FIGURE 49
(Continued)

| | | | | | |
|---|---|---|---|---|---|
| iPS:437110 | 21-225_211E9 | NA | GCTTCCAGCACTGGAGCAGT CACCAGTGGTAACTATCCAA AC | AGTACAATCAACAAACA CTCC | CTGCTCTACTACTATGGTGGTGC TCAGCTGGCA |
| | | | SEQ ID NO:3695 | SEQ ID NO:1707 | SEQ ID NO:1719 |
| | | AA | ASSTGAVTSGNYPN | STINKHS | LLYYGGAQLA |
| | | | SEQ ID NO:3696 | SEQ ID NO:1708 | SEQ ID NO:1720 |
| iPS:437112 | 21-225_212C2 | NA | ACTGGAACCAGCAGTGACGT TGGTGGTTATAACTATGTCT CC | GAGGTCAGTAATCGGCC CTCA | AGTCATATACACGCAGCAT CACTTGGGTG |
| | | | SEQ ID NO:3697 | SEQ ID NO:1709 | SEQ ID NO:1721 |
| | | AA | TGTSSDVGGYNYVS | EVRNRPS | SSYTRSITWV |
| | | | SEQ ID NO:3698 | SEQ ID NO:1710 | SEQ ID NO:1722 |
| iPS:437114 | 21-225_212A4 | NA | ACTGGAACCAGCAGTGACGT TGGTGGTTATAACTATGTCT CC | GAGGTCAGTAATCGGCC CTCA | GGCTCATATGTAAAAGGCAT CACTTGGGTG |
| | | | SEQ ID NO:3699 | SEQ ID NO:1711 | SEQ ID NO:1723 |
| | | AA | TGTSSDVGGYNYVS | EVSNRPS | GSYVKGITWV |
| | | | SEQ ID NO:3700 | SEQ ID NO:1712 | SEQ ID NO:1724 |
| iPS:437116 | 21-225_212F6 | NA | ACTGGAACCAGTAGTGACGT TGGTGGTTATAACTATGTCT CC | GAGGTCAGTAATCGGCC CTCA | AACTCATATACAAGCAGCAT CACTTGGGTG |
| | | | SEQ ID NO:3701 | SEQ ID NO:1713 | SEQ ID NO:1725 |
| | | AA | TGTSSDVGGYNYVS | EVSNRPS | NSYTSSITWV |
| | | | SEQ ID NO:3702 | SEQ ID NO:1714 | SEQ ID NO:1726 |
| iPS:437118 | 21-225_212G7 | NA | ACTGGAACCAGCAGTGACGT TGGTGGTTATATTATGTCT CC | GAGGTCAGTAATCGGCC CTCA | AACTCATATACAAGCAGCAT CACTTGGGTG |
| | | | SEQ ID NO:3703 | SEQ ID NO:1715 | SEQ ID NO:1727 |
| | | AA | TGTSSDVGGYNYVS | EVSNRPS | NSYTSSITWV |
| | | | SEQ ID NO:3704 | SEQ ID NO:1716 | SEQ ID NO:1728 |

FIGURE 49
(Continued)

| | | | | | |
|---|---|---|---|---|---|
| iPS:437120 | 21-225_212A9 | NA | GCTTCCAGCACTGGAGCAGTCACCAGTGGTTACTATCCAAAC | AGTACAAACAACAAACACTCC | CTGCTCTACTACTATGGTGGTGCTCAGGTGGGA |
| | | | SEQ ID NO:3705 | SEQ ID NO:11717 | SEQ ID NO:19729 |
| | | AA | ASSTGAVTSGYYPN | STNNKHS | LLYYGGAQVG |
| | | | SEQ ID NO:3706 | SEQ ID NO:11718 | SEQ ID NO:19730 |
| iPS:437124 | 21-225_212H12 | NA | GCTTCCAGCACTGGAGCAGTCACCAGTGGTTACTATCCAAAC | AGTACAAGCAACAAACACTCC | CTGCTCTACTACTATGGTGGTGCTCATGTGGTA |
| | | | SEQ ID NO:3707 | SEQ ID NO:11719 | SEQ ID NO:19731 |
| | | AA | ASSTGAVTSGYYPN | STSNKHS | LLYYGGAHVV |
| | | | SEQ ID NO:3708 | SEQ ID NO:11720 | SEQ ID NO:19732 |
| iPS:437128 | 21-225_213G3 | NA | ACTGGAACCAGCAGTGACGTTGGTGGTTATAACTATGTCTCC | GAGGTCAGGAATCGGCCCTCA | AACTCATATACACGCAGCATCACTTGGGTG |
| | | | SEQ ID NO:3709 | SEQ ID NO:11721 | SEQ ID NO:19733 |
| | | AA | TGTSSDVGGYNYVS | EVRNRPS | NSYTRSITWV |
| | | | SEQ ID NO:3710 | SEQ ID NO:11722 | SEQ ID NO:19734 |
| iPS:437130 | 21-225_213D5 | NA | ACTGGAACCAGCAGTGACGTTGGTGGTTATAACTATGTCTCC | GAGGTCCGTAATCGGCCCTCA | TGCTCATATATACAAGAAGAATCACTTGGGTG |
| | | | SEQ ID NO:3711 | SEQ ID NO:11723 | SEQ ID NO:19735 |
| | | AA | TGTSSDVGGYNYVS | EVRNRPS | CSYTRRITWV |
| | | | SEQ ID NO:3712 | SEQ ID NO:11724 | SEQ ID NO:19736 |
| iPS:437132 | 21-225_213F5 | NA | GGTTCCAGCACTGGGATCAGTCACCAGTGGTTACTTCCAAAC | AGTACAAACAACAAACACTCC | CTGCTCTACTTTGGTGGTGCTCAGCTGGCA |
| | | | SEQ ID NO:3713 | SEQ ID NO:11725 | SEQ ID NO:19737 |
| | | AA | GSSTGSVTSGYFPN | STNNKHS | LLYFGGAQLA |
| | | | SEQ ID NO:3714 | SEQ ID NO:11726 | SEQ ID NO:19738 |

FIGURE 49
(Continued)

| | | | | | |
|---|---|---|---|---|---|
| iPS-437134 | 21-225_213A7 | NA | ACTGGAACCAGCAGTGACGTTGGTGGTTATAACTATGTCTCC | GAGGTCAGGAATCGGCCCTCA | AGCTCATATACCAGCAGCCGCACTCTGGTA |
| | | | SEQ ID NO:3715 | SEQ ID NO:11727 | SEQ ID NO:19739 |
| | | AA | TGTSSDVGGYNYVS | EVRNRPS | SSYTSSRTLV |
| | | | SEQ ID NO:3716 | SEQ ID NO:11728 | SEQ ID NO:19740 |
| iPS-437136 | 21-225_214H3 | NA | GCTTCCAGCACTGGAGCAGTCACCAGTGGTTACTATCCAAAC | AGTACAAGCAACAAACACTCC | CTGCTCTACTATGGTGGTGCTCATGTGGTA |
| | | | SEQ ID NO:3717 | SEQ ID NO:11729 | SEQ ID NO:19741 |
| | | AA | ASSTGAVTSGYYPN | STSNKHS | LLYYGGAHVV |
| | | | SEQ ID NO:3718 | SEQ ID NO:11730 | SEQ ID NO:19742 |
| iPS-437138 | 21-225_214D8 | NA | TCTGGAAGCAGTCCAACATTGGGAATAATTATGTATCC | GACAATAATAAGCGACCCTCA | GGAGCATGGGATAGCAGCCTGAGTGCTGTGGTA |
| | | | SEQ ID NO:3719 | SEQ ID NO:11731 | SEQ ID NO:19743 |
| | | AA | SGSSSNIGNNYVS | DNNKRPS | GAWDSSLSAVV |
| | | | SEQ ID NO:3720 | SEQ ID NO:11732 | SEQ ID NO:19744 |
| iPS-437140 | 21-225_214E12 | NA | GCTTCCAGCACTGGAGCAGTCACCAGTGGCTACTATCCAAAC | AGTACAAGCAACAATAAACACTCC | CTGCTCTACTACTGTGATGGTGCCCAGCTGGTG |
| | | | SEQ ID NO:3721 | SEQ ID NO:11733 | SEQ ID NO:19745 |
| | | AA | ASSTGAVTSGYYPN | STSNKHS | LLYCDGAQLV |
| | | | SEQ ID NO:3722 | SEQ ID NO:11734 | SEQ ID NO:19746 |
| iPS-437142 | 21-225_215A3 | NA | GCTTCCAGCACTGAAGCCGTCACCAGTGGTAACTATCCAAGC | AGTACAAGCAACAAACACTCC | CTGCTCTACTACTGTGGGGCGCTCAGCTGGCA |
| | | | SEQ ID NO:3723 | SEQ ID NO:11735 | SEQ ID NO:19747 |
| | | AA | ASSTEAVTSGNYPS | STSNKHS | LLYYGGAQLA |
| | | | SEQ ID NO:3724 | SEQ ID NO:11736 | SEQ ID NO:19748 |

FIGURE 49
(Continued)

| | | | | | |
|---|---|---|---|---|---|
| iPS:437144 | 21-225_215B3 | NA | TCTGGAGATAAATTGGGGATAAATTGCTTGC<br>SEQ ID NO:3725 | CAAGATAGCAAGCGGCCCTCA<br>SEQ ID NO:11737 | CAGGGGTGTGGGACAGCAGCACTGTGGTA<br>SEQ ID NO:19749 |
| | | AA | SGDKLGDKFAC<br>SEQ ID NO:3726 | QDSKRPS<br>SEQ ID NO:11738 | QAWDSSTVV<br>SEQ ID NO:19750 |
| iPS:437146 | 21-225_215D3 | NA | ACTGGAACCAGCAGTGACATTGGTGGTTATAACTATGTCTCC<br>SEQ ID NO:3727 | GAGGTCAGTAATCGGCCCTCA<br>SEQ ID NO:11739 | AACTCATATAAAAGGGGCAGCACTTGGGTG<br>SEQ ID NO:19751 |
| | | AA | TGTSSDIGGYNYVS<br>SEQ ID NO:3728 | EVSNRPS<br>SEQ ID NO:11740 | NSYKRGSTWV<br>SEQ ID NO:19752 |
| iPS:437148 | 21-225_215H3 | NA | GCTTCCAGCACTGGAGCAGTCACCAGTGGTTACTATCCAAAC<br>SEQ ID NO:3729 | AGTACAAACAACAACAAACACTCC<br>SEQ ID NO:11741 | CTGCTCTACTATGGTGGTGCATCAGGTGGGA<br>SEQ ID NO:19753 |
| | | AA | ASSTGAVTSGYYPN<br>SEQ ID NO:3730 | STNNKHS<br>SEQ ID NO:11742 | LLYYGGAQVG<br>SEQ ID NO:19754 |
| iPS:437150 | 21-225_216A3 | NA | ACTGGAACCAGCAGTGACGTTGGTGGTTATAATTATGTCTCC<br>SEQ ID NO:3731 | GAGGTCAGTAATCGGCCCTCA<br>SEQ ID NO:11743 | AACTCATATACAAGCAGCATCACTTGGGTG<br>SEQ ID NO:19755 |
| | | AA | TGTSSDVGGYNYVS<br>SEQ ID NO:3732 | EVSNRPS<br>SEQ ID NO:11744 | NSYTSSITWV<br>SEQ ID NO:19756 |
| iPS:437154 | 21-225_216A7 | NA | GCTTCCAGCACTGGAGCAGTCACCAGTGGTTACTATCCAAAC<br>SEQ ID NO:3733 | AGTACAAACAACAACAAACACTCC<br>SEQ ID NO:11745 | CTGCTCTACTATGGTGGTGCATCAGGTGGGA<br>SEQ ID NO:19757 |
| | | AA | ASSTGAVTSGYYPN<br>SEQ ID NO:3734 | STNNKHS<br>SEQ ID NO:11746 | LLYYGGAQVG<br>SEQ ID NO:19758 |

FIGURE 49
(Continued)

| | | | | | |
|---|---|---|---|---|---|
| iPS:437158 | 21-225_216H11 | NA | GCTTCCAGCACTGGAGCAGT CACCAGTGGCTACTATCCAA AC | AGTACAAGCAATAAACA CTCC | CTGCTCTACTGTGATGGTGC TCAGCTGGTG |
| | | | SEQ ID NO:3735 | SEQ ID NO:11747 | SEQ ID NO:19759 |
| | | AA | ASSTGAVTSGYYPN | STSNKHS | LLYCDGAQLV |
| | | | SEQ ID NO:3736 | SEQ ID NO:11748 | SEQ ID NO:19760 |
| iPS:437160 | 21-225_216B12 | NA | GGGGGAGACAACATTAGAA GAAGAAATGTGCAC | AGGGATAGCAACCGGCC CTCT | CAGGTGTGGGACAGCAGCAC TGGGGTG |
| | | | SEQ ID NO:3737 | SEQ ID NO:11749 | SEQ ID NO:19761 |
| | | AA | GGDNIRRRNVH | RDSNRPS | QVWDSSTGV |
| | | | SEQ ID NO:3738 | SEQ ID NO:11750 | SEQ ID NO:19762 |
| iPS:437162 | 21-225_217B2 | NA | ACTGGAACCAGCAGTGACGT TGGTGGTTATAACTATGTCT CC | GAGGTCAGTAATCGGCC CTCA | GGCTCATATGTAAAAGGCAT CACTTGGGTG |
| | | | SEQ ID NO:3739 | SEQ ID NO:11751 | SEQ ID NO:19763 |
| | | AA | TGTSSDVGGYNYVS | EVSNRPS | GSYVKGITWV |
| | | | SEQ ID NO:3740 | SEQ ID NO:11752 | SEQ ID NO:19764 |
| iPS:437164 | 21-225_217C6 | NA | TCTGGAGATGCATTGCCAAA GCAATATGCTTAT | AAAGACAGTGAGAGGCC CTCA | CAATTAATAGTCAGCAGTGA TACTTATGTC |
| | | | SEQ ID NO:3741 | SEQ ID NO:11753 | SEQ ID NO:19765 |
| | | AA | SGDALPKQYAY | KDSERPS | QLIVSSDTYV |
| | | | SEQ ID NO:3742 | SEQ ID NO:11754 | SEQ ID NO:19766 |
| iPS:437166 | 21-225_217G11 | NA | TCTGGAGATGCATTGCCAAA ACAATATGCTTAT | AAAGACAGTGAGAGGCC CTCA | CAATTAGTGTACAGCAGTGA TACTTATGTC |
| | | | SEQ ID NO:3743 | SEQ ID NO:11755 | SEQ ID NO:19767 |
| | | AA | SGDALPKQYAY | KDSERPS | QLVYSSDTYV |
| | | | SEQ ID NO:3744 | SEQ ID NO:11756 | SEQ ID NO:19768 |
| iPS:437168 | 21_225_218G4 | NA | TCTGGAAGCAGCTCCAACAT TGGGAATAATTATGTATCC | GACAGTAATAAGGACC CTCA | GGAACATGGGATAGCAGCCT GAATACTGTGGTA |

FIGURE 49
(Continued)

| | | | | | | | |
|---|---|---|---|---|---|---|---|
| iPS:437170 | 21-225_218G4 | AA | SEQ ID NO:3745<br>SGSSSNIGNYVS<br>SEQ ID NO:3746 | SEQ ID NO:11757<br>DSNKRPS<br>SEQ ID NO:11758 | SEQ ID NO:19769<br>GTWDSSLNTVV<br>SEQ ID NO:19770 |
| iPS:437172 | 21-225_218F5 | NA | TCTAGAGATGTATTGCCGAA<br>GCAATATGCTTAT<br>SEQ ID NO:3747<br>SRDVLPKQYAY<br>SEQ ID NO:3748 | AAAGACAGTGAGAGGCC<br>CTCA<br>SEQ ID NO:11759<br>KDSERPS<br>SEQ ID NO:11760 | CAATTAGTTGTCAGCAGTGA<br>TACTTATGTC<br>SEQ ID NO:19771<br>QLVVSSDTYV<br>SEQ ID NO:19772 |
| | 21-225_219A7 | AA | ACTGGAACCAGCAGTGACGT<br>TGGTGGTTATAATTATGTCT<br>CC<br>SEQ ID NO:3749<br>TGTSSDVGGYNYVS<br>SEQ ID NO:3750 | GAGGTCAGAAATCGGCC<br>CTCA<br>SEQ ID NO:11761<br>EVRNRPS<br>SEQ ID NO:11762 | TGCTCATATACAAGGAGCAT<br>CACTTGGGTG<br>SEQ ID NO:19773<br>CSYTRSITWV<br>SEQ ID NO:19774 |
| iPS:437182 | 21-225_221H2 | NA | ACTGGAACCAGCAGTGACGT<br>TGGTGGTTATAACTATGTCT<br>CC<br>SEQ ID NO:3751<br>TGTSSDVGGYNYVS<br>SEQ ID NO:3752 | GAGGTCAGGAATCGGCC<br>CTCA<br>SEQ ID NO:11763<br>EVRNRPS<br>SEQ ID NO:11764 | AACTCATATACACGCAGCAT<br>CACTTGGGTG<br>SEQ ID NO:19775<br>NSYTRSITWV<br>SEQ ID NO:19776 |
| iPS:437184 | 21-225_221G4 | AA | ACTGGAACCAGCAGTGACGT<br>TGGTGGTTATAACTATGTCT<br>CC<br>SEQ ID NO:3753<br>TGTSSDVGGYNYVS<br>SEQ ID NO:3754 | GAGGTCAGGAATCGGCC<br>CTCA<br>SEQ ID NO:11765<br>EVRNRPS<br>SEQ ID NO:11766 | AACTCATATACACGCAGCAT<br>CACTTGGGTG<br>SEQ ID NO:19777<br>NSYTRSITWV<br>SEQ ID NO:19778 |
| iPS:437186 | 21-225_224H2 | AA | TCTGGAGATAATTTGGGGGT<br>TAAATATACTTAC<br>SEQ ID NO:3755<br>SGDNLGVKYTY | CAAGATAGCAAGCGGCC<br>CTCA<br>SEQ ID NO:11767<br>QDSKRPS | CAGGCGTGGACAGCAGCAC<br>TGTGGTA<br>SEQ ID NO:19779<br>QAWDSSTVV |

FIGURE 49
(Continued)

| | | | | | | |
|---|---|---|---|---|---|---|
| iPS:437188 | 21-225_224B11 | NA | SEQ ID NO:3756 ACTGGGAGCAGCTCCAACAT CGGGGCAGGTTATGATGTAC AC | SEQ ID NO:11768 GGTAACAGCAATCGGCC CTCA | SEQ ID NO:19780 CAGTCCTATGACAACAGCCT GAGTGGTGTG |
| | | AA | SEQ ID NO:3757 TGSSSNIGAGYDVH | SEQ ID NO:11769 GNSNRPS | SEQ ID NO:19781 QSYDNSLSGV |
| iPS:437190 | 21-225_225A9 | NA | SEQ ID NO:3758 TCTGGAGATAAATTGGGGAA TAAATATGCTGC | SEQ ID NO:11770 CAAGATAGCAAGCGGCC CTCA | SEQ ID NO:19782 CAGGCGTGGGACAGCAACAC TGCATGTGTC |
| | | AA | SEQ ID NO:3759 SGDKLGNKYAC | SEQ ID NO:11771 QDSKRPS | SEQ ID NO:19783 QAWDSNTACV |
| iPS:437192 | 21-225_225E9 | NA | SEQ ID NO:3760 TCTGGAGATAATTGGGGAA TAGATATGCTGC | SEQ ID NO:11772 CAAGATCGCAAGCGGCC CTCA | SEQ ID NO:19784 CAGGCGTGGGACAGCAGAAC TGCTGTGGTA |
| | | AA | SEQ ID NO:3761 SGDNLGNRYAC | SEQ ID NO:11773 QDRKRPS | SEQ ID NO:19785 QAWDSRTAVV |
| iPS:437194 | 21-225_226B2 | NA | SEQ ID NO:3762 TCTGGAGATACATTGGGGGG TAAATATGCTGG | SEQ ID NO:11774 CAAGATCGCAAGCGGCC CTCA | SEQ ID NO:19786 CAGGCGTGGGACAACGGCGC TGCGGTT |
| | | AA | SEQ ID NO:3763 SGDTLGGKYAW | SEQ ID NO:11775 QDRKRPS | SEQ ID NO:19787 QAWDNGAAV |
| iPS:437196 | 21-225_226B7 | NA | SEQ ID NO:3764 TCTGGAGATGCATTGCCAAG GCATTAGTTTAT | SEQ ID NO:11776 AAAGACAGTGAGAGGCC CTCA | SEQ ID NO:19788 CAATCAGCAGACAGCAGTGG TACTTATGTC |
| | | AA | SEQ ID NO:3765 SGDALPRHYVY | SEQ ID NO:11777 KDSERPS | SEQ ID NO:19789 QSADSSGTYV |
| iPS:437198 | 21-225_226F8 | NA | SEQ ID NO:3766 ACTGGGAGCAGCTCCAACAT CGGGGCAGGTTATGATGTAC AC | SEQ ID NO:11778 GGTAACAGCAATCGGCC CTCA | SEQ ID NO:19790 CAGTCCTATGACAACAGCCT GAGTGGTGTG |

FIGURE 49
(Continued)

| | | | | | | |
|---|---|---|---|---|---|---|
| iPS:437200 | 21-225_226F8 | NA | SEQ ID NO:3767 TCTGGAGATACATTGGGGGG TAAATATGCTTGG | SEQ ID NO:11779 CAAGATCGCAAGCGCC CTCA | SEQ ID NO:19791 CAGGCGTGGGACAACGGCGCC TGCGGTT | |
| | | AA | SEQ ID NO:3768 TGSSSNIGAGYDVH | SEQ ID NO:11780 GNSNRPS | SEQ ID NO:19792 QSYDNSLSGV | |
| iPS:437202 | 21-225_226A10 | NA | SEQ ID NO:3769 SGDTLGGKYAW | SEQ ID NO:11781 QDRKRPS | SEQ ID NO:19793 QAWDNGAAV | |
| | | AA | SEQ ID NO:3770 ACTGGGAGCAGTCCAACAT CGGGGCAGGTTATGATGTAC AC | SEQ ID NO:11782 GGTAACAGCAATCGGCC CTCA | SEQ ID NO:19794 CAGTCCTATGACAACAGCCT GAGTGGTGTG | |
| iPS:437204 | 21-225_227D3 | NA | SEQ ID NO:3771 TGSSSNIGAGYDVH | SEQ ID NO:11783 GNSNRPS | SEQ ID NO:19795 QSYDNSLSGV | |
| | | AA | SEQ ID NO:3772 TCTGGAGATAAATTGGGGA AAAATATGCTTGC | SEQ ID NO:11784 CAAGATAGGAAGCGCC CTCA | SEQ ID NO:19796 CAGGCGTGGGTCAACAACAC TATGATA | |
| iPS:437208 | 21-225_227E5 | NA | SEQ ID NO:3773 SGDKLGEKYAC | SEQ ID NO:11785 QDRKRPS | SEQ ID NO:19797 QAWVNNTMI | |
| | | AA | SEQ ID NO:3774 ACTGGGAGCAGTCCAACAT CGGGGCAGGTTATGATGTAC AC | SEQ ID NO:11786 GGTAACAGCAATCGGCC CTCA | SEQ ID NO:19798 CAGTCCTATGACAACAACCT GAGTGGGTG | |
| iPS:437208 | 21-225_227C10 | NA | SEQ ID NO:3775 TGSSSNIGAGYDVH | SEQ ID NO:11787 GNSNRPS | SEQ ID NO:19799 QSYDNNLSGV | |
| | | AA | SEQ ID NO:3776 TCTGGAGATAAATTGGGGGA TAAATATGTTTGT | SEQ ID NO:11788 CAAGATAGCAAGCGCC CTCA | SEQ ID NO:19800 CAGGCGTGGAACAGCAGCAA TGTGGTA | |
| iPS:437210 | 21-225_227E12 | NA | SEQ ID NO:3777 SGDKLGDKYVC | SEQ ID NO:11789 QDSKRPS | SEQ ID NO:19801 QAWNSSNVV | |
| | | AA | SEQ ID NO:3778 | SEQ ID NO:11790 | SEQ ID NO:19802 | |

FIGURE 49
(Continued)

| | | | | | |
|---|---|---|---|---|---|
| iPS:437214 | 21-225_48B12 | NA | TCTGGAGATGCATTGCCAAA AAAATATGCTTAT SEQ ID NO:3779 | GAGGACAGCAGAAACGACC CTCC SEQ ID NO:11791 | AACTCAACAGACAGCAGTGG TAATCATGTGGTA SEQ ID NO:19803 |
| | | AA | SGDALPKYAY SEQ ID NO:3780 | EDSKRPS SEQ ID NO:11792 | NSTDSSGNHVV SEQ ID NO:19804 |
| iPS:437216 | 21-225_51D5 | NA | CGGGCGAGTCAGGGCATTAA CAATTATTTAGCC SEQ ID NO:3781 | GCTGCATCCAGTTTGCA AGT SEQ ID NO:11793 | CAACAGTATTATAGTTACCC ATTCACT SEQ ID NO:19805 |
| | | AA | RASQGINNYLA SEQ ID NO:3782 | AASSLRS SEQ ID NO:11794 | QQYYSYPFT SEQ ID NO:19806 |
| iPS:437220 | 21-225_55H6 | NA | CGGGCAAGTCAGGGCATTAG AAACGATTTAGGC SEQ ID NO:3783 | GGTGCATCCAGTTTGCA AAGT SEQ ID NO:11795 | CTACAGCGTGATAGTTACCC GTTCACT SEQ ID NO:19807 |
| | | AA | RASQGIRNDLG SEQ ID NO:3784 | GASSLQS SEQ ID NO:11796 | LQRDSYPFT SEQ ID NO:19808 |
| iPS:437224 | 21-225_56H1 | NA | CGGGCGAGTCAGGGCATTAG CCATTATTTAGCC SEQ ID NO:3785 | GCTGCATCCGGTTTGCAA AGT SEQ ID NO:11797 | CAACAATATCAGAATTACCC CTTCACT SEQ ID NO:19809 |
| | | AA | RASQGISHYLA SEQ ID NO:3786 | AASGLQS SEQ ID NO:11798 | QQYQNYPFT SEQ ID NO:19810 |
| iPS:437226 | 21-225_57C2 | NA | AGGTCTAGTCAAAGCCTCGT ATACAGTGATGGAAACACCT ACTTGAAT SEQ ID NO:3787 | GAGGTTTCTAACTGGGA CTCT SEQ ID NO:11799 | GTGCAAGGTACACACTGGCC TCGGACG SEQ ID NO:19811 |
| | | AA | RSSQSLVYSDGNTYLN SEQ ID NO:3788 | EVSNWDS SEQ ID NO:11800 | VQGTHWPRT SEQ ID NO:19812 |
| iPS:437228 | 21-225_60C11 | NA | AGGGCCAGTCAGAGTGTTAG CAACGACTTAGCC SEQ ID NO:3789 | GGTGCATCCACCAGGGC CACT SEQ ID NO:11801 | CAGCAGTATAGTAACTGGCC ATTCACT SEQ ID NO:19813 |
| | | AA | RASQSVSNDLA | GASTRAT | QQYSNWPFT |

FIGURE 49
(Continued)

| | | | | | |
|---|---|---|---|---|---|
| iPS:437230 | 21-225_62H10 | NA | SEQ ID NO:3790 CGGGCAAGTCAGAGCATTAC CAGCTATTTAAAT | SEQ ID NO:11802 ACTGCATCCAGTTGCAA AGT | SEQ ID NO:19814 CAACAGAGTCACAGTTCCC ATTCACT |
| | | AA | SEQ ID NO:3791 RASQSITSYLN | SEQ ID NO:11803 TASSLQS | SEQ ID NO:19815 QQSHSFPFT |
| iPS:437232 | 21-225_63E1 | NA | SEQ ID NO:3792 CGTGCGAGTCAGGGTATTAG CAGCTACTTAGCC | SEQ ID NO:11804 GCTGCATCCAGTTGCAA AGT | SEQ ID NO:19816 CAACAGGCTAACAGTTCCC GCTCACT |
| | | AA | SEQ ID NO:3793 RASQGISSYLA | SEQ ID NO:11805 AASSLQS | SEQ ID NO:19817 QQANSFPLT |
| iPS:437234 | 21-225_64E2 | NA | SEQ ID NO:3794 CGGGCGAGTCAGGGTATTAG CAGGTGGTTAGCC | SEQ ID NO:11806 GCTGCATCCAGTTGCAA AGT | SEQ ID NO:19818 CAACAGGCTAACAGTTCCC ATTCACT |
| | | AA | SEQ ID NO:3795 RASQGISRWLA | SEQ ID NO:11807 AASSLQS | SEQ ID NO:19819 QQANSFPFT |
| iPS:437248 | 21-225_97H3 | NA | SEQ ID NO:3796 AGGTCTAGTCAGAGCCTCCT GCATAGTAATGGACACAACT ATTTGGAT | SEQ ID NO:11808 TTGGGTTCTAATCGGGCC TCC | SEQ ID NO:19820 ATGCAACCTCTACAAACTCC GTTCACT |
| | | AA | SEQ ID NO:3797 RSSQSLLHSNGHNYLD | SEQ ID NO:11809 LGSNRAS | SEQ ID NO:19821 MQPLQTPFT |
| iPS:437250 | 21-225_148C6 | NA | SEQ ID NO:3798 AGGTCTAGTCAAAGCCTCGT ATACAGTGATGGAAACACCT ACTTGAAT | SEQ ID NO:11810 AAGGTTCTAACTGGGA CTCT | SEQ ID NO:19822 ATGCAAGGTACACACTGGTC GCTCACT |
| | | AA | SEQ ID NO:3799 RSSQSLVYSDGNTYLN | SEQ ID NO:11811 KVSNWDS | SEQ ID NO:19823 MQGTHWSLT |
| | | | SEQ ID NO:3800 | SEQ ID NO:11812 | SEQ ID NO:19824 |

FIGURE 49
(Continued)

| | | | | | | |
|---|---|---|---|---|---|---|
| iPS:437252 | 21-225_148H11 | NA | AGGTCTAGTCAAAGCCTCGT ATACAGTGATGGAAACACCT ACTTGAAT SEQ ID NO:3801 | AAGGTTTCTAACTGGGA CTCT SEQ ID NO:11813 | ATGCAAGGTACACACTGGTT GCTCACT SEQ ID NO:19825 |
| | | AA | RSSQSLVYSDGNTYLN SEQ ID NO:3802 | KVSNWDS SEQ ID NO:11814 | MQGTHWLLT SEQ ID NO:19826 |
| iPS:437254 | 21-225_149F2 | NA | AGGTCTAGTCAAAGCCTCGT ATACAGTGATGGAAACACCT CCTTGAAT SEQ ID NO:3803 | AAGGTTTCTAACTGGGA CTCT SEQ ID NO:11815 | ATGCAAGGTACACACTGGCC TCCCACT SEQ ID NO:19827 |
| | | AA | RSSQSLVYSDGNTSLN SEQ ID NO:3804 | KVSNWDS SEQ ID NO:11816 | MQGTHWPPT SEQ ID NO:19828 |
| iPS:437256 | 21-225_150F11 | NA | AGGTCTAGTCAAAGCCTCGT ATACAGTGATGGAAACACCT CCTTGAAT SEQ ID NO:3805 | AAGGTTTCTAACTGGGA CTAT SEQ ID NO:11817 | ATGCAAGGTACACACTGGCC TCCCACT SEQ ID NO:19829 |
| | | AA | RSSQSLVYSDGNTSLN SEQ ID NO:3806 | KVSNWDY SEQ ID NO:11818 | MQGTHWPPT SEQ ID NO:19830 |
| iPS:437258 | 21-225_153F9 | NA | CGGGCGAGTCAGGGCATTAG CAATTATTTAGCC SEQ ID NO:3807 | GCTGCATCCAGTTGCAA AGT SEQ ID NO:11819 | CAACAGTATAATAGTTACCC GCTCAGT SEQ ID NO:19831 |
| | | AA | RASQGISNYLA SEQ ID NO:3808 | AASSLQS SEQ ID NO:11820 | QQYNSYPLS SEQ ID NO:19832 |
| iPS:437260 | 21-225_170D1 | NA | CGGGCGAGTCAGGACATTAG CAATTATTTAGCC SEQ ID NO:3809 | GCTGCATCCAGTTGCAA AGT SEQ ID NO:11821 | CAACAGTGTGATAGTTTCCC TCTCACT SEQ ID NO:19833 |
| | | AA | RASQDISNYLA SEQ ID NO:3810 | AASSLQS SEQ ID NO:11822 | QQCDSFPLT SEQ ID NO:19834 |
| iPS:437262 | | NA | CGGGCAAGTCAGGGCATTAG AAATGATTTAGGC | GTTGCATCCGGTTGCAA AGT | CTACAGCACAATAGTTACCC TCCGTGGACG |

FIGURE 49
(Continued)

| | | | | | | | |
|---|---|---|---|---|---|---|---|
| iPS:437264 | 21-225_170E4 | AA | SEQ ID NO:3811 RASQGIRNDLG | SEQ ID NO:11823 VASGLQS | SEQ ID NO:19835 LQHNSYPPWT | | |
| iPS:437266 | 21-225_171H12 | NA | SEQ ID NO:3812 CGGGCGAGTCAGGACATTAG CAATTATTAGCC | SEQ ID NO:11824 TCTGCATCCAGTTGCAA AGT | SEQ ID NO:19836 CAACAATCTGATAGTTACCC TCTCACT | | |
| | | AA | SEQ ID NO:3813 RASQDISNYLA | SEQ ID NO:11825 SASSLQS | SEQ ID NO:19837 QQSDSYPLT | | |
| iPS:437268 | 21-225_177A5 | NA | SEQ ID NO:3814 CGGGCGAGTCAGGACATTAG CAATTATTAGCC | SEQ ID NO:11826 TCTGCATCCAGTTGCAA AGT | SEQ ID NO:19838 CAACAATCTGATAGTTACCC TCTCACT | | |
| | | AA | SEQ ID NO:3815 RASQDISNYLA | SEQ ID NO:11827 SASSLQS | SEQ ID NO:19839 QQSDSYPLT | | |
| iPS:437270 | 21-225_177D2 | NA | SEQ ID NO:3816 AGGTCTAGTCAAAGCCTCGT ATACAGTGATGGAAACACCT ACTTGAAT | SEQ ID NO:11828 AAGGTTTCTAACTGGGA CTCT | SEQ ID NO:19840 ATGCAAGGTACACACTGGCC TCTCACT | | |
| | | AA | SEQ ID NO:3817 RSSQSLVYSDGNTYLN | SEQ ID NO:11829 KVSNWDS | SEQ ID NO:19841 MQGTHWPLT | | |
| iPS:437272 | 21-225_178H4 | NA | SEQ ID NO:3818 CGGGCGAGTCAGGACATTAG CAATTATTAGCC | SEQ ID NO:11830 TCTGCATCCAGTTGCAA AGT | SEQ ID NO:19842 CAACAATCTAATAGTTACCC TCTCACT | | |
| | | AA | SEQ ID NO:3819 RASQDISNYLA | SEQ ID NO:11831 SASSLQS | SEQ ID NO:19843 QQSNSYPLT | | |
| iPS:437274 | 21-225_196D4 | NA | SEQ ID NO:3820 CGGGCGAGTCAGGACATTAG CAATTATTAGCC | SEQ ID NO:11832 GCTGCATCCAGTTGCAA AGT | SEQ ID NO:19844 CAACATTATCTTAATTACCCT CTCACC | | |
| | | AA | SEQ ID NO:3821 RASQGISNYLA | SEQ ID NO:11833 AASSLQS | SEQ ID NO:19845 QHYLNYPLT | | |
| | | | SEQ ID NO:3822 | SEQ ID NO:11834 | SEQ ID NO:19846 | | |

FIGURE 49
(Continued)

| | | | | | |
|---|---|---|---|---|---|
| iPS:437280 | 21-225_203C10 | NA | CGGGCAAGTCAGGACATTAG AAATGATTAGGC SEQ ID NO:3823 | AGAGCATCCAGTTTGCA AAGT SEQ ID NO:11835 | CTACAGCATAATAGTTACCC GTGGACG SEQ ID NO:19847 |
| | | AA | RASQDIRNDLG SEQ ID NO:3824 | RASSLQS SEQ ID NO:11836 | LQHNSYPWT SEQ ID NO:19848 |
| iPS:437282 | 21-225_207C9 | NA | CGGGCAAGTCAGAGGTTTAG TAACTATTTAAAT SEQ ID NO:3825 | ACTGCATCCAGTTGCAA AGT SEQ ID NO:11837 | CAACAGAGTTACAGTATTCC GCTCACT SEQ ID NO:19849 |
| | | AA | RASQRFSNYLN SEQ ID NO:3826 | TASSLQS SEQ ID NO:11838 | QQSYSIPLT SEQ ID NO:19850 |
| iPS:437286 | 21-225_208F1 | NA | CGGGCAAGTCAGGGCATTAG ACATGATTAGGC SEQ ID NO:3827 | GCTGCATCCAGTTGCAA AGT SEQ ID NO:11839 | CTACAGCATTATAGTTTCCT CGGACG SEQ ID NO:19851 |
| | | AA | RASQGIRHDLG SEQ ID NO:3828 | AASSLQS SEQ ID NO:11840 | LQHYSFPRT SEQ ID NO:19852 |
| iPS:437290 | 21-225_210G6 | NA | CGGGCAAGTCAGGGCATTAG ACATGATTAGGC SEQ ID NO:3829 | GCTGCATCCAGTTCGCA AAGT SEQ ID NO:11841 | GTACAGCATTATAGTTTCCC TCGGACG SEQ ID NO:19853 |
| | | AA | RASQGIRHDLG SEQ ID NO:3830 | AASSSQS SEQ ID NO:11842 | VQHYSFPRT SEQ ID NO:19854 |
| iPS:437294 | 21-225_216D5 | NA | AGGTCTAGTCAAAGCCTCGT ATACAGTGATGGAAACACCT ACTTGAAT SEQ ID NO:3831 | AAGGTTTCTAACTGGGA CTCT SEQ ID NO:11843 | ATGCAAGGTGCACACTGGTT CACC SEQ ID NO:19855 |
| | | AA | RSSQSLVYSDGNTYLN SEQ ID NO:3832 | KVSNWDS SEQ ID NO:11844 | MQGAHWFT SEQ ID NO:19856 |
| iPS:437302 | 21-225_225B11 | NA | CAGGCGAGTCAGGACATTTT CAACTATTTAAAT SEQ ID NO:3833 | GATGCATCCACTTTGGA AACA SEQ ID NO:11845 | CAACAGTATGATAATCTCCC GATCACC SEQ ID NO:19857 |
| | | AA | QASQDIFNYLN | DASTLET | QQYDNLPIT |

FIGURE 49
(Continued)

| | | | | | | | | |
|---|---|---|---|---|---|---|---|---|
| iPS:437320 | 21-225_75A1 | NA | AGGTCTAGTCAGAGCCTCCTGCATAGTAATGGACACAACTTATTTGGAT | SEQ ID NO:3834 | TTGGGTTCTAATCGGGCCTCC | SEQ ID NO:11846 | ATGCAACCTCTACAAACTCCGTTCACT | SEQ ID NO:19858 |
| | | AA | RSSQSLLHSNGHNYLD | SEQ ID NO:3835 | LGSNRAS | SEQ ID NO:11847 | MQPLQTPFT | SEQ ID NO:19859 |
| iPS:437322 | 21-225_75B1 | NA | AGGGCCAGTCAGAGTGTTAGCAGCAGCTACTTAGTC | SEQ ID NO:3836 | GGTGCATCCACCAGGGCCACT | SEQ ID NO:11848 | CAGCAGTATGGTTGCTCACCGCTCACT | SEQ ID NO:19860 |
| | | AA | RASQSVSSSYLV | SEQ ID NO:3837 | GASTRAT | SEQ ID NO:11849 | QQYGCSPLT | SEQ ID NO:19861 |
| iPS:437324 | 21-225_75C2 | NA | AGGGCCAGTCAGAGTGTTAGCAGCAGCTACTTAGCC | SEQ ID NO:3838 | GGTGCATCCAGCCAGCCGGGCCACT | SEQ ID NO:11850 | CAGCACTATGATAACTCACCGTGGACG | SEQ ID NO:19862 |
| | | AA | RASQSVYSSYLA | SEQ ID NO:3839 | GASSRAT | SEQ ID NO:11851 | QHYDNSPWT | SEQ ID NO:19863 |
| iPS:437326 | 21-225_75C10 | NA | CGGGCGAGTCAGGGCATTAGCATCTGGTTAGCC | SEQ ID NO:3840 | GCTGCATCCAGTTGCAAAGT | SEQ ID NO:11852 | CAACAGGCTAAAAGTTTCCCGCTCACT | SEQ ID NO:19864 |
| | | AA | RASQGISIWLA | SEQ ID NO:3841 | AASSLQS | SEQ ID NO:11853 | QQAKSFPLT | SEQ ID NO:19865 |
| iPS:437328 | 21-225_75D3 | NA | AGGGCCAGTCAGAGTGTTAGCAGCAGCTACTTAGCC | SEQ ID NO:3842 | GGTGCATCCAGCCGGTCCACT | SEQ ID NO:11854 | CAGCACTATGATAACTCACCGTGGACG | SEQ ID NO:19866 |
| | | AA | RASQSVYSSYLA | SEQ ID NO:3843 | GASSRST | SEQ ID NO:11855 | QHYDNSPWT | SEQ ID NO:19867 |
| iPS:437332 | 21-225_75F3 | NA | AGGGCCAGTCAGAGTGTTAGCAGCAGCTACTTAGCC | SEQ ID NO:3844 | GGTGCATCCAGCCGGGCCACT | SEQ ID NO:11856 | CAGCACTATGATAACTCACCGTGGACG | SEQ ID NO:19868 |
| | | | | SEQ ID NO:3845 | | SEQ ID NO:11857 | | SEQ ID NO:19869 |

FIGURE 49
(Continued)

| | | | | | | |
|---|---|---|---|---|---|---|
| iPS:437334 | | AA | RASQSVYSSYLA | GASSRAT | QHYDNSPWT | |
| | | | SEQ ID NO:3846 | SEQ ID NO:11858 | SEQ ID NO:19870 | |
| | 21-225_75F11 | NA | AGGGCCAGTCAGAGTGTTAGCAGAAATTTAGCC | GGTGCATCCATCAGGGCCACT | CAGCAGTATAATAACTGGCCTCCGCTCACT | |
| | | | SEQ ID NO:3847 | SEQ ID NO:11859 | SEQ ID NO:19871 | |
| iPS:437340 | | AA | RASQSVSRNLA | GASIRAT | QQYNWPPLT | |
| | | | SEQ ID NO:3848 | SEQ ID NO:11860 | SEQ ID NO:19872 | |
| | 21-225_75G9 | NA | AGGGCCAGTCCGAGTGTTGACAGCAGCTACTTAGCC | GGTGCATCCAGCAGGGCCCCT | CAGCAGTATGAAAGTTCACCGTGGACG | |
| | | | SEQ ID NO:3849 | SEQ ID NO:11861 | SEQ ID NO:19873 | |
| iPS:437344 | | AA | RASPSVDSSYLA | GASSRAP | QQYESSPWT | |
| | | | SEQ ID NO:3850 | SEQ ID NO:11862 | SEQ ID NO:19874 | |
| | 21-225_75G12 | NA | AGGGCCAGTCAGAGTGTTTACAGCAGCTACTTAGCC | GGTGCATCCAGCCGGGCCACT | CAGCACTATGATAACTCACCGTGGACG | |
| | | | SEQ ID NO:3851 | SEQ ID NO:11863 | SEQ ID NO:19875 | |
| iPS:437346 | | AA | RASQSVYSSYLA | GASSRAT | QHYDNSPWT | |
| | | | SEQ ID NO:3852 | SEQ ID NO:11864 | SEQ ID NO:19876 | |
| | 21-225_75H7 | NA | CGGGCAAGTCAGGGCATAAGAAATGATTTAGGC | GATGCATCCAGTTGCAAAGT | ATACAGCATAGTAATTACCGCTCACT | |
| | | | SEQ ID NO:3853 | SEQ ID NO:11865 | SEQ ID NO:19877 | |
| iPS:437350 | | AA | RASQGIRNDLG | DASSLQS | IQHSNYPLT | |
| | | | SEQ ID NO:3854 | SEQ ID NO:11866 | SEQ ID NO:19878 | |
| | 21-225_74A3 | NA | AGGGCCAGTCAGAGTGTTTACAGCAGCTACTTAGCC | GGTGCATCCAGCGGGTCCACT | CAGCACTCTGATAACTCACCGTGGACG | |
| | | | SEQ ID NO:3855 | SEQ ID NO:11867 | SEQ ID NO:19879 | |
| iPS:437356 | | AA | RASQSVYSSYLA | GASSRST | QHSDNSPWT | |
| | | | SEQ ID NO:3856 | SEQ ID NO:11868 | SEQ ID NO:19880 | |
| | 21_225_74B1 | NA | AAGTCCAGCCAGAGTGTTTTACACAGGTCCAACAATTACAACTACTTAGCG | TGGGCATCTACCGGGAATCC | CAGCAATATTATAGTACTCCTCCGACG | |

FIGURE 49
(Continued)

| | | | | | | |
|---|---|---|---|---|---|---|
| iPS:437361 | 21-225_74B1 | AA | SEQ ID NO:3857 KSSQSVLHRSNNYNYLA | SEQ ID NO:11869 WASTRES | SEQ ID NO:19881 QQYYSTPPT |
| | | NA | SEQ ID NO:3858 AAGTCCAGCAGAGTATTT ACACAGTCCAACAATTACA ATTACTTAGCT | SEQ ID NO:11870 TGGGCATCTACCCGGGA ATCC | SEQ ID NO:19882 CAGCAATATTATAGTACTCC GTGGACG |
| iPS:437363 | 21-225_74C1 | AA | SEQ ID NO:3859 KSSQSILHSSNNYNYLA | SEQ ID NO:11871 WASTRES | SEQ ID NO:19883 QQYYSTPWT |
| | | NA | SEQ ID NO:3860 AAGTCCAGCAGAGTGTTTT ATACAGTCCAACAATGCGA ACTACTTAGCT | SEQ ID NO:11872 TGGGCATCTACCCGGGA ATCC | SEQ ID NO:19884 CAGCAATATTATAGTACTCC GTGAGT |
| iPS:437369 | 21-225_74C10 | AA | SEQ ID NO:3861 KSSQSVLYSSNNANYLA | SEQ ID NO:11873 WASTRES | SEQ ID NO:19885 QQYYSTPCS |
| | | NA | SEQ ID NO:3862 AGGGCCAGTCAGAGTGTTTA CAGCAGTCACTTAGCC | SEQ ID NO:11874 GGTGCATCCAGCGGGC CACT | SEQ ID NO:19886 CAGCATTATGATAACTCACC GTGGACG |
| iPS:437371 | 21-225_74D6 | AA | SEQ ID NO:3863 RASQSVYSSYLA | SEQ ID NO:11875 GASSRAT | SEQ ID NO:19887 QHYDNSPWT |
| | | NA | SEQ ID NO:3864 AGGTCTAGTCAGAGCCTCGT GCATAGTAGTGGATACAACT ATTGGAT | SEQ ID NO:11876 TTGGGTTCTAATCGGGCC TCC | SEQ ID NO:19888 ATGCAAGCTCTACACCCTCC TCTCACT |
| iPS:437377 | 21-225_74D8 | AA | SEQ ID NO:3865 RSSQSLVHSSGYNYLD | SEQ ID NO:11877 LGSNRAS | SEQ ID NO:19889 MQALHPPLT |
| | | NA | SEQ ID NO:3866 AGGGCCAGTCAGAGTGTTAG CAGCAGCTACTTAGTC | SEQ ID NO:11878 GGTGCATCCACCAGGGC CACT | SEQ ID NO:19890 CAGCAGTATGGTTGCTCACC GCTCACT |
| | 21-225_74G9 | AA | SEQ ID NO:3867 RASQSVSSSYLV | SEQ ID NO:11879 GASTRAT | SEQ ID NO:19891 QQYGCSPLT |

FIGURE 49
(Continued)

| | | | | | | |
|---|---|---|---|---|---|---|
| iPS:437379 | 21-225_74H2 | NA | SEQ ID NO:3868<br>AAGTCCAGCCAGAGTGTTT<br>ACACAGCTCCAACAATAAGAA<br>ACTACTTAACT | SEQ ID NO:11880<br>TGGGCATCTACTCGGGA<br>ATCC | SEQ ID NO:19892<br>CAGCAATATTATAGTATTCC<br>TCCGACG |
| | | AA | SEQ ID NO:3869<br>KSSQSVLHSSNNKNYLT | SEQ ID NO:11881<br>WASTRES | SEQ ID NO:19893<br>QQYYSIPPT |
| iPS:437383 | 21-225_74H8 | NA | SEQ ID NO:3870<br>AGGGCCAGTCAGAGTTTTAG<br>CAGCAGCTACTTAGCC | SEQ ID NO:11882<br>GGTGCATCCAGCAGGGC<br>CACT | SEQ ID NO:19894<br>CAGCAGTATGGTAGCTCAAG<br>GACG |
| | | AA | SEQ ID NO:3871<br>RASQSFSSSYLA | SEQ ID NO:11883<br>GASSRAT | SEQ ID NO:19895<br>QQYGSSRT |
| iPS:438664 | 21-225_216G1 | NA | SEQ ID NO:3872<br>CGGGCGAGTCAGGCATTAG<br>CAGTTATTAGCC | SEQ ID NO:11884<br>GCTGCATCCAGTTGCAA<br>AGT | SEQ ID NO:19896<br>CTACGGTATGATACTTACCC<br>TCTCACT |
| | | AA | SEQ ID NO:3873<br>RASQGISSYLA | SEQ ID NO:11885<br>AASSLQS | SEQ ID NO:19897<br>LRYDTYPLT |
| iPS:441468 | 21-225_25A4.001.001 | NA | SEQ ID NO:3874<br>AAGTCCAGCCAGAGTGTTT<br>ATACAGCTCCCACAATAACA<br>ACTACTTAGCT | SEQ ID NO:11886<br>TGGGCATCTACCCGGGA<br>ATCC | SEQ ID NO:19898<br>CAGCAGTATTATAGTACTCC<br>TCCGACG |
| | | AA | SEQ ID NO:3875<br>KSSQSVLYSSHNNNYLA | SEQ ID NO:11887<br>WASTRES | SEQ ID NO:19899<br>QQYYSTPPT |
| iPS:441475 | 21-225_25A4.001.002 | NA | SEQ ID NO:3876<br>AAGTCCAGCCAGAGTGTTT<br>ATACAGCTCCCACAATAACA<br>ACTACTTAGCT | SEQ ID NO:11888<br>TGGGCATCTACCCGGGA<br>ATCC | SEQ ID NO:19900<br>CAGCAGTATTATAGTACTCC<br>TCCGACG |
| | | AA | SEQ ID NO:3877<br>KSSQSVLYSSHNNNYLA | SEQ ID NO:11889<br>WASTRES | SEQ ID NO:19901<br>QQYYSTPPT |
| | | | SEQ ID NO:3878 | SEQ ID NO:11890 | SEQ ID NO:19902 |

FIGURE 49
(Continued)

| | | | | | | |
|---|---|---|---|---|---|---|
| iPS:441482 | 21-225_25A4.001.003 | NA | AAGTCCAGCCAGAGTGTTT ATACAGTCCCACAATAACA ACTACTTAGCT SEQ ID NO:3879 | TGGGCATCTACCCGGGA ATCC SEQ ID NO:1891 | CAGCAGTATTATAGTACTCC TCCGACG SEQ ID NO:19903 |
| | | AA | KSSQSVLYSSHNNNYLA SEQ ID NO:3880 | WASTRES SEQ ID NO:1892 | QQYYSTPPT SEQ ID NO:19904 |
| iPS:441489 | 21-225_25A4.001.004 | NA | AAGTCCAGCCAGAGTGTTT ATACAGTCCCACAATAACA ACTACTTAGCT SEQ ID NO:3881 | TGGGCATCTACCCGGGA ATCC SEQ ID NO:1893 | CAGCAGTATTATAGTACTCC TCCGACG SEQ ID NO:19905 |
| | | AA | KSSQSVLYSSHNNNYLA SEQ ID NO:3882 | WASTRES SEQ ID NO:1894 | QQYYSTPPT SEQ ID NO:19906 |
| iPS:441496 | 21-225_25A4.001.005 | NA | AAGTCCAGCCAGAGTGTTT ATACAGTCCCACAATAACA ACTACTTAGCT SEQ ID NO:3883 | TGGGCATCTACCCGGGA ATCC SEQ ID NO:1895 | CAGCAGTATTATAGTACTCC TCCGACG SEQ ID NO:19907 |
| | | AA | KSSQSVLYSSHNNNYLA SEQ ID NO:3884 | WASTRES SEQ ID NO:1896 | QQYYSTPPT SEQ ID NO:19908 |
| iPS:441505 | 21-225_25A4.001.006 | NA | AAGTCCAGCCAGAGTGTTT ATACAGTCCCACAATAACA ACTACTTAGCT SEQ ID NO:3885 | TGGGCATCTACCCGGGA ATCC SEQ ID NO:1897 | CAGCAGTATTATAGTACTCC TCCGACG SEQ ID NO:19909 |
| | | AA | KSSQSVLYSSHNNNYLA SEQ ID NO:3886 | WASTRES SEQ ID NO:1898 | QQYYSTPPT SEQ ID NO:19910 |
| iPS:441512 | 21-225_25A4.001.007 | NA | AAGTCCAGCCAGAGTGTTT ATACAGTCCCACAATAACA ACTACTTAGCT SEQ ID NO:3887 | TGGGCATCTACCCGGGA ATCC SEQ ID NO:1899 | CAGCAGTATTATAGTACTCC TCCGACG SEQ ID NO:19911 |
| | | AA | KSSQSVLYSSHNNNYLA SEQ ID NO:3888 | WASTRES SEQ ID NO:11900 | QQYYSTPPT SEQ ID NO:19912 |

FIGURE 49
(Continued)

| | | | | | |
|---|---|---|---|---|---|
| iPS:441519 | 21-225_25A4.001.008 | NA | AAGTCCAGCCAGAGTGTTTT ATACAGTCCCACAATAACA ACTACTTAGCT SEQ ID NO:3889 | TGGGCATCTACCCGGGA ATCC SEQ ID NO:11901 | CAGCAGTATTATAGTACTCC TCCGACG SEQ ID NO:19913 |
| | | AA | KSSQSVLYSSHNNNYLA SEQ ID NO:3890 | WASTRES SEQ ID NO:11902 | QQYYSTPPT SEQ ID NO:19914 |
| iPS:441554 | 21-225_25A4.001.013 | NA | AAGTCCAGCCAGAGTGTTTT ATACAGTCCCACAATAACA ACTACTTAGCT SEQ ID NO:3891 | TGGGCATCTACCCGGGA ATCC SEQ ID NO:11903 | CAGCAGTATTATAGTACTCC TCCGACG SEQ ID NO:19915 |
| | | AA | KSSQSVLYSSHNNNYLA SEQ ID NO:3892 | WASTRES SEQ ID NO:11904 | QQYYSTPPT SEQ ID NO:19916 |
| iPS:441595 | 21-225_25A4.001.019 | NA | AAGTCCAGCCAGAGTGTTTT ATACAGTCCCACAATAACA ACTACTTAGCT SEQ ID NO:3893 | TGGGCATCTACCCGGGA ATCC SEQ ID NO:11905 | CAGCAGTATTATAGTACTCC TCCGACG SEQ ID NO:19917 |
| | | AA | KSSQSVLYSSHNNNYLA SEQ ID NO:3894 | WASTRES SEQ ID NO:11906 | QQYYSTPPT SEQ ID NO:19918 |
| iPS:441604 | 21-225_25A4.001.020 | NA | AAGTCCAGCCAGAGTGTTTT ATACAGTCCCACAATAACA ACTACTTAGCT SEQ ID NO:3895 | TGGGCATCTACCCGGGA ATCC SEQ ID NO:11907 | CAGCAGTATTATAGTACTCC TCCGACG SEQ ID NO:19919 |
| | | AA | KSSQSVLYSSHNNNYLA SEQ ID NO:3896 | WASTRES SEQ ID NO:11908 | QQYYSTPPT SEQ ID NO:19920 |
| iPS:441613 | 21-225_25A4.001.021 | NA | AAGTCCAGCCAGAGTGTTTT ATACAGTCCCACAATAACA ACTACTTAGCT SEQ ID NO:3897 | TGGGCATCTACCCGGGA ATCC SEQ ID NO:11909 | CAGCAGTATTATAGTACTCC TCCGACG SEQ ID NO:19921 |
| | | AA | KSSQSVLYSSHNNNYLA SEQ ID NO:3898 | WASTRES SEQ ID NO:11910 | QQYYSTPPT SEQ ID NO:19922 |

FIGURE 49
(Continued)

| | | | | | |
|---|---|---|---|---|---|
| iPS:441841 | 21-225_4A2.001.001 | NA | AAGTCCAGCCAGAGTATTT ACACAGCTCCAACAATAACA ACTACTTAGCT SEQ ID NO:3899 | TGGGCATCTACCCGGGA ATCC SEQ ID NO:11911 | CAGCAATATTATAGTACTCC AGTCACT SEQ ID NO:19923 |
| | | AA | KSSQSILHSSNNNYLA SEQ ID NO:3900 | WASTRES SEQ ID NO:11912 | QQYYSTPVT SEQ ID NO:19924 |
| iPS:441847 | 21-225_4A2.001.002 | NA | AAGTCCAGCCAGAGTATTT ACACAGCTCCAACAATAACA ACTACTTAGCT SEQ ID NO:3901 | TGGGCATCTACCCGGGA ATCC SEQ ID NO:11913 | CAGCAATATTATAATGCTCC AGTCACT SEQ ID NO:19925 |
| | | AA | KSSQSILHSSNNNYLA SEQ ID NO:3902 | WASTRES SEQ ID NO:11914 | QQYYNAPVT SEQ ID NO:19926 |
| iPS:441853 | 21-225_4A2.001.003 | NA | AAGTCCAGCCAGAGTATTT ACACAGCTCCAACAATAACA ACTACTTAGCT SEQ ID NO:3903 | TGGGCATCTACCCGGGA ATCC SEQ ID NO:11915 | CAGCAATATTATCAAACTCC AGTCACT SEQ ID NO:19927 |
| | | AA | KSSQSILHSSNNNYLA SEQ ID NO:3904 | WASTRES SEQ ID NO:11916 | QQYYQTPVT SEQ ID NO:19928 |
| iPS:441859 | 21-225_4A2.001.004 | NA | AAGTCCAGCCAGAGTATTT ACACAGCTCCAACAATAACA ACTACTTAGCT SEQ ID NO:3905 | TGGGCATCTACCCGGGA ATCC SEQ ID NO:11917 | CAGCAATATTATAATACTCC AGTCACT SEQ ID NO:19929 |
| | | AA | KSSQSILHSSNNNYLA SEQ ID NO:3906 | WASTRES SEQ ID NO:11918 | QQYYNTPVT SEQ ID NO:19930 |
| iPS:441866 | 21-225_4A2.001.005 | NA | AAGTCCAGCCAGAGTATTT ACACAGCTCCAACAATAACA ACTACTTAGCT SEQ ID NO:3907 | TGGGCATCTACCCGGGA ATCC SEQ ID NO:11919 | CAGCAATATTATAATACTCC AGTCACT SEQ ID NO:19931 |
| | | AA | KSSQSILHSSNNNYLA SEQ ID NO:3908 | WASTRES SEQ ID NO:11920 | QQYYNTPVT SEQ ID NO:19932 |

FIGURE 49
(Continued)

| iPS: | | | | | |
|---|---|---|---|---|---|
| iPS:441873 | 21-225_4A2.001.006 | NA | AAGTCCAGCCAGAGTATTTT ACACAGCTCCAACAATAACA ACTACTTAGCT SEQ ID NO:3909 | TGGGCATCTACCCGGGA ATCC SEQ ID NO:11921 | CAGCAATATTATAATACTCC AGTCACT SEQ ID NO:19933 |
| | | AA | KSSQSILHSSNNNYLA SEQ ID NO:3910 | WASTRES SEQ ID NO:11922 | QQYYNTPVT SEQ ID NO:19934 |
| iPS:441880 | 21-225_4A2.001.007 | NA | AAGTCCAGCCAGAGTATTTT ACACAGCTCCAACAATAACA ACTACTTAGCT SEQ ID NO:3911 | TGGGCATCTACCCGGGA ATCC SEQ ID NO:11923 | CAGCAATATTATAGTACTCC AGTCACT SEQ ID NO:19935 |
| | | AA | KSSQSILHSSNNNYLA SEQ ID NO:3912 | WASTRES SEQ ID NO:11924 | QQYYSTPVT SEQ ID NO:19936 |
| iPS:441884 | 21-225_4A2.001.008 | NA | AAGTCCAGCCAGAGTATTTT ACACAGCTCCAACAATAACA ACTACTTAGCT SEQ ID NO:3913 | TGGGCATCTACCCGGGA ATCC SEQ ID NO:11925 | CAGCAATATTATAGTACTCC AGTCACT SEQ ID NO:19937 |
| | | AA | KSSQSILHSSNNNYLA SEQ ID NO:3914 | WASTRES SEQ ID NO:11926 | QQYYSTPVT SEQ ID NO:19938 |
| iPS:441888 | 21-225_4A2.001.009 | NA | AAGTCCAGCCAGAGTATTTT ACACAGCTCCAACAATAACA ACTACTTAGCT SEQ ID NO:3915 | TGGGCATCTACCCGGGA ATCC SEQ ID NO:11927 | CAGCAATATTATAATGCTCC AGTCACT SEQ ID NO:19939 |
| | | AA | KSSQSILHSSNNNYLA SEQ ID NO:3916 | WASTRES SEQ ID NO:11928 | QQYYNAPVT SEQ ID NO:19940 |
| iPS:441892 | 21-225_4A2.001.010 | NA | AAGTCCAGCCAGAGTATTTT ACACAGCTCCAACAATAACA ACTACTTAGCT SEQ ID NO:3917 | TGGGCATCTACCCGGGA ATCC SEQ ID NO:11929 | CAGCAATATTATCAAACTCC AGTCACT SEQ ID NO:19941 |
| | | AA | KSSQSILHSSNNNYLA SEQ ID NO:3918 | WASTRES SEQ ID NO:11930 | QQYYQTPVT SEQ ID NO:19942 |

FIGURE 49
(Continued)

| | | | | | |
|---|---|---|---|---|---|
| iPS:441896 | 21-225_4A2.001.011 | NA | AAGTCCAGCCAGAGTATTT ACACAGCTCCAACAATAACA ACTACTTAGCT SEQ ID NO:3919 | TGGGCATCTACCCGGGA ATCC SEQ ID NO:11931 | CAGCAATATTATCAAACTCC AGTCACT SEQ ID NO:19943 |
| | | AA | KSSQSILHSSNNNNYLA SEQ ID NO:3920 | WASTRES SEQ ID NO:11932 | QQYYQTPVT SEQ ID NO:19944 |
| iPS:441900 | 21-225_4A2.001.012 | NA | AAGTCCAGCCAGAGTATTT ACACAGCTCCAACAATAACA ACTACTTAGCT SEQ ID NO:3921 | TGGGCATCTACCCGGGA ATCC SEQ ID NO:11933 | CAGCAATATTATCAAACTCC AGTCACT SEQ ID NO:19945 |
| | | AA | KSSQSILHSSNNNNYLA SEQ ID NO:3922 | WASTRES SEQ ID NO:11934 | QQYYQTPVT SEQ ID NO:19946 |
| iPS:441955 | 21-225_4A2.001.022 | NA | AAGTCCAGCCAGAGTATTT ACACAGCTCCAACAATAACA ACTACTTAGCT SEQ ID NO:3923 | TGGGCATCTACCCGGGA ATCC SEQ ID NO:11935 | CAGCAATATTATAGTACTCC AGTCACT SEQ ID NO:19947 |
| | | AA | KSSQSILHSSNNNNYLA SEQ ID NO:3924 | WASTRES SEQ ID NO:11936 | QQYYSTPVT SEQ ID NO:19948 |
| iPS:441962 | 21-225_4A2.001.023 | NA | AAGTCCAGCCAGAGTATTT ACACAGCTCCAACAATAACA ACTACTTAGCT SEQ ID NO:3925 | TGGGCATCTACCCGGGA ATCC SEQ ID NO:11937 | CAGCAATATTATAGTACTCC AGTCACT SEQ ID NO:19949 |
| | | AA | KSSQSILHSSNNNNYLA SEQ ID NO:3926 | WASTRES SEQ ID NO:11938 | QQYYSTPVT SEQ ID NO:19950 |
| iPS:441971 | 21-225_4A2.001.024 | NA | AAGTCCAGCCAGAGTATTT ACACAGCTCCAACAATAACA ACTACTTAGCT SEQ ID NO:3927 | TGGGCATCTACCCGGGA ATCC SEQ ID NO:11939 | CAGCAATATTATAGTACTCC AGTCACT SEQ ID NO:19951 |
| | | AA | KSSQSILHSSNNNNYLA SEQ ID NO:3928 | WASTRES SEQ ID NO:11940 | QQYYSTPVT SEQ ID NO:19952 |

FIGURE 49
(Continued)

| iPS:441999 | 21-225_4A2.001.028 | NA | AAGTCCAGCCAGAGTATTTT ACACAGTCCAACAATAACA ACTACTTAGCT SEQ ID NO:3929 | TGGGCATCTACCCGGGA ATCC SEQ ID NO:11941 | CAGCAATATTATAGTACTCC AGTCACT SEQ ID NO:19953 |
|---|---|---|---|---|---|
| | | AA | KSSQSILHSSNNNNYLA SEQ ID NO:3930 | WASTRES SEQ ID NO:11942 | QQYYSTPVT SEQ ID NO:19954 |
| iPS:442006 | 21-225_4A2.001.029 | NA | AAGTCCAGCCAGAGTATTTT ACACAGTCCAACAATAACA ACTACTTAGCT SEQ ID NO:3931 | TGGGCATCTACCCGGGA ATCC SEQ ID NO:11943 | CAGCAATATTATAGTACTCC AGTCACT SEQ ID NO:19955 |
| | | AA | KSSQSILHSSNNNNYLA SEQ ID NO:3932 | WASTRES SEQ ID NO:11944 | QQYYSTPVT SEQ ID NO:19956 |
| iPS:442020 | 21-225_4A2.001.031 | NA | AAGTCCAGCCAGAGTATTTT ACACAGTCCAACAATAACA ACTACTTAGCT SEQ ID NO:3933 | TGGGCATCTACCCGGGA ATCC SEQ ID NO:11945 | CAGCAATATTATAATACTCC AGTCACT SEQ ID NO:19957 |
| | | AA | KSSQSILHSSNNNNYLA SEQ ID NO:3934 | WASTRES SEQ ID NO:11946 | QQYYNTPVT SEQ ID NO:19958 |
| iPS:442050 | 21-225_4H6.004 | NA | CGGGCGAGTCAGGGTATTAG CAGGTGGTTAGCC SEQ ID NO:3935 | GGTGCATCCAGTTGCA AAGT SEQ ID NO:11947 | CAACAGGCTAACAGTTTCCC ATTCACT SEQ ID NO:19959 |
| | | AA | RASQGISRWLA SEQ ID NO:3936 | GASSLQS SEQ ID NO:11948 | QQANSFPFT SEQ ID NO:19960 |
| iPS:442059 | 21-225_4H6.005 | NA | CGGGCGAGTCAGGGTATTAG CAGGTGGTTAGCC SEQ ID NO:3937 | GGTGCATCCAGTTGCA AAGT SEQ ID NO:11949 | CAACAGGCTAACAGTTTCCC ATTCACT SEQ ID NO:19961 |
| | | AA | RASQGISRWLA SEQ ID NO:3938 | GASSLQS SEQ ID NO:11950 | QQANSFPFT SEQ ID NO:19962 |
| iPS:442065 | | NA | CGGGCGAGTCAGGGTATTAG CAGGTGGTTAGCC | GGTGCATCCAGTTGCA AAGT | CAACAGGCTAACAGTTTCCC ATTCACT |

FIGURE 49
(Continued)

| | | | | | | |
|---|---|---|---|---|---|---|
| iPS:442071 | 21-225_4H6.006 | AA | SEQ ID NO:3939<br>RASQGISRWLA<br>SEQ ID NO:3940 | SEQ ID NO:11951<br>GASSLQS<br>SEQ ID NO:11952 | SEQ ID NO:19963<br>QQANSFPFT<br>SEQ ID NO:19964 |
| | | NA | CGGGCGAGTCAGGGTATTAG<br>CAGGTGGTTAGCC<br>SEQ ID NO:3941 | GGTGCATCCAGTTGCA<br>AAGT<br>SEQ ID NO:11953 | CAACAGGCTAACAGTTCCC<br>ATTCACT<br>SEQ ID NO:19965 |
| iPS:442078 | 21-225_4H6.007 | AA | RASQGISRWLA<br>SEQ ID NO:3942 | GASSLQS<br>SEQ ID NO:11954 | QQANSFPFT<br>SEQ ID NO:19966 |
| | | NA | CGGGCGAGTCAGGGTATTAG<br>CAGGTGGTTAGCC<br>SEQ ID NO:3943 | GGTGCATCCAGTTGCA<br>AAGT<br>SEQ ID NO:11955 | CAACAGGCTAACAGTTCCC<br>ATTCACT<br>SEQ ID NO:19967 |
| iPS:442085 | 21-225_4H6.008 | AA | RASQGISRWLA<br>SEQ ID NO:3944 | GASSLQS<br>SEQ ID NO:11956 | QQANSFPFT<br>SEQ ID NO:19968 |
| | | NA | CGGGCGAGTCAGGGTATTAG<br>CAGGTGGTTAGCC<br>SEQ ID NO:3945 | GGTGCATCCAGTTGCA<br>AAGT<br>SEQ ID NO:11957 | CAACAGGCTAACAGTTCCC<br>ATTCACT<br>SEQ ID NO:19969 |
| iPS:442089 | 21-225_4H6.009 | AA | RASQGISRWLA<br>SEQ ID NO:3946 | GASSLQS<br>SEQ ID NO:11958 | QQANSFPFT<br>SEQ ID NO:19970 |
| | | NA | CGGGCGAGTCAGGGTATTAG<br>CAGGTGGTTAGCC<br>SEQ ID NO:3947 | GGTGCATCCAGTTGCA<br>AAGT<br>SEQ ID NO:11959 | CAACAGGCTAACAGTTCCC<br>ATTCACT<br>SEQ ID NO:19971 |
| iPS:442093 | 21-225_4H6.010 | AA | RASQGISRWLA<br>SEQ ID NO:3948 | GASSLQS<br>SEQ ID NO:11960 | QQANSFPFT<br>SEQ ID NO:19972 |
| | | NA | CGGGCGAGTCAGGGTATTAG<br>CAGGTGGTTAGCC<br>SEQ ID NO:3949 | GGTGCATCCAGTTGCA<br>AAGT<br>SEQ ID NO:11961 | CAACAGGCTAACAGTTCCC<br>ATTCACT<br>SEQ ID NO:19973 |
| iPS:442115 | 21-225_4H6.011 | AA | RASQGISRWLA<br>SEQ ID NO:3950 | GASSLQS<br>SEQ ID NO:11962 | QQANSFPFT<br>SEQ ID NO:19974 |
| | | NA | CGGGCAAGTCAGGGCATTAG<br>AAATGATTTAGGC | GCTGCATCCAGTTGCAA<br>AGT | CTACAGCATTATAGTTACCC<br>TCGGACG |

FIGURE 49
(Continued)

| | | | | | | |
|---|---|---|---|---|---|---|
| iPS:442122 | 21-225_5E5.003 | AA | SEQ ID NO:3951<br>RASQGIRNDLG<br>SEQ ID NO:3952 | SEQ ID NO:11963<br>AASSLQS<br>SEQ ID NO:11964 | SEQ ID NO:19975<br>LQHYSYPRT<br>SEQ ID NO:19976 | |
| | | NA | CGGGCAAGTCAGGGCATTAG<br>AAATGATTTAGGC<br>SEQ ID NO:3953 | GCTGCATCCAGTTGCAA<br>AGT<br>SEQ ID NO:11965 | CTACAGCATTATAGTTACCC<br>TCGGACG<br>SEQ ID NO:19977 | |
| iPS:442129 | 21-225_5E5.004 | AA | RASQGIRNDLG<br>SEQ ID NO:3954 | AASSLQS<br>SEQ ID NO:11966 | LQHYSYPRT<br>SEQ ID NO:19978 | |
| | | NA | CGGGCAAGTCAGGGCATTAG<br>AAATGATTTAGGC<br>SEQ ID NO:3955 | GCTGCATCCAGTTGCAA<br>AGT<br>SEQ ID NO:11967 | CTACAGCATTATAGTTACCC<br>TCGGACG<br>SEQ ID NO:19979 | |
| iPS:442136 | 21-225_5E5.005 | AA | RASQGIRNDLG<br>SEQ ID NO:3956 | AASSLQS<br>SEQ ID NO:11968 | LQHYSYPRT<br>SEQ ID NO:19980 | |
| | | NA | CGGGCAAGTCAGGGCATTAG<br>AAATGATTTAGGC<br>SEQ ID NO:3957 | GCTGCATCCAGTTGCAA<br>AGT<br>SEQ ID NO:11969 | CTACAGCATTATAGTTACCC<br>TCGGACG<br>SEQ ID NO:19981 | |
| iPS:442171 | 21-225_5E5.006 | AA | RASQGIRNDLG<br>SEQ ID NO:3958 | AASSLQS<br>SEQ ID NO:11970 | LQHYSYPRT<br>SEQ ID NO:19982 | |
| | | NA | CGGGCAAGTCAGGGCATTAG<br>AAATGATTTAGGC<br>SEQ ID NO:3959 | GCTGCATCCAGTTGCAA<br>AGT<br>SEQ ID NO:11971 | CTACAGCATTATAGTTACCC<br>TCGGACG<br>SEQ ID NO:19983 | |
| iPS:442178 | 21-225_5E5.011 | AA | RASQGIRNDLG<br>SEQ ID NO:3960 | AASSLQS<br>SEQ ID NO:11972 | LQHYSYPRT<br>SEQ ID NO:19984 | |
| | | NA | CGGGCAAGTCAGGGCATTAG<br>AAATGATTTAGGC<br>SEQ ID NO:3961 | GCTGCATCCAGTTGCAA<br>AGT<br>SEQ ID NO:11973 | CTACAGCATTATAGTTACCC<br>TCGGACG<br>SEQ ID NO:19985 | |
| iPS:442199 | 21-225_5E5.012 | AA | RASQGIRNDLG<br>SEQ ID NO:3962 | AASSLQS<br>SEQ ID NO:11974 | LQHYSYPRT<br>SEQ ID NO:19986 | |
| | | NA | CGGGCAAGTCAGGGCATTAG<br>AAATGATTTAGGC | GCTGCATCCAGTTGCAA<br>AGT | CTACAGCATTATAGTTACCC<br>TCGGACG | |

FIGURE 49
(Continued)

| | | | | | | | |
|---|---|---|---|---|---|---|---|
| iPS:442206 | 21-225_5E5.015 | AA | SEQ ID NO:3963<br>RASQGIRNDLG<br>SEQ ID NO:3964 | SEQ ID NO:11975<br>AASSLQS<br>SEQ ID NO:11976 | SEQ ID NO:19987<br>LQHYSYPRT<br>SEQ ID NO:19988 |
| | | NA | CGGGCAAGTCAGGGCATTAG<br>AAATGATTTAGGC<br>SEQ ID NO:3965 | GCTGCATCCAGTTGCAA<br>AGT<br>SEQ ID NO:11977 | CTACAGCATTATAGTTACCC<br>TCGGACG<br>SEQ ID NO:19989 |
| iPS:442213 | 21-225_5E5.016 | AA | RASQGIRNDLG<br>SEQ ID NO:3966 | AASSLQS<br>SEQ ID NO:11978 | LQHYSYPRT<br>SEQ ID NO:19990 |
| | | NA | CGGGCAAGTCAGGGCATTAG<br>AAATGATTTAGGC<br>SEQ ID NO:3967 | GCTGCATCCAGTTGCAA<br>AGT<br>SEQ ID NO:11979 | CTACAGCATTATAGTTACCC<br>TCGGACG<br>SEQ ID NO:19991 |
| iPS:442220 | 21-225_5E5.017 | AA | RASQGIRNDLG<br>SEQ ID NO:3968 | AASSLQS<br>SEQ ID NO:11980 | LQHYSYPRT<br>SEQ ID NO:19992 |
| | | NA | CGGGCAAGTCAGGGCATTAG<br>AAATGATTTAGGC<br>SEQ ID NO:3969 | GCTGCATCCAGTTGCAA<br>AGT<br>SEQ ID NO:11981 | CTACAGCATTATAGTTACCC<br>TCGGACG<br>SEQ ID NO:19993 |
| iPS:442227 | 21-225_5E5.018 | AA | RASQGIRNDLG<br>SEQ ID NO:3970 | AASSLQS<br>SEQ ID NO:11982 | LQHYSYPRT<br>SEQ ID NO:19994 |
| | | NA | CGGGCAAGTCAGGGCATTAG<br>AAATGATTTAGGC<br>SEQ ID NO:3971 | GCTGCATCCAGTTGCAA<br>AGT<br>SEQ ID NO:11983 | CTACAGCATTATAGTTACCC<br>TCGGACG<br>SEQ ID NO:19995 |
| iPS:442255 | 21-225_5E5.019 | AA | RASQGIRNDLG<br>SEQ ID NO:3972 | AASSLQS<br>SEQ ID NO:11984 | LQHYSYPRT<br>SEQ ID NO:19996 |
| | | NA | CGGGCAAGTCAGGGCATTAG<br>AAATGATTTAGGC<br>SEQ ID NO:3973 | GCTGCATCCAGTTGCAA<br>AGT<br>SEQ ID NO:11985 | CTACAGCATTATAGTTACCC<br>TCGGACG<br>SEQ ID NO:19997 |
| iPS:442262 | 21-225_5E5.023 | AA | RASQGIRNDLG<br>SEQ ID NO:3974 | AASSLQS<br>SEQ ID NO:11986 | LQHYSYPRT<br>SEQ ID NO:19998 |
| | | NA | CGGGCAAGTCAGGGCATTAG<br>AAATGATTTAGGC | GCTGCATCCAGTTGCAA<br>AGT | CTACAGCATTATAGTTACCC<br>TCGGACG |

FIGURE 49
(Continued)

| | | | | | |
|---|---|---|---|---|---|
| iPS:442269 | 21-225_5E5.024 | AA | SEQ ID NO:3975 RASQGIRNDLG | SEQ ID NO:11987 AASSLQS | SEQ ID NO:19999 LQHYSYPRT |
| | | NA | SEQ ID NO:3976 CGGGCAAGTCAGGGCATTAG AAATGATTTAGGC | SEQ ID NO:11988 GCTGCATCCAGTTGCAA AGT | SEQ ID NO:20000 CTACAGCATTATAGTTACCC TCGGACG |
| iPS:442311 | 21-225_5E5.025 | AA | SEQ ID NO:3977 RASQGIRNDLG | SEQ ID NO:11989 AASSLQS | SEQ ID NO:20001 LQHYSYPRT |
| | | NA | SEQ ID NO:3978 CGGGCAAGTCAAAACATTAT CAGCTATTTAAAT | SEQ ID NO:11990 ACTGCATCCAGTTGCAA AGT | SEQ ID NO:20002 CAACAGACTTACAGTACCCC GCTCACT |
| iPS:442317 | 21-225_7E11.001.001 | AA | SEQ ID NO:3979 RASQNIISYLN | SEQ ID NO:11991 TASSLQS | SEQ ID NO:20003 QQTYSTPLT |
| | | NA | SEQ ID NO:3980 CGGGCAAGTCAAAACATTAT CAGCTATTTAAAT | SEQ ID NO:11992 ACTGCATCCAGTTGCAA AGT | SEQ ID NO:20004 CAACAGACTTACAGTACCCC GCTCACT |
| iPS:442323 | 21-225_7E11.001.002 | AA | SEQ ID NO:3981 RASQNIISYLN | SEQ ID NO:11993 TASSLQS | SEQ ID NO:20005 QQTYSTPLT |
| | | NA | SEQ ID NO:3982 CGGGCAAGTCAAAACATTAT CAGCTATTTAAAT | SEQ ID NO:11994 ACTGCATCCAGTTGCAA AGT | SEQ ID NO:20006 CAACAGACTTACAGTACCCC GCTCACT |
| iPS:442330 | 21-225_7E11.001.003 | AA | SEQ ID NO:3983 RASQNIISYLN | SEQ ID NO:11995 TASSLQS | SEQ ID NO:20007 QQTYSTPLT |
| | | NA | SEQ ID NO:3984 CGGGCAAGTCAAAACATTAT CAGCTATTTAAAT | SEQ ID NO:11996 ACTGCATCCAGTTGCAA AGT | SEQ ID NO:20008 CAACAGACTTACAGTACCCC GCTCACT |
| iPS:442337 | 21-225_7E11.001.004 | AA | SEQ ID NO:3985 RASQNIISYLN | SEQ ID NO:11997 TASSLQS | SEQ ID NO:20009 QQTYSTPLT |
| | | NA | SEQ ID NO:3986 CGGGCAAGTCAAAACATTAT CAGCTATTTAAAT | SEQ ID NO:11998 ACTGCATCCAGTTGCAA AGT | SEQ ID NO:20010 CAACAGACTTACAGTACCCC GCTCACT |

FIGURE 49
(Continued)

| | | | | | | |
|---|---|---|---|---|---|---|
| iPS:442344 | 21-225_7E11.001.005 | AA | SEQ ID NO:3987<br>RASQNIISYLN<br>SEQ ID NO:3988 | SEQ ID NO:11999<br>TASSLQS<br>SEQ ID NO:12000 | SEQ ID NO:20011<br>QQTYSTPLT<br>SEQ ID NO:20012 |
| iPS:442351 | 21-225_7E11.001.006 | NA | CGGGCAAGTCAAAACATTAT CAGCTATTTAAAT<br>SEQ ID NO:3989 | ACTGCATCCAGTTGCAA AGT<br>SEQ ID NO:12001 | CAACAGACTTACAGTACCCC GCTCACT<br>SEQ ID NO:20013 |
| | | AA | RASQNIISYLN<br>SEQ ID NO:3990 | TASSLQS<br>SEQ ID NO:12002 | QQTYSTPLT<br>SEQ ID NO:20014 |
| iPS:442358 | 21-225_7E11.001.007 | NA | CGGGCAAGTCAAAACATTAT CAGCTATTTAAAT<br>SEQ ID NO:3991 | ACTGCATCCAGTTGCAA AGT<br>SEQ ID NO:12003 | CAACAGACTTACAGTACCCC GCTCACT<br>SEQ ID NO:20015 |
| | | AA | RASQNIISYLN<br>SEQ ID NO:3992 | TASSLQS<br>SEQ ID NO:12004 | QQTYSTPLT<br>SEQ ID NO:20016 |
| iPS:442365 | 21-225_7E11.001.008 | NA | CGGGCAAGTCAAAACATTAT CAGCTATTTAAAT<br>SEQ ID NO:3993 | ACTGCATCCAGTTGCAA AGT<br>SEQ ID NO:12005 | CAACAGACTTACAGTACCCC GCTCACT<br>SEQ ID NO:20017 |
| | | AA | RASQNIISYLN<br>SEQ ID NO:3994 | TASSLQS<br>SEQ ID NO:12006 | QQTYSTPLT<br>SEQ ID NO:20018 |
| iPS:442372 | 21-225_7E11.001.009 | NA | CGGGCAAGTCAAAACATTAT CAGCTATTTAAAT<br>SEQ ID NO:3995 | ACTGCATCCAGTTGCAA AGT<br>SEQ ID NO:12007 | CAACAGACTTACAGTACCCC GCTCACT<br>SEQ ID NO:20019 |
| | | AA | RASQNIISYLN<br>SEQ ID NO:3996 | TASSLQS<br>SEQ ID NO:12008 | QQTYSTPLT<br>SEQ ID NO:20020 |
| iPS:442379 | 21-225_7E11.001.010 | NA | CGGGCAAGTCAAAACATTAT CAGCTATTTAAAT<br>SEQ ID NO:3997 | ACTGCATCCAGTTGCAA AGT<br>SEQ ID NO:12009 | CAACAGACTTACAGTACCCC GCTCACT<br>SEQ ID NO:20021 |
| | | AA | RASQNIISYLN<br>SEQ ID NO:3998 | TASSLQS<br>SEQ ID NO:12010 | QQTYSTPLT<br>SEQ ID NO:20022 |
| | | NA | CGGGCAAGTCAAAACATTAT CAGCTATTTAAAT | ACTGCATCCAGTTGCAA AGT | CAACAGACTTACAGTACCCC GCTCACT |

FIGURE 49
(Continued)

| | | | | | | |
|---|---|---|---|---|---|---|
| iPS:442386 | 21-225_7E11.001.011 | AA | SEQ ID NO:3999<br>RASQNIISYLN<br>SEQ ID NO:4000 | SEQ ID NO:12011<br>TASSLQS<br>SEQ ID NO:12012 | SEQ ID NO:20023<br>QQTYSTPLT<br>SEQ ID NO:20024 |
| | 21-225_7E11.001.012 | NA | CGGGCAAGTCAAAACATTAT CAGCTATTTAAAT<br>SEQ ID NO:4001 | ACTGCATCCAGTTGCAA AGT<br>SEQ ID NO:12013 | CAACAGACTTACAGTACCCC GCTCACT<br>SEQ ID NO:20025 |
| iPS:442390 | 21-225_7E11.001.012 | AA | RASQNIISYLN<br>SEQ ID NO:4002 | TASSLQS<br>SEQ ID NO:12014 | QQTYSTPLT<br>SEQ ID NO:20026 |
| | 21-225_7E11.001.013 | NA | CGGGCAAGTCAAAACATTAT CAGCTATTTAAAT<br>SEQ ID NO:4003 | ACTGCATCCAGTTGCAA AGT<br>SEQ ID NO:12015 | CAACAGACTTACAGTACCCC GCTCACT<br>SEQ ID NO:20027 |
| iPS:442394 | 21-225_7E11.001.013 | AA | RASQNIISYLN<br>SEQ ID NO:4004 | TASSLQS<br>SEQ ID NO:12016 | QQTYSTPLT<br>SEQ ID NO:20028 |
| | 21-225_7E11.001.014 | NA | CGGGCAAGTCAAAACATTAT CAGCTATTTAAAT<br>SEQ ID NO:4005 | ACTGCATCCAGTTGCAA AGT<br>SEQ ID NO:12017 | CAACAGACTTACAGTACCCC GCTCACT<br>SEQ ID NO:20029 |
| iPS:442398 | 21-225_7E11.001.014 | AA | RASQNIISYLN<br>SEQ ID NO:4006 | TASSLQS<br>SEQ ID NO:12018 | QQTYSTPLT<br>SEQ ID NO:20030 |
| | 21-225_7E11.001.015 | NA | CGGGCAAGTCAAAACATTAT CAGCTATTTAAAT<br>SEQ ID NO:4007 | ACTGCATCCAGTTGCAA AGT<br>SEQ ID NO:12019 | CAACAGACTTACAGTACCCC GCTCACT<br>SEQ ID NO:20031 |
| iPS:442402 | 21-225_7E11.001.015 | AA | RASQNIISYLN<br>SEQ ID NO:4008 | TASSLQS<br>SEQ ID NO:12020 | QQTYSTPLT<br>SEQ ID NO:20032 |
| | 21-225_7E11.001.016 | NA | CGGGCAAGTCAAAACATTAT CAGCTATTTAAAT<br>SEQ ID NO:4009 | ACTGCATCCAGTTGCAA AGT<br>SEQ ID NO:12021 | CAACAGACTTACAGTACCCC GCTCACT<br>SEQ ID NO:20033 |
| iPS:442406 | 21-225_7E11.001.016 | AA | RASQNIISYLN<br>SEQ ID NO:4010 | TASSLQS<br>SEQ ID NO:12022 | QQTYSTPLT<br>SEQ ID NO:20034 |
| | | NA | CGGGCAAGTCAAAACATTAT CAGCTATTTAAAT | ACTGCATCCAGTTGCAA AGT | CAACAGACTTACAGTACCCC GCTCACT |

FIGURE 49
(Continued)

| | | | | | | | |
|---|---|---|---|---|---|---|---|
| iPS:442410 | 21-225_7E11.001.017 | AA | SEQ ID NO:4011<br>RASQNIISYLN<br>SEQ ID NO:4012 | SEQ ID NO:12023<br>TASSLQS<br>SEQ ID NO:12024 | SEQ ID NO:20035<br>QQTYSTPLT<br>SEQ ID NO:20036 |
| iPS:442417 | 21-225_7E11.001.018 | NA | CGGGCAAGTCAAAACATTAT<br>CAGCTATTTAAAT<br>SEQ ID NO:4013 | ACTGCATCCAGTTGCAA<br>AGT<br>SEQ ID NO:12025 | CAACAGACTTACAGTACCCC<br>GCTCACT<br>SEQ ID NO:20037 |
| | | AA | RASQNIISYLN<br>SEQ ID NO:4014 | TASSLQS<br>SEQ ID NO:12026 | QQTYSTPLT<br>SEQ ID NO:20038 |
| iPS:442431 | 21-225_7E11.001.019 | NA | CGGGCAAGTCAAAACATTAT<br>CAGCTATTTAAAT<br>SEQ ID NO:4015 | ACTGCATCCAGTTGCAA<br>AGT<br>SEQ ID NO:12027 | CAACAGACTTACAGTACCCC<br>GCTCACT<br>SEQ ID NO:20039 |
| | | AA | RASQNIISYLN<br>SEQ ID NO:4016 | TASSLQS<br>SEQ ID NO:12028 | QQTYSTPLT<br>SEQ ID NO:20040 |
| iPS:442438 | 21-225_7E11.001.021 | NA | CGGGCAAGTCAAAACATTAT<br>CAGCTATTTAAAT<br>SEQ ID NO:4017 | ACTGCATCCAGTTGCAA<br>AGT<br>SEQ ID NO:12029 | CAACAGACTTACAGTACCCC<br>GCTCACT<br>SEQ ID NO:20041 |
| | | AA | RASQNIISYLN<br>SEQ ID NO:4018 | TASSLQS<br>SEQ ID NO:12030 | QQTYSTPLT<br>SEQ ID NO:20042 |
| iPS:442468 | 21-225_7E11.001.022 | NA | CGGGCAAGTCAAAACATTAT<br>CAGCTATTTAAAT<br>SEQ ID NO:4019 | ACTGCATCCAGTTGCAA<br>AGT<br>SEQ ID NO:12031 | CAACAGACTTACAGTACCCC<br>GCTCACT<br>SEQ ID NO:20043 |
| | | AA | RASQNIISYLN<br>SEQ ID NO:4020 | TASSLQS<br>SEQ ID NO:12032 | QQTYSTPLT<br>SEQ ID NO:20044 |
| iPS:442568 | 21-225_149D8 | NA | AGGGCCAGTCAGAGTGTGAT<br>CAGCAGCTACTTAGCC<br>SEQ ID NO:4021 | GGTGTATCTAGTTGGGCC<br>ACT<br>SEQ ID NO:12033 | CAACAATATGGTAGGTCACC<br>ATTCAAT<br>SEQ ID NO:20045 |
| | | AA | RASQSVISSYLA<br>SEQ ID NO:4022 | GVSSWAT<br>SEQ ID NO:12034 | QQYGRSPFN<br>SEQ ID NO:20046 |

FIGURE 49
(Continued)

| | | | | |
|---|---|---|---|---|
| iPS:443003 | 21-225_43F11_LC2 | NA | ACTGGGAGCAGCTCCAACATCGGGGCAGGTTATGATGTACAC | GGTAACAGCAGCAATCGGCCCTCA | CAGTCCTATGACAACAGCCTGAGTGGTTGGTA |
| | | | SEQ ID NO:4023 | SEQ ID NO:12035 | SEQ ID NO:20047 |
| | | AA | TGSSSNIGAGYDVH | GNSNRPS | QSYDNSLSGSV |
| | | | SEQ ID NO:4024 | SEQ ID NO:12036 | SEQ ID NO:20048 |
| iPS:443005 | 21-225_43F11_LC1 | NA | AGGTCTAGTCAAAGCCTCGTATACAGTGATGGAAACACCTACTTGAAT | AAGGTTTCTAACTGGGACTCT | ATGCAAGGTACACACTGGCCGCTCACT |
| | | | SEQ ID NO:4025 | SEQ ID NO:12037 | SEQ ID NO:20049 |
| | | AA | RSSQSLVYSDGNTYLN | KVSNWDS | MQGTHWPLT |
| | | | SEQ ID NO:4026 | SEQ ID NO:12038 | SEQ ID NO:20050 |
| iPS:443006 | 21-225_25A4.001.029 | NA | AAGTCCAGCAGAGTGTTTATACAGCTCCCACAATAACAACTACTTAGCT | TGGGCATCTACCCGGAATCC | CAGCAGTATTATAGTACTCCTCCGACG |
| | | | SEQ ID NO:4027 | SEQ ID NO:12039 | SEQ ID NO:20051 |
| | | AA | KSSQSVLYSSHNNNYLA | WASTRES | QQYYSTPPT |
| | | | SEQ ID NO:4028 | SEQ ID NO:12040 | SEQ ID NO:20052 |
| iPS:443016 | 21-225_4H6.014 | NA | CGGGCAGAGTCAGGGTATTAGCAGGTGGTTAGCC | GGTGCATCCAGTTGCAAAGT | CAACAGGCTAACAGTTTCCCATTCACT |
| | | | SEQ ID NO:4029 | SEQ ID NO:12041 | SEQ ID NO:20053 |
| | | AA | RASQGISRWLA | GASSLQS | QQANSFPPT |
| | | | SEQ ID NO:4030 | SEQ ID NO:12042 | SEQ ID NO:20054 |
| iPS:443027 | 21-225_7E11.001.023 | NA | CGGGCAAGTCAAAACATTATCAGCTATTTAAAT | ACTGCATCCAGTTGCAAAGT | CAACAGACTTACAGTACCCCGCTCACT |
| | | | SEQ ID NO:4031 | SEQ ID NO:12043 | SEQ ID NO:20055 |
| | | AA | RASQNIISYLN | TASSLQS | QQTYSTPLT |
| | | | SEQ ID NO:4032 | SEQ ID NO:12044 | SEQ ID NO:20056 |

FIGURE 49
(Continued)

| | | | | | |
|---|---|---|---|---|---|
| iPS:446086 | 21-225_94D8 | NA | AAGTCCAGACAGAGTGTTTT ATACAGTCCAACAATTACA ACTACTTAACT SEQ ID NO:4033 | TGGGCATCTACCCGGGA ATCC SEQ ID NO:12045 | CAGCAATATTATAGTTCTCC TCCTACT SEQ ID NO:20057 |
| | | AA | KSRQSVLYSSNNYNYLT SEQ ID NO:4034 | WASTRES SEQ ID NO:12046 | QQYYSSPPT SEQ ID NO:20058 |
| iPS:446094 | 21-225_77E1 | NA | AAGTCCAGCCAGACTGTCTT ACACAGTCCAACAATTATA ACTACTTAGCT SEQ ID NO:4035 | TGGACATCTACCCGGGA ATCC SEQ ID NO:12047 | CACCAATATCTTAGTAGTCC TCTGACG SEQ ID NO:20059 |
| | | AA | KSSQTVLHSSNNYNYLA SEQ ID NO:4036 | WTSTRES SEQ ID NO:12048 | HQYLSSPLT SEQ ID NO:20060 |
| iPS:448904 | 21-225_65C12 | NA | AGGGCCAGTCAGAGTGTTAG CATCAACTTAGCC SEQ ID NO:4037 | GGTGCATCCACCAGGGC CACT SEQ ID NO:12049 | CAGCAGTATAATACCTGGCC TCTCACT SEQ ID NO:20061 |
| | | AA | RASQSVSINLA SEQ ID NO:4038 | GASTRAT SEQ ID NO:12050 | QQYNTWPLT SEQ ID NO:20062 |
| iPS:448906 | 21-225_72G9 | NA | CGGGCAAGTCAGAGCATTAC CAGCTATTAAAT SEQ ID NO:4039 | ACTGCATCCAGTTGCAA AGT SEQ ID NO:12051 | CAACAGAGTCACAGTTCCC ATTCACT SEQ ID NO:20063 |
| | | AA | RASQSITSYLN SEQ ID NO:4040 | TASSLQS SEQ ID NO:12052 | QQSHSFPFT SEQ ID NO:20064 |
| iPS:448908 | 21-225_50G9 | NA | TCTGGAGATAAATTGGGGGA TAAATATGCTGC SEQ ID NO:4041 | CAAGATAGCAAGCGGCC CTCA SEQ ID NO:12053 | CAGGGCGCGGAACAGCCGCAG AGGGGTA SEQ ID NO:20065 |
| | | AA | SGDKLGDKYAC SEQ ID NO:4042 | QDSKRPS SEQ ID NO:12054 | QARNSRRGV SEQ ID NO:20066 |
| iPS:451102 | 21-225_45F6 | NA | TCTGGAGATAAATTGGGGGA TAAATATGCTTCC SEQ ID NO:4043 | CAAGATAGTAAGCGGCC CTCA SEQ ID NO:12055 | CAGGGCGTGGGACAACAGAAC TATGGTA SEQ ID NO:20067 |

FIGURE 49
(Continued)

| | | | | | | |
|---|---|---|---|---|---|---|
| iPS:451104 | 21-225_49C5 | AA | SGDKLGDKYAS<br>SEQ ID NO:4044 | QDSKRPS<br>SEQ ID NO:12056 | QAWDNRTMV<br>SEQ ID NO:20068 | |
| | | NA | TCTGGAAGCAGCTCCAACAT<br>CGGAAGTAATATTGTGACC<br>SEQ ID NO:4045 | AGTAATGATCAGCGGCC<br>CTCA<br>SEQ ID NO:12057 | ACAGCATGGATGACAGCCT<br>GAATGGTTGGGTG<br>SEQ ID NO:20069 | |
| iPS:451106 | 21-225_49D10 | AA | SGSSSNIGSNIVT<br>SEQ ID NO:4046 | SNDQRPS<br>SEQ ID NO:12058 | TAWDDSLNGWV<br>SEQ ID NO:20070 | |
| | | NA | TCTGGAAGCAACTCCAACAT<br>CGGAAGTAATATTGTAACC<br>SEQ ID NO:4047 | AGTAATGATCAGCGGCC<br>CTCA<br>SEQ ID NO:12059 | GCAGCATGGATGACAGCCT<br>GAATGGTTGGGTG<br>SEQ ID NO:20071 | |
| iPS:451108 | 21-225_53E8 | AA | SGSNSNIGSNIVT<br>SEQ ID NO:4048 | SNDQRPS<br>SEQ ID NO:12060 | AAWDDSLNGWV<br>SEQ ID NO:20072 | |
| | | NA | TCTGGAAGCTGCTCCAACAT<br>CGGAAGTAATATTGTGACC<br>SEQ ID NO:4049 | AGTAATGATCAGCGGCC<br>CTCA<br>SEQ ID NO:12061 | ACAGCATGGATGACAGCCT<br>GAATGATTGGGTG<br>SEQ ID NO:20073 | |
| iPS:451110 | 21-225_74C9 | AA | SGSCSNIGSNIVT<br>SEQ ID NO:4050 | SNDQRPS<br>SEQ ID NO:12062 | TAWDDSLNDWV<br>SEQ ID NO:20074 | |
| | | NA | TCAGGAGATAAATCGGGGA<br>ATAAATATGTTTCC<br>SEQ ID NO:4051 | CAAGATAACAGGCGGCC<br>GTCA<br>SEQ ID NO:12063 | CAGGCGTGGGACAGCACCCC<br>TGTGATA<br>SEQ ID NO:20075 | |
| iPS:451112 | 21-225_53D10 | AA | SGDKSGNKYVS<br>SEQ ID NO:4052 | QDNRRPS<br>SEQ ID NO:12064 | QAWDSTPVI<br>SEQ ID NO:20076 | |
| | | NA | TCTGGAGATAAATGGGGAA<br>TAAATATGCTTGC<br>SEQ ID NO:4053 | CAAGATCGCAAGCGGCC<br>CTCA<br>SEQ ID NO:12065 | CAGGCGTGGGACAGCAGCAC<br>TGTGGTA<br>SEQ ID NO:20077 | |
| | | AA | SGDKLGNKYAC<br>SEQ ID NO:4054 | QDRKRPS<br>SEQ ID NO:12066 | QAWDSSTVV<br>SEQ ID NO:20078 | |

FIGURE 49
(Continued)

| | | | | | |
|---|---|---|---|---|---|
| iPS:451114 | 21-225_159A3 | NA | CGGGCAAGTCAGGACATTAG AAAGGATTTAGGC SEQ ID NO:4055 | CTGGCATCCAGTTTGCAA AGT SEQ ID NO:12067 | CTACAGCAGCATCATAGTTATCC TCGGACG SEQ ID NO:20079 |
| | | AA | RASQDIRKDLG SEQ ID NO:4056 | AASSLQS SEQ ID NO:12068 | LQHHSYPRT SEQ ID NO:20080 |
| iPS:451116 | 21-225_164A4 | NA | AAGTCCAGCCAGAGTGTTTT ATACAGCTCCAACAATAAGA ACTACTTAACT SEQ ID NO:4057 | TGGGCATCTACCCGGGA ATCC SEQ ID NO:12069 | CAGCAATATATTTTAGTACTCC GTGGACG SEQ ID NO:20081 |
| | | AA | KSSQSVLYSSNNKNYLT SEQ ID NO:4058 | WASTRES SEQ ID NO:12070 | QQYFSTPWT SEQ ID NO:20082 |
| iPS:451118 | 21-225_191C8 | NA | AGGGCCAGTCAGAGTGTTCG CAGTAACTTAGCC SEQ ID NO:4059 | GGTGCATCCACCAGGGC CACT SEQ ID NO:12071 | CAGCAGTCTTTTACCTGGCT CCGGACG SEQ ID NO:20083 |
| | | AA | RASQSVRSNLA SEQ ID NO:4060 | GASTRAT SEQ ID NO:12072 | QQSFTWLRT SEQ ID NO:20084 |
| iPS:451120 | 21-225_197D3 | NA | CGGGCGAGTCAGGGCATTAG AAATTATTTAGCC SEQ ID NO:4061 | GCTGCATCCAGTTTGCAA AGT SEQ ID NO:12073 | CAACATTATCTTACTTACCC GCTCACT SEQ ID NO:20085 |
| | | AA | RASQGIRNYLA SEQ ID NO:4062 | AASSLQS SEQ ID NO:12074 | QHYLTYPLT SEQ ID NO:20086 |
| iPS:451122 | 21-225_200A1 | NA | AGGGCCAGTCAGAGTGTTAA CAGCAACTATTTAGCC SEQ ID NO:4063 | GGGGCATCCAGCAGGGC CACT SEQ ID NO:12075 | CAGCAGTATGAGATCTCACC GTGGACG SEQ ID NO:20087 |
| | | AA | RASQSVNSNYLA SEQ ID NO:4064 | GASSRAT SEQ ID NO:12076 | QQYEISPWT SEQ ID NO:20088 |
| iPS:451124 | 21-225_74F6 | NA | AAGTCCAGCCAGAATATTTT ATCCAGCTCCAACAATAAGA ACTACTTAACT SEQ ID NO:4065 | TGGACATCTACCCGGGA ATCC SEQ ID NO:12077 | CAGCAATATATTTTAGTGTTCCT CTGACG SEQ ID NO:20089 |

FIGURE 49
(Continued)

| | | | | | |
|---|---|---|---|---|---|
| iPS:451127 | 21-225_164A7 | AA | KSSQNILSSSNKNYLT | WTSTRES | QQYFSVPLT |
| | | | SEQ ID NO:4066 | SEQ ID NO:12078 | SEQ ID NO:20090 |
| | | NA | AAGTCCAGCCAGAGTGTTTT ACACAGCTCCAACAATAACA ACTACTTAGCT | TGGACATCTACCCGGGA ATCC | CAGCAATATTATAGTATTCC TCTGACG |
| | | | SEQ ID NO:4067 | SEQ ID NO:12079 | SEQ ID NO:20091 |
| iPS:451129 | 21-225_94D2 | AA | KSSQSVLHSSNNNYLA | WTSTRES | QQYYSIPLT |
| | | | SEQ ID NO:4068 | SEQ ID NO:12080 | SEQ ID NO:20092 |
| | | NA | AAGTCCAGCCAGAGTGTTTT ACACAGTCCAACAATAAGA ACTACTTAACT | TGGGCATCTACTCGGGA ATCC | CAGCAATATCATAGTATTCC TCCGACG |
| | | | SEQ ID NO:4069 | SEQ ID NO:12081 | SEQ ID NO:20093 |
| iPS:451131 | 21-225_160A7 | AA | KSSQSVLHSSNNKNYLT | WASTRES | QQYHSIPPT |
| | | | SEQ ID NO:4070 | SEQ ID NO:12082 | SEQ ID NO:20094 |
| | | NA | AAGTCCAGCCAGAGTGTTTT ATCCAACTCCCACAATAACA ACTACTTAGCT | TGGGCATCTACCCGGGA ATCC | CAGCAATATTATAGTACTCC GTGCAGT |
| | | | SEQ ID NO:4071 | SEQ ID NO:12083 | SEQ ID NO:20095 |
| iPS:451133 | 21-225_95H4 | AA | KSSQSVLSNSHNNNYLA | WASTRES | QQYYSTPCS |
| | | | SEQ ID NO:4072 | SEQ ID NO:12084 | SEQ ID NO:20096 |
| | | NA | AAGTCCAGCCAGAGTGTTTT ATTCAGCTCCAACAATTATA ATTACTTAGCT | TGGGCATCTACCCGGGA ATCC | CAGCAATATCATAGTTCTCC TCTGACG |
| | | | SEQ ID NO:4073 | SEQ ID NO:12085 | SEQ ID NO:20097 |
| iPS:437240 | 21-225_84H12 | AA | KSSQSVLFSSNNYNYLA | WASTRES | QQHSSPLT |
| | | | SEQ ID NO:4074 | SEQ ID NO:12086 | SEQ ID NO:20098 |
| | | NA | CGGGCAAGTCAGGGCATTAG AAATGATTTAGGC | GCTGCATCCAGTTTGCAA AGT | TTACAGACATAATGATTACC ATTCACT |
| | | | SEQ ID NO:4075 | SEQ ID NO:12087 | SEQ ID NO:20099 |
| | | AA | RASQGIRNDLG | AASSLQS | LQHNDYPFT |

FIGURE 49
(Continued)

| | | | | | | |
|---|---|---|---|---|---|---|
| iPS:434577 | 21-225_75C11 | NA | SEQ ID NO:4076 CGGGCAAGTCAGGGCATTAG AAATGATTAGGC | SEQ ID NO:12088 GCTGCATCCAGTTTGCAA AGT | SEQ ID NO:20100 CTACAGCATAATGATTACCC ATTCACT |
| | | | SEQ ID NO:4077 RASQGIRNDLG | SEQ ID NO:12089 AASSLQS | SEQ ID NO:20101 LQHNDYPFT |
| | | AA | SEQ ID NO:4078 | SEQ ID NO:12090 | SEQ ID NO:20102 |
| iPS:435477 | 21-225_154E8 | NA | SEQ ID NO:4079 CGGGCGAGTCAGTTTATTAG CAGCTGGTTAGCC | SEQ ID NO:12091 ACTGCATCCAGTTTGCA AGT | SEQ ID NO:20103 CAACAGGCTAACAGTTCCC GTGGACG |
| | | | SEQ ID NO:4080 RASQFISSWLA | SEQ ID NO:12092 TASSLQS | SEQ ID NO:20104 QQANSFPWT |
| | | AA | | | |
| iPS:434553 | 21-225_76H12 | NA | SEQ ID NO:4081 CGGGCAAGTCAGGGCATTAG AAATGATTAGGC | SEQ ID NO:12093 GCTGCATCCAGATTGCA AAGT | SEQ ID NO:20105 CTACAGCATAATGATTACCC ATTCACT |
| | | | SEQ ID NO:4082 RASQGIRNDLG | SEQ ID NO:12094 AASRLQS | SEQ ID NO:20106 LQHNDYPFT |
| | | AA | | | |
| iPS:434927 | 21-225_86E5 | NA | SEQ ID NO:4083 CGGGCAAGTCAGGGCATTAG AAATGATTAGGC | SEQ ID NO:12095 GCTGCATCCAGTTGCAA AGT | SEQ ID NO:20107 CTACAGCATAATGATTACCC ATTCACT |
| | | | SEQ ID NO:4084 RASQGIRNDLG | SEQ ID NO:12096 AASSLQS | SEQ ID NO:20108 LQHNDYPFT |
| | | AA | | | |
| iPS:435385 | 21-225_149G7 | NA | SEQ ID NO:4085 CGGGCGAGTCAGTTTATTAG CAGCTGGTTAGCC | SEQ ID NO:12097 GCTGCATCCAGTTGCAA AGT | SEQ ID NO:20109 CAACAGGCTAACAGTTCCC GTGGACG |
| | | | SEQ ID NO:4086 RASQFISSWLA | SEQ ID NO:12098 AASSLQS | SEQ ID NO:20110 QQANSFPWT |
| | | AA | | | |

Table 2B

FIGURE 49
(Continued)

Standard
IgG Antibody
VH CDRs

| iPS# | Ab | Type | CDR1 | CDR2 | CDR3 |
|---|---|---|---|---|---|
| iPS:451135 | 21-225_64A11 | NA | AACTATGGCATGCAC SEQ ID NO:4087 | GTTATATCATATGTTGGA AGTAATAAATACTATGC AGACTCCGTGAAGGGC SEQ ID NO:12099 | AGAGGAGCAGTGGCTCGTA CTACGGGTATGGACGTC SEQ ID NO:20111 |
| | | AA | NYGMH | VISYVGSNKYYADSVKG | RGAVAPYYGMDV |
| iPS:451141 | 21-225_164B11 | NA | AATTATGATATCAAC SEQ ID NO:4089 | TGGATGACCCCTAACAG TGGTAACACAGGCTATG CACAGAAGTTCCAGGGC SEQ ID NO:12101 | AGCAGTGGCTGGTACATGTT TGACTAC SEQ ID NO:20113 |
| | | AA | NYDIN | WMTPNSGNTGYAQKFQG | SSGWYMFDY |
| iPS:451137 | 21-225_74A7 | NA | AATTATGATATCAAC SEQ ID NO:4091 | TGGATGAACCCTAACAG TGGTAACACAGGCTATG CACAGAAGTTCCAGGGC SEQ ID NO:12103 | TCCAGTGGCTGGAACTGGTT CGACCCC SEQ ID NO:20114 |
| | | AA | NYDIN | WMNPNSGNTGYAQKFQG | SSGWNWFDP |
| iPS:451139 | 21-225_71A6 | NA | AACTATGGCATGCAC SEQ ID NO:4092 | GTTATATCATATGATGGA AGTAATGAATACTATGC AGACTCCGTGAAGGGC SEQ ID NO:12105 | GATCACAGATATGGGGTTCG GGGAGGCTTTGACTAC SEQ ID NO:20116 |
| | | AA | NYGMH | VISYDGSNEYYADSVKG | DHRYGVRGGFDY SEQ ID NO:20117 |

FIGURE 49
(Continued)

| | | | | | |
|---|---|---|---|---|---|
| iPS:451143 | 21-225_66H11 | NA | SEQ ID NO:4094 ACCTATGGTATCAGC | SEQ ID NO:12106 TGGATCAGCGCTTACAA TGTAACACAAACTATG CACAGAAGCTCCAGGGC | SEQ ID NO:20118 GGGGAAGCAGTGGCTGTCTT CGACCCC |
| | | AA | SEQ ID NO:4095 TYGIS | SEQ ID NO:12107 WISAYNGNTNYAQKLQG | SEQ ID NO:20119 GEAVAVFDP |
| iPS:453445 | 21-225_148E10 | NA | SEQ ID NO:4096 AGCTATGGCATGCAC | SEQ ID NO:12108 GTTATATGGTTTGATGGC AGTAATAAATACTATGT AGACTCCGTGAAGGAC | SEQ ID NO:20120 GATCGGGTGGAGGGTTCGGG GACTCCTACTACTACTACG GTATGGACGTC |
| | | AA | SEQ ID NO:4097 SYGMH | SEQ ID NO:12109 VIWFDGSNKYYVDSVKD | SEQ ID NO:20121 DRVEGSGIPYYYYGMDV |
| iPS:453447 | 21-225_65F10 | NA | SEQ ID NO:4098 GGCTACCATATGCAC | SEQ ID NO:12110 TGGATCAACCCTAACAA TGGTGGCACAAGCTATG CACAGAAGTTTCAGGAC | SEQ ID NO:20122 GATAGTAGGTCGTCCTGGGA CTAC |
| | | AA | SEQ ID NO:4099 GYHMH | SEQ ID NO:12111 WINPNNGGTSYAQKFQD | SEQ ID NO:20123 DSRSSWDY |
| | | | SEQ ID NO:4100 | SEQ ID NO:12112 | SEQ ID NO:20124 |
| iPS:453449 | 21-225_208A2 | NA | SEQ ID NO:4101 AGTTACTACTGGAGC | SEQ ID NO:12113 CGTATCTATACCAGTGG GAGCACCGACTACAACC CCTCCCTCAAGAGT | SEQ ID NO:20125 GGGTTCGGTGACTGGGACTA C |
| | | AA | SEQ ID NO:4102 SYYWS | SEQ ID NO:12114 RIYTSGSTDYNPSLKS | SEQ ID NO:20126 GFGDWDY |

FIGURE 49
(Continued)

| | | | | | | | | |
|---|---|---|---|---|---|---|---|---|
| iPS-453451 | 21-225_52G11 | NA | GGCTACTATTTGCAC | SEQ ID NO:4103 | TGGATCAACCCTAATAGAAATGGCACAAACTATGCACAGAAGTTTCAGGGC | SEQ ID NO:12115 | GACGGTACCAGCAGCTTTGACTAC | SEQ ID NO:20127 |
| | | AA | GYYLH | SEQ ID NO:4104 | WINPNRNGTNYAQKFQG | SEQ ID NO:12116 | DGTSSFDY | SEQ ID NO:20128 |
| iPS-453453 | 21-225_53F2 | NA | GGCTACTATTTGCAC | SEQ ID NO:4105 | TGGATCAACCCTAATAGAAATGGCACAAACTATGCACAGAAGTTTCAGGGC | SEQ ID NO:12117 | GACGGTACCAGTAGCTTTGACTAC | SEQ ID NO:20129 |
| | | AA | GYYLH | SEQ ID NO:4106 | WINPNRNGTNYAQNFQG | SEQ ID NO:12118 | DGTSSFDY | SEQ ID NO:20130 |
| iPS-468810 | 21-225_74D5 | NA | GGTTGCTACTGGAGC | SEQ ID NO:4107 | GAAATCAATTATAGTGGAAGGACCAACTTCAACCCGTCCCTCAAGAGT | SEQ ID NO:12119 | GACTACGGCGGTATGGACGTC | SEQ ID NO:20131 |
| | | AA | GCYWS | SEQ ID NO:4108 | EINYSGRTNFNPSLKS | SEQ ID NO:12120 | DYGGMDV | SEQ ID NO:20132 |
| iPS-468812 | 21-225_48H4 | NA | GACTCTCTCATGCAC | SEQ ID NO:4109 | GTTATATGGTATGATGGAAGTAATAAATACTATACAGACTCCGTTAAGGGC | SEQ ID NO:12121 | GAAAACTATAGCAGTGGCTGGTACGGGTACGGTATGGACGTC | SEQ ID NO:20133 |
| | | AA | DSLMH | SEQ ID NO:4110 | VIWYDGSNKYYTDSVKG | SEQ ID NO:12122 | ENYSSGWYGYGMDV | SEQ ID NO:20134 |

FIGURE 49
(Continued)

| | | | | |
|---|---|---|---|---|
| iPS:468816 | 21-225_52G8 | NA | AGCTATGGCATGCAC | GTTATATGGTATGATGG AAGTAATAAATACTATG CAGACTCCGTGAAGGGC | AGGTATAGCAGCAGCTGGTC GGGCGGTATGGACGTC |
| | | | SEQ ID NO:4111 | SEQ ID NO:12123 | SEQ ID NO:20135 |
| | | AA | SYGMH | VIWYDGSNKYYADSVKG | RYSSSWSGGMDV |
| | | | SEQ ID NO:4112 | SEQ ID NO:12124 | SEQ ID NO:20136 |
| iPS:468814 | 21-225_223D11 | NA | AACTATGGCATGGAC | GTTATATGGTATGATGG AAGTAATGACTACTATG CAGACTCCGTGAAGGGC | GATCGGGGGATCGGGTACAA CGATATGGACGTC |
| | | | SEQ ID NO:4113 | SEQ ID NO:12125 | SEQ ID NO:20137 |
| | | AA | NYGMD | VIWYDGSNDYYADSVKG | DRGIGYNDMDV |
| | | | SEQ ID NO:4114 | SEQ ID NO:12126 | SEQ ID NO:20138 |
| iPS:468822 | 21-225_147E10 | NA | AACTATGGCTTACAC | ATTATATGGTATGATGG AAGTAATAAATACTATG CAGACTCCGTGAAGGGC | GATCATTACGATTTTTGGAG TGGTCACTTTGACTAC |
| | | | SEQ ID NO:4115 | SEQ ID NO:12127 | SEQ ID NO:20139 |
| | | AA | NYGLH | IIWYDGSNKYYADSVKG | DHYDFWSGHFDY |
| | | | SEQ ID NO:4116 | SEQ ID NO:12128 | SEQ ID NO:20140 |
| iPS:468824 | 21-225_73G6 | NA | AGCTATGGCATGCAC | GTTATATGGTATGATGTA AGTAATAAATACTATGG AGACTCCGTGAAGGGC | GAAGTGGGGATGACTTCTGA CTAC |
| | | | SEQ ID NO:4117 | SEQ ID NO:12129 | SEQ ID NO:20141 |
| | | AA | SYGMH | VIWYDVSNKYYGDSVKG | EVGMTSDY |
| | | | SEQ ID NO:4118 | SEQ ID NO:12130 | SEQ ID NO:20142 |

FIGURE 49
(Continued)

| | | | | | |
|---|---|---|---|---|---|
| iPS:468818 | 21-225_190C8 | NA | AGTTATGATATCAAC | TGGATGAACCCTAAAAGGGGTAACACAGGCTATGCACAGAAGTTCCAGGGC | GGAGACCCGTATAACTGGAACTCCTACGCTATGGACGTC |
| | | | SEQ ID NO:4119 | SEQ ID NO:12131 | SEQ ID NO:20143 |
| | | AA | SYDIN | WMNPKRGNTGYAQKFQG | GDPYNWNSYAMDV |
| | | | SEQ ID NO:4120 | SEQ ID NO:12132 | SEQ ID NO:20144 |
| | | NA | GACTATGTCATGCAC | GTATATGGTATGATGGAAGTAATAAATACTATGTAGACTCCGTGAAGGGC | GAACGGTATAGCAGTGGCTTGTACGACTACGGTATGGACGTC |
| iPS:468826 | 21-225_201C5 | | SEQ ID NO:4121 | SEQ ID NO:12133 | SEQ ID NO:20145 |
| | | AA | DYVMH | VIWYDGSNKYYVDSVKG | ERYSSGLYDYGMDV |
| | | | SEQ ID NO:4122 | SEQ ID NO:12134 | SEQ ID NO:20146 |
| | | NA | AGCTGTGGCATGCAC | GCTATATGGTATGATGGAAGCAATAAATACTATGCAGACTCCGTGAAGGGC | GACAAAATATAATGGAGATACTTGGTTTGACTTC |
| iPS:468828 | 21-225_162A10 | | SEQ ID NO:4123 | SEQ ID NO:12135 | SEQ ID NO:20147 |
| | | AA | SCGMH | AIWYDGSNKYYADSVKG | DKNIMGDTWFDF |
| | | | SEQ ID NO:4124 | SEQ ID NO:12136 | SEQ ID NO:20148 |
| | | NA | GGCTACTATATGCAC | TGGATCAACCCTAATAGTGGTGGCACAAACTTTGCACAGAAGTTTCAGGGC | GGAAAGAACTATGGCTCCTACTTTGACTAC |
| iPS:468830 | 21-225_191G11 | | SEQ ID NO:4125 | SEQ ID NO:12137 | SEQ ID NO:20149 |
| | | AA | GYYMH | WINPNSGGTNFAQKFQG | GKNYGSYFDY |
| | | | SEQ ID NO:4126 | SEQ ID NO:12138 | SEQ ID NO:20150 |

FIGURE 49
(Continued)

| | | | | | |
|---|---|---|---|---|---|
| iPS:468832 | 21-225_76H10 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4127 | SEQ ID NO:12139 | SEQ ID NO:20151 |
| | | AA | GCYWS | EINYSGRTNFNPSLKS | DYGGMDV |
| | | | SEQ ID NO:4128 | SEQ ID NO:12140 | SEQ ID NO:20152 |
| iPS:468834 | 21-225_94G10 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4129 | SEQ ID NO:12141 | SEQ ID NO:20153 |
| | | AA | GCYWS | EINYSGRTNFNPSLKS | DYGGMDV |
| | | | SEQ ID NO:4130 | SEQ ID NO:12142 | SEQ ID NO:20154 |
| iPS:468836 | 21-225_198E3 | NA | AGCTATGGCATGCAC | GTTATATCATATGATGGA GGTTATAAAACTATGC AGACTCCGTGAAGGGC | GGTACCCACGGGTACTACTA CGGTGTGGACGTC |
| | | | SEQ ID NO:4131 | SEQ ID NO:12143 | SEQ ID NO:20155 |
| | | AA | SYGMH | VISYDGGYKNYADSVKG | GTHGYYYGVDV |
| | | | SEQ ID NO:4132 | SEQ ID NO:12144 | SEQ ID NO:20156 |
| iPS:468838 | 21-225_80E12 | NA | GGTTGCTACTGGAGC | GAAATCAATTATAGTGG AAGGACCAACTTCAACC CGTCCCTCAAGAGT | GACTACGGCGGTATGGACGT C |
| | | | SEQ ID NO:4133 | SEQ ID NO:12145 | SEQ ID NO:20157 |
| | | AA | GCYWS | EINYSGRTNFNPSLKS | DYGGMDV |
| | | | SEQ ID NO:4134 | SEQ ID NO:12146 | SEQ ID NO:20158 |
| iPS:468840 | 21-225_200H9 | NA | AGTGGTGGTGACTACTGGAG C | TACATCTATTACAGTGGG AGCACCTACTACAACCC GTCCTCAAGAGT | ATGGACTACAGTAACTACTA CTACGGTATGGACGTC |
| | | | SEQ ID NO:4135 | SEQ ID NO:12147 | SEQ ID NO:20159 |
| | | AA | SGGDYWS | YIYYSGSTYYNPSLKS | MDYSNYYYGMDV |
| | | | SEQ ID NO:4136 | SEQ ID NO:12148 | SEQ ID NO:20160 |

FIGURE 49
(Continued)

| | | | | GGTTCCTACTGGAGC | GAAATCAATTATAGTGG AAGGACCAACTCAACC CGTCCCTCAAGAGT | GACTACGGGCGGTATGGACGT C |
|---|---|---|---|---|---|---|
| iPS:468820 | 21-225_76E10 | NA | | SEQ ID NO:4137 | SEQ ID NO:12149 | SEQ ID NO:20161 |
| | | AA | | GSYWS | EINYSGRTNFNPSLKS | DYGGMDV |
| | | | | SEQ ID NO:4138 | SEQ ID NO:12150 | SEQ ID NO:20162 |
| iPS:468842 | 21-225_50H4 | NA | | AGCTATGTCATGCAC | GCTATATGGTAGTAGTAATAAATACTATG CAGACTCCGTGAAGGGC | GAGTTGTATAGCAGCAACTG GTACGACTACGGGTATGGACG TC |
| | | | | SEQ ID NO:4139 | SEQ ID NO:12151 | SEQ ID NO:20163 |
| | | AA | | SYVMH | AIWYDGSNKYYADSVKG | ELYSSNWYDYGMDV |
| | | | | SEQ ID NO:4140 | SEQ ID NO:12152 | SEQ ID NO:20164 |
| iPS:468844 | 21-225_48E10 | NA | | AGCTATAACATGAAC | TCCATTAGTGGTAGTAGT AGTTACATATACGCG AGACTCAGTGAAGGGC | AGCCTCGACCTC |
| | | | | SEQ ID NO:4141 | SEQ ID NO:12153 | SEQ ID NO:20165 |
| | | AA | | SYNMN | SISGSSSYIYYADSVKG | SLDL |
| | | | | SEQ ID NO:4142 | SEQ ID NO:12154 | SEQ ID NO:20166 |
| iPS:468846 | 21-225_53B10 | NA | | AGCTATAGCATGAAC | TCCATTAGTGGTAGTAGC AGTTACATATACTACGTA GACTCAGTGAAGGGC | GTCAACTCTTTTGACTCC |
| | | | | SEQ ID NO:4143 | SEQ ID NO:12155 | SEQ ID NO:20167 |
| | | AA | | SYSMN | SISGSSSYIYYVDSVKG | VNSFDS |
| | | | | SEQ ID NO:4144 | SEQ ID NO:12156 | SEQ ID NO:20168 |
| iPS:468848 | 21-225_54B1 | NA | | AGCTATGCCATGAGC | GTTCTTAGTGGTAGTGGT GGTAGCACATTCTACGC AGACTCCGTGAAGGGC | AGAGGCCGTGAATATAGTGG CTACGATTACTTTGACTAC |
| | | | | SEQ ID NO:4145 | SEQ ID NO:12157 | SEQ ID NO:20169 |

FIGURE 49
(Continued)

| | | | | | | RGREYSGYDYFDY |
|---|---|---|---|---|---|---|
| iPS:468850 | | AA | SYAMS | VLSGSGGSTFYADSVKG | SEQ ID NO:20170 |
| | | | SEQ ID NO:4146 | SEQ ID NO:12158 | |
| | 21-225_63F4 | NA | AATTATGATGTCAAC | TGGATGCACCCTAACAG TGGTAACACAGGCTATG CACAGAAGTTCCGGGGC | AGCAGTGGCTGGTACGTTTT TGACTAC |
| | | | SEQ ID NO:4147 | SEQ ID NO:12159 | SEQ ID NO:20171 |
| iPS:468852 | | AA | NYDVN | WMHPNSGNTGYAQKFRG | SSGWYVFDY |
| | | | SEQ ID NO:4148 | SEQ ID NO:12160 | SEQ ID NO:20172 |
| | 21-225_71F3 | NA | AATTATGATGTCAAC | TGGATGCACCCTAACAG TGGTAACACAGGCTATG CACAGAAGTTCCAGGGC | AGCAGTGGCTGGTACGTTTT TGACTCC |
| | | | SEQ ID NO:4149 | SEQ ID NO:12161 | SEQ ID NO:20173 |
| iPS:468854 | | AA | NYDVN | WMHPNSGNIGYAQKFQG | SSGWYVFDS |
| | | | SEQ ID NO:4150 | SEQ ID NO:12162 | SEQ ID NO:20174 |
| | 21-225_72C4 | NA | AATTATGATATCAAC | TGGATGCACCCTAACAG TGGTAACACAGGCTATG CACAGAAGTTCCAGGGC | AGCAGTGGCTGGTACCTCTT TGACTAC |
| | | | SEQ ID NO:4151 | SEQ ID NO:12163 | SEQ ID NO:20175 |
| iPS:468856 | | AA | NYDIN | WMHPNSGNTGYAQKFQG | SSGWYLFDY |
| | | | SEQ ID NO:4152 | SEQ ID NO:12164 | SEQ ID NO:20176 |
| | 21-225_77C9 | NA | AGGAGTAGTTACTACTGGGG C | AGTATCTATTATAGTGGG AGCGCTACTCCAACCC GTCCCTCAAGAGT | CTTGACTCTAACTGGGGTCT TGACTAC |
| | | | SEQ ID NO:4153 | SEQ ID NO:12165 | SEQ ID NO:20177 |
| | | AA | RSSYYWG | SIYYSGSAYSNPSLKS | LDSNWGLDY |
| | | | SEQ ID NO:4154 | SEQ ID NO:12166 | SEQ ID NO:20178 |

FIGURE 49
(Continued)

| | | NA | GACTATGGCATGCAC | GTTATATGGTATGATGG AAGTAATAAGTACTATG CAGACTCCGTGAAGGGC | GAGAGGTATAGCAGTGGCTG GTACGACTACGGTTGGACG TC |
|---|---|---|---|---|---|
| iPS:468858 | 21-225_148C9 | | SEQ ID NO:4155 | SEQ ID NO:12167 | SEQ ID NO:20179 |
| | | AA | DYGMH | VIWYDGSNKYYADSVKG | ERYSSGWYDYGLDV |
| | | NA | AGCTATGTCATGCAC | GTTATATGGTATGATGG AAGTAATAAATACTATG CAGACTCCGTGAAGGGC | GAACAGTATAGCAGCAGCTG GTACGACTTCGGTCTGGACG TC |
| iPS:468860 | 21-225_224E7 | | SEQ ID NO:4156 | SEQ ID NO:12168 | SEQ ID NO:20180 |
| | | AA | SYVMH | VIWYDGSNKYYADSVKG | EQYSSSWYDFGLDV |
| | | NA | GACTATTATATGCAC | SEQ ID NO:4157 | SEQ ID NO:12169 | SEQ ID NO:20181 |
| | | | SEQ ID NO:4158 | TGGATCAACCCTAACAG AGGTGGCACAAACTATG CTCAGAAGTTTCAGGGC | GAGGAGGATGCAGTGGCTG GTACTACTACTACGGTATGG ACGTC |
| iPS:468862 | 21-225_178H8 | | | SEQ ID NO:12170 | SEQ ID NO:20182 |
| | | AA | DYYMH | WINPNRGGTNYAQKFQG | EEDRSGWYYYYGMDV |
| | | NA | SEQ ID NO:4159 | SEQ ID NO:12171 | SEQ ID NO:20183 |
| | | | ACTAGTGGAGTGGGTGTGG C | CTCATTATTGGAAAGAT GATGAGGCTACAGCCC ATCTCTGAAGAGC | GCAGTGGCTGTCTCCTTTGA CTAC |
| iPS:468864 | 21-225_60D6 | | SEQ ID NO:4160 | SEQ ID NO:12172 | SEQ ID NO:20184 |
| | | AA | TSGVGVG | LIYWKDDERYSPSLKS | AVAVSFDY |
| | | NA | GGCTACTATATGCAC | TGGATCAACCCTTACAGT GGTGGCACAAACTATGC ACAGAAGTTTCAGGGC | GATAGAGCAGTGGCTGGAAA CTACTTCTACTACGGTATGG ACGTC |
| iPS:468866 | 21-225_190C1 | | SEQ ID NO:4162 | SEQ ID NO:12174 | SEQ ID NO:20186 |
| | | | SEQ ID NO:4161 | SEQ ID NO:12173 | SEQ ID NO:20185 |

FIGURE 49
(Continued)

| | | | | | |
|---|---|---|---|---|---|
| iPS:468868 | 21-225_190C1 | AA | SEQ ID NO:4163<br>GYYMH | SEQ ID NO:12175<br>WINPYSGGTNYAQKFQG | SEQ ID NO:20187<br>DRAVAGNYFYYGMDV |
| | | NA | SEQ ID NO:4164<br>GGTAGTAGTTACTACTGGGGC | SEQ ID NO:12176<br>AATATCTATTATAGTGGGAGCACCTACCACAACCCGTCCCTCAAGAGT | SEQ ID NO:20188<br>CATGATTACTTGGTCCTTGACTTC |
| iPS:468870 | 21-225_74A1 | AA | SEQ ID NO:4165<br>GSSYYWG | SEQ ID NO:12177<br>NIYYSGSTYHNPSLKS | SEQ ID NO:20189<br>HDLLWSLDF |
| | | NA | SEQ ID NO:4166<br>AATTATGATATCAAC | SEQ ID NO:12178<br>TGGATGCACCTAACAGTGGTAACACAGGCTATGCACAGAAGTTCCAGGGC | SEQ ID NO:20190<br>AGTAGTGGCTGGTACAAATTTGACTAC |
| | 21-225_74A8 | AA | SEQ ID NO:4167<br>NYDIN | SEQ ID NO:12179<br>WMHPNSGNTGYAQKFQG | SEQ ID NO:20191<br>SSGWYKFDY |
| iPS:472730 | 21-225_14B1_LC1 | NA | SEQ ID NO:4168<br>AGCTATACCATGAAC | SEQ ID NO:12180<br>TCCATAAGTGGTAGTAGTAGTTACTTATACTACCCAGACTCAGTGAAGGGC | SEQ ID NO:20192<br>GATAGAGGCAGCAGC |
| | | AA | SEQ ID NO:4169<br>SYTMN | SEQ ID NO:12181<br>SISGSSSYLYYPDSVKG | SEQ ID NO:20193<br>DRGSS |
| iPS:472731 | 21-225_14B1_LC2 | NA | SEQ ID NO:4170<br>AGCTATACCATGAAC | SEQ ID NO:12182<br>TCCATAAGTGGTAGTAGTAGTTACTTATACTACCCAGACTCAGTGAAGGGC | SEQ ID NO:20194<br>GATAGAGGCAGCAGC |
| | | AA | SEQ ID NO:4171<br>SYTMN | SEQ ID NO:12183<br>SISGSSSYLYYPDSVKG | SEQ ID NO:20195<br>DRGSS |
| | | | SEQ ID NO:4172 | SEQ ID NO:12184 | SEQ ID NO:20196 |

FIGURE 49
(Continued)

| | | | | | |
|---|---|---|---|---|---|
| iPS:472732 | 21-225_2B10_LC1 | NA | AGCTATGTCATGCAC | GTTATATGGTATGATGG AAGTAATAAATACTATG CAGACTCCGTGAAGGTC | GAGAGATATACCAGTGGCTG GTATGACTACGGTATGGACG TC |
| | | | SEQ ID NO:4173 | SEQ ID NO:12185 | SEQ ID NO:20197 |
| | | AA | SYVMH | VIWYDGSNKYYADSVKV | ERYTSGWYDYGMDV |
| | | | SEQ ID NO:4174 | SEQ ID NO:12186 | SEQ ID NO:20198 |
| iPS:472733 | 21-225_2B10_LC2 | NA | AGCTATGTCATGCAC | GTTATATGGTATGATGG AAGTAATAAATACTATG CAGACTCCGTGAAGGTC | GAGAGATATACCAGTGGCTG GTATGACTACGGTATGGACG TC |
| | | | SEQ ID NO:4175 | SEQ ID NO:12187 | SEQ ID NO:20199 |
| | | AA | SYVMH | VIWYDGSNKYYADSVKV | ERYTSGWYDYGMDV |
| | | | SEQ ID NO:4176 | SEQ ID NO:12188 | SEQ ID NO:20200 |
| iPS:473253 | 21-225_7C3_LC1 | NA | GACTACTATTTGCAC | TGGATCCACCCTAACAG TGGTGGCACAAACTATG CACAGAAGTTTCAGGGC | GATGGTACCAGCTCGTTTGA CTAC |
| | | | SEQ ID NO:4177 | SEQ ID NO:12189 | SEQ ID NO:20201 |
| | | AA | DYYLH | WIHPNSGGTNYAQKFQG | DGTSSFDY |
| | | | SEQ ID NO:4178 | SEQ ID NO:12190 | SEQ ID NO:20202 |
| iPS:473254 | 21-225_7C3_LC2 | NA | GACTACTATTTGCAC | TGGATCCACCCTAACAG TGGTGGCACAAACTATG CACAGAAGTTTCAGGGC | GATGGTACCAGCTCGTTTGA CTAC |
| | | | SEQ ID NO:4179 | SEQ ID NO:12191 | SEQ ID NO:20203 |
| | | AA | DYYLH | WIHPNSGGTNYAQKFQG | DGTSSFDY |
| | | | SEQ ID NO:4180 | SEQ ID NO:12192 | SEQ ID NO:20204 |

FIGURE 49
(Continued)

| | | | | | | | |
|---|---|---|---|---|---|---|---|
| iPS:473255 | 21-225_9F12_LC1 | NA | GACTACTATTTGCAC | | TGGATCCACCCTAACAG TGGTGGCACAAACTTTG CACAGAAGTTTCAGGGC | | GATGGTACCAGCTCGTTTGA CTAC |
| | | | SEQ ID NO:4181 | | SEQ ID NO:12193 | | SEQ ID NO:20205 |
| | | AA | DYYLH | | WIHPNSGGTNFAQKFQG | | DGTSSFDY |
| | | | SEQ ID NO:4182 | | SEQ ID NO:12194 | | SEQ ID NO:20206 |
| iPS:473256 | 21-225_9F12_LC2 | NA | GACTACTATTTGCAC | | TGGATCCACCCTAACAG TGGTGGCACAAACTTTG CACAGAAGTTTCAGGGC | | GATGGTACCAGCTCGTTTGA CTAC |
| | | | SEQ ID NO:4183 | | SEQ ID NO:12195 | | SEQ ID NO:20207 |
| | | AA | DYYLH | | WIHPNSGGTNFAQKFQG | | DGTSSFDY |
| | | | SEQ ID NO:4184 | | SEQ ID NO:12196 | | SEQ ID NO:20208 |
| iPS:472742 | 21-225_30D9_LC2 | NA | GGCTACTATCTGCAC | | TGGATCAACCCTAACAG TGGTGGCACAAACTATG CACAGAAGTTTCAGGGC | | GTGTATTACTATGGTTCGGG GAGTTATTATAACGAGTTTG ACAAC |
| | | | SEQ ID NO:4185 | | SEQ ID NO:12197 | | SEQ ID NO:20209 |
| | | AA | GYYLH | | WINPNSGGTNYAQKFQG | | VYYYGSGSYYNEFDN |
| | | | SEQ ID NO:4186 | | SEQ ID NO:12198 | | SEQ ID NO:20210 |
| iPS:472741 | 21-225_30D9_LC1 | NA | GGCTACTATCTGCAC | | TGGATCAACCCTAACAG TGGTGGCACAAACTATG CACAGAAGTTTCAGGGC | | GTGTATTACTATGGTTCGGG GAGTTATTATAACGAGTTTG ACAAC |
| | | | SEQ ID NO:4187 | | SEQ ID NO:12199 | | SEQ ID NO:20211 |
| | | AA | GYYLH | | WINPNSGGTNYAQKFQG | | VYYYGSGSYYNEFDN |
| | | | SEQ ID NO:4188 | | SEQ ID NO:12200 | | SEQ ID NO:20212 |
| iPS:472743 | 21-225_68G6 | NA | GGYTACTATATGCAC | | TCGATCTACCGTAACAGT GGTGGCACAAATTATGC ACAGAAGTTTCAGGGC | | GCCTTTTACTATGGTTCGGG GACTATTATAACGAATTTG ACTAC |
| | | | SEQ ID NO:4189 | | SEQ ID NO:12201 | | SEQ ID NO:20213 |
| | | AA | GYYMH | | SIYRNSGGTNYAQKFQG | | AFYYGSGTYYNEFDY |
| | | | SEQ ID NO:4190 | | SEQ ID NO:12202 | | SEQ ID NO:20214 |

FIGURE 49
(Continued)

| | | | | | |
|---|---|---|---|---|---|
| iPS:392573 | 21-225_15G2 | NA | ACTAGTGGAGTGGGTGTGG C | CTCATTTATTGGAATGAT GATAAGGCGCTACAGCCC ATCTCTGAAGAGC | ACCGGTGTCAGCTGCTGCTA TTTTCACTAT |
| | | | SEQ ID NO:4191 | SEQ ID NO:12203 | SEQ ID NO:20215 |
| | | AA | TSGVGVG | LIYWNDDKRYSPSLKS | TGVSCCYFHY |
| | | | SEQ ID NO:4192 | SEQ ID NO:12204 | SEQ ID NO:20216 |
| iPS:392583 | 21-225_10B10 | NA | ACTGGTGGAGTGGGTGTGG C | TTCATTTATTGGAGTGAT GATAAGCGCTACAGCCC ATCTCTGAAGAGC | ATAGCAGCAGTTGCCTTTGA CTAC |
| | | | SEQ ID NO:4193 | SEQ ID NO:12205 | SEQ ID NO:20217 |
| | | AA | TGGVGVG | FIYWSDDKRYSPSLKS | IAAVAFDY |
| | | | SEQ ID NO:4194 | SEQ ID NO:12206 | SEQ ID NO:20218 |
| iPS:392585 | 21-225_14H11 | NA | GGCCACTATATGTGC | TGGATCAACCCTAATAG TGGTGGCACAAACTATG CACAGAAGTTTCAGGGC | GGATATTGTAGTAGTTCCAG CTGCTATTTGCAACCGGGTT ATTACGGTATGGACGTC |
| | | | SEQ ID NO:4195 | SEQ ID NO:12207 | SEQ ID NO:20219 |
| | | AA | GHYMC | WINPNSGGTNYAQKFQG | GYCSSSSCYLQPGYYGMDV |
| | | | SEQ ID NO:4196 | SEQ ID NO:12208 | SEQ ID NO:20220 |
| iPS:392587 | 21-225_18G5 | NA | ACTAGTGGAGTGGGTGTGG C | CTCATTTATTGGAATGAT GATAAGGTCTACAGCCC ATCTCTGAAGAGC | AGGGGACAGCAGCAGCTGCCCT CGACTAC |
| | | | SEQ ID NO:4197 | SEQ ID NO:12209 | SEQ ID NO:20221 |
| | | AA | TSGVGVG | LIYWNDDKVYSPSLKS | RGQQLALDY |
| | | | SEQ ID NO:4198 | SEQ ID NO:12210 | SEQ ID NO:20222 |
| iPS:392589 | 21-225_27H2 | NA | GGCTATGGCATGCAC | GTTATATGGTATGATGG AAGTAATAAATACTATG CAGACTCCGTGAAGGGC | GATAGGGTATATTGTAGTAG TACCAGCTGCTCCCCTTACT ACTACTACGGTATGGAC GTC |
| | | | SEQ ID NO:4199 | SEQ ID NO:12211 | SEQ ID NO:20223 |

FIGURE 49
(Continued)

| | | | | | | | |
|---|---|---|---|---|---|---|---|
| iPS:392593 | 21-225_3E10 | AA | GYGMH | | VIWYDGSNKYYADSVKG | | DRVYCSSTSCSPYYYYGMDV |
| | | | SEQ ID NO:4200 | | SEQ ID NO:12212 | | SEQ ID NO:20224 |
| | | NA | ACTGGTGGAGTGGGTGTGGGC | | CTCATTTATTGGAATGATGATAAGGCGCCACAGCCCATCTCTGAAGAGC | | CTTATAGAAGTGGCCTTTGACTAT |
| iPS:392596 | 21-225_12D8 | AA | TGGVGVG | | LIYWNDDKRHSPSLKS | | LIEVAFDY |
| | | | SEQ ID NO:4201 | | SEQ ID NO:12213 | | SEQ ID NO:20225 |
| | | NA | AGCTATGTCATGAGC | | ACTATTAGTGTTGGTGGTGGTAGCACATACTACGCAGACTCCGTGAAGGGC | | TGGGGACGTGGATACAGCTATGAATACTACTACGGTATGGACGTC |
| | | | SEQ ID NO:4202 | | SEQ ID NO:12214 | | SEQ ID NO:20226 |
| iPS:392598 | 21-225_18E10 | AA | SYVMS | | TISVGGSTYYADSVKG | | WGRGYSYEYYYGMDV |
| | | | SEQ ID NO:4203 | | SEQ ID NO:12215 | | SEQ ID NO:20227 |
| | | NA | GGCTACTACTATGCAC | | TGGATCAACCTAACAGTGGTGCACAAACTATGCACAGAAGTTTCAGGGC | | TCGTACTACTATGGTTCGGGAGTTATTATAACGAGTTTGACTAC |
| | | | SEQ ID NO:4204 | | SEQ ID NO:12216 | | SEQ ID NO:20228 |
| iPS:392618 | 21-225_16F10 | AA | GYYMH | | WINPNSGGTNYAQKFQG | | SYYYGSGSYYNEFDY |
| | | | SEQ ID NO:4205 | | SEQ ID NO:12217 | | SEQ ID NO:20229 |
| | | NA | GACTATGGCATGCAC | | GTCATATGGTATGATGGAAATAATAAATACTATGTAGACTCCGTGAAGGGC | | GAGCTTGCCTGGTACGAGGACTAC |
| | | | SEQ ID NO:4206 | | SEQ ID NO:12218 | | SEQ ID NO:20230 |
| | | AA | DYGMH | | VIWYDGNNKYYVDSVKG | | ELAWYEDY |
| | | | SEQ ID NO:4207 | | SEQ ID NO:12219 | | SEQ ID NO:20231 |
| | | | SEQ ID NO:4208 | | SEQ ID NO:12220 | | SEQ ID NO:20232 |

FIGURE 49
(Continued)

| | | | | | | | |
|---|---|---|---|---|---|---|---|
| iPS:392620 | 21-225_17H5 | NA | AGCTATAGCATGAAC | | TCCATTAGTAGTAGTAGT ACTTACATATACTACGCA GACTCAGTGAAGGGC | | GTGGCTTCATTTGACTAC |
| | | | SEQ ID NO:4209 | | SEQ ID NO:12221 | | SEQ ID NO:20233 |
| | | AA | SYSMN | | SISSSSTYIYYADSVKG | | VASFDY |
| | | | SEQ ID NO:4210 | | SEQ ID NO:12222 | | SEQ ID NO:20234 |
| iPS:392622 | 21-225_17H8 | NA | AGAAGTAGTTACTACTGGGG C | | AATATCTATTATGGTGGG AACACCTACTACAACCC GTCCCTCAAGAGT | | CATGGAAAAGACTGGGCCT TGACTAC |
| | | | SEQ ID NO:4211 | | SEQ ID NO:12223 | | SEQ ID NO:20235 |
| | | AA | RSSYYWG | | NIYYGGNTYYNPSLKS | | HGKDWGLDY |
| | | | SEQ ID NO:4212 | | SEQ ID NO:12224 | | SEQ ID NO:20236 |
| iPS:392624 | 21-225_17H12 | NA | AGCTATACCATGAAC | | TCCATTAGTAGTGGTAGTAGT AGTTACATATACTACGC AGACTCAGTGAAGGGC | | GATCGAGGGCTCCATC |
| | | | SEQ ID NO:4213 | | SEQ ID NO:12225 | | SEQ ID NO:20237 |
| | | AA | SYTMN | | SISGSSSYIYYADSVKG | | DRGSI |
| | | | SEQ ID NO:4214 | | SEQ ID NO:12226 | | SEQ ID NO:20238 |
| iPS:392626 | 21-225_18A5 | NA | GACTATGGCATGCAC | | GTTATATGGTTTGATGGA AGTAATAAATACTATGC AGACTCCGTGAAGGGC | | GATCTTGGCTGGACGGAAGA GTAC |
| | | | SEQ ID NO:4215 | | SEQ ID NO:12227 | | SEQ ID NO:20239 |
| | | AA | DYGMH | | VIWFDGSNKYYADSVKG | | DLGWTEEY |
| | | | SEQ ID NO:4216 | | SEQ ID NO:12228 | | SEQ ID NO:20240 |
| iPS:392628 | 21-225_20C2 | NA | AGAAGTAGTTACTACTGGGG C | | AATATCTATTATAGTGGG ACTGCCTACTGTAATTCG TCCCTCAAGAGT | | CATAGTAGCAGCTGGTCCCT TGACAAC |
| | | | SEQ ID NO:4217 | | SEQ ID NO:12229 | | SEQ ID NO:20241 |
| | | AA | RSSYYWG | | NIYYSGTAYCNSSLKS | | HSSSWSLDN |

FIGURE 49
(Continued)

| | | | | | | |
|---|---|---|---|---|---|---|
| iPS:392630 | 21-225_20E5 | NA | SEQ ID NO:4218 GACTATGGCATGCAC | SEQ ID NO:12230 GTTATTTGGTATGAAGA AATAATCAATACTATG CAGACTCCGTGAAGGGC | SEQ ID NO:20242 GAACTGGGGGTCCGGTCTGA CTAC | |
| | | AA | SEQ ID NO:4219 DYGMH | SEQ ID NO:12231 VIWYEENNQYYADSVKG | SEQ ID NO:20243 ELGFRSDY | |
| iPS:392632 | 21-225_16A11 | NA | SEQ ID NO:4220 AGCTATAGCATGAAC | SEQ ID NO:12232 TCCATTAGTAGTGGTAGTAGT AGTCTCATATACTACGCA GACTCAGTGAAGGGC | SEQ ID NO:20244 GTAGCAGCCTTTGACTAC | |
| | | AA | SEQ ID NO:4221 SYSMN | SEQ ID NO:12233 SISGSSSLIYYADSVKG | SEQ ID NO:20245 VAAFDY | |
| iPS:392634 | 21-225_17H3 | NA | SEQ ID NO:4222 AACTGTGTCATGCAC | SEQ ID NO:12234 GTTATATGGTATGATGG AAGTAATAAATACTATG CAGACTCCGTGAAGGGC | SEQ ID NO:20246 GAAAAGTATAGCAGCAGCTG GTACGACTACGGTATGGACG TC | |
| | | AA | SEQ ID NO:4223 NCVMH | SEQ ID NO:12235 VIWYDGSNKYYADSVKG | SEQ ID NO:20247 EKYSSSWYDYGMDV | |
| iPS:392636 | 21-225_17A6 | NA | SEQ ID NO:4224 CGCAACACTGCTGCTTGGAG C | SEQ ID NO:12236 AGGACATACACAGGTC CAAGTGGTATAATGATT ATGCAGTATCTGTGAAA AGT | SEQ ID NO:20248 GTAAGCAGTGGCTGGTCCCA TCACTACTACTACGGGTA TGGACGTC | |
| | | AA | SEQ ID NO:4225 RNTAAWS | SEQ ID NO:12237 RTYYRSKWYNDYAVSVK S | SEQ ID NO:20249 VSSGWSHHYYYYGMDV | |

FIGURE 49
(Continued)

| | | | | | | |
|---|---|---|---|---|---|---|
| iPS:392638 | 21-225_17F9 | NA | SEQ ID NO:4226 AGAAGTAGTTACTATTGGGG C | SEQ ID NO:12238 AATATCTATTATAGTGGG AGCACCTACACAATCC GTCCCTCAAGAGT | SEQ ID NO:20250 CATGGAAAAGACTGGGGCCT TGACTAC | |
| | | AA | SEQ ID NO:4227 RSSYYWG | SEQ ID NO:12239 NIYYSGSTYYNPSLKS | SEQ ID NO:20251 HGKDWGLDY | |
| | | | SEQ ID NO:4228 | SEQ ID NO:12240 | SEQ ID NO:20252 | |
| iPS:392640 | 21-225_18A1 | NA | SEQ ID NO:4229 AGCTATGGCATGCAT | SEQ ID NO:12241 GTTATATGGTATGAGGA AATATAATAAATATTATG TAGACTCCGTGAAGGGC | SEQ ID NO:20253 GAGCTAGGCTTCCAGTCTGA CTAC | |
| | | AA | SEQ ID NO:4230 SYGMH | SEQ ID NO:12242 VIWYEENNKYYVDSVKG | SEQ ID NO:20254 ELGFQSDY | |
| iPS:392642 | 21-225_18C6 | NA | SEQ ID NO:4231 AGGAGTAGTTATTACTGGGG C | SEQ ID NO:12243 AATATCTATTATAGTGGG TACACCTACTACAACCC GTCCCTCAAGAGT | SEQ ID NO:20255 CATAGTAGCAGTTGGTCCCT TGACGAC | |
| | | AA | SEQ ID NO:4232 RSSYYWG | SEQ ID NO:12244 NIYYSGYTYYNPSLKS | SEQ ID NO:20256 HSSSWSLDD | |
| iPS:392644 | 21-225_19E1 | NA | SEQ ID NO:4233 AACTATGGCATGCAC | SEQ ID NO:12245 GTTATTTGGTATGAAGA AATAATCAATACTATG CAGACTCCGTGAAGGGC | SEQ ID NO:20257 GAACTGGGGGTTCCGGTCTGA CTAC | |
| | | AA | SEQ ID NO:4234 NYGMH | SEQ ID NO:12246 VIWYEENNQYYADSVKG | SEQ ID NO:20258 ELGFRSDY | |

FIGURE 49
(Continued)

| | | | | |
|---|---|---|---|---|
| iPS:392646 | 21-225_20G2 | NA | AGGGATGACATGCAC | GTTATATGGTTTGATGGA AGTATAAATACTATGC AGACTCCGTGAAGGGC | GATCTGATAGCAGCAGCTGG TACGGTTGACTAC |
| | | | SEQ ID NO:4235 | SEQ ID NO:12247 | SEQ ID NO:20259 |
| | | AA | SDDMH | VIWFDGSNKYYADSVKG | DLIAAAGFVDY |
| | | | SEQ ID NO:4236 | SEQ ID NO:12248 | SEQ ID NO:20260 |
| iPS:392648 | 21-225_16D11 | NA | CGCAACACTGCTGCTTGGAG C | AGGACATACTACAGGTC CAAGTGGTATAATGATT ATGCAGTATCTGTGAAA AGT | GTAAACAGTGGCTGGTCCA TCACTACTACTACTACGGTA TGGACGTC |
| | | | SEQ ID NO:4237 | SEQ ID NO:12249 | SEQ ID NO:20261 |
| | | AA | RNTAAWS | RTYYRSKWYNDYAVSVK S | VNSGWSHHYYYYGMDV |
| | | | SEQ ID NO:4238 | SEQ ID NO:12250 | SEQ ID NO:20262 |
| iPS:392650 | 21-225_17A4 | NA | GACTACTACATGAGC | CACATTAGTAGTAGTGG TAGTACCATATATTACGC AGACTCTGTGAAGGGC | TATCGGAATAACCGGGATA CTTCGATCTC |
| | | | SEQ ID NO:4239 | SEQ ID NO:12251 | SEQ ID NO:20263 |
| | | AA | DYYMS | HISSSGSTIYYADSVKG | YRNNRGYFDL |
| | | | SEQ ID NO:4240 | SEQ ID NO:12252 | SEQ ID NO:20264 |
| iPS:392652 | 21-225_17C6 | NA | AGCTATGCCATGAAC | GTTATTAGTGGTGGTGGT GGTAACACATTCTACGC AGACTCCGTGAAGGGC | CGTTGGCAGTGGCTGGCTC GGAGGCTTTTGATATC |
| | | | SEQ ID NO:4241 | SEQ ID NO:12253 | SEQ ID NO:20265 |
| | | AA | SYAMN | VISGRGGNTFYADSVKG | RLAVAGSEAFDI |
| | | | SEQ ID NO:4242 | SEQ ID NO:12254 | SEQ ID NO:20266 |

FIGURE 49
(Continued)

| | | | | | | |
|---|---|---|---|---|---|---|
| iPS:392654 | 21-225_17A10 | NA | AACTATGGCATGCAC | GTTATTTGGTATGAAGAAAATAATCAATACTATGCAGACTCCGTGAAGGGC | GAACTGGGGGTTCCGGTCTGACTAC | |
| | | | SEQ ID NO:4243 | SEQ ID NO:12255 | SEQ ID NO:20267 | |
| | | AA | NYGMH | VIWYEENNQYYADSVKG | ELGFRSDY | |
| | | | SEQ ID NO:4244 | SEQ ID NO:12256 | SEQ ID NO:20268 | |
| iPS:392656 | 21-225_1F2 | NA | AGGAGTAGTTACTACTGGGGC | AATATTTATTATAGTGGGAGCGCCTACAACACCCGTCCCTCAAGGGT | CATGGAAAAGACTGGGGCCTTGACTAC | |
| | | | SEQ ID NO:4245 | SEQ ID NO:12257 | SEQ ID NO:20269 | |
| | | AA | RSSYYWG | NIYYSGSAYNNPSLKG | HGKDWGLDY | |
| | | | SEQ ID NO:4246 | SEQ ID NO:12258 | SEQ ID NO:20270 | |
| iPS:392658 | 21-225_18E8 | NA | AACTATGGCATGCAC | GTTATTTGGTATGAAGAAAATAATCAATACTATGCAGACTCCGTGAAGGGC | GAACTGGGGGTTCCGGTCTGACTAC | |
| | | | SEQ ID NO:4247 | SEQ ID NO:12259 | SEQ ID NO:20271 | |
| | | AA | NYGMH | VIWYEENNQYYADSVKG | ELGFRSDY | |
| | | | SEQ ID NO:4248 | SEQ ID NO:12260 | SEQ ID NO:20272 | |
| iPS:392660 | 21-225_19B3 | NA | AGTTATGACATGCAC | GTTATATGGTATGACGGAAGTGATAAATACTATGCAGACTCCGTGAAGGGC | GATCGGGCCTATAGCAGCTCGTCTGACTAC | |
| | | | SEQ ID NO:4249 | SEQ ID NO:12261 | SEQ ID NO:20273 | |
| | | AA | SYDMH | VIWYDGSDKYYADSVKG | DRAYSSSSDY | |
| | | | SEQ ID NO:4250 | SEQ ID NO:12262 | SEQ ID NO:20274 | |

FIGURE 49
(Continued)

| | | | | |
|---|---|---|---|---|
| iPS:392664 | 21-225_20F6 | NA | AGCTATGGCATGCAC SEQ ID NO:4251 | GTTATATGGCATGATGG AAGTAATAAATACTATG CAGACTCCGTGAAGGGC SEQ ID NO:12263 | GATCTGAGTATGGGCGGAAT GGACGTC SEQ ID NO:20275 |
| | | AA | SYGMH SEQ ID NO:4252 | VIWHDGSNKYYADSVKG SEQ ID NO:12264 | DLSMGGMDV SEQ ID NO:20276 |
| iPS:392666 | 21-225_16F11 | NA | AGCTATGGCATGCAC SEQ ID NO:4253 | GTTATATGGTATGAGGA AAATAATAAATACTATG TAGACTCCGTGAAGGGC SEQ ID NO:12265 | GAACTAGGCTTCCAGTCTGA CTAC SEQ ID NO:20277 |
| | | AA | SYGMH SEQ ID NO:4254 | VIWYEENKYYVDSVKG SEQ ID NO:12266 | ELGFQSDY SEQ ID NO:20278 |
| iPS:392668 | 21-225_17B4 | NA | AGCTATGCCATGAAC SEQ ID NO:4255 | GTTATTAGTGGCCGTGGT GGTAACACATTCTACGC AGACTCCGTGAAGGGC SEQ ID NO:12267 | CGTTTGGCAGTGGCTGGCTC GGAGGCTTTTGATATC SEQ ID NO:20279 |
| | | AA | SYAMN SEQ ID NO:4256 | VISGRGGNTFYADSVKG SEQ ID NO:12268 | RLAVAGSEAFDI SEQ ID NO:20280 |
| iPS:392674 | 21-225_18C2 | NA | GACTATGGCATGCAC SEQ ID NO:4257 | GTTATATGGTATGATGTA ACTAATAAATACTATGC AGACTCCGTGAAGGGC SEQ ID NO:12269 | GAGCTTGGCTGGTACGAGGA CTAC SEQ ID NO:20281 |
| | | AA | DYGMH SEQ ID NO:4258 | VIWYDVTNKYYADSVKG SEQ ID NO:12270 | ELGWYEDY SEQ ID NO:20282 |

FIGURE 49
(Continued)

| | | | | | |
|---|---|---|---|---|---|
| iPS:392676 | 21-225_19F3 | NA | GGTAGTAGTTACTACTGGGG C | AATATCTATTATAGTGGG AGCACCTACTACAACCC GTCCTTCAAGAGT | CATTCCAGTAGCTGGTCCCT TGACTAC |
| | | AA | GSSYYWG | NIYYSGSTYYNPSFKS | HSSSWSLDY |
| | | | SEQ ID NO:4259 | SEQ ID NO:12271 | SEQ ID NO:20283 |
| | | | SEQ ID NO:4260 | SEQ ID NO:12272 | SEQ ID NO:20284 |
| iPS:392678 | 21-225_20F3 | NA | AGCTATGCCATGAAC | GTTATTAGTGGTAGTGGT GGTAGCACATACTACGC AGACTCCGTGAAGGGC | AGGATAGCAGCAGCTGGTAC GGAGTACTTCGATCTC |
| | | AA | SYAMN | VISGSGSTYYADSVKG | RIAAGTEYFDL |
| | | | SEQ ID NO:4261 | SEQ ID NO:12273 | SEQ ID NO:20285 |
| | | | SEQ ID NO:4262 | SEQ ID NO:12274 | SEQ ID NO:20286 |
| iPS:392680 | 21-225_20A7 | NA | AACTATGGCATGCAC | GTTATTTGGTATGAAGA AATAATCAATACTATG CAGACTCCGTGAAGGGC | GAACTGGGGTTCCGGTCTGA CTAC |
| | | AA | NYGMH | VIWYEENNQYYADSVKG | ELGFRSDY |
| | | | SEQ ID NO:4263 | SEQ ID NO:12275 | SEQ ID NO:20287 |
| | | | SEQ ID NO:4264 | SEQ ID NO:12276 | SEQ ID NO:20288 |
| iPS:392682 | 21-225_16A12 | NA | AGCTATAGAATGAAC | TCCATTAGTGGTAGTAGT ACTGACATATACTACGC AGACTCAGTGAAGGGC | AGGGACTTC |
| | | AA | SYRMN | SISGSSTDIYYADSVKG | RDF |
| | | | SEQ ID NO:4265 | SEQ ID NO:12277 | SEQ ID NO:20289 |
| | | | SEQ ID NO:4266 | SEQ ID NO:12278 | SEQ ID NO:20290 |
| iPS:392684 | 21_225_17F4 | NA | AACTATGGCATGAAC | GTTATATGGTATGATGG AATAATAAACACTATG CAGACTCCGTGAAGGGC | AGTGGGAGCTACTTCTTTGA CTAC |

FIGURE 49
(Continued)

| | | | | | | |
|---|---|---|---|---|---|---|
| iPS:392686 | 21-225_17F4 | AA | SEQ ID NO:4267 NYGMN | SEQ ID NO:12279 VIWYDGNNKHYADSVKG | SEQ ID NO:20291 SGSYFFDY | |
| | | NA | SEQ ID NO:4268 GACTATGGCATGCAC | SEQ ID NO:12280 GTTATATGGTTTGATGGAAGTAATAAATACTATGCAGACTCCGTGAAGGGC | SEQ ID NO:20292 GATCTTGGCTGGACGGAAGAATAC | |
| iPS:392690 | 21-225_17C7 | AA | SEQ ID NO:4269 DYGMH | SEQ ID NO:12281 VIWFDGSNKYYADSVKG | SEQ ID NO:20293 DLGWTEEY | |
| | | NA | SEQ ID NO:4270 GACTATGGCATGCAC | SEQ ID NO:12282 GTTATATGGTTTGATGGAAGTAATAAATACTATGCAGACTCCGTGAAGGGC | SEQ ID NO:20294 GATCTTGGCTGGACGGAAGAGTAC | |
| iPS:392692 | 21-225_18F2 | AA | SEQ ID NO:4271 DYGMH | SEQ ID NO:12283 VIWFDGSNKYYVDSVKG | SEQ ID NO:20295 DLGWTEEY | |
| | | NA | SEQ ID NO:4272 ACCTATAGCATGAAC | SEQ ID NO:12284 TACATTAGTAGGAGTAGTAGTACCAATAGAGACTACGCAGACTCTGTGAAGGGC | SEQ ID NO:20296 GGAGGTGGGAGCCCTTTTGACTAC | |
| iPS:392692 | 21-225_18G10 | AA | SEQ ID NO:4273 TYSMN | SEQ ID NO:12285 YISRSSTIDYADSVKG | SEQ ID NO:20297 GGGSPFDY | |
| | | NA | SEQ ID NO:4274 AGCTATAGCCATGCAC | SEQ ID NO:12286 GTTATATGGTTTGATGGAAGTGATAAATACTATGCAGACTCCGTGAAGGGC | SEQ ID NO:20298 GATCGGGCCTATAGTAGCTCGTCTGACTAC | |
| iPS:392694 | 21-225_19A5 | AA | SEQ ID NO:4275 SYAMH | SEQ ID NO:12287 VIWFDGSDKYYADSVKG | SEQ ID NO:20299 DRAYSSSSDY | |
| | | | SEQ ID NO:4276 | SEQ ID NO:12288 | SEQ ID NO:20300 | |

FIGURE 49
(Continued)

| | | | | |
|---|---|---|---|---|
| iPS:392696 | 21-225_20A4 | NA | AGCTATGCCATGACC | GTTATAAGTGGTAGTGGTGGTTACACATACAACGCGGACTCCGTGAAGGGC | CGTATAGCAGTAGTGGCTGGCTCGGAGGCTTTTGATATC |
| | | | SEQ ID NO:4277 | SEQ ID NO:12289 | SEQ ID NO:20301 |
| | | AA | SYAMT | VISGSGGTYNADSVKG | RIAVAGSEAFDI |
| | | | SEQ ID NO:4278 | SEQ ID NO:12290 | SEQ ID NO:20302 |
| iPS:392700 | 21-225_16E12 | NA | AACTATGGCATGCAC | GTTATATGGTATGAGGGAAGTAATAAATATTATGTAGACTCCGTGAGGGC | GAGCTAGGCTTCCAGTCTGATCAC |
| | | | SEQ ID NO:4279 | SEQ ID NO:12291 | SEQ ID NO:20303 |
| | | AA | NYGMH | VIWYEGSNKYYVDSVRG | ELGFQSDH |
| | | | SEQ ID NO:4280 | SEQ ID NO:12292 | SEQ ID NO:20304 |
| iPS:392702 | 21-225_17F7 | NA | AGCTATGCCATGAAC | ATTATTAGTGGTCGTGGTGGTAACACATTCTACGCAGACTCCGTGAAGGGC | CGTTTGGCAGTGGCTGGCTCGGAGGCTTTTGATATC |
| | | | SEQ ID NO:4281 | SEQ ID NO:12293 | SEQ ID NO:20305 |
| | | AA | SYAMN | IISGRGGNTFYADSVKG | RLAVAGSEAFDI |
| | | | SEQ ID NO:4282 | SEQ ID NO:12294 | SEQ ID NO:20306 |
| iPS:392704 | 21-225_17F11 | NA | AGCTATGCCATGAGC | GTTATTAGTGGTAGAGGTGGTAACACATACTCCGCAGACTCCGTGAAGGGC | CGTTTAGCAGTGGCTGGCTCGGAGGCTTTTTCATATC |
| | | | SEQ ID NO:4283 | SEQ ID NO:12295 | SEQ ID NO:20307 |
| | | AA | SYAMS | VISGRGGNTYSADSVKG | RLAVAGSEAFHI |
| | | | SEQ ID NO:4284 | SEQ ID NO:12296 | SEQ ID NO:20308 |
| iPS:392706 | 21-225_18A3 | NA | AGAAGTAGTTATTACTGGGGC | AATATCTATTATATAGTGGGTATACCTACTACACTCCGTCCCTCAAGAGT | CATAGCACCAGCTGGTCCCTGACTAC |
| | | | SEQ ID NO:4285 | SEQ ID NO:12297 | SEQ ID NO:20309 |
| | | AA | RSSYYWG | NIYYSGYTYTPSLKS | HSTSWSLDY |
| | | | SEQ ID NO:4286 | SEQ ID NO:12298 | SEQ ID NO:20310 |

FIGURE 49
(Continued)

| | | | | |
|---|---|---|---|---|
| iPS:392708 | 21-225_18D11 | NA | AGCTATAGCATGAAC | TACATTAGTAGTAGTAGT GGTACCATATACTACGC AGACTCTGTGAAGGGC | GGAGGTGGGGAGCCCTTTGA CTAC |
| | | | SEQ ID NO:4287 | SEQ ID NO:12299 | SEQ ID NO:20311 |
| | | AA | SYSMN | YISSSSGTIYYADSVKG | GGGSPFDY |
| | | | SEQ ID NO:4288 | SEQ ID NO:12300 | SEQ ID NO:20312 |
| iPS:392710 | 21-225_19A10 | NA | AGCTATGGCATGCAC | GTTATATGGTATGATGA AGTAATAAATACTATG CAGACTCCGTGAAGGGC | GAGCTTGCCTGGTACGAGGA CTCC |
| | | | SEQ ID NO:4289 | SEQ ID NO:12301 | SEQ ID NO:20313 |
| | | AA | SYGMH | VIWYDESNKYYADSVKG | ELAWYEDS |
| | | | SEQ ID NO:4290 | SEQ ID NO:12302 | SEQ ID NO:20314 |
| iPS:392714 | 21-225_16G12 | NA | AGCTATGCCATGAAC | ACTATTAGTGGTCGTGGT GGTCACACATACTACGC AGACTCCGTGAGGGGC | CAGGACTGC |
| | | | SEQ ID NO:4291 | SEQ ID NO:12303 | SEQ ID NO:20315 |
| | | AA | SYAMT | TISGRGGHTYYADSVRG | QDC |
| | | | SEQ ID NO:4292 | SEQ ID NO:12304 | SEQ ID NO:20316 |
| iPS:392716 | 21-225_17B5 | NA | GACTATGGCATGCAC | GTTATATGGTATGATGA AGTAATAAACACTATA TAGACTCCGTGAAGGGC | GAACTGGGGTTCCGGTTTGA CTAC |
| | | | SEQ ID NO:4293 | SEQ ID NO:12305 | SEQ ID NO:20317 |
| | | AA | DYGMH | VIWYDESNKHYIDSVKG | ELGFRFDY |
| | | | SEQ ID NO:4294 | SEQ ID NO:12306 | SEQ ID NO:20318 |
| iPS:392718 | | NA | AGCTATGTCTATCAAC | TGGATGAACCTAACAC TGGTAACACAGGCTATG CACAGAAGTTCCAGGGC | AAGGCTGGGTTTGACTAC |

FIGURE 49
(Continued)

| | | | | | | |
|---|---|---|---|---|---|---|
| iPS:392720 | 21-225_17B8 | AA | SEQ ID NO:4295<br>SYAIN | SEQ ID NO:12307<br>WMNPNTGNTGYAQKFQG | SEQ ID NO:20319<br>KAGFDY |
| | | NA | SEQ ID NO:4296<br>AGCTATGCCATGAGC | SEQ ID NO:12308<br>ATTATTAGTGGTCGTGGG<br>GGAAACGCATTCTACGC<br>AGACTCCGTGAAGGGC | SEQ ID NO:20320<br>CGTATAGCAGTGGCTGGCTC<br>GGAGGCTTTTGATATC |
| iPS:392722 | 21-225_17A12 | AA | SEQ ID NO:4297<br>SYAMS | SEQ ID NO:12309<br>IISGRGGNAFYADSVKG | SEQ ID NO:20321<br>RIAVAGSEAFDI |
| | | NA | SEQ ID NO:4298<br>AGCTATGCCATGAGC | SEQ ID NO:12310<br>ATTATTAGTGGTCGTGGT<br>GGTAACACATTCTACGC<br>AGACTCCGTGAAGGGC | SEQ ID NO:20322<br>CGTCTGGCAGTGGCTGGCTC<br>GGAGGCTTTTGATATC |
| iPS:392726 | 21-225_18E12 | AA | SEQ ID NO:4299<br>SYAMS | SEQ ID NO:12311<br>IISGRGGNTFYADSVKG | SEQ ID NO:20323<br>RLAVAGSEAFDI |
| | | NA | SEQ ID NO:4300<br>AGCTATAGCATGAAC | SEQ ID NO:12312<br>TCCATTAGTGGGAGTAG<br>TAGTACATATACTACGC<br>AGACTCAGTGAAGGGC | SEQ ID NO:20324<br>GATCGTGGGAGCTAC |
| | 21-225_20B5 | AA | SEQ ID NO:4301<br>SYSMN | SEQ ID NO:12313<br>SISGSSSYIYYADSVKG | SEQ ID NO:20325<br>DRGSY |
| iPS:392728 | | NA | SEQ ID NO:4302<br>GACTATTACATGAGC | SEQ ID NO:12314<br>CACATTAGTAGTAGTGG<br>TAGTACCATATACTACGC<br>AGACTCTGTGAAGGGC | SEQ ID NO:20326<br>TATCGGAATAACCGGGGTA<br>CTTCGATCTC |
| | 21-225_20F7 | AA | SEQ ID NO:4303<br>DYYMS | SEQ ID NO:12315<br>HISSSGSTIYYADSVKG | SEQ ID NO:20327<br>YRNNRGYFDL |
| | | | SEQ ID NO:4304 | SEQ ID NO:12316 | SEQ ID NO:20328 |

FIGURE 49
(Continued)

| | | | | | |
|---|---|---|---|---|---|
| iPS:392730 | 21-225_17A1 | NA | AGCTATGCCATGAAC | GTTATTAGTGGTAGTGGT AGTAACACATACTACGC AGACTCCGTGAAGGGC | AGATATACCAGTGACTGGCA TGATGCTTTTGATATC |
| | | | SEQ ID NO:4305 | SEQ ID NO:12317 | SEQ ID NO:20329 |
| | | AA | SYAMN | VISGSGSNTYYADSVKG | RYTSDWHDAFDI |
| | | | SEQ ID NO:4306 | SEQ ID NO:12318 | SEQ ID NO:20330 |
| iPS:392732 | 21-225_17E5 | NA | GACTATGGCATGCAC | CTTATATGGTATGATGTA ACTAATAAATACTATGG AGACTCCGTGAAGGGC | GAGCTTGGCTGGTACGAGGA CTAC |
| | | | SEQ ID NO:4307 | SEQ ID NO:12319 | SEQ ID NO:20331 |
| | | AA | DYGMH | LIWYDVTNKYYGDSVKG | ELGWYEDY |
| | | | SEQ ID NO:4308 | SEQ ID NO:12320 | SEQ ID NO:20332 |
| iPS:392734 | 21-225_17D8 | NA | AGCTATGGCTTGAAC | TCCATTAGTGGTAGTGGT AGTCACATATCCTACGC GGACTCAGTGAAGGGC | GATCGGGGCAGTGGC |
| | | | SEQ ID NO:4309 | SEQ ID NO:12321 | SEQ ID NO:20333 |
| | | AA | SYGLN | SISGSGSHISYADSVKG | DRGSG |
| | | | SEQ ID NO:4310 | SEQ ID NO:12322 | SEQ ID NO:20334 |
| iPS:392736 | 21-225_17B12 | NA | AGCTATGCCATGAAC | GTTATTAGTGGTAGTGGT GGTAGCACATACTACGC AGACTCCGTGAAGGGC | AGGTATACCAGTGACTGGCA TGATGCTTTTGATATC |
| | | | SEQ ID NO:4311 | SEQ ID NO:12323 | SEQ ID NO:20335 |
| | | AA | SYAMN | VISGSGGSTYYADSVKG | RYTSDWHDAFDI |
| | | | SEQ ID NO:4312 | SEQ ID NO:12324 | SEQ ID NO:20336 |
| iPS:392738 | 21-225_18G4 | NA | AGCTATGGCATGCAC | ATTATATGGTATGATGG AAGTAATAAATACTATG CAGACTCCGTGAAGGGC | GATCTGAGTATGGGGCGGTAT GGACGTC |

FIGURE 49
(Continued)

| | | | SEQ ID NO:4313 SYGMH | SEQ ID NO:12325 IIWYDGSNKYYADSVKG | SEQ ID NO:20337 DLSMGGMDV |
|---|---|---|---|---|---|
| iPS:392740 | 21-225_18H12 | AA | | | |
| | | NA | SEQ ID NO:4314 GACTATGGCATGCAC | SEQ ID NO:12326 GTTATATGGTATGATGTAACTAATAAATACTATGCAGACTCCGTGAAGGGC | SEQ ID NO:20338 GAGGTTGGCTGGTACGAGGACTAC |
| iPS:392742 | 21-225_20B2 | AA | SEQ ID NO:4315 DYGMH | SEQ ID NO:12327 VIWYDVTNKYYADSVKG | SEQ ID NO:20339 EVGWYEDY |
| | | NA | SEQ ID NO:4316 AATTATGTCATTCAC | SEQ ID NO:12328 GTTATATGGTATGATGGAAGTAATAAATACTATGCAGACTCCGTGAAGGGC | SEQ ID NO:20340 GAGAAGTATAGCAGCAGCTGGTACGACTACGGTATGGACGTC |
| iPS:392744 | 21-225_20D5 | AA | SEQ ID NO:4317 NYVIH | SEQ ID NO:12329 VIWYDGSNKYYADSVKG | SEQ ID NO:20341 EKYSSSWYDYGMDV |
| | | NA | SEQ ID NO:4318 AGCTATGGCATGCAC | SEQ ID NO:12330 GTTATTTGGTATGAAGAAATAATCAATACTATGCAGACTCCGTGAAGGGC | SEQ ID NO:20342 GAACTGGGGTTCCGGTCTGACTAC |
| iPS:392746 | 21_225_20H7 | AA | SEQ ID NO:4319 SYGMH | SEQ ID NO:12331 VIWYEENNQYYADSVKG | SEQ ID NO:20343 ELGFRSDY |
| | | NA | SEQ ID NO:4320 AGCTATAGCATGAAC | SEQ ID NO:12332 TCCATTAGTGGTAGTAGTAGTTTCATATACTACGCAGACTCAGTGAAGGGC | SEQ ID NO:20344 GTAGCAGCTCTTGACTAC |

FIGURE 49
(Continued)

| | | | | | |
|---|---|---|---|---|---|
| iPS:392748 | 21-225_20H7 | AA | SEQ ID NO:4321<br>SYSMN | SEQ ID NO:12333<br>SISGSSSSFIYYADSVKG | SEQ ID NO:20345<br>VAALDY |
| | | NA | SEQ ID NO:4322<br>AGCTATAGCGTGAAC | SEQ ID NO:12334<br>TCCATTAGTAGTAGTAGT<br>AGTTCCTATACTACGCA<br>GACTCAGTGAAGGGC | SEQ ID NO:20346<br>AACTGGGACTAC |
| iPS:392750 | 21-225_20A8 | AA | SEQ ID NO:4323<br>SYSVN | SEQ ID NO:12335<br>SISSSSFLYYADSVKG | SEQ ID NO:20347<br>NWDY |
| | | NA | SEQ ID NO:4324<br>AGCGATGACATGCAC | SEQ ID NO:12336<br>GTTATATGGTTTGATGGA<br>AGTAATAAATACTATGC<br>AGACTCCGTGAAGGGC | SEQ ID NO:20348<br>GATCTAATAGCAGCAGCTGG<br>TACGGTTGACTAC |
| iPS:392752 | 21-225_20A10 | AA | SEQ ID NO:4325<br>SDDMH | SEQ ID NO:12337<br>VIWFDGSNKYYADSVKG | SEQ ID NO:20349<br>DLIAAAGTVDY |
| | | NA | SEQ ID NO:4326<br>AGCTATGGCATGCAC | SEQ ID NO:12338<br>GTTATATCATATGATGGA<br>AGTAATAAATACTATGC<br>AGACTCCGTGAAGGGC | SEQ ID NO:20350<br>GGGGTATGGTTCGGGGACCT<br>C |
| iPS:392754 | 21-225_21D3 | AA | SEQ ID NO:4327<br>SYGMH | SEQ ID NO:12339<br>VISYDGSNKYYADSVKG | SEQ ID NO:20351<br>GVWFGDL |
| | | NA | SEQ ID NO:4328<br>GACTATGGCATGCAC | SEQ ID NO:12340<br>GTTATATGGTATGATGTA<br>ACTAATGAATACTATGC<br>AGACTCCGTGAAGGGC | SEQ ID NO:20352<br>GAGCTTGGCTGGTACGAGGA<br>CTAC |
| iPS:392758 | 21-225_21G11 | AA | SEQ ID NO:4329<br>DYGMH | SEQ ID NO:12341<br>VIWYDVTNEYYADSVKG | SEQ ID NO:20353<br>ELGWYEDY |
| | | | SEQ ID NO:4330 | SEQ ID NO:12342 | SEQ ID NO:20354 |

FIGURE 49
(Continued)

| | | | | | |
|---|---|---|---|---|---|
| iPS:392760 | 21-225_22G3 | NA | AGCTATGCCATGAAC | ATTATTAGTGGTGGTCGTGGT GTTAACACATTCTACGCA GACTCCGTGAAGGGC | CGTTTGGCAGTGGCTGGCTC GGAGGCTTTTGATATC |
| | | | SEQ ID NO:4331 | SEQ ID NO:12343 | SEQ ID NO:20355 |
| | | AA | SYAMN | IISGRGVNTFYADSVKG | RLAVAGSEAFDI |
| | | | SEQ ID NO:4332 | SEQ ID NO:12344 | SEQ ID NO:20356 |
| iPS:392762 | 21-225_22G5 | NA | AGCTATGCCATGAAC | GTTATTAGTCGTAGTGGT GGTTACACATACTACGC GGACTCCGTGAAGGGC | CGTTTAGCAGTGGCTGGCTC GGAGGCTTTTGATATC |
| | | | SEQ ID NO:4333 | SEQ ID NO:12345 | SEQ ID NO:20357 |
| | | AA | SYAMN | VISRSGGYTYYADSVKG | RLAVAGSEAFDI |
| | | | SEQ ID NO:4334 | SEQ ID NO:12346 | SEQ ID NO:20358 |
| iPS:392764 | 21-225_22G10 | NA | AGCTATGCCATGAAC | GTTATTAGTGGTGGTAGTGGT GGTAACACATTCTACGC AGACTCCGTGAAGGGC | CGTATGGCAGTGGCTGGCTC GGAGGCTTTTGATATC |
| | | | SEQ ID NO:4335 | SEQ ID NO:12347 | SEQ ID NO:20359 |
| | | AA | SYAMN | VISGSGGNTFYADSVKG | RMAVAGSEAFDI |
| | | | SEQ ID NO:4336 | SEQ ID NO:12348 | SEQ ID NO:20360 |
| iPS:392766 | 21-225_23H4 | NA | AGCTATGCCATGAAC | GTTATTAGTGGTGTAGTGGT GGTACCACATACTTCGC AGACTCCGTGAAGGGC | AGAAATAGCAGTGGCTGGCA TGATGTTTTTGATATC |
| | | | SEQ ID NO:4337 | SEQ ID NO:12349 | SEQ ID NO:20361 |
| | | AA | SYAMN | VISGSGGTTYFADSVKG | RNSSGWHDVFDI |
| | | | SEQ ID NO:4338 | SEQ ID NO:12350 | SEQ ID NO:20362 |
| iPS:392768 | 21-225_20B8 | NA | AGTTATAGCATGAAC | TCCATCAGTGGCAGTGG TAGTCACATATACTACGC GGACTCAGTGAAGGGC | GATCGGGGCAGTGGC |
| | | | SEQ ID NO:4339 | SEQ ID NO:12351 | SEQ ID NO:20363 |
| | | AA | SYSMN | SISGSGSHYYADSVKG | DRGSG |
| | | | SEQ ID NO:4340 | SEQ ID NO:12352 | SEQ ID NO:20364 |

FIGURE 49
(Continued)

| iPS: | Name | Type | CDR1 | CDR2 | CDR3 |
|---|---|---|---|---|---|
| iPS:392770 | 21-225_20C10 | NA | AGCTATGCCATGAAC | GTTATTAGTGGTAGTGGT GGTACCACATACGC AGACTCCGTGAAGGGC | AGGTATACCAGTGACTGGCA TGATGCTTTTGATATC |
| | | | SEQ ID NO:4341 | SEQ ID NO:12353 | SEQ ID NO:20365 |
| | | AA | SYAMN | VISGSGGTTYADSVKG | RYTSDWHDAFDI |
| | | | SEQ ID NO:4342 | SEQ ID NO:12354 | SEQ ID NO:20366 |
| iPS:392772 | 21-225_20E12 | NA | AGCTATGGCATGCAC | GTTATGTGGTATGATGA AAGTAATAAACACTATG CAGACTCCGTGAAGGGC | GAACTGGGGTTCCGGTTTGA CTAC |
| | | | SEQ ID NO:4343 | SEQ ID NO:12355 | SEQ ID NO:20367 |
| | | AA | SYGMH | VMWYDESNKHYADSVKG | ELGFRFDY |
| | | | SEQ ID NO:4344 | SEQ ID NO:12356 | SEQ ID NO:20368 |
| iPS:392774 | 21-225_21F3 | NA | AGAAGTAGTTACTACTGGG C | AGCATCTATTATAGTGG GAGCACCTACTACAACC CGTCCCTCAAGAGT | CTTAGCAGCAGCTGGGACTT CCAGCAC |
| | | | SEQ ID NO:4345 | SEQ ID NO:12357 | SEQ ID NO:20369 |
| | | AA | RSSYYWG | SIYYSGSTYYNPSLKS | LSSSWDFQH |
| | | | SEQ ID NO:4346 | SEQ ID NO:12358 | SEQ ID NO:20370 |
| iPS:392776 | 21-225_21A12 | NA | AGCTATAGCATGAAC | TCCATTAGTGGTAGTAGT AGTTACATATACTACGC AGACTCAGTGAAGGGC | GCGGCTGGCTTTGACTAC |
| | | | SEQ ID NO:4347 | SEQ ID NO:12359 | SEQ ID NO:20371 |
| | | AA | SYSMN | SISGSSSYIYYADSVKG | AAGFDY |
| | | | SEQ ID NO:4348 | SEQ ID NO:12360 | SEQ ID NO:20372 |
| iPS:392778 | 21-225_22H3 | NA | AGCTATAGCATGAAC | TCCATTAGTAGTAGTAGT AGTTACATATACTACGC AGACTCAGTGAAGGGC | GATAGGGGGCAGCCTC |
| | | | SEQ ID NO:4349 | SEQ ID NO:12361 | SEQ ID NO:20373 |

FIGURE 49
(Continued)

| | | | | | | |
|---|---|---|---|---|---|---|
| iPS:392780 | 21-225_22B7 | AA | SYSMN<br>SEQ ID NO:4350 | SISSSSSYIYYADSVKG<br>SEQ ID NO:12362 | DRGSL<br>SEQ ID NO:20374 |
| | | NA | AGCTATGGCATGAAC<br>SEQ ID NO:4351 | GTTATTTGGTATGAAGA<br>AATAATCAATACTATG<br>CAGACTCCGTGAAGGGC<br>SEQ ID NO:12363 | GAAGTGGGGTTCCGGTCTGA<br>CTAC<br>SEQ ID NO:20375 |
| iPS:392782 | 21-225_22B12 | AA | SYGMH<br>SEQ ID NO:4352 | VIWYEENNQYYADSVKG<br>SEQ ID NO:12364 | EVGFRSDY<br>SEQ ID NO:20376 |
| | | NA | AGCTATAGCATGAAC<br>SEQ ID NO:4353 | TCCATTAGTAGTGGTAGTAGT<br>AGTTACACATACTACGC<br>AGACTCCGTGAAGGGC<br>SEQ ID NO:12365 | GTAGCAGCCCTTGACTCC<br>SEQ ID NO:20377 |
| iPS:392784 | 21-225_23C7 | AA | SYSMN<br>SEQ ID NO:4354 | SISGSSSYTYYADSVKG<br>SEQ ID NO:12366 | VAALDS<br>SEQ ID NO:20378 |
| | | NA | AGCTATGTTATGAGC<br>SEQ ID NO:4355 | GCTATGAGTGGTAGTGG<br>TGGTAGCACATATTATGT<br>AGACTCCGTGAAGGGC<br>SEQ ID NO:12367 | ACTGGGGTCTTTGACTAC<br>SEQ ID NO:20379 |
| iPS:392786 | 21-225_24E1 | AA | SYVMS<br>SEQ ID NO:4356 | AMSGSGGSTYYVDSVKG<br>SEQ ID NO:12368 | TGVFDY<br>SEQ ID NO:20380 |
| | | NA | AATTATGATATCAAC<br>SEQ ID NO:4357 | TGGATGCACCTAACAG<br>TGGTAACACAGGCTATG<br>CACAGAGGTTCCAGGGC<br>SEQ ID NO:12369 | AGCAGTGGCTGGAGGTCTT<br>TGACTAC<br>SEQ ID NO:20381 |
| | | AA | NYDIN<br>SEQ ID NO:4358 | WMHPNSGNTGYAQRFQG<br>SEQ ID NO:12370 | SSGWEVFDY<br>SEQ ID NO:20382 |

FIGURE 49
(Continued)

| | | | | | | |
|---|---|---|---|---|---|---|
| iPS:392788 | 21-225_20C8 | NA | AGCTATAGCATGAAC | TCCATTAGTGGCAGTAGTAGTTACATATACTACGCAGACTCAGTGAAGGCC | GACAGAGGCAGTCTC | |
| | | | SEQ ID NO:4359 | SEQ ID NO:12371 | SEQ ID NO:20383 | |
| | | AA | SYSMN | SISGSSSYIYYADSVKA | DRGSL | |
| | | | SEQ ID NO:4360 | SEQ ID NO:12372 | SEQ ID NO:20384 | |
| iPS:392790 | 21-225_20D10 | NA | GACTATGGCATGCAC | GTTATATGGTTTGATGGAAGTAATAAATACTATGTAGACTCCGTGAAGGGC | GATCTTGGCTGGACGGAAGAGTAC | |
| | | | SEQ ID NO:4361 | SEQ ID NO:12373 | SEQ ID NO:20385 | |
| | | AA | DYGMH | VIWFDGSNKYYVDSVKG | DLGWTEEY | |
| | | | SEQ ID NO:4362 | SEQ ID NO:12374 | SEQ ID NO:20386 | |
| iPS:392792 | 21-225_20G12 | NA | AGCTATAGCATGAAC | TCCATTAGCGGTAGTAGTAGTTACATCTACTACGCAGACTCACTGAAGGGC | GATCGTGGGAGTAC | |
| | | | SEQ ID NO:4363 | SEQ ID NO:12375 | SEQ ID NO:20387 | |
| | | AA | SYSMN | SISGSSSYIYYADSLKG | DRGSY | |
| | | | SEQ ID NO:4364 | SEQ ID NO:12376 | SEQ ID NO:20388 | |
| iPS:392794 | 21-225_21H3 | NA | AGGAGTAGTTACTACTGGGGC | AATATTTATTATAGTGGGAGCACCTAGCAGACAACCCGTCCCTCAAGAGT | CATGGAAAAGACTGGGGCCTTGACTAC | |
| | | | SEQ ID NO:4365 | SEQ ID NO:12377 | SEQ ID NO:20389 | |
| | | AA | RSSYYWG | NIYYSGSTYDNPSLKS | HGKDWGLDY | |
| | | | SEQ ID NO:4366 | SEQ ID NO:12378 | SEQ ID NO:20390 | |
| iPS:392796 | 21-225_22A4 | NA | GACTATGGCATACAC | GTTATATGGTTTGATGGAAGTAATAAATACTATGCAGACTCCGTGAAGGGC | GATCTTGGCTGGACGGAAGAGTAC | |
| | | | SEQ ID NO:4367 | SEQ ID NO:12379 | SEQ ID NO:20391 | |

FIGURE 49
(Continued)

| | | | AA | DYGIH | | VIWFDGSNKYYADSVKG | | DLGWTEEY | |
|---|---|---|---|---|---|---|---|---|---|
| iPS:392798 | | | | SEQ ID NO:4368 | | SEQ ID NO:12380 | | SEQ ID NO:20392 | |
| | 21-225_22C7 | | NA | AGCTATGGCATGCAC | | GTTATATGGCATGATGG AAGTAATAAATACTATG CAGACTCCGTGAAGGGC | | GATCTGAGTATGGGCGGTAT GGACGTC | |
| | | | | SEQ ID NO:4369 | | SEQ ID NO:12381 | | SEQ ID NO:20393 | |
| iPS:392800 | | | AA | SYGMH | | VIWHDGSNKYYADSVKG | | DLSMGGMDV | |
| | | | | SEQ ID NO:4370 | | SEQ ID NO:12382 | | SEQ ID NO:20394 | |
| | 21-225_22D12 | | NA | AGGAGTAGTTACTACTGGG C | | AATATCTATTATAGTGGG ACCACCTCCTACAACCC GTCCCTCAAGAGT | | CTCAGCAGCAGCTGGTCCGT TGACTAC | |
| | | | | SEQ ID NO:4371 | | SEQ ID NO:12383 | | SEQ ID NO:20395 | |
| iPS:392802 | | | AA | RSSYYWG | | NIYYSGTTSYNPSLKS | | LSSSWSVDY | |
| | | | | SEQ ID NO:4372 | | SEQ ID NO:12384 | | SEQ ID NO:20396 | |
| | 21-225_23E7 | | NA | AGCTATGCCATGAAC | | GCTATTAGTGGTGGTAGTGGT GGTTTCACATACTACGCA GACTCCGTGAAGGGC | | ACCAGTGGCTTTGACTAC | |
| | | | | SEQ ID NO:4373 | | SEQ ID NO:12385 | | SEQ ID NO:20397 | |
| iPS:392806 | | | AA | SYAMN | | AISGSGGFTYYADSVKG | | TSGFDY | |
| | | | | SEQ ID NO:4374 | | SEQ ID NO:12386 | | SEQ ID NO:20398 | |
| | 21-225_24H3 | | NA | AGCTATGGCATGCAC | | GTTATATGGTATGATGG AAGTAATAAATACTATG CAGACTCCGTGAAGGGC | | GTAGCAGTGGCAGGCGGTAT GGACGTC | |
| | | | | SEQ ID NO:4375 | | SEQ ID NO:12387 | | SEQ ID NO:20399 | |
| | | | AA | SYGMH | | VIWYDGSNKYYADSVKG | | VAVAGGMDV | |
| | | | | SEQ ID NO:4376 | | SEQ ID NO:12388 | | SEQ ID NO:20400 | |

FIGURE 49
(Continued)

| | | | | |
|---|---|---|---|---|
| iPS:392808 | 21-225_20F8 | NA | AGCTATGCCATGAGC | GTTATTAGTGGTAGTGGT GGTAGCACATATTACGC AGACTCCGTGAAGGGC | AGGTATAACAGTGGCTGGCA TGATGTTTTGATATC |
| | | | SEQ ID NO:4377 | SEQ ID NO:12389 | SEQ ID NO:20401 |
| | | AA | SYAMS | VISGSGGSTYYADSVKG | RYNSGWHDVFDI |
| | | | SEQ ID NO:4378 | SEQ ID NO:12390 | SEQ ID NO:20402 |
| iPS:392810 | 21-225_20H12 | NA | AACTATGGCATGCAC | GTTATATGGTATGATGA AATAATAAATACTATG TAGACTCCGTGAAGGC | GAGTTGGGGTTCCGGTCTGA CTAC |
| | | | SEQ ID NO:4379 | SEQ ID NO:12391 | SEQ ID NO:20403 |
| | | AA | NYGMH | VIWYDENNKYYVDSVKG | ELGFRSDY |
| | | | SEQ ID NO:4380 | SEQ ID NO:12392 | SEQ ID NO:20404 |
| iPS:392812 | 21-225_21F4 | NA | AGCTATGCCATGAAC | GTTATTAGTGGTGGTCGTGGT GGTAACACATTCTACGC AGACTCCGTGAAGGGC | CGTTTGGCCAGTGGTGGCTC GGAGGCTTGTGATATC |
| | | | SEQ ID NO:4381 | SEQ ID NO:12393 | SEQ ID NO:20405 |
| | | AA | SYAMN | VISGRGGNTFYADSVKG | RLAVAGSEACDI |
| | | | SEQ ID NO:4382 | SEQ ID NO:12394 | SEQ ID NO:20406 |
| iPS:392814 | 21-225_22A1 | NA | AGCTATGGCATGCAC | GTTATGTGGTATGATGG AAGTAATAAATATTATG CAGACTCCGTGAAGGGC | GATGGGGGATTTTTGGAGTG GTTAGACTAC |
| | | | SEQ ID NO:4383 | SEQ ID NO:12395 | SEQ ID NO:20407 |
| | | AA | SYGMH | VMWYDGSNKYYADSVK G | DGGFLEWLDY |
| | | | SEQ ID NO:4384 | SEQ ID NO:12396 | SEQ ID NO:20408 |
| iPS:392816 | 21_225_22E4 | NA | AGCTATGCCATGAGC | ATTATTAGTGGTCGTGGT ACTAACACATTCTACGC AGACTCCGTGAAGGGC | CGTATAGCAGTGGCTGGCTC GGAGGCTTTTGATATC |

FIGURE 49
(Continued)

| | | | | | | | |
|---|---|---|---|---|---|---|---|
| iPS:392818 | 21-225_22E4 | AA | SEQ ID NO:4385<br>SYAMS | | SEQ ID NO:12397<br>IISGRGTNTFYADSVKG | | SEQ ID NO:20409<br>RIAVAGSEAFDI |
| | | NA | SEQ ID NO:4386<br>AGCTATGGCATGCAC | | SEQ ID NO:12398<br>ATTATATCATATGATGGAAGTAATAAATACTATGCAGACTCCGTGAAGGGC | | SEQ ID NO:20410<br>GGGGTTTGGTTCGGGGACTTC |
| iPS:392820 | 21-225_22D8 | AA | SEQ ID NO:4387<br>SYGMH | | SEQ ID NO:12399<br>IISYDGSNKYYADSVKG | | SEQ ID NO:20411<br>GVWFGDF |
| | | NA | SEQ ID NO:4388<br>AGAAGTAGTTACTACTGGGGC | | SEQ ID NO:12400<br>AGTATCTATTATATAGTGGGAGCGCCCAGTACAACCCGTCCCTCAAGAGT | | SEQ ID NO:20412<br>CTGAGCAGCAGCTGGTCTTTTGACTAC |
| iPS:392822 | 21-225_23D1 | AA | SEQ ID NO:4389<br>RSSYYWG | | SEQ ID NO:12401<br>SIYYSGSAQYNPSLKS | | SEQ ID NO:20413<br>LSSSWSFDY |
| | | NA | SEQ ID NO:4390<br>AGGAGTAGTTACTACTGGGGC | | SEQ ID NO:12402<br>AATATTTATTATATAGTGGGACCACTTACAACAACCCGTCCCTCAAGAGT | | SEQ ID NO:20414<br>CATGGAAAAGACTGGGGCCTTGACTAC |
| iPS:392824 | 21-225_23C8 | AA | SEQ ID NO:4391<br>RSSYYWG | | SEQ ID NO:12403<br>NIYYSGTTYNNPSLKS | | SEQ ID NO:20415<br>HGKDWGLDY |
| | | NA | SEQ ID NO:4392<br>AGGAGTAGTTACTACTGGGGC | | SEQ ID NO:12404<br>AGTATCTATTATATAGTGGGAGCGCCAACTACAACCCGTCCCTCAAGAGT | | SEQ ID NO:20416<br>CTCAGCAGCAGCTGGTCCATTGACAAC |
| | 21-225_24E5 | AA | SEQ ID NO:4393<br>RSSYYWG | | SEQ ID NO:12405<br>SIYYSGSANYNPSLKS | | SEQ ID NO:20417<br>LSSSWSIDN |
| | | NA | SEQ ID NO:4394 | | SEQ ID NO:12406 | | SEQ ID NO:20418 |

FIGURE 49
(Continued)

| | | | | |
|---|---|---|---|---|
| iPS:392826 | 21-225_20B9 | NA | AGCTATAGCATGAAC | TACATTAGTAGTAGTAGT AGTACCATATACTATGC AGACTCTGTGAAGGGC | TCACTATGGTCCCCCTTTGAC TAC |
| | | | SEQ ID NO:4395 | SEQ ID NO:12407 | SEQ ID NO:20419 |
| | | AA | SYSMN | YISSSSSTIYYADSVKG | SLWSPFDY |
| | | | SEQ ID NO:4396 | SEQ ID NO:12408 | SEQ ID NO:20420 |
| iPS:392830 | 21-225_21A5 | NA | AGTTACTTCTGGAGC | CGTATCTATACCAGTGG GATCACCAACTACAACC CCTCCCTCAAGAGT | GGCCCGACTTCGGGGTGGTT CGACCCC |
| | | | SEQ ID NO:4397 | SEQ ID NO:12409 | SEQ ID NO:20421 |
| | | AA | SYFWS | RIYTSGITNYNPSLKS | GPTSGWFDP |
| | | | SEQ ID NO:4398 | SEQ ID NO:12410 | SEQ ID NO:20422 |
| iPS:392832 | 21-225_21H8 | NA | GACTATGGCATGCAC | GTTATATGGTTTGATGGA AGTAATAAATACTATGC AGACTCCGTGAAGGGC | GATCTTGGCTGGACGGAAGA GTAC |
| | | | SEQ ID NO:4399 | SEQ ID NO:12411 | SEQ ID NO:20423 |
| | | AA | DYGMH | VIWFDGSNKYYADSVKG | DLGWTEEY |
| | | | SEQ ID NO:4400 | SEQ ID NO:12412 | SEQ ID NO:20424 |
| iPS:392834 | 21-225_22C1 | NA | AGGAGTAGTTACTACTGGGG C | AATATCTATTATAGTGGG GCCACCTATTATAATTCG TCCCTCAAGAGT | CATAGCGGCAGCTGGTCCCT TGACTAC |
| | | | SEQ ID NO:4401 | SEQ ID NO:12413 | SEQ ID NO:20425 |
| | | AA | RSSYYWG | NIYYSGATYYNSSLKS | HSGSWSLDY |
| | | | SEQ ID NO:4402 | SEQ ID NO:12414 | SEQ ID NO:20426 |
| iPS:392836 | 21-225_22F4 | NA | GACTATGGCATGCAC | GTTATATGGTATGATGG AAGTAATAAATACTATG TAGACTCCGTGAAGGGC | GAAAAGTATAGCAGCAGCTG GTACGACTACGGTATGGACG TC |
| | | | SEQ ID NO:4403 | SEQ ID NO:12415 | SEQ ID NO:20427 |

FIGURE 49
(Continued)

| | | AA | DYGMH | | VIWYDGSNKYYVDSVKG | | EKYSSSWYDYGMDV |
|---|---|---|---|---|---|---|---|
| iPS:392838 | | | | SEQ ID NO:4404 | | SEQ ID NO:12416 | SEQ ID NO:20428 |
| | 21-225_22G8 | NA | AGGAGTAGTTACTACTGGGGC | | AATATCTATTATAGTGGG AGCACCTACTACAACCC GTCCGTCAAGAGT | | CATGGAAAAGACTGGGGCT TGACTAC |
| | | AA | RSSYYWG | | NIYYSGSTYYNPSVKS | | HGKDWGLDY |
| iPS:392840 | | | | SEQ ID NO:4406 | | SEQ ID NO:12418 | SEQ ID NO:20430 |
| | 21-225_23G1 | NA | AGCTATGCCATGAGC | | GTTATTAGTGGTAGTGGT GGTACCACATATAACAC AGACTCCGTGAAGGGC | | AGCTCCTTGTTTGACTAC |
| | | | | SEQ ID NO:4407 | | SEQ ID NO:12419 | SEQ ID NO:20431 |
| | | AA | SYAMS | | VISGSGGTTYNTDSVKG | | SSLFDY |
| iPS:392842 | | | | SEQ ID NO:4408 | | SEQ ID NO:12420 | SEQ ID NO:20432 |
| | 21-225_23G8 | NA | AGCTATGCCATGAGC | | GCTATTAGTGGTAGTGGT GGTAGCACATACTAGC AGACTCCGTGAAGGGC | | AGCAGTGGCTGGTTCGCC |
| | | | | SEQ ID NO:4409 | | SEQ ID NO:12421 | SEQ ID NO:20433 |
| | | AA | SYAMS | | AISGSGGSTYYADSVKG | | SSGWFA |
| iPS:392844 | | | | SEQ ID NO:4410 | | SEQ ID NO:12422 | SEQ ID NO:20434 |
| | 21-225_23E11 | NA | TCCTATACCATGAAC | | TCCATTAGTGGTAGTAGT AGTTACATATGGTATGTA GACTCAGTGAAGGGC | | GATCGGGGCCAGTCTC |
| | | | | SEQ ID NO:4411 | | SEQ ID NO:12423 | SEQ ID NO:20435 |
| | | AA | SYTMN | | SISGSSSYIWYVDSVKG | | DRGSL |
| | | | | SEQ ID NO:4412 | | SEQ ID NO:12424 | SEQ ID NO:20436 |

FIGURE 49
(Continued)

| | | | | | |
|---|---|---|---|---|---|
| iPS:392846 | 21-225_24B6 | NA | AACTATGTCATGCAC | GTTATATGGTATGATGG AAGTAATAAATACTATG CAGACTCCGTGAAGGGC | GAGGAATATAGTAGTGGCTG GTACGACTACGGTATGGACG TC |
| | | | SEQ ID NO:4413 | SEQ ID NO:12425 | SEQ ID NO:20437 |
| | | AA | NYVMH | VIWYDGSNKYYADSVKG | EEYSSGWYDYGMDV |
| | | | SEQ ID NO:4414 | SEQ ID NO:12426 | SEQ ID NO:20438 |
| | | NA | AGCTATAGCATGAAC | TCCATTAGTAGTAGTAGT AGTTACATATACTACGC AGACTCAGTGAAGGGC | GATCGTGGGAGCTGC |
| iPS:392848 | 21-225_20F9 | | SEQ ID NO:4415 | SEQ ID NO:12427 | SEQ ID NO:20439 |
| | | AA | SYSMN | SISSSSSYIYYADSVKG | DRGSC |
| | | | SEQ ID NO:4416 | SEQ ID NO:12428 | SEQ ID NO:20440 |
| | | NA | ACCTATAGCATGAAC | TCCATTAGTAGTAGTAGT AGTTACATATACTACGC AGACTCAGTGAAGGGC | GATCGTGGGAGCCTC |
| iPS:392850 | 21-225_20H10 | | SEQ ID NO:4417 | SEQ ID NO:12429 | SEQ ID NO:20441 |
| | | AA | TYSMN | SISSSSSYIYYADSVKG | DRGSL |
| | | | SEQ ID NO:4418 | SEQ ID NO:12430 | SEQ ID NO:20442 |
| | | NA | AGCTATGCCATGAAC | ATTATTAGTGGTCGTGGT GGTAACACATTCTACGC AGACTCCGTGAAGGGC | CGTTGGCAGTGGCTGGCTC GGAGGCTTTTGATATC |
| iPS:392852 | 21-225_21A2 | | SEQ ID NO:4419 | SEQ ID NO:12431 | SEQ ID NO:20443 |
| | | AA | SYAMN | IISGRGGNTFYADSVKG | RLAVAGSEAFDI |
| | | | SEQ ID NO:4420 | SEQ ID NO:12432 | SEQ ID NO:20444 |
| iPS:392854 | 21_225_21E5 | NA | GACTATGGCATGCAC | GTTATATGGTATGATGA AGTAATAAATACTATG CAGACTCCGTGAAGGGC | GAACTGGGGTTCCGGTCTGA CTAT |

FIGURE 49
(Continued)

| | | | | | | |
|---|---|---|---|---|---|---|
| iPS:392856 | 21-225_21E5 | AA | SEQ ID NO:4421 DYGMH | SEQ ID NO:12433 VIWYDESNKYYADSVKG | SEQ ID NO:20445 ELGFRSDY | |
| iPS:392858 | 21-225_22A2 | NA | SEQ ID NO:4422 AGCTATGGCCATGAGC | SEQ ID NO:12434 GGTATTAGTGGTAGTGG AGGTAACACACCCTACG CAGACTCCGTGAAGGGC | SEQ ID NO:20446 GTAGTGGGAGCTGTCCAC | |
| | | AA | SEQ ID NO:4423 SYAM5 | SEQ ID NO:12435 GISGSGGNTPYADSVKG | SEQ ID NO:20447 VVGAVH | |
| iPS:392860 | 21-225_22H4 | NA | SEQ ID NO:4424 AGGAGTAGTTACTACTGGGG C | SEQ ID NO:12436 AATATTATTATAGTGGG AGCACCTACCACAACCC GTCTCTCAAGAGT | SEQ ID NO:20448 CATGGAAAAGACTGGGGCCT TGACTAC | |
| | | AA | SEQ ID NO:4425 RSSYYWG | SEQ ID NO:12437 NIYYSGSTYHNPSLKS | SEQ ID NO:20449 HGKDWGLDY | |
| iPS:392862 | 21-225_22H8 | NA | SEQ ID NO:4426 AGCTATGGCATGCAC | SEQ ID NO:12438 GTTATCTGGTATGATGGA AATAATAAATACTATGC AGACTCCGTGAAGGGC | SEQ ID NO:20450 GAGCTTGCCTGGTACGAAGA CTAC | |
| | | AA | SEQ ID NO:4427 SYGMH | SEQ ID NO:12439 VIWYDGNNKYYADSVKG | SEQ ID NO:20451 ELAWYEDY | |
| iPS:392864 | 21-225_23B9 | NA | SEQ ID NO:4428 AGTGGTGGTTACTACTGGAG C | SEQ ID NO:12440 TACATCTATTACAGTGGG AGCACCTACTACAACCC GTCCCTCAAGAGT | SEQ ID NO:20452 GAGGACGGTGCCTTCGGCTA CTACGGTATGGACGTC | |
| | | AA | SEQ ID NO:4429 SGGYYWS | SEQ ID NO:12441 YIYYSGSTYYNPSLKS | SEQ ID NO:20453 EDGAFGYYGMDV | |

FIGURE 49
(Continued)

| | | | | | |
|---|---|---|---|---|---|
| iPS:392866 | 21-225_23H11 | NA | SEQ ID NO:4430 AGCTATGGCATGCAC | SEQ ID NO:12442 GTTATATGGTATGATGA AATAATAAATACTATG TAGACTCCGTGAAGGGC | SEQ ID NO:20454 GAATTGGGGTTCCGGTCTGA CTAC |
| | | AA | SEQ ID NO:4431 SYGMH | SEQ ID NO:12443 VIWYDENNKYYVDSVKG | SEQ ID NO:20455 ELGFRSDY |
| iPS:392868 | 21-225_24D6 | NA | SEQ ID NO:4432 AGCTATGGCATGCAC | SEQ ID NO:12444 ATTATATCATATGCTGA AGTAATAAATCCTATGC AGACTCCGTGAAGGGC | SEQ ID NO:20456 CGGGGATACAGCTATGGCGG GTACGGTATGGACGTC |
| | | AA | SEQ ID NO:4433 SYGMH | SEQ ID NO:12445 IISYAGSNKSYADSVKG | SEQ ID NO:20457 RGYSYGGYGMDV |
| iPS:392870 | 21-225_20G9 | NA | SEQ ID NO:4434 AGGAGTAGTTACTACTGGGG C | SEQ ID NO:12446 AGTATCTATTATAGTGGG AGCGCCTCTTACAACCC GTCCCTCAAGAGT | SEQ ID NO:20458 CTGAGCAGCAGCTGGTCTTT TGACTAC |
| | | AA | SEQ ID NO:4435 RSSYYWG | SEQ ID NO:12447 SIYYSGSASYNPSLKS | SEQ ID NO:20459 LSSSWSFDY |
| iPS:392872 | 21-225_20B11 | NA | SEQ ID NO:4436 AGCTATGTCATGCAC | SEQ ID NO:12448 GTTATATGGTATGATGG AAGTAATAAATACTATG CAGACTCCGTGAAGGTC | SEQ ID NO:20460 GAGAGATATACCAGTGGCTG GTATGACTACGGTATGGACG TC |
| | | AA | SEQ ID NO:4437 SYVMH | SEQ ID NO:12449 VIWYDGSNKYYADSVKV | SEQ ID NO:20461 ERYTSGWYDYGMDV |
| | | | SEQ ID NO:4438 | SEQ ID NO:12450 | SEQ ID NO:20462 |

FIGURE 49
(Continued)

| | | | | |
|---|---|---|---|---|
| iPS:392874 | 21-225_21D2 | NA | AACTATGCCATGAGC | GTTCTTAGTGTGTAGTGGT GGTAGCACATTCTACGC AGACTCCGTGAAGGGC | TATTGTAGTAGTAGTGCCAGGTG CCCTTATGATGCCTTTGATAT C |
| | | | SEQ ID NO:4439 | SEQ ID NO:12451 | SEQ ID NO:20463 |
| | | AA | NYAMS | VLSGSGGSTFYADSVKG | YCSSARCPYDAFDI |
| | | | SEQ ID NO:4440 | SEQ ID NO:12452 | SEQ ID NO:20464 |
| iPS:392876 | 21-225_21F7 | NA | GACTATGGCATGCAC | GTTATATGGTTTGATGGA AATAATAAATACTATGT AGACTCCGTGAAGGGC | GATCTTGGCTGGACGGAAGA GTAC |
| | | | SEQ ID NO:4441 | SEQ ID NO:12453 | SEQ ID NO:20465 |
| | | AA | DYGMH | VIWFDGNNKYYVDSVKG | DLGWTEEY |
| | | | SEQ ID NO:4442 | SEQ ID NO:12454 | SEQ ID NO:20466 |
| iPS:392878 | 21-225_22C5 | NA | AGCTATGCCATGAGC | ATTATTAGTAGTGGT GGTTACACATACTACGC GGACTCCGTGAAGGGC | CGTATAGCAGTAGGCTGGCTC GGAGGCTTTGATATC |
| | | | SEQ ID NO:4443 | SEQ ID NO:12455 | SEQ ID NO:20467 |
| | | AA | SYAMS | IISGSGGYTYYADSVKG | RIAVAGSEAFDI |
| | | | SEQ ID NO:4444 | SEQ ID NO:12456 | SEQ ID NO:20468 |
| iPS:392880 | 21-225_22F9 | NA | AGCTATGGCATGCAC | GTTATATGGTATGAGGA AATAATAAAGACTATG TAGACTCCGTGAAGGGC | GAGTTAGGCTTCCAGTCTGA CTAC |
| | | | SEQ ID NO:4445 | SEQ ID NO:12457 | SEQ ID NO:20469 |
| | | AA | SYGMH | VIWYEENNKDYVDSVKG | ELGFQSDY |
| | | | SEQ ID NO:4446 | SEQ ID NO:12458 | SEQ ID NO:20470 |

FIGURE 49
(Continued)

| | | | | |
|---|---|---|---|---|
| iPS:392882 | 21-225_23A3 | NA | AGGAGTAGTTACTACTGGGG C SEQ ID NO:4447 | AATATTATTATAGTGGG AGCACCTACAACAACCC GTCCCTCAAGAGT SEQ ID NO:12459 | CATGGAAAAGACTGGGGCCT TGACTTC SEQ ID NO:20471 |
| | | AA | RSSYYWG SEQ ID NO:4448 | NIYYSGSTYNNPSLKS SEQ ID NO:12460 | HGKDWGLDF SEQ ID NO:20472 |
| iPS:392884 | 21-225_23A10 | NA | AGCTATGGCATGCAC SEQ ID NO:4449 | GTTATATGGTATGATGG AAGTAATAAATACTATG CAGACTCCGTGAAGGGC SEQ ID NO:12461 | GAAAGGTATAGCAGTGGCTG GCACGACTACGGTATGGACG TC SEQ ID NO:20473 |
| | | AA | SYGMH SEQ ID NO:4450 | VIWYDGSNKYYADSVKG SEQ ID NO:12462 | ERYSSGWHDYGMDV SEQ ID NO:20474 |
| iPS:392886 | 21-225_23A12 | NA | AATTATGATATCAAC SEQ ID NO:4451 | TGGATGCACCCTAACAG TGGTAACACAGGCTATG CACAGAAGTTCCAGGGC SEQ ID NO:12463 | AGCAGTGGCTGGTACTACTT TGACTAC SEQ ID NO:20475 |
| | | AA | NYDIN SEQ ID NO:4452 | WMHPNSGNTGYAQKFQG SEQ ID NO:12464 | SSGWYYFDY SEQ ID NO:20476 |
| iPS:392888 | 21-225_25A2 | NA | AGCTATGGCATGCAC SEQ ID NO:4453 | GTTATATGGTATGATGG AAGTAATAAATACTATG CAGACTCCGTGAAGGGC SEQ ID NO:12465 | AGGTATAGCAGCAGTGGTC AGGGGGTATGGACGTC SEQ ID NO:20477 |
| | | AA | SYGMH SEQ ID NO:4454 | VIWYDGSNKYYADSVKG SEQ ID NO:12466 | RYSSSWSGGMDV SEQ ID NO:20478 |

FIGURE 49
(Continued)

| | | | | |
|---|---|---|---|---|
| iPS:392890 | 21-225_20H9 | NA | AGCTATGCCATGAGC | GCTATTAGTGGTAGTGGT GGTTACACATACTACGC AGACTCCGTGAAGGGC | GGGGGGTCCCTCTTCTAC |
| | | | SEQ ID NO:4455 | SEQ ID NO:12467 | SEQ ID NO:20479 |
| | | AA | SYAMS | AISGSGGYTYYADSVKG | GGSLFY |
| | | | SEQ ID NO:4456 | SEQ ID NO:12468 | SEQ ID NO:20480 |
| iPS:392892 | 21-225_20C11 | NA | AGCTATGCCATGAGC | ACTATTAGTGGTCGTGGT GGTCACACATACTACGC AGACTCCGTGAAGGGC | CAGGACTGC |
| | | | SEQ ID NO:4457 | SEQ ID NO:12469 | SEQ ID NO:20481 |
| | | AA | SYAMS | TISGRGGHTYYADSVKG | QDC |
| | | | SEQ ID NO:4458 | SEQ ID NO:12470 | SEQ ID NO:20482 |
| iPS:392894 | 21-225_21G2 | NA | GACTATGGCATGCAC | GTTATATGGTATGATGTA ACTATAAATACTATGC AGACTCCGTGAAGGGC | GAGCTTGGCTGGTACGAGGA CTAC |
| | | | SEQ ID NO:4459 | SEQ ID NO:12471 | SEQ ID NO:20483 |
| | | AA | DYGMH | VIWYDVTNKYYADSVKG | ELGWYEDY |
| | | | SEQ ID NO:4460 | SEQ ID NO:12472 | SEQ ID NO:20484 |
| iPS:392896 | 21-225_21G7 | NA | AGAAGTAGTTACTACTGGGG C | AATATCTATTATAGTGGG TATAGTTACTACAATCCG TCCCTCAAGAGT | CATAGCACCAGCTGGTCCCT TGACTAC |
| | | | SEQ ID NO:4461 | SEQ ID NO:12473 | SEQ ID NO:20485 |
| | | AA | RSSYYWG | NIYYSGYSYNPSLKS | HSTSWSLDY |
| | | | SEQ ID NO:4462 | SEQ ID NO:12474 | SEQ ID NO:20486 |
| iPS:392898 | 21-225_21H10 | NA | AACGCCCTGGATGAAC | CGTATTAAAAGCAAAAC TGATGGTGGGACAACAG ACTACGCTGCACCGTG AAAGGC | GAAGGCTGGAACACGGACTA C |

FIGURE 49
(Continued)

| | | | | | | | | |
|---|---|---|---|---|---|---|---|---|
| iPS:392900 | 21-225_21H10 | AA | SEQ ID NO:4463 | NAWMN | SEQ ID NO:12475 | RIKSKTDGGTDYAAPVKG | SEQ ID NO:20487 | EGWNTDY |
| | | NA | SEQ ID NO:4464 | GACTATGGCATGCAC | SEQ ID NO:12476 | GTTATATGGTATGAGGGAAGTAATAAATACTATGTAGACTCCGTGAGGGGC | SEQ ID NO:20488 | GAGCTAGGCTTCCAGTCTGACTAC |
| iPS:392902 | 21-225_22F2 | AA | SEQ ID NO:4465 | DYGMH | SEQ ID NO:12477 | VIWYEGSNKYYVDSVRG | SEQ ID NO:20489 | ELGFQSDY |
| | | NA | SEQ ID NO:4466 | AGCTATGCCATGAGC | SEQ ID NO:12478 | GTTATTAGTGGTCGTGGTGGTAACACATTCTACGCAGACTCCGTGAAGGGC | SEQ ID NO:20490 | CGTATAGCAGTGGCTGGCTCGGAGGCTTTTGATATC |
| iPS:392904 | 21-225_22B5 | AA | SEQ ID NO:4467 | SYAMS | SEQ ID NO:12479 | VISGRGGNTFYADSVKG | SEQ ID NO:20491 | RIAVAGSEAFDI |
| | | NA | SEQ ID NO:4468 | GGTAGTAATTACTACTGGGC | SEQ ID NO:12480 | AATATCTATTATATGTGGGAGCACCTACTACAACCCGTCCCTCAAGAGT | SEQ ID NO:20492 | CATAGCAGTAGCTGGTCCCTTGACTAC |
| iPS:392906 | 21-225_22G9 | AA | SEQ ID NO:4469 | GSNYYWG | SEQ ID NO:12481 | NIYYSGSTYYNPSLKS | SEQ ID NO:20493 | HSSSWSLDY |
| | | NA | SEQ ID NO:4470 | AGCTATGGCCATGAGC | SEQ ID NO:12482 | GTTATATGGTATGATGAAACTAATAAATACTATGCAGACTCCGTGAAGGGC | SEQ ID NO:20494 | GAGCTTGCCTGGTACGAGGACTAC |
| iPS:392908 | 21-225_23F12 | AA | SEQ ID NO:4471 | SYGMH | SEQ ID NO:12483 | VIWYDETNKYYADSVKG | SEQ ID NO:20495 | ELAWYEDY |

FIGURE 49
(Continued)

| | | | | | | | | |
|---|---|---|---|---|---|---|---|---|
| iPS:392912 | 21-225_25A9 | NA | SEQ ID NO:4472 | AGCTATGGCATGCAC | SEQ ID NO:12484 | GTTATATGGTATGATGTAACTAATAAATACTATACAGGCTCCGTGAAGGGC | SEQ ID NO:20496 | GAAATTGGCTGGTTAGATGACTAC |
| | | AA | SEQ ID NO:4473 | SYGMH | SEQ ID NO:12485 | VIWYDVTNKYYTGSVKG | SEQ ID NO:20497 | EIGWLDDY |
| iPS:392914 | 21-225_25D12 | NA | SEQ ID NO:4474 | AGCGATGGCATGAAC | SEQ ID NO:12486 | GTTATATGGTATGATGGAAGTAATAAATACTATGCAGACTCCGTGAAGGGC | SEQ ID NO:20498 | GAGAGGTATAGCAGCAGCTGGTACGACTACGGTATGGACGTC |
| | | AA | SEQ ID NO:4475 | SDGMH | SEQ ID NO:12487 | VIWYDGSNKYYADSVKG | SEQ ID NO:20499 | ERYSSSWYDYGMDV |
| iPS:392916 | 21-225_27C5 | NA | SEQ ID NO:4476 | AGCTATAGCATGAAC | SEQ ID NO:12488 | TCCACTAGTAGTGATAGTTATATACTACGCAGACTCAGTGAAGGGC | SEQ ID NO:20500 | GTGGCGTCCTTTGACTGC |
| | | AA | SEQ ID NO:4477 | SYSMN | SEQ ID NO:12489 | STSSSDSYIYYADSVKG | SEQ ID NO:20501 | VASFDC |
| iPS:392918 | 21-225_28F5 | NA | SEQ ID NO:4478 | AGCTATGGCATGCAC | SEQ ID NO:12490 | GTTATATGGTATGATGAAAATAATAAATACTATGCAGACTCCGTGAAGGGC | SEQ ID NO:20502 | GAATTAGGCTGGTACGACGACTAC |
| | | AA | SEQ ID NO:4479 | SYGMH | SEQ ID NO:12491 | VIWYDENNKYYADSVKG | SEQ ID NO:20503 | ELGWYDDY |

FIGURE 49
(Continued)

| | | | | | | |
|---|---|---|---|---|---|---|
| iPS:392920 | 21-225_29G4 | NA | SEQ ID NO:4480 GACTATGGCATACAC | SEQ ID NO:12492 GTTATATGGTATGATGA AAGTAATAAATACTATG CAGACTCCATGAAGGGC | SEQ ID NO:20504 GAACTGGGAATGACGGGTGA CTAC |
| | | AA | SEQ ID NO:4481 DYGIH | SEQ ID NO:12493 VIWYDESNKYYADSMKG | SEQ ID NO:20505 ELGMTGDY |
| iPS:392922 | 21-225_30G4 | NA | SEQ ID NO:4482 AGCTATGGCATGCAC | SEQ ID NO:12494 GTTATATGGTATGATGG AACTGATAAATACTATG TAGACTCCGTGAAGGGC | SEQ ID NO:20506 GAAAATAGCAGCTCGTACTA CTTTGACTAC |
| | | AA | SEQ ID NO:4483 SYGMH | SEQ ID NO:12495 VIWYDGIDKYYVDSVKG | SEQ ID NO:20507 ENSSSYYFDY |
| iPS:392924 | 21-225_32H2 | NA | SEQ ID NO:4484 AGCTATGCATGCAC | SEQ ID NO:12496 GTTATATGGTATGATGG AAGTAATAAATACTATG CAGACTCCGTGAAGGGC | SEQ ID NO:20508 AGATATAGCAGCAGCTGGAC GGGGGTATGGACGTC |
| | | AA | SEQ ID NO:4485 SYGMH | SEQ ID NO:12497 VIWYDGSNKYYADSVKG | SEQ ID NO:20509 RYSSSWTGGMDV |
| iPS:392928 | 21-225_25A4 | NA | SEQ ID NO:4486 AATTATGATATTAAT | SEQ ID NO:12498 TGGATGTACCTAACAG TGGTAACACAGGCTATG CACAGAAATTCCAGGGC | SEQ ID NO:20510 AGCAGTGGCTGGTACTACTT TGACTAC |
| | | | SEQ ID NO:4487 | SEQ ID NO:12499 | SEQ ID NO:20511 |

FIGURE 49
(Continued)

| | | AA | | | |
|---|---|---|---|---|---|
| iPS:392930 | 21-225_25H9 | AA | NYDIN | WMYPNSGNTGYAQKFQG | SSGWYYFDY |
| | | | SEQ ID NO:4488 | SEQ ID NO:12500 | SEQ ID NO:20512 |
| | | NA | AACTATGGCATGCAC | ATTATATGGTATGATGG AAGTATAAATACTATG CAGACTCCGTGAAGGGC | GAGGGATACGATTTTTGGAG TGGCTTCTTTGACTCC |
| | | | SEQ ID NO:4489 | SEQ ID NO:12501 | SEQ ID NO:20513 |
| iPS:392934 | 21-225_27D5 | AA | NYGMH | IIWYDGSYKYYADSVKG | EGYDFWSGFFDS |
| | | | SEQ ID NO:4490 | SEQ ID NO:12502 | SEQ ID NO:20514 |
| | | NA | AGCTATGGCATGCAC | GTTATATGGTATGATGA AGTAATAAATACTATG GAGACTCCGTGAAGGGC | GAACTGGGGTTCCTCTCTGA CTAC |
| | | | SEQ ID NO:4491 | SEQ ID NO:12503 | SEQ ID NO:20515 |
| iPS:392936 | 21-225_28B6 | AA | SYGMH | VIWYDESNKYYGDSVKG | ELGFLSDY |
| | | | SEQ ID NO:4492 | SEQ ID NO:12504 | SEQ ID NO:20516 |
| | | NA | AATTATGATATTAAT | TGGATGCACCCTGACAG TGGTAACACAGGCTATG CACAGAAGTTCCAGGGC | AGCAGTGGCTGGTACTACTT TGACTAC |
| | | | SEQ ID NO:4493 | SEQ ID NO:12505 | SEQ ID NO:20517 |
| iPS:392938 | 21-225_29H4 | AA | NYDIN | WMHPDSGNTGYAQKFQG | SSGWYYFDY |
| | | | SEQ ID NO:4494 | SEQ ID NO:12506 | SEQ ID NO:20518 |
| | | NA | AGCTATGGCATACAC | GTTATATGGTATGATGG AAGTAATAAATACTATG CAGACTCCGTGAAGGGC | AGGTATAGCAGCAGCTGGTC AGGGGGTATGGACGTC |
| | | | SEQ ID NO:4495 | SEQ ID NO:12507 | SEQ ID NO:20519 |

FIGURE 49
(Continued)

| | | | | | | | |
|---|---|---|---|---|---|---|---|
| iPS:392940 | 21-225_29D9 | AA | SYGIH | | VIWYDGSNKYYADSVKG | | RYSSSWSGGMDV |
| | | | SEQ ID NO:4496 | | SEQ ID NO:12508 | | SEQ ID NO:20520 |
| | | NA | GACTATGGCATTCAC | | GTTATATGGTATGATGA AGTAATAACTACTATG CAGACTCCGTGAAGGGC | | GAAATTGGCTGGTTAGATGA CTAC |
| | | | SEQ ID NO:4497 | | SEQ ID NO:12509 | | SEQ ID NO:20521 |
| iPS:392942 | 21-225_30E9 | AA | DYGIH | | VIWYDESNNYYADSVKG | | EIGWLDDY |
| | | | SEQ ID NO:4498 | | SEQ ID NO:12510 | | SEQ ID NO:20522 |
| | | NA | AGCTGTGCCATGAAC | | GCTATTAGTGGTCGTGGT GGTAGCACATTCTACGC AGACTCCGTGAAGGGC | | GGGGAGCTACTAGAGGACTA CTACTTCTACGGTATGGACG TC |
| | | | SEQ ID NO:4499 | | SEQ ID NO:12511 | | SEQ ID NO:20523 |
| iPS:392944 | 21-225_31H5 | AA | SCAMN | | AISGRGGSTFYADSVKG | | GELLEDYYYGMDV |
| | | | SEQ ID NO:4500 | | SEQ ID NO:12512 | | SEQ ID NO:20524 |
| | | NA | AGCTATGCCATGAGC | | GCTATTAGTGGTCGTGGT GGAAGCATATTCCACGC AGACTCCGTGAAGGGC | | GGGGAGCTACTAGAGGACTA CTACTTCTACGGTATGGACG TC |
| | | | SEQ ID NO:4501 | | SEQ ID NO:12513 | | SEQ ID NO:20525 |
| iPS:392948 | 21-225_25G5 | AA | SYAMS | | AISGRGGSIFHADSVKG | | GELLEDYFYGMDV |
| | | | SEQ ID NO:4502 | | SEQ ID NO:12514 | | SEQ ID NO:20526 |
| | | NA | GACTATGGCATACAC | | GTTATTGGTATGATGGA AATAATAAATATATGC AGACTCCGTGAAGGGC | | GAAATTGGCTGGTTAGATGA CTAC |
| | | | SEQ ID NO:4503 | | SEQ ID NO:12515 | | SEQ ID NO:20527 |
| | | AA | DYGIH | | VIWYDGNNKYYADSVKG | | EIGWLDDY |
| | | | SEQ ID NO:4504 | | SEQ ID NO:12516 | | SEQ ID NO:20528 |

FIGURE 49
(Continued)

| | | | | | | |
|---|---|---|---|---|---|---|
| iPS:392950 | 21-225_25C10 | NA | AGCTATAGGATGAAC | | TCCATTAGTAGTAGTAGT AGTACCATATACTACGC AGACTCTGTGAAGGGC | | ACGGCTGTGGTTTTGACTAC |
| | | | SEQ ID NO:4505 | | SEQ ID NO:12517 | | SEQ ID NO:20529 |
| | | AA | SYRMN | | SISSSSSTIYYADSVKG | | TAGFDY |
| | | | SEQ ID NO:4506 | | SEQ ID NO:12518 | | SEQ ID NO:20530 |
| iPS:392952 | 21-225_26G1 | NA | AGCTATGGCATGAAC | | TCCATTAGTGGTAGTAGT AGTTACATATACTACGC GGACTCAGTGAAGGGC | | CTGACTACCTTTGACTTC |
| | | | SEQ ID NO:4507 | | SEQ ID NO:12519 | | SEQ ID NO:20531 |
| | | AA | SYGMN | | SISGSSSYIYYADSVKG | | LTTFDF |
| | | | SEQ ID NO:4508 | | SEQ ID NO:12520 | | SEQ ID NO:20532 |
| iPS:392954 | 21-225_26A10 | NA | AGCTATGCCATGAGC | | GTTATTAGTGGTAGTGGT GTTAACACATTCTACGCA GACTCCGTGAAGGGC | | AAGATAGCAGTGGCTGGTAC TCACTACTTTGACTAC |
| | | | SEQ ID NO:4509 | | SEQ ID NO:12521 | | SEQ ID NO:20533 |
| | | AA | SYAMS | | VISGSGVNTFYADSVKG | | KIAVAGTHYFDY |
| | | | SEQ ID NO:4510 | | SEQ ID NO:12522 | | SEQ ID NO:20534 |
| iPS:392956 | 21-225_27A11 | NA | AGCTATGGCATGCAC | | GTTATATGGTATGATGG AAGTAATAAATACTATG CAGACTCCGTGAAGGGC | | GATTCCTCCCCTACGGTAT GGACGTC |
| | | | SEQ ID NO:4511 | | SEQ ID NO:12523 | | SEQ ID NO:20535 |
| | | AA | SYGMH | | VIWYDGSNKYYADSVKG | | DSSPYGMDV |
| | | | SEQ ID NO:4512 | | SEQ ID NO:12524 | | SEQ ID NO:20536 |
| iPS:392958 | 21_225_28C7 | NA | AGCTATGGCATGCAC | | GTTATATGGTATGATGA AAGTAATAAATACTATG CAGACTCCGTGAAGGGC | | GAATTAGGCTGGTACGACGA CTAC |

FIGURE 49
(Continued)

| | | | | | |
|---|---|---|---|---|---|
| iPS:392960 | 21-225_28C7 | AA | SEQ ID NO:4513<br>SYGMH | SEQ ID NO:12525<br>VIWYDESNKYYADSVKG | SEQ ID NO:20537<br>ELGWYDDY |
| iPS:392962 | 21-225_29E6 | NA | SEQ ID NO:4514<br>AATTATGATATTAAT | SEQ ID NO:12526<br>TGGATCGCACCTAACAG<br>TGGTAACACAGGCTATG<br>CACAGAAATTCCAGGGC | SEQ ID NO:20538<br>AGCAGTGGCTGGTACTACTT<br>TGACTAC |
| | | AA | SEQ ID NO:4515<br>NYDIN | SEQ ID NO:12527<br>WMHPNSGNTGYAQKFQG | SEQ ID NO:20539<br>SSGWYYFDY |
| iPS:392962 | 21-225_30A1 | NA | SEQ ID NO:4516<br>AGCTATGTCATGAAC | SEQ ID NO:12528<br>GCTATTAGTGGTAGTGGT<br>GGTAGCACATACTACGC<br>AGACTCCGTGAAGGGC | SEQ ID NO:20540<br>ACTGGGGTCTTTGACTAC |
| | | AA | SEQ ID NO:4517<br>SYVMN | SEQ ID NO:12529<br>AISGSGGSTYYADSVKG | SEQ ID NO:20541<br>TGVFDY |
| iPS:392964 | 21-225_31A8 | NA | SEQ ID NO:4518<br>AGCTATGCCATGAGC | SEQ ID NO:12530<br>GCTATTAGTGGTGGTCGTGGT<br>GGTAGCACATTCCACGC<br>AGACTCCGTGAAGGGC | SEQ ID NO:20542<br>GGGGAGCTACTAGAGGACTA<br>CTACTTCTACGGTATGGACG<br>TC |
| | | AA | SEQ ID NO:4519<br>SYAMS | SEQ ID NO:12531<br>AISGRGGSTFHADSVKG | SEQ ID NO:20543<br>GELLEDYYFYGMDV |
| iPS:392966 | 21-225_32G3 | NA | SEQ ID NO:4520<br>AGCTATAGCCATGAAC | SEQ ID NO:12532<br>TCCATTAGTGGTAGTAGT<br>AGTTACATATACTACGC<br>AGACTCCGTGAAGGGC | SEQ ID NO:20544<br>GGCAATATAGCAAGGGACTA<br>C |
| | | AA | SEQ ID NO:4521<br>SYSMN | SEQ ID NO:12533<br>SISGSSSYIYYADSVKG | SEQ ID NO:20545<br>GNIARDY |
| | | | SEQ ID NO:4522 | SEQ ID NO:12534 | SEQ ID NO:20546 |

FIGURE 49
(Continued)

| | | NA | AACTATGGCATGCAC | GTTATATGGTATGAGGA AAGTAATAAATACTATA CAGAGTCCGTGAAGGGC | GAACTGGGGTTCCTCTCTGA CTAC |
|---|---|---|---|---|---|
| iPS:392968 | 21-225_25B6 | | SEQ ID NO:4523 | SEQ ID NO:12535 | SEQ ID NO:20547 |
| | | AA | NYGMH | VIWYEESNKYYTESVKG | ELGFLSDY |
| | | | SEQ ID NO:4524 | SEQ ID NO:12536 | SEQ ID NO:20548 |
| iPS:392972 | 21-225_26A2 | NA | AGCTATGGCATGCAC | GTTATATGGTATGAAGG AAGTAATAAATACTATG TAGACTCCGTGAAGGGC | GAATTAGGCTGGTACGACGA CTAC |
| | | | SEQ ID NO:4525 | SEQ ID NO:12537 | SEQ ID NO:20549 |
| | | AA | SYGMH | VIWYEGSNKYYVDSVKG | ELGWYDDY |
| | | | SEQ ID NO:4526 | SEQ ID NO:12538 | SEQ ID NO:20550 |
| iPS:392974 | 21-225_26A11 | NA | AACTGTGTCATGCAC | GTTATATGGTATGATGG AAGTAATAAATACTATG CAGAGTCCGTGAAGGGC | GAGGAGTATAGCAGTGGCTG GTACGACTACGGTATGGACG TC |
| | | | SEQ ID NO:4527 | SEQ ID NO:12539 | SEQ ID NO:20551 |
| | | AA | NCVMH | VIWYDGSNKYYADSVKG | EEYSSGWYDYGMDV |
| | | | SEQ ID NO:4528 | SEQ ID NO:12540 | SEQ ID NO:20552 |
| iPS:392976 | 21-225_27H12 | NA | AGCTATAGCCTGAAC | TCCATTAGTGGTAGTAGT AGTAACATATACTACAC AGACTCAGTGAAGGGC | GTGGCGTCCTTTGACTAC |
| | | | SEQ ID NO:4529 | SEQ ID NO:12541 | SEQ ID NO:20553 |
| | | AA | SYSLN | SISGSSNYYTDSVKG | VASFDY |
| | | | SEQ ID NO:4530 | SEQ ID NO:12542 | SEQ ID NO:20554 |

FIGURE 49
(Continued)

| | | | | | |
|---|---|---|---|---|---|
| iPS:392978 | 21-225_28B8 | NA | GACTATGGCATGCAC | GTTATATGGTATGATGCA AATAATAAATACTATGC AGACTCCGTGAAGGGC | GAAATTGGCTGCTTAGATGA CTAC |
| | | | SEQ ID NO:4531 | SEQ ID NO:12543 | SEQ ID NO:20555 |
| | | AA | DYGMH | VIWYDANNKYYADSVKG | EIGWLDDY |
| | | | SEQ ID NO:4532 | SEQ ID NO:12544 | SEQ ID NO:20556 |
| iPS:392980 | 21-225_29H6 | NA | GACTATGGCATGCAC | GTTATATGGTATAATGA AATAATAAATACTATG CAGACTCCGTGAAGGGC | GAACTGGGGATGACGGGTGA CTCC |
| | | | SEQ ID NO:4533 | SEQ ID NO:12545 | SEQ ID NO:20557 |
| | | AA | DYGMH | VIWYNENNKYYADSVKG | ELGMTGDS |
| | | | SEQ ID NO:4534 | SEQ ID NO:12546 | SEQ ID NO:20558 |
| iPS:392982 | 21-225_30D1 | NA | AGCTATGCCATGAGC | GCTATTAGTGGTGGTCGTGGT GGTAGCACATTCCACGC AGACTCCGTGAAGGGC | GGGGAGCTACTAGAGGACTA CTACTTCTACGGTTTGGACG TC |
| | | | SEQ ID NO:4535 | SEQ ID NO:12547 | SEQ ID NO:20559 |
| | | AA | SYAMS | AISGRGGSTFHADSVKG | GELLEDYYFYGLDV |
| | | | SEQ ID NO:4536 | SEQ ID NO:12548 | SEQ ID NO:20560 |
| iPS:392984 | 21-225_30E11 | NA | ATCTATGCCATGAGC | GTTATTAGTGGTAGTGGT GGTAGCTCATTCTACGCA GACTCCGTGAAGGGC | GATCGGGTGAAAGCTCATGA TGGTTTTGATATC |
| | | | SEQ ID NO:4537 | SEQ ID NO:12549 | SEQ ID NO:20561 |
| | | AA | IYAMS | VISGSGGSSFYADSVKG | DRVKAHDGFDI |
| | | | SEQ ID NO:4538 | SEQ ID NO:12550 | SEQ ID NO:20562 |

FIGURE 49
(Continued)

| | | | | | |
|---|---|---|---|---|---|
| iPS:392986 | 21-225_31B8 | NA | AGCTATGCCATGAGC | GCTATTAGTGGTCGTGGT GGTAGCACATTCCACGC AGACTCCGTGAAGGGC | GGGGAGCTACTAGAGGACTA CTACTTCTACGGTATGGACG TC |
| | | | SEQ ID NO:4539 | SEQ ID NO:12551 | SEQ ID NO:20563 |
| | | AA | SYAMS | AISGRGGSTFHADSVKG | GELLEDYYFYGMDV |
| | | | SEQ ID NO:4540 | SEQ ID NO:12552 | SEQ ID NO:20564 |
| iPS:392988 | 21-225_25E6 | NA | GACTATGGCATGCAC | GTTATATGGTATGATGA AATAATAAATACTATG CAGACTCCGTGAAGGGC | GAACTGGGGATGACGGGTGA CTCC |
| | | | SEQ ID NO:4541 | SEQ ID NO:12553 | SEQ ID NO:20565 |
| | | AA | DYGMH | VIWYDENNKYYADSVKG | ELGMTGDS |
| | | | SEQ ID NO:4542 | SEQ ID NO:12554 | SEQ ID NO:20566 |
| iPS:392990 | 21-225_25H10 | NA | GACTATGGCATGCAC | GTTATATGGTATGATGA AGTAATAAATACTATG CAGACTCCATGAAGGGC | GAACTGGGGATGACGGGTGA CTAC |
| | | | SEQ ID NO:4543 | SEQ ID NO:12555 | SEQ ID NO:20567 |
| | | AA | DYGMH | VIWYDESNKYYADSMKG | ELGMTGDY |
| | | | SEQ ID NO:4544 | SEQ ID NO:12556 | SEQ ID NO:20568 |
| iPS:392992 | 21-225_26C4 | NA | AATTATGATATCAAC | TGGATGAACCCTAACAG TGGTAACACAGGCTATG CACAGAGATTCCAGGGC | AGCAGTGGCTGGTACTACTT TGACTAC |
| | | | SEQ ID NO:4545 | SEQ ID NO:12557 | SEQ ID NO:20569 |
| | | AA | NYDIN | WMNPNSGNTGYAQRFQG | SSGWYYFDY |
| | | | SEQ ID NO:4546 | SEQ ID NO:12558 | SEQ ID NO:20570 |

FIGURE 49
(Continued)

| | | | | | |
|---|---|---|---|---|---|
| iPS:392994 | 21-225_26G11 | NA | AGCTATGGCATGCAC | GTTATATGGTATGATGG AAGTAATAAATACTATG CAGACTCCGTGAAGGGC | AGGTATAGCAACAGCTGGTC AGGGGTATGGACGTC |
| | | | SEQ ID NO:4547 | SEQ ID NO:12559 | SEQ ID NO:20571 |
| | | AA | SYGMH | VIWYDGSNKYYADSVKG | RYSNSWSGGMDV |
| | | | SEQ ID NO:4548 | SEQ ID NO:12560 | SEQ ID NO:20572 |
| iPS:392996 | 21-225_28B1 | NA | AGCTATGCCATGAGC | GCTATTAGTGGTAGTGG AAGTAACACATTCTACG CAGACTCCGTGAAGGGC | TTGGGGCGTATAGCAGTGAC TGGTCCTTACTTTGACTAC |
| | | | SEQ ID NO:4549 | SEQ ID NO:12561 | SEQ ID NO:20573 |
| | | AA | SYAMS | AISGSGGNTFYADSVKG | LGRIAVTGPYFDY |
| | | | SEQ ID NO:4550 | SEQ ID NO:12562 | SEQ ID NO:20574 |
| iPS:392998 | 21-225_28A9 | NA | AGCTATGGCATACAC | GTTATATGGTTTGATGGA AGTAATAAATACTATGC AGACTCCGTGAAGGGC | GAAATTGGCTGGTTAGATGA CTAC |
| | | | SEQ ID NO:4551 | SEQ ID NO:12563 | SEQ ID NO:20575 |
| | | AA | SYGIH | VIWFDGSNKYYADSVKG | EIGWLDDY |
| | | | SEQ ID NO:4552 | SEQ ID NO:12564 | SEQ ID NO:20576 |
| iPS:393000 | 21-225_29D7 | NA | AGCTATGGCATGCAC | GTTATATGGTATGATGA AAGTAATAAATACTATG GAGACTCCGTGAAGGGC | GAACTGGGGGTTCCTCTCTGA CTAC |
| | | | SEQ ID NO:4553 | SEQ ID NO:12565 | SEQ ID NO:20577 |
| | | AA | SYGMH | VIWYDESNKYYGDSVKG | ELGFLSDY |
| | | | SEQ ID NO:4554 | SEQ ID NO:12566 | SEQ ID NO:20578 |

FIGURE 49
(Continued)

| | | | | | | |
|---|---|---|---|---|---|---|
| iPS:393002 | 21-225_30G1 | NA | TACTATGGCATGCAC | | GTTATATGGCATGATGG AAGTAATAAATACTATG TAGACTCCGTGAAGGGC | | GAAAATAGCAGTTCGTACTA CTTTGACTAC |
| | | | SEQ ID NO:4555 | | SEQ ID NO:12567 | | SEQ ID NO:20579 |
| | | AA | YYGMH | | VIWHDGSNKYYVDSVKG | | ENSSSYYFDY |
| | | | SEQ ID NO:4556 | | SEQ ID NO:12568 | | SEQ ID NO:20580 |
| iPS:393004 | 21-225_30G11 | NA | AGCTATGCCATGAGC | | GCTATTAGTGGTGGTGGT GGTAGCACATTCAACGC AGACTCCGTGAAGGGC | | GGGGAGCTACTAGAGGACTA CTACTTCTACGGTATGGACG TC |
| | | | SEQ ID NO:4557 | | SEQ ID NO:12569 | | SEQ ID NO:20581 |
| | | AA | SYAMS | | AISGRGGSTFNADSVKG | | GELLEDYYFYGMDV |
| | | | SEQ ID NO:4558 | | SEQ ID NO:12570 | | SEQ ID NO:20582 |
| iPS:393006 | 21-225_31G9 | NA | AGCTATAGCATGAAC | | TCAATTAGTAGTAGTAGT AGTTACATATACTACGC AGACTCAGTGAAGGGC | | GATGCGAGGCAGCAGC |
| | | | SEQ ID NO:4559 | | SEQ ID NO:12571 | | SEQ ID NO:20583 |
| | | AA | SYSMN | | SISSSSYIYYADSVKG | | DRGSS |
| | | | SEQ ID NO:4560 | | SEQ ID NO:12572 | | SEQ ID NO:20584 |
| iPS:393010 | 21-225_25E11 | NA | AGCTATGCCATGAGC | | GTTATTAGTGGTGGTGGT GGTAGCACATACTACGC AGACTCCGTGAAGGGC | | CGTGGATATAGTGGCTACGA GGACCTCCTCTACTTTGACT GC |
| | | | SEQ ID NO:4561 | | SEQ ID NO:12573 | | SEQ ID NO:20585 |
| | | AA | SYAMS | | VISGGGSTYYADSVKG | | RGYSGYEDLLYFDC |
| | | | SEQ ID NO:4562 | | SEQ ID NO:12574 | | SEQ ID NO:20586 |
| iPS:393012 | 21-225_26G7 | NA | AGCTATGCCATGAGC | | GTTATATGGTATGATGG AAGTAATAAATATTATG CAGACTCCGTGAAGGGC | | AGGTATAGCAGCAGCTGGTC AGGGGTATGGACGTC |
| | | | SEQ ID NO:4563 | | SEQ ID NO:12575 | | SEQ ID NO:20587 |

FIGURE 49
(Continued)

| | | AA/NA | | | |
|---|---|---|---|---|---|
| iPS:393014 | 21-225_26D12 | AA | SYGMH | VIWYDGSNKYYADSVKG | RYSSSWSGGMDV |
| | | | SEQ ID NO:4564 | SEQ ID NO:12576 | SEQ ID NO:20588 |
| | | NA | AGTTATGGCATGCAC | GTTATATGGTATGATGG AAGTAATGAATACTATG CAGACTCCGTGAAGGC | GATTCCTCCCCTACGGTAT GGACGTC |
| | | | SEQ ID NO:4565 | SEQ ID NO:12577 | SEQ ID NO:20589 |
| iPS:393016 | 21-225_28F11 | AA | SYGMH | VIWYDGSNEYYADSVKG | DSSPYGMDV |
| | | | SEQ ID NO:4566 | SEQ ID NO:12578 | SEQ ID NO:20590 |
| | | NA | AGCTATGGCATGAGC | GTTACTAGTGGTAGTGGT GGTACCACATTCTACGC AGACTCCGTGAAGGGC | CGGACCCAGTTGATGATTT TGATATC |
| | | | SEQ ID NO:4567 | SEQ ID NO:12579 | SEQ ID NO:20591 |
| iPS:393018 | 21-225_29B8 | AA | SYAMS | VTSGSGGTFYADSVKG | RTQFDFDFDI |
| | | | SEQ ID NO:4568 | SEQ ID NO:12580 | SEQ ID NO:20592 |
| | | NA | GACTATGGCATGCAC | GTTATATGGTATGATGA AAATAATAAATACTATG CAGACTCCGTGAAGGGC | GAACTGGGGATGACGGGTGA CTCC |
| | | | SEQ ID NO:4569 | SEQ ID NO:12581 | SEQ ID NO:20593 |
| iPS:393020 | 21-225_30E3 | AA | DYGMH | VIWYDENNKYYADSVKG | ELGMTGDS |
| | | | SEQ ID NO:4570 | SEQ ID NO:12582 | SEQ ID NO:20594 |
| | | NA | AGCTATGGCATGCAC | GTTATATCATATGGTGGA AGTAATAAATTCTATGC AGTCTCCGTGAAGGGC | AGGGGTATAGCAGTGGAGG CTACGGTATGGACGTC |
| | | | SEQ ID NO:4571 | SEQ ID NO:12583 | SEQ ID NO:20595 |
| | | AA | SYGMH | VISYGGSNKFYAVSVKG | RGYSSGGYGMDV |
| | | | SEQ ID NO:4572 | SEQ ID NO:12584 | SEQ ID NO:20596 |

FIGURE 49
(Continued)

| | | | | | |
|---|---|---|---|---|---|
| iPS:393022 | 21-225_30H11 | NA | AGCTATAGCATGAAC | TCCATTAGTGGTAGTAGT AGTTACATATACGC AGACTCAGTGAAGGGC | GATAGGGGGAGCCTC |
| | | | SEQ ID NO:4573 | SEQ ID NO:12585 | SEQ ID NO:20597 |
| | | AA | SYSMN | SISGSSSYIYYADSVKG | DRGSL |
| | | | SEQ ID NO:4574 | SEQ ID NO:12586 | SEQ ID NO:20598 |
| iPS:393024 | 21-225_31H9 | NA | AGCTGTGCCATGAAC | GCTATTAGTGGTAGTGGT GGTAGCTCATTCTACGCA GACTCCGTGAAGGGC | CGGACTCCTATGATGTCTTT GATATC |
| | | | SEQ ID NO:4575 | SEQ ID NO:12587 | SEQ ID NO:20599 |
| | | AA | SCAMN | AISGSGGSSFYADSVKG | RTPYDVFDI |
| | | | SEQ ID NO:4576 | SEQ ID NO:12588 | SEQ ID NO:20600 |
| iPS:393026 | 21-225_32B6 | NA | GACTATGGCATGCAC | GTTATATGGTATGATGA AATACTAAATACTATG CAGACTCCGTGAAGGGC | GAGTGGGGGGACTAC |
| | | | SEQ ID NO:4577 | SEQ ID NO:12589 | SEQ ID NO:20601 |
| | | AA | DYGMH | VIWYDENTKYYADSVKG | EWGDY |
| | | | SEQ ID NO:4578 | SEQ ID NO:12590 | SEQ ID NO:20602 |
| iPS:393028 | 21-225_25D7 | NA | AGCTATAGCATGAGC | GCTATTAGTGGTAGAGG TGGTACCACATTCTACGC AGACTCCGTGAAGGGC | GACGGGTACGGTGTAACTC CTTCTTTGACTAC |
| | | | SEQ ID NO:4579 | SEQ ID NO:12591 | SEQ ID NO:20603 |
| | | AA | SYAMS | AISGRGGTTFYADSVKG | DGYGGNSFFDY |
| | | | SEQ ID NO:4580 | SEQ ID NO:12592 | SEQ ID NO:20604 |
| iPS:393030 | 21_225_25H11 | NA | GACTATGGCATGCAC | GTTATATGGTATGATGA AATAATGAATACTATG CAGACTCCGTGAAGGGC | GAACTGGGGATGACGGGTGA CTCC |

FIGURE 49
(Continued)

| | | | SEQ ID NO:4581 | SEQ ID NO:12593<br>VIWYDENNEYYADSVKG | SEQ ID NO:20605<br>ELGMTGDS |
|---|---|---|---|---|---|
| iPS:393032 | 21-225_25H11 | AA | DYGMH | | |
| | | NA | SEQ ID NO:4582<br>GGCTATGGCATGCAC | SEQ ID NO:12594<br>ATTATATGGTATGATGG<br>AAGTAATAAATACTATG<br>CAGACTCCGTGAAGGGC | SEQ ID NO:20606<br>GAGAGGTACGATTTTGGAG<br>TGGTTGTATGGACGTC |
| iPS:393034 | 21-225_26F8 | AA | SEQ ID NO:4583<br>GYGMH | SEQ ID NO:12595<br>IIWYDGSNKYYADSVKG | SEQ ID NO:20607<br>ERYDFWSGCMDV |
| | 21-225_27F2 | NA | SEQ ID NO:4584<br>GACTATGGCATGCAC | SEQ ID NO:12596<br>GTTATATGGTATGATGA<br>AAATAATAAATACTATG<br>TAGACTCCGTGAGGGGC | SEQ ID NO:20608<br>GAACTGGGGATGACGGGTGA<br>CTCC |
| | | AA | SEQ ID NO:4585<br>DYGMH | SEQ ID NO:12597<br>VIWYDENNKYYVDSVRG | SEQ ID NO:20609<br>ELGMTGDS |
| iPS:393036 | 21-225_28G3 | NA | SEQ ID NO:4586<br>ACCTATGGCATGCAC | SEQ ID NO:12598<br>GTTATATGGTATGATGG<br>AAGTAATAAATACTATG<br>CAGACTCCGTGAAGGGC | SEQ ID NO:20610<br>GATCGATACGATTTTGGAG<br>TGGTTATTTTGACTAC |
| | | AA | SEQ ID NO:4587<br>TYGMH | SEQ ID NO:12599<br>VIWYDGSNKYYADSVKG | SEQ ID NO:20611<br>DRYDFWSGYFDY |
| | | | SEQ ID NO:4588 | SEQ ID NO:12600 | SEQ ID NO:20612 |

FIGURE 49
(Continued)

| | | | | | |
|---|---|---|---|---|---|
| iPS:393038 | 21-225_29D8 | NA | GACTATGGCATACAC | GTTATATGGTTTGATGGAACTAATAAATACTATGCAGACTCCGTGAAGGGC | GAAATTGGCTGGTTAGATGACTAC |
| | | | SEQ ID NO:4589 | SEQ ID NO:12601 | SEQ ID NO:20613 |
| | | AA | DYGIH | VIWFDGTNKYYADSVKG | EIGWLDDY |
| | | | SEQ ID NO:4590 | SEQ ID NO:12602 | SEQ ID NO:20614 |
| iPS:393040 | 21-225_30E3 | NA | AGCTATGCCATGAAC | GCTATTAGTGGTCGTGGTGGTAGCACATTCTACGCAGACTCCGAGAAGGGC | GGGGAGCTATTAGAGGACTACTACTACTACGGAATGGACGTC |
| | | | SEQ ID NO:4591 | SEQ ID NO:12603 | SEQ ID NO:20615 |
| | | AA | SYAMN | AISGRGGSTFYADSEKG | GELLEDYYYGMDV |
| | | | SEQ ID NO:4592 | SEQ ID NO:12604 | SEQ ID NO:20616 |
| iPS:393042 | 21-225_31F1 | NA | GACTACTATATGCAC | TGGATCAACCCTAACAGTGGTGGCACAAACTATGCACAGAAGTTTCAGGGC | GATAGTAGCAATTTCAGCAACTGGTACGATTACTACGGTATGGACGTC |
| | | | SEQ ID NO:4593 | SEQ ID NO:12605 | SEQ ID NO:20617 |
| | | AA | DYYMH | WINPNSGGTNYAQKFQG | DSSNFSNWYDYYGMDV |
| | | | SEQ ID NO:4594 | SEQ ID NO:12606 | SEQ ID NO:20618 |
| iPS:393044 | 21-225_25B8 | NA | AGCTATGGTATCAGC | TGGATCAGCGCTTACAATGGTAACACAACCTATGCACAGAAGCTCCGGGGC | ACCGCTGCTGGGTATAGCAGCAGCTGGTTTGACTAC |
| | | | SEQ ID NO:4595 | SEQ ID NO:12607 | SEQ ID NO:20619 |
| | | AA | SYGIS | WISAYNGNTTYAQKLRG | TAAGYSSSWFDY |
| | | | SEQ ID NO:4596 | SEQ ID NO:12608 | SEQ ID NO:20620 |

FIGURE 49
(Continued)

| iPS ID | Clone | Type | Sequence 1 | Sequence 2 | Sequence 3 |
|---|---|---|---|---|---|
| iPS:393046 | 21-225_25A12 | NA | AACTGTGTCATGCAC SEQ ID NO:4597 | GTTATATGGTATGATGGAAGTAATAAATACTATGCAGACTCCGTGAAGGGC SEQ ID NO:12609 | GAGGAGTATAGCAGTGGCTGGTACGACTACGGTATGGACGTC SEQ ID NO:20621 |
| | | AA | NCVMH SEQ ID NO:4598 | VIWYDGSNKYYADSVKG SEQ ID NO:12610 | EEYSSGWYDYGMDV SEQ ID NO:20622 |
| iPS:393048 | 21-225_27C3 | NA | GACTATGGCATGCAC SEQ ID NO:4599 | GTTATATGGTATGATGAAATAATAAATCCTATGCAGACTCCGTGAAGGGC SEQ ID NO:12611 | GAACTGGGGATGACGGGTGACTCC SEQ ID NO:20623 |
| | | AA | DYGMH SEQ ID NO:4600 | VIWYDENKSYADSVKG SEQ ID NO:12612 | ELGMTGDS SEQ ID NO:20624 |
| iPS:393050 | 21-225_28C5 | NA | AGCTATGGTATCAGC SEQ ID NO:4601 | TGGATCAGCGCCTTACAATGGTAACACAACCTATGCACAGAAGCTCCGGGGC SEQ ID NO:12613 | ACCGCTGCTGGTATAGCAGCAGCTGGTTTGACTAC SEQ ID NO:20625 |
| | | AA | SYGIS SEQ ID NO:4602 | WISAYNGNTTYAQKLRG SEQ ID NO:12614 | TAAGYSSSWFDY SEQ ID NO:20626 |
| iPS:393054 | 21-225_29G8 | NA | GACTATGGCATGCAC SEQ ID NO:4603 | GTTATATGGTATGATGAACTAATAAATACTATGCAGACTCCGTGAAGGGC SEQ ID NO:12615 | GAACTGGGGATGACGAGTGACTAC SEQ ID NO:20627 |
| | | AA | DYGMH SEQ ID NO:4604 | VIWYDETNKYYADSVKG SEQ ID NO:12616 | ELGMTSDY SEQ ID NO:20628 |

FIGURE 49
(Continued)

| | | | | | |
|---|---|---|---|---|---|
| iPS:393056 | 21-225_30F3 | NA | AGCTATGGCATGCAC | GTTATATGGTATGATGTAAGTAATAAATACTATGCAGACTCCGTGAAGGGC | GAAATGGCTGGTACGATGACTAC |
| | | AA | SEQ ID NO:4605 SYGMH | SEQ ID NO:12617 VIWYDVSNKYYADSVKG | SEQ ID NO:20629 EMGWYDDY |
| iPS:393058 | 21-225_31H3 | NA | AGCTATGCCATGAAC | GCTATTAGTGGTCGTGGTGGTAACACATTCTACGCAGACTCCGTGAAGGGC | GGGGAGTACTAGAGGACTACTACTACTACCGGAATGGACGTC |
| | | AA | SEQ ID NO:4607 SYAMN | SEQ ID NO:12619 AISGRGGNTFYADSVKG | SEQ ID NO:20631 GELLEDYYYGMDV |
| iPS:393060 | 21-225_32G12 | NA | AGCTATGCCATGAGC | TCTATTAGTGGTCGTGGTGGTAGCACATTCCACGCAGACTCCGTGAAGGGC | GGGGAGTACTAGAGGACTACTACTTCTACGGTATGGACGTC |
| | | AA | SEQ ID NO:4609 SYAMS | SEQ ID NO:12621 SISGRGGSTFHADSVKG | SEQ ID NO:20633 GELLEDYFYGMDV |
| iPS:393062 | 21-225_33H3 | NA | AGCTATGGCATGCAC | ATTATATCATATAGGTGGAAGTAATAACTTCTATGCAGACTCCGTGAAGGGC | AGGGGGTATAGCAGTGGAGGCTACGGTATGGACGTC |
| | | AA | SEQ ID NO:4611 SYGMH | SEQ ID NO:12623 IISYGGSNNFYADSVKG | SEQ ID NO:20635 RGYSSGGYGMDV |
| iPS:393064 | 21-225_33A9 | NA | AGTTATGATATCAAC | TGGATGAACCCTAACAGTGGTAACACAGGCTATGCACAGAAGTTCCAGGGC | AAGAAGGCTAACGACTAC |
| | | | SEQ ID NO:4613 | SEQ ID NO:12625 | SEQ ID NO:20637 |

FIGURE 49
(Continued)

| | | AA/NA | | | | | | |
|---|---|---|---|---|---|---|---|---|
| iPS:393066 | | AA | SYDIN | | WMNPNSGNTGYAQKFQG | | KKANDY | |
| | 21-225_34D3 | NA | SEQ ID NO:4614 TACTATGGCATGAGC | SEQ ID NO:12626 GTTATATGGCATGATGG AAGTAATAAATACTATG TAGACTCCGTGAAGGGC | | SEQ ID NO:20638 GAAAATAGCAGTTCGTTCTA CTTTGACTAC | | |
| iPS:393068 | | AA | SEQ ID NO:4615 YYGMH | SEQ ID NO:12627 VIWHDGSNKYYVDSVKG | | SEQ ID NO:20639 ENSSSFYFDY | | |
| | 21-225_34G9 | NA | SEQ ID NO:4616 AGCTATGCCATGAGC | SEQ ID NO:12628 GCTATTAGTGGTCGTGGT GGTAGCACATTCCACGC AGACTCCGTGAAGGGC | | SEQ ID NO:20640 GGGGAGCTACTAGAGGACTA CTACTTCTACGGTATGGACG TC | | |
| iPS:393072 | | AA | SEQ ID NO:4617 SYAMS | SEQ ID NO:12629 AISGRGGSTFHADSVKG | | SEQ ID NO:20641 GELLEDYYFYGMDV | | |
| | 21-225_36C5 | NA | SEQ ID NO:4618 AGCTATGCCATGAAC | SEQ ID NO:12630 GCTATTAGTGGTCGTGGT GGTAGCACATTCCACGC AGACTCCGTGAAGGGC | | SEQ ID NO:20642 GGGGAGCTATTAGAGGACTA CTACTTCTACGGTATGGACG TC | | |
| iPS:393074 | | AA | SEQ ID NO:4619 SYAMN | SEQ ID NO:12631 AISGRGGSTFHADSVKG | | SEQ ID NO:20643 GELLEDYYFYGMDV | | |
| | 21-225_33B1 | NA | SEQ ID NO:4620 GACTATGGCATGCAC | SEQ ID NO:12632 GTTATATGGTATGATAG AAATAATAAATACTATG CAGACTCCGTGAAGGGC | | SEQ ID NO:20644 GAAATGGGCTGGTACGATGA CTAC | | |
| | | AA | SEQ ID NO:4621 DYGMH | SEQ ID NO:12633 VIWYDRNNKYYADSVKG | | SEQ ID NO:20645 EMGWYDDY | | |

FIGURE 49
(Continued)

| | | | | | |
|---|---|---|---|---|---|
| iPS:393076 | 21-225_33A4 | NA | SEQ ID NO:4622<br>AGCTATGCCATGAAC | SEQ ID NO:12634<br>GCTATTAGTGTCGTGGT<br>GGTAGCACATTCTACGC<br>AGACTCCGTGAAGGGC | SEQ ID NO:20646<br>GGGAACTACTAGAGGACTA<br>CTCCTACTACGGTATCGACG<br>TC |
| | | AA | SEQ ID NO:4623<br>SYAMN | SEQ ID NO:12635<br>AISRRGGSTFYADSVKG | SEQ ID NO:20647<br>GELLEDYSYYGIDV |
| iPS:393078 | 21-225_33H11 | NA | SEQ ID NO:4624<br>AGCTATAGCATGAAC | SEQ ID NO:12636<br>TCCATTAGTGGTAGTAGT<br>AGTTACATATACTACGC<br>AGACTCAGTGAAGGGC | SEQ ID NO:20648<br>ACAAACGGTATGGACGTC |
| | | AA | SEQ ID NO:4625<br>SYSMN | SEQ ID NO:12637<br>SISGSSSYIYYADSVKG | SEQ ID NO:20649<br>TNGMDV |
| iPS:393080 | 21-225_34F3 | NA | SEQ ID NO:4626<br>GGCTACCATATGCAC | SEQ ID NO:12638<br>TGGATCAACCTAACAG<br>TGGTGGCACAAACTATG<br>CACAGAAGTTTCAGGGC | SEQ ID NO:20650<br>GACGGTACCAGCTCCTTGA<br>CTAC |
| | | AA | SEQ ID NO:4627<br>GYHMH | SEQ ID NO:12639<br>WINPNSGGTNYAQKFQG | SEQ ID NO:20651<br>DGTSSFDY |
| iPS:393082 | 21-225_34C11 | NA | SEQ ID NO:4628<br>AGTTATACCATGAGC | SEQ ID NO:12640<br>TCCATTAGTGGTAGTAGT<br>AATTACATATACTACGC<br>AGACTCAGTGAAGGGC | SEQ ID NO:20652<br>TTAACTGGTTTTGACTAC |
| | | AA | SEQ ID NO:4629<br>SYTMS | SEQ ID NO:12641<br>SISGSSNYIYYADSVKG | SEQ ID NO:20653<br>LTGFDY |
| iPS:393084 | 21-225_35C6 | NA | SEQ ID NO:4630<br>GGCGATTATATGCAC | SEQ ID NO:12642<br>TGGATCAGCCCTAAAAA<br>TGGTGGCACAAACTATG<br>CACAGAAGTTTCAGGGC | SEQ ID NO:20654<br>GATGGAACTGGGTCCTTTGA<br>CTAC |
| | | | SEQ ID NO:4631 | SEQ ID NO:12643 | SEQ ID NO:20655 |

FIGURE 49
(Continued)

| | | | AA | GDYMH | | WISPKNGGTNYAQKFQG | DGTGSFDY |
|---|---|---|---|---|---|---|---|
| iPS:393086 | | | | SEQ ID NO:4632 | | SEQ ID NO:12644 | SEQ ID NO:20656 |
| | 21-225_36H5 | | NA | GACTATCATATGCAC | | TGGATCAACCCTAATAG GGGTGGCACAAACTATG CACAGAAGTTCAGGAC | GATGGAACTGGGTCCTTTGA CTAC |
| | | | | SEQ ID NO:4633 | | SEQ ID NO:12645 | SEQ ID NO:20657 |
| | | | AA | DYHMH | | WINPNRGGTNYAQKFQD | DGTGSFDY |
| iPS:393088 | | | | SEQ ID NO:4634 | | SEQ ID NO:12646 | SEQ ID NO:20658 |
| | 21-225_33D1 | | NA | AATTATGACATTAAC | | TGGATGCACCCTAACAG TGGTAACACAGGCTTTG CACAGAAGTTCCGGGGC | AGCAGTGGCTGGTACTTTTT TGACTAC |
| | | | | SEQ ID NO:4635 | | SEQ ID NO:12647 | SEQ ID NO:20659 |
| | | | AA | NYDIN | | WMHPNSGNTGFAQKFRG | SSGWYFFDY |
| iPS:393090 | | | | SEQ ID NO:4636 | | SEQ ID NO:12648 | SEQ ID NO:20660 |
| | 21-225_33A5 | | NA | AGCTATGTCATAAAC | | GCTATTAGTGGTAGTGGT GTTAGCACATACTACGC AGACTCCGTGAAGGGC | ACTTCCCTCTTTGACTAC |
| | | | | SEQ ID NO:4637 | | SEQ ID NO:12649 | SEQ ID NO:20661 |
| | | | AA | SYVIN | | AISGSGVSTYYADSVKG | TSLFDY |
| iPS:393092 | | | | SEQ ID NO:4638 | | SEQ ID NO:12650 | SEQ ID NO:20662 |
| | 21-225_33C12 | | NA | CACTATGGCATGCAC | | GTTATATGGTATGATGG AAGTAATAAATACTATG CAGACTCCGTGAAGGGC | GAAAATAGCAGCTCGTACTA CTTTGACTAC |
| | | | | SEQ ID NO:4639 | | SEQ ID NO:12651 | SEQ ID NO:20663 |
| | | | AA | HYGMH | | VIWYDGSNKYYADSVKG | ENSSSYYFFDY |
| | | | | SEQ ID NO:4640 | | SEQ ID NO:12652 | SEQ ID NO:20664 |

FIGURE 49
(Continued)

| | | | | | |
|---|---|---|---|---|---|
| iPS:393094 | 21-225_34C4 | NA | AGAAGTAGTTACTACTGGG C | AGTATCTATTATAGTGGG AGCACCGCTACAATCC GTCCCTCAAGAGT | CTGAGCAGCAGCTGGTCTTT TGACTAC |
| | | | SEQ ID NO:4641 | SEQ ID NO:12653 | SEQ ID NO:20665 |
| | | AA | RSSYYWG | SIYYSGSTAYNPSLKS | LSSSWSFDY |
| | | | SEQ ID NO:4642 | SEQ ID NO:12654 | SEQ ID NO:20666 |
| iPS:393096 | 21-225_34D11 | NA | AGCTATGCCATGAAC | GCTATTAGTGGTCGTGGT GGTAGCACATTCCACGC AGACTCCGTGAAGGGC | GGGGAGTTAGTAGAGAGACTA CTACTTCTACGGTATGGACG TC |
| | | | SEQ ID NO:4643 | SEQ ID NO:12655 | SEQ ID NO:20667 |
| | | AA | SYAMN | AISGRGGSTFHADSVKG | GELVEDYYFYGMDV |
| | | | SEQ ID NO:4644 | SEQ ID NO:12656 | SEQ ID NO:20668 |
| iPS:393098 | 21-225_35G6 | NA | GACTACCATATACAC | TGGATCAACCTAACAA TGGTGGCACACTATG CACAGGAGTTTCAGGGC | GATGGAACTGGGTCCTTGA CTAC |
| | | | SEQ ID NO:4645 | SEQ ID NO:12657 | SEQ ID NO:20669 |
| | | AA | DYHIH | WINPNNGGTHYAQEFQG | DGTGSFDY |
| | | | SEQ ID NO:4646 | SEQ ID NO:12658 | SEQ ID NO:20670 |
| iPS:393100 | 21-225_36B8 | NA | AACTATGGCATGCAC | GTTATATATGGCATGATGG AAGTAATAAATACTATG GAGACTCCGTGAAGGGC | GAAAATAGCAGCTCGTACTA CTTTGACTAC |
| | | | SEQ ID NO:4647 | SEQ ID NO:12659 | SEQ ID NO:20671 |
| | | AA | NYGMH | VIWHDGSNKYYGDSVKG | ENSSSYYFDY |
| | | | SEQ ID NO:4648 | SEQ ID NO:12660 | SEQ ID NO:20672 |
| iPS:393102 | 21_225_33F1 | NA | AGCTATGCCATGAGC | TCTATTAGTGGTCGTGGT GGTAGCACATTCCACGC AGACTCCGTGAAGGGC | GGGGAGCTACTTGAGGACTA CTACTTCTACGGTATGGACG TC |

FIGURE 49
(Continued)

| | | | | | | |
|---|---|---|---|---|---|---|
| iPS:393104 | 21-225_33F1 | AA | SEQ ID NO:4649<br>SYAMS | SEQ ID NO:12661<br>SISGRGGSTFHADSVKG | SEQ ID NO:20673<br>GELLEDYYFYGMDV | |
| | | NA | SEQ ID NO:4650<br>AGCTGTGCCATGAGC | SEQ ID NO:12662<br>GCTATTAGTGGTCGTGGT<br>GGTAGCACATTCCACGC<br>AGACTCCGTGAAGGGC | SEQ ID NO:20674<br>GGGGAACTACTAGAGGACTA<br>CTACTTCTACGGTATGGACG<br>TC | |
| iPS:393106 | 21-225_33A7 | AA | SEQ ID NO:4651<br>SCAMS | SEQ ID NO:12663<br>AISGRGGSTFHADSVKG | SEQ ID NO:20675<br>GELLEDYYFYGMDV | |
| | | NA | SEQ ID NO:4652<br>AACTATGCCATGAAC | SEQ ID NO:12664<br>GCTATTAGTCGTCGTCGTGGT<br>GGTAGCACATTCTACG<br>AGACTCCGTGAAGGGC | SEQ ID NO:20676<br>GGGGAGCTACTAGAGGACTA<br>CTACTACTTCGCTATGGACG<br>TC | |
| iPS:393108 | 21-225_34A6 | AA | SEQ ID NO:4653<br>NYAMN | SEQ ID NO:12665<br>AISRRGGSTFYADSVKG | SEQ ID NO:20677<br>GELLEDYYFAMDV | |
| | | NA | SEQ ID NO:4654<br>GGCTACTATATGCAC | SEQ ID NO:12666<br>TGGATCAACCCTAACAG<br>TGGTGGCACAAACTATG<br>CACAGAAGTTTCAGGGC | SEQ ID NO:20678<br>GATATTAGTAATTTCAGCAG<br>CTGGTACGATTACTACGCTA<br>TGGACGTC | |
| iPS:393110 | 21-225_34G11 | AA | SEQ ID NO:4655<br>GYYMH | SEQ ID NO:12667<br>WINPNSGGTNYAQKFQG | SEQ ID NO:20679<br>DISNFSSWYDYYAMDV | |
| | | NA | SEQ ID NO:4656<br>AGCTATGCCATGAGC | SEQ ID NO:12668<br>GCTATTAGTGGTCGTGGT<br>GGTAGCACATTCCACGC<br>AGACTCCGTGAAGGGC | SEQ ID NO:20680<br>GGGGAGCTACTAGAGGACTA<br>CTACTTCTACGGTATGGACG<br>TC | |
| iPS:393112 | 21-225_35B7 | AA | SEQ ID NO:4657<br>SYAMS | SEQ ID NO:12669<br>AISGRGGSTFHADSVKG | SEQ ID NO:20681<br>GELLEDYYFYGMDV | |
| | 21_225_33G1 | NA | SEQ ID NO:4658<br>GGCTACTATATGCAC | SEQ ID NO:12670<br>TGGATCAGCCCTAACAA<br>TGGTGGCACAAACTATG<br>CACAGAAGTTTCAGGGC | SEQ ID NO:20682<br>GATGGAACTGGGTCCTTTGA<br>CTAC | |

FIGURE 49
(Continued)

| | | | | | | | |
|---|---|---|---|---|---|---|---|
| iPS:393114 | 21-225_33G1 | AA | SEQ ID NO:4659<br>GYYMH | SEQ ID NO:12671<br>WISPNNGGTNYAQKFQG | SEQ ID NO:20683<br>DGTGSFDY | | |
| | | NA | SEQ ID NO:4660<br>AGCTATGCCATGAGC | SEQ ID NO:12672<br>GTTATTAGTGGTAGTGGT<br>GGTAGCTCATTCTACGCA<br>GACTCCGTGAAGGGC | SEQ ID NO:20684<br>GATCGGGTGAGAGCTCATGA<br>TGGTTTGATATC | | |
| iPS:393116 | 21-225_33G12 | AA | SEQ ID NO:4661<br>SYAMS | SEQ ID NO:12673<br>VISGSGGSSFYADSVKG | SEQ ID NO:20685<br>DRVRAHDGFDI | | |
| | | NA | SEQ ID NO:4662<br>GACTACCATATTCAC | SEQ ID NO:12674<br>TGGATCAACCCTAACAA<br>TGGTGGCACACACTATG<br>CACAGAAGTTTCAGGGC | SEQ ID NO:20686<br>GATGGAACTGGGTCCTTTGA<br>CTAC | | |
| iPS:393118 | 21-225_34G7 | AA | SEQ ID NO:4663<br>DYHIH | SEQ ID NO:12675<br>WINPNNGGTHYAQKFQG | SEQ ID NO:20687<br>DGTGSFDY | | |
| | | NA | SEQ ID NO:4664<br>AGCTATGCCATGAAC | SEQ ID NO:12676<br>GCTATTAGTGGTAGTGGT<br>GGTAGCACATTCTACGC<br>AGACTCCGTGAAGGGC | SEQ ID NO:20688<br>GGGGAGCTACTAGAGGACTA<br>CTACTACTACGGTATGGACG<br>TC | | |
| iPS:393120 | 21-225_34H11 | AA | SEQ ID NO:4665<br>SYAMN | SEQ ID NO:12677<br>AISQRGGSTFYADSVKG | SEQ ID NO:20689<br>GELLEDYYYYGMDV | | |
| | | NA | SEQ ID NO:4666<br>AGTTATAGCATGAAC | SEQ ID NO:12678<br>TCCATTAGTGGTACTGGT<br>AGTTTCATATACTACGCA<br>GACTCAGTGAAGGGC | SEQ ID NO:20690<br>GTCTCTGGCTTTGACTAC | | |
| | 21-225_35H8 | AA | SEQ ID NO:4667<br>SYSMN | SEQ ID NO:12679<br>SISGTGSFIYYADSVKG | SEQ ID NO:20691<br>VSGFDY | | |
| | | | SEQ ID NO:4668 | SEQ ID NO:12680 | SEQ ID NO:20692 | | |

FIGURE 49
(Continued)

| | | | | |
|---|---|---|---|---|
| iPS:393122 | 21-225_33B2 | NA | AACTATGGCATGCAC SEQ ID NO:4669 | GTTATATGGCATGATGG AAGTAATAAATACTATG CAGACTCCGTGAAGGGC SEQ ID NO:12681 | GAAAATAGCAGCTCGTACTA CTTTGACTAC SEQ ID NO:20693 |
| | | AA | NYGMH SEQ ID NO:4670 | VIWHDGSNKYYADSVKG SEQ ID NO:12682 | ENSSSYYFDY SEQ ID NO:20694 |
| iPS:393124 | 21-225_33G7 | NA | AACTATGCCATGAGC SEQ ID NO:4671 | GCTATTAGTCGTCGTGGT GGTAGCACATTCTACGC AGACTCCGTGAAGGGC SEQ ID NO:12683 | GGGGAGTACTAGAGGACTA CTCCTACTACGGTATGGACG TC SEQ ID NO:20695 |
| | | AA | NYAMS SEQ ID NO:4672 | AISRGGSTFYADSVKG SEQ ID NO:12684 | GELLEDYSYYGMDV SEQ ID NO:20696 |
| iPS:393126 | 21-225_35D1 | NA | AGCTATGCCATGAGC SEQ ID NO:4673 | GCTATTAGTGGTCGTGGT GGTAGCACATTCCACGC AGACTCCGTGAAGGGC SEQ ID NO:12685 | GGGGAGTTACTAGAGGACTA CTACTTCTACGGTATGGACG TC SEQ ID NO:20697 |
| | | AA | SYAMS SEQ ID NO:4674 | AISRGGSTFHADSVKG SEQ ID NO:12686 | GELLEDYYFYGMDV SEQ ID NO:20698 |
| iPS:393128 | 21-225_35F11 | NA | AGCTATGCCATGAGC SEQ ID NO:4675 | GCTATTAGTGGTCGTGGT GGTAGCACATTCCACGC AGACTCCATGAAGGGC SEQ ID NO:12687 | GGGGAGTACTAGAGGACTA CTACTTCTACGGTATGGACG TC SEQ ID NO:20699 |
| | | AA | SYAMS SEQ ID NO:4676 | AISRGGSTFHADSMKG SEQ ID NO:12688 | GELLEDYYFYGMDV SEQ ID NO:20700 |
| iPS:393130 | 21-225_33C2 | NA | AGCTATACCATGAAC SEQ ID NO:4677 | TCCATTAGTGGTAGTAGT AGTTACATATACTACGC GGACTCAGTGAAGGC SEQ ID NO:12689 | GATCGGGGGGGGACC SEQ ID NO:20701 |

FIGURE 49 (Continued)

| | | | | | | |
|---|---|---|---|---|---|---|
| | | AA | SYTMN | SISGSSSYIYYADSVKG | DRGGT | |
| iPS:393132 | 21-225_33H7 | NA | GACTACCATATACAC SEQ ID NO:4678 | TGGATCAACCTAACAA TGGTGGCACACTATG CACAGGAGTTCAGGGC SEQ ID NO:12690 | GATGGAACTGGGTCCTTGA CTAC SEQ ID NO:20702 | |
| | | AA | DYHIH SEQ ID NO:4679 | WINPNNGGTHYAQEFQG SEQ ID NO:12691 | DGTGSFDY SEQ ID NO:20703 | |
| iPS:393134 | 21-225_34C2 | NA | AACTATGTCATGCAC SEQ ID NO:4680 | CTTATATATGGTATGATGGA AGTAATAAATACTATG AGACTCCGTGAAGGGC SEQ ID NO:12692 | GAAAATAGCAGCTCGTACTA CTTTGACTAC SEQ ID NO:20704 | |
| | | AA | NYVMH SEQ ID NO:4681 | LIWYDGSNKYYADSVKG SEQ ID NO:12693 | ENSSSYYFDY SEQ ID NO:20705 | |
| iPS:393136 | 21-225_34D8 | NA | AACTATGGCATGCAC SEQ ID NO:4682 | GTTATATGGTATGATGG AAGTAATAAATACTATG CAGACTCCGTGAAGGGC SEQ ID NO:12694 | GAAAATAGCAGCTCGTACTA CTTTGACTAC SEQ ID NO:20706 | |
| | | AA | NYGMH SEQ ID NO:4683 | VIWYDGSNKYYADSVKG SEQ ID NO:12695 | ENSSSYYFDY SEQ ID NO:20707 | |
| iPS:393138 | 21-225_35E3 | NA | AGCTATGGCATGCAC SEQ ID NO:4684 | GTTATATCATATGGTAGTGGA AGTAATAAATACTATGC AGACTCCGTGAAGGGC SEQ ID NO:12696 | AGGGGGTATAGCAGTGGAGG CTACGGTATGGACGTC SEQ ID NO:20708 | |
| | | | SEQ ID NO:4685 | SEQ ID NO:12697 | SEQ ID NO:20709 | |

FIGURE 49
(Continued)

| | | | | VISYGGSNKYYADSVKG | RGYSSGGYGMDV |
|---|---|---|---|---|---|
| iPS:393140 | 21-225_35H12 | AA | SYGMH | SEQ ID NO:12698 | SEQ ID NO:20710 |
| | | | SEQ ID NO:4686 | | |
| | | NA | GACTACTATATACAC | TGGATCAACCCTAATAGGGGTGGCACAAACTATGCACAGAAGTTCAGGGC | GATGGAACTGGGTCCTTTGACTAC |
| | | | SEQ ID NO:4687 | SEQ ID NO:12699 | SEQ ID NO:20711 |
| iPS:393142 | 21-225_33A3 | AA | DYYIH | WINPNRGGTNYAQKFQG | DGTGSFDY |
| | | | SEQ ID NO:4688 | SEQ ID NO:12700 | SEQ ID NO:20712 |
| | | NA | AGCTATGGCATGAAC | TCCATTAGTGGTAGTAGTACTTACATATACTACGCAGACTCAGTGAAGGC | ACAAACGGTATGGACGTC |
| | | | SEQ ID NO:4689 | SEQ ID NO:12701 | SEQ ID NO:20713 |
| iPS:393144 | 21-225_34D2 | AA | SYGMN | SISGSSTYIYYADSVKG | TNGMDV |
| | | | SEQ ID NO:4690 | SEQ ID NO:12702 | SEQ ID NO:20714 |
| | | NA | AATTATGACATTAAC | TGGCTGCACCCTAACAGTGGTACCACAGGCTTTGCACAGAAGTTCCGGGC | AGCAGTGGCTGGTACTTTTTGACTAC |
| | | | SEQ ID NO:4691 | SEQ ID NO:12703 | SEQ ID NO:20715 |
| iPS:393146 | 21-225_34G8 | AA | NYDIN | WLHPNSGTTGFAQKFRG | SSGWYFFDY |
| | | | SEQ ID NO:4692 | SEQ ID NO:12704 | SEQ ID NO:20716 |
| | | NA | AGCTATGCCATGAGC | GCTATTAGTGGTGGTCGTGGTGGTAGCACATTCCACGCAGACTCCGTGAAGGGC | GGGGAGCTACTAGAGGACTACTACTTCTACGGTATGGACGTC |
| | | | SEQ ID NO:4693 | SEQ ID NO:12705 | SEQ ID NO:20717 |
| iPS:393148 | 21-225_35E5 | AA | SYAMS | AISGRGGSTFHADSVKG | GELLEDYYFYGMDV |
| | | | SEQ ID NO:4694 | SEQ ID NO:12706 | SEQ ID NO:20718 |
| | | NA | AGTTATGATATCAAC | TGGATGAACCCTAACAGTGGTAACAGGCTATGCACAGAAGTTCCAGGGC | AAGAAGTCTAACGACTAC |
| | | | SEQ ID NO:4695 | SEQ ID NO:12707 | SEQ ID NO:20719 |

FIGURE 49
(Continued)

| | | | | | |
|---|---|---|---|---|---|
| iPS:393150 | 21-225_36A5 | AA | SYDIN | WMNPNSGNTGYAQKFQG | KKSNDY |
| | | | SEQ ID NO:4696 | SEQ ID NO:12708 | SEQ ID NO:20720 |
| | | NA | AACTATGCCATGAAC | GCTATTAGTGTCGTCGTGGT GGTAACACATTCTACGC AGACTCCGTGAAGGGC | GGGGAGCTACTAGAGGACTA CTACTACTACGCTATGGACG TC |
| | | | SEQ ID NO:4697 | SEQ ID NO:12709 | SEQ ID NO:20721 |
| iPS:393152 | 21-225_25B3 | AA | NYAMN | AISRGGNTFYADSVKG | GELLEDYYYYAMDV |
| | | | SEQ ID NO:4698 | SEQ ID NO:12710 | SEQ ID NO:20722 |
| | | NA | AGCTATGGCATGCAC | GTTATATGGTATGATGG AAGTAATAAATATTATG CAGACTCCGTGAAGGGC | GATTCCTCCCCCTACGGTAT GGACGTC |
| | | | SEQ ID NO:4699 | SEQ ID NO:12711 | SEQ ID NO:20723 |
| iPS:393166 | 21-225_27G6 | AA | SYGMH | VIWYDGSNKYYADSVKG | DSSPYGMDV |
| | | | SEQ ID NO:4700 | SEQ ID NO:12712 | SEQ ID NO:20724 |
| | | NA | GGCTATGGCATGCAC | ATTATATGGTATGATGG AAGTAAAAATACAATG CAGACTCCGTGAAGGGC | GATAGGGTATATTGTAGTAG TACCAGCTGCTCCCCTTACT ACTACTACGGTATGGAC GTC |
| | | | SEQ ID NO:4701 | SEQ ID NO:12713 | SEQ ID NO:20725 |
| iPS:393168 | 21-225_32B11 | AA | GYGMH | IIWYDGSKKYNADSVKG | DRVYCSSTSCSPYYYYYGMD V |
| | | | SEQ ID NO:4702 | SEQ ID NO:12714 | SEQ ID NO:20726 |
| | | NA | GGCTACTATATGCAC | TGGATCAACCCTAACAG TGATGGCACTAACTATG CACAGAAGTTTCAGGGC | GGGTTTTACTATGGTTCGGG GAGTTATTATAACGACCTCG ACCCC |
| | | | SEQ ID NO:4703 | SEQ ID NO:12715 | SEQ ID NO:20727 |
| | | AA | GYYMH | WINPNSDGTNYAQKFQG | GFYYGSGSYYNDLDP |
| | | | SEQ ID NO:4704 | SEQ ID NO:12716 | SEQ ID NO:20728 |

FIGURE 49
(Continued)

| | | | | | |
|---|---|---|---|---|---|
| iPS:393172 | 21-225_3B12 | NA | TACTATGGCATGCAC | GTTATATCATATGATGGA AGTAATAAATACTATGC AGACTCCGTGAAGGGC | GATCGGAGGGGGGGCTATGG AGTCCCGATGCTTTTGATA TC |
| | | | SEQ ID NO:4705 | SEQ ID NO:12717 | SEQ ID NO:20729 |
| | | AA | YYGMH | VISYDGSNKYYADSVKG | DRRGGYGVPDAFDI |
| | | | SEQ ID NO:4706 | SEQ ID NO:12718 | SEQ ID NO:20730 |
| iPS:393174 | 21-225_15D8 | NA | GGCTATGGCATGCAC | GTTATATCATATGATGGA AGTAATAAATACTATGC AGACTCCGTGAAGGGC | GATCGGGTCTATTGTAGTAG TACCAGCTGCGTCCCTTACT ACGACTACTACGGTATGGAC GTC |
| | | | SEQ ID NO:4707 | SEQ ID NO:12719 | SEQ ID NO:20731 |
| | | AA | GYGMH | VISYDGSNKYYADSVKG | DRVYCSSTSCVPYYDYYGMD V |
| | | | SEQ ID NO:4708 | SEQ ID NO:12720 | SEQ ID NO:20732 |
| iPS:393176 | 21-225_27E7 | NA | AGTATGGCATGCAC | GTTATATGGTATGATGG AAGTAATAAATACTATG CAGACTCCGTGAAGGGC | GAGGATTCCTATTGTAGTAG TACCAGCTGCCCTTACTACT ACTACTACGGTATGGACGTC |
| | | | SEQ ID NO:4709 | SEQ ID NO:12721 | SEQ ID NO:20733 |
| | | AA | SYGMH | VIWYDGSNKYYADSVKG | EDSYCSSTSCPYYYYYGMDV |
| | | | SEQ ID NO:4710 | SEQ ID NO:12722 | SEQ ID NO:20734 |
| iPS:393178 | 21-225_34D7 | NA | GGCTACTATATGCAC | TGGATCAACCCTAACAG TGGTGGCACAAACTATG CACAGAAGTTTCAGGGC | GGGTATTACTATGGTTCGGG GAGTTATTATAACGACCTCG ACCCC |
| | | | SEQ ID NO:4711 | SEQ ID NO:12723 | SEQ ID NO:20735 |
| | | AA | GYYMH | WINPNSGGTNYAQKFQG | GYYYGSGSYYNDLDP |
| | | | SEQ ID NO:4712 | SEQ ID NO:12724 | SEQ ID NO:20736 |

FIGURE 49
(Continued)

| | | NA | AGCTATGCCATGAGC | ACTCTTAGTGGTCGTGGT GGTAGCACATACTACGC AGACTCCGTGAAGGGC | TGGGGACGTGGATACAGCTA TGAGTACTACGGTATGG ACGTC |
|---|---|---|---|---|---|
| iPS:393180 | 21-225_4G12 | | SEQ ID NO:4713 | SEQ ID NO:12725 | SEQ ID NO:20737 |
| | | AA | SYAMS | TLSGRGGSTYYADSVKG | WGRGYSYEYYYGMDV |
| | | NA | GGCTACTATATGCAC | TGGATCAACCCTAACAG TGGTGGCACAAACTCTG CACAGAAGTTTCAGGGC | TCCTATTACTATGGTTCGGG GAGTTATTATAACGAGTTTG ACTAC |
| iPS:393182 | 21-225_4B3 | | SEQ ID NO:4714 | SEQ ID NO:12726 | SEQ ID NO:20738 |
| | | AA | GYYMH | WINPNSGGTNSAQKFQG | SYYYGSGSYYNEFDY |
| | | NA | ACTGGTGGAGTGGGTGTGG C | SEQ ID NO:4715 | SEQ ID NO:12727 | SEQ ID NO:20739 |
| | | | | CTCATTTATTGGCATGAT GATAAGCGCTACAGTCC ATCTCTGAGGAGC | ATAGTAGCAGTTGCCTTTGA CTAC |
| iPS:393184 | 21-225_15H11 | | SEQ ID NO:4716 | SEQ ID NO:12728 | SEQ ID NO:20740 |
| | | AA | TGGVGVG | LIYWHDDKRYSPSLRS | IVAVAFDY |
| | | NA | GGCTACTATATGCAC | SEQ ID NO:4717 | SEQ ID NO:12729 | SEQ ID NO:20741 |
| | | | | TGGATCAACCCTAACAG TGGTGGCACAAAGTATG CACAGAAGTTTCAGGGC | GAGAGGTGTAGTACTACCAG TTGCTATTTAGGAATTACGG GCTACTACGGTATGGACGTC |
| iPS:393186 | 21-225_27D9 | | SEQ ID NO:4718 | SEQ ID NO:12730 | SEQ ID NO:20742 |
| | | AA | GYYMH | WINPNSGGTKYAQKFQG | ERCSTTSCYLGTTGYYGMDV |
| | | NA | ACTAGTGGAGTGGGTGGTTGGG C | SEQ ID NO:4719 | SEQ ID NO:12731 | SEQ ID NO:20743 |
| | | | | CTCATTTATTGGAATGAT GATAAGCGCTACAGCCC ATCTCTGAAGAGC | TTAATAGCAGTGACTTTGA CTCC |
| iPS:393188 | 21-225_34B9 | | SEQ ID NO:4720 | SEQ ID NO:12732 | SEQ ID NO:20744 |
| | | AA | TSGVGVG | LIYWNDDKRYSPSLKS | LIAVTFDS |
| | | | SEQ ID NO:4721 | SEQ ID NO:12733 | SEQ ID NO:20745 |

FIGURE 49
(Continued)

| | | | SEQ ID NO:4722 AGCTATGGCATGCAC | SEQ ID NO:12734 GTTATATGGAATGATGG AAGTAATAAATACTATG CAGACTCCGTGAAGGGC | SEQ ID NO:20746 GATCGGGTAGCAGCAGCTGG TACCCCTACTACTACTACG GTATGGACGTC |
|---|---|---|---|---|---|
| iPS:393192 | 21-225_12B1 | NA | | | |
| | | AA | SYGMH | VIWNDGSNKYYADSVKG | SEQ ID NO:20747 DRVAAAGTPYYYYGMDV |
| | | | SEQ ID NO:4723 | SEQ ID NO:12735 | |
| iPS:393194 | 21-225_16D2 | NA | SEQ ID NO:4724 AACGCCTGGATGAAC | SEQ ID NO:12736 CGTATTAAAAGCAAAAC TGATGGTGGGACAACAG ACTACGCTGCACCCGTG AAAGGC | SEQ ID NO:20748 GATACGGGTCCTATAGCAGC TCGTCTCGCTTACTACTACTA CTACGCTATGGACGTC |
| | | AA | SEQ ID NO:4725 NAWMN | SEQ ID NO:12737 RIKSKTDGGTTDYAAPVK G | SEQ ID NO:20749 DTGPIAARLAYYYYYAMDV |
| iPS:393196 | 21-225_16G8 | NA | SEQ ID NO:4726 AGCTATGCCATGAGC | SEQ ID NO:12738 GGTATTAGTGGTAGTGG TGGTAGCACATACTACG CAGACTCCGTGAAGGGC | SEQ ID NO:20750 GAATATTGTGGTGGTGACTG CTATTCCCCTTACTACTACTA CTACGGTATGGACGTC |
| | | AA | SEQ ID NO:4727 SYAMS | SEQ ID NO:12739 GISGSGGSTYYADSVKG | SEQ ID NO:20751 EYCGGDCYSPYYYYYGMDV |
| iPS:393198 | 21-225_28A11 | NA | SEQ ID NO:4728 GGCTATGGCCTGCAC | SEQ ID NO:12740 CTTATATGGTATGATGGA AATAATACATACTATGC AGACTCCGTGAAGGGC | SEQ ID NO:20752 GATAGGGTATATTGTAGTAG TACCAGCTGCTCCCCTTACT ACTACTACTACGGTATGGAC GTC |
| | | | SEQ ID NO:4729 | SEQ ID NO:12741 | SEQ ID NO:20753 |

FIGURE 49
(Continued)

| | | | | | LIWYDGNNTYYADSVKG | DRVYCSSTSCSPYYYYGMDV |
|---|---|---|---|---|---|---|
| iPS:393200 | 21-225_35E1 | AA | GYGLH | | | |
| | | NA | SEQ ID NO:4730 GGCTACTATGCAC | | SEQ ID NO:12742 TGGATCAACCCTAAAAGTGGTGCACAAATTATGCACAGAAGTTTCAGGGC | SEQ ID NO:20754 GTGTATTACCATGGTTCGGGGAGTTATTATAACGAGTTTGATTAT |
| iPS:393202 | 21-225_6B4 | AA | GYYMH | | SEQ ID NO:12743 WINPKSGGTNYAQKFQG | SEQ ID NO:20755 VYYHGSGSYYNEFDY |
| | | NA | SEQ ID NO:4732 AGCTATGGCATGAGC | | SEQ ID NO:12744 GCTATTAGTGGTAGTGGTAGTAGCACATACTACGCAGACTCCGTGAAGGGC | SEQ ID NO:20756 GAATATTGTGGTGGTGACTGCTATTCCCTTACTACTACTACTACGGTATGGACGTC |
| iPS:393204 | 21-225_8C12 | AA | SYAMS | | SEQ ID NO:12745 AISGSGSSTYYADSVKG | SEQ ID NO:20757 EYCGGDCYSPYYYYGMDV |
| | | NA | SEQ ID NO:4734 AGCTATGGCATGCAC | | SEQ ID NO:12746 CTTATATGGTATGATGGAAGTAATAAATACTATGCAGACTCCGTGAAGGGC | SEQ ID NO:20758 GATGGGTATCTTGTAGTAGTTCCAGCTGCTATCCTTACTACTACTACTACGGTATGGACGTC |
| iPS:393206 | 21-225_13F6 | AA | SYGMH | | SEQ ID NO:12747 LIWYDGSNKYYADSVKG | SEQ ID NO:20759 DRVSCSSSSCYPYYYYGMDV |
| | | NA | SEQ ID NO:4736 GGCTACTATGCAC | | SEQ ID NO:12748 TGGATCAACCCTAACAGTGGTGGCGCAAACTATGCACAGAAGTTTCAGGGC | SEQ ID NO:20760 TCGTTTACTATGGTTCGGGGACTTATTATAACGAGTTTGACTAC |
| | | AA | SEQ ID NO:4737 GYYMH | | SEQ ID NO:12749 WINPNSGGANYAQKFQG | SEQ ID NO:20761 SFYYGSGTYYNEFDY |

FIGURE 49
(Continued)

| | | | | | | |
|---|---|---|---|---|---|---|
| iPS:393208 | 21-225_16F3 | NA | SEQ ID NO:4738 GGGCACTATATGCAC | SEQ ID NO:12750 TGGATCAACCCTAACAG TGGTGGCACAAACTATG CACAGAAGTTTCAGGGC | SEQ ID NO:20762 TCGTATTACTATGGTTCGGG GACTTATTATAACGAGTTTG ACTAC |
| | | AA | SEQ ID NO:4739 GHYMH | SEQ ID NO:12751 WINPNSGGTNYAQKFQG | SEQ ID NO:20763 SYYYGSGTYYNFPDY |
| iPS:393210 | 21-225_17D3 | NA | SEQ ID NO:4740 GGCTACTATATGCAC | SEQ ID NO:12752 TGGATCAACCCTAACAG TGGTGGCACAAACTATG CACAGAAGTTTCAGGGC | SEQ ID NO:20764 GCGAATTACTATGGTTCGGG GAGTTATTATAACGACTTTG ACTAC |
| | | AA | SEQ ID NO:4741 GYYMH | SEQ ID NO:12753 WINPNSGGTNYAQKFQG | SEQ ID NO:20765 ANYYGSGSYYNDFDY |
| iPS:393212 | 21-225_30H6 | NA | SEQ ID NO:4742 ACTGGTGGAGTGGGTGTGG C | SEQ ID NO:12754 CTCATTATTGGCATGAT GATAAGCGCTACAGTCC CTCTCTGAAGAGC | SEQ ID NO:20766 TTAATAGCAGTGGCTTTGA CTAT |
| | | AA | SEQ ID NO:4743 TGGVGVG | SEQ ID NO:12755 LIYWHDDKRYSPSLKS | SEQ ID NO:20767 LIAVAFDY |
| iPS:393214 | 21-225_33A1 | NA | SEQ ID NO:4744 GGCTACTATATGCAC | SEQ ID NO:12756 TGGATCAACCCTAACAA TGGTGGCACACACTATG CACAGAAGTTTCAGGGC | SEQ ID NO:20768 GGATATTATTATGCTTCGGG GAGTTATTATAACGACCTCG ACCCC |
| | | AA | SEQ ID NO:4745 GYYMH | SEQ ID NO:12757 WINPNNGGTHYAQKFQG | SEQ ID NO:20769 GYYYASGSYYNDLDP |
| iPS:393218 | 21_225_14G3 | NA | SEQ ID NO:4746 GGCTACTATATGTAC | SEQ ID NO:12758 TGGATCAACCCTAACAG TGGTGGCACAAAGTTTCAGGGC | SEQ ID NO:20770 TCGTATTTTATGGTTCGGGG AGTTATTATAACGAGTTTGA CTAC |

FIGURE 49
(Continued)

| | | | | | |
|---|---|---|---|---|---|
| iPS:393222 | 21-225_14G3 | AA | SEQ ID NO:4747<br>GYYMY | SEQ ID NO:12759<br>WINPNSGGTNYAQKFQG | SEQ ID NO:20771<br>SYPYGSGSYYNEFDY |
| | | NA | SEQ ID NO:4748<br>ACTAGTGGAGTGGGTGTGG<br>C | SEQ ID NO:12760<br>CTCATTTATTGGGATGAT<br>GATAAGCGCTACAGCCC<br>ATCTCTGAAGAGC | SEQ ID NO:20772<br>ATTATAGCAGTGGCTTTTGA<br>CTAC |
| iPS:393224 | 21-225_17F5 | AA | SEQ ID NO:4749<br>ISGVGVG | SEQ ID NO:12761<br>LIYWDDDKRYSPSLKS | SEQ ID NO:20773<br>IIAVAFDY |
| | | NA | SEQ ID NO:4750<br>ACTGGTGGAGTGGGTGTGG<br>C | SEQ ID NO:12762<br>CTCATTTATTGGAATGAT<br>GATGAGCGCTACAGCCC<br>ATCTCTGAAGAGC | SEQ ID NO:20774<br>TTAATAGCAGTTTCCTTTGAC<br>TAC |
| iPS:393226 | 21-225_31C2 | AA | SEQ ID NO:4751<br>TGGVGVG | SEQ ID NO:12763<br>LIYWNDDERYSPSLKS | SEQ ID NO:20775<br>LIAVSFDY |
| | | NA | SEQ ID NO:4752<br>GGCTACTATATGCAC | SEQ ID NO:12764<br>TGGATCAACCCTAACAG<br>TGGTGGCACAAACTATG<br>CACAGAAGTTTCAGGGC | SEQ ID NO:20776<br>GTGTATTACTATGGTTCGGG<br>GAGTTATTATAACGAGTTTG<br>ACTAC |
| iPS:393230 | 21-225_33E6 | AA | SEQ ID NO:4753<br>GYYMH | SEQ ID NO:12765<br>WINPNSGGTNYAQKFQG | SEQ ID NO:20777<br>VYYYGSGTYYNEFDY |
| | | NA | SEQ ID NO:4754<br>GGCTACTATATACAC | SEQ ID NO:12766<br>TGGATCAACCCTAACAG<br>TGGTGGCACAGACTATG<br>CACAGAAGTTTCAGGGC | SEQ ID NO:20778<br>TCGTATTACTATGGTTCGGG<br>GACTTATTATAACGAGTTTG<br>ACTAC |
| iPS:393232 | 21-225_9G9 | AA | SEQ ID NO:4755<br>GYYIH | SEQ ID NO:12767<br>WINPNSGGTDYAQKFQG | SEQ ID NO:20779<br>SYYYGSGTYYNEFDY |
| | 21_225_17F12 | NA | SEQ ID NO:4756<br>AGCTATGCCATGAGC | SEQ ID NO:12768<br>GCTATTAGTGGTGGTGGT<br>GGTAGCACATACTACGC<br>AGACTCCGTGAAGGGC | SEQ ID NO:20780<br>TGGGGACGTGGATACAACTA<br>TGAGTACTACTACGGTATGG<br>ACGTC |

FIGURE 49
(Continued)

| | | | | | | | |
|---|---|---|---|---|---|---|---|
| iPS:393234 | 21-225_17F12 | | SEQ ID NO:4757 | | SEQ ID NO:12769 | | SEQ ID NO:20781 |
| | | AA | SYAMS | | AISGSGGSTYYADSVKG | | WGRGVNYEYYYGMDV |
| | | | SEQ ID NO:4758 | | SEQ ID NO:12770 | | SEQ ID NO:20782 |
| | | NA | GGCTACTATGCCATGAGC | | TGGATCAACCCTAACAG TGGTGGCACAAACTATG CACAGAAGTTTCAGGGC | | GAGAGGTGTAGTACTACCAG CTGCTATTTAGGAATTACGG GCTACTACGGTATGGACGTC |
| iPS:393345 | 21-225_26C10 | | SEQ ID NO:4759 | | SEQ ID NO:12771 | | SEQ ID NO:20783 |
| | | AA | GYYVH | | WINPNSGGTNYAQKFQG | | ERCSTTSCYLGITGYYGMDV |
| | | | SEQ ID NO:4760 | | SEQ ID NO:12772 | | SEQ ID NO:20784 |
| | | NA | AGCTATGCCATGAGC | | GCTATTAGTGGTGGTAGTGGT GGTAGCACATACTACGC AGACTCCGTGAAGGGC | | GAATATTGTGGTGGTGACTG CTATTCCCCTACTACTACTA CTACGGTATGGACGTC |
| iPS:393368 | 21-225_5G7 | | SEQ ID NO:4761 | | SEQ ID NO:12773 | | SEQ ID NO:20785 |
| | | AA | SYAMS | | AISGSGGSTYYADSVKG | | EYCGGDCYSPYYYYYGMDV |
| | | | SEQ ID NO:4762 | | SEQ ID NO:12774 | | SEQ ID NO:20786 |
| | | NA | AATTATGATATCAAC | | TGGATGAACCCTAACAG TGGTAACACAGGCTATG CACAGAGAGTTCCAGGC | | AGCAGTGGCTGGTACTACTT TGACTAC |
| iPS:393368 | 21-225_29H8 | | SEQ ID NO:4763 | | SEQ ID NO:12775 | | SEQ ID NO:20787 |
| | | AA | NYDIN | | WMPNSGNTGYAQRFQG | | SSGWYYFDY |
| | | | SEQ ID NO:4764 | | SEQ ID NO:12776 | | SEQ ID NO:20788 |
| | | NA | GGCTACTATATGCAC | | TGGATCAACCCTAACAG TGGTGGCACAAACTATG CACAGAAGTTTCAGGGC | | GTGTATTTCTATGGTTCGGG GAGTTATTATAACGAGTTTG ACTAC |
| iPS:393565 | 21-225_34B11 | | SEQ ID NO:4765 | | SEQ ID NO:12777 | | SEQ ID NO:20789 |
| | | AA | GYYMH | | WINPNSGGTNYAQKFQG | | VYFYGSGSYYNEFDY |
| | | | SEQ ID NO:4766 | | SEQ ID NO:12778 | | SEQ ID NO:20790 |

FIGURE 49
(Continued)

| | | | | | |
|---|---|---|---|---|---|
| iPS:393802 | 21-225_3D12 | NA | ACCGCTGGATGAAC | CGGATTAAAACAAAT TGATGGTGGGACAACAG ACTACGTTGCACCCGTG AAAGGC | GAAGGCTGGAACACGGACTA C |
| | | AA | SEQ ID NO:4767 TAWMN | SEQ ID NO:12779 RIKNKIDGGTTDYVAPVK G | SEQ ID NO:20791 EGWNTDY |
| iPS:393804 | 21-225_5H7 | NA | SEQ ID NO:4768 AGAAGTAGTTATTACTGGGG C | SEQ ID NO:12780 AATATCTATTATAGTGGG ACCACCTACTACAACCC GTCCCTCAAGAGT | SEQ ID NO:20792 CATGAAAAGACTGGGGCCT TGACTAC |
| | | AA | SEQ ID NO:4769 RSSYYWG | SEQ ID NO:12781 NIYYSGTTYYNPSLKS | SEQ ID NO:20793 HGKDWGLDY |
| iPS:393806 | 21-225_6A6 | NA | SEQ ID NO:4770 AGAAGTAGTTACTACTGGGG C | SEQ ID NO:12782 AATATCTATTATAGTGGG ATCCCCTACTACAACCCG TCCCTCAAGAGT | SEQ ID NO:20794 CACAGCAGCAGCTGGTCTCT TGACTAC |
| | | AA | SEQ ID NO:4771 RSSYYWG | SEQ ID NO:12783 NIYYSGIPYYNPSLKS | SEQ ID NO:20795 HSSSWSLDY |
| iPS:393808 | 21-225_1A2 | NA | SEQ ID NO:4772 AGCTATACCATGAAC | SEQ ID NO:12784 TCCATTAGTGGTAGTGGT AGTTACATATACTACGC AGACTCAGTGAAGGGC | SEQ ID NO:20796 GGGAGCAGCTCGTCCGGTT TGACTAC |
| | | AA | SEQ ID NO:4773 SYTMN | SEQ ID NO:12785 SISGSGSYIYYADSVKG | SEQ ID NO:20797 GSSSSGFDY |
| iPS:393810 | 21-225_5A4 | NA | SEQ ID NO:4774 AGCTCTGCCATGAGC | SEQ ID NO:12786 GCTATTAGTGGTCGTGGT GGTAACACATTCTACAC AGACTCCGTGAAGGGC | SEQ ID NO:20798 CTGGGGAAAGACTACTACTA CTACGGTATGGACGTC |
| | | | SEQ ID NO:4775 | SEQ ID NO:12787 | SEQ ID NO:20799 |

FIGURE 49
(Continued)

| | | | | | | | |
|---|---|---|---|---|---|---|---|
| iPS:393812 | 21-225_6A11 | AA | SSAMS | | AISGRGGNTFYTDSVKG | | LGKDYYYGMDV |
| | | | SEQ ID NO:4776 | | SEQ ID NO:12788 | | SEQ ID NO:20800 |
| | | NA | GACTATGGCATGCAC | | GTTATATGGTTTGATGGAAGTAATAAATACTATGCAGACTCCGTGAAGGGC | | GATCTTGGCTGGACGGAAGAGTAC |
| | | | SEQ ID NO:4777 | | SEQ ID NO:12789 | | SEQ ID NO:20801 |
| iPS:393814 | 21-225_7F4 | AA | DYGMH | | VIWFDGSNKYYADSVKG | | DLGWTEEY |
| | | | SEQ ID NO:4778 | | SEQ ID NO:12790 | | SEQ ID NO:20802 |
| | | NA | AGGAGTAGTTACTACTGGGGC | | AATATCTATTATAGTGGGGCCACCTACTACAACCCGTCCCTCAAGAGT | | CATAGCGGGCAGCAGCTGGTCCCTTGACTAC |
| | | | SEQ ID NO:4779 | | SEQ ID NO:12791 | | SEQ ID NO:20803 |
| iPS:393816 | 21-225_6D4 | AA | RSSYYWG | | NIYYSGATYYNPSLKS | | HSGSWSLDY |
| | | | SEQ ID NO:4780 | | SEQ ID NO:12792 | | SEQ ID NO:20804 |
| | | NA | AGAAGTAGTTCCTACTGGGGC | | AATATCTATTATAGTGGGAGCGGCCTACTACATTCCGTCCCTCAAGAGT | | CACAGCAGCAGCTGGTCTCTTGACTGC |
| | | | SEQ ID NO:4781 | | SEQ ID NO:12793 | | SEQ ID NO:20805 |
| | | AA | RSSSYWG | | NIYYSGSAYYIPSLKS | | HSSSWSLDC |
| | | | SEQ ID NO:4782 | | SEQ ID NO:12794 | | SEQ ID NO:20806 |
| iPS:393818 | 21-225_6G12 | NA | AGCTATGGCATGCAC | | GTTATTGGTATGATAGAAGTAATAACTACTATGCAGACTCCGTGAAGGGC | | GAACTGGGGTTCCGGTCTGACTAC |
| | | | SEQ ID NO:4783 | | SEQ ID NO:12795 | | SEQ ID NO:20807 |
| | | AA | SYGMH | | VIWYDRSNNYYADSVKG | | ELGFRSDY |
| | | | SEQ ID NO:4784 | | SEQ ID NO:12796 | | SEQ ID NO:20808 |

FIGURE 49
(Continued)

| | | NA | GACTTTGGCATGCAC | GTTATTGGTATGAAGA AAATAATCAATACTATG CAGACTCCGTGAAGGGC | GAGCTGGGGGTTCCGGTCTGA CTAC |
|---|---|---|---|---|---|
| iPS:393820 | 21-225_8H7 | | SEQ ID NO:4785 | SEQ ID NO:12797 | SEQ ID NO:20809 |
| | | AA | DFGMH | VIWYEENNQYYADSVKG | ELGFRSDY |
| | | | SEQ ID NO:4786 | SEQ ID NO:12798 | SEQ ID NO:20810 |
| | | NA | AACTATGGCATGCAC | GTTATATGGTATGAAGA AAGTAATAATACTATA CAGACTCCGTGAAGGGC | GAAGTGGGGATTCACTGAGGA CTAC |
| iPS:393822 | 21-225_15B11 | | SEQ ID NO:4787 | SEQ ID NO:12799 | SEQ ID NO:20811 |
| | | AA | NYGMH | VIWYEESNKYYTDSVKG | EVGFTEDY |
| | | | SEQ ID NO:4788 | SEQ ID NO:12800 | SEQ ID NO:20812 |
| | | NA | AGCTATGCCATGAGC | ATTATTAGTGGTCGTGGT GGTAACACATTCTACGC AGACTCCGTGAAGGGC | CGTGTAGCAGTGGCTGGCTC GGAGGCTTTTGCTATC |
| iPS:393824 | 21-225_10F12 | | SEQ ID NO:4789 | SEQ ID NO:12801 | SEQ ID NO:20813 |
| | | AA | SYAMS | IISGRGGNTFYADSVKG | RVAVAGSEAFAI |
| | | | SEQ ID NO:4790 | SEQ ID NO:12802 | SEQ ID NO:20814 |
| | | NA | AACTATGGCATGCAC | GTTATTGGTATGAAGA AAATAATCAATACTATG CAGACTCCGTGAAGGGC | GAACTGGGGGTTCCGGTCTGA CTAC |
| iPS:393826 | 21-225_10G5 | | SEQ ID NO:4791 | SEQ ID NO:12803 | SEQ ID NO:20815 |
| | | AA | NYGMH | VIWYEENNQYYADSVKG | ELGFRSDY |
| | | | SEQ ID NO:4792 | SEQ ID NO:12804 | SEQ ID NO:20816 |

FIGURE 49
(Continued)

| | | | | | |
|---|---|---|---|---|---|
| iPS:393828 | 21-225_10H12 | NA | GACTATGGCATGCAC | GTTATTGGTATGAAGAC AATAATCAATACTATGC AGACTCCGTGAAGGGC | GAACTGGGGGTTCCGGTCTGA CTAC |
| | | | SEQ ID NO:4793 | SEQ ID NO:12805 | SEQ ID NO:20817 |
| | | AA | DYGMH | VIWYEDNNQYYADSVKG | ELGFRSDY |
| | | | SEQ ID NO:4794 | SEQ ID NO:12806 | SEQ ID NO:20818 |
| iPS:393830 | 21-225_12A1 | NA | AGTTATGGCATGCAC | GTTATTGGTATGATGAAGA AATAATCAATACTATG CAGACTCCGTGAAGGGC | GAACTGGGGGTTCCGGTCTGA CTAC |
| | | | SEQ ID NO:4795 | SEQ ID NO:12807 | SEQ ID NO:20819 |
| | | AA | SYGMH | VIWYEENNQYYADSVKG | ELGFRSDY |
| | | | SEQ ID NO:4796 | SEQ ID NO:12808 | SEQ ID NO:20820 |
| iPS:393832 | 21-225_14B2 | NA | AGAAGTAGTATTATTACTGGGG T | AATATCTATTATAGTGGG ACCACCTACTACAACCC GTCCCTCAAGAGT | CATGGAAAAGACTGGGGCCT TGACTAC |
| | | | SEQ ID NO:4797 | SEQ ID NO:12809 | SEQ ID NO:20821 |
| | | AA | RSSYYWG | NIYYSGTTYYNPSLKS | HGKDWGLDY |
| | | | SEQ ID NO:4798 | SEQ ID NO:12810 | SEQ ID NO:20822 |
| iPS:393836 | 21-225_15A2 | NA | AGCTATACCATGAAC | TCCATTAGTGGTAGTGGT AGTTACATATACTACGC AGACTCAGTGAAGGGC | GTGGCTTCATTGACTAC |
| | | | SEQ ID NO:4799 | SEQ ID NO:12811 | SEQ ID NO:20823 |
| | | AA | SYTMN | SISGSGSYIYYADSVKG | VASFDY |
| | | | SEQ ID NO:4800 | SEQ ID NO:12812 | SEQ ID NO:20824 |

FIGURE 49
(Continued)

| | | NA | GACTATGGCATACAC | GTCATTGGTTTGATGGA AGTAATAAATACTATGC AGACTCCGTGAAGGGC | GATCTTGGCTGGACGGAAGA GTAC |
|---|---|---|---|---|---|
| iPS:393838 | 21-225_6G2 | | SEQ ID NO:4801 | SEQ ID NO:12813 | SEQ ID NO:20825 |
| | | AA | DYGIH | VIWFDGSNKYYADSVKG | DLGWTEEY |
| | | | SEQ ID NO:4802 | SEQ ID NO:12814 | SEQ ID NO:20826 |
| | | NA | AGCTATGGCATGCAC | GTTATATGGCATGATGG AAGTAATAAATACTATG CAGACTCCGTGAAGGGC | GATCTGAGTATGGGCGGTAT GGACGTC |
| iPS:393840 | 21-225_3F8 | | SEQ ID NO:4803 | SEQ ID NO:12815 | SEQ ID NO:20827 |
| | | AA | SYGMH | VIWHDGSNKYYADSVKG | DLSMGGMDV |
| | | | SEQ ID NO:4804 | SEQ ID NO:12816 | SEQ ID NO:20828 |
| | | NA | AACTATGGCATGCAC | GTCATATGGCATGATGG AAGTAATAAATACTATG TAGACTCCGTGAAGGGC | GATGAGAGGCTGGGGGATTTT TGACTAC |
| iPS:393844 | 21-225_3G7 | | SEQ ID NO:4805 | SEQ ID NO:12817 | SEQ ID NO:20829 |
| | | AA | NYGMH | VIWHDGSNKYYVDSVKG | DERLGIFDY |
| | | | SEQ ID NO:4806 | SEQ ID NO:12818 | SEQ ID NO:20830 |
| | | NA | GGCTATGCCATGAAC | GTTATTAGTCGTAGTGGT GGTTACACATACACGC GGACTCCGTGAAGGGC | CGTTTAGCAGTGGCTGGCTC GGAGGCTTTTGATATC |
| iPS:393848 | 21-225_4H2 | | SEQ ID NO:4807 | SEQ ID NO:12819 | SEQ ID NO:20831 |
| | | AA | GYAMN | VISRSGGYTYYADSVKG | RLAVAGSEAFDI |
| | | | SEQ ID NO:4808 | SEQ ID NO:12820 | SEQ ID NO:20832 |

FIGURE 49
(Continued)

| | | | | |
|---|---|---|---|---|
| iPS:393852 | 21-225_12A10 | NA | AGCTATGGCATGCAC | GTTATATGGCATGATGA AAGTAATAAATACTATA CAGACTCCGTGAAGGGC | GACGAGAGGCTGGGGATTTT TGACTAC |
| | | | SEQ ID NO:4809 | SEQ ID NO:12821 | SEQ ID NO:20833 |
| | | AA | SYGMH | VIWHDESNKYYTDSVKG | DERLGIFDY |
| | | | SEQ ID NO:4810 | SEQ ID NO:12822 | SEQ ID NO:20834 |
| iPS:393854 | 21-225_7H11 | NA | GACTATGGCATGCAC | GTTATATGGTATGATGA AATAATAAATACTATG CAGACTCCGTGAAGGGC | GAACTGGGGTTCCGGTCTGA CTAC |
| | | | SEQ ID NO:4811 | SEQ ID NO:12823 | SEQ ID NO:20835 |
| | | AA | DYGMH | VIWYDENNKYYADSVKG | ELGFRSDY |
| | | | SEQ ID NO:4812 | SEQ ID NO:12824 | SEQ ID NO:20836 |
| iPS:393856 | 21-225_14C2 | NA | GACTATGGCATGCAC | GTTATATGGTATGACGA AAGTAATAAATACTATG AAGACTCCGTGAAGGGC | GAAGTGGGATTCCGGTCTGA CTAC |
| | | | SEQ ID NO:4813 | SEQ ID NO:12825 | SEQ ID NO:20837 |
| | | AA | DYGMH | VIWYDESNKYYEDSVKG | EVGFRSDY |
| | | | SEQ ID NO:4814 | SEQ ID NO:12826 | SEQ ID NO:20838 |
| iPS:393862 | 21-225_5G2 | NA | AGCTATGCCATGAGC | GTTATTAGTGGTCGTGGT GTTAACACATTCTACGCA GACTCCGTGAAGGGC | CGTATAGCAGTGGCTGGCTC GGAGGCTTTGATATC |
| | | | SEQ ID NO:4815 | SEQ ID NO:12827 | SEQ ID NO:20839 |
| | | AA | SYAMS | VISGRGVNFYADSVKG | RIAVAGSEAFDI |
| | | | SEQ ID NO:4816 | SEQ ID NO:12828 | SEQ ID NO:20840 |

FIGURE 49
(Continued)

| | | | | | |
|---|---|---|---|---|---|
| iPS:393864 | 21-225_4C5 | NA | AGCTATGTCCTGCAC | GTTATATGGTATGATGG AAGTAATAAATACTATG CAGACTCCGTGAAGGGC | GAAAAGTATACCAGCAGCTG GTACGACTACGGTATGGACG TC |
| | | | SEQ ID NO:4817 | SEQ ID NO:12829 | SEQ ID NO:20841 |
| | | AA | SYVLH | VIWYDGSNKYYADSVKG | EKYTSSWYDYGMDV |
| | | | SEQ ID NO:4818 | SEQ ID NO:12830 | SEQ ID NO:20842 |
| iPS:393866 | 21-225_14E3 | NA | GACTTGGCATGCAC | GTTATTGGTATGAAGA AATAATCAATACTATG CAGACTCCGTGAAGGGC | GAGCTGGGGTTCCGGTCTGA CTAC |
| | | | SEQ ID NO:4819 | SEQ ID NO:12831 | SEQ ID NO:20843 |
| | | AA | DFGMH | VIWYEENNQYYADSVKG | ELGFRSDY |
| | | | SEQ ID NO:4820 | SEQ ID NO:12832 | SEQ ID NO:20844 |
| iPS:393868 | 21-225_9C11 | NA | AGCTATGGCATGCAC | GTTATATGGCATGATGA AACTAATAAATACTATG CAGATTCCGTGAAGGGC | GACGAGAGGCTGGGGATTTT TGACTAC |
| | | | SEQ ID NO:4821 | SEQ ID NO:12833 | SEQ ID NO:20845 |
| | | AA | SYGMH | VIWHDETNKYYADSVKG | DERLGIFDY |
| | | | SEQ ID NO:4822 | SEQ ID NO:12834 | SEQ ID NO:20846 |
| iPS:393870 | 21-225_7B1 | NA | AGCTATGACATGAGC | ACTATTAGTGGTAGTGGT GGTATCACATACTACGC AGACTCCGTGAAGGGC | GATCGGGGCAGGCGTC |
| | | | SEQ ID NO:4823 | SEQ ID NO:12835 | SEQ ID NO:20847 |
| | | AA | SYDMS | TISGSGGITYYADSVKG | DRGSV |
| | | | SEQ ID NO:4824 | SEQ ID NO:12836 | SEQ ID NO:20848 |

FIGURE 49
(Continued)

| iPS | Name | | | |
|---|---|---|---|---|
| iPS:393872 | 21-225_2A11 | NA | AGGAGTAGTTACTACTGGGGC | AATATCTATTATAGTGGGAGCACCTACTACAACCCGTCCGTCAAGAGT | CATGGAAAAGACTGGGGCCTTGAAGAC |
| | | | SEQ ID NO:4825 | SEQ ID NO:12837 | SEQ ID NO:20849 |
| | | AA | RSSYYWG | NIYYSGSTYYNPSVKS | HGKDWGLED |
| | | | SEQ ID NO:4826 | SEQ ID NO:12838 | SEQ ID NO:20850 |
| iPS:393874 | 21-225_4C8 | NA | AACTATGGCATGCAC | GTTATTTGGTATGAAGAAATAATCAATACTATGCAGACTCCGTGAAGGGC | GAAATGGGGTTCCTGTCTGACTAC |
| | | | SEQ ID NO:4827 | SEQ ID NO:12839 | SEQ ID NO:20851 |
| | | AA | NYGMH | VIWYEENNQYYADSVKG | EMGFLSDY |
| | | | SEQ ID NO:4828 | SEQ ID NO:12840 | SEQ ID NO:20852 |
| iPS:393876 | 21-225_9A1 | NA | GACTATGGCATGCAC | GTTATATGGTTTGATGGAAGTAATAAATACTACGCAGACTCCGTGAAGGGC | GATCTTGGCTGGACGGAAGAGTAC |
| | | | SEQ ID NO:4829 | SEQ ID NO:12841 | SEQ ID NO:20853 |
| | | AA | DYGMH | VIWFDGSNKYYADSVKG | DLGWTEEY |
| | | | SEQ ID NO:4830 | SEQ ID NO:12842 | SEQ ID NO:20854 |
| iPS:393878 | 21-225_7G12 | NA | AGCTATGCCATGAAC | GTTATTAGTGGTAGTGGTGGTAGCACATACTACGCAGACTCCGTGAAGGGC | AGGTATACCAGTGACTGGCATGATGCTTTTGATATC |
| | | | SEQ ID NO:4831 | SEQ ID NO:12843 | SEQ ID NO:20855 |
| | | AA | SYAMN | VISGSGGSTYYADSVKG | RYTSDWHDAFDI |
| | | | SEQ ID NO:4832 | SEQ ID NO:12844 | SEQ ID NO:20856 |
| iPS:393880 | 21_225_15A1 | NA | AGAAGTAGTTACTACTGGGGC | AGTATCTATTATAGTGGGAGCGCCCAGTACAACCCGTCCCTCAAGAGT | CTGAGCAGCAGCTGGTCTTTTGACTAC |

FIGURE 49
(Continued)

| | | | | | | | |
|---|---|---|---|---|---|---|---|
| iPS:393882 | 21-225_15A1 | AA | SEQ ID NO:4833<br>RSSYYWG | SEQ ID NO:12845<br>SIYYSGSAQYNPSLKS | SEQ ID NO:20857<br>LSSSWSFDY |
| | | NA | SEQ ID NO:4834<br>AGCTATGGCATGCAC | SEQ ID NO:12846<br>GTTATATGGTATGAGGA<br>AAGTAATAAACACTATG<br>CAGACTCCGTGAAGGGC | SEQ ID NO:20858<br>GAGCTGGGGGTTCCTCTCTGA<br>CTAC |
| iPS:393884 | 21-225_15E3 | AA | SEQ ID NO:4835<br>SYGMH | SEQ ID NO:12847<br>VIWYEENNKHYADSVKG | SEQ ID NO:20859<br>ELGFLSDY |
| | | NA | SEQ ID NO:4836<br>AACTATGGCATGCAC | SEQ ID NO:12848<br>GTTATATGGTATGAAGG<br>AAGTAATCAATACTATG<br>GAGACTCCGTGAAGGGC | SEQ ID NO:20860<br>GAGCTGGGGGTTCCTCTCTGA<br>CTAC |
| iPS:393886 | 21-225_16F4 | AA | SEQ ID NO:4837<br>NYGMH | SEQ ID NO:12849<br>VIWYEGSNQYYGDSVKG | SEQ ID NO:20861<br>ELGFLSDY |
| | | NA | SEQ ID NO:4838<br>CCTAATTACTACTGGGGC | SEQ ID NO:12850<br>AGTATCTATTATAGTGGA<br>AGCACCTCCTACAACCC<br>GTCCCTCAACAGT | SEQ ID NO:20862<br>CTAAGCAGCAACTGGGACTT<br>TGACAAC |
| iPS:393888 | 21-225_2G9 | AA | SEQ ID NO:4839<br>PNYYWG | SEQ ID NO:12851<br>SIYYSGSTSYNPSLNS | SEQ ID NO:20863<br>LSSNWDFDN |
| | | NA | SEQ ID NO:4840<br>AGCTATGTCATGAGC | SEQ ID NO:12852<br>ATTATTAGTGGTCGTGGT<br>GGTAACACATTCTACGC<br>AGACTCCGTGAAGGGC | SEQ ID NO:20864<br>CGTTTAGCAGTGGCTGGCTC<br>GGAGGCTTTTGATATC |
| | 21-225_3E3 | AA | SEQ ID NO:4841<br>SYVMS | SEQ ID NO:12853<br>IISGRGGNTFYADSVKG | SEQ ID NO:20865<br>RLAVAGSEAFDI |
| | | | SEQ ID NO:4842 | SEQ ID NO:12854 | SEQ ID NO:20866 |

FIGURE 49
(Continued)

| iPS ID | Clone | Type | CDR1 | SEQ ID | CDR2 | SEQ ID | CDR3 | SEQ ID |
|---|---|---|---|---|---|---|---|---|
| iPS:393890 | 21-225_4B1 | NA | AGTTACTCCTGGAGC | SEQ ID NO:4843 | CGTATCTATACCAGTGGAGCACCAACTACACCCCTCCCTCAAGAGT | SEQ ID NO:12855 | GATTTGAAGAGCAGTGGCTGCCTTTCTTTGACTAC | SEQ ID NO:20867 |
| | | AA | SYSWS | SEQ ID NO:4844 | RIYTSGSTNYIPSLKS | SEQ ID NO:12856 | DLKSSGCLFFDY | SEQ ID NO:20868 |
| iPS:393892 | 21-225_6G7 | NA | AGCTATGGCATGCAC | SEQ ID NO:4845 | ATTATATCATATGTTGGAAGAATAAATATTATGCAGACTCCGTGAAGGGC | SEQ ID NO:12857 | CGGGGAAACAGTATGGCGGGTACGGTATGGACGTC | SEQ ID NO:20869 |
| | | AA | SYGMH | SEQ ID NO:4846 | IISYVGKNKYYADSVKG | SEQ ID NO:12858 | RGNSYGGYGMDV | SEQ ID NO:20870 |
| iPS:393894 | 21-225_5E11 | NA | AGCTATAGCATGAAC | SEQ ID NO:4847 | TCCATTAGTGGTAGTAGTACTTACATATACTACGCAGACTCAGTGAAGGGC | SEQ ID NO:12859 | GTGGCTTCATTTGACTAC | SEQ ID NO:20871 |
| | | AA | SYSMN | SEQ ID NO:4848 | SISGSSTYIYYADSVKG | SEQ ID NO:12860 | VASFDY | SEQ ID NO:20872 |
| iPS:393896 | 21-225_2A4 | NA | AGCTATAGCATGAAC | SEQ ID NO:4849 | TCCATTAGTGGTAGTAGTACTTACATATACTACGCAGACTCAGTGAAGGGC | SEQ ID NO:12861 | GTGGCTTCATTTGACTAC | SEQ ID NO:20873 |
| | | AA | SYSMN | SEQ ID NO:4850 | SISGSSTYIYYADSVKG | SEQ ID NO:12862 | VASFDY | SEQ ID NO:20874 |
| iPS:393898 | 21-225_5F7 | NA | AGCTATGCCATGAGC | SEQ ID NO:4851 | ATTATTAGTGGTCGTGGTAACACATTCTACGCAGACTCCGTGAAGGGC | SEQ ID NO:12863 | CGTATATACCAGTGGCTGCTCGGAGGCTTTTGCTATC | SEQ ID NO:20875 |
| | | AA | SYAMS | | IISGRGGNTFYADSVKG | | RIAVAGSEAFAI | |

FIGURE 49
(Continued)

| | | | SEQ ID NO:4852 AACTATGGCATGCAC | SEQ ID NO:12864 GTTATATGGCATGATGG AAGTAATAAATACTATG TAGACTCCGTGAAGGGC | SEQ ID NO:20876 GATGAGAGGCTGGGATTTT TGACTAC |
| iPS:393900 | 21-225_10E12 | NA | | | |
| | | AA | SEQ ID NO:4853 NYGMH | SEQ ID NO:12865 VIWHDGSNKYYVDSVKG | SEQ ID NO:20877 DERLGIFDY |
| | | NA | SEQ ID NO:4854 GACTATGGCATGCAC | SEQ ID NO:12866 GTTATATGGTATGATGG AAGTAATAAATACTATG CAGACTCCGTGAAGGGC | SEQ ID NO:20878 GAGAAGTATAGCAGCAGCTG GTACGACTACGGTATGGACG TC |
| iPS:393902 | 21-225_14E10 | | | | |
| | | AA | SEQ ID NO:4855 DYGMH | SEQ ID NO:12867 VIWYDGSNKYYADSVKG | SEQ ID NO:20879 EKYSSSWYDYGMDV |
| | | NA | SEQ ID NO:4856 ACCTATAACATGCAC | SEQ ID NO:12868 GTTATATGGTATGATGG AAGTGATAGATACTCTG CAGACTCCGTGAAGGGC | SEQ ID NO:20880 GATCGGGCCTATAGCAGCTC GTCTGACTTC |
| iPS:393904 | 21-225_8H11 | | | | |
| | | AA | SEQ ID NO:4857 TYNMH | SEQ ID NO:12869 VIWYDGSDRYSADSVKG | SEQ ID NO:20881 DRAYSSSSDF |
| | | NA | SEQ ID NO:4858 AGTTATACCATGAAC | SEQ ID NO:12870 TCCATTAGTGGTAGTAGT AGTTACATATACTACG GGACTCAGTGAAGGGC | SEQ ID NO:20882 GATCGGGCAGTGGC |
| iPS:393906 | 21-225_13D3 | | | | |
| | | AA | SEQ ID NO:4859 SYTMN | SEQ ID NO:12871 SISGSSSYIYYADSVKG | SEQ ID NO:20883 DRGSG |
| | | | SEQ ID NO:4860 | SEQ ID NO:12872 | SEQ ID NO:20884 |

FIGURE 49
(Continued)

| iPS ID | Name | Type | Seq 1 | SEQ ID | Seq 2 | SEQ ID | Seq 3 | SEQ ID |
|---|---|---|---|---|---|---|---|---|
| iPS:393908 | 21-225_10E9 | NA | AACTATGTCATACAC | SEQ ID NO:4861 | GTTATATGGTATGATGG AAGTAATAAATACTATG CAGACTCCGTGAAGGGC | SEQ ID NO:12873 | GAAAAGTATAGCAGCAGCTG GTACGACTACGGTATGGACG TC | SEQ ID NO:20885 |
| | | AA | NYVIH | SEQ ID NO:4862 | VIWYDGSNKYYADSVKG | SEQ ID NO:12874 | EKYSSSWYDYGMDV | SEQ ID NO:20886 |
| iPS:393910 | 21-225_15F10 | NA | AGCTATGGCATGCAC | SEQ ID NO:4863 | GTTATATCATATGGTGGA AGTAATAATTACTATGC AGACTCCGTGAAGGGC | SEQ ID NO:12875 | CGGGATACAGCTATGGCGG GTACGGTATGGACGTC | SEQ ID NO:20887 |
| | | AA | SYGMH | SEQ ID NO:4864 | VISYGGSNNYYADSVKG | SEQ ID NO:12876 | RGYSYGGYGMDV | SEQ ID NO:20888 |
| iPS:393912 | 21-225_16F6 | NA | AACTATGGCATGCAC | SEQ ID NO:4865 | GTTATATGGTATGATGG AAGTAATCAATACTATG GAGACTCCGTGAAGGGC | SEQ ID NO:12877 | GAGCTGGGGTTCCTCTCTGA TTAC | SEQ ID NO:20889 |
| | | AA | NYGMH | SEQ ID NO:4866 | VIWYEGSNQYYGDSVKG | SEQ ID NO:12878 | ELGFLSDY | SEQ ID NO:20890 |
| iPS:393914 | 21-225_16B8 | NA | AGCTATAGCATGAAC | SEQ ID NO:4867 | TCCATTAGTGGTAGTAGT ACTTACATATACGCA GACTCAGTGAAGGGC | SEQ ID NO:12879 | GTGGCTTCATTGACTAC | SEQ ID NO:20891 |
| | | AA | SYSMN | SEQ ID NO:4868 | SISGSSTYIYYADSVKG | SEQ ID NO:12880 | VASFDY | SEQ ID NO:20892 |
| iPS:393916 | 21_225_2G4 | NA | AGCTATGTCATGCAC | | GTTATATGGTATGATGG AAGTAATAAATACTATG CAGACTCCGTGAAGGGC | | GAGAAGTATAGCAGCAGCTG GTACGACTACGGTATGGACG TC | |

FIGURE 49
(Continued)

| | | | | | | | |
|---|---|---|---|---|---|---|---|
| iPS:393920 | 21-225_2G4 | AA | SEQ ID NO:4869 SYVMH | SEQ ID NO:12881 VIWYDGSNKYYADSVKG | SEQ ID NO:20893 EKYSSSWYDYGMDV | | |
| | | NA | SEQ ID NO:4870 AGCTATGGCATGCAC | SEQ ID NO:12882 ATTATATGGCATGATGG AAGTAATAAATACTATG TAGACTCCGTGAAGGGC | SEQ ID NO:20894 GATGAGAGGCTGGGGATTTT TGACTAC | | |
| iPS:393922 | 21-225_1H12 | AA | SEQ ID NO:4871 SYGMH | SEQ ID NO:12883 IIWHDGSNKYYVDSVKG | SEQ ID NO:20895 DERLGIFDY | | |
| | | NA | SEQ ID NO:4872 AGCTATGGCATGCAC | SEQ ID NO:12884 GTTATATGGTATGAGGA AATAATAAATACTATG TAGACTCCGTGAAGGGC | SEQ ID NO:20896 GAACTAGGCTTCCAGTCTGA CTAC | | |
| iPS:393924 | 21-225_2B2 | AA | SEQ ID NO:4873 SYGMH | SEQ ID NO:12885 VIWYEENNKYYVDSVKG | SEQ ID NO:20897 ELGFQSDY | | |
| | | NA | SEQ ID NO:4874 AGCTATGGCATGCAC | SEQ ID NO:12886 GTTATATGGCATGATGG AAGTAATAAATACTATG CAGACTCCGTGAAGGGC | SEQ ID NO:20898 GATCTGAGAATGGGCGGTAT GGACGTC | | |
| iPS:393926 | 21-225_4G4 | AA | SEQ ID NO:4875 SYGMH | SEQ ID NO:12887 VIWHDGSNKYYADSVKG | SEQ ID NO:20899 DLRMGGMDV | | |
| | | NA | SEQ ID NO:4876 CGTAGTAGTTACTACTGGGG C | SEQ ID NO:12888 AGTGTCTATTATAGTGGG GCCACCTCCTACAACCC GTCCCTCAAGAGT | SEQ ID NO:20900 CTAAGCAGCAACTGGGACTT TGACTAC | | |
| iPS:393928 | 21_225_4E10 | | | | | | |

FIGURE 49
(Continued)

| | | | | | |
|---|---|---|---|---|---|
| | 21-225_4E10 | | SEQ ID NO:4877 RSSYYWG | SEQ ID NO:12889 SVYYSGATSYNPSLKS | SEQ ID NO:20901 LSSNWDFDY |
| iPS:393930 | | AA | SEQ ID NO:4878 AGCTTTGGCATGCAC | SEQ ID NO:12890 ATTATATGGCATGATGG AAGTAATAAATACTATG CAGACTCCGTGAAGGGC | SEQ ID NO:20902 GATCTGAGTGATGGGCGGTAT GGACGTC |
| | 21-225_7E11 | NA | SEQ ID NO:4879 SFGMH | SEQ ID NO:12891 IIWHDGSNKYYADSVKG | SEQ ID NO:20903 DLSMGGMDV |
| iPS:393932 | | AA | SEQ ID NO:4880 AGCTATGGCATGCAC | SEQ ID NO:12892 ATTATATGGCATGATGG AAGTAATAAATATTATG TAGACTCCGTGAAGGGC | SEQ ID NO:20904 GATGAGAGGCTGGGGATTTT TGACTAC |
| | 21-225_10F5 | NA | SEQ ID NO:4881 SYGMH | SEQ ID NO:12893 IIWHDGSNKYYVDSVKG | SEQ ID NO:20905 DERLGIFDY |
| iPS:393934 | | AA | SEQ ID NO:4882 AACTATGGCATGCAC | SEQ ID NO:12894 GTTATATGGTATGATGA AAATAATAAATATTATA TAGACTCCGTGAAGGGC | SEQ ID NO:20906 GAATTGGGGTTCCGGTCTGA CTAC |
| | 21-225_13E6 | NA | SEQ ID NO:4883 NYGMH | SEQ ID NO:12895 VIWYDENNKYYIDSVKG | SEQ ID NO:20907 ELGFRSDY |
| iPS:393936 | | AA | SEQ ID NO:4884 AGCTATGCCATGAAC | SEQ ID NO:12896 GTTATTAGTGGTAGAGG TGGTAGTACATACTACG CAGACTCCGTGAAGGGC | SEQ ID NO:20908 AGGATAGCAGCTGGTATGGA GTACTTCGATCTC |
| | 21-225_14A11 | | SEQ ID NO:4885 SYAMN | SEQ ID NO:12897 VISGRGGSTYYADSVKG | SEQ ID NO:20909 RIAAGMEYFDL |
| | | AA | SEQ ID NO:4886 | SEQ ID NO:12898 | SEQ ID NO:20910 |

FIGURE 49
(Continued)

| | | | | |
|---|---|---|---|---|
| iPS:393940 | 21-225_16B2 | NA | AGCTATGCCATGAGC | GTTATTAGTGGTAGTGGT GGTAGCACATTCTACGC AGACTCCGTGAAGGGC | TATTGTGTAGTAGTACCAGGTG CCCTTATGATGCCTTTGATAT C |
| | | | SEQ ID NO:4887 | SEQ ID NO:12899 | SEQ ID NO:20911 |
| | | AA | SYAMT | VISGSGGSTFYADSVKG | YCSSTRCPYDAFDI |
| | | | SEQ ID NO:4888 | SEQ ID NO:12900 | SEQ ID NO:20912 |
| iPS:393942 | 21-225_11E5 | NA | AATTATGATATCAAC | TGGATGCACCCTAACAG TGGTGCCACGGCTATG CACAGAGGTTCCAGGGC | AGCAGTGGCTGGGAGGTCTT TGACTAC |
| | | | SEQ ID NO:4889 | SEQ ID NO:12901 | SEQ ID NO:20913 |
| | | AA | NYDIN | WMHPNSGATGYAQRFQG | SSGWEVFDY |
| | | | SEQ ID NO:4890 | SEQ ID NO:12902 | SEQ ID NO:20914 |
| iPS:393944 | 21-225_14D6 | NA | AGTTATACCATGAAC | TCCATTAGTGGTAGTAGT AGTTACATATACTACGC AGACTCAGTGAAGGGC | GTAGCAGCCTTTGACTCC |
| | | | SEQ ID NO:4891 | SEQ ID NO:12903 | SEQ ID NO:20915 |
| | | AA | SYTMN | SISGSGSYIYYADSVKG | VAAFDS |
| | | | SEQ ID NO:4892 | SEQ ID NO:12904 | SEQ ID NO:20916 |
| iPS:393946 | 21-225_16A4 | NA | AGCTATAGCATGAAC | TCCATTAGTGGTAGTAGT ACTTACAAATACTACGC AGACTCAGTGAAGGGC | GATCGTGGGAGCTAC |
| | | | SEQ ID NO:4893 | SEQ ID NO:12905 | SEQ ID NO:20917 |
| | | AA | SYSMN | SISGSSTYKYYADSVKG | DRGSY |
| | | | SEQ ID NO:4894 | SEQ ID NO:12906 | SEQ ID NO:20918 |
| iPS:393948 | 21-225_16A5 | NA | GACTATGGCATGCAC | GTTATATGGTTTGATGGA AGTAATAAATACTATGT AGACTCCGTGAAGGGC | GATCTTGGCTGGACGGAAGA GTAC |
| | | | SEQ ID NO:4895 | SEQ ID NO:12907 | SEQ ID NO:20919 |

FIGURE 49
(Continued)

| | | AA | DYGMH | | VIWFDGSNKYYVDSVKG | DLGWTEEY |
|---|---|---|---|---|---|---|
| iPS:393950 | | | SEQ ID NO:4896 | | SEQ ID NO:12908 | SEQ ID NO:20920 |
| | 21-225_3H10 | NA | AGCTATGTCATGCAC | | GTTATATGGTATGATGG AAGTAATAAATACTATG CAGACTCCGTGAAGGGC | GAGAGATATAGCAGTGGCTG GTATGACTACGGTTTGGACG TC |
| | | AA | SYVMH | | VIWYDGSNKYYADSVKG | ERYSSGWYDYGLDV |
| iPS:393952 | | | SEQ ID NO:4897 | | SEQ ID NO:12909 | SEQ ID NO:20921 |
| | 21-225_1F1 | NA | AGCTATAACATGAAC | | TCCATTAGTAGTAGTAGT AGTTACATATACTACGC AGACTCAGTGAAGGGC | GTTAACCTCTTTGACTAC |
| | | | SEQ ID NO:4898 | | SEQ ID NO:12910 | SEQ ID NO:20922 |
| | | AA | SYNMN | | SISSSSYIYYADSVKG | VNLFDY |
| iPS:393954 | | | SEQ ID NO:4899 | | SEQ ID NO:12911 | SEQ ID NO:20923 |
| | 21-225_4H6 | NA | GACTACTATTTGCAC | | TGGATCCACCCTAACAG TGGTGGCACAAACTATG CACAGAAGTTTCAGGGC | GATGGTACCAGCTCGTTTGA CTAC |
| | | AA | DYYLH | | WIHPNSGGTNYAQKFQG | DGTSSFDY |
| iPS:393956 | | | SEQ ID NO:4900 | | SEQ ID NO:12912 | SEQ ID NO:20924 |
| | 21-225_4D7 | NA | AGCTATGCCATGAGC | | GTTCTTAGTGGTAGTGGT GGTAGCACATTCTACGC AGACTCCGTGAAGGGC | TATTGTAGTAGTGCCAGGTG CCCTTATGATGCCTTTGATAT C |
| | | | SEQ ID NO:4903 | | SEQ ID NO:12915 | SEQ ID NO:20927 |
| | | AA | SYAMS | | VLSGSGGSTFYADSVKG | YCSSARCPYDAFDI |
| | | | SEQ ID NO:4904 | | SEQ ID NO:12916 | SEQ ID NO:20928 |

FIGURE 49
(Continued)

| | | | | | |
|---|---|---|---|---|---|
| iPS:393958 | 21-225_5H2 | NA | AGCTATACCATGAAC | TCCATTAGTGGTAGTAGTAGTTACATATACTACGCAGACTCAGTGAAGGGC | GGGAGCAGCTCGTCCGGCTTTGACTAC |
| | | | SEQ ID NO:4905 | SEQ ID NO:12917 | SEQ ID NO:20929 |
| | | AA | SYTMN | SISGSSYIYYADSVKG | GSSSSGFDY |
| | | | SEQ ID NO:4906 | SEQ ID NO:12918 | SEQ ID NO:20930 |
| iPS:393960 | 21-225_7G2 | NA | GACTATGGCATGCAC | GTTATATGGTATGATGTAACTAATAAATACTATGCAGACTCCGTGAAGGGC | GAACTTGGCTGGTACGAGGACTAC |
| | | | SEQ ID NO:4907 | SEQ ID NO:12919 | SEQ ID NO:20931 |
| | | AA | DYGMH | VIWYDVTNKYYADSVKG | ELGWYEDY |
| | | | SEQ ID NO:4908 | SEQ ID NO:12920 | SEQ ID NO:20932 |
| iPS:393962 | 21-225_7H7 | NA | AGAAGTAGTTACTACTGGGGC | AATATCTATTATAGTGGGAGCACCTACTACATCCCGTCCCTCAAGAGT | CACAGTACCAGCTGGTCTCTTGACCAC |
| | | | SEQ ID NO:4909 | SEQ ID NO:12921 | SEQ ID NO:20933 |
| | | AA | RSSYYWG | NIYYSGSTYYIPSLKS | HSTSWSLDH |
| | | | SEQ ID NO:4910 | SEQ ID NO:12922 | SEQ ID NO:20934 |
| iPS:393964 | 21-225_6G1 | NA | AGCTATGGCATGCAC | ATTATATGGTATGATGGAAGTAATAAATACTATGCAGACTCCGTGAAGGGC | GATCTGAGTATGGGCGGTATGGACGTC |
| | | | SEQ ID NO:4911 | SEQ ID NO:12923 | SEQ ID NO:20935 |
| | | AA | SYGMH | IIWYDGSNKYYADSVKG | DLSMGGMDV |
| | | | SEQ ID NO:4912 | SEQ ID NO:12924 | SEQ ID NO:20936 |

FIGURE 49
(Continued)

| | | | | | | |
|---|---|---|---|---|---|---|
| iPS:393966 | 21-225_7F8 | NA | AGCTGTGTCATGCAC | | GTTATATGGTATGATGG AAGTAATAAATACTATG CAGACTCCGTGAAGGGC | GAAAGGTATACCAGTGGCTG GCACGACTACGGTATGGACG TC |
| | | | SEQ ID NO:4913 | | SEQ ID NO:12925 | SEQ ID NO:20937 |
| | | AA | SCVMH | | VIWYDGSNKYYADSVKG | ERYTSGWHDYGMDV |
| | | | SEQ ID NO:4914 | | SEQ ID NO:12926 | SEQ ID NO:20938 |
| iPS:393968 | 21-225_5A5 | NA | AGCTATGCCATGAAC | | GCTATTAGTGGTAGTGGT GGTTACACATACTACGC AGACTCCGTGAAGGGC | GGGGGGTCCCTCTCTAC |
| | | | SEQ ID NO:4915 | | SEQ ID NO:12927 | SEQ ID NO:20939 |
| | | AA | SYAMN | | AISGSGGYTYYADSVKG | GGSLFY |
| | | | SEQ ID NO:4916 | | SEQ ID NO:12928 | SEQ ID NO:20940 |
| iPS:393972 | 21-225_7C9 | NA | AACTATGTCATGCAC | | GTTATATGGTATGATGG AAGTAATAAATACTATG CAGACTCCGTGAAGGGC | GAGAAGTATAGCAGCAGCTG GTACGACTACGGTATGGACG TC |
| | | | SEQ ID NO:4917 | | SEQ ID NO:12929 | SEQ ID NO:20941 |
| | | AA | NYVMH | | VIWYDGSNKYYADSVKG | EKYSSSWYDYGMDV |
| | | | SEQ ID NO:4918 | | SEQ ID NO:12930 | SEQ ID NO:20942 |
| iPS:393974 | 21-225_7C4 | NA | AACTATGGCATGCAC | | GTTATTGGTATGAAGA AATAATCAATACTATG CAGACTCCGTGAAGGGC | GAACTGGGGTTCCGGTCTGA CTAC |
| | | | SEQ ID NO:4919 | | SEQ ID NO:12931 | SEQ ID NO:20943 |
| | | AA | NYGMH | | VIWYEENNQYYADSVKG | ELGFRSDY |
| | | | SEQ ID NO:4920 | | SEQ ID NO:12932 | SEQ ID NO:20944 |

FIGURE 49
(Continued)

| | | | | | |
|---|---|---|---|---|---|
| iPS:393976 | 21-225_7E9 | NA | GACTATGGCATGCAC | GTTATATGGTATGATGA AATAATAAATACTATG TAGACTCCGTGAAGGGC | GAATTGGGGTTCCGGTCTGA CTAC |
| | | | SEQ ID NO:4921 | SEQ ID NO:12933 | SEQ ID NO:20945 |
| | | AA | DYGMH | VIWYDENNKYYVDSVKG | ELGFRSDY |
| | | | SEQ ID NO:4922 | SEQ ID NO:12934 | SEQ ID NO:20946 |
| iPS:393978 | 21-225_4C12 | NA | AGCTATGTCATGCAC | GTTATATGGTATGATGG AAGTAATAAATACTATG CAGACTCCGTGAAGGGC | GAGAAGTATAGCAGCAGCTG GTACGACTACGGTATGGACG TC |
| | | | SEQ ID NO:4923 | SEQ ID NO:12935 | SEQ ID NO:20947 |
| | | AA | SYVMH | VIWYDGSNKYYADSVKG | EKYSSSWYDYGMDV |
| | | | SEQ ID NO:4924 | SEQ ID NO:12936 | SEQ ID NO:20948 |
| iPS:393980 | 21-225_6D3 | NA | AGCTATGCCATGAAC | GTTATTAGTGGTCGTGGT GGTAACACATTCTACGC AGACTCCGTGAAGGGC | CGTTTGGCAGTGGCTGGCTC GGAGGCTTTGATATC |
| | | | SEQ ID NO:4925 | SEQ ID NO:12937 | SEQ ID NO:20949 |
| | | AA | SYAMN | VISGRGGNTFYADSVKG | RLAVAGSEAFDI |
| | | | SEQ ID NO:4926 | SEQ ID NO:12938 | SEQ ID NO:20950 |
| iPS:393982 | 21-225_6C12 | NA | AGCTATATAGCATGAAC | TCCATTAGTAGTAGTAGT AGTTACATATACTACGC AGACTCAGTGAAGGGC | GATCGTGGGAGCCTC |
| | | | SEQ ID NO:4927 | SEQ ID NO:12939 | SEQ ID NO:20951 |
| | | AA | SYSMN | SISSSSYIYYADSVKG | DRGSL |
| | | | SEQ ID NO:4928 | SEQ ID NO:12940 | SEQ ID NO:20952 |

FIGURE 49
(Continued)

| | | | | | |
|---|---|---|---|---|---|
| iPS:393984 | 21-225_4F12 | NA | AGCTATGGCATGCAC | GTTATATGGTATGATGTTACTAATAAAAGTATGCAGACTCCGTGAAGGGC | GAAAAGGGGGGGTCTATTTGACTAC |
| | | | SEQ ID NO:4929 | SEQ ID NO:12941 | SEQ ID NO:20953 |
| | | AA | SYGMH | VIWYDVTNKKYADSVKG | EKGGLFDY |
| | | | SEQ ID NO:4930 | SEQ ID NO:12942 | SEQ ID NO:20954 |
| iPS:393986 | 21-225_7G4 | NA | AACTATGTCATGCAC | GTTATATGGTATGATGGAAGTAATAAATACTATGCAGACTCCGTGAAGGGC | GAGAAGTATAGCAGCAACTGGTACGACTACGGTATGGACGTC |
| | | | SEQ ID NO:4931 | SEQ ID NO:12943 | SEQ ID NO:20955 |
| | | AA | NYVMH | VIWYDGSNKYYADSVKG | EKYSSNWYDYGMDV |
| | | | SEQ ID NO:4932 | SEQ ID NO:12944 | SEQ ID NO:20956 |
| iPS:393988 | 21-225_7F10 | NA | AGCTATAGCATGAAC | TCCATTAGTAGTAGTAGTAGTTACATATACTACGCAGACTCAGTGAAGGGC | GCTAACCTCTTTGACTAC |
| | | | SEQ ID NO:4933 | SEQ ID NO:12945 | SEQ ID NO:20957 |
| | | AA | SYSMN | SISSSSSYIYYADSVKG | ANLFDY |
| | | | SEQ ID NO:4934 | SEQ ID NO:12946 | SEQ ID NO:20958 |
| iPS:393990 | 21-225_11G7 | NA | AGGAGTACTTACTACTGGGGC | AGTATCTATTATAGTGGGAGCACCTCCTACAGCCCGTCCCTCAAGAGT | CTGAACAGCAGCTGGTCTTTGACTAC |
| | | | SEQ ID NO:4935 | SEQ ID NO:12947 | SEQ ID NO:20959 |
| | | AA | RSTYYWG | SIYYSGSTSYSPSLKS | LNSSWSFDY |
| | | | SEQ ID NO:4936 | SEQ ID NO:12948 | SEQ ID NO:20960 |

FIGURE 49
(Continued)

| | | | | | |
|---|---|---|---|---|---|
| iPS:393992 | 21-225_14H8 | NA | AGCAATAGCATGAAC | TACATTAGTAGTAGTAGT AGTACCATATACTACGC AGACTCTGTGAAGGGC | GGAGGTGGGAGCCCTTTGA CTAC |
| | | | SEQ ID NO:4937 | SEQ ID NO:12949 | SEQ ID NO:20961 |
| | | AA | SNSMN | YISSSSSTTIYADSVKG | GGGSPFDY |
| | | | SEQ ID NO:4938 | SEQ ID NO:12950 | SEQ ID NO:20962 |
| iPS:393994 | 21-225_8C9 | NA | AGCTATGGCATGCAC | GTTATATGGTATGATGA AATAATAAATACTATG TAGACTCCGTGAAGGGC | GAATTGGGGTTCCGGTCTGA CTAC |
| | | | SEQ ID NO:4939 | SEQ ID NO:12951 | SEQ ID NO:20963 |
| | | AA | SYGMH | VIWYDENNKYYVDSVKG | ELGFRSDY |
| | | | SEQ ID NO:4940 | SEQ ID NO:12952 | SEQ ID NO:20964 |
| iPS:393996 | 21-225_15C11 | NA | GACTATGTCATGCAC | GTTATATGGTATGATGG AAGTAATAAATACTATG CAGACTCCGTGAAGGGC | GAGAAGTATAGCAGCAGCTG GTACGACTACGGGTTGGACG TC |
| | | | SEQ ID NO:4941 | SEQ ID NO:12953 | SEQ ID NO:20965 |
| | | AA | DYVMH | VIWYDGSNKYYADSVKG | EKYSSSWYDYGLDV |
| | | | SEQ ID NO:4942 | SEQ ID NO:12954 | SEQ ID NO:20966 |
| iPS:393998 | 21-225_12B12 | NA | GACTATGGCATGCAC | GTTATATGGTATGATGTA ACTAATAAATACTATGC AGACTCCGTGAAGGGC | GAGCTTGGCTGGTACGAGGA CTAC |
| | | | SEQ ID NO:4943 | SEQ ID NO:12955 | SEQ ID NO:20967 |
| | | AA | DYGMH | VIWYDVTNKYYADSVKG | ELGWYEDY |
| | | | SEQ ID NO:4944 | SEQ ID NO:12956 | SEQ ID NO:20968 |

FIGURE 49
(Continued)

| | | | | | |
|---|---|---|---|---|---|
| iPS:394000 | 21-225_11A2 | NA | AGCTATGGCATGCAC SEQ ID NO:4945 | GTTATATCATATGGTGGA AGTAATAAAGACTCTGC AGACTCCGTGAAGGGC SEQ ID NO:12957 | CGGGGATACAGCTATGGCGG GTACGGTATGGACGTC SEQ ID NO:20969 |
| | | AA | SYGMH SEQ ID NO:4946 | VISYGGSNKDSADSVKG SEQ ID NO:12958 | RGYSYGGYGMDV SEQ ID NO:20970 |
| iPS:394002 | 21-225_15G7 | NA | AGGAGTAGTTCCTACTGGGG C SEQ ID NO:4947 | AGTATCTATTATAGTGGG TACACCTATTACACCCCG TCCCTCAAGAGT SEQ ID NO:12959 | CTGAGCAGCAGTTGGTCTTT TGACTTC SEQ ID NO:20971 |
| | | AA | RSSSYWG SEQ ID NO:4948 | SIYYSGYTYTPSLKS SEQ ID NO:12960 | LSSSWSFDF SEQ ID NO:20972 |
| iPS:394004 | 21-225_13A1 | NA | AGCTATGGCATGCAC SEQ ID NO:4949 | GTTATATCATATGGTGG AACTAATAATCAATACTATG CAGACTCCGTGAAGGGC SEQ ID NO:12961 | CGGGGATACAGCTATGGCGG GTACGGTATGGACGTC SEQ ID NO:20973 |
| | | AA | SYGMH SEQ ID NO:4950 | VISY AGTNQYYADSVKG SEQ ID NO:12962 | RGYSYGGYGMDV SEQ ID NO:20974 |
| iPS:394006 | 21-225_15C2 | NA | AGCTATGGCATGCAC SEQ ID NO:4951 | ATAATATCATATGGTGG ACGTAATAATCACTATG CAGACTCCGTGAAGGGC SEQ ID NO:12963 | CGGGGATACAGCTATGGCGG GTACGGTATGGACGTC SEQ ID NO:20975 |
| | | AA | SYGMH SEQ ID NO:4952 | IISYGGRNNHYADSVKG SEQ ID NO:12964 | RGYSYGGYGMDV SEQ ID NO:20976 |
| iPS:394008 | 21-225_15H8 | NA | AGCTATGTCATGAAC SEQ ID NO:4953 | TCCATTAGTGGTAGTAGT ACTTACATATACTGCGCA GACTCAATCAAGGGC SEQ ID NO:12965 | GATCGAGGCTCCATC SEQ ID NO:20977 |

FIGURE 49
(Continued)

| | | | | | | |
|---|---|---|---|---|---|---|
| iPS:394010 | 21-225_12G5 | AA | SYVMN | | SISGSSTYIYCADSIKG | DRGSI |
| | | | SEQ ID NO:4954 | | SEQ ID NO:12966 | SEQ ID NO:20978 |
| | | NA | AACTATGGCATCTAC | | GTTATATCATATGATGGA AGTAATAAATACTATG AGACTCCGTGAAGGC | GATCGGGGAGCAGTGGCTGC TTACTACTACTACGGTATAG ACGTC |
| | | | SEQ ID NO:4955 | | SEQ ID NO:12967 | SEQ ID NO:20979 |
| | | AA | NYGIY | | VISYDGSNKYYADSVKG | DRGAVAAYYYYGIDV |
| | | | SEQ ID NO:4956 | | SEQ ID NO:12968 | SEQ ID NO:20980 |
| iPS:394012 | 21-225_15A3 | NA | AGCTATGGCATTCAC | | GTTATATGGCATGATGG AAGTAATAAATACTATG CAGACTCCGTGAAGGC | GATCTGAGTATGGGCGGTAT GGACGTC |
| | | | SEQ ID NO:4957 | | SEQ ID NO:12969 | SEQ ID NO:20981 |
| | | AA | SYGIH | | VIWHDGSNKYYADSVKG | DLSMGGMDV |
| | | | SEQ ID NO:4958 | | SEQ ID NO:12970 | SEQ ID NO:20982 |
| iPS:394014 | 21-225_8G6 | NA | AGCTATGTCATGAAC | | GTTATTAGTTGGTCGTGGT GGTAACACATTCTACGC AGACTCCGTGAAGGC | CGTTTGGCAGTGGCTGGCTC GGAGGCTTTTGATATC |
| | | | SEQ ID NO:4959 | | SEQ ID NO:12971 | SEQ ID NO:20983 |
| | | AA | SYVMN | | VISGRGGNTFYADSVKG | RLAVAGSEAFDI |
| | | | SEQ ID NO:4960 | | SEQ ID NO:12972 | SEQ ID NO:20984 |
| iPS:394016 | 21-225_13D4 | NA | AGCTATGGCATGCAC | | GTTATATGGCATGATGG AAGTAATAAATACTATG CAGACTCCGTGAAGGC | GATCTGAGTATGGGCGGTAT GGACGTC |
| | | | SEQ ID NO:4961 | | SEQ ID NO:12973 | SEQ ID NO:20985 |
| | | AA | SYGMH | | VIWHDGSNKYYADSVKG | DLSMGGMDV |

FIGURE 49
(Continued)

| | | | | SEQ ID NO:4962 AGCTATGTCATGAGC | SEQ ID NO:12974 GGTATTAGTGGTAGTGG TGGTAGCACAAACAACG CAGACTCCGTGAAGGGC | SEQ ID NO:20986 AGCTCCTTGTTGACTAC |
|---|---|---|---|---|---|---|
| iPS:394018 | 21-225_15B1 | NA | | | | |
| | | AA | | SEQ ID NO:4963 SYVMS | SEQ ID NO:12975 GISGSGGSTNNADSVKG | SEQ ID NO:20987 SSLFDY |
| iPS:394020 | 21-225_15H10 | NA | | SEQ ID NO:4964 AACTATGGCATGCAC | SEQ ID NO:12976 GTTATATGGTATGATGA AGTAATAAATACTATG AAGACTCCGTGAAGGGC | SEQ ID NO:20988 GAAGTGGGGTTTCTTTCTGA CTAC |
| | | AA | | SEQ ID NO:4965 NYGMH | SEQ ID NO:12977 VIWYDESNKYYEDSVKG | SEQ ID NO:20989 EVGFLSDY |
| iPS:394022 | 21-225_16H6 | NA | | SEQ ID NO:4966 AGCTATGCCATGAAC | SEQ ID NO:12978 GTTATTAGTCGTAGTGGT GGTTACACATACTACGC GGACTCCGTGAAGGGC | SEQ ID NO:20990 CGTTAGCAGTGGCTGGCTC GGAGGCTTTTGATATC |
| | | AA | | SEQ ID NO:4967 SYAMN | SEQ ID NO:12979 VISRSGGYTYYADSVKG | SEQ ID NO:20991 RLAVAGSEAFDI |
| iPS:394024 | 21-225_16B7 | NA | | SEQ ID NO:4968 AGCTATGGCATGCAC | SEQ ID NO:12980 GTTATATGGTATGATGA AAGTAATAAATACTATG CAGACTCCGTGAAGGGC | SEQ ID NO:20992 GAACTGGGGTTTCTCTCTGA CTAC |
| | | AA | | SEQ ID NO:4969 SYGMH | SEQ ID NO:12981 VIWYDESNKYYADSVKG | SEQ ID NO:20993 ELGFLSDY |
| | | | | SEQ ID NO:4970 | SEQ ID NO:12982 | SEQ ID NO:20994 |

FIGURE 49
(Continued)

| | | | | |
|---|---|---|---|---|
| iPS:394026 | 21-225_16C7 | NA | AGCTATGTCATGACC | ACTATTAGTGGTAGTGGT GGTTGGACATATTATGC AGACTCCGTGAAGGGC | AGCTCCTTGTTTGACTAT |
| | | | SEQ ID NO:4971 | SEQ ID NO:12983 | SEQ ID NO:20995 |
| | | AA | SYVMT | TISGSGWTYYADSVKG | SSLFDY |
| | | | SEQ ID NO:4972 | SEQ ID NO:12984 | SEQ ID NO:20996 |
| iPS:394029 | 21-225_1B12 | NA | AGCTATGGCATGCAC | ATTATATCATATGCTGGA AGTAATAAATCCTATGC AGACTCCGTGAAGGGC | CGGGGATACAGCTATGGCGG GTACGGTATGGACGTC |
| | | | SEQ ID NO:4973 | SEQ ID NO:12985 | SEQ ID NO:20997 |
| | | AA | SYGMH | IISYAGSNKSYADSVKG | RGYSYGGYGMDV |
| | | | SEQ ID NO:4974 | SEQ ID NO:12986 | SEQ ID NO:20998 |
| iPS:394033 | 21-225_5F4 | NA | AGCTATAGCATGAAC | TCCATTAGTGGTAGTAGT AGTTACATATACGC AGACTCCGTGAAGGGC | GTTAACAACTTTGACTAC |
| | | | SEQ ID NO:4975 | SEQ ID NO:12987 | SEQ ID NO:20999 |
| | | AA | SYSMN | SISGSSSYIYYADSVKG | VNNFDY |
| | | | SEQ ID NO:4976 | SEQ ID NO:12988 | SEQ ID NO:21000 |
| iPS:394035 | 21-225_5G9 | NA | AATTATGGCATGCAC | ATTATATCATATGCTGGA AGTAATAAATACTATGC AGACTCCGTGAAGGGC | CGTATAACAGCTCGTCTCTA CTACGGTATGGACGTC |
| | | | SEQ ID NO:4977 | SEQ ID NO:12989 | SEQ ID NO:21001 |
| | | AA | NYGMH | IISYAGSNKYYADSVKG | RITARLYYGMDV |
| | | | SEQ ID NO:4978 | SEQ ID NO:12990 | SEQ ID NO:21002 |
| iPS:394037 | 21-225_4F4 | NA | AGGAGTAGTTACTACTGGG C | AATATTTATTATAGTGGG AGCACCTACGACAACCC GTCCCTCAAGAGT | CATGGAAAAGACTGGGGCCT TGACTAC |
| | | | SEQ ID NO:4979 | SEQ ID NO:12991 | SEQ ID NO:21003 |
| | | AA | RSSYYWG | NIYYSGSTYDNPSLKS | HGKDWGLDY |

FIGURE 49
(Continued)

| | | | | | |
|---|---|---|---|---|---|
| iPS:394041 | 21-225_5E5 | NA | SEQ ID NO:4980<br>AACTATGTCATGCAC | SEQ ID NO:12992<br>GTTATATGGTATGATGG<br>AAGTAATAAATACTATG<br>CAGACTCCGTGAAGGGC | SEQ ID NO:21004<br>GAGGTATATAGCAGTGGCTG<br>GTACGACTACGGTATGGACG<br>TC |
| | | AA | SEQ ID NO:4981<br>NYVMH | SEQ ID NO:12993<br>VIWYDGSNKYYADSVKG | SEQ ID NO:21005<br>EVYSSGWYDYGMDV |
| iPS:394043 | 21-225_3B1 | NA | SEQ ID NO:4982<br>AGCTATGCCATGAAC | SEQ ID NO:12994<br>GTTATTAGTGGTCGTGGT<br>ATTACACATTCTACGCA<br>GACTCCGTGAAGGGC | SEQ ID NO:21006<br>CGTTTAGCAGTGGCTGGCTC<br>GGAGGCTTTGATATC |
| | | AA | SEQ ID NO:4983<br>SYAMN | SEQ ID NO:12995<br>VISGRGINTFYADSVKG | SEQ ID NO:21007<br>RLAVAGSEAFDI |
| iPS:394045 | 21-225_4H4 | NA | SEQ ID NO:4984<br>AGGAGTAGTTACTACTGGGG<br>C | SEQ ID NO:12996<br>AATATTATTATAGTGGG<br>AACACCTACAACAACCC<br>GTCCCTCAAGAGT | SEQ ID NO:21008<br>CATGGAAAAGACTGGGGCCT<br>TGACTAC |
| | | AA | SEQ ID NO:4985<br>RSSYYWG | SEQ ID NO:12997<br>NIYYSGNTYNNPSLKS | SEQ ID NO:21009<br>HGKDWGLDY |
| iPS:394047 | 21-225_5E6 | NA | SEQ ID NO:4986<br>AGCTATGGCATGCAC | SEQ ID NO:12998<br>ATTATATCATATGTTGGA<br>AATAATAAATACTATGC<br>AGACTCCGTGAAGGGC | SEQ ID NO:21010<br>CGGGGATACAGCTATGGCGG<br>GTACGGTATGGACGTC |
| | | | SEQ ID NO:4987<br>SYGMH | SEQ ID NO:12999<br>IISYVGNNKYYADSVKG | SEQ ID NO:21011<br>RGYSYGGYGMDV |
| | | AA | SEQ ID NO:4988 | SEQ ID NO:13000 | SEQ ID NO:21012 |

FIGURE 49
(Continued)

| | | | | | |
|---|---|---|---|---|---|
| iPS:394049 | 21-225_13H5 | NA | AGAAGTAGTTACTACTGGGG C | AGTATCTATTATAGTGGG AGCACCTACTACAACCC GTCCCTCAAGAGT | CTTAGCAGCAGCTGGGACTT CCAGCAC |
| | | | SEQ ID NO:4989 | SEQ ID NO:13001 | SEQ ID NO:21013 |
| | | AA | RSSYYWG | SIYYSGSTYYNPSLKS | LSSSWDFQH |
| | | | SEQ ID NO:4990 | SEQ ID NO:13002 | SEQ ID NO:21014 |
| iPS:394051 | 21-225_9E5 | NA | AACTATGCCATGAAC | GCTATTAGTGGTGGTGGT GGTAACACATTCTACGC AGACTCCGTGAAGGGC | CGTATAGCAGCAGTGGCTGGCTC GGAGGCTTTTGCTATC |
| | | | SEQ ID NO:4991 | SEQ ID NO:13003 | SEQ ID NO:21015 |
| | | AA | NYAMN | AISGGGNTFYADSVKG | RIAVAGSEAFAI |
| | | | SEQ ID NO:4992 | SEQ ID NO:13004 | SEQ ID NO:21016 |
| iPS:394053 | 21-225_11F10 | NA | AGAAGTAGTTACTACTGGGG C | AGTATTATTATAGTGGG AGCGCCAGTACAACCC GTCCCTCAAGAGT | CTGAGCAGCAGCTGGTCTTT TGACTAC |
| | | | SEQ ID NO:4993 | SEQ ID NO:13005 | SEQ ID NO:21017 |
| | | AA | RSSYYWG | SIYYSGSAQYNPSLKS | LSSSWSFDY |
| | | | SEQ ID NO:4994 | SEQ ID NO:13006 | SEQ ID NO:21018 |
| iPS:394055 | 21-225_9C8 | NA | AGCCAGAGCATGAAC | TACATTAGTATTAGTAGT ACCATATACTATGCAGA CTCTGTGAAGGGC | GGAGGTGGGAGCCCTTTTGA CTCC |
| | | | SEQ ID NO:4995 | SEQ ID NO:13007 | SEQ ID NO:21019 |
| | | AA | SQSMN | YISISSTIYYADSVKG | GGGSPFDS |
| | | | SEQ ID NO:4996 | SEQ ID NO:13008 | SEQ ID NO:21020 |
| iPS:394057 | 21-225_15H1 | NA | AGAAGTAGTTACTACTGGGG C | AATATCTATTATAGTGGG TATCCTACTACAATCCG TCCCTCAAGAGT | CATAGCACCAGCTGGTCCCT TGACTAC |
| | | | SEQ ID NO:4997 | SEQ ID NO:13009 | SEQ ID NO:21021 |
| | | AA | RSSYYWG | NIYYSGYPYYNPSLKS | HSTSWSLDY |
| | | | SEQ ID NO:4998 | SEQ ID NO:13010 | SEQ ID NO:21022 |

FIGURE 49
(Continued)

| ID | Clone | Type | Seq 1 | Seq 2 | Seq 3 |
|---|---|---|---|---|---|
| iPS:394059 | 21-225_9E8 | NA | AGCTATGGCATGCAC<br>SEQ ID NO:4999 | GTTATTGGTATGAAGAAATAATCAATACTATGCAGACTCCGTGAAGGGC<br>SEQ ID NO:13011 | GAACTGGGGTTCCGGTCTGACTAC<br>SEQ ID NO:21023 |
|  |  | AA | SYGMH<br>SEQ ID NO:5000 | VIWYEENNQYYADSVKG<br>SEQ ID NO:13012 | ELGFRSDY<br>SEQ ID NO:21024 |
| iPS:394061 | 21-225_12D2 | NA | AGCTATAGCATGAAC<br>SEQ ID NO:5001 | TCCATTAGTAGTAGTAGTAGTTACATATACTACGCAGACTCAGTGAAGGGC<br>SEQ ID NO:13013 | TTAGGGGACTAC<br>SEQ ID NO:21025 |
|  |  | AA | SYSMN<br>SEQ ID NO:5002 | SISSSSYIYYADSVKG<br>SEQ ID NO:13014 | LGDY<br>SEQ ID NO:21026 |
| iPS:394063 | 21-225_16A1 | NA | AGGAGTAGTTACTACTGGGGC<br>SEQ ID NO:5003 | AGTATCTATTATAGTGGGAGCGCTATCACAACCCGTCCCTCAAGAGT<br>SEQ ID NO:13015 | CTGAGCAGCAGCTGGTCCTTTGACTAC<br>SEQ ID NO:21027 |
|  |  | AA | RSSYYWG<br>SEQ ID NO:5004 | SIYYSGSAYHNPSLKS<br>SEQ ID NO:13016 | LSSSWSFDY<br>SEQ ID NO:21028 |
| iPS:394065 | 21-225_11E2 | NA | AATTATGATATCAAC<br>SEQ ID NO:5005 | TGGATGAACACTAACAGTGGTAACACAGGCTATGCACAGAAGTTCCAGGGC<br>SEQ ID NO:13017 | AGTCATGGCTGGTTCCTCTTTGACTAC<br>SEQ ID NO:21029 |
|  |  | AA | NYDIN<br>SEQ ID NO:5006 | WMNTNSGNTGYAQKFQG<br>SEQ ID NO:13018 | SHGWFLFDY<br>SEQ ID NO:21030 |

FIGURE 49
(Continued)

| | | | | | |
|---|---|---|---|---|---|
| iPS:394067 | 21-225_12F2 | NA | GACTATGGCATGCAC | GTTATATGGTTTGATGGAAATAATAAATACTATGTAGATTCCGTGAAGGGC | GAGCTTGCTGGTCCGAGGACTAC |
| | | | SEQ ID NO:5007 | SEQ ID NO:13019 | SEQ ID NO:21031 |
| | | AA | DYGMH | VIWFDGNNKYYVDSVKG | ELAWSEDY |
| | | | SEQ ID NO:5008 | SEQ ID NO:13020 | SEQ ID NO:21032 |
| iPS:394069 | 21-225_16H1 | NA | AGCTATAGCATGAAC | TCCATTAGTGGTAGTAGTACTTACATATACTACGCAGACTCAGTGAAGGGC | GTAGCAGCCTTTGACTAC |
| | | | SEQ ID NO:5009 | SEQ ID NO:13021 | SEQ ID NO:21033 |
| | | AA | SYSMN | SISGSSTYTYYADSVKG | VAAFDY |
| | | | SEQ ID NO:5010 | SEQ ID NO:13022 | SEQ ID NO:21034 |
| iPS:394071 | 21-225_10C7 | NA | AGCTATAGCATGAAC | TCCATTAGTAGTAGTAATAATTACATATACTACGAGACTCAGTGAAGGGC | TTAGGGGTCTAC |
| | | | SEQ ID NO:5011 | SEQ ID NO:13023 | SEQ ID NO:21035 |
| | | AA | SYSMN | SISSSNNYIYYADSVKG | LGVY |
| | | | SEQ ID NO:5012 | SEQ ID NO:13024 | SEQ ID NO:21036 |
| iPS:394073 | 21-225_15C9 | NA | AGAAGTAGTTACTACTGGGGC | AATATCTATTATAGTGGGAGCACCTACAACAACCCGTCCCTCAAGAGT | CAGGGCAGTGGCTGGGAGGTTGACTAC |
| | | | SEQ ID NO:5013 | SEQ ID NO:13025 | SEQ ID NO:21037 |
| | | AA | RSSYYWG | NIYYSGSTYNNPSLKS | QGSGWEVDY |
| | | | SEQ ID NO:5014 | SEQ ID NO:13026 | SEQ ID NO:21038 |
| iPS:394075 | 21-225_8D12 | NA | AGAAGTAGTTACTACTGGGGC | AATATCTATTATAGTGGGTATCCCTACTACAATCCGTCCCTCAAGAGT | CATAGCACCAGCTGGTCCCTTGACTAC |
| | | | SEQ ID NO:5015 | SEQ ID NO:13027 | SEQ ID NO:21039 |

FIGURE 49
(Continued)

| | | | CDR1 | CDR2 | CDR3 |
|---|---|---|---|---|---|
| iPS:394877 | | AA | RSSYYWG<br>SEQ ID NO:5016 | NIYYSGYPYYNPSLKS<br>SEQ ID NO:13028 | HSTSWSLDY<br>SEQ ID NO:21040 |
| | 21-225_8E12 | NA | AGCTATGGCCATGAGC<br>SEQ ID NO:5017 | ATTATTAGTGGTCGTGGTGGTAACACATTCTACGCAGACTCCGTGAAGGGC<br>SEQ ID NO:13029 | CGTATGGCAGTGGCTGGCTCGGAGGCTTTTGATATC<br>SEQ ID NO:21041 |
| iPS:394879 | | AA | SYAMS<br>SEQ ID NO:5018 | IISGRGGNTFYADSVKG<br>SEQ ID NO:13030 | RMAVAGSEAFDI<br>SEQ ID NO:21042 |
| | 21-225_11F5 | NA | AGGAGTAGTTACTACTGGGGC<br>SEQ ID NO:5019 | AATATTATTATAGTGGGAGCACCTACACCAACCCGTCCCTCAAGAGT<br>SEQ ID NO:13031 | CATGGAAAAGACTGGGGCCTTGACAAC<br>SEQ ID NO:21043 |
| iPS:394881 | | AA | RSSYYWG<br>SEQ ID NO:5020 | NIYYSGSTYTNPSLKS<br>SEQ ID NO:13032 | HGKDWGLDN<br>SEQ ID NO:21044 |
| | 21-225_16B3 | NA | AGCTATGGCATGCAC<br>SEQ ID NO:5021 | GTTATATCATATGCTGGAATTAATAAATCCTATGCAGACTCCGTGAAGGGC<br>SEQ ID NO:13033 | CGGGGATACAGCTATGGCGGGTATGGTATGGACGTC<br>SEQ ID NO:21045 |
| iPS:394883 | | AA | SYGMH<br>SEQ ID NO:5022 | VISYAGINKSYADSVKG<br>SEQ ID NO:13034 | RGYSYGGYGMDV<br>SEQ ID NO:21046 |
| | 21-225_16E6 | NA | AGCTATGGCATGCAC<br>SEQ ID NO:5023 | GTTATATGGCATGATGGAAGTAATAAATACTATGTAGACTCCGTGAAGGGC<br>SEQ ID NO:13035 | GATCTGAGTATGGGCGGTATGGACGTC<br>SEQ ID NO:21047 |
| | | AA | SYGMH<br>SEQ ID NO:5024 | VIWHDGSNKYYVDSVKG<br>SEQ ID NO:13036 | DLSMGGMDV<br>SEQ ID NO:21048 |

FIGURE 49
(Continued)

| | | NA | AATTATGATATCAAC | TGGATGCACCCTAACAG TGTAACACAGGCTATG CACAGAAGTTCCAGGGC | AGCAGTGGCTGGTACTTCTT TGACTAC |
|---|---|---|---|---|---|
| iPS:394085 | 21-225_8B11 | | SEQ ID NO:5025 | SEQ ID NO:13037 | SEQ ID NO:21049 |
| | | AA | NYDIN | WMHPNSGNTGYAQKFQG | SSGWYFFDY |
| | | NA | AGCTATGCCATGAGC | GTTATTAGTGGTCGTGGT GTTAACACATTCTACGCA GACTCCGTGAAGGGC | CGTATCGCCAGTGGCTGGCTC GGAGGCTTTGATATC |
| iPS:394087 | 21-225_11A5 | | SEQ ID NO:5026 | SEQ ID NO:13038 | SEQ ID NO:21050 |
| | | AA | SYAMS | VISGRGVNTFYADSVKG | RIAVAGSEAFDI |
| | | NA | GACTATGGCATGCAC | GTTATATGGTATGATGA AAGTAATAAATACTATG CAGACTCCGTGAAGGGC | GAGCTTGCCTGGTACGAGGA CTAC |
| iPS:394089 | 21-225_12E6 | | SEQ ID NO:5027 | SEQ ID NO:13039 | SEQ ID NO:21051 |
| | | AA | DYGMH | VIWYDESNKYYADSVKG | ELAWYEDY |
| | | NA | AGCTATGGCATGCAC | GTTATTGGTATGAGGA AAGTAATAAATACTATG TAGACTCCGTGAGGGGC | GAACTAGGCTTCCAGTCTGA CTTC |
| iPS:394091 | 21-225_13H3 | | SEQ ID NO:5028 | SEQ ID NO:13040 | SEQ ID NO:21052 |
| | | AA | SYGMH | VIWYEESNKYYVDSVRG | ELGFQSDF |
| | | | SEQ ID NO:5029 | SEQ ID NO:13041 | SEQ ID NO:21053 |
| | | | | SEQ ID NO:13042 | SEQ ID NO:21054 |
| | | | SEQ ID NO:5030 | SEQ ID NO:13043 | SEQ ID NO:21055 |
| | | | SEQ ID NO:5031 | SEQ ID NO:13044 | SEQ ID NO:21056 |
| | | | SEQ ID NO:5032 | | |

Note: The table above represents an approximation; the patent figure contains SEQ ID NO labels (5025–5032, 13037–13044, 21049–21056) paired with the nucleotide (NA) and amino acid (AA) sequences shown for antibody clones 21-225_8B11, 21-225_11A5, 21-225_12E6, and 21-225_13H3 (iPS:394085, 394087, 394089, 394091).

FIGURE 49
(Continued)

| | | | | | |
|---|---|---|---|---|---|
| iPS:394093 | 21-225_9D12 | NA | GACTATGGCATGCAC | GTTATATGGTATGATGG AATAATAATTACTATG CAGACTCCGTGAAGGC | GAGCTTGCCTGGTACGAGGA CTTC |
| | | | SEQ ID NO:5033 | SEQ ID NO:13045 | SEQ ID NO:21057 |
| | | AA | DYGMH | VIWYDGNNYYADSVKG | ELAWYEDF |
| | | | SEQ ID NO:5034 | SEQ ID NO:13046 | SEQ ID NO:21058 |
| iPS:394095 | 21-225_16H4 | NA | AACTATGGCATGCAC | GTTATATGGTATGATGTA AGTAATAAATACTATGC AGACTCCGTGAAGGGC | GAAATGGGCTGGACCGATGA CTGC |
| | | | SEQ ID NO:5035 | SEQ ID NO:13047 | SEQ ID NO:21059 |
| | | AA | NYGMH | VIWYDVSNKYYADSVKG | EMGWTDDC |
| | | | SEQ ID NO:5036 | SEQ ID NO:13048 | SEQ ID NO:21060 |
| iPS:394097 | 21-225_16G7 | NA | GACTATGGCATGCAC | GTTATTGGTATGATGAA AATAATGAATACTATGC AGACTCCGTGAAGGGC | GAGCTTGCCTGGTACGAGGA CTAC |
| | | | SEQ ID NO:5037 | SEQ ID NO:13049 | SEQ ID NO:21061 |
| | | AA | DYGMH | VIWYDENNEYYADSVKG | ELAWYEDY |
| | | | SEQ ID NO:5038 | SEQ ID NO:13050 | SEQ ID NO:21062 |
| iPS:398470 | 21-225_14B7 | NA | GGCTACTATATGCAC | TGGATCAACCCTAACAG TGGTGGCACAAACTATG TACAGAAGTTTCAGGGC | TCGTTTTCTATGGTTCGGGG AGTTATTATAAGAATTTGA CTAC |
| | | | SEQ ID NO:5039 | SEQ ID NO:13051 | SEQ ID NO:21063 |
| | | AA | GYYMH | WINPNSGGTNYVQKFQG | SFFYGSGSYYNEFDY |
| | | | SEQ ID NO:5040 | SEQ ID NO:13052 | SEQ ID NO:21064 |

FIGURE 49
(Continued)

| | | | | | |
|---|---|---|---|---|---|
| iPS:398472 | 21-225_16E4 | NA | AGCTATGTCATGAGC | ACTATTAGTGTTGGTGGT GGTACCACATACTACGC AGACTCCGTGAAGGGC | TGGGGACGTGGCAACAGCTA TGAGTACTACTACGGTATGG ACGTC |
| | | | SEQ ID NO:5041 | SEQ ID NO:13053 | SEQ ID NO:21065 |
| | | AA | SYVMS | TISVGGGTTYYADSVKG | WGRGNSYEYYYGMDV |
| | | | SEQ ID NO:5042 | SEQ ID NO:13054 | SEQ ID NO:21066 |
| iPS:398474 | 21-225_17B10 | NA | AGCTATGCCATGAGC | GTTATTAGTGGTAGTGGT GGTAACACATACTTCGC AGACTCCGTGAAGGGC | AGGGGTATACCAGAGAGCTGA TGCTTTTGATATC |
| | | | SEQ ID NO:5043 | SEQ ID NO:13055 | SEQ ID NO:21067 |
| | | AA | SYAMS | VISGSGGNTYFADSVKG | RGIPEADAFDI |
| | | | SEQ ID NO:5044 | SEQ ID NO:13056 | SEQ ID NO:21068 |
| iPS:398476 | 21-225_17C1 | NA | AGCTATGCCATGAGC | GTTATTAGTGGTAGTGGT GGTACCACATTCTACGC AGACTCCGTGAAGGGC | TATTGTAGTAGTACCAGGTG TCCTTATGATGCCTTTGATAT C |
| | | | SEQ ID NO:5045 | SEQ ID NO:13057 | SEQ ID NO:21069 |
| | | AA | SYAMS | VISGSGGTTFYADSVKG | YCSSTRCPYDAFDI |
| | | | SEQ ID NO:5046 | SEQ ID NO:13058 | SEQ ID NO:21070 |
| iPS:398478 | 21-225_17C10 | NA | AGCTATAGCATGAAC | TCCATTAGTGGTAGTAGT AGTTACATGTACTACGC AGACTCAGTGAAGGGC | GATCGTGGGAGCTCC |
| | | | SEQ ID NO:5047 | SEQ ID NO:13059 | SEQ ID NO:21071 |
| | | AA | SYSMN | SISGSSSYMYYADSVKG | DRGSS |
| | | | SEQ ID NO:5048 | SEQ ID NO:13060 | SEQ ID NO:21072 |
| iPS:398480 | 21-225_17G4 | NA | GACTATTATATGCAC | TGGATCAACCCTAACAG TGGTGGCACAAACTATG AACAGAAGTTTCAGGGC | GGATACAGCTATGGGTACAA CTGGTTCGACCCC |
| | | | SEQ ID NO:5049 | SEQ ID NO:13061 | SEQ ID NO:21073 |
| | | AA | DYYMH | WINPNSGGTNYEQKFQG | GYSYGYNWFDP |
| | | | SEQ ID NO:5050 | SEQ ID NO:13062 | SEQ ID NO:21074 |

FIGURE 49
(Continued)

| | | | | |
|---|---|---|---|---|
| iPS:398482 | 21-225_17H6 | NA | AGCTATAGCATGAAC | TCCATTAGTAGTGGTAGTAGT AGTTACATATACTACGC AGACTCAGTGAAGGGC | GTGGCTTCATTTGACTAC |
| | | | SEQ ID NO:5051 | SEQ ID NO:13063 | SEQ ID NO:21075 |
| | | AA | SYSMN | SISGSSSYIYYADSVKG | VASFDY |
| | | | SEQ ID NO:5052 | SEQ ID NO:13064 | SEQ ID NO:21076 |
| iPS:398484 | 21-225_18D4 | NA | GGCTACTATTGCAC | TGGATCAACCCTAACAG TAATGGCACAATCTCTGC ACAGAAGTTTCAGGGC | GATGGTACCAGCTCGCTGA CTAC |
| | | | SEQ ID NO:5053 | SEQ ID NO:13065 | SEQ ID NO:21077 |
| | | AA | GYYLH | WINPNSNGTISAQKFQG | DGTSSLDY |
| | | | SEQ ID NO:5054 | SEQ ID NO:13066 | SEQ ID NO:21078 |
| iPS:398486 | 21-225_19A1 | NA | GGCTACTATATGCAC | TGGATCAATCCTAACAG TGGTGGCACAAACTATG CACAGAAGTTTCAGGGC | GGATACAGCTATGGGTACAA CTGGTTCGACCCC |
| | | | SEQ ID NO:5055 | SEQ ID NO:13067 | SEQ ID NO:21079 |
| | | AA | GYYMH | WINPNSGGTNYAQKFQG | GYSYGYNWFDP |
| | | | SEQ ID NO:5056 | SEQ ID NO:13068 | SEQ ID NO:21080 |
| iPS:398488 | 21-225_19F6 | NA | AACGCCTGGATGAAC | CGTATTAAAAGCAAAAC TGATGGTGGGACAACAG ACTACGCTGCACCCGTG AAAGGC | GATACGGGTCCTATAGCAGC TCGTCTCGCTTACTACTACTA TTACGCTATGGACGTC |
| | | | SEQ ID NO:5057 | SEQ ID NO:13069 | SEQ ID NO:21081 |
| | | AA | NAWMN | RIKSKLTDGGTTDYAAPVK G | DTGPIAARLAYYYYAMDV |
| | | | SEQ ID NO:5058 | SEQ ID NO:13070 | SEQ ID NO:21082 |
| iPS:398490 | 21-225_21D12 | NA | GACTACTATATTCAC | TGGATCAACCCTAACAG TGGTGGGACAAACAATG CACAGAAGTTTCAGGGC | TCGTATTACTATGGTTCGGG GACTTATTATAACGAATTTG ACTAC |
| | | | SEQ ID NO:5059 | SEQ ID NO:13071 | SEQ ID NO:21083 |

FIGURE 49
(Continued)

| | | | | | |
|---|---|---|---|---|---|
| iPS:398494 | 21-225_21H4 | AA | DYYIH<br>SEQ ID NO:5060 | WINPNSGGTNNAQKFQG<br>SEQ ID NO:13072 | SYYYGSGTYYNEFDY<br>SEQ ID NO:21084 |
| | | NA | AGCTATGCCATGAGC<br>SEQ ID NO:5061 | GCTCTTAGTGGTGGTCGTGGT<br>GGTAGCACATACTACGC<br>AGACTCCGTGAAGGGC<br>SEQ ID NO:13073 | TGGGGACGTGGATACAGCTA<br>TGAGTACTACTACGGTATGG<br>ACGTC<br>SEQ ID NO:21085 |
| iPS:398496 | 21-225_22D2 | AA | SYAMS<br>SEQ ID NO:5062 | ALSGRGGSTYYADSVKG<br>SEQ ID NO:13074 | WGRGYSYEYYYGMDV<br>SEQ ID NO:21086 |
| | | NA | AATTATGATATCAAC<br>SEQ ID NO:5063 | TGGATGCACCCTGACAG<br>TGGTAACACAGGCTATG<br>CACAGAAGTTCCAGGGC<br>SEQ ID NO:13075 | AGTAGTGGCTGGTACTACTT<br>TGACTAC<br>SEQ ID NO:21087 |
| | | AA | NYDIN<br>SEQ ID NO:5064 | WMHPDSGNIGYAQKFQG<br>SEQ ID NO:13076 | SSGWYYFDY<br>SEQ ID NO:21088 |
| iPS:398498 | 21-225_22E6 | NA | ACTGGTGGAGTGGGTGTGG<br>C<br>SEQ ID NO:5065 | CTCATTTATTGGAATGAT<br>GATAAGCGCTACAGCCC<br>ATCTCTGAAGAGC<br>SEQ ID NO:13077 | ACTATAGCAGTTCGTGGCTT<br>TGACTAC<br>SEQ ID NO:21089 |
| | | AA | TGGVGVG<br>SEQ ID NO:5066 | LIYWNDDKRYSPSLKS<br>SEQ ID NO:13078 | TIAVRGFDY<br>SEQ ID NO:21090 |
| iPS:398500 | 21-225_23A11 | NA | AGTTATAGCATGAAC<br>SEQ ID NO:5067 | TCCATTAGTGGTAGTAGT<br>ACTTACATATACTACGCA<br>GACTCAGTGAAGGGC<br>SEQ ID NO:13079 | GTGGCTTCATTTGACTAC<br>SEQ ID NO:21091 |
| | | AA | SYSMN<br>SEQ ID NO:5068 | SISGSSTYIYYADSVKG<br>SEQ ID NO:13080 | VASFDY<br>SEQ ID NO:21092 |

FIGURE 49
(Continued)

| | | NA | GGCTACTATCTGCAC | TGGATCAACCCTAACAA TAATGGCACAAACTATG CACAGAAGTTTCAGGGC | GATGGTACCAGCTCGTTTGA CTAC |
|---|---|---|---|---|---|
| iPS:398502 | 21-225_23B11 | | SEQ ID NO:5069 | SEQ ID NO:13081 | SEQ ID NO:21093 |
| | | AA | GYYLH | WINPNNGTNYAQKFQG | DGTSSFDY |
| | | NA | SEQ ID NO:5070 ACTAGTGGAGTGGGTGTGG C | SEQ ID NO:13082 CTCATTTATTGGAATAAT GATAAGGTCTACAGCCC ATCTCTGAAGAGC | SEQ ID NO:21094 AGGGGACAGCAGCTGCCCT CGACTAC |
| iPS:398504 | 21-225_23D7 | | SEQ ID NO:5071 | SEQ ID NO:13083 | SEQ ID NO:21095 |
| | | AA | TSGVGVG | LIYWNNDKVYSPSLKS | RGQQLALDY |
| | | NA | SEQ ID NO:5072 AATTATGATATCAAC | SEQ ID NO:13084 TGGATGTACCTAACAG TGGTAACACGGGCTATG CACAGAAGTTCCAGGGC | SEQ ID NO:21096 AGCGGTGGCTGGTACTACTT TGACTAC |
| iPS:398506 | 21-225_23G12 | | SEQ ID NO:5073 | SEQ ID NO:13085 | SEQ ID NO:21097 |
| | | AA | NYDIN | WMYPNSGNTGYAQKFQG | SGGWYYFDY |
| | | NA | SEQ ID NO:5074 AGCTATGCCATGAGC | SEQ ID NO:13086 GCTATTAGTGGTCGTGGT GGTAGCACATACTACGC AGACTCCGTGAAGGGC | SEQ ID NO:21098 TGGGGACGTGGATACAGCTA TGAGTACTACTACGGTATGG ACGTC |
| iPS:398508 | 21-225_24B1 | | SEQ ID NO:5075 | SEQ ID NO:13087 | SEQ ID NO:21099 |
| | | AA | SYAMS | AISGRGGSTYYADSVKG | WGRGYSYEYYYGMDV |
| iPS:398510 | | NA | SEQ ID NO:5076 AATTATGATATCAAC | SEQ ID NO:13088 TGGATGCACCCTAACAG TGGTAACACAGGCTATG CACAGAAGTTCCAGGGC | SEQ ID NO:21100 AGCAGTGGCTGGTATTGGTT CGACCCC |

FIGURE 49
(Continued)

| | | | | | | |
|---|---|---|---|---|---|---|
| iPS:398512 | 21-225_25A3 | AA | SEQ ID NO:5077 NYDIN | SEQ ID NO:13089 WMHPNSGNTGYAQKFQG | SEQ ID NO:21101 SSGWYWFDP | |
| | | NA | SEQ ID NO:5078 AATTATGATATTCAAC | SEQ ID NO:13090 TGGATGAACCCTAACAG TGGTAACACAGGCTATG CACAGAAGTTCCAGGGC | SEQ ID NO:21102 AGCAATGGCTGGTACTACTT TGACTAC | |
| iPS:398516 | 21-225_25E12 | AA | SEQ ID NO:5079 NYDIN | SEQ ID NO:13091 WMNPNSGNTGYAQKFQG | SEQ ID NO:21103 SNGWYYFDY | |
| | | NA | SEQ ID NO:5080 AATTATGATATTCAAC | SEQ ID NO:13092 TGGATGCACCTAACAG TGGTAACACAGGCTGTG CACAGAAGTTCCAGGGC | SEQ ID NO:21104 AGCAGTGGCTGGTACTGGTT CGACCCC | |
| iPS:398520 | 21-225_26A9 | AA | SEQ ID NO:5081 NYDIN | SEQ ID NO:13093 WMHPNSGNTGCAQKFQG | SEQ ID NO:21105 SSGWYWFDP | |
| | | NA | SEQ ID NO:5082 GGCGATTATATGCAC | SEQ ID NO:13094 TGGATCAGCCCTAAAAA TGGTGGCACAAACTATG CACAGAAGTTTCAGGGC | SEQ ID NO:21106 GATGGAACTGGGTCCTTTGA CTAC | |
| iPS:398522 | 21-225_31C4 | AA | SEQ ID NO:5083 GDYMH | SEQ ID NO:13095 WISPKNGGTNYAQKFQG | SEQ ID NO:21107 DGTGSFDY | |
| | | NA | SEQ ID NO:5084 AACTATGATATTAAC | SEQ ID NO:13096 TGGATGAACCCTAACAG TGGTAACACAGGCTATG CACAGAAGTTCCAGGGC | SEQ ID NO:21108 AGCAGTGGCTGGTACTTTTT TGACTAC | |
| | 21-225_32A1 | | SEQ ID NO:5085 | SEQ ID NO:13097 | SEQ ID NO:21109 | |

FIGURE 49
(Continued)

| | | AA | | | |
|---|---|---|---|---|---|
| | | AA | NYDIN | WMNPNSGNTGYAQKFQG | SSGWYFFDY |
| iPS:398524 | | | SEQ ID NO:5086 | SEQ ID NO:13098 | SEQ ID NO:21110 |
| | 21-225_32A5 | NA | AATTATGACATCAAC | TGGATGAACCCTAACAG TGGTAACACAGGCTTTG CACAGAAGTTCCGGGGC | AGCAGTGGCTGGTACTTTTT TGACTAC |
| | | | SEQ ID NO:5087 | SEQ ID NO:13099 | SEQ ID NO:21111 |
| | | AA | NYDIN | WMHPNSGNTGFAQKFRG | SSGWYFFDY |
| iPS:398526 | | | SEQ ID NO:5088 | SEQ ID NO:13100 | SEQ ID NO:21112 |
| | 21-225_32B3 | NA | AGCTATAGCATGAAC | TCCATTAGTGGTAGTAGT ACTTACATATACGCA GACTCAGTGAAGGGC | GTGGCTGGCTTTGACTAC |
| | | | SEQ ID NO:5089 | SEQ ID NO:13101 | SEQ ID NO:21113 |
| | | AA | SYSMN | SISGSSTYIYYADSVKG | VAGFDY |
| iPS:398528 | | | SEQ ID NO:5090 | SEQ ID NO:13102 | SEQ ID NO:21114 |
| | 21-225_32G1 | NA | AGCTATGCCATGAGC | GCTATTAGTGGTGGTCGTGGT GGTAGCACATTCCACGC AGACTCCGTGAAGGGC | GGGGAGCTACTAGAGGACTA CTACTTCTACGGTATGGACG TC |
| | | | SEQ ID NO:5091 | SEQ ID NO:13103 | SEQ ID NO:21115 |
| | | AA | SYAMS | AISGRGGSTFHADSVKG | GELLEDYYFYGMDV |
| iPS:398530 | | | SEQ ID NO:5092 | SEQ ID NO:13104 | SEQ ID NO:21116 |
| | 21-225_32G4 | NA | AGTTATGATATATCAAC | TGGATGAACCCTAACAG TGGTAACACAGGCTATG CACAGAAGTTCCAGGGC | AAGAAGGCTAACGACTAC |
| | | | SEQ ID NO:5093 | SEQ ID NO:13105 | SEQ ID NO:21117 |
| | | AA | SYDIN | WMNPNSGNTGYAQKFQG | KKANDY |
| | | | SEQ ID NO:5094 | SEQ ID NO:13106 | SEQ ID NO:21118 |

FIGURE 49
(Continued)

| ID | subID | Type | Seq1 | Seq2 | Seq3 |
|---|---|---|---|---|---|
| iPS:398532 | 21-225_33B7 | NA | AGCTATAACATGAAC | TCCATTAGTGGTAGTAGT AGTTACATATACGGC AGACTCAGTGAAGGGC | TTAAATGGTTTTGACTAC |
| | | | SEQ ID NO:5095 | SEQ ID NO:13107 | SEQ ID NO:21119 |
| | | AA | SYNMN | SISGSSSYIYYADSVKG | LNGFDY |
| | | | SEQ ID NO:5096 | SEQ ID NO:13108 | SEQ ID NO:21120 |
| iPS:398534 | 21-225_33B8 | NA | AGCTATGCCATGAGC | GCTATTAGTGGTGGTGGTGGT GGTAGCACATTCCACGC AGACTCCGTGAAGGGC | GGGGAGCTACTAGAGGACTA CTACTTCTACGGTATGGACG TC |
| | | | SEQ ID NO:5097 | SEQ ID NO:13109 | SEQ ID NO:21121 |
| | | AA | SYAMS | AISGRGGSTFHADSVKG | GELLEDYFYGMDV |
| | | | SEQ ID NO:5098 | SEQ ID NO:13110 | SEQ ID NO:21122 |
| iPS:398536 | 21-225_33D12 | NA | AGTTATGATATCAGC | TGGATGAACCCTAACAG TGGTAACACAGGCTATG CACAGAAGTTCCAGGGC | AAGAGGGCTAACGACTAC |
| | | | SEQ ID NO:5099 | SEQ ID NO:13111 | SEQ ID NO:21123 |
| | | AA | SYDIS | WMNPNSGNTGYAQKFQG | KRANDY |
| | | | SEQ ID NO:5100 | SEQ ID NO:13112 | SEQ ID NO:21124 |
| iPS:398538 | 21-225_34H7 | NA | AACTATGATATTAAC | TGGATGAACCCTAACAG TGGTAACACAGGCTATG CACAGAAGTTCCAGGGC | AGCAGTGGCTGGTACTTTTT TGACTAC |
| | | | SEQ ID NO:5101 | SEQ ID NO:13113 | SEQ ID NO:21125 |
| | | AA | NYDIN | WMNPNSGNTGYAQKFQG | SSGWYFDY |
| | | | SEQ ID NO:5102 | SEQ ID NO:13114 | SEQ ID NO:21126 |
| iPS:398540 | 21-225_35A6 | NA | AGCTATGCCATGAGC | ACTATTAGTGGTCGTGGT GGTAGCACATTCCACGC AGACTCCGTGAAGGGC | GGGGAGCTACTAGAGGACTA CTACTTCTACGGTATGGACG TC |
| | | | SEQ ID NO:5103 | SEQ ID NO:13115 | SEQ ID NO:21127 |

FIGURE 49
(Continued)

| | | | | | | |
|---|---|---|---|---|---|---|
| iPS:398544 | 21-225_7C8 | AA | SYAMS | TISGRGGSTFHADSVKG | GELLEDYFYGMDV | |
| | | | SEQ ID NO:5104 | SEQ ID NO:13116 | SEQ ID NO:21128 | |
| | | NA | AACGCCCGGATGAAC | CGTATTAAAAGCAAAACTGATGGTGGGACAACAGACTACGCTGCACCCGTGAAAGGC | GATACGGGTCCTATAGCAGCTCGTCTCGCTTACTACTACTACTACGCTATGGACGTC | |
| | | | SEQ ID NO:5105 | SEQ ID NO:13117 | SEQ ID NO:21129 | |
| iPS:398546 | 21-225_9H10 | AA | NARMN | RIKSKTDGGTTDYAAPVKG | DTGPIAARLAYYYYYAMDV | |
| | | | SEQ ID NO:5106 | SEQ ID NO:13118 | SEQ ID NO:21130 | |
| | | NA | ACTAGTGGAGTGGGTGTGGGC | CTCATTATTGGAGTGATGATAAGCGCTACAGCCCATCTCTGAAGAGC | ACCGGTTCTAGCTGCTGCTATTTTGACTAC | |
| | | | SEQ ID NO:5107 | SEQ ID NO:13119 | SEQ ID NO:21131 | |
| | | AA | TSGVGVG | LIYWSDDKRYSPSLKS | TGSSCCYFDY | |
| | | | SEQ ID NO:5108 | SEQ ID NO:13120 | SEQ ID NO:21132 | |
| iPS:402219 | 21-225_1C12 | NA | AACTATGGCATGCAC | GTTATATGGTATGATGAAAATAATAAATACTATGTAGACTCCGTGAAGGGC | GAATTGGGTTCCGGTCTGACTAC | |
| | | | SEQ ID NO:5109 | SEQ ID NO:13121 | SEQ ID NO:21133 | |
| | | AA | NYGMH | VIWYDENNKYYVDSVKG | ELGFRSDY | |
| | | | SEQ ID NO:5110 | SEQ ID NO:13122 | SEQ ID NO:21134 | |
| iPS:402221 | 21-225_2C12 | NA | AGCTATAGCATGAAC | TCCATTAGTGGTAGTAGTAGTTACATGTACTACGCAGACTCAGTGAAGGGC | GTGAATCTCTTTGACTAC | |
| | | | SEQ ID NO:5111 | SEQ ID NO:13123 | SEQ ID NO:21135 | |
| | | AA | SYSMN | SISGSSSYMYYADSVKG | VNLFDY | |
| | | | SEQ ID NO:5112 | SEQ ID NO:13124 | SEQ ID NO:21136 | |

FIGURE 49
(Continued)

| | | | | | |
|---|---|---|---|---|---|
| iPS:402223 | 21-225_30A11 | NA | GACTATCATATGCAC | TGGATCAACCCTAATAGGGGTGGCACAAACTATGCACAGAAGTTTCAGGAC | GATGGAACTGGGTCCTTTGACTAC |
| | | | SEQ ID NO:5113 | SEQ ID NO:13125 | SEQ ID NO:21137 |
| | | AA | DYHMH | WINPNRGGTNYAQKFQD | DGTGSFDY |
| | | | SEQ ID NO:5114 | SEQ ID NO:13126 | SEQ ID NO:21138 |
| iPS:402225 | 21-225_2B1 | NA | AGCTATAGCATGAAC | TCCATTAGTAGTAGTAGTAGTTACATATACGCAGACTCAGTGAAGGGC | CTGGGGAACTAC |
| | | | SEQ ID NO:5115 | SEQ ID NO:13127 | SEQ ID NO:21139 |
| | | AA | SYSMN | SISSSSYIYYADSVKG | LGNY |
| | | | SEQ ID NO:5116 | SEQ ID NO:13128 | SEQ ID NO:21140 |
| iPS:402229 | 21-225_16H9 | NA | AGCTATAGCATGAAC | TCCATTAGTGGTAGTAGTAGTTACATATACGCAGACTCAGTGAAGGGC | GTCAACGTATGGACGTC |
| | | | SEQ ID NO:5117 | SEQ ID NO:13129 | SEQ ID NO:21141 |
| | | AA | SYSMN | SISGSSSYIYYADSVKG | VNGMDV |
| | | | SEQ ID NO:5118 | SEQ ID NO:13130 | SEQ ID NO:21142 |
| iPS:402231 | 21-225_6D9 | NA | AACGCCTGGATGAAC | CGTATTAAAAGCAAAACTGATGGTGGGACAACAGACTACGCTGCACCCGTGAAAGGC | GATACGGGTCCTATAGCAGCTCGTTCGTTACTTACTACTACTACGCTATGGACGTC |
| | | | SEQ ID NO:5119 | SEQ ID NO:13131 | SEQ ID NO:21143 |
| | | AA | NAWMN | RIKSKTDGGTTDYAAPVKG | DTGPIAARLAYYYYAMDV |
| | | | SEQ ID NO:5120 | SEQ ID NO:13132 | SEQ ID NO:21144 |
| iPS:402233 | 21-225_16D10 | NA | ACCTATAACTTGAAC | TCCATTAGTGGTGGTGCCGGTCACATATATTACTCAGACTCAGTGAAGGGC | ACTAATGGGTTTGACTTC |

FIGURE 49
(Continued)

| | | | | | |
|---|---|---|---|---|---|
| iPS:402235 | 21-225_16D10 | AA | SEQ ID NO:5121<br>TYNLN | SEQ ID NO:13133<br>SISGGAGHIYYSDSVKG | SEQ ID NO:21145<br>TNGPDF |
| | | NA | SEQ ID NO:5122<br>AGCTATAGCATGAAC | SEQ ID NO:13134<br>TCCATTAGTACTAGTACT<br>TTCATATATACGCAGAT<br>TCAGTGAAGGGC | SEQ ID NO:21146<br>AAGGCTGGGCTTGATATC |
| iPS:402237 | 21-225_20F10 | AA | SEQ ID NO:5123<br>SYSMN | SEQ ID NO:13135<br>SISTSTFIYYADSVKG | SEQ ID NO:21147<br>KAGLDI |
| | | NA | SEQ ID NO:5124<br>AGCTATAAACATAAAC | SEQ ID NO:13136<br>TCCATTAGTAGTGGTAATAGT<br>GGTTACATATACTACGC<br>AGACTCAGTGAAGGGC | SEQ ID NO:21148<br>ACTAACCTCTTTGACTAC |
| iPS:402237 | 21-225_23D11 | AA | SEQ ID NO:5125<br>SYNIN | SEQ ID NO:13137<br>SISGNSGYIYYADSVKG | SEQ ID NO:21149<br>TNLFDY |
| | | NA | SEQ ID NO:5126<br>AGAAGTAGTTATTACTGGGG<br>C | SEQ ID NO:13138<br>AGTATCTATTATAGTGGG<br>AGGGCCAACTACAACCC<br>GTCCCTCAAGAGT | SEQ ID NO:21150<br>CTGGACAGGGGCTGGTCCTT<br>TGACTAC |
| iPS:403868 | 21-225_19D11 | AA | SEQ ID NO:5127<br>RSSYYWG | SEQ ID NO:13139<br>SIYYSGSANYNPSLKS | SEQ ID NO:21151<br>LDRGWSFDY |
| | | NA | SEQ ID NO:5128<br>AGCTATGCCATGAGC | SEQ ID NO:13140<br>GTTATTAGTGGCGTGGT<br>GGTAGCACATACTACGC<br>AGACTCCGTGAAGGGC | SEQ ID NO:21152<br>AGGGGGATAGTAGTGGGAGCTAC<br>TGAGGCTTTTGATATC |
| iPS:403870 | 21-225_23G4 | AA | SEQ ID NO:5129<br>SYAMS | SEQ ID NO:13141<br>VISGRGGSTYYADSVKG | SEQ ID NO:21153<br>RGIVGATEAFDI |
| | | NA | SEQ ID NO:5130<br>AGGACTAGTTACTACTGGGG<br>C | SEQ ID NO:13142<br>AATATTTATTATAGTGGG<br>AGCGCCTACACAACCC<br>GTCCCTCAAGAGT | SEQ ID NO:21154<br>CATGGACAAGACTGGGCCT<br>TGACTAC |
| iPS:403872 | 21-225_8F11 | | | | |

FIGURE 49
(Continued)

| | | | | | | | |
|---|---|---|---|---|---|---|---|
| iPS:404090 | 21-225_8F11 | AA | SEQ ID NO:5131 RTSYYWG | | SEQ ID NO:13143 NIYYSGSAYNNPSLKS | | SEQ ID NO:21155 HGQDWGLDY |
| | | NA | SEQ ID NO:5132 AGCTATAGCATGAAC | | SEQ ID NO:13144 TCCATTAGTAGTAGTAGT AGTTACATATACGC AGACTCAGTGAAGGGC | | SEQ ID NO:21156 CTGGGTAACTAC |
| iPS:412232 | 21-225_8D8 | AA | SEQ ID NO:5133 SYSMN | | SEQ ID NO:13145 SISSSSSYIYYADSVKG | | SEQ ID NO:21157 LGNY |
| | | NA | SEQ ID NO:5134 AATTATGATATCAAC | | SEQ ID NO:13146 TGGATGCACCCTAACAG TGGTAACACAGGCTATG CACAGAAGTTCCAGGGC | | SEQ ID NO:21158 AGCAGTGGCTGGTACTACTT TGACTAC |
| iPS:422894 | 21-225_4A2 | AA | SEQ ID NO:5135 NYDIN | | SEQ ID NO:13147 WMHPNSGNTGYAQKFQG | | SEQ ID NO:21159 SSGWYYFDY |
| | | NA | SEQ ID NO:5136 AATTATGATATCAAC | | SEQ ID NO:13148 TGGATGCACCCTAACAG TGGTAACACAGGCTATG CACAGAAGTTCCAGGGC | | SEQ ID NO:21160 AGCAGTGGCTGGTACTACTT TGACTAC |
| | 21-225_4A2.001 | AA | SEQ ID NO:5137 NYDIN | | SEQ ID NO:13149 WMHPNSGNTGYAQKFQG | | SEQ ID NO:21161 SSGWYYFDY |
| | | NA | SEQ ID NO:5138 GGCTACTATATGCAC | | SEQ ID NO:13150 TGGATCAACCCTAACAG TGGTGGCACAAACTATG TACAGAAGTTTCAGGGC | | SEQ ID NO:21162 GTGTATTACTATGGTTCGGG GAGTTATTATAACGAGTTTG ACTAC |
| iPS:423018 | 21-225_31D12_LC2 | AA | SEQ ID NO:5139 GYYMH | | SEQ ID NO:13151 WINPNSGGTNYVQKFQG | | SEQ ID NO:21163 VYYYGSGSYYNEFDY |
| | | | SEQ ID NO:5140 | | SEQ ID NO:13152 | | SEQ ID NO:21164 |

FIGURE 49
(Continued)

| | | | | | |
|---|---|---|---|---|---|
| iPS:423019 | 21-225_31D12_LC1 | NA | GGCTACTATATGCAC SEQ ID NO:5141 | TGGATCAACCCTAACAG TGGTGGCACAAACTATG TACAGAAGTTCAGGGC SEQ ID NO:13153 | GTGTATTACTATGGTTCGGG GAGTTATTATAACGAGTTTG ACTAC SEQ ID NO:21165 |
| | | AA | GYYMH SEQ ID NO:5142 | WINPNSGGTNYVQKFQG SEQ ID NO:13154 | VYYYGSGSYYNEFDY SEQ ID NO:21166 |
| iPS:423314 | 21-225_12F11 | NA | AATTATGATATATCAAC SEQ ID NO:5143 | TGGATGCACCTAACAG TGGTAACACAGGCTATG CAAAGAAGTTCCAGGGC SEQ ID NO:13155 | AGCAGTGGCTGGTACTACTT TGACTAC SEQ ID NO:21167 |
| | | AA | NYDIN SEQ ID NO:5144 | WMHPNSGNTGYAKKFQG SEQ ID NO:13156 | SSGWYYFDY SEQ ID NO:21168 |
| iPS:424419 | 21-225_25A4.001 | NA | AATTATGATATATTAAT SEQ ID NO:5145 | TGGATGTACCCTAACAG TGGTAACACAGGCTATG CACAGAAATTCCAGGGC SEQ ID NO:13157 | AGCAGTGGCTGGTACTACTT TGACTAC SEQ ID NO:21169 |
| | | AA | NYDIN SEQ ID NO:5146 | WMYPNSGNTGYAQKFQG SEQ ID NO:13158 | SSGWYYFDY SEQ ID NO:21170 |
| iPS:424460 | 21-225_7E11.001 | NA | AGCTTTGGCATGCAC SEQ ID NO:5147 | ATTATCTGGCATGATGG AAGTAATAAATACTATG CAGACTCCGTGAAGGGC SEQ ID NO:13159 | GATCTGAGTATGGGCGGTAT GGACGTC SEQ ID NO:21171 |
| | | AA | SFGMH SEQ ID NO:5148 | IIWHDGSNKYYADSVKG SEQ ID NO:13160 | DLSMGGMDV SEQ ID NO:21172 |

FIGURE 49
(Continued)

| | | | | | |
|---|---|---|---|---|---|
| iPS:426108 | 21-225_10G6 | NA | GCCTACCATATGCAC SEQ ID NO:5149 | TGGATCAACCCTAACAA TAATGGCACAAACTATG CACAGAAGTTTCAGGGC SEQ ID NO:13161 | GATGTTACCAGCTCGTTTGA CTAT SEQ ID NO:21173 |
| | | AA | AYHMH SEQ ID NO:5150 | WINPNNNGTNYAQKFQG SEQ ID NO:13162 | DVTSSFDY SEQ ID NO:21174 |
| iPS:426110 | 21-225_12E9 | NA | GACTACTATTTGCAC SEQ ID NO:5151 | TGGGTCCACCTAACAG TGGTGGCACAAACTTTG CACAGAAGTTTCAGGAC SEQ ID NO:13163 | GATGGTACCAGCTCGTTTGA CTAC SEQ ID NO:21175 |
| | | AA | DYYLH SEQ ID NO:5152 | WVHPNSGGTNFAQKFQD SEQ ID NO:13164 | DGTSSFDY SEQ ID NO:21176 |
| iPS:426112 | 21-225_12F12 | NA | AATTATGATATCAAC SEQ ID NO:5153 | TGGATGTACCCTAACAG TGGTAACACGGGCTATG CACAGAAGTTCCAGGGC SEQ ID NO:13165 | AGCAGTGGCTGGTACTACTT TGACTTC SEQ ID NO:21177 |
| | | AA | NYDIN SEQ ID NO:5154 | WMYPNSGNTGYAQKFQG SEQ ID NO:13166 | SSGWYYFDF SEQ ID NO:21178 |
| iPS:426114 | 21-225_28H2 | NA | AACTATGTCATGCAC SEQ ID NO:5155 | GTTATATGGTATGATGG AAGTAATAAGTACTATG CAGACTCCGTGAAGGGC SEQ ID NO:13167 | GAGGAGTATAGCAGTGGCTG GTACGACTACGGTATGGACG TC SEQ ID NO:21179 |
| | | AA | NYVMH SEQ ID NO:5156 | VIWYDGSNKYADSVKG SEQ ID NO:13168 | EEYSSGWYDYGMDV SEQ ID NO:21180 |

FIGURE 49
(Continued)

| | | | | | |
|---|---|---|---|---|---|
| iPS:426116 | 21-225_29E2 | NA | AACTGTGTCATGCAC | GTTATATGGTATGATGGAAGTAATAAATACTATGCAGACTCCGTGAAGGGC | GAGGAGTAGTATAGCAGTGGCTGGTACGACTACGGTATGGACGTC |
| | | | SEQ ID NO:5157 | SEQ ID NO:13169 | SEQ ID NO:21181 |
| | | AA | NCVMH | VIWYDGSNKYYADSVKG | EEYSSGWYDYGMDV |
| | | | SEQ ID NO:5158 | SEQ ID NO:13170 | SEQ ID NO:21182 |
| iPS:426118 | 21-225_7A10 | NA | AGCTATGGCATGCAC | GTTATATGGTATGATGGAAGTAATAAATACTATGCAGACTCCGTGAAGGGC | GATGAGAGCTGGGGATTTTTGACTAC |
| | | | SEQ ID NO:5159 | SEQ ID NO:13171 | SEQ ID NO:21183 |
| | | AA | SYGMH | VIWYDGSNKYYADSVKG | DERLGIFDY |
| | | | SEQ ID NO:5160 | SEQ ID NO:13172 | SEQ ID NO:21184 |
| iPS:426124 | 21-225_32D6 | NA | AGCTATGGCATGCAC | GTTATATGGCATGATGGAAGTAATGCATACTATGCAGACTCCGTGAAGGGC | GAAAATAGCAGCTCGTACTACTTTGACTAC |
| | | | SEQ ID NO:5161 | SEQ ID NO:13173 | SEQ ID NO:21185 |
| | | AA | SYGMH | VIWHDGSNAYYADSVKG | ENSSSYYFDY |
| | | | SEQ ID NO:5162 | SEQ ID NO:13174 | SEQ ID NO:21186 |
| iPS:426126 | 21-225_6G6 | NA | AATTATGATATCAAC | TGGATGCACCCTAACAGTGGTAACACAGGCTATGCAAAGAAGTTCCAGGGC | AGCAGTGGCTGGTACTACTTTGACTAC |
| | | | SEQ ID NO:5163 | SEQ ID NO:13175 | SEQ ID NO:21187 |
| | | AA | NYDIN | WMHPNSGNTGYAKKFQG | SSGWYYFDY |

FIGURE 49
(Continued)

| | | | | | |
|---|---|---|---|---|---|
| iPS:433895 | 21-225_43E1 | NA | SEQ ID NO:5164 AGCTATAGCATGAAC | SEQ ID NO:13176 GCCATTAGTGGTAATAG TACTTACATATACTACGC AGACTCGTTGAAGGGC | SEQ ID NO:21188 GATCGGGGCAGTGAA |
| | | AA | SEQ ID NO:5165 SYSMN | SEQ ID NO:13177 AISGNSTYIYYADSLKG | SEQ ID NO:21189 DRGSE |
| iPS:433897 | 21-225_43C2 | NA | SEQ ID NO:5166 AGCTATGCCATGAGC | SEQ ID NO:13178 GCTATTAGTGGTCGTGGT GTAACACATTCGACGC AGACTCCGTGAAGGGC | SEQ ID NO:21190 GAAAGGAGTGGGAGCTATTT TGACTAC |
| | | AA | SEQ ID NO:5167 SYAMS | SEQ ID NO:13179 AISGRGVNTFDADSVKG | SEQ ID NO:21191 ERSGSYFDY |
| iPS:433899 | 21-225_43C3 | NA | SEQ ID NO:5168 AGCTATGGCATACAC | SEQ ID NO:13180 GTTATATGGTATGATGA AAATAATAAATACTATG CAGACTCCGTGAAGGGC | SEQ ID NO:21192 GAGCTAGGATTTCCAATGA CTAC |
| | | AA | SEQ ID NO:5169 SYGIH | SEQ ID NO:13181 VIWYDENNKYYADSVKG | SEQ ID NO:21193 ELGFSNDY |
| iPS:433901 | 21-225_43A4 | NA | SEQ ID NO:5170 AGCTATACCATGAAC | SEQ ID NO:13182 TCCATTAGTGGAAGTAG TACTTACATATACTACGC AGACTCAGTGAAGGGC | SEQ ID NO:21194 GTGACCTCTTTTGACTAC |
| | | AA | SEQ ID NO:5171 SYTMN | SEQ ID NO:13183 SISGSSTYIYYADSVKG | SEQ ID NO:21195 VTSFDY |
| iPS:433903 | 21_225_43H4 | NA | SEQ ID NO:5172 AGCTATGCCATGAGC | SEQ ID NO:13184 GCTATTAGTGGTCGTGGT ATTAACACATTCGACGC AGACTCCGTGAAGGGC | SEQ ID NO:21196 GAAAGGAGTGGGAGCTATTT TGACTAC |

FIGURE 49
(Continued)

| | | | | | | |
|---|---|---|---|---|---|---|
| iPS:433905 | 21-225_43H4 | AA | SEQ ID NO:5173<br>SYAMS | SEQ ID NO:13185<br>AISGRGINTFDADSVKG | SEQ ID NO:21197<br>ERSGSYFDY | |
| | | NA | SEQ ID NO:5174<br>GACTACTACATGAGC | SEQ ID NO:13186<br>TACATTAGTAGTAGTGGT<br>ATTACCAAATACTACGC<br>AGACTCTATGAAGGGC | SEQ ID NO:21198<br>GATACAATCTAC | |
| iPS:433909 | 21-225_43E5 | | SEQ ID NO:5175<br>DYYMI | SEQ ID NO:13187<br>YISSSGITKYYADSMKG | SEQ ID NO:21199<br>DTIY | |
| | | AA | SEQ ID NO:5176<br>NYDIN | SEQ ID NO:13188<br>WMHPNSGNTGYAQKFQG | SEQ ID NO:21200<br>SSGWTLFDY | |
| | | NA | | SEQ ID NO:13189 | SEQ ID NO:21201 | |
| iPS:433911 | 21-225_43D8 | AA | SEQ ID NO:5177 | SEQ ID NO:13190 | SEQ ID NO:21202 | |
| | | NA | AATTATGATATCAAC | TGGATGCACCTAACAG<br>TGGTAACACAGGCTATG<br>CACAGAAGTTCCAGGGC | AGCAGTGGCTGGACCCTCTT<br>TGACTAC | |
| iPS:433911 | 21-225_43E8 | AA | SEQ ID NO:5178<br>AGCTATGCCATGAGC | SEQ ID NO:13191<br>GCTATTAGTGGTCGTGGT<br>ATTAACACATTCGACGC<br>AGACTCCGTGAAGGGC | SEQ ID NO:21203<br>GAAAGGAGTGGGAGCTATTT<br>TGACTAC | |
| | | | SEQ ID NO:5179<br>SYAMS | SEQ ID NO:13192<br>AISGRGINTFDADSVKG | SEQ ID NO:21204<br>ERSGSYFDY | |
| iPS:433913 | 21-225_43H8 | NA | SEQ ID NO:5180<br>GACTACTACATGAAC | SEQ ID NO:13193<br>TACATTAGTAGTAGTGGT<br>AGAACCATATTCTACGC<br>AGACTCTTTGAAGGGC | SEQ ID NO:21205<br>GATACAATCTAC | |
| | | AA | SEQ ID NO:5181<br>DYYMN | SEQ ID NO:13194<br>YISSSGRTHFYADSLKG | SEQ ID NO:21206<br>DTIY | |
| | | | SEQ ID NO:5182 | | | |

FIGURE 49
(Continued)

| | | | | |
|---|---|---|---|---|
| iPS:433915 | 21-225_43H9 | NA | AGCTATGCCATGAGT | GCTATTAGTGGTAGTGGT AGTAACACATTCTACGC AGACTCCGTGAAGGGC | CGAACGCCCTCTGATGTTTT GATATC |
| | | | SEQ ID NO:5183 | SEQ ID NO:13195 | SEQ ID NO:21207 |
| | | AA | SYAMS | AISGSGSNTFYADSVKG | RTPSDVFDI |
| | | | SEQ ID NO:5184 | SEQ ID NO:13196 | SEQ ID NO:21208 |
| iPS:433917 | 21-225_43E11 | NA | GACTATGGCATGCAC | GTTATATGGTATGATGG AAGTAATAAATACTATG CAGACTCCGTGAAGGGC | CGGTATGTCAGAAGCTGGGT GGGAGGTATGGACGTC |
| | | | SEQ ID NO:5185 | SEQ ID NO:13197 | SEQ ID NO:21209 |
| | | AA | DYGMH | VIWYDGSNKYYADSVKG | RYVRSWVGGMDV |
| | | | SEQ ID NO:5186 | SEQ ID NO:13198 | SEQ ID NO:21210 |
| iPS:433919 | 21-225_44B3 | NA | GACTATGGCATGCAC | GTTATATGGTATGATGG AAGTAATAAATACTATG CAGACTCCGTGAAGGGC | GAGAGGTATAGCAGTGGCTG GTACGACTACGGTATGGACG TC |
| | | | SEQ ID NO:5187 | SEQ ID NO:13199 | SEQ ID NO:21211 |
| | | AA | DYGMH | VIWYDGSNKYYADSVKG | ERYSSGWYDYGMDV |
| | | | SEQ ID NO:5188 | SEQ ID NO:13200 | SEQ ID NO:21212 |
| iPS:433921 | 21-225_44C3 | NA | AGCTATGGCATGCAC | GTTATATGGTTTGAAGG AAGTAATAAATACTATG CAGATTCCGTGAAGGGC | GAACTAGGATTTTCCACCGA CTAC |
| | | | SEQ ID NO:5189 | SEQ ID NO:13201 | SEQ ID NO:21213 |
| | | AA | SYGMH | VIWFEGSNKYYADSVKG | ELGFSTDY |
| | | | SEQ ID NO:5190 | SEQ ID NO:13202 | SEQ ID NO:21214 |

FIGURE 49
(Continued)

| iPS:433923 | 21-225_44D3 | NA | AGCTATGTCATGCAC | GTTATATGGTATGATGG AAGTAATAAATACTATG CTGACTCCGTGAAGGGC | GAAAGGTATAGCAGTGGCTT GTACGACTACGGTATGGACG TC |
| --- | --- | --- | --- | --- | --- |
| | | | SEQ ID NO:5191 | SEQ ID NO:13203 | SEQ ID NO:21215 |
| | | AA | SYVMH | VIWYDGSNKYYADSVKG | ERYSSGLYDYGMDV |
| | | | SEQ ID NO:5192 | SEQ ID NO:13204 | SEQ ID NO:21216 |
| iPS:433925 | 21-225_44F3 | NA | AGCTATGCCATGAGC | ATTCTCAGTGGTGGTGGT AAGACCACATACTACGC AGACTCCGTGAAGGGC | CGAAGCCCTCTGATGCTTT TGATATC |
| | | | SEQ ID NO:5193 | SEQ ID NO:13205 | SEQ ID NO:21217 |
| | | AA | SYAMS | ILSGGGKTTYYADSVKG | RTPSDAFDI |
| | | | SEQ ID NO:5194 | SEQ ID NO:13206 | SEQ ID NO:21218 |
| iPS:433929 | 21-225_44D5 | NA | AGCTATGTCATGCAC | GTTATATGGTATGATGG AAGTAATAAATACTATG CAGACTCCGTGAAGGGC | GTCCCGTATAGCAGCAGCTG GTACGACTACGGTATGGACG TC |
| | | | SEQ ID NO:5195 | SEQ ID NO:13207 | SEQ ID NO:21219 |
| | | AA | SYVMH | VIWYDGSNKYYADSVKG | VPYSSSWYDYGMDV |
| | | | SEQ ID NO:5196 | SEQ ID NO:13208 | SEQ ID NO:21220 |
| iPS:433931 | 21-225_44F6 | NA | AGTTACTACTGGAGC | TATATCTATTACAGTGGA AACACCAACTACAACCC CTCCCTCAAGAGT | GGGGTGGCTATAAAGAACTA C |
| | | | SEQ ID NO:5197 | SEQ ID NO:13209 | SEQ ID NO:21221 |
| | | AA | SYYWS | YIYYSGNTNYNPSLKS | GVAIKNY |
| | | | SEQ ID NO:5198 | SEQ ID NO:13210 | SEQ ID NO:21222 |

FIGURE 49
(Continued)

| | | | | | | |
|---|---|---|---|---|---|---|
| iPS:433933 | 21-225_44C8 | NA | AACTATGGCATGCAC | | GTTATATGGTATGAAGG AAGTAATAAATACTATG CAGACTCCGTGAAGGGC | | GAACTGGGGTTCCTCTCTGA CTAC |
| | | | SEQ ID NO:5199 | | SEQ ID NO:13211 | | SEQ ID NO:21223 |
| | | AA | NYGMH | | VIWYEGSNKYYADSVKG | | ELGFLSDY |
| | | | SEQ ID NO:5200 | | SEQ ID NO:13212 | | SEQ ID NO:21224 |
| iPS:433935 | 21-225_44F9 | NA | AGCTATGTCATGCAC | | GTTATATGGTATGGATGG AAGTAATAAATACTATG CAGACTCCGTGAAGGGC | | GAACCATATAGCAGCAGCTG GTACGACTACGGTATGGACG TC |
| | | | SEQ ID NO:5201 | | SEQ ID NO:13213 | | SEQ ID NO:21225 |
| | | AA | SYVMH | | VIWYDGSNKYYADSVKG | | EPYSSSWYDYGMDV |
| | | | SEQ ID NO:5202 | | SEQ ID NO:13214 | | SEQ ID NO:21226 |
| iPS:433937 | 21-225_44B10 | NA | AGCTATGGCATGCAC | | GTTATATGGTATGATGG AAGTAATAAATACTATG CAGACTCCGTGAAGGGC | | CGGTATAGCAGCAGCTGGT GGGGGTATGGACGTC |
| | | | SEQ ID NO:5203 | | SEQ ID NO:13215 | | SEQ ID NO:21227 |
| | | AA | SYGMH | | VIWYDGSNKYYADSVKG | | RYSSSWVGGMDV |
| | | | SEQ ID NO:5204 | | SEQ ID NO:13216 | | SEQ ID NO:21228 |
| iPS:433939 | 21-225_44C10 | NA | GACTGTGTCATGCAC | | GTTATATGGTATGGATGG AAGTAATAAATACTATG CTGACTCCGTGAAGGGC | | GAAAGGTATAGCAGCAGTGGCTT GTACGACTACGGTATGGACG TC |
| | | | SEQ ID NO:5205 | | SEQ ID NO:13217 | | SEQ ID NO:21229 |

FIGURE 49
(Continued)

| | | | DCVMH | VIWYDGSNKYYADSVKG | ERYSSGLYDYGMDV |
|---|---|---|---|---|---|
| iPS:433941 | | AA | SEQ ID NO:5206 | SEQ ID NO:13218 | SEQ ID NO:21230 |
| | 21-225_44D10 | NA | AGCTATGCCATGAGC | GCTATTAGTGGTGCTGTGGT GTAACACATTCGACGC AGACTCCGTGAAGGGC | GAAAGGAGTGGGAGCTATTT TGACTAC |
| | | AA | SEQ ID NO:5207 SYAMS | SEQ ID NO:13219 AISGRGVNTFDADSVKG | SEQ ID NO:21231 ERSGSYFDY |
| iPS:433943 | | NA | SEQ ID NO:5208 AGCTATGCCATGAAC | SEQ ID NO:13220 GGTGTTGTTGGTAGTGGT GGTAGAACATACTACGC AGACTCCGTGAAGGGC | SEQ ID NO:21232 GATCGGGGGCAGTGGCTCCT AGGCGGTATGGACGTC |
| | 21-225_44E10 | AA | SEQ ID NO:5209 SYSVN | SEQ ID NO:13221 GVVGSGGRTYYADSVKG | SEQ ID NO:21233 DRGQWLLGGMDV |
| iPS:433945 | | NA | SEQ ID NO:5210 AGCTATAGCGTGAAC | SEQ ID NO:13222 TACATTAGTAGTAGTAGTAGT AGTACCATATACTACGC AGACTCTGTGAAGGGC | SEQ ID NO:21234 AGTGGATACAGCTATGCTTA CTACTACTACGGTATGG ACGTC |
| | 21-225_44C12 | AA | SEQ ID NO:5211 SYSYN | SEQ ID NO:13223 YISSSSSTIYYADSVKG | SEQ ID NO:21235 SGYSYAYYYYGMDV |
| iPS:433947 | | NA | SEQ ID NO:5212 AGCGATGACACGCAC | SEQ ID NO:13224 GTTATATGGTTTGATGAA TATAATAATACTATGC AGACTCCGTGAAGGGC | SEQ ID NO:21236 GATCTAATAGCAGCAGCTGG GACGGGAGACTAC |
| | 21-225_44E12 | AA | SEQ ID NO:5213 SDDTH | SEQ ID NO:13225 VIWFDEYNKYYADSVKG | SEQ ID NO:21237 DLIAAAGTGDY |
| | | | SEQ ID NO:5214 | SEQ ID NO:13226 | SEQ ID NO:21238 |

FIGURE 49
(Continued)

| | | | | | |
|---|---|---|---|---|---|
| iPS:433949 | 21-225_45H2 | NA | GACTACTACATGAAC<br>SEQ ID NO:5215 | TACATTAGTAGTAGTGGT<br>ATTACCAAATACTACGC<br>AGACTCTGTGAAGGGC<br>SEQ ID NO:13227 | GATACAATCTAC<br>SEQ ID NO:21239 |
| | | AA | DYYMN<br>SEQ ID NO:5216 | YISSSGITKYYADSVKG<br>SEQ ID NO:13228 | DTIY<br>SEQ ID NO:21240 |
| iPS:433951 | 21-225_45B4 | NA | GACTGTGTCATGCAC<br>SEQ ID NO:5217 | GTTATATGGTATGATGG<br>AAGTAATAAATACTATG<br>CTGACTCCGTGAAGGGC<br>SEQ ID NO:13229 | GAAAGGTATAGCAGTGGCTT<br>GTACGACTACGGTATGGACG<br>TC<br>SEQ ID NO:21241 |
| | | AA | DCVMH<br>SEQ ID NO:5218 | VIWYDGSNKYYADSVKG<br>SEQ ID NO:13230 | ERYSSGLYDYGMDV<br>SEQ ID NO:21242 |
| iPS:433953 | 21-225_45H4 | NA | AGCTATGCCATGAGT<br>SEQ ID NO:5219 | GCTATTAGTGGTAGTGGT<br>AGTAACACATTCTACGC<br>AGACTCCGTGAAGGGC<br>SEQ ID NO:13231 | CGAACGCCCTCTGATGTTTTT<br>GATATC<br>SEQ ID NO:21243 |
| | | AA | SYAMS<br>SEQ ID NO:5220 | AISGSGSNTFYADSVKG<br>SEQ ID NO:13232 | RTPSDVFDI<br>SEQ ID NO:21244 |
| iPS:433955 | 21-225_45B8 | NA | GACTGTGTCATGCAC<br>SEQ ID NO:5221 | GTTATATGGTATGATGG<br>AAGTAATAAATACTATG<br>CTGACTCCGTGAAGGGC<br>SEQ ID NO:13233 | GAAAGGTATAGCAGTGGCTT<br>GTACGACTACGGTATGGACG<br>TC<br>SEQ ID NO:21245 |
| | | AA | DCVMH<br>SEQ ID NO:5222 | VIWYDGSNKYYADSVKG<br>SEQ ID NO:13234 | ERYSSGLYDYGMDV<br>SEQ ID NO:21246 |

FIGURE 49
(Continued)

| | | | | |
|---|---|---|---|---|
| iPS:433957 | 21-225_45F8 | NA | AGCTATGCCATGAGC | GCTATTAGTGGTGGTGTGTGGT GTTAACACATTCGACGC AGACTCCGTGAAGGGC | GAAAGGAGTGGGAGCTATTT TGACTAC |
| | | | SEQ ID NO:5223 | SEQ ID NO:13235 | SEQ ID NO:21247 |
| | | AA | SYAMS | AISGRGVNTFDADSVKG | ERSGSYFDY |
| | | | SEQ ID NO:5224 | SEQ ID NO:13236 | SEQ ID NO:21248 |
| iPS:433959 | 21-225_45C9 | NA | AGCTATGCCATGAGC | GTTATTAGTGGTCGTGTGGT GGTACCACATACTACGC AGACTCCGTGAAGGGC | CGAACGCCCTCTGATGCTTT TGATATC |
| | | | SEQ ID NO:5225 | SEQ ID NO:13237 | SEQ ID NO:21249 |
| | | AA | SYAMS | VISGRGGTTYYADSVKG | RTPSDAFDI |
| | | | SEQ ID NO:5226 | SEQ ID NO:13238 | SEQ ID NO:21250 |
| iPS:433961 | 21-225_45D9 | NA | AGCTATACCATGAAC | TCCATTAGTGGAAGTAG TACTTACATATACTACGC AGACTCCGTGAAGGGC | GTGACCTCTTTTGACTAC |
| | | | SEQ ID NO:5227 | SEQ ID NO:13239 | SEQ ID NO:21251 |
| | | AA | SYTMN | SISGSSTYIYYADSVKG | VTSFDY |
| | | | SEQ ID NO:5228 | SEQ ID NO:13240 | SEQ ID NO:21252 |
| iPS:433963 | 21-225_46B1 | NA | AGCGATGACTCGCAC | GTTATATGGTTTGATGAA TATACTAAATACTATGCA GACGGGAGACTAC | GATCTAATAGCAGCAACTGG |
| | | | SEQ ID NO:5229 | SEQ ID NO:13241 | SEQ ID NO:21253 |
| | | AA | SDDSH | VIWFDEYIKYYADSVKG | DLIAATGTGDY |
| | | | SEQ ID NO:5230 | SEQ ID NO:13242 | SEQ ID NO:21254 |
| iPS:433965 | 21-225_46F2 | NA | AGCTATGGCATGCAC | ATTATATGGTATGATGG AAGTAATAAATACTATG TAGACTCCGTGAAGGGC | GATCGATACGATTTTTGGAG TGGTTACTTGACTAC |
| | | | SEQ ID NO:5231 | SEQ ID NO:13243 | SEQ ID NO:21255 |
| | | AA | SYGMH | IIWYDGSNKYYVDSVKG | DRYDFWSGYFDY |

FIGURE 49
(Continued)

| | | | | | | |
|---|---|---|---|---|---|---|
| iPS:433967 | 21-225_46C3 | NA | SEQ ID NO:5232 AGCTATGTCATGCAC | SEQ ID NO:13244 GTTATATGGTATGATGG AAGTAATAAATACTATG CTGACTCCGTGAAGGGC | SEQ ID NO:21256 GAAAGGTATAGCAGTGGCTT GTACGACTACGGTATGGACG TC |
| | | AA | SEQ ID NO:5233 SYVMH | SEQ ID NO:13245 VIWYDGSNKYYADSVKG | SEQ ID NO:21257 ERYSSGLYDYGMDV |
| iPS:433969 | 21-225_46F3 | NA | SEQ ID NO:5234 GATTATGGCATGCAC | SEQ ID NO:13246 GTTATATGGTTTGAAGG AAGTAATAAATACTATG CAGATTCCGTGAAGGGC | SEQ ID NO:21258 GAACTAGGATTTTCCAATGA CTAC |
| | | AA | SEQ ID NO:5235 DYGMH | SEQ ID NO:13247 VIWFEGSNKYYADSVKG | SEQ ID NO:21259 ELGFSNDY |
| iPS:433971 | 21-225_46D4 | NA | SEQ ID NO:5236 AGCTATGTCATGCAC | SEQ ID NO:13248 GTTATATGGTATGATGG AAGTAATAAATACTATG CAGACTCCGTGAAGGGC | SEQ ID NO:21260 GTCCCGTATAGCAGCAGTTG GTACGACTACGGTATGGACG TC |
| | | AA | SEQ ID NO:5237 SYVMH | SEQ ID NO:13249 VIWYDGSNKYYADSVKG | SEQ ID NO:21261 VPYSSSWYDYGMDV |
| iPS:433973 | 21-225_46A6 | NA | SEQ ID NO:5238 AGCTATGCCATGAGC | SEQ ID NO:13250 GCTATTAGTGGTCGTGGT ATTAACACATTCGACGC AGACTCCGTGAAGGGC | SEQ ID NO:21262 GAAAGGAGTGGGAGCTATTT TGACTAC |
| | | AA | SEQ ID NO:5239 SYAMS | SEQ ID NO:13251 AISGRGINTFDADSVKG | SEQ ID NO:21263 ERSGSYFDY |
| | | | SEQ ID NO:5240 | SEQ ID NO:13252 | SEQ ID NO:21264 |

FIGURE 49
(Continued)

| | | | | |
|---|---|---|---|---|
| iPS:433975 | 21-225_46C6 | NA | AGCTATGGCATACAC | GTTATATGGTATGATGA AATAATAAATACTATG CAGACTCCGTGAAGGGC | GAGCTAGGAGATTTCCAATGA CTAC |
| | | | SEQ ID NO:5241 | SEQ ID NO:13253 | SEQ ID NO:21265 |
| | | AA | SYGIH | VIWYDENNKYYADSVKG | ELGFSNDY |
| | | | SEQ ID NO:5242 | SEQ ID NO:13254 | SEQ ID NO:21266 |
| iPS:433977 | 21-225_46D8 | NA | GATTATGGCATACAC | GTTATATGGTTTGAAGG AAGTAATAAATACTATG CAGATTCCGTGAAGGGC | GAACTAGGAGATTTCCAATGA CTAC |
| | | | SEQ ID NO:5243 | SEQ ID NO:13255 | SEQ ID NO:21267 |
| | | AA | DYGIH | VIWFEGSNKYYADSVKG | ELGFSNDY |
| | | | SEQ ID NO:5244 | SEQ ID NO:13256 | SEQ ID NO:21268 |
| iPS:433979 | 21-225_46B9 | NA | AGCTATGGCATGCAC | GTTATATGGTATGATGG AAGAAATAAATACTATG CAGACTCCGTGAAGGGC | CGGTATAGCAGCAGCTGGAT GGGAGGTATGGACGTC |
| | | | SEQ ID NO:5245 | SEQ ID NO:13257 | SEQ ID NO:21269 |
| | | AA | SYGMH | VIWYDGRNKYYADSVKG | RYSSSWMGGMDV |
| | | | SEQ ID NO:5246 | SEQ ID NO:13258 | SEQ ID NO:21270 |
| iPS:433981 | 21-225_46E9 | NA | GACTACTACATGAAC | TACATTAATAGTAATGGT TTTACCATATACTACGCA GACTCTGTGAAGGGC | GATACAATCTAC |
| | | | SEQ ID NO:5247 | SEQ ID NO:13259 | SEQ ID NO:21271 |
| | | AA | DYYMN | YINSNGFTIYYADSVKG | DTIY |
| | | | SEQ ID NO:5248 | SEQ ID NO:13260 | SEQ ID NO:21272 |

FIGURE 49
(Continued)

| iPS:433983 | 21-225_47A1 | NA | GACTATGGCATGCAC | GTTATATGGTATGATGAC TATAATAAAAAGTATGC AGACTCCGTGAAGGGC | GAACTGGGGATGCTCTTTGA CTAC |
|---|---|---|---|---|---|
| | | | SEQ ID NO:5249 | SEQ ID NO:13261 | SEQ ID NO:21273 |
| | | AA | DYGMH | VIWYDDYNKKYADSVKG | ELGMLFDY |
| | | | SEQ ID NO:5250 | SEQ ID NO:13262 | SEQ ID NO:21274 |
| iPS:433985 | 21-225_47C1 | NA | GACTATGGCATGCAC | GTTATATGGTATGATGG AAGTAATAAATACTATG CAGACTCCGTGAAGGGC | CGGTATAGCCGCAGCTGGGT GGGAGGTATGGACGTC |
| | | | SEQ ID NO:5251 | SEQ ID NO:13263 | SEQ ID NO:21275 |
| | | AA | DYGMH | VIWYDGSNKYYADSVKG | RYSRSWVGGMDV |
| | | | SEQ ID NO:5252 | SEQ ID NO:13264 | SEQ ID NO:21276 |
| iPS:433987 | 21-225_47A5 | NA | GACGATGACACACAC | GTTATATGGTTTGATGGA AGTAATAAATACTATGC AGACTCCGTGAAGGGC | GATCTTATAGCAGCAGCTGG TACAGTTGACTAC |
| | | | SEQ ID NO:5253 | SEQ ID NO:13265 | SEQ ID NO:21277 |
| | | AA | DDDTH | VIWFDGSNKYYADSVKG | DLIAAAGTVDY |
| | | | SEQ ID NO:5254 | SEQ ID NO:13266 | SEQ ID NO:21278 |
| iPS:433989 | 21-225_47C7 | NA | AACTATGCCATGAGC | GGTATTAGTGGTAGTGG TAGTCGCACATACTACG CAGACTCCGTGAAGGGC | GATCGGGGGCAGTGGCTCAT AGGCGGTATGGACGTC |
| | | | SEQ ID NO:5255 | SEQ ID NO:13267 | SEQ ID NO:21279 |
| | | AA | NYAMS | GISGSGSRTYYADSVKG | DRGQWLIGGMDV |
| | | | SEQ ID NO:5256 | SEQ ID NO:13268 | SEQ ID NO:21280 |

FIGURE 49
(Continued)

| iPS | | | | |
|---|---|---|---|---|
| iPS:433991 | 21-225_47E7 | NA | ATCTATGGCATGCAC | GTTATATGGTATGATGGAAGTAATAAATACTATGCAGACTCCGTGAAGGGC | CGGTATAGCAGAAGCTGGGTGGGAGGTATGGACGTC |
| | | | SEQ ID NO:5257 | SEQ ID NO:13269 | SEQ ID NO:21281 |
| | | AA | IYGMH | VIWYDGSNKYYADSVKG | RYSRSWVGGMDV |
| | | | SEQ ID NO:5258 | SEQ ID NO:13270 | SEQ ID NO:21282 |
| iPS:433993 | 21-225_47G7 | NA | AGCTATGCCATGAGT | GCTATTAGTGGTGTCGTGGTGGTAACACATTCTACGCAGAGTCCGTGAAGGGC | ATTATCGGGAGCAGTGGGCCTTTGACTAC |
| | | | SEQ ID NO:5259 | SEQ ID NO:13271 | SEQ ID NO:21283 |
| | | AA | SYAMS | AISGRGGNTFYAESVRG | HREQWAFDY |
| | | | SEQ ID NO:5260 | SEQ ID NO:13272 | SEQ ID NO:21284 |
| iPS:433995 | 21-225_47H7 | NA | GACTACTACATGATC | TACATTAATAGTAATGGTTTTACCAAATACTACGCAGACTCTGTGAAGGGC | GATACAGTCTAC |
| | | | SEQ ID NO:5261 | SEQ ID NO:13273 | SEQ ID NO:21285 |
| | | AA | DYYMI | YINSNGFTKYYADSVKG | DTVY |
| | | | SEQ ID NO:5262 | SEQ ID NO:13274 | SEQ ID NO:21286 |
| iPS:433997 | 21-225_48C1 | NA | AGCTATGGCATGCAC | GTTGTATGGTATGATGAAATTAATAAAAAGTATGCAGACTCCGTGAAGGGC | GAATTAGGGTGGGAGGCTGACTAC |
| | | | SEQ ID NO:5263 | SEQ ID NO:13275 | SEQ ID NO:21287 |
| | | AA | SYGMH | VVWYDEINKKYADSVKG | ELGWEADY |
| | | | SEQ ID NO:5264 | SEQ ID NO:13276 | SEQ ID NO:21288 |

FIGURE 49
(Continued)

| iPS: | | | | | |
|---|---|---|---|---|---|
| iPS:433999 | 21-225_48D1 | NA | AGTTATATGCCATGAGC | GTTATTAGTGGTCGTGGT GGTAGCACATTCTACGC AGACTCCGTGAAGGGC | CGTATAGCAGTGGCTGGGAA TGAGGCTTTTGATATC |
| | | | SEQ ID NO:5265 | SEQ ID NO:13277 | SEQ ID NO:21289 |
| | | AA | SYAMS | VISGRGGSTFYADSVKG | RIAVAGNEAFDI |
| | | | SEQ ID NO:5266 | SEQ ID NO:13278 | SEQ ID NO:21290 |
| iPS:434001 | 21-225_48F2 | NA | AACTATGTCATGCAC | GTTATATGGTATGAGG AAGTAATAAATACTATG CAGACTCCGTGAAGGGC | GAGAGGTATAGCAGCAGCTG GTACGACTACGGTCTGGACG TC |
| | | | SEQ ID NO:5267 | SEQ ID NO:13279 | SEQ ID NO:21291 |
| | | AA | NYVMH | VIWYDGSNKYYADSVKG | ERYSSSWYDYGLDV |
| | | | SEQ ID NO:5268 | SEQ ID NO:13280 | SEQ ID NO:21292 |
| iPS:434003 | 21-225_48C3 | NA | AGTTATATGCCATGAGC | GTTATTAGTGGTCGTGGT GGTAGCACATTCTACGC AGACTCCGTGAAGGGC | CGTATAGCAGTGGCTGGGAA TGAGGCTTTTGATATC |
| | | | SEQ ID NO:5269 | SEQ ID NO:13281 | SEQ ID NO:21293 |
| | | AA | SYAMS | VISGRGGSTFYADSVKG | RIAVAGNEAFDI |
| | | | SEQ ID NO:5270 | SEQ ID NO:13282 | SEQ ID NO:21294 |
| iPS:434007 | 21-225_48D7 | NA | AACTCTGCCATGAAC | GCTATTAGTGGTAGTGGT GGTACCACATTCTACGC AGACTCCGTGAAGGGC | TGTGGGCGGGAGCAGTGGCT TGACTAC |
| | | | SEQ ID NO:5271 | SEQ ID NO:13283 | SEQ ID NO:21295 |
| | | AA | NSAMN | AISGSGGTTFYADSVKG | CGREQWLDY |
| | | | SEQ ID NO:5272 | SEQ ID NO:13284 | SEQ ID NO:21296 |
| iPS:434089 | 21_225_48A9 | NA | AGCTATGGCATGCAC | GTTATATGGTATGAGGA AATAAGAAATACTATG CAGACTCCGTGAAGGGC | GAACTTGCCTGGTACGAGGA CTAC |

FIGURE 49
(Continued)

| | | | | | | | |
|---|---|---|---|---|---|---|---|
| iPS:434011 | 21-225_48A9 | AA | SEQ ID NO:5273 SYGMH | | SEQ ID NO:13285 VIWYEENKKYYADSVKG | | SEQ ID NO:21297 ELAWYEDY |
| iPS:434013 | 21-225_48B10 | NA | SEQ ID NO:5274 GACTACTTCATGACC | | SEQ ID NO:13286 TACATTAGTAGTGCTGGT GGTGCCATATACTACGC AGACTCTGTGAAGGGC | | SEQ ID NO:21298 GCAGTGGCTGCCCCTGGTGT TTTTGATATC |
| | | AA | SEQ ID NO:5275 DYFMT | | SEQ ID NO:13287 YISSAGGAIYYADSVKG | | SEQ ID NO:21299 AVAAPGVFDI |
| iPS:434015 | 21-225_48D12 | NA | SEQ ID NO:5276 GACTATGGCATGCAC | | SEQ ID NO:13288 GTTATATGGTATGATGTA AGTAATAAATACTATGT AGACTCCGTGAAGGGC | | SEQ ID NO:21300 GAACTGGGGATGAGATCTGA CTAC |
| | | AA | SEQ ID NO:5277 DYGMH | | SEQ ID NO:13289 VIWYDVSNKYYVDSVKG | | SEQ ID NO:21301 ELGMRSDY |
| iPS:434017 | 21-225_48F12 | NA | SEQ ID NO:5278 GACTACTTCATGACC | | SEQ ID NO:13290 TACATTAGTAGTGCTGGT GGTGCCATATACTACGC AGACTCTGTGAAGGGC | | SEQ ID NO:21302 GCAGTGGCTGCCCCTGGTGC TTTTGATATC |
| | | AA | SEQ ID NO:5279 DYFMT | | SEQ ID NO:13291 YISSAGGAIYYADSVKG | | SEQ ID NO:21303 AVAAPGAFDI |
| iPS:434017 | 21-225_48G12 | NA | SEQ ID NO:5280 GACTACTTCATGACC | | SEQ ID NO:13292 TACATTAGTAGTGCTGGT GGTGCCATATACTACGC AGACTCTGTGAAGGGC | | SEQ ID NO:21304 SEQ ID NO:21305 GCAGTGGCTGCCCCTGGTGC TTTTGATATC |
| | | AA | SEQ ID NO:5281 DYFMT SEQ ID NO:5282 | | SEQ ID NO:13293 YISSAGGAIYYADSVKG SEQ ID NO:13294 | | SEQ ID NO:21305 AVAAPGAFDI SEQ ID NO:21306 |

FIGURE 49
(Continued)

| | | | | | |
|---|---|---|---|---|---|
| iPS:434019 | 21-225_49A1 | NA | GACTATGGCATGCAC SEQ ID NO:5283 | GTTATATGGTATGATGA AGATAAATAATATTATG TAGACTCCGTGAAGGGC SEQ ID NO:13295 | GAACTGGGGTTCCTCTCTGA CTAC SEQ ID NO:21307 |
| | | AA | DYGMH SEQ ID NO:5284 | VIWYDEDNKYYVDSVKG SEQ ID NO:13296 | ELGFLSDY SEQ ID NO:21308 |
| iPS:434021 | 21-225_49C1 | NA | AGCTATGGCATGCAC SEQ ID NO:5285 | GTTATATGGTATGATGG AAGTAATAAATACTATG CAGACTCCGTGAAGGGC SEQ ID NO:13297 | AGGTATAGCAGCAGCTGGTC GGGCGGTATGGACGTC SEQ ID NO:21309 |
| | | AA | SYGMH SEQ ID NO:5286 | VIWYDGSNKYYADSVKG SEQ ID NO:13298 | RYSSSWSGGMDV SEQ ID NO:21310 |
| iPS:434023 | 21-225_49F1 | NA | AGCTATGGCATGAGC SEQ ID NO:5287 | GTTATTAGTGGTAGTGGT GGTAGCACATTCTACGC AGACTCCGTGAAGGGC SEQ ID NO:13299 | GCTATAGCAGCGGCTGGTGC CCACTATTTTGACTAC SEQ ID NO:21311 |
| | | AA | SYAMS SEQ ID NO:5288 | VISGSGGSTFYADSVKG SEQ ID NO:13300 | AIAAAGAHYFDY SEQ ID NO:21312 |
| iPS:434025 | 21-225_49G3 | NA | AGTTATGGCATGCAC SEQ ID NO:5289 | GTTATATGGTATGATGG AAGTAATAAATACTATG CAGACTCCGTGAAGGGC SEQ ID NO:13301 | AGGTATAGCAGCAGCTGGTC GGGCGGAATGGACGTC SEQ ID NO:21313 |
| | | AA | SYGMH SEQ ID NO:5290 | VIWYDGSNKYYADSVKG SEQ ID NO:13302 | RYSSSWSGGMDV SEQ ID NO:21314 |

FIGURE 49
(Continued)

| | | | | | |
|---|---|---|---|---|---|
| iPS:434027 | 21-225_49H5 | NA | AGCTATGGCCATGACC SEQ ID NO:5291 | GCTATTAGTGGTAGTGGT GGTAACTCATTCTACGCA GACTCCGTGAAGGGC SEQ ID NO:13303 | GCAAGGGCAGTGGCTGGGTC ACACTGGTTCGACCCC SEQ ID NO:21315 |
| | | AA | SYAMT SEQ ID NO:5292 | AISGSGGNSFYADSVKG SEQ ID NO:13304 | ARAVAGSHWFDP SEQ ID NO:21316 |
| iPS:434029 | 21-225_49C6 | NA | AACTATGGCATGCAC SEQ ID NO:5293 | GTTATATGGTTTGATGTA AGTAATAAAAGTATGT AGACTCCGTGAAGGGC SEQ ID NO:13305 | GATCTGGGGATGATCGAGGA CTAC SEQ ID NO:21317 |
| | | AA | NYGMH SEQ ID NO:5294 | VIWFDVSNKKYVDSVKG SEQ ID NO:13306 | DLGMIEDY SEQ ID NO:21318 |
| iPS:434031 | 21-225_49E7 | NA | AGCTATGGCATGCAC SEQ ID NO:5295 | GTTATATGGTATGATGG AAGTAATAAATACTATG CAGACTCCGTGAAGGGC SEQ ID NO:13307 | AGGTATAGCAGCAGCTGGTC GGGCGGTATGGACGTC SEQ ID NO:21319 |
| | | AA | SYGMH SEQ ID NO:5296 | VIWYDGSNKYYADSVKG SEQ ID NO:13308 | RYSSSWSGGMDV SEQ ID NO:21320 |
| iPS:434033 | 21-225_49F9 | NA | AGTTATGGCATGCAC SEQ ID NO:5297 | CTTATATGGTATGATGGA AGGAATAAATACTATGC AGACTCCGTGAAGGGC SEQ ID NO:13309 | AGGTATAGCAGCAGCTGGTC GGGCGGTATGGACGTC SEQ ID NO:21321 |
| | | AA | SYGMH SEQ ID NO:5298 | LIWYDGRNKYYADSVKG SEQ ID NO:13310 | RYSSSWSGGMDV SEQ ID NO:21322 |

FIGURE 49
(Continued)

| | | | | | |
|---|---|---|---|---|---|
| iPS:434035 | 21-225_49F10 | NA | GGCTACCATATGCAC | TGGATCAACCCTAATAACAATGCCACAAACTATGCTCAGAACTTTCAGGGC | GACGGTACCAGCAGCTTTGACTTC |
| | | | SEQ ID NO:5299 | SEQ ID NO:13311 | SEQ ID NO:21323 |
| | | AA | GYHMH | WINPNNATNYAQNFQG | DGTSSPDF |
| | | | SEQ ID NO:5300 | SEQ ID NO:13312 | SEQ ID NO:21324 |
| iPS:434037 | 21-225_49G12 | NA | AGCTATGCCATGAGC | GTTATTAGTGGTAGTGGTGGTACCACATTCTACGCAGACTCCGTGAAGGGC | CGTATAGCAGTGGCTGGGAATGATGCTTTTGATATC |
| | | | SEQ ID NO:5301 | SEQ ID NO:13313 | SEQ ID NO:21325 |
| | | AA | SYAMS | VISGSGGTTFYADSVKG | RIAVAGNDAFDI |
| | | | SEQ ID NO:5302 | SEQ ID NO:13314 | SEQ ID NO:21326 |
| iPS:434039 | 21-225_43B1 | NA | GACTACTACATGAAC | TACATTAATAGTAATGGTTTTACCATATACTACGCAGACTCTGTGAAGGGC | GATACAATCTAC |
| | | | SEQ ID NO:5303 | SEQ ID NO:13315 | SEQ ID NO:21327 |
| | | AA | DYYMN | YINSNGFTIYYADSVKG | DTIY |
| | | | SEQ ID NO:5304 | SEQ ID NO:13316 | SEQ ID NO:21328 |
| iPS:434041 | 21-225_50H8 | NA | AGTTATGCCATGAGC | GTTATTAGTGGTCGTGGTGGTACCACATTCTACGCAGACTCCGTGAAGGGC | CGTATAGCAGTGGCTGGGAATGAGGCTTTTGATATC |
| | | | SEQ ID NO:5305 | SEQ ID NO:13317 | SEQ ID NO:21329 |
| | | AA | SYAMS | VISGRGGTTFYADSVKG | RIAVAGNEAFDI |
| | | | SEQ ID NO:5306 | SEQ ID NO:13318 | SEQ ID NO:21330 |
| iPS:434043 | 21-225_50G10 | NA | AGCTATAGCATGAAC | TCCATTAGTAGTGGTAGTAGTACATATACCGCAGACTCAGTGAAGGGC | GTAGCAACTTTTGACTAC |
| | | | SEQ ID NO:5307 | SEQ ID NO:13319 | SEQ ID NO:21331 |

FIGURE 49
(Continued)

| | | | | SYSMN | SISGSSSYIYYADSVKG | VATFDY |
|---|---|---|---|---|---|---|
| iPS:434045 | 21-225_50H10 | AA | | SEQ ID NO:5308 | SEQ ID NO:13320 | SEQ ID NO:21332 |
| | | NA | | AGTTATGCCATGAGC | GTTATTAGTGGTCGTGGT GGTAGCACATTCTACGC AGACTCCGTGAAGGGC | CGTATAGCAGTGGCTGGGAA TGAGGCTTTTGATATC |
| iPS:434047 | 21-225_50A12 | AA | | SYAMS | VISGRGGSTFYADSVKG | RIAVAGNEAFDI |
| | | | | SEQ ID NO:5309 | SEQ ID NO:13321 | SEQ ID NO:21333 |
| | | NA | | SEQ ID NO:5310 | SEQ ID NO:13322 | SEQ ID NO:21334 |
| | | | | GGCCACTATATAAAC | TGGGTCAACCTAGTAACAG TGGTGGCACAAACTCTG CACAGAAGTTTCAGGGC | GGAGGGCAGCTCGGCGGGTT TAACTACTACTACTACGGTA TGGACGTC |
| iPS:434049 | 21-225_50B12 | AA | | GHYIN | WVNPNSGGTNSAQKFQG | GGQLGGFNYYYYGMDV |
| | | | | SEQ ID NO:5311 | SEQ ID NO:13323 | SEQ ID NO:21335 |
| | | NA | | AGCCATAGCATGAAC | TCCATCAGTAGTAGTAGT AATTACATATACTACGC AGACTCAGTGAAGGGC | GATCGGAGCATAGTAGTGGC TGGTCCCTGGGACTACTACG GTATGGACGTC |
| | | | | SEQ ID NO:5312 | SEQ ID NO:13324 | SEQ ID NO:21336 |
| iPS:434053 | 21-225_51E1 | AA | | SHSMN | SISSSSNYIYYADSVKG | DRSIVVAGPWDYYGMDV |
| | | | | SEQ ID NO:5313 | SEQ ID NO:13325 | SEQ ID NO:21337 |
| | | NA | | AGCTATGGCATGCAC | GTTATATGGTATGATGG AAGTAGTAAATACTATG CAGACTCCGTGAAGGGC | AGGTATAGCAGCAGTGGTC GGGCGGTATGGACGTC |
| | | | | SEQ ID NO:5314 | SEQ ID NO:13326 | SEQ ID NO:21338 |
| iPS:434055 | 21_225_51B4 | AA | | SYGMH | VIWYDGSSKYYADSVKG | RYSSSWSGGMDV |
| | | | | SEQ ID NO:5315 | SEQ ID NO:13327 | SEQ ID NO:21339 |
| | | NA | | AGCTATGTCATGAGC | GCTATTAGTGGTCGTGGT AGTAACACATTCTACAC AGACTCCGTGAAGGGC | GGGATAACTGGATCACACGG TGCTTTTGATATC |
| | | | | SEQ ID NO:5316 | SEQ ID NO:13328 | SEQ ID NO:21340 |

FIGURE 49
(Continued)

| | | | | | | | |
|---|---|---|---|---|---|---|---|
| iPS:434057 | 21-225_51B4 | AA | | SYVMS | | AISGRGSNTFYTDSVKG | | GITGSHGAFDI |
| | | | SEQ ID NO:5317 | | SEQ ID NO:13329 | | SEQ ID NO:21341 |
| | | NA | AGCTATGGCATGCAC | | GTTATATGGTATGATGA AGTAATAAATACTATG CAGACTCCGTGAAGGGC | | GAACTGGGATTTCTCTGA CTAC |
| | | | SEQ ID NO:5318 | | SEQ ID NO:13330 | | SEQ ID NO:21342 |
| iPS:434059 | 21-225_51E4 | AA | | SYGMH | | VIWYDESNKYYADSVKG | | ELGFLSDY |
| | | | SEQ ID NO:5319 | | SEQ ID NO:13331 | | SEQ ID NO:21343 |
| | | NA | AGCTATGTCATGAGC | | ACTATGAGTGGTAGTGG TGGTCGCACATACTACG CAGACTCCGTGAACGGC | | GTGACTGCTTTGACTAC |
| | | | SEQ ID NO:5320 | | SEQ ID NO:13332 | | SEQ ID NO:21344 |
| iPS:434061 | 21-225_51C5 | AA | | SYVMS | | TMSGSGGRTYYADSVNG | | VTAFDY |
| | | | SEQ ID NO:5321 | | SEQ ID NO:13333 | | SEQ ID NO:21345 |
| | | NA | AACTATGCCATGACC | | GTTATTAGTGCTAGTGGT GGTAACTCATTCTACGCA GACTCCGTGAAGGGC | | GCAAGGGCAGTGGCTGGGTC ACACTGGTTGACCCC |
| | | | SEQ ID NO:5322 | | SEQ ID NO:13334 | | SEQ ID NO:21346 |
| iPS:434063 | 21-225_51C7 | AA | | NYAMT | | VISASGGNSFYADSVKG | | ARAVAGSHWFDP |
| | | | SEQ ID NO:5323 | | SEQ ID NO:13335 | | SEQ ID NO:21347 |
| | | NA | AGCTATAGCATGAAC | | TCCATTAGTAGTAGTAGT AGTTACATATACTACG AGACTCAGTGAAGGGC | | GCTCGCCTTGACTAC |
| | | | SEQ ID NO:5324 | | SEQ ID NO:13336 | | SEQ ID NO:21348 |
| iPS:434063 | 21-225_51G7 | AA | | SYSMN | | SISSSSYIYYADSVKG | | ARLDY |
| | | | SEQ ID NO:5325 | | SEQ ID NO:13337 | | SEQ ID NO:21349 |
| | | | SEQ ID NO:5326 | | SEQ ID NO:13338 | | SEQ ID NO:21350 |

FIGURE 49
(Continued)

| | | NA | GGCTACCATATGCAC SEQ ID NO:5327 | TGGATCAACCCTAATAA TAATGCCACAAACTATG CTCAGAGCTTTCAGGGC SEQ ID NO:13339 | GACGGTACCAGCAGCTTTGA CTTC SEQ ID NO:21351 |
| --- | --- | --- | --- | --- | --- |
| iPS:434065 | 21-225_50D4 | AA | GYHMH SEQ ID NO:5328 | WINPNNNATNYAQSFQG SEQ ID NO:13340 | DGTSSFDF SEQ ID NO:21352 |
| iPS:434067 | 21-225_51H8 | NA | GGCCACTATATGAAC SEQ ID NO:5329 | TGGGTCAACCCTAACAG TGGTGGCTCAAACTCTGC ACAGCAGTTTCAGGGC SEQ ID NO:13341 | GGAGGGCAGCTCGGCGGCTT TAACTTCTACTACTACGGTA TGGACGTC SEQ ID NO:21353 |
| | | AA | GHYMN SEQ ID NO:5330 | WVNPNSGGSNSAQQFQG SEQ ID NO:13342 | GGQLGGFNFYYYGMDV SEQ ID NO:21354 |
| iPS:434069 | 21-225_51E9 | NA | GGCTACCATATACAC SEQ ID NO:5331 | TGGATCAACCCTAACAC TAATGGCACACAGTATG CACAGAAGTTTCAGGGC SEQ ID NO:13343 | GATGGCACCTCGTCCTTTGA CTAC SEQ ID NO:21355 |
| | | AA | GYHIH SEQ ID NO:5332 | WINPNTNGTQYAQKFQG SEQ ID NO:13344 | DGTSSFDY SEQ ID NO:21356 |
| iPS:434071 | 21-225_51F9 | NA | GACTATGGCATGCAC SEQ ID NO:5333 | GTTATATGGTTTGATGGA AATAATAAATACTATGC AGACTCCGTGAAGGGC SEQ ID NO:13345 | GAGCTGGGATTCTCTCTGA CTAC SEQ ID NO:21357 |
| | | AA | DYGMH SEQ ID NO:5334 | VIWFDGNNKYYADSVKG SEQ ID NO:13346 | ELGFLSDY SEQ ID NO:21358 |
| iPS:434073 | 21-225_51H10 | NA | AGCTATGCCATGAGC SEQ ID NO:5335 | GTTATTAGTGGTAGTGGT GGTACCACATTCTACGC AGACTCCGTGAAGGGC SEQ ID NO:13347 | CGTATAGCAGTGGCTGGGAA TGATGCTTTTGATATC SEQ ID NO:21359 |

FIGURE 49
(Continued)

|  |  |  | AA | SYAMS | VISGSGGTTFYADSVKG | RIAVAGNDAFDI |
|---|---|---|---|---|---|---|
| iPS:434075 | 21-225_51B11 | | | SEQ ID NO:5336 | SEQ ID NO:13348 | SEQ ID NO:21360 |
| | | | NA | GACTATGGCATGCAC | GTTATATGGTTTGGTGGAAATAATAAATACTATGGAGACTCCGTGAAGGC | GAGCTGGGATTTCTCTCTGACTAC |
| | | | | SEQ ID NO:5337 | SEQ ID NO:13349 | SEQ ID NO:21361 |
| | | | AA | DYGMH | VIWFGGNNKYYGDSVKG | ELGFLSDY |
| iPS:434077 | 21-225_51F11 | | | SEQ ID NO:5338 | SEQ ID NO:13350 | SEQ ID NO:21362 |
| | | | NA | AACTTTGGCATGCAC | GTTATATGGTATGAGGAAGTAATAAATACTATGCAGACTCCGTGAAGGGC | GAACTGGGGTTCCTCTCTGACTTC |
| | | | | SEQ ID NO:5339 | SEQ ID NO:13351 | SEQ ID NO:21363 |
| | | | AA | NFGMH | VIWYEESNKYYADSVKG | ELGFLSDF |
| iPS:434079 | 21-225_52B1 | | | SEQ ID NO:5340 | SEQ ID NO:13352 | SEQ ID NO:21364 |
| | | | NA | GGCTATCATATGCAG | TGGATCAACCCTAACAGTGGTGCCACAAACTATGCACAGAACTTTCAGGGC | GATGGCACCTCGTCCTTTGACTAC |
| | | | | SEQ ID NO:5341 | SEQ ID NO:13353 | SEQ ID NO:21365 |
| | | | AA | GYHMQ | WINPNSGATNYAQNFQG | DGTSSFDY |
| iPS:434081 | 21-225_52B2 | | | SEQ ID NO:5342 | SEQ ID NO:13354 | SEQ ID NO:21366 |
| | | | NA | AACTATGGCATGCAC | GTTACATGGTTTGATGGAAGTAATCAAGCTATGCAGACTCCGTGAAGGGC | GATCTGGGGATGATCGAGGACTTC |
| | | | | SEQ ID NO:5343 | SEQ ID NO:13355 | SEQ ID NO:21367 |
| | | | AA | NYGMH | VIWFDGSNQRYADSVKG | DLGMIEDF |
| | | | | SEQ ID NO:5344 | SEQ ID NO:13356 | SEQ ID NO:21368 |

FIGURE 49
(Continued)

| iPS: | | | | |
|---|---|---|---|---|
| iPS:434083 | 21-225_52H2 | NA | AGAAATGCCATGAGC<br>SEQ ID NO:5345<br>RNAMS<br>SEQ ID NO:5346 | GCTATTAGTGGTCGTGGT<br>GGTAATACATTCTACGC<br>AGACTCCGTGAAGGGC<br>SEQ ID NO:13357<br>AISGRGGNTFY ADSVKG<br>SEQ ID NO:13358 | AATGGGCGAGAGCAGTGGCT<br>TGACTAC<br>SEQ ID NO:21369<br>NGREQWLDY<br>SEQ ID NO:21370 |
| iPS:434085 | 21-225_52E3 | NA | AGCTATAAAATGAAC<br>SEQ ID NO:5347<br>SYKMN<br>SEQ ID NO:5348 | TCCATTAGTAGTGGTAAT<br>AGTTCCATATACTACGCA<br>GACTCAGTGAAGGGC<br>SEQ ID NO:13359<br>SISSGNSSIYY ADSVKG<br>SEQ ID NO:13360 | GTTAGCAGTAATGACTAC<br>SEQ ID NO:21371<br>VSSNDY<br>SEQ ID NO:21372 |
| iPS:434087 | 21-225_52F6 | NA | AGCTATGGCATGCAC<br>SEQ ID NO:5349<br>SYGMH<br>SEQ ID NO:5350 | ATTATATCATATGGAGG<br>AAGTAATAAATACTATG<br>CAGACTCCGTGAAGGGC<br>SEQ ID NO:13361<br>IISYGGSNKYY ADSVKG<br>SEQ ID NO:13362 | AGGTCAGCAGCTCGGCCGGG<br>CTACGGTATGGACGTC<br>SEQ ID NO:21373<br>RSAARPGYGMDV<br>SEQ ID NO:21374 |
| iPS:434091 | 21-225_52B9 | NA | GACTATGGCATGCAC<br>SEQ ID NO:5351<br>DYGMH<br>SEQ ID NO:5352 | GTTATATGGTTTGATGGA<br>AATAATAAATACTATGC<br>AGACTCCGTGAAGGGC<br>SEQ ID NO:13363<br>VIWFDGNNKYY ADSVKG<br>SEQ ID NO:13364 | GAGCTGGGATTTCTCTCGA<br>CTAC<br>SEQ ID NO:21375<br>ELGFLSDY<br>SEQ ID NO:21376 |

FIGURE 49
(Continued)

| | | | | |
|---|---|---|---|---|
| iPS:-434093 | 21-225_52D10 | NA | AGTTATGGCATGCAC<br>SEQ ID NO:5353 | CTTATATGGTTATGATGGA<br>AGTAATAATACCATGC<br>AGACTCCGTGAAGGGC<br>SEQ ID NO:13365 | AGGTATAGCAGCAGCTGGTC<br>GGGCGGTATGGACGTC<br>SEQ ID NO:21377 |
| | | AA | SYGMH<br>SEQ ID NO:5354 | LIWYDGSNKYHADSVKG<br>SEQ ID NO:13366 | RYSSSWSGGMDV<br>SEQ ID NO:21378 |
| iPS:-434095 | 21-225_52F10 | NA | TTCTATGGCATGCAC<br>SEQ ID NO:5355 | GTTATATGGGAGGATGG<br>AAGTAATAAATACTATG<br>CAGACTCCGTGAAGGGC<br>SEQ ID NO:13367 | GATTCTCTGTATAGCAGCAG<br>CTGGTTGTTTGACTAC<br>SEQ ID NO:21379 |
| | | AA | FYGMH<br>SEQ ID NO:5356 | VIWDDGSNKYYADSVKG<br>SEQ ID NO:13368 | DSLYSSSWLFDY<br>SEQ ID NO:21380 |
| iPS:-434097 | 21-225_52H10 | NA | GGCTACCATATGCAG<br>SEQ ID NO:5357 | TGGATCAACCCTAACAA<br>TGGTGGCACACAGTATG<br>CACAGAAGTTCAGGGC<br>SEQ ID NO:13369 | GATGGCACCTCGTCCTTTGA<br>CTAC<br>SEQ ID NO:21381 |
| | | AA | GYHMQ<br>SEQ ID NO:5358 | WINPNNGGTQYAQKFQG<br>SEQ ID NO:13370 | DGTSSFDY<br>SEQ ID NO:21382 |
| iPS:-434101 | 21-225_52H12 | NA | AGCTATAGCATGAAC<br>SEQ ID NO:5359 | TCCATTAGTGGTAGTAGT<br>ACTTACATATACTACGCA<br>GACTCAGTGAAGGGC<br>SEQ ID NO:13371 | GTCAACTCCTTTGACTAC<br>SEQ ID NO:21383 |
| | | AA | SYSMN<br>SEQ ID NO:5360 | SISGSSTYIYYADSVKG<br>SEQ ID NO:13372 | VNSFDY<br>SEQ ID NO:21384 |

FIGURE 49
(Continued)

| | | | AGCTATAGCATGAAC | NA | TCCATTAGTGGTAGTAGT AGTTACATATACTGC AGACTCAGTGAAGGGC | GATCGGGGAGCAGCACC |
|---|---|---|---|---|---|---|
| iPS:434103 | 21-225_53G1 | | SEQ ID NO:5361 | | SEQ ID NO:13373 | SEQ ID NO:21385 |
| | | | SYSMN | AA | SISGSSSYIYYADSVKG | DRGST |
| | | | SEQ ID NO:5362 | | SEQ ID NO:13374 | SEQ ID NO:21386 |
| iPS:434105 | 21-225_53D2 | | AACTATGGCATGCAC | NA | GTTGTATGGGATGATGG AAGTAATAAATACTATG CAGACTCCGTGAAGGGC | GGCCTTGGCTTTACGGGAGA CTAC |
| | | | SEQ ID NO:5363 | | SEQ ID NO:13375 | SEQ ID NO:21387 |
| | | | NYGMH | AA | VVWDGSNKYYADSVKG | GLGFTGDY |
| | | | SEQ ID NO:5364 | | SEQ ID NO:13376 | SEQ ID NO:21388 |
| iPS:434107 | 21-225_53E2 | | AGCTATGCCATGAGC | NA | GCTATTAGTGGTAGTGGT GGTAACACATTCTACGC AGACTCCGTGAAGGGC | AAGGTCGTGGATACAGCCAT GGCTCTTGACTAC |
| | | | SEQ ID NO:5365 | | SEQ ID NO:13377 | SEQ ID NO:21389 |
| | | | SYAMS | AA | AISGSGNTFYADSVKG | KVVDTAMALDY |
| | | | SEQ ID NO:5366 | | SEQ ID NO:13378 | SEQ ID NO:21390 |
| iPS:434111 | 21-225_53H2 | | AGCTATGGCATGCAC | NA | GTTATATCATATGGTGGA AGTAATAAATACCATGC AGACTCCGTGAAGGGC | CGGGGAGCAGCAGCTGTCTGG CTACGGTATGGACGTC |
| | | | SEQ ID NO:5367 | | SEQ ID NO:13379 | SEQ ID NO:21391 |
| | | | SYGMH | AA | VISYGGSNKYHADSVKG | RGAARPGYGMDV |
| | | | SEQ ID NO:5368 | | SEQ ID NO:13380 | SEQ ID NO:21392 |
| iPS:434115 | 21_225_53E4 | | AGCTATGTCATGAGC | NA | GGTATTAGTGGTAGTGG TGGTCGCACATACTACG CAGACTCCGTGAAGGGC | GTGGCCCTTTTGACTAC |

FIGURE 49
(Continued)

| | | | | | | |
|---|---|---|---|---|---|---|
| iPS:434117 | 21-225_53E4 | AA | SEQ ID NO:5369<br>SYVMS | SEQ ID NO:13381<br>GISGSGGRTYYADSVKG | SEQ ID NO:21393<br>VALFDY |
| | | NA | SEQ ID NO:5370<br>AGCTATGTGATGAGC | SEQ ID NO:13382<br>GCTATTAGTGGTAGTGGT<br>GGTGCCACATACTACGC<br>AGACTCCGTGAAGGGC | SEQ ID NO:21394<br>CCTCTAGTGGGAGCCCATGA<br>TGCTTTTGAAATC |
| iPS:434119 | 21-225_53C6 | AA | SEQ ID NO:5371<br>SYAMN | SEQ ID NO:13383<br>AISGSGGATYYADSVKG | SEQ ID NO:21395<br>PLVGAHDAFEI |
| | | NA | SEQ ID NO:5372<br>GACTATGGCATCCAC | SEQ ID NO:13384<br>GTTATATGGTATGATGA<br>AAGTAATAAATACTATG<br>GAGACTCCGTGAAGGGC | SEQ ID NO:21396<br>GAACTGGGGATGACGTCTGA<br>CTAC |
| iPS:434121 | 21-225_53E6 | AA | SEQ ID NO:5373<br>DYGIH | SEQ ID NO:13385<br>VIWYDESNKYYGDSVKG | SEQ ID NO:21397<br>ELGMTSDY |
| | | NA | SEQ ID NO:5374<br>AGCTATGTGATGAGC | SEQ ID NO:13386<br>GTTATATCATATGGTGGA<br>AGTAATAATACGATGC<br>AGACTCCGTGAAGGGC | SEQ ID NO:21398<br>CGACGGGCAGCTCGTCCAGG<br>GTACGGTATGGACGTC |
| iPS:434123 | 21-225_53F6 | AA | SEQ ID NO:5375<br>SYGMH | SEQ ID NO:13387<br>VISYGGSNKYDADSVKG | SEQ ID NO:21399<br>RRAARPGYGMDV |
| | | NA | SEQ ID NO:5376<br>GGCTACCATATGCAC | SEQ ID NO:13388<br>TGGATCAACCTAACAA<br>TAACGGCACAAACTATG<br>CACAGAAGTTTCAGGGC | SEQ ID NO:21400<br>GACGGTACCAGCAGCTTTGA<br>CTAC |
| | 21-225_53F7 | | SEQ ID NO:5377 | SEQ ID NO:13389 | SEQ ID NO:21401 |

FIGURE 49
(Continued)

| | | | | | | | |
|---|---|---|---|---|---|---|---|
| | | | AA | GYHMH | | WINPNNGTNYAQKFQG | DGTSSFDY |
| iPS:434127 | 21-225_53H8 | | | SEQ ID NO:5378 AGCTATGGCATGCAC | | SEQ ID NO:13390 GTTGTATGGTATGATGG AAGTAATAAATACTATG CAGACTCCGTGAAGGGC | SEQ ID NO:21402 GCCCGTATTGGTACTTTGA CTCC |
| | | | NA | | | | |
| iPS:434129 | 21-225_53B12 | | AA | SEQ ID NO:5379 SYGMH | | SEQ ID NO:13391 VIWYDGSNKYYADSVKG | SEQ ID NO:21403 ARIGYFDS |
| | | | NA | SEQ ID NO:5380 AACTTTGGCATGCAC | | SEQ ID NO:13392 GTTGTATGGTATGATGG AATAATAGATACTATG CAGACTCCGTGAAGGGC | SEQ ID NO:21404 GAACTGGGATTCTCTCTGA CTTC |
| iPS:434131 | 21-225_54D3 | | AA | SEQ ID NO:5381 NFGMH | | SEQ ID NO:13393 VVWYDGNNRYYADSVKG | SEQ ID NO:21405 ELGFLSDF |
| | | | NA | SEQ ID NO:5382 AACTATGGCATGCAC | | SEQ ID NO:13394 GTTACATGGTTTGATGGA AATAACTACTATGC AGACTCCGTGAAGGGC | SEQ ID NO:21406 GAACTGGGGTTCCTTTCTGA TTAT |
| iPS:434133 | 21_225_54G3 | | AA | SEQ ID NO:5383 NYGMH | | SEQ ID NO:13395 VTWFDGNNNYYADSVKG | SEQ ID NO:21407 ELGFLSDY |
| | | | NA | SEQ ID NO:5384 ACCTATGCCATGAGT | | SEQ ID NO:13396 GCTATTAGTGGTAGTGGT GTTAACACATTCTACGCA GACTCCGTGAAGGGC | SEQ ID NO:21408 CTGGGGAAGGACTACTACTA CTACGGTATGGACGTC |

FIGURE 49
(Continued)

| | | | | | | |
|---|---|---|---|---|---|---|
| iPS:434135 | 21-225_54G3 | AA | SEQ ID NO:5385<br>TYAMS | SEQ ID NO:13397<br>AISGSGVNTFYADSVKG | SEQ ID NO:21409<br>LGKDYYYGMDV |
| | | NA | SEQ ID NO:5386<br>AGCTATAGCATGATC | SEQ ID NO:13398<br>TCCATTAGTGGTACTAGT<br>AGTTACATATACTACGC<br>AGACTCAGTGAAGGGC | SEQ ID NO:21410<br>ATGACTACAGTAATT |
| iPS:434137 | 21-225_54H3 | AA | SEQ ID NO:5387<br>SYSMI | SEQ ID NO:13399<br>SISGTSSYIYYADSVKG | SEQ ID NO:21411<br>MTTVI |
| | | NA | SEQ ID NO:5388<br>AGCTATAGCATGCAC | SEQ ID NO:13400<br>GTTATATGGTATGATGG<br>AAGTAATAAATACTATG<br>CAGACTCCGTGAAGGGC | SEQ ID NO:21412<br>AGGTATAGCAGCAGCTGGTC<br>GGGCGGTATGGACGTC |
| iPS:434139 | 21-225_54D4 | AA | SEQ ID NO:5389<br>SYGMH | SEQ ID NO:13401<br>VIWYDGSNKYYADSVKG | SEQ ID NO:21413<br>RYSSSWSGGMDV |
| | | NA | SEQ ID NO:5390<br>GACTATGGCATCCAC | SEQ ID NO:13402<br>GTTATATGGTATGATGA<br>AATAATAAATACTATG<br>CAGACTCCGTGAAGGGC | SEQ ID NO:21414<br>GAACTGGGGATGACGTCTGA<br>CTAC |
| iPS:434141 | 21-225_54C6 | AA | SEQ ID NO:5391<br>DYGIH | SEQ ID NO:13403<br>VIWYDENNKYYADSVKG | SEQ ID NO:21415<br>ELGMTSDY |
| | | NA | SEQ ID NO:5392<br>AACTATGGCATGCAC | SEQ ID NO:13404<br>GTTATATGGTATGAGGA<br>AAGTAATAAATACTATG<br>GAGACTCCGTGAAGGGC | SEQ ID NO:21416<br>GAATTGGGGTTCCTCTCTGA<br>CTAC |
| iPS:434143 | 21-225_54G7 | | SEQ ID NO:5393 | SEQ ID NO:13405 | SEQ ID NO:21417 |

FIGURE 49
(Continued)

| | | | | | | | ELGFLSDY |
|---|---|---|---|---|---|---|---|
| | | AA | NYGMH | | VIWYEESNKYYGDSVKG | | SEQ ID NO:21418 |
| iPS:434145 | | | SEQ ID NO:5394 | | SEQ ID NO:13406 | | |
| | 21-225_55B1 | NA | GGCTACTATTTCCAC | | TGGATCCACCTAACAATAATGCCACAAACTATGCACAGAAGTTCAGGGC | | GATGGCAGATCGTCCTTTGACTAC |
| | | | SEQ ID NO:5395 | | SEQ ID NO:13407 | | SEQ ID NO:21419 |
| | | AA | GYYFH | | WIHPNNNATNYAQKFQG | | DGRSSFDY |
| iPS:434147 | | | SEQ ID NO:5396 | | SEQ ID NO:13408 | | SEQ ID NO:21420 |
| | 21-225_55E1 | NA | AGCTATGGCCATGAGC | | GCTATTAGTGGTCGTGGTAGTAGCACATTCTACGCAGACTCCGTGAAGGGC | | GATCACGGTATAGTGGAACTATTTACTTGACTAC |
| | | | SEQ ID NO:5397 | | SEQ ID NO:13409 | | SEQ ID NO:21421 |
| | | AA | SYAMS | | AISGRGSSTFYADSVKG | | DHGIVGTIYFDY |
| iPS:434149 | | | SEQ ID NO:5398 | | SEQ ID NO:13410 | | SEQ ID NO:21422 |
| | 21-225_55H1 | NA | AGCTATGGCATGCAC | | GTTATATGGTATGATGGAAGTAATAAATACTATGCAGACTCCGTGAAGGGC | | AGGTATAGCAGCAGCTGGTCGGGCGGTATGGACGTC |
| | | | SEQ ID NO:5399 | | SEQ ID NO:13411 | | SEQ ID NO:21423 |
| | | AA | SYGMH | | VIWYDGSNKYYADSVKG | | RYSSSWSGGMDV |
| iPS:434151 | | | SEQ ID NO:5400 | | SEQ ID NO:13412 | | SEQ ID NO:21424 |
| | 21-225_55C2 | NA | AGTTATGGCATGCAC | | CTTATATGGTATGATGGAAGTAATAATACCATGCAGACTCCGTGAAGGGC | | AGGTATAGCAGCAGCTGGTCGGGCGGTATGGACGTC |
| | | | SEQ ID NO:5401 | | SEQ ID NO:13413 | | SEQ ID NO:21425 |
| | | AA | SYGMH | | LIWYDGSNKYHADSVKG | | RYSSSWSGGMDV |

FIGURE 49
(Continued)

| | | | | | |
|---|---|---|---|---|---|
| iPS:434155 | 21-225_55B3 | NA | SEQ ID NO:5402 AGCTATGGCATGCAC | SEQ ID NO:13414 GTTATATGGTTGATGGAAATAATAAATACTATGAAGACTCCGTGAAGGGC | SEQ ID NO:21426 GAACTGGGATTCTCTCTGACTAC |
| | | AA | SEQ ID NO:5403 SYGMH | SEQ ID NO:13415 VIWFDGNNKYYEDSVKG | SEQ ID NO:21427 ELGFLSDY |
| iPS:434157 | 21-225_55D4 | NA | SEQ ID NO:5404 AGTTATATAGGATGAAC | SEQ ID NO:13416 TCCATTAGTAGTAGTAGTAATCACATAGACTACGCAGACTCAGTGAAGGGC | SEQ ID NO:21428 GGGACTGACTAC |
| | | AA | SEQ ID NO:5405 SYRMN | SEQ ID NO:13417 SISSSSNHIDYADSVKG | SEQ ID NO:21429 GTDY |
| iPS:434159 | 21-225_55B8 | NA | SEQ ID NO:5406 GACTATGGCATGCAC | SEQ ID NO:13418 GTTATATGGTATGATGAAAATAATAAATACTATGCAGACTCCGTGAAGGGC | SEQ ID NO:21430 GAATGGTTTGACTAC |
| | | AA | SEQ ID NO:5407 DYGMH | SEQ ID NO:13419 VIWYDENNKYYADSVKG | SEQ ID NO:21431 EWFDY |
| iPS:434161 | 21-225_55F9 | NA | SEQ ID NO:5408 AGCTATGGCATGCAC | SEQ ID NO:13420 GTTATATGGTATGATGGAAATGGCAAATATTATGCAGACTCCGTGAAGGGC | SEQ ID NO:21432 AGGTATAGCAGCAGCTGGTCGGGCGGTATGGACGTC |
| | | AA | SEQ ID NO:5409 SYGMH | SEQ ID NO:13421 VIWYDGNGKYYADSVKG | SEQ ID NO:21433 RYSSSWSGGMDV |
| | | | SEQ ID NO:5410 | SEQ ID NO:13422 | SEQ ID NO:21434 |

FIGURE 49
(Continued)

| | | | | | |
|---|---|---|---|---|---|
| iPS:434163 | 21-225_50H1 | NA | AGCTATGGCATGCAC | ATTATATCATATGGTGGA AGTAATAAATACGATGC AGACTCCGTGAAGGGC | CGACGGGCAGCTCGTCCAGG GTACGGTATGGACGTC |
| | | | SEQ ID NO:5411 | SEQ ID NO:13423 | SEQ ID NO:21435 |
| | | AA | SYGMH | IISYGGSNKYDADSVKG | RRAARPGYGMDV |
| | | | SEQ ID NO:5412 | SEQ ID NO:13424 | SEQ ID NO:21436 |
| iPS:434165 | 21-225_50F2 | NA | AGCTATGGCATGCAC | GTTATATGGCATGATGG AAGTAATAAATACTATG CAGACTCCGTGAAGGGC | GACGAGCAGCTCGGACCTT TGACTAC |
| | | | SEQ ID NO:5413 | SEQ ID NO:13425 | SEQ ID NO:21437 |
| | | AA | SYGMH | VIWHDGSNKYYADSVKG | DEQLGTFDY |
| | | | SEQ ID NO:5414 | SEQ ID NO:13426 | SEQ ID NO:21438 |
| iPS:434167 | 21-225_50F3 | NA | ACCTATGGCCATGACC | GCTATCAGTGGTAGTGG TGTTAACTCATTCTACGC AGACTCCGTGAAGGGC | GCAAGGGCAGTGGCTGGGTC ACACTGGTTCGACCCC |
| | | | SEQ ID NO:5415 | SEQ ID NO:13427 | SEQ ID NO:21439 |
| | | AA | TYAMT | AISGSGVNSFYADSVKG | ARAVAGSHWFDP |
| | | | SEQ ID NO:5416 | SEQ ID NO:13428 | SEQ ID NO:21440 |
| iPS:434169 | 21-225_50C4 | NA | GACTATGGCATGCAC | GTTATATGGTATGAAGA AACTAATAAATACTATG CAGACTCCGTGAAGGGC | GAAGTGGGGTTCCTGAATGA CTAC |
| | | | SEQ ID NO:5417 | SEQ ID NO:13429 | SEQ ID NO:21441 |
| | | AA | DYGMH | VIWYEETNKYYADSVKG | EVGFLNDY |
| | | | SEQ ID NO:5418 | SEQ ID NO:13430 | SEQ ID NO:21442 |

FIGURE 49
(Continued)

| | | | | |
|---|---|---|---|---|
| iPS-434171 | 21-225_50G4 | NA | AGTTACTATATACAC | GTAATCAACCCTAGTAA TGGTAGAACAAGCTACG CACAGAAGTTCCAGGGC | GATCGAGGAGATGGTTACTA CTTCTACTACGGTATGGACG TC |
| | | | SEQ ID NO:5419 | SEQ ID NO:13431 | SEQ ID NO:21443 |
| | | AA | SYYIH | VINPSNGRTSYAQKFQG | DRGDGYYFYYGMDV |
| | | | SEQ ID NO:5420 | SEQ ID NO:13432 | SEQ ID NO:21444 |
| iPS-434175 | 21-225_55A11 | NA | AGCTATGGCATGCAC | GTTATATCATATGTTGGA AGTACTAAATACTATGC AGACTCCGTGAGGGC | GGGAGAGGTCGATATAGTGA CTACGGTCATGATGCTTTTG ATATC |
| | | | SEQ ID NO:5421 | SEQ ID NO:13433 | SEQ ID NO:21445 |
| | | AA | SYGMH | VISYVGSTKYYADSVRG | GRGRYSDYGHDAFDI |
| | | | SEQ ID NO:5422 | SEQ ID NO:13434 | SEQ ID NO:21446 |
| iPS-434177 | 21-225_56A1 | NA | AATTATGATATCAAC | TGGATGCACCCTAACAG TGGTAACACAGGCTATG CACAGAAGTTCCAGGGC | AGCAGTGGCTGGTACGTTTT TGACTAC |
| | | | SEQ ID NO:5423 | SEQ ID NO:13435 | SEQ ID NO:21447 |
| | | AA | NYDIN | WMHPNSGNTGYAQKFQG | SSGWYVFDY |
| | | | SEQ ID NO:5424 | SEQ ID NO:13436 | SEQ ID NO:21448 |
| iPS-434179 | 21-225_56F1 | NA | AGCTATAGCATGAAC | TCCATTAGTAGTAGTAGT ACTTACATATACGG AGACTCAGTGAAGGGC | GATCGGGGCAGCAGC |
| | | | SEQ ID NO:5425 | SEQ ID NO:13437 | SEQ ID NO:21449 |
| | | AA | SYSMN | SISSSSTYIYYGDSVKG | DRGSS |
| | | | SEQ ID NO:5426 | SEQ ID NO:13438 | SEQ ID NO:21450 |
| iPS-434181 | 21-225_56B2 | NA | AGCTATGCCATGAGC | GCTATTAGTGGTAGTGGT GGTAACACATTCTACGC AGACTCCGTGAAGGGC | AAGGTCGTGATACAGCCAT GGCTCTTGACTAC |
| | | | SEQ ID NO:5427 | SEQ ID NO:13439 | SEQ ID NO:21451 |
| | | AA | SYAMS | AISGSGGNTFYADSVKG | KVVDTAMALDY |

FIGURE 49
(Continued)

| | | | | | |
|---|---|---|---|---|---|
| iPS:434187 | 21-225_56A5 | NA | SEQ ID NO:5428 AGCTATAGCATGAAC | SEQ ID NO:13440 TCCATTAGTGGTAGTAGT AGTTACATATACTACGC AGACTCAGTGAAGGC | SEQ ID NO:21452 GTGGCTACTTTTGACTAC |
| | | AA | SEQ ID NO:5429 SYSMN | SEQ ID NO:13441 SISGSSSYIYYADSVKG | SEQ ID NO:21453 VATFDY |
| iPS:434189 | 21-225_56E5 | NA | SEQ ID NO:5430 GGCTACCATATGCAC | SEQ ID NO:13442 TGGATCAACCCTAACAA TAATGCCACAAACTATG CACAGAAGTTTCAGGGC | SEQ ID NO:21454 GATGGCACCTCGTCTTTGA CTAC |
| | | AA | SEQ ID NO:5431 GYHMH | SEQ ID NO:13443 WINPNNNATNYAQKFQG | SEQ ID NO:21455 DGTSSFDY |
| iPS:434191 | 21-225_56B6 | NA | SEQ ID NO:5432 AGCTATGGCATGCAC | SEQ ID NO:13444 GTTATATGGCATGATGG AAGTAATAAATATTATG TAGACTCCGTGAAGGGC | SEQ ID NO:21456 GACGAGCAGCTCGGGACCTT TGACTAC |
| | | AA | SEQ ID NO:5433 SYGMH | SEQ ID NO:13445 VIWHDGSNKYYVDSVKG | SEQ ID NO:21457 DEQLGTFDY |
| iPS:434193 | 21-225_56C6 | NA | SEQ ID NO:5434 GACTACCATATGCAC | SEQ ID NO:13446 TGGATCAACCCTAACAG AGGTGGCACAAATTATG TACAGAAGTTTCAGGGT | SEQ ID NO:21458 GATGGCACCTCGTCTTTGA CTAT |
| | | AA | SEQ ID NO:5435 DYHMH | SEQ ID NO:13447 WINPNRGTNYVQKFQG | SEQ ID NO:21459 DGTSSFDY |
| | | | SEQ ID NO:5436 | SEQ ID NO:13448 | SEQ ID NO:21460 |

FIGURE 49
(Continued)

| iPS:434195 | 21-225_56F6 | NA | GACTACTATATGCAC SEQ ID NO:5437 | TGGATCAACCCTAACAG TGGTGGCACAAACTATG CACAGAGGTTTCAGGGC SEQ ID NO:13449 | GAGGGAGCAACTCGTCCGAC GGGTTTGACTAC SEQ ID NO:21461 |
| --- | --- | --- | --- | --- | --- |
| | | AA | DYYMH SEQ ID NO:5438 | WINPNSGGTNYAQRFQG SEQ ID NO:13450 | EGATRPTGFDY SEQ ID NO:21462 |
| iPS:434197 | 21-225_56C7 | NA | GGCCACTATATAAAC SEQ ID NO:5439 | TGGGTCAACCCTAACAG TGGTGGCACAAACTCTG CACAGAAGTTTCAGGGC SEQ ID NO:13451 | GGAGGGCAGCTCGGCGGGTT TAACTACTACTACTACGGTA TGGACGTC SEQ ID NO:21463 |
| | | AA | GHYIN SEQ ID NO:5440 | WVNPNSGGTNSAQKFQG SEQ ID NO:13452 | GGQLGGFNYYYYGMDV SEQ ID NO:21464 |
| iPS:434199 | 21-225_59F11 | NA | AACTATGGCATGCAC SEQ ID NO:5441 | GTTATATGGTATGATGA AAGTAATAAACACTATG CAGACTCCGTGAAGGGC SEQ ID NO:13453 | GAACTGGGGGATGAACGGAG ACTAC SEQ ID NO:21465 |
| | | AA | NYGMH SEQ ID NO:5442 | VIWYDESNKHYADSVKG SEQ ID NO:13454 | ELGMNGDY SEQ ID NO:21466 |
| iPS:434201 | 21-225_59A12 | NA | AGCTATGGCATGCAC SEQ ID NO:5443 | GTTATATGGTATGATGG AAGTAATAAATACTATG CAGACTCCGTGAAGGGC SEQ ID NO:13455 | CGGTATAGCAGCAGCTGGGA CGGGGGTATGGACGTC SEQ ID NO:21467 |
| | | AA | SYGMH SEQ ID NO:5444 | VIWYDGSNKYYADSVKG SEQ ID NO:13456 | RYSSSWDGGMDV SEQ ID NO:21468 |

FIGURE 49
(Continued)

| | | | | | |
|---|---|---|---|---|---|
| iPS:434203 | 21-225_60E2 | NA | GACTATGGCATGCAC | ATTATATGGTATGATGA AATAATAAATACTATG CAGACTCCGTGAAGGGC | GATGTTCTGGACCCTTTTGA CTAC |
| | | | SEQ ID NO:5445 | SEQ ID NO:13457 | SEQ ID NO:21469 |
| | | AA | DYGMH | IIWYDENNKYYADSVKG | DVLDPFDY |
| | | | SEQ ID NO:5446 | SEQ ID NO:13458 | SEQ ID NO:21470 |
| iPS:434205 | 21-225_60G2 | NA | AGTTATGGCATGCAC | GTTATATGGTATGATGG AAGTAATAAATACTATG CAGACTCCGTGAAGGGC | AGGTATAGCAGAAGCTGGAC GGGAGGCATGGACGTC |
| | | | SEQ ID NO:5447 | SEQ ID NO:13459 | SEQ ID NO:21471 |
| | | AA | SYGMH | VIWYDGSNKYYADSVKG | RYSRSWTGGMDV |
| | | | SEQ ID NO:5448 | SEQ ID NO:13460 | SEQ ID NO:21472 |
| iPS:434207 | 21-225_60A3 | NA | AGTTATGGCATGCAC | GTTATATGGTATGAAGA AAGTAATAAATACTATG CAGACTCCGTGAAGGGC | GAACTGGGGATGACCGGAGA CTAC |
| | | | SEQ ID NO:5449 | SEQ ID NO:13461 | SEQ ID NO:21473 |
| | | AA | SYGMH | VIWYEESNKYYADSVKG | ELGMTGDY |
| | | | SEQ ID NO:5450 | SEQ ID NO:13462 | SEQ ID NO:21474 |
| iPS:434209 | 21-225_60C3 | NA | GGCCACTATATACAC | TGGATCAACCCTAACAG CGGTGGCACAAACTATG TACAGAAATTTCAGGGC | GGGGGCCTACTGGGAGTAC CAACTACTATTATTACGGTA TGGACGTC |
| | | | SEQ ID NO:5451 | SEQ ID NO:13463 | SEQ ID NO:21475 |
| | | AA | GHYIH | WINPNSGGTNYVQKFQG | GGLLGATNYYYYGMDV |
| | | | SEQ ID NO:5452 | SEQ ID NO:13464 | SEQ ID NO:21476 |

FIGURE 49
(Continued)

| | | | | | |
|---|---|---|---|---|---|
| iPS:434211 | 21-225_60F3 | NA | AATTATGATATCAAC | TGGATGCACCCTAACAG TGGTAACACAGGCTATG CACAGAAGTTCCAGGGC | AGCAGTGGCTGGTACTTCTT TGACTAC |
| | | | SEQ ID NO:5453 | SEQ ID NO:13465 | SEQ ID NO:21477 |
| | | AA | NYDIN | WMHPNSGNTGYAQKFQG | SSGWYFFDY |
| | | | SEQ ID NO:5454 | SEQ ID NO:13466 | SEQ ID NO:21478 |
| iPS:434213 | 21-225_60A4 | NA | AGCTATGTCATGAGC | TCTATTAGTGGTAGTGGT GGTTGGACAAACTACGC AGACTCCGTGAAGGGC | CTAACTGGATTTGACTAT |
| | | | SEQ ID NO:5455 | SEQ ID NO:13467 | SEQ ID NO:21479 |
| | | AA | SYVMS | SISGSGGWTNYADSVKG | LTGFDY |
| | | | SEQ ID NO:5456 | SEQ ID NO:13468 | SEQ ID NO:21480 |
| iPS:434215 | 21-225_60F7 | NA | AGCTATGTCATGAGC | GGTATTAGTGGTAGTGG TAATAGAACATACTACG CAGACTCCGTGAAGGGC | TTGGGGATTGAC |
| | | | SEQ ID NO:5457 | SEQ ID NO:13469 | SEQ ID NO:21481 |
| | | AA | SYVMS | GISGSGNRTYYADSVKG | LGID |
| | | | SEQ ID NO:5458 | SEQ ID NO:13470 | SEQ ID NO:21482 |
| iPS:434217 | 21-225_60E8 | NA | AGGAGTAGTTACTACTGGGG C | AGTATCTATTATAGTGGG AGGGCCTCCTACAACCC GTCCCTCAAGAGT | CTGGACAGTGGCTGGTCGTT TGACTAC |
| | | | SEQ ID NO:5459 | SEQ ID NO:13471 | SEQ ID NO:21483 |
| | | AA | RSSYYWG | SIYYSGSASYNPSLKS | LDSGWSFDY |
| | | | SEQ ID NO:5460 | SEQ ID NO:13472 | SEQ ID NO:21484 |
| iPS:434219 | 21-225_60E9 | NA | AGCTATGCCATGAGC | GCTATTAGTGGTAGTGGT GGTAACACATTCTACGC AGACTCCGTGAAGGGC | TTTTTCGGTATAGTGGGAGC CGGGTACTTTGACTAC |
| | | | SEQ ID NO:5461 | SEQ ID NO:13473 | SEQ ID NO:21485 |

FIGURE 49
(Continued)

| | | | | | | |
|---|---|---|---|---|---|---|
| iPS:434221 | 21-225_60A11 | AA | SYAMS | AISGSGGNTFYADSVKG | FFGIVGAGYFDY | |
| | | | SEQ ID NO:5462 | SEQ ID NO:13474 | SEQ ID NO:21486 | |
| | | NA | AACTATGCCATGACC | GCTATTAGTGGTAGTGGT GGTAACACATTCTACGC AGACTCCGTGACGGGC | CTGGGGAAGGACTACCACTA CTACGGTATGGACGTC | |
| | | | SEQ ID NO:5463 | SEQ ID NO:13475 | SEQ ID NO:21487 | |
| iPS:434223 | 21-225_60C12 | AA | NYAMT | AISGSGGNTFYADSVTG | LGKDYHYYGMDV | |
| | | | SEQ ID NO:5464 | SEQ ID NO:13476 | SEQ ID NO:21488 | |
| | | NA | AGCTATGGCATGCAC | GTTATATGGTATGATGG AAGTAATAAATACTATG TAGACTCCGTGAAGGGC | AGGTATAGCAGAAGCTGGAC GGGAGGTATGGACGTC | |
| | | | SEQ ID NO:5465 | SEQ ID NO:13477 | SEQ ID NO:21489 | |
| iPS:434225 | 21-225_60E12 | AA | SYGMH | VIWYDGSNKYYVDSVKG | RYSRSWTGGMDV | |
| | | | SEQ ID NO:5466 | SEQ ID NO:13478 | SEQ ID NO:21490 | |
| | | NA | AGTTACTTCTGGAGC | CGCATCTATACCAGGGG GAGCACCAACTACAACC CCTCCCTCAAGAGT | GAGGGAAAAACTGGGGGGG TTTCTTACTTGACTAC | |
| | | | SEQ ID NO:5467 | SEQ ID NO:13479 | SEQ ID NO:21491 | |
| iPS:434227 | 21-225_61A1 | AA | SYFWS | RIYTRGSTNYNPSLKS | EGKTGGVSYFDY | |
| | | | SEQ ID NO:5468 | SEQ ID NO:13480 | SEQ ID NO:21492 | |
| | | NA | AGTCACTTCTGGAGC | CGCATCTATATCAGGGG GAGCACCAACTACAACC CCTCCCTCAAGAGT | GAGGGAAAAACTGGGGGGG TTTCTTACTTGACTAC | |
| | | | SEQ ID NO:5469 | SEQ ID NO:13481 | SEQ ID NO:21493 | |
| | | AA | SHFWS | RIYIRGSTNYNPSLKS | EGKTGGVSYFDY | |
| | | | SEQ ID NO:5470 | SEQ ID NO:13482 | SEQ ID NO:21494 | |

FIGURE 49
(Continued)

| | | | | | |
|---|---|---|---|---|---|
| iPS:434229 | 21-225_61H1 | NA | GACTATGGCATGCAC | ATTATATGGTATGATGAAGTAATAAATACTATGCAGACTCCGTGAAGGGC | GATGTTCTGGACCCTTTTGACTAC |
| | | | SEQ ID NO:5471 | SEQ ID NO:13483 | SEQ ID NO:21495 |
| | | AA | DYGMH | IIWYDESNKYYADSVKG | DVLDPFDY |
| | | | SEQ ID NO:5472 | SEQ ID NO:13484 | SEQ ID NO:21496 |
| iPS:434231 | 21-225_61F2 | NA | AGCTATGGCATGCAC | GTTATATGGTATGATGGAAGTAATAAATACTATGCAGACTCCGTGAAGGGC | GAGAGGTATAGCAGTGGCTGGTACGACTACGGTATGGACGTC |
| | | | SEQ ID NO:5473 | SEQ ID NO:13485 | SEQ ID NO:21497 |
| | | AA | SYGMH | VIWYDGSNKYYADSVKG | ERYSSGWYDYGMDV |
| | | | SEQ ID NO:5474 | SEQ ID NO:13486 | SEQ ID NO:21498 |
| iPS:434233 | 21-225_61B3 | NA | AGCTATGGCATGCAC | GTTATATGGTATGATGGAAGTAATAAATACTATGCAGACTCCGTGAAGGGC | AGGTATAGCAGAAGCTGGGCGGGAGGCATGGACTGGACGTC |
| | | | SEQ ID NO:5475 | SEQ ID NO:13487 | SEQ ID NO:21499 |
| | | AA | SYGMH | VIWYDGSNKYYADSVKG | RYSRSWAGGMDV |
| | | | SEQ ID NO:5476 | SEQ ID NO:13488 | SEQ ID NO:21500 |
| iPS:434235 | 21-225_61E3 | NA | AATTATGATATCAAC | TGGATGACCCCTAACAGTGGTAACACAGGCTATGCACAGAAGTTCCAGGGC | AGCAGTGGCTGGTACCGCTTTGACTAC |
| | | | SEQ ID NO:5477 | SEQ ID NO:13489 | SEQ ID NO:21501 |
| | | AA | NYDIN | WMTPNSGNTGYAQKFQG | SSGWYRFDY |
| | | | SEQ ID NO:5478 | SEQ ID NO:13490 | SEQ ID NO:21502 |

FIGURE 49
(Continued)

| | | | | | |
|---|---|---|---|---|---|
| iPS:434237 | 21-225_61B5 | NA | AATTATGATATCAAC SEQ ID NO:5479 | TGGATGCACCCTAACAG TGGTAGCACAGGCTATG CACAGAAGTTCCAGGGC SEQ ID NO:13491 | AGCAGTGGCTGGTACTACTT TGACTAC SEQ ID NO:21503 |
| | | AA | NYDIN SEQ ID NO:5480 | WMHPNSGSTGYAQKFQG SEQ ID NO:13492 | SSGWYYFDY SEQ ID NO:21504 |
| iPS:434239 | 21-225_58F1 | NA | AGCTATGCCATGAGT SEQ ID NO:5481 | GCTATTAGTACTGGTGGT GGTAACACATACTACGC AGACTCCGTGAAGGGC SEQ ID NO:13493 | CGGGGGGTCTACGGTGACTT TGATGCTTTTGATATC SEQ ID NO:21505 |
| | | AA | SYAMS SEQ ID NO:5482 | AISTGGGNTYYADSVKG SEQ ID NO:13494 | RGVYGDFDAFDI SEQ ID NO:21506 |
| iPS:434241 | 21-225_61E6 | NA | AGCTATGCCATGAGC SEQ ID NO:5483 | GCTACTAGTGGTAGTGG TGTTAACACATTCTACGC AGACTCCGTGAAGGGC SEQ ID NO:13495 | TTGGAACTGGGGATCTTTGA CTAC SEQ ID NO:21507 |
| | | AA | SYAMS SEQ ID NO:5484 | ATSGSGVNTFYADSVKG SEQ ID NO:13496 | LELGIFDY SEQ ID NO:21508 |
| iPS:434243 | 21-225_62C1 | NA | AGCTATAGCATGAAC SEQ ID NO:5485 | TCCATTAGTAGTAGTAGT AGTTACATATACTACGC AGACTCAGTGAAGGGC SEQ ID NO:13497 | TTTGGAGTGGAC SEQ ID NO:21509 |
| | | AA | SYSMN SEQ ID NO:5486 | SISSSSYTYYADSVKG SEQ ID NO:13498 | FGVD SEQ ID NO:21510 |
| iPS:434245 | 21-225_62H1 | NA | AGCTATGGCATGCAC SEQ ID NO:5487 | ATTATATGGTATGATGG AAGTAATAAATACTATG CAGACTCCGTGAAGGGC SEQ ID NO:13499 | GAAGACCCGGTACCAGCTG CTCTGACTAC SEQ ID NO:21511 |

FIGURE 49
(Continued)

| | | AA | SYGMH | | IIWYDGSNKYYADSVKG | | EDPRTSCSDY | |
|---|---|---|---|---|---|---|---|---|
| iPS:434247 | 21-225_62D2 | | SEQ ID NO:5488 | | SEQ ID NO:13500 | | SEQ ID NO:21512 | |
| | | NA | AGCTATGGCATGCAC | | GTTATATGGTATGATGG AAGTAATAAATACTCTG CAGACTCCGTGAAGGGC | | GATAATGGTAACTGGAACTA CCTTGACTAC | |
| | | | SEQ ID NO:5489 | | SEQ ID NO:13501 | | SEQ ID NO:21513 | |
| iPS:434249 | 21-225_62E2 | AA | SYGMH | | VIWYDGSNKYSADSVKG | | DNGNWNYLDY | |
| | | | SEQ ID NO:5490 | | SEQ ID NO:13502 | | SEQ ID NO:21514 | |
| | | NA | AGAAGTAGTTACTACTGGGG C | | AGCATCTATTATAGTGG GATCGCCTCCTATAATCC GTCCCTCAAGAGT | | CTGAGCAGTGGCTGGTCCTT TGACTAC | |
| | | | SEQ ID NO:5491 | | SEQ ID NO:13503 | | SEQ ID NO:21515 | |
| iPS:434251 | 21-225_62G3 | AA | RSSYYWG | | SIYYSGIASYNPSLKS | | LSSGWSFDY | |
| | | | SEQ ID NO:5492 | | SEQ ID NO:13504 | | SEQ ID NO:21516 | |
| | | NA | AGCTATAGCATGAAC | | TCCATTAGTAGTAGTAGT AGTTACATATACGC AGACTCAGTGAAGGGC | | GTTAACTCTTTTGACTCC | |
| | | | SEQ ID NO:5493 | | SEQ ID NO:13505 | | SEQ ID NO:21517 | |
| iPS:434253 | 21-225_62E4 | AA | SYSMN | | SISSSSSYIYYADSVKG | | VNSFDS | |
| | | | SEQ ID NO:5494 | | SEQ ID NO:13506 | | SEQ ID NO:21518 | |
| | | NA | GACTATGGCATGCAC | | GTTATATGGTATGATGG AAGTAATAAATACTATG CAGACTCCGTGAAGGGC | | GAGCTTGGGTTCAGCAGTGA CTAC | |
| | | | SEQ ID NO:5495 | | SEQ ID NO:13507 | | SEQ ID NO:21519 | |
| | | AA | DYGMH | | VIWYDRSNKYYADSVKG | | ELGFSSDY | |
| | | | SEQ ID NO:5496 | | SEQ ID NO:13508 | | SEQ ID NO:21520 | |

FIGURE 49
(Continued)

| | | | | |
|---|---|---|---|---|
| iPS:434255 | 21-225_62E6 | NA | TCCTATGGCATGCAC | GCTATATGGTATGATGG AAGTAATAAATACTATG GAGACTCCGTGAAGGGC | GATCAGGGCATAGTGGGAGC TACTTGGTTGACTAC |
| | | | SEQ ID NO:5497 | SEQ ID NO:13509 | SEQ ID NO:21521 |
| | | AA | SYGMH | AIWYDGSNKYYGDSVKG | DQGIVGATWFDY |
| | | | SEQ ID NO:5498 | SEQ ID NO:13510 | SEQ ID NO:21522 |
| iPS:434257 | 21-225_62F7 | NA | AGCTATGTTATGAGC | GGTATTAGTGGTAGTGG TGCTAAACATACTATG CAGACTCCGTGAAGGGC | CTGGGGATAGACTACTACTA CGGTATGGACGTC |
| | | | SEQ ID NO:5499 | SEQ ID NO:13511 | SEQ ID NO:21523 |
| | | AA | SYVMS | GISGSGAKTYYADSVKG | LGIDYYYGMDV |
| | | | SEQ ID NO:5500 | SEQ ID NO:13512 | SEQ ID NO:21524 |
| iPS:434259 | 21-225_62G7 | NA | GGCTACTATATGCAC | TGGATCAAACCTAAAAG TGGTGGCACAAACCAAG CACAGAAGTTTCAGGGC | GCTCCGGGTATAGCAGCAGC TGGTACATGGGGATACTTTG ACTAC |
| | | | SEQ ID NO:5501 | SEQ ID NO:13513 | SEQ ID NO:21525 |
| | | AA | GYYMH | WIKPKSGGTNQAQKFQG | APGIAAAGTWGYFDY |
| | | | SEQ ID NO:5502 | SEQ ID NO:13514 | SEQ ID NO:21526 |
| iPS:434261 | 21-225_56F7 | NA | AGCTATGTCTTAAAC | GCTATGAGTGGTAGTGG TGGTAGAACATACTACG CAGACTCCGTGAAGGGC | ACTACGCACTTTGACTAC |
| | | | SEQ ID NO:5503 | SEQ ID NO:13515 | SEQ ID NO:21527 |
| | | AA | SYVLN | AMSGSGGRTYYADSVKG | TTHFDY |
| | | | SEQ ID NO:5504 | SEQ ID NO:13516 | SEQ ID NO:21528 |
| iPS:434263 | 21_225_56H7 | NA | AGCTATAGCATGAAC | TCCATTAGTAGTAGTAGT ACTTACATATACTACGG AGACTCAGTGAAGGGC | GATCGGGCAGCAGC |

FIGURE 49
(Continued)

| | | | | | | |
|---|---|---|---|---|---|---|
| iPS:434265 | 21-225_56H7 | AA | SEQ ID NO:5505 SYSMN | SEQ ID NO:13517 SISSSSTYIYGDSVKG | SEQ ID NO:21529 DRGSS | |
| | | NA | SEQ ID NO:5506 AGTTATAGCATGAAC | SEQ ID NO:13518 TCCATTAGTAGTGGTAGTAGT AGTTACATAAACTACAC AGACTCAGTGAAGGGC | SEQ ID NO:21530 GTGGCTGGCTTTGACTAC | |
| iPS:434267 | 21-225_57B2 | AA | SEQ ID NO:5507 SYSMN | SEQ ID NO:13519 SISGSSSYINYTDSVKG | SEQ ID NO:21531 VAGFDY | |
| | | NA | SEQ ID NO:5508 AGTTACTACTGGAGC | SEQ ID NO:13520 CGCATCTATACCAGGGG GAGCACCAACTACAACC CCTCCCTCAAGAGT | SEQ ID NO:21532 GAGGGAAAACTGGGGGGG TTTCTTACTTTGACTAC | |
| iPS:434269 | 21-225_57F2 | AA | SEQ ID NO:5509 SYYWS | SEQ ID NO:13521 RIYTRGSTNYNPSLKS | SEQ ID NO:21533 EGKTGGVSYFDY | |
| | | NA | SEQ ID NO:5510 AGCTATGGCATGCAC | SEQ ID NO:13522 GCTATATGGTATGATGG AAGTAATAAATACTATG CAGACTCCGTGAAGGGC | SEQ ID NO:21534 GATTATGGTATAGTGGGAGC TACATATTTTGACTAC | |
| iPS:434269 | 21-225_57H3 | AA | SEQ ID NO:5511 SYGMH | SEQ ID NO:13523 AIWYDGSNKYYADSVKG | SEQ ID NO:21535 DYGIVGATYFDY | |
| | | NA | SEQ ID NO:5512 GACTATGGCATGCAC | SEQ ID NO:13524 GTTATATGGTATGCTGGA AGTAATAAATACTATGT AGACTCCGTGAAGGGC | SEQ ID NO:21536 GAACTGGGGATGAGGTCTGA CTAC | |
| iPS:434271 | 21-225_57A4 | AA | SEQ ID NO:5513 DYGMH | SEQ ID NO:13525 VIWYAGSNKYYVDSVKG | SEQ ID NO:21537 ELGMRSDY | |

FIGURE 49
(Continued)

| | | | | | |
|---|---|---|---|---|---|
| iPS:434273 | 21-225_57E4 | NA | SEQ ID NO:5514<br>AGCTATGCCATGAGC | SEQ ID NO:13526<br>GTTATTAGTGGTAGTGGT<br>GGTAGTACATTCTACGC<br>AGACTCCGTGAAGGGC | SEQ ID NO:21538<br>AGGGACTGGAACGACGTTTT<br>TGACTAC |
| | | AA | SEQ ID NO:5515<br>SYAMS | SEQ ID NO:13527<br>VISGSGGSTFYADSVKG | SEQ ID NO:21539<br>RDWNDVFDY |
| iPS:434275 | 21-225_57F4 | NA | SEQ ID NO:5516<br>GACTACTACATGAAC | SEQ ID NO:13528<br>TACATTAGTAGTAGTGGT<br>AGTACCATATACTACG<br>AGACTCTGTGAAGGGC | SEQ ID NO:21540<br>GATATGATTACG |
| | | AA | SEQ ID NO:5517<br>DYYMN | SEQ ID NO:13529<br>YISSSGSTIYYADSVKG | SEQ ID NO:21541<br>DMIT |
| iPS:434277 | 21-225_57A7 | NA | SEQ ID NO:5518<br>GGCTACCATATATACAC | SEQ ID NO:13530<br>TGGATCAACCTAACAA<br>TAATGGCACAAACTATG<br>CACAGAAGTTTCAGGGC | SEQ ID NO:21542<br>GATGGGAGAAGTGGTTTTGA<br>CTAC |
| | | AA | SEQ ID NO:5519<br>GYHIH | SEQ ID NO:13531<br>WINPNNNGTNYAQKFQG | SEQ ID NO:21543<br>DGRSGFDY |
| iPS:434279 | 21-225_57F7 | NA | SEQ ID NO:5520<br>AGCTATGCCATGAGC | SEQ ID NO:13532<br>GCTATTAGTGGTAGTGGT<br>GGTAACACATTCTACGC<br>AGACTCCGTGAAGGGC | SEQ ID NO:21544<br>TTTTTCGGTGTAGTGGGAGT<br>CGGGTGCTTTGACTAC |
| | | AA | SEQ ID NO:5521<br>SYAMS | SEQ ID NO:13533<br>AISGSGGNTFYADSVKG | SEQ ID NO:21545<br>FFGVVGVGCFDY |
| iPS:434281 | 21-225_57B8 | NA | SEQ ID NO:5522<br>AGCTATGCCATGAGC | SEQ ID NO:13534<br>GCTATTAGTGGTAGTGGT<br>GGTAACACATTCTACGC<br>AGACTCCGTGAAGGGC | SEQ ID NO:21546<br>TTGGAACTGGGGATCTTTGA<br>CTAC |

FIGURE 49
(Continued)

| | | | | | | |
|---|---|---|---|---|---|---|
| | 21-225_57B8 | AA | SEQ ID NO:5523 SYAMS | SEQ ID NO:13535 AISGSGGNTFYADSVKG | SEQ ID NO:21547 LELGIFDY | |
| iPS:434283 | | NA | SEQ ID NO:5524 AACTATGCCATGAGC | SEQ ID NO:13536 GCTAGCAGTGGTAGTGG TGGTAACACATTCTACGC AGACTCCGTGACGGGC | SEQ ID NO:21548 CTGGGGAAGGACTACCACTA CTACGGTATGGACGTC | |
| | 21-225_57F8 | AA | SEQ ID NO:5525 NYAMS | SEQ ID NO:13537 ASSGSGGNTFYADSVTG | SEQ ID NO:21549 LGKDYHYYGMDV | |
| iPS:434285 | | NA | SEQ ID NO:5526 AATTATGATATCAAC | SEQ ID NO:13538 TGGATGAACCCTAACAG TGTTAACACAGGCTATG CACAGAAGTTCCAGGGC | SEQ ID NO:21550 AGCAGTGGCTGGAACTGGTT CGACCCC | |
| | 21-225_57A11 | AA | SEQ ID NO:5527 NYDIN | SEQ ID NO:13539 WMNPNSVNTGYAQKFQG | SEQ ID NO:21551 SSGWNWFDP | |
| iPS:434287 | | NA | SEQ ID NO:5528 AATTATGATATCAAC | SEQ ID NO:13540 TGGATGAACCCTAACAG TGTAACACAGGCTATG CACAGAAGTTCCAGGGC | SEQ ID NO:21552 AGCAGTGGCTGGTACCGGTT CGACCCC | |
| | 21-225_57F12 | AA | SEQ ID NO:5529 NYDIN | SEQ ID NO:13541 WMNPNSGNTGYAQKFQG | SEQ ID NO:21553 SSGWYRFDP | |
| iPS:434289 | | NA | SEQ ID NO:5530 AGCTACGCCATGAGC | SEQ ID NO:13542 GCTATTAGTGGTAGTGGT GGTAACACATTCTACGG AGACTCCGTGAAGGGC | SEQ ID NO:21554 TTTTTCGGTATAGTGGGTGC CGGGTACTTGACTAC | |
| | 21-225_57H12 | AA | SEQ ID NO:5531 SYAMS | SEQ ID NO:13543 AISGSGGNTFYGDSVKG | SEQ ID NO:21555 FFGIVGAGYFDY | |
| | | | SEQ ID NO:5532 | SEQ ID NO:13544 | SEQ ID NO:21556 | |

FIGURE 49
(Continued)

| | | | | | |
|---|---|---|---|---|---|
| iPS:434291 | 21-225_58A4 | NA | AGCTACGCCATGAGC | GCTATTAGTGGTAGTGGT GGTAACACATTCTACGG AGACTCCGTGAAGGGC | TTTTTCGGTATAGTGGGAGC CGGGTTCTTTGACTCC |
| | | | SEQ ID NO:5533 | SEQ ID NO:13545 | SEQ ID NO:21557 |
| | | AA | SYAMS | AISGSGGNTFYGDSVKG | FFGIVGAGFFDS |
| | | | SEQ ID NO:5534 | SEQ ID NO:13546 | SEQ ID NO:21558 |
| iPS:434293 | 21-225_58F5 | NA | GACTATGGCATGCAC | GTTATATATGGTATGCTGGA AGTAATAAATACCATGT AGACTCCGTGAAGGGC | GAACTGGGGATGAGGTCTGA CTAC |
| | | | SEQ ID NO:5535 | SEQ ID NO:13547 | SEQ ID NO:21559 |
| | | AA | DYGMH | VIWYAGSNKYHVDSVKG | ELGMRSDY |
| iPS:434295 | 21-225_58B9 | NA | AATTATGATATCAAC | TGGATGAACCCTAACAG TGGTAGCACAGGCTATG CACAGAAGTTCCAGGGC | AGCAGTGGCTGGTACTACTT TGACTAC |
| | | | SEQ ID NO:5536 | SEQ ID NO:13548 | SEQ ID NO:21560 |
| | | AA | NYDIN | WMNPNSGSTGYAQKFQG | SSGWYYFDY |
| | | | SEQ ID NO:5537 | SEQ ID NO:13549 | SEQ ID NO:21561 |
| iPS:434297 | 21-225_58A10 | NA | AGCTATGCCATGAGC | GCTATTAGTGGTAGTGGT GGTAACACATTCTACGC AGACTCCGTGAAGGGC | TTTTTCGGTATAGTGGGAGC CGGGTACTTTGACTAC |
| | | | SEQ ID NO:5538 | SEQ ID NO:13550 | SEQ ID NO:21562 |
| | | AA | SYAMS | AISGSGGNTFYADSVKG | FFGIVGAGYFDY |
| | | | SEQ ID NO:5539 | SEQ ID NO:13551 | SEQ ID NO:21563 |
| | | | SEQ ID NO:5540 | SEQ ID NO:13552 | SEQ ID NO:21564 |

FIGURE 49
(Continued)

| | | | | | |
|---|---|---|---|---|---|
| iPS:434299 | 21-225_58D11 | NA | GACTATGGCATGAGC<br>SEQ ID NO:5541 | GTTATATGGTATGATGG<br>AAGTAAAAATATATG<br>CAGACTCCGTGAAGGGC<br>SEQ ID NO:13553 | GATCGGGTCACTTTTGACTA<br>C<br>SEQ ID NO:21565 |
| | | AA | DYDIH<br>SEQ ID NO:5542 | VIWYDGSKKYYADSVKG<br>SEQ ID NO:13554 | DRVTFDY<br>SEQ ID NO:21566 |
| iPS:434301 | 21-225_58F11 | NA | AGCTATGCCATGAGC<br>SEQ ID NO:5543 | GCTATTAGTGGTAGTGGT<br>GGTAACACATTCTACGC<br>AGACTCCGTGAAGGGC<br>SEQ ID NO:13555 | TTTTTCGGTATGGTGGGAGC<br>CGGATTCTTTGACTAC<br>SEQ ID NO:21567 |
| | | AA | SYAMS<br>SEQ ID NO:5544 | AISGSGGNTFYADSVKG<br>SEQ ID NO:13556 | FFGMVGAGFFDY<br>SEQ ID NO:21568 |
| iPS:434303 | 21-225_58H11 | NA | AGCTATGGCATGCAC<br>SEQ ID NO:5545 | GGTATAGCAGCAGCTGGGA<br>CGGGGGTATGGACGTC<br>SEQ ID NO:13557 | GTTATATGGTATGATGG<br>AAGTAATAAATACCATG<br>CAGACTCCGTGAAGGGC<br>SEQ ID NO:21569 |
| | | AA | SYGMH<br>SEQ ID NO:5546 | VIWYDGSNKYHADSVKG<br>SEQ ID NO:13558 | RYSSSWDGGMDV<br>SEQ ID NO:21570 |
| iPS:434305 | 21-225_59E1 | NA | AATTATGATATCAAC<br>SEQ ID NO:5547 | TGGATGACTCCTAACAG<br>TGGTAACACAGGCTATG<br>CACAGAAGTTCCAGGGC<br>SEQ ID NO:13559 | AGCAGTGGCTGGTACTTCTT<br>TGACTAC<br>SEQ ID NO:21571 |
| | | AA | NYDIN<br>SEQ ID NO:5548 | WMTPNSGNTGYAQKFQG<br>SEQ ID NO:13560 | SSGWYFFDY<br>SEQ ID NO:21572 |

FIGURE 49
(Continued)

| | | | | | | |
|---|---|---|---|---|---|---|
| iPS:434307 | 21-225_59B2 | NA | GGCTACTATATACAC | | TGGATCAACCTAACAGTGGTGGCACAAACTATGCACAGAAGTTTCAGGGC | | GATCCGGGGCCCTTTGACTAC |
| | | | SEQ ID NO:5549 | | SEQ ID NO:13561 | | SEQ ID NO:21573 |
| | | AA | GYYIH | | WINPNSGGTNYAQKFQG | | DPGPFDY |
| | | | SEQ ID NO:5550 | | SEQ ID NO:13562 | | SEQ ID NO:21574 |
| iPS:434309 | 21-225_59B5 | NA | AGCTATGCCATGAAC | | GCTATTAGTGGTAGTGGTGGTAACACATTCTACGCAGACTCCGTGAAGGGC | | AGGGGGGTCTACGGTGACTACGGAGGCTTTGATATC |
| | | | SEQ ID NO:5551 | | SEQ ID NO:13563 | | SEQ ID NO:21575 |
| | | AA | SYAMN | | AISGSGGNTFYADSVKG | | RGVYGDYEAFDI |
| | | | SEQ ID NO:5552 | | SEQ ID NO:13564 | | SEQ ID NO:21576 |
| iPS:434311 | 21-225_59H5 | NA | AGCTATGGCATGCAC | | GTTATATGGTATGATGGAAGTAATAAATACTATGCAGACTCCGTGAAGGGC | | GAGAGGGTATAGCAGTGGGGTATACGGTATGGACGTC |
| | | | SEQ ID NO:5553 | | SEQ ID NO:13565 | | SEQ ID NO:21577 |
| | | AA | SYGMH | | VIWYDGSNKYYADSVKG | | ERGIAVGYYGMDV |
| | | | SEQ ID NO:5554 | | SEQ ID NO:13566 | | SEQ ID NO:21578 |
| iPS:434313 | 21-225_59E6 | NA | AGAAGTAGTTACTACTGGGGC | | AATATCTATTATAGTGGGAGCACCTACTACAACCCGTCCCTCAAGAGT | | CATAGCAGCAGTGGTCCCTTGACTAC |
| | | | SEQ ID NO:5555 | | SEQ ID NO:13567 | | SEQ ID NO:21579 |
| | | AA | RSSYYWG | | NIYYSGSTYYNPSLKS | | HSSSWSLDY |
| | | | SEQ ID NO:5556 | | SEQ ID NO:13568 | | SEQ ID NO:21580 |
| iPS:434315 | 21-225_59G7 | NA | GGCCACTATATACAC | | TGGATCAACCGAACAGTGGTGGCACAAACTATGTACAGAAATTTCAGGGC | | GGGGGCCTACTGGGAGCTACCAACTACTACTACGGTATGGACGTC |

FIGURE 49
(Continued)

| | | | | | | | |
|---|---|---|---|---|---|---|---|
| iPS:434317 | 21-225_59E8 | AA | SEQ ID NO:5557 GHYIH | SEQ ID NO:13569 WINPNSGGTNYVQKFQG | SEQ ID NO:21581 GGLLGATNYYYGMDV | | |
| | | NA | SEQ ID NO:5558 AGCTATAGCATGAAT | SEQ ID NO:13570 TACATTAGTAGTAGTAGT GGGACCATATACTACGC AGACTCTGTGAAGGGC | SEQ ID NO:21582 GAATGGGGAATGGCAGTGGC TGGCCCGTTTGACTAC | | |
| iPS:434319 | 21-225_59B9 | AA | SEQ ID NO:5559 SYSMN | SEQ ID NO:13571 YISSSSGTIYYADSVKG | SEQ ID NO:21583 EWGMAVAGPFDY | | |
| | | NA | SEQ ID NO:5560 GGCAATTATATACAC | SEQ ID NO:13572 TGGATCAACCCTAACAG TGGTGGCACAAACTATG TACAGAAGTTCAGGGC | SEQ ID NO:21584 GGGGGCCTACTGGGAGCTAC CTACTACTACTACGGTA TGGACGTC | | |
| iPS:434321 | 21-225_59F10 | AA | SEQ ID NO:5561 GNYIH | SEQ ID NO:13573 WINPNSGGTNYVQKFQG | SEQ ID NO:21585 GGLLGATYYYYGMDV | | |
| | | NA | SEQ ID NO:5562 AATTATGATATCAAC | SEQ ID NO:13574 TGGATGAACCCTAACAG TGGTAACACAGGCTATG CACAGAAGTTCCAGGGC | SEQ ID NO:21586 AGCAGTGGCTGGTACTACTT TGACTAC | | |
| iPS:434323 | 21-225_62H8 | AA | SEQ ID NO:5563 NYDIN | SEQ ID NO:13575 WMNPNSGNTGYAQKFQG | SEQ ID NO:21587 SSGWYYFDY | | |
| | | NA | SEQ ID NO:5564 ACCTATGGCATGCAC | SEQ ID NO:13576 GTTATATGGCATGATGG AAGTGATAAATATTATG TAGACTCCGTGAAGGGC | SEQ ID NO:21588 GAAGACCCGCGCTACCAGCTG CTCTGACTAC | | |
| | | AA | SEQ ID NO:5565 TYGMH | SEQ ID NO:13577 VIWHDGSDKYYVDSVKG | SEQ ID NO:21589 EDPRTSCSDY | | |
| | | | SEQ ID NO:5566 | SEQ ID NO:13578 | SEQ ID NO:21590 | | |

FIGURE 49
(Continued)

| | | | | | |
|---|---|---|---|---|---|
| iPS:434327 | 21-225_63G6 | NA | AGCTATGGCATGCAC | GTTATATGGTATGATGG AAGTAATAAATACTATG CAGACTCCGTGAAGGGC | GATAGCCTCTCGGGTATAGC AGCAGCTTTGACTAC |
| | | | SEQ ID NO:5567 | SEQ ID NO:13579 | SEQ ID NO:21591 |
| | | AA | SYGMH | VIWYDGSNKYYADSVKG | DSLSGIAAAFDY |
| | | | SEQ ID NO:5568 | SEQ ID NO:13580 | SEQ ID NO:21592 |
| iPS:434331 | 21-225_63H8 | NA | AGCTATAACATGAAC | TCCATTAGTGGTAGTAGC ACTTACATGAACTACAC AGACTCAGTGAAGGGC | CTACGTAATTTTGACTAC |
| | | | SEQ ID NO:5569 | SEQ ID NO:13581 | SEQ ID NO:21593 |
| | | AA | SYNMN | SISGSSTYMNYTDSVKG | LRNFDY |
| | | | SEQ ID NO:5570 | SEQ ID NO:13582 | SEQ ID NO:21594 |
| iPS:434333 | 21-225_63C9 | NA | GGCTACTATATGCAC | TGGATCAACCCTAACAG TGGTGGCACAAACTTTG CACAGAAGTTTCAGGGC | GCTCCGGGTGTAGCAGCAGC TGGTTCATGGGGATACTTTG ACTAC |
| | | | SEQ ID NO:5571 | SEQ ID NO:13583 | SEQ ID NO:21595 |
| | | AA | GYYMH | WINPNSGGTNFAQKFQG | APGVAAAGSWGYFDY |
| | | | SEQ ID NO:5572 | SEQ ID NO:13584 | SEQ ID NO:21596 |
| iPS:434335 | 21-225_63C10 | NA | AGCTATGGCATGCAC | GTCATATGGTATGATGG AAGTAATAAATACTATG CAGACTCCGTGAAGGGC | GATGATCCAGATCCTCGGC CGGGGACTAC |
| | | | SEQ ID NO:5573 | SEQ ID NO:13585 | SEQ ID NO:21597 |
| | | AA | SYGMH | VIWYDGSNKYYADSVKG | DDPRSSAGDY |
| | | | SEQ ID NO:5574 | SEQ ID NO:13586 | SEQ ID NO:21598 |

FIGURE 49
(Continued)

| iPS: | Clone | | | | |
|---|---|---|---|---|---|
| iPS:434337 | 21-225_64E1 | NA | AGCTATGGCATGCAC | GTTATATGGTTTGATGAA ACTAATAAATACTATGG AGACTCCGTGAAGGGC | GAGCTTGGGTTCAGCAGTGA CTAT |
| | | | SEQ ID NO:5575 | SEQ ID NO:13587 | SEQ ID NO:21599 |
| | | AA | SYGMH | VIWFDETNKYYGDSVKG | ELGFSSDY |
| | | | SEQ ID NO:5576 | SEQ ID NO:13588 | SEQ ID NO:21600 |
| iPS:434339 | 21-225_64A4 | NA | GATTATGTCATGCAC | GTCATATGGTATGATGG AAGTAATAAATACTATG CAGACTCCGTGAAGGGC | GAAAGGTATAGCAGCAGCTG GTACGACTACGGTATGGACG TC |
| | | | SEQ ID NO:5577 | SEQ ID NO:13589 | SEQ ID NO:21601 |
| | | AA | DYVMH | VIWYDGSNKYYADSVKG | ERYSSSWYDYGMDV |
| | | | SEQ ID NO:5578 | SEQ ID NO:13590 | SEQ ID NO:21602 |
| iPS:434341 | 21-225_64F7 | NA | AGTTACTTCTGGAGC | CGTATCTATACCAGTGG GATCTCCAACTACAATCC CTCCCTCAAGAGT | TTTAGCAGTTGGCTTTTTGAC TAC |
| | | | SEQ ID NO:5579 | SEQ ID NO:13591 | SEQ ID NO:21603 |
| | | AA | SYFWS | RIYTSGISNYNPSLKS | FSSGFFDY |
| | | | SEQ ID NO:5580 | SEQ ID NO:13592 | SEQ ID NO:21604 |
| iPS:434343 | 21-225_64C8 | NA | GACTATGTCATGCAC | GTTATATGGTATGATGG AAGTAATAAATACTATG CAGACTCCATGAAGGGC | GAACGGTATAGCAGCAGTGGCTG GTACGACTACGGTATGGACG TC |
| | | | SEQ ID NO:5581 | SEQ ID NO:13593 | SEQ ID NO:21605 |
| | | AA | DYVMH | VIWYDGSNKYYADSMKG | ERYSSGWYDYGMDV |
| | | | SEQ ID NO:5582 | SEQ ID NO:13594 | SEQ ID NO:21606 |

FIGURE 49
(Continued)

| | | | | |
|---|---|---|---|---|
| iPS:434345 | 21-225_64H9 | NA | ACCTATGGCATGCAC | ATTATATGGTATGATGG AAGTAATAAATACTATG CAGACTCCGTGAAGGGC | GATACATACGATTTTTGGAG TGGTTATTGGGCTAC |
| | | | SEQ ID NO:5583 | SEQ ID NO:13595 | SEQ ID NO:21607 |
| | | AA | TYGMH | HWYDGSNKYYADSVKG | DTYDFWSGYLGY |
| | | | SEQ ID NO:5584 | SEQ ID NO:13596 | SEQ ID NO:21608 |
| iPS:434347 | 21-225_64H10 | NA | GGCTACTATATGCAC | TGGATCAAACCAAACAG TGGTGGCACAAACCAAG CACAGAAGTTTCAGGGC | GCTCCGGGTACTGCAGCAAC TGGTACATGGGGATACTTTG ACTAC |
| | | | SEQ ID NO:5585 | SEQ ID NO:13597 | SEQ ID NO:21609 |
| | | AA | GYYMH | WIKPNSGGTNQAQKFQG | APGTAATGTWGYFDY |
| | | | SEQ ID NO:5586 | SEQ ID NO:13598 | SEQ ID NO:21610 |
| iPS:434351 | 21-225_64A12 | NA | AGCTATGGCATGCAC | GTTATATGGTATGATGA AAGTAATAAATACTATG TAGACTCCGTGAAGGGC | GAACTCGGGTTCCTCTCTGA CCAC |
| | | | SEQ ID NO:5587 | SEQ ID NO:13599 | SEQ ID NO:21611 |
| | | AA | SYGMH | VIWYDESNKYYVDSVKG | ELGFLSDH |
| | | | SEQ ID NO:5588 | SEQ ID NO:13600 | SEQ ID NO:21612 |
| iPS:434353 | 21-225_64B12 | NA | AGAAGTAGTTACTACTGGGG C | AGTATCTATTACAGTGG GAGCACCTCCTACAACC CGTCCCTCAAGAGT | CTGGACAGTGGCTGGTCCTT TGACTAC |
| | | | SEQ ID NO:5589 | SEQ ID NO:13601 | SEQ ID NO:21613 |
| | | AA | RSSYYWG | SIYYSGSTSYNPSLKS | LDSGWSFDY |
| | | | SEQ ID NO:5590 | SEQ ID NO:13602 | SEQ ID NO:21614 |

FIGURE 49
(Continued)

| | | | | | |
|---|---|---|---|---|---|
| iPS:434355 | 21-225_64G12 | NA | AGTAATGGCCATGAGC | GTTATTAGTAGTGGTAGTGGT GGTAGCACATACTACGC AGACTCCGTGAAGGGC | AGGAACTACGACGATGCTTT TGATATC |
| | | | SEQ ID NO:5591 | SEQ ID NO:13603 | SEQ ID NO:21615 |
| | | AA | SNAMS | VISGSGGSTYYADSVKG | RNYDDAFDI |
| | | | SEQ ID NO:5592 | SEQ ID NO:13604 | SEQ ID NO:21616 |
| iPS:434357 | 21-225_65C1 | NA | GACTATGGCATGCAC | GTGATATGGTTGAGGG AAGTAATAAACACTATA CAGACTCCGTGAAGGGC | GAACTTGGGTTCAGCAGTGA CTAC |
| | | | SEQ ID NO:5593 | SEQ ID NO:13605 | SEQ ID NO:21617 |
| | | AA | DYGMH | VIWFEGSNKHYTDSVKG | ELGFSSDY |
| | | | SEQ ID NO:5594 | SEQ ID NO:13606 | SEQ ID NO:21618 |
| iPS:434359 | 21-225_65G3 | NA | GGCTACTATATACAC | TGGATCAACCTAACAG TGGTGGCACAAACTCTG CACAGAAGTTTCAGGGC | GCTCCGGGTAAAGCAGCAGC TGGTACATGGGGATACTTTG ACTAC |
| | | | SEQ ID NO:5595 | SEQ ID NO:13607 | SEQ ID NO:21619 |
| | | AA | GYYIH | WINPNSGGTNSAQKFQG | APGKAAGTWGYFDY |
| | | | SEQ ID NO:5596 | SEQ ID NO:13608 | SEQ ID NO:21620 |
| iPS:434361 | 21-225_65D5 | NA | AGCTATGGTATCAGT | TGGATCAGCGCTTACAG TGGTAACACAAACTATG CACAGAAGCTCCAGGGC | GGGGAAGCAGTGGCTGTCTT CGACCCC |
| | | | SEQ ID NO:5597 | SEQ ID NO:13609 | SEQ ID NO:21621 |
| | | AA | SYGIS | WISAYSGNTNYAQKLQG | GEAVAVFDP |
| | | | SEQ ID NO:5598 | SEQ ID NO:13610 | SEQ ID NO:21622 |
| iPS:434363 | 21_225_65A6 | NA | AACTATGGCATGCAC | GTTATATGGTATGATGG AAGTAATAAATACTATG GAGACTCCGTGAAGGGC | GATCAGGGCATAGTGGGAGC TACTTGGTTTGACTAC |

FIGURE 49
(Continued)

| | | | | | | |
|---|---|---|---|---|---|---|
| iPS:434367 | 21-225_65A6 | AA | SEQ ID NO:5599<br>NYGMH | SEQ ID NO:13611<br>VIWYDGSNKYYGDSVKG | SEQ ID NO:21623<br>DQGIVGATWFDY | |
| | | NA | SEQ ID NO:5600<br>AGCTATATAGGATGAAC | SEQ ID NO:13612<br>TCCATTAGTAGTAGTAAT<br>AGTTCCATATACTGCA<br>GACTCAGTGAAGGGC | SEQ ID NO:21624<br>ACAAGTGGGAGC | |
| iPS:434369 | 21-225_65H11 | AA | SEQ ID NO:5601<br>SYRMN | SEQ ID NO:13613<br>SISSSNSSIYYADSVKG | SEQ ID NO:21625<br>TSGS | |
| | | NA | SEQ ID NO:5602<br>GGCTACTATATGCAC | SEQ ID NO:13614<br>TGGATCAACCCTAACAG<br>TGGTGGCACAAACAATG<br>CACAGAAGTTCAGGGC | SEQ ID NO:21626<br>GCTCCGGGTACAGCAGCAGC<br>TGGTACATGGGGATACTTTG<br>ACTAC | |
| iPS:434371 | 21-225_66B1 | AA | SEQ ID NO:5603<br>GYYMH | SEQ ID NO:13615<br>WINPNSGGTNNAQKFQG | SEQ ID NO:21627<br>APGTAAAGTWGYFDY | |
| | | NA | SEQ ID NO:5604<br>GGCTACTATATGCAC | SEQ ID NO:13616<br>TGGATCAACCAACAG<br>TGGTGGCACAAACCAAG<br>CACAGAAGTTCCAGGGC | SEQ ID NO:21628<br>GCTCCGGGCACAGTAGCAGC<br>TGGTACATGGGGATACTTTG<br>ACTAT | |
| iPS:434373 | 21-225_66A7 | AA | SEQ ID NO:5605<br>GYYMH | SEQ ID NO:13617<br>WIKPNSGGTNQAQKFQG | SEQ ID NO:21629<br>APGTVAAGTWGYFDY | |
| | | NA | SEQ ID NO:5606<br>GACTATGGCATGCAC | SEQ ID NO:13618<br>GTTATATGGTTTGAGGG<br>AAGTCATAAATACTATA<br>CAGACTCCGTGAAGGGC | SEQ ID NO:21630<br>GAACTTGGGTTCAGCAGTGA<br>CTAC | |
| iPS:434375 | 21-225_66C7 | AA | SEQ ID NO:5607<br>DYGMH | SEQ ID NO:13619<br>VIWFEGSHKYYTDSVKG | SEQ ID NO:21631<br>ELGFSSDY | |
| | | NA | SEQ ID NO:5608 | SEQ ID NO:13620 | SEQ ID NO:21632 | |

FIGURE 49
(Continued)

| iPS: | | | | |
|---|---|---|---|---|
| iPS:434379 | 21-225_66A9 | NA | AGCTATGGCATGCAC<br>SEQ ID NO:5609 | GTTATATGGCATGATGG<br>AAGTGATAAATACTATG<br>CAGACTCCGTGAAGGGC<br>SEQ ID NO:13621 | GAAGACCCGCGTACCAGTTG<br>TTCTGACTAC<br>SEQ ID NO:21633 |
| | | AA | SYGMH<br>SEQ ID NO:5610 | VIWHDGSDKYYADSVKG<br>SEQ ID NO:13622 | EDPRTSCSDY<br>SEQ ID NO:21634 |
| iPS:434383 | 21-225_66F9 | NA | AGCTATAGCATGAAC<br>SEQ ID NO:5611 | TCCATTAGTGGTACTAGT<br>AGTTACATATACCGC<br>AGACTCAGTGAAGGGC<br>SEQ ID NO:13623 | ACCAATGCTTTTGATATC<br>SEQ ID NO:21635 |
| | | AA | SYSMN<br>SEQ ID NO:5612 | SISGTSSYIYYADSVKG<br>SEQ ID NO:13624 | TNAFDI<br>SEQ ID NO:21636 |
| iPS:434385 | 21-225_66C10 | NA | AGCTATGTTATGAGC<br>SEQ ID NO:5613 | GGTATTAGTGGTAGTGG<br>TGCTAGAACATACTACG<br>CAGACTCCGTGAAGGGC<br>SEQ ID NO:13625 | CTGGGGATAGACTACTACTA<br>CGGTATGGACGTC<br>SEQ ID NO:21637 |
| | | AA | SYVMS<br>SEQ ID NO:5614 | GISGSGARTYYADSVKG<br>SEQ ID NO:13626 | LGIDYYYGMDV<br>SEQ ID NO:21638 |
| iPS:434387 | 21-225_66D11 | NA | AGTTATGGCATGCAC<br>SEQ ID NO:5615 | GTTATATGGTATGATGG<br>AAGTAATAAATACTATG<br>CAGACTCCGTGAAGGGC<br>SEQ ID NO:13627 | GAGATGTATAGCAGCAACTG<br>GTACGACTACGGTTTGGACG<br>TC<br>SEQ ID NO:21639 |
| | | AA | SYGMH<br>SEQ ID NO:5616 | VIWYDGSNKYYADSVKG<br>SEQ ID NO:13628 | EMYSSNWYDYGLDV<br>SEQ ID NO:21640 |

FIGURE 49
(Continued)

| | | | | | |
|---|---|---|---|---|---|
| iPS:434389 | 21-225_66F11 | NA | GGCTACCATATGCAC | TGGATCAACCCTAACAATGGTGGCACACACTATGCACAGAAGTTTCAGGAC | GATAGTAGAAGTTCGTGGACTAC |
| | | | SEQ ID NO:5617 | SEQ ID NO:13629 | SEQ ID NO:21641 |
| | | AA | GYHMH | WINPNNGGTHYAQKFQD | DSRSSWDY |
| | | | SEQ ID NO:5618 | SEQ ID NO:13630 | SEQ ID NO:21642 |
| iPS:434393 | 21-225_67C3 | NA | AGTTATATGGCATGCAC | GCTATATGGTATGATGGAAGTAATAAATATTATGGAGACTCCGTGAAGGGC | GATCAGGGCATAGTGGGAGCTACTTGTTTGACTAC |
| | | | SEQ ID NO:5619 | SEQ ID NO:13631 | SEQ ID NO:21643 |
| | | AA | SYGMH | AIWYDGSNKYYGDSVKG | DQGIVGATWFDY |
| | | | SEQ ID NO:5620 | SEQ ID NO:13632 | SEQ ID NO:21644 |
| iPS:434397 | 21-225_67H4 | NA | GGCTACTATATGCAC | TGGATCAAACCAACAGTGGTGGCACAAACCAAGCACAGAAGTTTCAGGGC | GCTCCGGGTACTGCAGCAACTGGTACATGGGGATACTTTG ACTAC |
| | | | SEQ ID NO:5621 | SEQ ID NO:13633 | SEQ ID NO:21645 |
| | | AA | GYYMH | WIKPNSGGTNQAQKFQG | APGTAATGTWGYFDY |
| | | | SEQ ID NO:5622 | SEQ ID NO:13634 | SEQ ID NO:21646 |
| iPS:434399 | 21-225_67B7 | NA | AACTATGGCATGCAC | GTTATATTATATGATGGAAGTAAGAAATACTATGCAGACTCCGTGAAGGGC | AGTATCCCGGAATTTGACTAT |
| | | | SEQ ID NO:5623 | SEQ ID NO:13635 | SEQ ID NO:21647 |
| | | AA | NYGMH | VILYDGSKKYYADSVKG | SIPEFDY |
| | | | SEQ ID NO:5624 | SEQ ID NO:13636 | SEQ ID NO:21648 |

FIGURE 49
(Continued)

| | | | | | |
|---|---|---|---|---|---|
| iPS:434405 | 21-225_68E6 | NA | AGCTTTGGCATGAAC | TACATTAGTAGAAGTAG TAGTCACATATACGC AGACTCAGTGAAGGGC | TCTAGTGGGAGCCCCTTTGA CTAC |
| | | | SEQ ID NO:5625 | SEQ ID NO:13637 | SEQ ID NO:21649 |
| | | AA | SFGMN | YISRSSHIYYADSVKG | SSGSPFDY |
| | | | SEQ ID NO:5626 | SEQ ID NO:13638 | SEQ ID NO:21650 |
| iPS:434407 | 21-225_68G8 | NA | AGCTATAGCATGAAC | TCCATTAGTGGTAGTAGT AGTTACATATATTACGCA GACTCAGTGATGGGC | GTCAACAGCTTTGACTCC |
| | | | SEQ ID NO:5627 | SEQ ID NO:13639 | SEQ ID NO:21651 |
| | | AA | SYSMN | SISGSSYIYYADSVMG | VNSFDS |
| | | | SEQ ID NO:5628 | SEQ ID NO:13640 | SEQ ID NO:21652 |
| iPS:434411 | 21-225_68F11 | NA | GACTATGGCATGCAC | GTTATATGGTATGATGTA AGTATAAATACTATGC AGACTCCGTGAAGGGC | GAACTGGGGATGACCTCTGA CTGC |
| | | | SEQ ID NO:5629 | SEQ ID NO:13641 | SEQ ID NO:21653 |
| | | AA | DYGMH | VIWYDVSNKYYADSVKG | ELGMTSDC |
| | | | SEQ ID NO:5630 | SEQ ID NO:13642 | SEQ ID NO:21654 |
| iPS:434413 | 21-225_68D12 | NA | AGAAGTAGTTACTACTGGGG C | AATATCTATTATAGTGGG AGCACCTATTACATCCCG TCCCTCAAGAGT | CATAGCACCAGCTGGTCCAT TGACTAC |
| | | | SEQ ID NO:5631 | SEQ ID NO:13643 | SEQ ID NO:21655 |
| | | AA | RSSYYWG | NIYYSGSTYYIPSLKS | HSTSWSIDY |
| | | | SEQ ID NO:5632 | SEQ ID NO:13644 | SEQ ID NO:21656 |
| iPS:434417 | 21-225_69C8 | NA | AACTATGCCATGCAC | GTTATATGGTATGATGG AAGTGATAAATACTATG CAGACTCCGTGAAGGGC | GATATCCCTAGCAACTCGGC GGGGACTAC |
| | | | SEQ ID NO:5633 | SEQ ID NO:13645 | SEQ ID NO:21657 |

FIGURE 49
(Continued)

| | | | | | |
|---|---|---|---|---|---|
| | | AA | NYAMH | VIWYDGSDKYYADSVKG | DIPSNSAGDY |
| | | | SEQ ID NO:5634 | SEQ ID NO:13646 | SEQ ID NO:21658 |
| iPS:434423 | 21-225_70D1 | NA | GGCTACCATATGCAC | TGGATCAACCCTAACAGTAATGCCACAAACTATGCACAGAAGTTTCAGGGC | GATAGCATATCGTCGTGGGACTAC |
| | | | SEQ ID NO:5635 | SEQ ID NO:13647 | SEQ ID NO:21659 |
| | | AA | GYHMH | WINPNSNATNYAQKFQG | DSISSWDY |
| | | | SEQ ID NO:5636 | SEQ ID NO:13648 | SEQ ID NO:21660 |
| iPS:434425 | 21-225_70A5 | NA | AGCTATGGCATGCAC | GTTATATGGTATGATGGAAGTAATAAATACTATGCAGACTCCGTGAAGGGC | GATCAGGGCATAGTGGGAGCTACTTGGTTTGACTAC |
| | | | SEQ ID NO:5637 | SEQ ID NO:13649 | SEQ ID NO:21661 |
| | | AA | SYGMH | VIWYDGSNKYYADSVKG | DQGIVGATWFDY |
| | | | SEQ ID NO:5638 | SEQ ID NO:13650 | SEQ ID NO:21662 |
| iPS:434427 | 21-225_70D6 | NA | GGCTACTATATGCAC | TGGATCAACCCTAAGAGTGGTGGCACAAACTCTGCACAGAAGTTTCAGGGC | GCTCCGGGTAAAGCAGCAGCTGGTACATGGGGATTCTTTGACTAC |
| | | | SEQ ID NO:5639 | SEQ ID NO:13651 | SEQ ID NO:21663 |
| | | AA | GYYMH | WINPKSGGTNSAQKFQG | APGKAAAGTWGFFDY |
| | | | SEQ ID NO:5640 | SEQ ID NO:13652 | SEQ ID NO:21664 |
| iPS:434429 | 21-225_70H6 | NA | AGTTATGGCATGCAC | GTTATATGGCATGATGGAAGTAATAAATACTATGCAGACTCCGTGAAGGGC | GATGATCCCAGATCCTCGGCCGGGGACTAC |
| | | | SEQ ID NO:5641 | SEQ ID NO:13653 | SEQ ID NO:21665 |
| | | AA | SYGMH | VIWHDGSNKYYADSVKG | DDPRSSAGDY |

FIGURE 49 (Continued)

| | | | | | | |
|---|---|---|---|---|---|---|
| iPS:434431 | 21-225_70E7 | NA | SEQ ID NO:5642 AATTATGATATCAAC | SEQ ID NO:13654 TGGATGCACCCTAACAG TGGTAACACAGGCTATG CACAGAAGTTCCAGGGC | SEQ ID NO:21666 AGCAGTGGCTGGTACGTCTT TGACTAC | |
| | | AA | SEQ ID NO:5643 NYDIN | SEQ ID NO:13655 WMHPNSGNTGYAQKFQG | SEQ ID NO:21667 SSGWYVFDY | |
| iPS:434433 | 21-225_70E8 | NA | SEQ ID NO:5644 AGCTATGGCATGCTC | SEQ ID NO:13656 ATTATATGGTATGATGA AAGTAATAAATACTATG CAGACTCCGTGAAGGGC | SEQ ID NO:21668 GACCTACTGGACCCACGGGA CTAC | |
| | | AA | SEQ ID NO:5645 SYGML | SEQ ID NO:13657 IIWYDESNKYYADSVKG | SEQ ID NO:21669 DLLDPRDY | |
| iPS:434435 | 21-225_70G9 | NA | SEQ ID NO:5646 GGCTACTATATGCAC | SEQ ID NO:13658 TGGATCAAACCTAACAG TGGTGGCACAAACCAAG CACAGAAGTTTCAGGGC | SEQ ID NO:21670 GCTCCGGGTATAGCAGCAGC TGGTACATGGGGATACTTTG ACTAC | |
| | | AA | SEQ ID NO:5647 GYYMH | SEQ ID NO:13659 WIKPNSGGTNQAQKFQG | SEQ ID NO:21671 APGIAAAGTWGYFDY | |
| iPS:434437 | 21-225_70A12 | NA | SEQ ID NO:5648 GGCTACTATATGCAC | SEQ ID NO:13660 TGGATCAAACCAAACAG TGGTGGCACAAACCAAG CACAGAAGTTTCAGGGC | SEQ ID NO:21672 GCTCCGGGTACTGCAGCAAC TGGTACATGGGGATACTTTG ACTAC | |
| | | AA | SEQ ID NO:5649 GYYMH | SEQ ID NO:13661 WIKPNSGGTNQAQKFQG | SEQ ID NO:21673 APGTAATGTWGYFDY | |
| | | | SEQ ID NO:5650 | SEQ ID NO:13662 | SEQ ID NO:21674 | |

FIGURE 49
(Continued)

| | | | | | |
|---|---|---|---|---|---|
| iPS:434439 | 21-225_70E12 | NA | AGCTATAGCATGAAC | TCCATTAGTAGTGGTAATAGT ACTTACATATACTACACA GACTCAGTGAAGGGC | GTGGCCGCCTTTGACTGC |
| | | | SEQ ID NO:5651 | SEQ ID NO:13663 | SEQ ID NO:21675 |
| | | AA | SYSMN | SISGNSTYIYYTDSVKG | VAAFDC |
| | | | SEQ ID NO:5652 | SEQ ID NO:13664 | SEQ ID NO:21676 |
| iPS:434441 | 21-225_71A2 | NA | GACTATGGCATGCAC | GTGATATGGTATGATGA AAGTAATAAATACTATG CAGACTCCGTGAAGGGC | GAATTGGGGTGGCAGGATGA TTAC |
| | | | SEQ ID NO:5653 | SEQ ID NO:13665 | SEQ ID NO:21677 |
| | | AA | DYGMH | VIWYDESNKYYADSVKG | ELGWQDDY |
| | | | SEQ ID NO:5654 | SEQ ID NO:13666 | SEQ ID NO:21678 |
| iPS:434443 | 21-225_71G3 | NA | AATTATGATATCAAC | TGGATGCACCCTAACAG TGGTAGCACAGGCTATG CACAGAAGTTCCAGGGC | AGCAGTGGCTGGTACTACTT TGACTAC |
| | | | SEQ ID NO:5655 | SEQ ID NO:13667 | SEQ ID NO:21679 |
| | | AA | NYDIN | WMHPNSGSTGYAQKFQG | SSGWYYFDY |
| | | | SEQ ID NO:5656 | SEQ ID NO:13668 | SEQ ID NO:21680 |
| iPS:434447 | 21-225_71B6 | NA | AACTATGGCATGCAC | GTTATTTGGTATGATAGA ACAAATAAATACTATGC AGACTCCGTGAAGGGC | GAACTGGGGATGTTGTCTGA CTAC |
| | | | SEQ ID NO:5657 | SEQ ID NO:13669 | SEQ ID NO:21681 |
| | | AA | NYGMH | VIWYDRTNKYYADSVKG | ELGMLSDY |
| | | | SEQ ID NO:5658 | SEQ ID NO:13670 | SEQ ID NO:21682 |

FIGURE 49
(Continued)

| | | | | | |
|---|---|---|---|---|---|
| iPS:434449 | 21-225_71H6 | NA | AGCTATAGCATGAAC | TCCATTAGTAGTGGTACTAGTAGTTACATATACTACGCAGACTCAGTGAAGGGC | ACCAATGCTTTTGATATC |
| | | | SEQ ID NO:5659 | SEQ ID NO:13671 | SEQ ID NO:21683 |
| | | AA | SYSMN | SISGTSSYIYYADSVKG | TNAFDI |
| | | | SEQ ID NO:5660 | SEQ ID NO:13672 | SEQ ID NO:21684 |
| iPS:434451 | 21-225_71B7 | NA | GGCTACTATATGCAC | TGGATCAACCCTAACAGTGGTGGCACAAACTCTGCACAGAAGTTTCAGGGC | GCTCCGGGTAAAGCAGCAGCTGGTACATGGGGATTCTTTGACTAC |
| | | | SEQ ID NO:5661 | SEQ ID NO:13673 | SEQ ID NO:21685 |
| | | AA | GYYMH | WINPNSGGTNSAQKFQG | APGKAAAGTWGFFDY |
| | | | SEQ ID NO:5662 | SEQ ID NO:13674 | SEQ ID NO:21686 |
| iPS:434453 | 21-225_71B11 | NA | GACTATGGCATGCAC | GTTATATGGTATGATAGAAATAATACTATGGAGACTCCGTGAAGGGC | GAACTGGGGATGTTGTCTGACTAC |
| | | | SEQ ID NO:5663 | SEQ ID NO:13675 | SEQ ID NO:21687 |
| | | AA | DYGMH | VIWYDRNNKYYGDSVKG | ELGMLSDY |
| | | | SEQ ID NO:5664 | SEQ ID NO:13676 | SEQ ID NO:21688 |
| iPS:434455 | 21-225_72F5 | NA | AGCTATGCCATGATC | ACTATTAGTGGTAGTGGTGGTTACACATACTCCGCAGACTCCGTGAAGGGC | CGTATAGCAGTAGACTGGGACGGAAATGGTACGACCCC |
| | | | SEQ ID NO:5665 | SEQ ID NO:13677 | SEQ ID NO:21689 |
| | | AA | SYAMI | TISGSGGYTYSADSVKG | RIAVTGTEWYDP |
| | | | SEQ ID NO:5666 | SEQ ID NO:13678 | SEQ ID NO:21690 |
| iPS:434457 | 21-225_72G12 | NA | AGCTATGGCATGCAC | GTTATATGGTTTGATGAAAGTAATAAATACTATGCAGACTCCGTGAAGGGC | GAGCTTGGTTTCAGCAGTGACTAC |

FIGURE 49
(Continued)

| | | | | | | | |
|---|---|---|---|---|---|---|---|
| iPS:434459 | 21-225_71A7 | AA | SEQ ID NO:5667<br>SYGMH | SEQ ID NO:13679<br>VIWFDESNKYYADSVKG | SEQ ID NO:21691<br>ELGFSSDY |
| | | NA | SEQ ID NO:5668<br>GGCTACTATATGCAC | SEQ ID NO:13680<br>TGGATCAACCCTAAAAG<br>TGGTGGCACAAATTATG<br>TACAGAAGTTTCAGGGC | SEQ ID NO:21692<br>GCTCCGGGTACAGCACCAGC<br>TGGGTCATGGGGATACTTTG<br>ACTAC |
| iPS:434461 | 21-225_73A3 | AA | SEQ ID NO:5669<br>GYYMH | SEQ ID NO:13681<br>WINPKSGGTNYVQKFQG | SEQ ID NO:21693<br>APGTAPAGSWGYFDY |
| | | NA | SEQ ID NO:5670<br>GGCTACTATATGCAC | SEQ ID NO:13682<br>TGGATCAACCCTAAAAG<br>TGGTGGCACGAATCATG<br>TCCAGAAGTTTCAGGGC | SEQ ID NO:21694<br>GCTCCGGGTACAGCAGCAGC<br>TGGGTCATGGGGATGCTTTG<br>ACTAC |
| iPS:434463 | 21-225_73A6 | AA | SEQ ID NO:5671<br>GYYMH | SEQ ID NO:13683<br>WINPKSGGTNHVQKFQG | SEQ ID NO:21695<br>APGTAAAGSWGCFDY |
| | | NA | SEQ ID NO:5672<br>TACTATGGCATGCAC | SEQ ID NO:13684<br>GTTATATTATATGATGGA<br>AGTAAGAAATACTATGC<br>AGCCTCCGTGAAGGGC | SEQ ID NO:21696<br>AGTATCCGGACTTTGACTA<br>C |
| iPS:434465 | | AA | SEQ ID NO:5673<br>YYGMH | SEQ ID NO:13685<br>VILYDGSKKYYAASVKG | SEQ ID NO:21697<br>SIPDFDY |
| | | NA | SEQ ID NO:5674<br>AGCAATGCCATGAGC | SEQ ID NO:13686<br>GACATTAGTCGTAGTGG<br>TGGTACCACATTCTACGC<br>AGACTCCGTGAAGGGC | SEQ ID NO:21698<br>TGGGATAGCAGCAGCTGGTA<br>CGACGTGACTCCCTTTGACT<br>AC |
| iPS:434467 | 21-225_73H8 | AA | SEQ ID NO:5675<br>SNAMS | SEQ ID NO:13687<br>DISRSGTTFYADSVKG | SEQ ID NO:21699<br>WDSSSWYDVTPFDY |
| | | | SEQ ID NO:5676 | SEQ ID NO:13688 | SEQ ID NO:21700 |

FIGURE 49
(Continued)

| | | | | |
|---|---|---|---|---|
| iPS:434469 | 21-225_73C9 | NA | AATTATGTCATGCAC | GTTATATGTGTATGATGGAAGTAATAAATACTATGCAGACTCCGTGAAGGGC | GAAAGGTATAGCAGCAGCTGGTTCGACTACGGTATGGACGTC |
| | | | SEQ ID NO:5677 | SEQ ID NO:13689 | SEQ ID NO:21701 |
| | | AA | NYVMH | VIWYDGSNKYYADSVKG | ERYSSSWFDYGMDV |
| | | | SEQ ID NO:5678 | SEQ ID NO:13690 | SEQ ID NO:21702 |
| iPS:434471 | 21-225_75G3 | NA | GGTTCCTACTGGAGC | GAAATCAATCTTAGTGGAAGTACCAACTACAACCCGTCCCTCAAGAGT | GACTACGGTGGCCTTGACTAC |
| | | | SEQ ID NO:5679 | SEQ ID NO:13691 | SEQ ID NO:21703 |
| | | AA | GSYWS | EINLSGSTNYNPSLKS | DYGGLDY |
| | | | SEQ ID NO:5680 | SEQ ID NO:13692 | SEQ ID NO:21704 |
| iPS:434473 | 21-225_76D1 | NA | GGTTGCTACTGGAGC | GAAATCAATCATAGTGGAAGAACCAACTACAACCCGTCCCTCAAGAGT | GACTACGGGCGGTATGGACGTC |
| | | | SEQ ID NO:5681 | SEQ ID NO:13693 | SEQ ID NO:21705 |
| | | AA | GCYWS | EINHSGRTNYNPSLKS | DYGGMDV |
| | | | SEQ ID NO:5682 | SEQ ID NO:13694 | SEQ ID NO:21706 |
| iPS:434475 | 21-225_74B9 | NA | AATTATGATATCAAC | TGGATGAACCCTAACAGTGGTAACACAGGCTGTGCACAGAAGTTCCAGGGC | AGCAGTGGCTGGAACTTCTTTGACTAC |
| | | | SEQ ID NO:5683 | SEQ ID NO:13695 | SEQ ID NO:21707 |
| | | AA | NYDIN | WMNPNSGNTGCAQKFQG | SSGWNFFDY |
| | | | SEQ ID NO:5684 | SEQ ID NO:13696 | SEQ ID NO:21708 |
| iPS:434477 | | NA | AATTATGATATCAAC | TGGATGCACCCTAACAGTGGTAACACAGGCTATGCACAGAAGTTCCGGGGC | AGCAGTGGCTGGTACTACTTTGACTAC |

FIGURE 49
(Continued)

| | | | | | | | |
|---|---|---|---|---|---|---|---|
| iPS:434479 | 21-225_74A6 | AA | SEQ ID NO:5685 NYDIN | SEQ ID NO:13697 WMHPNSGNTGYAQKFRG | SEQ ID NO:21709 SSGWYYFDY |
| | | NA | SEQ ID NO:5686 AATTATGATATCAAC | SEQ ID NO:13698 TGGATGCACCCTAACAG TGGTAACACAGGCTATG CACAGAAGTTCCAGGGC | SEQ ID NO:21710 AGTAGTGGCTGGTACTGGTT CGACCCC |
| iPS:434481 | 21-225_76H11 | AA | SEQ ID NO:5687 NYDIN | SEQ ID NO:13699 WMHPNSGNTGYAQKFQG | SEQ ID NO:21711 SSGWYWFDP |
| | | NA | SEQ ID NO:5688 AATTATGATATCAAC | SEQ ID NO:13700 TGGATGCACCCTAACAG TGGTAACACAGGCTTTG CACAGAAGTTCCAGGGC | SEQ ID NO:21712 TCCAGTGGCTGGTACTGGTT CGACCCC |
| iPS:434483 | 21-225_74B10 | AA | SEQ ID NO:5689 NYDIN | SEQ ID NO:13701 WMHPNSGNTGFAQKFQG | SEQ ID NO:21713 SSGWYWFDP |
| | | NA | SEQ ID NO:5690 AATTATGATATCAAC | SEQ ID NO:13702 TGGATGAACCCTAACAG TGGTAACACAGGCTATG CACAGAAGTTCCAGGGC | SEQ ID NO:21714 AGCAGTGGCTGGTACTGGTT CGACCCC |
| iPS:434485 | 21-225_74C12 | AA | SEQ ID NO:5691 NYDIN | SEQ ID NO:13703 WMNPNSGNTGYAQKFQG | SEQ ID NO:21715 SSGWYWFDP |
| | | NA | SEQ ID NO:5692 AGCTATGGCATGCAC | SEQ ID NO:13704 GTTATTTGGTATGATGGA AGTAATAAATACTATGC AGACTCCGTGAAGGGC | SEQ ID NO:21716 GATGCAATATAGTGGGAGC TACTTACTTTGAGTCC |
| | 21-225_76D2 | | SEQ ID NO:5693 | SEQ ID NO:13705 | SEQ ID NO:21717 |

FIGURE 49
(Continued)

| | | AA | SYGMH | VIWYDGSNKYYADSVKG | DRNIVGATYFES |
|---|---|---|---|---|---|
| iPS:434487 | | | SEQ ID NO:5694 | SEQ ID NO:13706 | SEQ ID NO:21718 |
| | 21-225_76G2 | NA | AATTATGATATCAAC | TGGATGAACCCTAACAGTGGTAACACAGGCTATGCACAGAAGTTCCAGGGC | AGCAGTGGCTGGTACATGTTTGACTAC |
| | | | SEQ ID NO:5695 | SEQ ID NO:13707 | SEQ ID NO:21719 |
| | | AA | NYDIN | WMNPNSGNTGYAQKFQG | SSGWYMFDY |
| iPS:434489 | | | SEQ ID NO:5696 | SEQ ID NO:13708 | SEQ ID NO:21720 |
| | 21-225_74E4 | NA | AGTAGTAATTACTACTGGGGC | AGTATCTATTATAGTGGATACACCTCCTACAACCCGTCCCTCAAGAGT | CTTGACTCTAACTGGGGTCTTGACTAC |
| | | | SEQ ID NO:5697 | SEQ ID NO:13709 | SEQ ID NO:21721 |
| | | AA | SSNYYWG | SIYYSGYTSYNPSLKS | LDSNWGLDY |
| | | | SEQ ID NO:5698 | SEQ ID NO:13710 | SEQ ID NO:21722 |
| iPS:434493 | | AA | NYDIN | WMNPNSGNTGYAQKFQG | SSGWNWFDP |
| | 21-225_76F3 | NA | AATTATGATATCAAC | TGGATGAACCCTAACAGTGGTAACACAGGCTATGCACAGAAGTTCCAGGGC | TCCAGTGGCTGGAACTGGTTCGACCCC |
| | | | SEQ ID NO:5699 | SEQ ID NO:13711 | SEQ ID NO:21723 |
| | | AA | NYDIN | WMNPNSGNTGYAQKFQG | SSGWNWFDP |
| iPS:434495 | | | SEQ ID NO:5700 | SEQ ID NO:13712 | SEQ ID NO:21724 |
| | 21-225_74B2 | NA | GGTCCCTACTGGAGC | GAAATCAATCATAGTGGAAGCACCAACTACAACCCGTCCCTCACGAGT | GACTACGGGGGTTTGGACGTC |
| | | | SEQ ID NO:5701 | SEQ ID NO:13713 | SEQ ID NO:21725 |
| | | AA | GPYWS | EINHSGSTNYNPSLTS | DYGGLDV |
| | | | SEQ ID NO:5702 | SEQ ID NO:13714 | SEQ ID NO:21726 |

FIGURE 49
(Continued)

| | | | | |
|---|---|---|---|---|
| iPS:434497 | 21-225_76A4 | NA | GGTTGCTACTGGAGC | GAAATCAATCATAGTGG AAGCACCAACTACAACC CGTCCCTCAAGAGT | GACTACGGGCGGTATGGACGT C |
| | | | SEQ ID NO:5703 | SEQ ID NO:13715 | SEQ ID NO:21727 |
| | | AA | GCYWS | EINHSGSTNYNPSLKS | DYGGMDV |
| | | | SEQ ID NO:5704 | SEQ ID NO:13716 | SEQ ID NO:21728 |
| iPS:434501 | 21-225_76G4 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5705 | SEQ ID NO:13717 | SEQ ID NO:21729 |
| | | AA | GCYWS | EINHSGSTNYNPSLKS | DYGGMDV |
| | | | SEQ ID NO:5706 | SEQ ID NO:13718 | SEQ ID NO:21730 |
| iPS:434503 | 21-225_74D7 | NA | AGAAGTAGTTACTACTGGGG C | GGTATCTATTATAGTGGG AGCACCTCCTACAACCC GTCCCTCAAGAGT | CTGCGACCTAACTGGGACTT TGACTAC |
| | | | SEQ ID NO:5707 | SEQ ID NO:13719 | SEQ ID NO:21731 |
| | | AA | RSSYYWG | GIYYSGSTSYNPSLKS | LRPNWDFDY |
| | | | SEQ ID NO:5708 | SEQ ID NO:13720 | SEQ ID NO:21732 |
| iPS:434507 | 21-225_74C5 | NA | GGTTGCTACTGGAGC | GAAATCAATCATAGTGG ATGCACCAACTTCAACC CGTCCCTCAAGAGT | GACTACGGCGGTATGGACGT C |
| | | | SEQ ID NO:5709 | SEQ ID NO:13721 | SEQ ID NO:21733 |
| | | AA | GCYWS | EINHSGCTNFNPSLKS | DYGGMDV |
| | | | SEQ ID NO:5710 | SEQ ID NO:13722 | SEQ ID NO:21734 |
| iPS:434509 | 21-225_76F5 | NA | AATTATGATATCAAC | TGGATGAACCTAACAG TGGTAACACAGGCTATG CACAGAAGTTCCAGGGC | AGCAGTGGCTGGTACTGGTT CGACCCC |
| | | | SEQ ID NO:5711 | SEQ ID NO:13723 | SEQ ID NO:21735 |
| | | AA | NYDIN | WMNPNSGNTGYAQKFQG | SSGWYWFDP |

FIGURE 49
(Continued)

| | | | | | |
|---|---|---|---|---|---|
| iPS:434511 | 21-225_74B11 | NA | SEQ ID NO:5712<br>AATTATGATATCAAC | SEQ ID NO:13724<br>TGGATGCACCCTAACAG<br>TGGTAACACAGGCTATG<br>CACAGAAGTTCCAGGGC | SEQ ID NO:21736<br>AGCAGTGGCTGGTACTACTT<br>TGACTAC |
| | | AA | SEQ ID NO:5713<br>NYDIN | SEQ ID NO:13725<br>WMHPNSGNTGYAQKFQG | SEQ ID NO:21737<br>SSGWYYFDY |
| iPS:434513 | 21-225_76A6 | NA | SEQ ID NO:5714<br>AATTATGATATCAAC | SEQ ID NO:13726<br>TGGATGCACCCTAACAA<br>TGGTAACACAGGCTATG<br>CACAGAAGTTCCAGGGC | SEQ ID NO:21738<br>AGCAGTGGCTGGTACTGGTT<br>CGACCCC |
| | | AA | SEQ ID NO:5715<br>NYDIN | SEQ ID NO:13727<br>WMHPNNGNTGYAQKFQG | SEQ ID NO:21739<br>SSGWYWFDP |
| iPS:434515 | 21-225_74A5 | NA | SEQ ID NO:5716<br>AATTATGATATCAAC | SEQ ID NO:13728<br>TGGATGCACCCTAACAG<br>TGGTAACACAGGCTATG<br>CACAGAAGTTCCAGGGC | SEQ ID NO:21740<br>AGTAGTGGCTGGTACTGGTT<br>CGACCCC |
| | | AA | SEQ ID NO:5717<br>NYDIN | SEQ ID NO:13729<br>WMHPNSGNTGYAQKFQG | SEQ ID NO:21741<br>SSGWYWFDP |
| iPS:434517 | 21-225_76A7 | NA | SEQ ID NO:5718<br>GGTTGCTACTGGAGC | SEQ ID NO:13730<br>GAAATCAATCATAGTGG<br>AAGGACCAACTACAACC<br>CGTCCCTCAAGAGT | SEQ ID NO:21742<br>GACTACGGTGGGCTTGACTA<br>C |
| | | AA | SEQ ID NO:5719<br>GCYWS | SEQ ID NO:13731<br>EINHSGRTNYNPSLKS | SEQ ID NO:21743<br>DYGGLDY |
| | | | SEQ ID NO:5720 | SEQ ID NO:13732 | SEQ ID NO:21744 |

FIGURE 49
(Continued)

| | | | | | |
|---|---|---|---|---|---|
| iPS:434519 | 21-225_74C7 | NA | GGTTCCTACTGGAGC | GAAATCAATCTTAGTGG AAGCACCAACTACAACC CGTCCCTCAAGAGT | GACTACGGTGGCCTTGACTA C |
| | | AA | SEQ ID NO:5721<br>GSYWS | SEQ ID NO:13733<br>EINLSGSTNYNPSLKS | SEQ ID NO:21745<br>DYGGLDY |
| iPS:434523 | 21-225_75C3 | NA | SEQ ID NO:5722<br>GGTTGCTACTGGAGC | SEQ ID NO:13734<br>GAAATCAATTATAGTGG AAGAACCAACTACAACC CGTCCCTCAAGAGT | SEQ ID NO:21746<br>GACTACGGCGGTATGGACGT C |
| | | AA | SEQ ID NO:5723<br>GCYWS | SEQ ID NO:13735<br>EINYSGRTNYNPSLKS | SEQ ID NO:21747<br>DYGGMDV |
| iPS:434525 | 21-225_76E8 | NA | SEQ ID NO:5724<br>AATTATGATATCAAC | SEQ ID NO:13736<br>TGGATGAACCTAACAG TGGTAACACAGGCTATG CACAGAAGTTCCAGGGC | SEQ ID NO:21748<br>TCCAGTGGCTGGCACTGGTT CGACCCC |
| | | AA | SEQ ID NO:5725<br>NYDIN | SEQ ID NO:13737<br>WMNPNSGNTGYAQKFQG | SEQ ID NO:21749<br>SSGWHWFDP |
| iPS:434529 | 21-225_76B9 | NA | SEQ ID NO:5726<br>AATTATGATATCAAC | SEQ ID NO:13738<br>TGGATGCACCCTAACAG TGGTAACACAGGCTATG CACAGAAGTTCCAGGGC | SEQ ID NO:21750<br>AGTAGTGGCTGGTACTGGTT CGACCCC |
| | | AA | SEQ ID NO:5727<br>NYDIN | SEQ ID NO:13739<br>WMHPNSGNTGYAQKFQG | SEQ ID NO:21751<br>SSGWYWFDP |
| iPS:434531 | 21_225_76C9 | NA | SEQ ID NO:5728<br>AACGCCCTGGATGAAC | SEQ ID NO:13740<br>CGTATTAAAAACAAAGC TGATGGTGGGACAACAG ACTTCGCTGCACCCGTGA AAGGC | SEQ ID NO:21752<br>GTGGGACCTACTACGGACTA C |

FIGURE 49
(Continued)

| | | | | | | |
|---|---|---|---|---|---|---|
| iPS:434533 | 21-225_76C9 | AA | SEQ ID NO:5729 NAWMN | SEQ ID NO:13741 RIKNKADGGTTDFAAPVK G | SEQ ID NO:21753 VGPTIDY | |
| | | NA | SEQ ID NO:5730 GGTCCCTACTGGAGC | SEQ ID NO:13742 GAAATCAATCATAGTGG AAGCACCAACTACAACC CGTCCCTCAAGAGT | SEQ ID NO:21754 GACTACGGGGGTTTGGACGT C | |
| iPS:434535 | 21-225_85F7 | AA | SEQ ID NO:5731 GPYWS | SEQ ID NO:13743 EINHSGSTNYNPSLKS | SEQ ID NO:21755 DYGGLDV | |
| | | NA | SEQ ID NO:5732 AGCTATGGCATGCAC | SEQ ID NO:13744 GTTATATGGTATGATGG AAGTAATAAAAACTATG CAGACTCCGTGAAGGGC | SEQ ID NO:21756 GATGGCAGCTATGGTTATGA CGGCCTTGACTAC | |
| iPS:434537 | 21-225_74C8 | AA | SEQ ID NO:5733 SYGMH | SEQ ID NO:13745 VIWYDGSNKYYADSVKG | SEQ ID NO:21757 DGSYGYDGLDY | |
| | | NA | SEQ ID NO:5734 AGCTATGGCATGCAC | SEQ ID NO:13746 GTTATTGGTATGATGGA AGTAATAAATACTATGC AGACTCCGTGAAGGGC | SEQ ID NO:21758 GATCGCAATATAGTGGGAGC TACTTACTTTGAGTCC | |
| iPS:434539 | 21-225_74E11 | AA | SEQ ID NO:5735 SYGMH | SEQ ID NO:13747 VIWYDGSNKYYADSVKG | SEQ ID NO:21759 DRNIVGATYFES | |
| | | NA | SEQ ID NO:5736 GATTACTACTGGAGC | SEQ ID NO:13748 GAAATCAATCATAGTGG AGACACCAACTACAACC CGTCCCTCAAGAGT | SEQ ID NO:21760 GAGTTCCATATAGTGGAAG CTACCTCTACTACTACGGTA TGGACGTC | |
| | 21-225_74A2 | | SEQ ID NO:5737 | SEQ ID NO:13749 | SEQ ID NO:21761 | |

FIGURE 49
(Continued)

| | | | | | | |
|---|---|---|---|---|---|---|
| iPS:434547 | 21-225_74H5 | AA | DYYWS<br>SEQ ID NO:5738 | EINHSGDTNYNPSLKS<br>SEQ ID NO:13750 | EFPYSGSYLYYYGMDV<br>SEQ ID NO:21762 |
| | | NA | GGTTGCTACTGGAGC<br>SEQ ID NO:5739 | GAAATCAATCATAGTGG<br>AAGGACCAACTTCAACC<br>CGTCCCTCAAGAGT<br>SEQ ID NO:13751 | GACTACGGCGGGTATGGACGT<br>C<br>SEQ ID NO:21763 |
| iPS:434549 | 21-225_76E11 | AA | GCYWS<br>SEQ ID NO:5740 | EINHSGRTNFNPSLKS<br>SEQ ID NO:13752 | DYGGMDV<br>SEQ ID NO:21764 |
| | | NA | AATTATGATATCAAC<br>SEQ ID NO:5741 | TGGATGAACCCTAACAG<br>TGGTAACACAGGCTATG<br>CACAGAAGTTCCAGGGC<br>SEQ ID NO:13753 | AGCAGTGGCTGGTACTACTT<br>TGACTAC<br>SEQ ID NO:21765 |
| iPS:434551 | 21-225_75C4 | AA | NYDIN<br>SEQ ID NO:5742 | WMNPNSGNTGYAQKFQG<br>SEQ ID NO:13754 | SSGWYYFDY<br>SEQ ID NO:21766 |
| | | NA | AATTATGATATCAAC<br>SEQ ID NO:5743 | TGGATGCATCCTAACAG<br>TGGTAACACAGGCTATG<br>CACAGAAGTTCCAGGGC<br>SEQ ID NO:13755 | AGCAGTGGCTGGTACTACTT<br>TGACTAC<br>SEQ ID NO:21767 |
| iPS:434559 | 21-225_74B11 | AA | NYDIN<br>SEQ ID NO:5744 | WMHPNSGNTGYAQKFQG<br>SEQ ID NO:13756 | SSGWYYFDY<br>SEQ ID NO:21768 |
| | | NA | GGTTGCTACTGGAGC<br>SEQ ID NO:5745 | GAAATCAATCATAGTGG<br>AAGCACCAACTACAACC<br>CGTCCCTCAAGAGT<br>SEQ ID NO:13757 | GACTACGGCGGGTATGGACGT<br>C<br>SEQ ID NO:21769 |
| | | AA | GCYWS<br>SEQ ID NO:5746 | EINHSGSTNYNPSLKS<br>SEQ ID NO:13758 | DYGGMDV<br>SEQ ID NO:21770 |

FIGURE 49
(Continued)

| | | | | | | |
|---|---|---|---|---|---|---|
| iPS:434561 | 21-225_77G1 | NA | GGTTGCTACTGGAGC | | GAAATCAATCATAGTGG AAGCACCAACTACAACC CGTCCCTCAAGAGT | GACTACGGGCGGTATGGACGT C |
| | | | SEQ ID NO:5747 | | SEQ ID NO:13759 | SEQ ID NO:21771 |
| | | AA | GCYWS | | EINHSGSTNYNPSLKS | DYGGMDV |
| | | | SEQ ID NO:5748 | | SEQ ID NO:13760 | SEQ ID NO:21772 |
| iPS:434563 | 21-225_75D8 | NA | AACTACGACATGCAC | | GCTATTGGTACTGCTGGT GACACATACTATCCAGG CTCCGTGAAGGGC | GTTCTTGACTACGGTGACTC CTTGGGCTACTACTACTACG GTATGGACGTC |
| | | | SEQ ID NO:5749 | | SEQ ID NO:13761 | SEQ ID NO:21773 |
| | | AA | NYDMH | | AIGTAGDTYYPGSVKG | VLDYGDSLGYYYYGMDV |
| | | | SEQ ID NO:5750 | | SEQ ID NO:13762 | SEQ ID NO:21774 |
| iPS:434565 | 21-225_75B10 | NA | GGTTACTACTGGAGC | | GAAATCAATCATAGTGG AAGCACCAACTACAACC CGTCCCTCAAGAGT | GACTACGGTGGTTTGGACGT C |
| | | | SEQ ID NO:5751 | | SEQ ID NO:13763 | SEQ ID NO:21775 |
| | | AA | GYYWS | | EINHSGSTNYNPSLKS | DYGGLDV |
| | | | SEQ ID NO:5752 | | SEQ ID NO:13764 | SEQ ID NO:21776 |
| iPS:434569 | 21-225_77H5 | NA | AATTATGGCATGCAC | | GTTATATGGTATGATGG AAGAAATAAATACTATG CAGACTCCGTGAAGGGC | GATCGGAGTATATGGGAGC TACTTCTTTGACTAC |
| | | | SEQ ID NO:5753 | | SEQ ID NO:13765 | SEQ ID NO:21777 |
| | | AA | NYGMH | | VIWYDGRNKYYADSVKG | DRSILGATFFDY |
| | | | SEQ ID NO:5754 | | SEQ ID NO:13766 | SEQ ID NO:21778 |
| iPS:434571 | 21-225_74D2 | NA | GGTTGCTACTGGAGC | | GAAATCAATCATAGTGG AAGGACCAACTACAACC CGTCCCTCAAGAGT | GACTACGGTGGGCTTGACTA C |
| | | | SEQ ID NO:5755 | | SEQ ID NO:13767 | SEQ ID NO:21779 |

FIGURE 49
(Continued)

| | | | | | | |
|---|---|---|---|---|---|---|
| | | AA | GCYWS | | EINHSGRTNYNPSLKS | DYGGLDY |
| iPS:434573 | | | SEQ ID NO:5756 | | SEQ ID NO:13767 | SEQ ID NO:21780 |
| | 21-225_77E6 | NA | AGTTATGGCATGCAC | | GTTATATGGTATGATGG AAGTAATCAAAACTATG CAGACTCCGTGAAGGGC | GATGGCAGCTATGGTTACGA CGGCCTTGACTAC |
| | | | SEQ ID NO:5757 | | SEQ ID NO:13769 | SEQ ID NO:21781 |
| | | AA | SYGMH | | VIWYDGSNQNYADSVKG | DGSYGYDGLDY |
| iPS:434575 | | | SEQ ID NO:5758 | | SEQ ID NO:13770 | SEQ ID NO:21782 |
| | 21-225_77C7 | NA | AATTATGATATCAAC | | TGGATGAACCCTAACAG TGGTAACACAGGCTATG CACAGAAGTTCCAGGGC | TCCAGTGGCTGGCACTGGTT CGACCCC |
| | | | SEQ ID NO:5759 | | SEQ ID NO:13771 | SEQ ID NO:21783 |
| | | AA | NYDIN | | WMNPNSGNTGYAQKFQG | SSGWHWFDP |
| iPS:434579 | | | SEQ ID NO:5760 | | SEQ ID NO:13772 | SEQ ID NO:21784 |
| | 21-225_77F7 | NA | GGTTGCTACTGGAGC | | GAAATCAATCATAGTGG AAGCACCAACTACAACC CGTCCCTCAAGAGT | GACTACGGCGGGTATGGACGT C |
| | | | SEQ ID NO:5761 | | SEQ ID NO:13773 | SEQ ID NO:21785 |
| | | AA | GCYWS | | EINHSGSTNYNPSLKS | DYGGMDV |
| iPS:434581 | | | SEQ ID NO:5762 | | SEQ ID NO:13774 | SEQ ID NO:21786 |
| | 21-225_74B12 | NA | GGTTGCTACTGGAGC | | GAAATCAATCATAGTGG AAGCACCAACTACAACC CGTCCCTCAAGAGT | GACTACGGCGGGTATGGACGT C |
| | | | SEQ ID NO:5763 | | SEQ ID NO:13775 | SEQ ID NO:21787 |
| | | AA | GCYWS | | EINHSGSTNYNPSLKS | DYGGMDV |
| | | | SEQ ID NO:5764 | | SEQ ID NO:13776 | SEQ ID NO:21788 |

FIGURE 49
(Continued)

| | | | | | | |
|---|---|---|---|---|---|---|
| iPS:434583 | 21-225_74B6 | NA | AATTATGATATCAAC SEQ ID NO:5765 | TGGATGCACCCTAACAA TGGTAACACAGGCTATG CACAGAAGTTCCAGGGC SEQ ID NO:13777 | AGCAGTGGCTGGTACTGGTT CGACCCC SEQ ID NO:21789 | |
| | | AA | NYDIN SEQ ID NO:5766 | WMHPNSGNTGYAQKFQG SEQ ID NO:13778 | SSGWYWFDP SEQ ID NO:21790 | |
| iPS:434585 | 21-225_75A12 | NA | GGTTGCTACTGGAGC SEQ ID NO:5767 | GAAATCAATTATAGTGG AAGAACCAACTACAACC CGTCCCTCAAGAGT SEQ ID NO:13779 | GACTACGGCGGTATGGACGT C SEQ ID NO:21791 | |
| | | AA | GCYWS SEQ ID NO:5768 | EINYSGRTNYNPSLKS SEQ ID NO:13780 | DYGGMDV SEQ ID NO:21792 | |
| iPS:434587 | 21-225_74G3 | NA | AATTATGATATCAAC SEQ ID NO:5769 | TGGATGCACCCTAACAG TGGTAACACAGGCTATG CACAGAAGTTCCAGGGC SEQ ID NO:13781 | AGTAGTGGCTGGTACTGGTT CGACCCC SEQ ID NO:21793 | |
| | | AA | NYDIN SEQ ID NO:5770 | WMHPNSGNTGYAQKFQG SEQ ID NO:13782 | SSGWYWFDP SEQ ID NO:21794 | |
| iPS:434595 | 21-225_77A10 | NA | GGTTGCTACTGGAGC SEQ ID NO:5771 | GAAATCAATTATAGTGG AAGAACCAACTACAACC CGTCCCTCAAGAGT SEQ ID NO:13783 | GACTACGGCGGTATGGACGT C SEQ ID NO:21795 | |
| | | AA | GCYWS SEQ ID NO:5772 | EINYSGRTNYNPSLKS SEQ ID NO:13784 | DYGGMDV SEQ ID NO:21796 | |
| iPS:434597 | 21-225_77C10 | NA | AATTATGATATCAAC SEQ ID NO:5773 | TGGATGCACCCTAACAG TGGTAACACAGGCTATG CACAGAAGTTCCAGGGC SEQ ID NO:13785 | AGCAGTGGCTGGTACTGGTT CGACCCC SEQ ID NO:21797 | |

FIGURE 49
(Continued)

| | | | | WMHPNSGNTGYAQKFQG | SSGWYWFDP |
|---|---|---|---|---|---|
| iPS:434603 | 21-225_77D11 | AA | NYDIN | SEQ ID NO:13786 | SEQ ID NO:21798 |
| | | NA | SEQ ID NO:5774 AATTATGATATCAAC | TGGATGCACCCTAACAG TGGTAACACAGGCTATG CACAGAAGTTCCAGGGC SEQ ID NO:13787 | AGTAGTGGCTGGTACTGGTT CGACCCC SEQ ID NO:21799 |
| iPS:434611 | 21-225_77C12 | AA | SEQ ID NO:5775 NYDIN | WMHPNSGNTGYAQKFQG SEQ ID NO:13788 | SSGWYWFDP SEQ ID NO:21800 |
| | | NA | SEQ ID NO:5776 GGTTCCTACTGGAGC | GAAATCAATTATAGGGG AAGCACCAACTACAACC CGTCCCTCAAGAGT SEQ ID NO:13789 | GACTACGGCGGTATGGACGT C SEQ ID NO:21801 |
| iPS:434613 | 21-225_77D12 | AA | SEQ ID NO:5777 GSYWS | EINYRGSTNYNPSLKS SEQ ID NO:13790 | DYGGMDV SEQ ID NO:21802 |
| | | NA | SEQ ID NO:5778 AATTATGATATCAAC | TGGATGAACCCTAACAG TGGTAACACAGGCTATG CACAGAAGTTCCAGGGC SEQ ID NO:13791 | AGCAGTGGCTGGTACTGGTT CGACCCC SEQ ID NO:21803 |
| iPS:434615 | 21-225_76C5 | AA | SEQ ID NO:5779 NYDIN | WMNPSGNIGYAQKFQG SEQ ID NO:13792 | SSGWYWFDP SEQ ID NO:21804 |
| | | NA | SEQ ID NO:5780 AGCTATGGCATGCAC | GTTATATGGTATGATGG AAGTAATAAAAACTATG CAGACTCCGTGAAGGGC SEQ ID NO:13793 | GATGGCAGCTATGGTTACGA CGGCCTTGACTAC SEQ ID NO:21805 |
| | | AA | SEQ ID NO:5781 SYGMH | VIWYDGSNKNYADSVKG | DGSYGYDGLDY |

FIGURE 49
(Continued)

| | | | | | | |
|---|---|---|---|---|---|---|
| iPS:434617 | 21-225_74B8 | NA | SEQ ID NO:5782 AATTATGATATCAAC | SEQ ID NO:13794 TGGATGCACCCTAATAGTGGTAACACAGGCTATGCACAGAAGTTCCAGGGC | SEQ ID NO:21806 TCCAGTGGCTGGTACTGGTTCGACCCC | |
| | | AA | SEQ ID NO:5783 NYDIN | SEQ ID NO:13795 WMHPNSGNTGYAQKFQG | SEQ ID NO:21807 SSGWYWFDP | |
| iPS:434619 | 21-225_78C1 | NA | SEQ ID NO:5784 AATTATGATATCAAC | SEQ ID NO:13796 TGGATGCACCCTAACAGTGGTAACACAGGCTATGCACAGAAGTTCCAGGGC | SEQ ID NO:21808 AGCAGTGGCTGGTACTGGTTCGACCCC | |
| | | AA | SEQ ID NO:5785 NYDIN | SEQ ID NO:13797 WMHPNSGNTGYAQKFQG | SEQ ID NO:21809 SSGWYWFDP | |
| iPS:434621 | 21-225_74D1 | NA | SEQ ID NO:5786 AGCTATGGCATGCAC | SEQ ID NO:13798 GTTATATGGTATGATGGAAGTAATAAATACCATGCAGACTCCGTGAAGGGC | SEQ ID NO:21810 GATGAGGGGTTCGGGAGTTCGACTACTACAACTACGGTATGGACGTC | |
| | | AA | SEQ ID NO:5787 SYGMH | SEQ ID NO:13799 VIWYDGSNKYHADSVKG | SEQ ID NO:21811 DEGFGEFDYNYGMDV | |
| iPS:434629 | 21-225_74C3 | NA | SEQ ID NO:5788 AGCTTTGGCATGCAC | SEQ ID NO:13800 GCTATTTGGTATGATGGAAGTAATAAATACTGTGCAGACTCCGTGAAGGGC | SEQ ID NO:21812 GATCGGAGTATACTGGGAGCTGCTTTCTTTGACTAC | |
| | | AA | SEQ ID NO:5789 SFGMH | SEQ ID NO:13801 AIWYDGSNKYCADSVKG | SEQ ID NO:21813 DRSILGAAFFDY | |
| | | | SEQ ID NO:5790 | SEQ ID NO:13802 | SEQ ID NO:21814 | |

FIGURE 49
(Continued)

| | | | | | | |
|---|---|---|---|---|---|---|
| iPS:434633 | 21-225_74G8 | NA | AACGCCTGGATGAAC | | CGTATTAAAAACAAAGC TGATGGTGGGACAACAG ACTACGCTGCACCCGTG AAAGGC | GTGGGAGCTACTACGGACTA C |
| | | | SEQ ID NO:5791 | | SEQ ID NO:13803 | SEQ ID NO:21815 |
| | | AA | NAWMN | | RIKNKADGGTTDYAAPVK G | VGATTDY |
| | | | SEQ ID NO:5792 | | SEQ ID NO:13804 | SEQ ID NO:21816 |
| iPS:434635 | 21-225_78E6 | NA | AATTATGATATCAAC | | TGGATGCACCCTAACAG TGGTAACACAGGCTATG CACAGAAGTTCCAGGGC | AGTAGTGGCTGGTACAAATT TGACTAC |
| | | | SEQ ID NO:5793 | | SEQ ID NO:13805 | SEQ ID NO:21817 |
| | | AA | NYDIN | | WMHPNSGNTGYAQKFQG | SSGWYKFDY |
| | | | SEQ ID NO:5794 | | SEQ ID NO:13806 | SEQ ID NO:21818 |
| iPS:434637 | 21-225_78E7 | NA | GGTTCCTACTGGAGC | | GAAATCAATCTTAGTGG AAGCACCAACTACAACC CGTCCCTCAAGAGT | GACTACGGTGGCCTTGACTA C |
| | | | SEQ ID NO:5795 | | SEQ ID NO:13807 | SEQ ID NO:21819 |
| | | AA | GSYWS | | EINLSGSTNYNPSLKS | DYGGLDY |
| | | | SEQ ID NO:5796 | | SEQ ID NO:13808 | SEQ ID NO:21820 |
| iPS:434639 | 21-225_74B7 | NA | AATTATGATATCAAC | | TGGATGAACCCTAACAG TGGTAACACAGGCTATG CACAGAAGTTCCAGGGC | TCCAGTGGCTGGCACTGGTT CGACCCC |
| | | | SEQ ID NO:5797 | | SEQ ID NO:13809 | SEQ ID NO:21821 |
| | | AA | NYDIN | | WMNPNSGNTGYAQKFQG | SSGWHWFDP |
| | | | SEQ ID NO:5798 | | SEQ ID NO:13810 | SEQ ID NO:21822 |

FIGURE 49
(Continued)

| iPS:434649 | 21-225_78E11 | NA | AATTATGATATCAAC | TGGATGAACCCTAACAGTGGTAACACAGGCTGTGCACAGAAGTTCCAGGGC | AGCAGTGGCTGGAACTTCTTTGACTAC |
| --- | --- | --- | --- | --- | --- |
| | | | SEQ ID NO:5799 | SEQ ID NO:13811 | SEQ ID NO:21823 |
| | | AA | NYDIN | WMNPNSGNTGCAQKFQG | SSGWNFFDY |
| | | | SEQ ID NO:5800 | SEQ ID NO:13812 | SEQ ID NO:21824 |
| iPS:434653 | 21-225_74B5 | NA | AATTATGATATCAAC | TGGATGAACCCTAACAGTGGTAACACAGGCTATGCACAGAAGTTCCAGGGC | TCCAGTGGCTGGAACTGGTTCGACCCC |
| | | | SEQ ID NO:5801 | SEQ ID NO:13813 | SEQ ID NO:21825 |
| | | AA | NYDIN | WMNPNSGNTGYAQKFQG | SSGWNWFDP |
| | | | SEQ ID NO:5802 | SEQ ID NO:13814 | SEQ ID NO:21826 |
| iPS:434655 | 21-225_78H12 | NA | AATTATGATATCAAC | TGGATGAACCCTAACAGTGGTAACACAGGCTATGCACAGAAGTTCCAGGGC | TCCAGTGGCTGGCACTGGTTCGACCCC |
| | | | SEQ ID NO:5803 | SEQ ID NO:13815 | SEQ ID NO:21827 |
| | | AA | NYDIN | WMNPNSGNTGYAQKFQG | SSGWHWFDP |
| | | | SEQ ID NO:5804 | SEQ ID NO:13816 | SEQ ID NO:21828 |
| iPS:434657 | 21-225_79G1 | NA | GGTTGCTACTGGAGC | GAAATCAATCATATGGAAGCACCAACTACAACCCGTCCCTCAAGAGT | GACTACGGCGGGTATGGACGTC |
| | | | SEQ ID NO:5805 | SEQ ID NO:13817 | SEQ ID NO:21829 |
| | | AA | GCYWS | EINHSGSTNYNPSLKS | DYGGMDV |
| | | | SEQ ID NO:5806 | SEQ ID NO:13818 | SEQ ID NO:21830 |
| iPS:434663 | 21_225_79F3 | NA | GGTTGCTACTGGAGC | GAAATCAATCATATGGAAGCACCAACTACAACCCGTCCCTCAAGAGT | GACTACGGCGGGTATGGAGGTC |

FIGURE 49
(Continued)

| | | | | | |
|---|---|---|---|---|---|
| iPS:434665 | 21-225_79F3 | AA | SEQ ID NO:5807 GCYWS | SEQ ID NO:13819 EINHSGSTNYNPSLKS | SEQ ID NO:21831 DYGGMDV |
| | | NA | SEQ ID NO:5808 AATTATGATGTCAAC | SEQ ID NO:13820 TGGATGCACCTAACAGTGGTAACACAGGCTATGCACAGAAGTTCCAGGGC | SEQ ID NO:21832 AGCAGTGGCTGGTACCATTTTGACTAC |
| iPS:434669 | 21-225_74G4 | AA | SEQ ID NO:5809 NYDVN | SEQ ID NO:13821 WMHPNSGNTGYAQKFQG | SEQ ID NO:21833 SSGWYHFDY |
| | | NA | SEQ ID NO:5810 AACTATGGCATGCAC | SEQ ID NO:13822 GTTATATGGTTATGATGGAAGTAATCAAAACTATGCAGACTCCGTGAAGGGC | SEQ ID NO:21834 GATGGCAGCTATGGTTATGACGGCCTTGACTAC |
| | 21-225_79F4 | AA | SEQ ID NO:5811 NYGMH | SEQ ID NO:13823 VIWYDGSNQNYADSVKG | SEQ ID NO:21835 DGSYGYDGLDY |
| iPS:434671 | | NA | SEQ ID NO:5812 AACGCTCTGGATGAAC | SEQ ID NO:13824 CGAATTAAAACAAAATTGATGGTGGGACAACAGACTACGCTGCACCCGTGAAAGGC | SEQ ID NO:21836 GTGGGAGCTACTACGGACTAC |
| | 21-225_74F4 | AA | SEQ ID NO:5813 NAWMN | SEQ ID NO:13825 RIKNKIDGGTTDYAAPVKG | SEQ ID NO:21837 VGATTDY |
| iPS:434673 | 21 225 74E3 | NA | SEQ ID NO:5814 AGCTATGGCATGCAC | SEQ ID NO:13826 GTTATTTGGTATGATGGAAGTAATAAATACTATGCAGACTCCGTGAAGGGC | SEQ ID NO:21838 GATCGCAATATAGTGGGAGCTACTTACTTGAGTCC |

FIGURE 49
(Continued)

| | | AA/NA | | | | |
|---|---|---|---|---|---|---|
| iPS:434675 | 21-225_74E3 | AA | SEQ ID NO:5815 SYGMH | SEQ ID NO:13827 VIWYDGSNKYYADSVKG | SEQ ID NO:21839 DRNIVGATYFES | |
| | | NA | SEQ ID NO:5816 AATTATGATATCAAC | SEQ ID NO:13828 TGGATGCACCCTAACAG TGTAACACAGGCTTTG CACAGAAGTTCCAGGGC | SEQ ID NO:21840 TCCAGTGGCTGCTACTGGTT CGACCCC | |
| iPS:434679 | 21-225_79G6 | AA | SEQ ID NO:5817 NYDIN | SEQ ID NO:13829 WMHPNSGNTGFAQKFQG | SEQ ID NO:21841 SSGWYWFDP | |
| | | NA | SEQ ID NO:5818 AATTATGATATCAAC | SEQ ID NO:13830 TGGATGCACCCTAACAG TGTAACACAGGCTATG CACAGAAGTTCCAGGGC | SEQ ID NO:21842 AGTAGTGGCTGGTACAAATT TGACTAC | |
| iPS:434685 | 21-225_79G7 | AA | SEQ ID NO:5819 NYDIN | SEQ ID NO:13831 WMHPNSGNTGYAQKFQG | SEQ ID NO:21843 SSGWYKFDY | |
| | | NA | SEQ ID NO:5820 AATTATGATCTAAC | SEQ ID NO:13832 TGGATGCATCCTAACAG TGTAACACAGGCTATG CACAGAAGTTCCAGGGC | SEQ ID NO:21844 AGCAGTGGCTGGTACTACTT TGACTAC | |
| | 21-225_79E9 | AA | SEQ ID NO:5821 NYDIN | SEQ ID NO:13833 WMHPNSGNTGYAQKFQG | SEQ ID NO:21845 SSGWYYFDY | |
| iPS:434687 | | NA | SEQ ID NO:5822 GGTTGCTACTGGAGC | SEQ ID NO:13834 GAAATCAATCATAGTGG AAGCACCAACTACAACC CGTCCCTCAAGAGT | SEQ ID NO:21846 GACTACGGCCGGTATGGACGT C | |
| | 21-225_75A5 | AA | SEQ ID NO:5823 GCYWS | SEQ ID NO:13835 EINHSGSTNYNPSLKS | SEQ ID NO:21847 DYGGMDV | |

FIGURE 49
(Continued)

| | | | | | | |
|---|---|---|---|---|---|---|
| iPS:434689 | 21-225_79G10 | NA | SEQ ID NO:5824 AATTATGATATCAAC | SEQ ID NO:13836 TGGATGAACCCTAACAG TGGTAACACAGGCTATG CACAGAAGTTCCAGGGC | SEQ ID NO:21848 TCCAGTGGCTGGAACTGGTT CGACCCC |
| | | AA | SEQ ID NO:5825 NYDIN | SEQ ID NO:13837 WMNPNSGNTGYAQKFQG | SEQ ID NO:21849 SSGWNWFDP |
| iPS:434691 | 21-225_75G7 | NA | SEQ ID NO:5826 GGTTGCTACTGGAGC | SEQ ID NO:13838 GAAATCAATTATAGGGG AAGCACCAACTACAACC CGTCCCTCAAGAGT | SEQ ID NO:21850 GACTACGGCGGTATGGACGT C |
| | | AA | SEQ ID NO:5827 GSYWS | SEQ ID NO:13839 EINYRGSTNYNPSLKS | SEQ ID NO:21851 DYGGMDV |
| iPS:434693 | 21-225_79F11 | NA | SEQ ID NO:5828 GGTTGCTACTGGAGC | SEQ ID NO:13840 GAAATCAATCATAGTGG AAGCACCAACTACAACC CGTCCCTCAAGAGT | SEQ ID NO:21852 GACTACGGCGGTATGGACGT C |
| | | AA | SEQ ID NO:5829 GCYWS | SEQ ID NO:13841 EINHSGSTNYNPSLKS | SEQ ID NO:21853 DYGGMDV |
| iPS:434697 | 21-225_79F12 | NA | SEQ ID NO:5830 AATTATGATATCAAC | SEQ ID NO:13842 TGGATGAACCCTAACAG TGGTAACACAGGCTATG CACAGAAGTTCCAGGGC | SEQ ID NO:21854 AGCAGTGGCTGGTACTTCTT TGACTAC |
| | | AA | SEQ ID NO:5831 NYDIN | SEQ ID NO:13843 WMNPNSGNTGYAQKFQG | SEQ ID NO:21855 SSGWYFFDY |
| iPS:434699 | 21-225_79G12 | NA | SEQ ID NO:5832 GGTTGCTACTGGAGC | SEQ ID NO:13844 GAAATCAATCATAGTGG AAGCACCAACTACAACC CGTCCCTCAAGAGT | SEQ ID NO:21856 GACTACGGCGGTATGGACGT C |

FIGURE 49
(Continued)

| | | | | | | | |
|---|---|---|---|---|---|---|---|
| iPS:434701 | 21-225_79G12 | AA | SEQ ID NO:5833<br>GCYWS | SEQ ID NO:13845<br>EINHSGSTNYNPSLKS | SEQ ID NO:21857<br>DYGGMDV | | |
| | | NA | SEQ ID NO:5834<br>GGTTGCTACTGGAGC | SEQ ID NO:13846<br>GAAATCAATCATAGTGG<br>AAGCACCAACTACAACC<br>CGTCCCTCAAGAGT | SEQ ID NO:21858<br>GACTACGGGCGGTATGGACGT<br>C | | |
| iPS:434703 | 21-225_80A1 | AA | SEQ ID NO:5835<br>GCYWS | SEQ ID NO:13847<br>EINHSGSTNYNPSLKS | SEQ ID NO:21859<br>DYGGMDV | | |
| | | NA | SEQ ID NO:5836<br>GGTTGCTACTGGAGC | SEQ ID NO:13848<br>GAAATCAATCATAGTGG<br>AAGCACCAACTACAACC<br>CGTCCCTCAAGAGT | SEQ ID NO:21860<br>GACTACGGGCGGTATGGACGT<br>C | | |
| iPS:434705 | 21-225_80C1 | AA | SEQ ID NO:5837<br>GCYWS | SEQ ID NO:13849<br>EINHSGSTNYNPSLKS | SEQ ID NO:21861<br>DYGGMDV | | |
| | | NA | SEQ ID NO:5838<br>AATTATGATATCAAC | SEQ ID NO:13850<br>TGGATGCACCCTAACAG<br>TGGTAACACAGGCTATG<br>CACAGAAGTTCCAGGGC | SEQ ID NO:21862<br>AGTAGTGGCTGGTACTGGTT<br>CGACCCC | | |
| iPS:434707 | 21-225_80A2 | AA | SEQ ID NO:5839<br>NYDIN | SEQ ID NO:13851<br>WMHPNSGNTGYAQKFQG | SEQ ID NO:21863<br>SSGWYWFDP | | |
| | | NA | SEQ ID NO:5840<br>AATTATGATATCAAC | SEQ ID NO:13852<br>TGGATGCACCCTAACAG<br>TGGTAACACAGGCTATG<br>CACAGAAGTTCCAGGGC | SEQ ID NO:21864<br>AGCAGTGGCTGGTACTGGTT<br>CGACCCC | | |
| | 21-225_80D3 | AA | SEQ ID NO:5841<br>NYDIN | SEQ ID NO:13853<br>WMHPNSGNTGYAQKFQG | SEQ ID NO:21865<br>SSGWYWFDP | | |
| | | | SEQ ID NO:5842 | SEQ ID NO:13854 | SEQ ID NO:21866 | | |

FIGURE 49
(Continued)

| | | NA | GGTTGCTACTGGAGC | | GAAATCAATCATAGTGG AAGCACCAACTACAACC CGTCCCTCAAGAGT | | GACTACGGGCGGTATGGACGT C | |
|---|---|---|---|---|---|---|---|---|
| iPS:434709 | 21-225_80E3 | | | SEQ ID NO:5843 | | SEQ ID NO:13855 | | SEQ ID NO:21867 |
| | | AA | GCYWS | | EINHSGSTNYNPSLKS | | DYGGMDV | |
| | | | | SEQ ID NO:5844 | | SEQ ID NO:13856 | | SEQ ID NO:21868 |
| iPS:434711 | 21-225_80H3 | NA | AATTATGATATCAAC | | TGGATGAACCCTAACAG TGGTAACACAGGCTATG CACAGAAGTTCCAGGGC | | ACCAGTGGCTGGAACTTCTT TGACTAC | |
| | | | | SEQ ID NO:5845 | | SEQ ID NO:13857 | | SEQ ID NO:21869 |
| | | AA | NYDIN | | WMNPNSGNTGYAQKFQG | | TSGWNFFDY | |
| | | | | SEQ ID NO:5846 | | SEQ ID NO:13858 | | SEQ ID NO:21870 |
| iPS:434715 | 21-225_80D5 | NA | GGTTCCTACTGGAGC | | GAAATCAATCATAGTGG AAGCACCAACTACAACC CGTCCCTCAAGAGT | | GACTACGGGGGTTGGACGT C | |
| | | | | SEQ ID NO:5847 | | SEQ ID NO:13859 | | SEQ ID NO:21871 |
| | | AA | GPYWS | | EINHSGSTNYNPSLKS | | DYGGLDV | |
| | | | | SEQ ID NO:5848 | | SEQ ID NO:13860 | | SEQ ID NO:21872 |
| iPS:434717 | 21-225_80A6 | NA | GGTTGCTACTGGAGC | | GAAATCAATCATAGTGG AAGGACCAACTACAACC CGTCCCTCAAGAGT | | GACTACGGTGGGCTTGACTA C | |
| | | | | SEQ ID NO:5849 | | SEQ ID NO:13861 | | SEQ ID NO:21873 |
| | | AA | GCYWS | | EINHSGRTNYNPSLKS | | DYGGLDY | |
| | | | | SEQ ID NO:5850 | | SEQ ID NO:13862 | | SEQ ID NO:21874 |
| iPS:434725 | 21-225_80H7 | NA | GGTTCCTACTGGAGC | | GAAATCAATCAAAGTGG ACGCACCAACTACAACC CGTCCCTCAAGAGT | | GACTACGGGGGTATAGACGT C | |
| | | | | SEQ ID NO:5851 | | SEQ ID NO:13863 | | SEQ ID NO:21875 |
| | | AA | GSYWS | | EINQSGRTNYNPSLKS | | DYGGIDV | |

FIGURE 49
(Continued)

| | | | | | | |
|---|---|---|---|---|---|---|
| iPS:434729 | 21-225_80B12 | NA | SEQ ID NO:5852 AATTATGATATCAAC | SEQ ID NO:13864 TGGATGAACCCTAACAG TGGTAACACAGGCTATG CACAGAAGTTCCAGGTC | SEQ ID NO:21876 AGCAGTGGCTGGTACATCTT TGACTAC | |
| | | AA | SEQ ID NO:5853 NYDIN | SEQ ID NO:13865 WMNPNSGNTGYAQKFQV | SEQ ID NO:21877 SSGWYIFDY | |
| iPS:434731 | 21-225_80E9 | NA | SEQ ID NO:5854 AATTATGATATCAAC | SEQ ID NO:13866 TGGATGCACCTAACAG TGGTAACACAGGCTATG CACAGAAGTTCCAGGGC | SEQ ID NO:21878 AGCAGTGGCTGGTACTGGTT CGACCCC | |
| | | AA | SEQ ID NO:5855 NYDIN | SEQ ID NO:13867 WMHPNSGNTGYAQKFQG | SEQ ID NO:21879 SSGWYWFDP | |
| iPS:434735 | 21-225_80B10 | NA | SEQ ID NO:5856 GGTTGCTACTGGAGC | SEQ ID NO:13868 GAAATCAATCATAGTGG AAGCACCAACTACAACC CGTCCCTCAAGAGT | SEQ ID NO:21880 GACTACGGGTGGGCTTGACTA C | |
| | | AA | SEQ ID NO:5857 GCYWS | SEQ ID NO:13869 EINHSGSTNYNPSLKS | SEQ ID NO:21881 DYGGLDY | |
| | | | SEQ ID NO:5858 | SEQ ID NO:13870 | SEQ ID NO:21882 | |
| iPS:434737 | 21-225_74G6 | NA | SEQ ID NO:5859 AGCTATGGCATGCAC | SEQ ID NO:13871 GTTATATGGTATGATGG AAGTAATAAAAACTATG CAGACTCCGTGAAGGGC | SEQ ID NO:21883 GATGGCAGTAGTATGGTTATGA CGGCCTGACTAC | |
| | | AA | SEQ ID NO:5860 SYGMH | SEQ ID NO:13872 VIWYDGSNKNYADSVKG | SEQ ID NO:21884 DGSYGYDGLDY | |

FIGURE 49
(Continued)

| | | | | |
|---|---|---|---|---|
| iPS:434741 | 21-225_80C11 | NA | AGCTATGGCATGCAC | GTTATATGTATGATGGAAGTAATAAAAACTATGCAGACTCCGTGAAGGGC | GATGGCAGCTATGGGTATGACGGCCTTGACTAC |
| | | | SEQ ID NO:5861 | SEQ ID NO:13873 | SEQ ID NO:21885 |
| | | AA | SYGMH | VIWYDGSNKNYADSVKG | DGSYGYDGLDY |
| | | | SEQ ID NO:5862 | SEQ ID NO:13874 | SEQ ID NO:21886 |
| iPS:434743 | 21-225_74A4 | NA | GGTTGCTACTGGAGC | GAAATCAATCATAGTGGAAGCACCAACTACAACCCGTCCCTCAAGAGT | GACTACGGCGGTATGGACGTC |
| | | | SEQ ID NO:5863 | SEQ ID NO:13875 | SEQ ID NO:21887 |
| | | AA | GCYWS | EINHSGSTNYNPSLKS | DYGGMDV |
| | | | SEQ ID NO:5864 | SEQ ID NO:13876 | SEQ ID NO:21888 |
| iPS:434747 | 21-225_80C12 | NA | AATTATGATATCAAC | TGGATGCACCCTAACAATGGTAACACAGGTTATGCACAGAAGTTCCAGGGC | AGCAGTGGCTGGTACTGGTTCGACCCC |
| | | | SEQ ID NO:5865 | SEQ ID NO:13877 | SEQ ID NO:21889 |
| | | AA | NYDIN | WMHPNNGNTGYAQKFQG | SSGWYWFDP |
| | | | SEQ ID NO:5866 | SEQ ID NO:13878 | SEQ ID NO:21890 |
| iPS:434751 | 21-225_80H12 | NA | GGTTGCTACTGGAGC | GAAATCAATCATAGTGGAAGCACCAACTACAACCCGTCCCTCAAGAGT | GACTACGGCGGTATGGACGTC |
| | | | SEQ ID NO:5867 | SEQ ID NO:13879 | SEQ ID NO:21891 |
| | | AA | GCYWS | EINHSGSTNYNPSLKS | DYGGMDV |
| | | | SEQ ID NO:5868 | SEQ ID NO:13880 | SEQ ID NO:21892 |
| iPS:434759 | 21_225_81C5 | NA | GGTTGCTACTGGAGC | GAAATCAATCATAGTGGAAGCACCAACTACAACCCGTCCCTCAAGAGT | GACTACGGCGGTATGGACGTC |

FIGURE 49
(Continued)

| | | | | | | |
|---|---|---|---|---|---|---|
| iPS:434761 | ? ? ? ?_? ? ? ? | AA | SEQ ID NO:5869<br>GCYWS | SEQ ID NO:13881<br>EINHSGSTNYNPSLKS | SEQ ID NO:21893<br>DYGGMDV |
| | | NA | SEQ ID NO:5870<br>AATTATGATATCAAC | SEQ ID NO:13882<br>TGGATGAACCCTAACAG<br>TGGTAACACAGGCTATG<br>CACAGAAGTTCCAGGGC | SEQ ID NO:21894<br>TCCAGTGGCTGGAACTGGTT<br>CGACCCC |
| iPS:434771 | 21-225_81E5 | AA | SEQ ID NO:5871<br>NYDIN | SEQ ID NO:13883<br>WMNPNSGNTGYAQKFQG | SEQ ID NO:21895<br>SSGWNWFDP |
| | | NA | SEQ ID NO:5872<br>AATTATGATATCAAC | SEQ ID NO:13884<br>TGGATGCACCCTAACAG<br>TGGTAACACAGGCTATG<br>CACAGAAGTTCCAGGGC | SEQ ID NO:21896<br>AGCAGTGGCTGGTACTGGTT<br>CGACCCC |
| iPS:434773 | 21-225_81F9 | AA | SEQ ID NO:5873<br>NYDIN | SEQ ID NO:13885<br>WMHPNSGNTGYAQKFQG | SEQ ID NO:21897<br>SSGWYWFDP |
| | | NA | SEQ ID NO:5874<br>GGTCCCTACTGGAGC | SEQ ID NO:13886<br>GAAATCAATTATAGGGG<br>AAGCACCAACTACAACC<br>CGTCCCTCAAGAGT | SEQ ID NO:21898<br>GACTACGGCGGGTATGGACGT<br>C |
| iPS:434777 | 21-225_75D9 | AA | SEQ ID NO:5875<br>GPYWS | SEQ ID NO:13887<br>EINYRGSTNYNPSLKS | SEQ ID NO:21899<br>DYGGMDV |
| | | NA | SEQ ID NO:5876<br>GGTTGCTACTGGAGC | SEQ ID NO:13888<br>GAAATCAATCATAGTGG<br>AAGCACCAACTACAACC<br>CGTCCCTCAAGAGT | SEQ ID NO:21900<br>GACTACGGCGGGTATGGACGT<br>C |
| iPS:434777 | 21-225_81C11 | AA | SEQ ID NO:5877<br>GCYWS | SEQ ID NO:13889<br>EINHSGSTNYNPSLKS | SEQ ID NO:21901<br>DYGGMDV |
| | | | SEQ ID NO:5878 | SEQ ID NO:13890 | SEQ ID NO:21902 |

FIGURE 49
(Continued)

| iPS ID | Clone | | Seq 1 | Seq 2 | Seq 3 |
|---|---|---|---|---|---|
| iPS:434793 | 21-225_82A5 | NA | AATTATGATATCAAC | TGGATGCACCCTAACAA TGGTAACACAGGCTATG CACAGAAGTTCCAGGGC | AGCAGTGGCTGGTACTGGTT CGACCCC |
| | | | SEQ ID NO:5879 | SEQ ID NO:13891 | SEQ ID NO:21903 |
| | | AA | NYDIN | WMHPNSGNTGYAQKFQG | SSGWYWFDP |
| | | | SEQ ID NO:5880 | SEQ ID NO:13892 | SEQ ID NO:21904 |
| iPS:434797 | 21-225_82G5 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5881 | SEQ ID NO:13893 | SEQ ID NO:21905 |
| | | AA | NYDIN | WMHPNSGNTGYAQKFQG | SSGWYWFDP |
| | | | SEQ ID NO:5882 | SEQ ID NO:13894 | SEQ ID NO:21906 |
| iPS:434805 | 21-225_82D9 | NA | AATTATGATATCAAC | TGGATGCACCCTAACAG TGGTAACACAGGCTATG CACAGAAGTTCCAGGGC | AGTAGTGGCTGGTACTGGTT CGACCCC |
| | | | SEQ ID NO:5883 | SEQ ID NO:13895 | SEQ ID NO:21907 |
| | | AA | NYDIN | WMHPNSGNTGYAQKFQG | SSGWYWFDP |
| | | | SEQ ID NO:5884 | SEQ ID NO:13896 | SEQ ID NO:21908 |
| iPS:434809 | 21-225_74F5 | NA | GGTTGCTACTGGAGC | GAAATCAATCATATGG AAGCACCAACTACAACC CGTCCCTCAAGAGT | GACTACGGCGGTATGGACGT C |
| | | | SEQ ID NO:5885 | SEQ ID NO:13897 | SEQ ID NO:21909 |
| | | AA | GCYWS | EINHSGSTNYNPSLKS | DYGGMDV |
| | | | SEQ ID NO:5886 | SEQ ID NO:13898 | SEQ ID NO:21910 |
| iPS:434813 | | NA | AATTATGATATCAAC | TGGATGCACCCTAACAA TGGTAACACAGGCTATG CACAGAAGTTCCAGGGC | AGCAGTGGCTGGTACTGGTT CGACCCC |

FIGURE 49 (Continued)

| iPS ID | Clone | Type | CDR1 SEQ ID | CDR1 | CDR2 SEQ ID | CDR2 | CDR3 SEQ ID | CDR3 |
|---|---|---|---|---|---|---|---|---|
| iPS:434815 | 21-225_82C12 | AA | SEQ ID NO:5887 | NYDIN | SEQ ID NO:13899 | WMHPNSGNTGYAQKFQG | SEQ ID NO:21911 | SSGWYWFDP |
| | | NA | SEQ ID NO:5888 | AGTTATGATATCAAC | SEQ ID NO:13900 | TGGATGAACCCTAACAG TGGTAACACAGGCTATG CACAGAAGTTCCAGGGC | SEQ ID NO:21912 | GGCTTTTACGATACTTGACT GGTTCCGGCTACTACTACGT TATGGACGTC |
| iPS:434821 | 21-225_74A11 | AA | SEQ ID NO:5889 | SYDIN | SEQ ID NO:13901 | WMNPNSGNTGYAQKFQG | SEQ ID NO:21913 | GFYDTLTGSGYYYVMDV |
| | | NA | SEQ ID NO:5890 | GGTTGCTACTGGAGC | SEQ ID NO:13902 | GAAATCAATCATAGTGG AAGCACCAACTACAACC CGTCCCTAAGAGT | SEQ ID NO:21914 | GACTACGGCGGTATGGACGT C |
| iPS:434823 | 21-225_83G1 | AA | SEQ ID NO:5891 | GCYWS | SEQ ID NO:13903 | EINHSGSTNYNPSLKS | SEQ ID NO:21915 | DYGGMDV |
| | | NA | SEQ ID NO:5892 | AATTATGATATCAAC | SEQ ID NO:13904 | | SEQ ID NO:21916 | |
| iPS:434825 | 21-225_83C2 | AA | SEQ ID NO:5893 | NYDIN | SEQ ID NO:13905 | WMHPNSGNTGYAQKFQG | SEQ ID NO:21917 | SSGWYWFDP |
| | | NA | SEQ ID NO:5894 | AATTATGATATCAAC | SEQ ID NO:13906 | TGGATGCACCCTAACAG TGGTAACACAGGCTATG CACAGAAGTTCCAGGGC | SEQ ID NO:21918 | AGCAGTGGCTGGTACTGGTT CGACCCC |
| iPS:434827 | 21-225_83F3 | AA | SEQ ID NO:5895 | NYDIN | SEQ ID NO:13907 | WMHPNSGNTGYAQKFQG | SEQ ID NO:21919 | SSGWYWFDP |

FIGURE 49
(Continued)

| | | | | | | |
|---|---|---|---|---|---|---|
| iPS:434829 | 21-225_83G3 | NA | SEQ ID NO:5896 AATTATGATATCAAC | SEQ ID NO:13908 TGGATGCACCTAACAG TGGTAACACAGGCTATG CACAGAAGTTCCAGGGC | SEQ ID NO:21920 AGCAGTGGCTGGTACTGGTT CGACCCC | |
| | | AA | SEQ ID NO:5897 NYDIN | SEQ ID NO:13909 WMHPNSGNTGYAQKFQG | SEQ ID NO:21921 SSGWYWFDP | |
| iPS:434833 | 21-225_83C5 | NA | SEQ ID NO:5898 AATTATGATATCAAC | SEQ ID NO:13910 TGGATGCACCTAACAG TGGTAACACAGGCTATG CACAGAAGTTCCAGGGC | SEQ ID NO:21922 AGTAGTGGCTGGTACTGGTT CGACCCC | |
| | | AA | SEQ ID NO:5899 NYDIN | SEQ ID NO:13911 WMHPNSGNTGYAQKFQG | SEQ ID NO:21923 SSGWYWFDP | |
| iPS:434835 | 21-225_83B6 | NA | SEQ ID NO:5900 GGTTGCTACTGGAGC | SEQ ID NO:13912 GAAATCAATCATAGTGG AAGGACCAACTACAACC CCTCCCTCAAGAGT | SEQ ID NO:21924 GACTACGGTGGGCTTGACTA C | |
| | | AA | SEQ ID NO:5901 GCYWS | SEQ ID NO:13913 EINHSGRTNYNPSLKS | SEQ ID NO:21925 DYGGLDY | |
| iPS:434839 | 21-225_83B7 | NA | SEQ ID NO:5902 GGTTGCTACTGGAGC | SEQ ID NO:13914 GAAATCAATCATAGTGG AAGCACCAACTACAACC CGTCCCTCAAGAGT | SEQ ID NO:21926 GACTACGGCGGTATGGACGT C | |
| | | AA | SEQ ID NO:5903 GCYWS | SEQ ID NO:13915 EINHSGSTNYNPSLKS | SEQ ID NO:21927 DYGGMDV | |
| iPS:434841 | | NA | SEQ ID NO:5904 AATTATGATATCAAC | SEQ ID NO:13916 TGGATGAACCTAACAG TGGTAACACAGGCTATG CACAGAAGTTCCAGGGC | SEQ ID NO:21928 TCCAGTGGCTGGCACTGGTT CGACCCC | |

FIGURE 49
(Continued)

| | | | | | | | |
|---|---|---|---|---|---|---|---|
| iPS:434849 | 21-225_83G7 | AA | SEQ ID NO:5905<br>NYDIN | SEQ ID NO:13917<br>WMNPNSGNTGYAQKFQG | SEQ ID NO:21929<br>SSGWHWFDP | | |
| | | NA | SEQ ID NO:5906<br>GGTTACTACTGGAGC | SEQ ID NO:13918<br>GAAATCAATCATAGTGG<br>AAGCACCAACTTCAACC<br>CGTCCCTCAAGAGT | SEQ ID NO:21930<br>GACTACGGTGGCTTGACTA<br>C | | |
| iPS:434851 | 21-225_83C10 | AA | SEQ ID NO:5907<br>GYYWS | SEQ ID NO:13919<br>EINHSGSTNFNPSLKS | SEQ ID NO:21931<br>DYGGLDY | | |
| | | NA | SEQ ID NO:5908<br>AATTATGATATCAAC | SEQ ID NO:13920<br>TGGATGAACCCTAACAG<br>TGGTAACACAGGCTATG<br>CACAGAAGTTCCAGGAC | SEQ ID NO:21932<br>AGCAGTGGCTGGTACATCTT<br>TGACTAC | | |
| iPS:434863 | 21-225_75A6 | AA | SEQ ID NO:5909<br>NYDIN | SEQ ID NO:13921<br>WMNPNSGNTGYAQKFQG | SEQ ID NO:21933<br>SSGWYIFDY | | |
| | | NA | SEQ ID NO:5910<br>AATTATGATATCAAC | SEQ ID NO:13922<br>TGGATGAACCCTAACAG<br>TGGTAACACAGGCTATG<br>CACAGAAGTTCCAGGAC | SEQ ID NO:21934<br>TCCAGTGGCTGGCACTGGTT<br>CGACCCC | | |
| iPS:434865 | 21-225_84G7 | AA | SEQ ID NO:5911<br>NYDIN | SEQ ID NO:13923<br>WMNPNSGNTGYAQKFQD | SEQ ID NO:21935<br>SSGWHWFDP | | |
| | | NA | SEQ ID NO:5912<br>AGCTATGGCATGCAC | SEQ ID NO:13924<br>GTTATATGGTATGATGG<br>AAGTAATAAAACTATG<br>CAGACTCCGTGAAGGGC | SEQ ID NO:21936<br>GATGGCAGCTATGGTTACGA<br>CGGCCTTGACTAC | | |
| iPS:434867 | 21-225_79A12 | | SEQ ID NO:5913 | SEQ ID NO:13925 | SEQ ID NO:21937 | | |

FIGURE 49
(Continued)

| | | | | | |
|---|---|---|---|---|---|
| iPS:434869 | 21-225_84E12 | AA | SYGMH | VIWYDGSNKNYADSVKG | DGSYGYDGLDY |
| | | | SEQ ID NO:5914 | SEQ ID NO:13926 | SEQ ID NO:21938 |
| | | NA | GGTTCCTACTGGAGC | GAAATCAATCAAAGTGG ACGCACCAACTACAACC CGTCCCTCAAGAGT | GACTACGGGGGTATAGACGT C |
| | | | SEQ ID NO:5915 | SEQ ID NO:13927 | SEQ ID NO:21939 |
| | | AA | GSYWS | EINQSGRTNYNPSLKS | DYGGIDV |
| | | | SEQ ID NO:5916 | SEQ ID NO:13928 | SEQ ID NO:21940 |
| iPS:434871 | 21-225_85H1 | NA | AGCTATGGCATACAC | GTTATATGGTATGATGG AAGTAATAAATACTATG CAGACTCCGTGAAGGGC | GATCCCTTTATAGTGGAGC TACTTACTTGACTAC |
| | | | SEQ ID NO:5917 | SEQ ID NO:13929 | SEQ ID NO:21941 |
| | | AA | SYGIH | VIWYDGSNKYYADSVKG | DPFIVGATYFDY |
| | | | SEQ ID NO:5918 | SEQ ID NO:13930 | SEQ ID NO:21942 |
| iPS:434877 | 21-225_85H2 | NA | AATTATGATATCAAC | TGGATGCACCTAATAG TGGTAACACAGGCTATG CACAGAAGTTCCAGGGC | TCCAGTGGCTGGTACTGGTT CGACCCC |
| | | | SEQ ID NO:5919 | SEQ ID NO:13931 | SEQ ID NO:21943 |
| | | AA | NYDIN | WMHPNSGNTGYAQKFQG | SSGWYWFDP |
| | | | SEQ ID NO:5920 | SEQ ID NO:13932 | SEQ ID NO:21944 |
| iPS:434879 | 21-225_85A3 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5921 | SEQ ID NO:13933 | SEQ ID NO:21945 |
| | | AA | GCYWS | EINHSGSTNYNPSLKS | DYGGMDV |
| | | | SEQ ID NO:5922 | SEQ ID NO:13934 | SEQ ID NO:21946 |

FIGURE 49
(Continued)

| | | NA/AA | | | |
|---|---|---|---|---|---|
| iPS:434881 | 21-225_85B4 | NA | GGTTGCTACTGGAGC | GAAATCAATATAGTGG AAGCACCAACTACAACC CGTCCCTCAAGAGT | GACTACGGGCGGTATGGACGT C |
| | | | SEQ ID NO:5923 | SEQ ID NO:13935 | SEQ ID NO:21947 |
| | | AA | GCYWS | EINHSGSTNYNPSLKS | DYGGMDV |
| | | | SEQ ID NO:5924 | SEQ ID NO:13936 | SEQ ID NO:21948 |
| iPS:434883 | 21-225_85B5 | NA | AATTATGATATCAAC | TGGATGCACCTAACAG TGGTAACACAGGCTATG CACAGAAGTTCCAGGGC | AGTAGTGGCTGGTACTGGTT CGACCCC |
| | | | SEQ ID NO:5925 | SEQ ID NO:13937 | SEQ ID NO:21949 |
| | | AA | NYDIN | WMHPNSGNTGYAQKFQG | SSGWYWFDP |
| | | | SEQ ID NO:5926 | SEQ ID NO:13938 | SEQ ID NO:21950 |
| iPS:434887 | 21-225_85D6 | NA | GGTTGCTACTGGAGC | GAAATCAATATAGTGG AAGCACCAACTACAACC CGTCCCTCAAGAGT | GACTACGGCGGTATGGACGT C |
| | | | SEQ ID NO:5927 | SEQ ID NO:13939 | SEQ ID NO:21951 |
| | | AA | GCYWS | EINYSGRTNYNPSLKS | DYGGMDV |
| | | | SEQ ID NO:5928 | SEQ ID NO:13940 | SEQ ID NO:21952 |
| iPS:434891 | 21-225_85G6 | NA | GATTGCTACTGGAGC | GAAATCAATATAGTGG AAGGACCAACTACAACC CGTCCCTCAAGAGT | GACTACGGTGGGCTTGACTA C |
| | | | SEQ ID NO:5929 | SEQ ID NO:13941 | SEQ ID NO:21953 |
| | | AA | DCYWS | EINHSGRTNYNPSLKS | DYGGLDY |
| | | | SEQ ID NO:5930 | SEQ ID NO:13942 | SEQ ID NO:21954 |
| iPS:434895 | 21-225_74H7 | NA | GGTCCCTACTGGAGC | GAAATCAATATAGTGG AAGCACCAACTACAACC CGTCCCTCAAGAGT | GACTACGGGGTTGGACGT C |
| | | | SEQ ID NO:5931 | SEQ ID NO:13943 | SEQ ID NO:21955 |
| | | AA | GPYWS | EINHSGSTNYNPSLKS | DYGGLDV |

FIGURE 49
(Continued)

| | | | | | |
|---|---|---|---|---|---|
| iPS:434899 | 21-225_85B9 | NA | SEQ ID NO:5932<br>GGTTGCTACTGGAGC | SEQ ID NO:13944<br>GAAATCAATCATAGTGG<br>AAGGACCAACTTCAACC<br>CGTCCCTCAAGAGT | SEQ ID NO:21956<br>GACTACGGCGGTATGGACGT<br>C |
| | | AA | SEQ ID NO:5933<br>GCYWS | SEQ ID NO:13945<br>EINHSGRTNFNPSLKS | SEQ ID NO:21957<br>DYGGMDV |
| iPS:434901 | 21-225_85H9 | NA | SEQ ID NO:5934<br>AATTATGATATCAAC | SEQ ID NO:13946<br>TGGATGAACCCTAACAG<br>TGGTAACACAGGCTATG<br>CACAGAAGTTCCAGGGC | SEQ ID NO:21958<br>ACCAGTGGCTGGAACTTCTT<br>TGACTAC |
| | | AA | SEQ ID NO:5935<br>NYDIN | SEQ ID NO:13947<br>WMHPNSGNTGYAQKFQG | SEQ ID NO:21959<br>TSGWNFFDY |
| iPS:434907 | 21-225_85G10 | NA | SEQ ID NO:5936<br>GGTTGTTACTGGAGC | SEQ ID NO:13948<br>GAAATCAATCATAGTGG<br>AATCACCAACTACAACC<br>CGTCCCTCAAGAGT | SEQ ID NO:21960<br>GACTACGGTGTTGGACGT<br>C |
| | | AA | SEQ ID NO:5937<br>GCYWS | SEQ ID NO:13949<br>EINHSGITNYNPSLKS | SEQ ID NO:21961<br>DYGGLDV |
| iPS:434909 | 21-225_85C11 | NA | SEQ ID NO:5938<br>AATTATGATATCAAC | SEQ ID NO:13950<br>TGGATGCACCCTAACAG<br>TGGTAACACAGGCTATG<br>CACAGAAGTTCCAGGGC | SEQ ID NO:21962<br>AGTAGTGGCTGGTACAAATT<br>TGACTAC |
| | | AA | SEQ ID NO:5939<br>NYDIN | SEQ ID NO:13951<br>WMHPNSGNTGYAQKFQG | SEQ ID NO:21963<br>SSGWYKFDY |
| iPS:434911 | | NA | SEQ ID NO:5940<br>AATTATGATATCAAC | SEQ ID NO:13952<br>TGGATGCACCCTAACAG<br>TGGTAACACAGGCTATG<br>CACAGAAGTTCCAGGGC | SEQ ID NO:21964<br>AGTAGTGGCTGGTACTGGTT<br>CGACCCC |

FIGURE 49
(Continued)

| | | | | | | | |
|---|---|---|---|---|---|---|---|
| iPS:434913 | 21-225_85D11 | AA | SEQ ID NO:5941<br>NYDIN | SEQ ID NO:13953<br>WMHPNSGNTGYAQKFQG | SEQ ID NO:21965<br>SSGWYWFDP |
| | | NA | SEQ ID NO:5942<br>GGTTGCTACTGGAGC | SEQ ID NO:13954<br>GAAATCAATCATAGTGG<br>AAGCACCAACTACAACC<br>CGTCCCTCAAGAGT | SEQ ID NO:21966<br>GACTACGGCGGGTATGGACGT<br>C |
| iPS:434921 | 21-225_86C1 | AA | SEQ ID NO:5943<br>GCYWS | SEQ ID NO:13955<br>EINHSGSTNYNPSLKS | SEQ ID NO:21967<br>DYGGMDV |
| | | NA | SEQ ID NO:5944<br>GGTTGCTACTGGAGC | SEQ ID NO:13956<br>GAAATCAATCATAGTGG<br>AAGCACCAACTACAACC<br>CGTCCCTCAAGAGT | SEQ ID NO:21968<br>GACTACGGCGGGTATGGACGT<br>C |
| iPS:434935 | 21-225_86E4 | AA | SEQ ID NO:5945<br>GCYWS | SEQ ID NO:13957<br>EINHSGSTNYNPSLKS | SEQ ID NO:21969<br>DYGGMDV |
| | | NA | SEQ ID NO:5946<br>AATTATGATATCAAC | SEQ ID NO:13958<br>TGGATGAACCCTAACAG<br>TGGTAACACAGGCTATG<br>CACAGAAGTTCCAGGGC | SEQ ID NO:21970<br>TCCAGTGGCTGGTCCTGGTT<br>CGACCCC |
| iPS:434935 | 21-225_86E9 | AA | SEQ ID NO:5947<br>NYDIN | SEQ ID NO:13959<br>WMNPNSGNTGYAQKFQG | SEQ ID NO:21971<br>SSGWSWFDP |
| | | NA | SEQ ID NO:5948<br>GGTTGCTACTGGAGC | SEQ ID NO:13960<br>GAAATCAATCATAGTGG<br>AAGCACCAACTACAACC<br>CGTCCCTCAAGAGT | SEQ ID NO:21972<br>GACTACGGCGGGTATGGACGT<br>C |
| iPS:434939 | 21-225_86C11 | AA | SEQ ID NO:5949<br>GCYWS | SEQ ID NO:13961<br>EINHSGSTNYNPSLKS | SEQ ID NO:21973<br>DYGGMDV |
| | | | SEQ ID NO:5950 | SEQ ID NO:13962 | SEQ ID NO:21974 |

FIGURE 49
(Continued)

| | | | | |
|---|---|---|---|---|
| iPS:434943 | 21-225_87H1 | NA | GGTTACTACTGGAGC | GAAATCAATCATAGTGGACGCACCAACTACAACCCGTCCCTCAAGAGT | GACTACGGTGGTTTGGACGTC |
| | | AA | GYYWS | SEQ ID NO:13963 | SEQ ID NO:21975 |
| | | | SEQ ID NO:5951 | EINHSGRTNYNPSLKS | DYGGLDV |
| | | | SEQ ID NO:5952 | SEQ ID NO:13964 | SEQ ID NO:21976 |
| iPS:434945 | 21-225_87E5 | NA | GGTTGCTACTGGAGC | GAAATCAATCATAGTGGAAGCACCAACTACAACCCGTCCCTCAAGAGT | GACTACGGCGGTATGGACGTC |
| | | | SEQ ID NO:5953 | SEQ ID NO:13965 | SEQ ID NO:21977 |
| | | AA | GCYWS | EINHSGSTNYNPSLKS | DYGGMDV |
| | | | SEQ ID NO:5954 | SEQ ID NO:13966 | SEQ ID NO:21978 |
| iPS:434947 | 21-225_87B7 | NA | AGCTATGGCATGCAC | GTTATATGGTATGATGGAAGTAATAAAACTATGCAGACTCCGTGAAGGGC | GATTTTGGAGTGGGCTACTACGGTATGGACGTC |
| | | | SEQ ID NO:5955 | SEQ ID NO:13967 | SEQ ID NO:21979 |
| | | AA | SYGMH | VIWYDGSNKNYADSVKG | DFGVGYYGMDV |
| | | | SEQ ID NO:5956 | SEQ ID NO:13968 | SEQ ID NO:21980 |
| iPS:434955 | 21-225_87C9 | NA | GGTTGCTACTGGAGC | GAAATCAATCATAGTGGAAGCACCAACTACAACCCGTCCCTCAAGAGT | GACTACGGCGGTATGGACGTC |
| | | | SEQ ID NO:5957 | SEQ ID NO:13969 | SEQ ID NO:21981 |
| | | AA | GCYWS | EINHSGSTNYNPSLKS | DYGGMDV |
| | | | SEQ ID NO:5958 | SEQ ID NO:13970 | SEQ ID NO:21982 |
| iPS:434957 | 21-225_87A10 | NA | AATTATGATATCAAC | TGGATGCACCCTAACAATGGTAACACAGGCTATGCACAGAAGTTCCAGGGC | AGCAGTGGCTGGTACTGGTTCGACCCC |
| | | | SEQ ID NO:5959 | SEQ ID NO:13971 | SEQ ID NO:21983 |

FIGURE 49
(Continued)

| | | | | | | |
|---|---|---|---|---|---|---|
| | | | AA | NYDIN | | WMHPNNGNTGYAQKFQG | SSGWYWFDP |
| iPS:434959 | | | | SEQ ID NO:5960 | SEQ ID NO:13972 | SEQ ID NO:21984 |
| | 21-225_87E10 | | NA | AATTATGATATCAAC | TGGATGAACCCTAACAG TGGTAACACAGGCTATG CACAGAAGTTCCAGGGC | AGCAGTGGCTGGTACTTCTT TGACTAC |
| | | | | SEQ ID NO:5961 | SEQ ID NO:13973 | SEQ ID NO:21985 |
| | | | AA | NYDIN | WMNPNSGNTGYAQKFQG | SSGWYFFDY |
| iPS:434961 | | | | SEQ ID NO:5962 | SEQ ID NO:13974 | SEQ ID NO:21986 |
| | 21-225_87A12 | | NA | GGTTGCTACTGGAGC | GAAATCAATCATAGTGG AAGCACCAACTACAACC CGTCCCTCAAGAGT | GACTACGGGCTGGTATGGACGT C |
| | | | | SEQ ID NO:5963 | SEQ ID NO:13975 | SEQ ID NO:21987 |
| | | | AA | GCYWS | EINHSGSTNYNPSLKS | DYGGMDV |
| | | | | SEQ ID NO:5964 | SEQ ID NO:13976 | SEQ ID NO:21988 |
| iPS:434965 | 21-225_88A1 | | NA | AATTATGATATCAAC | TGGATGAACCCTAACAG TGGTAACACAGGCTATG CACAGAAGTTCCAGGGC | AGCAGTGGCTGGTACTACTT TGACTAC |
| | | | | SEQ ID NO:5965 | SEQ ID NO:13977 | SEQ ID NO:21989 |
| | | | AA | NYDIN | WMNPNSGNTGYAQKFQG | SSGWYFFDY |
| | | | | SEQ ID NO:5966 | SEQ ID NO:13978 | SEQ ID NO:21990 |
| iPS:434969 | 21-225_88H1 | | NA | GGTTGCTACTGGAGC | GAAATCAATCATAGTGG AAGCACCAACTACAACC CGTCCCTCAAGAGT | GACTACGGGCGGTATGGACGT C |
| | | | | SEQ ID NO:5967 | SEQ ID NO:13979 | SEQ ID NO:21991 |
| | | | AA | GCYWS | EINHSGSTNYNPSLKS | DYGGMDV |
| | | | | SEQ ID NO:5968 | SEQ ID NO:13980 | SEQ ID NO:21992 |

FIGURE 49
(Continued)

| iPS:434971 | 21-225_88G2 | NA | AATTATGATATCAAC | TGGATGCACCCTAACAG TGGTAACACAGGCTATG CACAGAAGTTCCAGGGC | AGCAGTGGCTGGTACTGGTT CGACCCC |
|---|---|---|---|---|---|
| | | | SEQ ID NO:5969 | SEQ ID NO:13981 | SEQ ID NO:21993 |
| | | AA | NYDIN | WMHPNSGNTGYAQKFQG | SSGWYWFDP |
| | | | SEQ ID NO:5970 | SEQ ID NO:13982 | SEQ ID NO:21994 |
| iPS:434973 | 21-225_88B4 | NA | AATTATGATATCAAC | TGGATGAACCCTAACAG TGGTGACACAGGCTATG CACAGAAGTTCCAGGGC | AGCAGTGGCTGGTACTACTT TGACTAC |
| | | | SEQ ID NO:5971 | SEQ ID NO:13983 | SEQ ID NO:21995 |
| | | AA | NYDIN | WMNPNSGDTGYAQKFQG | SSGWYYFDY |
| | | | SEQ ID NO:5972 | SEQ ID NO:13984 | SEQ ID NO:21996 |
| iPS:434977 | 21-225_88A5 | NA | AGTTATGATATCAAC | TGGATGAACCCTAACAG TGGTAACACAGGCTATG CACAGAAGTTCCAGGGC | GGGTTTTACGATTTTTTGACT GGTTATTCCCCACCTACTA CTACTACGATATGGACGTC |
| | | | SEQ ID NO:5973 | SEQ ID NO:13985 | SEQ ID NO:21997 |
| | | AA | SYDIN | WMNPNSGNTGYAQKFQG | GFYDFLTGYSPTYYYYDMDV |
| | | | SEQ ID NO:5974 | SEQ ID NO:13986 | SEQ ID NO:21998 |
| iPS:434981 | 21-225_88E7 | NA | GGTTGCTACTGGAGC | GAAATCAATCATAGTGG AAGCACCAACTACAACC CGTCCCTCAAGAGT | GACTACGGGCGGTATGGACGT C |
| | | | SEQ ID NO:5975 | SEQ ID NO:13987 | SEQ ID NO:21999 |
| | | AA | GCYWS | EINHSGSTNYNPSLKS | DYGGMDV |
| | | | SEQ ID NO:5976 | SEQ ID NO:13988 | SEQ ID NO:22000 |

FIGURE 49
(Continued)

| | | | | | |
|---|---|---|---|---|---|
| iPS:434983 | 21-225_88F7 | NA | GGTTGCTACTGGAGC | GAAATCAATCATAGTGG AAGCACCAACTACAACC CGTCCCTCAAGAGT | GACTACGGGCGGTATGGACGT C |
| | | | SEQ ID NO:5977 | SEQ ID NO:13989 | SEQ ID NO:22001 |
| | | AA | GCYWS | EINHSGSTNYNPSLKS | DYGGMDV |
| | | | SEQ ID NO:5978 | SEQ ID NO:13990 | SEQ ID NO:22002 |
| iPS:434995 | 21-225_88G9 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5979 | SEQ ID NO:13991 | SEQ ID NO:22003 |
| | | AA | GCYWS | EINHSGSTNYNPSLKS | DYGGMDV |
| | | | SEQ ID NO:5980 | SEQ ID NO:13992 | SEQ ID NO:22004 |
| iPS:434997 | 21-225_88C10 | NA | AATTATGATATCAAC | TGGATGACCCCTAACAG TGGTAACACAGGCTATG CACAGAAGTTCCAGGGC | AGCAGTGGCTGGTACTACTT TGACTCC |
| | | | SEQ ID NO:5981 | SEQ ID NO:13993 | SEQ ID NO:22005 |
| | | AA | NYDIN | WMTPNSGNTGYAQKFQG | SSGWYYFDS |
| | | | SEQ ID NO:5982 | SEQ ID NO:13994 | SEQ ID NO:22006 |
| iPS:434999 | 21-225_75A8 | NA | GGTTGCTACTGGAGC | GAAATCAATCATAGTGG AAGCACCAACTACAACC CGTCCCTCAAGAGT | GACTACGGCGGTATGGACGT C |
| | | | SEQ ID NO:5983 | SEQ ID NO:13995 | SEQ ID NO:22007 |
| | | AA | GCYWS | EINHSGSTNYNPSLKS | DYGGMDV |
| | | | SEQ ID NO:5984 | SEQ ID NO:13996 | SEQ ID NO:22008 |
| iPS:435809 | 21-225_89G4 | NA | AGCTACGACATGCAC | GCTATTGGTACTGCTGGT GACACATACTATCCAGG CTCCGTGAAGGGC | GCTCTTGACTACGGTGACTC CTTGGGCTACTACTACG GTATGGACGTC |
| | | | SEQ ID NO:5985 | SEQ ID NO:13997 | SEQ ID NO:22009 |
| | | AA | SYDMH | AIGTAGDTYYPGSVKG | ALDYGDSLGYYYYGMDV |

FIGURE 49
(Continued)

| | | | | | | |
|---|---|---|---|---|---|---|
| iPS:435013 | 21-225_89D5 | NA | SEQ ID NO:5986<br>GGTTGCTACTGGAGC | SEQ ID NO:13998<br>GAAATCAATCAATAGTGG<br>AAGCACCAACTACAACC<br>CGTCCCTCAAGAGT | SEQ ID NO:22010<br>GACTACGGCGGTATGGACGT<br>C |
| | | AA | SEQ ID NO:5987<br>GCYWS | SEQ ID NO:13999<br>EINHSGSTNYNPSLKS | SEQ ID NO:22011<br>DYGGMDV |
| iPS:435015 | 21-225_89H5 | NA | SEQ ID NO:5988<br>GGTTGCTACTGGAGC | SEQ ID NO:14000<br>GAAATCAATTATAGTGG<br>AAGCACCAACTTCAACC<br>CGTCCCTCAAGAGT | SEQ ID NO:22012<br>GACTACGGCGGTATGGACGT<br>C |
| | | AA | SEQ ID NO:5989<br>GCYWS | SEQ ID NO:14001<br>EINYSGSTNFNPSLKS | SEQ ID NO:22013<br>DYGGMDV |
| iPS:435025 | 21-225_89E10 | NA | SEQ ID NO:5990<br>GGTTGCTACTGGAGC | SEQ ID NO:14002<br>GAAATCAATCAATATGTGG<br>AAGCACCAACTACAACC<br>CGTCCCTCAAGAGT | SEQ ID NO:22014<br>GACTACGGCGGTATGGACGT<br>C |
| | | AA | SEQ ID NO:5991<br>GCYWS | SEQ ID NO:14003<br>EINHSGSTNYNPSLKS | SEQ ID NO:22015<br>DYGGMDV |
| iPS:435029 | 21-225_89A11 | NA | SEQ ID NO:5992<br>GGTTACTACTGGAGC | SEQ ID NO:14004<br>GAAATCAATCAATATAGTGG<br>ACGCACCAGTACAACC<br>CGTCCCTCAAGAGT | SEQ ID NO:22016<br>GACTACGGTGGTTTGGACGT<br>C |
| | | AA | SEQ ID NO:5993<br>GYYWS | SEQ ID NO:14005<br>EINHSGRTSYNPSLKS | SEQ ID NO:22017<br>DYGGLDV |
| iPS:435039 | 21-225_90G4 | NA | SEQ ID NO:5994<br>GGTTGCTACTGGAGC | SEQ ID NO:14006<br>GAAATCAATCAATATAGTGG<br>AAGCACCAACTACAACC<br>CGTCCCTCAAGAGT | SEQ ID NO:22018<br>GACTACGGCGGTATGGACGT<br>C |
| | | AA | SEQ ID NO:5995<br>GCYWS | SEQ ID NO:14007<br>EINHSGSTNYNPSLKS | SEQ ID NO:22019<br>DYGGMDV |

FIGURE 49
(Continued)

| | | | | | | | |
|---|---|---|---|---|---|---|---|
| iPS:435041 | 21-225_90A5 | NA | SEQ ID NO:5996<br>GGTTGCTACTGGAGC | SEQ ID NO:14008<br>GAAATCAATCATATGG<br>AAGCACCAACTACAACC<br>CGTCCCTCAAGAGT | SEQ ID NO:22020<br>GACTACGGCGGTATGGACGT<br>C |
| | | AA | SEQ ID NO:5997<br>GCYWS | SEQ ID NO:14009<br>EINHSGSTNYNPSLKS | SEQ ID NO:22021<br>DYGGMDV |
| iPS:435043 | 21-225_90G5 | NA | SEQ ID NO:5998<br>GGTTGCTACTGGAGC | SEQ ID NO:14010<br>GAAATCAATCATATGG<br>AAGCACCAACTACAACC<br>CGTCCCTCAAGAGT | SEQ ID NO:22022<br>GACTACGGCGGTATGGACGT<br>C |
| | | AA | SEQ ID NO:5999<br>GCYWS | SEQ ID NO:14011<br>EINHSGSTNYNPSLKS | SEQ ID NO:22023<br>DYGGMDV |
| iPS:435045 | 21-225_90H5 | NA | SEQ ID NO:6000<br>GACTATGGCATGCAC | SEQ ID NO:14012<br>GTTATATGGTATGAAGG<br>AAGTAATACATACTATG<br>CAGACTCCGTGAAGGGC | SEQ ID NO:22024<br>GAGATGGGGTGGTTAGATGA<br>CTAC |
| | | AA | SEQ ID NO:6001<br>DYGMH | SEQ ID NO:14013<br>VIWYEGSNTYYADSVKG | SEQ ID NO:22025<br>EMGWLDDY |
| iPS:435051 | 21-225_90D9 | NA | SEQ ID NO:6002<br>AATTATGATATCAAC | SEQ ID NO:14014<br>TGGATGAACCCTAACAG<br>TGGTAACACAGGCTATG<br>CACAGAAGTTCCAGGGC | SEQ ID NO:22026<br>TCCAGTGGCTGGCACTGGTT<br>CGACCCC |
| | | AA | SEQ ID NO:6003<br>NYDIN | SEQ ID NO:14015<br>WMNPNSGNTGYAQKFQG | SEQ ID NO:22027<br>SSGWHWFDP |
| iPS:435053 | 21-225_75F9 | NA | SEQ ID NO:6004<br>AATTATGATATCAAC | SEQ ID NO:14016<br>TGGATGAACCCTAACAG<br>TGGTAACACAGGCTATG<br>CACAGAAGTTCCAGGGC | SEQ ID NO:22028<br>AGCAGTGGCTGGTACATCTT<br>TGACTAC |
| | | | SEQ ID NO:6005 | SEQ ID NO:14017 | SEQ ID NO:22029 |

FIGURE 49
(Continued)

| | | | AA | NYDIN | | WMHPNSGNTGYAQKFQG | | SSGWYIFDY | |
|---|---|---|---|---|---|---|---|---|---|
| iPS:435055 | | | | | SEQ ID NO:6006 | | SEQ ID NO:14018 | | SEQ ID NO:22030 |
| | 21-225_90F10 | | NA | GGTTGCTACTGGAGC | | GAAATCAATCATAGTGG AAGCACCAACTACAACC CGTCCCTCAAGAGT | | GACTACGGCGGTATGGACGT C | |
| | | | | | SEQ ID NO:6007 | | SEQ ID NO:14019 | | SEQ ID NO:22031 |
| | | | AA | GCYWS | | EINHSGSTNYNPSLKS | | DYGGMDV | |
| iPS:435059 | | | | | SEQ ID NO:6008 | | SEQ ID NO:14020 | | SEQ ID NO:22032 |
| | 21-225_90C11 | | NA | AACTACGACATGCAC | | GCTATTGGTACTGCTGGT GACACATATCCAGG CTCCGTGAAGGGC | | GTTCTTGACTACGGTGACTC CTTGGGCTACTACTACG GTATGGACGTC | |
| | | | | | SEQ ID NO:6009 | | SEQ ID NO:14021 | | SEQ ID NO:22033 |
| | | | AA | NYDMH | | AIGTAGDTYYPGSVKG | | VLDYGDSLGYYYYGMDV | |
| iPS:435071 | | | | | SEQ ID NO:6010 | | SEQ ID NO:14022 | | SEQ ID NO:22034 |
| | 21-225_91F1 | | NA | AATTATGATATCAAC | | TGGATGCACCCTAACAG TGGTAACACAGGCTATG CACAGAAGTTCCAGGGC | | AGCAGTGGCTGGTACTGGTT CGACCCC | |
| | | | | | SEQ ID NO:6011 | | SEQ ID NO:14023 | | SEQ ID NO:22035 |
| | | | AA | NYDIN | | WMHPNSGNTGYAQKFQG | | SSGWYWFDP | |
| iPS:435073 | | | | | SEQ ID NO:6012 | | SEQ ID NO:14024 | | SEQ ID NO:22036 |
| | 21-225_91B2 | | NA | GGTTGCTACTGGAGC | | GAAATCAATCATAGTGG AAGCACCAACTACAACC CGTCCCTCAAGAGT | | GACTACGGCGGTATGGACGT C | |
| | | | | | SEQ ID NO:6013 | | SEQ ID NO:14025 | | SEQ ID NO:22037 |
| | | | AA | GCYWS | | EINHSGSTNYNPSLKS | | DYGGMDV | |
| | | | | | SEQ ID NO:6014 | | SEQ ID NO:14026 | | SEQ ID NO:22038 |

FIGURE 49
(Continued)

| | | | | | |
|---|---|---|---|---|---|
| iPS:435075 | 21-225_91B3 | NA | GGTTGCTACTGGAGC SEQ ID NO:6015 | GAAATCAATCATAGTGGAAGCACCAACTACAACCCGTCCCTCAAGAGT SEQ ID NO:14027 | GACTACGGCGGTATGGACGTC SEQ ID NO:22039 |
| | | AA | GCYWS SEQ ID NO:6016 | EINHSGSTNYNPSLKS SEQ ID NO:14028 | DYGGMDV SEQ ID NO:22040 |
| iPS:435077 | 21-225_91F3 | NA | GGTTGCTACTGGAGC SEQ ID NO:6017 | GAAATCAATCATAGTGGAAGCACCAACTACAACCCGTCCCTCAAGAGT SEQ ID NO:14029 | GACTACGGCGGTATGGACGTC SEQ ID NO:22041 |
| | | AA | GCYWS SEQ ID NO:6018 | EINHSGSTNYNPSLKS SEQ ID NO:14030 | DYGGMDV SEQ ID NO:22042 |
| iPS:435079 | 21-225_91B4 | NA | GGTTGCTACTGGAGC SEQ ID NO:6019 | GAAATCAATCATAGTGGAAGCACCAACTACAACCCGTCCCTCAAGAGT SEQ ID NO:14031 | GACTACGGCGGTATGGACGTC SEQ ID NO:22043 |
| | | AA | GCYWS SEQ ID NO:6020 | EINHSGSTNYNPSLKS SEQ ID NO:14032 | DYGGMDV SEQ ID NO:22044 |
| iPS:435087 | 21-225_91G8 | NA | AATTATATGATATCAAC SEQ ID NO:6021 | TGGATGCACCTAACAGTGGTAACACAGGCTATGCACAGAAGTTCCAGGGC SEQ ID NO:14033 | AGCAGTGGCTGGTACTGGTTCGACCCC SEQ ID NO:22045 |
| | | AA | NYDIN SEQ ID NO:6022 | WMHPNSGNTGYAQKFQG SEQ ID NO:14034 | SSGWYWFDP SEQ ID NO:22046 |
| iPS:435089 | 21-225_91E9 | NA | GGTTGCTACTGGAGC SEQ ID NO:6023 | GAAATCAATCATAGTGGAAGCACCAACTACAACCCGTCCCTCAAGAGT SEQ ID NO:14035 | GACTACGGCGGTATGGACGTC SEQ ID NO:22047 |
| | | AA | GCYWS | EINHSGSTNYNPSLKS | DYGGMDV |

FIGURE 49
(Continued)

| | | | | | | |
|---|---|---|---|---|---|---|
| iPS:435097 | 21-225_92B1 | NA | SEQ ID NO:6024 GGTTCCTACTGGAGC | SEQ ID NO:14036 GAAATCAATTATAGGGG AAGCACCAACTACAACC CGTCCCTCAAGAGT | SEQ ID NO:22048 GACTACGGCGGTTGGACGT C |
| | | AA | SEQ ID NO:6025 GSYWS | SEQ ID NO:14037 EINYRGSTNYNPSLKS | SEQ ID NO:22049 DYGGLDV |
| iPS:435103 | 21-225_92B2 | NA | SEQ ID NO:6026 AACTACGACATGCAC | SEQ ID NO:14038 GCTATTGGTACTGCTGGT GACACATACTATCCAGG CTCCGTGAAGGGC | SEQ ID NO:22050 GCTCTTGACTACGGTGACTC CTTGGGCTACTACTACG GTATGGACGTC |
| | | AA | SEQ ID NO:6027 NYDMH | SEQ ID NO:14039 AIGTAGDTYYPGSVKG | SEQ ID NO:22051 ALDYGDSLGYYYYGMDV |
| iPS:435109 | 21-225_92H5 | NA | SEQ ID NO:6028 AGCTATGGCATGCAC | SEQ ID NO:14040 GTTATATGGTATGATGG AAGTAATAAATACTATG CAGACTCCGTGAAGGGC | SEQ ID NO:22052 GATCCCTTTATAGTGGAGC TACTTACTTTGACTAC |
| | | AA | SEQ ID NO:6029 SYGMH | SEQ ID NO:14041 VIWYDGSNKYYADSVKG | SEQ ID NO:22053 DPFIVGATYFDY |
| iPS:435111 | 21-225_92B6 | NA | SEQ ID NO:6030 GGTTGCTACTGGAGC | SEQ ID NO:14042 GAAATCAATCATAGTGG AAGCACCAACTACAACC CGTCCCTCAAGAGT | SEQ ID NO:22054 GACTACGGCGGTATGGACGT C |
| | | AA | SEQ ID NO:6031 GCYWS | SEQ ID NO:14043 EINHSGSTNYNPSLKS | SEQ ID NO:22055 DYGGMDV |
| iPS:435113 | | NA | SEQ ID NO:6032 AATTATGATATCAAC | SEQ ID NO:14044 TGGATGCACCCTAACAG TGGTAACACAGGCTATG CACAGAAGTTCCAGGGC | SEQ ID NO:22056 AGCAGTGGCTGGTACTTTTT TGACTAC |

FIGURE 49
(Continued)

| | | | | | | | |
|---|---|---|---|---|---|---|---|
| iPS:435115 | 21-225_92E6 | | | SEQ ID NO:6033 NYDIN | | SEQ ID NO:14045 WMHPNSGNTGYAQKFQG | SEQ ID NO:22057 SSGWYFFDY |
| | | AA | NA | SEQ ID NO:6034 GGTTGCTACTGGAGC | | SEQ ID NO:14046 GAAATCAATCATAGTGG AAGCACCAACTACAACC CGTCCCTCAAGAGT | SEQ ID NO:22058 GACTACGGCGGTATGGACGT C |
| iPS:435167 | 21-225_77C5 | AA | | SEQ ID NO:6035 GCYWS | | SEQ ID NO:14047 EINHSGSTNYNPSLKS | SEQ ID NO:22059 DYGGMDV |
| | | | NA | SEQ ID NO:6036 AATTATGATATCAAC | | SEQ ID NO:14048 TGGATGAACCCTAACAG TGGTAACACAGGCTATG CACAGAAGTTCCAGGGC | SEQ ID NO:22060 ACCAGTGGCGGGGAAGTTCTT CGACTAC |
| iPS:435171 | 21-225_92F12 | AA | | SEQ ID NO:6037 NYDIN | | SEQ ID NO:14049 WMNPNSGNTGYAQKFQG | SEQ ID NO:22061 TSGGKFFDY |
| | | | NA | SEQ ID NO:6038 GGTTGCTACTGGAGC | | SEQ ID NO:14050 GAAATCAATCATAGTGG AAGCACCAACTACAACC CGTCCCTCAAGAGT | SEQ ID NO:22062 GACTACGGCGGTATGGACGT C |
| iPS:435177 | 21-225_93C2 | AA | | SEQ ID NO:6039 GCYWS | | SEQ ID NO:14051 EINHSGSTNYNPSLKS | SEQ ID NO:22063 DYGGMDV |
| | | | NA | SEQ ID NO:6040 GGTTGCTACTGGAGC | | SEQ ID NO:14052 GAAATCAATCATAGTGG AAGCACCAACTACAACC CGTCCCTCAAGAGT | SEQ ID NO:22064 GACTACGGCGGTATGGACGT C |
| | 21-225_93E4 | AA | | SEQ ID NO:6041 GCYWS | | SEQ ID NO:14053 EINHSGSTNYNPSLKS | SEQ ID NO:22065 DYGGMDV |
| | | | | SEQ ID NO:6042 | | SEQ ID NO:14054 | SEQ ID NO:22066 |

FIGURE 49
(Continued)

| | | | | | |
|---|---|---|---|---|---|
| iPS:435183 | 21-225_93E9 | NA | GGTTGCTACTGGAGC | GAAATCAATCATAGTGGAAGGACCAACTACAACCCGTCCCTCAAGAGT | GACTACGGTGTGGGCTTGACTAC |
| | | | SEQ ID NO:6043 | SEQ ID NO:14055 | SEQ ID NO:22067 |
| | | AA | GCYWS | EINHSGRTNYNPSLKS | DYGGLDY |
| | | | SEQ ID NO:6044 | SEQ ID NO:14056 | SEQ ID NO:22068 |
| iPS:435195 | 21-225_94D3 | NA | GGTTGCTACTGGAGC | GAAATCAATTATAGTGGAAGAACCAACTACAACCCGTCCCTCAAGAGT | GACTACGGCGGGTATGGACGTC |
| | | | SEQ ID NO:6045 | SEQ ID NO:14057 | SEQ ID NO:22069 |
| | | AA | GCYWS | EINYSGRTNYNPSLKS | DYGGMDV |
| | | | SEQ ID NO:6046 | SEQ ID NO:14058 | SEQ ID NO:22070 |
| iPS:435197 | 21-225_94F3 | NA | AACGATATCATGCAC | GTTATATGGTATGATGAAGTAATAAATACTATGCAGACTCCGTGAAGGGCTC | GAAAAATATAGCAGTGGCTGGTACGACTACGGTATGGACGTC |
| | | | SEQ ID NO:6047 | SEQ ID NO:14059 | SEQ ID NO:22071 |
| | | AA | NDIMH | VIWYDGSNKYYADSVKG | EKYSSGWYDYGMDV |
| | | | SEQ ID NO:6048 | SEQ ID NO:14060 | SEQ ID NO:22072 |
| iPS:435203 | 21-225_75A7 | NA | AATTATGATATCAAC | TGGATGAACCCTAACAGTGGTAACACAGGCTATGCACAGAAGTTCCAGGAC | TCCAGTGGCTGGCACTGGTTCGACCCC |
| | | | SEQ ID NO:6049 | SEQ ID NO:14061 | SEQ ID NO:22073 |
| | | AA | NYDIN | WMNPNSGNTGYAQKFQD | SSGWHWFDP |
| | | | SEQ ID NO:6050 | SEQ ID NO:14062 | SEQ ID NO:22074 |

FIGURE 49 (Continued)

| | | | | |
|---|---|---|---|---|
| iPS:435209 | 21-225_75A10 | NA | AATTATGATATCAAC SEQ ID NO:6051 | TGGATGAACCCTAACAG TGGTAACACAGGCTATG CACAGAAGTTCCAGGGC SEQ ID NO:14063 | AGCAGTGGCTGGTACTACTT TGACTAC SEQ ID NO:22075 |
| | | AA | NYDIN SEQ ID NO:6052 | WMNPNSGNTGYAQKFQG SEQ ID NO:14064 | SSGWYYFDY SEQ ID NO:22076 |
| iPS:435211 | 21-225_94E11 | NA | AATTATGATATCAAC SEQ ID NO:6053 | TGGATGAACCCTAACAG TGGTAACACAGGCTATG CACAGAAGTTCCAGGGC SEQ ID NO:14065 | TCCAGTGGCTGGAAGTGGTT CGACCCC SEQ ID NO:22077 |
| | | AA | NYDIN SEQ ID NO:6054 | WMNPNSGNTGYAQKFQG SEQ ID NO:14066 | SSGWKWFDP SEQ ID NO:22078 |
| iPS:435215 | 21-225_94E12 | NA | AATTATGATATCAAC SEQ ID NO:6055 | TGGATGAACCCTAACAG TGGTAACACAGGCTATG CACAGAAGTTCCAGGGC SEQ ID NO:14067 | ACCAGTGGCTGGAAGTTCTT TGACTAC SEQ ID NO:22079 |
| | | AA | NYDIN SEQ ID NO:6056 | WMNPNSGNTGYAQKFQG SEQ ID NO:14068 | TSGWKFFDY SEQ ID NO:22080 |
| iPS:435217 | 21-225_94F12 | NA | GGTTGCTACTGGAGC SEQ ID NO:6057 | GAAATCAATCATAGTGG AAGCACCAACTACAACC CGTCCCTCAAGAGT SEQ ID NO:14069 | GACTACGGCGGGTATGGACGT C SEQ ID NO:22081 |
| | | AA | GCYWS SEQ ID NO:6058 | EINHSGSTNYNPSLKS SEQ ID NO:14070 | DYGGMDV SEQ ID NO:22082 |
| iPS:435219 | 21-225_95D2 | NA | GGTTGCTACTGGAGC | GAAATCAATCATAGTGG AAGCACCAACTACAACC CGTCCCTCAAGAGT | GACTACGGCGGGTATGGACGT C |

FIGURE 49
(Continued)

| | | | | | |
|---|---|---|---|---|---|
| 21-225_95D2 | | | | SEQ ID NO:6059<br>GCYWS | SEQ ID NO:14071<br>EINHSGSTNYNPSLKS | SEQ ID NO:22083<br>DYGGMDV |
| iPS:435221 | | AA | | | | |
| | | NA | SEQ ID NO:6060<br>AGCTATGGCATGCAC | SEQ ID NO:14072<br>GTATTGTAGTATGATGGA<br>AGTAATAAATACTATGC<br>AGACTCCGTGAAGGGC | SEQ ID NO:22084<br>GATCGCAATATAGTGGAGC<br>TACTTACTTTGAGTCC |
| 21-225_95G2 | | | | SEQ ID NO:6061<br>SYGMH | SEQ ID NO:14073<br>VIWYDGSNKYYADSVKG | SEQ ID NO:22085<br>DRNIVGATYFES |
| iPS:435227 | | AA | | | | |
| | | NA | SEQ ID NO:6062<br>AATTATGATATCAAC | SEQ ID NO:14074<br>TGGATGAACCCTAACAG<br>TGGTAACACAGGCTATG<br>CACAGAAGTTCCAGGGC | SEQ ID NO:22086<br>TCCAGTGGCTGGAACTGGTT<br>CGACCCC |
| 21-225_95G4 | | | | SEQ ID NO:6063<br>NYDIN | SEQ ID NO:14075<br>WMNPNSGNTGYAQKFQG | SEQ ID NO:22087<br>SSGWNWFDP |
| iPS:435235 | | AA | | | | |
| | | NA | SEQ ID NO:6064<br>GGTTGCTACTGGAGC | SEQ ID NO:14076<br>GAAATCAATCATAGTGG<br>AAGCACCAACTACAACC<br>CGTCCCTCAAGAGT | SEQ ID NO:22088<br>GACTACGGCGGTATGGACGT<br>C |
| 21-225_95F9 | | | | SEQ ID NO:6065<br>GCYWS | SEQ ID NO:14077<br>EINHSGSTNYNPSLKS | SEQ ID NO:22089<br>DYGGMDV |
| iPS:435237 | | AA | | SEQ ID NO:6066 | SEQ ID NO:14078 | SEQ ID NO:22090 |
| | | NA | SEQ ID NO:6067<br>GGTTGCTACTGGAGC | SEQ ID NO:14079<br>GAAATCAATCATAGTGG<br>AAGCACCAACTACAACC<br>CGTCCCTCAAGAGT | SEQ ID NO:22091<br>GACTACGGCGGTATGGACGT<br>C |
| 21-225_95G9 | | | | SEQ ID NO:6068<br>GCYWS | SEQ ID NO:14080<br>EINHSGSTNYNPSLKS | SEQ ID NO:22092<br>DYGGMDV |
| | | AA | | | | |

FIGURE 49 (Continued)

| | | | | | | |
|---|---|---|---|---|---|---|
| iPS:435239 | 21-225_95H10 | NA | GGTTGCTACTGGAGC | | GAAATCAATCATAGTGG AAGCACCAACTACAACC CGTCCCTCAAGAGT | GACTACGGGCGGTATGGACGT C |
| | | AA | SEQ ID NO:6069 GCYWS | | SEQ ID NO:14081 EINHSGSTNYNPSLKS | SEQ ID NO:22093 DYGGMDV |
| iPS:435245 | 21-225_95E12 | NA | SEQ ID NO:6070 AATTATGATATCAAC | | SEQ ID NO:14082 TGGATGAACCCTAACAG TGGTAACACAGGCTATG CACAGAAGTTCCAGGGC | SEQ ID NO:22094 AGCAGTGGCTGGTACTGGTT CGACCCC |
| | | AA | SEQ ID NO:6071 NYDIN | | SEQ ID NO:14083 WMHPNSGNTGYAQKFQG | SEQ ID NO:22095 SSGWYWFDP |
| iPS:435247 | 21-225_96G1 | NA | SEQ ID NO:6072 AATTATGATATCAAC | | SEQ ID NO:14084 TGGATGCACCCTAACAA TGGTAACACAGGCTATG CACAGAAGTTCCAGGGC | SEQ ID NO:22096 AGCAGTGGCTGGTACTGGTT CGACCCC |
| | | AA | SEQ ID NO:6073 NYDIN | | SEQ ID NO:14085 WMHPNSGNTGYAQKFQG | SEQ ID NO:22097 SSGWYWFDP |
| iPS:435249 | 21-225_96E2 | NA | SEQ ID NO:6074 AATTATGATATCAAC | | SEQ ID NO:14086 TGGATGCACCCTAATAG TGGTAACACAGGCTATG CACAGAAGTTCCAGGGC | SEQ ID NO:22098 TCCAGTGGCTGGTACTGGTT CGACCCC |
| | | AA | SEQ ID NO:6075 NYDIN | | SEQ ID NO:14087 WMHPNSGNTGYAQKFQG | SEQ ID NO:22099 SSGWYWFDP |
| iPS:435251 | 21-225_96A3 | NA | SEQ ID NO:6076 AGTAGTAATTACTACTGGGG C | | SEQ ID NO:14088 AGTATCTATTATAGTGGA TACACCTCCTACAACCCG TCCCTCAAGAGT | SEQ ID NO:22100 CTTGACTCTAACTGGGGTCT TGACTAC |

FIGURE 49
(Continued)

| | | | | | | |
|---|---|---|---|---|---|---|
| iPS:435253 | 21-225_96A3 | AA | SEQ ID NO:6077<br>SSNYYWG | | SEQ ID NO:14089<br>SIYYSGYTSYNPSLKS | | SEQ ID NO:22101<br>LDSNWGLDY |
| | | NA | SEQ ID NO:6078<br>AGTTATGATATCAAC | | SEQ ID NO:14090<br>TGGATGAACCCTAACAG<br>TGGTAACACAGGCTATG<br>CACAGAAGTTCCAGGGC | | SEQ ID NO:22102<br>GGCTTTTACGATACTTTGACT<br>GGTTCCGGCTACTACTACGT<br>TATGGACGTC |
| iPS:435255 | 21-225_96A4 | AA | SEQ ID NO:6079<br>SYDIN | | SEQ ID NO:14091<br>WMNPNSGNTGYAQKFQG | | SEQ ID NO:22103<br>GFYDTLTGSGYYYVMDV |
| | | NA | SEQ ID NO:6080<br>AATTATGATATCAAC | | SEQ ID NO:14092<br>TGGATGAACCCTAACAG<br>TGGTAACACAGGCTATG<br>CACAGAAGTTCCAGGGC | | SEQ ID NO:22104<br>TCCAGTGGCTGGTCCTGGTT<br>CGACCCC |
| iPS:435257 | 21-225_96D5 | AA | SEQ ID NO:6081<br>NYDIN | | SEQ ID NO:14093<br>WMNPNSGNTGYAQKFQG | | SEQ ID NO:22105<br>SSGWSWFDP |
| | | NA | SEQ ID NO:6082<br>AATTATGATATCAAC | | SEQ ID NO:14094<br>TGGATGCACCCTAACAG<br>TGGTAACACAGGCTATG<br>CACAGAAGTTCCAGGGC | | SEQ ID NO:22106<br>AGTAGTGGCTGGTACAAATT<br>TGACTAC |
| iPS:435259 | 21-225_96H5 | AA | SEQ ID NO:6083<br>NYDIN | | SEQ ID NO:14095<br>WMHPNSGNTGYAQKFQG | | SEQ ID NO:22107<br>SSGWYKFDY |
| | | NA | SEQ ID NO:6084<br>AGTTATGATATCAAC | | SEQ ID NO:14096<br>TGGATGAACCCTAACAG<br>TCGTAACACAGGCTATG<br>CACAGAAGTTCCAGGGC | | SEQ ID NO:22108<br>GGCGGCTACGATGTTTTGCC<br>TGGAATAACTACTACTACG<br>ATATGGACGTC |
| | 21-225_96C6 | AA | SEQ ID NO:6085<br>SYDIN | | SEQ ID NO:14097<br>WMNPNSRNTGYAQKFQG | | SEQ ID NO:22109<br>GGYDVLPGNNYYYDMDV |

FIGURE 49
(Continued)

| | | | SEQ ID NO:6086 | AATTATGATATCAAC | SEQ ID NO:14098 | TGGATGCACCCTAACAG TGGTAACACAGGCTATG CACAGAAGTTCCAGGGC | SEQ ID NO:22110 | AGCAGTGGCTGGTACTTTT TGACTAC |
|---|---|---|---|---|---|---|---|---|
| iPS:435267 | 21-225_96D10 | NA | | | | | | |
| | | AA | SEQ ID NO:6087 | NYDIN | SEQ ID NO:14099 | WMHPNSGNTGYAQKFQG | SEQ ID NO:22111 | SSGWYFFDY |
| iPS:435273 | 21-225_97A2 | NA | SEQ ID NO:6088 | GGTTGCTACTGGAGC | SEQ ID NO:14100 | GAAATCAATCATAGTGG AAGCACCAACTACAACC CGTCCCTCAAGAGT | SEQ ID NO:22112 | GACTACGGCGGGTATGGACGT C |
| | | AA | SEQ ID NO:6089 | GCYWS | SEQ ID NO:14101 | EINHSGSTNYNPSLKS | SEQ ID NO:22113 | DYGGMDV |
| iPS:435279 | 21-225_97H4 | NA | SEQ ID NO:6090 | AATTATGATATCAAC | SEQ ID NO:14102 | TGGATGCACCCTAACAG TGGTAACACAGGCTATG CACAGAAGTTCCAGGGC | SEQ ID NO:22114 | AGCAGTGGCTGGTACTGGTT CGACCCC |
| | | AA | SEQ ID NO:6091 | NYDIN | SEQ ID NO:14103 | WMHPNSGNTGYAQKFQG | SEQ ID NO:22115 | SSGWYWFDP |
| iPS:435281 | 21-225_97E5 | NA | SEQ ID NO:6092 | GGTTGCTACTGGAGC | SEQ ID NO:14104 | GAAATCAATCATAGTGG AAGCACCAACTACAACC CGTCCCTCAAGAGT | SEQ ID NO:22116 | GACTACGGCGGGTATGGACGT C |
| | | AA | SEQ ID NO:6093 | GCYWS | SEQ ID NO:14105 | EINHSGSTNYNPSLKS | SEQ ID NO:22117 | DYGGMDV |
| | | | SEQ ID NO:6094 | | SEQ ID NO:14106 | | SEQ ID NO:22118 | |

FIGURE 49
(Continued)

| ID | Clone | Type | Col1 | Col2 | Col3 |
|---|---|---|---|---|---|
| iPS:435291 | 21-225_146E1 | NA | AGCTATGGCATGCAC<br>SEQ ID NO:6095 | ATTATATGGTATGATGG<br>AAGTAATAAATACTATG<br>CAGACTCCGTGAAGGC<br>SEQ ID NO:14107 | GATCGTTTAGTGGGAGCTAC<br>CGCTGATGCTTTGATATC<br>SEQ ID NO:22119 |
| | | AA | SYGMH<br>SEQ ID NO:6096 | IIWYDGSNKYYADSVKG<br>SEQ ID NO:14108 | DRLVGATADAFDI<br>SEQ ID NO:22120 |
| iPS:435293 | 21-225_146F1 | NA | AGAAGTAGTTACTACTGGGG<br>C<br>SEQ ID NO:6097 | AGTATATATTATAGTGG<br>GAGTACCTCCTACAACC<br>CGTCCCTCAAGAGT<br>SEQ ID NO:14109 | CTTGATCTCCTGTGGAGTTTT<br>GACTAC<br>SEQ ID NO:22121 |
| | | AA | RSSYYWG<br>SEQ ID NO:6098 | SIYYSGSTSYNPSLKS<br>SEQ ID NO:14110 | LDLLWSFDY<br>SEQ ID NO:22122 |
| iPS:435295 | 21-225_146H1 | NA | AGCTATGCCATGAGC<br>SEQ ID NO:6099 | GCTATTAGTGGTCGTGGT<br>GGTAACACATTCTACGC<br>AGACTCCGTGAAGGGC<br>SEQ ID NO:14111 | CGGGTGACGGACTACGGTGG<br>TAACGACTGGTTCGACCCC<br>SEQ ID NO:22123 |
| | | AA | SYAMS<br>SEQ ID NO:6100 | AISGRGGNTFYADSVKG<br>SEQ ID NO:14112 | RVTDYGGNDWFDP<br>SEQ ID NO:22124 |
| iPS:435297 | 21-225_146B3 | NA | AGCTATGGCATGCAC<br>SEQ ID NO:6101 | GTTATATGGTATGATGG<br>AAGTTATAAATACTATG<br>CAGACTCCGTGAAGGC<br>SEQ ID NO:14113 | ATGGGTATAGAAGTGGCTGT<br>GGACTACTACGGTATGG<br>ACGTC<br>SEQ ID NO:22125 |
| | | AA | SYGMH<br>SEQ ID NO:6102 | VIWYDGSKYYADSVKG<br>SEQ ID NO:14114 | MGIEVAVDYYYGMDV<br>SEQ ID NO:22126 |
| iPS:435299 | 21-225_146D4 | NA | AATTATGATATCAAC<br>SEQ ID NO:6103 | TGGGTGCACCTAACAG<br>TGGTAACACAGGCTATG<br>CACAGAAGTTCCAGGGC<br>SEQ ID NO:14115 | AGCAGTGGCTGGTACTACTT<br>TGACTAC<br>SEQ ID NO:22127 |

FIGURE 49
(Continued)

| | | AA/NA | CDR1 | | CDR2 | | CDR3 | |
|---|---|---|---|---|---|---|---|---|
| iPS:435301 | 21-225_146G4 | AA | NYDIN | SEQ ID NO:6104 | WVHPNSGNTGYAQKFQG | SEQ ID NO:14116 | SSGWYYFDY | SEQ ID NO:22128 |
| | | NA | AACAGTGGTTACTACTGGAG C | SEQ ID NO:6105 | TACAGTATTACAGTGG GAGCACCTACTACAACC CGTCCCTCAAGAGT | SEQ ID NO:14117 | GGGAAATATAACTGGAACCA TGCTTTTGATATC | SEQ ID NO:22129 |
| iPS:435303 | 21-225_146A6 | AA | NSGYYWS | SEQ ID NO:6106 | YSYYSGSTYYNPSLKS | SEQ ID NO:14118 | GKYNWNHAFDI | SEQ ID NO:22130 |
| | | NA | AGCTATGCCATGAAC | SEQ ID NO:6107 | GCTATTAGTGGTAGTGGT GGTAACACATTCTACGC AGACTCCGTGAAGGGC | SEQ ID NO:14119 | AAGGATAATGATTACGTTTG GGGGAGTCCTTACTTTGACT AC | SEQ ID NO:22131 |
| iPS:435305 | 21-225_146C9 | AA | SYAMN | SEQ ID NO:6108 | AISGSGGNTFYADSVKG | SEQ ID NO:14120 | KDNDYVWGSPYFDY | SEQ ID NO:22132 |
| | | NA | AATTATGATATCAAC | SEQ ID NO:6109 | TGGATGCACCTAACAG TGGTAACACAGGCTATG CACAGAAGTTCCAGGGC | SEQ ID NO:14121 | AGCAGTGGCTGGTACTCCTT TGACTAC | SEQ ID NO:22133 |
| iPS:435307 | 21-225_146E9 | AA | NYDIN | SEQ ID NO:6110 | WMHPNSGNTGYAQKFQG | SEQ ID NO:14122 | SSGWYSFDY | SEQ ID NO:22134 |
| | | NA | AGCTATGCCATGAGC | SEQ ID NO:6111 | GCTATTAGTGGTGGTGGT GGTAACACATTCTACGC AGACTCCGTGAAGGGC | SEQ ID NO:14123 | CGGGTGACGGACTACGGTGG TAACGACTGGTTCGACCCC | SEQ ID NO:22135 |
| | | AA | SYAMS | SEQ ID NO:6112 | AISGRGGNTFYADSVKG | SEQ ID NO:14124 | RVIDYGGNDWFDP | SEQ ID NO:22136 |

FIGURE 49
(Continued)

| | | | | | |
|---|---|---|---|---|---|
| iPS:435309 | 21-225_146F9 | NA | AATTATGATATCAAC | TGGATGCACCCTAACAGTGGTAACACAGGCTATGCACAGAAGTTCCAGGGC | AGCAGTGGCTGTACTTTTTGACTAC |
| | | | SEQ ID NO:6113 | SEQ ID NO:14125 | SEQ ID NO:22137 |
| | | AA | NYDIN | WMHPNSGNTGYAQKFQG | SSGWYFFDY |
| | | | SEQ ID NO:6114 | SEQ ID NO:14126 | SEQ ID NO:22138 |
| iPS:435311 | 21-225_146H9 | NA | AGCTATGGCATGCAC | GTGATATGGTTTGATGAAGTAATAAACACTATGGAGACTCCGTGAAGGGC | GAATTGGGATTTCTCTCTGACTAT |
| | | | SEQ ID NO:6115 | SEQ ID NO:14127 | SEQ ID NO:22139 |
| | | AA | SYGMH | VIWFDESNKHYGDSVKG | ELGFLSDY |
| | | | SEQ ID NO:6116 | SEQ ID NO:14128 | SEQ ID NO:22140 |
| iPS:435313 | 21-225_146G11 | NA | AGCTATAGCATGAAC | TCCATTAGTGGTAGTGGTAGTACACATACTACGCAGACTCAGTGAAGGGC | GGTAGCAGCTCGTCCGGGTTTGACTAC |
| | | | SEQ ID NO:6117 | SEQ ID NO:14129 | SEQ ID NO:22141 |
| | | AA | SYSMN | SISGSGSYTYYADSVKG | GSSSSGFDY |
| | | | SEQ ID NO:6118 | SEQ ID NO:14130 | SEQ ID NO:22142 |
| iPS:435315 | 21-225_147B2 | NA | AGCTATGGCATGCAC | GTTATATGGTATGATGGAAGTAATAAATACTATGCAGACTCCGTGAAGGGC | AGGTATAGCAGCAGCTGGTCGGGGGTATGGGACGTC |
| | | | SEQ ID NO:6119 | SEQ ID NO:14131 | SEQ ID NO:22143 |
| | | AA | SYGMH | VIWYDGSNKYYADSVKG | RYSSSWSGGMDV |
| | | | SEQ ID NO:6120 | SEQ ID NO:14132 | SEQ ID NO:22144 |

FIGURE 49
(Continued)

| | | | | | |
|---|---|---|---|---|---|
| iPS:435317 | 21-225_147D2 | NA | AGTGGTGATTACTACTGGAAC | TTCATCTATTACACTGGGAGCACTACTACAACCCGTCCCTCAAGAGT | GGGGGAGCTTACTACTCCTACTACGGTATGGACGTC |
| | | | SEQ ID NO:6121 | SEQ ID NO:14133 | SEQ ID NO:22145 |
| | | AA | SGDYYWN | FIYYTGSTYYNPSLKS | GGAYYSYYGMDV |
| | | | SEQ ID NO:6122 | SEQ ID NO:14134 | SEQ ID NO:22146 |
| iPS:435319 | 21-225_147E3 | NA | AATAGTGGTTACTACTATAGC | TACATCTATTACAGGTGGGGCACCTACTACAACCCGTCCCTCAAGAGT | GGGGGATATAACTGGAACCATGCTTTTTGATTTC |
| | | | SEQ ID NO:6123 | SEQ ID NO:14135 | SEQ ID NO:22147 |
| | | AA | NSGYYYS | YIYYSGGTYYNPSLKS | GGYNWNHAFDF |
| | | | SEQ ID NO:6124 | SEQ ID NO:14136 | SEQ ID NO:22148 |
| iPS:435321 | 21-225_147E4 | NA | AATTATGATATCAAC | TGGATGAACCCTAACAGTGGTAACACAGGCTATGCACAGAAGTTCCAGGGC | AGCAGTGGCTGGTACTTTTTTGACTAC |
| | | | SEQ ID NO:6125 | SEQ ID NO:14137 | SEQ ID NO:22149 |
| | | AA | NYDIN | WMNPNSGNTGYAQKFQG | SSGWYFFDY |
| | | | SEQ ID NO:6126 | SEQ ID NO:14138 | SEQ ID NO:22150 |
| iPS:435323 | 21-225_147D5 | NA | AATTATGATATCAAC | TGGGTGCACCCTAACAGTGGTAACACAGGCTATGCACAGAAGTTCCAGGGC | AGCAGTGGCTGGTACTACTTTGACTAC |
| | | | SEQ ID NO:6127 | SEQ ID NO:14139 | SEQ ID NO:22151 |
| | | AA | NYDIN | WVHPNSGNTGYAQKFQG | SSGWYYFDY |
| | | | SEQ ID NO:6128 | SEQ ID NO:14140 | SEQ ID NO:22152 |
| iPS:435325 | 21-225_147H5 | NA | GACTATGGCATGCAC | GTTATATGGTATGATGGAAGTAATAAGTACTATGCAGACTCCGTGAAGGGC | GAGAGGTATAGCAGTGGCTGGTACGACTACGGGTTTGGACGTTC |
| | | | SEQ ID NO:6129 | SEQ ID NO:14141 | SEQ ID NO:22153 |

FIGURE 49
(Continued)

| | | | | | |
|---|---|---|---|---|---|
| iPS:435327 | 21-225_147G6 | AA | DYGMH | VIWYDGSNKYYADSVKG | ERYSSGWYDYGLDV |
| | | | SEQ ID NO:6130 | SEQ ID NO:14142 | SEQ ID NO:22154 |
| | | NA | AATTATGATATCAAC | TGGATGCACCCAACAGTGGTAACACAGGCTATGCACAGAAGTTCCAGGGC | AGCAGTGGCTGGTACTGGTTCGACCCC |
| | | | SEQ ID NO:6131 | SEQ ID NO:14143 | SEQ ID NO:22155 |
| iPS:435329 | 21-225_147A8 | AA | NYDIN | WMHPNSGNTGYAQKFQG | SSGWYWFDP |
| | | | SEQ ID NO:6132 | SEQ ID NO:14144 | SEQ ID NO:22156 |
| | | NA | AGCTATGGCATGCAC | GTTATATGGTATGATGGAAGTAATAAATACTATGCAGACTCCGTGAAGGGC | AGGTATAGCAGCAGCTGGACGGGGGGTATGGACGTC |
| | | | SEQ ID NO:6133 | SEQ ID NO:14145 | SEQ ID NO:22157 |
| iPS:435331 | 21-225_147G8 | AA | SYGMH | VIWYDGSNKYYADSVKG | RYSSSWTGGMDV |
| | | | SEQ ID NO:6134 | SEQ ID NO:14146 | SEQ ID NO:22158 |
| | | NA | GCTTACTACTGGAGC | GAAATCAATCATAGTGGAAGTACCAACTACAAACCGTCCCTCAAGAGT | GACTACGGTGTTTTTGACTAC |
| | | | SEQ ID NO:6135 | SEQ ID NO:14147 | SEQ ID NO:22159 |
| iPS:435333 | 21-225_147E9 | AA | AYYWS | EINHSGSTNYKPSLKS | DYGVFDY |
| | | | SEQ ID NO:6136 | SEQ ID NO:14148 | SEQ ID NO:22160 |
| | | NA | AGCTATAGCATGAAC | TCCATTAGTGGTAGAAACACTAACCATATACTATGCAGACTCTGTGAAGGGC | GATCGGGGCAGTTGC |
| | | | SEQ ID NO:6137 | SEQ ID NO:14149 | SEQ ID NO:22161 |
| | | AA | SYSMN | SISGRNTTIYYADSVKG | DRGSC |
| | | | SEQ ID NO:6138 | SEQ ID NO:14150 | SEQ ID NO:22162 |

FIGURE 49
(Continued)

| | | | | | | |
|---|---|---|---|---|---|---|
| iPS:435335 | 21-225_147D10 | NA | AGCTATGGCCATGAGC | GCTATTAGTGTGGTCGTGGT GGTAACACATTCTACGC AGACTCCGTGAAGGGC | AAGGATTATGATTACGTTTG GGGGAGTCCTTACTTTGACT AC | |
| | | | SEQ ID NO:6139 | SEQ ID NO:14151 | SEQ ID NO:22163 | |
| | | AA | SYAMS | AISGRGGNTFYADSVKG | KDYDYVWGSPYFDY | |
| | | | SEQ ID NO:6140 | SEQ ID NO:14152 | SEQ ID NO:22164 | |
| iPS:435339 | 21-225_147D12 | NA | AGCTATGCCATGAGC | GCTATTAGTGGTCGTGGT GGTAACACATTCTACGC AGACTCCGTGAAGGGC | AAGGATTATGATTACGTTTG GGGGAGTCCTTACTTTGACT AC | |
| | | | SEQ ID NO:6141 | SEQ ID NO:14153 | SEQ ID NO:22165 | |
| | | AA | SYAMS | AISGRGGNTFYADSVKG | KDYDYVWGSPYFDY | |
| | | | SEQ ID NO:6142 | SEQ ID NO:14154 | SEQ ID NO:22166 | |
| iPS:435341 | 21-225_148B2 | NA | AGCTATGGCCATGCAC | ATTATCTGGTATGATGGA AGTTATAAATACTATGC AGACCCGTGAAGGGC | GATCATTTCGATTTTTGGAGT GGTCACTTGACTAC | |
| | | | SEQ ID NO:6143 | SEQ ID NO:14155 | SEQ ID NO:22167 | |
| | | AA | SYGMH | IIWYDGSYKYYADSVKG | DHFDFWSGHFDY | |
| | | | SEQ ID NO:6144 | SEQ ID NO:14156 | SEQ ID NO:22168 | |
| iPS:435343 | 21-225_148E2 | NA | AGCTATGCCATGAGC | GCTATTAGTGGTCGTGGT GGTAACACATTCTACGC AGACTCCGTGAAGGGC | AAGGATTATGATTACGTTTG GGGGAGTCCTTACTTTGACT AC | |
| | | | SEQ ID NO:6145 | SEQ ID NO:14157 | SEQ ID NO:22169 | |
| | | AA | SYAMS | AISGRGGNTFYADSVKG | KDYDYVWGSPYFDY | |
| | | | SEQ ID NO:6146 | SEQ ID NO:14158 | SEQ ID NO:22170 | |
| iPS:435345 | 21-225_148G3 | NA | AATTATGATATCAAC | TGGATGCACCCTAACAG TGGTAACACAGGCTATG CACAGAACTTCCAGGGC | AGCAGTGGCTGGTACTTTTT TGACTAC | |
| | | | SEQ ID NO:6147 | SEQ ID NO:14159 | SEQ ID NO:22171 | |
| | | AA | NYDIN | WMHPNSGNTGYAQNFQG | SSGWYFFDY | |

FIGURE 49
(Continued)

| | | | | | |
|---|---|---|---|---|---|
| iPS:435347 | 21-225_148C4 | NA | SEQ ID NO:6148<br>AGCTATGCCATGAAC | SEQ ID NO:14160<br>GCTATTAGTGGTAGTGGT<br>GGTAACACATTCTACGC<br>AGACTCCGTGAAGGGC | SEQ ID NO:22172<br>CGGGTGACGGACTACGGTGG<br>TAACGACTGGTTCGACCCC |
| | | AA | SEQ ID NO:6149<br>SYAMN | SEQ ID NO:14161<br>AISGSGGNTFYADSVKG | SEQ ID NO:22173<br>RVTDYGGNDWFDP |
| iPS:435349 | 21-225_148F5 | NA | SEQ ID NO:6150<br>AGCTATGGCATGCAC | SEQ ID NO:14162<br>GTTATATGGTATGATGG<br>AAGTAATAAATACTATG<br>CAGACTCCGTGAAGGGC | SEQ ID NO:22174<br>AGGTATAGCAGCAGCTGGTC<br>GGGGGGTATGGACGTC |
| | | AA | SEQ ID NO:6151<br>SYGMH | SEQ ID NO:14163<br>VIWYDGSNKYYADSVKG | SEQ ID NO:22175<br>RYSSSWSGGMDV |
| iPS:435351 | 21-225_148B6 | NA | SEQ ID NO:6152<br>GGCTACTATATGCAC | SEQ ID NO:14164<br>TGGATCCACCTAACAA<br>TGGTGGCACAAACTATG<br>CACAGACGTTTCAGGGC | SEQ ID NO:22176<br>GATCCTGTAGTAGTACCAGC<br>TGCCCCCTTTGACTAC |
| | | AA | SEQ ID NO:6153<br>GYYMH | SEQ ID NO:14165<br>WIHPNNGGTNYAQTFQG | SEQ ID NO:22177<br>DPVVPAAPFDY |
| iPS:435353 | 21-225_148F8 | NA | SEQ ID NO:6154<br>AATTATGATATCAAC | SEQ ID NO:14166<br>TGGATGAACCCTAACAG<br>TGGTAACACAGGCTATG<br>CACAGAAGTTCCAGGGC | SEQ ID NO:22178<br>AGCAGTGGCTGGTACTACTT<br>TGACTAC |
| | | AA | SEQ ID NO:6155<br>NYDIN | SEQ ID NO:14167<br>WMNPNSGNTGYAQKFQG | SEQ ID NO:22179<br>SSGWYYFDY |
| | | | SEQ ID NO:6156 | SEQ ID NO:14168 | SEQ ID NO:22180 |

FIGURE 49 (Continued)

| | | | | | |
|---|---|---|---|---|---|
| iPS:435355 | 21-225_148H9 | NA | AGCTATGCCATGAGC | GCTATTAGTGGTCGTGGT GGTAACACATTCTACGC AGACTCCGTGAAGGGC | CGGGTGACGGACTACGGTGG TAACGACTGGTTCGACCCC |
| | | | SEQ ID NO:6157 | SEQ ID NO:14169 | SEQ ID NO:22181 |
| | | AA | SYAMS | AISGRGGNTFYADSVKG | RVTDYGGNDWFDP |
| | | | SEQ ID NO:6158 | SEQ ID NO:14170 | SEQ ID NO:22182 |
| iPS:435357 | 21-225_148G10 | NA | AGCTATGGCATGCAC | ATTATATGGTATGATGG AAGTAATAAATACTATG CAGACTCCGTGAAGGGC | GATCGTTACGATTTTGGAG TGGTCACTTTGACTAC |
| | | | SEQ ID NO:6159 | SEQ ID NO:14171 | SEQ ID NO:22183 |
| | | AA | SYGMH | IIWYDGSNKYYADSVKG | DRYDFWSGHFDY |
| | | | SEQ ID NO:6160 | SEQ ID NO:14172 | SEQ ID NO:22184 |
| iPS:435359 | 21-225_148H10 | NA | AGCTATGGCATGCAC | GTTATATGGTATGATGG AAGTAATAAATACTATG GAGACTCCGTGAAGGGC | AGGTATAGCAGCAGCTGGTC GGGGGTATGGACGTC |
| | | | SEQ ID NO:6161 | SEQ ID NO:14173 | SEQ ID NO:22185 |
| | | AA | SYGMH | VIWYDGSNKYYGDSVKG | RYSSSWSGGMDV |
| | | | SEQ ID NO:6162 | SEQ ID NO:14174 | SEQ ID NO:22186 |
| iPS:435361 | 21-225_148E11 | NA | AGAAGTAGTTACTACTGGGG C | AGTATCTATTACAGTGGG AGCACCTCCTACAACCC GTCCCTCAAGAGT | CTTGATCCCCAGTGGAGTTT TGACTAC |
| | | | SEQ ID NO:6163 | SEQ ID NO:14175 | SEQ ID NO:22187 |
| | | AA | RSSYYWG | SIYYSGSTSYNPSLKS | LDPQWSFDY |
| | | | SEQ ID NO:6164 | SEQ ID NO:14176 | SEQ ID NO:22188 |
| iPS:435363 | 21-225_148F12 | NA | AATGGTGGTTACTACTGGAA C | TACATCTATTACAGTGGG AGCACTACTACAACCC GTCCCTCAAGAGT | TACAGTAGTACTACGACTACTA CTACGGTATGGACGTC |

FIGURE 49
(Continued)

| | | | | |
|---|---|---|---|---|
| iPS:435365 | 21-225_148F12 | AA | SEQ ID NO:6165<br>NGGYYWN | SEQ ID NO:14177<br>YIYYSGSTYYNPSLKS | SEQ ID NO:22189<br>YSTYDYYGMDV |
| | | NA | SEQ ID NO:6166<br>AGCTATGGCATGCAC | SEQ ID NO:14178<br>ATTATCTGGTATGATGGAAGTTATAAATACTATGCAGACTCCGTGAAGGGC | SEQ ID NO:22190<br>GATCATTTCGATTTTTGGAGTGGTCACTTGACTAC |
| iPS:435367 | 21-225_149F1 | AA | SEQ ID NO:6167<br>SYGMH | SEQ ID NO:14179<br>IIWYDGSYKYYADSVKG | SEQ ID NO:22191<br>DHFDFWSGHFDY |
| | | NA | SEQ ID NO:6168<br>GACTATGGCATGCAC | SEQ ID NO:14180<br>GTTATATGGTATGAAGGAAGTAATAAATACTATGCAGACTCCGTGAAGGGC | SEQ ID NO:22192<br>GAAATAGGATTCAGTGAGGACTAC |
| iPS:435369 | 21-225_149G1 | AA | SEQ ID NO:6169<br>DYGMH | SEQ ID NO:14181<br>VIWYEGSNKYYADSVKG | SEQ ID NO:22193<br>EIGFSEDY |
| | | NA | SEQ ID NO:6170<br>AATTATGATATCAAC | SEQ ID NO:14182<br>TGGGTGCACCCTAACAGTGGTAACACAGGCTATGCACAGAAGTTCCAGGGC | SEQ ID NO:22194<br>AGCAGTGGCTGGTACTACTTTGACTAC |
| iPS:435371 | 21-225_149A2 | AA | SEQ ID NO:6171<br>NYDIN | SEQ ID NO:14183<br>WVHPNSGNTGYAQKFQG | SEQ ID NO:22195<br>SSGWYYFDY |
| | | NA | SEQ ID NO:6172<br>AACTATGCCATGACC | SEQ ID NO:14184<br>GCTATTAGTGGTCGTGGTGGTAACACATTCTACGCAGACTCCGTGAAGGGC | SEQ ID NO:22196<br>CGGGTGACGGACTACGGTGGTAACGACTGGTTCGACCCC |
| iPS:435371 | 21-225_149A3 | AA | SEQ ID NO:6173<br>NYAMT | SEQ ID NO:14185<br>AISGRGGNTFYADSVKG | SEQ ID NO:22197<br>RVIDYGGNDWFDP |
| | | | SEQ ID NO:6174 | SEQ ID NO:14186 | SEQ ID NO:22198 |

FIGURE 49
(Continued)

| | | | | | |
|---|---|---|---|---|---|
| iPS:435373 | 21-225_149E3 | NA | AATTATGATATCAAC | TGGATGCACCCTAACAG TGGTAACACAGGCTATG CACAGAAGTTCCAGGGC | AGCAGTGGCTGGTACTGGTT TGACTAC |
| | | | SEQ ID NO:6175 | SEQ ID NO:14187 | SEQ ID NO:22199 |
| | | AA | NYDIN | WMHPNSGNTGYAQKFQG | SSGWYWFDY |
| | | | SEQ ID NO:6176 | SEQ ID NO:14188 | SEQ ID NO:22200 |
| iPS:435375 | 21-225_149H4 | NA | AATTATGATATCAAC | TGGATGCACCCTAACAG TGGTAACACAGACTATG CACAGAAGTTCCAGGGC | AGCAGTGGCTGGTACTACTT TGACTAC |
| | | | SEQ ID NO:6177 | SEQ ID NO:14189 | SEQ ID NO:22201 |
| | | AA | NYDIN | WMHPNSGNTDYAQKFQG | SSGWYYFDY |
| | | | SEQ ID NO:6178 | SEQ ID NO:14190 | SEQ ID NO:22202 |
| iPS:435377 | 21-225_149G5 | NA | AATGGTGGTTACTACTGGAA C | TACATCTATTACAGTGGG AGCACCTACTACAACCC GTCCCTCAAGAGT | TACAGTACCTACGACTACTA CTACGGTATGGACGTC |
| | | | SEQ ID NO:6179 | SEQ ID NO:14191 | SEQ ID NO:22203 |
| | | AA | NGGYYWN | YIYYSGSTYYNPSLKS | YSTYDYYYGMDV |
| | | | SEQ ID NO:6180 | SEQ ID NO:14192 | SEQ ID NO:22204 |
| iPS:435379 | 21-225_149B6 | NA | AGCTATGCCATGAGC | GTTATTAGTGGTAGTGGT GGTAGCACATTCTACGC AGACTCCGTGAAGGGC | CGAACTCCGGAAGATGTTTT TGATATC |
| | | | SEQ ID NO:6181 | SEQ ID NO:14193 | SEQ ID NO:22205 |
| | | AA | SYAMS | VISGSGGSTFYADSVKG | RTPEDVFDI |
| | | | SEQ ID NO:6182 | SEQ ID NO:14194 | SEQ ID NO:22206 |
| iPS:435381 | 21-225_149C6 | NA | AGCTATGCCATGAGC | GCTATTAGTGGTAGTGGT GGTAACACATTCTACGC AGACTCCGTGAAGGGC | AAGGATTATGATTACGTTTG GGGGAGTCCTTACTTTGACT AC |
| | | | SEQ ID NO:6183 | SEQ ID NO:14195 | SEQ ID NO:22207 |

FIGURE 49
(Continued)

| | | | | | | |
|---|---|---|---|---|---|---|
| iPS:435383 | 21-225_149D7 | AA | SYAMS | | AISGSGGNTFYADSVKG | KDYDYVWGSPYFDY |
| | | | SEQ ID NO:6184 | | SEQ ID NO:14196 | SEQ ID NO:22208 |
| | | NA | AACAGTGGTTACTACTGGAG C | TACAGCTATTACAGTGG GAGCACCACTACAACC CGTCCCTCAAGAGT | GGGGGATATAACTGGAACCA TGCTTTTGATATC |
| | | | SEQ ID NO:6185 | | SEQ ID NO:14197 | SEQ ID NO:22209 |
| iPS:435391 | 21-225_149F8 | AA | NSGYYWS | | YSYYSGSTYYNPSLKS | GGYNWNHAFDI |
| | | | SEQ ID NO:6186 | | SEQ ID NO:14198 | SEQ ID NO:22210 |
| | | NA | AGCTATGCCATGAGC | | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6187 | | SEQ ID NO:14199 | SEQ ID NO:22211 |
| iPS:435393 | 21-225_149D10 | AA | SYAMS | | AISGRGGNTFYADSVKG | KDYDYVWGSPYFDY |
| | | | SEQ ID NO:6188 | | SEQ ID NO:14200 | SEQ ID NO:22212 |
| | | NA | GACTATGGCATGCAC | | GTTATATGGTATGATGG AAGTAATAAGTACTATG CAGACTCCGTGAAGGGC TC | GAGAGGTATAGCAGTGGCTG GTACGACTACGGTATGGACG |
| | | | SEQ ID NO:6189 | | SEQ ID NO:14201 | SEQ ID NO:22213 |
| iPS:435395 | 21-225_149D11 | AA | DYGMH | | VIWYDGSNKYYADSVKG | ERYSSGWYDYGMDV |
| | | | SEQ ID NO:6190 | | SEQ ID NO:14202 | SEQ ID NO:22214 |
| | | NA | AGCTATGCCATGAGC | | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6191 | | SEQ ID NO:14203 | SEQ ID NO:22215 |
| | | AA | SYAMS | | AISGRGGNTFYADSVKG | KDYDYVWGSPYFDY |
| | | | SEQ ID NO:6192 | | SEQ ID NO:14204 | SEQ ID NO:22216 |

FIGURE 49
(Continued)

| iPS:435397 | 21-225_149F12 | NA | GACTATGGCATGCAC | GTTATATGGTATGAAGA AATAATAAATACTATG CAGACTCCGTGAAGGC | GAAATAGGGTTCAGTGAAGA CTAC |
|---|---|---|---|---|---|
| | | | SEQ ID NO:6193 | SEQ ID NO:14205 | SEQ ID NO:22217 |
| | | AA | DYGMH | VIWYEENNKYYADSVKG | EIGFSEDY |
| | | NA | AATTATGATATCAAC | TGGATGCACCTAACAG TGGTAACACAGGCTATG CACAGAAGTTCCAGGGC | AGCAGTGGCTGGTACTACTT TGACTAC |
| iPS:435399 | 21-225_150D2 | | SEQ ID NO:6194 | SEQ ID NO:14206 | SEQ ID NO:22218 |
| | | AA | NYDIN | WMHPNSGNTGYAQKFQG | SSGWYYFDY |
| | | | SEQ ID NO:6195 | SEQ ID NO:14207 | SEQ ID NO:22219 |
| iPS:435401 | 21-225_150E2 | NA | AGCTATGTCATGCAC | GTTATATGGTATGATGG AAGTAATAAATACTATG CAGACTCCGTGAAGGGC TC | GAGGAGTATAGCAGCAGCTG GTACGGGTACGGTATGGACG |
| | | | SEQ ID NO:6196 | SEQ ID NO:14208 | SEQ ID NO:22220 |
| | | AA | SYVMH | VIWYDGSNKYYADSVKG | EEYSSSWYGYGMDV |
| | | | SEQ ID NO:6197 | SEQ ID NO:14209 | SEQ ID NO:22221 |
| iPS:435403 | 21-225_150C5 | NA | AGCTATGCCATGAGC | GCTATTAGTGGTAGTGGT GGTAACACATTCTACGC AGACTCCGTGAAGGGC | AAGGATTATGATTACGTTTG GGGGAGTCCTTACTTTGACT AC |
| | | | SEQ ID NO:6198 | SEQ ID NO:14210 | SEQ ID NO:22222 |
| | | AA | SYAMS | AISGSGGNTFYADSVKG | KDYDYVWGSPYFDY |
| | | | SEQ ID NO:6199 | SEQ ID NO:14211 | SEQ ID NO:22223 |
| | | | SEQ ID NO:6200 | SEQ ID NO:14212 | SEQ ID NO:22224 |

FIGURE 49
(Continued)

| | | | | |
|---|---|---|---|---|
| iPS:435405 | 21-225_150B7 | NA | AATTATGATATCAAC<br>SEQ ID NO:6201 | TGGATGCACCCTAACAG<br>TGGTAACACAGGCTATG<br>CACAGAAGTTCCAGGGC<br>SEQ ID NO:14213 | AGCAGTGGCTGGTACTTTTT<br>TGACTAC<br>SEQ ID NO:22225 |
| | | AA | NYDIN<br>SEQ ID NO:6202 | WMHPNSGNTGYAQKFQG<br>SEQ ID NO:14214 | SSGWYFFDY<br>SEQ ID NO:22226 |
| iPS:435407 | 21-225_150E7 | NA | GACTATGGCATGCAC<br>SEQ ID NO:6203 | GTTATATGGTATGAAGA<br>AAATAATACTATG<br>CAGACTCCGTGAAGGGC<br>SEQ ID NO:14215 | GAAATAGGGTTCAGTGAGGA<br>CTAC<br>SEQ ID NO:22227 |
| | | AA | DYGMH<br>SEQ ID NO:6204 | VIWYEENNKYYADSVKG<br>SEQ ID NO:14216 | EIGFSEDY<br>SEQ ID NO:22228 |
| iPS:435409 | 21-225_150G8 | NA | ACCTATAGCATGACT<br>SEQ ID NO:6205 | TACATTAGTAGGAGTAG<br>TAGTACCATATACTACGC<br>AGACTCTGTGAAGGGC<br>SEQ ID NO:14217 | TCGGCATTAGCCCTTTGAT<br>CTAC<br>SEQ ID NO:22229 |
| | | AA | TYSMT<br>SEQ ID NO:6206 | YISRSSSTIYYADSVKG<br>SEQ ID NO:14218 | SAFSPFDY<br>SEQ ID NO:22230 |
| iPS:435413 | 21-225_150B11 | NA | AGCTATGGCATGCAC<br>SEQ ID NO:6207 | ATTATATGGTATGATGG<br>AAGTAATAAATACTATG<br>CAGACTCCGTGAAGGGC<br>SEQ ID NO:14219 | GATCGTTACGATTTTGGAG<br>TGGTCACTTTGACTAC<br>SEQ ID NO:22231 |
| | | AA | SYGMH<br>SEQ ID NO:6208 | IIWYDGSNKYYADSVKG<br>SEQ ID NO:14220 | DRYDFWSGHFDY<br>SEQ ID NO:22232 |

FIGURE 49
(Continued)

| | | | | | | | | |
|---|---|---|---|---|---|---|---|---|
| iPS:435415 | 21-225_150C11 | NA | AGCTATGCCATGAAC | SEQ ID NO:6209 | GCTATTAGTGGTAGTGGT GGTAACACATTCTACGC AGACTCCGTGAAGGGC | SEQ ID NO:14221 | CGGGTGACGGACTACGGTGG TAACGACTGGTTCGACCCC | SEQ ID NO:22233 |
| | | AA | SYAMN | SEQ ID NO:6210 | AISGSGGNTFYADSVKG | SEQ ID NO:14222 | RVTDYGGNDWFDP | SEQ ID NO:22234 |
| iPS:435417 | 21-225_150D11 | NA | AGCTATGGCATGCAC | SEQ ID NO:6211 | GTATATTCTATGATGGA AGTAATAAACACTATGC AGACTCCGTGAAGGGC | SEQ ID NO:14223 | AGGTTTAGCAGCAGCTGGTC GGGGGGTATGGACGTC | SEQ ID NO:22235 |
| | | AA | SYGMH | SEQ ID NO:6212 | VIFYDGSNKHYADSVKG | SEQ ID NO:14224 | RFSSSWSGGMDV | SEQ ID NO:22236 |
| iPS:435419 | 21-225_150C12 | NA | AGCTATGCCATGAGC | SEQ ID NO:6213 | GCTATTAGTGGTGGTCGTGGT GGTAACACATTCTACGC AGACTCCGTGAAGGGC | SEQ ID NO:14225 | CGGGTGACGGACTACGGTGG TAACGACTGGTTCGACCCC | SEQ ID NO:22237 |
| | | AA | SYAMS | SEQ ID NO:6214 | AISGRGGNTFYADSVKG | SEQ ID NO:14226 | RVTDYGGNDWFDP | SEQ ID NO:22238 |
| iPS:435421 | 21-225_151F1 | NA | AGCTTTAGCATGAAC | SEQ ID NO:6215 | TCCATTAGTAGTAGTAGT TATTACATATACGCA GACTCAGTGAAGGGC | SEQ ID NO:14227 | GATACACCACTGGTTTAC | SEQ ID NO:22239 |
| | | AA | SFSMN | SEQ ID NO:6216 | SISSSSYIYYADSVKG | SEQ ID NO:14228 | DTPLVY | SEQ ID NO:22240 |
| iPS:435423 | 21-225_151G5 | NA | AGCTATGGCATGCAC | SEQ ID NO:6217 | ATTATATGGTATGATGG AAGTAATAAATACTATG CAGACTCCGTGAAGGGC | SEQ ID NO:14229 | GATCGATACGATTTTGGAG TGGTCACTTTGACTAC | SEQ ID NO:22241 |

FIGURE 49
(Continued)

| | | | | | | |
|---|---|---|---|---|---|---|
| iPS:435425 | 21-225_151B12 | AA | SYGMH SEQ ID NO:6218 | IIWYDGSNKYYADSVKG SEQ ID NO:14230 | DRYDFWSGHFDY SEQ ID NO:22242 |
| | | NA | AGCTATGCCATGAAC SEQ ID NO:6219 | GCTATTAGTGGTAGTGGT AAAAACACATTCTACGC AGACTCCGTGAAGGGC SEQ ID NO:14231 | CGGGTGACGGACTACGGTGG TAACGACTGGTTCGACCCC SEQ ID NO:22243 |
| iPS:435427 | 21-225_151C9 | AA | SYAMN SEQ ID NO:6220 | AISGSGKNTFYADSVKG SEQ ID NO:14232 | RVTDYGGNDWFDP SEQ ID NO:22244 |
| | | NA | AGCTATGGCATGCAC SEQ ID NO:6221 | GTTATATCATATGATGGA AGTAATAAATACTATGC AGACTCCGTGAAGGGC SEQ ID NO:14233 | GGGGTATTACTATGGTTCGG GGAGCTAGAAGATGACTGGT TCGACCCC SEQ ID NO:22245 |
| iPS:435429 | 21-225_151A10 | AA | SYGMH SEQ ID NO:6222 | VISYDGSNKYYADSVKG SEQ ID NO:14234 | GVLLWFGELEDDWFDP SEQ ID NO:22246 |
| | | NA | AACTATGGCATGCAC SEQ ID NO:6223 | ATTATATATGGTATGATGG AAGTAATAAATACTATG CAGACTCCGTGAAGGGC SEQ ID NO:14235 | GATCATTAGGATTTTTGGAG TGGTCACTTTGACTAC SEQ ID NO:22247 |
| iPS:435431 | 21-225_152D2 | AA | NYGMH SEQ ID NO:6224 | IIWYDGSNKYYADSVKG SEQ ID NO:14236 | DHYDFWSGHFDY SEQ ID NO:22248 |
| | | NA | AGCTATGCCATGAGC SEQ ID NO:6225 | GCTATTAGTGGTCGTGGT GGTAACACATTCTACGC AGACTCCGTGAAGGGC SEQ ID NO:14237 | CGGGTGACGGACTACGGTGG TAACGACTGGTTCGACCCC SEQ ID NO:22249 |
| | | AA | SYAMS SEQ ID NO:6226 | AISGRGGNTFYADSVKG SEQ ID NO:14238 | RVTDYGGNDWFDP SEQ ID NO:22250 |

FIGURE 49 (Continued)

| | | | | | |
|---|---|---|---|---|---|
| iPS:435433 | 21-225_152E3 | NA | AATTATGATATCAAC SEQ ID NO:6227 | TGGATGCACCCTAACAG TGGTAACACAGGCTATG CACAGAAGTTCCAGGGC SEQ ID NO:14239 | AGCAGTGGCTGGTACTTTTT TGACTAC SEQ ID NO:22251 |
| | | AA | NYDIN SEQ ID NO:6228 | WMHPNSGNTGYAQKFQG SEQ ID NO:14240 | SSGWYFFDY SEQ ID NO:22252 |
| iPS:435435 | 21-225_152H3 | NA | AATTATGATATCAAC SEQ ID NO:6229 | TGGATGCACCCTAACAG TGGTAACACAGGCTATG CACAGAAGTTCCAGGGC SEQ ID NO:14241 | AGCAGTGGCTGGTACTGGTT TGACTAC SEQ ID NO:22253 |
| | | AA | NYDIN SEQ ID NO:6230 | WMHPNSGNTGYAQKFQG SEQ ID NO:14242 | SSGWYWFDY SEQ ID NO:22254 |
| iPS:435437 | 21-225_152F4 | NA | AATTATGATATCAAC SEQ ID NO:6231 | TGGATGCACCCTAACAG TGGTAACACAGGCTATG CACAGAAGTTCCAGGGC SEQ ID NO:14243 | AGCAGTGGCTGGTACTGGTT CGACCCC SEQ ID NO:22255 |
| | | AA | NYDIN SEQ ID NO:6232 | WMHPNSGNTGYAQKFQG SEQ ID NO:14244 | SSGWYWFDP SEQ ID NO:22256 |
| iPS:435439 | 21-225_152G4 | NA | AGCTATGGCCATGAGC SEQ ID NO:6233 | GCTATTAGTGGTGTGGT GGTAACACATTCTACGC AGACTCCGTGAAGGGC SEQ ID NO:14245 | CGGGTGACGGACTACGGTGG TAACGACTGGTTCGACCCC SEQ ID NO:22257 |
| | | AA | SYAMS SEQ ID NO:6234 | AISGRGGNTFYADSVKG SEQ ID NO:14246 | RVTDYGGNDWFDP SEQ ID NO:22258 |
| iPS:435441 | 21-225_152F6 | NA | AGCTATGGCATGCAC | ATTATATGGTATGATGG AAGTTATAAATACTATG CAGACTCCGTGAAGGGC | GAGGGGTACGATTTTTGGAG TGGTTACCTTGGCTAC |

FIGURE 49
(Continued)

| | | | | | | |
|---|---|---|---|---|---|---|
| iPS:435443 | 21-225_152F6 | AA | SEQ ID NO:6235<br>SYGMH | SEQ ID NO:14247<br>IIWYDGSYKYYADSVKG | SEQ ID NO:22259<br>EGYDFWSGYLGY | |
| | | NA | SEQ ID NO:6236<br>AACAGTGGTTACTACTGGAG | SEQ ID NO:14248<br>TACAGTTATTACAGTGG<br>GAGCACCTACTACAACC<br>CGTCCCTCAAGAGT | SEQ ID NO:22260<br>GGGGGATATAACTGGAACCA<br>TGCTTTTGATATC | |
| iPS:435445 | 21-225_152F7 | AA | SEQ ID NO:6237<br>NSGYYWS | SEQ ID NO:14249<br>YSYYSGSTYYNPSLKS | SEQ ID NO:22261<br>GGYNWNHAFDI | |
| | | NA | SEQ ID NO:6238<br>AGCTATATCATGCAC | SEQ ID NO:14250<br>GTTATATGGTATGATGG<br>AAGTAATAAATACTATG<br>CAGACTCCGTGAAGGGC | SEQ ID NO:22262<br>GAGGAGTATAGCAGCAGCTG<br>GTACGGGTACGGTATGGACG<br>TC | |
| | | AA | SEQ ID NO:6239<br>SYIMH | SEQ ID NO:14251<br>VIWYDGSNKYYADSVKG | SEQ ID NO:22263<br>EEYSSSWYGYGMDV | |
| iPS:435447 | 21-225_152H7 | NA | SEQ ID NO:6240<br>AGCTATGCCATGAAC | SEQ ID NO:14252<br>GCTATTAGTGGTAGTGGT<br>GGTAACACATTCTACGC<br>AGACTCCGTGAAGGGC | SEQ ID NO:22264<br>AAGGATAATGATTACGTTTG<br>GGGGAGTCCTTACTTTGACT<br>AC | |
| | | AA | SEQ ID NO:6241<br>SYAMN | SEQ ID NO:14253<br>AISGSGGNTFYADSVKG | SEQ ID NO:22265<br>KDNDYVWGSPYFDY | |
| iPS:435449 | 21-225_152H9 | NA | SEQ ID NO:6242<br>AGAAGTAGTTACTACTGGGG<br>C | SEQ ID NO:14254<br>AGTATCTATTATAGTGGG<br>AGCGCTCCTACAACCC<br>GTCCCTCAAGAGT | SEQ ID NO:22266<br>CTTGATCTCCAGTGGAGTTTT<br>GACTTC | |
| | | AA | SEQ ID NO:6243<br>RSSYYWG | SEQ ID NO:14255<br>SIYYSGSASYNPSLKS | SEQ ID NO:22267<br>LDLQWSFDF | |
| | | | SEQ ID NO:6244 | SEQ ID NO:14256 | SEQ ID NO:22268 | |

FIGURE 49
(Continued)

| | | | | | |
|---|---|---|---|---|---|
| iPS:435451 | 21-225_152D10 | NA | AATTACTACTGGAGC | CGTATCGATACCAGTGG GATCACCAACTACAAC CCTCCCTCAAGAGT | GAGGGGGGGATTGGGAGCTAC CTTCTTTGACTAC |
| | | | SEQ ID NO:6245 | SEQ ID NO:14257 | SEQ ID NO:22269 |
| | | AA | NYYWS | RIDTSGITNYNPSLKS | EGGLGATFFDY |
| | | | SEQ ID NO:6246 | SEQ ID NO:14258 | SEQ ID NO:22270 |
| iPS:435453 | 21-225_152G10 | NA | AGCTATGCCATGAGC | GCTATTAGTGGTCGTGGT GGTAACACATTCTACGC AGACTCCGTGAAGGGC | AAGGATTATGATTACGTTTG GGGGAGTCCTTACTTTGACT AC |
| | | | SEQ ID NO:6247 | SEQ ID NO:14259 | SEQ ID NO:22271 |
| | | AA | SYAMS | AISGRGGNTFYADSVKG | KDYDYVWGSPYFDY |
| | | | SEQ ID NO:6248 | SEQ ID NO:14260 | SEQ ID NO:22272 |
| iPS:435455 | 21-225_152B11 | NA | AGCTATGCCATGAAC | GCTATTAGTGGTCGTGGT GGTAACACATTCTACGC AGACTCCGTGAAGGGC | CGGGTGACGGACTACGGTGG TAACGACTGGTTCGACCCC |
| | | | SEQ ID NO:6249 | SEQ ID NO:14261 | SEQ ID NO:22273 |
| | | AA | SYAMN | AISGRGGNTFYADSVKG | RVTDYGGNDWFDP |
| | | | SEQ ID NO:6250 | SEQ ID NO:14262 | SEQ ID NO:22274 |
| iPS:435457 | 21-225_152C11 | NA | AACTATGGCATGCAC | ATTATATGGTATGATGG AAGTAATAAATACTATG CAGACTCCGTGAAGGGC | GAGGCTTACGATTTTTGGAG TGGTTATTTTGACTAC |
| | | | SEQ ID NO:6251 | SEQ ID NO:14263 | SEQ ID NO:22275 |
| | | AA | NYGMH | IIWYDGSNKYYADSVKG | EAYDFWSGYFDY |
| | | | SEQ ID NO:6252 | SEQ ID NO:14264 | SEQ ID NO:22276 |
| iPS:435459 | 21-225_152E12 | NA | AATTATGATATCAAC | TGGATGAACCCTAACAG TGGTAACACAGGCTATG CACAGAAGTTCCAGGGC | AGCAGTGGCTGTACTACTT TGACTAC |
| | | | SEQ ID NO:6253 | SEQ ID NO:14265 | SEQ ID NO:22277 |

FIGURE 49
(Continued)

| | | | | | | | |
|---|---|---|---|---|---|---|---|
| iPS:435461 | 21-225_153A1 | AA | NYDIN | | WMNPNSGNTGYAQKFQG | | SSGWYYFDY |
| | | | SEQ ID NO:6254 | | SEQ ID NO:14266 | | SEQ ID NO:22278 |
| | | NA | AGCTATGTCATGAGT | | GCTATTAGTGGAAGTGG TGATAGAACATACTACG CAGACTCCGTGAAGGGC | | ACGGGACTAAGGACTAC |
| | | | SEQ ID NO:6255 | | SEQ ID NO:14267 | | SEQ ID NO:22279 |
| | | AA | SYVMS | | AISGSGDRTYYADSVKG | | TATKDY |
| | | | SEQ ID NO:6256 | | SEQ ID NO:14268 | | SEQ ID NO:22280 |
| iPS:435463 | 21-225_153D2 | NA | AGCTATGGCATGCAC | | ATTATATGGTATGATGG AAGTTATAAATACTATG CAGACTCCGTGAAGGGC | | GAGGGGTACGATTTTGGAG TGGTTACCTTGGCTAC |
| | | | SEQ ID NO:6257 | | SEQ ID NO:14269 | | SEQ ID NO:22281 |
| | | AA | SYGMH | | IIWYDGSYKYYADSVKG | | EGYDFWSGYLGY |
| | | | SEQ ID NO:6258 | | SEQ ID NO:14270 | | SEQ ID NO:22282 |
| iPS:435465 | 21-225_153A6 | NA | AACAGTGGTTACTACTGGAGC | | TACAGCTATTACAGTGG GAGCACCTACTACAACC CGTCCCTCAAGAGT | | GGGGGATATAACTGGAACCA TGCTTTTGATATC |
| | | | SEQ ID NO:6259 | | SEQ ID NO:14271 | | SEQ ID NO:22283 |
| | | AA | NSGYYWS | | YSYYSGSTYYNPSLKS | | GGYNWNHAFDI |
| | | | SEQ ID NO:6260 | | SEQ ID NO:14272 | | SEQ ID NO:22284 |
| iPS:435467 | 21-225_153B9 | NA | AGTTACTACTGGAGC | | CGTATCGATACCAGTGG GATCACCAACTACAACC CCTCCCTCAAGAGT | | GAGGGGGAGTGGGAGCTA CGTACTTTGACTAC |
| | | | SEQ ID NO:6261 | | SEQ ID NO:14273 | | SEQ ID NO:22285 |
| | | AA | SYYWS | | RIDTSGITNYNPSLKS | | EGGVGATYFDY |
| | | | SEQ ID NO:6262 | | SEQ ID NO:14274 | | SEQ ID NO:22286 |

FIGURE 49
(Continued)

| ID | subID | type | CDR1 NA/AA | SEQ ID | CDR2 NA/AA | SEQ ID | CDR3 NA/AA | SEQ ID |
|---|---|---|---|---|---|---|---|---|
| iPS:435469 | 21-225_153G9 | NA | AGCTATGGCATGCAC | SEQ ID NO:6263 | CTTATATTCTATGATGGAAGTAATAAATACTATGCAGACTCCGTGAAGGGC | SEQ ID NO:14275 | CGCTATAGCCGCAGCTGGGCCGGGGTATGGACGTC | SEQ ID NO:22287 |
| | | AA | SYGMH | SEQ ID NO:6264 | LIFYDGSNKYYADSVKG | SEQ ID NO:14276 | RYSRSWAGGMDV | SEQ ID NO:22288 |
| iPS:435471 | 21-225_153F11 | NA | AATTATGATATCAAC | SEQ ID NO:6265 | TGGATGCACCCTAACAGTGGTAACACAGGCTATGCACAGAAGTTCCAGGGC | SEQ ID NO:14277 | AGCAGTGGCTGGTACTTCTTTGACAAC | SEQ ID NO:22289 |
| | | AA | NYDIN | SEQ ID NO:6266 | WMHPNSGNTGYAQKFQG | SEQ ID NO:14278 | SSGWYFFDN | SEQ ID NO:22290 |
| iPS:435475 | 21-225_154H6 | NA | AATTATGATATCAAC | SEQ ID NO:6267 | TGGATGAACCCTAACAGTGGTAACACAGGCTATGCACAGAAGTTCCAGGGC | SEQ ID NO:14279 | AGCAGTGGCTGGTACATCTTTGACTAC | SEQ ID NO:22291 |
| | | AA | NYDIN | SEQ ID NO:6268 | WMNPNSGNTGYAQKFQG | SEQ ID NO:14280 | SSGWYIFDY | SEQ ID NO:22292 |
| iPS:435479 | 21-225_154E9 | NA | AGCTATGCCATGAGC | SEQ ID NO:6269 | GCTATTAGTGGTCGTGGTGGTAACACATTCTACGCAGACTCCGTGAAGGGC | SEQ ID NO:14281 | AGGGGATTTCGATTTTTGGAGTGGTTGGGGGGCTTTGACTAC | SEQ ID NO:22293 |
| | | AA | SYAMS | SEQ ID NO:6270 | AISGRGGNTFYADSVKG | SEQ ID NO:14282 | RGFRFLEWLGGFDY | SEQ ID NO:22294 |
| iPS:435481 | | NA | AATTATGATATCAAC | | TGGATGAACCCTAACAGTGGTAACACAGAAGTTCCAGGGC | | AGCAGTGGCTGGTACTACTTCGACTAC | |

FIGURE 49
(Continued)

| | | | | SEQ ID NO:6271 | SEQ ID NO:14283 | SEQ ID NO:22295 |
| --- | --- | --- | --- | --- | --- | --- |
| iPS:435483 | 21-225_154A11 | | AA | NYDIN | WMNPNSGNTGYAQKFQG | SSGWYYFDY |
| | | | NA | SEQ ID NO:6272 AGCTATGCCATGAGC | SEQ ID NO:14284 GCTATTAGTGGTAGTGGT GGTAACACATTCTACGC AGACTCCGTGAAGGGC | SEQ ID NO:22296 AAGGATTATGATTACGTTG GGGGAGTCCTTACTTTGACT AC |
| iPS:435485 | 21-225_155A4 | | AA | SEQ ID NO:6273 SYAMS | SEQ ID NO:14285 AISGSGGNTFYADSVKG | SEQ ID NO:22297 KDYDYVWGSPYFDY |
| | | | NA | SEQ ID NO:6274 AGCTATGCCATGAGC | SEQ ID NO:14286 GCTATTAGTGGTAGTGGT GGTAACACATTCTACGC AGACTCCGTGAAGGGC | SEQ ID NO:22298 AAGGATTATGATTACGTTG GGGGAGTCCTTACTTTGACT AC |
| iPS:435487 | 21-225_155B4 | | AA | SEQ ID NO:6275 SYAMS | SEQ ID NO:14287 AISGSGGNTFYADSVKG | SEQ ID NO:22299 KDYDYVWGSPYFDY |
| | | | NA | SEQ ID NO:6276 AGCTATGCCATGAGC | SEQ ID NO:14288 GCTATTAGTGGTGTCGTGGT GGTAACACATTCTACGC AGACTCCGTGAAGGGC | SEQ ID NO:22300 CGGGTGACGGACTACGGTGG TAACGACTGGTTCGACCCC |
| iPS:435489 | 21-225_155C4 | | AA | SEQ ID NO:6277 SYAMS | SEQ ID NO:14289 AISGRGGNTFYADSVKG | SEQ ID NO:22301 RVTDYGGNDWFDP |
| | | | NA | SEQ ID NO:6278 AGCTATGCCATGCAC | SEQ ID NO:14290 ATTATATGGTATGATGG AAGTAGTAAATACTATG CAGACTCCGTGAAGGGC | SEQ ID NO:22302 GATCGATACGATTTTGGAG TGGTCACTTTGACTAC |
| | 21-225_155A5 | | AA | SEQ ID NO:6279 SYGMH | SEQ ID NO:14291 HWYDGSSKYYADSVKG | SEQ ID NO:22303 DRYDFWSGHFDY |
| | | | | SEQ ID NO:6280 | SEQ ID NO:14292 | SEQ ID NO:22304 |

FIGURE 49
(Continued)

| | | | | | | |
|---|---|---|---|---|---|---|
| iPS:435491 | 21-225_155E5 | NA | AATTATGATATCAAC | | TGGATGCACCCTAACAG TGGTAGTACAGGCTATG CACAGAGGTTCCAGGGC | | AGCAGTGGCTGGTACTATTT TGACTAC |
| | | | SEQ ID NO:6281 | | SEQ ID NO:14293 | | SEQ ID NO:22305 |
| | | AA | NYDIN | | WMHPNSGSTGY AQRFQG | | SSGWYYFDY |
| | | | SEQ ID NO:6282 | | SEQ ID NO:14294 | | SEQ ID NO:22306 |
| iPS:435495 | 21-225_155B6 | NA | AATTATGATATCAAC | | TGGATGAACCCTAACAG TGGTAACACAGGCTATG CACAGAAGTTCCAGGGC | | AGCAGTGGCTGGTACTACTT TGACTAC |
| | | | SEQ ID NO:6283 | | SEQ ID NO:14295 | | SEQ ID NO:22307 |
| | | AA | NYDIN | | WMNPNSGNTGY AQKFQG | | SSGWYYFDY |
| | | | SEQ ID NO:6284 | | SEQ ID NO:14296 | | SEQ ID NO:22308 |
| iPS:435497 | 21-225_155H9 | NA | AGCTATGCCATGAAC | | ACTATTAGTGGTAGAGG TCTTGGCACATACTACGC AGACTCCGTGAAGGGC | | GACCATGACTACGGTGACTA CAATATCTACTTTGACTAC |
| | | | SEQ ID NO:6285 | | SEQ ID NO:14297 | | SEQ ID NO:22309 |
| | | AA | SYAMN | | TISGRGLGTYYADSVKG | | DHDYGDYNIYFDY |
| | | | SEQ ID NO:6286 | | SEQ ID NO:14298 | | SEQ ID NO:22310 |
| iPS:435499 | 21-225_156G1 | NA | AGAAGTAGTTACTACTGGGG C | | AGTATCTATTATAGTGGG AGCGCCTCCTACAACCC GTCCCTCAAGAGT | | CTTGATCTCCAGTGGAGTTTT GACTTC |
| | | | SEQ ID NO:6287 | | SEQ ID NO:14299 | | SEQ ID NO:22311 |
| | | AA | RSSYYWG | | SIYYSGSASYNPSLKS | | LDLQWSFDF |
| | | | SEQ ID NO:6288 | | SEQ ID NO:14300 | | SEQ ID NO:22312 |
| iPS:435501 | 21-225_156H1 | NA | AATTATGATATCAAC | | TGGGTGCACCCTAACAG TGGTAACACAGGCTATG CACAGAAGTTCCAGGGC | | AGCAGTGGCTGGTACTACTT TGACTAC |
| | | | SEQ ID NO:6289 | | SEQ ID NO:14301 | | SEQ ID NO:22313 |

FIGURE 49
(Continued)

|  |  |  | NYDIN | SEQ ID NO:6290 | WVHPNSGNTGYAQKFQG | SEQ ID NO:14302 | SSGWYFDY | SEQ ID NO:22314 |
|---|---|---|---|---|---|---|---|---|
| iPS:435503 | 21-225_156F4 | NA | AGCTATGGCATGAGC | SEQ ID NO:6291 | GCTATTAGTGGTCGTGGT GGTAACACATTCTACGC AGACTCCGTGAAGGGC | SEQ ID NO:14303 | CGGGTGACGGACTACGGTGG TAACGACTGGTTCGACCCC | SEQ ID NO:22315 |
|  |  | AA | SYAMS | SEQ ID NO:6292 | AISGRGGNTFYADSVKG | SEQ ID NO:14304 | RVTDYGGNDWFDP | SEQ ID NO:22316 |
| iPS:435505 | 21-225_157C1 | NA | AGCTATAGAATGAAC | SEQ ID NO:6293 | TCCATGAGTAATAGTAG TAGTTCCATATACTACGC AGACTCAGTGAAGGGC | SEQ ID NO:14305 | CAGGCAGCCCAGGACTAC | SEQ ID NO:22317 |
|  |  | AA | SYRMN | SEQ ID NO:6294 | SMSNSSSSIYYADSVKG | SEQ ID NO:14306 | QAAQDY | SEQ ID NO:22318 |
| iPS:435509 | 21-225_157H1 | NA | AGTTATGCCATGAGG | SEQ ID NO:6295 | GATATTAGTGGTAGTGG TGGTACCACATACTACG CAGACTCCGTGAAGGGC | SEQ ID NO:14307 | ACCTACCTC | SEQ ID NO:22319 |
|  |  | AA | SYAMR | SEQ ID NO:6296 | DISGSGGTTYYADSVKG | SEQ ID NO:14308 | TYL | SEQ ID NO:22320 |
| iPS:435511 | 21-225_157C3 | NA | ACCTATGGCATGCAC | SEQ ID NO:6297 | GTTATATGGTATGATGTA AATAATAAATACTATGC AGACTCCGTGAAGGGC | SEQ ID NO:14309 | GAGCTGGGGGTTCCTCTCTGA CTAT | SEQ ID NO:22321 |
|  |  | AA | TYGMH | SEQ ID NO:6298 | VIWYDVNNKYYADSVKG | SEQ ID NO:14310 | ELGFLSDY | SEQ ID NO:22322 |

FIGURE 49
(Continued)

| | | | | | |
|---|---|---|---|---|---|
| iPS:435513 | 21-225_157F3 | NA | ACCTATGCCATGAGC | GTTATTAGTGGTAGTGGT GGTAGCACATACTACGC AGACTCCGTGAAGGGC | AGGAGCAGTGGCTGGTACGA GGATGCTCTTGATATC |
| | | | SEQ ID NO:6299 | SEQ ID NO:14311 | SEQ ID NO:22323 |
| | | AA | TYAMS | VISGSGGSTYYADSVKG | RSSGWYEDALDI |
| | | | SEQ ID NO:6300 | SEQ ID NO:14312 | SEQ ID NO:22324 |
| iPS:435515 | 21-225_157E4 | NA | AGCTATACCATGAAC | TCCATTAGTGGTAGTAGT AGTTACATATACTACGC AGACTCAGTGAAGGGC | GTAGCTACCTTTGACTAC |
| | | | SEQ ID NO:6301 | SEQ ID NO:14313 | SEQ ID NO:22325 |
| | | AA | SYTMN | SISGSSSYIYYADSVKG | VATFDY |
| | | | SEQ ID NO:6302 | SEQ ID NO:14314 | SEQ ID NO:22326 |
| iPS:435521 | 21-225_157H4 | NA | AGTTATAGCATGAAC | TCCATTAGTAGTAGTAGT ACTTACATATACTACGCA GACTCAGTGAAGGGC | GATAGAGGGTCCATC |
| | | | SEQ ID NO:6303 | SEQ ID NO:14315 | SEQ ID NO:22327 |
| | | AA | SYSMN | SISSSSTYIYYADSVKG | DRGSI |
| | | | SEQ ID NO:6304 | SEQ ID NO:14316 | SEQ ID NO:22328 |
| iPS:435523 | 21-225_157G5 | NA | AGCTATGTCATGAGC | GCTATGAGTGGTAGTGG TGGTAGAACATACTACG CAGACTCCGTGAAGGGC | TATACCTGAACGGCTAC |
| | | | SEQ ID NO:6305 | SEQ ID NO:14317 | SEQ ID NO:22329 |
| | | AA | SYVMS | AMSGSGGRTYYADSVKG | YTWNGY |
| | | | SEQ ID NO:6306 | SEQ ID NO:14318 | SEQ ID NO:22330 |
| iPS:435525 | 21-225_157E7 | NA | AGTGGTAGTTACTACTGGGG C | AGTATCTACTATAGTGG GAGCACTACTACAATC CGTCCCTCAAGAGT | CATAAAGTGGCTGGTCCCTT TGACTAC |
| | | | SEQ ID NO:6307 | SEQ ID NO:14319 | SEQ ID NO:22331 |
| | | AA | SGSYYWG | SIYYSGSTYYNPSLKS | HKVAGPFDY |
| | | | SEQ ID NO:6308 | SEQ ID NO:14320 | SEQ ID NO:22332 |

FIGURE 49
(Continued)

| iPS:435527 | 21-225_157G7 | NA | AGTTATAGCATGAAC SEQ ID NO:6309 | TCCATTAGTGGTAGTAGT ACGTACATATACTGC AGACTCAGTGAAGGGC SEQ ID NO:14321 | GATCGGGGCAGCAGC SEQ ID NO:22333 |
| --- | --- | --- | --- | --- | --- |
| | | AA | SYSMN SEQ ID NO:6310 | SISGSSTYYADSVKG SEQ ID NO:14322 | DRGSS SEQ ID NO:22334 |
| iPS:435529 | 21-225_157H7 | NA | AGCTATAGCATGAAC SEQ ID NO:6311 | TGCATTAGTGGTAGTAGT AGTTACATATATTATGCA GACTCAGTGAAGGGC SEQ ID NO:14323 | GATCGAGGGGCTAT SEQ ID NO:22335 |
| | | AA | SYSMN SEQ ID NO:6312 | CISGSSYIYYADSVKG SEQ ID NO:14324 | DRGGY SEQ ID NO:22336 |
| iPS:435531 | 21-225_157G8 | NA | AATTATGGCATGCAC SEQ ID NO:6313 | ATTATATGGTATGATGG AAGTTATAAATACTATG CAGACTCCGTGAAGGGC SEQ ID NO:14325 | GAGGGATACGATTTTTGGAG TGGTTTCTTGACTCC SEQ ID NO:22337 |
| | | AA | NYGMH SEQ ID NO:6314 | IIWYDGSYKYYADSVKG SEQ ID NO:14326 | EGYDFWSGFFDS SEQ ID NO:22338 |
| iPS:435533 | 21-225_157H8 | NA | AGCTATGGCATGCAC SEQ ID NO:6315 | GTTATATGGTATGATGTA AATAATAAATACTATGC AGACTCCGTGAAGGGC SEQ ID NO:14327 | GAGCTGGGGTTCCTCTCTGA CTAC SEQ ID NO:22339 |
| | | AA | SYGMH SEQ ID NO:6316 | VIWYDVNKYYADSVKG SEQ ID NO:14328 | ELGFLSDY SEQ ID NO:22340 |
| iPS:435535 | 21-225_157H10 | NA | AGCTATACCATGAAC SEQ ID NO:6317 | TCCATTAGTGGTAGCAGT AGTTACATAAACTACGC AGACTCAGTGAAGGGC SEQ ID NO:14329 | GTGGCTCACTTTGACTAC SEQ ID NO:22341 |

FIGURE 49
(Continued)

| | | | | | |
|---|---|---|---|---|---|
| iPS:435537 | 21-225_157H12 | AA | SYTMN | SISGSSSYINYADSVKG | VAHFDY |
| | | | SEQ ID NO:6318 | SEQ ID NO:14330 | SEQ ID NO:22342 |
| | | NA | AGTATATAGCATGAAC | TCCATTAGTGGTAGTGGT AGTTACATAAACTACGC AGACTCAGTGAAGGGC | TCCAAGTTTGACTCC |
| | | | SEQ ID NO:6319 | SEQ ID NO:14331 | SEQ ID NO:22343 |
| iPS:435539 | 21-225_158G1 | AA | SYSMN | SISGSGSYINYADSVKG | SKFDS |
| | | | SEQ ID NO:6320 | SEQ ID NO:14332 | SEQ ID NO:22344 |
| | | NA | AGTTATGGCATGAAC | TCCATTAGTGGTAGTGGT AGTTACATATACTACGC AGACTCAGTGAAGGGC | AGCAGTGGCTGGTCT |
| | | | SEQ ID NO:6321 | SEQ ID NO:14333 | SEQ ID NO:22345 |
| iPS:435543 | 21-225_158D4 | AA | SYGMN | SISGSGSYIYYADSVKG | SSGWS |
| | | | SEQ ID NO:6322 | SEQ ID NO:14334 | SEQ ID NO:22346 |
| | | NA | GACTATGTCATGCAC | GTTATATGGTATGATGG AAGTAATAAATACTATG CAGACTCCGTGAAGGGC | GAACCGTATACTAGTGGCTG GTACGACTACGGTATGGACG TC |
| | | | SEQ ID NO:6323 | SEQ ID NO:14335 | SEQ ID NO:22347 |
| | | AA | DYVMH | VIWYDGSNKYYADSVKG | EPYTSGWYDYGMDV |
| | | | SEQ ID NO:6324 | SEQ ID NO:14336 | SEQ ID NO:22348 |
| iPS:435545 | 21-225_158F4 | NA | AGTCACTTCTGGAGC | CGTATCTATACCAGTGG GACCACCAACTACACCC CCTCCCTCAAGAGT | TTGAGCAGTGGCTGGTTGA CTAC |
| | | | SEQ ID NO:6325 | SEQ ID NO:14337 | SEQ ID NO:22349 |
| | | AA | SHFWS | RIYTSGTTNYTPSLKS | LSSGWFDY |
| | | | SEQ ID NO:6326 | SEQ ID NO:14338 | SEQ ID NO:22350 |

FIGURE 49
(Continued)

| | | | | | | |
|---|---|---|---|---|---|---|
| iPS:435547 | 21-225_158F5 | NA | AGTTATAGCATGAAC | | TCCATTAGTGGTAGTAGT ACGTACATACTACGC AGACTCAGTGAAGGGC | | GATCGGGGCAGCAGC |
| | | | SEQ ID NO:6327 | | SEQ ID NO:14339 | | SEQ ID NO:22351 |
| | | AA | SYSMN | | SISGSSTYYYADSVKG | | DRGSS |
| | | | SEQ ID NO:6328 | | SEQ ID NO:14340 | | SEQ ID NO:22352 |
| iPS:435549 | 21-225_158H5 | NA | AGCTATAGCATGAAC | | TCCATCAGTGGTAGTAGT ACTTACATATACTACGCA GACTCAGTGAAGGGC | | GATCGGGGCAGCAGC |
| | | | SEQ ID NO:6329 | | SEQ ID NO:14341 | | SEQ ID NO:22353 |
| | | AA | SYSMN | | SISGSSTYYYADSVKG | | DRGSS |
| | | | SEQ ID NO:6330 | | SEQ ID NO:14342 | | SEQ ID NO:22354 |
| iPS:435551 | 21-225_158H6 | NA | AGCTATGGCATGCAC | | GTTATATGGTATGATGTA ACTATAAATACTATGC AGACTCCGTGAAGGGC | | GAACTGGGATGGGCGGAGG ACTAC |
| | | | SEQ ID NO:6331 | | SEQ ID NO:14343 | | SEQ ID NO:22355 |
| | | AA | SYGMH | | VIWYDVTNKYYADSVKG | | ELGWAEDY |
| | | | SEQ ID NO:6332 | | SEQ ID NO:14344 | | SEQ ID NO:22356 |
| iPS:435553 | 21-225_158G8 | NA | AGCTATACCATGAAC | | TTGATTAGTGGCAGTAGT AGTTACATATACTACGC AGACTCAGTGAAGGGC | | GATCGAGGCAGCCTC |
| | | | SEQ ID NO:6333 | | SEQ ID NO:14345 | | SEQ ID NO:22357 |
| | | AA | SYTMN | | LISGSSYYIYYADSVKG | | DRGSL |
| | | | SEQ ID NO:6334 | | SEQ ID NO:14346 | | SEQ ID NO:22358 |
| iPS:435557 | 21-225_158B12 | NA | AATTATGATATCAAC | | TGGATGCACCCTAACAG TGGTAACACAGGCTATG CACAGAAGTTCCAGGGC | | AGCAGTGGCTGGTACCGCTT TGACTAC |
| | | | SEQ ID NO:6335 | | SEQ ID NO:14347 | | SEQ ID NO:22359 |

FIGURE 49
(Continued)

| ID | Clone | Type | CDR1 | CDR2 | CDR3 |
|---|---|---|---|---|---|
| iPS:435559 | 21-225_158H12 | AA | NYDIN<br>SEQ ID NO:6336 | WMHPNSGNTGYAQKFQG<br>SEQ ID NO:14348 | SSGWYRFDY<br>SEQ ID NO:22360 |
| | | NA | AGCTATGTCATGAGC<br>SEQ ID NO:6337 | GCTATTAGTGGTAGTGGTGGTAGGACAGACTACGCAGACTCCGTAAAGGGC<br>SEQ ID NO:14349 | GGGGGCTGGAACCACGAC<br>SEQ ID NO:22361 |
| iPS:435561 | 21-225_159F1 | AA | SYVMS<br>SEQ ID NO:6338 | AISGSGGRTDYADSVKG<br>SEQ ID NO:14350 | GGWNHD<br>SEQ ID NO:22362 |
| | | NA | AGCTATAGAATGAAC<br>SEQ ID NO:6339 | TCCATAAGTGGTAGTGGTAATTACATAGACTACGCAGACTCAGTGAAGGGC<br>SEQ ID NO:14351 | GGTTGGGACGTC<br>SEQ ID NO:22363 |
| iPS:435563 | 21-225_159H2 | AA | SYRMN<br>SEQ ID NO:6340 | SISGSGNYIDYADSVKG<br>SEQ ID NO:14352 | GWDV<br>SEQ ID NO:22364 |
| | | NA | AGTTATGATATCAAC<br>SEQ ID NO:6341 | TGGATGAACCCTAACAGTGGTAACACAGGCTATGTACAGAAGTTCCAGGGC<br>SEQ ID NO:14353 | AAGAAAACTGGGGACTAC<br>SEQ ID NO:22365 |
| iPS:435565 | 21-225_159C4 | AA | SYDIN<br>SEQ ID NO:6342 | WMNPNSGNTGYVQKFQG<br>SEQ ID NO:14354 | KKTGDY<br>SEQ ID NO:22366 |
| | | NA | AACTATGGCATGCAC<br>SEQ ID NO:6343 | GTTATATCATATTCTGGAAACAATAAATACTATGCAGACTCCGTGAAGGGC<br>SEQ ID NO:14355 | CGGAGCAGCTCGTGGGGGGGCTACGGTATGGACGTC<br>SEQ ID NO:22367 |
| | | AA | NYGMH<br>SEQ ID NO:6344 | VISYSGNNKYYADSVKG<br>SEQ ID NO:14356 | RSSSWGGYGMDV<br>SEQ ID NO:22368 |

FIGURE 49
(Continued)

| | | | | | |
|---|---|---|---|---|---|
| iPS:435569 | 21-225_159C5 | NA | AGCTATGGCATACAC | GTTGTATGGTATGATGTA AATAATAAATACTATGC AGACTCCGTGAAGGGC | GAGCTGGGGTTCCTCTCTGA CTAC |
| | | | SEQ ID NO:6345 | SEQ ID NO:14357 | SEQ ID NO:22369 |
| | | AA | SYGIH | VVWYDVNNKYYADSVK G | ELGFLSDY |
| | | | SEQ ID NO:6346 | SEQ ID NO:14358 | SEQ ID NO:22370 |
| iPS:435571 | 21-225_159C8 | NA | GACTATGTCATGCAG | GTTATATGGTATGATGG AAGTAATAAATACTATG CAGACTCCGTGAAGGGC | GAACCGTATAGTAGTGGCTG GTACGACTACGGTATGGACG TC |
| | | | SEQ ID NO:6347 | SEQ ID NO:14359 | SEQ ID NO:22371 |
| | | AA | DYVMQ | VIWYDGSNKYYADSVKG | EPYNSGWYDYGMDV |
| | | | SEQ ID NO:6348 | SEQ ID NO:14360 | SEQ ID NO:22372 |
| iPS:435573 | 21-225_159D8 | NA | AACTATGTCATGCAC | GTTATATGGTATGATGG AAGTAATAAATACTATG CAGACTCCGTGAAGGGC | GAACCGTATAGTAGTGGCTG GTACGACTACGGTATGGACG TC |
| | | | SEQ ID NO:6349 | SEQ ID NO:14361 | SEQ ID NO:22373 |
| | | AA | NYVMH | VIWYDGSNKYYADSVKG | EPYSSGWYDYGMDV |
| | | | SEQ ID NO:6350 | SEQ ID NO:14362 | SEQ ID NO:22374 |
| iPS:435575 | 21-225_159H11 | NA | AGCTATACCATGAAC | TCCATTAGTGGTAGTAGT AGTTACATATACTACGC AGACTCAGTGAAGGGC | GTGAGCTGGGCTGACTGC |
| | | | SEQ ID NO:6351 | SEQ ID NO:14363 | SEQ ID NO:22375 |
| | | AA | SYTMN | SISGSSSYIYYADSVKG | VSWADC |
| | | | SEQ ID NO:6352 | SEQ ID NO:14364 | SEQ ID NO:22376 |

FIGURE 49
(Continued)

| | | NA | AGCTATGGCATGCAC | GTTATATGGTATGATGG AAGTTATAAATACTATG CAGACTCCGTGAAGGGC | GAGGCCTACGATTTTTGGAG TGGTTATTATGACTAC |
|---|---|---|---|---|---|
| iPS:435577 | 21-225_160B1 | | SEQ ID NO:6353 | SEQ ID NO:14365 | SEQ ID NO:22377 |
| | | AA | SYGMH | VIWYDGSYKYYADSVKG | EAYDFWSGYYDY |
| | | | SEQ ID NO:6354 | SEQ ID NO:14366 | SEQ ID NO:22378 |
| | | NA | AGCTATGTCATGAGC | GCTATGAGTGGTAGTGG TGGTCACACATACTACG CAGACTCCGTGAAGGGC | CATGGATACAGC |
| iPS:435579 | 21-225_160G1 | | SEQ ID NO:6355 | SEQ ID NO:14367 | SEQ ID NO:22379 |
| | | AA | SYVMS | AMSGSGGHTYYADSVKG | HGYS |
| | | | SEQ ID NO:6356 | SEQ ID NO:14368 | SEQ ID NO:22380 |
| | | NA | AGCTATCGCATGAAC | TCCATTAGTAGTAGTACT GGTTACATGTACTACGC AGACTCAGTGAAGGGC | GATAAAGATTAC |
| iPS:435581 | 21-225_160H1 | | SEQ ID NO:6357 | SEQ ID NO:14369 | SEQ ID NO:22381 |
| | | AA | SYRMN | SISSSTGYMYYADSVKG | DKDY |
| | | | SEQ ID NO:6358 | SEQ ID NO:14370 | SEQ ID NO:22382 |
| | | NA | AGTTATGGCATGAAC | TCCATTAGTGGTAGTGGT AGTTACATATACTACGC AGACTCAGTGAAGGGC | AGCAGTGGCTGGTCT |
| iPS:435583 | 21-225_160F2 | | SEQ ID NO:6359 | SEQ ID NO:14371 | SEQ ID NO:22383 |
| | | AA | SYGMN | SISGSGSYIYYADSVKG | SSGWS |
| | | | SEQ ID NO:6360 | SEQ ID NO:14372 | SEQ ID NO:22384 |
| | | NA | AGCTATGTCATGAGC | GCTATGAGTGGTAGTGG TGGTCACACATACTACG CAGACTCCGTGAAGGGC | CATGGATACAGC |
| iPS:435585 | 21-225_160G3 | | SEQ ID NO:6361 | SEQ ID NO:14373 | SEQ ID NO:22385 |

FIGURE 49
(Continued)

| | | | | | | | |
|---|---|---|---|---|---|---|---|
| iPS:435587 | 21-225_160H3 | AA | SYVMS | SEQ ID NO:6362 | AMSGSGGHTYYADSVKG | SEQ ID NO:14374 | HGYS | SEQ ID NO:22386 |
| | | NA | AGAAGTAGTTACTACTGGGGC | SEQ ID NO:6362 | AGTATCTATTATAGTGGGAGTACCTCCTACAACCCGTCTCTCTGAGAGT | SEQ ID NO:14374 | CTCTCTCAACGGTGGGACTTTGACTAC | SEQ ID NO:22386 |
| | | AA | RSSYYWG | SEQ ID NO:6363 | SIYYSGSTSYNPSLES | SEQ ID NO:14375 | LSQRWDFDY | SEQ ID NO:22387 |
| iPS:435589 | 21-225_160A4 | NA | AATTATGATATCAAC | SEQ ID NO:6364 | TGGATGCACCCTAACAGTGGTAACACAGGCTATCCACAGAAGTTCCAGGGC | SEQ ID NO:14376 | AGCAGGCGGCTGGTACATTTTTGACTAC | SEQ ID NO:22388 |
| | | AA | NYDIN | SEQ ID NO:6365 | WMHPNSGNTGYPQKFQG | SEQ ID NO:14377 | SSGWYIFDY | SEQ ID NO:22389 |
| iPS:435591 | 21-225_160C4 | NA | GACTATGTCATGCAG | SEQ ID NO:6366 | GTTATATGGTATGATGGAAGTAATAAATACTATGCAGACTCCGTGAAGGGC | SEQ ID NO:14378 | GAACCGTATAATAGTGGCTGGTACGACTACGGTATGGACGTC | SEQ ID NO:22390 |
| | | AA | DYVMQ | SEQ ID NO:6367 | VIWYDGSNKYYADSVKG | SEQ ID NO:14379 | EPYNSGWYDYGMDV | SEQ ID NO:22391 |
| iPS:435593 | 21-225_160F4 | NA | AGTTATATAGCATGAAC | SEQ ID NO:6368 | TCCATTAGTGGTAGTAGTAGTACATATACGCAGACTCAGTGAAGGGC | SEQ ID NO:14380 | GATCGGGGGCAGCAGC | SEQ ID NO:22392 |
| | | AA | SYSMN | SEQ ID NO:6369 | SISGSSTYIYYADSVKG | SEQ ID NO:14381 | DRGSS | SEQ ID NO:22393 |
| | | | | SEQ ID NO:6370 | | SEQ ID NO:14382 | | SEQ ID NO:22394 |

FIGURE 49
(Continued)

| | | | | | | |
|---|---|---|---|---|---|---|
| iPS:435595 | 21-225_160H4 | NA | AGCTATAGGATGAAC | | TCCATTAGTGGTAGTAGT AGTTACATAGACTACGC AGACTCAGTGAAGGGC | | AAGAGTGGTTTGACTAC |
| | | | SEQ ID NO:6371 | SEQ ID NO:14383 | | SEQ ID NO:22395 |
| | | AA | SYRMN | SISGSSSYIDYADSVKG | | KSWFDY |
| | | | SEQ ID NO:6372 | SEQ ID NO:14384 | | SEQ ID NO:22396 |
| iPS:435599 | 21-225_160B10 | NA | AGAAGTAGTACTACTGGGG C | AATATCTATTATAGTGGG AGCGCTACCACATTCC GTCCCTCAAGAGT | | CATGACCCAAACTGGGAGT TGACTAC |
| | | | SEQ ID NO:6373 | SEQ ID NO:14385 | | SEQ ID NO:22397 |
| | | AA | RSSYYWG | NIYYSGSAYHIPSLKS | | HDPNWGVDY |
| | | | SEQ ID NO:6374 | SEQ ID NO:14386 | | SEQ ID NO:22398 |
| iPS:435601 | 21-225_160C10 | NA | AGCTTTGGCATGCAC | GTCATATGGTATGATGG AAGTTATAAATACTATG CAGACTCCGTGAAGGGC | | GTTGGTATAGAAGTGGCTGG TGACTACTACTCGGTATGG AAGTC |
| | | | SEQ ID NO:6375 | SEQ ID NO:14387 | | SEQ ID NO:22399 |
| | | AA | SFGMH | VIWYDGSYKYYADSVKG | | VGIEVAGDYYFGMEV |
| | | | SEQ ID NO:6376 | SEQ ID NO:14388 | | SEQ ID NO:22400 |
| iPS:435605 | 21-225_161A4 | NA | AGCAACTACATGAGC | GTTATTTATACCGGTGGT AGCACATACAACGCAGA CTCCGTGAAGGGC | | AATTGGGAATGGCTGGCCC CTTTGACTAC |
| | | | SEQ ID NO:6377 | SEQ ID NO:14389 | | SEQ ID NO:22401 |
| | | AA | SNYMS | VIYTGGSTYNADSVKG | | NWGMAGPFDY |
| | | | SEQ ID NO:6378 | SEQ ID NO:14390 | | SEQ ID NO:22402 |
| iPS:435607 | 21-225_161G4 | NA | AGCTATGGCATGCAC | GTTATATCATATGGTGGA AGTAATAAATACCATGC AGACTCCGTGAAGGGC | | CGGAGCAGCTCGTGGGGGG CTACGGTATGGACGTC |
| | | | SEQ ID NO:6379 | SEQ ID NO:14391 | | SEQ ID NO:22403 |

FIGURE 49
(Continued)

| | | | | | | |
|---|---|---|---|---|---|---|
| iPS:435609 | 21-225_161F7 | AA | SYGMH | VISYGGSNKYHADSVKG | RSSSSGGYGMDV | |
| | | | SEQ ID NO:6380 | SEQ ID NO:14392 | SEQ ID NO:22404 | |
| | | NA | GACTTTGGCTTGCAC | GTTATATGGTTTGATGGAAGTAATAAATACTATGCAGACTCCGTGAAGGGC | GAGATTGGCTGGCTCTCTGACTAC | |
| | | | SEQ ID NO:6381 | SEQ ID NO:14393 | SEQ ID NO:22405 | |
| iPS:435611 | 21-225_161F10 | AA | DFGLH | VIWFDGSNKYYADSVKG | EIGWLSDY | |
| | | | SEQ ID NO:6382 | SEQ ID NO:14394 | SEQ ID NO:22406 | |
| | | NA | AGCTATGGCATGCAC | ATTATATCATATTCTGGAAGAAATGATTTCTATGCAGACTCCGTGAAGGGC | CGTATAGCAGCAGTGGTCACTACGGTATGGACGTC | |
| | | | SEQ ID NO:6383 | SEQ ID NO:14395 | SEQ ID NO:22407 | |
| iPS:435613 | 21-225_161D11 | AA | SYGMH | IISYSGRNDFYADSVKG | RIAAAGHYGMDV | |
| | | | SEQ ID NO:6384 | SEQ ID NO:14396 | SEQ ID NO:22408 | |
| | | NA | GACTTTGGCTTGCAC | GTTATATGGTTTGATGGAAGTAATAAATACTATGCAGACTCCGTGAAGGGC | GAGATTGGCTGGCTCTCTGACTAC | |
| | | | SEQ ID NO:6385 | SEQ ID NO:14397 | SEQ ID NO:22409 | |
| iPS:435615 | 21-225_161G12 | AA | DFGLH | VIWFDGSNKYYADSVKG | EIGWLSDY | |
| | | | SEQ ID NO:6386 | SEQ ID NO:14398 | SEQ ID NO:22410 | |
| | | NA | GACTATGTCATGCAG | GTTATATGGTATGATGGAAGTAATAAATACTATGCAGACTCCGTGAAGGGC | GAACCGTATAATAGTGGCTGGTACGACTACGGTATGGACGTC | |
| | | | SEQ ID NO:6387 | SEQ ID NO:14399 | SEQ ID NO:22411 | |
| | | AA | DYVMQ | VIWYDGSNKYYADSVKG | EPYNSGWYDYGMDV | |
| | | | SEQ ID NO:6388 | SEQ ID NO:14400 | SEQ ID NO:22412 | |

FIGURE 49 (Continued)

| | | | | | |
|---|---|---|---|---|---|
| iPS:435617 | 21-225_162F2 | NA | AGTTATAGCATGAAC | TCCATTAGTGGTAGTAGT AGTACATATACTACGC AGACTCAGTGAAGGC | GATCGGGGCAGCAGC |
| | | | SEQ ID NO:6389 | SEQ ID NO:14401 | SEQ ID NO:22413 |
| | | AA | SYSMN | SISGSSTYIYYADSVKG | DRGSS |
| | | | SEQ ID NO:6390 | SEQ ID NO:14402 | SEQ ID NO:22414 |
| iPS:435621 | 21-225_162H3 | NA | AGTTATAGCATGAAC | TCCATTAGTGGTAGTAGT ACGTACATATACTACGC AGACTCAGTGAAGGGC | GATCGGGGCAGCAGC |
| | | | SEQ ID NO:6391 | SEQ ID NO:14403 | SEQ ID NO:22415 |
| | | AA | SYSMN | SISGSSTYIYYADSVKG | DRGSS |
| | | | SEQ ID NO:6392 | SEQ ID NO:14404 | SEQ ID NO:22416 |
| iPS:435623 | 21-225_162D5 | NA | AATTATGATATCAAC | TGGATGCACCTAACAG TGGTAACACAGGCTATG CACAGAAGTTCCAGGGC | AGCAGTGGCTGGTACTTCTT TGACTAC |
| | | | SEQ ID NO:6393 | SEQ ID NO:14405 | SEQ ID NO:22417 |
| | | AA | NYDIN | WMHPNSGNTGYAQKFQG | SSGWYFFDY |
| | | | SEQ ID NO:6394 | SEQ ID NO:14406 | SEQ ID NO:22418 |
| iPS:435627 | 21-225_162F6 | NA | AATTATGATATCAAC | TGGATGCACCCTAACAG TGGTAACACAGGCTATG CACAGAAGTTCCAGGGC | AGCAGTGGCTGGTACCGCTT TGACTAC |
| | | | SEQ ID NO:6395 | SEQ ID NO:14407 | SEQ ID NO:22419 |
| | | AA | NYDIN | WMHPNSGNTGYAQKFQG | SSGWYRFDY |
| | | | SEQ ID NO:6396 | SEQ ID NO:14408 | SEQ ID NO:22420 |
| iPS:435629 | 21-225_162H6 | NA | AACTATGGCATGCAC | GTTATATGGTATGATGG AAGTAATAAATACTATG CAGACTCCGTGAAGGGC | AAAGGTATAGCAGCAGTTGG AGACTACTACTACGGTATGG ACGTC |

FIGURE 49
(Continued)

| | | | | | | | |
|---|---|---|---|---|---|---|---|
| iPS:435635 | 21-225_162H6 | AA | SEQ ID NO:6397 NYGMH | | SEQ ID NO:14409 VIWYDGSNKYYADSVKG | | SEQ ID NO:22421 KGIAAVGDYYGMDV |
| | | NA | SEQ ID NO:6398 AGCTATAGCATGAAC | | SEQ ID NO:14410 TCCATTAGTGGTAGTGGT AGTTACATATACGC AGACTCAGTGAAGGGC | | SEQ ID NO:22422 TATAGCAGCTCGCACTAT |
| iPS:435637 | 21-225_163F1 | AA | SEQ ID NO:6399 SYSMN | | SEQ ID NO:14411 SISGSGSYIYYADSVKG | | SEQ ID NO:22423 YSSSHY |
| | | NA | SEQ ID NO:6400 AGCTATAGCATGAAC | | SEQ ID NO:14412 TCCACTAGTGGGAGTTCT ACTTACATATACTACGCA GACTCAGTGAAGGGC | | SEQ ID NO:22424 GATCGAGGCAGCCTC |
| iPS:435639 | 21-225_163E2 | AA | SEQ ID NO:6401 SYSMN | | SEQ ID NO:14413 STSGSSTYIYYADSVKG | | SEQ ID NO:22425 DRGSL |
| | | NA | SEQ ID NO:6402 AGTTATAGCATGAGC | | SEQ ID NO:14414 TCCATTAGTGGTAGTAGT GCTTACATATACTACGCA GACTCAGTGAAGGGC | | SEQ ID NO:22426 TTGAGCGGTATGGACGTC |
| iPS:435640 | 21-225_163G6 | AA | SEQ ID NO:6403 SYSMS | | SEQ ID NO:14415 SISGSSAYIYYADSVKG | | SEQ ID NO:22427 LSGMDV |
| | | NA | SEQ ID NO:6404 AGCTATAGCATGAAC | | SEQ ID NO:14416 TCCATTAGTGGTAGTAGT ACTTACATATACTACGCA GACTCAGTGAAGGGC | | SEQ ID NO:22428 GATCGAGGCAGCCTC |
| iPS:435641 | 21-225_163F9 | AA | SEQ ID NO:6405 SYSMN | | SEQ ID NO:14417 SISGSSTYIYYADSVKG | | SEQ ID NO:22429 DRGSL |
| | | | SEQ ID NO:6406 | | SEQ ID NO:14418 | | SEQ ID NO:22430 |

FIGURE 49
(Continued)

| | | | | | |
|---|---|---|---|---|---|
| iPS:435643 | 21-225_163G10 | NA | AGCTATAGCATGAAC | TCCATTAGTGGTAGTAGT ACTTACATATACGCA GACTCAGTGAAGGGC | GCCCGTATGGACGTC |
| | | | SEQ ID NO:6407 | SEQ ID NO:14419 | SEQ ID NO:22431 |
| | | AA | SYSMN | SISGSSTYIYYADSVKG | ARMDV |
| | | | SEQ ID NO:6408 | SEQ ID NO:14420 | SEQ ID NO:22432 |
| iPS:435649 | 21-225_165H2 | NA | CATTATGATATCAAC | TGGATGCACCCTAACAG TCATAAGACAGGCTATG CACAGAAGTTCCAGGGC | AGCAGTGGCTGGTACATGTT TGACTAC |
| | | | SEQ ID NO:6409 | SEQ ID NO:14421 | SEQ ID NO:22433 |
| | | AA | HYDIN | WMHPNSHKTGYAQKFQG | SSGWYMFDY |
| | | | SEQ ID NO:6410 | SEQ ID NO:14422 | SEQ ID NO:22434 |
| iPS:435653 | 21-225_166H12 | NA | AGCTATAGCATGAGC | TCCATTAGTGGGAGTAG TAGTTACAGTTACTACGC AGACTCAGTGAAGGGC | CTAACTGGCTTTGACTAC |
| | | | SEQ ID NO:6411 | SEQ ID NO:14423 | SEQ ID NO:22435 |
| | | AA | SYSMS | SISGSSYSYYADSVKG | LTGFDY |
| | | | SEQ ID NO:6412 | SEQ ID NO:14424 | SEQ ID NO:22436 |
| iPS:435655 | 21-225_167E2 | NA | AGCTTTGGCATGCAC | GTCATATGGTATGATGG AACTTATAAATACTATGC AGACTCCGTGAAGGGC | GTTGGTATTGAAGTGGCTGG TGACTACTACGGTATGG AAGTC |
| | | | SEQ ID NO:6413 | SEQ ID NO:14425 | SEQ ID NO:22437 |
| | | AA | SFGMH | VIWYDGTYKYYADSVKG | VGIEVAGDYYYGMEV |
| | | | SEQ ID NO:6414 | SEQ ID NO:14426 | SEQ ID NO:22438 |
| iPS:435657 | 21-225_167H10 | NA | AGCTTTGGCATGCAC | GTCATATGGTATGATGG AAGTTATAAGTACCATG CAGACTCCGTGAAGGGC | GTTGGTATAGAAGTGGCTGG TGACTACTACGGTATGG AAGTC |
| | | | SEQ ID NO:6415 | SEQ ID NO:14427 | SEQ ID NO:22439 |

FIGURE 49
(Continued)

| | | | | SFGMH | VIWYDGSYKYHADSVKG | VGIEVAGDYYYGMEV |
|---|---|---|---|---|---|---|
| iPS:435659 | 21-225_167D12 | | AA | SEQ ID NO:6416 | SEQ ID NO:14428 | SEQ ID NO:22440 |
| | | | NA | AGCTATGTCATGAGC | GCTATGAGTGGTAGTGG TGGTAGAACATACTACG CAGACTCCGTGAAGGGC | TATACCTGGAACGGCTAC |
| | | | | | SEQ ID NO:14429 | SEQ ID NO:22441 |
| | | | AA | SYVMS | AMSGSGGRTYYADSVKG | YTWNGY |
| iPS:435663 | 21-225_169B1 | | | SEQ ID NO:6418 | SEQ ID NO:14430 | SEQ ID NO:22442 |
| | | | NA | AGCTATGGCATGCAC | GTTATATGGTATGATGG AAGTAATAAATACTATG CAGACTCCGTGAGGGGC | GATCCCTTACGTGGATACAA TGACCCGGTTATGGACTAC |
| | | | | | SEQ ID NO:14431 | SEQ ID NO:22443 |
| | | | AA | SYGMH | VIWYDGSNKYYADSVRG | DPLRGYNDPVMDY |
| iPS:435665 | 21-225_169F2 | | | SEQ ID NO:6420 | SEQ ID NO:14432 | SEQ ID NO:22444 |
| | | | NA | AGTTACTACTGGAGT | CGTATCGATACCAGTGG GATCACCAACTACAACC CCTCCCTCAAGAGT | GAGGGAGGAGTGGGAGCTA CCTACTTTGACTAC |
| | | | | | SEQ ID NO:14433 | SEQ ID NO:22445 |
| | | | AA | SYYWS | RIDTSGITNYNPSLKS | EGGVGATYFDY |
| iPS:435667 | 21-225_169E3 | | | SEQ ID NO:6422 | SEQ ID NO:14434 | SEQ ID NO:22446 |
| | | | NA | GGCCATAGCATGAAC | TACATTAGCCTTAGTGGT AGTACCATAAAGTACGC AGACTCTGTGAAGGGC | AGGGGGATTACTACTGTGGTTCG GAATGAGGACGGTTGGACG TC |
| | | | | | SEQ ID NO:14435 | SEQ ID NO:22447 |
| | | | AA | GHSMN | YISLSGSTIKYADSVKG | RGITVRNEDGLDV |
| | | | | SEQ ID NO:6424 | SEQ ID NO:14436 | SEQ ID NO:22448 |

FIGURE 49
(Continued)

| | | | | | |
|---|---|---|---|---|---|
| iPS:435669 | 21-225_169F9 | NA | ACCTATGGCATGCAC | ATTATATGGTATGATGG AACTAATAAATACTATG CAGACTCCGTGAAGGGC | GATCCCTTACGTGGATACAA TGACCCGGTTATGGACTAC |
| | | | SEQ ID NO:6425 | SEQ ID NO:14437 | SEQ ID NO:22449 |
| | | AA | TYGMH | IIWYDGTNKYYADSVKG | DPLRGYNDPVMDY |
| | | | SEQ ID NO:6426 | SEQ ID NO:14438 | SEQ ID NO:22450 |
| iPS:435671 | 21-225_169H5 | NA | AGTTACTACTGGAGT | CGTATCGATACCAGTGG GATCACCAACTACAACC CCTCCCTCAAGAGT | GAGGGAGGAGTGGGAGCTA CCTACTTGACTAC |
| | | | SEQ ID NO:6427 | SEQ ID NO:14439 | SEQ ID NO:22451 |
| | | AA | SYYWS | RIDTSGITNYNPSLKS | EGGVGATYFDY |
| | | | SEQ ID NO:6428 | SEQ ID NO:14440 | SEQ ID NO:22452 |
| iPS:435673 | 21-225_169E6 | NA | GGCCATAGCATGAAC | TACATTAGCATTAGTAGT AGTACCATAAAGTACGC AGACTCTGTGAAGGGC | AGGGGATTACTACTGTGGTTCG GAATGAGGACGGTTTGGACG TC |
| | | | SEQ ID NO:6429 | SEQ ID NO:14441 | SEQ ID NO:22453 |
| | | AA | GHSMN | YISISSSTIKYADSVKG | RGITVVRNEDGLDV |
| | | | SEQ ID NO:6430 | SEQ ID NO:14442 | SEQ ID NO:22454 |
| iPS:435675 | 21-225_169D7 | NA | AGTTACTACTGGACC | CGTATCTATACCAGTGG GAGCACCAACTACAACC CCTCCCTCAAGAGT | GTCGGGAGGTACTACTACAGG TATGGACGTC |
| | | | SEQ ID NO:6431 | SEQ ID NO:14443 | SEQ ID NO:22455 |
| | | AA | SYYWT | RIYTSGSTNYNPSLKS | VGRYYYGMDV |
| | | | SEQ ID NO:6432 | SEQ ID NO:14444 | SEQ ID NO:22456 |
| iPS:435677 | 21-225_169C10 | NA | GGCTACTTTATGCAC | TGGATCAAGCCTAAGAG TGGTGGCACAAACTCTG CACAGAGGTTTCAGGGC | GGGGGACTACGGTGGCTAC GTGGGGGTCTTTGACTAC |
| | | | SEQ ID NO:6433 | SEQ ID NO:14445 | SEQ ID NO:22457 |
| | | AA | GYFMH | WIKPKSGGTNSAQRFQG | GGTIVATWGVFDY |

FIGURE 49 (Continued)

| | | | | | |
|---|---|---|---|---|---|
| iPS:435679 | 21-225_169D10 | NA | SEQ ID NO:6434<br>AGCTATGTCATGAGT | SEQ ID NO:14446<br>GCTATTAGTGGTAGTGGT<br>AGTAGAATATACGC<br>GGACTCCGTGAAGGC | SEQ ID NO:22458<br>GTGGCTTTCTTTGACTAT |
| | | AA | SEQ ID NO:6435<br>SYVMS | SEQ ID NO:14447<br>AISGSGSRIYYADSVKG | SEQ ID NO:22459<br>VAFFDY |
| iPS:435681 | 21-225_169D11 | NA | SEQ ID NO:6436<br>GACTATGTCATGCAC | SEQ ID NO:14448<br>GTTATATGGTATGATGG<br>AAGTAATAAATACTATG<br>CAGACTCCGTGAAGGGC | SEQ ID NO:22460<br>GAAAGGTATAGCAGTGGCTG<br>GTACGACTACGGTATGGACG<br>TC |
| | | AA | SEQ ID NO:6437<br>DYVMH | SEQ ID NO:14449<br>VIWYDGSNKYYADSVKG | SEQ ID NO:22461<br>ERYSSGWYDYGMDV |
| iPS:435683 | 21-225_170A1 | NA | SEQ ID NO:6438<br>AGCTATGGCATGCAC | SEQ ID NO:14450<br>ATTATATGGTATGATGG<br>AAGTTATAAATACTATG<br>CAGATTCCGTGAAGGGC | SEQ ID NO:22462<br>GATGCCCAGGATTTTTGGAG<br>TGGTTACTTTGACTCC |
| | | AA | SEQ ID NO:6439<br>SYGMH | SEQ ID NO:14451<br>IIWYDGSYKYYADSVKG | SEQ ID NO:22463<br>DAHDFWSGYFDS |
| iPS:435685 | 21-225_170E1 | NA | SEQ ID NO:6440<br>AGCTATGTCATGAGT | SEQ ID NO:14452<br>GCTATTAGTGGTAGTGGT<br>AATAGAATATACTACGC<br>AGACTCCGTGAAGGGC | SEQ ID NO:22464<br>GTGGCTTTCTTTGACTAT |
| | | AA | SEQ ID NO:6441<br>SYVMS | SEQ ID NO:14453<br>AISGSGNRIYYADSVKG | SEQ ID NO:22465<br>VAFFDY |
| iPS:435687 | 21-225_170H1 | NA | SEQ ID NO:6442<br>AGTTATTACTGGAGC | SEQ ID NO:14454<br>CGTATCTATACCAGTGG<br>GAGCACCAACTACAACC<br>CCTCCCTCAAGAGT | SEQ ID NO:22466<br>GTCGGGAGGTACTACTATGG<br>TATGGACGTC |

FIGURE 49
(Continued)

| | | | | | | |
|---|---|---|---|---|---|---|
| iPS:435689 | 21-225_170H1 | AA | SEQ ID NO:6443<br>SYYWS | SEQ ID NO:14455<br>RIYTSGSTNYNPSLKS | SEQ ID NO:22467<br>VGRYYYGMDV | |
| | | NA | SEQ ID NO:6444<br>GACTATGTCATGCAC | SEQ ID NO:14456<br>GTTATATGGTATGATGG<br>AAGTAATAAATACTATG<br>AAGACTCCGTGAAGGGC | SEQ ID NO:22468<br>GAGACGTATAGCAGCAGCTG<br>GTACGACTACGGTTATGGACG<br>TC | |
| iPS:435693 | 21-225_170F3 | AA | SEQ ID NO:6445<br>DYVMH | SEQ ID NO:14457<br>VIWYDGSNKYYEDSVKG | SEQ ID NO:22469<br>ETYSSSWYDYGMDV | |
| | | NA | SEQ ID NO:6446<br>ACCTATGGCATGCAC | SEQ ID NO:14458<br>ATTATATGGTATGATGG<br>AACTAATAAATACTATG<br>CAGACTCCGTGAAGGGC | SEQ ID NO:22470<br>GATCCCTTACGTGGATACAA<br>TGACCCGGTTATGGACTAC | |
| iPS:435695 | 21-225_170G4 | AA | SEQ ID NO:6447<br>TYGMH | SEQ ID NO:14459<br>IIWYDGTNKYYADSVKG | SEQ ID NO:22471<br>DPLRGYNDPVMDY | |
| | | NA | SEQ ID NO:6448<br>AGCTATGGCATGCAC | SEQ ID NO:14460<br>ATTATATGGTATGATGG<br>AACTAATAAATACTATG<br>CAGACTCCGTGAAGGGC | SEQ ID NO:22472<br>GATCCCTTACGTGGATACAA<br>TGACCCGGTTATGGACTAC | |
| iPS:435697 | 21-225_170D5 | AA | SEQ ID NO:6449<br>SYGMH | SEQ ID NO:14461<br>IIWYDGTNKYYADSVKG | SEQ ID NO:22473<br>DPLRGYNDPVMDY | |
| | | NA | SEQ ID NO:6450<br>ACCTATGGCATGCAC | SEQ ID NO:14462<br>ATTATATGGTATGATGG<br>GACTAATAAATACTATG<br>CAGACTCCGTGAAGGGC | SEQ ID NO:22474<br>GATCCCTTACGTGGATACAA<br>TGACCCGGTTATGGACTAC | |
| | 21-225_170G5 | AA | SEQ ID NO:6451<br>TYGMH | SEQ ID NO:14463<br>IIWYDGTNKYYADSVKG | SEQ ID NO:22475<br>DPLRGYNDPVMDY | |

FIGURE 49
(Continued)

| | | | | | | | |
|---|---|---|---|---|---|---|---|
| iPS:435699 | 21-225_170D6 | NA | SEQ ID NO:6452 GGCTACTTTATACAC | SEQ ID NO:14464 TGGATCAAGCCTAACAG TGGTGGCACAAACTCTG CACAGAGGTTTCAGGGC | SEQ ID NO:22476 GGGGGACTACGGTGGCTAC GTGGGGGGTCTTTGACTAC |
| | | AA | GYFIH | SEQ ID NO:14465 WIKPNSGGTNSAQRFQG | SEQ ID NO:22477 GGTTVATWGVFDY |
| iPS:435701 | 21-225_170F6 | NA | SEQ ID NO:6454 AATTATATGATATCAAC | SEQ ID NO:14466 TGGATGAACCCTAACAG TGGTAACACAGGCTATG CACAGAAGTTCCAGGAC | SEQ ID NO:22478 AGCAGTGGCTGGTACTGGTT CGACCCC |
| | | AA | NYDIN | SEQ ID NO:14467 WMNPNSGNTGYAQKFQD | SEQ ID NO:22479 SSGWYWFDP |
| iPS:435703 | 21-225_170D11 | NA | SEQ ID NO:6456 AGCTATGGCATGCAC | SEQ ID NO:14468 ATTATATGGTATGATGG AACTAATAAATACTATG CAGACTCCGTGAAGGGC | SEQ ID NO:22480 GATCCCTTACGTGGATACAA TGACCCGGTTATGGACTAC |
| | | AA | SYGMH | SEQ ID NO:14469 IIWYDGTNKYYADSVKG | SEQ ID NO:22481 DPLRGYNDPVMDY |
| iPS:435705 | 21-225_171C3 | NA | SEQ ID NO:6458 ACCTATGGCATGCAC | SEQ ID NO:14470 ATTATATGGTATGATGG GACTAATAAATACTATG CAGACTCCGTGAAGGGC | SEQ ID NO:22482 GATCCCTTACGTGGATACAA TGACCCGGTTATGGACTAC |
| | | AA | TYGMH | SEQ ID NO:14471 IIWYDGTNKYYADSVKG | SEQ ID NO:22483 DPLRGYNDPVMDY |
| | | | SEQ ID NO:6460 | SEQ ID NO:14472 | SEQ ID NO:22484 |

FIGURE 49
(Continued)

| iPS:435709 | 21-225_171A4 | NA | ACCTATGGCATGCAC SEQ ID NO:6461 | ATTATATGGTATGATGG AAGTAATAAATACTATG CAGACTCCGTGAAGGGC SEQ ID NO:14473 | GATCCCTTACGTGGATACAA TGACCCGGTTATGGACTAC SEQ ID NO:22485 |
| | | AA | TYGMH SEQ ID NO:6462 | IIWYDGSNKYYADSVKG SEQ ID NO:14474 | DPLRGYNDPVMDY SEQ ID NO:22486 |
| iPS:435711 | 21-225_171G4 | NA | AGCTGTGCCATGACC SEQ ID NO:6463 | GCTATTAGTGGTCGTGGT GGTACCACAGTTCTACGC AGACTCCGTGAGGGC SEQ ID NO:14475 | GATCTTATTGGGGGAGCTAC TTACTTTGACTAC SEQ ID NO:22487 |
| | | AA | SCAMT SEQ ID NO:6464 | AISGRGGTTFYADSVRG SEQ ID NO:14476 | DLIGGATYFDY SEQ ID NO:22488 |
| iPS:435713 | 21-225_171D7 | NA | AGCTATGGCATGCAC SEQ ID NO:6465 | GTTATATCATATGGACGG AAACAATAGACACTATG CAGACTCCGTGCAGGGC SEQ ID NO:14477 | GATGTCACCGTTGGACTA CTACGCGTTTGGACGTC SEQ ID NO:22489 |
| | | AA | SYGMH SEQ ID NO:6466 | VISYDGNNRHYADSVQG SEQ ID NO:14478 | DRHRLDYYALDV SEQ ID NO:22490 |
| iPS:435715 | 21-225_171A8 | NA | AGCTCTGCCATGAGC SEQ ID NO:6467 | GTTATTAGTGGTAGTGGT GGTAGCACATTCTACAC AGACTCCGTGAAGGGC SEQ ID NO:14479 | TCGAATAGCAGTGGCTGGTT TGACTAC SEQ ID NO:22491 |
| | | AA | SSAMS SEQ ID NO:6468 | VISGSGGSTFYTDSVKG SEQ ID NO:14480 | SNSSGWFDY SEQ ID NO:22492 |
| iPS:435717 | 21-225_171A9 | NA | AGCTATGCCATGACT SEQ ID NO:6469 | GCTATTAGTGGTAGTGGT GGTAACACATTCAACGC AGACTCCGTGAAGGGC SEQ ID NO:14481 | CTGGGGATCGACTACTACTA CTACGGTATGGACGTC SEQ ID NO:22493 |

FIGURE 49
(Continued)

| | | | | | | | |
|---|---|---|---|---|---|---|---|
| iPS:435719 | 21-225_171A11 | AA | SYAMT | | AISGSGGNTFNADSVKG | | LGIDYYYYGMDV |
| | | | SEQ ID NO:6470 | | SEQ ID NO:14482 | | SEQ ID NO:22494 |
| | | NA | AGCTATAGCATGAAC | | TCCATTAGTGGTAGTAGT AGTTACATATACTGC AGACTCAGTGAAGGC | | GATAGGGGCAGCTCC |
| | | | SEQ ID NO:6471 | | SEQ ID NO:14483 | | SEQ ID NO:22495 |
| iPS:435721 | 21-225_172B3 | AA | SYSMN | | SISGSSSYIYYADSVKG | | DRGSS |
| | | | SEQ ID NO:6472 | | SEQ ID NO:14484 | | SEQ ID NO:22496 |
| | | NA | ACCTATGGCATGCAC | | GTTATATGGTATGATGG AAGTAATAAATACTATG CAGACTCCGTGAAGGGC | | GATCCCTTACGTGGATACAA TGACCCGGTTATGGACTCC |
| | | | SEQ ID NO:6473 | | SEQ ID NO:14485 | | SEQ ID NO:22497 |
| iPS:435723 | 21-225_172B7 | AA | TYGMH | | VIWYDGSNKYYADSVKG | | DPLRGYNDPVMDY |
| | | | SEQ ID NO:6474 | | SEQ ID NO:14486 | | SEQ ID NO:22498 |
| | | NA | AACTATGGCATGCAC | | ATTATATGGTATGATGG AAGTAATAAATACTATG TAGACTCCGTGAAGGGC | | GAGGCGTACGATTTTTGGAG TGGTTATTGGGACTAC |
| | | | SEQ ID NO:6475 | | SEQ ID NO:14487 | | SEQ ID NO:22499 |
| iPS:435725 | 21-225_172G8 | AA | NYGMH | | IIWYDGSNKYYVDSVKG | | EAYDFWSGYWDY |
| | | | SEQ ID NO:6476 | | SEQ ID NO:14488 | | SEQ ID NO:22500 |
| | | NA | ACCTATGGCATGCAC | | ATTATATGGTATGATGG AACTAATAAATACTATG CAGACTCCGTGAAGGGC | | GATCCCTTACGTGGATACAA TGACCCGGTTATGGACTAC |
| | | | SEQ ID NO:6477 | | SEQ ID NO:14489 | | SEQ ID NO:22501 |
| | | AA | TYGMH | | IIWYDGTNKYYADSVKG | | DPLRGYNDPVMDY |
| | | | SEQ ID NO:6478 | | SEQ ID NO:14490 | | SEQ ID NO:22502 |

FIGURE 49
(Continued)

| | | | | |
|---|---|---|---|---|
| iPS:435727 | 21-225_172E11 | NA | AATTATGATATATCAAC SEQ ID NO:6479 | TGGATGCACCCTAACAG TGGTAACACAGGCTATG CACAGAAGTTCCAGGGC SEQ ID NO:14491 | AGCAGTGGCTGGTACCGGTT TGACTAC SEQ ID NO:22503 |
| | | AA | NYDIN SEQ ID NO:6480 | WMHPNSGNTGYAQKFQG SEQ ID NO:14492 | SSGWYRFDY SEQ ID NO:22504 |
| iPS:435729 | 21-225_173E7 | NA | AGCTATGCCATGAGC SEQ ID NO:6481 | TTTATTAGTGGTAGTGGT GGTAACACATTCTACGC AGACTCCGTGAAGGGC SEQ ID NO:14493 | AGGGATACTACAACGGTG GGATGCTTTTGATATC SEQ ID NO:22505 |
| | | AA | SYAMS SEQ ID NO:6482 | FISGSGGNTFYADSVKG SEQ ID NO:14494 | RDTYNGWDAFDI SEQ ID NO:22506 |
| iPS:435731 | 21-225_173A11 | NA | AGCTATGGCATGCAC SEQ ID NO:6483 | ATTATATGGTATGATGG AAGTAATAAATACTATG CAGACTCCGTGAAGGGC SEQ ID NO:14495 | GAGGCCTACGATTTTTGGAG TGGTTTCTTTGACTCC SEQ ID NO:22507 |
| | | AA | SYGMH SEQ ID NO:6484 | IIWYDGSNKYYADSVKG SEQ ID NO:14496 | EAYDFWSGFFDS SEQ ID NO:22508 |
| iPS:435733 | 21-225_173C11 | NA | AGCTATGGCATACAC SEQ ID NO:6485 | CTTATATTTTATGGA AGTAATAAATACTATGC AGACTCCGTGAAGGGC SEQ ID NO:14497 | CGGTATAGCAGCAGCTGGTC CGGTGGTATGGACGTC SEQ ID NO:22509 |
| | | AA | SYGIH SEQ ID NO:6486 | LIFYDGSNKYYADSVKG SEQ ID NO:14498 | RYSSSWSGGMDV SEQ ID NO:22510 |

FIGURE 49
(Continued)

| | | | | | |
|---|---|---|---|---|---|
| iPS:435735 | 21-225_173H12 | NA | AGCTATGGCATGCAC | ATTATATGGTATGATGGAACTAACAAATACTATGCAGACTCCGTGAAGGGC | GATCCCTTACGTGGATACAATGACCCGGTTATGGACTAC |
| | | | SEQ ID NO:6487 | SEQ ID NO:14499 | SEQ ID NO:22511 |
| | | AA | SYGMH | IIWYDGTNKYYADSVKG | DPLRGYNDPVMDY |
| | | | SEQ ID NO:6488 | SEQ ID NO:14500 | SEQ ID NO:22512 |
| iPS:435737 | 21-225_174G5 | NA | AATTATGATATCAAC | TGGATGCACCCTAACAGTGGTAACACAGGCTATGCACAGAAGTTCCAGGGC | AGCAGTGGCTGGTACTGGTTCGACCCC |
| | | | SEQ ID NO:6489 | SEQ ID NO:14501 | SEQ ID NO:22513 |
| | | AA | NYDIN | WMHPNSGNTGYAQKFQG | SSGWYWFDP |
| | | | SEQ ID NO:6490 | SEQ ID NO:14502 | SEQ ID NO:22514 |
| iPS:435739 | 21-225_174G7 | NA | AGCTCTGCCATGAGC | GTTATTAGTGGTAGTGGTGGTAGCACATTCTACACAGACTCCGTGAAGGGC | TCGAATAGCAGTGGCTGGTTTGACTAC |
| | | | SEQ ID NO:6491 | SEQ ID NO:14503 | SEQ ID NO:22515 |
| | | AA | SSAMS | VISGSGGSTFYTDSVKG | SNSSGWFDY |
| | | | SEQ ID NO:6492 | SEQ ID NO:14504 | SEQ ID NO:22516 |
| iPS:435741 | 21-225_174G10 | NA | GACTATGTCATGCAC | GTTATATGGTATGATGGAAGTAATAAATACTATGCAGACTCCGTGAAGGGC | GAAAGGTATAGCAGTGGCTGGTACGACTACGGTATGGACGTC |
| | | | SEQ ID NO:6493 | SEQ ID NO:14505 | SEQ ID NO:22517 |
| | | AA | DYVMH | VIWYDGSNKYYADSVKG | ERYSSGWYDYGMDV |
| | | | SEQ ID NO:6494 | SEQ ID NO:14506 | SEQ ID NO:22518 |

FIGURE 49
(Continued)

| | | | | | | |
|---|---|---|---|---|---|---|
| iPS:435743 | 21-225_175G1 | NA | ACCTATGGCATGCAC | | GTTATATGGTATGATGG AAGTAATAAATACTATG CAGACTCCGTGAAGGGC | | GATCCCTTACGTGGATACAA TGACCCGGTTATGACTAC |
| | | | SEQ ID NO:6495 | | SEQ ID NO:14507 | | SEQ ID NO:22519 |
| | | AA | TYGMH | | VIWYDGSNKYYADSVKG | | DPLRGYNDPVMDY |
| | | | SEQ ID NO:6496 | | SEQ ID NO:14508 | | SEQ ID NO:22520 |
| iPS:435745 | 21-225_175G3 | NA | GGCTACTTTATGCAC | | TGGATCAAGCCTAAAAG TGGTGGCACAAACTGTG CACAGAGGTTCAGGGC | | GGGGGACTACGGTGACTAC GTGGGGGGTCTTTGACTAC |
| | | | SEQ ID NO:6497 | | SEQ ID NO:14509 | | SEQ ID NO:22521 |
| | | AA | GYFMH | | WIKPKSGGTNCAQRFQG | | GGTVTVWGVFDY |
| | | | SEQ ID NO:6498 | | SEQ ID NO:14510 | | SEQ ID NO:22522 |
| iPS:435747 | 21-225_175C4 | NA | AGCTATGTCATGAGC | | GCTATTAGTGGTAGTGGT GATAGAACATACTACGC AGACTCCGTGAAGGGC | | ACAGCGGGCTTTGACTAC |
| | | | SEQ ID NO:6499 | | SEQ ID NO:14511 | | SEQ ID NO:22523 |
| | | AA | SYVMS | | AISGSGDRTYYADSVKG | | TAGFDY |
| | | | SEQ ID NO:6500 | | SEQ ID NO:14512 | | SEQ ID NO:22524 |
| iPS:435749 | 21-225_175C10 | NA | AGCTATGCCATGAGC | | TCTATTAGTGGTCGTGGT GGTAGCACGTTCTACGC AGACTCCGTGAAGGGC | | TCGAATAGCAGTGGCTGGTT TGACTAC |
| | | | SEQ ID NO:6501 | | SEQ ID NO:14513 | | SEQ ID NO:22525 |
| | | AA | SYAMS | | SISGRGGSTFYADSVKG | | SNSSGWFDY |
| | | | SEQ ID NO:6502 | | SEQ ID NO:14514 | | SEQ ID NO:22526 |
| iPS:435751 | | NA | AATTATGATCTCAAC | | TGGATGCACCCTAACAG TGGTAACACAGGCTATG CACAGAAGTTCCAGGGC | | AGCAGTGGCTGGTACTACTT TGACTAC |

FIGURE 49
(Continued)

| | | | | | | |
|---|---|---|---|---|---|---|
| iPS:435753 | 21-225_175D10 | AA | SEQ ID NO:6503<br>NYDLN | SEQ ID NO:14515<br>WMHPNSGNTGYAQKFQG | SEQ ID NO:22527<br>SSGWYYFDY | |
| | | NA | SEQ ID NO:6504<br>AGCTATGCCATGAGC | SEQ ID NO:14516<br>ATTATTAGTGGTAGTGGT<br>GGTAACACATACTACGC<br>AGACTCCGTGAAGGGC | SEQ ID NO:22528<br>AGGGATACCTGGAACGGTTG<br>GGATGCTTTTGATATC | |
| iPS:435755 | 21-225_175G10 | AA | SEQ ID NO:6505<br>SYAMS | SEQ ID NO:14517<br>IISGSGGNTYYADSVKG | SEQ ID NO:22529<br>RDTWNGWDAFDI | |
| | | NA | SEQ ID NO:6506<br>AGCTATGGCATGCAC | SEQ ID NO:14518<br>ATTATATGGTATGATGG<br>AAGTTATAAATACTATG<br>CAGACTCCGTGAAGGGC | SEQ ID NO:22530<br>GATGCCACGATTTTTGGAG<br>TGGTTACTTGCCTAC | |
| iPS:435759 | 21-225_176H4 | AA | SEQ ID NO:6507<br>SYGMH | SEQ ID NO:14519<br>IIWYDGSYKYYADSVKG | SEQ ID NO:22531<br>DAHDFWSGYFAY | |
| | | NA | SEQ ID NO:6508<br>GGCCATAGTATGAAC | SEQ ID NO:14520<br>TACATTAGCATTAGTGGT<br>AGTACCATAAAGTACGC<br>AGACTCTGTGAAGGGC | SEQ ID NO:22532<br>AGGGGGATTACTGTGGTTCG<br>GAATGAGGACGGTTTGGACG<br>TC | |
| iPS:435761 | 21-225_176E6 | AA | SEQ ID NO:6509<br>GHSMN | SEQ ID NO:14521<br>YISISGSTIKYADSVKG | SEQ ID NO:22533<br>RGITVVRNEDGLDV | |
| | | NA | SEQ ID NO:6510<br>ACCTATGGCATGCAC | SEQ ID NO:14522<br>ATTATATGGTATGATGG<br>AACTAATAAATACTATG<br>CAGACTCCGTGAAGGGC | SEQ ID NO:22534<br>GATCCCTTAGTGGATACAA<br>TGACCCGGTTTTGGACTAC | |
| iPS:435761 | 21-225_176B11 | AA | SEQ ID NO:6511<br>TYGMH | SEQ ID NO:14523<br>IIWYDGTNKYYADSVKG | SEQ ID NO:22535<br>DPLRGYNDPVLDY | |
| | | | SEQ ID NO:6512 | SEQ ID NO:14524 | SEQ ID NO:22536 | |

FIGURE 49
(Continued)

| | | | | | |
|---|---|---|---|---|---|
| iPS:435763 | 21-225_176H12 | NA | GACTATGTCATGCAC<br><br>SEQ ID NO:6513 | GTTATATGGTATGATGG<br>AAGTAATAAATACTATG<br>CCGACTCCGTGAAGGGC<br><br>SEQ ID NO:14525 | GAAAAGTATAGCAGCAACTG<br>GTACGACTACGGTATGGACG<br>TC<br><br>SEQ ID NO:22537 |
| | | AA | DYVMH<br><br>SEQ ID NO:6514 | VIWYDGSNKYYADSVKG<br><br>SEQ ID NO:14526 | EKYSSNWYDYGMDV<br><br>SEQ ID NO:22538 |
| iPS:435765 | 21-225_177D3 | NA | AGCTATGTCATGAAC<br><br>SEQ ID NO:6515 | GGTATGAGCGGTAGTGG<br>TGGTAGAACATACTACG<br>CAGACTCCGTGAAGGAC<br><br>SEQ ID NO:14527 | GTGACTTICTTTGACTAT<br><br>SEQ ID NO:22539 |
| | | AA | SYVMN<br><br>SEQ ID NO:6516 | GMSGSGGRTYYADSVKD<br><br>SEQ ID NO:14528 | VTFFDY<br><br>SEQ ID NO:22540 |
| iPS:435767 | 21-225_177B4 | NA | GATTATGTCATGCAC<br><br>SEQ ID NO:6517 | GTTATATGGTATGATGG<br>AAGTAATAAATACTATG<br>CAGACTCCGTGAAGGGC<br><br>SEQ ID NO:14529 | GAAAAGTATAGCAGCAGCTG<br>GTACGACTACGGTTTGGACG<br>TC<br><br>SEQ ID NO:22541 |
| | | AA | DYVMH<br><br>SEQ ID NO:6518 | VIWYDGSNKYYADSVKG<br><br>SEQ ID NO:14530 | EKYSSSWYDYGLDV<br><br>SEQ ID NO:22542 |
| iPS:435769 | 21-225_177B6 | NA | AGTTATGCCATGAGC<br><br>SEQ ID NO:6519 | GTTATTAGTAGTGGTAGTGGT<br>AGTAACACATACTAGT<br>AGACTCCGTGAAGGGC<br><br>SEQ ID NO:14531 | GGTTACTATGATAGTAGTGG<br>TTATTACTACCCTTTTGACTT<br>C<br><br>SEQ ID NO:22543 |
| | | AA | SYAMS<br><br>SEQ ID NO:6520 | VISGSGSNTYYVDSVKG<br><br>SEQ ID NO:14532 | GYYDSSGYYYPFDF<br><br>SEQ ID NO:22544 |

FIGURE 49
(Continued)

| | | | | |
|---|---|---|---|---|
| iPS:435771 | 21-225_177B11 | NA | AGCTATGGCATGCAC | ATTATATGGTATGATGGAAGTTATAAATACTATACAGACTCCGTGAAGGGC | GAGACTTACGATTTTGGAGTGGTTATTTGTCTTC |
| | | | SEQ ID NO:6521 | SEQ ID NO:14533 | SEQ ID NO:22545 |
| | | AA | SYGMH | IIWYDGSYKYYTDSVKG | ETYDFWSGYFVF |
| | | | SEQ ID NO:6522 | SEQ ID NO:14534 | SEQ ID NO:22546 |
| iPS:435773 | 21-225_177B12 | NA | AATTATATGATATCAAC | TGGATGCACCTAACAGTGGTAACACAGGCTATGCACAGAAGTTCCAGGGC | AGCAGTGGCTGGTACTACTTTGACTTC |
| | | | SEQ ID NO:6523 | SEQ ID NO:14535 | SEQ ID NO:22547 |
| | | AA | NYDIN | WMHPNSGNTGYAQKFQG | SSGWYYFDF |
| | | | SEQ ID NO:6524 | SEQ ID NO:14536 | SEQ ID NO:22548 |
| iPS:435775 | 21-225_178A5 | NA | AGCTATGCCATGACC | GTTATTAGTGGTAGTGGTGGTAACACATTCTACGCAGACTCCGTGAAGGGC | CGGGACGGTGACTACTTTGACTAC |
| | | | SEQ ID NO:6525 | SEQ ID NO:14537 | SEQ ID NO:22549 |
| | | AA | SYAMT | VISGSGGNTFYADSVKG | RDGDYFDY |
| | | | SEQ ID NO:6526 | SEQ ID NO:14538 | SEQ ID NO:22550 |
| iPS:435777 | 21-225_178F7 | NA | AGCTATGCCATGACC | GTTATTAGTGGTAGTGGTGGTAACACATTCTACGCAGACTCCGTGAAGGGC | CGGTACGGTGACTACTTTGACTAC |
| | | | SEQ ID NO:6527 | SEQ ID NO:14539 | SEQ ID NO:22551 |
| | | AA | SYAMT | VISGSGGNTFYADSVKG | RYGDYFDY |
| | | | SEQ ID NO:6528 | SEQ ID NO:14540 | SEQ ID NO:22552 |
| iPS:435779 | 21-225_178B10 | NA | ACCTATGGCATGCAC | ATTATATGGTATGATGGAACTAATAAATACTATGCAGACTCCGTGAAGGGC | GATCCCTTACGTGGATACAATGACCCGGTTATGGACTAC |
| | | | SEQ ID NO:6529 | SEQ ID NO:14541 | SEQ ID NO:22553 |

FIGURE 49
(Continued)

| | | | | | | |
|---|---|---|---|---|---|---|
| iPS:435781 | 21-225_178G10 | AA | TYGMH<br>SEQ ID NO:6530 | IIWYDGTNKYYADSVKG<br>SEQ ID NO:14542 | DPLRGYNDPVMDY<br>SEQ ID NO:22554 |
| | | NA | ACCTATGGCCATGCAC<br>SEQ ID NO:6531 | GTTATATGGTATGATGG<br>AAGTAATAAATACTACG<br>CAGACTCCGTGAAGGGC<br>SEQ ID NO:14543 | GAACGGTACGATTTTGGAG<br>TGGTCATTTTGACTAC<br>SEQ ID NO:22555 |
| iPS:435783 | 21-225_179G1 | AA | TYGMH<br>SEQ ID NO:6532 | VIWYDGSNKYYADSVKG<br>SEQ ID NO:14544 | ERYDFWSGHFDY<br>SEQ ID NO:22556 |
| | | NA | AGCTATGGCCATGACC<br>SEQ ID NO:6533 | GTTATTAGTGGTTTTGGT<br>GGTAACACATTCTACGC<br>AGACTCCGTGAAGGGC<br>SEQ ID NO:14545 | CGGTACGGTGACTACTTTGA<br>CTAC<br>SEQ ID NO:22557 |
| | | AA | SYAMT<br>SEQ ID NO:6534 | VISGFGGNTFYADSVKG<br>SEQ ID NO:14546 | RYGDYFDY<br>SEQ ID NO:22558 |
| iPS:435785 | 21-225_179C2 | NA | AGCTATGGCCATGCAC<br>SEQ ID NO:6535 | CTTATATTTTATGATGGA<br>AGTAATAAATACTATGC<br>AGACTCCGTGAAGGGC<br>SEQ ID NO:14547 | CGGTATAGCGGCAGCTGGTC<br>CGGTGGTATGGACGTC<br>SEQ ID NO:22559 |
| | | AA | SYGMH<br>SEQ ID NO:6536 | LIFYDGSNKYYADSVKG<br>SEQ ID NO:14548 | RYSGSWSGGMDV<br>SEQ ID NO:22560 |
| iPS:435787 | 21-225_180A3 | NA | AGCTTTGCCATGAAC<br>SEQ ID NO:6537 | GTTATTAGCGGTCGCGGT<br>GGTAACACATTCTACGC<br>AGACTCCGTGAAGGGC<br>SEQ ID NO:14549 | CGGACTGGGGATGATGTTTT<br>TGATGTC<br>SEQ ID NO:22561 |
| | | AA | SFAMN<br>SEQ ID NO:6538 | VISGRGGNTFYADSVKG<br>SEQ ID NO:14550 | RTGDDVFDV<br>SEQ ID NO:22562 |

FIGURE 49
(Continued)

| iPS: | | | | | |
|---|---|---|---|---|---|
| iPS:435789 | 21-225_180C4 | NA | GCCTATGGCATGCAC | ATTATTGGTATGATGGA AGTTATAAATACTATGC AGACTCCGTGAAGGGC | ACCGGTGTGGATCCCTGGGA CTACTACAACGGAATGGACG TC |
| | | | SEQ ID NO:6539 | SEQ ID NO:14551 | SEQ ID NO:22563 |
| | | AA | AYGMH | IIWYDGSYKYYADSVKG | TGVDPWDYYNGMDV |
| | | | SEQ ID NO:6540 | SEQ ID NO:14552 | SEQ ID NO:22564 |
| iPS:435791 | 21-225_180H7 | NA | GACTATGGCATGCAC | GTTATATGGTATGATGA AAATAATAAACACTATG CAGACTCCGCGAAGGGC | GAGGTTGGCTGGTCCGATGA CTAC |
| | | | SEQ ID NO:6541 | SEQ ID NO:14553 | SEQ ID NO:22565 |
| | | AA | DYGMH | VIWYDENNKHYADSAKG | EVGWSDDY |
| | | | SEQ ID NO:6542 | SEQ ID NO:14554 | SEQ ID NO:22566 |
| iPS:435793 | 21-225_180F8 | NA | AGCTATGGCATGCAC | GTTATATGGTATGATGG AAGTGATAAATACTATG AAGACTCCGTGAAGGGC | GATCATCCCGGTGGAGCTA CGGAGACTAC |
| | | | SEQ ID NO:6543 | SEQ ID NO:14555 | SEQ ID NO:22567 |
| | | AA | SYGMH | VIWYDGSDKYYEDSVKG | DHPRWSYGDY |
| | | | SEQ ID NO:6544 | SEQ ID NO:14556 | SEQ ID NO:22568 |
| iPS:435795 | 21-225_181C2 | NA | AGCTATGGCATGCAC | ATTATATGGTATGATGG AAGTTATAAATACTATG CAGACTCCGTGAAGGGC | GATCATTAGACGATTTTGGAG TGGGCACTTTGACTTC |
| | | | SEQ ID NO:6545 | SEQ ID NO:14557 | SEQ ID NO:22569 |
| | | AA | SYGMH | IIWYDGSYKYYADSVKG | DHYDFWSGHFDF |
| | | | SEQ ID NO:6546 | SEQ ID NO:14558 | SEQ ID NO:22570 |

FIGURE 49
(Continued)

| | | | | | | |
|---|---|---|---|---|---|---|
| iPS:435797 | 21-225_181G2 | NA | AGCTACAATATGCAC | | TGGATCAACCCTAACAATGGTGGCTCAAACTATACACAGAAGTTTCAGGGC | | AAGTTTGGGGAC |
| | | | SEQ ID NO:6547 | | SEQ ID NO:14559 | | SEQ ID NO:22571 |
| | | AA | SYNMH | | WINPNNGGSNYTQKFQG | | KFGD |
| | | | SEQ ID NO:6548 | | SEQ ID NO:14560 | | SEQ ID NO:22572 |
| iPS:435799 | 21-225_181G3 | NA | AGCTATGCCATGAGT | | GTTATTAGTGGTAGTGGTGGTAACACATTCTACGGAGACTCCGTGAAGGGC | | CGGGAGACCTACGACTGGGGATCCGATGCTTTTGATATC |
| | | | SEQ ID NO:6549 | | SEQ ID NO:14561 | | SEQ ID NO:22573 |
| | | AA | SYAMS | | VISGSGGNTFYGDSVKG | | RETYDWGSDAFDI |
| | | | SEQ ID NO:6550 | | SEQ ID NO:14562 | | SEQ ID NO:22574 |
| iPS:435801 | 21-225_181E5 | NA | AATTATGATATCAAC | | TGGATGAACCCTAACAGTGGTAACACAGGCTATGCACAGAAGTTCCAGGGC | | AGTAGTGGCTGGTACATCTTTGACTAC |
| | | | SEQ ID NO:6551 | | SEQ ID NO:14563 | | SEQ ID NO:22575 |
| | | AA | NYDIN | | WMNPNSGNTGYAQKFQG | | SSGWYIFDY |
| | | | SEQ ID NO:6552 | | SEQ ID NO:14564 | | SEQ ID NO:22576 |
| iPS:435805 | 21-225_181A8 | NA | GACTATGGCATGCAC | | GTTATATGGTATGATGAAATAATAAACACTATGCAGACTCCGCGAAGGGC | | GAGGTTGGCTGGTCCGATGACTAC |
| | | | SEQ ID NO:6553 | | SEQ ID NO:14565 | | SEQ ID NO:22577 |
| | | AA | DYGMH | | VIWYDENNKHYADSAKG | | EVGWSDDY |
| | | | SEQ ID NO:6554 | | SEQ ID NO:14566 | | SEQ ID NO:22578 |

FIGURE 49
(Continued)

| | | NA | AGCTATGGCATGCAC | ATTATATGGTATGATGG AAGTTATAAATACTATG CAGACTCCGTGAAGGGC | GATCATTACGATTTTTGGAG TGGGCACTTTGACTAC |
|---|---|---|---|---|---|
| iPS:435807 | 21-225_181C10 | | SEQ ID NO:6555 | SEQ ID NO:14567 | SEQ ID NO:22579 |
| | | AA | SYGMH | IIWYDGSYKYYADSVKG | DHYDFWSGHFDY |
| | | | SEQ ID NO:6556 | SEQ ID NO:14568 | SEQ ID NO:22580 |
| iPS:435809 | 21-225_182H5 | NA | AGCTATGCCATGAGT | GTTATTAGTGGTAGAGG TGGTACCACATTCTACGC AGACTCCGTGAAGGGC | CGGACTGGGGATGATGTTTT TGATATC |
| | | | SEQ ID NO:6557 | SEQ ID NO:14569 | SEQ ID NO:22581 |
| | | AA | SYAMS | VISGRGGTFYADSVKG | RTGDDVFDI |
| | | | SEQ ID NO:6558 | SEQ ID NO:14570 | SEQ ID NO:22582 |
| iPS:435811 | 21-225_183H6 | NA | AGCTATGGCATGCAC | ATTATATCATATGCTGGA AGTACTAAATTCTATGCA GACTCCGTGAAGGGC | AGGCCCCGCCAGTGGCTGGT AGAGGGCTACGGTATGGACG TC |
| | | | SEQ ID NO:6559 | SEQ ID NO:14571 | SEQ ID NO:22583 |
| | | AA | SYGMH | IISYAGSTKFYADSVKG | RPPQWLVEGYGMDV |
| | | | SEQ ID NO:6560 | SEQ ID NO:14572 | SEQ ID NO:22584 |
| iPS:435813 | 21-225_183A12 | NA | AGCTATGGCATGCAC | GTTATATCATCTGCTGGA AGTAATAAATACTATGC AGACTCCGTGAAGGGC | AGGTAGAGCAGTGGCTGGGA CTGGTTCGACCCC |
| | | | SEQ ID NO:6561 | SEQ ID NO:14573 | SEQ ID NO:22585 |
| | | AA | SYGMH | VISSAGSNKYYADSVKG | RYSSGWDWFDP |
| | | | SEQ ID NO:6562 | SEQ ID NO:14574 | SEQ ID NO:22586 |
| iPS:435815 | 21-225_190G10 | NA | GACTATAGCATGAAC | TCTATTAGTAGTGGTAGT GGTTACATACACTACGC AGACTCAGTGAAGGGC | GCAACTATGGCCCCTGACTA C |
| | | | SEQ ID NO:6563 | SEQ ID NO:14575 | SEQ ID NO:22587 |
| | | AA | DYSMN | SISSGSGYIHYADSVKG | ATMALDY |

FIGURE 49
(Continued)

| | | | | | |
|---|---|---|---|---|---|
| iPS:435817 | 21-225_190B11 | NA | SEQ ID NO:6564<br>AATTACTACTGGAGC | SEQ ID NO:14576<br>CGTATCTATACCAGTGG<br>GAGCACCAACTACAACC<br>CCTCCCTCAAGAGT | SEQ ID NO:22588<br>GATCGGGGATACTATGGCTA<br>CTACGGTATGGACGTC |
| | | AA | SEQ ID NO:6565<br>NYYWS | SEQ ID NO:14577<br>RIYTSGSTNYNPSLKS | SEQ ID NO:22589<br>DRGYYGYYGMDV |
| iPS:435819 | 21-225_190C11 | NA | SEQ ID NO:6566<br>AGCTATGGCATGCAC | SEQ ID NO:14578<br>GTTATATGGTATGATGG<br>AAGTAATAAAAACTATG<br>CAGACTCCGTGAAGGGC | SEQ ID NO:22590<br>GATCAGGGCGTGGGCTACGA<br>CGGTTTGGACGTC |
| | | AA | SEQ ID NO:6567<br>SYGMH | SEQ ID NO:14579<br>VIWYDGSNKNYADSVKG | SEQ ID NO:22591<br>DQGVGYDGLDV |
| iPS:435821 | 21-225_190E11 | NA | SEQ ID NO:6568<br>AACTATGGCATGCAC | SEQ ID NO:14580<br>ATTATATGGTTTGATGGA<br>AGTAATAAATACTATGC<br>AGACTCCGTGAAGGGC | SEQ ID NO:22592<br>GCCCAGGGGGTCTACTACTA<br>CGTTATGGACGTC |
| | | AA | SEQ ID NO:6569<br>NYGMH | SEQ ID NO:14581<br>IIWFDGSNKYYADSVKG | SEQ ID NO:22593<br>AQGVYYYVMDV |
| iPS:435823 | 21-225_190F11 | NA | SEQ ID NO:6570<br>AGCTATGCCATGAAC | SEQ ID NO:14582<br>ACTATTAGTGGTACTGGT<br>CGTAGGACATACTACGC<br>AGACTCCGTGAAGGGC | SEQ ID NO:22594<br>GAGGAGGATTACTATGATAG<br>TAGTGGCCCGGGGTTCGACC<br>CC |
| | | AA | SEQ ID NO:6571<br>SYAMN | SEQ ID NO:14583<br>TISGTGRRTYYADSVKG | SEQ ID NO:22595<br>EEDYYDSSGPGFDP |
| | | | SEQ ID NO:6572 | SEQ ID NO:14584 | SEQ ID NO:22596 |

FIGURE 49
(Continued)

| | | | | | |
|---|---|---|---|---|---|
| iPS:435825 | 21-225_190G11 | NA | ATTTATGGCATGCAC | GTTATATGTGGTATGATGG AAGTAATAAAACTATG CAGACTCCGTGAAGGGC | GATCAGGGCGTGGGCTACGA CGGTTTGGACGTC |
| | | | SEQ ID NO:6573 | SEQ ID NO:14585 | SEQ ID NO:22597 |
| | | AA | IYGMH | VIWYDGSNKNYADSVKG | DQGVGYDGLDV |
| | | | SEQ ID NO:6574 | SEQ ID NO:14586 | SEQ ID NO:22598 |
| iPS:435827 | 21-225_190H11 | NA | AGCTACCACTGGAGC | CTTATCTATACCAGTAGG AGCACCATTTACAACCC CTCCCTCAAGAGT | CTCCGGTATAACTGGAACTT CCCTTACTTTGACTAC |
| | | | SEQ ID NO:6575 | SEQ ID NO:14587 | SEQ ID NO:22599 |
| | | AA | SYHWS | LIYTSRSTIYNPSLKS | LRYNWNFPYFDY |
| | | | SEQ ID NO:6576 | SEQ ID NO:14588 | SEQ ID NO:22600 |
| iPS:435829 | 21-225_190B12 | NA | AGTGGTGGTTACTACTGGAA C | TATATCTATTACAGTGGG AGCACCTACTACAACCC GTCCCTCAAGAGT | TCCGGGTATAATTGGACGC CGGGGTGACCCC |
| | | | SEQ ID NO:6577 | SEQ ID NO:14589 | SEQ ID NO:22601 |
| | | AA | SGGYYWN | YIYYSGSTYYNPSLKS | SGYNWDAGVDP |
| | | | SEQ ID NO:6578 | SEQ ID NO:14590 | SEQ ID NO:22602 |
| iPS:435831 | 21-225_190C12 | NA | AGCTATGGCATGCAC | GTTATATCATATGATGGA GGTTATAAAACTATGT AGACTCCGTGAAGGGC | GGTACCACGGGTACTACTA CGGTGTGGACGTC |
| | | | SEQ ID NO:6579 | SEQ ID NO:14591 | SEQ ID NO:22603 |
| | | AA | SYGMH | VISYDGGYKNYVDSVKG | GTHGYYYGVDV |
| | | | SEQ ID NO:6580 | SEQ ID NO:14592 | SEQ ID NO:22604 |
| iPS:435833 | 21-225_190D12 | NA | AGCTATGCCATGAGC | GCTATTATTGGTAATGGT GGTAGGACATACTACGC AGACTCCGTGAAGGGC | GATATGGTAGATACAGCTA TGGTTTCTTTGACTAC |
| | | | SEQ ID NO:6581 | SEQ ID NO:14593 | SEQ ID NO:22605 |

FIGURE 49
(Continued)

| | | | | | | | |
|---|---|---|---|---|---|---|---|
| iPS:435835 | 21-225_190F12 | AA | SYAMS<br>SEQ ID NO:6582 | | AIIGNGGRTYYADSVKG<br>SEQ ID NO:14594 | | DMGRYSYGFFDY<br>SEQ ID NO:22606 |
| | | NA | AACTATGGCATGCAC<br>SEQ ID NO:6583 | | GTTATATGGTTTGATGGA<br>AGTAATGACTACTATGC<br>AGACTCCGTGAAGGGC<br>SEQ ID NO:14595 | | GATAGAAGCGTCGGCTACGA<br>CGGTTTAGATGTC<br>SEQ ID NO:22607 |
| iPS:435837 | 21-225_198G3 | AA | NYGMH<br>SEQ ID NO:6584 | | VIWFDGSNDYYADSVKG<br>SEQ ID NO:14596 | | DRSVGYDGLDV<br>SEQ ID NO:22608 |
| | | NA | ACCTATGGCATGCAC<br>SEQ ID NO:6585 | | GTTATATGGTATGATGG<br>AACTAATAAAAACTATG<br>CAGACTCCGTGAAGGGC<br>SEQ ID NO:14597 | | GATCAGGGCGTGGGCTACGA<br>CGGTTTGGACGTC<br>SEQ ID NO:22609 |
| iPS:435839 | 21-225_191B1 | AA | TYGMH<br>SEQ ID NO:6586 | | VIWYDGTNKNYADSVKG<br>SEQ ID NO:14598 | | DQGVGYDGLDV<br>SEQ ID NO:22610 |
| | | NA | AGTTATCACTGGAGC<br>SEQ ID NO:6587 | | CATATCTATACCAGTGG<br>GAGCACCAAGTACAACC<br>CCTCCCTCAAGAGT<br>SEQ ID NO:14599 | | CTCCGGTATAACTGGAACTT<br>CCCTTTCTTTGACTAT<br>SEQ ID NO:22611 |
| iPS:435841 | 21-225_191D8 | AA | SYHWS<br>SEQ ID NO:6588 | | HIYTSGSTKYNPSLKS<br>SEQ ID NO:14600 | | LRYNWNFPFFDY<br>SEQ ID NO:22612 |
| | | NA | AATTATGATATCAAC<br>SEQ ID NO:6589 | | TGGATGCACCTAACAG<br>TGGTAACACAGGCTATG<br>CACAGAAGTTCCAGGGC<br>SEQ ID NO:14601 | | AGCAGTGGCTGTACTACTT<br>TGACTAC<br>SEQ ID NO:22613 |
| | | AA | NYDIN<br>SEQ ID NO:6590 | | WMHPNSGNTGYAQKFQG<br>SEQ ID NO:14602 | | SSGWYYFDY<br>SEQ ID NO:22614 |

FIGURE 49
(Continued)

| | | | | | |
|---|---|---|---|---|---|
| iPS:435843 | 21-225_191F1 | NA | AGTGGTGGTTACTACTGGAAC | TACATCTTTTACAGTGGGAGCACCTACTACAACCCGTCCCTCAAGAGT | GGGGATTACGATGGTTCGGGGAGTTATCACTACTATTACGGTATGGACGTC |
| | | | SEQ ID NO:6591 | SEQ ID NO:14603 | SEQ ID NO:22615 |
| | | AA | SGGYYWN | YIFYSGSTYYNPSLKS | GDYDGSGSYHYYYGMDV |
| | | | SEQ ID NO:6592 | SEQ ID NO:14604 | SEQ ID NO:22616 |
| iPS:435845 | 21-225_191G1 | NA | AGCTATGGCATGCAC | GTTATATGTATGATGGAAGTAATGAACACTATGCAGACTCCGTGAAGGGC | GATAGGGGGGGTGGGTTACTACGGTTTGGACGTC |
| | | | SEQ ID NO:6593 | SEQ ID NO:14605 | SEQ ID NO:22617 |
| | | AA | SYGMH | VIWYDGSNEHYADSVKG | DRGVGYYGLDV |
| | | | SEQ ID NO:6594 | SEQ ID NO:14606 | SEQ ID NO:22618 |
| iPS:435847 | 21-225_191A3 | NA | AGTGGTGATTACTACTGGAAC | TACATCTTTTACAGTGGGAGCACCTACTACAACCCGTCCCTCAAGAGT | GGGGATTACGATGGTTCGGGGAGTTATCACTACTACTACGGTATGGACGTC |
| | | | SEQ ID NO:6595 | SEQ ID NO:14607 | SEQ ID NO:22619 |
| | | AA | SGDYYWN | YIFYSGSTYYNPSLKS | GDYDGSGSYHYYYGMDV |
| | | | SEQ ID NO:6596 | SEQ ID NO:14608 | SEQ ID NO:22620 |
| iPS:435849 | 21-225_191C3 | NA | AGTGGTGATTACTACTGGAAC | TACATCTTTTACAGTGGGAGCACCTACTACAACCCGTCCCTCAAGAGT | GGGGATTACGATGGTTCGGGGAGTTATCACTTCTACTACGGTATGGACGTC |
| | | | SEQ ID NO:6597 | SEQ ID NO:14609 | SEQ ID NO:22621 |
| | | AA | SGDYYWN | YIFYSGSTYYNPSLKS | GDYDGSGSYHPYYGMDV |
| | | | SEQ ID NO:6598 | SEQ ID NO:14610 | SEQ ID NO:22622 |
| iPS:435851 | 21-225_191D3 | NA | AGTGGTGATTACTACTGGAAC | TACATCTTTTACAGTGGGAGCACCTACTACAACCCGTCCCTCAAGAGT | GGGGATTACGATGGTTCGGGGAGTTATCACTACTACTACGGTATGGACGTC |
| | | | SEQ ID NO:6599 | SEQ ID NO:14611 | SEQ ID NO:22623 |

FIGURE 49
(Continued)

| | | | | | | |
|---|---|---|---|---|---|---|
| iPS:435853 | 21-225_191E3 | AA | SGDYYWN | | YIFYSGSTYYNPSLKS | GDYDGSGSYHYYYGMDV |
| | | | SEQ ID NO:6600 | | SEQ ID NO:14612 | SEQ ID NO:22624 |
| | | NA | AGCTACCACTGGAGC | | CTTATCTATACCAGTAGG AGCACCAATTACAACCC CTCCCTCAAGAGT | CTCCGGTATAACTGGAACTT CCCTTACTTGACTAC |
| | | | SEQ ID NO:6601 | | SEQ ID NO:14613 | SEQ ID NO:22625 |
| | | AA | SYHWS | | LIYTSRSTNYNPSLKS | LRYNWNFPYFDY |
| | | | SEQ ID NO:6602 | | SEQ ID NO:14614 | SEQ ID NO:22626 |
| iPS:435855 | 21-225_191G3 | NA | AATTATGATATCAAC | | CGGATGAACCCTAACAG TGGTAACACAGGCTATG CACAGAAGTTCCAGGGC | AGCAGTGGCTGGTACATCTT TGACTAC |
| | | | SEQ ID NO:6603 | | SEQ ID NO:14615 | SEQ ID NO:22627 |
| | | AA | NYDIN | | RMNPNSGNTGYAQKFQG | SSGWYIFDY |
| | | | SEQ ID NO:6604 | | SEQ ID NO:14616 | SEQ ID NO:22628 |
| iPS:435857 | 21-225_191A4 | NA | AGCTATGGCATGCAC | | GTTATATCATATGATGGA GGTTATAAAAACTATGC AGACTCCGTGAAGGGC | GGTACCCACGGGTACTACTA CGGTGTGGACGTC |
| | | | SEQ ID NO:6605 | | SEQ ID NO:14617 | SEQ ID NO:22629 |
| | | AA | SYGMH | | VISYDGGYKNYADSVKG | GTHGYYYGVDV |
| | | | SEQ ID NO:6606 | | SEQ ID NO:14618 | SEQ ID NO:22630 |
| iPS:435859 | 21-225_190E6 | NA | AGCTATGGCATGCAC | | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6607 | | SEQ ID NO:14619 | SEQ ID NO:22631 |
| | | AA | SYGMH | | VIWYDGSNKNYADSVKG | DQGVGYDGLDV |
| | | | SEQ ID NO:6608 | | SEQ ID NO:14620 | SEQ ID NO:22632 |

FIGURE 49 (Continued)

| iPS:435861 | 21-225_190A5 | NA | AGTTATGGCATGCAC | GTTATATGGTATGATGG AAGTAATAAAACTATG CAGACTCCGTGAAGGGC | GATTTCTCTGTAGGGTACGA CGGTATGGACGTC |
|---|---|---|---|---|---|
| | | AA | SEQ ID NO:6609 SYGMH | SEQ ID NO:14621 VIWYDGSNKNYADSVKG | SEQ ID NO:22633 DFSVGYDGMDV |
| iPS:435863 | 21-225_191H4 | NA | SEQ ID NO:6610 AGTGGTGGTTACTACTGGAA C | SEQ ID NO:14622 TACATCTTTACAGTGGG AGCACCTACTACAACCC GTCCCTCAGGAGT | SEQ ID NO:22634 TCCGGGTATAACTGGGACAA CGGGGTCGACCC |
| | | AA | SEQ ID NO:6611 SGGYYWN | SEQ ID NO:14623 YIFYSGSTYYNPSLRS | SEQ ID NO:22635 SGYNWDNGVDP |
| iPS:435865 | 21-225_191A5 | NA | SEQ ID NO:6612 GACTATAGCATGAAC | SEQ ID NO:14624 TCCATTAGTAGTAGTAGT GGTTACATATTATGCAC GACTCAGTGAAGGGC | SEQ ID NO:22636 GCTACTATGGCCCTTGACTA C |
| | | AA | SEQ ID NO:6613 DYSMN | SEQ ID NO:14625 SISSSGYIYYADSVKG | SEQ ID NO:22637 ATMALDY |
| iPS:435867 | 21-225_191E5 | NA | SEQ ID NO:6614 AGCTATGCCATGAAC | SEQ ID NO:14626 ACTATTAGTGGTAGTACTGGT CGTAGGACATACTAGC AGACTCCGTGAAGGGC | SEQ ID NO:22638 GAGGAGGATTACTATGATAG TAGTGGCCGGGGTTCGACC CC |
| | | AA | SEQ ID NO:6615 SYAMN | SEQ ID NO:14627 TISGTGRRTYYADSVKG | SEQ ID NO:22639 EEDYYDSSGPGFDP |
| iPS:435869 | 21-225_190B1 | NA | SEQ ID NO:6616 AGCTATGGCATGCAC | SEQ ID NO:14628 GTTATATGGTATGATGG AAGTAATAAACATTATG CAGACTCCGTGAAGGGC | SEQ ID NO:22640 GATAGAACAGTGGGATACTC CGGTATGGACGTC |

FIGURE 49
(Continued)

| | | | | | | |
|---|---|---|---|---|---|---|
| iPS:435871 | 21-225_190B1 | AA | SEQ ID NO:6617 SYGMH | SEQ ID NO:14629 VIWYDGSNKHYADSVKG | SEQ ID NO:22641 DRTVGYSGMDV | |
| iPS:435873 | 21-225_191E6 | NA | SEQ ID NO:6618 AGCTACCACTGGAGC | SEQ ID NO:14630 CTTATCTATACCAGTAGGAGCACCAATTACAACCCCTCCCTCAAGAGT | SEQ ID NO:22642 CTCCGGTATAACTGGAACTTCCCTTACTTGACTTC | |
| | | AA | SEQ ID NO:6619 SYHWS | SEQ ID NO:14631 LIYTSRSTNYNPSLKS | SEQ ID NO:22643 LRYNWNFPYFDF | |
| iPS:435875 | 21-225_190G4 | NA | SEQ ID NO:6620 AGCTATGGCATGCAC | SEQ ID NO:14632 GTTATATGGTATGATGGAAGTAATAAAACTACGCAGACTCCGTGAAGGGC | SEQ ID NO:22644 GATCAGGGCGTGGGCTACGACGGTTTGGACGTC | |
| | | AA | SEQ ID NO:6621 SYGMH | SEQ ID NO:14633 VIWYDGSNKNYADSVKG | SEQ ID NO:22645 DQGVGYDGLDV | |
| iPS:435877 | 21-225_190B9 | NA | SEQ ID NO:6622 ACCTATGCCATGAGT | SEQ ID NO:14634 GCTATTAGTGGTAGTGGTGGTAACACACTACGCAGACTCCGTGAAGGGC | SEQ ID NO:22646 GATGGATTCGGTGGGAGCTCCTACTTTGACTAC | |
| | | AA | SEQ ID NO:6623 TYAMS | SEQ ID NO:14635 AISRSGGNTHYADSVKG | SEQ ID NO:22647 DGFGGSSYFDY | |
| iPS:435877 | 21-225_184E7 | NA | SEQ ID NO:6624 AGCTACACAATATGCAC | SEQ ID NO:14636 TGGATCAACCCTAACAATGGTGGCTCAAACTATACACAGAAGTTTCAGGGC | SEQ ID NO:22648 AAGTTTGGGGAC | |
| | | AA | SEQ ID NO:6625 SYNMH | SEQ ID NO:14637 WINPNNGGSNYTQKFQG | SEQ ID NO:22649 KFGD | |

FIGURE 49
(Continued)

| | | | | | | |
|---|---|---|---|---|---|---|
| iPS:435879 | 21-225_184H10 | NA | SEQ ID NO:6626 GACTATGGCATGCAC | SEQ ID NO:14638 GTTATTTGGTATGATGAAACTAATAAACACTATGGAGACTCCGTGAAGGGC | SEQ ID NO:22650 GAGGTTGGCTGGCACGATGACTAT | |
| | | AA | SEQ ID NO:6627 DYGMH | SEQ ID NO:14639 VIWYDETNKHYGDSVKG | SEQ ID NO:22651 EVGWHDDY | |
| iPS:435881 | 21-225_184D11 | NA | SEQ ID NO:6628 GACTATGGCATGCAC | SEQ ID NO:14640 GTTATTTGGTATGATGAAACTAATAAACACTATGGAGACTCCGTGAAGGGC | SEQ ID NO:22652 GAGGTTGGCTGGCACGATGACTAT | |
| | | AA | SEQ ID NO:6629 DYGMH | SEQ ID NO:14641 VIWYDETNKHYGDSVKG | SEQ ID NO:22653 EVGWHDDY | |
| iPS:435883 | 21-225_185A1 | NA | SEQ ID NO:6630 AGCTATAGCATGAAC | SEQ ID NO:14642 TCCATTAGCAGTAGTGGTAGTTACATATATTACGCAGACTCAGTGAAGGGC | SEQ ID NO:22654 AGCAACCTTTTTGACTGC | |
| | | AA | SEQ ID NO:6631 SYSMN | SEQ ID NO:14643 SISSSGSYIYYADSVKG | SEQ ID NO:22655 SNLFDC | |
| iPS:435885 | 21-225_185E10 | NA | SEQ ID NO:6632 AGCTACAATATGCAC | SEQ ID NO:14644 TGGATCAACCCTAACAATGGTGGCTCAAACTATACACAGAAGTTTCAGGGC | SEQ ID NO:22656 AAGTTTGGGGAC | |
| | | AA | SEQ ID NO:6633 SYNMH | SEQ ID NO:14645 WINPNNGGSNYTQKFQG | SEQ ID NO:22657 KFGD | |
| | | | SEQ ID NO:6634 | SEQ ID NO:14646 | SEQ ID NO:22658 | |

FIGURE 49
(Continued)

| | | | | | |
|---|---|---|---|---|---|
| iPS:435887 | 21-225_186F7 | NA | ACCTATGGCATGCAC | ATTATATGGTATGATGGAAGTTATAAATATTATGCAGACTCCGTGAAGGGC | GATCATTACGATTTTTGGAGTGGCACTTTGACTAC |
| | | | SEQ ID NO:6635 | SEQ ID NO:14647 | SEQ ID NO:22659 |
| | | AA | TYGMH | IIWYDGSYKYYADSVKG | DHYDFWSGHFDY |
| | | | SEQ ID NO:6636 | SEQ ID NO:14648 | SEQ ID NO:22660 |
| iPS:435889 | 21-225_186A11 | NA | AGCTATGCCATGAGT | GTTATTAGTGGTAGAGGTGGTACCACATTCTACGCAGACTCCGTGAAGGGC | CGGACTGGGGATGATGTTTTTGATATC |
| | | | SEQ ID NO:6637 | SEQ ID NO:14649 | SEQ ID NO:22661 |
| | | AA | SYAMS | VISGRGGTFYADSVKG | RTGDDVFDI |
| | | | SEQ ID NO:6638 | SEQ ID NO:14650 | SEQ ID NO:22662 |
| iPS:435891 | 21-225_188H5 | NA | AGCTACAATATGCAC | TGGATCAACCCTAACAGTGGTGGCTCAAACTATACACAGAAGTTTCAGGGC | AAGTTTGGGGAC |
| | | | SEQ ID NO:6639 | SEQ ID NO:14651 | SEQ ID NO:22663 |
| | | AA | SYNMH | WINPNSGGSNYTQKFQG | KFGD |
| | | | SEQ ID NO:6640 | SEQ ID NO:14652 | SEQ ID NO:22664 |
| iPS:435895 | 21-225_188E8 | NA | AGCTCTGCCATGAAC | GTTATTAGTGGTAGTGGTGGTTACACATACTACGCAGACTCCGTGAAGGGC | AGGAACACCGATGATGCTTTTGATATC |
| | | | SEQ ID NO:6641 | SEQ ID NO:14653 | SEQ ID NO:22665 |
| | | AA | SSAMN | VISGSGGYTYYADSVKG | RNTDDAFDI |
| | | | SEQ ID NO:6642 | SEQ ID NO:14654 | SEQ ID NO:22666 |
| iPS:435897 | 21-225_188B9 | NA | AGCTACAATATGCAC | TGGATCAACCCTAACAGTGGTGGCTCAAACTATACACAGAAGTTTCAGGGC | AAGTTTGGGGAC |
| | | | SEQ ID NO:6643 | SEQ ID NO:14655 | SEQ ID NO:22667 |
| | | AA | SYNMH | WINPNSGGSNYTQKFQG | KFGD |
| | | | SEQ ID NO:6644 | SEQ ID NO:14656 | SEQ ID NO:22668 |

FIGURE 49
(Continued)

| | | | | |
|---|---|---|---|---|
| iPS:435899 | 21-225_188G11 | NA | AGTTATGGCATGCAC | ATTATATGGTATGATGG AAGTTATAAATACTATG CAGACTCCGTGAAGGGC | GAGAGATACGATTTTTGGAG TGGTCATTTGACTAC |
| | | | SEQ ID NO:6645 | SEQ ID NO:14657 | SEQ ID NO:22669 |
| | | AA | SYGMH | IIWYDGSYKYYADSVKG | ERYDFWSGHFDY |
| | | | SEQ ID NO:6646 | SEQ ID NO:14658 | SEQ ID NO:22670 |
| iPS:435901 | 21-225_189G2 | NA | AACTATGGCATGCAC | ATTATATGGTATGATGG AAGTTATAAATACTATG CAGACTCCGTGAAGGGC | GATCGATTCGATTTTTGGAG TGGTTATTCCGACTAC |
| | | | SEQ ID NO:6647 | SEQ ID NO:14659 | SEQ ID NO:22671 |
| | | AA | NYGMH | IIWYDGSYKYYADSVKG | DRFDFWSGYSDY |
| | | | SEQ ID NO:6648 | SEQ ID NO:14660 | SEQ ID NO:22672 |
| iPS:435903 | 21-225_190E2 | NA | GACTACTACATGAGC | TACATTAGTAGTGGT ACTACCGTATTCTACGCA GACTCTGTGAAGGGC | GAATGGGTGGGAGCCGACTA C |
| | | | SEQ ID NO:6649 | SEQ ID NO:14661 | SEQ ID NO:22673 |
| | | AA | DYYMS | YISSSGTTVFYADSVKG | EWVGADY |
| | | | SEQ ID NO:6650 | SEQ ID NO:14662 | SEQ ID NO:22674 |
| iPS:435905 | 21-225_190A3 | NA | AGTGGTGGTTACTACTGAA C | TTCATCTTTATAGTGGG AGCAACTACACAACCC GTCCCTCAAGAGT | GGGGATTACGATGGTTCGGG GAGTTATATCACTACTATTACG GTATGGACGTC |
| | | | SEQ ID NO:6651 | SEQ ID NO:14663 | SEQ ID NO:22675 |
| | | AA | SGGYYWN | FIFYSGSTYNPSLKS | GDYDGSGSYHYYYGMDV |
| | | | SEQ ID NO:6652 | SEQ ID NO:14664 | SEQ ID NO:22676 |
| iPS:435907 | 21-225_190G3 | NA | AGCTATGGCATGCAC | GTTATATCATATGATGGA GGTTATAAAAACTATGT AGACTCCGTGAAGGGC | GGTACCCACGGGTACTACTA CGGGTGTGGACGTC |
| | | | SEQ ID NO:6653 | SEQ ID NO:14665 | SEQ ID NO:22677 |
| | | AA | SYGMH | VISYDGGYKNYVDSVKG | GTHGYYYGVDV |
| | | | SEQ ID NO:6654 | SEQ ID NO:14666 | SEQ ID NO:22678 |

FIGURE 49
(Continued)

| | | | | |
|---|---|---|---|---|
| iPS:435909 | 21-225_190H3 | NA | AGCTATGCCATGAGC | GCTATTAGTGGTGTCGTGGT GGTAACACATACTACGC AGACTCCGTGAAGGGC | GATGGATTCCGTGTGGGAGCTC CTATTTTGACTAC |
| | | | SEQ ID NO:6655 | SEQ ID NO:14667 | SEQ ID NO:22679 |
| | | AA | SYAMS | AISGRGGNTYYADSVKG | DGFGGSSYFDY |
| | | | SEQ ID NO:6656 | SEQ ID NO:14668 | SEQ ID NO:22680 |
| iPS:435911 | 21-225_190B4 | NA | AGTGGTGATTACTACTGGAAC | TACATCTTTACAGTGGG AGCACCTACTACAACCC GTCCCTCAAGAGT | GGGGATTACGATGGTTCGGG GAGTTATCACTACTACTACG GTATGGACGTC |
| | | | SEQ ID NO:6657 | SEQ ID NO:14669 | SEQ ID NO:22681 |
| | | AA | SGDYYWN | YIFYSGSTYYNPSLKS | GDYDGSGSYHYYYGMDV |
| | | | SEQ ID NO:6658 | SEQ ID NO:14670 | SEQ ID NO:22682 |
| iPS:435913 | 21-225_190A7 | NA | AGTGGTGTTTACTACTGGAGC | AACATCTATTACAGTGG GAGCACCTACAACAACC CGTCCCTCAAGAGT | GGGGATTACGATGGTTCGGG GAGTTATCACTACTACTACG GTTTGGACGTC |
| | | | SEQ ID NO:6659 | SEQ ID NO:14671 | SEQ ID NO:22683 |
| | | AA | SGVYYWS | NIYYSGSTYNNPSLKS | GDYDGSGSYHYYYGLDV |
| | | | SEQ ID NO:6660 | SEQ ID NO:14672 | SEQ ID NO:22684 |
| iPS:435915 | 21-225_190H4 | NA | AATTATGATATCAAC | TGGATGAACCCTAACAG TGGTAACACAGGCTATG CACAGAAGTTCCAGGGC | AGCAGTGGCTGGTACATCTT TGACTAC |
| | | | SEQ ID NO:6661 | SEQ ID NO:14673 | SEQ ID NO:22685 |
| | | AA | NYDIN | WMNPNSGNTGYAQKFQG | SSGWYIFDY |
| | | | SEQ ID NO:6662 | SEQ ID NO:14674 | SEQ ID NO:22686 |
| iPS:435917 | 21-225_190D5 | NA | AATTACTACTGGAGC | CGTATCTATGCCAGTGG GAGCACCAACTACAACC CCTCCCTCAAGAGT | GATCGGGGATACTATGGCTA CTACGGTATGGACGTC |
| | | | SEQ ID NO:6663 | SEQ ID NO:14675 | SEQ ID NO:22687 |
| | | AA | NYYWS | RIYASGSTNYNPSLKS | DRGYYGYYGMDV |

FIGURE 49
(Continued)

| | | | | | | | |
|---|---|---|---|---|---|---|---|
| iPS:435919 | 21-225_190H5 | NA | SEQ ID NO:6664<br>AGCTATGGCATGCAC | SEQ ID NO:14676<br>GTTATATCATATGATGGA<br>GGTTATAAAAACTATGC<br>AGACTCCGTGAAGGGC | SEQ ID NO:22688<br>GGTACCCACGGGTACTACTA<br>CGGTGTGGACGTC |
| | | AA | SEQ ID NO:6665<br>SYGMH | SEQ ID NO:14677<br>VISYDGGYKNYADSVKG | SEQ ID NO:22689<br>GTHGYYYGVDV |
| iPS:435921 | 21-225_190D6 | NA | SEQ ID NO:6666<br>AGCTTTATCATGCAC | SEQ ID NO:14678<br>GTTATATGGTATGATGG<br>AAGTAATAAATACTATG<br>CAGACTCCGTGAAGGGC | SEQ ID NO:22690<br>GAGGAGTATAGCAGTGGCTG<br>GTTCGGGTACGGTATGGACG<br>TC |
| | | AA | SEQ ID NO:6667<br>SFIMH | SEQ ID NO:14679<br>VIWYDGSNKYYADSVKG | SEQ ID NO:22691<br>EEYSSGWFGYGMDV |
| iPS:435923 | 21-225_190H6 | NA | SEQ ID NO:6668<br>GACTACTACATGAGC | SEQ ID NO:14680<br>TACATTAGTAGTAGTGGT<br>ACTACCGTATTCTACGCA<br>GACTCTGTGAAGGGC | SEQ ID NO:22692<br>GAATGGGTGGGAGCCGACTA<br>C |
| | | AA | SEQ ID NO:6669<br>DYYMS | SEQ ID NO:14681<br>YISSSGTTVFYADSVKG | SEQ ID NO:22693<br>EWVGADY |
| iPS:435925 | 21-225_190D7 | NA | SEQ ID NO:6670<br>AATTATGATATCAAC | SEQ ID NO:14682<br>TGGATGAACCCTAATAG<br>TGGTAATACAGGCTATG<br>CACAGAAGTTCCAGGGC | SEQ ID NO:22694<br>AGCAGTGGCTGGTACTTCTT<br>TGACTAC |
| | | AA | SEQ ID NO:6671<br>NYDIN | SEQ ID NO:14683<br>WMNPNSGNTGYAQKFQG | SEQ ID NO:22695<br>SSGWYFFDY |
| | | | SEQ ID NO:6672 | SEQ ID NO:14684 | SEQ ID NO:22696 |

FIGURE 49
(Continued)

| | | | | | |
|---|---|---|---|---|---|
| iPS:435927 | 21-225_190E7 | NA | AGTTACCACTGGAGT<br>SEQ ID NO:6673 | CATATCTATACCAGTAG<br>GAGCACCAACTACAACC<br>CCTCCCTCAAGAGT<br>SEQ ID NO:14685 | CTCCGGTATAACTGGAACTT<br>CCCTTACTTGACTAC<br>SEQ ID NO:22697 |
| | | AA | SYHWS<br>SEQ ID NO:6674 | HIYTSRSTNYNPSLKS<br>SEQ ID NO:14686 | LRYNWNFPYFDY<br>SEQ ID NO:22698 |
| iPS:435929 | 21-225_190D9 | NA | AGCTATGCCATGAGT<br>SEQ ID NO:6675 | ACTATTAGTGGTACTGGT<br>CGTAGGACATACTACGC<br>AGACTCCGTGAAGGGC<br>SEQ ID NO:14687 | GAGGAGATTACTATGATAG<br>TAGTGGCCCGGGGTTCGACC<br>CC<br>SEQ ID NO:22699 |
| | | AA | SYAMS<br>SEQ ID NO:6676 | TISGTGRRTYYADSVKG<br>SEQ ID NO:14688 | EEDYYDSSGPGFDP<br>SEQ ID NO:22700 |
| iPS:435933 | 21-225_190F8 | NA | ACTTATGGCATGCAC<br>SEQ ID NO:6677 | GTTATATGGTATGATGG<br>AAGTAATAAAACTATG<br>CAGACTCCGTGAAGGGC<br>SEQ ID NO:14689 | GATCAGGGCGTGGGCTACGA<br>CGGTTTGACGTC<br>SEQ ID NO:22701 |
| | | AA | TYGMH<br>SEQ ID NO:6678 | VIWYDGSNKNYADSVKG<br>SEQ ID NO:14690 | DQGVGYDGLDV<br>SEQ ID NO:22702 |
| iPS:435935 | 21-225_190H8 | NA | AGCTATGCCATGAGC<br>SEQ ID NO:6679 | ACTATTAGTGGTACTGGT<br>CGTAGGACATATTACGC<br>AGACTCCGTGAAGGGC<br>SEQ ID NO:14691 | GAGGAGATTACTATGATAG<br>TAGTGGCCCGGGGTTCGACC<br>CC<br>SEQ ID NO:22703 |
| | | AA | SYAMS<br>SEQ ID NO:6680 | TISGTGRRTYYADSVKG<br>SEQ ID NO:14692 | EEDYYDSSGPGFDP<br>SEQ ID NO:22704 |
| iPS:435937 | 21-225_190H9 | NA | AACTATGGCATGCAC<br>SEQ ID NO:6681 | GTTATATGGTTTGATGGA<br>AGTAATGACTACTATGC<br>AGACTCCGTGAAGGGC<br>SEQ ID NO:14693 | GATAGAAGCGTCGGCTACGA<br>CGGTTTAGATGTC<br>SEQ ID NO:22705 |

FIGURE 49
(Continued)

| | | | | | | | |
|---|---|---|---|---|---|---|---|
| iPS:435939 | 21-225_191H7 | AA | NYGMH | | VIWFDGSNDYYADSVKG | | DRSVGYDGLDV |
| | | | SEQ ID NO:6682 | | SEQ ID NO:14694 | | SEQ ID NO:22706 |
| | | NA | AGTGGTGATTACTACTGGAA C | | TACATCTTTACAGTGGG AGCACCTACTACAACC GTCCCTCAAGAGT | | GGGGATTACGATGGTTCGG GAGTTATCACTACTATTACG GTATGGACGTC |
| | | | SEQ ID NO:6683 | | SEQ ID NO:14695 | | SEQ ID NO:22707 |
| iPS:435941 | 21-225_191E8 | AA | SGDYYWN | | YIFYSGSTYYNPSLKS | | GDYDGSGSYHYYGMDV |
| | | | SEQ ID NO:6684 | | SEQ ID NO:14696 | | SEQ ID NO:22708 |
| | | NA | AACTATGGCATGCAC | | ATTATATGGTTGATGGA AGTAATCAATACTATGC CGACTCCGTGAAGGGC | | GCCCACGGGGTCTACTACTA CGGCTATGGACGTC |
| | | | SEQ ID NO:6685 | | SEQ ID NO:14697 | | SEQ ID NO:22709 |
| iPS:435943 | 21-225_191C9 | AA | NYGMH | | HWFDGSNQYYADSVKG | | AHGVYYYAMDV |
| | | | SEQ ID NO:6686 | | SEQ ID NO:14698 | | SEQ ID NO:22710 |
| | | NA | AGTGGTGGTTACTACTGGAA C | | TATATCTATTACAGTGGG AGCACCTACTACAACC GTCCCTCAAGAGT | | TCCGGGTATAATTGGGACGC CGGGGTCGACCCC |
| | | | SEQ ID NO:6687 | | SEQ ID NO:14699 | | SEQ ID NO:22711 |
| iPS:435945 | 21-225_191A10 | AA | SGGYYWN | | YIYYSGSTYYNPSLKS | | SGYNWDAGVDP |
| | | | SEQ ID NO:6688 | | SEQ ID NO:14700 | | SEQ ID NO:22712 |
| | | NA | AGCTATGGCATGCAC | | GTTATATGGTATGATGG AAGTAATAAAAACTACG CAGACTCCGTGAAGGGC | | GATCAGGGCGTGGCTACGA CGGTTTGGACGTC |
| | | | SEQ ID NO:6689 | | SEQ ID NO:14701 | | SEQ ID NO:22713 |
| | | AA | SYGMH | | VIWYDGSNKNYADSVKG | | DQGVGYDGLDV |
| | | | SEQ ID NO:6690 | | SEQ ID NO:14702 | | SEQ ID NO:22714 |

FIGURE 49
(Continued)

| iPS:435947 | 21-225_191E10 | NA | AGCTATGGCATGCAC | GTTATATGGTATGATGGAAGTAATAAAACTACGCAGACTCCGTGAAGGGC | GATCAGGGCCGTGGGCTACGACGGTTTGGACGTC |
|---|---|---|---|---|---|
| | | | SEQ ID NO:6691 | SEQ ID NO:14703 | SEQ ID NO:22715 |
| | | AA | SYGMH | VIWYDGSNKNYADSVKG | DQGVGYDGLDV |
| | | | SEQ ID NO:6692 | SEQ ID NO:14704 | SEQ ID NO:22716 |
| iPS:435953 | 21-225_191B12 | NA | GACTACTACATGAGC | TACATTAGTAGTAGTGGTACTACCGTATTCTACGCACGACTCTGTGAAGGGC | GAATGGGTGGGAGCCGACTAC |
| | | | SEQ ID NO:6693 | SEQ ID NO:14705 | SEQ ID NO:22717 |
| | | AA | DYYMS | YISSSGTTVFYADSVKG | EWVGADY |
| | | | SEQ ID NO:6694 | SEQ ID NO:14706 | SEQ ID NO:22718 |
| iPS:435957 | 21-225_191G12 | NA | AGCTATGGCATGCAC | GTTATATGGTATGATGGAAGTAATAAAACTATGCAGACTCCGTGAAGGGC | GATCAGGGCCGTGGGCTACGACGGTTTGGACGTC |
| | | | SEQ ID NO:6695 | SEQ ID NO:14707 | SEQ ID NO:22719 |
| | | AA | SYGMH | VIWYDGSNKNYADSVKG | DQGVGYDGLDV |
| | | | SEQ ID NO:6696 | SEQ ID NO:14708 | SEQ ID NO:22720 |
| iPS:435961 | 21-225_192A2 | NA | AGCTATGGCATGCAC | GTTATATGGTATGATGGAAGTTATAAATACTATGCAGACTCCGTGAAGGGC | GAGGATTCCCCTTATAGTGGCTACGCCTTGGACTACTTCTACGGTATGGACGTC |
| | | | SEQ ID NO:6697 | SEQ ID NO:14709 | SEQ ID NO:22721 |
| | | AA | SYGMH | VIWYDGSYKYYADSVKG | EDSPYSGYALDYFYGMDV |
| | | | SEQ ID NO:6698 | SEQ ID NO:14710 | SEQ ID NO:22722 |

FIGURE 49
(Continued)

| | | | | | | |
|---|---|---|---|---|---|---|
| iPS:435963 | 21-225_192D2 | NA | AGCTATGGCATGCAC | | GTTATATGGTATGATGG AAGTAATAAAACTATG CAGACTCCGTGAAGGC | | GATCGTGGGGTTGGCTACTA CGGTATGGACGTC |
| | | | SEQ ID NO:6699 | SEQ ID NO:14711 | SEQ ID NO:22723 |
| | | AA | SYGMH | VIWYDGSNKNYADSVKG | DRGVGYYGMDV |
| | | | SEQ ID NO:6700 | SEQ ID NO:14712 | SEQ ID NO:22724 |
| iPS:435965 | 21-225_192H2 | NA | AGCTCTGCCATGAGC | GCCATTAGTGGTAGTGG TGGTAACACATTCTACGC CCCTACTTTGACTAC AGACTCCGTGAAGGC | | CTCATAGCAGTAGTGGGTC |
| | | | SEQ ID NO:6701 | SEQ ID NO:14713 | SEQ ID NO:22725 |
| | | AA | SSAMS | AISGSGGNTFYADSVKG | LIAVGSHYFDY |
| | | | SEQ ID NO:6702 | SEQ ID NO:14714 | SEQ ID NO:22726 |
| iPS:435967 | 21-225_192B3 | NA | AGTGGTGATTACTACTGGA AC | TTCATCTTTTACAGTGGG AGCACCTACTACAACCC GTCCCTCAAGAGT | | GGGGATTACGATGGTTCGG GAGTTATCACCACTACTACG GTATGGACGTC |
| | | | SEQ ID NO:6703 | SEQ ID NO:14715 | SEQ ID NO:22727 |
| | | AA | SGDYYWN | FIFYSGSTYYNPSLKS | GDYDGSGSYHHYYGMDV |
| | | | SEQ ID NO:6704 | SEQ ID NO:14716 | SEQ ID NO:22728 |
| iPS:435971 | 21-225_192D3 | NA | AGCTATGGCATGCAC | | GTTATATGGTATGATGG AAGTAATGAACACTATG CAGACTCCGTGAAGGC | | GATAGGGGGGGTGGGTTACTA CGGTTTGGACGTC |
| | | | SEQ ID NO:6705 | SEQ ID NO:14717 | SEQ ID NO:22729 |
| | | AA | SYGMH | VIWYDGSNEHYADSVKG | DRGVGYYGLDV |
| | | | SEQ ID NO:6706 | SEQ ID NO:14718 | SEQ ID NO:22730 |

FIGURE 49
(Continued)

| | | | | | |
|---|---|---|---|---|---|
| iPS:435973 | 21-225_192H3 | NA | AGTGTTAGTTACTACTGGAGC | AACCTCTATTACAGTGGGAGCACCACTACAACCCGTCCCTCAGGAGT | GGGGATTACGATGGTTCGGGAGTTATCACTACTACCACGGTATGGACGTC |
| | | | SEQ ID NO:6707 | SEQ ID NO:14719 | SEQ ID NO:22731 |
| | | AA | SVSYYWS | NLYYSGSTYYNPSLRS | GDYDGSGSYHYYHGMDV |
| | | | SEQ ID NO:6708 | SEQ ID NO:14720 | SEQ ID NO:22732 |
| iPS:435977 | 21-225_192F4 | NA | AGTTATGGCATGCAC | GTTATATGGTATGATGGAAGTAACAAAAACTATGTAGACTCCGTGAGGGGC | GATAGAAGCGTCGGCTACGACGGTATGGACGTC |
| | | | SEQ ID NO:6709 | SEQ ID NO:14721 | SEQ ID NO:22733 |
| | | AA | SYGMH | VIWYDGSNKNYVDSVRG | DRSVGYDGMDV |
| | | | SEQ ID NO:6710 | SEQ ID NO:14722 | SEQ ID NO:22734 |
| iPS:435979 | 21-225_192H4 | NA | AGCTATGGCATGCAC | GTTATATGGTATGATGGAAGCAATAAAAACTATGCAGACTCCGTGAAGGGC | GATCAAGGTGTGGGGTACTACGGTATGGACGTC |
| | | | SEQ ID NO:6711 | SEQ ID NO:14723 | SEQ ID NO:22735 |
| | | AA | SYGMH | VIWYDGSNKNYADSVKG | DQGVGYYGMDV |
| | | | SEQ ID NO:6712 | SEQ ID NO:14724 | SEQ ID NO:22736 |
| iPS:435983 | 21-225_192E5 | NA | AATGGGTGGATACTACTGGAGC | TACATCTTTTACAGCGGGAGCACCTACAACCCGTCCCTCAAGAGT | GCGGGATATAACTGGGACAACGGGTTTGACTAC |
| | | | SEQ ID NO:6713 | SEQ ID NO:14725 | SEQ ID NO:22737 |
| | | AA | NGGYYWS | YIFYSGSTYYNPSLKS | AGYNWDNGFDY |
| | | | SEQ ID NO:6714 | SEQ ID NO:14726 | SEQ ID NO:22738 |

FIGURE 49
(Continued)

| | | NA | AGCTTTATCATGCAC | GTTATATGTGTATGATGG AAGTAATAAATACTATG TAGACTCCGTGAAGGGC | GAGGAGTATAGTAGCGGCTG GTTCGGGTACGTATGGACG TC |
|---|---|---|---|---|---|
| iPS:435985 | 21-225_192F6 | | SEQ ID NO:6715 | SEQ ID NO:14727 | SEQ ID NO:22739 |
| | | AA | SFIMH | VIWYDGSNKYYVDSVKG | EEYSSGWFGYGMDV |
| | | | SEQ ID NO:6716 | SEQ ID NO:14728 | SEQ ID NO:22740 |
| | | NA | AGCTATGGCATGCAC | GTTTATGTATGATGGA ACTAATAAAAACTATGC AGACTCCGTGAAGGGC | GATCAGGGGTGGCTACGA CGGTTTGGACGTC |
| iPS:435987 | 21-225_192G6 | | SEQ ID NO:6717 | SEQ ID NO:14729 | SEQ ID NO:22741 |
| | | AA | SYGMH | VLWYDGTNKNYADSVKG | DQGVGYDGLDV |
| | | | SEQ ID NO:6718 | SEQ ID NO:14730 | SEQ ID NO:22742 |
| | | NA | AGCTATGGCATGCAC | GTTATATCATATGATGGA GGTTATAAAAACTATGC AGACTCCGTGAAGGGC | GGTACCCACGGGTACTACTA CGGTGTGGACGTC |
| iPS:435989 | 21-225_192F7 | | SEQ ID NO:6719 | SEQ ID NO:14731 | SEQ ID NO:22743 |
| | | AA | SYGMH | VISYDGGYKNYADSVKG | GTHGYYYGVDV |
| | | | SEQ ID NO:6720 | SEQ ID NO:14732 | SEQ ID NO:22744 |
| | | NA | AGCTATGGCATGCAC | GTTATATGGTATGATGG AAGTAATGAACACTATG CAGACTCCGTGAAGGGC | GATAGGGGAGTGGGTTACTA CGGTATGGACGTC |
| iPS:435993 | 21-225_192C8 | | SEQ ID NO:6721 | SEQ ID NO:14733 | SEQ ID NO:22745 |
| | | AA | SYGMH | VIWYDGSNEHYADSVKG | DRGVGYYGMDV |
| | | | SEQ ID NO:6722 | SEQ ID NO:14734 | SEQ ID NO:22746 |

FIGURE 49
(Continued)

| | | | | | |
|---|---|---|---|---|---|
| iPS:435995 | 21-225_192F8 | NA | GGTTGCTACTGGAGC | GAAATCAATCAAAGTGG AAGGTCCAACTACAACC CGTCCCTCAAGAGT | GACTACGGTGTCTTTGACTA C |
| | | | SEQ ID NO:6723 | SEQ ID NO:14735 | SEQ ID NO:22747 |
| | | AA | GCYWS | EINQSGRSNYNPSLKS | DYGVFDY |
| | | | SEQ ID NO:6724 | SEQ ID NO:14736 | SEQ ID NO:22748 |
| iPS:435997 | 21-225_192G8 | NA | AGCTATGGCATGCAC | GTTATATGGTATGAGG AAGTAATAAAAACTATG CAGACTCCGTGAAGGGC | GATCAGGGCGTGGCTACGA CGGTTTGGACGTC |
| | | | SEQ ID NO:6725 | SEQ ID NO:14737 | SEQ ID NO:22749 |
| | | AA | SYGMH | VIWYDGSNKNYADSVKG | DQGVGYDGLDV |
| | | | SEQ ID NO:6726 | SEQ ID NO:14738 | SEQ ID NO:22750 |
| iPS:435999 | 21-225_192F9 | NA | AGCTACCACTGGAGC | CTTATCTATACCAGTAGG AGCACCAATTACAACCC CTCCCTCAAGAGT | CTCCGTATAACTGGAACTT CCCTTACTTGACTAC |
| | | | SEQ ID NO:6727 | SEQ ID NO:14739 | SEQ ID NO:22751 |
| | | AA | SYHWS | LIYTSRSTNYNPSLKS | LRYNWNFPYFDY |
| | | | SEQ ID NO:6728 | SEQ ID NO:14740 | SEQ ID NO:22752 |
| iPS:436001 | 21-225_192C10 | NA | AACTATGGCATGCAC | GTTATATGGTTTGATGGA AGTAATGACTACTATGC AGACTCCGTGAAGGGC | GATAGAAGCGTCGGCTACGA CGGTTTAGATGTC |
| | | | SEQ ID NO:6729 | SEQ ID NO:14741 | SEQ ID NO:22753 |
| | | AA | NYGMH | VIWFDGSNDYYADSVKG | DRSVGYDGLDV |
| | | | SEQ ID NO:6730 | SEQ ID NO:14742 | SEQ ID NO:22754 |
| iPS:436003 | 21-225_192G10 | NA | AGCTATGCCATGAGC | GCTATTAGTGGTAGAGG CGGTAGTACATTCTACGC AGACTCCGTGAAGGGC | CGTTTAGCACTGGATGGCTA TGATGCTTTTGATATC |
| | | | SEQ ID NO:6731 | SEQ ID NO:14743 | SEQ ID NO:22755 |

FIGURE 49
(Continued)

| | | | | | AISGRGGSTFYADSVKG | | RLALDGYDAFDI |
|---|---|---|---|---|---|---|---|
| | | | AA | SYAMS | | | |
| | | | | SEQ ID NO:6732 | SEQ ID NO:14744 | | |
| iPS:436005 | 21-225_192H10 | | NA | AGTATGGCATGCAC | GTTATATGGTATGATGG AAGTAATAAAAACTACG CAGACTCCGTGAAGGGC | | GATCAGGCGGTGGCTACGA CGGTTTGGACGTC |
| | | | | SEQ ID NO:6733 | SEQ ID NO:14745 | | SEQ ID NO:22756 |
| | | | AA | SYGMH | VIWYDGSNKNYADSVKG | | DQGVGYDGLDV |
| | | | | SEQ ID NO:6734 | SEQ ID NO:14746 | | SEQ ID NO:22757 |
| iPS:436007 | 21-225_192G12 | | NA | AGTGGTGTTTACCACTGGAG C | AACATCCATTACAGCGG GAGCACCTACAACAACC CGTCCCTCAAGAGT | | GGGGATTACGATGGTTCGGG GAGTTATCACTACTACTACG GTATGGACGTC |
| | | | | SEQ ID NO:6735 | SEQ ID NO:14747 | | SEQ ID NO:22758 |
| | | | AA | SGVYHWS | NIHYSGSTYNNPSLKS | | GDYDGSGSYHYYYGMDV |
| | | | | SEQ ID NO:6736 | SEQ ID NO:14748 | | SEQ ID NO:22759 |
| iPS:436009 | 21-225_193A1 | | NA | AGTGGTGTTTACTACTGGAG C | AACATCTATTACAGTGG GAGCACCTACAACAACC CGTCCCTCAAGAGT | | GGGGATTACGATGGTTCGGG GAGTTATCACTACTACTACG GTATGGACGTC |
| | | | | SEQ ID NO:6737 | SEQ ID NO:14749 | | SEQ ID NO:22760 |
| | | | AA | SGVYYWS | NIYYSGSTYNNPSLKS | | GDYDGSGSYHYYYGMDV |
| | | | | SEQ ID NO:6738 | SEQ ID NO:14750 | | SEQ ID NO:22761 |
| iPS:436011 | 21-225_193B1 | | NA | AGTGGTGTTTACTACTGGAG C | AACATCTATTACAGTGG GAGCACCTACAACAACC CGTCCCTCAAGAGT | | GGGGATTACGATGGTTCGGG GAGTTATCACTACTACTACG GTATGGACGTC |
| | | | | SEQ ID NO:6739 | SEQ ID NO:14751 | | SEQ ID NO:22762 |
| | | | AA | SGVYYWS | NIYYSGSTYNNPSLKS | | GDYDGSGSYHYYYGMDV |
| | | | | SEQ ID NO:6740 | SEQ ID NO:14752 | | SEQ ID NO:22763 |

FIGURE 49
(Continued)

| | | | | |
|---|---|---|---|---|
| iPS:436013 | 21-225_193F2 | NA | ACCTTTGCCATGAGT | GCTATTAGTCGTAGTGGT GGTAACACACACTACGC AGACTCCGTGAAGGGC | GATGGATTCGTGGGAGCTC CTACTTGACTAC |
| | | | SEQ ID NO:6741 | SEQ ID NO:14753 | SEQ ID NO:22765 |
| | | AA | TFAMS | AISRSGGNTHYADSVKG | DGFGGSSYFDY |
| | | | SEQ ID NO:6742 | SEQ ID NO:14754 | SEQ ID NO:22766 |
| iPS:436015 | 21-225_193D3 | NA | AGTGGTGGATTACTACTGGAAC | TACATCTTTACAGTGGG AGCACCTACTACAACCC GTCCCTCAAGAGT | GGGGATTACGATGGTTCGGG GAGTTATCACTTCTACTACG GTATGGACGTC |
| | | | SEQ ID NO:6743 | SEQ ID NO:14755 | SEQ ID NO:22767 |
| | | AA | SGDYYWN | YIFYSGSTYYNPSLKS | GDYDGSGSYHFYYGMDV |
| | | | SEQ ID NO:6744 | SEQ ID NO:14756 | SEQ ID NO:22768 |
| iPS:436017 | 21-225_193F3 | NA | AGTGGTGGATTACTACTGGAAC | TACATCTTTACAGTGGG AGCACCTACTACAACCC GTCCCTCAAGAGT | GGGGATTACGATGGTTCGGG GAGTTATCACTACTATTACG GTATGGACGTC |
| | | | SEQ ID NO:6745 | SEQ ID NO:14757 | SEQ ID NO:22769 |
| | | AA | SGDYYWN | YIFYSGSTYYNPSLKS | GDYDGSGSYHYYYGMDV |
| | | | SEQ ID NO:6746 | SEQ ID NO:14758 | SEQ ID NO:22770 |
| iPS:436019 | 21-225_193C4 | NA | AGCTATGCCATGAAC | GCTATTATTGGTAATGGT GGTAGAACATACTACGC AGACTCCGTGAAGGGC | GATCTGGGTAGATACAGCTA TGGTTTCTTTGACTAC |
| | | | SEQ ID NO:6747 | SEQ ID NO:14759 | SEQ ID NO:22771 |
| | | AA | SYAMN | AIIGNGGRTYYADSVKG | DLGRYSYGFFDY |
| | | | SEQ ID NO:6748 | SEQ ID NO:14760 | SEQ ID NO:22772 |
| iPS:436021 | 21-225_193G4 | NA | AATTATGATATCAAC | TGGATGAACCCTAACAG TGGTAACACAGGCTATG CACAGAAGTTCCAGGGC | AGCAGTGGCTGGTACTTCTT TGACTAC |
| | | | SEQ ID NO:6749 | SEQ ID NO:14761 | SEQ ID NO:22773 |
| | | AA | NYDIN | WMNPNSGNTGYAQKFQG | SSGWYFFDY |

FIGURE 49
(Continued)

| | | | | SEQ ID NO:6750 AGTTATGATATCAAC | SEQ ID NO:14762 TGGATGAACCCTAAAAG GGGTAACACAGGCTATG CACAGAAGTTCCAGGGC | SEQ ID NO:22774 GGAGACCCGTATAACTGGAA CTCCTACGCTATGGACGTC |
|---|---|---|---|---|---|---|
| iPS:436023 | 21-225_193A5 | NA | | | | |
| | | AA | | SEQ ID NO:6751 SYDIN | SEQ ID NO:14763 WMNPKRGNTGYAQKFQG | SEQ ID NO:22775 GDPYNWNSYAMDV |
| iPS:436025 | 21-225_193B5 | NA | | SEQ ID NO:6752 AGTGGTGGTTACTACTGGAG C | SEQ ID NO:14764 TACATCTATTACAGTGGG AGCACTACTACAACCC GTCCCTCAAGAGT | SEQ ID NO:22776 GGAGAGTATAACTGGAACCA CGGTATGGACGTC |
| | | AA | | SEQ ID NO:6753 SGGYYWS | SEQ ID NO:14765 YIYYSGSTYYNPSLKS | SEQ ID NO:22777 GEYNWNHGMDV |
| iPS:436027 | 21-225_193E6 | NA | | SEQ ID NO:6754 GGTCCCTACTGGAGT | SEQ ID NO:14766 GAATCCAATCATATAGTGG ACGCCAACTACAACC CGTCCCTCAAGAGT | SEQ ID NO:22778 GACTACGGTGGTTTGGACTA C |
| | | AA | | SEQ ID NO:6755 GPYWS | SEQ ID NO:14767 ESNHSGRTNYNPSLKS | SEQ ID NO:22779 DYGGLDY |
| iPS:436029 | 21-225_193H6 | NA | | SEQ ID NO:6756 AGTGGTGATTACTACTGGAA C | SEQ ID NO:14768 TACATCTTTTACAGTGGG AGCACTACTACAACCC GTCCCTCAAGAGT | SEQ ID NO:22780 GGGGATTACGATGGTTCGGG GAGTTATCACTACTATTACG GTATGGACGTC |
| | | AA | | SEQ ID NO:6757 SGDYYWN | SEQ ID NO:14769 YIFYSGSTYYNPSLKS | SEQ ID NO:22781 GDYDGSGSYHYYGMDV |
| | | | | SEQ ID NO:6758 | SEQ ID NO:14770 | SEQ ID NO:22782 |

FIGURE 49
(Continued)

| | | | | | |
|---|---|---|---|---|---|
| iPS:436031 | 21-225_193C7 | NA | AGCTATGGCATGCAC<br>SEQ ID NO:6759 | GTTATATGTTATGATGG<br>AAGTAATAAAAACTACG<br>CAGACTCCGTGAAGGGC<br>SEQ ID NO:14771 | GATCAGGGCGTGGGCTACGA<br>CGGCTTGGACGTC<br>SEQ ID NO:22783 |
| | | AA | SYGMH<br>SEQ ID NO:6760 | VIWYDGSNKNYADSVKG<br>SEQ ID NO:14772 | DQGVGYDGLDV<br>SEQ ID NO:22784 |
| iPS:436033 | 21-225_193E7 | NA | GGTTACTTCTGGACC<br>SEQ ID NO:6761 | GAAATCAATCATAGTGG<br>AAGCACCAACTACAACC<br>CGTCCCTCAAGAGT<br>SEQ ID NO:14773 | GACTACGTGCTGACTAC<br>SEQ ID NO:22785 |
| | | AA | GYFWT<br>SEQ ID NO:6762 | EINHSGSTNYNPSLKS<br>SEQ ID NO:14774 | DYGADY<br>SEQ ID NO:22786 |
| iPS:436035 | 21-225_193C8 | NA | AGTGGTGATTACTACTGGAA<br>C<br>SEQ ID NO:6763 | TACATCTTTTACAGTGGG<br>AGCACCTACTACAACCC<br>GTCCCTCAAGAGT<br>SEQ ID NO:14775 | GGGGATTACGATGGTTCGGG<br>GAGTTATCACTACTACTACG<br>GTATGGACGTC<br>SEQ ID NO:22787 |
| | | AA | SGDYYWN<br>SEQ ID NO:6764 | YIFYSGSTYYNPSLKS<br>SEQ ID NO:14776 | GDYDGSGSYHYYYGMDV<br>SEQ ID NO:22788 |
| iPS:436037 | 21-225_193D8 | NA | AGTGGGTGGTTACTACTGGAA<br>C<br>SEQ ID NO:6765 | TTCATCTTTTACAGTGGG<br>AGCACCTACTACAACCC<br>GTCCCTCAAGAGT<br>SEQ ID NO:14777 | GGGGATTACGATGGTTCGGG<br>GAGTTATCACTACTACTATACG<br>GTATGGACGTC<br>SEQ ID NO:22789 |
| | | AA | SGGYYWN<br>SEQ ID NO:6766 | FIFYSGSTYYNPSLKS<br>SEQ ID NO:14778 | GDYDGSGSYHYYYGMDV<br>SEQ ID NO:22790 |
| iPS:436039 | 21-225_193F8 | NA | ATCTATGGCATGGAC<br>SEQ ID NO:6767 | GTTATATGTGTATGATGG<br>AAGTTATAAATACTATG<br>CAGACTCCGTGAAGGGC<br>SEQ ID NO:14779 | GAGGATTCCCCTTATAGTGG<br>CTACGGCTTGGACTACTACT<br>ACGGTATGGACGTC<br>SEQ ID NO:22791 |

FIGURE 49
(Continued)

| | | | | | VIWYDGSYKYYADSVKG | EDSPYSGYGLDYYYGMDV |
|---|---|---|---|---|---|---|
| | | | AA | IYGMD | | |
| iPS:436041 | 21-225_193G8 | | | SEQ ID NO:6768 | SEQ ID NO:14780 | SEQ ID NO:22792 |
| | | | NA | AGTGGTGTTTACTACTGGAG | AACATCTATTACAGTGG GAGCACCTACAACAACC CGTCCCCTCAAGAGT | GGGGATTACGATGGTTCGGG GAGTTATCACTTCTACTACG GTTTGGACGTC |
| | | | | SEQ ID NO:6769 | SEQ ID NO:14781 | SEQ ID NO:22793 |
| | | | AA | SGVYYWS | NIYYSGSTYNNPSLKS | GDYDGSGSYHFYYGLDV |
| iPS:436043 | | | | SEQ ID NO:6770 | SEQ ID NO:14782 | SEQ ID NO:22794 |
| | 21-225_193G9 | | NA | AATGGTGGATACTACTGGAG | TACATCTTTACAGCGGG AGCACCTACTACAACCC GTCCCTCAAGAGT | GCGGGATATAACTGGGACAA CGGGTTTGACTAC |
| | | | | SEQ ID NO:6771 | SEQ ID NO:14783 | SEQ ID NO:22795 |
| | | | AA | NGGYYWS | YIFYSGSTYYNPSLKS | AGYNWDNGFDY |
| iPS:436045 | | | | SEQ ID NO:6772 | SEQ ID NO:14784 | SEQ ID NO:22796 |
| | 21-225_193A10 | | NA | AGCTATGGCATGCAC | GTTATATGGTATGATGG AAGTAATGAACACTATG CAGACTCCGTGAAGGGC | GATAGGGGGGGGGTTACTA CGGTTTGGACGTC |
| | | | | SEQ ID NO:6773 | SEQ ID NO:14785 | SEQ ID NO:22797 |
| | | | AA | SYGMH | VIWYDGSNEHYADSVKG | DRGVGYYGLDV |
| iPS:436047 | | | | SEQ ID NO:6774 | SEQ ID NO:14786 | SEQ ID NO:22798 |
| | 21-225_193B10 | | NA | GACTATAGCATGAAC | TCCATTAGTAGTGCTGGT GGTTACATATACTACGC AGACTCACTCACTGAAGGGC | GCAACTATGGCCCTTGACTA C |
| | | | | SEQ ID NO:6775 | SEQ ID NO:14787 | SEQ ID NO:22799 |
| | | | AA | DYSMN | SISSAGGYIYYADSLKG | ATMALDY |
| | | | | SEQ ID NO:6776 | SEQ ID NO:14788 | SEQ ID NO:22800 |

FIGURE 49
(Continued)

| | | | | | |
|---|---|---|---|---|---|
| iPS:436049 | 21-225_193B12 | NA | AGTGCTGATTACTACTGGAA C | TACATCTTTTACAGTGGG AGCACCTACTACAACCC GTCCCTCAAGAGT | GGGGATTACGATGGTTCGGG AGTTATCACTTCTACTACG GTATGGACGTC |
| | | | SEQ ID NO:6777 | SEQ ID NO:14789 | SEQ ID NO:22801 |
| | | AA | SADYYWN | YIFYSGSTYYNPSLKS | GDYDGSGSYHFYYGMDV |
| | | | SEQ ID NO:6778 | SEQ ID NO:14790 | SEQ ID NO:22802 |
| iPS:436051 | 21-225_193G12 | NA | AGCTATGCCATGCAC | GTTATATGGTATGATGG AACTAATAAATACTATG GAGACTCCGTGAAGGGC | GATTTCACTATAACTGGAGC TACATATTTTGACTAC |
| | | | SEQ ID NO:6779 | SEQ ID NO:14791 | SEQ ID NO:22803 |
| | | AA | SYAMH | VIWYDGTNKYYGDSVKG | DFTITGATYFDY |
| | | | SEQ ID NO:6780 | SEQ ID NO:14792 | SEQ ID NO:22804 |
| iPS:436054 | 21-225_194C1 | NA | AGCTATGGCATGCAC | GTTATATGGTATGATGG AAGTAATGAACACTATG CAGACTCCGTGAAGGGC | AATAGGGGGGTGGGTTACTA CGGTTTGGACGTC |
| | | | SEQ ID NO:6781 | SEQ ID NO:14793 | SEQ ID NO:22805 |
| | | AA | SYGMH | VIWYDGSNEHYADSVKG | NRGVGYYGLDV |
| | | | SEQ ID NO:6782 | SEQ ID NO:14794 | SEQ ID NO:22806 |
| iPS:436056 | 21-225_194C3 | NA | AATTACTACTGGAGC | CGTATCTATGCCAGTGG GAGCACCAACTACAACC CCTCCCTCAAGAGT | GATCGGGGATACTATGGCTA CTACGGTATGGACGTC |
| | | | SEQ ID NO:6783 | SEQ ID NO:14795 | SEQ ID NO:22807 |
| | | AA | NYYWS | RIYASGSTNYNPSLKS | DRGYYGYYGMDV |
| | | | SEQ ID NO:6784 | SEQ ID NO:14796 | SEQ ID NO:22808 |

FIGURE 49
(Continued)

| | | | | | |
|---|---|---|---|---|---|
| iPS:436058 | 21-225_194A4 | NA | GTCTACTATTTGAAC SEQ ID NO:6785 | TGGATCAACCCTAACAGTGGTGGCACAAACTATGCACAGAAGTTTCAGGGC SEQ ID NO:14797 | GGCTACGATATTTGACTGGT SEQ ID NO:22809 |
| | | AA | VYYLN SEQ ID NO:6786 | WINPNSGGTNYAQKFQG SEQ ID NO:14798 | GYDILTG SEQ ID NO:22810 |
| iPS:436060 | 21-225_194F4 | NA | AGTTACCACTGGAGC SEQ ID NO:6787 | CTTATCTATACCAGTAGGAGCACCAACTACACAACTCCCTCAAGAGT SEQ ID NO:14799 | CTCCGGTATAACTGGAACTTCCCTTACTTTGACTAC SEQ ID NO:22811 |
| | | AA | SYHWS SEQ ID NO:6788 | LIYTSRSTNYNPSLKS SEQ ID NO:14800 | LRYNWNFPYFDY SEQ ID NO:22812 |
| iPS:436062 | 21-225_194E5 | NA | AGTGGTGATTACTACTGGAAC SEQ ID NO:6789 | TACATCTTTTACAGTGGGAGCACCTACTACAACCCGTCCCTCAAGAGT SEQ ID NO:14801 | GGGGATTACGATGGTTCGGGGAGTTATCACTACTATTACGGTATGGACGTC SEQ ID NO:22813 |
| | | AA | SGDYYWN SEQ ID NO:6790 | YIFYSGSTYYNPSLKS SEQ ID NO:14802 | GDYDGSGSYHYYYGMDV SEQ ID NO:22814 |
| iPS:436064 | 21-225_194E6 | NA | AGTGGTGATTACTACTGGAAC SEQ ID NO:6791 | TTCATCTTTTACAGTGGGAGCACCTACTACAACCCGTCCCTCAAGAGT SEQ ID NO:14803 | GGGGATTACGATGGTTCGGGGAGTTATCACTACTATTACGGTATGGACGTC SEQ ID NO:22815 |
| | | AA | SGDYYWN SEQ ID NO:6792 | FIFYSGSTYYNPSLKS SEQ ID NO:14804 | GDYDGSGSYHYYYGMDV SEQ ID NO:22816 |
| iPS:436066 | 21-225_194B7 | NA | AGTATGGCATGCAC SEQ ID NO:6793 | GTTATATGGTATGATGGAAGTAATAAAAACTATGCAGACTCCGTGAAGGGC SEQ ID NO:14805 | GATCGGTCTAAGGGTTACGACGGTATGGACGTC SEQ ID NO:22817 |

FIGURE 49
(Continued)

| | | | | VIWYDGSNKNYADSVKG | DRSKGYDGMDV |
|---|---|---|---|---|---|
| iPS:436068 | | AA | SYGMH | SEQ ID NO:14806 | SEQ ID NO:22818 |
| | 21-225_194F7 | NA | GACTACTACATACAC | TGGATCAACCTAACAATGGTGCACAAACTATGCACAGAAATTTCAGGGC | GAACCCTTGGTTACTATGGTTCGGGGAGTTATGGGCCTACGGTATGGACGTC |
| | | AA | DYYIH | SEQ ID NO:14807 WINPNNGGTNYAQKFQG | SEQ ID NO:22819 EPLGYYGSGSYGAYGMDV |
| iPS:436072 | | NA | SEQ ID NO:6796 TATTACTACTGGAGC | SEQ ID NO:14808 GAAATCAATCATAGTGGAAGCACCAACTACAACCCGTCCCTCAAGAGT | SEQ ID NO:22820 GACTACGGTGCTTTTGATATC |
| | 21-225_194C10 | AA | YYYWS | SEQ ID NO:14809 EINHSGSTNYNPSLKS | SEQ ID NO:22821 DYGAFDI |
| iPS:436074 | | NA | SEQ ID NO:6798 AGCTTTATCATGCAC | SEQ ID NO:14810 GTTATATGGTATGATGGAAGTAATAAATACTATGCAGACTCCGTGAAGGGC | SEQ ID NO:22822 GAGGAGTATAGCAGCAGTGGCTGGTTCGGGTACGGTATGGACG TC |
| | 21-225_194F10 | AA | SFIMH | SEQ ID NO:14811 VIWYDGSNKNYADSVKG | SEQ ID NO:22823 EEYSSGWFGYGMDV |
| iPS:436076 | | NA | SEQ ID NO:6800 AGCTATGGCATGCAC | SEQ ID NO:14812 GTTATATGGTATGATGGAAGTAATGAACACTATGCAGACTCCGTGAAGGGC | SEQ ID NO:22824 GATAGGGGGGTGGGTTATTACGGTTTGGACGTC |
| | 21-225_194H11 | | SEQ ID NO:6801 | SEQ ID NO:14813 | SEQ ID NO:22825 |

FIGURE 49
(Continued)

| | | | | SYGMH | VIWYDGSNEHYADSVKG | DRGVGYYYGLDV |
|---|---|---|---|---|---|---|
| iPS:436078 | 21-225_194H12 | AA | | SEQ ID NO:6802 | SEQ ID NO:14814 | SEQ ID NO:22826 |
| | | NA | | AACTATGGCATGCAC | GTTATATGGTTTGATGGAAGTAATGACTACTATGCAGACTCCGTGAAGGGC | GATAGAAGGGTCGGCTACGACGGTTTAGATGTC |
| iPS:436080 | 21-225_195B1 | AA | | NYGMH | VIWFDGSNDYYADSVKG | DRSVGYDGLDV |
| | | | | SEQ ID NO:6803 | SEQ ID NO:14815 | SEQ ID NO:22827 |
| | | NA | | TATTACTTCTGGAGC | GAAATCAATCATAGTGGACGCACCAACTACAACCCGTCCCTCAAGAGT | GACTACGGTGCTTTTGATATC |
| | | | | SEQ ID NO:6804 | SEQ ID NO:14816 | SEQ ID NO:22828 |
| iPS:436082 | 21-225_195D9 | AA | | YYFWS | EINHSGRTNYNPSLKS | DYGAFDI |
| | | | | SEQ ID NO:6805 | SEQ ID NO:14817 | SEQ ID NO:22829 |
| | | NA | | CACTATGTCATGCAC | GTTATTGGTATGATGGAACTAATAAATACTATGCAGACTCCGTGAAGGGC | GATTGGTTCGGGGAGGGGAACTACTACGGTATGGACGTC |
| iPS:436084 | 21-225_195F2 | AA | | HYVMH | VIWYDGTNKYYADSVKG | DWFGEGNYYGMDV |
| | | | | SEQ ID NO:6807 | SEQ ID NO:14819 | SEQ ID NO:22831 |
| | | NA | | AGCGGTGGTTACTACTGGAGC | TACAGCTATTACAGTGGGAGCACCAACTATAACCCGTCCCTCAAGAGT | GGGGGTATAACTGGAACAACGGGTTTGACTAC |
| | | | | SEQ ID NO:6809 | SEQ ID NO:14821 | SEQ ID NO:22833 |
| | | AA | | SGGYYWS | YSYYSGSTNYNPSLKS | GGYNWNNGFDY |
| | | | | SEQ ID NO:6810 | SEQ ID NO:14822 | SEQ ID NO:22834 |

FIGURE 49
(Continued)

| | | | | | |
|---|---|---|---|---|---|
| iPS:436086 | 21-225_191G10 | NA | AGCTATGGCATGCAC | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6811 | SEQ ID NO:14823 | SEQ ID NO:22835 |
| | | AA | SYGMH | VIWYDGSNKNYADSVKG | DQGVGYDGLDV |
| | | | SEQ ID NO:6812 | SEQ ID NO:14824 | SEQ ID NO:22836 |
| iPS:436088 | 21-225_195C8 | NA | AGTGGTGATTACTACTGGAA C | TACATCTTTACAGTGGG AGCACCTACTACAACCC GTCCCTCAAGAGT | GGGGATTAGACGATGGTTCGGG GAGTTATCACTTCTACTACG GTATGGACGTC |
| | | | SEQ ID NO:6813 | SEQ ID NO:14825 | SEQ ID NO:22837 |
| | | AA | SGDYYWN | YIFYSGSTYYNPSLKS | GDYDGSGSYHFYYGMDV |
| | | | SEQ ID NO:6814 | SEQ ID NO:14826 | SEQ ID NO:22838 |
| iPS:436090 | 21-225_195A9 | NA | AGCTATGGCATGCAC | GTTATATGGTATGATGG AAGTAATGAACACTATG CAGACTCCGTGAAGGGC | GATAGGGGGGGTGGGTTACTA CGGTTTGGACGTC |
| | | | SEQ ID NO:6815 | SEQ ID NO:14827 | SEQ ID NO:22839 |
| | | AA | SYGMH | VIWYDGSNEHYADSVKG | DRGVGYYYGLDV |
| | | | SEQ ID NO:6816 | SEQ ID NO:14828 | SEQ ID NO:22840 |
| iPS:436092 | 21-225_195B9 | NA | AGCTATGGCATGCAC | GTTATATGGTATGATGG AAGTAATAATACTATG CAGACTCCGTGAAGGGC | GAATGGCTACAATTCAGGTA CTACTACGGTATGGACGTC |
| | | | SEQ ID NO:6817 | SEQ ID NO:14829 | SEQ ID NO:22841 |
| | | AA | SYGMH | VIWYDGSNKYYADSVKG | EWLQFRYYGMDV |
| | | | SEQ ID NO:6818 | SEQ ID NO:14830 | SEQ ID NO:22842 |

FIGURE 49
(Continued)

| | | | | | |
|---|---|---|---|---|---|
| iPS:436094 | 21-225_195B10 | NA | AATAGTGGTTACTACTGGAG C | TACATGTATTATACAGTGG GAGCACTACTACAACC CGTCCCTCAAGAGT | GGGGGGTATAACTGGAACAA TGGGTTTGACTGT |
| | | | SEQ ID NO:6819 | SEQ ID NO:14831 | SEQ ID NO:22843 |
| | | AA | NSGYYWS | YMYYSGSTYYNPSLKS | GGYNWNNGFDC |
| | | | SEQ ID NO:6820 | SEQ ID NO:14832 | SEQ ID NO:22844 |
| iPS:436096 | 21-225_195E10 | NA | AGTGGTGGTTACTACTGGAG C | TACATCTATTACAGTGGG AGCACCTACTACAACCC GTCCCTCAAGAGT | GGGGGGTATAACTGGAACCA CGGTATGGACGTC |
| | | | SEQ ID NO:6821 | SEQ ID NO:14833 | SEQ ID NO:22845 |
| | | AA | SGGYYWS | YIYYSGSTYYNPSLKS | GGYNWNHGMDV |
| | | | SEQ ID NO:6822 | SEQ ID NO:14834 | SEQ ID NO:22846 |
| iPS:436098 | 21-225_195G11 | NA | GACTACTACATGAGC | TACATTAGTAGTAGTGGT ACTACCGTATTCTACGCA GACTCTGTGAAGGGC | GAATGGGTGGGAGCCGACTA C |
| | | | SEQ ID NO:6823 | SEQ ID NO:14835 | SEQ ID NO:22847 |
| | | AA | DYYMS | YISSSGTVFYADSVKG | EWVGADY |
| | | | SEQ ID NO:6824 | SEQ ID NO:14836 | SEQ ID NO:22848 |
| iPS:436100 | 21-225_195G12 | NA | ACCTATGCCATGAGT | GCTATTAGTCGTAGTGGT GGTAACACACACTACGC AGACTCCGTGAAGGGC | GATGGATTCGGTGGGAGCTC CTACTTTGACTAC |
| | | | SEQ ID NO:6825 | SEQ ID NO:14837 | SEQ ID NO:22849 |
| | | AA | TYAMS | AISRSGGNTHYADSVKG | DGFGGSSYFDY |
| | | | SEQ ID NO:6826 | SEQ ID NO:14838 | SEQ ID NO:22850 |
| iPS:436102 | 21-225_196B1 | NA | GACTACTACATGAGC | TACATTAGTAGTAGTGGT ATTACCATGTACTACGCA C GACTCTGTGAAGGGC | GAATGGGTGGGAGCCGACTA C |
| | | | SEQ ID NO:6827 | SEQ ID NO:14839 | SEQ ID NO:22851 |
| | | AA | DYYMS | YISSSGITMYYADSVKG | EWVGADY |
| | | | SEQ ID NO:6828 | SEQ ID NO:14840 | SEQ ID NO:22852 |

FIGURE 49
(Continued)

| | | NA | GACTACTACATGAGC | TACATTAGTAGTAGTGGT ACTACCGTATTCTACGCAC GACTCTGTGAAGGGC | GAATGGGTGGGAGCCGACTA C |
|---|---|---|---|---|---|
| iPS:436104 | 21-225_196C1 | | SEQ ID NO:6829 | SEQ ID NO:14841 | SEQ ID NO:22853 |
| | | AA | DYYMS | YISSSGTTVFYADSVKG | EWVGADY |
| | | | SEQ ID NO:6830 | SEQ ID NO:14842 | SEQ ID NO:22854 |
| iPS:436106 | 21-225_196F2 | NA | AGCTTTGGCATGCAC | GTTATATTAAATGATGG AAGTAATAAAAGTGTG CAGACTCCGTGAAGGGC | GGACAGCAGTGGCTGGTAAA CGGTGTGGACGTC |
| | | | SEQ ID NO:6831 | SEQ ID NO:14843 | SEQ ID NO:22855 |
| | | AA | SFGMH | VILNDGSNKKCADSVKG | GQQWLVNGVDV |
| | | | SEQ ID NO:6832 | SEQ ID NO:14844 | SEQ ID NO:22856 |
| iPS:436110 | 21-225_196F4 | NA | AGCTGTGCCATGACC | GCTATTAGTGGTAGTGGT GGTAGCACATACTACGC AGACTCCGTGAAGGGC | GTGGGGGTTGACTGGCTC CTACTACTACGGTATGG ACGTC |
| | | | SEQ ID NO:6833 | SEQ ID NO:14845 | SEQ ID NO:22857 |
| | | AA | SCAMT | AISGSGGSTYYADSVKG | VGGLTGSYYYYGMDV |
| | | | SEQ ID NO:6834 | SEQ ID NO:14846 | SEQ ID NO:22858 |
| iPS:436112 | 21-225_196C7 | NA | AGCTATTGGCATGCAC | GTTATATGGTATGATGG AAGTAATGAACACTATG CAGACTCCGTGAAGGGC | GATAGGGGGGTGGGTTACTA CGGTTTGGACGTC |
| | | | SEQ ID NO:6835 | SEQ ID NO:14847 | SEQ ID NO:22859 |
| | | AA | SYGMH | VIWYDGSNEHYADSVKG | DRGVGYYGLDV |
| | | | SEQ ID NO:6836 | SEQ ID NO:14848 | SEQ ID NO:22860 |
| iPS:436114 | | NA | AATTATGATATCAAC | TGGATGCACCTTAACAG TGGTAACACAGGCTATG CACCGAAGTTCCAGGGC | AGCGGTGGCTGGTACGTGTT CGACCCC |

FIGURE 49
(Continued)

| | | | | | | |
|---|---|---|---|---|---|---|
| iPS:436116 | 21-225_196G8 | AA | SEQ ID NO:6837<br>NYDIN | SEQ ID NO:14849<br>WMHLNSGNTGYAPKFQG | SEQ ID NO:22861<br>SGGWYVFDP |
| | | NA | SEQ ID NO:6838<br>GGCTACTATATGCAC | SEQ ID NO:14850<br>TGGATCAACCTAACAG<br>TGGTGGCACAAACTTTG<br>CACAGAAGTTCGGGGC | SEQ ID NO:22862<br>GGGGGGTTCGGGGAGTCC<br>CAACTACTACGTTATGG<br>ACGTC |
| iPS:436118 | 21-225_196B9 | AA | SEQ ID NO:6839<br>GYYMH | SEQ ID NO:14851<br>WINPNSGGTNFAQKFRG | SEQ ID NO:22863<br>GGVRGVPNYYYVMDV |
| | | NA | SEQ ID NO:6840<br>CACTATGTCATGCAC | SEQ ID NO:14852<br>GTTATTTGGTATGATGGA<br>ACTAATAAATACTATGC<br>AGACTCCGTGAAGGGC | SEQ ID NO:22864<br>GATGGTTCGGGGAGGGAA<br>CTACTACGGTATGGACGTC |
| iPS:436120 | 21-225_196A10 | AA | SEQ ID NO:6841<br>HYVMH | SEQ ID NO:14853<br>VIWYDGTNKYYADSVKG | SEQ ID NO:22865<br>DWFGEGNYYGMDV |
| | | NA | SEQ ID NO:6842<br>AGTGGTGGTGACTACTGGAG<br>C | SEQ ID NO:14854<br>TTCATCTATTACAGTGGG<br>AGCACCTACTACAATCC<br>GTCCCTCAAGAGT | SEQ ID NO:22866<br>ATGGACTACAGTAACTACTA<br>CTACGGTATGGACGTC |
| iPS:436122 | 21-225_196C10 | AA | SEQ ID NO:6843<br>SGGDYWS | SEQ ID NO:14855<br>FIYYSGSTYYNPSLKS | SEQ ID NO:22867<br>MDYSNYYYGMDV |
| | | NA | SEQ ID NO:6844<br>GACTATAGCATGAAC | SEQ ID NO:14856<br>TCTATTAGTAGTAGTGGTAGT<br>GGTTACATACACTACGC<br>AGACTCAGTGAAGGGC | SEQ ID NO:22868<br>GCAACTATGGCCCTTGACTA<br>C |
| | 21-225_196G10 | AA | SEQ ID NO:6845<br>DYSMN | SEQ ID NO:14857<br>SISSGSGYTHYADSVKG | SEQ ID NO:22869<br>ATMALDY |
| | | NA | SEQ ID NO:6846 | SEQ ID NO:14858 | SEQ ID NO:22870 |

FIGURE 49
(Continued)

| | | | | | | |
|---|---|---|---|---|---|---|
| iPS:436132 | 21-225_196C12 | NA | AGTTATGATATCAAC | | TGGATGAACCCTAAAAG GGGTAACACAGGCTATG CACAGAAGTTCCAGGGC | GGAGACCCGTATAACTGGAA CTCCTACGCTACGGACGTC |
| | | | SEQ ID NO:6847 | | SEQ ID NO:14859 | SEQ ID NO:22871 |
| | | AA | SYDIN | | WMNPKRGNTGYAQKFQG | GDPYNWNSYAMDV |
| | | | SEQ ID NO:6848 | | SEQ ID NO:14860 | SEQ ID NO:22872 |
| iPS:436134 | 21-225_196H12 | NA | AGTGGTGTTTACTACTGGAG C | | AACATCTATTACAGTGG GAGCACCTACACAACC CGTCCCTCAAGAGT | GGGGATTACGATGGTTCGG GAGTTATCACTACTACTACG GTTTGGACGTC |
| | | | SEQ ID NO:6849 | | SEQ ID NO:14861 | SEQ ID NO:22873 |
| | | AA | SGVYYWS | | NIYYSGSTYNNPSLKS | GDYDGSGSYHYYYGLDV |
| | | | SEQ ID NO:6850 | | SEQ ID NO:14862 | SEQ ID NO:22874 |
| iPS:436138 | 21-225_197F2 | NA | AGCTATGGCATGCAC | | GTTATATGGTATGATGG AAGTAATAAAAACTATG CAGACTCCGTGAAGGGC | GATCAGGGCGTGGGCTACGA CGGTTTGGACGTC |
| | | | SEQ ID NO:6851 | | SEQ ID NO:14863 | SEQ ID NO:22875 |
| | | AA | SYGMH | | VIWYDGSNKNYADSVKG | DQGVGYDGLDV |
| | | | SEQ ID NO:6852 | | SEQ ID NO:14864 | SEQ ID NO:22876 |
| iPS:436140 | 21-225_197G3 | NA | AGCCATGGCATGCAC | | GTTATATGGTATGATGG AAGTAATAAAAACTATG CAGACTCCGTGAAGGGC | GATCCCTCTGTAGGGTACGA CGGTATGGACGTC |
| | | | SEQ ID NO:6853 | | SEQ ID NO:14865 | SEQ ID NO:22877 |
| | | AA | SHGMH | | VIWYDGSNKNYADSVKG | DPSVGYDGMDV |
| | | | SEQ ID NO:6854 | | SEQ ID NO:14866 | SEQ ID NO:22878 |

FIGURE 49
(Continued)

| | | | AGTGGTGATTACTACTGGAA C | TACATCTTTTACAGTGGG AGCACTACTACAACCC GTCCCTCAAGAGT | GGGGATTACGATGGTTCGGG GAGTATCACTACTACTACG GTTTGGACGTC |
|---|---|---|---|---|---|
| iPS:436146 | 21-225_197F4 | NA | SEQ ID NO:6855 | SEQ ID NO:14867 | SEQ ID NO:22879 |
| | | AA | SGDYYWN | YIFYSGSTYYNPSLKS | GDYDGSGSYHYYYGLDV |
| | | | SEQ ID NO:6856 | SEQ ID NO:14868 | SEQ ID NO:22880 |
| iPS:436150 | 21-225_197H4 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:6857 | SEQ ID NO:14869 | SEQ ID NO:22881 |
| | | AA | NYDIN | WMHPNSGNTGYAQKFQG | SSGWYYFDY |
| | | | SEQ ID NO:6858 | SEQ ID NO:14870 | SEQ ID NO:22882 |
| iPS:436152 | 21-225_197B6 | NA | AGCTATGGCATGCAC | GTTATATGGTATGATGG AAGTAATAAAAACTACG CAGACTCCGTGAAGGGC | GATCAGGGCCGTGGGCTACGA CGGTTTGGACGTC |
| | | | SEQ ID NO:6859 | SEQ ID NO:14871 | SEQ ID NO:22883 |
| | | AA | SYGMH | VIWYDGSNKNYADSVKG | DQGVGYDGLDV |
| | | | SEQ ID NO:6860 | SEQ ID NO:14872 | SEQ ID NO:22884 |
| iPS:436154 | 21-225_197C6 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:6861 | SEQ ID NO:14873 | SEQ ID NO:22885 |
| | | AA | NYDIN | WMHPNSGNTGYAQKFQG | SSGWYYFDY |
| | | | SEQ ID NO:6862 | SEQ ID NO:14874 | SEQ ID NO:22886 |

FIGURE 49
(Continued)

| | | | | |
|---|---|---|---|---|
| iPS-436156 | 21-225_197C8 | NA | AGCTCTGCCATGACC | GCTATCATTGGTAATGGT GGTAGAGCATACTACGC AGACTCCGTGAAGGGC | GATCGGGGATATAGCAGGAT AGCAGTGGCTGGTACCTTTG ACTAC |
| | | | SEQ ID NO:6863 | SEQ ID NO:14875 | SEQ ID NO:22887 |
| | | AA | SSAMT | AIIGNGGRAYYADSVKG | DRGYSRIAVAGTFDY |
| | | | SEQ ID NO:6864 | SEQ ID NO:14876 | SEQ ID NO:22888 |
| iPS-436158 | 21-225_197G8 | NA | GCTTACTCCTGGAGC | CGTCTCTCTCCTGGTGG AGCACCAACTTCAACCC CTCCCTCAAGAGT | CTCCGGTATAACTGGAACTT CCCTTACTTTGACTAC |
| | | | SEQ ID NO:6865 | SEQ ID NO:14877 | SEQ ID NO:22889 |
| | | AA | AYSWS | RLSPGGSTNFNPSLKS | LRYNWNFPYFDY |
| | | | SEQ ID NO:6866 | SEQ ID NO:14878 | SEQ ID NO:22890 |
| iPS-436160 | 21-225_197C9 | NA | AGCTATGCCATGAGC | GTTATTAGTGGTAGAGG TGGTAACACATACTACG CAGACTCCGTGAAGGGC | GGCATAGCAGTGGCTGGCTC GCACTACTTTGACTAC |
| | | | SEQ ID NO:6867 | SEQ ID NO:14879 | SEQ ID NO:22891 |
| | | AA | SYAMS | VISGRGGNTYYADSVKG | GIAVAGSHYFDY |
| | | | SEQ ID NO:6868 | SEQ ID NO:14880 | SEQ ID NO:22892 |
| iPS-436164 | 21-225_197G10 | NA | AGCTATGGCATGCAC | GTTACATGGTATGATGG AAGTAATAAATACTATG CAGACTCCGTGAAGGGC | GAATGGCTACAATTAGGTA CTACTACGGTATAGACGTC |
| | | | SEQ ID NO:6869 | SEQ ID NO:14881 | SEQ ID NO:22893 |
| | | AA | SYGMH | VTWYDGSNKYYADSVKG | EWLQFRYYYGIDV |
| | | | SEQ ID NO:6870 | SEQ ID NO:14882 | SEQ ID NO:22894 |
| iPS-436167 | 21-225_197E11 | NA | AACTATGGCATGCAC | GTTATATGGTTTGATGGA AGTAATGACTACTATGC AGACTCCGTGAAGGGC | GATAGAAGGTCGGCTACGA CGGTTTAGATGTC |
| | | | SEQ ID NO:6871 | SEQ ID NO:14883 | SEQ ID NO:22895 |

FIGURE 49
(Continued)

| | | AA/NA | | | | | |
|---|---|---|---|---|---|---|---|
| iPS:436173 | 21-225_197G12 | AA | NYGMH | SEQ ID NO:6872 | VIWFDGSNDYYADSVKG | SEQ ID NO:14884 | DRSVGYDGLDV SEQ ID NO:22896 |
| | | NA | AGTATGGCATGCAC SEQ ID NO:6873 | | GTTATATGGTTATGATGG AAGTAATAAAAACTATG CAGACTCCGTGAAGGGC SEQ ID NO:14885 | | GATCAGGGCGTGGCTACGA CGGTTTGGACGTC SEQ ID NO:22897 |
| iPS:436177 | 21-225_198B1 | AA | SYGMH SEQ ID NO:6874 | | VIWYDGSNKNYADSVKG SEQ ID NO:14886 | | DQGVGYDGLDV SEQ ID NO:22898 |
| | | NA | AGTGGTGATTACTGGAA C SEQ ID NO:6875 | | TACATCTTCCACAGTGGG AGCACCTACTACAACCC GTCCCTCAAGAGT SEQ ID NO:14887 | | GGGGATTACGATGGTTCGGG GAGTTATCACTACTATTACG GTATGGACGTC SEQ ID NO:22899 |
| iPS:436179 | 21-225_198F1 | AA | SGDYYWN SEQ ID NO:6876 | | YIFHSGSTYYNPSLKS SEQ ID NO:14888 | | GDYDGSGSYHYYYGMDV SEQ ID NO:22900 |
| | | NA | AGTGGTGGTTACTACTGGAA C SEQ ID NO:6877 | | TTCATCTTTTACAGTGGG AGCACCTACTACAACCC GTCCCTCAAGAGT SEQ ID NO:14889 | | GGGGATTACGATGGTTCGGG GAGTTATCACTACTATTACG GTATGGACGTC SEQ ID NO:22901 |
| iPS:436181 | 21-225_198C2 | AA | SGGYYWN SEQ ID NO:6878 | | FIFYSGSTYYNPSLKS SEQ ID NO:14890 | | GDYDGSGSYHYYYGMDV SEQ ID NO:22902 |
| | | NA | AGTGGTGGTTACTATGGTTCGGAG C SEQ ID NO:6879 | | AACATCTATTACAGTGG GAGCACCTACTACAACC CGTCCCTCAAGAGT SEQ ID NO:14891 | | GGGGATTACTATGGTTCGGG GAGTTATCACAACTACTACG GTTTGGACGTC SEQ ID NO:22903 |
| | | AA | SGGYYWS SEQ ID NO:6880 | | NIYYSGSTYYNPSLKS SEQ ID NO:14892 | | GDYYGSGSYHNYYGLDV SEQ ID NO:22904 |

FIGURE 49 (Continued)

| iPS: | | | | | |
|---|---|---|---|---|---|
| iPS:436189 | 21-225_198B6 | NA | AGTATGGCATGCAC SEQ ID NO:6881 | GTTATATGGTATGATGG AAGTAATAAACACTATG CAGACTCCGTGAAGGGC SEQ ID NO:14893 | GATCAGGGCGTGGGCTACTA CGGTATGGACGTC SEQ ID NO:22905 |
| | | AA | SYGMH SEQ ID NO:6882 | VIWYDGSNKHYADSVKG SEQ ID NO:14894 | DQGVGYYGMDV SEQ ID NO:22906 |
| iPS:436191 | 21-225_198B9 | NA | AACTATGGCATGCAC SEQ ID NO:6883 | ATTATATGGTTTGATGGA AGTAATAAATACTATGT AGACTCCGTGAAGGGC SEQ ID NO:14895 | GAATGGCTACAATTCAGGTA CTACTACGGTATGGACGTC SEQ ID NO:22907 |
| | | AA | NYGMH SEQ ID NO:6884 | IIWFDGSNKYYVDSVKG SEQ ID NO:14896 | EWLQFRYYYGMDV SEQ ID NO:22908 |
| iPS:436193 | 21-225_198A10 | NA | AGTTACCACTGGAGT SEQ ID NO:6885 | CATATCTATACCAGTAG GAGCACCAACTACAACC CCTCCCTCAAGAGT SEQ ID NO:14897 | CTCCGGTATAACTGGAACTT CCCTTACTTTGACTAC SEQ ID NO:22909 |
| | | AA | SYHWS SEQ ID NO:6886 | HIYTSRSTNYNPSLKS SEQ ID NO:14898 | LRYNWNFPYFDY SEQ ID NO:22910 |
| iPS:436195 | 21-225_198G10 | NA | AGTGGTGATTACTACTGGAA C SEQ ID NO:6887 | TACATCTTTTACAGTGGG AGCACCTACTACAACCC GTCCCTCAAGAGT SEQ ID NO:14899 | GGGGATTACGATGGTTCGGG GAGTTATCACTTCTACTACG GTATGGACGTC SEQ ID NO:22911 |
| | | AA | SGDYYWN SEQ ID NO:6888 | YIFYSGSTYYNPSLKS SEQ ID NO:14900 | GDYDGSGSYHFYYGMDV SEQ ID NO:22912 |
| iPS:436197 | 21-225_199C2 | NA | AGTGGTGATTACTACTGGAA C | TACATCTTTTACAGTGGG AGCACCTACTACAACCC GTCCCTCAAGAGT | GGGGATTACGATGGTTCGGG GAGTTATCACTACTACTACG GTATGGACGTC |

FIGURE 49
(Continued)

| | | | | | | |
|---|---|---|---|---|---|---|
| iPS:436199 | 21-225_199C2 | AA | SEQ ID NO:6889<br>SGDYYWN | SEQ ID NO:14901<br>YIFYSGSTYYNPSLKS | SEQ ID NO:22913<br>GDYDGSGSYHYYYGMDV |
| | | NA | SEQ ID NO:6890<br>GGTTACTTCTGGAAC | SEQ ID NO:14902<br>GAAATCAATCATAGTGG<br>AAGCACCAACTACAACC<br>CGTCCCTCAAGAGT | SEQ ID NO:22914<br>GACTACGGTGCTGACTAC |
| iPS:436201 | 21-225_199E3 | AA | SEQ ID NO:6891<br>GYFWT | SEQ ID NO:14903<br>EINHSGSTNYNPSLKS | SEQ ID NO:22915<br>DYGADY |
| | | NA | SEQ ID NO:6892<br>AGCTATGGCATGCAC | SEQ ID NO:14904<br>GTTATATATGGTATGATGG<br>AAGTAATAAAAACTATG<br>CAGACTCCGTGAAGGGC | SEQ ID NO:22916<br>GATCAGGGCGTGGGCTACTA<br>CGGTATGGACGTC |
| iPS:436203 | 21-225_199C5 | AA | SEQ ID NO:6893<br>SYGMH | SEQ ID NO:14905<br>VIWYDGSNKNYADSVKG | SEQ ID NO:22917<br>DQGVGYYYGMDV |
| | | NA | SEQ ID NO:6894<br>AACTATGGCATGCAC | SEQ ID NO:14906<br>ATTATATGGTTTGATGGA<br>AGTAATCAATACTATGC<br>CGACTCCGTGAAGGGC | SEQ ID NO:22918<br>GCCCACGGGGTCTACTACTA<br>CGGCTATGGACGTC |
| iPS:436205 | 21-225_199A6 | AA | SEQ ID NO:6895<br>NYGMH | SEQ ID NO:14907<br>IIWFDGSNQYYADSVKG | SEQ ID NO:22919<br>AHGVYYYAMDV |
| | | NA | SEQ ID NO:6896<br>AACTATGGCATGCAC | SEQ ID NO:14908<br>ATTATATGGTTTGATGGA<br>AGTAATAAATACTATGC<br>AGACTCCGTGAAGGGC | SEQ ID NO:22920<br>GAATGGCTACAATTCAGGTA<br>CTACTACGGTATGGACGTC |
| | 21-225_199A7 | AA | SEQ ID NO:6897<br>NYGMH | SEQ ID NO:14909<br>IIWFDGSNKYYADSVKG | SEQ ID NO:22921<br>EWLQFRYYYGMDV |
| | | NA | SEQ ID NO:6898 | SEQ ID NO:14910 | SEQ ID NO:22922 |

FIGURE 49
(Continued)

| | | | | |
|---|---|---|---|---|
| iPS:436207 | 21-225_199C7 | NA | AGTGGTGGTTACTACTGGAAC SEQ ID NO:6899 | TTCATCTTTTACAGTGGGAGCACTACTACAACCCGTCCCTCAAGAGT SEQ ID NO:14911 | GGGGATTACGATGGTTCGGGGAGTTATCACTACTATTACGGTATGGACGTC SEQ ID NO:22923 |
| | | AA | SGGYYWN SEQ ID NO:6900 | FIFYSGSTYYNPSLKS SEQ ID NO:14912 | GDYDGSGSYHYYYGMDV SEQ ID NO:22924 |
| iPS:436210 | 21-225_199G11 | NA | AGTGGTGGTTACTACTGGAGC SEQ ID NO:6901 | AACATCTATTACAGTGGGAGCACCTACTACAACCCGTCCCTCAAGAGT SEQ ID NO:14913 | GGGGATTACTATGGTTCGGGGAGTTATCACAACTACTACGGTTTGGACGTC SEQ ID NO:22925 |
| | | AA | SGGYYWS SEQ ID NO:6902 | NIYYSGSTYYNPSLKS SEQ ID NO:14914 | GDYYGSGSYHNYYGLDV SEQ ID NO:22926 |
| iPS:436212 | 21-225_200G1 | NA | AGCTATGCCATGAGC SEQ ID NO:6903 | GCTATTAGTGGTAGAGGCGGTAATACATTCTACGCAGACTCCGTGAGGGGC SEQ ID NO:14915 | CGTATAGCAGTGGATGGCTATGATGCTTTTGATGTC SEQ ID NO:22927 |
| | | AA | SYAMS SEQ ID NO:6904 | AISGRGGNTFYADSVRG SEQ ID NO:14916 | RIAVDGYDAFDV SEQ ID NO:22928 |
| iPS:436214 | 21-225_200F6 | NA | AGTTATGGCATGCAC SEQ ID NO:6905 | GTTATATGGTATGATGGAAGTAATAAATACTATGCAGACTCCGTGAAGGGC SEQ ID NO:14917 | GAATGGCTACAATTAGGTATTACTACGGTATGGACGTC SEQ ID NO:22929 |
| | | AA | SYGMH SEQ ID NO:6906 | VIWYDGSNKYYADSVKG SEQ ID NO:14918 | EWLQFRYYYGMDV SEQ ID NO:22930 |
| iPS:436216 | 21-225_200B7 | NA | AGTGGTGGTTACTACTGGAGC SEQ ID NO:6907 | TACATCTTTTACAGTGGGAGCACCAACTACAACCCGTCCCTCAGGAGT SEQ ID NO:14919 | GCCGGGTATAACTGGAACAACGGTATGGACGTC SEQ ID NO:22931 |

FIGURE 49
(Continued)

| | | | | SGGYYWS | | YIFYSGSTNYNPSLRS | | AGYNWNNGMDV |
|---|---|---|---|---|---|---|---|---|
| iPS:436218 | | | AA | SEQ ID NO:6908 | | SEQ ID NO:14920 | | SEQ ID NO:22932 |
| | 21-225_200G7 | | NA | AATTATGATATCAAC | | TGGATGCACCTTAACAG TGGTAACACAGGCTATG CACCGAAGTTCCAGGGC | | AGCGGTGGCTGGTACGTGTT CGACCCC |
| | | | | | | SEQ ID NO:14921 | | SEQ ID NO:22933 |
| | | | AA | NYDIN | | WMHLNSGNTGYAPKFQG | | SGGWYVFDP |
| iPS:436220 | | | | SEQ ID NO:6910 | | SEQ ID NO:14922 | | SEQ ID NO:22934 |
| | 21-225_200F8 | | NA | AATTACTACTGGAGC | | CGTATCTATACCAGTGG GAGCACCAACTACAACC CCTCCCTCAAGAGT | | GATCGGGGATACTATGGCTA CTACGGTATGGACGTC |
| | | | | SEQ ID NO:6911 | | SEQ ID NO:14923 | | SEQ ID NO:22935 |
| | | | AA | NYYWS | | RIYTSGSTNYNPSLKS | | DRGYGYYGMDV |
| iPS:436222 | | | | SEQ ID NO:6912 | | SEQ ID NO:14924 | | SEQ ID NO:22936 |
| | 21-225_200C9 | | NA | AGCTATGGCATGCAC | | GTTATATCATATGATGGA GGTTATAAAACTATAT AGACTCCGTGAAGGGC | | GGTACCACCAGGGTACTACTA CGGTGTGGACGTC |
| | | | | SEQ ID NO:6913 | | SEQ ID NO:14925 | | SEQ ID NO:22937 |
| | | | AA | SYGMH | | VISYDGGYKNYIDSVKG | | GTHGYYYGVDV |
| iPS:436226 | | | | SEQ ID NO:6914 | | SEQ ID NO:14926 | | SEQ ID NO:22938 |
| | 21-225_200F10 | | NA | AGTGGTGGTGATTACTACTGGAA C | | TACATCTTTACAGTGG AGCACCTACTACAACCC GTCCCTCAAGAGAT | | GGGGATTACGATGGTTCGG GAGTTATCACTACTACTACG GTATGGACGTC |
| | | | | SEQ ID NO:6915 | | SEQ ID NO:14927 | | SEQ ID NO:22939 |
| | | | AA | SGDYYWN | | YIFYSGSTYYNPSLKS | | GDYDGSGSYHYYYGMDV |
| | | | | SEQ ID NO:6916 | | SEQ ID NO:14928 | | SEQ ID NO:22940 |

FIGURE 49
(Continued)

| | | | | | |
|---|---|---|---|---|---|
| iPS:436228 | 21-225_200F12 | NA | GGTTACTTCTGGACC | GAAATCAGTCATAGTGG AAGCACCAACTACAACC CGTCCCTCAAGAGT | GACTACGGGGCGGACTAC |
| | | | SEQ ID NO:6917 | SEQ ID NO:14929 | SEQ ID NO:22941 |
| | | AA | GYFWT | EISHSGSTNYNPSLKS | DYGADY |
| | | | SEQ ID NO:6918 | SEQ ID NO:14930 | SEQ ID NO:22942 |
| iPS:436230 | 21-225_201A1 | NA | GGTTACTTCTGGACC | GAAATCAGTCATAGTGG ACGCACCAACTACAACC CGTCCCTCAAGAGT | GACTACGGGGCGGACTAC |
| | | | SEQ ID NO:6919 | SEQ ID NO:14931 | SEQ ID NO:22943 |
| | | AA | GYFWT | EISHSGRTNYNPSLKS | DYGADY |
| | | | SEQ ID NO:6920 | SEQ ID NO:14932 | SEQ ID NO:22944 |
| iPS:436232 | 21-225_201E1 | NA | CCTTACTACTGGAGC | GAAGTCAATCATAGTGG AAGCACCAACTACAACC CGTCCCTCAAGAGT | GACTACGGGGTTTAGACTA C |
| | | | SEQ ID NO:6921 | SEQ ID NO:14933 | SEQ ID NO:22945 |
| | | AA | PYYWS | EVNHSGSTNYNPSLKS | DYGGLDY |
| | | | SEQ ID NO:6922 | SEQ ID NO:14934 | SEQ ID NO:22946 |
| iPS:436234 | 21-225_51E3 | NA | AGCTATGGTATCAGC | TGGATCAGCGCTTATAAT GGTAACACAAAGAATGC ACAGAGGTTCCAGGGC | CACGATTTTGGAGTGGTTA TTATAAGGTATGGGACGTC |
| | | | SEQ ID NO:6923 | SEQ ID NO:14935 | SEQ ID NO:22947 |
| | | AA | SYGIS | WISAYNGNTKNAQRFQG | HDFWSGYYKGMDV |
| | | | SEQ ID NO:6924 | SEQ ID NO:14936 | SEQ ID NO:22948 |
| iPS:436236 | 21-225_201F7 | NA | AGCAACAGTGCTGCTTGGAA C | AGGACACATACTACAGGTC CAAGTGGTATAATTATTA TGAAGTATCTGTGAGAA GT | GATCAAGGTACTACGGTAT GGACGTC |
| | | | SEQ ID NO:6925 | SEQ ID NO:14937 | SEQ ID NO:22949 |

FIGURE 49 (Continued)

| | | | | | RTYYRSKWYNYYEVSVRS | DQRYYGMDV |
|---|---|---|---|---|---|---|
| | | | | SNSAAWN | | |
| iPS:436238 | | AA | | SEQ ID NO:6926 | SEQ ID NO:14938 | SEQ ID NO:22950 |
| | 21-225_201B2 | NA | | GTTACTACTGGACC | GAAATCAATCATAGTGG AAGCACCAACTACAACC CGTCCCTCAAGAGT | GACTATGGTGTCTTTGATTA C |
| iPS:436240 | | | | | SEQ ID NO:14939 | SEQ ID NO:22951 |
| | | AA | | VYYWT | EINHSGSTNYNPSLKS | DYGVFDY |
| | 21-225_201E8 | NA | | SEQ ID NO:6928 | SEQ ID NO:14940 | SEQ ID NO:22952 |
| iPS:436242 | | | | GGCTACTATATGCAC | TGGATCGACCCTAACAG TGGTGGCACAAACTATC CACAGAAGTTTCAGGGC | GATCAAGGTATAACTGGAA CTCTTTTGACTAC |
| | | AA | | SEQ ID NO:6929 | SEQ ID NO:14941 | SEQ ID NO:22953 |
| | 21-225_201A10 | NA | | GYYMH | WIDPNSGGTNYPQKFQG | DQGYNWNSFDY |
| iPS:436244 | | | | SEQ ID NO:6930 | SEQ ID NO:14942 | SEQ ID NO:22954 |
| | | AA | | GGTTACTTCTGGACC | GAAATCAGTCATAGTGG AAGCACCAACTACAACC CGTCCCTCAAGAGT | GACTACGGGGGGGACTAC |
| | 21-225_201H10 | NA | | SEQ ID NO:6931 | SEQ ID NO:14943 | SEQ ID NO:22955 |
| iPS:436246 | | | | GYFWT | EISHSGSTNYNPSLKS | DYGADY |
| | | AA | | SEQ ID NO:6932 | SEQ ID NO:14944 | SEQ ID NO:22956 |
| | 21-225_201G6 | NA | | GGCTACTATATCCAC | TGGATCAACCCTAATAG TGGTGGCACAAACTATG CACAGAAGTTTCAGGGC | GGATACAGCTATGGTTACAA CTGGTTCGACCCC |
| | | | | SEQ ID NO:6933 | SEQ ID NO:14945 | SEQ ID NO:22957 |
| | | AA | | GYYIH | WINPNSGGTNYAQKFQG | GYSYGYNWFDP |
| | | NA | | SEQ ID NO:6934 | SEQ ID NO:14946 | SEQ ID NO:22958 |
| | | | | AGCTATGCCATGAGC | ACTATTAGTGGTAGTGGT GTTAGAACATACTACGC AGACTCCGTGAAGGGC | GGGGGAGCTAGGAGCAGTG GCTGGTTCCACTTGACTAC |

FIGURE 49
(Continued)

| | | | | | | |
|---|---|---|---|---|---|---|
| iPS:436248 | 21-225_201G6 | AA | SEQ ID NO:6935 SYAMS | SEQ ID NO:14947 TISGSGVRTYYADSVKG | SEQ ID NO:22959 GGARSSGWFHFDY | |
| | | NA | SEQ ID NO:6936 AGTTATGATATCAAC | SEQ ID NO:14948 TGGATGAACCCTAAGAG AGGTAACACAGGCTATG CACAGAAGTTCCAGGGC | SEQ ID NO:22960 GGAAGGTATAGCAGGGAGG ATTACTACTACTATTATGAT ATGGACGTC | |
| iPS:436250 | 21-225_202A3 | AA | SEQ ID NO:6937 SYDIN | SEQ ID NO:14949 WMNPKRGNTGYAQKFQG | SEQ ID NO:22961 GRYSREDYYYYDMDV | |
| | | NA | SEQ ID NO:6938 AGCAACAGTGCTGCTTGGAA C | SEQ ID NO:14950 AGGACATACTACAGGTC CAAGTGGTATAATTATTA TGAAGTATCTGTGAAAA GT | SEQ ID NO:22962 GATCAACGGTACTACGTAT GGACGTC | |
| iPS:436252 | 21-225_201A4 | AA | SEQ ID NO:6939 SNSAAWN | SEQ ID NO:14951 RTYYRSKWYNYYEVSVK S | SEQ ID NO:22963 DQRYYGMDV | |
| | | NA | SEQ ID NO:6940 AGCAACAGTGCTGCTTGGAA C | SEQ ID NO:14952 AGGACATACTACAGGTC CAAGTGGTATAATGAGT ATGCAGTATCTGTGAGA AGT | SEQ ID NO:22964 GATCAACGGTACTACGTAT GGACGTC | |
| iPS:436254 | 21-225_202A8 | AA | SEQ ID NO:6941 SNSAAWN | SEQ ID NO:14953 RTYYRSKWYNEYAVSVRS | SEQ ID NO:22965 DQRYYGMDV | |
| | | NA | SEQ ID NO:6942 AGCTATGCCATGAGC | SEQ ID NO:14954 ACTATTAGTGGTAGTGGT GTTAGAACATACTACGC AGACTCCGTGAAGGGC | SEQ ID NO:22966 GGGGGAGCTAGGAGCAGTG GCTGGTTCCACTTTGACTAC | |
| | 21-225_202C12 | | SEQ ID NO:6943 | SEQ ID NO:14955 | SEQ ID NO:22967 | |

FIGURE 49
(Continued)

| | | | | | | |
|---|---|---|---|---|---|---|
| iPS:436256 | 21-225_202D9 | AA | SYAMS<br>SEQ ID NO:6944 | TISGSGVRTYYADSVKG<br>SEQ ID NO:14956 | GGARSSGWFHFDY<br>SEQ ID NO:22968 |
| | | NA | CCTTACTACTGGAGC<br>SEQ ID NO:6945 | GAAATCAATCATAGTGG<br>AAGCACCAACTACAATC<br>CGTCCCTCAAGAGT<br>SEQ ID NO:14957 | GACTACGGGGGTTTAGACTA<br>C<br>SEQ ID NO:22969 |
| iPS:436258 | 21-225_202F12 | AA | PYYWS<br>SEQ ID NO:6946 | EINHSGSTNYNPSLKS<br>SEQ ID NO:14958 | DYGGLDY<br>SEQ ID NO:22970 |
| | | NA | TACTATGGCATGCAC<br>SEQ ID NO:6947 | ATTATATGGTATGATGG<br>AAGTAATAAATTCTATG<br>CAGACTCCGTGAAGGGC<br>SEQ ID NO:14959 | AATATAGCAGCAGCTGCCCC<br>TTACTTTGACTAC<br>SEQ ID NO:22971 |
| | | AA | YYGMH<br>SEQ ID NO:6948 | HWYDGSNKFYADSVKG<br>SEQ ID NO:14960 | NIAAAPYFDY<br>SEQ ID NO:22972 |
| iPS:436260 | 21-225_203H1 | NA | AGCTATGGCATGCAC<br>SEQ ID NO:6949 | GTTATATGGTATGATGG<br>AAGTAATAAAAACTATG<br>CAGACTCCGTGAAGGGC<br>SEQ ID NO:14961 | GATAGAACAGTTGGCTACAA<br>CGGTATGGACGTC<br>SEQ ID NO:22973 |
| | | AA | SYGMH<br>SEQ ID NO:6950 | VIWYDGSNKNYADSVKG<br>SEQ ID NO:14962 | DRTVGYNGMDV<br>SEQ ID NO:22974 |
| iPS:436262 | 21-225_203E3 | NA | GGCTACTATATCCAC<br>SEQ ID NO:6951 | TGGATCAACCCTAATAG<br>TGGTGGCACAAACTATG<br>CACAGAAGTTTCAGGGC<br>SEQ ID NO:14963 | GGATACAGCTATGGTTACAA<br>CTGGTTCGACCCC<br>SEQ ID NO:22975 |
| | | AA | GYYIH<br>SEQ ID NO:6952 | WINPNSGGTNYAQKFQG<br>SEQ ID NO:14964 | GYSYGYNWFDP<br>SEQ ID NO:22976 |

FIGURE 49
(Continued)

| | | | | |
|---|---|---|---|---|
| iPS:436264 | 21-225_203F7 | NA | GACTATGTCATGCAC<br>SEQ ID NO:6953 | GTATATGGTATGATGG<br>AAGTAATAAATACTATG<br>TAGACTCCGTGAAGGGC<br>SEQ ID NO:14965 | GAACGGTATAGCAGTGGCTT<br>GTACGACTACGGTATGGACG<br>TC<br>SEQ ID NO:22977 |
| | | AA | DYVMH<br>SEQ ID NO:6954 | VIWYDGSNKYYVDSVKG<br>SEQ ID NO:14966 | ERYSSGLYDYGMDV<br>SEQ ID NO:22978 |
| iPS:436268 | 21-225_203B9 | NA | AGTTTTGGCATGCAC<br>SEQ ID NO:6955 | GTTATATGGTATGATGTA<br>AATAATAAATACTATGC<br>AGACTCCGTGAAGGGC<br>SEQ ID NO:14967 | GAACTGGGGGTTCCTCTCTGA<br>CTAC<br>SEQ ID NO:22979 |
| | | AA | SFGMH<br>SEQ ID NO:6956 | VIWYDVNNKYYADSVKG<br>SEQ ID NO:14968 | ELGFLSDY<br>SEQ ID NO:22980 |
| iPS:436270 | 21-225_203F10 | NA | GACTACTACATGAGC<br>SEQ ID NO:6957 | TACATTAGTAGTGGTAGTGGT<br>ACTACCACATACTACGC<br>AGACTCTGTGAAGGGC<br>SEQ ID NO:14969 | GATAGGGGGGGGGTTTGGACGT<br>C<br>SEQ ID NO:22981 |
| | | AA | DYYMS<br>SEQ ID NO:6958 | YISGSGTTTYYADSVKG<br>SEQ ID NO:14970 | DRGGLDV<br>SEQ ID NO:22982 |
| iPS:436272 | 21-225_201F5 | NA | AATTATGATATCAAC<br>SEQ ID NO:6959 | TGGATGCACCTAACAG<br>TGGTAACACAGGCTATG<br>CACAGAAGTTCCAGGGC<br>SEQ ID NO:14971 | AGCAGTGGCTGGTACTACTT<br>TGACTAC<br>SEQ ID NO:22983 |
| | | AA | NYDIN<br>SEQ ID NO:6960 | WMHPNSGNTGYAQKFQG<br>SEQ ID NO:14972 | SSGWYYFDY<br>SEQ ID NO:22984 |

FIGURE 49
(Continued)

| | | | | |
|---|---|---|---|---|
| iPS:436274 | 21-225_204H3 | NA | AGCTATGTCATGCAC | GTTATATGGTATGATGG AAGTAATAAATATAATG CAGACTCCGTGAAGGGC | GAACCGTATAGCAGCAGCTG GTACGACTACGGTATGGACG TC |
| | | | SEQ ID NO:6961 | SEQ ID NO:14973 | SEQ ID NO:22985 |
| | | AA | SYVMH | VIWYDGSNKYNADSVKG | EPYSSSWYDYGMDV |
| | | | SEQ ID NO:6962 | SEQ ID NO:14974 | SEQ ID NO:22986 |
| iPS:436276 | 21-225_204H4 | NA | GGCTACTATATCCAC | TGGATCAACCCTAATAG TGGTGGCACAAACTATG CACAGAAGTTTCAGGGC | GGATACAGCTATGGTTACAA CTGGTTCGACCCC |
| | | | SEQ ID NO:6963 | SEQ ID NO:14975 | SEQ ID NO:22987 |
| | | AA | GYYIH | WINPNSGGTNYAQKFQG | GYSYGYNWFDP |
| | | | SEQ ID NO:6964 | SEQ ID NO:14976 | SEQ ID NO:22988 |
| iPS:436278 | 21-225_201F2 | NA | AGCAACAGTGCTGCTTGGAA C | AGGACATACTACACGTC CAAGTGGTATAATTATTA TGAAGTATCTGTGAGAA GT | GATCAACGGTACTACGGTAT GGACGTC |
| | | | SEQ ID NO:6965 | SEQ ID NO:14977 | SEQ ID NO:22989 |
| | | AA | SNSAAWN | RTYYRSKWYNYEVSVRSDQRYYGMDV | |
| | | | SEQ ID NO:6966 | SEQ ID NO:14978 | SEQ ID NO:22990 |
| iPS:436280 | 21-225_204D6 | NA | ACCTATGCCATGAGC | GCTATTAGTGGTAGTGGT GGTAGCACATATTACGC AGACTCCGTGAAGGGC | GGGATAAGTGGTGGAACCGGCTC CTACTACTACTACGGTGTGG ACGTC |
| | | | SEQ ID NO:6967 | SEQ ID NO:14979 | SEQ ID NO:22991 |
| | | AA | TYAMS | AISGSGGSTYYADSVKG | GISGFGSYYYYGVDV |
| | | | SEQ ID NO:6968 | SEQ ID NO:14980 | SEQ ID NO:22992 |

FIGURE 49
(Continued)

| iPS | | | | | | |
|---|---|---|---|---|---|---|
| iPS:436282 | 21-225_204G6 | NA | AGCTATGGCATGCAC | | GTTATATGGTATGATGG AAGTAATAAAACTATG CAGACTCCGTGAAGGGC | GATCGAGGTGTCGGCTACGA CGGTATGGACGTC |
| | | | SEQ ID NO:6969 | | SEQ ID NO:14981 | SEQ ID NO:22993 |
| | | AA | SYGMH | | VIWYDGSNKNYADSVKG | DRGVGYDGMDV |
| | | | SEQ ID NO:6970 | | SEQ ID NO:14982 | SEQ ID NO:22994 |
| iPS:436284 | 21-225_204G8 | NA | AGCTATGGCATGCAC | | GTTATATGGTATGATGGT AGCAATGAAAATTATGT AGCCTCCGTGAAGGGC | GATCTGGGGATAGGGTATTA CGGTATGGACGTC |
| | | | SEQ ID NO:6971 | | SEQ ID NO:14983 | SEQ ID NO:22995 |
| | | AA | SYGMH | | VIWYDGSNENYVASVKG | DLGIGYYGMDV |
| | | | SEQ ID NO:6972 | | SEQ ID NO:14984 | SEQ ID NO:22996 |
| iPS:436286 | 21-225_204H8 | NA | GGTTACTTCTGGACC | | GAAATCAGTCAGTAGTGG AAGCACCAGTTACAACC CGTCCCTCAAGAGT | GACTACGGGGCCGACTAC |
| | | | SEQ ID NO:6973 | | SEQ ID NO:14985 | SEQ ID NO:22997 |
| | | AA | GYFWT | | EISHSGSTSYNPSLKS | DYGADY |
| | | | SEQ ID NO:6974 | | SEQ ID NO:14986 | SEQ ID NO:22998 |
| iPS:436290 | 21-225_205G3 | NA | GGTCACTACTGGAGC | | GAAAGTATCATTTTGGA AACACCAACTACAACCC GTCCCTCAAGAGT | GTGGGGCAGTGGCTGGCTTT TGATATC |
| | | | SEQ ID NO:6975 | | SEQ ID NO:14987 | SEQ ID NO:22999 |
| | | AA | GHYWS | | EMYHFGNTNYNPSLKS | VGQWLAFDI |
| | | | SEQ ID NO:6976 | | SEQ ID NO:14988 | SEQ ID NO:23000 |

FIGURE 49
(Continued)

| iPS:436292 | 21-225_205H3 | NA | AGCTATGGCATGCAC | GTTATATGGTATGATGGAAGTAATAAATACTATGCAGACTCCGTGAAGGGC | GATAGATCAGTTGGCTACGACGGTACGGGACGTC |
|---|---|---|---|---|---|
| | | | SEQ ID NO:6977 | SEQ ID NO:14989 | SEQ ID NO:23001 |
| | | AA | SYGMH | VIWYDGSNKYYADSVKG | DRSVGYDGTDV |
| | | | SEQ ID NO:6978 | SEQ ID NO:14990 | SEQ ID NO:23002 |
| iPS:436294 | 21-225_205G4 | NA | AGCAACAGTGCTGCTTGGAAC | AGGACATATTACAGGTCCAAGTGGTATAATTATTAGTGAAGTATCTGTGAAGT | GATCAACGGTACTACGGTATGGACGTC |
| | | | SEQ ID NO:6979 | SEQ ID NO:14991 | SEQ ID NO:23003 |
| | | AA | SNSAAWN | RTYYRSKWYNYYEVSVRSDQRYYGMDV | |
| | | | SEQ ID NO:6980 | SEQ ID NO:14992 | SEQ ID NO:23004 |
| iPS:436296 | 21-225_205F5 | NA | AGATATGGCATGCAC | GTTATATGGTATGATGGAAGTAATGAGAATTAFGTAGACTCCGTGAAGGGC | GATATGGGGATAGGGTATTATGGTATGGACGTC |
| | | | SEQ ID NO:6981 | SEQ ID NO:14993 | SEQ ID NO:23005 |
| | | AA | RYGMH | VIWYDGSNENYVDSVKG | DMGIGYYGMDV |
| | | | SEQ ID NO:6982 | SEQ ID NO:14994 | SEQ ID NO:23006 |
| iPS:436302 | 21-225_205G7 | NA | GTTTATTACTGGAGC | GAAAGCAATCAGAGTGGACGCACCACTACAACCCGTCCCTCAAGAGT | GACTACGGTGTCTTTGACTAC |
| | | | SEQ ID NO:6983 | SEQ ID NO:14995 | SEQ ID NO:23007 |
| | | AA | VYYWS | ESNQSGRTTYNPSLKS | DYGVFDY |
| | | | SEQ ID NO:6984 | SEQ ID NO:14996 | SEQ ID NO:23008 |

FIGURE 49
(Continued)

| | | | | | |
|---|---|---|---|---|---|
| iPS:436304 | 21-225_201F3 | NA | AGCTATGCCATGAGC | ACTATTAGTGGTAGTGGT GTTAGAACATACTACGC AGACTCCGTGAAGGGC | GGGGGAGCTAGGAGCAGTG GCTGGTTCCACTTTGACTAC |
| | | | SEQ ID NO:6985 | SEQ ID NO:14997 | SEQ ID NO:23009 |
| | | AA | SYAMS | TISGSGVRTYYADSVKG | GGARSSGWFHFDY |
| | | | SEQ ID NO:6986 | SEQ ID NO:14998 | SEQ ID NO:23010 |
| iPS:436306 | 21-225_201H4 | NA | AGCTATGCCATGCAC | GCTATATGGTATGATGG AAGTAATAAATACAATG CAGACTCCGTGAAGGGC | GATGTGGTACAGTGGGAGC TACCTACTTTGACTGC |
| | | | SEQ ID NO:6987 | SEQ ID NO:14999 | SEQ ID NO:23011 |
| | | AA | SYAMH | AIWYDGSNKYNADSVKG | DVGTVGATYFDC |
| | | | SEQ ID NO:6988 | SEQ ID NO:15000 | SEQ ID NO:23012 |
| iPS:436308 | 21-225_205H8 | NA | GGTTACTTCTGGAGC | GAAATCAGTCATATGG ACGCACCAACTACAACC CGTCCCTCAAGAGC | GACTACGGGGCGGACTAC |
| | | | SEQ ID NO:6989 | SEQ ID NO:15001 | SEQ ID NO:23013 |
| | | AA | GYFWS | EISHSGRTNYNPSLKS | DYGADY |
| | | | SEQ ID NO:6990 | SEQ ID NO:15002 | SEQ ID NO:23014 |
| iPS:436310 | 21-225_202D11 | NA | GGTCCCTACTGGAGC | GAAATCAATCATATGG AAGCACCAACTACAACC CGTCCCTCAAGAGT | GACTAGGGTGTCCTGACTA C |
| | | | SEQ ID NO:6991 | SEQ ID NO:15003 | SEQ ID NO:23015 |
| | | AA | GPYWS | EINHSGSTNYNPSLKS | DYGVLDY |
| | | | SEQ ID NO:6992 | SEQ ID NO:15004 | SEQ ID NO:23016 |
| iPS:436312 | 21-225_206A4 | NA | GGCTACTATATCCAC | TGGATCAACCTAATAG TGGTGGCACAAACTATG CACAGAAGTTTCAGGGC | GGATACAGCTATGGTTACAA CTGGTTCGACCCC |
| | | | SEQ ID NO:6993 | SEQ ID NO:15005 | SEQ ID NO:23017 |

FIGURE 49
(Continued)

| | | | | | | | |
|---|---|---|---|---|---|---|---|
| iPS:436314 | 21-225_206G4 | AA | GYYIH | | WINPNSGGTNYAQKFQG | | GYSYGYNWFDP |
| | | | SEQ ID NO:6994 | | SEQ ID NO:15006 | | SEQ ID NO:23018 |
| | | NA | GGCTACTATATACAC | | TGGATCGACCCTAATAGTGGTGGCACAAACTATGCACAGAAGTTTCAGGGC | | GATCAAGGGTATAACTGGAACTCTTTTGACTAC |
| | | | SEQ ID NO:6995 | | SEQ ID NO:15007 | | SEQ ID NO:23019 |
| iPS:436316 | 21-225_206A5 | AA | GYYIH | | WIDPNSGGTNYAQKFQG | | DQGYNWNSFDY |
| | | | SEQ ID NO:6996 | | SEQ ID NO:15008 | | SEQ ID NO:23020 |
| | | NA | GGCTACTATATCCAC | | TGGATCAACCTAATAGTGGTGGCACAAACTATGCACAGAAGTTTCAGGGC | | GGATACAGCTATGGTTACAACTGGTTCGACCCC |
| | | | SEQ ID NO:6997 | | SEQ ID NO:15009 | | SEQ ID NO:23021 |
| iPS:436324 | 21-225_207G6 | AA | GYYIH | | WINPNSGGTNYAQKFQG | | GYSYGYNWFDP |
| | | | SEQ ID NO:6998 | | SEQ ID NO:15010 | | SEQ ID NO:23022 |
| | | NA | AGCTATGGCATGCAC | | GTTATATGGTATGATGGAAGTAATAAAAACTATGCAGAGTCCGTGAAGGGC | | GATGCGGGTATTGGATACTACGGTATAGACGTC |
| | | | SEQ ID NO:6999 | | SEQ ID NO:15011 | | SEQ ID NO:23023 |
| | | AA | SYGMH | | VIWYDGSNKNYAESVKG | | DAGIGYYGIDV |
| | | | SEQ ID NO:7000 | | SEQ ID NO:15012 | | SEQ ID NO:23024 |
| iPS:436328 | 21-225_207F12 | NA | AACTATGGCATGCAC | | GTTATATGGTATGATAGAAATAATAAATACTATGGTGACTCCGTGAAGGGC | | GAACTGGGGTTCCTCTTTGACTAC |
| | | | SEQ ID NO:7001 | | SEQ ID NO:15013 | | SEQ ID NO:23025 |
| | | AA | NYGMH | | VIWYDRNNKYYGDSVKG | | ELGFLFDY |
| | | | SEQ ID NO:7002 | | SEQ ID NO:15014 | | SEQ ID NO:23026 |

FIGURE 49
(Continued)

| | | | | | |
|---|---|---|---|---|---|
| iPS:436332 | 21-225_208B2 | NA | GACTGTGTCATGCAC | GTTATATGGTATGATGGAAGTAATAAATACTATGTAGACTCCGTGAAGGGC | GAACGGTATAGCAGTGGCTTGTACGACTACGGTTGGACGTC |
| | | | SEQ ID NO:7003 | SEQ ID NO:15015 | SEQ ID NO:23027 |
| | | AA | DCVMH | VIWYDGSNKYYVDSVKG | ERYSSGLYDYGLDV |
| | | | SEQ ID NO:7004 | SEQ ID NO:15016 | SEQ ID NO:23028 |
| iPS:436334 | 21-225_208G3 | NA | AGCTATGCCATGAGC | ACTATTAGTGGTAGTGGTGTTAGAACATACTACGCAGACTCCGTGAAGGGC | GGGGGAGCTAGGAGCAGTGGCTGGTTCCACTTTGACTAC |
| | | | SEQ ID NO:7005 | SEQ ID NO:15017 | SEQ ID NO:23029 |
| | | AA | SYAMS | TISGSGVRTYYADSVKG | GGARSSGWFHFDY |
| | | | SEQ ID NO:7006 | SEQ ID NO:15018 | SEQ ID NO:23030 |
| iPS:436336 | 21-225_208B5 | NA | GTTTACTACTGGACC | GAAATCAATCATATGGAAGCACCAACTACAACCCGTCCCTCAAGAGT | GACTATGGTGTCTTTGATTAC |
| | | | SEQ ID NO:7007 | SEQ ID NO:15019 | SEQ ID NO:23031 |
| | | AA | VYYWT | EINHSGSTNYNPSLKS | DYGVFDY |
| | | | SEQ ID NO:7008 | SEQ ID NO:15020 | SEQ ID NO:23032 |
| iPS:436338 | 21-225_208E8 | NA | GGCTACTATATCCAC | TGGATCAACCCTAATAGTGGTGGCACAAACTATGCACAGAAGTTTCAGGGC | GGATACAGCTATGGTTACAACTGGTTCGACCCC |
| | | | SEQ ID NO:7009 | SEQ ID NO:15021 | SEQ ID NO:23033 |
| | | AA | GYYIH | WINPNSGGTNYAQKFQG | GYSYGYNWFDP |
| | | | SEQ ID NO:7010 | SEQ ID NO:15022 | SEQ ID NO:23034 |
| iPS:436340 | 21-225_208A9 | NA | GTTTCCTACTGGAGC | GAAATCAATCATATGGACGGCCAACTACAACCCGTCCCTCAAGAGT | GACTACGGTGTCCTGACTAC |
| | | | SEQ ID NO:7011 | SEQ ID NO:15023 | SEQ ID NO:23035 |

FIGURE 49
(Continued)

| | | | | | | |
|---|---|---|---|---|---|---|
| iPS:436344 | 21-225_208B11 | AA | VSYWS<br>SEQ ID NO:7012 | EINHSGRANYNPSLKS<br>SEQ ID NO:15024 | DYGVLDY<br>SEQ ID NO:23036 | |
| | | NA | GGCTACTACTATATCCAC<br>SEQ ID NO:7013 | TGGATCAACCCTAATAG<br>TGGTGGCACAAACTATG<br>CACAGAAGTTCAGGGC<br>SEQ ID NO:15025 | GGATACAGCTATGGTTACAA<br>CTGGTTCGACCCC<br>SEQ ID NO:23037 | |
| iPS:436350 | 21-225_210E4 | AA | GYYIH<br>SEQ ID NO:7014 | WINPNSGGTNYAQKFQG<br>SEQ ID NO:15026 | GYSYGYNWFDP<br>SEQ ID NO:23038 | |
| | | NA | AACTATGGCATGCAC<br>SEQ ID NO:7015 | GTTATATGGTATGATGA<br>AATAATAATACTATG<br>TAGACTCCGTGAAGGGC<br>SEQ ID NO:15027 | GAGACGGGGTTCTGAGCGA<br>CTAC<br>SEQ ID NO:23039 | |
| iPS:436352 | 21-225_210G5 | AA | NYGMH<br>SEQ ID NO:7016 | VIWYDENNKYYVDSVKG<br>SEQ ID NO:15028 | ETGFLSDY<br>SEQ ID NO:23040 | |
| | | NA | GACTGTGTCATGCAC<br>SEQ ID NO:7017 | GTTATATGGTATGATGG<br>AAGTAATAAATACTATG<br>TAGACTCCGTGAAGGGC<br>SEQ ID NO:15029 | GAACGGTATAGCAGTGGCTT<br>GTACGACTACGGGTTGGACG<br>TC<br>SEQ ID NO:23041 | |
| iPS:436354 | 21-225_210G10 | AA | DCVMH<br>SEQ ID NO:7018 | VIWYDGSNKYYVDSVKG<br>SEQ ID NO:15030 | ERYSSGLYDYGLDV<br>SEQ ID NO:23042 | |
| | | NA | AGTTACTACTGGAGC<br>SEQ ID NO:7019 | CGTATCTATACCAGTGG<br>GAGCACGACTACAACC<br>CCTCCCTCAAGAGT<br>SEQ ID NO:15031 | GGGTTCGGTGACTGGGACTA<br>C<br>SEQ ID NO:23043 | |
| | | AA | SYYWS<br>SEQ ID NO:7020 | RIYTSGSTDYNPSLKS<br>SEQ ID NO:15032 | GFGDWDY<br>SEQ ID NO:23044 | |

FIGURE 49
(Continued)

| | | | | | |
|---|---|---|---|---|---|
| iPS:436356 | 21-225_210H10 | NA | AGCAACAGTGCTGCTTGGAAC<br>SEQ ID NO:7021<br>SNSAAWN | AGGACATACTACAGGTCCAAGTGGTATAATTATTATCCAGTATCTGTGAGAAGT<br>SEQ ID NO:15033<br>RTYYRSKWYNYYPVSVRS | GATCAACGGTACTACGGTATGGACGTC<br>SEQ ID NO:23045<br>DQRYYGMDV |
| | | AA | SEQ ID NO:7022 | SEQ ID NO:15034 | SEQ ID NO:23046 |
| iPS:436358 | 21-225_210D11 | NA | GGCTACTATATCCAC<br>SEQ ID NO:7023<br>GYYIH | TGGATCAACCCTAATAGTGGTGGCACAAACTATGCACAGAAGTTTCAGGGC<br>SEQ ID NO:15035<br>WINPNSGGTNYAQKFQG | GGATACAGCTATGGTTACAACTGGTTCGACCCC<br>SEQ ID NO:23047<br>GYSYGYNWFDP |
| | | AA | SEQ ID NO:7024 | SEQ ID NO:15036 | SEQ ID NO:23048 |
| iPS:436360 | 21-225_210H11 | NA | AGCCATGGCATGCAC<br>SEQ ID NO:7025<br>SHGMH | GTTACATGGTATGATGGAAGTGATAAATACTATGCAGACTCCGTGAAGGGC<br>SEQ ID NO:15037<br>VTWYDGSDKYYADSVKG | GACCGGCTAGTGGGAGCTACTACCGATGCTTTGATATC<br>SEQ ID NO:23049<br>DRLVGATTDAFDI |
| | | AA | SEQ ID NO:7026 | SEQ ID NO:15038 | SEQ ID NO:23050 |
| iPS:436362 | 21-225_210C12 | NA | AACAATGGTATCAGC<br>SEQ ID NO:7027<br>NNGIS | TGGATCAACGCTTACAATGGTCACAAACTATGCACAGAAGTTCCAGGGC<br>SEQ ID NO:15039<br>WINAYNGHTNYAQKFQG | GATCCTACGGTGACCACTACTATTACTACGGTATGGACG<br>SEQ ID NO:23051<br>DPTVTHYYYYGMDV |
| | | AA | SEQ ID NO:7028 | SEQ ID NO:15040 | SEQ ID NO:23052 |

FIGURE 49
(Continued)

| | | | | | |
|---|---|---|---|---|---|
| iPS:436364 | 21-225_211A11 | NA | AGCTATGGCATGCAC | GTTCTTTGGTTTGATGGAAGTAATAGAAACTATGCAGACTCCGTGAAGGGC | GATCGGGGAGTGGGCTACTACGGTACGGACGTC |
| | | AA | SEQ ID NO:7029<br>SYGMH | SEQ ID NO:15041<br>VLWFDGSNRNYADSVKG | SEQ ID NO:23053<br>DRGVGYYGTDV |
| iPS:436366 | 21-225_211A3 | NA | AGTTATGGCATGCAC | GTTATATGGTATGATGGAAGTAATAAAAACTATGAAGACTCCGTGAAGGGC | GATGGGAGTTATGGTTACGACGGTATGGACGTC |
| | | AA | SEQ ID NO:7031<br>SYGMH | SEQ ID NO:15043<br>VIWYDGSNKNYEDSVKG | SEQ ID NO:23055<br>DGSYGYDGMDV |
| iPS:436368 | 21-225_211G3 | NA | AACTATGGCATGCAC | GTTATATGGCATGATGGAAGTAATAAATACTATGCAGACTCCGTGAAGGGC | TTAGACTACAGTAACTACGGGTGGTTCGACCCC |
| | | AA | SEQ ID NO:7033<br>NYGMH | SEQ ID NO:15045<br>VIWHDGSNKYYADSVKG | SEQ ID NO:23057<br>LDYSNYGWFDP |
| iPS:436370 | 21-225_211A6 | NA | AGCTATGGCATGCAC | GTTATATGGTATGATGGAAGTAATAAAAACTATGCAGACTCCGTGAAGGGC | GATAGGACGGTGGCTATGATGGTTTTGATATC |
| | | AA | SEQ ID NO:7035<br>SYGMH | SEQ ID NO:15047<br>VIWYDGSNKNYADSVKG | SEQ ID NO:23059<br>DRTVGYDGFDI |

FIGURE 49
(Continued)

| | | | | | | |
|---|---|---|---|---|---|---|
| iPS:436372 | 21-225_211A8 | NA | SEQ ID NO:7036<br>AGCTATGGCATGCAC | SEQ ID NO:15048<br>GTTATATGGTATGATGG<br>AAGTAATGAACACTATG<br>CAGACTCCGTGAAGGC | SEQ ID NO:23060<br>GACCACGGTGTCGGGTACTA<br>CGGTATGGACGTC | |
| | | AA | SEQ ID NO:7037<br>SYGMH | SEQ ID NO:15049<br>VIWYDGSNEHYADSVKG | SEQ ID NO:23061<br>DHGVGYYGMDV | |
| iPS:436374 | 21-225_211C10 | NA | SEQ ID NO:7038<br>AGGCATGGTATCAGC | SEQ ID NO:15050<br>TGGATCAGCGCTTACAA<br>TGGTCTCACAAACTATGC<br>ACAGAAGTTCCAGGGC | SEQ ID NO:23062<br>GATCCTACGGTGACCCACTA<br>CTACTACTACGGTATGGACG<br>TC | |
| | | AA | SEQ ID NO:7039<br>RHGIS | SEQ ID NO:15051<br>WISAYNGLTNYAQKFQG | SEQ ID NO:23063<br>DPTVTHYYYYGMDV | |
| iPS:436376 | 21-225_212F6 | NA | SEQ ID NO:7040<br>AGCTATGGCATGCAC | SEQ ID NO:15052<br>GTTATATGGTATGATGG<br>AAGTAATAAAAACTATG<br>TAGACTCCGTGAAGGGC | SEQ ID NO:23064<br>GACTACGGTGTCGGGTACTA<br>CGGTACGGACGTC | |
| | | AA | SEQ ID NO:7041<br>SYGMH | SEQ ID NO:15053<br>VIWYDGSNKNYVDSVKG | SEQ ID NO:23065<br>DYGVGYYGTDV | |
| iPS:436378 | 21-225_212D7 | NA | SEQ ID NO:7042<br>AGCTATGGCATGCAC | SEQ ID NO:15054<br>GTTATATGGTATGATGG<br>AAGTAATAAAATTATG<br>CAGACTCCGTGAAGGGC | SEQ ID NO:23066<br>GACTACGGTGTCGGGTACTA<br>CGGTACGGACGTC | |
| | | AA | SEQ ID NO:7043<br>SYGMH | SEQ ID NO:15055<br>VIWYDGSNKNYADSVKG | SEQ ID NO:23067<br>DYGVGYYGTDV | |

FIGURE 49
(Continued)

| | | | SEQ ID NO:7044 AGCTATGGCATGCAC | SEQ ID NO:15056 GTTATATGGTATGATGG AAGTAATGAACACTATG CGGTATGGACGTC | SEQ ID NO:23068 GACCACGGTGTCGGTACTA CGGTATGGACGTC |
|---|---|---|---|---|---|
| iPS:436380 | 21-225_212H9 | NA | | | |
| | | AA | SEQ ID NO:7045 SYGMH | SEQ ID NO:15057 VIWYDGSNEHYADSVKG | SEQ ID NO:23069 DHGVGYYGMDV |
| iPS:436382 | 21-225_212C10 | NA | SEQ ID NO:7046 AGCTATGGCATGCAC | SEQ ID NO:15058 GCTATATGGTATGATGG AAGTCATAAATACTATA CAGATTCCGTGAAGGGC | SEQ ID NO:23070 GATCGGAGTATAGTGGGAGC TACCTACTTTGACTAC |
| | | AA | SEQ ID NO:7047 SYGMH | SEQ ID NO:15059 AIWYDGSHKYYTDSVKG | SEQ ID NO:23071 DRSIVGATYFDY |
| iPS:436384 | 21-225_212F10 | NA | SEQ ID NO:7048 AGATATGGCATGCAC | SEQ ID NO:15060 GTTATATGGTATGATGG AAGTAATAAACACTATG CAGACTCCGTGAAGGGC | SEQ ID NO:23072 GATCGGGGAGTGGCTACAA CGGTATGGACGTC |
| | | AA | SEQ ID NO:7049 RYGMH | SEQ ID NO:15061 VIWYDGSNKHYADSVKG | SEQ ID NO:23073 DRGVGYNGMDV |
| iPS:436386 | 21-225_212B11 | NA | SEQ ID NO:7050 GACTATGTCATGCAC | SEQ ID NO:15062 GTTATATGGTATGATGG AAGTAATAAATATTATG CAGACTCCGTGAAGGGC | SEQ ID NO:23074 GAACGTTATAGCAGTGGCTG GTACGACTACGGTATGGACG TC |
| | | | SEQ ID NO:7051 | SEQ ID NO:15063 | SEQ ID NO:23075 |

FIGURE 49
(Continued)

| | | | | | | | |
|---|---|---|---|---|---|---|---|
| iPS:436388 | 21-225_212H11 | AA | DYVMH | | VIWYDGSNKYYADSVKG | | ERYSSGWYDYGMDV |
| | | NA | SEQ ID NO:7052 AGTTATGGCATGCAC | | SEQ ID NO:15064 GTTATATGGTATGATGG AAGTAATAAAAACTATG AAGACTCCGTGAAGGGC | | SEQ ID NO:23076 GATGGGAGTTATGGTTACGA CGGTTATGGGACGTC |
| | | AA | SEQ ID NO:7053 SYGMH | | SEQ ID NO:15065 VIWYDGSNKNYEDSVKG | | SEQ ID NO:23077 DGSYGYDGMDV |
| iPS:436390 | 21-225_213D2 | NA | SEQ ID NO:7054 AGCTATGGCATGCAC | | SEQ ID NO:15066 GTTATATGGTATGATGG AAGTAATAAAAATTATG CAGACTCCGTGAAGGGC | | SEQ ID NO:23078 GACTACGGTGTCGGGTACTA CGGTACGGACGTC |
| | | AA | SEQ ID NO:7055 SYGMH | | SEQ ID NO:15067 VIWYDGSNKNYADSVKG | | SEQ ID NO:23079 DYGVGYYYGIDV |
| iPS:436392 | 21-225_213B3 | NA | SEQ ID NO:7056 AGCTATGGCATGCAC | | SEQ ID NO:15068 GTTATATGGTATGATGG AAGTAATAAAAACTATG CAGACTCCGTGAAGGGC | | SEQ ID NO:23080 GATAGGACGGTGGGCTATGA TGGTTTTGATATC |
| | | AA | SEQ ID NO:7057 SYGMH | | SEQ ID NO:15069 VIWYDGSNKNYADSVKG | | SEQ ID NO:23081 DRTVGYDGFDI |
| | | | SEQ ID NO:7058 | | SEQ ID NO:15070 | | SEQ ID NO:23082 |

FIGURE 49
(Continued)

| | | | | |
|---|---|---|---|---|
| iPS:436394 | 21-225_213C4 | NA | AGCTATGGCATGCAC<br>SEQ ID NO:7059 | GTTATATGGTATGATGG<br>AAGTAATAAACACTATG<br>CAGACTCCGTGAAGGGC<br>SEQ ID NO:15071 | GACTACGGTGTCGGGTACGA<br>CGGTATGGACGTC<br>SEQ ID NO:23083 |
| | | AA | SYGMH<br>SEQ ID NO:7060 | VIWYDGSNKHYADSVKG<br>SEQ ID NO:15072 | DYGVGYDGMDV<br>SEQ ID NO:23084 |
| iPS:436396 | 21-225_213E5 | NA | AGTTATGGCATGCAC<br>SEQ ID NO:7061 | GTTATATGGTATGATGG<br>AAGTAATAAAAACTATG<br>AAGACTCCGTGAAGGGC<br>SEQ ID NO:15073 | GATGGGAGTTATGGTTACGA<br>CGGTATGGACGTC<br>SEQ ID NO:23085 |
| | | AA | SYGMH<br>SEQ ID NO:7062 | VIWYDGSNKNYEDSVKG<br>SEQ ID NO:15074 | DGSYGYDGMDV<br>SEQ ID NO:23086 |
| iPS:436398 | 21-225_213B8 | NA | AGCTATGGCATGCAC<br>SEQ ID NO:7063 | GTTATATGGTATGATGG<br>AAGTAATAAACACTATG<br>CAGACTCCGTGAAGGGC<br>SEQ ID NO:15075 | GACTACGGTGTCGGGTACTA<br>CGGTACGGACGTC<br>SEQ ID NO:23087 |
| | | AA | SYGMH<br>SEQ ID NO:7064 | VIWYDGSNKHYADSVKG<br>SEQ ID NO:15076 | DYGVGYYGTDV<br>SEQ ID NO:23088 |
| iPS:436400 | 21-225_213H7 | NA | GGCTACCATATGCAC<br>SEQ ID NO:7065 | TGGATCAATCCTAAGAG<br>TGATGGCACAAACTATG<br>CACAGAAGTTTCAGGGC<br>SEQ ID NO:15077 | GAAAAGCCTGGGAGCTACTA<br>CAAATAC<br>SEQ ID NO:23089 |
| | | AA | GYHMH<br>SEQ ID NO:7066 | WINPKSDGTNYAQKFQG<br>SEQ ID NO:15078 | EKPGSYYKY<br>SEQ ID NO:23090 |

FIGURE 49
(Continued)

| | | | | | |
|---|---|---|---|---|---|
| iPS:436402 | 21-225_213H12 | NA | AGCTATGGTATCAAC | TGGATCAGCGGTTCACAA TGGTAACACAGACTATG CACAGAAGTTCCAGGGC | GACTACTACTACGGTATGGA CGTC |
| | | | SEQ ID NO:7067 | SEQ ID NO:15079 | SEQ ID NO:23091 |
| | | AA | SYGIN | WISVHNGNTDYAQKFQG | DYYYGMDV |
| | | | SEQ ID NO:7068 | SEQ ID NO:15080 | SEQ ID NO:23092 |
| iPS:436404 | 21-225_214C3 | NA | AGCTATGGCATGCAC | GTTATATGGTATGATGG AAGTAATAAAACTATG GAGACTCCGTGAAGGGC | GATCGGGGAGTGGGCTACGA CGGAATGGACGTC |
| | | | SEQ ID NO:7069 | SEQ ID NO:15081 | SEQ ID NO:23093 |
| | | AA | SYGMH | VIWYDGSNKNYGDSVKG | DRGVGYDGMDV |
| | | | SEQ ID NO:7070 | SEQ ID NO:15082 | SEQ ID NO:23094 |
| iPS:436406 | 21-225_214E4 | NA | AGCTATGGCATGCAC | GTTATATGGTATGATGG AAGTAATGAAAACTATG CAGACTCCGTGAAGGGC | GATAGGACGGTGGGCTATGA TGGTTGTGATATC |
| | | | SEQ ID NO:7071 | SEQ ID NO:15083 | SEQ ID NO:23095 |
| | | AA | SYGMH | VIWYDGSNENYADSVKG | DRTVGYDGCDI |
| | | | SEQ ID NO:7072 | SEQ ID NO:15084 | SEQ ID NO:23096 |
| iPS:436408 | 21-225_214H8 | NA | GGCCACTATATACAC | TGGATCAACTCTAACAG TGGTGGCACAAACTATG CACAGAAGTTTCAGGGC | GACGGGAGATACAGCTATGG TTACGACTGGTTCGACCCC |
| | | | SEQ ID NO:7073 | SEQ ID NO:15085 | SEQ ID NO:23097 |
| | | AA | GHYIH | WINSNSGGTNYAQKFQG | DGRYSYGYDWFDP |
| | | | SEQ ID NO:7074 | SEQ ID NO:15086 | SEQ ID NO:23098 |

FIGURE 49
(Continued)

| | | | | | |
|---|---|---|---|---|---|
| iPS:436410 | 21-225_212E10 | NA | AGCTATGGCATGCAC SEQ ID NO:7075 | GTTATATGGTATGATGG AAGTAATAAATACTATG CAGACTCCGTGAAGGGC SEQ ID NO:15087 | GACTACGGTGTGTCGGGTACTA CGGTACGGACGTC SEQ ID NO:23099 |
| | | AA | SYGMH SEQ ID NO:7076 | VIWYDGSNKYYADSVKG SEQ ID NO:15088 | DYGVGYYGTDV SEQ ID NO:23100 |
| iPS:436412 | 21-225_214H9 | NA | AGCTATGTCATGCAC SEQ ID NO:7077 | GTTATATGGTATGATGG AAGTAATAAATACTATG CAGACTCCGTGAAGGGC SEQ ID NO:15089 | GAGAGGTATACCAGCAGCTG GTACGACTACGGTATGGACG TC SEQ ID NO:23101 |
| | | AA | SYVMH SEQ ID NO:7078 | VIWYDGSNKYYADSVKG SEQ ID NO:15090 | ERYTSSWYDYGMDV SEQ ID NO:23102 |
| iPS:436414 | 21-225_214G10 | NA | GACTATGTCATGCAC SEQ ID NO:7079 | GTTATATGGTATGATGG AAGTAATAAATATTATG CAGACTCCGTGAAGGGC SEQ ID NO:15091 | GAACGTTATAGCAGTAGCAGGCTG GTACGACTACGGTATGGACG TC SEQ ID NO:23103 |
| | | AA | DYVMH SEQ ID NO:7080 | VIWYDGSNKYYADSVKG SEQ ID NO:15092 | ERYSSGWYDYGMDV SEQ ID NO:23104 |
| iPS:436416 | 21-225_214G12 | NA | GACTATGTCATGCAC SEQ ID NO:7081 | GTTATATGGTATGATGG AAGTAATAAATATTATG CAGACTCCGTGAAGGGC SEQ ID NO:15093 | GAACGTTATAGCAGTAGCAGGCTG GTACGACTACGGTATGGACG TC SEQ ID NO:23105 |
| | | AA | DYVMH SEQ ID NO:7082 | VIWYDGSNKYYADSVKG SEQ ID NO:15094 | ERYSSGWYDYGMDV SEQ ID NO:23106 |

FIGURE 49
(Continued)

| | | | | | |
|---|---|---|---|---|---|
| iPS:436418 | 21-225_215E3 | NA | GACTATGTCATACAC | GTTATATGGTATGATGG AAGTAATAAATATTATG CAGACTCCGTGAAGGGC | GAACGTTATAGCAGTGGCTG GTACGACTACGGTATGGACG TC |
| | | | SEQ ID NO:7083 | SEQ ID NO:15095 | SEQ ID NO:23107 |
| | | AA | DYVIH | VIWYDGSNKYYADSVKG | ERYSSGWYDYGMDV |
| | | | SEQ ID NO:7084 | SEQ ID NO:15096 | SEQ ID NO:23108 |
| iPS:436420 | 21-225_215B5 | NA | AGCTATGGCATGCAC | GTTATATGGTATGATGG AAGTAATAAAATTATG CAGACTCCGTGAAGGGC | GACTACGGTGTCGGGTACTA CGGTACGGACGTC |
| | | | SEQ ID NO:7085 | SEQ ID NO:15097 | SEQ ID NO:23109 |
| | | AA | SYGMH | VIWYDGSNKNYADSVKG | DYGVGYYGTDV |
| | | | SEQ ID NO:7086 | SEQ ID NO:15098 | SEQ ID NO:23110 |
| iPS:436422 | 21-225_215D6 | NA | AGCTATGGCATGCAC | GTTATATGGTATGATGG AAGTAATAAAAACTATG CAGATTCCGTGAAGGGC | GACTGCGGTGTCGGATACTA CGGTACGGACGTC |
| | | | SEQ ID NO:7087 | SEQ ID NO:15099 | SEQ ID NO:23111 |
| | | AA | SYGMH | VIWYDGSNKNYADSVKG | DCGVGYYGTDV |
| | | | SEQ ID NO:7088 | SEQ ID NO:15100 | SEQ ID NO:23112 |
| iPS:436424 | 21-225_215H6 | NA | GGCCACTATATACAC | TGGATCAACTCTAACAG TGGTGGCACAAATTATG CAGAGAAGTTTCAGGGC | GACGGGAGATACAGCTATGG TCACGACTGGTTCGACCCC |
| | | | SEQ ID NO:7089 | SEQ ID NO:15101 | SEQ ID NO:23113 |
| | | AA | GHYIH | WINSNSGGTNYAEKFQG | DGRYSYGHDWFDP |
| | | | SEQ ID NO:7090 | SEQ ID NO:15102 | SEQ ID NO:23114 |

FIGURE 49
(Continued)

| | | | | | | |
|---|---|---|---|---|---|---|
| iPS:436426 | 21-225_215C7 | NA | TACTATGGCATGCAC | GTTATATGGCATGATGG AAGTAATAAATACTATG CAGACTCCGTGAAGGGC | TTAGACTACAGTAATTACGG GTGGTTCGACCCC |
| | | AA | SEQ ID NO:7091 YYGMH | SEQ ID NO:15103 VIWHDGSNKYYADSVKG | SEQ ID NO:23115 LDYSNYGWFDP |
| iPS:436428 | 21-225_215E11 | NA | SEQ ID NO:7092 GACTATGTCATGCAC | SEQ ID NO:15104 GTTATATGGTATGATGG AAGTAATAAATATTATG CAGACTCCGTGAAGGGC | SEQ ID NO:23116 GAACGTTATAGCAGTGGCTG GTACGACTACGGTATGGACG TC |
| | | AA | SEQ ID NO:7093 DYVMH | SEQ ID NO:15105 VIWYDGSNKYYADSVKG | SEQ ID NO:23117 ERYSSGWYDYGMDV |
| iPS:436430 | 21-225_215A12 | NA | SEQ ID NO:7094 AGCTATGGCATGCAC | SEQ ID NO:15106 GTTATATGGTATGATGG AAGTAATGAACACTATG CCGTATGGACGTC | SEQ ID NO:23118 GATCGGGGAGTGGGCTACTA CGGTATGGACGTC |
| | | AA | SEQ ID NO:7095 SYGMH | SEQ ID NO:15107 VIWYDGSNEHYADSVKG | SEQ ID NO:23119 DRGVGYYGMDV |
| iPS:436432 | 21-225_215H12 | NA | SEQ ID NO:7096 AACTATGGCATGCAC | SEQ ID NO:15108 GTTATATGGCATGATGG AAGTAATAAATACTATG CAGACTCCGTGAAGGGC | SEQ ID NO:23120 TTAGACTACAGTAACTACGG GTGGTTCGACCCC |
| | | AA | SEQ ID NO:7097 NYGMH | SEQ ID NO:15109 VIWHDGSNKYYADSVKG | SEQ ID NO:23121 LDYSNYGWFDP |

FIGURE 49
(Continued)

| | | | | | |
|---|---|---|---|---|---|
| iPS:436434 | 21-225_216B10 | NA | SEQ ID NO:7098 AGCTATGGCATGCAC | SEQ ID NO:15110 GCTATATGGTATGATGG AAGTAATAAATACTATG CAGACTCCGTGAAGGGC | SEQ ID NO:23122 GATCCAACATAGTGGAGC TACTTGGTTTGACTAC |
| | | AA | SEQ ID NO:7099 SYGMH | SEQ ID NO:15111 AIWYDGSNKYYADSVKG | SEQ ID NO:23123 DPNIVGATWFDY |
| iPS:436436 | 21-225_216F10 | NA | SEQ ID NO:7100 AGCTATAGCATGAAC | SEQ ID NO:15112 TACATTACTGGTAGTAGT AGTACCATATACTACG AGACTCTGTGAAGGGC | SEQ ID NO:23124 TCGGGTTTAGCAGTGGAGGA CTAC |
| | | AA | SEQ ID NO:7101 SYSMN | SEQ ID NO:15113 YITGSSSTIYYADSVKG | SEQ ID NO:23125 SGLAVEDY |
| iPS:436438 | 21-225_216E8 | NA | SEQ ID NO:7102 GACTATGTCATGCAC | SEQ ID NO:15114 GTTATATGGTATGATGG AAGTAATAAATATTATG CAGACTCCGTGAAGGGC | SEQ ID NO:23126 GAACGTTATAGCAGTGGCTG GTACGACTACGGTATGGACG TC |
| | | AA | SEQ ID NO:7103 DYVMH | SEQ ID NO:15115 VIWYDGSNKYYADSVKG | SEQ ID NO:23127 ERYSSGWYDYGMDV |
| iPS:436440 | 21-225_216H12 | NA | SEQ ID NO:7104 GACTATGTCATGCAC | SEQ ID NO:15116 GTTATATGGTATGATGG AAGTAATAAATATTATG CAGACTCCGTGAAGGGC | SEQ ID NO:23128 GAACGTTATAGCAGTGGCTG GTACGACTACGGTATGGACG TC |
| | | AA | SEQ ID NO:7105 DYVMH | SEQ ID NO:15117 VIWYDGSNKYYADSVKG | SEQ ID NO:23129 ERYSSGWYDYGMDV |
| | | | SEQ ID NO:7106 | SEQ ID NO:15118 | SEQ ID NO:23130 |

FIGURE 49
(Continued)

| | | NA | AGCTATAATATGAAC | TACATTAGTAGTAGTCGT AATATCATATATTACGCA GACTCTGTGAAGGGC | GATGGCTCTTATAGCAGTGG CTGGTACTGGGGTTTTGACT AC |
|---|---|---|---|---|---|
| iPS:436448 | 21-225_217A3 | | SEQ ID NO:7107 | SEQ ID NO:15119 | SEQ ID NO:23131 |
| | | AA | SYNMN | YISSSRNIIYYADSVKG | DGSYSSGWYWGFDY |
| | | | SEQ ID NO:7108 | SEQ ID NO:15120 | SEQ ID NO:23132 |
| iPS:436450 | 21-225_217E5 | NA | GACTATGTCATGCAC | GTTATATGGTATGATGG AAGTAATAAATATTATG CAGACTCCGTGAAGGGC | GAACGTTATAGCAGTGGCTG GTACGACTACGGTATGGACG TC |
| | | | SEQ ID NO:7109 | SEQ ID NO:15121 | SEQ ID NO:23133 |
| | | AA | DYVMH | VIWYDGSNKYYADSVKG | ERYSSGWYDYGMDV |
| | | | SEQ ID NO:7110 | SEQ ID NO:15122 | SEQ ID NO:23134 |
| iPS:436452 | 21-225_217G5 | NA | AGCAATGGCATGCAC | GTTATATGGTATGAIGG AAGTAATAAAACTATG CAGACTCCGTGAAGGGC | GACTACGGTGTCGGGTACTA CGGTCTGGACGTC |
| | | | SEQ ID NO:7111 | SEQ ID NO:15123 | SEQ ID NO:23135 |
| | | AA | SNGMH | VIWYDGSNKNYADSVKG | DYGVGYYGLDV |
| | | | SEQ ID NO:7112 | SEQ ID NO:15124 | SEQ ID NO:23136 |
| iPS:436454 | 21-225_217B10 | NA | AGTTATATGGCATGCAC | GTTATATGGTATGATGG AAGTAATAAAACTATG AAGACTCCGTGAAGGGC | GATGGGAGTTATGGTTACGA CGGTATGGACGTC |
| | | | SEQ ID NO:7113 | SEQ ID NO:15125 | SEQ ID NO:23137 |
| | | AA | SYGMH | VIWYDGSNKNYEDSVKG | DGSYGYDGMDV |
| | | | SEQ ID NO:7114 | SEQ ID NO:15126 | SEQ ID NO:23138 |

FIGURE 49
(Continued)

| iPS: | Sample | | | | | |
|---|---|---|---|---|---|---|
| iPS:436456 | 21-225_217G10 | NA | GACTATGTCATGCAC SEQ ID NO:7115 | GTTATATGGTATGATGG AAGTAATAAATATTATG CAGACTCCGTGAAGGGC SEQ ID NO:15127 | GAACGTTATAGCAGTGGCTG GTACGACTACGGTATGGACG TC SEQ ID NO:23139 |
| | | AA | DYVMH SEQ ID NO:7116 | VIWYDGSNKYYADSVKG SEQ ID NO:15128 | ERYSSGWYDYGMDV SEQ ID NO:23140 |
| iPS:436458 | 21-225_217H12 | NA | GACTATGTCATGCAC SEQ ID NO:7117 | GTTATATGGTATGATGG AAGTAATAAATATTATG CAGACTCCGTGAAGGGC SEQ ID NO:15129 | GAACGTTATAGCAGTGGCTG GTACGACTACGGTATGGACG TC SEQ ID NO:23141 |
| | | AA | DYVMH SEQ ID NO:7118 | VIWYDGSNKYYADSVKG SEQ ID NO:15130 | ERYSSGWYDYGMDV SEQ ID NO:23142 |
| iPS:436462 | 21-225_218C4 | NA | GACTATGTCATGCAC SEQ ID NO:7119 | GTTATATGGTATGATGG AAGTAATAAATATTATG CAGACTCCGTGAAGGGC SEQ ID NO:15131 | GAACGTTATAGCAGTGGCTG GTACGACTACGGTATGGACG TC SEQ ID NO:23143 |
| | | AA | DYVMH SEQ ID NO:7120 | VIWYDGSNKYYADSVKG SEQ ID NO:15132 | ERYSSGWYDYGMDV SEQ ID NO:23144 |
| iPS:436464 | 21-225_219H1 | NA | AGATATGGCATGCAC SEQ ID NO:7121 | GTTATATGGTATGATGG AAGTAATAAACACTATG CAGACTCCGTGAAGGGC SEQ ID NO:15133 | GATCGGGGAGTGGCTACAA CGGTATGGACGTC SEQ ID NO:23145 |
| | | AA | RYGMH SEQ ID NO:7122 | VIWYDGSNKHYADSVKG SEQ ID NO:15134 | DRGVGYNGMDV SEQ ID NO:23146 |

FIGURE 49 (Continued)

| | | | | |
|---|---|---|---|---|
| iPS:436472 | 21-225_220E1 | NA | ACTTACTACTGGAGC | TATATCTATTACAGTGGG ACCACCAACTACAACCC CTCCCTCAAGAGT | GACCAGCAGTGGCTGGTACG TGGGAGGGACAACTACTACT ACGGTATGGACGTC |
| | | | SEQ ID NO:7123 | SEQ ID NO:15135 | SEQ ID NO:23147 |
| | | AA | TYYWS | YIYYSGTTNYNPSLKS | DQQWLVRGRDNYYYGMDV |
| | | | SEQ ID NO:7124 | SEQ ID NO:15136 | SEQ ID NO:23148 |
| iPS:436480 | 21-225_220F8 | NA | GACTATGTCATGCAC | GTTATATGGTATGATGG AAGTAATAAATATTATG CAGACTCCGTGAAGGGC | GAACGTTATAGCAGTGGCTG GTACGACTACGGTATGGACG TC |
| | | | SEQ ID NO:7125 | SEQ ID NO:15137 | SEQ ID NO:23149 |
| | | AA | DYVMH | VIWYDGSNKYYADSVKG | ERYSSGWYDYGMDV |
| | | | SEQ ID NO:7126 | SEQ ID NO:15138 | SEQ ID NO:23150 |
| iPS:436488 | 21-225_221A6 | NA | GGCTACTATATGCAC | TGGATCCACCCTAACAG TGGTGGCACAAACTATG CACAGAAATTTCAGGGC | GATGGGACCAGCTCGTTTGA CTAC |
| | | | SEQ ID NO:7127 | SEQ ID NO:15139 | SEQ ID NO:23151 |
| | | AA | GYYMH | WIHPNSGGTNYAQKFQG | DGTSSFDY |
| | | | SEQ ID NO:7128 | SEQ ID NO:15140 | SEQ ID NO:23152 |
| iPS:436490 | 21-225_221F6 | NA | AGCAATGGCATGCAC | GTTATATGGTACGATGG AAGTAATGAAAACTATG CAGACTCCGTGAAGGGC | GATCGGACAGTGGGCTACAA CGGTATGGACGTC |
| | | | SEQ ID NO:7129 | SEQ ID NO:15141 | SEQ ID NO:23153 |
| | | AA | SNGMH | VIWYDGSNENYADSVKG | DRIVGYNGMDV |
| | | | SEQ ID NO:7130 | SEQ ID NO:15142 | SEQ ID NO:23154 |
| iPS:436496 | 21-225_222E1 | NA | GGCTACTATATGCAC | TGGATCCACCCTAACAG TGGTGGCACAAACTATG CACAGAAATTTCAGGGC | GATGGGACCAGCTCGTTTGA CTAC |

FIGURE 49
(Continued)

| | | | | | | |
|---|---|---|---|---|---|---|
| iPS:436500 | 21-225_222E1 | AA | SEQ ID NO:7131<br>GYYMH | | SEQ ID NO:15143<br>WIHPNSGGTNYAQKFQG | SEQ ID NO:23155<br>DGTSSFDY |
| | | NA | SEQ ID NO:7132<br>AGCTATGGTATCAAC | | SEQ ID NO:15144<br>TGGATCAGCGTTTACAAT<br>GGTAACACAAACTATGC<br>ACAGAAGCTCCAGGGC | SEQ ID NO:23156<br>GACTACTACTACGGTTTTGA<br>CGTC |
| iPS:436502 | 21-225_222H3 | AA | SEQ ID NO:7133<br>SYGIN | | SEQ ID NO:15145<br>WISVYNGNTNYAQKLQG | SEQ ID NO:23157<br>DYYYGFDV |
| | | NA | SEQ ID NO:7134<br>AGCTATGGCATGCAC | | SEQ ID NO:15146<br>GTTATATGGTATGATGG<br>AAGTAATAAAAACTATG<br>CAGACTCCGTGAAGGGC | SEQ ID NO:23158<br>GATCGGGATGTCGGGTACAA<br>CGGTATGGACGTC |
| iPS:436504 | 21-225_222A11 | AA | SEQ ID NO:7135<br>SYGMH | | SEQ ID NO:15147<br>VIWYDGSNKNYADSVKG | SEQ ID NO:23159<br>DRDVGYNGMDV |
| | | NA | SEQ ID NO:7136<br>AACTTTGCCATGAGT | | SEQ ID NO:15148<br>AGTATTGTTGGTAGTGGT<br>GGTGCACGTACTACGC<br>AGACTCCGTGAAGGGC | SEQ ID NO:23160<br>GACCCTTATCGTGTGTAGCAGT<br>GGTGGGCCTTTGACTAC |
| iPS:436506 | 21-225_222H4 | AA | SEQ ID NO:7137<br>NFAMS | | SEQ ID NO:15149<br>SIVGSGGRTYYADSVKG | SEQ ID NO:23161<br>DPYRVAVAGAFDY |
| | | NA | SEQ ID NO:7138<br>GGTCGCTACTGGAGC | | SEQ ID NO:15150<br>GAAATCAATCATATGG<br>AAGGCCAACTACAACC<br>CGTCCCTCAAGAGT | SEQ ID NO:23162<br>GACTACGGCGCCCTTGATTT<br>C |
| | 21-225_222C7 | AA | SEQ ID NO:7139<br>GRYWS | | SEQ ID NO:15151<br>EINHSGSANYNPSLKS | SEQ ID NO:23163<br>DYGALDF |

FIGURE 49
(Continued)

| | | | | | |
|---|---|---|---|---|---|
| iPS:436508 | 21-225_222F7 | NA | SEQ ID NO:7140<br>GGCTACTATATGCAC | SEQ ID NO:15152<br>TGGATCCACCCTAACAG<br>TGGTGGCACAAACTATG<br>CACAGAAATTTCAGGGC | SEQ ID NO:23164<br>GATGGGACCAGCTCGTTTGA<br>CTAC |
| | | AA | SEQ ID NO:7141<br>GYYMH | SEQ ID NO:15153<br>WIHPNSGGTNYAQKFQG | SEQ ID NO:23165<br>DGTSSFDY |
| iPS:436510 | 21-225_222H8 | NA | SEQ ID NO:7142<br>AACTTTGCCATGAGT | SEQ ID NO:15154<br>AGTATTGTTGGTAGTGGT<br>GGTCGCACGTACTACGC<br>AGACTCCGTGAAGGGC | SEQ ID NO:23166<br>GACCCTTATCGTGTAGCAGT<br>GGCTGGGGCCTTTGACTAC |
| | | AA | SEQ ID NO:7143<br>NFAMS | SEQ ID NO:15155<br>SIVGSGGRTYYADSVKG | SEQ ID NO:23167<br>DPYRVAVAGAFDY |
| iPS:436514 | 21-225_222D10 | NA | SEQ ID NO:7144<br>AGTATGGCATGCAC | SEQ ID NO:15156<br>GTTATATGGTATGATGG<br>AAGTAATAAAAACTATG<br>CAGACTCCGTGAAGGGC | SEQ ID NO:23168<br>GATCGGGATGTCGGGTACAA<br>CGGTATGGACGTC |
| | | AA | SEQ ID NO:7145<br>SYGMH | SEQ ID NO:15157<br>VIWYDGSNKNYADSVKG | SEQ ID NO:23169<br>DRDVGYNGMDV |
| iPS:436516 | 21-225_222C12 | NA | SEQ ID NO:7146<br>GGCTACTATATGCAC | SEQ ID NO:15158<br>TGGATCCACCCTAACAG<br>TGGTGGCACAAACTATG<br>CACAGAAATTTCAGGGC | SEQ ID NO:23170<br>GATGGGACCAGCTCGTTTGA<br>CTAC |
| | | AA | SEQ ID NO:7147<br>GYYMH | SEQ ID NO:15159<br>WIHPNSGGTNYAQKFQG | SEQ ID NO:23171<br>DGTSSFDY |
| | | | SEQ ID NO:7148 | SEQ ID NO:15160 | SEQ ID NO:23172 |

FIGURE 49
(Continued)

| | | | | |
|---|---|---|---|---|
| iPS:436520 | 21-225_223G10 | NA | AGCTATGGTATCAAC | TGGATCAGCGGTTTACAGTGGTAACACAAACTATGCACAGAAGCTCCAGGGC | GACTACTACTACGGTATGGACGTC |
| | | | SEQ ID NO:7149 | SEQ ID NO:15161 | SEQ ID NO:23173 |
| | | AA | SYGIN | WISVYSGNTYAQKLQG | DYYYGMDV |
| | | | SEQ ID NO:7150 | SEQ ID NO:15162 | SEQ ID NO:23174 |
| iPS:436522 | 21-225_223H10 | NA | AGCTATGGCATGCAC | GTTATATGGTATGGATGGAAGTAATAAAAACTATGCAGACTCCGTGAAGGGC | GATCGGGATGTCGGGTACAACCGGTATGGACGTC |
| | | | SEQ ID NO:7151 | SEQ ID NO:15163 | SEQ ID NO:23175 |
| | | AA | SYGMH | VIWYDGSNKNYADSVKG | DRDVGYNGMDV |
| | | | SEQ ID NO:7152 | SEQ ID NO:15164 | SEQ ID NO:23176 |
| iPS:436526 | 21-225_224A1 | NA | AGCTATGCCATGAGC | GCTATTAGTGGCAGAGGCGGCAGCACATACTACGCAGACGCCGTGAAGGGC | GGCTCCTAGAGATAGTAGTGGTTATTACCACTACTTAGACAC |
| | | | SEQ ID NO:7153 | SEQ ID NO:15165 | SEQ ID NO:23177 |
| | | AA | SYAMS | AISGRGGSTYYADAVKG | GSYDSSGYYHYLDH |
| | | | SEQ ID NO:7154 | SEQ ID NO:15166 | SEQ ID NO:23178 |
| iPS:436528 | 21-225_224B1 | NA | AGCTATGCCATGAGC | GCTATTAGTGGTAGTGGTGGTAACACATACTACGCAGACTCCGTGAAGGGC | GAGGGGGGCTACTACTATTACTACGGTGTGGACGTC |
| | | | SEQ ID NO:7155 | SEQ ID NO:15167 | SEQ ID NO:23179 |
| | | AA | SYAMS | AISGSGGNTYYADSVKG | EGGYYYYYGVDV |
| | | | SEQ ID NO:7156 | SEQ ID NO:15168 | SEQ ID NO:23180 |

FIGURE 49
(Continued)

| | | | | |
|---|---|---|---|---|
| iPS:436534 | 21-225_224F1 | NA | AGCTATATCATGCAC | GTTATATGGTATGATGG AAGTAATAAATACTACG CAGACTCCGTGAAGGGC | GAGAGGTATAGCAGCAACTG GTACGACTACGGTATGGACG TC |
| | | | SEQ ID NO:7157 | SEQ ID NO:15169 | SEQ ID NO:23181 |
| | | AA | SYIMH | VIWYDGSNKYYADSVKG | ERYSSNWYDYGMDV |
| | | | SEQ ID NO:7158 | SEQ ID NO:15170 | SEQ ID NO:23182 |
| iPS:436536 | 21-225_224G1 | NA | GGCTACTATATACAC | TGGATCAACCCTACAGT GGTGACACAAACTATGC ACAGAAGTTCAGGGC | GATTGGGGTGGCTACAGTTC TTACTACTACGGTATGGACG TC |
| | | | SEQ ID NO:7159 | SEQ ID NO:15171 | SEQ ID NO:23183 |
| | | AA | GYYIH | WINPYSGDTNYAQKFQG | DWGGYSSYYYGMDV |
| | | | SEQ ID NO:7160 | SEQ ID NO:15172 | SEQ ID NO:23184 |
| iPS:436538 | 21-225_224C3 | NA | AGAAGTAGTTACTACTGGGG C | AATATCTATTATAGTGGG AGCACTACTACAACCC GTCCCTCAAGAGT | CAGGGTCGGGACTGGGGTGT TGACTAC |
| | | | SEQ ID NO:7161 | SEQ ID NO:15173 | SEQ ID NO:23185 |
| | | AA | RSSYYWG | NIYYSGSTYYNPSLKS | QGRDWGVDY |
| | | | SEQ ID NO:7162 | SEQ ID NO:15174 | SEQ ID NO:23186 |
| iPS:436540 | 21-225_224F3 | NA | AGCTATGGCATGCAC | GTTATATGGTATGATGG AAGTAATAAATACTATG CAGACTCCGTGAAGGGC | GAGAGGTATAGCAGCAGCTG GTACGACTACGGTATGGACG TC |
| | | | SEQ ID NO:7163 | SEQ ID NO:15175 | SEQ ID NO:23187 |
| | | AA | SYGMH | VIWYDGSNKYYADSVKG | ERYSSSWYDYGMDV |
| | | | SEQ ID NO:7164 | SEQ ID NO:15176 | SEQ ID NO:23188 |

FIGURE 49
(Continued)

| | | | | |
|---|---|---|---|---|
| iPS:436544 | 21-225_224H5 | NA | AATTATGATATCAAC<br>SEQ ID NO:7165<br>NYDIN<br>SEQ ID NO:7166 | TGGATGAACCCTAACAG<br>TGGTAACACAGGCTATG<br>CACAGAAGTTCCAGGGC<br>SEQ ID NO:15177<br>WMNPNSGNTGYAQKFQG<br>SEQ ID NO:15178 | TCCAGTGGCTGGAACTGGTT<br>CGACCCC<br>SEQ ID NO:23189<br>SSGWNWFDP<br>SEQ ID NO:23190 |
| iPS:436546 | 21-225_224D6 | NA<br>AA | AGCGATGCCATGAGC<br>SEQ ID NO:7167<br>SDAMS<br>SEQ ID NO:7168 | GCTATTAGTGGTAGTGGT<br>GATAACACATTCTACGC<br>AGACTCCGTGAAGGGC<br>SEQ ID NO:15179<br>AISGSGDNTFYADSVKG<br>SEQ ID NO:15180 | GTCTATAGTGCCTACGATTC<br>TCACTGGTTCGACCCC<br>SEQ ID NO:23191<br>VYSAYDSHWFDP<br>SEQ ID NO:23192 |
| iPS:436548 | 21-225_224A7 | NA<br>AA | GGCTACTATATACAAC<br>SEQ ID NO:7169<br>GYYIH<br>SEQ ID NO:7170 | TGGATCAACCCTACAGT<br>GGTGACAACAACTATGC<br>ACAGAAGTTCCAGGGC<br>SEQ ID NO:15181<br>WINPYSGDTNYAQKFQG<br>SEQ ID NO:15182 | GATTGGGGTGGCTACAGTTC<br>TTACTACTACGGTATGGACG<br>TC<br>SEQ ID NO:23193<br>DWGGYSSYYYGMDV<br>SEQ ID NO:23194 |
| iPS:436550 | 21-225_224D8 | NA<br>AA | AATTATGATATCAAC<br>SEQ ID NO:7171<br>NYDIN<br>SEQ ID NO:7172 | TGGTTGTACCCTAACAGT<br>GGTAACACAGGCTATG<br>ACAGAAGTTCCAGGGC<br>SEQ ID NO:15183<br>WLYPNSGNTGYAQKFQG<br>SEQ ID NO:15184 | AGCAGTGGCTGGTACTACTT<br>TGACTAC<br>SEQ ID NO:23195<br>SSGWYYFDY<br>SEQ ID NO:23196 |
| iPS:436554 | 21-225_224C10 | NA | AATTATGATATCAAC<br>SEQ ID NO:7173 | TGGATGCACCCTAACAG<br>TGGTAACACAGGCTATG<br>CACAGAAGTTCCAGGGC<br>SEQ ID NO:15185 | AGCAGTGGCTGGTACAAGTT<br>TGACTAC<br>SEQ ID NO:23197 |

FIGURE 49
(Continued)

| | | | | WMHPNSGNTGYAQKFQG | SSGWYKFDY |
|---|---|---|---|---|---|
| iPS:436556 | 21-225_224D10 | AA | NYDIN | SEQ ID NO:15186 | SEQ ID NO:23198 |
| | | NA | AGCTATGGCATGCAC | GTTATATGGTATGAGGGAAGTAATAAATACTATGTAGACTCCGTGAGGGC | GAGCTAGGCTTCCAGTCTGACTAC |
| | | | SEQ ID NO:7174 | | |
| | | | | | SEQ ID NO:23199 |
| | | AA | SYGMH | VIWYEGSNKYYVDSVRG | ELGFQSDY |
| | | | SEQ ID NO:7175 | SEQ ID NO:15187 | SEQ ID NO:23200 |
| iPS:436558 | 21-225_224C11 | NA | GGCTACTATATACAC | TGGATCAACCCTTACAGTGGTGACACAAACTATGCACAGAAGTTTCAGGGC | GATTGGGGTGGCTACAGTCTTACTACTTCGGTATGGACGTC |
| | | | SEQ ID NO:7176 | SEQ ID NO:15188 | SEQ ID NO:23201 |
| | | AA | GYYIH | WINPYSGDTNYAQKFQG | DWGGYSSYYFGMDV |
| | | | SEQ ID NO:7177 | SEQ ID NO:15189 | SEQ ID NO:23202 |
| iPS:436560 | 21-225_224F11 | NA | AATTATGATATCAAC | TGGATGAACCCTAACAGTGGTAACACAGGCTATGCACAGAAGTTTCAGGGC | AGCAGTGGCTGGTACAAGTTTGACTAC |
| | | | SEQ ID NO:7178 | SEQ ID NO:15190 | SEQ ID NO:23203 |
| | | AA | NYDIN | WMNPNSGNTGYAQKFQG | SSGWYKFDY |
| | | | SEQ ID NO:7179 | SEQ ID NO:15191 | SEQ ID NO:23204 |
| iPS:436562 | 21-225_224H11 | NA | GGCTACTATATACAC | TGGATCAACCCTTACAGTGGTGACACAAACTATGCACAGAAGTTTCAGGGC | GATTGGGGTGGCTACAGTCTTACTACTACGGTATGGACGTC |
| | | | SEQ ID NO:7180 | SEQ ID NO:15192 | SEQ ID NO:23205 |
| | | AA | GYYIH | WINPYSGDTNYAQKFQG | DWGGYSSYYYGMDV |
| | | | SEQ ID NO:7181 | SEQ ID NO:15193 | SEQ ID NO:23206 |
| | | | SEQ ID NO:7182 | SEQ ID NO:15194 | |

FIGURE 49
(Continued)

| | | | | | |
|---|---|---|---|---|---|
| iPS:436564 | 21-225_225A1 | NA | GACTATGTCATCCAC<br>SEQ ID NO:7183 | GTTATATGGTATGATGG<br>AAGTAATAAATACTATG<br>CAGACTCCGTGAAGGGC<br>SEQ ID NO:15195 | GAGAGGTATAGCAGTGGCTG<br>GTACGACTACGGTATGGACG<br>TC<br>SEQ ID NO:23207 |
| | | AA | DYVIH<br>SEQ ID NO:7184 | VIWYDGSNKYYADSVKG<br>SEQ ID NO:15196 | ERYSSGWYDYGMDV<br>SEQ ID NO:23208 |
| iPS:436568 | 21-225_225B3 | NA | AGCTACTACTATAGCAC<br>SEQ ID NO:7185 | ATAATCAACCCTAGTGG<br>TGGTAGCACAAGCTACG<br>CACAGAAGTTCCAGGGC<br>SEQ ID NO:15197 | GATTAGCAGCTCGTTCTTA<br>CTACTACTACTTCGGTATGG<br>ACGTC<br>SEQ ID NO:23209 |
| | | AA | SYYMH<br>SEQ ID NO:7186 | IINPSGGSTSYAQKFQG<br>SEQ ID NO:15198 | DLAARSYYYFGMDV<br>SEQ ID NO:23210 |
| iPS:436570 | 21-225_225F4 | NA | AATTATGATATCAAC<br>SEQ ID NO:7187 | TGGATGCACCTAACAG<br>TGGTAGCACAGGCTATG<br>CACAGAAGTTCCAGGGC<br>SEQ ID NO:15199 | AGCAGTGGCTGGTACTGGTT<br>CGACCCC<br>SEQ ID NO:23211 |
| | | AA | NYDIN<br>SEQ ID NO:7188 | WMHPNSGSTGYAQKFQG<br>SEQ ID NO:15200 | SSGWYWFDP<br>SEQ ID NO:23212 |
| iPS:436572 | 21-225_225G4 | NA | GGCTACTATATACAC<br>SEQ ID NO:7189 | TGGATCAACCCTTACAGT<br>GGTGACACAAACTATGC<br>ACAGAAGTTCAGGGC<br>SEQ ID NO:15201 | GATTGGGGTGGCTACAGTTC<br>TTACTACTACGGTATGGACG<br>TC<br>SEQ ID NO:23213 |
| | | AA | GYYIH<br>SEQ ID NO:7190 | WINPYSGDTNYAQKFQG<br>SEQ ID NO:15202 | DWGGYSSYYYGMDV<br>SEQ ID NO:23214 |
| iPS:436574 | | NA | AATTATGATATCAAC | TGGATGCATCCTAACAG<br>TGGTAACACAGGCTTTG<br>CACAGAAGTTCCAGGGC | AGCAGTGGCTGGTACCGCTT<br>TGACTAC |

FIGURE 49 (Continued)

| | | | | | |
|---|---|---|---|---|---|
| iPS:436576 | 21-225_225F5 | AA | SEQ ID NO:7191<br>NYDIN | SEQ ID NO:15203<br>WMHPNSGNTGFAQKFQG | SEQ ID NO:23215<br>SSGWYRFDY |
| | | NA | SEQ ID NO:7192<br>GACTATGGCATGCAC | SEQ ID NO:15204<br>GTTATATGGTATGATGA AAATAATAAATACTATG CAGACTCCGTGAAGGGC | SEQ ID NO:23216<br>GAAGTGGGATTCACTGAGGA CTAC |
| iPS:436578 | 21-225_225B6 | AA | SEQ ID NO:7193<br>DYGMH | SEQ ID NO:15205<br>VIWYDENNKYYADSVKG | SEQ ID NO:23217<br>EVGFTEDY |
| | | NA | SEQ ID NO:7194<br>AACTATGGCATGCAC | SEQ ID NO:15206<br>GTTATATGGTATGATGA AAATAATAAATACTATG CAGACTCCGTGAAGGGC | SEQ ID NO:23218<br>GAAGTGGGATTCACTGAGGA CTAC |
| iPS:436580 | 21-225_225D6 | AA | SEQ ID NO:7195<br>NYGMH | SEQ ID NO:15207<br>VIWYDENNKYYADSVKG | SEQ ID NO:23219<br>EVGFTEDY |
| | | NA | SEQ ID NO:7196<br>AGTGGTCATTACTACTGGAG C | SEQ ID NO:15208<br>TTCATCTATTACACTGGG AGCACTACTACAACCC GTCCCTCAAGAGT | SEQ ID NO:23220<br>GAGGCCGGTGACTACGGCTA CTACGGTATGGACGTC |
| iPS:436582 | 21-225_225E7 | AA | SEQ ID NO:7197<br>SGHYYWS | SEQ ID NO:15209<br>FIYYTGSTYNPSLKS | SEQ ID NO:23221<br>EAGDYGYYGMDV |
| | 21-225_225F8 | NA | SEQ ID NO:7198<br>AGCTATGGCATGCAC | SEQ ID NO:15210<br>GTTATATGGTATGATGA AAATAATAAATACTATG TAGACTCCGTGAAGGGC | SEQ ID NO:23222<br>GAAGTGGGATTACTGAGGA CTAC |

FIGURE 49
(Continued)

| | | | | | | |
|---|---|---|---|---|---|---|
| iPS:436584 | 21-225_225F8 | AA | SEQ ID NO:7199<br>SYGMH | SEQ ID NO:15211<br>VIWYDENNKYYVDSVKG | SEQ ID NO:23223<br>EVGFTEDY | |
| | | NA | SEQ ID NO:7200<br>AATTATGATATCAAC | SEQ ID NO:15212<br>TGGATGCACCCTAACAG<br>TGGTAACACAGGCTATG<br>CACAGAAGTTCCGGGGC | SEQ ID NO:23224<br>AGCAGTGGCTGGACCCTTTT<br>TGACTAC | |
| iPS:436586 | 21-225_225B9 | AA | SEQ ID NO:7201<br>NYDIN | SEQ ID NO:15213<br>WMHPNSGNTGYAQKFRG | SEQ ID NO:23225<br>SSGWTLFDY | |
| | | NA | SEQ ID NO:7202<br>AATTATGATATCAAC | SEQ ID NO:15214<br>TGGATGCACCCTAACAG<br>TGGTAACACAGGCTATG<br>CACAGAAGTTCCAGGGC | SEQ ID NO:23226<br>AGCAGTGGCTGGTACCGGCTT<br>TGACTAC | |
| iPS:436588 | 21-225_225F11 | AA | SEQ ID NO:7203<br>NYDIN | SEQ ID NO:15215<br>WMHPNSGNTGYAQKFQG | SEQ ID NO:23227<br>SSGWYRFDY | |
| | | NA | SEQ ID NO:7204<br>CATTATGATATCAAC | SEQ ID NO:15216<br>TGGATGCACCCAAACAG<br>TGGTAACACAGGCTATG<br>CACAGAAGTTCCAGGGC | SEQ ID NO:23228<br>AGCAGTGGCTGGTACAAGTT<br>TGACTAC | |
| iPS:436590 | 21-225_225F12 | AA | SEQ ID NO:7205<br>HYDIN | SEQ ID NO:15217<br>WMHPNSGNTGYAQKFQG | SEQ ID NO:23229<br>SSGWYKFDY | |
| | | NA | SEQ ID NO:7206<br>AATTATGATATCAAC | SEQ ID NO:15218<br>TGGATGCACCCTAACAG<br>TGGTAACACAGGCTATG<br>CACAGAAGTTCCAGGGC | SEQ ID NO:23230<br>AGCAGTGGCTGGTACAAGTT<br>TGACTAC | |
| | 21-225_225H12 | | SEQ ID NO:7207 | SEQ ID NO:15219 | SEQ ID NO:23231 | |

FIGURE 49
(Continued)

| | | AA/NA | | | | | |
|---|---|---|---|---|---|---|---|
| iPS:436592 | | AA | NYDIN | | WMHPNSGNTGYAQKFQG | | SSGWYKFDY |
| | 21-225_226B1 | NA | SEQ ID NO:7208 ACCTATGGCATGCAC | SEQ ID NO:15220 ATTATATGGTATGATGG AGGTTATAAATACTATG CAGACTCCGTGAAGGGC | | SEQ ID NO:23232 GATCACTACGATTTTGGAG TGGTTATCTTACCCAC | |
| iPS:436594 | | AA | SEQ ID NO:7209 TYGMH | SEQ ID NO:15221 IIWYDGGYKYYADSVKG | | SEQ ID NO:23233 DHYDFWSGYLTH | |
| | 21-225_226A5 | NA | SEQ ID NO:7210 AACTATGGCATGCAC | SEQ ID NO:15222 ATTATATGGTATGATGG AACTAATAAATACTATA CAGACTCCGTGAAGGGC | | SEQ ID NO:23234 GAGGGTCACGATTTTTGGAG TGGCTTTTTTGTTAC | |
| iPS:436596 | | AA | SEQ ID NO:7211 NYGMH | SEQ ID NO:15223 IIWYDGTNKYYTDSVKG | | SEQ ID NO:23235 EGHDFWSGFFCY | |
| | 21-225_226C6 | NA | SEQ ID NO:7212 GACTATGGCATGCAC | SEQ ID NO:15224 GTTATATGGTATGATGG AAGTAATAAATACTATG CAGACTCCGTGAAGGGC | | SEQ ID NO:23236 GAGAGGTATAGCAGCAGCTG GTACGACTACGGTATGGACG TC | |
| iPS:436598 | | AA | SEQ ID NO:7213 DYGMH | SEQ ID NO:15225 VIWYDGSNKYYADSVKG | | SEQ ID NO:23237 ERYSSSWYDYGMDV | |
| | 21-225_226D6 | NA | SEQ ID NO:7214 AATTATGATATCAAC | SEQ ID NO:15226 TGGATGCACCCTAACAG TGGTAACACAGGCTATG CACAGAAGTTCCAGGGC | | SEQ ID NO:23238 AGCAGTGGCTGGTACAAGTT TGACTAC | |
| | | AA | SEQ ID NO:7215 NYDIN | SEQ ID NO:15227 WMHPNSGNTGYAQKFQG | | SEQ ID NO:23239 SSGWYKFDY | |

FIGURE 49
(Continued)

| | | | | | |
|---|---|---|---|---|---|
| iPS:436600 | 21-225_226F6 | NA | SEQ ID NO:7216<br>AATTATGATATCAAC | SEQ ID NO:15228<br>TGGATGCACCTAACAG<br>TGGTAACACAGGCTATG<br>CACAGAAGTTCCAGGGC | SEQ ID NO:23240<br>AGCAGTGGCTGGTACCGCTT<br>TGACTAC |
| | | AA | SEQ ID NO:7217<br>NYDIN | SEQ ID NO:15229<br>WMHPNSGNTGYAQKFQG | SEQ ID NO:23241<br>SSGWYRFDY |
| iPS:436602 | 21-225_226E7 | NA | SEQ ID NO:7218<br>ACCTATGGCATGCAC | SEQ ID NO:15230<br>ATTATATGGTATGATGG<br>AAGTAATAAATACTATG<br>CAGACTCCGTGAAGGGC | SEQ ID NO:23242<br>GAGAATTACGATTTTGGAG<br>TGGTTATTATGGCTAC |
| | | AA | SEQ ID NO:7219<br>TYGMH | SEQ ID NO:15231<br>IIWYDGSNKYYADSVKG | SEQ ID NO:23243<br>ENYDFWSGYYGY |
| iPS:436604 | 21-225_226F7 | NA | SEQ ID NO:7220<br>AGCTATGGCATGCAC | SEQ ID NO:15232<br>ATTATATGGTATGATGG<br>AAGTAATAAATACTATG<br>CAGACTCCGTGAAGGGC | SEQ ID NO:23244<br>GAGAGGTATAACAGCGGCTG<br>GTACGACTACGGTTTGGACG<br>TC |
| | | AA | SEQ ID NO:7221<br>SYGMH | SEQ ID NO:15233<br>IIWYDGSNKYYADSVKG | SEQ ID NO:23245<br>ERYNSGWYDYGLDV |
| iPS:436606 | 21-225_226G8 | NA | SEQ ID NO:7222<br>GGCTACTATATACAC | SEQ ID NO:15234<br>TGGATCAACCCTTACAGT<br>GGTGACACAAAGTATGC<br>ACAGAAGTTTCAGGGC | SEQ ID NO:23246<br>GATTGGGGTGGCTACAGTTC<br>TTACTACTACGGTATGGACG<br>TC |
| | | AA | SEQ ID NO:7223<br>GYYIH | SEQ ID NO:15235<br>WINPYSGDTKYAQKFQG | SEQ ID NO:23247<br>DWGGYSSYYYGMDV |
| | | | SEQ ID NO:7224 | SEQ ID NO:15236 | SEQ ID NO:23248 |

FIGURE 49
(Continued)

| | | NA | AACTATGGCATGCAC | | GTTATATGGTATGAGGA AAGTAATAAATACTATA CAGACTCCGTGAAGGGC | | GAAGTGGGATTCACTGAGGA CTAC | |
|---|---|---|---|---|---|---|---|---|
| iPS:436608 | 21-225_226A9 | | SEQ ID NO:7225 | | SEQ ID NO:15237 | | SEQ ID NO:23249 | |
| | | AA | NYGMH | | VIWYEESNKYYTDSVKG | | EVGFTEDY | |
| | | | SEQ ID NO:7226 | | SEQ ID NO:15238 | | SEQ ID NO:23250 | |
| iPS:436610 | 21-225_226F9 | NA | GGCTACTATATACAC | | TGGATCAACCCTTACAGT GGTGACAAAGTATGC ACAGAAGTTTCAGGGC | | GATTGGGGTGGCTACAGTTC TTACTACTACGGTATGGACG TC | |
| | | | SEQ ID NO:7227 | | SEQ ID NO:15239 | | SEQ ID NO:23251 | |
| | | AA | GYYIH | | WINPYSGDTKYAQKFQG | | DWGGYSSYYYGMDV | |
| | | | SEQ ID NO:7228 | | SEQ ID NO:15240 | | SEQ ID NO:23252 | |
| iPS:436612 | 21-225_226H9 | NA | GGCTACTATATACAC | | TGGATCAACCCTTACAGT GGTGACACAAACTCTGC ACAGAAGTTTCAGGGC | | GATTGGGGTGGCTACAGTTC TTACTACTACGGTATGGACG TC | |
| | | | SEQ ID NO:7229 | | SEQ ID NO:15241 | | SEQ ID NO:23253 | |
| | | AA | GYYIH | | WINPYSGDTNSAQKFQG | | DWGGYSSYYYGMDV | |
| | | | SEQ ID NO:7230 | | SEQ ID NO:15242 | | SEQ ID NO:23254 | |
| iPS:436614 | 21-225_226F10 | NA | GGCTATTATATACAC | | TGGATCAACCATACAG TGGTGACAAAACTATG CACAGAGAAGTTTCAGGGC | | GATTGGGGTGGCTACAGTTC TTACTACTACGGTATGGACG TC | |
| | | | SEQ ID NO:7231 | | SEQ ID NO:15243 | | SEQ ID NO:23255 | |
| | | AA | GYYIH | | WINPYSGDTNYAQKFQG | | DWGGYSSYYYGMDV | |
| | | | SEQ ID NO:7232 | | SEQ ID NO:15244 | | SEQ ID NO:23256 | |
| iPS:436616 | 21-225_226D11 | NA | AATTATGATATCAAC | | TGGATGCACCCTAACAG TGGTAACACAGGCTATG CACAGAAGTTCCAGGGC | | AGCAGTGGCTGTACTACTT TGACTAC | |
| | | | SEQ ID NO:7233 | | SEQ ID NO:15245 | | SEQ ID NO:23257 | |

FIGURE 49
(Continued)

| | | | | NYDIN | | WMHPNSGNTGYAQKFQG | | SSGWYYFDY |
|---|---|---|---|---|---|---|---|---|
| | | | AA | | | | | |
| iPS:436618 | 21-225_226E11 | NA | | SEQ ID NO:7234 GGCTACTATATACAC | | SEQ ID NO:15246 TGGATCAACCCTTACAGTGGTGACACAAACTATGCACAGAAGTTTCAGGGC | | SEQ ID NO:23258 GATTGGGGTGGCTACAGTTCTTACTACGGTATGGACG TC |
| | | AA | | SEQ ID NO:7235 GYYIH | | SEQ ID NO:15247 WINPYSGDTNYAQKFQG | | SEQ ID NO:23259 DWGGYSSYYYGMDV |
| iPS:436620 | 21-225_226H11 | NA | | SEQ ID NO:7236 AACTGTGGCATGCAC | | SEQ ID NO:15248 GTTATATGGTATGATGGAAGTAATAAATACTATGCAGACTCCGTGAAGGGC | | SEQ ID NO:23260 GAGCTGTATAGCAGCAGCTGGTACGACTACGGTTTGGACG TC |
| | | AA | | SEQ ID NO:7237 NCGMH | | SEQ ID NO:15249 VIWYDGSNKYYADSVKG | | SEQ ID NO:23261 ELYSSSWYDYGLDV |
| iPS:436622 | 21-225_226A12 | NA | | SEQ ID NO:7238 AATTATGATATCAAC | | SEQ ID NO:15250 TGGATGCACCCTAACAGTGGTAACACAGGCTATGCACAGAAGTTCCAGGGC | | SEQ ID NO:23262 AGCAGTGGCTGGTACTACTTTGACTAC |
| | | AA | | SEQ ID NO:7239 NYDIN | | SEQ ID NO:15251 WMHPNSGNTGYAQKFQG | | SEQ ID NO:23263 SSGWYYFDY |
| iPS:436624 | 21-225_226H12 | NA | | SEQ ID NO:7240 GGCTACTATATACAC | | SEQ ID NO:15252 TGGATCAACCCTTACAGTGGTGACACAAACTATGCACAGAAGTTTCAGGGC | | SEQ ID NO:23264 GATTGGGGTGGCTACAGTTCTTACTACGGTATGGACG TC |
| | | AA | | SEQ ID NO:7241 GYYIH | | SEQ ID NO:15253 WINPYSGDTNYAQKFQG | | SEQ ID NO:23265 DWGGYSSYYYGMDV |
| | | | | SEQ ID NO:7242 | | SEQ ID NO:15254 | | SEQ ID NO:23266 |

FIGURE 49
(Continued)

| | | | | | |
|---|---|---|---|---|---|
| iPS:436626 | 21-225_227C1 | NA | GGCTACTATACACAC | TGGATCAACCCTTACAGTGGTGGCACAAATGCACAGAAGTTTCAGGGC | GATTGGGGTGGCTACAGTTCTTACTACGGTATGGACGTC |
| | | | SEQ ID NO:7243 | SEQ ID NO:15255 | SEQ ID NO:23267 |
| | | AA | GYYTH | WINPYSGGTNYAQKFQG | DWGGYSSYYYGMDV |
| | | | SEQ ID NO:7244 | SEQ ID NO:15256 | SEQ ID NO:23268 |
| iPS:436628 | 21-225_227F2 | NA | GGCTACTATATACAC | TGGATCAACCCTTACAGTGGTGACACAAAGTATGCACAGAAGTTTCAGGGC | GATTGGGGTGGCTACAGTTCTTACTACGGTATGGACGTC |
| | | | SEQ ID NO:7245 | SEQ ID NO:15257 | SEQ ID NO:23269 |
| | | AA | GYYIH | WINPYSGDTKYAQKFQG | DWGGYSSYYYGMDV |
| | | | SEQ ID NO:7246 | SEQ ID NO:15258 | SEQ ID NO:23270 |
| iPS:436630 | 21-225_227G3 | NA | AGCTATGGCATGCAC | GTTATATGGTATGTGGAAGTAATCAATACTATGCAGACTCCGTGAAGGGC | GAAGTGGGATTCACTGAGGACTAC |
| | | | SEQ ID NO:7247 | SEQ ID NO:15259 | SEQ ID NO:23271 |
| | | AA | SYGMH | VIWYVGSNQYYADSVKG | EVGFTEDY |
| | | | SEQ ID NO:7248 | SEQ ID NO:15260 | SEQ ID NO:23272 |
| iPS:436632 | 21-225_227E4 | NA | ACTTTTGCCATGACC | GTTATTAGTAGTGGTAGAGGTGGTAGCTCATTCTACGCAGACTCCGTGAAGGGC | GATCAACTATGGTTTGACTAC |
| | | | SEQ ID NO:7249 | SEQ ID NO:15261 | SEQ ID NO:23273 |
| | | AA | TFAMT | VISGRGGSSFYADSVKG | DQLWFDY |
| | | | SEQ ID NO:7250 | SEQ ID NO:15262 | SEQ ID NO:23274 |
| iPS:436634 | 21-225_227H5 | NA | AACTATGGCATGCAC | GTTATATGGTATGAAGAAAGTAATAAATACTATGCAGACTCCGTGAAGGGC | GAAGTGGGATTCACTGAGGACTAC |
| | | | SEQ ID NO:7251 | SEQ ID NO:15263 | SEQ ID NO:23275 |

FIGURE 49
(Continued)

| | | | | | | | |
|---|---|---|---|---|---|---|---|
| iPS:436636 | 21-225_227E6 | AA | NYGMH<br>SEQ ID NO:7252 | VIWYEESNKYYADSVKG<br>SEQ ID NO:15264 | EVGFTEDY<br>SEQ ID NO:23276 |
| | | NA | AATTATGATATCAAC<br>SEQ ID NO:7253 | TGGATGCACCCTAACAG<br>TGGTAACACAGGCTATG<br>CACAGAAGTTCCAGGGC<br>SEQ ID NO:15265 | AGCAGTGGCTGGTACAAGTT<br>TGACTAC<br>SEQ ID NO:23277 |
| iPS:436638 | 21-225_227C7 | AA | NYDIN<br>SEQ ID NO:7254 | WMHPNSGNTGYAQKFQG<br>SEQ ID NO:15266 | SSGWYKFDY<br>SEQ ID NO:23278 |
| | | NA | AATTATGATATCAAC<br>SEQ ID NO:7255 | TGGATGCATCCTAACAG<br>TGGTAACACAGGCTATG<br>CACAGAAGTTCCAGGGC<br>SEQ ID NO:15267 | AGCAGTGGCTGGTACCGCTT<br>TGACTAC<br>SEQ ID NO:23279 |
| iPS:436640 | 21-225_227A8 | AA | NYDIN<br>SEQ ID NO:7256 | WMHPNSGNTGYAQKFQG<br>SEQ ID NO:15268 | SSGWYRFDY<br>SEQ ID NO:23280 |
| | | NA | GGCTACTATATACAC<br>SEQ ID NO:7257 | TGGATCAACCCTTACAGT<br>GGTGACACAAACTATGC<br>ACAGAAGTTTCAGGGC<br>SEQ ID NO:15269 | GATTGGGGTGGCTACAGTTC<br>TTACTACTACGGTATGGACG<br>TC<br>SEQ ID NO:23281 |
| iPS:436644 | 21-225_227G9 | AA | GYYIH<br>SEQ ID NO:7258 | WINPYSGDTNYAQKFQG<br>SEQ ID NO:15270 | DWGGYSSYYYGMDV<br>SEQ ID NO:23282 |
| | | NA | AATTATGATATCAAC<br>SEQ ID NO:7259 | TGGATGTACCCTAACAG<br>TGGTAACACAGGCTATG<br>CACAGAAGTTCCAGGGC<br>SEQ ID NO:15271 | AGCAGTGGCTGGTACTGGTT<br>CGACCCC<br>SEQ ID NO:23283 |
| | | AA | NYDIN<br>SEQ ID NO:7260 | WMYPNSGNTGYAQKFQG<br>SEQ ID NO:15272 | SSGWYWFDP<br>SEQ ID NO:23284 |

FIGURE 49
(Continued)

| | | | | | |
|---|---|---|---|---|---|
| iPS:436646 | 21-225_227D11 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7261 | SEQ ID NO:15273 | SEQ ID NO:23285 |
| | | AA | NYDIN | WMHPNSGNTGYAQKFQG | SSGWYYFDY |
| iPS:436648 | 21-225_227F11 | NA | ACCTATAGCATGAAC | TCCATTAGTAGTAGTATT AATTACATGTACTACGC AGACTCAGTGAAGGGC | TTAGGGGTCTAC |
| | | | SEQ ID NO:7263 | SEQ ID NO:15275 | SEQ ID NO:23287 |
| | | AA | TYSMN | SISSSINYMYYADSVKG | LGVY |
| iPS:436650 | 21-225_227C12 | NA | AACTATGGCATGCAC | GTTATATGGTATATTGGA AGTAATCAATACTATGC GGACTCCGTGAAGGGC | GAAGTGGGATTCACTGAGGA CTAC |
| | | | SEQ ID NO:7265 | SEQ ID NO:15277 | SEQ ID NO:23289 |
| | | AA | NYGMH | VIWYIGSNQYYADSVKG | EVGFTEDY |
| iPS:436652 | 21-225_146B11 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7267 | SEQ ID NO:15279 | SEQ ID NO:23291 |
| | | AA | SYAMS | VISGGGSSTYYADSVKG | WRGNPTDYGMDV |
| iPS:436654 | 21-225_146C11 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7269 | SEQ ID NO:15281 | SEQ ID NO:23293 |
| | | AA | SYAMS | VISGGGSSTYYADSVKG | WRGNPTDYGMDV |

FIGURE 49
(Continued)

| | | | | | |
|---|---|---|---|---|---|
| iPS:436658 | 21-225_146A2 | NA | SEQ ID NO:7270<br>AGCTATGCCATGAGC | SEQ ID NO:15282<br>GTTATTAGTGGTGGTGGT<br>AGTAGCACATACTACGC<br>AGACTCCGTGAAGGGC | SEQ ID NO:23294<br>TGGCGAGGTAACCCCACTGA<br>CTACGGTATGGACGTC |
| | | AA | SEQ ID NO:7271<br>SYAMS | SEQ ID NO:15283<br>VISGGGSSTYYADSVKG | SEQ ID NO:23295<br>WRGNPTDYGMDV |
| iPS:436660 | 21-225_146D8 | NA | SEQ ID NO:7272<br>AACTATAACATGAAC | SEQ ID NO:15284<br>TACATTAGTAGAAGTAG<br>TAATACCAAATACTATGT<br>AGACTCTGTGAAGGGC | SEQ ID NO:23296<br>GATAGGAGTGGGAGTACGG<br>GTACTTCTACTACTACGGTTT<br>GGACGTC |
| | | AA | SEQ ID NO:7273<br>NYNMN | SEQ ID NO:15285<br>YISRSSNTKYYVDSVKG | SEQ ID NO:23297<br>DRSGSYGYFYYYGLDV |
| iPS:436662 | 21-225_147D7 | NA | SEQ ID NO:7274<br>AGTTATGATATCAAC | SEQ ID NO:15286<br>TGGATGAACCTAATAG<br>TGGTAACACAGGCTATG<br>CACAGAAGTTCCAGGGC | SEQ ID NO:23298<br>GCGGATATTGTATTAGTACC<br>AGCTGCTATCCCTTATAATT<br>ACTACTTCGCTATGGACGTC |
| | | AA | SEQ ID NO:7275<br>SYDIN | SEQ ID NO:15287<br>WMNPNSGNTGYAQKFQG | SEQ ID NO:23299<br>ADIVLVPAAIPYNYYFAMDV |
| iPS:436664 | 21-225_147E7 | NA | SEQ ID NO:7276<br>AGCTATGCCATGAGC | SEQ ID NO:15288<br>GTTATTAGTGGTGGTGGT<br>AGTAGCACATACTACGC<br>AGACTCCGTGAAGGGC | SEQ ID NO:23300<br>TGGCGAGGTAACCCCACTGA<br>CTACGGTATGGACGTC |
| | | AA | SEQ ID NO:7277<br>SYAMS | SEQ ID NO:15289<br>VISGGGSSTYYADSVKG | SEQ ID NO:23301<br>WRGNPTDYGMDV |
| iPS:436666 | 21-225_147B8 | NA | SEQ ID NO:7278<br>GACTACTATTTGCAC | SEQ ID NO:15290<br>TGGATCAACCTAACAG<br>TGGTGACACAAACTATG<br>CACAGAAGTTTCAGGGC | SEQ ID NO:23302<br>GATCGGGACTCTGGTTCGGG<br>GAGTTACCCTACTACTACT<br>ACTACGGTATGGACGTC |
| | | | SEQ ID NO:7279 | SEQ ID NO:15291 | SEQ ID NO:23303 |

FIGURE 49
(Continued)

| | | AA | DYYLH | WINPNSGDTNYAQKFQG | DRDSGSGSYPYYYYGMDV |
|---|---|---|---|---|---|
| iPS:436668 | 21-225_147B9 | | SEQ ID NO:7280 | SEQ ID NO:15292 | SEQ ID NO:23304 |
| | | NA | AGCTATGGCATGCAC | GTTATATGGTTATGATGG AAGTAATAAATACTATG CAGACTCCGTGAAGGGC | GATCGTGACTACGGTGACCC CCCTACTACTACTACTACG GTATGGACGTC |
| | | | SEQ ID NO:7281 | SEQ ID NO:15293 | SEQ ID NO:23305 |
| iPS:436670 | 21-225_147D9 | AA | SYGMH | VIWYDGSNKYYADSVKG | DRDYGDPPYYYYGMDV |
| | | | SEQ ID NO:7282 | SEQ ID NO:15294 | SEQ ID NO:23306 |
| | | NA | AGCTATGGCATGCAC | GATATATGGTTGATGG AGTAATAAATACTATGT AGACTCCGTGAAGGAC | GATCGGGTGGAGGGTTCGGG GACTCCCTACTACTACTACG GTATGGACGTC |
| | | | SEQ ID NO:7283 | SEQ ID NO:15295 | SEQ ID NO:23307 |
| iPS:436672 | 21-225_147F9 | AA | SYGMH | DIWFDGSNKYYVDSVKD | DRVEGSGTPYYYYGMDV |
| | | | SEQ ID NO:7284 | SEQ ID NO:15296 | SEQ ID NO:23308 |
| | | NA | ACCTATGGCATGCAC | GTTATATGGTTATGGTGG AAGTGATAAAGACTATG CAGACTCCGTGAAGGGC | GATCGGGATTATTGTAGTGG TGGTACTTGTCCTTACTACTA CTACTACGGTATGGACGTC |
| | | | SEQ ID NO:7285 | SEQ ID NO:15297 | SEQ ID NO:23309 |
| iPS:436674 | 21-225_147G9 | AA | TYGMH | VIWYGGSDKDYADSVKG | DRDYCSGGTCPYYYYGMDV |
| | | | SEQ ID NO:7286 | SEQ ID NO:15298 | SEQ ID NO:23310 |
| | | NA | ACCTATGGCATGCAC | GTTATATGGTTATGGTGG AAGTGATAAAGACTATG CAGACTCCGTGAAGGGC | GATCGGGATTATTGTAGTGG TGGTAGCTGCCCTTACTACT ACTACTACGGTATGGACGTC |
| | | | SEQ ID NO:7287 | SEQ ID NO:15299 | SEQ ID NO:23311 |

FIGURE 49
(Continued)

| | | AA | TYGMH | | VIWYGGSDKDYADSVKG | | DRDYCSGGSCPYYYYGMDV | |
|---|---|---|---|---|---|---|---|---|
| iPS:436676 | | | | SEQ ID NO:7288 | | SEQ ID NO:15300 | | SEQ ID NO:23312 |
| | 21-225_147E11 | NA | AACTATGTCATGAGC | | GTTATTAGTGGTGGTGGT AGTAGTACATACTACGC AGACTCCGTGAAGGGC | | TGGCGAGGTAACCCCACTGA CTACGGTATGGACGTC | |
| | | | | SEQ ID NO:7289 | | SEQ ID NO:15301 | | SEQ ID NO:23313 |
| iPS:436678 | | AA | NYVMS | | VISGGGSTYYADSVKG | | WRGNPTDYGMDV | |
| | | | | SEQ ID NO:7290 | | SEQ ID NO:15302 | | SEQ ID NO:23314 |
| | 21-225_147B12 | NA | AGCTATGCCATGAGC | | GTTATTAGTGGTGGTGGT AGTAGCACATACTACGC AGACTCCGTGAAGGGC | | TGGCGAGGTAACCCCACTGA CTACGGTATGGACGTC | |
| | | | | SEQ ID NO:7291 | | SEQ ID NO:15303 | | SEQ ID NO:23315 |
| iPS:436680 | | AA | SYAMS | | VISGGGSTYYADSVKG | | WRGNPTDYGMDV | |
| | | | | SEQ ID NO:7292 | | SEQ ID NO:15304 | | SEQ ID NO:23316 |
| | 21-225_147H12 | NA | AGTGGTTATTACCACTGGAG C | | TACATCTATTACAGTGGG AGCACCTACTACAACCC GTCCCTCAAGAGT | | GATTGGGGTGGCTACGATTC GAGTGGCTGTTCGACCCC | |
| | | | | SEQ ID NO:7293 | | SEQ ID NO:15305 | | SEQ ID NO:23317 |
| iPS:436682 | | AA | SGYYHWS | | YIYYSGSTYYNPSLKS | | DWGGYDSSGWFDP | |
| | | | | SEQ ID NO:7294 | | SEQ ID NO:15306 | | SEQ ID NO:23318 |
| | 21-225_146A8 | NA | AACTATAACATGAAC | | TACATTAGTAGAAGTAG TAATACCAAATACTACG CAGACTCTGTGAGGGGC | | GATAGGAGTGGGAGCTACGG GTACTTCTACTACTACGGTTT GGACGTC | |
| | | | | SEQ ID NO:7295 | | SEQ ID NO:15307 | | SEQ ID NO:23319 |
| | | AA | NYNMN | | YISRSSNTKYYADSVRG | | DRSGSYGYFYYYGLDV | |
| | | | | SEQ ID NO:7296 | | SEQ ID NO:15308 | | SEQ ID NO:23320 |

FIGURE 49
(Continued)

| | | | | | |
|---|---|---|---|---|---|
| iPS:436684 | 21-225_146B6 | NA | AGCTATAACATGAAC | TACATTAGTAGAAGTAG TAATACCAAAACACTACG CAGACTCTGTGAAGGGC | GATAGGAGTGGGAGCTACGG GTACTTCTACTACTACGGTTT GGACGTC |
| | | | SEQ ID NO:7297 | SEQ ID NO:15309 | SEQ ID NO:23321 |
| | | AA | SYNMN | YISRSSNTKHYADSVKG | DRSGSYGYFYYYGLDV |
| | | | SEQ ID NO:7298 | SEQ ID NO:15310 | SEQ ID NO:23322 |
| iPS:436686 | 21-225_148G6 | NA | AGCTATGCCATGAGC | GTTATTAGTGGTGGTGGT AGTAGCACATACTACGC AGACTCCGTGAAGGGC | TGGCGAGGTAACCCACTGA CTACGGTATGGACGTC |
| | | | SEQ ID NO:7299 | SEQ ID NO:15311 | SEQ ID NO:23323 |
| | | AA | SYAMS | VISGGGSSTYYADSVKG | WRGNPTDYGMDV |
| | | | SEQ ID NO:7300 | SEQ ID NO:15312 | SEQ ID NO:23324 |
| iPS:436688 | 21-225_148C8 | NA | AGCTATGGCATGCAC | GTTATATGGTATGATGG AAGTAATAAATACTATG CAGACTCCGTGAAGGGC | GATCGTGACTAGGTGACC CCCTACTACTACTACTACG GTATGGACGTC |
| | | | SEQ ID NO:7301 | SEQ ID NO:15313 | SEQ ID NO:23325 |
| | | AA | SYGMH | VIWYDGSNKYYADSVKG | DRDYGDPPYYYYGMDV |
| | | | SEQ ID NO:7302 | SEQ ID NO:15314 | SEQ ID NO:23326 |
| iPS:436690 | 21-225_148A9 | NA | ACCTATGGCATGCAC | GTTATATGGTATGGTGG AAGTGATAAAGACTATG CAGACTCCGTGAAGGGC | GATCGGGATTATTGTAGTGG TGGTACTTGTCCTTACTACTA CTACTACGGTATGGACGTC |
| | | | SEQ ID NO:7303 | SEQ ID NO:15315 | SEQ ID NO:23327 |
| | | AA | TYGMH | VIWYGGSDKDYADSVKG | DRDYCSGGTCPYYYYGMDV |
| | | | SEQ ID NO:7304 | SEQ ID NO:15316 | SEQ ID NO:23328 |

FIGURE 49
(Continued)

| | | | | | |
|---|---|---|---|---|---|
| iPS:436694 | 21-225_148G11 | NA | AGCTATCCCATGAGC<br>SEQ ID NO:7305 | GTTATTAGTAGTGGTGGTGGT<br>AGTAGTGCATACTACG<br>AGACTCCGTGAAGGGC<br>SEQ ID NO:15317 | TGGCGAGGTAACCCCACTGA<br>CTACGGTATGGACGTC<br>SEQ ID NO:23329 |
| | | AA | SYPMS<br>SEQ ID NO:7306 | VISGGGSSAYYADSVKG<br>SEQ ID NO:15318 | WRGNPTDYGMDV<br>SEQ ID NO:23330 |
| iPS:436696 | 21-225_149A1 | NA | AGCTATAACATGAAC<br>SEQ ID NO:7307 | TACATTAGTAGAGAAGTAG<br>TAATACCAAACACTACG<br>CAGACTCTGAAGGGC<br>SEQ ID NO:15319 | GATAGGAGTGGGAGCTACGG<br>GTACTTCTACTACTACGGTTT<br>GGACGTC<br>SEQ ID NO:23331 |
| | | AA | SYNMN<br>SEQ ID NO:7308 | YISRSSNTKHYADSVKG<br>SEQ ID NO:15320 | DRSGSYGYFYYYGLDV<br>SEQ ID NO:23332 |
| iPS:436698 | 21-225_149B5 | NA | GGCTATTGGATGAAC<br>SEQ ID NO:7309 | AACATAAAGCAAGATGG<br>AAGTGAGAAATACTATG<br>TGGACTCTGAAGGGC<br>SEQ ID NO:15321 | GGGATGTATAGCAGTGGCTG<br>GTACGTCTTTGACTAC<br>SEQ ID NO:23333 |
| | | AA | GYWMN<br>SEQ ID NO:7310 | NIKQDGSEKYYVDSVKG<br>SEQ ID NO:15322 | GMYSSGWYVFDY<br>SEQ ID NO:23334 |
| iPS:436700 | 21-225_149C7 | NA | AGCTATGCCATGAGC<br>SEQ ID NO:7311 | GTTATTAGTGGTGGTGGT<br>AGTAGCACATACTACG<br>AGACTCCGTGAAGGGC<br>SEQ ID NO:15323 | TGGCGAGGTAACCCCACTGA<br>CTACGGTATGGACGTC<br>SEQ ID NO:23335 |
| | | AA | SYAMS<br>SEQ ID NO:7312 | VISGGGSSTYYADSVKG<br>SEQ ID NO:15324 | WRGNPTDYGMDV<br>SEQ ID NO:23336 |
| iPS:436702 | 21-225_149E8 | NA | AGTTATATAGCATGAAC<br>SEQ ID NO:7313 | GCCATTAGTAGTAGTACTGGT<br>AGTTACATATATTACGCA<br>GACTCAGTGAAGGGC<br>SEQ ID NO:15325 | ACGGCAGTGGCTGGTACTGG<br>GTGGTTCGACCCC<br>SEQ ID NO:23337 |

FIGURE 49
(Continued)

| | | | | | | |
|---|---|---|---|---|---|---|
| iPS:436704 | 21-225_149C10 | AA | SYSMN | AISSTGSYIYYADSVKG | TAVAGTGWFDP | |
| | | | SEQ ID NO:7314 | SEQ ID NO:15326 | SEQ ID NO:23338 | |
| | | NA | AGCCACGCCATGAGC | GTTATAAGTGGAGGTGGTAGTAGCACATATTACGCAGACTCCGTGAAGGGC | TGGCGAGGTAACCCCACTGACTACGGTATGGACGTC | |
| | | | SEQ ID NO:7315 | SEQ ID NO:15327 | SEQ ID NO:23339 | |
| iPS:436706 | 21-225_149A11 | AA | SHAMS | VISGGGSSTYYADSVKG | WRGNPTDYGMDV | |
| | | | SEQ ID NO:7316 | SEQ ID NO:15328 | SEQ ID NO:23340 | |
| | | NA | AGCTATGGCATGCAC | GTTATATGGTATGATGGAAGTAATAAATACTATGCAGACTCCGTGAAGGGC | GATCGTGACTACGGTGACCCCCCCTACTACTACTACGGTATGACGTC | |
| | | | SEQ ID NO:7317 | SEQ ID NO:15329 | SEQ ID NO:23341 | |
| iPS:436708 | 21-225_150D3 | AA | SYGMH | VIWYDGSNKYYADSVKG | DRDYGDPPYYYYGMDV | |
| | | | SEQ ID NO:7318 | SEQ ID NO:15330 | SEQ ID NO:23342 | |
| | | NA | ACCTATGGCATGCAC | GTTATATGGTATGGTGGAAGTAATAAAGACTATGCAGACTCCGTGAAGGGC | GATCGGATTATTGTAGTGGTGGTACCTGCCCTTACTACTACTACGGTATGGACGTC | |
| | | | SEQ ID NO:7319 | SEQ ID NO:15331 | SEQ ID NO:23343 | |
| iPS:436710 | 21-225_150F6 | AA | TYGMH | VIWYGGSNKDYADSVKG | DRDYCSGGTCPYYYYGMDV | |
| | | | SEQ ID NO:7320 | SEQ ID NO:15332 | SEQ ID NO:23344 | |
| | | NA | AGCTATGGCCATGAGC | GTTATTAGTGGTGGTGGTAGTAGCACATACTACGCAGACTCCGTGAAGGGC | TGGCGAGGTAACCCCACTGACTACGGTATGGACGTC | |
| | | | SEQ ID NO:7321 | SEQ ID NO:15333 | SEQ ID NO:23345 | |
| | | AA | SYAMS | VISGGGSSTYYADSVKG | WRGNPTDYGMDV | |
| | | | SEQ ID NO:7322 | SEQ ID NO:15334 | SEQ ID NO:23346 | |

FIGURE 49
(Continued)

| | | | | | |
|---|---|---|---|---|---|
| iPS:436712 | 21-225_150F9 | NA | AGCTATAACATGAAC | TACATTAGTAGAAGTAGTAATACCAAACACTACGCAGACTCTGTGAAGGGC | GATAGGAGTGGGGAGCTACGGGTACTTCTACTACTACGGTTGGACGTC |
| | | | SEQ ID NO:7323 | SEQ ID NO:15335 | SEQ ID NO:23347 |
| | | AA | SYNMN | YISRSSNTKHYADSVKG | DRSGSYGYFYYYGLDV |
| | | | SEQ ID NO:7324 | SEQ ID NO:15336 | SEQ ID NO:23348 |
| iPS:436714 | 21-225_150H11 | NA | ACCTATGCCATGAGC | ATTATTAGTGGTGGTGGTAGTAGCACATACTACGCAGACTCCGTGAAGGGC | TGGCGAGGTAACCCACTGACTACGGTATGGACGTC |
| | | | SEQ ID NO:7325 | SEQ ID NO:15337 | SEQ ID NO:23349 |
| | | AA | TYAMS | IISGGGSSTYYADSVKG | WRGNPTDYGMDV |
| | | | SEQ ID NO:7326 | SEQ ID NO:15338 | SEQ ID NO:23350 |
| iPS:436716 | 21-225_151F3 | NA | ACCTATGCCATGCAC | GTTATATGGTATGGTGGAAGTAATACAGACTATGCAGACTCCGTGAAGGGC | GATCGGGATTATTGTAGTGGTACTAGCTGCCCTTACTACTACTACGGTATGGACGTC |
| | | | SEQ ID NO:7327 | SEQ ID NO:15339 | SEQ ID NO:23351 |
| | | AA | TYGMH | VIWYGGSNTDYADSVKG | DRDYCSGTSCPYYYYGMDV |
| | | | SEQ ID NO:7328 | SEQ ID NO:15340 | SEQ ID NO:23352 |
| iPS:436718 | 21-225_151H5 | NA | AGCTATGCCATGAGC | GTTATTAGTGGTGGTGGTAGTAGCACATACTACGCAGACTCCGTGAAGGGC | TGGCGAGGTAACCCACTGACTACGGTATGGACGTC |
| | | | SEQ ID NO:7329 | SEQ ID NO:15341 | SEQ ID NO:23353 |
| | | AA | SYAMS | VISGGGSSTYYADSVKG | WRGNPTDYGMDV |
| | | | SEQ ID NO:7330 | SEQ ID NO:15342 | SEQ ID NO:23354 |

FIGURE 49
(Continued)

| iPS:436720 | 21-225_151H6 | NA | GACTATGGCATGCAC | CTTATATGGTATGATGGA AGTAATAAATACTATGC AGACTCCGTGAAGGGC | GATGACCGATCTTGTAGTAG AACCAGTGCCCTTACTACT ACTACTACGGTTTGGACGTC |
|---|---|---|---|---|---|
| | | | SEQ ID NO:7331 | SEQ ID NO:15343 | SEQ ID NO:23355 |
| | | AA | DYGMH | LIWYDGSNKYYADSVKG | DDRSCSRTSCPYYYYGLDV |
| | | | SEQ ID NO:7332 | SEQ ID NO:15344 | SEQ ID NO:23356 |
| iPS:436722 | 21-225_151H7 | NA | AGCTATGCCATGAGC | GTTATTAGTGGTGGTGGT AGTAGCACATACTACGC AGACTCCGTGAAGGGC | TGGCGAGGTAACCCACTGA CTACGGTATGGACGTC |
| | | | SEQ ID NO:7333 | SEQ ID NO:15345 | SEQ ID NO:23357 |
| | | AA | SYAMS | VISGGGSSTYYADSVKG | WRGNPTDYGMDV |
| | | | SEQ ID NO:7334 | SEQ ID NO:15346 | SEQ ID NO:23358 |
| iPS:436724 | 21-225_151B9 | NA | AGCTATGCCATGAGC | GTTATTAGTGGTGGTGGT AGTAGCACATACTACGC AGACTCCGTGAAGGGC | TGGCGAGGTAACCCACTGA CTACGGTATGGACGTC |
| | | | SEQ ID NO:7335 | SEQ ID NO:15347 | SEQ ID NO:23359 |
| | | AA | SYAMS | VISGGGSSTYYADSVKG | WRGNPTDYGMDV |
| | | | SEQ ID NO:7336 | SEQ ID NO:15348 | SEQ ID NO:23360 |
| iPS:436726 | 21-225_152G5 | NA | GACTATGGCATGCAC | CTTATATGGTATGATGGA AGTAATAAATACTATGC AGACTCCGTGAAGGGC | GATGACCGATCTTGTAGTAG AACCAGTGCCCTTACTACT ACTACTACGGTTTGGACGTC |
| | | | SEQ ID NO:7337 | SEQ ID NO:15349 | SEQ ID NO:23361 |
| | | AA | DYGMH | LIWYDGSNKYYADSVKG | DDRSCSRTSCPYYYYGLDV |
| | | | SEQ ID NO:7338 | SEQ ID NO:15350 | SEQ ID NO:23362 |

FIGURE 49
(Continued)

| | | | | | |
|---|---|---|---|---|---|
| iPS:436728 | 21-225_152G6 | NA | AGCTATGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7339 | SEQ ID NO:15351 | SEQ ID NO:23363 |
| | | AA | SYAMS | VISGGGSSTYYADSVKG | WRGNPTDYGMDV |
| | | | SEQ ID NO:7340 | SEQ ID NO:15352 | SEQ ID NO:23364 |
| iPS:436730 | 21-225_152D7 | NA | AGCTATGCCATGAGC | GTTATTAGTGGTGGTGGT AGTAGCACATACTACGC AGACTCCGTGAAGGGC | TGGCGAGGTAACCCCACTGA CTCCGGTATGGACGTC |
| | | | SEQ ID NO:7341 | SEQ ID NO:15353 | SEQ ID NO:23365 |
| | | AA | SYAMS | VISGGGSSTYYADSVKG | WRGNPTDSGMDV |
| | | | SEQ ID NO:7342 | SEQ ID NO:15354 | SEQ ID NO:23366 |
| iPS:436732 | 21-225_152B12 | NA | GACTATGGCATGCAC | GTTATATGGTATGATGG AAGTAATAAATACTATG CAGACTCCGTGAAGGGC | GATGACCGATCTGTAGTAG TACCAGCTGCCCTTACTACT ACTACTACGGTTGGACGTC |
| | | | SEQ ID NO:7343 | SEQ ID NO:15355 | SEQ ID NO:23367 |
| | | AA | DYGMH | VIWYDGSNKYYADSVKG | DDRSCSSTSCPYYYYGLDV |
| | | | SEQ ID NO:7344 | SEQ ID NO:15356 | SEQ ID NO:23368 |
| iPS:436734 | 21-225_153A8 | NA | GACTATGGCATGCAC | CTTATATGGTATGATGGA AGTAATAAATACTATGC AGACTCCGTGAAGGGC | GATGACCGATCTGTAGTAG AACCAGCTGCCCTTACTACT ACTACTACGGTTGGACGTC |
| | | | SEQ ID NO:7345 | SEQ ID NO:15357 | SEQ ID NO:23369 |
| | | AA | DYGMH | LIWYDGSNKYYADSVKG | DDRSCSRTSCPYYYYGLDV |
| | | | SEQ ID NO:7346 | SEQ ID NO:15358 | SEQ ID NO:23370 |

FIGURE 49
(Continued)

| | | NA | AACTATGGCATGCAC | GTTATATGGTTTGATGGC AGTAATAAATACTATGTT GACTCCGTGAAGGAC | GATCGGGTGGAGGGTTCGGG GACTCCTACTACTACG GTATGGACGTC |
|---|---|---|---|---|---|
| iPS:436736 | 21-225_153E8 | | SEQ ID NO:7347 | SEQ ID NO:15359 | SEQ ID NO:23371 |
| | | AA | NYGMH | VIWFDGSNKYYVDSVKD | DRVEGSGTPYYYGMDV |
| | | | SEQ ID NO:7348 | SEQ ID NO:15360 | SEQ ID NO:23372 |
| iPS:436738 | 21-225_153D9 | NA | ACCTATGGCATGCAC | GTTATATGGTATGGTGG AAGTAATAAAGACTATG CAGACTCCGTGAAGGGC | GATCGGGATTATTGTAGTGG TGGTAGCTGTCCTTACTACT ACTACTACGGTATGGACGTC |
| | | | SEQ ID NO:7349 | SEQ ID NO:15361 | SEQ ID NO:23373 |
| | | AA | TYGMH | VIWYGGSNKDYADSVKG | DRDYCSGGSCPYYYYYGMDV |
| | | | SEQ ID NO:7350 | SEQ ID NO:15362 | SEQ ID NO:23374 |
| iPS:436740 | 21-225_154C3 | NA | ACCTATGGCATGCAC | GTTGTATGGTATGGTGG AAATAATAAAGACTATG CAGACTCCGTGAAGGGC | GATCGGGATTATTGTAGTGG TGGTAGCTGCCCTTACTACT ACTACTACGGTATGGACGTC |
| | | | SEQ ID NO:7351 | SEQ ID NO:15363 | SEQ ID NO:23375 |
| | | AA | TYGMH | VVWYGGNNKDYADSVK G | DRDYCSGGSCPYYYYYGMDV |
| | | | SEQ ID NO:7352 | SEQ ID NO:15364 | SEQ ID NO:23376 |
| iPS:436742 | 21-225_154C4 | NA | AGCTATGGCCATGAGC | GTTATTAGTGGTGGTGGT AGTAGCACATACTACGC AGACTCCGTGAAGGGC | TGGCGAGGTAACCCCACTGA CTACGGTATGGACGTC |
| | | | SEQ ID NO:7353 | SEQ ID NO:15365 | SEQ ID NO:23377 |
| | | AA | SYAMS | VISGGGSTYYADSVKG | WRGNPTDYGMDV |
| | | | SEQ ID NO:7354 | SEQ ID NO:15366 | SEQ ID NO:23378 |

FIGURE 49
(Continued)

| | | | | |
|---|---|---|---|---|
| iPS:436744 | 21-225_154F4 | NA | AGCTATGGCATGCAC | GTTATATGGTATGATGG AAGTAATAAATACTATG CAGACTCCGTGAAGGGC | GAGGATTCCTATTGTAGTGG TACCAGCTGCCCTACTACT ACTACTACGGTATGGACGTC |
| | | | SEQ ID NO:7355 | SEQ ID NO:15367 | SEQ ID NO:23379 |
| | | AA | SYGMH | VIWYDGSNKYADSVKG | EDSYCSGTSCPYYYYGMDV |
| | | | SEQ ID NO:7356 | SEQ ID NO:15368 | SEQ ID NO:23380 |
| iPS:436746 | 21-225_154E10 | NA | AGCTATGCCATGAGC | GTTATTAGTGGTGGTGGT AGTAGCACATACTACGC AGACTCCGTGAAGGGC | TGGCGAGGTAACCCACTGA CTACGGTATGGACGTC |
| | | | SEQ ID NO:7357 | SEQ ID NO:15369 | SEQ ID NO:23381 |
| | | AA | SYAMS | VISGGGSSTYYADSVKG | WRGNPTDYGMDV |
| | | | SEQ ID NO:7358 | SEQ ID NO:15370 | SEQ ID NO:23382 |
| iPS:436748 | 21-225_154D11 | NA | ACCTATGGCATGCAC | GTTATATGGTATGGTGG AAGTAATAAAGACTATG CAGACTCTGTGAAGGGC | GATCGGGATTATTGTAGTGG TGGTAGTTGCCCTTACTACT ACTACTACGGTATGGACGTC |
| | | | SEQ ID NO:7359 | SEQ ID NO:15371 | SEQ ID NO:23383 |
| | | AA | TYGMH | VIWYGGSNKDYADSVKG | DRDYCSGGSCPYYYYGMDV |
| | | | SEQ ID NO:7360 | SEQ ID NO:15372 | SEQ ID NO:23384 |
| iPS:436750 | 21-225_154G12 | NA | AGTGGTTATTACTACTGGAG C | TACATCTATTATAGTGGG AGCACCTACTACAACCC GTCCCTCAAGAGT | GATTGGGGTGGCTACGATTC GAGTGGCTGGTTCGACCCC |
| | | | SEQ ID NO:7361 | SEQ ID NO:15373 | SEQ ID NO:23385 |
| | | AA | SGYYYWS | YIYYSGSTYYNPSLKS | DWGGYDSSGWFDP |
| | | | SEQ ID NO:7362 | SEQ ID NO:15374 | SEQ ID NO:23386 |

FIGURE 49
(Continued)

| | | | | |
|---|---|---|---|---|
| iPS:436752 | 21-225_155H1 | NA | AGCTACTGGATCGGC | CTCATCTATCTGGTGCC TCTGATACCAGATACAG CCCGTCCTTCCAAGGC | CAGGCCATAGCAAGTCGAGG GAGGTACTACTACTACGGTA TGGACGTC |
| | | | SEQ ID NO:7363 | SEQ ID NO:15375 | SEQ ID NO:23387 |
| | | AA | SYWIG | LIYPGASDTRYSPSFQG | QAIASRGRYYYYGMDV |
| | | | SEQ ID NO:7364 | SEQ ID NO:15376 | SEQ ID NO:23388 |
| iPS:436754 | 21-225_155G3 | NA | AGCTATGGCATGCAC | GTTATATCATATGATGGA AGTAATAAATACTATGC AGACTCCGTGAAGGGC | GATACGGAGAGATGGCTACC ATACTCCTACGGTATGGACG TC |
| | | | SEQ ID NO:7365 | SEQ ID NO:15377 | SEQ ID NO:23389 |
| | | AA | SYGMH | VISYDGSNKYYADSVKG | DTERWLPYSYGMDV |
| | | | SEQ ID NO:7366 | SEQ ID NO:15378 | SEQ ID NO:23390 |
| iPS:436756 | 21-225_146A10 | NA | GGCTATGGCATGCAC | CTTATACGGTATGATGG AAGCGATAAAAACTATG CAGACTCCGTGAAGGGC | GATCGGGTTTTTTGTAGTAG TACCAGCTGCCTCTCTTACTA CTACTACTACGGTATGGACG TC |
| | | | SEQ ID NO:7367 | SEQ ID NO:15379 | SEQ ID NO:23391 |
| | | AA | GYGMH | LIRYDGSDKNYADSVKG | DRVFCSSTSCLSYYYYGMDV |
| | | | SEQ ID NO:7368 | SEQ ID NO:15380 | SEQ ID NO:23392 |
| iPS:436758 | 21-225_155C10 | NA | AGCTATGCCATGAGC | GTTATTAGTGGTGGTGGT AGTAGCACATACTACGC AGACTCCGTGAAGGGC | TGGCGAGGTAACCCACTGA CTACGGTATGGACGTC |
| | | | SEQ ID NO:7369 | SEQ ID NO:15381 | SEQ ID NO:23393 |
| | | AA | SYAMS | VISGGGSSTYYADSVKG | WRGNPTDYGMDV |
| | | | SEQ ID NO:7370 | SEQ ID NO:15382 | SEQ ID NO:23394 |

FIGURE 49
(Continued)

| | | | | | |
|---|---|---|---|---|---|
| iPS:436760 | 21-225_155E10 | NA | AGCTATGGCATGCAC | GTTATATGGTATGATGG AAGTAATAAATACTATG CAGACTCCGTGAAGGGC | GATCGTGACTACGGTGACCC CCCTACTACTACTACG GTATGGACGTC |
| | | AA | SEQ ID NO:7371 SYGMH | SEQ ID NO:15383 VIWYDGSNKYYADSVKG | SEQ ID NO:23395 DRDYGDPPYYYYYGMDV |
| iPS:436762 | 21-225_156H2 | NA | AACTATAACATGAAC | TACATTAGTAGAAGTAG TAATACCAAATACTACG CAGACTCTGTGAAGGGC | GATAGGAGTGGGAGCTACGG GTACTTCTACTACTACGGTA TGGACGTC |
| | | AA | SEQ ID NO:7372 NYNMN | SEQ ID NO:15384 YISRSSNTKYYADSVKG | SEQ ID NO:23396 DRSGSYGYFYYYGMDV |
| iPS:436764 | 21-225_158E9 | NA | AGCTATGGCATGCAC | GTTATATGGTATGATGG AAGTAGTAAATACTATG CAGACTCCGTGAAGGGC | GATCGGGTTTTTGTAGTGG TACCAGCTGCCCTTACTACT ACTACTACGGTATGGACGTC |
| | | AA | SEQ ID NO:7375 SYGMH | SEQ ID NO:15387 VIWYDGSSKYYADSVKG | SEQ ID NO:23399 DRVFCSGTSCPYYYYYGMDV |
| iPS:436766 | 21-225_158D10 | NA | AGCTATGGCATGCAC | GTTATATGGTATGATGG AAGTAATAAATACTATG CAGACTCCGTGAAGGGC | GATCGGGTTCTTCTGTAGTAG TACCAGCTGCCCTTACTACT ACTACTACGGTATGGACGTC |
| | | AA | SEQ ID NO:7377 SYGMH | SEQ ID NO:15389 VIWYDGSNKYYADSVKG | SEQ ID NO:23401 DRVSCSSTSCPYYYYYGMDV |

FIGURE 49
(Continued)

| | | | | | | | |
|---|---|---|---|---|---|---|---|
| iPS:436768 | 21-225_159H8 | NA | SEQ ID NO:7378 ACCTATGGCATGCAC | SEQ ID NO:15390 GTTATATGGTATGATGG AAGTAATAAATACTATG CAGACTCCGTGAAGGGC | SEQ ID NO:23402 GATCGGGTTTCTTGTAGTAG TACCAGCTGCCCTTACTACT ACTACTACGGTATGGACGTC |
| | | AA | SEQ ID NO:7379 TYGMH | SEQ ID NO:15391 VIWYDGSNKYYADSVKG | SEQ ID NO:23403 DRVSCSSTSCPYYYYGMDV |
| iPS:436770 | 21-225_160B12 | NA | SEQ ID NO:7380 AGCTATGGCATGCAC | SEQ ID NO:15392 GTTATATGGTATGATGG AAGTAATAAATACTATG CAGACTCCGTGAAGGGC | SEQ ID NO:23404 GATCGGGTTTCTTGTAGTAG TACCAGCTGCCCTTACTACT ACTACTACGGTATGGACGTC |
| | | AA | SEQ ID NO:7381 SYGMH | SEQ ID NO:15393 VIWYDGSNKYYADSVKG | SEQ ID NO:23405 DRVSCSSTSCPYYYYGMDV |
| iPS:436772 | 21-225_161H3 | NA | SEQ ID NO:7382 AGCTATGGCATGCAC | SEQ ID NO:15394 GTTATATGGTATGATGG AAGTAATAAATACTATG CAGACTCCGTGAAGGGC | SEQ ID NO:23406 GTCGGGTATAGCGGTGGCTG GTACATCTTTGACTAC |
| | | AA | SEQ ID NO:7383 SYGMH | SEQ ID NO:15395 VIWYDGSNKYYADSVKG | SEQ ID NO:23407 VGYSGGWYIFDY |
| iPS:436774 | 21-225_161E10 | NA | SEQ ID NO:7384 AGCTATGGCATGCAC | SEQ ID NO:15396 GTTATATGGTATGATGG AAGTAATAAATACTATG TAGACTCCGTGAAGGGC | SEQ ID NO:23408 GATCGGGTTTTTGTAGTGG TACCAGCTGCCCTTACTACT ACTACTACGGTATGGACGTC |
| | | | SEQ ID NO:7385 | SEQ ID NO:15397 | SEQ ID NO:23409 |

FIGURE 49
(Continued)

| | | | | | | |
|---|---|---|---|---|---|---|
| iPS:436776 | | AA | SYGMH SEQ ID NO:7386 | VIWYDGSNKYYVDSVKG SEQ ID NO:15398 | DRVFCSGTSCPYYYYGMDV SEQ ID NO:23410 |
| | 21-225_161F12 | NA | AGTGGTGGTTACTACTGGAGC SEQ ID NO:7387 | TACATCTATTACAGTGGGAGCCCCTACTACAACCCGTCCCTCAAGAGT SEQ ID NO:15399 | TCGAATTGTAGTAGTGCCAACTGCTATACGGTGGGGTTCTACTACTACGGTTTGGACGTC SEQ ID NO:23411 |
| | | AA | SGGYYWS SEQ ID NO:7388 | YIYYSGSPYYNPSLKS SEQ ID NO:15400 | SNCSSANCYTVGFYYYGLDV SEQ ID NO:23412 |
| iPS:436780 | 21-225_165H3 | NA | AGTGGTGGTTACTACTGGAGC SEQ ID NO:7389 | TACATCTATTACAGTGGGAGCCCCTACTACAATCCGTCCCTCAAGAGT SEQ ID NO:15401 | TCGAATTGTAGTAGTGCCAACTGCTATACGGTGGGGTTCTACTACTACGGTATGGACGTC SEQ ID NO:23413 |
| | | AA | SGGYYWS SEQ ID NO:7390 | YIYYSGSPYYNPSLKS SEQ ID NO:15402 | SNCSSANCYTVGFYYYGMDV SEQ ID NO:23414 |
| iPS:436782 | 21-225_166G11 | NA | GGCTATGGCATGCAC SEQ ID NO:7391 | GTTATATGGTATGATGGAAGTAATAAATACTATGCAGACTCCGTGAAGGGC SEQ ID NO:15403 | GATGATAGATATTGTAGTAGTCCCACCTGCCATCCTTACTACTACTACGGTCTGGACGTC SEQ ID NO:23415 |
| | | AA | GYGMH SEQ ID NO:7392 | VIWYDGSNKYYADSVKG SEQ ID NO:15404 | DDRYCSSPTCHPYYYYGLDV SEQ ID NO:23416 |

FIGURE 49
(Continued)

| | | | | |
|---|---|---|---|---|
| iPS-436784 | 21-225_169C1 | NA | AGCAATGGCATGCAC SEQ ID NO:7393 | GTTATATGGTATGATGG AAGTAATAAATACTATG CAGACTCCGTGAAGGGC SEQ ID NO:15405 | GATCAGTACAACGGAACGA CGGACCACCAGCTTACTACT ACTACTACGGTTTGGACGTC SEQ ID NO:23417 |
| | | AA | SNGMH SEQ ID NO:7394 | VIWYDGSNKYYADSVKG SEQ ID NO:15406 | DQYNRNDGPPAYYYYYGLDV SEQ ID NO:23418 |
| iPS-436786 | 21-225_169A6 | NA | AGCAATGGCATGCAC SEQ ID NO:7395 | GTTATATGGTATGATGG AAGTAATAAATACTATG CAGACTCCGTGAAGGGC SEQ ID NO:15407 | GATCAGTACAACGGAACGA CGGACCACCAGCTTACTACT ACTACTACGGTATGGACGTC SEQ ID NO:23419 |
| | | AA | SNGMH SEQ ID NO:7396 | VIWYDGSNKYYADSVKG SEQ ID NO:15408 | DQYNRNDGPPAYYYYYGMD V SEQ ID NO:23420 |
| iPS-436788 | 21-225_169B7 | NA | AGCTATAGCTTGAAC SEQ ID NO:7397 | TACATTGGTAGTAGTGG CAGTATCATATTCTACGC AGACTCTGTGAAGGGC SEQ ID NO:15409 | GGGGATACAGCTGGGGTTAC CTATTACTACGGTATGGACG TC SEQ ID NO:23421 |
| | | AA | SYSLN SEQ ID NO:7398 | YIGSSGSIIFYADSVKG SEQ ID NO:15410 | GDTAGVTYYYGMDV SEQ ID NO:23422 |
| iPS-436790 | 21-225_169G11 | NA | AGCTATGGCATGCAC SEQ ID NO:7399 | ATTATATGGTATGATGG AAGTAATAAATACTATG CAGACTCCGTGAAGGGC SEQ ID NO:15411 | GAGGGGGCTAGTATTACCA TGGTTCGGGGAGTTATTATC CGGCTACTAACTACGGTATG GACGTC SEQ ID NO:23423 |
| | | AA | SYGMH SEQ ID NO:7400 | IIWYDGSNKYYADSVKG SEQ ID NO:15412 | EGATYHGSGSYYPATNYGM DV SEQ ID NO:23424 |

FIGURE 49
(Continued)

| | | | | | |
|---|---|---|---|---|---|
| iPS:436792 | 21-225_169D12 | NA | AGCTATGGCATGCAC | GTTATATGGTATGATGG AAGTAATAAATATTATG CAGACTCCGTGAAGGGC | CCCCTTTACGATATGGGACT CTACTACGATATGGACGTC |
| | | | SEQ ID NO:7401 | SEQ ID NO:15413 | SEQ ID NO:23425 |
| | | AA | SYGMH | VIWYDGSNKYYADSVKG | PLYDMGLYDMDV |
| | | | SEQ ID NO:7402 | SEQ ID NO:15414 | SEQ ID NO:23426 |
| iPS:436794 | 21-225_170F1 | NA | GGCTATGGCATGAAC | ATTATATGGTATGATGG AAATAATAAATACTATG CAGACTCCGTGAAGGGC | GATCGGGTTTATTGTAGTAG TACCAGCTGCCATCCTATT ACTACTACGCTATGGAC GTC |
| | | | SEQ ID NO:7403 | SEQ ID NO:15415 | SEQ ID NO:23427 |
| | | AA | GYGMN | IIWYDGNKYYADSVKG | DRVYCSSTSCHPYYYYAMD V |
| | | | SEQ ID NO:7404 | SEQ ID NO:15416 | SEQ ID NO:23428 |
| iPS:436796 | 21-225_170A5 | NA | AACTGTGGCATGCAC | ATTATGGTATGATGG AAGTAATAAATACTATG CAGACTCCGTGAAGGGC | GATCAGTACACAGGAACGA CGGACCACCAGCTTACTACT ACTACTACGGTTTGGACGTC |
| | | | SEQ ID NO:7405 | SEQ ID NO:15417 | SEQ ID NO:23429 |
| | | AA | IICGMH | IIWYDGSNKYYADSVKG | DQYNRNDGPPAYYYYGLDV |
| | | | SEQ ID NO:7406 | SEQ ID NO:15418 | SEQ ID NO:23430 |
| iPS:436798 | 21-225_171F5 | NA | AGCTATAGCTTTGAAC | TACATTGGTAGTAGTGG CAGTATCATATTCTACGC AGACTCTGTGAAGGGC | GGGGATACAGCTGGGGTTAC CTATTACTACGGTATGGACG TC |
| | | | SEQ ID NO:7407 | SEQ ID NO:15419 | SEQ ID NO:23431 |
| | | AA | SYSLN | YIGSSGSIIFYADSVKG | GDTAGVTYYYGMDV |
| | | | SEQ ID NO:7408 | SEQ ID NO:15420 | SEQ ID NO:23432 |

FIGURE 49
(Continued)

| | | | | | |
|---|---|---|---|---|---|
| iPS:436800 | 21-225_171D12 | NA | AGTTACTATATGTAT | ATAATCAACCCTAGTGG TGGTAGCACAAACTACG CACAGAAGTTCCAGGGC | GGTTGGGAGTTAAACTAC |
| | | | SEQ ID NO:7409 | SEQ ID NO:15421 | SEQ ID NO:23433 |
| | | AA | SYYMY | IINPSGGSTNYAQKFQG | GWELNY |
| | | | SEQ ID NO:7410 | SEQ ID NO:15422 | SEQ ID NO:23434 |
| iPS:436802 | 21-225_171E12 | NA | AGTTATGGCATGCAC | GTTATATGGAATGATGG AGGTAATAAATATAATG GAGACTCCGTGAAGGGC | GACCGTACGTATTACTCTGG TTCGGGGAGCCCCCCTACT ACTACTACGGTATGGACGTC |
| | | | SEQ ID NO:7411 | SEQ ID NO:15423 | SEQ ID NO:23435 |
| | | AA | SYGMH | VIWNDGGNKYNGDSVKG | DRTYYSGSGSPPYYYYYGMDV |
| | | | SEQ ID NO:7412 | SEQ ID NO:15424 | SEQ ID NO:23436 |
| iPS:436804 | 21-225_172C3 | NA | AGTTACTATATGTAT | ACAATCAACCCTAGTGG TGGTAGCACAGACTACG CACAGAAGTTCCAGGGC | GGCTGGGAGTTAAACTAC |
| | | | SEQ ID NO:7413 | SEQ ID NO:15425 | SEQ ID NO:23437 |
| | | AA | SYYMY | TINPSGGSTNYAQKFQG | GWELNY |
| | | | SEQ ID NO:7414 | SEQ ID NO:15426 | SEQ ID NO:23438 |
| iPS:436806 | 21-225_172B12 | NA | AGTTACTATATGTAT | ACAATCAACCCTAGTGG TGGTAGCACAGACTACG CACAGAAGTTCCAGGGC | GGCTGGGAATTAAACTAC |
| | | | SEQ ID NO:7415 | SEQ ID NO:15427 | SEQ ID NO:23439 |
| | | AA | SYYMY | TINPSGGSTDYAQKFQG | GWELNY |
| | | | SEQ ID NO:7416 | SEQ ID NO:15428 | SEQ ID NO:23440 |
| iPS:436808 | 21-225_173F8 | NA | AGCTATGGCATGCAC | GTTATATCATATGATGGA AGTCCTAAATACTGTGC AGACTCCGTGAAGGGC | GATGAAAGGCAGTGCTGCC GGCCCCTACGGTATGGACG TC |
| | | | SEQ ID NO:7417 | SEQ ID NO:15429 | SEQ ID NO:23441 |

FIGURE 49
(Continued)

| | | | | | |
|---|---|---|---|---|---|
| iPS:436810 | 21-225_175F4 | AA | SYGMH<br>SEQ ID NO:7418 | VISYDGSPKYCADSVKG<br>SEQ ID NO:15430 | DERQWLPAPYGMDV<br>SEQ ID NO:23442 |
| | | NA | AGCAACAGTGCTGCTTGGAAC<br>SEQ ID NO:7419 | AGGACATACTACAGGTCCAAGTGGTATAATGCTTATCCAGTATCTATGAAAGT<br>SEQ ID NO:15431 | GATAAGGCAGCTGGGAGGAATGACTTCTACTACGGTATGGACGTC<br>SEQ ID NO:23443 |
| iPS:436812 | 21-225_175C6 | AA | SNSAAWN<br>SEQ ID NO:7420 | RTYYRSKWYNAYPVSMES<br>SEQ ID NO:15432 | DKAAGRNDFYYGMDV<br>SEQ ID NO:23444 |
| | | NA | AACTGTGGCATGCAC<br>SEQ ID NO:7421 | ATTATATGGTATGATGGAAGTAATAAATACTATGCAGACTCCGTGAAGGGC<br>SEQ ID NO:15433 | GATCAGTACAACAGGAACGACGGACCACCAGCTTACTACTACTACTACGGTTTGGACGTC<br>SEQ ID NO:23445 |
| iPS:436814 | 21-225_178H10 | AA | NCGMH<br>SEQ ID NO:7422 | IIWYDGSNKYYADSVKG<br>SEQ ID NO:15434 | DQYNRNDGPPAYYYYYGLDV<br>SEQ ID NO:23446 |
| | | NA | AGCAACAGTGCTGCTTGGAAC<br>SEQ ID NO:7423 | AGGACATACTACAGGTCCAAGTGGTATAGTGCTTATCCAGTATCTATGAAAGT<br>SEQ ID NO:15435 | GATAAGGCAGCTGGGAGGAATGACTTCTACTACGGTATGGACGTC<br>SEQ ID NO:23447 |
| iPS:436816 | 21-225_179H5 | AA | SNSAAWN<br>SEQ ID NO:7424 | RTYYRSKWYSAYPVSMES<br>SEQ ID NO:15436 | DKAAGRNDFYYGMDV<br>SEQ ID NO:23448 |
| | | NA | AGCTATGGCATGCAC<br>SEQ ID NO:7425 | GTTATATGGTATGATGGAAGTAATGAATACTATGCAGACTCCGTGAAGGGC<br>SEQ ID NO:15437 | GATATCCGGAACTACTACTACGGTTTGGACGTC<br>SEQ ID NO:23449 |

FIGURE 49
(Continued)

| | | | | SYGMH | SEQ ID NO:7426 | VIWYDGSNEYYADSVKG | SEQ ID NO:15438 | DIRNYYYGLDV | SEQ ID NO:23450 |
|---|---|---|---|---|---|---|---|---|---|
| iPS:436818 | 21-225_179C7 | | NA | AACTCTGGCATGCAC | SEQ ID NO:7427 | ATTATATATTGGATACGA AGTTATAAATACAATGC AGACTCCGTGAAGGGC | SEQ ID NO:15439 | GACCGTCATTAGGATTCCA CGTTCCTACTATTACTATTA CGGTATGGACGTC | SEQ ID NO:23451 |
| iPS:436820 | 21-225_179D10 | | AA | NSGMH | SEQ ID NO:7428 | IIYYDGSYKYNADSVKG | SEQ ID NO:15440 | DRHYDFHVPYYYYGMDV | SEQ ID NO:23452 |
| | | | NA | AGCTATAGCATGAAC | SEQ ID NO:7429 | TACATTAGTAGTAGTGG AAGTACCACATACACG CAGACTCTGTGCAGGGC | SEQ ID NO:15441 | GATAGTAGGAAGGGGTTCTA CTACGGTCTGGACGTC | SEQ ID NO:23453 |
| iPS:436822 | 21-225_180D4 | | AA | SYSMN | SEQ ID NO:7430 | YISSSGSTTYYADSVQG | SEQ ID NO:15442 | DSRKGFYYGLDV | SEQ ID NO:23454 |
| | | | NA | AACTTTGGCATGCAC | SEQ ID NO:7431 | ATTATATGGTATGATGG AAGTGATAAATACTATG CAGACTCCGTGAAGGGC | SEQ ID NO:15443 | GGGGGACCCCCGTTCTCTAC GGTGACTATGTACTTGACT AC | SEQ ID NO:23455 |
| iPS:436824 | 21-225_180C5 | | AA | NFGMH | SEQ ID NO:7432 | IIWYDGSDKYYADSVKG | SEQ ID NO:15444 | GGPPFSTVTMYFDY | SEQ ID NO:23456 |
| | | | NA | ACTAGTGGAGTGGGTGTGGG C | SEQ ID NO:7433 | TTCATTTCTTGGAATGAT GATAAGCGCTACAGCCC ATCTCTGAAGAGC | SEQ ID NO:15445 | AAAGCAGCAGCTGTTGCTTT TGATATC | SEQ ID NO:23457 |
| | | | AA | TSGVGVG | SEQ ID NO:7434 | FISWNDDKRYSPSLKS | SEQ ID NO:15446 | KAAAVAFDI | SEQ ID NO:23458 |

FIGURE 49
(Continued)

| | | | | | | |
|---|---|---|---|---|---|---|
| iPS:436826 | 21-225_180G5 | NA | AGTTATGATATCAAC<br>SEQ ID NO:7435 | | TGGATGAACCCTAACAG<br>TGGTAACACAGGCTATG<br>CACAGAAGTTCCAGGGC<br>SEQ ID NO:15447 | GGGTTTATTACTATGGTTCG<br>GGGAGTCATGTCCCTACCA<br>CTACTACTACGGTTTGGACG<br>TC<br>SEQ ID NO:23459 |
| | | AA | SYDIN<br>SEQ ID NO:7436 | | WMNPNSGNTGYAQKFQG<br>SEQ ID NO:15448 | GFYYYGSGSHVPYHYYYGLD<br>V<br>SEQ ID NO:23460 |
| iPS:436828 | 21-225_181H1 | NA | AACTATGGCATGCAC<br>SEQ ID NO:7437 | | ATTATATGGTATGATGG<br>AAGTGATAAATACTATG<br>CAGACTCCGTGAAGGGC<br>SEQ ID NO:15449 | GGGGGCCCCGTTTCTAC<br>GGTGACTATATGTACTTCGACT<br>AC<br>SEQ ID NO:23461 |
| | | AA | NYGMH<br>SEQ ID NO:7438 | | IIWYDGSDKYYADSVKG<br>SEQ ID NO:15450 | GGPPFSTVTMYFDY<br>SEQ ID NO:23462 |
| iPS:436830 | 21-225_51F4 | NA | AGCTATGGTATCAGC<br>SEQ ID NO:7439 | | TGGATCAGCGCTTATAAT<br>GGTAACACAAAGTATGC<br>ACAGAAGCTCCAGGGC<br>SEQ ID NO:15451 | CACGATTTTGAGTGGTTA<br>TTATAAGGGTATGGACGTC<br>SEQ ID NO:23463 |
| | | AA | SYGIS<br>SEQ ID NO:7440 | | WISAYNGNTKYAQKLQG<br>SEQ ID NO:15452 | HDFWSGYYKGMDV<br>SEQ ID NO:23464 |
| iPS:436832 | 21-225_51D8 | NA | AGTAACAGTGCTGCTTGGAA<br>C<br>SEQ ID NO:7441 | | AGGACATACTACAGGTC<br>CAAGTGGTATAATGATT<br>ATGCAGTATCTGTGAAA<br>AGT<br>SEQ ID NO:15453 | GACGCTATAACTGGAACTA<br>CCCCTACTGGTACTTCGATCT<br>C<br>SEQ ID NO:23465 |
| | | AA | SNSAAWN<br>SEQ ID NO:7442 | | RTYYRSKWYNDYAVSVK<br>S<br>SEQ ID NO:15454 | DRYNWNYPYWYFDL<br>SEQ ID NO:23466 |

FIGURE 49
(Continued)

| | | | | | |
|---|---|---|---|---|---|
| iPS:436834 | 21-225_52F1 | NA | AGCTATGGTGTCAGC | TGGATCAGCGGCTTATAATGGTAACAGAAAGTATGCACAGAAGCTCCAGGGC | CACGATTTTTGGAGTGGTTATTATAAGGGTATGGACGTC |
| | | | SEQ ID NO:7443 | SEQ ID NO:15455 | SEQ ID NO:23467 |
| | | AA | SYGVS | WISAYNGNRKYAQKLQG | HDFWSGYYKGMDV |
| | | | SEQ ID NO:7444 | SEQ ID NO:15456 | SEQ ID NO:23468 |
| iPS:436836 | 21-225_52H1 | NA | GGCTATGGCATGCAC | GTTATATGGTATGATGGAAGTAATAAATACTATGCAGACTCCGTGAAGGGC | GATGGGTCTATTGTAGTAGTTCCAGCTGCTCATATTACTACTACTACGGTATGGACGTC |
| | | | SEQ ID NO:7445 | SEQ ID NO:15457 | SEQ ID NO:23469 |
| | | AA | GYGMH | VIWYDGSNKYYADSVKG | DRVYCSSSSCSYYYYYGMDV |
| | | | SEQ ID NO:7446 | SEQ ID NO:15458 | SEQ ID NO:23470 |
| iPS:436838 | 21-225_52H4 | NA | CACTTTGGCATGCAC | GTTATTTGGTATGATGGAAGTAATAAATACTATGCAGACTCCGTGAAGGGC | GGGGACTGGAACTACGAGGGTTTTGACTAC |
| | | | SEQ ID NO:7447 | SEQ ID NO:15459 | SEQ ID NO:23471 |
| | | AA | HFGMH | VIWYDGSNKYYADSVKG | GDWNYEGFDY |
| | | | SEQ ID NO:7448 | SEQ ID NO:15460 | SEQ ID NO:23472 |
| iPS:436840 | 21-225_53E9 | NA | GGCTACTATATGCAC | TGGATCATCCCTAACAGTGGTGACACAAACTATGCACAGAAGTTTCAGGGC | GATGGGTATAGCAGTAGTGGCTGGTTCAACTGGTTCGACCCC |
| | | | SEQ ID NO:7449 | SEQ ID NO:15461 | SEQ ID NO:23473 |
| | | AA | GYYMH | WIIPNSGDTNYAQKFQG | DGYSSGWFNWFDP |
| | | | SEQ ID NO:7450 | SEQ ID NO:15462 | SEQ ID NO:23474 |

FIGURE 49
(Continued)

| | | | | | | |
|---|---|---|---|---|---|---|
| iPS:436842 | 21-225_54E9 | NA | AGCTATGGTATCAGC | TGGATTAGTGCTTATAAT GGTAACACAAAGAATGC ACAGAAGTCCAGGGC | CACGATTTTTGGAGTGGTTA TTATAAGGGTATGGACGTC | |
| | | | SEQ ID NO:7451 | SEQ ID NO:15463 | SEQ ID NO:23475 | |
| | | AA | SYGIS | WISAYNGNTKNAQKLQG | HDFWSGYYKGMDV | |
| | | | SEQ ID NO:7452 | SEQ ID NO:15464 | SEQ ID NO:23476 | |
| iPS:436844 | 21-225_56G1 | NA | AGCTATGGTATCAGC | TGGATCAGCGCTTATAAT GGTAACACAAAGTATGC ACAGAAGTTCCAGGGC | CACGATTTTTGGAGTGGTTA TTATAAGGGTATGGACGTC | |
| | | | SEQ ID NO:7453 | SEQ ID NO:15465 | SEQ ID NO:23477 | |
| | | AA | SYGIS | WISAYNGNTKYAQKFQG | HDFWSGYYKGMDV | |
| | | | SEQ ID NO:7454 | SEQ ID NO:15466 | SEQ ID NO:23478 | |
| iPS:436846 | 21-225_56E3 | NA | AGCTATGGTTTCAGC | TGGATCAGCGCTTATAAT GGTAACACAAAGGAAGC ACAGAAGTTCCAGGGC | CACGATTTTTGGAGTGGTTA TTATAAGGGTATGGACGTC | |
| | | | SEQ ID NO:7455 | SEQ ID NO:15467 | SEQ ID NO:23479 | |
| | | AA | SYGFS | WISAYNGNTKEAQKFQG | HDFWSGYYKGMDV | |
| | | | SEQ ID NO:7456 | SEQ ID NO:15468 | SEQ ID NO:23480 | |
| iPS:436848 | 21-225_57F1 | NA | ACTAGTGGAGTGGGTGTGGG C | CTCATTTATTGGCATGAA GATAAGCGCTACAGCCC ATCTCTGAAGAGC | GTCACAGGTATAGCAGCTCC CTAC | |
| | | | SEQ ID NO:7457 | SEQ ID NO:15469 | SEQ ID NO:23481 | |
| | | AA | TSGVGVG | LIYWHEDKRYSPSLKS | VTGIAAPY | |
| | | | SEQ ID NO:7458 | SEQ ID NO:15470 | SEQ ID NO:23482 | |

FIGURE 49
(Continued)

| | | | | | |
|---|---|---|---|---|---|
| iPS:436850 | 21-225_57D9 | NA | ACTAGTGGAGTGGGTGTGGG C | CTCATTTATTGGAATGAT GATAAGCGCTACAGTCC ATCTCTGAAGAGC | GCAGTGGCTGTGTCCTTTGA CTAC |
| | | | SEQ ID NO:7459 | SEQ ID NO:15471 | SEQ ID NO:23483 |
| | | AA | TSGVGVG | LIYWNDDKRYSPSLKS | AVAVSFDY |
| | | | SEQ ID NO:7460 | SEQ ID NO:15472 | SEQ ID NO:23484 |
| iPS:436852 | 21-225_57H11 | NA | ACTAGTGGAGTGGGTGTGGG C | CTCATTTATTGGCATGAA GATAGGCGCTACAGCCC ATCTCTGAAGAGC | GTCACAGTAGTATAGCAGCTCC CTAC |
| | | | SEQ ID NO:7461 | SEQ ID NO:15473 | SEQ ID NO:23485 |
| | | AA | TSGVGVG | LIYWHEDRRYSPSLKS | VTGIAAPY |
| | | | SEQ ID NO:7462 | SEQ ID NO:15474 | SEQ ID NO:23486 |
| iPS:436854 | 21-225_58C1 | NA | ACTAGTGGAGTGGGTGTGGG C | CTCATTTATTGGATGAT GATAAGCGCTACAGCCC ATCTCTGAAGAGC | CTTATAGCAGTGGCCTTTGA CTCC |
| | | | SEQ ID NO:7463 | SEQ ID NO:15475 | SEQ ID NO:23487 |
| | | AA | TSGVGVG | LIYWDDDKRYSPSLKS | LIAVAFDS |
| | | | SEQ ID NO:7464 | SEQ ID NO:15476 | SEQ ID NO:23488 |
| iPS:436856 | 21-225_58C5 | NA | AGCTATAGCATGAAC | TCCATTAGTAGTAGTAGT TATTACTTATACTACGCA GACTCAGTGAAGGGC | ACCTATAGTGGGAGTTTTGA CTAC |
| | | | SEQ ID NO:7465 | SEQ ID NO:15477 | SEQ ID NO:23489 |
| | | AA | SYSMN | SISSSSYYLYYADSVKG | TYSGSFDY |
| | | | SEQ ID NO:7466 | SEQ ID NO:15478 | SEQ ID NO:23490 |
| iPS:436858 | 21-225_58E7 | NA | TTCTATGGCATGCAC | GTTACATCATATGATGG AAGTGATAAATACTATG CAGACTCCGTGAAGGGC | GATGACTATGGTTCGGGGAG TCCCTATACTACGGTATGG ACGTC |
| | | | SEQ ID NO:7467 | SEQ ID NO:15479 | SEQ ID NO:23491 |
| | | AA | FYGMH | VTSYDGSDKYYADSVKG | DDYGSGSPLYYGMDV |

FIGURE 49
(Continued)

| | | | | SEQ ID NO:7468 | SEQ ID NO:15480 CACATAAGCAAGATGG AAGTGAGAAATACTATG TGGACTCTGTGAAGGGC | SEQ ID NO:23492 GGGGACCTCCATACAGCTC GGGCTACTACTACGGTATGG ACGTC |
| iPS:436860 | 21-225_58F7 | NA | AGCTTTTGGATGAGC | | |
| | | AA | SFWMS | SEQ ID NO:7469 | SEQ ID NO:15481 HIKQDGSEKYYVDSVKG | SEQ ID NO:23493 GDLPYSSGYYYGMDV |
| iPS:436862 | 21-225_58F8 | NA | AGCTATGGCATGCAC | SEQ ID NO:7470 | SEQ ID NO:15482 GTTATATCATATGATGGA AGTAATAAATACTATGC AGACTCCGTGAAGGGC | SEQ ID NO:23494 GATGAGGGACGTGGATATGG TGGCTACGAGAGGGATATT ACTACTACTACGGTATG GACGTC |
| | | AA | SYGMH | SEQ ID NO:7471 | SEQ ID NO:15483 VISYDGSNKYYADSVKG | SEQ ID NO:23495 DEGRGYGGYERGYYYYYG MDV |
| iPS:436864 | 21-225_58G11 | NA | AGCTATAGCATGAAC | SEQ ID NO:7472 | SEQ ID NO:15484 TACATTAGTACTAGTAGT AGTACCATATTCTACGCA GACTCTGTGAAGGGC | SEQ ID NO:23496 GGGGATACAGCTATGGTCCT CTACTACTACGGTATGGACG TC |
| | | AA | SYSMN | SEQ ID NO:7473 | SEQ ID NO:15485 YISTSSSTIFYADSVKG | SEQ ID NO:23497 GDTAMVLYYYGMDV |
| iPS:436866 | 21-225_59F2 | NA | AGCTATAGCATGAAC | SEQ ID NO:7474 | SEQ ID NO:15486 TACATTAGTGGGAGTAG TAATATCATATACTACAC AGACTCTGTGAAGGGC | SEQ ID NO:23498 GCGGATACACCTATGGTCCT TTACTTCTACGGTATGGACG TC |
| | | AA | SYSMN | SEQ ID NO:7475 | SEQ ID NO:15487 YISGSSNIYYTDSVKG | SEQ ID NO:23499 ADTPMVLYFYGMDV |
| | | | | SEQ ID NO:7476 | SEQ ID NO:15488 | SEQ ID NO:23500 |

FIGURE 49
(Continued)

| | | | | | |
|---|---|---|---|---|---|
| iPS:436868 | 21-225_59B11 | NA | AGTTATGGGCTGTGCAC | GCTATATGGTATGATGG AAGTAATAAATACTATG CAGACTCCGTGAAGGGC | GATAGGGACTATTGTAGTAG TTCCAGCTGCCCTACTACTA CTACTACGGTATGGACGTC |
| | | | SEQ ID NO:7477 | SEQ ID NO:15489 | SEQ ID NO:23501 |
| | | AA | SYGVH | AIWYDGSNKYYADSVKG | DRDYCSSSSCPYYYYGMDV |
| | | | SEQ ID NO:7478 | SEQ ID NO:15490 | SEQ ID NO:23502 |
| iPS:436870 | 21-225_60B1 | NA | ACTAGTGGAGTGGGTGTGG C | CTCATTATTGGCATGAA GATAAGCCCTACAGCCC ATCTCTGAAGAGC | GTCACATATAGCAGCTCC CTAC |
| | | | SEQ ID NO:7479 | SEQ ID NO:15491 | SEQ ID NO:23503 |
| | | AA | TSGVGVG | LIYWHEDKRYSPSLKS | VTYIAAPY |
| | | | SEQ ID NO:7480 | SEQ ID NO:15492 | SEQ ID NO:23504 |
| iPS:436872 | 21-225_60D2 | NA | AGCTATAGCATGAAC | TACATTAGTAGAGAGTAG TAATATCATATACTACAC AGACTCTGTGAAGGGC | GCGGATACACCTATGGTCCT TTACTCTACGGTATGGACG TC |
| | | | SEQ ID NO:7481 | SEQ ID NO:15493 | SEQ ID NO:23505 |
| | | AA | SYSMN | YISESSNIIYTDSVKG | ADTPMVLYFYGMDV |
| | | | SEQ ID NO:7482 | SEQ ID NO:15494 | SEQ ID NO:23506 |
| iPS:436874 | 21-225_60A12 | NA | ACTAGTGGAGTGGGTGTGG C | CTCATTATTGGGATGAT GATAAGCGCTACAGCCC ATCTCTGAAGAGC | CTTATAGCAGTGGCCTTTGA CTCC |
| | | | SEQ ID NO:7483 | SEQ ID NO:15495 | SEQ ID NO:23507 |
| | | AA | TSGVGVG | LIYWDDDKRYSPSLKS | LIAVAFDS |
| | | | SEQ ID NO:7484 | SEQ ID NO:15496 | SEQ ID NO:23508 |
| iPS:436876 | 21-225_61F5 | NA | ACTAGTGGGTTGGGTGTGG C | CTCATTATTCACATGAA GATAAGCGCTACAGCCC ATCTCTGAAGAGC | GTCACAGGTATAGCAGCTCC CTAC |
| | | | SEQ ID NO:7485 | SEQ ID NO:15497 | SEQ ID NO:23509 |

FIGURE 49
(Continued)

| | | | | | |
|---|---|---|---|---|---|
| iPS:436878 | 21-225_62E3 | AA | TSGLGVG SEQ ID NO:7486 | LIYSHEDKRYSPSLKS SEQ ID NO:15498 | VTGIAAPY SEQ ID NO:23510 |
| | | NA | ACTAGTGGAGTGGGTGTGGGC SEQ ID NO:7487 | CTCATTAATTGAATGATGATAAGCGCTACAGCCCATCTCTGAAGAGC SEQ ID NO:15499 | AAAGCTACCTGGGTGGCTTTTGATATC SEQ ID NO:23511 |
| iPS:436880 | 21-225_62E8 | AA | TSGVGVG SEQ ID NO:7488 | LINWNDDKRYSPSLKS SEQ ID NO:15500 | KATWVAFDI SEQ ID NO:23512 |
| | | NA | ACTAGTGGAGTGGGTGTGGGC SEQ ID NO:7489 | CTCATTAATTGAATGGAATGATGATAAGCGCTACAGCCCATCTCTGAAGAGC SEQ ID NO:15501 | AAAGCTACCTGGGTGGCTTTTGATATC SEQ ID NO:23513 |
| iPS:436882 | 21-225_62D10 | AA | TSGVGVG SEQ ID NO:7490 | LINWNDDKRYSPSLKS SEQ ID NO:15502 | KATWVAFDI SEQ ID NO:23514 |
| | | NA | ACTAGTGGAGTGGGTGTGGGC SEQ ID NO:7491 | CTCATTAATTGAATGATGATAAACGCTACAGCCCATCTCTGAAGAGC SEQ ID NO:15503 | AAAGCTACCTGGGTGGCTTTTGATATC SEQ ID NO:23515 |
| iPS:436884 | 21-225_62A12 | AA | TSGVGVG SEQ ID NO:7492 | LINWNDDKRYSPSLKS SEQ ID NO:15504 | KATWVAFDI SEQ ID NO:23516 |
| | | NA | ACTAGTGGAGTGGGTGTGGGC SEQ ID NO:7493 | CTCATTAATTGAATGATGATAAACCGCTACAGCCCATCTCTGAAGAGC SEQ ID NO:15505 | AAAACTACCTGGGTGGCTTTTGATATC SEQ ID NO:23517 |
| iPS:436886 | 21-225_62B12 | AA | TSGVGVG SEQ ID NO:7494 | LINWNDDKRYSPSLKS SEQ ID NO:15506 | KTTWVAFDI SEQ ID NO:23518 |
| | | NA | ACTAGTGGAGTGGGTGTGGGC SEQ ID NO:7495 | CTCATTAATTGAATGATGATAAGCGCTACAGCCCGTCTCTGAAGAGC SEQ ID NO:15507 | AAAGCTACCTGGGTGGCTTTTGATATC SEQ ID NO:23519 |

FIGURE 49
(Continued)

| | | | | | | |
|---|---|---|---|---|---|---|
| iPS:436888 | 21-225_63G7 | AA | TSGVGVG | | LINWNDDKRYSPSLKS | KATWVAFDI |
| | | | SEQ ID NO:7496 | | SEQ ID NO:15508 | SEQ ID NO:23520 |
| | | NA | AGCTATAGCATGAAC | | TACATTAGTAGTAGTACTAGTACCATATACTACGCAGCCCTCTGTGAAGGGC | GATCACCGTTACTATGATAGTAGTGGTTATTACTCTGATGCTTTTGATATC |
| | | | SEQ ID NO:7497 | | SEQ ID NO:15509 | SEQ ID NO:23521 |
| iPS:436890 | 21-225_63A10 | AA | SYSMN | | YISSSTSTIYYAASVKG | DHRYYDSSGYYSDAFDI |
| | | | SEQ ID NO:7498 | | SEQ ID NO:15510 | SEQ ID NO:23522 |
| | | NA | AGCTATAGCATGAAC | | TACATTAGTAGTAGTACTAGTACCATATACTACGCAGCCCTCTGTGAAGGGC | GATCACCGTTACTATGATAGTAGTGGTTATTACTCTGATGCTTTTGATATC |
| | | | SEQ ID NO:7499 | | SEQ ID NO:15511 | SEQ ID NO:23523 |
| iPS:436892 | 21-225_65E9 | AA | SYSMN | | YISSSTSTIYYAASVKG | DHRYYDSSGYYSDAFDI |
| | | | SEQ ID NO:7500 | | SEQ ID NO:15512 | SEQ ID NO:23524 |
| | | NA | GGCTACTATATGCAC | | TGGATCAACCCTAACAGTGGTGGCACAAGTTATGCACAGAAGTTTCAGGGC | GCGTATTATTATGGTTCGGGGAGTTATTATAATGAATTTGATATG |
| | | | SEQ ID NO:7501 | | SEQ ID NO:15513 | SEQ ID NO:23525 |
| iPS:436894 | 21-225_66G9 | AA | GYYMH | | WINPNSGGTNYAQKFQG | AYYYGSGSYYNEFDM |
| | | | SEQ ID NO:7502 | | SEQ ID NO:15514 | SEQ ID NO:23526 |
| | | NA | ACTAGTGGAGTGGGTGTGGGC | | CTCATTAATTGGAATGATGATAAGCGCCTTCAGCCCATCTCTGAAGAGC | AAAGCTACCTGGGTGGCTTTTGATATC |
| | | | SEQ ID NO:7503 | | SEQ ID NO:15515 | SEQ ID NO:23527 |
| iPS:436896 | 21-225_67F10 | AA | TSGVGVG | | LINWNDDKRFSPSLKS | KATWVAFDI |
| | | | SEQ ID NO:7504 | | SEQ ID NO:15516 | SEQ ID NO:23528 |
| | | NA | GGCTACTATATGCAC | | TGGATCAACCCTAACAGTGGTGGCACAAACTATGGACAGAAGTTTCAGGGC | ACGTATTTCTATGGTTCGGGGAGTTATTATAACGGCTTTGACTAC |
| | | | SEQ ID NO:7505 | | SEQ ID NO:15517 | SEQ ID NO:23529 |

FIGURE 49
(Continued)

| | | | | | | | |
|---|---|---|---|---|---|---|---|
| iPS:436898 | 21-225_68D8 | AA | GYYMH | SEQ ID NO:7506 | WINPNSGGTNYGQKFQG | SEQ ID NO:15518 | TYFYGSGSYYNGFDY | SEQ ID NO:23530 |
| | | NA | AGCAACAGTGCTGCTTGGAAC | SEQ ID NO:7507 | AGGACATACTACAGGTCCGAGTGCTATAATGATTATGCAGTATCTGTGCAGAGT | SEQ ID NO:15519 | GATAGAGGGCATAGAGGGTTCTACGGTATGGACGTC | SEQ ID NO:23531 |
| iPS:436900 | 21-225_69B9 | AA | SNSAAWN | SEQ ID NO:7508 | RTYYRSECYNDYAVSVQS | SEQ ID NO:15520 | DRGHRGFYGMDV | SEQ ID NO:23532 |
| | | NA | GGCTACCATATGCAC | SEQ ID NO:7509 | TGGATCAACCCTAACAGTGGTGGCACAAATTATGCACAGAAGTTTCAGGGC | SEQ ID NO:15521 | GCGTATTATTATGGTTCGGGGAGTTATTATAATGAATCTGATATG | SEQ ID NO:23533 |
| iPS:436902 | 21-225_69B11 | AA | GYHMH | SEQ ID NO:7510 | WINPNSGGTNYAQKFQG | SEQ ID NO:15522 | AYYYGSGSYYNESDM | SEQ ID NO:23534 |
| | | NA | GGCTACTATATGCAC | SEQ ID NO:7511 | TGGATCAACCCTAACAGTGGTGGCACAAACTATGGACAGAAGTTTCAGGAC | SEQ ID NO:15523 | ACGTATTACTATGGGTCGGGGAGTTATTATAACGGCTTTGACTAC | SEQ ID NO:23535 |
| iPS:436904 | 21-225_71D4 | AA | GYYMH | SEQ ID NO:7512 | WINPNSGGTNYGQKFQD | SEQ ID NO:15524 | TYYYGGSGSYYNGFDY | SEQ ID NO:23536 |
| | | NA | GGCTACTGTATGCAC | SEQ ID NO:7513 | TGGATCAACCCTAACAGTGGTGGCACAAACTATGCACAGAAGTTTCAGGTC | SEQ ID NO:15525 | GCGTATTACTATGGTTCGGGGACTTATCATAACGAATTTG ACTAC | SEQ ID NO:23537 |
| | | AA | GYCMH | SEQ ID NO:7514 | WINPNSGGTNYAQKFQV | SEQ ID NO:15526 | AYYYGSGTYHNEFDY | SEQ ID NO:23538 |

FIGURE 49
(Continued)

| | | | | | |
|---|---|---|---|---|---|
| iPS:436906 | 21-225_72B4 | NA | GGCTACTATATGCAC | TGGATCAACCCTAACAG TGGTGGCACAAACTATG GACAGAAGTTTCAGGGC | ACGTATTACTATGGTTCGGG GAGTTATTATAACGGCTTTG ACTAC |
| | | | SEQ ID NO:7515 | SEQ ID NO:15527 | SEQ ID NO:23539 |
| | | AA | GYYMH | WINPNSGGTNYGQKFQG | TYYYGSGSYYNGFDY |
| | | | SEQ ID NO:7516 | SEQ ID NO:15528 | SEQ ID NO:23540 |
| iPS:436908 | 21-225_72D5 | NA | ACTAGTGGAGTGGGTGTGGG C | CTCATTAATTGGAATGAT GATAAGCGCTACAGCCC ATCTCTGAAGAGC | AAAGCTACCTGGGGTGGCTTT TGATATC |
| | | | SEQ ID NO:7517 | SEQ ID NO:15529 | SEQ ID NO:23541 |
| | | AA | TSGVGVG | LINWNDDKRYSPSLKS | KATWVAFDI |
| | | | SEQ ID NO:7518 | SEQ ID NO:15530 | SEQ ID NO:23542 |
| iPS:436910 | 21-225_73G1 | NA | TACTATGGCATGCAC | GTTACAACATATGATGG AAGTAATAAATACTATG CAGACTCCGTGAAGGGC | GAGACTGGAACCTGGGGCTTT TGATATC |
| | | | SEQ ID NO:7519 | SEQ ID NO:15531 | SEQ ID NO:23543 |
| | | AA | YYGMH | VTTYDGSNKYYADSVKG | ETGTWAFDI |
| | | | SEQ ID NO:7520 | SEQ ID NO:15532 | SEQ ID NO:23544 |
| iPS:436912 | 21-225_73C4 | NA | ACTAGTGGAGTGGGTGTGGG C | CTCATTAATTGGAATGAT GATAAGCGCTACAGCCC ATCTCTGAAGAGC | AAAACTACCTGGGTGGCTTT TGATATC |
| | | | SEQ ID NO:7521 | SEQ ID NO:15533 | SEQ ID NO:23545 |
| | | AA | TSGVGVG | LINWNDDKRYSPSLKS | KTTWVAFDI |
| | | | SEQ ID NO:7522 | SEQ ID NO:15534 | SEQ ID NO:23546 |
| iPS:436914 | 21-225_76B4 | NA | ACTGGTGGAGTGGGTGTGGG C | CTCATTATTGGGATGAT GATAAGCGCTACAGCCC ATCTCTGAAGAGC | CTTATAGCAGTGGCCTTTGA CTAC |
| | | | SEQ ID NO:7523 | SEQ ID NO:15535 | SEQ ID NO:23547 |

FIGURE 49
(Continued)

| | | AA | TGGVGVG | LIYWDDKRYSPSLKS | LIAVAFDY |
|---|---|---|---|---|---|
| iPS:436916 | 21-225_74A9 | NA | AGCTATGGCATGCAC | GTTATATGGTATGATGG AATATAAATCCTATG CAGACTCCGTGAAGGGC | SEQ ID NO:23548 GATCGAGATTATTGTAGTGG TACCAGCTGCCCTTATTA CTACTACGGTATGGACGTC |
| | | | SEQ ID NO:7524 | SEQ ID NO:15536 | |
| | | | SEQ ID NO:7525 | SEQ ID NO:15537 | SEQ ID NO:23549 |
| | | AA | SYGMH | VIWYDGNNKSYADSVKG | DRDYCSGTSCPYYYYGMDV |
| | | | SEQ ID NO:7526 | SEQ ID NO:15538 | SEQ ID NO:23550 |
| iPS:436918 | 21-225_77A2 | NA | ACTAGTGGAGTGGGTGTGGG C | TTCATTTATTGGGATGAT GATAAGCGCTACAGCCC ATCTCTGAAGAGC | CTTATATAGCAGTGGCCTTTGA CTAC |
| | | | SEQ ID NO:7527 | SEQ ID NO:15539 | SEQ ID NO:23551 |
| | | AA | TSGVGVG | FIYWDDKRYSPSLKS | LIAVAFDY |
| | | | SEQ ID NO:7528 | SEQ ID NO:15540 | SEQ ID NO:23552 |
| iPS:436920 | 21-225_74E5 | NA | AGTGGTGGTTACTACTGGAG C | TACATCTATTACAGTGGG AGCACTACTACAACCC GTCCCTCAGGAGT | GATTCACCAGTGGCTGGTAC TGACTAC |
| | | | SEQ ID NO:7529 | SEQ ID NO:15541 | SEQ ID NO:23553 |
| | | AA | SGGYYWS | YIYYSGSTYYNPSLRS | DSPVAGTDY |
| | | | SEQ ID NO:7530 | SEQ ID NO:15542 | SEQ ID NO:23554 |
| iPS:436922 | 21-225_78E9 | NA | AGCTATGGCATGCAC | GTTATATGGTATGATGG AATATAAATCCTATG CAGACTCCGTGAAGGGC | GATCGAGATTATTGTAGTAG TACCAGCTGCCCTTATTA CTACTACGGTATGGACGTC |
| | | | SEQ ID NO:7531 | SEQ ID NO:15543 | SEQ ID NO:23555 |
| | | AA | SYGMH | VIWYDGNNKSYADSVKG | DRDYCSSTSCPYYYYGMDV |
| | | | SEQ ID NO:7532 | SEQ ID NO:15544 | SEQ ID NO:23556 |

FIGURE 49
(Continued)

| | | | | | |
|---|---|---|---|---|---|
| iPS:436924 | 21-225_74B3 | NA | CGATATGGCATGCAC SEQ ID NO:7533 | GTTTTTTGGTATGATGGA AGTAATAAAGACTATGC AGACTCCGTGAAGGGC SEQ ID NO:15545 | GATCGAGATTATTGTAGTAG TACCAGCTGCCTTACTACT ACTACTACGGTATGGACGTC SEQ ID NO:23557 |
| | | AA | RYGMH SEQ ID NO:7534 | VFWYDGSNKDYADSVKG SEQ ID NO:15546 | DRDYCSSTSCPYYYYGMDV SEQ ID NO:23558 |
| iPS:436926 | 21-225_78D10 | NA | AGTGGTGGTTACTACTGGAG C SEQ ID NO:7535 | TACATCTATTACATTGGG AGTGTTTACTACAACCCG TCCCTCAAGAGT SEQ ID NO:15547 | GATGCCCCGACTTCGGTAT GGACGTC SEQ ID NO:23559 |
| | | AA | SGGYYWS SEQ ID NO:7536 | YIYYIGSVYYNPSLKS SEQ ID NO:15548 | DAPDFGMDV SEQ ID NO:23560 |
| iPS:436928 | 21-225_79E7 | NA | AGCTATGGCATGCAC SEQ ID NO:7537 | GTTATATGGTATGATGG AAATAATAAATCCTATG CAGACTCCGTGAAGGGC SEQ ID NO:15549 | GATCGAGATTATTGTAGTAG TACCAGCTGCCTTATTATTA CTACTACGGTATGGACGTC SEQ ID NO:23561 |
| | | AA | SYGMH SEQ ID NO:7538 | VIWYDGNNKSYADSVKG SEQ ID NO:15550 | DRDYCSSTSCPYYYYGMDV SEQ ID NO:23562 |
| iPS:436932 | 21-225_92A4 | NA | AGCTATGGCATGCAC SEQ ID NO:7539 | GTTATATGGTATGATGG AAATAATAAATCCTATG CAGACTCCGTGAAGGGC SEQ ID NO:15551 | GATCGAGATTATTGTAGTAG TACCAGCTGCCTTATTATTA CTACTACGGTATGGACGTC SEQ ID NO:23563 |
| | | AA | SYGMH SEQ ID NO:7540 | VIWYDGNNKSYADSVKG SEQ ID NO:15552 | DRDYCSSTSCPYYYYGMDV SEQ ID NO:23564 |

FIGURE 49
(Continued)

| | | | | |
|---|---|---|---|---|
| iPS:436934 | 21-225_96B5 | NA | ACTGGTGGAGTGGGTGTGG C SEQ ID NO:7541 | CTCATTTATTGGGATGAT GATAAGCGCTACAGCCC ATCTCTGAAGAGC SEQ ID NO:15553 | CTTATAGCAGTGGCCTGTGA CTAC SEQ ID NO:23565 |
| | | AA | TGGVGVG SEQ ID NO:7542 | LIYWDDDKRYSPSLKS SEQ ID NO:15554 | LIAVACDY SEQ ID NO:23566 |
| iPS:436936 | 21-225_97E6 | NA | AGCTATGGCATGCAC SEQ ID NO:7543 | GTTATATGGTATGATGG AAATAATAAATCCTATG CAGACTCCGTGAAGGGC SEQ ID NO:15555 | GATCGAGATTATTGTAGTAG TACCAGTCGCCCTTATTATTA CTACTACGGTATGGACGTC SEQ ID NO:23567 |
| | | AA | SYGMH SEQ ID NO:7544 | VIWYDGNNKSYADSVKG SEQ ID NO:15556 | DRDYCSSTSCPYYYYYGMDV SEQ ID NO:23568 |
| iPS:436938 | 21-225_146A3 | NA | AGCTATGGCCATGAGC SEQ ID NO:7545 | GTTATTAGTGGTGGTGGT ACTACCACATACTACGC AGACTCCGTGAAGGGC SEQ ID NO:15557 | TGGCGAGGTAACCCACTGA CTACGGTATGGACGTC SEQ ID NO:23569 |
| | | AA | SYAMS SEQ ID NO:7546 | VISGGGTTTYYADSVKG SEQ ID NO:15558 | WRGNPTDYGMDV SEQ ID NO:23570 |
| iPS:436940 | 21-225_146B8 | NA | ACCTATGGCATGCAC SEQ ID NO:7547 | GTTGTATGGTATGGTGG AAATGATAAAGACTTTG CAGACTCCGTGACGGGC SEQ ID NO:15559 | GATCGGGATTATTGTAGTGG TGGTAGCTGCCCTTACTACT ACTACTACGGTATGGACGTC SEQ ID NO:23571 |
| | | AA | TYGMH SEQ ID NO:7548 | VVWYGGNDKDFADSVTG SEQ ID NO:15560 | DRDYCSGGSCPYYYYYGMDV SEQ ID NO:23572 |

FIGURE 49
(Continued)

| | | | | | |
|---|---|---|---|---|---|
| iPS:436942 | 21-225_146H8 | NA | AGTTATGATATCAAT SEQ ID NO:7549 | TGGATGAACCCTAACAGTGGTAACACAGGCTATGCACAGAAGTTCCAGGGC SEQ ID NO:15561 | GGAGATTATTACTATGATAGTAGTGGTCACCAGCCTACTACTACTACGGTATGGACGTC SEQ ID NO:23573 |
| | | AA | SYDIN SEQ ID NO:7550 | WMNPNSGNTGYAQKFQG SEQ ID NO:15562 | GDYYYDSSGHQPYYYYYGMDV SEQ ID NO:23574 |
| iPS:436944 | 21-225_182D12 | NA | ACTACTGGAGTGGGTGTGGC SEQ ID NO:7551 | ATCCTTTTTTGGAATGATGATGAGCGCTACAGCCCATCTCTGAAGAGC SEQ ID NO:15563 | AAATGGCAGCTCGTCTACTTTGACTAC SEQ ID NO:23575 |
| | | AA | TTGVGVG SEQ ID NO:7552 | ILFWNDDERYSPSLKS SEQ ID NO:15564 | KSQLVYFDY SEQ ID NO:23576 |
| iPS:436946 | 21-225_183F4 | NA | AGTTATGGCATGCAC SEQ ID NO:7553 | GTTATATGGTATGATGGAAGTAATAAATACTATGCAGACTCCGTGAAGGGC SEQ ID NO:15565 | GAAAGGACGTATTGTAGTGGTACCACCTGCCCCTACTACTACTACGGTCTGGGCGTC SEQ ID NO:23577 |
| | | AA | SYGMH SEQ ID NO:7554 | VIWYDGSNKYYADSVKG SEQ ID NO:15566 | ERTYCSGTTCPYYYYYGLGV SEQ ID NO:23578 |
| iPS:436948 | 21-225_183F5 | NA | AGTTATGGCATGCTC SEQ ID NO:7555 | GTTATATGGTATGATGGAAGTGGTAAATACTATGCAGACTCCGTGAAGGGC SEQ ID NO:15567 | GAGAATTTTTGGAGTGGTGACTAC SEQ ID NO:23579 |
| | | AA | SYGML SEQ ID NO:7556 | VIWYDGSGKYYADSVKG SEQ ID NO:15568 | ENFWSGDY SEQ ID NO:23580 |

FIGURE 49 (Continued)

| iPS: | Clone | | | | | |
|---|---|---|---|---|---|---|
| iPS:436950 | 21-225_184G4 | NA | AGCTATGGCATGCAC SEQ ID NO:7557 | ATTATATGGTATGATGG AAGTAATAAATACTATG CAGACTCCGTGAAGGGC SEQ ID NO:15569 | GGGGGGCCCCGTTCTCTAC GGTGACTATGTACTTGACT AC SEQ ID NO:23581 |
| | | AA | SYGMH SEQ ID NO:7558 | IIWYDGSNKYYADSVKG SEQ ID NO:15570 | GGPPFSTVTMYFDY SEQ ID NO:23582 |
| iPS:436952 | 21-225_185D2 | NA | AACTATGGCATGCAC SEQ ID NO:7559 | ATTATATGGTATGATGG AAGTGATAAATACTATG CAGACTCCGTGAAGGGC SEQ ID NO:15571 | GGGGGGCCCCGTTCTCTAC GGTGACTATGTACTTGACT AC SEQ ID NO:23583 |
| | | AA | NYGMH SEQ ID NO:7560 | IIWYDGSDKYYADSVKG SEQ ID NO:15572 | GGPPFSTVTMYFDY SEQ ID NO:23584 |
| iPS:436954 | 21-225_185G7 | NA | ACTGGTGGAGTGGGTGTGG C SEQ ID NO:7561 | CTCATTATTGGAATGAT GATGAGCGCTACAGCCC ATCTCTGAAGAGC SEQ ID NO:15573 | ATTATAGCAGTGGCCTTCCA GCAT SEQ ID NO:23585 |
| | | AA | TGGVGVG SEQ ID NO:7562 | LIYWNDDERYSPSLKS SEQ ID NO:15574 | IIAVAFQH SEQ ID NO:23586 |
| iPS:436956 | 21-225_186H6 | NA | ACTAGTGGAGTGGGTGTGG C SEQ ID NO:7563 | TTCATTTCTTGGAATGAT GATAAGGCTACAGCCC ATCTCTGAAGAGC SEQ ID NO:15575 | AAAGCAGCAGCTGTTGCTTT TGATATC SEQ ID NO:23587 |
| | | AA | TSGVGVG SEQ ID NO:7564 | FISWNDDKRYSPSLKS SEQ ID NO:15576 | KAAAVAFDI SEQ ID NO:23588 |
| iPS:436958 | 21-225_190D1 | NA | AGTGGTGGTTACTACTGGAG C SEQ ID NO:7565 | TACATCTATTACAGTGGG AGCACCTACTACAACCC GTCCCTCAAGAGT SEQ ID NO:15577 | GATTCCCCACTACGAGGCTT TGACTAC SEQ ID NO:23589 |
| | | AA | SGGYYWS | YIYYSGSTYYNPSLKS | DSPLRGFDY |

FIGURE 49
(Continued)

| | | | | | |
|---|---|---|---|---|---|
| iPS:436960 | 21-225_198D2 | NA | SEQ ID NO:7566 AGCTATGGCATGCAT | SEQ ID NO:15578 GTTATAATATGATGG AAGTTATAAGTACTATG CAGACTCCGTGAAGGC | SEQ ID NO:23590 ACGTATAGCGGGGGTATGGA CGTC |
| | | AA | SEQ ID NO:7567 SYGMH | SEQ ID NO:15579 VIIYDGSYKYYADSVKG | SEQ ID NO:23591 TYSGGMDV |
| iPS:436962 | 21-225_190H1 | NA | SEQ ID NO:7568 AGGAAAAGTGCTACTTGGAA C | SEQ ID NO:15580 AAGACATACTACAGGTC CAAGTGGTATAATGATT ATGCAGTATCTGTGAAA AGT | SEQ ID NO:23592 GATCCGGGTGGCCTCTTTGA CTAC |
| | | AA | SEQ ID NO:7569 RKSATWN | SEQ ID NO:15581 KTYYRSKWYNDYAVSVK S | SEQ ID NO:23593 DPGGLFDY |
| iPS:436964 | 21-225_190B3 | NA | SEQ ID NO:7570 AACTATGGCATACAC | SEQ ID NO:15582 GTTATATGGTTTGATGGA GATAATAAATACTATGC AGACTCCGTGAAGGGC | SEQ ID NO:23594 GATAACTGGAACTACGGCGA TCACTACTACTACTTCGGTAT GGACGTC |
| | | AA | SEQ ID NO:7571 NYGIH | SEQ ID NO:15583 VIWFDGDNKYYADSVKG | SEQ ID NO:23595 DNWNYGDHYYFGMDV |
| iPS:436966 | 21-225_190C3 | NA | SEQ ID NO:7572 AGCTATGGCATGCAC | SEQ ID NO:15584 GTTATATGGTATGATGG AAGTAATAAATACTATG CAGACTCCGTGAAGGGC | SEQ ID NO:23596 TGGTACTACTACTACTACGG TATGGACGTC |
| | | AA | SEQ ID NO:7573 SYGMH | SEQ ID NO:15585 VIWYDGSNKYYADSVKG | SEQ ID NO:23597 WYYYYGMDV |

FIGURE 49
(Continued)

| | | | | | |
|---|---|---|---|---|---|
| iPS:436968 | 21-225_190B10 | NA | SEQ ID NO:7574<br>AGCTATGGCATGCAC | SEQ ID NO:15586<br>GTTATATGGAATGATGG<br>AAGTAAAAATACCATG<br>TAGACTCCGTGAAGGGC | SEQ ID NO:23598<br>GATCTGGATAAGAGGAACTT<br>TCCTTATTACTACTACTACGG<br>TATGGACGTC |
| | | AA | SEQ ID NO:7575<br>SYGMH | SEQ ID NO:15587<br>VIWNDGSKKYHVDSVKG | SEQ ID NO:23599<br>DLDKRNFPYYYYYGMDV |
| iPS:436970 | 21-225_190B8 | NA | SEQ ID NO:7576<br>AGCTATGGCATGCAC | SEQ ID NO:15588<br>GTTATATGGTTTGATGGA<br>AGTAATAAATACTATAC<br>AGACTCCGTGAAGGGC | SEQ ID NO:23600<br>GATAACTGGAACTACGGCGA<br>TTACTACTACTACTACGTA<br>TGGACGTC |
| | | AA | SEQ ID NO:7577<br>SYGMH | SEQ ID NO:15589<br>VIWFDGSNKYYTDSVKG | SEQ ID NO:23601<br>DNWNYGDYYYYYGMDV |
| iPS:436972 | 21-225_190C7 | NA | SEQ ID NO:7578<br>GGCTACTATATGCAC | SEQ ID NO:15590<br>TGGATCAACCCTAACAG<br>TGGTGGCACAAACTATG<br>CACAGAAGTTTCAGGGC | SEQ ID NO:23602<br>GATAGAGCAGTGGCTGGAAA<br>CTACTTCTACTACGGTATGG<br>ACGTC |
| | | AA | SEQ ID NO:7579<br>GYYMH | SEQ ID NO:15591<br>WINPNSGGTNYAQKFQG | SEQ ID NO:23603<br>DRAVAGNYFYYGMDV |
| iPS:436974 | 21-225_190H7 | NA | SEQ ID NO:7580<br>AGCTATGGCATGCAT | SEQ ID NO:15592<br>GTTATATATATGATGG<br>AAGTTATAAGTACTATG<br>CAGACTCCGTGAAGGGC | SEQ ID NO:23604<br>ACGTATAGCGGGGGGTATGGA<br>CGTC |
| | | AA | SEQ ID NO:7581<br>SYGMH | SEQ ID NO:15593<br>VIIYDGSYKYYADSVKG | SEQ ID NO:23605<br>TYSGGMDV |
| | | | SEQ ID NO:7582 | SEQ ID NO:15594 | SEQ ID NO:23606 |

FIGURE 49
(Continued)

| | | | | |
|---|---|---|---|---|
| iPS:436976 | 21-225_190D8 | NA | AGCTATGGCCTGCAC | GTTATATGGTATGATGG AAGTAATAAATACTATG CAGACTCCGTGAAGGGC | TGGTACTACTACTACTACGG TATGGACGTC |
| | | | SEQ ID NO:7583 | SEQ ID NO:15595 | SEQ ID NO:23607 |
| | | AA | SYGLH | VIWYDGSNKYYADSVKG | WYYYYYGMDV |
| | | | SEQ ID NO:7584 | SEQ ID NO:15596 | SEQ ID NO:23608 |
| iPS:436978 | 21-225_190G9 | NA | AGGAAAAGTGCTACTGGAA C | AGGACATACAGGTC CAAGTGGTATAAATGATT ATGCAGTATCTGTGAAA AGT | GATCCGGGTGGCCTCTTTGA CTAC |
| | | | SEQ ID NO:7585 | SEQ ID NO:15597 | SEQ ID NO:23609 |
| | | AA | RKSAFWN | RTYYRSKWYNDYAVSVK S | DPGGLFDY |
| | | | SEQ ID NO:7586 | SEQ ID NO:15598 | SEQ ID NO:23610 |
| iPS:436980 | 21-225_190C10 | NA | AACTATGGCATGCAC | GTTATATGGTTTGGTGGA GATAATAAATACTATGC AGACTCCGTGAGGGGC | GATAACTGGAACTACGGCGA TCACTACTACTATTACGGAA TGGACGTC |
| | | | SEQ ID NO:7587 | SEQ ID NO:15599 | SEQ ID NO:23611 |
| | | AA | NYGMH | VIWFGGDNKYYADSVRG | DNWNYGDHYYYYGMDV |
| | | | SEQ ID NO:7588 | SEQ ID NO:15600 | SEQ ID NO:23612 |
| iPS:436982 | 21-225_190D10 | NA | AGCTATGGCATGCAT | GTTATATAATATATGATGG AAGTTATAAGTACTATG CAGACTCCGTGAAGGGC | ACGTATAGCGGGGTATGGA CGTC |
| | | | SEQ ID NO:7589 | SEQ ID NO:15601 | SEQ ID NO:23613 |
| | | AA | SYGMH | VIIYDGSYKYYADSVKG | TYSGGMDV |
| | | | SEQ ID NO:7590 | SEQ ID NO:15602 | SEQ ID NO:23614 |

FIGURE 49
(Continued)

| | | | | | |
|---|---|---|---|---|---|
| iPS:436984 | 21-225_190F10 | NA | AGTGGTGGTGACTACTGGAG C | TACATCTATTATACAGTGGG ATCACCACTACAATCCG TCCCTCAAGAGT | GATAGCAGCTCGCGGGGTAT GGACGTC |
| | | AA | SGGDYWS | YIYYSGITYNPSLKS | DSSSRGMDV |
| | | | SEQ ID NO:7591 | SEQ ID NO:15603 | SEQ ID NO:23615 |
| | | | SEQ ID NO:7592 | SEQ ID NO:15604 | SEQ ID NO:23616 |
| iPS:436986 | 21-225_191A1 | NA | AGTTACTACTGGATC | TATATCTATTACAGTGGG AGTACTAAGTACAACCC CTCCCTCAAGAGT | AAGGGAGTGGGAACCATCCA CTTTGACTAC |
| | | AA | SYYWI | YIYYSGSTKYNPSLKS | KGVGTIHFDY |
| | | | SEQ ID NO:7593 | SEQ ID NO:15605 | SEQ ID NO:23617 |
| | | | SEQ ID NO:7594 | SEQ ID NO:15606 | SEQ ID NO:23618 |
| iPS:436988 | 21-225_191A2 | NA | AGTGGTGGTGACTACTGGAG C | TACATCTATTATACAGTGGG ATCACCACTACAATCCG TCCCTCAAGAGT | GATAGCAGCTCGCGGGGTAT GGACGTC |
| | | AA | SGGDYWS | YIYYSGITYNPSLKS | DSSSRGMDV |
| | | | SEQ ID NO:7595 | SEQ ID NO:15607 | SEQ ID NO:23619 |
| | | | SEQ ID NO:7596 | SEQ ID NO:15608 | SEQ ID NO:23620 |
| iPS:436992 | 21-225_191B8 | NA | AGCTATGGCATGCAC | GTTATATGGTTTGATGGA AGTAATAAATACTATGC AGACTCCGTGAAGGGC | GATAACTGAACTACGGCGA TCACTACTACTATTACGGTA TGGACGTC |
| | | AA | SYGMH | VIWFDGSNKYYADSVKG | DNWNYGDHYYYGMDV |
| | | | SEQ ID NO:7597 | SEQ ID NO:15609 | SEQ ID NO:23621 |
| | | | SEQ ID NO:7598 | SEQ ID NO:15610 | SEQ ID NO:23622 |
| iPS:436994 | 21-225_191A9 | NA | AATTATGGCATGCAC | GTTATATGGTTTGGTGGA GATAATAAATACTATGC AGACTCCGTGAAGGGC | GATAACTGGAACTACGGCGA TCACTACTACTATTACGGTA TGGACGTC |
| | | | SEQ ID NO:7599 | SEQ ID NO:15611 | SEQ ID NO:23623 |

FIGURE 49
(Continued)

| | | AA/NA | | | | |
|---|---|---|---|---|---|---|
| iPS:436996 | 21-225_191B9 | AA | NYGMH | VIWFGGDNKYYADSVKG | DNWNYGDHYYYYGMDV | |
| | | | SEQ ID NO:7600 | SEQ ID NO:15612 | SEQ ID NO:23624 | |
| | | NA | TTCCATGGCATGCAC | GTTATATGGTTATGATGG AAGTAAAAATACTATG CAGACTCCGTGAAGGGC | GAAGGGTATAGCAGTGGCTT TACAGGGGGTTGACAAC | |
| | | | SEQ ID NO:7601 | SEQ ID NO:15613 | SEQ ID NO:23625 | |
| iPS:437000 | 21-225_191G9 | AA | FHGMH | VIWYDGSKKYYADSVKG | EGYSSGFYRGFDN | |
| | | | SEQ ID NO:7602 | SEQ ID NO:15614 | SEQ ID NO:23626 | |
| | | NA | ACCTATGGCATGCAC | CTTATATGGTTTGATGGA AGTAATAAATACTATGC AGACTCCGTGAAGGGC | GATCGGGTGGGAGGTACTAG TCCTCCTTACTACTACTACTA CGGTATGGACGTC | |
| | | | SEQ ID NO:7603 | SEQ ID NO:15615 | SEQ ID NO:23627 | |
| iPS:437002 | 21-225_191H9 | AA | TYGMH | LIWFFDGSNKYYADSVKG | DRVGGTSPPYYYYGMDV | |
| | | | SEQ ID NO:7604 | SEQ ID NO:15616 | SEQ ID NO:23628 | |
| | | NA | GGCTACAATATGCAC | TGGATCAACCCTAATAG TGGTGGCACAAACTATG CACACAAGTTTCAGGGC | GATTTCTATGATAGTGGTGG AGAAGGGTGGTTCGACCCC | |
| | | | SEQ ID NO:7605 | SEQ ID NO:15617 | SEQ ID NO:23629 | |
| iPS:437006 | 21-225_192G2 | AA | GYNMH | WINPNSGGTNYAHKFQG | DFYDSGGEGWFDP | |
| | | | SEQ ID NO:7606 | SEQ ID NO:15618 | SEQ ID NO:23630 | |
| | | NA | AGCTATGGCATGCAC | GTTATATGGAATGATGG AAGTAATAAATACTATG CAGACTCCGTGAAGGGC | GATCTGGATAAGAGGAACTT TCCTTATTACTACTACTACGG TATGGACGTC | |
| | | | SEQ ID NO:7607 | SEQ ID NO:15619 | SEQ ID NO:23631 | |

FIGURE 49 (Continued)

| | | SYGMH | VIWNDGSNKYYADSVKG | DLDKRNFPYYYYGMDV |
|---|---|---|---|---|
| iPS:437008 | 21-225_192E3 | AA | SEQ ID NO:7608 | SEQ ID NO:15620 | SEQ ID NO:23632 |
| | | NA | AGTGGTGGTTACTACTGGAGC | TACATCTATTACACTGGGAGCACCTACTACAACCCGTCCCTCAAGAGT | GACGATCCCCTCTACGGAATGGACGTC |
| iPS:437010 | 21-225_192G3 | AA | SGGYYWS | YIYYTGSTYNPSLKS | DDPLYGMDV |
| | | NA | SEQ ID NO:7610 | SEQ ID NO:15622 | SEQ ID NO:23634 |
| | | AA | AATTACTACTGGAGC | CGGATCTATTCCAGTGGGAGCACCAACTACAACCCCTCCCTCAAGAGT | GGGTGGGAGCTAAACTAC |
| iPS:437012 | 21-225_192G7 | NA | SEQ ID NO:7611 | SEQ ID NO:15623 | SEQ ID NO:23635 |
| | | AA | NYYWS | RIYSSGSTNYNPSLKS | GWFLNY |
| | | NA | SEQ ID NO:7612 | SEQ ID NO:15624 | SEQ ID NO:23636 |
| | | AA | AGTGGTGGTTACTACTGGAGC | TACATCTATTACAGAGGGAGTACCTACTACAATCCGTCCCTCAAGAGT | GACTCCCCGGTGACAGGATTTGACTAT |
| iPS:437014 | 21-225_192H8 | NA | SEQ ID NO:7613 | SEQ ID NO:15625 | SEQ ID NO:23637 |
| | | AA | SGGYYWS | YIYYSGPTYNPSLKS | DSPVTGFDY |
| | | NA | SEQ ID NO:7614 | SEQ ID NO:15626 | SEQ ID NO:23638 |
| | | AA | AGTGGTGGTGGACTACTGGAG | TACATCTATTACAGTGGGCCCACCTACTACAACCCGTCCCTCAAGAGT | GATAGCTCCCTCTACGGTATGGACGTC |
| iPS:437016 | 21-225_193A6 | NA | SEQ ID NO:7615 | SEQ ID NO:15627 | SEQ ID NO:23639 |
| | | AA | SGGDYWS | YIYYSGPTYNPSLKS | DSSLYGMDV |
| | | NA | SEQ ID NO:7616 | SEQ ID NO:15628 | SEQ ID NO:23640 |
| | | | AGTTACTACTGGAGC | TATATCTATTACAGTGGGAGCACCAACTACAACCCCTCCCTCAAGAGT | GGATGGGAGCTAAACTAC |

FIGURE 49 (Continued)

| | | | | | | |
|---|---|---|---|---|---|---|
| iPS:437018 | 21-225_193A6 | AA | SEQ ID NO:7617<br>SYYWS | SEQ ID NO:15629<br>YIYYSGSTNYNPSLKS | SEQ ID NO:23641<br>GWELNY |
| | | NA | SEQ ID NO:7618<br>AACGCTACATGACC | SEQ ID NO:15630<br>CGTATTAAAAGCAAAAC<br>TGATGGTGGGACAACAG<br>ACTACGCTGCACCCGTG<br>AAAGGC | SEQ ID NO:23642<br>GATCCCGGGTGGTATCTTTGA<br>CTAC |
| iPS:437020 | 21-225_193H5 | AA | SEQ ID NO:7619<br>NAYMT | SEQ ID NO:15631<br>RIKSKTDGGTTDYAAPVK<br>G | SEQ ID NO:23643<br>DPGGIFDY |
| | | NA | SEQ ID NO:7620<br>GGCTACTATATGCAC | SEQ ID NO:15632<br>TGGATCAACCCTTACAGT<br>GGTGGCACAAACTATGC<br>ACAGAAGTTTCAGGGC | SEQ ID NO:23644<br>GATAGAGCAGTGGCTGGAAA<br>CTACTTCTACTACGGTATGG<br>ACGTC |
| iPS:437022 | 21-225_193F11 | AA | SEQ ID NO:7621<br>GYYMH | SEQ ID NO:15633<br>WINPYSGGTNYAQKFQG | SEQ ID NO:23645<br>DRAVAGNYFYYGMDV |
| | | NA | SEQ ID NO:7622<br>AGTGGTGGTGACTACTGGAG<br>C | SEQ ID NO:15634<br>TACATCTATTACAGTGGG<br>AGCACCTACTACAACCC<br>GTCTCTCAAGAGT | SEQ ID NO:23646<br>GATCACTCCCTCTACGGTAT<br>GGACGTC |
| iPS:437024 | 21-225_194G5 | AA | SEQ ID NO:7623<br>SGGDYWS | SEQ ID NO:15635<br>YIYYSGSTYYNPSLKS | SEQ ID NO:23647<br>DHSLYGMDV |
| | | NA | SEQ ID NO:7624<br>AGCTATGGCATGCAC | SEQ ID NO:15636<br>GTTATATGGAATGATGG<br>AAGTAAAAATACCATG<br>TAGACTCCGTGAAGGGC | SEQ ID NO:23648<br>GATCTGGATAAGAGGAACTT<br>TCCTTATTACTACTACGG<br>TATGGACGTC |
| | 21-225_194F11 | AA | SEQ ID NO:7625<br>SYGMH | SEQ ID NO:15637<br>VIWNDGSKKYHVDSVKG | SEQ ID NO:23649<br>DLDKRNFPYYYYGMDV |

FIGURE 49 (Continued)

| | | | | |
|---|---|---|---|---|
| iPS:437026 | 21-225_194D12 | NA | SEQ ID NO:7626<br>AGTGGTGGTGACTACTGGAGC | SEQ ID NO:15638<br>TACATCTATTACAGTGGGAGTACCTACTACAACCCGTCCCTCAAGAGT | SEQ ID NO:23650<br>GATGGGGTCGGCACGGTATGGACGTC |
| | | AA | SEQ ID NO:7627<br>SGGDYWS | SEQ ID NO:15639<br>YIYYSGSTYYNPSLKS | SEQ ID NO:23651<br>DGARHGMDV |
| iPS:437028 | 21-225_194G12 | NA | SEQ ID NO:7628<br>AGCTATGGCATGCAC | SEQ ID NO:15640<br>GTTATATGGAATGATGGAAGTAATAAATACTATGCAGACTCCGTGAAGGGC | SEQ ID NO:23652<br>GATCTGGATAAGAGGAACTTTCCTTATTACTACTACGGTATGGACGTC |
| | | AA | SEQ ID NO:7629<br>SYGMH | SEQ ID NO:15641<br>VIWNDGSNKYYADSVKG | SEQ ID NO:23653<br>DLDKRNFPYYYYGMDV |
| iPS:437030 | 21-225_195E3 | NA | SEQ ID NO:7630<br>GACTACTACATGAGC | SEQ ID NO:15642<br>TATATTACTAGTAGTGGTAATACCATATACTACGCAGACTCTGTGAAGGGC | SEQ ID NO:23654<br>GATAGTCGATATTTTGACTGGTTTGACTAC |
| | | AA | SEQ ID NO:7631<br>DYYMS | SEQ ID NO:15643<br>YITSSGNTIYYADSVKG | SEQ ID NO:23655<br>DSRYFDWFDY |
| iPS:437032 | 21-225_195H6 | NA | SEQ ID NO:7632<br>AATTACTACTGGAGC | SEQ ID NO:15644<br>CGTATCTATAGCAGTGGGAGCACCAACTACAACCCCTCCCTCAAGAGT | SEQ ID NO:23656<br>GGGTGGGAGCTAAACAAC |
| | | AA | SEQ ID NO:7633<br>NYYWS | SEQ ID NO:15645<br>RIYSSGSTNYNPSLKS | SEQ ID NO:23657<br>GWELNN |
| iPS:437034 | 21-225_195E9 | NA | SEQ ID NO:7634<br>GGCTACTATATGCAC | SEQ ID NO:15646<br>TGGATCAACCCTAACAGTGGTGCCACAAACTATGCACAGAAGTTTCAGGGC | SEQ ID NO:23658<br>GCCTATTACTATGGTTCGGGACTTATTATAAGGAGTTCGACTAC |

FIGURE 49 (Continued)

| | | | | | |
|---|---|---|---|---|---|
| iPS:437036 | 21-225_195E9 | AA | SEQ ID NO:7635<br>GYYMH | SEQ ID NO:15647<br>WINPNSGATNYAQKFQG | SEQ ID NO:23659<br>AYYYGSGTYNEFDY |
| | | NA | SEQ ID NO:7636<br>GGCTACTATATGCAC | SEQ ID NO:15648<br>TGGATCAACCCTAACAGT<br>GGTGGCACAAACTATGC<br>ACAGAAGTTTCAGGAC | SEQ ID NO:23660<br>GATAGAGCAGTGGCTGGAAA<br>CTACTTCTACTACGGTATGG<br>ACGTC |
| iPS:437040 | 21-225_195H9 | AA | SEQ ID NO:7637<br>GYYMH | SEQ ID NO:15649<br>WINPYSGGTNYAQKFQD | SEQ ID NO:23661<br>DRAVAGNYFYYGMDV |
| | | NA | SEQ ID NO:7638<br>GGCTACAATATGCAC | SEQ ID NO:15650<br>TGGATCAACCCTAATAG<br>TGGTGGCACAAACTATG<br>CACACAAGTTTCAGGGC | SEQ ID NO:23662<br>GATTACTATGATACTAGTGG<br>AGAAGGGTGGTTCGACCCC |
| iPS:437042 | 21-225_196E7 | AA | SEQ ID NO:7639<br>GYNMH | SEQ ID NO:15651<br>WINPNSGGTNYAHKFQG | SEQ ID NO:23663<br>DYYDTSGEGWFDP |
| | | NA | SEQ ID NO:7640<br>GGCTACTATATACAC | SEQ ID NO:15652<br>TGGATCAACCCTAACAG<br>TGGTGGCACAAACTATG<br>CACAGAGAGTTTCAGGGC | SEQ ID NO:23664<br>GAGATAGCAGTGGCTGGAAA<br>CTACTTCTACTACGGTATGG<br>GCGTC |
| iPS:437044 | 21-225_197E8 | AA | SEQ ID NO:7641<br>GYYIH | SEQ ID NO:15653<br>WINPNSGGTNYAQRFQG | SEQ ID NO:23665<br>EIAVAGNYFYYGMGV |
| | | NA | SEQ ID NO:7642<br>ATTTACTACTGGAGC | SEQ ID NO:15654<br>TATGTCTATTACAGTGGG<br>AGCACCACCTACAACCC<br>CTCCCTCAAGAGT | SEQ ID NO:23666<br>GAAAGGGGAGTAGCCACA<br>GATGGGGGGACTACTACGGA<br>ATGGACGTC |
| iPS:437046 | 21-225_197F9 | AA | SEQ ID NO:7643<br>IYYWS | SEQ ID NO:15655<br>YVYYSGSTTYNPSLKS | SEQ ID NO:23667<br>ERGSSHRWGDYYGMDV |
| | | NA | SEQ ID NO:7644<br>AGTGGTGGTTACTACTGGAG<br>C | SEQ ID NO:15656<br>TACATCTATTACACTGGG<br>AGCACTACTACAACCC<br>GTCCCTCAAGAGT | SEQ ID NO:23668<br>GACGATCCCTCTACGGAAT<br>GGACGTC |
| iPS:437048 | 21-225_197B11 | | | | |

FIGURE 49
(Continued)

| | | | | | | |
|---|---|---|---|---|---|---|
| iPS:437050 | 21-225_197B11 | AA | SGGYYWS | SEQ ID NO:7645 | YIYYTGSTYYNPSLKS | SEQ ID NO:15657 | DDPLYGMDV | SEQ ID NO:23669 |
| | | NA | GGCTACAATATGCAC | SEQ ID NO:7646 | TGGATCAACCCTAATAGTGGTGGCACAAACTATGCACACAAGTTTCAGGGC | SEQ ID NO:15658 | GATTACTATGATAGTAGTGGAGAAGGGTGGTTCGACCCC | SEQ ID NO:23670 |
| iPS:437054 | 21-225_197C11 | AA | GYNMH | SEQ ID NO:7647 | WINPNSGGTNYAHKFQG | SEQ ID NO:15659 | DYYDSSGEGWFDP | SEQ ID NO:23671 |
| | | NA | TTCCATGGCATGCAC | SEQ ID NO:7648 | GTTATATGGTATGATGGAAGTAAAAATACTATGCAGACTCCGTGAAGGGC | SEQ ID NO:15660 | GAAGGGTTTAGCAGTGGCTTTTACAGGGGTTTGACAAC | SEQ ID NO:23672 |
| | 21-225_194G3 | AA | FHGMH | SEQ ID NO:7649 | VIWYDGSKKYYADSVKG | SEQ ID NO:15661 | EGFSSGFYRGFDN | SEQ ID NO:23673 |
| | | NA | AGTGGTGGTGACTACTGGAGC | SEQ ID NO:7650 | TACATCTATTACAGTGGGATCACCTACTACAATCCGTCCCTCAAGAGT | SEQ ID NO:15662 | GATAGCAGCTCGCGGGGTATGGACGTC | SEQ ID NO:23674 |
| iPS:437056 | 21-225_198B8 | AA | SGGDYWS | SEQ ID NO:7651 | YIYYSGITYYNPSLKS | SEQ ID NO:15663 | DSSSRGMDV | SEQ ID NO:23675 |
| | | NA | TTCTATGGCATGCAC | SEQ ID NO:7652 | GTTATTTGGTATGATGGAAGTAGTAAATACTATGCAGACTCCGTGAAGGGC | SEQ ID NO:15664 | GAAGGGTATAGCAGTGGCTTTTACAGGGGATTTGCCAAC | SEQ ID NO:23676 |
| iPS:437058 | 21-225_199F3 | AA | FYGMH | SEQ ID NO:7653 | VIWYDGSSKYYADSVKG | SEQ ID NO:15665 | EGYSSGFYRGFAN | SEQ ID NO:23677 |
| | | NA | | SEQ ID NO:7654 | | SEQ ID NO:15666 | | SEQ ID NO:23678 |

FIGURE 49
(Continued)

| | | | | | |
|---|---|---|---|---|---|
| iPS:437060 | 21-225_199C3 | NA | ATTTACTACTGGAGC | TATATCTATTACAGTGGGAGCACCACTACAACCCCTCCCTCAAGAGT | GAAAGGGGGAGTAGCCACAGATGGGGGACTACTACGGAATGGACGTC |
| | | | SEQ ID NO:7655 | SEQ ID NO:15667 | SEQ ID NO:23679 |
| | | AA | IYYWS | YIYYSGSTYYNPSLKS | ERGSSHRWGDYYGMDV |
| | | | SEQ ID NO:7656 | SEQ ID NO:15668 | SEQ ID NO:23680 |
| iPS:437062 | 21-225_200H1 | NA | AGTGGTGGTGACTATATGGAGC | TACATCTATTATAGTGGGAGCACCTACAACCCGTCCCTCAAGAGT | GATGGAGCAGCTCTGGGTATGGACGTC |
| | | | SEQ ID NO:7657 | SEQ ID NO:15669 | SEQ ID NO:23681 |
| | | AA | SGGDYWS | YIYYSGSTYYNPSLKS | DGAALGMDV |
| | | | SEQ ID NO:7658 | SEQ ID NO:15670 | SEQ ID NO:23682 |
| iPS:437064 | 21-225_200G8 | NA | AGTTACTACTGGAGC | TATATCTATTACAGTGGGAGTACTAAGTACAACCCCTCCCTCAAGAGT | AAGGGAGTGGGAACCATCCACTTTGACTAC |
| | | | SEQ ID NO:7659 | SEQ ID NO:15671 | SEQ ID NO:23683 |
| | | AA | SYYWS | YIYYSGSTKYNPSLKS | KGVGTIHFDY |
| | | | SEQ ID NO:7660 | SEQ ID NO:15672 | SEQ ID NO:23684 |
| iPS:437066 | 21-225_200G9 | NA | AGTGGTGGTGACTACTGGAG | TACATCTATTACAGTGGGAGCACCTACTACAACCCGTCCCTCAAGAGT | GATGGAGCAGCTCTGGGTATGGACGTC |
| | | | SEQ ID NO:7661 | SEQ ID NO:15673 | SEQ ID NO:23685 |
| | | AA | SGGDYWS | YIYYSGSTYYNPSLKS | DGAALGMDV |
| | | | SEQ ID NO:7662 | SEQ ID NO:15674 | SEQ ID NO:23686 |
| iPS:437068 | 21-225_200A11 | NA | AGTGGTGGTGACTACTGGAG | TACATCTATTACAGAGGGAGCACCTACTACAACCCCGTCCCTCAAGAGT | GATGCAGCAGCCCACGGCATGGACGTC |
| | | | SEQ ID NO:7663 | SEQ ID NO:15675 | SEQ ID NO:23687 |
| | | AA | SGGDYWS | YIYYRGSTYYNPSLKS | DAAAHGMDV |
| | | | SEQ ID NO:7664 | SEQ ID NO:15676 | SEQ ID NO:23688 |

FIGURE 49
(Continued)

| | | | | | |
|---|---|---|---|---|---|
| iPS:437070 | 21-225_201G11 | NA | CGCATCAATCCTACTTGGAA C | AGGACATACTACAGGTC CAAGTGTATCATGTTTA TGCAGTATCTGTGAAAA GT | GATCCTGGGGGGCTCTTTGA CTAC |
| | | | SEQ ID NO:7665 | SEQ ID NO:15677 | SEQ ID NO:23689 |
| | | AA | RTNPTWN | RTYYRSKWYHVYAVSVK G | DPGGLFDY |
| | | | SEQ ID NO:7666 | SEQ ID NO:15678 | SEQ ID NO:23690 |
| iPS:437074 | 21-225_203B2 | NA | AACTATGGCATGCAC | ATTATATGGTTTGATGGA AGTAATGAATACTATGC AGACTCCGTGAAGGGC | GAAAGTGGGAGCTATGCTCT TTATATC |
| | | | SEQ ID NO:7667 | SEQ ID NO:15679 | SEQ ID NO:23691 |
| | | AA | NYGMH | IIWFDGSNEYYADSVKG | ESGSYALYI |
| | | | SEQ ID NO:7668 | SEQ ID NO:15680 | SEQ ID NO:23692 |
| iPS:437076 | 21-225_203G6 | NA | CGCACCAATCCTACTTGGAA C | AGGACATACTACAGGTC CAAGTGTATCATGTTTA TGCACTATCTGTGAAAA GT | GATCCTGGGGGGCCTCTTTGA CTAC |
| | | | SEQ ID NO:7669 | SEQ ID NO:15681 | SEQ ID NO:23693 |
| | | AA | RTNPTWN | RTYYRSKWYHVYALSVK S | DPGGLFDY |
| | | | SEQ ID NO:7670 | SEQ ID NO:15682 | SEQ ID NO:23694 |
| iPS:437082 | 21-225_205E12 | NA | AACTATGGCATGCAC | ATTATATGGTTTGATGGA AGTAATGAATACTATGC AGACTCCGTGAAGGGC | GAAAGTGGGAGCTATGCTCT TTATATC |
| | | | SEQ ID NO:7671 | SEQ ID NO:15683 | SEQ ID NO:23695 |
| | | AA | NYGMH | IIWFDGSNEYYADSVKG | ESGSYALYI |
| | | | SEQ ID NO:7672 | SEQ ID NO:15684 | SEQ ID NO:23696 |

FIGURE 49
(Continued)

| | | | | |
|---|---|---|---|---|
| iPS:437084 | 21-225_206B5 | NA | AGCTATGGCATGCAC<br><br>SEQ ID NO:7673 | GTTATATGGTATGATGG<br>AAGTAATAAATACTATG<br>CAGACTCCGTGAAGGGC<br><br>SEQ ID NO:15685 | GAGGGTGGGAGCTACCACCT<br>TGACTAC<br><br>SEQ ID NO:23697 |
| | | AA | SYGMH<br><br>SEQ ID NO:7674 | VIWYDGSNKYYADSVKG<br><br>SEQ ID NO:15686 | EGGSYHLDY<br><br>SEQ ID NO:23698 |
| iPS:437086 | 21-225_209A8 | NA | AGTTATAGCATGAAC<br><br>SEQ ID NO:7675 | TACATTAGTAGTAGTAGT<br>AGTATCAAAAAGTACGC<br>AGACTCTGTGAAGGGC<br><br>SEQ ID NO:15687 | GATGATGGGAGCTACTACTT<br>TGACTAC<br><br>SEQ ID NO:23699 |
| | | AA | SYSMN<br><br>SEQ ID NO:7676 | YISSSSSIKKYADSVKG<br><br>SEQ ID NO:15688 | DDGSYYFDY<br><br>SEQ ID NO:23700 |
| iPS:437088 | 21-225_209H10 | NA | AGCTATGGCATGCAC<br><br>SEQ ID NO:7677 | GTTATATGGTATGATGG<br>AAGTAATAAATACTATG<br>CAGACTCCGTGAAGGGC<br><br>SEQ ID NO:15689 | GAGGGTGGGAGCTACCACCT<br>TGACTAC<br><br>SEQ ID NO:23701 |
| | | AA | SYGMH<br><br>SEQ ID NO:7678 | VIWYDGSNKYYADSVKG<br><br>SEQ ID NO:15690 | EGGSYHLDY<br><br>SEQ ID NO:23702 |
| iPS:437090 | 21-225_210F11 | NA | AGTGGTGGTTCCTACTGGAG<br>C<br><br>SEQ ID NO:7679 | TACATCTATTACATTGGG<br>ACCACCTACTACAACCC<br>GTCCCTCAAGAGT<br><br>SEQ ID NO:15691 | GATGAGCCATTGACCGGTAT<br>GGACGTC<br><br>SEQ ID NO:23703 |
| | | AA | SGGSYWS<br><br>SEQ ID NO:7680 | YIYYIGTTYYNPSLKS<br><br>SEQ ID NO:15692 | DEPLTGMDV<br><br>SEQ ID NO:23704 |

FIGURE 49
(Continued)

| | | | | | | |
|---|---|---|---|---|---|---|
| iPS:437092 | 21-225_210B12 | NA | GACTACTATATGAAC | | TGGATCAACCCTAACAGTGGTGGCACAAACTATGCACAGAAGTTTCAGGGC | | GGGTATGACTCGTTCGCCCC |
| | | | SEQ ID NO:7681 | | SEQ ID NO:15693 | | SEQ ID NO:23705 |
| | | AA | DYYMN | | WINPNSGGTNYAQKFQG | | GYDSFAP |
| | | | SEQ ID NO:7682 | | SEQ ID NO:15694 | | SEQ ID NO:23706 |
| iPS:437094 | 21-225_210D12 | NA | CACTATGGCATGCAC | | GTTATATGGTATGATGGAAGTAATAAATACTATGCAGACTCCGTGAAGGGC | | GGGGACTGGAACCCCGAGGGTTTGGACGTC |
| | | | SEQ ID NO:7683 | | SEQ ID NO:15695 | | SEQ ID NO:23707 |
| | | AA | HYGMH | | VIWYDGSNKYYADSVKG | | GDWNPEGLDV |
| | | | SEQ ID NO:7684 | | SEQ ID NO:15696 | | SEQ ID NO:23708 |
| iPS:437096 | 21-225_210E12 | NA | AACTATGGCATGCAC | | GTTATATGGTATGATGGAAGTAATAAATACTATGCAGACTCCGTGAAGGGC | | GGGGACTGGAACCCCGAGGGTATGGACGTC |
| | | | SEQ ID NO:7685 | | SEQ ID NO:15697 | | SEQ ID NO:23709 |
| | | AA | NYGMH | | VIWYDGSNKYYADSVKG | | GDWNPEGMDV |
| | | | SEQ ID NO:7686 | | SEQ ID NO:15698 | | SEQ ID NO:23710 |
| iPS:437098 | 21-225_211C1 | NA | CACTATGGCATGCAC | | GTTATATGGTATGATGGAAGTAATAAATACTATGCAGACTCCGTGAAGGGC | | GGGGACTGGAACCCCGAGGGTTTGGACGTC |
| | | | SEQ ID NO:7687 | | SEQ ID NO:15699 | | SEQ ID NO:23711 |
| | | AA | HYGMH | | VIWYDGSNKYYADSVKG | | GDWNPEGLDV |
| | | | SEQ ID NO:7688 | | SEQ ID NO:15700 | | SEQ ID NO:23712 |

FIGURE 49
(Continued)

| | | | | | |
|---|---|---|---|---|---|
| iPS:437100 | 21-225_211H2 | NA | AGCTATGCCATGCAC | GTTATATGGTATGATGGAAGTAATAAATACTATGCAGACTCCGTGAAGGGC | GATCCTGGGAGCTACGGGTTCGACCCC |
| | | | SEQ ID NO:7689 | SEQ ID NO:15701 | SEQ ID NO:23713 |
| | | AA | SYAMH | VIWYDGSNKYYADSVKG | DPGSYGFDP |
| | | | SEQ ID NO:7690 | SEQ ID NO:15702 | SEQ ID NO:23714 |
| iPS:437102 | 21-225_211E5 | NA | AACTATGGCATGCAC | ATTATATGGTTTGATGGAAGTGATCAATACTATGCAGACTCCGTGAAGGGC | GGCCTCTCTGTCTACTACTACGGTATGGGCGTC |
| | | | SEQ ID NO:7691 | SEQ ID NO:15703 | SEQ ID NO:23715 |
| | | AA | NYGMH | IIWFDGSDQYYADSVKG | GLSVYYYGMGV |
| | | | SEQ ID NO:7692 | SEQ ID NO:15704 | SEQ ID NO:23716 |
| iPS:437104 | 21-225_211G5 | NA | CACTATGGCATGCAC | GTTATATGGTATGATGGAAGTAATAAATACTATGCAGACTCCGTGAAGGGC | GGGGACTGGAACCCCGAGGGTTTGGACGTC |
| | | | SEQ ID NO:7693 | SEQ ID NO:15705 | SEQ ID NO:23717 |
| | | AA | HYGMH | VIWYDGSNKYYADSVKG | GDWNPEGLDV |
| | | | SEQ ID NO:7694 | SEQ ID NO:15706 | SEQ ID NO:23718 |
| iPS:437106 | 21-225_211H7 | NA | AGTGGTGGTTACTACTGGAGC | TACATCTATTACGTTGGGAGCACTACTACAACCCGTCCCTCAAGAGT | GATGGGCCATTGAGGCGGTATGGACGTC |
| | | | SEQ ID NO:7695 | SEQ ID NO:15707 | SEQ ID NO:23719 |
| | | AA | SGGYYWS | YIYYVGSTYNPSLKS | DGPLSGMDV |
| | | | SEQ ID NO:7696 | SEQ ID NO:15708 | SEQ ID NO:23720 |

FIGURE 49
(Continued)

| | | | | |
|---|---|---|---|---|
| iPS:437108 | 21-225_211C9 | NA | AGTGGTGGTGACTACTGGAG C | TACATCTATTATAGTGG AGCAACTACTACAACCC GTCCCTCAAGAGT | GATTCAGCAGTGTACAATAT GGACGTC |
| | | | SEQ ID NO:7697 | SEQ ID NO:15709 | SEQ ID NO:23721 |
| | | AA | SGGDYWS | YIYYSGSTYYNPSLKS | DSAVYNMDV |
| | | | SEQ ID NO:7698 | SEQ ID NO:15710 | SEQ ID NO:23722 |
| iPS:437110 | 21-225_211E9 | NA | AGTGGTGGTGACTACTGGAG C | TACATCTATTACACTGGG AGCAACTACTACAACCC GTCCCTCAAGAGT | GATTCAGCAGTGTACGGTAT GGACGTC |
| | | | SEQ ID NO:7699 | SEQ ID NO:15711 | SEQ ID NO:23723 |
| | | AA | SGGDYWS | YIYYTGSNYYNPSLKS | DSAVYGMDV |
| | | | SEQ ID NO:7700 | SEQ ID NO:15712 | SEQ ID NO:23724 |
| iPS:437112 | 21-225_212C2 | NA | CACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7701 | SEQ ID NO:15713 | SEQ ID NO:23725 |
| | | AA | HYGMH | VIWYDGSNKYYADSVKG | GDWNPEGMDV |
| | | | SEQ ID NO:7702 | SEQ ID NO:15714 | SEQ ID NO:23726 |
| iPS:437114 | 21-225_212A4 | NA | AACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7703 | SEQ ID NO:15715 | SEQ ID NO:23727 |
| | | AA | NYGMH | VIWYDGSNKYYADSVKG | GDWNPEGMDV |
| | | | SEQ ID NO:7704 | SEQ ID NO:15716 | SEQ ID NO:23728 |

FIGURE 49
(Continued)

| | | | | |
|---|---|---|---|---|
| iPS:437116 | 21-225_212F6 | NA | CACTATGGCATGCAC | GTTATATGGTATGATGG AAGTAATAAATACTATG CGGACTCCGTGAAGGGC | GGGGACTGGAACCCCGAGGG TTTGGACGTC |
| | | | SEQ ID NO:7705 | SEQ ID NO:15717 | SEQ ID NO:23729 |
| | | AA | HYGMH | VIWYDGSNKYYADSVKG | GDWNPEGLDV |
| | | | SEQ ID NO:7706 | SEQ ID NO:15718 | SEQ ID NO:23730 |
| iPS:437118 | 21-225_212G7 | NA | CACTATGGCATGCAC | GTTATATGGTATGATGG AAGTAATAAATACTATG CAGACTCCGTGAAGGGC | GGAGACTGGAACCCCGAGGG TTTGGACGTC |
| | | | SEQ ID NO:7707 | SEQ ID NO:15719 | SEQ ID NO:23731 |
| | | AA | HYGMH | VIWYDGSNKYCADSVKG | GDWNPEGLDV |
| | | | SEQ ID NO:7708 | SEQ ID NO:15720 | SEQ ID NO:23732 |
| iPS:437120 | 21-225_212A9 | NA | AGTGGTGGTGACTACTGGAG C | TATATGTATTACAGTGGG AGCACCTACTACAACCC GTCCCTCAAGAGT | GATTCAGCAGTGTACGGTAT GGACGTC |
| | | | SEQ ID NO:7709 | SEQ ID NO:15721 | SEQ ID NO:23733 |
| | | AA | SGGDYWS | YMYYSGSTYYNPSLKS | DSAVYGMDV |
| | | | SEQ ID NO:7710 | SEQ ID NO:15722 | SEQ ID NO:23734 |
| iPS:437124 | 21-225_212H12 | NA | AGTGGTGGTGACTACTGGAG T | TACATCTATTACAGTGGG AGCACCTACTACAACCC GTCCCTCAAGAGT | GATAGCAGCTCTACGGTAT GGACGTC |
| | | | SEQ ID NO:7711 | SEQ ID NO:15723 | SEQ ID NO:23735 |
| | | AA | SGGDYWS | YIYYSGSTYYNPSLKS | DSSSYGMDV |
| | | | SEQ ID NO:7712 | SEQ ID NO:15724 | SEQ ID NO:23736 |

FIGURE 49
(Continued)

| | | | | | |
|---|---|---|---|---|---|
| iPS:437128 | 21-225_213G3 | NA | CACTATGGCATGCAC SEQ ID NO:7713 | GTTATATGGTATGATGG AAGTAATAAATACTATG CAGACTCCGTGAAGGGC SEQ ID NO:15725 | GGGGACTGGAACCCGAGGG TATGGACGTC SEQ ID NO:23737 |
| | | AA | HYGMH SEQ ID NO:7714 | VIWYDGSNKYYADSVKG SEQ ID NO:15726 | GDWNPEGMDV SEQ ID NO:23738 |
| iPS:437130 | 21-225_213D5 | NA | CACTATGGCATGCAC SEQ ID NO:7715 | GTTATATGGTATGATGG AAGTAATAAATACTATG CAGACTCCGTGAAGGGC SEQ ID NO:15727 | GGGGACTGGAACCCGAGGG TATGGACGTC SEQ ID NO:23739 |
| | | AA | HYGMH SEQ ID NO:7716 | VIWYDGSNKYYADSVKG SEQ ID NO:15728 | GDWNPEGMDV SEQ ID NO:23740 |
| iPS:437132 | 21-225_213F5 | NA | AGTGGTGGTGACTACTGGAG C SEQ ID NO:7717 | TACATCTATTATAGTGGG AGCACCTACTACAACCC GTCCCTCAAGAGT SEQ ID NO:15729 | GATTCAGCAGTGTACAATAT GGACGTC SEQ ID NO:23741 |
| | | AA | SGGDYWS SEQ ID NO:7718 | YIYYSGSTYYNPSLKS SEQ ID NO:15730 | DSAVYNMDV SEQ ID NO:23742 |
| iPS:437134 | 21-225_213A7 | NA | GACTACTATATGAAC SEQ ID NO:7719 | TGGATCAACCCTAAGAA TGGTGGCACAAACTATG CACAGAAGTTTCAGGGC SEQ ID NO:15731 | GGGTATGATTCGTTCGCCCC C SEQ ID NO:23743 |
| | | AA | DYYMN SEQ ID NO:7720 | WINPKNGGTNYAQKFQG SEQ ID NO:15732 | GYDSFAP SEQ ID NO:23744 |

FIGURE 49
(Continued)

| | | | | | |
|---|---|---|---|---|---|
| iPS:437136 | 21-225_214H3 | NA | AGTGGTGGTGACTACTGGAGT SEQ ID NO:7721 | TACATCTATTACAGTGGG AGCACCTACACAACCC GTCCCTCAAGAGT SEQ ID NO:15733 | GATAGCAGCTCCTACGGTAT GGACGTC SEQ ID NO:23745 |
| | | AA | SGGDYWS SEQ ID NO:7722 | YIYYSGSTYYNPSLKS SEQ ID NO:15734 | DSSSYGMDV SEQ ID NO:23746 |
| iPS:437138 | 21-225_214D8 | NA | ACTGCTTTTACTACTGGAG C SEQ ID NO:7723 | TACATCTATTCAGTGGG AGCACCTACACAACCC GTCCCTCAAGAGT SEQ ID NO:15735 | GCAAGGGATATCACTACACAG TATCTTTGACTAC SEQ ID NO:23747 |
| | | AA | TAFYYWS SEQ ID NO:7724 | YIYFSGSTYYNPSLKS SEQ ID NO:15736 | ARGYHYSIFDY SEQ ID NO:23748 |
| iPS:437140 | 21-225_214E12 | NA | AGTGGTGGTGATTACTGGAG C SEQ ID NO:7725 | TACATCTATTACAGTGGG CCCACCTACACAACCC GTCCCTCAAGAGT SEQ ID NO:15737 | GATGGGGCTGCGGAGGGTAT GGACGTC SEQ ID NO:23749 |
| | | AA | SGGDYWS SEQ ID NO:7726 | YIYYSGPTYYNPSLKS SEQ ID NO:15738 | DGAAEGMDV SEQ ID NO:23750 |
| iPS:437142 | 21-225_215A3 | NA | AGTGGTGGTGACTACTGGAG C SEQ ID NO:7727 | TACATCTATTACACTGGG AGCAACTACACAACCC GTCCCTCAAGAGT SEQ ID NO:15739 | GATTCAGCAGTGTACGGTAT GGACGTC SEQ ID NO:23751 |
| | | AA | SGGDYWS SEQ ID NO:7728 | YIYYTGSNYYNPSLKS SEQ ID NO:15740 | DSAVYGMDV SEQ ID NO:23752 |
| iPS:437144 | 21-225_215B3 | NA | AACGCCTGGATGCAC SEQ ID NO:7729 | CGTATTAAAAGCAAAAC TAATGGTGGGACAACAG ACTACGCTGCACCCGTG AAAGGC SEQ ID NO:15741 | GATCCGGGGGGGATCTTTGA CTAC SEQ ID NO:23753 |

FIGURE 49
(Continued)

| | | | | RIKSKTNGGTTDYAAPVKG | DPGGIFDY |
|---|---|---|---|---|---|
| iPS:437146 | | AA | NAWMH | SEQ ID NO:15742 | SEQ ID NO:23754 |
| | 21-225_215D3 | NA | CACTATGGCATGCAC | GTTATATGGTATGATGG AAGTAATGAGTACTATG CAGACTCCGTGAAGGGC | GGGGACTGGAACCCGAGGG TATGGACGTC |
| | | | SEQ ID NO:7730 | SEQ ID NO:15743 | SEQ ID NO:23755 |
| | | AA | HYGMH | VIWYDGSNEYYADSVKG | GDWNPEGMDV |
| iPS:437148 | | | SEQ ID NO:7731 | SEQ ID NO:15744 | SEQ ID NO:23756 |
| | 21-225_215H3 | NA | AGTGGTGGTGACTACTGGAGC | TATATGTATTACAGTGGG AGCACCTACTACAACCC GTCCCTCAAGAGT | GATTCAGCAGTGTACGGTAT GGACGTC |
| | | | SEQ ID NO:7732 | SEQ ID NO:15745 | SEQ ID NO:23757 |
| | | AA | SGGDYWS | YMYYSGSTYYNPSLKS | DSAVYGMDV |
| iPS:437150 | | | SEQ ID NO:7733 | SEQ ID NO:15746 | SEQ ID NO:23758 |
| | 21-225_216A3 | NA | CACTATGGCATGCAC | GTTATATGGTATGATGG AAGTAATAATACTATG CAGACTCCGTGAAGGGC | GGGGACTGGAACCCGAGGG TTTGGACGTC |
| | | | SEQ ID NO:7734 | SEQ ID NO:15747 | SEQ ID NO:23759 |
| | | AA | HYGMH | VIWYDGSNKYYADSVKG | GDWNPEGLDV |
| iPS:437154 | | | SEQ ID NO:7735 | SEQ ID NO:15748 | SEQ ID NO:23760 |
| | 21-225_216A7 | NA | AGTGGTGGTGACTACTGGAGC | TATATGTATTACAGTGGG AGCACCTACTACAACCC GTCCCTCAAGAGT | GATTCAGCAGTGTACGGTAT GGACGTC |
| | | | SEQ ID NO:7736 | SEQ ID NO:15749 | SEQ ID NO:23761 |
| | | AA | SGGDYWS | YMYYSGSTYYNPSLKS | DSAVYGMDV |
| | | | SEQ ID NO:7737 | SEQ ID NO:15750 | SEQ ID NO:23762 |

FIGURE 49 (Continued)

| iPS ID | Clone | Type | Seq 1 | Seq 2 | Seq 3 |
|---|---|---|---|---|---|
| iPS:437158 | 21-225_216H11 | NA | AGTGGTGGTGATTACTGGAG C<br>SEQ ID NO:7739 | TACATCTATTACAGTGGG CCCACCACTACAACCC GTCCCTCAAGAGT<br>SEQ ID NO:15751 | GATGGGGCTGCGGAGGGTTT GGACGTC<br>SEQ ID NO:23763 |
| | | AA | SGGDYWS<br>SEQ ID NO:7740 | YIYYSGPTYYNPSLKS<br>SEQ ID NO:15752 | DGAAEGLDV<br>SEQ ID NO:23764 |
| iPS:437160 | 21-225_216B12 | NA | AGCTATGCCATGCAC<br>SEQ ID NO:7741 | GTTATATGGTATGATGG AAGTAATAAATACTATG CAGACTCCGTGAAGGGC<br>SEQ ID NO:15753 | GATCGGGACTGGGATACTT CTTTGACTAC<br>SEQ ID NO:23765 |
| | | AA | SYAMH<br>SEQ ID NO:7742 | VIWYDGSNKYYADSVKG<br>SEQ ID NO:15754 | DLGLGYFFDY<br>SEQ ID NO:23766 |
| iPS:437162 | 21-225_217B2 | NA | AACTATGGCATGCAC<br>SEQ ID NO:7743 | GTTATATGGTATGATGG AAGTAATAAATACTATG CAGACTCCGTGAAGGGC<br>SEQ ID NO:15755 | GGGGACTGGAACCCCGAGGG TATGGACGTC<br>SEQ ID NO:23767 |
| | | AA | NYGMH<br>SEQ ID NO:7744 | VIWYDGSNKYYADSVKG<br>SEQ ID NO:15756 | GDWNPEGMDV<br>SEQ ID NO:23768 |
| iPS:437164 | 21-225_217C6 | NA | AACTATGGCATGCAC<br>SEQ ID NO:7745 | ATTATATGGTTTGATGGA AGTGATGAATACTATGC AGACTCCGTGAAGGGC<br>SEQ ID NO:15757 | GGCCTATCTGTCTACTACTA CGGTATGGACGTC<br>SEQ ID NO:23769 |
| | | AA | NYGMH<br>SEQ ID NO:7746 | IIWFDGSDEYYADSVKG<br>SEQ ID NO:15758 | GLSVYYGMDV<br>SEQ ID NO:23770 |

FIGURE 49
(Continued)

| | | | | |
|---|---|---|---|---|
| iPS:437166 | 21-225_217G11 | NA | AACTATGGCATGCAC<br>SEQ ID NO:7747 | ATTATATGGTTTGATGGA<br>AGTGATCAGTACTATGC<br>AGACTCCGTGAAGGGC<br>SEQ ID NO:15759 | GGCCTCTCTGTCTACTACTAC<br>GGTATGGACGTC<br>SEQ ID NO:23771 |
| | | AA | NYGMH<br>SEQ ID NO:7748 | IIWFDGSDQYYADSVKG<br>SEQ ID NO:15760 | GLSVYYYGMDV<br>SEQ ID NO:23772 |
| iPS:437168 | 21-225_218G4 | NA | AGCTATGGCTTGCAC<br>SEQ ID NO:7749 | GTTATATGGTATGATGG<br>AAGTAATAAATACTATG<br>CAGACTCCGTGAAGGGC<br>SEQ ID NO:15761 | TGGTACTACTATTACTACGG<br>TATGGACGTC<br>SEQ ID NO:23773 |
| | | AA | SYGLH<br>SEQ ID NO:7750 | VIWYDGSNKYYADSVKG<br>SEQ ID NO:15762 | WYYYYYGMDV<br>SEQ ID NO:23774 |
| iPS:437170 | 21-225_218E5 | NA | AACTATGGCATGCAC<br>SEQ ID NO:7751 | ATTATATGGTTTGATGGA<br>AGTGATGAATACTATGC<br>AGACTCCGTGAAGGGC<br>SEQ ID NO:15763 | GGCCTATCTGTCTACTACTA<br>CGGTATGGACGTC<br>SEQ ID NO:23775 |
| | | AA | NYGMH<br>SEQ ID NO:7752 | IIWFDGSDEYYADSVKG<br>SEQ ID NO:15764 | GLSVYYYGMDV<br>SEQ ID NO:23776 |
| iPS:437172 | 21-225_219A7 | NA | CACTATGGCATGCAC<br>SEQ ID NO:7753 | GTCATATGGTATGATGG<br>AAGTAATAAATACTATG<br>CAGACTCCGTGAAGGGC<br>SEQ ID NO:15765 | GGGGACTGGAACCCCGAGGG<br>TATGGACGTC<br>SEQ ID NO:23777 |
| | | AA | HYGMH<br>SEQ ID NO:7754 | VIWYDGSNKYYADSVKG<br>SEQ ID NO:15766 | GDWNPEGMDV<br>SEQ ID NO:23778 |

FIGURE 49
(Continued)

| | | | | | | |
|---|---|---|---|---|---|---|
| iPS:437182 | 21-225_221H2 | NA | CACTATGGCATGCAC | GTTATATGGTATGATGG AAGTAATAAATACTATG CAGACTCCGTGAAGGGC | GGGGACTGGAACCCCGAGGG TATGGACGTC | |
| | | | SEQ ID NO:7755 | SEQ ID NO:15767 | SEQ ID NO:23779 | |
| | | AA | HYGMH | VIWYDGSNKYYADSVKG | GDWNPEGMDV | |
| | | | SEQ ID NO:7756 | SEQ ID NO:15768 | SEQ ID NO:23780 | |
| iPS:437184 | 21-225_221G4 | NA | CACTATGGCATGCAC | GTTATATGGTATGATGG AAGTAATAAATACTATG CAGACTCCGTGAAGGGC | GGGGACTGGAACCCCGAGGG TATGGACGTC | |
| | | | SEQ ID NO:7757 | SEQ ID NO:15769 | SEQ ID NO:23781 | |
| | | AA | HYGMH | VIWYDGSNKYYADSVKG | GDWNPEGMDV | |
| | | | SEQ ID NO:7758 | SEQ ID NO:15770 | SEQ ID NO:23782 | |
| iPS:437186 | 21-225_224H2 | NA | AGCAACAGTGCTGCTTGGAA C | AGGACATACTACAGTC CAAGTGGTATAATGATT ATGCAGTATCTGTGAAA AGT | GAGGGGGGCTAGGATATTG TAGTAGTACCAGTGCTATG GAGGCTGGTTCGACCCC | |
| | | | SEQ ID NO:7759 | SEQ ID NO:15771 | SEQ ID NO:23783 | |
| | | AA | SNSAAWN | RTYYRSKWYNDYAVSVK S | EGGLGYCSSTSCYGGWFDP | |
| | | | SEQ ID NO:7760 | SEQ ID NO:15772 | SEQ ID NO:23784 | |
| iPS:437188 | 21-225_224B11 | NA | GGCTACTATATACAC | TGGATCAACCTAAAAA TGGTGGCACAAACTATG CACAGAAGTTTCAGGGC | GGAGGCGTTTGATTACTTCTA CTACTACGCTATGGACGTC | |
| | | | SEQ ID NO:7761 | SEQ ID NO:15773 | SEQ ID NO:23785 | |

FIGURE 49
(Continued)

| | | AA | GYYIH | | WINPKNGGTNYAQKFQG | | GAFDYFYYYAMDV | |
|---|---|---|---|---|---|---|---|---|
| iPS:437190 | 21-225_225A9 | NA | ACCTATGGCATGCAC | SEQ ID NO:7762 | GTTATATGGTATGATGG AAGTAATAAATACTATG CAGACTCCGTGAAGGGC | SEQ ID NO:15774 | GATAACCACTATTGTAGTAG TACCAGCTGCTCCCCATACT ACTACTACTTCGGTATGGAC GTC | SEQ ID NO:23786 |
| | | AA | TYGMH | SEQ ID NO:7763 | VIWYDGSNKYYADSVKG | SEQ ID NO:15775 | DNHYCSSTSCSPYYYFGMDV | SEQ ID NO:23787 |
| iPS:437192 | 21-225_225E9 | NA | AGCTATGGCATGCAC | SEQ ID NO:7764 | GTTATGTGGTATGATGG AGGTAATAAGACTATG CAGACTCCGTGAAGGGC | SEQ ID NO:15776 | GATCGGGAATATTGTACTAG TACCAGCTGCCCTTACTACT ACTACTACGGTATGGACGTC | SEQ ID NO:23788 |
| | | AA | SYGMH | SEQ ID NO:7765 | VMWYDGGNKDYADSVK G | SEQ ID NO:15777 | DREYCTSTSCPYYYYYGMDV | SEQ ID NO:23789 |
| iPS:437194 | 21-225_226B2 | NA | GGCTACTTTATGCAC | SEQ ID NO:7766 | TGGATCAACCCTAACAG TGGTGACACAAACTATG CACAGAAGTTTCAGGGC | SEQ ID NO:15778 | GGGACTTACTATGGTTCGG GAGTTATTTAACGAACTTG ACTCC | SEQ ID NO:23790 |
| | | AA | GYFMH | SEQ ID NO:7767 | WINPNSGDTNYAQKFQG | SEQ ID NO:15779 | GTYYGSGSYFNELDS | SEQ ID NO:23791 |
| iPS:437196 | 21-225_226B7 | NA | GGCTACTATATGCAC | SEQ ID NO:7768 | TGGATCAACCCTAACAG TGGAGGCACAAACTATG CACAGAAGTTTCAGGAC | SEQ ID NO:15780 | GGATATTACTATGGTTCGGG GAGTTATTATAACTGGTTCG ACTCC | SEQ ID NO:23792 |
| | | AA | GYYMH | SEQ ID NO:7769 | WINPNSGGTNYAQKFQD | SEQ ID NO:15781 | GYYYGSGSYYNWFDS | SEQ ID NO:23793 |

FIGURE 49
(Continued)

| | | | | | |
|---|---|---|---|---|---|
| iPS:437198 | 21-225_226F8 | NA | SEQ ID NO:7770<br>GGCTACTATATACAC | SEQ ID NO:15782<br>TGGATCAACCCTAACAG<br>TGGTGGCACAAACTATG<br>CACGGAAGTTTCAGGGC | SEQ ID NO:23794<br>GGAGCGTTTGATTACTACTA<br>CTACTACGCTTTGGACGTC |
| | | AA | SEQ ID NO:7771<br>GYYIH | SEQ ID NO:15783<br>WINPNSGGTNYARKFQG | SEQ ID NO:23795<br>GAFDYYYYYALDV |
| iPS:437200 | 21-225_226A10 | NA | SEQ ID NO:7772<br>GGCTACTTTATGCAC | SEQ ID NO:15784<br>TGGATCAACCCTAACAG<br>TGGTGACAAACTATG<br>CACAGAAGTTTCAGGGC | SEQ ID NO:23796<br>GGGACTTACTATGGTTCGGG<br>GAGTTATTTAACGAACTG<br>ACTCC |
| | | AA | SEQ ID NO:7773<br>GYFMH | SEQ ID NO:15785<br>WINPNSGDTNYAQKFQG | SEQ ID NO:23797<br>GTYYGSGSYFNELDS |
| iPS:437202 | 21-225_227D3 | NA | SEQ ID NO:7774<br>GGCTACTATATGCAC | SEQ ID NO:15786<br>TGGATCAACCCTAAGAG<br>TGGTGGCACAAACTTTG<br>CACAGAAGTTTCAGGGC | SEQ ID NO:23798<br>GGAGCGTTTGATTACTCTA<br>CTACTACGGTATGGACGTC |
| | | AA | SEQ ID NO:7775<br>GYFMH | SEQ ID NO:15787<br>WINPKSGGTNFAQKFQG | SEQ ID NO:23799<br>GAFDYFYYYGMDV |
| iPS:437204 | 21-225_227E5 | NA | SEQ ID NO:7776<br>AGCTATGCCATGAGC | SEQ ID NO:15788<br>GCTATTAGTAGTGGT<br>GGTAGCACATACGC<br>AGACTCCGTGAAGGGC | SEQ ID NO:23800<br>GAATATTGTGGTGGTGACTG<br>CTATTCCCCTACTACTA<br>CTACGGTATGGACGTC |
| | | AA | SEQ ID NO:7777<br>SYAMS | SEQ ID NO:15789<br>AISGSGGSTYYADSVKG | SEQ ID NO:23801<br>EYCGGDCYSPYYYYYGMDV |
| iPS:437208 | 21-225_227C10 | NA | SEQ ID NO:7778<br>GGCTACTATATGCAC | SEQ ID NO:15790<br>TGGATCAACCCTAAGAG<br>TGGTGGCACAAACTATG<br>CACAGAAGTTTCAGGGC | SEQ ID NO:23802<br>GGAGCGTTTGATTACTTCTA<br>CTACTACGGTATGGACGTC |
| | | | SEQ ID NO:7779 | SEQ ID NO:15791 | SEQ ID NO:23803 |

FIGURE 49
(Continued)

| | | | | | |
|---|---|---|---|---|---|
| iPS:437210 | 21-225_227E12 | AA | GYYMH<br>SEQ ID NO:7780 | WINPKSGGTNYAQKFQG<br>SEQ ID NO:15792 | GAFDYFYYGMDV<br>SEQ ID NO:23804 |
| | | NA | ACTAGTGGAGTGGGTGTGGGC<br>SEQ ID NO:7781 | CTCATTTATTGGAATGAT<br>GATAAGGTCTACAGCCC<br>ATCTCTGAAGAGC<br>SEQ ID NO:15793 | AGGGGACAGCAGCTGGCCCT<br>CGACTAC<br>SEQ ID NO:23805 |
| iPS:437214 | 21-225_48B12 | AA | TSGVGVG<br>SEQ ID NO:7782 | LIYWNDDKVYSPSLKS<br>SEQ ID NO:15794 | RGQQLALDY<br>SEQ ID NO:23806 |
| | | NA | AGCTATGCCATGAAC<br>SEQ ID NO:7783 | GCTATTAGTGGTCGTGGT<br>GGTAACACATTCTACG<br>AGACTCCGTGAAGGGC<br>SEQ ID NO:15795 | AGAGAGACGTATAACTGGAA<br>CTACGAAGGGTTTGACTAC<br>SEQ ID NO:23807 |
| iPS:437216 | 21-225_51D5 | AA | SYAMN<br>SEQ ID NO:7784 | AISGRGGNTFYADSVKG<br>SEQ ID NO:15796 | RETYNWNYEGFDY<br>SEQ ID NO:23808 |
| | | NA | AGCTATGTCATGAGC<br>SEQ ID NO:7785 | ACTATGAGTGGTAGTGG<br>TGGTCGCACATACTACG<br>CAGACTCCGTGAACGGC<br>SEQ ID NO:15797 | GTGACTGCTTTTGACTAC<br>SEQ ID NO:23809 |
| iPS:437220 | 21-225_55H6 | AA | SYVMS<br>SEQ ID NO:7786 | TMSGSGGRTYYADSVNG<br>SEQ ID NO:15798 | VTAFDY<br>SEQ ID NO:23810 |
| | | NA | AGCTATAGCATGAAC<br>SEQ ID NO:7787 | TCCATTAGTGGTAGTAGT<br>ACTTACATATACTACGCA<br>GACTCAGTGAAGGGC<br>SEQ ID NO:15799 | ACTGGGGTCTTTGACTAC<br>SEQ ID NO:23811 |
| iPS:437224 | 21-225_56H1 | AA | SYSMN<br>SEQ ID NO:7788 | SISGSSTYIYYADSVKG<br>SEQ ID NO:15800 | TGVFDY<br>SEQ ID NO:23812 |
| | | NA | AACTATAGAATGAAC<br>SEQ ID NO:7789 | TCCATTAGTGGTAGTAGT<br>ACTGACATATACTACG<br>AGACTCAGTGAAGGGC<br>SEQ ID NO:15801 | GTGGCCTCCTTTGACTAC<br>SEQ ID NO:23813 |

FIGURE 49 (Continued)

| | | | | | | |
|---|---|---|---|---|---|---|
| iPS:437226 | 21-225_57C2 | AA | NYRMN SEQ ID NO:7790 | SISGSSTIDIYYADSVKG SEQ ID NO:15802 | VASFDY SEQ ID NO:23814 |
| | | NA | AGCTTTGGCATGAAC SEQ ID NO:7791 | TCTATTAGTAGTAGTACT GGTTACATATACAACGC AGACTCAGTGAAGGGC SEQ ID NO:15803 | ACCTATAGTGGGAGCCTGGA CGTC SEQ ID NO:23815 |
| iPS:437228 | 21-225_60C11 | AA | SFGMN SEQ ID NO:7792 | SISSSTGYIYNADSVKG SEQ ID NO:15804 | TYSGSLDV SEQ ID NO:23816 |
| | | NA | AGCTATGCCATGAGC SEQ ID NO:7793 | GCTATTAGTGGTAGTGGT GGTAACACATTCTACGC AGACTCCGTGAAGGGC SEQ ID NO:15805 | TTTTTCGGTGTAGTGGGAGT CGGGTGCTTTGACTAC SEQ ID NO:23817 |
| iPS:437230 | 21-225_62H10 | AA | SYAMS SEQ ID NO:7794 | AISGSGGNTFYADSVKG SEQ ID NO:15806 | FFGVGVGCFDY SEQ ID NO:23818 |
| | | NA | AGCTATAGCATGAAC SEQ ID NO:7795 | TCCATTAGTAGTAGTAGT AGTTACATATACTACGC AGACTCAGTGAAGGGC SEQ ID NO:15807 | GGGGGTTCGAGGGGGTTCGA CCCC SEQ ID NO:23819 |
| iPS:437232 | 21-225_63E1 | AA | SYSMN SEQ ID NO:7796 | SISSSSYIYYADSVKG SEQ ID NO:15808 | GGSRGFDP SEQ ID NO:23820 |
| | | NA | ACTTCTGCCATGAGC SEQ ID NO:7797 | GCTATTAGTGGTAGTGGT GCTAACACATTCTACGC AGACTCCGTGAAGGGC SEQ ID NO:15809 | GTTATAGCAGTGGCTGGAGG GCACTTTTCGACCCC SEQ ID NO:23821 |
| iPS:437234 | 21-225_64E2 | AA | TSAMS SEQ ID NO:7798 | AISGSGANTFYADSVKG SEQ ID NO:15810 | VIAVAGGHFFDP SEQ ID NO:23822 |
| | | NA | GGCTACTATATGCAC SEQ ID NO:7799 | TGGATCAACCCTAACAA TAATGGCACAAACTATG CACAGAAGTTTCAGGGC | GATGGGAGCAGTGGCTTTGA CTAC |

FIGURE 49
(Continued)

| | | | | | | |
|---|---|---|---|---|---|---|
| iPS:437248 | 21-225_64E2 | AA | SEQ ID NO:7799<br>GYYMH | SEQ ID NO:15811<br>WINPNNGNTNYAQKFQG | SEQ ID NO:23823<br>DGSSGFDY |
| | | NA | SEQ ID NO:7800<br>GATTACTACTGGAGC | SEQ ID NO:15812<br>GAAATCAATCATAGTGG<br>AGACACCAACTACAACC<br>CGTCCCTCAAGAGT | SEQ ID NO:23824<br>GAGTTCCATATAGTGGAAG<br>CTACCTCTACTACTACGGTA<br>TGGACGTC |
| iPS:437250 | 21-225_97H3 | AA | SEQ ID NO:7801<br>DYYWS | SEQ ID NO:15813<br>EINHSGDTNYNPSLKS | SEQ ID NO:23825<br>EFPYSGSYLYYYGMDV |
| | | NA | SEQ ID NO:7802<br>AGCTATGCCATGAGC | SEQ ID NO:15814<br>GTTATTAGTGGTGGTGGT<br>AGTAGTACATACTACGC<br>AGACTCCGTGAAGGGC | SEQ ID NO:23826<br>TGGCGAGGTAACCCCACTGA<br>CTACGGTATGGACGTC |
| iPS:437252 | 21-225_148C6 | AA | SEQ ID NO:7803<br>SYAMS | SEQ ID NO:15815<br>VISGGGSSTYYADSVKG | SEQ ID NO:23827<br>WRGNPTDYGMDV |
| | | NA | SEQ ID NO:7804<br>AGCTATGCCATGAGC | SEQ ID NO:15816<br>GTTATTAGTGGTGGTGGT<br>AGTAGCACATACTACGC<br>AGACTCCGTGAAGGGC | SEQ ID NO:23828<br>TGGCGAGGTAACCCCACTGA<br>CTACGGTATGGACGTC |
| iPS:437252 | 21-225_148H11 | AA | SEQ ID NO:7805<br>SYAMS | SEQ ID NO:15817<br>VISGGGSSTYYADSVKG | SEQ ID NO:23829<br>WRGNPTDYGMDV |
| | | NA | SEQ ID NO:7806<br>CGCTATGCCATGCAC | SEQ ID NO:15818<br>TTTATATGGTATGATGGA<br>AGTGAGAACTACTATGC<br>AGACTCCGTGAAGGGC | SEQ ID NO:23830<br>GATCGGGTGGAGGGTTCGGG<br>GACTCCCTACTACTACTACG<br>GTATGGACGTC |
| iPS:437254 | 21-225_149F2 | AA | SEQ ID NO:7807<br>RYGMH | SEQ ID NO:15819<br>FIWYDGSENYYADSVKG | SEQ ID NO:23831<br>DRVEGSGTPYYYGMDV |
| | | | SEQ ID NO:7808 | SEQ ID NO:15820 | SEQ ID NO:23832 |

FIGURE 49 (Continued)

| | | | | |
|---|---|---|---|---|
| iPS:437256 | 21-225_150F11 | NA | CGCTATGGCATGCAC<br>SEQ ID NO:7809 | TTTATATGGTATGATGGA<br>AGTGAGAACTACTATGC<br>AGACTCCGTGAAGGGC<br>SEQ ID NO:15821 | GATCGGGTGGAGGGTTCGGG<br>GACTCCCTACTACTACG<br>GTATGGACGTC<br>SEQ ID NO:23833 |
| | | AA | RYGMH<br>SEQ ID NO:7810 | FIWYDGSENYYADSVKG<br>SEQ ID NO:15822 | DRVEGSGTPYYYYGMDV<br>SEQ ID NO:23834 |
| iPS:437258 | 21-225_153F9 | NA | ACCTATGGCATGCAC<br>SEQ ID NO:7811 | GTTATATGGTATGGTGG<br>AAGTGATACAGACTATG<br>CAGACTCCGTGAGGGGC<br>SEQ ID NO:15823 | GATCGGGATTATTGTAGTGG<br>TGGTAACTGCCCTTACTACT<br>ACTACTACGTATGGACGTC<br>SEQ ID NO:23835 |
| | | AA | TYGMH<br>SEQ ID NO:7812 | VIWYGGSDTDYADSVRG<br>SEQ ID NO:15824 | DRDYCSGGNCPYYYYGMDV<br>SEQ ID NO:23836 |
| iPS:437260 | 21-225_170D1 | NA | GGCTACTTTATGCAC<br>SEQ ID NO:7813 | TGGATCAAGCCTAAAAG<br>CGGTGGCACAAACTGTG<br>CACAGAAGTTTCAGGGC<br>SEQ ID NO:15825 | GGGGGGCTACGGTGACTAC<br>GTGGGGGTCTTTGACTAC<br>SEQ ID NO:23837 |
| | | AA | GYFMH<br>SEQ ID NO:7814 | WIKPKSGGTNCAQKFQG<br>SEQ ID NO:15826 | GGATVTWGVFDY<br>SEQ ID NO:23838 |
| iPS:437262 | 21-225_170E4 | NA | AGCTATAGCATGAAC<br>SEQ ID NO:7815 | TACATTAGCAGTAGTGG<br>TAGTACCAAATACTACG<br>CAGACTCTGTGGAGGGC<br>SEQ ID NO:15827 | GATAGTAGGAAGGGGTTCTA<br>CTACGGTCTGGACGTC<br>SEQ ID NO:23839 |
| | | AA | SYSMN<br>SEQ ID NO:7816 | YISSSGSTKYYADSVEG<br>SEQ ID NO:15828 | DSRKGFYYGLDV<br>SEQ ID NO:23840 |
| iPS:437264 | 21-225_171H12 | NA | GGCTACTTTATGCAC | TGGATCAAGCCTAAGAG<br>TGGTGGCACAAACTCTG<br>CACAGAGGTTTCAGGGC | GGGGGGACTACGGTGGCTAC<br>GTGGGGGGTCTTTGACTAC |

FIGURE 49
(Continued)

| | | | | | | | |
|---|---|---|---|---|---|---|---|
| iPS:437266 | 21-225_171H12 | AA | SEQ ID NO:7817 GYFMH | SEQ ID NO:15829 WIKPKSGGTNSAQRFQG | SEQ ID NO:23841 GGTTVATWGVFDY | | |
| | | NA | SEQ ID NO:7818 GGCTACTTTATGCAC | SEQ ID NO:15830 TGGATCAAGCCTAAGAG TGGTGGCACAAACTCTG CACAGAGTTTCAGGGC | SEQ ID NO:23842 GGGGGACTACGGTGGCTAC GTGGGGGGTCTTTGACTAC | | |
| iPS:437268 | 21-225_177A5 | AA | SEQ ID NO:7819 GYFMH | SEQ ID NO:15831 WIKPKSGGTNSAQRFQG | SEQ ID NO:23843 GGTTVATWGVFDY | | |
| | | NA | SEQ ID NO:7820 AGCTATGGCATGGAC | SEQ ID NO:15832 ATTATATGGTTTGATGGA AGTAATAAATACTATGC AGACTCCGTGAAGGGC | SEQ ID NO:23844 GCATATTGTTGGTGGTGACTG CTATTTCCCCATCTCCATTA CTACGGTATGGACGTC | | |
| iPS:437270 | 21-225_177D2 | AA | SEQ ID NO:7821 SYGMD | SEQ ID NO:15833 IIWFDGSNKYYADSVKG | SEQ ID NO:23845 AYCGGDCYFPHLHYYGMDV | | |
| | | NA | SEQ ID NO:7822 GGCTACTTTATGCAC | SEQ ID NO:15834 TGGATCAAGCCTAAAAG TGGTGGCACAAACTGTG CACAGAAGTTTCAGGGC | SEQ ID NO:23846 GGGGGACTACGGTGGACTAC GTGGGGGGTCTTTGACTAC | | |
| iPS:437272 | 21-225_178H4 | AA | SEQ ID NO:7823 GYFMH | SEQ ID NO:15835 WIKPKSGGTNCAQKFQG | SEQ ID NO:23847 GGTTVTTWGVFDY | | |
| | | NA | SEQ ID NO:7824 AGCTATGGCATGGAC | SEQ ID NO:15836 GTTATATGGTTATGATGG AAGTAATAGAAACTATG CAGACTCCGTGAAGGGC | SEQ ID NO:23848 GATCGGTCTAAGGGTTACGA CGGTATGGACGTC | | |
| iPS:437274 | 21-225_196D4 | | SEQ ID NO:7825 | SEQ ID NO:15837 | SEQ ID NO:23849 | | |

FIGURE 49
(Continued)

| | | | | | | | | |
|---|---|---|---|---|---|---|---|---|
| | | AA | SYGMH | | VIWYDGSNRNYADSVKG | | DRSKGYDGMDV | |
| iPS:437280 | 21-225_203C10 | NA | GACTATGGCATGCAC | SEQ ID NO:7826 | GTTATATGGTTATGATGG AGTAATACACATTATA CAGACTCCGTGAAGGGC | SEQ ID NO:15838 | GAAGTGGGTTGGCTTGATGA CTAC | SEQ ID NO:23850 |
| | | AA | DYGMH | SEQ ID NO:7827 | VIWYDGGNTHYTDSVKG | SEQ ID NO:15839 | EVGWLDDY | SEQ ID NO:23851 |
| iPS:437282 | 21-225_207C9 | NA | AGCTATGCCATGAGC | SEQ ID NO:7828 | GCTATTAGTGGTAGTGGT GGTAGCACATACTACGC AGACTCCGTGAAGGGC | SEQ ID NO:15840 | GCTGGTGGAACTACGGGGAG CTACTACTACAACGGTATGG ACGTC | SEQ ID NO:23852 |
| | | AA | SYAMS | SEQ ID NO:7829 | AISGSGGSTYYADSVKG | SEQ ID NO:15841 | AGGTTGSYYYNGMDV | SEQ ID NO:23853 |
| iPS:437286 | 21-225_208F1 | NA | GACTATGTCATGCAC | SEQ ID NO:7830 | GTTATATGGTATGATGG AAGTAATAAATACTATG TAGACTCCGTGAAGGGC | SEQ ID NO:15842 | GAACGGTATAGCAGTGGCTT GTACGACTACGGTATGGACG TC | SEQ ID NO:23854 |
| | | AA | DYVMH | SEQ ID NO:7831 | VIWYDGSNKYYVDSVKG | SEQ ID NO:15843 | ERYSSGLYDYGMDV | SEQ ID NO:23855 |
| iPS:437290 | 21-225_210G6 | NA | GACTATGTCATGCAC | SEQ ID NO:7832 | GTTATATGGTATGATGG AAGTAATAATACTATG TAGACTCCGTGAAGGGC | SEQ ID NO:15844 | GAACGGTATAGCAGTGGCTT GTACGACTACGGTATGGACG TC | SEQ ID NO:23856 |
| | | | | SEQ ID NO:7833 | | SEQ ID NO:15845 | | SEQ ID NO:23857 |

FIGURE 49
(Continued)

| | | AA | DYYMH | VIWYDGSNKYYVDSVKG | ERYSSGLYDYGMDV |
|---|---|---|---|---|---|
| | | | SEQ ID NO:7834 | SEQ ID NO:15846 | SEQ ID NO:23858 |
| iPS:437294 | 21-225_216D5 | NA | AGTGGTGGTTACTACTGGAG C | TACATCTATTACAGTGGG AGCACCTACTACAACCC GTCCCTCAAGAGT | GATTCCCCTGACAGGGGGTT TGACTAC |
| | | | SEQ ID NO:7835 | SEQ ID NO:15847 | SEQ ID NO:23859 |
| | | AA | SGGYYWS | YIYYSGSTYYNPSLKS | DSPDRGFDY |
| | | | SEQ ID NO:7836 | SEQ ID NO:15848 | SEQ ID NO:23860 |
| iPS:437302 | 21-225_225B11 | NA | AGCTATGGCATGCAC | ATTATATCATATAGTGGA AGTAATAAATACTATGC AGACTCCGTGAAGGGC | CGGGGATACAGCTATGGCGG GTACGGTATGGACGTC |
| | | | SEQ ID NO:7837 | SEQ ID NO:15849 | SEQ ID NO:23861 |
| | | AA | SYGMH | IISYSGSNKYYADSVKG | RGYSYGGYGMDV |
| | | | SEQ ID NO:7838 | SEQ ID NO:15850 | SEQ ID NO:23862 |
| iPS:437320 | 21-225_75A1 | NA | GATTACTACTGGAGC | GAAATCAATCATAGTGG AGACAACAACTACAACC CGTCCCTCAAGAGT | GAGTTCCATATAGTGGAAG CTACCTCTACTACGGTA TGGACGTC |
| | | | SEQ ID NO:7839 | SEQ ID NO:15851 | SEQ ID NO:23863 |
| | | AA | DYYWS | EINHSGDTNYNPSLKS | EFPYSGSYLYYYGMDV |
| | | | SEQ ID NO:7840 | SEQ ID NO:15852 | SEQ ID NO:23864 |
| iPS:437322 | 21-225_75B1 | NA | AATTATGATATCAAC | TGGATGCACCTAACAG TGGTAACACAGGCTATG CACAGAAGTTCCAGGGC | AGTAGTGGCTGGTACTGGTT CGACCCC |
| | | | SEQ ID NO:7841 | SEQ ID NO:15853 | SEQ ID NO:23865 |
| | | AA | NYDIN | WMHPNSGNTGYAQKFQG | SSGWYWFDP |
| | | | SEQ ID NO:7842 | SEQ ID NO:15854 | SEQ ID NO:23866 |

FIGURE 49
(Continued)

| | | | | | |
|---|---|---|---|---|---|
| iPS:437324 | 21-225_75C2 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:7843 | SEQ ID NO:15855 | SEQ ID NO:23867 |
| | | AA | GCYWS | EINHSGSTNYNPSLKS | DYGGMDV |
| | | | SEQ ID NO:7844 | SEQ ID NO:15856 | SEQ ID NO:23868 |
| iPS:437326 | 21-225_75C10 | NA | AGTTATGGCATGCAT | GTTATATGGTATGATGG AAGTGATAAATACTATG CAGACTCCGTGAAGGGC | GATCGGTTAGTGGGAGCTAC GGTTGATGCTTTTGATATC |
| | | | SEQ ID NO:7845 | SEQ ID NO:15857 | SEQ ID NO:23869 |
| | | AA | SYGMH | VIWYDGSDKYYADSVKG | DRLVGATVDAFDI |
| | | | SEQ ID NO:7846 | SEQ ID NO:15858 | SEQ ID NO:23870 |
| iPS:437328 | 21-225_75D3 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:7847 | SEQ ID NO:15859 | SEQ ID NO:23871 |
| | | AA | GCYWS | EINHSGSTNYNPSLKS | DYGGMDV |
| | | | SEQ ID NO:7848 | SEQ ID NO:15860 | SEQ ID NO:23872 |
| iPS:437332 | 21-225_75F3 | NA | GGTTGCTACTGGAGC | GAAATCAATCATAGTGG AAGCACCAACTACAACC CGTCCCTCAAGAGT | GACTACGGCGGGTATGGACGT C |
| | | | SEQ ID NO:7849 | SEQ ID NO:15861 | SEQ ID NO:23873 |
| | | AA | GCYWS | EINHSGSTNYNPSLKS | DYGGMDV |
| | | | SEQ ID NO:7850 | SEQ ID NO:15862 | SEQ ID NO:23874 |
| iPS:437334 | 21-225_75F11 | NA | ACTGGGTGGAGTGGGTGTGG C | CTCATTATTGGGATGAT GATAAGCGCTACAGCCC ATCTCTGAAGAGC | CTTATAGCAGTGGCCTTTGA CTAC |
| | | | SEQ ID NO:7851 | SEQ ID NO:15863 | SEQ ID NO:23875 |
| | | AA | TGGVGVG | LIYWDDDKRYSPSLKS | LIAVAFDY |

FIGURE 49
(Continued)

| | | | | | | | |
|---|---|---|---|---|---|---|---|
| iPS:437340 | 21-225_75G9 | NA | SEQ ID NO:7852 GGTTGCTACTGGAGC | SEQ ID NO:15864 GAAATCAATCATAGTGG AAGGACCAACTACAACC CGTCCCTCAAGAGT | SEQ ID NO:23876 GACTACGGTGGGCTTGACTA C | | |
| | | AA | SEQ ID NO:7853 GCYWS | SEQ ID NO:15865 EINHSGRTNYNPSLKS | SEQ ID NO:23877 DYGGLDY | | |
| iPS:437344 | 21-225_75G12 | NA | SEQ ID NO:7854 GGTTGCTACTGGAGC | SEQ ID NO:15866 GAAATCAATCATAGTGG AAGCACCAACTACAACC CGTCCCTCAAGAGT | SEQ ID NO:23878 GACTACGGCGGTATGGACGT C | | |
| | | AA | SEQ ID NO:7855 GCYWS | SEQ ID NO:15867 EINHSGSTNYNPSLKS | SEQ ID NO:23879 DYGGMDV | | |
| iPS:437346 | 21-225_75H7 | NA | SEQ ID NO:7856 AGGAGTAGTTACTACTGGGG C | SEQ ID NO:15868 AGTATCTATTATAGTGGG AGCGCTACTCCAACC GTCCCTCAAGAGT | SEQ ID NO:23880 CTTGACTCTAACTGGGGTCT TGACTAC | | |
| | | AA | SEQ ID NO:7857 RSSYYWG | SEQ ID NO:15869 SIYYSGSAYSNPSLKS | SEQ ID NO:23881 LDSNWGLDY | | |
| iPS:437350 | 21-225_74A3 | NA | SEQ ID NO:7858 GGTTGCTACTGGAGC | SEQ ID NO:15870 GAAATCAATCATAGTGG AAGCACCAACTACAACC CGTCCCTCAAGAGT | SEQ ID NO:23882 GACTACGGCGGTATGGACGT C | | |
| | | AA | SEQ ID NO:7859 GCYWS | SEQ ID NO:15871 EINHSGSTNYNPSLKS | SEQ ID NO:23883 DYGGMDV | | |
| iPS:437356 | 21-225_74B1 | NA | SEQ ID NO:7860 AATTATGATATCAAC | SEQ ID NO:15872 TGGATGAACCCTAACAG TGGTAACACAGGCTATG CACAGAAGTTCCAGGGC | SEQ ID NO:23884 ACCAGTGGCTGGAACTTCTT TGACTAC | | |
| | | | SEQ ID NO:7861 | SEQ ID NO:15873 | SEQ ID NO:23885 | | |

FIGURE 49
(Continued)

| | | | | | |
|---|---|---|---|---|---|
| iPS:437361 | 21-225_74C1 | AA | NYDIN | WMNPNSGNTGYAQKFQG | TSGWNFFDY |
| | | | SEQ ID NO:7862 | SEQ ID NO:15874 | SEQ ID NO:23886 |
| | | NA | AATTATGATATCAAC | TGGATGAACCCTGACAGTGGTAACACAGGCTTTGCACAGAAGTTCCAGGGC | TCCAGTGGCTGGTACTGGTTCGACCCC |
| | | | SEQ ID NO:7863 | SEQ ID NO:15875 | SEQ ID NO:23887 |
| iPS:437363 | 21-225_74C10 | AA | NYDIN | WMNPDSGNTGFAQKFQG | SSGWYWFDP |
| | | | SEQ ID NO:7864 | SEQ ID NO:15876 | SEQ ID NO:23888 |
| | | NA | AATTATGATATCAAC | TGGATGAACCCTAACAGTGGTAACATAGGCTATGCACAGAAGTTCCAGGGC | AGCAGTGGCTGGTACTGGTTCGACCCC |
| | | | SEQ ID NO:7865 | SEQ ID NO:15877 | SEQ ID NO:23889 |
| iPS:437369 | 21-225_74D6 | AA | NYDIN | WMNPNSGNIGYAQKFQG | SSGWYWFDP |
| | | | SEQ ID NO:7866 | SEQ ID NO:15878 | SEQ ID NO:23890 |
| | | NA | GGTTGCTACTGGAGC | GAAATCAATCATAGTGGAAGCACCAACTACAACCGTCCCTCAAGAGT | GACTACGGCGGGTATGGAGACGTC |
| | | | SEQ ID NO:7867 | SEQ ID NO:15879 | SEQ ID NO:23891 |
| iPS:437371 | 21-225_74D8 | AA | GCYWS | EINHSGSTNYNPSLKS | DYGGMDV |
| | | | SEQ ID NO:7868 | SEQ ID NO:15880 | SEQ ID NO:23892 |
| | | NA | AACTACGACATGCAC | GCTATTGGTACTGCTGGTGACACATATATCCAGGCTCCGTGAAGGGC | GTTCTTGACTACGGTGACTCCTGGGCTACTACTACGGTATGGACGTC |
| | | | SEQ ID NO:7869 | SEQ ID NO:15881 | SEQ ID NO:23893 |
| | | AA | NYDMH | AIGTAGDTYYPGSVKG | VLDYGDSLGYYYYGMDV |
| | | | SEQ ID NO:7870 | SEQ ID NO:15882 | SEQ ID NO:23894 |

FIGURE 49
(Continued)

| | | | | | |
|---|---|---|---|---|---|
| iPS:437377 | 21-225_74G9 | NA | ACTGGTGGAGTGGGTGTGG C | CTCATTTATTGGGATGAT GATAAGGCGCTACAGCCC ATCTCTGAAGAGC | CTTATAGCAGTGGCCTTTGA CTAC |
| | | | SEQ ID NO:7871 | SEQ ID NO:15883 | SEQ ID NO:23895 |
| | | AA | TGGVGVG | LIYWDDDKRYSPSLKS | LIAVAFDY |
| | | | SEQ ID NO:7872 | SEQ ID NO:15884 | SEQ ID NO:23896 |
| iPS:437379 | 21-225_74H2 | NA | AATTATGATATCAAC | TGGATGCACCCTAACAG TGGTAACACAGGCTTTG CACAGAAGTTCCAGGGC | TCCAGTGGCTGGTACTGGTT CGACCCC |
| | | | SEQ ID NO:7873 | SEQ ID NO:15885 | SEQ ID NO:23897 |
| | | AA | NYDIN | WMHPNSGNTGFAQKFQG | SSGWYWFDP |
| | | | SEQ ID NO:7874 | SEQ ID NO:15886 | SEQ ID NO:23898 |
| iPS:437383 | 21-225_74H8 | NA | AACGCCTGGATGAAC | CGTATTAAAAGCAAAAC TGATGGTGGGACAACAG ACTACGCTGCACCCGTG AAAGGC | GTGGGAGTACTACGGACTA C |
| | | | SEQ ID NO:7875 | SEQ ID NO:15887 | SEQ ID NO:23899 |
| | | AA | NAWMN | RIKSKTDGGTTDYAAPVK G | VGATTDY |
| | | | SEQ ID NO:7876 | SEQ ID NO:15888 | SEQ ID NO:23900 |
| iPS:438664 | 21-225_216G1 | NA | AACTATGGCATGCAC | GTTATATGGTATGATGG AAGTAATAAATACTATG CAGACTCCGTGAAGGGC | GGGGACTGGAACCCCGAGGG TATGGACGTC |
| | | | SEQ ID NO:7877 | SEQ ID NO:15889 | SEQ ID NO:23901 |
| | | AA | NYGMH | VIWYDGSNKYYADSVKG | GDWNPEGMDV |
| | | | SEQ ID NO:7878 | SEQ ID NO:15890 | SEQ ID NO:23902 |

FIGURE 49
(Continued)

| iPS:441468 | 21-225_25A4.001.001 | NA | AATTATGATATTAAT SEQ ID NO:7879 | TGGATGTACCCTAACAG TGGTAGCACAGGCTATG CACAGAAATTCCAGGGC SEQ ID NO:15891 | AGCAGTGGCTGGTACTACTT TGACTAC SEQ ID NO:23903 |
|---|---|---|---|---|---|
| | | AA | NYDIN SEQ ID NO:7880 | WMYPNSGSTGYAQKFQG SEQ ID NO:15892 | SSGWYYFDY SEQ ID NO:23904 |
| iPS:441475 | 21-225_25A4.001.002 | NA | AATTATGATATTAAT SEQ ID NO:7881 | TGGATGTACCTAACAG TGGTAACGCAGGCTATG CACAGAAATTCCAGGGC SEQ ID NO:15893 | AGCAGTGGCTGGTACTACTT TGACTAC SEQ ID NO:23905 |
| | | AA | NYDIN SEQ ID NO:7882 | WMYPNSGNAGYAQKFQG SEQ ID NO:15894 | SSGWYYFDY SEQ ID NO:23906 |
| iPS:441482 | 21-225_25A4.001.003 | NA | AATTATGATATTAAT SEQ ID NO:7883 | TGGATGTACCCTAACAG TGGTAACGTAGGCTATG CACAGAAATTCCAGGGC SEQ ID NO:15895 | AGCAGTGGCTGGTACTACTT TGACTAC SEQ ID NO:23907 |
| | | AA | NYDIN SEQ ID NO:7884 | WMYPNSGNVGYAQKFQG SEQ ID NO:15896 | SSGWYYFDY SEQ ID NO:23908 |
| iPS:441489 | 21-225_25A4.001.004 | NA | AATTATGATATTAAT SEQ ID NO:7885 | TGGATGTACCCTAACAG TGGTCAAACAGGCTATG CACAGAAATTCCAGGGC SEQ ID NO:15897 | AGCAGTGGCTGGTACTACTT TGACTAC SEQ ID NO:23909 |

FIGURE 49
(Continued)

| | | AA | NYDIN | | WMYPNSGQTGYAQKFQG | SSGWYYFDY |
|---|---|---|---|---|---|---|
| iPS:441496 | | | SEQ ID NO:7886 | | SEQ ID NO:15898 | SEQ ID NO:23910 |
| | 21-225_25A4.001.005 | NA | AATTATGATATTAAT | | TGGATGTACCCTAACAGTGGTAGCACAGGCTATGCACAGAAATTCCAGGGC | AGCAGTGGCTGGTACTACTTTGACTAC |
| | | | SEQ ID NO:7887 | | SEQ ID NO:15899 | SEQ ID NO:23911 |
| | | AA | NYDIN | | WMYPNSGSTGYAQKFQG | SSGWYYFDY |
| iPS:441505 | | | SEQ ID NO:7888 | | SEQ ID NO:15900 | SEQ ID NO:23912 |
| | 21-225_25A4.001.006 | NA | AATTATGATATTAAT | | TGGATGTACCCTAACAGTGGTAACGCAGGCTATGCACAGAAATTCCAGGGC | AGCAGTGGCTGGTACTACTTTGACTAC |
| | | | SEQ ID NO:7889 | | SEQ ID NO:15901 | SEQ ID NO:23913 |
| | | AA | NYDIN | | WMYPNSGNAGYAQKFQG | SSGWYYFDY |
| iPS:441512 | | | SEQ ID NO:7890 | | SEQ ID NO:15902 | SEQ ID NO:23914 |
| | 21-225_25A4.001.007 | NA | AATTATGATATTAAT | | TGGATGTACCCTAACAGTGGTAACGTAGGCTATGCACAGAAATTCCAGGGC | AGCAGTGGCTGGTACTACTTTGACTAC |
| | | | SEQ ID NO:7891 | | SEQ ID NO:15903 | SEQ ID NO:23915 |
| | | AA | NYDIN | | WMYPNSGNVGYAQKFQG | SSGWYYFDY |
| | | | SEQ ID NO:7892 | | SEQ ID NO:15904 | SEQ ID NO:23916 |

FIGURE 49
(Continued)

| | | | | | |
|---|---|---|---|---|---|
| iPS:441519 | 21-225_25A4.001.008 | NA | AATTATGATATTAAT SEQ ID NO:7893 | TGGATGTACCCTAACAG TGGTCAAACAGGCTATG CACAGAAATTCCAGGGC SEQ ID NO:15905 | AGCAGTGGCTGGTACTACTT TGACTAC SEQ ID NO:23917 |
| | | AA | NYDIN SEQ ID NO:7894 | WMYPNSGQTGYAQKFQG SEQ ID NO:15906 | SSGWYYFDY SEQ ID NO:23918 |
| iPS:441554 | 21-225_25A4.001.013 | NA | AATTATGATATTAAT SEQ ID NO:7895 | TGGATGTACCCTAACAG TGGTAGCACAGGCTATG CACAGAAATTCCAGGGC SEQ ID NO:15907 | AGCAGTGGCTGGTACTACTT TGACTAC SEQ ID NO:23919 |
| | | AA | NYDIN SEQ ID NO:7896 | WMYPNSGSTGYAQKFQG SEQ ID NO:15908 | SSGWYYFDY SEQ ID NO:23920 |
| iPS:441595 | 21-225_25A4.001.019 | NA | AATTATGATATTAAT SEQ ID NO:7897 | TGGATGTACCCTAACAG TGGTCAAACAGGCTATG CACAGAAATTCCAGGGC SEQ ID NO:15909 | AGCAGTGGCTGGTACTACTT TGACTAC SEQ ID NO:23921 |
| | | AA | NYDIN SEQ ID NO:7898 | WMYPNSGSTGYAQKFQG SEQ ID NO:15910 | SSGWYYFDY SEQ ID NO:23922 |
| iPS:441604 | 21-225_25A4.001.020 | NA | AATTATGATATTAAT SEQ ID NO:7899 | TGGATGTACCCTAACAG TGGTCAAACAGGCTATG CACAGAAATTCCAGGGC SEQ ID NO:15911 | AGCAGTGGCTGGTACTACTT TGACTAC SEQ ID NO:23923 |

FIGURE 49
(Continued)

| | | | AA | NYDIN | | WMYPNSGQTGYAQKFQG | SSGWYYFDY |
|---|---|---|---|---|---|---|---|
| iPS:441613 | 21-225_25A4.001.021 | | | | SEQ ID NO:7900 | | SEQ ID NO:23924 |
| | | | NA | AATTATGATATTAAT | | TGGATGTACCCTAACAG TGGTAACGCAGGCTATG CACAGAAATTCCAGGGC | AGCAGTGGCTGGTACTACTT TGACTAC |
| | | | | | SEQ ID NO:7901 | SEQ ID NO:15912 | SEQ ID NO:23925 |
| | | | AA | NYDIN | | WMYPNSGNAGYAQKFQG | SSGWYYFDY |
| iPS:441843 | 21-225_4A2.001.001 | | | | SEQ ID NO:7902 | SEQ ID NO:15913 | SEQ ID NO:23926 |
| | | | NA | AATTATGATATCAAC | | TGGATGCACCCTAACAG TGGTAACACAGGCTATG CACAGAAGTTCCAGGGC | AGCAGTGGCTGGTACTACTT TGACTAC |
| | | | | | SEQ ID NO:7903 | SEQ ID NO:15914 | SEQ ID NO:23927 |
| | | | AA | NYDIN | | WMHPNSGNTGYAQKFQG | SSGWYYFDY |
| iPS:441847 | 21-225_4A2.001.002 | | | | SEQ ID NO:7904 | SEQ ID NO:15915 | SEQ ID NO:23928 |
| | | | NA | AATTATGATATCAAC | | TGGATGCACCCTAACAG TGGTAACACAGGCTATG CACAGAAGTTCCAGGGC | AGCAGTGGCTGGTACTACTT TGACTAC |
| | | | | | SEQ ID NO:7905 | SEQ ID NO:15916 | SEQ ID NO:23929 |
| | | | AA | NYDIN | | WMHPNSGNTGYAQKFQG | SSGWYYFDY |
| iPS:441853 | 21-225_4A2.001.003 | | | | SEQ ID NO:7906 | SEQ ID NO:15917 | SEQ ID NO:23930 |
| | | | NA | AATTATGATATCAAC | | TGGATGCACCCTAACAG TGGTAACACAGGCTATG CACAGAAGTTCCAGGGC | AGCAGTGGCTGGTACTACTT TGACTAC |
| | | | | | SEQ ID NO:7907 | SEQ ID NO:15919 | SEQ ID NO:23931 |

FIGURE 49
(Continued)

| | | AA | NYDIN | | WMHPNSGNTGYAQKFQG | SSGWYYFDY |
|---|---|---|---|---|---|---|
| iPS:441859 | | NA | SEQ ID NO:7908 AATTATGATATCAAC | | SEQ ID NO:15920 TGGATGCACCCTAACAG TGGTAACGCAGGCTATG CACAGAAGTTCCAGGGC | SEQ ID NO:23932 AGCAGTGGCTGGTACTACTT TGACTAC |
| | 21-225_4A2.001.004 | AA | SEQ ID NO:7909 NYDIN | | SEQ ID NO:15921 WMHPNSGNAGYAQKFQG | SEQ ID NO:23933 SSGWYYFDY |
| iPS:441866 | | NA | SEQ ID NO:7910 AATTATGATATCAAC | | SEQ ID NO:15922 TGGATGCACCCTAACAG TGGTAGCACAGGCTATG CACAGAAGTTCCAGGGC | SEQ ID NO:23934 AGCAGTGGCTGGTACTACTT TGACTAC |
| | 21-225_4A2.001.005 | AA | SEQ ID NO:7911 NYDIN | | SEQ ID NO:15923 WMHPNSGSTGYAQKFQG | SEQ ID NO:23935 SSGWYYFDY |
| iPS:441873 | | NA | SEQ ID NO:7912 AATTATGATATCAAC | | SEQ ID NO:15924 TGGATGCACCCTAACAG TGGTCAAACAGGCTATG CACAGAAGTTCCAGGGC | SEQ ID NO:23936 AGCAGTGGCTGGTACTACTT TGACTAC |
| | 21-225_4A2.001.006 | AA | SEQ ID NO:7913 NYDIN | | SEQ ID NO:15925 WMHPNSGQTGYAQKFQG | SEQ ID NO:23937 SSGWYYFDY |
| iPS:441880 | | NA | SEQ ID NO:7914 AATTATGATATCAAC | | SEQ ID NO:15926 TGGATGCACCCTAACAG TGGTCAAACAGGCTATG CACAGAAGTTCCAGGGC | SEQ ID NO:23938 AGCAGTGGCTGGTACTACTT TGACTAC |
| | 21-225_4A2.001.007 | AA | SEQ ID NO:7915 NYDIN | | SEQ ID NO:15927 WMHPNSGQTGYAQKFQG | SEQ ID NO:23939 SSGWYYFDY |

FIGURE 49
(Continued)

| iPS | ID | | | | | |
|---|---|---|---|---|---|---|
| iPS:441884 | 21-225_4A2.001.008 | NA | SEQ ID NO:7916<br>AATTATGATATCAAC | SEQ ID NO:15928<br>TGGATGCACCCTAACAG<br>TGGTAACGCAGGCTATG<br>CACAGAAGTTCCAGGGC | SEQ ID NO:23940<br>AGCAGTGGCTGGTACTACTT<br>TGACTAC |
| | | AA | SEQ ID NO:7917<br>NYDIN | SEQ ID NO:15929<br>WMHPNSGNAGYAQKFQG | SEQ ID NO:23941<br>SSGWYYFDY |
| iPS:441888 | 21-225_4A2.001.009 | NA | SEQ ID NO:7918<br>AATTATGATATCAAC | SEQ ID NO:15930<br>TGGATGCACCCTAACAG<br>TGGTCAAACAGGCTATG<br>CACAGAAGTTCCAGGGC | SEQ ID NO:23942<br>AGCAGTGGCTGGTACTACTT<br>TGACTAC |
| | | AA | SEQ ID NO:7919<br>NYDIN | SEQ ID NO:15931<br>WMHPNSGQTGYAQKFQG | SEQ ID NO:23943<br>SSGWYYFDY |
| iPS:441892 | 21-225_4A2.001.010 | NA | SEQ ID NO:7920<br>AATTATGATATCAAC | SEQ ID NO:15932<br>TGGATGCACCCTAACAG<br>TGGTAACGCAGGCTATG<br>CACAGAAGTTCCAGGGC | SEQ ID NO:23944<br>AGCAGTGGCTGGTACTACTT<br>TGACTAC |
| | | AA | SEQ ID NO:7921<br>NYDIN | SEQ ID NO:15933<br>WMHPNSGNAGYAQKFQG | SEQ ID NO:23945<br>SSGWYYFDY |
| iPS:441896 | 21-225_4A2.001.011 | NA | SEQ ID NO:7922<br>AATTATGATATCAAC | SEQ ID NO:15934<br>TGGATGCACCCTAACAG<br>TGGTCAAACAGGCTATG<br>CACAGAAGTTCCAGGGC | SEQ ID NO:23946<br>AGCAGTGGCTGGTACTACTT<br>TGACTAC |
| | | AA | SEQ ID NO:7923<br>NYDIN | SEQ ID NO:15935<br>WMHPNSGQTGYAQKFQG | SEQ ID NO:23947<br>SSGWYYFDY |
| | | | SEQ ID NO:7924 | SEQ ID NO:15936 | SEQ ID NO:23948 |

FIGURE 49
(Continued)

| iPS: | | NA | AATTATGATATCAAC | TGGATGCACCCTAACAG TGGTAGCACAGGCTATG CACAGAAGTTCCAGGGC | AGCAGTGGCTGGTACTACTT TGACTAC |
|---|---|---|---|---|---|
| iPS:441900 | 21-225_4A2.001.012 | | SEQ ID NO:7925 | SEQ ID NO:15937 | SEQ ID NO:23949 |
| | | AA | NYDIN | WMHPNSGSTGYAQKFQG | SSGWYYFDY |
| | | | SEQ ID NO:7926 | SEQ ID NO:15938 | SEQ ID NO:23950 |
| iPS:441955 | 21-225_4A2.001.022 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7927 | SEQ ID NO:15939 | SEQ ID NO:23951 |
| | | AA | NYDIN | WMHPNSGNTGYAQKFQG | SSGWYYFDY |
| | | | SEQ ID NO:7928 | SEQ ID NO:15940 | SEQ ID NO:23952 |
| iPS:441962 | 21-225_4A2.001.023 | NA | AATTATGATATCAAC | TGGATGCACCCTAACAG TGGTAACACAGGCTATG CACAGAAGTTCCAGGGC | AGCAGTGGCTGGTACTACTT TGACTAC |
| | | | SEQ ID NO:7929 | SEQ ID NO:15941 | SEQ ID NO:23953 |
| | | AA | NYDIN | WMHPNSGNTGYAQKFQG | SSGWYYFDY |
| | | | SEQ ID NO:7930 | SEQ ID NO:15942 | SEQ ID NO:23954 |
| iPS:441971 | 21-225_4A2.001.024 | NA | AATTATGATATCAAC | TGGATGCACCCTAACAG TGGTCAAACAGGCTATG CACAGAAGTTCCAGGGC | AGCAGTGGCTGGTACTACTT TGACTAC |
| | | | SEQ ID NO:7931 | SEQ ID NO:15943 | SEQ ID NO:23955 |
| | | AA | NYDIN | WMHPNSGQTGYAQKFQG | SSGWYYFDY |
| | | | SEQ ID NO:7932 | SEQ ID NO:15944 | SEQ ID NO:23956 |

FIGURE 49 (Continued)

| iPS: | | | | | |
|---|---|---|---|---|---|
| iPS:441999 | 21-225_4A2.001.028 | NA | AATTATGATATCAAC SEQ ID NO:7933 | TGGATGCACCCTAACAG TGGTCAAACAGGCTATG CACAGAAGTTCCAGGGC SEQ ID NO:15945 | AGCAGTGGCTGGTACTACTT TGACTAC SEQ ID NO:23957 |
| | | AA | NYDIN SEQ ID NO:7934 | WMHPNSGQTGYAQKFQG SEQ ID NO:15946 | SSGWYYFDY SEQ ID NO:23958 |
| iPS:442006 | 21-225_4A2.001.029 | NA | AATTATGATATCAAC SEQ ID NO:7935 | TGGTAGCACCCTAACAG TGGTAGCACAGGCTATG CACAGAAGTTCCAGGGC SEQ ID NO:15947 | AGCAGTGGCTGGTACTACTT TGACTAC SEQ ID NO:23959 |
| | | AA | NYDIN SEQ ID NO:7936 | WMHPNSGSTGYAQKFQG SEQ ID NO:15948 | SSGWYYFDY SEQ ID NO:23960 |
| iPS:442020 | 21-225_4A2.001.031 | NA | AATTATGATATCAAC SEQ ID NO:7937 | TGGATGCACCCTAACAG TGGTAACGAAGGCTATG CACAGAAGTTCCAGGGC SEQ ID NO:15949 | AGCAGTGGCTGGTACTACTT TGACTAC SEQ ID NO:23961 |
| | | AA | NYDIN SEQ ID NO:7938 | WMHPNSGNEGYAQKFQG SEQ ID NO:15950 | SSGWYYFDY SEQ ID NO:23962 |
| iPS:442050 | 21-225_4H6.004 | NA | GACTACTATTGCAC SEQ ID NO:7939 | TGGATCCACCCTAACAG TGGTGGCACAAACTATG CACAGAAGTTTCAGGGC SEQ ID NO:15951 | GATGGTACCAGCTCGTTTGA CTAC SEQ ID NO:23963 |
| | | AA | DYYLH SEQ ID NO:7940 | WIHPNSGGTNYAQKFQG SEQ ID NO:15952 | DGTSSFDY SEQ ID NO:23964 |
| iPS:442059 | 21-225_4H6.005 | NA | GACTACTATTGCAC | TGGATCCACCCTAACAG TGGTGGCACAAACTATG CACAGAAGTTTCAGGGC | GATGGTACCAGCTCGTTTGA CTAC |

FIGURE 49 (Continued)

| | | | | | | | |
|---|---|---|---|---|---|---|---|
| iPS:442065 | 21-225_4H6.005 | AA | SEQ ID NO:7941<br>DYYLH | SEQ ID NO:7941<br>WIHPNSGGTNYAQKFQG | SEQ ID NO:15953 | SEQ ID NO:23965<br>DGTSSFDY | |
| | | NA | SEQ ID NO:7942<br>GACTACTATTTGCAC | SEQ ID NO:15954<br>TGGATCCACCTAACAG<br>TGGTGGCACAAACTATG<br>CACAGAAGTTTCAGGGC | SEQ ID NO:23966<br>GATGGTACCAGCTCGTTTGA<br>CTAC | | |
| iPS:442071 | 21-225_4H6.006 | AA | SEQ ID NO:7943<br>DYYLH | SEQ ID NO:15955<br>WIHPNSGGTNYAQKFQG | SEQ ID NO:23967<br>DGTSSFDY | | |
| | | NA | SEQ ID NO:7944<br>GACTACTATTTGCAC | SEQ ID NO:15956<br>TGGATCCACCTAACAG<br>TGGTGGCACAAACTATG<br>CACAGAAGTTTCAGGGC | SEQ ID NO:23968<br>GATGCTACCAGCTCGTTTGA<br>CTAC | | |
| iPS:442078 | 21-225_4H6.007 | AA | SEQ ID NO:7945<br>DYYLH | SEQ ID NO:15957<br>WIHPNSGGTNYAQKFQG | SEQ ID NO:23969<br>DATSSFDY | | |
| | | NA | SEQ ID NO:7946<br>GACTACTATTTGCAC | SEQ ID NO:15958<br>TGGATCCACCTAACAG<br>TGGTGGCACAAACTATG<br>CACAGAAGTTTCAGGGC | SEQ ID NO:23970<br>AGTGGTACCAGCTCGTTTGA<br>CTAC | | |
| iPS:442085 | 21-225_4H6.008 | AA | SEQ ID NO:7947<br>DYYLH | SEQ ID NO:15959<br>WIHPNSGGTNYAQKFQG | SEQ ID NO:23971<br>SGTSSFDY | | |
| | | NA | SEQ ID NO:7948<br>GACTACTATTTGCAC | SEQ ID NO:15960<br>TGGATCCACCTAACAG<br>TGGTGGCACAAACTATG<br>CACAGAAGTTTCAGGGC | SEQ ID NO:23972<br>AGTGGTACCAGCTCGTTTGA<br>CTAC | | |
| iPS:442085 | 21-225_4H6.009 | AA | SEQ ID NO:7949<br>DYYLH | SEQ ID NO:15961<br>WIHPNSGGTNYAQKFQG | SEQ ID NO:23973<br>SGTSSFDY | | |
| iPS:442089 | 21-225_4H6.010 | NA | SEQ ID NO:7950<br>GACTACTATTTGCAC | SEQ ID NO:15962<br>TGGATCCACCTAACAG<br>TGGTGGCACAAACTATG<br>CACAGAAGTTTCAGGGC | SEQ ID NO:23974<br>GATGCTACCAGCTCGTTTGA<br>CTAC | | |

FIGURE 49
(Continued)

| | | | | | | |
|---|---|---|---|---|---|---|
| iPS:442093 | 21-225_4H6.010 | AA | SEQ ID NO:7951<br>DYYLH | SEQ ID NO:15963<br>WIHPNSGGTNYAQKFQG | SEQ ID NO:23975<br>DATSSFDY | |
| | | NA | SEQ ID NO:7952<br>GACTACTATTTGCAC | SEQ ID NO:15964<br>TGGATCCACCTAACAGTGGTGGCACAAACTATGCACAGAAGTTTCAGGGC | SEQ ID NO:23976<br>GATGCTACCAGCTCGTTTGACTAC | |
| iPS:442115 | 21-225_4H6.011 | AA | SEQ ID NO:7953<br>DYYLH | SEQ ID NO:15965<br>WIHPNSGGTNYAQKFQG | SEQ ID NO:23977<br>DATSSFDY | |
| | | NA | SEQ ID NO:7954<br>AACTATGTCATGCAC | SEQ ID NO:15966<br>GTTATCTGGTATGATGCAAGTAATAAATACTATGCAGACTCCGTGAAGGGC | SEQ ID NO:23978<br>GAGGTATATAGCAGTGGCTGGTACGACTACGGTATGGACGTC | |
| iPS:442122 | 21-225_5E5.003 | AA | SEQ ID NO:7955<br>NYVMH | SEQ ID NO:15967<br>VIWYDASNKYYADSVKG | SEQ ID NO:23979<br>EVYSSGWYDYGMDV | |
| | | NA | SEQ ID NO:7956<br>AACTATGTCATGCAC | SEQ ID NO:15968<br>GTTATCTGGTATGATGACAGTAATAAATACTATGCAGACTCCGTGAAGGGC | SEQ ID NO:23980<br>GAGGTATATAGCAGTGGCTGGTACGACTACGGTATGGACGTC | |
| iPS:442129 | 21-225_5E5.004 | AA | SEQ ID NO:7957<br>NYVMH | SEQ ID NO:15969<br>VIWYDGSNKYYAESVKG | SEQ ID NO:23981<br>EVYSSGWYDYGMDV | |
| | | NA | SEQ ID NO:7958<br>AACTATGTCATGCAC | SEQ ID NO:15970<br>GTTATCTGGTATGATGGAAGTAATAAATACTATGCAGGCTCCGTGAAGGGC | SEQ ID NO:23982<br>GAGGTATATAGCAGTGGCTGGTACGACTACGGTATGGACGTC | |
| | 21-225_5E5.005 | | SEQ ID NO:7959 | SEQ ID NO:15971 | SEQ ID NO:23983 | |

FIGURE 49
(Continued)

| | | | AA | NYVMH | VIWYDGSNKYYAGSVKG | EVYSSGWYDYGMDV |
|---|---|---|---|---|---|---|
| iPS:442136 | 21-225_5E5.006 | | | SEQ ID NO:7960 | SEQ ID NO:15972 | SEQ ID NO:23984 |
| | | | NA | AACTATGTCATGCAC | GTTATCTGGTATGATGGA AGTAATAAATACTATGC AGACGCCGTGAAGGGC | GAGGTATATAGCAGTGGCTG GTACGACTACGGTATGGACG TC |
| | | | AA | NYVMH | VIWYDGSNKYYADAVKG | EVYSSGWYDYGMDV |
| | | | | SEQ ID NO:7961 | SEQ ID NO:15973 | SEQ ID NO:23985 |
| iPS:442171 | 21-225_5E5.011 | | | SEQ ID NO:7962 | SEQ ID NO:15974 | SEQ ID NO:23986 |
| | | | NA | AACTATGTCATGCAC | GTTATCTGGTATGATGCA AGTAATAAATACTATGC AGAATCCGTGAAGGGC | GAGGTATATAGCAGTGGCTG GTACGACTACGGTATGGACG TC |
| | | | AA | NYVMH | VIWYDASNKYYAESVKG | EVYSSGWYDYGMDV |
| | | | | SEQ ID NO:7963 | SEQ ID NO:15975 | SEQ ID NO:23987 |
| iPS:442178 | 21-225_5E5.012 | | | SEQ ID NO:7964 | SEQ ID NO:15976 | SEQ ID NO:23988 |
| | | | NA | AACTATGTCATGCAC | GTTATCTGGTATGATGCA AGTAATAAATACTATGC AGACGCCGTGAAGGGC | GAGGTATATAGCAGTGGCTG GTACGACTACGGTATGGACG TC |
| | | | AA | NYVMH | VIWYDASNKYYADAVKG | EVYSSGWYDYGMDV |
| | | | | SEQ ID NO:7965 | SEQ ID NO:15977 | SEQ ID NO:23989 |
| | | | | SEQ ID NO:7966 | SEQ ID NO:15978 | SEQ ID NO:23990 |

FIGURE 49
(Continued)

| | | | | | |
|---|---|---|---|---|---|
| iPS:442199 | 21-225_5E5.015 | NA | AACTATGTCATGCAC SEQ ID NO:7967 | GTTATCTGGTATGATGCA AGTAATAAATACTATGC AGACTCCGTGAAGGGC SEQ ID NO:15979 | GAGGTATATAGCAGTGGCTA TTACGACTACGGTATGGACG TC SEQ ID NO:23991 |
| | | AA | NYVMH SEQ ID NO:7968 | VIWYDASNKYYADSVKG SEQ ID NO:15980 | EVYSSGYYDYGMDV SEQ ID NO:23992 |
| iPS:442206 | 21-225_5E5.016 | NA | AACTATGTCATGCAC SEQ ID NO:7969 | GTTATCTGGTATGATGCA AGTAATAAATACTATGC AGACTCCGTGAAGGGC SEQ ID NO:15981 | GAGGTATATAGCAGTGGCTT CTACGACTACGGTATGGACG TC SEQ ID NO:23993 |
| | | AA | NYVMH SEQ ID NO:7970 | VIWYDGSNKYYADSVKG SEQ ID NO:15982 | EVYSSGFYDYGMDV SEQ ID NO:23994 |
| iPS:442213 | 21-225_5E5.017 | NA | AACTATGTCATGCAC SEQ ID NO:7971 | GTTATCTGGTATGATGGA AGTAATAAATACTATGC AGAATCCGTGAAGGGC SEQ ID NO:15983 | GAGGTATATAGCAGTGGCTA TTACGACTACGGTATGGACG TC SEQ ID NO:23995 |
| | | AA | NYVMH SEQ ID NO:7972 | VIWYDGSNKYYAESVKG SEQ ID NO:15984 | EVYSSGYYDYGMDV SEQ ID NO:23996 |
| iPS:442220 | 21-225_5E5.018 | NA | AACTATGTCATGCAC SEQ ID NO:7973 | GTTATCTGGTATGATGGA AGTAATAAATACTATGC AGACTCCGTGAAGGGC SEQ ID NO:15985 | GAGGTATATAGCAGTGGCTA TTACGACTACGGTATGGACG TC SEQ ID NO:23997 |

FIGURE 49
(Continued)

| | | AA | NYVMH | | VIWYDGSNKYYADSVKG | | EVYSSGYYDYGMDV |
|---|---|---|---|---|---|---|---|
| iPS:442227 | | | SEQ ID NO:7974 | | SEQ ID NO:15986 | | SEQ ID NO:23998 |
| | 21-225_5E5.019 | NA | AACTATGTCATGCAC | | GTTATCTGGTATGATGGA AGTAATAAATACTATGC AGACTCCGTGAAGGGC | | GAGGTATATAGCAGTGGCTT CTACGACTACGGTATGGACG TC |
| | | AA | NYVMH | | VIWYDGSNKYYADSVKG | | EVYSSGFYDYGMDV |
| iPS:442255 | | | SEQ ID NO:7975 | | SEQ ID NO:15987 | | SEQ ID NO:23999 |
| | | | SEQ ID NO:7976 | | SEQ ID NO:15988 | | SEQ ID NO:24000 |
| | 21-225_5E5.023 | NA | AACTATGTCATGCAC | | GTTATCTGGTATGATGCA AGTAATAAATACTATGC AGAATCCGTGAAGGGC | | GAGGTATATAGCAGTGGCTA TTACGACTACGGTATGGACG TC |
| | | AA | NYVMH | | VIWYDASNKYYAESVKG | | EVYSSGYYDYGMDV |
| iPS:442262 | | | SEQ ID NO:7977 | | SEQ ID NO:15989 | | SEQ ID NO:24001 |
| | | | SEQ ID NO:7978 | | SEQ ID NO:15990 | | SEQ ID NO:24002 |
| | 21-225_5E5.024 | NA | AACTATGTCATGCAC | | GTTATCTGGTATGATGCA AGTAATAAATACTATGC AGACGCCGTGAAGGGC | | GAGGTATATAGCAGTGGCTA TTACGACTACGGTATGGACG TC |
| | | AA | NYVMH | | VIWYDASNKYYADAVKG | | EVYSSGYYDYGMDV |
| | | | SEQ ID NO:7979 | | SEQ ID NO:15991 | | SEQ ID NO:24003 |
| | | | SEQ ID NO:7980 | | SEQ ID NO:15992 | | SEQ ID NO:24004 |

FIGURE 49
(Continued)

| iPS:442269 | 21-225_5E5.025 | NA | AACTATGTCATGCAC<br>SEQ ID NO:7981 | GTTATCTGGTATGATGGA<br>AGTAATAAATACTATGC<br>AGAATCCGTGAAGGGC<br>SEQ ID NO:15993 | GAGGTATATAGCAGTGGCTG<br>GTACGACTACGGTATGGACG<br>TC<br>SEQ ID NO:24005 |
|---|---|---|---|---|---|
| | | AA | NYVMH | VIWYDGSNKYYAESVKG | EVYSSGWYDYGMDV |
| iPS:442311 | 21-225_7E11.001.001 | NA | AGCTTTGGCATGCAC<br>SEQ ID NO:7982 | ATTATCTGGCATGATGG<br>AAGTAATAAATACTATG<br>CAGACTCCGTGAAGGGC<br>SEQ ID NO:15994 | GATCTGAGTATGGGCGGTAT<br>GGACGTC<br>SEQ ID NO:24006 |
| | | AA | SFGMH<br>SEQ ID NO:7983 | IIWHDGSNKYYADSVKG<br>SEQ ID NO:15995 | DLSMGGMDV<br>SEQ ID NO:24007 |
| iPS:442317 | 21-225_7E11.001.002 | NA | AGCTTTGGCATGCAC<br>SEQ ID NO:7984 | ATTATCTGGCATGATGG<br>AAGTAATAAATACTATG<br>CAGACTCCGTGAAGGGC<br>SEQ ID NO:15996 | GATCTGAGTATGGGCGGTAT<br>GGACGTC<br>SEQ ID NO:24008 |
| | | AA | SFGMH<br>SEQ ID NO:7985 | IIWHDGSNKYYADSVKG<br>SEQ ID NO:15997 | DLSMGGMDV<br>SEQ ID NO:24009 |
| iPS:442323 | 21-225_7E11.001.003 | NA | AGCTTTGGCATGCAC<br>SEQ ID NO:7986 | ATTATCTGGCATAGTGG<br>AAGTAATAAATACTATG<br>CAGACTCCGTGAAGGGC<br>SEQ ID NO:15998 | GATCTGAGTATGGGCGGTAT<br>GGACGTC<br>SEQ ID NO:24010 |
| | | AA | SFGMH<br>SEQ ID NO:7987 | IIWHSGSNKYYADSVKG<br>SEQ ID NO:15999 | DLSMGGMDV<br>SEQ ID NO:24011 |
| | | | SEQ ID NO:7988 | SEQ ID NO:16000 | SEQ ID NO:24012 |

FIGURE 49
(Continued)

| iPS:442330 | 21-225_7E11.001.004 | NA | AGCTTTGGCATGCAC | ATTATCTGGCATGAAGG AAGTAATAAATACTATG CAGACTCCGTGAAGGGC | GATCTGAGTATGGGCGGTAT GGACGTC |
|---|---|---|---|---|---|
| | | | SEQ ID NO:7989 | SEQ ID NO:16001 | SEQ ID NO:24013 |
| | | AA | SFGMH | HWHEGSNKYYADSVKG | DLSMGGMDV |
| | | | SEQ ID NO:7990 | SEQ ID NO:16002 | SEQ ID NO:24014 |
| iPS:442337 | 21-225_7E11.001.005 | NA | AGCTTTGGCATGCAC | ATTATCTGGCATGATGCA AGTAATAAATACTATG AGACTCCGTGAAGGGC | GATCTGAGTATGGGCGGTAT GGACGTC |
| | | | SEQ ID NO:7991 | SEQ ID NO:16003 | SEQ ID NO:24015 |
| | | AA | SFGMH | HWHDASNKYYADSVKG | DLSMGGMDV |
| | | | SEQ ID NO:7992 | SEQ ID NO:16004 | SEQ ID NO:24016 |
| iPS:442344 | 21-225_7E11.001.006 | NA | AGCTTTGGCATGCAC | ATTATCTGGCATGATGG AAGTAATAAATACTATG CAGAATCCGTGAAGGGC | GATCTGAGTATGGGCGGTAT GGACGTC |
| | | | SEQ ID NO:7993 | SEQ ID NO:16005 | SEQ ID NO:24017 |
| | | AA | SFGMH | HWHDGSNKYYAESVKG | DLSMGGMDV |
| | | | SEQ ID NO:7994 | SEQ ID NO:16006 | SEQ ID NO:24018 |
| iPS:442351 | 21-225_7E11.001.007 | NA | AGCTTTGGCATGCAC | ATTATCTGGCATGATGG AAGTAATAAATACTATG CAGACGCCGTGAAGGGC | GATCTGAGTATGGGCGGTAT GGACGTC |
| | | | SEQ ID NO:7995 | SEQ ID NO:16007 | SEQ ID NO:24019 |
| | | AA | SFGMH | HWHDGSNKYYADAVKG | DLSMGGMDV |
| | | | SEQ ID NO:7996 | SEQ ID NO:16008 | SEQ ID NO:24020 |

FIGURE 49
(Continued)

| | | | | | |
|---|---|---|---|---|---|
| iPS:442358 | 21-225_7E11.001.008 | NA | AGCTTTGGCATGCAC | ATTATCTGGCATGAAGG AAGTAATAAATACTATG CAGACGCCGTGAAGGGC | GATCTGAGTATGGGCGGTAT GGACGTC |
| | | | SEQ ID NO:7997 | SEQ ID NO:16009 | SEQ ID NO:24021 |
| | | AA | SFGMH | IIWHEGSNKYYADAVKG | DLSMGGMDV |
| | | | SEQ ID NO:7998 | SEQ ID NO:16010 | SEQ ID NO:24022 |
| iPS:442365 | 21-225_7E11.001.009 | NA | AGCTTTGGCATGCAC | ATTATCTGGCATGAAGG AAGTAATAAATACTATG CAGAATCCGTGAAGGGC | GATCTGAGTATGGGCGGTAT GGACGTC |
| | | | SEQ ID NO:7999 | SEQ ID NO:16011 | SEQ ID NO:24023 |
| | | AA | SFGMH | IIWHEGSNKYYAESVKG | DLSMGGMDV |
| | | | SEQ ID NO:8000 | SEQ ID NO:16012 | SEQ ID NO:24024 |
| iPS:442372 | 21-225_7E11.001.010 | NA | AGCTTTGGCATGCAC | ATTATCTGGCATAGTGG AAGTAATAAATACTATG CAGACGCCGTGAAGGGC | GATCTGAGTATGGGCGGTAT GGACGTC |
| | | | SEQ ID NO:8001 | SEQ ID NO:16013 | SEQ ID NO:24025 |
| | | AA | SFGMH | IIWHSGNKYYAESVKG | DLSMGGMDV |
| | | | SEQ ID NO:8002 | SEQ ID NO:16014 | SEQ ID NO:24026 |
| iPS:442379 | 21-225_7E11.001.011 | NA | AGCTTTGGCATGCAC | ATTATCTGGCATAGTGG AAGTAATAAATACTATG CAGACGCCGTGAAGGGC | GATCTGAGTATGGGCGGTAT GGACGTC |
| | | | SEQ ID NO:8003 | SEQ ID NO:16015 | SEQ ID NO:24027 |
| | | AA | SFGMH | IIWHSGNKYYADAVKG | DLSMGGMDV |
| | | | SEQ ID NO:8004 | SEQ ID NO:16016 | SEQ ID NO:24028 |

FIGURE 49
(Continued)

| | | | | | | |
|---|---|---|---|---|---|---|
| iPS:442386 | 21-225_7E11.001.012 | NA | AGCTTTGGCATGCAC | SEQ ID NO:8005 | ATTATCTGGCATAGTGG AAGTAATAAATACTATG CAGACTCCGTGAAGGGC | SEQ ID NO:16017 | GATCTGAGTATGGGCGGTAT GGACGTC | SEQ ID NO:24029 |
| | | AA | SFGMH | SEQ ID NO:8006 | IIWHSGSNKYYADSVKG | SEQ ID NO:16018 | DLSMGGMDV | SEQ ID NO:24030 |
| iPS:442390 | 21-225_7E11.001.013 | NA | AGCTTTGGCATGCAC | SEQ ID NO:8007 | ATTATCTGGCATGATGG AAGTAATAAATACTATG CAGAATCCGTGAAGGGC | SEQ ID NO:16019 | GATCTGAGTATGGGCGGTAT GGACGTC | SEQ ID NO:24031 |
| | | AA | SFGMH | SEQ ID NO:8008 | IIWHSGSNKYYAESVKG | SEQ ID NO:16020 | DLSMGGMDV | SEQ ID NO:24032 |
| iPS:442394 | 21-225_7E11.001.014 | NA | AGCTTTGGCATGCAC | SEQ ID NO:8009 | ATTATCTGGCATAGTGG AAGTAATAAATACTATG CAGAATCCGTGAAGGGC | SEQ ID NO:16021 | GATCTGAGTATGGGCGGTAT GGACGTC | SEQ ID NO:24033 |
| | | AA | SFGMH | SEQ ID NO:8010 | IIWHSGSNKYYAESVKG | SEQ ID NO:16022 | DLSMGGMDV | SEQ ID NO:24034 |
| iPS:442398 | 21-225_7E11.001.015 | NA | AGCTTTGGCATGCAC | SEQ ID NO:8011 | ATTATCTGGCATAGTGG AAGTAATAAATACTATG CAGACTCCGTGAAGGGC | SEQ ID NO:16023 | GATCTGAGTATGGGCGGTAT GGACGTC | SEQ ID NO:24035 |
| | | AA | SFGMH | SEQ ID NO:8012 | IIWHSGSNKYYADSVKG | SEQ ID NO:16024 | DLSMGGMDV | SEQ ID NO:24036 |

FIGURE 49
(Continued)

| | | | | | |
|---|---|---|---|---|---|
| iPS:442402 | 21-225_7E11.001.016 | NA | AGCTTTGGCATGCAC | ATTATCTGGCATAGTGG AAGTAATAAATACTATG CAGAATCCGTGAAGGGC | GATCTGAGTATGGGCGGTAT GGACGTC |
| | | | SEQ ID NO:8013 | SEQ ID NO:16025 | SEQ ID NO:24037 |
| | | AA | SFGMH | IIWHSGSNKYYAESVKG | DLSMGGMDV |
| | | | SEQ ID NO:8014 | SEQ ID NO:16026 | SEQ ID NO:24038 |
| iPS:442406 | 21-225_7E11.001.017 | NA | AGCTTTGGCATGCAC | ATTATCTGGCATGAAGG AAGTAATAAATACTATG CAGACGCCGTGAAGGGC | GATCTGAGTATGGGCGGTAT GGACGTC |
| | | | SEQ ID NO:8015 | SEQ ID NO:16027 | SEQ ID NO:24039 |
| | | AA | SFGMH | IIWHEGSNKYYADAVKG | DLSMGGMDV |
| | | | SEQ ID NO:8016 | SEQ ID NO:16028 | SEQ ID NO:24040 |
| iPS:442410 | 21-225_7E11.001.018 | NA | AGCTTTGGCATGCAC | ATTATCTGGCATGATGCA AGTAATAAATACTATGC AGAATCCGTGAAGGGC | GATCTGAGTATGGGCGGTAT GGACGTC |
| | | | SEQ ID NO:8017 | SEQ ID NO:16029 | SEQ ID NO:24041 |
| | | AA | SFGMH | IIWHDASNKYYAESVKG | DLSMGGMDV |
| | | | SEQ ID NO:8018 | SEQ ID NO:16030 | SEQ ID NO:24042 |
| iPS:442417 | 21-225_7E11.001.019 | NA | AGCTTTGGCATGCAC | ATTATCTGGCATGATGG AAGTAATAAATACTATG CAGAATCCGTGAAGGGC | GATCTGAGTATGGGCGGTAT GGACGTC |
| | | | SEQ ID NO:8019 | SEQ ID NO:16031 | SEQ ID NO:24043 |
| | | AA | SFGMH | IIWHDGSNKYYAESVKG | DLSMGGMDV |
| | | | SEQ ID NO:8020 | SEQ ID NO:16032 | SEQ ID NO:24044 |

FIGURE 49
(Continued)

| | | | | |
|---|---|---|---|---|
| iPS:442431 | 21-225_7E11.001.021 | NA | AGCTTTGGCATGCAC SEQ ID NO:8021 | ATTATCTGGCATAGTGG AAGTAATAAATACTATG CAGAATCCGTGAAGGC SEQ ID NO:16033 | GATCTGAGTATGGGCGGTAT GGACGTC SEQ ID NO:24045 |
| | | AA | SFGMH SEQ ID NO:8022 | IIWHSGSNKYYAESVKG SEQ ID NO:16034 | DLSMGGMDV SEQ ID NO:24046 |
| iPS:442438 | 21-225_7E11.001.022 | NA | AGCTTTGGCATGCAC SEQ ID NO:8023 | ATTATCTGGCATGAAGG AAGTAATAAATACTATG CAGAATCCGTGAAGGC SEQ ID NO:16035 | GATCTGAGTATGGGCGGTAT GGACGTC SEQ ID NO:24047 |
| | | AA | SFGMH SEQ ID NO:8024 | IIWHEGSNKYYAESVKG SEQ ID NO:16036 | DLSMGGMDV SEQ ID NO:24048 |
| iPS:442568 | 21-225_149D8 | NA | AACAGTGGTTACTACTGGAG C SEQ ID NO:8025 | TACAGTATTACAGTGG GAGCACCTACTACAACC CGTCCCTCAAGAGT SEQ ID NO:16037 | GGGGGATATAAACTGGAACCA TGCTTTTGATATC SEQ ID NO:24049 |
| | | AA | NSGYYWS SEQ ID NO:8026 | YSYYSGSTYYNPSLKS SEQ ID NO:16038 | GGYNWNHAFDI SEQ ID NO:24050 |
| iPS:443803 | 21-225_43F11_LC2 | NA | GGCTACTATATACAC SEQ ID NO:8027 | TGGATCAACCCTAACAG TGGTGGCACAAACTATG CACAGAAGTTTCAGGGC SEQ ID NO:16039 | GGAGGGAATTACTTCTACAA CCACGTTATGGACGTC SEQ ID NO:24051 |
| | | AA | GYYIH SEQ ID NO:8028 | WINPNSGGTNYAQKFQG SEQ ID NO:16040 | GGNYFYNHVMDV SEQ ID NO:24052 |
| iPS:443805 | 21-225_43F11_LC1 | NA | GGCTACTATATACAC SEQ ID NO:8029 | TGGATCAACCCTAACAG TGGTGGCACAAACTATG CACAGAAGTTTCAGGGC SEQ ID NO:16041 | GGAGGGAATTACTTCTACAA CCACGTTATGGACGTC SEQ ID NO:24053 |

FIGURE 49
(Continued)

| | | | | | | | |
|---|---|---|---|---|---|---|---|
| iPS:443006 | 21-225_25A4.001.029 | AA | GYYIH | | WINPNSGGTNYAQKFQG | | GGNYFYNHVMDV |
| | | | SEQ ID NO:8030 | | SEQ ID NO:16042 | | SEQ ID NO:24054 |
| | | NA | AATTATGATATTAAT | | TGGATGTACCCTAACAG TGGTCAAACAGGCTATG CACAGAAATTCCAGGGC | | AGCAGTGGCTGGTACTACTT TGACTAC |
| | | | SEQ ID NO:8031 | | SEQ ID NO:16043 | | SEQ ID NO:24055 |
| iPS:443016 | 21-225_4H6.014 | AA | NYDIN | | WMYPNSGQTGYAQKFQG | | SSGWYYFDY |
| | | | SEQ ID NO:8032 | | SEQ ID NO:16044 | | SEQ ID NO:24056 |
| | | NA | GACTACTATTTGCAC | | TGGATCCACCTAACAG TGGTGGCACAAACTATG CACAGAAGTTTCAGGGC | | GATGTACCAGCTCGTTTGA CTAC |
| | | | SEQ ID NO:8033 | | SEQ ID NO:16045 | | SEQ ID NO:24057 |
| iPS:443027 | 21-225_7E11.001.023 | AA | DYYLH | | WIHPNSGGTNYAQKFQG | | DATSSFDY |
| | | | SEQ ID NO:8034 | | SEQ ID NO:16046 | | SEQ ID NO:24058 |
| | | NA | AGCTTTGGCATGCAC | | ATTATCTGGCATGATGCA AGTAATAAATACTATGC AGACGCCGTGAAGGGC | | GATCTGAGTATGGGCGGTAT GGACGTC |
| | | | SEQ ID NO:8035 | | SEQ ID NO:16047 | | SEQ ID NO:24059 |
| | | AA | SFGMH | | IIWHDASNKYYADAVKG | | DLSMGGMDV |
| | | | SEQ ID NO:8036 | | SEQ ID NO:16048 | | SEQ ID NO:24060 |
| iPS:446086 | 21-225_94D8 | NA | AATTATGATATCAAC | | TGGATGAACCTAACAG TGGTAACACAGGCTATG CACAGAAGTTCCAGGTC | | AGCAGTGGCTGGTACATCTT TGACTAC |
| | | | SEQ ID NO:8037 | | SEQ ID NO:16049 | | SEQ ID NO:24061 |
| | | AA | NYDIN | | WMNPSGNTGYAQKFQV | | SSGWYIFDY |

FIGURE 49 (Continued)

| | | | | | |
|---|---|---|---|---|---|
| iPS:446094 | 21-225_77E1 | NA | SEQ ID NO:8038<br>AATTATGATATCAAC | SEQ ID NO:16050<br>TGGATGAACCCTAACAG<br>TGGTAACACAGGCTATG<br>CACAGAAGTTCCAGGGC | SEQ ID NO:24062<br>TCCAGTGGCTGGCACTGGTT<br>CGACCCC |
| | | AA | SEQ ID NO:8039<br>NYDIN | SEQ ID NO:16051<br>WMNPNSGNTGYAQKFQG | SEQ ID NO:24063<br>SSGWHWFDP |
| iPS:448904 | 21-225_65C12 | NA | SEQ ID NO:8040<br>AGCTTTAGCTTGAAC | SEQ ID NO:16052<br>TCCATTAGTAGTAGTAGT<br>AGTTACATATACTACGC<br>AGACTCAGTGAAGGGC | SEQ ID NO:24064<br>GATGCGTATAGCCACTAC |
| | | AA | SEQ ID NO:8041<br>SFSLN | SEQ ID NO:16053<br>SISSSSYIYYADSVKG | SEQ ID NO:24065<br>DAYSHY |
| iPS:448906 | 21-225_72G9 | NA | SEQ ID NO:8042<br>AGTTATAGCATGAAC | SEQ ID NO:16054<br>TCCATTAGTGGTAGTAGT<br>AGTTACATATACTACGC<br>AGACTCAGTGAAGGGC | SEQ ID NO:24066<br>GGGGGTTCGAGGGGGTTCGA<br>CCCC |
| | | AA | SEQ ID NO:8043<br>SYSMN | SEQ ID NO:16055<br>SISGSSSYIYYADSVKG | SEQ ID NO:24067<br>GGSRGFDP |
| iPS:448908 | 21-225_50G9 | NA | SEQ ID NO:8044<br>AGCTATGGCATGCAC | SEQ ID NO:16056<br>GTTATATCACAAGATGG<br>AATTATTAGATACTATGC<br>AGACTCCGTGAAGGGC | SEQ ID NO:24068<br>GATGTGAAGCAGTGGCTGGT<br>ACGGACCTACGGTATGGACG<br>TC |
| | | AA | SEQ ID NO:8045<br>SYGMH | SEQ ID NO:16057<br>VISQDGIIRYYADSVKG | SEQ ID NO:24069<br>DVKQWLVRTYGMDV |
| iPS:451102 | 21-225_45F6 | NA | SEQ ID NO:8046<br>TACTATGGCTTGCAC | SEQ ID NO:16058<br>GTTATATCATATGATGGA<br>AGTAATAAATATTATGC<br>AGACTCCGTGAAGGGC | SEQ ID NO:24070<br>GAGGATGCGATATTGTAGTGG<br>TACCAGCTGCCCTACTACT<br>ACTACTACGGTATGGACGTC |

FIGURE 49
(Continued)

| | | | | SEQ ID NO:8047 YYGLH | SEQ ID NO:16059 VISYDGSNKYYADSVKG | SEQ ID NO:24071 EDRYCSGTSCPYYYYGMDV |
|---|---|---|---|---|---|---|
| iPS:451104 | 21-225_45F6 | AA | | SEQ ID NO:8048 AGCTATGGTATCAGC | SEQ ID NO:16060 TGGATCAGCGCTTATAAT GGTAACACAAAGTATGC ACAGAAGCTCCAGGGC | SEQ ID NO:24072 CACGATTTTGGAGTGGTTA TTATAAGGGTATGGACGTC |
| | 21-225_49C5 | NA | | SEQ ID NO:8049 SYGIS | SEQ ID NO:16061 WISAYNGNTKYAQKLQG | SEQ ID NO:24073 HDFWSGYYKGMDV |
| iPS:451106 | | AA | | SEQ ID NO:8050 AGCTATGGTATCAGC | SEQ ID NO:16062 TGGATCAGCGCTTATAAT GGTAACACAAAGAATGC ACAGAAGCTCCAGGGC | SEQ ID NO:24074 CACGATTTTGGAGTGGTTA TTATAAGGGTATGGACGTC |
| | 21-225_49D10 | NA | | SEQ ID NO:8051 SYGIS | SEQ ID NO:16063 WISAYNGNTKNAQKLQG | SEQ ID NO:24075 HDFWSGYYKGMDV |
| iPS:451108 | 21-225_53E8 | AA | | SEQ ID NO:8052 AGCTATGGTATCAGC | SEQ ID NO:16064 TGGATCAGCGCTTATAAT GGTAACACAAAGTTGC ACAGAAGCTCCAGGGC | SEQ ID NO:24076 CACGATTTTGGAGTGGTTA TTATAAGGGTATGGACGTC |
| | | NA | | SEQ ID NO:8053 SYGIS | SEQ ID NO:16065 WISAYNGNTKFAQKLQG | SEQ ID NO:24077 HDFWSGYYKGMDV |
| | | AA | | SEQ ID NO:8054 | SEQ ID NO:16066 | SEQ ID NO:24078 |

FIGURE 49
(Continued)

| | | | | | |
|---|---|---|---|---|---|
| iPS:451110 | 21-225_74C9 | NA | AGCTATGGCATGCAC SEQ ID NO:8055 | GTTATATGGTATGATGG AAATAATAAATCCTATG CAGACTCCGTGAAGGGC SEQ ID NO:16067 | GATCGAGATTATTGTAGTAG TACCAGCTGCCCTATTATTA CTACTACGGTATGGACGTC SEQ ID NO:24079 |
| | | AA | SYGMH SEQ ID NO:8056 | VIWYDGNNKSYADSVKG SEQ ID NO:16068 | DRDYCSSTSCPYYYYYGMDV SEQ ID NO:24080 |
| iPS:451112 | 21-225_53D10 | NA | GGCTACTATATACAC SEQ ID NO:8057 | TGGATCAACCCTAACAG TGGTGGCACAAACTATG CACAGAAGTTTCAGGGC SEQ ID NO:16069 | GAAAACGAAAGTCTAGCAAC TCGTCCTTTCTACGACTACTA CGGTATGGACGTC SEQ ID NO:24081 |
| | | AA | GYYIH SEQ ID NO:8058 | WINPNSGGTNYAQKFQG SEQ ID NO:16070 | ENESLATRPFYDYYGMDV SEQ ID NO:24082 |
| iPS:451114 | 21-225_159A3 | NA | GACTATGTCATGCAG SEQ ID NO:8059 | GTTATATGGTATGATGG AAGTAATAAATACTATG CAGACTCCGTGAAGGGC SEQ ID NO:16071 | GAACCGTATAATAGTGGCTG GTACGACTACGGTATGGACG TC SEQ ID NO:24083 |
| | | AA | DYVMQ SEQ ID NO:8060 | VIWYDGSNKYYADSVKG SEQ ID NO:16072 | EPYNSGWYDYGMDV SEQ ID NO:24084 |
| iPS:451116 | 21-225_164A4 | NA | AATTATGATATCAAC SEQ ID NO:8061 | TGGATGCACCTAACAG TGGTAACACAGGCTATG CACAGAAGTTCCAGGGC SEQ ID NO:16073 | AGCAGTGGCTGGTACTTCTT TGACTAC SEQ ID NO:24085 |
| | | AA | NYDIN SEQ ID NO:8062 | WMHPNSGNTGYAQKFQG SEQ ID NO:16074 | SSGWYFFDY SEQ ID NO:24086 |

FIGURE 49
(Continued)

| | | | | | | |
|---|---|---|---|---|---|---|
| iPS:451118 | 21-225_191C8 | NA | AGTGGTGGTTACTACTGGAG C | TATATCTATTATTACAGTGGG ACCACCATTACAACCCC TCCCTCAAGAGT | GACACGTTTGCTTTGATGG TTGTGTTATTCTTTGACTC C |
| | | | SEQ ID NO:8063 | SEQ ID NO:16075 | SEQ ID NO:24087 |
| | | AA | SGGYYWS | YIYYSGTTIYNPSLKS | DTFCFDGCGYFFDS |
| | | | SEQ ID NO:8064 | SEQ ID NO:16076 | SEQ ID NO:24088 |
| iPS:451120 | 21-225_197D3 | NA | AGCCATGGCATGCAC | GTTATATGTAATGTATGATGG AAGTAATGAACACTATG CAGACTCCGTGAAGGGC | GATCAAGGTGTGGGGTACTA CGGTATGGACGTC |
| | | | SEQ ID NO:8065 | SEQ ID NO:16077 | SEQ ID NO:24089 |
| | | AA | SHGMH | VIWYDGSNEHYADSVKG | DQGVGYYGMDV |
| | | | SEQ ID NO:8066 | SEQ ID NO:16078 | SEQ ID NO:24090 |
| iPS:451122 | 21-225_200A1 | NA | GTTTACTATTGGAGC | GAAATCAATCATAGTGG AAGCACCACTACAACC CGTCCCTCAAGAGT | GACTACGGTGTCTTTGACTA C |
| | | | SEQ ID NO:8067 | SEQ ID NO:16079 | SEQ ID NO:24091 |
| | | AA | VYYWS | EINHSGSTNYNPSLKS | DYGVFDY |
| | | | SEQ ID NO:8068 | SEQ ID NO:16080 | SEQ ID NO:24092 |
| iPS:451124 | 21-225_74F6 | NA | AATTATGATATCAAC | TGGATGCACCCTAACAG TGGTAACACAGGCTATG CACAGAAGTTCCAGGGC | AGCAGTGGCTGGTACTTTTT TGACTAC |
| | | | SEQ ID NO:8069 | SEQ ID NO:16081 | SEQ ID NO:24093 |
| | | AA | NYDIN | WMHPNSGNTGYAQKFQG | SSGWYFFDY |
| | | | SEQ ID NO:8070 | SEQ ID NO:16082 | SEQ ID NO:24094 |
| iPS:451127 | | NA | AATTATGATGTCAAC | TGGATGCACCCTAACAG TGGTAACACAGGCTATG CACAGAAGTTCCAGGGC | AGCAGTGGCTGGTACCTCTT TGACTAC |

FIGURE 49
(Continued)

| | | | | | | | |
|---|---|---|---|---|---|---|---|
| iPS:451129 | 21-225_164A7 | AA | SEQ ID NO:8071<br>NYDVN | SEQ ID NO:16083<br>WMHPNSGNTGYAQKFQG | SEQ ID NO:24095<br>SSGWYLFDY | | |
| | | NA | SEQ ID NO:8072<br>AATTATGATATCAAC | SEQ ID NO:16084<br>TGGATGCACCCTAACAG<br>TGGTAACACAGGCTTTG<br>CACAGAAGTTCCAGGGC | SEQ ID NO:24096<br>TCCAGTGGCTGGTACTGGTT<br>CGACCCC | | |
| iPS:451131 | 21-225_94D2 | AA | SEQ ID NO:8073<br>NYDIN | SEQ ID NO:16085<br>WMHPNSGNTGFAQKFQG | SEQ ID NO:24097<br>SSGWYWFDP | | |
| | | NA | SEQ ID NO:8074<br>AATTATGATATCAAC | SEQ ID NO:16086<br>TGGATGCACCCTCACAG<br>TGGTAACACAGGCTATG<br>CACAGAAGTTCCAGGGC | SEQ ID NO:24098<br>AGCAGTGGCTGGTACTACTT<br>TGACTAC | | |
| iPS:451133 | 21-225_160A7 | AA | SEQ ID NO:8075<br>NYDIN | SEQ ID NO:16087<br>WMHPNSGNTGYAQKFQG | SEQ ID NO:24099<br>SSGWYYFDY | | |
| | | NA | SEQ ID NO:8076<br>AATTATGATATCAAC | SEQ ID NO:16088<br>TGGATGAACCCTAACAG<br>TGGTAACACAGGCTATG<br>CACAGAAGTTCCAGGGC | SEQ ID NO:24100<br>TCCAGTGGCTGGAACTGGTT<br>CGACCCC | | |
| iPS:437240 | 21-225_95H4 | AA | SEQ ID NO:8077<br>NYDIN | SEQ ID NO:16089<br>WMNPNSGNTGYAQKFQG | SEQ ID NO:24101<br>SSGWNWFDP | | |
| | | NA | SEQ ID NO:8078<br>AGTTATGATATCAAC | SEQ ID NO:16090<br>TGGCTGAACCCTCACAG<br>TGGTAACACAGGCTATG<br>CACAGAAGTTCCAGGGC | SEQ ID NO:24102<br>GGGTTTTACGATATTTGACT<br>GGTTATTCCCCACCTACTA<br>CTACTACGATATGGACGTC | | |
| | 21-225_84H12 | | SEQ ID NO:8079 | SEQ ID NO:16091 | SEQ ID NO:24103 | | |

FIGURE 49
(Continued)

| | | AA | SYDIN | WLNPHSGNTGYAQKFQG | GFYDILTGYSPTYYYDMDV |
|---|---|---|---|---|---|
| iPS:434577 | | | SEQ ID NO:8080 | SEQ ID NO:16092 | SEQ ID NO:24104 |
| | 21-225_75C11 | NA | AGTTATGATATCAAC | TGGCTGAACCCTCACAG TGGTAACACAGGCTATG CACAGAAGTTCCAGGGC | GGGTTTACGATATTTGACT GGTTATTCCCCACCTACTA CTACTACGATATGGACGTC |
| | | AA | SYDIN | WLNPHSGNTGYAQKFQG | GFYDILTGYSPTYYYDMDV |
| iPS:435477 | | | SEQ ID NO:8081 | SEQ ID NO:16093 | SEQ ID NO:24105 |
| | 21-225_154E8 | NA | AGTTATGCCATGAGC | GCTATTAGTGGTAGTGGT GGTAACACATTCTACGC AGACTCCGTGAAGGGC | CACGGTATAGCAGTGGCTGG TACTGGGGCTCACTACTTTG ACTAC |
| | | | SEQ ID NO:8082 | SEQ ID NO:16094 | SEQ ID NO:24106 |
| | | AA | SYAMS | AISGSGGNTFYADSVKG | HGIAVAGTGAHYFDY |
| iPS:434553 | | | SEQ ID NO:8083 | SEQ ID NO:16095 | SEQ ID NO:24107 |
| | 21-225_76H12 | NA | AGTTATGATATCAAC | TGGCTGAACCCTCACAG TGGTAACACAGGCTATG CACAGAAGTTCCAGGGC | GGGTTTACGATATTTGACT GGTTATTCCCCACCTACTA CTACTACGATATGGACGTC |
| | | AA | SYDIN | WLNPHSGNTGYAQKFQG | GFYDILGYSPTYYYDMDV |
| iPS:434927 | | | SEQ ID NO:8085 | SEQ ID NO:16097 | SEQ ID NO:24109 |
| | 21-225_86E5 | NA | AGTTATGATATCAAC | TGGATGAACCCTAACAG TGGTAACACAGGCTATG CACAGAAGTTCCAGGGC | GGGTTTACGATATTTGACT GGTTATTCCCCACCTACTA CTACTACGATATGGACGTC |
| | | | SEQ ID NO:8087 | SEQ ID NO:16099 | SEQ ID NO:24111 |

FIGURE 49
(Continued)

| | | AA | SYDIN | | WMNPNSGNTGYAQKFQG | GFYDILTGYSPTYYYYDMDV |
|---|---|---|---|---|---|---|
| | | | SEQ ID NO:8088 | | SEQ ID NO:16100 | SEQ ID NO:24112 |
| | | NA | AGCTATGCCATGAGC | GCTATTAGTGGTAGTGGT GGTAACACATTCTACGC AGACTCCGTGAAGGGC | CACGGTATAGCAGTGGCTGG TACTGGGGCTCACTACTTTG ACTAC |
| iPS:435385 | 21-225_149G7 | | SEQ ID NO:8089 | | SEQ ID NO:16101 | SEQ ID NO:24113 |
| | | AA | SYAMS | | AISGSGGNTFYADSVKG | HGIAVAGTGAHYFDY |
| | | | SEQ ID NO:8090 | | SEQ ID NO:16102 | SEQ ID NO:24114 |

FIGURE 50

Table 3
Standard IgG Antibody Variable Region Sequences

| IPS# | Ab | Type | LC V-region | HC V-region |
|---|---|---|---|---|
| iPS:451135 | 21-225_64A11 | NA | GACATCCAGATGACCCAGTCTCCATTCTCCCT GTCTGCATCTGTAGGCGACAGAGTCACCATCA CTTGCCGGGCAAGTCAGAGCGTTAGCAGATAT TTAAATTGGTATCAGCAGAAACACTGGGAAAGC CCTTAAGCTCTTGATATCTGTTGCATCCGTTT GCAAAGTGGGGTCCCATCGAGGTTCAGTGCA GTGGATCTGGGACAGATTTCACTCTCACCATC AGCAGTCTGCAACGTGAAGATTTTGCAACTTA CTTCTGTGTCAACAGAGTGACAGTTTCCCTCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAACTATGGCAT GCACTGGGTCCGCCAGGCTCCAGGCAAGGGCT GGAGTGGGTGGCAGTTATATCATATGTTGGAAGT AATAAATACTATGCAGACTCCGTGAAGGGCCGA TTCACCATCTCCAGAGACAATTCCAAGAACACGC TGTATCTGCAAATGAACACCCTGAGAGCTGAGG ACACGGCTGTGTATTACTGTGCGAGAGAGGAG CAGTGGCTCCGTACTACGGTATGGACGTCTGGGG CCAAGGGACCACGGTCACCGTCTCCTCA |
| | | | SEQ ID NO: 24115 | SEQ ID NO: 28121 |
| | | AA | DIQMTQSPFSLSASVGDRVTITCRASRVSVSRYLN WYQQTLGKALKLLISVASRLQSGVPSRFSGSGSG TDFTLTISSVQREDFATYFCQQSDSFPLTFGGGTK VEIK | QVQLVESGGGVVQPGRSLRLSCAASGFTFSNYGM HWVRQAPGKGLEWVAVISYVGSNKYYADSVKGR FTISRDNSKNTLYLQMNTLRAEDTAVYYCARRGAV APYYGMDVWGQGTTVTVSS |
| | | | SEQ ID NO: 24116 | SEQ ID NO: 28122 |

FIGURE 50
(Continued)

| | | | |
|---|---|---|---|
| iPS:451141 | 21-225_164B11 | NA | GACATCGTGATGACCCAGTCTCCAGACTCCCT GGCTGTGTCTCTGGGCGAGAGGGCCACCATCA ACTGCAAGTCCAGCCAGAGTCTTTAAAGAGC TCCAACAATAAGAGCTACTTAGCTTCGTACCA GCAGAAGCCAGGACAGCAGTTCCTAAACTGCTCA TTTACTGGGCATCTTCCCGGAATCCGGGGTC CCTGACCGATTCAGTGGCAGCGGGTCTGGGAC AGATTTCACTCTCACCATCAGCAGCCTGCAGG CTGAAGATGTGGCACTTTATTACTGTCAGCAA TATTATAGTATTCCCTCCCACTTTCGGCCATGGG ACCAATGTGGATATCACG<br><br>SEQ ID NO: 24117 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGATGGATGACCCTAACAGTGG TAACACAGGCTATGCACAGAAGTTCAGGGCAG AGTCACCATGACCAGGAACACTTCCATGAGCACC GCCTACATGGAGCTGAGCAGCCTGAGATCTGAG GACTCGGCCGTGTATTACTGTTCCTATAGCAGTG GCTGGTACATGTTTGACTACTGGGGCCAGGGAAC CCTGGTCACCGTCTCCTCA<br><br>SEQ ID NO: 28123 |
| | | AA | DIVMTQSPDSLAVSLGERATINCKSSQSLLKSSN NKSYLASYQQKPGQLPKLLIYWASSRESGVPDR FSGSGSGTDFTLTISSLQAEDVALYYCQQYYSIPP TFGHGTNVDIT<br><br>SEQ ID NO: 24118 | QVQLVQSGAEVKKPGASVKVSCKASGYTFTNYDIN WVRQATGQGLEWMGWMTPNSGNTGYAQKFQGR VTMTRNTSMSTAYMELSSLRSEDSAVYYCSYSSG WYMFDYWGQGTLVTVSS<br><br>SEQ ID NO: 28124 |
| iPS:451137 | 21-225_74A7 | NA | GACATCGTTATGACCCAGTCTCCAGACTCCCT GGCTGTGTCTCTGGGCGAGAGGGCCACCATCA ACTGCAAGTCCAGCCAGAGTGTTTATTCAGC TCCAACAATTATAACTACTTAGCTTGGTACCA GCAGAAGCCAGGACAGCCTCCTAAACTGCTCA TTTACTGGGCATCTCACCCGGGGCAGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTTCCTCGACGTTCGGCCAAGG GACCACGGTGCAAATCAAA<br><br>SEQ ID NO: 24119 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGATGACCAGAAGTTCCAACAGTGG TAACACAGGCTATGCACAGAAGTTCCAGGGCAG AGTCACCATGACCAGGAACACCTCACAAGCAC AGCCCACATGGAGCTGAGCAGCCTGAGATCTGA GGACACGGCCGTGTATTACTGTGCGGTCTCCAGT GGCTGAACTGGTTCGACCCCTGGGGCCAGGGA ACCCTGGTCACCGTCTCCTCA<br><br>SEQ ID NO: 28125 |

FIGURE 50
(Continued)

| | | | |
|---|---|---|---|
| iPS:451139 | 21-225_71A6 | AA | DIVMTQSPDSLAVSLGERATINCKSSQSVLFSSN NYNYLAWYQQRPGQPPNLLIYWASTRESGVPD RFSGSGSGTDFTLTISSLQAADVAVYYCQQYHSS PPTFGQGTTVQIK<br>SEQ ID NO: 24120 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br>SEQ ID NO: 28126 |
| | | NA | GATATTGTGATGACCCAGACTCCACTCTCTCTC TCTGTCACACCTGGACAGCCGGCCTCCATCTC CTGCAAGTCTAGTCAGAGCCTCTGCGTAGTG ATGGAAAGAACCCATTTGTATTGGTACCTGCAG AAGCCAGGCCAGCCTCCACAGCTCTTAATCTA TGAAGTTTCCAACGGTTCTCTGGAGTGTCAG ATAGGTTCAGTGGCAGGGTCAGGGACAGA TTTCACACTGAAAATCAGCCGGGTGGAGGCTG AGGATGTTGGGGTTTATTACTGCATGCAAAGT AAACAGCTTCCTCTCACTTTCGGCGGAGGGAC CAAGGTGGAGTTCAAA<br>SEQ ID NO: 24121 | CAGGTGCAACTGGTGGAGTCTGGGGGAGGCGTG GTCCAGCCTGGGAGGTCCCTGAGACTCTCCTGTG CAGCCTCTGGATTCACCTTCAGTAACTATGGCAT GCACTGGGTCCGCCAGGCTCCAGGCAAGGGGCT GGAGTGGGTGGCAGTTATATCATATGATGGAAGT AATGAATACTATGCAGACTCCGTGAAGGGCCGA TTCACCATCTCCAGAGACAACAATTCCAAGAACACGC TGTATCTGCAAATGAACAGCCTGAGAGCTGAGG ACACGGCTGTGTATTACTGTGCGAGAGATCACAG ATATGGGGTTCGGGGAGGCTTTGACTACTGGGGC CAGGGAACCCTGGTCACCGTCTCCTCA<br>SEQ ID NO: 28127 |
| | | AA | DIVMTQTIPLSLSVTPGQPASISCKSSQSLLRSDGK THLYWYLQKPGQPPQLLIYEVSNRFSGVSDRFSG SGSGTDFTLKISRVEAEDVGVYYCMQSKQLPLT FGGGTKVEFK<br>SEQ ID NO: 24122 | QVQLVESGGGVVQPGRSLRLSCAASGFTFSNYGM HWVRQAPGKGLEWVAVISYDGSNEYYADSVKGRF TISRDNSKNTLYLQMNSLRAEDTAVYYCARDHRY GVRGGFDYWGQGTLVTVSS<br>SEQ ID NO: 28128 |

FIGURE 50
(Continued)

| | | | | |
|---|---|---|---|---|
| iPS:451143 | 21-225_66H11 | NA | GACATCCAGATGACCCAGTTTCCATCTCACT GTTTGCATTGTAGGAGACAGAGTCACCATCA CTTGTCCGGCGAGTCAGGCATTAGCAATTAT TTAGCTTGGTTTCAGCAGAAACCAGGAAAGC CCCTAAGTCCCTTATTTATGGTGCATTCAATTT GCACAGTGGGGTCCCATCAAAGTTCAGCGGCA GTGGATTTGGGACAGATTTCACTCTCACCATC AACAGCCTGCAACAGTATAGTTGTTACCCATTCAC TTTCGGCCATGGGACCAAAGTGGATATCAAA SEQ ID NO: 24123 | CAGGTTCAGCTGGTCCAGTCTGGAGCTGAGGTGA AGAAGCCTGGGGCCTCAGTGAAGGTCTCCTGCA AGGCTTCTGTTACACCTTTGCCACTATGGTAT CAGCTGGGTGCGACAGGCCCCTGGACAGGGCT TGAGTGGATGGGATGGATCAGCGTTACAATGGT AACACAAACTATGCACAGAAGTCCAGGCAGA GTCACCATGACCACAGACACATCCACGAGCACA GCCTACATGGAGCTGAGGAGCCTGAGATCTGAC GACACGGCCGTGTATTACTGTGCGAGAGGGAA GCAGTGGCTGTCTCTGACCCCTGGGGCCAGGAA CCCTGGTCACCGTCCTCA SEQ ID NO: 28129 |
| | | AA | DIQMTQFPSSLFAFVGDRVTITCPASQGISNYLA WFQQKPGKAPKSLIYGAFNLHSGVPSKFSGSGF GTDFTLTINSLQPEDFANYYCQQYSCYPFTFGHG TKVDIK SEQ ID NO: 24124 | QVQLVQSGAEVKKPGASVKVSCKASGYTFATYGIS WVRQAPGQGLEWMGWISAYNGNTNYAQKLQGR VTMTDTSTSTAYMELRSLRSDDTAVYYCARGEA VAVFDPWGQGTLVTVSS SEQ ID NO: 28130 |
| iPS:453445 | 21-225_148E10 | NA | TCCTATGAGCTGACTCAGCCACCTCAGTGTC CGTGTCCCCAGGACAGACAGCCAGCATCACCT GCTCTGGAGATAAATTGGGTAATAAATATGTT TGTTGGTATCAGCAGAGGCCAGGCCATGCTGC TGTGCTGATCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT TCTGTCAGGCGTGGGACAGGAACACTTAGTG GTGTTCGGCGGAGGGACCAAGCTGACCGTCCT A SEQ ID NO: 24125 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGCT GGAGTGGGTGGCAGTTATATAGACTCCGTGAAGGACCAGT AATAAATACTATGTAGACTCCGTGAAGGACCGAT TCACCATCTCCAGAGACAATTCCAAGAACACGCT GTATCTGCAAATGAACAGCCTGAGAGCCGAGGA CACGGCTGTTTATTACTGTGCGAGAGATCGGGTG GAGGGTTCGGGACTCCTACTACTACTACGGTA TGGACGTCTGGGGCCAAGGGACCACGGTCACCG TCTCCTCA SEQ ID NO: 28131 |

FIGURE 50
(Continued)

| | | | |
|---|---|---|---|
| iPS:453447 | 21-225_65F10 | AA | SYELTQPPSVSVSPGQTASITCSGDKLGNKYVCW YQQRPGHAAVLIIYQDSKRPSGIPERFSGSNSGNT ATLTISGTQAMDEADYFCQAWDRNTYVFGGG TKLTVL<br>SEQ ID NO: 24126 | QVQLVESGGGVVQPGRSLRLSCAASGFTFSSYGMH WVRQAPGKGLEWVAVIWFDGSNKYYVDSVKDRF TISRDNSKNTLYLQMNSLRAEDTAVYYCARDRVEG SGTPYYYYGMDVWGQGTTVTSS<br>SEQ ID NO: 28132 |
| | | NA | GACATCCAGATGACCCAGTCTCCATCTTCCGT GTCTGCATCTGTAGGAGACAGAGTCACCATCA CTTGTCGGGGGGGTCAGGTATTAGCACATGG TTAGCATGGTATCAGCAGAAACCAGGAAAG CCCCTAAGCTCCTGATCTATGCTGCATCCATTT TGCAAAGTGGGGTCCCATCAAGGTTCAGAGGC AGGGGATCTGGGACAGATTTCACTCTCACCAT CAGCAGCCTGCAGCCTGAAGATTTTGCAACTT ATTATTGTCAACAGGGTAACATTTTCCCATTCA CTTTCGGCCGAGGGACCAAAGTGGATATCAAA<br>SEQ ID NO: 24127 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACAGAAGTTCAGGACAG TGGCACAAGCTATGCACAGAGAAGTTCAGGACAG GGTCAACATGACCAGGGACACGTCCATCAGCAC AGCCTACACATGGAGCTGAAGCAGCCTGAGATCTGA CGACACGGCCGTGTACTACTGTGCGAGAGATAGT AGGTCGTCCTGGGACTACTGGGGCCAGGGAACC CTGGTCACCGTCTCCTCA<br>SEQ ID NO: 28133 |
| | | AA | DIQMTQSPSSVSASVGDRVTITCRGGQGISTWLA WYQQKPGKAPKLLIYAASILQSGVPSRFRGRGS GTDFTLTISSLQPEDFATYYCQQGNIFPFTFGRGT KVDIK<br>SEQ ID NO: 24128 | QVQLVQSGAEVKKPGASVKVSCKASGYTFTGYHM HWVRQAPGQGLEWMGWINPNNGGTSYAQKFQDR VNMTRDTSISTAYMELSRLRSDDTAVYYCARDSRS SWDYWGQGTLVTVSS<br>SEQ ID NO: 28134 |

FIGURE 50
(Continued)

| | | | | |
|---|---|---|---|---|
| iPS:453449 | 21-225_208A2 | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGCAACCAGGGAAA CCCCTAAGCGCCTGATCTATGCTGCATCCAGT TTGCTTAGTGGGGTCCCATCAAGGTTCAGCGG CAGTAGATCTGGGACAGATTTCACTCTCACAA TCAGCAGCCTGCAGCCTGAAGATTTTGCAACT TATTACTGTCTACAGTATAATAGTTACCCTCCC ACCTTCGGCCAAGGGACACGACTGGAGATTAA A SEQ ID NO: 24129 | CAGGTGCAGCTGCAGGAGTCGGGCCAGGACTG GTGAAGCCTTCGGAGACCCTGTCCTCAACTGCA CTGTCTCTGGTGGCTCCATCAGGAGTTACTACTG GAGCTGGATCCGGCAGCCCGCCGGGAAGGACT GGAGTGGATTGGGCGTATCTATACCAGTGGAGC ACCGACTACAACCCCTCCCTCAAGAGTCGAATCA CCATGTCAGTAGACACGTCCAAGAACCAGTTCTC TTTGAAGCTGAGCTGTGTGACCGCCGCGGACACG GCCGTGTATTACTGTGCGAGAGAGGGTTCGGTGACT GGGACTACTGGGGCCAGGGAACCCTGGTCACCG TCTCCTCA SEQ ID NO: 28135 |
| | | AA | DIQMTQSPSSLSASVGDRVTITCRTSQGIRNDLG WYQQKPGKTPKRLIYAASSLLSGVPSRFSGSRSG TDFTLTISSLQPEDFATYYCLQYNSYPPTFGQGT RLEIK SEQ ID NO: 24130 | QVQLQESGPGLVKPSETLSLNCTVSGGSIRSYYWS WIRQPAGKGLEWIGRIYTSGSTDYNPSLKSRITMSV DTSKNQFSLKLSSVTAADTAVYYCARGFGDWDYW GQGTLVTVSS SEQ ID NO: 28136 |
| iPS:453451 | 21-225_52G11 | NA | GACATCCAGATGACCCAGTCTCCATCTTCCGT GTCTGCATCTGTAGGAGACAGAGTCACCATCA CTTGTCGGGCGAGTCAGGGTATTAGCAAATGG TTAGCCTGGTATCAGCAGAAACCAGGGAAAG CCCCTAAGCTCCTGATCTATGCTGCATCCAGTT TGCAAAGTGGGGTCCCATCAAGATTCAGCGCC AGTGGATCTGGGACAGATTTCACTCTCACCAT CAGCAGTTTGCAGCCTGAAGATTTTGCAACTT ACTATTGTCAACAGGCTAACAGTTTCCCATTC ACTTTCGGCCCTGGGACCAAAGTGGATGTCAA A SEQ ID NO: 24131 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATT TGCACTGGGTGCGACAGGCCCCTGGACAAGGGC TTGAGTGGATGGGATGGATCAACCCTAATAGAA ATGGCACAAACTATGCACAGAAGTTTCAGGGCA GGGTCACCATGACCAGGGACACGTCCATCAGCA CAGCCTTCATGGAGCTGAGCAGGCTGAGATCTGA CGACACGGCCGTGTATTACTGTGTGGAGAGACGGT ACCAGCAGCTTTGACTACTGGGGCCAGGGAACC CTGGTCACCGTCTCCTCA SEQ ID NO: 28137 |

FIGURE 50
(Continued)

| | | | | |
|---|---|---|---|---|
| iPS:453453 | 21-225_53F2 | AA | DIQMTQSPSSVSASVGDRVTITCRASQGISKWLA WYQQKPGKAPKLLLYAASSLQSGVPSRFSASGS GTDFTLTISSLQPEDFATYYCQQANSFPFTFGPGT KVDVK<br>SEQ ID NO: 24132 | QVQLVQSGAEVKKPGASVKVSCKASGYTFTGYYL HWVRQAPGQGLEWMGWINPNRNGTNYAQKFQGR VTMTRDTSISTAFMELSRLRSDDTAVYYCARDGTS SFDYWGQGTLVTVSS<br>SEQ ID NO: 28138 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAAGTGG TTAGCCTGGTATCAGCAGAAACCAGGGAAAG CCCCTAACCTCCTCCTATGCTGCATCCAGTT TGCAAAGTGGGGTCCCATCAAAATTCAGCGGT AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATGTCAA A<br>SEQ ID NO: 24133 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATT TGCACTGGGTGCGACAGGCCCCTGGACAAGGGC TTGAGTGGATGGGATGGATCAACCCTAACAGAA ATGGCACAAACTATGCAACAGAAGAATTTCAGGGCA GGGTCACCATGACCAGGGACACGTCCATCAGCA CAGCCTACATGGAGCTGAGCAGACTGAGAAGTCTG ACGACAGTAGCTTTGACTACTGGGGCCAGGAAC GTACCAGTCACCGTCTCCTCA<br>SEQ ID NO: 28139 |
| | | AA | DIQMTQSPSSVSASVGDRVTITCRASQGISKWLA WYQQKPGKAPNLLLYAASSLQSGVPSKFSGSGS GTDFTLTISSLQPEDFATYCCQQANSFPFTFGPGT KVDVK<br>SEQ ID NO: 24134 | QVQLVQSGAEVKKPGASVKVSCKASGYTFTGYYL HWVRQAPGQGLEWMGWINPNRNGTNYAQNFQGR VTMTRDTSISTAYMELSRLKSDDTAVYYCARDGTS SFDYWGQGTLVTVSS<br>SEQ ID NO: 28140 |

FIGURE 50
(Continued)

| | | | |
|---|---|---|---|
| iPS:468810 | 21-225_74D5 | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCATTCTCAT CATCAGCAGACTGGAGCCTGAAGATTTTGCAG TGTATTACTGTCAGCAGTATGAAAGCTCGCCG TGGACGTTCGGCCAAGGGACCAAGGTGGAAA TCAAA<br>SEQ ID NO: 24135 | CAGGTGCAGCTACAACAGTGGGGCGCAGGACTG TTGAAGCCTTCGGAGAGACCCTGTCCCTCACTTGCG CTGTCAATGGTGGGCCCTTCAGCGGTTGCTACTG GAGCTGGATCCGCCAGCCCCAGGAAGGGCT GGAGTGGATTGGGGAAATCAATTATAGTGGAAG GACCAACTTCAACCCGTCCCTCAAGAGTCGAGTC ACCATATCAGTTGACACGTCCAAGAACCAGTTCT CCCTGAAGCTGAGCTCTGTGACCGCCGGACAC GGCTGTGTATTACTGTGCGAGAGACTACGGCGGT ATGGACGTCTGGGGCCAAGGGACCACGGTCACC GTCTCCTCA<br>SEQ ID NO: 28141 |
| | | AA | EIVLTQSPGTLSLSPGERATLSCRASQSVNSNYLA WYRQKPGQAPRLLIYGASSRATGIPDRFSGSGSG TDFILTISRLEPEDFAVYYCQQYESSPWTFGQGTK VEIK<br>SEQ ID NO: 24136 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br>SEQ ID NO: 28142 |
| iPS:468812 | 21-225_48H4 | NA | GACATCCAGATGACCCAGTTTCCATCCTCCCT GTCTGCATCTGTAGGAGACAGAGTCACCATCA CTTGCCGGGCAAGTCAGAGTCATTAGAAATGAT TTAGGCTGGTATCAGCAGAAAACCAGGAAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATTATAGTTACCCGCTC ACTTTCGGCGGAGGGACCAAGGTGGAGATCA AA<br>SEQ ID NO: 24137 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTCTCTAT GCACTGGGTCCGCCAGGCTCCAGGCAAGGGGCT GGAGTGGGTGGCAGTTATATGGTATGATGGAAGT AATAAATACTATACAGACTCCGTTAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAACTAT AGCAGTGGTGGTACGGGTACGGTATGGACGTCT GGGGCCAAGGGACCACGGTCACCGTCCTCA<br>SEQ ID NO: 28143 |

FIGURE 50
(Continued)

| | | | | |
|---|---|---|---|---|
| iPS:468816 | | AA | DIQMTQFPSSLSASVGDRVTITCRASRDIRNDLGWYQQKPGKAPKRLIYAASSLQSGVPSRFSGSGSGTEFTLTISSLQPEDFATYYCLQHYSYPLTFGGGTKVEIK | QVQLVESGGGVVQPGRSLRLSCAASGFTFSDSLMHWVRQAPGKGLEWVAVIWYDGSNKYTDSVKGRFTISRDNSKNTLYLQMNSLRAEDTAVYYCARENYSSGWYGYGMDVWGQGTTVTSS |
| | | | SEQ ID NO: 24138 | SEQ ID NO: 28144 |
| | 21-225_52G8 | NA | GATATTGTGATGACCCAGACTCCACTCTCTCTGTCCGTCAAGTCTCCTGACAGCGCCTCCATGTCCTGCAAGTCTAGTCAGAGCCTCCTGCATAGTGAAGGAAAGACCTATTTGTATTGGTACCTGCAGAAGACAGGCCAGCCTCCACACTCCCTGATCTATGAAGTTTCCAAGCGGCTCTCTGGCGTGCCAGATAGGTTCAGTGGCAGTGGGTCAGGGACAGATTTCACACTGAAAATCAGCCGGATGGAGGCTGAGGATGTTGGGGTTTATTACTGCATGCAAAGTATGCAGCTTCCGATTATCTTCGGCCAGGGGACACGACTGGAGATTAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGCATGCACTGGGTCCGCCAGGCTCCAGGCAAGGGGCTGGAGTGGGTGGCAGTTATATCGACTCCCTGAAGGTATAAATACTATGCAGACACCCGTGAAGGGCCGATTCACCATCTCCAGAGACAATTCCAAGAACACGCTGTATCTGCAAATGAACAGCCTGAGAGCCGAGGACACGGCTCTGTATTACTGTGCGAGAAGGTATAGCAGCAGCTGGTGGGCGGTATGGACGTCTGGGGCCAAGGGACCACGGTCACCGTCTCCTCA |
| | | | SEQ ID NO: 24139 | SEQ ID NO: 28145 |
| | | AA | DIVMTQTPLSLSVTPGQPASMSCKSSQSLLHSEGKTYLYWYLQKTGQPPHLLIYEVSKRLSGVPDRFSGSGSGTDFTLKISRMEAEDVGVYYCMQSMQLPIIFGQGTRLEIK | QVQLVESGGGVVQPGRSLRLSCAASGFTFSSYGMHWVRQAPGKGLEWVAVIWYDGSNKYYADSVKGRFTISRDNSKNTLYLQMNSLRAEDTALYYCARRYSSSWSGGMDVWGQGTTVTSS |
| | | | SEQ ID NO: 24140 | SEQ ID NO: 28146 |

FIGURE 50
(Continued)

| | | | | |
|---|---|---|---|---|
| iPS:468814 | 21-225_223D11 | NA | GACATCCAGATGACCCAGTCTCCCTCCTCACTGTCTGCATCTGTAGGAGACAGAGTCACCATCACTTGTGTCGGGCGAGTCAGGGCATTAGCAATTATTTAGCCTGGTTTCAGCAGAAACCAGGGAAAGCCCCTAAGTCCCGATCTATGCTGCATCCACTTTGCAAAGTGGGGTCCCATCAAAGTTCAGCGGCAGTAGATCTGGGACAGATTTAATCTCACCATCAGCAACCTGCAGCCTGAAGATTTTGCAACTTATTACTGCCAACAGTATAGTGGTTACCATTCACTTTCGGCCCTGGGACCAAAGTGGATACCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTATGGCATGGACTGGGTCCGCCAGGCTCCAGGCAAGGGCTGGAGTGGGTGGCAGTTATATGTATGATGGAAGTAATGACTACTATGCAGACTCCGTGAAGGGCCGATTCACCATCTCCAGAGACAACGCCAAGAACACGCTGTTTCTGCAAATGAACAGCCTGAGAGCCGAGGACACGGCTGTGTATTACTGTGCGAGAGATCGGGGGATCGGGTACAACGATATGGACGTCTGGGGCCAAGGGACCACGGTCACCGTCTCCTCA |
| | | | SEQ ID NO: 24141 | SEQ ID NO: 28147 |
| | | AA | DIQMTQSPSSLSASVGDRVTITCRASQGISNYLAWFQQKPGKAPKSLIYAASTLQSGVPSKFSGSRSGTDFNLTISNLQPEDFATYYCQQYSGYPFTFGPGTKVDTK | QVQLVESGGGVVQPGRSLRLSCAASGFTFSNYGMDWVRQAPGKGLEWVAVIWYDGSNDYYADSVKGRFTISRDNSKNTLFLQMNSLRAEDTAVYYCARDRGIGYNDMDVWGQGTTVTVSS |
| | | | SEQ ID NO: 24142 | SEQ ID NO: 28148 |
| iPS:468822 | 21-225_147E10 | NA | GCTATTGTGATGACCCAGACTCCACTCTCTGTCCGTCACCCTGGACAGCCGGCCTCCATCTCCTGCAAGTCTAGTCAGGGCCTCCTGCATGGTGATGGAAAGACCTATTTGTATTGGTACCTGCAGAAGCCAGGCCAGCCTCCAACGGTTCTCCACCGTTCTGGAGTGCCAGATAGGTTCAGTGGCAGCGGGTCAGGGACAGATTTCACACTGAAAATCAGCAGGGTGGAGGCTGAGGATGTTGGGGTTTATTACTGCATGCAAGGTATACAGGTTCCGTGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCTGCGTCTGGATTCACCTTCAGTAACTATGGCTTACACTGGGTCCGCCAGGCTCCAGGCAAGGGCTGGAGTGGGTGGCAATTATATGTATGATGGAAGTAATAAATACTATGCAGACTCCGTGAAGGGCCGATTCACCATCTCCAGAGACAACGCTTCCAAGAACACGCTGTATCTGCAAATGAACAGCCTGAGAGCCGAGGACACGGCTGTGTATTACTGTGCGAGAGATCATTACGATTTTTGGAGTGGTCACTTGACTACTGGGGCCAGGGAACCCTGGTCACCGTCTCCTCA |
| | | | SEQ ID NO: 24143 | SEQ ID NO: 28149 |

FIGURE 50
(Continued)

| | | | |
|---|---|---|---|
| iPS:468824 | | AA | AIVMTQTPLSLSVTPGQPASISCKSSQRLLHGDG KTYLYWYLQKPGQPPHLLISEVSNRFSGVPDRFS GSGSGTDFTLKISRVEAEDVGVYYCMQSIQVPW TFGQGTKVEIK<br>SEQ ID NO: 24144 | QVQLVESGGGVVQPGKSLRLSCAASGFTFSNYGLH WVRQAPGKGLEWVAIIWYDGSNKYYADSVKGRFT ISRDNSKNTLYLQMNSLRAEDTAVYYCARDHYDF WSGHFDYWGQGTLVTVSS<br>SEQ ID NO: 28150 |
| | 21-225_73G6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCGTCAAGGTTCAGCGG CAGTGGATCTGGGACAGATCACTCTCACAA TCAGCAGCCTGCAGCCTGAAGATTTTGCAACT TATTACTGTCTACAGCATATAAGTTACCCGCTC ACTTTCGGCGGAGGGACCAAGGTGGAGATCA AA<br>SEQ ID NO: 24145 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGTAAGT AATAAATACTATGGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGAAGTGGG GATGACTTCTGACTACTGGGGCCAGGGAACCCTG GTCACCGTCTCCTCA<br>SEQ ID NO: 28151 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24146 | QVQLVESGGGVVQPGRSLRLSCAASGFTFSSYGMH WVRQAPGKGLEWVAVIWYDVSNKYYGDSVKGRF TISRDNSKNTLYLQMNSLRAEDTAVYYCAREVGM TSDYWGQGTLVTVSS<br>SEQ ID NO: 28152 |

FIGURE 50
(Continued)

| | | | |
|---|---|---|---|
| iPS:468818 | 21-225_190C8 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCTGAAGATTTTGAAACT TATTACTGTCTACAGCATAATGATTACCCGTTC ACTTTCGGCGGAGGGACCAAGGTGGAGATCA AA<br>SEQ ID NO: 24147 | CAGGTGCAGCTGGTGCAGTCTGGGGCTGAGGTG AAGAAGCCTGGGGCCTCAGTGAAGGTCTCCTGC AAGGCTTCTGGATACACCTTCATCAGTATGATA TCAACTGGGTGCGACAGGCCACTGGACAAGGGC TTGAGTGGATGGATGGATGAACCTAAAAGG GTAACACAGGCTATGCACAGAAGTTCCAGGGCA GAGTCACCATGACCAGGGACACCTCCATAAGCA CAGCCTACATGGAGCTGAGCAGCCTGAGATCTG AGGACACGGCCGTTTATTACTGTGCGAGAGAG ACCCGTATAACTGAACTCTACGCTATGGACGT CTGGGGCCAAGGGACCACGGTCACCGTCTCCTCA<br>SEQ ID NO: 28153 |
| | | AA | DIQMTQSPSSLSASVGDRVTITCRASQGIRNDLG WYQQKPGKAPKRLIYAASSLQSGVPSRFSGSGS GTEFTLTISSLQPEDFETYYCLQHNDYPFTFGGG TKVEIK<br>SEQ ID NO: 24148 | QVQLVQSGAEVKKPGASVKVSCKASGYTFISYDIN WVRQATGQGLEWMGWMNPKRGNTGYAQKFQGR VTMTRDTSISTAYMELSSLRSEDTAVYYCARGDPY NWNSYAMDVWGQGATVTVSS<br>SEQ ID NO: 28154 |
| iPS:468826 | 21-225_201C5 | NA | GACATCCAGATGACCCAGTCTCCATCCTCCT GTCTGCATCTGTAGGAGACAGAGTCACCATCA CTTGCCGGGCAAGTCAGGGACAGTCACAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTCCCTCGG ACGTTCGGCCAAGGGACCAAGGTGGAAATCA AA<br>SEQ ID NO: 24149 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTGACTATGTCAT GCACTGGGTCCGCCAGGCTCCAGGCAAGGGCT GGAGTGGGTGGCAGTTATATGACTCCGTGAAGT AATAAATACTATGCAGACACATTCCAGGAACACGCT TCACCATCTCCAGAGACAATTCCAAGAACACGCT GTATCTGCAAATGAACAGCCTGAGAGCCGAGGA CACGGCTGTGTATTACTGTGCGAGAGAACGTAT AGCAGTGGCTTGTACGACTACGGTATGGACGTCT GGGGCCAAGGGACCACGGTCACCGTCTCCTCA<br>SEQ ID NO: 28155 |

FIGURE 50
(Continued)

| | | AA | DIQMTQSPSSLSASVGDRVTITCRASQGIRHDLGWYQQKPGKAPKRLIYAASSLQSGVPSRFSGSGSGTEFTLTISSLQPEDFATYYCLQHYSFPRTFGQGTKVEIK<br>SEQ ID NO: 24150 | QVQLVESGGGVVQPGRSLRLSCAASGFTFSDYVMHWVRQAPGKGLEWVAVIWYDGSNKYYVDSVKGRFTISRDNSRNTLYLQMNSLRAEDTAVYYCARERYSSGLYDYGMDVWGQGTTVTVSS<br>SEQ ID NO: 28156 |
|---|---|---|---|---|
| iPS:468828 | 21-225_162A10 | NA | GAAATAGTGATGACGCAGTCTCCAGCCACCCTGTCTGTGTCTCCAGGGGAAAGAGCCACCCTCTCCTGCAGGGCCAGTCAGTCAGAGAGCAACTTAGCCTGGTACCAGCAGAAATCTGGCCAGGCTCCCAGGCTCCTCATCTTTGGTGCATCCACCAGGGCCACTGTTATCCCAGCCAGGATCAATGGCAGTGGGTCTGGGACAGAGTTCACTCTCACCATCAGCAGCCTGCGGGTCTGAAGATTTTGCAGTTTATTTCTGTCAGCAGTATAATGACTGGCCGTGCAGTTTTGGCCAGGGGACCAAGCTGGAGATCAAA<br>SEQ ID NO: 24151 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTGTGGCATGCACTGGGTCCGCCAGGCTCCAGGCAAGGGGCTGGAATGGGTGGCAGCTATATGATGTATGATGGAAGCAATAAATACTATGCAGACTCCGTGAAGGGCCGATTCACCATCTCCAGAGACAACAATTCCAAGAACACGCTGTTTCTGCAAATGAACAGCCTGAGAGCCGAGGACACGGCTGTGTATTACTGTGCGAGAGACAAAATATAATGGAGATACTTGGTTTGACTTCTGGGGCCAGGGAACCCTGGTCACCGTCTCCTCA<br>SEQ ID NO: 28157 |
| | | AA | EIVMTQSPATLSVSPGERATLSCRASQTVNSNLAWYQQKSGQAPRLLIFGASTRATVIPARINGSGSGTEFTLTISSLRSEDFAVYFCQQYNDWPCSFGQGTKLEIK<br>SEQ ID NO: 24152 | QVQLVESGGGVVQPGRSLRLSCAASGFTFSSCGMHWVRQAPGKGLEWVAAIWYDGSNKYYADSVKGRFTISRDNSKNTLFLQMNSLRAEDTAVYYCARDKNIMGDTWFDFWGQGTLVTVSS<br>SEQ ID NO: 28158 |

FIGURE 50
(Continued)

| | | | |
|---|---|---|---|
| iPS:468830 | 21-225_191G11 | NA | GAAATAGTGATGACGCAGTCTCCAGCCACCCT GTCTGTGTCTCCAGGGGAAAGAGCCAACCTCT CCTGCAGGACCAGTCAGAGTGTTTGGATTAGC GTAGCCTGGTACCACCAGAAACCTGGCCAGGC TCCCAGGCTCCTCATCTATGGTGCAGCCACCA GGGCCACTGGTATCCCAGCCAGGTTTAGTGGC AGTGGGTCTGGGACAGAGTTCACTCTCACCAT CAGCAGCCTGCAGTCTGAAGATTTTGCAGTTT ATTACTGTCAGCAGTATAATTACTGGCCGCTC ACTTTCGGCGGAGGGACCAAGGTGGAGATCA AA |
| | | | SEQ ID NO: 24153 |
| | | AA | EIVMTQSPATLSVSPGERANLSCRTSQSVWISVA WYHQKPGQAPRLLIYGAATRATGIPARFSGSGS GTEFTLTISSLQSEDFAVYYCQQYNYWPLTFGG GTKVEIK |
| | | | SEQ ID NO: 24154 |
| | | NA | GACATCCAGATGACCCAGTCTCCATCCTCCCT GTCTGCCTCTGCAGGAGACAGAGTCACCATCA CTTGCCGGGCAAGTCAGGACATTAGAAATTAT TTAGGCTGGTATCAGCAGAAACCAGGGAAAG CCCCTAAGCGACTGATCTATGGTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TTTTACTGTCTACAGTATGATAATAGTTACCCATTC ACTTTCGGCCCTGGGACCAAAGTGGATATCAA A |
| | | | SEQ ID NO: 24155 |
| iPS:468832 | 21-225_76H10 | | CAGGTGCAACTGGTGCAGTCTGGGGCTGAGGTG AAGAAGCCTGGGGCTTCAGTGAAGGTTCCTGC AAGGCTTCTGGATACACCTTCACCGGCTACTATA TGCACTGGGTGCGACAGGCCCCTGGACAAGGAC TTGAGTGGATGGGATGGATCAACCCTAATAGTGG TGGCACAAACTTTGCACAGAAGTTTCAGGGCAG GGTCACCTTGACCAGGGACACGTCCATCAACACA GCCTACATGGAGCTGAGCTGGCTGCGATCTGACG ACACGGCCGTATATTACTGTGCGCGTGGAAAGA ACTATGGCTCCTACTTTGACTACTGGGGCCAGGG AACCCTGGTCACCGTCCTCG |
| | | | SEQ ID NO: 28159 |
| | | | QVQLVQSGAEVKKPGASVKVSCKASGYTFTGYYM HWVRQAPGQGLEWMGWINPNSGGTNFAQKFQGR VTLTRDTSINTAYMELSWLRSDDTAVYYCARGKN YGSYFDYWGQGTLVTVSS |
| | | | SEQ ID NO: 28160 |
| | | | CAGGTGCAGCTACAACAGTGGGGCGCAGGACTG TTGAAGCCTTCGGAGACCCTGTCCCTCACTTGCG CTGTCAATGGTGGGCCCTTCAGCGGTTGCTACTG GAGCTGGATCCGCCAGCCCGCAGGGAAGGGCT GGAGTGGATTGGGAAATCAATTATATGTGGAAG GACCAACTTCAACCCTGTCCTCCAAGATCGAGTC ACCATATCAGTTGACACGTCCAAGAACCAGTTCT CCCTGAAGCTGAGCTCTGTGACCGCGGCGGACAC GGCTGTGTATTACTGTGCGAGAGACTACGGCGGT ATGGACGTCTGGGGCCAAGGGACCAAGGTCACC GTCTCCTCA |
| | | | SEQ ID NO: 28161 |

FIGURE 50
(Continued)

| | | | | |
|---|---|---|---|---|
| iPS:468834 | 21-225_94G10 | AA | DIQMTQSPSSLSASAGDRVTITCRASQDIRNYLG WYQQKPGKAPKRLIYGASSLQSGVPSRFSGSGS GTEFTLTISSLQPEDFATFYCLQYNSYPFTFGPGT KVDIK<br>SEQ ID NO: 24156 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br>SEQ ID NO: 28162 |
| | | NA | GAAATTGTGTTGACGCAGTCTCCAGGCACCCT GTCTTTGTCTCCAGGGGAGAGAGCCACCCTCT CCTGCAGGGCCAGTCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAA TCAAA<br>SEQ ID NO: 24157 | CAGGTGCAGCTACAACAGTGGGGCGCAGGACTG TTGAAGCCTTCGGAGACCCTGTCCCTCACTTGCG CTGTCAATGGTGGCCCTTCAGCGTGTTGCTACTG GAGCGGGATCCGCCAGCCCCCAGGGAAGGGCG GGAGTGGATTGGGAAATCAATTATAGTGGAAG GACCAACTTCAACCCGTCCCTCAAGAGTCGAGTC ACCATATCAGTTGACACGTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA<br>SEQ ID NO: 28163 |
| | | AA | EIVLTQSPGTLSLSPGERATLSCRASQSVNSNYLA WYRQKPGQAPRLLIYGASSRATGIPDRFSGSGSG TDFILISRLEPEDFAVYYCQQYESSPWTFGQGTK VEIK<br>SEQ ID NO: 24158 | QVQLQQWGAGLLKPSETLSLTCAVNGGPFSGCYW SGIRQPPGKGREWIGEINYSGRTNFNPSLKSRVTISV DTSKNQFSLKLSSVTAADTAVYYCARDYGGMDV WGQGTTVTVSS<br>SEQ ID NO: 28164 |

FIGURE 50
(Continued)

| | | | | |
|---|---|---|---|---|
| iPS:468836 | 21-225_198E3 | NA | GACATCCAGATGACCCAGTCTCCATCTCCT GTCTGCATCTGTAGGAGACAGAGTCACCATCA CTTGCCGGGCAAGTCAGGGCATAAGAAAAGA TTTAGGCTGGTATCAGCAGAAACCAGGGAAA GCCCCTAAGCGCCTGATCTATGCTGCATCCAG TTTGCAAAGTGGGGTCCCATCAAGGTTCAGCG GCAGTGGATCTGGGACAGATTCACTCTCACA ATCAGCAGCCTGCAGCCTGAAGATTTTGCAAC TTATGTCTGTCTACAACATTATCGTTACCCTT CACTTTCGGCCCTGGGACCAAAGTGGATTTCA AA | CAGGTGCAGCTGGTGGAGTCTGGGGGAGGCGTG GTCCAGCCTGGGAGGTCCCTGAGACTCTCCTGTG CAGCCTCTGATTCACCTTCAGTAGCTATGGCAT GCACTGGGTCCGCCAGGCTCCAGGCAAGGGGCT GGAGTGGGTGGCAGTTATATCATATGATGAGGT TATAAAAACTATGCAGACTCCGTGAAGGGCCGA TTCACCATCTCCAGAGACAATTCCAAGAACACGC TGTATCTGCAAATGAATAGCCTGAGAGCTGAGGA CACGGCTGTGTATTACTGTGCAGAGAGTACCCAC GGGTACTACTACGGTGTGGACGTCTGGGGCCAA GGGACCACGGTCACCGTCTCCTCA |
| | | | SEQ ID NO: 24159 | SEQ ID NO: 28165 |
| | | AA | DIQMTQSPSSLSASVGDRVTITCRASQGIRKDLG WYQQKPGKAPKRLIYAASSLQSGVPSRFSGSGS GTEFTLTISSLQPEDFATYVCLQHYRYPFTFGPGT KVDFK | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTVSS |
| | | | SEQ ID NO: 24160 | SEQ ID NO: 28166 |
| iPS:468838 | 21-225_80E12 | NA | GAAATTGTGTTGACGCAGTCTCCAGGCACCCT GTCTTTGTCTCCAGGGGAGAGAGCCACCGTCT CCTGCAGGGCCAGTCAGAGCGTTAACAGCAAC TACTTAGCCTGGTACCGGCAGAAACCTGACCA GGCTCCCAGGCTCCTCATCTATGGTGCATCCA GCAGGGCCACTGGCATCCCAGACAGGTTCAGT GGCAGTGGGTCTGGGACAGCCTGAGGACTCTCAT CATCAGCAGACTGGAGCCTGAAGATATGAAAGCTCGCCG TGTATTACTGTCAGCAGTATGAAAAGCTCGCCG TGGACGTTCGGCCAAGGGACCAAGGTGGAAA TCAAA | CAGGTGCAGCTACAACAGTGGGGCGCAGGACTG TTGAAGCCTTCGGAGACCCTGTCCCTCACTTGCG CTGTCAATGGTGGGCCCTTCAGCGGTTGCTACTG GAGCTGGATCCGCCAGCCCGCCAGGGAAGGGCT GGAGTGGATTGGGGAAATCAATTATATAGTGAAG ACCAACTTCAACCCGTCCCTCAAGAGTCGAGTC ACCATATCAGTTGACAGTTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA |
| | | | SEQ ID NO: 24161 | SEQ ID NO: 28167 |

FIGURE 50
(Continued)

| | | | |
|---|---|---|---|
| iPS:468840 | | AA | EIVLTQCPGTLSLSPGERATVSCRASQSVNSNYL AWYRQKPDQAPRLLIYGASSRATGIPDRFSGSGS GTDFILISRLEPEDFAVYYCQQYESSPWTFGQGT KVEIK<br>SEQ ID NO: 24162 | QVQLQQWGAGLLKPSETLSLTCAVNGGPFSGCYW SWIRQPPGKGLEWIGEINYSGRTNFNPSLKSRVTISV DTSKNQFSLKLSSVTAADTAVYYCARDYGGMDV WGQGTTVTVSS<br>SEQ ID NO: 28168 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGATCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AA<br>SEQ ID NO: 24163 | CAGGTGCAGCTGCAGGAGTCGGGCCAGGACTG GTGAAGCCTTCACAGACCCTGTCCCTCACCTGCA TTGTCTCTGGTGGCTCCATGAGGAGTGGTGGTGA CTACTGGAGCTGGATCCGCCAGCACCCAGGGAA GGGCCTGGAGTGGTTTGGGTACATCTATTACAGT GGGAGCACCTACTACAACCCGTCCCTCAAGAGTC GAGTTACCTTATCAGTAGACACGTCTAAGAACCA GTTCTCCCTGAAGCTGAGCTCTGTGACTGCCGCG GACACGGCCGTGTATTACTGTGCGAGAATGGACT ACAGTAACTACTACGGTATGGACGTCTGGGG CCAAGGGACCTCGGTCACCGTCTCCTCA<br>SEQ ID NO: 28169 |
| 21-225_200H9 | | AA | DIQMTQSPSSLSASVGDRVTITCRASQGIRNDLG WYQQKPGKAPKRLIYAASSLQSGIPSRFSGSGSG TEFTLTISSLQPEDFATYYCLQHNSYPLTFGGGT KVEIK<br>SEQ ID NO: 24164 | QVQLQESGPGLVKPSQTLSLTCIVSGGSMRSGGDY WSWIRQHPGKGLEWFGYIYYSGSTYYNPSLKSRVT LSVDTSKNQFSLKLSSVTAADTAVYYCARMDYSN YYYGMDVWGQGTSVTVSS<br>SEQ ID NO: 28170 |

FIGURE 50
(Continued)

| | | | |
|---|---|---|---|
| iPS:468820 | 21-225_76F10 | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAA TCAAA SEQ ID NO: 24165 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGCTATATGGTATGATGGAAG TAATAAATACTATGCAGAGACTCCGTGAAGGCCG ATTCACCATCTCCAGAGACAACAGCCTCAAGAACACG CTGGATCTGCAAATGAACAGCCTGAGAGCCGAG GACACGGCTGTGTATTACTGTGCGAGAGAGTTGT ATAGCAGCAACTGGTACGACTACGGTATGGACG TCTGGGGCCAAGGGACCACGGTCACCGTCTCCTC A SEQ ID NO: 28173 |
| iPS:468820 | 21-225_76F10 | AA | EIVLTQSPGTLSLSPGERATLSCRASQSVNSNYLA WYRQKPGQAPRLLIYGASSRATGIPDRFSGSGSG TDFILISRLEPEDFAVYYCQQYESSPWTFGQGTK VEIK SEQ ID NO: 24166 | QVQLQQWGAGLLKPSETLSLTCAVNGGPFSGSYW SWIRQPPGKGLEWIGEINYSGRTNFNPSLKSRVTISV DTSKNQFSLKLSSVTAADTAVYYCARDYGGMDV WGQGTTVTVSS SEQ ID NO: 28172 |
| iPS:468842 | 21-225_50H4 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAGG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATTTTGCAACT TATTACTGTCTACAACATTATAGTTACCCTCGG ACGTTCGGCCAAGGGACCAAGGTGGAAATCA AA SEQ ID NO: 24167 | SEQ ID NO: 28173 |

FIGURE 50
(Continued)

| | | | | |
|---|---|---|---|---|
| iPS:468844 | 21-225_48E10 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEIK<br><br>SEQ ID NO: 24168 | QVQLVESGGGVVQPGRSLRLSCAASGFTFSSYVMH WVRQAPGKGLEWVAAIWYDGSNKYYADSVKGRF TISRDNSKNTLDLQMNSLRAEDTAVYYCARELYSS NWYDYGMDVWGQGTTVTVSS<br><br>SEQ ID NO: 28174 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAACCAGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGATATAATAGTTACCCATTC ACTTTCGGCCCTGGGACCAAAGTGGATATCAA A<br><br>SEQ ID NO: 24169 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAACAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAAGCCTCGAC CTCTGGGGCCAGGGAACCCTGGTCACCGTCTCCT CA<br><br>SEQ ID NO: 28175 |
| | | AA | DIQMTQSPSSLSASVGDRVTITCRASQGIRSDLG WYQQKPGKAPKRLIYTASSLQSGVPSRFSGSGSG TEFTLTISSLQPEDFATYYCLQYNSYPFTFGPGTK VDIK<br><br>SEQ ID NO: 24170 | EVQLVESGGGLVKPGGSLRLSCAASGFTFSSYNMN WVRQAPGKGLEWVSSISGSSSYIYYADSVKGRFTIS RDNAKNSLYLQMNSLRAEDTAVYYCARSLDLWG QGTLVTVSS<br><br>SEQ ID NO: 28176 |

FIGURE 50
(Continued)

| | | | |
|---|---|---|---|
| iPS:468846 | 21-225_53B10 | NA | GACATCCAGATGACCCAGTCTCCATCCTCCT GTCTGCCTCTGCAGGAGACAGAGTCACCATCA CTTGCCGGGCAAGTCAGGACATTAGAAATTAT TTAGGCTGGTATCAGCAGAAACCAGGGAAAG CCCCTAAGCGACTGATCTATGGTGCATCCAGT TTGCAAAGTGGGGTCCCATCAAGGTTCAGCGG CAGTGGATCTGGGACAGAATTCACTCTCACAA TCAGCAGCCTGCAGCTGAAGATTTTGCAACT TTTTACTGTCTACAGTATAATAGTTACCCATTC ACTTTCGGCCCTGGGACCAAAGTGGATATCAA A |
| | | | SEQ ID NO: 24171 |
| | | AA | DIQMTQSPSSLSASAGDRVTITCRASQDIRNYLG WYQQKPGKAPKRLIYGASSLQSGVPSRFSGSGS GTEFTLTISSLQPEDFATFYCLQYNSYPFTFGPGT KVDIK |
| | | | SEQ ID NO: 24172 |
| | | | GAGGTGCAGTTGGTGGAGTCTGGGGGAGGCTTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGCAGT TACATATACTACGTAGACTCAGTGAAGGGCGAT TCACCATCCAGAGACAACGCCAAGAACTCACT GTATCTGCAAATGAACAGCCTGAGAGCCGAGGA CACGGCTGTGTATTACTGTGCGAGAGTCAACTCT TTTGACTCTGGGGCCAGGGAACCCTGGTCACCG TCTCCTCA |
| | | | SEQ ID NO: 28177 |
| | | AA | EVQLVESGGGLVKPGGSLRLSCAASGFTFSSYSMN WVRQAPGKGLEWVSSISGSSSYIYYDSVKGRFTIS RDNAKNSLYLQMNSLRAEDTAVYYCARVNSFDSW GQGTLVTVSS |
| | | | SEQ ID NO: 28178 |
| iPS:468848 | 21-225_54B1 | NA | GACATCCAGATGACCCAGTCTCCATCCTCCCT GTCTGCTTCTATTGGAGACAGAGTCACCATCA CTTGCCGGGCAAGTCAGAACATTAGCAGTAT TTAAAATTGGTATCAGCAGAAACCAGGAAGG CCCCCAAGTTCCTGATCTATGCTGCATCCAGT TGCATAGTGGGGTCCCACCAAGGTTCAGTGGC AGTGGATCTGGGACAGATTTCACTCTCACCAT CAGCAGTCTGCAACCTGAAGATTTTGCAATTT ACTACTGTCTCAACAGAGTTACAGAACCCTCTG TGGACGTTCGGCCAAGGGACCAAGGTGGAAA TCAAA |
| | | | SEQ ID NO: 24173 |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTCTTAGTGGTAGTGGTGGT AGCACATTCTACGCAGACTCCGTGAAGGGCCGGT TCACCATCTCCAGAGACAATTCCAAGAACACGCT GTATCTGCAAATGAGCAGCCTGAGAGCCGAGGA CACGGCCGTATATTACTGTGCCGAAGAGGCCGT GAATATAGTGGCTACGATTACTTTGACTACTGGG GCCAGGGAACCCTGGTCACCGTCTCCTCA |
| | | | SEQ ID NO: 28179 |

FIGURE 50
(Continued)

| | | | |
|---|---|---|---|
| iPS:468850 | 21-225_63F4 | AA | DIQMTQSPSSLSASIGDRVTITCRASQNISSYLNWYQQKPGKAPKFLIYAASSLHSGVPPRFSGSGSGTDFTLTISSLQPEDFAIYYCQQSYRTPLWTFGQGTKVEIK | EVQLLESGGGLVQPGGSLRLSCAASGFTFSSYAMSWVRQAPGKGLEWVSVLSGSGGSTFYADSVKGRFTISRENSKNTLYLQMSSLRAEDTAVYYCARRGREYSGYDYFDYWGQGTLVTVSS |
| | | | SEQ ID NO: 24174 | SEQ ID NO: 28180 |
| | | NA | GACATCGTGATGACCCAATCTCCAGACTCCCTGGCTGTGTCTCTGGGCGAGAGTGTTTATCCAGCACTGCAAGTCCAGCCAGAGTGTTTATCCAGCTCCAACAATAACAACTACTTAGCTTGGTACCAGCAGAAACCAGGACAGCCTCCTAAGCTGCTCATTTACTGGGCATCTACCCGGTCAGCCGGGATCCCTGACCGATTCAGTGGCAGCGGGTCTGGGACAGGTTTCACTCTCACCATCAGCAGCCTGCAGGCTGAGGATGTGGCAGTTTATTACTGTCAGCAATATTATACTACTCCGTGCAGTTTGGCCAGGGACCAAGCTGGAGATCAAT | CAGGTGCAGCTGGTGCAATCTGGGGCTGAGGTGAAGAAGCCTGGGGCTCAGTGAAGGTCTCTGCAAGGCTTCTGGATACACCTTCACCAATTATGATGTCAACTGGGTGCGACAGGCCACTGGACAAGGCTTGAGTGGATGGGATGCATGCACAGAAGTTCCGGGCATAACACAGGCTATGCACAGAAGTTCCGGGCAAGTCACCATGACCAGGAACACCTCCCTAAGCACAGTCTACATGGAGCTGAGCAGCCTGCGATCTGAGGACACGGCCGTGTATTACTGTGCCTATAGCAGTGGCTGGTACGTTTTTGACTACTGGGGCCAGGGAACCCTGGTCACCGTCTCCTCA | 
| | | | SEQ ID NO: 24175 | SEQ ID NO: 28181 |
| | | AA | DIVMTQSPDSLAVSLGERATINCKSSQSVLSSSNNNNYLAWYQQKPGQPPKLLIYWASTRESGIPDRFSGSGSGTGFTLTISSLQAEDVAVYYCQQYYTTPCSFGQGTKLEIN | QVQLVQSGAEVKKPGASVKVSCKASGYTFTNYDVNWVRQATGQGLEWMGWMHPNSGNTGYAQKFRGRVTMTRNTSLSTVYMELSSLRSEDTAVYYCAYSSGWYVFDYWGQGTLVTVSS |
| | | | SEQ ID NO: 24176 | SEQ ID NO: 28182 |

FIGURE 50
(Continued)

| | | | |
|---|---|---|---|
| iPS:468852 | 21-225_71F3 | NA | GACATCGTGATGACCCAATCTCCAGACTCCT GGCTGTGTCTGGGGCGAGGGCCACCATCA ACTGCAAGTCCAGCAGTGTTTTATCCAAC TCCAACAATAACAACTACTTAGCTTGGTACCA GCAGAAACCAGGACAGCCTCCTAAGCTGCTCA TTTACTGGGCATCTACCCGGGAATCCGGGATC CCTGACCGATTCAGTGGCAGCGGGTCTGGGAC AGATTTCACTCTCACCATCAACAGCCTGCAGG CTGAAGATGTGGCAGTTTATTACTGTCAGCAA TATTATACTCCGTCCGTGCAGTTTTGGCCAGGG GACCAAGCTGGAGATCAAA<br><br>SEQ ID NO: 24177 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATG TCAACTGGGTGCGACAGGCCACTGGACAAGGC TTGAGTGGATGGGATGGATGCACCTAACAGTGG TAACACAGGCTATGCACAGAAGTTCCAGGCAC AGTCACCATGACCAGGAACACCTCCATAAGCAC AGCCTACATGGAGCTGAGCAGCCTGCGATCTGA GGACACGGCCGTGTATTACTGTGCCTATAGCAGT GGCTGGTACGTTTTGACTCTGTGGGCCAGGGAA CCCTGGTCACCGTCCTCA<br><br>SEQ ID NO: 28183 |
| | | AA | DIVMTQSPDSLAVSLGARATINCKSSQSVLSNSN NNNYLAWYQQKPGQPPKLLIYWASTRESGIPDR FSGSGSGTDFTLTINSLQAEDVAVYYCQQYYTIP CSFGQGTKLEIK<br><br>SEQ ID NO: 24178 | QVQLVQSGAEVKKPGASVKVSCKASGYTFTNYDV NWVRQATGQGLEWMGWMHPNSGNTGYAQKFQG RVTMTRNTSISTAYMELSSLRSEDTAVYYCAYSSG WYVFDSWGQGTLVTVSS<br><br>SEQ ID NO: 28184 |
| iPS:468854 | 21-225_72C4 | NA | GATGTTGTAATGACTCAGTCTCCGCTCCCCTG CCCGTCACCCTTGGACAGCCGGCTCCATCTC CTGCAGGTCTGGTCAAAGCCTGTATACAGTG ATGGAAACACCTACTTGAATTGGTTTCAGCAG AGGCCAGGCCAATCTCCAAGGCGCCTAATTTA TGAGGTTTCTAAGTGGGACTCTGGGGTCCCAG ACAGATTCAGTGGCAGTGGGTCAGGCACTAAT TTCACACTGGAAATCAGCAGGGTGGAGGCTGA GGATGTTGGGGTCTTTTACTGCATGCAAGGTA CACACTGGCCGCCGCTCACTTTCGGCGGAGGGACC AAGGTGGAGATCAAA<br><br>SEQ ID NO: 24179 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAC AGTCACCATGACCAGGAACACCTCCATAAGCAC AGCCTACATGAACTGAACAGCCTGAGATCTGA GGACACGGCCGTGTATTACTGTTCGCATAGCAGT GGCTGGTACCTCTTTGACTACTGGGGCCAGGGAA CCCTGGTCACCGTCTCTCA<br><br>SEQ ID NO: 28185 |

FIGURE 50
(Continued)

| | | | | |
|---|---|---|---|---|
| iPS:468856 | 21-225_77C9 | AA | DVVMTQSPLSLPVTLGQPASISCRSGQSLVYSDG NTYLNWFQQRPGQSPRRLIYEVSKWDSGVPDRF SGSGSGTNFTLKISRVEAEDVGVFYCMQGTHWP LTFGGGTKVEIK<br>SEQ ID NO: 24180 | QVQLVQSGAEVKKPGASVKVSCKASGYTFTNYDIN WVRQVTGQGLEWMGWMHPNSGNTGYAQKFQGR VTMTRNTSISTAYMELNSLRSEDTAVYYCSHSSGW YLFDYWGQGTLVTVSS<br>SEQ ID NO: 28186 |
| | | NA | GATGTTGTGATGACTCAGTCTCCACTCTCCCTG CCCGTCACCCTTGGACAGCCGGCCTCCATCTC CTGCAGGTCTAGTCAAAGCCTCGTTTACAGTG TTGGAAACACCTCCTTGAGTTGGTTTCAGCAG AGGCCAGGCCAATCTCCAAGGCGCCTAATTTA TAAGGTTTCTAACTGGGACTCTGGGGTCCCAG ACAGATTCAGCGGCCAGTGGGTCAGGCACTGAT TTCACACTGAAAATCAGCAGGGTGGAGGCTGA GGATGTTGGGGTTTATTACCGCATGCAAGGTA CACACTGGCCATTCACTTTCGGCCCTGGGACC AAAGTGGATATCAAA<br>SEQ ID NO: 24181 | CAGCTGCAGCTGCAGGAGTCGGGCCAGGACTG GTGACGCCTTCTGGAGACCCGTCCCTCACCTGCA CTGTCTCTGGGGCTCCATCAGCAGGAGTAGTTA CTACTGGGGCTGGATCCGCCAGCCCCCAGGGAA GGGGCTGAGTGGATTGGAGTATCTATTATAGT GGGAGCGCCTACTCCAACCCGTCCCTCAAGAGT GAGTCACCATATCCGTAGACACGTCCAAGAACC AGTTCTCCCTGAAGCTGAGCTCTGTGACCGCCGC GGACACGGCTCTGTTTACTGTGCGAGACTTGAC TCTAACTGGGGTCTTGACTACTGGGGCCAGGAA CCCTGGTCACCGTCTCCTCA<br>SEQ ID NO: 28187 |
| | | AA | DVVMTQSPLSLPVTLGQPASISCRSSQSLVYSVG NTSLSWFQQRPGQSPRRLIYKVSNWDSGVPDRF SGSGSGTDFTLKISRVEAEDVGVYYRMQGTHWP FTFGPGTKVDIK<br>SEQ ID NO: 24182 | QLQLQESGPGLVTPSETLSLTCTVSGGSISRSSYYW GWIRQPPGKGLEWIGSIYYSGSAYSNPSLKSRVTIS VDTSKNQFSLKLSSVTAADTALFYCARLDSNWGLD YWGQGTLVTVSS<br>SEQ ID NO: 28188 |

FIGURE 50
(Continued)

| | | | | |
|---|---|---|---|---|
| iPS:468858 | 21-225_148C9 | NA | GACATCCAGATGACCCAGTCTCCATCCTCCCT GTCTGCATCTGTAGGAGACAGAGTCACCATCA CTTGCCGGGCAAGTCGGGCATTAGCAGATGAT TTAGGCTGGTATCAGCAGAAACCAGGAAAG CCCCTAAGCGCCTGATCTATGCTGCATCCAGT TTGCAGAGTGGGGTCCCATCAAGGTTCAGCGG CAGTGGATCTGGGACAGAATTCACTCTCACAA TCAGCAGCCTGCAGCCTGAAGATTTGCAACT TATTACTGTCTACAGCATTATAGTTATCCTCGG ACGTTCGGCCAAGGGACCAAGGTGGAAATCA AA | CAGGTGCAGCTGGTGGAGTCTGGGGGAGGCGTG GCCCAGCCTGGGAGGTCCCTGAGACTCTCCTGTG CAGCGTCTGGATTCACCTTCAGTGACTATGGCAT GCACTGGGTCCGCCAGGTCCAGGCAAGGGCT GGAGTGGGTGGCAGTTATATGGTATGATGAAGT AATAAGTACTATGCAGACTCCGTGAAGGGCCGA CTCACCATCTCCAGAGACAATTCCAAGAACACGC TGTATCTGCAAATGAACAGCCTGAGAGCCGAGG ACACGGCTGTGTATTACTGTGCGAGAGAGAGGTA TAGCAGTGGCTGGTACGACTACGGTTTGACGTC TGGGGCCAAGGGACCACGGTCACCGTCTCCTCA |
| | | | SEQ ID NO: 24183 | SEQ ID NO: 28189 |
| | | AA | DIQMTQSPSSLSASVGDRVTITCRASRGIRDDLG WYQQKPGKAPKRLIYAASSLQSGVPSRFSGSGS GTEFTLTISSLQPEDFATYYCLQHYSYPRTFGQG TKVEIK | QVQLVESGGGVAQPGRSLRLSCAASGFTFSDYGM HWVRQAPGKGLEWVAVIWYDGSNKYYADSVKGR LTISRDNSKNTLYLQMNSLRAEDTAVYYCARERYS SGWYDYGLDVWGQGTTVTVSS |
| | | | SEQ ID NO: 24184 | SEQ ID NO: 28190 |
| iPS:468860 | 21-225_224E7 | NA | GACATCCAGATGACCCAGTCTCCTTCCTCCCT GTCTGCATCTGTAGGAGACAGAGTCACCATCA CTTGCCGGGCAAGTCAGGGCATTAGCAGATGAT TTAGGCTGGTATCAGCAGAAACCAGGGAAAG CCCCTACGCGCCTGATCTATGCTGCATCCAGTT TGCAAAGTGGGGTCCCATCGAGGTTCAGCGGC AGTGGATCTGGGACAGAATTCACTCTCACAAT CAGCAGCCTGCAGCCTGAAGATTTGCAACTT ATTACTGTCTACAACATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGCCTCTCCTGTG CAGCGTCTGGATTCACCTTCAGTAGCTATGTCAT GCACTGGGTCCGCCAGGTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACAGTA TAGCAGCAGTGGTACGACTTCGGTCTGACGTC TGGGGCCAAGGGACCACGGTCACCGTCTCCTCA |
| | | | SEQ ID NO: 24185 | SEQ ID NO: 28191 |

FIGURE 50
(Continued)

| | | AA | DIQMTQSPSSLSASVGDRVTITCRASQGIRNDLG WYQQKPGKAPTRLIYAASSLQSGVPSRFSGSGSG TEFTLTISSLQPEDFATYYCLQHYSYPRTFGQGT KVEIK | QVQLVESGGGVVQPGRSLSLSCAASGFTFSSYVMH WVRQAPGKGLEWVAVIWYDGSNKYYADSVKGRF TISRDNSKNTLYLQMNSLRAEDTAVYYCAREQYSS SWYDFGLDVWGQGTTVTVSS |
| | | | SEQ ID NO: 24186 | SEQ ID NO: 28192 |
| iPS:468862 | 21-225_178H8 | NA | CAGTCTGCCCTGACTCAGTCTGCCTCCGTGTCG GGGTCTCCTGGACAGTCGATCACCATCTCCTG CACTGGAACCAGCAGTGACGTTGGTGGTTATA ATTTTGTCTCTGGTACCAACAGCACCAGGC AAAGTCCCAAATTACATGATTTATGAGGTCAG TAATCGGCCCTCAGGGGTTCCTAATCGTTTTC TGGCTCCAAGTCTGGCAACACGGCCTCCCTGA CCATCTCTGGCCTCCAGGCTGAGGACGAGGCT GATTATTACTGCAGTCATATACAAGCAGCTA CACTTGGGTGTTCGGCGGAGGGACCAAACTGA CCGTCCTA | CAGGTGCAGCTGGTGCAGTCTGGGGCTGAGGTG AGGACGCCTGGGGCCTCAGTGAAGGTCTCTGCA AGGCTTCTGGATACACCTTCACCGACTATTATAT GCACTGGGTGCGACAGGCCCCTGGACAAGGGCT TGAGTGGATGGGATGGATCAACCCTAACAGAGG TGGCACAAACTATGCTCAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGAGGA GGATCGCAGTGGCTGGTACTACTACTACGGTATG GACGTCTGGGGCCAAGGGACCACGGTCACCGTC TCCTCA |
| | | | SEQ ID NO: 24187 | SEQ ID NO: 28193 |
| | | AA | QSALTQSASVSGSPGQSITISCTGTSSDVGGYNFV SWYQQHPGKVPKFMIYEVSNRPSGVPNRFSGSK SGNTASLTISGLQAEDEADYYCSSYTSSYTWVFG GGTKLTVL | QVQLVQSGAEVRTPGASVKVSCKASGYTFTDYYM HWVRQAPGQGLEWMGWINPNRGGTNYAQKFQGR VTMTRDTSISTAYMELSRLRSDDTAVYYCAREEDR SGWYYYGMDVWGQGTTVTVSS |
| | | | SEQ ID NO: 24188 | SEQ ID NO: 28194 |

FIGURE 50
(Continued)

| | | | | |
|---|---|---|---|---|
| iPS:468864 | 21-225_60D6 | NA | CAGTCTGTGTTGCTGACTCAGCCACCCTCAGCGTCTGGGACCCCGGGCAGAGCTCACCATCTCTTGTTCTGGAAGCAGCTCCAACATCGGAAGTAATACTGTAAACTGGTACCAGCAGCTCCCAGGAACGGCCCCCAAACTCCTCATCTATAGTAATAATCAGGGGCCCTCAGGGGTCCCTGACCGATTCTCTGGCTCCAAGTCTGGCACCTCAGCCTCCCTGCCATCAGTGGGCTCCAGTCTGAGGATGAGGCTGATTATTACTGTGCAGCATGGGATGACAGCCTGAATGGTCGCGGTCGGCGGAGGGACCAAGCTGACCGTCCTA<br>SEQ ID NO: 24189 | CAGATCACCTTGAAGGAGTCTGGTCCTACGCTGGTGAAACCACAGACCCTCACGCTGACCTGCACCTTCTCTGGGTTCTCACTCAGCACTAGTGGAGTGGGTGTGGGCTGGATCCGTCAGCCCCCAGGAAAGGCCCTGGAGTGGCTTGCACTCATTTATTGGAAAGATGATGAGCGCTACAGCCCATCTCTGAAGAGCAGGCTCACCATCACCAAGGACACCTCCAAAAACCAGTTGGTCCTTACAATGACAACATGACCCTGTGGACACAGCCACATATTACTGTGCACATGCAGTGGCTGTCTCCTTTGACTACTGGGGCCAGGGAACCCTGGTCACCGTCCTCTCA<br>SEQ ID NO: 28195 |
| | | AA | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVGGGTKLTVL<br>SEQ ID NO: 24190 | QITLKESGPTLVKPTQTILTLCTFSGFSLSTSGVGVGWIRQPPGKALEWLALIYWKDDERYSPSLKSRLTITKDTSKNQVLTMTNMDPVDTATYYCAHAVAVSFDYWGQGTLVTVSS<br>SEQ ID NO: 28196 |
| iPS:468866 | 21-225_190C1 | NA | TCCTATGAGCTGACACAGCCACCCTCGGTGTCAGTGTCCCAGGACACAGCCAGGATCACCTGCACTGGAGATGCAATGCCGAAAAATATGCTTATTGGGACCAGCAGAAGTCAGGCAGGCCCCTGTGCTGGTCATCTCTGAGGACAGCAAGCGACCCTCCGGGATCCCTGAGAGATTCTCTGGCTCCAGCTCAGGGACAATGGCCCCCTTGACTATCAGTGGGGCCCAGGTGGAGGATGAAACTGACTACGACTGTAACTCAACAGACAGCAGTGGTAATCGGGTGTTCGGCGGAGGGACCAAGCTGACCGTCCTA<br>SEQ ID NO: 24191 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGACTTGAGTGGATGGGGATGATCAACCCTTACAGTGGTGGCACAAACTATGCACAGAAGTTTCAGGGCAGGGTCACCATGACCAGGGACACGTCCATCAGCACAGCCTACATGGAACTGAGCAGGCTGAGATCTGACGACACGGCCGTGTATTACTGTGCGAGAGATAGAGCAGTGGCTGGAAACTACTTCTACTACGGTATGGACGTCTGGGGCCAAGGGACCACGGTCACCGTCTCCTCA<br>SEQ ID NO: 28197 |

FIGURE 50
(Continued)

| | | AA | SYELTQPPSVSVSPGQTARITCTGDAMPKKYAYWDQQKSGQAPVLVISEDSKRPSGIPERFSGSSSGTMAPLTISGAQVEDETDYDCNSTDSSGNRVFGGGTKLTVL | QVQLVQSGAEVKKPGASVKVSCKASGYTFTGYYMHWVRQAPGQGLEWMGWINPYSGGTNYAQKFQGRVTMTRDTSISTAYMELSRLRSDDTAVYYCARDRAVAGNYFYGMDVWGQGTTVTVSS |
|---|---|---|---|---|
| | | | SEQ ID NO: 24192 | SEQ ID NO: 28198 |
| iPS:468868 | 21-225_74A1 | NA | GACATCCAGATGACCCAGTCTCCATCCTCCTGTCGGACATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTACGCTGCATCCAGTTTGCAAAGTGGGGTCCCATCAAGGTTCAGCGGCAGTGGATCTGGGACAGATCACTCTCACAATCAGCAGCCTGCAGCCTGAAGATTTTGCAACTTATTACTGTCTACAGCATGATAGTTACCCTCTCACTTTCGGCGGAGGGACCAAGGTGGAGATCAAA | CAACTGCAGTCTGCAGGAGAGTCGGGCCCGGGACTGGTGAAGCCTTCGGAGACCCTGTCCCTCACCTGCACTGTCTCTGGTGGCTCCATCAGCGGTAGTAGTTACTGGGGCTGGATCCGCCAGCCCCCGGGAAGGGGCTGGAGTGGATTGGGAATATTATTATAGTGGGAGCACCTACCACAACCCGTCCCTCAAGAGTCGAGTCACCATATCCGTGGACACGTCCAAGAACCAGTTCTCCCTGAAGCTGACCTCTGTGACCGCGCAGACACGGCTGTGTTTACTGTGCGAGACATGATTTACTTTGGTCCCTGACTTCTGGGGCCAGGGAATTCTGGTCACCGTCTCCTCA |
| | | | SEQ ID NO: 24193 | SEQ ID NO: 28199 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHDSYPLTFGGGAKVEIK | QLQLQESGPGLVKPSETLSLTCTVSGGSISGSSYYWGWIRQPPGKGLEWIGNIYSGSTYHNPSLKSRVTISVDTSKNQFSLKLTSVTAADTAVFYCARHDLLWSLDFWGQGILVTVSS |
| | | | SEQ ID NO: 24194 | SEQ ID NO: 28200 |

FIGURE 50
(Continued)

| | | | |
|---|---|---|---|
| iPS:468870 | 21-225_74A8 | NA | GACATCGTGATGACCCAGTCTCCAGACTCCCT GGCTGTGTCTCTGGGCGAGAGGGCCACCATCA ACTGCAAGTCCAGCCAGAGTGTTTGTACAGC TCCAACAGTCACAACTACTTAGCTTGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAAGCTGGAGATCAAA<br><br>SEQ ID NO: 24195 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGAC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACTCGGCCGTATATTACTGTGCGTATAGTAGT GGCTGGTACAAATTTGACTACTGGGAGCCAGGGA ACCCTGGTCACCGTCTCCTCA<br><br>SEQ ID NO: 28201 |
| | | AA | DIVMTQSPDSLAVSLGERATINCKSSQSVLYSSN SHNYLAWYQQKPGQPPKLLIYWASTRESGVPDR FSGSGSGTDFTLTISSLQAEDVAVYYCQQYYSTP CSFGQGTKLEIK<br><br>SEQ ID NO: 24196 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br><br>SEQ ID NO: 28202 |
| iPS:472730 | 21-225_14B1_LC1 | NA | GACATCCAGATGACCCAGTCTCCATCCTACCT GTCTGCATCTGTAGGAGACAGAGTCACCATCA CTTGCCGGGCAAGTCAGGACATTAGAGATAAT TTAGGCTGGTATCAGCAGAAACCAGGGAAAG CCCCTAAACGCCTGATCTATACTGCATACAGT TTGCAAAGTGGGGTCCCATCAAGGTTCAGCGG CAGTGGATCTGGGACAGACGTTCACTCTCACAA TCAGCAGCCTGCAGCCTGAGGATTTTGCAACT TATTACTGTCTACAACATTATAATTACCCGCTC ACTTTCGGCGGAGGGACCAAGGTGGAGATCA AA<br><br>SEQ ID NO: 24197 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATAAGTGGTAGTAGTAGT TACTTATACTACCAGACTCAGTGAAGGGCCGAT TCACCATCTCCAGAGACAACGCCAAGAACTCT GTATCTGCAAATGAACAGCCTGAGAGCCGAGGA CACGGCTGTGTATTACTGTGCGAGAGATAGAGGC AGCAGCTGGGGCCAGGGAACCCTGGTCACCGTC TCCTCA<br><br>SEQ ID NO: 28203 |

FIGURE 50
(Continued)

| | | | |
|---|---|---|---|
| iPS:472731 | 21-225_14B1_LC2 | AA | DIQMTQSPSYLSASVGDRVTITCRASQDIRDNLG WYQQKPGKAPKRLIYTAYSLQSGVPSRFSGSGS GTEFTLTISSLQPEDFATYYCLQHYNYPLTFGGG TKVEIK<br>SEQ ID NO: 24198 | EVQLVESGGGLVKPGGSLRLSCAASGFTFSSYTMN WVRQAPGKGLEWVSSISGSSSYLYYPDSVKGRFTIS RDNAKNSLYLQMNSLRAEDTAVYYCARDRGSSW GQGTLVTVSS<br>SEQ ID NO: 28204 |
| | | NA | TCCTTTGAGCTGACTCAGCCACCCTCAGTGTCC GTGTCCCCAGGACAGACAGCCAGCATCACCTG CTCTGGAGATAAATTGGGGGATAAATATGCTT ACTGGTATCAGCAGAAGCCAGGCCAGTCCCCT GTGTTGGTCATCTATCAAGATAGGAAGCGCCC CTCAGGGATCCCTGAGCGATTCTCTGGCTCCA ACTCTGGGAACACAGCCACTCTGACCATCAGC GGGACCCAGGCTATGGATGAGGCTGACTATTA CTGTCAGGCGTGGGACAACAGCACTGTGGTGT TCGGCGGAGGGACCAAGCTGACCGTCCTA<br>SEQ ID NO: 24199 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATAAGTGGTAGTAGTAGT TACTTATACTACCCAGACTCAGTGAAGGGCCGAT TCACCATCTCCAGAGACAACGCCAAGAACTCTCT GTATCTGCAAATGAACAGCCTGAGAGCCGAGGA CACGGCTGTGTATTACTGTGCGAGAGATAGAGGC AGCAGCTGGGGCCAGGGAACCCTGGTCACCGTC TCCTCA<br>SEQ ID NO: 28205 |
| | | AA | SFELTQPPSVSVSPGQTASITCSGDKLGDKYAYW YQQKPGQSPVLVIYQDRKRPSGIPERFSGSNSGN TATLTISGTQAMDEADYYCQAWDNSTVVFGGG TKLTVL<br>SEQ ID NO: 24200 | EVQLVESGGGLVKPGGSLRLSCAASGFTFSSYTMN WVRQAPGKGLEWVSSISGSSSYLYYPDSVKGRFTIS RDNAKNSLYLQMNSLRAEDTAVYYCARDRGSSW GQGTLVTVSS<br>SEQ ID NO: 28206 |

FIGURE 50
(Continued)

| | | | |
|---|---|---|---|
| iPS:472732 | 21-225_2B10_LC1 | NA | GATGTTGTGATGACTCAGTCTCCACTCTCCCTG CCCGTCACCCTTGGACAGCCGGCCTCCATCTC CTGCAGGTCTAGTCAAAGCCTCTGTATACAGTG ATGGAAACACCTTCTTGAATTGGTTTCAGCAG AGGCCAGGCCAATCTCCAAGGCGCCTAATTTA TAAGGTTTCTAACTGGGACTGGGGTCCCAG ACAGATTCAGCGGCAGTGGGTCAGGCACTGGT TTCACACTGAAAATCAGCAGGGTGGAGGCTGA GGATGTTGGGGTTTATTACTGCATACAAGGTA CGCACTGGCCTTTCCCCTTCGGCCAAGGGACA CGACTGGAGATTAAA <br><br> SEQ ID NO: 24201 |
| | | AA | DVVMTQSPLSLPVTLGQPASISCRSSQSLVYSDG NTFLNWFQQRPGQSPRRLIYKVSNWDSGVPDRF SGSGSGTGFTLKISRVEAEDVGVYYCIQGTHWPF PFGQGTRLEIK <br><br> SEQ ID NO: 24202 |
| iPS:472733 | 21-225_2B10_LC2 | NA | CAGTCTGCCTGACTCAGCCTGCCTCCGTGTCT GGGTCTCCTGGACAGTCGATCACCATCTCCTG CACTGGAACCAGCAGTGACGTTGGTGGTTATA ATTTTGTCTCCTGGTACCAACAGCACCCAGAC AAAGCCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAGCTCATATACAAGCACCGG ACTGTGGTAATGCGGCGGAGGGGACCAAACTG ACCGTCCTA <br><br> SEQ ID NO: 24203 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCGGTTATATGTATGATGGAAGT AATAAATACTATGCAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATAT ACCAGTGGCTGTATGACTACGGTATGGACGTCT GGGGCCAAGGGACCACGGTCACCGTCTCCTCA <br><br> SEQ ID NO: 28207 |
| | | | QVQLVESGGGVVQPGRSLRLSCAASGFTFSSYVMH WVRQAPGKGLEWVAVIWYDGSNKYYADSVKVRF TVSRDNSKNTLSLQMNSLRAEDTAVYYCARERYTS GWYDYGMDVWGQGTTVTVSS <br><br> SEQ ID NO: 28208 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCGGTTATATGTATGATGGAAGT AATAAATACTATGCAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATATT GGTATGGACGTCT ACCAGTGGCTGTATGACTACGGTATGGACGTCT GGGGCCAAGGGACCACGGTCACCGTCTCCTCA <br><br> SEQ ID NO: 28209 |

FIGURE 50
(Continued)

| | | | |
|---|---|---|---|
| iPS:473253 | | AA | QSALTQPASVSGSPGQSITISCTGTSSDVGGYNFV SWYQQHPDKAPKLMIYEVSNRPSGVSNRFSGSK SGNTASLTISGLQAEDEADYYCSSYTSTGTVVIG GGTKLTVL<br>SEQ ID NO: 24204 | QVQLVESGGGVVQPGRSLRLSCAASGFTFSSYVMH WVRQAPGKGLEWVAVIWYDGSNKYYADSVKRF TVSRDNSKNTLSLQMNSLRAEDTAVYYCARERYTS GWYDYGMDVWGQGTTVTVSS<br>SEQ ID NO: 28210 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAATCCAGTCAAAGC CCCTAAGCGCCTGATCTATGCTGCATCCAGTTT GCAAAGTGGGGTCCCATCGAGGTTCAGCGGCA GTGGATCTGGGACAGAATTCACTCTCACAGTC AGCAGCCTGCAGCCTGAAGATTTTGCATTTTA TTACTGTCTACAGCATATAATAGTTACCTCCCAT CACCTTCGGCCAAGGGACACGACTGGAAATTA AA<br>SEQ ID NO: 24205 | CAGGTGCAGCTGGTACAGTCTGGGGCTGAGGTG AAGAAGCCTGGGGCCTCAGTGAAGGTCTCCTGC AAGGCTTCTGGATACACCTTCAACGACTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACGTCCATCAGCACA GCCTACATGGAGCTGAGCAGCCTGAGATCTGAC GACACGGCCGTGTATTCCTGTGCGAGAGATGTA CCAGCTCGTTTGACTACTGGGGCCAGGGAACCCT GGTCACCGTCTCCTCA<br>SEQ ID NO: 28211 |
| | 21-225_7C3_LC1 | AA | DIQMTQSPSSLSASVGDRVTITCRASQGIRSDLG WYQQNPVKAPKRLIYAASSLQSGVPSRFSGSGS GTEFTLTVSSLQPEDFAFYYCLQHNSYLPITFGQ GTRLEIK<br>SEQ ID NO: 24206 | QVQLVQSGAEVKKPGASVKVSCKASGYTFNDYYL HWVRQAPGQGLEWMGWIHPNSGGTNYAQKFQGR VTMTRDTSISTAYMELSSLRSDDTAVYSCARDGTSS FDYWGQGTLVTVSS<br>SEQ ID NO: 28212 |

FIGURE 50
(Continued)

| | | | |
|---|---|---|---|
| iPS:473254 | 21-225_7C3_LC2 | NA | GACATCCAGATGACCCAGTCTCCATCTTCCGT GTCTGCATCTGTAGGAGACAGAGTCACCATCA CTTGTCGGGCGAGTCAGGTATTAGCAGTCTGG TTAGCCTGGTATCAGCAGAAACAAGGAAAG CCCCTAAGCTCCTGATCTTTGCTGCATCCAGGT TGCAAAGTGGGGCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A | CAGGTGCAGCTGGTACAGTCTGGGGCTGAGGTG AAGAAGCCTGGGGCCTCAGTGAAGGTCTCCTGC AAGGCTTCTGGATACACCTTCAACGACTACTATT TGCACTGGGTGCGACAGGCCCCTGGACAAGGTCT TGAGTGGATGGGATGGATCCACAGAAGTTCAGGGCAGG GGCACAAACTATGCACAGGGACACGTCCATCAGC ACA GTCACCATGACCAGGACACGTCGAGATCTGAC GCCTACATGATGAGCTGAGCAGCCTGAGATCTGAC GACACGGCCGTGTATTCTGTGCGAGAGATGGTA CCAGTCGTTTGACTACTGGGGCCAGGGAACCCT GGTCACCGTCTCCTCA |
| | | | SEQ ID NO: 24207 | SEQ ID NO: 28213 |
| | | AA | DIQMTQSPSSVSASLGDRVTITCRASQGISSWLA WYQQKQGKAPKLLIFAASRLQSGAPSRFSGSGS GTDFTLTISSLQPEDFATYYCQQANSFPFTFGPGT KVDIK | QVQLVQSGAEVKKPGASVKVSCKASGYTFNDYYL HWVRQAPGQGLEWMGWIHPNSGGTNYAQKFQGR VTMTRDTSISTAYMELSSLRSDDTAVYSCARDGTSS FDYWGQGTLVTVSS |
| | | | SEQ ID NO: 24208 | SEQ ID NO: 28214 |
| iPS:473255 | 21-225_9F12_LC1 | NA | GACATCCAGATGACCCAGTCTCCATCTTCCGT GTCTGCATCTGTAGGAGACAGAGTCACCATCA CTTGTCGGGCGAGTCAGGGTATTAGCAGTGG TTAGCCTGGTATCAGCAGAAACCAGGGAAAG CCCCTAAGCTCCTGATCTATGCTGCATCCAGA TTGCAAAGTGGGGTCCCATCAAGGTTCAGCGG CAGTGGATCTGGGACAGATTTCACTCTCACCA TCAGCGGCCTGCTGCCTGAAGATTTTGCAATT TATTATTGTCAACAGGCTAACAGTTTCCCATTC ACTTTCGGCCCTGGGACCAAAGTGGATTTCAA A | CAGGTGCAGCTGGTACAGTCTGGGGCTGAGGTG AAGAAGCCTGGGGCCTCAGTGAAGGTCTCCTGC AAGGCTTCTGGATACACCTTCGCGCGACTACTATT TGCACTGGGTGCGACAGGCCCCTGGACAAGGTCT TGAGTGGATGGGATGGATCCACAGAAGTTGGT GGCACAAACTTTGCACAGAAGTTTCAGGGCAGG GTCACCATGACCAGGGACACGTCCATCAGCACA GCCTACCTGGAACTGAGCAGTCTGAGAGATGTGAC ACACGGCCTTCTATTACTGTGCGAGAGATGTAC CAGTCGTTTGACTACTGGGGCCAGGGAACCCTG GTCACCGTCTCCTCA |
| | | | SEQ ID NO: 24209 | SEQ ID NO: 28215 |

FIGURE 50
(Continued)

| | | | |
|---|---|---|---|
| | | AA | DIQMTQSPSSVSASVGDRVTITCRASQGISRWLA WYQQKPGKAPKLLIYAASRLQSGVPSRFSGSGS GTDFTLTISGLLPEDFAIYYCQQANSFPFTFGPGT KVDFK<br>SEQ ID NO: 24210 | QVQLVQSGAEVKKPGASVKVSCKASGYTFADYYL HWVRQAPGQGLEWMGWIHPNSGGTNFAQKFQGR VTMTRDTSISTAYLELSSLRSDDTAFYYCARDGTSS FDYWGQGTLVTVSS<br>SEQ ID NO: 28216 |
| iPS:473256 | 21-225_9F12_LC2 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGTCAAAGC CCCTAAGCGCCTTATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATAATAGTACTCCCCCAT CACCTTTCGGCCAAGGGACACGACTGGAGATTA AA<br>SEQ ID NO: 24211 | CAGGTGCAGCTGGTACAGTCTGGGGCTGAGGTG AAGAAGCCTGGGGCTCAGTGAAGGTCTCCTGC AAGGCTTCTGGATACACCTTCGCCGACTACTATT TGCACTGGGTGCGACAGGCCCCTGGACAAGGTCT TGAGTGGATGGGATGGATCCACCTAACAGTGGT GGCACAAACTTTGCACAGAAGTTTCAGGGCAGG GTCACCATGACCAGGGACACGTCCATCAGCACA GCCTACCTGGAACTGAGCAGTCTGAGATCTGACG ACACGGCCTTCTATTACTGTGCGAGAGATGGTAC CAGTCGTTTGACTACTGGGGCCAGGGAACCCTG GTCACCGTCTCCTCA<br>SEQ ID NO: 28217 |
| | | AA | DIQMTQSPSSLSASVGDRVTITCRASQGIRNDLG WYQQKPVKAPKRLIYAASSLQSGVPSRFSGSGS GTEFTLTISSLQPEDFATYYCLQHNSYLPITFGQG TRLEIK<br>SEQ ID NO: 24212 | QVQLVQSGAEVKKPGASVKVSCKASGYTFADYYL HWVRQAPGQGLEWMGWIHPNSGGTNFAQKFQGR VTMTRDTSISTAYLELSSLRSDDTAFYYCARDGTSS FDYWGQGTLVTVSS<br>SEQ ID NO: 28218 |

FIGURE 50
(Continued)

| | | | |
|---|---|---|---|
| iPS:472742 | 21-225_30D9_LC2 | NA | TCCTATGAGCTGACTCAGCCACCCTCAGTGTCCGTGTCCCCAGGACAGACAGCCAGCATCACCTGCTCTGGAGATAAATTGGGGGATAAATATGTTTACTGGTTTCAGCAGAAGCCAGGCCAGTCCCCTGTGCTAGTCATCTATCAAGATCGCAAGCGGCCCTCAGGGATCCCTGAGCGATTCTCTGGCTCCAACTCTGGGAACACAGCCACTCTGACCATCAGCGGGACGCAGGCTCTGGATGAGGCTGACTATTACTGTCAGGCGTGGGACAACAGCACTGCGGTATTCGGCGGAGGGACCAAGCTGACCGTCCTA SEQ ID NO: 24213 |
| | | AA | SYELTQPPSVSVSPGQTASITCSGDKLGDKYVYWFQQKPGQSPVLVIYQDRKRPSGIPERFSGSNSGNTATLTISGTQALDEADYYCQAWDNSTAVFGGGTKLTVL SEQ ID NO: 24214 | CAGGTGAAACTGGTGCAGTCTGGGGCTGAGGTGGAGAAGCCTGGGGCCTCAGTGAAGGTCTCCTGCAAGGCTTCAGGATACACCTTCACCGGCTACTATCTGCACTGGGTGCGACAGGCCCCTGGACAAGGGCTTGAGTGGATGGGATGGATCAACCCTAACAGTGGCACAAACTATGCACAGGACACGTCCATCAGCACGGTCACCATGACCAGGGACACGTCCATCAGCACGGTCACCATGACCAGGGACACGTCCATCAGCACAGCCTACATGGAGCTGAGCAGGCTGAGATCTGAGGACACGGCCGTGTATTACTGTGCGAGAGTGTATTACTATGGTTCGGGGAGTTATTATAACGAGTTGACAAACTGGGGCCAGGGAACCCTGGTCACCGTCTCCTCA SEQ ID NO: 28219 |
| | | | QVKLVQSGAEVEKPGASVKVSCKASGYTFTGYYLHWVRQAPGQGLEWMGWINPNSGGTNYAQKFQGRVTMTRDTSISTAYMELSRLRSDDTAVYYCARVYYYGSGSYYNEFDNWGQGTLVTVSS SEQ ID NO: 28220 |
| iPS:472741 | 21-225_30D9_LC1 | NA | GATGTCGTGATGACTCAGTCTCCACTCTCCCTGCCCGTCACCCTTGGACAGCCGGCCTCCATCTCCTGCAGGTCTAGTCAAAGCCTCGTATGGTTCAGCAGATGGAAACACCTTCTTGAATTGGTTTCAGCAGAGGCCAGGCCAATCTCCAAGGCGCCTAATTTAAGGTTTCTAACTGGGACTCTGGGGTCCCAGACAGATTCAGCGGCAGTGGGTCAGGCACTGATTTCACACTGAAAATCAGCAGGGTTGGAGGCTGAGGATGTTGGGGTTTATTACTGCTGCAAGGTACACACTGCGCTCTCACCTTCGGCCAAGGGACACGACTGGAGATTAAA SEQ ID NO: 24215 | CAGGTGAAACTGGTGCAGTCTGGGGCTGAGGTGGAGAAGCCTGGGGCCTCAGTGAAGGTCTCCTGCAAGGCTTCAGGATACACCTTCACCGGCTACTATCTGCACTGGGTGCGACAGGCCCCTGGACAAGGGCTTGAGTGGATGGGATGGATCAACCCTAACAGTGGCACAAACTATGCACAGAAGTTCAGGCAGGGTCACCATGACCAGGGACACGTCCATCAGCACAGCCTACATGGAGCTGAGCAGGCTGAGATCTGAGGACACGGCCGTGTATTACTGTGCGAGAGTTTGACAAACTGGGGCCAGGGAACCCTGGTCACCGTCTCCTCA SEQ ID NO: 28221 |

FIGURE 50
(Continued)

| | | | |
|---|---|---|---|
| iPS:472743 | 21-225_68G6 | AA | DVVMTQSPLSLPVTLGQPASISCRSSQSLVSSDG NTFLNWFQQRPGQSPRRLIYKVSNWDSGVPDRF SGSGSGTDFTLKISRLEAEDVGVYYCLQGTHWP LTFGQGTRLEIK<br>SEQ ID NO: 24216 | QVKLVQSGAEVEKPGASVKVSCKASGYTFTGYYL HWVRQAPGQGLEWMGWINPNSGGTNYAQKFQGR VTMTRDTSISTAYMELSRLRSDDTAVYYCARVYYY GSGSYYNEFDNWGQGTLVTVSS<br>SEQ ID NO: 28222 |
| | | NA | TCCTATGAGGTGACTCAGCCACCCTCAGTGTC CGTGTCCCCAGGACAGACAGCCAGCATCACCT GCTCTGGAGATAAATTGGGGGATAAATATACT TACTGGTATCAGCAGAAGGCAGGCCAGTCCCC TTTCCTCGTCATCTATCAAGATAGGAAGCGGC CCTCAGGGATCCCTGACCGATTCTCTGGCTCC AACTCTGGGAACACAGCCACTCTGACCATCAG CGGGACCCAGGCTATGGATGCGGCTGACTTTT ACTGTCAGGCGTGGGACAATAGTACTGCGGTA TTCGGCGGAGGGACCAAGCTGACCGTCCTA<br>SEQ ID NO: 24217 | CAGGTGCAGTTGGTGCAGTTTGGGGGTGAGGTGA AGAAGCCTGGGTCCTCAGTGAAGGTNTCCTGCAA GGCTTCAGGATACACCTTCACCGGTTACTATATG CACTGGGTGCGACAGGCCCCTGGACAAGGGCTT GAGTGGATGGGATCGATCTACCGTAACAGTGGTG GCACAAATTATGCACAGAAGTTTCAGGGCAGG TCAACCATGACCAGGGACAAGTCCATCAGCACCG CCTACATGGAGAGAGCAGGATCAGATCTGATG ACACGGCCGTGTATTACTGTGCGAGAGCCTTTA CTATGGTTCGGGGACTTATTATAACGAATTTGAC TACTGGGGCCAGGGAACCCTGGTCACCGTCTCCT CA<br>SEQ ID NO: 28223 |
| | | AA | SYEVTQPPSVSVSPGQTASITCSGDKLGDKYTY WYQQKAGQSPFLVIYQDRKRPSGIPDRFSGSNSG NTATLTISGTQAMDAADFYCQAWDNSTAVFGG GTKLTVL<br>SEQ ID NO: 24218 | QVQLVQFGGEVKKPGSSVKVSCKASGYTFTGYYM HWVRQAPGQGLEWMGSIYRNSGGTNYAQKFQGR VTMTRDKSISTAYMEKSRIRSDDTAVYYCARAFYY GSGTYYNEFDYWGQGTLVTVSS<br>SEQ ID NO: 28224 |

FIGURE 50
(Continued)

| | | | |
|---|---|---|---|
| iPS:392573 | 21-225_15G2 | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ACTATGTCTCCTGGTACCAACAGCACCCAGGC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCACCTCATATACAAGCACCAG CACTGTGGTCTTCGGCGGAGGGACCAAGCTGA CCGTCCTA<br><br>SEQ ID NO: 24219 | CAGATCACCTTGAAGGAGTCTGGTCCTACGCTGG TGAAACCCACACAGACCCTCACGCTGACCTGCAC CTTCTCTGGATTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGGCTACAGCCATCTCTGAAGAGCA GGCTCACCATCCACCAAGGACACCTCCAAAACC AGGTGGTCCTTACAATGACCAACATGGACCCTGT GGACACAGCCACATATTACTGTGCAGACACCGGT GTCAGCTGCTGCTATTTTCACTATTGGGGCCAGG GAACCCTGGTCACCGTCTCCTCA<br><br>SEQ ID NO: 28225 |
| | | AA | QSALTQPASVSGSPGQSITISCTGTSSDVGGYNY VSWYQQHPGKAPKLMIYEVSNRPSGVSNRFSGS KSGNTASLTISGLQAEDEADYYCTSYTSTSTVVF GGGTKLTVL<br><br>SEQ ID NO: 24220 | QITLKESGPTLVKPTQTLTLTCTFSGFSLSTSGVVG WIRQPPGKALEWLALIYWNDDKRYSPSLKSRLTIT KDTSKNQVVLTMTNMDPVDTATYYCADTGVSCC YFHYWGQGTLVTVSS<br><br>SEQ ID NO: 28226 |
| iPS:392583 | 21-225_10B10 | NA | TCCTATGAGCTGACTCAGCCACCCTCAGTGTC CGTGTCCCCAGGACAGACAGCCAGCATCACCT GCTCTGGAGATAAATTGGGAATAAATATGCT TGGTACCAGCAGAAGCCAGGCCAGTCCCCC TGTGCTGGTGGTTATCAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTT TTCGGCGGAGGGACCAAACTGACCGTCCTA<br><br>SEQ ID NO: 24221 | CAGATCACCTTGAAGGAGTCTGGTCCTACGCTGG TGAAACCCACACAGACCCTCACGCTGACCTGCAC CTTCTCTGGTTCTCACTCAGCACTGGTGGAGTG GGTGTGGGCTGGATCCGTCAGCCCCCAGGAAAG GCCCTGGAGTGGCTTGTATTCATTTATTGGAGTG ATGATAAGCGCTACAGCCCATCTCTGAAGAGCA GGCTCCATCACCAAGGACACCTCCAAAAACCA GGTGGTCCTTACAATGACCAACATGGACCCTGTG GACACAGCCACCATATTACTGTGCACGTATAGCAG CAGTTGCCTTTGACTACTGGGGCCAGGAACCCT GGTCACCGTCTCCTCA<br><br>SEQ ID NO: 28227 |

FIGURE 50
(Continued)

| | | | |
|---|---|---|---|
| | | AA | SYELTQPPSVSVSPGQTASITCSGDKLGNKYAW WYQQKPGQSPVLVIYQDRKRPSGIPERFSGSNSG NTATLTISGTQAMDEADYYCQAWDNSTVVFGG GTKLTVL<br>SEQ ID NO: 24222 | QITLKESGPTLVKPTQTLTLTCTFSGFSLSTGGVGVG WIRQPPGKALEWLVFIYWSDDKRYSPSLKSRLSITK DTSKNQVVLTMTNMDPVDTATYYCARIAAVAFDY WGQGTLVTVSS<br>SEQ ID NO: 28228 |
| iPS:392585 | 21-225_14H11 | NA | ACCTATGAGCTGACTCAGCCATCCTCAGTGTC CGTGTCCCCAGGACAGACCAGCATCACCT GCTCTGGAGATAAATTGGGGAAAATATGTT TGCTGGTATCAGCAGAAGCCAGGCCAGTCCCC TGTGCTGGTCATATCAAGATACCAAGCGGC CCTCAGGGATCCCTGAGCGATTCTCTGGCTCC AACTCTGGGAACACAGCCACTCTGACCATCAG CGGAACCCAGGCTATGGACAGCAGCACTATATT ACTGTCAGGGCTGGGACCAAGCTGACCGTCCTA GGCGGAGGGACCAAGCTGACCGTCCTA<br>SEQ ID NO: 24223 | CAGGTGCAGCTGGTGCAGTCTGGGGCTGAGGTG AAGAAGCCTGGGGCCTCAGTGAAGGTCTCCTGC AAGGGTTCTGGATACACCTTCACCGGCCACTATAT GTGCTGGGTGCGACAGGCCCCTGGACAAGGGCT TGAGTGGATGGGATGGATCAACCCTAATAGTGGT GGCACAAACTATGCACAGGACACGTCCATCAGCAGG GTCACCATGACCAGGGACACGTCCATCAGCACA GCCTACATGGAGCTGAGCAGGCTGAGATCTGAC GACACGGCCGTGTATTACTGTGCGCGTGGATATT GTAGTAGTTCCAGCTGCTATTTGCAACCGGGTTA TTACGGTATGGACGTCTGGGGCCAAGGGACCAC GGTCACCGTCTCCTCA<br>SEQ ID NO: 28229 |
| | | AA | TYELTQPSSVSVSPGQTASITCSGDKLGEKYVCW YQQKPGQSPVLVIYQDTKRPSGIPERFSGSNSGN TATLTISGTQAMDEADYYCQAWDSSTIFGGGTK LTVL<br>SEQ ID NO: 24224 | QVQLVQSGAEVKKPGASVKVSCQGSGYTFTGHYM CWVRQAPGQGLEWMGWINPNSGGTNYAQKFQGR VTMTRDTSISTAYMELSRLRSDDTAVYYCAAGYCS SSSCYLQPGYYGMDVWGQGTTVTVSS<br>SEQ ID NO: 28230 |

FIGURE 50
(Continued)

| | | | |
|---|---|---|---|
| iPS:392587 | 21-225_18G5 | NA | TCCTATGAGCTGACTCAGCCACCCTCAGTGTC CGTGTCCCCAGGACAGACAGCCAGCATCACCT GCTCTGGAGAGAAATTGGGGGATAAATATGTT TGTTGGTATCAGCAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGAACAGCAGCAATGTGGTA TTCGGCGGAGGGACCAAGCTGACCGTCCTA | CAGATCACCTTGAAGGAGTCTGGTCCTACGCTGG TGAAACCCACAGACCCTCACGCTGACCTGCAC CTTCTCTGGGTTCTCACTCAGCACTAGTGGAGTG GGTGTGGGCTGGATCCGTCAGCCCCCCAGGAAAG GCCCTGGAGTGCCTTTCACTCATTTATTGGAATG ATGATAAGGTCTACAGCCCATCTCTGAAGAGCAG GCTCACCATCACCAAGTACACCTCAAAAACCAG GTGGTCCTTACAATGACCAACATGGACCCTGTGG ACACAGCCACATATTACTGTGCACACAGGGAC AGCAGCTGCCCTGACTACTGGGGCCAGGGAA CCCTGGTCACCGTCTCCTCA |
| | | | SEQ ID NO: 24225 | SEQ ID NO: 28231 |
| | | AA | SYELTQPPSVSVSPGQTASITCSGEKLGDKYVCW YQQKPGQSPVLVIYQDSKRPSGIPERFSGSNSGN TATLTISGTQAMDEADYYCQAWNSSNVVFGGG TKLTVL | QITLKESGPTLVKPTQTILTCTFSGFSLSTSGVVG WIRQPPGKALECLSLIYWNDDKVYSPSLKSRLTITK YTSKNQVLTMTNMDPVDTATYYCAHRGQQLAL DYWGQGTLVTVSS |
| | | | SEQ ID NO: 24226 | SEQ ID NO: 28232 |
| iPS:392589 | 21-225_27H2 | NA | TCCTATGAGCTGACTCAGCCACCCTCAGTGTC CGTATCCCAGGACAGACAGCCAGCATCACCT GCTCTGGAGATAAATTGGGGGATAAATATGCT TCCTGGTATCAGCAGAAGCCAGGCCAGTCCCC TGTTTTGGTCATCTATCAAGATGGCAAGCGGC CCTCAGGGATCCCTGAGCGATTCTCTGGCTCC AACTCTGGGAACACAGCCACTCTGACCCTCAG CGGGACCCAGGCTGTGGACACAGCAGACTATGTG ACTGTCAGGCGTGGGACAGCAGCACTTATGTG GTATTCGGCGGAGGGACCAAGCTGACCGTCCT A | CAGGTGCAGTTGGTGGAGTCTGGGGGAGGCGTG GTCCAGCCTGGGAGGTCCCTGAGACTCTCCTGTG CAGCGTCTGGATTCACCTTCAGTGGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGAGATAGGGT ATATTGTAGTAGTACCAGCTGCTCCCCTTACTAC TACTACTACGGTATGGACGTCTGGGGCCAAGGG ACCACGGTCACCGTCTCCTCA |

FIGURE 50
(Continued)

| | | | | |
|---|---|---|---|---|
| iPS:392593 | 21-225_3E10 | AA | SEQ ID NO: 24227<br>SYELTQPPSVSVSPGQTASITCSGDKLGDKYASWYQQKPGQSPVLVIYQDGKRPSGIPERFSGSNSGNTATLTLSGTQAMDEADYYCQAWDSSTYVVFGGGTKLTVL<br>SEQ ID NO: 24228 | SEQ ID NO: 28233<br>QVQLVESGGGVVQPGRSLRLSCAASGFTFSGYGMHWVRQAPGKGLEWVAVIWYDGSNKYADSVKGRFTISRDNSKNTLFLQMNSLRAEDTAVYYCARDRVYCSSTSCSPYYYYGMDVWGQGTTVTVSS<br>SEQ ID NO: 28234 |
| | | NA | TCCTATGAGCTGACTCAGCCACACTCAGTGTCAGTGGCCACAGCACAGATGGCCAGGATCACCTGTGGGGGAAACAATTGGAAGTAAAGCTATGCACTGGTACCAGCAAAAGCCAGGACCAGGTGTCTGTGGTCATCTATAGCGATGGAACCGGCCCTCAGGGATCCCTGAGCGATTCTCTGGCTCCAACCCAGGGAACACCGCCACCCTAACCATCAGCAGGATCGAGGCTGGGGATGAGGCTGACTATTACTGTCAGGTGTGGGACAGTAGTAGTGATCATGTGGTATTCGGCGGAGGGACCAAGCTGACCGTCCTA<br>SEQ ID NO: 24229 | CAGATCACCTTGAAGGAGTCTGGTCCTACGCTGGTGAAACCCACACAGACCCTCACGCTGACCTGCACCTTCTCTGGGTTCTCACTCAATACTGGTGAGTGGGTGTGGGCTGGATCCGTCAGCCCCCAGGAAAGGCCCTGGAGTGGCTTGCACTCATTTATTGGAATGATGATAAGCGCCACAGCCATCTGAAGAGCAGGCTCACCATCACCAAAGACACCTCCAAAAACCAGTGGTCCTTACAATGACCCACATGGCCCTGTGACACAGCCACATATTACTGTGCACACCTTATAGAAGTGGCCTTTGACTATTGGGGCCAGGGAACCCTGGTCACCGTCTCCTCA<br>SEQ ID NO: 28235 |
| | | AA | SYELTQPHSVSVATAQMARITCGGNNIGSKAVHWYQQKPGQDPVLVIYSDSNRPSGIPERFSGSNPGNTATLTISRIEAGDEADYYCQVWDSSSDHVVFGGGTKLTVL<br>SEQ ID NO: 24230 | QITLKESGPTLVKPTQTLTLTCTFSGFSLNTGGVGVGWIRQPPGKALEWLALIYWNDDKRHSPSLKSRLTITKDTSKNQVVLTMTPHMAPVDTATYCAHLIEVAFDYWGQGTLVTVSS<br>SEQ ID NO: 28236 |

FIGURE 50
(Continued)

| | | | |
|---|---|---|---|
| iPS:392596 | 21-225_12D8 | NA | CTGCCTCTGTGCTGACTCAGCCCCCGTCTGCATCT GCCTTGCTGGGAGCCTCGATCAAGCTCACCTG CACCCTAAGCAGTGAGCAGCACTACCACCA TCGAATGGTATCAACAGAGACCAGGAGGTC CCCCAGTATATATAAGGTTAAGAGTGATG GCAGCCACAGCAAGGGGACGGGATCCCGA TGCTTCATGGGCTCCAGTTCTGGGCTGACC GCTACCTCACCTTCTCCAACCTCCAGTCTGACG ATGAGGATGAGTATCACTGTGGAGAGCCA ACGATTGATGGCCAAGTCGGTGTGTATTCG GCGGAGGGACCAAGCTGACCGTCCTA | GAGGTGCAGTTGTTGGAATCTGGGGGAGGCTTGG TACAGCCTGGGGGGTCCCTGAGACTCTCCTGTGC AGCCTCTGGATTCACCTTAGCAGTCATGTCATG AGCTGGGTCCGCCAGGCTCCAGGGAAGGGCTG GAGTGGGTCTCAACTATTAGTGTTGGTGGTGTA GCACATACTACGCAGACTCCGTGAAGGGCCGGTT CACCATCTCCAGAGACAATTCCAAGACCACGCTG TATCTGCAAATGAACAGCCTGAGAGCCGAGGAC ACGGCCGTATATTACTGTGCGAAATGGGGACGTG GATACAGCTATGAATACTACGGTATGGACGT CTGGGGCCAAGGGACCACGGTCACCGTCTCCTCA |
| | | | SEQ ID NO: 28237 |
| | | AA | LPVLTQPPSASALLGASIKLTCTLSSEHSTYTIEW YQQRPGQYIMKVKSDGSHSKGDGIPDRFMG SSSGADRYLTFSNLQSDDEDEYHCGESHTIDGQV GVVFGGGTKLTVL | EVQLLESGGGLVQPGGSLRLSCAASGFTFSSYVMS WVRQAPGKGLEWVSTISVGGGSTYYADSVKGRFTI SRDNSKTTLYLQMNSLRAEDTAVYYCAKWGRGYS YEYYYGMDVWGQGTTVTVSS |
| | | | SEQ ID NO: 28238 |
| iPS:392598 | 21-225_18E10 | NA | TCCTATGAACTGACGCAGCCACCCTCAGTGTC CGTGTCCCCAGGACAGACAGCCAGCATCACCT GCTCTGGAGATAGATTGGGGGATAAATATGCT TGGTGGTATCAGCAGAAGCCAGGCCAGTCCCC TGTGCTGGTCATATATCAAGATCGCAAGCGGC CCTCAGGGATCCCTGAGCGATTCTCTGGCTCC AATTCAGGGAACACAGCCACTCTGACCATCAG CGGGACCCAGGCTATGGATGAGGCTGACTATT ACTGTCAGGCGTGGGACACAGCAGCACAGTGGT ATTCGGCGGAGGGACCAAGCTGACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGGTGGATCAACCCTAACAGTGG TGGCACAAAACTATGCACAGAAGTTTCAGGGCAG GGTCACCATGACCAGGGACTCGTCCATCAACACA GCCTACATGGAGCTGAGCAGGCTGAGATCGAC GACACGGCCGTGTATTACTGTGCGAGGTCGTACT ACTATGGTTCGGGAGTTATTATAACGAGTTTGA CTACTGGGGCCAGGGAACCCTGGTCACCGTCTCC TCA |
| | | | SEQ ID NO: 28239 |
| | | | SEQ ID NO: 24233 |

FIGURE 50
(Continued)

| | | AA | SYELTQPPSVSVSPGQTASITCSGDRLGDKYAW WYQQKPGQSPVLVIYQDRKRPSGIPERFSGSNSG NTATLTISGTQAMDEADYYCQAWDSSTVVFGG GTKLTVL<br><br>SEQ ID NO: 24234 | QVQLVQSGAEVKKPGASVKVSCKASGYTFTGYYM HWVRQAPGQGLEWMGWINPNSGGTNYAQKFQGR VTMTRDSSINTAYMELSRLRSDDTAVYYCARSYYY GSGSYYNEFDYWGQGTLVTVSS<br><br>SEQ ID NO: 28240 |
|---|---|---|---|---|
| iPS:392618 | 21-225_16F10 | NA | GATATTGTGATGACCCAGACTCCACTCTCTCT GTCCGTCATTCCTGGACAGCCGGCCTCCATCT CCTGCAAGTCTAGTCAGAGCCTTCTGCATAGT GATGGAAAGACCCATTTGAATTGGTACCTGCA GAAGCCAGGCCAGCTCCACAGTCCCTGATCT ATGAAGTTCCTACCGGGTTCTCTGGAGTGCCA GATAGGTTCAGTGGCAGCGGGTCAGGACAG TTTTCACACTGGAGATCAGCGCGGTGGAGGCT GCGGATGTTGGGGTTTATTACTGCTTTCAAAG TATACAGCTTCCGCTCACTTTCGGCGGAGGGA CCAAGGTGGAGATCAAA<br><br>SEQ ID NO: 24235 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTCATATGTATGATGGAAA TAATAAATACTATGTAGACTCCGTGAAGGGCCGA TTCACCATCTCCAGAGACAATTCCAAGAATACGC TGTATCTGCAAATGAACAGCCTGAGAGCCGAGG ACACGGCTGTGTATTACTGTGCGAGAGAGCTTGC CTGGTACGAGGACTACTGGGGCCAGGGAACCCT GGTCACCGTCTCCTCA<br><br>SEQ ID NO: 28241 |
| | | AA | DIVMTQTPLSLSVIPGQPASISCKSSQSLLHSDGK THLNWYLQKPGQPPQLLIYEVSYRFSGVPDRFSG SGSGTVFTLEISRVEAADVGVYYCFQSIQLPLTF GGGTKVEIK<br><br>SEQ ID NO: 24236 | QVQLVESGGGVVQPGRSLRLSCAASGFTFSDYGM HWVRQAPGKGLEWVAVIWYDGNNKYYVDSVKG RFTISRDNSKNTLYLQMNSLRAEDTAVYYCARELA WYEDYWGQGTLVTVSS<br><br>SEQ ID NO: 28242 |

FIGURE 50
(Continued)

| | | | |
|---|---|---|---|
| iPS:392620 | 21-225_17H5 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCAATGCTGTGCATCCAGTT ACAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATCATAGTTACCATTCA CTTTCGGCCCTGGGACCAAGGTGATATCCAAA AA<br/>SEQ ID NO: 24237 | GAGGTGCAGCTGGTGGAGTCTGGGGGAGGCTG GTCAAGCCTGGGGGGTCCCTGAGACTCTCCTG CAGCCTCTGGATTCACCTTCAGTAGTATAGCAT GAACTGGGTCCGCCAGGCTCCAGGGAAGGGGCT GGAGTGGGTCTCATCCATTAGTAGTAGTACT TACATATACTACGCAGATCAGTGAAGGCCGAT TCACCATCTCCAGAGACAACGCCAAGAACTCACT GTATCTGCAAATGAACAGCCTGAGAGCCGAGA CACGGCTGTGTATTACTGTGCGAGAGTGGCTTCA TTTGACTACTGGGGCCAGGGAACCCTGGTCACCG TCTCCTCA<br/>SEQ ID NO: 28243 |
| | | AA | DIQMTQSPSSLSASVGDRVTITCRASQGISNYLA WFQQKPGKAPKSLINAASSLQSGVPSKFSGSGSG TDFTLTISSLQPEDFATYYCQQYHSYPFTFGPGT KVDIK<br/>SEQ ID NO: 24238 | EVQLVESGGGLVKPGGSLRLSCAASGFTFSSYSMN WVRQAPGKGLEWVSSISSSSTYYADSVKGRFTIS RDNAKNSLYLQMNSLRAEDTAVYYCARVASFDY WGQGTLVTVSS<br/>SEQ ID NO: 28244 |
| iPS:392622 | 21-225_17H8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTACAACT TATTACTGTCTACAGCATAATAGTTACCCACTC ACTTTCGGCGGAGGGACCAAGGTGGAGATCA AA<br/>SEQ ID NO: 24239 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGAAGTAGTTA CTACTGGGGCTGGATCCGCCAGCCCCAGGGAG GGGCTGGAGTGGATTGGGAATATCTATTATGGT GGGAACACTACTACAACCCGTCCCTCAAGAGTC GAGTCACCATATCCGTAGACACGTCAAGAACC AGTTCTCCCTGAAGCTGAGCTCTGTGACCGCGC AGACACGGCTGTGTATTACTGTGCGAGACATGA AAAGACTGGGGCCTTGACTACTGGGGCCAGGGA ACCCTGGTCACCGTCTCCTCA<br/>SEQ ID NO: 28245 |

FIGURE 50
(Continued)

| | | | | |
|---|---|---|---|---|
| iPS:392624 | 21-225_17H12 | AA | DIQMTQSPSSLSASVGDRVTITCRASQGIRNDLG WYQQKPGKAPKRLIYGASSLQSGVPSRFSGSGS GTEFTLTISSLQPEDFTTYYCLQHNSYPLTFGGGT KVEIK<br>SEQ ID NO: 24240 | QLQLQESGPGLVKPSETLSLTCTVSGGSISRSSYYW GWIRQPPGRGLEWIGNIYYGGNTYNPSLKSRVTIS VDTSKNQFSLKLSSVTAADTAVYYCARHGKDWGL DYWGQGTLVTVSS<br>SEQ ID NO: 28246 |
| | | NA | GACATCCAGATGACCCAGTCTCCATCCTCCCT GTCTGCATCTGTAGGAGACAGAGTCACCATCA CTTGCCGGGCAAGTCAGGACAGATTAGAAATGAT TTAGGCTGGTATCAGCAGAAAGCAGGGAAAG CCCCTAAGCGCCTGATCAATGCTGCATCCAGT TTGCAAAGTGGGGTCCCATCCAAGGTTCAGCGG CAGTGGCTCTGGGACAGAATTCACTCTCACAA TCACCGGCCTGCAGCCTGAAGATTTTGCAACT TATTACTGTCTACAGCATTATAGTTATATGTTC ACTTTCGGCGGAGGGACCAAGGTGGAGATCA AA<br>SEQ ID NO: 24241 | GAGGTGCAACTGGTGGAGTCTGGGGGAGGCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATTAGTGGTAGTAGT TACATATACTACGCAGACTCAGTGAAGGGCCGAT TCACCATCTCCAGAGACAACGCCAAGAACTCACT GTATTTGCAAATGAACAGCCTGAGAGCCGAGGA CACGGCTGTATATTACTGTGCAGAGATCGAGGC TCCATCTGGGGCCAAGGGACAATGGTCACCGTCT CTTCA<br>SEQ ID NO: 28247 |
| | | AA | DIQMTQSPSSLSASVGDRVTITCRASQDIRNDLG WYQQKPGKAGKAPKRLINAASSLQSGVPSRFSGIGS GTEFTLTITGLQPEDFATYYCLQHYSYMFTFGGG TKVEIK<br>SEQ ID NO: 24242 | EVQLVESGGGLVKPGGSLRLSCAASGFTFSSYTMN WVRQAPGKGLEWVSSISGSSSYIYYADSVKGRFTIS RDNAKNSLYLQMNSLRAEDTAVYYCARDRGSIWG QGTMVTVSS<br>SEQ ID NO: 28248 |

FIGURE 50
(Continued)

| | | | |
|---|---|---|---|
| iPS:392626 | 21-225_18A5 | NA | GACATCCAGATGACCCAGTCTCCATCCTCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 24243 | CAGGTGCAGTTGGTGGAGTCTGGGGGAGGCGTG GTCCAGCCTGGGAGGTCCCTGAGACTCTCCTATA CAGCGTCTGGATTCACCTTCAGTGACTATGGCAT GCACGTGGGTCCGCCAGGCTCCAGGCAAGGGCT GGAGTGGGTGGCAGTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCTTGG CTGGACGGAAGAGTACTGGGGCCAGGGAACCCT GGTCACCGTCTCCTCA<br><br>SEQ ID NO: 28249 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br><br>SEQ ID NO: 24244 | QVQLVESGGGVVQPGRSLRLSYTASGFTFSDYGMH WVRQAPGKGLEWVAVIWFDGSNKYYADSVKGRF TISRDNSKNTLYLQMNSLRAEDTAVYYCARDLGW TEEYWGQGTLVTVSS<br><br>SEQ ID NO: 28250 |
| iPS:392628 | 21-225_20C2 | NA | GACATCCAGATGACCCAGTCTCCATCCTCCT GTCTGCATCTGTACAAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTTTGCTGCATCCAGT TGCAAAGTGGGGTCCCGTCAAGGTTCAGCGGC AGTGGATCTGGGACAGAATTCACTCTCACAAT CAGCAGCCTGCAGCCTGAAGATTTTGCAACTT ATTACTGTCTTCAACATGCTAGTTACCCGCTCA CTTTCGGCGGAGGGACCAAGGTGGAGATCGA A<br><br>SEQ ID NO: 24245 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAATATCTATTATAGT GGGACTGCCTACTGTAATTCGTCCCTCAAGAGTC AGTTCTCCCTGAAGCTGAGCTCTGTGACCGCCACA GTTCTCCCTGAAGCTGAGCTGTATTACTGTGCGAGAACCA GACACGGCTGTGTATTACTGTGCGAGACATAGTA GCAGCTGGTCCCTTGACAACTGGGGCCAGGGAA CCCTGGTCACCGTCTCCTCA<br><br>SEQ ID NO: 28251 |

FIGURE 50
(Continued)

| | | | | |
|---|---|---|---|---|
| iPS:392630 | 21-225_20E5 | AA | DIQMTQSPSSLSASVGDRVTITCRASQGIRNDLGWYQQKPGKAPKRLIFAASSLQSGVPSRFSGSGSGTEFTLTISSLQPEDFATYYCLQHASYPLTFGGGTKVEIE<br><br>SEQ ID NO: 24246 | QLQLQESGPGLVKPSETLSLTCTVSGGSISRSSYYWGWIRQPPGKGLEWIGNIYYSGTAYCNSSLKSRVIISVDTSKNQFSLKLSSVTATDTAVYYCARHSSSWSLDNWGQGTLVTVSS<br><br>SEQ ID NO: 28252 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATATAGTTACCCGCTCACTTTCGGCGGAGGGACCAAGGTGGAGATCAAAA<br><br>SEQ ID NO: 24247 | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGGCATGCACTGGGTCCGCCAGGCTCCAGGCAAGGGGCTGGAGTGGGTGGCAGTTATTTGGTATGAAGAAAATAATCAATACTATGCAGACTCCGTGAAGGGCCGATTCACCATCTCAGAGACAATTCAAGAACACGCTGTATCTGCAAATGAACAGCCTGAGAGCCGAGGACACGGCTGTGTATTACTGTGCGAGAGAACTGGGGTTCCGGTCTGACTACTGGGGCCAGGGAACCCTGGTCACCGTCTCCTCA<br><br>SEQ ID NO: 28253 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK<br><br>SEQ ID NO: 24248 | QVQLVESGGGVVQPGRSLRLSCAASGFTFSDYGMHWVRQAPGKGLEWVAVIWYEENNQYYADSVKGRFTISRDNSKNTLYLQMNSLRAEDTAVYYCARELGFRSDYWGQGTLVTVSS<br><br>SEQ ID NO: 28254 |

FIGURE 50
(Continued)

| | | | |
|---|---|---|---|
| iPS:392632 | 21-225_16A11 | NA | GACATCCAGATGACCCAGTCTCCATCCTCCCT GTCTGCATCTGTGGGAGACAGAGTCACCATCA CTTGCCGGGCAAGTCAGAGACATTAGAAATCAT TTAGGCTGGTATCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGATTCACTCTCACAATC AGCAGCCTGCAGCCTGAAGACTTTGCAACTTA TTACTGTCTACAGTATAATAGTTATCCATTCAC TTTCGGCCCTGGGACCAAAGTGGACATCAAA<br>SEQ ID NO: 24249 | GAGGTGCAGCTGGTGGAGTCTGGGGGAGGCGTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT CTCATATACTACGCAGACTCAGTGAAGGGCCGAT TCACCATCTCCAGAGACAACGCCAAGAACTCACT GTATCTGCAAATGAACAGCCTGAGAGCCGAGA CACGGCTGTGTATTACTGTGCGAGAGTAGCAGCC TTTGACTACTGGGGCCAGGGAACCCTGGTCACCG TCTCCTCA<br>SEQ ID NO: 28255 |
| | | AA | DIQMTQSPSSLSASVGDSVTISCRASQDIRNHLG WYQRNPGKAPKRLIYAASSLQSGVPSRFSGSGS GTEFTLTISSLQPEDFATYYCLQYNSYPFTFGPGT KVDIK<br>SEQ ID NO: 24250 | EVQLVESGGGLVKPGGSLRLSCAASGFTFSSYSMN WVRQAPGKGLEWVSSISGSSSLIYYADSVKGRFTIS RDNAKNSLYLQMNSLRAEDTAVYYCARVAAFDY WGQGTLVTVSS<br>SEQ ID NO: 28256 |
| iPS:392634 | 21-225_17H3 | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCAATATAGTTACCCTCG GACGTTCGGCCAAGGGACCAAGGTGGAAATC AAA<br>SEQ ID NO: 24251 | CAGGTGCAGCTGGTGGAGTCTGGGGGAGGCGTG GTCCAGCCTGGGAGGTCCCTGAGACTCTCCTGTG CAGCGTCTGGATTCACCTCAGTAACTGTGTCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACACAATTCCAAGAACACGC TGTATCTGCAAATGAACAGCCTGAGAGCCGAGG ACACGGCTGTGTATTACTGTGCGAGAGAAAAGTA TAGCAGCAGCTGTAGCAGCTACCGTATGGACGTC TGGGGCCAAGGGACCACGGTCACCGTCTCCTCA<br>SEQ ID NO: 28257 |

FIGURE 50
(Continued)

| | | | | |
|---|---|---|---|---|
| iPS:392636 | 21-225_17A6 | AA | DIQMTQSPSSLSASVGDRVTFTCRASQGIRSDLGWYQQKPGKAPKRLIYAASSLQSGVPSRFSGSGSGTEFTLTISSLQPEDFATYYCLQQYSYPRTFGQGTKVEIK<br>SEQ ID NO: 24252 | QVQLVESGGGVVQPGRSLRLSCAASGFTFSNCVMHWVRQAPGKGLEWVAVIWYDGSNKYYADSVKGRFTISRDNSKNTLYLQMNSLRAEDTAVYYCAREKYSSSWYDYGMDVWGQGTTVTVSS<br>SEQ ID NO: 28258 |
| | | NA | GACATCCAGATGACCCAGTCTCCATCCTCCCTGTCTGCATCTGTGGAGACAGAGTCACCATCACTTGCCGGGCAAGTCAGAGCATTAGCAACTATTTAAATTGGTATCAGAAACCAGGGAAAGCCCCTAAGCTCCTGATCTATGCTGCTTCCAGTTTGCAAAGTGGGGTCCCATCAAGGTTCAGTGGCAGTGGATCTGGGACAGATTTCACTCTCACCATCAGCAGTCTGCAACAGAGTCACACTTGCCCCGCTCACTTTCGGCGGAGGGACCAAGGTGGAGATCAAA<br>SEQ ID NO: 24253 | CAGGTACAGCTGCAGCAGTCAGGTCCAGGACTGGTGAAGCCCTCGCAGACCCTCTCACTCACCTGTGCCATCTCCGGGGACAGTGTCTCTGCAACACTGCTGCTTGGAGCTGGATCAGGCAGTCCCATCGAGAGGCCTTGAGTGGCTGGAAGGACATACTACAGGTCCAAGTGGTATAATGATTATGCAGTATCTGTGAAAAGTGAGTAACCATCAACCAGACACATCCAGAACCAGTTCTCCCTGCAGCTGAACTCTGTGACTCCCGAGGACACGGCTGTGTATTACTGTGCAAGAGTAAGCAGTGGCTGGTCCCATCACTACTACTACTACGGTATGACGTCTGGGGCCAAGGGACCACGGTCACCGTCTCCTCA<br>SEQ ID NO: 28259 |
| | | AA | DIQMTQSPSSLSASVGDRVTITCRASQTISNYLNWYHQKPGKAPKLLIYAASSLQSGVPSRFSGSGSGTDFTLTISSLQPEDFATYYCQQSHTSPLTFGGGTKVEIK<br>SEQ ID NO: 24254 | QVQLQQSGPGLVKPSQTLSLTCAISGDSVSRNTAAWSWIRQSPSRGLEWLGRTYYRSKWYNDYAVSVKSRVTINPDTSKNQFSLQLNSVTPEDTAVYYCARVSSGWSHHYYYGMDVWGQGTTVTVSS<br>SEQ ID NO: 28260 |

FIGURE 50
(Continued)

| | | | |
|---|---|---|---|
| iPS:392638 | 21-225_17F9 | NA | GACATCCAGATGACCCAGTCTCCATCCTCCT<br>GTCTGCATCTGTAGGAGACAGAGTCACCATCA<br>CTTGCCGGGCAAGTCAGTCATTAGAAATGAT<br>TTAGGCTGGTATCAGCAGAAACCAGGGAAAG<br>CCCCTAAGCGCCTGATCTATGCTGTATCCAGTT<br>TGCAAAGTGGGGTCCATCAAGGTTCAGCGGC<br>AGTGGATCTGGGACAGAATTCACTCTCACAAT<br>CAACAGCCTGCAGCCTGAAGATTTTGCAACTT<br>ATTACTGTCTACAACATAATACTTATCCGCTCA<br>CTTTCGGCGGCGGGACCAAGGTGGAGTTCAAA<br><br>SEQ ID NO: 24255 | CAGCTGCAGCTGCAGGAGTCGGGCCCAGGACTG<br>GTGAAGCCTTCGGAGACCCTGTCCCTCACTGCA<br>CTGTCTCTGGCGGCTCCATCAGCAGAAGTAGTTA<br>CTATTGGGGCTGGATCCGCCAGCCCCCAGGGAA<br>GGGCCTGGAGTGGATTGGAATATCTATTATAGT<br>GGGAGCACCTACTACAATCCGTCCCTCAAGAGTC<br>GAGTCACCATATCGTAGACTGTCAAGAACCA<br>GTTCTCCCTGAACCTGAACTCTGTGACCGCCGCA<br>GACACGGCTGTGTATTCCTGTGCGAGACATGGAA<br>AAGACTGGGGCCTGACTACTGGGGCCAGGGAA<br>CCCTGGTCACCGTCTCCTCA<br><br>SEQ ID NO: 28261 |
| | | AA | DIQMTQSPSSLSASVGDRVTITCRASQVIRNDLG<br>WYQQKPGKAPKRLIYAVSSLQSGVPSRFSGSGS<br>GTEFTLTINSLQPEDFATYYCLQHNTYPLTFGGG<br>TKVEFK<br><br>SEQ ID NO: 24256 | QLQLQESGPGLVKPSETLSLTCTVSGGSISRSSYYW<br>GWIRQPPGKGLEWIGNIYYSGSTYYNPSLKSRVTIS<br>VDSSKNQFSLNLNSVTAADTAVYSCARHGKDWGL<br>DYWGQGTLVTVSS<br><br>SEQ ID NO: 28262 |
| iPS:392640 | 21-225_18A1 | NA | GACATCCAGATGACCCAGTCTCCATCCTCCT<br>GTCTGCATCTGTAGGAGACAGAGTCACCATCA<br>CTTGCCGGGCAAGTCAGGGCATTAGAAATGAT<br>TTAGGCTGGTATCAGCAGAAACCAGGGAAAG<br>CCCCTAAGCGCCTGATCTATGCTGCATCCAGT<br>TTACAAAGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAGCATAATAGTTACCCGCTC<br>ACTTTCGGCGGAGGGACCAAGGTGGAGATCA<br>AA<br><br>SEQ ID NO: 24257 | CAGGTGCAGCTGGTGGAGTCTGGGGGAGGCGTG<br>GTCCAGCCTGGGAGGTCCCTGAGACTCTCCTGTG<br>CAGTGTCTGGATTCACCTTCAGTAGCTATGGCAT<br>GCATTGGGTCCGCCAGGCTCCAGGCAAGGGCT<br>GGAGTGGGTGGCAGTTATATGTAGACTCCGTGAAGGGCGA<br>TAATAAATATTATGCAGACTCCGTGAAGGGCCGA<br>TTCACCATCTCCAGAGACAATTCCAAGAGCACGC<br>TGTATCTGCAAATGAACAGCCTGAGAGCCGAGG<br>ACACGGCTGTATTACTGTGTGAGAGAGCTAGG<br>CTTCCAGTCTGACTACTGGGGCCAGGGAACCCCG<br>GTCACCGTCTCCTCA<br><br>SEQ ID NO: 28263 |

FIGURE 50
(Continued)

| | | | |
|---|---|---|---|
| iPS:392642 | 21-225_18C6 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24258 | QVQLVESGGGVVQPGRSLRLSCAVSGFTFSSYGMH WVRQAPGKGLEWVAVIWYEENNKYVDSVKGRF TISRDNSKSTLYLQMNSLRAEDTAVYYCVRELGFQ SDYWGQGTPVTVSS<br>SEQ ID NO: 28264 |
| | | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCGGGAAAG CCCCTAAGCGCCTGATCTATGCTGCATCCAGT TTGCAAAGTGGGGTCCCGTCAAGGTTCAGCGG CAGTGGATCTGGGACAGAATTCACTCTCACAA TCAGCAGCCTGCAGCCTGAAGATTTTGCAACT TATTACTGTCTACAGCATAGTAGTTCTTACCCGCTC ACTTTCGGCGGAGGGACCAAGGTGGAGATCA AA<br>SEQ ID NO: 24259 | CAGCTGCAGCTGCAGGAGTCGGGCCCAGGACTG GTGAAGCCTTCGGAGACCCTGTCCTCACCTGCA CTGTCTCTGGTGGCTCCATCAGTAGGAGTAGTTA TTACTGGGCTGGATCCGCCAGCCCCCAGGGAA GGGGCTGGAGTGGATTGGAATATCATTATAGT GGGTACACCTACTACAACCCGTCCTCAAGAGTC AGTCATCATCCGTAGACACGTCCAAGAACCA GTTCTCCCTGAAGCTGAGCTCTGTGACCGCCGCA GACACGGCTCTGTATTACTGTGCGAGACATAGTA GCAGTTGGTCCCTGACTGGGGCCAGGGAA CCCTGGTCACCGTCTCCTCT<br>SEQ ID NO: 28265 |
| | | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHSSYPLTFGGGT KVEIK<br>SEQ ID NO: 24260 | QLQLQESGPGLVKPSETLSLTCTVSGGSISRSSYYW GWIRQPPGKGLEWIGNIYSGYTYNPSLKSRVIIS VDTSKNQFSLKLSSVTAADTALYYCARHSSSWSLD DWGQGTLVTVSS<br>SEQ ID NO: 28266 |

FIGURE 50
(Continued)

| | | | |
|---|---|---|---|
| iPS:392644 | 21-225_19E1 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAATTTACAAAGTGGGGTCCCATCAAGGTTCAGCGGCAGTGGATCTGGGACAGATTCACTCTCACAATCAGCAGCCTGCAGCCTGAAGATTTTGCAACTTATTACTGTCTACAGCATAATAGTTTCCCGCTCACTTTCGGCGGAGGGACCAAGGTGGAGATCAAA SEQ ID NO: 24261 | CAGGTGCAGCTGGTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCCGGCAAGGGGCTGGAGTGGGTGGCAGTTATTTGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACTGGGGTTCCGGTCTGACTACTGGGGCCAGGGAACCCTGGTCACCGTCTCCTCA SEQ ID NO: 28267 |
| | | AA | DIQMTQSPSSLSASVGDRVTITCRASQGIRNDLGWYQQKPGKAPKRLIYAASNLQSGVPSRFSGSGSGTEFTLTISSLQPEDFATYYCLQHNSFPLTFGGGTKVEIK SEQ ID NO: 24262 | QVQLVESGGGVVQPGRSLRLSCAASGFTFSNYGMHWVRQAPGKGLEWVAVIWYEENNQYYADSVKGRFTISRDNSKNTLYLQMNSLRAEDTAVYYCARELGFRSDYWGQGTLVTVSS SEQ ID NO: 28268 |
| iPS:392646 | 21-225_20G2 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTCCAAAGTGGGGTCCCATCAAGGTTCAGCGGCAGTGGATCTGGGACAGCCTGCAGCCTGAAGATTTTGCAAGTTATTACTGTCTACAGCATAATAGTTACCCGCTCACTTTCGGCGGAGGGACCAAGGTGGAGATCAAA SEQ ID NO: 24263 | CAGGTGCAGCTGGTGGTGGAGTCTGGGGGAGGCGTGGTCCAGCCTGGGAGGTCCCTGAGACTCTCCTGTCAGCGTCTGGATTCACCCTCAGTAGCGATGACATGCACTGGGTCCGCCAGGAACCAGGCAAGGGGCTGGAGTGGGTGGCAGTTATATGGTTTGATGGAAGTAATAAATACTATGCAGACTCCGTGAAGGGCCGATTCCATCAGTCCAGAGACACAATTCCAAGAACACCCTGTATCTGCAAATGAACAGCCTGAGAGCCGGGGACACGGCTGTGTATTACTGTGCGAGAGATCTGATAGCAGCAGTGGTACGGTTGACTACTGGGGCCAGGGAACCCTGGTCACCGTCTCCTCA SEQ ID NO: 28269 |

FIGURE 50
(Continued)

| | | | |
|---|---|---|---|
| iPS:392648 | 21-225_16D11 | AA | DIQMTQSPSSLSASVGDRVTITCRASQGIRNDLGWYQQKPGKAPKRLIYAASSFQSGVPSRFSGSGSGTEFTLTISSLQPEDFASYYCLQHNSYPLTFGGGTKVEIK<br>SEQ ID NO: 24264 | QVQLVESGGGVVQPGRSLRLSCAASGFTLSSDDMHWVRQEPGKGLEWVAVIWFDGSNKYYADSVKGRFIMSRDNSKNTLYLQMNSLRAGDTAVYYCARDLIAAAGTVDYWGQGTLVTVSS<br>SEQ ID NO: 28270 |
| | | NA | GACATCCAGATGACCCAGTCTCCATCCTCCCTGTCTGCATCTGTGGAGACAGAGTCACCATCACTTGCCGGGCAAGTCAGAGCATTAGCAACTATTTAAATTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGATTTCACTCTCACCATCAGCAGTCTGCAACTGAAGATTTTGCAACTTACTACTGTCTACAACAGAGTCACAGTTCCCCGCTCACTTTCGGCGGAGGGACCAAGGTGGAGATCAAA<br>SEQ ID NO: 24265 | CAGGTACAGCTGCAGCAGTCAGGTCCAGGACTGGTGAAGCCCTCGCAGACCCTCTCACTCACCTGTGCCATCTCCGGGGACAGTGTCTCTGCAACACTGCTGCTTGGAGCTGGATCAGGAGCAGTCCCATCGAGAGGCCTTGAGTGGCTGGAAGGACATACTACAGGTCCAAGTGGTATAATGATTATGCAGTATCTGTGAAAAGTCGAATAACCATCAACCAGACACATCCAAGAACCAGTTCTCCCTGCAGCTGAACCTCTGTGACTCCCGAGGACACGGCTGTGTATTACTGTGCAAGAGTAAACAGTGGCTGGTCCCATCACTACTACTACTACGGTATGGACGTCTGGGGCCAAGGGACCACGGTCACCGTCTCCTCA<br>SEQ ID NO: 28271 |
| | | AA | DIQMTQSPSSLSASVGDRVTITCRASQTISNYLNWYHQKPGKAPKLLIYAASSLQSGVPSRFSGSGSGTDFTLTISSLQPEDFATYYCQQSHSSPLTFGGGTKVEIK<br>SEQ ID NO: 24266 | QVQLQQSGPGLVKPSQTLSLTCAISGDSVSRNTAAWSWIRQSPSRGLEWLGRTYYRSKWYNDYAVSVKSRITINPDTSKNQFSLQLNSVTPEDTAVYYCARVNSGWSHHYYYGMDVWGQGTTVTVSS<br>SEQ ID NO: 28272 |

FIGURE 50
(Continued)

| | | | | |
|---|---|---|---|---|
| iPS:392650 | 21-225_17A4 | NA | GACATCCAGATGACCCAGTCTCCATCTTCCGT GTCTGCATCTGTAGGAGACAGAGTCACCATCA CTTGTGTCGGGCGAGTCAGGGTATTGGCAACTGG TTAGCCTGGTATCAGCAGAAACCAGGGAAAG CCCCTAAACTCCTGATCTTTGCTGCATCCAGTT TGCAAAGTGGGGGTCCCATCACGGTTCAGCGGC AGTGGATCTGGGACAGATTTCACTCTCACCAT CAGCAGCCTGCAGCCTGAAGATTTTGTAACTT ACTATTGTCAACAGGCTAACAGTTTCCCTCGG ACGTTCGGCCAAGGGACCAAGGTGAAATCA AA | CAGGTGCAGCTGGTGGAGTCTGGGGGAGGCTTG GTCAAGCCTGGAGGGTCCCTGAGACTCTCCTGTG CAGCCCTCTGATTCACCTTCAGTGACTACTACAT GAGCTGGATCCGCCAGGCTCCAGGGAAGGGCT GGAGTGGGTTTCACACATTAGTAGTAGTGGTAGT ACCATATATTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGCGATCTCTGGGGCCGAGAAT AACCGGGGATACTTCGATCTCTGGGGCCGTGGCA CCCTGGTCACTGTCTCTTCA |
| | | | SEQ ID NO: 24267 | SEQ ID NO: 28273 |
| | | AA | DIQMTQSPSSVSASVGDRVTITCRASQGIGNWLA WYQQKPGKAPKLLIFAASSLQSGVPSRFSGSGSG TDFTLTISSLQPEDFVTYYCQQANSFPRTFGQGT KVEIK | QVQLVESGGGLVKPGGSLRLSCAASGFTFSDYYMS WIRQAPGKGLEWVSHISSSGSTIYYADSVKGRFTIS RDNAKNSLYLQMNSLRAEDTAVYYCARYRNNRG YFDLWGRGTLVTVSS |
| | | | SEQ ID NO: 24268 | SEQ ID NO: 28274 |
| iPS:392652 | 21-225_17C6 | NA | GACATCCAGATGACCCAGTCTCCATCTCCCT GTCTGCATCTGTAGGAGACAGAGTCACCATCA CTTGCCGGGCAAGTCAGAGCATTAATAACTTAT TTAAATTGGTATCAGCAGAAAAACCAGGGAAAG CCCCTAAGCTCCTGATCTATGCTGCAAGTTCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTACAGAACCCCCTTT TTCACTTTCGGCCCTGGGACCAAAGTGGATAT CAAA | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGCT GGAGTGGGTCTCAGTTATTAGTAGTGTCGTGGTGGT AACACATTCTACGCAGACTCCGTGAAGGGCCGGT TCACCATCTCCAGAGACAATTCCAAGAACACGCT CTTTCTGCAAATGAACAGCCTGAGAGCCGAGGA CACGGCCGTATATATTATTGTGCTCCCGTTTGGCA GTGGCTGCGGAGGCTTTTGATATCTGGGGCC AAGGGACAATGGTCACCGTCTCTCA |
| | | | SEQ ID NO: 24269 | SEQ ID NO: 28275 |

FIGURE 50
(Continued)

| | | | |
|---|---|---|---|
| iPS:392654 | 21-225_17A10 | AA | DIQMTQSPSSLSASVGDRVTITCRASQSINTYLN WYQQKPGKAPKLLIYAASSLQSGVPSRFSGSGS GTDFTLTISSLQPEDFATYFCQQSYRTPFFTFGPG TKVDIK<br>SEQ ID NO: 24270 | EVQLLESGGGLVQPGGSLRLSCAASEFTFSSYAMN WVRQAPGKGLEWVSVISGRGGNTFYADSVKGRFTI SRDNSKNTLFLQMNSLRAEDTAVYYCASRLAVAG SEAFDIWGQGTMVTVSS<br>SEQ ID NO: 28276 |
| | | NA | GACATCCAGATGACCCAGTCTCCATCCTCCCT GTCTGCATCTGTAGGAGACAGAGTCACCATCA CTTGCCGGGCAAGTCAGAGCATTAGAAATGAT TTAGGCTGGTATCAGCAGAAACCAGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAAGTACCCGCTC ACTTTCGGCGGAGGGACCAAGGTGGAGATCA AA<br>SEQ ID NO: 24271 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGCCAAGGGGCT GGAGTGGGTGGCAGTTATTGGTATGAAGAAAAT AATCAATACTATGCAGACTCCGTGAAGGGCCGAT TCACCATCTCAGAGACAATTCCAAGAACACGCT GTATCTGCAAATGAACAGCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br>SEQ ID NO: 28277 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24272 | QVQLVESGGGVVQPGRSLRLSCAASGFTFSNYGM HWVRQAPAKGLEWVAVIWYEENNQYYADSVKGR FTISRDNSKNTLYLQMNSLRAEDTAVYYCARELGF RSDYWGQGTLVTVSS<br>SEQ ID NO: 28278 |

FIGURE 50
(Continued)

| | | | |
|---|---|---|---|
| iPS:392656 | 21-225_1F2 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTGCAAAGTGGGGTCCCATCAAGGTTCAGCGG CAGTGGATCTGGGACAGATTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACTGCA CTGTCTCTGGTGGCTCCATCAGTAGGAGTAGTTA CTACTGGGGCTGGATCCGCCAGCCCCCAGGGAA GGGGCTGGAGTGGATTGGGAATATTATTATAGT GGGAGCGCTACAACAACCCGTCCTCAAGGGT CGAGTCACCATATCGTAGACACGTCAAGAACC AGTTCTCCCTGAAGCTGAACTCTGTGACCGCGC AGACACGGCTGTGTATTACTGTGGGAGACATGGA AAAGACTGGGCCTTGACTACTGGGGCCAGGGA ACCCTGGTCACCGTCCTCA |
| | | | SEQ ID NO: 24273 | SEQ ID NO: 28279 |
| | | AA | DIQMTQSPSSLSASVGDRVTITCRASQGIRNDLG WYQQKPGKAPKRLIYAASSVQSVPSRFSGSGS GTEFTLTISSLQPEDFAIYYCLQHNSYPLTFGGGT KVEIK | QLQLQESGPGLVKPSETLSLTCTVSGGSISRSSYYW GWIRQPPGKGLEWIGNIYYSGSAYNNPSLKGRVTIS VDTSKNQFSLKLNSVTAADTAVYYCGRHGKDWGL DYWGQGTLVTVSS |
| | | | SEQ ID NO: 24274 | SEQ ID NO: 28280 |
| iPS:392658 | 21-225_18E8 | NA | GACATCCAGATGACCCAGGCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGTTGGTGGAGTCTGGGGGAGGCGTG GTCCAGCCTGGGAGGTCCCTGAGACTCTCCTGTG CAGCCGTCTGAATTCACCTTCACTGAGTAACTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCGTCTCCAGAGACAATTCCAAGAACACGCT GTTTCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA |
| | | | SEQ ID NO: 24275 | SEQ ID NO: 28281 |

FIGURE 50
(Continued)

| | | | |
|---|---|---|---|
| iPS:392660 | 21-225_19B3 | AA | DIQMTQAPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK  SEQ ID NO: 24276 | QVQLVESGGGVVQPGRSLRLSCAASGFTFSNYGM HWVRQAPGKGLEWVAVIWYEENNQYYADSVKGR FTVSRDNSKNTLFLQMNSLRAEDTAVYYCARELGF RSDYWGQGTLVTVSS  SEQ ID NO: 28282 |
| | | NA | GACATCCAGATGACCCAGTCTCCATCCTCCCT GTCTGCTTCTGTGGGAGACAGAGTCACCATCA CTTGCCGGGCAGGTCAGAGAACATTATCAACTAT TTAAATTGGTATCAGCAGAAACCAGGGAAAG CCCCTAACCTCGTGATATATGTTGCATCCAGTT TGCAAAGTGGGGTCCCATCAAGGTTCAATGGC AGTGGATCTGGGACAGATTTCACTCTCACCAT CAGCAGTCTGCAACCTGAAGATTTTGCAACTT ACTACTGTCAACAGAGTTACAGTACCCCTTTC ACTTTCGGCCCTGGGACCAAAGTGGATATCAA A  SEQ ID NO: 24277 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGACAT GCACTGGGTCCGCCAGGCTCCAGGCAAGGGGCT GGAGTGGGTGGCAGTTATATGGTATGAGGAAG TGATAAATACTATGCAGACTCCGTGAAGGGCCG ATTCACCATCTCCAGAGACAACAATTCCAAGAACACG CTCTTTCTGCAAATGAACAGCCTGAGAGCCGAGG ACACGGCTGTGTATTACTGTGCGAGAGATCGGC CTATAGCAGCTCGTCTGACTACTGGGGCCAGGGA ACCCTGGTCACCGTCTCCTCA  SEQ ID NO: 28283 |
| | | AA | DIQMTQSPSSLSASVGDRITITCRAGQNINYLNW YQQKPGKAPNLLIYVASSLQSGVPSRFNGSGSGT DFTLTISSLQPEDFATYYCQQSYSTPFTFGPGTKV DIK  SEQ ID NO: 24278 | QVQLVESGGGVVQPGRSLRLSCAASGFTFSSYDMH WVRQAPGKGLEWVAVIWYDGSDKYYADSVKGRF TISRDNSKNTLFLQMNSLRAEDTAVYYCARDRAYS SSSDYWGQGTLVTVSS  SEQ ID NO: 28284 |

FIGURE 50
(Continued)

| | | | |
|---|---|---|---|
| iPS:392664 | 21-225_20F6 | NA | GACATCCAGATGACCCAGTCTCCATCTCCT GTCTCTGCATCTGTAGGAGACAGAGTCACCATCA CTTGCCGGGCAAGTCAGAGCATTATCACCTAT TTAAATTGGTATCAGCAGAAACCAGGGAAAG CCCCTAAGGTCCTGATCCATACTGCATCCAGT TTGCAAAGTGGGGTCCCATCAAGGTTCAGTGG CAGTGGATCTGGGACAGATTTCACTCTCACCA TCAGCAGTCTGCAACCTGAAGATTTTGCAACT TACTACTGTCAACAGACTTACAGTCCCCGCT CACTTTCGGCGGAGGGACCAAGGTGGAGATC AAA<br>SEQ ID NO: 24279 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGGGCAGTTATATGCAGACTCCGTGAAG GGCCGTAATAATACTATCCAGAGCAAATGCCAAGAACAC ATTCACCATCTCGAAATGAACAGCTGAGAGCCGA GCTGTATCTGCAAATGAACAGCTGTGCGAGAGATCTG GGACACGGCTGTGTATTACTGTGCGAGAGATCTG AGTATGGGCGAATGGACGTCTGGGGCCAAGGG ACCACGGTCACCGTCTCCTCA<br>SEQ ID NO: 28285 |
| | | AA | DIQMTQSPSSLSASVGDRVTITCRASQSIITYLNW YQQKPGKAPKVLIHTASSLQSGVPSRFSGSGSGT DFTLTISSLQPEDFATYYCQQTYSPPLTFGGGTK VEIK<br>SEQ ID NO: 24280 | QVQLVESGGGVVQPGRSLRLSCVASGFTFSSYGMH WVRQAPGKGLEWGAVIWHDGSNKYYADSVKGRF TISRDNAKNTLYLQMNSLRAEDTAVYYCARIDLSM GGMDVWGQGTTVTVSS<br>SEQ ID NO: 28286 |
| iPS:392666 | 21-225_16F11 | NA | GACATCCAGATGACCCAGTCTCCATCTCCT GTCTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTACAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 24281 | CAGGTGCAGATGGTGGAGTCTGGGGGAGGCGTG GTCCAGCCTGGGAGGTCCCTGAGACTCTCTGTG AAGCGTCTGGATTCACCTTCAGTAGCTATGGCAT GCACTGGGTCCGCCAGGCTCCAGGCAAGGGGCT GGAGTGGGTGGCAGTTATATGGTATGGAAAA TTCACCATCTCCAGAGACAATTCCAAGGGCCGA TGTATCTGCAAATGAATAGCCTGAGAGCCGAGG CTTCCAGTCTGACTACTGTGGGGCCAGGGAACCCCG GTCACCGTCTCCTCA<br>SEQ ID NO: 28287 |

FIGURE 50
(Continued)

| | | | |
|---|---|---|---|
| iPS:392668 | | AA | DIQMTQSPSSLSASVGDRVTITCRASQGIRNDLGWYQQKPGKAPKRLIYAASSVQSGVPSRFSGSGSGTEFTLTISSLQPEDFATYYCLQHNSYPLTFGGGTKVEIK<br>SEQ ID NO: 24282 | QVQMVESGGGVVQPGRSLRLSCEASGFTFSSYGMHWVRQAPGKGLEWVAVIWYEENNKYYVDSVKGRFTISRDNSKSTLYLQMNSLRAEDTAVYYCVRELGFQSDYWGQGTPVTVSS<br>SEQ ID NO: 28288 |
| | 21-225_17B4 | NA | GACATCCAGATGACCCAGTCTCCATCCTCCCTGTCTGCATCTGTAGGCGACAGAGTCACCATCACTTGCCGGGCAAGTCAGAGCATTAGTAGTTATTTAAATTGGTATCAGCAGAAACCAGGGAAAGCCCCTAAGCTCCTGATCTTTGGTGCATCCAGTTTGCAAACTGGGGTCCCATCAAGGTTCAGTGGCAGTGGATCTGGGACAGATTTCACTCTCACCATCAACAGTCTGCAACAGAGTTACAGAACCCCCTTTACTTTCGGCCCTGGGACCAAAGTGGATATCAAA<br>SEQ ID NO: 24283 | GAGGTGCAGCTGTTGGAGTCTGGGGGAGGCTTGGTACAGCCTGGGGGGTCCCTGAGACTCTCCTGTGCAGCCTCTGAATTTACCTTTAGCAGCTATGCCATGAACTGGGTCCGCCAGGCTCCAGGGAAGGGGCTGGAGTGGGTCTCAGTTATTAGTGGCCGTGGTGGTAACACATTCTACGCAGACTCCGTGAAGGGCCGGTTCACCATCTCCAGAGACAATTCCAAGAACACGCTGTATCTGCAAATGAACAGCTGAGAGCCGAGGACACGGCCGTATATTACTGTGCGTCCCGTTTGGCAGTGGCTGGCTCGGAGGCTTTGATATCTGGGGCCAAGGGACAATGGTCACCGTCTCCTCA<br>SEQ ID NO: 28289 |
| | | AA | DIQMTQSPSSLSASVGDRVTITCRASQNISSYLNWYQQKPGKAPKLLIFGASSLQTGVPSRFSGSGSGTDFTLTINSLQPEDFATYFCQQSYRTPFFTFGPGTKVDIK<br>SEQ ID NO: 24284 | EVQLLESGGGLVQPGGSLRLSCAASEFTFSSYAMNWVRQAPGKGLEWVSVISGRGGNTFYADSVKGRFTISRDNSKNTLYLQMNSLRAEDTAVYYCASRLAVAGSEAFDIWGQGTMVTVSS<br>SEQ ID NO: 28290 |

FIGURE 50
(Continued)

| | | | |
|---|---|---|---|
| iPS:392674 | 21-225_18C2 | NA | GACATCCAGATGACCCAGTCTCCATCCTCCCT GTCTGCGTCTGTAGGAGACAGAGTCACCATCA CTTGCCGGGCAAGTCAGGACAGGCATTAGAAATGAT TTAGGCTGGTATCAGCAGAAACCAGGGAAAG CCCCTAAGCGCCTGATCTATACTGCATCCAGT TTGCAAAGTGGGGTCCCATCACAAGATTCAGCGG CAGTGGATTGGGACAGAATTCACTCTCACAA TCAGCAGCCTGCAGCCTGAAGATTTTGCAACT TATTACTGTCTACAACATAATAGTTACCCGTG GACGTTCGGCCTGGGACCAAGGTGGTCATCA AA SEQ ID NO: 24285 | CAGGTGCAACTGGTGCAGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGATGGCAGTTATATGGTATGATGTAACT AATAAATACTATGCAGACTCCGTGAAGGGCCGA TTCACCATCTCCAGAGACAATTCCAAGAACACGC TGTATCTGCAAATGAACAGCCTGAGCGCCGAGG ACACGGCTGTTTATTACTGTGCGAGAGAGCTTGG CTGGTACGAGGACTACTGGGGCCAGGGAACCCT GGTCACCGTCTCCTCA SEQ ID NO: 28291 |
| | | AA | DIQMTQSPSSLSASVGDRVTITCRASQGIRNDLG WYQQKPGKAPKRLIYTASSLQSGVPSRFSGSGFG TEFTLTISSLQPEDFATYYCLQHNSYPWTFGLGT KVVIK SEQ ID NO: 24286 | QVQLVESGGGVVQPGRSLRLSCVASGFTFSDYGM HWVRQAPGKGLEWMAVIWYDVTNKYYADSVKG RFTISRDNSKNTLYLQMNSLSAEDTAVYYCARELG WYEDYWGQGTLVTVSS SEQ ID NO: 28292 |
| iPS:392676 | 21-225_19F3 | NA | GACATCCAGATGACCCAGTCTCCATCCTCCCT GTCTGCATCTGTACGAGACAGAGTCACCATCA CTTGCCGGGCAAGTCAGGGCATAAGAAATGAT TTAGGCTGGTATCAGCAGAAACCAGGGAAAG CCCCTAAGCGCCTGATCTATGCTGTTTCCAGTT TGCAAAGTGGGGTCCCATCACAAGGTTCAGCGGC AGTGGATCTGGGACAGCCTGAAGATTCACTCTCACAAT CAGCAGCCTGCAGCCTGTCTACAGCATGCCAGTTACCCGCTC ACTTTCGGCGGAGGGACCAAGGTGGAGATCA AA SEQ ID NO: 24287 | CAGGTGCAGCTGCAGGAGTCGGGCCCAGGACTG GTGAAGCCTTCCGGTGGAGACCCTGTCCTCACCTGCA CTGTCTCCGGTGGGCCATCAGCGGTAGTAGTTA CTACTGGGGCTGGATCCGCCAGCCCCAGGGAA ACAACTGGAGTGGATTGGGAATATCTATTATAGT GGGAGCACCTACTACAACCCGTCCTTCAAGAGTC GAGTCACCATATCCGTAGACACGTCAAGAACC AGTTCTCCCTGAAGCTGAGCTGTGACCGCCGA AGACACGGCTGTCTATTACTGTGCGAGACATTCC AGTAGCTGTCCCTGACTACTGGGGCCAGGGAA CCCTGGTCACCGTCTCCTCT SEQ ID NO: 28293 |

FIGURE 50
(Continued)

| | | | | |
|---|---|---|---|---|
| iPS:392678 | 21-225_20F3 | AA | DIQMTQSPSSLSASVRDRVTITCRASQGIRNDLGWYQQKPGKAPKRLIYAVSSLQSGVPSRFSGSGSGTEFTLTISSLQPEDFATYYCLQHASYPLTFGGGTKVEIK<br>SEQ ID NO: 24288 | QVQLQESGPGLVKPSETLSLTCTVSGGAISGSSYYWGWIRQPPGKQLEWIGNIYYSGSTYYNPSFKSRVTISVDTSKNQFSLKLSSVTAEDTAVYYCARHSSSWSLDYWGQGTLVTVSS<br>SEQ ID NO: 28294 |
| | | NA | GACATCCAGATGACCCAGTCTCCATCCTCCTGTCTGCATCTGTAGGAGACAGAGTCACCATCACTTGCCGGGCAAGTCAGAGCATTAGTAGTTATTTATATTGGTATCAGCAGAAACCAGGGAAAGCCCCTAAGCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCTCAACAGAGTTACAGTGCCCCTCCATTCACTTTCGGCCCTGGGACCAAAGTGGATATCAAA<br>SEQ ID NO: 24289 | GAGGTGCAGCTGTTGGAGTCTGGGGGAGGCTTGGTACAGCCGGGGGGGTCCCTGAGACTCTCCTGTGCAGCCTCTGGATTCACCTTTAGCAGCTATGCCATGAACTGGGTCCGCCAGGCTCCAGGGAAGGGGCTGGAGTGGGTCTCAGTTATTAGTGGTAGTGGTGGTAGCACATACTACGCAGACTCCGTGAAGGGCCGGTTCACCATCTCCAGAGACAACGCCAAGAACACGCTGTATCTGCAAATGAACAGCCTGAGAGCCGAGGACACGGCCGTATATTACTGTGCGAAAGGATAGCAGCAGCTGGTACGGAGTACTTCGATCTCTGGGGCCGTGGCACCCTGGTCACTGTCTCCTCA<br>SEQ ID NO: 28295 |
| | | AA | DIQMTQSPSSLSASVGDRVTITCRASQSISSYLYWYQQKPGKAPKLLIYAASSLQSGVPSRFSGSGSGTDFTLTISSLQPEDFATYYCQQSYSAPPFTFGPGTKVDIK<br>SEQ ID NO: 24290 | EVQLLESGGGLVQPGGSLRLSCAASGFTFSSYAMNWVRQAPGKGLEWVSVISGSGGSTYYADSVKGRFTISRDNSKNTLYLQMNSLRAEDTAVYYCAKRIAAAGTEYFDLWGRGTLVTVSS<br>SEQ ID NO: 28296 |

FIGURE 50
(Continued)

| | | | | |
|---|---|---|---|---|
| iPS:392680 | 21-225_20A7 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAAAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAACTATGGCAT GCACGTGGGTCCGCCAGGCTCCAGGCAAGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTATTTATTACTGTGCGAGAGAACTGGGG TTCCGGTCTGACTACTGGGGCCAGGGAACCCTGG TCACCGTCTCCTCA |
| | | | SEQ ID NO: 24291 | SEQ ID NO: 28297 |
| | | AA | DIQMTQSPSSLSASVGDRVTITCRASQGIRNDLG WYQQKPGKAPKRLIYAASSLQSGVPSRFSGSGS GTEFSLTISSLQPEDFATYYCLQHNSYPLTFGGGT KVEIK | QVQLVESGGGVVQPGRSLRLSCAASGFTFSNYGM HWVRQAPGKGLEWVAVIWYEENNQYYADSVKGR FTISRDNSKNTLYLQMNSLRAEDTAIYYCARELGFR SDYWGQGTLVTVSS |
| | | | SEQ ID NO: 24292 | SEQ ID NO: 28298 |
| iPS:392682 | 21-225_16A12 | NA | GACATCCAGATGACCCAGTCTCCATCCTCACT GTCTGCATCTGTAGGAGACAGAGTCACCATCA CTTGTCGGGCGAGTCAGGCCATTAGCAGGTAT TTAGCCTGGTTTCAGCAGAAACCAGGGAAAGC CCCTAAGTCCCTGATTTCTGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATTATAGTTATCCGCTCAC TTTCGGCGGAGGGACCAAGGTGGAGATCAAA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTAGTTATAGAAT GAACTGGGTCCGCCAGGCTCCAGGGAAGGGGCT GGAGTGGGTCTCATCCATTAGTGGTAGTAGTACT GACATATACTACGCAGACTCAGTGAAGGGCCGA TTCACCATCTCCAGAGACAACGCCGAGAACTCAC TGTATCTGCAAATGAACAGCCTGAGAGCCGAGG ACACGGCTGTGTATTACTGTGCGAGAGGGACTT CTGGGGCCAGGGAACCCTGGTCACCGTCTCCTCA |
| | | | SEQ ID NO: 24293 | SEQ ID NO: 28299 |

FIGURE 50
(Continued)

| | | AA | DIQMTQSPSSLSASVGDRVTITCRASQAINTYLAWFQQKPGKAPKSLISAASSLQSGVPSKFSGSGSGTEFTLTISSLQPEDFATYYCQQYYSYPLTFGGGTKVEIK<br><br>SEQ ID NO: 24294 | EVQLVESGGGLVKPGGSLRLSCAASGFTFSSYRMNWFRQAPGKGLEWVSSISGSSTDIYYADSVKGRFTISRDNAENSLYLQMNSLRAEDTAVYYCARRDFWGQGTLVTVSS<br><br>SEQ ID NO: 28300 |
| iPS:392684 | 21-225_17F4 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATCACTCTCACAATCAGCAGCCTGCAGCCTGAAGATTTTGCAACTTATTACTGTCTACAGCATATAGTTACCCATTCACTTTCGGCCCTGGGACCAAAGTGGATATCAAA<br><br>SEQ ID NO: 24295 | CAGGTGCAGCTGGTGGAGTCTGGGGGAGGCGTGGTCCAGCCTGGGAGGTCCCTGAGACTCTCCTGTCAGCGTCTGTGATTCACCTTCAGTAACTATGGCATGAACTGGGTCCGCCAGGCTCCAGGCAAGGGGCTGGAGTGGGTGGCAGTTATATGGTATGATGGAAATAATAAACACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGTAGTGGGAGCTACTTCTTTGACTACTGGGGCCAGGGAACCCTGGTCACCGTCTCCTCA<br><br>SEQ ID NO: 28301 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK<br><br>SEQ ID NO: 24296 | QVQLVESGGGVVQPGRSLRLSCAASGFTFSNYGMNWVRQAPGKGLEWVAVIWYDGNNKHYADSVKGRFTISRDNSKNTLYLQMNSLRAEDTAVYYCASSGSYFFDYWGQGTLVTVSS<br><br>SEQ ID NO: 28302 |

FIGURE 50
(Continued)

| | | | |
|---|---|---|---|
| iPS:392686 | 21-225_17C7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGATTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 24297 | CAGGTGCAGCTGGTGGAGTCTGGGGGAGGCGTG GTCCAGCCTGGGAAGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG GCACGGCTGTGTATTACTGTGCGAGAGATCTTGG CTGGACGGAAGAATACTGGGGCCAGGGAACCCT GGTCACCGTCTCCTCA<br><br>SEQ ID NO: 28303 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br><br>SEQ ID NO: 24298 | QVQLVESGGGVVQPGKSLRLSCAASGFTFSDYGM HWVRQAPGKGLEWVAVIWFDGSNKYYADSVKGR FTISRDNSKNTLYLQMNSLRAEGTAVYYCARDLG WTEEYWGQGTLVTVSS<br><br>SEQ ID NO: 28304 |
| iPS:392690 | 21-225_18F2 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAGAAACCAGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTCACTCTCACAA TCAGCAGCCTGCAGCCTGAAGATTTTGCAACT TATTACTGTCTACAGCATAATAGTACCCCGTG GACGTTCGGCCAAGGGACCAAGGTGGAAATC AAA<br><br>SEQ ID NO: 24299 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGAT TCACCATCTCCAGAGACAATTCCAAGAACAGCT GTATCTGCAAATGAACAGCTGAGAGTCGAGGA CACGGCTGTGTATTACTGTGCGAGAGATCTTGGC TGGACGGAAGAGTACTGGGGCCAGGGAACCCTG GTCACCGTCTCCTCA<br><br>SEQ ID NO: 28305 |

FIGURE 50
(Continued)

| | | | | |
|---|---|---|---|---|
| iPS:392692 | 21-225_18G10 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK<br><br>SEQ ID NO: 24300 | QVQLVESGGGVVQPGRSLRLSCAASGFTFSDYGM HWVRQAPGKGLEWVAVIWFDGSNKYYVDSVKGR FTISRDNSKNTLYLQMNSLRVEDTAVYYCARDLG WTEEYWGQGTLVTVSS<br><br>SEQ ID NO: 28306 |
| | | NA | GACATCCAGATGACCCAGTCTCCATCCTCACT GTCTGCATCTGTAGGAGACAGAGTCACCATCA CTTGTCGGGCGAGTCAGGACATTAGGAAAGC TTAGCCTGGTTTCAGCAGAAACCAGGGAAAGC CCCTAAGTCCCTGATTTATGCTGCATCCAGTT GCAAAAGTGGGGTCCCATCAAAGTTCGGCGGCA GTGGATTTGGGACAGATTTCACTCTCACCATC AGCAGCCTGCAGCCTGAAGATTTTGCAACTTA TTACTGCTTACAGTATAATAGTTACCATTCAC TTTCGGCCCTGGGACCAAAGTGGATATCAAA<br><br>SEQ ID NO: 24301 | GAGGTGCAGCTGGTGGAGTCTGGGGGAGGCTTG GTACAGCCTGGGGGGTCCCTGAGACTCCTCTGTG CAGCCTCTGGAATCCACCTTCAGTACCTATAGCAT GAACTGGGTCCGCCAGGCTCCAGGGAAGGGGCT GGAGTGGGTTTCATACATTAGTAGGAGTAGTAGT ACCATAGACTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGCGAGAGGAGGTGG GAGCCCTTTTGACTACTGGGGCCAGGGAACCCTG GTCACCGTCTCCTCA<br><br>SEQ ID NO: 28307 |
| | | AA | DIQMTQSPSSLSASVGDRVTITCRASQDISYYLA WFQQKPGKAPKSLIYVASSLQSGVPSKFGGSGF GTDFTLTISSLQPEDFATYYCLQYNSYPFTFGPGT KVDIK<br><br>SEQ ID NO: 24302 | EVQLVESGGGLVQPGGSLRLLCAASGITFSTYSMN WVRQAPGKGLEWVSYISRSSSTIDYADSVKGRFTIS RDNAKNSLYLQMNSLRDEDTAVYYCARGGGSPFD YWGQGTLVTVSS<br><br>SEQ ID NO: 28308 |

FIGURE 50
(Continued)

| | | | | |
|---|---|---|---|---|
| iPS:392694 | 21-225_19A5 | NA | GACATCCAGATGACCCAGTCTCCATCCTCCCT GTCTGCACCTGTAGGAGACAGAGTCTCCATCA CTTGCCGGGCAAGTCAGAACAGATTATCAACTAT TTAAATTGGTATCAGCAGAAACCAGGGAAAG CCCCTAAGCTCCTGATAGATGTTGCATCCAAT TTACAAGGTGGGGTCCCATCAAGGTTCAGTGG CAGTGGATCTGGGACAGATTTCACTCTCACCA TCAGCAGTCTGCAACCTGAAGATTTTGCAACT TACTACTGTCAACAGAGTTACAGTACCCCTTT CACTTTCGGCCCTGGGACCAAAGTGGATATCA AA | CAGGTGCAGCTGGTGGAGTCTGGGGGAGGCGTG GTCCAGCCTGGGAGGTCCCTGAGACTCTCCTGT CAGCGTCTGGATTCACCTTCAGTAGCTATGCCAT GCACTGGGTCCGCCAGGCTCCAGGCAAGGGCT GGAGTGGGTGGCAGTTATATGTTTGATGAAGT GATAAATACTATGCAGACTCCGTGAAGGCCGA TTCACCATCTCCAGAGACAATTCCAAGAACACGC TGTATCTACAAATGAACAGCCTGAGAGCCGAGG ACACGGCTGTGTATTACTGTGCGAGAGATCGGGC CTATAGTAGCTCGTCTGACTACTGGGGCCAGGGA ACCCTGGTCACCGTCTCCTCA |
| | | | SEQ ID NO: 24303 | SEQ ID NO: 28309 |
| | | AA | DIQMTQSPSSLSAPVGDRVSITCRASQNIINYLN WYQQKPGKAPKLLIDVASNLQGVPSRFSGSGS GTDFTLTISSLQPEDFATYYCQQSYSTPFTFGPGT KVDIK | QVQLVESGGGVVQPGRSLRLSCAASGFTFSSYAMH WVRQAPGKGLEWVAVIWFDGSDKYYADSVKGRF TISRDNSKNTLYLQMNSLRAEDTAVYYCARDRAYS SSSDYWGQGTLVTVSS |
| | | | SEQ ID NO: 24304 | SEQ ID NO: 28310 |
| iPS:392696 | 21-225_20A4 | NA | GACATCCAGATGACCCAGTCTCCAGCCTCCT GTCTGCATCTGTAGGAGACAGAGTCACCATCA CTTGCCGGGCAAGTCAGAGCATTATCAACTAT TTAAATTGGTATCAGCAGAAACCAGGGAAATC CCCTAAGCTCCTGATCTATGCTGCATCCAGTTT GCACAGTGGGGTCCCATCAAGGTTCAGTGGCA GAGGATCTGGGACAGATTTCACTCTCACCATC AGTAGTCTGCAACAGAGTTACAGAACCCCTAT CTTCTGTCAACAGAGTTACAGAACCCCTTAT TCACTTTCGGCCCTGGGACCAAAGTAGATTTC AAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GACCTGGGTCCGCCAGGTTCCAGGGATGGGCT GGAGTGGGTCTCAGTTATAAGTGGTAGTGGTGT TACACATACAACGGGACTCCGTGAAGGGCCG TTCACCATCTCCAGAGACAATTCCAAGAACACGC TGTATCTGCAAATGAACAGCCTGAGAGTCGAGG ACACGGCCGTATATTACTGTGCGTCCGTATAGC AGTGGCTGCTCGGAGGCTTTGATATCTGGGGC CAAGGGACAATGGTCACCGTCTCTTCA |
| | | | SEQ ID NO: 24305 | SEQ ID NO: 28311 |

FIGURE 50
(Continued)

| | | | |
|---|---|---|---|
| iPS:392700 | 21-225_16E12 | AA | DIQMTQSPASLSASVGDRVTITCRASQSIINYLN WYQQRPGKSPKLLIYAASSLHSGVPSRFSGRGSG TDFTLTISSLQPEDFATYFCQQSYRTPLFTFGPGT KVDFK<br>SEQ ID NO: 24306 | EVQLLESGGGLVQPGGSLRLSCAASGFTFSSYAMT WVRQGPGMGLEWVSVISGSGGYTYNADSVKGRFT ISRDNSKNTLYLQMNSLRVEDTAVYYCASRIAVAG SEAFDIWGQGTMVTVSS<br>SEQ ID NO: 28312 |
| | | NA | GACATCCAGATGACCCAGTCTCCATCCTCCCT GTCTGCATCTGTAGGAGACAGAGTCACCATCA CTTGCCGGGCAAGTCAGAGCATTAGAAATGAT TTAGGCTGGTATCAGCAGAAACCAGGAAAG CCCCTAAGCGCCTGATCTATGCTGCATCCAGT TTACAAAGTGGGGTCCCATCAAGGTTCAGCGG CAGTGGATCTGGGACAGATCACTCTCACAA TCAGCAGCCTGCAGCCTGAAGATTTTGCAACT TATTACTGTCTACAGCATATAAGTTACCCGCTC ACTTTCGGCGGAGGGACCAAGGTGGAGATCA AA<br>SEQ ID NO: 24307 | CAGGTGCAGCTGGTGGAGTCTGGGGGAGGCCTG GTCCAGCCTGGGAGGTCCCTGAGACTCTCCTGTG CAGCGTCTGGATTCACCTTCAGTAACTATGCCAT GCACTGGGTCCGCCAGGCTCCAGGCAAGGGGCT GGAGTGGGTGGCAGTTATATGACTCCGTGAGGGCCGA TAATAAATATTATGTAGACTCCGTGAGGGCCGA TTCACCATCTCCAGAGACAATTCCAAGAACACGC TGTATCTGCAAATGAACAGCCTGAGAGCCGAGG ACACGGCTGTGTATTACTGTGTGAGAGAGCTAGG CTTCCAGTCTGATCACTGGGGCCAGGGAACCCG GTCACCGTCTCCTCA<br>SEQ ID NO: 28313 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24308 | QVQLVESGGGLVQPGRSLRLSCAASGFTFSNYGMH WVRQAPGKGLEWVAVIWYEGSNKYYVDSVRGRF TISRDNSKSTLYLQMNSLRAEDTAVYYCVRELGFQ SDHWGQGTPVTVSS<br>SEQ ID NO: 28314 |

FIGURE 50
(Continued)

| | | | | |
|---|---|---|---|---|
| iPS:392702 | 21-225_17F7 | NA | GACATCCAGATGACCCAGTCTCCATCTCCCT GTCTGCATCTGTTGGAGACAGAGTCACCATCA CTTGCCGGGCAAGTCAGACAGCATTAGTAGTTTT TTAAATTGGTATCAGCAGAAACCAGGGAAAG CCCCTAAACTCCTGATCTATGCTGTCTTCCAGTT TGCAAAGTGGGGGTCCCGTCAAGGTTCAGTGGC AGTGGATCTGGGACAGATTTCACTCTCACCAT CAGCGGTCTGCAACCTGAAGATTTTGCAACTT ACTTCTGTCAACAGAGTTACAGAACCCCCTTT TCACTTTCGGCCCTGGGACCAAAGTGGATAT CAAA | GAGGTGCAGCTGTTGGAGTCTGGGGGAGGCTTG GTACAGCCTGGGGGGTCCCTGAGACTCTCCTGTG CAGCCCTCTGAATTCACCTTTAGCAGCTATGCCAT GAACTGGGTCCGCCAGGCTCCAGGGAAGGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGGCTCGGAGGCTTTTGATATCTGGGGCC AAGGGACAATGGTCACCGTCTCTTCA |
| | | | SEQ ID NO: 24309 | SEQ ID NO: 28315 |
| | | AA | DIQMTQSPSSLSASVGDRVTITCRASQTISSFLNW YQQKPGKAPKLLIYAASSLQSGVPSRFSGSGSGT DFTLTISGLQPEDFATYFCQQSYRTPFFTFGPGTK VDIK | EVQLLESGGGLVQPGGSLRLSCAASEFTFSSYAMN WVRQAPGKGLEWVSIISGRGGNTFYADSVKGRFTI SRDNSKNTLYLQMNSLRAEDTAVYYCASRLAVAG SEAFDIWGQGTMVTVSS |
| | | | SEQ ID NO: 24310 | SEQ ID NO: 28316 |
| iPS:392704 | 21-225_17F11 | NA | GACATCCAGATGACCCAGTCTCCATCTCCCT GTCTGCATCTATAGGAGACAGAGTCACCATCA CTTGCCGGGCAAGTCGGACAGTCATTAACACTAT TTAAATTGGTATCAGCAGAAACCAGGGAAAG CCCCTAAACTCCTGATCTTTGCTACATCCAGTT TACAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCCTTA TTCGCTTTCGGCCCTGGGACCAAAGTGGATAT CAAA | GAGGCGCAGCTGTTGGAGTCTGGGGGAGGCTTG GAACAGCCTGGGGGGTCCCTGAGACTCTCCTGTG CAGCCCTCTGATTCACCTTTAGCAGCTATGCCAT GAGCTGGGTCCGCCAGGCTCCAGGGAAGGGGCT GGAGTGGGTCTCAGTTATTAGTGGTAGAGGTGGT AACACATACTCCGCAGACTCCGTGAAGGGCCGG TTCACCATCTCCAGAGACAATTCCAAGAACACGC TATATCTACAAATGAACAGCCTGAGAGCCGAGG ACACGGCCGTATATTACTGTGCGTCCCGTTTAGC AGTGGCTGGCTCGGAGGCTTTTCATATCTGGGGC CAAGGGACAATGGTCACCGTCTCTTCA |
| | | | SEQ ID NO: 24311 | SEQ ID NO: 28317 |

FIGURE 50
(Continued)

| | | | |
|---|---|---|---|
| iPS:392706 | 21-225_18A3 | AA | DIQMTQSPSSLSASIGDRVSITCRASRTINNYLNW YQQKPGKAPKLLIFATSSLQSGVPSRFSGSGSGT DFTLTISSLQPEDFATYYCQQTYSTPLFAFGPGTK VDIK | EAQLLESGGGLEQPGGSLRLSCAASGFTFSSYAMS WVRQAPGKGLEWVSVISGRGNTYSADSVKGRFTI SRDNSKNTLYLQMNSLRAEDTAVYYCASRLAVAG SEAFHIWGQGTMVTVSS |
| | | | SEQ ID NO: 24312 | SEQ ID NO: 28318 |
| | | NA | GACATCCAGATGACCCAGTCTCCATCCTCCT GTCTGCATCTGTAGGAGACAGAGTCAGCATCA CTTGCCGGGCAAGTCAGGGCATTAGAAATGAT TTAGGCTGGTATCAGCAGAAACCAGGGAAAG CCCCTAAGCGCCTGATCTATGTTGCATCCAGTT TGCAAAGTGGGGTCCCATCAAGGTTCAACGGC AGTGGATCTGGGACAGAATTCACTCTCACAAT CAGCAGCCTGCAGCCTGAAGATATTTGCAACTT ATTACTGTCTACAGCATAGTAGTTACCCGCTC ACTTTCGGCGGAGGGACCAAGGTGGAGATCA AA | CAGCTGCAGCTGCAGGAGTCGGGCCCAGGACTG GTGAAGTTTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATAGGAATATCATTATAGT GGGTATACCTACTACAACTCCGTCCTCCAAGAGTC GAGTCACCATATCCGTAGACACGTCCAAGAACC AGTTCTCCCTGAAGCTGAGCTCTGTGACCGCCGC AGACACGGCTGTGTATTACTGTGCGAGACATAGC ACCAGCTGGTCCCTTGACTACTGGGGCCAGGGAA CCCTGGTCACCGTCTCCTCA |
| | | | SEQ ID NO: 24313 | SEQ ID NO: 28319 |
| | | AA | DIQMTQSPSSLSASVGDRVTITCRASQGIRNDLG WYQQKPGKAPKRLIYVASSLQSGVPSRFNGSGS GTEFTLTISSLQPEDFATYYCLQHSSYPLTFGGGT KVEIK | QLQLQESGPGLVKFSETLSLTCTVSGGSISRSSYYW GWIRQPPGKGLEWIGNIYYSGYTYTPSLKSRVTIS VDTSKNQFSLKLSSVTAADTAVYYCARHSTSWSLD YWGQGTLVTVSS |
| | | | SEQ ID NO: 24314 | SEQ ID NO: 28320 |

FIGURE 50
(Continued)

| | | NA | GACATCCAGATGACCCAGTCTCCTTCCTCACTGTTTGCATTTGTAGGAGACAGAGTCACCATCACTTGTCGGGCGAGTCAGGGCATTAGCTATTATTTAGCCTGGTTTCAGCAGAAACCAGGGAAAGCCCCTAAGTCCCTGATTTATGTTGCATCCAGTTTGCAAAGTGGGGTCCCATCAAAGTTCAGGGCAGTGGGATTTGGGACAGATTTCACTCTCACCATCAGCAGCCTGCAGCCTGAAGATTTTGCAACTTATTACTGCCAACAGTATAATACTTACCCATTCACTTTCGGCCCTGGGACCACAGTGGATATCAAG SEQ ID NO: 24315 | GAGGTGCAGCTGGTGGAGTCTGGGGGAGGCTTGGTACAGCCTGGGGGGTCCCTGAGACTCTCCTGTGCAGCCTCTGGATTCACCTTCAGAAGCTATAGCATGAACTGGGTCCGCCAGGCTCCAGGGAAGGGCTGGAGTGGCTTTCATACATTAGTAGTAGTGGTACCATATACTACGCAGACTCTGTGAAGGGCCGATTCACCATCTCCAGAGACAACGCCAGGAACTCACTGAATCTGCAAATGAACAGCCTGAGAGACGAGGACACGGCTGTGTATTACTGTGCGAGAGGAGGTGGGAGCCCTTTTGACTACTGGGGCCAGGGAATCCTGGTCACCGTCTCCTCA SEQ ID NO: 28321 |
|---|---|---|---|---|
| iPS:392708 | 21-225_18D11 | AA | DIQMTQSPSSLFAFVGDRVTITCRASQGISYYLAWFQQKPGKAPKSLIYVASSLQSGVPSKFSGSGFGTDFTLTISSLQPEDFATYYCQQYNTYPFTFGPGTTVDIK SEQ ID NO: 24316 | EVQLVESGGGLVQPGGSLRLSCAASGFTFRSYSMNWVRQAPGKGLEWLSYISSSSGTIYYADSVKGRFTISRDNARNSLNLQMNSLRDEDTAVYYCARGGGSPFDYWGQGILVTVSS SEQ ID NO: 28322 |
| iPS:392710 | 21-225_19A10 | NA | GACATCCAGATGACCCAGTCTCCATCCTCCCTGTCTGCATCTGTAGGAGACAGAGTCACCATCACTTGCCGGGCAAGTCAGAGCATTAGAAACTGATTAGGCTGGTATCAGCAGAAACCAGGGAAAGCCCCTAAGCGCCTGATCTATACTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATGGTTACCCGTGGACGTTCGGCCAAGGGACCAAGGTGGAAATCAAA SEQ ID NO: 24317 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGCAGACTCCGTGAAGGGCCGAATAAATACTACTGCAGAGACTCCGTGAAGGGCCGATTCACCATCTGCAAATGAACAGCCTGAGAGACGAGGTACGACTCCTGGGCGCAGGAGAGCTTGCTGTTACGAGGACTCCTGGGCGCAGGAGAGCTTGCACACGGCTGTATATTACTGTGCGAGAGAGACCCTGGTCACCGTCTCCTCA SEQ ID NO: 28323 |

FIGURE 50
(Continued)

| | | | |
|---|---|---|---|
| iPS:392714 | 21-225_16G12 | AA | DIQMTQSPSSLSASVGDRVTITCRASQGIRTDLG WYQQRPGKAPKRLIYTASSLQSGVPSRFSGSGSG TEFTLTISRLQPEDFATYYCLQHNGYPWTFGQGT KVEIK<br>SEQ ID NO: 24318 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELAW YEDSWGQGTLVTVSS<br>SEQ ID NO: 28324 |
| | | NA | GACATCCAGATGACCCAGTCTCCATCCTCACT GTCTGCATCTGTTGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGAGGC AGTGGATCTGGGACAGATTTCACTCTCACCAT CAGCAACCTGCAACAGTATCATAGTTTCCATTCA ATTACTGCCAACAGTATCATAGTTTCCCATTCA CTTTCGGCCCTGGGACCAAAGTGGATATCAAA<br>SEQ ID NO: 24319 | GAGGTGCAACTGTTGGAGTCGGGGGAGGCTTG GTACAGCCTGGGGGGTCCCTGAGACTCTCCTGTG CAGCCTCTGGATTCTCCTTTAGTAGCTATGCCAT GACCTGGGTCCGCCAGGCTCCAGGGAAGGGCT GGAGTGGGTCTCAACTATTAGTGGTCGTGGTGGT CACACATACTACGCAGACTCCGTGAGGGGCCGG TTCGCCATCTCCAGAGACAACAGCCTGAGAGCCGAGG TGTATCTGCAAATGAACAGCCTGAGAGCCGAGG ACACGGCCGTATATTACTGTGCGAAACAGGACTG CTGGGGCCAGGGAACCCTGGTCACCGTCTCCTCA<br>SEQ ID NO: 28325 |
| | | AA | DIQMTQSPSSLSASVGDRVTITCRASQDISNYLA WFQQKPGKAPKSLIYAASSLQSGVPSKFRGSGSG TDFTLTISNLQPEDFASYYCQQYHSFPFTFGPGTK VDIK<br>SEQ ID NO: 24320 | EVQLLESGGGLVQPGGSLRLSCAASGFSFSSYAMT WVRQAPGKGLEWVSTISGRGGHTYADSVRGRFA ISRDSSKNTLYLQMNSLRAEDTAVYYCAKQDCWG QGTLVTVSS<br>SEQ ID NO: 28326 |

FIGURE 50
(Continued)

| | | | |
|---|---|---|---|
| iPS:392716 | 21-225_17B5 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAATTCAGTTTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br><br>SEQ ID NO: 24321 | CAGGTGCAGTTGGTGGAGTCTGGGGGAGGCGTG GTCCAGCCTGGGAGGTCCCTGAGACTCTCCTG CAGCGTCTGGATTCACCTTCAGTGACTATGGCAT GCACTGGGTCCGCCAGGCTCCAGGCAAGGGCT GGAGTGGGTGGCAGTTATATGGTATGATGAAAGT AATAAACACTATATAGACTCCGTGAAGGGCCGA TTCACCATCTCCAGAGACAATTCCAAGAACACGC TGTATCTGCAAATGAACAGCCTGAGAGCCGAGG ACACGGCTGTGTATTATTGCGTGAGAGAACTGGG GTTCCGGTTTGACTACTGGGGCCAGGGAACCCTG GTCACCGTCTCCTCA<br><br>SEQ ID NO: 28327 |
| | | AA | DIQMTQSPSSLSASVGDRVTITCRASQGIRNDLG WYQQKPGKAPKRLIYAASNLQSGVPSRFSGSGS GTEFSFTISSLQPEDFATYYCLQHNSYPLTFGGGT KVEIK<br><br>SEQ ID NO: 24322 | QVQLVESGGGVVQPGRSLRLSCAASGFTFSDYGM HWVRQAPGKGLEWVAVIWYDESNKHYIDSVKGRF TISRDNSKNTLYLQMNSLRAEDTAVYYCVRELGFR FDYWGQGTLVTVSS<br><br>SEQ ID NO: 28328 |
| iPS:392718 | 21-225_17B8 | NA | GATATTGTGATGACTCAGTCTCCACTCTCCCTG CCCGTCACCCTGGAGAGCCGGCCTCCATCTC CTGTAGGTCTAGTCAGAGCCTCTGCATAGTA ATGGAACAACTCTTTGGATTGGTACCTGCAG AAGCCAGGCCAGTCTCCACAGCTCCTGATCTA TTTGGGTTCTCAGTGACAGTGGATCAGGCACAGAT ACAGGTTCAGTGACAGTGGATCAGGCACAGAT TTTACACTGAAAATCAGAGAGTGGAGGCTGA GGATGTTGGGGTTTATTACTGCATGCAAGTTC TACAAACTCCTCCCCTCACTTTCGGCGGAGGG ACCAAGGTGGAGATCAAA<br><br>SEQ ID NO: 24323 | CAGGTGCAGCTGGTGCAGTCTGGGGCTGAGGTG AAGAAGCCTGGGGCCTCAGTGAAGGTCTCCTGC AAGGCGTCTGGATACACCTTCACCAGCTATGCTA TCAACTGGGTGCGACAGGCCACTGGACAAGGGC TTGAGTGGATGGGATGGATGAACCTAACACTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTATATTTCTGTACGAGAAAGGCT GGGTTGACTACTGGGGCCAGGGAACCCTGGTCA CCGTCTCCTCA<br><br>SEQ ID NO: 28329 |

FIGURE 50
(Continued)

| | | | |
|---|---|---|---|
| iPS:392720 | 21-225_17A12 | AA | DIVMTQSPLSLPVTPGEPASISCRSSQSLLHSNGN NSLDWYLQKPGQSPQLLIYLGSHRASGVPDRFS DSGSGTDFTLKISRVEAEDVGVYYCMQVLQTPP LTFGGGTKVEIK<br>SEQ ID NO: 24324 | QVQLVQSGAEVKKPGASVKVSCKASGYTFTSYAIN WVRQATGQGLEWMGWMNPNTGNTGYAQKFQGR VTMTRNTSISTAYMELSSLRSEDTAVYFCTRKAGF DYWGQGTLVTVSS<br>SEQ ID NO: 28330 |
| | | NA | GACATCCAGATGACCCAGTCTCCATCCTCCCT GTCTGCATCTGTAGGAGACAGAGTCACCATCA CTTGCCGGGCAAGTCAGAGCATTAGTAGTTAT TTAAATTGGTATCACCAGAAACCAGGGAAAGC CCCTAAGCTCCTGATCTATGCTGCATCCAGTTT GCAAAGTGGGGTCCCATCAAGGTTCAGTGGCA GTGGATCTGGGACAGATTTCACTCTCACCATC AGCAATCTGCAACCTGAAGATTTTGCAACTTA CTACTGTCAACAGAGTTACAATACCCCTTAT TCACTTTCGGCCCTGGGACCAAAGTGGATATC AAA<br>SEQ ID NO: 24325 | GAGGTGCAGCTGTTGGAGTCTGGGGGAGGCTTG ATACAGCCTGGGGGGTCCCTGAGACTCTCCTGTG CAGCCTCTGAATTCACCTTTAGCAGCTATGCCAT GAGCTGGGTCCGCCAGGATCCAGGGAAGGGGCT GGAGTGGGTCTCAATTATTAGTGGTCGTGGGGGA AACGCATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGTCCCGTATAGCA GTGGCTGGCTCGGAGGCTTTTGATATCTGGGGCC AAGGGACAATGGTCACCGTCTCTTCA<br>SEQ ID NO: 28331 |
| | | AA | DIQMTQSPSSLSASVGDRVTITCRASQSISSYLNW YHQKPGKAPKLLIYAASSLQSGVPSRFSGSGSGT DFTLTISNLQPEDFATYYCQQSYNTPLFTFGPGT KVDIK<br>SEQ ID NO: 24326 | EVQLLESGGGLIQPGGSLRLSCAASEFTFSSYAMSW VRQDPGKGLEWVSIISGRGGNAFYADSVKGRFTISR DNSKNTLYLQMNSLRAEDTAVYYCASRIAVAGSE AFDIWGQGTMVTVSS<br>SEQ ID NO: 28332 |

FIGURE 50
(Continued)

| | | | |
|---|---|---|---|
| iPS:392722 | 21-225_18E12 | NA | GACATCCAGATGACCCAGTCTCCATCCTCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCTACGCTCCTGATCTATGCTGCATCCAGTT TACAAAGTGGGGTCCCATCAAGGTTCAGTGGC AGTGGATCTGGGACAGATTTCACTCTCACCAT CAACAGTCTGCAACCTGAAGATTTTGCAACTT ACTTCTGTCAACAGAGTTACAGAACCCCTTT TTCACTTTCGGCCCTGGGACCAAAGTGGATAT CAAA | GAGGTGCAGCTGGTGGAGTCTGGGGGAGGCTTG GTACAGCCTGGGGGGTCCCTGAGACTCTCCTGTG CAGCCTCTGAATTCACCTTTAGCAGCTATGCCAT GAGCTGGGTCCGCCAGGCTCCAGGGACGGGGCT GGAGTGGGTCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTCTGGCA GTGGCTGGCTCGGAGGCTTTTGATATCTGGGGCC AAGGGACGATGGTCACCGTCTCTTCA |
| | | | SEQ ID NO: 24327 |
| | | AA | DIQMTQSPSSLSASVGDRVTITCRASQSISSYLNW YQQKPGKAPTLLIYAASSLQSGVPSRFSGSGSGT DFTLTINSLQPEDFATYFCQQSYRTPFFTFGPGTK VDIK | EVQLLESGGGLVQPGGSLRLSCAASEFTFSSYAMS WVRQAPGTGLEWVSIISGRGGNTFYADSVKGRFTI SRDNSKNTLYLQMNSLRAEDTAVYYCASRLAVAG SEAFDIWGQGTMVTVSS |
| | | | SEQ ID NO: 24328 | SEQ ID NO: 28333 |
| iPS:392726 | 21-225_20B5 | NA | GACATCCAGATGACCCAGTCTCCATCCTCCT GTCTGCATCTGTAGGAGACAGAGTCACCATCA CTTGCCGGGCGAGTCAGGGCATTAACAGGCA TTAGCCTGGTATCAGCAGAAACCAGGGAAAAT TCCTAAGCTCCTGATCTATGCTGCATCCACTTT GCAATCAGGGGTCCCCTCTCGGTTCAGTGGCA GTGGATCTGGGACAGATTTCACTCTCACCATC AGCAGCCTGCAGCCTGAAGATTGTGCAACTTA TTGCTGTCAAAAGTATAACAGTGCCCCTCCGA TCACCTTCGGCCAAGGGACACGACTGGAGATT AAA | GAGGTGCAGCTGGTGGAGTCCGGGGGAGGCCTG GTCAAGCCGGGGGGGTCCCTGAGACTCTCCTGTG CAGCCTCTGGATTCACCTTCACCAGCTATAGCAT GAACTGGGTCCGCCAGGCTCCAGGGAAGGGGCT GGAGTGGGTCTCATCCATTAGTGGGAGTAGTAGT TACATATACTACCAGAGCCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGTGGG AGCTACTGGGGCCAGGGTACCCTGGTCACCGTCT CCTCA |
| | | | SEQ ID NO: 24329 | SEQ ID NO: 28335 |

FIGURE 50
(Continued)

| | | | | |
|---|---|---|---|---|
| iPS:392728 | | | AA | DIQMTQSPSSLSASVGDRVTITCRASQGINNYLA WYQQKPGKIPKLLIYAASTLQSGVPSRFSGSGSG TDFTLTISSLQPEDVATYCCQKYNSAPPITFGQGT RLEIK | EVQLVEAGGGLVKPGGSLRLSCAASGFTFSYSMN WVRQAPGKGLEWVSSISGSSSYIYYADSVKGRFTIS RDNAKNSLYLQMNSLRAEDTAVYYCARDRGSYW GQGTLVTVSS |
| | | | | SEQ ID NO: 24330 | SEQ ID NO: 28336 |
| | | | NA | GACATCCAGATGACCCAGTCTCCATCTTCCGT GTCTGCATCTGTAGGAGACGGAGTCACCATCA CTTGTCGGGCGAGTCAGGGTATTAGCAGCTGG TTAGCCTGGTATCAGCAGAAACCAGGGAAAG CCCCTAAACTCTTGATTTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCTCGG ACGTTCGGCCAAGGGACCAAGGTGGAAATCA AA | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTGACTACAT GAGCTGGATCCGCCAGGCTCCAGGGAAGGGGCT GGAGTGGGTTCACACATTAGTAGTAGTGGTAGT ACCATATACTACGCAGACTCTGTGAAGGGCCGAT TCACCATCTCCAGGGACAACAGCCTGGAGAACTCACT GTATCTGCAAATGAACAGCCTGAGAGCCGAGGA CACGGCCGTGTATTACTGTGCGAGATATCGAAT AACCGGGGGTACTTCGATCTCTGGGGCCGTGGCT CCCTGGTCACTGTCTCCTCA |
| | 21-225_20F7 | | | SEQ ID NO: 24331 | SEQ ID NO: 28337 |
| | | | AA | DIQMTQSPSSVSASVGDGVTITCRASQGISSWLA WYQQKPGKAPKLLIYAASSLQSGVPSRFSGSGS GTDFTLTISSLQPEDFATYYCQQANSFPRTFGQG TKVEIK | QVQLVESGGGLVKPGGSLRLSCAASGFTFSDYYMS WIRQAPGKGLEWVSHISSSGSTIYYADSVKGRFTIS RDNGENSLYLQMNSLRAEDTAVYYCARYRNNRG YFDLWGRGSLVTVSS |
| | | | | SEQ ID NO: 24332 | SEQ ID NO: 28338 |

FIGURE 50
(Continued)

| | | | |
|---|---|---|---|
| iPS:392730 | 21-225_17A1 | NA | GACATCCAGATGACCCAGTCCTCCATCCTCCT GTCTGCATCTGTAGGAGACAGAGTCACCATCA CCTGCCGGGCAAGTCAGAACATTAACAATTAT TTAAATTGGTATCAGCAGAAACCAGGGAAAG GCCCTAAGGTCCTGATCTTTACTACATCTAGTT TACAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACACTCACCCCACG TGGACGTTCGGCCAAGGGACCAAGGTGGAAA TCAAA<br>SEQ ID NO: 24333 | GAGGTGCAACTGTTGGAGTCTGGGGGAGGCTTG GTACAGCCTGGGGGGTCCCTGAGACTCTCCTGTG CAGCCTCTGATTCACCTTTAGCAGCTATGCCAT GAACTGGGTCCGCCAGGCTCCAGGGAAGGGGCT GGAGTGGGTCTCAGTTATTAGTGGTAGTGGTAGT AACACATACTACGCAGACTCCGTGAAGGGCGG TTCACCATCTCCAGAGACAATTCCAAGAACACGC TGTATCTGCAAATGAACAGCCTGAGAGCCGAGG ACACGGCCGTATATTACTGTGCGAAAAGATATAC CAGTGACTGGCATGATGCTTTTGATATCTGGGGC CAAGGGACAATGGTCACCGTCTCTTCA<br>SEQ ID NO: 28339 |
| | | AA | DIQMTQSPSSLSASVGDRVTITCRASQNINNYLN WYQQKPGKPGKPKVLIFTTSSLQSGVPSRFSGSGSG TDFTLTISSLQPEDFATYYCQQSYTTPTWFGQG TKVEIK<br>SEQ ID NO: 24334 | EVQLLESGGGLVQPGGSLRLSCAASGFTFSSYAMN WVRQAPGKGLEWVSVISGSGSNTYYADSVKGRFTI SRDNSKNTLYLQMNSLRAEDTAVYYCAKRYTSDW HDAFDIWGQGTMVTVSS<br>SEQ ID NO: 28340 |
| iPS:392732 | 21-225_17E5 | NA | GACATCCAGATGACCCAGTCTCCATCCTCCT GTCTGCATCTGTAGGAGACAGAGTCACCATCA CTTGCCGGGCAAGTCAGGGACAGATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAACATAATAGTTACCCGTTG ACGTTCGGCCAAGGGACCAAGGTGGTCATCAA A<br>SEQ ID NO: 24335 | CAGGTGCAACTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCACTTATATGGACTCCGTGAAGGGCCGA AATAAATACTATGGAGACTCCGTGAAGGGCCGA TTCACCATCTCCAGAGACAATTCCAAGAACAGC TGTATCTGCAACTGAACAGCCTGAGAGCCGAGG ACACGGCTGTGTATTACTGTGCGAGAGAGCTTGG CTGGTACGAGGACTACTGGGGCCAGGGAACCCT GGTCACCGTCTCCTCA<br>SEQ ID NO: 28341 |

FIGURE 50
(Continued)

| | | | | |
|---|---|---|---|---|
| iPS:392734 | 21-225_17D8 | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPLTFGPGTK VVIK<br>SEQ ID NO: 24336 | QVQLVESGGGVVQPGRSLRLSCAASGFTFSDYGM HWVRQAPGKGLEWVALIWYDVTNKYYGDSVKGR FTISRDNSQNTLYLQLNSLRAEDTAVYYCARELGW YEDYWGQGTLVTVSS<br>SEQ ID NO: 28342 |
| | | NA | GAAATAGTGATGACGCAGTCTCCATCCACCCT GTCTGTGTCTCCAGGGGAAAGAGCCACCCTCT CCTGCAGGGCCAGTCAGAGTGTTAGCAGCAAC TTAGCCTGGTTCCAGCAGAAACCTGGCCAGGC TCCCAGGCTCCTCATCAATGTGCATCCACCA GGGCCAGTGGTATCCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATAATAACTGGCCTCTG ACGTTCGGCCAAGGGACCAAGGTGGAAATCA AA<br>SEQ ID NO: 24337 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATGGCTT GAACTGGGTCCGCCAGGCTCCAGGGAAGGGGCT GGAGTGGGTCTCATCATTAGTGGTAGTGGTAGT CACATATCTACGCGGACTCAGTGAAGGGCCGAT TCACCATCTCCAGAGACAACGCCAAGAACTCACT GTATCTGCAACTGAACAGCCTGAGAGCCGAGGA CACGGCTGTGTATTACTGTGCGAGAGATCGGGGC AGTGGCTGGGGCCAGGGAACCCTGGTCACCGTCT CCTCA<br>SEQ ID NO: 28343 |
| | | AA | EIVMTQSPSTLSVSPGERATLSCRASQSVSSNLA WFQQKPGQAPRLLINGASTRASGIPARFSGSGSG TEFTLTISSLQSEDFAVYYCQQYNNWPLTFGQGT KVEIK<br>SEQ ID NO: 24338 | EVQLVESGGGLVKPGGSLRLSCAASGFTFSSYGLN WVRQAPGKGLEWVSSISGSGSHISYADSVKGRFTIS RDNAKNSLYLQLNSLRAEDTAVYYCARDRGSWG QGTLVTVSS<br>SEQ ID NO: 28344 |

FIGURE 50
(Continued)

| | | | |
|---|---|---|---|
| iPS:392736 | 21-225_17B12 | NA | GACATCCAGATGACCCAGTCTCCATCCTCCT GTCTGCATCTGTAGGAGACAGAGTCTCCATCA CTTGCCGGGCAAGTCAGAATATTAACAACTAT TTAAATTGGTATCAGCAGAAACCAGGGAAAG GCCCTAAGGTCCTGATCTTACTGCATCCAGTT TGCAAAGTGGGGTCCCATCAAGGTTCAGTGGC AGTGGATCTGGGACAGATTTCACTCTCACCAT CAGCAGTCTACAACCTGAAGATTTTGCAACTT ACTACTGTCAACAGACTTACACTCCCCCACG TGGACGTTCGGCCAAGGGACCAAGGTGAAA TCAAA<br><br>SEQ ID NO: 24339 | GAGGTGCAGCTGTTGGAGTCTGGGGGAGGCTTG GTACAGCCTGGGGGGTCCCTGAGACTCTCCTGTG TAGCCTTCTGGATTCACCTTTAGCAGCAGTATGCCAT GAACTGGGTCCGCCAGGCTCCAGGGAAGGGGCT GGAGTGGGTCTCAGTTATTAGTGGTAGTGGTGGT AGCACATACTACGCAGACTCCGTGAAGGGCCGG TTCACCATCTCCAGAGACAATTCCAAGAACACGC TGTATCTGCAAATGAACACCCTGAGAGCCGAGG ACACGGCCGTATATTACTGTGCGAAAGTATAC CAGTGACTGGCATGATGCTTTTGATATCTGGGGC CAAGGGACAATGGTCACCGTCTCTTCA<br><br>SEQ ID NO: 28345 |
| | | AA | DIQMTQSPSSLSASVGDRVSITCRASQNINNYLN WYQQKPGKSPKVLILTASSLQSGVPSRFSGSGSG TDFTLTISSLQPEDFATYYCQQTYTPTWTFGQG TKVEIK<br><br>SEQ ID NO: 24340 | EVQLLESGGGLVQPGGSLRLSCVASGFTFSSYAMN WVRQAPGKGLEWVSVISGSGSTYYADSVKGRFTI SRDNSKNTLYLQMNTLRAEDTAVYYCAKRYTSDW HDAFDIWGQGTMVTVSS<br><br>SEQ ID NO: 28346 |
| iPS:392738 | 21-225_18G4 | NA | GACATCCACATGACCCAGTCTCCATCCTCCCT GTCTGCATCTGTAGGAGACAGAGTCACCATCA CTTGCCGGGCAAGTCAGAGCATTATCAGCTAT TTAAATTGGTATCAGCAGAAACCAGGGAAAG CCCCTAAGGTCCTGATCTATACTGCATCCAGTT TGCAAACTGGGGTCCCATCAGGTTCAGTGGC AGTGGATCTGGGACAGATTTCACTCTCACCAT CAGCAGTCTGCAACTGAAGATTACACTGTTAT ACTACTGTCAACAGACTTACAGTGTCCCCGTC ACTTTCGGCGGTGGGACCAAGGTGGAGATCAA A<br><br>SEQ ID NO: 24341 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAACAGCCAAGAACACGC TGTATCTGCAAATGAACAGCCTGAGAGCCGAGG ACACGGCTGTGTATTACTGTGCGAGAGATCTGAG TATGGGCGGTATGGACGTCTGGGGCCAAGGGAC CACGGTCACCGTCTCCTCA<br><br>SEQ ID NO: 28347 |

FIGURE 50
(Continued)

| | | | |
|---|---|---|---|
| | | AA | DIHMTQSPSSLSASVGDRVTITCRASQSIISYLNW YQQKPGKAPKVLIYTASSLQTGVPSGFSGSGSGT DFTLTISSLQPEDFATYYCQQTYSPPLTFGGGTK VEIK | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCARDLSMG GMDVWGQGTTVTVSS |
| | | | SEQ ID NO: 24342 | SEQ ID NO: 28348 |
| iPS:392740 | 21-225_18H12 | NA | GACATCCAGATGACCCAGTCTCCATCCTCCCT GTCTGCGTCTCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATACTGCATCCAAT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAATTACCCGTG GACGTTCGGCCCTAGGGACCAAGGTGGTCATCA AA | CAGGTGCAACTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGATGGCAGTTATATGGTATGATGTAACT AATAAATACTATGCAGACTCCGTGAAGGGCGA TTCCACCATCTCCAGAGACAATTCCAAGAACACGC TGTATCTGCAAATGAACAGCCTGAGAGCCGAGG ACACGGCTGTTTATTACTGTGCGAGAGAGGTTGG CTGGTACGAGGACTACTGGGGCCAGGGAACCCT GGTCACCGTCTCCTCA |
| | | | SEQ ID NO: 24343 | SEQ ID NO: 28349 |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHNNYPWTFGLG TKVVIK | QVQLVESGGGVVQPGRSLRLSCAASGFTFSDYGM HWVRQAPGKGLEWMAVIWYDVTNKYYADSVKG RFTISRDNSKNTLYLQMNSLRAEDTAVYYCAREVG WYEDYWGQGTLVTVSS |
| | | | SEQ ID NO: 24344 | SEQ ID NO: 28350 |

FIGURE 50
(Continued)

| | | | | |
|---|---|---|---|---|
| iPS:392742 | 21-225_20B2 | NA | GACATCCAGATGACCCAGTCCATCCTCCT GTCTGCCTCTGTAGGAGACAGAGTCAATATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACGA TCAGCAGCCTGCAGCCTGAAGATTTTGCAACT TATTACTGTCTACAGCATTATAATTACCCTCGG GCGTTCGGCCAGGGGACCAAGGTGGATATCA AA | CAGGTGCAACTGGTGGAGTCTGGGGAGGCGTG GTCCAGCCTGGGAGGTCCCTGAGACTCTCCTGTG CAGCGTCTGATTCACCTTCAGTAATTATGTCATT CACTGGGTCCGCCAGGCTCCAGGCAAGGGACTG GAGTGGGTGGCAGTTATATGTGTATGATGAAGTA ATAAATACTATGCAGAGACTCCGTGAAGGGCGCTT CACCATTCCAGAGACAATTCCAAGAACACGCTG TATCTGCAAATGAACAGCCTGAGAGCCGAGGAC ACGGCTGTGTATTCCTGTGCGAGAGAAGTATA GCAGCAGCTGGTACGACTACGGTATGGACGTCTG GGGCCAAGGGACCACGGTCACCGTCTCCTCA |
| | | | SEQ ID NO: 24345 | SEQ ID NO: 28351 |
| | | AA | DIQMTQSPSSLSASVGDRVNITCRASQDIRNDLG WYQQKPGKAPKRLIYAASSLQSGVPSRFSGSGS GTEFTLTISSLQPEDFATYYCLQHYNYPRAFGQG TKVDIK | QVQLVESGGGVVQPGRSLRLSCAASGFTFSNYVIH WVRQAPGKGLEWVAVIWYDGSNKYYADSVKGRF TISRDNSKNTLYLQMNSLRAEDTAVYSCAREKYSS SWYDYGMDVWGQGTTVTVSS |
| | | | SEQ ID NO: 24346 | SEQ ID NO: 28352 |
| iPS:392744 | 21-225_20D5 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGGCT GGAGTGGGTGGCAGTTATTTGGTATGAAGAAAAT TCACCATTCCAGAGACACTCCGTGAAGGGCCGAT GTATCTGCAAATGAACAGCCTGAGAGCCGACGA CACGGCTGTGTATTACTGTGCGAGAGAACTGGGG TTCCGGTCTGACTACTGGGGCCAGGGAACCCTGG TCACCGTCTCCTCA |
| | | | SEQ ID NO: 24347 | SEQ ID NO: 28353 |

FIGURE 50
(Continued)

| | | | |
|---|---|---|---|
| iPS:392746 | 21-225_20H7 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGGGT KVEIK<br>SEQ ID NO: 24348 | QVQLVESGGGVVQPGRSLRLSCAASGFTFSSYGMH WVRQAPGKGLEWVAVIWYEENNQYYADSVKGRF TISRDNSKNTLYLQMNSLRADDTAVYYCARELGFR SDYWGQGTLVTVSS<br>SEQ ID NO: 28354 |
| | | NA | GACATCCAGATGACCCAGTCTCCATCCTCACT GTCTGCATCTGTAGGAGACAGAGTCACCATCA CTTGTCGGACGAGTCAGGCATTAGAGTAATTAT TTAGTCTGGTTTCAGCAGAAACCAGGGAAAGC CCCTAAGCGCCTGATCTATGCTGCATCCAGTT TGCAAAGTGGGGTCCCATCAAAGTTCAGCGGCA GTGGATCTGGGACAGAGATTCACTCTCACCATC AGCAGCCTGCAGCCTGAAGATTTTGCAACTTA TTACTGCCAACACAGTATTATAGTTACCCATTCAC TTTCGGCCCTGGGACCAAAATGGATTTCAAA<br>SEQ ID NO: 24349 | GAGGTGCACCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TTCATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGTAGCAGCT CTTGACTACTGGGGCCAGGGAACCCTGGTCACCG TCTCCTCA<br>SEQ ID NO: 28355 |
| | | AA | DIQMTQSPSSLSASVGDRVTITCRTSQGINNYLV WFQQKPGKAPKRLIYAASSLQSGVPSKFSGSGSG TDFTLTISSLQPEDFATYYCQQYYSYPFTFGPGT KMDFK<br>SEQ ID NO: 24350 | EVHLVESGGGLVKPGGSLRLSCAASGFTFSSYSMN WVRQAPGKGLEWVSSISGSSSFIYYADSVKGRFTIS RDNAKNSLYLQMNSLRAEDTAVYYCARVAALDY WGQGTLVTVSS<br>SEQ ID NO: 28356 |

FIGURE 50
(Continued)

| | | | |
|---|---|---|---|
| iPS:392748 | 21-225_20A8 | NA | GACATCCAGATGACCCAGTCTCCATCCTCACT GTCTGCATCTGTAGGAGACAGAGTCACCATCA CTTGTCGGGCGAGTCAGGGCATTAATAATTAT TTAGTCTGGTTTCAGCAGAAACCAGGGAAAGC CCCTAAGTCCCTGATCTATGCTGCATCCAGTT GCTGAGTGGGGTCCCATCAAGTTCAGGGGCA GTGGATCTGGGACAGATTTCACTCTCACCATC AGCAGCCTGCAGCCTGAAGATTTTGCAACTTA TTACTGCCAACAGTATAATAGTTACCCGATCA CCTTCGGCCAAGGGACACGACTGGAGATTAAA <br> SEQ ID NO: 24351 | GAGGTGCAGCTGGTGGAGTCTGGGGGAGGCTG GTCAAGCCTGGGGGGTCCCTAAGACTCTCCTGTG CAGCCTCTGGATTCACCTTCAGTAGCTATAGCGT GAACTGGGTCCGCCAGGCTCCAGGGAAGGGGCT GGAGTGGGTCTCATCCATTAGTAGTAGTAGTAGT TCCTATACTACGCAGAGTCACTGTGAAGGGCCGAT TCACCATCTCCAGAGACAACGCCAAGAACTCAGT GTATCTGCAAATGAACAGCCTGAGAGCCGAGGA CACGGCTGTATATTACTGTGCGAGAAACTGGGAC TACTGGGGCCAGGGAACCCTGGTCACCGTCTCCT CA <br> SEQ ID NO: 28357 |
| | | AA | DIQMTQSPSSLSASVGDRVTITCRASQGINNYLV WFQQKPGKAPKSLIYAASSLSGVPSKFSGSGSG TDFTLTISSLQPEDFATYYCQQYNSYPITFGQGTR LEIK <br> SEQ ID NO: 24352 | EVQLVESGGGLVKPGGSLRLSCAASGFTFSSYSVN WVRRAPGKGLEWVSSISSSSFLYYADSVKGRFTIS RDNAKNSVYLQMNSLRAEDTAVYYCARNWDYW GQGTLVTVSS <br> SEQ ID NO: 28358 |
| iPS:392750 | 21-225_20A10 | NA | GACATCCAGATGACCCAGTCTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACAAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACCA TCAGCAGCCTGCAGCCTGAAGATTTTGCAACT TATTACTGTCTACAGCATAATAGATACCCGCT CACTTTCGGCGGAGGGACCAAGGTGGAGATC AAA <br> SEQ ID NO: 24353 | CAGGTGCAGCTGGTGGAGTCTGGGGGAGGCGTG GTCCAGCCTGGGAGGTCCCTGAGACTCTCCTGTG CAGCGTCTGGATTCACCTCAGTAGCGATGACAT GCACTGGGTCCGCCAGGCTCCAGGCAAGGGGCT GGAGTGGGTGGCAGTTATATGGTTTGATGGAAGT AATAAATACTATGCAGACTCCGTGAAGGGCCGA TTCACTATCTCCAGAGACAATTCCAAGAACACGC TGTATCTGCAAATGAACAGCCTGAGAGCCGAGG ACACGGCTATGTATTACTGTGCGAGAGATCTAAT AGCAGCAGCTGGTACGGTTGACTACTGGGGCCA GGGAACCCTGGTCACCGTCTCCTCA <br> SEQ ID NO: 28359 |

FIGURE 50
(Continued)

| | | | |
|---|---|---|---|
| | | AA | DIQMTQSPSSLSASVGDRVTITCRASQGIRNDLG WYQQKQGKAPKRLIYAASSLQSGVPSRFSGSGS GTEFTLTISSLQPEDFATYYCLQHNRYPLTFGGG TKVEIK<br><br>SEQ ID NO: 24354 | QVQLVESGGGVVQPGRSLRLSCAASGFTLSSDDMH WVRQAPGKGLEWVAVIWFDGSNKYYADSVKGRFI ISRDNSKNTLYLQMNSLRAEDTAMYYCARDLIAAA GTVDYWGQGTLVTVSS<br><br>SEQ ID NO: 28360 |
| iPS:392754 | 21-225_21D3 | NA | GACATCCAGATGACCCAGTCTCCATCCTCCCT GTCTGCATCTGTAGGAGACAGAGTCACCATCA CTTGCCGGGCAAGTCAGAGACAGCATTACTGGTTAT TCAAATTGGTATCAGCAGAAGCCAGGAAAA CCCCTAAACTCCTGATCTTTGCTACATACAGTT TGGAAAGTGGGGTCCCATCAAGGTTCAGTGGC AGTGGATTGGGACAAATTCACTCTCACCAT CACCAGTCTGCAACCTGAAGATTTTGCAACTT ACTACTGTCAACAGAGTTACAGTACCTCGATC ACCTTCGGCCAAGGGACACGACTGGAGATTAA A<br><br>SEQ ID NO: 24355 | CAGGTGCAGCTGGTGGAGTCTGGGGGAGGCGTG GTCCAGCCTGGGAGGTCCCTGAGACTCTCCTGTG TTGCCTCTGGATTCACCTTCAGTAGTAGTGCAT GCACTGGGTCCGCCAGGCTCCAGGCAAGGGCT GGAGTGGGTGACAGTTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGGGTATG GTTCGGGGACCTCTGGGGCCAGGGAACCCTGTC ACCGTCTCCTCA<br><br>SEQ ID NO: 28361 |
| | | AA | DIQMTQSPSSLSASVGDRVTITCRASQSITGYSN WYQQKPGKTPKLLIFATYSLESGVPSRFSGSGFG TNFTLTITSLQPEDFATYYCQQSYSTSITFGQGTR LEIK<br><br>SEQ ID NO: 24356 | QVQLVESGGGVVQPGRSLRLSCVASGFTFSSYGMH WVRQAPGKGLEWVTVISYDGSNKYYADSVKGRFT ISRDNSKNTLYLQMNSLRAEDTAVYYCARGVWFG DLWGQGTLVTVSS<br><br>SEQ ID NO: 28362 |

FIGURE 50
(Continued)

| | | | | |
|---|---|---|---|---|
| iPS:392758 | 21-225_21G11 | NA | GACATCCAGATGACCCAGTCTCCATCCTCCT GTCTGCGTCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATACTGCATCCAGT TGCAAAGTGGGGTCCCATCCAAGGTTCAGCGG CAGTGGATCTGGGACAGAATTCACTCTCACAA TCAGCAGCCTGCAGCCTGAAGATTTTGCAACT TATTACTGTCTACAACATAATAATTACCCGTG GACGTTCGGCCTAGGGACCAAGGTGGTCATCA AA | CAGGTGCAACTGGTGGAGTCTGGGGGAGGCGTG GTCCAGCCTGGGAGGTCCCTGAGACTCTCCTG CAGCGTCTGATTCACCTTCAGTGACTATGGCAT GCACTGGGTCCGCCAGGCTCCAGGCAAGGGCT GGAGTGGATGGCAGTTATATGGTATGATGTAACT AATGAATACTATGCAGACTCCGTGAAGGGCGA TTCACCATCTCCAGAGACAATTCCAAGAACAGC TGTATCTGCAAATGAACAGCCTGAGAGCCGAG ACACGGCTGTTTATTACTGTGCGAGAGAGTTGG CTGGTACGAGGACTACTGGGGCCAGGGAACCCT GGTCACCGTCTCCTCA |
| | | | SEQ ID NO: 24357 | SEQ ID NO: 28363 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNNYPWTFGLGT KVVIK | QVQLVESGGGVVQPGRSLRLSCAASGFTFSDYGM HWVRQAPGKGLEWMAVIWYDVTNEYYADSVKG RFTISRDNSKNTLYLQMNSLRAEDTAVYYCARELG WYEDYWGQGTLVTVSS |
| | | | SEQ ID NO: 24358 | SEQ ID NO: 28364 |
| iPS:392760 | 21-225_22G3 | NA | GACATCCAGATGACCCAGTCTCCATCCTCCCT GTCTGCATCTGTAGGAGACAGAGTCACCATCA CTTGCCGGGCAAGTCAGAGCATTAGTAATTAT TTAAATTGGTATCAGCAGAAACCAGGGAAAG CCCCTAAGCTCCTGATCTTTGCTGCTTCCAGT TGCAAAGTGGGGTCCCATCCAAGGTTCAGTGGC AGTGGATCTGGGACAAACCTGAAGATTTCACCAT CAGCGGTCTACAACCTGAAGATTTTGCAACTT ACTTCTGTCAACAGAGTTTCAGAACCCCTTT TCACTTTCGGCCCTGGGACCAAAGTGGATATC AAA | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGGCT GGAGTGGGTCTCAATTATTAGTGGTCGTGGTGTT AACACATTCTACCCAGAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGCTCGGAGGTTTGATATCTGGGGCC AAGGGACAATGGTCACCGTCTCTTCA |
| | | | SEQ ID NO: 24359 | SEQ ID NO: 28365 |

FIGURE 50
(Continued)

| | | | | |
|---|---|---|---|---|
| | | AA | DIQMTQSPSSLSASVGDRVTITCRASQSISNYLN WYQQKPGKAPKLLIFAASSLQSGVPSRFSGSGSG TDFTLTISGLQPEDFATYFCQQSFRTPFFTFGPGT KVDIK | EVQLLESGGGLVQPGGSLRLSCAASEFTFSSYAMN WVRQAPGKGLEWVSIISGRGVNTFYADSVKGRFTI SRDNSKNTLYLQMNSLRAEDTAVYYCASRLAVAG SEAFDIWGQGTMVTVSS |
| | | | SEQ ID NO: 24360 | SEQ ID NO: 28366 |
| iPS:392762 | 21-225_22G5 | NA | GACATCCAGATGACCCAGTCTCCATCCTCCCT GTCTGCATCTGTAGGAGACAGAGTCACCATCA CTTGCCGGGCAAGTCAGAGCATTAGCAGTAT TTAAATTGGTATCAGCAGAAACAAGGGAAAG CCCCTAAGCTCCTGATCTATGCTGCATCCAGTT TGCAAAATGGGGTCCCATCAAGGTTCAGTGGC AGAGGATCTGGGACAGATTTCACTCTCACCAT CAGTAGTCTGCAACCTGAAGATTTTGCAACTT ACTACTGTCAACAGAGAGTTACAGAACCCCTTA TTCACTTTCGGCCCTGGGACCAAGGTTGATTTC AAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGATGGGGCT GGAGTGGGTCTCAGTTATTAGTCGTAGTGGTGGT TACACATACTACGCGACTCCGTGAAGGGCCGGT TCACCATCTCCAGAGACAATTCCAAGAACACGCT GTATCTGCAAATGAACAGCTGAGAGCCGAGGA CACGGCCGTCTATTACTGTGCGCCCGTTTAGCA GTGGCTGGCTCGGAGGCTTTGATATCTGGGGCC AAGGGACACTGGTCACCGTCTCTTCA |
| | | | SEQ ID NO: 24361 | SEQ ID NO: 28367 |
| | | AA | DIQMTQSPSSLSASVGDRVTITCRASQNISSYLN WYQQKPGKQGKAPKLLIYAASSLQNGVPSRFSGRGS GTDFTLTISSLQPEDFATYCQQSYRTPLFTFGPG TKVDFK | EVQLLESGGGLVQPGGSLRLSCAASGFTFSSYAMN WVRQAPGMGLEWVSVISRSGGYTYYADSVKGRFT ISRDNSKNTLYLQMNSLRAEDTAVYYCASRLAVAG SEAFDIWGQGTLVTVSS |
| | | | SEQ ID NO: 24362 | SEQ ID NO: 28368 |

FIGURE 50
(Continued)

| | | | | |
|---|---|---|---|---|
| iPS:392764 | 21-225_22G10 | NA | GACATCCAGATGACCCAGTCTCCATCCCCT GTCTGCATCTGTAGGAGACAGAGTCACCATCA CTTGCCGGGCAAGTCAGAGCATTTTCAGCTAT TTAAATTGGTATCAGCAGAAACCAGGGAAAG CCCCTAAACTCCTGATCTATGCTGCATCCAGTT TACAAAGTGGGGTCCCATCAAGGTTCAGTGGC AGTGGATCTGGGACAGATTTCACTCTCACCAT CAGCAGTCTCCAACCTGAAGATTTTGCAACTT ACTTCTGTCAACAGAGTTTCAGAACCCCTTA TTCACTTTCGGCCCTGGGACCAAGGTGTGAT TTCAAA SEQ ID NO: 24363 | GAGGTGCAGCTGTTGGAGTCTGGGGGAGACTTG GTACAGCCTGGGGGGTCCCTGAGACTCTCCTGTA CAGCCTCTGATTCACCTTTAGCAGCTATGCCAT GAACTGGGTCCGCCAGGCTCCAGGGAAGGGCT GGAGTGGGTCTCAGTTATTAGTGGTAGTGGTGT AACACATTCTACGCAGACTCCGTGAAGGGCCGAT TCACCATCTCCAGAGACAATTCCAAGAACACGCT GTTTCTGCACATGAACAGCCTGAGAGCCGAGGA CACGGCCGTTTATTACTGTGCGTCCCGTATGGCA GTGGCTGGCTCGGAGGCTTTTGATATCTGGGGCC AAGGGACAATGGTCACCGTCTCTTCA SEQ ID NO: 28369 |
| | | AA | DIQMTQSPSSLSASVGDRVTITCRASQSIFSYLNW YQQKPGKAPKLLIYAASSLQSGVPSRFSGSGSGT DFTLTISSLQPEDFATYFCQQSFRTPLFTFGPGTK VDFK SEQ ID NO: 24364 | EVQLLESGGDLVQPGGSLRLSCTASGFTFSSYAMN WVRQAPGKGLEWVSVISGSGNTFYADSVKGRFTI SRDNSKNTLFLHMNSLRAEDTAVYYCASRMAVAG SEAFDIWGQGTMVTVSS SEQ ID NO: 28370 |
| iPS:392766 | 21-225_23H4 | NA | GACATCCAGATGACCCAGTCTCCATCCCCT GTCTGCATCTGTAGGAGACAGAGTCACCATCA CTTGCCGGGCAAGTCAGAGCATTAGCAGTAT TTAAATTGGTATCAGCAGAAACCAGGGAAAG CCCCTAAACTCCTGATCTATGCTTCTACATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ATTACTGTCAACAGAGTACAGTACCCCACG TGGACGTTCGGCCAAGGGACCAAGGTGGAA TCAGA SEQ ID NO: 24365 | GAGGTGCAGCTGTTGGAGTCTGGGGGAGGCTTG GTACAGCCTGGGGGGTCCCTGAGACTCTCCTGTG CAGCCTCTGATTCACCTTTAGCAGCTATGCCAT GAACTGGGTCCGCCAGGCTCCAGGGAAGGGGCT GGAGTGGGTCTCAGTTATTAGTGGTAGTGGTGGT ACCACATACTTCGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAAAGAAATAG CAGTGGCTGGCATGATGTTTTGATATCTGGGGC CAAGGGACAAAGGTCACCGTCTCTTCA SEQ ID NO: 28371 |

FIGURE 50
(Continued)

| | | | | |
|---|---|---|---|---|
| iPS:392768 | 21-225_20B8 | AA | DIQMTQSPSSLSASVGDRVTITCRASQSISRYLN WYQQKPGKAPKLLICSTSSLQSGVPSRFSGSGSG TDFTLTISSLQPEDFATYYCQQSYSTPTWTFGQG TKVEIR<br><br>SEQ ID NO: 24366 | EVQLLESGGGLVQPGGSLRLSCAASGFTFSSYAMN WVRQAPGKGLEWVSVISGSGGTTYFADSVKGRFTI SRDNSKNTLYLQMNSLRAEDTAVYYCAKRNSSGW HDVFDIWGQGTKVTVSS<br><br>SEQ ID NO: 28372 |
| | | NA | GAAATAGTGATGACGCAGTCTCCATCCACCCT GTCTGTGTCTCCAGGGGAAAGAGTCACCCTCT CTTGCAGGGCCAGTCAGAGTGTTAGCAGCAAC TTAGCCTGGTTTCAGCAGAAACCTGGCCAGGC TCCCAGGCTCCTCATCAATGTGCATCCACCA GGGCCAGTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATAATAACTGTCCTCTG ACGTTCGGCCAAGGGACCAAGGTGGAAATCA AA<br><br>SEQ ID NO: 24367 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCATCATCAGTGGCAGTGGTAGT CACATATACTACGCGACTCAGTCAAGGGCCGA TTCACCATCTCCAGAGACAACGCCAAGAACTAC TGTATCTGCAAATGAACAGCCTGAGAGCCGAGG ACACGGCTGTGTATTACTGTGCGAGAGATCGGGG CAGTGGCTGGGGCCAGGGAACCCTGGTCACCGT CTCCTCA<br><br>SEQ ID NO: 28373 |
| | | AA | EIVMTQSPSTLSVSPGERVTLSCRASQSVSSNLA WFQQKPGQAPRLLINGASTRASGIPARFSGSGSG TEFTLTISSLQSEDFAVYYCQQYNNCPLTFGQGT KVEIK<br><br>SEQ ID NO: 24368 | EVQLVESGGGLVKPGGSLRLSCAASGFTFSSYSMN WVRQAPGKGLEWVSSISGSGSHIYYADSVKGRFTIS RDNAKNSLYLQMNSLRAEDTAVYYCARDRGSGW GQGTLVTVSS<br><br>SEQ ID NO: 28374 |

FIGURE 50
(Continued)

| | | | | |
|---|---|---|---|---|
| iPS:392770 | 21-225_20C10 | NA | GACATCCACAATGACCCAGTCTCCATCCTCCT GTCTGCATCTGTGGAGACAAAGTCTCCATCA CTTGCCGGGCAAGTCACCATTAGCAACTAT TTAAATTGGTATCAGCAGAAACCAGGGAAAG GCCCTAAGGTCCTGATCCTTACTGCATCCAGTT TGCAAAGTGGGGTCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACACTACCCCCACG TGGACGTTCGGCCAAGGGACCAAGGTGGAAA TCAAA | GAGGTGCAGCTGTGGAGTCTGGGGGAGGCTTG GTACAGCCTGGGGGGTCCCTGAGACTCTCCTGTG CAGCCTCTGATTCACTTTAGCAGCTATGCCAT GAACTGGGTCCGCCAGGCTCCAGGGAAGGGGCT GGAGTGGGTCTCAGTTATTAGTGGTAGTGGTGGT ACCACATACTACGCAGACTCCGTGAAGGGCCGG TTCACCATCTCCAGAGACAATTCCAAGAACACGC TGTATCTGCAAATGAACACCCTGAGAGCCGAGG ACACGGCCGTATATTACTGTGCGAAAAGTATAC CAGTGACTGGCATGATGCTTTTGATATCTGGGGC CAAGGGACAATGGTCACCGTCTCTTCA |
| | | | SEQ ID NO: 24369 | SEQ ID NO: 28375 |
| | | AA | DIHMTQSPSSLSASVGDKVSITCRASHHISNYLN WYQQKPGKPKVLILTASSLQSGVPSRFSGSGSG TDFTLTISSLQPEDFATYYCQQSYTTPTWTFGQG TKVEIK | EVQLLESGGGLVQPGGSLRLSCAASGFTFSSYAMN WVRQAPGKGLEWVSVISGSGGTTYYADSVKGRFTI SRDNSKNTLYLQMNTLRAEDTAVYYCAKRYTSDW HDAFDIWGQGTMVTVSS |
| | | | SEQ ID NO: 24370 | SEQ ID NO: 28376 |
| iPS:392772 | 21-225_20E12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTTTGCTGCATCCAGTT TACAAAGTGGGGTCCCATCAAGGTTCAGCGGC AGTGGATCTGGGACAGCAATTCACTCTCACAAT CAGCAGCCTGCAGCCTGAAGATTTTGCAACTT ATTACTGTCTACAGCATAATAGTTACCCGTTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATGTGGTATGATGGAAGT AATAAACACTATGCAGACTCCGTGAAGGGCCGA TTCACCATCTCCAGAGACAATGCCAAGAACAGC TGTATCTGCAAATGAACAGCCTGAGAGCCGAGG ACACGGCTGTGTATTACTGTGCGAGAGAACTGGG GTTCCGGTTTGACTACTGGGGCCAGGGAACCCTG GTCACCGTCTCCTCA |
| | | | SEQ ID NO: 24371 | SEQ ID NO: 28377 |

FIGURE 50
(Continued)

| | | | | |
|---|---|---|---|---|
| iPS:392774 | | AA | DIQMTQSPSSLSASVGDRVTITCRASQGIRNDLGWYQQKPGKAPKRLIFAASSLQSGVPSRFSGSGSGTEFTLTISSLQPEDFATYYCLQHNSYPFTFGGGTKVEIK | QVQLVESGGGVVQPGRSLRLSCAASGFTFSSYGMHWVRQAPGKGLEWVAVMWYDESNKHYADSVKGRFTISRDNSRNTLYLQMNSLRAEDTAVYYCARELGFRFDYWGQGTLVTVSS |
| | | | SEQ ID NO: 24372 | SEQ ID NO: 28378 |
| | 21-225_21F3 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATTTCATTCTCACAATCAGCAGCCTGCAGCCTGAAGATTTTGCAACTTATTACTGTCTACAGCATATAGTTACCCCTCACTTTCGGCGGAGGGACCAAGGTGGAGATCAAA | CAGCTGCAGCTGCAGGAGTCGGGCCCAGGACTGGTGAAGCCTGCGGAGACCCTGTCCCTCACCTGCACTGTCTCTGGTGGCTCCATCAGCAGAAGTAGTTACTACTGGGGCTGGATCCGCCAGCCCCCAGGGAAGGGTGCTGGAGTGGATTGGGAGCATCTATTATAGTGGGAGCACCTACTACAACCCGTCCCTCAAGAGTCGAGTCACCATATCCGTGGACACGTCCAAGAACCAGTTCTCCCTGAAGCTGAGCTCTGTGACCGCCGCAGACACGGCTGAGTATTACTGTGCGAGCTTAGCAGCAGCTGGGACTTCCAGCACTGGGGCCAGGGCACCCTGGTCACCGTCTCCTCA |
| | | | SEQ ID NO: 24373 | SEQ ID NO: 28379 |
| | | AA | DIQMTQSPSSLSASVGDRVTITCRASQGIRNDLGWYQQKPGKAPKRLIYAASSLQSGVPSRFSGSGSGTDFTLTISSLQPEDFATYYCLQHSSYPLTFGGGTKVEIK | QLQLQESGPGLVKPAETLSLTCTVSGGSISRSSYYWGWIRQPPGKVLEWIGSIYYSGSTYYNPSLKSRVTISVDTSKNQFSLKLSSVTAADTAEYYCASLSSSWDFQHWGQGTLVTVSS |
| | | | SEQ ID NO: 24374 | SEQ ID NO: 28380 |

FIGURE 50
(Continued)

| | | | |
|---|---|---|---|
| iPS:392776 | 21-225_21A12 | NA | GACATCCAGATGACCCAGTCTCCATCCTCACT GTCTGCATCTGTGGGAGACAGAGTCACCATCA CTTGTCGGGCGAGTCAAGGCATTAGCAGTAT TTAGCCTGGTTTCAGCAGAAACCAGGGAAAGC CCCTAAGTCCCTGATCTATGCTGCATCCAGTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATAATAGTTACCCGTTCA GGTTTGGCCAGGGGACCAAGCTGGAGATCAA A<br><br>SEQ ID NO: 24375 | GAGGTGCAGCTGGTGGAGTCTGGGGGAGGCTG GTCAAGCCTGGGGGGTCCCTGAGACTCTCCTGTG CAGCCTCTGGATTCACCTTCAATAGCTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTCTGTATTACTGTGCGAGAGCGGCTGGC TTTGACTACTGGGGCCAGGGAACCCTGGTCACCG TCTCCTCA<br><br>SEQ ID NO: 28381 |
| | | AA | DIQMTQSPSSLSASVGDRVTITCRASQGISKYLA WFQQKPGKAPKSLIYAASSLQSGVPSKFSGSGSG TDFTLTISSLQPEDFATYYCQQYNSYPFRFGQGT KLEIK<br><br>SEQ ID NO: 24376 | EVQLVESGGGLVKPGGSLRLSCAASGFTFNSYSMN WVRQAPGKGLEWVSSISGSSSYIYYADSVKGRFTIS RDNAKNSLYLQMNSLRAEDTALYYCARAAGFDY WGQGTLVTVSS<br><br>SEQ ID NO: 28382 |
| iPS:392778 | 21-225_22H3 | NA | GACATCCAGATGACCCAGTCTCCATCCTCCCT GTCTGCATCTGTAGGAGACAGAGTCACCATCA CTTGCCGGGCAAGTCAGGACATTAGAAATAAT TTAGGCTGGTATCAGCAGAAACCAGGGAAAG CCCCTAAGCTCCTGATCTATCCTGCATCCAGTT TGCAAACTGGGGTCCCATCAAGGTTCAGCGGC AGTGGATCTGGGACAGATTCACTCTCACAAT CAGCAGCCTGCAGCCTGAAGATTTTGCAACTT ATTTCTGTCTACAGGATAATAGTTACCCATTCA CTTTCGGCCCTGGGACCAAAGTGGATATCAAA<br><br>SEQ ID NO: 24377 | GCGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTGTTTTACTGTGCGAGAGATAGGGGC AGCCCTCTGGGGCCAGGGAACCCTGGTCACCGTCT CCTCT<br><br>SEQ ID NO: 28383 |

FIGURE 50
(Continued)

| | | | | |
|---|---|---|---|---|
| iPS:392780 | 21-225_22B7 | AA | DIQMTQSPSSLSASVGDRVTITCRASQDIRNNLGWYQQKPGKAPKRLIYPASSLQTGVPSRFSGSGSGTEFTLTISSLQPEDFATYFCLQDNSYPFTFGPGTKVDIK<br>SEQ ID NO: 24378 | AVQLVESGGGLVKPGGSLRLSCAASGFTFSSYSMNWVRQAPGKGLEWVSSISSSSYIYYADSVKGRFTISRDNAKNSLYLQMNSLRAEDTAVFYCARDRGSLWGQGTLVTVSS<br>SEQ ID NO: 28384 |
| | | NA | GACATCCAGATGACCCAGTCTCCATCCTCCCTGTCTGCATCTGTAGGAGACAGAGTCACCATCACTTGCCGGGCAAGTCAGGACATTAGAAATGATTTAGGCTGGTATCAGCAGAAACCAGGGAAAGCCCCTAAACGCCTGATCTATGCATCCAGTTTGCAAAGTGGGGTCCCATCAAGGTTCAGCGGCAGTGGTTCTGGGACAGACTTCACTCTCACAATCAGCAGCCTGCAGCCTGAAGATTTTGCAACTTATTACTGTCTACAGCATATAATACTTACCCGTTCACTTTCGGCGGAGGGACCAAGGTGGAGATCAAA<br>SEQ ID NO: 24379 | CAGGTGCAGCTGGTGGAGTCTGGGGGAGGCGTGGTCCAGCCTGGGAGGTCCCTGAGACTCTCCTGTGCAGCCGTCTGATTCACCTTCAGTAGTTATAGCATGCACTGGGTCCGCCAGGCTCCAGGCAAGGGGCTGGAGTGGGTGGCAGTTATTTGGTATGAAGAAAATAATCAATACTATGCAGACTCCGTGAAGGGCCGATTCACCATCTCAAGAGACAATTCCAAGAACACGCTGTATCTGCAAATGAACAGCCTGAGAGCCGAGGACACGGCTGTGTATTACTGTGCGAGAGAAGTGGGGTTCCGGTCTGACTACTGGGGCCAGGGAACCCTGGTCACCGTCTCCTCA<br>SEQ ID NO: 28385 |
| | | AA | DIQMTQSPSSLSASVGDRVTITCRASQGIRNDLGWYQQKPGKAPKRLIYTASSLQSGVPSRFSGSGSGTEFTLTISSLQPEDFATYYCLQHNTYPLTFGGGTKVEIK<br>SEQ ID NO: 24380 | QVQLVESGGGVVQPGRSLRLSCAASGFTFSSYGMHWVRQAPGKGLEWVAVIWYEENNQYYADSVKGRFTISRDNSKNTLYLQMNSLRAEDTAVYYCAREVGFRSDYWGQGTLVTVSS<br>SEQ ID NO: 28386 |

FIGURE 50
(Continued)

| | | | | |
|---|---|---|---|---|
| iPS:392782 | 21-225_22B12 | NA | GACATCCAGATGACCCAGTCTCCATCCTCACT GTCTGCGTCTGTAGGAGACAGAGTCACCATCA CTTGTGCGGCGAGTCAGGACATTAGCAATTAT TTAGCCTGGTTTCAGGAGACAAACCAGGGAAAGC CCATAAGTCCCTGATCTATGGTGCATCCAGTTT GCGGAGTGGGGTCCCATCAAGGTTCAGCGGCA GTGGATCTGGGACAGATTTCAATCTCACCATC AGCAGCCTGCAGCCTGAAGATCTTGCAACTTA TTACTGCCAACAGTATCATAGTTACCCATTCA CTTTCGGCCCTGGGACCAAAGTGGATTTCAAA<br><br>SEQ ID NO: 24381 | GAGGTGCAGCTGGTGGAGTCTGGGGGAGGCTG GTCAAGCCTGGGGGGTCCCTGAGACTCTCCTGTG CAGCCTCTGGATTCACCTTCAGCAGCTATAGCAT GAACTGGGTCCGCCAGGCTCCAGGGAAGGGGCT GGAGTGGGTCTCATCCATTAGTGGTAGTAGTAGT TACACATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTAGAGC CCTTGACTCCTGGGGCCAGGGAACCCTGGTCACC GTCTCCTCA<br><br>SEQ ID NO: 28387 |
| | | AA | DIQMTQSPSSLSASVGDRVTIICRASQDISNYLA WFQEKPGKAHKSLIYGASSLRSGVPSKFSGSGSG TDFNLTISSLQPEDLATYYCQQYHSYPFTFGPGT KVDFK<br><br>SEQ ID NO: 24382 | EVQLVESGGGLVKPGGSLRLSCAASGFTSSSYSMN WVRQAPGKGLEWVSSISGSSSYTYADSVKGRFTI SRDNAKNSLYLQMNSLRAEDTAVYYCARVAALDS WGQGTLVTVSS<br><br>SEQ ID NO: 28388 |
| iPS:392784 | 21-225_23C7 | NA | GACATCCAGATGACCCAGTCTCCATCCTCACT GTCTGCATCTGTAGGAGACAGAGTCACCATCA CTTGCCGGGCGAGTCAGGGCATTGGCATTTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGAGTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAA<br><br>SEQ ID NO: 24383 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTTAT GAGCTGGGTCCGCCAGGCTCCAGGGAAGGGGCT GGAGTGGGTCTCAGTATGAGACTCGTGAGTGGT AGCACATATTATGTAGACTCCGTGAAGGGCCGGT TCACCATCTCCAGAGACAATTCCAAGAACACGCT GTATCTGCAAATGAACAGCCTGAGAGCCGAGGA CACGGCCGTATATTATTGTGCGCGAACTGGGGTC TTTGACTACTGGGGCCAGGGAACCCTGGTCATCG TCTCCTCA<br><br>SEQ ID NO: 28389 |

FIGURE 50
(Continued)

| | | | |
|---|---|---|---|
| iPS:392786 | 21-225_24E1 | AA | DIQMTQSPSSLSASVGDRVTITCRASQGIGIYLA WFQQKPGKAPKSLISAASSLQSGVPSKFSGSGSG TEFTLTISSLQPEDFATYYCQQYNSYPFTFGPGTK VDIK | EVQLLESGGGLVQPGGSLRLSCAASGFTFSSYVMS WVRQAPGKGLEWVSAMSGSGGSTYYVDSVKGRF TISRDNSKNTLYLQMNSLRAEDTAVYYCARTGVFD YWGQGTLVIVSS |
| | | | SEQ ID NO: 24384 | SEQ ID NO: 28390 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATACACC TCCAACAATAACAACTACTTAACTTGGTACCA GCAGAAACCTGGACAGCGTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TTTTATAGTACTCCTCCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGCACCTAACAGTGG TAACACAGGCTATGCACAGAGGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGACAAGCAGT GGCTGGGAGGTCTTTGACTACTGGGGCCAGGGA ACCCTGGTCACCGTCTCCTCA |
| | | | SEQ ID NO: 24385 | SEQ ID NO: 28391 |
| | | AA | DIVMTQSPDSLAVSLGERATINCKSSQSVLYTSN NNNYLTWYQQKPGQRPNLLIYWASTRESGVPD RFSGSGSGTDFTLTISSLQAEDVAVYYCQQFYST PPTFGQGTKVEIK | QVQLVQSGAEVKKPGASVKVSCKASGYTFTNYDIN WVRQATGQGLEWMGWMHPNSGNTGYAQRFQGR VTMTRNTSISTAYMELSSLRSEDTAVYYCATSSGW EVFDYWGQGTLVTVSS |
| | | | SEQ ID NO: 24386 | SEQ ID NO: 28392 |

FIGURE 50
(Continued)

| | | | |
|---|---|---|---|
| iPS:392788 | 21-225_20C8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGAAGAAACCAGGGAAAG CCCCTAAGCGCCTGATCAATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAAGATAATAGTTACCCGTTC ACTTTCGGCGGAGGGACCAAGGTGGAGATCA CA<br><br>SEQ ID NO: 24387 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTGGCAGTAGTAGT TACATATACTACGCAGACTCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGAGAGACAGAGG CAGTCTCTGGGGCCAGGGAACCCTGGTCACCGTC TCCTCA<br><br>SEQ ID NO: 28393 |
| | | AA | DIQMTQSPSSLSASVGDRVTITCRASQGIRNDLG WYQKKPGKAPKRLINAASSLQSGVPSRFSGSGS GTEFTLTISSLQPEDFATYYCLQDNSYPFTFGGGT KVEIT<br><br>SEQ ID NO: 24388 | EVQLVESGGGLVKPGGSLRLSCAASGFTESSYSMN WVRQAPGKGLEWVSSISGSSSYIYYADSVKARFTIS RDNAKNSLYLQMNSLRAEDTAVYYCARDRGSLW GQGTLVTVSS<br><br>SEQ ID NO: 28394 |
| iPS:392790 | 21-225_20D10 | NA | GACATCCAGATGACCCAGTCTCCATCCTCCCT GTCTGCATTTGTAGGAGACAGAGTCACCATCA CTTGCCGGGCAAGTCAGGGCATTAGAAATGAT TTAGGCTGGTATCAGCAGAAACCAGGGAAAG CCGGTAAGCGCCTGATCTATGTTGCATACAGT TTGCAAAGTGGGGTCCCATCAAGGTTCAGCGG CAGTGGATATGGGACAGAATTCACTCTCACAA TCAGCAGCTTGCAGCCTGAAGATTTTGCAACT TATTACTGTCTATACAGCAAAATAGTTACCCGTG GACGTTCGGCCAAGGGACCAAGGTGGAAATC AAA<br><br>SEQ ID NO: 24389 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTAGACTCCGTGAAGGGCCGAT TCACCATCTCCAGAGACGATTCCAAGAACACTCT GTATCTGCAAATGAACAGCCTGAGAGCCGAGGA CACGGCTGTGTATTACTGTGCGCGAGAGATCTTGGC TGGACGGAAGAGTACTGGGGCCAGGGAACCCTG GTCACCGTCTCCTCA<br><br>SEQ ID NO: 28395 |

FIGURE 50
(Continued)

| | | | | |
|---|---|---|---|---|
| | | AA | DIQMTQSPSSLSAFVGDRVTITCRASQGIRNDLG WYQQKPGKAPKRLIYAYSLQSGVPSRFSGSGY GTEFTLTISSLQPEDFATYYCIQQNSYPWTFGQG TKVEIK<br><br>SEQ ID NO: 24390 | QVQLVESGGGVVQPGRSLRLSCAASGFTFSDYGM HWVRQAPGKGLEWVAVIWFDGSNKYYVDSVKGR FTISRDDSKNTLYLQMNSLRAEDTAVYYCARDLG WTEEYWGQGTLVTVSS<br><br>SEQ ID NO: 28396 |
| iPS:392792 | 21-225_20G12 | NA | GACATCCAGATGACCCAGTCTCCATCCTCCCT GTCTGCATCTGTAGGAGACAGAGTCACCATCA CTTGCCGGGCGAGTCAGGGCATTAGACAATTAT TTAGCCTGGTATCAGCAGAAACCAGGGAAAGT TCCTAAGGTCTTGATCTATGCATCCACTTT GCAATCAGGGGTCCCATCTCGGTTCAGTGGCA GTGGATCTGGGACAGATTTCACTCTCACCGTC AGCAGCCTGCAGCCTGAAGATGTTGCAACTA TTACTGTCAAAGATATAACAGTGCCCCTCCGA TCACCTTCGGCCAAGGGACACGACTGGAGATT AAA<br><br>SEQ ID NO: 24391 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGCGGTAGTAGTAGT TACATCTACTACGCAGACTCACTGAAGGGCCGAT TCACCATCTCCAGAGACAACGCCAAGAACTCACT GTATCTGCAAATGAACAGCTGAGAGCCGAGGA CACGGCTGTGTATTACTGTGCAGAGATCGTGGG AGTACTGGGGCCAGGGAACCCTGGTCACCGTCT CCTCA<br><br>SEQ ID NO: 28397 |
| | | AA | DIQMTQSPSSLSASVGDRVTITCRASQGISNYLA WYQQKPGKVPKVLIYTASTLQSGVPSRFSGSGS GTDFTLTVSSLQPEDVATYYCQKYNSAPPITFGQ GTRLEIK<br><br>SEQ ID NO: 24392 | EVQLVESGGGLVKPGGSLRLSCAASGFTFSSYSMN WVRQAPGKGLEWVSSISGSSSYIYYADSLKGRFTIS RDNAKNSLYLQMNSLRAEDTAVYYCARDRGSYW GQGTLVTVSS<br><br>SEQ ID NO: 28398 |

FIGURE 50
(Continued)

| | | | |
|---|---|---|---|
| iPS:392794 | 21-225_21H3 | NA | GACATCCAGATGACCCAGTCTCCATCTCCT GTCTGCATCTGTAGGAGACAGAGTCACCATCA CTTGCCGGGCAAGTCAGGGACAGATTAGAAATGAT TTAGGCTGGTATCAGCAGAAACCAGGGAAAG CCCCTAAGCGCCTGATCTATGCTGCTTCCAGT GTGCAAACTGGGGTCCCATCAAGGTTCAGCGG CAGTGGATCTGGGACAGATTCACTCTCACAA TCAGCAGCCTGCAGGCTGAAGATTTTGCAATT TATTACTGTCTACAGCATAATAGTTATCCGCTC ACTTTCGGCGGAGGGACCAAGGTGGAGATCA AA SEQ ID NO: 24393 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAA GGGGCTGGAGTGGATTGGGAATATTTATTATAGT GGGAGCACCTACGACAACCCGTCCCTCAAGAGT CGAGTCACCATATCGTAGACACGTCAAGAACC AGTTCTCCCTGAAGCTGAGCTCTGTGACCGCCGC GGACACGGCTGTTTATTACTGTGGGAGACATGA AAAGACTGGGCCTTGACTACTGGGGCCAGGGA ACCCTGGTCACCGTCTCCTCA SEQ ID NO: 28399 |
| | | AA | DIQMTQSPSSLSASVGDRVTITCRASQGIRNDLG WYQQKPGKAPKRLIYAASSVQTGVPSRFSGSGS GTEFTLTISSLQAEDLAIYYCLQHNSYPLTFGGGT KVEIK SEQ ID NO: 24394 | QLQLQESGPGLVKPSETLSLTCTVSGGSISRSSYYW GWIRQPPGKGLEWIGNIYYSGSTYDNPSLKSRVTIS VDTSKNQFSLKLSSVTAADTAVYYCGRHGKDWGL DYWGQGTLVTVSS SEQ ID NO: 28400 |
| iPS:392796 | 21-225_22A4 | NA | GACATCCAGATGACCCAGTCTCCATCTCCCT GTCTGCATCTGTAGGAGACAGAGTCACCATCA CTTGCCGGGCAAGTCAGGGACAGATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGGCTGCACTCTCACAA TCAGCAGCCTGCAGCCTGAAGATTTTGCAACT TATTACTGTCTTCTTCAGCATATAGTTACCCGTGG ACGTTCGGCCAAGGGACCAAGGTGGAAATCA AA SEQ ID NO: 24395 | CAGGTGCAGCTGGTGGAGTCTGGGGGAGGCGTG GTCCAGCCTGGGAGGTCCCTGAGACTCTCCTGTG CAGCCGTCTCTGGATTCACCTTCAGTGACTATGGCAT ACACTGGGTCCGCCAGGCTCCAGGCAAGGGCT GGAGTGGGTGGCAGTTATATGGTTTGATGGAAGT AATAAATACTATGCAGACTCCGTGAAGGGCCGA ATCACCATCTCTAGAGACAATTCAAGAACACGC TGTATCTGCAAATGAACAGCCTGAGAGCCGAGG ACACGGCTGTGTATTACTGTGCGAGAGATCTTGG CTGGACGGAAGAGTACTGGGGCCAGGGAACCCT GGTCACCGTCTCCTCA SEQ ID NO: 28401 |

FIGURE 50
(Continued)

| | | | |
|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK | QVQLVESGGGVVQPGRSLRLSCAASGFTFSDYGIH WVRQAPGKGLEWVAVIWFDGSNKYYADSVKGRIF ISRDNSKNTLYLQMNSLRAEDTAVYYCARDLGWT EEYWGQGTLVTVSS |
| | | | SEQ ID NO: 24396 | SEQ ID NO: 28402 |
| iPS:392798 | 21-225_22C7 | NA | GACATCCAGATGACCCAGTCTCCATCCTCCCT GTCTGCATCTGTAGGAGACAGAGTCACCATCA CTTGCCGGGCAAGTCAGAGTCAGAACATTATCAGTAT TTAAATTGGTATCAGCAGAAACCAGAGAAAG CCCCTAAACTCCTGATCCATATTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGGGGCAGTTATATGGTTATGATGAAG TAATAAATACTATGCAGACTCCGTGAAGGGCCG ATTCACCATCTCCAGAGACAATGCCAAGAACAC GCTGTATCTGCAAATGAACAGCTGAGAGCCGA GGACACGGCTGTGTATTACTGTGCGAGAGATCTG AGTATGGGCGGTATGGACGTCTGGGGCCAAGGG ACCACGGTCACCGTCTCCTCA |
| | | | SEQ ID NO: 24397 | SEQ ID NO: 28403 |
| | | AA | DIQMTQSPSSLSASVGDRVTITCRASQNIISYLNW YQQKPEKAPKLLIHIASSLQSGVPSRFSGSGSGTD FTLTISSLQPEDFATYYCQQTYSTPLTFGGGTKV EIK | QVQLVESGGGVVQPGRSLRLSCAASGFTFSSYGMH WVRQAPGKGLEWGAVIWHDGSNKYYADSVKGRF TISRDNAKNTLYLQMNSLRAEDTAVYYCARDLSM GGMDVWGQGTTVTVSS |
| | | | SEQ ID NO: 24398 | SEQ ID NO: 28404 |

FIGURE 50
(Continued)

| | | | |
|---|---|---|---|
| iPS:392800 | 21-225_22D12 | NA | GACATCCAGATGACCCAGTCTCCATCCTCCT GTCTGCATCTGTAGGAGACAGAGTCACCATCA CTTGTCGGGCAAGTCAGGGCATTAGAAATGAT TTAGGCTGGTATCAGCAGAAACCAGGGAAAG CCCCTAAGCGCCTGATCTATGCTGCATCCAGT TTGCAGAGTGGGGTCCCATCTAGGTTCAGCGG CAGTGGATCTGGGACAGATTTCACTCTCACAA TCAGCAGCCTGCAGCCTGAAGATTTTGCAACT TATTACTGTCTACAGCATAGTACTTACCCTCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGCAGGAGTAGTTA CTACTGGGGCTGGATCCGCCAGCCCCCAGGGAA GGGGCTGGAGTGGATTGGAAATATCTATTATAGT GGGACCACCTCTACAACCCGTCCCTCAAGAGTC GAGTCACCATATCCGTTGACACGTCCAGGAACCA GTTCTCCCTGAAGCTGAGCTCTGTGACCGCCGCA GACACGGCTGTGTTTTACTGTGCGAGACTCAGCA GCACGGGCTGGTCCGTTGACTACTGGGGCCAGGGAA CCCTGGTCACCGTCTCCTCA |
| | | | SEQ ID NO: 28405 |
| | | AA | DIQMTQSPSSLSASVGDRVTITCRASQGIRNDLG WYQQKPGKAPKRLIYAASSLQSGVPSRFSGSGS GTDFTLTISSLQPEDFATYYCLQHSTYPLTFGGG TKVEIK | QLQLQESGPGLVKPSETLSLTCTVSGGSISRSSYYW GWIRQPPGKGLEWIGNIYYSGTTSYNPSLKSRVTIS VDTSRNQFSLKLSSVTAADTAVFYCARLSSWSWVD YWGQGTLVTVSS |
| | | | SEQ ID NO: 24399 | SEQ ID NO: 28406 |
| iPS:392802 | 21-225_23E7 | NA | GACATCCAGATGACCCAGTCTCCATCCTCACT GTCTGCATCTGTAGGAGACAGAGTCACCATCA CTTGTCGGGCGAGTCAGGGCATTAGCAATCA TTAGCCTGGTTTCAGCAGATACCAGGGAAAGC CCCTAAGTCCCTGATCTATGCTGCATCCAGTTT GCAAAGTGGGGTCCCATCAAAGTTCAGCGGCA GTGGATCTGGGACAGCTTTCACTCTCACCATC AGCAGCCTGCAGCCTGAAGATTTTGCAACTTA TTACTGTCTGCCAACAGTGTTTATAGTTACCCATTCAC TTTCGGCGGAGGGACCAAGGTGGATATCAAT | GAGGTGCAGCTGTTGGAGTCTGGGGGAGGCTTG GTACAGCCTGGGGGGTCCCTGAGACTCTCCTGTA CAGCCTCTGGATTCACCTTTAGCAGCTATGCCAT GAACTGGGTCCGCCAGGCTCCAGGGAAGGGCT GGAGTGGGTCTCAGTATTAGTGGTAGTGGTGGT TTCACATACTACGCAGACTCCGTGAAGGGCCGGT TCACCATCTCCAGAGACAATTCCAGGAACACGCT GTATCTGCAAATGAACAGCCTGAGAGCCGAGGA CACGGCCGTATATTACTGTGCGCGTACCAGTGGC TTTGACTACTGGGGCCAGGGAACCCTGGTCACCG TCTCCTCA |
| | | | SEQ ID NO: 24401 | SEQ ID NO: 28407 |

FIGURE 50
(Continued)

| | | | | |
|---|---|---|---|---|
| iPS:392806 | | AA | DIQMTQSPSSLSASVGDRVTITCRASQGISNYLA WFQQIPGKAPKSLIYAASSLQSGVPSKFSGSGSG TDFTLTISSLQPEDFATYYCQQFYSYPFTFGPGTK VDIN<br>SEQ ID NO: 24402 | EVQLLESGGGLVQPGGSLRLSCTASGFTFSSYAMN WVRQAPGKGLEWVSAISGSGGFTYYADSVKGRFTI SRDNSRNTLYLQMNSLRAEDTAVYYCARTSGFDY WGQGTLVTVSS<br>SEQ ID NO: 28408 |
| | 21-225_24H3 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCAAC TTAGCCTGGTACCAGCAGAAACCTGGCCAGGC TCCCAGGCTCCTCATCTATTTTGCATCCATCAG GGCCACTGGTATCCCAGCCAGGTTCAGTGGCA GTGGGTCTGGGACAGAGTTCACTCTCACCATC AGCAGCCTGCAGTCTGAAGATATAACTGGCCC ATGT TTACTGTCAGCAGTATAATAACTGGCCCATGT GCAGTTTTGGCCAGGGGACCAAGCTGGAGATC AAA<br>SEQ ID NO: 24403 | CAGGTGCAGCTGGTGGAGTCTGGGGGAGGCGTG GTCCAGCCTGGGAGGTCCCTGAGACTCTCCTGTG GAGCGTCTGGATTCACCTTCAGTAGCTATGGCAT GCACTGGGTCCGCCAGGCTCCAGGCAAGGGGCT GGAGTGGGTGGCAGTTATATGATGTATGATGAAGT AATAAATACTATGCAAGACTCCGTGAAGGGCCGA TTCACCATCTCAAGAGACAATTCCAAGAACACGC TGTATCTGCAAATGAACAGCCTGAGAGCCGAGG ACACGGCTGTGTATTACTGTGCGAGAGTAGCAGT GGCAGGCGGTATGGACGTCTGGGGCCAAGGGAC CACGGTCACCGTCTCCTCA<br>SEQ ID NO: 28409 |
| | | AA | EIVMTQSPATLSVSPGERATLSCRASQSVSSNLA WYQQKPGQAPRLLIYFASIRATGIPARFSGSGSG TEFTLTISSLQSEDFAVYYCQQYNNWPMCSFGQ GTKLEIK<br>SEQ ID NO: 24404 | QVQLVESGGGVVQPGRSLRLSCGASGFTFSSYGMH WVRQAPGKGLEWVAVIWYDGSNKYYADSVKGRF TISRDNSKNTLYLQMNSLRAEDTAVYYCARVAVA GGMDVWGQGTTVTVSS<br>SEQ ID NO: 28410 |

FIGURE 50
(Continued)

| | | | | |
|---|---|---|---|---|
| iPS:392808 | 21-225_20F8 | NA | GACATCCAGATGACCCAGTCCATCCTCCT GTCTGCATCTGTAGGAGACAGAGTCACCATCA CTTGCCGGGCAAGTCAGAGCATTAGCAGGTAT TTAAATTGGTATCAGCAGAAACCAGGGAAAG CCCCTGAGCTCCTGATCTATGCTGCTTCCAGTT TGCAAAGTGGGGTCCCATCAAGGTTCAGTGGC AGTGGATCTGGGACAGATTTCATTCTCACCAT CAGCAGTCTACAACCTGAAGATTTTGCAACTT ACTACTGTCAACAGAGTTACAATACCCCCACG TGGACGTTCGGCCAAGGGACCAAGGTGGAAA TCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGATCCGCCAGGCTCCAGGGAGGGGGCT GGAGTGGTCTTCAGTTATTAGTGGTAGTGGTGGT AGCACATATTACGCAGACTCCGTGAAGGGCCGG TTCACCATCTCCAGAGACAATTCCAAGAACACGC TGTATCTGCAAATGAGCAGCCTGAGAGCCGAAG ACACGGCCGTATATTACTGTGCGAAAAGTATAA CAGTGGCTGGCATGATGTTTTTGATATCTGGGGC CAAGGGACAATGGTCACCGTCTCTTCA |
| | | | SEQ ID NO: 24405 | SEQ ID NO: 28411 |
| | | AA | DIQMTQSPSSLSASVGDRVTITCRASQSISRYLN WYQQKPGKAPELLIYAASSLQSGVPSRFSGSGSG TDFTLTISSLQPEDFATYYCQQSYNTPTWTFGQG TKVEIK | EVQLLESGGGLVQPGGSLRLSCAASGFTFRSYAMS WIRQAPGRGLEWSSVISGSGGSTYYADSVKGRFTIS RDNSKNTLYLQMSSLRAEDTAVYYCAKRYNSGW HDVFDIWGQGTMVTVSS |
| | | | SEQ ID NO: 24406 | SEQ ID NO: 28412 |
| iPS:392810 | 21-225_20H12 | NA | GACATCCAGATGACCCAGTCTCCATCCTCCCT GTCTGCTCTGGGACAGAGAGTCACCATCA CTTGCCGGGCAAGTCAGGGCATTAGCAAATGAT TTAGACTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCAGTTCAGTAACTATGGCAT GCACTGGGTCCGCCAGGCTCCAGGCAAGGGGCT GGAGTGGGTGGCAGTTATATGACTCCGTGAAGGGCCGAT AATAAATACTATGTAGACTCCGTGAAGGGCCGAT TCACCATCTCCAGAGACAACTCCAAGAACACGCT GTATCTGCAAATGAACAGCCTGAGAGCCGAGGA TTCCGGTCTGACTACTGTGCGCAGGAGTGGGG TCACCGTCTCCTCA |
| | | | SEQ ID NO: 24407 | SEQ ID NO: 28413 |

FIGURE 50
(Continued)

| | | | |
|---|---|---|---|
| iPS:392812 | 21-225_21F4 | AA | DIQMTQSPSSLSASVGDRVTITCRASQGIRNDLD WYQQKPGKAPKRLIYAASSLQSGVPSRFSGSGS GTEFTLTISSLQPEDFATYYCLQHNSYPLTFGGG TKVEIK<br>SEQ ID NO: 24408 | QVQLVESGGGVVQPGRSLRLSCAASGFTFSNYGM HWVRQAPGKGLEWVAVIWYDENNKYYVDSVKGR FTISRDNSKNTLYLQMNSLRAEDTAVYYCARELGF RSDYWGQGTLVTVSS<br>SEQ ID NO: 28414 |
| | | NA | GACATCCAGATGACCCAGTCTCCATCCTCCCT GTCTGCATCTGTAGGAGACAGAGTCACCATCA CTTGCCGGGCAAGTCAGAACATTGGTAGTTAT TTAAATTGGTATCAGCAGAAACCAGGGAAAG CCCCTAAGCTCCTGATCTTTGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT TCTTCTGTCAACAGAGTTACAGAACCCCTTTT TCACTTTCGGCCCTGGGACCAAAGTGGATTTC AAA<br>SEQ ID NO: 24409 | GAGGTGCAGCTGTTGGAGTCTGGGGGAGGCTTG GTACAGCCTGGGGGGTCCCTGAGACTCTCCTGTG CAGCCTCTGAATTCACCTTTAGCAGCTATGCCAT GAACTGGGTCCGCCAGGCTCCAGGGAAGGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGTCCGTTTGGCA GTGGCTGGCTCGGAGGCTTGTGATATCTGGGGCC AAGGGACAATGGTCACCGTCTCTTCA<br>SEQ ID NO: 28415 |
| | | AA | DIQMTQSPSSLSASVGDRVTITCRASQNIGSYLN WYQQKPGKAPKLLIFAASSLQSGVPSRFSGSGSG TDFTLTISSLQPEDFATFFCQQSYRTPFFTFGPGT KVDFK<br>SEQ ID NO: 24410 | EVQLLESGGGLVQPGGSLRLSCAASEFTFSSYAMN WVRQAPGKGLEWVSVISGRGGNTFYADSVKGRFTI SRDNSKNTLYLQMNSLRAEDTAVYYCASRLAVAG SEACDIWGQGTMVTVSS<br>SEQ ID NO: 28416 |

FIGURE 50
(Continued)

| | | | |
|---|---|---|---|
| iPS:392814 | 21-225_22A1 | NA | GATATTGTGATGACCCAGACTCCACTCTCTCT GTCCGTCACCCCTGGACAGCCGGCCTCCATCT CCTGCAAGTCTAGTCAGAGCTCCTGCATAGT GGTGGAAAAGACCTATTTATATTGGTACCTGCA GAAGCCAGGCCAGCCTCCACAGCTCCTGATCT ATGAAGTTTCCAACCGGTTCTCTGGACTGCCA GATAGGTTCAGTGGCAGCGGGTCAGGGACAG ATTTCACACTGAAAATCAGCGGGTGGAGGCT GCGGATGTTGGGGTTTATTACTGCATGCAAAC TTTACACCTTCCGTGGACGTTCGGCCAAGGGA CCAAGGTGGAAATCAAA SEQ ID NO: 24411 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATGTGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATGGGGGA TTTTTGGAGTGGTTAGACTACTGGGGCCAGGGAA CCCTGGTCACCGTCTCCTCA SEQ ID NO: 28417 |
| | | AA | DIVMTQTPLSLSVTPGQPASISCKSSQSLLHSGGK TYLYWYLQKPGQPPQLLIYEVSNRFSGLPDRFSG SGSGTDFTLKISRVEAADVGVYYCMQTLHLPWT FGQGTKVEIK SEQ ID NO: 24412 | QVQLVESGGGVVQPGRSLRLSCAASGFTFSSYGMH WVRQAPGKGLEWVAVMWYDGSNKYYADSVKGR FTISRDNSKNTLYLQMNSLRAEDTAVYYCARDGGF LEWLDYWGQGTLVTVSS SEQ ID NO: 28418 |
| iPS:392816 | 21-225_22E4 | NA | GACATCCAGATGACCCAGTCTCCATCTCCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAATACCCCCTTA TTCACTTTCGGCCCTGGGACCAAAGTGGATAT CAAA SEQ ID NO: 24413 | GAGGTGCAGCTGTTGGAGTCTGGGGGAGGCTTG GTGCAGCCTGGGGGGTCCCTGAGACTCTCCTGTG CAGCCTCTGAATTCACCTTTAGCAGTTATGCCAT GAGCTGGGTCCGCCAGGCTCCAGGGAAGGGCT GGAGTGGGTCTCAATTATTAGTAGTCGTGGTACT AACACATTCTACGCAGACTCCGTGAAGGGCCGGT TCACCATCTCCAGAGTCAATTCCAAGAACACGCT GTATCTGCAAATGAACAGCCTGAGAGCCGAGGA CACGGCCGTATATTACTGTGCGTCCCGTATAGCA GTGGGTGCTCGGAGGCTTTTGATATCTGGGGCC AAGGGACAATGGTCACCGTCTCTTCA SEQ ID NO: 28419 |

FIGURE 50
(Continued)

| | | | | |
|---|---|---|---|---|
| iPS:392818 | 21-225_22D8 | AA | DIQMTQSPSSLSASVGDRVTITCRASQNISSYLN WYQQKPGKAPKLLIYAASSLQSGVPSRFSGSGS GTDFTLTISSLQPEDFATYYCQQSYNTPLFTFGPG TKVDIK<br>SEQ ID NO: 24414 | EVQLLESGGGLVQPGGSLRLSCAASEFTFSSYAMS WVRQAPGKGLEWVSIISGRGTNTFYADSVKGRFTI SRVNSKNTLYLQMNSLRAEDTAVYYCASRIAVAGS EAFDIWGQGTMVTVSS<br>SEQ ID NO: 28420 |
| | | NA | GACATCCAGATGACCCAGTCTCCATCCTCCCT GTCTGCATCTGTAGGAGACAGAGTCACCATCA CTTGCCGGACAAGTCAGAACAGTAACAGTTAT TTAAATTGGTATCAGCAGAAACCAGGAAAG CCCCTAAGCTCCTGATCTTTGCTGCATACAGTT TGGAAAGTGGGGTCCCATCAAGGTTCAGTGGC AATAGATCTGGGACAGAGTTCACTCTCACCAT CAGCAGTCTGCAACCTGAAGATTTTGCAACTT ACTACTGTCAACAGAGTTACGGTACCTCGATC ACCTTCGGCCAAGGGACACGACTGGAGATTAA A<br>SEQ ID NO: 24415 | CAGGTGCAGCTGGTGGAGTCTGGGGGAGGCGTG GTCCAGCCTGGGAGGTCCCTGAGACTCTCCTGTG TAGCCTCTGATTCACCTTCAGGAGCTATGGCAT GCACTGGGTCCGCCAGGCTCCAGGCAAGGGGCT GGAGTGGGTGACAATTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTATATTTCTGTGCAGAGAGGGTTTG GTTCGGGGACTTCTGGGGCCAGGGAACCCTGGTC ACCGTCTCCTCA<br>SEQ ID NO: 28421 |
| | | AA | DIQMTQSPSSLSASVGDRVTITCRTSQNSNSYLN WYQQKPGKAPKLQIFAAYSLESGVPSRFSGNRS GTEFTLTISSLQPEDFATYYCQQTYGTSITFGQGT RLEIK<br>SEQ ID NO: 24416 | QVQLVESGGGVVQPGRSLRLSCVASGFTFRSYGMH WVRQAPGKGLEWVTIISYDGSNKYYADSVKGRFTI SRDNSKNTLYLQMNSLRAEDTAVYFCARGVWFGD FWGQGTLVTVSS<br>SEQ ID NO: 28422 |

FIGURE 50
(Continued)

| | | | | |
|---|---|---|---|---|
| iPS:392820 | 21-225_23D1 | NA | GACATCCAGATGACCCAGTCTCCATCCTCCCT GTCTGCATCTGTAGGAGACAGAGTCACCATCA CTTGCCGGGCAAGTCAGGGCATCAGAAATGAT TTAGGCTGGTATCAGCAGAAACCAGGGAAAG CCCCTAAGCGCCTGATCTATGCTGCATCCAGT TTACAAAGTGGGGTCCATCAAGGTTCAGCGG CAGTGGTTCTGGGACAGAATTCACTCTCACAG TCAGCAGCCTGCAGCCTGAAGATTTTGCAACT TATTACTGTCTACAGCATAGTAGTTACCCTCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCAGGGAA GGGACTGGAGTGGATTGGGAGTATCTATTATAGT GGGAGCGCCCAGTACAACCCGTCCCTCAAGAGT CGAGTCACCATATCGTCGACACGTCCAAGAACC AGTTCTCCCTGACCTGAGCTCTGTGACCGCGC AGACACGGCTTTATATTACTGTGCGAGACTGAGC AGCAGCTGGTCTTTGACTACTGGGCCAGGGAA CCCTGGTCACCGTCCTCA SEQ ID NO: 28423 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHSSYPLTFGGG TKVEIK SEQ ID NO: 24418 | QLQLQLQESGPGLVKPSETLSLTCTVSGGSISRSSYYW GWIRQPPGKGLEWIGSIYYSGSAQYNPSLKSRVTIS VDTSKNQFSLTLSSVTAADTALYYCARLSSSWSFD YWGQGTLVTVSS SEQ ID NO: 28424 |
| iPS:392822 | 21-225_23C8 | NA | GACATCCAGATGACCCAGTCTCCATCCTCCCG GTCTGCATCTGTAGGGGACAGAGTCACCATCA CTTGCCGGGCAAGTCAGGGACATTAGAAATGAT TTAGGCTGGTATCAGCAGAAACCAGGGAGAG CCCCTAAGCGCCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTGTAATT TATTACTGTCTACAGCATAGTAGTTACCCGCTC ACTTTCGGCGGAGGGACCAAGGTGGAGATCA AA | CAGTTGCAACTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCAGGGAA GGGGCTGGAGTGGATTGGGAATATTATTATAGT GGGACCACTTACAACACCCGTCCCTCAAGAGTC GAGTCACCATATCCGTAGACACGTCCAAGAACC ACTTCTCCCTGAAGCTGAGCTCTGTGACCGCGC AGACACGCTGTGTATTACTGTGGGAGACATGGA AAAGACTGGGGCCTTGACTACTGGGGCCAGGGA ACCCTGGTCACCGTCCTCA SEQ ID NO: 28425 |
| | | | SEQ ID NO: 24419 | |

FIGURE 50
(Continued)

| | | | | |
|---|---|---|---|---|
| iPS:392824 | 21-225_24E5 | AA | DIQMTQSPSSRSASVGDRVTITCRASQDIRNDLG WYQQKPGRAPKRLINGASSVQSGVPSRFSGSGS GTEFTLTISSLQPEDFVIYYCLQHNSYPLTFGGGT KVEIK<br><br>SEQ ID NO: 24420 | QLQLQESGPGLVKPSETLSLTCTVSGGSISRSSYYW GWIRQPPGKGLEWIGNIYSGTTYNNPSLKSRVTIS VDTSKNHFSLKLSSVTAADTAVYYCGRHGKDWGL DYWGQGTLVTVSS<br><br>SEQ ID NO: 28426 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAGTAATTACCCGCTC ACTTTCGGCGGAGGGACCAAGGTGGAGATCA AA<br><br>SEQ ID NO: 24421 | CAGCTGCAGCTGCAGGAGTCGGGCCCAGGACTG GTGAAGCCCTGGAGACCCTGTCCTCACCTGCA CTGTCTCTGGTGCGCCATCAGCAGGAGTAGTTA CTACTGGGGCTGGATCCGCCAGCCCCCAGGGAA GGGGCTGGAGTGGATTGGAGTATCTATTATAGT GGGAGCGCCAACTACAACCCGTCCTCCAAGAGT CGAGTCACCATATCCGTAGACACGTCCAAGAACC AGTTCTCCCTGAAGCTGAGCTCTGTGACCGCCGC AGACACGGCTGTGTATTACTGTGCGAGACTCAGC AGCAGCTGGTCCATTGACAACTGGGGCCAGGA ACCCTGGTCACCGTCTCCTCA<br><br>SEQ ID NO: 28427 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSNYPLTFGGG TKVEIK<br><br>SEQ ID NO: 24422 | QLQLQESGPGLVKPSETLSLTCTVSGGAISRSSYYW GWIRQPPGKGLEWIGSIYSGSANYNPSLKSRVTIS VDTSKNQFSLKLSSVTAADTAVYYCARLSSSWSID NWGQGTLVTVSS<br><br>SEQ ID NO: 28428 |

FIGURE 50
(Continued)

| | | | |
|---|---|---|---|
| iPS:392826 | 21-225_20B9 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGTTGCATCCAGTTT GCAAAGTGGGGTCCCATCAAAGTTCAGCGGCA GTGGATCTGGGACAGATTCACTCTCACCATC AGCAGCCTGCAACCTGAAGATTTTGCAACTTA TTACTGCCAACAGTATAATACTTATCCATTCAC TTTCGGCCCTGGGACCAAAGTGGATATCAAA |
| | | | SEQ ID NO: 24423 |
| | | AA | DIQMTQSPSSLSASVGDRVTITCRASQGISNYLA WFQQKPGKAPKSLIYVASSLQSGVPSKFSGSGSG TDFTLTISSLQPEDFATYYCQQYNTYPFTFGPGT KVDIK |
| | | | SEQ ID NO: 24424 |
| | | | GAGGTGCAGCTGGTGGAGTCTGGGGGAGGCTTG GTACAGCCTGGGGGGTCCCTGAGACTCTCCTGTG CAGCCTCTGGATTCACCTTCAGTAGTTACTAGCAT GAACTGGGTCCGCCAGGCTCCAGGGAAGGGGCT GGAGTGGGTTTCATACATTAGTAGTAGTAGTAGT ACCATATACTATGCAGACTCTGTGAAGGGCCGAT TCACCATCTCCAGAGACAATGCCAAGAACTCACT GTACCTGCAAATGAACAGCCTGAGAGACGAGGA CACGGCTGTGTATTACTGTGCGAGGTCACTATGG TCCCCCTTTGACTACTGGGGCCAGGGAACCCTGG TCACCGTCTCCTCA |
| | | | SEQ ID NO: 28429 |
| | | | EVQLVESGGGLVQPGGSLRLSCAASGFTFSSYSMN WVRQAPGKGLEWVSYISSSSSTIYADSVKGRFTIS RDNAKNSLYLQMNSLRDEDTAVYYCARSLWSPFD YWGQGTLVTVSS |
| | | | SEQ ID NO: 28430 |
| iPS:392830 | 21-225_21A5 | NA | GACATCCAGATGACCCAGTCTCCATCCTCCCT GTGTGCATCTGTAGGAGACAGAGTCACCATCA CTTGCCGGGCAAGTCAGAGCATTAGCAGCCAT TTAAATTGGTATCAGCAGAAACCAGGGAAAG CCCCTAAACTCCTGATCTATGCTGCATCCAGTT TGCAAAGTGGGGTCCCATCTCACCGGTTCAGTGGC AGTGGATCTGGGACAGATTTCACTCTCACCAT CAGCAGTGTGCAACCTGAAGATTTTGCAACTTAC ATTACTGTCAACAGAGTTACATATCTCATTCACT TTCGGCCCTGGGACCAAAGTGGATATCAA A |
| | | | SEQ ID NO: 24425 |
| | | | CAGGTGCAGCTGCAGGAGTCGGGCCCAGGACTG GTGAAGCCTTCGGAGACCCTGTCCTCACCTGCA CTGTCTCTGGTGGCTCCATCAGTAGTTACTTCTGG AGCTGGATCCGGCAGCCCGCCGGGAAGGGACTG GAGTGGATTGGGCGTATCTATACCAGTGGGATCA CCAACTACAACCCCTCCCTCAAGAGTCGAGTGAC CATGTCAGTAGACACGTCCAAGAACCAGTTCTCC CTGAAACTGAGTTCTGTGACCGCCGCGGACACGG CCATATATTACTGTGCGAGAGCCCGACTTCGGG GTGGTTCGACCCCTGACCCTGGGGCCAGGGAACCCTGGTC ACCGTCTCCTCA |
| | | | SEQ ID NO: 28431 |

FIGURE 50
(Continued)

| | | | |
|---|---|---|---|
| | | AA | DIQMTQSPSSLCASVGDRVTITCRASQTISSHLN WYQRKPGKAPKLLIYAASSLQSGVPSRFSGSGSG TDFTLTISSVQPEDFATYYCQQSYNISFTFGPGTK VDIK<br><br>SEQ ID NO: 24426 | QVQLQESGPGLVKPSETLSLTCTVSGGSISSYFWSW IRQPAGKGLEWIGRIYTSGITNYNPSLKSRVTMSVD TSKNQFSLKLSSVTAADTAIYYCARGPTSGWFDPW GQGTLVTVSS<br><br>SEQ ID NO: 28432 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGAGG CAGTGGATCTGGGACAGATTCACTCTCACAA TCAGCAGCCTGCAGCCTGAAGATATTGCAACT TATTACTGTCTACAGCATAATAGTTACCCGTG GACGTTCGGCCAAGGGACCAAGGTGGAAATC AAA<br><br>SEQ ID NO: 24427 | CAGGTGCAGCTGGTGGAGTCTGGGGGAGGCGTG GTCCAGTCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATAGACTCCGTGAAGGT AATAAATACTATGCAGACTCCGTGAAGGGCCGA TTCACCATCTCAAGAGACAATTCCAAGAACACGC TGTATCTGCAAATGAACAGCCTGAGAGCCGAGG ACACGGCTGTGTATTACTGTGCGAGAGATCTTGG CTGGACGGAAGAGTACTGGGGCCAGGGAACCCT GGTCACCGTCTCCTCA<br><br>SEQ ID NO: 28433 |
| iPS:392832 | 21-225_21H8 | AA | DIQMTQSPSSLSASVGDRVTITCRASQGIRNDLG WYQQKPGKAPKRLIYAASSLQSGVPSRFRGSGS GTEFTLTISSLQPEDFATYYCLQHNSYPWTFGQG TKVEIK<br><br>SEQ ID NO: 24428 | QVQLVESGGGVVQSGRSLRLSCAASGFTFSDYGM HWVRQAPGKGLEWVAVIWFDGSNKYYADSVKGR FTISRDNSKNTLYLQMNSLRAEDTAVYYCARDLG WTEEYWGQGTLVTVSS<br><br>SEQ ID NO: 28434 |

FIGURE 50
(Continued)

| | | | | |
|---|---|---|---|---|
| iPS:392834 | 21-225_22C1 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAGTACTTACCCGCTC ACTTTCGGCGGAGGGACCAAGGTGGAGATCA AA | CAACTGCAGTTGCAGGAGTCGGGCCCAGGACTG GTGAAGCCTTCGGAGACCCTGTCCTCACCTGTA CTGTTTCTGGTGGCTCCATCAACAGGAGTAGTTA CTACTGGGGCTGGATCCGCCAGCCCCCAGGAA GGGGCTGGAGTGGATTGGGAATATCTATTATAGT GGGCCACCTATTATAATTCGTCCCTCAAGAGTC GAGTCACCATCTCCGTAGACACGTCCACGAACCA GTTCTCCCTGAAGCTGAGCTCTGTGACCGCCGCA GACACGGCTGTGTATTACTGTGCGAGACATAGCG GCAGCTGGTCCCTGACTACTGGGGCCAGGGAAC CCTGGTCACCGTCTCCTCA |
| | | | SEQ ID NO: 24429 | SEQ ID NO: 28435 |
| | | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHSTYPLTFGGGT KVEIK | QLQLQESGPGLVKPSETLSLTCTVSGGSINRSSYYW GWIRQPPGKGLEWIGNIYYSGATYNSSLKSRVTIS VDTSTNQFSLKLSSVTAADTAVYYCARHSGGWSLD YWGQGTLVTVSS |
| | | | SEQ ID NO: 24430 | SEQ ID NO: 28436 |
| iPS:392836 | 21-225_22F4 | NA | GACATCCAGATGACCCAGTCTCCATCTCCCT GTCTGCTTCTGTTGGAGACAGAGTCACCATCA CTTGCCGGGCAAGTCAGTCAGAGATTAGAGATGAT TTAGGCTGGTATCAGCAGAAACCAGGGAAAG CCCCTAAGCGCCTGATCTATGCTGCATCCAGT TTGCAAAGTGGGGTCCCATCGAGGTTCAGCGG CAGTAGATCTGGGACAGCCTCACTCTCACAA TCAGCAGCCTGCAGCCTGAAGATTTTGCAACT TATTACTGTCTACACCACTATAGTATCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGATTCACCTTCAGCGACTATGGCAT GCACTGGGTCCGCCAGGCTCCAGGCAAGGGCT GGAGTGGGTGGCAGTTATATGAGACTCCGTGAAGT AATAAATACTATGAGACACAATTCCAAGAACACGCT TCACCATCTCCAAATGAACAGCCTGAGAGCCGAGGA GTATCTGCAAATGAACAGCCTGAGAGAGAAAGTAT CACGGCTGTGTATTACTGTGCGAGACTACGTTGAGCTAT AGCAGCAGTCGGTACGACTACGGTATGGACGTCT GGGGCCAAGGGACCACGGTCACCGTCTCCTCA |
| | | | SEQ ID NO: 24431 | SEQ ID NO: 28437 |

FIGURE 50
(Continued)

| | | AA | DIQMTQSPSSLSASVGDRVTITCRASQVIRDDLG WYQQKPGKAPKRLIYAASSLQSGVPSRFSGSRS GTDFTLTISSLQPEDFATYYCLHHYSYPRTFGQG TKVEIK | QVQLVESGGGVVQPGRSLRLSCAASGFTFSDYGM HWVRQAPGKGLEWVAVIWYDGSNKYYVDSVKGR FTISRDNSKNTLYLQMNSLRAEDTAVYYCAREKYS SSWYDYGMDVWGQGTTVTVSS |
|---|---|---|---|---|
| | | | SEQ ID NO: 24432 | SEQ ID NO: 28438 |
| iPS:392838 | 21-225_22G8 | NA | GACATCCAGATGATCCAGTCTCCATCCTCCCT GTTCGCATCTGTAGGAGACAGAGTCACCATCA CTTGCCGCGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAAATTCAGCGG CAGTGGATCTGGGACAGAGATTCACTCTCAA TCAGCAGCCTGCAGCCTGAAGATTTTGCAACT TATTACTGTCTACAGCATATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAACAGGAGTAGTTA CTACTGGGGCTGGATCCGCCAGCCCCCAGGGAA GGGGCTGGACTGGATTGGAATATCTATTATAGT GGGAGCACCTACTACAACCCGTCCGTCAAGAGTC GATTCACCATATCCGTAGACACGTCCAAGAACCA GTTCTCCCTGAAGCTGAGCTCTGTGACCGCCGCA GACACGGCTGTGTATTACTGTGCGAGACATGGAA AAGACTGGGGCCTTGACTACTGGGGCCAGGGAA CCCTGGTCACCGTCTCCTCA |
| | | | SEQ ID NO: 24433 | SEQ ID NO: 28439 |
| | | AA | DIQMIQSPSSLFASVGDRVTITCRTSQGIRNDLG WYQQKPGKAPKRLIYAASSLQSGVPSKFSGSGS GTEFTLSISSLQPEDFATYYCLQHNSYPLTFGGGT KVEIK | QLQLQESGPGLVKPSETLSLTCTVSGGSINRSSYYW GWIRQPPGKGLDWIGNIYYSGSTYYNPSVKSRFTIS VDTSKNQFSLKLSSVTAADTAVYYCARHGKDWGL DYWGQGTLVTVSS |
| | | | SEQ ID NO: 24434 | SEQ ID NO: 28440 |

FIGURE 50
(Continued)

| | | | |
|---|---|---|---|
| iPS:392840 | 21-225_23G1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT ACAGAGTGGGGTCCCATCACAGTTCAGCGGCA GTGGATTTGGGACAGATTTCACTCTCACCATC AGCAGCCTGCAGCCTGAGGATTTTGCAACTTA TTACTGCCAACAGTATAATAGTTACCCATTCA CTTTCGGCCCTGGGACCAAGGTGGATATCAAA<br>SEQ ID NO: 24435 | GAGGTGCAACTGTTGGAGTCTGGGGGAGGCTTG GTACAGCCTGGGGGGTCCCTGAGACTCTCCTGTG CAGCCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT ACCACATATAACACAGACTCCGTGAAGGGCCGG TTCACCATCTCCAGAGACAATTCCAAGAACACGC TATATCTGCAAATGAACAGCCTGAGAGCCGAGG ACACGGCCGTATATTACTGTGCCCGCAGCTCTT GTTTGACTACTGGGGCCAGGGAACCCTGGTCACC GTCTCCTCA<br>SEQ ID NO: 28441 |
| | | AA | DIQMTQSPSSLSASVGDRVTITCRASQGISNYLA WFQQKPGKAPKSLISAASSLQSGVPSQFSGSGFG TDFTLTISSLQPEDFATYYCQQYNSYPFTFGPGT KVDIK<br>SEQ ID NO: 24436 | EVQLLESGGGLVQPGGSLRLSCAASGFTFSSYAMS WVRQAPGRGLEWVSVISGSGGTYNTDSVKGRFTI SRDNSKNTLYLQMNSLRAEDTAVYYCARSSLFDY WGQGTLVTVSS<br>SEQ ID NO: 28442 |
| iPS:392842 | 21-225_23G8 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAACTTCAGCGGCA GTGGATCTGGGACAGATTTCACTCTCACCATC AGTAGCCTGCAGCCTGAAGATTTTGCAACTTA TTACTGCCAACAGTATAATAGTTACCCTTTCAC TATCGGCCCTGGGACCAAGGTGGATATCAAA<br>SEQ ID NO: 24437 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AGCACATACTACGCAGACTCCGTGAAGGGCCGG TTCACCATCTGCAAATGAACAGCCTGAGAGCCGAGG TGTATCTGCAAATGAACAGCCTGAGAGCCGAGG ACACGGCCGTATATTACTGTGCGGTTAGCAGTGG CTGGTTCGCCTGGGCCAGGGAACCCTGGTCACC GTCTCCTCA<br>SEQ ID NO: 28443 |

FIGURE 50
(Continued)

| | | | |
|---|---|---|---|
| iPS:392844 | 21-225_23E11 | AA | DIQMTQSPSSLSASVGDRVTITCRASQGIRNYLA WFQQKPGKAPKSLIYAASSLQSGVPSNFSGSGSG TDFTLTISSLQPEDFATYYCQQYNSYPFTIGPGTK VDIK<br>SEQ ID NO: 24438 | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYCAVSSGWFA WGQGTLVTVSS<br>SEQ ID NO: 28444 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCCTGCATCCAGTT TGCAAAGTGGGGTCCCATCAAGGTTCAGCGGC AGTGGATCTGGGACAGACTTCACTCTCACAAT CAGCAGCCTGCAGCCTGAAGATATAGTTACCCGTGG ACGTTCGGCCAAGGGACCAAGGTGGAAATCA AA<br>SEQ ID NO: 24439 | GAGGTGCAACTGGTGGAGTCTGGGGGAGGCTG GTCAAGCCTGGGGGGTCCTGAGACTCTCCTGTG CAGCCTCTGGATTCACCTTCAGTTCCTATACCAT GAACTGGGTCCGCCAGGCTCCAGGGAAGGGGCT GGAGTGGGTCTCATCCATTAGTGGTAGTAGT TACATATGGTATGTAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGGGGC AGTCTCTGGGGCCAGGGAACCCTGGTCACCGTCT CCTCA<br>SEQ ID NO: 28445 |
| | | AA | DIQMTQSPSSLSASVGDRITITCRASQGIRNDLG WYQQKPGKAPKRLIYPASSLQSGVPSRFSGSGSG TEFTLTISSLQPEDFATYYCLQHNSYPWTFGQGT KVEIK<br>SEQ ID NO: 24440 | EVQLVESGGGLVKPGGSLRLSCAASGFTFSSYTMN WVRQAPGKGLEWVSSISGSSSYIWYDSVKGRFTI SRDNAKNSLYLQMNSLRAEDTAVYYCARDRGSLW GQGTLVTVSS<br>SEQ ID NO: 28446 |

FIGURE 50
(Continued)

| | | | |
|---|---|---|---|
| iPS:392846 | 21-225_24B6 | NA | GACATCCAGATGACCCAGTCTCCATCCTCCT GTCTGCATCTGTCGGAGACAGAGTCACCATCA CTTGCCGGGCAAGTCAGGACATTAGAAATGAT TTAGGCTGGTATCAGCAGAAGCCAGGGAAAG CCCCTAAGCGCCTGATCTATGCTGCATCCAGT TTGCACAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AG<br>SEQ ID NO: 24441 | CAGGTGCAGCTGGTGGAGTCTGGGGGAGGCGTG GTCCAGCCTGGGAGGTCCCCGAGACTCTCCTGTG CAGCGTCTGGATTCATCTTCAGTAACTATGTCAT GCACTGGGTCCGCCAGGCTCCAGGCAAGGGGCT GGAGTGGGTGGCAGTTATATGTGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAATA TAGTAGTGGCTGGTACGACTACGGTATGGACGTC TGGGGCCAAGGGACCACGGTCACCGTCTCCTCA<br>SEQ ID NO: 28447 |
| | | AA | DIQMTQSPSSLSASVGDRVTITCRASQDIRNDLG WYQQKPGKAPKRLIYAASSLHSGVPSRFSGSGS GTEFTLTISSLQTEDFATYYCLQHYSYPRTFGQG TKVEVK<br>SEQ ID NO: 24442 | QVQLVESGGGVVQPGRSPRLSCAASGFIFSNYVMH WVRQAPGKGLEWVAVIWYDGSNKYYADSVKGRF TISRDNSKNTLYLQMNSLRAEDTAVYYCAREEYSS GWYDYGMDVWGQGTTVTVSS<br>SEQ ID NO: 28448 |
| iPS:392848 | 21-225_20F9 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT GCAAAGTGGGGTCCCTTCAAAGTTCAGCGGCA GTGGATCCGGGACAGATTTCACTCTCACCATC AGCAGCCTGCAGCCTGAAGATTATCATAGTTACCCGTGA CGTTCGGCCAAGGGACCAAGGTGGAAATCAA A<br>SEQ ID NO: 24443 | GAAGTGCAGCTGGTGGAGTCGGGGGAGGCCTG GTCAAGCCTGGGGGGTCCCTGAGACTCTCCTGTG CAGCCTCTGGATTCACCTTCAGTAGCATAGCAT GAACTGGGTCCGCCAGGCTCCAGGGAAGGGGCT GGAGTGGGTCTCATCCATTAGTAGTAGTAGTAGT TACATATACTACCAGAGACTCAGTGAAGGGCCGAT TCACCATCTCCAGAGACAACGCCAAGAACTCACT GTATCTGCAAATGAACAGCCTGAGAGCCGAGGA CACGGCTGTGTATTATTGTGCGAGAGATCGTGGG AGCTGCTGGGCCAGGGAACCCTGGTCACCATCT CCTCA<br>SEQ ID NO: 28449 |

FIGURE 50
(Continued)

| | | | |
|---|---|---|---|
| iPS:392850 | 21-225_20H10 | AA | DIQMTQSPSSLSASVGDRITITCRASQGISNYLAWFQQKPGKAPKSLLISAASSLQSGVPSKFSGSGSGTDFTLTISSLQPEDFATYCCQQYHSYPWTFGQGTKVEIK<br>SEQ ID NO: 24444 | EVQLVESGGGLVKPGGSLRLSCAASGFTFSSYSMNWVRQAPGKGLEWVSSISSSSYIYYADSVKGRFTISRDNAKNSLYLQMNSLRAEDTAVYYCARDRGSCWGQGTLVTISS<br>SEQ ID NO: 28450 |
| | | NA | GGCATCCAGATGACCCAGTCTCCATCCTCCCTGTCTGCATCTGTAGGAGACAGAGTCACCATCACTTGCCGGGCAAGTCAGGGCATTAGCAGTTATTTAGCCTGGTATCAGCAGAAACCAGGGAAAGGCCCTAAGTCCCTGATCTATGCTGCATCCAGTTTGCAAAGTGGGGTCCCATCCAAGGTTCAGCGGCAGTGGATCTGGGACAGAATTCACTCTCACAATCAGCAGCCTGCAGCCTGAAGATTTTGCAACTTATTACTGTCTACAGCATATAGTTACCCGCTCACTTTCGGCGGAGGGACCAAGGTGGAGATCAAA<br>SEQ ID NO: 24445 | GAGGTGCAGCTGGTGGAGTCTGGGGGAGGCTGGTCAAGCCTGGGGGGTCCCTGAGACTCTCCTGTGCAGCCTCTGGATTCACCTTCAGTAGTTACTCTATGCATGAACTGGGTCCGCCAGGCTCCAGGGAAGGGGCTGGAGTGGGTCTCATCCATTAGTAGTAGTAGTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTATTTATTACTGTGCGAGAGATCGTGGGAGCCTCGGGGCCAGGGAACCCTGGTCACCGTCTCCTCA<br>SEQ ID NO: 28451 |
| | | AA | GIQMTQSPSSLSASVGDRVTITCRASQGIKNNLGWYQQKPGKGPKCLIYAASSLQSGVPSRFSGSGSGTEFTLTISSLQPEDFATYYCLQHNSYPLTFGGGTKVEIK<br>SEQ ID NO: 24446 | EVQLVESGGGLVKPGGSLRLSCAASGFTFSTYSMNWVRQAPGKGLEWVSSISSSSYIYYADSVKGRFTISRDNAKNSLYLQMNSLRAEDTAIYYCARDRGSLWGQGTLVTVSS<br>SEQ ID NO: 28452 |

FIGURE 50
(Continued)

| | | | |
|---|---|---|---|
| iPS:392852 | 21-225_21A2 | NA | GACATCCAGATGACCCAGTCTCCATCTCCT GTCTGCATCTGTAGGAGACAGAGTCACCATCA CTTGCCGGGCAAGTCAGAGTATTAGTAGTTAT TTAAATTGGTATCAGCAGAAACCAGGGAAAG CCCCTAAGCTCCTGATCTATGCTGCATCCAGT TGCAAAGTGGGGTCCCATCAAGGTTCAGTGGC AGTGGATCTGGGACAGACTTCACTCTCACCAT CAGTAGTCTGCAACCTGAAGATTTTGCAACTT ACTTCTGTCAACAGAGTTACAGAACCCCTTT TTCACTTTCGGCCCTGGGACCAAAGTGGATAT CAAA<br><br>SEQ ID NO: 24447 | GAGGTGCAGCTGTGGAGTCTGGGGGAGGCTTG GTACAGCCTGGGGGGTCCCTGAGACTCTCCTGTG CAGCCTCTAAATTCACCTTTAGCAGCTATGCCAT GAACTGGGTCCGCCAGGCTCCAGGGAAGGGGCT GGAGTGGATCTCAATTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGGCTCGGAGGCTTTTGATATCTGGGGCC AAGGGACAATGGTCACCGTCTCTTCA<br><br>SEQ ID NO: 28453 |
| | | AA | DIQMTQSPSSLSASVGDRVTITCRASQSISSYLNW YQQKPGKAPKLLIYAASSLQSGVPSRFSGSGSGT DFTLTISSLQPEDFATYFCQQSYRTPFFTFGPGTK VDIK<br><br>SEQ ID NO: 24448 | EVQLLESGGGLVQPGGSLRLSCAASKFTFSSYAMN WVRQAPGKGLEWISIISGRGGNTFYADSVKGRFTIS RDNSKNTLYLQMNSLRAEDTAVYYCASRLAVAGS EAFDIWGQGTMVTVSS<br><br>SEQ ID NO: 28454 |
| iPS:392854 | 21-225_21E5 | NA | GACATCCAGATGACCCAGTCTCCATCTCCT GTCTGCATCTGTAGGAGACAGAGTCACCATCA CTTGCCGGGCAAGTCAGGGACAGAGTCACTCACAA TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGACCTCACTCTCACAA TCAGCAGCCTGCAGCCTGAAGATTTTGCAACT TATTACTGTCTACAGCATATAATAGTTACCCCCTC ACTTTCGGCGGAGGGACCAAGGTGGAGATCA AA<br><br>SEQ ID NO: 24449 | CAGGTGCAGCTGGTGGAGTCTGGGGGAGGCGTG GTCCAGCCTGGGAGGTCCCTGAGACTCTCCTGTT CAGCGTCTGATTCAGCTTCACCTTCAGTGACTATGGCAT GCACTGGGTCCGCCAGGCTCCAGGCAAGGGGCT GGAGTGGGTGGCAGTTATATGACACTCCGTGAAGGGCCGA AATAAATACTATGCAGACTCCGTGAAGGGCCGA TTCACCATCTCCAGAGACAATTCCAAGAACGC TGTATCTGCAAATGAACAGCCTGAGAGCCGAGG ACACGGCTATGTATTACTGTACGAGAGAACTGGG GTTCCGGTCTGACTATTGGGGCCAGGGAACCCTG GTCACCGTCTCCTCA<br><br>SEQ ID NO: 28455 |

FIGURE 50
(Continued)

| | | AA | DIQMTQSPSSLSASVGDRVTITCRASQGIRNDLG WYQQKPGKAPKRLIYATSSLQSGVPSRFSGSGSG TEFTLTISSLQPEDFATYYCLQHNSYPLTFGGGT KVEIK<br><br>SEQ ID NO: 24450 | QVQLVESGGGVVQPGRSLRLSCSASGFTFSDYGMH WVRQAPGKGLEWVAVIWYDESNKYYADSVKGRF TISRDNSKNTLYLQMNSLRAEDTAMYYCTRELGFR SDYWGQGTLVTSS<br><br>SEQ ID NO: 28456 |
| iPS:392856 | 21-225_22A2 | NA | GAGGTGCAGCTGTTGGAGTCTGGGGGAGGCTTG GTCCAACCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGGTATTAGTGGTAGTGGAGGT AACACACCTACGCAGCAGACTCCGTGAAGGGCCGG AGTGGATCTGGGACAGATTTCACTCTCACCAT CAGCAGCCTGCAGCCTGAAGATTTTGCAAGTT ATTACTGCCAACAGTATAGTTTCCCGCTC ACTTTCGGCGGAGGGACCAAGGTGGAGATCA AA<br><br>SEQ ID NO: 24451 | GAGGTGCAGCTGTTGGAGTCTGGGGGAGGCTTG GTCCAACCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGGTATTAGTGGTAGTGGAGGT AACACACCTACGCAGCAGACTCCGTGAAGGGCCGG TTCACCATCTCCAGAGACAATTCCAAGAACACGC TGTATCTGCAAATGAACAGCTGAGAGCCGAAG ACACGGCCGTATATTACTGTGCGAAAGTAGTGGG AGCTGTCCACTGGGCGCGGGAACCCTGGTCACC GTCTCCTCA<br><br>SEQ ID NO: 28457 |
| | | AA | DIQMTQSPSSLSASVGDRVTITCRASQDISNYLA WVQQKPGKAPKSLIYAASSLQSGVPSKFSGSGS GTDFTLTISSLQPEDFASYYCQQYNSFPLTFGGG TKVEIK<br><br>SEQ ID NO: 24452 | EVQLLESGGGLVQPGGSLRLSCAASGFTFSSYAMS WVRQAPGKGLEWVSGISGSGGNTPYADSVKGRFTI SRDISKNTLYLQMNSLRAEDTAVYYCAKVVGAVH WGRGTLVTVSS<br><br>SEQ ID NO: 28458 |

FIGURE 50
(Continued)

| | | | | |
|---|---|---|---|---|
| iPS:392858 | 21-225_22H4 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCACTT TATTACTGTCTACAGCATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACTGCA CTGTCTCTGGTGCTCATCAGTAGGAGTAGTTA CTACTGGGGCTGGATCCGCCAGCCCCCAGGGAA GGGGCTGGAGTGGATTGGGAATATTTATTATAGT GGGAGCACCTACCACAACCCGTCTCTCAAGAGTC GAGTCACCATATCGTAGACACGTCCATGAACCA GTTCTCCCTGAAGTTGACCTCTGTGACCGCCGCA GACACGGCTGTGTATTTCTGTGGGAGACATGGAA AAGACTGGGGCCTTGACTACTGGGGCCAGGGAA CCCTGGTCACCGTCTCCTCA |
| | | | SEQ ID NO: 24453 | SEQ ID NO: 28459 |
| | | AA | DIQMTQSPSSLSASVGDRVTITCRASQGIRNDLG WYQQKPGKAPKRLIYAASSVQSGVPSRFSGSGS GTEFTLTISSLQPEDFALYYCLQHNSYPLTFGGG TKVEIK | QLQLQESGPGLVKPSETLSLTCTVSGGSISRSSYYW GWIRQPPGKGLEWIGNIYYSGSTYHNPSLKSRVTIS VDTSMNQFSLKLTSVTAADIAVYFCGRHGKDWGL DYWGQGTLVTVSS |
| | | | SEQ ID NO: 24454 | SEQ ID NO: 28460 |
| iPS:392860 | 21-225_22H8 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGACCTTTTTGTATTGGTACCTGCA GAAGCCAGGCCATCCTCCACAGTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGAATTATTACTGCATGCAAAG TATACAGCTTCCGCTCTCATTCGGCGGAGGGA CCAAGGTGGAGATCAAC | CAGGTGCAGCTGGTGGAGTCTGGGGGAGGCGTG GTCCAGCCTGGGAGGTCCTGAGACTCTCCTGTG CAGCCGTCTGGATTCACCTTCAGTAGTAGTATGGCAT GCACTGGGTCCGCCAGGCTCCAGGCAAGGGCT GGAGTGGGTGGCAGTTATCTGGTATGGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTTGC CTGGTACGAAGACTACTGGGGCCAGGGAACCCT GGTCACCGTCTCCTCA |
| | | | SEQ ID NO: 24455 | SEQ ID NO: 28461 |

FIGURE 50
(Continued)

| | | | | |
|---|---|---|---|---|
| iPS:392864 | 21-225_23B9 | AA | DIVMTQTPLSLSVTPGQPASISCKSSQSLLHSDGK TFLYWYLQKPGHPPQLLIYEVSNRFSGVPDRFSG SGSGTDFTLKISRVEAEDVGIYYCMQSIQLPLSFG GGTKVEIN | QVQLVESGGGVVQPGRSLRLSCAASGFTFSSYGMH WVRQAPGKGLEWVAVIWYDGNNKYYADSVKGRF TISRDNSKNTLYLQMNSLRAEDTAVYYCARELAW YEDYWGQGTLVTVSS |
| | | | SEQ ID NO: 24456 | SEQ ID NO: 28462 |
| | | NA | GAAATTGTGTTGACGCAGTCTCCAGGCACCCT GTCTTTGTCTCCAGGAGAAAGAGCCACCCTCT CCTGCAGGGCCAGTCAGAATGTTTACAGCAGC TACTTAGCCTGGTACCAGCAGAAACCTGGCCA GACTCCCAGGCTCCTCATCTATGGTGCATCCA GCAGGGCCAGTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCACCT CGGACGTTCGGCCAAGGGACCAAGGTGGAAA TCAAA | CAGGTGCAGCTGCAGGCTGCGGCCCAGGACTG GTGAAGCCTTCACAGACCCTGTCCTCACCTGCA CTGTCTCTGATGGCTCCATCAGCAGTGGTGGTTA CTACTGGAGCTGGATCCGCCAGCACCCAGGGAA GGGCTGGAGTGGATTGGGTACATCTATTACAGT GGGAGCACCTACTACAACCCGTCCCTCAAGAGTC GAGTTACCATATCAGTAGACACGTCTAAGAACCA GTTCTCCCTGAAGCTGAGTTCTGTGACTGCCGCG GACACGGCCGTATATTACTGTGCGAGAGAGGAC GGTGCCTTCGGCTACTACGGTATGGACGTCTGGG GCCAAGGGACCACGGTCACCGTCTCCTCA |
| | | | SEQ ID NO: 24457 | SEQ ID NO: 28463 |
| | | AA | EIVLTQSPGTLSLSPGERATLSCRASQNVYSSYLA WYQQKPGQTPRLLIYGASSRASGIPDRFSGSGSG TDFTLTISRLEPEDFAVYYCQQYGSSPRTFGQGT KVEIK | QVQLQASGPGLVKPSQTLSLTCTVSDGSISSGGYY WSWIRQHPGKGLEWIGYIYYSGSTYYNPSLKSRVTI SVDTSKNQFSLKLSSVTAADTAVYYCAREDGAFGY YGMDVWGQGTTVTVSS |
| | | | SEQ ID NO: 24458 | SEQ ID NO: 28464 |

FIGURE 50
(Continued)

| | | | | |
|---|---|---|---|---|
| iPS:392866 | 21-225_23H11 | NA | GACATCCAGATGACCCAGTCTCCATCCTCCT GTCTGCATCTGTAGGAGACAGAGTCACCATCA CTTGCCGGGCAAGTCAGGACAGTGCATTAGAAATGAT TTAGACTGGTATCAGCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATCGTTACCCGCTC ACTTTCGGCGGAGGGACCAAGGTGGAGATCA AA SEQ ID NO: 24459 | CAGGAGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGTCCAGGCAAGGGCT GGAGTGGGTGGCAGTTATATGGTATGAAAAT AATAAATACTATGTAGACTCCGTGAAGGGCCGAT TCACCATCTCCAGAGACAACTCCAAGAACACGCT GTATCTGCAAATGAACAGCCTGAGAGCCGAGGA CACGGCTGTGTATTACTGTGCGAGAGAATTGGGG TTCCGGTCTGACTACTGGGGCCAGGGAACCCTGG TCACCGTCTCCTCA SEQ ID NO: 28465 |
| | | AA | DIQMTQSPSSLSASVGDRVTITCRASQGIRNDLD WYQQKPGKAPKRLIYAASSLQSGVPSRFSGSGS GTEFTLTISSLQPEDFATYYCLQHNRYPLTFGGG TKVEIK SEQ ID NO: 24460 | QEQLVESGGGVVQPGRSLRLSCAASGFTFSSYGMH WVRQAPGKGLEWVAVIWYDENNKYYVDSVKGRF TISRDNSKNTLYLQMNSLRAEDTAVYYCARELGFR SDYWGQGTLVTVSS SEQ ID NO: 28466 |
| iPS:392868 | 21-225_24D6 | NA | GACATCCAGATGACCCAGTCTCCATCCTCCT GTCTGCATCTGTAGGAGACAGAGTCACCATCA CTTGCCAGGCGAGTCAGGACAGACATTAACAACTAT TTAAATGGTATCAGCAGCAGAAACCAGGGAAAG CCCTTAAGCTCCTGATATACGATGCATCCAGT TGGAAACAGGGGTCCCATCAAGGTTCAGTGGA AGTGGATCTGGGACAGATTTTACTTTCACCAT CAGCAGTCTGCAGCCTGAAGATATGAAATCTCCGATC ATTACTGTCAACAGTATGATAATCTCCCGATC ACCTTCGGCCAAGGGACACGACTGGAGATTAA A SEQ ID NO: 24461 | CAGGTGCAACTGGTAGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGTTCCAGGCAAGGGGCT GGAGTGGGTGGCAATTATATCATATGCTGGAAGT AATAAATCTATGCAGACTCCGTGAAGGGCCGAT TCACCATCTCCAGAGACAATTCCAAGAACCTGAGGA GTATCTGCAAATGAACAGCCTGAGAGCTGAGGA CACGGCTGTGTATTACTGTGTGAGACGGGGATAC AGTATGGCGGGTACGGTATGGACGTGGGGC CAAGGGGCCACGGTCACCGTCCTCA SEQ ID NO: 28467 |

FIGURE 50
(Continued)

| | | | |
|---|---|---|---|
| | | AA | DIQMTQSPSSLSASVGDRVTITCQASQDINNYLNWYQQKPGKALKLLIYDASDLETGVPSRFSGSGSGTDFTFTISSLQPEDIAIYYCQQYENLPITFGQGTRLEIK<br>SEQ ID NO: 24462 | QVQLVESGGGVVQPGRSLRLSCAASGFTFSSYGMHWVRQVPGKGLEWVAIISYAGSNKSYADSVKGRFTISRDNSKNTLYLQMNSLRAEDTAVYYCVRRGYSYGGYGMDVWGQGATVTVSS<br>SEQ ID NO: 28468 |
| iPS:392870 | 21-225_20G9 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGATTCCAGTTTGCAAAGTGGGGTCCCATCAAGGTTCAGCGGCAGTGGATCTGGGACAGATTCACTCTCACAATCAGCAGCCTGCAGCCTGAAGATTTTGCAACTTATTACTGTCTACAGCATAGTACTTACCCTCTCACTTTCGGCGGAGGGACCAAGGTGGAGATCAAA<br>SEQ ID NO: 24463 | CAGCTGCAGCTGCAGGAGTCGGGCCCAGGACTGGTGAAGCCTTCGGAGACCCTGTCCCTCACCTGCACTGTCTCTGGTGGCTCCATCAGCAGGAGTAGTTACTACTGGGGCTGGATCCGCCAGCCCCCAGGGAAGGGGACTGGAGTGGATTGGGAGTATCATTATAGTGGGAGCGCCTCTTACAACCGGTCCCTCAAGAGTCGAGTCACCATATCCGTAGACACGTCCAGGAACCAGTTCTCCCTGAAGCTGAGCTCTGTGACCGCCGCAGACACGGCTGCGTATTACTGTGCGAGACTGAGCAGCAGTGGTCTTTTGACTACTGGGGCCAGGGAACCCTGGTCACCGTCTCCTCA<br>SEQ ID NO: 28469 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHSTYPLTFGGGTKVEIK<br>SEQ ID NO: 24464 | QLQLQESGPGLVKPSETLSLTCTVSGGSISRSSYYWGWIRQPPGKGLEWIGSIYYSGSASYNPSLKSRVTISVDTSRNQFSLKLSSVTAADTAAYYCARLSSSWSFDYWGQGTLVTVSS<br>SEQ ID NO: 28470 |

FIGURE 50
(Continued)

| | | | | |
|---|---|---|---|---|
| iPS:392872 | 21-225_20B11 | NA | GACATCCAGATGACCCAGTCTCCATCTCCCT GTCTGCATCTGTAGGAGACAGAGTCACCATCA CTTGCCGGGCAAGTCAGGGCATTGGAAATGAT TTAGGCTGGTATCAGCAGAAACCAGAGAAAG CCCCTAAGCGCCTGATCTATGCTGCATCCAGT TTGCATAGTGGGGTCCCATCCAGGTTCAGCGG CAGTGGCTCTGGGACAGAATTCACTCTCACAA TCAGCAGCCTGCAGCCTGAAGATTTTGCAACT TATTACTGTCTACAGCATTATAGTTACCCTCGG ACGTTTGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGTCAT GCACTGGGTCCGCCAGGCTCCAGGCAAGGGCT GGAGTGGGTGGCAGTTATATGTGATGAAGT AATAAATACTATGCAGAGACTCCGTGAAGGTCCGAT TCACCGTCTCCAGAGACAATTCCAAGAACACGCT GTCTCTGCAAATGAACAGCCTGAGAGCCGAGGA CACGGCTGTGTATTACTGTGCGAGAGAGATAT ACCAGTGGCTGTATGACTACGGTATGGACGTCT GGGGCCAAGGGACCACGGTCACCGTCTCCTCA |
| | | | SEQ ID NO: 24465 | SEQ ID NO: 28471 |
| | | AA | DIQMTQSPSSLSASVGDRVTITCRASQGIGNDLG WYQQKPEKAPKRLIYAASSLHSGVPSRFSGSGSG TEFTLTISSLQPEDFATYYCLQHYSYPRTFGQGT KVEIK | QVQLVESGGGVVQPGRSLRLSCAASGFTFSSYVMH WVRQAPGKGLEWVAVIWYDGSNKYYADSVKVRF TVSRDNSKNTLSLQMNSLRAEDTAVYYCARERYTS GWYDYGMDVWGQGTTVTVSS |
| | | | SEQ ID NO: 24466 | SEQ ID NO: 28472 |
| iPS:392874 | 21-225_21D2 | NA | GACATCCAGATGACCCAGTCTCCATCTCCCT GTTTGCATCTGTAGGAGACAGAGTCACCATCA CTTGCCGGGCAAGTCAGAGCATTAGCAGCTAT TTAAATTGGTATCAGCAGAAACCAGGGAGAG CCCCTAAACTCCTGATCTATGATACATCCAGTT TGCAAAGTGGGGTCCCATCAAGGTTCAGCGGC AGTGGATCTGGGACAGATTTCACTCTCACCAT CAACAGTCTGCAACCTGAAGATTTTGCAACTT ACTACTGTCAACAGAGACTTACAATATTCTCCG GAGGCCAGTTTTGGCCGGGGGACCAAGCTGG AGATCAAA | GAGGTGAAGCTGTTGGAGTCTGGGGGAGGCTTG GTACAGCCGGGGGGTCCCTGAGACTCTCCTGTG CAGCCTCTGATTCACCTTTAACAACTATGCCAT GAGCTGGGTCCGCCAGGCTCCAGGGAAGGGCT GGAGTGGGTCTCAGTTCTTAGTGGTAGTGGTGGT AGCACATTCTACGCAGACTCCGTGAAGGGCCGGT TCACCATCTCCAGAGACAATTCCAAGAACACGCT GTATCTGCAAATGAGCAGCCTGAGAGCCGGGA CACGGCCGTATATTCTGTCCGATATTGTAGT AGTGCCAGGTGCCCTTATGATGCCTTTGATATCT GGGGCCAAGGGACAATGGTCACCGTCTCCTCA |
| | | | SEQ ID NO: 24467 | SEQ ID NO: 28473 |

FIGURE 50
(Continued)

| | | | |
|---|---|---|---|
| | | AA | DIQMTQSPSSLFASVGDRVTITCRASQSISDYLN WYQQKPGRAPKLLIYDTSSLQSGVPSRFSGSGSG TDFTLTINSLQPEDFATYYCQQTYNILPERSFGRG TKLEIK<br>SEQ ID NO: 24468 | EVKLLESGGGLVQPGGSLRLSCAASGFTFNNYAMS WVRQAPGKGLEWVSVLSGSGGSTFYADSVKGRFTI SRDNSKNTLYLQMSSLRAGDTAVYFCARYCSSARC PYDAFDIWGQGTMVTVSS<br>SEQ ID NO: 28474 |
| iPS:392876 | 21-225_21F7 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCCTGCATCCAAT TTTCAAAGTGGGGTCCCATCAAGGTTCAGCGG CAGTGGATCTGGGACAGATCACTCTCACAA TCAGCAGCCTGCAGCCTGAAGATTTTGCAACT TATTACTGTCTACAGCATATAATAATTACCCGTG GACGTTCGGCCAAGGGACCAAGGTGGAAATC AAA<br>SEQ ID NO: 24469 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGATGAGTTATGGAAAT AATAAATACTATGTAGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCGAGAGATCTTGGC TGGACGGAAGAGTACTGGGGCCAGGGAACCCTG GTCACCGTCTCCTCA<br>SEQ ID NO: 28475 |
| | | AA | DIQMTQSPSSLSASVGDRVTITCRASQDIRNDLG WYQQKPGKAPKRLIYAASNFQSGVPSRFSGSGS GTEFTLTISSLQPEDFATYYCLQHNNYPWTFGQG TKVEIK<br>SEQ ID NO: 24470 | QVQLVESGGGVVQPGRSLRLSCAASGFTFSDYGM HWVRQAPGKGLEWVAVIWFDGNNKYYVDSVKGR FTISRDNSKNTLYLQMNSLRAEDTAVYYCARDLG WTEEYWGQGTLVTVSS<br>SEQ ID NO: 28476 |

FIGURE 50
(Continued)

| | | | |
|---|---|---|---|
| iPS:392878 | 21-225_22C5 | NA | GACATCCAGATGACCCAGTCTCCAGCCTCCCTGTCTGCGTCTGTTGGAGACAGAGTCACCATCACTTGCCGGGCAAGTCAGAGCATTAGCAGCTATTTAAATTGGTATCAGCAGAAACCAGGGAAGGCCCCTAAACTCCTGATCTATGCTGCATCCGTTTGCAACATGGGATCCCATCAAGGTTCAGTGGCAGGGATCTGGGACAGATTTCACTCTCATCATCAGTAGTCTGCAACCTGAAGATTTGCAACTTACTACTGTCAACAGAGTTACAGAACCCTTATCAACAAGTGGTGAGATCAAACTCAAAGAT |
| | | | SEQ ID NO: 24471 | GAGGTGCAGCTGTTGGAGTCTGGGGAGGCTTGGTACAGGTTGGGGGGTCCCTGAGACTCTCCTGTGCAGCCTCTGATTCACTTTAGCAGCTATGCCATGAGCTGGGTCCGCCAGGCTCCAGGGATGGGGCTGGAGTGGGTCTCAATTATTAGTGGTAGTGGTGGTACACATACCGGGACTCCGTGAAGGGCCGATTCACCATCTCCAGAGACAACGCCTGAAGAACACGCTGTATCTGCAAATGAACAGCCTGAGAGCCGAGGACACGGCCGTATATTATTGTGCGTCCGTATAGCAGTGGCTGGCTCGGAGGCTTTGATATCTGGGGCAAGGGACAATGGTCACCGTCTCTTCA |
| | | | | SEQ ID NO: 28477 |
| | | AA | DIQMTQSPASLSASVGDRVTITCRASQSISSYLNWYQQKPGKAPKLLIYAASVLQHGIPSRFSGSRGSGTDFTLTISSLQPEDFATYYCQQSYRTPLFTFGPGTKVDFK | EVQLLESGGGLVQVGGSLRLSCAASGFTFSSYAMSWVRQAPGMGLEWVSIISGSGGYTYYADSVKGRFTISRDNSKNTLYLQMNSLRAEDTAVYYCASRIAVAGSEAFDIWGQGTMVTVSS |
| | | | SEQ ID NO: 24472 | SEQ ID NO: 28478 |
| iPS:392880 | 21-225_22F9 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTACAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATATGTAGACTCCGTGAAGGGCCGTAATAAACACATCTCCAGAGACAATTCCAAGAGCACGCTGTATCTGCAAATGAATAGTCTGAGAGCTGAGGACACGGCTGTATATTACTGTGTGAGAGAGTTAGGCTTCCAGTCTGACTACTGGGGCCAGGGAACCCCGGTCACCGTCTCCTCA |
| | | | SEQ ID NO: 24473 | SEQ ID NO: 28479 |

FIGURE 50
(Continued)

| | | | |
|---|---|---|---|
| iPS:392882 | 21-225_23A3 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 24474 | QVQMVESGGGVVQPGRSLRLSCAASGFTFSSYGM HWVRQAPGKGLEWVAVIWYEENNKDYVDSVKGR FTISRDNSKSTLYLQMNSLRAEDTAVYYCVRELGF QSDYWGQGTPVTVSS<br>SEQ ID NO: 28480 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCAATT TATTTCTGTCTACAGCATATAGTTACCCGCTC ACTTTCGGCGGAGGGACCAAGGTGGAGATCA AA<br>SEQ ID NO: 24475 | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGCA GGGGCTGGAGTGGATTGGAATATTTATTATAGT GGGAGCACCTACAACAACCCGTCCCTCAAGAGT CGAGTCTCCATATCCGTTGACACGTCCAAGAACC AGTTCTCCCTGAACCTGAGCTCTGTGACCGCGC AGACACGGCTGTGTATTACTGTGGGAGACATGGA AAAGACTGGGGCCTTGACTTCTGGGGCCAGGGA ACCCTGGTCACCGTCTCCTCA<br>SEQ ID NO: 28481 |
| | | AA | DIQMTQSPSSLSASVGDRVTITCRASQGIRNDLG WYQQKPGKAPKRLIYAASSVQSGVPSRFSGSGS GTEFTLTISSLQPEDFAIYFCLQHNSYPLTFGGGT KVEIK<br>SEQ ID NO: 24476 | QLQLQESGPGLVKPSETLSLTCTVSGGSISRSSYYW GWIRQPPGQGLEWIGNIYSGSTYNNPSLKSRVSIS VDTSKNQFSLNLSSVTAADTAVYYCGRHGKDWGL DFWGQGTLVTVSS<br>SEQ ID NO: 28482 |

FIGURE 50
(Continued)

| | | | |
|---|---|---|---|
| iPS:392884 | 21-225_23A10 | NA | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGGTA TAGCAGTGGCTGGCACGACTACGGTATGGACGTC TGGGGCCAAGGGACCACGGTCACCGTCTCCTCA<br>SEQ ID NO: 28483 |
| | | | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGGTCCCATCAAGGTTCAGCGG CAGTGGATCTGGGACAGAATTCACTCTCACAA CTGGCAGCCTGCAGCCTGAAGATTTTGCAACT TATTACTGTCTGCAACATTATAGTTACCCTCGG ACGTTCGGCCAAGGGACCAAGGTGGAAATCA AA<br>SEQ ID NO: 24477 | AA | DIQMTQSPSSLSASVGDRVTITCRASQGIRNDLG WYQQKPGKAPKRLIYAASSLQSGVPSRFSGSGS GTEFTLTIGSLQPEDFATYYCLQHYSYPRTFGLG TKVEIK<br>SEQ ID NO: 24478 |
| | | | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERYSS GWHDYGMDVWGQGTTVTVSS<br>SEQ ID NO: 28484 |
| iPS:392886 | 21-225_23A12 | NA | CAGGTGCAGCTGGTGCAGTCTGGGGCTGAGGTG AAGAAGCCTGGGGCCTCAGTGAAGGTCTCCTGC AAGGCTTCTGGATACCCCTTCACCAATTATGATA TCAACTGGGTGCGACAGGCCACTGGACAAGGC TTGAGTGGATGGGATGGATGCACAGAAGTTCAGGCAG TAACACAGGCTATGCACAGAAGTTCCAGGCAG AGTCACCATGACCAGGAACACCTCCATAAACAC AGCCTACATGGAACTGAGCAGCCTGAGATCTGA GGACACGGCCGTGTATTACTGTGCGGGTAGCAGT GGCTGGTACTACTTTGACTACTGGGGCCAGGGAA CCCTGGTCACCGTCTCCTCA<br>SEQ ID NO: 28485 |
| | | | GACGTCGTGATGACCCAGTCTCCAGACTCCT GGCTGTGTCTCTGGGCGAGAGGGCCACCATCA ACTGCAAGTCCAGCCAGAGTGTTTTATACAGC TCCAACAATAACAATTATTAGCTTGGTACCA GCAGAAACCAGGACAGCCTCCTAAGCTGCTCA TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCCGTTTATTACTGTCAGCAAG TATTATGATACTCCTCCGACGTTCGGCCAAGG GACCAAGGTGGAAATCAAA<br>SEQ ID NO: 24479 | | |

FIGURE 50
(Continued)

| | | | |
|---|---|---|---|
| iPS:392888 | 21-225_25A2 | AA | DIVMTQSPDSLAVSLGERATINCKSSQSVLYSSN NNNYLAWYQQKPGQPPKLLIYWTSTRESGVPDR FSGSGSGTDFTLTISSLQAEDVAVYYCQQYDTP PTFGQGTKVEIK<br>SEQ ID NO: 24480 | QVQLVQSGAEVKKPGASVKVSCKASGYPFTNYDIN WVRQATGQGLEWMGWMHPNSGNTGYAQKFQGR VTMTRNTSINTAYMELSSLRSEDTAVYYCAGSSGW YYFDYWGQGTLVTVSS<br>SEQ ID NO: 28486 |
| | | NA | GATATTGTGATGAACCAGACTCCACTCTCTCT GTCCGTCACCCCTGGACAGCCGGGCTCCATCT CCTGCAAGTCTAGTCAGAGCCTCCTACATAGT GAAGGAAAGACCTATTTGTATTGGTATCTGCA GAAGCCAGGCCAGCCTCCACAACTCCTGATCT ATGAAATTTCCAACGGTTCTCTGGAGTGCCA GCTAGGTTAAGTGGCAGCGGGTCAGGGACAG ATTTCACACTGAAAATCAGCCGGGTGGAGGCT GAGGATGTTGGGGTTTATTACTGCATGCAAAG TACACAGTTTCCGCTCACTTTCGGCGGAGGGA CCAAGGTGGAGATCAAA<br>SEQ ID NO: 24481 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGCATGATGGAAGT AATAAATACTATGCAGACTCCGTGAAGGGCCGA TTCACCATCTCCAGAGACAACGCAATTCCAAGAACACGC TGTATCTGCAAATGAACAGCCTGAGAGCCGAGG ACACGGCTGTGTATTACTGTGCGAGAAGGTATAG CAGCAGCTGGTCAGGGGGTATGGACGTCTGGGG CCAAGGGACCACGGTCACCGTCTCCTCA<br>SEQ ID NO: 28487 |
| | | AA | DIVMNQTPLSLSVTPGQPASISCKSSQSLLHSEGK TYLYWYLQKPGQPPQLLIYEISNRFSGVPARLSG SGSGTDFTLKISRVEAEDVGVYYCMQSTQFPLTF GGGTKVEIK<br>SEQ ID NO: 24482 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 28488 |

FIGURE 50
(Continued)

| | | | |
|---|---|---|---|
| iPS:392890 | 21-225_20H9 | NA | GACATCCAGATGACCCAGTCTCCATCCTCACT<br>GTCTGCATCTGTAGGAGACAGAGTCACCATCA<br>CTTGTCGGGCGAGTCAGGGACATTAGCAATTAT<br>TTAGCCTGGTTTCAGCAGAAACCAGGGAAAGC<br>CCCTAAGTCCCTGATCTCTGCTGCATCCAGTTT<br>GCAAAGTGGGGTCCCATCAAAGTTCAGCGGCA<br>GTGGATCTGGGACAGATTCACTCTCACCATC<br>AGCAGCCTGCAGCCTGAAGATTTTGCAACTTA<br>TTACTGCCAACAGTATAATAGTTACCCATTCA<br>CTTTCGGCCCTGGGACCAAAGTGGATATCAAA<br><br>SEQ ID NO: 24483 | GAGGTGCAGCTGTTGGAGTCTGGGGGAGGCTTG<br>GTACAGCCTGGGGGGTCCCTGAGACTCTCCTGTG<br>CAGCCTCCGGATTCACCTTTAGCAGCTATGCCAT<br>GAGCTGGGTCCGCCAGGCTCCAGGGAAGGGGCT<br>GGAGTGGGTCTCAGTTATTAGTGGTAGTGGTGGT<br>TACACATACTACGCAGACTCCGTGAAGGGCCGGT<br>TCACCATCTCCAGAGACAATTCCGAGAACACGCT<br>GTATCTGCAAATGAGCAGCCTGAGAGCCGAGGA<br>CACGGCCGTTTATTACTGTGCGAAAGGGGGTCC<br>CTCTTCTACTGGGGCCAGGGAACCCTGGTCACCG<br>TCTCCTCA<br><br>SEQ ID NO: 28489 |
| | | AA | DIQMTQSPSSLSASVGDRVTITCRASQGISNYLA<br>WFQQKPGKAPKSLISAASSLQSGVPSKFSGSGSG<br>TDFTLTISSLQPEDFATYYCQQYNSYPFTFGPGT<br>KVDIK<br><br>SEQ ID NO: 24484 | EVQLLESGGGLVQPGGSLRLSCAASGFTFSSYAMS<br>WVRQAPGKGLEWVSAISGSGGYTYYADSVKGRFT<br>ISRDNSENTLYLQMSSLRAEDTAVYYCAKGGSLFY<br>WGQGTLVTVSS<br><br>SEQ ID NO: 28490 |
| iPS:392892 | 21-225_20C11 | NA | GACATCCAGATGACCCAGTCTCCATCCTCACT<br>GTCTGCATCTGTTGGAGACAGAGTCACCATCA<br>CTTGTCGGGCGAGTCAGGACAGTTAGCAATTAT<br>TTAGCCTGGTTTCAGCAGAAACCAGGGAAAGC<br>CCCTAAGTCCCTGATCTATGCTGCATCCAGTTT<br>GCAAAGTGGGGTCCCATCAAAGTTCAGAGGC<br>AGTGGATCTGGGACAGATTTCACTCTCACCAT<br>CAGCAGCCTGCAGCCTGAAGATTTTGCAACTT<br>ATTACTGCCAACAGTATCATAGTTCCCATTCA<br>CTTTCGGCCCTGGGACCAAAGTGGATGTCAAA<br><br>SEQ ID NO: 24485 | GAGGTGCAGCTGTTGGAGTCGGGGGAGGCTTG<br>GTACAGCCTGGGGGGTCCCTGAGACTCTCCTGTG<br>CAGCCTCTGGATTCTCCTTTAGTAGCTATGCCAT<br>GAGCTGGGTCCGCCAGGCTCCAGGGAAGGGGCT<br>GGAGTGGGTCTCAACTATTAGTGGTCGTGGTGGT<br>CACACATACTACGCAGACTCCGTGAAGGGCCGG<br>TTCGCCATCTCCAGAGACAGTTCCAAGAACACGC<br>TGTATCTGCAAATGCGTATATTACTGTGCGAAACAGGACTG<br>ACACGGCCGTATATTACTGTGCGAAACAGGACTG<br>CTGGGGCCAGGGAACCCTGGTCACCGTCTCCTCA<br><br>SEQ ID NO: 28491 |

FIGURE 50
(Continued)

| | | | | |
|---|---|---|---|---|
| | | AA | DIQMTQSPSSLSASVGDRVTITCRASQDISNYLA WFQQKPGKAPKSLIYAASSLQSGVPSKFRGSGSG TDFTLTISSLQPEDFATYYCQQYHSFPFTFGPGTK VDVK<br><br>SEQ ID NO: 24486 | EVQLLESGGGLVQPGGSLRLSCAASGFSFSSYAMS WVRQAPGKGLEWVSTISGRGGHTYYADSVKGRFA ISRDSSKNTLYLQMNSLRAEDTAVYYCAKQDCWG QGTLVTVSS<br><br>SEQ ID NO: 28492 |
| iPS:392894 | 21-225_21G2 | NA | GACATCCAGATGACCCAGTCTCCATCCTCCCT GTCTGCGTCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAACATAATAGTTACCCGTGG ACGTTCGGCCTAGGGACCAAGGTGGTCATCAA A<br><br>SEQ ID NO: 24487 | CAGGTGCAACTGGTGGAGTCTGGGGGAGGCGTG GTCCAGCCTGGGAGGTCCCTGAGACTCTCCTGTG CAGCGTCTGGATTCAGTTCAGTGACTATGGCAT GCACTGGGTCCGCCAGGCTCCAGGCAAGGGGCT GGAGTGGATGGCAGTTATATGTATGATGTAACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTTTATTACTGTGCGAGAGAGCTTGG CTGGTACGAGGACTACTGGGGCCAGGGAACCCT GGTCACCGTCTCCTCA<br><br>SEQ ID NO: 28493 |
| | | AA | DIQMTQSPSSLSASVGDRVTITCRASQGIRNDLG WYQQKPGKAPKRLIYTSSSLQSGVPSRFSGSGSG TEFTLTISSLQPEDFATYYCLQHNSYPWTFGLGT KVVIK<br><br>SEQ ID NO: 24488 | QVQLVESGGGVVQPGRSLRLSCAASGFTFSDYGM HWVRQAPGKGLEWMAVIWYDVTNKYYADSVKG RFTISRDNSKNTLYLEMNSLRAEDTAVYYCARELG WYEDYWGQGTLVTVSS<br><br>SEQ ID NO: 28494 |

FIGURE 50
(Continued)

| iPS:392896 | 21-225_21G7 | NA | GACATCCAGATGACCCAGTCTCCATCCTCCT GTCTGCATCTGTAGGAGACAGAGTCACCATCA CTTGCCGGGCAAGTCAGGGCGTTAGAAATGAT TTAGGCTGGTATCAGCAGAAACCAGGGAAAG CCCCTCAGCGCCTGATCTATGCTGCATCCAGTT TGCAAAGTGGGGTCCCATCAAGGTTCAACGGC AGTGGATCTGGGACAGAATTCACTCTCACAAT CAGCAGCCTGCAGCCTGAAGATTTTGCAACTT ATTACTGTCTACAGCATAGTAGTTACCCGCTC ACTTTCGGCGGAGGGACCAAGGTGGAGATCA AA | CAGCTGCAGCTGCAGGAGTCGGGCCCAGGACTG GTGAAGTTTTCGGAGACCCTGTCCCTCACCTGCA CTGTCTCTGGTGGCTCCATCAGCAGAAGTAGTTA CTACTGGGGCTGGATCCGCCAGCCCCAGGGAA GGGGCAGGAGTGGATAGGAATATCTATTATAG TGGGTATAGTTACTACAATCCGTCCCTCAAGAGT CGAGTCACCATATCCGTAGACACGTCCAAGAACC AGTTCTCCCTGAAGCTGAGCTCTGTGACCGCGC AGACACGGCTGTGTATTACTGTGCGAGACATAGC ACCAGCTGGTCCCTTGACTACTGGGGCCAGGGAA CCCTGGTCACCGTCCTCA |
| | | | SEQ ID NO: 24489 | SEQ ID NO: 28495 |
| | | AA | DIQMTQSPSSLSASVGDRVTITCRASQGVRNDLG WYQQKPGKAPQRLIYAASSLQSGVPSRFNGSGS GTEFTLTISSLQPEDFATYYCLQHSSYPLTFGGGT KVEIK | QLQLQLQESGPGLVKFSETLSLTCTVSGGSISRSSYYW GWIRQPPGKGQEWIGNIYYSGYSYYNPSLKSRVTIS VDTSKNQFSLKLSSVTAADTAVYYCARHSTSWSLD YWGQGTLVTVSS |
| | | | SEQ ID NO: 24490 | SEQ ID NO: 28496 |
| iPS:392898 | 21-225_21H10 | NA | GAAATTGTGTTGACGCAGTCTCCAGGCACCCT GTCTTTGTCTCCAGGGGAAAGAGCCACCCTCT CCTGCAGGGCCAGTCAGAGTTTAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCACGC AGTTTGGCCAGGGGACCAAGCTGGAGATCAA A | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCTGGAT GAACTGGGTCCGCCAGGCTCCAGGAAGGGGCT GGAGTGGGTTGGCCGTATTAAAAGCAAAACTGA TGGTGGGACAACAGACTACGCTGCACCGTGAA AGGCAGATTCACCATCTCAAGAGATGATTCAAA AAACACGCTGTATCTGCAAATGAACAGCCTGAA AACCGAGGACACAGCCGTGTATTACTGTACCACA GAAGGCTGAACACGGACTACTGGGGCCAGGGA ACCCTGGTCACCGTCTCCTCA |
| | | | SEQ ID NO: 24491 | SEQ ID NO: 28497 |

FIGURE 50
(Continued)

| | | | |
|---|---|---|---|---|
| iPS:392900 | 21-225_22F2 | AA | EIVLTQSPGTLSLSPGERATLSCRASQSFSSSYLA WYQQKPGQAPRLLIYGASSRATGIPDRFSGSGSG TDFTLTISRLEPEDFAVYYCQQYGSSRSFGQGTK LEIK<br><br>SEQ ID NO: 24492 | EVQLVESGGGLVKPGGSLRLSCAASGFTFSNAWM NWVRQAPGKGLEWVGRIKSKTDGGTTDYAAPVK GRFTISRDDSKNTLYLQMNSLKTEDTAVYYCTTEG WNTDYWGQGTLVTVSS<br><br>SEQ ID NO: 28498 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTACAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATATAAGTACCCGCTC ACTTTCGGCGGAGGGACCAAGGTGGAGATCA AA<br><br>SEQ ID NO: 24493 | CAGGTGCAGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTAGACTCCGTGAGGGGCCGA TAATAAATACTACTATGTAGACTCCGTGAGGGGCCGA TTCACCATCTCAGAGACAATTCCAAGAGACAGC TGTATCTGCAAATGAACAGCCTGAGAGCCGAGG ACACGGCTGTTTATTACTGTGTGAGAGAGTAGG CTTCCAGTCTGACTACTGGGGCCAGGGAACCCG GTCACCGTCTCCTCA<br><br>SEQ ID NO: 28499 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br><br>SEQ ID NO: 24494 | QVQLVESGGGVVQPGRSLRLSCAASGFTFSDYGM HWVRQAPGKGLEWVAVIWYEGSNKYYVDSVRGR FTISRDNSKSTLYLQMNSLRAEDTAVYYCVRELGF QSDYWGQGTPVTVSS<br><br>SEQ ID NO: 28500 |

FIGURE 50
(Continued)

| | | | | |
|---|---|---|---|---|
| iPS:392902 | 21-225_22D5 | NA | GACATCCAGATGACCCAGTCTCCATCCTCCCT GTCTGCATCTGTAGGAGACAGAGTCACCATCA CTTGCCGGGCAAGTCAGAACATTTTAGTTAT TTAAATTGGTATCATCAGAAACCAGGGAAAGC CCCTAAGCTCCTGATCTATGCTGCATCCAGTT TGCAAAGTGGGGTCCCATCAAGGTTCAGTGGCA GTGGATCTGGGACAGATTTCACTCTCACCATC AGCAGTCTACAACCTGAAGATTTTGCAACTTA CTACTGTCAACAGAGTTACAGTACCCCTAT TCACTTTCGGCCCTGGGACCAAAGTGGATATC AAA | GAGGTGCAGCTGTTGGAGTCTGGGGGAGGCTTG GTACAGCCTGGGGGGTCCCTGAGACTCTCCTGT CAGCCTCTGAATTCACCTTTAGCAGCTATGCCAT GAGCTGGGTCCGCCAGGCTCCAGGGAAGGGCT GGAGTGGGTCTCAGTTATTAGTGGTCGTGGTGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTATAGCA GTGGCTGGCTCGGAGGCTTTTGATATCTGGGGCC AAGGGACAATGGTCACCGTCTCTTCA |
| | | | SEQ ID NO: 24495 | SEQ ID NO: 28501 |
| | | AA | DIQMTQSPSSLSASVGDRVTITCRASQNIFSYLN WYHQKPGKAPKLLIYAASSLQSGVPSRFSGSGS GTDFTLTISSLQPEDFATYCQQSYSTPLFTFGPG TKVDIK | EVQLLESGGGLVQPGGSLRLSCAASEFTFSSYAMS WVRQAPGKGLEWVSVISGRGGNTFYADSVKGRFTI SRDNSKNTLYLQMNSLRAEDTAVYYCASRIAVAGS EAFDIWGQGTMVTVSS |
| | | | SEQ ID NO: 24496 | SEQ ID NO: 28502 |
| iPS:392904 | 21-225_22G9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAAG CCCCTAAGCGCCTGATCTATGCTGCTTCCAGTT TGCAAAGTGGGGTCCCATCAAGGTTCAGCGGC AGTGGATCTGGGACAGAGTTCACTCTCACAAT CAGCAGCCTGCAGCCTGAAGATTTTGCAACTT ATTACTGTCTACAGCATGCCAGTTACCCGCTC ACTTTCGGCGGAGGGACCAAGGTGGAGATCA AA | CAGCTGCAGCTGCAGGAGTCGGGCCCAGGACTG GTGAAGCCTTCCGGTGGCGCCAGCCTGTCCTCACCTGCA CTGTCTCCGGTGGCGCCATCAGCGGTAGTAATTA CTACTGGGGCTGGATCCGCCAGCCCGCCAGGGAA GGGACTGGAGTGGATTGGAAATATCATTATAGT GGGAGCACCTACTACAACCCGTCCCTCAAGAGTC GAGTCACCATATCCGTAGACACGTCCAAGAACC AGTTCTCCCTGAAGCTGAGCTGTGACCGCCGA AGACACGCTGTGTATTACTGTGCGAGACATAGC AGTAGTGGTCCCTTGACTACTGGGGCCAGGGAA CCCTGGTCACCGTCTCCTCA |
| | | | SEQ ID NO: 24497 | SEQ ID NO: 28503 |

FIGURE 50
(Continued)

| | | | |
|---|---|---|---|
| iPS:392908 | 21-225_23F12 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHASYPLTFGGG TKVEIK<br><br>SEQ ID NO: 24498 | QLQLQESGPGLVKPSETLSLTCTVSGGAISGSNYYW GWIRQPPGKELEWIGNIYYSGSTYYNPSLKSRVTIS VDTSKNQFSLKLRSVTAEDTAVYYCARHSSSWSLD YWGQGTLVTVSS<br><br>SEQ ID NO: 28504 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGTTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAAGTT ATTACTGTCTACAGCATATAGTTACCCGTGG ACGTTCGGCCAAGGGACCAAGGTGGAAATCA AA<br><br>SEQ ID NO: 24499 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAGTTATATGACTCCGTGAAACT AATAAATACTATGCAGAGACTCCGTGAAGGGCCGA TTCACCATCTCAAGAGACAATTCCAAGAACACGC TGTATCTGCAAATGAACAGCCTGAGAGCCGAGG ACACGGCTATTTATTACTGTGCGAGAGAGCTTGC CTGGTACGAGGACTACTGGGGCCAGGGATCCCT GGTCACCGTCTCCTCA<br><br>SEQ ID NO: 28505 |
| | | AA | DIQMTQSPSSLSASVGDRVTITCRASQGIRNDLG WYQQKPGKAPKRLIYVASSLQSGVPSRFSGSGS GTEFTLTISSLQPEDFASYYCLQHNSYPWTFGQG TKVEIK<br><br>SEQ ID NO: 24500 | QVQLVESGGGVVQPGRSLRLSCVASGFTFSSYGMH WVRQAPGKGLEWVAVIWYDETNKYYADSVKGRF TISRDNSKNTLYLQMNSLRAEDTAIYYCARELAWY EDYWGQGSLVTVSS<br><br>SEQ ID NO: 28506 |

FIGURE 50
(Continued)

| | | | | |
|---|---|---|---|---|
| iPS:392912 | 21-225_25A9 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGTGGCAGTGGATCTGGGACAGATTCACTCTCACAATCAGCAGCCTGCAGCCTGAAGATTTTGCAACTTATTACTGTCTACAGCATAATAGTTACCCATTCACTTTCGGCCCTGGGACCAAAGTGGATATCAAA | CAGGTGCAGCTGGTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAATACTATACAGGTCCGTGAAGGGCGATTCACCATCTCCAGAGACAATTCCAAGAACACGCTGTATCTGCAAATGAACAGCCTGAGAGCCGAGACACGGCTGTATATTACTGTGCGAGAGAAATTGGCTGGTTAGATGACTACTGGGGCCAGGGAACCCTGGTCACCGTCTCCTCA |
| | | | SEQ ID NO: 24501 | SEQ ID NO: 28507 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK | QVQLVESGGGVVQPGRSLRLSCAASGFTFSSYGMHWVRQAPGKGLEWVAVIWYDVTNKYTGSVKGRFTISRDNSKNTLYLQMNSLRAEDTAVYYCAREIGWLDDYWGQGTLVTVSS |
| | | | SEQ ID NO: 24502 | SEQ ID NO: 28508 |
| iPS:392914 | 21-225_25D12 | NA | GACATCCAGATGACCCAGTCTCCATCCTCCCTGTCTGCATCTGTAGGAGACAGAGTCACCATCACTTGCCGGGACAAGTCAGGGCATTAGAAATGATTTAGGCTGGTATCAGCAGAAACCAGGGAAAGCCCCTAAGCGCCTGATCTATGCTGCATCCAGTTTACAAAGTGGGGTCCCATCAAGGTTCAGTGGCAGTGGATCTGGGACAGATTCACTCTCACAATCAGCAGCCTGCAGCCTGAAGATTTTGCAACTTATTACTGTCTACAGCATTATAGTTTCCCTCGGACGTTCGGCCAAGGGACCAAAGTGGAAATCAAA | CAGGTGCAGCTGGTGGTGGAGTCTGGGGGAGGCGTGGTCCAGCCTGGGAGGTCCCTGAGACTCTCCTGTGCAGCGTCTGGATTCACCTTCAGTAGCGATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGTGTATTACTGTGCGAGAGAGGTAACACGGCTGTGTAGCAGCTGTGACTACTCGTATGACGTCTGGGGCCAAGGGACCACGGTCACCGTCTCCTCA |
| | | | SEQ ID NO: 24503 | SEQ ID NO: 28509 |

FIGURE 50
(Continued)

| | | | |
|---|---|---|---|
| iPS:392916 | 21-225_27C5 | AA | DIQMTQSPSSLSASVGDRVTITCRTSQGIRNDLG WYQQKPGKAPKRLIYAASSLQSGVPSRFSGSGS GTEFTLTISSLQPEDFATYYCLQHYSFPRTFGQGT KVEIK<br>SEQ ID NO: 24504 | QVQLVESGGGVVQPGRSLRLSCAASGFTFSSDGMH WVRQAPGKGLEWVAVIWYDGSNKYYADSVKGRF TISRDNSKNTLYLQMNSLRAEDTAVYYCARERYSS SWYDYGMDVWGQGTTVTVSS<br>SEQ ID NO: 28510 |
| | | NA | GAGGTCAGATGACCCAGTCTCCCTCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGTTCCTGATCTATGCTGCATCCAGTT TGCAAAGTGGGGTCCCATCAAGGTTCAGCGCC AGTGGATCTGGGACAGAGTTCACTCTCACCAT CAGCAGCCTGCAGCCTGAAGATTTGCAACTT ACTGTTGTCAACAGTATGACAGTTCCCTCGG ACGTTCGGCCAAGGGACCAAGGTGGAAATCA AA<br>SEQ ID NO: 24505 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCACTAGTAGTGATAGT TATATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGTGGCGTCC TTTGACTGCTGGGGCCAGGGAACCCTGGTCACCG TCTCCTCA<br>SEQ ID NO: 28511 |
| | | AA | DIQMTQSPSSVSASVGDRVTITCRASQGISSWLA WYQQKPGKAPKFLIYGASSLQSGVPSRFSASGSG TEFTLTISSLQPEDFATYCCQQYDSFPRTFGQGTK VEIK<br>SEQ ID NO: 24506 | EVQLVESGGGLVKPGGSLRLSCAASGFTFSSYSMN WVRQAPGKGLEWVSSTSSSDSYIYYADSVKGRFTI SRDNAKNSLYLQMNSLRAEDTAVYYCARVASFDC WGQGTLVTVSS<br>SEQ ID NO: 28512 |

FIGURE 50
(Continued)

| | | | | |
|---|---|---|---|---|
| iPS:392918 | 21-225_28F5 | NA | GACATCCAGATGACCCAGTCTCCATCCTCCCTGTCTGCATCTGTAGGAGACAGAGTCACCATCACTTGCCGGGCAAGTCAGGCATTAGAGACAGTCAGGCAAGTGGTATCAGCAGAAACCAGGGAAAGCCCCTAAGCGCCTGATCTATACTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAATACTTACCCGTGGACGTTCGGCCAAGGGACCAAGGTGGAAGTCAAA SEQ ID NO: 24507 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTAGTTATGGCATGCACTGGGTCCGCCAGGCTCCAGGCAAGGGGCTGGAGTGGGTGGCAGTTATATGACGATGGAAGTGATGAAAATAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAATTAGGCTGGTACGACTACTGGGGCCAGGGAACCCTGGTCACCGTCTCCTCA SEQ ID NO: 28513 |
| | | AA | DIQMTQSPSSLSASVGDRVTITCRASQGIRNDLGWYQQKPGKAPKRLIYTASSLQSGVPSRFSGSGSGTEFTLTISSLQPEDFATYYCLQHNTYPWTFGQGTKVEVK SEQ ID NO: 24508 | QVQLVESGGGVVQPGRSLRLSCAASGFTFSSYGMHWVRQAPGKGLEWVAVIWYDENNKYYADSVKGRFTISRDNSKNTLYLQMNSLRAEDTAVYYCARELGWYDDYWGQGTLVTVSS SEQ ID NO: 28514 |
| iPS:392920 | 21-225_29G4 | NA | GACATCCAGATGACCCAGTCTCCATCCTCCCTGTCTGCATCTGTAGGAGACAGAGTCACCATCACTTGCCGGGCAAGTCAGGCATTAGAAATGATTTAGGCTGGTATCAGCAGAAAACCAGGGAAAGCCCCTAAGCGCCTGATCTATGCTGCATCCAGTTTGCAAAGTGGGGTCCCATCAAGGTTCAGCGGCAGTGGATCTGGGACAGCCTGCAGCCTGAAGATTTTGCAACTTATTACTGTCTACAGCATAATAGTTACCCGCTCACTTTCGGCGGAGGGACCAAGGTGGAGATCACA SEQ ID NO: 24509 | CAGGTGCAGCTGGTGGAGTCTGGGGGAGGCGTGGTCCAGCCTGGGAGGTCCCTGAGACTCACCTGTGCAGCGTCTGGATTCACCTTCAGTGACTATGGCATACACTGGGTCCGCCAGGCTCCAGGCAAGGGGCTGGAGTGGGTGGCAGTTATATGGTATGATGAAAGTAATAAATACTATGCAGACACTCCATGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACTGGGAATGACGGGTGACTACTGGGGCCAGGGAACCCTGGTCACCGTCTCCTCA SEQ ID NO: 28515 |

FIGURE 50
(Continued)

| | | | |
|---|---|---|---|
| iPS:392922 | 21-225_30G4 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIT<br>SEQ ID NO: 24510 | QVQLVESGGGVVQPGRSLRLTCAASGFTFSDYGIH WVRQAPGKGLEWVAVIWYDESNKYYADSMKGRF TISRDNSKNTLYLQMNSLRAEDTAVYYCARELGMT GDYWGQGTLVTVSS<br>SEQ ID NO: 28516 |
| | | NA | GACATCCAGATGACCCAGTCTCCACCCTCCCT GTCTACATCTGTAGGAGACAGAGTCACCATCA CTTGCCGGGCAACTCAGAACAGAACATTTCAGCTAT TTAAATTGGCATCAGCAGAAACCAGGGAAAG CCCCTAAGCTCCTGATCCATGCATCCAGT TGCAAGGTGGGGTCCCATCAAGGTTCAGTGGC AGTGGATCTGGGACAGATTTCACTCTCACCAT CATCAGTAGCCTGCAACCTGAAGATTTTGCCACTT ACTACTGTCTCAACTCAGCTACAGTCCCCGTAC ACTTTTGGCGGAGGGACCAAGGTGGAGATCA AA<br>SEQ ID NO: 24511 | CAGGTGCAGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCGGGGCT GGAATGGGTGGCAGTTATATGACTCCGTGAAGGGCCGAT GATAAATACTATGTAGACTCCGTGAAGGGCCGAT TCACCATCTCCAGAGACAACAATTCCAAGAACACGCT GTATCTGCAAATGAACAGCCTGAGAGCCGAGGA CTGGCTGTGTATTACTGTGCGAGAGAAATAGC AGCTCGTACTACTTTGACTACTGGGGCCAGGAA CCCTGGTCACCGTCTCCTCA<br>SEQ ID NO: 28517 |
| | | AA | DIQMTQSPPSLSTSVGDRVTITCRATQNIFSYLN WHQQKPGKAPKLLIHTASSLQGGVPSRFSGSGS GTDFTLTIISMQPEDFSTYYCQLSYSPPYTFGGGT KVEIK<br>SEQ ID NO: 24512 | QVQLVESGGGVVQPGRSLRLSCAASGFTFSSYGMH WVRQAPGRGLEWVAVIWYDGTDKYYVDSVKGRF TISRDNSKNTLYLQMNSLRAEDSAVYYCARENSSS YYFDYWGQGTLVTVSS<br>SEQ ID NO: 28518 |

FIGURE 50
(Continued)

| | | | |
|---|---|---|---|
| iPS:392924 | 21-225_32H2 | NA | GATATTGTGATGACCCAGACTCCACTCTCTCT GTCCGTCACCCCTGGACAGCCGGCCTCCATCT CCTGCAGGTCTAGTCAGAGCCTCCTCCATAGT GATGGAAGGACCTATTTGTATTGGTACCTGCA GAAGCCAGGCCAGCCTCCACAGCTCCTGATCT ATGAACTTTCAACCGGTTCTCTGGAGTGCCA GATAGGTTCAGTGGCAGCGGGTCAGGGACAG ATTTCACACTGAAAATCAGCGGGTGGAGGCT GAGGATGTTGGGATTTATTCCTGCTTGCAAAG TATACAATATCCCATCACCTTCGGCCAAGGGA CACGACTGGAGATTAAA<br><br>SEQ ID NO: 24513 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACACAATTCCAAGAACAGC TGAATCTGCAAATGAACAGCCTGAGAGCCGAGG ACACGGGTGTGTATTACTGTGCGAGAAGATATAG CAGCAGCTGGACGGGGGGTATGGACGTCTGGGG CCAAGGGACCACGGTCACCGTCTCCTCA<br><br>SEQ ID NO: 28519 |
| | | AA | DIVMTQTPLSLSVTPGQPASISCRSSQSLLHSDGR TYLYWYLQKPGQPPQLLIYELSNRFSGVPDRFSG SGSGTDFTLKISRVEAEDVGIYSCLQSIQYPITFG QGTRLEIK<br><br>SEQ ID NO: 24514 | QVQLVESGGGVVQPGRSLRLSCAASGFTFSSYGMH WVRQAPGKGLEWVAVIWYDGSNKYYADSVKGRF TISRDNSKNTLNLQMNSLRAEDTGVYYCARRYSSS WTGGMDVWGQGTTVTVSS<br><br>SEQ ID NO: 28520 |
| iPS:392928 | 21-225_25A4 | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAAACCAGGACAGCCTCCTAAGTTGCTC GCAGAAAACCAGGACAGCCTCCTAAGTTGCTC TTTACTGGGCATCTACCCGGGAATCCGGGGTC CCTGACCGATTCAGTGGCAGCGGGTCTGGGAC AGAATTCACTCTCACCATCAGCAGCCTGGAGG CTGAAGATGTGGCAGTTTATTACTGTCAGCAG TATTATATAGTACTCCTCGACGTTCGGCCAAGG GACCAAGGTGGAAATCAAA<br><br>SEQ ID NO: 24515 | CAGGTGCTCCTGGTGCAGTCTGGGGCTGAGGTGA AGAAGCCTGGGCCCTCAGTGAAGGTCTCCTGCA AGGCTTCTGGATACACCTTCACCAATTATGATAT TAATTGGGTGCGACAGGCCACTGGACAAGGGCT TGAGTGGATGGGATGGATGTACCCTAACAGTGGT AACACAGGCTATGCACAGAAATTCCAGGGCAGA GTCACCATGACCAGGAACACCTCCATAAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTCTCCTCA<br><br>SEQ ID NO: 28521 |

FIGURE 50
(Continued)

| | | | | |
|---|---|---|---|---|
| iPS:392930 | 21-225_25H9 | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK | QVLLLVQSGAEVKRPGASVKVSCKASGYTFTNYDIN WVRQATGQGLEWMGWMYPNSGNTGYAQKFQGR VTMTRNTSISTAYMELSSLRSEDTAVYYCASSSGW YYFDYWGQGTLVTSS |
| | | | SEQ ID NO: 24516 | SEQ ID NO: 28522 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTTTTGGTACCTGCA GAAGCCAGGCCAGCCTCCACAGCTCCTGATCT ATGAAGTTTCCAATCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGCTTCCGTGGACGTTCGGCCAAGGGA CCAAGGTGGAAATCAAA | CAGGTGCAGCTGTGGTGGAGTCTGGGGGAGGCGTG GTCCAGCCTGGGAGGTCCCTGAGACTCTCCTGTG CAGCGTCTGATTCCCCTCAATAACTATGGCAT GCACTGGGTCCGCCAGGCTCCAGGCAAGGGGCT GGAGTGGGTGTCAATTATATGATGATGAAGT TATAAATACTATGCAGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCGAGAGAGGATAC GATTTTTGGAGTGGCTTCTTTGACTCTCGGGCC AGGGAACCCTGGTCACCGTCTCCTCA |
| | | | SEQ ID NO: 24517 | SEQ ID NO: 28523 |
| | | AA | DIVMTQTIPLSLSVTPGQPASISCKSSQSLLHGDG KTYLFWYLQKPGQPPQLLIYEVSNRFSGVPDRFS GSGSGTDFTLKISRVEAEDVGVYYCMQSIQLPW TFGQGTKVEIK | QVQLVESGGGVVQPGRSLRLSCAASGFPNNYGM HWVRQAPGKGLEWVSIIWYDGSYKYYADSVKGRF TISRDNSKNTLYLQMNSLRAEDTAVYYCAREGYDF WSGFFDSWGQGTLVTVSS |
| | | | SEQ ID NO: 24518 | SEQ ID NO: 28524 |

FIGURE 50
(Continued)

| | | | | |
|---|---|---|---|---|
| iPS:392934 | 21-225_27D5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCGCCTGATCTATGCTGCCATCCAGT TTGCAAAGTGGGGTCCCATCAAGGTTCAGCGG CAGTGGATCGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A | |
| | | | SEQ ID NO: 24519 | |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK | |
| | | | SEQ ID NO: 24520 | |
| | | NA | CAGGTGCAACTGGTGGAGTCTGGGGGAGGCGTG GTCCAGCCTGGGAGGTCCCTGAGACTCTCCTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAAGT AATAAATACTATGGAGACTCCGTGAAGGGCCGA TTCACCATCTCCAGAGACAATTCCAAGAATATGC TGTATCTGCAAATGAACAGCCTGAGAGGCGAGG ACACGGCTCTGTATTACTGTGCGAGAGAACTGGG GTTCCTCCTGACTACTGGGGCCAGGGAACCCTG GTCACCGTCTCCTCA | |
| | | | SEQ ID NO: 28525 | |
| iPS:392936 | 21-225_28B6 | AA | QVQLVESGGGVVQPGRSLRLSCAASGFTFSSYGMH WVRQAPGKGLEWVAVIWYDESNKYYGDSVKGRF TISRDNSKNMLYLQMNSLRGEDTALYYCARELGFL SDYWGQGTLVTVSS | |
| | | | SEQ ID NO: 28526 | |
| | | NA | CAGGTGCTCCTGGTGCAGTCTGGGGCTGAGGTGA AGAGGCCTGGGGCTCAGTGAAGGTCTCCTGCA AGGCTTCTGGATACACCTTCACCAATTATGATAT TAATTGGGTGCGACAGGCCACTGGACAAGGTCTT GAGTGGATGGGATGGATGCACCCTGACAGTGGT AACACAGGCTATGCACAGAAGTTCCAGGGCAGA GTCACCATGACCAGGAACACCTCCATAAGCACG GCCTACATGGAGCTGAGCAGCCTGAGATCTGAG GACACGGCCGTGTATTACTGTGCGAGTAGCAGTG GCTGGTACTACTTTGACTACTGGGGCCAGGAAC CCTGGTCACCGTCCTCA | |
| | | | SEQ ID NO: 28527 | |
| | | | SEQ ID NO: 24521 | |

FIGURE 50
(Continued)

| | | | | |
|---|---|---|---|---|
| iPS:392938 | 21-225_29H4 | AA | DVVMTQSPLSLPVTLGQPASISCRSSQSLVYSDG DTYLNWFQQRPGQSPRRQIYKVSNWDSGVPDRF SGSGSGTDFTLNISRVEAEDVGIYFCMHCTHWLL FGPGTKVDIK<br>SEQ ID NO: 24522 | QVLLLVQSGAEVKRPGASVKVSCKASGYTFTNYDIN WVRQATGQGLEWMGWMHPDSGNTGYAQKFQGR VTMTRNTSISTAYMELSSLRSEDTAVYYCASSSGW YYFDYWGQGTLVTVSS<br>SEQ ID NO: 28528 |
| | | NA | GATATTGTGATGACCCAGACTCCACTCTCTCT GTCCGTCACCCCTGGACAGCCGGCCTCCTTCT CCTGCAAGTCTAGTCAGAGCCTCGTACATAGT GATGGAAAGACCTATTTGTATTGGTACCTGCA GAAGCCAGGCCAGGGTCCTCACAGCTCCTGATCT TTGAGGTTTCCAACCGGTTCTCTGGACTGCA GATAGGTTCAGTGGCAGCGGGTCAGGACAG ATTTCACACTGAAAATCAGCCGGGTGAGGCT GAGGATGTTGGGGTTTATTACTGCATGCAAAG TATACAGCATCCGTTCACTTTCGGCGGAGGGA CCAGGGTGGAGATCAAA<br>SEQ ID NO: 24523 | CAGGTGCAGCTGTGGTGGAGTCTGGGGGAGGCGTG GTCCAGCCTGGGAGGTCCCTGAGACTCTCCTGTG CAGCGTCTGGATTCACCTTCAGTAGTAGTATGCAT ACACTGGGTCCGCCAGGCTCCAGGCAAGGGGCT GGAGTGGGTGGCAGTTATATGCAGTCCGGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCAGGGGGTATGGACGTCTGGGG CCAAGGGACCACGGTCACCGTCTCCTCA<br>SEQ ID NO: 28529 |
| | | AA | DIVMTQTPLSLSVTPGQPASFSCKSSQSLLHSDG KTYLYWYLQKPGQPPQLLIFEVSHRFSGLPDRFS GSGSGTDFTLKISRVEAEDVGVYYCMQSIQHPFT FGGGTRVEIK<br>SEQ ID NO: 24524 | QVQLVESGGGVVQPGRSLRLSCAASGFTFSSYGIH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 28530 |

FIGURE 50
(Continued)

| | | | |
|---|---|---|---|
| iPS:392940 | 21-225_29D9 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTTTCAGCAGAAACCGGGGAAAGC CCCTAAGCGCCTGATCTATGCTGCATCCAGTT GCAAAAGTGGGGGTCCCATCAAGGTTCAGCGGCA GTGGATCTGGGACAGAGAATTCACTCTCACAATC AGCAGCCTGCAGCCTGAAGATTTTGCAACTTA TTACTGTCTACAGCATAATACTTACCCATTCAC TTTCGGCCCTGGGACCAAAGTGGATTTCAAA<br><br>SEQ ID NO: 24525 | CAGGTGCAGCTGGTGGAGTCTGGGGGAGGCGTG GTCCAGCCTGGGAGGTCCCTGAAACTCTCCTGT CAGCGTCTGGATTCACCTTCAGTGACTATGGCAT TCACTGGGTCCGCCAGGCTCCAGGCAAGGGCT GGAGTGGGTGGCAGTTATATGTATGATGAAAGT AATAACTACTATGCAGACTCCGTGAAGGGCGAT TCACCATCTCCAGAGACAATTCCAAGAACACGCT GTATCTGCAAATGAACAGCCTGAGAGCCGAGGA CACGGCTGTGTACTACTGTGCGAGAGAAATTGGC TGGTTAGATGACTACTGGGGCCAGGGAACCCAG GTCACCGTCTCCTCA<br><br>SEQ ID NO: 28531 |
| | | AA | DIQMTQSPSSLSASVGDRVTITCRASQGIRNDLG WFQQKPGKAPKRLIYAASSLQSGVPSRFSGSGSG TEFTLTISSLQPEDFATYYCLQHNTYPFTFGPGTK VDFK<br><br>SEQ ID NO: 24526 | QVQLVESGGGVVQPGRSLKLSCSASGFTFSDYGIH WVRQAPGKGLEWVAVIWYDESNNYYADSVKGRF TISRDNSKNTLYLQMNSLRAEDTAVYYCAREIGWL DDYWGQGTQVTVSS<br><br>SEQ ID NO: 28532 |
| iPS:392942 | 21-225_30E9 | NA | GACATCCAGATGACCCAGTCTCCATCCTCCCT GTCTGCATCTGTAGGAGACAGAGTCACCATCA CTTGCCGGGCAAGTCAGGACATTAGAAACCAGGGAAAG TTAGGCTGGTATCAGCAGAAACCAGGGAAAG CCCCTAGGCGCCTGATCTATGGTGCATTCAGC TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGTAGT<br>ACTTTCGGCGGAGGGACCAAGGTGGAGATCA AA<br><br>SEQ ID NO: 24527 | GAGGTGCAGGTGTTGGAGTCTGGGGGAGGCTTG GTACAGCCTGGGGGGGTCCCTGAGACTCTCCTGTG CAGCCTCTGGATTCACCTTTAGCAGCTGTGCCAT GAACTGGGTCCGCCAGGCTCCAGGGAAGGGGCT GGAGTGGGTCTCCGTCTATTAGTGGTGGTGGT AGCACATTCTACGCAGACTCCGTGAAGGGCCGGT TCACCATCTCCAGAGACAATGAACAGCCTGAGAGCCGAGGA CACGGCCGTATATTACTGTGCGAAGGGAGCT ACTAGAGGACTACTACTACTACGGAATGGACGTC TGGGGCCAAGGGACCACGGTCACCGTCTCCTCA<br><br>SEQ ID NO: 28533 |

FIGURE 50
(Continued)

| | | | | |
|---|---|---|---|---|
| | | AA | DIQMTQSPSSLSASVGDRVTITCRASQDIRDDLG WYQQKPGKAPRRLIYGAFSLQSGVPSRFSGSGS GTEFTLTISSLQPEDFATYYCLQHTSYPPTFGGGT KVEIK | EVQVLESGGGLVQPGGSLRLSCAASGFTFSSCAMN WVRQAPGKGLEWVSAISGRGGSTFYADSVKGRFTI SRDNSKNTLYLQMNSLRAEDTAVYYCAKGELLED YYYYGMDVWGQGTTVTVSS |
| | | | SEQ ID NO: 24528 | SEQ ID NO: 28534 |
| iPS:392944 | 21-225_31H5 | NA | GACATCCAGATGACCCAGTCTCCATCCTCCCT GTCTGCATCTGTAGGAGACAGATTCACCATCT CTTTCCGGCAAGTCAGGACATTAGAAGTGAT TTAGGCTGGTATCAGCAGAAACCAGGAAAG CCCATAAGCGCATCATCTATGCTGCATCCAGT TTGCAAAGTGGGGTCCCATCAAGGTTCAGCGT CAGTGGATCTGGGACAGAATTCACTTTCACAA TCAGCAGCATGCAGCCTGACGATTTTTCAAAT TATTACTGTATACAACATATTATTACCCTCCT ACTTTCGGCGGAGGGACCAAGGTGGAGATCA AA | GAGGTGCAGTCTGTTGGAGTCTGGGGAGGCTTG GTACAGCCTGGGGGGTCCCTGAGACTCTCCTGTG CAGCCTCTGGATTCACCTTTAGCAGTTGCATGCCAT GAGCTGGGTCCGCCAGGCTCCAGGGAAGGGGCT GGAGTGGGTCTCCGCTATTAGTGGTGGTGGA AGCATATTCCACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGTGAAAGGGGAGCTA CTAGAGGACTACTACTTCTACGGTATGGACGTCT GGGGCCAAGGGACCACGGTCACCGTCTCCTCA |
| | | | SEQ ID NO: 24529 | SEQ ID NO: 28535 |
| | | AA | DIQMTQSPSSLSASVGDRFTISFRASQDIRSDLGW YQQKPGKAHKRIIYAASSLQSGVPSRFSVSGSGT EFTFTISSMQPDDFSNYYCIQHIYPPTFGGGTKV EIK | EVQLLESGGGLVQPGGSLRLSCAASGFTFSSYAMS WVRQAPGKGLEWVSAISGRGGSIFHADSVKGRFTI SRDNSKNTLYLQMNSLRAEDTAVYCVKGELLED YYFYGMDVWGQGTTVTVSS |
| | | | SEQ ID NO: 24530 | SEQ ID NO: 28536 |

FIGURE 50
(Continued)

| | | | | |
|---|---|---|---|---|
| iPS:392948 | 21-225_25G5 | NA | GACATCCAGATGACCCAGTCTCCATCCTCACTTGTCTGCATCTGTTGGAGACAGAGTCACCATCACTTGCCGGGCAAGTCAGGACAGATTAGAAATGATTTAGGCTGGTATCAGCAGAAACCAGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAGTCAGCAGCCTGCAGCCTGAAGATTTTGCAACTTATTACTGTCTACAGCATAATAGTTACCCCTTCACTTTCGGCCCTGGGACCAAAGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGGCATACACTGGGTCCGCCAGGCTCCAGGCAAGGGCTGGAGTGGGTGGCAGTTATTTGGTATGATGGAAATAATAAATATTATGCAGACTCCGTGAAGGGCCGATTCACCATCTCCAGAGACAACGCCAAGAACACGCTGTATCTGCAAATGAACAACCTGAGAGCCGAGGACACGGCTGTGTATTACTGTGCGAGAGAAATTGGCTGGTTAGATGACTACTGGGGCCAGGGAACCCTGGTCACCGTCTCCTCA |
| | | | SEQ ID NO: 24531 | SEQ ID NO: 28537 |
| | | AA | DIQMTQSPSSLSASVGDRVTITCRASQDIRNDLGWYQQKPGKAPKRLIYAASSLQSGVPSRFSGSGSGTEFTLTVSSLQPEDFATYYCLQHNSYPFTFGPGTKVDIK | QVQLVESGGGVVQPGRSLRLSCAASGFTFSDYGIHWVRQAPGKGLEWVAVIWYDGNNKYYADSVKGRFTISRDNSKNTLYLQMNNLRAEDTAVYYCAREIGWLDDYWGQGTLVTVSS |
| | | | SEQ ID NO: 24532 | SEQ ID NO: 28538 |
| iPS:392950 | 21-225_25C10 | NA | GACATCCAGATGACCCAGTCTCCATCCTCACTGTCTGCATCTGTAGGAGACAGAGTCACCATCACTTGTCGGGCGAGTCAGGGCATTAGCAGTGCATTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATATTGCAACTTATTACTGTCAACAGTATCATAGTTACCCATTCACTTTCGGCCCTGGGACCAAAGTGGATATCAAA | GAGGTGCAGTTGGTGGAGTCTGGGGGAGGCTTGGTACAGCCTGGGGGGTCCCTGAGACTCTCCTGTGCAGCCTCTGGATTCACCTTCAGTAGCTATAGGATGAACTGGGTCCGCCAGGCTCCAGGGAAGGGGCTGGAGTGGGTTTCATCCATTAGTAGTAGTAGTACCATATACTACGCAGACTCTGTGAAGGGCCGATTCACCATCTCCAGAGACAATGCCAAGAACTCACTGTATCTGCAAATGAACAGCCTGAGAGACGAGGACACGGCTGTGTATTACTGTGCGAGAACCGGTTTTGACTACTGGGGCCAGGGAACCCTGGTCACCGTCTCCTCA |
| | | | SEQ ID NO: 24533 | SEQ ID NO: 28539 |

FIGURE 50
(Continued)

| | | AA | DIQMTQSPSSLSASVGDRVTITCRASQGISNYLA WFQQKPGKAPKSLIYAASSLQSGFPSKFSGSGSG TDFTLTISSLQPEDFATYYCQQYHSYPFTFGPGT KVDIK<br>SEQ ID NO: 24534 | EVQLVESGGGLVQPGGSLRLSCAASGFTFSSYRMN WVRQAPGKGLEWVSSISSSSTIYYADSVKGRFTIS RDNAKNSLYLQMNSLRDEDTAVYYCARTAGFDY WGQGTLVTVSS<br>SEQ ID NO: 28540 |
|---|---|---|---|---|
| iPS:392952 | 21-225_26G1 | NA | GACATCCAGATGACCCAGTCTCCATCCTCACT GTCTGCATCTGTAGGAGACAGAGTCACCATCA CTTGTCGGGCGAGTCAGGACAGATTAGCAATTAT TTAGCCTGGTTTCAGCAGAAACCAGGGAAAGC CCCTAAGTCCCTGATCTATGCTGCATCCAGTTT GCGAAGTGGGGTCCCATCAAACTTCAGCGGCA GTGGATCTGGGACAGATTTCACTCTCACCATC AGCAGCCTGCAGCCTGAAAATTTTGCAACTTA TTACTGCCAACAGTATCATAGTTACCCATTCA CTTTCGGCCCTGGGACCAAAGTGGATATCAAA<br>SEQ ID NO: 24535 | GAGGTGCAGCTGGTGGAGTCTGGGGGAGGCTG GTCAAGCCTGGGGGGTCCCTGAGACTCTCCTGTG CAGCCCTCTGGATTCACCTTCAGTAGCTATGGCAT GAACTGGGTCCGCCAGGCTCCAGGGAAGGGGCT GGAGTGGGTCTCATCCATTAGTGGTAGTAGTAGT TACATATACTACGCGGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGACTGACTACC TTTGACTTCTGGGGCCAGGGAACCCTGGTCACCG TCTCCTCA<br>SEQ ID NO: 28541 |
| | | AA | DIQMTQSPSSLSASVGDRVTITCRASQDISNYLA WFQQKPGKAPKSLIYAASSLRSGVPSNFSGSGSG TDFTLTISSLQPENFATYYCQQYHSYPFTFGPGT KVDIK<br>SEQ ID NO: 24536 | EVQLVESGGGLVKPGGSLRLSCAASGFTFSSYGMN WVRQAPGKGLEWVSSISGSSSYIYYADSVKGRFTIS RDNAKNSLYLQMNSLRAEDTAVYYCARLTFDFW GQGTLVTVSS<br>SEQ ID NO: 28542 |

FIGURE 50
(Continued)

| | | | |
|---|---|---|---|
| iPS:392954 | 21-225_26A10 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTATGCTGCATCCAGC TTGCAAAGTGGGGTCCCATCAAGATTCAGTGG CAGTGGATCTGGGACAGATTTCACTCTCACCA TCAGCAGTCTGCAACCTGAAGATTTTGCAACT TACTACTGTCAACAGAGTTACAGTACCCCTAC GTGGACGTTCGGCCAAGGGACCAAGGTGGAA ATCAAA<br>SEQ ID NO: 24537 | GAGGTGCAGCTGCTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGTCT GGAGTGGGTCTCAGTTATTAGTGGTAGTGGTGTT AACACATTCTACGCAGACTCCGTGAAGGGCCGGT TCACCATCTCCAGAGACAACGCTGAGAGCCGAGGA GTATCTGTAATGAACAGCCTGAGAGACGT CACGGCCGTATATTACTGTGCGAAAAGATAGC AGTGGCTGTACTCACTACTTTGACTACTGGGGC CAGGGAACCCTGGTCACCGTCTCCTCA<br>SEQ ID NO: 28543 |
| | | AA | DIQMTQSPSSLSASVGDRITITCRASQSISSYLNW YQQKPGKAPKVLIYAASSLQSGVPSRFSGSGSGT DFTLTISSLQPEDFATYYCQQSYSTPTWTFGQGT KVEIK<br>SEQ ID NO: 24538 | EVQLLESGGGLVQPGGSLRLSCAASGFTFSSYAMS WVRQAPGKGLEWVSVISGSGVNTFYADSVKGRFTI SRDNSKNTLYLLMNSLRAEDTAVYYCAKKIAVAG THYFDYWGQGTLVTVSS<br>SEQ ID NO: 28544 |
| iPS:392956 | 21-225_27A11 | NA | GACATCCAGATGACCCAGTCTCCATCCTCCGT GTCTGCATCTGTAGGAGACAGAGTCACCATCA CTTGTCGGGCGAGTCAGGGTATTAGTAGTTGG TTAGCCTGGTATCAGCAGAAACCAGGGAAAG CCCCTAAGCTCCTGATCTATGGTGCATCCAGT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTGTGTCAACAGTATGACAGTTTCCCTCCG ACGTTCGGCCAAGGGACCAAGGTGAAATCA AA<br>SEQ ID NO: 24539 | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGCTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TATATCTACAAATGAACAGCCTGAGAGCCGAGG ACACGGCTGTGTATCACTGTGCGAGAGATTCCTC CCCCTACGGTATGGACGTCTGGGGCCAAGGGAC CACGGTCACCGTCTCCTCA<br>SEQ ID NO: 28545 |

FIGURE 50
(Continued)

| | | | |
|---|---|---|---|
| iPS:392958 | 21-225_28C7 | AA | DIQMTQSPSSVSASVGDRVTITCRASQGISSWLA WYQQKPGKAPKLLIYGASSLQSGVPSRFSASGS GTDFTLTISSLQPEDFATYCCQQSDSFPRTFGQGT KVEIK<br>SEQ ID NO: 24540 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYHCARDSSPY GMDVWGQGTTVTVSS<br>SEQ ID NO: 28546 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATATAACTTACCCGTGG ACGTTCGGCCAAGGGACCAAGGTGGAAATCA AA<br>SEQ ID NO: 24541 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATTAGG CTGGTACGACGACTACTGGGGCCAGGGAACCCT GGTCACCGTCTCCTCT<br>SEQ ID NO: 28547 |
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNTYPWTFGQGT KVEIK<br>SEQ ID NO: 24542 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELGW YDDYWGQGTLVTVSS<br>SEQ ID NO: 28548 |

FIGURE 50 (Continued)

| | | | |
|---|---|---|---|
| iPS:392960 | 21-225_29E6 | NA | GACATCGTGATGACCCAGTTCCAGACTCCCT GGCTGTGTCTCTGGGCGAGAGGGCCACCATCA ACTGTAAGTCCAGCCAGAGTGTTTATACAGC TCCCACAATAACTACTACTTAACTGGTACCA GCAGAAACCAGGACAGCCTCATAAGTTGCTCC TTTACTGGGCATCTTCCGGGAATCCAGGGGTC CCTGACCGATTCAGTGGCAGCGGGTCTGGGAC AGAATTCACTCTCACCATCAGCAGTCTGCAGG CTGAAGATGTGGCAGTTTATTACTGTCAGCAG TATTATAGTACTCCTCCGACGTTCGGCCAAGG GACCAAGGTGGAAATCAAA<br><br>SEQ ID NO: 24543 | CAGGTGCTCCTGGTGCAGTCTGGGGCTGAGGTGA AGAGGCCTGGGCCTCAGTGAAGGTCTCTGCA AGGCTTCTGGATACACCTTCACCAATTATGATAT TAATTGGGTGCGACAGGCCACTGGACAAGGCT TGAGTGGATGGGATGGATGCACCTAACAGTGGT AACACAGGCTATGCACAGAAATTCCAGGGCAGA GTCACCATGACCAGGAACACCTCCATAAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTCCTCA<br><br>SEQ ID NO: 28549 |
| | | AA | DIVMTQFPDSLAVSLGERATINCKSSQSVLYSSH NNYLTWYQQKPGQPHKLLIYWASSRESGVPD RFSGSGSGTEFTLTISSLQAEDVAVYYCQQYYST PPTFGQGTKVEIK<br><br>SEQ ID NO: 24544 | QVLLVQSGAEVKRPGASVKVSCKASGYTFTNYDIN WVRQATGQGLEWMGWMHPNSGNTGYAQKFQGR VTMTRNTSISTAYMELSSLRSEDTAVYYCASSSGW YYFDYWGQGTLVTVSS<br><br>SEQ ID NO: 28550 |
| iPS:392962 | 21-225_30A1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT GCAAACTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAA<br><br>SEQ ID NO: 24545 | GAGGTGCAGCTGTTGGAGTCTGGGGGAGGCCTG GTACAGCCGGGGGGGTCCCTGAGACTCTCCTGTG CAGCCTCTGGATTCACCTTTAGCAGCTATGTCAT GAACTGGGTCCGCCAGGCTCCAGGGAAGGGCT GGAGTGGGTCTCAGTATTAGTGGTAGTGGTGGT AGCACATACTACGCAGACTCCGTGAAGGGCCGG TTCACCATCTCCAGAAACAATGAACAGCCTGAGC TGTATCTGCAAATGAACAGCCTGAGAGCCGAGG ACACGGCCGTATATTACTGTGCGCGAACTGGGGT CTTTGACTACTGGGGCCAGGGAACCCTGGTCACC GTCTCCTCA<br><br>SEQ ID NO: 28551 |

FIGURE 50
(Continued)

| | | AA | DIQMTQSPSSLSASVGDRVTITCRASQGISNYLAWFQQKPGKAPKSLISAASSLQTGVPSKFSGSGSGTDFTLTISSLQPEDFATYYCQQYNSYPFTFGPGTKVDIK | EVQLLESGGGLVQPGGSLRLSCAASGFTFSSYVMNWVRQAPGKGLEWVSAISGSGSTYYADSVKGRFTISRNNSKNTLYLQMNSLRAEDTAVYYCARTGVFDYWGQGTLVTVSS |
|---|---|---|---|---|
| | | | SEQ ID NO: 24546 | SEQ ID NO: 28552 |
| iPS:392964 | 21-225_31A8 | NA | GACATCCAGATGACCCAGTCTCCATCCTCCCTGTCTGCATCTGTAGGAGACAGAGTCACCATCACTTGCCGGGCAAGTCAGGACATTAGAAGTGATTTAGGCTGGTATCAGCAGAAACCAGGGAAAGCCCCTAAGCGCCTGATCTATGCTGTATCCAGTTTGCAAAGTGGGGTCCCATCAAGGTTCAGCGGCAGTGGCTCTGGGACAGAATTCACTCTCACAATCAGCAGCCTGCAGCCTGAAGATTTTGCCACTTATTACTGTCTACAGCATACTATTTACCCTCCTACTTTCGGCGGAGGGACCAAGGTGGAGATCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGTCCATGAGCTGGGTCCGCCAGGCTCCAGGGAAGGGGCTGGAGTGGGTCTCGCTATTAGTGGTCGTGGTGGTAGCACATTCCACGCAGACTCCGTGAAGGGCCGGTTCACCATCTCCAGAGACAATTCCAAGAACACGCTGTATCTGCAAATGAACAGCCTGAGAGACGAGGACACGGCCGTATATTACTGTGTGAAAGGGGAGCTACTAGAGGACTACTACTTCTACGTATGGACGTCTGGGGCCAAGGGACCACGGTCACCGTCTCCTCA |
| | | | SEQ ID NO: 24547 | SEQ ID NO: 28553 |
| | | AA | DIQMTQSPSSLSASVGDRVTITCRASQDIRSDLGWYQQKPGKAPKRLIYAVSSLQSGVPSRFSGSGSGTEFTLTISSLQPEDFATYYCLQHTIYPPTFGGGTKVEIK | EVQLLESGGGLVQPGGSLRLSCAASGFTFSSYAMSWVRQAPGKGLEWVSAISGRGGSTHADSVKGRFTISRDNSKNTLYLQMNSLRDEDTAVYCVKGELLEDYYFYGMDVWGQGTTVTVSS |
| | | | SEQ ID NO: 24548 | SEQ ID NO: 28554 |

FIGURE 50
(Continued)

| | | | |
|---|---|---|---|
| iPS:392966 | 21-225_32G3 | NA | GACATCCAGATGACCCAGTCTCCAACCTCACTGTCTGCATCTGTCGGAGACAGAGTCACCATCACTTGTCGGGCGAGTCAGGCCATTAGCAATTATTTAGCCTGGTTTCAGCAGAAACCAGGGAAAGCCCCTAAGTCCCTGATCTATGATACATCCAGTTTGCAAAGTGGGGTCCCATCAAAATTCAGCGGCAGTGGGTCTGGGACAGATTTCACTCTCACCATCAGCACCCTACAGCCTGAAGATTTTGCAACTTATTACTGCCAACAGTATCATAGTTACCGCTCACTTTCGGCGGAGGGACCAAGGTGGAGATCAAG |
| | | | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGGTCTCATCCATTAGTGGTAGTAGTAGTTACATATACTACGCAGACTCAGTGAAGGGCCGATTCACCATCTCCAGAGACAACGCCAAGAACTCACTGTATCTGCAAATCAACAGCCTGAGAGCCGAGGACACGGCTGTGTATTACTGTGCGAGAGGCAATATAGCAAGGGACTACTGGGGCCAGGGAACCCTGGTCACCGTCTCCTCA |
| | | | SEQ ID NO: 24549 |
| | | AA | DIQMTQSPTSLSASVGDRVTITCRASQAISNYLAWFQQKPGKAPKSLIYDTSSLQSGVPSKFSGSGSGTDFTLTISTLQPEDFATYYCQQYHSYPLTFGGGTKVEIK |
| | | | EVQLVESGGGLVKPGGSLRLSCAASGFTFSSYSMNWVRQAPGKGLEWVSSISGSSSYIYADSVKGRFTISRDNAKNSLYLQINSLRAEDTAVYYCARGNIARDYWGQGTLVTVSS |
| | | | SEQ ID NO: 24550 |
| | | | SEQ ID NO: 28555 |
| | | | SEQ ID NO: 28556 |
| iPS:392968 | 21-225_25B6 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCATTCACTTTCGGCCCTGGGACCAAAGTGGATATCAAA |
| | | | CAGGTGCAGCTGGTGGAGTCTGGGGGAGGCGTGGTCCAGCCTGGGAGGTCCCTGAGAGTCTCCTGTACAGCGTCTGGATTCACCCTCAGAAACTATGGCATGCACTGGGTCCGCCAGGCTCCAGGCAAGGGGCTGGAGTGGGTGGCAGTTATATATGGTATGAGGAAAGTAATAAATACTATACAGAGTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACTGGAGGTTCCTCTCTGACTACTGGGGCCAGGGAACCCTGGTCACCGTCTCCTCA |
| | | | SEQ ID NO: 24551 |
| | | | SEQ ID NO: 28557 |

FIGURE 50
(Continued)

| | | | | |
|---|---|---|---|---|
| iPS:392972 | 21-225_26A2 | AA | DIQMTQSPSSLSASVGDRVTITCRASQGIRNDLG WYQQKPGKAPKRLIYRASSLQSGVPSRFSGSGS GTEFTLTISSLQPEDFATYYCLQHNSYPFTFGPGT KVDIK<br>SEQ ID NO: 24552 | QVQLVESGGGVVQPGRSLRVSCTASGFTLRNYGM HWVRQAPGKGLEWVAVIWYEESNKYYTESVKGR FTISRDNSKNTLYLQMNSLRAEDTAVYYCARELGF LSDYWGQGTLVTVSS<br>SEQ ID NO: 28558 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAACCAGGAAAG CCCCTAAGCGCCTGATCTATACTGCATCCAGT TTGCAGAGTGGGGTCCCATCCAAGATTCAGCGG CAGTGGATCTGGGACAGATCACTCTCACAT TCAGCAGCCTGCAGCCTGAAGATTTTGCAACG TATTACTGTCTACAGCATAATCGTTACCCGTG GACGTTCGGCCAAGGGACCAAGGTGGAAATC AAA<br>SEQ ID NO: 24553 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGAAGAAG TAATAAATACTATGTAGAGTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAATTAGG CTGGTACGACGACTACTGGGGCCAGGGAACCCT GGTCACCGTCTCCTCA<br>SEQ ID NO: 28559 |
| | | AA | DIQMTQSPSSLSASVGDRVTITCRASQGIRSDLG WYQQKPGKAPKRLIYTASSLQSGVPSRFSGSGSG TEFTLTFSSLQPEDFATYYCLQHNRYPWTFGQGT KVEIK<br>SEQ ID NO: 24554 | QVQLVESGGGVVQPGRSLRLSCAASGFTFSSYGMH WVRQAPGKGLEWVAVIWYEGSNKYYVDSVKGRF TISRDNSKNTLYLQMNSLRAEDTAVYYCARELGW YDDYWGQGTLVTVSS<br>SEQ ID NO: 28560 |

FIGURE 50
(Continued)

| | | | | |
|---|---|---|---|---|
| iPS:392974 | 21-225_26A11 | NA | GACATCCAGATGACCCAGTCTCCAATTTCCCT GTCTGCATCTGTAGGAGACAGAGTCACCATCA CTTGCCGGGCAAGTCAGGCCATTAGAAATGAT TTAGGCTGGTATCAGCAGAGACCAGGGAAAG CCCCTAAGCGCCTGATCTATGCTGCATCCAGT TTGCAAAGTGGGGTCCCATCAAGGTTCAGCGG CAGTGGATCTGGGACAGAGAATTATTCTCACAA TCAGCAGCCTGCAGCCTGAAGATTTTGCAACT TATTACTGTCTACAGCATTATAATTACCCTGC AGTTTTGGCCAGGGGACCAAGCTGGAGATCAG A<br>SEQ ID NO: 24555 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTGTGTCAT GCACTGGGTCCGCCAGGCTCCAGGCAAGGGGCT GGAGTGGGTGGCAGTTATATGCATGGTATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGAGTA TAGCAGTGGCTGGTACGACTACGGTATGGACGTC TGGGGCCAAGGGACCACGGTCACCGTCTCCTCA<br>SEQ ID NO: 28561 |
| | | AA | DIQMTQSPISLSASVGDRVTITCRASQAIRNDLG WYQQRPGKAPKRLIYAASSLQSGVPSRFSGSGS GTEFILTISSLQPEDFATYYCLQHYNYPRSFGQGT KLEIR<br>SEQ ID NO: 24556 | QVQLVESGGGVVQPGRSLRLSCAASGFTFSNCVMH WVRQAPGKGLEWVAVIWYDGSNKYYADSVKGRF TISRDNSKNTLYLQMNSLRAEDTAVYYCAREEYSS GWYDYGMDVWGQGTTVTVSS<br>SEQ ID NO: 28562 |
| iPS:392976 | 21-225_27H12 | NA | GACATCCAGATGACCCAGTCTCCATCCTCACT GTCTGCATCTGTAGGAGACAGAGTCACCATCA CTTGTCGGGCGAGTCAGGGTCATTAGCAATTAT TTAGCCTGGTTTCAGCAGAAACCAGGGAAAGC CCCTAAGTCCCTGATCAATGGTGCATCCAGT TGCAAAGTGGGGTCTCATCCATTCAGCGCGC AGTGGATCTGGGACAGATTTCACTCTCACCAT CAGCAGCCTGCAGCCTGAAGATTTTGCAACTT ATTACTGCCAACAGTATTAGTTACCCATTC ACTTTCGGCCCTGGGACCAAAGTGAATATCAA T<br>SEQ ID NO: 24557 | GAGGTGCAGCTGGTGGAGTCTGGGGGAGGCCTG GTCAAGCCTGGGGGGTCCCTGAGACTCTCCTGTG CAGCCTCTGGATTCACCTTCACCTTCAGTAGCATAGCCT GAACTGGGTCCGCCAGGCTCCAGGGAAGGGGCT GGAGTGGGTCTCATCCATTAGTGGTAGTAGTAGT AACATATACTACACAGACTCAGTGAAGGGCCGA TTCACCATCTCCAGAGACAATGAACAGCCAAGAACTCAC TGTTTCTGCAAATGAACAGCCTGAGAGCCGAGG ACACGGCTGTGTATTACTGTGCGAGAGTGGCGTC CTTTGACTACTGGGGCCAGGGAACCCTGGTCACC GTCTCCTCA<br>SEQ ID NO: 28563 |

FIGURE 50
(Continued)

| | | | | |
|---|---|---|---|---|
| iPS:392978 | 21-225_28B8 | AA | DIQMTQSPSSLSASVGDRVTITCRASQGISNYLAWFQQKPGKAPKSLINGASSLQSGVPSKFSGSGSGTDFTLTISSLQPEDFATYYCQQYSYPFTFGPGTKVNIN<br><br>SEQ ID NO: 24558 | EVQLVESGGGLVKPGGSLRLSCAASGFTFSSYSLNWVRQAPGKGLEWVSSISGSSSNIYYTDSVKGRFTISRDNAKNSLFLQMNSLRAEDTAVYYCARVASFDYWGQGTLVTVSS<br><br>SEQ ID NO: 28564 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCACAAACCAGGAAAGCCCCTAAGCGCCTGATCTATGCTGCATCCAGTTTGCAAAGTGGGGTCCCATCAAGGTTCAGCGGCAGTGGATCTGGGACAGATTCACTCTCACAATCAGCAGCCTGCAGCCTGAAGATTTTGCAACTTATTACTGTCTACAGCATATAGTTACCCATTCACTTTCGGCCCTGGGACCAAAGTGGATATCAAT<br><br>SEQ ID NO: 24559 | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGGCATGCACTGGGTCCGCCAGGCTCCAGGCAAGGGGCTGGAGTGGGTGACAGTTATATGGTATGATGGAAATAATAAATACTATGCAGACTCCGTGAAGGGCCGATTCACCATCTCCAGAGACAATTCAAAAACACGGTGTATCTGCAAATGAACAGCCTGAGAGCCGAGGACACGGCTGTGTATTACTGTGCGAGAGAAATTGGCTGGTTAGATGACTACTGGGGCCAGGGAACCCTGGTCACCGTCTCCTCA<br><br>SEQ ID NO: 28565 |
| | | AA | DIQMTQSPSSLSASVGDRVTITCRASQGIRNDLGWYQHKPGKAPKRLIYAASSLQSGVPSRFSGSGSGTEFTLTISSLQPEDFATYYCLQHNSYPFTFGPGTKVDIN<br><br>SEQ ID NO: 24560 | QVQLVESGGGVVQPGRSLRLSCAASGFTFSDYGMHWVRQAPKGLEWVTVIWYDANNKYYADSVKGRFTISRDNFKNTVYLQMNSLRAEDTAVYYCAREIGWLDDYWGQGTLVTVSS<br><br>SEQ ID NO: 28566 |

FIGURE 50
(Continued)

| | | | | |
|---|---|---|---|---|
| iPS:392980 | 21-225_29H6 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAATCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGTCTGCAGCCTGAAGATTTTGCAACCTATTACTGTCTACAGCATAATAGTTACCCGTCACTTTCGGCGGAGGGACCAAGGTGGAGATCAAA SEQ ID NO: 24561 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGTGACAGTTATATGGTATAATGAAAATAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAGAACTGGGGATGACGGGTGACTCCTGGGGCCAGGGAACCCTGGTCACCGTCTCCTCA SEQ ID NO: 28567 |
| | | AA | DIQMTQSPSSLSASVGDRVTITCRASQGIRNDLGWYQQKSGKTPKRLIYAASSLQSGVPSRFSGSGSGTEFTLTISSLQPEDFATYYCLQHNSYPLTFGGGTKVEIK SEQ ID NO: 24562 | QVQLVESGGGVVQPGRSLRLSCAASGFTFSDYGMHWVRQAPGKGLEWVTVIWYNENNKYADSVKGRFTISRDNSKNTLYLQMNSLRAEDTAVYYCARELGMTGDSWGQGTLVTVSS SEQ ID NO: 28568 |
| iPS:392982 | 21-225_30D1 | NA | GACATCCAGATGACCCAGTCTCCATCCTCCCTGTCTGCATCTGTAGGAGACAGAGTCACCATCACTTGCCGGGCAAGTCAGGACAGATTAGAAGTGATTTAGGCTGGTATCAACAACAGAAAACCAGGGAAAGCCCCTGAGCGCCTGATCTATGCTGCATCCAGTTTGCAAAGTGGGGTCCCATCAAGGTTCAGCGGCAGTGGATCTGGGACAGCCTGCACTCTCACAATCAGCAGCCTGCAGCCTGAAGATTATTACCCTCCTACTTTCGGCGGAGGGACCAAGGTGGAGATCAAA SEQ ID NO: 24563 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCCGTTATTAGTGGTGGTGGTAGCACATTCACCACAGACTCCGTGAAGGGCCGAGTTCACCATCTCCAGAGACAATGAACAGCCTGAGAGCCGAGGTGTATCTGCAAATGAACAGCCTGAGAGCCGAGGACACGGCCGTATATTACTGTGTGAAAGGGGAGCTACTAGAGGACTACTACTACTACGGTTTGGACGTCTGGGGCCAAGGGACCACGGTCACCGTCTCCTCA SEQ ID NO: 28569 |

FIGURE 50
(Continued)

| | | | |
|---|---|---|---|
| iPS:392984 | 21-225_30E11 | AA | DIQMTQSPSSLSASVGDRVTITCRASQDIRSDLG WYQQKPGKAPERLIYAASSLQSGVPSRFSGSGSG TEFTLTISSLQPEDFTTYYCLQHTIYPPTFGGGTK VEIK |
| | | | SEQ ID NO: 24564 |
| | | | EVQVLESGGGLVQPGGSLRLSCAASGFTFSSYAMS WVRQAPGKGLEWSAISGRGGSTFHADSVKGRFTI SRDNSKNTLYLQMNSLRAEDTAVYYCVKGELLED YFYGLDVWGQGTTVTVSS |
| | | | SEQ ID NO: 28570 |
| | | NA | GACATCCAGATGACCCAGTCTCCATCCTCCCT GTCTGCATCTGTAGGAGACAGAGTCACCATCA CTTGCCGGGCAAGTCAGAGCATTAGCAACTAT TTAAATTGGTATCAACAGAAACAGGGAAAG CCCCTAAGTTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCATTC ACTTTCGGCCCTGGGACCAAAGTGGATATCAA A |
| | | | SEQ ID NO: 24565 |
| | | | GAGGTGCAGTCTGTTGGAGTCTGGGGGAGACATG GTCCAGCCTGGGGGGGTCCCTGAGACTCTCCTGTG CAGCCTCCGGATTCACCTTTAGCATCTATGCCAT GAGCTGGGTCCGCCAGGCTCCAGGGAAGGGGCT GGAGTGGGTCTCAGTTATTAGTGGTAGTGGTGGT AGTCATTCTACGACTGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTACGAAAGATCGGGTG AAAGCTCATGATGGTTTTGATATCTGGGGCCAAG GGACAATGGTCACCGTCTCTCTCA |
| | | | SEQ ID NO: 28571 |
| | | AA | DIQMTQSPSSLSASVGDRVTITCRASQSISNYLN WYQQTGKAPKFLIYAASSLQSGVPSRFSGSGS GTDFTLTISSLQPEDFATYYCQQSYSTPFTFGPGT KVDIK |
| | | | SEQ ID NO: 24566 |
| | | | EVQLLESGGDMVQPGGSLRLSCAASGFTFSIYAMS WVRQAPGKGLEWSVISGSGGSSFYADSVKGRFTI SRDNSKNTLYLQMNSLRAEDTAVYYCTKDRVKAH DGFDIWGQGTMVTVSS |
| | | | SEQ ID NO: 28572 |

FIGURE 50
(Continued)

| | | | | |
|---|---|---|---|---|
| iPS:392986 | 21-225_31B8 | NA | GACATCCAGATGATCCAGTCTCCATCCTCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATATTATTACCCTCCT ACTTTCGGCGGAGGGACCAAGGTGGAGATCA AA | GAGGTGCAGCTGTTGGAGTCTGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCAACTGAACAGCCTGAGAGCCGATGA TGTATCTACAACTGAACAGCCTGAGAGCCGATGA CACGGCCGTATATTACTGTGTGAAAGGGGAGCTA CTAGAGGACTACTTCTACGGTATGGACGTCT GGGGCCAAGGGACCACGGTCACCGTCTCCTCA |
| | | | SEQ ID NO: 24567 | SEQ ID NO: 28573 |
| | | AA | DIQMIQSPSSLSASVGDRVTITCRASQDIRSDLGW YQQKPGKAPKRLIYGASSLQSGVPSRFSGSGSGT EFTLTISSLQPEDFATYYCLQHIYPPTFGGGTKV EIK | EVQLLESGGGLVQPGGSLRLSCAASGFTFSSYAMS WVRQAPGKGLEWVSAISGRGGSTFHADSVKGRFTI SRDNSKNTLYLQLNSLRADDTAVYYCVKGELLED YYFYGMDVWGQGTTVTVSS |
| | | | SEQ ID NO: 24568 | SEQ ID NO: 28574 |
| iPS:392988 | 21-225_25E6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCCGCGG CAGTGGATCTGGGACAGATCCACTCTCACAA TCAACAGTCTGCAGCCTGAAGATTTTGCAACC TATTACTGTCTACAGCATAATAGTTACCCGCTC ACTTTCGGCGGAGGGACCAAGGTGGAGATCA AA | CAGGTGCAGCTGGTGGAGTCTGGGGAGGCGTG GTCCAGCCTGGGAGGTCCCTGAGACTCTCCTGTG CAGCGTCTGGATTCAGTCACCTTCAGTGACTATGGCAT GCACTGGGTCCGCCAGGCTCCAGGCAAGGGCT GGAGTGGGTGGCAGTTATATGTATGATGAAAAT AATAAATACTATGCAGACTCCGTGAAGGGCCGA TTCACCATCTGCAAATGAACAGCCTGAGAGCCGAGG TGTATCTGCAAATGAACAGCCTGAGAGCCGAGG GATGACGGGTGACTCCTGGGGCCAGGAACCCT GGTCACCGTCTCCTCA |
| | | | SEQ ID NO: 24569 | SEQ ID NO: 28575 |

FIGURE 50
(Continued)

| | | | | |
|---|---|---|---|---|
| iPS:392990 | 21-225_25H10 | AA | DIQMTQSPSSLSASVGDRVTITCRASQGIRNDLG WYQRKPGKAPKRLIYAASSLQSGVPSRFRGSGS GTEFTLTINSLQPEDFATYYCLQHNSYPLTFGGG TKVEIK<br><br>SEQ ID NO: 24570 | QVQLVESGGGVVQPGRSLRLSCAASGFTFSDYGM HWVRQAPGKGLEWVAVIWYDENNKYYADSVKGR FTISRDNSKNTLYLQMNSLRAEDTALYYCATELGM TGDSWGQGTLVTVSS<br><br>SEQ ID NO: 28576 |
| | | NA | GACATCCAGATGACCCAGTCTCCATCCTCCCT GTCTGCATCTGTAGGAGACAGAGTCACCATCA CTTGCCGGGCAAGTCGGGGCATTAGAAATGAT TTAGGCTGGTATCAGCAGAAACCAGGAAAG CCCCTAAGCGCCTGATCTATGCTGCATTCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATATAAGTTACCCGCTC ACTTTCGGCGGAGGGACCAAGGTGGAGATCA AA<br><br>SEQ ID NO: 24571 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAGT AATAAATACTATGCAGACTCCATGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGACGGGTGACTACTGGGGCCAGGGAACCCT GGTCACCGTCTCCTCA<br><br>SEQ ID NO: 28577 |
| | | AA | DIQMTQSPSSLSASVGDRVTITCRASRGIRNDLG WYQQKPGKAPKRLIYAAFSLQSGVPSRFSGSGS GTEFTLTISSLQPEDFATYYCLQHNSYPLTFGGG TKVEIK<br><br>SEQ ID NO: 24572 | QVQLVESGGGVVQPGRSLRLSCAASGFTFSDYGM HWVRQAPGKGLEWVAVIWYDESNKYYADSMKGR FTISRDNSKNTLYLQMNSLRAEDTAVYYCARELGM TGDYWGQGTLVTVSS<br><br>SEQ ID NO: 28578 |

FIGURE 50
(Continued)

| | | | | |
|---|---|---|---|---|
| iPS:392992 | 21-225_26C4 | NA | GACATCGTGATGACCCAGTCTCCAGACTCCCT GGCTGTGTCTCTGGGCGAGAGGGCCACCATCA ACTGCAAGTCCAGCCAGAGTGTTTTATACCGC TCCAACAATTACAACTACTTAGCTTGGTACCA GCACAAAACCAGGACAGCCTCCTAAGCTGCTCA TTTACTGGGCATCTACCCGGGAATCCGGGGTC CCTGACCGCTTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCGACGTTCGGCCAAGG GACCAAGGTGGAATTCAAA<br><br>SEQ ID NO: 24573 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGC TTGAGTGGATGGGATGGATGAACCCTAACAGTG GTAACACAGGCTATGCACAGAGATTCCAGGCA GAGTCACCATGACCAGGAACACCTCCATAAACA CAGCCTACATGGAGCTGAGCAGCCTGAGATCTG AGGACACGGCCGTATACTTTGCACTACTGGGGGCCAGGGG GTGGCTGGTACTACTTTGACTACTGGGGCCAGGG AACCCTGGTCACCGTCCTCA<br><br>SEQ ID NO: 28579 |
| | | AA | DIVMTQSPDSLAVSLGERATINCKSSQSVLYRSN NYNYLAWYQHKPGQPPKLLIYWASTRESGVPD RFSGSGSGTDFTLTISSLQAEDVAVYYCQQYYST PPTFGQGTKVEFK<br><br>SEQ ID NO: 24574 | QVQLVQSGAEVKKPGASVKVSCKASGYTFTNYDIN WVRQASGQGLEWMGWMNPNSGNTGYAQRFQGR VTMTRNTSINTAYMELSSLRSEDTAVYYCASSSGW YYFDYWGQGTLVTVSS<br><br>SEQ ID NO: 28580 |
| iPS:392994 | 21-225_26G11 | NA | GATATTGTGATGACCCAGACTCCACTCTCT GTCCGTCACCCTGGACAGCCGGCCTCCATCT CCTGCAAGTCTAGTCAGAGCCTCCTGCATGGT GAAGGAAAGACCTATTTGTATTGGTACCTGCA GAAGCCAGGCCAGCCTCCACACCTCCTGATCT ATGAAGTTTCCAACCGGTTCTCTGGAGTGCCA GATAGGTTCAGTGGCAGCGGGTCAGGACAG ATTTCACACTGAAAATCAGCGGGGTGGAGGCT GAGGATGTTGGAGTTTATTACTGCATGCAAAG TATAAAGCTTCCGCTCACTTTCGGCGGAGGGA CCAAGGTGGAGATCAAA<br><br>SEQ ID NO: 24575 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAACAGCAAGAACACGC TGTATCTGCAAATGAACAGCCTGAGAGCCGAGG ACACGGCTGTATATTACTGTGCGAGAAGGTATAG CAACAGCTGGTCAGGGGGTATGACGTCTGGGG CCAAGGGACCACGGTCACCGTCTCCTCA<br><br>SEQ ID NO: 28581 |

FIGURE 50
(Continued)

| | | | | |
|---|---|---|---|---|
| iPS:392996 | 21-225_28B1 | AA | DIVMTQTPLSLSVTPGQPASISCKSSQTLLHGEGK TYLYWYLQKPGQPPHLLIYEVSNRFSGVPDRFSG SGSGTDFTLKISRVEAEDVGIYYCMQSIKLPLTFG GGTKVEIK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSNS WSGGMDVWGQGTTVTSS |
| | | | SEQ ID NO: 24576 | SEQ ID NO: 28582 |
| | | NA | GACATCCAGATGACCCAGTCTCCATCTTCCGT GTCTGCATCTGTAGGAGACAGAGTCACCATCA CTTGTCGGGCGAGTCAGGTCATCAATGACTGG TTAGCCTGGTATCAGCAGAAACCAGGGAAAG CCCCTAAGCTCCTGATCTATGCTGCATCCAGTT TCCAAAGTGGGGTCCCATCCAAGGTTCAGCGGC AGTGGATCTGGGACAGATTTCACTCTCACCAT CACCAGCCTGCAGCCTGAAGATTTTGCAACTT ACTATTGTCAACAGGCTAGCAGTTTCCCATTC ACTTTCGGCCCTGGGACCAAAGTGGATATCAA A | GAGGTGCAGCTGTTGGAGTCTGGGGGAGGCTTG GTACAGCCTGGGGGGTCCCTGAGATTGTCCTGTG CAGCCTCTGGATTCACCTTTAGCAGCTATGCCAT GAGCTGGGTCCGCCAGGCTCCAGGGAAGGGGCT GGAGTGGGTCTCAGTATTAGTGGTAGTGGAGGT AACACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGAAATTGGGGCGT ATAGCAGTGACTGGTCCTTACTTTGACTACTGGG GCCAGGGAACCCTGGTCACCGTCTCCTCA |
| | | | SEQ ID NO: 24577 | SEQ ID NO: 28583 |
| | | AA | DIQMTQSPSSVSASVGDRVTITCRASQAINDWLA WYQQKPGKAPKLLIYAASSFQSGVPSRFSGSGSG TDFTLTITSLQPEDFATYYCQQASSFPFTFGPGTK VDIK | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKLGRIAV TGPYFDYWGQGTLVTVSS |
| | | | SEQ ID NO: 24578 | SEQ ID NO: 28584 |

FIGURE 50
(Continued)

| | | | |
|---|---|---|---|
| iPS:392998 | 21-225_28A9 | NA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTAGTATGGCAT<br>ACACTGGGTCCGCCAGGCTCCAGGCAAGGGCT<br>GGAGTGGGTGGCAGTTATATGCGTTTGATGGAAGT<br>AATAAATACTATGCAGACTCCGTGAAGGGCCGA<br>TTCACCATCTCCAGAGACAATTCCAAGAACACGC<br>TGTTTCTGCAAATGAACAGCCTGAGAGTCGAGGA<br>CACGGCTGTGTATTACTGTGCGAGAGAAATTGGC<br>TGGTTAGATGACTACTGGGGCCAGGGAACCCTG<br>GTCACCGTCTCCTCA<br><br>SEQ ID NO: 28585 |
| | | AA | GACATCCAGATGACCCAGTCTCCATCCTCCCT<br>GTCTGCATCTGTAGGAGACAGAGTCACCATCA<br>CTTGCCGGGCAAGTCAGGACAGTCATTAGAAATGAT<br>TTAGGCTGGTATCAGCAGAAACCAGGGAAAG<br>CCCCTAAGCGCCTGATCTATGCTGCTTCTAGTT<br>TGCAAAATGGAGTCCCATCAAGGTTCAGCGGC<br>AGTGGATCTGGGACAGAATTCACTCTCACAAT<br>CAGCAGCCTGCAGCCTGAAGATTTTGCAACTT<br>ATTACTGTCTACAGCATAATCGTTACCCATTCA<br>CTTTCGGCCCTGGGACCAAGTGGATATCAAA<br><br>SEQ ID NO: 24579 | DIQMTQSPSSLSASVGDRVTITCRASQGIRNDLG<br>WYQQKPGKAPKRLIYAASSLQNGVPSRFSGSGS<br>GTEFTLTISSLQPEDFATYYCLQHNRYPFTFGPGT<br>KVDIK<br><br>SEQ ID NO: 24580 | QVQLVESGGGVVQPGRSLRLSCAASGFTFSSYGIH<br>WVRQAPGKGLEWVAVIWFDGSNKYYADSVKGRF<br>TISRDNSKNTLFLQMNSLRVEDTAVYYCAREIGWL<br>DDYWGQGTLVTVSS<br><br>SEQ ID NO: 28586 |
| iPS:393000 | 21-225_29D7 | NA | GACATCCAGATGACCCAGTCTCCATCCTCCCT<br>GTCTGCATCTGTAGGAGACAGAGTCACCATCA<br>CTTGCCGGGCAAGTCAGGACAGTCATTAGAAATGAT<br>TTAGGCTGGTATCAACAGAAACCAGGGAAAG<br>CCCCTAAGCGCCTGATCTATGCTGCATCCAGT<br>TTACAAAGTGGGGTCCCATCAAGGTTCAGCGG<br>CAGTGGATCTGGGACAGATTCACTCTCACAA<br>TCAGCAGCCTGCAGCCTGAAGATTTTGCAACT<br>TATTACTGTCTACAGCATAATAGTTACCCATTC<br>ACTTTCGGCCCTGGGACCAAGTGGATATCAA<br>A<br><br>SEQ ID NO: 24581 | CAGGTGCAACTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGCT<br>GGAGTGGGTGGCAGTTATATGGAGTATGATGGAAGT<br>AATAAATACTATGCAGACTCCGTGAAGGGCCGA<br>TTCACCATCTGCAAATGAACAGCCTGAGAGGAGG<br>TGTATCTGCAAATGAACAGCCTGAGAGGAGG<br>ACACGGCTCTGTATTACTGTGCGAGAGAACTGGG<br>GTTCCTCTGACTACTGGGGCCAGGGAACCCTG<br>GTCACCGTCTCCTCA<br><br>SEQ ID NO: 28587 |

FIGURE 50
(Continued)

| | | | |
|---|---|---|---|
| iPS:393002 | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK | QVQLVESGGGVVQPGRSLRLSCAASGFTFSSYGMHWVRQAPGKGLEWVAVIWYDESNKYYGDSVKGRFTISRDNSKNTLYLQMNSLRGEDTALYYCARELGFLSDYWGQGTLVTVSS |
| | | | SEQ ID NO: 24582 | SEQ ID NO: 28588 |
| | 21-225_30G1 | NA | GACATCCAGATGACCCAGTCTCCATCCTCCCTGTCTGCATCTGTAGGAGACAGAGTCACCATCACTTGCCGGGCAAGTCAGAACATTTACAGTCTATTTAAATTGGTATCAGCAGAAACCAGGGAAAGACCCTAAGCTCCTGATCTATGCTGCATCCAGTTTGCATAGTGTGGGGTCCCGTCACGGTTCAGTGGCAGTGGTCTGGGACAGATTTCACTCTCACCATCAGCAGTCTGCAACCTGAAGATTTTGCAACTTACTACTGTCAACAGAGTTACAGTACTCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGAGAAGTAATAAATACTATGGAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAATAGCAGTTCGTACTACTTTGACTACTGGGGCCAGGGAACCCTGGTCACCGTCTCCTCA |
| | | | SEQ ID NO: 24583 | SEQ ID NO: 28589 |
| | | AA | DIQMTQSPSSLSASVGDRVTITCRASQNIYSYLNWYQQKPGKDPKLLIYAASSLHSGVPSRFSGSGSGTDFTLTISSLQPEDFATYYCQQSYSTPLTFGGGTKVEIK | QVQLVESGGGVVQPGRSLRLSCAASGFTFSYYGMHWVRQAPGKGLEWVAVIWHDGSNKYYVDSVKGRFTISRDNSKNTLYLQMNSLRAEDTAVYYCARENSSSYYFDYWGQGTLVTVSS |
| | | | SEQ ID NO: 24584 | SEQ ID NO: 28590 |

FIGURE 50
(Continued)

| | | | |
|---|---|---|---|
| iPS:393004 | 21-225_30G11 | NA | GACATCCAGATGACCCAGTCTCCATCCTCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCGGCAGCCTGCAGCCTGAAGATTTTGCAACT TATTTCTGTCTACAGCATACTATTTACCCTCCT ACTTTCGGCGGAGGGACCAAGGTGGAGATCA AA |
| | | | SEQ ID NO: 24585 |
| | | AA | DIQMTQSPSSLSASVGDRVTITCRASQDIRSDLG WYQQKPGKAPKRLIYAASSLQSGVPSRFSGSGS GTEFTLTIGSLQPEDFATYFCLQHTIYPPTFGGGT KVEIK |
| | | | SEQ ID NO: 24586 |
| iPS:393006 | 21-225_31G9 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCCTGCATCCAGT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGGATAATAGTTACCCTTTCA CTTTCGGCCCTGGGACCAAAGTGGATATCAAA |
| | | | SEQ ID NO: 24587 |

| | |
|---|---|
| GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTGGTAGTGGT AGCACATTCAACGCAGACTCCGTGAAGGGCCGG TTCACCATCTCCAGAGACAATTCCAAGACCACGC TGTATCTGCAAATGAACAGCCTGAGAGCCGAAG ACACGGCCGTATATTACTGTGTGAAAGGGAGCT ACTAGAGGACTACTACTTCTACGGTATGGACGTC TGGGGCCAAGGGACCACGGTCACCGTCTCCTCA | |
| SEQ ID NO: 28591 | |
| EVQLLESGGGLVQPGGSLRLSCAASGFTFSSYAMS WVRQAPGKGLEWVSAISGGGSTFNADSVKGRFTI SRDNSKTTLYLQMNSLRAEDTAVYYCVKGELLED YYFYGMDVWGQGTTVTVSS | |
| SEQ ID NO: 28592 | |
| GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCAATTAGTAGTAGTAGTAGT TACATATATACTGCAGAGACAACGCCAAGAACTCACT TCACCATCTCCAGAGACAACGCCAAGAACTCACT GTATCTGCAAATGAACAGCCTGAGAGCCGAGGA CACGGCTGTGTATTACTGTGCGAGAGATCGAGGC AGCAGCTGGGGCCAGGGAACCCTGGTCACCGTC TCCTCA | |
| SEQ ID NO: 28593 | |

FIGURE 50
(Continued)

| | | | | |
|---|---|---|---|---|
| iPS:393010 | 21-225_25E11 | AA | DIQMTQSPSSLSASIGDRVTITCRASQGIRNDLG WYQQKPGKAPKRLIYPASSLQSGVPSRFSGSGSG TEFTLTISSLQPEDFATYYCLQDNSYPFTFGPGTK VDIK | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARDRGSSW GQGTLVTVSS |
| | | | SEQ ID NO: 24588 | SEQ ID NO: 28594 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTATCCTGCATCCAGTT TGCAAAGTGGGGTCCCATCAAGGTTCAGCGGC AGTGGATCTGGGACAGATTTCACTATCAGCAT CAGCAGCCTGCAGCCTGAAGATTTTGCAACTT ACTATTGTCAACAGGCTAACAGTTTCCCAATC ACTTTCGGCCCTGGGACCAAAGTGGATATCAA A | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATAGCCAT GAGCTGGGTCCGCCAGGCTCCAGGGAAGGGGCT GGAGTGGGTCTCAGTTATTAGTGGTGGTGGTGGT AGCACATACTACGCAGACTCCGTGAAGGGCCGG TTCACCATCTCCAGAGACAACAATTCCAAGAACGC TGTATCTGCAAATGAACAGCCTGAGAGCCGAGG ACACGGCCGTATATTACTGTGCGAAACGTGGATA TAGTGGCTACGAGGACCTCTACTTTGACTGC TGGGGCCAGGGAACCCTGGTCACCGTCTCCTCA |
| | | | SEQ ID NO: 24589 | SEQ ID NO: 28595 |
| | | AA | DIQMTQSPSSVSASVGDRVTITCRASQGISNWLA WYQQKPGKAPKLLIYTASSLQGGVPSRFSGSGS GTDFTISISSLQPEDFATYYCQQANSFPITFGPGT KVDIK | EVQLLESGGGLVQPGGSLRLSCAASGFTFSSYAMS WVRQAPGKGLEWVSVISGGGSTYYADSVKGRFT ISRDNSKNTLYLQMNSLRAEDTAVYYCAKRGYSG YEDLLYFDCWGQGTLVTVSS |
| | | | SEQ ID NO: 24590 | SEQ ID NO: 28596 |

FIGURE 50
(Continued)

| | | | | |
|---|---|---|---|---|
| iPS:393012 | 21-225_26G7 | NA | GATATCTTGATGACCCAGACTCCACTCTCTG TCCGTCACCCCTGGAGACAGCCGGCCTCATCT CTGCAAGTCTAGTCAGAGCCTCTGCATAGTG AGGGAAAGAACCTATTTGTATTGGTACCTGCAG AAGCAGGCCAGCTCCACAGTTCCTGATCTA TGAAGTTCCACCGGCTCTCTGGAGTGCCAG ATAGGTTCAGTGGCAGCGGGTCAGGGACAGA TTTCACACTGAAAATCAGCCGGGTTGAGGCTG AGGATGTTGGGGTTTATTACTGCATGCAAAGT ATACAGGCTTCCGCTCACTTTCGCGGAGGGAC CAAGGTGGAGATCAAA<br><br>SEQ ID NO: 24591 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTATGATGGAAGT AATAAATATTATGCAGACTCCGTGAAGGGCCGAT TCACCATCTCCAGAGACAATTCCAATAACACGCT GTATCTGCAAATGAACAGCCTGAGAGCCGAGGA CACGGCTGTGTATTACTGTGCGAGAAGTATAGC AGCAGCTGGTCAGGGGGTATGGACGTCTGGGGC CAAGGGACCACGGTCACCGTCTCCTCA<br><br>SEQ ID NO: 28597 |
| | | AA | DILMTQTPLSLSVTPGQPASISCKSSQSLLHSEGK TYLYWYLQKPGQPPQFLIYEVSHRLSGVPDRFSG SGSGTDFTLKISRVEAEDVGVYYCMQSIQLPLTF GGGTKVEIK<br><br>SEQ ID NO: 24592 | QVQLVESGGGVVQPGRSLRLSCAASGFTFSSYGMH WVRQAPGKGLEWVAVIWYDGSNKYYADSVKGRF TISRDNSNNTLYLQMNSLRAEDTAVYYCARRYSSS WSGGMDVWGQGTTVTVSS<br><br>SEQ ID NO: 28598 |
| iPS:393014 | 21-225_26D12 | NA | GACATCCAGATGACCCAGTCTCCCTCTTCCGT GTCTGCATCTGTAGGAGACAGAGTCACCATCA CTTGTCGGGCGAGTCAGGGTATTAGTAGTTGG TTAGCCTGGTATCAGCAGAAACCAGGGAAAG CCCCTAAGTCCCTGATCTATGGTGCATCCAGTT TGCAAAGTGGGGTCCCATCAAGGTTCAGCGCC AGTGGATCTGGGACAGATTTCACTCTCACCAT CAGCAGCCTGCAGCCTGAAGATTTTGCAACTT ACTGTGTCAACAGCTGACAGTTTCCCTCCG ACGTTCGGCCAAGGGACCAAGGTGAAATCA AA<br><br>SEQ ID NO: 24593 | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGTTATGGCAT GCACTGGGTCCGCCAGGCTCCAGGCAAGGGCT GGAGTGGGTGGCAGTTATATGTATGATGGAAGT AATGAATACTATGCAGACACCCGTGAAGGGCCGA TTCACCATCTCCAGAGACAATTCCAAGAACACGC TATATCTACAAATGAACAGCCTGAGAGCCGAG ACACCGCTGTGTATTACTGTGCGAGAGATTCCTC CCCTACGGTATGGACGTCTGGGGCCAAGGGAC CACGGTCACCGTCTCCTCA<br><br>SEQ ID NO: 28599 |

FIGURE 50
(Continued)

| | | | |
|---|---|---|---|
| iPS:393016 | 21-225_28F11 | AA | DIQMTQSPSSVSASVGDRVTITCRASQGISSWLA WYQQKPGKAPKLLIYGASSLQSGVPSRFSASGS GTDFTLTISSLQPEDFATYCCQQSDSFPRTFGQGT KVEIK<br>SEQ ID NO: 24594 | QVQLVESGGGVVQPGRSLRLSCAASGFTFSSYGMH WVRQAPGKGLEWVAVIWYDGSNEYYADSVKGRF TISRDNSKNTLYLQMNSLRAADTAVYYCARDSSPY GMDVWGQGTTVTSS<br>SEQ ID NO: 28600 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTCTGCTGCATCCAATT TGCAAAGTGGGGTCCCATCAAGGTTCAGAGGC AGTGGATCTGGGACAGATTTCACTCTCACCAT CACCAGCCTGCAGCCTGAAGATTTTGCAACTT ACTGTTGTCAACAGGCTAACAGTCTCCCATTC ACTTTCGGCCCTGGGACCAAAGTGGATATCAA A<br>SEQ ID NO: 24595 | GAGGTGCAGCTGTTGGAGTCTGGGGGAGGCTTG GTACAGCCGGGGGGGTCCCTGAGACTCTCCTGTG CAGCCTCTGGATTCATCTTTAGCAGCTATGCCAT GAGCTGGGTCCGCCAGGCTCCAGGGAAGGGGCT GGAGTGGGTCTCAGTTACTAGTAGTGGTGGT ACCACATTCTACGCAGACTCCGTGAAGGGCCGGT TCACCATCTCCAGAGACAATTCCAAGAACACGCT TTATCTGCAAATGAACAGCTGAGACGACCAGA CACGGCCGTTTATTACTGTGCGAAACGACCAG TTTGATGATTTGATATCTGGGGCCAAGGGACAA TGGTCACCGTCTCTTCA<br>SEQ ID NO: 28601 | 
| | | AA | DIQMTQSPSSVSASVGDRVTITCRASQGISNWLA WYQQKPGKAPKLLISAASNLQSGVPSRFRGSGS GTDFTLTITSLQPEDFATYCCQQANSLPFTFGPGT KVDIK<br>SEQ ID NO: 24596 | EVQLLESGGGLVQPGGSLRLSCAASGFIFSSYAMS WVRQAPGKGLEWVSVTSGSGGTTFYADSVKGRFT ISRDNSKNTLYLQMNSLRAEDTAVYYCAKRTQFDD FDIWGQGTMVTVSS<br>SEQ ID NO: 28602 |

FIGURE 50
(Continued)

| | | | |
|---|---|---|---|
| iPS:393018 | 21-225_29B8 | NA | GACATCCAGATGACCCAGTCTCCATCCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTAGATCGGGACAGAATTCACTCTCACAA TCAGCAGTCTGCAGCCTGAAGATTTTGCAACC TATTACTGTCTACAGCATAATAGTTACCCGTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGACGGGTGACTCCTGGGGCCAGGGAACCCT GGTCACCGTCTCCTCA |
| | | | SEQ ID NO: 24597 | SEQ ID NO: 28603 |
| | | AA | DIQMTQSPSSLSASVGDRVTITCRASQGIRNDLG WYQQKPGKAPKRLIYAASSLQSGVPSRFSGSRS GTEFTLTISSLQPEDFATYYCLQHNSYPLTFGGG TKVEIK | QVQLVESGGGVVQPGRSLRLSCAASGFTFSDYGM HWVRQAPGKGLEWVAVIWYDENNKYADSVKGR FTISRDNSKNTLYLQMNSLRAEDTAVYYCARELGM TGDSWGQGTLVTVSS |
| | | | SEQ ID NO: 24598 | SEQ ID NO: 28604 |
| iPS:393020 | 21-225_30E2 | NA | GACATCCAGATGACCCAGTCTCCACATTCCCT GTCTGCATCTGTAGGAGACAGAGTCACCATCA CTTGCCAGGCGAGTCAGTACATTAGCAACTAT TTAAATTGGTATCAGCAGAAATCAGGAAAAGC CCCTAAGCTCCTGATCTACGATGATCCAGTT TGGAAACAGGGGTCCCATCAAGGTTCAGTGGA AGTGGATCTGGGACAGATTTTACTTTCACCAT CAGCAGCCTGCAGCCTGAAGATCTTGCAACAT ATTACTGTCAACAGTATGATAATCTCCGATC ACCTTCGGCCAAGGGACCACGACTGGAGATTAA A | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGTGGAAGT AATAAATTCTATGCAGACTCCGTGAAGGGCCGAT TCAACATCTCCAGAGACAATTCCAAGAACACGCT GTATCTGCAAATGAACAGCCTGAGAGCTGAGGA CACGGCTGTGTATTACTGTGTGAGAAGGGGTAT AGCAGGGAGGCTACGGTATGGACGTCTGGGGC CAAGGGACCACGGTCACCGTCTCCTCA |
| | | | SEQ ID NO: 24599 | SEQ ID NO: 28605 |

FIGURE 50
(Continued)

| | | | |
|---|---|---|---|
| iPS:393022 | 21-225_30H11 | AA | DIQMTQSPHSLSASVGDRVTITCQASQYISNYLN WYQQKSGGKAPKLLIYDGSSLETGVPSRFSGSGSG TDFTFTISSLQPEDLATYYCQQYDNLPITFGQGTR LEIK<br>SEQ ID NO: 24600 | QVQLVESGGGVVQPGRSLRLSCAASGFTFSSYGMH WVRQAPGKGLEWVAVISYGGSNKFYAVSVKGRFN ISRDNSKNTLYLQMNSLRAEDTAVYYCVRRGYSSG GYGMDVWGQGTTVTVSS<br>SEQ ID NO: 28606 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGGTCTATCCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGGATAATAGTCATCCATTC ACTTTCGGCCCTGGGACCAAAGTGGATATCAC A<br>SEQ ID NO: 24601 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCAGAGATAGGGGG AGCCTCTGGGGCCAGGGAACCCTGGTCACCGTCT CCTCA<br>SEQ ID NO: 28607 |
| | | AA | DIQMTQSPSSLSASVGDRVTITCRASQGIRNDLG WYQQKPGKAPKRLVYPASSLQSGVPSRFSGSGS GTEFTLTISSLQPEDFATYYCLQDNSHPFTFGPGT KVDIT<br>SEQ ID NO: 24602 | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARDRGSLW GQGTLVTVSS<br>SEQ ID NO: 28608 |

FIGURE 50
(Continued)

| | | | |
|---|---|---|---|
| iPS:393024 | 21-225_31H9 | NA | GACATCCAGATGACCCAGTCTCCATCTTCCGT GTCTGCATCTGTAGGAGACAGAGTCACCATCA CTGTCGGGCGAGTCAGGGTATTACCAGCTGG TTAACTTGGTATCAGCAGAAACCAGGGAAAGC CCCTAAACCTCCTGATCTATGATACATCCAGTT GCAAAGTGGGGTCCCATCAAGGTTCAGGGCA GTGGATCTGGGACAGATTTCATTTCACCATC AGCAGCCTGCAGCCTGAAGATTTTGCCACTTA TTATTGTCAACAGGGTAACAGTTTCCCATTCA CTTTCGGCCAAGGGACCAAGGTGGATATCAAA<br><br>SEQ ID NO: 24603 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTGTGCCAT GAACTGGGTCCGCCAGGCTCCAGGGAAGGGGCT GGAGTGGGTCTCAGCTATTAGTGGTAGTGGTGGT AGCTCATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAACGGACTCC TATGATGTCTTTGATATCTGGGGCCAAGGGACAA TGGTCACCGTCTCTTCA<br><br>SEQ ID NO: 28609 |
| | | AA | DIQMTQSPSSVSASVGDRVTITCRASQGITSWLT WYQQRPGKAPKLLIYDTSSLQSGVPSRFSGSGSG TDFIFTISSLQPEDFATYCQQGNSFPFTFGQGTK VDIK<br><br>SEQ ID NO: 24604 | EVQLLESGGGLVQPGGSLRLSCAASGFTFSSCAMN WVRQAPGKGLEWVSAISGSGGSSFYADSVKGRFTI SRDNSKNTLYLQMNSLRAEDTAVYYCAKRTPYDV FDIWGQGTMVTVSS<br><br>SEQ ID NO: 28610 |
| iPS:393026 | 21-225_32B6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAAACCAGGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTGG ACGTTCGGCCAAGGGACCAAGGTGGAAATCA AA<br><br>SEQ ID NO: 24605 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGACACAAGGGCT GGAGTGGGTGGCAGTTATATGCAGATCCGTGAAGGG ACTAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGTGCGAGAGAGTGGGGG GACTACTGGGGCCAGGGAACCCTGGTCACCGTCT CCTCA<br><br>SEQ ID NO: 28611 |

FIGURE 50
(Continued)

| | | AA | DIQMTQSPSSLSASVGDRVTITCRASQGIRNDLGWYQQKPGKAPKRLIYIASSLQSGVPSRFSGSGSGTEFTLTISSLQPEDFATYYCLQHNSYPWTFGQGTKVEIK | QVQLVESGGGVVQPGRSLRLSCAASGFTFSDYGMHWVRQAPDKGLEWVAVIWYDENTKYYADSVKGRFTISRDNSKNTLYLQMNSLRAEDTAVYYCAREWGDYWGQGTLVTVSS |
|---|---|---|---|---|
| | | | SEQ ID NO: 24606 | SEQ ID NO: 28612 |
| iPS:393028 | 21-225_25D7 | NA | GACATCCAGATGACCCAGTCTCCATCTTCCGTGTCTGCATCTGTAGGAGACAGAGTCACCTTCACTTGTCGGGCGAGTCAGGATCAGTATTTGACTGGTTAGCCTGGTATCAGCAGAAACCCGGGACAGCCCCTAAGCTCCTGATCTATGCGCATCCAGTTTGCAAAGTGGGGTCCCATCAAGGTTCAGCGGCAGTGGATCTGGGACAAATTTCACTCTCACCGTCAGCGGCCTGCAGCCTGAAGATTTTGCTACTTACTATTGTCAACAGGCTTACAGTTTCCCGTGGACGTTCGGCCAAGGGACCAAGGTGGAAATCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGACTCCAGGGCAGGGGCTGGAGTGGGTCTCAGCTATTAGTGGTAGAGGTGGTACCACATTCTACGACTCCGTGAAGGGCCGTTCACCATCTCCAGAGACAACAATTCAAGAACACGCTGTATCTGCAAATGAACAGCCTGAGAGCCGAGGACACGGCCGTATATTACTGTGCGAAAGACGGGTACGGTGGTAACTCCTTCTTTGACTACTGGGGCCAGGGAACCCTGGTCACCGTCTCCTCA |
| | | | SEQ ID NO: 24607 | SEQ ID NO: 28613 |
| | | AA | DIQMTQSPSSVSASVGDRVTFTCRASQDIFDWLAWYQQKPGTAPKLLIYAASSLQSGVPSRFSGSGSGTNFTLTVSGLQPEDFATYYCQQAYSFPWTFGQGTKVEIK | EVQLLESGGGLVQPGGSLRLSCAASGFTFSSYAMSWVRQTPGQGLEWVSAISRGGTTFYADSVKGRFTISRDNSKNTLYLQMNSLRAEDTAVYYCAKDGYGGNSFFDYWGQGTLVTVSS |
| | | | SEQ ID NO: 24608 | SEQ ID NO: 28614 |

FIGURE 50
(Continued)

| | | | | |
|---|---|---|---|---|
| iPS:393030 | 21-225_25H11 | NA | GACATCCAGATGACCCAGTCTCCATCCTCCT<br>GTCTGCGTCTGTAGGAGACAGAGTCACCATCA<br>CTTGCCGGGCAAGTCAGGACAGATTAGAACTGAT<br>TTAGGCTGGTATCAGCAGAAACCAGGGAAAG<br>CCCCTAAGCGCCTGATCTATGCTGCATCCAGT<br>TTACAAAGTGGGGTCCCATCAAGGTTCAGCGG<br>CAGTGGATCTGGGACAGAATTCACTCTCACAA<br>TCAGTAGTCTGCAGCCTGAAGATTTTGCAACC<br>TATTACTGTCTACAGCATAATAGTTACCCGCTC<br>ACTTTCGGCGGAGGGACCAAGGTGGAGATCA<br>AA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTATGGCAT<br>GCACTGGGTCCGCCAGGCTCCAGGCAAGGGGCT<br>GGAGTGGGTGGCAGTTATATGGTATGATGAAAAT<br>AATGAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGAACTGGG<br>GATGACGGGTGACTCCTGGGGCCAGGGAACCCT<br>GGTCACCGTCTCCTCA |
| | | | SEQ ID NO: 24609 | SEQ ID NO: 28615 |
| | | AA | DIQMTQSPSSLSASVGDRVTITCRASQGIRTDLG<br>WYQQKPGKAPKRLIYAASSLQSGVPSRFSGSGS<br>GTEFTLTISSLQPEDFATYYCLQHNSYPLTFGGG<br>TKVEIK | QVQLVESGGGVVQPGRSLRLSCAASGFTFSDYGM<br>HWVRQAPGKGLEWVAVIWYDENEYYADSVKGR<br>FTISRDNSKNTLYLQMNSLRAEDTAVYYCARELGM<br>TGDSWGQGTLVTVSS |
| | | | SEQ ID NO: 24610 | SEQ ID NO: 28616 |
| iPS:393032 | 21-225_26F8 | NA | GATATTGTGATGACCCAGACTCCACTCTCT<br>GTCCGTCACCCTGGACAGCCGGGCCTCCATCT<br>CCTGCAAGTCTAGTCAGAGCCTCCTGCATGGT<br>GATGGAAAGACCTATTTGTATTGGTACCTGCA<br>GAAGCCAGGCCAGCCTCCACAGCTCCTGATCT<br>ATGAAGTTTCCAACCGGTTCTCTGGAGTGCCA<br>GATAGGTTCAGTGGCAGCGGGTCAGGGACAG<br>ATTTCACACTGAAAATCAGCGGGTGGAGGCT<br>GAGGATGTTGGGGTTTATTACTGCATGCAAAG<br>TATACAGCTTCCGTGGACGTTCGGCCAGGGGA<br>CCAAGGTGGAAATCAAA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGGCTATGGCAT<br>GCACTGGGTCCGCCAGGCTCCAGGCAAGGGGCT<br>GGAGTGGGTGGCAATTATATGGTATGATGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGAGGTA<br>CGATTTTTGAGTGGTTGTATGGACGTCTGGGGC<br>CAAGGGACCACGGTCACCGTCTCCTCA |
| | | | SEQ ID NO: 24611 | SEQ ID NO: 28617 |

FIGURE 50
(Continued)

| | | | |
|---|---|---|---|
| iPS:393034 | 21-225_27F2 | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYYCMQSIQLPW TFGQGTKVEIK<br>SEQ ID NO: 24612 | QVQLVESGGGVVQPGRSLRLSCAASGFTFSGYGM HWVRQAPGKGLEWVAIIWYDGSNKYYADSVKGR FTISRDNSKNTLYLQMNSLRAEDTAVYYCARERYD FWSGCMDVWGQGTTVTVSS<br>SEQ ID NO: 28618 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGTTGCATCCAGTT TGCAAAGTGGGGTCCCATCAAGGTTCAGCGGC AGTGGATCTGGGACAGATTCACTCTCACAAT CAGCAGTCTGCAGCCTGAAGATATTGCAACCT ATTACTGTCTACAGCATATAAGTTACCCGCTC ACTTTCGGCGGAGGGACCAAGGTGGAGATCA AA<br>SEQ ID NO: 24613 | CAGGAGCAGTCTGGTGGAGTCTGGGGGAGGCGTG GTCCAGCCTGGGAGGTCCCTGAGACTCTCCTGTG CAGCGTCTGGATTCATCTTCAGTGACTATGGCAT GCACTGGGTCCGCCAGGCTCCAGGCAAGGGGCT GGAGTGGGTGGCAGTTATATGTAGACTCCGTGAGGGCCGAT AATAAATACTATGTAGACTCCGTGAGGGCCGAT TCACCATCTCAGAGACAATTCCAAGAACACGCT GTATCTGCAAATGAACAGCTGAGAGCCGAGGA CACGGCTGTGTATTACTGTGCAGAGAGAACTGGGG ATGACGGGTGACTCCTGGGGCCAGGGAACCCTG GTCACCGTCTCCTCA<br>SEQ ID NO: 28619 |
| | | AA | DIQMTQSPSSLSASVGDRVTITCRASQGIRNDLG WYQQKPGKAPKRLIYVASSLQSGVPSRFSGSGS GTEFTLTISSLQPEDFATYYCLQHNSYPLTFGGG TKVEIK<br>SEQ ID NO: 24614 | QEQLVESGGGVVQPGRSLRLSCAASGFIFSDYGMH WVRQAPGKGLEWVAVIWYDENNKYYVDSVRGRF TISRDNSKNTLYLQMNSLRAEDTAVYYCARELGMT GDSWGQGTLVTVSS<br>SEQ ID NO: 28620 |

FIGURE 50
(Continued)

| | | | | |
|---|---|---|---|---|
| iPS:393036 | 21-225_28G3 | NA | GAAATTGTGATGACCCAGACTCCACTCTCT GTCCGTCACCCTGGACAGCCGGCCTCCATCT CCTGCAAGTCTAGTCAGAGCCTCCTACATGGT GATGGAAAGACCTATTTGTATTGGTACCTGCA GAAGCCAGGCCAGCTCCACAGCTCCTGATCT ATGAAGTTTCCAACCGGTTCTCTGGAGTGCCA GAAAGGTTCAGTGGTGTAGCGGGTCAGGACAG ATTTCACACTGAAAATCAGCCGGGTGGAGGCT GAGGATGTTGGGGTTTATTACTGTATGCAAAG TATACAGATTCCGTGGACGTTCGGCCAAGGGA CCAAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCATCTTCAGTACCTATGGCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGATA CGATTTTTGGAGTGGTTATTTGACTACTGGGGC CAGGGAACCCTGGTCACCGTCTCCTCA |
| | | | SEQ ID NO: 24615 | SEQ ID NO: 28621 |
| | | AA | EIVMTQTPLSLSVTPGQPASISCKSSQSLLHGDGK TYLYWYLQKPGQPPQLLIYEVSNRFSGVPERFSG SGSGTDFTLKISRVEAEDVGVYYCMQSIQIPWTF GQGTKVEIK | QVQLVESGGGVVQPGRSLRLSCAASGFIFSTYGMH WVRQAPGKGLEWVAVIWYDGSNKYYADSVKGRF TISRDNSKNTLYLQMNSLRAEDTAVYYCARDRYDF WSGYFDYWGQGTLVTVSS |
| | | | SEQ ID NO: 24616 | SEQ ID NO: 28622 |
| iPS:393038 | 21-225_29D8 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGGGACTACTGGCAT ACACTGGGTCCGCCAGGCTCCAGGCAAGGGGCT GGAGTGGGTGGCAGTTATATGGTTTGATGAAACT AATAAATACTATGCAGACTCCGTGAAGGGCCGA TTCACCATCTCCAGAGACAATTCCAAGAACACGC TGTATCTGCAAATGAACAGCCTGAGAGCCGAAG ACACGGCTGTGTATTACTGTGGGAGAGAAATTGG CTGGTTAGATGACTACTGGGGCCAGGGAACCCTG GTCACCGTCTCCTCA |
| | | | SEQ ID NO: 24617 | SEQ ID NO: 28623 |

FIGURE 50
(Continued)

| | | | |
|---|---|---|---|
| iPS:393040 | 21-225_30E3 | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPFTFGPGTK VDIK<br><br>SEQ ID NO: 24618 | QVQLVESGGGVVQPGRSLRLSCAASGFTFRDYGIH WVRQAPGKGLEWVAVIWFDGTNKYYADSVKGRF TISRDNSKNTLYLQMNSLRAEDTAVYYCGREIGWL DDYWGQGTLVTVSS<br><br>SEQ ID NO: 28624 |
| | | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAGCAGAAACCAGGAAAG CCCCTAGGCGCCTGATCTATGCTGCATTCAGC TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCTCCT ACTTTCGGCGGAGGGACCAAGGTGGAGATCA AA<br><br>SEQ ID NO: 24619 | GAGGTGCAGGTGTTGGAGTCTGGGGGAGGCTTG GTACAGCCTGGGGGGTCCCTGAGACTCTCCTGTG CAGCCTCTGGATTCACCTTTAGCAGTTATGCCAT GAACTGGGTCCGCCAGGCTCCAGGGAAGGGGCT GGAGTGGGTCTCGCTATTAGTGGTCGTGGTGGT AGCACATTCTACGCAGACTCCGAGAAGGGCCGG TTCACCATCTCCAGAGACAATTCCAAGAACACGC TGTATCTGCAAATGAACAGCCTGAGAGCCGAGG ACACGGCCCTATATTACTGTGCGAAAGGGGAGCT ATTAGAGGACTACTACTACTACGGAATGGACGTC TGGGGCCAAGGGACCACGGTCACCGTCTCCTCA<br><br>SEQ ID NO: 28625 |
| | | AA | DIQMTQSPSSLSASVGDRVTITCRASQDIRDDLG WYQQKPGKAPRRLIYAAFSLQSGVPSRFSGSGS GTEFTLTISSLQPEDFATYYCLQHTSYPPTFGGGT KVEIK<br><br>SEQ ID NO: 24620 | EVQVLESGGGLVQPGGSLRLSCAASGFTFSSYAMN WVRQAPGKGLEWVSAISRGGSTFYADSEKGRFTI SRDNSKNTLYLQMNSLRAEDTALYYCAKGELLED YYYYGMDVWGQGTTVTVSS<br><br>SEQ ID NO: 28626 |

FIGURE 50
(Continued)

| | | | | |
|---|---|---|---|---|
| iPS:393042 | 21-225_31F1 | NA | GACATCCAGATGACCCAGTCTCCATCCTCCCT GTCTGCATCTGTAGGAGACAGAGTCACCATCA CTTGCCGGGCAAGTCAGAGGATTAGCAGCTAT TTAAATTGGTATCAGCAGAAACCAGGGAAAG CCCCTAAGCTCCTGATCTTTGCTGCATCCAGTT CGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGAGTTACATTACCCCGTC ACTTTCGGCGGAGGGACCAAGGTGGAGATCA GA | CAGGTGCAGCTGGTGCAGTCTGGGGCTGAGGTG AAGAAGCCTGGGGCCTCAGTGAAGGTCTCCTGC AAGGCTTCTGGATACACCTTCACCGACTACTATA TGCACTGGGTGCGACAGGCCCCTGGACAGGGGC TTGAGTGGATGGGATGGATCAACCCTAACAGTGG TGGCACAAACTATGCACAGGGACACGTCAGGGCAG GGTCACCATGACCAGGGACACGTCCATTATGACA GCCTATATGGAGCTGAGCAGGCTGAGATCTGAC GACACGGCCGTGTATTACTGTGCGAGAGATAGTA GCAATTTCAGCAACTGGTACGATTACTACGGTAT GGACGTCTGGGGCCAAGGGACCACGGTCACCGT CTCCTCA |
| | | | SEQ ID NO: 24621 | SEQ ID NO: 28627 |
| | | AA | DIQMTQSPSSLSASVGDRVTITCRASQRISSYLN WYQQKPGKAPKLLIFAASSSQSGVPSRFSGSGSG TDFTLTISSLQPEDFATYYCQQSYITPLTFGGGT KVEIR | QVQLVQSGAEVKKPGASVKVSCKASGYTFTDYYM HWVRQAPGQGLEWMGWINPNSGGTNYAQKFQGR VTMTRDTSIMTAYMELSRLRSDDTAVYYCARDSSN FSNWYDYYGMDVWGQGTTVTVSS |
| | | | SEQ ID NO: 24622 | SEQ ID NO: 28628 |
| iPS:393044 | 21-225_25B8 | NA | GAAATAGTGATGACGCAGTCTCCAGCCACCCT GTCTGTGTCTCCAGGGGAAAGAGCCACCCTCT CCTGCAGGGCCAGTCAGAGTGTTAGAAGTAAT TTAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCACTTT ATTACTGTCAGCAGTATAATAATTGGCCTCCG TGGCCCGTTCGGCCAAGGGACCAAGGTGGAAA TCAAA | CAGGTTCAGTTGGTGCAGTCTGGAGCTGAGGTGA AGAAGCCTGGGGCCTCAGTGAAGGTCTCCTGCA AGGCTTCTGGTTACACCTTCACCAGCTATGTGTAT AGGCTTCTGGGTGCGACAGGCCCCTGGACAAGGGCT CAGCTGGGTGCGACAGGCCCCTGGACAAGGGCT TGAGTGGATGGGATGGATCAGCGCTTACAATGGT AACACAACCTATGCACAGAAGTTCCGGGGCAGA GTCACCATGACCACAGACACATCCAGAGCACA GCCTACATGGATCTGAGGAGCTGAGATCTGACG ACACGGCCGTGTATTACTGTGCGAGAACCGCTGC TGGGTATAGCAGCAGCTGTTTGACTACTGGGGC CAGGGAACCCTGGTCACCGTCTCCTCA |
| | | | SEQ ID NO: 24623 | SEQ ID NO: 28629 |

FIGURE 50
(Continued)

| | | | |
|---|---|---|---|
| iPS:393046 | | AA | EIVMTQSPATLSVSPGERATLSCRASQSVRSNLAWYQQKPGQAPRLLIYGASTRATGIPARFSGSGSGTEFTLTISSLQSEDFALYYCQQYNNWPPWPFGQGTKVEIK | QVQLVQSGAEVKKPGASVKVSCKASGYTFTSYGISWVRQAPGQGLEWMGWISAYNGNTTYAQKLRGRVTMTDTSTSTAYMDLRSLRSDDTAVYYCARTAAGYSSSWFDYWGQGTLVTVSS |
| | | | SEQ ID NO: 24624 | SEQ ID NO: 28630 |
| | 21-225_25A12 | NA | GACATCCAGATGACCCAGTCTCCATCCTCCTGTCTGCATCTGTAGGAGACAGAGTCACCGTCACTTGCCGGGCAAGTCAGGCCATTAGAGATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAGAATTTATTCTCACAATCAGCAGCCTGCAGCCTGAAGATTTTGCAACTTATTACTGTCTACAGCATTATAATTACCCTCGCAGTTTTGGCCAGGGGACCAAGCTGGAGATCAAA | CAGGTGCAGCTGGTGGAGTCTGGGGGAGGCGTGGTCCAGCCTGGGAGGTCCCTGAGACTCTCCTGTCAGCGTCTGATTCACCTTCAGTGAGTCAACTGTGTCATGCACTGGGTCCGCCAGGCTCCAGGCAAGGGGCTGGAGTGGGTGGCAGTTATATGCAGATCCGTGAAGGGCCGAAATAAATACTATGCAGACACTCCGTGAAGAACACGCTTCACCATCTCCAGAGACAATTCCAAGAACACGCTGTATCTGCAAATGAACAGCCTGAGAGCCGAGGACACGGCTGTGTATTACTGTGCGAGAGAGGAGTAAGCAGTGGCTGTGACTACGGTATGGACGTCTGGGGCCAAGGGACCACGGTCACCGTCTCCTCA |
| | | | SEQ ID NO: 24625 | SEQ ID NO: 28631 |
| | | AA | DIQMTQSPSSLSASVGDRVTVTCRASQAIRDDLGWYQQRPGKAPKRLIYAASSLQSGVPSRFSGSGSGTEFILTISSLQPEDFATYYCLQHYNYPRSFGQGTKLEIK | QVQLVESGGGVVQPGRSLRLSCAASGFTFSNCVMHWVRQAPGKGLEWVAVIWYDGSNKYYADSVKGRFTISRDNSKNTLYLQMNSLRAEDTAVYYCAREEYSSGWYDYGMDVWGQGTMVTVSS |
| | | | SEQ ID NO: 24626 | SEQ ID NO: 28632 |

FIGURE 50
(Continued)

| | | | | |
|---|---|---|---|---|
| iPS:393048 | 21-225_27C3 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGTCTGCAGCCTGAAGATTTTGCAACC TATTACTGTCTACAGCATAATCGTTACCCGCTC ACTTTCGGCGGAGGGACCAAGGTGGAGATCA AA | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATCTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG ATGACGGGTGACTCCTGGGGCCAGGGAACCCTG GTCACCGTCTCCTCA |
| | | | SEQ ID NO: 24627 | SEQ ID NO: 28633 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPLTFGGG TKVEIK | QVQLVESGGGVVQPGRSLRLSCAASGFTFSDYGM HWVRQAPGKGLEWVAVIWYDENNKSYADSVKGR FTISRDNSKNTLYLQMNSLRAEDTAVYYCARELGM TGDSWGQGTLVTVSS |
| | | | SEQ ID NO: 24628 | SEQ ID NO: 28634 |
| iPS:393050 | 21-225_28C5 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCAAC TTAGCCTGGTACCACCATCAGAAACCTGGCCAGGC TCCCAGGCTCCTCATCTATGGTGCATCCACCA GGGCCACTGGTATCCCAGCCAGGTTCAGTGGC AGTGGGTCTGGGACAGACTTCACTCTCACCAT CAGCAGCCTGCAGTCTGAAGATTTTGCACTTT ATTACTGTCAGCAGTATAATAATTGGCCTCCG TGGCCGTTCGGCGGCCAAGGGACCAAGGTGGAAA TCAAA | CAGGTTCAGTTGGTGCAGTCTGGAGCTGAGGTGA AGAAGCCTGGGGCTCAGTGAAGGTCTCCTGCA AGGCTTCTGATTACACCTTCACCAGCTATGGTAT CAGCTGGGTGCGACAGGCCCCTGGACAAGGCT TGAGTGGATGGGATGGATCAGCGCTTACAATGGT AACACAACTATGCACAGAAGCTCCGGGGCAGA GTCACCATGACCACAGACACATCCACGAGCACA GCCTACATGGATCTGAGGAGCCTGAGATCTGACG ACACGGCCGTGTATTACTGTGCGAGAACCGCTGC TGGGTATAGCAGCAGCAGTGGTTTGACTACTGGGGC CAGGGAACCCTGGTCACCGTCTCCTCA |
| | | | SEQ ID NO: 24629 | SEQ ID NO: 28635 |

FIGURE 50
(Continued)

| | | | |
|---|---|---|---|
| iPS:393054 | | AA | EIVMTQSPATLSVSPGERATLSCRASQSVSSNLA WYHQKPGQAPRLLIYGASTRATGIPARFSGSGSG TEFTLTISSLQSEDFALYYCQQYNNWPPWPFGQ GTKVEIK<br>SEQ ID NO: 24630 | QVQLVQSGAEVKKPGASVKVSCKASDYTFTSYGIS WVRQAPGQGLEWMGWISAYNGNTTYAQKLRGRV TMTTDTSTSTAYMDLRSLRSDDTAVYYCARTAAG YSSSSWFDYWGQGTLVTVSS<br>SEQ ID NO: 28636 |
| | 21-225_29G8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCTGAAACCAGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATATAGTTATCCGCTCA TAACTGTCTACAGCATATAAGTTATCCGCTCA CTTTCGGCGGAGGGACCAAGGTGGAGATCAA A<br>SEQ ID NO: 24631 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAACT AATAAATACTATGCAGACTCCGTGAAGGGCCGA TTCACCATCTCAGAGACAATCCAAGAACACGC TGTATCTGCAAATGAACAGCCTGAGAGCCGAGG ACACGGCTGTGTATTACTGTGCGAGAGAACTGGG GATGACGAGTGACTACTGGGGCCAGGGAACCCT GGTCACCGTCTCCTCA<br>SEQ ID NO: 28637 |
| | | AA | DIQMTQSPSSLSASVGDRVTITCRASQGIRNDLG WYQLKPGKAPKRLIYAASSLQSGVPSRFSGSGSG TEFTLTISSLQPEDFATYNCLQHNSYPLTFGGGT KVEIK<br>SEQ ID NO: 24632 | QVQLVESGGGVVQPGRSLRLSCAASGFTFSDYGM HWVRQAPGKGLEWVAVIWYDEINKYYADSVKGR FTISRDNSKNTLYLQMNSLRAEDTAVYYCARELGM TSDYWGQGTLVTVSS<br>SEQ ID NO: 28638 |

FIGURE 50
(Continued)

| | | | |
|---|---|---|---|
| iPS:393056 | 21-225_30F3 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATACTGCATCCAGTTTACAAAGTGGGGTCCCATCAAGGTTCAGCGGCAGTGGATCTGGGACAGATTTCACTCTCACAATCAGCAGCCTGCAGCCTGAAGATTTTGCAAGTTATTACTGTCTACAGCATAATAGTTACCCGTTCACTTTCGGCGGAGGGACCAAGGTGGAGATCAAA SEQ ID NO: 24633 | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAATGGGCTGGTACGATGACTACTGGGGCCAGGGAACCCTGGTCACCGTCTCCTCA SEQ ID NO: 28639 |
| | | AA | DIQMTQSPSSLSASVGDRVTITCRASQGIRNDLGWYQQKPGKAPKRLIYTASSLQSGVPSRFSGSGSGTDFTLTISSLQPEDFASYYCLQHNSYPFTFGGGTKVEIK SEQ ID NO: 24634 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREMGWYDDYWGQGTLVTVSS SEQ ID NO: 28640 |
| iPS:393058 | 21-225_31H3 | NA | GACATCCAGATGACACAGTCTCCATCCTCCCTGTCTGCATCTGTAGGAGACACAGTCACCATCACTTGCCGGGCAAGTCAGGACAGAGAAACCAGGGAAAGCCCCTAGGCTGGTATCAGCAGAAACCAGGGAAAGCCCCTAGGCGCCTGATCTATGCTGCAAGCTTGCAAAGTGGGGTCCCATCAAGGTTCAGCGGCAGTGGATCTGGGACAGATTTCACTCTCACAATCAGCAGCCTGCAGCCTGAAGATTTTGCAACTTATTACTGTCTACAGCATATTAGTTACCCTCCTACTTTCGGCGGAGGGACCAAGGTGGAGATCAAA SEQ ID NO: 24635 | GAGGTGCAGGTGTTGGAGTCTGGGGGAGGCTTGGTACAGCCTGGGGGGTCCCTGAGACTCTCCTGTCAGCCTCTGGATTCACCTTTAGCAGCTATGCCATGAACTGGGTCCGCCAGGCTCCAGGGAAGGGGCTGGAGTGGGTCTCCGTTATTAGTGGTCGTGGTGGTAACACATTCTACGCAGAGACTCCGTGAAGGGCCGGTTCACCATCTCCAGAGACAATGAACAGCCTGAGAGCCGAGGAGTATCTGCAAATGAACAGCCTGAGAGCCGAGGACACGGCCGTATATTACTGTGCGAAAGGGGAGTTACTAGAGGACTACTACTACTACGGAATGGACGTCTGGGGCCAAGGGACCACGGTCACCGTCTCCTCA SEQ ID NO: 28641 |

FIGURE 50
(Continued)

| | | | | |
|---|---|---|---|---|
| iPS:393060 | 21-225_32G12 | AA | DIQMTQSPSSLSASVGDRVTITCRASQDIRDLG WYQQKPGKAPRRLIYAAFSLQSGVPSRFSGSGS GTEFTLTISSLQPEDFATYYCLQHTSYPPTFGGGT KVEIK | EVQVLESGGGLVQPGGSLRLSCAASGFTSSYAMN WVRQAPGKGLEWVSAISGRGNTFYADSVKGRFTI SRDNSKNTLYLQMNSLRAEDTAVYYCAKGELLED YYYYGMDVWGQGTTVTVSS |
| | | | SEQ ID NO: 24636 | SEQ ID NO: 28642 |
| | | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAGACCAGGAAAAG CCCCTAAGCGCCTGATCTATGCTGCATCCAGT TTGCAAAGTGGGGTCCCATCAAGGTTCAGCGG CAGTGGATCTGGGACAGAGAATTCACTCTCACAA TCAGCAGCCTACAGCCTGAAGATTTTGCAACT TATTACTGTCTGCAGCATACTAGTTACCCTCCT ACTTTCGGCGGAGGGACCAAGGTGGAGATCA AA | GAGGTGCAGCTGTTGGAGTCTGGGGGAGGCTTGC TACAGCCTGGGGGGTCCCTGAGACTCTCCTGTGC AGCCTCTGGATTCACCTTTAATAGCTATGCCATG AGCTGGGTCCGCCAGGCTCCAGGGAAGGGGCTG GAGTGGGTCTCCTCTATTAGTGGTGTGTGTA GCACATTCCACGCAGACTCCGTGAAGGGCCGGTT CCACATCTCCAGAGACAATTCCAGGAACACGCTG TATCTGCAAATGAACAGCCTGAGAGCCGAGGAC ACGGCCGTATATTACTGTGTGAAAGGGAGCTAC TAGAGGACTACTACTTCTACGGTATGGACGTCTG GGGCCAAGGGACCACGGTCACCGTCTCCTCA |
| | | | SEQ ID NO: 24637 | SEQ ID NO: 28643 |
| | | AA | DIQMTQSPSSLSASVGDRVTITCRASQDIRSDLG WYQQRPGKAPKRLIYAASSLQSGVPSRFSGSGS GTEFTLTISSLQPEDFATYYCLQHTIYPPTFGGGT KVEIK | EVQLLESGGGLLQPGGSLRLSCAASGFTFNSYAMS WVRQAPGKGLEWVSSISGRGGSTFHADSVKGRFTI SRDNSRNTLYLQMNSLRAEDTAVYYCVKGELLED YYFYGMDVWGQGTTVTVSS |
| | | | SEQ ID NO: 24638 | SEQ ID NO: 28644 |

FIGURE 50
(Continued)

| | | | |
|---|---|---|---|
| iPS::393062 | 21-225_33H3 | NA | GACATCCAGATGACCCAGTCTCCATCCTCCT GTCTGCATCTGTTGGAGACAGAGTCACCATCA CTTGCCAGGCGAGTCAGGACATTTCCAACTTT TTAAATTGGTTTCGCGCAGAAACCAGGAAAGC CCCTAACTCCCTGATCTACGATGCATCCAATTT GGTAACAGGGGTCCCATCAAGGTTCAGTGGAC GTGGATCTGGGACAGATTTTACTTTCACCATC AGCAGCCTGCAGCTGAACAGTATGATAATCTC CCGATCATTACTGTCAACAGGACACGGCTGGA GATTAAACCCTTCGGCCAAGGGACCACGGCTGGAGATTAAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCGGGCTCCAGGCAAGGGGCT GGAGTGGGTGGCAATTATATCATATGGTGAAGT AATAACTTCTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGCGAGAAGGGGTAT AGCAGGTGGAGGTACGGTATGGACGTCTGGGGC CAAGGGACCACGGTCACCGTCTCCTCA |
| | | | SEQ ID NO: 28645 |
| | | AA | DIQMTQSPSSLSASVGDRVTITCQASQDISNFLN WFRQKPGKAPNSLIYDASNLVTGVPSRFSGRGS GTDFTFTISSLQPEDFATYYCQQYDNLPITFGQGT RLEIK | QVQLVESGGGVVQPGRSLRLSCAASGFTFSSYGMH WVRRAPGKGLEWVAIISYGGSNNFYADSVKGRFTI SRDNSKNTLYLQMNSLRAEDTAVYYCARRGYSSG GYGMDVWGQGTTVTVSS |
| | | | SEQ ID NO: 24640 | SEQ ID NO: 28646 |
| iPS::393064 | 21-225_33A9 | NA | GACATCCAGATGACCCAGTCTCCATCCTCCT GTCTGCATCTGTAGGAGACAGAGTCACCATCA CTTGCCGGGCAAGTCAGAGCATTAGCAGGTAT TTAAGTTGGTATCAGCAGAAACCAGGGAGAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAATATCCCGATC ACCTTCGGCCAAGGGACACGACTGGAGATTAAA | CAGGTGCAGCTGCAGTCTGGTGCAGTCTGGGGCTGAGGTG AAGAAGCCTGGGGCCTCAGTGAAGGTCTCCTGTA AGGCTTCTGGATACACCTTCACCAGTTATGATAT CAACTGGGTGCGACAGGCCACTGGTCAAGGCT TGAGTGGATGGGATGGATGAACCTAACAGTGG TAACACAGGCTATGCCACAGAAGTTCCAGGGCAG AGTCACCATGACCAGGAACACCTCCATAAGCAC AGCCTACATGGAGCTGAGCAGCCTGGGATCTGA GGACACGGCCGTGTATTACTGTGCGAGAAAGAA GGCTAACGACTACTGGGGCCAGGGAACCCTGGT CACCGTCTCCTCA |
| | | | SEQ ID NO: 24641 | SEQ ID NO: 28647 |

FIGURE 50
(Continued)

| | | | |
|---|---|---|---|
| iPS:393066 | 21-225_34D3 | AA | DIQMTQSPSSLSASVGDRVTITCRASQSISRYLSWYQQKPGRAPNLQIYAASSLQSGVPSRFSGSGSGTDFTLTISSLQPEDFATYYCQQSYNPITFGQGTRLEIK | QVQLVQSGAEVKKPGASVKVSCKASGYTFTSYDINWVRQATGQGLEWMGWMNPNSGNTGYAQKFQGRVTMTRNTSISTAYMELSSLGSEDTAVYYCARKKANDYWGQGTLVTVSS |
| | | | SEQ ID NO: 24642 | SEQ ID NO: 28648 |
| | | NA | GACATCCAGATGACCCAGTCTCCATCCTCCCTGTCTGCATCTGTTGGAGACAGAGTCACCATCACTTGCCGGGCAAGTCAGAGCATTAGCAGATATTTAAATTGGTATCAGCAGAAACCAGGGAAAGCCCTAAACTCCTGATCTATGCTGCATCCAGTTTGCATAGTGGGGTCCCGTCACGGTTCAGTGGCAGTGGGTCTGGGACAGATTTCACTCTCACCATCAGCAGTCTGCAACCTGAAGATTTTGCAACTTACTACTGTCAACAGAGTTACAGTACTCCGCTCACTTTCGGCGGAGGGACCAAGGTGGAGATCAAA | CAGGTGCAGCTGGTGCAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAATACTATGTAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAATAGCAGTTCGTTCTCACTTTGACTACTGGGGCCAGGGAACCCTGGTCACCGTCTCCTCA |
| | | | SEQ ID NO: 24643 | SEQ ID NO: 28649 |
| | | AA | DIQMTQSPSSLSASVGDRVTITCRASQNIYSYLNWYQQKPGKDPKLLIYAASSLHSGVPSRFSGSGSGTDFTLTISSLQPEDFATFYCQQSYSTPLTFGGGTKVEIK | QVQLVESGGGVVQPGRSLRLSCAASGFTFSYYGMHWVRQAPGKGLEWVAVIWHDGSNKYYVDSVKGRFTISRDNSKNTLYLQMNSLRAEDTAVYYCARENSSSFYFDYWGQGTLVTVSS |
| | | | SEQ ID NO: 24644 | SEQ ID NO: 28650 |

FIGURE 50
(Continued)

| | | | | |
|---|---|---|---|---|
| iPS:393068 | 21-225_34G9 | NA | GACATCCAGATGACCCAGTCTCCATCTCCTGTCTGCATCTGTAGGAGACAGAGTCACCATCACTTGCCGGGCAAGTCAGGACAGTTAGAAGTGATTTAGGCTGGTATCAGCAGAAACCAGGGAAAGCCCCTAAGCGCCTGATCTATGCTGCATCCAGTTTGCAAAGTGGGGTCCCATCAAGGTTCACGTTCAGTGGCTCTGGGACAGAATTCACTCTCACAATCAGCAGCCTGCAGCCTGAAGCTTTTGCAATTATTACTGTCTCCAGCATACTATTTACCCTCCTACTTTCGGCGGAGGGACCAAGGTGTGATCAAA | GAGGTGCAGCTGGTGGAGTCTGGGGGAGGCTTGGTACAGCCTGGGGGGTCCCTGAGACTCTCCTGTGCAGCCTCTGATTCACCTTTAGCAGCTATGCCATGAGCTGGGTCCGCCAGGCTCCAGGGAAGGGCTGGAGTGGGTCTCCGCTATTAGTGGTCGTGGTGGTAGCACATTCCACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGTGAAAGGGGAGCTACTAGAGGACTACTACTTCTACGGTATGACGGTCTGGGGCCAAGGGACCACGGTCACCGTCTCCTCA |
| | | | SEQ ID NO: 24645 | SEQ ID NO: 28651 |
| | | AA | DIQMTQSPSSLSASVGDRVTITCRASQDIRSDLGWYQQKPGKAPKRLIYAASSLQSGVPSRFTGSGSGTEFTLTISSLQPEAFAIYYCLQHTIYPPTFGGGTKVWIK | EVQLVESGGGLVQPGGSLRLSCAASGFTFSSYAMSWVRQAPGKGLEWVSAISRGGSTFHADSVKGRFTISRDNSKNTLYLQMNSLRAEDTAVYYCVKGELLEDYYFYGMDVWGQGTTVTVSS |
| | | | SEQ ID NO: 24646 | SEQ ID NO: 28652 |
| iPS:393072 | 21-225_36C5 | NA | GACATCCAGATGACCCAGTCTCCATCTCCCTGTCTGCATCTGTAGGAGACAGAGTCACCATCACTTGCCGGGCAAGTCAGGACAGTTAGAAGTGATTTAGGCTGGTATCAGCAGAAACCAGGGAAAGCCCCTAAGCGCCTGATCTATGCTGCATCCAGTTTGCAAAGTGGGGTCCCATCAAGGTTCACGTTCAGTGGCTCTGGGACAGAATTCACTCTCACAATCAGCAGCGTGCAGCCTGAAGATTTTGCAACTTATTACTGTCTCCAATCATCCTATTTACCCTCCTACTTTCGGCGGAGGGACCAAGGTGTGATCAAA | GAGGTGCAGCTGGTGGAGTCTGGGGGAGGCTTGGTACAGCCTGGGGGGTCCCTGAGACTCTCCTGTGCAGCCTCTGATTCACCTTTAGCAGCTATGCCATGAACTGGGTCCGCCAGGCTCCAGGGAAGGGCTGGAGTGGGTCTCCGCTATTAGTGGTCGTGGTGGTAGCACATTCCACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGTGAAAGGGAGCTATTAGAGGACTACTACTTCTACGGTATGACGTCTGGGGCCAAGGGACCACGGTCACCGTCTCCTCA |
| | | | SEQ ID NO: 24647 | SEQ ID NO: 28653 |

FIGURE 50
(Continued)

| | | AA | DIQMTQSPSSLSASVGDRVTITCRASQDIRSDLG WYQQKPGKAPKRLIYAASSLQSGVPSRFTGSGS GTEFTLTISSVQPEDFATYYCLHHPIYPPTFGGGT KVWIK<br>SEQ ID NO: 24648 | EVQLVESGGGLVQPGGSLRLSCAASGFTFSSYAMN WVRQAPGKGLEWVSAISGRGGSTHADSVKGRFTI SRDNSKNTLYLQMNSLRAEDTAVYCVKGELLED YYFYGMDVWGQGTTVTVSS<br>SEQ ID NO: 28654 |
|---|---|---|---|---|
| iPS:393074 | 21-225_33B1 | NA | GACATCCAGATGACCCAGTCTCCATCCTCCCT GTCTGCATCTGTAGGAGACAGAGTCACCATCA CTTGCCGGACAAGTCAGGGACATTAGAAATGAT TTAGGCTGGTTTCAGCAGAAACCAGGGAAAGC CCCTAAGCGCCTGATCTATACTGCATCCAGTTT GCAAAGTGGGGTCCCATCAAGGTTCAGCGGCA GTGGATCTGGGACAGAATTCACTCTCACAATT AGCAGCCTGCAGCCTGAAGATTTTGCAACTTA TTACTGTCTACAGCATATAAGTTACCCGCTCA CTTTCGGCGGAGGGACCAAGGTGGAGGTCAA A<br>SEQ ID NO: 24649 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGCCAAGGGGCT GGAGTGGGTGGCAGTTATATGGTATGATAGAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAAATGGG CTGGTACGATGACTACTGGGGCCAGGGAACCCT GGTCACCGTCTCCTCA<br>SEQ ID NO: 28655 |
| | | AA | DIQMTQSPSSLSASVGDRVTITCRTSQGIRNDLG WFQQKPGKAPKRLIYTASSLQSGVPSRFSGSGSG TEFTLTISSLQPEDFATYYCLQHNSYPLTFGGGT KVEVK<br>SEQ ID NO: 24650 | QVQLVESGGGVVQPGRSLRLSCAASGFTFSDYGM HWVRQAPAKGLEWVAVIWYDRNNKYYADSVKG RFTISRDNSKNTLYLQMNSLRAEDTAVYYCAREMG WYDDYWGQGTLVTVSS<br>SEQ ID NO: 28656 |

FIGURE 50
(Continued)

| | | | |
|---|---|---|---|
| iPS:393076 | 21-225_33A4 | NA | GACATCCAGATGACCCAGTCTCCATCCTCCT GTCTGCATCTGTAGGAGACAGAGTCACCATCA CTTGCCGGGCAAGTCAGGACATTAGAAATGAT GTAGGCTGGTATCAGCAGAAACCAGGGAAAG CCCCTGAGCGCCTGATCTATGCTGCATCCAGT TTGCAACGTGGGGTCCCATCAAGGTTCAGCGG CAGTGGATCTGGGACAGAATTCACTCTCACAA TCAGCAGCCTGCAGCCTGAAGATTTTGCAAGA TATTACTGTCTACAGCATTATAGTTACCCTCT ACTTTCGGCGGAGGGACCAAGGTGGAGATCA AA |
| | | | SEQ ID NO: 24651 |
| | | AA | DIQMTQSPSSLSASVGDRVTITCRASQDIRNDVG WYQQKPGKAPERLIYAASSLQRGVPSRFSGSGS GTEFTLTISSLQPEDFARYYCLQHYSYPPTFGGG TKVEIK |
| | | | SEQ ID NO: 24652 |
| iPS:393078 | 21-225_33H11 | NA | GACATCCAGATGACCCAGTCTCCATCCTCACT GTCTGCATTTGTAGGAGACAGAGTCACCATCA CTTGTTGGGCGAGTCAGGGCATTAACAGTTAT TTAGCCTGGTTTCAGCAGAAGACCAGGGAAAGC CCATAAGTCCTTGATCTATGCTGAATCCAGTTT GCAAGGTGGGGTCCCATCAAAGTTCAGCGGCA GTGGATCTGGGACAGATTTCATTCTCACCATC AGCAGCCTGCAGCCTGAAGATTTTGCAACTTA TTACTGCCAACAGTTTAATAGTTACCCTCTGAC GTTCGGCCAAGGGACCAAGGTGGAAATCAAA |
| | | | SEQ ID NO: 24653 |

| | | | |
|---|---|---|---|
| | | | GAGGTGCAGTTGTTGGAGTCTGGGGGAGGCTTGG TACAGTCTGGGGGTCCCTGAGACTCTCCTGTGA AGCCTCAGGATTCATCTTTAGCAGTTATGCCATG AACTGGGTCCGCCAGGTTCCAGGGAAGGGGCTG GAGTGGGTCTCAGTATTAGTCGTCGTGGTGTA GCACATTCTACGCAGACTCCGTGAAGGGCCGGTT CACCATTTCCAGAGACAATTCCAAGAACACGCTG TATCTGCAAATGAACAGCCTGAGAGCCGAGGAC ACGGCCGTATATTTCTGTGCGAAAGGGGAACTAC TAGAGGACTACTCCTACTACGGTATGGACGTCTG GGGCCAGGGGACCACGGTCACCGTCTCCTCA |
| | | | SEQ ID NO: 28657 |
| | | | EVQLLESGGGLVQSGGSLRLSCEASGFIFSSYAMN WVRQVPGKGLEWVSAISRRGGSTFYADSVKGRFTI SRDNSKNTLYLQMNSLRAEDTAVYFCAKGELLED YSYYGIDVWGQGTTVTVSS |
| | | | SEQ ID NO: 28658 |
| | | | GAGGTGCAGCTGGTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATATACTACCAGAGACAGTCAGTGAAGGGCCGAT TCACCATCTCCAGAGACAACGCCAAGAACTCACT GTATCTGCAAATGAGCAGCCTGAGAGCCGAGGA CACGGCTGTGTACTACTGTGCGAGAACAAACGGT ATGGACGTCTGGGGCCAAGGGACCACGGTTACC GTCTCCTCA |
| | | | SEQ ID NO: 28659 |

FIGURE 50
(Continued)

| | | | |
|---|---|---|---|
| | | AA | DIQMTQSPSSLSAFVGDRVTITCWASQGINSYLA WFQQRPGKAHKSLIYAASSLQGGVPSKFSGSGS GTDFILTISSLQREDFATYYCQQFNSYPLTFGQGT KVEIK<br><br>SEQ ID NO: 24654 | EVQLVESGGGLVKPGGSLRLSCAASGFTFSSYSMN WVRQAPGKGLEWVSSISGSSSYIYYADSVKGRFTIS RDNAKNSLYLQMSSLRAEDTAVYYCARTNGMDV WGQGTTVTSS<br><br>SEQ ID NO: 28660 |
| iPS:393080 | 21-225_34F3 | NA | GACATCCAGATGACCCAGTCTCCGTCTTCCGT GTCTGCAACTGTAGGAGACAGAGTCACCAGCA CTTGTGCGGGCGAGTCAGGTATTAGTAAGTGG TTAGCCTGGTATCAGCAGAAGCCAGGGAAAG CCCCTAAACTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGACTCTGCAACTT ACTATTGTCAACAGGCTAACAGTTTCCCTTTCA CTTTCGGCCCTGGGACCAAAGTGGATATCAAA<br><br>SEQ ID NO: 24655 | CAGGTGCAGCTGGTGCAGTCTGGGGCTGAGGTG AAGAAGCCTGGGGCTCAGTGAAGGTCTCCTGC AAGGCTTCTGGATACACCTTCACCGGCTACCATA TGCACTGGGTGCGACAGGCCCCTGGACAAGGGC TTGACTGGATGGGATGGATCAACCCTAACAGTGG TGGCACAAACTATGCACAGAAGTTCAGGCAG GGTCACCATGACCAGGGACACGTCCATCAGCAC AGCCTATATGGAGCTGAGCAGGCTGAGATCTGA CGACACGGCCGTGTATTACTGTGCGAGAGACGGT ACCAGCTCCTTTGACTACTGGGGCCAGGGAACCC TGGTCACCGTCTCCTCA<br><br>SEQ ID NO: 28661 |
| | | AA | DIQMTQSPSSVSATVGDRVTSTCRASQGISKWLA WYQQKPGKAPKLLIYAASSLQSGVPSRFSGSGS GTDFTLTISSLQPEDSATYYCQQANSFPFTFGPGT KVDIK<br><br>SEQ ID NO: 24656 | QVQLVQSGAEVKKPGASVKVSCKASGYTFTGYHM HWVRQAPGQGLDWMGWINPNSGGTNYAQKFQGR VTMTRDTSISTAYMELSRLRSDDTAVYYCARDGTS SFDYWGQGTLVTVSS<br><br>SEQ ID NO: 28662 |

FIGURE 50
(Continued)

| | | | |
|---|---|---|---|
| iPS:393082 | 21-225_34C11 | NA | GACATCCAGATGACCCAGTTTCCATCTTCCCTGTCTACATCTGTAGGAGACAGAGTCACCAGCACTTGCCCGGGCAAGTCAGAACATTAGGAACTTTTTAAATTGGTATCAGCAGAAACCTGAGAAAGACCCTAAGCTCCAGATCTATGGTGCATCCACTTTGCAAAGTGGGGTCCCATCAAGGTTCAGTGGCAGTGGATTTGGGACAGATTTCACTCTCACCATCAGTAGTCTGCAACTGCAACAGATTTTGCAACTTACTACTGTGTCAACAGACTTGCAGTACCCGCTCACTTTCGGCGGAGGGACCAAGGTGGAGATCAAA SEQ ID NO: 24657 | GAGGTGCAGCTGGTGGAGTCTGGGGGAGGCTGGTCAAGCCTGGGGGGTCCCTGAGACTCTCCTGTGCAGCCTCTGGATTCACCTTCAGTAGTTATACCATGAGCTGGGTCCGCCAGGCTCCAGGGAAGGGCTGGAGTGGGTCTCATCCATTAGTGGTAGTAGTAATTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGATTAACTGGTTTTGACTACTGGGGCCAGGGAACCCTGGTCACCGTCTCCTCA SEQ ID NO: 28663 |
| | | AA | DIQMTQFPSSLSTSVGDRVTSTCRASQNIRNFLNWYQQKPEKDPKLQIYGASTLQSGVPSRFSGSGFGTDFTLTISSLQPKDFATYYCQQTCSTPLTFGGGTKVEIK SEQ ID NO: 24658 | EVQLVESGGGLVKPGGSLRLSCAASGFTFSSYTMSWVRQAPGKGLEWVSSISGSSNYIYADSVKGRFTISRDNAKNSLYLQMNSLRAEDTAVYYCARLTGFDYWGQGTLVTVSS SEQ ID NO: 28664 |
| iPS:393084 | 21-225_35C6 | NA | GACATCCAGATGACCCAGTCTCCATCTTCCGTGTCTGCATCTGTAGGAGACAGAGTCACCATCACTTGTCTGCGGCGAGTCAGGGTATTAGCAAATGGTTAGCCTGGTATCAGCAGAAACCAGGGAAAGCCCCTAAACCCCTGATCTATGCTGCATCCAGTTTGCAGAGTGGGGTCCCAACAAGGTTCAGCGGCAGTGGATCTGGGACAGATTTCACTCTCACCATCAGCAGCCTGCAGCCTGAAGATTTTGCAATTTACTATTGTCAACAGGCTAACAGTTTCCCATTCACTTTCGGCCCTGGGACCAAAGTGGATATCAAA SEQ ID NO: 24659 | CAGGTGCAGTTGGTGCAGTCTGGGACTGAGGTGAAGAAGCCTGGGGCCTCAGTGAAGGTCTCCTGCAAGGCTTCTGGATACACCTTCACCGGCGATTATATAGGCTGGGTGCGACAGGCCCCTGGACAAGGGCTTGAGTGGATGGGATGGATCAGCCTAAAATGGTGGCACAAACTATGCACAGAAGTTTCAGGCAGGGTCACCATGACCAGGGACACGTCCATCAGCACAGCCTACATGGAGCTGAACAGGCTGAGATCTGACGAACACGGCCGTGTATTACTGTGCGAGAGATGGAACTGGGTCCTTTGACTACTGGGGCCAGGGAACCCTGGTCACCGTCTCCTCA SEQ ID NO: 28665 |

FIGURE 50
(Continued)

| | | | |
|---|---|---|---|
| iPS:393086 | 21-225_36H5 | AA | DIQMTQSPSSVSASVGDRVTITCRASQGISKWLAWYQQKPGKAPKPLIYAASSLQSGVPTRFSGSGSGTDFTLTISSLQPEDFAIYYCQQANSFPFTFGPGTKVDIK<br>SEQ ID NO: 24660 | QVQLVQSGTEVKKPGASVKVSCKASGYTFTGDYMHWVRQAPGQGLEWMGWISPKNGGTNYAQKFQGRVTMTRDTSISTAYMELNRLRSDDTAVYYCARDGTGSFDYWGQGTLVTVSS<br>SEQ ID NO: 28666 |
| | | NA | GACATCCAGATGACCCAGTCTCCATCTTCCGTGTCTGCATCTGTAGGAGACAGAGTCACCATCACTTGTCGGGCGAGTCAGGGTATTAGCAGCAGATGGTTAGCCTGGTATCAGCAGAAACCAGGGAAAGCCCCTGAACTCCTGATCTATGCTGCATCCCGTTTGCAAAGTGGGATCCCATCCAGGTTCAGCGGCAGTGGATCTGGGACAGACTTCACTCTCACCATCAGCAGCCTGCAGCCTGAAGATTTTGCAACTTACTATTGTCAACAGGCTAACAGTTTCCCTTTCACTTTCGGCCCTGGGACCAAAGTGGATATCAAA<br>SEQ ID NO: 24661 | CAGGTGCAGCTGGTGCAGTCTGGGGCTGAGGTGAAGAAGCCTGGGGCCTCAATGAAGGTCTCTGCAAGGCTTCTGGATACACCTTCACCGACTATCATATGCACTGGGTGCGACAGGCCCCTGGACAAGGGCTTGAGTGGATGGGATGGATCAACCTAATAGGGGTGGCACAAACTATGCACAGAAGTTTCAGGACAGGGTCACCATGACCAGGGACACGTCCATCAGCACAGCCTACATGGAACTGAACCTGAGAGCTGAGATCTGACGACACGGCCGTGTATTTCTGTGCGAGAGATGGAACTGGGTCCTTTGACTACTGGGGCCAGGGAACCCTGGTCACCGTCTCCTCA<br>SEQ ID NO: 28667 |
| | | AA | DIQMTQSPSSVSASVGDRVTITCRASQGISRWLAWYQQKPGKAPELLIYAASRLQSGIPSRFSGSGSGTDFTLTISSLQPEDFATYYCQQANSFPFTFGPGTKVDIK<br>SEQ ID NO: 24662 | QVQLVQSGAEVKKPGASMKVSCKASGYTFTDYHMHWVRQAPGQGLEWMGWINPNRGGTNYAQKFQDRVTMTRDTSISTAYMELSRLRSDDTAVYFCARDGTGSFDYWGQGTLVTVSS<br>SEQ ID NO: 28668 |

FIGURE 50
(Continued)

| | | | |
|---|---|---|---|
| iPS:393088 | 21-225_33D1 | NA | GACATCGTGATGACCCAGTCTCCAGACTCCCTGTCTGTGTCTCTTGGGCGAGAGGGCCACCATCAACTGCAAGTCCATCCAGAGTGTTTTATACAGATCCAACAATAAGAACTACTTAACTTGGTATCAGCAGAAACCAGGACAGCCTCGTAAACTGGGAATCCGGGGTCTTTATTGGGCATCTACCCGGGAATCCGGGGTCCTTGACCGATTCAGTGGCAGCGGGTGTGGGACAGATTTCACTCTCACCATCATCAGCCTGCAGGCTGAAGATGTGGCACTTTATTACTGTCAGCAATATTATAGTTCTCCGTGCAGTTTTGGCCAGGGACCAAGCTGGAGATCAAA |
| | | | SEQ ID NO: 24663 |
| | | AA | DIVMTQSPDSLSVSLGERATINCKSIQSVLYRSNNKNYLTWYQQKPGQPRKLFIYWASTRESGVLDRFSGSGCGTDFTLTIISLQAEDVALYYCQQYYSSPCSFGQGTKLEIK |
| | | | SEQ ID NO: 24664 |
| | | NA | GACATCCAGATGACCCAGTCTCCATCCTCACTGTCTGCATCTGTAGGAGACAGAGTCACCATCACTTGTCGGGCAGTCAGGGCCATTAGCAATGCAATTAGCCTGGTTTCAGCAGAAACCAGGGAAAGCCCCTAAGTCCCTGATCCTGCATCCAAGTTTCAGCGGCAGCAAAAGTGGGGTCCCATCAAAGTTCAGCGGCAGTGGATCTGGGACAGATTTCACTCTCACCATCAGCAGCCTGCAGCCTGAAGATTTTGCAACTTATTACTGCCAACAGTATATAGTTACCCATTCACTTTCGGCGGCCTGGGACCAAGCTGGATATCAAA |
| iPS:393090 | 21-225_33A5 | | SEQ ID NO: 24665 |

| | | | |
|---|---|---|---|
| | | | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGACATTAACTGGGTGCGACAGGCCACTGGACAAGGGCTTGAGTGGATGGGATGGATGCACCCTAACAGTGGTAACACAGGCTTTGCACAGAAGTTCCGGGCAGAGTCACCATGACCAGGAACACCTCCATAAGCACAGCCTACATGGAACTGAGCAGCCTGAGATCTGAGGACACGGCCGTGTATTACTGTGCGAGCAGCAGTGGCTGGTACTTTTTGACTACTGGGGCCAGGGAACCCTGGTCACCGTCTCCTCA |
| | | | SEQ ID NO: 28669 |
| | | | QVQLVQSGAEVKKPGASVKVSCKASGYTFTNYDINWVRQATGQGLEWMGWMHPNSGNTGFAQKFRGRVTMTRNTSISTAYMELSSLRSEDTAVYYCASSSGWYFFDYWGQGTLVTVSS |
| | | | SEQ ID NO: 28670 |
| | | | GAGGTGCAGCTGTGTTAGAGTCTGGGGGAGGCTTGGTACAGCCTGGGGGGTCCCTGAGACTCTCCTGTGCAGCCTCTGGATTCACCTTTAGCAGCTATGTCATAAACTGGGTCCGCCAGGCTCCAGGGAAGGGGCTGGAGTGGGTCTCAGTTATTAGTGGTAGTGGTGTTAGCACATACTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAGAACTTCCCTCTTTGACTACTGGGGCCAGGGAACCCTGGTCACCGTCTCCTCA |
| | | | SEQ ID NO: 28671 |

FIGURE 50
(Continued)

| | | | |
|---|---|---|---|
| | | AA | DIQMTQSPSSLSASVGDRVTITCRASQGISNYLAWFQQKPGKAPKSLISAASSLQSGVPSKFSGSGSGTDFTLTISSLQPEDFATYYCQQYNSYPFTFGPGTNVDIK | EVQLLESGGGLVQPGGSLRLSCAASGFTFSSYVINWVRQAPGKGLEWVSAISGSGVSTYYADSVKGRFTISRDNSKNTLYLQMNSLRAEDTAVYYCARTSLFDYWGQGTLVTVSS |
| | | | SEQ ID NO: 24666 | SEQ ID NO: 28672 |
| iPS:393092 | 21-225_33C12 | NA | GACATCCAGATGACCCAGTCTCCATCCTCCTGTCTACATCTGTAGGAGACAGAGTCACCATCACTTGCCGGGCAAGTCAGAGTCATTATCAGTTATTTAAATTGGTATCAGCAGAAACCAGGGAAAGCCCCTAAACTCCTGATCTATGTTGCATCCAGTTTGCAAGGTGGGGTCCCATCAAGGTTCACTCTCACCATAGTGGATCTGGGACAGATTTCACTCTCACCATCAGCAGTCTGCAACCTGCAAGAGTTACAGTACCCCGTACACTACTGTCAACAAGAGTTACAGTACCCCGTACACTTTCGGCGGAGGGACCAAGGTGGAGATCAAA | CAGGTGCAGTTGGTGGAATCTGGGGGAGGCGTGGTCCAGCCTGGGAGGTCCCTGAGACTCTCCTGTCAGCGTCTGGATTCACCTTCAGTCAGTCACTATGGCATGCACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATGAACAGCCTGAGAGCCGAGGACACGGCTGTGTATTACTGTGCGAGAGAAATAGCAGTCGTACTACTTTGACTACTGGGGCCAGGGAACCCTGGTCACCGTCTCCTCA |
| | | | SEQ ID NO: 24667 | SEQ ID NO: 28673 |
| | | AA | DIQMTQSPSSLSTSVGDRVTITCRASQSIISYLNWYQQKPGKAPKLLIYVASSLQGGVPSRFNGSGSGTDFTLTISSLQPEDFATYYCQQSYSTPYTFGGGTKVEIK | QVQLVESGGGVVQPGRSLRLSCAASGFTFSHYGMHWVRQAPGKGLEWVAVIWYDGSNKYADSVKGRFTISRDNSKNTLYLQMNSLRAEDTAVYYCARENSSSYYFDYWGQGTLVTVSS |
| | | | SEQ ID NO: 24668 | SEQ ID NO: 28674 |

FIGURE 50
(Continued)

| | | | | |
|---|---|---|---|---|
| iPS:393094 | 21-225_34C4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAGTTCTTACCCCATC ACCTTCGGCCAAGGGACACGACTGGAGATTAA A | CAGCTGCAGCTGCAGGAGTCGGGCCCAGGACTG GTGAAGCCTTCGGAGACCCTGTCCCTCACCTGCA CTGTCTCTGGTGGCTCCATCAGTAGAAGTAGTTA CTACTGGGGCTGGATCCGCCAGTCCCCAGGAA GGGGCTGGAGTGGATTGGGAGTATCTATTATAGT GGGAGCACCGCCTACAATCCGTCCCTCAAGAGTC GAGTCACCATATCCGTAGACACGTCCAAGAACC AGGTTCCCTGAAGCTGAGCTCCGTGACCGCGC AGACACGGCTGTGTCTTTGACTGTATTACTGTGCGAGACTGAGC AGCAGCTGGTCTTTGACTACTGGGGCCAGGGAA CCCTGGTCACCGTCTCCTCA |
| | | | SEQ ID NO: 24669 | SEQ ID NO: 28675 |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHSSYPITFGQGT RLEIK | QLQLQESGPGLVKPSETLSLTCTVSGGSISRSSYYW GWIRQSPGKGLEWIGSIYYSGSTAYNPSLKSRVTIS VDTSKNQVSLKLSSVTAADTAVYYCARLSSSWSFD YWGQGTLVTVSS |
| | | | SEQ ID NO: 24670 | SEQ ID NO: 28676 |
| iPS:393096 | 21-225_34D11 | NA | GACATCCAGATGACCCAGTCTCCATCTCCCT GTCTGCATCTGTAGGAGACAGAGTCACCATCA CTTGCCGGGCAAGTCAGGGACATTAGAAGTGAT TTAGGCTGGTATCAGCAGCAGAAACCAGGGAAAG CCCCTAAGCGCCTGATCTATGCTGCATCCAGT TTGCAAAGTGGGGTCCCATCCAGGTTCAGCGG CAGTGGATCTGGGACAGAATTCACTCTCACAG TCATCAGCCTGCAGCCTGAAGATTTTGCAACT TATTACTGTCTACAGCATACTATTACCCTCCT ACTTTCGGCGGAGGGACCAAGGTGGGGATCA AA | GAGGTGCAGCTGTGGAGTCTGGGGGAGGCTTG GTACAGCCTGGGGGGTCCCTGAGACTCTCCTGTG CAGCCTCTGGATTCACCTTTAGCAGTCAGTATGCCAT GAACTGGGTCCGCCAGGCTCCAGGGAAGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAGGGGAGTT AGTAGAGGACTACTTCTACGGTATGACGTC TGGGGCCAAGGGACCACGGTCACCGTCTCCTCA |
| | | | SEQ ID NO: 24671 | SEQ ID NO: 28677 |

FIGURE 50
(Continued)

| | | | |
|---|---|---|---|
| iPS:393098 | 21-225_35G6 | AA | DIQMTQSPSSLSASVGDRVTITCRASQDIRSDLG WYQQKPGKAPKRLIYAASSLQSGVPSRFSGSGS GTEFTLTVISLQPEDFATYYCLQHTIYPPTFGGGT KVGIK<br>SEQ ID NO: 24672 | EVQLSESGGGLVQPGGSLRLSCAASGFTFSSYAMN WVRQAPGKGLEWVSAISGRGGSTHADSVKGRFTI SRDNSKNTLYLQMNSLRAEDTAVYYCVKGELVED YYFYGMDVWGQGTTVTVSS<br>SEQ ID NO: 28678 |
| | | NA | GACATCCAGATGACCCAGTCTCCATCTTCCGT GTCTGCATCTGTAGGCGACAGACTCACCATCA CTTGTCGGGCGAGTCAGGGTATTAGCCGGTGG TTAGCCTGGTATCAGCAGAAAGTGGGGAAAGT CCCCAAACTCCTGATCTATGCTGCATCCAGGT TGCAAAGTGGGGTCCCATCAAGGTTCAGCGGC AGTGGATCTGGGACAGTTTCACTCTCACCAT CGGCAGCCTGCAGCCTGAAGATTTTGCAACTT ACTATTGTCAACAGGCTAACAGTTTCCCGTTC ACTTTCGGCCCTGGGACCAAAGTGGATCTCAA A<br>SEQ ID NO: 24673 | CAGGTGCAGCTGGTGCAGTCTGGGGCTGACGTG AAGAAGCCTGGGGCCTCAGTGAAGGTCTCCTGC AAGGCTTCTGGATACACCTTCACCGACTACCATA TACACTGGGTGCGACAGGCCCCTGGACAAGGGC TTGAGTGGATGGGATGGATCAACCTAACAATGG TGGCACACACTATGCACAGGAGTTCAGGCAG GGTCACCATGACCAGGGACACGTCCATCAGCAC AGCCTACATGGAGCTGAGTAGCCTGAGATCTGAC GACACGGCCGTGTATTACTGTGCGAGAGATGGA ACTGGGTCCTTTGACTACTGGGGCCAGGGAACCC TGGTCACCGTCTCCTCA<br>SEQ ID NO: 28679 |
| | | AA | DIQMTQSPSSVSASVGDRLTITCRASQGISRWLA WYQQKVGKVPKLLIYAASRLQSGVPSRFSGSGS GTAFTLTIGSLQPEDFATYYCQQANSFPFTFGPG TKVDLK<br>SEQ ID NO: 24674 | QVQLVQSGADVKKPGASVKVSCKASGYTFTDYHI HWVRQAPGQGLEWMGWINPNNGGTHYAQEFQGR VTMTRDTSISTAYMELSSLRSDDTAVYYCARDGTG SFDYWGQGTLVTVSS<br>SEQ ID NO: 28680 |

FIGURE 50
(Continued)

| | | | |
|---|---|---|---|
| iPS:393100 | 21-225_36B8 | NA | GACATCCAGATGACCCAGTCTCCATCCTCCCT GTCTCTGTAGGAGACAGAGTCACCATCA CTTGCCGGGCAAGTCAGACAGATTATCAGCTAT TTAAATTGGTATCAGCAGAAACCAGGGAAAG CCCCTAAACTCCTGATCTATGTTGCATCAGTT TGCAAAGTGGGGTCCCATCAAGGTTCAGTGGC AGTGGATCTGGGACAGATTTCACTCTCACCAT CAGCAGTCTGCAACCTGAAGATTTTGCGACTT ACTACTGTCAACAGAGTTACAGTACCCGTAC ACTTTCGGCGGAGGGACCAAGGTGGAGATCA AA<br>SEQ ID NO: 24675 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGTAACTATGGCAT GCACTGGGTCCGCCAGGCTCCAGGCAAGGGCT GGAGTGGGTGGCAGTTATATGGAGCATGATGAAG TAATAAATACTATGGAGACTCCGTGAAGGGCCG ATTCACCATCTCCAGAGACAATTCCAAGAACACA CTGTATCTGCAAATGAACAGCCTGAGAGCCGAG GACACGGCTGTGTATTACTGTGCGAGAGAAAATA GCAGCTCGTACTACTTTGACTACTGGGGCCAGGG AACCCTGGTCACCGTCCTCA<br>SEQ ID NO: 28681 |
| | | AA | DIQMTQSPSSLSTSVGDRVTITCRASQSIISYLNW YQQKPGKAPKLLIYVASSLQSGVPSRFSGSGSGT DFTLTISSLQPEDFATYYCQQSYSTPYTFGGGTK MEIK<br>SEQ ID NO: 24676 | QVQLVESGGGVVQPGRSLRLSCAASGFTFSNYGM HWVRQAPGKGLEWVAVIWHDGSNKYYGDSVKGR FTISRDNSKNTLYLQMNSLRAEDTAVYYCARENSS SYYFDYWGQGTLVTVSS<br>SEQ ID NO: 28682 |
| iPS:393102 | 21-225_33F1 | NA | GACATCCAGATGACCCAGTCTCCATCCTCCCT GTCTCATCTGTAGGAGACAGAGTCACCATCA CTTGCCGGACAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACCTCACTCTCACAA TCAGCAGCCTGCAGCCTGAAGATTTGCAATT TATTACTGTCTACAGCATACATATTACCCTCCT ACTTTCGGCGGAGGGACCAAGGTGGAGATCA AA<br>SEQ ID NO: 24677 | GAGGTGCAGCTGTTGGAGTCTGGGGGAGGCTTGC TACAGCCGGGGGGTCCCTGAGACTCTCCTGTGC AGCCTCTGGATTCACCTTTAGCAGCTATGCCATG AGCTGGGTCCGCCAGGCTCCAGGGAAGGGCTG GAGTGGGTCTCTCTATTAGTGGTGGTGGTA GCACATTCCACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGTGAAGGGGGAGCTAC TTGAGGACTACTACTTCTACGGTATGGACGTCTG GGGCCAAGGGACCACGGTCACCGTCCTCTCA<br>SEQ ID NO: 28683 |

FIGURE 50
(Continued)

| | | | |
|---|---|---|---|
| | | AA | DIQMTQSPSSLSASVGDRVTITCRTSQDIRSDLGWYQQKPGKAPKRLIYAASSLQSGVPSRFSGSGSGTEFTLTISSLQPEDFAIYYCLQHTIYPPTFGGGTKVEIK | EVQLLESGGGLLQPGGSLRLSCAASGFTFSSYAMSWVRQAPGKGLEWVSSISGRGGSTFHADSVKGRFTISRDNSKNTLYLQMNSLRAEDTAVYYCVKGELLEDYYFYGMDVWGQGTTVTSS |
| | | | SEQ ID NO: 24678 | SEQ ID NO: 28684 |
| iPS:393104 | 21-225_33A7 | NA | GACATCCAGATGACCCAGTCTCCATCCTCCTGTCTGCATCTGTAGGAGACAGAGTCACCATCACTTGCCGGGCAAGTCAGGACATTAGAAGTGATCTTAGGCTGGTATCAGCAGAAACCAGGAAAGCCCCTAAGCGCCTGATCTATGTTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAGCATATTACTGTCTACAGCATACTATTTACCCTCCTACTTTCGGCGGAGGGACCAAGGTGGAGATCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCCGCTATTAGTGGTCGTGGTGGTAGCACATTCCACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGTGAAAGGGGAACTACTAGAGGACTACTTCTACGGTATGGACGTCTGGGGCCAAGGGACCACGGTCACCGTCTCCTCA |
| | | | SEQ ID NO: 24679 | SEQ ID NO: 28685 |
| | | AA | DIQMTQSPSSLSASVGDRVTITCRASQDIRSDLGWYQQKPGKAPKRLIYVASSLQSGVPSRFSGSGSGTEFTLTISSLQPEDFAAYYCLQHTIYPPTFGGGTKVEIK | EVQLLESGGGLVQPGGSLRLSCAASGFTFSSCAMSWVRQAPGKGLEWVSAISGRGGSTFHADSVKGRFTISRDNSKNTLYLQMNSLRAEDTAVYYCVKGELLEDYYFYGMDVWGQGTTVTSS |
| | | | SEQ ID NO: 24680 | SEQ ID NO: 28686 |

FIGURE 50
(Continued)

| | | | | |
|---|---|---|---|---|
| iPS:393106 | 21-225_34A6 | NA | GACATCCAGATGACCCAGTCTCCATCTCCCTGTCTGCATCTGTAGGAGACAGAGTCACCATCACTTGCCGGACAAGTCAGGACAGAAATGATTTAGGCTGTGGTATCAGCAGAAACCAGGGAAAGCCCCCTAAGCGCCTGATCTTTGCTGCATCCAGTTTGCAAAGTGGGGTCCCATCAAGATTCACTCTCACAGTAGTGGATCTGGGACAGAATTCACTCTCACAGTCAGCAGCCTGCAGCCTGAAGATTTTGCAACTTATTACTGTCTACAGCATAATAGTTACCCTCCTACTTTCGGCGGAGGGACCAAGGTGGAGATCAAA | GAGGTGCAGCTGTTGGAGTCTGGGGGAGGCTTGGTACAGCCTGGGGGTCCCTGAGACTCTCCTGTCAGCCCTCTGATTCACCTTTAACAACTATGCCATGAACTGGGTCCGCCAGGCTCCAGGGAAGGGCTGGAGTGGGTCTCAGTTATTAGTCGTCGTGGTGGTAGCACATTCTACGCAGACTCCGTGAAGGGCCGGTTCACCATCTCCAGAGACACAATTCCAAGAACACTCTGTATCTCCAAATGAACAGCCTGAGAGCCGAGGACACGGCCGTATATATTACTGTGCGAAAGGGGAGCTACTAGAGGACTACTACTTCGCTATGACGTCTGGGGCCAAGGGACCACGGTCACCGTCTCCTCA |
| | | | SEQ ID NO: 24681 | SEQ ID NO: 28687 |
| | | AA | DIQMTQSPSSLSASVGDRVTITCRTSQDIRNDLGWYQQKPGKAPKRLIFAASSLQSGVPSRFSGSGSGTEFTLTVSSLQPEDFATYYCLQHNSYPPTFGGGTKVEIK | EVQLLESGGGLVQPGGSLRLSCAASGFTFNNYAMNWVRQAPGKGLEWVSAISRRGGSTFYADSVKGRFTISRDNSKNTLYLQMNSLRAEDTAVYYCAKGELLEDYYYFAMDVWGQGTTVTVSS |
| | | | SEQ ID NO: 24682 | SEQ ID NO: 28688 |
| iPS:393108 | 21-225_34G11 | NA | GACATCCAGATGACCCAGTCTCCATCTCCCTGTCTGCATCTGTGGGAGACAGAGTCACCATCACTTGCCGGCAAGTCAGAACATTAACCAGGTATTTAAATTGGTATCAGCAGAAACCAGGGAAAGCCCCTAAGCTCCTGATCTATGGTGCATCCAGTTTGCAAAGTGGGGTCCCATCAAGGTTCAGTGGCAGTGGATCTGGGACAGATTTCACTCTCACCATCAGCACTCTGCAACTGAAGATTTTGCAACTTACTACTGTCAACAGACTTACATTACCCCGCTCACTTTCGGCGGAGGGACCAAGGTGGAGATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAGGGCTTGAGTGGATGGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGAGATATTAGTAATTTCAGCAGCTGGTACGATTACTACGCTATGGACGTCTGGGGCCAAGGGACCACGGTCACCGTCTCCTCA |
| | | | SEQ ID NO: 24683 | SEQ ID NO: 28689 |

FIGURE 50
(Continued)

| | | | | |
|---|---|---|---|---|
| | | AA | DIQMTQSPSSLSASVGDRVTITCRASQNINRYLN WYQQKPGKAPKLLIYGASSLQSGVPSRFSGSGS GTDFTLTISTLQPEDFATYYCQQTYITPLTFGGGT KVEIK | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARDISNF SSWYDYYAMDVWGQGTTVTVSS |
| | | | SEQ ID NO: 24684 | SEQ ID NO: 28690 |
| iPS:393110 | 21-225_35B7 | NA | GACATCCAGATGACCCAGTCTCCATCCTCCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTGAGCGCCTGATCTATGCTGCATCCAGT TTGCAAAGTGGGGTCCCATCCAAGGTTCAGCGG CAGTGGATCTGGGACAGAGAATTCACTCTCACAA TCAGCAGCCTGCAGCCTGAAGATTTTGCAACT TATTACTGTCTACAGCATATATTACCCTCCT ACTTTCGGCGGAGGGACCAAGGTGGAGATCA AA | GAGGTGCAGCTGTTGGAGTCTGGGGGAGGCTTG GTACAGCCTGGGGGGTCCCTGAGACTCTCCTGT GCAGCCTCTGGATTCACCTTAGCAGTCAGTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGGAGCT ACTAGAGGACTACTACTTCTACGTATGGACGTC TGGGGCCAAGGGGCCACGGTCACCGTCTCCTCA |
| | | | SEQ ID NO: 24685 | SEQ ID NO: 28691 |
| | | AA | DIQMTQSPSSLSASVGDRITITCRASQDIRSDLGW YQQKPGKAPERLIYAASSLQSGVPSRFSGSGSGT EFTLTISSLQPEDFATYYCLQHTIYPPTFGGGTKV EIK | EVQLLESGGGLVQPGGSLRLSCAASGFTFSSYAMS WVRQAPGKGLEWVSAISGRGGSTHADSVKGRFTI SRDNSKNTLYLQMNSLRAEDTAVYYCVKGELLED YYFYGMDVWGQGATVTVSS |
| | | | SEQ ID NO: 24686 | SEQ ID NO: 28692 |

FIGURE 50
(Continued)

| | | | |
|---|---|---|---|
| iPS:393112 | 21-225_33G1 | NA | GACATCCAGATGACCCAGTCTCCATCTTCCGT GTCTGTGTCTGGGCGAGTCAGGGTATTAGCAGGTGG CTTGTCGGGCGAGTCAGGGTATTAGCAGGTGG TTAGCCTGGTATCAGCAGAAACCTGGGAAAGC CCCAAAGCTCCTGATCTATGGTGCATACAGTC TGCAAAGTGGGGTCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 24687 | CAGGTGCAGTTGGCGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAGCCTAACAATGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGATGG AACTGGGTCCTTTGACTACTGGGGCCAGGGAACC CTGGTCACCGTCTCCTCA<br>SEQ ID NO: 28693 |
| | | AA | DIQMTQSPSSVSVSVGDRVTITCRASQGISRWLA WYQQKPGKAPKLLIYGAYSLQSGVPSRFSGSGS GTDFTLTISSLQPEDFATYCQQANSFPFTFGPGT KVDIK<br>SEQ ID NO: 24688 | QVQLAQSGAEVKKPGASVKVSCKASGYTFTGYYM HWVRQAPGQGLEWMGWISPNNGTNYAQKFQGR VTMTRDTSISTAYMELSRLRSDDTAVYYCARDGTG SFDYWGQGTLVTVSS<br>SEQ ID NO: 28694 |
| iPS:393114 | 21-225_33G12 | NA | GACATCCAGATGACCCAGTCTCCATCCTCCCT GTCTGCATCTGTAGGAGACAGAGTCACCATCA CTTGCCGGGCAAGTCAGGGCATTAGCAACTAT TTAAATTGGTATCAACAGCAAACAGGGAAAG CCCCTAAGTTCCTGATTTATGCTGCATCCAGTT TGCAAAGTGGGGTCCCATCAAGGTTCAGTGGC AGTGGATCTGGGACAAGCTGAACCTGAAGATTTCACTCTCACC CAGCAGTCTGCAACAGAGTTACAGTACCCATTC ACTTTCGGCCCTGGGACCAAAGTGGATATCAA A<br>SEQ ID NO: 24689 | GAGGTGCAGCTGTTGGAGTCTGGGGGAGACATG GTCCAGCCTGGGGGGTCCCTGAGACTCTCCTGTG CAGCCTCCGGATTCACCTTTAGCAGCTATGCCAT GAGCTGGGTCCGCCAGCTCCAGGAAGGGGCT GGAGTGGGTCTCAGTTATTAGTGGTAGTGGTGGT AGTCATTCTACGCAGACTCCGTGAAGGGCCGGT TCACCATCTCCAGAGACAATTCCAAGAACACGCT GTATCTGCAAATGAACAGCCTGAGGGCCGAGGA CACGGCCGTATATTACTGTGCGAAAGATCGGGTG AGAGCTCATGATGGTTTTGATATCTGGGGCCAAG GGACAATGGTCACCGTCTCTTCA<br>SEQ ID NO: 28695 |

FIGURE 50
(Continued)

| | | | |
|---|---|---|---|
| | | AA | DIQMTQSPSSLSASVGDRVTITCRASQSISNYLN WYQQKPGKAPKFLIYAASSLQSGVPSRFSGSGS GTDFTLTISSLQPEDFATYYCQQSYSTPFTFGPGT KVDIK<br>SEQ ID NO: 24690 | EVQLLESGGDMVQPGGSLRLSCAASGFTFSSYAMS WVRQAPGKGLEWVSVISGSGGSSFYADSVKGRFTI SRDNSKNTLYLQMNSLRAEDTAVYYCAKDRVRAH DGFDIWGQGTMVTVSS<br>SEQ ID NO: 28696 |
| iPS:393116 | 21-225_34G7 | NA | GACATCCAGATGACCCAGTCTCCATCTTCCGT GTCTGCATCTGTAGGAGACAGAGTCACCATCA CTTGTCGGGCGAGTCAGTTATTAGCAAGTGG TTAGCCTGGTATCAGCAGAAACCAGGGAAAG CCCCTAAACTCCTGATCTATGCTGCATCCAGTT TGCAAAGTGGGGTCCCATTAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 24691 | CAGGTGCAGCTGGTGCAGTCTGGGGCTGAGGTG AAGAAGCCTGGGGCCTCAGTGAAGGTCTCCTGC AGGGCTTCTGGATACACCTTCACCGACTACCATA TTCACTGGGTGCGACAGGCCCCTGGACAAGGGCT TGAGTGGATGGGATGGATCAACCCTAACAATGGT GGCACACACTATGCACAGAAGTTTCAGGGCAGG GTCACCATGACCAGGGACACGTCCATCAGCACA GCCTACATGGAGCTGAGCAGGCTGAGATCTGAC GACACGGCCGTGTATTATTGTGCGAGAGATGAA CTGGGTCCTTTGACTACTGGGGCCAGGGAAACCT GGTCACCGTCTCCTCA<br>SEQ ID NO: 28697 |
| | | AA | DIQMTQSPSSVSASVGDRVTITCRASQLISKWLA WYQQKPGKAPKLLIYAASSLQSGVPLRFSGSGS GTDFTLTISSLQPEDFATYYCQQANSFPFTFGPGT KVDIK<br>SEQ ID NO: 24692 | QVQLVQSGAEVKKPGASVKVSCRASGYTFTDYHIH WVRQAPGQGLEWMGWINPNNGGTHYAQKFQGRV TMTRDTSISTAYMELSRLRSDDTAVYYCARDGTGS FDYWGQGNLVTVSS<br>SEQ ID NO: 28698 |

FIGURE 50
(Continued)

| | | | |
|---|---|---|---|---|
| iPS:393118 | 21-225_34H11 | NA | GACATCCAGATGACCCAGTCTCCATCCTCCT GTCTGCATCTGTGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCTCCT ACTTTCGGCGGAGGGACCAAGGTGGAGATCA AA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAGGGGCT GGAGTGGGTCTCCGCTATTAGTGGTCGTGGTGGT AGCACATTCTACGCAGACTCCGTGAAGGGCCGGT TCACCATCTCCAGAGACAATTCCAAGAACACGCT GTTTCTGCAAATGAACAGCCTGAGAGCCGAGGA CACGGCCGTTTATTACTGTGCGAAAGGGGAGCTA CTAGAGGACTACTACTACTACGGTATGGACGTCT GGGGCCAAGGGACCACGGTCACCGTCTCCTCA |
| | | | SEQ ID NO: 24693 | SEQ ID NO: 28699 |
| | | AA | DIQMTQSPSSLSASVGDRVTITCRASQDIRNDLG WYQQKPGKAPKRLIYATSSLQSGVPSRFSGSGSG TEFTLTISSLQPEDFATYYCLQHNSYPPTFGGGTK VEIK | EVQLLESGGGLVQPGGSLRLSCAASGFTFSSYAMN WVRQAPGEGLEWVSAISGRGGSTFYADSVKGRFTI SRDNSKNTLFLQMNSLRAEDTAVYYCAKGELLED YYYYGMDVWGQGTTVTVSS |
| | | | SEQ ID NO: 24694 | SEQ ID NO: 28700 |
| iPS:393120 | 21-225_35H8 | NA | GACATCCAGATGACCCAGTCTCCATCCTCACT GTCTGCATCTGTAGGAGACAGAGTCACCATCA CTTGTCGGGCGAGTCAGGCCATTAGTAATTAT TTAGCCTGGTTTCAGCAGAAAACCAGGGAAAGC CCCTAAGTCCCTGATCTATGGTGCGTCCGGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATTTCAAA | GAGGTTCAACTGGTGGAGTCTGGGGGGGCCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCGTCCATTAGTGGTACTGGTAGT TTCATATACTACGCAGACTCAGTGAAGGGCCGAT TCACCATCTCCAGAGACAACAAGCCAAGAAATCAG TGTATCTGCAAATGAACAGCCTGAGAGCCGAGG ACACGGCTGTGTATTACTGTGCGAGAGTTCTGG CTTTGACTACTGGGGCCAGGGAACCCTGGTCACC GTCTCCTCA |
| | | | SEQ ID NO: 24695 | SEQ ID NO: 28701 |

FIGURE 50
(Continued)

| | | | | |
|---|---|---|---|---|
| iPS:393122 | 21-225_33B2 | AA | DIQMTQSPSSLSASVGDRVTITCRASQAISNYLA WFQQKPGKAPKSLIYGASGLQSGVPSKFSGSGS GTDFTLTISSLQPEDFATYYCQQYNSYPFTFGPG TKVDFK | EVQLVESGGGLVKPGGSLRLSCAASGFTFSSYSMN WVRQAPGKGLEWVSSISGTGSFIYYADSVKGRFTIS RDNAKKSVYLQMNSLRAEDTAVYYCARVSGFDY WGQGTLVTVSS |
| | | | SEQ ID NO: 24696 | SEQ ID NO: 28702 |
| | | NA | GACATCCAGATGACCCAGTCTCCATCCTCCCT GTCTACATCTGTCGGAGACAAAGTCACCATCA CTTGCCGGGCAAGTCAGAGTCAGAAAGCATTATCAGTAT TTAAATTGGTATCAGCAGAAACCAGGGAAAG CCCCTAAACTCCTGATCTATGTTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCGTAC ACTTTCGGCGGGGGGACTAAGGTGGAGATCA AA | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGCAT GCACTGGGTCCGCCAGGCTCCAGGCAAGGGGCT GGAGTGGGTGGCAGTTATATCGAGATCCGTGAAGGGCCG TAATAAATACTATGCAGACTCCGTGAAGGGCCG ATTCACCATCTCCAGAGACAACAATTCCAAGAACACG CTGTATCTGCAAATGAACAGCCTGAGAGCCGAG GACACGGCTGTGTATTACTGTGCGAGAGAAAATA GCAGCTCGTACTACTTTGACTACTGGGGCCAGGG AACCCTGGTCACCGTCTCCTCA |
| | | | SEQ ID NO: 24697 | SEQ ID NO: 28703 |
| | | AA | DIQMTQSPSSLSTSVGDKVTITCRASQSIISYLNW YQQKPGKAPKLLIYVASSLQSGVPSRFSGSGSGT DFTLTISSLQPEDFATYYCQQSYSTPYTFGGGTK VEIK | QVQLVESGGGVVQPGRSLRLSCAASGFTFSNYGM HWVRQAPGKGLEWVAVIWHDGSNKYYADSVKGR FTISRDNSKNTLYLQMNSLRAEDTAVYYCARENSS SYYFDYWGQGTLVTVSS |
| | | | SEQ ID NO: 24698 | SEQ ID NO: 28704 |

FIGURE 50
(Continued)

| | | | | |
|---|---|---|---|---|
| iPS:393124 | 21-225_33G7 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACCCTCACAA TCAGCAGCCTGCAGCTGAAGATTTGCAACA TATTACTGTCTACAGCATTATAGTTACCCTCCT ACTTTCGGCGGAGGGACCAAGGTGGAGATCA AA | GAGGTTCAATTGTTGGAGTCTGGGGGAGGCTTGG TACAGCCTGGGGGGTCCCTGAGACTCTCCTGTGC AGCCTCTGGATTCACCTTTAGCAACTATGCCATG AGCTGGGTCCGCCAGGCTCCAGGGAAGGGCTG GAGTGGGTCTCAGTTATTAGTCGTCGTGGTGTA GCACATTCTACGCAGAGACTCCGTGAAGGGCCAGTT CACCATTTCCAGAGACAATTCCAAGAACACGCTG TATCTGCAAATGAACAGCCTGAGAGCCGAGGAC ACGGCCGTGTATTACTGTGCGAAAGGGGAGCTA CTAGAGGACTACTCTACTACGTATGACGTCT GGGGCCAGGGGACCACGGTCACCGTCTCCTCA |
| | | | SEQ ID NO: 24699 | SEQ ID NO: 28705 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPPTFGGGT KVEIK | EVQLLESGGGLVQPGGSLRLSCAASGFTFSNYAMS WVRQAPGKGLEWVSAISRRGGSTFYADSVKGQFTI SRDNSKNTLYLQMNSLRAEDTAVYYCAKGELLED YSYYGMDVWGQGTTVTVSS |
| | | | SEQ ID NO: 24700 | SEQ ID NO: 28706 |
| iPS:393126 | 21-225_35D1 | NA | GACATCCAGATGACCCAGTCTCCATCCTCCCT GTCTGCATCTGTAGGAGACAGAGTCACCATCA CTTGCCGGGCAAGTCAGGACAGTCATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTGCAACT TCAGCAGCCTGCAGCTGAAGATTTGCAACT TATTACTGTCTACAGCATATATATTACCCTCCC ACTTTCGGCGGAGGGACCAAGGTGGAGATCA AA | GAGGTGCAACTGTTGGAGTCTGGGGGAGGCTTG GTACAGCCTGGGGGGTCCCTGAGACTCTCCTGTG CAGCCTCTGATTCACCTTTAGCAGTCAGTGCCAT GAGCTGGGTCCGCCAGGCTCCAGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAACAACACGC TGTATCTGCAAATGAACAGCCTGAGAGCCGAGG ACACGGCCGTATATTACTGTGTGAAGGGGAGTT ACTAGAGGACTACTTCTACGGTATGACGTC TGGGGCCAAGGGGCCACGGTCACCGTCTCCTCA |
| | | | SEQ ID NO: 24701 | SEQ ID NO: 28707 |

FIGURE 50
(Continued)

| | | | | |
|---|---|---|---|---|
| | | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTIYPPTFGGGT KVEIK | EVQLLESGGGLVQPGGSLRLSCAASGFTFSSYAMS WVRQAPGKGLEWVSAISGRGGSTFHADSVKGRFTI SRDNSNNTLYLQMNSLRAEDTAVYYCVKGELLED YYFYGMDVWGQGATVTVSS |
| | | | SEQ ID NO: 24702 | SEQ ID NO: 28708 |
| iPS:393128 | 21-225_35F11 | NA | GACATCCAGATGACCCAGTCTCCATCCTCCT GTCTGCATCTGTAGGAGACAGAGTCACCATCA CTTGCCCGGGCAAGTCAGGACATTAGAAGTGAT CAGCCTCTGATTCACCTTAGCAGTCAGCCAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATATCCTGTTACCCTCCT ACTTTCGGCGGAGGGACCAAGGTGGAGATCA AA | GAGGTGCAGCTGTTGGAGTCTGGGGGAGGCTTG GTACAGCCTGGGGGGTCCCTGAGACTCTCCGTG CAGCCTCTGGATTCACCTTTAGCAGTTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCATGAAGGGCCGG TTCACCATCTCCAGAGACAATTCCAAGAACACGC TGTATCTGCAAATGAACAGCCTGAGAGCCGAGG ACACGGCCGTATATTACTGTGTAAAGGGGAGCT ACTAGAGGACTACTACTTCTACGGTATGGACGTC TGGGGCCAAGGGACCACGGTCACCGTCTCCTCA |
| | | | SEQ ID NO: 24703 | SEQ ID NO: 28709 |
| | | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTVPPTFGGG TKVEIK | EVQLLESGGGLVQPGGSLRLSCAASGFTFSSYAMS WVRQAPGKGLEWVSAISGRGGSTFHADSMKGRFTI SRDNSKNTLYLQMNSLRAEDTAVYYCVKGELLED YYFYGMDVWGQGTTVTVSS |
| | | | SEQ ID NO: 24704 | SEQ ID NO: 28710 |

FIGURE 50
(Continued)

| | | | | |
|---|---|---|---|---|
| iPS:393130 | 21-225_33C2 | NA | GACATCCAGATGACCCAGTCTCCATCCTCCCT GTCTGCATCTGTAGGAGACAGAGTCACCATCA CTTGCCGGGCAAGTCAGGGACATTAGAACCAGT GAAATGAT TTAGGCTGGTATCAGCAGAAAACCAGTGAAAGC CCCTAAGCGCCTGATCTATGCTGCACCCAGTT TGCAAAGTGGGGTCCCATCAAGGTTCAGCGGC AGTGGATCTGGGACAGAATTCACTCTCACAAT CAGCAGCCTGCAGCCTGAACATTTGCAACTT ATTACTGTCTACAGCATATAGTTACCCGTGG ACGTTCGGCCAAGGGACCAAGGTGGAAATCA AA SEQ ID NO: 24705 | GAGGTGCAACTGGTGGAGTCTGGGGGAGGCTG GTCAAGCCGGGGGGGGTCCCTGAGACTCTCCTGTG CAGCCTCTGGATTCACCTTCAGTAGTACCAT GAACTGGGTCCGCCAGGCTCCAGGGAAGGGCT GCAGTGGGTCTCATCCATTAGTGGTAGTAGTAGT TACATATACGGGACTCAGTGAAGGGCCGAT TCACCATCTCCAGAGACAACGCCAAGAACTACT GTTTCTGCAAATGAACAGCCTGAGAGCCGAGGA CACGGCTATCTTTTACTGTGCGGAGATCGGGGG GGGACCTGGGGCCAGGGAACCCTGGTCACCGTC TCCTCA SEQ ID NO: 28711 |
| | | AA | DIQMTQSPSSLSASVGDRVTITCRASQGIRNDLG WYQQKPVKAPKRLIYAAPSLQSGVPSRFSGSGS GTEFTLTISSLQPEHFATYYCLQHNSYPWTFGQG TKVEIK SEQ ID NO: 24706 | EVQLVESGGGLVKPGGSLRLSCAASGFTFSSYTMN WVRQAPGKGLQWVSSISGSSSYIYYADSVKGRFTIS RDNAKNSLFLQMNSLRAEDTAIFYCARDRGGTWG QGTLVTVSS SEQ ID NO: 28712 |
| iPS:393132 | 21-225_33H7 | NA | GACATCCAGATGACCCAGTCTCCATCTTCCGT GTCTGCATCTGTAGGCGACAGAGTCACCATCA CTTGTCGGGCGAGTCAGGGTATTAGCCGGTGG TTAGCCTGGTATCAGCAGAAAGTGGGGAAAGT CCCCAAACTCCTGATCTATGCTGCATCCAGGT TGCAAAGTGGGGTCCCATCAAGGTTCAGCGGC AGTGGATCTGGGACAGATTCACTCTCACCAT CGGCAGCCTGCAGCCTGAAGATTTTGCAACTT ACTATTGTCAACAGGCTAACATTTTCCGTTCA CTTTCGGCCCTGGGACCAAAGTGGATCTCAAA SEQ ID NO: 24707 | CAGGTGCAGCTGGTGCAGTCTGGGGCTGACGTG AAGAAGCCTGGGGCCTCAGTGAAGGTCTCCTGC AAGGCTTCTGGATACACCTTCACGACTACCATA TACTGGGTGCGACAGGCCCCCTGGACAAGGGC TTGAGTGGATGGGATGGATCAACCTAACAATGG TGGCACACACTATGCACAGGAGTTTCAGGGCAG GGTCACCATGACCAGGGACACGTCCATCAGCAC AGCCTACATGGAACTGAGGAGCCTGAGATCTGAC GACACGGCCGTGTATCACTGTGCGAGAGATGGA ACTGGGTCCTTTGACTACTGGGGCCAGGGAACCC TGGTCACCGTCTCCTCA SEQ ID NO: 28713 |

FIGURE 50
(Continued)

| | | | |
|---|---|---|---|
| | | AA | DIQMTQSPSSVSASVGDRVTITCRASQGISRWLA WYQQKVGKVPKLLIYAASRLQSGVPSRFSGSGS GTDFTLTIGSLQPEDFATYYCQQANIFPFTFGPGT KVDLK | QVQLVQSGADVKKPGASVKVSCKASGYTFTDYHI HWVRQAPGQGLEWMGWINPNNGGTHYAQEFQGR VTMTRDTSISTAYMELSSLRSDDTAVYHCARDGTG SFDYWGQGTLVTVSS |
| | | | SEQ ID NO: 24708 | SEQ ID NO: 28714 |
| iPS:393134 | 21-225_34C2 | NA | GACATCCAGATGACCCAGTCTCCATCCTCCCT GTCTACATTGTAGGAGACAGAGTCACCATTA CTTGTCGGGCAAGTCAGAGTCAGAATTATCAGTGAT TTAAATTGGTTTCAGCAGAAACCAGGGAAAGC CCCTAAACTCCTGATCTATGTTGCATCCAGTTT GCAAAGTGGGGTCCCGTCAAGGTTCACTCTCA GTGGATCTGGGACATATTTCACTCTCACCATC AGCAGTCTGCAACCTGAAGATTTTGCGACTTA CTACTGTCAACAGAGTTACAGTACCCGTACA CTTTCGGGCGGAGGGACCAAGATGGAGATCAA A | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCACTTATATCGATGTATGATGAAGT AATAAATACTATGCAGAGACTCCGTGAAGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAATAG CAGCTCGTACTACTTTGACTACTGGGCCAGGGA ACCCTGTCACCGTCCTCA |
| | | | SEQ ID NO: 24709 | SEQ ID NO: 28715 |
| | | AA | DIQMTQSPSSLSTFVGDRVTITCRASQRIISYLNW FQQKPGKAPKLLIYVASSLQSGVPSRFSGSGSGT YFTLTISSLQPEDFATYYCQQSYSTPYTFGGGTK MEIK | QVQLVESGGGVVQPGRSLRLSCAASGFTFSNYVM HWVRQAPGKGLEWVALIWYDGSNKYYADSVKGR FTISRDNSKNTLYLQMNSLRAEDTAVYYCARENSS SYYFDYWGQGTLVTVSS |
| | | | SEQ ID NO: 24710 | SEQ ID NO: 28716 |

FIGURE 50
(Continued)

| | | | |
|---|---|---|---|
| iPS:393136 | 21-225_34D8 | NA | GACATCCAGATGACCCAGTCTCCATCTCCCT GTCTACATCTGTAGGAGACAGAGTCACCATCA CTTGCCGGGCAAGTCAGATCATTATCAGCTAT TTAAATTGGTATCAGCAGAAACCAGGGAAAG CCCCTAAACTCCTGATCTTTGTTGATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCGTAC ACTTTCGGCGGAGGGACCAAGGTGGAGATCA AA<br><br>SEQ ID NO: 24711 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAATAG CAGCTCGTACTACTTTGACTACTGGGGCCAGGGA ACCCTGGTCACCGTCTCCTCA<br><br>SEQ ID NO: 28717 |
| | | AA | DIQMTQSPSSLSTSVGDRVTITCRASQIISYLNW YQQKPGKAPKLLIFVASSLQSGVPSRFSGSGSGT DFTLTISSLQPEDFATYYCQQSYSTPYTFGGGTK VEIK<br><br>SEQ ID NO: 24712 | QVQLVESGGGVVQPGRSLRLSCAASGFTFSNYGM HWVRQAPGKGLEWVAVIWYDGSNKYYADSVKGR FTISRDNSKNTLYLQMNSLRAEDTAVYYCARENSS SYYFDYWGQGTLVTVSS<br><br>SEQ ID NO: 28718 |
| iPS:393138 | 21-225_35E3 | NA | GACATCCAGATGACCCAGTCTCCATCTCCCT GTCTGCATCTGTAGGAGACAGAGTCACCATCA CTTGCCAGGCGAGTCAGGACAGTTTCAACTAT TTAAATTGGTATCAGCAGAAACCAGGGAAAG CCCCTAAGCTCCTGATCTACGATGCCTCCAATT TGGAAACAGGGGTCCCATCAAGGTTCAGTGGA AGTGGATCTGGGACAGATTTTACTTTCACCAT CAGCAGCCTGCAGCCTGAAGATATTGCGACAT ATTTCTGTCAACAGTATGATAATCTCCCGATC ACCTTCGGCCAAGGGACACGACTGGATATTAG A<br><br>SEQ ID NO: 24713 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATATGGTGGAAGT AATAAATACTATGCAGACTCCGTGAAGGGCCGA TTCACCATCTCCAGAGACAACAGCCAAGAACACGC TGTATCTGCAAATGAACAGCCTGAGAGCTGAGG ACACGGCTGTGTATTACTGTGTGAGAGGGGGTA TAGCAGTGGAGGCTACGGTATGGACGTCTGGGG CCAAGGGACCACGGTCACCGTCTCCTCA<br><br>SEQ ID NO: 28719 |

FIGURE 50
(Continued)

| | | | | |
|---|---|---|---|---|
| iPS:393140 | 21-225_35H12 | AA | DIQMTQSPSSLSASVGDRVTITCQASQDIFNYLNWYQQKPGKAPNLLIYDASNLETGVPSRFSGSGSGTDFTFTISSLQPEDIATYFCQQYDNLPITFGQGTRLDIR<br><br>SEQ ID NO: 24714 | QVQLVESGGGVVQPGRSLRLSCAASGFTFSSYGMHWVRQAPGKGLEWVAVISYGGSNKYYADSVKGRFTISRDNSKNTLYLQMNSLRAEDTAVYYCVRRGYSSGGYGMDVWGQGTTVTVSS<br><br>SEQ ID NO: 28720 |
| | | NA | GACATCCAGATGACCCAGTCTCCATCTTCCGTGTCTGCATCTGTAGGAGACAGAGTCACCATCACTTGTCGGGCGAGTCAGGTATTAGCAGATGGTTAGCCTGGTATCAGCAGAAACCAGGGAAAGCCCCTGAACTCCTGATCTATGCTGCATCCGTTTGCAAAGTGGATCCCATCCAGGTTCAGCGGCAGTGGATCTGGGACAGACTTCACTCTCACCATCAGCAGCCTGCAGCCTGAAGATTTTGCAACTTACTATTGTCAACAGGCTAACAGTTTCCCATTCACTTTCGGCCCTGGGACCAAAGTGGATATCAAA<br><br>SEQ ID NO: 24715 | CAGGTGCAGCTGGTGCAGTCTGGGGGCTGAGGTGAAGAAGCCTGGGGGCTCAGTGAAGGTCTCCTGCAAGGCTTCTGGATACACCTTCACCGACTACTATACACTGGGTGCGACAGGCCCCTGGACAAGGGCTTGAGTGGATGGGATGGATCAACCCTAATAGGGGTGGCACAAACTATGCACAGAAGTTTCAGGGCAGGGTCACCATGACCAGGGACACGTCCATCAGCAGCCTACATGGAACTGAGCAGCCTGAGATCTGACGACACGGCCGTGTATTACTGTGCGAGAGATGGAACTGGGTCCTTTGACTACTGGGGCCAGGGAACCCTGGTCACCGTCTCCTCA<br><br>SEQ ID NO: 28721 |
| | | AA | DIQMTQSPSSVSASVGDRVTITCRASQGISRWLAWYQQKPGKAPELLIYAASRLQSGIPSRFSGSGSGTDFTLTISSLQPEDFATYYCQQANSFPFTFGPGTKVDIK<br><br>SEQ ID NO: 24716 | QVQLVQSGAEVKKPGASVKVSCKASGYTFTFDYYIHWVRQAPGQGLEWMGWINPNRGGTNYAQKFQGRVTMTRDTSISTAYMELSRLRSDDTAVYYCARDGTGSFDYWGQGTLVTVSS<br><br>SEQ ID NO: 28722 |

FIGURE 50
(Continued)

| | | | | |
|---|---|---|---|---|
| iPS:393142 | 21-225_33A3 | NA | GACATCCAGATGACCCAGTCTCCATCCTCACT GTCTGCATCTGTAGGAGACAGAGTCACCATCA CTTGTCGGGCGAGTCAGGGCATTAACAATTAT TTAGCCTGGTTTCAACAGAAACCAGGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTTTAATAGTTACCCTCCGA CGTTCGGCCAAGGGACCAAGGTGGAAATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTATGGCAT GAACTGGGTCCGCCAGGCTCCAGGGAAGGGGCT GGAGTGGGTCTCATCCATTAGTGGTAGTAGTACT TACATATACTACGCAGAGACTCAGTGAAGGGCGAT TCACCATCTCCAGAGACAACGCCAAGAACTCACT GTATCTGCAAATGAACAGCCTGAGAGCCGAGGA CACGGCTGTGTATTACTGTGCGAGAACAAACGGT ATGGACGTCTGGGGCCAAGGGACCACGGTCACC GTCTCCTCA |
| | | | SEQ ID NO: 24717 | SEQ ID NO: 28723 |
| | | AA | DIQMTQSPSSLSASVGDRVTITCRASQGINNYLA WFQQKPGKAPKSLIYAASSLQSGVPSKFSGSGSG TDFTLTISSLQPEDFATYYCQQFNSYPPTFGQGT KVEIK | EVQLVESGGGLVKPGGSLRLSCAASGFTFSSYGMN WVRQAPGKGLEWVSSISGSSTYIYADSVKGRFTIS RDNAKNSLYLQMNSLRAEDTAVYYCARTNGMDV WGQGTTVTVSS |
| | | | SEQ ID NO: 24718 | SEQ ID NO: 28724 |
| iPS:393144 | 21-225_34D2 | NA | GATATTGTGATGACCCAGACTCCACTCTCT GTCCGGTCACCCCTGGACAGCCGGCCTCCATCT CCTGCAAGTCTAGTCAGAGCCTCCTGCATAGT GATGGAAAGACCTATTTGTATTGGTACCTGCA GAAGCCAGGCCAGCTCCACAGCTCCTGATCT ATGAAGTTTCCAACCGGTTCTCTGGAGTGCCA GATAGGTTCAGTGGCAGCGGGTCAGGGACAG ATTTCACACTAAAAATCAGCGGGTGGAGGCT GAGGATGTTGGGGTTTATTACTGCATGCAAAG TAAACAGCTTCCTCCTTTCGGCGGAGGGACCA AGGTGGAGATCAGA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGACA TTAACTGGGTGCGACAGGCCACTGGACAAGGC TTGAGTGGATGGGATGGATGCACCTAACAGTGG TACCACAGGCTTTGCACAGAAGTTCCGGGCAG AGTCACCATGACCAGAAACACCTCCATAAGCAC AGCCTACTTGGAACTGAGCAGCCTGAGATCTGAG GACACGGCCGTGTATTACTGTGCGAGCAGCAGTG GCTGGTACTTTTTGACTACTGGGGCCAGGGAAC CCTGGTCACCGTCTCCTCA |
| | | | SEQ ID NO: 24719 | SEQ ID NO: 28725 |

FIGURE 50
(Continued)

| | | | |
|---|---|---|---|
| iPS:393146 | 21-225_34G8 | AA | DIVMTQTPLSLSVTPGQPASISCKSSQSLLHSDGK TYLYWYLQKPGQPPQLLIYEVSNRFSGVPDRFSG SGSGTDFTLKISRVEAEDVGVYYCMQSKQLPPF GGGTKVEIR | QVQLVQSGAEVKKPGASVKVSCKASGYTFTNYDIN WVRQATGQGLEWVGWLHPNSGTTGFAQKFRGRV TMTRNTSISTAYLELSLRSEDTAVYYCASSSGWYF FDYWGQGTLVTVSS |
| | | | SEQ ID NO: 24720 | SEQ ID NO: 28726 |
| | | NA | GACATCCAGATGACCCAGTCTCCATCCTCCT GTCTGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATACTATTACCCTCCT ACTTTCGGCGGAGGGACCAAGGTGGAGATCA AA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATTAACAGCCTGAGAGCCGAGG ACACGGCCGTATATTACTGTGTGAAAGGGAGCT ACTAGAGGACTACTTCTACGTATGGACGTC TGGGGCCAAGGGACCACGGTCACCGTCTCCTCA |
| | | | SEQ ID NO: 24721 | SEQ ID NO: 28727 |
| | | AA | DIQMTQSPSSLSASVGDRVTITCRASQDIRSDLG WYQQKPGKAPKRLIYAASSLQSGVPSRFSGSGS GTEFTLTISSLQPEDFATYYCLQHTIYPPTFGGGT KVEIK | EVQLLESGGGLVQPGGSLRLSCAASGFTFSSYAMS WVRQAPGKGLEWVSAISGRGGSTHADSVKGRFTI SRDNSKNTLYLQINSLRAEDTAVYYCVKGELLEDY YFYGMDVWGQGTTVTVSS |
| | | | SEQ ID NO: 24722 | SEQ ID NO: 28728 |

FIGURE 50
(Continued)

| | | | | |
|---|---|---|---|---|
| iPS:393148 | 21-225_35E5 | NA | GACATCCAGATGATCCAGTCTCCATCCTCCT GTCTGCATCTGTAGGAGACAGAGTCACCATCA CTTACCGGGCAAGTCAGAGCATTAGCAGCTAT TTAAATGGTATCAGCAGAAACCAGCGAAAGC CCCTAAGCTCCACATCTATGGTGCATCCAGTTT CCAAAGTTGGGTCCCATCAAGGTTCAGTGGCA GTGGATCTTGACAGATTTCACGCTCACCATC ATCAGTATGCAACCTGGAGATTATGCAACTTA CTACTGTCACCAGAGTTACAATCTCCGATCA CCTTCGGCCAAGGGACCCGACTGGAGATTAAA<br>SEQ ID NO: 24723 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGAAAGA AGTCTAACGACTACTGGGGCCAGGGAACCCTGG TCACCGTCTCCTCA<br>SEQ ID NO: 28729 |
| | | AA | DIQMIQSPSSLSASVGDRVTITYRASQSISSYLNW YQQKPAKAPKLHIYGASSFQSWVPSRFSGSGST DFTLTIISMQPGDYATYYCHQSYNLPITFGQGTR LEIK<br>SEQ ID NO: 24724 | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARKKSN DYWGQGTLVTVSS<br>SEQ ID NO: 28730 |
| iPS:393150 | 21-225_36A5 | NA | GACATCCAGATGACCCAGTCTCCATCCTCCCT GTCTGCATCTGTAGGAGACAGAGTCACCATCA CTTGCCGGACAAGTCAGGACATTAGAAATGAT TTAGGCTGGTATCAGCAGAAACCAGGGAAAG CCCCTAAGCTCCTGATCTTTGCTGCATCCAGTT TGCAAAGTGGGGTCCCATCAAGATTCAGCGGC AGTGGATCTGGGACAGAATTCACTCTCACAAT CAGCAGCCTGCAGCCTGAAGATTTTGCAACTT ATTACTGTCTACACCACAATAGTTACCCTCCTA AGTTTGGCCGGAGGGATCAAGGTGGAGATCAC A<br>SEQ ID NO: 24725 | GAGGTGCAGCTGTTGGAGTCTGGGGGAGGCTTG GTACAGCCTGGGGGGTCCCTGAGACTCTCCTGTG CAGCCTCTGGATTCACCTTTAACAACTATGCCAT GAACTGGGTCCGCCAGGCTCCAGGGAAGGGGCT GGAGTGGGTCTCAGTATTAGTCGTGGTGGT AACACATTCTACGCAGACTCCGTGAAGGGCCGGT TCACCATCTCCAGAGACAATTCCAAGAACACGCT GTATCTCCAAATGAACAGCCTGAGAGCCGAGGA CACGGCCGTATATTACTGTGCGAAAGGGAGCT ACTAGAGGACTACTACTACTACGCTATGACGTC TGGGGCCAAGGGACCACGGTCACCGTCTCCTCA<br>SEQ ID NO: 28731 |

FIGURE 50
(Continued)

| | | | |
|---|---|---|---|
| iPS:393152 | 21-225_25B3 | AA | DIQMTQSPSSLSASVGDRVTITCRTSQDIRNDLGWYQQKPGKAPKRLIFAASSLQSGVPSRFSGSGSGTEFTLTISSLQPEDFATYYCLHHNSYPPKFGGGIKVEIT | EVQLLESGGGLVQPGGSLRLSCAASGFTFNNYAMNWVRQAPGKGLEWVSAISRRGGNTFYADSVKGRFTISRDNSKNTLYLQMNSLRAEDTAVYYCAKGELLEDYYYAMDVWGQGTTVTVSS |
| | | | SEQ ID NO: 24726 | SEQ ID NO: 28732 |
| | | NA | GACATCCAGATGACCCAGTCTCCCTCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCGACTTACTGTTGTCAACAGTCTGACAGTTTCCCTCGGACGTTCGGCCAAGGGACCAAGGTGGAAATCAAA | CAGGTGCAGCTGGTGGAGTCTGGGGGAGGCGTGGTCCAGCCTGGGGAGGTCCCTGAGACTCTCCTGTGCAGCGTCTGATTCACCTTCAGCAGCTATGCATGCACTGGGTCCGCCAGGCTCCAGGCAAGGGGCTGGAGTGGGTGGCAGTTATATGCAGACTCCGTGAAGGGCCGATTCACCATCTCCAGAGACAACGCTCCAAGAACACGCTATATCTACAAATGAACAGCTGAGAGCCGAGGACACGGCTGTGTATTACTGTGCGAGAGATTCCTCCCCCTACGGTATGGACGTCTGGGGCCAAGGGACCACGGTCACCGTCTCCTCA |
| | | | SEQ ID NO: 24727 | SEQ ID NO: 28733 |
| | | AA | DIQMTQSPSSVSASVGDRVTITCRASQGISSWLAWYQQKPGKAPKLLIYGASSLQSGVPSRFSASGSGTDFTLTISSLQPEDFATYCCQQSDSFPRTFGQGTKVEIK | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSSPYGMDVWGQGTTVTVSS |
| | | | SEQ ID NO: 24728 | SEQ ID NO: 28734 |

FIGURE 50
(Continued)

| | | | | |
|---|---|---|---|---|
| iPS:393166 | 21-225_27G6 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGCTGGTATCAGCAGAAGCCAGGCCAGTCCCCTGTGTTGGTCATCTATCAAGATAGGAAGCGGCCCTCAGGGATCCCTGAGGCGATTCTCTGGCTCCAACTCTGGGAACACAGCCACTCTGACCATCAGCGGGACCCAGACTATGGATGAGGCTGACTATTACTGTCAGGCGTGGGACAGCAGCAGCTCTTATGTGGTATTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGGCTATGGCATGCACTGGGTCCGCCAGGCTCCAGGCAAGGGCTGGAGTGGGTGGCAATTATATGGTATGATGGAAGTAAAAATACAATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGGGTATATTGTAGTAGTACCAGCTGCTCCCCTTACTACTACTACGGTATGGACGTCTGGGGCCAAGGGACCACGGTCACCGTCTCCTCA |
| | | | SEQ ID NO: 24729 | SEQ ID NO: 28735 |
| | | AA | SYELTQPPSVSVSPGQTASITCSGDKLGDKYACWYQQKPGQSPVLVIYQDRKRPSGIPERFSGSNSGNTATLTISGTQTMDEADYYCQAWDSSSYVFGGGTKLTVL | QVQLVESGGGVVQPGRSLRLSCAASGFTFSGYGMHWVRQAPGKGLEWVAIIWYDGSKKYNADSVKGRFTISRDNSKNTLYLQMNSLRAEDTAVYYCARDRVYCSSTSCSPYYYYYGMDVWGQGTTVTVSS |
| | | | SEQ ID NO: 24730 | SEQ ID NO: 28736 |

FIGURE 50
(Continued)

| | | | |
|---|---|---|---|
| iPS:393168 | 21-225_32B11 | NA | TCCTATGAACTGACTCAGCCACCCTCAGTGTC CGTGTCCCCAGGACAGACAGCCAGCATCACCT GCTCTGGAGATAAATTGGGGGATAAATATGCT TACTGGTATCAGCAGAAGCCAGGCCAGTCCCC TGTGTTGGTCATCTATCAAGATAGTAAGCGGT CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGTA TTCGGCGGAGGGACCAAGCTGACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGA TGGCACTAACTATGCACAGAAGTTTCAGGGCAG GGTCACCATGACCAGGGACACGTCCATCAGCAC AGCCTACATGGAGCTGAACAGGCTGAGATCTGA CGACACGGCCGTGTATTACTGTGCGAGGGGTTT TACTATGTTCGGGGAGTTATTATAACGACCTCG ACCCCTGGGGCCAGGGAACCCTGGTCACCGTCTC CTCA |
| | | | SEQ ID NO: 24731 | SEQ ID NO: 28737 |
| | | AA | SYELTQPPSVSVSPGQTASITCSGDKLGDKYAY WYQQKPGQSPVLVIYQDSKRSSGIPERFSGSNSG NTATLTISGTQAMDEADYYCQAWDNSTVVFGG GTKLTVL | QVQLVQSGAEVKPGASVKVSCKASGYTFTGYYM HWVRQAPGQGLEWMGWINPNSDGTNYAQKFQGR VTMTRDTSISTAYMELNRLRSDDTAVYYCARGFYY GSGSYYNDLDPWGQGTLVTVSS |
| | | | SEQ ID NO: 24732 | SEQ ID NO: 28738 |
| iPS:393172 | 21-225_3B12 | NA | TCCTATGAGCTGACTCAGCCACCCTCAGTGTC CGTGTCCCCAGGACAGACAGCCAGCATCACCT GCTCTGGAGATAAATTGGGGGAAAATATGCT TGCTGGTATCAGCAGAAGCCAGGCCAGTCCCC TGTGCTGGTGGTCATCTATCAAGATAGGAAGCGGC CCCTCAGGGATCCCTGAGCGATTCTCTGGCTCC AACTCTGGGAACAAAGCCACTCTGACCATCAG CGGGACCCAGGCTATGGATGAGGCTGACTATT ACTGTCAGGCGTGGGTCAACAACACTGTGATA TTCGGCGGAGGGACCAAGCTGACCGTCCTA | CAGGTGCACCTGGTGGAGTCTGGGGGAGGCGTG GTCCAGCCTGGGAGGTCCCTGAGACTCTCCTGTG CAGCCTCTGGATTCACCTTCAGTACTACTGGCAT GCACTGGGTCCGCCAGGCTCCAGGCAAGGGGCT GGAGTGGGTGGCAGTTATATCAGACTCCGTGAAGT AATAAATACTATGCAGACTCCGTGAAGGGCCGA TTCACCATCTCCAGAGACAATTCCAAGAACACGC TGCATCTGCAAATGAACAGCCTGAGAGCTGAGG ACACGGCTGTGTATTACTGTGCGAGAGATCGGAG GGGGGCTATGGAGTCCCCGATGCTTTTGATATC TGGGGCCAAGGGACAATGGTCACCGTCTCTTCA |
| | | | SEQ ID NO: 24733 | SEQ ID NO: 28739 |

FIGURE 50
(Continued)

| | | | |
|---|---|---|---|
| iPS:393174 | 21-225_15D8 | AA | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL<br>SEQ ID NO: 24734 | QVHLVESGGGVVQPGRSLRLSCAASGFTFSYYGM HWVRQAPGKGLEWVAVISYDGSNKYYADSVKGR FTISRDNSKNTLHLQMNSLRAEDTAVYYCARDRRG GYGVPDAFDIWGQGTMVTVSS<br>SEQ ID NO: 28740 |
| | | NA | CTGCCTGTGCTGACTCAGCCCCCGTCTGCATCT GCCTTGCTGGGAGCCTCGATCAAGTCACCTG CACCTGTAAGCAGTGAGCAGCAGACCAGGAGGTC TCGAATGGTATCAACAGAGACCAGGAGGTC CCCCAGTATATCAAGGTTAAGAGTGATG GCAGCCACAGCAAGGGGACGGGATCCCGA TCGCTTCATGGGCTCCAGTTCTGGGGCTGACC GCTACATCACCTTCTCAACCTCCAGTCTGAC GATGAGGAGGAGTATCACTGTGAGAGCC ACACGATGATGGCCAAGTCGGTGTGGTATTC GGGCGGAGGGACCAAGCTGACCGTCCTA<br>SEQ ID NO: 24735 | CAGGTGCAGTTGGTGGAGTCTGGGGGAGGCGTG GTCCAGACTGGGGAGGTCCCTGAGACTCTCCTGTG CAGCCTCTGGATTCACCTTCAGTGCTATGGCAT GCACTGGGTCCGCCAGGCTCCAGGCAAGGGGCT GGAGTGGGTGTCAGTTATATCATATGATGGAAGT AATAAATACTATGCAGACTCCGTGAAGGGCCGA TTCACCATCTCCAGAGACACAATTCCAAGAACACGC TGTATCTGCAAATGAACAGCTGAGAGCTGAGG ACACGGCTGTGTATTACTGTGCGAGAGATCGGGT CTATTGTAGTAGTACCAGCTGCCTCCCTTACTAC GACTACGGTATGGACGTCTGGGGCCAAGGG ACCACGGTCACCGTCTCCTCA<br>SEQ ID NO: 28741 |
| | | AA | LPVLTQPPSASALLGASIKLTCTLSSEHSTYTIEW YQQRPGRSPQYIMKVKSDGSHSKGDGIPDRFMG SSSGADRYTFSNLQSDDEEEYHCGESHTIDGQV GVVFGGGTKLTVL<br>SEQ ID NO: 24736 | QVQLVESGGGVVQTGRSLRLSCAASGFTFSGYGM HWVRQAPGKGLEWVSVISYDGSNKYYADSVKGRF TISRDNSKNTLYLQMNSLRAEDTAVYYCARDRVY CSSTSCVPYYDYYGMDVWGQGTTVTVSS<br>SEQ ID NO: 28742 |

FIGURE 50
(Continued)

| | | | | |
|---|---|---|---|---|
| iPS:393176 | 21-225_27E7 | NA | TCCTATGAGCTGACTCAGCCACCCTCAGTGTC CGTGTCCCCAGGACAGAGACAGCCAGCATCACCT GCTCTGGAGATAAATTGGGGAATAAATATGCT TGCTGGTATCAGCAGAAGCCAGGCCAGTCCCC TGTGGAGGTCATCTATCAAGATAGCAAGCGGC CCTTAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGTAGTACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTGCGAGAGAGGATTC CTATTGTAGTAGTACCAGCTGCCCTTACTACTAC TACTACGGTATGGACGTCTGGGGCCAAGGGACC ACGGTCACCGTCTCCTCA |
| | | | SEQ ID NO: 24737 | SEQ ID NO: 28743 |
| | | AA | SYELTQPPSVSVSPGQTASITCSGDKLGNKYACW YQQKPGQSPVEVIYQDSKRPLGIPERFSGSNSGN TATLTISGTQAMDEADYYCQAWDSSTVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCAREDSYC SSTSCPYYYYGMDVWGQGTTVTVSS |
| | | | SEQ ID NO: 24738 | SEQ ID NO: 28744 |

FIGURE 50
(Continued)

| | | | |
|---|---|---|---|
| iPS:393178 | 21-225_34D7 | NA | TCCTATGAGCTGACTCAGCCACCCTCAGTGTC CGTGTCCCAGGAGACAGCAGCCAGCATCACCT GCTCTGGAGATAAATTGGGGGAGAAATATGCT TACTGGTATCAGCAGAAGCCAGGCCAGTCCCC TGTGCTGGTCCTCTATCAAGATAGCAAGCGGC CCTCAGGGATCCCTGAGCGATTCTCTGGCTCC AACTCTGGGAACACAGCCACTCTGACCATCAG CGGGACCCAGACTATGGATGAGGCTGACTTTT ACTGTCAGGCGTGGGACAACACCACTGTGGTA TTCGGCGGAGGGACCAAGCTGACCGTCCTA<br>SEQ ID NO: 24739 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAACTATGCACAGGAGACACGTCATCAGCAC GGTCACCATGACCAGGGACACGTCCATCAGCAC AGCCTACATGGAGCTGAGCAGGCTGAGATCTGA CGACACGGCCGTGTATTACTGTGCGAGGGGTAT TACTATGTTCGGGGAGTTATTATAACGACCTG ACCCCTGGGGTCAGGGAACCCTGGTCACCGTCTC CTCA<br>SEQ ID NO: 28745 |
| | | AA | SYELTQPPSVSVSPGQTASITCSGDKLGEKYAYW YQQKPGQSPVLVLYQDSKRPSGIPERFSGSNSGN TATLTISGTQTMDEADFYCQAWDNTTVVFGGG TKLTVL<br>SEQ ID NO: 24740 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARGYYY GSGSYYNDLDPWGQGTLVTVSS<br>SEQ ID NO: 28746 |
| iPS:393180 | 21-225_4G12 | NA | CAGTCTGTGCTGACTCAGCCACCCTCAGCGTC TGGGACCCCCGGGCAGAGGGTCAACATGTCTT GTTCTGGAACCAACTCCAACATCGGAAGTTAT ACTGTAAACTGGTACCAGCAGCTCCCAGGAAC GGCCCCCAAACTCCTCATCTATATTAATAATC AGCGGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTGCAGCATGGGATGACAGCCTA AATGGTCATGTGGTATTCGGCGGAGGGACCAA GCTGACCGTCCTA<br>SEQ ID NO: 24741 | GAGGTGCAGCTGTTGGAGTCTGGGGGAGGCTTG GTACAGCCCGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAACTCTTAGTGGTGTCGTGGGT AGCACATACTACGCAGACTCCGTGAAGGGCCG TCCACCATCCAGAGACAATTCCAAGAACACGC TGTATCTGCAAATGAGCAGCCTGAGAGCCGAGG ACACGGCCGTATATTACTGTGCGAAATGGGAC GTGGATACAGCTATGAGTACTACGGTATGA CGTCTGGGGCCAAGGGACCACGGTCACCGTCTCC TCA<br>SEQ ID NO: 28747 |

FIGURE 50
(Continued)

| | | | |
|---|---|---|---|
| iPS:393182 | | AA | QSVLTQPPSASGTPGQRVNMSCSGTNSNIGSYTV NWYQQLPGTAPKLLIYINNQRPSGVPDRFSGSKS GTSASLAISGLQSEDEADYYCAAWDDSLNGHVV FGGRTKLTVL | EVQLLESGGGLVQPGGSLRLSCAASGFTFSSYAMS WVRQAPGKGLEWVSTLSGRGGSTYADSVKGRST ISRDNSKNTLYLQMSSLRAEDTAVYYCAKWGRGY SYEYYYGMDVWGQGTTVTVSS |
| | | | SEQ ID NO: 24742 | SEQ ID NO: 28748 |
| | | NA | TCCTATGAGCTGACTCAGCCACCCTCAGTGTC CGTGTCCCCAAGACAGTCAGCATCACCT GCTCTGAGATAAATTGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTCC AACTCTGGGAACACAGGCTATGATGAGGCTGACTATT ACTGTCAGGGCGTGGGACAACAACACTGTGATA TTCGGCGGAGGGACCAAGCTGACCGTCCTA | CAGGTGCAACTGGTGCAGTCTGGGGCTGAGGTG AAGAAGCCTGGGGCCTCAGTGAAGGTCTCCTGC AAGGCTTCTGATACACCTTCACCGGCTACTATA TGCACTGGGTGCGACAGGCCCCTGGACAAGGGC TTGAGTGGATGGGATGGATCAACCTAACAGTGG TGGCACAAACTCTGCACAGAAGTTTCAGGCAG GGTCACCATGACCAGGGACACGTCCATCAGCAC AGCCTACATGGAGCTGAGCAGGCTGAGATCTGA CGACACGGCCGTATATTACTGTGCGAGGTCCTAT TACTATGGTTCGGGAGTTATTATAACGAGTTTG ACTACTGGGGCCAGGGAACCCTGGTCACCGTCTC CTCA |
| | | | SEQ ID NO: 24743 | SEQ ID NO: 28749 |
| | 21-225_4B3 | AA | SYELTQPPSVSVSPRQTVSITCSGDKLGDKYACW YQQKPGQSPVLVIYQDRKRPSGIPERFSGSNSGN TATLTISGTQAMDEADYYCQAWDNNTVIFGGG TKLTVL | QVQLVQSGAEVKKPGASVKVSCKASGYTFTGYYM HWVRQAPGQGLEWMGWINPNSGGTNSAQKFQGR VTMTRDTSISTAYMELSRLRSDDTAVYYCARSYYY GSGSYYNEFDYWGQGTLVTVSS |
| | | | SEQ ID NO: 24744 | SEQ ID NO: 28750 |

FIGURE 50
(Continued)

| | | | |
|---|---|---|---|
| iPS:393184 | 21-225_15H11 | NA | TCCTATGAGCTGACTCAGCCACCTCAGTGTC CGTGTCCCCAGGACAGACAGCCAGCATCACCT GCTCTGGAGATAAATTGGGGGAGAAATATGCT TGCTGGTATCAGCAGAAGCCAGGCCAGTCCCC TGTGGTGGTCATCTATCAAGATAGGAAGCGGC CCCTCAGGGATCCCTGAGCGATTCTCTGGCTCC AACTCTGGGAACACAGCCACTCTGACCATCAG CGGGACCCAGGCTATAGATGAGGCTGACTATT ACTGTCAGGCGTGGGACAGCAGCACTGCGGTA TTCGGCGGAGGGACCAAGTTGACCGTCCTA | CAGATCACCTTGAAGGAGTCTGGTCTTACGCTGA TGAAACCACACAGACCCTCACTCACTCAGCTGACCTGCAC CTTCTCTGGGTTCTCACTCAGCACTGGTGGAGTG GGTGTGGGCTGGATCCGTCAGCCCCCAGGAAAG GCCCTGGAGTGGCTTGCACTCATTTATTGGCATG ATGATAAGCGCTACAGTCCATCTCTGAGGAGCAG GCTCACCATCACCAAGGACACCTCCAAAACCA GGTGGTCCTTACAATGACCAACATGACCCTGTG GACACAGCCACATATTACTGTGCACGTATAGTAG CAGTTGCCTTTGACTACTGGGGCCAGGGAACCCT GATCACCGTCTCCTCA |
| | | AA | SYELTQPPSVSVSPGQTASITCSGDKLGEKYACW YQQKPGQSPVVVIYQDRKRPSGIPERFSGSNSGN TATLTISGTQAIDEADYYCQAWDSSTAVFGGGT KLTVL | QITLKESGLTLMKPTQTLTLTCTFSGFSLSTGGVGV GWIRQPPGKALEWLALIYWHDDKRYSPSLRSRLTI TKDTSKNQVVLTMTNMDPVDTATYYCARIVAVAF DYWGQGTLITVSS |
| | | | SEQ ID NO: 24745 | SEQ ID NO: 28751 |
| | | | SEQ ID NO: 24746 | SEQ ID NO: 28752 |
| iPS:393186 | 21-225_27D9 | NA | TCCTATGAGCTGACTCAGCCACCTCAATGTC CGTGTCCCCAGGACAGACAGCCAGCATCACCT GCTCTGGATATAAATTGGGGGATAAATATGCT TGCTGGTTTCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGATGAGGCTGACTATT ACTGTCAGGCGTGGGTCAACAACACTGTATTC GGCGGAGGGACCAAGCTGACCGTCCTA | CAGGTGCAGTTGGTGCAGTCTGGGGCTGAGGTGA AGAAGCCTGGGGCCTCAGTGAAGGTCTCCTGCA AGGCTTCTGGATACACCTTCACCGGCTACTATAT GCACTGGGTGCGACAGGCCCCTGGACAAGGGCT TGAGTGGATGGGATGGATCAACCCTAACAGTGGT GGCACAAAGTATGCACAGAAGTTTCAGGGCAGG GTCACCATGACCAGGGACACGTCCATCAGCACA GCCTACATGGAGCTGAACAGGCTGAGATCGAC GACACGCCGTGTATTACTGTGCGAGAGAGAGG TGTAGTACTACCAGTTGCTATTAGGAATTACGG GCTACTACGGTATGGACGTCTGGGGCCAAGGGA CCACGGTCACCGTCCCTCA |

FIGURE 50
(Continued)

| | | | SEQ ID NO: 24747 | SYELTQPPSMSVSPGQTASITCSGYKLGDKYAC WFQQKPGQSPVLVIYQDSKRPSGIPERFSGSNSG NTATLTISGTQAMDEADYYCQAWVNNTVFGGG TKLTVL | SEQ ID NO: 28753 | QVQLVQSGAEVKKPGASVKVSCKASGYTFTGYYM HWVRQAPGQGLEWMGWINPNSGGTKYAQKFQGR VTMTRDTSISTAYMELNRLRSDDTAVYYCARERCS TTSCYLGHTGYYGMDVWGQGTTVTVSS |
|---|---|---|---|---|---|---|
| | | AA | SEQ ID NO: 24748 | TCCTATGAGCTGACTCAGCCACCCTCAGTGTC CGTGTCCCCAGGACAGACAGCCAGCATCACCT GCTCTGGAGATAAATTGGGGGAGAAATATGTT TCCTGGTATCAGGAGAAGCCAGGCCAGTCCCC TGTGCTGGTCATCTATCAAGATAGTAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAGCTGACCGTCCTA | SEQ ID NO: 28754 | CAGATCACCTTGAGGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGCGCTACAGCCCATCTCTGAAGAGCA GACTCACCATCACCAAGGACACCACCTCCAAAACC AGTTGGTCCTTACAATGACAACATGACCCTGT GGACACAGCCACATATTACTGTGCACACTTAATA GCAGTGACTTTTGACTCCTGGGGCCAGGGATCCC TGGTCACCGTCTCCTCA |
| iPS:393188 | 21-225_34B9 | | SEQ ID NO: 24749 | SYELTQAPSVSVSPGQTASITCSGDKLGEKYVSW YQEKPGQSPVLVIYQDSKRPSGIPERFSGSNSGNT ATLTISGTQAMDEADYYCQAWDSSTVFGGGTK LTVL | SEQ ID NO: 28755 | QITLRESGPTLVKPTQTLTLTCTFSGFSLSTSGVVG WIRQPPGKALEWLALIYWNDDKRYSPSLKSRLTIT KDTSKNQVVLTMTNMDPVDTATYYCAHLJAVTFD SWGQGSLVTVSS |
| | | AA | SEQ ID NO: 24750 | | SEQ ID NO: 28756 | |

FIGURE 50
(Continued)

| | | | |
|---|---|---|---|
| iPS:393192 | 21-225_12B1 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGCTGGTATCAGCAGAAGCCAGGCCAGTCCCCTGTGCTGGTCATCTATCAAGATCGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAACAACACTGTGACCGTCCTATTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTCAGCGTCTGATTCACCTTCAGTAGCTATGGCATGCACTGGGTCCGCCAGGCTCCAGGCAAGGGCTGGAGTGGGTGGCAGTTATATGCGAATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGGTAGCAGCAGTGGTACCCCTACTACTACTACGGTATGGACGTCTGGGGCCAAGGGACCACGGTCACCGTCTCCTCA |
| | | | SEQ ID NO: 24751 | SEQ ID NO: 28757 |
| | | AA | SYELTQPPSVSVSPRQTVSITCSGDKLGDKYACWYQQKPGQSPVLVIYQDRKRPSGIPERFSGSNSGNTATLTISGTQAMDEADYYCQAWDNNTVIFGGGTKLTVL | QVQLVESGGGVVQPGRSLRLSCAASGFTFSSYGMHWVRQAPGKGLEWVAVIWNDGSNKYYADSVKGRFTISRDNSKNTLYLQMNSLRAEDTAVYYCARDRVAAGTPYYYYGMDVWGQGTTVTVSS |
| | | | SEQ ID NO: 24752 | SEQ ID NO: 28758 |
| iPS:393194 | 21-225_16D2 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGCTGGTATCAGCAGAAGCCAGGCCAGTCCCCTGTGCTGGTCGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGCACTTATGTGTATTCGGCGGAGGGACCAAGCTGACCGTCCTA | GAGGTGCAGCTGGTGGAGTCTGGGGGAGGCTTGGTAAAGCCTGGGGGGTCCCTTAGAGACTCTCCTGTGCAGCCTCTGGATTCACTTTCAGTAACGCTGGATGAACTGGGTCCGCCAGGCTCCAGGGAAGGGCTGGAGTGGGTTGGCCGTATTAAAAGCAAACTGAGTGGTGGGACAACAGACTACGCTGCACCGTGAAGGCAGATTCACCATCTCAAGAGATGATTCAAAAAACACGTGTCTGCAAATGCACAGCCTGAAAACCGGAGGACACAGCCGTGTATTACTGTCGCTTACTGATACGGGTCCTATAGCAGCTGTCTCGCTTACTACTACTACGGCTATGGACGTCTGGGGCCAAGGGACCACGGTCACGTCCTCA |

FIGURE 50
(Continued)

| | | | | |
|---|---|---|---|---|
| | | SEQ ID NO: 24753 | SYELTQPPSVSVSPGQTASITCSGDKLGDKYACW YQQKPGQSPVLVIYQDSKRPSGIPERFSGSNSGN TATLTISGTQAMDEADYYCQAWDSSTYVFGG GTKLTVL | SEQ ID NO: 28759 | EVQLVESGGGLVKPGGSLRLSCAASGFTFSNAWM NWVRQAPGKGLEWVGRIKSKTDGGTTDYAAPVK GRFTISRDIDSKNTLYLQMHSLKTEDTAVYYCTTDT GPIAARLAYYYYAMDVWGQGTTVTSS |
| iPS:393196 | 21-225_16G8 | AA | | | |
| | | SEQ ID NO: 24754 | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGGAAGCGGC CCCTCAGGGATCCCTGAGCGATTCTCTGGCTCC AACTCTGGGAACAAAGCCACTCTGACCATCAG CGGGACCCAGGCTATGGATGAGGCTGACTATT ACTGTCAGGCGTGGGTCAATAACACTATGATA TTCGGCGGAGGGACCAAGCTGACCGTCCTA | SEQ ID NO: 28760 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGGTATTAGTGGTAGTGGTGGT AGCACATACTACGCAGACTCCGTGAAGGGCCGG TTCACCATCTCCAGAGACAACAGCCTGAAGAACACGC TGTGTCTGCACATGAACAGCCTGAGAGCCGAGG ACACGGCCGTATATTACTGTGCAAAGAATATTG TGGTGGTGACTGCTATTCCCCTTACTACTACTACT ACGGTATGGACGTCTGGGGCCAAGGGACCACGG TCACCGTCTCCTCA |
| | | SEQ ID NO: 24755 | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL | SEQ ID NO: 28761 | EVQLLESGGGLVQPEGSLRLSCAASGFTFSSYAMS WVRQAPGKGLEWVSGISGSGGSTYYADSVKGRFTI SRDNSKNTLCLHMNSLRAEDTAVYYCAKEYCGGD CYSPYYYYGMDVWGQGTTVTSS |
| | | SEQ ID NO: 24756 | | SEQ ID NO: 28762 | |

FIGURE 50
(Continued)

| | | | |
|---|---|---|---|
| iPS:393198 | 21-225_28A11 | NA | TCCTATGAGTTGACTCAGCCACCCTCAGTGTCCGTGTCCCCAGGACAGAGCAGCCAGCATCACCTGCTCTGGAGATAAATTGGGGGATAAATATGCTTGCTGGTATCAGCAGAAGCCAGGCCAGTCCCCTGTGCTGGTCATCTATCAAGATAGCAAGGGCCCTCAGGGATCCCTGAGCGATTCTCTGGCTCCAACTCTGGGAACACAGCCACTCTGACCATCAGCGGACCCAGGCTATGGATGAGGCTGACTATTACTGTCAGGCGTGGGACAGTAGCACTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGGCTATGCCTGCACTGGGTCCGCCAGGCTCCAGGCAAGGGCTGGAGTGGGTGGCACTTATATGGTATGATGGAAATAATACATACTATGCAGACTCCGTGAAGGGCCGATTCACCATCTCCAGAGACAATTCCAAGAACACGCTGTATCTGCAAATGAACAGCCTGAGAGCCGAAGACACGGCTGTGTATTACTGTGCGAGAGATAGGGTATATTGTAGTAGTACCAGCTGCTCCCCTTACTACTACTACTACGGTATGGACGTCTGGGGCCAAGGGACCACGGTCACCGTCTCCTCA |
| | | | SEQ ID NO: 24757 | SEQ ID NO: 28763 |
| | | AA | SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGGGTKLTVL | QVQLVESGGGVVQPGRSLRLSCAASGFTFSGYGLHWVRQAPGKGLEWVALIWYDGNNTYADSVKGRFTISRDNSKNTLYLQMNSLRAEDTAVYYCARDRVYCSSTSCSPYYYYYGMDVWGQGTTVTVSS |
| | | | SEQ ID NO: 24758 | SEQ ID NO: 28764 |

FIGURE 50
(Continued)

| | | | | |
|---|---|---|---|---|
| iPS:393200 | 21-225_35E1 | NA | TCCTATGAGCTGACTCAGCCACCCTCAGTGTCCGTGTCCCCAGGACAGAGACAGCCAGCATCACCTGCTCTGGAGATAAATTGGGGGAAAAATATGCTTACTGGTTTCAGCAGAAGCCAGGCCAGTCCCCTGTGATAGTCATCTATCAAGATAGGAAGCGGCCCTCAGGGATCCCTGAGCGATTCTCTGGCTCCAACTCTGGGAACACAGCCACTCTGACCATCAGCGGGACGCAGGCTATGGATGAGGCTGACTATTACTGTCAGGCGTGGGACAACAGCACTGCGGTATTCGGCGGAGGGACCAAGCTGACCGTCCTA<br><br>SEQ ID NO: 24759 | CAGGTGAAGCTGGTGCAGTCTGGGGCTGAGGTGAAGAAGCCTGGGGCCTCAGTGAAGGTCTCCTGCAAGGCTTCAGGATACACCTTCACCGGCTACTATATGCACTGGGTGCGACAGGCCCCTGGACAAGGGCTTGAGTGGATGGATGGATCAACCCTAAAAGTGGTGGCACAAATTATGCACAGGACACGTCCATCAGCAGGGTCACCATGACCAGGGACACGTCCATCAGCACGCACGCCGTGTATTACTGTGCGAGAGTGTATTACCATGGTTCGGGGAGTTATTATAACGAGTTTGATTATTGGGGCCAGGGAACCCTGGTCACCGTCTCCCTCA<br><br>SEQ ID NO: 28765 |
| | | AA | SYELTQPPSVSVSPGQTASITCSGDKLGEKYAYWFQQKPGQSPVIVIYQDRKRPSGIPERFSGSNSGNTATLTISGTQAMDEADYYCQAWDNSTAVFGGGTKLTVL<br><br>SEQ ID NO: 24760 | QVKLVQSGAEVKKPGASVKVSCKASGYTFTGYYMHWVRQAPGQGLEWMGWINPKSGGTNYAQKFQGRVTMTRDTSISTVYMEPSRLRSDDTAVYYCARVYYHGSGSYYNEFDYWGQGTLVTVSS<br><br>SEQ ID NO: 28766 |
| iPS:393202 | 21-225_6B4 | NA | TCCTATGAGCTGACTCAGCCACCCTCAGTGTCCGTGTCCCCAAGACAGAGACAGTCAGCATCACCTGCTCTGGAGATAAATTGGGGGATAAATATGCTTGCTGGTATCAGCAGAAGCCAGGCCAGTCCCCTGTGTGCTGGTGGTCATCTATCAAGATCGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAACACAACACTGTGGTATTCGGCGGAGGGACCAAGCTGACCGTCCTA<br><br>SEQ ID NO: 24761 | GAGGTGCAGCTGTTGGAGTCTGGGGGAGGCTTGGTACAGCCTGAGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGCTATTAGTAGTAGTGGTAGTAGCACATACTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAAAGAATATTGTGGTGACTGCTATTCCCCTTACTACTACTACTACGGTATGGACGTCTGGGGCCAAGGGACCACGGTCACCGTCTCCTCA<br><br>SEQ ID NO: 28767 |

FIGURE 50
(Continued)

| | | | |
|---|---|---|---|
| iPS:393204 | 21-225_8C12 | AA | SYELTQPPSVSVSPRQTVSITCSGDKLGDKYACW YQQKPGQSPVLVIYQDRKRPSGIPERFSGSNSGN TATLTISGTQAMDEADYYCQAWDNNTVIFGGG TKLTVL<br>SEQ ID NO: 24762 | EVQLLESGGGLVQPEGSLRLSCAASGFTFSSYAMS WVRQAPGKGLEWVSAISGSGSTYYADSVKGRFTI SRDNSKNTLCLQMNSLRAEDTAVYYCAKEYCGGD CYSPYYYYGMDVWGQGTTVTVSS<br>SEQ ID NO: 28768 |
| | | NA | TCCTATGAGCTGACTCAGCCACACTCAGTGTC AGTGGCCACACAGATGGCCAGGATCACCT GTGGGGGAAACATTGGAAGTAAAGCTGT GCACTGGTACCAGCAAAAGCCAGGACAGGAC CCTGTGCTGGTCATCTATCAGGATAGCAACCG GCCCTCAGGGATCCCTGAGCGATTCTCTGGCT CCAACCCAGGGAACACCGCCACCTAACCATC AGCAGGATGAGGCTGGGGATTGAGGCTGACT ATTACTGTCAGGTGTGGGACAGTAGTAGTGAT CATGTGGTATTCGGCGGAGGGACCAAGCTGAC CGTCCTA<br>SEQ ID NO: 24763 | CAGGTGCAGTTGGTGGAGTCTGGGGGAGGCGTG GTCCAGCCTGGGAGGTCCCTGAGACTCTCCTGTG CAGCGTCTGGATTCACCTTCGGTAGTATGGCAT GCACTGGGTCCGCCAGGCTCCAGGCAAGGGGCT GGAGTGGGTGGCACTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT ATCTTGTAGTAGTTCCAGCTGCTATCCTTACTACT ACTACTACGGTATGACGTCTGGGGCCAAGGGA CCACGGTCACCGTCTCCTCA<br>SEQ ID NO: 28769 |
| | | AA | SYELTQPHSVSVATAQMARITCGNNIGSKAVH WYQQKPGQDPVLVIYSDSNRPSGIPERFSGSNPG NTATLTISRIEAGDEADYYCQVWDSSSDHVFG GGTKLTVL<br>SEQ ID NO: 24764 | QVQLVESGGGVVQPGRSLRLSCAASGFTFGSYGM HWVRQAPGKGLEWVALIWYDGSNKYYADSVKGR FTISRDNSKNTLYLQMNSLRAEDTAVYYCARDRVS CSSSSCYPYYYYGMDVWGQGTTVTVSS<br>SEQ ID NO: 28770 |

FIGURE 50
(Continued)

| | | | | |
|---|---|---|---|---|
| iPS:393206 | 21-225_13F6 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGCTGGTATCAGCAGAAGCCAGGCCAGTCCCCTGTGCTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGGACAACAGCACTGCTGTGGTATTCGGCGGAGGGACCAAGCTGACCGTCCTG | CAGGTGCAGCTGGTGCAGTCTGGGGCTGAGGTGAAGAAGCCTGGGGCCTCAGTGAAGGTCTCTGCAAGGCTTCTGGATACACCTTCACCGGCTACTATATGCACTGGGTGCGACAGGCCCCTGGACAAGGCTTGAGTGGATGGGATGGATCAACCCTAACAGTGGTGGCGCAAACTATGCACAGGAGACACGTCAGGGCAGGGTCACCATGACCAGGGACACGTCCATCAGCACAGCCTACATGGAGCTGAGCAGGCTGAGATCTGAGACACGGCCGTGTATTTCTGTGCGAGGTCGTTTACTATGTTCGGGGACTTATTATAACGAGTTTGACTACTGGGGCCAGGGAACCCTGGTCACCGTCTCCTCA |
| | | | SEQ ID NO: 24765 | SEQ ID NO: 28771 |
| | | AA | SYELTQPPSVSVSPGQTASITCSGDKLGDKYACWYQQKPGQSPVLVIYQDSKRPSGIPERFSGSNSGNTATLTISGTQAMDEADYYCQAWGNSTAVVFGGGTKLTVL | QVQLVQSGAEVKKPGASVKVSCKASGYTFTGYYMHWVRQAPGQGLEWMGWINPNSGGANYAQKFQGRVTMTRDTSISTAYMELSRLRSDDTAVYFCARSFYYGSGTYYNEFDYWGQGTLVTVSS |
| | | | SEQ ID NO: 24766 | SEQ ID NO: 28772 |
| iPS:393208 | 21-225_16F3 | NA | TCCTATGTGCTGACTCAGCCACCCTCGGTGTCAGTGGCCCCAGGACAGACGGCCAGGATTACCTGTGGGGGAAACAACATTGGAAGTAAAAGTGTGCACTGGTACCAGCAGAAGCCAGGCCAGGCCCCTGTGCTGGTCGTCTATGATGATAGCGATACCGACGGCCCTCAGGGATCCCGAGCGATTCTCTGGCTCCAACTCTGGGAACACGGCCACCCTGACCATCAGCAGGGTCGAAGCTGGGGATGAGGCCGACTATTACTGTCAGGTGTGGGATAGTAGCAGTGATCATGTGGTATTCGGCGGAGGGACCAAGCTGACCGTCCTA | CAGGTGCAGCTGGTGCAGTCTGGGGCTGAGGTGAAGAAGCCTGGGGCCTCAGTGAAGGTCTCTGCAAGGCTTCTGGATACACCTTCACCGGGCACTATATGCACTGGGTGCGACAGGCCCCTGGACAAGGACTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGGTCGTATTACTATGGTTCGGGGACTTATTATAACGAGTTTGACTACTGGGGCCAGGGAACCCTGGTCACCGTCTCCTCA |
| | | | SEQ ID NO: 24767 | SEQ ID NO: 28773 |

FIGURE 50
(Continued)

| | | | |
|---|---|---|---|
| iPS:393210 | 21-225_17D3 | AA | SYVLTQPPSVSVAPGQTARITCGGNNIGSKSVHW YQQKPGQAPVLVVYDDTDRPSGIPERFSGSNSG NTATLTISRVEAGDEADYYCQVWDSSSDHVFG GGTKLTVL<br>SEQ ID NO: 24768 |
| | | | QVQLVQSGAEVKKPGASVKVSCKASGYTFTGHYM HWVRQAPGQGLEWMGWINPNSGGTNYAQKFQGR VTMTRDTSISTAYMELSRLRSDDTAVYYCARSYYY GSGTYYNEFDYWGQGTLVTVSS<br>SEQ ID NO: 28774 |
| | | NA | TCCTATGAGCTGACGCAGTCACCCTCAGTGTC CGTGTCCCCAGGACAGACAGCCAGGATCACCT GCTCTGGAGATAAATTGGGGATAAATATGTT TACTGGTATCAGCAGAAGCCAGGCCAGTCCC TGTGGTGGTCATCTATCAAGATAGGAAGCGGC CCTCAGGGATCCCTGAGCGATTCTCTGGCTCC AACTCTGGGAACACAGGCTATGAGGCTGACTATT CGGGACCCAGGCGTGGGACAGCATCACTGCAGTA ACTGTCAGGCGTGAGGGACCAAGCTGACCGTCCGA<br>SEQ ID NO: 24769 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCGGA CGACACGGCCGTGTATTACTGTGCGAGAGCGAAT TACTATGGTTCGGGGAGTTATTATAACGACTTTG ACTACTGGGGCCAGGGAACCCTGGTCACCGTCTC CTCA<br>SEQ ID NO: 28775 |
| | | AA | SYELTQSPSVSVSPGQTASITCSGDKLGDKYVY WYQQKPGQSPVVVIYQDRKRPSGIPERFSGSNSG NTATLTISGTQAMDEADYYCQAWDSITAVFGGG TKLTVR<br>SEQ ID NO: 24770 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARANYY GSGSYYNDFDYWGQGTLVTVSS<br>SEQ ID NO: 28776 |

FIGURE 50
(Continued)

| | | | |
|---|---|---|---|
| iPS:393212 | 21-225_30H6 | NA | TCCTATGAGCTGACTCAGCCACCCTCAGTGTC CGTGTCCCCAGGACAGACAGCCAGCATCACCT GCTCTGGAGATAAATTGGGTAATAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTTTTC GGCGGAGGGACCAAGCTGACCGTCCTA<br>SEQ ID NO: 24771 | CAGATCACCTTGAAGGAGTCTGGTCCTACGCTGG TGAAACCACACAGACCCTCAGCTGACCTGCAC CTTCTCTGGATTCTCACTCAGCACTGGTGGAGTG GGTGTGGGCTGATCCGTCAGCCCCCAGGAAAG GCCCTGGAGTGGCTTGCACTCATTTATTGGCATG ATGATAAGCGCTACACAGTCCCTCTGAAGAGCAG GCTCGCCATCACCAAGGACACCTCCAAAAACCA GGTGGTCCTTACAATTACCAACATGTGACCCTGTG GACACAGCCACATATTACTGTGTCACTTAATAG CAGTGGCTTTTGACTATTGGGGCCAGGGAACCCT GGTCACCGTCTCCTCA<br>SEQ ID NO: 28777 |
| | | AA | SYELTQPPSVSVSPGQTASITCSGDKLGNKYACW YQQKPGQSPVLVIYQDSKRPSGIPERFSGSNSGN TATLTISGTQAMDEADYYCQAWDSSTVFGGGT KLTVL<br>SEQ ID NO: 24772 | QITLKESGPTLVKPTQTLTLTCTFSGFSLSTGGVVG WIRQPPGKALEWLALIYWHDDKRYTSPLKSRLAIT KDTSKNQVVLTITNMDPVDTATYYCAHLIAVAFDY WGQGTLVTVSS<br>SEQ ID NO: 28778 |
| iPS:393214 | 21-225_33A1 | NA | TCCTATGAGCTGACTCAGCCACCCTCAGTGTC CGTGTCCCCAGGACAGACAGCCAGCATCACCT GCTCTGGAGATAAATTGGGGGATAAATTTGTT TATTGGTATCAGCAGAAGCCAGGCCAGTCCCC TGTGCTGGTCGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCACCACCGTGGTA TTCGGCGGAGGGACCAAGCTGACCGTCCTA<br>SEQ ID NO: 24773 | CAGGTGCAGCTGGTGCAGTCTGGGGCTGAGGTG AAGAAGCCTGGGGCCTCAGTGAAGGTCTCCTGC AAGGCTTCTGGATACACCTTCAGCGGCTACTATA TGCACTGGGTGCGACAGGCCCCTGGACAAGGAC TTGAGTGGATGGGATGGATCAACCCTAACAATGG TGGCACACACTATGCACAGAAGTTTCAGGGCAG GGTCACCATGACCAGGGACACGTCCATCCGAC AGCCTCCATGGAGCTGAGCAGGCTGAGATCTGA CGACACGGCCGTGTATTTCTGTGCGAGGGATAT TATTATGCTTCGGGGAGTTATTATAACGACCTCG ACCCTGGGGCCAGGGAACCCTGGTCACCGTCTC CTCA<br>SEQ ID NO: 28779 |

FIGURE 50
(Continued)

| | | | | |
|---|---|---|---|---|
| iPS:393218 | 21-225_14G3 | AA | SYELTQPPSVSVSPGQTASITCSGDKLGDKFVYW YQQKPGQSPVLVIYQDSKRPSGIPERFSGSNSGN TATLTISGTQAMDEADYYCQAWDSTTVFGGG TKLTVL | QVQLVQSGAEVKKPGASVKVSCKASGYTFSGYYM HWVRQAPGQGLEWMGWINPNNGGTHYAQKFQGR VTMTRDTSIRTASMELSRLRSDDTAVYFCARGYYY ASGSYYNDLDPWGQGTLVTVSS |
| | | | SEQ ID NO: 24774 | SEQ ID NO: 28780 |
| | | NA | TCCTATGAGCTGACTCAGCCACCCTCAGTGTC CGTGTCCCAGGACAGACAGCCAGCATCACCT GCTCTGGAGATATCAGCGGGGATAAATATGTT TGCTGGTATCAGCAGAAGCCAGGCCAGTCCCC TGTGCTGGTCATCTATCAAGATGCAAGCGGC CCTCAGGGATCCCTGAGCGATTCTCTGGCTCC AACTCTGGGAACACAGCCACTCTGACCATCAG CGGGACCCAGGCTATGGAGGCTGATTATT ACTGTCAGGCTGGGACAACAGCACTGTGTG GTATTCGGCGGAGGGACCAAGCTGACCGTCCT G | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCCTAACAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTTTATTACTGTGCGAGGTCGTAT TTTATGGTTCGGGGAGTTATTATAACGAGTTG ACTACTGGGGCCAGGGAACCCTGGTCACCGTCTC CTCA |
| | | | SEQ ID NO: 24775 | SEQ ID NO: 28781 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWGNSTAVFGG GTKLTVL | QVQLVQSGAEVKKPGASVKVSCKASGYTFTFGYYM YWVRQAPGQGLEWMGWINPNSGGTNYAQKFQGR VTMTRDTSISTAYMELSRLRSDDTAVYYCARSYFY GSGSYYNEFDYWGQGTLVTVSS |
| | | | SEQ ID NO: 24776 | SEQ ID NO: 28782 |

FIGURE 50
(Continued)

| | | | | |
|---|---|---|---|---|
| iPS:393222 | 21-225_17F5 | NA | TCCTATGAGCTGACTCAGCCACCCTCAGTGTC CGTGTCCCAGGACAGACAGCCAGCATCACCT GCTCTGGAGATATCAGCAGAAAATATGCT TGCTGGTATCAGCAGAAGCCAGGCCAGTCCCC TGTGCTGGTCATCTATCAAGATAGAAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACGGTATTC GGCGGAGGGACCAAACTGACCGTCCTA<br><br>SEQ ID NO: 24777 | CAGATCACCTTGAAGGAGTCTGGTCCTTCGCTGG TGAAGCCACACAGACCCTCACGCTGACCTGCAC CTTCTCTGGATTCTCACTCAGCACTAGTGGAGTG GGTGTGGGCTGATCCGTCAGCCCCCGGAAAG GCCCTGGAGTGGCTTGCACTCATTTATTGGGATG ATGATAAGCGCTACAGCCCATCTCTGAAGAGCA GGCTCACCATCACCAAGGACACCTCCAAAACC AGGTGGTCCTGACAATGACCAACATGGACCCTGT GGACACAGCCACATATTCCTGTGCACACATTATA GCAGTGGCTTTGACTACTGGGGCCAGGGAACCC TGGTCACCGTCTCCTCA<br><br>SEQ ID NO: 28783 |
| | | AA | SYELTQPPSVSVSPGQTASITCSGDKLGEKYACW YQQKPGQSPVLVIYQDRKRPSGIPERFSGSNSGN TATLTISGTQAMDEADYYCQAWDSSTVFGGGT KLTVL<br><br>SEQ ID NO: 24778 | QITLKESGPSLVKPTQTLTLTCTFSGFSLSTSGVVG WIRQPPGKALEWLALIYWDDDKRYSPSLKSRLTIT KDTSKNQVVLTMTNMDPVDTATYSCAHIIAVAFD YWGQGTLVTVSS<br><br>SEQ ID NO: 28784 |
| iPS:393224 | 21-225_31C2 | NA | TCCTATGAGCTGACTCAGCCACCCTCAGTGTC CGTGTCCCAGGGCAGACAGCCAGCATCACCT GCTCTGGAGATAAATTGGGAAATAAATATGCT TGCTGGTATCAGCAGAAGCCAGGCCAGTCCCC TGTGCTGGTCGTCATCTATCAAGATTCCAAGCGGC CCTCAGGGATCCCTGAGCGATTCTCTGGCTCC AACTCTGGGAACACAGGCCACTCTGACCATCAG CGGGACCCAGGCTATGGATGAGGCTGACTATT ACTGTCAGGCGTGGGACAGCAGCACTGTATTC GGCGGAGGGACCAAACTGACCGTCCTA<br><br>SEQ ID NO: 24779 | CAGATCACCTTGAAGGAGTCTGGTCCTACGCTGG TGAAACCCACACAGACCCTCACGCTGACCTGCAC CTTCTCTGGTTCCCTCAACACTGGTGGAGTG GGTGTGGGCTGATCCGTCAGCCCCCAGGAAAG GCCCTGGAGTGGCTTGCACTCATTTATTGGAATG ATGATGAGCGCTACAGCCCATCTCTGAAGAGCA GGCTCACCATCACCAAGGACACCTCCAAAACC AGGTGGTCCTTACAATGACCAACATGGACCCTTT GGACACAGCCTCATATTACTGTGCACACTTAATA GCAGTTCCTTTGACTACTGGGGCCAGGGAGCCC TGGTCACCGTCTCCTCA<br><br>SEQ ID NO: 28785 |

FIGURE 50
(Continued)

| | | | |
|---|---|---|---|
| iPS:393226 | 21-225_33E6 | AA | SYELTQPPSVSVSPGQTASITCSGDKLGNKYACW YQQKPGQSPVLVIYQDSKRPSGIPERFSGSNSGN TATLTISGTQAMDEADYYCQAWDSSTVFGGGT KLTVL<br>SEQ ID NO: 24780 | QITLKESGPTLVKPTQTLTLTCTFSGFSLNTGGVGV GWIRQPPGKALEWLALIYWNDDERYSPSLKSRLTIF KDTSKNQVVLTMTNMDPLDTASYYCAHLIAVSFD YWGQGALVTVSS<br>SEQ ID NO: 28786 |
| | | NA | TCCTATGAGCTGACTCAGCCACCCTCAGTGTC CGTGTCCCCAGGACAGACCAGCATCACCT GCTCTGAGATAAATTGGGGATAAATATGCT TACTGGTTCAGCAGAAGCCAGGCCAGTCCCC TGTGATAGTCATCTATCAAGATAGGAAGCGGC CCTCAGGGATCCCTGAGCGATTCTCTGGCTCC AACTCTGGGAACACAGGCTATGATGAGGCTGACTATT CGGGACGCAGGCGTGGGACAACAGCACTGCGGTA TTCGGCGGAGGGACCAAGCTGACCGTCCTA<br>SEQ ID NO: 24781 | CAGGTGAAGCTGGTGCAGTCTGGGGCTGAGGTG AAGAAGCCTGGGGCCTCAGTGAAGGTCTCCTGC AAGGCTTCAGGATACACCTTCACCGGCTACTATA TGCACTGGGTGCGACAGGCCCCTGGACAAGGGC TTGAGTGGATGGGATGGATCAACCTAACAGTGG TGGCACAAACTATGCACAGAAGTTTCAGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGGTTCGGGAGTTATTATAACGAGTTTG ACTACTGGGGCCAGGGAACCCTGGTCACCGTCTC CTCA<br>SEQ ID NO: 28787 |
| | | AA | SYELTQPPSVSVSPGQTASITCSGDKLGDKYAY WFQQKPGQSPVIVIYQDRKRPSGIPERFSGSNSG NTATLTISGTQAMDEADYYCQAWDNSTAVFGG GTKLTVL<br>SEQ ID NO: 24782 | QVKLVQSGAEVKKPGASVKVSCKASGYTFTGYM HWVRQAPGQGLEWMGWINPNSGGTNYAQKFQGR VTMTRDTSISTAYMELSRLRSDDTAVYYCARVYYY GSGSYYNEFDYWGQGTLVTVSS<br>SEQ ID NO: 28788 |

FIGURE 50
(Continued)

| | | | |
|---|---|---|---|
| iPS:393230 | 21-225_9G9 | NA | CAGTCTGTGTTGACTCAGCCACCTCAGCGTC TGGGACCCCGGGCAGAGGGTCAACATGTCTT GTTCTGGAACCAACTCAACATCGGAAGTTAT ACTGTAAACTGGTACCAGCAGCTCCCAGGAAC GGCCCCAAACTCCTCATCTATATTAATAATC AGCGGCCCTCAGGGGTCCCTGACCGATTCTCT GGCTCCAAGTCTGGCACCTCAGCTCCCTGGC CATCAGTGGGCTCCAGTCTGAGGATGACAGCTG ATTATTACTGTGCAGCATGGGATGACAGCCTG AATGGTCATGTGGTATTCGGCGGAGGGACCAA GCTGACCGTCCTA CAGGTGCAGCTGGTGCAGTCTGGGGCTGAGGTG AAGAAGCCTGGGGCCTCAGTGAAGGTCTCCTGC AAGGCTTCTGGATACACCTTCACGGGCTACTATA TACACTGGGTGCGACAGGCCCCTGGACAAGGAC TTGAGTGGATGGGATGGATCAACCCTAACAGTGG TGGCACAGACTATGCACAGAAGTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGGTCGTAT TACTATGTTCGGGGACTTATTATAACGAGTTTG ACTACTGGGGCCAGGGAACCCTGGTCACCGTCTC CTCA |
| | | | SEQ ID NO: 24783 | SEQ ID NO: 28789 |
| | | AA | QSVLTQPPSASGTPGQRVNMSCSGTNSNIGSYTV NWYQQLPGTAPKLLIYINNQRPSGVPDRFSGSKS GTSASLAISGLQSEDEADYYCAAWDDSLNGHVV FGGRTKLTVL | QVQLVQSGAEVKKPGASVKVSCKASGYTFTGYYIH WVRQAPGQGLEWMGWINPNSGGTDYAQKFQGRV TMTRDTSISTAYMELSRLRSDDTAVYYCARSYYYG SGTYYNEFDYWGQGTLVTVSS |
| | | | SEQ ID NO: 24784 | SEQ ID NO: 28790 |
| iPS:393232 | 21-225_17F12 | NA | CAGTCTGCCTGACTCAGCCTGCCTCCGTGTCT GGGTCTCCTGGACAGTCGATCACCATCTCCTG CACTGGAGCCAGCAGTGACGTTGGTGATTATA ACTCTGTCTCTGGTACCAACAGCACCCAGGC AAAGCCCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAGTCAGCTCATATACAAGCAGCAT CACTGTGGTATTCGGCGGAGGGACCAAACTGA CCGTCCTA | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGCCATG AGCTGGGTCCGCCAGGCTCCAGGGAAGGGCTG GAGTGGGTCTCAGTTATTAGTGGTGGTGGTGTA GCACATACTACGCAGACTCCGTGAAGGGCCGG TCACCATCTCCAGAGACAATTCCAAGAACAGCT GTATCTGCAAATGAACAGCCTGAGAGCCGAGGA CACGGCCGTATATTACTGTGCGAAATGGGACGT GGATACAACTATGAGTACTACTACGGTATGGACG TCTGGGGCCAAGGGACCACGGTCACCGTCTCCTC A |
| | | | SEQ ID NO: 24785 | SEQ ID NO: 28791 |

FIGURE 50
(Continued)

| | | | |
|---|---|---|---|
| iPS:393234 | 21-225_26C10 | AA | QSALTQPASVSGSPGQSITISCTGASSDVGDYNSVSWYQQHPGKAPKLMIYEVSNRPSGVSNRFSGSKSGNTASLTISGLQAEDEADYYCSSYTSSITVFGGGTKLTVL<br>SEQ ID NO: 24786 | EVQLLESGGGLVQPGGSLRLSCAASGFTFSSYAMSWVRQAPGKGLEWVSAISGGGSTYYADSVKGRVTISRDNSKNTLYLQMNSLRAEDTAVYYCAKWGRGYNYEYYGMDVWGQGTTVTVSS<br>SEQ ID NO: 28792 |
| | | NA | TCCTATGAAGTGACTCAGCCACCCTCAATGTCCGTGTCCCCAGGACAGACAGCATCACCTGCTCTGGAGATAAATTGGGGGATAAATATGTTTGCTGGTTTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGGCGTGGGTCAACAACACTGTCCTAGGCGGAGGGACCAAGCTGACCGTCCTA<br>SEQ ID NO: 24787 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATGTGCACTGGGTGCGACAGGCCCCTGGACAAGGCCTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGAACGGCCGTGTATTACTGTGCGAGAGAGGTGTAGTACTACCAGCTGCTATTAGGAATTACGGGCTACTACGGTATGGACGTCTGGGGCCAAGGGACCACGGTCACCGTCTCCTCA<br>SEQ ID NO: 28793 |
| | | AA | SYEVTQPPSMSVSPGQTASITCSGDKLGDKYVCWFQQKPGQSPVLVIYQDSKRPSGIPERFSGSNSGNTATLTISGTQAMDEADYYCQAWVNNTVFGGGTKLTVL<br>SEQ ID NO: 24788 | QVQLVQSGAEVKKPGASVKVSCKASGYTFTGYYVHWVRQAPGQGLEWMGWINPNSGGTNYAQKFQGRVTMTRDTSISTAYMELSRLRSDDTAVYYCARERCSTTSCYLGITGYYGMDVWGQGTTVTVSS<br>SEQ ID NO: 28794 |

FIGURE 50
(Continued)

| | | | |
|---|---|---|---|
| iPS:393345 | 21-225_5G7 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGGTGGTATCAGCAGAAGCCAGGCCAGTCCCC TGTGCTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGGTT TTCGGCGGAGGGACCAAACTGACCGTCCTA SEQ ID NO: 24789 | GAGGTGCAGCTGTTGGAGTCTGGGGAGGCTTG GTACAGCCTGAGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTATTAGTGGTAGTGGTGGT AGCACATACTACGCAGACTCCGTGAAGGGCCGG TTCACCATCTCCAGAGACAATTCCAAGAACACGC TGTGTCTGCAAATGAACAGCCTGAGAGCCGAGG ACACGGCCGTATATTACTGTGCAAAGAATATTG TGGTGGTGACTGCTATTCCCCTTACTACTACTACT ACGGTATGGACGTCTGGGGCCAAGGGACCACGG TCACCGTCTCCTCA SEQ ID NO: 28795 |
| | | AA | SYELTQPPSVSVSPGQTASITCSGDKLGNKYAW WYQQKPGQSPVLVIYQDRKRPSGIPERFSGSNSG NTATLTISGTQAMDEADYYCQAWDNSTVVFGG GTKLTVL SEQ ID NO: 24790 | EVQLLESGGGLVQPEGSLRLSCAASGFTFSSYAMS WVRQAPGKGLEWVSAISGSGSTYYADSVKGRFTI SRDNSKNTLCLQMNSLRAEDTAVYYCAKEYCGGD CYSPYYYYYGMDVWGQGTTVTVSS SEQ ID NO: 28796 |
| iPS:393368 | 21-225_29H8 | NA | GACATCGTGATGACCCAGTCTCCAGACTCCCT GGCTGTGTCTCTGGGCGAGAGGGCCACCATCA ACTGCAAGTCCAGCCAGCAGACTATTTACACAGC TCCAACAATTACAACCAGGACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATTGTACTCCTCCGACGTTCGGCCAAGG GACCAAGGTGGAAATCAAA SEQ ID NO: 24791 | CAGGTGCAGCTGGTGCAGTCTGGGGCTGAGGTG CAGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGGCTGGATGAACCCTAACAGTGGT AACACAGGCTATGCACAGAGGTTCCAGGGCAGA GTCACCATGACCAGGAACACCTCCATAAGCGCA GCCTACATGGAGCTGAGCAGCCTGAGATCTGAG GACACGGCCGTATATTACTGTGCGAGTAGCAGTG GCTGGTACTACTTTGACTACTGGGGCCAGGGAAC CCTGGTCACCGTCTCCTCA SEQ ID NO: 28797 |

FIGURE 50
(Continued)

| | | | |
|---|---|---|---|
| iPS:393565 | 21-225_34B11 | AA | DIVMTQSPDSLAVSLGERATINCRSSQTILHSSNNYNYLAWYQQKPGQPPKLLIYWASTRESGVPDRFSGSGSGTDFTLTISSLQAEDVAVYYCQQYYCTPPTFGQGTKVEIK<br>SEQ ID NO: 24792 | QVQLVQSGAEVQKPGASVKVSCKASGYTFTNYDINWVRQATGQGLEWMGWMNPNSGNTGYAQRFQGRVTMTRNTSISAAYMELSSLRSEDTAVYYCASSSGWYYFDYWGQGTLVTVSS<br>SEQ ID NO: 28798 |
| | | NA | TCCTATGAGCTGACTCAGCCACCCTCAGTGTCCGTGTCCCCAGGACAGACAGCCAGCATCACCTGCTCTGGAGATAAATTGGGGATAAATATGCTTGCTGGTATCAGCAGAAGCCAGGCCAGTCCCTGTGGTGGTCTCATCTATCAAGATATGAAGCGGCCCTCAGGGATCCCTGAGCGATTCTCTGGCTCCAACTCTGGGAACACAGGCTATGGAGGCTGACTATTCGGGACGACGCAGGCGTGGGACAACAGCACTGCGGTAACTGTCAGGGCGTGGGACAACAGCACTGCGGTATTCGGCGGAGGGACCAAGCTGACCGTCCTA<br>SEQ ID NO: 24793 | CAGGTGAAACTGGTGCAGTCTGGGGCTGAGGTGAAGAAGCCTGGGGCCTCAGTGAAGGTCTCCTGCAAGGCTTCAGGATACACCTTCACCGGCTACTATATGCACTGGGTGCGACAGGCCCCTGGACAAGGGCTTGAGTGGATGGGATGGATCAACCCTAACAGTGGTGGCACAAACTATGCACAGAAGTTCAGGGCAGGGTCACCATGACCAGGGACACGTCCATCAGCAGCCTACATGGAGCTGAGCAGGCTGAGATCTGACGACACGCCCGTGTATTACTGTGCGAGAGTGTATTTCTATGGTTCGGGGAGTTATTATAACGAGTTGACTACTGGGGCCAGGGAACCCTGGTCACCGTCTCCTCA<br>SEQ ID NO: 28799 |
| | | AA | SYELTQPPSVSVSPGQTASITCSGDKLGDKYACWYQQKPGQSPVVVIYQDMKRPSGIPERFSGSNSGNTATLTISGTQAMDEADYYCQAWDNSTAVFGGGTKLTVL<br>SEQ ID NO: 24794 | QVKLVQSGAEVKKPGASVKVSCKASGYTFTGYMHWVRQAPGQGLEWMGWINPNSGGTNYAQKFQGRVTMTRDTSISTAYMELSRLRSDDTAVYYCARVYFYGSGSYYNEFDYWGQGTLVTVSS<br>SEQ ID NO: 28800 |

FIGURE 50
(Continued)

| | | | | |
|---|---|---|---|---|
| iPS:393802 | 21-225_3D12 | NA | GAAATTGTGTTGACGCAGTCTCCAGGCACCCT GTCTTTGTCTCTGCAGGGGAAAGAGCCACCCTCT CCTGCAGGGCCAGTCAGAGTGTTAGCAGCAGC TACTTAGCCTGGTACCAGCAGAAACCTGGCCA GGCTCCCAGGCTCCTCATCTATGGTACATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGTTCACGC AGTTTTGGCCAGGGGACCAAGCTGGAGATCAA A | GAGGTGCAGCTGGTGGAGTCTGGGGGAGGCTTG GTAAAGCCTGGGGGGTCCCTTAGACTCTCCTGTG CAGCCTCTGAGTCACTTCAGTACCGCTGGAT GAACTGGGTCCGCCAGCTCCAGGGAAGGGCT GGAGTGGGTTGGCCGGATTAAAAACAAAATTGA TGTGGGGACAACAGACTACGTTGCACCGTGAA AGGCAGATTCACCATCTCAAGAGATGATTCAAA AAACACGCTGTATCTGCAAATGAACAGCCTGAA AACCGAGGACACAGCCGTATATTACTGTACCACA GAAGGCTGAACACGGACTACTGGGGCCAGGGA ACCCTGGTCACCGTCTCCTCA |
| | | AA | EIVLTQSPGTLSLSPGERATLSCRASQSVSSSYLA WYQQKPGQAPRLLIYGTSSRATGIPDRFSGSGSG TDFTLTISRLEPEDFAVYYCQQYGSSRSFGQGTK LEIK | EVQLVESGGGLVKPGGSLRLSCAASGVTFSTAWM NWVRQAPGKGLEWVGRIKNKIDGGTTDYVAPVKG RFTISRDDSKNTLYLQMNSLKTEDTAVYYCTTEGW NTDYWGQGTLVTVSS |
| | | | SEQ ID NO: 24795 | SEQ ID NO: 28801 |
| | | | SEQ ID NO: 24796 | SEQ ID NO: 28802 |
| iPS:393804 | 21-225_5H7 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGTTACATCCAGTT TGCAAGGTGGGTCCCATCAAGGTTCAGCGGC AGTGGATCTGGGACAGATTCACTCTCACAACT CAGCAGCCTGCAGCCTGAAGATTTTGCAACTT ATTACTGTCTACAACATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAACAGAAGTAGTTA TTACTGGGGCTGGATCCGCCAGCCCCAGGGAA GGGACCACTACTACAACCCGTCCCTCAAGAGTC GAGTCACCATATCCGTAGACACGTCCAAGAACC AGTTCTCCCTGAACCTGAGCTCTGTGACCGCCGC AGACACGCTGTATATTCTGTGTGAGACATGGA AAAGACTGGGGCTTGACTACTGGGGCCAGGGA ACCCTGGTCACCGTCTCCTCA |
| | | | SEQ ID NO: 24797 | SEQ ID NO: 28803 |

FIGURE 50
(Continued)

| | | | |
|---|---|---|---|
| | | AA | DIQMTQSPSSLSASVGDRVTITCRASQGIRNDLGWYQQKPGKAPKRLIYVTSSLQGGVPSRFSGSGSGTEFTLTISSLQPEDFATYYCLQHNSYPLTFGGGTKVEIK | QLQLQLESGPGLVKPSETLSLTCTVSGGSINRSSYYWGWIRQPPGKGLEWIGNIYSGTTYNPSLKSRVTISVDTSKNQFSLNLSSVTAADTAVYSCARHGKDWGLDYWGQGTLVTVSS |
| | | | SEQ ID NO: 24798 | SEQ ID NO: 28804 |
| iPS:393806 | 21-225_6A6 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAGTAGTTACCCGTCACTTTCGGCGGAGGGACCAAGGTGGAGATCAAA | CAGCTGCAGCTGCAGGAGTCGGGCCCAGGACTGGTGAAGCCTTCGGAGACCCTGTCCCTCACCTGCACTGTCTCTGGTGGCTCCATCAGCAGAAGTAGTTACTACTGGGGCTGGATCCGCCAGCCCCCAGGGAAGGGGCTGGAGTGGATTGGGAATATCTATTATAGTGGGATCCCTACTACAACCCGTCCCTCAAGAGTCGGGTCAACATATCCGTAGACACGTCCAAGAACCAGTTCTCCCTGAAGCTGAACTCTGTGACCGCCGCAGACACGGCTGTGTATTACTGTGCGAGACACAGCAGCAGCTGGTCTCTTGACTACTGGGGCCAGGGAACCCTAGTCACCGTCTCCTCA |
| | | | SEQ ID NO: 24799 | SEQ ID NO: 28805 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIK | QLQLQLESGPGLVKPSETLSLTCTVSGGSISRSSYYWGWIRQPPGKGLEWIGNIYSGIPYYNPSLKSRVNISVDTSKNQFSLKLNSVTAADTAVYYCARHSSSWSLDYWGQGTLVTVSS |
| | | | SEQ ID NO: 24800 | SEQ ID NO: 28806 |

FIGURE 50
(Continued)

| | | | | |
|---|---|---|---|---|
| iPS:393808 | 21-225_1A2 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTGCAACT TATTACTGTCTACAGCATAATAGTCACCCTCTC ACTTTCGGCGGAGGGACCAAGGTGGAGATCA AA | GAGGTGCAGCTGGTGGAGTCTGGGGGAGGCTG GTCAAGCCTGGGGGGGTCCCTGAGACTCTCCTGTG CAGCCTCTGGATTCACCTTCAGTAGTAGTTACCAT GAACTGGGTCCGCCAGGCTCCAGGGAAGGGGCT GGAGTGGGTCTCATCCATTAGTAGTGGTAGTGGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGGAGCAG CTCGTCCGGGTTTGACTACTGGGGCCAGGGAACC CTGGTCACCGTCTCCTCA |
| | | | SEQ ID NO: 24801 | SEQ ID NO: 28807 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSHPLTFGGG TKVEIK | EVQLVESGGGLVKPGGSLRLSCAASGFTFSSYTMN WVRQAPGKGLEWVSSISGSGSVIYYADSVKGRFTIS RDNAKNSLYLQMNSLRAEDTAVYYCARGSSSSGF DYWGQGTLVTVSS |
| | | | SEQ ID NO: 24802 | SEQ ID NO: 28808 |
| iPS:393810 | 21-225_5A4 | NA | GACATCCAGATGACCCAGTCTCCATCTTCCGT GTCTGCATCTGTAGGAGACAGAGTCACCATCA CTTGTCGGGCGAGTCAGGTATTAGCAGCACCTGG TTAGCCTGGTATCAACAGAAACCAGGGAAAG CCCCCTAAACTCCTGATCTATGATGCATCCAGTT TGCAAAGTGGGGTCCCATCAAGGTTCAGCGGC AGTGGATCTGGGACAGCCTCAAGTTCACTCTCACCAT CAGCAGCCTGCAGCCTGAAGATTTTGCAACTT ACTATTGTCAACAGGCTAACAGTTTCCCGTGG ACGTTCGGCCAAGGGACCAAGGTGGAAATCA AA | GAGGTGCAGCTGTTGGAGTCTGGGGGAGGCTTG GTACAGCCTGGGGGGGTCCCTGAGACTCTCCTGTG CAGCCTCTGGACTCACCTTTAGCAGCTCTGCCAT GAGCTGGGTCCGCCAGGCTCCAGGGAAGGGGCT GGAGTGGGTCTCAGCTATTAGTGGTCGTGGTGGT AACACATTCTACACAGACTCCGTGAAGGGCCGGT TCACCATTTCCAGAGACAATTCCAAGAACACGCT GTATCTGCAAATGAACAGCCTGAGAGCCGAGGA CACGGCCGTATATTACTGTGCGAAACTGGGGAA AGACTACTACTACGGTATGGACGTCTGGGGC CAAGGGACCACGGTCACCGTCTCCTCA |
| | | | SEQ ID NO: 24803 | SEQ ID NO: 28809 |

FIGURE 50
(Continued)

| | | | |
|---|---|---|---|
| iPS:393812 | 21-225_6A11 | AA | DIQMTQSPSSVSASVGDRVTITCRASQGISTWLAWYQQKPGKAPKLLIYDASSLQSGVPSRFSGSGSGTDFTLTISSLQPEDFATYYCQQANSFPWTFGQGTKVEIK<br>SEQ ID NO: 24804 | EVQVLESGGGLVQPGGSLRLSCAASGLTFSSSAMSWVRQAPGKGLEWVSAISGRGGNTFYTDSVKGRFTISRDNSKNTLYLQMNSLRAEDTAVYYCAKLGKDYYYYGMDVWGQGTTVTVSS<br>SEQ ID NO: 28810 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATATAATAGTTACCCGTGGACGTTCGGCCAAGGGACCAAGGTGGAAATCAAA<br>SEQ ID NO: 24805 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGTGGCAGTTATATGGTTTGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATGACTGTGCGAGAGATCTTGGCTGGACGGAAGAGTACTGGGGCCAGGGAACCCTGGTCACCGTCTCCTCA<br>SEQ ID NO: 28811 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK<br>SEQ ID NO: 24806 | QVQLVESGGGVVQPGRSLRLSCAASGFTFSDYGMHWVRQAPGKGLEWVAVIWFDGSNKYYADSVKGRFTISRDNSKNTLYLQMNSLRAEDTAVYDCARDLGWTEEYWGQGTLVTVSS<br>SEQ ID NO: 28812 |

FIGURE 50
(Continued)

| | | | |
|---|---|---|---|
| iPS:393814 | 21-225_7F4 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATTTATGCTGCATCCAATT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAGTGTCTTACCCGCTC ACTTTCGGCGGAGGGACCAAGGTGGAGATCA AA<br><br>SEQ ID NO: 24807 | CAACTGCAGCTGCAGGAGTCGGGCCCAGGACTG GTGAAGCCTTCGGAGACCCTGTCCTCACCTGCA CTGTCTCTGGTGGCTGTCCATCAGCAGGAGTAGTTA CTACTGGGGCTGGATCCGCCAGCCCCAGGAA GGGGCTGGAGTGGATTGGGAATATCTATTATAGT GGGCCCACTACTACAACCGTCCCTCAAGAGTC GAGTCACCATCTCCGTAGACACGTCCACGAACCA GTTCTCCCTGAAGCTGAGCTCTGTGACCGCCGCA GACACGGCTGTGTATTACTGTGCGAGACATAGCG GCAGCTGGTCCCTGACTACTGGGGCCAGGGAAC CCTGGTCACCGTCTCCTCA<br><br>SEQ ID NO: 28813 |
| | | AA | DIQMTQSPSSLSASVGDRVTITCRTSQGIRNDLG WYQQKPGKAPKRLIYAASNLQSGVPSRFSGSGS GTEFTLTISSLQPEDFATYYCLQHSAYPLTFGGG TKVEIK<br><br>SEQ ID NO: 24808 | QLQLQLQESGPGLVKPSETLSLTCTVSGGSISRSSYYW GWIRQPPGKGLEWIGNIYYSGATYYNPSLKSRVTIS VDTSTNQFSLKLSSVTAADTAVYYCARHSGSWSLD YWGQGTLVTVSS<br><br>SEQ ID NO: 28814 |
| iPS:393816 | 21-225_6D4 | NA | CAGATCCAGATGACCCAGTCTCCATCTCCCT GTCTGCTTCTGTAGGAGACAGAGTCACCATCA CTTGCCGGGCAAGTCAGGCCATTAGAAATGAT TTAGGCTGGTATCAGCAGAAACCAGGGAAAG CCCCTAAGCGCCTGATCTATGCTGCATCCAGTT TGCAAAGTGGGGTCCCATCAAGGTTCAGCGGC AGTGGATCTGGGACAGCCTGAAGATTCACTCTCACAAT CAGCAGCCTGCAGCCTGAAGATTTTGCAACTT ATTACTGTCTACAGCATAGTAGTTACCCGCTC ACTTTCGGCGGAGGGACCAAGGTGGAGATCA AA<br><br>SEQ ID NO: 24809 | CAGCTGCAGCTGCAGGAGTCGGGCCCAGGACTG GTGAAGCCTTCGGAGACCCTGTCCTCACCTGCA CTGTCTCTGGTGGCTCCATCAGCAGAAGTAGTTC CTACTGGGGCTGGATCCGCCAGCCCCCAGGAA GGGAGCGCTACTACATTCCGTCCCTCAAGAGTC GAGTCACCATATCCGTAGCCAGTCAAGAACCA GTTCTCCCTGAACCTGAGCTCTGTGACCGCCGCA GACACGGCTGTGTATTACTGTGCGACACAGCA GCAGCTGGTCTTGACTGCTGTGGGGCCAGGGAAC GCTGGTCACCGTCTCCTCA<br><br>SEQ ID NO: 28815 |

FIGURE 50
(Continued)

| | | | |
|---|---|---|---|
| iPS:393818 | 21-225_6G12 | AA | DIQMTQSPSSLSASVGDRVTITCRASQAIRNDLGWYQQKPGKAPKRLIYAASSLQSGVPSRFSGSGSGTEFTLTISSLQPEDFATYYCLQHSSYPLTFGGGTKVEIK<br>SEQ ID NO: 24810 | QLQLQESGPGLVKPSETLSLTCTVSGGSISRSSSYWGWIRQPPGKGLEWIGNIYYSGSAYYIPSLKSRVTISVATSKNQFSLNLTSVTAADTAVYYCARHSSSWSLDCWGQGTLVTVSS<br>SEQ ID NO: 28816 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCACTTTGCAAAGTGGGGTCCCATCAAGGTTCAGCGGCAGTGGATCTGGGACAGACTTCACTCTCACAATCAGCAGCCTGCAGCCTGAAGATTTTGCAACTTATTACTGTCTACAGCATAGTAGTTACCCGCTCACTTTCGGCGGAGGGACCAAGGTGGAGATCAAA<br>SEQ ID NO: 24811 | CAGGTGCAGCTGCAGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATTTGGTATGATAGAAGTAATAACTACTATGCAGACTCCGTGAAGGGCCGATTCACCATCTCCAGAGACAACAATTCCAAGAATACGCTGTATCTGCAAATGAACAGCCTGAGAGCCGAGGACACGGCTGTGTATTACTGTGCGAGAGAACTGGGGTTCCGGTCTGACTACTGGGGCCAGGGAACCCTGGTCACCGTCTCCTCA<br>SEQ ID NO: 28817 |
| | | AA | DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIK<br>SEQ ID NO: 24812 | QVQLVESGGGVVQPGRSLRLSCAASGFTFSSYGMHWVRQAPGKGLEWVAVIWYDRSNNYYADSVKGRFTISRDNSKNTLYLQMNSLRAEDTAVYYCARELGFRSDYWGQGTLVTVSS<br>SEQ ID NO: 28818 |

FIGURE 50
(Continued)

| | | | | |
|---|---|---|---|---|
| iPS:393820 | 21-225_8H7 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATTTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCGTTCACTTTCGGCGGAGGGACCAAGGTGGAGATCAAA SEQ ID NO: 24813 | CAGGTGCAGCTGGTGGTGGAGTCTGGGGGAGGCGTGGTCCAGCCTGGGAGGTCCCTGAGACTCTCCTGTCAGCGTCTGGATTCACCTTCAGTGACTTTGGCATGCACTGGGTCCGCCAGGCTCCAGGCAAGGGCTGGAGTGGGTGGCAGTTATTGGTATGAAGAAAATAATCAATACTATGCAGACTCCGTGAAGGGCCGATTCACCATCTCCAGAGACAATTCCAAGAACACGCTGTATCTGCAAATGAACAGCCTGAGAGCCGAGGACGGCGTGTATTACTGTGCGAGAGAGCTGGGGTTCCGGTCGACTACTGGGGCCAGGGAACCCTGGTCACCGTCTCCTCA SEQ ID NO: 28819 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGGGTKVEIK SEQ ID NO: 24814 | QVQLVESGGGVVQPGRSLRLSCPASGFTFSDFGMHWVRQAPGKGLEWVAVIWYEENNQYYADSVKGRFTISRDNSKNTLYLQMNSLRAEDTAVYYCARELGFRSDYWGQGTLVTVSS SEQ ID NO: 28820 |
| iPS:393822 | 21-225_15B11 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGCCTGAGCAGCCTGAGCAGCCTGAAGCTGAAGATTTTGCAACTTATTACTGTCTACAGCATAATAGTTACCCATTCACTTTCGGCCCTGGGACCAAAGTGGATATCAAA SEQ ID NO: 24815 | CAGGTGCAGCTGGTGGTGGAGTCTGGGGGAGGCGTGGTCCAGCCTGGGAGGTCCCTGAGACTCTCCTGTGCAGCGTCTGGATTCACCTTCAGTGACTAACTATGGCATGCACTGGGTCCGCCAGGCTCCAGGCAAGGGGCTGGAATGGGTGGCAGTTATATGGTATGAGGAAAGTAATAAATACTATACAGACTCCGTGAAGGGCCGATTCACCATCTGCAAATGAACAGCCTGAGAGACACGCTGTATCTGCAAATGAACAGCCTGAGACCCGAGGACACGGCTGTGTATTACTGTGCGAGAGAAGTGGGATTCACTGAGGACTACTGGGGCCAGGGAACCCTGGTCACCGTCTCCTCA SEQ ID NO: 28821 |

FIGURE 50
(Continued)

| | | | |
|---|---|---|---|
| iPS:393824 | 21-225_10F12 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK<br>SEQ ID NO: 24816 | QVQLVESGGGVVQPGRSLRLSCAASGFTFSNYGMHWVRQAPGKGLEWVAVIWYEESNKYTDSVKGRFTISRDNSKNTLYLQMNSLRPEDTAVYYCAREVGFTEDYWGQGTLVTVSS<br>SEQ ID NO: 28822 |
| | | NA | GACATCCAGATGACCCAGTCTCCATCCTCCCTGTCTGCATCTGTAGGAGACAGAGTCACCATCACTTGCCGGGCAAGTCAGAACATTAGTAGTTATTTAAATTGGTATCAGCAGAAACCAGGGAAAGCCCCTAAACTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAATACCCCTTCTTCACTTTCGGCCCTGGGACCAAAGTGGATATCAAA<br>SEQ ID NO: 24817 | GAGGTGCAGCTGTTGGAGTCTGGGGGAGGCTTGGTACAGCCTGGGGGGTCCCTGAGACTCTCCTGTGCAGCCTCTGAATTCACCTTTAGCAGCTATGCCATGAGCTGGGTCCGCCAGGCTCCAGGGAAGGGGCTGGAGTGGGTCTCAATTATTAGTGGTCGTGGTGGTAACACATTCTACGCAGACTCCGTGAAGGGCCGGTTCACCATCTCCAGAGACAATTCCAAGAACACTCTGTATCTGCAAATGAACAGCCTGAGAGCCGAGGACACGGCCGTATATTACTGTGCCTCCCGTAGCAGTGGCTGGCTCGGAGGCTTTGTATCTGGGGCCAAGGGACAAATGGTCACCGTCTCTTCA<br>SEQ ID NO: 28823 |
| | | AA | DIQMTQSPSSLSASVGDRVTITCRASQNISSYLNWYQQKPGKAPKLLIYAASSLQSGVPSRFSGSGSGTDFTLTISSLQPEDFATYYCQQSYNTPFFTFGPGTKVDIK<br>SEQ ID NO: 24818 | EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRVAVAGSEAFAIWGQGTMVTVSS<br>SEQ ID NO: 28824 |

FIGURE 50
(Continued)

| | | | |
|---|---|---|---|
| iPS:393826 | 21-225_10G5 | NA | GACATCCAGATGACCCAGTCTCCATCCTCCCT GTCTGCATCTGTAGGAGACAGAGTCACCATCA CTTGCCGGGCAAGTCAGGCAGTCATTAGAAATGAT TTAGGCTGGTATCAGCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24819 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAACTATGGCAT GCACGTGGGTCCGCCAGGCTCCAGGCAAGGGCT GGAGTGGGTGGCAGTTATTTGGTATGAAGAAAAT AATCAATACTATGCAGACTCCGTGAAGGGCCGAT TCACCATCTCCAGAGACAACAGCCTGAGAGCCGAGGA GTATCTGCAAATGAACAGCCTGAGAGCCGAGGA CACGGCTGTTTATTACTGTACGAGAGAACTGGGG TTCCGGTCTGACTACTGGGGCCAGGGAACCCTGG TCACCGTCTCCTCA SEQ ID NO: 28825 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK SEQ ID NO: 24820 | QVQLVESGGGVVQPGRSLRLSCAASGFTFSNYGM HWVRQAPGKGLEWVAVIWYEENNQYYADSVKGR FTISRDNSKNTLYLQMNSLRAEDTAVYYCTRELGF RSDYWGQGTLVTVSS SEQ ID NO: 28826 |
| iPS:393828 | 21-225_10H12 | NA | GACATCCAGATGACCCAGTCTCCATCCTCCCT GTCTGCATCTGTAGGAGACAGAGTCACCATCA CTTGCCGGGCAAGTCAGGCAGTCATTAGAAATGAT TTAGGCTGGTATCAGCAGCAGAAAACCAGGGAAAG CCCCTAAGCGCCTGATCTATGGTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA SEQ ID NO: 24821 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACGTGGGTCCGCCAGGCTCCAGGCAAGGGCT GGAGTGGGTGGCAGTTATTTGGTATGAAGACAAT AATCAATACTATGCAGACTCCGTGAAGGGCCGAT TCACCATCTCCAGAGACAACAGCCTGAGAGCCGAGGA GTATCTGCAAATGAACAGCCTGAGAGCCGAGGA CACGGCTGTCGTATTACTGTGTGCGAGAGAACTGGGG TTCCGGTCTGACTACTGGGGCCAGGGAACCCTGG TCACCGTCTCCTCA SEQ ID NO: 28827 |

FIGURE 50
(Continued)

| | | | |
|---|---|---|---|
| iPS:393830 | 21-225_12A.1 | AA | DIQMTQSPSSLSASVGDRVTITCRASQGIRNDLG WYQQKPGKAPKRLIYGASSLQSGVPSRFSGSGS GTEFLTISSLQPEDFATYYCLQHNSYPLTFGGG TKVEIK<br><br>SEQ ID NO: 24822 | QVQLVESGGGVVQPGRSLRLSCAASGFTFSDYGM HWVRQAPGKGLEWVAVIWYEDNNQYYADSVKGR FTISRDNSKNTLYLQMNSLRAEDTAVYYCARELGF RSDYWGQGTLVTVSS<br><br>SEQ ID NO: 28828 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATCACTCTCACAA TCAGCAGCCTGCAGCCTGAAGATTTTGCAACT TATTACTGTCTACAGCATATAGTTACCCGCTC ACTTTCGGCGGAGGGACCAAGGTGGAGATCA AA<br><br>SEQ ID NO: 24823 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCAGAGACAATCCAAGAACACGCT GTATCTGCAAATGAACAGCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br><br>SEQ ID NO: 28829 |
| | | AA | DIQMTQSPSSLSASVGDRVTITCRASQGIRNDLG WYQQKPGKAPKRLIYAASSLQSGVPSRFSGSGS GTEFLTISSLQPEDFATYYCLQHNSYPLTFGGG TKVEIK<br><br>SEQ ID NO: 24824 | QVQLVESGGGVVQPGRSLRLSCAASGFTFSSYGMH WVRQAPGKGLEWVAVIWYEENNQYYADSVKGRF TISRDNSKNTLYLQMNSLRAEDTAVYYCARELGFR SDYWGQGTLVTVSS<br><br>SEQ ID NO: 28830 |

FIGURE 50
(Continued)

| | | | | |
|---|---|---|---|---|
| iPS:393832 | 21-225_14B2 | NA | GACATCCAGATGACCCAGTCTCCATCCTCCT GTCTGCATCTGTTGGAGACAGAGTCACCATCA CTTGCCGGGCAAGTCAGGGCATTAGAAAATGAT TTAGGCTGGTATCAGCAGAAACCAGGGAAAG CCCCTAAGCGCCTGATCTATGTTACATCCAGTT TGCAAGGTGGGGTCCCATCAAGGTTCAGCGGC AGTGGATCTGGGACAGAGAATTCACTCTCACAAT CAGCAGCCTGCAGCCTGAAGATTTTGCAACTT ATTACTGTCTACAACATATAGTTACCCGCTC ACTTTCGGCGGAGGGACCAAGGTGGAGATCA AA SEQ ID NO: 24825 | CAGCTGCAGCTGCAGGAGTCGGGGCCAGGACTG GTGAAGCCTTCGGAGACCCTGTCCCTCACCTGCA CTGTCTCTGGTGGCTCCATCAACAGAAGTAGTTA CTACTGGGGTTGGATCCGCCAGCCCCCAGGGAAG GGGCTGGAGTGGATTGGGAATATCTATTATAGTG GGACCACTTACTACAACCCGTCCCTCAAGAGTCG AGTCACCATATCGTAGACACGTCCAAGAACCA GTTCTCCCTGAACCTGAGCTCTGTGACCGCCGCA GACACGGCTGTATATTCCTGTGCGAGACATGGAA AAGACTGGGGCCTTGACTACTGGGGCCAGGGAG CCCTGGTCACCGTCTCCTCA SEQ ID NO: 28831 |
| | | AA | DIQMTQSPSSLSASVGDRVTITCRASQGIRNDLG WYQQKPGKAPKRLIYVTSSLQGGVPSRFSGSGS GTEFTLTISSLQPEDFATYYCLQHNSYPLTFGGG TKVEIK SEQ ID NO: 24826 | QLQLQESGPGLVKPSETLSLTCTVSGGSINRSSYYW GWIRQPPGKGLEWIGNIYYSGTTYYNPSLKSRVTIS VDTSKNQFSLNLSSVTAADTAVYSCARHGKDWGL DYWGQGALVTVSS SEQ ID NO: 28832 |
| iPS:393836 | 21-225_15A2 | NA | GACATCCAGATGACCCAGTCTCCATCCTCACT GTTTGCATTTATAGGAGACAGAGTCACCATCA CTTGCCGGGCGAGTCAGGGCATTAGCAATTAT TTAGCCTGGTTTCAGCAGAAACCTGGAAAGC CCCTAAGTCCCTGATTTTGCTCATCCAGTT GCAAAGTGGGGTCCCATCAAAGTTTAGCGGCA GTGGATTTGGGACAGATTTCACTTTTCCATCA GCAGCCTGCAGCCTGAAGATTATTGCAAATTAT TACTGCCAACAGTATTATAGTTACCCATTCACT TTCGGCCCTGGGACCAAGTGGATGTCAAA SEQ ID NO: 24827 | GAGGTGCAGCTGGTGGTGAGTCTGGGGGAGGCCTG GTCAAGCCTGGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATTAGTAGTGGTAGTGGTAGT TACATATACTCCAGAGACAACGCCAAGAACTCACT GTATCTGCAAATGAACGCCCTGAGAGCCGAGGA CACGGCTGTGTATTACTGTGCGAGAGTGGCTTCA TTTGACTACTGGGGCCAGGGAACCCTGGTCACCG TCTCCTCA SEQ ID NO: 28833 |

FIGURE 50
(Continued)

| | | AA | DIQMTQSPSSLFAFIGDRVTITCRASQGISNYLAW<br>FQQKPGKAPKSLIFAASSLQSGVPSKFSGSGFGT<br>DFTFPISSLQPEDFANYYCQQYSYPFTFGPGTQ<br>VDVK<br>SEQ ID NO: 24828 | EVQLVESGGGLVKPGGSLRLSCAASGFTFSSYTMN<br>WVRQAPGKGLEWVSSISGSGSYIYYADSVKGRFTIS<br>RDNAKNSLYLQMNALRAEDTAVYYCARVASFDY<br>WGQGTLVTVSS<br>SEQ ID NO: 28834 |
|---|---|---|---|---|
| | | NA | GACATCCAGATGACCCAGTCTCCATCCTCCG<br>GTCTGCATTTGTTGGAGACAGAGTCACCATCA<br>CTTACCGGGCAAGTCAGGGCATTAGAAATGAT<br>TTAGGCTGGTATCAGCAGAAACCAGGGAAAG<br>CCCCTCAGCGCCTGATCTATGCTGCATCCAGT<br>CTGCAAAGTGGGGTCCCATCAAGGTTCAGCGG<br>CAGTGGATATGGGACTGAATTCAATATCACAA<br>TCAGCAGCTTGCAGCTGAAGATTTTGCAATT<br>TATTACTGTATACAGCATAATAGTTACCTGTG<br>GACGTTCGGCCAAGGGACCAAGGTGGAAATC<br>ACA<br>SEQ ID NO: 24829 | CTGGTGCAGTCTGGTGGTGAGTCTGGGGGAGGCGTG<br>GTCCAGCCTGGGAAGTCCCTGAGACTCTCCTGTG<br>CAGCGTCTGGATTCACCTTCAGTGACTATGGCAT<br>ACACTGGGTCCGCCAGGCTCCAGGCAAGGGGCT<br>GGAGTGGGTGGCAGTCATTTGGTTTGATGAAGT<br>AATAAATACTATGCAGACTCCGTGAAGGGCCGA<br>TTCACCATCTCCAGCGACATTCCAAAAACACGC<br>TGTATCTGCAAATGAACAGCCTGAGAGCCGAGG<br>ACACGGCTGTGTATTACTGTGCGAGAGATCTTGG<br>CTGGACGGAAGAGTACTGGGGCCAGGGAACCCT<br>GGTCACCGTCTCCTCA<br>SEQ ID NO: 28835 |
| iPS:393838 | 21-225_6G2 | AA | DIQMTQSPSSRSAFVGDRVTITYRASQGIRNDLG<br>WYQQKPGKAPQRLIYAASSLQSGVPSRFSGSGY<br>GTEFNITISSLQPEDFAIYYCIQHNSYLWTFGQGT<br>KVEIT<br>SEQ ID NO: 24830 | LVQLVESGGVVQPGKSLRLSCAASGFTFSDYGIH<br>WVRQAPGKGLEWVAVIWFDGSNKYYADSVKGRF<br>TISSDNSKNTLYLQMNSLRAEDTAVYYCARDLGW<br>TEEYWGQGTLVTVSS<br>SEQ ID NO: 28836 |

FIGURE 50
(Continued)

| | | | |
|---|---|---|---|
| iPS:393840 | 21-225_3F8 | NA | GACTTCCAGATGACCCAGTCTCCATCTCCCT GTCTGCATCTGTAGGAGACAGAGTCACCATCA CTTGCCGGGCAAGTCAGAGTATTCTCAGCTAT TTAAATTGGTATCGGCAGAAACCAGGGAGAG CCCCTCAGGTCCTGATCCATACTACATCCAGTT TGCAAAGTGGGGGTCCCATCAAGGTTCAGTGGC AGTGGATCTGGGACAGTTTCACTCTCACCAT CAGCAGTCTGCAACCTGAAGATTTTGCAACTT ACTACTGTCAACAGAGTTACAGTACCCGCTC ACTTTCGGCGGAGGGACCAGGGTGGAGATCA AC<br><br>SEQ ID NO: 24831 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGTCCAGGCAAGGGCT GGAGTGGGGGCAGTTATATGCAGGTCAAGGGCCG TAATAAATACTATGCAGAGACAATGCCAAGAACAC GCTGTATCTGCAAATGAACAGCTGAGAGCCGA GGACACGGCTGTGTATTACTGTGCGAGAGATCTG AGTATGGGCGGTATGGACGTCTGGGGCCAAGGG ACCACGGTCACCGTCTCCTCA<br><br>SEQ ID NO: 28837 |
| | | AA | DFQMTQSPSSLSASVGDRVTITCRASQSILSYLN WYRQKPGRAPQVLIHTTSSLQSVPSRFSGSGSG TVFTLTISSLQPEDFATYYCQQTYSTPLTFGGGTR VEIN<br><br>SEQ ID NO: 24832 | QVQLVESGGGVVQPGRSLRLSCAASGFTFSSYGMH WVRQVQARPGKGLEWGAVIWHDGSNKYYADSVKGRF TISRDNAKNTLYLQMNSLRAEDTAVYYCARDLSM GGMDVWGQGTTVTVSS<br><br>SEQ ID NO: 28838 |
| iPS:393844 | 21-225_3G7 | NA | GACGTGCAGCTGACCCAGTCTCCATCTCCCT GTCTGCATCTGTCGTCGGAGACAGAGTCACCGTCA CTTGCCGGGCAAGTCAGAGCATTTACAGGTAT TTAAAATTGGTATCAGGGGAGACCAGGGAGAG GCACTAAACTCCTGGAGTCTATGCTGCATCCAGTT CGCAAAGTGTGGGGGTCCATCAAGATTCAGTGGC AGTGGATCTGGGACAGATTTCACTGTCACCAT CAGTAGTCTTCAACCTGAAGATTTTGCAACTT ATTACTGTCAACAGAGTTACAGTCCCCCTTTC ACTTTCGGCGGAGGGACCAAGGTGGAGATCG AC<br><br>SEQ ID NO: 24833 | CAGGTGCAGCTGGTGGAGTCTGGGGGAGGCGTG GTCCAGCCTGGGAGGTCCCTGAGACTCTCCTGTG CAGCGTCTGGATTCAACTTCAGTAACTATGGCAT GCACTGGGTCCGCCAGGTCCAGGCAAGGGCT GGAGTGGGTGGCAGTCATATGAGACTCGTGAAGGGCCGA TAATAAATACTATGCAGAGACAATTCCAAGAACACGG TTCACCATCTCCAGAGACAATTCCAAGAACACGG TGTATCTGCAAATGAACAGCCTGAGAGCCGAGG ACACGGCTGTGTATTACTGTGCGAGAGATGAGAG GCTGGGGATTTTGACTACTGTGGGGGCCAGGGAACC CTGGTCACCGTCTCCTCA<br><br>SEQ ID NO: 28839 |

FIGURE 50
(Continued)

| | | | |
|---|---|---|---|
| iPS:393848 | 21-225_4H2 | AA | DIQMTQSPSSLSASVGDRVTVTCRASQNIYRYLN WYQGRPGRAPKLMIYAASSSQSGVPSRFSGSGS GTDFTVTISSLQPEDFATYYCQQSYSPPFTFGGG AKVEID | QVQLVESGGGVVQPGRSLRLSCAASGFNFSNYGM HWVRQAPGKGLEWVAVIWHDGSNKYYVDSVKGR FTISRDNSKNTVYLQMNSLRAEDTAVYYCARDERL GIFDYWGQGTLVTVSS |
| | | | SEQ ID NO: 24834 | SEQ ID NO: 28840 |
| | | NA | GACATCCAGATGACCCTGTCTCCATCCTCCCT GTCTGCATCTGTAGGAGACAGAGTCACCATCA CTTGCCGGGCAATTCAGAACATTAGCAGTAT TTAAATTGGTATCAGCAGAGAAACCAGGGAAAG CCCCTAAACTCGTGATCTATGCTGCATCCAGC TTGCAAAGTGGGGTCCCATCAAGGTTCAGTGG CAGAGGATCTGGGACAGATTCACTCTCACCA TCGGTTGTGTGCAACGTGAAGATTTTGCAACT TACTACTGTCAACAGAGTTACAGAACCCCCTT ATTCACTTTCGGCCCTGGGACCAAGGTTGATA TCAAA | GAGGTGCAGCTGTTGGAGTCTGGGGGAGGCTTG GTACAGCCTGGGGGGTCCCTGAGACTCTCCTGTG CAGCCTCTGGATTCAACCTTAGCGCTATGCCAT GAACTGGGTCCGCCAGGCTCCAGGGATGGGGCT GGAGTGGGTCTCAGTTATTAGTCGTAGTGGTGGT TACACATACTACGCGACTCCGTGAAGGGCCGGT TCACCATCTCCAGAGACAATTCCAAGAACACGCT GTATCTGCAAATGAACAGCTGAGAGCCGAGGA CACGGCCGTCTATTACTGTGCGTCCCGTTTAGCA GTGGCTGGCTCGGAGGCTTTGATATCTGGGGCC AAGGGACAAATGGTCACCGTCTCTTCA |
| | | | SEQ ID NO: 24835 | SEQ ID NO: 28841 |
| | | AA | DIQMTLSPSSLSASVGDRVTITCRAIQNISSYLNW YQQKPGKAPKLVIYAASSLQSGVPSRFSGRGSGT DFTLTIGCVQREDFATYYCQQSYRTPLFTFGPGT KVDIK | EVQLLESGGGLVQPGGSLRLSCAASGFTFSGYAMN WVRQAPGMGLEWVSVISRSGGYTYYADSVKGRFT ISRDNSKNTLYLQMNSLRAEDTAVYYCASRLAVAG SEAFDIWGQGTMVTVSS |
| | | | SEQ ID NO: 24836 | SEQ ID NO: 28842 |

FIGURE 50
(Continued)

| | | | |
|---|---|---|---|
| iPS:393852 | 21-225_12A10 | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATACAGACTCATGAAAG TAATAAATACTATACAGACTCCGTGAAGGGCCG ATTCACCATCTCCAGAGACAATTCCAAGAACACG CTGTATCTGCAAATGAACAGCCTGAGAGACGAG GACACGGCTGTGTATTACTGTGCGAGAGACGAG AGGCTGGGGATTTTGACTACTGGGGCCAGGGAA CCCTGGTCACCGTCTCCTCA |
| | | | GACGTCCAGATGACCCAGTCTCCATCCTCCT GTCTGCATCTGCAGGAGACAGAGTCACCATCA CTTGCCGGGCAAGTCAGAGACATTTACAGCTAT TTAAATGGTATCAGCAGAAACCAGGGAGAG CCCCTAAGGTCCTGATCCATACTGCATCCAGT TTGCAAAGTGGGGTCCCATCAAGGTTCAGTGG CAGTGGATCTGGGGCAGATTCACTCTCACCA TCAACAGTCTGCAACCTGAAGATTTTGCAACT TACTACTGTCAGCAGTTACAGTCCCCCTCT CACTTTCGGCGGAGGGACCAAGGTAGAGATC AAA |
| | | | SEQ ID NO: 24837 |
| | | | SEQ ID NO: 28843 |
| | | AA | DVQMTQSPSSLSASAGDRVTITCRASQNIYSYLN WYQQKPGRAPKVLIHTASSLQSGVPSRFSGSGSG ADFTLTINSLQPEDFATYYCQQSYSPPLTFGGGT KVEIK | QVQLVESGGGVVQPGRSLRLSCAASGFTFSSYGMH WVRQAPGKGLEWVAVIWHDESNKYYTDSVKGRF TISRDNSKNTLYLQMNSLRAEDTAVYYCARDERLG IFDYWGQGTLVTVSS |
| | | | SEQ ID NO: 24838 | SEQ ID NO: 28844 |
| iPS:393854 | 21-225_7H11 | NA | GACATCCAGATGACCCAGTCTCCATCCTCCGC ATCTGTCATCTGTAGGAGACAGAGTCACCATCA TTTGCCTGGCAAGTCAGGGCATTAGAAATGAT TTAGGCTGGTATCAGCAGAAACCAGGGAAAG CCCCTAAGCTCCTGATCTATGTTGCATGTAGT TTCCAAAGTGGGGTCCCATCAAGGTTCAGCGG CAGTGGATATGGGACAGAATTCACTCTCACAA TCAGCATCATGCAGCCTGAAGATTTTCGCAACT TATTACTGTCTACAACATATCTTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTT CAGCGTCTGATTCACCTTCAGTGACTATGGCAT GCACTGGGTCCGCCAGGCTCCAGGCAAGGGGCT GGAGTGGGTGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GTTCCGGTCTGACTACTGGGGCCAGGGAACCCTG GTCACCGTCTCCTCA |
| | | | SEQ ID NO: 24839 |
| | | | SEQ ID NO: 28845 |

FIGURE 50
(Continued)

| | | | |
|---|---|---|---|
| iPS:393856 | 21-225_14C2 | AA | DIQMTQSPSSASASVGVRVTITCLASQGIRNDLG WYQQKPGKAPKRIIYVACSFQSGVPSRFSGSGY GTEFTLTISIMQPEDFATYYCLQHNLYPLTFGGG TKVEIK<br>SEQ ID NO: 24840 | QVQLVESGGGVVQPGRSLRLSCSASGFTFSDYGMH WVRQAPGKGLEWVAVIWYDENNKYADSVKGRF TISRDNSKNTLYLQMNSLRAEDTAVYYCARELGFR SDYWGQGTLVTVSS<br>SEQ ID NO: 28846 |
| | | NA | GACATCCAGATGATCCAGTCTCCATCCTCCCT GTTTGCATGTGTAGGAGACAGAGTCATCATCA CTTGCCGGGCAAGTCAGGGCATTAGAAATGAT TTAGACTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCGTGCAGCGTGAAGATTTTGCAACT TATTACTGTGTACAGCATAATAGTTACCCGCT CACTTTCGGCGGAGGGACCAAGGTGGAGATC AGA<br>SEQ ID NO: 24841 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGGTATGACGAAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGGTGTGTATTACTGTGCGAGAGAAGTG GGATTCCGGTCTGACTACTGGGGCCAGGGAACCC TGGTCACCGTCTCCTCA<br>SEQ ID NO: 28847 |
| | | AA | DIQMIQSPSSLFACVGDRVIITCRASQGIRNDLDW YQQKPGKAPKRLIYAASSLQSGVPSRFSGSGSGT EFTLTISSVQREDFATYYCVQHNSYPLTFGGGTK VEIR<br>SEQ ID NO: 24842 | QVQLVESGGGVVQPGRSLRLSCAASGFTFSDYGM HWVRQAPGKGLEWVAVIWYDESNKYEDSVKGR FTISRDNSKNTLYLQMKSLRAEDTGVYYCAREVGF RSDYWGQGTLVTVSS<br>SEQ ID NO: 28848 |

FIGURE 50
(Continued)

| | | | |
|---|---|---|---|
| iPS:393862 | 21-225_5G2 | NA | GACATCCAGATGACCCAGTCTCCATCCTCCC<br>GTCTGCATCTGTAGGAGACAGAGTCACCATCA<br>CTTTCCGGGCAAGTCAGAACATTATTAGTTAT<br>TTAAATTGGTATCAGCAGAAACCAGGGAAAG<br>CCCGTAAGCTCGTGATCTATGGTGCATCCAGT<br>TTGCAAAGTGGGGTCCCATCAAGGTTCAGTGG<br>CAGTGGATCTGGGACAGATTTCACTCTCAACA<br>TCAGAAGTCTGCAACCTGAAGATTTTGCAACT<br>TACTACTGTCAACAGAGTTACAGTACTCCCTT<br>ATTCACCTTTCGGCCCTGGGACCAAAGTGGATA<br>TCAAA<br><br>SEQ ID NO: 24843 | GAGGTGCAGCTGTTGGAGTCTGGGGGAGGCTTG<br>GTACAGCCTGGGGGGTCCCTGAGACTCTCCTGTG<br>CAGCCCTCTGAATTCACCTTTAGCAGCTATGCCAT<br>GAGCTGGGTCCGCCAGGCTCCAGGGAAGGGGCT<br>GGAGTGGGTCTCAGTTATTAGTGGTCGTGGTGTT<br>AACACATTCTACGCAGACTCCGTGAAGGGCCGGT<br>TCACCATCTCCAGAGACAATTCCAAGAACACGCT<br>GTATCTGCAAATGAACAGCCTGAGAGCCGAGGA<br>CACGGCCGTATATTACTGTGCGTCCCGTATAGCA<br>GTGGCTGGCTCGGAGGCTTTTGATATCTGGGGCC<br>AAGGGACAATGGTCACCGTCTCTTCA<br><br>SEQ ID NO: 28849 |
| | | AA | DIQMTQSPSPSASVGDRVTITFRASQNIISYLNW<br>YQQKPGKARKLVIYGASSLQSGVPSRFSGSGSGT<br>DFTLNIRSLQPEDFATYYCQQSYSTPLFTFGPGTK<br>VDIK<br><br>SEQ ID NO: 24844 | EVQLLESGGGLVQPGGSLRLSCAASEFTFSSYAMS<br>WVRQAPGKGLEWVSVISGRGVNTFYADSVKGRFTI<br>SRDNSKNTLYLQMNSLRAEDTAVYYCASRIAVAGS<br>EAFDIWGQGTMVTVSS<br><br>SEQ ID NO: 28850 |
| iPS:393864 | 21-225_4C5 | NA | GACATCCAGATGACCCAGTCTCCATCCTCCCT<br>GTCTGCATCTGTAGGACACAGAGTCACCATCA<br>CTTGCCGGGCAAGTCGGGGCATCAGAGGTGAT<br>TTAGGTTGGTATCGCCAGAAACCAGGGAAAGC<br>CCCTAAGCGCCTTGATCTATGCTGCATCCAATTT<br>GCAAAGTGGGGTCCCATCAAGGTTCAGCGGCA<br>GTGGATATGGGACAGAATTCACTCTCACAATC<br>GGCAGCCTGCAGCCTGAAGATTTTGCAACTTA<br>TTACTGTCTACAGCATTATAGTTACCCTCGGAC<br>GTTCGGCCAAGGGACCAAGGTGGAAATCAAA<br><br>SEQ ID NO: 24845 | CAGGTGCAACTGGTGGAGTCTGGGGGAGGCGTG<br>GTCCAGCCTGGGAGGTCCCTGAGACTCTCCTGTG<br>CAGCGTCTGGATTCACCTTCAGTAGTTATGTCCT<br>GCACTGGGTCCGCCAGGCTCCAGGCAAGGGGCT<br>GGAGTGGGTGGCAGTTATATGCAGACTCCGTGAAGT<br>AATAAATACTATGCAGACTCCGTGAAGGGCCGA<br>TTCACCATCTCCAGAGACAATTCCAAGAACACGC<br>TATATCTGCAAATGAACAGCCTGAGAGCCGAGG<br>ACACGGCTGTTTATTACTGTGCGCGAGAAAGTA<br>TACCAGCAGCTGGTACGACTACGGTATGGACGTC<br>TGGGGCCAAGGGACCACGGTCACCGTCTCCTCA<br><br>SEQ ID NO: 28851 |

FIGURE 50
(Continued)

| | | | |
|---|---|---|---|
| iPS:393866 | 21-225_14E3 | AA | DIQMTQSPSSLSASVGHRVHLTCRASRGIRGDLG WYRQKPGKAPKRLIYAASNLQSGVPSRFSGSGY GTEFTLTIGSLQPEDFATYYCLQHYSYPRTFGQG TKVEIK<br><br>SEQ ID NO: 24846 | QVQLVESGGGVVQPGRSLRLSCAASGFTFSSYVLH WVRQAPGKGLEWVAVIWYDGSNKYYADSVKGRF TISRDNSKNTLYLQMNSLRAEDTAVYYCAREKYTS SWYDYGMDVWGQGTTVTVSS<br><br>SEQ ID NO: 28852 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAACAAAAACCAGGGAAAG CCCCTAAGCGCATTATTTATTCTGCATCCAGTT TGCAAAGTGGGGTCCCATCAAGGTTCATCGGC AGTGGATGTGGGACTGAATTCACTCTCACAAT CAGCAGCCTGCAGCCTGAAGATTTTGCAGCTT ATTACAGTGTACAGCATTATAGTTACCCGTTC ACTTTCGGCGGAGGGACCAAGGTGGAGATCA AA<br><br>SEQ ID NO: 24847 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTTGGCAT GCACTGGGTCCGCCAGGCTCCAGGCAAGGGGCT GGAGTGGGTGGCAGTTATTGGTATGGAAGAAAT AATCAATACTATGCAGACTCCGTGAAGGGCCGAT TCACCATCTCAGAGACAATTCCAAGAACACGCT GTATCTGCAAATGAACAGCTGAGAGCCGAGGA CACGGCTTTTATTACTGTGCGAGAGAGTGGGG TTCCGGTCTGACTACTGGGCCAGGGAACCCTGG TCACCGTCTCCTCA<br><br>SEQ ID NO: 28853 |
| | | AA | DIQMTQSPSSLSASVGDRVTITCRASQGIRNDLG WYQQKPGKAPKRIIYSASSLQSGVPSRFIGSGCG TEFTLTISSLQREDFAAYYSVQHYSYPFTFGGGT KVEIK<br><br>SEQ ID NO: 24848 | QVQLVESGGGVVQPGRSLRLSCAASGFTFSDFGMH WVRQAPGKGLEWVAIWYEENNQYYADSVKGRF TISRDNSKNTLYLQMNSLRAEDTAFYYCARELGFR SDYWGQGTLVTVSS<br><br>SEQ ID NO: 28854 |

FIGURE 50
(Continued)

| | | | |
|---|---|---|---|
| iPS:393868 | 21-225_9C11 | NA | GACATCCAGATGACCCAGTCCTCATCCTCCT GTCTGCATCTGTAGGAGACAGAGTCACCATCA CTTGCCGGGCAAGTCAGAACATTAGAAATTAT TTAAATTGGTATCAGCAGAAATCAGGGAGAGC CCCTAAGCTCCTGATCTATGTTGCATCCAGTTT GCAAAGTGGGGGTCCCATCAAGGTTCAGTGGCA GTGGATCTGGGACAGAATTCACTCTCACCATC AACAGTCTGCAACCTGAAGATTTTGCAATTTA TCACTGTCATCAGAGTAACAGTACTCCTCTCA CGTTCGGCCAAGGGACCAAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCATGATGAAACT AATAAATACTATGCAGATTCCGTGAAGGGCCGAT TCACCATCTCCAGAGACAATTCCAAGAACACGCT GTCTCTGCAAATGAACAGCCTGAGAGCCGAGGA CACGGCTGTGTATTACTGTGCGAGAGACGAGAG GCTGGGGATTTTGACTACTGGGGCCAGGGAACC CTGGTCACCGTCTCCTCA |
| | | | SEQ ID NO: 24849 | SEQ ID NO: 28855 |
| | | AA | DIQMTQSPSSLSASVGDRVTITCRASQNIRNYLN WYQQKSGRAPKLLIYVASSLQSGVPSRFSGSGSG TEFTLTINSLQPEDFAIYHCQSNSTPLTFGQGTK VEIK | QVQLVESGGGVVQPGRSLRLSCAASGFTFSSYGMH WVRQAPGKGLEWVAVICMMKLNKYYADSVKGRF TISRDNSKNTLSLQMNSLRAEDTAVYYCARDERLG IFDYWGQGTLVTVSS |
| | | | SEQ ID NO: 24850 | SEQ ID NO: 28856 |
| iPS:393870 | 21-225_7B1 | NA | GATATCCAGATGACCCAGTCCTCCATCCTCACT GTCTGCTTCTGGGCGAGTCAGAGACAGAGTCACCATCA CTTGTCGGGCGAGTCAGGACATTAGCAATCAT TTAGTCTGGTTTCAGCAGAAACCAGGGAAAGC CCCTAAGTCCCTGATCTTTGCTGCATCCAGTTT ACAAAGTGGGGTCCCATCACGGTCAGTGGCA GTGGATCTGGAACAGATTTCACTCTCACCATC AGCAGCCTGCAGCCTGAGGATTTTGCAACTTA TTACTGCCACCAGTATAATAGTTACCCCTTCAC TTTCGGCCCTGGGACCAAAGTGGATTTCAAA | GAGGTGCAGCTGTGTTGGAGTCTGGGGGAGGCTTG GTACAGCCTGGGGCGGCTGCCTGAGACTCTCCTGTG CAGCCTCTGGATTCACCTTAGCAGCTATGACAT GAGCTGGGTCCGCCAGGCTCCAGGGAAGGGGCT GGAGTGGGTCTCAACTATTAGTGGTAGTGGTGGT ATCACATACACCAGACTCCGTGAAGGGCCGGT TCACCATCTCCAGAGACAACGCCCAAGAACAAGCT GTATCTGCAAATGAACAGCCTGAGAGCCGAGGA CACGGCCGTATATTCTGTGCGAGAGATGGGCC AGGGTCTGGGGCCAGGGAACCCTGGTCACCGTCT CCTCA |
| | | | SEQ ID NO: 24851 | SEQ ID NO: 28857 |

FIGURE 50
(Continued)

| | | | | |
|---|---|---|---|---|
| iPS:393872 | 21-225_2A11 | AA | DIQMTQAPSSLSASVGDRVTITCRASQDISNHLV WFQQKPGKAPKSLIFAASSLQSGVPSQFSGSGSG TDFTLTISILQPEDFATYYCHQYNSYPFTFGPGTK VDFK | EVQLLESGGGLVQPGGSLRLSCAASGFTFSSYDMS WVRQAPGKGLEWVSTISGSGGITYADSVKGRFTI SRDNSKKTLYLQMNSLRAEDTAVYFCARDRGSVW GQGTLVTVSS |
| | | | SEQ ID NO: 24852 | SEQ ID NO: 28858 |
| | | NA | GACATCCAGATGACCCAGTCTCCATCCTCCCT GTCTCCATCTGTAGGAGACAGAGTCACCATCA CTTGCCGGGCAAGTCAGGGCATTAGAAATGAT TTAGGCTGGTATCAGCAGAAACCAGGGAAAG CCCCTCAGCGCCTGATCTCTGCTGCATCCAGTT TGCAAAGTGGGGTCCCATCAAGGTTCAGCGGC AGTGGATCTGGGACAGATTTCACTCTCACAAT CAGCAGTTTGCAGCCTGAAGATTTTGCAACTT ATTACTGTCTACAGCATATAGTTACCCGCTC ACTTTCGGCGGAGGGACCAAGATGGAGATCA AA | CAGCTGCAGTCTGCAGGAGTCGGGCCCAGGACTG GTGAAGCCTTCTGGTGGCTCCATCAGTAGGAGTTA CTGTCTCTGGTGGCTCCATCAGTAGTAGTTA CTACTGGGGCTGGATCCGGCAGCCCCAGGGAA GGGGCTGGAGTGATTGGAATATCATTATAGT GGGAGCACCTACTACAACCCGTCCGTCAAGAGTC GAGTCACCATATCGTAGACACGTCCAAGAACC AGTTCTCCCTGAAGCTGAGTACTGTGACCGCGC AGACACGGCTGTGTATTACTGTGCGAGACATGA AAAGACTGGGGCCTTGAAGACTGGGGCCAGGA ACCCTGGTCACCGTCTCCTCA |
| | | | SEQ ID NO: 24853 | SEQ ID NO: 28859 |
| | | AA | DIQMTQSPSSLSPSVGDRVTITCRASQGIRNDLG WYQQKPGKAPQRLISAASSLQSGVPSRFSGSGSG TDFTLTISSLQPEDFATYYCLQHNSYPLTFGGGT KMEIK | QLQLQESGPGLVKPSETLSLTCTVSGGSISRSSYYW GWIRQPPGKGLEWIGNIYYSGSTYNPSVKSRVTIS VDTSKNQFSLKLSTVTAADTAVYYCARHGKDWGL EDWGQGTLVTVSS |
| | | | SEQ ID NO: 24854 | SEQ ID NO: 28860 |

FIGURE 50
(Continued)

| | | | | |
|---|---|---|---|---|
| iPS:393874 | 21-225_4C8 | NA | GACATCCAGATGATCCAGTCTCCATCCTTCCT GTTTGCATGTGTAGGAGACAGAGTCACCATCA CTTGCCGCGGGCAAGTCAGGCATTAGAAATGAT TTAGGCTGGTATCAGCAGAAACCAGGAAAG CCCCTAAGCGCCTGATATATGCTGCATCCAGT TTGCAAAGTGGGGGTCCCATCAAGGTTCAGCGG CAGTGTATCTGGGACAGAATTCACTCTCACAA TCAGCAGCCTGCAGCCTGAAGATTTCGCAACT TATTACTGTCTACAGCATAATAGTTACCCGCTC ACTTTCGGCGGAGGGACCAAGGTGGAGATCA AA SEQ ID NO: 24855 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTGCAAATGAACAGCTGACAGCCGAGGA CACGGCTGTTTATTACAGTCCGAGAGAAATGGGG TTCCTGTCTGACTACTGGGGCCAGGAACCCTGG TCACCGTCTCCTCA SEQ ID NO: 28861 |
| | | AA | DIQMIQSPSFLFACVGDRVTITCRASQGIRNDLG WYQQKPGKAPKRLIYAASSLQSGVPSRFSGSVS GTEFTLTISSLQPEDFATYYCLQHNSYPLTFGGG TKVEIK SEQ ID NO: 24856 | QVQLVESGGGVVQPGRSLRLSCAASGFTFSNYGM HWVRQAPGKGLEWVAVIWYEENNQYYADSVKGR FTISRDNSKNTLYLQMNSLTAEDTAVYYSPREMGF LSDYWGQGTLVTVSS SEQ ID NO: 28862 |
| iPS:393876 | 21-225_9A1 | NA | GACATCCAGATGACCCAGTCTCCATCCTCCCG GTCTGCATTTGTTGGAGACAGAGTCACCATCA CTTGCCGGGCAAGTCAGGGCATTAGAAACAA TTAGGGTGGTATCAGCAGAAAACCAGGAAAG CCCGTAAGCGCCTGATCTATACTGCATCCAGT TTGCAAAGTGGGGTCCCATCAAGGTTCAGCGG CAGTGGATATGGGACTGAATTCACTATCACAA TCAGCAGCTTGCAGCCTGAAGATTTTGCAACT TATTACTGTCTATACAGCATAATAGTTACCTGTG GACGTTCGGCCAAGGGACCAAGGTGAAATC AAA SEQ ID NO: 24857 | CAGGTGCAGGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGCAGACTCCGTGAAGT AATAAATACTATGCAGACTCCGTGAAGGGCCGA TTCACCATCTCCAGAGACAATTCCAAGAACACGC TGTATCTGCAAATGAACAGTCTGAGAGCCGAGG ACACGGCTGTGTATTACTGTGCGAGAGATCTTGG CTGGACGGAAGAGTACTGGGGCCAGGAACCCTG GGTCACCGTCTCCTCA SEQ ID NO: 28863 |

FIGURE 50
(Continued)

| | | | |
|---|---|---|---|
| iPS:393878 | 21-225_7G12 | AA | DIQMTQSPSSRSRSAFVGDRVTITCRASQGIRNDLG WYQQKPGKARKRLIYTASSLQSGVPSRFSGSGY GTEFTITISSLQPEDFATYYCIQHNSYLWTFGQGT KVEIK<br>SEQ ID NO: 24858 | QVQVVESGGGVVQPGRSLRLSCAASGFTFSDYGM HWVRQAPGKGLEWVAVIWFDGSNKYYADSVKGR FTISRDNSKNTLYLQMNSLRAEDTAVYYCARDLG WTEEYWGQGTPVTVSS<br>SEQ ID NO: 28864 |
| | | NA | GACATCCAGATGACCCAGTCTCCATCCTCCCT GTCTGCATCTGTAGGAGACAGAGTCTCCATCA CTTGCCGGGCAAGTCAGAATATTAACAACTAT TTAAATTGGTATCAGCAGAAACCAGGGAAAG GCCCTAAGGTCCTGATCCTTACTGCATCCAGTT TGCAAAGTGGTGGGTCCATCAAGGTTCAGTGGC AGTGGATCTGGGACAGATTTCACTCTCACCAT CAACAGTCTGCAACCTGAAGATTTTGCAACTT ACTACTGTCAACAGAGTTACACTACCCCCACG TGGACGTTCGGCCAAGGGACCAAGGTGGAAA TCAAA<br>SEQ ID NO: 24859 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGTTATTAGTGGTAGTGGTGGT AGCACATACTACGCAGACTCCGTGAAGGGCCGG TTCACCATCTCCAGAGACAATTCCAAGAACACGC TGTATTTGCAAATGAACACCCTGAGAGCCGAGG ACACGGCCGTATATTACTGTGCGAAAAGGTATAC CAGTGACTGGCATGATGCTTTTGATATCTGGGGC CAAGGGACAATGGTCACCGTCTCTTCA<br>SEQ ID NO: 28865 |
| | | AA | DIQMTQSPSSLSASVGDRVSITCRASQNINNYLN WYQQKPGKGPKVLILTASSLQSGVPSRFSGSGSG TDFTLTINSLQPEDFATYYCQQSYTTPTWTFGQG TKVEIK<br>SEQ ID NO: 24860 | EVQLLESGGGLVQPGGSLRLSCAASGFTFSSYAMN WVRQAPGKGLEWVSVISGSGGSTYYADSVKGRFTI SRDNSKNTLYLQMNTLRAEDTAVYYCAKRYTSDW HDAFDIWGQGTMVTVSS<br>SEQ ID NO: 28866 |

FIGURE 50
(Continued)

| | | | |
|---|---|---|---|
| iPS:393880 | 21-225_15A1 | NA | GACATCCAGATGACCCAGTCCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGTTCTGGGACAGAATTCACTCTCACAG TCAGCAGCCTGCAGCCTGAAGATTTTGCAAGT TATTACTGTCTACAACAGTAGTTACCCTGTT AAGTTTGGGGAGGGATAAAGGTGGAGATCA CA |
| | | | SEQ ID NO: 24861 |
| | | AA | DIQMTQSPSSLSASVGDRVTITCRASQGIRNDLG WYQQKPGKAPKRLIYAASSLQSGVPSRFSGSGS GTEFTLTVSSLQPEDFASYYCLHNSSYPVKFGGG IKVEIT |
| | | | SEQ ID NO: 24862 |
| iPS:393882 | 21-225_15E3 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TCGCAAAGTGGGTCCCATCAAGGTTCAGCGG CAGTCGATCTGGGACAGAATTCACTCTCACAA TCAGCAGCCTGCAGCCTGAAGATCTTGCAGT TATTACTGTCTACAGCATCATAGTTACCCGCTC ACTTTCGGCGGAGGGACCGAGGTGGAGATCTA C |
| | | | SEQ ID NO: 24863 |

| | | | |
|---|---|---|---|
| | | | CAGCTGCATCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAGTATCTATTATAGT GGGAGCGCCAGTACAACCCGTCCCTCAAGAGT CGAGTCACCATATCCGTAGACACGAGCAAGAAC CAGTTCTCCCTGACGCTGAGCTCTGTGACCGCG CAGACACGGCTGTATATTACTGTGCGAGACTGAG CAGCAGCTGGTCTTTTGACTACTGGGGCCAGGGA ACCCTGGTCACCGTCTCCTCA |
| | | | SEQ ID NO: 28867 |
| | | | QLHLQESGPGLVKPSETLSLTCTVSGGSISRSSYYW GWIRQPPGKGLEWIGSIYYSGSAQYNPSLKSRVTIS VDTTKNQFSLTLSSVTAADTAVYYCARLSSWSFD YWGQGTLVTVSS |
| | | | SEQ ID NO: 28868 |
| | | | CAGGTGCAGTTGGTGGAGTCTGGGGAACCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGGTATGGAGAAAA TAATAACACTATGCAGACTCCGTGAAGGGCCG ATTCACCATCTCCAGAGACAACAATTCCAAGAACG CTGTATCTGCAAATGAACAGCCTGAGAGCCGAG GACACGGCTGTGTATTACTGTGCGAGAGAGCTGG GGTTCCTCTCTGACTACTGGGGCCAGGGAACCCT GGTCACCGTCTCCTCA |
| | | | SEQ ID NO: 28869 |

FIGURE 50
(Continued)

| | | | |
|---|---|---|---|
| iPS:393884 | 21-225_16F4 | AA | DIQMTQSPSSLSASVGDRVTITCRASQGIRNDLG WYQQKPGKAPKRLIYAASSSQSGVPSRFSGSRSG TEFTLTISSLQPEDLAAYYCLQHHSYPLTFGGGT EVEIY SEQ ID NO: 24864 | QVQLVESGGTVVQPGRSLRLSCAASGFTFSSYGMH WVRQAPGKGLEWVAVIWYEENNKHYADSVKGRF TISRDNSKNTLYLQMNSLRAEDTAVYYCARELGFL SDYWGQGTLVTVSS SEQ ID NO: 28870 |
| | | NA | GACATCCAGATGATCCAGTCTCCATCCTCCC GTCTGCATCTGTAGGAGACAGAGTCACCATCA CTTGCCGGGCAAGTCAGGGCATTAGAAATGAT TTAGGCTGGTATCAGCAGAAATCAGGGAAAG CCCCTAAGCGCCTGATATATGTTGCATCCAGT TTGCAAAGTGGGGTCCCATCAAGGTTCAGCGG CAGTGGATCTGGGACAGAATTCACTATCACAA TCAGCAGCGTGCAGCCTGAAGATTTTGCAACT TATTACTGTGTATACAGCATAATAGTTATCCGTTC ACTTTCGGCGGAGGGACCAAGGTGGAGATCA AA SEQ ID NO: 24865 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGAAGGAAG TAATCAATACTATGCAGACTCCGTGAAGGGCCG ATTCACCATCTCCAGAGACAATTCCAAGAACACG GTGTATCTGCAAATGCACAGCCTGAGAGCCGAG GACACGGCTGTGTATTACTGTGCGAGAGAGCTGG GGTTCCTCTGACTACTGGGGCCAGGGAACCCT GGTCACCGTCTCCTCA SEQ ID NO: 28871 |
| | | AA | DIQMIQSPSSPSASVGDRVTITCRASQGIRNDLG WYQQKSGKAPKRLIYVASSLQSGVPSRFSGSGS GTEFTITISSVQPEDFATYYCIQHNSYPFTFGGGT KVEIK SEQ ID NO: 24866 | QVQLVESGGGVVQPGRSLRLSCAASGFTFSNYGM HWVRQAPGKGLEWVAVIWYEGSNQYYGDSVKGR FTISRDNSKNTVYLQMHSLRAEDTAVYYCARELGF LSDYWGQGTLVTVSS SEQ ID NO: 28872 |

FIGURE 50
(Continued)

| | | | | |
|---|---|---|---|---|
| iPS:393886 | 21-225_2G9 | NA | GACATCCAGATGACCCAGTCTCCATCCTCCCT GTTTGCATCTGTGGAGACAGAGTCACCATCA CTTGCCGGGCAAGTCAGGGCATTAGAAATGAT TTAGGTTGGTATCAGCAGAAACCAGGGAAAG CCCCTCAGCGCCTGATCTATGCTGCATCCAGT TGCAAAGTGGAGTCCCATCAAGGTTCAGCGGC AGTGGATTTGGGACAGAATTCACTCTCACAAT CAGCAGCCTGCAGCTTGAAGATTTTGCAACTT ATTACTGTTTACAGCATGATGAAAGTTACCCTCTC ACTTTCGGCGGAGGGACCAAGGTGGAAATCA AA | CAACTGCAGTCGCAGGAGTCGGGCCCAGGACTG GTGAAGCCTTCGGAGACCCTGTCCCTCACCTGCA CTGTCTCTGGTGGCTCCATCAGACTTACTA CTGGGGCTGGATCCGCCAGCCCCAGGGAAGG GCTGGAGTGGATTGGTAGTATCTATTATAGTGGA AGCACCTCTACAACCCGTCCCTCAACAGTCGAG TCACCATATCCGTGGACACGTCCAAGAACCAGTT CTCCCTGAAGCTGAACTCTGTGACCGCCAGAC ACGGCTGTGTATTACTGTGCGAGACTAAGCAGCA ACTGGGACTTTGACAACTGGGGCCAGGGAACCC TGGTCACCGTCTCCTCA SEQ ID NO: 28873 |
| | | AA | DIQMTQSPSSLFASVGDRVTITCRASQGIRNDLG WYQQKPGKAPQRLIYAASSLQSGVPSRFSGSGF GTEFTLTISSLQLEDFATYYCLQHESYPLTFGGGT KVEIK SEQ ID NO: 24868 | QLQLQESGPGLVKPSETLSLTCTVSGGSIRPNYYWG WIRQPPGKGLEWIGSIYYSGSTSYNPSLNSRVTISVD TSKNQFSLKLNSVTAADTAVYYCARLSSNWDFDN WGQGTLVTVSS SEQ ID NO: 28874 |
| iPS:393888 | 21-225_3E3 | NA | GACATCCAGATGACCCAGTCTCCATCCTCCCC GTCTGCATCTGTAGGAGACAGAGTCACCATCA CTTTCCGGGCAAGTCAGAGCATTAGAAGTTAT TTAAATTGGTATCAGCAGAAACCAGGGAAAG CCCATAAAACTCGTGATCTATGCTGCATCCAGT TTGCAAAGTGGGGTCCCATCAAGGTTCAGTGG CAGTGGATCTGGGACAGACTTCACTCTCACCA TCAGCAGTCTGCAACCTGAAGATTTTGCAACT TACTACTGTCTACAACAGAGTTACAGTACCCCCTT GTCACTTTCGGCCCTGGGACCAAAGTGGATA TCAAA SEQ ID NO: 24869 | GAGGTGCAGCTGTTGGAGTCTGGGGGAACCTTGG TACAGCCTGGGGGGTCCCTGAGACTCTCCTGTGC AGCCTCTGAATTCACCTTTAGCAGCTATGTCATG AGCTGGGTCCGCCAGGCTCCAGGGAAGGGGCTG GAGTGGGTCTCAATTATTAGTGGTGGTAGTGTA ACACATTCTACGCAGACTCCGTGAAGGGCCGGTT CCACCATCTCCAGAGACAATTCCAAGAACACGCTG TATCTGCAAATGAACAGCCTGAGAGCCGAGGAC ACGGCCTTATATTACTGTGTCCGTCCGTTAGCAG TGGCTGGCTCGGAGGCTTTGATATCGGGGCCA AGGGACAATGGTCACCGTCTCTTCA SEQ ID NO: 28875 |

FIGURE 50
(Continued)

| | | | |
|---|---|---|---|
| iPS:393890 | 21-225_4B1 | AA | DIQMTQSPSSPSASVGDRVTITFRASQSIRSYLNW YQQKPGKAHKLVIYGTSSLQSGVPSRFSGSGSGT DFTLTISSLQPEDFATYYCQQSYSTPLFTFGPGTK VDIK<br>SEQ ID NO: 24870 | EVQLLESGGTLVQPGGSLRLSCAASEFTFSSYVMS WVRQAPGKGLEWVSIISGRGGNTFYADSVKGRFTI SRDNSKNTLYLQMNSLRAEDTALYYCASRLAVAG SEAFDIWGQGTMVTVSS<br>SEQ ID NO: 28876 |
| | | NA | GACATCCAGATGACCCAGTCTCCATCCTCCT GTCTGCATCTGTAGGCGACAGAGTCACCATCA CTTGCCGGGCAAGTCATACCATTAGAACCTAT TTAAACTGGTATCAGCAGAAACCAGGGAAAG CCCCTAAGCTCCTGATCTATGGTGCATCCAGTT TGCAAAGTGGGGTCCCATCAAGGATCAATGGC AGTGGATCTGGGACAGATTTCACTCTCACCAT CACCAAATCTACAGCCTGAAGAGTTACAATATCTCATTC ACTACTGTCAACAGAGTTACAATATCTCATTC AGTTTCGGCCCTGGGACCAAAGTGGATATCAA A<br>SEQ ID NO: 24871 | CAGGTGCAGCTGCAGGAGTCGGGCCAGGACTG GTGAAGCCTTCGGAGACCCTGTCCCTCACCTGTA GTGTCTCTGGTGACTCCATCAGTAGTTACTCCTG GAGCTGGATCCGGCAGCCCGCCGGGAAGGGACT GGAATGGATTGGGCGTATCTATACCAGTGGAGC ACCAACTACAATCCCCCTCCAAGAGTCGAATCA CCATGTCAGTAGACACGTCCAAGAACCAGTTCTC CCTGAAGCTGAGCTCTGTGACCGCCGCGGACACG GCCGTGTATTACTGTGCGAGAGATTTGAAGAGCA GTGGCTGCCTTTTCTTTGACTACTGGGGCCAGGG AACCCTGGTCACCGTCTCCTCA<br>SEQ ID NO: 28877 | |
| | | AA | DIQMTQSPSSLSASVGDRVTITCRASHTIRTYLN WYQQKPGKAPKLLIYAASSLQSGVPSRINGSGSG TDFTLTITNLQPEDFATYYCQQSYNISFTFGPGTK VDIK<br>SEQ ID NO: 24872 | QVQLQESGPGLVKPSETLSLTCSVSGDSISSYSWSW IRQPAGKGLEWIGRIYTSGSTNYIPSLKSRITMSVDT SKKQFSLKLSSVTAADTAVYYCARDLKSSGCLFFD YWGQGTLVTVSS<br>SEQ ID NO: 28878 |

FIGURE 50
(Continued)

| | | | |
|---|---|---|---|
| iPS:393892 | 21-225_6G7 | NA | GACATCCAGATGACCCAGTCTCCATCCTCCG GTCTGCATCTGTAGGAGACAGAGTCACCATCA CTTGCCAGGCGAGTCAGGACATTAGCAACTAT TTAAATTGGTATCAACAGAAACCAGGGAAAG CCCTTAAGCTCTTGATATACGATGCATCCACTT TGGAAACAGGGGTCCCCTCAAGGTTCAGTGGA AGTGGATCTGGGACAGATTTTACTTTCACCAT CAGCAGCCTGCAGCCTGAAGATATTGCAACAT ATTACTGCCAACAGTATGATAATGTCCCGATC ACCTTCGGCCAAGGGACACGACTGGAGATTAA A<br><br>SEQ ID NO: 24873 | CAGGTGCAGCTGGTGGAGTCTGGGGGAGGCGTG GTCCAGCCTGGGAGGTCCCTGAGACTCTCCTGTG CAGCCTCTGGATTTACCTTCAGTAGCTATGGCAT GCACTGGGTCCGCCAGACTCCAGGCAAGGGGCT GGAGTGGGTGGCAATTATATCATATGTTGGAAAG AATAAATATTATGCAGACTCCGTGAAGGGCGAT TCACCATCTCCAGAGACAATTCCAAGAACACGCT GTATCTGCAAATGAACAGCTGAGAGCTGAGGA CACGGCTGTGTATTACTGTGCGAGACGGGGAAA CAGCTATGCGGGTACGGTATGGACGTCTGGGG CCAAGGGACTACGGTCACCGTCTCCTCA<br><br>SEQ ID NO: 28879 |
| | | AA | DIQMTQSPSSRSASVGDRVTITCQASQDISNYLN WCQQKPGKALKLLIYDASTLETGVPSRFSGSGS GTDFTFTISSVQPEDIATYYCQQYDNVPITFGQGT RLEIK<br><br>SEQ ID NO: 24874 | QVQLVESGGGVVQPGRSLRLSCAASGFTFSSYGMH WVRQTPGKGLEWVAIISYVGKNKYYADSVKGRFTI SRDNSKNTLYLQMNSLRAEDTAVYYCARRGNSYG GYGMDVWGQGTTVTVSS<br><br>SEQ ID NO: 28880 |
| iPS:393894 | 21-225_5E11 | NA | GTCATCCAGATGACCCAGTCTCCATCCTCACT GTCTGCCTCTGGGGACAGAGTCACCATCA CTTGTCGGGCGAGTCAGGGCATTAGCAATTAT TTAGCCTGGTTTCAGCAGAAACCAGGGAAAGC CCCTAAGTCCCTGATCAATGCTGCATCCAGTG TGCAGAGTGGGGTCCCATCAAAATTCAGCGGC AATGGATCTGGGACAGACTTCACTCTCACCAT CAGCAGCCTGCAGCCTGAAGATTTTGCAACTT ATTACTGCCACCAGTATCACAGTTACCCATTC ACTTTCGGCCCTGGGACCAAAGTGGATATCAA A<br><br>SEQ ID NO: 24875 | GAGGTGCAGCTGGTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTTTTACTGTGCGAGAGTGGCTTCA TTTGACTACTGGGGCCAGGGAACCCTGGTCACCG TCTCCTCA<br><br>SEQ ID NO: 28881 |

FIGURE 50
(Continued)

| | | | | |
|---|---|---|---|---|
| iPS:393896 | 21-225_2_A4 | AA | VIQMTQSPSSLSASVGDRVTITCRASQGISNYLA WFQQKPGKAPKSLINAASSVQSGVPSKFSGNGS GTDFTLTISSLQPEDFATYYCHQYHSYPFTFGPG TKVDIK<br>SEQ ID NO: 24876 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVFYCARVASFDYW GQGTLVTVSS<br>SEQ ID NO: 28882 |
| | | NA | GACATCCAGATGACCCAGTCTCCATCCTCACT GTTTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGCGCCTGATCTATACTGCATCCAGTTT GCAAAGTGGGGTCCCATCAAAGTTCAGCGGCA GTGGATTTGGGACAGATTTCACTCTCACCATC AGCAGCCTGCAGCCTGAAGATTTTGCAACTTA TTACTGCCAACAGTATATAGTTACCCATTCA CTTTCGGCCCTGGGACCAAAGTGGATATCAAA<br>SEQ ID NO: 24877 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGA ATCGCCATCTCCAGAGACAACGCCAAGAACTCG CTGTATCTGCAAATGAACAGCCTGAGAGCCGAG GACACGGCTGTATATTACTGTGCGAGAGTGGCTT CATTTGACTACTGGGGCCAGGGAACCCTGGTCAC CGTCTCCTCA<br>SEQ ID NO: 28883 |
| | | AA | DIQMTQSPSSLFASVGDRVTITCRASQGISNYLA WFQQKPGKAPKRLIYTASSLQSGVPSKFSGSGFG TDFTLTISSLQPEDFATYYCQQYNSYPFTFGPGT KVDIK<br>SEQ ID NO: 24878 | EVQLVESGGGLVKPGGSLRLSCAASGFTFSSYSMN WVRQAPGKGLEWVSSISGSSTYIYYADSVKGRIAIS RDNAKNSLYLQMNSLRAEDTAVYYCARVASFDY WGQGTLVTVSS<br>SEQ ID NO: 28884 |

FIGURE 50
(Continued)

| | | | |
|---|---|---|---|
| iPS:393898 | 21-225_5F7 | NA | GACATTCAGATGACCCAGTCTCCATCCTCCCCTGTCTGCATCTGTAGGAGACAGAGTCACCATCACTTGCCGGGCAAGTCAGAGCAGAACATTAGTAGTTATTTAAATTGGTATCAGCAGAAACCAGGGAAAGCCCCTAAACTCCTGATCTCTGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAATACCCCTTATTCACTTTCGGCCCTGGGACCAAAGTGTGTTATCAAA<br>SEQ ID NO: 24879 | GAGGTGCAGTTGTTGGAGTCTGGGGGAGGCTTGGTACAGCCTGGGGGGTCCCTGAGACTCTCCTGTGCAGCCTCTGAATTCACCTTTAGCAGCTATGCCATGAGCTGGGTCCGCCAGGCTCCAGGGAAGGGGCTGGAGTGGGTCTCAATTATTAGTGGTCGTGGTGGTAGACACATTCTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGTCCCGTATAGCAGTGGCTGGCTCGGAGGCTTTTGCTATCTGGGGCCAAGGGACAATGGTCACCGTCTCTCA<br>SEQ ID NO: 28885 |
| | | AA | DIQMTQSPSPSASVGDRVTITFRASQTISSYLNWYQQKPGKAPKLLISAASSLQSGVPSRFSGSGSGTDFTLTISSLQPEDFATYYCQQSYNTPLFTFGPGTKVVIK<br>SEQ ID NO: 24880 | EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRIAVAGSEAFAIWGQGTMVTVSS<br>SEQ ID NO: 28886 |
| iPS:393900 | 21-225_10E12 | NA | GACATCCAGATGACCCAGTCTCCATCCTCCCTGTCTGCATCTGTAGGAGACAGAGTCACCATCACTTGCCGGGCAAGTCAGAGCATTACAGTTATTTAAATTGGTATCAGCAGAAACCAGGGAGAGCCCCTAAAGCTCCTGATCTATGCAAGGTTCGGTGGCAGTGGATCTGGGACAGATTTCACTCTCACCATCAGCAGTCTACAACCTGAAGATTACAGTTTTGCAACTTACTACTGTCAACAGAATTACAGTCCCCCCTCACTTTCGGCGGAGGGACCAAGGTGGAGATCGAA<br>SEQ ID NO: 24881 | CAGGTGCAGCTGGTGGAGTCGGGGGGAGGCGTGGTCCAGCCTGGGAGGTCCCTGAGACTCTCCTGTGCAGCGTCTGGATTCAACTTCAGTAACTATGGCATGCACTGGGTCCGCCAGGTTCCAGGCAAGGGGCTGGAGTGGGTGGCAGTTATATGTAGACTCCGTGAAGGGCCGATAATAAATACTATGGAGACTCCGTGAAGGGCCGATTCACCATCTCCAGAGACAATTCCAAGAACACGCTGTCTCTGCAAATGAACAGCCTGAGAGCCGAGGACACGGCTGTGTATTGCGTGCGAGAGATGAAGGCTGGGGATTTTGACTACTGGGGCCAGGGAACCCTGGTCACCGTCTCCTCA<br>SEQ ID NO: 28887 |

FIGURE 50
(Continued)

| | | | |
|---|---|---|---|
| iPS:393902 | 21-225_14E10 | AA | DIQMTQSPSSLSASVGDRVTITCRASQNIYSYLN WYQEKPGRAPKLLIYATSSLQSGVPSRFGGSGSG TDFTLTISSLQPEDFATYYCQQNYSPPLTFGGGT KVEIE |  QVQLVESGGGVVQPGRSLRLSCAASGFNFSNYGM HWVRQVPGKGLEWVAVIWHDGSNKYYVDSVKGR FTISRDNSKNTLSLQMNSLRAEDTAVYCCARDERL GIFDYWGQGTLVTVSS |
| | | | SEQ ID NO: 24882 | SEQ ID NO: 28888 |
| | | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCACAAACCAGGGCAAGC CCCTAAGCGCCTGATCTATGCTGCATCCAGTT ACAAAGTGGGGTCCCATCAAGGTTCAGCGGCA GTGGATCTGGGACAGACCTGAAGATTTTACAGCTTA AGCAGCCTGCAGCCTGAAGATTTTACAGCTTA TTACTGTCTGCAAGCATTATAGTACCCTCGAC GTTCGGCCAAGGGACCAAGGTGGAAATCAAG | CAGGTGCAGCTGGTGGAGTCTGGGGGAGGCGTG GTCCAGCCTGGGAGGTCCCTGAGACTCTCCTGTG CAGCGTCTGGATTCAACTTCAGTGACTATGGCAT GCACTGGGTCCGCCAGGCTCCAGGCAAGGGGCT GGAGTGGGTGGCAGTTATATGCAGACTCCGTGAAGGT AATAAATACTATGTCGATTAGTGATGGAAGT TCACCATCTCCAGAGACACAATTCCAAGAACACGC TCTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCAAGGGACCACGGTCACCGTCTCCTCA |
| | | | SEQ ID NO: 24883 | SEQ ID NO: 28889 |
| | | AA | DIQMTQSPSSLSASVGDRVTITCRTSQGIRNDLG WYQHKPGQAPKRLIYAASSLQSGVPSRFSGSGS GTEFTLTISSLQPEDFTAYYCLQHYSYPRTFGQG TKVEIK | QVQLVESGGGVVQPGRSLRLSCAASGFTFSDYGM HWVRQAPGKGLEWVAVIWYDGSNKYYADSVKGR FTISRDNSKNTLYLQMNSLRAEDTAVYYCAREKYS SSWYDYGMDVWGQGTTVTVSS |
| | | | SEQ ID NO: 24884 | SEQ ID NO: 28890 |

FIGURE 50
(Continued)

| | | | |
|---|---|---|---|
| iPS:393904 | 21-225_8H11 | NA | GACATCCAGATGACCCAGTCTCCATCCTCCT GTCTGCATTTGTAGGAGACAGAGTCACCATCA CTTGCCGGGCAAGTCAGAACATTATCAGCTAT TTAAATTGGTATCAACAGAAACCAGGGAAAG CCCCTAAACCTCATGATATATGTTACATCCAGTT TGCACAGTGGGGTCCCATCAAGGTTCAGTGGC AGTGGATCTGGGACAGATTTCTCTCACCAT CAGCAGTCTCCAACCTGAGGATTTTGCAACTT ACTACTGTCAACAGAGTTACAGTACCCCTTTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATAACAT GCACTGGGTCCGCCAGGCTCCAGGCAAGGGGCT GGAGTGGGTGGCAGTTATATGTATGGATGAAGT GATAGATACTCTGCAGACTCCGTGAAGGGCCGAT TCACCATCTCCGAGACAATTCCAAGAACACGCT GTATCTGCAAATGAACAGCCTGAGAGCCGAGGA CACGGCTGTGTATTACTGTGCGAGAGATCGGGCC TATAGCAGCTGCTGACTTCTGGGGCCAGGGAA CCCTGGTCACCGTCTCCTCA |
| | | | SEQ ID NO: 24885 | SEQ ID NO: 28891 |
| | | AA | DIQMTQSPSSLSAFVGDRVTITCRASQNIISYLNW YQQKPGKAPKLMIYVTSSLHSGVPSRFSGSGSGT DFSLTISSLQPEDFATYYCQQSYSTPFTFGPGTKV DIK | QVQLVESGGGVVQPGRSLRLSCAASGFTFSTYNMH WVRQAPGKGLEWVAVIWYDGSDRYSADSVKGRF TISRDNSKNTLYLQMNSLRAEDTAVYYCARDRAYS SSSDFWGQGTLVTVSS |
| | | | SEQ ID NO: 24886 | SEQ ID NO: 28892 |
| iPS:393906 | 21-225_13D3 | NA | GAAATAGTGATGACGCAGTCTCCAGCCACCCT GTCTGTGTCTCCAGGGGAAAGCGCCACCCTCT CCTGCAGGGCCAGTCAGAGTGTTAGCAGCAAC TTAGCCTGGTTCCAGCAGAAAGCCTGGCCAGGC TCCCAGGCTCCTCATCAATGGTGCATCCACCA GGGCCACTGGTATCCCAGCCAGGTTCAGTGGC AGTGGGTCTGGGACAGTTCACTCTCACCATC AGCAGCCTGCAGTCTGAAGATTTTGCAGTTT ATTTCTGTCAGCAGTATCATGACTGCCTCCG ACGTTCGGCCAAGGGACCAAGGTGGAAATCA AA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTTATACCAT GAACTGGGTCCGCCAGGCTCCAGGGAAGGGGCT GGACTGGGTCTCATCATTAGTGGTAGTAGTAGT TACATATACTCCAGAGACAACGCCAAGAACTACT TCAGCCTGCAAATGAACAGCCTGAGAGCCGAGGA CACGGCTGTGTATTACTGTGCGAGAGATCGGGGC AGTGGCTGGGGCCAGGGAACCCTGGTCACCGTCT CCTCA |
| | | | SEQ ID NO: 24887 | SEQ ID NO: 28893 |

FIGURE 50
(Continued)

| | | | |
|---|---|---|---|
| iPS:393908 | 21-225_10E9 | AA | EIVMTQSPATLSVSPGESATLSCRASQTVSSNLA WFQQKPGQAPRLLINGASTRATGIPARFSGSGSG TEFTLTISSLQSEDFAVYFCQQYHDWPPTFGQGT KVEIK | EVQLVESGGGLVKPGGSLRLSCAASGFTFSSYTMN WVRQAPGKGLDWVSSISGSSSYIYYADSVKGRFTIS RDNAKNSLYLQMNSLRAEDTAVYYCARDRGSGW GQGTLVTVSS |
| | | | SEQ ID NO: 24888 | SEQ ID NO: 28894 |
| | | NA | GACATCCAGATGACCCAGTCTCCATCCTCCCT GTCTGCATCTGTAGGAGACAGAGTCACCTTCA CTTGCCGGGCAAGTCAGGACATTAGAAGTGAT TTAGGCTGGTATCAGCAGAAACCAGGGAAAG CCCCTACGCGCCTGATCTTTGCTGCATCCAGTT TGCAAAGTGGGGTCCCATCCAAGGTTCAGCGGC AGTGGATCTGGGACAGCCTGAAGATTTTGCAACTT ATTACTGTCTACAGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT ACACTGGGTCCGCCAGGCTCCAGGCAAGGGGCT GGAGTGGGTGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAAGTA TAGCAGCTGGTACGACTACGGTATGGACGTC TGGGGCCAAGGGACCACGGTCACCGTCTCCTCA |
| | | | SEQ ID NO: 24889 | SEQ ID NO: 28895 |
| | | AA | DIQMTQSPSSLSASVGDRVTFTCRASQDIRSDLG WYQQKPGKAPTRLIFAASSLQSGVPSRFSGSGSG TEFTLTINSLQPEDFATYYCLQHYSYPRTFGQGT KVEIK | QVQLVESGGGVVQPGRSLRLSCAASGFTFSNYVIH WVRQAPGKGLEWVAVIWYDGSNKYYADSVKGRF TISRDNSKNTLYLQMNSLRAEDTAVYYCAREKYSS SWYDYGMDVWGQGTTVTVSS |
| | | | SEQ ID NO: 24890 | SEQ ID NO: 28896 |

FIGURE 50
(Continued)

| | | | |
|---|---|---|---|
| iPS:393910 | 21-225_15F10 | NA | GACATCCAGATGACCCAGTCTCCATCCTCCCT GTCTGCTTCTGTAGGAGACAGAGTCACCATCA CTTGCCAGGCGAATCAGGACATTACCAACTT TAAATTGGTATCAGCTGAAACCAGGGAAAGC CCCTAACCTCCTGATCTCCGATGCATCCAATT TGGAAACAGGGGTCCCATCAAGGTTCAGTGA AGTGGATCTGGGACAGATTTTACTTTCACCAT CAGCAGCCTGCAGCCTGAAGATGTTGCGACAT ATTACTGTCAACAGTATGATAATCTCCCGATC ACCTTCGGCCAAGGGACACGACTGGAGATTAA A<br><br>SEQ ID NO: 24891 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGTCAGTTATATCATATGGTGAAGT AATAATTACTATGCAGACTCCGTGAAGGGCCGAT TCACCATCTCCAGAGACAATTCCAAGAACACGCT GTATCTGCAAATGAACAGCTGAGAGCTGAGGA CACGGCTGTGTATTACTGTGTGAGACGGGATAC AGCTATGGCGGGTACGGTATGGACGTCTGGGGC CAAGGGACCACGGTCACCGTCTCCTCA<br><br>SEQ ID NO: 28897 |
| | | AA | DIQMTQSPSSLSASVGDRVTITCQANQDITNFLN WYQLKPGKAPNLLISDASNLETGVPSRFSGSGSG TDFTFTISSLQPEDVATYYCQQYDNLPITFGQGT RLEIK<br><br>SEQ ID NO: 24892 | QVQLVESGGGVVQPGRSLRLSCAASGFTFSSYGMH WVRQAPGKGLEWVSVISYGGSNNYYADSVKGRFT ISRDNSKNTLYLQMNSLRAEDTAVYYCVRRGYSY GGYGMDVWGQGTTVTVSS<br><br>SEQ ID NO: 28898 |
| iPS:393912 | 21-225_16F6 | NA | GACATCCAGATGACCCAGTCTCCATCCTCCCT GTCTGCTTCTGTAGGAGACAGAGTCACCATCA CTTGCCAGGCGAATCAGGACATTACCAACTT TAAATTGGTATCAGCTGAAACCAGGGAAAGC CCCTAACCTCCTGATCTCCGATGCATCCAATT TGGAAACAGGGGTCCCATCAAGGTTCAGTGA AGTGGATCTGGGACAGATTTTACTTTCACCAT CAGCAGCCTGCAGCCTGAAGATGTTGCGACAT ATTACTGTCAACAGTATGATAATCTCCCGATC ACCTTCGGCCAAGGGACACGACTGGAGATTAA A<br><br>SEQ ID NO: 24893 | CAGGTGCAGTTGGTGGAGTCTGGGGGAGGCGTG GTCCAGCCTGGGAGGTCCCTGAGACTCTCCTGTG CAGCGTCTGATTCACCTTCAGTAACTATGGCAT GCACCGGGTCCGCCAGGCTCCAGGCAAGGGGCT GGAGTGGGTGGCAGTTATATGGTATGAAGGAAG TAATCAATACTATGGAGACTCCGTGAAGGGCCG ATTCACCATCTCCAGAGACAATTCCAAGAACACG GTGTATCTGCAAATGCACAGCTGAGAGCCGAG GACACGGCTGTGTATTACTGTGCGAGAGAGCTGG GGTTCCTCTCTGATTACTGGGGCCAGGGAACCCT GGTCACCGTCTCCTCA<br><br>SEQ ID NO: 28899 |

FIGURE 50
(Continued)

| | | AA | DIQMTQSPSSLSASVGDRVTITCQANQDITNFLNWYQLKPGKAPNLLISDASNLETGVPSRFSGSGSGTDFTFTISSLQPEDVATYYCQQYDNLPITFGQGTRLEIK<br><br>SEQ ID NO: 24894 | QVQLVESGGGVVQPGRSLRLSCAASGFTFSNYGMHRVRQAPGKGLEWVAVIWYEGSNQYYGDSVKGRFTISRDNSKNTVYLQMHSLRAEDTAVYYCARELGFLSDYWGQGTLVTVSS<br><br>SEQ ID NO: 28900 |
| iPS:393914 | 21-225_16B8 | NA | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGATCTCATCCATTAGTGGTAGTAGTACTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGAGTGGCTTCATTCGACTACTGGGGCCAGGGAACCCTGGTCACCGTCTCCTCA<br><br>SEQ ID NO: 28901 | |
| | | AA | DIQMTQSPSSLSASVGDRVTITCRASQGINNYLAWFQQKPGKALKSLINAASSVQSGVPSKFSGSGSGTDFTLTISSLQPEDFATYYCHQYHSYPFTFGPGTKVDIV<br><br>SEQ ID NO: 24896 | EVQLVESGGGLVKPGGSLRLSCAASGFTFSSYSMNWVRQAPGKGLEWISSISGSSTYIYYADSVKGRFTISRDNAKNSLYLQMNSLRAEDTAVYYCARVASFDYWGQGTLVTVSS<br><br>SEQ ID NO: 28902 |

FIGURE 50
(Continued)

| | | | | |
|---|---|---|---|---|
| iPS:393916 | 21-225_2G4 | NA | GACATCCAGATGACCCAGTCTCCATCTCCCT GTCTGCTCTGTAGGCGACAGAGTCACCATCA CTTGCCGGGCAAGTCAGGGCATTAGAAATGAT TTAGGCTGGTATCAGCAGAAACCAGGGAAAG CCCCTACGCGCCTGATCTATGCTGCATCCAGTT TGCACAGTGGGGTCCCATCACGGTTCAGCGGC AGTGGATCTGGGACAGAATTCACTCTCACAAT CAGCAGCCTGCAGCCTGAAGATCTTGCAACTT ATTACTGTCTACAACATTTATAGTTTCCCTCGA CGTTCGGCCGAGGGACCAAGGTGGAAATCAA A | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCACGGGACCACGGTCACCGTCTCCTCA |
| | | | SEQ ID NO: 24897 | SEQ ID NO: 28903 |
| | | AA | DIQMTQSPSSLSASVGDRVTITCRASQGIRNDLG WYQQKPGKAPTRLIYAASSLHSGVPSRFSGSGSG TEFTLTISSLQPEDLATYYCLQHYSFPRTFGRGTK VEIK | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREKYSS SWYDYGMDVWGHGTTVTVSS |
| | | | SEQ ID NO: 24898 | SEQ ID NO: 28904 |
| iPS:393920 | 21-225_1H12 | NA | GACATCCAGATGACCCAGTCTCCATCTCCCT GTCTGCATCTGTTGGAGACAGAGTCACCATCA CTTGCCGGGCAAGTCAGAACATTTACAGGTAT TTAAATTGGTATCAGCAGAAACCAGGGAGAG CCCCTAAGCTCCTGATCTATACTGCATCCAGTT TACAAAGTGGGGTCCCATCAAGGTTCAGTGGC AGTGACTCTGGGACAGATTTCACTCTCACCAT CAGCAGTCTGCAACCTGAAGATTTTGCAACTT ACTACTGTCAACAGAGTTACAGTCCCCCTCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCAACTTCAGTAGCTATGGCAT GCACTGGGTCCGCCAGGCTCCAGGCAAGGGGCT GGAGTGGGTGGCAATTATATGTAGACTCCGTGAAGGGCCGA TAATAAATACTATGTAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGAAGAG GCTGGGGATTTTGACTACTGGGGCCAGGGAACC CTGGTCACCGTCTCCTCA |
| | | | SEQ ID NO: 24899 | SEQ ID NO: 28905 |

FIGURE 50
(Continued)

| | | | |
|---|---|---|---|
| iPS:393922 | | AA | DIQMTQSPSSLSASVGDRVTITCRASQNIYRYLN WYQEKPGRAPKLLIYTASSLQSGVPSRFSGSDSG TDFTLTISSLQPEDFATYYCQQSYSPPLTFGGGTK VEIK<br>SEQ ID NO: 24900 | QVQLVESGGGVVQSGRSLRLSCAASGFNFSSYGMH WVRQAPGKGLEWVAIIWHDGSNKYYVDSVKGRFT ISRDNSKNTLYLQMNSLRAEDTAVYYCARDERLGI FDYWGQGTLVTSS<br>SEQ ID NO: 28906 |
| | 21-225_2B2 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGCAAG CCCCTAAGCGCCTGATCTATGCTGCATCCAGT TTACAAAGTGGGGTCCCATCCAAGGTTCAGCGG CAGTGGATCTGGGACAGAATTCACTCTCACAA TCAGCAGCCTGCAGCCTGAAGATCTTGCAACT TATCACTGTCTACAGCATAATAGTTACCCGCT CACTTTCGGCGGAGGGACCAAGGTGGAGATC AAA<br>SEQ ID NO: 24901 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGCATGATGGAAAA TAATAAATACTATGTAGACTCCGTGAAGGGCCGA TTCACCATCTCCAGAGACAATTCCAAGAGCACGC TGTATCTGCAAATGAACAGCCTGAGAGCCGAGG ACACGGCTGTGTATTACTGTGTGAGAGAACTAGG CTTCCAGTCTGACTACTGGGGCCAGGGAACCCCG GTCACCGTCTCCTCA<br>SEQ ID NO: 28907 |
| | | AA | DIQMTQSPSSLSASVGDRVTITCRASQGIRNDLG WYQQKPGQAPKRLIYAASSLQSGVPSRFSGSGS GTEFTLTISSLQPEDLATYHCLQHNSYPLTFGGG TKVEIK<br>SEQ ID NO: 24902 | QVQLVESGGGVVQPGRSLRLSCAASGFTFSSYGMH WVRQAPGKGLEWVAVIWYEENNKYYVDSVKGRF TISRDNSKSTLYLQMNSLRAEDTAVYYCVRELGFQ SDYWGQGTPVTVSS<br>SEQ ID NO: 28908 |

FIGURE 50
(Continued)

| | | | |
|---|---|---|---|
| iPS:393926 | 21-225_4G4 | NA | GACATCCAGATGACCCAGTCTCCATCTCCCT GGCTGCATCTGTAGGAGACAGAGTCACCATCA CTTGCCGGGCAAGTCAGACAGCCATTATCAGCTAT TTAAATTGGTATCAGCAGAAACCAGGGAAAG CCCCTAAACTTCTGATCCATACTGCATCCAGTT TGCAAAGTGGGGTCCCATCAAGGTTCAGTGGC AGTGGATCTGGGACAGATTTCACTCTCCAT CAGCAGTCTGCAACCTGAAGATTTTGCAACTT ACTACTGTCAACAGACTTACAGTACTCCGCTC ACTTTCGGCGGAGGGACCAAGGTGGAGATCA AA<br>SEQ ID NO: 24903 | CAGGTGCAGCTGGTGGAGTCTGGGGGAGGCGTG GTCCAGCCTGGGAGGTCCCTGAGACTCTCCTGTG CAGCGTCTCCGGATTCACCTTCAGTAGCTATGGCAT GCACTGGGTCCGCCAGGCTCCAGGCAAGGGCT GGAGTGGGGGCAGTTATATGCAGACTCCGTGAAGGGCCG TAATAAATACTATGCAGACTCCGTGAAGGGCCG ATTCACCATCTCCAGAGACAATGCCAAGAACAC GCTGTATCTGCAAATGAACAGCTGAGAGCCGA GGACACGGCTGTGTATTACTGTGCGAGAGATCTG AGAATGGGCGGTATGGACGTCTGGGGCCAAGGG ACCACGGTCACCGTCTCCTCA<br>SEQ ID NO: 28909 |
| | | AA | DIQMTQSPSSLSAASVGDRVTITCRASQTIISYLNW YQQKPGKAPKLLIHTASSLQSGVPSRFSGSGSGT DFTLSISSLQPEDFATYYCQQTYSTPLTFGGGTK VEIK<br>SEQ ID NO: 24904 | QVQLVESGGGVVQPGRSLRLSCAASGFTFSSYGMH WVRQAPGKGLEWGAVIWHDGSNKYYADSVKGRF TISRDNAKNTLYLQMNSLRAEDTAVYYCARDLRM GGMDVWGQGTTVTVSS<br>SEQ ID NO: 28910 |
| iPS:393928 | 21-225_4E10 | NA | GACATCCAGATGACCCAGTCTCCATCTCCCT GTTTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATTTGGGACAGATTTCACTCTCACAA TCAGCAGCCTGCAGCTTGAAGATTTTGCAACT TATTACTGTGTTTACAGCATGATAATTACCCTCTC ACTTTCGGCGGAGGGACCAAGGTGGAGATCA AA<br>SEQ ID NO: 24905 | CAGCTGCAGCTACAGGAGTCGGGCCCAGGACTG GTGAAGCCTTCGGAGACCCTGTCCTCACCTGCA CTGTCTCTGGTGGTCTCCATCAGCCGTAGTAGTTA CTACTGGGGCTGGATCCGCCAGCCCCCAGGGAA GGGGCTGGAGTGGATTGGAGTGTCTATTATAGT GGGGCCACCTCCTACAACCCGTCCCTCAAGAGTC GAGTCACCATATCCGTAGACACGTCCAAGAACC AGTTTTCCCTGAAGCTGAACTCTGTGACCGCCGC AGACACGGCTTTGTATTACTGTGTGAGACTAAGC AGCAACTGGGACTTTGACTACTGGGGCCAGGGA ACCCTGGTCACCGTCTCCTCA<br>SEQ ID NO: 28911 |

FIGURE 50
(Continued)

| | | | |
|---|---|---|---|
| | | AA | DIQMTQSPSSLFASVGDRVTITCRASQGIRNDLGWYQQKPGKAPKRLLIYAASSLQSGVPSRFSGSGFGTEFTLTISSLQLEDFATYYCLQHDNYPLTFGGGTKVEIK<br>SEQ ID NO: 24906 | QLQLQESGPGLVKPSETLSLTCTVSGGSISRSSYYWGWIRQPPGKGLEWIGSVYYSGATSYNPSLKSRVTISVDTSKNQFSLKLNSVTAADTALYYCVRLSSNWDFDYWGQGTLFTVSS<br>SEQ ID NO: 28912 |
| iPS:393930 | 21-225_7E11 | NA | GACATCCAGATGACCCAGTCTCCATCCTCCCTGTCTGCATCTGTAGGAGACAGAGTCACCATCGCTTGCCCGGGCAAGTCAAAACATTATCAGCTATTAAATTGGTATCAACAGAAACCAGGAAAGCCCCTAAATTCCTGATCTATACTGCATCCAGTTTGCAAAGTGGTGGTCCATCAAGGTTCAGTGGCAGTGGATCTGGGACAGATTTCACTCTCACCATCAGCAGTCTGCAACCTGCAAGAATTTGCAATTTACTACTGTCAACAGATTACAGTACCCCGCTCACTTTCGGCGGCGGGACCAAGGTGGAGATCAAA<br>SEQ ID NO: 24907 | CAGGTGCAGCTGCAGGAGTCTGGGGGAGGCGTGGTCCAGCCTGGGAGGTCCCTGAGACTCTCCTGTGCAGCGTCTGGATTCACCTTCAGTAGCTTTGGCATGCACTGGGTCCGCCAGGCTCCAGGCAAGGGGCTGGAGTGGGTGGCAATTATATGGCATGATGAAGTAATAAATACTATGCAGAGACTCCGTGAAGGCCGATTCACCATCTCCAGAGACAATTCCAACAACACGCTGTATCTGCAAATGAGCAGCCTGCGAGCCGAGGACACGGCTGTGTATTACTGTGCGAGAGATCTGAGTATGGGGGGTATGGAGGTCTGGGCCAAGGGACCACGGTCACCGTCTCCTCA<br>SEQ ID NO: 28913 |
| | | AA | DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIK<br>SEQ ID NO: 24908 | QVQLVESGGGVVQPGRSLRLSCAASGFTFSSFGMHWVRQAPGKGLEWVAIIWHDGSNKYYADSVKGRFTISRDNSNNTLYLQMSSLRAEDTAVYYCARDLSMGGMDVWGQGTTVTVSS<br>SEQ ID NO: 28914 |

FIGURE 50
(Continued)

| | | | |
|---|---|---|---|---|
| iPS:393932 | 21-225_10F5 | NA | GACATCCAGATGACCCAGTCTCCATCTCCT GTCTGCATCTGTTGGAGACAGAGTCACCATCA CTTGCCGGGCAAGTCAGAGACATTTACAGGTAT TTAAATGGTATCAGGAGAAACCAGGGAGAG CCCCTAAACTCCTGATCTATACTGCATCCAGTT TGCAAAGTGGGGTCCCATCAAGGTTCAGTGGC AGTGACTCTGGGACAGATTTCACTCTCACCAT CAGCAGTCTGCAACCTGAAGATTTTGCAACTT ACTACTGTCAACAGAGTTACAGTCCCCCTCTC ACTTTCGGCGGAGGGACCAAGGTGGAGATCA AA SEQ ID NO: 24909 | CAGGTGCAGCTGGTGGAGTCTGGGGGAGGCGTG GTCCAGCCTGGGAGGTCCCTGAGACTCTCCTGTG CAGCGTCTGGATTCAACTTCAGTAGCTATGGCAT GCACTGGGTCCGCCAGGCTCCAGGCAAGGGGCT GGAGTGGGTGTCAATTATATGGACTCATGATGAAGT AATAAATATTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATGAGAGG CTGGGGATTTTGACTACTGGGGCCAGGGAACCC TGGTCACCGTCTCCTCG SEQ ID NO: 28915 |
| | | AA | DIQMTQSPSSLSASVGDRVTITCRASQNIYRYLN WYQEKPGRAPKLLIYTASSLQSGVPSRFSGSDSG TDFTLTISSLQPEDFATYYCQQSYSPPLTFGGGTK VEIK SEQ ID NO: 24910 | QVQLVESGGGVVQPGRSLRLSCAASGFNFSSYGMH WVRQAPGKGLEWVSIIWHDGSNKYYVDSVKGRFT ISRDNSKNTLYLQMNSLRAEDTAVYYCARDERLGI FDYWGQGTLVTVSS SEQ ID NO: 28916 |
| iPS:393934 | 21-225_13E6 | NA | GACATCCAGGTGACCCAGTCTCCATCTTCCT GTCTGCATCTGTAGGAGACAGAGTCACCATCA CTAGCCGGGCAAGTCAGGCATTAGAAATGAT TTAGGCTGGTATCAGCAGAAACCAGGGAAAG CCCCTAAGGCTCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTGTACAGCATAATAGTTACCCGCT CACTTTCGGCGGAGGGACCAAGGTGGCGATCA AA SEQ ID NO: 24911 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAATTGGGG TCCGGTCTGACTACTGGGGCCAGGGAACCCTGG TCACCGTCTCCTCA SEQ ID NO: 28917 |

FIGURE 50
(Continued)

| | | | |
|---|---|---|---|
| iPS:393936 | 21-225_14A11 | AA | DIQVTQSPSSLSASVGDRVTITSRASQGIRNDLG WYQQKPGKAPKRLIYAASSLQSGVPSRFSGSGS GTEFTLTISSLQPEDFATYYCVQHNSYPLTFGGG TKVAIK |  QVQLVESGGGVVQPGRSLRLSCAASGFTFSNYGM HWVRQAPGKGLEWVAVIWYDENNKYYIDSVKGR FTISRDNSKNTLYLQMNSLRAEDTAVYYCARELGF RSDYWGQGTLVTVSS |
| | | | SEQ ID NO: 24912 | SEQ ID NO: 28918 |
| | | NA | GACATCCAGATGACCCAGTCTCCATCCTCCCT GTCTGCATCTATAGGAGACAGAGTCACCATCA CTTGCCGGGCAAGTCAGAGCATTAGCAGTTAT TTAAATTGGTATCAGCAGAAACCAGGGAAAG CCCCTAAGCTCCTGATCTTTGCTGCATCCAGTT TGCAAAATGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGACTTACAGTAGCCCTCCA TTCACTTTCGCCCCTGGGACCAAAGTGGATAT CAAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGTTATTAGTGGTAGAGGTGGT AGTACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAAGGATAG CAGCTGGTATGGAGTACTTCGATCTCTGGGGCCG TGGCACCCTGGTCACCGTCTCCTCA |
| | | | SEQ ID NO: 24913 | SEQ ID NO: 28919 |
| | | AA | DIQMTQSPSSLSASIGDRVTITCRASQSISSYLNW YQQKPGKAPKLLIFAASSLQNGVPSRFSGSGSGT DFTLTISSLQPEDFATYYCQQTYSSPPFTFAPGTK VDIK | EVQLLESGGGLVQPGGSLRLSCAASGFTFSSYAMN WVRQAPGKGLEWVSVISGRGGSTYYADSVKGRFTI SRDNSKNTLYLQMNSLRAEDTAVYYCAKRIAAGM EYFDLWGRGTLVTVSS |
| | | | SEQ ID NO: 24914 | SEQ ID NO: 28920 |

FIGURE 50
(Continued)

| | | | |
|---|---|---|---|
| iPS:393940 | 21-225_16B2 | NA | GGCGTCCAGATGACCCAGTCTCCATCCTCCCT GTCTGCATCTGTAGGAGACAGAGTCACCATCA CTTGCCGGGCAAGTCAGAGCATTAGCGGCTAT TTAAATTGGTATCAGCAGAAACCAGGGAAAG CCCCTAAGCTCCTGATCTATGCTGCATCCAGTT TGCAAAGTGGGGTCCATCAAGGTTCAGTGGC GGTGGATCGGGACAGATTTCACTCTCACCAT CAGCAGTCTACAACCTGAAGATTTTGCAACTT ACTACTGTCAACAGAGTTACAATACCCCTCCG GAGCGCAGTTTTGGCCAGGGGACCAAGCTGG AGATCAAA SEQ ID NO: 24915 | GAGGTGCAGTTGTTGGAGTCTGGGGGAGGCTTGG TACAGCCGGGGGGGTCCCTGAGACTCTCCTGTGC AGCCTCTGGATTCACCTTTAGCAGCTATGCCATG ACCTGGGTCCGCCAGGCTCCAGGGAAGGGCCG GAGTGGGTCTCAGTTATTAGTGGTAGTGGTGTA GCACATTCTACGCAGACTCCGTGAAGGGCCGGTT CACCATCTCCAGAGACAATTCCAAGAACACGCTT TATCTGCAAATGAGCAGCCTGAGAGCCGAGGAC ACGGCCGTTTATTTCTGTGCCGATATTGTAGTA GTACCAGGTGCCCTTATGATGCCTTTGATATCTG GGGCCAAGGGACAATGGTCACCGTCTCCTCA SEQ ID NO: 28921 |
| | | AA | GVQMTQSPSSLSASVGDRVTITCRASQSISGYLN WYQQKPGKAPKLLIYAASSLQSGVPSRFSGGGS GTDFTLTISSLQPEDFATYCQQTYNTPPERSFG QGTKLEIK SEQ ID NO: 24916 | EVQLLESGGGLVQPGGSLRLSCAASGFTFSSYAMT WVRQAPGKGPEWVSVISGSGSTFYADSVKGRFTI SRDNSKNTLYLQMSSLRAEDTAVYFCARYCSSTRC PYDAFDIWGQGTMVTVSS SEQ ID NO: 28922 |
| iPS:393942 | 21-225_11E5 | NA | GACATCGTGATGACCCAGTCTCCAGACTCCCT GGCTGTGTCTCTGGGCGAGAGGGCCACCCTCA ACTGCAAGTCCAGCCAGAGTGTTTTATACAGC TCCAACAATAACAACTACTTAACTTGGTACCA GCAGAAACCTGGACAGCGACCTAAGTTGCTCA TTTACTGGGCATCTACCCGGGAATCCGGGGTC CCTGACCGATTCAGTGGCAGCGGGTCTGGGAC AGTCACCATGACCAGGAACACCTCCATAAGCAC AAATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA SEQ ID NO: 24917 | CAGGTGCAACTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAATGCCAACCTAACAGTGG TGCCACGGCTATGCACAGAGGTTCCAGGCAG AGTCACCATGACCAGGAACACCTCCATAAGCAC AGCCTACATGGAGCTGAGCAGCCTGAGATCTGA GGACACGGCCGTGTATTACTGTGCGACAAGCAGT GGCTGGGAGGTCTTTGACTACTGGGGCCAGGGA ACCCTGGTCACCGTCTCCTCA SEQ ID NO: 28923 |

FIGURE 50
(Continued)

| | | AA | DIVMTQSPDSLAVSLGERATLNCKSSQSVLYSSN NNNYLTWYQQKPGQRPKLLIYWASTRESGVPD RFSGSGSGTNFTLTISSLQAEDVAVYCQQYYST PPTFGQGTKVEIK<br><br>SEQ ID NO: 24918 | QVQLVQSGPEVKKPGASVKVSCKASGYTFTNYDIN WVRQATGQGLEWMGWMHPNSGATGYAQRFQGR VTMTRNTSISTAYMELSSLRSEDTAVYYCATSSGW EVFDYWGQGTLVTVSS<br><br>SEQ ID NO: 28924 |
|---|---|---|---|---|
| iPS:393944 | 21-225_14D6 | NA | GACATCCAAATGACCCAGTCTCCATCCCCT GTCTGCATCTGTCGGAGACAGTGTCACCATCA CTTGCCGGGCAAGTCAGAGACATTAGAAATCAT TTAGGCTGGTATCAGCATAAACCAGGAAAGC CCCTAAGCGCCTGATCTATGCTGCATCCAGTTT GCAAAGTGGGGTCCCATCTAGGTTCAGCGGCA GTGGATCTGGGACAGATTCACTCTCACAATC AGCAGCCTGCAGCCTGAAGATTTTGCAACTTA TTACTGTCTACACAGTATATAGTTACCATTCAC TTTCGGCCCTGGGACCAAAGTGGATATCAAC<br><br>SEQ ID NO: 24919 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATACCAT GAACTGGGTCCGCCAGGCTCCAGGGAAGGGGCT GGAGTGGGTCTCATCCATTAGTGGTAGTGGTAGT TACATATACTACGCAGACTCAGTGAAGGGCCGAT TCACCATGTCCAGAGACAACGCCAAGAACTCACT GTATCTGCAAATGAACAGCCTGAGAGCCGAGGA CACGGCTGTGTATTACTGTGCGAGAGTAGCAGCC TTTGACTCCTGGGGCCAGGGAACCCTGGTCTCCG TCTCCTCA<br><br>SEQ ID NO: 28925 |
| | | AA | DIQMTQSPSSLSASVGDSVTITCRASQDIRNHLG WYQHKPGKAPKRLIYAASSLQSGVPSRFSGSGS GTEFTLTISSLQPEDFATYYCLQYNSYPFTFGPGT KVDIN<br><br>SEQ ID NO: 24920 | EVQLVESGGGLVKPGGSLRLSCAASGFTFSSYTMN WVRQAPGKGLEWVSSISGSGSYIYYADSVKGRFTM SRDNAKNSLYLQMNSLRAEDTAVYYCARVAAFDS WGQGTLVSVSS<br><br>SEQ ID NO: 28926 |

FIGURE 50
(Continued)

| | | | |
|---|---|---|---|
| iPS:393946 | 21-225_16A4 | NA | GACATCCAGATGACCCAGTCTCCATCCTCACT GTCTGCATCTGTAGGAGACAGAGTCACCATCA CTTGTCGGGCGAGTCAGGACATTAGTAGTAAT TTAGCCTGGTTTCAGCAGAAACCAGGGAAAGC CCCTAAGTCCCTGATCTCTGCTGCATCCAGTT GCAAAGTGGGGTCCCATCAAAATTCACTCTCAC AGCAGCCTGCAGCCTGAAGATTTTGCAACTTA TTACTGCCAACAGTATCATAGTTACCCGTGGA CGTTCGGCCAAGGGACCAAGGTGGAAATCAA T SEQ ID NO: 24921 | GAGGTGCAGCTGGTGGAGTCTGGGGGAGGCCTG GTCAAGCCTGGGGGGTCCCTGAGACTCTCCTGTG CAGCCTCTGGATTCACCTTCAGCAGCTATAGCAT GAACTGGGTCCGCCAGGCTCCAGGGAAGGGGCT GGAGTGGGTCTCATCCATTAGTGGTAGTAGTACT TACAAATACTACGCAGACTCAGTGAAGGGCCGA TTCACCATCTCCAGAGACAACGCCAAGAACTCAC TGTATCTGCAAATGAACAGCCTGAGAACCGAGG ACACGGCTGTGTATTACTGTGCGAGAGATCGTGG GAGCTACTGGGGCCAGGGAACCCAGGTCACCGT CTCCTCA SEQ ID NO: 28927 |
| | | AA | DIQMTQSPSSLSASVGDRVTITCRASQDISNYLA WFQQKPGKAPKSLISAASSLQSGVPSKFSGSGSG TDFTLTISSLQPEDFATYYCQQYHSYPWTFGQGT KVEIN SEQ ID NO: 24922 | EVQLVESGGGLVKPGGSLRLSCAASGFTFSSYSMN WVRQAPGKGLEWVSSISGSSTYKYYADSVKGRFTI SRDNAKNSLYLQMNSLRTEDTAVYYCARDRGSYW GQGTQVTVSS SEQ ID NO: 28928 |
| iPS:393948 | 21-225_16A5 | NA | GACATCCAGATGACCCAGTCTCCTTCCTCCCT GTCTGCATCTGTAGGAGACAGAGTCACCATCA CTTGCCGGGCAAGTCAGGGCATTAGAAATGAT TTAGGCTGCTATCAGCAGAAACCAGGGAAAG CCCCTAAGCGCCTGATCTATGCTGCATCCAGT TTGCAAAGTGGGGTCCCATCAAGGTTCAGCGG CAATGGATATGGGACAGATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 24923 | CAGGTGCAGCTGGTGGAGTCTGGGGGAGGCGTG GTCCAGCCTGGGAGGTCCCTAAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTAGACTCCGTGAAGGCCGAT AATAAATACTATGTAGACTCCGTGAAGGGCCGAT TCACCATCTCCAGAGACAATTCCAAGAACACGCT GTATCTGCAAATGAGCAGCCTGAGAGCCGAGGA CACGGCTGTGTATTACTGTGCGGAGAGATCTTGGC TGGACGAAGAGTACTGGGGCCAGGGAACCCTG GTCACCGTCTCCTCA SEQ ID NO: 28929 |

FIGURE 50
(Continued)

| | | | |
|---|---|---|---|
| iPS:393950 | 21-225_3H10 | AA | DIQMTQSPSSLSASVGDRVTITCRASQGIRNDLG CYQQKPGKAPKRLIYAASSLQSGVPSRFSGNGY GTEFTLTISSLQPEDFATYYCLQHNSYPWTFGQG TKVEIK |
| | | | SEQ ID NO: 24924 |
| | | | QVQLVESGGGVVQPGRSLRLSCAASGFTFSDYGM HWVRQAPGKGLEWVAVIWFDGSNKYYVDSVKGR FTISRDNSKNTLYLQMSSLRAEDTAVYYCARDLGW TEEYWGQGTLVTVSS |
| | | | SEQ ID NO: 28930 |
| | | NA | TCCTATGAGCTGAGTCAGCCACCCTCAGTGTC CGTGTCCCCAGGACAGACAGCCAGCATCACCT GCTCTCTGAGATAAATTGGGGAAAATATGCT TGCTCTGGTATCAGCAGAAGCCAGGCCAGTCCCC TGTGCTCTGGTCATCTATCAAGATAGGAAGCGGC CCTCAGGGATCCCTGAGCGATTCTCTGGCTCC AACTCTGGGAACAAAGCCACTCTGACCATCAG CGGGACCCAGGCTGTGGATGAGGCTGACTATT ACTGTCAGGCGTGGGTCAACAACACTATGATA TTCGGCGGAGGGACCAAGCTGACCGTCCTA |
| | | | SEQ ID NO: 24925 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGATA TAGCAGTGGCTGGTATGACTACGGTTTGGACGTC TGGGGCCAAGGGACCACGGTCACCGTCTCCTCA |
| | | | SEQ ID NO: 28931 |
| | | AA | SYELSQPPSVSVSPGQTASITCSGDKLGEKYACW YQQKPGQSPVLVIYQDRKRPSGIPERFSGSNSGN KATLTISGTQAMDEADYYCQAWVNNTMIFGGG TKLTVL |
| | | | SEQ ID NO: 24926 |
| | | | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARERYSS GWYDYGLDVWGQGTTVTVSS |
| | | | SEQ ID NO: 28932 |

FIGURE 50
(Continued)

| | | | |
|---|---|---|---|
| iPS:393952 | 21-225_1F1 | NA | GACATCCAGATGACCCAGTCTCCATCCTCACT GTCTGCATCTGTAGGAGACAGAGTCACCATCA CTTGTCGGGCGAGTCAGGCATTAACAATTAT TTAGCCTGGTTTCAGCAGAAATCAGGGAAAGC CCCTAAGTCCCTGATCTCTGTTGCATCCAGTT GCAAACTGGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATAATAGTTACCCTCTCA CTTTCGGCGGAGGGACCAAGGTGGAGATCAA A SEQ ID NO: 24927 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTAGTTACAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTTAACCTC TTTGACTACTGGGGCCAGGGAACCCTGGTCACCG TCTCCTCA SEQ ID NO: 28933 |
| | | AA | DIQMTQSPSSLSASVGDRVTITCRASQGINNYLA WFQQKSGKAPKSLISVASSLQTGVPSRFSGSGSG TDFTLTISSLQPEDFATYYCQQYNSYPLTFGGGT KVEIK SEQ ID NO: 24928 | EVQLVESGGGLVKPGGSLRLSCAASGFTFSSYNMN WVRQAPGKGLEWVSSISSSSYIYADSVKGRFTIS RDNAKNSLYLQMNSLRAEDTAVYYCARVNLFDY WGQGTLVTVSS SEQ ID NO: 28934 |
| iPS:393954 | 21-225_4H6 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A SEQ ID NO: 24929 | CAGGTGCAGCTGGTACAGTCTGGGGCTGAGGTG AAGAAGCCTGGGGCCTCAGTGAAGGTCTCCTGC AAGGCTTCTGGATACACCTTCACCGACTACTATT TGCACTGGGTGCGACAGGCCCCTGGACAAGGTCT TGAGTGGATGGGATGGATCCACCTAACAGTGGT GGCACAAACTATGCACAGAAGTTTCAGGGCAGG GTCACCATGACCAGGGACACGTCCATCAGCACA GCCTACATGGGGCTGAGCAGTCTGAGATCTGACG ACACGGCCGTGTATTACTGTGCGAGAGATGGTAC CAGCTCGTTTGACTACTGGGGCCAGGGAACCCTG GTCACCGTCTCCTCA SEQ ID NO: 28935 |

FIGURE 50
(Continued)

| | | | |
|---|---|---|---|
| | | AA | DIQMTQSPSSVSASVGDRVTITCRASQGISRWLAWYQQKPGKAPKLLIYGASSLQSGVPSRFSGSGSGTDFTLTISSLQPEDFAIYYCQQANSFPTFGPGTKVDIK | QVQLVQSGAEVKKPGASVKVSCKASGYTFTDYYLHWVRQAPGQGLEWMGWIHPNSGGTNYAQKFQGRVTMTRDTSISTAYMGLSSLRSDDTAVYYCARDGTSSFDYWGQGTLVTVSS |
| | | | SEQ ID NO: 24930 | SEQ ID NO: 28936 |
| iPS:393956 | 21-225_4D7 | NA | GACATCCAGATGACCCAGTCTCCATCCTCCCTGTCTGCATCTGTAGGAGACAGAGTCACCATCACTTGCCGGGCAAGTCAGAGCATTAGCGACTATTTAAATTGGTATCAGCAGAAACCAGGGAAAGCCCCTAAACTCCTGATCTTTGATACAACCAGTTTGCAAAGTGGGGTCCCATCAAGGTTCAGTGGCAGTGGATCTGGGACAGATTTCACTCTCACCATCAACAGTCTGCAACCTGAAGATTTTGCAACTTACTACTGTCAACAGAGTTACAATACCCCTCCGGAGCGCAGTTTTGGCCAGGGGACCAAGCTGGAGATCAAA | GAGGTGAAGCTGTTGGAGTCTGGGGGAGGCTTGGTACAGCCGGGGGGGTCCCTGAGACTCTCCTGTGCAGCCTCTGGATTCACCTTCAGCAGCTATGCCATGAGCTGGGTCCGCCAGGCTCCAGGGAAGGGGCTGGAGTGGGTCTCAGTTCTTAGTGGTAGTGGTGGTAGCACATTCTACGCAGACTCCGTGAAGGGCCGGTTCACCATCTCCAGAGACAATTCCAAGAACACGCTGTATCTGCAAATGAGCAGCCTGAGAGCCGGGACACGGCCGTATATTCTGTGCCGATATTGTAGTAGTGCCAGTGCCCTTATGATGCTTTGATATCTGGGGCCAAGGGACAATGGTCACCGTCTCCTCA |
| | | | SEQ ID NO: 24931 | SEQ ID NO: 28937 |
| | | AA | DIQMTQSPSSLSASVGDRVTITCRASQSISDYLNWYQQKPGKAPKLLIFDTTSLQSGVPSRFSGSGSGTDFTLTINSLQPEDFATYYCQQTYNTPPERSFGQGTKLEIK | EVKLLESGGGLVQPGGSLRLSCAASGFTFSSYAMSWVRQAPGKGLEWVSVLSGSGGSTFYADSVKGRFTISRDNSKNTLYLQMSSLRAGDTAVYFCARYCSSARCPYDAFDIWGQGTMVTVSS |
| | | | SEQ ID NO: 24932 | SEQ ID NO: 28938 |

FIGURE 50
(Continued)

| | | | |
|---|---|---|---|
| iPS:393958 | 21-225_5H2 | NA | GACATCCAGATGACCCAGTCTCCATCCTCCCTGTCTGCATCTGTAACAGTCAGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCAGTCTCACAATCAGCAGCCTGCAGCCTGAAGATTTTGCAACTTATTACTGTCTACAGCATAATAGTTACCCTCTCACTTTCGGCGGAGGGACCAAGGTGGAGATCAAA | GAGGTGCAGCTGGTGGAGTCTGGGGGAGGCTGGTCAAGCCTGGGGGGTCCTTGAGACTCTCCTGTGCAGCCTCTCTGGATTCACATTCAGTAGTAGTTACCATGAACTGGGTCCGCCAGGCTCCAGGGAAGGGCTGGAGTGGGTCTCATCCATTAGTGGTAGTAGTGGTACATATACTACGCAGACTCAGTGAAGGGCCGATTCACCATCTCCAGAGACAACGCAAGAACTCATTGTATCTGCAAATGAACAGCCTGAGAGCCGAGGACACGGCTGTGTATTACTGTGCGAGAGAGGAGCAGCTCGTCCGGCTTTGACTACTGGGGCCAGGGAACCCTGGTCACCGTCTCCTCA |
| | | | SEQ ID NO: 24933 | SEQ ID NO: 28939 |
| | | AA | DIQMTQSPSSLSASVTDRVTITCRASQGIRNDLGWYQQKPGKAPKRLIYAASSLQSGVPSRFSGSGSGTEFSLTISSLQPEDFATYYCLQHNSYPLTFGGGTKVEIK | EVQLVESGGGLVKPGGSLRLSCAASGFTFSSYTMNWVRQAPGKGLEWVSSISGSSSYIYADSVKGRFTISRANAKNSLYLQMNSLRAEDTAVYYCARGSSSSGFDYWGQGTLVTVSS |
| | | | SEQ ID NO: 24934 | SEQ ID NO: 28940 |
| iPS:393960 | 21-225_7G2 | NA | GACATCCAGATGACCCAGTCTCCATCCTCCCTGTCTGCGTCTGTAGGAGACAGAGTCACCATCACTTGCCGGGCAAGTCAGGACAGAGAAACCAGGGAAAGTTAGGCTGGTATCAGCAGAAACCAGGGAAAGCCCCTAAGCGCCTGATCTATCTATACTGCATCCAGTTTGCAAAGTGGGGTCCCATCAAGGTTCAGCGGCAGTGGATCTGGGACAGCCTGAAGATTCACTCTCACAATCAGCAGCCTGCAGCCTGAAGATTTTGCAACTTATTACTGTCTACAACAACATAATAGTTACCCCGTGGACGTTCGGCCTAGGGACCAAGGTGGTCATCAAA | CAGGTGCAACTGGTGGAGTCTGGGGGAGGCGTGGTCCAGCCTGGGAGGTCCCTGAGACTCTCCTGTGCAGCGTCAGGATTCACCTTCAGTGACTATGGCATGCACTGGGTCCGCCAGGCTCCAGGCAAGGGGCTGGAGTGGATGGCAGTTATATATGATGTAACTAATAAATACTATGCAGACTCCGTGAAGGGCCGATTCACCATCTCCAGAGACAATTCCAAGAACACGCTGTATCTGCAACTGAACAGCCTGAGAGCCGAGGACACGGCTGTTTATTACTGTGCGAGAGAACTTGGCTGGTACGAGGACTACTGGGGCCAGGGAACCCTGGTCACCGTCTCCTCA |
| | | | SEQ ID NO: 24935 | SEQ ID NO: 28941 |

FIGURE 50
(Continued)

| | | | | |
|---|---|---|---|---|
| iPS:393962 | 21-225_7H7 | AA | DIQMTQSPSSLSASVGDRVTITCRASQGIRNDLGWYQQKPGKAPKRLIYTASSLQSGVPSRFSGSGSGTEFTLTISSLQPEDFATYYCLQHNSYPWTFGLGTKVVIK | QVQLVESGGGVVQPGRSLRLSCAASGFTFSDYGMHWVRQAPGKGLEWMAVIWYDVTNKYYADSVKGRFTISRDNSKNTLYLQLNSLRAEDTAVYYCARELGWYEDYWGQGTLVTVSS |
| | | | SEQ ID NO: 24936 | SEQ ID NO: 28942 |
| | | NA | GACATCCAGATGACCCAGTCTCCATCCTCCTGTCTGCATCTGTAGGAGACAGAGTCACCATCACTTGCCGGGCAAGTCAGGGCATTAGAAATGATCTGTCTCTGGTGGCTCCATCAGCAGAAGTAGTTATTAGGCTGGTATCAGCAGAAACCAGGGAAAGCTACTGGGGCTGGATCGCCAGCCCCAGGGAACCCCTAAGCGCCTGATCTATGCTGCATCCAGTGGGGCTGAGTGAGTTGGAATATCTATTAGTTTGCAAAGTGGGGTCACATCAAGGTTCAGCGGGGGAGCACCTACTACTCCCGTCTCCTCAAGAGTCCAGTGGATCTGGGACAGAATTCACTCTCACAAGAGTCACCATATCCGTTGACACGTCAAGAACCATCAGCAGCCTGCAGCCTGAAGATTTTGCAACTGTTCTCCCTGAAACTGAGCTCTGTGACCGCCGCATATTACTGTCTACAGCATAGTAGTTACCCGTCCGACACGGCTGGTCTGTATTACTGTGCGAGACACAGTAACTTTCGGCGGAGGGACCAAAGTGGAGATCAACCAGCTGGTCTCTTGACCACTGGGGCCAGGGAACCCTGGTCACCGTCTCCTCA | CAGCTGCAGCTGCAGGAGTCGGGCCCAGGACTGGTGAAGCCTTCTGGGTGGCTCCATCAGCAGAAGTAGTTA |
| | | | SEQ ID NO: 24937 | SEQ ID NO: 28943 |
| | | AA | DIQMTQSPSSLSASVGDRVTITCRASQGIRNDLGWYQQKPGKAPKRLIYAASSLQSGVTSRFSGSGSGTEFTLTISSLQPEDFATYYCLQHSSYPFTFVGGTKVEIK | QLQLQESGPGLVKPSETLSLTCTVSGGSISRSSYYWGWIRQPPGKGLEWIGNIYYSGSTYYIPSLKSRVTISVDTSKNQFSLKLSSVTAADTAVYYCARHSTSWSLDHWGQGTLVTVSS |
| | | | SEQ ID NO: 24938 | SEQ ID NO: 28944 |

FIGURE 50
(Continued)

| | | | |
|---|---|---|---|
| iPS:393964 | 21-225_6G1 | NA | GACATCCAGATGACCCAGTCTCCATCTCCT GTCTGCATCTGTAGGAGACAGAGTCACCATCA CTTGCCGGACAAGTCAGAACATTATCAGCTAT TTAAATTGGTATCAGCAGAAACCAGGGAAAG CCCCTAAGGTCCTGATCTATACTGCATCCAATT TGCAAACTGGGGTCCCATCAGGGTTCAGTGGC AGTGGATCTGGGACAGATTTCACTCTCACCAT CAGCAGTCTGCAACCTGAAGATTTTGCAACTT ACTACTGTCAACAGCCTCACAGTCCCCGCTC ACTTTCGGCGGAGGGACCAAGGTGGAGATCA AA SEQ ID NO: 24939 | CAGGTGCAGCTGGTGGAGTCTGGGGGAGGCGTG GTCCAGCCTGGGAGGTCCCTGAGACTCTCCTGTG CAGCGTCTGGATTCATCTTCAGTAGCTATGGCAT GCACTGGGTCCGCCAGGCTCCAGGCAAGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCTGAG TATGGGCGGTATGGACGTCTGGGGCCAAGGGAC CACGGTCACCGTCTCCTCA SEQ ID NO: 28945 |
| | | AA | DIQMTQSPSSLSASVGDRVTITCRTSQNIISYLNW YQQKPGKAPKVLIYTASNLQTGVPSGFSGSGSGT DFTLTISSLQPEDFATYYCQQPHSPPLTFGGGTK VEIK SEQ ID NO: 24940 | QVQLVESGGGVVQPGRSLRLSCAASGFIFSSYGMH WVRQAPGKGLEWVAIIWYDGSNKYYADSVKGRFT ISRDNSKNTLYLQMNSLRAEDTAMYYCARDLSMG GMDVWGQGTTVTVSS SEQ ID NO: 28946 |
| iPS:393966 | 21-225_7F8 | NA | GACATCCAGATGACCCAGTCTCCATCTCCCT GTCTGCATCTGTGGGAGACAGAGTCACCATCA CTTGCCGGGCAAGTCAGGGCATTGGAAATGAT TTAGGCTGGTATCAGCAGAAACCAGGGAAAG CCCCTAAGCGCCTGATCTATGCTGCATCCAGT TTGCAAAGTGGGGTCCCATCACGGTTCAGCGG CAGTGTATCTGGGACAGCCTGAAATTCACTCTCCAA TCAGCAGCCTGCAGCCTGAAGATTTTGCAACT TATTACTGTCTACAACATTATACTTACCCTCGG ACGTTCGGCCAAGGGACCAAGGTGGAAATCA AA SEQ ID NO: 24941 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTGTGTCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAATAACACGC TGTATCTGCAAATGAACAGCCTGAGAGCCGAGG ACACGGCTGTGTATTACTGTGCGAGAGAAGGTA TACCAGTGGCTGGCACGACTACGGTTATGGACGTC TGGGGCCAAGGGACCACGGTCACCGTCTCCTCG SEQ ID NO: 28947 |

FIGURE 50
(Continued)

| | | | |
|---|---|---|---|
| | | AA | DIQMTQSPSSLSASVGDRVTITCRASQGIGNDLG WYQQKPGKAPKRLIYAASSLQSGVPSRFSGSVS GTEFTLPISSLQPEDFATYYCLQHYTYPRTFGQG TKVEIK<br>SEQ ID NO: 24942 | QVQLVESGGGVVQPGRSLRLSCAASGFTFSSCVMH WVRQAPGKGLEWVAVIWYDGSNKYYADSVKGRF TISRDNSNNTLYLQMNSLRAEDTAVYYCARERYTS GWHDYGMDVWGQGTTVTSS<br>SEQ ID NO: 28948 |
| iPS:393968 | 21-225_5A5 | NA | GACATCCAGATGACCCAGTCTCCATCCTCACT GTCTGCATCTGTAGGAGACAGAGTCACCATCA CTTGTCGGGCGAGTCAGGCATTAGGCAATTAT TTAGCCTGGTTTCAGCAGAAACCAGGGAAAGC CCCTAAGTCCCTGATCTCTGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATATAGTTGCAACTTA TTACTGCCAACAGTATATAGTTACCCATTCA CTTTCGGCCCTGGGACCAAAGTGGATATCAAA<br>SEQ ID NO: 24943 | GAGGTGCAGCTGTGGGAGTCTGGGGGAGGCTTG GTACAGCCTGGGGGGTCCCTGAGACTCTCCTGTG CAGCCTCCGGATTCACCTTTAGCAGTAGCCAT GAACTGGGTCCGCCAGGCTCCAGGGAAGGGGCT GGAGTGGGTCTCAGTATTAGTGGTAGTGGTGGT TACACATACTACGCAGACTCCGTGAAGGGCCGGT TCACCATCTCCGAGACACAATCCAAGAACACGCT GTATCTGCAAATGAGCAGCCTGAGAGCCGAGGA CACGGCCGTTTATTACTGTGCGAAAGGGGGGTCC CTCTTCTACTGGGGCCAGGGAACCTTGGTCACCG TCTCTTCA<br>SEQ ID NO: 28949 |
| | | AA | DIQMTQSPSSLSASVGDRVTITCRASQGISNYLA WFQQKPGKAPKSLISAASSLQSGVPSKFSGSGSG TDFTLTISSLQPEDFATYYCQQYNSYPFTFGPGT KVDIK<br>SEQ ID NO: 24944 | EVQLWESGGGLVQPGGSLRLSCAASGFTFSSYAMN WVRQAPGKGLEWVSAISGSGGYTYADSVKGRFT ISRDNSKNTLYLQMSSLRAEDTAVYYCAKGGSLFY WGQGTLVTVSS<br>SEQ ID NO: 28950 |

FIGURE 50
(Continued)

| | | | |
|---|---|---|---|
| iPS:393972 | 21-225_7C9 | NA | GACATCCAGATGACCCAGTCTCCATCTCCT GTCTGCATCTGTAGGAGACAGAGTCACCATCA CTTGCCGGGCAAGTCAGGGCATTAGAAACGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGTTTATAGTTACCCTCGG ACGTTCGGCCAGGGGACCAAGGTGGATATCA AA<br>SEQ ID NO: 24945 | CAGGTGCAGCTGGTGGAGTCTGGGGGAGGCGTG GTCCAGCCTGGGAGGTCCCTGAGACTCTCCTGTG CAGCGTCTGGACTTCACCTTCAGTAACTATGTCAT GCACTGGGTCCGCCAGGCTCCAGGCAAGGGGCT GGAGTGGGTGGCTGTTATATGGTATGATGGAAGT AATAAATACTATGCAGACTCCGTGAAGGGCCGA TTCACCATCTCCAGAGACAATTCCAAGAACACGT TGTATCTGCAAATGAACAGCCTGAGAGCCGAGG ACACGGCTGTATTACTGTGCAGAGAGAAGTA TAGCAGCAGCTGGTACGACTACGGTATGGACGTC TGGGGCCAAGGGACCACGGTCACCGTCTCCTCA<br>SEQ ID NO: 28951 |
| | | AA | DIQMTQSPSSLSASGGDRVTITCRASQGIRNDLG WYQQKPGKAPKRLIYAASSLQSGVPSRFSGSGS GTEFTLTISSLQPEDFATYYCLQLYSYPRTFGQGT KVDIK<br>SEQ ID NO: 24946 | QVQLVESGGGVVQPGRSLRLSCAASGLTFSNYVM HWVRQAPGKGLEWVAVIWYDGSNKYYADSVKGR FTISRDNSKNTLYLQMNSLRAEDTAVYYCAREKYS SSWYDYGMDVWGQGTTVTVSS<br>SEQ ID NO: 28952 |
| iPS:393974 | 21-225_7C4 | NA | GACATCCAGATGACCCAGTCTCCATCTCCT GTTTGCATCTGTAGGAGACAGAGTCACCATCA CTTGCCGGGCAAGTCAGGGCATTAGAAATGAT TTAGGCTGGTATCAGCAGAAACCAGGGAAAG CCCATAAGCGCCTTATATATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br>SEQ ID NO: 24947 | CAGGTGCAGCTGGTGGAGTCTGGGGGAGGCGTG GTCCAGCCTGGGAAGTCCCTGAGACTCTCCTGTG CAGCGTCTGATTCACCTTCAGTAACTATGGCAT GCACTGGGTCCGCCAGGCTCCAGGCAAGGGGCT GGAATGGGTGGCAGTTATTGGTATGAAGAAAAT TCACCATCTCCAGAGACAATTCCAAGAGCCGAT GTATCTGCAAATGAACAGCCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br>SEQ ID NO: 28953 |

FIGURE 50
(Continued)

| | | | DIQMTQSPSSLFASVGDRVTITCRASQGIRNDLG WYQQKPGKAHKRLIYAASSLQSGVPSRFSGSGS GTEFLTISSLQPEDFATYYCLQHNSYPLTFGGG TKVEIK | QVQLVESGGGVVQPGKSLRLSCAASGFTFSNYGM HWVRQAPGKGLEWVAVIWYEENNQYYADSVKGR FTISRDNSKNTLYLQMNSLRAEDTAVYYCARELGF RSDYWGQGTLVTVSS |
|---|---|---|---|---|
| | | AA | SEQ ID NO: 24948 | SEQ ID NO: 28954 |
| iPS:393976 | 21-225_7E9 | NA | GACATCCAGATGACCCAGTCTCCATCCTCCCT GTTTGCATCTGTAGGAGACAGAGTCACCATCA CTTGCCGGGCAAGTCAGGGCATTAGAAATGAT TTAGGCTGGTATGAGCAGAAACCAGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGTAGACTCCGTGAAGGGCCGAT AATAAATACTATTCCAGAGACAACTCCAAGAACACGCT GTATCTGCAAATGAACAGCTGAGAGCCGAGGA CACGGCTGTATATTATTGTGCAGAGAATTGGGG TTCCGGTCTGACTACTGGGGCCAGGGAACCCTGG TCACCGTCTCCTCA |
| | | | SEQ ID NO: 24949 | SEQ ID NO: 28955 |
| | | AA | DIQMTQSPSSLFASVGDRVTITCRASQGIRNDLG WYEQKPGKAPKRLIYTASSLQSGVPSRFSGSGSG TEFTLTISSLQPEDFATYYCLQHNSYPLTFGGGT KVEIK | QVQLVESGGGVVQPGRSLRLSCAASGFTFSDYGM HWVRQAPGKGLEWVAVIWYDENNKYYVDSVKGR FTISRDNSKNTLYLQMNSLRAEDTAVYYCARELGF RSDYWGQGTLVTVSS |
| | | | SEQ ID NO: 24950 | SEQ ID NO: 28956 |

FIGURE 50
(Continued)

| | | | | |
|---|---|---|---|---|
| iPS:393978 | 21-225_4C12 | NA | GACATCCAGATGACCCAGTCTCCATCTCCCT GTCTGCTCTGTAGGCGACAGAGTCACCATCA CTTGCCGGGCAAGTCAGGGCATTAGAAATGAT TTAGGCTGGTATCAGCAGAAACCAGGGAAAG CCCCTACGCGCCTGATCTATGCTGCATCCAGTT TGCACAGTGGGGTCCCATCACGGTTCAGCGGC AGTGGATCTGGGACAGAATTCACTCTCACAAT CAGCAGCCTGCAGCCTGAAGATCTTGCAACTT ATTACTGTCTACAACATTATAGTTTCCCTCGA CGTTCGGCCAAGGGACCAAGGTGGAAATCAA A | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTAGTGTCAT GCACTGGGTCCGCCAGGTCCAGGCAAGGGCT GGAGTGGGTGGCAGTTATATGGTATGGATGAAGT AATAAATACTATGCAGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTA TAGCAGCAGCTGGTACGACTACGGTATGGACGTC TGGGGCCACGGGACCACGGTCACCGTCTCCTCA |
| | | | SEQ ID NO: 24951 | SEQ ID NO: 28957 |
| | | AA | DIQMTQSPSSLSASVGDRVTITCRASQGIRNDLG WYQQKPGKAPTRLIYAASSLHSGVPSRFSGSGSG TEFTLTISSLQPEDLATYYCLQHYSFPRTFGQGTK VEIK | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREKYSS SWYDYGMDVWGHGTTVTVSS |
| | | | SEQ ID NO: 24952 | SEQ ID NO: 28958 |
| iPS:393980 | 21-225_6D3 | NA | GACATCCAGATGACCCAGTCTCCATCTCCCT GTCTGCATCTGTAGGAGACAGAGTCACCATCA CTTGCCGGACAAGTCAGAGCATTAGTACTTAT TTAAATTGGTATCAGCAGAAACCAGGGAAAG CCCCTAAGCTCCTGATCTTTGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCCTTT TTCACTTTCGGCCCTGGGACCAAAGTGGATAT CAAA | GAGGTGCAGCTGTTGGAGTCTGGGGGAGGCTTG GTACAGCCTGGGGGGTCCCTGAGACTCTCCTGTG CAGCCTCTGAATTCACCTTTAGCAGTTCATGCCAT GAACTGGGTCCGCCAGGCTCCAGGGAAGGGGCT GGAGTGGGTCTCAGTTATTAGTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTCGTGCGTCCGTTTGGCA GTGGGTGCCGGAGGCTTTGATATCTGGGGCC AAGGGACAATGGTCACCGTCTCTTCA |
| | | | SEQ ID NO: 24953 | SEQ ID NO: 28959 |

FIGURE 50
(Continued)

| | | | |
|---|---|---|---|
| iPS:393982 | 21-225_6C12 | AA | DIQMTQSPSSLSASVGDRVTITCRTSQSISTYLNWYQQKPGKAPKLLIFAASSLQSGVPSRFSGSGSGTDFTLTISSLQPEDFATYFCQQSYRTPFFTFGPGTKVDIK<br>SEQ ID NO: 24954 | EVQLLESGGGLVQPGGSLRLSCAASEFTFSSYAMNWVRQAPGKGLEWVSVISGRGGNTFYADSVKGRFTISRDNSKNTLYLQMNSLRAEDTAVYFCASRLAVAGSEAFDIWGQGTMVTVSS<br>SEQ ID NO: 28960 |
| | | NA | GACATCCAGATGACCCAGTCTCCATCCTCCCTGTCTGCATCTGTAGGAGACAGAGGCACCATCACTTGCCGGGCAAGTCAGGGCATTAGAAGTAATTTAGGCTGGTATCAGCAGAAACCAGGGAAAGCCCCTAAGCGCCTGATCTATGCTGCATCCAGTTTGGAAAGTGGGGTCCCATCAAGGTTCAGCGGCAGTGGATCTGGGACAGAATTCACTCTCACAATCAGCAGCCTGCAGCCTGAAGATTTTGCAACTTATTTCTGTCTACAGGATATAGTTATCCGTTCACTTTCGGCGGAGGGACCAAGGTGGAGATCAAA<br>SEQ ID NO: 24955 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGGTCTCATCCATTAGTAGTAGTAGTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGAGATCGTGGGAGCCTCGGGGCCAGGGAACCCTGGTCACCGTCTCCTCA<br>SEQ ID NO: 28961 |
| | | AA | DIQMTQSPSSLSASVGDRGTITCRASQGIRSNLGWYQQKPGKAPKRLIYAASSLESGVPSRFSGSGSGTEFTLTISSLQPEDFATYFCLQDNSYPFTFGGGTKVEIK<br>SEQ ID NO: 24956 | EVQLVESGGGLVKPGGSLRLSCAASGFTFSSYSMNWVRQAPGKGLEWVSSISSSSYIYYADSVKGRFTISRDNAKNSLYLQMNSLRAEDTAVYYCARDRGSLWGQGTLVTVSS<br>SEQ ID NO: 28962 |

FIGURE 50
(Continued)

| | | | | |
|---|---|---|---|---|
| iPS:393984 | 21-225_4F12 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CGGTGGATCTGGGACAATATTCACTCTCACAA TCAGCAGCCTGCAGCCTGAAGATTTTGCAACT TATTACTGTCTACAGCATAATAGTTACGCGCT CACTTTCGGCGGAGGGACCAAGGTGGAGATC AAA<br>SEQ ID NO: 24957 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGTTACT AATAAAAAGTATGCAGACTCCGTGAAGGGCGA TTCACCATCTCCAGAGACAATTCCAAGAACAGC TGTATCTGCAAATGAACAGCCTGACACCAGAGA ACACGGGTGGATATGAGAACCAGAGAAAAGG GGGGTCTATTTGACTACTGGGGCCAGGGAACCCT GGTCACCGTCTCCTCA<br>SEQ ID NO: 28963 |
| | | AA | DIQMTQSPSSLSASVGDRVTITCRASQGIRNDLG WYQQKPGKAPKRLIYAASSLQSGVPSRFSGGGS GTIFTLTISSLQPEDFATYYCLQHNSYALTFGGGT KVEIK<br>SEQ ID NO: 24958 | QVQLVESGGGVVQPGRSLRLSCAASGFTFSSYGMH WVRQAPGKGLEWVAVIWYDVTNKKYADSVKGRF TISRDNSKNTLYLQMNSLTPENTGGYENQREKGGL FDYWGQGTLVTVSS<br>SEQ ID NO: 28964 |
| iPS:393986 | 21-225_7G4 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTCTGCAACT TATTACTGTCTACATCAATATAGTTACCCTCGG ACGTTCGGCCAAGGGACCAAGGTGGAAATCA AA<br>SEQ ID NO: 24959 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAATAACTATGTCAT GCACTGGGTCCGCCAGGCTCCAGGCAAGGGGCT GGAGTGGGTGGCAGTTATATGGTATGATGGAAGT AATAAAATACTATGCAGACTCCGTGAAGGGCCGA TTCACCATCTCCAGAGACAATTCCAAGAACAGC TGTATCTGCAAATGAACAGCCTGAGAGCCGAGG ACACGGCTGTGTATTACTGTGCGAGAGAAGTA TAGCAGCAACTGTAGCTACTACGGTATGACGTC TGGGGCCAAGGGACCACGGTCACCGTCTCCTCA<br>SEQ ID NO: 28965 |

FIGURE 50
(Continued)

| | | | | |
|---|---|---|---|---|
| | | AA | DIQMTQSPSSLSASVGDRVTITCRASQGIRNDLG WYQQRPGKAPKRLIYAASSLQSGVPSRFSGSGS GTEFTLTISSLQPEDSATYYCLHQYSYPRTFGQG TKVEIK<br><br>SEQ ID NO: 24960 | QVQLVESGGGVVQPGRSLRLSCAASGFTFNNYVM HWVRQAPGKGLEWVAVIWYDGSNKYYADSVKGR FTISRDNSKNTLYLQMTSLRAEDTAVYYCAREKYS SNWYDYGMDVWGQGTTVTVSS<br><br>SEQ ID NO: 28966 |
| iPS:393988 | 21-225_7F10 | NA | GACATCCAGATGACCCAGTCTCCATCCGCACT GTCTGCATCTGTAGGAGACAGAGTCACCATCA CTTGTCGGGCGAGTCAGGACATTAGGAATTAT TTAGCCTGGTTTCAGCAGAAACCAGGAAAGC CCCTAAGTCCCTGATCTCTGTTGCATCCAGTTT GCAAAGTGGGGTCCCATCCAAGGTTCAGCGG AGTGGATCTGGGACAGATTTCACTCTCACCAT CAGCAGCCTGCAGCCTGAAGATTTTGCAACTT ATTATTGCCAACAGTATAATAGTTACCCCTCTC ACTTTCGGCGGAGGGACCAAGGTGGAGATCA AA<br><br>SEQ ID NO: 24961 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCTGAGAACCGAGGA CACGGCTGTGTATTACTGTGCGAGAGCTAACCTC TTTGACTACTGGGGCCAGGGAACCCTGGTCACCG TCTCCTCA<br><br>SEQ ID NO: 28967 |
| | | AA | DIQMTQSPSALSASVGDRVTITCRASQDIRNYLA WFQQKPGKAPKSLISVASSLQSGVPSRFSGSGSG TDFTLTISSLQPEDFATYYCQQYNSYPLTFGGGT KVEIK<br><br>SEQ ID NO: 24962 | EVQLVESGGGLVKPGGSLRLSCAASGFTFSSYSMN WVRQAPGKGLEWVSSISSSSYIYYADSVKGRFTIS RDNAKNSLYLQMNSLRTEDTAVYYCARANLFDY WGQGTLVTVSS<br><br>SEQ ID NO: 28968 |

FIGURE 50
(Continued)

| | | | |
|---|---|---|---|
| iPS:393990 | 21-225_11G7 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAGTAATTACCCTCTC ACTTTCGGCGGAGGGACCATGGTGGAGATCAG A | CAGCTGCAGCTGCAGGAGTCGGGCCCAGGACTG GTGAAGCCTTCGGAGACCCTGTCCCTCACTGCA CTGTCTCTGGTGGCTTCATCAGCAGGAGTACTTA CTACTGGGGCTGGATCCGCCAGCCCCCAGGGAA GGGGCTGGAGTGGATTGGGAGTATCTATTATAGT GGGAGCACCTCTACAGCCGTCCTCAAGAGTC GAGTCACCATATCGTAGAAGTTGAGCTCTGTGACCGCGC AGTTCTCCCTGAAGTTGAGCTCTGTGACCGCGC AGACACGGCTGTGTATTACTGTGCGAGACTGAAC AGCAGCTGGTCTTTGACTACTGGGGCCAGGGAA CCCTGGTCACCGTCTCCTCA |
| | | | SEQ ID NO: 28969 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSNYPLTFGGG TMVEIR | QLQLQESGPGLVKPSETLSLTCTVSGGFISRSTYYW GWIRQPPGKGLEWIGSIYYSGSTSYSPSLKSRVTISV DTSKNQFSLKLSSVTAADTAVYYCARLNSSWSFDY WGQGTLVTVSS |
| | | | SEQ ID NO: 24964 | SEQ ID NO: 28970 |
| iPS:393992 | 21-225_14H8 | NA | GACATCCAGATGACCCAGTCTCCATCCTCACT GTCTGCATCTGTAGGAGACAGAGTCACCATCA CTTGTCGGGCGAGTCAGGGCATTAGAAGTATTAT TTAGCCTGGTTTCAGCAGAAACCAGGGAAAGC CCCTAAGTCCCTGATCTATGTTGCATCCAGTT GCAAAGTGGGGTCCCATCAAAGTTCAGCGGCA GTGGATCTGGGACAGATTTCACTCTCACCATC AGCAGCCTGCAGCCTGAAGATATAGTTACCATCA TTACTGCCAACACAGTATATAGTTACCCATTCA CTTTCGGCCCTGGGACCAAAGTGGATATCAAT | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCAATAGCAT GAACTGGGTCCGCCAGGCTCCAGGGAAGGGGCT GGAGTGGGTTTCATACATTAGTAGTAGTAGTAGT ACCATATACGCAGACTCTGTGAAGGGCCGAT TCACCATCTCCAGAGACAATGCCAAGAACTCACT GTATCTGCAAATGAACAGCCTGAGAGACGAGGA CACGGGCTGTGTATTACTGTGCGAGAGGTTGGG AGCCCTTTTGACTACTGGGGCCAGGGAACCCTGG TCACCGTCTCCTCA |
| | | | SEQ ID NO: 24965 | SEQ ID NO: 28971 |

FIGURE 50
(Continued)

| | | | |
|---|---|---|---|
| iPS:393994 | 21-225_8C9 | AA | DIQMTQSPSSLSASVGDRVTITCRASQGISYYLAWFQQKPGKAPKSLIYAASSLQSGVPSKFSGSGSGTDFTLTISSLQPEDFATYYCQQYNSYPFTFGPGTKVDIN<br>SEQ ID NO: 24966 | EVQLVESGGGLVQPGGSLRLSCAASGFTFSSNSMNWVRQAPGKGLEWVSYISSSSSTIYYADSVKGRFTIARDNAKNSLYLQMNSLRDEDTAVYYCARGGGSPFDYWGQGTLVTVSS<br>SEQ ID NO: 28972 |
| | | NA | GACATCCAGATGACCCAGTCTCCATCCTCCCTGTCTGCATCTATAGGAGACAGAGTCACCATCACTTGCCGGGCAAGTCAGGGCCATTAGAAATGATTTAGACTGGTATCAGCAGAAACCAGGGAAAGCCCCTAAGCGCCTTATCTATGCTGCATCCAGTTTGCAAAGTGGGGTCCCATCAAGGTTCAGCGGCAGTGGATCTGGGACAGAGATTCACTCTCACAATCAGCAGCCTGCAGACTGAAGATTTTGCAACTTATTACTGTCTACAGCATAATAGTTATCCGCTCACTTTCGGCGGAGGGACCAAGGTGGAGATCAAA<br>SEQ ID NO: 24967 | CAGGTGCAGCTGGTGGAGTCTGGGGGAGGCGTGGTCCAGCCTGGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAGTTATATGTAGACTCCGTGAAGGGCCGATAATAAATACTATGTAGACTCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGAATTGGGGTTCCGGTCTGACTACTGGGGCCAGGGAACCCTGGTCACCGTCTCCTCA<br>SEQ ID NO: 28973 |
| | | AA | DIQMTQSPSSLSASIGDRVTITCRASQAIRNDLDWYQQKPGKAPKRLIYAASSLQSGVPSRFSGSGSGTEFTLTISSLQTEDFATYYCLQHNSYPLTFGGGTKVEIK<br>SEQ ID NO: 24968 | QVQLVESGGGVVQPGRSLRLSCAASGFTFSSYGMHWVRQAPGKGLEWVAVIWYDENNKYYVDSVKGRFTISRDNSKNTLYLQMNSLRAEDTAVYYCARELGFRSDYWGQGTLVTVSS<br>SEQ ID NO: 28974 |

FIGURE 50
(Continued)

| | | | |
|---|---|---|---|
| iPS:393996 | 21-225_15C11 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAGCCAGGGAAAG TCCCTAAGCGCCTGATCTATGCTGCATCCAGT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACTGCATTATAGTTACCCTCGA CGTTCGGCCGAGGGACCAAGGTGGAAATCAA A |
| | | | SEQ ID NO: 24969 |
| | | AA | DIQMTQSPSSLSASVGDRVTITCRASQGIRNDLG WYQQKPGKVPKRLIYAASSLQSGVPSRFSGSGS GTEFTLTISSLQPEDFATYYCLLHYSYPRTFGRGT KVEIK |
| | | | SEQ ID NO: 24970 |
| iPS:393998 | 21-225_12B12 | NA | GACATCCAGATGACCCAGTCTCCATCTCCCT GTCTGCGTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGTTACCCGTG GACGTTCGGCCAGGGACCAAGGTGGTCATCA AA |
| | | | SEQ ID NO: 24971 |

| | | | |
|---|---|---|---|
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAAG ACACGGCTGTGTATTACTGTGCGAGAGAAGTA TAGCAGCAGCTGGTACGACTACGGTTTGGACGTC TGGGGCCAAGGGACCACGGTCACCGTCTCCTCA |
| | | | SEQ ID NO: 28975 |
| | | | QVQLVESGGGVVQPGRSLRLSCAASGFTFSDYVM HWVRQAPGKGLEWVAVIWYDGSNKYYADSVKGR FTISRDNSKNTLYLQMNSLRAEDTAVYYCAREKYS SSWYDYGLDVWGQGTTVTVSS |
| | | | SEQ ID NO: 28976 |
| | | | CAGGTGCAACTGGTGGAGTCTGGGGGAGGCGTG GTCCAGCCTGGGAGGTCCCTGAGACTCTCCTGTG CAGCGTCTGATTCACCTTCAGTGACTATGGCAT GCACTGGGTCCGCCAGGCTCCAGGCAAGGGGCT GGAGTGGATGGCAGTTATATGGTATGATGTAACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTTTATTACTGTGCGAGAGAGCTTGG CTGGTACGAGGACTACTGGGGCCAGGGAACCCT GGTCACCGTCTCCTCA |
| | | | SEQ ID NO: 28977 |

FIGURE 50
(Continued)

| | | | |
|---|---|---|---|
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPWTFGLGT KVVIK | QVQLVESGGGVVQPGRSLRLSCAASGFTFSDYGM HWVRQAPGKGLEWMAVIWYDVTNKYYADSVKG RFTISRDNSKNTLYLQMNSLRAEDTAVYYCARELG WYEDYWGQGTLVTVSS |
| | | | SEQ ID NO: 24972 | SEQ ID NO: 28978 |
| iPS:394000 | 21-225_11A2 | NA | GACATCCAGATGACCCAGTCTCCATCCTCCCT GTCTGCATCTGTAGGAGACAGAGTCACCATCA CTTGCCAGGCGAGTCAGACAGCATTAGCAACTAT TTAAATTGGTATCAGCAGAAACCAGGGAAAG CCCCTAAGCTCCTGATCTACGATGCATCCAAT TTGGAAACAGGGGTCCCCTCAAGATTCAGTGG AAGTGGATCTGGGACAGATTTACTTTCACCA TCAGCAGCCTGCAACCTGAGGATGTTGCAACA TATTACTGTCAACAGTATGATAATCTCCCGAT CACCTTCGGCCAAGGGACACGACTGGACATTA AA | CAGGTGCAGCTGGTGGAGTCTGGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGGTGGAAGT AATAAAGACTCTGCAGACTCCGTGAAGGGCCGA TTCATCATCTCCAGAGACAATTCCAAGAACACGC TGTATCTGCAAATGAACAGCCTGAGAGCTGAGG ACACGGCTGTGTATTACTGTGTGAGACGGGGATA CAGCTATGGCGGGTACGGTATGGACGTCTGGGG CCAAGGGACCACGGTCACCGTCTCCTCA |
| | | | SEQ ID NO: 24973 | SEQ ID NO: 28979 |
| | | AA | DIQMTQSPSSLSASVGDRVTITCQASQDISNYLN WYQQKPGKAPKLLIYDASNLETGVPSRFSGSGS GTDFTFTISSLQPEDVATYYCQQYDNLPITFGQG TRLDIK | QVQLVESGGGVVQPGRSLRLSCAASGFTFSSYGMH WVRQAPGKGLEWVAVISYGGSNKDSADSVKGRFII SRDNSKNTLYLQMNSLRAEDTAVYYCVRRGYSYG GYGMDVWGQGTTVTVSS |
| | | | SEQ ID NO: 24974 | SEQ ID NO: 28980 |

FIGURE 50
(Continued)

| | | | |
|---|---|---|---|
| iPS:394002 | 21-225_15G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGATCCCATCAAGGTTCAGCGG CAGTGGATTTGGGACAGAATTCACTCTCACAA TCAGCAGCCTGCAGCTGAAGATTTTGCAACT TATTACTGTCTACAGCATGATAATTACCCTCTC ACTTTCGGCGGAGGGACCAAGGTGGAGATCA AA |
| | | | SEQ ID NO: 24975 |
| | | AA | DIQMTQSPSSLSASVGDRVTITCRASQGIRNDLG WYQQKPGKAPKRLIYAASSLQSGIPSRFSGSGFG TEFTLTISSLQPEDFATYYCLQHSNYPLTFGGGT KVEIK |
| | | | SEQ ID NO: 24976 |
| | | | CAGCTGCAGCTGCAGGAGTCGGGCCCAGGACTG GTGAAGCCTTCGGAGACCCTGTCCCTCACCTGCA CTGTCTCTGGTGGCTCCATCAGCAGGAGTAGTTC CTACTGGGGCTGGATCCGCCAGCCCCCAGGGAA GGGACTGGAGTGGATTGGGAGTATCTATTATAGT GGGTACACCTATTACAACCCGTCCCTCAAGAGTC GAGTCACCATATCCGTGGACACGTCCAAGAACC AGTTCTCCCTGAGGCTGAGCTCTGTGACCGCGC AGACACGGCTTCGTATTACTGTGCGAGACTGAGC AGCAGTTGGTCTTTTGACTTCTGGGGCCAGGGAA CCCTGGTCACCGTCCTCCTCA |
| | | | SEQ ID NO: 28981 |
| | | | QLQLQESGPGLVKPSETLSLTCTVSGGSISRSSSYW GWIRQPPGKGLEWIGSIYYSGYTYYNPSLKSRVTIS VDTSKNQFSLRLSSVTAADTASYYCARLSSSWSFD FWGQGTLVTVSS |
| | | | SEQ ID NO: 28982 |
| iPS:394004 | 21-225_13A1 | NA | GACATCCAGATGACCCAGTCTCCATCTCCCT GTCTGCATCTGTAGGAGACAGAGTCACCATCA CTTGCCAGGCGAGTCAGGACATTAACAACTAT TTAAATTGGTATCAGCAGAAACCAGGGACAGC CCCTAAGCTCCTGATCTACGATGGATCCAATT TGGAAACAGGGGTCCCATCAAGGTTCAGTGGA AGTGGATCTGGGACAGATTTTACTTTCACCAT CAGCAGCCTGCAGCCTGAAGATATTGCAACAT ATTACTGTCAACAGTATGAAGATCTCCCGATC ACTTTCGGCGGAGGGACCAAGGTGGAGATTAA A |
| | | | SEQ ID NO: 24977 |
| | | | CAGGTGCAGTTGGTGGAGTCTGGGGGAGGCGTG GTCCAGCCTGGGGAGGTCCCTGAGACTCTCCTGTG CAGCCTCTGATTCACTTCAGCAGTCAGTGCAT GCACTGGGTCCGCCAGGTTCAGGCAAGGGCT GGAGTGGGTGGCAGTTATATCATATGCGGAAACT AATCAATACTATGCAGACTCCGTGAAGGGCCGAT TCACCATTTCCAGAGACAATTCCAAGAACACGCT CTATCTGCAAATGAACAGCCTGAGAGCTGAGGA CACGGCTGTGTTTATTATTGTGTGAGACGGGATAC AGCTATGCGGGTACGATGGACGTCTGGGGC CAAGGGACCACGGTCACCGTCTCCTCA |
| | | | SEQ ID NO: 28983 |

FIGURE 50
(Continued)

| | | | |
|---|---|---|---|
| iPS:394006 | | AA | DIQMTQSPSSLSASVGDRVTITCQASQDINNYLN WYQQKLGTAPKLLIYDGSNLETGVPSRFSGSGS GTDFTFTISSLQPEDIATYYCQQYENLPITFGQGT RLEIK | QVQLVESGGGVVQPGRSLRLSCAASGFTFSSYGMH WVRQAPGKGLEWVAVISYAGTNQYYADSVKGRF TISRDNSKNTLYLQMNSLRAEDTAVYYCVRRGYSY GGYGMDVWGQGTTVTSS |
| | | | SEQ ID NO: 24978 | SEQ ID NO: 28984 |
| | 21-225_15C2 | NA | GACATCCAGATGACCCAGTCTCCATCCTCCT GTCTGCATCTGTAGGAGACAGAGTCACCATCA CTTGCCAGGCGAGTCAGACATTACCAACTAT TTAAATTGGTATCAGCAGAAACCAGGGAAAG CCCCTAAGCCTCTGATCTACGATGCATCCAATT TGGAAAACAGGGGTCCCATCAAGGTTCAGTGGA AGTGGATCTGGGACAGATTTTACTTTCACCAT CAGCAGCCTGCAGCCTGAAGATATTGCGACAT ATTACTGTCAACAGTATGATAATCTCCCGATC ACCTTCGGCCCAAGGGACACGACTGGAGATTAA A | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTCATATACTATGCAGACTCCGTGAAGGGCCGAT TCACCATCTCCAGAGACAATTCCAAGAACACGCT GTATCTGCAAATGAACAGCTGAGAGCTGAGGA CACGGCTGTGTATTACTGTGTGAGACGGGATAC AGCTATGGCGGGTAGGGTATGGACGTCTGGGGC CAAGGGACCACGGTCACCGTCTCCTCA |
| | | | SEQ ID NO: 24979 | SEQ ID NO: 28985 |
| | | AA | DIQMTQSPSSLSASVGDRVTITCQASQDITNYLN WYQQKPGKAPNLLIYDASNLETGVPSRFSGSGS GTDFTFTISSLQPEDIATYYCQQYDNLPITFAQGT RLEIK | QVQLVESGGGVVQPGRSLRLSCAASGFTFSSYGMH WVRQAPGKGLEWVSIISYGGRNNHYADSVKGRFTI SRDNSKNTLYLQMNSLRAEDTAVYYCVRRGYSYG GYGMDVWGQGTTVTSS |
| | | | SEQ ID NO: 24980 | SEQ ID NO: 28986 |

FIGURE 50
(Continued)

| | | | |
|---|---|---|---|
| iPS:394008 | 21-225_15H8 | NA | GACATCCAGATGACCCAGTCTCCATCCTCCT GTCTGCATCTGTAGGAGACAGAGTCACCATCA CTTGCCGGGCAAGTCAGGACAGTCATTAGAAATGAT TTAGGCTGGTATCAGCAGAAACCAGGGAAAG CCCCTAAGCGCCTGATCTTTGCGCATCCAGTT TGCAAAGTGGCGTCCCATCACGGTTCAGGGC AGTGGATCTGGGACAGAATTCACTCTCACAAT CAGCAGCCTGCAGCCTGAAGATTTTGCAACTT ATTACTGTCTACAGCATATAGTTACCCGCTC ACTTTCGGCGGAGGGACCAAGGTGGAGATCA GA<br><br>SEQ ID NO: 24981 | GAGGTGCAGCTGGTGGAGTCTGGGGGAGGCCTG GTCAAGCCTGGGGGGTCCCTGAGACTCTCCTGTG CAGCCCTCTGGATTCACCTTCAGCAGCTATGTCAT GAACTGGGTCCGCCAGGCTCCAGGGAAGGGGCT GGAGTGGGTCTCATCCATTAGTGGTAGTAGTACT TACATATACTGCGAGACTCAATCAAGGGCCGAT TCACCATCTCCCGAGACAACGCCAAGAACTCTCT GTATCTGCAAATGAACAGCCTGAGAGCCGATGA CACGGCTGTGTATTACTGTGCGAGAGATCGAGGC TCCATCTGGGGCCAAGGGACAATGGTCACCGTCT CTTCA<br><br>SEQ ID NO: 28987 |
| | | AA | DIQMTQSPSSLSASVGDRVTITCRASQGIRNDLG WYQQKPGKAPKRLIFAASSLQSGVPSRFSGSGSG TEFTLTISSLQPEDFATYYCLQHNSYPLTFGGGT KVEIR<br><br>SEQ ID NO: 24982 | EVQLVESGGGLVKPGGSLRLSCAASGFTFSSYVMN WVRQAPGKGLEWVSSISGSSTYIYCADSIKGRFTIS RDNAKNSLYLQMNSLRADDTAVYYCARDRGSIWG QGTMVTVSS<br><br>SEQ ID NO: 28988 |
| iPS:394010 | 21-225_12G5 | NA | GACATCCAGATGACCCAGTCTCCATCCTCCT GTCTGCATCTGTAGGAGACAGAGTCACCATCC CTTGCCGGGCGAGTCAGGACATTAGCAATTAT TTAGCCTGGTATCAGCAGAAACCAGGGAAAGT TCCTAAGCTCCTGATCTATGCTGCATACATTTT GCAATCAGGGGTCCCATCTCGTTCAGTGGCA GTGGATCTGGGACAGATTTCACTCTCACCATC AGCAGCCTGCAGCCTGAAGATGTTGCAGCTTA TTACTGTCAAAAGTATGACAGTGCCCATTCA CTTTCGGCCCTGGGACCAAAGTGGATATCAAA<br><br>SEQ ID NO: 24983 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAACTATGGCAT CTACTGGGTCCGCCAGGCTCCAGGCAAGGGGCT GGAGTGGGTGGCAGTTATATCATATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGATCGGGG AGCAGGGCGTCGTACTACTACGGTATAGAC GTCTGGGGCCAAGGGACCACGGTCACCGTCTCCT CA<br><br>SEQ ID NO: 28989 |

FIGURE 50
(Continued)

| | | | | |
|---|---|---|---|---|
| | | AA | DIQMTQSPSSLSASVGDRVTIPCRASQDISNYLA WYQQKPGKVPKLLIYAAYILQSGVPSRFSGSGSG TDFTLTISSLQPEDVAAYYCQKYDSAPFTFGPGT KVDIK | QVQLVESGGGVVQPGRSLRLSCAASGFTFSNYGIY WVRQAPGKGLEWVAVISYDGSNKYYADSVKGRFT ISRDNSKNTLYLQMNSLRAEDTAVYYCARDRGAV AAYYYYGIDVWGQGTTVTVSS |
| | | | SEQ ID NO: 24984 | SEQ ID NO: 28990 |
| iPS:394012 | 21-225_15A3 | NA | GACATCCAGATGACCCAGTCTCCATCCTCCCT GTCTGCATCTGTAGGAGACAGAGTCACCATCA CTTGCCGGGCAAGTCAGAGCATTATCAGTAT TTAAATTGGTATCTGCAGAAACCAGGGAAAGC CCCTAAGTTCCTGATCTATACTGCATCCAGTTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTACTGTCAACAGATTACAGTACCCGCTCA CTTTCGGCGGAGGGACCAAGGTGGAGATCAA G | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT TCACTGGGTCCGCCAGGCTCCAGGCAAGGGGCT GGAGTGGGTGGCAGTTATATACTACGACTCCGTGAAGGGCCG ATTCACCATCTCCAGAGACAACAATTCCAAGAACACG CTGTATCTGCAAATGAACAGCCTGAGAGCCGAG GACACGGCTGTGTATTACTGTGCGAGAGATCTGA GTATGGGGGTATGGACGTCTGGGGCCAAGGGA CCACGGTCACCGTCTCCTCA |
| | | | SEQ ID NO: 24985 | SEQ ID NO: 28991 |
| | | AA | DIQMTQSPSSLSASVGDRVTITCRASQSIISYLNW YLQKPGKAPKFLIYTASSLQSGVPSRFSGSGSGT DFTLTISSLQPEDFATYYCQQTYSTPLTFGGGTK VEIK | QVQLVESGGGVVQPGRSLRLSCAASGFTFSSYGIH WVRQAPGKGLEWVAVIWHDGSNKYYADSVKGRF TISRDNSKNTLYLQMNSLRAEDTAVYYCARDLSM GGMDVWGQGTTVTVSS |
| | | | SEQ ID NO: 24986 | SEQ ID NO: 28992 |

FIGURE 50
(Continued)

| | | | | |
|---|---|---|---|---|
| iPS:394014 | 21-225_8G6 | NA | GACATCCAGATGACCCAGTCTCCATCCTCCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCCAAGCTCCTGATCTTTGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCTTT TCACTTTCGGCCCTGGGACCAAAGTGGATAT CAAA | GAGGTGCAGCTGTTGGAGTCTGGGGGAGGCTTG GTACAGCCTGGGGGGTCCCTGAGACTCTCCTGTG TAGCCTTCTGAATTCACCTTTAGCAGTCATGTCAT GAACTGGGTCCGCCAGGCTCCAGGGAAGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGTCCCGTTTGGCA GTGGCTGCTCGGAGGCTTTTGATATCTGGGGCC AAGGGACAATGGTCAGCGTCAGCGTCTCTTCA SEQ ID NO: 28993 |
| | | | SEQ ID NO: 24987 | |
| | | AA | DIQMTQSPSSLSASVGDRVTITCRASQSISSYLNW YQQKPGKAPKLLIFAASSLQSGVPSRFSGSGSGT DFTLTISSLQPEDFATYFCQQSYRTPFFTFGPGTK VDIK | EVQLLESGGGLVQPGGSLRLSCVASEFTFSSYVMN WVRQAPGKGLEWVSVISGRGGNTFYADSVKGRFTI SRDNSKNTLYLQMNSLRAEDTAVYYCASRLAVAG SEAFDIWGQGTMVSVSS |
| | | | SEQ ID NO: 24988 | SEQ ID NO: 28994 |
| iPS:394016 | 21-225_13D4 | NA | GACCTCCAGATGACCCAGTCTCCATCCTCCCT GTCTGCATCTGTAGGAGACAGAGTCACCATCA CTTGCCGGGCAAGTCAGAGCATTAGTCAGCTAC TTAAATTGGTATCAGCAGAAACCAGGGAAAG CCCCTAAGCTCCTGATCTGTACTGCATCCAGTT TGCAAAATGGGGTCCCATCAAGGTTCACTCTCAC AGTGGATCTGGGACAGATTTCACTCTCACCATT CAGCAGTCTACAGCCTGAGGATTTTGCAACTT ACTACTGTCAACAGACTTACAGTCTTCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTTGCAT GCACTGGGTCCGCCAGGCTCCAGGCAAGGGGCT GGAGTGGGTGGCAGTTATATGCAGTGATGAAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCAGAGATCTGA GTATGGGGGTATGGACGTCTGGGGCCAAGGGA CCACGGTCACCGTCTCCTCA |
| | | | SEQ ID NO: 24989 | SEQ ID NO: 28995 |

FIGURE 50
(Continued)

| | | | | |
|---|---|---|---|---|
| iPS:394018 | 21-225_15B1 | AA | DLQMTQSPSSLSASVGDRVTITCRASQSIFSYLNWYQQKPGKAPKLLICTASSLQNGVPSRFSGSGSGTDFTLTISSLQPEDFATYYCQQTYSLPLTFGGGTKVEIK<br>SEQ ID NO: 24990 | QVQLVESGGGVVQPGRSLRLSCAASGFTFSSYGMHWVRQAPGKGLEWVAVIWHDGSNKYYADSVKGRFTISRDNSKNTLYLQMNSLRAEDTAVYYCARDLSMGGMDVWGQGTTVTVSS<br>SEQ ID NO: 28996 |
| | | NA | GACATCCAGATGACCCAGTCTCCATCCTCACTGTCTGCATCTGTAGGAGACAGAGTCACCATCACTTGTCGGGCGAGTCAGGGCATTAGCAATTATTTAGCCTGGTTTCAGCAGAAACCAGGGAAAGCCCCTAAGTCCCTAATCTCTGCTGCATCCAGTTTGCAAAGTGGGGTCCCATCAAACTTCAGCGGCAGTGGATCTGGGACAGATTTCACTCTCACCATCAGCAGCCTGCAGCCTGAAGATTATCATAGTTACCACCATTCATTACTGCCAACAGTATCATAGTTACCATTCACTTTCGGCGGCCCTGGGACCAAAGTGGATATCAAA<br>SEQ ID NO: 24991 | GAGGTGCAGCTGTTGGAGTCTGGGGGAGGCTTGGTACAGCCGGGGGGGTCCCTGAGACTCTCCTGTGCAACCTCAGGATTCACCTTTAGCAGCTATGTCATGAGCTGGGTCCGCCAGGCTCCAGGGAAGGGGCTGGAGTGGGTCTCAGTTATTAGTGGTAGTGGTGGTAGCACAAACAACCAGCAGACTCCGTGAAGGGCCGGTTCACCATCTCCAGAGACAACGCCAAGAACACGCTGTATCTGCAAGTGAACAGCCTGAGAGCCGAGGACACGGCCGTATATTACTGTGCCCGCAGTCCTTGTTTGACTACTGGGGCCAGGGAACCCTGGTCACCGTCTCCTCA<br>SEQ ID NO: 28997 |
| | | AA | DIQMTQSPSSLSASVGDRVTITCRASQGISNYLAWFQQKPGKAPKSLISAASSLQSGVPSNFSGSGSGTDFTLTISSLQPEDFATYYCQQYHSYPFTFGPGTKVDIK<br>SEQ ID NO: 24992 | EVQLLESGGGLVQPGGSLRLSCATSGFTFSSYVMSWVRQAPGKGLEWVSGISGSGGSTNNADSVKGRFTISRDNSKNTLYLQVNSLRAEDTAVYYCARSSLFDYWGQGTLVTVSS<br>SEQ ID NO: 28998 |

FIGURE 50
(Continued)

| | | | | |
|---|---|---|---|---|
| iPS:394020 | 21-225_15H10 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCGGGACAGAATTCACTCTCACAA TCAGCAGCCTGCAGCCTGAAGATTTTGCAAGT TATTACTGTCTACAGCATAATAGTTACCCGCTC ACTTTCGGCGGAGGGACCAAGGTGGAGATCA AT SEQ ID NO: 24993 | CAGGTGCAGCTGGTGGAGTCTGGGGGAGGCGTG GTCCAGCCTGGGAGGTCCCTGAGACTCTCCTG CAGCGTCTGGATTCACCTTCAGTAACTATGGCAT GCACTGGGTCCGCCAGGCTCCAGGCAAGGGCT GGAGTGGGTGGCAGTTATATGGTATGATGAAAGT AATAAATACTATGAAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGTGAGGGAAGTGG GTTTCTTTCGACTACTGGGGCCAGGGAATCCTG GTCACCGTCTCCTCA SEQ ID NO: 28999 |
| | | AA | DIQMTQSPSSLSASVGDRVTITCRASQGIRNDLG WYQQKPGKAPKRLIYAASSLQSGVPSRFSGSGS GTEFTLTISSLQPEDFASYYCLQHNSYPLTFGGGT KVEIN SEQ ID NO: 24994 | QVQLVESGGGVVQPGRSLRLSCAASGFTFSNYGM HWVRQAPGKGLEWVAVIWYDESNKYYEDSVKGR FTISRDNSKNTLYLQMNSLRAEDTAVYYCVREVGF LSDYWGQGILVTVSS SEQ ID NO: 29000 |
| iPS:394022 | 21-225_16H6 | NA | GACATCCAGATGACCCAGTCTCCATCCTCCCT GTCTGCATCTGTAGGAGACAGAGTCACCATCA CTTGCCGGGCAAGTCAGAACATTAGCAGTAT TTAAATTGGTATCAGCAGAAACCAGGGAAAG CCCCTAAGCTCCTGATCTATGCTGCATCCAGT TGCAAAGTGGGGTCCCATCAAGGTTCAGTGGC AGAGGATCTGGACAGATTTCACTCTCACCAT CAGTAGTCTGCAACTGAAGATTTTGCAACTT ACTACTGTCAACAGAGTTACAGAACCCCTTA TTCACTTTCGGCCCTGGGACCAAGGTTGATTTC AAA SEQ ID NO: 24995 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGCTCCAGGGATGGGCT GGAGTGGGTCTCAGTTATTAGTCGTAGTGGTGGT TACACATACTACGCAGACTCCGTGAAGGGCCGGT TCACCATCTCCAGAGACAATTCCAAGAACAGCT GTATCTGCAAATGAACAGCCTGAGAGCCGAGGA CACGGCCGTCTATTACTGTGCGCCCGTTTAGCA GTGGCTGGCTCCGGAGGCTTTGATATCTGGGGCC AAGGGACAATGGTCACCGTCTCTTCA SEQ ID NO: 29001 |

FIGURE 50
(Continued)

| | | AA | DIQMTQSPSSLSASVGDRVTITCRASQNISSYLN WYQQKPGKAPKLLIYAASSLQSGVPSRFSGRGS GTDFTLTISSLQPEDFATYYCQQSYRTPLFTFGPG TKVDFK<br>SEQ ID NO: 24996 | EVQLLESGGGLVQPGGSLRLSCAASGFTFSSYAMN WVRQAPGMGLEWVSVISRSGGYTYYADSVKGRFT ISRDNSKNTLYLQMNSLRAEDTAVYYCASRLAVAG SEAFDIWGQGTMVTVSS<br>SEQ ID NO: 29002 |
| iPS:394024 | 21-225_16B7 | NA | GACATCCAGATGACCCAGTCTCCATCCTCCCT GTCTGCATCTGTAGGAGACAGAGTCACCATCA CTTGCCGGGCAAGTCAGGGACAGTCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATATAGTTACCCGCTC ACTTTCGGCGGAGGGACCAAGGTGGAGTTCAA T<br>SEQ ID NO: 24997 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCAGACTCCGTGAAGGCCGA AATAAATACTATGCAGACTCCGTGAAGGCCGA TTCACCATCTCCAGAGACAATTCCAAGAACACGC TGTATCTGCAAATGAACAGCCTGAGAGCCGAGG ACACGGCTGTGTATTACTGTGCGAGGGAACTGGG GTTTCTCTGACTACTGGGGCCAGGGAACCCTG GTCACCGTCTCCTCA<br>SEQ ID NO: 29003 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEFN<br>SEQ ID NO: 24998 | QVQLVESGGGVVQPGRSLRLSCAASGFTFSSYGMH WVRQAPGKGLEWVAVIWYDESNKYYADSVKGRF TISRDNSKNTLYLQMNSLRAEDTAVYYCARELGFL SDYWGQGTLVTVSS<br>SEQ ID NO: 29004 |

FIGURE 50
(Continued)

| | | | |
|---|---|---|---|
| iPS:394026 | 21-225_16C7 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTCTGCTGCATCCAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAGTATAATAGTTACCCATTCA CTTTCGGCCCTGGGACCAAAGTGGATATCAAA <br><br>SEQ ID NO: 24999 | GAGGTGCAACTGTTGGAGTCTGGGGGAGGCTTG GTACAGCCTGGGGGGTCCCTGAGACTCTCCTGTG CAGCCCTCTGGATTCACCTTTAGCAGCTATGTCAT GACCTGGGTCCGCCAGGCTCCAGGGAAGGGGCT GGAGTGGGTCTCAACTATTAGTGGTAGTGGTGGT TGGACATATTATGCAGACTCCGTGAAGGGCCGGT TCACCATTTCCAGAGACAATTCCAAGAACACGCT GTATCTGCAAATGAACAGCCTGAGAGCCGAGGA CACGGCCGAATATTACTGTGCCCGCAGCTCCTTG TTTGACTATTGGGGCCAGGGAACCCTGGTCACCG TCTCCTCA <br><br>SEQ ID NO: 29005 |
| | | AA | DIQMTQSPSSLSASVGDRVTITCRASQGISNYLA WFQQKPGKAPKSLISAASSLQSGVPSKFSGSGSG TDFTLTISSLQPEDFATYYCQQYNSYPFTFGPGT KVDIK <br><br>SEQ ID NO: 25000 | EVQLLESGGGLVQPGGSLRLSCAASGFTFSSYVMT WVRQAPGKGLEWVSTISGSGGWTYYADSVKGRFT ISRDNSKNTLYLQMNSLRAEDTAEYYCARSSLFDY WGQGTLVTVSS <br><br>SEQ ID NO: 29006 |
| iPS:394029 | 21-225_1B12 | NA | GACATCCAGATGACCCAGTCTCCATCCTCCCT GTCTGCATCTGTAGGAGACAGAGTCACCATCA CTTGCCAGGCGAGTCAGGACATTAACAACTAT TTAAATTGGTATCAACAGAAACCAGGGAAAG CCCCTAAGCTCCTGATATACGATGCATCCAAT TTGGAAACAGGGGTCCCATCAAGGTTCAGTGG AAGTGGATCTGGGACAGATTTCACTTTCACCA TCAGCAGTCTGCAGCCTGAAGATATTACAACA TATTACTGTCAACAGTATGAAAATCTCCCGAT CACCTTCGGCCAAGGGACACGACTGGAGATTA AA <br><br>SEQ ID NO: 25001 | CAGGTGCAGCTGGTAGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAATTATATATCATATGTGAAGT AATAAATCTATGCAGACTCCGTGAAGGGCCGAT TCACCATCTCCAGAGACAATGAATAGCCTGAGGA GTATCTGCAAATGAATAACTGTGTGAGACGGGATAC AGCTATGGCGGTACGATGTGACGTCTGGGGC CAAGGGGCCACGGTCACCGTCTCCTCA <br><br>SEQ ID NO: 29007 |

FIGURE 50
(Continued)

| | | | |
|---|---|---|---|
| iPS:394033 | 21-225_5F4 | AA | DIQMTQSPSSLSASVGDRVTITCQASQDINNYLN WYQQKPGKAPKLLIYDASNLETGVPSRFSGSGS GTDFTFTISSLQPEDITTYYCQQYENLPITFGQGT RLEIK<br><br>SEQ ID NO: 25002 | QVQLVESGGGVVQPGRSLRLSCAASGFTFSSYGMH WVRQAPGKGLEWVAIISYAGSNKSYADSVKGRFTI SRDNSKNMLYLQMNSLRAEDTAVYYCVRRGYSY GGYGMDVWGQGATVTVSS<br><br>SEQ ID NO: 29008 |
| | | NA | GACATCCAGATGACCCAGTCTCCATCCTCCCT GTCTGCATCTGTAGGAGACAGAGTCACCATCA CTTGCCGGGCAAGTCAGGGCATTCGAAATCAT TTAGGCTGGTATCAGCAGAAACCAGGGAAAG CCCCTAAGCGCCTGATCTATGCTGCCTCCAGTT TGCAAAGTGGGGTCCCATCAAGGTTCAGCGGC AGTGGATCTGGGACAGACCTCACTCTCACAGT CAGCAGCCTGCAGCCTGAAGATTTTGCAACTT ATTACTGTCTACAGTATATAATGGTTACCCATTCA CTTTCGGCCCTGGGACCAAAGTGGATATCAAA<br><br>SEQ ID NO: 25003 | GAGGTGCAGTTGGTGGAGTCTGGGGGAGGCCTG GTCAAGCCTGGGGGGTCCCTGAGACTCTCCTGTG TAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTTTCTGCAAATGAACAGCCTGAGAGCCGAGGA CACGGCTGTGTATTACTGTGCGAGAGTTAACAAC TTTGACTACTGGGGCCAGGGAACCCTGGTCACCG TCTCCTCA<br><br>SEQ ID NO: 29009 |
| | | AA | DIQMTQSPSSLSASVGDRVTITCRASQGIRNHLG WYQQKPGKAPKRLIYAASSLQSGVPSRFSGSGS GTEFTLTVSSLQPEDFATYYCLQYNGYPFTFGPG TKVDIK<br><br>SEQ ID NO: 25004 | EVQLVESGGGLVKPGGSLRLSCVASGFTFSSYSMN WVRQAPGKGLEWVSSISGSSSYIYYADSVKGRFTIS RDNAKNSLFLQMNSLRAEDTAVYYCARVNNFDY WGQGTLVTVSS<br><br>SEQ ID NO: 29010 |

FIGURE 50
(Continued)

| | | | | |
|---|---|---|---|---|
| iPS:394035 | 21-225_5G9 | NA | GACATCCAGATGACCCAGTCTCCATCTCCCT GTCTGCATCTGTAGGAGACAGAGTCACCATCA CTTGCCAGGCGAGTCAGGGCATTAGCAACTCT TTAAATTGGTATCAGCAGAAACCAGGAAAG CCCCTAAACTCCTGATCTACGATGCATCCAAT TTGGAAACAGGGGTCCCATCAAGGTTCAGTGG AAGTGGAGCTGGGACAGATTTTACTTTCACCA TCAGCAGCCTGCAGCCTGAAGATATTGCAACA TATTACTGTCAACAATATGATATAATCTCCCGCTC ACTTTCGGCGGAGGGACCAAGGTGGAGATCA AA SEQ ID NO: 25005 | CAGGTGCAGCTGGTGGAGTCTGGGGGAGGCGTG GTCCAGCCTGGGGAGGTCCCTGAGACTCTCCTGTG CAGCCTCTGGATTCACCTTCAGTAGTAATTATGGCAT GCACTGGGTCCGCCAGGTCCAGGCAAGGGCT GGAGTGGGTGGCAATTATATCATATGCTGAAGT AATAAATACTATGCAGACTCCGTGAAGGCCGA TTCACCATCTCCAGAGACAATTCCAAGAACACGC TGTATCTGCAAATGAACAGCCTGAGAGTGAGG ACACGGCTGTGTATTACTGTGTGAGACGTATAAC AGCTGTCTCTACTAGGTATGGACGTCTGGGGC CAAGGGACCACGGTCACCGTCTCCTCA SEQ ID NO: 29011 |
| | | AA | DIQMTQSPSSLSASVGDRVTITCQASQGISNSLN WYQQKPGKAPKLLIYDASNLETGVPSRFSGSGA GTDFTFTISSLQPEDIATYYCQQYDNLPLTFGGG TKVEIK SEQ ID NO: 25006 | QVQLVESGGGVVQPGRSLRLSCAASGFTFSNYGM HWVRQAPGKGLEWVAIISYAGSNKYYADSVKGRF TISRDNSKNTLYLQMNSLRAEDTAVYYCVRRITAR LYYGMDVWGQGTTVTVSS SEQ ID NO: 29012 |
| iPS:394037 | 21-225_4F4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCGTCCAGT GTGCAAACTGGGGTCCCATCAAGGTTCAGCGG CAGTGGATCTGGGACAGACGCCTGAAGATTTTGCAATT TATTACTGTCTACAGCATAATAGTTACCCGCTC ACTTTCGGCGGAGGGACCAAGGTGGAGATCA AA SEQ ID NO: 25007 | CAGCTGCAGCTGCAGGAGTCGGGCCCAGGACTG GTGAGGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAAA GGGGAGCACTACGACAACCCGTCCCTCAAGAGT CGAGTCACCATATCCGTAGACACGTCCAAGAACC AGTTCTCCCTGAAGCTGAGCTCTGTGACCGCGC GGACACGCTGTTTATTACTGTGGGAGACATGGA AAAGACTGGGGCCTTGACTACTGGGGCCAGGGA ACCCTGGTCACCGTCTCCTCA SEQ ID NO: 29013 |

FIGURE 50
(Continued)

| | | | | |
|---|---|---|---|---|
| iPS:394041 | 21-225_5E5 | AA | DIQMTQSPSSLSASVGDRVTITCRASQGIRNDLGWYQQKPGKAPKRLIYAASSVQTGVPSRFSGSGSGTEFTLTISSLQPEDFAIYYCLQHNSYPLTFGGGTKVEIK | QLQLQESGPGLVRPSETLSLTCTVSGGSISRSSYYWGWIRQPPGKGLEWIGNIYSGSTYDNPSLKSRVTISVDTSKNQFSLKLSSVTAADTAVYYCGRHGKDWGLDYWGQGTLVTVSS |
| | | | SEQ ID NO: 25008 | SEQ ID NO: 29014 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGAAAGCCCCTAAGCGCCTGATCTATGCTGCATCCAGTTTGCAAAGTGGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAGTCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAACTATGTCATGCACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATGCCAAGAACACGCTGTATCTGCAAATGAACAGCCTGAGAGCCGAGGACACGGCTGTGTATTACTGTACGAGAGAGGTATATAGCAGTGGCTGGTACGACTACGGTATGGACGTCTGGGGCCAAGGGACCACGGTCACCGTCTCCTCA |
| | | | SEQ ID NO: 25009 | SEQ ID NO: 29015 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK | QVQLVESGGGVVQPGRSLRLSCAASGFTFSNYMHWVRQAPGKGLEWVAVIWYDGSNKYYADSVKGRFTISRDNSKNTLYLQMNSLRAEDTAVYYCTREVYSSGWYDYGMDVWGQGTTVTVSS |
| | | | SEQ ID NO: 25010 | SEQ ID NO: 29016 |

FIGURE 50
(Continued)

| | | | |
|---|---|---|---|
| iPS:394043 | 21-225_3B1 | NA | GACATCCAGATGACCCAGTCTCCATCTCCCT GTCTGCATCTGTAGGAGACAGAGTCACCATCA CTTGCCGGGCAAGTCAGAGTATTAATAATTAT TTAAATTGGTATCAGCAGAAACCAGGGAAAG CCCCTAAGCTCCTGATCTATGCTACATCCAGTT TGCAAAATGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCTTA TTCACTTTCGGCCCTGGGACCAAAGTGATAT CAAT | GAGGTGCAGCTGTTGGAGTCTGGGGGAGGCTTG GTACAGCCTGGGGGGTCCCTGAGACTCTCCTGTG CAGCCCTCTGAATTCACCTTTAGCAGCTATGCCAT GAACTGGGTCCGCCAGGCTCCAGGGAAGGGCT GGAGTGGGTCTCAGTTATTAGTGGTCGTGGTATT AACACATTCTACGCAGACTCCGTGAAGGGCCGGT TCACCATTTCCAGAGACAATTCCAAGAACACGCT GTATCTGCAAATGAACAGCCTGAGAGCCGAGGA CACGGCCGTATATTACTGTGCGTCCCGTTAGCA GTGGCTGGCTCGGAGGCTTTTGATATCTGGGCC AAGGGACAATGGTCACCGTCTCTTCA |
| | | | SEQ ID NO: 29017 |
| | | AA | DIQMTQSPSSLSASVGDRVTITCRASQSINNYLN WYQQKPGKAPKLLIYATSSLQNGVPSRFSGSGS GTDFTLTISSLQPEDFATYYCQQSYSTPLFTFGPG TKVDIN | EVQLLESGGGLVQPGGSLRLSCAASEFTFSSYAMN WVRQAPGKGLEWVSVISGRGINTFYADSVKGRFTI SRDNSKNTLYLQMNSLRAEDTAVYYCASRLAVAG SEAFDIWGQGTMVTVSS |
| | | | SEQ ID NO: 25011 | SEQ ID NO: 29018 |
| iPS:394045 | 21-225_4H4 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCGGGAAAAG CCCCTAAGCGCCTGATCTATGCTGCATCCAGT GTGCAAAGTGGGGTCCCATCAAGGTTCAGCGG CAGTGGATCTGGGACAGACTTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGATG GGAACACCTACAACAACCCGTCCCTCAAGAGTC GAGTCACCATATCCGTAGACACGTCCAAGAACC AGTTCTCCCTGAAGCTGAACTCTGTGACCGCGC AGACACGGCTGTGTATTACTGTGGAGACATGGA AAGACTGGGGCCTTGACTACTGGGGCCAGGGA ACCCTGGTCATCGTCTCCTCA |
| | | | SEQ ID NO: 25013 | SEQ ID NO: 29019 |

FIGURE 50
(Continued)

| | | | | |
|---|---|---|---|---|
| iPS:394047 | | AA | DIQMTQSPSSLSASVGDRVTITCRASQGIRNDLGWYQQKPGKAPKRLIYAASSVQSGVPSRFSGSGSGTEFTLTISSLQPEDFAIYYCLQHNSYPLTFGGGTKVEIK | QLQLQESGPGLVKPSETLSLTCTVSGGSISRSSYYWGWIRQPPGMGLEWIGNIYYSGNTYNNPSLKSRVTISVDTSKNQFSLKLNSVTAADTAVYYCGRHGKDWGLDYWGQGTLVIVSS |
| | | | SEQ ID NO: 25014 | SEQ ID NO: 29020 |
| | 21-225_5E6 | NA | GACATCCAGATGACCCAGTCTCCATCCTCCCTGTCTGCATCTGTAGGAGACAGAGTCACCATCACTTGCCAGGCGAGTCAGGACATTAACAGGGAAAGTTAAATTGGTGTCAACAGAAACCAGGGAAAGCCCCTAAGCTCTTGATATACGATGCATCCAATTTGGAAACAGGGGTCCCATCAAGGTTCAGTGGAAGTGGATCTGGGACAGATTTACTTTCACCATCAGCAGCCTGCAGCCTGAAGATATTGCAACATATTACTGTCAACAGTATGATAATCTCCCGATCACCTTCGGCCAAGGGACACGACTGGAGATTAAA | CAGGTGCAGCTGGTGGAGTCTGGGGGAGGCGTGGTCCAGCCTGGGAGGTCCCTGAGACTCTCCTGTCAGCCTCTGGATTCACCTTCAGTAGCTATGGCATGCACTGGGTCCGCCAGGCTCCAGGCAAGGGGCTGGAGTGGGTGGCAATTATATCGAGACTCCGTGAAGGGCCGAAATAAATACTATGCAGACTCCGTGAAGGGCCGATTCACCATCTCCAGAGACAATTCCAAGAACACGCTGTATCTGCAAATGAACAGCCTGAGAGTTGAGGACACGGCTGTGTATTACTGTGCGAGACGGGGATACAGTATGGCGGGTAGGTTATGGACGTCTGGGGCCAAGGGACCACGGTCACCGTCTCCTCA |
| | | | SEQ ID NO: 25015 | SEQ ID NO: 29021 |
| | | AA | DIQMTQSPSSLSASVGDRVTITCQASQDINNYLNWCQQKPGKAPKLLIYDASNLETGVPSRFSGSGSGTDFTFTISSLQPEDIATYYCQQYDNLPITFGQGTRLEIK | QVQLVESGGGVVQPGRSLRLSCAASGFTFSSYGMHWVRQAPKGLEWVAIISYVGNNKYYADSVKGRFTISRDNSKNTLYLQMNSLRVEDTAVYYCARRGYSYGGYGMDVWGQGTTVTVSS |
| | | | SEQ ID NO: 25016 | SEQ ID NO: 29022 |

FIGURE 50
(Continued)

| | | | |
|---|---|---|---|
| iPS:394049 | 21-225_13H5 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAACTGGGGTCCCATCAAGATTCAGCGG CAGTGGATCTGGGACAGATTCATTCTCACAA TCAGCAGCCTGCAGCTGAAGATTTTGCAACT TATTACTGTCTACAGCATAATAGTTACCCTCTC ACTTTCGGCGGAGGGACCAAGGTGGAGATCA AA<br>SEQ ID NO: 25017 | CAGCTGCAGCTGCAGGAGTCGGGCCCAGGACTG GTGAAGCCTGCGGAGACCCTGTCCCTGCACTTGCA CTGTCTCTGGTGGTCGATCCGCCAGCCCCAGGAA CTACTGGGGCTGGATCGGCCAGCCCCAGGAA GGGGCTGGAGTGGATTGGGAGTATCTATTATAGT GAGAGCACTACTACAACCGTCCCTCAAGAGTC AGTTCACCATATCCGTGGACACGTCCAAGAACC AGTTCTCCCTGAAGCTGAGCTCTGTGACCGCGC AGACACGGCTGTGTATTACTGTGCGAGCCTTAGC AGCAGCTGGGACTTCCAGCACTGGGGCCAGGGC ACCCTGGTCACCGTCCTCA<br>SEQ ID NO: 29023 |
| | | AA | DIQMTQSPSSLSASVGDRVTITCRASQGIRNDLG WYQQKPGKAPKRLIYAASSLQTGVPSRFSGSGS GTEFILTISSLQPEDFATYYCLQHNSYPLTFGGGT KVEIK<br>SEQ ID NO: 25018 | QLQLQLQESGPGLVKPAETLSLTCTVSGGSISRSSYYW GWIRQPPGKGLEWIGSIYYSGSTYYNPSLKSRVTIS VDTSKNQFSLKLSSVTAADTAVYYCASLSSSWDFQ HWGQGTLVTVSS<br>SEQ ID NO: 29024 |
| iPS:394051 | 21-225_9E5 | NA | GACATCCAGATGACCCAGTCTCAATCTCCCT GTCTGCATCTGTAGGAGACAGAGTCACCATCA CTTGCCGGGCAAGTCAGAGTCATTGCCAGTTAT TTAAATTGGTATCAGCAGAAACCAGGGAAAG CCCCTAAACTCCTGATCTATGGTGCACCAGTT TGCAAAGTGGGGTCCCATCAAGGTTCAGTGGC AGTGGATCTGGGACAGATTTCACTCTCACCAT CAGCAGTCTCCAACCTGAAGATTTTGCAACTT ACTACTGTCAACAGAGTTACAGTACCCCTTA TTCAGTTTCGGCCCTGGGACCAAAGTGGATAT CAAA<br>SEQ ID NO: 25019 | GAGGTGCAGCTGTTGGAGTCTGGGGGAGGCTTG GTACAGCCTGGGGGGTCCCTGAGACTCTCCTGTG CAGCCTCTGGATTCACCTTTAGCAACTATGCCAT GAACTGGGTCCGCCAGGCTCCAGGGAAGGGGCT GGAGTGGGTCTCAGCTATTAGTGGTGGTGGT AACACATTCTACGCAGACTCCGTGAAGGGCCGGT TCACCATCTCCAGAGACAATTCCAAGAACACGCT GTATCTGCAAATGAACGGCCTGAGAGCCGAGGA CACGGCCGTATATTACTGTGCGTCCCGTATAGCA GTGGGCTCGGAGGCTTTGCTATCTGGGGCC AAGGGACATTGGTCACCGTCTCTTCA<br>SEQ ID NO: 29025 |

FIGURE 50
(Continued)

| | | | | |
|---|---|---|---|---|
| iPS:394053 | 21-225_11F10 | AA | DIQMTQSQSSLSASVGDRVTITCRASQSIASYLN WYQQKPGKAPKLLIYGASSLQSGVPSRFSGSGS GTDFTLTISSLQPEDFATYYCQQSYSTPLFSFGPG TKVDIK | EVQLLESGGGLVQPGGSLRLSCAASGFTFSNYAMN WVRQAPGKGLEWVSAISGGGGNTFYADSVKGRFT ISRDNSKNTLYLQMNGLRAEDTAVYYCASRIAVAG SEAFAIWGQGTLVTVSS |
| | | | SEQ ID NO: 25020 | SEQ ID NO: 29026 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGTTCTGGGACAGACTTCACTCTCACAG TCAGCAGCCTGCAGCCTGAAGATTTTGCAACT TATTACTGTCTACAGCATAGTAGTTACCCTCTC ACTTTCGGCGGAGGGACCAAGGTGGAGATCA AA | CAGCTCTGCATCTGCAGGAGTCGGGCCAGGACTG GTGAAGCCTTCGGAGACCCTGTCCTCACCTGCA CTGTCTCTGGTGCCTCCATCAGCAGAAGTAGTTA CTACTGGGGCTGGATCCGCCAGCCCCCAGGGAA GGGGCTGGAGTGGATTGGGAGTATTATTATAGT GGGAGCGCCCAGTACAACCCGTCCCTCAAGAGT CGAGTCACCATATCCGTAGACACGTCCAAGAACC AGTTCTCCCTGACGCTGAGCTCTGTGACCGCGC AGACACGGCTGTATATTACTGTGCGAGACTGAGC AGCAGCTGGTCTTTTGACTACTGGGGCCAGGGAA CCCTGGTCACCGTCTCCTCA |
| | | | SEQ ID NO: 25021 | SEQ ID NO: 29027 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHSSYPLTFGGG TKVEIK | QLHLQESGPGLVKPSETLSLTCTVSGASISRSSYYW GWIRQPPGKGLEWIGSIYSGSAQYNPSLKSRVTIS VDTSKNQFSLTLSSVTAADTAVYYCARLSSSWSFD YWGQGTLVTVSS |
| | | | SEQ ID NO: 25022 | SEQ ID NO: 29028 |

| | | | |
|---|---|---|---|
| iPS:394059 | 21-225_9E8 | AA | DIQMTQSPSSLSASVGDRVTITCRASQGIRNDLG WYQQKPGKAPKRLIYTASSLQSGVPSRFNGSGS GTEFTLTISSLQPEDFATYYCLQHSSYPLTFGGGT KVEIK<br>SEQ ID NO: 25026 | QLQLQESGPGLVKFSETLSLTCTVSGGSISRSSYYW GWIRQPPGKGLEWIGNIYYSGYPYYNPSLKSRVTIS VDTSKNQFSLKLSSVTAADTAVYYCARHSTSWSLD YWGQGTLVTVSS<br>SEQ ID NO: 29032 |
| | | NA | GACATCCAGATGACCCAGTCTCCATCCTCCCT GTTTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTTATCTATGCTGCATCCAGTT TGCAAAGTGGTGGGTCCATCAAGGTTCAGCGGC AGTGGATCTGGGACAGAGAATTCACTCTCACAAT CAGCAGCCTGCAGCCTGAAGATTTTGCAACTT ATTACTGTCTACAGCATATAAGTTACCCGCTC ACTTTCGGCGGAGGGACCAAGGTGGAGATCA AA<br>SEQ ID NO: 25027 | CAGGTGCAGCTGTGGTGGAGTCTGGGGGAGGCGTG GTCCAGCCTGGGAGGTCCCTGAGACTCTCCTGTG AAGCGTCTGGATTCACCTTCAGTAGCTATGGCAT GCACTGGGTCCGCCAGGCTCCAGGCAAGGGGCT GGAGTGGGTGGCAGTTATTTGGTATGAAGAAAAT AATCAATACTATGCAGACTCCGTGAAGGGCCGAT TCACCATCTCCAGAGACAATTCCAAGAACACGCT GTATCTACAAATGAACAGCTGAGAGCCGAGGA CACGGCTGTGTATTACTGTGCGAGAGAACTGGGG TTCCGGTCTGACTACTGGGGCCAGGGAACCCTGG TCACCGTCTCCTCA<br>SEQ ID NO: 29033 |
| | | AA | DIQMTQSPSSLFASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 25028 | QVQLVESGGGVVQPGRSLRLSCEASGFTFSSYGMH WVRQAPGKGLEWVAVIWYEENNQYYADSVKGRF TISRDNSKNTLYLQMNSLRAEDTAVYYCARELGFR SDYWGQGTLVTVSS<br>SEQ ID NO: 29034 |

FIGURE 50
(Continued)

| | | | |
|---|---|---|---|
| iPS:394061 | 21-225_12D2 | NA | GATATTGTGATGACTCAGTCTCCACTCTCCCTG CCCGTCACCCTGGTGTGAGCCGGCCTCCATCTC CTGCAGGTCTAGTCAGAGCCTCCTCCATAGTA ATGGATACAACTATTTGGATTGGTACCTGCAG AAGCCAGGGCAGTCTCCACAGGTCCTGATCTA TTTGGGGTCTAATCGGGCCTCCGGGGTCCCTG ACAGGTTCAGTGGCAGTGGATCAGGCACAGAT TTTACTCTGAAAATCAGCAGAGTGGAGGCTGA GGATGTTGGGGTTTATTACTGCATGCAAGCTC TACAAACTCCTATCACCTTCGGCCAAGGGACA CGACTGGAGATTAAA<br>SEQ ID NO: 25029 | GAGGTGCAGCTGGTGGAGTCTGGGGGAGGCCTG GTCAAGCCTGGGGGGTCCCTGAGACTCTCCTGTG CAGCCCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACGCAGATCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGAGATTAGGGGAC TACTGGGGCCAGGGAACCCTGGTCGCCGTCCT CA<br>SEQ ID NO: 29035 |
| iPS:394063 | 21-225_16A1 | AA | DIVMTQSPLSLPVTPGEPASISCRSSQSLLHSNGY NYLDWYLQKPGQSPQVLIYLGSNRASGVPDRFS GSGSGTDFTLKISRVEAEDVGVYYCMQALQTPIT FGQGTRLEIK<br>SEQ ID NO: 25030 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARLGDYWG QGTLVAVSS<br>SEQ ID NO: 29036 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAAACCAGGGAAAG CCCCTAAGCGCCTGATCTATGCTGCGTCCAGT TTGCAAAGTGGGGGTCCCATCAAGGTTCAGCGG CAGTGGATCTGGGACAGATTCACTCTCACAA TCAGCAGCCTGCAGCCTGAAGATTTTGCAACT TATTACTGTCTACACCATAGTAATTACCCTCTC ACTTTCGGCGGAGGGACCAAGGTGGAGATCG AA<br>SEQ ID NO: 25031 | CAGCTGCAGCTGCAGGAGTCGGGCCCAGGACTG GTGAAGCCTTCGGAGACCCTGTCCCTCATTTGTA CTGTCTCTGGTGGCTCCATCGACAGGAGTAGTTA CTACTGGGGCTGGATCCGCCAGCCCCCAGGGAA GGGGCTGGAGTGGATTGGGAGTATCTATTATAGT GGGAGCGCTATCAACAACCCGTCCCTCAAGAGTC GAGGCACCATATCCGTAGATACGTCCAAGAACC AGTTCTCCCTGAAGCTGAGCTCTGTGACCGCCGC AGACACGGCTGCGTATTACTGTGCGAGACTGAGC AGCAGTGGTCCTTTGACTACTGGGGCCAGGGAA CCCTGGTCACCGTCTCCTCT<br>SEQ ID NO: 29037 |

FIGURE 50
(Continued)

| | | | | |
|---|---|---|---|---|
| iPS:394065 | 21-225_11E2 | AA | DIQMTQSPSSLSASVGDRVTITCRASQGIRNDLGWYQQKPGKAPKRLIYAASSLQSGVPSRFSGSGSGTEFTLTISSLQPEDFATYYCLHHSNYPLTFGGGTKVEIE<br><br>SEQ ID NO: 25032 | QLQLQESGPGLVKPSETLSLICTVSGGSIDRSSYYWGWIRQPPGKGLEWIGSIYYSGSAYHNPSLKSRGTISVDTSKNQFSLKLSSVTAADTAAYYCARLSSSWSFDYWGQGTLVTVSS<br><br>SEQ ID NO: 29038 |
| | | NA | GACATCGTGATGACCCAGTCTCCAGACTCCCTGGCTGTGTCTCTGGGCGAGAGGGCCACCATCAACTGCAAGTCCAACCAGAGAGTTTTATCCAGCTCCAACAATCACAACTACTTAGCTTGGTACCAGCAGAGACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTTTAGTACTCCATTCACTTTCGGCCCTGGGACCAAAGTGGATATCAAA<br><br>SEQ ID NO: 25033 | CAGGTGCAGGTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCCTTGAGTGGATGGGATGGATGAACACAGTGGTAACACAGGCTATGCACAGAAGTTCCAGGGCAGTCACCATGACCAGGAACACCTCCATAAGCACAGCCTACATGGACCTGAGCAGCCTGAGATCTGAGGACACGGCCGTATATTACTGTGCGTATAGTCATGGCTGGTTCCTCTTTGACTACTGGGGCCAGGGAATCCTGGTCACCGTCTCCTCA<br><br>SEQ ID NO: 29039 |
| | | AA | DIVMTQSPDSLAVSLGERATINCKSNQRVLSSSNNHNYLAWYQQRPGQPPKLLIYWASTRESGVPDRFSGSGSGTDFTLTISSLQAEDVAVYYCQQYFSTPFTFGPGTKVDIK<br><br>SEQ ID NO: 25034 | QVQVVQSGAEVKKPGASVKVSCKASGYTFTNYDINWVRQATGQGLEWMGWMNTNSGNTGYAQKFQGRVTMTRNTSISTAYMDLSSLRSEDTAVYYCAYSHGWFLFDYWGQGILVTVSS<br><br>SEQ ID NO: 29040 |

FIGURE 50
(Continued)

| | | | |
|---|---|---|---|
| iPS:394067 | 21-225_12F2 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTACCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGTAACT TATTACTGTCTACAGCATATAGTTATCCGTG GACGTTCGGCCAAGGGACCAAGGTGGAAATC AAA<br><br>SEQ ID NO: 25035 | CAGGTGCAGCTGGTGGAGTCTGGGGGAGGCGTG GTCCAGCCTGGGAGGTCCCTGAGACTCTCCTGT CAGCGTCTGGATTCACCTTCAGTGACTATGGCAT GCACTGGGTCCGCCAGGCTCCAGGCAAGGGGCT GGAGTGGGTGGCAGTTATATGGTTTGATGAAAT AATAAATACTATGTAGATTCCGTGAAGGGCCGAT TCACCATCTCCAGAGACAATTCAAGAACACGCT GTTTCTGCAAATGAACAGCCTGAGAGCCGAGGA CACGGCTGTGTATTACTGTGTGAGAGAGCTTGCC TGGTCCGAGGACTACTGGGGCCAGGGAACCCTG GTCACCGTCTCCTCA<br><br>SEQ ID NO: 29041 |
| | | AA | DIQMTQSPSSLSASVGDRVTITCRASQGIRNDLG WYQQKPGKAPKRLIYAASSLQSGVPSRFSGSGS GTEFTLTISSLQPEDFVTYYCLQHNSYPWTFGQG TKVEIK<br><br>SEQ ID NO: 25036 | QVQLVESGGGVVQPGRSLRLSCAASGFTFSDYGM HWVRQAPGKGLEWVAVIWFDGNNKYYVDSVKGR FTISRDNSKNTLFLQMNSLRAEDTAVYYCVRELAW SEDYWGQGTLVTVSS<br><br>SEQ ID NO: 29042 |
| iPS:394069 | 21-225_16H1 | NA | GACATCCAGATGACCCAGTCTCCATCCTCCCT GTCTGCATCTGTAGGAGACAGAGTCACCATCA CTTGCCGGGCAAGTCAGGGCATTAGAGATATT TTAGGCTGGTATCAGCAGAAACCAGGGAAAG CCCCTAAGCGCCTGATCTATGCTGCATCCAGT TTGCAAATGGGGGTCCCATCAAGGTTCAGCGG CAGTGGATCTGGGACAGCCTGAAGATTTTGCAACT TCAGCAGCCTGAAGATTTTGCAACT TATTACTGTCTACAGTATCATAGTTACCCATTC ACTTTCGGCCCTGGGACCAAAGTGGATGTCAA A<br><br>SEQ ID NO: 25037 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTATTACTGTGTGCGAGAGTAGCAGCC TTTGACTACTGGGGCCAGGGAACCCTGGTCACCG TCTCCTCA<br><br>SEQ ID NO: 29043 |

FIGURE 50
(Continued)

| | | | |
|---|---|---|---|
| iPS:394071 | | AA | DIQMTQSPSSLSASVGDRVTITCRASQGIRDILG WYQQKPGKAPKRLIYAASSLQNGVPSRFSGSGS GTEFTLTISSLQPEDFATYYCLQYHSYPFTFGPGT KVDVK<br>SEQ ID NO: 25038 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVYYCARVAAFDY WGQGTLVTVSS<br>SEQ ID NO: 29044 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA AGGGATACAACTATTTGGATTGGTACCTGCAG AAGCCAGGGCAGTCTCCACAGGTCCTGATCTA TTTGGGTTCTAATCGGGCTCCGGGGTCCCTG ACAGGTTCAGTGGCAGTGGATCAGGCACAGAT TTTACACTGAAAATCAGCAGAGTGGAGGCTGA GGATGTTGGGGTTTATTACTGCATGCAAGCTC TACAAACTCCTCTCACCTTCGGCCAAGGGACA CGACTGGAGATTAAA<br>SEQ ID NO: 25039 | GAGGTGCAGCTGGTGGAGTCTGGGGGAGGCTG GTCAAGCCGGGGGGGTCCCTGAGACTCTCCTG TGCAGCCTCTGGATTCACCTTCAGTAGCTATAGCAT GAACTGGGTCCGCCAGGCTCCAGGGAAGGGGCT GGAGTGGGTCTCATCCATTAGTAGTAGTAATAAT TACATATACTACGCAGACTCAGTGAAGGGCCGAT TCACCATCTCCAGAGACAACGCCAAGAACTCACT GTATCTGCAAATGAACAGCTGAGAGCCGAGGA CTCGGCTGTGTATTACTGTGCGAGATTAGGGGTC TACTGGGGCCAGGGAACCCTGGTCACCGTCTCCT CA<br>SEQ ID NO: 29045 |
| 21-225_10C7 | | AA | DIVMTQSPLSLPVTPGEPASISCRSSQSLLHSKGY NYLDWYLQKPGQSPQVLIYLGSNRASGVPDRFS GSGSGTDFTLKISRVEAEDVGVYYCMQALQTPL TFGQGTRLEIK<br>SEQ ID NO: 25040 | EVQLVESGGGLVKPGGSLRLSCAASGFTFSSYSMN WVRQAPGKGLEWVSSISSSNNYIYYADSVKGRFTIS RDNAKNSLYLQMNSLRAEDSAVYYCARLGVYWG QGTLVTVSS<br>SEQ ID NO: 29046 |

FIGURE 50
(Continued)

| | | | |
|---|---|---|---|
| iPS:394073 | 21-225_15C9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCGCCTGATCTATGCTGCATCCAGT TTGCAAAGTGGGGTCCATCAAGGTTCAGCGG CAGTGGATCTGGGACAGAATTCACTCTCACAG TCAGCAGCCTGCAGCCTGAAGATTTTGCTACT TATTACTGTCTACAACATACTAGTTACCCGCTC ACTTTCGGCGGAGGGACCAAGGTGGAGATCA AA |
| | | | SEQ ID NO: 25041 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYYCLQHTSYPLTFGGG TKVEIK |
| | | | SEQ ID NO: 25042 |
| | | NA | CAGCTGCAGTTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAATATCTATTATAGT GGGAGCACCTACAACAACCCGTCCCTCAAGAGT CGAGTCACCATATCCGTAGACACGTCCAAGAACC AGTTCTCCCTGAAGCTGAGCTCTGTGACCGCGC AGACACGGCTGTGTATTACTGTGCGAGACAGGG CAGTGGCTGGGAGGTTGACTACTGGGGCCAGGG AACCCTGGTCACCGTCTCCTCA |
| | | | SEQ ID NO: 29047 |
| | | AA | QLQLQESGPGLVKPSETLSLTCTVSGGSISRSSYYW GWIRQPPGKGLEWIGNIYYSGSTYNNPSLKSRVTIS VDTSKNQFSLKLSSVTAADTAVYYCARQGSGWEV DYWGQGTLVTVSS |
| | | | SEQ ID NO: 29048 |
| iPS:394075 | 21-225_8D12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAACAGAAACCAGGGAAAG CCCCTAAGCGCCTGATCTATGCTGCATCCAGT TTGCAAAGTGGGGTCCATCAAGGTTCAACGG CAGTGGATCTGGGACAGACGCCTGAAGATTTTGCAACT TATTACTGTCTGTTCTACAGCATAGTAGTTACCCGCTC ACTTTCGGCGGAGGGACCAAGGTGGAGATCA AA |
| | | | SEQ ID NO: 25043 |
| | | | CAGCTGCAGTTGCAGGAGTCGGGCCCAGGACTG GTGAAGTTTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGTATCCTACTACAATCCGTCCCTCAAGAGTC GAGTCACCATATCCATAGACACGTCCAAGAACC AGTTCTCCCTGAAGCTGAGCTCTGTGACCGCGC AGACACGGCTGGTCCCTTGACTACTGTGCGAGACATAGC ACCAGCTGCTCCCTTGACTACTGTGGGGCCAGGAA CCCTGGTCACCGTCTCCTCA |
| | | | SEQ ID NO: 29049 |

FIGURE 50
(Continued)

| | | | | |
|---|---|---|---|---|
| iPS:394077 | | AA | DIQMTQSPSSLSASVGDRVTITCRASQGIRNDLGWYQQKPGKAPKRLIYAASSLQSGVPSRFNGSGSGTEFTLTISSLQPEDFATYYCLQHSSYPLTFGGGTKVEIK | QLQLQESGPGLVKFSETLSLTCTVSGGSISRSSYYWGWIRQPPGKGLEWIGNIYSGYPYNPSLKSRVTISIDTSKNQFSLKLSSVTAADTAVYYCARHSTSWSLDYWGQGTLVTVSS |
| | | | SEQ ID NO: 25044 | SEQ ID NO: 29050 |
| | | NA | GACATCCAGATGACCCAGTCTCCATCCTCCTGTCTGCATCTGTAGGAGACAGAGTCACCATCACTTGCCGGGCAAGTCAGAGCATTAGTAATTATTTAAATTGGTATCAGCAGAAACCAGGGAAAGCCCCTAAGCTCCTGATCTATGCTGCATCCAGTTTACAAAGTGGGGTCCCATCAAGGTTCAGTGGCAGTGGATCTGGGACAGATTTCACTCTCACCATCAGCAGTCTGCAACCTGAAGATTTTGCAACTTACTTCTGTCAACAGAGTTACAGAACCCCCTTTTTCACTTTCGGCCCTGGGACCAAAGTGGATATCAAA | GAGGTGCAGCTGTTGGAGTCTGGGGGAGGCTTGGTACAGCCTGGGGGGTCCCTGAGACTCTCCTGTGCAGCCTCTGAATTCACCTTTAGCAGCTATGCCATGAGCTGGGTCCGCCAGGCTCCAGGGAAGGGGCTGGAGTGGGTCTCAATTATTAGTGGTCGTGGTGGTAACACATTCTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGTCCGTATGCAGTGGCTGGCTCGGAGGCTTTTGATATCTGGGGCCAAGGGACAATGGTCACCGTCTCCTCA |
| | 21-225_8E12 | | SEQ ID NO: 25045 | SEQ ID NO: 29051 |
| | | AA | DIQMTQSPSSLSASVGDRVTITCRASQSISNYLNWYQQKPGKAPKLLIYAASSLQSGVPSRFSGSGSGTDFTLTISSLQPEDFATYFCQQSYRTPFFTFGPGTKVDIK | EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRMAVAGSEAFDIWGQGTMVTVSS |
| | | | SEQ ID NO: 25046 | SEQ ID NO: 29052 |

FIGURE 50
(Continued)

| | | | |
|---|---|---|---|
| iPS:394079 | 21-225_11F5 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGTCTGATCTATGCTGCATCCAGT GTGCAAAGTGGGGTCCCATCAAGGTTCAGCGG CAGTGGATCTGGGACAGAATTCACTCTCACAA TCAGCAGCCTGCAGCCTGAAGATTTTGCAATT TATTACTGTCTACAGCATAATAGTTACCCGCTC ACTTTCGGCGGAGGGACCAAGGTGGAGATCA AA |
| | | | SEQ ID NO: 25047 |
| | | AA | DIQMTQSPSSLSASVGDRVTITCRASQGIRNDLG WYQQKPGKAPKRLIYAASSVQSGVPSRFSGSGS GTEFTLTISSLQPEDFAIYYCLQHNSYPLTFGGGT KVEIK |
| | | | SEQ ID NO: 25048 |
| | | | CAGCTGCAGCTGCAGGAGTCGGGCCCAGGACTG GTGAAGCCTTCGGAGACCCTGTCCCTCACCTGCA CTGTCTCTGGTGGCTCCATCAGTAGGAGTAGTTA CTACTGGGGCTGGATCCGCCAGCCCCCAGGGAA GGGGCTGGAATGGATTGGAAATATTTATTATAGT GGGAGCACCTACAACCGTCCCTCAAGAGTC GAGTCACCATATCCGTAGACACGTCCAAGAACC ACTTCCCTGAAGCTGAGCTGTGACCGCGC AGACACGGCTGTGTATTACTGTGGGAGACATGGA AAAGACTGGGGCTTGACAACTGGGGCCAGGGA ACCCTGGTCACCGTCTCCTCA |
| | | | SEQ ID NO: 29053 |
| | | | QLQLQESGPGLVKPSETLSLTCTVSGGSISRSSYYW GWIRQPPGKGLEWIGNIYYSGSTYNPSLKSRVTIS VDTSKNHFSLKLSSVTAADTAVYYCGRHGKDWGL DNWGQGTLVTVSS |
| | | | SEQ ID NO: 29054 |
| iPS:394081 | 21-225_16B3 | NA | GACATCCAGATGACCCAGTCTCCATCTCCCT GTCTGCATCTGTAGGAGACAGAGTCACCATCA CTTGCCAGGCGAGTCAGGACATCAGGACAATTAT TTAAATTGGTATCAGCAGAAACCAGGGAGAG CCCCTAAGCTCCTGATCTACGATGCATCCAAT TTGGAAACAGGGGTCCCATCAAGGTTCAGTGG AAGTGGCTCTGGGACAGATTTTACTTTCACCA TCAGCAGCCTGCAGCCTGAAGATATTGCAACA TATTACTGTCAACAGTTTGATAATCTCCCGATC ACCTTCGGCCAAGGGACACGACTGGAGATTAA A |
| | | | SEQ ID NO: 25049 |
| | | | CAGGTGCAGCTGGTAGAGTCTGGGGGAGGCGTG GTCCAGCCTGGGAGGTCCCTGAGACTCTCCTGTG TAGCCTCTGGATTCACCTTCAGTAGCTATGGCAT GCACTGGGTCCGCCAGGCTCCAGGCAAGGGGCT GGAGTGGGTGGCAGTTATATCATATGCTGGAATT AATAAATCCTATGCAGACTCCGTGAAGGGCCGAT TCACCATCTCCAGAGACAATTCCAATAACACGCT GTATCTGCAAATGAACAGCCTGAGAGCTGAGGA CACGGCTGTGTATTACTGTGTGAGACGGGATAC AGCTATGGCGGGTATGGTATGGACGTCTGGGGCC AAGGGGCCACGGTCACCGTCTCCTCA |
| | | | SEQ ID NO: 29055 |

FIGURE 50
(Continued)

| | | | |
|---|---|---|---|
| iPS:394083 | 21-225_16E6 | AA | DIQMTQSPSSLSASVGDRVTITCQASQDINNYLNWYQQKPGRAPKLLIYDASNLETGVPSRFSGSGSGTDFTFTISSLQPEDIATYYCQQFDNLPITFGQGTRLEIK<br>SEQ ID NO: 25050 | QVQLVESGGGVVQPGRSLRLSCVASGFTFSSYGMHWVRQAPGKGLEWVAVISYAGINKSYADSVKGRFTISRDNSNNTLYLQMNSLRAEDTAVYYCVRRGYSYGGYGMDVWGQGATVTVSS<br>SEQ ID NO: 29056 |
| | | NA | GACATCCAGATGACCCAGTCTCCATCCTCCCTGTCTGCATCTGTAGGAGACAGAGTCACCATCACTTGCCGGGCAAGTCAGAGCATTATCAGTATCTTAAATTGGTATCAGCAGAAACCAGGGAAAGCCCCTAAGCTCCTGATCTATTACTACATCCAGTTTGCAAAGTGGGGTCCCATCAAGGTTCAGTGGCAGTGGATCTGGGACAGATTTCACTCTCACCATCAGTAGTCTGCAACCTGAAGATTTTGCAACTTACTACTGTCAGCAGATTACAGTACCCCGCTCACTTTCGGCGGAGGGACCAAGGTGGAGATCAAA<br>SEQ ID NO: 25051 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGTAGACTCCGTGAAGGGCCGATAATAAATACTATGTAGACTCCGTGAAGGGCCGATTCACCATCTCCAGAGACAATTCCAAGAACACGCTGAATCTGCAAATGAACAGCCTGAGAGATCTGAGACACGGCTGTGTATTACTGTGCGAGAGATCTGAGTATGGGCGGTATGGACGTCTGGGGCCAAGGGACCACGGTCACCGTCTCCTCA<br>SEQ ID NO: 29057 |
| | | AA | DIQMTQSPSSLSASVGDRVTITCRASQSIISYLNWYQQKPGKAPKFLIYTSSLQSGVPSRFSGSGSGTDFTLTISSLQPEDFATYYCQQTYSTPLTFGGGTKVEIK<br>SEQ ID NO: 25052 | QVQLVESGGGVVQPGRSLRLSCAASGFTFSSYGMHWVRQAPGKGLEWVAVIWHDGSNKYYVDSVKGRFTISRDNSKNTLNLQMNSLRAEDTAVYYCARDLSMGGMDVWGQGTTVTVSS<br>SEQ ID NO: 29058 |

FIGURE 50
(Continued)

| | | | | |
|---|---|---|---|---|
| iPS:394085 | 21-225_8B11 | NA | GACATCGTGATGACCCAGTCTCCAGACTCCCT GGCTGTGTCTCTGGGCGAGAGGGCCACCATCA ACTGCAAGTCCAGCAGAATGTTTTATACAAC TCCAACAATAACAACTACTTAGCTTGGTACCA GCAGAAACCAGGACAGCCTCCTAAGCTGCTCA TTTACTGGGCATCTACCCGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATACTACTCCGTCCGTGCAGTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCCGTGGACAAGGC TTGAGTGGATGGGATGGATGCACCTAACAGTGG TAACACAGGCTATGCACAGAAGTTCCAGGCAG AGTCACCATGACCAGGAACACCTCCAGAAGCAC AGCCTACATGGAGCTGAGCAGCCTGAGATCTGA GGACACGGCCGTGTACTACTGTGCGTATAGCAGT GGCTGGTACTTCTTTGACTACTGGGGCCAGGGAA CCCTGGTCACCGTCTCCTCA |
| | | | SEQ ID NO: 25053 | SEQ ID NO: 29059 |
| | | AA | DIVMTQSPDSLAVSLGERATINCKSSQNVLYNSN NNNYLAWYQQKPGQPPKLLIYWASTRKSGVPD RFSGSGSGTDFTLTISSLQAEDVAVYYCQQYYT PCSFGQGTKLEIK | QVQLVQSGAEVKKPGASVKVSCKASGYTFTNYDIN WVRQAAGQGLEWMGWMHPNSGNTGYAQKFQGR VTMTRNTSRSTAYMELSSLRSEDTAVYYCAYSSG WYFFDYWGQGTLVTVSS |
| | | | SEQ ID NO: 25054 | SEQ ID NO: 29060 |
| iPS:394087 | 21-225_11A5 | NA | GACATCCAGATGACCCAGTCTCCATCTCCCT GTCTGCATCTGTAGGAGACAGAGTCACCATCA CTTGCCGGGCAAGTCAGAGCATTAGTAGTTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTACAACCTGAAGATTTTGCAACTT ACTACTGTCAACAGAGTTACAATACCCCCTTA TTCACTTTCGGCCCTGGGACCAAAGTGGATAT CAAA | GAGGTGCAGCTGTTGGAGTCTGGGGGAGACTTG GTTCAGCCTGGGGGGTCCCTGAGACTCTCCTGTG CAGCCTCTGAATTCACCTTTAGCAGCTATGCCAT GAGCTGGGTCCGCCAGGCTCCAGGGAAGGGGCT GGAGTGGATCTCAGTTATTAGCGCAGACTCCGG AACACATTCTACGCAGACTCCGTGAAGGGCCGGT TCACCATCTCCAGAGACAATTCCAAGAACACGCT CTATCTACAAATGAACAGCCTGAGAGCCGAGGA CACGGCCGTATATTACTGTGCGTCCCGTATCGCA GTGGGCTCGGAGGCTTTGATATCTGGGGCC AAGGGACAATGGTCACCGTCTCTTCA |
| | | | SEQ ID NO: 25055 | SEQ ID NO: 29061 |

FIGURE 50
(Continued)

| | | | | |
|---|---|---|---|---|
| iPS:394089 | 21-225_12E6 | AA | DIQMTQSPSSLSASVGDRVTITCRASQNIYSYLN WYQQKPGKAPKLLIYAASSLQSGVPSRFSGSGS GTDFTLTISSLQPEDFATYYCQQSYNTPLFTFGPG TKVDIK<br>SEQ ID NO: 25056 | EVQLLESGGDLVQPGGSLRLSCAASEFTFSSYAMS WVRQAPGKGLEWISVISGRGVNTFYADSVKGRFTI SRDNSKNTLYLQMNSLRAEDTAVYYCASRIAVAGS EAFDIWGQGTMVTVSS<br>SEQ ID NO: 29062 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAACCAGGGAAAG CCCCTAAGCGCCTGATCTATGCTGCATCCAGT TTGCAAAGTGGGGTCCCATCCAAGGTTCAGCGG CAGTGGATCTGGGACAGAATTCACTCTCACAA TCAGCAGCCTGCAGCCTGAAGATTTTGCAACT TATTACTGTCTACAGCATATAAGTTACCCGTG GACGTTCGGCCAAGGGACCAAGGTGGAAATC AAA<br>SEQ ID NO: 25057 | CAGGTGCAGCTGGTGGAGTCTGGGGGAGGCGTG GTCCAGCCTGGGAGGTCCCTGAGACTCTCCTGTG CAGCGTCTGAGTTCACCTTCAGTGACTATGGCAT GCACTGGGTCCGCCAGGCTCCAGGCAAGGGGCT GGAGTGGGTGACAGTTATATGGTATGATGAAAGT AATAAATACTATGCAGACTCCGTGAAGGGCCGA TTCACCATCTCCAGAGACGATTCCAAAAACACGC TGTATCTGCAAATGAACAGTCTGAGAGCCGAGG ACACGGCTGTGTATTACTGTGCGAGAGAGCTTGC CTGGTACGAGGACTACTGGGGCCAGGGAACCCT GGTCACCGTCTCCTCA<br>SEQ ID NO: 29063 |
| | | AA | DIQMTQSPSSLSASVGDRVTITCRASQGIRSDLG WYQQKPGKAPKRLIYAASSLQSGVPSRFSGSGS GTEFTLTISSLQPEDFATYYCLQHNSYPWTFGQG TKVEIK<br>SEQ ID NO: 25058 | QVQLVESGGGVVQPGRSLRLSCAASGFTFSDYGM HWVRQAPGKGLEWVTVIWYDESNKYYADSVKGR FTISRDDSKNTLYLQMNSLRAEDTAVYYCARELAW YEDYWGQGTLVTVSS<br>SEQ ID NO: 29064 |

FIGURE 50
(Continued)

| | | | |
|---|---|---|---|
| iPS:394091 | 21-225_13H3 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTC ACTTTCGGCGGAGGGACCAAGGTGGAGATCA AA SEQ ID NO: 25059 | CAGGTGCAGCTGGTGGAGTCTGGGGGAGGCCTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAGTTATTTGGTATGAGGAAAGT AATAAATACTATGTAGAACTCCGTGAGGGCCGAT TCACCATCTCCAGAGACAATTCAAGAGACACGCT GTATCTGCAAATGAACAGCCTGAGAGCCGAGGA CACGGCTGTGTATTACTGTGTGAGAGAACTAGGC TTCCAGTCTGACTTCTGGGGCCAGGAACCCCGG TCACCGTCTCCTCA SEQ ID NO: 29065 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK SEQ ID NO: 25060 | QVQLVESGGGLVQPGRSLRLSCAASGFTFSSYGMH WVRQAPGKGLEWVAVIWYEESNKYYVDSVRGRF TISRDNSKSTLYLQMNSLRAEDTAVYYCVRELGFQ SDFWGQGTPVTVSS SEQ ID NO: 29066 |
| iPS:394093 | 21-225_9D12 | NA | GACATCCAGATGACCCAGTCTCCATCCTCCCT GTCTGCATCTGTAGGAGACAGAGTCACCATCA CTTGCCGGGCAAGTCAGGACAGTCATTAGAAATGAT TTAGGCTGGTATCAGCAGAAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTAGTTACCCGTG GACGTTCGGCCAAGGGACCAAGGTGGAAATC AAA SEQ ID NO: 25061 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGTGCGAGAGAGCTTGCC TGGTACGAGGACTTCTGGGGCCAGGAACCCTG GTCACCGTCTCCTCA SEQ ID NO: 29067 |

FIGURE 50
(Continued)

| | | | | |
|---|---|---|---|---|
| | | | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPWTFGQG TKVEIK | QVQLVESGGGVVQPGRSLRLSCAASGFTFSDYGM HWVRQAPGKGLEWVAVIWYDGNNNYADSVKG RFTISRDNSKNTLYLQMNSLRAEDTAVYYCARELA WYEDFWGQGTLVTVSS |
| | | AA | SEQ ID NO: 25062 | SEQ ID NO: 29068 |
| iPS:394095 | 21-225_16H4 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTTATCTATGCATCCAGTT TGCAAAGTGGTGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATATAAGTTACCCGTGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATAGACTCCGTGAAGGCCGA AATAAATACTATGCAGACTCCGTGAAGGGCCGA TTCACCATCTCCAGAGACAATTCCAAGAACATGT TGTATCTGCAAATGAACAGCCTGAGAGCCGAGG ACACGGCTGTGTATTACTGTGCGCGAGAATGGG CTGGACCGATGACTGCTGGGGCCAGGGAACCCT GGTCACCGTCTCCTCA |
| | | | SEQ ID NO: 25063 | SEQ ID NO: 29069 |
| | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHNSYPWTFGQGT KVEIK | QVQLVESGGGVVQPGRSLRLSCAASGFTFSNYGM HWVRQAPKGLEWVAVIWYDVSNKYADSVKGR FTISRDNSKNMLYLQMNSLRAEDTAVYYCAREMG WTDDCWGQGTLVTVSS |
| | | | SEQ ID NO: 25064 | SEQ ID NO: 29070 |

FIGURE 50
(Continued)

| | | | | |
|---|---|---|---|---|
| iPS:394097 | 21-225_16G7 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAACATAATAGTTACCCGTGGACGTTCGGCCAAGGGACCAAGGTGGAAATCAAA SEQ ID NO: 25065 | CAGGTGCAGCTGGTGGTGGAGTCTGGGGGAGGCGTGGTCCAGCCTGGGAGGTCCCTGAGACTCTCCTGTCAGCGTCTGGATTCACCTTCACTGACTATGGCATGCACTGGGTCCGCCAGGCTCCAGGCAAGGGGCTGGAGTGGGTGGCAGTTATTTGGTATGATGAAAATAATGAATACTATGCAGACTCCGTGAAGGGCCGATTCACCATCTCCAGAGCCAATTCCAAGAACACGCTGTATCTGCAAATGAACAGCCTGAGAGCCGAGGACACGGCTGTGTATTACTGTGCGAGAGAGCTTGCCTGGTACGAGGACTACTGGGGCCAGGGAACCCTGGTCACCGTCTCCTCA SEQ ID NO: 29071 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK SEQ ID NO: 25066 | QVQLVESGGGVVQPGRSLRLSCAASGFTFTDYGMHWVRQAPGKGLEWVAVIWYDENEYYADSVKGRFTISRANSKNTLYLQMNSLRAEDTAVYYCARELAWYEDYWGQGTLVTVSS SEQ ID NO: 29072 |
| iPS:398470 | 21-225_14B7 | NA | TCCTATGAGCTGACTCAGCCACCCTCAGTGTCCGTGTCCCCAGGACAGACGGCCAGCATCACCTGCTCTGGAGATAAATTGGGGAATAAATATGCTTACTGGTATCAGCAGAAGCCAGGCCAGTCCCCTGTGCTGGTCATCTATCAAGATAGAAAGCGCCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGAACAACAGCACTGTGGTATTCGGCGGAGGGACCAAGCTGACCGTCCTA SEQ ID NO: 25067 | CAGGTGCAGCTGCAGTGCAGTCTGGGGCTGAGGTGAAGAAGCCTGGGGCCTCAGTGAAGGTCTCCTGCAAGGCTTCTGGATACACCTTCACCGGCTACTATAAGGCTTCTGGATACACCTTCACCGGCTACTATATGCACTGGGTGCGACAGGCCCCTGGACAAGGCTTGAGTGGATGGGATGGATCAACCTAACAGTGGTGGCACAAACTATGTACAGAAGTTTCAGGGCAGGGTCACCATGACCAGGGACACGTCCATCAGCACAGCCTACATGGAGCTGAGCAGGCTGAAATCTGAAGACACGGCCGTGTATTTCTGTGCGAGGTGTTTTCTATGGTTCGGGGAGTTATTATAACGAATTTGACTACTGGGGCCAGGGAACCCTGGTCACCGTCTCCTCA SEQ ID NO: 29073 |

FIGURE 50
(Continued)

| | | | |
|---|---|---|---|
| iPS:398472 | 21-225_16E4 | AA | SYELTQPPSVSVSPGRTASITCSGDKLGNKYAYW YQQKPGQSPVLVIYQDRKRPSGIPERFSGSNSGN TATLTISGTQTMDEADYYCQAWNNSTVFGGG TKLTVL<br>SEQ ID NO: 25068 | QVQLVQSGAEVKKPGASVKVSCKASGYTFTGYYM HWVRQAPGQGLEWMGWINPNSGGTNYVQKFQGR VTMTRDTSISTACMELSRLKSDDTAVYFCARSFFY GSGSYYNEFDYWGQGTLVTVSS<br>SEQ ID NO: 29074 |
| | | NA | CCCTATGAGCTGACTCAGCCACCCTCAGTGTC CGTGTCCCAGGACAGACAGCCAGCATCACCT GCTCTGAGATAAATTGGGGATAAATATGTT TACTGGTATCAGCAGAAGTCAGGCCAGTCCC TGTGCTGGTCATCTATCAAGATAGCAAGCGC CCTCAGGGATCCCTGAGCGATTCTCTGGCTCC AACTCTGGAAACACAGGCTATGAGGCTGACTATT CGGGACCCAGGCGTGGGACAGCAGCACTGTGGTT ACTGTCAGGCGTGGGACAGCAGCACTGTGGTT TTCGGCGGAGGGACCAAGCTGACCGTCCTA<br>SEQ ID NO: 25069 | GAGGTGCAGCTGTTGGAGTCTGGGGGAGGCTTG ATACAGCCTGGGGGGTCCCTGAGACTCTCCTGTG CAGCCTCTGGATTCACCTTTAGTAGCTATGTCAT GAGCTGGGTCCGCCAGGCTCCAGGGAAGGGCT GGAGTGGGTCTCACTATTAGTGTTGGTGGTGGT ACCACATACTACGCAGACTCCGTGAAGGGCCGG TTCACCATCTCCAGAGACAATTCCAAGAATACGC TGTATCTGCAAATGAACAGCCTGAGAGCCGAGG ACACGGCCGTATATTACTGTGCAAATGGGGAC GTGGCAACAGCTATGAGTACTACTACGGTATGGA CGTCTGGGGCCAAGGGACCACGGTCACCGTCTCC TCA<br>SEQ ID NO: 29075 |
| | | AA | PYELTQPPSVSVSPGQTASITCSGDKLGDKYVY WYQQKSGQSPVLVIYQDSKRPSGIPERFSGSNSG NTAALTISGTQAMDEADYYCQAWDSSTVFGG GTKLTVL<br>SEQ ID NO: 25070 | EVQLLESGGGLIQPGGSLRLSCAASGFTFSSYVMSW VRQAPGKGLEWVSTISVGGGTTYYADSVKGRFTIS RDNSKNTLYLQMNSLRAEDTAVYYCAKWGRGNS YEYYYGMDVWGQGTTVTVSS<br>SEQ ID NO: 29076 |

FIGURE 50
(Continued)

| | | | |
|---|---|---|---|
| iPS:398474 | 21-225_17B10 | NA | GACATCCAGATGACCCAGTCTCCATCCTCCT ATCTGCATCTGTAGGAGACAGAGTCACCATCA CTTGCCGGTCAAGTCAGAGACATTAACAGCTAT TTAAATTGGTATCAGCAGAAACCTGGGAAAGC CCCTAAGCTCCTGATCTTTGCTGCATCCAGTTT GCACAGTGGGGTCCCATCAAGGTTCAGTGGCA GTGGATCTGGGACGGATTTCACTCTCACCATC AGCAGTCTGCAACCTGAAGATTTTGCAACTTA CTACTGTCAACAGGGTTACAATACCCCACGT GGACGTTCGGCCAAGGGACCAAGGTGGAAAT CAAT SEQ ID NO: 25071 | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGCT GGAGTGGGTCTCAGTTATTAGTGGTAGTGGTGGT AACACATACTTCGCAGACTCCGTGAAGGGCCGGT TCACCATCTCCAGAGACAATTCCAAGAACACGCT GTATCTGCAAATGGACAGCCTGAGAGCCGAGGA CACGGCCGTATATTACTGTGCGAAAGGGGTATA CCAGAGGCTGATGCTTTTGATATCTGGGGCCAAG GGACAATGGTCACTGTCTCTTCA SEQ ID NO: 29077 |
| | | AA | DIQMTQSPSSLSASVGDRVTITCRSSQSINSYLNW YQQKPGKAPKLLIFAASSLHSGVPSRFSGSGSGT DFTLTISSLQPEDFATYYCQQGYNTPTWTFGQGT KVEIN SEQ ID NO: 25072 | EVQLLESGGGLVQPGGSLRLSCAASGFTFRSYAMS WVRQAPGKGLEWVSVISGSGGNTYFADSVKGRFTI SRDNSKNTLYLQMDSLRAEDTAVYYCAKRGIPEAD AFDIWGQGTMVTVSS SEQ ID NO: 29078 |
| iPS:398476 | 21-225_17C1 | NA | GACATCCAGATGACCCAGTCTCCATCCTCCCT GTCTGCATCTGTAGGAGACAGAGTCACCATCA CTTGCCGGGCAAGTCAGAGTCAGAAACGACTAT TTAAATTGGTATCAGCAGAAACCAGGGAAAG CCCCTAAGCTCCTGATCTATGCTGCATCCAATT TGCAAAGTGGGGTCCCAGCAAGGTTCAGTGGC AGTCGATCTGGGACAGATTTCACTCTCACCAT CAGCAGTCTGCAACCTGAAGATTTTGCAACTT ACTACTGTCAACAGAGTTACAATACCCCTCCG GAGCGCAGTTTTGGCCAGGGGACCAAGCTGG AGATCAAA SEQ ID NO: 25073 | GAGGTGCAGCTGTTGGAGTCTGGGGGAGGCTTG GAACAGCCGGGGGGTCCCTGAGACTCTCCTGTG CAGCCTCTGATTCACCTTAGCAGTCAGTGCCAT GAGCTGGGTCCGCCAGGCTCCAGGGAAGGGCT GGAGTGGGTCTCAGTTATTAGTGGTAGTGGTGGT ACCACATTCTACGCAGACTCCGTGAAGGGCCGGT TCACCATCTCCAGAGACAATTCCAAGAACACGCT GTATCTGCAAATGAGCAGCCTGAGAGCCGAGGA CACGGCCGTATATTCTGTGCCGATATTGTAGT AGTACCAGGTGTCCTTATGATGCTTTGATATCT GGGGCCAAGGGACAATGGTCACCGTCTCCTCA SEQ ID NO: 29079 |

FIGURE 50
(Continued)

| | | | |
|---|---|---|---|
| iPS:398478 | | AA | DIQMTQSPSSLSASVGDRVTITCRASQNINDYLN WYQQKPGKAPKLLIYAASNLQSGVPARFSGSRS GTDFTLTISSLQPEDFATYYCQQTYNTPPERSFG QGTKLEIK<br>SEQ ID NO: 25074 | EVQLLESGGGLEQPGGSLRLSCAASGFTFSSYAMS WVRQAPGKGLEWVSVISGSGTTFYADSVKGRFTI SRDNSKNTLYLQMSSLRAEDTAVYFCARYCSSTRC PYDAFDIWGQGTMVTVSS<br>SEQ ID NO: 29080 |
| | | NA | GACATCCAGATGACCCAGTCTCCATCCTCCA GTCTGCATCTGTAGGAGACAGAGTCACCATCA CTTGCCGGGCGAGTCAGGGCATTAGCAATTAT TTAGCCTGGTATCAGCAGAAACCAGGGAGAGT TCCTAAGCTCCTGATCTATGCTGCATCCACTTT GCAATCAGGGGTCCCATCTCGGTTCAGTGGCA GTGGATCTGGGACAGATTTCACTCTCACCATC AGCAGCCTGCAGCCTGACGATGTTGCAACTTA TTACTGTCAAAAGTATAACAGTGCCCCTCCGC TCACCTTCGGCCAAGGGACACGACTGGAGATT AAA<br>SEQ ID NO: 25075 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATGTACTACGCAGACTCAGTGAAGGGCCGAT TCACCATCTCCAGAGACAACGCCAAGAACTCACT GTATCTGCAAATGAACAGCCTGCAGCCGAGGA CACGGCTCTGTATTACTGTGCGAGAGATCGTGGG AGCTCCTGGGGCCAGGGAACCCTGGTCACCGTCT CCTCA<br>SEQ ID NO: 29081 |
| | 21-225_17C10 | AA | DIQMTQSPSSQSASVGDRVTITCRASQGISNYLA WYQQKPGRVPKLLIYAASTLQSGVPSRFSGSGS GTDFTLTISSLQPDDVATYYCQKYNSAPPLTFGQ GTRLEIK<br>SEQ ID NO: 25076 | EVQLVESGGGLVKPGGSLRLSCAASGFTFSSYSMN WVRQAPGKGLEWVSSISGSSSYMYYADSVKGRFTI SRDNAKNSLYLQMNSLRAEDTALYYCARDRGSSW GQGTLVTVSS<br>SEQ ID NO: 29082 |

FIGURE 50
(Continued)

| | | | |
|---|---|---|---|
| iPS:398480 | 21-225_17G4 | NA | GACATCCAGATGACCCAGTCCCCATCCTCCCTGTCTGCATCTGTAGGAGACAGAGTCACCATCACTTGCCGGACAAGTCAGAATATTAGCAACTATTTAAATTGGTATCAGCAGAAACCAGGAAAGCCCCTAAGCTCCTGATCTATGTTGCGTCCAGTTTCCCAAGTGGGGTCCCATCAAGGTTCAGTGGCAGTGGATCTGGGACAGAGTTCACTCTCACCATCAGCAGTCTGCAACCTGAAGATTTTGCAACTTACTACTGTCAACAGAGTAACTTTTTCCCGTCACTTTCGGCGGAGGGACCAAGGTGGAGATCAT A SEQ ID NO: 25077 |
| | | AA | DIQMTQSPSSLSASAGDRVTITCRTSQNISNYLNWYQQKPGKAPKLLIYVASSFPSGVPSRFSGSGSGTEFTLTISSLQPEDFATYYCQQSNFFPLTFGGGTKVEII SEQ ID NO: 25078 |
| | | | CAGGTGCAGTTGGTGCAGTCTGGGCTGAGGTGAAGAAGCCTGGGGCCTCAGTGAAGGTCTCTGCAGACTTCTGGATACACCTTCACCGACTATTATATAGACTTCTGGATACACCTTCACCGACTATTATATGCACTGGGTGCGACAGGCCCCTGGACAAGGGCTTGAGTGGATGGGATGGATCAACCCTAACAGTGGTGGCACAAACTATGAACAGAAGTTCAGGGCAGGGTCACCATGACCAGGGACACGTCCATCAGCACAGCCTACATGGAACTGAGTAGGCTGAGATCTGACGACACGGCCGTGTATTACTGTGCGAGTGGATACAGCTATGGGTACAACTGGTTCGACCCCTGGGGCCAGGGAACCCTGGTCACCGTCTCCTCA SEQ ID NO: 29083 |
| | | | QVQLVQSGAEVKKPGASVKVSCKTSGYTFTDYYMHWVRQAPGQGLEWMGWINPNSGGTNYEQKFQGRVTMTRDTSISTAYMELSRLRSDDTAVYYCASGYSYGYNWFDPWGQGTLVTVSS SEQ ID NO: 29084 |
| iPS:398482 | 21-225_17H6 | NA | GACATCCAGATGACCCAGTCTCCATCCTCCACTGTCTGCATCTGTAGGAGACAGAGTCACCATCACTTGTGTCGGGCAGTCGGGACATTAGCAATTATTTAGCCTGGTTTCAGCAGAAACCAGGGAAAGCCCCTAAGTCCCTGATCTCTACTGCATCCAGTTTGCAAAGTGGGGTCCCATCAAAGTTCAGTGGCAGTGGATCTGGGACAGATTTCACTCTCACCATCAGCAGCCTGCAGCCTGAAGATTTTGCAATTTATTACTGCCAACAGTATCATAGTTACCCATTCACTTTCGGCCCTGGGACCAAAGTGGATATCCAA SEQ ID NO: 25079 |
| | | | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGGTCTCATCCATTAGTAGTGGTAGTAGTTACATATACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGAGTGGCTTCATTTGACTACTGGGGCCAGGGAACCCTGGTCACCGTCTCCTCA SEQ ID NO: 29085 |

FIGURE 50
(Continued)

| | | | | |
|---|---|---|---|---|
| iPS:398484 | 21-225_18D4 | AA | DIQMTQSPSSLSASVGDRVTITCRASRDISNYLA WFQQKPGKAPKSLISTASSLQSGVPSKFSGSGSG TDFTLTISSLQPEDFAIYYCQQYHSYPFTFGPGTK VDIQ<br><br>SEQ ID NO: 25080 | EVQLVESGGGLVKPGGSLRLSCAASGFTFSSYSMN WVRQAPGRGLEWVSSISGSSSYIYYADSVKGRFTIF RDNAKNSLYLQMNSLRAEDTAVYYCARVASFDY WGQGTLVTVSS<br><br>SEQ ID NO: 29086 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGGAAAGTGGGGTCCCATCCAAGGTTCAGCGG CAGTGGATCTGGGACAGAATTCACTCTCACAG TCAGCAGCCTGCAGCCTGAAGATTTTGCAACT TATTACTGTCTACATCATAATAATTACCTCCCC ATCACCTTCGGCCAAGGGACACGACTGGAGAT TAAA<br><br>SEQ ID NO: 25081 | CAGGTGCAACTGGTGCAGTCTGGGGCTGAGGTG AAGAAGCCTGGGGCCTCCGTGAAGGTCTCCTGCA AGGCTTCTGGATACACCTTCACCGCTACTATTT GCACTGGGTGCGACAGGCCCCTGGACAAGGGCT TGAGTGGCTGGGATGGATCAACCTAACAGTAAT GGCACAATCTCTGCACAGAAGTTTCAGGGCAGG GTCACCATGACCAGGGACACGTCCATCAGCACA GCCTACATGGAGCTGAGCAGGCTGAGATCTGACG ACACGGCCGTATATTACTGTGCGAGAGATGGTAC CAGTCGCTTGACTACTGGGGCCAGGGAACCCTG GTCACCGTCTCCTCA<br><br>SEQ ID NO: 29087 |
| | | AA | DIQMTQSPSSLSASVGDRVTITCRASQGIRNDLG WYQQKPGKAPKRLIYAASSLESGVPSRFSGSGSG TEFTLTVSSLQPEDFATYYCLHHNNYLPITFGQG TRLEIK<br><br>SEQ ID NO: 25082 | QVQLVQSGAEVKKPGASVKVSCKASGYTFTGYYL HWVRQAPGQGLEWLGWINPNSNGTISAQKFQGRV TMTRDTSISTAYMELSRLISDDTAVYYCARDGTSSL DYWGQGTLVTVSS<br><br>SEQ ID NO: 29088 |

FIGURE 50
(Continued)

| | | | | |
|---|---|---|---|---|
| iPS:398486 | 21-225_19A1 | NA | GACATCCAGATGACCCAGTCTCCATCCCCT GTCTGCATCTGTAGGAGACAGAGTCACCATCA CTTGCCGGGCAAGTCATACCAGTCATTACCAGCTAT TTAAATTGGTATCAGCAGAAACCAGGGAAAG CCCCTAAGTTCCTGATCTATGCTACATCCAATC TCCAAAGTGGGGTCCCATCAAGGTTCAGTGGC AGTGGATCTGGGACAGATTTCACTTTCACCAT CAGCAGTCTGCAACCTGAAGATTTTGCAATTT ACTACTGTCAACAGAGTTACAACTTCCCGCTC ACTTTCGGCGGAGGGACCAAGGTGGAGATCA AA | CAGGTGCAACTGGTGCAGTCTGGGGCTGAGGTG AAGAAGCCTGGGGCCTCAGTGAAGGTCTCCTGC AAGGCTTCTGGTGACACCTTCACCGGCTACTATA TGCACTGGGTGCGACAGGCCCCTGGACAAGGGC TTGAGTGGATGGGATGGATCAATCTAACAGTGG TGGCACAAACTATGCACAGAAGTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGTGGATAC AGCTATGGGTACAACTGGTTCGACCCCTGGGGCC AGGGAACCCTGGTCACCGTCCTCCTCA |
| | | | SEQ ID NO: 25083 | SEQ ID NO: 29089 |
| | | AA | DIQMTQSPSSLSASVGDRVTITCRASHTITSYLN WYQQKPGKAPKFLIYATSNLQSGVPSRFSGSGS GTDFTFTISSLQPEDFAIYYCQQSYNFPLTFGGGT KVEIK | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCASGYSY GYNWFDPWGQGTLVTVSS |
| | | | SEQ ID NO: 25084 | SEQ ID NO: 29090 |
| iPS:398488 | 21-225_19F6 | NA | TCCTATGAGCTGACTCAGCCACCCTCAGTGTC CGTGTCCCCAGGACAGACAGTCAGCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGGC CCTCAGGGACCCCTGAGCGATTCTCTGGCTCC AACTCTGGGAACACAGCCACTCTGACCATCAG CGGACCCAGGCGTGGGACAACACTGTGGTA ACTGTCAGGCGTGGGACACAAGCTGACCGTCCTA TTCGGCGGAGGGACCAAGCTGACCGTCCTA | GAGGTGCAGCTGGTGGAGTCTGGGGGAGGCTTG GTGAAGCCTCTGGGGGGTCCCTTAGACTCTCCTGTG CAGCCTCTGGATTCACTTTCAGTAACGCTGGAT GAACTGGGTCCGCCAGGCTCCAGGAAGGGCT GGAGTGGGTTGGCCGTATTAAAAGCAAACTGA TGGTGGACAACAGACTACGCTGCACCGTGAA AGGCAGATTCACCATCTCAAGAGATGATTCAAA AAACACGTGTATCTGCAAATGAACAGCCTGAA AACCGAGGACACAGCCGTGTATTACTGTACCACA GATACGGCTCCTATAGCAGCTCGTCTGCTTACT ACTACTATTAGCTATGGACGTCTGGGGCCACGG GACCACGGTCACCGTCTCCTCA |

FIGURE 50
(Continued)

| | | | SEQ ID NO: 25085 | SYELTQPPSVSVSPGQTVSITCSGDKLGDKYACW YQQKPGQSPVLVIYQDSKRPSGTPERFSGSNSGN TATLTISGTQAMDEADYCQAWDNNTVVFGGG TKLTVL | SEQ ID NO: 29091 | EVQLVESGGGLVKPGGSLRLSCAASGFTFSNAWM NWVRQAPGKGLEWVGRIKSKTDGGTTDYAAPVK GRFTISRDDSKNTLYLQMNSLKTEDTAVYYCTTDT GPIAARLAYYYYAMDVWGHGTTVTVSS |
| --- | --- | --- | --- | --- | --- | --- |
| | | AA | SEQ ID NO: 25086 | TCCTATGAGCTGACTCAGCCACCCTCAGTGTC CGTGTCCCCAGGACACAGCCAGCATCACCT GCTCTGGAGATAAATTGGGGATAAATATGCT TACTGGTATCAGCAGAAGCCAGGCCAGTCCC TGTGTTGGTCATCTATCAAGATAGAAAGAGGC CCTCAGGGATCCCTGAGCGATTCTCTGGCTCC AACTCTGGGAACACAGCCACTCTGACCATCAG CGGGACCCAGGCTATGGATGAGGCTGACTTTT ACTGTCAGGCGTGGGACAACAGCACTGTGGTA TTCGGCGGAGGGACCAAGGCTGACCGTCCTA | SEQ ID NO: 29092 | CAGGTGCAGCTGGTGCAGTCTGGGGCTGAGGTG AAGAAACCTGGGGCCTCAGTGAAGGTCTCCTGC AAGGCTTCTGGATACACCTTCACCGACTACTATA TTCACTGGGTGCGACAGGCCCCTGGACAAGGGCT TGAGTGGATGGGATGGATCAACCCTAACAGTGGT GGGACAAACAATGCACAGAAGTTTCAGGGCAGG GTCACCATGACCAGGGACACGTCCATCAGTACA GCCTACATGGAGCTGAGCAGGCTGAGATCTGAC GATACGGCCGTGTATTCCTGTGCGAGGTCGTATT ACTATGGTTCGGGACTTATTATAACGAATTTGA CTACTGGGGCCAGGGAACCCTGGTCACCGTCTCC TCA |
| iPS:398490 | 21-225_21D12 | NA | SEQ ID NO: 25087 | SYELTQPPSVSVSPGQTASITCSGDKLGNKYAY WYQQKPGQSPVLVIYQDRKRPSGIPERFSGSNSG NTATLTISGTQAMDEADFYCQAWDNSTVVFGG GTRLTVL | SEQ ID NO: 29093 | QVQLVQSGAEVKKPGASVKVSCKASGYTFTDYYIH WVRQAPGQGLEWMGWINPNSGGTNNAQKFQGRV TMTRDTSISTAYMELSRLRSDDTAVYSCARSYYYG SGTYNEFDYWGQGTLVTVSS |
| | | AA | SEQ ID NO: 25088 | | SEQ ID NO: 29094 | |

FIGURE 50
(Continued)

| | | | |
|---|---|---|---|
| iPS:398494 | 21-225_21H4 | NA | CAGTCTGCCCTGACTCAGCCTGCCTCCGTGTCT<br>GGGTCTCCTGGACAGTCAGTGATCACCATCCTG<br>CACTGGAACCAGCAGTCACGTTGGTGGTTATA<br>ACTCTGTCTCCTGGTACCAACAGCACCCAGAC<br>AAGCCCCAAACTCATGATTTATGAGGTCAG<br>TAATCGGCCCTCAGGGGTTTCTAATCGCTCTC<br>TGGCTCCAAGTCTGGCAACACGGCCTCCCTGA<br>CCATCTCTGGGCTCCAGGCTGAGGACGAGGCT<br>GATTATTACTGCAGTCATGATACAAGGAGCAG<br>CACTGTGGATATTCGGCGGAGGGACCAAGCTGA<br>CCGTCCTA | GAGGTGCAGCTGTTGGAGTCTGGGGAGGCTTG<br>GTACAGCCTGGGGGGTCCTGAGACTCTCCTGTG<br>CAGCCTCTGGATTCACCTTTAGCAGCTATGCCAT<br>GAGCTGGGTCCGCCAGGCTCCAGGGAAGGGGCT<br>GGAGTGGGTCTCAGCTCTTAGTGGTCGTGGTGGT<br>AGCACATACTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGGGAC<br>GTGGATACAGCTATGAGTACTACTACGGTATGGA<br>CGTCTGGGGCCAAGGGACCACGGTCACCGTCTCC<br>TCA |
| | | | SEQ ID NO: 25089 | SEQ ID NO: 29095 |
| | | AA | QSALTQPASVSGSPGQSITISCTGTSSDVGGYNSV<br>SWYQQHPDKAPKLMIYEVSNRFSGSK<br>SGNTASLTISGLQAEDEADYYCSSYTRSSTVVFG<br>GGTKLTVL | EVQLLESGGGLVQPGGSLRLSCAASGFTFSSYAMS<br>WVRQAPGKGLEWVSALSGRGGSTYYADSVKGRFT<br>ISRDNSKNTLYLQMNSLRAEDTAVYYCAKWGRGY<br>SYEYYYGMDVWGQGTTVTVSS |
| | | | SEQ ID NO: 25090 | SEQ ID NO: 29096 |
| iPS:398496 | 21-225_22D2 | NA | GACATCGTGATGACCCAGTCTCCAGACTCCCT<br>GGCTGTGTCTCTGGGCGAGAGGGCCACCATCA<br>CCTGCAAGTCCAGCCAGAGTGTTTTACACAGC<br>TCCAACAATAACAACTACTTAGCTTGGTACCA<br>GCAGAAACCAGGACAGCCTCCTAAGCTACTCA<br>TTTACTGGGCATCTACCCGGGAAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTTCTGTCAGCAA<br>TATTATAGTACTCCGTGCAGTTTGGCCAGGG<br>GACCAAGCTGGAGATCAAA | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCATAAATTATGATA<br>TCAACTGGGTGCGACAGGCCACTGGACAAGGGC<br>TTGAGTGGATGGGATGGATGAACACCTGACAGTGG<br>TAACACAGGCTATGCACAGAAGTTCCAGGCAG<br>AGTCACCATGACCAGGAACACCTCCATAAGCAC<br>AGCCTACATGGAGCTGAGCAGTTTGAGATCTGAG<br>GACACGGCCGTGTATTATTGTGCGTATAGTAGTG<br>GCTGGTACTACTTTGACTACTGGGGCCAGGGAAC<br>CCTGGTCACCGTCTCCTCA |
| | | | SEQ ID NO: 25091 | SEQ ID NO: 29097 |

FIGURE 50
(Continued)

| | | | |
|---|---|---|---|
| | | AA | DIVMTQSPDSLAVSLGERATITCKSSQSVLHSSN NNNYLAWYQQKPGQPPKLLIYWASTRKSGVPD RFSGSGSGTDFTLTISSLQAEDVAVYFCQQYYST PCSFGQGTKLEIK<br>SEQ ID NO: 25092 | QVQLVQSGAEVKKPGASVKVSCKASGYTFINYDIN WVRQATGQGLEWMGWMHPDSGNTGYAQKFQGR VTMTRNTSISTAYMELSSLRSEDTAVYYCAYSSGW YYFDYWGQGTLVTVSS<br>SEQ ID NO: 29098 |
| iPS:398498 | 21-225_22E6 | NA | TCCTATGAGCTGACTCAGCCACCCTCAGTGTC CGTGTCCCCAGGACAGAGCCAGCATCACCT GCTCTGGAGATAAATTGGGGGAGAAATATGCT TGCTGGTATCAGCAGAAGCCAGGCCAGTCCC TGTGTTGTCATCTATCAAGATAGAAAGCGGC CCTCAGGGATCCCTGAGCGATACTCTGGCTCC AACACTGGGAACACAGCCACTCTGACCATCAG CGGGACCCAGGCTATGGATGAGGCTGACTATT ACTGTCAGGCGTGGGACAGCAGCACTGCGGTA TTCGGCGGAGGGACCAAGCTGACCGTCCTA<br>SEQ ID NO: 25093 | CAGATCACCTTGAAGGAGTCTGGTCCTACGCTGG TGAAACCCACACAGACCCTCACGCTGACCTGCAC CTTCTCTGGGTTCTCACTCAGCACTGGTGAGTG GGTGTGGGCTGGATCCGTCAGCCCCCAGGAAAG GCCCTGGAGTGGCTTGCACTCATTTATTGGAATG ATGATAAGCGCTACAGCCCATCTCTGAAGAGCA GGCTCACCATCACCAGGGACACCTCCAAAAACC AGGTGGTCCTTACAATGACCAACATGGACCCTGT GGACACAGCCACATATTACTGTGCACACACTATA GCAGTTCGTGGCTTTGACTACTGGGGCCAGGGAA CCCTGGTCACCGTCACCTCA<br>SEQ ID NO: 29099 |
| | | AA | SYELTQPPSVSVSPGQTASITCSGDKLGEKYACW YQQKPGQSPVLVIYQDRKRPSGIPERYSGSNTGN TATLTISGTQAMDEADYCQAWDSSTAVFGGG TKLTVL<br>SEQ ID NO: 25094 | QITLKESGPTLVKPTQTLTLTCTFSGFSLSTGGVGVG WIRQPPGKALEWLALIYWNDDKRYSPSLKSRLTIT RDTSKNQVVLTMTNMDPVDTATYYCAHTIAVRGF DYWGQGTLVTVSS<br>SEQ ID NO: 29100 |

FIGURE 50
(Continued)

| | | | |
|---|---|---|---|
| iPS:398500 | 21-225_23A11 | NA | GACATCCAGATGACCCAGTCTCCATCCTCACT GTCTACATCTGTAGGAGACAGAGTCACCATCA CTTGTCGGGCGAGTCAGGACATTAGCAATTAT TTAGCCTGGTTTCAGCAGAAACCAGGGAAAGC CCCTAAGCGCCTGATCTATGCTGCATCCACTTT GCAAAGTGGGGTCCCATCAAAGTTCAGCGGCA GTGGATCTGGGACAGATTTCACTCTCACCATC AGCAGCCTGCAACAGTATAATAGTTACCATCA TTACTGCCAACAGTATAATAGTTACCATTCA CTTTCGGCCCTGGGACCAAAGTGGATCTCAAG | GAGGTGCAGCTGGTGGAGTCTGGGGGAGGCTG GTCAAGCCTGGGGGGTCCCTGAGACTCTCCTGTG CAGCCCTCTGGATTCACCTTCAGTAGTTATAGCAT GAACTGGATCCGCCAGGCTCCAGGGAAGGGGCT GGAGTGGGTCTCATCCATTAGTGGTAGTAGTACT TACATATACTACGCAGACTCAGTGAAGGGCCGA ATCGCCATCTCCAGAGACAACGCCAAGAACTCA CTGTATCTGCAAATGAACAGCCTGAGAGCCGAG GACACGGCTGTGTATTACTGTGCGAGAGTGGCTT CATTTGACTACTGGGGCCAGGGAACCCTGGTCAC CGTCTCCTCA |
| | | | SEQ ID NO: 25095 | SEQ ID NO: 29101 |
| | | AA | DIQMTQSPSSLSTSVGDRVTITCRASQDISNYLA WFQQKPGKAPKRLIYAASTLQSGVPSKFSGSGS GTDFTLTISSLQPEDFATYYCQQYNSYPFTFGPG TKVDLK | EVQLVESGGGLVKPGGSLRLSCAASGFTFSSYSMN WIRQAPGKGLEWVSSISGSSTYIYYADSVKGRIAIS RDNAKNSLYLQMNSLRAEDTAVYYCARVASFDY WGQGTLVTVSS |
| | | | SEQ ID NO: 25096 | SEQ ID NO: 29102 |
| iPS:398502 | 21-225_23B11 | NA | GACATCCAGATGACCCAGTCTCCATCTTCCGT GTCTGCATCTGTAGGAGACAGAGTCACCATCA CTTGTCGGGCGAGTCAGGGTATTACCAAGTGG TTAGCCTGGTATCAGCAGAAACCAGGGAAAG CCCCTAAAGTCCTGATCTATGCTGCATCCAGTT TGCAAAGTGGGGTCCCATCAAGGTTCAGCGGC AGTAGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATC TGCACTGGGTGCGACAGGCCCCTGGACAAGGGC TTGAGTGGATGGGATGGATCAACCCTAACAATAA GGTCACCAAACTATGCACAGAAGTTTCAGGCAG GGTCACCATGACCAGGGACACGTCCATCAGCAC AGCCTACATGGAGCTGAGCCGGCTGAGATCTGA CGACACGGCCGTGTATTACTGTGCGAGAGATGGT ACCAGCTGCGTTTGACTACTGGGGCCAGGGAACCC TGGTCACCGTCTCCTCA |
| | | | SEQ ID NO: 25097 | SEQ ID NO: 29103 |

FIGURE 50
(Continued)

| | | AA | DIQMTQSPSSVSASVGDRVTITCRASQGITKWLA WYQQKPGKAPKVLIYAASSLQSRVPSRFSGSRS GTDFTLTISSLQPEDFATYYCQQANSFPFTFGPGT KVDIK | QVQLVQSGAEVKKPGASVKVSCKASGYTFTGYYL HWVRQAPGQGLEWMGWINPNNNGTNYAQKFQGR VTMTRDTSISTAYMELSRLRSDDTAVYYCARDGTS SFDYWGQGTLVTVSS |
|---|---|---|---|---|
| | | | SEQ ID NO: 25098 | SEQ ID NO: 29104 |
| iPS:398504 | 21-225_23D7 | NA | TCCTATGAACTGACTCAGCCACCTCAGTGTC CGTGTCCCCAGGACAGAGACAGCATCACCT GCTCTGAGAAAAATTGGGGATAAATATGTT TGTTGGTATCAGCAGAAGCCAGGCCAGTCCC TGTGGTGGTCATCTATCAAGATAGCAAGCGGC CCTCAGGGATCCCTGAGCGATTCTCTGGCTCC AACTCTGGGAACACAGGCTATGATGAGGCTATT CGGGACCCCAGGCTGTGGAACAGCAGCAATGTGGTA ACTGTCAGGCGGTGGAGGGACCAAGCTGACCGTCCTA | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGCTTTCACTCATTATTGAATA ATGATAAGGTCTACAGCCCATCTGAAGAGCAG GCTCACCATCACCAAGTACACCTCCAAAAACCAG GTGGTCCTTACAAGTCCAACATGGACCCTGTGG ACACAGCCACATATTACTGTGCACACAGGGGAC AGCAGCTGGCCCTGACTACTGGGGCCAGGGAA CCCTGGTCACCGTCTCCTCA |
| | | | SEQ ID NO: 25099 | SEQ ID NO: 29105 |
| | | AA | SYELTQPPSVSVSPGQTASITCSGEKLGDKYVCW YQQKPGQSPVVVIYQDSKRPSGIPERFSGSNSGN TATLTISGTQAMDEADYCQAWNSSNVFGGG TKLTVL | QITLKESGPTLVKPTQTLTLTCTFSGFSLSTSGVVG WIRQPPGKALECLSLIYWNNDKVYSPSLKSRLTITK YTSKNQVVLTMSNMDPVDTATYYCAHRGQQLAL DYWGQGTLVTVSS |
| | | | SEQ ID NO: 25100 | SEQ ID NO: 29106 |

FIGURE 50
(Continued)

| | | | | |
|---|---|---|---|---|
| iPS:398506 | 21-225_23G12 | NA | GACATCGTGATGACCCAGTCTCCAGACTCCCTGGCTGTGTCTCTGGGCGAGAGGGCCACCATCAACTGCAAGTCCAGCCAGAGTCCAGAGTATTTATTCAGCTCCAACAATAACAACTACTTAGCTTGGTACCAGCAGAAACCAGGACAAACCTCCTAAGTTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTTCTGTCAGCAATATTCTAGTACTCCGTGGACGTTCGGCCAAGGGACCAAGGTGGAAATCAAA | CAGGTGCAGCTGCTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGTACCTAACAGTGGTAACACGGGCTATGCACAGAAGTTCCAGGGCAGAGTCACCATGACCATGAACACCTCCATAAGCACAGCCTACATGGAGTTGAGCAGCCTGAGATCTGAGGACACGGCCGTGTATTACTGTGCGATTAGCGGTGGCTGGTACTACTTTGACTACTGGGGCCAGGGAACCCTGGTCACCGTCTCCTCT |
| | | | SEQ ID NO: 25101 | SEQ ID NO: 29107 |
| | | AA | DIVMTQSPDSLAVSLGERATINCKSSQSILFSSNNNNYLAWYQQKPGQPPKLLIYWASTRESGVPDRFSGSGSGTDFTLTISSLQAEDVAVYFCQQYSSTPWTFGQGTKVEIK | QVQLLQSGAEVKKPGASVKVSCKASGYTFTNYDINWVRQATGQGLEWMGWMYPNSGNTGYAQKFQGRVTMTMNTSISTAYMELSSLRSEDTAVYYCAISGGWYYFDYWGQGTLVTVSS |
| | | | SEQ ID NO: 25102 | SEQ ID NO: 29108 |
| iPS:398508 | 21-225_24B1 | NA | GATGTTGTGATGACTCAGTCTCCACTCCCTGCCCGTCACCCTTGGACAGCCGGCCTCCATCTCTGCAGGTCTAGTCAAAGCCTCGTATACAGTGATGGAAACACCTACTTGAATTGGTTTCAGCAGAGGCCAGGCCAATCTCCAAGGCGCCTAATTTATAAGGTTTCTAACTGGGACTCTGGGGTCCCAGACAGATTCAGCGGCAGTGGGTCAGGCACTGATTTCACACTGAAAATCAGTCGGGTGGAGGCTGAGGATGTTGGGGTTTATTACTGCATGCAAGGTCACACTGGCCTCCGATCACCTTCGGCCAAGGGACACGACTGGAGATTAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTGGTGGTAGCACATACTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATACTGTAGTACTACGGTATGAGTGGATACAGCTATGAGTACTACGGTATGAAGTCTGGGGCCAAGGGACCACGGTCACCGTCTCCTCA |
| | | | SEQ ID NO: 25103 | SEQ ID NO: 29109 |

FIGURE 50
(Continued)

| | | | | |
|---|---|---|---|---|
| iPS:398510 | 21-225_25A3 | AA | DVVMTQSPSLSLPVTLGQPASISCRSSQSLVYSDG NTYLNWFQQRPGQSPRRLIYKVSNWDSGVPDRF SGSGSGTDFTLKISWVEAEDVGVCYCMQGAHW PPITFGQGTRLEIK<br>SEQ ID NO: 25104 | EVQLLESGGGLVQPGGSLRLSCAASGFTFSSYAMS WVRQAPGKGLEWVSAISGRGGSTYYADSVKGRFTI SRDNSKNTLYLQMNSLRAEDTAVYYCAKWGRGY SYEYYYGMDVWGQGTTVTVSS<br>SEQ ID NO: 29110 |
| | | NA | GACATCGTGATGACCCAGTCTCCAGACTCCCT GACTGTGTCTCTGGGCGACAGGGCCACCATCA ACTGCAAGTCCAGCCAGAGTGTTTATACAGC TCCAACAATAAGAACTACTTAGCTTGGTACCA GCAGAAACCTGGACAGCCTCCTAAGCTGCTCA TTTACTGGGCATCTCACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAGGCTGGAGATCAAA<br>SEQ ID NO: 25105 | CAGGTGCAGCTGGTGCAGTCTGGGGCTGAGGTG AAGAAGCCTGGGGCTCAGTGAAGGTCTCCTGC AAGGCTTCTGGATACATCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCTGGAACACCTCCATAAGCACA GCCAACATGGAGCTGAGCAGCTGAGATCTGAG GACACGGCCGTGTATTACTGTGCGAGTAGCAGTG GCTGGTATTGGTTCGACCCCTGGGGCCAGGAAC CCTGGTCACCGTCTCCTCA<br>SEQ ID NO: 29111 | 
| | | AA | DIVMTQSPDSLTVSLGERATINCKSSQSVLYSSN NKNYLAWYQQKPGQPPKLLIYWASTRESGVPD RFSGSGSGTDFTLTISSLQAEDVAVYYCQQYYST PCSFGQGTRLEIK<br>SEQ ID NO: 25106 | QVQLVQSGAEVKKPGASVKVSCKASGYIFTNYDIN WVRQATGQGLEWMGWMHPNSGNTGYAQKFQGR VTMTWNTSISTANMELSSLRSEDTAVYYCASSSGW YWFDPWGQGTLVTVSS<br>SEQ ID NO: 29112 |

FIGURE 50
(Continued)

| | | | | |
|---|---|---|---|---|
| iPS:398512 | 21-225_25E12 | NA | GACATCGTGCTGACCCAGTCTCCAGACTTCCTGGCTATGTCTCTGGGCGAGAGGGCCACCATCAACTGCAAGTCCAGCCAGAGTGTTTTATACCACTCCAACAATTACAACTACTTAGCTTGGTACCAGCAGAAACCAAAACAGCCTCCTAAGCTGCTCATTTACTGGGCATCTACCCGGGAGTCCGGGGTCCCTGACCGATTCAGTGGCAGCGGGTCTGGGACATATTTCACTCTCACCATCAGCAGCCTCCAGGCTGAAGATGTGGCAGTTTATTACTGTCAGCAATATTACAGTACTCCGTGCAGTTTTGGCCAGGGGACCAACCTGGAGATCAAA<br>SEQ ID NO: 25107 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGAACCTAACAGTGGTAACACAGGCTATGCACAGAAGTTCCAGGCAGAGTCACCATGACCAGGAACACCTCCATAAGCACAGCCTACCTGGAGCTGAGCAGCCTGAGATCTGAGGACACGGCCGTGTATTACTGTGCGGGAGCAATGGCTGGTACTACTTTGACTACTGGGGCCAGGGAACCCTGGTCACCGTCTCCTCA<br>SEQ ID NO: 29113 |
| | | AA | DIVLTQSPDFLAMSLGERATINCKSSQSVLYHSNNYNYLAWYQQKPKQPPKLLIYWASTRESGVPDRFSGSGSGTYFTLTISSLQAEDVAVYYCQQYYSTPCSFGQGTNLEIK<br>SEQ ID NO: 25108 | QVQLVQSGAEVKKPGASVKVSCKASGYTFTNYDINWVRQATGQGLEWMGWMNPNSGNTGYAQKFQGRVTMTRNTSISTAYLELSSLRSEDTAVYYCAGSNGWYYFDYWGQGTLVTVSS<br>SEQ ID NO: 29114 |
| iPS:398516 | 21-225_26A9 | NA | GACATCGTGATGACCCAGTCTCCAGACTCCTGGCTGTGTCTCTGGGCGAGAGGGCCACCATCAACTGCAAGTCCAGCCAGAGTGTTTTATACAGCTCCAACAATAAGAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACATGCACAGGCTGTGCAGCTGAAGATGTGGCAGTTTATTACTGTCAGCAAGACTTCACTCTCACTATCAGCAGCCTGCAGGCTGAAGATGTGGCAGTTTATTACTGTCAGCAATATTATAGTAGTCCGTGCAGTTTGGCCAGGGGACCAGGCTGGAGATCAAA<br>SEQ ID NO: 25109 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACAGAAGTTCCAGGCAGTAACACAGGCTGTGCACAGAAGTTCCAGGCAGTCACCATGACCTGGAACATGTCCATAAGCACAGCCTACATGGAGCTGAGCAGCCTGAGATCTGAGGACACGGCCGTATATTACTGTGCGAGTAGCAGTGGCTGGTACTGGTTCGACCCCTGGGGCCAGGGAACCCTGGTCACCGTCTCCTCA<br>SEQ ID NO: 29115 |

FIGURE 50
(Continued)

| | | | |
|---|---|---|---|
| iPS:398520 | 21-225_31C4 | AA | DIVMTQSPDSLAVSLGERATINCKSSQSVLYSSN NKNYLAWYQQKPGQPPKLLIYWASTRESGVPD RFSGSGSGTDFTLTISSLQAEDVAVYYCQQYYSS PCSFGQGTRLEIK<br>SEQ ID NO: 25110 | QVQLVQSGAEVKKPGASVKVSCKASGYTFTNYDIN WVRQATGQGLEWMGWMHPNSGNTGCAQKFQGR VTMTWNMSISTAYMELSSLRSEDTAVYYCASSSG WYWFDPWGQGTLVTVSS<br>SEQ ID NO: 29116 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAAATGG TTAGCCTGGTATCAGCAGAAACCAGGGAAAG CCCCTAAACCCTGATCTATGCTGCATCCAGTT TGCAGAGTGGGGTCCCAACAAGGTTCAGCGGC AGTGGATCTGGGACAGATTTCACTCTCACCAT CAGCAGCCTGCAGCCTGAAGATTTTGCAATTT ACTATTGTCAACAGGCTAACAGTTTCCCATTC ACTTTCGGCCCTGGGACCAAAGTGGATATCAA A<br>SEQ ID NO: 25111 | CAGGTGCAGTTGGTGCAGTCTGGGACTGAGGTGA AGAAGCCTGGGGCCTCAGTGAAGGTCTCCTGCA AGGCTTCTGGATACACCTTCACCGGCGATTATAT GCACTGGGTGCGACAGGCCCCTGGACAAGGGCT TGAGTGGATGGGATGGATCAGCGTAAAAATGG TGGCACAAACTATGCACAGAAGTTTCAGGGCAG GGTCACCATGACCAGGGACACGTCCATCAGCAC AGTCTACATGGAGCTGAACAGGCTGAGATCTGA CGACACGGCCGTGTATTACTGTGCGAGAGATGG AACTGGGTCTTTGACTACTGGGGCCAGGGAACC CTAGTCACCGTCTCCTCA<br>SEQ ID NO: 29117 |
| | | AA | DIQMTQSPSSVSASVGDRVTITCRASQGISKWLA WYQQKPGKAPKPLIYAASSLQSGVPTRFSGSGS GTDFTLTISSLQPEDFAIYYCQQANSFPFTFGPGT KVDIK<br>SEQ ID NO: 25112 | QVQLVQSGTEVKKPGASVKVSCKASGYTFTGDYM HWVRQAPGQGLEWMGWISPKNGGTNYAQKFQGR VTMTRDTSISTVYMELNRLRSDDTAVYYCARDGT GSFDYWGQGTLVTVSS<br>SEQ ID NO: 29118 |

FIGURE 50
(Continued)

| | | | |
|---|---|---|---|
| iPS:398522 | 21-225_32A1 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAACTACTTAGCTTGGTACCA GCTGAAACCAGGACAGCCTCCTAAGCTGCTCA TTTACTGGGCATCTACCCGGAAATCCGGGGTC CCTGACCGATTCAGTGGCAGCGGGTCTGGGAC AGATTTCACTCTCACCATCAGCAGCCTGCAGA CTGAAGATGTGGCACTTTATTACTGTCAACAA TATTATACTTCTCCGTGCAGTTTGGCCAGGGG ACCAAGCTGGAGATCAAA SEQ ID NO: 25113 | CAGGTGCAGCTGGTGCAGTCTGGGGCTGAGGTG AAGAAGCCTGGGGCCTCAGTGAAGGTCTCCTGC AAGGCTTCTGGATACACCTTCACCAACTATGATA TTAACTGGGTGCGACAGGCCACTGGACAAGGC TTGAGTGGATGGGATGGATGAACCTAACAGTG GTAACACAGGCTATGCACAGAAGTTCCAGGCC GAGTCACCATGACCAGAGACACCTCCATAAGCA CAGCCTACATGGAGCTGAGCAGCCTGAGATCTG AGGACACGGCCGTGTATTACTGTGCGAGCAGCA GTGGCTGGTACTTTTTTGACTACTGGGGCCAGGG AACCCTGGTCACCGTCTCCTCA SEQ ID NO: 29119 |
| | | AA | DIVMTQSPDSLAVSLGERATINCKSSQSVLYSSN NYNYLAWYQLKPGQPPKLLIYWASTRKSGVPD RFSGSGSGTDFTLTISSLQTEDVALYYCQQYYTS PCSFGQGTKLEIK SEQ ID NO: 25114 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YFFDYWGQGTLVTVSS SEQ ID NO: 29120 |
| iPS:398524 | 21-225_32A5 | NA | GACATCGTGATGACCCAGTCTGCCAGACTCCT GGCTGTGTCTCTGGGCGAGAGGGCCACCATCA ACTGCAAGTCCAGCCAGAGTGTTTACACAGC TCCAACAATAAGAACTACTTAGCTTGGTATCA GCAGAAACCAGGACAGCCTCCTAAGCTGCTCA TTTACTGGGCATCTACCCGGGAATCCGGGGTC CCTGACCGCTTCAGTGGCAGCGGGTCTGGGAC AGATTTCACTCTCGCCATCAGCAGCCTGCAGG CTGAAGATGTGGCACTTTATCACTGTCAGCAA GATTTATAGTTCTCCGTGCAGTTTTGGCCAGGG GACCGGGCTGGAGATCAAA SEQ ID NO: 25115 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGACA TCAACTGGGTGCGACAGGCCACTGGACAAGGC TTGAGTGGATGGGATGGATGCACAGAAGTTCCGGGCAG TAACACAGGCTTTGCACAGAAGTTCCGGGGCAG AGTCACCATGACCAGAAACACCTCCATAAGCAC AGCCTACATGAACTGAGCAGCCTGAGATCTGA GGACACGCCGTGTATTACTGTTGCGAGCAGAGT GGCTGGTACTTTTTGACTACTGGGGCCAGGGAA CCCTGGTCACCGTCTCCTCA SEQ ID NO: 29121 |

FIGURE 50
(Continued)

| | | | | |
|---|---|---|---|---|
| iPS:398526 | 21-225_32B3 | AA | DIVMTQSPDSLAVSLGERATINCKSSQSVLHSSN NKNYLAWYQQKPGQPPKLLIYWASTRESGVPD RFSGSGSGTDFTLAISSLQAEDVALYHCQQYYSS PCSFGQGTGLEIK<br>SEQ ID NO: 25116 | QVQLVQSGAEVKKPGASVKVSCKASGYTFTNYDIN WVRQATGQGLEWMGWMHPNSGNTGFAQKFRGR VTMTRNTSISTAYMELSSLRSEDTAVYYCSSSSGW YFFDYWGQGTLVTVSS<br>SEQ ID NO: 29122 |
| | | NA | GACATCCAGATGACCCAGTCTCCATCCTCACT GTCTGCATCTATAGGAGACAGAGTCACCATCA CTTGTCGGGCGAGTCAGGCATTAGCAATTAT TTAGCCTGGTTTCAGCAGAAACCAGGGAAAGC CCCTAGGTCCCTGATCTATGCTGCATCCAGTTT ACAAAGTGGGGTCCCATCAACGTTCAGCGGCA GTGGATCTGGGACAGATTTCACTCTCACCATC AGCAGCCTGCAGCCTGAAGATTATAGTTATCCA TTACTGCCAACAGTATATAGTTATCCATTCA CTTTCGGCCCTGGGACCAAAGTGGATATCAAA<br>SEQ ID NO: 25117 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGTGGCTGGC TTTGACTACTGGGGCCAGGGAACCCTGGTCACCG TCTCCTCA<br>SEQ ID NO: 29123 |
| | | AA | DIQMTQSPSSLSASIGDRVTITCRASQGISNYLAW FQQKPGKAPRSLIYAASSLQSGVPSTFSGSGSGT DFTLTISSLQPEDFATYYCQQYNSYPFTFGPGTK VDIK<br>SEQ ID NO: 25118 | EVQLVESGGGLVKPGGSLRLSCAASGFTFSSYSMN WVRQAPGKGLEWVSSISGSSTYIYYADSVKGRFTIS RDNAKNSLYLQMNSLRAEDTAVYYCARVAGFDY WGQGTLVTVSS<br>SEQ ID NO: 29124 |

FIGURE 50
(Continued)

| | | | |
|---|---|---|---|
| iPS:398528 | 21-225_32G1 | NA | GACATCCAGATGACCCAGTCCTCCATCTCCCTGTCTGCATCTGTAGGAGACAGAGTCACCATCACTTGCCGGGCAAGTCAGGACATGAGAAGTGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATTTCACTCTCACAATCAGCAGCCTGCAGCCTGAAGATTTTGCAACTTATTACTGTCTACAGCATATATTTCCCTCTACTTTCGGCGGAGGGACCAAGGTGGAGATCAA SEQ ID NO: 25119 | GAGGTGCAGCTGTTGGAGTCTGGGGGAGGCTTGGCACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCCGTATTAGTGGTGTGGTGTAGCACATTCCACGCAGACTCCGTGAAGGGCCGGTTCACGATCTCCAGAGACAATTCCAAGAACACGCTGTATCTGCAAATGAACAGCCTGAGAGCCGAGGACACGGCCGTATATTACTGTGTGAAAGGGGAGCTACTAGAGGACTACTACTTCTACGGTATGGACGTCTGGGGCCAAGGGACCACGGTCACCGTCTCCTCA SEQ ID NO: 29125 |
| | | AA | DIQMTQSPSSLSASVGDRVTITCRASQDMRSDLGWYQQKPGKAPKRLIYAASSLQSGVPSRFSGSGSGTEFTLTISSLQPEDFATYYCLQHTISPPTFGGGTKVEIK SEQ ID NO: 25120 | EVQLLESGGGLAQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGMDVWGQGTTVTVSS SEQ ID NO: 29126 |
| iPS:398530 | 21-225_32G4 | NA | GATGTTGTGATGACTCAGTCTCCACTCTCCCTGTCCGTCACCCTTGGACAGCCGGCCTCCATCTCCTGCAGGTCTAGTCAAAGCCTCGTATACAGTGATGGAAACACCTACTTGAATTGGTTTCAGCAGAGGCCAGGCCAATCTCCAAGGCGCCTAATTTATAAGGTTTCTAACTGGGACTCTGGGGTCCCAGACAGATTCAGCGGCAGTGGGTCAGGCACAGATTTTACACTGAAAATCAGCAGGGTGGAGGCTGAGGATGTTGGGGTTTATTACTGCATGCAAGGTATACACTGGCTCACTTTCGGCGGAGGGACCAAGGTGGAGATCAAA SEQ ID NO: 25121 | CAGGTGCAGCTGGTGCAGTCTGGGGCTGAGGTGAAGAAGCCTGGGGCCTCAGTGAAGGTCTCCTGCAAGGCTTCTGGATACACCTTCACCAGTTATGATATCAACTGGGTGCGACAGGCCACTGGACAAGGGCTTGAGTGGATGGGATGGATGAACCCTAACAGTGGTAACACAGGCTATGCACAGGAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGCGAAAGAAGGCTAACGACTACTGGGGCCAGGGAACCCTGGTCACCGTCTCCTCA SEQ ID NO: 29127 |

FIGURE 50
(Continued)

| | | | |
|---|---|---|---|
| iPS:398532 | | AA | DVVMTQSPLSLSVTLGQPASISCRSSQSLVYSDG NTYLNWFQQRPGQSPRRLIYKVSNWDSGVPDRF SGSGSGTDFTLKISRVEAEDVGVYYCMQGIHWL TFGGGTKVEIK<br>SEQ ID NO: 25122 | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARKKAN DYWGQGTLVTSS<br>SEQ ID NO: 29128 |
| | 21-225_33B7 | NA | GACATCCAGATGACCCAGTCTCCATCCTCACT GTCTGCATCTGTAGGAGACAGAGTCACCATCA CTTGTCGGGCGAGTCAGGACATTAGCAATTAT TTGGCCTGGTTTCAGCAGAAACCAGGGAAAGC CCCTACGTCCCGATCTATGCTGCATCTAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTT TTACTGCCAACAGTATCATAGTTACCCGCTCA CCTTCGGCCAAGGGACACGACTGGAAATTAAA<br>SEQ ID NO: 25123 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAACAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGGTTAAATGGT TTTGACTACTGGGGCCAGGGAACCCTGGTCACCG TCTCCTCA<br>SEQ ID NO: 29129 |
| | | AA | DIQMTQSPSSLSASVGDRVTITCRASQDISNYLA WFQQKPGKAPTSLIYAASSLQSGVPSKFSGSGSG TDFTLTISSLQPEDFATFYCQQYHSYPLTFGQGT RLEIK<br>SEQ ID NO: 25124 | EVQLVESGGGLVKPGGSLRLSCAASGFTFSSYNMN WVRQAPGKGLEWVSSISGSSSYIYYADSVKGRFTIS RDNAKNSLYLQMNSLRAEDTAVYYCARLNGFDY WGQGTLVTVSS<br>SEQ ID NO: 29130 |

FIGURE 50
(Continued)

| | | | |
|---|---|---|---|
| iPS:398534 | 21-225_33B8 | NA | GACATCCAGATGACCCAGTCCTCCATCCTCCT GTCTGCATCTGTAGGAGACAGAGTCACCATCA CTTGCCGGGCAAGTCAGAGACATTAGAAGTGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTTCTGTCTACAGCATACTATTTACCCTCCT ACTTTCGGCGGAGGGACCAAGGTGGAGATCA AA<br><br>SEQ ID NO: 25125 | GAGGTGCAGCTGGTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCCGCTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGTGAAAGGGAGCT ACTAGAGGACTACTACTTCTACGGTATGGACGTC TGGGGCCAAGGGACCACGGTCACCGTCTCCTCA<br><br>SEQ ID NO: 29131 |
| | | AA | DIQMTQSPSSLSASVGDRVTITCRASQDIRSDLG WYQQKPGKAPKRLIYAASSLQSGVPSRFSGSGS GTEFTLTISSLQPEDFATYFCLQHTIYPPTFGGT KVEIK<br><br>SEQ ID NO: 25126 | EVQLLESGGGLVQPGGSLRLSCAASGFTFSSYAMS WVRQAPGKGLEWVSAISGRGGSTFHADSVKGRFTI SRDNSKNTLYLQMNSLRAEDTAVYYCVKGELLED YYFYGMDVWGQGTTVTVSS<br><br>SEQ ID NO: 29132 |
| iPS:398536 | 21-225_33D12 | NA | GACGTCCAGATGACCCAGTCTCCATCCTCCCT GTCTGCATCTTTAGGAGACAGAGTCACCATCA CTTGCCGGGCAAGTCAGAGCATTAGAAGCTAT TTAAATTGGTATCAGCAGAAACCAGGGAAAG CCCCTAAGCTCCTGATCTATGCAGTCATCCAGT TGCAAAGTGGGGTCCCATCAAGGTTCAGTGGC AGTGGATCTGGGACAGATTTCACTCTCACCAT CAGCAGTCTGCAACCTGAAGATTACAGTATCC AGTATTACTGTCAACAGAGTTACAGTATCCGATC ACCTTCGGCCAAGGGACCACGACTGGAGATTAA A<br><br>SEQ ID NO: 25127 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAGCTGGGTGCGACTGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGAAAGA GGGCTAACGACTACTGGGGCCAGGGAACCCTGG TCACCGTCTCCTCA<br><br>SEQ ID NO: 29133 |

FIGURE 50
(Continued)

| | | | |
|---|---|---|---|
| iPS:398538 | 21-225_34H7 | AA | DVQMTQSPSSLSASLGDRVTITCRASQSIRSYLN WYQQKPGKAPNLLIYSASSLQSGVPSRFSGSGSG TDFTLTISSLQPEDFANYYCQQSYSIPITFGQGTR LEIK<br>SEQ ID NO: 25128 | QVQLVQSGAEVKKPGASVKVSCKASGYTFTSYDIS WVRLATGQGLEWMGWMNPNSGNTGYAQKFQGR VTMTRNTSISTAYMELSSLRSEDTAVYYCARKRAN DYWGQGTLVTVSS<br>SEQ ID NO: 29134 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAACTACTTAGCTTGGTACCA GCTGAAACCAGGACAGCCTCCTAAGCTGCTCA TTTACTGGGCATCTCACCCGGAAATCCGGGGTC CCTGACCGATTCAGTGGCAGCGGGTCTGGGAC AGATTTCACTCTCACCATCAGCAGCCTGCAGA CTGAAGATGTGGCACTTTATTACTGTCAGCAA TATTATACTTCTCCGTGCAGTTTTGGCCAGGGG ACCAAGCTGGAGATCAAA<br>SEQ ID NO: 25129 | CAGGTGCAGCTGGTGCAGTCTGGGGCTGAGGTG AAGAAGCCTGGGGCTCAGTGAAGGTCTCCTGC AAGGCTTCTGGATACACCTTCACCAACTATGATA TTAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAACAGCCTGAGATCTG AGGACACGGCCGTGTATTACTGTGCGAGCAGCA GTGGCTGGTACTTTTTGACTACTGGGGCCAGGG AACCCTGGTCACCGTCTCCTCA<br>SEQ ID NO: 29135 |
| | | AA | DIVMTQSPDSLAVSLGERATINCKSSQSVLYSSN NYNYLAWYQLKPGQPPKLLIYWASTRKSGVPD RFSGSGSGTDFTLTISSLQTEDVALYYCQQYYTS PCSFGQGTKLEIK<br>SEQ ID NO: 25130 | QVQLVQSGAEVKKPGASVKVSCKASGYTFTNYDIN WVRQATGQGLEWMGWMNPNSGNTGYAQKFQGR VTMTRNTSISTAYMELNSLRSEDTAVYYCASSSGW YFFDYWGQGTLVTVSS<br>SEQ ID NO: 29136 |

FIGURE 50
(Continued)

| | | | |
|---|---|---|---|
| iPS:398540 | 21-225_35A6 | NA | GACATCCAGATGACCCAGTCTCCATCCCCT GTCCGCATCTGTAGGAGACAGAGTCACCATCA CTTGCCGGGCAAGTCAGGACATTAGAAGTGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGATTCACTCTCACAA TCAGCAGCCTGCAGCCTGAAGATTTGCAACT TATTACTGTCTACAGCATACTATTTACCCTCCT ACTTTCGGCGGAGGGACCAAGGTGGAGATCA AA |
| | | | SEQ ID NO: 25131 |
| | | | GAGGTGCAGCTGTTGGAGTCTGGGGGAGGCTTG GTACAGCCTGGGGGGTCCCTGAGACTCTCCTGTG CAGCCCTCTGGATTCACCTTTAGCAGCTATGCCAT GAGCTGGGTCCGCCAGGCTCCAGGGAAGGGGCT GGAGTGGGTCTCCACTATTAGTGGTCGTGGTGGT AGCACATTCCACGCAGACTCCGTGAAGGGCCGG TTCACCATCTCCAGAGACAATTCCAAGAACACGC TGTATCTGCAAATGAACAGCCTGAGAGCCGAAG ACACGGCCGTATATTACTGTGTGAAGGGGAGCT ACTAGAGGACTACTACTTCTACGTATGGACGTC TGGGGCCAAGGGACCACGGTCACCGTCTCCTCA |
| | | AA | SEQ ID NO: 29137 |
| | | | DIQMTQSPSSLSASVGDRVTITCRASQDIRSDLG WYQQKPGKAPKRLIYATSSLQSGVPSRFSGSGSG TEFTLTISSLQPEDFATYYCLQHTIYPPTFGGGTK VEIK |
| | | | SEQ ID NO: 25132 |
| | | | EVQLLESGGGLVQPGGSLRLSCAASGFTFSSYAMS WVRQAPGKGLEWVSTISGRGGSTFHADSVKGRFTI SRDNSKNTLYLQMNSLRAEDTAVYYCVKGELLED YYFYGMDVWGQGTTVTVSS |
| | | | SEQ ID NO: 29138 |
| iPS:398544 | 21-225_7C8 | NA | CTGCCTGTGCTGACTCAGCCCCCGTCTGCATCT GCCTTGCTGGGAGCCTCGATCAAGCTCACCTG CACCCTAAGCAGTGAGCAGTGCACCTACACCA TCGAATGGTATCAACAGAGACCAGGGAGGTC CCCCCAGTATATAATGAAGGTTAAGAGTGATG GCAGCCACAAGGGGACGGGATCCCGA TCGCTTCATGGGCTCCAGTTCTGGGGGTACC GCTACCTCACCTTCTCCAACCTGTGAGAGCCA ATGAGGATGAGTATCACTGTGGTGTGGTATTCG CCCGATTGATGGCCAAGTCGGTGGTGGTTC GCGAGGGACCAAGCTGACCGTCCTA | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCCGGAT GAACTGGGGTCCGCTGCCTGGCTCCAGGGAAGGGGCT GGAGTGGGTTGGCCGTATTAAAAGCAAAACTGA TGGTGGGACAACAGACTACGCTGCACCGTGAA AGGCAGATTCACCATCTCAAGAGATGAATCAGA AAACACGTGTATCTGCAAATGAACAGCCTGAA AACCGAGGACACAGGTGTATTACTGTCGTCCACA GATACGGGTCCTATAGCAGCTCGTCTGCTTACT ACTACTACTACGCTATGGACGTCTGGGGCCAAGG GACCACGGTCACCGTCTCCTCA |

FIGURE 50
(Continued)

| | | | | |
|---|---|---|---|---|
| | | | SEQ ID NO: 25133 | SEQ ID NO: 29139 |
| | | AA | LPVLTQPPSASALLGASIKLTCTLSSEHSTYTIEW YQQRPGRSPQYIMKVKSDGSHSKGDGIPDRFMG SSSGGDRYLTFSNLQSDDEDEYHCGESHPIDGQV GVVFGGGTKLTVL | EVQLVESGGGLVKPGGSLRLSCAASGFTFSNARMN WVRLAPGKGLEWVGRIKSKTDGTTDYAAPVKGR FTISRDESENTLYLQMNSLKTEDTGVYYCSTDTGPI AARLAYYYYAMDVWGQGTTVTVSS |
| | | | SEQ ID NO: 25134 | SEQ ID NO: 29140 |
| iPS:398546 | 21-225_9H10 | NA | TCCTATGAGCTGACTCAGCCACCCTCAGTGTC CGTGTCCCCAGGACAGAGCCAGCATCACCT GCTCTGGAGATAAATTGGGGATAAATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTTATGTG GTATTCGGCGGAGGGACCAAGCTGACCGTCCT A | CAGATCACCTTGAAGGAGTCTGGTCCTACGCTGG TGAAACCCACACAGACCCTCACGCTGACCTGCAC CTTCTCTGGGTTCTCACTCACCACTAGTGGAGTG GGTGTGGGCTGGATCCGTCAGCCCCCAGGAAAG GCCCTGGAATGGCTTGCACTCATTTATTGGAGTG ATGATAAGCGCTACAGCCCATCCTGAAGAGCA GGCTCACCATCACCAAGGACACACCTCCAAAACC AGTTGGTCCTTACAATGACCAACATGGCCCTGT GGACACAGCCACATATTACTGTGCACACGGTT TCTAGCTGCTGCTATTTTGACTACTACTGGGGCCAGG GAACCCTGGTCACCGTCCTCA |
| | | | SEQ ID NO: 25135 | SEQ ID NO: 29141 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDSSTYVFGG GTKLTVL | QITLKESGPTLVKPTQTLTLTCTFSGFSLTTSGVGVG WIRQPPGKALEWLALIYWSDDKRYSPSLKSRLTITK DTSKNQVVLTMTNMAPVDTATYYCAHTGSSCCYF DYWGQGTLVTVSS |
| | | | SEQ ID NO: 25136 | SEQ ID NO: 29142 |

FIGURE 50
(Continued)

| | | | | |
|---|---|---|---|---|
| iPS:402219 | 21-225_1C12 | | GACATCCAGATGACCCAGTCTCCATCCTCCCT<br>GTCTGCATCTGTAGGAGACAGAGTCACCATCA<br>CTTGCCGGGCAAGTCAGGGCATTAGAAATGAT<br>TTAGGCTGGTATCAGCAGAAACCAGGAAAG<br>CCCCTAAGCGCCTGATCTATGCTGCATCCAGT<br>TTGCAAAGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAACATATAGTTACCCGCTC<br>ACTTTCGGCGGAGGGACCAAGGTGGCGATCA<br>AA<br>SEQ ID NO: 25137 | NA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTAACTATGGCAT<br>GCACTGGGTCCGCCAGGCTCCAGGCAAGGGCT<br>GGAGTGGGTGGCAGTTATATGTATGATGAAAAT<br>AATAAATACTATGTAGACTCCGTGAAGGGCCGAT<br>TCACCATCTCCAGAGACAACTCCAAGAACACGCT<br>GTATCTGCAAATGAACAGCTGAGAGCCGAGGA<br>CACGGCTGTGTATTACTGTGCGAGAGAATTGGGG<br>TTCCGGTCTGACTACTGGGGCCAGGGAACCCTGG<br>TCACCGTCTCCTCA<br>SEQ ID NO: 29143 |
| | | AA | DIQMTQSPSSLSASVGDRVTITCRASQGIRNDLG<br>WYQQKPGKAPKRLIYAASSLQSGVPSRFSGSGS<br>GTEFTLTISSLQPEDFATYYCLQHNSYPLTFGGG<br>TKVAIK<br>SEQ ID NO: 25138 | | QVQLVESGGGVVQPGRSLRLSCAASGFTFSNYGM<br>HWVRQAPGKGLEWVAVIWYDENNKYYVDSVKGR<br>FTISRDNSKNTLYLQMNSLRAEDTAVYYCARELGF<br>RSDYWGQGTLVTVSS<br>SEQ ID NO: 29144 |
| iPS:402221 | 21-225_2C12 | | GACATCCAGATGACCCAGTCTCCATCCTCACT<br>GTCTGCATCTGTAGGAGACAGAGTCACCATCA<br>CTTGTCGGGCGAGTCAGGGCATTAGCAATTAT<br>TTAGCCTGGTTTCAGCAGAAATCAGGGAAAGC<br>CCCTAAGTCTCCTGATCTCTGCTGCAACCAGTTT<br>GCAAAGTGGGGTCCCATCACAGTTCAGCGGCA<br>GTGGATCTGGGACAGATTTCACTCTCACCATC<br>AGCAGCCTGCAGCCTGAAGATTTTGCAACTTA<br>TTACTGCCAACAGTATTATAGTTACCGATCA<br>CCTTCGGCCAAGGGACACGACTGGAGATTAAA<br>SEQ ID NO: 25139 | NA | GAGGTGCAGCTGGTGGAGTCTGGGGGAGGCTG<br>GTCAAGCCTGGGGGGTCCCTGAGACTCTCCTGTG<br>CAGCCTCTGATTCACCTTCAGTAGCTATAGCAT<br>GAACTGGGTCCGCCAGGCTCCAGGGAAGGGCT<br>GGAGTGGGTCTCATCCATTAGTGGTAGTAGT<br>TACATGTACTACGCAGACTCAGTGAAGGGCCGAT<br>TCACCATCTCCAGAGACAACGCCAAGAACTCACT<br>GTATCTGCAAATGAACAGCTGAGAGCCGAGGA<br>CACGGCTGTGTATTACTGTGCGAGAGAGTGAATCTC<br>TTTGACTACTGGGGCCAGGGAACCCTGGTCACCG<br>TCTCCTCA<br>SEQ ID NO: 29145 |

FIGURE 50
(Continued)

| | | | |
|---|---|---|---|
| iPS:402223 | 21-225_30A11 | AA | DIQMTQSPSSLSASVGDRVTITCRASQGISNYLA WFQQKSGKAPKSLISAATSLQSGVPSQFSGSGSG TDFTLTISSLQPEDFATYYCQQYYSYPITFGQGTR LEIK<br>SEQ ID NO: 25140 | EVQLVESGGGLVKPGGSLRLSCAASGFTFSSYSMN WVRQAPGKGLEWVSSISGSSSYMYYADSVKGRFTI SRDNAKDSLYLQMNSLRAEDTAVYYCARVNLFDY WGQGTLVTVSS<br>SEQ ID NO: 29146 |
| | | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCGACTATCATA TGCACTGGGTGCGACAGGCCCCTGGACAAGGGC TTGAGTGGATGGGATGGATCAACCTAATAGGG GTGGCACAAACTATGCACAGAAGTTTCAGGACA GGGTCACCATGACCAGGGACACGTCCATCAGCA CAGCCTACATGAACTGAGCAGGCTGAGATCTG ACGACACGGCCGTCTATTTCTGTGCGAGAGATGG AACTGGGTCCTTTGACTACTGGGGCCAGGGAACC CTGGTTCACCGTCTCCTCA<br>GACATCCAGATGACCCAGTCTCCATCTTCCGT GTCTGCATCTGTAGGAGACAGAGTCACCATCA CTTGTCGGGCGAGTCAGGGTATTAGCAGATGG TTAGCCTGGTATCAGCAGAAACCAGGGAGAG CCCCTGAACTCCTGATCTATGCTGCATCCCGTT TGCAAAGTGGGATCCCATCCAGGTTCAGCGGC AGTGGATCTGGGACAGATTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATAACAA A<br>SEQ ID NO: 25141 | SEQ ID NO: 29147 |
| | | AA | DIQMTQSPSSVSASVGDRVTITCRASQGISRWLA WYQQKPGKGRAPELLIYAASRLQSGIPSRFSGSGSG TDFTLTISSLQPEDFATYYCQQANSFPFTFGPGTK VDNK<br>SEQ ID NO: 25142 | QVQLVQSGAEVKKPGASVKVSCKASGYTFTDYHM HWVRQAPGQGLEWMGWINPNRGGTNYAQKFQDR VTMTRDTSISTAYMELSRLRSDDTAVYFCARDGTG SFDYWGQGTLVTVSS<br>SEQ ID NO: 29148 |

FIGURE 50
(Continued)

| | | | |
|---|---|---|---|
| iPS:402225 | 21-225_2B1 | NA | TCCTATGAGCTGACTCAGCCACCCTCAGTGTC CGTGTCCCCAGGACAGACAGTCAGCATCACCT GCTCTGGAGATAAATTGGGGGATAAATATGCT TGCTGGTATCAGCAGAAGCCAGGCCAGTCCCC TGTGCTGGTCATCTATCAAGATCGCAAGCGGC CCTCAGGGATCCCTGAGCGATTCTCTGGCTC AACTCTGGGAACACAGCCACTCTGACCATCAG CGGGACCCAGGCTATGGATGAGGCTGACTATT ACTGTCAGGCGTGGGACAACACTGTGGTA TTCGGCGGAGGGACCAAGCTGACCGTCCTA

SEQ ID NO: 25143 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTAGCAT GAACTGGGTCCGCCAGGCTCCAGGGAAGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGCGTCTGGGAAC TACTGGGGCCAGGGAACCCTGGTCACCGTCTCCT CA

SEQ ID NO: 29149 |
| | | AA | SYELTQPPSVSVSPGQTVSITCSGDKLGDKYACW YQQKPGQSPVLVIYQDRKRPSGIPERFSGSNSGN TATLTISGTQAMDEADYYCQAWDNNTVVFGGG TKLTVL

SEQ ID NO: 25144 | EVQLVESGGGLVKPGGSLRLSCAASGFTFSSYSMN WVRQAPGKGLEWVSSISSSSYIYADSVKGRFTIS RDNAKNSLYLQMNSLRAEDTAVYYCARLGNYWG QGTLVTVSS

SEQ ID NO: 29150 |
| iPS:402229 | 21-225_16H9 | NA | GACATCCAGATGACCCAGTCTCCATCCCCT GTCTGCATCTGTAGGAGACAGAGTCACCATCA CTTGCCGGGCAAGTCAGGGCATTAGAAATTAT TTAGGCTGGTTTCAGCAGAAAACCAGGGAAAGC CCCTAAGCGCCTGATCTATGGTGCATCCAGTT TGCAAAGTGGGGTCCCATCAAGGATCAGCGGC AGTGGATCTGGGACAGAATTCACTCTCACAAT CAGCAGCCTGCAGCCTGAAGATTTTGCAACTT ATTACTGTCTACAGTATCATAGTTATCTATTCA CTTCGGCCCTGGGACCAAAGTGGATATCAAA

SEQ ID NO: 25145 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTGGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGTCAACGGT ATGGACGTCTGGGGCCAAGGGACCACGGTCACC GTCTCCTCA

SEQ ID NO: 29151 |

FIGURE 50
(Continued)

| | | | |
|---|---|---|---|
| iPS:402231 | 21-225_6D9 | AA | DIQMTQSPSSLSASVGDRVTITCRASQGIRNYLG WFQQKPGKAPKRLIYGASSLQSGVPSRISGSGSG TEFTLTISSLQPEDFATYYCLQYHSYLFTFGPGTK VDIK<br>SEQ ID NO: 25146 | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARVNGMDV WGQGTTVTVSS<br>SEQ ID NO: 29152 |
| | | NA | TCCTATGAGCTGACTCAGCCACCCTCAGTGTC CGTGTCCCCAGGACAGACAGCCAGCATCACCT GCTCTGGAGATAAATTGGGGAAAAATATGCT TGCTGGTATCAGCAGAAGCCAGGCCAGTCCC TGTACTGGTCATCTATCAAGATAAGAAGCGGC CCTCAGGGATCCCTGAGCGATTCTCTGGCTCC AACTCTGGGAACACAGCCACTCTGACCATCAG CGGAACCCAGGCTATGATGAGGCTGACTATT ACTGTCAGGCGTGGGACAGCAGCACTGTCCTA GGGGAGGGACCAAACTGACCGTCCTA<br>SEQ ID NO: 25147 | GAGGTGCAGCTGGTGGAGTCTGGGGGAGGCTTG GTAAAGCCTGGGGGGTCCCTTAGACTCTCCTGTG CAGCCTCTGGATTCACTTTCAGTAACGCTGAT GAACTGGGTCCGCCTGGCTCCAGGGAAGGGCT GGAGTGGGTTGGCCGTATTAAAAGCAAAACTGA TGGTGGGACAACAGACTACGCTGCACCCGTGAA AGGCAGATTCACCATCTCAAGAGATGATTCAGA AACACGTTGTATCTGCAAATGAACAGCCTGAA AACCGAGGACACAGCCGTGTATTACTGTTCCACA GATACGGGTCCTATAGCAGCTCGTCTGCTTACT ACTACTACGCTATGGACGTCTGGGGCCAAGG GACCACGGTCACCGTCTCCTCA<br>SEQ ID NO: 29153 |
| | | AA | SYELTQPPSVSVSPGQTASITCSGDKLGEKYACW YQQKPGQSPVLVIYQDKKRPSGIPERFSGSNSGN TATLTISGTQAMDEADYYCQAWDSSTVFGGGT KLTVL<br>SEQ ID NO: 25148 | EVQLVESGGGLVKPGGSLRLSCAASGFTFSNAWM NWVRLAPGKGLEWVGRIKSKTDGGTTDYAAPVKG RFTISRDDSENTLYLQMNSLKTEDTAVYYCSTDTGP IAARLAYYYYAMDVWGQGTTVTVSS<br>SEQ ID NO: 29154 |

FIGURE 50
(Continued)

| | | | |
|---|---|---|---|
| iPS:402233 | 21-225_16D10 | NA | GACATCCAGATGACCCAGTCTCCATCCTCACT GTCTGCATCTGTAGGAGACAGAGTCACCATCA CTTGTCGGGCGAGTCAGGACATAAGTAATTAT TTAGCCTGGTTTCAGCAGAAACCAGGGAAAGC CCCTAAGTCCCTGATCTATGCTACACCCAGTTT GCAGAGTGGGGTCCCATCAAAGTTCAGCGGCA GTGGATCTGGGACAGAGTTCACTCTCACCATC AGCAGCCTGCAGCCTGAAGATTTTGCAACTTA TTACTGCCAACAGTATAATAGTTACCCGCTCA CTTTCGGCGGAGGGACCAAGGTGGAGATCAA A | GAGGTGCAACTGGTGGAGTCTGGGGGAGGCTG GTCAAGCCTGGGGGGTCCCTGAGACTCTCCTGTG CAGCCTCTGGATTCACCTTCAGTAGTTAACTT GAACTGGGTCCGCCAGGCTCCAGGGAAGGGCT GGAGTGGGTCTCATCCATTAGTGGTGGTGCCGGT CACATATATTACTCAGACTCAGTGAAGGGCCGAT TCACCATCTCCAGAGACAACGCCAAGAACTACT GTATCTGCAAATGAACAGCCTGAGAGCCGAGGA CACGGCTGTGTATTACTGTGCGAGGACTAATGG TTTGACTTCTGGGGCCAGGGAACCCTGGTCACCG TCTCCCTCA |
| | | | SEQ ID NO: 25149 | SEQ ID NO: 29155 |
| | | AA | DIQMTQSPSSLSASVGDRVTITCRASQDISNYLA WFQQKPGKAPKSLIYATPSLQSGVPSKFSGSGSG TEFTLTISSLQPEDFATYYCQQYNSYPLTFGGGT KVEIK | EVQLVESGGGLVKPGGSLRLSCAASGFTFSTYNLN WVRQAPGKGLEWVSSISGGAGHIYYSDVKGRFTI SRDNAKNSLYLQMNSLRAEDTAVYYCARTNGFDF WGQGTLVTVSS |
| | | | SEQ ID NO: 25150 | SEQ ID NO: 29156 |
| iPS:402235 | 21-225_20F10 | NA | GACATCCAGATGACCCAGTCTCCATCCTCACT GTCTGCATCTGTGGAGACAGAGTCACCATCA CTTGTCGGGCGAGTCAGGCATTAAACAGGAAAGC TTAGCCTGGTTTCAGCAGAAACCAGGGAAAGC CCCTAAGTCCCTGATTTATGCTGCATCCAGTTT GCAAAGTGGGGTCCCATCAAGGTTCAGCGGCA GTGGATTTGGGACAGCCTGAAGATCACTCTCACCATC AGCAGCCTGCAGCAATATAGTTACCCATTCA CTTTTGGCCCTGGGACCAAAGTGGATAACAAA | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGCT GGAGTGGGTCTCATCCATTAGTAGTGGTACTTTC ATATACTACGCAGATTCAGTGAAGGGCCGATTCA CCATCTCAAGAGACAACGCCAAGAACTACTGT ATCTGCAAATGAACAGCCTGAGAGCCGAGGACA CGGCTGTGTATTACTGTGCGAGAAAGGCTGGCT TGATATCTGGGGCCAAGGGACAATGGTCACCGTC TCTTCA |
| | | | SEQ ID NO: 25151 | SEQ ID NO: 29157 |

FIGURE 50
(Continued)

| | | | |
|---|---|---|---|
| iPS:402237 | 21-225_23D11 | AA | DIQLTQSPSSLSASVGDRVTITCRASQGINNYLAWFQQKPGKAPKSLIYAASSLQSGVPSRFSGSGFGTDFTLTISSLQPEDFATFYCQQYNSYPFTFGPGTKVDNK<br>SEQ ID NO: 25152 | EVQLVESGGGLVKPGGSLRLSCAASGFTFSSYSMNWVRQAPGKGLEWVSSISTSTFIYYADSVKGRFTISRDNAKNSLYLQMNSLRAEDTAVYYCARKAGLDIWGQGTMVTVSS<br>SEQ ID NO: 29158 |
| | | NA | GACATCCAGATGACCCAGTCTCCATCCTCACTGTCTGCATCTGTAGGGGACAGAGTCACCATCACTTGTCGGGCGAGTCAGGGCAGGGCATTGCCAATTATCTTAGCCTGGTTTCAGCAGAAACCAGGGAAAGCCCCTAAGTCCCTGATCTCTGCTGCATCCAGTTTGCAAAGTGGGGTCCCATCAAGGTTCAGCGGCAGTGGATCTGGGACAGAGTTCACTCTCACCATCAGCAGCCTGCAGCCTGAAGATTTTGCAACTATTACTGCCAACAGTATCATAGTTACCCGCTCACTTTCGGCGGAGGGTCCAAGGTGGAGATCAAATCTCCCTCA<br>SEQ ID NO: 25153 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAACATAAACTGGGTCCGCCAGGCTCCAGGGAAGGGGCTGGAGTGGGTCTCATCCATTAGTGGTAATAGTGGTTACATATACTACGCAGACTCAGTGAAGGGCCGATTCACCATCTCAAGAGACAACGCCAAGAACTCACTGTATCTGCAAATGAACAGCCTGAGAGCCGAGGACACGGCTGTGTATTACTGTGCGCGAACTAACCTCTTTGACTACTGGGGCCAGGGAACCCTGGTCACCGTCTCCTCA<br>SEQ ID NO: 29159 |
| | | AA | DIQMTQSPSSLSASVGDRVTITCRASQGIANYLAWFQQRPGKAPKSLISAASSLQSGVPSKFSGSGSGTEFTLTISSLQPEDFATYYCQQYHSYPLTFGGGSKVEIK<br>SEQ ID NO: 25154 | EVQLVESGGGLVKPGGSLRLSCAASGFTFSSYNINWVRQAPGKGLEWVSSISGNSGYIYYADSVKGRFTISRDNAKNSLYLQMNSLRAEDTAVYYCARTNLFDYWGQGTLVTVSS<br>SEQ ID NO: 29160 |

FIGURE 50
(Continued)

| | | | |
|---|---|---|---|
| iPS:403868 | 21-225_19D11 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGAATTCACTCTCACAA TCAGCAGCCTGCAGCCTGAGGATTTTGCAACT TATTACTGTCTACAGTATTATAGTTACCCGCTC ACTTTCGGCGGAGGGACCGAGGTGGAGATCA AA<br><br>SEQ ID NO: 25155 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA TTACTGGGGCTGGATCCGCCAGCCCCCGGAAG GGCTGGACTGGATTGGAGTATCTATTATAGTG GGAGCGCCAACTACAACCCGTCCCTCAAGAGTC GAGTCACCATATCCGTAGACACGTCCAAGAACC AGTTCTCCCTGAAACTGAGTTCCGTGACCGCGC AGACGCGGCTGTGTATTACTGTGCGAGACTGGAC AGGGGCTGGTCCTTGACTACTGGGGCCAGGGA ACCCTGGTCACCGTCTCCTCA<br><br>SEQ ID NO: 29161 |
| | | AA | DIQMTQSPSSLSASVGDRVTITCRASQGIRNDLG WYQQKPGKAPKRLIYATSSLQSGVPSRFSGSGSG TEFTLTISSLQPEDFATYYCLQYYSYPLTFGGGTE VEIK<br><br>SEQ ID NO: 25156 | QLQLQESGPGLVKPSETLSLTCTVSGGSISRSSYYW GWIRQPPGKGLDWIGSIYYSGSANYNPSLKSRVTIS VDTSKNQFSLKLSSVTAADAAVYYCARLDRGWSF DYWGQGTLVTVSS<br><br>SEQ ID NO: 29162 |
| iPS:403870 | 21-225_23G4 | NA | GACATCCAGATGACCCAGTCTCCATCTCCCT GTCTGCATCTGTGGGAGACAGAGTCACCATCA CTTGCCGGGCAAGTCAGAACATTTACAGCTAT TTAAATTGGTATCAGCAGAAACCTGGGAAAGC CCCTAAGCTCCTGATCTATGCTGCATCCAGTTT GCAAAGTGGGGTTCCATCAAGGTTCAGTGGCA GTGGATCTGGGACAGAATTCACTCTCACCATC AGCATTCTGCAACCTGAAGATTTTGCAACTTA CTACTGTCAACAGAGTTACAATACCCCTCCGG AGTGCAATTTTGGCCAGGGACCAAGCTGGAG ATCAAA<br><br>SEQ ID NO: 25157 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTTATGCCAT GAGCTGGGTCCGCCAGGCTCCAGGGAAGGGCT GGAGTGGGTCTCAGTTATTAGTGGTGGTGGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGGGGGA TAGTGGGAGCTACTGAGGCTTTTGATATCTGGGG CCAAGGGACAATGGTCACCGTCTCTTCA<br><br>SEQ ID NO: 29163 |

FIGURE 50
(Continued)

| | | | | |
|---|---|---|---|---|
| | | AA | DIQMTQSPSSLSASVGDRVTITCRASQNIYSYLN WYQQKPGKAPKLLIYAASSLQSGVPSRFSGSGS GTEFTLTISILQPEDFATYYCQQSYNTPPECNFGQ GTKLEIK | EVQLLESGGGLVQPGGSLRLSCAASGFTFSSYAMS WVRQAPGKGLEWVSVISGRGGSTYYADSVKGRFTI SRDNSKNTLYLQMNSLRAEDTAVYYCAKRGIVGA TEAFDIWGQGTMVTVSS |
| | | | SEQ ID NO: 25158 | SEQ ID NO: 29164 |
| iPS:403872 | 21-225_8F11 | NA | GACATCCAGATGACCCAGTCTCCATCCTCCCT GTCTGCATCTGTAGGAGACAGAGTCACCATCA CTTGCCGGGCAAGTCAGGGCATTAGGAGTGAT TTAGGCTGGTTTCAGCAGAAACCAGGGAAAGC CCCTAAGCGCCTGATCTTTGATGCATCCAGTG TGCAAAGTGGGGTCCCATCAAGGTTCAGCGGC AGTGGATCTGGGACAGAATTCACTCTCACAAT CAGCAGCCTGCAGCCTGAAGATTTTGCAATTT ATTACTGTCTACAACATTATACTTACCCGCTCA CTTTCGGCGGAGGGACCAAGGTGGAGATCAA G | CAGCTGCAGCTGCAGGAGTCGGGCCCAGGACTG GTGCAGCCTTCGGAGACCCTGTCCCTCACCTGCA CTGTCTCTGGTGTCTCCATCAGTAGGACTAGTTA CTACTGGGGCTGGCTCCGCCAGCCCCCAGGGAA GGGGCTGGAGTGGATTGGCAATATTATATAGT GGGAGCGCCTACAACAACCCGTCCCTCAAGAGT CGAGTCACCATATCCGTTGACACGTCCAAGAACC AGTTCTCCCTGAAGCTGAGTTCTGTGACCGCCGC AGACACGGCTGTGTATTACTGTGTGGGAGACATGGA CAAGACTGGGGCCTGACTACTGGGGCCAGGGA ACCCTGGTCACCGTCTCCTCA |
| | | | SEQ ID NO: 25159 | SEQ ID NO: 29165 |
| | | AA | DIQMTQSPSSLSASVGDRVTITCRASQGIRSDLG WFQQKPGKAPKRLIFDASSVQSGVPSRFSGSGSG TEFTLTISSLQPEDFAIYYCLQHYTYPLTFGGGTK VEIK | QLQLQESGPGLVQPSETLSLTCTVSGVSISRTSYYW GWLRQPPGKGLEWIGNIYYSGSAYNNPSLKSRVTIS VDTSKNQFSLKLSSVTAADTAVYYCGRHGQDWGL DYWGQGTLVTVSS |
| | | | SEQ ID NO: 25160 | SEQ ID NO: 29166 |

FIGURE 50
(Continued)

| | | | |
|---|---|---|---|
| iPS:404090 | 21-225_8D8 | NA | TCCTATGAGCTGACTCAGCCACCTCAGTGTC CGTGTCCCAGGACAGCAGCCAGTCACCT GCTCTGGAGATAAATTGGGGGAGAAATATGT TGCTGGTATCAGCAGAAGCCAGGCCAGTCCC TGTGGTGGTCATCTATCAAGATAGGAAGCGGC CCTCAGGGATCCCTGAGCGATTCTCTGGCTCC AACTCTGGGAACACAGCCACTCTGACCATCAG CGGGACCCAGGCTATAGATGAGGCTGACTATT ACTGTCAGGCGTGGGACAGCAGCACTGCGGTA TTCGGCGGAGGGACCAAGTTGACCGTCCTA<br><br>SEQ ID NO: 25161 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGCGTCTGGGTAAC TACTGGGGCCAGGGAACCCTGGTCACCGTCTCCT CA<br><br>SEQ ID NO: 29167 |
| | | AA | SYELTQPPSVSVSPGQTASITCSGDKLGEKYACW YQQKPGQSPVVVIYQDRKRPSGIPERFSGSNSGN TATLTISGTQAIDEADYYCQAWDSSTAVFGGGT KLTVL<br><br>SEQ ID NO: 25162 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARLGNYWG QGTLVTVSS<br><br>SEQ ID NO: 29168 |
| iPS:412232 | 21-225_4A2 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC AGGCTTCTGGATACACCTTCACCAATTATGATA TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGGTATCAAA<br><br>SEQ ID NO: 25163 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGATGGCACCTAACAGTGG TAACACAGGCTATGCACAGAAGTTCAGGGCAG AGTCACCTTGACCAGGAACACCTCCATAAGCACA GCCTACATGGAACTGAGCAGCCTGAGATCTGAG GACACGGCCGTGTATTACTGTGCGAGTAGCAGTG GCTGGTACTACTTGACTACTGGGGCCAGGGAAC CCTGGTCACCGTCTCCTCA<br><br>SEQ ID NO: 29169 |

FIGURE 50
(Continued)

| | | | | |
|---|---|---|---|---|
| iPS:422894 | 21-225_4A2.001 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 25164 | QVQLVQSGTEVKKPGASVKVSCKASGYTFTNYDIN WVRQATGQGLEWMGWMHPNSGNTGYAQKFQGR VTLTRNTSISTAYMELSSLRSEDTAVYYCASSSGWY YFDYWGQGTLVTVSS<br>SEQ ID NO: 29170 |
| | | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAAGGACAACTACTTAGCTTGGTTCCA GCAGAAACCAGGACAGCCTCCTAAACTGCTCC TTTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGTATCAAA<br>SEQ ID NO: 25165 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCTTGACCAGGAACACCTCCATAAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 29171 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 25166 | QVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS<br>SEQ ID NO: 29172 |

FIGURE 50
(Continued)

| | | | | |
|---|---|---|---|---|
| iPS:423018 | 21-225_31D12_LC2 | NA | TCCTATGAGCTGACTCAGCCACCCTCAGTGTC CGTGTCCCCAGGACAGACAGCCAGCATCACCT GCTCTGGAGATAAATTGGGGATAAATATGCT TACTGGTTTCAGCAGAAGCCAGGCCAGTCCCC TGTGATAGTCATCTATCAAGATAGGAAGCGGC CCTCAGGGATCCCGAGCGATTCTCTGGCTCC AACTCTGGGAACACAGCCACTCTGACCATCAG CGGGACGCAGGCTATGGATGAGGCTGACTATT ACTGTCAGGCGTGGGACAACAGCACTGCGGTA TTCGGCGGAGGGACCAAGCTGACCGTCCTA | CAGGTGAAGCTGGTGCAGTCTGGGGCTGAGGTG AAGAAGCCTGGGGCCTCAGTGAAGGTCTCCTGC AAGGCTTCAGGATACACCTTCACGGCTACTATA TGCACTGGGTGCGACAGGCCCCTGGACAAGGGC TTGAGTGGATGGGATGGATCAACCCTAACAGTGG TGGCACAAACTATGTACAGGAGACACGTCCAGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGTTCGGGGAGTTATTATAACGAGTTG ACTACTGGGGCCAGGGAACCCTGGTCACCGTCTC CTCA |
| | | | SEQ ID NO: 25167 | SEQ ID NO: 29173 |
| | | AA | SYELTQPPSVSVSPGQTASITCSGDKLGDKYAY WFQQKPGQSPVIVIYQDRKRPSGIPERFSGSNSG NTATLTISGTQAMDEADYYCQAWDNSTAVFGG GTKLTVL | QVKLVQSGAEVKKPGASVKVSCKASGYTFTGYYM HWVRQAPGQGLEWMGWINPNSGGTNYVQKFQGR VTMTRDTSISTAYMELSRLRSDDTAVYYCARVYYY GSGSYYNEFDYWGQGTLVTVSS |
| | | | SEQ ID NO: 25168 | SEQ ID NO: 29174 |
| iPS:423019 | 21-225_31D12_LC1 | NA | GATGTTGTGATGACTCAGTCTCCACTCTCCCTG CCCGTCACCCTTGGACAGCCGGCCTCCATCTC CTGCAGGTCTAGTCAAAGCCTCATATACAGTG ATGGAAACACCTTCTTGAATTGGTTTCAGCAG AGGCCAGGCCAATCTCCAAGGCGCCTAATTTA AAGGTTTCTAATTGGGACTCTGGGGTCCCAG ACAGATTCAGCGGCAGTGGGTCAGGCACTGAT TTCACACTGAAAATCAGCAGGTTGGAGGCTGA GGATGTTGGGGATTATTACTGCATGCAAGGTA CACACTGCCTCTCACCTTCGGCCAAGGGACA CGACTGGAGATTAAA | CAGGTGAAGCTGGTGCAGTCTGGGGCTGAGGTG AAGAAGCCTGGGGCCTCAGTGAAGGTCTCCTGC AAGGCTTCAGGATACACCTTCACGGCTACTATA TGCACTGGGTGCGACAGGCCCCTGGACAAGGGC TTGAGTGGATGGGATGGATCAACCCTAACAGTGG TGGCACAAACTATGTACAGGAGACACGTCCAGGCAG GGTCACCATGACCAGGGACACGTCCATCAGCAC AGCCTACATGGAGCTGAGCAGGCTGAGATCTGA CGACACGGCCGTGTATTACTGTGCGAGAGTGTAT TACTATGTTCGGGGAGTTATTATAACGAGTTG ACTACTGGGGCCAGGGAACCCTGGTCACCGTCTC CTCA |
| | | | SEQ ID NO: 25169 | SEQ ID NO: 29175 |

FIGURE 50
(Continued)

| | | | |
|---|---|---|---|
| iPS:423314 | 21-225_12F11 | AA | DVVMTQSPLSLPVTLGQPASISCRSSQSLIYSDGN TFLNWFQQRPGQSPRRLIYKVSNWDSGVPDRFS GSGSGTDFTLKISRLEAEDVGIYYCMQGTHWPL TFGQGTRLEIK |
| | | | SEQ ID NO: 25170 |
| | | | QVKLVQSGAEVKKPGASVKVSCKASGYTFTGYM HWVRQAPGQGLEWMGWINPNSGGTNYVQKFQGR VTMTRDTSISTAYMELSRLRSDDTAVYYCARVYYY GSGSYYNEFDYWGQGTLVTVSS |
| | | | SEQ ID NO: 29176 |
| | | NA | GACATCGTGATGACCCAGTCTCCAGACTCCCT GGCTGTGTCTCTGGGCGAGAGGGCCACCATCA ATTGCAAGTCCAGCCAGAGTGTTTACACAGC TCCAACAATTATAACTACTTAGCTTGGTACCA GCAGAAACCAGGACAGCCTCCTAACTGCTCA TTTTCTGGGCATCTACCCCGGAATCCGGGGTC CCTGACCGATTCAGTGGCAGTGGGTTTGGGAC AGATTTCACTCTCAACATCAGCAGCCTGCAGG CTGAAGATGTGGCAGTTTATTACTGTCAGCAA TATTATGATAGTCCATTCACTTTCGGCCCTGGG ACCAAAGTGGATATCAAA |
| | | | SEQ ID NO: 25171 |
| | | | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC CTGAGTGGATGGGATGGATGCACCCTAACAGTG GTAACACAGGCTATGCAAAGAAGTTCCAGGCA GAGTCACCATGACCAGGAACACCTCCATAAGCG CAGCCTATATGGTTCTGAGCAGCCTGAGATCTGA GGACACGGCCGTGTATTACTGTGCGCTTAGCAGT GGCTGGTACTACTTTGACTACTGGGGCCAGGAA CCCTGGTCACCGTCCTCCTCA |
| | | | SEQ ID NO: 29177 |
| | | AA | DIVMTQSPDSLAVSLGERATINCKSSQSVLHSSN NYNYLAWYQQKPGQPPNLLIFWASTRESGVPDR FSGSGFGTDFTLNISSLQAEDVAVYYCQQYYDTP FTFGPGTKVDIK |
| | | | SEQ ID NO: 25172 |
| | | | QVQLVQSGAEVKKPGASVKVSCKASGYTFTNYDIN WVRQATGQPEWMGWMHPNSGNTGYAKKFQGR VTMTRNTSISAAYMVLSSLRSEDTAVYYCALSSGW YYFDYWGQGTLVTVSS |
| | | | SEQ ID NO: 29178 |

FIGURE 50
(Continued)

| | | | |
|---|---|---|---|
| iPS:424419 | 21-225_25A4.001 | NA | GACATGTGATGACCCAGTTCCAGACTCCCT GGCTGTGTCTCTGGGCGACAGAGGGCCACCATCA AGTGTAAGTCCAGCCAGAGTGTTTATACAGC TCCCACAATAACAACTACTTAGCTTGTACCA GCAGAAACCAGGACAGCCTCCTAAGTTGCTCC TTTACTGGGCATCTACCCGGAATCCGGGGTC CCTGACCGATTCAGTGGCAGCGGGTCTGGGAC AGAATTCACTCTCACCATCAGCAGCCTGAAGG CTGAAGATGTGGCAGTTTATTACTGTCAGCAG TATTATAGTACTCCTCCGACGTTCGGCCAAGG GACCAAGGTGGAAATCAAA<br><br>SEQ ID NO: 25173 | CAGGTGCTCCTGGTGCAGTCTGGGGCTGAGGTGA AGAGGCCTGGGGCCTCAGTGAAGGTCTCTGCA AGGCTTCTGGATACACCTTCACCAATTATGATAT TAATTGGGTGCGACAGGCCACTGGACAAGGCT TGAGTGGATGGGATGGATGTACCCTAACAGTGGT AACACAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br><br>SEQ ID NO: 29179 |
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK<br><br>SEQ ID NO: 25174 | QVLLVQSGAEVKRPGASVKVSCKASGYTFTNYDIN WVRQATGQGLEWMGWMYPNSGNTGYAQKFQGR VTMTRDTSISTAYMELSSLRSEDTAVYYCASSSGW YYFDYWGQGTLVTVSS<br><br>SEQ ID NO: 29180 |
| iPS:424460 | 21-225_7E11.001 | NA | GACATCCAGATGACCCAGTCTCCATCCTCCCT GTCTGCATCTGTAGGAGACAGAGTCACCATCG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGCGGGACCAAGGTGGAGATCA AA<br><br>SEQ ID NO: 25175 | CAGGTGCAGCTGGTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br><br>SEQ ID NO: 29181 |

FIGURE 50
(Continued)

| | | | | |
|---|---|---|---|---|
| iPS:426108 | 21-225_10G6 | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 25176 | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS<br>SEQ ID NO: 29182 |
| | | NA | GACATCCAGATGACCCAGTCTCCATCTTCCGT GTCTGCATCTGTGGGAGACAGAGTCACCATCA CTTGTCGGGCGAGTCAGGGTATTAGCAAATGG TTAGCCTGGTATCAGCAGAAACCAGGGAAAG CCCCTAAGATCCTGATATATGCTGCATATAGT TTACAAAGTGGGGTCCCAGCAAGGTTCAGCGG CAGTGGATCTGGGACAGATTTCACTCTCACCA TCAGGAGCCTGCAGCCTGAAGATTTTGCAACT TACTATTGTCAACAAACTTACAGTTTCCCATTC ACTTTCGGCCCTGGGACCAAAGTGGATATCAA A<br>SEQ ID NO: 25177 | CAGGTGCAGCTGGTGCAGTCTGGGGCTGAGGTG AAGAAGCCTGGGGCTCAGTGAAGGTCTCTGC AAGGCTTCTGGATACACCTTCACCGCCTACCATA TGCACTGGGTGCGACAGGCCCCTGGACAAGGAC TTGAGTGGATGGGATGGATCAACAGAAGTTTCAGGGCAG TGGCACAAACTATGCACAGGGACAGTCCATCAGCAC GGTCACCATGACCAGGGACACGTCCATCAGCAC AGCCTACATGGAGCTGAGCAGGCTGAGATCTGA CGACACGGCCGTTTATTACTGTGGGAGAGATGTT ACCAGCTCGTTTGACTATTGGGGCCAGGGAACCC TGGTCACCGTCTCCTCA<br>SEQ ID NO: 29183 |
| | | AA | DIQMTQSPSSVSASVGDRVTITCRASQGISKWLA WYQQKPGKAPKILIYAAYSLQSGVPARFSGSGS GTDFTLTIRSLQPEDFATYYCQQANSFPFTFGPGT KVDIK<br>SEQ ID NO: 25178 | QVQLVQSGAEVKKPGASVKVSCKASGYTFTAYHM HWVRQAPGQGLEWMGWINPNNNGTNYAQKFQGR VTMTRDTSISTAYMELSRLRSDDTAVYYCGRDVTS SFDYWGQGTLVTVSS<br>SEQ ID NO: 29184 |

FIGURE 50
(Continued)

| | | | |
|---|---|---|---|
| iPS:426110 | 21-225_12E9 | NA | GACATCCAGATGACCCAGTCTCCATCTTCCGT GTCTGCATCTGTAAGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATGCTGCATCCAGT TTGCAAAGTGGGGTCCCATCAAGGTTCAGCGG CAGTGGATCTGGGACAGATTTCACTCTCACCA TCAGCAGCCTGCAGCCTGAAGATTTTGCAACT TACTATTGTCAACAGGCTAACAGTTTCCCATTC ACTTTCGGCCCTGGGACCAAAGTGGATATCAA A <br> SEQ ID NO: 25179 | CAGGTGCAGCTGGTACAGTCTGGGGCTGAGGTG AAGAAGCCTGGGGCCTCAGTGAAGGTCTCCTGC AAGGCTTCTGGATACACCTTCACCGACTACTATT TGCACTGGGTGCGACAGGCCCCTGGACAAGGTCT TGAGTGGATGGGATGGGTCCACCCTAACAGTGGT GGCACAAACTTGCACAGAAGTTCAGGACAGG GTCACCATGACCAGGGACACGTCCATCAGCACA GCCTACATGGAGCTGAGCAGCCTGAGATCTGAC GACACGGCCATATATTCCTGTGCGGAGATGGTA CCAGCTCGTTTGACTACTGGGGCCAGGGAACCCT GGTCACCGTCTCCTCA <br> SEQ ID NO: 29185 |
| | | AA | DIQMTQSPSSVSASVRDRVTITCRASQGISSWLA WYQQKPGEAPKLLIYAASRLQSGVPSRFSGSGS GTDFTLTISSLQPEDFATYCQQANSFPFTFGPGT KVDIK <br> SEQ ID NO: 25180 | QVQLVQSGAEVKKPGASVKVSCKASGYTFTDYYL HWVRQAPGQGLEWMGWVHPNSGGTNFAQKFQD RVTMTRDTSISTAYMELSSLRSDDTAIYSCARDGTS SFDYWGQGTLVTVSS <br> SEQ ID NO: 29186 |
| iPS:426112 | 21-225_12F12 | NA | GACATCGTGATGACCCAGTCTCCAGACTCCCT GGCTGTGTCTCTGGGCGAGAGGGCCACCATCA ACTGCAAGTCCAGCCAGAGTGTTTATTCAGC TCCAACATAACCAGGAACAACCTCTAACCTCTCA GCAGAAACCAGGACAGCCTCCTAAGCTCCTCA TTTACTGGGCATCTACCCGGGACATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTAGTCCGTGGACGTTCGGCCAAGG GACCAAGGTGGAAATCAAA <br> SEQ ID NO: 25181 | CAGGTGCAGCTGCTGCAGTCTGGGGCTGAGGTG AAGAAGCCTGGGGCCTCAGTGAAGGTCTCCTGC AAGGCTTCGGATACACCTTCACCAATTATGATA TCAACTGGGTGCGACAGGCCACTGGACAAGGGC TTGAGTGGATGGGATGGATGCACAGAAGTTCAGGGCAG TAACACGGGCTATGCACCATGAACACCTCCATAAGCACA AGTCACCATGGAGTTGAGCAGCCTGAGATCTGAG GCCTACATGGAGTTGAGCAGCCTGTGCGATGAGCAGTG GACACGGCCGTGTACTTTGACTTCTGGGGCCAGGAAC CCTGGTCACCGTCTCCTCA <br> SEQ ID NO: 29187 |

FIGURE 50
(Continued)

| | | | |
|---|---|---|---|
| iPS:426114 | 21-225_28H2 | AA | DIVMTQSPDSLAVSLGERATINCKSSQTVLFSSN NNHYLAWYQQKPGQPPNLLIYWASTRASGVPD RFSGSGSGTDFTLTISSLQAEDVAVYYCQQYYSS PWTFGQGTKVEIK<br>SEQ ID NO: 25182 | QVQLLQSGAEVKKPGASVKVSCKASGYTFTNYDIN WVRQATGQGLEWMGWMYPNSGNTGYAQKFQGR VTMTMNTSISTAYMELSSLRSEDTAVYYCAMSSG WYYFDFWGQGTLVTVSS<br>SEQ ID NO: 29188 |
| | | NA | GACATCCAGATGACCCAGTCTCCTTCCCT GTCTGCATCTATAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATTTATGCTGCATCCAGTT TGCAAAGTGGGGTCCCATCAAGGTTCAGCGGC AGTGGATCTGGGACAGAGCCTGAAGAATTCACTCTCACAAT CAGCAGCCTGCAGCCTGAAGATTTTGCAACTT ATTACTGTCTACAACATTATAGTTACCCTCGCA GTTTTGGCCAGGGGACCAAGCTGGAGATCAAA<br>SEQ ID NO: 25183 | CAGGTGCAGCTGTTGGTGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATATGCAGACTCCGTGAAGGGCCGA AATAAGTACTATGCAGACTCCGTGAAGGGCCGA TTCACCATCTCCAGAGACAATTCCAAGAACACGC TGTATCTACAAATGAACAGCCTGAGAGCCGTGG ACACGGCTGTGTATTACTGTGCGAGAGAGGAGTA TAGCAGTGGCTGGTACGACTACGGTATGGACGTC TGGGGCCAAGGGACCACGGTCACCGTCTCCTCA<br>SEQ ID NO: 29189 |
| | | AA | DIQMTQSPSSLSASIGDRVTITCRASQGIRNDLG WYQQKPGKAPKRLIYAASSLQSGVPSRFSGSGS GTEFTLTISSLQPEDFATYYCLQHYSYPRSFGQG TKLEIK<br>SEQ ID NO: 25184 | QVQLVESGGGVVQPGRSLRLSCAASGFTFSNYM HWVRQAPGKGLEWVAVIWYDGSNKYYADSVKGR FTISRDNSKNTLYLQMNSLRAVDTAVYYCAREEYS SGWYDYGMDVWGQGTTVTVSS<br>SEQ ID NO: 29190 |

FIGURE 50
(Continued)

| | | | |
|---|---|---|---|
| iPS:426116 | 21-225_29E2 | NA | GACATCCAGATGACCCAGTCTCCATCTCCCTGTCTGCATCTGTAGGAGACAGAGTCACCATCACTTGCCGGGCAAGTCAGGCCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATTTATTCTCACAATCAGCAGCCTGCAGCCTGAAGATTTTGCAACTTATTACTGTTTACAGCATTATAATTACCCTCGCAGTTTTGGCCAGGGGACCAAGCTGGAGATCAA A | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTGTGTCATGCACTGGGTCCGCCAGGTCCAGGCAAGGGCTGGAGTGGGTGGCAGTTATATGGTATGATGAAGTAATAAATACTATGCAGACTCCGTGAAGGCCGAATCACCATCTCCAGAGACAATTCCAAGAACACGCTGTATCTGCAAATGAACAGCCTGAGAGCCGAGGACACGGCTGTGTATTACTGTGCGAGAGAGGAGTATAGCAGTGGCTGGTACGACTACGGTATGACGTCTGGGGCCAAGGGACCACGGTCACCGTCTCCTCA |
| | | | SEQ ID NO: 25185 |
| | | AA | DIQMTQSPSSLSASVGDRVTITCRASQAIRNDLGWYQQRPGKAPKRLIYAASSLQSGVPSRFSGSGSGTEFILTISSLQPEDFATYYCLQHYNYPRSFGQGTKLEIK | QVQLVESGGGVVQPGRSLRLSCAASGFTFSNCVMHWVRQAPGKGLEWVAVIWYDGSNKYYADSVKGRITISRDNSKNTLYLQMNSLRAEDTAVYYCAREEYSSGWYDYGMDVWGQGTTVTVSS |
| | | | SEQ ID NO: 25186 | SEQ ID NO: 29191 |
| iPS:426118 | 21-225_7A10 | NA | GACATCCAGATGACCCAGTCTCCATCTCCCTGTCTGCATCTGTAGGAGACAGAGTCACCATCACTTGCCGGGCAAGTCAGAGCATTACAGCTATTTAAATTGGTATCAGCAGAAACCAGGGAGAGCCCCTAAACTCGTGATCTATTCTACATCCAGTTTGCAAAGTGGGGTCCCATCAAGGTTCAGTGGCAGTGGATCTGGGACAGATTTCAGTCTCACCATCAGCAATCTGCAACTTACAGTTACATTTCAACTTACTACTGTCTAACAGAGTTACAGTGTCCCCCTCACTTTCGGCGGAGGGACCAAGGTGGAGATCA GA | CAGGTGCAGCTGGTGGAGTCTGGGGGAGGCGTGGTCCAGCCTGGGAGGTCCCTGAGACTCTCCTGTGCAGCGTCTGGATTCAACTTCAGTAGCTATGGCATGCACTGGGTCCGCCAGGTCCAGGCAAGGGCTGGAGTGGATGGCAGTTATATGGTATGATGAAGTAATAAATACTATGCAGACTCCGTGAAGGCCGAGATTCACCATCTCCAGAGACAATTCCAAGAACACGCTGTATCTGCAAATGCACAGCCTGAGAGCCGAGGACACGGCTGTGTATTACTGTGCGAGAGATGAAGGCTGGGGATTTTGACTACTGGGGCCAGGGAACCCTGGTCACCGTCTCCTCA |
| | | | SEQ ID NO: 25187 | SEQ ID NO: 29193 |

FIGURE 50
(Continued)

| | | | | |
|---|---|---|---|---|
| iPS:426124 | 21-225_32D6 | AA | DIQMTQSPSSLSASVGDRVTITCRASQNIYSYLN WYQQKPGRAPKLVIYSTSSLQSGVPSRFSGSGSG TDFSLTISNLQPEDFSTYYCQQSYSPPLTFGGGTK VEIR | QVQLVESGGGVVQPGRSLRLSCAASGFNFSSYGMH WVRQAPGKGLEWMAVIWYDGSNKYYADSVKGRF TISRDNSKNTLYLQMHSLRAEDTAVYYCARDERLG IFDYWGQGTLVTVSS |
| | | | SEQ ID NO: 25188 | SEQ ID NO: 29194 |
| | | NA | GACATCCAGATGACCCAGTCTCCATCCTCCCT GTCTACATCTGTAGGAGACAGAGTCACCATCA CTTGCCGGGCAAGTCAGAACATTATCAGTAT TTAAATTGGTATCAGCAGAAACCAGGGAAAG CCCCTAAGCTCCTGATGTATGTTGCATCCGTT TGCAAAGTGGGGTCCCATCAAGGTTCAGTGGC AGTGGATCTGGGACAGATTTCACTCTCACCAT CAGCAGTCTGCAAGCTGAAGATTTTGCAACTT ACTACTGTCAACAGAGTTACAGTACCCCGTAC ACTTTCGGCGGAGGGACCAAGGTGGAGATCA AA | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGACT GGAGTGGGTGGACAGTTATATGCATGATGAAG TAATGCATACTATGCAGATTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAATAG CAGCTCGTACTACTTTGACTACTGGGGCCAGGGA ACCCTGGTCACCGTCTCCTCA |
| | | | SEQ ID NO: 25189 | SEQ ID NO: 29195 |
| | | AA | DIQMTQSPSSLSTSVGDRVTITCRASQNIISYLNW YQQKPGKAPKLLMYVASRLQSGVPSRFSGSGSG TDFTLTISSLQAEDFATYYCQQSYSTPYTFGGGT KVAIK | QVQLVESGGGVVQPGRSLRLSCAASGFTFSSYGMH WVRQAPGKGLEWVTVIWHDGSNAYYADSVKGRF TISRDNSKNTLYLQMNSLRAEDTAVYYCARENSSS YYFDYWGQGTLVTVSS |
| | | | SEQ ID NO: 25190 | SEQ ID NO: 29196 |

FIGURE 50
(Continued)

| | | | |
|---|---|---|---|
| iPS:426126 | 21-225_6G6 | NA | GACATGTGATGACCCAGTCTCCAGACTCCCT GGCTGTGTCTCTGGGCGAGAGGGCCACCATCA ATTGCAAGTCCAGCAGTGTTTACACAAC TCCAACAATTATAACTATTAGCTTGGTACCA GCAGAAACCAGGACAGCCTCCTAACCTGCTCA TTTTCTGGGCATCTACCCGGGAATCCGGGTC CCTGACCGATTCAGTGGCAGCGGGTTTGGGAC AGATTTCACTCTCAACATCAGCAGCCTGCAGG CTGAAGATGTGGCAGTTTATTACTGTCAGCAA TATTATGATACTCCATTCACTTTCGGCCATGGG ACCAAAGTGGATATCAAA<br><br>SEQ ID NO: 25191 |
| | | AA | DIVMTQSPDSLAVSLGERATINCKSSQSVLHNSN NYNYLAWYQQKPGQPPNLLIFWASTRESGVPDR FSGSGFGTDFTLNISSLQAEDVAVYYCQQYYDTP FTFGHGTKVDIK<br><br>SEQ ID NO: 25192 |
| | | NA | CAGGTGCAGCTGGTGCAGTCTGGGGCTGAGGTG AGGAAGCCTGGGGCCTCAGTGAAGGTCTCCTGC AAGGCTTCTGGATACACCTTCACCAATTATGATA TCAACTGGGTGCGACAGGCCACTGGACAAGGGC CTGAGTGGATGGATGGATGCACCTAACAGTG GTAACACAGGCTATGCAAAGAAGTTCCAGGCA GAGTCACCATGACCAGGAACACCTCATAAGCG CAGCCTATATGGTTCTGAGCAGCTGAGATCTGA GGACACGGCCGTGTATTACTGTGCGCTTAGCAGT GGCTGGTACTACTTTGACTACTGGGGCCAGGGAA CCCTGGTCACCGTCTCCTCA<br><br>SEQ ID NO: 29197 |
| iPS:433895 | 21-225_43E1 | AA | QVQLVQSGAEVRKPGASVKVSCKASGYTFTNYDIN WVRQATGQGPEWMGWMHPNSGNTGYAKKFQGR VTMTRNTSISAAYMVLSSLRSEDTAVYYCALSSGW YYFDYWGQGTLVTVSS<br><br>SEQ ID NO: 29198 |
| | | NA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCCGCCATTAGTAGTGGTAATAGTACT TACATATACTCCAGAGACTCGTTGAAGGGCCGAT TCACCATCTCCAGAGACAACGCCAAGAACTCACT GTTTCTGCAACTGAACAGCCTGAGAGCCGAGGA CACGGCTGTTTATTACTGTGCGAGAGATCGGGGC AGTGAATGGGGCCAGGGAACCCTGGTCACCGTC TCCTCA<br><br>SEQ ID NO: 29199 |

FIGURE 50
(Continued)

| | | | |
|---|---|---|---|
| iPS:433897 | 21-225_43C2 | AA | DIQMTQSPSSLSASVGDRVTITCRASQGIRNDLG WYQKKPGKAPKRLINAASSLQSGVPSRFSGSGS GTEFTLTISSLQPEDFATYYCLQHNSYPFTFGPGT KVDIK<br>SEQ ID NO: 25194 | EVQLVESGGGLVKPGGSLRLSCAASGFTFSSYSMN WVRQAPGKGLEWVSAISGNSTYIYYADSLKGRFTI SRDNAKNSLFLQLNSLRAEDTAVYYCARDRGSEW GQGTLVTVSS<br>SEQ ID NO: 29200 |
| | | NA | GACATCCAGATGACCCAGTCTCCATCTTCCGT GTCTGCATCTGTAGGAGACAGAGTCACCATCA CTTGTCGGGCGAGTCAGGGTATTAGCGACTGG TTAGCCTGGTATCAGCAGAAACCAGGGAAAG CCCCTAGGCTCCTGATCTATGCTGCATCCAGTT TGCAAAGTGGGGTCCCATCAAGGTTCAGCGGC AGTGGATCTGGGACAGATTTCACTCTCACCAT CAGCAACCTGCAGCCTGAAGATTTTGCAACTT ACTATTGTCAACAGCACTAACAGTTTCCCGTGG ACGTTCGGCCAAGGGACCAAGGTGGAAATCA AA<br>SEQ ID NO: 25195 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGTT AACACATTCGACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAC CCTGGTCACCGTCTCCTCA<br>SEQ ID NO: 29201 |
| | | AA | DIQMTQSPSSVSASVGDRVTITCRASQGISDWLA WYQQKPGKAPRLLIYAASSLQSGVPSRFSGSGSG TDFTLTISNLQPEDFATYYCQQTNSFPWTFGQGT KVEIK<br>SEQ ID NO: 25196 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS<br>SEQ ID NO: 29202 |

FIGURE 50
(Continued)

| | | | | |
|---|---|---|---|---|
| iPS:433899 | 21-225_43C3 | NA | GACATCCAGATGACCCAGTCTCCATCCTCCCT<br>GTCTGCATCTGTAGGAGACAGAGTCACCATCA<br>CTTGCCGGGCAAGTCAGGGCATTAGAAATGAT<br>TTAGGCTGGTATCAGCAGAAACCAGGGAAAG<br>CCCCTAAGCGCCTGATCTATGCTGCATCCAGT<br>TTGCAAAGTGGGGTCCCATCAAGGTTCAGCGG<br>CAGTGGATCTGGGACAGAATTCACTCTCACAA<br>TCAGCAGCCTGCAGCCTGAAGATTTTGCAACT<br>TATTACTGTCTACAGCATAATAGTTACCCTCTC<br>ACTTTCGGCGGAGGGACCAAGGTGGGGATCA<br>CA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTAGTATGGCAT<br>ACACTGGGTCCGCCAGGCTCCAGGCAAGGGGCT<br>GGAGTGGGTGGCAGTTATATGCAGACTCCGTGAAGGGCCGA<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGAGTAGG<br>ATTTTCCAATGACTACTGGGGCCAGGGAACCCTG<br>GTCACCGTCTCCTCA |
| | | | SEQ ID NO: 25197 | SEQ ID NO: 29203 |
| | | AA | DIQMTQSPSSLSASVGDRVTITCRASQGIRNDLG<br>WYQQKPGKAPKRLIYAASSLQSGVPSRFSGSGS<br>GTEFTLTISSLQPEDFATYYCLQHNSYPLTFGGG<br>TKVGIT | QVQLVESGGGVVQPGRSLRLSCAASGFTFSSYGIH<br>WVRQAPGKGLEWVAVIWYDENNKYYADSVKGRF<br>TISRDNSKNTLYLQMNSLRAEDTAVYYCARELGFS<br>NDYWGQGTLVTVSS |
| | | | SEQ ID NO: 25198 | SEQ ID NO: 29204 |
| iPS:433901 | 21-225_43A4 | NA | GACATCCAGATGACCCAGTCTCCATCCTCACT<br>GTCTGCATCTGTAGGAGACAGAGTCACCATCA<br>CTTGTCGGGCGAGTCAGGGCATTAGCAGTAAT<br>TTAGCCTGGTTTCAGCAGAAACCAGGGAAAGC<br>CCCTAAGTCCCTGATCAATGCTGCATCCAGTTT<br>GCAAAGTGGGGTCCCATCAAGGTTCAGCGGCA<br>GTGGATCTGGGACAGATTTCACTCTCGCCATC<br>AGCAGCCTACAGCCTGAAGATTTTGCAACTTA<br>TTACTGCCAACAGTATTATAGTTACCATTCAC<br>TTTCGGCCCTGGGACCAAAGTGGATATCAAA | GAGGTGCAGCTGGTGGAGTCTGGGGGAGGCTG<br>GTCAAGCCGGGGGGGTCCCTGAGACTCTCTGTG<br>CAGCCTCTGGATTCACCTTCAGTAGCTATACCAT<br>GAACTGGGTCCGCCAGGTTCCAGGGAAGGGGCT<br>GGAGTGGGTCTCATCCATTAGTGGAAGTAGTACT<br>TACATATACTACGCAGACTCAGTGAAGGGCCGAT<br>TCACCATCTCCAGAGACGACGCCAGAACTCACT<br>GTATCTGCAAATGAACAGCCTGAGAGGCGAGGA<br>CACGGCTGTGTATTACTGTGCGAGAGGTGACCTCT<br>TTGACTACTGGGGCCAGGGAGCCCTGGTCACCG<br>TCTCCTCA |
| | | | SEQ ID NO: 25199 | SEQ ID NO: 29205 |

FIGURE 50
(Continued)

| | | | | |
|---|---|---|---|---|
| iPS:433903 | 21-225_43H4 | AA | DIQMTQSPSSLSASVGDRVTITCRASQGINNYLA WFQQKPGKAPKSLINAASSLQSGVPSRFSGSGSG TDFTLAISSLQPEDFATYYCQQYSYPFTFGPGT KVDIK<br><br>SEQ ID NO: 25200 | EVQLVESGGGLVKPGGSLRLSCAASGFTFSSYTMN WVRQVPGKGLEWVSSISGSSTYYYADSVKGRFTIS RDDAQNSLYLQMNSLRGEDTAVYYCARVTSFDY WGQGALVTVSS<br><br>SEQ ID NO: 29206 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGCTA TTAGCCTGGTATCAACAGAAACCAGGAAAG CCCCTAAGCTCCTGATCTATGCTGCATCCAGTT TGCAAAGTGGTGGTCCCATCAAGGTTCAGCGGC AGTGGATCTGGGACAGATTTCACTCTCACCAT CAGCAACCTGCAGCCTGAAGATTTTGCAACTT ACTATTGTCAACAGACTAACAGTTTCCCGTGG ACGTTCGGCCAAGGGACCAAGGTGGAAATCA AA<br><br>SEQ ID NO: 25201 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAC CCTGGTCACCGTCTCCTCA<br><br>SEQ ID NO: 29207 |
| | | AA | DIQMTQSPSSVSASVGDRVTITCRASQGIINWLA WYQQKPGKAPKLLIYAASSLQSGVPSRFSGSGS GTDFTLTISNLQPEDFATYYCQQTNSFPWTFGQG TKVEIK<br><br>SEQ ID NO: 25202 | EVQLLESGGGLVQPGGSLRLSCAASGFTFSSYAMS WVRQAPGKGLEWVSAISGRGINTFDADSVKGRFTI SRDNSKNTLYLQMNSLRAEDTAVYYCAKERSGSY FDYWGQGTLVTVSS<br><br>SEQ ID NO: 29208 |

FIGURE 50
(Continued)

| | | | |
|---|---|---|---|
| iPS:433905 | 21-225_43E5 | NA | GACATCCAGATGACCCAGTCTCCATCCTCCT GTCTGCATCTGTAGGAGACAGAGTCACCATCA CTTGCCGGGCAAGTCAGGGACATTAGAAATGAT TTAGGCTGGTATCAGCAGAAACCAGGGAAAG CCCCTAAGCGCCTGATCTATGGTGCATCCAAT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTACAGCATACTAGTTTCCCATTC ACTTTCGGCCCTGGGACCAAAGTGGATATCAA A SEQ ID NO: 25203 | CAGGTGCAGCTGGTGGAGTCTGGGGGAGGCTTG GTCAAGCCTGGAGGGTCCCTGAGACTCTCCTGTG CAGCCCTCTGGATTCACCTTCAGTGACTACTACAT GATCTGGATCCGCCAGGCTCCAGGGAAGGGGCT GGAGTGGGTTTCATACATTAGTAGTAGTGGTATT ACCAAATACTACGCAGACTCTATGAAGGGCCGA TTCACCATCTCCAGGGACAACGCCAAGAACTCAC TGTATCTGCAAATGAACAGCCTGAGAGCCGAGG ACACGGCCGTGTATTACTGTGCGCGATACAAT CTACTGGGGCCAGGGAACCCTGGTCACCGTCTCC TCA SEQ ID NO: 29209 |
| | | AA | DIQMTQSPSSLSASVGDRVTITCRASQGIRNDLG WYQQKPGKAPKRLIYGASNLQSGVPSRFSGSGS GTEFTLTVSSLQPEDFATYFCLQHTSFPFTFGPGT KVDIK SEQ ID NO: 25204 | QVQLVESGGGLVKPGGSLRLSCAASGFTFSDYYMI WIRQAPGKGLEWVSYISSSGITKYYADSMKGRFTIS RDNAKNSLYLQMNSLRAEDTAVYYCAADTIYWGQ GTLVTVSS SEQ ID NO: 29210 |
| iPS:433909 | 21-225_43D8 | NA | GACATCGTGATGACCCAGTCTCCAGACTCCCT GGCTGTGTCTCTGGGCGAGAGGGCCACCATCA ACTGCAAGTCCAGCAGGGTGTTTAATGACC TCCAACGATAAGAACTACTTAACTTGGTACCA GCAGAGACCAGGACAGCCTCCTAAGCTGCTCA TTTACTGGGCTTCTACCCGGGAATCCGGGGTC CCTGACCGATTCAGTGGCGGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAG SEQ ID NO: 25205 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAACAGTGG TAACACAGGCTATGCACAGAAGTTCAGGGCAG AGTCACCATGACCAGGAACACCTCCATAAGCAC AGCCTACATGGAGCTGAGCAGCCTGACATTGA GGACACGGCCGTGTATTACTGTGCCCATAGCAGT GGCTGGGACCCTCTTTGACTACTGGGGCCAGGAA CCCTGGTCACCGTCTCCGCA SEQ ID NO: 29211 |

FIGURE 50
(Continued)

| | | | |
|---|---|---|---|
| iPS:433911 | | AA | DIVMTQSPDSLAVSLGERATINCKSSQSVLMTSN DKNYLTWYQQRPGQPPKLLIYWASTRESGVPDR FSGGGSGTDFTLTISGLQAEDVAVYYCQQYYST PPTFGQGTKVEIK<br>SEQ ID NO: 25206 | QVQLVQSGAEVKKPGASVKVSCKASGYTFTNYDIN WVRQATGQGLEWMGWMHPNSGNTGYAQKFQGR VTMTRNTSISTAYMELSSLTSEDTAVYYCAHSSGW TLFDYWGQGTLVTVSA<br>SEQ ID NO: 29212 |
| | 21-225_43E8 | NA | GACATCCAGATGAACCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAGAG CCCCTAAGCTCCTGATCTATGCTGCATCCAGTT TGCAAAGTGGGGTCCCTTCAAGGTTCAGCGGC AGTGGATCTGGGACAGATTTCACTCTCACCAT CAGCAACCTGCAGCCTGAAGATTTTGCAACTT ACTATTGTCAACAGACTAACAGTTTCCCGTGG ACGTTCGGCCAAGGGACCAAGGTGGAAATCA AA<br>SEQ ID NO: 25207 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAC CCTGGTCACCGTCTCCTCA<br>SEQ ID NO: 29213 |
| | | AA | DIQMNQSPSSVSASVGDRVTITCRASQGISNWLA WYQQKPGRAPKLLIYAASSLQSGVPSRFSGSGSG TDFTLTISNLQPEDFATYYCQQTNSFPWTFGQGT KVEIK<br>SEQ ID NO: 25208 | EVQLLESGGGLVQPGGSLRLSCAASGFTFSSYAMS WVRQAPGKGLEWVSAISRGRGINTFDADSVKGRFTI SRDNSKNTLYLQMNSLRAEDTAVYYCAKERSGSY FDYWGQGTLVTVSS<br>SEQ ID NO: 29214 |

FIGURE 50
(Continued)

| | | | |
|---|---|---|---|
| iPS:433913 | 21-225_43H8 | NA | GACATCCAAATGACCCAGTCTCCATCCTCCCT GTCTGCATCTGTAGGAGACAGAGTCACCATCA CTTGCCGGGCAAGTCAGGCATTAGAAATGAT TTAGGCTGGCATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCAA TCAGCAGCCTGCAGCTGAAGATTTTGCAACT TATTACTGTCTACAGCATAATAGTTTCCCATTC ACTTTCGGCCCTGGGACCAAAGTGGATATCAA A<br>SEQ ID NO: 25209 | CAGGTGCAGCTGGTGGAGTCTGGGGGAGGCTTG GTCAAGCCTGGAGGGTCCCTGAGACTCTCCTGTG CAGCCTCTGGAATCACCTTCAGTGACTACTACAT GAACTGGATCCGCCAGGCTCCAGGGAAGGGGCT GGAGTGGGTTCATACATTAGTAGTAGTGGTAGA ACCATATTCTACGCAGACTCTTTGAAGGGCCGAT TCACCATCTCCAGGGACAACGCCAAGAACTCACT GTATCTGCAAATGAACAGCCTGAGAGCCGAGGA CACGGCCGTGTATTACTGTGCGGCCGATACAATC TACTGGGGCCAGGGAACCCTGGTCACCGTCTCCT CA<br>SEQ ID NO: 29215 |
| | | AA | DIQMTQSPSSLSASVGDRVTITCRASQGIRNDLG WHQQKPGKAPKRLIYAASSLQSGVPSRFSGSGS GTEFTLSISSLQPEDFATYYCLQHNSFPFTFGPGT KVDIK<br>SEQ ID NO: 25210 | QVQLVESGGGLVKPGGSLRLSCAASGITFSDYYMN WIRQAPGKGLEWVSYISSSGRTIFYADSLKGRFTISR DNAKNSLYLQMNSLRAEDTAVYYCAADTIYWGQ GTLVTVSS<br>SEQ ID NO: 29216 |
| iPS:433915 | 21-225_43H9 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGAAGAAAACCAGGGAAAG CCCCTAAACTCCTGATCTATGATGCATCCAGTT TGCAAAGTGGGGTCCCATCAAGGTTCAGCGGC AGTGGATCTGGGACAGATTTCATTCTCACCAT CAGCAGCCTGCAGCCTGAAGATTTTGCAACTT ACTTTTGTCAACAGGCTAACAGTCTCCCATTC ACTTTCGGCCCTGGGACCAAAGTGGATATCAA A<br>SEQ ID NO: 25211 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGTTATTAGTGGTGGTAGT AACACATTCTACGCAGACTCCGTGAAGGGCCGGT TCACCATCTCCAGAGACAATGCCAAGAACACGCT GTATCTGCACATGAACAGCCTGAGAGCCGAGGA CACTGCCGTATATTCTGTGCGAAACGAACGCCC TCTGATGTTTTGATATCTGGGGCCAAGGGACAA TGGTCACCGTCTCTCA<br>SEQ ID NO: 29217 |

FIGURE 50
(Continued)

| | | | | |
|---|---|---|---|---|
| iPS:433917 | 21-225_43E11 | AA | DIQMTQSPSSVSASVGDRVTITCRASQDISSWLAWYQKKPGKAPKLLIYDASSLQSGVPSRFSGSGSGTDFILTISSLQPEDFATYFCQQANSLPFTFGPGTKVDIK | EVQLLESGGGLVQPGGSLRLSCAASGFTFSSYAMSWVRQAPGMGLEWVSAISGSGSNTFYADSVKGRFTISRDNSKNTLYLHMNSLRAEDTAVYFCAKRTPSDVFDIWGQGTMVTVSS |
| | | | SEQ ID NO: 25212 | SEQ ID NO: 29218 |
| | | NA | GATATTGTGATGACCCAGACTCCACTCTCTCTGTCCGTCACCCCTGGACAGCCGGCCTCCATCTCCTGCAAGTCTAGTCAGAGCCTCCTGCACAGTGATGGAAGGACCTATTTGTATTGGTACCTTCAGAAGCCAGGCCAGGCCTCCGCAGCTCCTGATCTATGAAGTTTCCAACCGGTTCTCTGGAGTGCCAGATAGGTTCAGTGGCAGCGGGTCAGGGACAGACTTCACACTGAAAATCAGCCGGGTGGAGGCTGAGGATGTTGGGGGTTTATTACTGTATGCAAAGTATACAGCTTCCGTGACGTTCGGCCAAGGGACCAAGGTGGAAATCAAA | CAGGTGCAGCTGTGGTGGAGTCTGGGGGAGGCGTGGTCCAGCCTGGGAGGTCCCTGAGACTCTCCTGTGCAGCGTCTGGATTCTCCTTCAGTGACTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGACTCACCATCTCCAGAGACAATTCCAAGAACACGCTGTATCTGCAAATGAACAGCCTGAGAGCCGAGGACACGGCTGTGTATTACTGTGCGAGGCGGTATGTCAGAAGCTGGGTGGGAGGTATGGACGTCTGGGGCCAAGGGACCACGGTCACCGTCTCCTCA |
| | | | SEQ ID NO: 25213 | SEQ ID NO: 29219 |
| | | AA | DIVMTQTPLSLSVTPGQPASISCKSSQSLLHSDGRTYLYWYLQKPGQPPQLLIYEVSNRFSGVPDRFSGSGSGTDFTLKISRVEAEDVGVYYCMQSIQLPWTFGQGTKVEIK | QVQLVESGGGVVQPGRSLRLSCAASGFSFSDYGMHWVRQAPGKGLEWVAVIWYDGSNKYYADSVKGRLTISRDNSKNTLYLQMNSLRAEDTAVYYCARRYVRSWVGGMDVWGQGTTVTVSS |
| | | | SEQ ID NO: 25214 | SEQ ID NO: 29220 |

FIGURE 50
(Continued)

| | | | | |
|---|---|---|---|---|
| iPS:433919 | 21-225_44B3 | NA | GACATCCAGATGACCCAGTCTCCATCCTCCCT GTCTGCATCTGTAGGAGACAGAGTCACCATCA CTTGCCGGGCAAGTCAGGGACAGATTAGAAATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACTGCATTATAATTACCCTCGG ACGTTCGGCCAAGGGACCAAGGTGGAAATCA AG | CAGGTGCAGCTGGTGGAGTCTGGGGGAGGCGTG GTCCAGCCTGGGAGGTCCCTGAGACTCTCCTGTA CAGCGTCTGATTCACCTTCAGTGACTATGGCAT GCACTGGGTCCGCCAGGCTCCAGGCAAGGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGTGGCTGGTACGACTACGGTATGGACGTC TGGGGCCAAGGGACCACGGTCACCGTCTCCTCA |
| | | | SEQ ID NO: 25215 | SEQ ID NO: 29221 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLLHYNYPRTFGQG TKVEIK | QVQLVESGGGVVQPGRSLRLSCTASGFTFSDYGMH WVRQAPGKGLEWVAVIWYDGSNKYYADSVKGRF TISRDNSKNTLYLQMNSLRAEDTAVYYCARERYSS GWYDYGMDVWGQGTTVTVSS |
| | | | SEQ ID NO: 25216 | SEQ ID NO: 29222 |
| iPS:433921 | 21-225_44C3 | NA | GACATCCAGATGACCCAGTCTCCATCCTCCCT GTCTGCATCTGTAGGAGACAGAGTCACCATCA CTTGCCGGGCAAGTCAGGGACAGATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CGGTGGATCTGGGACAGAATTCACTCTCACAA TCAGCAGCCTGGGACCTGAAAGATTTTGCGACT TATTACTGTCTACAGCATAGTAGTTACCCTCTC ACTTTCGGCGGAGGGACCAAGGTGGAGATCA AG | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGGCT GGAGTGGGTGGCAGTTATATGGTTTGAAGGAAGT AATAAATACTATGCAGATTCCGTGAAGGGCCGAT TCACCATCTCCAGAGACAATTCCAAGAACACGCT GTATCTGCAAATGAGCAGCCTGAGAGCCGAGGA CACGGCTGTGTATTACTGTGTGAGAGAACTAGGA TTTTCCACCGACTACTGGGGCCAGGGAACCCTGG TCACCGTCTCCTCA |
| | | | SEQ ID NO: 25217 | SEQ ID NO: 29223 |

FIGURE 50
(Continued)

| | | | | |
|---|---|---|---|---|
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIK | QVQLVESGGGVVQPGRSLRLSCAASGFTFSSYGMHWVRQAPGKGLEWVAVIWFEGSNKYYADSVKGRFTISRDNSKNTLYLQMSSLRAEDTAVYYCVRELGFSTDYWGQGTLVTVSS |
| | | | SEQ ID NO: 25218 | SEQ ID NO: 29224 |
| iPS:433923 | 21-225_44D3 | NA | GACATCCAGATGACCCAGTCTCCATCCTCCTGTCTGCATCTGTGGAGACAGAGTCACCTTCACCTTGCCCGGGCAAGTCAGGGCATTAGAGATGATTTAGGCTGGTATCAGCAGAAACCAGGAAAGCCCCTAAGCGCCTGATCTATGCGCATCCAGTTTGCAAAGTGGGGTCCCATCAAGGTTCAGCGGCAGTAGATCTGGGAGAGAATTCACTCTCACAATCAGCAGCCTGCAACTGAAGATTTTGCAACTTATTACTGTCTACAGCATTATAGTTACCCTCGGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGTCATGCACTGGGTCCGCCAGGCTCCAGGCAAGGGGCTGGAGTGGGTGGCAGTTATATGGTATGATGGAAGTAATAAATACTATGCTGACTCCGTGAAGGGCCGATTCACCATCTCCAGAGACAACAGCCAAGAACACGCTGTATCTGCAAATGAACAGCCTGAGAGCCGAGGACACGGCTGTGTATTACTGTGCGAGAGAAAGGTATAGCAGTGGCTTGTACGACTACGGTATGGACGTCTGGGGCCAAGGGACCACGGTCACCGTCTCCTCA |
| | | | SEQ ID NO: 25219 | SEQ ID NO: 29225 |
| | | AA | DIQMTQSPSSLSASVGDRVTFTCRASQGIRDDLGWYQQKPGKAPKRLIYAASSLQSGVPSRFSGSRSGREFTLTISSLQPEDFATYYCLQHYSYPRTFGQGTKVEIK | QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCARERYSSGLYDYGMDVWGQGTTVTVSS |
| | | | SEQ ID NO: 25220 | SEQ ID NO: 29226 |

FIGURE 50
(Continued)

| | | | |
|---|---|---|---|
| iPS:433925 | 21-225_44F3 | NA | GACATCCAGATGACCCAGTCTCCATCTTCCGT GTCTGCATCTGTAGGAGACAGAGTCACCATCA CTTGTCGGGCGAGTCAGGGTATTAGCGACTGG TTAGCCTGGTATCAGCAGAAACCAGGGAAAG CCCCTAAGCTCCTGATTTATGCTGCATCCAGTT TACAAAGTGGAGTCCCATCAAGGTTCAGCGGC AGTGGATTTGGGACAGATTTCACTCTCACCAT CAGCAGCCTGCAGCCTGAAGATTTTGCAACTT ACTATTGTCAACAGGCTAACAGTTCCCATTC ACTTTCGGCCCTGGGACCAAAGTGGATATCAA A<br><br>SEQ ID NO: 25221 | GAGGTGCACCTGTTGGAGTCTGGGGGAGGCTTGG TACAGCCTGGGGGGTCCTGAGACTCTCCTGTGC AGCCTCTGGATTCACCTTTAGCAGCTATGCCATG AGCTGGGTCCGCCAGGTCCAGGGAAGGGGCTG GAGTGGGTCTCAATTCTCAGTGGTGTGGTAAGA CCACATACTACGCAGACTCCGTGAAGGGCCGTT CACCATCTCCAGAGACAATTCCAAGAACACGCTG TTTCTGCAAATGAACAGCTGAGAGCCGAGGAC ACGGCCGTATATTACTGTGCGAAACGAACGCCT CTGATGCTTTTGATATCTGGGGCCAAGGGACAAT GGTCACCGTCTCTTCA<br><br>SEQ ID NO: 29227 |
| | | AA | DIQMTQSPSSVSASVGDRVTITCRASQGISDWLA WYQQKPGKAPKLLIYAASSLQSGVPSRFSGSGF GTDFTLTISSLQPEDFATYYCQQANSFPFTFGPGT KVDIK<br><br>SEQ ID NO: 25222 | EVHLLESGGGLVQPGGSLRLSCAASGFTFSSYAMS WVRQAPGKGLEWVSILSGGGKTYYADSVKGRFTI SRDNSKNTLFLQMNSLRAEDTAVYYCAKRTPSDAF DIWGQGTMVTVSS<br><br>SEQ ID NO: 29228 |
| iPS:433929 | 21-225_44D5 | NA | GACATCCAGATGACCCAGTCTCCATCCTCCCT GTCTGCATCTGTAGGAGACAGAGTCACCATCA CTTGCCGGGCAAGTCAGGACATTAGAAACGAT TTAGGCTGGTATCAGCAGAAAACCAGGGAAAG CCCCTAAGCTCCTGATCTATGCTGCATCCACTT TGGAAAGTGGGGTCCCATCAAGGTTCAGCGGC AGTGGATCTGGGACAGCCTGAAATTCACTCTCACAAT CAGCAGCCTGCAGCCTGAAGATTTTGCAACTT ATTACTGTCTACAGCATTATAGTTCCCGTGGA CGTTCGGCCAAGGGGACCAAGGTGGAAATCAA A<br><br>SEQ ID NO: 25223 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGCAAGGGGCT GGAGTGGGTGGCAGTTATATGGTATGATGGAAGT AATAAATACTATGCAGACTCCGTGAAGGGCCGA TTCACCATCTCCAGAGACACAATTCCAAGAACACGC TGTATCTGCAAATGAACAGCTGAGAGCCGAGG ACACGGCTGTGTATTACTGTGCGAGAGTCCCGTA TAGCAGCAGCTGTAGCGACTACGGTATGGACGTC TGGGGCCAAGGGACCACGGTCACCGTCTCCTCA<br><br>SEQ ID NO: 29229 |

FIGURE 50
(Continued)

| | | | | |
|---|---|---|---|---|
| iPS:433931 | 21-225_44F6 | AA | DIQMTQSPSSLSASVGDRVTITCRASQDIRKDLG WYQQKPGKAPKRLIYAASTLESGVPSRFSGSGS GTEFTLTISSLQPEDFATYYCLQHYSFPWTFGQG TKVEIK<br><br>SEQ ID NO: 25224 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARVPYSS SWYDYGMDVWGQGTTVTVSS<br><br>SEQ ID NO: 29230 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGTGGAAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TTTATTACTGTCAGCAGTATGGTAGTTCACCGT GGACGTTCGGCCAAGGGACCAAGGTGGAAAT CAAA<br><br>SEQ ID NO: 25225 | CAGGTGCAACCTGCAGGAGTCGGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCCCAGGGAAGGGACT GGAGTGGATTGGGTATATCTATTACAGTGGAAAC ACCAACTACAACCCCTCCCTCAAGAGTCGAGTCA CCATATCAGTAGACACGTCCAAGAACCAGTTCTC CCTGAAGCTGAGCTCTGTGACCGCTGCGGACACG GCCGTGTATTACTGTGTGAGAGGGGTGGCTATAA AGAACTACTGGGGCCAGGGAATCCTGGTTACCG TCTCCTCA<br><br>SEQ ID NO: 29231 |
| | | AA | EIVLTQSPGTLSLSPGERATLSCRASQSVSGSYLA WYQQKPGQAPRLLIYGASSRATGIPDRFSGSGSG TDFTLTISRLEPEDFAVYYCQQYGSSPWTFGQGT KVEIK<br><br>SEQ ID NO: 25226 | QVHLQESGPGLVKPSETLSLTCTVSGGSISSYYWSW IRQPPGKGLEWIGYIYYSGNTNYNPSLKSRVTISVD TSKNQFSLKLSSVTAADTAVYYCVRGVAIKNYWG QGILVTVSS<br><br>SEQ ID NO: 29232 |

FIGURE 50
(Continued)

| | | | |
|---|---|---|---|
| iPS:433933 | 21-225_44C8 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAATTTGCAAAGTGGGGTCCCATCAAGGTTCAGCGGCAGTAGATCGGGACAGAATTCACTCTCACAACAGCAGCCTGCAGCCTGAAGATTTTGCAACTTATTACTGTCTACAGCATAATAGTTACCCATTCACTTTCGGCCCTGGGACCAAAGTGGATATCAAA SEQ ID NO: 25227 | CAGGTGCAGCTGGTGGAGTCTGGGGGAGGCGTGGTCCAGCCTGGGAGGTCCCTGAGACTCTCCTGTGCAGCGTCTGGATTCACCTTCAATAACTATGGCATGCACTGGGTCCGCCAGGCTCCAGGCAAGGGGCTGGAGTGGGTGGCAGTTATATGGTATGAAGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGTGAGAGAACTGGGGTTCCTCTGACTACTGGGGCCAGGGAACCCTGGTCACCGTCTCCTCA SEQ ID NO: 29233 |
| | | AA | DIQMTQSPSSLSASVGDRVTITCRASQGIRNDLGWYQQKPGKAPKRLIYAASNLQSGVPSRFSGSRSGTEFTLTISSLQPEDFATYYCLQHNSYPFTFGPGTKVDIK SEQ ID NO: 25228 | QVQLVESGGGVVQPGRSLRLSCAASGFTFNNYGMHWVRQAPGKGLEWVAVIWYEGSNKYYADSVKGRFTISRDNSKNTLYLQMNSLRAEDTAVYYCVRELGFLSDYWGQGTLVTVSS SEQ ID NO: 29234 |
| iPS:433935 | 21-225_44F9 | NA | GACGTCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTCATCTATGCTGCATCCAGTTTGCAAAGTGGGGTCCCATCAAGGTTCAGCGGCAGTGGATCTGGGACAGCCTGCAGCCTGAAGATTCACTCTCACAATCAGCAGCCTGCAGCCTGAAGATTTTGCAACTTATTACTGTCTCCACCATTATAATTACCCTCGAACGTTCGGCCAAGGGACCAAGGTGGAAATCACA SEQ ID NO: 25229 | CAGGTGCAGCTGGTGGAGTCTGGGGGAGGCGTGGTCCAGCCTGGGAGGTCCCTGAGACTCTCCTGTCAGCGTCTGGATTCACCTTCAGTAGTATGTCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGTGAGAGAACACGCTAGCAGCAGCTGTAGCAGCTACACGGTATGGACGTCGGGGGCCAAGGGACCACGGTCACCGTCTCCTCA SEQ ID NO: 29235 |

FIGURE 50
(Continued)

| | | | |
|---|---|---|---|
| iPS:433937 | 21-225_44B10 | AA | DVQMTQSPSSLSASVGDRVTITCRASQGIRNDLGWYQQKPGKAPKRLIYAASSLQSGVPSRFSGSGSGTEFTLTISSLQPEDFATYYCLHHYNYPRTFGQGTKVEIT<br>SEQ ID NO: 25230 | QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCAREPYSSSWYDYGMDVWGQGTTVTVSS<br>SEQ ID NO: 29236 |
| | | NA | CATATTGTGATGACCCAGACTCCACTCTCTCTGTCCGTCACCCCTGGACAGCCGGCCTCCATCTCTGCAAGTCTAGTGCAGAGCCTCTGCATAGTGAGGGAAGGACCTATTTGTATTGGTACCTGCAGAAGCCAGGCCAGCCTCCACAGGTTCTCTGGAGTGCCAGTGAAATTCAGTGGCAGGGTCAGGGACAGAATAGATTCACCCTGAAAATCAGCCGGGTGGAGGCTGTTTCACACTGCAAAATCAGCCTTTATTACTGCATGCAAAGTAGGATGTTGGGGTTTATTACTGCATGCAAAGTATCCACCTTCCGTTCACTTTCGGCGGAGGGACCAAGGTGGAGATCAAA<br>SEQ ID NO: 25231 | CAGGTGCAGTTGGTGGAGTCTGGGGGAGGCGTGGTCCAGCCTGGGAGGTCCCTGAGACTCTCCTGTGTAGCGTCTGATTCACCTTCAGTAGTCATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAACAATTCCAAGAACACGCTGTATCTGCAAATGAACAGCCTGAGAGCCGAGGACACGGCTGTGTATTATTGTGCGAGGCGGTATAGCAGCAGCTGGGTGGGGGTATGGACGTCTGGGGCCAAGGGACCACGGTCACCGTCTCCTCA<br>SEQ ID NO: 29237 |
| | | AA | HIVMTQTPLSLSVTPGQPASISCKSSQSLLHSEGRTYLYWYLQKPGQPPQLLIYEISHRFSGVPDRFSGSGSGTDFTLKISRVEAEDVGVYYCMQSIHLPFTFGGGTKVEIK<br>SEQ ID NO: 25232 | QVQLVESGGGVVQPGRSLRLSCVASGFTFSSYGMHWVRQAPGKGLEWVAVIWYDGSNKYYADSVKGRFTISRDNSKNTLYLQMNSLRAEDTAVYYCARRYSSSWVGGMDVWGQGTTVTVSS<br>SEQ ID NO: 29238 |

FIGURE 50
(Continued)

| | | | | |
|---|---|---|---|---|
| iPS:433939 | 21-225_44C10 | NA | GACATCCAGATGACCCAGTCTCCATCCTCCT GTCTGCATCTGTAGGAGACAGAGTCACCTTCA CTTGCCGGGCAAGTCAGGGCATTAGAGATGAT TTAGGCTGGTATCAGCAGAAACCAGGAAAG CCCCTAAGCGCCTGATCTATGCTACATCCAGT TTGCAAAGTGGGGTCCCATCAAGGTTCAGCGG CAGTGGATCTGGGACAGAATTCACTCTCACAA TCAGCAGCCTGCAGCCTGAAGATTATGTTACCCTGG TATTACTGTCTACAGCATTATAGTTACCCTGG ACGTTCGGCCAAGGGACCAAGGTGGAAATCA AA SEQ ID NO: 25233 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGTGATGGTGAAGT AATAAATACTATGCTGACTCCGTGAAGGGCGAT TCACCATCTCCAGAGACAATTCCAAGAACACGCT GTATCTGCAAATGAACAGCCTGAGAGCCGAGGA CACGGCTGTGTATTACTGTGCGAGAGAAAGTAT AGCAGTGGCTTGTACGACTACGGTATGGACGTCT GGGGCCAAGGGACCACGGTCACCGTCTCCTCA SEQ ID NO: 29239 |
| | | AA | DIQMTQSPSSLSASVGDRVTFTCRASQGIRDDLG WYQQKPGKAPKRLIYATSSLQSGVPSRFSGSGSG TEFTLTISSLQPEDFATYYCLQHYSYPRTFGQGT KVEIK SEQ ID NO: 25234 | QVQLVESGGGVVQPGRSLRLSCAASGFTFSDCVMH WVRQAPGKGLEWVAVIWYDGSNKYYADSVKGRF TISRDNSKNTLYLQMNSLRAEDTAVYYCARERYSS GLYDYGMDVWGQGTTVTVSS SEQ ID NO: 29240 |
| iPS:433941 | 21-225_44D10 | NA | GACATCCAGATGACCCAGTCTCCATCTTCCGT GTCTGCATCTGTGGGAGACAGAGTCACCATCA CTTGTCGGGCGAGTCAGGGTATTAGCGACTGG TTAGCCTGGTATCAACAGAAACCAGGGAAAG CCCCTAAGGCTCCTGATCTATGCTGCATCCAGTT TGCAAAGTGGGGTCCCATCAAAATTCAGCGGC AGTGGATCTGGGACAGATTTCACTCTCACCAT CAGCAGCCTGCAGCCTGAAGATTTTGCAACTT ACTATTGTCAACAGACTAACAGTTTCCCGTGG ACGTTCGGCCAAGGGACCAAGGTGGAAATCA AA SEQ ID NO: 25235 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTGGTGTT AACACATTGCACGACGCAGACTCCGTGAAGGGCCGG TTCACCATCTCCAGAGACAATGAACAGCCTGAGAG ACACGGCCGTATATTACTGTGCGAAGGAAAAGGA GTGGGAGCTATTTTGACTACTGGGGCCAGGGAAC CCTGGTCACCGTCTCCTCA SEQ ID NO: 29241 |

FIGURE 50
(Continued)

| | | | |
|---|---|---|---|
| iPS:433943 | | AA | DIQMTQSPSSVSASVGDRVTITCRASQGISDWLA WYQQKPGKAPRLLIYAASSLQSGVPSKFSGSGS GTDFTLTISNLQPEDFATYYCQQTNSFPWTFGQG TKVEIK<br>SEQ ID NO: 25236 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS<br>SEQ ID NO: 29242 |
| | 21-225_44E10 | NA | GATATTGTGATGACTCAGTCTCCACTCTCCCTG CCCGTCACCCCTGGAGAGCCGGCCTCCATCTC CTGCAGGTCTAGTCAGAGCCTCCTGCATAGTA ATGGATACAGCTATTTGGAGTGGTACCTGCAG AAGCCAGGACAGTCTCCACAACTCCTGATCTA TTTGGGTTCTAATCGGGCCTCCGGGGTCCCTG ACAGGTTCAGTGGCAGTGGATCAGGCACAGAT TTTACACTGAAAATCAGCAGAGTAGAGGCTGA GGATGTTGGGGTTTATTACTGCATGCAAACTC TACAAACTCCATTCACTTTCGGCCCTGGGACC AAAGTTGGATATCAAA<br>SEQ ID NO: 25237 | GAGGTGCAGCTGTTGGAGTCTGGGGGAGGCTTG GTACAGTCTGGAGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGGTGTTGTGTAGTGGTGGT AGAACATACTACGCAGACTCCGTGAAGGGCCGG TTCATCATCTCCAGAGACAATTCCAAGAACACGC TGTATCTGCAAATGAACAGCCTGAGAGCCGAGG ACACGGCCGTATATTACTGTGCGAAAGATCGGG GGCAGTGGCTCCTAGGCGGTATGGACGTCTGGG GCCAAGGGACCACGGTCACCGTCTCCTCA<br>SEQ ID NO: 29243 |
| | | AA | DIVMTQSPLSLPVTPGEPASISCRSSQSLLHSNGY SYLEWYLQKPGQSPQLLIYLGSNRASGVPDRFSG SGSGTDFTLKISRVEAEDVGVYYCMQTLQTPFTF GPGTKVDIK<br>SEQ ID NO: 25238 | EVQLLESGGGLVQSGGSLRLSCAASGFTFSSYAMN WVRQAPGKGLEWVSGVVGSGGRTYYADSVKGRFI ISRDNSKNTLYLQMNSLRAEDTAVYYCAKDRGQW LLGGMDVWGQGTTVTVSS<br>SEQ ID NO: 29244 |

FIGURE 50
(Continued)

| | | | | |
|---|---|---|---|---|
| iPS:433945 | 21-225_44C12 | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTCTGCTGCATTCAGTT TGCAAAGTGGGGTCCCATCAAGGTTCAGCGGC AGTGGATCGGGACAGATTTCACTCTCAGCAT CAGCAGCCTGCAGCCTGAAGATTTTGCAACTT ACTATTGTCAACAGTCTAACAGTTTCCCGTGG ACGTTCGGCCAAGGGACCAAGGTGGAAATCA AA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGTATAGCGT GAACTGGGTCCGCCAGGCTCCAGGGAAGGGGCT GGAGTGGGTTTCATACATTAGTAGTAGTAGTAGT ACCATATACTACGCAGACTCTGTGAAGGGCCGAT TCACCATCTCCAGAGACAATGCCAAGAACTACT GTATCTGCAAATGAACAGCCTGAGAGACGAGGA CACGGCTGTGTATTACTGTGCGAGAAGTGGATAC AGCTATGCTTACTACTACTACGGTATGACG TCTGGGGCCAAGGGACCACGGTCACCGTCTCCTC A |
| | | | SEQ ID NO: 25239 | SEQ ID NO: 29245 |
| | | AA | DIQMTQSPSSVSASVGDRVTITCRASQGISNWLA WYQQKPGKAPKLLISAAFSLQSGVPSRFSGSGSG TDFTLSISSLQPEDFATYYCQQSNSFPWTFGQGT KVEIK | EVQLVESGGGLVQPGGSLRLSCAASGFTFSSYSVN WVRQAPGKGLEWVSYISSSSSTIYYADSVKGRFTIS RDNAKNSLYLQMNSLRDEDTAVYYCARSGYSYAY YYYYGMDVWGQGTTVTVSS |
| | | | SEQ ID NO: 25240 | SEQ ID NO: 29246 |
| iPS:433947 | 21-225_44E12 | NA | GACATCCAGATGACCCAGTCTCCATCTCCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTAGTCTATGCTGCATCCAGT TTGCAAAGTGGGGTCCCATCAAGGTTCAGCGG CAGTGGATCTGGGACAGACGCCTGCACTCACAA TCAGCAGCCTGCAGCCTGAAGATTTTGCAACT TATTACTGTCTACAACATAATAGTTACCCGCTC ACTTTCGGCGGAGGGACCAAGGTGGAGATCA AA | CAGGTGCACCTGGCGGAGTCTGGGGGAGGCGTG GTCCAGCCTGGGAGGTCCCTGAGACTCTCCTGTG AAGCGTCTGGATTCACCCTCAGTAGCGATGACAC GCACTGGGTCCGCCAGCCTCCAGGCAAGGGGCT GGAGTGGGTGGCAGTTATATGGTTTGATGAATAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACGCGGCTGTGTATTACTGTGCGAGAGATCTAAT AGCAGCAGCTGGGACGGGAGACTACTGGGGCCA GGGAACCCTGGTCACCGTCTCCTCA |
| | | | SEQ ID NO: 25241 | SEQ ID NO: 29247 |

FIGURE 50
(Continued)

| | | | | |
|---|---|---|---|---|
| iPS:433949 | 21-225_45H2 | AA | DIQMTQSPSSLSASVGDRVTITCRTSQGIRNDLG WYQQKPGKAPKRLIYAASSLQSGVPSRFSGSGS GTEFLTISSLQPEDFATYYCLQHNSYPLTFGGG TKVEIK<br>SEQ ID NO: 25242 | QVHLAESGGGVVQPGRSLRLSCEASGFTLSSDDTH WVRQPPGKGLEWVAVIWFDEYNKYYADSVKGRF TISRDNSKNTLYLQMNSLRAEDAAVYYCARDLIAA AGTGDYWGQGTLVTVSS<br>SEQ ID NO: 29248 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGATTCACTCTCACAG TCAGCAGCCTGCAGCCTGAAGATTTTGCAACT TATTTCTGTCTACAGCATACTAGTTTCCCATTC ACTTTCGGCCCTGGGACCAAAGTGGATATCAA A<br>SEQ ID NO: 25243 | CAGGTGCAGCTGGTGGAGTCTGGGGGAGGCTTG GTCAAGCCTGGAGGGTCCCTGAGACTCTCCTGTG CAGCCTCTGGATTCACCTTTAGTGACTACTACAT GAACTGGATCCGCCAGGCTCCAGGGAAGGGGCT GGAGTGGGTTTCATACATTAGTAGTAGTGGTATT ACCAAATACTACGCAGACTCTGTGAAGGGCCGA TTCACCATCTCCAGGGACAACGCCAAGAACTCAC TGTATCTGCAAATGAACAGCTGAGAGCCGAGG ACACGGCCGTGTATTACTGTGCGGCCGATACAAT CTACTGGGGCCAGGGAACCCTGGTCACCGTCTCC TCA<br>SEQ ID NO: 29249 |
| | | AA | DIQMTQSPSSLSASVGDRVTITCRASQGIRNDLG WYQQKPGKAPKRLIYGASNLQSGVPSRFSGSGS GTEFLTVSSLQPEDFATYFCLQHTSFPFTFGPGT KVDIK<br>SEQ ID NO: 25244 | QVQLVESGGGLVKPGGSLRLSCAASGFTFSDYYMN WIRQAPGKGLEWVSYISSSGITKYYADSVKGRFTIS RDNAKNSLYLQMNSLRAEDTAVYYCAADTIYWGQ GTLVTVSS<br>SEQ ID NO: 29250 |

FIGURE 50
(Continued)

| | | | |
|---|---|---|---|
| iPS:433951 | 21-225_45B4 | NA | GACATCCAGATGACCCAGTCTCCATCTCCT GTCTGCATCTGTAGGAGACAGAGTCACCTTCA CTTGCCGGGCAAGTCAGGGCATTAGAGATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAATCA AA |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGTGGTATGATGGAAGT AATAAATACTATGCTGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAAGTAT AGCAGTGGCTTGTACGACTACGGTATGGACGTCT GGGGCCAAGGGACCACGGTCACCGTCTCCTCA |
| | | | SEQ ID NO: 25245 |
| | | AA | DIQMTQSPSSLSASVGDRVTFTCRASQGIRDDLG WYQQKPGKAPKRLIYAASSLQSGVPSRFSGSGS GTEFTLTISSLQPEDFATYYCLQHYSYPRTFGQG TKVEIK |
| | | | QVQLVESGGGVVQPGRSLRLSCAASGFTFSDCVMH WVRQAPGKGLEWVAVIWYDGSNKYYADSVKGRF TISRDNSKNTLYLQMNSLRAEDTAVYYCARERYSS GLYDYGMDVWGQGTTVTVSS |
| | | | SEQ ID NO: 25246 |
| | | | SEQ ID NO: 29251 |
| iPS:433953 | 21-225_45H4 | NA | GACATCCAGATGACCCAGTCTCCATCTTCCGT GTCTGCATCTGTGGGAGACAGAGTCACCATCA CTTGTCGGGCGAGTCAGGATATTAGCAGCTGG TTAGCCTGGTATCAGAAGAAACCAGGGAAAG CCCCTAAGTACCTGATCTATGATGCATCCAGT TTGCAAAGTGGGGTCCCATCAAGGTTCAGCGG CAGTGGATCTGGGACAGATTTCATTCTCACCA TCAGCAGCCTGCAGCCTGAAGATTTTGCAATT TACTTTTGTCAACAGGCTAACAGTCTCCCTTTC ACTTTCGGCCCTGGGACCAAAGTGGATATCAA A |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGATGGGGCT GGAGTGGGTCTCAGCTATTAGTGGTAGTGGTAGT AACACATTCTACGCAGACTCCGTGAAGGGCCGGT TCACCATCTCCAGAGACAATTCCAAGAGCACGCT GTATCTGCAAATGAACAGCCTGAGAGCCGAGGA CACTGCCGTATATTTCTGTGCGAAACGAACGCCC TCTGATGTTTTTGATATCTGGGGCCAAGGGACAA TGGTCACCGTCTCTTCA |
| | | | SEQ ID NO: 25247 |
| | | | SEQ ID NO: 29252 |
| | | | SEQ ID NO: 29253 |

FIGURE 50
(Continued)

| | | | | |
|---|---|---|---|---|
| iPS:433955 | | AA | DIQMTQSPSSVSASVGDRVTITCRASQDISSWLAWYQKKPGKAPKYLIYDASSLQSGVPSRFSGSGSGTDFILTISSLQPEDFAIYFCQQANSLPFTFGPGTKVDIK<br>SEQ ID NO: 25248 | EVQLLESGGGLVQPGGSLRLSCAASGFTFSSYAMSWVRQAPGMGLEWVSAISGSGSNTFYADSVKGRFTISRDNSKNTLYLHMNSLRAEDTAVYFCAKRTPSDVFDIWGQGTMVTVSS<br>SEQ ID NO: 29254 |
| | | NA | GACATCCAGATGACCCAGTCTCCATCCTCCCTGTCTGCATCTGTAGGAGACAGAGTCACCTTCACTTGCCGGGCAAGTCAGGACATTAGAGATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATTATAATTACCCTCGGACGTTCGGCCAAGGGACCAAGGTGGAAATCAAA<br>SEQ ID NO: 25249 | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTGTGTCATGCACTGGGTCCGCCAGGCTCCAGGCAAGGGGCTGGAGTGGGTGGCAGTTATATGGTATGATGGAAGTAATAAATACTATGCTGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAAGGTATAGCAGTGGCTTGTACGACTACGGTATGGACGTCTGGGGCCAAGGGACCACGGTCACCGTCTCCTCA<br>SEQ ID NO: 29255 |
| | 21-225_45B8 | AA | DIQMTQSPSSLSASVGDRVTFTCRASQDIRDDLGWYQQKPGKAPKRLIYAASSLQSGVPSRFSGSGSGTEFTLTISSLQPEDFATYYCLQHYNYPRTFGQGTKVEIK<br>SEQ ID NO: 25250 | QVQLVESGGGVVQPGRSLRLSCAASGFTFSDCVMHWVRQAPGKGLEWVAVIWYDGSNKYYADSVKGRFTISRDNSKNTLYLQMNSLRAEDTAVYYCARERYSSGLYDYGMDVWGQGTTVTVSS<br>SEQ ID NO: 29256 |

FIGURE 50
(Continued)

| | | | |
|---|---|---|---|
| iPS:433957 | 21-225_45F8 | NA | GACATCCAGATGACCCAGTCTCCATCTTCCGT GTCTGCATCTGTAGGAGACAGAGTCACCATCA CTTGTCGGGCGAGTCAGGTATTAGCGACTGG TTAGCCTGGTATCAGCAGAAACCAGGGAAAG CCCCTAGGCTCCTGATCTATGGTGCATCCAGTT TGCAAAGTGGGGTCCCATCAAGGTTCAGCGGC AGTGGATCTGGGACAGATTTCACTCTCACCAT CAGCAACCTGCAGCCTGAAGATTTTGCAACTT ACTATTGTCAACAGACTAACAGTTCCCGTGG ACGTTCGGCCAAGGGACCAAGGTGGAAATCA AA<br><br>SEQ ID NO: 25251 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCAGTATGCCAT GAGCTGGGTCCGCCAGGCTCCAGGGAAGGGGCT GGAGTGGGTCTCAGTATTAGTAGTGTCGTGGTGT AACACATTCGACGCAGACTCCGTGAAGGGCCGG TTCACCATATCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAAC CCTGGTCACCGTCTCCTCA<br><br>SEQ ID NO: 29257 |
| | | AA | DIQMTQSPSSVSASVGDRVTITCRASQGISDWLA WYQQKPGKAPRLLIYGASSLQSGVPSRFSGSGSG TDFTLTISNLQPEDFATYYCQQTNSPWTFGQGT KVEIK<br><br>SEQ ID NO: 25252 | EVQLLESGGGLVQPGGSLRLSCAASGFTFSSYAMS WVRQAPGKGLEWVSAISGRGVNTFDADSVKGRFTI SRDNSKNTLYLQMNSLRAEDTAVYYCAKERSGSY FDYWGQGTLVTVSS<br><br>SEQ ID NO: 29258 |
| iPS:433959 | 21-225_45C9 | NA | GACATCCAGATGACCCAGTCTCCATCTTCCGT GTCTGTTTCTGGGCGAGTCAGAGTCACCATCA CTTGTCGCGGGAGTCAGGATATTAGCGACTGG TTAGCTTGGTATCAGCAGGACCAGGGAAAGC CCCTAAGCTCTTGATCTATGCTGCATCCAGTTT GGGAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br><br>SEQ ID NO: 25253 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAGCTGGGTCCGCCAGGCTCCAGGGAAGGGGCT GGAGTGGGTCTCAGTTATTAGTGGTCGTGGTGGT ACCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAACAGAACCCC CTCTGATGCTTTGATATCTGGGGCCAAGGGACA ATGGTCACCGTCTCTTCA<br><br>SEQ ID NO: 29259 |

FIGURE 50
(Continued)

| | | | |
|---|---|---|---|
| iPS:433961 | 21-225_45D9 | AA | DIQMTQSPSSVSVSVGDRVTITCRASQDISDWLA WYQQRPGKAPKLLIYAASSLESGVPSRFSGSGSG TDFTLTISSLQPEDFATYYCQQANSFPFTFGPGTK VDIK<br><br>SEQ ID NO: 25254 | EVQLLESGGGLVQPGGSLRLSCAASGFTFNSYAMS WVRQAPGKGLEWVSVISGRGGTTYYADSVKGRFT ISRDNSKNTLYLQMNSLRAEDTAVYYCAKRTPSDA FDIWGQGTMVTVSS<br><br>SEQ ID NO: 29260 |
| | | NA | GACATCCAGATGACCCAGTCTCCATCCTCACT GTCTGCATCTGTAGGAGACAGAGTCACCATCA CTTGTCGGGCGAGTCAGGGCATTAACAATTAT TTAGCCTGGTTTCAGCAGAAACCAGGGAAAGC CCCTAAGCTCCTGATCAATGCTGCATCCAGTTT GCAAAGTGGGGTCCCATCAAGGTTCAGCGGCA GTGGATCTGGGACAGATTTCACTCTCGCCATC AGCAGCCTACAGCCTGAAGATTTTGCAACTTA TTACTGCCAACACTATTATTAGTTACCATTCAC TTTCGGCCGTGGGACCAAAGTGGATATCAAA<br><br>SEQ ID NO: 25255 | GAGGTGCAGCTGGTGGAGTCTGGGGGAGGCTG GTCAAGCCGGGGGGGTCCCTGAGACTCTCCTGTG CAGCCTCTGGATTCACCTTCAGTAGCTATACCAT GAACTGGGTCCGCCAGGTTCCAGGGAAGGGCT GGAGTGGGTCTCATCCATTAGTGGAAGTAGTACT TACATATACTACGCAGACTCAGTGAAGGGCCGAT TCACCATCTCCAGAGACAACGCCCAGAACTCACT GTATCTGCAAATGAACAGCTGAGAGGCGAGA CACGGCTGTGTATTACTGTGCGAGGGTGACCTCT TTTGACTACTGGGGCCAGGGAGCCCTGGTCACCG TCTCCTCA<br><br>SEQ ID NO: 29261 |
| | | AA | DIQMTQSPSSLSASVGDRVTITCRASQGINNYLA WFQQKPGKAPKSLINAASSLQSGVPSRFSGSGSG TDFTLAISSLQPEDFATYYCQHYYSYPFTFGRGT KVDIK<br><br>SEQ ID NO: 25256 | EVQLVESGGGLVKPGGSLRLSCAASGFTFSSYTMN WVRQVPGKGLEWVSSISGSSTYIYYADSVKGRFTIS RDDAQNSLYLQMNSLRGEDTAVYYCARVTSFDY WGQGALVTVSS<br><br>SEQ ID NO: 29262 |

FIGURE 50
(Continued)

| | | | |
|---|---|---|---|
| iPS:433963 | 21-225_46B1 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAGGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA |
| | | | SEQ ID NO: 25257 |
| | | AA | DIQMTQSPSSLSASVGDRVTITCRASQGIRNDLG WYQQKPGKAPKRLIYAASSLQGGVPSRFSGSGS GTEFTLTISSLQPEDFATYYCLQHNSYPLTFGGG TKVEIK |
| | | | SEQ ID NO: 25258 |
| iPS:433965 | 21-225_46F2 | NA | GATATCGTGATGACCCAGACTCCACTCTCT GACCGTCACCCCTGGACAGCCGGCCTCCATCT CCTGCAAGTCTAGTCAGAGCCTCCTGCATGGT GATGGAAAGACATATTTGTATTGGTACCTGCA GAAGCCAGGCCAGCCTCCACAGGTCCTGATCT ATGAAGTTTCCAATCGGTTCTCTGGAGTCCA GATAGGTTCAGTGGCAGCGGGTCAGGGACAG ATTTCACACTGAAACTGAGCAGGGTGGAGGCT GAGGATGTTGGGGTTTATTACTGCATGCAAAG TATACAGCTCCGTGACGTTCGGCCAAGGGA CCAAGGTGGAAATCAAA |
| | | | SEQ ID NO: 25259 |

| | | |
|---|---|---|
| | | CAGGTGCACCTGGCGGAGTCTGGGGGAGGCGTG GTCCAGCCTGGGAGGTCCCTGAGACTCTCCTGTG AAGCGTCTGGATTCACCTTCAGTAGCGATGACTC GCACTGGGTCCGCCAGGCTCCAGGCAAGGGCT GGAGTGGGTGGCAGTTATATGGTTTGATGAATAT ACTAAATACTATGCAGACTCCGTGAAGGGCCGAT TCACCATCTCCAGAGACAATTCCAAGAACACGCT GTATCTGCAAATGAACAACCTGAGAGCCGAGGA CGCGGCTGTGTATTACTGTGCGAGAGATCTAATA GCAGCAACTGGGACGGGAGACTACTGGGGCCAG GGAACCCTGGTCACCGTCTCCTCA |
| | | SEQ ID NO: 29263 |
| | | QVHLAESGGGVVQPGRSLRLSCEASGFTLSSDDSH WVRQPPGKGLEWVAVIWFDEYTKYYADSVKGRFT ISRDNSKNTLYLQMNNLRAEDAAVYYCARDLIAAT GTGDYWGQGTLVTVSS |
| | | SEQ ID NO: 29264 |
| | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGCT GGAGTGGGTGGCAATTATATGAGACTCCGTGAAGT AATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATCGATAC GATTTTTGGAGTGGTTACTTTGACTACTGGGGCC AGGGAACCCTGGTCACCGTCCTCA |
| | | SEQ ID NO: 29265 |

FIGURE 50
(Continued)

| | | | |
|---|---|---|---|
| iPS:433967 | 21-225_46C3 | AA | DIVMTQTPLSLTVTPGQPASISCKSSQSLLHGDG KTYLYWYLQKPGQPPQVLIYEVSNRFSGVPDRF SGSGSGTDFTLKLSRVEAEDVGVYYCMQSIQLP WTFGQGTKVEIK<br>SEQ ID NO: 25260 | QVQLVESGGGVVQPGRSLRLSCAASGFTFSSYGMH WVRQAPGKGLEWVAIIWYDGSNKYYVDSVKGRFT ISRDNSKNTLYLQMNSLRAEDTAVYYCARDRYDF WSGYFDYWGQGTLVTVSS<br>SEQ ID NO: 29266 |
| | | NA | GACATCCAGATGACCCAGTCTCCATCCTCCT GTCTGCATCTGTAGGAGACAGAGTCACCTTCA CTTGCCCGGGCAAGTCAGGGCATTAGAGATGAT TTAGGCTGGTATCAGCAGAAACCAGGGAAAG CCCCTAAGCGCCTGATCTATGCTGCATCCAGT TTGCAAAGTGGGGTCCCATCCAAGGTTCAGCGG CAGTAGATCTGGGACAGAATTCACTCTCACAA TCAGCAGCCTGCAACCTGAAGATTTTGCAACT TATTACTGTCTACAGCATTATAGTTACCCTCGG ACGTTCGGCCAAGGGACCAAGGTGGAAATCA AA<br>SEQ ID NO: 25261 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGGCT GGAGTGGGTGGCAGTTATATGGTATGATGGAAGT AATAAATACTATGTCGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCGAGAGAAAGGTAT AGCAGTGGCTTGTACGACTACGGTATGGACGTCT GGGGCCAAGGGACCACGGTCACCGTCTCCTCA<br>SEQ ID NO: 29267 |
| | | AA | DIQMTQSPSSLSASVGDRVTFTCRASQGIRDDLG WYQQKPGKAPKRLIYAASSLQSGVPSRFSGSRS GTEFTLTISSLQPEDFATYYCLQHYSYPRTFGQG TKVEIK<br>SEQ ID NO: 25262 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARERYSS GLYDYGMDVWGQGTTVTVSS<br>SEQ ID NO: 29268 |

FIGURE 50
(Continued)

| | | | | |
|---|---|---|---|---|
| iPS:433969 | 21-225_46F3 | NA | GACATCCAGATGACCCAGTCTCCATCCTCCCTGTCTGCATCTGTAGGAGACAGAGTCACCATCACTTGCCGGGCAAGTCAGGGCATTAGAAAAGATTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCAGTCTCACAATCAGCAGCCTGCAGCCTGAAGATTTTGCAACTTATTACTGTCTACAGCATAATAGTTACCCTCTCACTTTCGGCGGAGGGACCAAGGTGGAGATCAAAG | CAGGTGCAGCTGGTGGTGGAGTCTGGGGGAGGCGTGGTCCAGCCTGGGAGGTCCCTGAGACTCTCCTGTCAGCGTCTGGATTCACCTTCAGTGATTATGGCATGCACTGGGTCCGCCAGGCTCCAGGCAAGGGGCTGGAGTGGGTGGCAGTTATATGGTTTGAAGGAAGTAATAAATACTATGCAGATTCCGTGAAGGGCCGATTCACCATCTCCAGAGACAATTCCAAGAACACGCTGTATGTGCAAATGAACAGCCTGAGAGCTGAGGACACGGCTGTGTATTACTGTGTGAGAGAACTAGGATTTTCCAATGACTACTGGGGCCAGGGAACCCTGGTCACCGTCTCCTCA |
| | | | SEQ ID NO: 25263 | SEQ ID NO: 29269 |
| | | AA | DIQMTQSPSSLSASVGDRVTITCRASQGIRKDLGWYQQKPGKAPKRLIYAASSLQSGVPSRFSGSGSGTEFSLTISSLQPEDFATYYCLQHNSYPLTFGGGTKVEIK | QVQLVESGGGVVQPGRSLRLSCAASGFTFSDYGMHWVRQAPGKGLEWVAVIWFEGSNKYYADSVKGRFTISRDNSKNTLYVQMNSLRAEDTAVYYCVRELGFSNDYWGQGTLVTVSS |
| | | | SEQ ID NO: 25264 | SEQ ID NO: 29270 |
| iPS:433971 | 21-225_46D4 | NA | GACATCCAGATGACCCAGTCTCCATCCTCCCTGTCTGCATCTGTAGGAGACAGAGTCACCATCACTTGCCGGGACAAGTCAGGACAGATTAGAAAAGTAGGGAAAGTTAGGCTGGTATCAGCAGAGAAAGTAGGGAAAGCCCCTAAGCGCCTGATCTATGCTGCATCCAGTTTGGAAAGTGGGGTCCCATCAAGGTTCAGCGGCCAGTGGATCTGGGACAGAGCCTGAAGATTTTGCAACTTATTACTGTCTACAGCATTATAGTTTCCCGTGGACGTTCGGCCAAGGGACCAAGGTGGAAATCAAA | CAGGTGCAGCTGGTGGTGGAGTCTGGGGGAGGCGTAGTCCAGCCTGGGAGGTCCCTGAGACTCTCCTGTCAGCGTCTGGATTCACCTTCAGTAGTAGTGTCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGTGAGAGTATATGGGACTCTAGCAGCAGTTGGTACGACTACGGTATGGACGTCTGGGGCCAAGGGACCACGGTCACCGTCTCCTCA |
| | | | SEQ ID NO: 25265 | SEQ ID NO: 29271 |

FIGURE 50
(Continued)

| | | | |
|---|---|---|---|
| iPS:433973 | 21-225_46A6 | AA | DIQMTQSPSSLSASVGDRVTITCRTSQDIRKDLG WYQQKVGKAPKRLIYAASSLESGVPSRFSGSGS GTEFTLTISSLQPEDFATYYCLQHYSFPWTFGQG TKVEIK<br>SEQ ID NO: 25266 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCARVPYSS SWYDYGMDVWGQGTTVTVSS<br>SEQ ID NO: 29272 |
| | | NA | GACATCCAGATGAACCAGTCTCCATCTTCCGT GTCTGCATCTGTAGGAGACAGAGTCAACATCA CTTGTCGGGCGAGTCAGGGTATTAGCAACTGG TTAGCCTGGTATCAGCAGAAACCAGGGAAAGT CCCTAAGCTCCTGATCTATGCTGCATCCAGTTT GCAAAGTGGGGTCCCATCAAGGTTCAGCGGCA GTGGATCTGGGACAGATTTCACTCTCACCATC AGCAACCTGCAGCCTGAAGATTTTGCAACTTA CTATTGTCAACAGACTAACAGTTTCCCGTGGA CGTTCGGCGGCCAAGGGACCAAGGTGAAATCAA A<br>SEQ ID NO: 25267 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTCGTGGTATT AACACATTCGACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGAAAGGA GTGGGAGCTATTTTGACTACTGGGGCCAGGGAAC CCTGGTCACCGTCTCCTCA<br>SEQ ID NO: 29273 |
| | | AA | DIQMNQSPSSVSASVGDRVNITCRASQGISNWLA WYQQKPGKVPKLLIYAASSLQSGVPSRFSGSGS GTDFTLTISNLQPEDFATYYCQQTNSFPWTFGQG TKVEIK<br>SEQ ID NO: 25268 | EVQLLESGGGLVQPGGSLRLSCAASGFTFSSYAMS WVRQAPGKGLEWVSAISRGRGINTFDADSVKGRFTI SRDNSKNTLYLQMNSLRAEDTAVYYCAKERSGSY FDYWGQGTLVTVSS<br>SEQ ID NO: 29274 |

FIGURE 50
(Continued)

| | | | | |
|---|---|---|---|---|
| iPS:433975 | 21-225_46C6 | NA | GACATCCAGATGACCCAGTCTCCATCCTCCCT GTCTGCATCTGTAGGAGACAGAGTCACCATCA CTTGCCGGGCAAGTCAGGACAGTCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA CA<br><br>SEQ ID NO: 25269 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT ACACTGGGTCCGCCAGGCTCCAGGCAAGGGCT GGAGTGGGTGGCAGTTATATGCAGACTCCGTGAAGGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGTAGG ATTTTCCAATGACTACTGGGGCCAGGGAACCCTG GTCACCGTCTCCTCA<br><br>SEQ ID NO: 29275 |
| | | AA | DIQMTQSPSSLSASVGDRVTITCRASQGIRNDLG WYQQKPGKAPKRLIY AASSLQSGVPSRFSGSGS GTEFTLTISSLQPEDFATYYCLQHNSYPLTFGGG TKVEIT<br><br>SEQ ID NO: 25270 | QVQLVESGGGVVQPGRSLRLSCAASGFTFSSYGIH WVRQAPGKGLEWVAVIWYDENNKYYADSVKGRF TISRDNSKNTLYLQMNSLRAEDTAVYYCARELGFS NDYWGQGTLVTVSS<br><br>SEQ ID NO: 29276 |
| iPS:433977 | 21-225_46D8 | NA | GACATCCAGATGACCCAGTCTCCATCCTCCCT GTCTGCATCTGTAGGAGACAGAGTCACCATCA CTTGCCGGGCAAGTCAGGACAGTCATTAGAAAGAT TTAGGCTGGTATCAGCAGAAAACCAGGGAAAG CCCCTAAGCGCCTGATCTATGCTGCATCCAGT TTGCAAAGTGGGGTCCCATCAAGGTTCAGTGG CAGTGGATCTGGGACAGAATTCAGTCTCACAA TCAGCAGCCTGCAGCCTGAAGATTTTGCAACT TATTACTGTCTACAGCATAATAGTTACCCTCTC ACTTTCGGCGGAGGGACCAAGGTGGAGATCA AG<br><br>SEQ ID NO: 25271 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGATTATGGCAT ACACTGGGTCCGCCAGGCTCCAGGCAAGGGCT GGAGTGGGTGGCAGTTATATGGTTTGAAGGAAGT AATAAATACTATGCAGATTCCGTGAAGGGCCGAT TCACCATCTCCAGAGACAATTCCAAGAACACGCT GTATGTGCAAATGAACAGCCTGAGAGCCGAGGA CACGGCTGTGTATTACTGTGTGAGAGAACTAGGA TTTTCAATGACTACTGGGGCCAGGGAACCCTGG TCACCGTCTCCTCA<br><br>SEQ ID NO: 29277 |

FIGURE 50
(Continued)

| | | | |
|---|---|---|---|
| | | AA | DIQMTQSPSSLSASVGDRVTITCRASQGIRKDLG WYQQKPGKAPKRLIYAASSLQSGVPSRFSGSGS GTEFSLTISSLQPEDFATYYCLQHNSYPLTFGGGT KVEIK | QVQLVESGGGVVQPGRSLRLSCAASGFTFSDYGIH WVRQAPGKGLEWVAVIWFEGSNKYYADSVKGRF TISRDNSKNTLYVQMNSLRAEDTAVYYCVRELGFS NDYWGQGTLVTVSS |
| | | | SEQ ID NO: 25272 | SEQ ID NO: 29278 |
| iPS:433979 | 21-225_46B9 | NA | GATATTGTGATGACCCAGACTCCACTCTCTCT GTCCGTCACCCTGGACAGCCGGCTCCATCT CCTGCAAGTCTAGTCAGAGCCTCCTGCATAGT GAGGGAAAGACCTATTTGTATTGGTACCTGCA GAAGCCAGGCCAGCCTCCACAGCTCCTGATCT ATGAAGTTTCTTACCGGTTCTCTGGAGTGCCA GATAGGTTCAGTGGCAGCGGGTCAGGACAG ATTTCACACTGAAAATCAGCCGGATGGAGGCT GAGGATGTTGGGGTTTATTACTGCATGCACAG TATACAGTATCCGCTCACGTTTGGCGGAGGGA CCAAGGTGGAGATCCAA | CAGGTGCAGCTGGTGGAGTCTGGGGGAGGCGTG GTCCAGCCTGGGAGGTCCCTGAGACTCTCCTGT CAGCGTCTGGATTCACCTTCAGTGACTATGGCAT GCACTGGGTCCGCCAGGCTCCAGGCAAGGGGCT GGAGTGGGTGGCAGTTATATCGAGACTCCGTGAAGG AATAAATACTATGCAGACTCCGTGAAGGGCCG AATCACCATCTCCAGAGACAATTCCAAGAACAC GCTGTATCTGCAAATGAACAGCTGAGAGCCGA GGACACGGCTGTGTATTACTGTGCGAGGCGGTAT AGCAGCAGCTGGATGGGAGGTATGACGTCTGG GGCCAAGGGACCACGGTCACCGTCTCCTCA |
| | | | SEQ ID NO: 25273 | SEQ ID NO: 29279 |
| | | AA | DIVMTQTPLSLSVTPGQPASISCKSSQSLLHSEGK TYLYWYLQKPGQPPQLLIYEVSYRFSGVPDRFSG SGSGTDFTLKISRMEAEDVGVYYCMHSIQYPLTF GGGTKVEIQ | QVQLVESGGGVVQPGRSLRLSCSASGFTFSSYGMH WVRQAPGKGLEWVAVIWYDGRNKYYADSVKGRI TISRDNSKNTLYLQMNSLRAEDTAVYYCARRYSSS WMGGMDVWGQGTTVTVSS |
| | | | SEQ ID NO: 25274 | SEQ ID NO: 29280 |

FIGURE 50
(Continued)

| | | | |
|---|---|---|---|
| iPS:433981 | 21-225_46E9 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTTCAGCATACTAGTTTCCCATTC ACTTTCGGCCCTGGGACCAAAGTGGATATCAA A | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GAACTGGATCCGCCAGGCTCCAGGGAAGGGGCT GGAGTGGGTTTCATACATTAATAGTAATGGTTTT ACCATATACTACGCAGACTCTGTGAAGGGCCGAT TCACCATCTCCAGGGACAACAGCCAAGAACTCACT GTATCTGCAAATGAACAGCCTGAGAGCCGAGGA CACGGCCGTGTATTACTGTGCGGCCGATACAATC TACTGGGGCCAGGGAACCCTGGTCACCGTCTCCT CA |
| | | | SEQ ID NO: 25275 | SEQ ID NO: 29281 |
| | | AA | DIQMTQSPSSLSASVGDRVTITCRASQGIRNDLG WYQQKPGKAPKRLIYAASSLQSGVPSRFSGSGS GTEFTLTVSSLQPEDFATYFCLQHTSFPFTFGPGT KVDIK | QVQLVESGGGLVKPGGSLRLSCAASGFTFSDYYMN WIRQAPGKGLEWVSYINSNGFTIYYADSVKGRFTIS RDNAKNSLYLQMNSLRAEDTAVYYCAADTIYWGQ GTLVTVSS |
| | | | SEQ ID NO: 25276 | SEQ ID NO: 29282 |
| iPS:433983 | 21-225_47A1 | NA | GACATCCAGATGACCCAGTCTCCATCCTCCCT GTCTGCATCTGTAGGAGACAGAGTCACCATCA CTTGCCGGGCAAGTCAGGACAGATTAGAAATGAT TTAGGCTGGTATCAGCAGAAACCAGGGAAAG CCCCTAAGCGCCTGATCTATGCTGCATCCAGTT TGCAAAGTGGGGTCCCATCAAGGTTCATTCAGTT AGTAGATCTGGGACAGAATTCACTCTCACAAT CAGCAGCCTGCAGCCTGAAGATTTTGCAACTT ATTACTGTCTGCAACATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAAGCTCCAGGCAAGGGCT GGAGTGGGTGGCAGTTATATGATGATGACTAT GGAAAAAGTATGCAGACTCCGTGAAGGGCCGA TTCACCATCTCCAGAGACAACAATGCCAAGAACGC TGTATCTGCAAGTGAACAGCCTGAGAGTCGAAG ACACGGCTGTGTATTACTGTGCACAGAACTGGG GATGCTCTTTGACTACTGGGGCCAGGGAACCCTG GTCACCGTCTCCTCA |
| | | | SEQ ID NO: 25277 | SEQ ID NO: 29283 |

FIGURE 50
(Continued)

| | | | |
|---|---|---|---|
| iPS:433985 | 21-225_47C1 | AA | DIQMTQSPSSLSASVGDRVTITCRASQDIRNDLGWYQQKPGKAPKRLIYAAFSLQSGVPSRFSGSRSGTEFTLTISSLQPEDFATYYCLQHNSYPLTFGGGTKVEIK<br>SEQ ID NO: 25278 | QVQLVESGGGVVQPGRSLRLSCAASGFTFSDYGMHWVRQAPGKGLEWVAVIWYDDYNKKYADSVKGRFTISRDNAKNTLYLQVNSLRVEDTAVYYCATELGMLFDYWGQGTLVTVSS<br>SEQ ID NO: 29284 |
| | | NA | GATATTGTGATGACCCAGACTCCACTCTCTCTGTCCGTCACCCCTGGACAGCCGGCCTCCATCTCCTGCAGGTCTAGTCAGAGCCTCCTGCATAGTGAAGGAAAGACCTATTTGTATTGGTACCTCCAGAAGCCAGGCCAGTCTCCACAGCTCCTGATCTATGAAGTTTCCAACCGGTTCTCTGGAGTGCCAGATAGGTTCAGTGGCAGCGGGTCAGGGACAGATTTCACACTAAAAATCAGCGGGTGGAGGCTGAGGATGTTGGGGTTTTTACTGTATGCAAAGTATACAGCTTCCGTGGACGTTCGGCCAAGGGACCAAGGTGGAAATCAAA<br>SEQ ID NO: 25279 | CAGGTGCAGCTGGTGGAGTCTGGGGGAGGCGTGGTCCAGCCTGGGAGGTCCCTGAGACTCTCGTGCAGCGTCTGATTCACCTTCAGTGACTATGGCATGCACTGGGTCCGCCAGACTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATTCCAAGAACACGCTGTTTCTGCAAATGAACAGCCTGAGAGACGAGGACACGGCTGTGTATTACTGTGCGAGACGGTATAGCCGCAGCTGGGTGGGAGGTATGGACGTCTGGGGCCAAGGGACCACGGTCACCGTCTCCTCA<br>SEQ ID NO: 29285 |
| | | AA | DIVMTQTPLSLSVTPGQPASISCTSSQSLLHSEGKTYLYWYLQKPGQPPQLLIYEVSNRFSGVPDRFSGSGSGTDFTLKISRVEAEDVGVFYCMQSIQLPWTFGQGTKVEIK<br>SEQ ID NO: 25280 | QVQLVESGGGVVQPGRSLRLSCAASGFTFSDYGMHWVRQTPGKGLEWVAVIWYDGSNKYADSVKGRFTISRDNSKNTLFLQMNSLRDEDTAVYYCARRYSRSWVGGMDVWGQGTTVTVSS<br>SEQ ID NO: 29286 |

FIGURE 50
(Continued)

| | | | |
|---|---|---|---|
| iPS:433987 | 21-225_47A5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGGTCCCATCAAGGTTCAGCGG CAGTGGATCTGGGACAGAATTCACTCTCACAA TCAGCAGCCTGCAGCCTGAAGATTTGCAACT TATTACTGTCTACAGCATAATAGTTACCCGCTC ACTTTCGGCGGAGGGACCAAGGTGGAGATCA AA |
| | | | SEQ ID NO: 25281 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK |
| | | | SEQ ID NO: 25282 |
| | | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACGATGACAC ACACTGGGTCCGCCAGGCTCCAGGCAAGGGCT GGAGTGGGTGGCAGTTATATGGTTTGATGAAGT AATAAATACTATGCAGACTCCGTGAAGGGCCGA TTCACCATCTCCAGAGACAATTCCAAGAACACGC TGTATCTGCAAATGAACAGCCTGAGCGCCGAGG ACACGGCTGTGTATTACTGTGCGAGAGATCTTAT AGCAGCAGCTGGTACAGTTGACTACTGGGGCCA GGGAACCCTGGTCACCGTCCTCCTCA |
| | | | SEQ ID NO: 29287 |
| iPS:433989 | 21-225_47C7 | AA | QVQLVESGGGVVQPGRSLRLSCAASGFTFSDDDTH WVRQAPGKGLEWVAVIWFDGSNKYYADSVKGRF TISRDNSKNTLYLQMNSLSAEDTAVYYCARDLIAA AGTVDYWGQGTLVTVSS |
| | | | SEQ ID NO: 29288 |
| | | NA | GAGGTGCAGCTGTTGGAGTCTGGGGGAGGCTTG GTACAGCCTGGGGGGTCCCTGAGACTCTCCTGTG CAGCCTCTGGATTCACCTTTAGTAACTATGCCAT GAGCTGGGTCCGCCAGGCTCCAGGGAAGGGGCT GGAGTGGGTCTCAGTTATTAGTGGTAGTGGTAGT CGCACATACTACCAGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGATCGGG GGCAGTGGCTCATAGGCGGTATGACGTCTGGG GCCAAGGGACCACGGTCACCGTCTCCTCA |
| | | | SEQ ID NO: 29289 |

FIGURE 50
(Continued)

| | | | | |
|---|---|---|---|---|
| iPS:433991 | 21-225_47E7 | AA | DIVMTQSPLSPPVTPGEPASISCRSSQSLLHSNGY NYLEWYLQKSGQSPQFLIYLGFNRASGVPDRFT GSGSGTDFTLKISRVEAEDVGVYYCMQVLQTPF TFGPGTKVDIK<br>SEQ ID NO: 25284 | EVQLLESGGGLVQPGGSLRLSCAASGFTFSNYAMS WVRQAPGKGLEWVSGISGSGSRTYYADSVKGRFTI SRDNSKNTLYLQMNSLRAEDTAVYYCAKDRGQW LIGGMDVWGQGTTVSS<br>SEQ ID NO: 29290 |
| | | NA | GATATTGTGATGACCCAAACTCCACTCTCTCT GTCCGTCACCCTGGACAGCCGGCCTCCATCT CCTGCAAGTCTAGTCAGAGCCTCCTGCATAGT GATGGAAGGACCTATTTGTATTGGTACCTGCA GAAGCCAGGCCAGTCCACAGCTCCTGATCT ATGAAGTTTCCAGCCGGGTTCTCTGGAGTGCCA GATAGGTTCAGTGGCAGCGGGTCAGGACAG ATTTCGCACTGAAAATCAGCCGGGTGAGGCT GAGGATGTTGGGGTTTATTACTGCATGCAAAG TACACAACTTCCGTGACGTTCGGCCAAGGGA CCAAGGCGGAAATCAAA<br>SEQ ID NO: 25285 | CAGGTGCAGCTGTGGTGGAGTCTGGGGGAGGCGTG GTCCAGCCTGGGGAGGTCCCTGAGACTCTCCTGTG CAGCGTCTGAGATTCACCTTCAGTAGTAACGCTATGAGCTG GCACTGGGTCCGCCAGGCTCCAGGCAAGGGGCT GGAGTGGGTGGCAGTTATATGCAGATCCGTGAAGGGCCGA AATAAATACTATGCAGACTCCGTGAAGGGCCGA TTCACCATCTCCAGAGACAACATTCCAAGAACACGC TGTATCTTCAAATGAACAGCCTGAGAGCCGAGG ACACGGCTGTGTATTACTGTGCGAGACGGTATAG CAGAAGCTGGGTGGGAGGTATGGACGTCTGGGG CCAAGGGACCACGGTCACCGTCTCCTCA<br>SEQ ID NO: 29291 |
| | | AA | DIVMTQTIPLSLSVTPGQPASICKSSQSLLHSDGR TYLYWYLQKPGQPPQLLIYEVSSRFSGVPDRFSG SGSGTDFALKISRVEAEDVGVYYCMQSTQLPWT FGQGTKAEIK<br>SEQ ID NO: 25286 | QVQLVESGGGVVQPGRSLRLSCAASGFTFSIYGMH WVRQAPGKGLEWVAVIWYDGSNKYYADSVKGRF TISRDNSKNTLYLQMNSLRAEDTAVYYCARRYSRS WVGGMDVWGQGTTVTVSS<br>SEQ ID NO: 29292 |

FIGURE 50
(Continued)

| | | | |
|---|---|---|---|
| iPS:433993 | 21-225_47G7 | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTTTGCTGCCTCCAATT TGCAAAGTGGGGTCCCATCAAGGTTCAGCGGC AGTGGATCTGGGACAGATTTCACTCTCACCAT CAGCAGTCTGCAGCCTGCAGATTTGCAACTT ACTGTTGTCAACAGGTTAACAGTTCCCGTGG ACGTTCGGCCAAGGGACCAAGGTGGAAATCA AA |
| | | | SEQ ID NO: 25287 |
| | | AA | DIQMTQSPSSVSASVGDRVTITCRASQGISNWLA WYQQKPGKAPKLLIFAASNLQSGVPSRFSGSGS GTDFTLTISSLQPADFATYCCQQVNSFPWTFGQG TKVEIK |
| | | | SEQ ID NO: 25288 |
| iPS:433995 | 21-225_47H7 | NA | GACATCCAGATGACCCAGTCTCCATCTCTCCT GTCTGCATCTGTAGGAGACAGAGTCACCATCA CTTGCCGGACAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCCACTCTCACAG TCAGCAGCCTGCAGCCTGAAGATTTTGCAACT TATTTCTGTCTACAACATACTAGTTTCCCATTC ACTTTCGGCCCTGGGACCAAAGTGGATATCAA A |
| | | | SEQ ID NO: 25289 |

| | | | |
|---|---|---|---|
| | | | GAGGTGCAGTTGTTGGACTCTGGGGGAGGCTTGG TGCAGCCTGGGGGGTCCCTGAGACTCTCCTGTGC AGCCTCTGGATTCACCTTTAGCAGCTATGCCATG AGTTGGGTCCGCCAGGCTCCAGGGAAGGGGCTG GAGTGGGTCTCAGCTATTAGTGGTCGTGGTGTA ACACATTCTACGCAGAGTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAGATTATCCGG AGCAGIGGCCTTIGACTACTGGGGCCAGGGAA CCCTGGTCACCGTCTCCTCA |
| | | | SEQ ID NO: 29293 |
| | | | EVQLLDSGGGLVQPGGSLRLSCAASGFTFSSYAMS WVRQAPGKGLEWVSAISGRGGNTFYAESVRGRFTI SRDNSKNTLYLQMNSLRAEDTAVYYCAKIIREQWA FDYWGQGTLVTVSS |
| | | | SEQ ID NO: 29294 |
| | | | CAGGTGCAGTGTGGTGGAGTCTGGGGGAGGCTTG GTCAAGCCTGGAGGGTCCCTGAGACTCTCCTGTG CAGCCTCTGGATTCACCTTCAGTGACTGACTACAT GATCTGGATCCGCCAGGCTCCAGGGAAGGGGCT GGAGTGGGTTTCATACATTAATAGTAATGGTTTT ACCAAATACTACGCAGACTCTGTGAAGGGCCGA TTCACCATCTCCAGAGACAACGCCAAGAATTCAC TGTATCTGCAAATGAACAGTCTGAGAGCCGAGG ACACGGCCGTGTATTACTGTGCGCGATACAGT CTACTGGGGCCAGGGAACCCTGGTCACCGTCTCC TCA |
| | | | SEQ ID NO: 29295 |

FIGURE 50
(Continued)

| | | | |
|---|---|---|---|
| iPS:433997 | 21-225_48C1 | AA | DIQMTQSPSSLSASVGDRVTITCRTSQGIRNDLG WYQKKPGKAPKRLIYAASSLQSGVPSRFSGSGS GTEFTLTVSSLQPEDFATYFCLQHTSFPFTFGPGT KVDIK<br><br>SEQ ID NO: 25290 | QVQLVESGGGLVKPGGSLRLSCAASGFTFSDYYMI WIRQAPGKGLEWVSYINSNGFTKYYADSVKGRFTI SRDNAKNSLYLQMNSLRAEDTAVYYCAADTVYW GQGTLVTVSS<br><br>SEQ ID NO: 29296 |
| | | NA | GACATCCAGATGACCCAGTCTCCATCCTCCCT GTCTGCATCTGTAGGAGACAGAGTCACCATCA CTTGCCGGACAAGTCAGGGCATTAGAAATGAT TTAGGCTGGTATCAGCAGAAACCAGGAAAG CCCCTAAGCGCCTGATCTATGCAGCATCCAGT TTGCAAAGTGGGGTCCCAGCAAGGTTCAGCGG CAGTGGATCTGGGACAGAATTCACTCTTACAA TCAGCAGCCTGCAGCCTGAAGATTTTGCAATT TATTACTGTCTACAGCATATAATTTTACCCGTGG ACGTTCGGCCAAGGGACCAAGGTGGAAATCA AA<br><br>SEQ ID NO: 25291 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTGTATGGTATGATGAAATT GGAAGTAATAAAAAGTATGCAGACTCCGTGAAGGGCCGA GTCACCATCTCCAGAGACAATTCCAAGAACACGC TGTATCTGCAAATGAACAGCCTGAGAGCCGAGG ACACGGCTATGTATTACTGTGCGAGAGAATTAGG GTGGGAGGCTGACTACTGGGGCCAGGGAACCCT GGTCACCGTCTCCTCA<br><br>SEQ ID NO: 29297 |
| | | AA | DIQMTQSPSSLSASVGDRVTITCRTSQGIRNDLG WYQQKPGKAPKRLIYRASSLQSGVPARFSGSGS GTEFTLTISSLQPEDFAIYYCLQHNFYPWTFGQG TKVEIK<br><br>SEQ ID NO: 25292 | QVQLVESGGGVVQPGRSLRLSCAASGFTFSSYGMH WVRQAPGKGLEWVAVVWYDEINKKYADSVKGRV TISRDNSKNTLYLQMNSLRAEDTAMYYCARELGW EADYWGQGTLVTVSS<br><br>SEQ ID NO: 29298 |

FIGURE 50
(Continued)

| | | | |
|---|---|---|---|
| iPS:433999 | 21-225_48D1 | NA | GACATCCAGATGACCCAGTCTCCATCCTCCCT GTCTGCGTCTGTAGGAGACAGAGTCAACATCA CTTGCCGGGCAAGTCAGAGACATTAGCAGTTAT TTAATTTGGTATCAGCAGAAACCAGGGAAAGC CCCTAAGCTCCTGATCTATGCTGCATCCAGTTT GCAAAGTGGGGTCCCATCAAGGTTCAGTGCCA GTGGATCTGGGACAGATTTCACTCTCACCATC AGCAGTCTGCAACCTGAAGATTTTGCAAGTTA CTACTGTCAACAGAGTAACAGTATTCCATTCA CTTTCGGCCCTGGGACCAAAGTGGATATCAAA | GAGGTGCAGCTGTTGGAGTCTGGGGGAGGCTTG GTACAGCCTGGGGGGTCCCTGAGACTCTCCTGTG CAGCCCTCTAGATTCACCTTTAGCAGTTATGCCAT GAGCTGGGTCCGCCAGGCTCCAGGGAAGGGCT GGAGTGGGTCTCAGTTATTAGTGGTCGTGGTGGT AGCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGCGTCGTATAGCA GTGGCTGGAATGAGGCTTTTGATATCTGGGGCC AAGGGACAATGGTCACCGTCTCTTCA |
| | | | SEQ ID NO: 25293 | SEQ ID NO: 29299 |
| | | AA | DIQMTQSPSSLSASVGDRVNITCRASQSISSYLIW YQQKPGKAPKLLIYAASSLQSGVPSRFSASGSGT DFTLTISSLQPEDFASYYCQQSNSIPFTFGPGTKV DIK | EVQLLESGGGLVQPGGSLRLSCAASRFTFSSYAMS WVRQAPGKGLEWVSVISGRGGSTFYADSVKGRFTI SRDNSKNTLYLQMNSLRAEDTAVYYCARRIAVAG NEAFDIWGQGTMVTVSS |
| | | | SEQ ID NO: 25294 | SEQ ID NO: 29300 |
| iPS:434001 | 21-225_48F2 | NA | GACATCCAGATGACCCAGTCTCCATCCTCCCT GTCTGCATCTGTAGGAGACAGAGTCACCATCA CTTGCCGGGCAAGTCGGGGCATTAGAGATGAT TTAGGCTGGTATCAACAGAAACCAGGGAAAC CCCCTAAGCGCCTGATCTATGCTGCATCCAGT TTGCAAAGTGGGGTCCCATCAAGGTTCAACGG CAGTGGATCTGGGACAGATTTCACTCTCACAA TCAGCAGCCTGCAGTCTGAAGATCTGCAACT TATTACTGTCTACAGCACAATATAGTTATCTCGG ACGTTCGGCCAAGGGACCAAGGTGAAATCA AA | CAGGTGCAGCTGGTGGAGTCTGGGGGAGGCGTG GTCCAGCCTGGGAGGTCTCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATATGCAGATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAGGTA TAGCAGCAGCTGGTACGACTACGGTCTGGACGTC TGGGGCCAAGGGACCACGGTCACCGTCTCCTCA |
| | | | SEQ ID NO: 25295 | SEQ ID NO: 29301 |

FIGURE 50
(Continued)

| | | | | |
|---|---|---|---|---|
| iPS:434003 | 21-225_48C3 | AA | DIQMTQSPSSLSASVGDRVTITCRASRGIRDDLG WYQQKPGKPPKRLLIYAASSLQSGVPSRFNGSGS GTEFTLTISSLQSEDLATYYCLQQYSYPRTFGQG TKVEIK | QVQLVESGGGVVQPGRSLRLSCAASGFTFSNYM HWVRQAPGKGLEWVAVIWYDGSNKYYADSVKGR FTISRDNSKNTLYLQMNSLRAEDTAVYYCARERYS SSWYDYGLDVWGQGTTVTVSS |
| | | | SEQ ID NO: 25296 | SEQ ID NO: 29302 |
| | | NA | GACATCCAGATGACCCAGTCTCCATCCCCT GTCTCGCGTCTGTAGGAGACAGAGTCAACATCA CTTGCCGGGCAAGTCAGAGCATTATCAGTTAT TTAATTGGTATCAGCAGAAACCAGGGAAAGC CCCTAGGCTCCTGATCTATGCTGCATCCAGTTT GCAAAGTGGGGTCCCATCAAGGTTCAGTGCCA GTGGATCTGGGACAGAGATTCACTCTCACCATC AGCAGTCTGCAACCTGAAGATTTTGCAAGTTA CTACTGTCAACAGACTAACAGTATTCCATTCA CTTTCGGCCCTGGGACCAAAGTGGATATCAAA | GAGGTGCAGCTGTTGGAGTCTGGGGGAGGCTTG GTACAGCCTGGGGGGTCCCTGAGACTCTCCTGTG CAGCCTCTAGATTCACCTTTAGCAGTTATGCCAT GAGCTGGGTCCGCCAGGCTCCAGGGAAGGGGCT GGAGTGGGTCTCAGTTATTAGTGGTCGTGGTGGT AGCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGCGTCGTATAGCA GTGGCTGGGAATGAGGCTTTTGATATCTGGGGCC AAGGGACAATGGTCACCGTCTCTTCA |
| | | | SEQ ID NO: 25297 | SEQ ID NO: 29303 |
| | | AA | DIQMTQSPSSLSASVGDRVNITCRASQSIISYLIW YQQKPGKAPRLLIYAASSLQSGVPSRFSASGSGT DFTLTISSLQPEDFASYYCQQTNSIPFTFGPGTKV DIK | EVQLLESGGGLVQPGGSLRLSCAASRFTFSSYAMS WVRQAPGKGLEWVSVISGRGGSTFYADSVKGRFTI SRDNSKNTLYLQMNSLRAEDTAVYYCARRIAVAG NEAFDIWGQGTMVTVSS |
| | | | SEQ ID NO: 25298 | SEQ ID NO: 29304 |

FIGURE 50
(Continued)

| | | | |
|---|---|---|---|
| iPS:434007 | 21-225_48D7 | NA | GACATCCAGATGACCCAGTCTCCATCTTCCGT GTCTGCATCTGTAGGAGACAGAGTCACCATCA CTTGTCGGGCGAGTCAAAATATTACCAGCTGG TTAGCCTGGTATCAGCAGAAACCAGGGAAAG CCCCTAAGCTCCTGATCTATAGTGCATCCAGTT TGCAAAATGGGGTCCCATCAAGGTTCAGCGGC AGTGGATCTGGGACAGATTTCACTCTCACCAT CAGCAGCCTGCAGCCTGAAGATTTTGTAACTT ACTGTTGTCAACAGGCTAACAGTTTCCCGTGG ACGTTCGGCCAAGGGACCAAGGTGGAAATCA AA SEQ ID NO: 25299 | GAGGTGCAGCTGTTGGAGTCTGGGGAGGCTTG GTACAGCCGGGGGGGTCCCTGAGACTCTCCTGTG CAGCCTCTGGATTCACCTTTAGAAACTCTGCCAT GAACTGGGTCCGCCAGGCTCCAGGGAAGGGGCT GGAGTGGGTCTCAGTATTAGTGGTAGTGGTGGT ACCACATTCTACGCAGACTCCGTGAAGGGCCGGT TCACCATCTCCAGAGACAATTCCAAGAACACGTT GTATCTGCAAATAAAACAGCTGAGAGCCGAGGA CACGGCCGTATATTACTGTGCGAAATGTGGGCGG GAGCAGTGGCTTGACTACTGGGGCCAGGGAACC CTGGTCACCGTCTCCTCA SEQ ID NO: 29305 |
| | | AA | DIQMTQSPSSVSASVGDRVTITCRASQNITSWLA WYQQKPGKAPKLLIYSASSLQNGVPSRFSGSGS GTDFTLTISSLQPEDFVTYCCQQANSFPWTFGQG TKVEIK SEQ ID NO: 25300 | EVQLLESGGGLVQPGGSLRLSCAASGFTFRNSAMN WVRQAPGKGLEWVSAISGSGGTTFYADSVKGRFTI SRDNSKNTLYLQINSLRAEDTAVYYCAKCGREQW LDYWGQGTLVTVSS SEQ ID NO: 29306 |
| iPS:434009 | 21-225_48A9 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGAATTCACTCTCACTAT ATTACTGTCTACAGCATAATCGTTACCCGTGG ACGTTCGGCCAAGGGACCAAGGTGGAAATCA AA SEQ ID NO: 25301 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCCCCAGGCAAGGGGCT GGAGTGGGTGGCAGTTATATGGTATGAGGAAAA TAAGAAATACTATGCAGACTCCGTGAAGGGCCG ATTCACCATCTCCAGAGACAATTCCAAGAACACG CTGTTTCTGCAAATGAATAGCCTGAGAGCCGAGG ACACGGCTATGTATTTCTGTGCGAGAGAACTTGC CTGTACGAGGACTACTGGGGCCAGGGAACCCT GGTCACCGTCTCCTCA SEQ ID NO: 29307 |

FIGURE 50
(Continued)

| | | | |
|---|---|---|---|
| iPS:434011 | | AA | DIQMTQSPSSLSASVGDRVTITCRASQGIRNDLGWYQQKPGKAPKRLIYIASSLQSGVPSRFSGSGSGTEFTLTISGLQPEDFAIYYCLQHNRYPWTFGQGTKVEIK<br>SEQ ID NO: 25302 | QVQLVESGGGVVQPGRSLRLSCAASGFTFSSYGMHWVRQAPGKGLEWVAVIWYEENKKYYADSVKGRFTISRDNSKNTLFLQMNSLRAEDTAMYFCARELAWYEDYWGQGTLVTVSS<br>SEQ ID NO: 29308 |
| | | NA | GACATCCAGATGACCCAGTCTCCATCCTCCTGTCTGCGTCTGTAGGAGACAGAGTCACCATCACTTGCCGGGCAAGTCAGAGCATTAGGAAGTATTTAAATTGGTATCAGAGAAGACACCAGGGAAAGCCCCTAAACTCCTGATCTATGCTGCTTCCAGTTTGCAAAGTGGGGTCCCATCAAGGTTCAGTGGCAGTGGATCTGGGACAGATTTCACTCTCACCATCAGCAGTCTGCAACTGAAGATTTTGCAACTTACTACTGTCAACAGAGACTTACAGTAACCCACTCACTTTCGGCGGAGGGACCAAGGTGGAGTTCACA<br>SEQ ID NO: 25303 | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTTCATGACCTGGATCCGCCAGGCTCCAGGGCAGGGGCTGGAGTGGGTTCATACATCAGACTCTGTGAAGGCCGATGCCAATACTACGACTCTGTGAAGGCCGATTCACCATCTCCAGGGACAACGCCAAAACTCACTGTATCTGCAAATGAACAGCCTGAGAGCCGAGGACACGGCCGTGTATTACTGTGCAATAGCAGTGGCTGCCCCTGGTGTTTTGATATCTGGGGCCAAGGGACAATGGTCACCGTCTCCTCA<br>SEQ ID NO: 29309 |
| 21-225_48B10 | | AA | DIQMTQSPSSLSASVGDRVTITCRASQSIRKYLNWYQKTPGKAPKLLIYAASSLQSGVPSRFSGSGSGTDFTLTISSVQPEDFATYYCQQTYSNPLTFGGGTKVEFT<br>SEQ ID NO: 25304 | QVQLVESGGGLVKPGGSLRLSCAASGFTFSDYFMTWIRQAPGQGLEWVSYISSAGGAIYYADSVKGRFTISRDNAKNSLYLQMNSLRAEDTAVYYCAIAVAAPGVFDIWGQGTMVTVSS<br>SEQ ID NO: 29310 |

FIGURE 50
(Continued)

| | | | |
|---|---|---|---|
| iPS:434013 | 21-225_48D12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTT TGCAAAGTGGGGTCCCATCAAGGATCAGCGGC AGTGGATCTGGGACAGAATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA AA SEQ ID NO: 25305 | CAGGTGCAGCTGGTGGAGTCTGGGGAGGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAGGGGCCT GGAGTGGGTGGCAGTTATATGTATGATGGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG ATGAGATCTGACTACTGGGGCCAGGGAACCCTG GTCACCGTCTCCTCA SEQ ID NO: 29311 |
| | | AA | DIQMTQSPSSLSASVGDRVTITCRASQGIRNDLG WYQQKPGKAPKRLIYAASTLQSGVPSRISGSGSG TEFTLTISSLQPEDFATYYCLQHNSYPLTFGGGT KVEIK SEQ ID NO: 25306 | QVQLVESGGGVVQPGRSLRLSCAASGFTFSDYGM HWVRQAPGRGLEWVAVIWYDVSNKYYVDSVKGR FTISRDNSKNTLYLQMNSLRAEDTAVYYCARELGM RSDYWGQGTLVTVSS SEQ ID NO: 29312 |
| iPS:434015 | 21-225_48F12 | NA | GACATCCAGATGACCCAGTCTCCATCCTCCCT GTCTGCGTCTGTAGGAGACAGAGTCACCATCA CTTGCCGGGCAAGTCAGGGCATTAGAAGTAT TAAATTGGTATCAGCAGAAGACACCAGGGAAAG CCCCTAAACTCTTGATCTATGCTGCTTCCAGTT TGCAAAGTGGGGTCCCATCAAGGTTCAGTGGC AGTGGATCTGGGACAGATTTCACTCTCACCAT CAGCAGTCTGCAACAGACTTACAGTAACCCGCTC ACTTTCGGCGGAGGGACCAAGGTGGAGATCA CA SEQ ID NO: 25307 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTTCAT GACCTGGATCCGCCAGGCTCCAGGGCAGGGGCT GGAGTGGGTTCATCATACGCAGAGTAGTAGTGGT GCCATATACTACGCAGACACCGCCAAGAACTACT TCACCATCTCCAGGGACAACGCCTGAGAGCCGAGGA CGTTTCTGCAAATGAACAGCCTGTATAGCAGTGGCT GCCCCTGGTGCTTTGATATCTGGGGCCAAGGGA CATTGGTCACCGTCTCTTCA SEQ ID NO: 29313 |

FIGURE 50
(Continued)

| | | | | |
|---|---|---|---|---|
| iPS:434017 | | AA | DIQMTQSPSSLSASVGDRVTITCRASQSIRKYLN WYQKTPGKAPKLLIYAASSLQSGVPSRFSGSGSG TDFTLTISSLQPEDFANYYCQQTYSNPLTFGGGT EVEIT | QVQLVESGGGLVKPGGSLRLSCAASGFTFSDYFMT WIRQAPGQGLEWVSYISSAGGAIYYADSVKGRFTIS RDNAKNSLFLQMNSLRAEDTAVYYCAIAVAAPGA FDIWGQGTLVTVSS |
| | | | SEQ ID NO: 25308 | SEQ ID NO: 29314 |
| | 21-225_48G12 | NA | GACATCCAGATGACCCAGTCTCCATCCTCCCT GTCTGCGTCTGTAGGAGACAGAGTCACCATCA CTTGCCGGGCAAGTCAGAGCATTAGGAAGTAT TTAAATTGGTATCAGAAGACACCAGGAAAG CCCCTAAACTCTTGATATATGCTGCTTCCAGTT TGCAAAGTGGGGTCCCATCAAGGTTCAGTGGC AGTGGATCTGGGACAGATTTCACTCTCACCAT CAGCAGTGTGCAACCTGAAGATTTTGCAAATT ATTACTGTCAACAGACTTACAGTAACCCGCTC ACTTTCGGCGGAGGGACCGAGGTGGAGATCA CA | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTTCAT GACCTGGATCCGCCAGGCTCCAGGGCAGGGGCT GGAGTGGGTTCATATACGAGACTGTGTGGTGGT GCCATATACTACGCAGACTCTGTGAAGGGCCGAT TCACCATCTCCAGGGACAACGCCAAGAACTCACT GTTTCTGCAAATGAACAGCCTGAGAGCCGAGGA CACGGCCGTGTATTACTGTGCTATAGCAGTGGCT GCCCCTGGTGCTTTGATATCTGGGGCCAAGGGA CATTGGTCACCGTCTCTTCA |
| | | | SEQ ID NO: 25309 | SEQ ID NO: 29315 |
| | | AA | DIQMTQSPSSLSASVGDRVTITCRASQSIRKYLN WYQKTPGKAPKLLIYAASSLQSGVPSRFSGSGSG TDFTLTISSVQPEDFANYYCQQTYSNPLTFGGGT EVEIT | QVQLVESGGGLVKPGGSLRLSCAASGFTFSDYFMT WIRQAPGQGLEWVSYISSAGGAIYYADSVKGRFTIS RDNAKNSLFLQMNSLRAEDTAVYYCAIAVAAPGA FDIWGQGTLVTVSS |
| | | | SEQ ID NO: 25310 | SEQ ID NO: 29316 |

FIGURE 50
(Continued)

| | | | |
|---|---|---|---|
| iPS:434019 | 21-225_49A1 | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAGAT AATAAATATTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACTGGGG TTCCTCTGACTACTGGGGCCAGGGAACCCTGG TCACCGTCTCCTCA SEQ ID NO: 29317 |
| | | AA | DIQMTQSPSSLSASVGDRVTITCRASQGIRNDLD WYQQKPGKAPKRLIYAASSLQSGVPSRFSGSGS GTEFTLTISSLQPEDFATYYCLQHNSYPLTFGGG TKVEIK SEQ ID NO: 25311 | QVQLVESGGGVVQPGRSLRLSCAASGFTFSDYGM HWVRQAPGKGLEWVAVIWYDEDNKYYVDSVKGR FTISRDNSKNTLYLQMNSLRAEDTAVYYCARELGF LSDYWGQGTLVTVSS SEQ ID NO: 29318 |
| iPS:434021 | 21-225_49C1 | NA | GATATTGTGATGACCCAGACTCCACTCTCT GTCCGTCACCCTGGACAGCCGGCCTCCATCT CCTGCAAGTCTAGTCAGAGCCTCCTGCATAGG GAAGGAAAGACCTATTTGTATTGGTACCTGCA GAAGCCAGGCCAGGCTCCACAGTTCCTGATCT TTGAAGTTTCCCACCGGTTCTCTGGCGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGATTCCGATCACCCTCGGCCAAGGGA CACGACTGGAGATTAAAA SEQ ID NO: 25313 | CAGGTGCAGCTGGTGGAGTCTGGGGGAGGCGTG GTCCAGCCTGGGAGGTCCCTGAGACTCTCCTGTA CAGCGTCTGGATTCACCTTCAGTAGTATGGCAT GCACTGGGTCCGCCAGGCTCCAGGCAAGGGGCT GGAGTGGGTGGCAGTTATATGTGGTATGATGAAGT AATAAATACTATGCAGACTCCGTGAAGGGCCGA TTCACCATCTCCAGAGACACAATTCCAAGAACACGC TGTATCTGCAAATGAACAGCCTGAGAGCCGAGG ACACGGCTGTGTATTACTGTGCGAGAAGGTATAG CAGCAGCTGGTCGGGCGGTATGGACGTCTGGGG CCAAGGGACCACGGTCACCGTCTCCTCA SEQ ID NO: 29319 |

FIGURE 50
(Continued)

| | | | |
|---|---|---|---|
| iPS:434023 | 21-225_49F1 | AA | DIVMTQTPLSLSVTPGQPASISCKSSQSLLHREGK TYLYWYLQKPGQAPQFLIFEVSHRFSGVPDRFSG SGSGTDFTLKISRVEAEDVGVYYCMQSIQIPITLG QGTRLEIK<br>SEQ ID NO: 25314 | QVQLVESGGGVVQPGRSLRLSCTASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTSS<br>SEQ ID NO: 29320 |
| | | NA | GACATCCAGATGACCCAGTCTCCATCTTCCGT GTCTGCATCTGTAGGAGACAGAGTCACCATCA CTTGTCGGGCGAGTGCAGTCGGATATTAACGGCTGG TTAGCCTGGTATCAGCAGAAACCAGGGAAAG CCCCTAAGCTCCTGATCTATACTGTCTCCAGTT TGCAAAGTGGGGTCCCATCAAGGTTCAGCGGC AGTGGATCTGGGACAGAGCCTGAAGATTCACTCTCACCAT CAGCAGCCTGCAGCCTGAAGATTTTGCAACTT ACTATTGTCAACAGTCTAACAGTTCCCATTCA CTTTCGGCCCTGGGACCAAAGTGGATATCAAA<br>SEQ ID NO: 25315 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGACTGGGTCTCAGTTATTAGTGGTAGTGGTGGT AGCACATTCTACGCAGACTCCGTGAAGGCCGGT TCACCATCTCCAGAGACAATTCCAAGAGCACGCT GTATCTGCAAATGAACAGCCTGAGAGCCGAGGA CACGGCCGTATATTATTGTGCGAGCGCTATAGCA CGGGCTGGTGCCCACTATTTTGACTACTGGGGCC AGGGAACCCTGGTCACCGTCTCCTCA<br>SEQ ID NO: 29321 |
| | | AA | DIQMTQSPSSVSASVGDRVTITCRASRDINGWLA WYQQKPGKAPKLLIYTVSSLQSGVPSRFSGSGSG TDFTLTISSLQPEDFATYYCQQSNSFPFTFGPGTK VDIK<br>SEQ ID NO: 25316 | EVQLLESGGGLVQPGGSLRLSCAASGFTFSSYAMS WVRQAPGKGLDWVSVISGSGGSTFYADSVKGRFTI SRDNSKSTLYLQMNSLRAEDTAVYYCASAIAAAGA HYFDYWGQGTLVTVSS<br>SEQ ID NO: 29322 |

FIGURE 50
(Continued)

| | | | |
|---|---|---|---|
| iPS:434025 | 21-225_49G3 | NA | GATATTGTGATGACCCAGACTCCACTCTCTCT GTCCGTCACCCCTGGACAGCCGGCCTCCATGT CCTGCAAGTCTAGTCAGAGCTCCTGCATAGT GAAGGAAAGACCTATTTGTATTGGTACCTGCA GAAGACAGGCCAGCTCCACACCTCCTGATCT ATGAAGTTTCCAACCGCTCTCTGGCGTGCCA GATAGGTTCAGTGGCAGCGGTCAGGACAG ATTTCACACTGAAAATCAGCCGATGGAGGCT GAGGATGTTGGGGTTTATTTCTGCATGCAAAG TATGCAGCTTCCGATCACCTTCGGCCAGGGGA CACGACTGGAGAGATTAAA<br><br>SEQ ID NO: 25317 |
| | | AA | DIVMTQTPLSLSVTPGQPASMSCKSSQSLLHSEG KTYLYWYLQKTGQPPHLLIYEVSNRLSGVPDRF SGSGSGTDFTLKISRMEAEDVGVYFCMQSMQLP ITFGQGTRLEIK<br><br>SEQ ID NO: 25318 |
| | | NA | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCGGGCGGAATGGACGTCTGGGG CCAAGGGACCACGGTCACCGTCTCCTCA<br><br>SEQ ID NO: 29323 |
| iPS:434027 | 21-225_49H5 | AA | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br><br>SEQ ID NO: 29324 |
| | | NA | GACATCCAGATGACCCAGTCTCCATCTTCCGT GTCTGCATCTGTAGGAGACAGAGTCACCATCA CTTGTCGGGCGAGTCAGGGTTTTAGCAGCTGG TTAGCCTGGTTTCAGCAGAAACCAGGGAAAGC CCCTAAGTCTCTGATCTATGCTGCATCCAGTTT GCAAGATGGGGTCCCATCAAGGTTCAGCGGCA GTGGATCTGGGACAGATTTCACTCTCACCATC AGCAGCCTGCAGCCTGAAGATTTGCAACTTA CTATTGTCAACAGACTAACAGTTTCCCGTTCA CTTTCGGCCCTGGGACCAAAGTGGATATCAAA<br><br>SEQ ID NO: 25319 |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GACCTGGGTCCGCCAGACTCCAGGGAAGGGGCT GGAGTGGGTCTCAGCTATTAGTGGTGGTAGTGGT AACTCATTCTACGCAGACTCCGTGAAGGGCCGGT TCACCATCTCCAGAGACAATTCCGAGAACACGTT GTATCTGCAAATGAACAGCCTGAGAGCCGAGGA CACGGCCGTATATTACTGTGCGAAAGCAAGGCC AGTGGCTGGGTCACACTGGTTCGACCCTGGGGC CAGGGAACCCTGGTCACCGTCTCCTCA<br><br>SEQ ID NO: 29325 |

FIGURE 50
(Continued)

| | | | |
|---|---|---|---|
| iPS:434029 | 21-225_49C6 | AA | DIQMTQSPSSVSASVGDRVTITCRASQGFSTWLA WFQQKPGKAPKLLIY AASSLQDGVPSRFSGSGS GTDFTLTISSLQPEDFATYYCQQTNSFPFTFGPGT KVDIK<br>SEQ ID NO: 25320 | EVQLLESGGGLVQPGGSLRLSCAASGFTFSSYAMT WVRQTPGKGLEWVSAISGSGGNSFYADSVKGRFTI SRDNSENTLYLQMNSLRAEDTAVYYCAKARAVAG SHWFDPWGQGTLVTVSS<br>SEQ ID NO: 29326 |
| | | NA | GACATCCAGATGACCCAGTCTCCATCCTCCCT GTCTGCATCTGTCGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGTTTCCCATCAAGGTTCAGCGG CAGTGGATCTGGGACAGATTCACTCTCACAA TCAGCAGCCTGCAGCCTGAAGATTTTGCAACT TATTACTGTCTACAGACATATAGTTACCCCTCTC ACTTTCGGCGGAGGGACCAAGGTGGAGATCA AA<br>SEQ ID NO: 25321 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAACTATGCCAT GCACTGGGTCCGCCAGGCTCCAGGCAAGGGGCT GGAGTGGGTGGCAGTTATATGTAGACTCCGTGAAGGGCCGA AATAAAAGTATGTAGACTCCGTGAAGGGCCGA TTCACCATCTCCAGAGACAATTCCAAGAACACGC TGTATCTGCAAATGAGCAGCCTGAGAGCCGAGG ACACGGCTGTGTATTATTGTGCGAGAGATCTGGG GATGATCGAGGACTACTGGGGCCAGGGAACCCT GGTCACCGTCTCCTCA<br>SEQ ID NO: 29327 |
| | | AA | DIQMTQSPSSLSASVGDRVTITCRASQGIRNDLG WYQQKPGKAPKRLIYAASSLQSGFPSRFSGSGSG TEFTLTISSLQPEDFATYYCLQHNSYPLTFGGGT KVEIK<br>SEQ ID NO: 25322 | QVQLVESGGGVVQPGRSLRLSCAASGFTFSNYGM HWVRQAPGKGLEWVAVIWFDVSNKKYVDSVKGR FTISRDNSKNTLYLQMSSLRAEDTAVYYCARDLGM IEDYWGQGTLVTVSS<br>SEQ ID NO: 29328 |

FIGURE 50
(Continued)

| | | | |
|---|---|---|---|
| iPS:434031 | 21-225_49E7 | NA | GATATTGTGATGACCCAGACTCCACTCTCTCT GTCTGTCACCCCTGGACAGCCGGCCTTCATGT CCTGCAAGTCTAGTCAGTCTCTTCTTGCATAGT GAAGGAAAAGACCTATTTGTATTGGTACCTGCA GAAGACAGGCCAGCTCCACACCTCCTGATCT ATGAAGTTTCCAAGCGGCTCTCTGGCGTGCCA GATAGGTTCAGTGGCAGCCGGGTCAGGGACAG ATTTCACACTGAAAATCAGCCGATGGAGGCT GAGGATGTCGGGGTTATTACTGCATGCAAAG TATGCAGCTTCCGATTATCTTCGGCCAGGGGA CACGACTGGAGATTAAA SEQ ID NO: 25323 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTACTATGGCAT GCACTGGGTCCGCCAGGCTCCAGGCAAGGGCT GGAGTGGGTGGCAGTTATATGGTATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTCTGTATTACTGTGCGAGAAGGTATAG CAGCAGCTGGTCGGGCGGTATGGACGTCTGGGG CCAAGGGACCACGGTCACCGTCTCCTCA SEQ ID NO: 29329 |
| | | AA | DIVMTQTPLSLSVTPGQPAFMSCKSSQIFLHSEG KTYLYWYLQKTGQPPHLLIYEVSKRLSGVPDRF SGSGSGTDFTLKISRMEAEDVGVYYCMQSMQLP IIFGQGTRLEIK SEQ ID NO: 25324 | QVQLVESGGGVVQPGRSLRLSCAASGFTFSSYGMH WVRQAPGKGLEWVAVIWYDGSNKYYADSVKGRF TISRDNSKNTLYLQMNSLRAEDTALYYCARRYSSS WSGGMDVWGQGTTVTVSS SEQ ID NO: 29330 |
| iPS:434033 | 21-225_49F9 | NA | GATATTGTGATGACCCAGACTCCACTCTCTCT GTCCGTCACCCCTGGACAGCCGGCCTCCATCT CCTGCAAGTCTAATCAGAGCCTCGTGTACAAT GAAGGAAAAGACCTATTTGTATTGGTATTTGCA GAAGCCAGGCCAGCCTCCACAGCTCCTGATCT TTGAAGTTTCCAACCGGTTCTCTGGAGTGCCA GATAGGTTCAGTGGCAGCGGGTCAGGGACAG ATTTCACACTGAAAATCAGTCGGGTGGAGGCT GAGGATGTTGGGGTTTATTACTGCATGCAAAG TATACAGTATCCGATCACCTTCGGCCAAGGGA CACGACTGGAGATTAAA SEQ ID NO: 25325 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCACTTATATGCAGACTCCGTGAAGGGCCG AATTCACCATCTCCAGAGACAATCCAAGAACACG CTGTATCTGCAAATGAACAGCCTGAGAGCCGAG GACACGGCTGTGTATCACTGTGCGAGAAGGTATA GCAGCAGCTGGTCGGGCGGTATGGACGTCTGGG GCCAAGGGACCACGGTCACCGTCTCCTCA SEQ ID NO: 29331 |

FIGURE 50
(Continued)

| | | | |
|---|---|---|---|
| iPS:434035 | 21-225_49F10 | AA | DIVMTQTPLSLSVTPGQPASISCKSNQSLVHNEG KTYLYWYLQKPGQPPQLLIFEVSNRFSGVPDRFS GSGSGTDFTLKISRVEAEDVGVYCMQSIQYPIT FGQGTRLEIK<br>SEQ ID NO: 25326 | QVQLVESGGGVVQPGRSLRLSCAASGFTFSSYGMH WVRQAPGKGLEWVALIWYDGRNKYYADSVKGRF TISRDNPKNTLYLQMNSLRAEDTAVYHCARRYSSS WSGGMDVWGQGTTVSS<br>SEQ ID NO: 29332 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGGTCCTGATCTATGCTGCATCCACTT TGCAAAGTGGGGTCCCATCAAGGTTCAGCGGC AGTGGATCTGGGACAGATTTCACTCTCACCAT CAGCAGCCTGCAACCTGAAGATTTTGCAACTT ACTATTGTCAACAGGCTAACAGTTTCCCATTC ACTTTCGGCCCTGGGACCAAAGTGGATATCAA A<br>SEQ ID NO: 25327 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACCCTAATAACAA TGCCACAAACTATGCTCAGAACTTTCAGGGCAGG GTCACCCTGACCAGGGACACGTCCATCAGCACA GCCTACATGGAGCTGAGCAGGCTGAGAGACGGT GACACGGCCGTGTATTACTGTGCGAGAGACGGT ACCAGCAGTTTGACTTCTGGGGCCAGGGAACCC TGGTCACCGTCTCCTCA<br>SEQ ID NO: 29333 |
| | | AA | DIQMTQSPSSVSASVGDRVTITCRASQGISRWLA WYQQKPGKAPKVLIYAASTLQSGVPSRFSGSGS GTDFTLTISSLQPEDFATYYCQQANSFPFTFGPGT KVDIK<br>SEQ ID NO: 25328 | QVQLVQSGAEVKKPGASVKVSCKASGYTFTGYHM HWVRQAPGQGLEWMGWINPNNNATNYAQNFQGR VTLTRDTSISTAYMELSRLRSDDTAVYYCARDGTSS FDFWGQGTLVTVSS<br>SEQ ID NO: 29334 |

FIGURE 50
(Continued)

| | | | |
|---|---|---|---|
| iPS:434037 | 21-225_49G12 | NA | GACATCCAGATGACCCAGTCTCCATCCTCCT GTCTGCGTCTGTAGGAGACAGAGTCACCATCA CTTGCCGGTCAAGTCAGAGCATTAGTACCTAT TTAATGTGGTATCAGCAGCAGAAACCAGGGAAAG CCCCTAAGCTCTTGATCTATGCTGCATCCAGTT TGCAAATTGGGGTCCCATCAGAGTTCAGTGCC AGTGGATCTGGGACAGATTTCACTCTCACCAT CAGCAGTCTGCAACCTGAAGATTTTGCAACTT ACTACTGTCAACAGAGTTACAGTATCCCATTC ACTTTCGGCCCTGGGACCAAAGTGGATATCAA A <br> SEQ ID NO: 25329 | GAGGTGCAGCTGTTGGAGTCTGGGGGAGGCTTG GTACAGCCTGGGGGGTCCCTGAGACTCTCCTGTA CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AGCACATTCTACGCAGACTCCGTGAAGGGCCGGC TCACCATCTCCAGAGACAACGCCAAGAACACACT GTATCTGCAAATGAACAGCCTGAGAGCCGAGGA CACGGCCGTATATTACTGTGCGCGTCGTATAGCA GTGGCTGGGAATGATGCTTTTGATATCTGGGGCC AAGGGACAATGGTCACCGTCTCTTCA <br> SEQ ID NO: 29335 |
| | | AA | DIQMTQSPSSLSASVGDRVTITCRSSQSISTYLM WYQQKPGKAPKLLIYAASSLQIGVPSEFSASGSG TDFTLTISSLQPEDFATYYCQQSYSIPFTFGPGTK VDIK <br> SEQ ID NO: 25330 | EVQLLESGGGLVQPGGSLRLSCTASGFTFSSYAMS WVRQAPGKGLEWVSVISGSGGTFYADSVKGRLTI SRDNSKNTLYLQMNSLRAEDTAVYYCARRIAVAG NDAFDIWGQGFMVTVSS <br> SEQ ID NO: 29336 |
| iPS:434039 | 21-225_43B1 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTTCTGTCTACAGCATATAGTTTCCCATTC ACTTTCGGCCCTGGGACCAAAGTGGATATCAA A <br> SEQ ID NO: 25331 | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GAACTGGATCCGCCAGGCTCCAGGGAAGGGGCT GGAGTGGGTTTCATACATTAATAGTAGTAATGGTTTT ACCATATACTACCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGCCGATACAATC TACTGGGGCCAGGGAACCCGGGTCACCGTCTCCT CA <br> SEQ ID NO: 29337 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASSLQSGVPSRFSGSGS GTEFTLTVSSLQPEDFATYFCLQHTSFPFTFGPGT KVDIK | QVQLVESGGGLVKPGGSLRLSCAASGFTFSDYMN WIRQAPGKGLEWVSYINSNGFTIYYADSVKGRFTIS RDNAKNSLYLQMNSLRAEDTAVYYCAADTIYWGQ GTRVTVSS |
| | | | SEQ ID NO: 25332 | SEQ ID NO: 29338 |
| iPS:434041 | 21-225_50H8 | NA | GACATCCAGATGACCCAGTCTCCATCCCCT GTCTGCGTCTGTAGGAGACAGAGTCAACATCA CTTGCCGGGCAAGTCAGAGAGTCAGCAGTAT CTTAATTTGGTATCAGCAGAAACCAGGGAAAGC CCCTAAGCTCCTGATCTATGCTGCATCCAGTCT GCAAAGTGGGGTCCCATCAAGGTTCAGTGCCA GTGGATCTGGGACAGATTTCACTCTCACCATC AGCAGTCTGCAACCTGAAGATTTTGCAAGTA CTACTGTCAACAGAGTAACAGTCTTCCATTCA CTTTCGGCCCTGGGACCAAAGTGGATATCAAA | GAGGTGCAGCTGTTGGAGTCTGGGGGAGGCTTG GTACAGCCTGGGGGGTCCCTGAGACTCTCCTGTG CAGCCTCTAGATTCACCTTTAGCAGTCAGTTATGCCAT GAGCTGGGTCCGCCAGGCTCCAGGGAAGGGGCT GGAGTGGGTCTCAGTTATTAGTGGTCGTGGTGGT ACCACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGCGTCGTATAGCA GTGGCTGGAATGAGGCTTTTGATATCTGGGGCC AAGGGACAATGGTCACCGTCTCTCTCA |
| | | | SEQ ID NO: 25333 | SEQ ID NO: 29339 |
| | | AA | DIQMTQSPSSLSASVGDRVNITCRASQSISSYLIW YQQKPGKAPKLLIYAASSLQSGVPSRFSASGSGT DFTLTISSLQPEDFASYYCQQSNSLPFTFGPGTKV DIK | EVQLLESGGGLVQPGGSLRLSCAASRFTFSSYAMS WVRQAPGKGLEWVSVISRGGTFYADSVKGRFTI SRDNSKNTLYLQMNSLRAEDTAVYYCARRIAVAG NEAFDIWGQGTMVTVSS |
| | | | SEQ ID NO: 25334 | SEQ ID NO: 29340 |

FIGURE 50
(Continued)

| | | | |
|---|---|---|---|
| iPS:434043 | 21-225_50G10 | NA | GACATCCAGATGACCCAGTCTCCATCCTCCCT GTCTGCATCTGTAGGAGACAGAGTCACCATCA CTTGCCGGGCAAGTCAGGGCATTAGAAATAAT TTAGGCTGTATCAGCAGAAACCAGGGAAAG TCCCTAAGCGCCTGATCTATGCGCATCCAGTT TGCAAAGTGGGGTCCATCAAGGTTCAGCGGC AGTGGATCTGGGACAGAATTCACTCTCACAAT CAGCAGCCTGCAGCCTGAAGATTTTGCAACTT ATTACTGTCTACAGTATAATAGTTACCCGTTCA CTTTCGGCGGAGGGACCAAGGTGGAGAGCAA A<br><br>SEQ ID NO: 25335 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCTGGAAGGGGCT GGAGTGGGGTCTCATCCATTAGTGGTAGTAGTAGT TACATATACTACGCAGAGACTCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGAGAGTAGCAACT TTTGACTACTGGGGCCAGGGAACCCTGGTCACCG TCTCCTCA<br><br>SEQ ID NO: 29341 |
| | | AA | DIQMTQSPSSLSASVGDRVTITCRASQGIRNNLG WYQQKPGKVPKRLIYAASSLQSGVPSRFSGSGS GTEFTLTISSLQPEDFATYYCLQYNSYPFTFGGGT KVESK<br><br>SEQ ID NO: 25336 | EVQLVESGGGLVKPGGSLRLSCAASGFTFSSYSMN WVRQAPGKGLEWVSSISGSSSYIYADSVKGRFTIS RDNAKNSLYLQMNSLRAEDTAVYYCARVATFDY WGQGTLVTVSS<br><br>SEQ ID NO: 29342 |
| iPS:434045 | 21-225_50H10 | NA | GACATCCAGATGACCCAGTCTCCATCCTCCCT GTCTGCGTCTGTAGGAGACAGAGTCACCATCA CTTGCCGGGCAAGTCAGAGCATTTACAGCTAT TTAATTTGGTATCAGCAGAAACCAGGGAAAGC CCCTAAGCTCCTGATCTATGCTGCATCCAGTTT GCAAAGTGGGGTCCCATCAAGGTTCAGTGCA GTGGATCTGGGACAGATTTCACTCTCACCATC AGCAGTCTGCAACCTGAAGATTTTGCAAGTTA CTACTGTCAACAGAGTAACAGTATTCCATTCA CTTTCGGCGGCCCTGGGACCAAAGTGGATATCAAA<br><br>SEQ ID NO: 25337 | GAGGGGCAGTTGTTGGAGTCTGGGGGAGGCTTG GTACAGCCTGGGGGGTCCCTGAGACTCTCCTGTG CAGCCTCTAGATTCACCTTTAGCAGTCAGTATGCCAT GAGCTGGGTCCGCCAGGCTCCAGGGAAGGGGCT GGAGTGGGTCTCAGTTATTAGTGGTCGTGGTGGT AGCACATTCTACGCAGACTCCGTGAAGGGCCGGT TCACCATCTCCAGAGACAATTCCAAGAACACGCT GTATCTGCAAATGAACCTGAGAGCCGAGGA CACGGCCGTATATTACTGTGCGCGTCGTAGCA GTGGCTGGAATGAGGCTTTTGATATCTGGGGCC AAGGGACAATGGTCACCGTCTCTTCA<br><br>SEQ ID NO: 29343 |

FIGURE 50
(Continued)

| | | | | |
|---|---|---|---|---|
| iPS:434047 | 21-225_50A12 | AA | DIQMTQSPSSLSASVGDRVNITCRASQSIYSYLIWYQQKPGKAPKLLIYAASSLQSGVPSRFSASGSGTDFTLTISSLQPEDFASYYCQQSNSIPFTFGPGTKVDIK | EGQLLESGGGLVQPQPGGSLRLSCAASRFTFSSYAMSWVRQAPGKGLEWVSVISGRGSTFYADSVKGRFTISRDNSKNTLYLQMNSLRAEDTAVYYCARRIAVAGNEAFDIWGQGTMVTVSS |
| | | | SEQ ID NO: 25338 | SEQ ID NO: 29344 |
| | | NA | GACATCCAGATGACCCAGTCTCCATCCTCCTGTCTGCATCTGTAGGAGACAGAGTCAACATCACTTGCCGGGCAAGTCAGGGCATTAGAAATGATTTAGGCTGGTATCAGCAGAAACCAGGAAAGCCCCTAAGCGCCTGATCTATACTGCATCCAATTTACAAAGTGTGGGGTCCATCAAGGTTCAGCGGCAGTGGATCTGGGACAGATTCACTCTCACAACAGTCAGCCTGTCTACAGCATAATAGTTACCCGTGTATTACTGTCTACAGCATAATAGTTACCCGTTCACTTATTACTGTCAGCAGCCTGAAGATTTTGCAACTTATTACTGTCTACAGCATAATAGTTACCCGTGACGTTCGGCCAAGGGACCAAGGTGGAAATCAAA | CAGGTGCAACTGGTGCAGTCTGGGGCTGAGGTGAAGAAGCCTGGGGCCTCAGTGAAGGTCTCCTGCAAGGCTTCTGGATACACCTTCACCGGCCACTATATAAACTGGGTGCGACAGGCCCCTGGACAAGGGCCTGAGTGGATGGCATGGGTCAACCCTAACAGTGGTGGCACAAACTCTGCACAGAAGTTTCAGGCAGGGTCACCATGACCAGGGACACGTCCATCAGCACAGTCTACATGGAGCTGAGCAGGCTGAGATCTGACGACACGGCCGTGTATTACTGTGCGAGGGGAGGGCAGTCCGGCGGGTTTAACTACTACTACTACGGTATGGACGTCTGGGGCCAAGGGACCACGGTCACCGTCTCCTCA |
| | | | SEQ ID NO: 25339 | SEQ ID NO: 29345 |
| | | AA | DIQMTQSPSSLSASVGDRVTITCRASQGIRNDLGWYQQKPGKAPKRLIYTASNLQSGVPSRFSGSGSGTEFTLTISSLQPEDFATYYCLQHNSYPWTFGQGTKVEIK | QVQLVQSGAEVKKPGASVKVSCKASGYTFTFGHYINWVRQAPGQGPEWMAWVNPNSGGTNSAQKFQGRVTMTRDTSISTVYMELSRLRSDDTAVYYCARGGQLGGFNYYYGMDVWGQGTTVTVSS |
| | | | SEQ ID NO: 25340 | SEQ ID NO: 29346 |

FIGURE 50
(Continued)

| | | | | |
|---|---|---|---|---|
| iPS:434049 | 21-225_50B12 | NA | GACATCCAGATGACCCAGTCTCCATCCTCCCT GTCTGCATCTGTGGGAGACAGAGTCACCATCA CTTGTCGGGCAAGTCAGAGCATTAGTAGTTAT TTAAATTGGTATCAGCATAAACCAGGAAAGC CCCTAGGCTCCTGATCTATGCTGCATCCAGTTT GCAAAGTGGGTCCCATCAAGGTTCAGTGGCA GTGAATCTGGGACAGATTTCATTCTCACTATC AGCAGTCTGCAACCTGAAGATTTTACAACTTA TTACTGTCAACAGAGTTACATTGCCCATTCA CTTTCGGCCCTGGGACCAAAGTGGATATCAAA | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCCATAGCAT GAACTGGGTCCGCCAGGCTCCAGGGAAGGGGCT GGAGTGGGTCTCATCCATCAGTAGTAGTAGTAAT TACATATACTACGCAGACTCAGTGAAGGGCCGAT TCACCATCTCCAAGAGACTACGCCAAGAACTACT TTATCTGCAAATGAACAGCTGAGAGCCGAGA CACGGCTGTGTATTACTGTGCGAGAGATCGGAGC ATAGTAGTGGCTGGTCCCTGGGACTACTACGGTA TGGACGTCTGGGGCCAAGGGACCACGGTCACCG TCTCCTCA |
| | | | SEQ ID NO: 25341 | SEQ ID NO: 29347 |
| | | AA | DIQMTQSPSSLSASVGDRVTITCRASQSISSYLNW YQHKPGKAPRLLIYAASSLQSGVPSRFSGSESGT DFILTISSLQPEDFTTYYCQQSYIAPFTFGPGTKV DIK | EVQLVESGGGLVKPGGSLRLSCAASGFTFSSHSMN WVRQAPGKGLEWVSSISSSSNYYYADSVKGRFTIS RDYAKNSLYLQMNSLRAEDTAVYYCARDRSIVVA GPWDYYGMDVWGQGTTVTVSS |
| | | | SEQ ID NO: 25342 | SEQ ID NO: 29348 |
| iPS:434053 | 21-225_51E1 | NA | GATATTGTGATGACCCAGACTCCACTCTCT GTCCGTCACCCTGGACAGCCGGCCTCCATGT CCTGCAAGTCTAGTCAGAGCCTCCTGCATAGT GATGGAAAGACCTATTTGTATTGGTACCTGCG GAAGCCAGGCCAGCCTCCACAGTTCTGATCT TTGAAGTTTCCAACCGGTTCTCTGGAGTGCCA GATAGGTTCAGTGGCAGCGGGTCAGGGACAG AATTCACACTGAAAATCAGCGGGTGGAGGCT GAGGATGTTGGGGTTTATTACTGCATGCAAAG TATACAGCTTCCATTCACTTTCGGCCCTGGGAC CAAAGTGGATATCAAA | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGCAGACTCCGTGAAGT AGTAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAAGGTATAG CAGCAGTTGGTCGGCGGTATGGACGTCTGGGG CCAAGGGACCACGGTCACCGTCTCCTCA |
| | | | SEQ ID NO: 25343 | SEQ ID NO: 29349 |

FIGURE 50
(Continued)

| | | | | |
|---|---|---|---|---|
| | | AA | DIVMTQTPLSLSVTPGQPASMSCKSSQSLLHSEGKTYLYWYLRKPGQPPQFLIFEVSNRFSGVPDRFSGSGSGTEFTLKISRVEAEDVGVYYCMQSIQLPFTFGPGTKVDIK | QVQLVESGGGVVQPGRSLRLSCAASGFTFSSYGMHWVRQAPGKGLEWVAVIWYDGSSKYYADSVKGRFTISRDNSKNTLYLQMNSLRAEDTAVYYCARRYSSSWSGGMDVWGQGTTVTVSS |
| | | | SEQ ID NO: 25344 | SEQ ID NO: 29350 |
| iPS:434055 | 21-225_51B4 | NA | GACATCCAGATGACCCAGTCTCCATCCTCCCTGTCTGCATCTGTAGGAGACAGAGTCACCATCACTTGCCAGGCGAGTCGGGACATTACCTTCTATTTAAATTGGTATCAGCAGAAACCAGGGAAAGCCCCTAAGCTCCTGATCTACGATGCATCCAATTTGGAAACAGGGGTCCCATCAAGGTTCAGTGGCAGTGGATCTGGGACAGATTTTACTTTCACCATCAGCTGCGTGCATCCTGAAGATATTGCAACATATTTATGTCAACAGTATGATAATCTTCCATTCACTTTCGGCCCAGGGACCACAGTGGATATCAAA | GAGGTGCAGCTGTTGGAGTCTGGGGGAGGCTTGGTACAGCCTGGGGGGTCCCTGAGTCTCTCCTGTGCAGCCTCTGGATTCACCTTTAGAAGCTATGTCATGAGCTGGGTCCGCCAGGCTCCAGGGAAGGGGCTGGAGTGGGTCTCAGCTATTAGTGGTCGTGGTAGTAACACATTCTACACAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAAAGGGATAACTGGATCACACGGTGCTTTTGATATCTGGGGCCAAGGGACAATGGTCACCGTCTCTTCA |
| | | | SEQ ID NO: 25345 | SEQ ID NO: 29351 |
| | | AA | DIQMTQSPSSLSASVGDRVTITCQASRDITFYLNWYQQKPGKAPKLLIYDASNLETGVPSRFSGSGSGTDFTFTISCVHPEDIATYLCQQYDNLPFTFGPGTTVDIK | EVQLLESGGGLVQPGGSLSLSCAASGFTFRSYVMSWVRQAPGKGLEWVSAISGRGSNTFYTDSVKGRFTISRDNSKNTLYLQMNSLRAEDTAVYYCAKGITGSHGAFDIWGQGTMVTVSS | 

| | | | SEQ ID NO: 25346 | SEQ ID NO: 29352 |

FIGURE 50
(Continued)

| | | | | |
|---|---|---|---|---|
| iPS:434057 | 21-225_51E4 | NA | GACATCCAGATGACCCAGTCTCCATCCTCCCT GTCTGCATCTGTGGGAGACAGAGTCACCATCA CTTGCCGGGCAAGTCAGGACAGTCATTAGAAATGAT TTAGGCTGGTATCAGCAGAAACCAGGGAAAG CCCCTCAGCGCCTCAGCTCTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAGGATTTTGCAGCTT ATTATTGTCTACAGCATAATAGTTACCCATTCA CTTTCGGCCCTGGGACCAAAGTGGATATCAAA<br><br>SEQ ID NO: 25347 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGTAGTGCAT GCACTGGGTCCGCCAGGCTCCAGGCAAGGGCT GGAGTGGGTGGCAGTTATATGCTATGATGAAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGAACTGGG ATTTCTCTGACTACTGGGGCCAGGGAACCCTG GTCACCGTCTCCTCA<br><br>SEQ ID NO: 29353 |
| | | AA | DIQMTQSPSSLSASVGDRVTITCRASQGIRNDLG WYQQKPGKAPQRLIYAASSLQSGVPSRFSGSGS GTEFTLTISSLQPEDFAAYYCLQHNSYPFTFGPGT KVDIK<br><br>SEQ ID NO: 25348 | QVQLVESGGVVQPGRSLRLSCAASGFTFSSYGMH WVRQAPGKGLEWVAVIWYDESNKYYADSVKGRF TISRDNSKNTLYLQMNSLRAEDTAVYYCARELGFL SDYWGQGTLVTVSS<br><br>SEQ ID NO: 29354 |
| iPS:434059 | 21-225_51C5 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTTATCTATGCTGCATCCAGTTT GCGAAGTGGGGTCCCATCACAGTTCAGCGGCA GTGGATCTGGAACAGATTTCATTCTCACCATC AGCAGCCTGCAGCCTGAAGATTTTGCAACTTA TTACTGCCAACAGTATTATAGTTACCCATTCAC TTTCGGCCCTGGGACCAAAGTGGATATCAAA<br><br>SEQ ID NO: 25349 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGTCATG AGCTGGGTCCGCCAGACTCCAGGGAAGGGCTG GAGTGGGTCAACTATGAGTAGTGGTGGTC GCACATACTACGCAGACTCCGTGAAGGGCCGATT CACCGTCTCCAGAGACAATTCCAAGAACACGCTG TATTTGCAAATGAGCAGCCTGAGAGCCGAGGAC ACGGCCGTATATTACTGTGCGCGGGGTGACTGCTT TGACTACTGGGGCCAGGGAACCCTGGTCACCGT CTCCTCA<br><br>SEQ ID NO: 29355 |

FIGURE 50
(Continued)

| | | AA | DIQMTQSPSSLSASVGDRVTITCRASQGISNYLA WFQQKPGEAPKSLIYAASSLRSGVPSQFSGSGSG TDFILTISSLQPEDFATYYCQQYYSYPFTFGPGTK VDIK | EVQLLESGGGLVQPGGSLRLSCAASGFTFSSYVMS WVRQTPGKGLEWVSTMSGSGGRTYADSVNGRFTI VSRDNSKNTLYLQMSSLRAEDTAVYYCARVTAFD YWGQGTLVTVSS |
|---|---|---|---|---|
| | | | SEQ ID NO: 25350 | SEQ ID NO: 29356 |
| iPS:434061 | 21-225_51C7 | NA | GACATCCAGATGACCCAGTCTCCATCTTCCGT GTCTGCATCTGTAGGAGACAGAGTCACCATCA CTTGTCGGGCGAGTCAGGATCAGGATTAACAACTAC TTAGCCTGGTTTCAGCAGAAACCAGGGAAAGC CCCTAAGTCTCTGATCTATGCTGCATCCAGTTT GCAAAATGGGGTCCCATCAAGGTTCAGCGGCA GTGGATCTGGGACAGATTTCACTCTCACCATC AGCAGCCTGCTGCCTGAAGATTTTGCAACTTA CTATTGTCAACAAACTAACAGTTTCCCATTCA CTTTCGGCCCTGGGACCAAAGTGGATATCAAA | GAGGTGCAGCTGTTGGAGTCTGGGGGAGGCTTG GTGCAGCCTGGGGGGTCCCTGAGACTCTCCTGTG CAGCCTCTGGATTCACCATTAGCAACTATGCCAT GACCTGGGTCCGCCAGACTCCAGGGAAGGGGCT GGAGTGGGTCTCAGTTATTAGTGCTAGTGGTGGT AACTCATTCTACGCAGACTCCGTGAAGGGCCGGT TCACCATCTCAGAGACAATTCCGAGAACACGTT CTATCTGCAAATGAACAGCCTGAGAGCCGAGGA CACGGCCGTATATTACTGTGCGAAAGCAAGGC AGTGGCTGGGTCACACTGGTTCGACCCCTGGGGC CAGGGAACCCTGGTCACCGTCTCCTCA |
| | | | SEQ ID NO: 25351 | SEQ ID NO: 29357 |
| | | AA | DIQMTQSPSSVSASVGDRVTITCRASQDVNNYL AWFQQKPGKAPKLLIYAASSLQNGVPSRFSGSG SGTDFTLTISSLLPEDFATYYCQQTNSFPFTFGPG TKVDIK | EVQLLESGGGLVQPGGSLRLSCAASGFTISNYAMT WVRQTPGKGLEWVSVSASGGNSFYADSVKGRFTI SRDNSENTFYLQMNSLRAEDTAVYYCAKARAVAG SHWFDPWGQGTLVTVSS |
| | | | SEQ ID NO: 25352 | SEQ ID NO: 29358 |

FIGURE 50
(Continued)

| | | | | |
|---|---|---|---|---|
| iPS:434063 | 21-225_51G7 | NA | GACATCCAGATGACCCAGTCTCCATCTTCCGT GTCTGCATCTGTAGGAGACAGAGTCACCATCA CTTGTCGGGCGAGTCAGGATATTAGCAGTTGG TTAGCCTGGTATCAGCAGAAACCAGGGAAAG CCCCTAAGGTCCTGATCTATGCTCCATCCAATT TGCAAAGTGCGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTCACAGTTTCCCGTGG ACGTTCGGCCAAGGGACCAAGGTGGAAATCA AA | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTACTAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGCTCGCCTT GACTACTGGGGCCAGGGAACCCTGGTCACCGTCT CCTCA |
| | | | SEQ ID NO: 25353 | SEQ ID NO: 29359 |
| | | AA | DIQMTQSPSSVSASVGDRVTITCRASQDISSWLA WYQQKPGKAPKVLIYAPSNLQSAVPSRFSGSGS GTDFTLTISSLQPEDFATYYCQQAHSFPWTFGQG TKVEIK | EVQLVESGGGLVKPGGSLRLSCAASGFTFSSYSMN WVRQAPGKGLEWVSSISSSSYIYADSVKGRFTIS RDNAKNSLYLQMNSLRAEDTAVYYCARARLDYW GQGTLVTVSS |
| | | | SEQ ID NO: 25354 | SEQ ID NO: 29360 |
| iPS:434065 | 21-225_50D4 | NA | GACATCCAGATGACCCAGTCTCCATCTTCCGT GTCTGCATCTGTGGGAGACAGAGTCACCATCA CTTGTCGCGGGCGAGTCAGGGTATTAGCAGGTGG TTAGCCTGGTATCAGCAGAAACCAGGGAAAG CCCCTAAGGTCCTGATCTATGCTGCATCCACTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAG A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACCTAATAATAA GTCCACAAACTATGCTCAGAGCTTTCAGGGCAGG GTCACCTGACCAGGGACACGTCATCAGCACA GCCTACATGGAGCTGAGCAGGCTGAGATCTGAC GACACGGCCGTGTATTACTGTGCGAGAGACGGT ACCAGCAGTTTGACTTCTGGGGCCAGGGAACCC TGGTCACCGTCTCCTCA |
| | | | SEQ ID NO: 25355 | SEQ ID NO: 29361 |

FIGURE 50
(Continued)

| | | | | |
|---|---|---|---|---|
| iPS:434067 | 21-225_51H8 | AA | DIQMTQSPSSVSASVGDRLTITCRASQGISRWLA WYQQKPGKAPKVLIYAASTLQSGVPSRFSGSGS GTDFTLTISSLQPEDFATYYCQQANSFPFTFGPGT KVDIR<br>SEQ ID NO: 25356 | QVQLVQSGAEVKKPGASVKVSCKASGYTFTGYHM HWVRQAPGQGLEWMGWINPNNATNYAQSFQGR VTLTRDTSISTAYMELSRLRSDDTAVYYCARDGTSS FDFWGQGTLVTVSS<br>SEQ ID NO: 29362 |
| | | NA | GACATCCAGATGACCCAGTCTCCATCCTCCT GTCTGCATCTGTAGGAGACAGACTCACCATCA CTTGCCGGGCAAGTCAGGGCATTAGAAATGAT TTGGGCTGGTATCAGCAGAAACCAGGAAAG CCCCTAAGCGCCTGATCTATGCTGCTTCCAGTT TGCAAAGTGGGGTCCCATCAAGGTTCAGCGGC GGTGGATCTGGGACACACTTCACTCTCACAAT CAGCAGCCTGCAGCCTGAAGATTTTGCAACTT ATTACTGTCTACAGCATAATAGTTACCCGTGG ACGTTCGGCCAAGGGACCAAGGTGGAAATCA AA<br>SEQ ID NO: 25357 | CAGGTGCAGCTGGTGCAGTCTGGGGCTGAGGTG AAGAAGCCTGGGGCCTCAGTGAAGGTCTCCTGC AAGGCTTCTGGATACACCTTCACGGCCACTATA TGAACTGGGTGCGACAGGCCCCTGGACAAGGAC TTGAGTGGATGGGATGGGTCAACCTAACAGTGG TGGCTCAAACTCTGCACAGCAGTTTCAGGGCAGG GTCACCATGACCAGGGACACAGTCCATCAGCACA GTCTACATGGAGCTGAGCAGGCTGAGTTCTGACG ACACGGCCGTGTATTACTGTGCGAGGGAGGGC AGCTCGGCGGCTTTAACTTCTACTACTACGGTAT GGACGTCTGGGGCCAAGGGACCACGGTCACCGT CTCCTCA<br>SEQ ID NO: 29363 |
| | | AA | DIQMTQSPSSLSASVGDRVTITCRASQGIRNDLG WYQQKPGKAPKRLIYAASSLQSGVPSRFSGGGS GTHFTLTISSLQPEDFATYYCLQHNSYPWTFGQG TKVEIK<br>SEQ ID NO: 25358 | QVQLVQSGAEVKKPGASVKVSCKASGYTFTGHYM NWVRQAPGQGLEWMGWVNPNSGGSNSAQQFQGR VTMTRDTSISTVYMELSRLSSDDTAVYYCARGGQL GGFNFYYGMDVWGQGTTVTVSS<br>SEQ ID NO: 29364 |

FIGURE 50
(Continued)

| | | | |
|---|---|---|---|
| iPS:434069 | 21-225_51E9 | NA | GACATCCAGATGACCCAGTCTCCATCTTCCGT GTCTGCCTCTGTAGGAGACAGAGTCACCATCA CTTGTCGGGCGAGTCAGGTATTAGCAGTTGG TTAGCCTGGTATCAGCAGAAACCAGGGAAAG CCCCTAAGCTCCTGATCTATTGTGCATCCAGTT TGCAAAGTGGGGTCCCATCAAGGTTCAGCGGC AGTGGATCTGGGACAGATTTCACTCTCACCAT CAGGAGCCTGCAGCCTGAAGATTTTGCAACTT ACTATTGTCAACAGGCTAAAAGTTTCCCATTC ACTTTCGGCCCTGGGACCAAAGTGGATATCAA A <br><br> SEQ ID NO: 25359 | CAGGTGCAGCTGGTGCAGTCTGGGGCTGAGGTG AAGAAGCTGGGGCTCAGTGAAGGTCTCCTGC AAGGCTTCTAGATACACCTTCACCGGCTACCATA TACACTGGGTGCGACAGGCCCCTGGACAAGGC TTGAGTGGATGGGATGGATCAACCTAACACTAA TGGCACACAGTATGCACAGAAGTTTCAGGGCCG GGTCACCATGACCAGGGACACGTCCATCAGCAC AGCCTACATGGAGCTGAGCAGCCTGAGATCTGA CGACACGGCCGTGTATTACTGTGCGAGAGATGGC ACCTGTCCTTTGACTACTGGGGCCAGGGAACCC TGGTCACCGTCTCCTCA <br><br> SEQ ID NO: 29365 |
| | | AA | DIQMTQSPSSVSASVGDRVTITCRASQGISSWLA WYQQKPGKAPKLLIYVASSLQSGVPSRFSGSGS GTDFTLTIRSLQPEDFATYYCQQAKSFPFTFGPGT KVDIK <br><br> SEQ ID NO: 25360 | QVQLVQSGAEVKKPGASVKVSCKASRYTFTGYHIH WVRQAPGQGLEWMGWINPNTNGTYAQKFQGRV TMTRDTSISTAYMELSRLRSDDTAVYYCARDGTSS FDYWGQGTLVTVSS <br><br> SEQ ID NO: 29366 |
| iPS:434071 | 21-225_51F9 | NA | GACATCCAGATGACCCAGTCTCCATCCTCCCT GTCTGCATCTGTAGGAGACAGAGTCACCATCA CTTGCCGGGCAAGTCAGGGCATTAGGACTGAT TTAGGCTGGTATCAGCAGAGAAACCAAGGAAAG CCCCTCAGCGCCTGATCTATGCTGCATCCAGTT TGCAACGTGGAGTCCCATCAAGATTCAGCGGC AGTGGATCTGGGACAGCCTGCAGCCTGAAGATTTTGCATCTT ATTACTGTCTACAGCATAATAGTTACCCATTC ACTTTCGGCCCTGGGACCAAAGTGGATATCAA A <br><br> SEQ ID NO: 25361 | CAGGTGCAGCTGGTGGAGTCTGGGGGAGGCGTG GTCCAGCCGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGCAGACTCCGTGAAGGGCCGA AATAAATACTATGCAGACTCCGTGAAGGGCCGA TTCACCATCTCCAGAGACACAATTCCAAGAACACGC TGTATCTGCAAATGAACAGCCTGAGCGCCGAGG ACACGGCTGTGTATTACTGTGCGAGGAGCTGG ATTTCTCTGACTACTGGGGCCAGGGAACCCTG GTCACCGTCTCCTCA <br><br> SEQ ID NO: 29367 |

FIGURE 50
(Continued)

| | | | |
|---|---|---|---|
| iPS:434073 | 21-225_51H10 | AA | DIQMTQSPSSLSASVGDRVTITCRASQGIRTDLG WYQQKPRKAPQRLLIYAASSLQRGVPSRFSGSGS GTDFTLTISSLQPEDFASYYCLQHNSYPFTFGPGT KVDIK<br>SEQ ID NO: 25362 | QVQLVESGGGVVQPGRSLRLSCAASGFTFSDYGM HWVRQAPGKGLEWVAVIWFDGNNKYYADSVKGR FTISRDNSKNTLYLQMNSLSAEDTAVYYCARELGF LSDYWGQGTLVTVSS<br>SEQ ID NO: 29368 |
| | | NA | GACATCCAGATGACCCAGTCTCCATCCTCCCT GTCTGCGTCTGTAGGAGACAGAGTCACCATCA CTTGCCGGGCAAGTCAGAGCATTAGTACCTAT TTAATGTGGTATCAGCAGAAACCAGGGAAAG CCCCTAAGCTCTTGATATATGCTGCATCCAGTT TGCAAAGTGGGGTCCCATCAAGGTTCAGTGCC AGTGGATCTGGGACAGATTTCACTCTCACCAT CAGCAGTCTGCAACCTGAAGATTTTGCAACTT ACTACTGTCAACAGAGTTACAGTATCCCATTC ACTTTCGGCCCTGGGACCAAAGTGGATATCAA A<br>SEQ ID NO: 25363 | GAGGTGCAGCTGTTGGAGTCTGGGGGAGGCTTG GTACAGCCTGGGGGGTCCTGAGACTCTCCTGTA CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT ACCACATTCTACGCAGACTCCGTGAAGGGCCGGC TCACCATCTCCAGAGACAATCCAAGAACACACT GTATCTGCAAATGAACAGCTGAGAGCCGAGGA CACGGCCGTATATTACTGTGCGCGTCGTATAGCA GTGGCTGGAATGATGCTTTTGATATCTGGGGCC AAGGGACAAATGGTCACCGTCTCTTCA<br>SEQ ID NO: 29369 |
| | | AA | DIQMTQSPSSLSASVGDRVTITCRASQSISTYLM WYQQKPGKAPKLLIYAASSLQSGVPSEFSASGSG TDFTLTISSLQPEDFATYYCQQSYSIPFTFGPGTK VDIK<br>SEQ ID NO: 25364 | EVQLLESGGGLVQPGGSLRLSCTASGFTFSSYAMS WVRQAPGKGLEWVSVISGSGGTTFYADSVKGRLTI SRDNSKNTLYLQMNSLRAEDTAVYYCARRIAVAG NDAFDIWGQGTMVTVSS<br>SEQ ID NO: 29370 |

FIGURE 50
(Continued)

| | | | | | |
|---|---|---|---|---|---|
| iPS:434075 | 21-225_51B11 | NA | GCATCCAGATGACCCAGTCTCCATCCTCCT GTCTGCATCTGTAGGAGACAGAGTCACCATCA CTTGCCGGACAAGTCAGGCATTAGAAATGAT TTAGGCTGGTATCAGCAGAAACCAGGAAAG CCCCTAAACGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A | | CAGGTGCAGCTGGTGGAGTCTGGGGGAGGCGTG GTCCAGCCGGGGAGGTCCCTGAGACTCTCCTGTG CAGCGTCTGGATTCACCTTCAGTGACTTGACTGGCAT GCACCGTGGTCCGCCAGGCTCCAGGCAAGGGGCT GGAGTGGGTGGCAGTTATATGGATTCCGTGAAAT AATAAATACTATGGAGACTCCGTGAAGGGCCGA TTCACCATCTCAAGAGACAATCCAAGAACACGC TGTATCTGCAAATGAACAGCCTGAGCGCCGAGG ACACGGCTGTGTATTACTGTGCGAGGGAGCTGGG ATTTTCTCTGACTACTGGGCCAGGGAACCCTG GTCACCGTCTCCTCA |
| | | | SEQ ID NO: 25365 | | SEQ ID NO: 29371 |
| | | AA | AIQMTQSPSSLSASVGDRVTITCRTSQGIRNDLG WYQQKPRKAPKRLIYAASSLQSGVPSRFSGSGS GTEFTLTISSLQPEDFATYYCLQHNSYPFTFGPGT KVDIK | | QVQLVESGGGVVQPGRSLRLSCAASGFTFSDYGM HWVRQAPGKGLEWVAVIWFGGNNKYYGDSVKGR FTISRDNSKNTLYLQMNSLSAEDTAVYYCARELGF LSDYWGQGTLVTVSS |
| | | | SEQ ID NO: 25366 | | SEQ ID NO: 29372 |
| iPS:434077 | 21-225_51F11 | NA | GACATCCAGATGACCCAGTCTCCATCCTCCGCCCT GTCTGCATCTGTAGGAGACAGAGTCACCATCA CTTGCCGGGCAAGTCAGGGCATTAGAAATGAT TTAGGCTGGTATCAGCAGAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTTC ACTTTCGGCGGAGGGACCAAGGTGGAGATCA AA | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTTTGGCAT GCACTGGGTCCGCCAGGCTCCAGGCAAGGGGCT GGAGTGGGTGGCAGTTATATGGTATGGGAAAG TAATAAATACTATGCCAGAGACTCCGTGAAGGGCCG ATTCACCATCTCAAGAGACAATTCCAAGAACACG CTGTATCTGCAAATGAACAGCCTGAGAGCCGAG GACACGGCTGTGTATTACTGTGCGAGAGAACTGG GGTTCCTCTGACTTCTGGGGCCAGGGAACCCT GGTCACCGTCTCCTCA |
| | | | SEQ ID NO: 25367 | | SEQ ID NO: 29373 |

FIGURE 50
(Continued)

| | | | |
|---|---|---|---|
| iPS:434079 | 21-225_52B1 | AA | DIQMTQSPSALSASVGDRVTITCRASQGIRNDLGWYQQKPGKAPKRLIYAASSLQSGVPSRFSGSGSGTEFTLTISSLQPEDFATYYCLQHNSYPFTFGGGTKVEIK<br>SEQ ID NO: 25368 | QVQLVESGGGVVQPGRSLRLSCAASGFTFSNFGMHWVRQAPGKGLEWVAVIWYEESNKYYADSVKGRFTISRDNSKNTLYLQMNSLRAEDTAVYYCARELGFLSDFWGQGTLVTVSS<br>SEQ ID NO: 29374 |
| | | NA | GACATCCAGATGACCCAGTCTCCATCTCCGTGTCTACATTTGTAGGAGACAGAGTCACCATCACTTGTCGGGCGAGTCAGGATATTCGCACCTGGTTAGCCTGGTATCAGCAGAAACCTGGGAAAGCCCCTAAGCTCCTGATCTATGCTGCATCCAGTTTGCAAAATGGGGTCCCATCAAGGTTCAGCGGCAGTGGATCTGGGACAGATTTCACTCTCACCATCAGTAGCCTGCAGCCTGAAGATTTTGCAACTTACTTTTGTCAACAGGTAAAAGTTTCCCATTCACTTTCGGCCCTGGGACCAAAGTGGATATCAAA<br>SEQ ID NO: 25369 | CAGGTGCAGTTGGTGCAGTCTGGGGGCTGAGGTGAAGAAGCCTGGGGCCTCAGTGAAGGTCTCCTGCAAGGCTTCTGGATACACCTTCACCGGCTATCATATGCAGTGGGTGCGACAGGCCCCTGGACAAGGGCTTGAGTGGATGGGATGGATCAACCCTAACAGTGGTGCCACAAACTATGCACAGAACACTTTCAGGGCAGGGTCACCATGACCCGGACACGTCCATCAGCACAGCCTACCTGCAGCTGAGCAGGCTGAGATCTGACGACACGGCCGTGTATTACTGTGCGAGAGATGGCACCTGTCCTTTGACTACTGGGGCCAGGGAACCCTGGTCACCGTCTCCTCA<br>SEQ ID NO: 29375 |
| | | AA | DIQMTQSPSSVSTFVGDRITITCRASQDIRTWLAWYQQKPGKAPKLLIYAASSLQNGVPSRFSGSGSGTDFTLTISSLQPEDFATYFCQQAKSFPFTFGPGTKVDIK<br>SEQ ID NO: 25370 | QVQLVQSGAEVKKPGASVKVSCKASGYTFTGYHMQWVRQAPGQGLEWMGWINPNSGATNYAQNFQGRVTMTRDTSISTAYLDLSRLRSDDTAVYYCARDGTSSFDYWGQGTLVTVSS<br>SEQ ID NO: 29376 |

FIGURE 50
(Continued)

| | | | | |
|---|---|---|---|---|
| iPS:434081 | 21-225_52B2 | NA | GACATCCAGATGACCCAGTCTCCATCGTCACT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAGGCGCCTGATCTATGCTGCATCCTTT TGCAAAGTGGGGTCCCATCGACATTCAGCGGC AGTGGATCTGGGACAGAATTCACTCTCACAAT CAGCAGCCTGCAGCCTGAAGATTTTGCAACTT ATTACTGTCTGCAGCATAATAGCTACCCCTC ACTTTCGGCGGAGGGACCAAGGTGGAGATCA AA SEQ ID NO: 25371 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTACATGATCCGTGAAGT AATCAACGCTATGCAGAGTCCGTGAAGGGCCGA TTCACCATCTCCAGAGACAATTCCAAGAACACGC TGTATCTGCAAATGAACAGCCTGAGTGCCGAGG ACACGGCTGTGTATTACTGTGCGAGAGATCTGGG GATGATCGAGGACTTCTGGGGCCAGGAACCCT GGTCACCGTCTCCTCA SEQ ID NO: 29377 |
| | | AA | DIQMTQSPSSLSASVGDRVTITCRASQGIRNDLG WYQQKPGKAPRRLIYAASFLQSGVPSTFSGSGSG TEFTLTISSLQPEDFATYYCLQHNSYPLTFGGGT KVEIK SEQ ID NO: 25372 | QVQLVESGGGVVQPGRSLRLSCAASGFTFSNYGM HWVRQAPGKGLEWVAVTWFDGSNQRYADSVKGR FTISRDISKNTLYLQMNSLSAEDTAVYYCARDLGMI EDFWGQGTLVTVSS SEQ ID NO: 29378 |
| iPS:434083 | 21-225_52H2 | NA | GACATCCAGATGACCCAGTCTCCATCTTCCGT GTCTGCATCTGTAGGAGACAGAGTCACCATCA CTTGTCGGGCGAGTCAGAATATTACCAACTGG TTAGCCTGGTTTCAGCAGAAACCAGGGAGAGC CCCTAAGCTCCTGATCTATACTCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA CTGTTGTCAACAGACTAACAGTTTCCCGTGGA CGTTCGGCCAAGGGACCAAGGTAGAAGTCAA A SEQ ID NO: 25373 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGATGGGCT GGAGTGGGTCTCAGTATTAGTGGTGGTGGTGGT AATACATTCTACGCAGACTCCGTGAAGGGCCGGT TCACCGTCTCCAGAGACAATTCCAAGAACACGCT GTTTCTGCAAATGAACAGCCTGAGAGCCGAGGA CACGGCCGTATATTACTGTGCGAAAAATGGGCG AGAGCAGGTGGCTTGACTACTGGGGCCAGGGAAC CCTGGTCACCGTCTCCTCA SEQ ID NO: 29379 |

FIGURE 50
(Continued)

| | | | | |
|---|---|---|---|---|
| | | AA | DIQMTQSPSSVSASVGDRVTITCRASQNITNWLA WFQQKPGRAPKLLIYTTSSLQSGVPSRFSGSGSG TDFTLTISSLQPEDFATYCCQQTNSFPWTFGHGT KVEVK<br>SEQ ID NO: 25374 | EVQLLESGGGLVQPGGSLRLSCAASGFTFSRNAMS WVRQAPGMGLEWVSAISGRGGNTFYADSVKGRFT VSRDNSKNTLFLQMNSLRAEDTAVYYCAKNGREQ WLDYWGQGTLVTVSS<br>SEQ ID NO: 29380 |
| iPS:434085 | 21-225_52E3 | NA | GACATCCAGATGACCCAATCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCTGATCAATGCTGCATCCAGTT ACAAAAGTGGGGTCCCATCAAGGTTCAGCGGCA GTGGATCTGGGACAGATTTCACTCTCACTATC AGCAGCCTGCAGCCTGAAGATTTTGCAACTTA TTACTGCCAACAGTATATAGTTTCCCTTTCAC TTTCGGCCCTGGGACCAAAGTGGATATCAAA<br>SEQ ID NO: 25375 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAAAAT GAACTGGGTCCGCCAGGCTCCAGGGAAGGGGCT GGAGTGGGTCTCATCCATTAGTAGTGGTAATAGT TCCATATACTACGCAGACTCAGTGAAGGGCCGAT TCACCATCTCCAGAGACAACGCCGAAAACTCACT GTATCTGCAAATGAACAGCTGAGAGCCGAAGA CACGGCTGTGTATTACTGTGCGAGAGTTAGCAGT AATGACTACTGGGGCCAGGGAACCCTGGTCACC GTCTCCTCA<br>SEQ ID NO: 29381 |
| | | AA | DIQMTQSPSSLSASVGDRVTITCRASQGISNYLA WFQQKPGKAPKSLINAASSLQSGVPSKFSGSGSG TDFTLTISSLQPEDFATYCCQQYNSFPFTFGPGTK VDIK<br>SEQ ID NO: 25376 | EVQLVESGGGLVKPGGSLRLSCAASGFTFSSYKMN WVRQAPGKGLEWVSSISSGNSSSIYYADSVKGRFTIS RDNAENSLYLQMNSLRAEDTAVYYCARVSSNDY WGQGTLVTVSS<br>SEQ ID NO: 29382 |

FIGURE 50
(Continued)

| | | | |
|---|---|---|---|
| iPS:434087 | 21-225_52F6 | NA | GACATCCAGATGACCCAGTCCATCCTCCT GTCTGCATCTGTAGGAGACAGAGTCACCATCA CTTGCCAGGCGAGTCAGGACATTAGTAACTAT TTACATTGGTATCAGCAGAAACCAGGGAAAGC CCCTAAACTCCTGATCTACGATGCATCCACTTT GGGAACAGGGGTCCCATTAAGGTTCAGTGGA AGTGGATCTGGGACAGAATTTACTTTCACCAT TAACAGCCTGCAGCCTGAAGATATTGCAACAT ATTCCTGTCAACAGTGTGATAATCTCCCGTC ACTTTCGGCGGAGGGACCAAGGTGGAGATCA AA<br><br>SEQ ID NO: 25377 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAATTATATCATATGGAGGAAG TAATAAATACTATGCAGACTCCGTGAAGGGCCG ATTCACCATCTCCAGAGACAATTCCAAGAATACG CTGTATCTGCAAATGAACAGCCTGAGAGCTGATG ACACGGCTGTGTATTACTGTGCGAGAAGTCAGC AGCTCGGCCGGGCTACGGTATGGACGTCTGGGG CCAGGGGACCACGGTCACCGTCCTCA<br><br>SEQ ID NO: 29383 |
| | | AA | DIQMTQSPSSLSASVGDRVTITCQASQDISNYLH WYQQKPGKAPKLLIYDASTLGTGVPLRFSGSGS GTEFTFTINSLQPEDIATYSCQQCDNLPLTFGGGT KVEIK<br><br>SEQ ID NO: 25378 | QVQLVESGGGVVQPGRSLRLSCAASGFTFSSYGMH WVRQAPGKGLEWVAIISYGGSNKYYADSVKGRFTI SRDNSKNTLYLQMNSLRADDTAVYYCARRSAARP GYGMDVWGQGTTVTVSS<br><br>SEQ ID NO: 29384 |
| iPS:434091 | 21-225_52B9 | NA | GCCATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAAGGAAAG CCCCTAAGCGCCTGATCTATGCTGCATCCAGT TTGCAAAGTGGGGTCCCATTAAGGTTCAGCGG CAGTGGATCTGGGACAGAATTCACTCTCACAA TCAGAAGCCTGCAGCCTGAAGATTTTGCAACT TATTACTGTCTACAGCATAATAGTTACCCATTC ACTTTCGGCCCTGGGACCAAAGTGGATATCAA A<br><br>SEQ ID NO: 25379 | CAGGTGCAGCTGGTGGAGTCTGGGGGAGGCGTG GTCCAGCCGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGATGAAAT AATAAATACTATGCAGACTCCGTGAAGGGCCGA TTCACCATCTCCAGAGACAATTCCAAGAACACGC TGTATCTGCAAATGAACAGCCTGAGCGCCGAGG ATTTCTCTGTACTACTGGGGCCAGGGAGTCTGGG GTCACCGTCTCCTCA<br><br>SEQ ID NO: 29385 |

FIGURE 50
(Continued)

| | | | |
|---|---|---|---|
| iPS:434093 | 21-225_52D10 | AA | AIQMTQSPSSLSASVGDRVTITCRASQGIRNDLG WYQQKPRKAPKRLIYAASSLQSGVPLRFSGSGS GTEFTLTIRSLQPEDFATYYCLQHNSYPFTFGPGT KVDIK<br>SEQ ID NO: 25380 | QVQLVESGGGVVQPGRSLRLSCAASGFTFSDYGM HWVRQAPGKGLEWVAVIWFDGNNKYYADSVKGR FTISRDNSKNTLYLQMNSLSAEDTAVYYCARELGF LSDYWGQGTLVTVSS<br>SEQ ID NO: 29386 |
| | | NA | GATGTTATGATGACCCAGATTCCACTCTCTCTG TCCGTCACCCCTGGACAGCCGGCCTCCATCTC CTGCAAGTCTAGTCAGAGCCTCCTGCATAGTG AAGGAAAGACCTATTTGTATTGGTACTTGCAG AAGCCAGGCCAGTCTCCACAGCTCCTGATCTT TGAAGTTTCCAACGGGTCTCTGGAGTGCCAG ATAGGTTCAGTGGCAGAGGTCAGGGACAGA TTTCACACTGAAATCAGCCGGGTGGAGGCTG AGGATGTTGGGGTTTATTACTGCATGCAAAGT ATACAGTATCCGATCACCTTCGGCCAAGGGAC ACGACTGGAGATTAAA<br>SEQ ID NO: 25381 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCACTTATATGGTATGATGGAAGT AATAAATACCATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAAGGTATAG CAGCAGCTGGTGGGCGGTATGGACGTCTGGGG CCAAGGGACCACGGTCACCGTCTCCTCA<br>SEQ ID NO: 29387 |
| | | AA | DVMMTQIPLSLSVTPGQPASISCKSSQSLLHSEG KTYLYWYLQKPGQPPQLLIFEVSNRVSGVPDRFS GRGSGTDFTLKISRVEAEDVGVYYCMQSIQYPIT FGQGTRLEIK<br>SEQ ID NO: 25382 | QVQLVESGGGVVQPGRSLRLSCAASGFTFSSYGMH WVRQAPGKGLEWVALIWYDGSNKYHADSVKGRF TISRDNSKNTLYLQMNSLRAEDTAVYYCARRYSSS WSGGMDVWGQGTTVTVSS<br>SEQ ID NO: 29388 |

FIGURE 50
(Continued)

| | | | |
|---|---|---|---|
| iPS:434095 | 21-225_52F10 | NA | GACATCCAGATGACCCAGTCTCCATCCTCACTGTCTGTATCTGTAGGAGACAGAGTCACCATCACTTGTCGGGCGAGTCAGGGTCAGGGTATTAGTAGTAATTATTTAGGCTGGTTTCAGCAGAAACCAGGGAAAGCCCCGAAGTCCCTGATTTATGCTGCATCTAGTTTGCAAAGTGGGGTCCCATCAAGGTTCAGCGGCAGTGGATCTGGGACAGATTTCACTCTCACCATCAGCAGCCTACAGCCTGAAGATTATGTTATCCTGATTACTGCCAACAGTATAATAGTTATCCTCGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTTTCTATGGCATGCACTGGGTCCGCCAGGCTCCAGGCAAGGGGCTGGAGTGGGTGGCAGTTATATGGACGATGGAAGTAATAAATACTATGCAGACTCCGTGAAGGGCCGATTCACCATCTCCAGAGACAATTCCAAGAACACGCTGTTTCTGCAAATGATGAGCCTGAGAGCCGAGGACACGGCTGTGTATTACTGTGCGAGAGATTCTGTATAGCAGCAGCTGGTTGTTTGACTACTGGGGCCAGGGAACCCTGGTCACCGTCTCCTCA |
| | | | SEQ ID NO: 29389 |
| | | AA | DIQMTQSPSSLSVSVGDRVTITCRASQGISNYLGWFQQKPGKAPKSLIYAASSLQSGVPSRFSGSGSGTDFTLTISSLQPEDFATYYCQQYNSYPPTFGQGTKVEIK | QVQLVESGGGVVQPGRSLRLSCAASGFTFSFYGMHWVRQAPGKGLEWVAVIWDDGSNKYYADSVKGRFTISRDNSKNTLFLQMMSLRAEDTAVYYCARDSLYSSSWLFDYWGQGTLVTVSS |
| | | | SEQ ID NO: 25383 | SEQ ID NO: 29390 |
| iPS:434097 | 21-225_52H10 | NA | GACATCCAGATGACCCAGTCTCCATCTTCCGTGTCTGCATCTGTGGGAGACAGAGTCACCATCACTTGTCGGGCGAGTCAGGATATTAACAGTTGGTTAGCCTGGTATCAGCAGAAACCAGGGAAAGCCCCTAAACTCCTGATCTATGTTGCATCCAGTTTGCAAAGTGGGGCCCCATCAAGGTTCAGCGGCAGTGGATCTGGGACAGATTTCACTCTCACCATCAGGAGCCTGCAGCCTGAAGATTTTGCTACTTACTATTGTCAACAGGCTAAAAGTTTCCCATTCACTTTCGGCCCTGGGACCAAAGTGGATATCAAA | CAGGTGCAGCTGGTGGTGCAGTCTGGGGCTGAGGTGAAGAAGCCTGGGGCCTCAGTGAAGGTCTCCTGCAAGGCTTCTGGATACACCTTCACCGGCTACTATATGCAGTGGGTGCGACAGGCCCCTGGACAAGGGCTTGAGTGGATGGGATGGATCAACCCTAACAATGGTGGCACACAGTATGCACAGAAGTTTCAGGGCGGGTCACCATGACCAGGGACACGTCCATCAGCACAGCCTACATGGAACTGAGCAGGCTGAGATCTGAAGCTACACGGCCGTCTTTGACTACTGTGCGAGAGATGGCCGACACGGCCGTCTTTGACTACTGTGCGAGAGATGCCACCTCGTCTTTGACTACTGGGGCCAGGGAACCCTGGTCACCGTCTCCTCG |
| | | | SEQ ID NO: 25384 | SEQ ID NO: 29391 |
| | | | SEQ ID NO: 25385 | |

FIGURE 50
(Continued)

| | | | |
|---|---|---|---|
| iPS:434101 | | AA | DIQMTQSPSSVSASVGDRVTITCRASQDINSWLA WYQQKPGKAPKLLIYVASSLQSGAPSRFSGSGS GTDFTLTIRSLQPEDFATYYCQQAKSFPFTFGPGT KVDIK | QVQLVQSGAEVKKPGASVKVSCKASGYTFTGYHM QWVRQAPGQGLEWMGWINPNGGTQYAQKFQGR VTMTRDTSISTAYMELSRLRSDDTAVYYCARDGTS SFDYWGQGTLVTVSS |
| | | | SEQ ID NO: 25386 | SEQ ID NO: 29392 |
| | | NA | GACATCCAGATGACCCAGTCTCCATCCTCCCT GTCTGCATCTGTAGGAGACAGAGTCACCATCA CTTGCCGGGCAAGTCAGGGCATAAGAAATAAT TTAGGCTGGTATCAGCAGAAACCAGGGAAAG CCCCTAAGCGCCTGATCTATGTGCATCCAGT TTGCAAAGTGGGGTCCCATCCAAGGTTCAGCGG CAGTGGATCTGGGACAGATTCACTCTCACAA TCAGCAGCCTGCAGCCTGAAGATTTTGCAACT TATTACTGTCTACAGTATATAAGTTATCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTACT TACATATACTACGCAGACTCAGTGAAGGGCCGAT TCACCGTCTCCAGAGACAACGCCAAGAACTCACT GTATCTGCAAGTGAACAGCCTGAGAGCCGAGGA CACGGCTGTGTATTACTGTGCGAGAGTCAACTCC TTTGACTACTGGGGCCAGGGAACCCTGGTCACCG TCTCCTCA |
| | | | SEQ ID NO: 25387 | SEQ ID NO: 29393 |
| 21-225_52H12 | | AA | DIQMTQSPSSLSASVGDRVTITCRASQGIRNNLG WYQQKPGKAPKRLIYGASSLQSGVPSRFSGSGS GTEFTLTISSLQPEDFATYYCLQYNSYPFTFGPGT KVDIK | EVQLVESGGGLVKPGGSLRLSCAASGFTFSSYSMN WVRQAPGKGLEWVSSISGSSTYIYYADSVKGRFTV SRDNAKNSLYLQVNSLRAEDTAVYYCARVNSFDY WGQGTLVTVSS |
| | | | SEQ ID NO: 25388 | SEQ ID NO: 29394 |

FIGURE 50
(Continued)

| | | | | |
|---|---|---|---|---|
| iPS:434103 | 21-225_53G1 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGAAAG CCCCTAAGCGCCTGATCTATCCTGCATCCAGTT TACAAAGTGGGGTCCCATCAAGGTTCAGCGGC AGCGGATCTGGGACAGATTCAGTCTCACAAT CAGCAGCCTGCAGCCTGAAGATTTTGCAACTT ATTACTGTCTACAGGATAATAGTTACCCATTC ACTTTCGGCCCTGGGACCAAAGTGGATATCAA A  SEQ ID NO: 25389 | GAGGTGCAGCTGGTGGAGTCTGGGGGAGGCTG GTCAAGCCTGGGGAGTCCCTGAGACTCTCCTGTG CAGCCTCTGGATTCACCTTCAGTAGTAGCAT GAACTGGGTCCGCCAGGCTCCAGGGAAGGGGCT GGAGTGGGTCTCATCCATTAGTGGTAGTAGTAGT TACATATACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGGGGC AGCACCTGGGGCCAGGAACCCTGGTCACCGTCT CCTCA  SEQ ID NO: 29395 |
| | | AA | DIQMTQSPSSLSASVGDRVTITCRASQGIRNDLG WYQQKPGKAPKRLIYPASSLQSGVPSRFSGSGSG TEFSLTISSLQPEDFATYYCLQDNSYPFTFGPGTK VDIK  SEQ ID NO: 25390 | EVQLVESGGGLVKPGESLRLSCAASGFTFSSYSMN WVRQAPGKGLEWVSSISGSSSYIYYADSVKGRFTIS RDNAKNSLYLQMNSLRAEDTAVYYCARDRGSTW GQGTLVTVSS  SEQ ID NO: 29396 |
| iPS:434105 | 21-225_53D2 | NA | GACATCCAGATGACCCAGTCTCCATCCTCCCT GTCTGCATCTGTAGGAGACAGAGTCACCATCA CTTGCCGGGCAAGTCAGGACAGAGTCAGCAGCA TTAGGCTGGTATCAGCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGATACCCGCT CACTTTCGGCGGAGGGACCAAGGTGGAGATC AAA  SEQ ID NO: 25391 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAATGGGTGGCAGTTGTATGGGATGATGAAG TAATAAATACTATGCAGAGACTCCGTGAAGGCCG ATTCACCATCTCCAAATGAACAGCCTGAGAGACACG CTGTATCTGCAAATGAACAGCCTGAGAGGGCCTTG GACACGGCTGTGTATTACTGTACGGAGGGCCTTG GCTTTACGGAGACTACTGGGGCCAGGGAGCC TGGTCACCGTCTCCTCA  SEQ ID NO: 29397 |

FIGURE 50
(Continued)

| | | | |
|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPLTFGGG TKVEIK | QVQLVESGGGVVQPGRSLRLSCAASGFTFSNYGM HWVRQAPGKGLEWVTVVWDDGSNKYYADSVKG RFTISRDNSKNTLYLQMNSLRAEDTAVYYCTRGLG FTGDYWGQGALVTVSS |
| | | | SEQ ID NO: 25392 | SEQ ID NO: 29398 |
| iPS:434107 | 21-225_53E2 | NA | GACATCCAGATGACCCAGTCTCCATCCTCCCT GTCTGCATCTGTAGGAGACAGAGTCACCATCA CTTGCCGGGCAAGTCAGAGTTTTAGCCACTAT TTAAAATTGGTATCAGCAGAAACCAGGGAAAG CCCCTAACCTCGATCTTTGCTGTATCCAGTT TGCAAAGTGGGGTCCCATCACGGTTCAGTGGC AGTGGATCTGGGTCAGATTCACTCTCCCAT CAGTAGTTTGCAACCTGCAGAGTTTCAGTACCCATTC ACTTCTGTCAACAGAGTTTCAGTACCCATTC ACTTTCGGCCCTGGGACCAAAGTGGATATCAA A | GAGGTGCAGTTGTTGGAGTCTGGGGGAGGCTTGA TACAGCCTGGGGGGTCCCTGAGACTCTCCTGTGC AGCCTCTGGATTCACCTTTAGGAGCTATGCCATG AGCTGGGTCCGCCAGGCTCCAGGGAAGGGGCTG GAGTGGGTCTCAGCTATTAGTGGTAGTGGTGTA ACACATTCTACGCAGACTCCGTGAAGGGCCGGT TCACCATCTCCAGAGACAATTCCAAGAACACGCTG TATTTGCAAATGAACACCCTGAGAGCCGACGAC ACGGCCGTATATTACTGTGCGAAAAAGGTCGTGG ATACAGCCATGGCTCTTGACTACTGGGGCCAGGG AACCCTGGTCACCGTCTCCTCA |
| | | | SEQ ID NO: 25393 | SEQ ID NO: 29399 |
| | | AA | DIQMTQSPSSLSASVGDRVTITCRASQSFSHYLN WYQQKPGKAPNLLIFAVSSLQSGVPSRFSGSGSG SDFTLPISSLQPEDFAIYFCQQSFSTPFTFGPGTKV DIK | EVQLLESGGGLIQPGGSLRLSCAASGFTFRSYAMS WVRQAPGKGLEWVSAISGSGGNTFYADSVKGRFTI SRDNSKNTLYLQMNTLRADDTAVYYCAKKVVDT AMALDYWGQGTLVTVSS |
| | | | SEQ ID NO: 25394 | SEQ ID NO: 29400 |

FIGURE 50
(Continued)

| | | | |
|---|---|---|---|
| iPS:434111 | 21-225_53H2 | NA | GACATCCAGATGACCCAGTCTCCATCCTCCT GTCTGCATCTGTAGGAGACAGAGTCACCATCA CTTGCCAGGCGAGTCAGGACATTAGCAACTAT TTACATTGGTATCAGCAGAAACCAGGGAAAGC CCCTCAGCTCCTGATCTACGATGCATCCAATT GGAAACAGGGGTCCCATCAAGGTTCACTGGA AGTGGATCTGGGACAGATTTTACTTTCACCAT CAGCAGCCTGCAGCCTGAAGATATTGCAACAT ATTACTGTCATCAGTATGATAATCTCCCGCTCA CTTTCGGCGGAGGGACCAAGGTGGAGATCAA A<br>SEQ ID NO: 25395 | CAGGTGCAGCTGGTGGAGTCTGGGGGAGGCGTG GTCCAGCCTGGGGAGGTCCCTGAGACTCTCCTGTG CAGCCTCTGGATTCACCTTCAGTAGCTATGGCAT GCACTGGGTCCGCCAGGCTCCAGGCAAGGGGCC GGAGTGGGTGGCAGTTATATCATATGGTGGAAGT AATAAATACCATGCAGACTCCGTGAAGGGCGA TTCACCATCTCCAGAGACAATTCCAAGAACACGC TGTATCTGCAAATGAACAGCCTGAGAGCTGAGG ACACGGCTGTGTATTACTGTGCGAGGCGGGGAG CAGCTCGTCCTGCTACGGTATGGACGTCTGGGG CCAAGGGACCACGGTCACCGTCTCCTCA<br>SEQ ID NO: 29401 |
| | | AA | DIQMTQSPSSLSASVGDRVTITCQASQDISNYLH WYQQKPGKAPQLLIYDASNLETGVPSRFTGSGS GTDFTFTISSLQPEDIATYYCHQYDNLPLTFGGG TKVEIK<br>SEQ ID NO: 25396 | QVQLVESGGGVVQPGRSLRLSCAASGFTFSSYGMH WVRQAPGKGPEWVAVISYGGSNKYHADSVKGRFT ISRDNSKNTLYLQMNSLRAEDTAVYYCARRGAAR PGYGMDVWGQGTTVTVSS<br>SEQ ID NO: 29402 |
| iPS:434115 | 21-225_53E4 | NA | GACATCCAGATGACCCAGTCTCCATCCTCACT GTCTGCATCTGTAGGAGACAGAGTCACCATCA CTTGTCGGGCGAGTCAGGTCAGTTATTAGCAGCAATTAT TTAGCCTGGTTTCAGCAGAAACCAGGGAAAGC CCCTAAGTCCCTGATCTGCTGCATCGAGTTT GCAAAGTGGGGTCCCATCAAAGTTCAGCGGCA GTGGATCTGGGACAGATTTCACTCTCACCATC AGCAGCCTGCAACAGTATCATAGTTACCACTCA CTACTGCCGCGTGGGACCAAAGTGGATATCAAA<br>SEQ ID NO: 25397 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGCT GGAGTGGGTCTCAGTTATTAGTGGTAGTGGTGGT CGCACATACTACGCAGACTCCGTGAAGGGCGG TTCAACATCTCCAGAGACAATTCCAAGAACACGC TGTATCTGCAAATGAACAGCCTGAGAGCCGAGG ACACGGCCGTCTATTACTGTGCGAGGGTTGGCCCT TTTTGACTACTGGGGCCAGGGAACCCTGGTCACC GTCTCCTCA<br>SEQ ID NO: 29403 |

FIGURE 50
(Continued)

| | | | | |
|---|---|---|---|---|
| | | AA | DIQMTQSPSSLSASVGDRVTITCRASQVISNYLA WFQQKPGKAPKSLISAASSLQSGVPSKFSGSGSG TDFTLTISSLQPEDFATYYCQQYHSYPLTFGRGT KVDIK | EVQLLESGGGLVQPGGSLRLSCAASGFTFSSYVMS WVRQAPGKGLEWVSGISGSGGRTYADSVKGRFN ISRDNSKNTLYLQMNSLRAEDTAVYYCARVALFDY WGQGTLVTVSS |
| | | | SEQ ID NO: 25398 | SEQ ID NO: 29404 |
| iPS:434117 | 21-225_53C6 | NA | GACATCCAGATGACCCAGTCTCCATCCTCCCT GTCTGCATCTGTAGGAGACAGAGTCACCATCA CTTGCCGGGCAAGTCAGTACAGTAGCGACTAT TTAAAATTGGTATCAGCAGAAACCAGGGAAAG CCCCTAAGGTCCTGATCTTTGCTGCATCCAGTT TGAAAAGTGGGGTCCCATCAAGGTTCAGTGGC AGTGGATCTGGGACAGATTTCACTCTCACCAT CAGCAGTCTGCAACCTGAGGATTTTGCGACTT ACTTCTGTCAACAGAGTTACAGTACCCCGTTC ACCTTCGGCCAAGGGACACGACTGGAGATTAA A | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGTATTAGTGGTAGTGGTGGT GCCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTATTGTGCGAAACCTCTAGT GGGAGCCCATGATGCTTTTGAAATCTGGGGCCAA GGGACAATGGTCACCGTCTCTTCA |
| | | | SEQ ID NO: 25399 | SEQ ID NO: 29405 |
| | | AA | DIQMTQSPSSLSASVGDRVTITCRASQYSSDYLN WYQQKPGKAPKVLIFAASSLKSGVPSRFSGSGSG TDFTLTISSLEPEDFATYFCQQSYSTPFFGQGTR LEIK | EVQLLESGGGLVQPGGSLRLSCAASGFTFSSYAMN WVRQAPGKGLEWVSAISGSGGATYYADSVKGRFT ISRDNSKNTLYLQMNSLRAEDTAVYYCAKPLVGA HDAFEIWGQGTMVTVSS |
| | | | SEQ ID NO: 25400 | SEQ ID NO: 29406 |

FIGURE 50
(Continued)

| | | | |
|---|---|---|---|
| iPS:434119 | 21-225_53F6 | NA | GACATCCAGATGACCCAGTCTCCATCCTCCCT GTCTGCCTCTGTAGGCGCCAGAGTCACCATCA CTTGCCGGGCAAGTCAGGGCATTAGAAATGAT TTAGGCTGGTATCAGCAGAAATCCGGGAAAGC CCCTAAGCGCCTGATCTATGCTGCATCCAATT TGCAAAGTGGGGGTCCCATCAAGGTTCAGCGGCA GTGGATCTGGGACAGATTCACTCTCACTATC AGCAGCCTGCAGCCTGAAGATTTTGCAACTTA TTTCTGTCTACAACATAAATCGTTACCCGCTCAC TTTCGGCGGAGGGACCAAGGTGGAGATCAAA

SEQ ID NO: 25401 | CAGGTTCCAGCTGGTGGTGGAGTCTGGGGAGGCGTG GTCCAGCCTGGGAGGTCCCTGAGACTCTCCTGTA CAACGTTCTGGATTCACCTTCAGTGACTATGGCAT CCACTGGGTCCGCCAGGCTCCAGGCAAGGGGCT GGAGTGGGTGGCAGTTATATGGTATGATGAAAGT AATAAATACTATGGAGACTCCGTGAAGGGCCGA TTCGCCATCTCCAGAGACAATTCCAAGAACACGC TGTATCTGCAAATGAACAGCCTGAGAGCCGAGG ACACGGCTGTGTATTATTGTGTGAGAGAACTGG GATGAGCGTCTGACTACTGGGGCCAGGGAACCCT GGTCACCGTCTCCTCA

SEQ ID NO: 29407 |
| | | AA | DIQMTQSPSSLSASVGARVTITCRASQGIRNDLG WYQQNPGKAPKRLIYAASNLQSGVPSRFSGSGS GTEFTLTISSLQPEDFATYFCLQHNRYPLTFGGGT KVEIK

SEQ ID NO: 25402 | QVQLVESGGGVVQPGRSLRLSCTTSGFTFSDYGIH WVRQAPGKGLEWVAVIWYDESNKYYGDSVKGRF AISRDNSKNTLYLQMNSLRAEDTAVYYCVRELGM TSDYWGQGTLVTVSS

SEQ ID NO: 29408 |
| iPS:434121 | 21-225_53F6 | NA | GACATCCAGATGACCCAGTCTCCATCCTCCCT GTCTGCATCTGTAGGAGACAGAGTCACCATCA CTTGCCAGGCGAGTCAAGACATTACCAACTAT TTAGATTGGTATCAGCAGAAACCTGGGAAAG CCCCTAAACTCCTGATCTACGATGCATCCAAT TTGGGAACAGGGGTCCCATCAAGGTTCAGTGG AAGTGGATCTGGGACAGATTTTACTTTCACCA TCAGCAGCCTGCAGCCTGAAGATATTGCAACA TATTACTGTCAACAGTGTGATAATCTCCCGCTC ACTTTCGGCGGAGGGACCAAGGTGGAGATCA AA

SEQ ID NO: 25403 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGGTGGAAGT AATAAATACGATGCAGACTCCGTGAAGGGCCGA TTCACCATCTCCAGAGACACAATTCCAAGAACACGC TGTATCTGCAAATGACCAGCCTGAGAGCTGAGG ACACGGCTGTGTATTACTGTGCGAGACGACGGGC AGCTCGTCCAGGTACGGTATGACGTCTGGGGC CAAGGGACCACGGTCACCGTCTCCTCA

SEQ ID NO: 29409 |

FIGURE 50
(Continued)

| | | AA | DIQMTQSPSSLSASVGDRVTITCQASQDITNYLD WYQQKPGKAPKLLIYDASNLGTGVPSRFSGSGS GTDFTFTISSLQPEDIATYYCQQCDNLPLTFGGGT KVEIK<br><br>SEQ ID NO: 25404 | QVQLVESGGGVVQPGRSLRLSCAASGFTFSSYGMH WVRQAPGKGLEWVAVISYGGSNKYDADSVKGRFT ISRDNSKNTLYLQMTSLRAEDTAVYYCARRRAARP GYGMDVWGQGTTVTVSS<br><br>SEQ ID NO: 29410 |
|---|---|---|---|---|
| iPS:434123 | 21-225_53F7 | NA | GACATCCAGATGTCCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGCTCGGGACAGATTTCACTCTCACCAT CAGCAGCCTGCAGCCTGAAGATTTTGCAATTT ACTATTGTCAGCAGGCTAACAGTTTCCCATTC ACTTTCGGCCCTGGGACCAAAGTGGATATCAA A<br><br>SEQ ID NO: 25405 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAACAACCTAACAATAA CGGCACAAACTATGCACAGAAGTTTCAGGGCAG GGTCACCATGACCAGGGACACGTCCATCAGCAC AGCCTACATGGAGCTGAACAGGCTGACATCTGA CGACACGGCCGTGTATTACTGTGCGAGAGACGGT ACCAGCAGCTTTGACTACTGGGGCCAGGGAACC CTGGTCACCGTCTCCTCA<br><br>SEQ ID NO: 29411 |
| | | AA | DIQMSQSPSSVSASVGDRVTITCRASQGISRWLA WYQQKPGKAPNLLIYAASSLQSGVPSRFSGSGS GTDFTLTISSLQPEDFAIYYCQQANSFPFTFGPGT KVDIK<br><br>SEQ ID NO: 25406 | QVQLVQSGAEVKKPGASVKVSCKASGYTFTGYHM HWVRQAPGQGLEWMGWINPNNNGTNYAQKFQGR VTMTRDTSISTAYMELNRLTSDDTAVYYCARDGTS SFDYWGQGTLVTVSS<br><br>SEQ ID NO: 29412 |

FIGURE 50 (Continued)

| | | | |
|---|---|---|---|
| iPS:434127 | 21-225_53H8 | NA | GAAATTGTGTTGACGCAGTCTCCAGGCACCCT GTCTTTGTCTCCAGGGGAAAGAGCCACCCTCT CCTGCAGGGCCAGTCAGTCAGAGTATTACAAGCAGC TACTTAGCCTGGTACCAGCAGAAACCTGGCCA GGCTCCCAGGCTCCTCATCTATGGTGCGTCCG GCAGGGCCACTGGCATCCCAGACAGGTTCAGT GGCAGTGGGTCTGGGACAGACTTCACCCTCAC CATCAGCAGACTGGAGCCTGAAGATTTTGCAG TGTATTACTGTCAGCAGTTTGAAAGCTCACC ATGTGCAGTTTTGGCCAGGGGACCAACCTGGA GATCAAA<br><br>SEQ ID NO: 25407 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAGTTATATGACTCCTGAAGGCCGA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGGCCGTAT TGGGTACTTTGACTCCTGGGGCCAGGGAACCCTG GTCACCGTCTCCTCA<br><br>SEQ ID NO: 29413 |
| iPS:434129 | 21-225_53B12 | AA | EIVLTQSPGTLSLSPGERATLSCRASQSITSSYLA WYQQKPGQAPRLLIYGASGRATGIPDRFSGSGS GTDFTLTISRLEPEDFAVYYCQQFESSPMCSFGQ GTNLEIK<br><br>SEQ ID NO: 25408 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARARIGY FDSWGQGTLVTVSS<br><br>SEQ ID NO: 29414 |
| | | NA | GACATCCAGATGACCCAGTCTCCATCCTCCCT GTCTGCATCTGTAGGAGACAGAGTCACCATCA CTTGTCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTAGTACCCATTC ACTTTCGGCCCTGGGACCAAAGTGGATATCAA A<br><br>SEQ ID NO: 25409 | CAGGTGCAGCTGGTGGAGTCTGGGGGAGGCGTG GTCCAGCCTGGGGAGGTCCCTGAGACTCTCCTGTG CAGCGTCTGGATTCACCTTCAGTAACTTTGGCAT GCACTGGGTCCGCCAGGCTCCAGGCAAGGGGCT GGAGTGGGTGGCAGTTGTATGGTATGATGGAAAT AATAGATACTATGCAGACTCCGTGAAGGGCCGA TTCACCATCTCCAGAGACAATTCCAAGAACACGC TCTATCTGCAAATGCACAGCCTGAGAGCCGAGG ACACGGCTGTGTATTACTGTGCGAGGGAACTGGG ATTTCTCTCTGACTTCTGGGGCCAGGGAACCCTG GTCACCGTCTCCTCA<br><br>SEQ ID NO: 29415 |

FIGURE 50
(Continued)

| | | | |
|---|---|---|---|
| iPS:434131 | 21-225_54D3 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 25410 | QVQLVESGGGVVQPGRSLRLSCAASGFTFSNFGMH WVRQAPGKGLEWVAVVWYDGNNRYYADSVKGR FTISRDNSKNTLYLQMHSLRAEDTAVYYCARELGF LSDFWGQGTLVTVSS<br>SEQ ID NO: 29416 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGATTCAGCGG CAGTGGATCTGGGACAGAATTCACTCTCACAA TCAGCAGCCTGCAGCCTGAAGATTTTGCAACT TATTACTGTCTACAACATAATAGTTACCCATTC ACTTTCGGCCCTGGGACCAAAGTGGATATCAA A<br>SEQ ID NO: 25411 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTACATGATCCGTGAGGCCGAT AATAACTACTATGCAGACTCCGTGAAGGGCCGAT TCACCATCTCCAGAGACAATTCCAAGAACACGCT GTATCTGCAAATGAACAGCTGAGAGCCGAGA CACGGCTGTGTATTACTGTGCAGAGAACTGGGG TTCCTTTCTGATTATTGGGGCCAGGGAACCCTGG TCACCGTCTCCTCA<br>SEQ ID NO: 29417 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 25412 | QVQLVESGGGVVQPGRSLRLSCAASGFTFSNYGM HWVRQAPGKGLEWVAVTWFDGNNNYYADSVKG RFTISRDNSKNTLYLQMNSLRAEDTAVYYCARELG FLSDYWGQGTLVTVSS<br>SEQ ID NO: 29418 |

FIGURE 50
(Continued)

| | | | |
|---|---|---|---|
| iPS:434133 | 21-225_54G3 | NA | GACATCCAGATGACCCAGTCTCCATCTTCCGT GTCTGCATCTGTAGGAGACAGAGTCACCATCA CTTGTCGGGCGAGTTCAGGTATTAGCAGTGG TTAGCCTGGTATCAGCAGAAACCAGGGAAAG CCCCTAAACTCCTGATCTATGATGCATCCAGTT TGCAAAGTGGGGTCCCATCAAGGTTCAGCGGC AGTGGATCTGAGACAGATTTCACTCTCACCAT CAGCAGCCTGCAGCCTGAAGATTTTGCAACTT ACTATTGTCAACAGGCTAACAGTTTCCCGTGG ACGTTCGGCCAAGGGACCAAGGTGGAAATCA AA | GAGGTGCAGCTGTTGGAGTCTGGGGGAGGCTTG GTACAGCCTGGGGGGTCCCTGAGACTCTCCTGTG CAGCCTCTGGATTCACCTTTAGCACCTATGCCAT GAGTTGGGTCCGCCAGGCTCCAGGGAAGGGGCT GGAGTGGGTCTCAGCTATTAGTGGTAGTGGTGTT AACACATTCTACGCAGACTCCGTGAAGGGCCGGT TCACCATCTCCAGAGACAATTCCAAGAACACGCT GTTTCTGCAAATGAACAGCCTGAGAGCCGAGGA CACGGCCGTATATTACTGTGCGAAACTGGGGAA GGACTACTACTACGGTATGACGTCTGGGGC CAAGGGACCACGGTCACCGTCTCCTCA |
| | | | SEQ ID NO: 25413 | SEQ ID NO: 29419 |
| | | AA | DIQMTQSPSSVSASVGDRVTITCRASQGISSWLA WYQQKPGKAPKLLIYDASSLQSGVPSRFSGSGSE TDFTLTISSLQPEDFATYYCQQANSFPWTFGQGT KVEIK | EVQLLESGGGLVQPGGSLRLSCAASGFTFSTYAMS WVRQAPGKGLEWVSAISGSGVNTFYADSVKGRFTI SRDNSKNTLFLQMNSLRAEDTAVYYCAKLGKDYY YYGMDVWGQGTTVTVSS |
| | | | SEQ ID NO: 25414 | SEQ ID NO: 29420 |
| iPS:434135 | 21-225_54H3 | NA | GACATCCAGATGACCCAATCTCCATCTCCCT GTCTGCATCTGTTGGAGACAGAGTCACCATCA CTTGCCGGGCAAGTCAGGACATTAGAAATATT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGATTTCACTCTCACAA TCAGCAGCCTGCAGCCTGAGGATTTTCGCAACT TATTACTGTCTACAGTATAATAGTTACCCGTG GACGTTCGGCCAAGGGACCAAGGTGGAAATC AAA | GAGGTGCAGCTGTGGTGGAGTCTGGGGGAGGCCTG GTCAAGCCTGGGGGGTCCCTGAGACTCTCCTGTG CAGCCTCTGGATTCACCTTCAGTAGCTATAGCAT GATCTGGGTCCGCCAGGCTCCAGGGAAGGGGCT GGAGTGGGTCTCATCCATTAGTGGTACTAGTAGT TACATATACTACCAGAGTCAGTGAAGGCCGAT TCACCATCTCCAGAGACAACGCCAAGAACTCACT GTATCTGCAAATGAACAGCCTGAGAGCCGAGGA CACGGCTGTGTATTACTGTGCGGGAATGACTACA GTAATTTGGGGCCAGGGAACCCTGGTCACCGTCT CCTCA |
| | | | SEQ ID NO: 25415 | SEQ ID NO: 29421 |

FIGURE 50
(Continued)

| | | | |
|---|---|---|---|
| iPS:434137 | 21-225_54D4 | AA | DIQMTQSPSSLSASVGDRVTITCRASQDIRNILG WYQQKPGKAPKRLIYAASNLQSGVPSRFSGSGS GTEFTLTISSLQPEDFATYYCLQYNSYPWTFGQG TKVEIK<br>SEQ ID NO: 25416 | EVQLVESGGGLVKPGGSLRLSCAASGFTFSSYSMI WVRQAPGKGLEWVSSISGTSSYIYYADSVKGRFTIS RDNAKNSLYLQMNSLRAEDTAVYYCAGMTTVIW GQGTLVTVSS<br>SEQ ID NO: 29422 |
| | | NA | GATATTGTGATGACCCAGACTCCACTCTCTCT GTCCGTCACCCCTGGACAGCCGGCCTCCATGT CCTGCAAGTCTAGTCAGAGCCTCCTGCATAGT GAGGGAAAGACCTATTTGTATTGGTACCTGCG GAAGCCAGGCCAGCCTCCACAGTTCCTGATCT TTGAAGTTTCCAACCGGTTCTCTGGAGTGCCA GATAGGTTCAGTGGCAGCGGGTCAGGGACAG AATTCACACTGAAAATCAGCCGGTGGAGGCT GAGGATGTTGGGATTTATTACTGCATGCAAAG TATACAGTTTCCATTCACTTTCGGCCCTGGGAC CAAAGTGGATATATCAAA<br>SEQ ID NO: 25417 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATAGCAT GCACTGGGTCCGCCAGGCTCCAGGCAAGGGGCT GGAGTGGGTGGCAGTTATATGCAGACTCCGTAATGTATGAAGT AATAAATACTATGCAGACTCCGTGAAGGGCCGA TTCACCATCTCCAGAGACACATTCCAAGAACACGC TGTATCTGCAAATGAACAGCCTGAGAGCCGAGG ACACGGCTGTGTATTACTGTGCGAGAAGGTATAG CAGCAGCTGGTGGGCGGTATGGACGTCTGGGG CCAAGGGACCACGGTCACCGTCTCCTCA<br>SEQ ID NO: 29423 |
| | | AA | DIVMTQTPLSLSVTPGQPASMSCKSSQSLLHSEG KTYLYWYLRKPGQPPQFLIFEVSNRFSGVPDRFS GSGSGTEFTLKISRVEAEDVGIYYCMQSIQFPFTF GPGTKVDIK<br>SEQ ID NO: 25418 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS<br>SEQ ID NO: 29424 |

FIGURE 50
(Continued)

| | | | |
|---|---|---|---|
| iPS:434141 | 21-225_54C6 | NA | GACATCCAGATGACCCAGTCTCCATCTCCCT GTCTGCCTCTGTAGGCGACAGAGTCACCATCA CTTGCCGGGCAAGTCAGGGCATTAGAAATGAT TTAGGCTGGTATCAGCAGAAATCCGGGAAAGC CCCTAAGCGCCTGATCTATGCTGCATCCAATT GCAAAGTGGGGTCCCATCAAGGTTCAGCGGCA GTGGATCTGGGACAGAATTCACTCTCACTATC AGCAGCCTGCAGCCTGAAGATTTTGCAACTTA TTTCTGTCTACAGCATAATCGTTACCGCTCAC TTTCGGCGGAGGGACCAAGGTGGAGATCAAA<br><br>SEQ ID NO: 25419 | CAGGTCCAGCTGGTGGAGTCTGGGGGAGGCGTG GTCCAGCCTGGGAGGTCCCTGAGACTCTCCTGTA CAACGTCTGATTCACCTTCAGTGACTATGGCAT CCACTGGGTCCGCCAGGCTCCAGGCAAGGGCT GGAACTGGGTGGCAGTTATATGGTATGATGAAAAT AATAAATACTATGCAGACTCCGTGAAGGGCCGA TTCGCCATCTCCAGAGACAATTCCAAGAACACGC TGTATCTGCAAATGAACAGCCTGAGAGCCGAGG ACACGGCTGTGTATTATTGTGTGAGAGAACTGGG GATGACGTCTGACTACTGGGGCCAGGGAACCCT GGTCACCGTCTCCTCA<br><br>SEQ ID NO: 29425 |
| | | AA | DIQMTQSPSSLSASVGARVTITCRASQGIRNDLG WYQQNPGKAPKRLIYAASNLQSGVPSRFSGSGS GTEFTLTISSLQPEDFATYFCLQHNRYPLTFGGGT KVEIK<br><br>SEQ ID NO: 25420 | QVQLVESGGGVVQPGRSLRLSCTTSGFTFSDYGIH WVRQAPGKGLDWVAVIWYDENNKYYADSVKGRF AISRDNSKNTLYLQMNSLRAEDTAVYYCVRELGM TSDYWGQGTLVTVSS<br><br>SEQ ID NO: 29426 |
| iPS:434143 | 21-225_54G7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTTGCAACT TCAGCAGCCTGCAGCCTGAAGATTTTGCAACT TATTACTGTCTACATCATATAATACTTACCCATTC ACTTTCGGCCCTGGGACCAAAGTGGATATCAA A<br><br>SEQ ID NO: 25421 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATGGTATGAGGAAAG TAATAAATACTATGGAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAATTGG GGTTCCTCTGACTACTGGGGCCAGGGAACCCT GGTCACCGTCTCCTCA<br><br>SEQ ID NO: 29427 |

FIGURE 50
(Continued)

| | | | |
|---|---|---|---|
| iPS:434145 | 21-225_55B1 | AA | DIQMTQSPSSLSASVGDRVTITCRASQGIRNDLG WYQQKPGKAPKRLIYAASSLQSGVPSRFSGSGS GTEFTLTISSLQPEDFATYYCLHHNTYPFTFGPGT KVDIK<br>SEQ ID NO: 25422 | QVQLVESGGGVVQPGRSLRLSCAASGFTFSNYGM HWVRQAPGKGLEWVAVIWYEESNKYYGDSVKGR FTISRDNSKNTLYLQMNSLRAEDTAVYYCARELGF LSDYWGQGTLVTVSS<br>SEQ ID NO: 29428 |
| | | NA | GACATCCAGATGACCCAGTCTCCATCTTCCGT GTCTGCATCTGTAGGGGACAGAGTCACCATCA CTTGTCGGGCGAGTCAGGTCAGGTTATTAGCCGCTGG TTAGCCTGGTATCAGCAGAAACCAGGGAAAG CCCCTAACCTCCTGATCTATGCTGCATCCAGTT TGCAAAGTGGGGTCCCATCAAGGTTCAGCGGC AGTGGATCTGGGACAGATTTCACTCTGACCAT CAGCAGCCTGCAGCCTGAAGATTTTGCAACTT ACTATTGTCAACAGGCTAACAGTTTCCCATTC ACTTTCGGCCCTGGGACCAAAGTGGATCTCAA A<br>SEQ ID NO: 25423 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATT TCCACTGGGTGCGACAGGCCCCTGGTCAAGGGCT TGAGTGGATGGGATGGATCCACCTAACAATAAT GCCAACAAACTATGCAGCCAGAAGTTTCAGGCAGG GTCACCATGACCAGGGACACGTCCATCAGCACA GCCTACATGGAGCTGAGCAGGCTGAGATCTGAC GACACGGCCGTGTATTACTGTGCGAAGGATGGC AGATGTCTCCTTTGACTACTGGGGCCAGGGAACCC TGGTCACCGTCTCCTCA<br>SEQ ID NO: 29429 |
| | | AA | DIQMTQSPSSVSASVGDRVTITCRASQVISRWLA WYQQKPGKAPNLLIYAASSLQSGVPSRFSGSGS GTDFTLTISSLQPEDFATYCCQQANSFPFTFGPGT KVDLK<br>SEQ ID NO: 25424 | QVQLVQSGAEVKKPGASVKVSCKASGYTFTGYYF HWVRQAPGQGLEWMGWIHPNNNATNYAQKFQGR VTMTRDTSISTAYMELSRLRSDDTAVYYCAKDGRS SFDYWGQGTLVTVSS<br>SEQ ID NO: 29430 |

FIGURE 50
(Continued)

| | | | |
|---|---|---|---|
| iPS:434147 | 21-225_55E1 | NA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCGACTTAGCCTGGTACCAGCAGAAACCTGGCCAGGCTCCCAGGCTCCTCATCTATGATGCATCCGCCAGGGCCACTGGTATCCCAGCCAGGTTCAGTGGCAGTGGGTCTGGGACAGAGTTCACTCTCACCATCAGCAGCCTGCAGTCTGAAGATTTTGCATTTTATTACTGTCAGCAGTATTATAACTGGCCTCTCACTTTCGGCGGAGGGACCAAGGTGGAGATCAA | GAGGTGCAACTGTTGGAGTCTGGGGAGGCTTGGTACAGCCTGGGGGCTCCCTGAGACTCTCCTGTGCAGCCTCTGATTCACCTTTAGCAGTCTATGCCATGAGCTGGGTCCGCCAGGCTCCAGGGAAGGGCTGGAGTGGGTCTCAGTATTAGTGGTCGTGGTAGTAGCACATTCTACGCAGACTCCGTGAAGGGCCGGTTCACCATCTCCAGAGACAACGCCAAGAACACGCTGTATCTGCAAATGAACAGCCTGAGAGCCGAGGACACGGCCGTTTTTTACTGTGCGAAAGATCACGGTATAGTGGGAACTACTATTTACTTGACTACTGGGCCAGGGAACCCTGGTCACCGTCCTCA |
| | | | SEQ ID NO: 25425 | SEQ ID NO: 29431 |
| | | AA | EIVMTQSPATLSVSPGERATLSCRASQSVSSDLAWYQLKPGQAPRLLIYDASARATGIPARFSGSGSGTEFTLTISSLQSEDFAFYYCQQYYNWPLTFGGGTKVEIK | EVQLLESGGGLVQPGGSLRLSCAASGFTFSSYAMSWVRQAPGKGLEWVSAISGRGSSTFYADSVKGRFTISRDNSKNTLYLQMNSLRAEDTAVFYCAKDHGIVGTIYFDYWGQGTLVTVSS |
| | | | SEQ ID NO: 25426 | SEQ ID NO: 29432 |
| iPS:434149 | 21-225_55H1 | NA | GATATTGTGATGACCCAGACTCCACTCTCTGTCCGTGTCACCCTGGACAGCCGCCTCCATCTCCTGCAAATCTAGTCAGAGCCTCCTGCATAGTGAAGGAAAGAACCTATTTGTATTGGTACCTGCAGAAGCCAGGCCAGCCTCCACAGTTCCTGATCTTTGAAGTTTCCCACCGGTTCTCTGGAGTGCCAGATAGGTTCAGTGGCAGCGGGTCAGGGACAGATTTCACTCTGAAAATCAGCAGGGTGGAGGCTGAGGATGTTGGGGTTTATTACTGCATGCAAAGTATACAGCTTCCATTCACTTTCGGCCCTGGGACCAAAGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAAGAAGGTATAGCAGCAGCTGGTGCGGGCGGTATGGACGTCTGGGGCCAAGGGACCACGGTCACCGTCCTCA |
| | | | SEQ ID NO: 25427 | SEQ ID NO: 29433 |

FIGURE 50
(Continued)

| | | | |
|---|---|---|---|
| iPS:434151 | 21-225_55C2 | AA | DIVMTQTPLSLSVTPGQPASISCKSSQSLLHSEGK TYLYWYLQKPGQPPQFLIFEVSHRFSGVPDRFSG SGSGTDFTLKISRVEAEDVGVYYCMQSIQLPFTF GPGTKVDIK<br>SEQ ID NO: 25428 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTSS<br>SEQ ID NO: 29434 |
| | | NA | GATGTTATGATGACCCAGATTCCACTCTCTCTG TCCGTCACCCCTGGACAGCCGGCCTCCATCTC CTGCAAGTCTAGTCAGAGCCTCGTGCATAGTG AAGGAAAGACCTATTTGTATTGGTATTTGCAG AAGCCAGGCCAGCCTCCACAGCTCCTGATCTT TGAAGTTTCCAACGGGTCTCTGGAGTGCCAG ATAGGTTCAGTGGCAGAGGTCAGGGACAGA TTTCACACTGAAAATCAGCCGGGTGGAGGCTG AGGATGTTGGGGTTTATTACTGCATGCAAAGT ATACTGTATCCGATCACCTTCGGCCAAGGGAC ACGACTGGAGATTAAA<br>SEQ ID NO: 25429 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCACTTATATGGTATGATGGAAGT AATAAATACCATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGCGCGAGAAGGTATAG CAGCAGCTGGTGGGGCGGTATGGACGTCTGGGG CCAAGGGACCACGGTCACCGTCTCCTCA<br>SEQ ID NO: 29435 |
| | | AA | DVMMTQIPLSLSVTPGQPASISCKSSQSLVHSEG KTYLYWYLQKPGQPPQLLIFEVSNRVSGVPDRFS GRGSGTDFTLKISRVEAEDVGVYYCMQSILYPIT FGQGTRLEIK<br>SEQ ID NO: 25430 | QVQLVESGGGVVQPGRSLRLSCAASGFTFSSYGMH WVRQAPGKGLEWVALIWYDGSNKYHADSVKGRF TISRDNSKNTLYLQMNSLRAEDTAVYYCARRYSSS WSGGMDVWGQGTTVTSS<br>SEQ ID NO: 29436 |

FIGURE 50
(Continued)

| | | | | |
|---|---|---|---|---|
| iPS:434155 | 21-225_55B3 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTAGATCTGGGACAGAATTCACTCTCACAA TCAGCAGCCTGCAGCCTGAAGATTTTGCATCT TATTACTGTCTACAACATATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAGTTATATGAGACTCCGTGAAAT AATAAATACTATGAAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGTGAGGGAACTGG ATTTCTCTGACTACTGGGGCCAGGGAACCCTG GTCACCGTCTCCTCA |
| | | | SEQ ID NO: 25431 | SEQ ID NO: 29437 |
| | | AA | DIQMTQSPSSLSASVGDRVTITCRASQGIRNDLG WYQQKPGKAPKRLIYAASSLQSGVPSRFSGSRS GTEFTLTISSLQPEDFASYYCLQHNSYPFTFGPGT KVDIK | QVQLVESGGGVVQPGRSLRLSCAASGFTFSSYGMH WVRQAPGKGLEWVAVIWFDGNNKYYEDSVKGRF TISRDNSKNTLYLQMNSLRAEDTAVYYCVRELGFL SDYWGQGTLVTVSS |
| | | | SEQ ID NO: 25432 | SEQ ID NO: 29438 |
| iPS:434157 | 21-225_55D4 | NA | GACATCCAGATGACCCAGTCTCCATCCTCTCT GTTTGCATCTGTAGGAGACAGAGTCACCATCA CTTGTCGGGCGAGTCAGGACATTAGCAATTAT TTAATCTGGTTTCAGCAGAAACCAGGGAAAGC CCCTAAGTCCCTGATTTATACTGCATCCAGTTT GCAAAGTGGGGTCCCCTCAAAGTTCAGCGGCA GTGGATTTGGGACAGATTTCACTCTCACCATC AGCAACCTGCAGCCTGAAGATTTTGCGACTTA TTACTGCCAACAGTATCATAGTTTCCCTCTCAC TTTCGGCGGAGGGACCAAGGTGGAGATCAGA | GAGGTGCAACTGGTGGAGTCTGGGGGAGGCTG GTCAAGCCTGGGGGGTCCCTGAGACTCTCCTGTG CAGCCTCTGGATTCACCTTCAACTTCAATAGTTATAGGAT GAACTGGGTCCGCCAGGCTCCAGGCAAGGAAGGGCT GGAGTGGGTCTCATCCATTAGTAGTAGTAGTAAT CACATAGACTACGCAGAGTCAGTGAAGGGCCGA TTCACCATCTCCAGAGACAACGCCAAAAACTCAC TATATTTGCAAATGAACAGCCTGAGAGGGACTGAGG ACACGGCTTTATATTACTGTGCGAGAGAGGGACTGA CTACTGGGGCCAGGGAACCCTGGTCTCCGTCTCC TCA |
| | | | SEQ ID NO: 25433 | SEQ ID NO: 29439 |

FIGURE 50
(Continued)

| | | | |
|---|---|---|---|
| iPS:434159 | 21-225_55B8 | AA | DIQMTQSPSSLFASVGDRVTITCRASQDISNYLIWFQQKPGKAPKSLIYTASSLQSGVPSKFSGSGFGTDFTLTISNLQPEDFATYYCQQYHSFPLTFGGGTRVEIR<br>SEQ ID NO: 25434 | EVQLVESGGGLVKPGGSLRLSCAASGFTFNSYRMNWVRQAPGKGLEWVSSISSSNHIDYADSVKGRFTISRDNAKNSLYLQMNSLRAEDTALYYCARGTDYWGQGTLVSVSS<br>SEQ ID NO: 29440 |
| | | NA | GACATCCAGATGACCCAGTCTCCATCCTCCCTGTCTGCATCTGTAGGAGACAGAGTCACCATCACTTGCCGGGCAAGTCAGGCCATTAGAAATGATTTAGGCTGGTATCAGCAGAAACCAGGGAAAGCCCCTAAGCGCCTGATCTATGCTGCATTCAGGTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATATAGTTACCCTCTCACTTTCGGCGGAGGGACCAAGGTGGGGATCAAA<br>SEQ ID NO: 25435 | CAGGTGCAGCTGGTGGAGTCTGGGGGAGGCGTGGTCCAGCCTGGGAGGTCCCTGAGACTCTCCTGTGCAGCGTCTGATTCACCTTCAGTGACTTCTGACTATGGCATGCACTGGGTCCGCCAGGCTCCAGGCAAGGGGCTGGAGTGGGTGGCAGTTATATGTGATGAAAATAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTACGAGAGAATGTTTGACTACTGGGGCCAGGGAACCCTGGTCACCGTCTCCTCA<br>SEQ ID NO: 29441 |
| | | AA | DIQMTQSPSSLSSSVGDRVTITCRASQAIRNDLGWYQQKPGKAPKRLIHAAFRLQSGVPSRFSGSGSGTEFTLTISSLQPEDFATYYCLQHNSYPLTFGGGTKVGIK<br>SEQ ID NO: 25436 | QVQLVESGGGVVQPGRSLRLSCAASGFTFSDYGMHWVRQAPGKGLEWVAVIWYDENNKYYADSVKGRFTISRDNSKNTLYLQMNSLRAEDTAVYYCTREWFDYWGQGTLVTVSS<br>SEQ ID NO: 29442 |

FIGURE 50
(Continued)

| | | | |
|---|---|---|---|
| iPS:434161 | 21-225_55F9 | NA | GATATTGTGATGACCCAGACTCCACTCTCTCT GTCCGTCACCCCTGGACAGTCGGCCTCCATCT CCTGCAAGTCTAGTCAAAGCTCCTGCATAGT GAAGGAAAGACCTATTTGTATTGGTACTTGCA GAAGCCAGGCCAGCCTCCACAGCTCCTGATCT ATGAAGTTTCAACCGGTTCTCTGGAGTGCCA GATAGGTTCAGCGGCAGCGGGTCAGGACAG ATTTTACACTGAAAATCAGCGGGTGGAGGCT GAGGATGTTGGGGTTTATTACTGCATACAAAG TATACAACTTCCGATCACCTTCGGCCAAGGGA CACGACTGGAGATTAAA | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGTCCAGGCAAGGGCT GGAGTGGGTGGCAGTTATATGCAGACTCCGTGAAGGCCGA GGCAAATATTATGCAGACTCCGTGAAGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGGTCGGGCGGTATGGACGTCTGGGG CCAAGGGACCACGGTCACCGTCTCCTCA |
| | | | SEQ ID NO: 29443 |
| | | | SEQ ID NO: 25437 |
| | | AA | DIVMTQTPLSLSVTPGQSASISCKSSQSLLHSEGK TYLYWYLQKPGQPPQLLIYEVSNRFSGVPDRFSG SGSGTDFTLKISRVEAEDVGVYYCIQSIQLPITFG QGTRLEIK | QVQLVESGGGVVQPGRSLRLSCAASGFTFSSYGMH WVRQAPGKGLEWVAVIWYDGNGKYYADSVKGRF TISRDNSKNTLYLQMNSLRAEDTAVYYCARRYSSS WSGGMDVWGQGTTVTVSS |
| | | | SEQ ID NO: 25438 |
| | | | SEQ ID NO: 29444 |
| iPS:434163 | 21-225_50H1 | NA | GACATCCAGATGACCCAGTCTCCATCCTCCC GTCTGCTTCTGTAGGAGACAGAGTCACCATCA CTTGCCAGGCGAGTCAAGACATTAGCAACTAT TTAGATTGGTATCAGCAGAAACCAGGGAAAG CCCCTAAACTCCTGATATCGATGCATCCAAT TTGGAAACAGGGGTCCCATCAAGGTTCAGTGG AAGTGGATCTGGGACAGATTTGCTTTCACCA TCAGCAGCCTGCAGCCTGAAGATATTGCAACA TATTACTGTCAACAGTGTGATATAATCTCCGCTC ACTTTCGGCGGAGGGACCAAGGTGGAGATCA AA | CAGGTGCAGTTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGTCAATTATATCATATGGTGGAAGT AATAAATACGATGCAGACTCCGTGAAGGGCCGA TTCACCATCTCCAGAGACAATTCCAAGAACACGC TGTATCTGCAAATGACCAGCCTGAGAGCTGAGG ACACGGCTGTATATTACTGTGCGAGACGACGGGGC AGCTCGTCCAGGTACGGTATGGACGTCTGGGGC CAAGGGATCACGGTCACCGTCTCCTCA |
| | | | SEQ ID NO: 25439 |
| | | | SEQ ID NO: 29445 |

FIGURE 50
(Continued)

| | | | |
|---|---|---|---|
| iPS:434165 | 21-225_50F2 | AA | DIQMTQSPSPSASVGDRVTITCQASQDISNYLD WYQQKPGKAPKLLIYDASNLETGVPSRFSGSGS GTDFAFTISSLQPEDIATYYCQQCDNLPLTFGGG TKVEIK<br>SEQ ID NO: 25440 | QVQLVESGGGVVQPGRSLRLSCAASGFTFSSYGMH WVRQAPGKGLEWVSIISYGGSNKYDADSVKGRFTI SRDNSKNTLYLQMTSLRAEDTAVYYCARRRAARP GYGMDVWGQGITVTVSS<br>SEQ ID NO: 29446 |
| | | NA | GACATCCAGATGACCCAGTCTCCATCCTCCCT GTCTGCATCTGTAGGAGACAGAGTCACCATCA CTTGCCGGGCAAGTCAGAGACAGCATTCTCAGTTAT TTGAATTGGTATCAGCAGAAACCAGGAAAGG CCCCTAAACTCCTGATCTATGTTGCATCCAGTT TCCAAAGTGGGGTCCCATCAAGGTTCAGTGGC AGTGGATCTGGGACAGATTTCACTCTCACCAT CAGCAGTCTGCAACCTGATGATTTTGCAACTT ACTACTGTCAACAGAGTTACAGTCCCCCTCTC ACTTTCGGCGGAGGGACCAAGGTGGAGATCA AA<br>SEQ ID NO: 25441 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGACTCCAGGCAAGGGGCT GGAGTGGGTGGCAGTTATATGCAGATGATGAAG TAATAAATACTATGCAGACTCCGTGAAGGGCCG ATTCACCATCTCCAGAGACAACATTCCAAGAACACG CTGTATCTGCAAATGAACAGCCTGAGAGCCGAG GACACGGCTGTGTATTACTGTGCGAGAGACGAG CAGCTCGGGACCTTTGACTACTGGGGCCAGGGA ACCCTGGTCACCGTCCTCCTCA<br>SEQ ID NO: 29447 |
| | | AA | DIQMTQSPSSLSASVGDRITITCRASQSILSYLNW YQQKPGKAPKLLIYVASSFQSGVPSRFSGSGSGT DFTLTISSLQPDDFATYYCQQSYSPPLTFGGGTK VEIK<br>SEQ ID NO: 25442 | QVQLVESGGGVVQPGRSLRLSCAASAFTFSSYGMH WVRQTPGKGLEWVAVIWHDGSNKYYADSVKGRF TISRDNSKNTLYLQMNSLRAEDTAVYYCARDEQLG TFDYWGQGTLVTVSS<br>SEQ ID NO: 29448 |

FIGURE 50
(Continued)

| | | | |
|---|---|---|---|
| iPS:434167 | 21-225_50F3 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTGGCCTGGTTTCAGCAGAAACCAGGGAAAGC CCCTAAGCTCCTGATCTATGCTGCATCCAGTTT GCAAAATGGGGGTCCCGTCAAGGTTCAGCGGCA GTGGATCTGGGACAGATTTCACTCTCACCATC AGCAGCCTGCAACAGACTAACAGTTTCCAACTTA CTATTGCCAACAGACTAACAGTTTCCAATTCA CTTTCGGCCCTGGGACCAAAGTGGATATCAAA<br><br>SEQ ID NO: 25443 | GAGGTGCAGCTGTTGGAGTCTGGGGGAGGCTTG GTACAGCCTGGGGGGTCCCTGAGACTCTCCTGTG CAGCCTCTGGATTCACCTTTAGAACCTATGCCAT GACCTGGGTCCGCCAGGCTCCAGGGAAGGGGCT GGAGTGGGTCTCAGTATCGAGACTCCGTAGTGGTGTT AACTCATTCTACGCAGAGACAATTCCGAAGGCCGGT TCACCATCTCCAGAGACAATGAACAGCTGAAGAACACGCT GTATCTGCAAATGAACAGCCTGAGAGCCGAGGA CACGGCCGTATATTACTGTGCGAAAGCAAGGC AGTGGCTGGGTCACACTGGTTGACCCTGGGGC CAGGGAACCCTGGTCACCGTCTCCTCA<br><br>SEQ ID NO: 29449 |
| | | AA | DIQMTQSPSSVSASVGDRVTITCRASQDISSWLA WFQQKPGKAPKLLIYAASSLQNGVPSRFSGSGS GTDFTLTISSLQPEDFATYCQQTNSFPFTFGPGT KVDIK<br><br>SEQ ID NO: 25444 | EVQLLESGGGLVQPGGSLRLSCAASGFTFRTYAMT WVRQAPGKGLEWVSAISGSGVNSFYADSVKGRFTI SRDNSENTLYLQMNSLRAEDTAVYYCAKARAVAG SHWFDPWGQGTLVTVSS<br><br>SEQ ID NO: 29450 |
| iPS:434169 | 21-225_50C4 | NA | GACATCCAGATGACCCAGTCTCCATCCTCCCT GTCTGCATCTGTAGGAGACAGAGTCACCCTCA CTTGCCGGGCAAGTCAGGGCATTAGAAATGAT TTAGGCTGGTATCAGCAGAAACCAGGGATAGC CCCTAAGCGCCTGATCTATGCTGCATCCAGTT GCAAAGTGGGGGTCCCATCAAGGTTCAGCGGCA GTGGATCTGGGACAGATTTCACTCTCACAATC AGCAGCCTGCAGCCTGAAGATTTTGCAACTTA TTACTGTCTACAGCATATAATCGTTACCCATTCAC TTTCGGCCCTGGGACCAAAGTGGATATCAAA<br><br>SEQ ID NO: 25445 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGAAGAAAC TAATAAATACTATGCAGACTCCGTGAAGGGCCG ATTCACCATCTCCAGAGACAATGAACACAATTCCAAGAACACG CTGTATCTGCAAATGAACAGCTGAGAGGCGAG GACACGGCTGTGTATTACTGTGCGAGAGAAGTGG GGTTCCTGAATGACTACTGGGGCCAGGGAATCCT GGTCACCGTCTCCTCA<br><br>SEQ ID NO: 29451 |

FIGURE 50
(Continued)

| | | | | |
|---|---|---|---|---|
| | | AA | DIQMTQSPSSLSASVGDRVTLTCRASQGIRNDLG WYQQKPGIAPKRLIYAASSLQSGVPSRFSGSGSG TEFTLTISSLQPEDFATYYCLQHNRYPFTFGPGTK VDIK | QVQLVESGGGVVQPGRSLRLSCAASGFTFSDYGM HWVRQAPGKGLEWVAVIWYEETNKYYADSVKGR FTISRDNSKNTLYLQMNSLRGEDTAVYYCAREVGF LNDYWGQGILVTVSS |
| | | | SEQ ID NO: 25446 | SEQ ID NO: 29452 |
| iPS:434171 | 21-225_50G4 | NA | GACATCCAGATGACCCAGTCTCCAACCTCCCT GTCTGCATCTGTGGGAGACAGAGTCACCATCA CTTGCCAGGCGAGTCAGGACATTAATTCACCAACTTT TAAATTGGTATCAGCAGAAACCAGGGAAAG CCCCTAAGCTCCTGATCTACGATGCCTCCAATT TGGAAACAGGGGTCCCATCAAGGTTCAGTGGA AGTGGATCTGGGACAGATTTTACTTTCACCAT CAGCAGCCTTCAGCTGCAAGATATTGCAACAT ATTACTGTCAACAGTATGATAATCTGATCACC TTCGGCCAAGGGACACGACTGGAGATTAAA | CAGGTGCAGCTGGTGCAGTCTGGGGCTGAGGTG AAGGAGCCTGGGGCCTCAGTGAAGGTTTCCTGCA AGGCATCTGGATACACCTTCACCAGTTACTATAT ACACTGGGTGCGACAGGCCCCTGGACAAGGGCT TGAGTGGATGGGAGTAATCAACCCTAGTAATGGT AGAACAAGTACGCACAGAAGTTCCAGGCAGA GTCACCATGACCAGGGACACGTCCACGAGCACA GTCTACATGGAGCTGAGCAGCCTGAGATCTGAG GACACGGCCGTGTATTACTGTGCGAGAGATCGA GGAGATGGTTACTACTTCTACTACGGTATGGACG TCTGGGGCCAAGGGACCACGGTCACCGTCTCCTC A |
| | | | SEQ ID NO: 25447 | SEQ ID NO: 29453 |
| | | AA | DIQMTQSPTSLSASVGDRVTITCQASQDITNFLN WYQQKPGKAPKLLIYDASNLETGVPSRFSGSGS GTDFTFTISSLQPEDIATYYCQQYDNLITFGQGTR LEIK | QVQLVQSGAEVKEPGASVKVSCKASGYTFTSYYIH WVRQAPGQGLEWMGVINPSNGRTSYAQKFQGRVT MTRDTSTSTVYMELSSLRSEDTAVYYCARDRDG YYFYYGMDVWGQGTTVTVSS |
| | | | SEQ ID NO: 25448 | SEQ ID NO: 29454 |

FIGURE 50
(Continued)

| | | | | |
|---|---|---|---|---|
| iPS:434175 | 21-225_55A11 | NA | GACATCCAGATGACCCAGTCTCCATCCTCACT GTCTGCATCTGTAGGAGACAGAGTCACCATCA CTTGTCGGGCGAGTCAGGACATTAACATTTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGTCTGCAGCCTGAAGATTTTGCAACTTA TTACTGCCAACAGTATAATAGTTATCCTCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGACTCCAGGCAAGGGCT GGAGTGGGTGGCAGTTATATCATATGTTGGAAGT ACTAAATACTATGCAGACTCCGTGAGGGCCGAT TCACCATCTCCAGAGACAATTCCAAGAACACGCT GTATCTGCAAATGAACAGCCTGAGAACTGAGGA CACGGCTGTGTATTACTGTGCGAGAGGGAGAGGT CGATATAGTGACTACGGTCATGATGCTTTTGATA TCTGGGGCCAAGGGACAATGGTCACCGTCTCTTC A |
| | | | SEQ ID NO: 25449 | SEQ ID NO: 29455 |
| | | AA | DIQMTQSPSSLSASVGDRVTITCRASQDINIYLA WFQQKPGKAPKSLIYAASSLQSGVPSKFSGSGSG TDFTLTISSLQPEDFATYYCQQYNSYPLTFGGGT KVEIK | QVQLVESGGGVVQPGRSLRLSCAASGFTFSSYGMH WVRQTPGKGLEWVAVISYVGSTKYYADSVRGRFT ISRDNSKNTLYLQMNSLRTEDTAVYYCARGRGRYS DYGHDAFDIWGQGTMVTVSS |
| | | | SEQ ID NO: 25450 | SEQ ID NO: 29456 |
| iPS:434177 | 21-225_56A1 | NA | GACATCGTCATGACCCAGTCTCCAGACTCCCT GGCTGTGTCTCTGGGCGAGAGGGCCACCATCA ACTGCAAGTCCAGCCAGAGTGTTTTATACAGT TCCAACAATAAGAACTACTTAGTTTGGTACCA GCAGAAACCAGGACAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA | CAGGTACAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCAGGCAG TAACACAGGCTATGCACCAGGACAAGTTCAGGCAG AGTCACCATGACCAGGAACACCTCCATAAGCAC AGCCTACATGGAGCTGAGCAGCCTGAGATCTGA GGACACGGCCGTGTATTACTGTGCATATAGCAGT GGCTGGTACGTTTTTGACTACTGGGGCCAGGGA CCCTGGTCACCGTCTCCTCA |
| | | | SEQ ID NO: 25451 | SEQ ID NO: 29457 |

FIGURE 50
(Continued)

| | | | |
|---|---|---|---|
| iPS:434179 | | AA | DIVMTQSPDSLAVSLGERATINCKSSQSVLHSSN NKNYLVWYQQRPGQPPNLLIYWASTRESGVPD RFSGSGSGTDFTLTISSLQAEDVAVYYCQQYYST PPTFGQGTKVEIK<br>SEQ ID NO: 25452 | QVQLVQSGAEVKKPGASVKVSCKASGYTFTNYDIN WVRQATGQGLEWLGWMHPNSGNTGYAQKFQGR VTMTRNTSISTAYMELSSLRSEDTAVYYCAYSSGW YVFDYWGQGTLVTVSS<br>SEQ ID NO: 29458 |
| | | NA | GACATCCAGATGACCCAGTCTCCATCCTCCCT GTCTGCATCTGTAGGAGACAGAGTCACCATCA CTTGCCGGGCAAGTCAGGACATTAGAAATAAT TTAGGCTGGTATCAGCAGAAACCAGGGAAAG CCCCTAAGCGCCTGATCAATGCTGCATCCAGT TTACAAAGTGGGGTCCCATCCAAGGTTCAGCGG CAGTGGATCTGGGACAGAATTCACTCTCACAA TCAGCAGCCTGCAGCCTGAAGATTTTGCAACT TATTACTGTCTACAGGATAATAGTCACCCGTT CACTTTCGGCGGAGGGACCAAGGTGGAGATC AAA<br>SEQ ID NO: 25453 | GAGGTGCAGCTGGTGGAGTCTGGGGGAGGCTG GTCAAGTTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCATTAGTAGTAGTAGTACT TACATATACTACGGAGACTCAGTGAAGGGCCGA TTCACCATCTCCGAGACAACGCCAAGAACTCAC TATATCTGCAGATGAACAGCCTGAGAGCCGAGG ACACGGCTGTGTATTACTGTGCGAGAGATCGGGG CAGCAGCTGGGGCCAGGGAACCCTGGTCACCGT CTCCTCA<br>SEQ ID NO: 29459 |
| | 21-225_56F1 | AA | DIQMTQSPSSLSASVGDRVTITCRASQDIRNNLG WYQQKPGKAPKRLINAASSLQSGVPSRFSGSGS GTEFTLTISSLQPEDFATYYCLQDNSHPFTFGGGT KVEIK<br>SEQ ID NO: 25454 | EVQLVESGGGLVKFGGSLRLSCAASGFTFSSYSMN WVRQAPGKGLEWVSSISSSSTYIYGDSVKGRFTIS RDNAKNSLYLQMNSLRAEDTAVYYCARDRGSSW GQGTLVTVSS<br>SEQ ID NO: 29460 |

FIGURE 50
(Continued)

| | | | | |
|---|---|---|---|---|
| iPS:434181 | 21-225_56B2 | NA | GACATCCAGATGACCCAGTCTCCATCCTCCCT GTCTGCATCTGTAGGAGACAGAGTCACCATCA CTTGCCGGGCAAGTCAGAGTTTTAGCCACTAT TTAAATTGGTATCAGCAGAAACCAGGGAAAG CCCCTAAACCTCCTGATCTTTGCTGTATCCAGTT TGCAAAGTGGGGTCCCATCAAGGTTCAGTGGC AGTGGATCTGGGACAGATTTCACTCTCACCAT CAGTAGTCTGCAACCTGAAGAGTTACAGTATT ACTTCTGTCAACAGAGTTACAGTACCCCATTC ACTTTCGGCCCTGGGACCAAAGTGGATATCAA A<br>SEQ ID NO: 25455 | GAGGTGCAGTTGTTGGAGTCTGGGGGAGGCTTGA TACAGCCTGGGGGGTCCCTGAGACTCTCCTGTGC AGCCTCTGGATTCACCTTTAGGAGCTATGCCATG AGCTGGGTCCGCCAGGCTCCAGGGAAGGGGCTG GAGTGGGTCTCAGCTATTAGTGGTAGTGGTGTA ACACATTCTACGCAGACTCCGTGAAGGGCCGGTT CACCATCTCCAGAGACAATTCCAAGAACACGCTG TATTTGCAAATGAACACCCTGAGAGCCGACGAC ACGGCCGTATATTACTGTGCGAAAAGGTCGTGG ATACAGCCATGGCTCTTGACTACTGGGGCCAGGG AACCCTGGTCACCGTCTCCTCA<br>SEQ ID NO: 29461 |
| | | AA | DIQMTQSPSSLSASVGDRVTITCRASQSFSHYLN WYQQKPGKAPNLLIFAVSSLQSGVPSRFSGSGSG TDFTLTISSLQPEDFAIYFCQQSYSTPFTFGPGTK VDIK<br>SEQ ID NO: 25456 | EVQLLESGGGLIQPGGSLRLSCAASGFTFRSYAMS WVRQAPGKGLEWVSAISGSGGNTFYADSVKGRFTI SRDNSKNTLYLQMNTLRADDTAVYYCAKKVVDT AMALDYWGQGTLVTVSS<br>SEQ ID NO: 29462 |
| iPS:434187 | 21-225_56A5 | NA | GACATCCAGATGACCCAGTCTCCATCCTCCCT GTCTGCATCTGTAGGAGACAGAGTCACCATCA CTTGCCGGGCAAGTCAGGACAGTTAGAAATCTT TTAGGCTGGTATCAGCAGCAGAAACCAGGGAAAG CCCCTAAGCGCTTGATCTATGCTGCATCCAGTT TGCAAAGTGGGGTCCCATCAAGGTTCAGCGGC AGTGGATCTGGGACAGAGTTCACTCTCACAAT CAGCAGCCTGCAGCCTGAAGATTTTGCAACTT ATTACTGTCTACAGTATAATAGTTACCATTCA CTTCGGCCCTGGGACCAAAGTGGATATCAGA<br>SEQ ID NO: 25457 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATATACTCCAGAGACAACGCCAAGAACTCACT ATATCTGCAAATGAACAGCCTGAGAGGCCGAGGA CACGGCTGTGTATTACTGTGCGAGAGTGGCTACT TTTGACTACTGGGGCCAGGGAACCCTGGTCACCG TCTCCTCA<br>SEQ ID NO: 29463 |

FIGURE 50
(Continued)

| | | | |
|---|---|---|---|
| iPS:434189 | 21-225_56E5 | AA | DIQMTQSPSSLSASVGDRVTITCRASQDIRNLLG WYQQKPGKAPKRLIYAASSLQSGVPSRFSGSGS GTEFTLTISSLQPEDFATYYCLQYNSYPFTFGPGT KVDIR<br>SEQ ID NO: 25458 | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARVATFDY WGQGTLVTVSS<br>SEQ ID NO: 29464 |
| | | NA | GACATCCAGATGACCCAGTCTCCATCTCCGT GTCTGCATCTGTAGGCGACAGAGTCACCATCA CTTGTCGGGCGAGTCAGGGTATTAGGAAGTGG TTAGCCTGGTATCAGCAGAAACCAGGGAAAG CCCCTAAGCTCCTGATCTATGCTGCATCCAGTT TGCAAAGTGGGTCCCGTCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 25459 | CAGGTGCAGCTGGTGCAGTCTGGGGCTGAGGTG AAGAAGCCTGGGGCTCAGTGAAGGTCTCCTGC AGGGCTTCTGGATACACCTTCACCGCTACCATAT GCACTGGGTGCGACAGGCCCCTGGACAAGGGCT TGAGTGGATGGGATGGATCAACCCTAACAATAAT GCCACAAACTATGCACAGAAGTTTCAGGGCAGG GTCACCATGACCAGGGACACGTCCATCAGCACA GCCTACATGGAACTGAGGAGGCTGAGATCTGAC GACACGGCCGTGTATCACTGTGCGAGAGATGGC ACCTGGTCTTTTGACTACTGGGGCCAGGGAACCC TGGTCACCGTCTCCTCA<br>SEQ ID NO: 29465 |
| | | AA | DIQMTQSPSSVSASVGDRVTITCRASQGIRKWLA WYQQKPGKAPKLLIYAASSLQSGVPSRFSGSGS GTDFTLTISSLQPEDFATYYCQQANSFPFTFGPGT KVDIK<br>SEQ ID NO: 25460 | QVQLVQSGAEVKKPGASVKVSCQASGYTFTGYHM HWVRQAPGQGLEWMGWINPNNNATNYAQKFQGR VTMTRDTSISTAYMELRRLRSDDTAVYHCARDGTS SFDYWGQGTLVTVSS<br>SEQ ID NO: 29466 |

FIGURE 50
(Continued)

| | | | |
|---|---|---|---|
| iPS:434191 | 21-225_56B6 | NA | GACATCCAGATGACCCAGTCTCCATCTCCCT GTCTGTATCTGTAGGAGACAGAGTCACCATCA CTTGCCGGGCAAGTCAGAGCATTTCAGATAT TTAAATTGGTATCAGCAGAAACCAGGAAAGAG CCCCTAAGCTCCTGATCTTTGCTGCATCCAGTT CCAAAGTGGGGTCCCATCAAGGTTCAGTGGC AGTGGATCTGGGACAGACTTCACTCTCACCAT CAGCAGCCTACAACCTGAAGATTTTGCAACTT ACTACTGTCAACAGAGTTACAGTCCCCCTCTC ACTTTCGGCGGAGGGACCAAGGTGGAGATCA AA<br><br>SEQ ID NO: 25461 | CAGGTGCAACTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGGCT GGAGTGGGTGGCAGTTATATGAGACTCATGATGGAAG TAATAAATATTATGAGACTCCGTGAAGGGCGA TTCACCATCTCCAGAGACAATTCCAAGAATACGC TGTATCTGCAAATGAACAGCCTGAGAGCCGAGG ACACGGCTGTGTATTACTGTGCGAGAGACGAGC AGCTCGGGACCTTTGACTACTGGGGCCAGGGAA CCCTGGTCACCGTCTCCTCA<br><br>SEQ ID NO: 29467 |
| | | AA | DIQMTQSPSSLSVSVGDRVTITCRASQSIFRYLN WYQQKPGRAPKLLIFAASSFQSGVPSRFSGSGSG TDFTLTISSLQPEDFATYYCQQTYSPPLTFGGGTK VEIK<br><br>SEQ ID NO: 25462 | QVQLVESGGGVVQPGRSLRLSCAASGFTFSSYGMH WVRQAPGKGLEWVAVIWHDGSNKYYVDSVKGRF TISRDNSKNTLYLQMNSLRAEDTAVYYCARDEQLG TFDYWGQGTLVTVSS<br><br>SEQ ID NO: 29468 |
| iPS:434193 | 21-225_56C6 | NA | GACATCCAGATGACCCAGTCTCCATCTTCCGT GTCTGCATCTGTGGGAGACAGAGTCACCATCA CTTGTCGGGCAGTCAGGGTATTAGCAGCTGG TTAGCCTGGTATCAGCAGAAATCAGGGAATGC CCCTAAGCTCCTGATCTATGCTGCATCCAGATT GCAAAGTGGGGTCCCATCAAGGTTCAGCGGCA GTGGATCTGGTACATATTCACTCTCATTATCA GCAGCCTGCAGTCTGAAGATTTTGCAACTTAC TATTGTCAACAGGCTAACAGTTTCCCATTCACT TTCGGCCCTGGGACCAAAGTGGATATCAAA<br><br>SEQ ID NO: 25463 | CAGGTGCAGCTGGTGGTGCAGTCTGGGGCTGAGGTG AAGAAGCCTGGGGCCTCAGTGAAGGTCTCCTGC AAGGCTTCTGGATACACCTTCACCGACTACCATA TGCACTGGGTGCGACAGGCCCCTGGACAAGGGC TTGAGTGGATGGGATGGATCAACCCTAACAGAG GTGGCACAAATTATGTACAGAAGTTTCAGGGTAG GGTCGCCATGACCAATGACACACGTCCATCAGCACA GCCTATATGGAGCTGAGTGGGCTGAGATCTGACG ACACGGCCGTGTATTACTGTGCGAGAGATGGCAC CTGGTCTTTGACTATTGGGGCCGGGGAACCCTG GTCACCGTCTCCTCA<br><br>SEQ ID NO: 29469 |

FIGURE 50
(Continued)

| | | | | |
|---|---|---|---|---|
| iPS:434195 | 21-225_56F6 | AA | DIQMTQSPSSVSASVGDRVTITCRASQGISSWLAWYQQKSGNAPKLLIYAASRLQSGVPSRFSGSGSGTYFTLIISSLQSEDFATYYCQQANSFPFTFGPGTKVDIK<br><br>SEQ ID NO: 25464 | QVQLVQSGAEVKKPGASVKVSCKASGYTFTDYHMHWVRQAPGQGLEWMGWINPNRGGTNYVQKFQGRVAMTNDTSISTAYMELSGLRSDDTAVYYCARDGTSSFDYWGRGTLVTVSS<br><br>SEQ ID NO: 29470 |
| | | NA | GACATCCAGATGACCCAGTCTCCATCTTCTGTGTGTGCAGATGTAGGAGACAGAGTCACCATCACTTGTCGGGTGAGTCAGGATATTAGCAGCTGGTTAGCCTGGTTTCAGCAGAAACCAGGGAAAGCCCCTAAATTCTTGATATATGTTGCATCCGGTTTGCAAAGTGGGGTCCCATCAAGGTTCAGCGGCAGTGGATCTGGGACAGATTTCACTTTCACCATCAGCAGCCTGCAGCCTGAAGATTTTGCAACTTACTATTGTCAACAGGCTAACAGTTTCCCATTCACTTTCGGCCCTGGGACCAAAGTGGATATCAAA<br><br>SEQ ID NO: 25465 | CAGGTGCAGCTGGTGCAGTCTGGGGCTGAGGTGAAGAAGCCTGGGGCCTCAGTGAAGGTCTCCTGCAAGGCTTCTGGATTCACCTTCACCGACTACTATATGCACTGGGTGCGACAGGCCCCTGGACAAGGGCTTGAGTGGATGGGATGGATCAACCCTAACAGTGGTGGCACAAACTATGCACAGAGGTTTCAGGGCAGGGTCACCATGACCAGGGACACGTCCATCAGCACAGCCTACATGGAACTGAGCAGCAGACTGAGATCTGACGACACGGCCGTGTATTACTGTGCGAGAGAGGGAGCAACTGTCCGACGGGTTTGACTACTGGGGCCAGGGAACCCTGGTCACCGTCTCCTCA<br><br>SEQ ID NO: 29471 |
| | | AA | DIQMTQSPSSVCAYVGDRVTITCRVSQDISKWLAWFQQKPGKAPKFLIYVASGLQSGVPSRFSGSGSGTDFTFTISSLQPEDFATYYCQQANSFPFTFGPGTKVDIK<br><br>SEQ ID NO: 25466 | QVQLVQSGAEVKKPGASVKVSCKASGFTFTDYYMHWVRQAPGQGLEWMGWINPNSGGTNYAQRFQGRVTMTRDTSISTAYMELSRLRSDDTAVYYCTREGATRPTGFDYWGQGTLVTVSS<br><br>SEQ ID NO: 29472 |

FIGURE 50
(Continued)

| | | | |
|---|---|---|---|
| iPS:434197 | 21-225_56C7 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATACTGCATCCAAT TTACAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTATCCGTG GACGTTCGGCCAAGGGACCAAGGTGGAAATC AAA |
| | | | SEQ ID NO: 25467 |
| | | AA | DIQMTQSPSSLSASVGDRVTITCRASQGIRNDLG WYQQKPGKAPKRLIYTASNLQSGVPSRFSGSGS GTEFTLTISSLQPEDFATYYCLQHNSYPWTFGQG TKVEIK |
| | | | SEQ ID NO: 25468 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATGTTACCCTTTC ACTTTCGGCCCTGGGACCAAAGTGGATTTCAA A |
| iPS:434199 | 21-225_59F11 | | SEQ ID NO: 25469 |
| | | | CAGGTGCAGCTGGTGGTGCAGTCTGGGGCTGAGGTG AAGAAGCCTGGGGCCTCAGTGAAGGTCTCCTGC AAGGCTTCTGGATACACCTTCACCGGCCACTATA TAAACTGGGTGCGACAGGCCCCTGGACAAGGGC TTGAGTGGATGGCATGGGTCAACCCTAACAGTGG TGGCACAAACTCTGCACAGAAGTTTCAGGCAG GGTCACCATGACCAGGGACACGTCCATCAGCAC AGTCTACATGGAGCTGAGCAGGCTGAGATCTGA CGACACGGCCGTGTATTACTGTGCGAGGGAGG GCAGCTCGGGGGTTTAACTACTACTACGGT ATGGACGTCTGGGGCCAAGGGACCACGGTCACC GTCTCCTCA |
| | | | SEQ ID NO: 29473 |
| | | | QVQLVQSGAEVKKPGASVKVSCKASGYTFTGHYIN WVRQAPGQGLEWMAWVNPNSGGTNSAQKFQGR VTMTRDTSISTVYMELSRLRSDDTAVYYCARGGQL GGFNYYYYGMDVWGQGTTVTVSS |
| | | | SEQ ID NO: 29474 |
| | | | CAGGTGCAGCTGGTGGTGGAGTCTGGGGGAGGCGTG GTCCAGCCTGGGAGGTCCCTGAGACTCTCCTGTG CAGCCGTCTGATTCACCTTCAGTAACTATGGCAT GCACTGGGTCCGCCAGGCTCCAGGCAAGGGGCT GGAGTGGGTGGCAGTTATATGGTATGATGAAAGT AATAAACACTATGCAGACTCCGTGAAGGGCCGA TTCACCATCTCCAGAGACAATTCCAAGAACACGC TGTATCTGCAAATGAGCAGCCTGAGAGCCGAGG ACACGGCTGTGTATTATTGTCGAGAGAACTGGG GATGAACGGAGACTACTGGGGCCAGGGAACCCT GGTCACCGTCTCCTCA |
| | | | SEQ ID NO: 29475 |

FIGURE 50
(Continued)

| | | | |
|---|---|---|---|
| iPS:434201 | 21-225_59A12 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNRYPFTFGPGT KVDFK |
| | | | QVQLVESGGGVVQPGRSLRLSCAASGFTFSNYGM HWVRQAPGKGLEWVAVIWYDESNKHYADSVKGR FTISRDNSKTTLYLQMSSLRAEDTAVYYCSRELGM NGDYWGQGTLVTVSS |
| | | | SEQ ID NO: 25470 |
| | | | SEQ ID NO: 29476 |
| | | NA | GATATTGTGATGACCCAGACTCCACTCTCTCT GTCCGTCACCCCTGGACAGCCGTCCATCT CCTGCAAGTCTAGTCAGAGCCTCCAGCATGGT GAAGGAAAGACCTATTTGTATTGGTACGTGCA GAAGCCAGGCCAGGCCTCCACAGCTCCTGATCT ATGAAGTTTCCTATCGGTTTTCTGGAGTGCCA GATAGGTTCAGTGGCAGTGGGTCAGGACAG ATTTCACACTGAAAATCAGCGGGGTGAGGTT GAGGATGTTGGGGTTTATTACTGCATGCAAAG TACACAGCTTCCGCTCACCTTCGGCGGAGGGA CCAAGGTGGAGATCAAA |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGATGATGGAAGT AATAAATACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGGCGGTATAG CAGCAGCTGGGACGGGGTATGGACGTCTGGGG CCAAGGGACCACGGTCACCGTCTCCTCA |
| | | | SEQ ID NO: 25471 |
| | | | SEQ ID NO: 29477 |
| | | AA | DIVMTQTPLSLSVTPGQPASISCKSSQSLQHGEG KTYLYWYVQKPGQPPQLLIYEVSYRFSGVPDRF SGSGSGTDFTLKISRVEVEDVGVYYCMQSTQLP LTFGGGTKVEIK |
| | | | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WDGGMDVWGQGTTVTVSS |
| | | | SEQ ID NO: 25472 |
| | | | SEQ ID NO: 29478 |

FIGURE 50
(Continued)

| | | | |
|---|---|---|---|
| iPS:434203 | 21-225_60E2 | NA | GACATCCAGATGACCCAGTCTCCATCCTCCT GTCTGCATCTGTAGGAGACAGAGTCACCATCA CTTGCCGGGCAAGTCAGGGACATTAGAAAAGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA<br><br>SEQ ID NO: 25473 | CAGGTGCAGCTGGTGGAGTCTGGGGGAGGCGTG GTCCAGCCTGGGAGGTCCCTGAGACTCTCCTGTG CAGCGTCTGGATTCACCTTCAATGACTATGGCAT GCACTGGGTCCGCCAGGCTCCAGGCAAGGGGCT GGAGTGGGTGGCAATTATATGGTATGATGAAAAT AATAAATACTATGCAGACTCCGTGAAGGGCCGA TTCACCATCTCCAGAGACAATTCCAAGAACACGC TGTATCTGCAAATGAGCAGCCTGAGAGCCGAGG ACACGGCTGTATATTACTGTGCGAGAGATGTTCT GGACCCTTTTGACTACTGGGGCCAGGGAACCCTG GTCACCGTCTCCTCA<br><br>SEQ ID NO: 29479 |
| | | AA | DIQMTQSPSSLSASVGDRVTITCRASQGIRKDLG WYQQKPGKAPKRLIYAASSLQSGVPSRFSGSGS GTEFTLTISSLQPEDFATYYCLQHNSYPWTFGQG TKVEIK<br><br>SEQ ID NO: 25474 | QVQLVESGGGVVQPGRSLRLSCAASGFTFNDYGM HWVRQAPGKGLEWVAIIWYDENNKYYADSVKGR FTISRDNSKNTLYLQMSSLRAEDTAVYYCARDVLD PFDYWGQGTLVTVSS<br><br>SEQ ID NO: 29480 |
| iPS:434205 | 21-225_60G2 | NA | GATATTGTGATGACCCAGACTCCACTCTCT GTCCGTCACCTGGACAGTCGGCCTCCATCT CCTGCAAGTCTAGTACAGAGCCTCCGCATAGT GAAGGAAAGACCTATTGTATTGTACTGCA GAAGCCAGGCCAGCTCCACAGCTCCTGATCT ATGAAGTTTCCAACCGGATCTCTGGAGTGCCA GATAGGTTCAGTGGCAGCGGGTCAGGACAG ATTTCACACTGAAAATCAGCCGGGTGGAGGCT GAGGATGTTGGGGTTTATTACTGCATGCAAAG TATACAGCTTCCCGCTCACTTTCGGCCGAGGGA CCAAGGTGGAGATCAAA<br><br>SEQ ID NO: 25475 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGAAGCTGACGGGAGGCATGACGCTCTGGGG CCAAGGGACCACGGTCACCGTCTCCTCA<br><br>SEQ ID NO: 29481 |

FIGURE 50
(Continued)

| | | | |
|---|---|---|---|
| | | AA | DIVMTQTPLSLSVTPGQSASISCKSSQSLLHSEGK TYLYWYLQKPGQPPQLLIYEVSNRISGVPDRFSG SGSGTDFTLKISRVEAEDVGVYYCMQSIQLPLTF GGGTKVEIK<br>SEQ ID NO: 25476 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSRS WTGGMDVWGQGTLVTVSS<br>SEQ ID NO: 29482 |
| iPS:434207 | 21-225_60A3 | NA | GACATCCAGATGACCCAGTCTCCATCCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATTTAGTT TGCAAAGTGGGGTCCCATCAAGGTTCAGCGGC AGTGGATCTGGGACAGACCTCACTCTCACAAT CAGCAGCCTGCAGCCTGAAGATTTTGCAACTT ATTACTGTCTACAGCATATAGTTACCCTTTCA CTTTCGGCCCTGGGACCAAAGTGGATATCAAA<br>SEQ ID NO: 25477 | CAGGTGCAACTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGAGACTCCGTGAAGAAG TAATAAATACTACTATGCAGACTCCGTGAAGGCCG ATTCACCATCTCCAGAGACAATTCCAAGAACACG CTGTATCTGCAAATGAACAGCCTGAGAGCCGAG GACACGGCTGTATATTACTGTGCGAGAGAACTGG GGATGACCGGAGACTACTGGGGCCAGGGAACCC TGGTCACCGTCTCCTCA<br>SEQ ID NO: 29483 |
| | | AA | DIQMTQSPSSLSASVGDRVTITCRASQGIRNDLG WYQQKPGKAPKRLIYAAFSLQSGVPSRFSGSGS GTEFTLTISSLQPEDFATYYCLQHNSYPFTFGPGT KVDIK<br>SEQ ID NO: 25478 | QVQLVESGGGVVQPGRSLRLSCAASGFTFSSYGMH WVRQAPGKGLEWVAVIWYEESNKYYADSVKGRF TISRDNSKNTLYLQMNSLRAEDTAVYYCARELGMT GDYWGQGTLVTVSS<br>SEQ ID NO: 29484 |

FIGURE 50
(Continued)

| | | | | |
|---|---|---|---|---|
| iPS:434209 | 21-225_60C3 | NA | GACATCCAGATGACCCAGTCTCCATCCTCCCT GTCTGCATCTGTAGGAGACAGAGTCACCATCA CTTGCCGGGCAAGTCAGGGACAGAGTCACCATCA CTTGCCGGGCAAGTCAGGGCATTAGAAATGAT TTAGGCTGGTATCAGCAGAAACCAGGAAAG CCCCTAAGCGCCTGATCTATTCTGCATCCAGTT TACAAAGTGGGGTCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGTGG ACGTTCGGCCTAGGGACCAAGGTGGAAATCA AA | CAGGTGCAACTAGTGCAGTCTGGGGCTGAGGTG AAGAAGCCTGGGGCCTCAGTGAAGGTCTCCTGC AAGGCTTCTGGATACAGTTCACGGCCACTATA TACACTGGGTGCGACAGGCCCCTGGACAAGGGC TTGAGTACATGGGATGGATCAACCCTAACAGCG GTGGCACAAACTATGTACAGGACACGTCCATCA GCACCTACATGGAGCTGAGCAGGCTGAGATCTG ACGACACGGCCATATATTACTGTCGAGAGGG GCCTACTGGGAGCTACCAACTACTATTATTACGG TATGGACGTTCGGGGGCCAAGGGACCACGGTCAC CGTCTCCTCA |
| | | | SEQ ID NO: 25479 | SEQ ID NO: 29485 |
| | | AA | DIQMTQSPSSLSASVGDRVTITCRASQGIRNDLG WYQQKPGKAPKRLIYSASSLQSGVPSRFSGSGSG TEFTLTISSLQPEDFATYYCLQHNSYPWTFGLGT KVEIK | QVQLVQSGAEVKKPGASVKVSCKASGYSFTGHYIH WVRQAPGQGLEYMGWINPNSGTNYVQKFQGRV TMTRDTSISTAYMELSRLRSDDTAIYYCSRGGLLGA TNYYYGMDVWGQGTTVTVSS |
| | | | SEQ ID NO: 25480 | SEQ ID NO: 29486 |
| iPS:434211 | 21-225_60F3 | NA | GACATCGTGATGACCCAGTCTCCAGACTCCCT GACTGTGTCTCTGGGCGAGAGGGCCACCATCA ACTGCAAGTCCAGCCAGAGTGTTTTATACAGC TCCAACAATAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAATTTATTACTGTCAGCAA TATTATAGTACTCCGTGCAGTTTGGCCAGGG GACCAAGCTGGAGATCAAC | CAGGTGCTGCTGGTGCAGTCTGGGGCTGAGGTGA AGAAGCCTGGGGCCTCAGTGAAGGTCTCCTGCA AGGCTTCTGGATACACCTTCACCAATATGATAT CAACTGGGTGCGACAGGCCACTGGACAAGGGCT TGAGTGGATGGGATGGATCACAGAAGTTCAGGGCAGA AACACAGGCTATGCACCAGGAACACCTCCATAAGCACA GTCACCATGACCAGGGACACGTCCATAAGCACA GCCTACATGGAGCTGAGCAGCCTGAGATCTGAG GACACGGCCGTGTATTACTGTGCGTATAGCAGTG GCTGGTACTTCTTTGACTACTGGGGGCCAGGGAAC CCTGGTCACCGTCTCCTCA |
| | | | SEQ ID NO: 25481 | SEQ ID NO: 29487 |

FIGURE 50
(Continued)

| | | | |
|---|---|---|---|
| iPS:434213 | 21-225_60A4 | AA | DIVMTQSPDSLTVSLGERATINCKSSQSVLYSSN NKNYLAWYQQKPGQPPKLLIYWASTRESGVPD RFSGSGSGTDFTLTISSLQAEDVAIYYCQQYYSTP CSFGQGTKLEIN<br>SEQ ID NO: 25482 | QVLLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YFFDYWGQGTLVTVSS<br>SEQ ID NO: 29488 |
| | | NA | GACATCCAGATGACCCAGTCTCCATCCTCACT GTCTGCATCTGTAGGAGACAGAGTCACCATCA CATGTCGGGCAGTCAGGGCATTAGCAATTAC TTAGCCTGGTTTCAGCAGAAACCAGGGAAAGC CCCTAAGTCCCTGATCTATCTGCATCCAGTTT GCAAAGTGGGGTCCCATCAAAGTTCAGCGGCA GTGGATCTGGGACAGATTTCACTCTCACCATC AGCAGCCTGCAGTCTGAAGATTTTGCAACGTA CTACTGCCAACAATATAAAAGTCACCATTCA CTTTCGGCCCTGGGACCAAAGTGGATATCAAA<br>SEQ ID NO: 25483 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGGCT GGAGTGGGTCTCATCTATTAGTGGTAGTGGTGGT TGGACAAACTACGCAGACTCCGTGAAGGGCCGA TTCACCACCTCCAGAGACAATTCCAAGAACACGC TGTATCTGCAAATGAACAGCTGAGAGCCGAGG ACACGGCCGTTTATTACTGTGCGAGACTAACTGG ATTTGACTATTGGGGCCAGGAACCCTGGTCACC GTCTCCTCA<br>SEQ ID NO: 29489 |
| | | AA | DIQMTQSPSSLSASVGDRVTITCRASQGISNYLA WFQQKPGKAPKSLIYAASSLQSGVPSKFSGSGSG TDFTLTISSLQSEDFATYYCQQYKSHPFTFGPGT KVDIK<br>SEQ ID NO: 25484 | EVQLLESGGGLVQPGGSLRLSCAASGFTFSSYVMS WVRQAPGKGLEWVSSISGSGGWTNYADSVKGRFT TSRDNSKNTLYLQMNSLRAEDTAVYYCARLTGFD YWGQGTLVTVSS<br>SEQ ID NO: 29490 |

FIGURE 50
(Continued)

| | | | | |
|---|---|---|---|---|
| iPS:434215 | 21-225_60F7 | NA | GACATCCAGATGACCCAGTCTCCATCCTCACT GTCTGCATCTGTAGGAGACAGAGTCACCATCT CTTGTCGGGCGAGTCAGGTCATTAAGAATTAT TTAGTCTGGTTCAGCAGAAACCAGGGAAAGC CCCTAAGTCCCTGATCTATGCTGCGTCCAGTTT GCAAAGTGGGGTCCCATCAACGTTCAGCGGCA GTGGATCTGGGACAGATTTCACTCTCACCATC AGCAGCCTGCAGCCTGAAGATTTTGCAACTTA TTACTGCCTACAGTTCATAGTTACCCATTCAC TTTCGGCCCTGGGACCAAAATGAGATATCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGTCCAGGGAAGGGCT GGAGTGGGTCAGTTATTAGTGGTAGTGGTAAT AGAACATACTACGCAGACTCCGTGAAGGCCGG TTCACCATCTCCAGAGACAATTCCAAGAATACGC TGTATCTGCAAATGAACAGCCTGAGAGCCGAGG ACTCGGCCGTTTATTACTGTGTGGAGTTTGGGAT TGACTGGGGCCAGGGAACCCTGGTCACCGTCTCC TCA |
| | | | SEQ ID NO: 25485 | SEQ ID NO: 29491 |
| | | AA | DIQMTQSPSSLSASVGDRVTISCRASQVIKNYLV WVQQKPGKAPKSLIYAASSLQSGVPSTFSGSGSG TDFTLTISSLQPEDFATYYCLQFHSYPFTFGPGTK MDIK | EVQLLESGGGLVQPGGSLRLSCAASGFTFSSYVMS WVRQAPGKGLEWVSGISGSGNRTYADSVKGRFTI SRDNSKNTLYLQMNSLRAEDSAVYYCGSLGIDWG QGTLVTVSS |
| | | | SEQ ID NO: 25486 | SEQ ID NO: 29492 |
| iPS:434217 | 21-225_60E8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTTTCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGATTTCACTCTCACAATC AGCAGCCTGCAGCCTGAAGATTTTGCAACTTA TTACTGTCTACAGCATAGTAGTTACCCGCTCA CTTTCGCGGAGGGACCAAGGTGGAGATCAAA | CAGGTGCAGCTGCAGGAGTCGGGCCCAGGACTG GTGAGGCCTTCGGCGACCCTGTCCCTCACCTGCA CTGTCTCTGGTGGCTCCATCAGCAGGAGTAGTTA CTACTGGGGCTGGATCCGCCAGCCCCCAGGGAA GGGAGCGCTCTACAACCCGTCCCTCAAGAGTC GAGTCACCATATCCGTAGACACGTCGAGAACC AATTCTCCCTGAGGCTGAGCTCTGTGACCGCGC AGACACGGCTGTGTCGTTGACTACTGGGGCCAGGGAA AGTGGCTGGTCGTTGACTACTGGGGCCAGGGAA CCCTGGTCACCGTCTCCTCA |
| | | | SEQ ID NO: 25487 | SEQ ID NO: 29493 |

FIGURE 50
(Continued)

| | | | |
|---|---|---|---|
| iPS:434219 | 21-225_60E9 | AA | DIQMTQSPSSLSASVGDRVTFTCRASQGIRNDLG WFQQKPGKAPKRLIYAASSLQSGVPSRFSGSGSG TEFTLTISSLQPEDFATYYCLQHSSYPLTFGGGTK VEIK<br>SEQ ID NO: 25488 | QVQLQESGPGLVRPSATLSLTCTVSGGSISRSSYYW GWIRQPPGKGLEWIGSIYYSGSASYNPSLKSRVTIS VDTSENQFSLRLSSVTAADTAVYYCARLDSGWSFD YWGQGTLVTVSS<br>SEQ ID NO: 29494 |
| | | NA | GAAATAGTGATGACGCAGTCTCCAGCCACCCT GTCTGTGTCTCCAGGGGAAAGAGCCACCCTCT CCTGTAGGGCCAGTCAGAGTGTTAGCAGTTCC TTAGCCTGGTACCGGCAGAAACCTGGCCAGGC TCCCAGGCTCCTCATCTATGGTGCATCCACCA GGGCCACTGGTATCCCGGCCAGGTTCAGTGGC AGTGGGTCTGGGACAGAGTTCACTCTCACCAT CAGCAGCCTGCAGTCTGAAGATTTTGCAGTTT ATTGCTGTCAGCAGTATAATAACTGGCCATTC ACTTTCGGCCCTGGGACCAAAATAGATATCAA A<br>SEQ ID NO: 25489 | GAGGTGCAGTTGTTGGAGTCTGGGGGAGGCTGG TACAGCCTGGGGGGTCCCTGAGACTCTCCTGTGC AGCCTCTGGATTCACCTTTAGCAGCTATGCCATG AGCTGGGTCCGCCAGGCTCCAGGGAAGGGGCTG GAGTGGGTCTCAGCTATTAGTGGTAGTGGTGTA ACACATTCTACGCAGACTCCGTGAAGGGCCGGTT CACCATCTCCAGAGACAATTCCAAGAACACGCTG TTTCTTCAAATGAACAGCCTGAGAGCCGAGGACA CGGCCGTATATTACTGTGCGAAATTTTCGGTAT AGTGGGAGCCGGGTACTTTGACTACTGGGGCCA GGGAACCCTGGTCACCGTCTCCTCA<br>SEQ ID NO: 29495 |
| | | AA | EIVMTQSPATLSVSPGERATLSCRASQSVSSSLA WYRQKPGQAPRLLIYGASTRATGIPARFSGSGSG TEFTLTISSLQSEDFAVYCCQQYNNWPFTFGPGT KIDIK<br>SEQ ID NO: 25490 | EVQLLESGGGLVQPGGSLRLSCAASGFTFSSYAMS WVRQAPGKGLEWVSAISGSGGNTFYADSVKGRFTI SRDNSKNTLFLQMNSLRAEDTAVYYCAKFFGIVGA GYFDYWGQGTLVTVSS<br>SEQ ID NO: 29496 |

FIGURE 50
(Continued)

| | | | |
|---|---|---|---|
| iPS:434221 | 21-225_60A11 | NA | GACATCCAGATGACCCAGTCTCCATCTTCCGT GTCTGCATCTGTAGGAGACAGAGTCACCATCA CTTGTCGGGCGAGTCAGGTATTAGCAACTGG TTAGCCTGGTATCAGCTGAAACCAGGAAAGC CCCTAAGCTCCTGATCTATACTGCATCCAGTTT GCAAAGTGGGGTCCATCAAGGTTCAGCGGCA ATGAATCTGGGACAGATTTCACTCTCACCATC AGCAGCCTGCAGCCTGAAGATTTTGCAACTTA CTATTGTCAACAGGCTAACAGTTTCCCGTGA CGTTCGGCCAAGGGACCAAGGTGGAAATCAA A |
| | | | SEQ ID NO: 25491 |
| | | AA | DIQMTQSPSSVSASVGDRVTITCRASQVISNWLA WYQLKPGKAPKLLIYTASSLQSGVPSRFSGNESG TDFTLTISSLQPEDFATYYCQQANSFPWTFGQGT KVEIK |
| | | | SEQ ID NO: 25492 |
| | | | GAGGTGCAGCTGTTGGAGTCTGGGGGAGGCTTG GTACAGCCGGGGGGGTCCCTGAGACTCTCCTGTG CAGCCTCTGGATTCACCTTTAGCAACTATGCCAT GACCTGGGTCCGCCAGGCTCCAGGGAAGGGGCT GGAGTGGGTCTCAGCTATTAGTGGTAGTGGTGGT AACACATTCTACGCAGACTCCGTGACGGGCCGG GTCACCATCTCCAGAGACAATTCCAAGAACACGC TGTATCTGCAAATGAACAGTCTGAGAGCCGAGG ACACGGCCGTATATTACTGTGCGAAACTGGGGA AGGACTACCACTACTACGTATGGACGTCTGGGG CCAAGGGACCACGGTCACCGTCTCCTCA |
| | | | SEQ ID NO: 29497 |
| iPS:434223 | 21-225_60C12 | NA | GACATTGTGATGACCCAGACTCCACTCTCT GTCCGTCACCCTGGACAGCCGCCTCCATCT CCTGCAAGTCTAGTCAGAGCCTCCTGCATAGT GGGGAAAGAACCTATTTGTATTGGTACCTGCA GAGGCCAGGCCAGCCTCCACAGTTCCTGATCT ATGAAGTTTCCAACCGGTTCTCTGAGTGCCA GATAGGTTCAGTGGCAGCGGGTCAGGGACAG ATTTCACACTGAAAATCAGCGGGGTGGAGGCT GAGGATGTTGGAGATTATTACTGCATGCAAAG TATAAAGTATCCGCTCACTTTCGGCGGAGGA CCAAGGTGGAGATCAAA |
| | | | SEQ ID NO: 25493 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGAGCTGGTGATGGAAGT AATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAAGGTATAGC AGAAGTGGACGGGAGGTATGGACGTCTGGGGC CAGGGGACCACGGTCACCGTCTCCTCA |
| | | | SEQ ID NO: 29499 |

FIGURE 50
(Continued)

| | | | | |
|---|---|---|---|---|
| iPS:434225 | 21-225_60E12 | AA | DIVMTQTPLSLSVTPGQPASISCKSSQSLLHSEGK TYLYWYLQKPGQPPQFLIYEVSNRFSGVPDRFSG SGSGTDFTLKISRVEAEDVGIYYCMQSIKYPLTF GGGTKVEIK | QVQLVESGGGVVQPGRSLRLSCAASGFTFSSYGMH WVRQAPGKGLEWVAVIWYDGSNKYYVDSVKGRF TISRDNSKNTLYLQMNSLRAEDTAVYYCARRYSRS WTGGMDVWGQGTTVTVSS |
| | | | SEQ ID NO: 25494 | SEQ ID NO: 29500 |
| | | NA | GACATCCAGATGACCCAGTCTCCATCCTCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCACCTT ACTACTGTCAACAGAGTTACAATATTTCATTC ACTTTCGGCCCTGGGACCAAAGTGGATATCAA A | CAGGTGCAGCTGCAGGAGTCGGGCCAGGACTG GTGAAGCCTTCGGAGACCCTGTCCCTCACCTGCA CTGTCTCTGGTGGCTCCATCAGTAGTAGTTCTGG AGCTGGATCCGGCAGCCCCGGGAAGGACTG GAGTGGATTGGGCGCATCTATACCAGGGGAGC ACCAACTACAACCCTCCCTCAAGAGTCGAGTCA CCATGTCAGTAGACACGTCCAAGAACCAGTTCTC CCTGAAGCTGAGCTCTGTGACCGCCGCGGACACG GCCGTGTATTACTGTGCGAGAGAGGAAAAACT GGGGGGGTTTCTTACTTTGACTACTGGGGCCAGG GAACCCTGGTCACCGTCTCCTCA |
| | | | SEQ ID NO: 25495 | SEQ ID NO: 29501 |
| | | AA | DIQMTQSPSSLSASVGDRVTITCRASQSISSYLNW YQQKPGKAPKLLIYAASSLQSGVPSRFSGSGSGT DFTLTISSLQPEDFAPYYCQQSYNISFTFGPGTKV DIK | QVQLQESGPGLVKPSETLSLTCTVSGGSISSYFWSW IRQPAGKGLEWIGRIYTRGSTNYNPSLKSRVTMSVD TSKNQFSLKLSSVTAADTAVYYCAREGKTGGVSYF DYWGQGTLVTVSS |
| | | | SEQ ID NO: 25496 | SEQ ID NO: 29502 |

FIGURE 50
(Continued)

| | | | |
|---|---|---|---|
| iPS:434227 | 21-225_61A1 | NA | GACATCCAGATGACCCAGTCTCCATCCTCCT<br>GTCTGCATCTGTAGGAGACAGAGTCACCATCA<br>CTTGCCGGGCAAGTCAGAGCATTAGCAGCTAT<br>TTAAATTGGTATCAGCAGAAACCAGGGAAAG<br>CCCCTAAGCTCCTGATCTATGCTGCATCCAGTT<br>TGCAAAGTGGGGTCCCATCAAGGTTCAGTGGC<br>AGTGGATCTGGGACAGATTTCACTCTCACCAT<br>CAGCAGTCTGCAACCTGAAGATTTTGCACTT<br>ACTACTGTCAACAGAGTTACAATATTTCATTC<br>ACTTTCGGCCCTGGGACCAAAGTGGATATCAA<br>A<br>SEQ ID NO: 25497 | CAGGTGCAGCTGCAGGAGTCGGGCCCAGGACTG<br>GTGAAGCCTTCGGAGACCCTGTCCCTCACTGCA<br>CTGTCTCTGGTGGCTCCATCAGTAGTCACTCTG<br>GAGCTGGATCCGGCAGCCCGCCGGGAAGGGACT<br>GGAGTGGATTGGGCGCATCTATATCAGGGGGAG<br>CACCAACTACAACCCCTCCCTCAAGAGTCGAGTC<br>ACCATGTCAGTAGACACGTCCAAGAACCAGTTCT<br>CCCTGAAGCTGAGCTCTGTGACCGCCGGACAC<br>GGCCGTGTATTACTGTGCAGAGAGGAAAAAC<br>TGGGGGGGTTTCTTACTTTGACTACTGGGGCCAG<br>GGAACCCTGGTCACCGTCTCCTCA<br>SEQ ID NO: 29503 |
| | | AA | DIQMTQSPSSLSASVGDRVTITCRASQSISSYLNW<br>YQQKPGKAPKLLIYAASSLQSGVPSRFSGSGSGT<br>DFTLTISSLQPEDFAPYYCQQSYNISFTFGPGTKV<br>DIK<br>SEQ ID NO: 25498 | QVQLQESGPGLVKPSETLSLTCTVSGGSISSHFWSW<br>IRQPAGKGLEWIGRIYIYRGSTNYNPSLKSRVTMSVD<br>TSKNQFSLKLSSVTAADTAVYYCAREGKTGGVSYF<br>DYWGQGTLVTVSS<br>SEQ ID NO: 29504 |
| iPS:434229 | 21-225_61H1 | NA | GACATCCAGATGACCCAGTCTCCATCCTCCT<br>GTCTGCATCTGTAGGAGACAGAGTCACCATCA<br>CTTGCCGGGCAAGTCAGGGCATTAGAAAAGAT<br>TTAGGCTGGTATCAGCAGAAACCAGGGAAAG<br>CCCCTAAGCTCCTGATCTTTGCTGCATCCAGTT<br>TGCAAAGTGGGGTCCCATCAAGGTTCAGCGGC<br>AGTGGATCTGGGACAGATTTCACTCTCACAAT<br>CAGCAGCCTGCAGCCTGAAGATTTTGCAACTT<br>ATTACTGTCTACAGCATAATAGTTACCCGTGG<br>ACGTTCGGCCAAGGGACCAAGGTGGAAATCA<br>AA<br>SEQ ID NO: 25499 | CAGGTGCAGCTGGTGGAGTCTGGGGGAGGCGTG<br>GTCCAGCCTGGGGAGGTCCCTGAGACTCTCCTGTG<br>CAGCCGTCTGATTCACCTTCAACTGACTATGGCAT<br>GCACTGGGTCCGCCAGGCTCCAGGCAAGGGGCT<br>GGAGTGGGTGGCAATTATATGGTATGATGAAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTATATTACTGTGCGAGAGATGTTCT<br>GGACCCTTTTGACTACTGGGGCCAGGGAACCCTG<br>GTCACCGTCTCCTCA<br>SEQ ID NO: 29505 |

FIGURE 50
(Continued)

| | | | |
|---|---|---|---|
| iPS:434231 | 21-225_61F2 | AA | DIQMTQSPSSLSASVGDRVTITCRASQGIRKDLG WYQQKPGKAPKRLIFAASSLQSGVPSRFSGSGSG TEFTLTISSLQPEDFATYYCLQHNSYPWTFGQGT KVEIK | QVQLVESGGGVVQPGRSLRLSCAASGFTFNDYGM HWVRQAPGKGLEWVAIIWYDESNKYYADSVKGRF TISRDNSKNTLYLQMNSLRAEDTAVYYCARDVLDP FDYWGQGTLVTVSS |
| | | | SEQ ID NO: 25500 | SEQ ID NO: 29506 |
| | | NA | GACATCCAGATGACCCAGTCTCCATCCTCCCT GTCTGCATCTGTAGGAGACAGAGTCACCGTCA CTTGCCGGGCAAGTCAGGGCATTAGAGATGAT TTAGGCTGGTATCAGCAGAAACCAGGAAAG CCCCTGAGCGCCTGATCTATGCTGCATCCAGT TTGCAAAGTGGGGTCCCATCAAGGTTCAGCGG CAGTGGATCTGGGACAGAGTTCACTCTCACAA TCAGCAGCCTGCAGCCTGAAGATTTTGCAACT TATTACTGTCTACAGCATTATAGTTACCCTGC AGTTTTGGCCAGGGGACCAAGCTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAGTTATATGCAGTCCGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAGCAGTGGCTGGTGACTACGGTATGGACGTC TGGGGCCAAGGGACCACGGTCACCGTCTCCTCA |
| | | | SEQ ID NO: 25501 | SEQ ID NO: 29507 |
| | | AA | DIQMTQSPSSLSASVGDRVTVTCRASQGIRDDLG WYQQKPGKAPERLIYAASSLQSGVPSRFSGSGSG TEFTLTISSLQPEDFATYYCLQHYSYPRSFGQGT KLEIK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERYSS GWYDYGMDVWGQGTTVTVSS |
| | | | SEQ ID NO: 25502 | SEQ ID NO: 29508 |

FIGURE 50
(Continued)

| | | | | |
|---|---|---|---|---|
| iPS:434233 | 21-225_61B3 | NA | GATATTGTGATGACCCAGACTCCACTCTCTCT GTCCGTCACACCTGGACAGCCGGCCTCCATCT CCTGCAAGTCTAGTCAGAGCTCCTGCATAGT GAAGGAAAGACCTATTTGTATTGGTACCTGCA GAAGCCAGGCCAGCCTCCACAGCTCCTGATCT ATGAAGTTTCCAACCGGATCTCGGAGTGCCA GATAGGTTCAGTGGCAGCGGGTCAGGACAG ATTTCACACTGAAAATCAGCGGGTGGAGGCT GAGGATGTTGGGGTTTATTACTGCATGCAAAG TATACAGCTTCCGCTCACTTTCGGCGGAGGGA CCAAGGTGGAGATCAAA SEQ ID NO: 25503 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGAAGCTGGGGGAGGCATGACGTCTGGGG CCAAGGGACCACGGTCACCGTCTCCTCA SEQ ID NO: 29509 |
| | | AA | DIVMTQTPLSLSVTPGQPASISCKSSQSLLHSEGK TYLYWYLQKPGQPPQLLIYEVSNRISGVPDRFSG SGSGTDFTLKISRVEAEDVGVYYCMQSIQLPLTF GGGTKVEIK SEQ ID NO: 25504 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSRS WAGGMDVWGQGTTVTVSS SEQ ID NO: 29510 |
| iPS:434235 | 21-225_61E3 | NA | GACATCGTGATGACCCAGTCTCCAGACTCCCT GGCTGTGTCTCTGGGCGAGAGGGCCACCATCA ACTGCAAGTCCAGCCAGAGTGTTTTACACATC TCCAACAATAACAATTACTTAGCTTGGTACCA GCAGCAACCAGGACAGCCTCCTAAACTGCTCA TTTACTGGGCATCTATCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTATTCCGTGCAGTTTTGGCCAGGG GACCAAGCTGGAGATCAAA SEQ ID NO: 25505 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTGG TAACACAGGCTATGCACAGAAGTTCCAGGCAG AGTCACCATGACCAGGAACACCTCCATAAGCAC AGCCTACATGGAGCTGAGCAGCCTGAAATCTGA GGACACGGCCGTGTATTACTGTGCGTATAGCAGT GGCTGGTACCGCTTTGACTACTGGGGCCAGGAA CCCTGGTCACCGTCTCCTCA SEQ ID NO: 29511 |

FIGURE 50
(Continued)

| | | | | |
|---|---|---|---|---|
| iPS:434237 | 21-225_61B5 | AA | DIVMTQSPDSLAVSLGERATINCKSSQSVLHISN NNNYLAWYQQKPGQPPKLLIYWASIRESGVPDR FSGSGSGTDFTLTISSLQAEDVAVYYCQQYYSIP CSFGQGTKLEIK<br><br>SEQ ID NO: 25506 | QVQLVQSGAEVKKPGASVKVSCKASGYTFTNYDIN WVRQATGQGLEWMGWMTPNSGNTGYAQKFQGR VTMTRNTSISTAYMELSSLKSEDTAVYYCAYSSGW YRFDYWGQGTLVTVSS<br><br>SEQ ID NO: 29512 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATAACAACTCCTTAACTTGGTACCA GCTGAAACCAGGACAGCCTCCTAAGAAGCTCA TTTACTGGGCATCTCACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GTCCAAGGTGGAAATCAAA<br><br>SEQ ID NO: 25507 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAGCACAGGCTATGCACAGAAGTTCCAGGGCAG AGTCACCATGACCAGGAACACTCCATAAGCAC AGCCTACATGGAGCTGAGCAGCCTGAGATCTGA GGACACGGCCGTGTATTACTGTGCGTATAGCAGT GGCTGGTACTTTGACTACTGGGGCCAGGGAA CCCTGGTCACCGTCCTCCTCA<br><br>SEQ ID NO: 29513 |
| | | AA | DIVMTQSPDSLAVSLGERATINCKSSQSVLYSSN NNNSLTWYQLKPGQPPKKLIYWASTRESGVPDR FSGSGSGTDFTLTISSLQAEDVAVYYCQQYYSTP PTFGQGSKVEIK<br><br>SEQ ID NO: 25508 | QVQLVQSGAEVKKPGASVKVSCKASGYTFTNYDIN WVRQATGQGLEWMGWMHPNSGSTGYAQKFQGR VTMTRNTSISTAYMELSSLRSEDTAVYYCAYSSGW YYFDYWGQGTLVTVSS<br><br>SEQ ID NO: 29514 |

FIGURE 50
(Continued)

| | | | |
|---|---|---|---|
| iPS:434239 | 21-225_58F1 | NA | GACATCCAGATGACCCAGTCTCCATCCTCCCT GTCTGCATCTGTAGGAGACAGAGTCACCATCA CTTGCCGGGCAAGTCAGAGCATTACCAACTTT TTAAATTGGTATCAGCAGAAACCAGGGAAAG CGCCTAAACTCCTGATCTTCGCTGCATCCAGTT TGCAAAGTGGAATCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTATCCCGTGG ACGTTCGGCCAAGGGACCAAGGTGGAAATCA AA<br><br>SEQ ID NO: 25509 | GAGGTGCAGCTGTTGGAGTCTGGGGGAGGCTTG GTTCAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGCTATTAGTACTGGTGGTGGT AACACATACTACGCAGACTCCGTGAAGGGCCGG TTCACCATTTCCAGAGACAATTCCAAGAACACGC TGTATCTGCAAATGAACAGCCTGAGAGCCGAGG ACACGGCCGTATATTACTGTGCGAAACGGGGGG TCTACGGTGACTTTGATGCTTTTGATATCTGGGGC CAAGGGACAATGGTCACCGTCTCTTCA<br><br>SEQ ID NO: 29515 |
| | | AA | DIQMTQSPSSLSASVGDRVTITCRASQSITNFLN WYQQKPGKAPKLLIFAASSLQSGIPSRFSGSGSG TDFTLTISSLQPEDFATYYCQQSYSIPWTFGQGT KVEIK<br><br>SEQ ID NO: 25510 | EVQLLESGGGLVQPGGSLRLSCAASGFTFSSYAMS WVRQAPGKGLEWVSAISTGGGNTYYADSVKGRFT ISRDNSKNTLYLQMNSLRAEDTAVYYCAKRGVYG DFDAFDIWGQGTMVTVSS<br><br>SEQ ID NO: 29516 |
| iPS:434241 | 21-225_61E6 | NA | GACATCCAGATGACCCAGTCTCCATCTCCT GTCTGCATCTGTAGGAGACAGAGTCACCATCA CTTGCCGGGCAAGTCAGGGCATTAGCAGCGCGG TTAGGCTGGTATCAGCAGAAACCAGGGAAAG CCCCTGAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATATAGTTTCCCTCCG TGGACGTTCGGCCAAGGGACCAAGGTGGAAA TCAAA<br><br>SEQ ID NO: 25511 | GAGGTGCAGCTGTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTACTAGTGGTGGTGTT AACACATTCTACGCAGACTCCGTGAAGGGCCGGT TCACCATTTCCAGAGACAATGAACAGCCTGAGAGCCGAGGA GTATCTGCAAATGAACAGCCTGAGAGCCGAGGA CACGGCCGTATTTGACTACTGGGGCCAGGGAACCCTGG GGGATCTTTGACTACTGGGGCCAGGGAACCCTGG TCACCGTCTCCTCA<br><br>SEQ ID NO: 29517 |

FIGURE 50
(Continued)

| | | | | |
|---|---|---|---|---|
| iPS:434243 | 21-225_62C1 | AA | DIQMTQSPSSLSASVGDRITITCRASQGIGNDLG WYQQKPGKAPERLIYAASSLQSGVPSRFSGSGSG TEFTLTISSLQPEDFATYYCLQHNSFPPWTFGQG TKVEIK<br><br>SEQ ID NO: 25512 | EVQLLESGGGLVQPGGSLRLSCAASGFTFRSYAMS WVRQAPGKGLEWVSATSGSGVNTFYADSVKGRFT ISRDNSKNTLYLQMNSLRAEDTAVYYCAKLELGIF DYWGQGTLVTVSS<br><br>SEQ ID NO: 29518 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTACATAGTA ATGGATACAAACTATTTGGATTGGTACCTGCAG AAGCCAGGGCAGTCTCCACAGCTCCTGATCTA TTTGGTTTCTAATCGGCCTCCGGGGTCCCTGA CAGGTTCAGTGGCAGTGGATCAGGCACAGAT TTACACTGAAAATCAGCAGAGTGGGGGCTGA GGATGTTGGGGTTTATTTCTGCCTGCAAGCTCT ACAAACTCCTCACCTTCGGCCAAGGGACAC GACTGGAGATTAAA<br><br>SEQ ID NO: 25513 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGACT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGATTTTGGAGTG GACTGGGGCCAGGGAACCCTGGTCACCGTCTCCT CA<br><br>SEQ ID NO: 29519 |
| | | AA | DIVMTQSPLSLPVTPGEPASISCRSSQSLLHSNGY NYLDWYLQKPGQSPQLLIYLVSNRASGVPDRFS GSGSGTDFTLKISRVGAEDVGVYFCLQALQTPLT FGQGTRLEIK<br><br>SEQ ID NO: 25514 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCAIFGVDWGQ GTLVTVSS<br><br>SEQ ID NO: 29520 |

FIGURE 50
(Continued)

| | | | | |
|---|---|---|---|---|
| iPS:434245 | 21-225_62H1 | NA | GACATCCAGATGACCCAGTCTCCATCTCCCT GTCTGCATATGTAGGAGACAGAGTCACCATCA CTTGCCGGGCAAGTCAGAACATTTTCAGCTAT TTAAATTGGTATCAGCAGAAACCAGGGAAAG CCCCTAAGGTCCTGATCTATCGTGTATTTAGTT TGCAAAGTGGGGTCCCATCAAGGTTCAGTGGC AGTGGATCGGGACAGATTTCACTCTCACCAT CAGCAGTCTGCAACCTGCAAGAGTTTGCAACTT ACTACTGTCAACAGAGTTACAGTACCCCATTC ACTTTCGGCCCTGGGACCAAGGTGGATATCAA A<br>SEQ ID NO: 25515 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGTCCAGGCCAGGGCT GGAGTGGATGGCAATTATATGTATGATGGAAGT AATAAATACTATGCAGACTCCGTGAAGGGCCGA TTCACCATCTCCAGAGACAATTCCAAGAACACGC TGTATCTGCAAATCAACAGCCTGAGAGCCGAG ACACGGCTGTGTATTACTGTGCGAGAGAAGACCC GCGTACCAGCTGCTCTGACTACTGGGGCCAGGGA ACCCTGGTCACCGTCTCCTCA<br>SEQ ID NO: 29521 |
| | | AA | DIQMTQSPSSLSAYVGDRVTITCRASQNIFSYLN WYQQKPGKAPKVLIYAVFSLQSGVPSRFSGSGS GTDFTLTISSLQPEDFATYYCQQSYSTPFTFGPGT KVDIK<br>SEQ ID NO: 25516 | QVQLVESGGGVVQPGRSLRLSCAASGFTFSSYGMH WVRQAPGQGLEWMAIIWYDGSNKYYADSVKGRF TISRDNSKNTLYLQINSLRAEDTAVYYCAREDPRTS CSDYWGQGTLVTVSS<br>SEQ ID NO: 29522 |
| iPS:434247 | 21-225_62D2 | NA | GACATCCAGATGACCCAGTCTCCATCTCCCT GTCTGCATCTGTAGGAGACAGAGTCACCATCA TTTGCCGGGCAAGTCAGAGCATTATCAGTTAT TTAAATTGGTATCAGCAGAAACCAGGGAAAG CCCCTAAGCTCCTGATCTATGCTGTACATCCAGTT TGCAAAGTGGGGTCCCATCAAGGTTCAGTGGC AGTGGATCTGGGACAGATTTCACTCTCACCAT CAGCAGTCTGCAACCTGCAAGATTTTGCAACTT ACTACTGTCAACAGAGACTTACAGTCCCCGCTC ACTTTCGGCGGAGGGACCAAGGTGGAGATCA AA<br>SEQ ID NO: 25517 | CAGGTGTATCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGTCCAGGCAAGGGCT GGAGTGGGTGGCAGTTATATGTATGATGGAAGT AATAAATACTCTGCAGACTCCGTGAAGGGCCGAT TCACCATCTCCAGAGACAATTCCAAGAACACGCT GGATCTGCAAATGAACAGCCTGAGAGCCGAGGA CACGGCTGTGTATTACTGTGCGAGAGATAATGGT AACTGGAACTACCTGACTACTGGGGCCAGGGA ACCCTGGTCACCGTCTCCTCA<br>SEQ ID NO: 29523 |

FIGURE 50
(Continued)

| | | | |
|---|---|---|---|
| iPS:434249 | 21-225_62E2 | AA | DIQMTQSPSSLSASVGDRVTIICRASQSIISYLNWYQQKPGKAPKLLIYATSSLQSGVPSRFSGSGSGTDFTLTISSLQPEDFATYYCQQTYSPPLTFGGGTKVEIK<br>SEQ ID NO: 25518 | QVYLVESGGGVVQPGRSLRLSCAASGFTFSSYGMHWVRQAPGKGLEWVAVIWYDGSNKYSADSVKGRFTISRDNSKNTLDLQMNSLRAEDTAVYYCARDNGNWNYLDYWGQGTLVTVSS<br>SEQ ID NO: 29524 |
| | | NA | GACATCCAGATGACCCAGTCTCCATCCTCCCTGTCTGCATCTGTAGGAGACAGAGTCACCATCACTTGCCGGGCAAGTCAGGCATTAGAAATGATTTAGGCTGGTATCAGCAGAAACCAGGGAAAGCCCCTAAGCGCCTGATCTATGCTGCATCCCGTTTGCAAAGTGGGGTCCCATCAAGGTTCAGCGGCAGTGGATCTGGGACAGACCTGAAGATTTTGCAACTTATTACTGTCTACAGAGCATAGTAATTACCCTCTCACTTTCGGCGGAGGGACCAGGGTTGAGATCAAA<br>SEQ ID NO: 25519 | CAGCTGCAGCTGCAGGAGTCGGGCCCAGGACTGGTGAAGCCTTCGGAGACCCTGTCCCTCACCTGTATTGTCTCTGGTGGCTCCATCAGCAGAAGTAGTATACTACTGGGGCTGGATCCGCCAGCCCCCAGGGAAGGGGCTGGAGTGGATTGGGAGCATCTATTATAGTGGGATCGCCTCCTATAATCCGTCCCTCAAGAGTCGAGTCACCATATCCGTAGACACGTCCAAGAACCAGTTCTCCCTGAAGCTGAACTCTGTGACCGCCACAGACACGGCTGTATATTACTGTGCGAGACTGAGCAGTGGCTGGTCCTTTGACTACTGGGGCCAGGGAACCCTGGTCACCGTCTCCTCA<br>SEQ ID NO: 29525 |
| | | AA | DIQMTQSPSSLSASVGDRVTITCRASQGIRNDLGWYQQKPGKAPKRLIYAASRLQSGVPSRFSGSGSGTEFTLTISSLQPEDFATYYCLQHSNYPLTFGGGTRVEIK<br>SEQ ID NO: 25520 | QLQLQESGPGLVKPSETLSLTCIVSGGSISRSSYYWGWIRQPPGKGLEWIGSIYYSGIASYNPSLKSRVTISVDTSKNQFSLKLNSVTATDTAVYYCARLSSGWSFDYWGQGTLVTVSS<br>SEQ ID NO: 29526 |

FIGURE 50
(Continued)

| | | | |
|---|---|---|---|
| iPS:434251 | 21-225_62G3 | NA | GACATCCAGATGACCCAGTCTCCATCCTCCT GTCTGCATCTGTAGGAGACAGAGTCACCATCA CTTGCCGGGCAAGTCAGACAGTCATTAGAAATAAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCGACT TATTACTGTCTACAGTATAATAGTTACCCATTC ACTTTCGGCCCTGGGACCAAAGTGGATATCAA A<br><br>SEQ ID NO: 25521 | GAGGTGCAGCTGGTGGAGTCTGGGGGAGGCTG GTCAAGCCTCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTATATTACTGTGCGAGGGTTAACTCT TTTGACTCCTGGGGCCAGGGAACCCTGGTCACCG TCTCCTCA<br><br>SEQ ID NO: 29527 |
| | | AA | DIHMTQSPSSLSASVGDRVTITCRASQDIRNNLG WYQQKPGKAPKRLIYTASSLQSGVPSRFSGSGSG TEFTLTISSLQPEDFATYYCLQYNSYPFTFGPGTK VDIK<br><br>SEQ ID NO: 25522 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARVNSFDSW GQGTLVTVSS<br><br>SEQ ID NO: 29528 |
| iPS:434253 | 21-225_62E4 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAAACCAGGGAAAG CCCCTAAGCGCCTAATCTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATATAATAGTTATCCGCTC ACTTTCGGCGGAGGGACCAAGGTGGAGATCA AA<br><br>SEQ ID NO: 25523 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGCTATGATAGAAGT AATAAATACTATGCAGACTCCGTGAAGGGCCGA TTCACCATCTCCAGAGACAATTCCAAGAACACGC TGTATCTGCAAATGAACAGCCTGAGAGTCGAGG ACACGGCTGTATCACTACTGTGCGAGAGAGCTTGG GTTCAGCAGTGACTACTGGGGCCAGGGAACCCT GGTCACCGTCTCCTCA<br><br>SEQ ID NO: 29529 |

FIGURE 50
(Continued)

| | | | |
|---|---|---|---|
| iPS:434255 | 21-225_62E6 | AA | DIQMTQSPSSLSASVGDRVTITCRASQGIRNDLG WYQQKPGKAPKRLIYAAFSLQSGVPSRFSGSGS GTEFTLTISSLQPEDFATYYCLQHNSYPLTFGGG TKVEIK<br>SEQ ID NO: 25524 | QVQLVESGGGVVQPGRSLRLSCAASGFTFSDYGM HWVRQAPGKGLEWVAVIWYDRSNKYYADSVKGR FTISRDNSKNTLYLQMNSLRVEDTAVHCARELGF SSDYWGQGTLVTVSS<br>SEQ ID NO: 29530 |
| | | NA | GAAATAGTGATGACGCAGTCTCCAGCCACCCT GTCTGTGTCTCCAGGGGAAAGAGCCACCCTCT CCTGCAGGGCCAGTCAGAGTGTTAACAGCAAC TTAGCCTGGTACCAGCAGAAACCTGGCCAGGC TCCCAGGCTCCTCATCTCTGTTGCATCCACCAG GGCCACTGGTATCCCAGCCAGGTTCAATGGCA GTGGGTCTGGGACAGAGTTCACTCTCACCATC AGCAGCCTGCAGTCTGAAGATAATGACTGGCCGTGTA TTACTGTCAGCAGTATAATGACTGGCCGTGTA GTTTTGGCCAGGGGACCAAGCTGGAGATCAAA<br>SEQ ID NO: 25525 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTCCTATGGCAT GCACTGGGTCCGCCAGGCTCCAGGCAAGGGGCT GGAGTGGGTGGCAGCTATATGGTATGATGAAG TAATAAATACTATGCAGACTCCGTGAAGGGCCG AGTCACCATCTCCAGAGACAATTCCAAGAACTCG CTGCATCTGCAAATGAACAGCCTGAGAGCCGAG GACACGGCTGTGTATTATTGTGCGAGAGATCAGG GCATAGTGGGAGCTACTGGTTTGACTACTGGGG CCAGGGAACCCTGGTCACCGTCTCCTCA<br>SEQ ID NO: 29531 |
| | | AA | EIVMTQSPATLSVSPGERATLSCRASQSVNSNLA WYQQKPGQAPRLLISVASTRATGIPARFNGSGSG TEFTLTISSLQSEDFAVYYCQQYNDWPCSFGQGT KLEIK<br>SEQ ID NO: 25526 | QVQLVESGGGVVQPGRSLRLSCAASGFTFSSYGMH WVRQAPGKGLEWVAAIWYDGSNKYYGDSVKGRV TISRDNSKNSLHLQMNSLRAEDTAVYYCARDQGIV GATWFDYWGQGTLVTVSS<br>SEQ ID NO: 29532 |

FIGURE 50
(Continued)

| | | | |
|---|---|---|---|
| iPS:434257 | 21-225_62F7 | NA | GACATCCAGATGACCCAGTCTCCATCTCCCT GTCTGCATCTGTAGGAGACAGAGTCACCATCA CTTGCCGGGCAAGTCAGGCCATTAGAAATGAT TTAGGCTGGTATCAGCAGAAACCAGGGAAAG CCCCTAAGCGCCTGATCTATCCTGCATCCGTT TGCAAAGTGGGGGTCCCATCAAGGTTCAGCGGC AGTGGATCTGGGACAGCAGAATTCACTCTCACAAT CAGCAGCCTGCAGCCTGAAGATTTTGCAACTT ATTACTGTCTACAGTATAATAGTTACCCTCCGT GGACGTTCGGCCAAGGGTCCAAGGTGGAAAT CAAA<br><br>SEQ ID NO: 25527 | GAGGTGCAGCTGTTGGAGTCTGGGGGAGGCTTG GTTCAGCCTGGGGGGTCCCTGAGACTCTCCTGTG CAGCCTCTGGATTCACCTTTAGCAGCTATGTTAT GAGCTGGGTCCGCCAGGCTCCAGGGAAGGGGCT GGAGTGGGTCTCAGTTATTAGTGGTAGTGGTGCT AAACATACTATGCAGACTCCGTGAAGGGCCGA TTCACCATCTCCAGAGACAATTCCAAGAACACGC TGTATCTGCAAATGAACAGCCTGAGAGCCGAGG ACACGGCCGTATATTACTGTGCGAACTGGGAT AGACTACTACTACGGTATGGACGTCTGGGGCCAA GGGACCACGGTCACCGTCTCCTCA<br><br>SEQ ID NO: 29533 |
| | | AA | DIQMTQSPSSLSASVGDRVTITCRASQAIRNDLG WYQQKPGKAPKRLIYPASRLQSGVPSRFSGSGS GTEFTLTISSLQPEDFATYYCLQYNSYPPWTFGQ GSKVEIK<br><br>SEQ ID NO: 25528 | EVQLLESGGGLVQPGGSLRLSCAASGFTFSSYVMS WVRQAPGKGLEWVSGISGSGAKTYYADSVKGRFT ISRDNSKNTLYLQMNSLRAEDTAVYYCAELGIDYY YGMDVWGQGTTVTVSS<br><br>SEQ ID NO: 29534 |
| iPS:434259 | 21-225_62G7 | NA | GACATCCAGATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGCAGAAATCCAGGGAAGGC CCCTAAACTCCTGATCTATGCTGCATCCAGTTT GCAAAGTGGGGTCCCATCAAGGTTCAGCGGCA GTGGATCTGGGACAAATTTCACTCTCACCATC AGCAGCCTCCAGCCTGAAGATTTTGCAACTTA CTATTGTCAACAGACTAACAGTTTCCCTCTCAC TTTCGGCGGAGGGACCAAGGTGGAGATCAAA<br><br>SEQ ID NO: 25529 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTAACAGTG GTGGCACAAACAAGCACCAAGCACAGAAGTTTCAGGGCA GGGTCACCATGACCAGGGACACGTCCATCAGCA CAGCCTACATGGAGCTGAGCAGTCTGAGATCGA CGACACGGCCGTGTATTACTGTGCGAGAGCTCCG GGTATAGCAGCAGCTGGTACATGGGGATACTTTG ACTACTGGGGCCAGGGAACCCTGGTCACCGTCTC CTCA<br><br>SEQ ID NO: 29535 |

FIGURE 50
(Continued)

| | | | |
|---|---|---|---|
| iPS:434261 | 21-225_56F7 | AA | DIQMTQSPSSVSASVGDRVTFTCRASQDISSWLAWYQQNPGKAPKLLIYAASSLQSGVPSRFSGSGSGTNFTLTISSLQPEDFATYYCQQTNSFPLTFGGGTKVEIK<br>SEQ ID NO: 25530 | QVQLVQSGAEVKKPGASVKVSCKASGYTFTGYYMHWVRQAPGQGLEWMGWIKPKSGGTNQAQKFQGRVTMTRDTSISTAYMELSSLRSDDTAVYYCARAPGIAAAGTWGYFDYWGQGTLVTVSS<br>SEQ ID NO: 29536 |
| | | NA | GACATCTGATGACCCAGTCTCCATCCTCACTGTCTGCATCTGTAGGAGACAGAGTCACCATCACTTGTGCGGGCGAGTCAGGGCATTAGCACTTATCTTAGCCTGGTTTCAGCAGACACCAGGGACAGCCCCTAAGTCCCTGATCTATGCTGCATCCAGTTTGCAAGGTGGGGTCCCATCAAAGTTCAGCGGCAGTGGATCTGGGACAGATTCACTCTCACCATCAGCAGCCTGCAGCCTGAAGATTTTGCAACTTACTACTGCCATCAGTATAATAGTTTCCCATTTAAGTTCGGGCGTGGGACCAAAGTGGATATCACA<br>SEQ ID NO: 25531 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGTCTTAAACTGGGTCCGCCAGGCTCCAGGGAAGGGGCTGGAGTGGGTCTCAGTTATGAGTGGTAGTGGTGGTAGAACATACTACGCAGACTCCGTGAAGGGCCGGTTCACCATCTCAAGAGACAATTCCAAGAACACGCTGTATCTGCAAATGAACAGCCTGAGAGCCGAGGACACGGCCGTATATTTCTGTGCGATGACTACGCACTTTGACTACTGGGGCCAGGGAACCCTGGTCACCGTCTCCTCA<br>SEQ ID NO: 29537 |
| | | AA | DILMTQSPSSLSASVGDRVTITCRASQGISTYLAWFQQTPGTAPKSLIYAASSLQGGVPSKFSGSGSGTDFTLTISSLQPEDFATYYCHQYNSFPFKFGRGTKVDIT<br>SEQ ID NO: 25532 | EVQLLESGGGLVQPGGSLRLSCAASGFTFSSYVLNWVRQAPGKGLEWVSAMSGSGGRTYYADSVKGRFTISRDNSKNTLYLQMNSLRAEDTAVYFCAMTTHFDYWGQGTLVTVSS<br>SEQ ID NO: 29538 |

FIGURE 50
(Continued)

| | | | |
|---|---|---|---|
| iPS:434263 | 21-225_56H7 | NA | GACATCCAGATGACCCAGTCTCCATCCTCCCT GTCTGCATCTGTAGGAGACAGAGTCACCATCA CTTGCCGGGCAAGTCAGAGACATTAGAAATGAT TTAGGCTGGTATCAGCAGAGGCCAGGGAAAG CCCCTAAGCGCCTGATCTATCCTGCATCCAGTT TGCTAAGTGGGGTCCCATCAAGGTTCAGCGGC AGTGGATCTGGGACAGAATTCACTCTCACAAT CAGCAGCCTGCAGCCTGAAGATTTTGCAACTT ACTACTGTCTACAGGATAATAGTTACCCATTC ACTTTCGGCCCTGGGACCAAAGTGGATAGCAA A<br><br>SEQ ID NO: 25533 | GAGGTGCAGCTGGTGGAGTCTGGGGGAGGCTG GTCAAGCCTGGGGGGTCCCTGAGACTCTCCTGTG CAGCCTCTGGATTCTCCTTCAGTAGTAGTTATAGCAT GAACTGGGTCCGCCAGGCTCCAGGGAAGGGGCT GGAGTGGGTCTCATCCATTAGTAGTAGTAGTACT TACATATACTACGGAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGATCGGGG CAGCAGCTGGGGCCAGGGAACCCTGGTCACCGT CTCCTCA<br><br>SEQ ID NO: 29539 |
| | | AA | DIQLTQSPSSLSASVGDRVTITCRASQDIRNDLG WYQQRPGKAPKRLIYPASSLLSGVPSRFSGSGSG TEFTLTISSLQPEDFATYYCLQDNSYPFTFGPGTK VDSK<br><br>SEQ ID NO: 25534 | EVQLVESGGGLVKPGGSLRLSCAASGFSFSSYSMN WVRQAPGKGLEWVSSISSSSTYIYGDSVKGRFTIS RDNAKNSLYLQMNSLRAEDTAVYYCARDRGSSW GQGTLVTVSS<br><br>SEQ ID NO: 29540 |
| iPS:434265 | 21-225_57B2 | NA | GACATCCAGATGACCCAGTCTCCATCCTCCCT GTCTGTATCTGTAGGAGACAGAGTCACCATCA CTTGCCGGGCAAGTCAGGGCATTAGAAATGCT TTAGGCTGGTATCAGCAGAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br><br>SEQ ID NO: 25535 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATAAACTACACAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGAGTGGCTGG CTTGACTACTGGGGCCAGGGAACCCTGGTCACC GTCTCCTCA<br><br>SEQ ID NO: 29541 |

FIGURE 50
(Continued)

| | | | |
|---|---|---|---|
| iPS:434267 | | AA | DIQMTQSPSSLSVSVGDRVTITCRASQGIRNALG WYQQKPGKAPKRLIYAASSLQSGVPSRFSGSGS GTEFTLTISSLQPEDFATYYCLQHNSYPFTFGPGT KVDIK | EVQLVESGGGLVKPGGSLRLSCAASGFTFSSYSMN WVRQAPGKGLEWVSSISGSSSYINYTDSVKGRFTIS RDNAKNSLYLQMNSLRAEDTAVYYCARVAGFDY WGQGTLVTVSS |
| | | | SEQ ID NO: 25536 | SEQ ID NO: 29542 |
| | | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGCTCCTGATCTATGCTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCACCTT ACTACTGTCAACAGAGTTACAATATTTCATTC ACTTTCGGCCCTGGGACCAAAGTGGATATCAA A | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCGCCGGGAAGGGACT GGAGTGGATTGGGCGCATCTATACCAGGGGGAG CACCAACTACAACCCCTCCCTCAAGAGTCGAGTC ACCATGTCAATAGACACGTCCAAGAACCAGTTCT CCCTGAAGCTGAGCTCTGTGACCGCCGCGGACAC GGCCGTGTATTACTGTGCGAGAGAGGAAAAAC TGGGGGGGTTTCTTACTTTGACTACTGGGGCCAG GGAACCCTGGTCACCGTCTCCTCA |
| | 21-225_57F2 | | SEQ ID NO: 25537 | SEQ ID NO: 29543 |
| | | AA | DIQMTQSPSSLSASVGDRVTITCRASQSISSYLNW YQQKPGKAPKLLIYAASSLQSGVPSRFSGSGSGT DFTLTISSLQPEDFAPYYCQQSYNISFTFGPGTKV DIK | QVQLQESGPGLVKPSETLSLTCTVSGGSISSYYWSW IRQPAGKGLEWIGRIYTRGSTNYNPSLKSRVTMSID TSKNQFSLKLSSVTAADTAVYYCAREGKTGGVSYF DYWGQGTLVTVSS |
| | | | SEQ ID NO: 25538 | SEQ ID NO: 29544 |

FIGURE 50
(Continued)

| | | | | |
|---|---|---|---|---|
| iPS:434269 | 21-225_57H3 | NA | GAAATAGTGATGACGCAGTCTCCAGCCACCCT GTCTGTGTCTCCAGGGGAAAGAGCCACCCTCT CCTGCAGGGCCAGTCAGTGTTAGCAGCAGC TTAGCCTGGTACCAGCAGAAACCTGGCCAGGC TCCCAGGCTCCTCATCTATGGTGCATCCACCA GGGCCACTGGTTTCCCAGCCAGGTTCAATGGC AGTGGGTCTTGGACAGACTTCACTCTCACCAT CAGCAGCCTGCAGTCTGAAGATTTTGCAATTT ATTACTGTCAGCAGTAGTACTGGCCGTGC AGTTTTGGCCAGGGACCAAGCTGGAGATCAA A | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGCTATATGGTATGATGGAAG TAATAAATACTATGCAGAGACTCCGTGAAGGCCG ATTCACCATCTCCAGAGACAATTCCAAGAACACG CTGTATCTGCAAATGAACAGCCTGAGAGCCGAG GACACGGCTGTGTATTACTGTGCGAGAGATTATG GTATAGTGGAGCTACATATTTGACTACTGGGG CCAGGGAACCCTGGTCACCGTCTCCTCA |
| | | | SEQ ID NO: 25539 | SEQ ID NO: 29545 |
| | | AA | EIVMTQSPATLSVSPGERATLSCRASQSVSSSLA WYQQKPGQAPRLLIYGASTRATGFPARFNGSGS GTEFTLTISSLQSEDFAIYYCQQYNDWPCSFGQG TKLEIK | QVQLVESGGGVVQPGRSLRLSCAASGFTFSSYGMH WVRQAPGKGLEWVAAIWYDGSNKYYADSVKGRF TISRDNSKNTLYLQMNSLRAEDTAVYYCARDYGIV GATYFDYWGQGTLVTVSS |
| | | | SEQ ID NO: 25540 | SEQ ID NO: 29546 |
| iPS:434271 | 21-225_57A4 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCTGCAGAAACCAGGGAAAGC CCCTAAGCGCCTGATCTATGCTGCATCCAGTTT GCTAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATATAGTTACCATTCAC TTTCGGCCCTGGGACCAAAGTGGATATCAAA | CAGGTGCAGCTGGTGGTGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGGTGGCAGTTATATGTAGACTCCGTGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGGGAACTGGGG ATGAGGTCTGACTACTGGGGCCAGGGAACCCTG GTCACCGTCTCCTCA |
| | | | SEQ ID NO: 25541 | SEQ ID NO: 29547 |

FIGURE 50
(Continued)

| | | | |
|---|---|---|---|
| iPS:434273 | 21-225_57E4 | AA | DIQMTQSPSSLSASVGDRVTITCRASQGIRNDLG WYLQKPGKAPKRLIYAASSLLSGVPSRFSGSGSG TEFTLTISSLQPEDFATYYCLQHNSYPFTFGPGTK VDIK<br>SEQ ID NO: 25542 | QVQLVESGGGVVQPGRSLRLSCVASGFTFSDYGM HWVRQAPGKGLEWVAVIWYAGSNKYYVDSVKGR FTISRDNSKNTLYLQMNSLRAEDTAVYYCARELGM RSDYWGQGTLVTVSS<br>SEQ ID NO: 29548 |
| | | NA | GACATCCAGATGACCCAGTCTCCATCTTCCGT GTCTGCATCTGTAGGAGACAGAGTCTCCATCA CTTGTCGGGCGAGTCAGGATCAGATTAGCAACTGG TTAGCCTGGTATCAGCAGAAACCAGGGAAAG CCCCTAAGCTCCTGATCTATGCTGCATCCAGTT TGCAAAGTGGTGGGTCCCATCAAGGTTCAGCGGC AGTGGTTCTGGGACAGATTTCACTCTCACCAT CAGCAGCCTGCAGCCTGAAGATTTTGCAACTT ACTCTTGTCAACAGGGTAACAGTTTCCCATTC ACTTTCGGCCCTGGGACCAAAGTGGATATCAA A<br>SEQ ID NO: 25543 | GAGGTGCAGCTGTTGGAGTCTGGGGGAGGCTTG GTACAGCCGGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AGTACATTCTACGCAGACTCCGTGAAGGGCCGGT TCACCATCTCCAGAGACAATCCAAGACCACGCT GTATCTGCAAATGAACAGCTGAGAGCCGAGGA CACGGCCGTATATTACTGTGCGAAAAGGGACTG GAACGACGTTTTGACTACTGGGGCCAGGGAACC CTGGTCACCGTCTCCTCA<br>SEQ ID NO: 29549 |
| | | AA | DIQMTQSPSSVSASVGDRVSITCRASQDISNWLA WYQQKPGKAPKLLIYAASSLQSGVPSRFSGSGS GTDFTLTISSLQPEDFATYSCQQGNSFPFTFGPGT KVDIK<br>SEQ ID NO: 25544 | EVQLLESGGGLVQPGGSLRLSCAASGFTFSSYAMS WVRQAPGKGLEWVSVISGSGSTFYADSVKGRFTI SRDNSKTTLYLQMNSLRAEDTAVYYCAKRDWND VFDYWGQGTLVTVSS<br>SEQ ID NO: 29550 |

FIGURE 50
(Continued)

| iPS:434275 | 21-225_57F4 | NA | GACATCCAGATGACCCAGTCTCCATCTCCCT GTCTGCATCTGTAGGAGACAGAGTCACCATCA CTTGCCGGGCAAGTCAGTCAGACAGTAAATGAT TTAGGCTGGTATCAGCAGAAGCCAGGGAAAG CCCCTAAGCGCTTGATCTATGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATCACTGTCTACAGTATGGTAGTTTCCCATTCA CTTTCGGCCCTGGGACCAAAGTGGATATCAAA | CAGGTGCAGCTGGTGGAGTCTGGGGGAGGCTTG GTCAAGCCTGGAGGGTCCCTGAGACTGTCCTGTG CAGCCCTCTGGATTCATCTTCAGTGACTACTACAT GAACTGGATCCGCCAGGCTCCAGGGAAGGGGCT GGAGTGGGTTTCATACATTAGTAGTAGTGGTAGT ACCATATACTACGCAGAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGATATGATT ACGTGGGGCCAGGGAACCCTGGTCACCGTCTCCT CA |
| | | | SEQ ID NO: 25545 | SEQ ID NO: 29551 |
| | | AA | DIQMTQSPSSLSASVGDRVTITCRASQVIRNDLG WYQQKPGKAPKRLIYAASSLQSGVPSRFSGSGS GTEFTLTISSLQPEDFATYHCLQYGSFPFTFGPGT KVDIK | QVQLVESGGGLVKPGGSLRLSCAASGFIFSDYYMN WIRQAPGKGLEWVSYISSSGSTIYYADSVKGRFTIS RDNAKNSLYLQMNSLRAEDTAVYYCARDMITWG QGTLVTVSS |
| | | | SEQ ID NO: 25546 | SEQ ID NO: 29552 |
| iPS:434277 | 21-225_57A7 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAAACCAGGAAAG CCCCTAAGCTCCTGATCTATGCTGCATCCAATT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTAGATATCAA A | CAGGTGCAACTGGTGCAGTCTGGGGCTGAGGTG AAGAAGCCTGGGGCCTCAGTGAAGGTCTCCTGC AAGGCTTCTGGATACACCTTCACCGGCTACCATA TACACTGGGTGCGACAGGCCCCTGGACAAGATCT TGAGTGGATGGGATGGATCAACCTAACAATAAT GGCACAAACTATGCACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAGATGGG AGAAGTGGTTTTGACTACTGGGGCCAGGGAACC CTGGTCACCGTCTCCTCA |
| | | | SEQ ID NO: 25547 | SEQ ID NO: 29553 |

FIGURE 50
(Continued)

| | | | | |
|---|---|---|---|---|
| iPS:434279 | 21-225_57F7 | AA | DIQMTQSPSSVSASVGDRVTITCRASQGISRWLAWYQQKPGKAPNLLIYAASNLQSGVPSRFSGSGSGTDFTLTISSLQPEDFATYYCQQANSFPFTFGPGTKVDIK | QVQLVQSGAEVKKPGASVKVSCKASGYTFTGYHIHWVRQAPGQDLEWMGWINPNNNGTNYAQKFQGRVTMTRDTSISTAYMELSRLRSDDTAVYYCARDGRSGFDYWGQGTLVTVSS |
| | | | SEQ ID NO: 25548 | SEQ ID NO: 29554 |
| | | NA | GAAATAGTGATGACGCAGTCTCCAGCCATCCTGTCTGTGTTTCCAGGGGAAAGAGCCACCCTCCCTGCAGGGCCAGTCAGAGTGTTAGCAGCGACTTAGCCTGGTACCAGCAGAAACCTGGCCAGGCTCCCAGGCTCCTCATCTATGGTGCATCCACCAGGGCCACTGGTATGCCAGCCAGGTTCAGTGGCGGTGGGTCTGGGACAGAGTTCACTCTCACCATCAGCAGCCTGCAGTCTGAACATTTGCAGTTTATTACTGTCAGCAGTATAGTAACTGGCCATCACTTTCGGCCCTGGGACCAAAGTGGATATCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTAGTGGTGGTAACACATTCTACGCAGACTCCGTGAAGGGCCGGTTCACCATCTCCAGAGACAATTCCAAGAACACGCTGTATTTGCAAATGAACAGCCTGAGAGCCGAGGACACGGCCGTATATTACTGTGCGAAATTTTTCGGTGTAGTGGGAGTCGGGTGCTTTGACTACTGGGGCCAGGGAACCCTGGTCACCGTCTCCTCA |
| | | | SEQ ID NO: 25549 | SEQ ID NO: 29555 |
| | | AA | EIVMTQSPAILSVFPGERATLSCRASQSVSSDLAWYQQKPGQAPRLLIYGASTRATGMPARFSGGGSGTEFTLTISSLQSEHFAVYYCQQYSNWPFTFGPGTKVDIK | EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAKFFGVVGVGCFDYWGQGTLVTVSS |
| | | | SEQ ID NO: 25550 | SEQ ID NO: 29556 |

FIGURE 50
(Continued)

| | | | |
|---|---|---|---|
| iPS:434281 | 21-225_57B8 | NA | GACATCCAGATGACCCAGTCTCCATCCTCCT GTCTGCATCTGTAGGAGACAGAATCACCATCA CTTGCCGGGCAAGTCAGGACATTGGAAATGAT TTAGGCTGGTATCAGCAGAAACCAGGGAAAG CCCCTGAGGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAACATAATAGTTTCCCTCCG TGGACGTTCGGCCAAGGGACCAAGGTGGAAA TCAAA |
| | | | SEQ ID NO: 25551 |
| | | AA | DIQMTQSPSSLSASVGDRITITCRASQGIGNDLG WYQQKPGKAPERLIYAASSLQSGVPSRFSGSGSG TEFTLTISSLQPEDFATYYCLQHNSFPPWTFGQG TKVEIK |
| | | | SEQ ID NO: 25552 |
| | | NA | GAGGTGCAGCTGTTGGAGTCTGGGGGAGGCTTG GTACAGCCTGGGGGGTCCCTGAGACTCTCCTGTG CAGCCTCTGGATTCACCTTTAGAAGCTATGCCAT GAGCTGGGTCCGCCAGGCTCCAGGGAAGGGGCT GGAGTGGGTCTCAGCTATTAGTGGTAGTGGTGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAATTGGAACTG GGGATCTTTGACTACTGGGGCCAGGGAACCCTGG TCACCGTCTCCTCA |
| | | | SEQ ID NO: 29557 |
| iPS:434283 | 21-225_57F8 | AA | EVQLLESGGGLVQPGGSLRLSCAASGFTFRSYAMS WVRQAPGKGLEWVSAISGSGGNTFYADSVKGRFTI SRDNSKNTLYLQMNSLRAEDTAVYYCAKLELGIFD YWGQGTLVTVSS |
| | | | SEQ ID NO: 29558 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAGCTCCTGATCTATACTGCATCCAGTT TGCAAAGTGGGGTCCCATCAAGGTTCAGCGGC AATGAATCTGGGACAGCCTGAAACTGAGAGCCGAGG CAGCAGCCTGCAACAGGCTAACAGTTTCCGTGG ACTATTGTCAACAGGCTAACAGTTTCCGTGG ACGTTCGGCCAAGGGACCAAGGTGGAAATCA AA |
| | | | SEQ ID NO: 25553 |
| | | | GAGGTGCAGCTGTGTGGAGTCTGGGGGAGGCTTG GTACAGCCGGGGGGGTCCCTGAGACTCTCCTGTG TAGTCTCTGGATTCACCTTTAGCAACTATGCCAT GAGCTGGGTCCGCCAGGCTCCAGGGAAGGGGCT GGAGTGGGTCTCAGCTAGCAGACTCCGTGAAGGGCCGG AACACATTCTACGCAGACTCCGTGAAGGGCCGG GTCACCATCTCCAGAGACAATTCCAAGAACACGC TGTATCTGCAAATGAACAGTGTGCGAAACTGGGGA ACACGGCCGTATATTACTGTGCGAAACTGGGGA AGGACTACCACTACTACGGTATGGACGTCTGGGG CCAAGGGACCACGGTCACCGTCTCCTCA |
| | | | SEQ ID NO: 29559 |

FIGURE 50
(Continued)

| | | | |
|---|---|---|---|
| iPS:434285 | 21-225_57A11 | AA | DIQMTQSPSSVSASVGDRVTITCRASQGISNWLAWYQQKPGKAPKLLIYTASSLQSGVPSRFSGNESGTDFTLTISSLQPEDFATYYCQQANSFPWTFGQGTKVEIK<br>SEQ ID NO: 25554 | EVQLLESGGGLVQPGGSLRLSCVVSGFTFSNYAMSWVRQAPGKGLEWVSASSGSGNTFYADSVTGRVTISRDNSKNTLYLQMNSLRAEDTAVYYCAKLGKDYHYYGMDVWGQGTTVTSS<br>SEQ ID NO: 29560 |
| | | NA | GACATCGTGATGACCCAGTCTCCAGACTCCCTGACTGTGTCTCTGGGCGAGAGGGCCACCATCAACTGCAAGTCCAGCCAAAGTGTTTACACAGCTCCAACAATTATAACTACTTAGCTTGGTACCAGCAGAGACCAGGACAGCCTCCTAAGCTGCTCATTTACTGGGCATCTACCCGGGAGTCTGGGGTCCCTGACCGATTCAGTGGCAGCGGGTCTGGGACAGATTTCACTCTCACCATCAGCAGCCTGCAGGCTGAAGATATGGCAGTTTATTACTGTCAGCAATATTATAGTACTCCGTGGACGTTCGGCCAAGGGACCAAGGTGGAATTCAAA<br>SEQ ID NO: 25555 | CAGGTGCAGCTGGTGCAGTCTGGGGCTGAGGTGAAGAAGCCTGGGGCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGAACCCTAACAGTGTTAACACAGGCTATGCACAGAAGTTCCAGGGCAGAGTCACCATGACCAGGGACACCTCCATAAGCACAGCCTACATGGAGCTGAGCAGCCTGAGATCTGAGGACACGGCCGTGTATTACTGTGCGATCAGCAGTGGCTGGAACTGGTTCGACCCCTGGGGCCAGGGAACCCTGGTCACCGTCCTCTCA<br>SEQ ID NO: 29561 |
| | | AA | DIVMTQSPDSLTVSLGERATINCKSSQSVLHSSNNYNYLAWYQQRPGQPPKLVIYWASTRASGVPDRFSGSGSGTDFTLTISSLQAEDMAVYYCQQYYSTPWTFGQGTKVEFK<br>SEQ ID NO: 25556 | QVQLVQSGAEVKKPGASVKVSCKASGYTFTNYDINWVRQATGQGLEWMGWMNPNSVNTGYAQKFQGRVTMTRDTSISTAYMELSSLRSEDTAVYYCAISSGWNWFDPWGQGTLVTVSS<br>SEQ ID NO: 29562 |

FIGURE 50
(Continued)

| | | | | |
|---|---|---|---|---|
| iPS:434287 | 21-225_57F12 | NA | GACATCGTGATGACCCAGTCTCCAGACTCCCTGGCTGTGTCTCTGGGCGAGAGGGCCACCATCAACTGCAAGTCCAGCCAGAGTGTTTTATTCAGCTCCAACAATTACAATTACTTAGCTGGTACCAGCAGAAACAGGACAGCCTCCAAGCTGATCATTTACTGGGCATCTACCCGGGAATCCGGGGTCCCTGACCGATTCAGTGGCAGCGGGTCTGGAACAGATTTCACTCTCACCATCAGCAGCCTGCAGGCTGAAGATGTGGCAATTATTACTGTCAGCAATATTATAGTAATCCGTGTAGTTTTGGCCAGGGGACCAAGCTGGAGATCAAA<br>SEQ ID NO: 25557 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCCTTGAGTGGATGGGATGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGATAAGCAAGGACACGGCCGTTACCGGTCGACCCCTGGGGCCAGGGAACCCTGGTCACCGTCTCCTCA<br>SEQ ID NO: 29563 |
| | | AA | DIVMTQSPDSLAVSLGERATINCKSSQSVLFSSNNYNYLAWYQQKTGQPPKLIIYWASTRESGVPDRFSGSGSGTDFTLTISSLQAEDVAIYYCQQYYSNPCSFGQGTKLEIK<br>SEQ ID NO: 25558 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAISSGWYRFDPWGQGTLVTVSS<br>SEQ ID NO: 29564 |
| iPS:434289 | 21-225_57H12 | NA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCGACTTAGCCTGGTACCAGCAGAAACCTGGCCAGGCTCCCAGGCTCCTCATCTATGCTGCATCTACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATGATAACTGGCCATTCACTTTCGGCCCTGGGACCAAAGTGGATAACAAG<br>SEQ ID NO: 25559 | GAGGTGCAGCTGTTGGAGTCTGGGGGAGGCTTGGTACAGCCGGGGGGGTCCCTGAGACTCTCCTGTGCAGCCTCTGGATTAACGTTTAGTAGCTACGCCATGAGCTGGGTCCGCCAGGATCCAGGGAAGGGGCTGGAGTGGGTCTCAGCTATTAGTGGTAGTGGTGGTAACACATTCTACGGAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAAATTTTCGGTATAGTGGTGCCGGGTACTTTGACTACTGGGGCCAGGGAACCCTGGTCACCGTCTCCTCA<br>SEQ ID NO: 29565 |

FIGURE 50
(Continued)

| | | | |
|---|---|---|---|
| iPS:434291 | 21-225_58A4 | AA | EIVMTQSPATLSVSPGERATLSCRASQSVSSDLAWYQQKPGQAPRLLIYAASTRATGIPARFSGSGSGTEFTLTISSLQSEDFAVYYCQQYDNWPFTFGPGTKVDNK<br><br>SEQ ID NO: 25560 | EVQLLESGGGLVQPGGSLRLSCAASGLTFSSYAMSWVRQDPGKGLEWVSAISGSGGNTFYGDSVKGRFTISRDNSKKTLYLQMNSLRAEDTAVYYCAKFFGIVGAGYFDYWGQGTLVTVSS<br><br>SEQ ID NO: 29566 |
| | | NA | GAAATAGTGATGACGCAGTCTCCAGCCACCTGTCTGTGTCTCCAGGGGAAAGAGCCACCCTCCTGCAGGGCCAGTCAGAGTGTTAGCAGCGACTTAGCCTGGTACCAGCAGAGACCTGGCCAGGCTCCCAGGCTCCTCCATCTATGCTGCATCTACCAGGGCCACTGGTATCCCAGCCAGGTTCAGTGGCAGTGGGTCTGGGACAGAGTTCACTCTCACCATCAGCAGCCTGCAGTCTGAGGATTTTGCAGTTTATTACTGTCAGCAGTTTAATAACTGGCCATTCACTTTCGGCCCTGGGACCAAAGTGGATATCAAA<br><br>SEQ ID NO: 25561 | GAGGTGCAGCTGTTGGAGTCTGGGGGAGGCTTGGTACAGCCTGGGGGGTCCCTGAGACTCTCCTGTGCAGCCTCTGGATTAACGTTTAGTAGTACGCCATGAGCTGGGTCCGCCAGGATCCAGGGAAGGGGCTGGAGTGGGTCTCAGTATTAGTGGTAGTGGTAACACATTCTACGGAGACTCCGTGAAGGGCCGGTTCACCATCTCCAGAGACAACAATTCCAAGAAAACGCTGTATCTGCAAATGAACAGCCTGAGAGCCGAGGACACGGCCGTATATTACTGTGCGAAATTTTTCGGTATAGTGGAGCCGGGTTCTTTGACTCCTGGGCCAGGGAACCCTGGTCACCGTCTCCTCA<br><br>SEQ ID NO: 29567 |
| | | AA | EIVMTQSPATLSVSPGERATLSCRASQSVSSDLAWYQQRPGQAPRLLIYAASTRATGIPARFSGSGSGTEFTLTISSLQSEDFAVYYCQQFNNWPFTFGPGTKVDIK<br><br>SEQ ID NO: 25562 | EVQLLESGGGLVQPGGSLRLSCAASGLTFSSYAMSWVRQDPGKGLEWVSAISGSGGNTFYGDSVKGRFTISRDNSKKTLYLQMNSLRAEDTAVYYCAKFFGIVGAGFFDSWGQGTLVTVSS<br><br>SEQ ID NO: 29568 |

FIGURE 50
(Continued)

| | | | |
|---|---|---|---|
| iPS:434293 | 21-225_58F5 | NA | GACATCCAGATGACCCAGTCTCCATCCTCCCT GTCTGCATCTGTAGGGGACAGAGTCACCATCA CTTGCCGGGCAAGTCAGGGACAGAGTCACCATCA CTTGCCGGGCAAGTCAGGGCATTAGAAATGAT TTAGGCTGGTTTCTGCAGACACCAGGGAAAGC CCCTAAGCGCCTGATCTATGCTGCATCCAGTTT GCTAAGTGGGGTCCCATCACGGTTCGGCGGCA GTGGATCTGGGACAGAATTCACTCTCACAATC AGCAGCCTGCAGCCTGAAGATTTTGCAACTTA TTACTGTCTACAGCATAATAGTTACCCATTCAC TTTCGGCCCTGGGACCAAAGTGGAGATCAAA<br><br>SEQ ID NO: 25563 | CAGGTGCAGCTGGTGGTGGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGGTGGCAGTTATATGTATGCTGAAGT AATAAATACCATGTAGACTCCGTGAAGGGCCGA TTCCACCATCTCCAGAGACAATTCCAAGAACACGC TGTATCTGCAAATGAACAGCCTGAGAGCGAGG ACACGGCTGTGTATTACTGTGCGAGGGAACTGGG GATGAGGTCTGACTACTGGGGCCAGGGAACCCT GGTCACCGTCTCCTCA<br><br>SEQ ID NO: 29569 |
| | | AA | DIQMTQSPSSLSASVGDRVTITCRASQGIRNDLG WFLQTPGKAPKRLIYAASSLSGVPSRFGGSGSG TEFTLTISSLQPEDFATYYCLQHNSYPFTFGPGTK VEIK<br><br>SEQ ID NO: 25564 | QVQLVESGGGVVQPGRSLRLSCVASGFTFSDYGM HWVRQAPGKGLEWVAVIWYAGSNKYHVDSVKGR FTISRDNSKNTLYLQMNSLRAEDTAVYYCARELGM RSDYWGQGTLVTVSS<br><br>SEQ ID NO: 29570 |
| iPS:434295 | 21-225_58B9 | NA | GACATCGTGATGACCCAGTCTCCAGACTCCCT GGCTGTGTCTCTGGGCGAGAGGGCCACCATCA ACTGCAAGTCCGGCCAGAGTATTTTATACAGC TCCAACAATAACAACTACTTAGCTTGGTACCA GCAGAAACCAGGACAGCCTCCTAAGAAACTC ATTTACTGGGCATCTACCCGGGATTCCGGGGT CCCTGCCCGATTCAGTGGCAGCGGGTCTGGGA CAGATTTCACTCTCACCATCAGCAGCCTGCAG GCTGAAGATGTGGCAGTTTATTACTGTCAGCA ATATTATAGTACTCCTCCGACGTTCGGCCAAG GGTCCAAGGTGGAAATCAAA<br><br>SEQ ID NO: 25565 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACAGAAGTTCCAGGCA GTAGCACAGGCTATGCACCAGAACACCTCCATAAGCA GAGTCACCATGACCAGGGACACGTCCACAAGCAGCCTACATGAGCTGAGCAGCCTGAGATCTG AGGACACGGCCGTGTATTACTGTGCGTATAGCAG TGGCTGGTACTACTTTGACTACTACTGGGGCCAGGGA ACCCTGGTCACCGTCTCCTCA<br><br>SEQ ID NO: 29571 |

FIGURE 50
(Continued)

| | | | |
|---|---|---|---|
| | | AA | DIVMTQSPDSLAVSLGERATINCKSGQSILYSSN NNNYLAWYQQKPGQPPKKLIYWASTRDSGVPA RFSGSGSGTDFTLTISSLQAEDVAVYYCQQYYST PPTFGQGSKVEIK | QVQLVQSGAEVKKPGASVKVSCKASGYTFTNYDIN WVRQATGQGLEWMGWMNPNSGSTGYAQKFQGR VTMTRNTSISTAYMELSSLRSEDTAVYYCAYSSGW YYFDYWGQGTLVTSS |
| | | | SEQ ID NO: 25566 | SEQ ID NO: 29572 |
| iPS:434297 | 21-225_58A10 | NA | GAAATAGTGATGACGCAGTCTCCAGCCACCCT GTCTGTGTCTGCAGGGGAAAGAGCCACCCTCT CCTGCAGGGCCAGTCAGAGTGTTAGCAGCTCC TTAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATATATAACTGGCCATTC ACTTTCGGCCCTGGGACCAAAGTGGATATCAA A | GAGGTGCAGCTGTTGGAGTCTGGGGGAGGCTTG GTACAGCCTGGGGGGTCCCTGAGACTCTCCTGTG CAGCCTCTGGATTCACCTTTAGAAGTTATGCCAT GAGCTGGGTCCGCCAGGCTCCAGGGAAGGGGCT GGAGTGGGTCTCAGTTATTAGTGGTAGTGGTGGT AACACATTCTACGCAGACTCCGTGAAGGGCCGGT TCACCATCTCCAGAGACAATTCCAAGAACACGCT GTTTCTTCAAATGAACAGCCTGAGAGCCGAGGAC ACGGCCGTATATTACTGTGCGAAATTTTCGGTA TAGTGGGAGCGGGTACTTTGACTACTGGGGCCA GGGAACCCTGGTCACCGTCTCCTCA |
| | | | SEQ ID NO: 25567 | SEQ ID NO: 29573 |
| | | AA | EIVMTQSPATLSVCPGERATLSCRASQSVSSSLA WYQQKPGQAPRLLIYGASTRATGIPARFSGSGSG TEFTLTISSLQSEDFAVYYCQQYNNWPFTFGPGT KVDIK | EVQLLESGGGLVQPGGSLRLSCAASGFTFRSYAMS WVRQAPGKGLEWVSAISGSGGNTFYADSVKGRFTI SRDNSKNTLFLQMNSLRAEDTAVYYCAKFFGIVGA GYFDYWGQGTLVTVSS |
| | | | SEQ ID NO: 25568 | SEQ ID NO: 29574 |

FIGURE 50
(Continued)

| | | | | |
|---|---|---|---|---|
| iPS:434299 | 21-225_58D11 | NA | GACATCCAGATGACCCAGTCTCCATCCTCCCTGTCTGCATCTGTAGGAGACAGAGTCACCATCACTTGCCGGGCAAGTCAGGGCATTAGAAGTGATTTAGACTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTGCAACAGCAGCCTGCGCCTGAAGATTTTGCAACTTATTACTGTCTCCAGCATAATAATTTCCATTCACTTTCGGCCCTGGGACCAAAGGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGACATACACTGGGTCCGCCAGTCTCCAGGCAAGGGCTGGAGTGGGTGGCAGTTATATGGTATGATGGAAGTAAAAATATATTATGCAGACTCCGTGAAGGGCCGATTCACCATCTCCAGAGACAATTCCAAGAACACGTTGTATCTGCAAATGAACAGCCTGAGAGCCGAGGACACGGCTCTGTATTACTGTGCGAGAGATCGGGTCACTTTTGACTACTGGGGCCAGGGAACCCTGGTCACCGTCTCCTCA |
| | | | SEQ ID NO: 25569 | SEQ ID NO: 29575 |
| | | AA | DIQMTQSPSSLSASVGDRVTITCRASQGIRSDLDWYQQKPGKAPKRLIYAASSLQSGVPSRFSGSGSGTEFTLAISSLRPEDFATYYCLQHNNFPFTFGPGTKVDIK | QVQLVESGGGVVQPGRSLRLSCAASGFTFSDYDIHWVRQSPGKGLEWVAVIWYDGSKKYYADSVKGRFTISRDNSKNTLYLQMNSLRAEDTALYYCARDRVTFDYWGQGTLVTVSS |
| | | | SEQ ID NO: 25570 | SEQ ID NO: 29576 |
| iPS:434301 | 21-225_58F11 | NA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCGACTTAGTCTGGTACCAGCAGAAACCTGGCCAGGCTCCCAGGCTCCTCATCTATGGTGTATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTATTACTGTCAGCAGTATAATAACTGGCCATCACTTTCGGCCCTGGGACCAAAGTGGATATCAAA | GAGGTGCAGTTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGCTATTAGTAGTAGTGGTAGTACCATATACTACGCAGATACAATTCCAAGAGAGCCTGACCATCTCCAGAGACAATGCCAAGAACTCTTTGTATCTGCAAATGAACAGCCTGAGAGCCGAGGACACGGCCGTATATTACTGTGCGAAATTTTTCGGTATGGTGGAGCGGGATTCTTTGACTACTGGGGCCAGGGAACCCTGGTCACCGTCTCCTCA |
| | | | SEQ ID NO: 25571 | SEQ ID NO: 29577 |

FIGURE 50
(Continued)

| | | | |
|---|---|---|---|
| iPS:434303 | 21-225_58H11 | AA | EIVMTQSPATLSVSPGERATLSCRASQSVSSDLV WYQQKPGQAPRLLIYGVSTRATGIPARFSGSGSG TEFTLTISSLQSEDFAVYYCQQYNNWPFTFGPGT KVDIK<br>SEQ ID NO: 25572 | EVQLLESGGGLVQPGGSLRLSCAASGFTFSSYAMS WVRQAPGKGLEWVSAISGSGGNTFYADSVKGRFTI SRYNSKNTLYLQMNSLRAEDTAVYYCAKFFGMVG AGFFDYWGQGTLVTVSS<br>SEQ ID NO: 29578 |
| | | NA | GATATTGTGATGACCCAGACTCCACTCTCTCT GTCCGTCACCCCTGGACAGCCGGCCTCCATCT CCTGCAAGTCTAGTGAGAGCCTCCTGCATAGT GAGGGAAAGACCTATTTGTATTGGTACGTGCA GAAGCCAGGCCAGCCTCCACAACTCCTGATCT ATGAAAGTTTCCTATCGGTTTCTGGAGTGCCA GATAGGTTCAGTGGCAGCGGGTCAGGACAG ATTTCACACTGAAAATCAGCCGGGTGGAGGCT GAGGATGTTGGGGTTTATTACTGCATGCAAAG TATACAGCTTCCGCTCACTTTCGGCGGAGGGA CCAAGGTGGAGATCAAA<br>SEQ ID NO: 25573 | CAGGTGCAGCTGTTGGAGTCTGGGGGAGGCGTG GTCCAGCCTGGGAGGTCCCTGAGACTCTCCTGTG CAGCGTCTGGATTCACCTTCAGTAGTTATGCCAT GCACTGGGTCCGCCAGGCTCCAGGCAAGGGGCT GGAGTGGGTGGCAGTTATATGGTATGATGGAAGT AATAAATACCATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGCGGTATAG CAGCAGCTGGGACGGGGTATGGACGTCTGGGG CCAAGGGACCACGGTCACCGTCTCCTCA<br>SEQ ID NO: 29579 |
| | | AA | DIVMTQTPLSLSVTPGQPASISCKSSQSLLHSEGK TYLYWYVQKPGQPPQLLIYEVSYRFSGVPDRFS GSGSGTDFTLKISRVEAEDVGVYYCMQSIQLPLT FGGGTKVEIK<br>SEQ ID NO: 25574 | QVQLVESGGGVVQPGRSLRLSCAASGFTFSSYGMH WVRQAPGKGLEWVAVIWYDGSNKYHADSVKGRF TISRDNSKNTLYLQMNSLRAEDTAVYYCARRYSSS WDGGMDVWGQGTTVTVSS<br>SEQ ID NO: 29580 |

FIGURE 50
(Continued)

| | | | |
|---|---|---|---|
| iPS:434305 | 21-225_59E1 | NA | GACATGTGATGACCCAGTCTCCAGACTCCCT GGCTGTGTCTCTGGGCGAGAGGGCCACCATCA ACTGCAAGTCCAGCCAGAGTGTTTATACAGC TCCAACAATAACAACTACTAGCTTGGTACCA GCAGAGACCAGGACAGCCTCCTAAGTTGCTCA TTTACTGGTCATCTACCCGGGAATCCGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTTTAGTATTCCGTGCAGTTTTGGCCAGGGG ACCAAGCTGGAGATCAAA SEQ ID NO: 25575 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGACTCCTAACAGTGG TAACACAGGCTATGCACAGAAGTTCCAGGGCAG AGTCACCATGACCAGGACCACCTCCATAAGCAC AGCCTACATGGAGCTGAGCAGCCTGAGATCTGA GGACACGGCCGTGTATTACTGTGCGTTTAGCAGT GGCTGGTACTTCTTTGACTACTGGGGCCAGGGAA CCCTGGTCACCGTCTCCTCA SEQ ID NO: 29581 |
| | | AA | DIVMTQSPDSLAVSLGERATINCKSSQSVLYSSN NNNYLAWYQQRPGQPPKLLIYWSSTRESGVPDR FSGSGSGTDFTLTISSLQAEDVAVYYCQQYFSIPC SFGQGTKLEIK SEQ ID NO: 25576 | QVQLVQSGAEVKKPGASVKVSCKASGYTFTNYDIN WVRQATGQGLEWMGWMTPNSGNTGYAQKFQGR VTMTRTTSISTAYMELSSLRSEDTAVYYCAFSSGW YFFDYWGQGTLVTVSS SEQ ID NO: 29582 |
| iPS:434307 | 21-225_59B2 | NA | GAAATTGTGTTGACGCAGTCTCCAGGCACCCT GTCTTTGTCTCCAGGGGAAAGAGCCACCCTCT CCTGCTGGGCCAGTCAGAGTGTTACAGCAGC TTCTTAGCCTGGTTCCAGCAGAAATCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTACTGTCAGCAATATGGTACCTCACCGT GGACGTTCGGCCAAGGGACCAAGGTGGAAAT CAAA SEQ ID NO: 25577 | CAGGTGCAGTTGGTGCAGTCTGGGGCTGAGGTGA AGAAGCCTGGGGCCTCAGTGAAGGTCTCCTGCA AGGCTTCTGGATACACCTTCGCCGGCTACTATAT ACACTGGGTGCGACAGGCCCCTGGACAAGGACT TGAGTGGTTGGGTTGGATCAACCCTAACAGTGGT GGCACAAACTATGCACAGGACACGTTCAGGCAGG GTCACCATGACCAGGACACGTCCATCAGCACA GCCTACATGGAGCTGAGCAGGCTGAGATTTGAC GACACGGCCGTGTATTACTGGGGCCAGGGAACCCTGGT CACCGTCTCCTCA SEQ ID NO: 29583 |

FIGURE 50
(Continued)

| | | | |
|---|---|---|---|
| iPS:434309 | 21-225_59B5 | AA | EIVLTQSPGTLSLSPGERATLSCWASQSVYSSFLAWFQQKSGQAPRLLIYGASSRATGIPDRFSGSGSGTDFTLTISRLEPEDFAVFYCQQYGTSPWTFGQGTKVEIK<br>SEQ ID NO: 25578 | QVQLVQSGAEVKKPGASVKVSCKASGYTFAGYYIHWVRQAPGQGLEWLGWINPNSGGTNYAQKFQGRVTMTRDTSISTAYMELSRLRFDDTAVYYCARDPGPFDYWGQGTLVTVSS<br>SEQ ID NO: 29584 |
| | | NA | GACATCCAGATGACCCAGTCTCCATCCTCCCTGTCTGCATCTGTAGGAGACAGAGTCACCATCACTTGCCGGGCAAGTCAGAGCATTATCAGCTATTTAAATTGGTATCAGCAGAAACCAGGGAAAGCCCCTAAACTCCTGATCTATGGTGCATCCAGTTTGCAGAGTGGGGTCCCATCAAGGTTCAGTGGCAGTGGATCCGGGACAGATTTCACTCTCACCATCAGCAGTCTGCAACCTGAAGATTTTGCAACTTACTACTGTCAACAGAGTTACAGTACCCCTATGTTCAGTTTTGGCCAGGGGACCAAGCTGGAGATCAAA<br>SEQ ID NO: 25579 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAACTGGGTCCGCCAGGCTCCAGGGAAGGGGCTGGAGTGGGTCTCAGTTATTAGTGGTAGTGGTAACACATTCTACGCAGACTCCGTGAAGGGCCGGTTCACCATTTCCAGAGACAATTCCAAGAACACGCTGTATCTGCAAATGAACAGCCTGAGAGCCGAGGACACGGCCGTATATTACTGTGCGAAAAGGGGGGTCTACGGTGACTACGAGGCTTTTGATATCTGGGGCCAAGGGACAATGGTCACCGTCTCTTCA<br>SEQ ID NO: 29585 |
| | | AA | DIQMTQSPSSLSASVGDRVTITCRASQSIISYLNWYQQKPGKAPKLLIYGASSLQSGVPSRFSGSGSGTDFTLTISSLQPEDFATYYCQQSYSTPMFSFGQGTKLEIK<br>SEQ ID NO: 25580 | EVQLLESGGGLVQPGGSLRLSCAASGFTFSSYAMNWVRQAPGKGLEWVSAISGSGGNTFYADSVKGRFTISRDNSKNTLYLQMNSLRAEDTAVYYCAKRGVYGDYEAFDIWGQGTMVTVSS<br>SEQ ID NO: 29586 |

FIGURE 50
(Continued)

| | | | | |
|---|---|---|---|---|
| iPS:434311 | 21-225_59H5 | NA | GAAATTGTGTTGACGCAGTCTCCAGGCACCCT GTCTTTGTCTCTGCAGGGGAAAGAGCCACCCTCT CCTGCAGGGCCAGTCAGAGTGTTAGCAGCATC TACTTAGCCTGGTTCCTGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGATTCACTCTGAC CATCAGCAGACTGGAGCCTGAAGATTTTGCAG TGTATTACTGTCACCAGTATGGTAACTCACCA TTCACTTTCGGCCCTGGGACCAAAGTGATT CAAA | CAGGTACAACTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGG GTATAGCAGTGGGTACTACGGTATGGACGTCTG GGGCCAAGGGACCACGGTCACCGTCTCCTCA |
| | | | SEQ ID NO: 25581 | SEQ ID NO: 29587 |
| | | AA | EIVLTQSPGTLSLSPGERATLSCRASQSVSSIYLA WFLQKPGQAPRLLIYGASSRATGIPDRFSGSGSG TDFTLTISRLEPEDFAVYYCHQYGNSPFTFGPGT KVDFK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARERGIA VGYYGMDVWGQGTTVTVSS |
| | | | SEQ ID NO: 25582 | SEQ ID NO: 29588 |
| iPS:434313 | 21-225_59E6 | NA | GACATCCAGATGACCCAGTCTCCATCCTCCCT GTCTGCATCTGTAGGAGACAGAGTCACCATCA CTTGCCGGGCAAGTCAGAGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGTAGAAGTAGTTA CTACTGGGGCTGGATCCGCCAGCCCCCAGGGAA GGGGCTGGAGTGGATTGGAAATATCTATTATAGT GGGAGCACCTACTACAACCCGTCCCTCAAGAGTC GAGTCACCATATCCGTAGACACGTCCAAGAACC AGTTCTCCCTGAAGCTGAGCTCTGTGACCGCCGC AGACACGGCTCTGTATTACTGTGCGAGACATAGC AGCAGCTGGTCCCTTGACTACTGGGGCCAGGGA ACCCTGGTCACCGTCTCCTCA |
| | | | SEQ ID NO: 25583 | SEQ ID NO: 29589 |

FIGURE 50
(Continued)

| | | | |
|---|---|---|---|
| iPS:434315 | 21-225_59G7 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTRVEIK | QLQLQESGPGLVKPSETLSLTCTVSGGSISRSSYYWGWIRQPPGKGLEWIGNIYSGSTYYNPSLKSRVTISVDTSKNQFSLKLSSVTAADTALYYCARHSSSWSLDYWGQGTLVTVSS |
| | | | SEQ ID NO: 25584 | SEQ ID NO: 29590 |
| | | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATTCTGCATCCAGTTTACAAAGTGGGGTCCCATCAAGGTTCAGCGGCAGTGGATCTGGGACAGACTTCACTCTCACAATCAGCAGCCTGCAGCCTGAAGATATAGTTACCCGTGGACGTTCGGCCAAGGGACCAAGGTGGAAATCAAA | CAGGTGCAACTAGTGCAGTCTGGGGCTGAGGTGAAGAAGCCTGGGGCCTCAGTGAAGGTCTCCTGCAAGGCTTCTGGATACAGTTTCACCGGCCACTATATACACTGGGTGCGACAGGCCCCTGGACAAGGCTTGAGTACATGGGATGGATCAACCGAACAGTGGTGGCACAAACTATGTACAGAGAATTTCAGGGCAGGTCACCATGACCAGGGACACGTCCATCAGCACAGCCTACATGGAGCTGAGCAGGCTGAGATCTGACGACACGGCCATATATTACTGTTCGAGAGGGGCCTACTGGGAGCTACCAACTACTACTACGGTATGGACGTCTGGGGCCAAGGGACCACGGTCACCGTCACCTCA |
| | | | SEQ ID NO: 25585 | SEQ ID NO: 29591 |
| | | AA | DIQMTQSPSSLSASVGDRVTITCRASQGIRNDLGWYQQKPGKAPKRLIYSASSLQSGVPSRFSGSGSGTEFTLTISSLQPEDFATYYCLQHNSYPWTFGQGTKVEIK | QVQLVQSGAEVKKPGASVKVSCKASGYSFTGHYIHWVRQAPGQGLEYMGWINPNSGGTNYVQKFQGRVTMTRDTSISTAYMELSRLRSDDTAIYYCSRGGLLGATNYYYGMDVWGQGTTVTS |
| | | | SEQ ID NO: 25586 | SEQ ID NO: 29592 |

FIGURE 50
(Continued)

| | | | | |
|---|---|---|---|---|
| iPS:434317 | 21-225_59E8 | NA | GACATCCAGATGACCCAGTCTCCATCTCCCT GTCTGCATCTGTAGGAGACAGAGTCACCATCA CTTGCCGGGCAAGTCAGAGACATTAGCAGCTAT TTAAATTGGTATCAGCAGAAACCAGGGAAAG CCCCTAAGCTCCTGATCTATGCTGCATCCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTTCAGTAATTCGATC ACCTTCGGCCAAGGGACACGACTGGAGATTAA A | GAGGTGCAGCTGGTGGAGTCTGGGGGAGGCTTG GTACAGCCTGGGGGGTCCCTGAGACTCTCCTGTG CAGCCCTCTGATTCACTTCAGTAGTAGCTATAGCAT GAATTGGGTCCGCCAGGTCCAGGGAAGGGGCT GGGGTGGGTGTCATACATTAGTAGTAGTGGG ACCATATACTACGCAGACTCTGTGAAGGGCCGAT TCACCATCTCCAGAGACAACATGCCAAGAACTACT GTATCTGCAAATGAACAGCCTGAGAGACGAGGA CACGGCTGTGTATTACTGTGCGAGAGAATGGGGA ATGGCAGTGCTGGCCCGTTTGACTACTGGGGCC AGGGAACCCTGGTCACCGTCTCCTCA |
| | | | SEQ ID NO: 25587 | SEQ ID NO: 29593 |
| | | AA | DIQMTQSPSSLSASVGDRVTITCRASQSISSYLNW YQQKPGKAPKLLIYAASSLQSGVPSRFSGSGSGT DFTLTISSLQPEDFATYFCQQSFSNSITFGQGTRL EIK | EVQLVESGGGLVQPGGSLRLSCAASGFTFSSYSMN WVRQAPGKGLGWVSYISSSSGTIYYADSVKGRFTIS RDNAKNSLYLQMNSLRDEDTAVYYCAREWGMAV AGPFDYWGQGTLVTVSS |
| | | | SEQ ID NO: 25588 | SEQ ID NO: 29594 |
| iPS:434319 | 21-225_59B9 | NA | GACATCCAGATGACCCAGTCTCCATCTCCCT GTCTGCATCTGTAGGAGACAGAGTCACCATCA CTTGCCGGGCAAGTCAGGACATTAGAAATGAT TTAGGCTGGTATCAGCAGCACCCAGGGAAAGC CCCTAAGCGCCTGATCTATGCTGCATCCAGTTT ACAAAGTGGGGTCCCATCAAGGTTCAGCGGCA CTAGATCTGGGACAGAATTCACTCTCACAATC AGCAGCCTGCAGCCTGAAGATTTTGCAACTTA TTACTGTCTACAGCATATAGTTACCCGTGGA CGTTCGGCCAAGGGACCAAGGTGGAAATCAA A | CAGGTGCAGCTGCAGGTGCAGTCTGGGGCTGAGGTG AAGAAGCCTGGGGCCTCAGTGAAGGTCTCCTGC AAGGCTTCTGGATACATCTTCACCGGCAATTATA TACACTGGGTGCGACAGGCCCCTGGACAAGGGC TTGAGTACATGGGATGGATCAACCCTAACAGTGG TGGCACAAACTATGTACAGGAAGTTTCAGGCAG GGTCACCATGACCAGGGACACGTCCATCAGCAC AGCCAACATGGAACTGACCAGTCTGAGATCTGA CGACACGGCCGTGTATTACTGTGCGAGAGGGGGC CTACTGGGAGCTACTACTACTACTACTACGGTA TGGACGTCTGGGGCCAAGGGACCACGGTCACCG TCTCCTCA |
| | | | SEQ ID NO: 25589 | SEQ ID NO: 29595 |

FIGURE 50
(Continued)

| | | | |
|---|---|---|---|
| iPS:434321 | | AA | DIQMTQSPSSLSASVGDRVTITCRASQDIRNDLG WYQQHPGKAPKRLIYAASSLQSGVPSRFSGTRS GTEFTLTISSLQPEDFATYYCLQHNSYPWTFGQG TKVEIK | QVQLVQSGPEVKKPGASVKVSCKASGYIFTGNYIH WVRQAPGQGLEYMGWINPNSGGTNYVQKFQGRV TMTRDTSISTANMELTSLRSDDTAVYYCSRGGLLG ATYYYYGMDVWGQGTTVTSS |
| | | | SEQ ID NO: 25590 | SEQ ID NO: 29596 |
| | 21-225_59F10 | NA | GACATCGTGATGACCCAGTTTCCAGACTCCCT GGCTGTGTCTCTGGGCGAGAGGGCCACCATCA ACTGCAAGTCCAGCCAGACTGTTTATACAGG TCCAACAATTACAACTACTTAGCTTGGTACCA GCAGAAACCAGGACAGCCTCCTAAGCTGCTCA TTTACTGGGCATCTACCCGGGAATCCGGGTC CCTGACCGATTCAGTGGCAGTGGGTCTGGGAC AGATTTCACTCTCACCATCAGCAGCCTGCAGG CTGAAGATGTGGCAGTTTATTACTGTCAGCAA TATTTTAGTACTCCTCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCTGC AAGGCTTCTGGATACACCTTCACAAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATAACTGTGCGGTTAGCA GTGGCTGGTACTACTTTGACTACTGGGGCCAGGG AACCCTGGTCACCGTCTCCTCA |
| | | | SEQ ID NO: 25591 | SEQ ID NO: 29597 |
| | | AA | DIVMTQFPDSLAVSLGERATINCKSSQTVLYRSN NYNYLAWYQQKPGQPPKLLIYWASTRESGVPD RFSGSGSGTDFTLTISSLQAEDVAVYYCQQYFST PPTFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYNCAVSSGW YYFDYWGQGTLVTVSS |
| | | | SEQ ID NO: 25592 | SEQ ID NO: 29598 |

FIGURE 50
(Continued)

| | | | |
|---|---|---|---|
| iPS:434323 | 21-225_62H8 | NA | GACATCCAGATGACCCAGTCTCCATCCTCCCTGTCTGCATCTGTAGGAGACAGAGTCACCATCACTTGCCGGGCAAGTCAGAGACAGATTTCAGCTATTTAAATTGGTATCAGCAGAAATCCGGGAAAGCCCCTAAGCTCCTGATCTATGCGCATCCAGTTTGCAAAGTGGGGTCCCATCAAGGTTAAGTGGCAATGGATCTGGGACAGATTTCATTCTCACCATCAGCAGTCTGCAACCTGAAGATTTTGCAACTTACTACTGTCAACAGAGTTACAGTACCCCATTCACTTTCGGCCCTGGGACCAGAGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGCACTTATGGCATGCACTGGGTCCGCCAGGCTCCAGGCAAGGGCTGGAGTGGGTGGCAGTTATATGTAGACTCCGTGAAGGGCCGATGATAAATATTATGTAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAAGACCCGCGTACCAGCTGCTCTGACTACTGGGGCCAGGGAACCCTGGTCACCGTCTCCTCA |
| | | | SEQ ID NO: 25593 | SEQ ID NO: 29599 |
| | | AA | DIQMTQSPSSLSASVGDRVTITCRASQSIFSYLNWYQQNPGKAPKLLIYAASSLQSGVPSRLSGNGSGTDFILTISSLQPEDFATYYCQQSYSTPFTFGPGTRVDIK | QVQLVESGGGVVQPGRSLRLSCAASGFTFSTYGMHWVRQAPGKGLEWVAVIWHDGSDKYYVDSVKGRFTISRDNSKNTLYLQMNSLRAEDTAVYYCAREDPRTSCSDYWGQGTLVTVSS |
| | | | SEQ ID NO: 25594 | SEQ ID NO: 29600 |
| iPS:434327 | 21-225_63G6 | NA | GACATCCAGATGACCCAGTCTCCATCCTCCCTGTCTGCATCTGTAGGAGACAGAGTCACCATCACTTGCCGGGCAAGTCAGAGACAGATTTCAGCTATTTAAATTGGTATCAGCAGAAACCAGGGAAAGCCCCTAAGCTCCTGATCTATGATACATCCACTTTGCAAACTGGGGTCCCATCAAGGTTCAGTGGCAGTGGATCTGGGACAGATTTCACTCTCACCATCAACAGTCTGCAACAGAGTTACGTATCCCCATCACTTTCGGCCAAGGGACACGACTGGAGATTCAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCATGCACTGGGTCCGCCAGGCTCCAGGCAAGGGCTAGAATGGGTGACAGTTATATGTAGATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGCCTCTGGGTATAGCAGCAGTTTTGACTACTGGGGCCAGGGAACCCTGGTCACCGTCTCCTCA |
| | | | SEQ ID NO: 25595 | SEQ ID NO: 29601 |

FIGURE 50
(Continued)

| | | | |
|---|---|---|---|
| iPS:434331 | 21-225_63H8 | AA | DIQMTQSPSSLSASVGDRVIISCRASQSIFSYLNW YQVKPGKAPKLLIYDTSTLQTGVPSRFSGSGSGT DFTLTINSLQPEDFATYYCQQSYGIPITFGQGTRL EIQ<br>SEQ ID NO: 25596 | QVQLVESGGGVVQPGRSLRLSCAASGFTFSSYGMH WVRQAPGKGLEWVTVIWYDGSNKYYADSVKGRF TISRDNSKNTLYLQMNSLRAEDTAVYYCARDSLSG IAAAFDYWGQGTLVTVSS<br>SEQ ID NO: 29602 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGCTCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAATATCATAGTTACCCATTCA CTTTCGGCCCTGGGACCAAAGTGGATATCAGA<br>SEQ ID NO: 25597 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATAACAT GAACTGGGTCCGCCAGGCTCCAGGGAAGGGGCT GGAGTGGGTCTCATCCATTAGTGGTAGTAGCACT TACATGAACTACACAGACTCAGTGAAGGGCCGA TTCACCATCTCCAGAGACAACGCCAAGAACTCAC TGTATCTGCAAATGAACAGCTGAGAGCCGAGG ACACGGCTGTGTATTACTGTGCGAGACTACGTAA TTTTGACTACTGGGGCCAGGGAACCCTGGTCACC GTCTCCTCA<br>SEQ ID NO: 29603 |
| | | AA | DIQMTQSPSSLSASVGDRVTITCRASQGISNYLA WFQQKPGKAHKSLIYAASSLQSGVPSKFSGSGS GTDFTLTISSLQPEDFATYYCQQYHSYPFTFGPG TKVDIR<br>SEQ ID NO: 25598 | EVQLVESGGGLVKPGGSLRLSCAASGFTFSSYNMN WVRQAPGKGLEWVSSISGSSTYMNYTDSVKGRFTI SRDNAKNSLYLQMNSLRAEDTAVYYCARLRNFDY WGQGTLVTVSS<br>SEQ ID NO: 29604 |

FIGURE 50
(Continued)

| | | NA | GACATCCAGATGACCCAGTCTCCATCTTCCGT GTCTGCATCTGTGGAGACAGAGTCACCATCA CTTGTCGGGCGAGTCAGGTATTAGCAGCGG TTAGCCTGTGGTATCAGCAGAAACCAGGGAAAG CCCCTAAACCTCCTGATCTATGCTGCATCAGTT TGCAAAGTGGGGGTCCCATCAAGGTTCAGCGGC AGTGGATCGGGACAGATTTCACGTCACCAT CAGCGGCCTGCAGCCTGAAGATTTTGCAACTT ACTTTTGTCAACAGATTAACAGTTCCCTCTCA CTTTCGGCGGAGGGACCAAGGTGGAGATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAACTTGCACAGGACGCGTCCATCAACAC GGTCACCATGACCAGGGACACGTCCATCAACAC AGCCTACATGGAGCTGCGCAGCTGATATCTGAC GACACGGCCGTATATTACTGTGCGAGAGCTCCGG GTGTAGCAGCAGCTGGTTCATGGGGATACTTTGA CTACTGGGGCCAGGGAACCCTGGTCACCGTCTCC TCA |
| iPS:434333 | 21-225_63C9 | | | SEQ ID NO: 29605 |
| | | AA | DIQMTQSPSSVSASVGDRVTITCRASQGISSWLA WYQQKPGKAPNLLIYAASSLQSGVPSRFSGSGS GTDFTLTISGLQPEDFATYFCQQINSFPLTFGGGT KVAIK | QVQLVQSGAEVKKPGASVKVSCKASGYTFTGYYM HWVRQAPGQGLEWMGWINPNSGGTNFAQKFQGR VTMTRDASINTAYMELRSLISDDTAVYYCARAPGV AAAGSWGYFDYWGQGTLVTVSS |
| | | | SEQ ID NO: 25599 | SEQ ID NO: 29606 |
| iPS:434335 | 21-225_63C10 | NA | GACATCCAGATGACCCAGTCTCCGTCTCCCT GTCTACATCTGTAGGAGACAGAGTCACCATCA CTTGCCGGGCAAGTCAGAGCATTTTCAGCTAT TTACATTGGTATCAGCAGAAACCAGGGAAAGC CCCTAAGCTCCTGATCTCTGCTGCATCCAGTTT ACAAAGTGGGGTCCCATCAAGGTTCAGTGGCA GTGGATCTGGGACAGATTTCACTCTCACCATC AGTAGTCTGCAACAGACTTGAAGATTTTGCAACTTT CTACTGTCAACAGACTTACAGTCCCCCGCTCA CTTTCGGCGGAGGGACCAAGGTGGAGATCAA A | CAGGTGCAGCTGCAGCTGGAGTCTGGGGGAGGCGTG GTCCAGCCTGGGAGGTCCCTGAGACTCTCCTGTG CAGCGTCTGGATTCACCTTCAGTAGTAGTTGGCAT GCCTGGGTCCGCCAGGCTCCAGGCAAGGGGCT GGAGTGGGTGGCAGTCATATGGTATGATGGAAGT AATAAATACTATGCAGACTCCGTGAAGGGCCGA TTCACCATCTCCAAATGAACAGCCTGAGAGCGAGG TGTATCTGCAAATGAACAGCCTGAGAGCGAGG ACACGGCTGTGTATTACTGTGCGAGAGATCC CAGATCCTCCGGCGGGGACTACTGGGGCCAGGG AACCCTGGTCACCGTCTCCTCA |
| | | | SEQ ID NO: 25601 | SEQ ID NO: 29607 |

FIGURE 50
(Continued)

| | | AA | DIQMTQSPSSLSTSVGDRVTITCRASQSIFSYLHWYQQKPGKAPKLLISAASSLQSGVPSRFSGSGSGTDFTLTISSLQPEDFATFYCQQTYSPPLTFGGGTKVEIK<br>SEQ ID NO: 25602 | QVQLVESGGGVVQPGRSLRLSCAASGFTFSSYGMHWVRQAPGKGLDWVAVIWYDGSNKYYADSVKGRFTISRDNSKNTLYLQMNSLRAEDTAVYYCARDDPRSSAGDYWGQGTLVTVSS<br>SEQ ID NO: 29608 |
| iPS:434337 | 21-225_64E1 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGGCACCTAAGCGCCTGATCTATGCTGCATCCAGTTTGCAAAGTGGGGTCCCATCCACGGTTCAGCGGCAGTAAATCTGGGACAGAATTCACTCTCACAATCAGCAGCTTGCAGCCTGAAGATCTTGCAACTTATTACTGTCTACAGCATATAATAGTTACCCGCTCACTTTCGGCGGAGGGACCAAGGTGGAGATCAAA<br>SEQ ID NO: 25603 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAGCTTGGGTTCAGCAGTGACTATTGGGGCCAGGGAACCCTGGTCACCGTCTCCTCA<br>SEQ ID NO: 29609 |
| | | AA | DIQMTQSPSSLSASVGDRVTITCRASQGIRNDLGWYQQKPGKAPKRLIYAASSLQSGVPSRFSGSKSGTEFTLTISSLQPEDLATYYCLQHNSYPLTFGGGTKVEIK<br>SEQ ID NO: 25604 | QVQLVESGGGVVQPGRSLRLSCVASGFTFSSYGMHWVRQAPGKGLEWVAVIWFDETNKYYGDSVKGRFTISRDNSKNTLYLQMNSLRAEDTAVYYCARELGFSSDYWGQGTLVTVSS<br>SEQ ID NO: 29610 |

FIGURE 50
(Continued)

| | | | |
|---|---|---|---|
| iPS:434339 | 21-225_64A4 | NA | GACATCCAGATGACCCAGTCTCCATCCTCCCT GTCTGCATCTGTAGGAGACAGAGTCACCATCA CTTGCCGGGCAAGTCAGGGACAGTCAGGAAATGAT TTAGGCTGGTATCAGCAGAAACCAGGGAAAG CCCCTAAACGCCTGATCTATGCTGCATCCAGT TTGCAAAGTGGGGTCCCATCAAGGTTCAGCGG CAGTGGATCTGGGACAGATTCACTCTCACAA TCAGCAGCCTACAGCCTGAAGATCTATTACCCTGG TATTACTGTCTACAGCATTATAGTTACCCTCGG ACGTTCGGCCAAGGGACCAAGGTGGAAATCA AA |
| | | | SEQ ID NO: 25605 |
| | | AA | DIQMTQSPSSLSASVGDRVTITCRASQGIRNDLG WYQQKPGKAPKRLIYAASSLQSGVPSRFSGSGS GTEFTLTISSLQPEDLATYYCLQHYSYPRTFGQG TKVEIK |
| | | | SEQ ID NO: 25606 |
| iPS:434341 | 21-225_64F7 | NA | GACATCCAGATGACCCAGTCTCCATCCTCCCT GTCTGCATCTGTAGGAGACAGAGTCACCATCA CTTGCCGGGCAAGTCAGAGCATTAAGCAATAT TTAAATTGGTATCAGCAGAAACCAGGGAAAG CCCCTAAGTTCCTGATCTATGTGCATCCAGTT TGCAAAGTGGGGTCCATCAAGGTTCAGTGGC AGTGGATCTGGGACAGATTTCACTCTCACCAT CAGTAGCCTGCAACCTGAAGATTTTGCAGTT ACTACTGTCAACAGAGTTACAATATTCGTTC ACTTTCGGCGGAGGGACCAAGGTGGAGCTCA AA |
| | | | SEQ ID NO: 25607 |

| | |
|---|---|
| CAGGTGCAGCTGGTGGAGTCTGGGGGAGGCGTG GTCCAGCCTGGGAGGTCCCTGAGACTCTCCTGTG CAGCGGTCTGGATTCACCTTCAGCGATTATGTCAT GCACTGGGTCCGCCAGGCTCCAGGCAAGGGCT GGAGTGGGTGGCAGTCATATGGTATGATGGAAG TAATAAATACTATGCAGACTCCGTGAAGGGCCG ATTCACCATCTCCAGAGACAATTCCAGAACACG CTGTATCTGCAAATGAATAGCCTGAGAGCCGAG GACACGGCTGTGTATTACTGTGCGAGAGAAGGT ATAGCAGCAGCTGGTACGACTACGGTATGGACG TCTGGGGCCAAGGGACCACGGTCACCGTCTCCTC A | |
| SEQ ID NO: 29611 | |
| QVQLVESGGGVVQPGRSLRLSCAASGFTFSDYVM HWVRQAPGKGLEWVAVIWYDGSNKYYADSVKGR FTISRDNSQNTLYLQMNSLRAEDTAVYYCARERYS SSWYDYGMDVWGQGTTVTVSS | |
| SEQ ID NO: 29612 | |
| CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTTCTGG AGCTGGATCCGGCAGCCCGCCGGGAAGGGACTG GAGTGGATTGGGCGTATCTATACCAGTGGGATCT CCAACTACAATCCCTCCCTCAAGAGTCGAGTCAC CATGTCAGTTGACACGTCCAAGAACCAGTTCTCC CTGAAGCTGAGCTCTGTGACCGCGGCGGACACG GCCGTGTATTACTGTGCGAGGTTTAGCAGTGGCT TTTTGACTACTGGGGCCAGGGTACCCTGGTCAC CGTCTCCTCA | |
| SEQ ID NO: 29613 | |

FIGURE 50
(Continued)

| | | | |
|---|---|---|---|
| iPS:434343 | 21-225_64C8 | AA | DIQMTQSPSSLSASVGDRVTITCRASQNIKKYLN WYQQKPGKAPKFLIYGASSLQSGVPSRFSGSGSG TDFTLTISSLQPEDFAAYYCQQSYNISFTFGGGTK VELK<br>SEQ ID NO: 25608 | QVQLQESGPGLVKPSETLSLTCTVSGGSISSYFWSW IRQPAGKGLEWIGRIYTSGISNYNPSLKSRVTMSVD TSKNQFSLKLSSVTAADTAVYYCARFSSGFFDYWG QGTLVTVSS<br>SEQ ID NO: 29614 |
| | | NA | GACATCCAGATGACCCAGTCTCCATCCTCCCT GTCTGCAGCTGTGTAGGAGACAGAGTCACCATCA CTTGCCGGGCAAGTCAGGGCATTAGAAATGAT TTAGGCTGGTATCAGCAGAAACCAGGGAAAG CCCCTAAGTGCCTGATCTATGCTGCATCCAGTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTATTGTCTACACACCATTATAGTTACCCTCGGA CGTTCGGCCAAGGGACCAAGGTGGAAATCAA A<br>SEQ ID NO: 25609 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGCAGTATGATGAAGT AATAAATACTATGCAGATCCATGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACGGTA TAGCAGTGGCTGGTACGACTACGGTATGGACGTC TGGGGCCAAGGGACCACGGTCACCGTCTCCTCA<br>SEQ ID NO: 29615 |
| | | AA | DIQMTQSPSSLSAAVGDRVTITCRASQGIRNDLG WYQQKPGKAPKCLIYAASSLQSGVPSRFSGSGS GTEFTLTISSLQPEDFATYYCLHHYSYPRTFGQG TKVEIK<br>SEQ ID NO: 25610 | QVQLVESGGGVVQPGRSLRLSCAASGFTFSDYM HWVRQAPGKGLEWVAVIWYDGSNKYYADSMKG RFTISRDNSKNTLYLQMNSLRAEDTAVYYCARERY SSGWYDYGMDVWGQGTTVTVSS<br>SEQ ID NO: 29616 |

FIGURE 50
(Continued)

| | | | | |
|---|---|---|---|---|
| iPS:434345 | 21-225_64H9 | NA | GAAATTGTGATGACCCAGACTCCACTCTCT GTCCGTCACCCCTGGACAGCCGGCCTCCATCT CCTGCAAGTCTAGTCAGAGCCTCCTTCATGGT GATGGAAAAGACCTATTTGTTTGGTACCTGCA GAAGCCAGGCCAGCCTCCACAGGTCCTGATCT ATGAAGTTTCCAACCGGTTGTGTGGAGTGCCA GACAGGTTCAGTGGCAGCGGGTCAGGACAG ATTTCTCATTGAAAATCAGCCGGGTGGAGGCT GAGGACGTTGGGGTTTATTACTGCATGCAAAG TATACAGGTTCCGTGGACGTTCGGCCAAGGGA CCAAGGTGGAAATCACA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTACTATGGCAT GCACTGGGTCCGCCAGGCTCCAGGCAAGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TATATCTACAAATGAACAGCCTGAGAGCCGAGG ACACGGCTGTGTATTACTGTGCGAGAGATACATA CGATTTTGGAGTGGTTATTGGTACTGGGGC CAGGGAACCCTGGTCACCGTCTCCTCA |
| | | | SEQ ID NO: 25611 | SEQ ID NO: 29617 |
| | | AA | EIVMTQTPLSLSVTPGQPASISCKSSQSLLHGDGK TYLFWYLQKPGQPPQVLIYEVSNRLCGVPDRFS GSGSGTDFSLKISRVEAEDVGVYYCMQSIQVPW TFGQGTKVEIT | QVQLVESGGGVVQPGRSLRLSCAASGFTFSTYGMH WVRQAPGKGLEWVAIIWYDGSNKYYADSVKGRFT ISRDNSKNTLYLQMNSLRAEDTAVYYCARDTYDF WSGYLGYWGQGTLVTVSS |
| | | | SEQ ID NO: 25612 | SEQ ID NO: 29618 |
| iPS:434347 | 21-225_64H10 | NA | GACATCCAGATGACCCAGTCTCCATCTTCCGT GTCTGCATCTGTAGGAGACAGAGTCACCATCA CTTGTCGGGCGAGTCAGGTATTAGCAGCTGG TTAGCCTGGTATCAGCAGAAACCAGGGAAAG CCCTTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGATTAACAGTTTCCCTCTCA CTTTCGGCGGAGGGACCAAGGTGGAGATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAACCCTAACAGTG GTGGCACAAACCAAGCAGAAGTTTCAGGGCA GGGTCACCATGACCAGGGACACGTCCATCAGCA CAGCCTACATGGAGCTGAGCGGGCTGAGATCTG ACGACACGGCCGTGTATTACTGTGCGAGAGCTCC GGGTACTGCAGCAACTGGTACATGGGATACTTT GACTACTGGGGCCAGGGAACCCTGGTCACCGTCT CCTCA |
| | | | SEQ ID NO: 25613 | SEQ ID NO: 29619 |

FIGURE 50
(Continued)

| | | | | |
|---|---|---|---|---|
| iPS:434351 | 21-225_64A12 | AA | DIQMTQSPSSVSVSASVGDRVTITCRASQGISSWLA WYQQKPGKALKLLIYAASSLQSGVPSRFSGSGS GTDFTLTISSLQPEDFATYYCQQINSFPLTFGGGT KVEIK<br>SEQ ID NO: 25614 | QVQLVQSGAEVKKPGASVKVSCKASGYTFTGYYM HWVRQAPGQGLEWMGWIKPNSGGTNQAQKFQGR VTMTRDTSISTAYMELSGLRSDDTAVYYCARAPGT AATGTWGYFDYWGQGTLVTVSS<br>SEQ ID NO: 29620 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTACACGCCTGATCTATGCATCCACTT TGCAAAGTGGGGTCCCATCAAGGTTCAGCGGC AGTGGATCTGGGACAGATTCACTCTCACAAT CAGCAGCCTGCAGCCTGAAGATTTTGCAACTT ATTACTGTCTACAGCATATAATGGTTACCCATTC ACTTTCGGCGGCCCTGGGACCAAAGTGGATATCAA A<br>SEQ ID NO: 25615 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGATCCGTGAAGGCCGAT AATAAATACTATGTAGACTCCGTGAAGGGCCGAT TCACCATCTCAGAGACAATTCCAAGAACACGCT GTATCTGCAAATGAACAGCTGAGAGCCGAGGA CACGGCTGTGTATTACTGTGCGAGGGAACTCGGG TTCCTCTCTGACCACTGGGGCCAGGGAACCCTGG TCACCGTCTCCTCA<br>SEQ ID NO: 29621 |
| | | AA | DIQMTQSPSSLSASVGDRVTITCRASQGIRNDLG WYQQKPGKAPTRLIYTASTLQSGVPSRFSGSGSG TEFTLTISSLQPEDFATYYCLQHNGYPFTFGPGTK VDIK<br>SEQ ID NO: 25616 | QVQLVESGGGVVQPGRSLRLSCAASGFTFSSYGMH WVRQAPGKGLEWVAVIWYDESNKYYVDSVKGRF TISRDNSKNTLYLQMNSLRAEDTAVYYCARELGFL SDHWGQGTLVTVSS<br>SEQ ID NO: 29622 |

FIGURE 50
(Continued)

| | | | |
|---|---|---|---|
| iPS:434353 | 21-225_64B12 | NA | GACATCCAGATGACCCAGTCTCCATCCTCCT GTCTGCATCTGTAGGAGACAGAGTCACCATCA CTTGCCGGGCGAGTCAGGACATTAGCAATTAT TTAAATTGGTATCAGCAGAAACCAGGGACAGC CCCTAACCTCCTGATCTCTGATGCATCCATTTT GGAAACAGGGGTCCCATCAACGTTCAGTGGA AGTGGATCTGGGACAGATTTTACTTTCACCAT CAGCAGCCTGCAGCCTGAAGATGATAATCTCCCGTGC AGTTTTGGCCAGGGACCAAGGTGGAGATCA AA<br><br>SEQ ID NO: 25617 | CAGCTGCAGCTGCAGGAGTGGGCCCAGGACTG GTGAAGCCTTCGGAGACCCTGTCCCTCACCTGCA CTGTCTCTGGTGTCTCCATCAGCAGAAGTAGTTA CTACTGGGGCTGGATCCGCCAGCCCCCAGGGAA GGGGCTGGAGTGGATTGGGAGTATCTATTACAGT GGGAGCACCTCCTACAACCCGTCCCTCAAGAGTC GAGTCACCATATCGTAGAAGCTCTGTCTGTGACCGCGC AGACACGGCTGTGATTATTGTGCAGACTGGAC AGTGGCTGGTCCTTTGACTACTGGGGCCAGGGAA CCCTGGTCACCGTCTCCTCA<br><br>SEQ ID NO: 29623 | QLQLQESGPGLVKPSETLSLTCTVSGVSISRSSYYW GWIRQPPGKGLEWIGSIYYSGSTSYNPSLKSRVTISV DTSKNQFSLKLSSVTAADTAVYYCARLDSGWSFD YWGQGTLVTVSS<br><br>SEQ ID NO: 29624 |
| iPS:434355 | 21-225_64G12 | NA | GACATCCAGATGACCCAGTCTCCCTCTTCCGT GTCTGCATCTGTAGGAGACAGAGTCACCATCA CTTGTCGGGCGAGTCAGATATCAGCAGAAATATTACCACCTGG TTAGCCTGGTATCAGCAGAAACCAGGGAAAG CCCCTAAACTCCTGATCTCTGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ATATTTGTCAACAGGCTAACAGTTTTCCATTCA CTTTCGGCCCTGGGACCAAACTGGATATCAAA<br><br>SEQ ID NO: 25619 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTAATGCCAT GAGCTGGGTCCGCCAGGCTCCAGGGAAGGGCT GGAGTGGGTCTCAGTTATTAGTGGTAGTGGTGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCTTATATTACTGTGCGAAAAGGAACTA CGACGATGCTTTTGATATCTGGGGCCAAGGGACA ATGGTCACCGTCTCTTCA<br><br>SEQ ID NO: 29625 | |

FIGURE 50
(Continued)

| | | | | |
|---|---|---|---|---|
| iPS:434357 | | AA | DIQMTQSPSSVSASVGDRVTITCRASQNITTWLA WYQQKPGKAPKLLISAASSLQSGVPSRFSGSGSG TDFTLTISSLQPEDFATYICQQANSFPFTFGPGTK LDIK<br><br>SEQ ID NO: 25620 | EVQLLESGGGLVQPGGSLRLSCAASGFTFSSNAMS WVRQAPGKGLEWVSVISGSGSTYYADSVKGRFTI SRDNSKNTLYLQMNSLRAEDTALYYCAKRNYDDA FDIWGQGTMVTVSS<br><br>SEQ ID NO: 29626 |
| | | NA | GACATCCAGTTGACCCAGTCTCCATCTCCCT GTCTGCATCTGTAGGAGACAGAGTCACCATCA CTTGCCGGGCGAGTCAGGTCATTAGCAGTTAT TTACATTGGTATCAGCAGAAACCAGGGAAAGT TCCTAAGGTCCTGATCTATAGTGCATCCAATTT GCAATGTGGAGTCCCATCTCGGTTCAGCGGCA GTGGATCTGGGACAGATTTCACTCTCACCTTC AGCAGCCTGCAGCCTGAAGATGTTGCAACTTA TTACGGTCAACGGCCTTACAATGCCCCGCTCA CTTTCGGCGGAGGGACCAAGGTGGAGATCAA A<br><br>SEQ ID NO: 25621 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTTTGAGGGAAG TAATAAACACTATACAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAACTTG GGTTCAGCAGTGACTACTGGGGCCAGGGAACCC TGGTCACCGTCTCCTCA<br><br>SEQ ID NO: 29627 |
| | 21-225_65C1 | AA | DIQLTQSPSSLSASVGDRVTITCRASQVISSYLHW YQQKPGKAPKVLIYSASNLQCGVPSRFSGSGSGT DFTLTFSSLQPEDVATYYGQRPYNAPLTFGGGT KVEIK<br><br>SEQ ID NO: 25622 | QVQLVESGGGVVQPGRSLRLSCAASGFTFSDYGM HWVRQAPGKGLEWVAVIWFEGSNKHYTDSVKGR FTISRDNSKNTLYLQMNSLRAEDTAVYYCARELGF SSDYWGQGTLVTVSS<br><br>SEQ ID NO: 29628 |

FIGURE 50
(Continued)

| | | | | |
|---|---|---|---|---|
| iPS:434359 | 21-225_65G3 | NA | GACATCCAGATGACCCAGTCTCCATCCTCCGT GTCTGCATCTGTAGGAGACAGAGTCACCATCA CTTGTCGGGCGAGTCAGGGTATTAGCAGTGG TTAGCCTGGTATCAGCAGAAACCAGGGAAAG CCCCTAAGCTCTTGATCTATGCTGCATCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT TCTATTGTCAACAGGTTAACAGTTTCCCTCTCA CTTTCGGCGGAGGGACCAAGGTGGAGATCAA A | CAGGTGCAACTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTAACAGTGG TGGCACAAACTCTGCACAGGAGACACGTCAGGCAG GGTCACCATGACCAGGGACACGTCCATCAGCAC AGCCTACATGAGCTGAGCAGGCTGAGATCTGA CGACACGGCCGTATATTACTGTGCGAGAGCTCCG GGTAAAGCAGCAGCTGGTACATGGGATACTTTG ACTACTGGGGCCAGGGAACCCTGGTCACCGTCTC CTCA |
| | | | SEQ ID NO: 25623 | SEQ ID NO: 29629 |
| | | AA | DIQMTQSPSSVSASVGDRVTITCRASQGISSWLA WYQQKPGKAPKLLIYAASSLQSGVPSRFSGSGS GTDFTLTISSLQPEDFATFYCQQVNSFPLTFGGGT KVEIK | QVQLVQSGAEVKKPGASVKVSCKASGYTFTGYYIH WVRQAPGQGLEWMGWINPNSGGTNSAQKFQGRV TMTRDTSISTAYMELSRLRSDDTAVYYCARAPGKA AGTWGYFDYWGQGTLVTVSS |
| | | | SEQ ID NO: 25624 | SEQ ID NO: 29630 |
| iPS:434361 | 21-225_65D5 | NA | GACATCCAGATGACCCAGTCTCCGTCCTCACT ATCTGCATCTGTAGGAGACAGAGTCACCATCA CTTGTCGGGCGAGTCAGGACATTAACAATTAT TTAGCCTGGTTTCAGCAGAAACCAGGGAAAGC CCCTAAGGTCCTGATCTATGCTGCATCCAGTTT GCACAGTGGGGTCCCATCACAGTTCAGCGCCA GTGGTTCTGGGTCAGATTCACTCTTACTATCA GCAGCCTGCAGCCTGAAGATTTTGCAACTTAT TACTGCCCACTGTATAAAAGTTATCCACTCAC TTTTGGCCCTGGGACCAAAGTGGATATCAAA | CAGGTTCAGCTGGTGCAGTCTGGAGCTGAGGTGA AGAAGCCTGGGGCCTCAGTGAAGGTCTCCTGCA AGGCTTCTGGTTACACCTTTCCAGTCTATGGTAT CAGTTGGGTGCGACAGGCCCCTGGACAAGGACT TGAGTGGATGGGATGGATCAGCGCTTACAGTGGT AACACAAACTATGCACAGAAGAGTCCAGGGCAGA GTCACCATGACCACAGACACATCCAGGAGCACA GCCTACATGGAGCTGAGGAGCCTGAGATCTGAC GACACGGCCGTGTATTTCTGTGCGAGAGGGGAA GCAGTGGCTGTCTTTGACCCCTGGGGCCAGGGAA CCCTGGTCACCGTCTCCTCA |
| | | | SEQ ID NO: 25625 | SEQ ID NO: 29631 |

FIGURE 50
(Continued)

| | | | | |
|---|---|---|---|---|
| iPS:434363 | 21-225_65A6 | AA | DIQMTQSPSSLSASVGDRVTITCRASQDINNYLA WFQQKPGKAPRSLIYAASSLHSGVPSQFSASGSG SDFTLTISSLQPEDFATYYCPLYKSYPLTFGPGTK VDIK | QVQLVQSGAEVKKPGASVKVSCKASGYTFPSYGIS WVRQAPGQGLEWMGWISAYSGNTNYAQKLQGRV TMTDTSTSTAYMELRSLRSDDTAVYFCARGEAVA VFDPWGQGTLVTSS |
| | | | SEQ ID NO: 25626 | SEQ ID NO: 29632 |
| | | NA | GAAATAGTGATGACGCAGTCTCCAGTCACCCT GTTTGTGTCTCCAGGGGAAAGAGCCACCCTCT CCTGCAGGGCCAGTCAGAGTGTTAACAGCAAC TTAGCCTGGTACCAGCAGAAACCTGGCCAGGC TCCCAGGCTCCTCATCTATGGTGCATCCACCA GGGCCACTGGTATCCCAGCAGGTTCAATGGC AGTGGGTCTGGGACAGAGTTCACTCTCACCAT CAGCAGCCTGCAGTCTGAAGATTTTGCAGTT ATTATTGTCAGCAGTATAATGACTGGCCGTGC AGTTTTGGCCTGGAGACCAAGCTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGATGATGGAAGT AATAAATACTATGGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGG CATAGTGGAGCTACTTGGTTTGACTACTGGGGC CAGGGAACCCTGGTCACCGTCTCCTCA |
| | | | SEQ ID NO: 25627 | SEQ ID NO: 29633 |
| | | AA | EIVMTQSPVTLFVSPGERATLSCRASQSVNSNLA WYQQKPGQAPRLLIYGASTRATGIPARFNGSGS GTEFTLTISSLQSEDFAVYYCQQYNDWPCSFGLE TKLEIK | QVQLVESGGGVVQPGRSLRLSCAASGFTFSNYGM HWVRQAPGKGLEWVAVIWYDGSNKYYGDSVKGR FTISRDNSKNTLYLQMNSLRAEDTAVYYCARDQGI VGATWFDYWGQGTLVTVSS |
| | | | SEQ ID NO: 25628 | SEQ ID NO: 29634 |

FIGURE 50
(Continued)

| | | | |
|---|---|---|---|
| iPS:434367 | 21-225_65H11 | NA | GACATCCAGATGACCCAGTCTCCATCCTCT GTCTGCATCTGTAGGAGACAGAGTCACCATCA CTTGTCGGGCGAGTCAGGACATTAGCACTTAT TTAGCCTGGTTTCAGCAGAAACCAGGGAAAGC CCCTAAGTCACTGATCTATGCTGCATCCAGTT GCAAAGTGGGGTCCCATCAAGGTTCAGCGGCA GTGGATCTGGGACAGATTTCACTCTCACCATC AGTAGCCTGCAGCCTGAAGATTTTGCAACTTA TTACTGCCAACAGTATAATAGTTTCCCTCTCAC TTTCGGCGGAGGGACCAAGGTGGAGATCAAA SEQ ID NO: 25629 | GAGGTGCAGCTGGTGGAGTCTGGGGGAGGCTG GTCAAGCCGGGGGGGTCCCTGAGACTCTCCTGTG CAGCCCTCTGGATTCACCTTCAGTAGCTATAGGAT GAACTGGGTCCGCCAGGCTCCAGGGAAGGGGCT GGAGTGGGTCTCATCCATTAGTAGTAGTAGT TCCATATACTACGACAGACTCAGTGAAGGGCCGAT TCACCACCTCCAGAGACAACGCCAAGAACTCACT GTATCTGCAAATGAACAGCCTGAGAGCCGAGA CACGGCTGTGTATTACTGTACGAGTACAAGTGGG AGCTGGGGCCAGGGAACCCTGGTCACCGTCTCCT CA SEQ ID NO: 29635 |
| | | AA | DIQMTQSPSSLSASVGDRVTITCRASQDISTYLA WFQQKPGKAPKSLIYAASSLQSGVPSKFSGSGSG TDFTLTISSLQPEDFATYYCQQYNSFPLTFGGGT KVEIK SEQ ID NO: 25630 | EVQLVESGGGLVKPGGSLRLSCAASGFTFSSYRMN WVRQAPGKGLEWVSSISSSNSSIYYADSVKGRFTTS RDNAKNSLYLQMNSLRAEDTAVYYCTSTSGSWGQ GTLVTVSS SEQ ID NO: 29636 |
| iPS:434369 | 21-225_66B1 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCTTAAGCTCTGATCTATGCTGCATCCAGTT TGCAAAGTGGGGTCCCATCAAGGTTCAGCGGC AGTGGATCTGGGACAGCTCAGCTCTCACCAT CAGCAGCCTGCAGCCTGAAGATTTGCAACTT ACTATTGTCAACAGAGCTAACAGTTTCCCTCTC ACTTTCGGCGGAGGGACCAAGGTGGAGATCA AA SEQ ID NO: 25631 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAACCTAACAGTGG TGGCACAAACAATGACCAGGCCACGTCCAGTAC GGTCACCATGACCAGGGACACCAGCACAAGCAC AGCCTACATGGAACTGAGCAGGCTGAGATCTGA CGACACGGCCGTGTATTATTGTGCGAGAGCTCCG GGTACAGCAGCAGCTGGTACATGGGGATACTTTG ACTACTGGGGCCAGGGAACCCTGGTCACCGTCTC CTCA SEQ ID NO: 29637 |

FIGURE 50
(Continued)

| | | | | |
|---|---|---|---|---|
| iPS:434373 | 21-225_66A7 | AA | DIQMTQSPSSVSASVGDRVTITCRASQGISSWLAWYQQKPGKALKLLIYAASSLQSGVPSRFSGSGSGTDFTLTISSLQPEDFATYYCQQTNSFPLTFGGGTKVEIK<br>SEQ ID NO: 25632 | QVQLVQSGAEVKKPGASVKVSCKASGYTFTGYMHWVRQAPGQGLEWMGWINPNSGGTNNAQKFQGRVTMTRATSISTAYMELSRLRSDDTAVYYCARAPGTAAAGTWGYFDYWGQGTLVTVSS<br>SEQ ID NO: 29638 |
| | | NA | GACATCCAGATGACCCAGTCTCCATCTTCCGTGTCTGCATCTGTAGGGGACAGAGTCACCATCACTTGTCGGGCGAGTCAGGGTATTAGCAGCTGGCTTAGCCTGGTATCAGCAGAAACCAGGGAAAGCCCCTAAGCTCTTGATCTATGCTGCATCCAGTTTGCAAAGTGGGGTCCCTTCAAGGTTCAGCGGCAGTGGATCTGGGACAGATTTCACTCTCACCATCAGCAGCCTGCAGCCTGAAGATTAATAGTTTCCCTCTCACTATTGTCAACAGATTAATAGTTTCCCTCTCACTTTCGGCGGAGGGACCAAGGTGGAGATCAAA<br>SEQ ID NO: 25633 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGGATGGATCAACCCTAACAGTGGTGGCACAAACCAAGCACAGAAGTTCCAGGGCAGGGTCACCATGACCAGGGACACGTCCATCAGCACAGGTTACATGGAGCTGAGCAGGCTGAGATCTGACGACACGGCCGTGTATTACTGTGCGAGAGCTCCGGGCACAGTAGCAGCTGGTACATGGGATACTTTGACTATTGGGGCCAGGGAACCCTGGTCACCGTCTCCTCA<br>SEQ ID NO: 29639 |
| | | AA | DIQMTQSPSSVSASVGDRVTITCRASQGISSWLAWYQQKPGKAPKLLIYAASSLQSGVPSRFSGSGSGTDFTLTISSLQPEDFATYYCQQINSFPLTFGGGTKVEIK<br>SEQ ID NO: 25634 | QVQLVQSGAEVKKPGASVKVSCKASGYTFTGYMHWVRQAPGQGLEWMGWIKPNSGGTNQAQKFQGRVTMTRDTSISTGYMELSRLRSDDTAVYYCARAPGTVAAGTWGYFDYWGQGTLVTVSS<br>SEQ ID NO: 29640 |

FIGURE 50
(Continued)

| | | | |
|---|---|---|---|
| iPS:434375 | 21-225_66C7 | NA | GACATCCAGTTGACCCAGTCTCCATCTCCCT GTCTGCATCTGTAGGAGACAGAGTCACCATCA CTCGCCGGGCAGTCAGGCATTAGCAATTAT TTACATTGGTATCAGCAGAAACAGGGAAAGC TCCTAAGCTCTTGATCTATTGTGCATCCAATTT ACAATGTGGAGTCCCATCACGGTTCAGCGCA GTGGATCTGGGACAGATTTCACTCTCACAATC AGCAGCCTGCAGCCTGAAGATGTTGCAACTTA TTACTGTCAACAGCATATAATTCCCGCTCA CTTTCGCGGGAGGGACCAAGGTGGAGATCAA A | CAGGTGCAGCTGGTGGAGTCTGGGGAGGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGCT GGAGTGGGTGGCAGTTATATGGTTTGAGGAAGT CATAAATACTATACAGACTCCGTGAAGGGCGAT TCACCATCTCCAGAGACAATTCCAAGAACACGCT GTATCTGCAAATGAACAGCCTGAGAGCCGAGA CACGGCTGTGTATTACTGTGCGAGAGAACTTGGG TTCAGCAGTGACTACTGGGGCCAGGGAACCCTG GTCACCGTCTCCTCA |
| | | | SEQ ID NO: 25635 | SEQ ID NO: 29641 |
| | | AA | DIQLTQSPSSLSASVGDRVTITRRASQGISNYLH WYQQKPGKAPKLLIYCASNLQCGVPSRFSGSGS GTDFTLTISSLQPEDVATYYCQQHNNSPLTFGGG TKVEIK | QVQLVESGGGVVQPGRSLRLSCVASGFTFSDYGM HWVRQAPGKGLEWVAVIWFEGSHKYYTDSVKGR FTISRDNSKNTLYLQMNSLRAEDTAVYYCARELGF SSDYWGQGTLVTVSS |
| | | | SEQ ID NO: 25636 | SEQ ID NO: 29642 |
| iPS:434379 | 21-225_66A9 | NA | GACATCCAGATGACCCAGTCTCCATCCTCCCT GTCTGCATCTGTAGGAGACAGAGTCACCATCA CTTGCCGGGCAAGTCAGGGATTCAGACATTTAT CTTGCCGGGCAAGTCAGAGACATTTCAGCTAT CAGCAGAAACCAGGGAAAG CCCCTAAACTCCTGATCTTTGCTGCATCCAGTT TACAAAGTGGGGTCCCATCAAGGTTCAGTGGC AGTGGATCTGGGACAGATTTCACTCTCACCAT CAGCAGTCTGCAACAGACTTACAGTGTCCCTT ACTTTCGGCCCTGGGACTAAGGTGGATTTCAA A | CAGGTGCAGCTGGTGGAGTCTGGGGGAGGCGTG GTCCAGCCTGGGAGGTCCCTGAGACTCTCCTGTG CAGCGTCTGGATTCACCTCAGTAGCTATGGCAT GCACTGGGTCCGCCAGGCTCCAGGCAAGGGGCT GGAGTGGGTGGCAGTTATATGGCAATGATGAAG TGATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAAGAC CCGGCGTACCAGTTGTTGTCGACTACTGGGGCCAGG GAACCCTGGTCACCGTCCTCA |
| | | | SEQ ID NO: 25637 | SEQ ID NO: 29643 |

FIGURE 50
(Continued)

| | | | |
|---|---|---|---|
| iPS:434383 | 21-225_66F9 | AA | DIQMTQSPSSLSASVGDRVTITCRASQNIFSYLNWYQQKPGKAPKLLIFAASSLQSGVPSRFSGSGSGTDFTLTISSLQPEDFATYYCQQTYSVPFTFGPGTKVDFK<br>SEQ ID NO: 25638 | QVQLVESGGGVVQPGRSLRLSCAASGFTFSSYGMHWVRQAPGKGLEWVAVIWHDGSDKYYADSVKGRFTISRDNSKNTLYLQMNSLRAEDTAVYYCAREDPRTSCSDYWGQGTLVTVSS<br>SEQ ID NO: 29644 |
| | | NA | GACATCCAGATGACCCAGTCTCCATCCTCCCTGTCTGCATCTGTAGGAGACAGAGTCACCATCACTTGCCGGGCAAGTCAGGACATTAGAAATGTTTTAGGCTGGTATCAGCAGAAACCAGGGAAAGCCCCTAAGCGCCTGATCTATACTGCATCCAGTTTACAAAGTGTGGGGTCCCATCCAGGTTCAGCGGCAGTGGATCTGGGACAGATTCACTCTCACAATCAGCAGCCTGCAGCCTGAAGATTTTGCAACTTATTACTGTCTACAGTATAATAGTTACCCATTCACTTTCGGCCCTGGGACCAAAGTGGATATCAAA<br>SEQ ID NO: 25639 | GAGGTGCAGCTGGTGGAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGACTGGAGTGGGTCTCATCCATTAGTGGTACTAGTAGTTACATATACTACGCAGACTCAGTGAAGGGCCGATTCACCATCTCCAGAGACAACGCCAAGAACTCACTGTATCTGCAAATGAACGGCCTGAGAGCCGAGGACACGGCTGTGTATTTCTGTGCGAGAACCAATGCTTTTGATATCTGGGGCCAGGGGACAATGGTCACCGTCTCCTCA<br>SEQ ID NO: 29645 |
| | | AA | DIQMTQSPSSLSASVGDRVTITCRASQDIRNVLGWYQQKPGKAPKRLIYTASSLQSGVPSGFSGSGSGTEFTLTISSLQPEDFATYYCLQYNSYPFTFGPGTKVDIK<br>SEQ ID NO: 25640 | EVQLVESGGGLVKPGGSLRLSCAASGFTFSSYSMNWVRQAPGKGLEWVSSISGTSSYIYYADSVKGRFTISRDNAKNSLYLQMNGLRAEDTAVFCARTNAFDIWGQGTMVTVSS<br>SEQ ID NO: 29646 |

FIGURE 50
(Continued)

| | | | | |
|---|---|---|---|---|
| iPS:434385 | 21-225_66C10 | NA | GACATCCAGATGACCCAGTCTCCATCCTCCCT GTCTGCATCTGTAGGAGACAGAGTCACCATCA CTTGCCGGGCAAGTCAGGCCATTAGAAATGAT TTAGGCTGGTATCAGCAGAAACCAGGGAAAG CCCCTAAGCGCCTGATCTATCCTGCATCCAGTT TGCAAAGTGGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGTATAATAGTTACCCTCCGT GGACGTTCGGCCAAGGGTCCAAGGTGGAAAT CAAA | GAGGTGCAGCTGTTGGAGTCTGGGGGAGGCTTG GTACAGCCTGGGGGGTCCCTGAGACTCTCCTGTG CAGCCCTCTGATTCACCTTTAGCAGCTATGTTAT GAGCTGGGTCCGCCAGGCTCCAGGGAAGGGCT GGAGTGGGTCTCAGTTATTAGTGGTAGTGGTGCT AGAACATACTACGCAGACTCCGTGAAGGGCCGA TTCACCATCTCCAGAGACAATTCCAAGAACACGC TGTATCTGCAAATGAACAGCCTGAGAGCCGAGG ACACGGCCGTATATTACTGTGCGAACTGGGGAT AGACTACTACTACGGTATGGACGTCTGGGGCCAA GGGACCACGGTCACCGTCTCCTCA |
| | | | SEQ ID NO: 25641 | SEQ ID NO: 29647 |
| | | AA | DIQMTQSPSSLSASVGDRVTITCRASQAIRNDLG WYQQKPGKAPKRLIYPASSLQSGVPSRFSGSGSG TEFTLTISSLQPEDFATYYCLQYNSYPPWTFGQG SKVEIK | EVQLLESGGGLVQPGGSLRLSCAASGFTFSSYVMS WVRQAPGKGLEWVSGISSGSGARTYADSVKGRFTI SRDNSKNTLYLQMNSLRAEDTAVYYCAELGIDYY YGMDVWGQGTTVTVSS |
| | | | SEQ ID NO: 25642 | SEQ ID NO: 29648 |
| iPS:434387 | 21-225_66D11 | NA | GATATCCAGATGACCCAGTCTCCATCCTCCA GTCTGCATCTGTAGGAGACAGAGTCACCATCA CTTGCCGGGCAAGTCAGGGCATTAGAAATGAT TTAGGTTGGTATCAGCAGAAACCAGGGAAAG CCCATAAGCGCCTTGATCTATGCTGCATCCAGT TGTCAAAGTGGGGTCCCATCAAGGTTCAGCGG CAGTGGATGTGGGACAGAGAATTCACTATCTCAA TCAGCAGCATGCAGCCTGAAGATTTTGCAACT TATTACTGTCTGTATAGTGCATAATAGTTACCCTCG GACGTTCGGCCAAGGGACCAAGGTGGAAATC AAA | CAGGTGCAGCTGGTGGAGTCTGGGGGAGGCGTG GTCCAGCCTGGGAGGTCCCTGAGACTCTCCTGTG GAGCGTCTGGATTCAACCTTCAGTAGTTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTCTCTGCAAATGAACAGCCTGAGAGCCGAGG ACACGGCTCTGTATTACTGTGCGAGAGATGTA TAGCAGCAACTGGTACGACTACGGTTTGGACGTC TGGGGCCAAGGGACCACGGTCACCGTCTCCTCA |
| | | | SEQ ID NO: 25643 | SEQ ID NO: 29649 |

FIGURE 50
(Continued)

| | | | |
|---|---|---|---|
| iPS:434389 | 21-225_66F11 | AA | DIQMTQFPSSQSASVGDRVTITCRASQGIRNDLG WYQQKPGKAHKRLIYAASSCQSGVPSRFSGSGC GTEFTISISSMQREDFATYYCIVHNSYPRTFGQGT KVEIK<br>SEQ ID NO: 25644 | QVQLVESGGGVVQPGRSLRLSCGASGFTFSSYGMH WVRQAPGKGLEWVAVIWYDGSNKYYADSVKGRF TISRDNSKNTLSLQMNSLRAEDTALYYCAREMYSS NWYDYGLDVWGQGTTVTVSS<br>SEQ ID NO: 29650 |
| | | NA | GACATCCAGATGACCCAGTCTCCATCTCCGT GTGTGCATCTGTAGGAGACAGAGTCACCATCA CTTGTCGGGAGAGTCAGGGTATTAGCATCTGG TTAGCCTGGTATCAGCAGAAACCAGGAAAG CCCCTAAGCTTTGATCTATGCTGCATCCAGTT TGCAAAGTGGGTCCATCAAGGTTCAGCGGC AGTGGATATGGGACAGATTTCACTCTCACCAT CAGCAGCGTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 25645 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTCCGACAGGCCCCTGGACAAGGGC TTGAGTGGATGGGATGGATCAACAGAAGTTTCAGGACTGG TGGCACACACTATGCACAGGGACACGTCCATCAGCACA GTCACCATGACCAGGGACACGTCCATCAGCACA GCCTATATGGAACTGAGCAGGCTGAGATCTGAC GACACGGCCGTGTATTACTGTGCGAGAGATAGTA GAAGTTCGTGGGACTACTGGGGCCAGGGAACCC TGGTCTCCGTCTCCTCA<br>SEQ ID NO: 29651 |
| | | AA | DIQMTQSPSSVCASVGDRVTITCRESQGISIWLA WYQQKPGKAPKLLIYAASSLQSGVPSRFSGSGY GTDFTLTISSVQPEDFATYYCQQANSFPFTFGPGT KVDIK<br>SEQ ID NO: 25646 | QVQLVQSGAEVKKPGASVKVSCKASGYTFTGYHM HWVRQAPGQGLEWMGWINPNNGGTHYAQKFQD WVTMTRDTSISTAYMELSRLRSDDTAVYYCARDS RSSWDYWGQGTLVSVSS<br>SEQ ID NO: 29652 |

FIGURE 50
(Continued)

| | | | |
|---|---|---|---|
| iPS:434393 | 21-225_67C3 | NA | GAAATAGTGATGACGCAGTCTCCAGCCACCCT GTCTGTGTCTGTCCAGGGGAAAGAGCCACCCTCT CCTGCAGGGCCAGTCAGAGTGTTAACAGCAAC TTAGCCTGGTACCAGCAGAAACCTGGCCAGGC TCCCAGGCTCCTCATCTCTATTGCATCCACCAG GGCCACTGGTATCCCAGCCAGGTTCAATGGCA GTGGGTCTGGGACAGAGTTCACTCTCACCATC AGCAGCCTGCAGTCTGAAGATTTTGCAGTTTA TTACTGTCAGCAGTATAATGACTGGCCGTGTA GTTTTGGCCAGGGGACCAAGCTGGAGATCAAA | CAGGTGCAGCTGGTGGAGTCGGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAGTTATATGGTATGATGGAAG TAATAAATATTATGGAGACTCCGTGAAGGGCCGA GTCACCATCTCCAGAGACAATTCCAAGAACTCGC TGCATCTGCAAATGAACAGCCTGAGAGCCGAGG ACACGGCTGTGTATTACTGTGCGAGAGATCAGGG CATAGTGGGAGCTACTTGGTTTGACTACTGGGGC CAGGGAACCCTGGTCACCGTCTCCTCA |
| | | | SEQ ID NO: 29653 |
| | | AA | EIVMTQSPATLSVSPGERATLSCRASQSVNSNLA WYQQKPGQAPRLLISIASTRATGIPARFNGSGSG TEFTLTISSLQSEDFAVYYCQQYNDWPCSFGQGT KLEIK | QVQLVESGGGVVQPGRSLRLSCAASGFTFSSYGMH WVRQAPGKGLEWVAAIWYDGSNKYYGDSVKGRV TISRDNSKNSLHLQMNSLRAEDTAVYYCARDQGIV GATWFDYWGQGTLVTVSS |
| | | | SEQ ID NO: 25648 | SEQ ID NO: 29654 |
| iPS:434397 | 21-225_67H4 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGATTAACAGTTTCCCTCTCA CTTTCGGCGGAGGGACCAAGGTGGAGATCAA A | CAGGTGCAGCTGCAGTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGGATGGATCAACCAGAACAGTG GTGGCACAAACCAAGCACCAGGACAGTTTCAGGGCA GGTCACCATGACCAGGGACACGTCCATCAGCA CAGCCTACATGGAGCTGAGCGGGCTGAGATCTG ACGACACGGCCGTGTATTACTGTGCGAGAGCTCC GGGTACTGCAGCAACTGGTACATGGGGATACTTT GACTACTGGGGCCAGGGAACCCTGGTCACCGTCT CCTCA |
| | | | SEQ ID NO: 25649 | SEQ ID NO: 29655 |

FIGURE 50
(Continued)

| | | | | |
|---|---|---|---|---|
| | | AA | DIQMTQSPSSVSASVGDRVTITCRASQGISSWLAWYQQKPGKAPKLLIYAASSLQSGVPSRFSGSGSGTDFTLTISSLQPEDFATYYCQQINSFPLTFGGGTKVEIK<br><br>SEQ ID NO: 25650 | QVQLVQSGAEVKKPGASVKVSCKASGYTFTGYYMHWVRQAPGQGLEWMGWIKPNSGGTNQAQKFQGRVTMTRDTSISTAYMELSGLRSDDTAVYYCARAPGTAATGTWGYFDYWGQGTLVTVSS<br><br>SEQ ID NO: 29656 |
| iPS:434399 | 21-225_67B7 | NA | GACATCCAGATGACCCAGTCTCCATCCCTGTCTGCATCTGTAGGAGACAGAGTCACCATCACTTGCCGGGCAAGTCAGGGCATTAGAAATGATTTAGGCTGGTTTCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGACGCTCAGCCTGAAGATTTTGCAACTTATTACTGTCTACACCATAATAGTTATCCATTCAAATTTGGCCCTGGGACCAAAGTGGATATCAAA<br><br>SEQ ID NO: 25651 | CAGGTGCAGCTGGTGGAGTCTGGGGGAGGCGTGGTCCAGCCTGGGAGGTCCCTGAGACTCTCCTGTCAGCCTCTGGATTCACCTTCAGTAGTAACTATGGCATGCACTGGGTCCGCCAGGCTCCAGGCAAGGGGCTGGAATGGGTGGCAGTTATATAGAGCTGAAGGCCGAAGAAAATACTATGCAGACTCCGTGAAGGGCCGATTCACCATCTCCAGAGACAATTCCAAGAACACGCTTTATCTGCAAATGAACAGCCTGAGAGCTGAGGAACACGGCTGTGTATTACTGTGCGAGAGAGTATCCGGAATTTGACTATTGGGGCCAGGGAACCCTGGTCACCGTCTCCTCA<br><br>SEQ ID NO: 29657 |
| | | AA | DIQMTQSPSSLSASVGDRVTITCRASQGIRNDLGWFQQKPGKAPKRLIYAASSLQSGVPSRFSGSGSGTEFSLTISSLQPEDFATYYCLHHNSYPFKFGPGTKVDIK<br><br>SEQ ID NO: 25652 | QVQLVESGGGVVQPGRSLRLSCAASGFTFSNYGMHWVRQAPGKGLEWVAVILYDGSKKYYADSVKGRFTISRDNSKNTLYLQMNSLRAEDTAVYYCARSIPEFDYWGQGTLVTVSS<br><br>SEQ ID NO: 29658 |

FIGURE 50
(Continued)

| | | | |
|---|---|---|---|
| iPS:434405 | 21-225_68E6 | NA | GACATCCAGATGACCCAGTCTCCATCCTCACT GTCTGCATCTGTAGGAGACAGAGTCACCATCA CTTGTCGGGCGAGTCAGGGCATTAGCTATTAT TTAGCCTGGTTTCAGCAGAAACCAGGGAGAGC CCCTAAGTCCTGATCTATGTTGCATCCAGTT GCAAAGTGGGGTCCCATCAAGGTTCAGCGGCA GTGGATCTGGGACAGATTCACTCTCACCATC AGCAGCCTGCAACAGACCTGAAGATTTTGCAATTTA TTACTGCCAACAGTATGATAGTTACCCATTCA CTTTCGGCCCTGGGACCAAAGTGGATATCAGA<br><br>SEQ ID NO: 25653 | GAGGTGCAGCTGGTGGAGTCTGGGGGAGGCCTG GTCAAGCCGGGGGGGTCCCTGAGACTCTCCTGTG CAGCCTCTGGATTCACCTTAAGTAGTAGCTTTGGCAT GAACTGGGTCCGCCAGGCTCCAGGGAAGGGGCT GGAGTGGGTCTCATACATTAGTAGAAGTAGTAGT CACATATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGGTCTCTAGTGG AGCCCCTTTGACTACTGGGGCCAGGGAACCCTG GTCACCGTCTCCTCA<br><br>SEQ ID NO: 29659 |
| | | AA | DIQMTQSPSSLSASVGDRVTITCRASQGISYYLA WFQQKPGRAPKSLIYVASSLQSGVPSRFSGSGSG TDFTLTISSLQPEDFAIYYCQQYDSYPFTFGPGTK VDIR<br><br>SEQ ID NO: 25654 | EVQLVESGGGLVKPGGSLRLSCAASGFTLSSFGMN WVRQAPGKGLEWVSYISRSSSHYYADSVKGRFTIS RDNAKNSLYLQMNSLRAEDTAVYYCAVSSGSPFD YWGQGTLVTVSS<br><br>SEQ ID NO: 29660 |
| iPS:434407 | 21-225_68G8 | NA | GACATCCAGATGACCCAGTCTCCATCCTCCCT GTCTGCATCTGTAGGAGACAGAGTCACCATCA CTTGCCGGGCAAGTCAGGGCATTAGAAATAAT TTAGGCTGGTATCAGCAGAGACCAGGGAAAG CCCCTAAGCGCCTGATCTATGCTGCATCCAGT GTGCAAAGTGGGGTCCCATCACGGTTCAGCGG CAGTGGATCTGGGACAGATTCACTCTCACAA TCAGCAGCCTGCAGCCTGAAGATTTTGCAACT TATTACTGTCTACAGTATAATAGTTACCCATTC ACTTTCGGCCCTGGGACCAAAGTGGATATCAA A<br><br>SEQ ID NO: 25655 | GAGGTGCAGTTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTAGT TACATATATTACGCAGACTCAGTGATGGCCGAT TCACCATCTCCAGAGACAACGCCAAGAACTCTCT GTATCTGCAAATGAACAGCCTGAGAGCCGAGGA CACGGCTGTGTATTACTGTGCGAGAGAGTCAACAGC TTTGACTCCTGGGGCCAGGGAACCCTGGTCACCG TCTCCTCA<br><br>SEQ ID NO: 29661 |

FIGURE 50
(Continued)

| | | | |
|---|---|---|---|
| iPS:434411 | | AA | DIQMTQSPSSLSASVGDRVTITCRASQGIRNNLG WYQQRPGKAPKRLIYAASSVQSGVPSRFSGSGS GTEFTLTISSLQPEDFATYYCLQYNSYPFTFGPGT KVDIK<br>SEQ ID NO: 25656 | EVQLVESGGGLVKPGGSLRLSCAASGFTFSSYSMN WVRQAPGKGLEWVSSISGSSSYIYYADSVMGRFTIS RDNAKNSLYLQMNSLRAEDTAVYYCARVNSFDSW GQGTLVTVSS<br>SEQ ID NO: 29662 |
| | 21-225_68F11 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATTCACTCTCTCAA TCAGCAGCCTGCAGCCTGAAGATTTTGCAACT TATTACTGTCTACAGCATATAGTTATCCGTTC ACTTTCGGCGGAGGGACCAAGGTGGAGATCA AA<br>SEQ ID NO: 25657 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCTGTTATATGGTATGATGTAAGT AATAAATACTATGCAGACTCCGTGAAGGGCCGA TTCACCATCTCCAGAGACAATTCCAAGAACACGC TGTATCTTCAAATGAACAGCCTGAGAGCCGAGG ACACGGCTGTGTATTACTGTGTGAGAGAACTGGG GATGACCTGACTGCTGGGGCCAGGGAACCCTG GTCACCGTCTCCTCA<br>SEQ ID NO: 29663 |
| | | AA | DIQMTQSPSSLSASVGDRVTITCRASQGIRNDLG WYQQKPGKAPKRLIYAASSLQSGVPSRFSGSGS GPEFTLSISSLQPEDFATYYCLQHNSYPFTFGGGT KVEIK<br>SEQ ID NO: 25658 | QVQLVESGGGVVQPGRSLRLSCAASGFTFSDYGM HWVRQAPKGLEWVAVIWYDVSNKYYADSVKGR FTISRDNSKNTLYLQMNSLRAEDTAVYYCVRELGM TSDCWGQGTLVTVSS<br>SEQ ID NO: 29664 |

FIGURE 50
(Continued)

| iPS:434413 | 21-225_68D12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGATTCAGCGG CAGTGGATCTGGGACAGATTCACTCTCACAA TCAGCAGCCTGCAGCTGAAGATTTGCAACT TATTACTGTCTACAGCATAGTACTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGAA GGGGCTGGAGTGGATTGGGAATATCTATTATAGT GGGAGCACCTATTACAATCCGTCCCTCAAGAGTC GAGTCACCATATCCGTAGACACGTCCAAGAACC AGTTCTCCCTGAAGCTGACCTCTGTGACCGCGC AGACACGGCTGTGTATTACTGTGCGAGACATAGC ACCAGCTGGTCCATTGACTACTGGGGCCAGGGA ACCCTGGTCACCGTCTCCTCA |
| --- | --- | --- | --- | --- |
| | | | SEQ ID NO: 25659 | SEQ ID NO: 29665 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSTYPLTFGGGT KVEIK | QLQLQLQESGPGLVKPSETLSLTCTVSGGSISRSSYYW GWIRQPPGKGLEWIGNIYYSGSTYYIPSLKSRVTISV DTSKNQFSLKLTSVTAADTAVYYCARHSTSWSIDY WGQGTLVTVSS |
| | | | SEQ ID NO: 25660 | SEQ ID NO: 29666 |
| iPS:434417 | 21-225_69C8 | NA | GACATCCAGATGACCCAGTCTCCATCTCCCT GTCTGCATCTGTAGGAGACAGAGTCACCATCA CTTGCCGGGCAGGTCAGAGTCAGACAGTTTAT TTAAATTGGTATCAGCAGAAACCAGGGAAAG CCCCTAAGCTCCTGATCTATAAGGCTTCCAGTT TGCAAAGTGGGGTCCCATCAAGGTTCAGTGGC AGTGGATCTGGGACAGATTTCACTCTCGTCAT TAGTAGTCTGCAACCTGAAGATTTTGCAACTT ACTACTGTCAACAGAGTTACAGTACCCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGCCAT GCACTGGGTCCGCCAGGCTCCAGGCAAGGGCT GGAGTGGGTGGCAGTTATATGTGATGGAAGT GATAAATACTATGCAGACTCCGTGAAGGGCCGA TTCACCATCTCCAGAGACAATTCCAAGAACACGC TGTATCTGCAAATGATCAGCCTGAGAGCCGAGG ACACGGCTGTTTATTACTGTGCGAGAGATATCC TAGCAACTCGGCGGGGACTACTGGGGCCAGGG AACCCTGGTCACCGTCTCCTCA |
| | | | SEQ ID NO: 25661 | SEQ ID NO: 29667 |

FIGURE 50
(Continued)

| | | | |
|---|---|---|---|
| iPS:434423 | 21-225_70D1 | AA | DIQMTQSPSSLSASVGDRVTFTCRAGQTIYNYLN WYQQKPGKAPKLLIHVASSLQSGVPSRFSGSGS GTDFTLVISSLQPEDFATYYCQQSYSTPFTFGPGT KVDIK<br>SEQ ID NO: 25662 | QVQLVESGGGVVQPGRSLRLSCAASGFTFSNYAM HWVRQAPGKGLEWVAVIWYDGSDKYYADSVKGR FTISRDNSKNTLYLQMISLRAEDTAVYYCARDIPSN SAGDYWGQGTLVTVSS<br>SEQ ID NO: 29668 |
| | | NA | GACATCCAGATGACCCAGTCTCCATCTTCCGT GTCTGCATCTGTAGGAGACAGAGTCACCATCA CTTGTCGGGCGAGTCAGGGTGTTAGCAGTGG TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTGTCAACAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 25663 | CAGGTGCAGCTGGTGCAGTCTGGGGCTGAGGTG AAGAAGCCTGGGGCCTCAGTGAAGGTCTCCTGTA AGGCTTCTGGATACACCTTCACCGGCTACCATAT GCACTGGGTGCGACAGGCCCCTGGACAAGGGCT TGAGTGGATGGGATGGATCAACCCTAACAGTAAT GCCACAAACTATGCACAGAAGTTTCAGGGCAGG GTCACCATGACCAGGGACACGTCCATCAGCACA GCCTACATGGAACTGAGCAGGCTGAGATCTGAC ACATATGTCGTGGGACTACTGTGCGAGAGATAGC ATATCGTGTGGGACTACTGGGGCCAGGGAACC CTGGTCACCGTCTCCTCA<br>SEQ ID NO: 29669 |
| | | AA | DIQMTQSPSSVSASVGDRVTITCRASQGVSRWL AWYQQKPGKAPKLLIYAASSLQSGVPSRFSGSG SGTDFTVTISSLQPEDFATYYCQQANSFPFTFGPG TKVDIK<br>SEQ ID NO: 25664 | QVQLVQSGAEVKKPGASVKVSCKASGYTFTGYHM HWVRQAPGQGLEWMGWINPNSNATNYAQKFQGR VTMTRDTSISTAYMELSRLRSDDTAVYYCARDSISS WDYWGQGTLVTVSS<br>SEQ ID NO: 29670 |

FIGURE 50
(Continued)

| | | | |
|---|---|---|---|---|
| iPS:434425 | 21-225_70A5 | NA | GAAATAGTGATGACGCAGTCTCCAGCCACCCT GTCTGTGTCTCCAGGGGAAAGAGCAGCCACCCTCT CCTGCAGGGCCAGTCAGAGTGTTAACAGCAAC TTAGCCTGGTACCAGCTGAAACCTGGCCAGGC TCCCAGGCTCCTCATCTCTATTGCATCCACCAG GGCCACTGGTATCCACCCCGGTTCAATGGCA GTGGGTCTGGGACAGAGTTCACTCTCACCATC AGCAGCCTGCAGTCTGAAGATTTTGCAGTTTA TTACTGTCAGCAGTATAATGACTGGCCGTGTA GTTTTGGCCAGGGGACCAAGCTGGAGATCAAA | CAGGTTCAGCTGGTGGTGGAGTCTGGGGAGGCGTG GTCCAGCCTGGGAGGTCCCTGAGACTCTCCTGTG CAGCGCTGTCTGGATTCACCTTCAGTAGCTATGGCAT GCACTGGGTCCGCCAGGCTCCAGGCAAGGGCT GGAGTGGGTGGCAGTTATATGGTATGAAGT AATAAATACTATGCAGACTCCGTGAAGGGCCGA TTCACCATCTCCAGAGACAATTCCAAGAACTGC TGTATCTGCAAATGAACAGCCTGAGCGCCGAGG ACACGGCTGTTTATTACTGTGCGAGAGATCAGG CATAGTGGGAGCTACTTGGTTTGACTACTGGGGC CAGGGAACCCTGGTCACCGTCTCCTCA |
| | | | SEQ ID NO: 25665 | SEQ ID NO: 29671 |
| | | AA | EIVMTQSPATLSVSPGERATLSCRASQSVNSNLA WYQLKPGQAPRLLISIASTRATGIPPRFNGSGSGT EFTLTISSLQSEDFAVYYCQQYNDWPCSFGQGT KLEIK | QVQLVESGGGVVQPGRSLRLSCAASGFTFSSYGMH WVRQAPGKGLEWVAVIWYDGSNKYYADSVKGRF TISRDNSKNSLYLQMNSLSAEDTAVYYCARDQGIV GATWFDYWGQGTLVTVSS |
| | | | SEQ ID NO: 25666 | SEQ ID NO: 29672 |
| iPS:434427 | 21-225_70D6 | NA | GACATCCAGATGACCCAGTCTCCATCTTCCGT GTCTGCATCTGTAGGAGACAGAGTCACCATCA CTTGTCGGGCGAGTCAGGGTATTAGCAATGG TTAGCCTGGTATCAGCAGAAATCAGGGAAAGC CCTTAAGCTCCTGATCTTTGCTGCATCCAGTTT GCAAAGTGGGGTCCCATCAAGGTTCAGCGGCA GTGGATCTGGGACAGATTTCACTCTCACCATC AGCAGCCTCCAGCCTGAAGATTTTGCAAATTA CTATTGTCAACAGACTAACAGTTTCCCTCTCAC TTTCGGCGGAGGGACCAAGGTGGAGATCAAA | CAGGTGCAGCTGGTGCAGTCTGGGGCTGAGGTG AAGAAGCCTGGGGCCTCAGTGAAGGTCTCCTGC AAGGCCTCTGGATACATCTTCACCGGCTACTATA TGCACTGGGTGCGACAGGCCCCTGGACAAGGC TTGAGTGGATGGGGATGGATCAACCCTAAGAGTG GTCGCACAAACTCTGCACAGGAACAGTTCAGGGCA GGGTCCATGACCAGGGACACGTCCATCGGCAC AGCCTACATGGAGCTGCGCGGGCTAAGATCTGA CGACACGGCCGAGTATTACTGTGCGAGAGCTCCG GGTAAAGCAGCAGCTGGTACATGGGATTCTTTG ACTACTGGGGCCAGGGAACCCTGGTCACCGTCTC CTCA |
| | | | SEQ ID NO: 25667 | SEQ ID NO: 29673 |

FIGURE 50
(Continued)

| | | AA | DIQMTQSPSSVSASVGDRVTITCRASQGISKWLA WYQQNPGKALKLLIFAASSLQSGVPSRFSGSGSG TDFTLTISSLQPEDFANYYCQQTNSFPLTFGGGT KVEIK | QVQLVQSGAEVKKPGASVKVSCKASGYIFTGYYM HWVRQAPGQGLEWMGWINPKSGGTNSAQKFQGR VSMTRDTSIGTAYMELRGLRSDDTAEYYCARAPGK AAAGTWGFFDYWGQGTLVTVSS |
|---|---|---|---|---|
| | | | SEQ ID NO: 25668 | SEQ ID NO: 29674 |
| | | NA | GACATCCAGATGACCCAGTCTCCATCCTCCCT GTCTGCATCTTTAGGAGACAGAGTCACCATCA CTTGCCGCGACAAGTCAGAGCATTTCAACTAT TTAAATTGGTTCAGCGGAAACCAGGGAAAGC CCCTAAGGTCCTGATCTATACTGCATCCAGTTT GCAAAGTGGGATCCCATCAAGGTTCAGTGGCA GTGGATCTGGGACAGACTTCACTCTCACCATC AGCAGTCTGCAACCTGAAGATTCTGCAACTTA CTACTGTCAACAGAGTTACAGTATCCCGCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGACTCCAGGCAAGGGGCT GGACTGGGTGGCAGTTATATGCATGATGGAAGT AATAAATACTATGCAGACTCCGTGAAGGGCCGA TTCACCATCTCCAGAGACAACGCTTCCAAGAACACGC TGTATCTGCAAATGAACAGCCTGAGAGCCGAGG ACACGGCTGTGTATTACTGTGCGAGAGATGATCC CAGATCCTCGGCCGGGACTACTGGGGCCAGGG AACCCTGGTCACCGTCTCCTCA |
| | | | SEQ ID NO: 25669 | SEQ ID NO: 29675 |
| iPS:434429 | 21-225_70H6 | AA | DIQMTQSPSSLSASLGDRVTITCRTSQSIFNYLNW FQRKPGKAPKVLIYTASSLQSGIPSRFSGSGSGTD FTLTISSLQPEDSATYYCQQSYSIPLTFGGGTKVE IK | QVQLVESGGGVVQPGRSLRLSCAASGFTFSSYGMH WVRQTPGKGLDWVAVIWHDGSNKYYADSVKGRF TISRDNSKNTLYLQMNSLRAEDTAVYYCARDDPRS SAGDYWGQGTLVTVSS |
| | | | SEQ ID NO: 25670 | SEQ ID NO: 29676 |

FIGURE 50
(Continued)

| | | | |
|---|---|---|---|
| iPS:434431 | 21-225_70E7 | NA | GACATCGTGATGACCCAGTCTCCAGACTCCCTGGCTGTGTCTCTGGGCGAGAGGGCCACCCTCAACTGCAAGTCCAGCCAGAGTGTTTTATACAGCTCCAACAATAACAACTACTTGGCTTGGTACCAGCAGAAACCAGGACAGCCTCCTAAACTGCTCATTTACTGGGCATCTACCCGGGAATCCGGGGTCCCTGACCGATTCAGTGGCAGCGGGTCTGGGACAGATTTCACTCTCACTATCAGCAGCCTGCAGGCTGAAGATGTGGCAGTTTATTACTGTCAGCAATATTATAATATTCCTCGACGTTCGGCCAAGGGACCAAGGTGGAAATCAAA<br><br>SEQ ID NO: 25671 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGGTGGATGCACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGTATAGCAGTGGCTGGTACGTCTTTGACTACTGGGGCCAGGGAACCCTGGTCACCGTCTCCTCA<br><br>SEQ ID NO: 29677 |
| | | AA | DIVMTQSPDSLAVSLGERATLNCKSSQSVLYSSNNNNYLAWYQQKPGQPPKLLIYWASTRESGVPDRFSGSGSGTDFTLTISSLQAEDVAVYYCQQYYNIPPTFGQGTKVEIK<br><br>SEQ ID NO: 25672 | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYVFDYWGQGTLVTVSS<br><br>SEQ ID NO: 29678 |
| iPS:434433 | 21-225_70E8 | NA | GACATCCAGATGACCCAGTCTCCATCCTCCCTGTCTACATCTGTCGGAGACAGAGTCACCATCACTTGCCGGGCAAGTCAGGGCATTAGAAACGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAACATCAGCAGCCTGCAGCCTGAAGATTTTGCAACTTATTACTGTCTACAGCATAATAGTTACCCGCTCACTTTCGGCGGAGGGACCAAGGTGGAGATCAAA<br><br>SEQ ID NO: 25673 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCTCTGGGTCCGCCAGGCTCCAGGCAAGGGGCTGGAGTGGGTGGCAATTATATGGTATGATGGAAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGACCTACTGGACCCACGGGACTACTGGGGCCAGGGAACCCTGGTCACCGTCTCCTCA<br><br>SEQ ID NO: 29679 |

FIGURE 50
(Continued)

| | | | | |
|---|---|---|---|---|
| iPS:434435 | 21-225_70G9 | AA | DIQMTQSPSSLSTSVGDRVTITCRASQGIRKDLG WYQQKPGKAPKRLIYAASSLQSGVPSRFSGSGS GTEFTLTISSLQPEDFATYYCLQHNRYPLTFGGG TKVEIK<br><br>SEQ ID NO: 25674 | QVQLVESGGGVVQPGRSLRLSCAASGFTFSSYGML WVRQAPGKGLEWVAIIWYDESNKYYADSVKGRFT ISRDNSKNTLYLQMNSLRAEDTAVYYCARDLLDPR DYWGQGTLVTVSS<br><br>SEQ ID NO: 29680 |
| | | NA | GACATCCAAATGACCCAGTCTCCATCTTCCGT GTCTGCATCTGTAGGAGACAGAGTCACCATCA CTTGTCGGGCGAGTCAGGATATTAGCAGCTGG TTAGCCTGGTATCAGCAGAAATCCAGGGAAAGC CCCTAAACTCTTGATCTATGCTGCATCCAGTTT GCAAAGTGGGGTCCCATCAAGGTTCAGCGGCA GTGGATCTGGGACAGATTTCACTCTCACCATC AGCAGCCTCCAGCTGAAGATTTTGCAACTTA CTATTGTCAACAGAGTAACAGTTTCCCTCTCAC TTTCGGCGGAGGGACCAAGGTGGAGATCAAA<br><br>SEQ ID NO: 25675 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAAACCTAACAGTG GTGGCACAAACCAAGCACAGAAGTTTCAGGGCA GGGTCACCATGACCAGGGACACGTCCATCAGCA CAGCCTACATGGAGCTGAGCAGTCTGAGATCTGA CGACACGGCCGTGTATTACTGTGCGAGAGCTCCG GGTATAGCAGCAGCTGGTACATGGGGATACTTTG ACTACTGGGGCCAGGGAACCCTGGTCACCGTCTC CTCA<br><br>SEQ ID NO: 29681 |
| | | AA | DIQMTQSPSSVSASVGDRVTITCRASQDISSWLA WYQQNPGKAPKLLIYAASSLQSGVPSRFSGSGS GTDFTLTISSLQPEDFATYYCQQTNSFPLTFGGGT KVEIK<br><br>SEQ ID NO: 25676 | QVQLVQSGAEVKKPGASVKVSCKASGYTFTGYYM HWVRQAPGQGLEWMGWIKPNSGGTNQAQKFQGR VTMTRDTSISTAYMELSSLRSDDTAVYYCARAPGI AAAGTWGYFDYWGQGTLVTVSS<br><br>SEQ ID NO: 29682 |

FIGURE 50
(Continued)

| | | | | |
|---|---|---|---|---|
| iPS:434437 | 21-225_70A12 | NA | GACATCCAGATGACCCAGTCTCCATCTTCCGT GTCTGCATCTGTAGGAGACAGAGTCACCATCA CTTGTCGGGCGAGTCAGGTATTAGCAGCTGG TTAGCCTGGTATCAGCAGAAACCAGGGAAAG CCCTTAAGCTCTTGATATATGCTGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAACTT ACTATTGTCAACAGATTAACAGTTCCCTCTCA CTTTCGGCGGAGGGACCAAGGTGGAGATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCACAGAACAGTG GTGGCACAAACCAAGCACAGGACACAGAAGTTTCAGGGCA GGGCCTACATGAGCTGAGCGGGCTGAGATCTG CAGCCTACATGGAGCTGAGCGGGCTGAGATCTG ACGACACGGCCGTGTATTACTGTGCGAGAGCTCC GGGTACTGCAGCAACTGGTACATGGGGATACTTT GACTACTGGGGCCAGGGAACCCTGGTCACCGTCT CCTCA |
| | | | SEQ ID NO: 25677 | SEQ ID NO: 29683 |
| | | AA | DIQMTQSPSSVSASVGDRVTITCRASQGISSWLA WYQQKPGKAPKLLIYAASSLQSGVPSRFSGSGS GTDFTLTISSVQPEDFATYYCQQINSPLTFGGGT KVEIK | QVQLVQSGAEVKKPGASVKVSCKASGYTFTGYYM HWVRQAPGQGLEWMGWIKPNSGGTNQAQKFQGR VTMTRDTSISTAYMELSGLRSDDTAVYYCARAPGT AATGTWGYFDYWGQGTLVTVSS |
| | | | SEQ ID NO: 25678 | SEQ ID NO: 29684 |
| iPS:434439 | 21-225_70E12 | NA | GACATCCAGATGACCCAGTCTCCATCCTCCCT ATCTGCATCTGTAGGAGACAGAGTCACCATCA CTTGCCGGGCAAGTCAGGGCATTAACAATAAT TTAAACTGGTTTCAGCAGAAACCAGGGAAAGC CCCTAAGCGCCTGATCTATGCTGCATCCAGTTT GCAAAGTGGGGTCCCATCAAGGTTCAGCGGCA GTGGATCTGGGACAGATTTCACTCTCACAATC AGCAGCCTGCAGCCTGAAGATTTTGCAACTTA TTACTGTCTACAGCATATAGTTACCCGCTCA CTTTCGGCGGAGGGACCAAGGTCCAAGGTGGAGATCAAA | GAGGTGCAGCTGGTGGTGGAGTCTGGGGGAGGCCTG GTCAAGCCTGGGGGGTCCCTGAGACTCTCCTGTG CAGCCTCTGGATTCACCTTCAGTAGCAGTAGCAT GAACTGGGTCCGCCAGGCTCCAGGGAAGGGGCT GGAGTGGGTCTCTTCCATTAGTAGTAGTAGTACT TACATATACTACCACAGACTCAGTGAAGGGCCGAT TCACCATCTCCAGAGACAACGCCAAGAACTCACT GTATCTGCAAATGGACAGCCTGACAGCCGAGGA CACGGCTGTGTATTACTGTGCGAGAGATGGCCGCC TTTGACTGCTGGGGCCAGGGAACCCTGGTCACCG TCTCCTCA |
| | | | SEQ ID NO: 25679 | SEQ ID NO: 29685 |

FIGURE 50
(Continued)

| | | | |
|---|---|---|---|
| iPS:434441 | | AA | DIQMTQSPSSLSASVGDRVTITCRASQGINNNLN WFQQKPGKAPKRLIYAASSLQSGVPSRFSGSGSG TEFTLTISSLQPEDFATYYCLQHNSYPLTFGGGSK VEIK<br>SEQ ID NO: 25680 | EVQLVESGGGLVKPGGSLRLSCAASGFTFSSYSMN WVRQAPGKGLEWVSSISGNSTYIYYTDSVKGRFTIS RDNAKNSLYLQMDSLTAEDTAVYCARVAAFDC WGQGTLVTVSS<br>SEQ ID NO: 29686 |
| | 21-225_71A2 | NA | GACATCCAGATGACCCAGTCTCCATCCTCCG GTCTGCATCTGTAGGAGACAGAGTCACCATCA CTTGCCGTGCAAGTCAGGGCATTAGAAATGAT TTAGGATGGTATCAGCAGAAACCAGGAAAAG CCCCTAAGCGCCTGATCTATATTGCATTCAGA TTGCAAATTGGGGTCCCATCAAGGTTCAGCGG CAGTGGATCTGGGACAGAATTCACTCTCACAA TCAGCAGCCTGCAGCCTGAAGATTTTGCAACT TATTACTGTATACACCATAATAGTTACCCGTG GACGTTCGGCCAAGGGACCAAGGTGGAAATC AAA<br>SEQ ID NO: 25681 | CAGGTCAGCTGGTGGAGTCTGGGGGAGGCGTG GTCCAGCCTGGGAGGTCCCTGAGACTCTCCTGTG CAACGTCTGGATTCACCTTCAGTGACTATGGCAT GCACTGGGTCCGCCAGGCTCCAGGCAAGGGGCT GGAGTGGGTGGCAGTATATGGTATGATGAAAG TAATAAATACTATGCAGACTCCGTGAAGGGCCG AATTCACCATCTCCAGAGACAATTCCAAGAACAG CTGTATCTGCAAATGAACAGCCTGAGAGCCGAG GACACGGCTGTGTATTACTGTGCGAGAGAATTGG GGTGGCAGGATGATTACTGGGGCCAGGGAACCC TGGTCACCGTCTCCTCA<br>SEQ ID NO: 29687 |
| | | AA | DIQMTQSPSSRSASVGDRVTITCRASQGIRNDLG WYQQKPGKAPKRLIYIAFRLQIGVPSRFSGSGSG TEFTLTISSLQPEDFATYYCIHHNSYPWTFGQGT KVEIK<br>SEQ ID NO: 25682 | QVQLVESGGGVVQPGRSLRLSCATSGFTFSDYGMH WVRQAPGKGLEWVAVIWYDESNKYYADSVKGRF TISRDNSKNTLYLQMNSLRAEDTAVYYCARELGW QDDYWGQGTLVTVSS<br>SEQ ID NO: 29688 |

FIGURE 50
(Continued)

| iPS:434443 | 21-225_71G3 | NA | GACATGTGATGACCCAGTCTCCAGACTCCCT GGCTGTGTCTCTGGGCGAGAGGGTCGCCATCA ATTGCAAGTCCAGCCAGAGTGTTTACACAGC TCCAACAATAACAACTACTTAGATTGTATCA GCAGAAACCAGGACAGCCTCCTAAACTGCTCA TTTTCTGGGCATCTACCCGGGAATTCGGGGTT CCTGACCGATTCAGTGGCAGCGGGGTTTGGGAC AGATTTCACTCTCACCATCAGCAGCCTGCAGG CTGAAGATGTGGCAGATTACTACTGTCAACAA TATTATATTACTCCGTGCAGTTTTGGCCAGGG GACCAAGCTGGAGATCAAA | CAGGTGCAACTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAGCACAGGCTATGCACAGAAGTTCCAGGGCAG AGTCACCATGACCAGGGACACCTCCGTCAGCAC AGCCTACATGGAGCTGAGCAGCCTGAGATCTGA GGACACGGCCGTCTATTACTGTGCATATAGCAGT GGCTGGTACTACTTTGACTACTGGGGCCAGGGAA CCCTGGTCACCGTCTCCTCA |
| --- | --- | --- | --- | --- |
| | | | SEQ ID NO: 25683 | SEQ ID NO: 29689 |
| | | AA | DIVMTQSPDSLAVSLGERVAINCKSSQSVLHSSN NNNYLDWYQQKPGQLPKLLIFWASTREFGVPDR FSGSGFGTDFTLTISSLQAEDVADYYCQQYYITP CSFGQGTKLEIK | QVQLVQSGAEVKKPGASVKVSCKASGYTFTNYDIN WVRQATGQGLEWMGWMHPNSGSTGYAQKFQGR VTMTRDTSVSTAYMELSSLRSEDTAVYYCAYSSG WYYFDYWGQGTLVTVSS |
| | | | SEQ ID NO: 25684 | SEQ ID NO: 29690 |
| iPS:434447 | 21-225_71B6 | NA | GACATCCAGATGACCCAGTCTCCATCCTCCCC GTCTGCATCTGTAGGAGACAGAGTCACCATCA CTTGCCGGGCAAGTCAGGGCATTAGAAATGAT TTAGATTGGTATCAGCAGAAGCCAGGAAGG CCCCTCAGCGCCTTATCTATGCTGCATCCAGTT TGCAAAGTGGGGTCCCATCAAGGTTCAGCGGC AGTGGATCTGGGACAGATTCACTCTCACAAT CAGCAGCCTGCAGCCTGACGATTTTGCAACTT ATTACTGTCTACAGCATAATAGTTACCCATTC ACTTTCGGCCCTGGGACCAAAGTGGATATCAA A | CAGGTGCAACTGGTGCAGTCTGGGGGAGGCGTG GTCCAGCCTGGGAGGTCCTGAGACTCTCCTGTG CAGCGTCTGGATTCACCTTCAGTAACTATGGCAT GCACTGGGTCCGCCAGGCCCCAGGCAAGGGGCT GGAGTGGGTGGCAGTTATTTGGTATGATAGAACA AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGTTGTCTGACTACTGGGGCCAGGGAACCCTG GTCACCGTCTCCTCA |
| | | | SEQ ID NO: 25685 | SEQ ID NO: 29691 |

FIGURE 50
(Continued)

| | | | |
|---|---|---|---|
| iPS:434449 | 21-225_71H6 | AA | DIQMTQSPSPSASVGDRVTITCRASQGIRNDLD WYQQKPGKAPQRLIYAASSLQSGVPSRFSGSGS GTEFTLTISSLQPDDFATYYCLQHNSYPFTFGPGT KVDIK<br>SEQ ID NO: 25686 | QVQLVESGGGVVQPGRSLRLSCAASGFTFSNYGM HWVRQAPGKGLEWVAVIWYDRTNKYADSVKGR FTISRDNSKNTLHLQMNSLRAEDTAVYYCARELGM LSDYWGQGTLVTVSS<br>SEQ ID NO: 29692 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGTT TTAGGCTGGTATCAGCAGAAACCAGGGAAAG CCCCTAAGCGCCTGATCTATGCTGCATCCAGT TTACAAAGTGGGGTCCCATCCAAGGTTCAGCGG CAGTGGATCTGGGACAGAATTCACTCTCACAA TCAGCAGCCTGCAGCCTGAAGATTTTGCAACT TATTACTGTCTACAGTATAATAGTTACCCATTC ACTTTCGGCCCTGGGACCAAAGTGGATATCAA A<br>SEQ ID NO: 25687 | GAGGTGCAGCTGGTGGAGTCTGGGGGAGGCTG GTCAAGCCTGGGGGGTCCCTGAGACTCTCTGTG CAGCCTCTGGATTCACCTTCAGTAGCTATAGCAT GAACTGGGTCCGCCAGGCTCCAGGGAAGGGACT GGAGTGGGTCTCATCCATTAGTGGTACTAGTAGT TACATATACTACGCAGACTCAGTGAAGGGCCGAT TCACCATCTCCAGAGACAACGCCAAGAACTCACT GTATCTGCAAATGAACGGCCTGAGAGCCGAGGA CACGGCTGTGTATTTCTGTGCGAAAACCAATGCT TTTGATATCTGGGGCCAGGGGACAATGGTCACCG TCTCTTCA<br>SEQ ID NO: 29693 |
| | | AA | DIQMTQSPSSLSASVGDRVTITCRASQGIRNVLG WYQQKPGKAPKRLIYAASSLQSGVPSRFSGSGS GTEFTLTISSLQPEDFATYYCLQYNSYPFTFGPGT KVDIK<br>SEQ ID NO: 25688 | EVQLVESGGGLVKPGGSLRLSCAASGFTFSSYSMN WVRQAPGKGLEWVSSISGTSSYIYYADSVKGRFTIS RDNAKNSLYLQMNGLRAEDTAVYFCAKTNAFDIW GQGTMVTVSS<br>SEQ ID NO: 29694 |

FIGURE 50
(Continued)

| | | | |
|---|---|---|---|
| iPS:434451 | 21-225_71B7 | NA | GACATCCAGATGACCCAGTCTCCATCTCCGT GTCTGCATCTGTAGGAGACAGAGTCACCATCA CTTGTCGGGCGAGTCAGGGTATTAGCAGCTGG TTAGCCTGGTATCAGCAGAAATCCAGGGAAGC CCCTAAGCTCCTGATCTATGCTGCATCCAGTTT GCAAGGTGGGGTCCCATCAAGGTTCAGCGGCA GTGGATCTGGGACAGATTTCACTCTCACCATC AGCAGCCTCCAGCTGAAGATTTTGCAAATTA CTATTGTCAACAGACTAATAGTTTCCCTCTCAC TTTCGGCGGAGGGACCAAGGTGGAGATCAAA<br><br>SEQ ID NO: 25689 | CAGGTGCAGCTGGTGCAGTCTGGGGCTGAGGTG AAGAAGCCTGGGGCCTCAGTGAAGGTCTCCTGC AAGGCTTCTGGATACATCTTCACCGGCTACTATA TGCACTGGGTGCGACAGGCCCCTGGACAAGGGC TTGAGTGGATGGGATGGATCAACCCTAACAGTGG TGGCACAAACTCTGCACAGAAGTTTCAGGGCAG GGTCACCATGACCAGGGACACGTCCATCGGCAC AGCCTACATGGAGCTGAGCGGGCTGAGATCTGA CGACACGGCCGTGTATTACTGTGCGAGAGCTCCG GGTAAAGCAGCAGCTGGTACATGGGGATTCTTTG ACTACTGGGGCCAGGGAACCCTGGTCACCGTCTC CTCA<br><br>SEQ ID NO: 29695 |
| | | AA | DIQMTQSPSSSVSASVGDRVTITCRASQGISSWLA WYQQNPGEAPKLLIYAASSLQGGVPSRFSGSGS GTDFTLTISSLQPEDFANYYCQQTNSFPLTFGGG TKVEIK<br><br>SEQ ID NO: 25690 | QVQLVQSGAEVKKPGASVKVSCKASGYIFTGYYM HWVRQAPGQGLEWMGWINPNSGGTNSAQKFQGR VTMTRDTSIGTAYMELSGLRSDDTAVYYCARAPG KAAAGTWGFFDYWGQGTLVTVSS<br><br>SEQ ID NO: 29696 |
| iPS:434453 | 21-225_71B11 | NA | GACATCCAGATGACCCAGTCTCCATCCTCCCT GTCTGCATCTGTAGGAGACAGAGTCACCATCA CTTGCCGCGGCAAGTCAGGGCATTAGAAATGAT TTAGATTGGTATCAGCAGACACCAGGGAAAGC CCCTAAGCGCCTGATCTATGCTGCATCCAGTTT GCAAAGTGGGGTCCCATCAAGGTTCAGCGGCG GTGGATCTGGGACAGATTTCTCTCACAATC AGCAGCCTGCAGCATATAATACTTACCATTCAC TTACTGTCTACAGCATATAATACTTACCCATTCAC TTTCGGCGGAGGGACCAAAGTGGATGTCAAA<br><br>SEQ ID NO: 25691 | CAGGTGCAGCTGGTGGAGTCTGGGGGAGGCGTG GTCCAGCCTGGGAGGTCCCTGAGACTCTCCTGTG CAGCCGTCTGATTCACCTTCAGTGACTGACTGGCAT GCACTGGGTCCGCCAGGCTCCAGGCAAGGGGCT GGAGTGGGTGGCAGTTATATGGTATGATAGAAAT AATAAATACTATGGAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACTGGG GATGTTGTCTGACTACTGGGGCCAGGGAACCCTG GTCACCGTCTCCTCA<br><br>SEQ ID NO: 29697 |

FIGURE 50
(Continued)

| | | | |
|---|---|---|---|
| iPS:434455 | 21-225_72F5 | AA | DIQMTQSPSSLSASVGDRVTITCRASQGIRNDLD WYQQTPGKAPKRLIYAASSLQSGVPSRFSGGGS GTEFSLTISSLQPEDFTTYYCLQHNTYPFTFGPGT KVDVK | QVQLVESGGGVVQPGRSLRLSCAASGFTFSDYGM HWVRQAPGKGLEWVAVIWYDRNNKYYGDSVKG RFTISRDNSKNTLYLQMNSLRAEDTAVYYCARELG MLSDYWGQGTLVTVSS |
| | | | SEQ ID NO: 25692 | SEQ ID NO: 29698 |
| | | NA | GACATCCAGATGACCCAGTCTCCATCCCCT GTCTGCATCTGTAGGAGACAGAGTCATCATCC CTTGCCGGGCAAGTCAGAACAGATTAGCAGCTAT CTTAAATTGGTATCAGCAGAAACCAGGGAAAG CCCCTAAACTCCTGATCTATGCTGCATCCAGTT TGCAAAGTGGGGTCCCATCAAGGTTCAGTGGC AGTGGATCTGGGACAGATTCACTCTGACCAT CAGCAGTCTGCAGCCTGAAGATTTTGCAACTT ACTCCTGTCAACAGACTTACAGTACCCCACC TTCGGCCAAGGGACACGACTGGATATTAAT | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GATCTGGGTCCGCCAGGCTCCAGGGAAGGGGCT GGAGTGGGTCTCAACTATTAGTGGTAGTGGTGGT TACACATACTCCGAGACTCCGTGAAGGGCCGGT TCACCATCTCCAGAGACAATTCCAAGAACACGCT GTATCTTCAAATGAACAGCCTGAGAGCCGAGGA CACGGCCGTATATTACTGTGCGAGACGTATAGCA GTGACTGGACGGAATGGTACGACCCCTGGGGC CAGGGAACCCTGGTCACCGTCTCCTCA |
| | | | SEQ ID NO: 25693 | SEQ ID NO: 29699 |
| | | AA | DIQMTQSPSSLSASVGDRVTIPCRASQNISSYLNW YQQKPGKAPKLLIYAASSLQSGVPSRFSGSGSGT DFTLTISSLQPEDFATYSCQQTYSTPFGQGTRLD IN | EVQLLESGGGLVQPGGSLRLSCAASGFTFSSYAMI WVRQAPGKGLEWVSTISGSGGYTYSADSVKGRFTI SRDNSKNTLYLQMNSLRAEDTAVYYCARRIAVTGT EWYDPWGQGTLVTVSS |
| | | | SEQ ID NO: 25694 | SEQ ID NO: 29700 |

FIGURE 50
(Continued)

| | | | |
|---|---|---|---|
| iPS:434457 | 21-225_72G12 | NA | GACATCCAGTTGACCCAGTCTCCATCTCCCT GTCTGCATCTGTAGGAGACAGAGTCACCATCA CTTGCCGGGCGAGTCAGGGCATTAGCAGTTAT TTAAATTGGTCTCAGCAGAAACAGGGAAAGT TCCTAAGCTCCTGATCTGTGGTGCTTCCAATTT GCAATCTGGAGTCCCATCTCGGTTCAGCGGCA GTGCATCTGGGACAGAATTCATTCTCACTATC AGCAGCCTGCAGCCTGAAGATGTTACAACTTA TTACGGTCAACAGAATTACAATGCCCCGCTCA CTTTCGGCGGAGGGACCAAGGTGGAGATCAA A<br><br>SEQ ID NO: 25695 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGACACGGGGCT GGAGTGGGTGGCAGTTATATGTTTGATGAAAGT AATAAATACTATGCAGATCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGAGTTGG TTTCAGCAGTGACTACTGGGGCCAGGGAACCCTG GTCACCGTCTCCTCA<br><br>SEQ ID NO: 29701 |
| | | AA | DIQLTQSPSSLSASVGDRVTITCRASQGISSYLNW SQQKPGKVPKLLICGASNLQSGVPSRFSGSASGT EFILTISSLQPEDVTTYYGQQNYNAPLTFGGGTK VEIK<br><br>SEQ ID NO: 25696 | QVQLVESGGGVVQPGRSLRLSCAASGFTFSSYGMH WVRQAPDTGLEWVAVIWFDESNKYADSVKGRFT ISRDNSKNTLYLQMNSLRAEDTAVYYCARELGFSS DYWGQGTLVTVSS<br><br>SEQ ID NO: 29702 |
| iPS:434459 | 21-225_71A7 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCTGGGAAAGC CCCTAAGCTCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA CTATTGTCAACAGAGTTAACAGTTTCCCTCTCAC TTTCGGCGGAGGGACCAAGGTGGAGATCAAA<br><br>SEQ ID NO: 25697 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAACCCTAAAGTG GTGGCACAAATTATGACCAGGACACGTCCATCAGCAC AGCCTACATGGAGCTGAGCAGTCTGAGAGCTGAC GACACGGCCGTGTATTACTGTGCGAGAGCTCCGG GTACAGCACCAGCTGGTCAT GGGGATACTTTGA CTACTGGGGCCAGGGAACCCTGGTCACCGTCTCC TCA<br><br>SEQ ID NO: 29703 |

FIGURE 50
(Continued)

| | | | | |
|---|---|---|---|---|
| iPS:434461 | 21-225_73A3 | AA | DIQMTQSPSSVSASVGDRVTITCRASQGISSWLAWYQQKPGKAPKLLIYAASSLQSGVPSRFSGSGSGTDFTLTISSLQPEDFATYYCQQVNSFPLTFGGGTKVELK | QVQLVQSGAEVKKPGASVKVSCKASGYTFTGYYMHWVRQAPGQGLEWMGWINPKSGGTNYVQKFQGRVTMTRDTSISTAYMELSSLRSDDTAVYYCARAPGTAPAGSWGYFDYWGQGTLVTVSS |
| | | | SEQ ID NO: 25698 | SEQ ID NO: 29704 |
| | | NA | GACATCCAGATGACCCAGTCTCCATCTTCCGTGTCTGCATCTATAGGAGACAGAGTCACCATCACTTGTCGGGCGAGTCAGGGTATTAGCAACTGGTTAGCCTGGTATCAGCAGAAACCAGGGAAAGCCCCTAAGCTCCTGATCTATGCTGCATCCAGTTTGCAAAGTGGGGTCCCGTCAAGGTTCAGCGGCAGTGGATCTGAGACAGATTTCACTCTCACCATCAGCAGCCTGCAGCCTGAAGATTTTGCAACTTACTATTGTCAACAGGTTAACAGTTTCCCTCTCACTTTCGGCGGAGGGACCAAGGTGGAGATCAAA | CAGGTGCAACTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTACGACAGGCCCCTGGACAAGGACTTGACTGGATGGGATGGATCAACCCTAAAGTGGTGGCACGAATCATGTCCAGAAGTTTCAGGGCAGGGTCGCCATGACCAGGGACACGTCCATCAGCACAGCCTACATGGAGCTGAGCAGTCTGAGATCTCCGGGACACGGCCGTGTATTACTGTGCGAGAGTCCGGGTACAGCAGCAGTCTGGGTCATGGGATGCTTTGACTACTGGGGCCAGGGAACCCTGGTCACCGTCTCCTCA |
| | | | SEQ ID NO: 25699 | SEQ ID NO: 29705 |
| | | AA | DIQMTQSPSSVSASIGDRVTITCRASQGISNWLAWYQQKPGKAPKLLIYAASSLQSGVPSRFSGSGSETDFTLTISSLQPEDFATYYCQQVNSFPLTFGGGTKVEIK | QVQLVQSGAEVKKPGASVKVSCKASGYTFTGYYMHWVRQAPGQGLDWMGWINPKSGGTNHVQKFQGRVAMTRDTSISTAYMELSSLRSDDTAVYYCARAPGTAAAGSWGCFDYWGQGTLVTVSS |
| | | | SEQ ID NO: 25700 | SEQ ID NO: 29706 |

FIGURE 50
(Continued)

| | | | | |
|---|---|---|---|---|
| iPS:434463 | 21-225_73A6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTTTCAGCAGAAACCAGGGAAAGC CCCTAAGCGCCTGATCTATGCTGCATCCAATT GCAAAGTGGGGTCCCATCAAGGTTCAGCGGCA GTGGATCTGGGACAGATTCACTCTCACAATC AGCAGCCTGCAGCCTGAAGATTTTGCAACTTA TTACTGTCTACAGCATAATAGTTACCCATTCAC TTTCGGCCCTGGGACCAAAGTGGATATCAAA<br><br>SEQ ID NO: 25701 | CAGGTGCAGCTGGTGGAGTCTGGGGAGGGGTG GTCCAGCCTGGGAGGTCCCTGAGACTCTCCTGTG CAGCCTCTGGATTCACCTTCAGTTACTATGGCAT GCACTGGGTCCGCCAGGCTCCAGGCAAGGGCT GGAGTGGGTGGCAGTTATATTATATGATGGAAGT AAGAAATACTATGCAGCCTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGGAGTATCCC GGACTTTGACTACTGGGGCCAGGGAACCCTGGTC ACCGTCTCCTCA<br><br>SEQ ID NO: 29707 |
| | | AA | DIQMTQSPSSLSASVGDRVTITCRASQGIRNDLG WFQQKPGKAPKRLIYAASNLQSGVPSRFSGSGS GTEFTLTISSLQPEDFATYYCLQHNSYPFTFGPGT KVDIK<br><br>SEQ ID NO: 25702 | QVQLVESGGGVVQPGRSLRLSCAASGFTFSYYGM HWVRQAPGKGLEWVAVILYDGSKKYYAASVKGR FTISRDNSKNTLYLQMNSLRAEDTAVYYCARSIPDF DYWGQGTLVTVSS<br><br>SEQ ID NO: 29708 |
| iPS:434467 | 21-225_73H8 | NA | GACATCCAGATGACCCAGTCTCCATCCTCCCT GTATGCATCTGTAGGAGACAGAGTCACCATCA CTCGCGGGCAAGTCAGGACATCAGAAATGAT TTAGGCTGGTATCAGCAGAAACCAGGGAAAG CCCTTAAGCGCGTGATCTATGCTGCCATCCAGT TTGCAAAGTGGGGTCCCATCAAGCTTCAGCGG CAGTGGATCTGGGACAGAGTTCACTCTCACAA TCAGCAGCTTGCAGCCTGAAGATTTTGCAACT TATTACGTATACAGCATAATAGTTACCCTCC GATCACCGTCGGCCAAGGGACACGACTGGAG ATTAAA<br><br>SEQ ID NO: 25703 | GAGGTGCAGTTACGTGGAGTCTGGGGAGGCTGG GTACAGTCTGGGGGGTCCCTGAGACTCTCCTGTG CAGCCTCTGGATTCACCTTTAGCAGCAATGCCAT GAGCTGGGTCCGCCAGGCTCCAGGGAAGGGGCT GGAGTGGGTCTCAGACATTAGTCGTAGTGGTGGT ACCACATTCTACGCAGAGACAATTCCAAGAACACGCT TCACCATCTCCAGAGACAATGAACAGCCTGAGAGCCGTGAGGA GTATCTGCAAATGAACAGCTGAGAGCTGAGGA CACGGCCGTATATTACTGTGCGAAATGGGATAGC AGCAGTGGTACGACGTGACTGACTCCCTTTGACTACT GGGGCCAGGGAACCCTGGTCACCGTCTCCTCA<br><br>SEQ ID NO: 29709 |

FIGURE 50
(Continued)

| | | AA | DIQMTQSPSSLYASVGDRVTITRRASQDIRNDLG WYQQKPGKALKRVIYAASSLQSGVPSSFSGSGS GTEFTLTISSLQPEDFATYYGIQHNSYPPITVGQG TRLEIK | EVQLLESGGGWVQSGGSLRLSCAASGFTFSSNAMS WVRQAPGKGLEWVSDISRSGGTTFYADSVKGRFTI SRDNSKNTLYLQMNSLRAEDTAVYYCAKWDSSSW YDVTPFDYWGQGTLVTVSS |
|---|---|---|---|---|
| | | | SEQ ID NO: 25704 | SEQ ID NO: 29710 |
| iPS:434469 | 21-225_73C9 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGCAATGTCAT GCACTGGGTCCGCCAGGCTCCAGGCAAGGGGCT GGAGTGGGTGGCAGTTATATGCAGACTCCGTGAAG AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAAAGGTA TAGCAGCAGCTGGTTGACTACGGTATGGACGTC TGGGGCCAAGGGACCACGGTCACCGTCTCCTCA |
| | | | SEQ ID NO: 25705 | SEQ ID NO: 29711 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEIK | QVQLVESGGGVVQPGRSLRLSCAASGFTFSNYVM HWVRQAPGKGLEWVAVIWYDGSNKYYADSVKGR FTISRDNSKNTLYLQMNSLRAEDTAVYYCARERYS SSWFDYGMDVWGQGTTVTVSS |
| | | | SEQ ID NO: 25706 | SEQ ID NO: 29712 |

FIGURE 50
(Continued)

| | | | | |
|---|---|---|---|---|
| iPS:434471 | 21-225_75G3 | NA | GAAATTGTGTTGACGCAGTCGCCAGGCACCCT GTCTTTGTCTCCAGGGGAGAGAGCCACCCTCT CCTGCAGGGCCCGTCAGAATGTTGACAGCAGC TACTTAGCCTGGTACCAGAAACCTGGCCA GGCTCCCAGGCTCCTCATCTATGGTGCATCCA GCAGGGCCACTGGCATCCCAGACAGGTTCAGT GGCAGTGGGTCTGGGACAGGACTTCACTCTCAC CATCAGCAGACTGGAGCCTGAAGATTTTGCAG TGTTTTACTGTCAGCAGTATGAACGCTCACG TGGACGTTCGGCCAAGGGACCAAGGTGGAA TCAAA SEQ ID NO: 25707 | CAGGTGCAGCTACAGCAGTGGGGCGCAGGACTG TTGAAGCCTTCGGAGACCCGTCCCTCACCTGCG CTGTCTCTATGGTGGGTCCCTCAGTGGTTCCTACTG GAGCTGGATCCGCCAGCCCCCAGGGAAGGGCT GGAGTGGATTGGGGAAATCAATCTTAGTGGAAG TACCAACTACACAACCGTCCCTCAAGAGTCGAGTC ACCATATCAGTAGACACGTCAAGAGCCAGTCT CCCTGACGCTGCGCTCTGTGACCGCCGGGACAC GGCTGTGTATTACTGTGCGAGAGACTACGGTGGC CTTGACTACTGGGGCCAGGGAACCCTGGTCACCG TCTCCCTCA SEQ ID NO: 29713 |
| | | AA | EIVLTQSPGTLSLSPGERATLSCRARQNVDSSYL AWYQQKPGQAPRLLIYGASSRATGIPDRFSGSGS GTDFTLTISRLEPEDFAVFYCQQYERSPWTFGQG TKVEIK SEQ ID NO: 25708 | QVQLQQWGAGLLKPSETLSLTCAVYGGSLSGSYW SWIRQPPGKGLEWIGEINLSGSTNYNPSLKSRVTISV DTSKSQFSLTLRSVTAADTAVYYCARDYGGLDYW GQGTLVTVSS SEQ ID NO: 29714 |
| iPS:434473 | 21-225_76D1 | NA | GAAATTGTGTTGACGCAGTCTCCAGGCACCCT GTCTTTGTCTCCAGGGGAAAGAGCCACCCTCT CCTGCAGGGCCAGTCAGAATATTTACAGCAAC TACCTAGCCTGGTACCAGGAGAAGCCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGTAG TGTATTATTACTGTCAGCAGTATGAAAGTTCACCG TGGACGTTCGGCCAAGGGACCAAGGTGGAAA TCAAA SEQ ID NO: 25709 | CAGGTACAACTACAGCAGTGGGGCGCAGGACTG TTGAAGCCTTCGGAGACCCGTCCTCACCTGCG CTGTCTCTATAGTGGGTCCTTCAGTGGTTGCTACTG GAGCTGGATCCGCCAGCCCCCAGGGAAGGGCT GGAGTGGATTGGGGAAATCAATCATAGTGGAAG AACCAACTACAACCGTCCCTCAAGAGTCGAGTC ACCATATCAGTAGACACGTCAAGAACCAGTTCT CCCTGAAGCTGAGCTGTGACGCCGCGGACAC GGCTGTGTATTACTGTGCGAGGGACTACGGCGGT ATGGACGTCTGGGGCCAGGGACCACGGTCACC GTCTCCTCA SEQ ID NO: 29715 |

FIGURE 50
(Continued)

| | | | | |
|---|---|---|---|---|
| iPS:434475 | 21-225_74F9 | AA | EIVLTQSPGTLSLSPGERATLSCRASQNIYSNYLAWYQEKPGQAPRLLIYGASSRATGIPDRFSGSGSGTDFTLTISRLEPEDFVVYYCQQYESSPWTFGQGTKVEIK | QVQLQQWGAGLLKPSETLSLTCAVYSGSFSGCYWSWIRQPPGKGLEWIGEINHSGRTNYNPSLKSRVTISVDTSKNQFSLKLSSVTAADTAVYYCARDYGGMDVWGQGTTVTVSS |
| | | | SEQ ID NO: 25710 | SEQ ID NO: 29716 |
| | | NA | GACATCGTGATGACCCAGTCTCCAGACTCCCTGGCTGTGTCTCTGGGCGAGAGGGCCACCATCAACTGCAAGTCCAGCCAGTCTGTTTATACAGCTCCAACAATTACAACAGGACAGCCTCCTAAGAAGCTCGCAGAAACCAGGACAGCCTCCTAAGAAGCTCATTTACTGGGCATCTACCCGGGAATCCGGGGTCCCTGACCGATTCAGTGGCAGGGGTCTGGACAGATTTCACTCTCACCATCAGCAGCCTGCAGGCTGAAGATGTGGCAGTTTATTCCTGTCAGCAATATTATAGTAGTCCTCCGACGTTCGGCCAAGGGACCAAGGTGGAAATCAAA | CAGGTGCAGCTGGTGCAGTCTGGGGCTGAGGTGAAGAAGCCTGGGGCTCAGTGAAGGTCTCCTGCAAGGCTTCTGGATACACCTTCACCAATTATGATATTCAACTGGGTGCGACAGGCCACTGGACAAGGCTTGAGTGGATGGGATGGATGAACCCTAACAGTGGTAACACAGGCTGTGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGAGTAGCAGTGGCTGGAACTTCTTTGACTACTGGGGCCAGGGAACCCTGGTCACCGTCTCCTCA |
| | | | SEQ ID NO: 25711 | SEQ ID NO: 29717 |
| | | AA | DIVMTQSPDSLAVSLGERATINCKSSQSVLYSSNNYNYLAWYQQKPGQPPKLLIYWASTRESGVPDRFSGSGSGTDFTLTISSLQAEDVAVYSCQQYYSSPPTFGQGTKVEIK | QVQLVQSGAEVKKPGASVKVSCKASGYTFTNYDINWVRQATGQGLEWMGWMNPNSGNTGCAQKFQGRVTMTRNTSISTAYMELSSLRSEDTAVYYCASSSGWNFFDYWGQGTLVTVSS |
| | | | SEQ ID NO: 25712 | SEQ ID NO: 29718 |

FIGURE 50
(Continued)

| | | | | |
|---|---|---|---|---|
| iPS:434477 | 21-225_74A6 | NA | GACATCGTGATGACCCAGTCTCCAGACTCCCTGGCTGTGTCTCCGGGGAGAGGGCCACCATCAACTGCAAGTCCAGCCAGAGTGTTTTACACAGCTCCAACAATAACAATTACTTAGCCTGGTACCAGCAGAAACCAGGACAGCCTCCTGACCTGCTCATTTACTGGGCATCAACCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAAGATATTTTAGTACTCCGTGGACGTTCGGCCAAGGGACCCAGGTGGAAATCAAA<br>SEQ ID NO: 25713 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACCTAACAGTGGTAACACAGGCTATGCACAGAAGTTCCGGGCAGTCACCATGACCGTGAACACCTCCATAAGCACAGCCTACATGGAGCTGAGCAGCCTGAGATCTGAGGACACGGCCGTGTATTACTGTGCGAGTAGCAGTGGCTGGTACTACTTTGACTACTGGGGCCAGGGAACCCTGGTCACCGTCTCCTCA<br>SEQ ID NO: 29719 |
| | | AA | DIVMTQSPDSLAVSPGERATINCKSSQSVLHSSNNNNYLAWYQQKPGQPPDLLIYWASTRESGVPDRFSGSGSGTDFTLTISSLQAEDVAVYYCQQYFSTPWTFGQGTQVEIK<br>SEQ ID NO: 25714 | QVQLVQSGAEVKKPGASVKVSCKASGYTFTNYDINWVRQATGQGLEWMGWMHPNSGNTGYAQKFRGRVTMTVNTSISTAYMELSSLRSEDTAVYYCASSSGWYYFDYWGQGTLVTVSS<br>SEQ ID NO: 29720 |
| iPS:434479 | 21-225_76H1 | NA | GAATTTATGTTGACGCAGTCTCCAGGCACCCTGTATTGGTCTCCAGGGGAAAGAGCCACCCTCTCGTGCAGGGCCAGTCAGAGTGTTAGCAGCAGCTACTTAGTCTGGTATCAGCAGAAACCTGGCCAGGCTCCCAGGCTCCTCATCTATGGTGCATCCACCAGGGCCACTGGCATCCCAGACAGGTTCAGTGGCAGTGGGTCTGGGACAGACTTCACTCTCACCATCAGCAGACTGGAGCCTGAATATTTTGCAGTTATTATTACTGTCAGCAGTATGGTAGTTCACCCGCTCACTTTCGGCGGAGGGACCAAGGTGGAGATCACA<br>SEQ ID NO: 25715 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGTCCTGGACAAGGCTTGAGTGGATGGGATGCACAGAAGTTCCAGGCAGTAACACAGGCTATGCACAGAAGTTCCAGGCAGAGTCACCATGACCAGGAACACCTCCATCAGCACAGCCTACATGAGCTGAGCAGCCTGAGATCTGAGGACACGGCCGTGTATTACTGTGCGATTAGTAGTGGCTGGTACTGGTTCGACCCCTGGGGCCAGGAACCCTGGTCACCGTCTCCTCA<br>SEQ ID NO: 29721 |

FIGURE 50
(Continued)

| | | | | |
|---|---|---|---|---|
| iPS:434481 | 21-225_74B10 | AA | EFMLTQSPGTLYWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25716 | SEQ ID NO: 29722 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATAAGAACTACTTAACTTGGTACCA GCAGAAACCAGGACAGCCTCCTAAGCTGCTCA TTTACTGGGCATCTACTCGGGAATCCGGGGTC CCTGACCGATTCAGTGGCAGCGGGTCTGGGAC AGATTTCAGTCTCACGATCGCAGCCTGCAGG CTGAAGATGTGGCAGTTTATTACTGTCAGCAA TATTATAGTATTCCTCCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATTCACCTTCACCAATTATGATA TCAACTGGGTGCGACAGGCCACTGGACAAGGC TTGAGTGGATGGGATGGATGCACCTAACAGTGG TAACACAGGCTTTGCACAGAAGTTCAGGGCAG AGTCACCATGACCAGGAACACTCCATAAGCAC AGCCTACATGGAACTGAGCAGCCTGAGATCTGA GGACACGGCCGTGTATTACTGTGCGGTTTCCAGT GGCTGGTACTGGTTCGACCCCTGGGGCCAGGGA ACCCTGGTCACCGTCTCCTCA |
| | | | SEQ ID NO: 25717 | SEQ ID NO: 29723 |
| | | AA | DIVMTQSPDSLAVSLGERATINCKSSQSVLHSSN NKNYLTWYQQKPGQPPKLLIYWASTRESGVPDR FSGSGSGTDFSLTIGSLQAEDVAVYYCQQYYSIP PTFGQGTKVEIK | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS |
| | | | SEQ ID NO: 25718 | SEQ ID NO: 29724 |

FIGURE 50
(Continued)

| | | | | |
|---|---|---|---|---|
| iPS:434483 | 21-225_74C12 | NA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATGCAAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTACTCCGTCAGTTTGGCCAGGGGACCAAGCTGGAGATCAAA<br><br>SEQ ID NO: 25719<br><br>DIVMTQSPDSLAVSLGERATINCKSSQSVLYSSNNANYLAWYQQKPGQPPKLLIYWASTRESGVPDRFSGSGSGTDFTLTISSLQAEDVAVYYCQQYYSTPCSFGQGTKLEIK<br><br>SEQ ID NO: 25720 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGAACCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGATTAGCAGTGGCTGGTACTGGTTCGACCCCTGGGGCCAGGGAACCCTGGTCACCGTCTCCTCA<br><br>SEQ ID NO: 29725<br><br>QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAISSGWYWFDPWGQGTLVTVSS<br><br>SEQ ID NO: 29726 |
| iPS:434485 | 21-225_76D2 | NA | GAAATAGTGATGACGCAGTCTCCAGCCACCCCGTCTGTGTCTCCAGGGGAAAGAGCCACCCTCTCCTGCAGGGCCAGTGTGAGTGTTGTCAACAGCTTAGCCTGGTACCAGCAGAAACCTGGCCAGGCTCCCAGGCTCCTCATCCATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAAGTTATTACTGTCAGCAATATAATGACTGGCCGTGCAGTTTTGGCCAGGGGACCAAGCTGGAGATCAAA<br><br>SEQ ID NO: 25721 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATTTGGTATGATGGAAGTAATAAATACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGCGATCGCAATATAGTGGAGCTACTTACTTTGAGTCCTGGGGCCAGGGAACCCTGGTCACCGTCTCCTCA<br><br>SEQ ID NO: 29727 |

FIGURE 50
(Continued)

| | | | |
|---|---|---|---|
| | | AA | EIVMTQSPATPSVSPGERATLSCRASVSVVNSLA WYQQKPGQAPRLLIHGASTRATGIPARFSGSGSG TEFTLTISSVQSEDFAIYYCQQYNDWPCSFGQGT KLEIK | QVQLVESGGGVVQPGRSLRLSCAASGFTFSSYGMH WVRQAPGKGLEWVAVIWYDGSNKYYADSVKGRF TISRDNSKNTLFLQMNSLRAEDTAVYYCASDRNIV GATYFESWGQGTLVTVSS |
| | | | SEQ ID NO: 25722 | SEQ ID NO: 29728 |
| iPS:434487 | 21-225_76G2 | NA | GACATCGTGATGACCCAGTCTCCAGACTCCCT GGCTGTGTCTCTGGGCGAGCCAGTGTCACCATCA ACTGCAAGTCCAGCCAGAGTGTTTTACACAGC TCCAACAATTACAACTACTTAGCTTGGTACCA GCAGAGACCAGGACAGCCTCCTAGGCTGCTCA TTTACTGGGCATCTACCCGGGAATCCGGGGTC CCTGACCGATTCAGTGGCAGCGGTTCTGGGAC AGATTTCACTCTCACCATCAGCAGCCTGCAGG TTGAAGATGTGGCAGTTATTATTACTGTCAGCAA TATTATAGTTCTCCGACGTTCGGCCAAGG GACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGAC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTATATGGAGCTGAGCAGCCTGAGATCTGA AGACACGGCCGTGTATTACTGTGCGGGTAGCAGT GGCTGGTACATGTTTGACTACTGGGGCCAGGGAA CTCTGGTCACCGTCTCCTCA |
| | | | SEQ ID NO: 25723 | SEQ ID NO: 29729 |
| | | AA | DIVMTQSPDSLAVSLGERATINCKSSQSVLHSSN NYNYLAWYQQRPGQPPRLLIYWASTRESGVPDR FSGSGSGTDFTLTISSLQVEDVAVYYCQQYYSSP PTFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAGSSGW YMFDYWGQGTLVTVSS |
| | | | SEQ ID NO: 25724 | SEQ ID NO: 29730 |

FIGURE 50
(Continued)

| | | | |
|---|---|---|---|
| iPS:434489 | 21-225_74E4 | NA | GACATCCAGATGACCCAGTCTCCATCCTCCCT GTCTGCTCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCACTT TGCAAAGTGGGGGTCCCATCAAGGTTCAGCGGC AGTGGATCTGGGACAGAATTCACTCTCACAAT CAGCGGCCTGCAGCCTGAAGATTTTGCAACTT ATCACTGTCTACAGCATAGTAATTACCCGCTC ACTTTCGGCGGAGGGACCAAGGTGGAGATCA AA |
| | | | SEQ ID NO: 25725 |
| | | AA | DIQMTQSPSSLSASVGDRVTITCRASQGIRNDLG WYQQKPGKAPKRLIYAASTLQSGVPSRFSGSGS GTEFTLTISGLQPEDFATYHCLQHSNYPLTFGGG TKVEIK |
| | | | SEQ ID NO: 25726 |
| | | NA | CAGGTGCAGTTGGTGCAGTCTGGGGCTGAGGTGA AGAAGCCTGGGGCGCCTCAGTGAAGGTTCCTGCA AGGCTTCTGGATACACCTTCACCAATTATGATAT CAACTGGGTGCGACAGGCCACTGGACAAGGGCT TGAGTGGATGGGATGGATCAGAAGTTCAGGGCAG TAACACAGGCTATGCACAGGAACACCTCCACAAGCAC AGTCACCATGACCAGGAACACCTCCACAAGCAC AGCCCACATGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCTCCTCA |
| | | | SEQ ID NO: 29731 |
| | | | QLQLQESGPGLVKPSETLSLICTVSGGSISSSNYYW GWIRQPPGKGLEWIGSIYYSGYTSYNPSLKSRVTIS VDSSKNHFSLRLSSVTAADTAVYYCARLDSNWGL DYWGQGTLVTVSS |
| | | | SEQ ID NO: 29732 |
| iPS:434493 | 21-225_76F3 | NA | GACATCGTTATGACCCAGTCTCCAGACTCCCC GGCTGTGTCTCTGGGCGAGAGGGCCACCATCA ATTGCAAGTCCAGCCAGAGTGTTTTATTCAGC TCCAACAATTATATTAGCTTGGTACCA GCAGAGACCAGGACAGCCTCATGACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCCCTGACGTTCGGCCAAGG GACCACGGTGCAAATCAAA |
| | | | SEQ ID NO: 25727 |
| | | | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGGATGGATGAACCCTAACAGTGG TAACACAGGCTATGCACAGAAGTTCAGGGCAG AGTCACCATGACCAGGAACACCTCCACAAGCAC AGCCCACATGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCTCCTCA |
| | | | SEQ ID NO: 29733 |

FIGURE 50
(Continued)

| | | | | |
|---|---|---|---|---|
| iPS:434495 | 21-225_74B2 | AA | DIVMTQCPDSPAVSLGERATINCKSSQSVLFSSN NYNYLAWYQQRPGQPHDLLIYWASTRESGVPD RFSGSGSGTDFTLTISSLQAADVAVYYCQQYHSS PLTFGQGTTVQIK<br><br>SEQ ID NO: 25728 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br><br>SEQ ID NO: 29734 |
| | | NA | GAACTTGTGTTGACGCAGTCTCCAGGCACCCT GTCTTTGTCTCCAGGGGAAAGAGCCACCCTCT CCTGCAGGGCCAGTCAGTCAGAATATTACAGCAGT TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTGCTGTCAGCAGTATGAAAGCTCACCG TGGACCTTCGGCCAAGGGACCAAGGTGGAAA TCAAA<br><br>SEQ ID NO: 25729 | CAAGTGCAGCTACAGCAGTGGGGCGCAGGACTG TTGAAGCCTTCGGAGACCCTGTCCCTCACCTGCG CTGTCTATGGTGGGTCCTTCAGTGGTTCCTACTG GAGCTGGATCCGCCAGCCCCCGGGAAGGGCT GGAGTGGATTGGGGAAATCAATCATAGTGGAAG CACCAACTACAACCCGTCCCTCACGAGTCGAGTC ACCATATCAGTAGACACGTCAAGAACCAGTTCT CCCTGAAACTGACCTCTGTGACCGCCGCGGACTC GGCTGTGTATTACTGTGCGAGAGACTACGGGGGT TTGGACGTCTGGGGCCAAGGGACCACGGTCACC GTCTCCTCA<br><br>SEQ ID NO: 29735 |
| | | AA | ELVLTQSPGTLSLSPGERATLSCRASQNIYSSYLA WYQQKPGQAPRLLIYGASSRATGIPDRFSGSGSG TDFTLTISRLEPEDFAVYCCQQYESSPWTFGQGT KVEIK<br><br>SEQ ID NO: 25730 | QVQLQQWGAGLLKPSEPLSLTCAVYGGSFSGPYW SWIRQPPGKGLEWIGEINHSGSTNYNPSLTSRVTISV DTSKNQFSLKLTSVTAADSAVYYCARDYGGLDVW GQGTTVTVSS<br><br>SEQ ID NO: 29736 |

FIGURE 50
(Continued)

| | | NA | GAAATTGTGTTGACGCAGTCTCCAGGCACCCT GTATTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGGAAAT CAAA<br><br>SEQ ID NO: 25731 | CAGGTGCAGCTACAGCAGTGGGGCGCAGGACTG TTGAAGCCTTCGGAGACCCTGTCCTCACCTGCG CTGTCCATGGTGGGTCTTCAGTGGTTGCTACTG GAGCTGGATCCGCCAGCCCCAGGAAGGGCT GGAGTGGATTGGGAAATCAATCATAGTGGAAG CACCAACTACACAAACCCGTCCCTCAAGAGTCGAGTC ACCATTTCAGTAGACACGTCAAGAACCAGTTCT CCCTGAAGCTGAGCTGTGTGACCGCCGGACAC GGCTGTGTATTACTGTGCGAGGACTACGGCGGT ATGGACGTCTGGGGCCAAGGGACCACGGTCACC GTCTCCTCA<br><br>SEQ ID NO: 29737 |
| iPS:434497 | 21-225_76A4 | AA | EIVLTQSPGTLYLSPGERATLSCRASQSVYSSYLA WYQQKPGQAPRLLIYGASSRATGIPDRFSGSGSG TDFALTISRLEPEDFAVYYCQHSDNSPWTFGQGT KVEIK<br><br>SEQ ID NO: 25732 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29738 |
| iPS:434501 | 21-225_76G4 | NA | GAAATTGTGTTGACGCAGTCTCCAGGCACCCT GTCTTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 25733 | CAGGTGCAGCTACAGCAGTGGGGCGCAGGACTG TTGAAGCCTTCGGAGACCCTGTCCTCACCTGCG CTGTCCATGGTGGGTCCTTCAGTGGTTGCTACTG GAGCTGGATCCGCCAGCCCCAGGAAGGGCT GGAGTGGATTGGGAAATCAATCATAGTGGAAG CACCAACTACACAAACCCGTCCCTCAAGAGTCGAGTC ACCATTTCAGTAGACACGTCAAGAACCAGTCT CCCTGAAGCTGAGCTGTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29739 |

FIGURE 50
(Continued)

| | | | | |
|---|---|---|---|---|
| | | AA | EIVLTQSPGTLSLSPGERATLSCRASQSVYSSYLAWYQQKPGQAPRLLIYGASSRATGIPDRFSGSGSGTDFALTISRLEPEDCAVYYCQHSDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 25734 | SEQ ID NO: 29740 |
| iPS:434503 | 21-225_74D7 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATTTGGGACAGACTTCACTCTCACCATCAGCAGCCTGCAGCCTGAAGATTTTGCAACTTATTACTGTCTTCAGCATAGTAATAGTACCCGCTCACTTTCGGCGGAGGGACCAAGGTGGAGATCAAA | CAACTGCAGCTGCAGGAGTCGGGCCCAGGACTGGTGAAGCCTTCGGAGACCCTGTCCCTCACCTGCAGTGTCTCTGGTGGCTCCATCTTCAGAAGTAGTTACTACTGGGGCTGGATCCGCCAGCCCCCAGGGAAGGGGCTGGAGTGGATTGGGGGTATCTATTATAGTGGGAGCACCTCCTACAACCCGTCCCTCAAGAGTCGAGTCACCATATCCGTAGACACGTCCGAGAACCAGTTCTCCCTGAAGCTGAGCTCTGTGACCGCCGCAGACACGGCTGTGTATTACTGTGCGAGACTGCGACCTAACTGGGACTTTGACTACTGGGGCCAGGGAACCCTGGTCACCGTCTCCTCA |
| | | | SEQ ID NO: 25735 | SEQ ID NO: 29741 |
| | | AA | DIQMTQSPSSLSASVGDRVTITCRASQGIRNDLGWYQQKPGKAPKRLIYAASSLQSGVPSRFSGSGFGTEFTLTISSLQPEDFATYYCLQHSNYPLTFGGGTKVEIK | QLQLQESGPGLVKPSETLSLTCSVSGGSIFRSSYYWGWIRQPPGKGLEWIGGIYYSGSTSYNPSLKSRVTISVDTSENQFSLKLSSVTAADTAVYYCARLRPNWDFDYWGQGTLVTVSS |
| | | | SEQ ID NO: 25736 | SEQ ID NO: 29742 |

FIGURE 50
(Continued)

| | | | |
|---|---|---|---|
| iPS:434507 | 21-225_74C5 | NA | GAAATTGTGTTGACGCAGTCTCCAGGCACCCT GTCTTTGTCTCCAGGGGAAAGAGCCACCCTCT CTTGCAGGGCCAGTCAGAGTGTTAACAGCAAC TACTTAGCCTGGTACCAGCAGAAACCTGGCCA GGCTCCCAGGCTCCTCATCTATGGTGCATTCA GCAGGGCCACTGGCATCCCAGACAGGGTCAGT GGCAGTGGGTCTGGGACAGACTTCAATCTCAT CATCAGCAGACTGGAGCCTGAAGATTTTGCAG TGTATTACTGTCAGCAGTATGAAAGTCACCG TGGACGTTCGGCCAAGGGACCAAGGTGGAAA TCAAA<br>SEQ ID NO: 25737 |
| | | AA | EIVLTQSPGTLSLSPGERATLSCRASQSVNSNYLA WYQQKPGQAPRLLIYGAFSRATGIPDRVSGSGS GTDFNLIISRLEPEDFAVYYCQQYESSPWTFGQG TKVEIK<br>SEQ ID NO: 25738 | CAGGTGCAGTCAGTACAACAGTGGGGCGCAGGACTG TTGAAGCCTTCGGAGACCCTGTCCCTCACTTGCG CTGTCTATGGTGGGTCCTTCAGTGGTTGCTACTG GAGCTGGATCCGCCAGCCCCCAGGGAAGGGGCT GGAGTGGATTGGGGAAATCAATCATAGTGGATG CACCAACTTCAACCCGTCCCTCAAGAGTGAGTC ACCATATCAGTTGACACGTCCAAGAACCAGTTCT CCCTGAAGCTGAGCTCTGTGACCGCCGCGACAC GGCTGTGTATTACTGTGCGAGAGACTACGGCGGT ATGGACGTCTGGGGCCAAGGGACCACGGTCACC GTCTCCTCA<br>SEQ ID NO: 29743 |
| | | | QVQLQQWGAGLLKPSETLSLTCAVYGGSFSGCYW SWIRQPPGKGLEWIGEINHSGCTNFNPSLKSRVTISV DTSKNQFSLKLSSVTAADTAVYYCARDYGGMDV WGQGTTVTVSS<br>SEQ ID NO: 29744 |
| iPS:434509 | 21-225_76F5 | NA | GTCATCGTGTTGACCCAGTCTCCAGACTCCCT GGCTGTGTCTCTGGGCGAGAGGGCCACCATCA ACTGCAAGTCCAGCCAGAGTGTTATTACACAGC TCCAACAGTTACAACTACTTAGCTTGGTACCA GCAGAAACCAGGACAGTCTCCTAAGGTGCTCA TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTAGTCCTCCGACGTTCGGCCAAGG GACCAAGGTGGAAATCAAA<br>SEQ ID NO: 25739 | CAGGTGCAGTCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTATATGGAGCTGAGCAGCCTGAGATCTGA GGACACGGCCGTGTATTACTGTGCGAGTAGCAGT GGCTGGTACTGGTTCGACCCCCTGGGGCCAGGGA ACCCTGGTCACCGTCTCCTCA<br>SEQ ID NO: 29745 |

FIGURE 50
(Continued)

| | | AA | VIVLTQSPDSLAVSLGERATINCKSSQSVLHSSNS YNYLAWYQQKPGQSPKVLIYWTSTRESGVPDRF SGSGSGTDFTLTISSLQAEDVAVYYCQQYYSSPP TFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YWFDPWGQGTLVTVSS |
| --- | --- | --- | --- | --- |
| | | | SEQ ID NO: 25740 | SEQ ID NO: 29746 |
| iPS:434511 | 21-225_74B11 | NA | GATATCGTGATGACCCAGTCTCCAGACTCCCT GACTGTGTCTCTGGGCGAGAGGGCCACCATCA ACTGCAAGTCCAGCCAGAGTATTTTATACAAC TCCAACAATAACAACAGGACCTACTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCATTCTCACCATCAGCAGCCTGCAGG CTGAAGATGTGGCAGTTTACTACTGTCAGCAA TATTATAGCACTCCTCCTACTTTCGGCGGAGG GACCAAGGTGGAGATCAAA | CAGGTGCAGCTGGTGCAGTCTGGGGCTGAGGTG AAGAAGCCTGGGGCCTCAGTGAGGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGTATAGCAGT GGCTGGTACTTTGACTACTGGGGCCAGGGAA CCCTGGTCACCGTCTCCTCA |
| | | | SEQ ID NO: 25741 | SEQ ID NO: 29747 |
| | | AA | DIVMTQSPDSLTVSLGERATINCKSSQSILYNSNN NNYLAWYQQKPGQPPKLLIYWASTRESGVPDRF SGSGSGTDFILTISSLQAEDVAVYYCQQYYSTPP TFGGGTKVEIK | QVQLVQSGAEVKKPGASVRVSCKASGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS |
| | | | SEQ ID NO: 25742 | SEQ ID NO: 29748 |

FIGURE 50
(Continued)

| | | | |
|---|---|---|---|
| iPS:434513 | 21-225_76A6 | NA | GAAATTGTGTTGACGCAGTCTCCAGGCACCCG GTCTTGGTCTCCAGGGGAAAGAGCCACCCTCT CGTGCAGGGCCAGTCAGAGTGTTAGCAGCAGC TACTTAGCCTGGTACCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGATTCACTCTCAC CATCAGCAGACTGGAGCCTGAAGATTTTGCAG TTTATTACTGTCAGCAGTATGGTAACTCACCG CTCACTTTCGGCGGAGGGACCAAGGTGGAGAT CAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAATGG TAACACAGGCTATGCACAGAAGTTCCAGGGCAG AGTCACCATGACCAGGAACACCTCCATAAGCAC AGCCTACATGGAGCTGAACAGCCTGAGATCTGA GGACACGGCCGTGTATTACTGTGCGATTAGCAGT GGCTGGTACTTCGGTTTGACCCCTGGGGCCAGGGA ACCCTGGTCACCGTCCTCCTTA |
| | | | SEQ ID NO: 29749 |
| | | AA | EIVLTQSPGTRSWSPGERATLSCRASQSVSSSYL AWYQQKPGQAPRLLIYGASTRATGIPDRFSGSGS GTDFTLTISRLEPEYFAVYYCQQYGNSPLTFGGG TKVEIK | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL |
| | | | SEQ ID NO: 25744 | SEQ ID NO: 29750 |
| iPS:434515 | 21-225_74A5 | NA | GAATTTATGTTGACGCAGTCTCCAGGCACCCT GTCTTTGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTGGAGCCTGAAGATTTTGCAG TTATTACTGTCAGCAGTATGGTTGCTCACCGC TCACTTTCGGCGGAGGGACCAAGGTGGAGATC ACA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGCTATGCACAGAAGTTCCAGGGCAG AGTCACCATGACCAGGAACACCTCCATCAGCAC AGCCTACATGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA |
| | | | SEQ ID NO: 25745 | SEQ ID NO: 29751 |

FIGURE 50
(Continued)

| | | | |
|---|---|---|---|
| iPS:434517 | 21-225_76A7 | AA | EFMLTQSPGTLSLSPGERATLSCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25746 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29752 |
| | | NA | GAAATTGCGTTGACGCAGTCTCCAGGCACCCT GTCTTTGTCTCCAGGGGAAAGAGCCACCCTCT CCTGCAGGGCCAGTCCGAGTGTTGACAGCAGC TACTTAGCCTGGTACCAGCAGAGACCTGGCCA GGCTCCCAGGCTCCTCATCTATGGTGCATCA GCAGGGCCCCCTGCGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGAAAGTTCACCG TGGACGTTCGGCCAAGGGACCAAGGTGGAAA TCAAA<br>SEQ ID NO: 25747 | CAGGTGCAGCTACAGCAGTGGGGCGCAGGACTG TTGAAGCCTTCGGAGACCGTCCTCACGCG CTGTCTATGTGGGTCCTTCAGTGGTTGCTACTG GAGCTGGATCCGCCAGCCCCCAGGGAAGGGGCT GGAGTGGATTGGGAAATCAATCATAGTGGAAG GACCAACTACAACCGGTCCCTCAAGAGTCGAGTC ACCATATCAGTAGACACGTCCGAGAACCAGTTCT CCCTGAAGCTGAGCTCTGTGACCGCCGCGGACAC GGCTGTGTATTACTGTGCGAGAGACTACGGTGGG CTTGACTACTGGGGCCAGGGAGCCCTGGTCACCG TCTCCTCA<br>SEQ ID NO: 29753 |
| | | AA | EIALTQSPGTLSLSPGERATLSCRASPSVDSSYLA WYQQRPGQAPRLLIYGASSRAPGIPDRFSGSGSG TDFTLTISRLEPEDFAVYYCQQYESSPWIFGQGT KVEIK<br>SEQ ID NO: 25748 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGALVTVSS<br>SEQ ID NO: 29754 |

FIGURE 50
(Continued)

| | | | |
|---|---|---|---|
| iPS:434519 | 21-225_74C7 | NA | GAAATTGTGTTGACGCAGTCGCCAGGCACCCT GTCTTTGTCTCCAGGGGAGAGAGCCACCCTCT CCTGCAGGACCAGTCCGAATGTTGACAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTTACTGTCAGCAGTATGAACGCTCACG TGGACGTTCGGCCAAGGGACCAAGGTGGAAA TCAAA SEQ ID NO: 25749 | CAGGTGCAGTTACAGCAGTGGGGCGCAGGACTG TTGAAGCCTTCGGAGACCCTGTCCCTCACCTGCG CTGTCTATGGTGGGTCCCTCAGTGGTTCCTACTG GAGCTGGATCCGCCAGCCCCCAGGGAAGGGGCT GGAGTGGATTGGGGAAATCAATCTTAGTGGAAG CACCAACTACAACCCGTCCCTCAAGAGTCGAGTC ACCATATCAGTAGACACGTCAAGAGCCAGTCT CCCTGACGTGCGCTCTGTGACCGCCGCGGACAC GGCTGTGTATTACTGTGCGAGAGACTACGGTGGC CTTGACTACTGGGGCCAGGGAACCCTGGTCACCG TCTCCCTCA SEQ ID NO: 29755 |
| | | AA | EIVLTQSPGTLSLSPGERATLSCRTSPNVDSSYLA WYQQKPGQAPRLLIYGASSRATGIPDRFSGSGSG TDFTLTISRLEPEDFAVFYCQQYERSPWTFGQGT KVEIK SEQ ID NO: 25750 | QVQLQQWGAGLLKPSETLSLTCAVYGGSLSGSYW SWIRQPPGKGLEWIGEINLSGSTNYNPSLKSRVTISV DTSKSQFSLTLRSVTAADTAVYYCARDYGGLDYW GQGTLVTVSS SEQ ID NO: 29756 |
| iPS:434523 | 21-225_75C3 | NA | GAAATTGTGTTGACGCAGTCTCCAGGCACCCT GTCTTTGTCTCCAGGGGAAAGAGCCACCCTCT CCTGCAGGGCCAGTCAGTGTTAGCAGCAGG TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCAGTATTATGATAGCTCACCGT GGACGTTCGGCCAAGGGACCAAGGTGGAAAT CAAA SEQ ID NO: 25751 | CAGGTGCAGTCAGCTACAGCAGTGGGGCGCAGGACCG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATTATATGGAAG AACCAACTACAACCGTCCCTCAAGAGTCGAGTC ACCATATCAGTAGACACGTCAAGAACCAGTTCT CCCTGAAGTGCAGCTCTGTGACCGCCGCGGACAC GGCTGTGTATTACTGTGCGAGAGACTACGGCGGT ATGGACGTCTGGGGCCAAGGGACCACGGTCACC GTCTCCCTCA SEQ ID NO: 29757 |

FIGURE 50
(Continued)

| | | | |
|---|---|---|---|
| iPS:434525 | 21-225_76E8 | AA | EIVLTQSPGTLSLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK<br>SEQ ID NO: 25752 | QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS<br>SEQ ID NO: 29758 |
| | | NA | GACATCGTGATGACCCAGTCTCCAGACTCCCTGGCTGTGTCTCTGGGCGAGAGGGCCACCATCAACTGCAAGTCCAGCCAGAGTGTTTACACAGCTCCAACAATTATAACTACTTAGCTTGGTACCAGCAGAAGCCAGGACAGCCCCCTAAGGTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTTTAGTAGTCCCTCGACGTTCGGCCAAGGGACCAAGGTGGAAATCAAA<br>SEQ ID NO: 25753 | CAGGTGCAGCTGGTGCAGTCTGGGGCTGAGGTGAAGAAGCCTGGGGCTCAGTGAAGGTCTCCTGCAAGGCTTCTGGATACACCTTCCCAATTATGATATCAACTGGGTGCGACAGGCCACTGGACAAGGCTTGAGTGGATGGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTATTGTGCGGTTTCCAGTGGCTGGCACTGGTTCGACCCCTGGGGCCAGGGAACCCTGGTCACCGTCGCCTCA<br>SEQ ID NO: 29759 |
| | | AA | DIVMTQSPDSLAVSLGERATINCKSSQTVLHSSNNYNYLAWYQQKPGQPPKVLIYWSTRESGVPDRFSGSGSGTDFTLTISSLQAEDVAVYYCQQYFSSPLTFGQGTKVEIK<br>SEQ ID NO: 25754 | QVQLVQSGAEVKKPGASVKVSCKASGYTFPNYDINWVRQATGQGLEWMGWMNPNSGNTGYAQKFQGRVTMTRNTSISTAYMELSSLRSEDTAVYYCAVSSGWHWFDPWGQGTLVTVAS<br>SEQ ID NO: 29760 |

FIGURE 50
(Continued)

| | | | |
|---|---|---|---|
| iPS:434529 | 21-225_76B9 | NA | GAATTTATGTTGACGCAGTCTCCAGGCACCCT GTCTTGGTCTCCAGGGGAAAGAGCCACCCTCT CGTGCAGGGCCAGTCAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGATTCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA SEQ ID NO: 25755 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCCTGGACAAGGC TTGAGTGGATGGGATGGATGCACCCTAACAGTGG TAACACAGGCTATGCACAGAAGTTCCAGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA SEQ ID NO: 29761 |
| | | AA | EFMLTQSPGTLSWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT SEQ ID NO: 25756 | QVQLVQSGAEVKKPGASVKVSCKASGYTFTNYDIN WVRQVPGQGLEWMGWMHPNSGNIGYAQKFQGR VTMTRNTSISTAYMELSSLRSEDTAVYYCAISSGW YWFDPWGQGTLVTVSS SEQ ID NO: 29762 |
| iPS:434531 | 21-225_76C9 | NA | GAAATTGTGTTGACGCAGTCTCCAGGCACCCT GTCTTTGTCTCCAGGGGAAAGAGCCACCCTCT CCTGCAGGGCCAGTCAGTGTTAGCAGCAGT TACTTATCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGTGGAGCCTGAAGATTTTGCAG TGTATTACTGTCAGCAGTATGGTAGGTCACGG ACGTTCGGCCAAGGGACCAAGGTGGAAATCA GA SEQ ID NO: 25757 | GAGGTGCAGCTGGTGGAGTCTGGGGGAGGCTTG GTAAAGCCTGGGGGGTCCTTAGACTCTCCTGTG CAGCCTCTGGATTCAGTTCAGTAACGCCTGGAT GAACTGGGTCCGCCAGGCTCCAGGGAAGGGGCT GGAGTGGGTTGGCCGTATTAAAAACAAAGCTGA TGGTGGGACAACAGACTTCGCTGCACCGTGAA AGGCAGATTCACCATCTCAAGAGATGATTCAA ACACACGTGTATCTGCAAATGAACAGCCTGAA AACCGAGGACACAGCCGTGTATTACTGTACCACA GTGGGACCTACTACGGACTACTGGGGCCAGGGA ACCCTGGTCACCGTCTCCTCA SEQ ID NO: 29763 |

FIGURE 50
(Continued)

| | | | |
|---|---|---|---|
| iPS:434533 | 21-225_85F7 | AA | EIVLTQSPGTLSLSPGERATLSCRASQSVSSSYLSWYQQKPGQAPRLLIYGASSRATGIPDRFSGSGSGTDFTLTISRLEPEDFAVYYCQQYGRSRTFGQGTKVEIR<br>SEQ ID NO: 25758 |
| | | | EVQLVESGGGLVKPGGSLRLSCAASGFSFSNAWMNWVRQAPGKGLEWVGRIKNKADGGTTDFAAPVKGRFTISRDDSKHTLYLQMNSLKTEDTAVYYCTTVGPTTDYWGQGTLVTVSS<br>SEQ ID NO: 29764 |
| | | NA | GAACCTGTGTTGACGCAGTCTCCAGGCACCCTGTCTTTGTCTCCAGGGGAAAGAGCCACCCTCTCCTGCAGGGCCAGTCAGTTACAGCAGCCCTGTCCCTCACCTGCGTGTCTATGTGGGTCCTTCAGTGGTCCCTACTGGAGCTGGATCCGCCAGCCCCCGGGAAGGGGCTGGAGTGGATTGGGAGAAATCAATCATAGTGGAAGCACCAACTACAACCGTCCTCCTCAAGAGTCGAGTCACCATATCAGTAGACACGTCAAGAACCAGTTCTCCCTGAAACTGACCTCTGTGACCGCCGCGGACACGGCTGTGTATTACTGTGCGAGAGACTACGGGGGTTTGGACGTCTGGGGCCAAGGGACCACGGTCACCGTCTCCTCA<br>SEQ ID NO: 29765 |
| | | | GAACCTGTGTTGACGCAGTCTCCAGGCACCCTGTCTTTGTCTCCAGGGGAAAGAGCCACCCTCTCCTGCAGGGCCAGTCAGTTACAGCAGCCCTGTCCCTCACCTGCGTGTCTATGTGGGTCCTTCAGTGGTCCCTACTGGAGCTGGATCCGCCAGCCCCCGGGAAGGGGCTGGAGTGGATTGGGAGAAATCAATCATAGTGGAAGCACCAACTACAACCGTCCTCCTCAAGAGTCGAGTCACCATATCAGTAGACACGTCAAGAACCAGTTCTCCCTGAAACTGACCTCTGTGACCGCCGCGGACACGGCTGTGTATTACTGTGCGAGAGACTACGGGGGTTTGGACGTCTGGGGCCAAGGGACCACGGTCACCGTCTCCTCA<br>SEQ ID NO: 25759 |
| | | AA | EPVLTQSPGTLSLSPGERATLSCRASQNIYSNYLAWYQQKPGQAPRLLIYGASSRATGIPDRFSGSGSGTDFTLTISRLEPEDFAVYCCQQYESSPWTFGQGTKVEIK<br>SEQ ID NO: 25760 |
| | | | QVQLQQWGAGLLKPSEPLSLTCAVYGGSFSGPYWSWIRQPPGKGLEWIGEINHSGSTNYNPSLKSRVTISVDTSKNQFSLKLTSVTAADTAVYYCARDYGGLDVWGQGTTVTVSS<br>SEQ ID NO: 29766 |

FIGURE 50
(Continued)

| | | | |
|---|---|---|---|
| iPS:434535 | 21-225_74C8 | NA | GACATCCAGATGACCCAGTCTCCATCCTCACT GTCTGCATCAGTAGGAGACAGAGTCACCATCA CTTGTCGGGCGAGTCAGTGGTATCAGGCAAGTAT TTAGCCTGGTTTCAGCAGAAACCAGGGAAAGC CCCTAAGTCCCTGATCTATACTACATCCAATTT ACAAAGTGGGGTCCCATCAAGGTTCAGTGGC AGTGGATCTGGGACAGATTTCACTCTCACCAT CAGCAGCCTGCAGTATGAAGATTTTGCAACTT ATTACTGCCAACAGTACAGTAATTACCCGCTC ACTTTCGGCGGAGGGACCAAGGTGGAGATCA AT<br>SEQ ID NO: 25761 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGCT GGAGTGGGTGGCAGTTATATGTGATGGAAGT AATAAAACTATGCAGAGACACCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGGCAG CTATGGTTATGACGGCCTTGACTACTGGGGCCAG GGAACCCTGGTCACCGTCTCCTCA<br>SEQ ID NO: 29767 |
| | | AA | DIQMTQSPSSLSASVGDRVTITCRASQGIGKYLA WFQQKPGKAPKSLIYTTSNLQSGAPSKFSGSGSG TDFTLTISSLQYEDFATYYCQQYSNYPLTFGGGT KVEIN<br>SEQ ID NO: 25762 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDGSYG YDGLDYWGQGTLVTVSS<br>SEQ ID NO: 29768 |
| iPS:434537 | 21-225_74E11 | NA | GAAATAGTGATGACGCAGTCTCCAGCCACCCT GTCTGTGTCTCCAGGGGAAAGAGCCACCCTCT CCTGCAGGGCCAGTCTGAGTGTTGTCAACAGC TTAGCCTGGTACCAGCAGAAACCTGGCCAGGC TCCCAGGCTCCTCATCCATGGTGCATCCACCA GGGCCACTGGTATCCCAGCCAGGTTCAGTGGC AGTGGGTCTGGGACAGTCTGAAGATTTGCAATT CAGCAGTCTGCAGTCTGAAGATATAATGACTGGCCGTGC AGTTTTGGCCAGGGGACCAAGCTGGAGATCAA A<br>SEQ ID NO: 25763 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGCT GGAGTGGGTGGCAGTTATTGTGATGGAAGT AATAAATACTATGCAGAGACTCCGTGAAGGGCCGA TTCACCATCTCCAGAGACAATTCCAAGAACACGC TGTTTCTGCAAATGAACAGCCTGAGAGCCGAGG ACACGGCTGTATTACTGTGCGAGCGATCGCAA TATAGTGGAGCTACTTACTTTGAGTCCTGGGGC CAGGGAACCCTGGTCACCGTCTCCTCA<br>SEQ ID NO: 29769 |

FIGURE 50
(Continued)

| | | | |
|---|---|---|---|
| iPS:434539 | 21-225_74A2 | AA | EIVMTQSPATLSVSPGERATLSCRASLSVVNSLA WYQQKPGQAPRLLIHGASTRATGIPARFSGSGSG TEFTLTISSLQSEDFAIYYCQQYNDWPCSFGQGT KLEIK<br>SEQ ID NO: 25764 |
| | | | QVQLVESGGGVVQPGRSLRLSCAASGFTFSSYGMH WVRQAPGKGLEWVAVIWYDGSNKYYADSVKGRF TISRDNSKNTLFLQMNSLRAEDTAVYYCASDRNIV GATYFESWGQGTLVTVSS<br>SEQ ID NO: 29770 |
| | | NA | GATATTGTGATGACTCAGTCTCCACTCTCCCTG CCCGTCACCCCTGGAGAGCCGGCCTCCATCTC CTGCAGGTCTAGTCAGAGCCTCTGTAGTA ATGGACACAACTATTTGGATTGGTACCTACAG AAGCCAGGGCCGGTCTCCACAGCTCCTGATCTA TTTGGGTTCTAATCGGGCCTCCGGGGTCCCTG AGAGGTTCAGTGGCAGTGGATCAGGCACAGA TTTTACACTGAAAATCAGCAGAGTGGAGGCTG AGGATGTTGGGGTTTATTACTGCATGCAACCT CTACAAACTCCGTTCACTTTCGGCGGAGGGAC CAAGGTGGAGATCAAA<br>SEQ ID NO: 25765 | CAGGTGCAGGTACAGCAGTGGGGCGCAGGACTG TTGAAGCCTTCGGAGACCGTCCCTCACCTGCG CTGTCTATGTGGGTCCTTCACTGATTACTACTGG AGCTGGATCCGCCAGCCCCAGGAAGGGGCTG GAGTGGATTGGGAAATCAATCATAGTGGAGAC ACCAACTACAACCCGTCCCTCAAGAGTCGAGTCA CCATATCAGTAGACACGTCCAAGAACCAGTTCTC CCTGAAGCTGAGTTCTGTGACCGCCGGACACG GCTGTGTATTACTGTGCGAGAGAGTTCCATATA GTGGAAGCTACCTCTACTACTACGGTATGGACGT CTGGGGCCAAGGGACCACGGTCACCGTCTCCTCA<br>SEQ ID NO: 29771 |
| | | AA | DIVMTQSPLSLPVTPGEPASISCRSSQSLLHSNGH NYLDWYLQKPGRSPQLLIYLGSNRASGVPERFS GSGSGTDFTLKISRVEAEDVGVYYCMQPLQTPF TFGGGTKVEIK<br>SEQ ID NO: 25766 | QVQVQQWGAGLLKPSETLSLTCAVYGGSFTDYYW SWIRQPPGKGLEWIGEINHSGDTNYNPSLKSRVTIS VDTSKNQFSLKLSSVTAADTAVYYCAREFPYSGSY LYYYGMDVWGQGTTVTSS<br>SEQ ID NO: 29772 |

FIGURE 50
(Continued)

| | | | |
|---|---|---|---|
| iPS:434547 | 21-225_74H5 | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCAGCAGTATGAAAGCTCGCCG TGGACGTTCGGCCAAGGGACCAAGGTGGAAA TCAAA<br>SEQ ID NO: 25767 | CAGGTGCAGCTACAACAGTGGGGCGCAGGACTG TTGAAGCCTTCGGAGACCCTGTCCCTCACTTGCG CTGTCAATGGTGGGCCCTTCAGTGTTGCTACTG GAGCTGGATCCGCCAGCCCCCAGGAAGGGCT GGAGTGGATTGGGGAAATCAATCATAGTGGAAG GACCAACTTCAACCCGTCCCTCAAGAGTCGAGTC ACCATATCAGTTGACACGTCCAAGAACCAGTTCT CCCTGAAGCTGAGCTCTGTGACCGCCGGACAC GGCTGTGTATTACTGTGCGAGAGATACGGCGGT ATGGACGTCTGGGGCCAAGGGACCACGGTCACC GTCTCCTCA<br>SEQ ID NO: 29773 |
| | | AA | EIVLTQSPGTLSLSPGERATLSCRASQSVNSNYLA WYRQKPGQAPRLLIYGASSRATGIPDRFSGSGSG TDFILISRLEPEDFAVYYCQQYESSPWTFGQGTK VEIK<br>SEQ ID NO: 25768 | QVQLQQWGAGLLKPSETLSLTCAVNGGPFSGCYW SWIRQPPGKGLEWIGEINHSGRTNFNPSLKSRVTISV DTSKNQFSLKLSSVTAADTAVYYCARDYGGMDV WGQGTTVTVSS<br>SEQ ID NO: 29774 |
| iPS:434549 | 21-225_76E11 | NA | GACATCGTGATGACCCAGTCTCCAGACTCCCT GGCTGTGTCTCTGGGCGAGAGGGCCACCATCA ACTGCAAGTCCCGCCAGAGTGTTTACAGC TCCAACAATTACAACTACTTAGCTTGGTACCA GCAGAAAGCCAGGACAGCCTCCTAAACTGCTCA TTTACTGGGCTTCTACCCGGGAAATCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAGA<br>SEQ ID NO: 25769 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GACTCACCATGACCAGAACACCTCCATAAGCA CAGCCTACATGGAGCTGAGCAGCCTGAGATCTG AGGACACGGCCGTGTTTACTGTGCATATGCAG TGGCTGGTACTACTTGACTACTACTGGGGCCAGGGA ACCCTGGTCACCGTCTCCTCA<br>SEQ ID NO: 29775 |

FIGURE 50
(Continued)

| | | | |
|---|---|---|---|
| iPS:434551 | 21-225_75C4 | AA | DIVMTQSPDSLAVSLGEGATINCKSRQSVLHSSN NYNYLAWYQQKAGQPPKLLIYWASTRESGVPD RFSGSGSGTDFTLTISSLQAEDVAVYYCQQYYST PPTFGQGTKVEIR | QVQLVQSGAEVKKPGASVKVSCKASGYTFTNYDIN WVRQATGQGLEWMGWMNPNSGNTGYAQKFQGR LTMTRNTSISTAYMELSSLRSEDTAVFYCAYSSGW YYFDYWGQGTLVTSS |
| | | | SEQ ID NO: 25770 | SEQ ID NO: 29776 |
| | | NA | GACATCGTGATGACCCAGTCTCCAGACTCCCT GGCTGTGTCTCTGGGCGAGGGGCCACCATCA ACTGTAAGTCCAGCCAGAGTGTATTTATACAGC TCCAACAATAATAACTACTTAGCTTGGTTCCA GCAGAAACCAGGACAGCCTCCTAAGCTGCTCA TTTATTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATTACTCCTCCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGCATCTAACAGTGG TAACACAGGCTATGCACAGAAGTTCCAGGGCAG AGTCACCATGACCAGGAACACCTCCATAAGCAC AGCCTACATGGAACTGAGCAGCCTGAGATCTGA GGACACGGCCGTGTATTACTGTGCGAGTAGCAGT GGCTGGTACTACTTTGACTACTGGGGCCAGGGAA CCCTGGTCACCGTCTCCTCA |
| | | | SEQ ID NO: 25771 | SEQ ID NO: 29777 |
| | | AA | DIVMTQSPDSLAVSLGERATINCKSSQSILYSSNN NNYLAWFQQKPGQPPKLLIYWASTRESGVPDRF SGSGSGTDFTLTISSLQAEDVAVYYCQQYYITPP TFGQGTKVEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YYFDYWGQGTLVTSS |
| | | | SEQ ID NO: 25772 | SEQ ID NO: 29778 |

FIGURE 50
(Continued)

| | | | |
|---|---|---|---|
| iPS:434559 | 21-225_74D11 | NA | GAAATTGTGTTGACGCAGTCTCCAGGCACCCT GTCTTTGTCTCTGCAGGGGAAAGAGCCACCCTCT CCTGCAGGGCCAGTCAGTCAGAGTGTTTACAGCAGC TACTTAGCCTGGTACCAGCAGAAACCTGGCCA GGCTCCCAGGCTCCTCATTTATGGTGTGCATCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACG TGGACGTTCGGCCAAGGGACCAAGGTGGAAA TCAAA SEQ ID NO: 25773 | CAGGTGCAGCTACAGCAGTGGGGCGCAGGACTG TTGAAGCCTTCGGAGACCCTGTCCCTCACCTGCG CTGTCCATGTGGTGGTCTTCAGTGGTTGCTACTG GAGCTGGATCCGCCAGCCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 29779 |
| | | AA | EIVLTQSPGTLSLSPGERATLSCRASQSVYSSYLA WYQQKPGQAPRLLIYGASSRATGIPDRFSGSGSG TDFALTISRLEPEDFAVYYCQHYDNSPWTFGQG TKVEIK SEQ ID NO: 25774 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29780 |
| iPS:434561 | 21-225_77G1 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTACTGATAACTCACCG TGGACGTTCGGCCAAGGGACCAAGGTGGAAA TCAAA SEQ ID NO: 25775 | CAGGTGCAGCTACAGCAGTGGGGCGCAGGACTG TTGAAGCCTTCGGAGACCCTGTCCCTCACCTGCG CTGTCCATGGTGGGTCTTCAGTGGTTGCTACTG GAGCTGGATCCGCCAGCCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 29781 |

FIGURE 50
(Continued)

| | | | |
|---|---|---|---|
| iPS:434563 | 21-225_75D8 | AA | EIVLTQSPGTLYLSPGERATLSCRASQSVYSSYLAWYQQKPGQAPRLLIYGASSRATGIPDRFSGSGSGTDFALTISRLEPEDCAVYYCQHYDNSPWTFGQGTKVEIK<br>SEQ ID NO: 25776 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29782 |
| | | NA | GATATTGTGATGACTCAGTCTCCACTCTCCCTGCCCGTCACCCCTGGAGAGCCGGCCTCCATCTCTGCAGGTCTAGTGCAGAGCCTCCTGCATAGTAGTGGATACAACTATTTGGATTGGTACCTGCAGAAGCCAGGGCAGTCTCCACAGCTCCTGATCTATTTGGGTTCTAATCGGGCCTCCGGGGTCCCTGACAGGTTCAGTGGCAGTGGATCAGGTCAGGACTTTATTACTGCATGCAAGCTCTACACCCTCCTCACTTTCGGCGGAGGGACCAAGGTGGAGATCAAA<br>SEQ ID NO: 25777 | GAGGTGCAGCTGGTGGAGTCTGGGGGAGGCTTGGTACAGCCGGGGGGGTCCCTGAGACTCTCCTGTGCAGCCTCTGGATTCACCTTCAGTAGCTAACTACGACATGCACTGGGTCCGCCAAGCTACAGGAAAAGGTCTGGAGTGGGTCAGTATTGGTACTGCTGGTGACACATACTATCCAGGCTCCGTGAAGGGCCGATTCACCATCTCCAGAGAAAATGCCAAGAACTCCTTGTATCTTCAAATGAACAGCTGAGAGCGGGACACGGCTGTGTATTACTGTGCAAGAGTTCTTGACTACGGTGACTCCTTGGCTACTACTACTACGGTATGGACGTCTGGGGCCAAGGGACCACGGTCACCGTCTCCTCA<br>SEQ ID NO: 29783 |
| | | AA | DIVMTQSPLSLPVTPGEPASISCRSSQSLLHSSGYNYLDWYLQKPGQSPQLLIYLGSNRASGVPDRFSGSGSGSDFTLKISRVEAEDVGLYYCMQALHPPLTFGGGTKVEIK<br>SEQ ID NO: 25778 | EVQLVESGGGLVQPGGSLRLSCAASGFTFSNYDMHWVRQATGKGLEWVSAIGTAGDTYYPGSVKGRFTISRENAKNSLYLQMNSLRAGDTAVYYCARVLDYGDSLGYYYGMDVWGQGTTVTVSS<br>SEQ ID NO: 29784 |

FIGURE 50
(Continued)

| | | | | |
|---|---|---|---|---|
| iPS:434565 | 21-225_75B10 | NA | GAAATTGTGTTGACGCAGTCTCCAGGCACCCT<br>ATCTTTGTCTCCAGGGGAAAGAGCCACCCTCT<br>CCTGCAGGGCCAGTCCGAGTGTTAACAGCTAC<br>TACTTAGCCTGGTACCAGCAGAAACCTGGCCA<br>GGCTCCCAGGCTCCTCATCTATGGTGCAACCA<br>GCAGGGCCACTGACATCCCAGACAGGTTCAGT<br>GGCAGTGGGTCTGGAACAGACTTCACTCTCAC<br>CATCAGCAGACTGGAGCCTGAAGATTTTGCAG<br>TTTATTTCTGTCAGCAGTATGAAGACTCACCGT<br>GGACGTTCGGCCAAGGGACCAAGGTGAAAT<br>CAAA<br><br>SEQ ID NO: 25779 | CAGGTGCAGCTACAGCAGTGGGGCGCAGGACTG<br>TTGAAGCCTTCGGAGACCCTGTCCCTCAAATGCG<br>ATGTCTATGGTGGGTCCTTCAGTGGTTACTACTG<br>GAGCTGGATCCGCCAGCCCCCAGGGAAGGGCT<br>GGAGTGGATTGGGGAAATCAATCACAGTGGAAG<br>CACCAACTACAACCCGTCCCTCAAGAGTCGAGTC<br>ACCATATCAGTAGACACGTCCAAGAACCAGTTCT<br>CCCTGAAGCTGAGCTCTGTGACCGCCGCGACAC<br>GGCTGTGTATTACTGTGCGAGAGACTACGGTGGT<br>TTGGACGTCTGGGGCCAAGGGACCACGGTCACC<br>GTCTCCTCA<br><br>SEQ ID NO: 29785 |
| | | AA | EIVLTQSPGTLSLSPGERATLSCRASPSVNSYYLA<br>WYQQKPGQAPRLLIYGATSRATGIPDRFSGSGSG<br>TDFTLTISRLEPEDFAVYFCQQYEDSPWTFGQGT<br>KVEIK<br><br>SEQ ID NO: 25780 | QVQLQQWGAGLLKPSETLSLKCDVYGGSFSGYYW<br>SWIRQPPGKGLEWIGEINHSGSTNYNPSLKSRVTISV<br>DTSKNQFSLKLSSVTAADTAVYYCARDYGGLDVW<br>GQGTTVTVSS<br><br>SEQ ID NO: 29786 |
| iPS:434569 | 21-225_77H5 | NA | GAAATAGTGATGACGCAGTCTCCAGTCACCCT<br>GTCTGTGTCTCCAGGGGAAAGAGCCACCCTCT<br>CCTGCAGGGCCAGTCAGAGTGTTAGCAGCAGC<br>TTAGCCTGGTACCAGCAGAGAAACCTGGCCTGGC<br>TCCCAGGCTCCTCATCTATGGTGCATCCACCA<br>GGGCCACTGGTATCCCAGCCAGGTTCAGTGGC<br>AGTGGGTCTGGGACAGAGTTCTCTTTACCAT<br>CAGCAGCCTGCAGTCTGAAGATTTTGCAGTTT<br>ATTTCTGTCAGCAGTATAATGACTGGCCGTGC<br>AGTTTTGGCCAGGGGCTCCAAGCTGGAGATCCA<br>A<br><br>SEQ ID NO: 25781 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTTATATGCAT<br>GCACTGGGTCCGCCAGGCTCCAGGCAAGGGGCT<br>GGAGTGGGTGGCAGTTATATGTGATGGAAG<br>AATAAATACTATGCAGACTCCGTGAAGGGCCG<br>ATTCACCATCTCCAGAGACAATTCCAAGAACACG<br>CTGTATCTGCAAATGAACAGCCTGAGAGCCGAG<br>GACACGGCTCTATATTACTGTGCGAGAGATCGGA<br>GTATATTGGAGCTACTTCTTTGACTACTGGG<br>CCAGGGAACCCTGGTCACCGTCTCCTCA<br><br>SEQ ID NO: 29787 |

FIGURE 50
(Continued)

| | | | |
|---|---|---|---|
| iPS:434571 | 21-225_74D2 | AA | EIVMTQSPVTLSVSPGERATLSCRASQVSSSLA WYQQKPGLAPRLLIYGASTRATGIPARFSGSGSG TEFSFTISSLQSEDFAVYFCQQYNDWPCSFGQGS KLEIQ<br><br>SEQ ID NO: 25782 | QVQLVESGGGVVQPGRSLRLSCAASGFTFSNYGM HWVRQAPGKGLEWVAVIWYDGRNKYYADSVKG RFTISRDNSKNTLYLQMNSLRAEDTALYYCARDRSI LGATFFDYWGQGTLVTVSS<br><br>SEQ ID NO: 29788 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAAC TACTTAGCCTGGTACCAGCAGAAACCTGGCCA GGCTCCCAGGCTCCTCATCTATGGTGCATCA GCAGGGGCCCCTGCATCCAGACAGGTTCAGT GGCAGTGGGTCTGGGACAGACTTCACTCTCAC CATCAACAGACTGGAGCCTGAAGATTTTGCAG TGTATTTCTGTCAGCAGTATGAAAGCTCACCG TGGACGTTCGGCCAAGGGACCAAGGTGGAAA TCAAA<br><br>SEQ ID NO: 25783 | CAGGTGCAGCTACAGAGCAGTGGGGCGCAGGACTG TTGAAGCCTTCGGAGACCGTCCTCCTCACCGCG CTGTCTATGTGGGTCCTTCAGTGTTGCTACTG GAGCTGGATCCGCCAGCCCCCAGGGAAGGGCT GGAGTGGATTGGGAAATCAATCATAGTGGAAG GACCAACTACAACCGGTCCCTCAAGAGTCGAGTC ACCAATCTCAGTAGACACGTCCGAGAACCAGTTCT CCCTGAAGTTGAGCTCTGTGACCGCCGCGGACAC GGCTGTGTATTACTGTGCGAGAGACTACGGTGGG CTTGACTACTGGGGCCAGGGAACCCTGGTCACCG TCTCCCTCA<br><br>SEQ ID NO: 29789 |
| | | AA | EIVLTQSPGTLSLSPGERATLSCRASQSVDSNYLA WYQQKPGQAPRLLIYGASSRAPGIPDRFSGSGSG TDFTLTINRLEPEDFAVYFCQQYESSPWTFGQGT KVEIK<br><br>SEQ ID NO: 25784 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTLVTVSS<br><br>SEQ ID NO: 29790 |

FIGURE 50
(Continued)

| | | | |
|---|---|---|---|
| iPS:434573 | 21-225_77E6 | NA | GACATCGTGATGACCCAGTCTCCATCCTCACTGTCTGCATCTGTAGGAGACAGAGTCACCATCACTTGTCGGGCGAGTCAGGGCATTAGCAAGTATTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTACAGTAATTACCCGCTCACTTTCGGCGGAGGGACCAGGGTGGAGATCAAA |
| | | | CAGGTGCAGCTGGTGGAGTCTGGGGGAGGCGTGGTCCAGTCTGGGGAGGTCCTGAGACTCTCCTGTCAGCGTCTGGATTCACCTTCAGTAGCTATGGCATGCACTGGGTCCGCCAGGCTCCAGGCAAGGGCTGGAGTGGGTGGCAGTTATATGGTATGATGGAAGTAATCAAAACTATGCAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGAGATGGCAGCTATGGTTACGACGGCCTTGACTACTGGGGCCAGGGAACCCTGGTCACCGTCTCCTCA |
| | | | SEQ ID NO: 25785 |
| | | AA | DIQMTQSPSSLSASVGDRVTITCRASQGISKYLAWFQQKPGKAPKSLIYAASSLQGGAPSKFSGSGSGTDFTLTISSLQPEDFATYYCQQYSNYPLTFGGGTRVEIK |
| | | | QVQLVESGGGVVQSGRSLRLSCAASGFTFSSYGMHWVRQAPGKGLEWVAVIWYDGSNQNYADSVKGRFTISRDNSKNTLFLQMNSLRAEDTAVYYCARDGSYGYDGLDYWGQGTLVTVSS |
| | | | SEQ ID NO: 25786 |
| | | | SEQ ID NO: 29791 |
| iPS:434575 | 21-225_77C7 | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAACAATTATAACTACTTAGCTTGGTACCAGCAGAAAGCCAGGACAGCCTCCTAAGGTGCTCTCCTTTACTGGACATCTACCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTAGTCCTCCGACGTTCGGCCAAGGGACCAAGGTGGAAATCAAA |
| | | | CAGGTGCAGCTGGTGCAGTCTGGGGCTGAGGTGAAGAAGCCTGGGGCCTCAGTGAAGGTCTCCTGCAAGGCTTCTGGATACACCTTCCCCAATTATGATATCAACTGGGTGCGACAGGCCACTGGACAAGGCTTGAGTGGATGGGATGGATCACAGAAGTTCCAGGCAGAGTCCAAGCTATGCAGACAGCATGACGAAGCACTCCATAAGCACTTACAAGCCATGATGAGCAGCCTGAGATCTGAGGACACGGCCGTGTATTATTGTGCGGTTTCCAGGCTGCTGGCACTGTTTCAGCCCCTGGGGCCAGGAACCCTGGTCACCGTCGCCTCA |
| | | | SEQ ID NO: 25787 |
| | | | SEQ ID NO: 29792 |
| | | | SEQ ID NO: 29793 |

FIGURE 50
(Continued)

| | | | |
|---|---|---|---|
| iPS:434579 | 21-225_77F7 | AA | DIVMTQSPDSLAVSLGERATINCKSSQTVLHSSN NYNYLAWYQQKPGQPPKVLLYWTSTRESGVPD RFSGSGSGTDFTLTISSLQAEDVAVYYCQQYFSS PPTFGQGTRVEIK<br><br>SEQ ID NO: 25788 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br><br>SEQ ID NO: 29794 |
| | | NA | GAAATTGTGTTGACGCAGTCTCCAGGCACCCT GTATTTGTCTCCAGGGGAAAGAGCCACCCTGT CATGCAGGGCCAGTCAGAGTGTTTACAGCAGC TACTTAGCGTGGTACCAGCAGAAACCTGGCCA GGCTCCCAGGCTCCATCATTTATTGGTGCATCA GCCGGGCCACTGGCATCCCAGACAGGTTCAGT GGCAGTGGGTGTGGGACAGACTTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA<br><br>SEQ ID NO: 25789 | CAGGTGCAGCTACAGCAGTGGGGCGCAGGACTG TTGAAGCCTTCGGAGACCGTCCCTCACCTGCG CTGTCCATGTGGGTCCTTCAGTGGTTGCTACTG GAGCTGGATCCGCCAGCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29795 |
| | | AA | EIVLTQSPGTLYLSPGERATLSCRASQSVYSSYLA WYQQKPGQAPRLIIYGASSRATGIPDRFSGSGCG TDFALTISRVEHEDCAVYYCQHYDNSPWTFGQG TKVEIK<br><br>SEQ ID NO: 25790 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29796 |

FIGURE 50
(Continued)

| | | | |
|---|---|---|---|
| iPS:434581 | 21-225_74B12 | NA | GAAATTGTGTTGACGCAGTCTCCAGGCACCCT GTATTTGTCTCCAGGGGAAAGAGCCACCCTCT CCTGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAATCACCG TGGACGTTCGGCCAAGGGACCAAGGTGGAAA TCAAA SEQ ID NO: 25791 | CAGGTGCAGTCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 29797 |
| | | AA | EIVLTQSPGTLYLSPGERATLSCRASQSVYSSYLA WYQQKPGQAPRLLIYGASSRSTGIPDRFSGSGSG TDFALTISRLEPEDFAVYYCQHYDNSPWTFGQG TKVEIK SEQ ID NO: 25792 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29798 |
| iPS:434583 | 21-225_74B6 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TACTTAGCCTGGTACCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAGTCACCG CTCACTTTCGGCGGAGGGACCAAGGTGGAGAT CAAA SEQ ID NO: 25793 | CAGGTGCAGTCTGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAATGG TAACACAGGCTATGCACAGAAGTTCCAGGGCAG AGTCACCATGACCAGGAACACCTCCATAAGCAC AGCCTACATGGAGCTGAACAGCCTGAGATCTGA GGACACGGCCGTGTATTACTGTGCGATTAGCAGT GGCTGGTACTGTTCGACCCCCTGGGGCCAGGGA ACCCTGGTCACCGTCTCCTTA SEQ ID NO: 29799 |

FIGURE 50
(Continued)

| | | | |
|---|---|---|---|
| iPS:434585 | 21-225_75A12 | AA | EIVLTQSPGTLSLSPGERATLSCRASQSVSSSYLA WYQQKPGQAPRLLIYGASTRATGIPDRFSGSGSG TDFTLTISRLEPEYFAVYYCQQYGNSPLTFGGGT KVEIK<br>SEQ ID NO: 25794 | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL<br>SEQ ID NO: 29800 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGG TACTTAGCCTGGTACCAGCAGAAACCTGGCCA GGCTCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAGATTTTGCAG TATATTACTGTCAGCAGTATGATAGCTCACCGT GGACGTTCGGCCAAGGGACCAAGGTGGAAAT CAAA<br>SEQ ID NO: 25795 | CAGGTGCAGCTACAGCAGGGGGGCGCAGGACCG TTGAAGCCTTCGGAGACCGTCCCTCACCTGCG CTGTCTATGTGGGTCCTTCAGTGGTTGCTACTG GAGCTGGATCCGCCAGCCCCCAGGGAAGGGCT GGAGTGGATTGGGGAAATCAATTATAGTGGAAG AACCAACTACAACCGTCCCTCAAGAGTCGAGTC ACCATATCAGTAGACACGTCAAGAACCAGTTCT CCCTGAAGCTGAGCTCTGTGACCGCCGCGACAC GGCTGTGTATTACTGTGCGAGAGACTACGGCGGT ATGGACGTCTGGGGCCAAGGGACCACGGTCACC GTCTCCTCA<br>SEQ ID NO: 29801 |
| | | AA | EIVLTQSPGTLSLSPGERATLSCRASQSVSSRYLA WYQQKPGQAPRLLIYGASSRATGIPDRFSGSGSG TDFTLTISRLEPADFAVYYCQHYDSSPWTFGQGT KVEIK<br>SEQ ID NO: 25796 | QVQLQQGGAGPLKPSETLSLTCAVYGGSFSGCYWS WIRQPPGKGLEWIGEINYSGRTNYNPSLKSRVTISV DTSKNQFSLKLSSVTAADTAVYYCARDYGGMDV WGQGTTVTVSS<br>SEQ ID NO: 29802 |

FIGURE 50
(Continued)

| | | | |
|---|---|---|---|
| iPS:434587 | 21-225_74G3 | NA | GAATTTATGTTGACGCAGTCTCCAGGCACCCT GTGTTGGTCTCCAGGGGAAAGAGCCACCCTCT CGTGCAGGGCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCTGAATGGTTGCTCACCGC TTTATTACTGTCAGCAGTATGGTGCTCACCGC TCACTTTCGGCGGAGGGACCAAGGTGGAGATC ACA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGGTATGCACAGAAGTTCCAGGGCAG AGTCACCATGACCAGGAACACTTCCATCAGCAC AGCCTACATGGAGCTGAGCAGCCTGAGATCTGA GGACACGGCCGTGTATTACTGTGCGATTAGTAGT GGCTGGTACTGTTCGACCCCTGGGGCCAGGGA ACCCTGGTCACCGTCTCCTCA SEQ ID NO: 29803 |
| | | AA | SEQ ID NO: 25797 EFMLTQSPGTLCWSPGERATLSCRASQSVSSSYL VWYQQKPGQAPRLLIYGASTRATGIPDRFSGSGS GTDFTLTISRLEPEYFAVYYCQQYGCSPLTFGGG TKVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS SEQ ID NO: 29804 |
| iPS:434595 | 21-225_77A10 | NA | SEQ ID NO: 25798 GAAATTGTGTTGACGCAGTCTCCAGGCACCCT GTCTTTGTCTCCAGGGGAAAGAGCCACCCTCT CCTGCAGGGCCAGTCAGAGTGTTCACAGCAGG TACTTAGCCTGGTACCAGCAGAAACCTGGCCA GGCTCCCAAACTCCTCATCTTTGGTGCATCCA GCAGGGCCACTGGCATCCCAGACAGGTTCAGT GGCAGTGGGTCTGGGACGGACTTCACTCTCAC CATCAGCAGACTGGAGCCTGAAGATTTTGCAG TATATTACTGTCAGCATTATGATAGCTCACGT GGACGTTCGGCCAAGGGACCAAGGTGGAAAT CAAA SEQ ID NO: 25799 | CAGGTGCAGCTACAACAGGGGGGGCAGGACCG TTGAAGCCTTCGGAGACCCTGTCCCTCACCTGCG CTGTCTATGGTGGGTCCTTCAGTGGTTGCTACTG GAGCTGGATCCGCCAGCCCCAGGGAAGGGGCT GGAGTGGATTGGGGAAATCAATTATAGTGGAAG AACCAACTACAACCCGTCCCTCAAGAGTCGAGTC ACCATATCAGTAGACACGTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA SEQ ID NO: 29805 |

FIGURE 50
(Continued)

| | | | |
|---|---|---|---|
| iPS:434597 | 21-225_77C10 | AA | EIVLTQSPGTLSLSPGERATLSCRASQSVHSRYLAWYQQKPGQAPKLLIFGASSRATGIPDRFSGSGSGTDFTLTISRLEPEDFAVYYCQHYDSSPWTFGQGTKVEIK<br>SEQ ID NO: 25800 | QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS<br>SEQ ID NO: 29806 |
| | | NA | GACATCGTGATGACCCAGTCTCCAGATTGCCTGGCTGTGTCTCTGGGCGAGAGGGCCACCATCAACTGCAAGTCCAGCCAGAGTGTTTATACACCTCCAACAATAACAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTCACTCTCACCATCAGCAGCCTGCAGGCTGAAGATGTTGCAGTTTATTATTGTCAGCACTATTATAATACTCCGTGGAAGTTTGTCCAAGGGACCAAGGTGGAAATCACA<br>SEQ ID NO: 25801 | CAGGTGCAGCTGGTGCAGTCTGGGGCTGAGGTGAAGAAGCCTGGGGCTCAGTGAAGGTCTCCTGCAAGGCTTCTGGATACACCTTCACCAATTATGATATCAACTGGGTGCGACAGGCCACTGGACAAGGCTTGAGTGGATGGGATGCACAGAAGTTCCAGGGCAGTAACACAGGCTATGCACAGAAGAACACTCCATAAGCACAGTCACCATGACCAGGAGCTGAGCAGCCTGAGATCTGAAGCCTACATGGAGCTGTATTACTGTGCGATTAGCAGTGGACACGGCCGTGACTGGTTCGACCCCTGGGGCCAGGAGGCTGGTACTGGTTCGACCCCTGGGGCCAGGAACCCTGTCACCGTCCTCTCA<br>SEQ ID NO: 29807 |
| | | AA | DIVMTQSPDCLAVSLGERATINCKSSQSVLYTSNNNNYLAWYQQKPGQPPKLLIYWASTRESGVPDRFSGSGSGTDFTLTISSLQAEDVAVYYCQHYYNTPWKFVQGTKVEIT<br>SEQ ID NO: 25802 | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAISSGWYWFDPWGQGTLVTVSS<br>SEQ ID NO: 29808 |

FIGURE 50
(Continued)

| | | | |
|---|---|---|---|
| iPS:434603 | 21-225_77D11 | NA | GAATTTATGTTGACGCAGTCTCCAGGCACCCT GTATTGGTCTCCAGGGGAAAAGAGCCACCATCT CGTGCAGGGCCAGTCAGTGTTAGCAGCAGC TACTTAGTCTGGTATCAGCAGAAACCTGGCCA GGCTCCCAGGCTCCTCATCTATGGTGCATCA CCAGGGCCACTGGCATCCAGACAGTTCAGT GGCAGTGGGTCTGGGACAGACTTCACTCTCAC CATCAGCAGACTGGAGCCTGAATATGGTTGCAG TTTATTACTGTCAGCAGTATGGTTGCTCACCGC TCACTTTCGGCGGAGGGACCAAGGTGGAGATC ACA<br>SEQ ID NO: 25803 | CAGGTGCAGCTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGCTATGCACAGAAGTTCCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGTTGACCCCTGGGGCCAGGGA ACCCTGGTCACCGTCCTCA<br>SEQ ID NO: 29809 |
| | | AA | EFMLTQSPGTLVWSPGERATISCRASQSVSSSYL VWYQQKPGQAPRLLIYGASTRATGIPDRFSGSGS GTDFTLTISRLEPEYFAVYYCQQYGCSPLTFGGG TKVEIT<br>SEQ ID NO: 25804 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br>SEQ ID NO: 29810 |
| iPS:434611 | 21-225_77C12 | NA | GAAATTGTGTTGACGCAGTCTCCAGGCACCCT GTCTTTGTCTCCAGGGGAAAGAGCCACCCTCT CCTGCAGGGCCAGGCAGTCAGAGTGTTGACAGCAGT TATTTAGCCTGGTACCAGCAGAAACGTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGGCTGGAGCCTGAAGATTTTGCAG TATATTACTGTCAGCAGTATGAAAGCTCACCG TGGACGTTCGGCCAAGGGACCAAGGTGGAAA TCAAA<br>SEQ ID NO: 25805 | CAGGTGCAGCTACAGCAGTGGGGCGCAGGACTG TTGAAGCCTTCGGAGACCCTGTCCCTCACCTGCG CTGTCTATGGTGGGCCCTTCAGTGGTTCCTACTG GAGCTGGATCCGCCAGTCCCCAGGAAGGGCT GGAGTGGATTGGGGAAATCAATTATAGGGGAAG CACCAACTACTACAACCCGTCCCTCAAGAGTCGAGTC ACCATATCAGTAGACACGTCCAAGAACCAGTTCT CCCTGAACCTGAGCTCTGTGACCGCCGCAGACAC GGCTGTGTATTACTGTGCGAGGGACTACGGCGGT ATGGACGTCTGGGGCCAAGGGACCACGGTCACC GTCTCCTCA<br>SEQ ID NO: 29811 |

FIGURE 50
(Continued)

| | | | | |
|---|---|---|---|---|
| iPS:434613 | 21-225_77D12 | AA | EIVLTQSPGTLSLSPGERATLSCRARQSVDSSYLA WYQQKRGQAPRLLIYGASSRATGIPDRFSGSGSG TDFTLTISRLEPEDFAVYYCQQYESSPWTFGQGT KVEIK<br><br>SEQ ID NO: 25806 | QVQLQQWGAGLLKPSETLSLTCAVYGGAFSGSYW SWIRQSPGKGLEWIGEINYRGSTNYNPSLKSRVTIS VDTSKNQFSLNLSSVTAADTAVYYCARDYGGMDV WGQGTTVTVSS<br><br>SEQ ID NO: 29812 |
| | | NA | GACATCGTGATGACCCAGTCTCCAGACTCCCT GGCTGTGTCTCTGGGCGAGAGGGCCACCATCA ATTGCAGGTCCAGCCAGAGTGTTTATACAGC TCCAACAATTATAACTACTTAGCTTGGTACCA GCAGAAACCAGGACAGCCTCCTAAGCTGCTCA TTTACTGGGCATCTACCCGGGAATTCCGGGGTC CCTGACCGATTCAGTGGCAGCGGGTCTGGGAC AGATTTCACTCTCACCATCAGCAGCCTGCAGG CTGAAGATGTGGCCGTTTATTACTGTCAGCAA TATTATACTACTCCGTGCAGTTTTGGCCAGGG GACCAAGCTGGAGATCAAG<br><br>SEQ ID NO: 25807 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAACA CAGCCTACATGGAGCTGAGCAGCCTGAGATCTG AGGACACGGCCGTGTATTACTGTGCGATTAGCAG TGGCTGGTACTGGTTCGACCCCTGGGGCCAGGGA ACCCTGGTCACCGTCTCCTCA<br><br>SEQ ID NO: 29813 |
| | | AA | DIVMTQSPDSLAVSLGARATINCRSSQSVLYSSN NYNYLAWYQQKPGQPPKLLIYWASTRDSGVPD RFSGSGSGTDFTLTISSLQAEDVAVYYCQQYYTT PCSFGQGTKLEIK<br><br>SEQ ID NO: 25808 | QVQLVQSGAEVKKPGASVKVSCKASGYTFTNYDIN WVRQATGQGLEWMGWMNPNSGNTGYAQKFQGR VTMTRNTSINTAYMELSSLRSEDTAVYYCAISSGW YWFDPWGQGTLVTVSS<br><br>SEQ ID NO: 29814 |

FIGURE 50
(Continued)

| | | | | |
|---|---|---|---|---|
| iPS:434615 | 21-225_76C5 | NA | GACATCCAGATGACCCAGTCTCCATCCTCACTGTCTGCATCTGTAGGAGACAGAGTCACCATCACTTGTCGGGCGAGTCAGGTCATTAGCAAGTATTTAGCCTGGTTTCAGCAGAAACCAGGGAAAGCCCCTAAGTCCCTGATCTATGCTGCATCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAACTTATTACTGCCAACAGTACAGTAATTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGAAGTAATAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATGGCAGCTATGGTTACGACGGCCTTGACTACTGGGGCCAGGGAACCCTGGTCACCGTCTCCTCA |
| | | | SEQ ID NO: 25809 | SEQ ID NO: 29815 |
| | | AA | DIQMTQSPSSLSASVGDRVTITCRASQVISKYLAWFQQKPGKAPKSLIYAASSLQSGAPSKFSGSGSGTDFTLTISSLQPEDFATYYCQQYSNYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDGSYGYDGLDYWGQGTLVTVSS |
| | | | SEQ ID NO: 25810 | SEQ ID NO: 29816 |
| iPS:434617 | 21-225_74B8 | NA | GACAGCGTGATGACCCAGTCTCCAGACTCCCTGGCTGTGTCTCTGGGCGAGAGGGCCACCATCAACTGCAAGTCCAGCCAGAGTGTTTTACACAGCTCTAATAAAAGAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGTCTGCAGGCTGAAGATGTGGCAGTTTATTACTGTCAGCAATATTATAGGACTCCGTTCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGAACCCTAATAGTGGTAACACAGGCTATGCACAGAAGTTCCAGGCAGAGTCACCCTGACCAGAGAACACCTCCATAAGCACAGCCTACATGGAGCTGAGCAGCCTGAGATCTGAGGACACGGCCGTGTATTACTGTGCGGTTTCCAGTGGCTGGTACTGGTTCGACCCCTGGGGCCAGGGAACCCTGGTCACCGTCTCCTCA |
| | | | SEQ ID NO: 25811 | SEQ ID NO: 29817 |

FIGURE 50
(Continued)

| | | | | |
|---|---|---|---|---|
| iPS:434619 | 21-225_78C1 | AA | DSVMTQSPDSLAVSLGERATINCKSSQSVLHSSN KKNYLAWYQQKPGQPPKLLIYWASTRESGVPD RFSGSGSGTDFTLTISSLQAEDVAVYYCQQYYRT PWTFGQGTKVEIK | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS |
| | | | SEQ ID NO: 25812 | SEQ ID NO: 29818 |
| | | NA | GACATCGTGATGACCCAGTCTCCAGATTGCCT GGCTGTGTCTCTGGGCGAGAGGGCCACCATCA ACTGCAAGTCCAGCCAGAGTGTTTTATACACC TCCAACAATAACAGGACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGGAAGTTTGTCCAAGGG ACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGCACAGAAGTTCCAGGGCAG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA |
| | | | SEQ ID NO: 25813 | SEQ ID NO: 29819 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWKFVQGTKVEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25814 | SEQ ID NO: 29820 |

FIGURE 50
(Continued)

| | | | | |
|---|---|---|---|---|
| iPS:434621 | 21-225_74D1 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGAAAT TTAGCCTGGTTCCAGCAGAAACCTGGCCAGGC TCCCAGGCTCCTCATCTATGGTGCATCATCA GGGCCACTGGTATCCCAGCAGAGTTCAGTGGC AGTGGGTCTGGGACAGAGTTCACTCTCACCAT CTACAGCCTGCAGTCTGAAGATTTTGCAGTTT ATTACTGTCAGCAGTATAATAACTGGCCTCCG CTCACTTTCGGCGGAGGGACCAAGGTGGAGAT CAAA <br><br> SEQ ID NO: 25815 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAGT AATAAATACCATGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATGAGGG GTTCGGGGAGTTCGACTACTACAACTACGGTATG GACGTCTGGGGCCAAGGGACCACGGTCACCGTC TCCTCA <br><br> SEQ ID NO: 29821 |
| | | AA | EIVMTQSPATLSVSPGERATLSCRASQSVSRNLA WFQQKPGQAPRLLIYGASIRATGIPARFSGSGSG TEFTLTIYSLQSEDFAVYYCQQYNNWPPLTFGG GTKVEIK <br><br> SEQ ID NO: 25816 | QVQLVESGGGVVQPGRSLRLSCAASGFTFSSYGMH WVRQAPGKGLEWVAVIWYDGSNKYHADSVKGRF TISRDNSKNTLYLQMNSLRAEDTAMYYCARDEGF GEFDYYNYGMDVWGQGTTVTVSS <br><br> SEQ ID NO: 29822 |
| iPS:434629 | 21-225_74C3 | NA | GAAATAGTGATGACGCAGTCTCCAGCCACCCT GTCTGTGTCTCCAGGGGAAAGAGCCACCCTCT CCTGCAGGGCCAGTCAGAGTGTTGCCAGCAGC TTAGCCTGGTACCAGCAGAAACCTGGCCAGGC TCCCAGGCTCCTCATCTATGGTACTACCACCAG GGCCACTGGTATCCCAGCCAGGTTCAGTGGCA GTGGGTCTGGGACAGAGTTCACTCTCATAATC AGCAGCCTGCAGTCTGAAGATTTTGCAGTTTA TTACTGTCAGCAGTATAATGACTGGCCTGCA GTTTTGGCCTGGGGACCAAGCTGGAGATCAAA <br><br> SEQ ID NO: 25817 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTGGCAT GCACTGGGCCCGCCAGGCTCCAGGCAAGGGGCT GGAATGGGTGGCAGCTATTTGGTATGATGAAGT AATAAATACTGTGCAGACTCCGTGAAGGGCCGA TTCACCATCTCCAGAGACAATTCCAAGAACACAC TGTCTCTGCAAATGAACAGCCTGAGAGCCGAGG ACTCGGCTGTGTATTACTGTGCGAGAGATCGGAG TATACTGGGAGCTGTCTTCTTTGACTACTGGGGC CAGGGAACCCTGGTCACCGTCTCCTCA <br><br> SEQ ID NO: 29823 |

FIGURE 50
(Continued)

| | | | | |
|---|---|---|---|---|
| | | AA | EIVMTQSPATLSVSPGERATLSCRASQSVASSLAWYQQKPGQAPRLLIFGTSTRATGIPARFSGSGSGTEFTLIISSLQSEDFAVYYCQQYNDWPCSFGLGTKLEIK | QVQLVESGGGVVQPGRSLRLSCAASGFTFSSFGMHWARQAPGKGLEWVAAIWYDGSNKYCADSVKGRFTISRDNSKNTLSLQMNSLRAEDSAVYYCARDRSILGAAFFDYWGQGTLVTVSS |
| | | | SEQ ID NO: 25818 | SEQ ID NO: 29824 |
| iPS:434633 | 21-225_74G8 | NA | GAAATTGTGTTGACGCAGTCTCCAGGCACCCTGTCTTTGTCTCCAGGGGAAAGAGCCACCCTCTCCTGCAGGGCCAGTCAGAGTTTAGCAGCGCCTACTTAGCCTGGTACCAGCAGAAACCTGGCCAGGCTCCCAGGCTCCTCATCTATGGTACTTCAGCAGGGCCACTGGCATCCCAGACAGGTTCAGTGGCAGTGGGTCTGGGACAGATTTCACTCTCACCATCGCAGACTGGAGCCTGAAGATTTTGCAGTGTATTACTGTCAACAGTATGGTAACTCAAGGACGTTCGGCCAAGGGACCAAGGTGGAAATCAAA | GAGGTGCAGCTGGTGGAGTCTGGGGGAGGCTTGGTAAAGCCTGGGGGGTCCCTTAGACTCTCCTGTGCAGCCTCTGGATTCACTTTCAGTAGCTTTGGCATGCACTGGGTCCGCCAGGCTCCAGGGAAGGGGCTGGAGTGGGTTGGCCGTATTAAAAAACAAGCTGATGGTGGGACAACAGACTACGCTGCACCCGTGAAGGCAGATTCACCATCTCAAGAGATGATTCAAAAACACGCTGTATCTGCAAATGAACAGCTGAAACCGAGGACACAGCCGTGTATTACTGTGCCACCAGTGGGAGCTACTACGGACTACTGGGGCCAGGAACCCTGGTCACCGTCTCCTCA |
| | | | SEQ ID NO: 25819 | SEQ ID NO: 29825 |
| | | AA | EIVLTQSPGTLSLSPGERATLSCRASQSFSSAYLAWYQQKPGQAPRLLIYGTSSRATGIPDRFSGSGSGTDFTLTIGRLEPEDFAVYYCQQYGNSRTFGQGTKVEIK | EVQLVESGGGLVKPGGSLRLSCAASGFTFSNAWMNWVRQAPGKGLEWVGRIKNKADGGTTDYAAPVKGRFTISRDDSKNTLYLQMNSLKTEDTAVYYCTTVGATTDYWGQGTLVTVSS |
| | | | SEQ ID NO: 25820 | SEQ ID NO: 29826 |

FIGURE 50
(Continued)

| | | | |
|---|---|---|---|
| iPS:434635 | 21-225_78E6 | NA | GACATGTGTGATGACCCAGTCTCCAGACTCCCT GGCTGTGTCTCTGGGCGAGAGGGCCACCATCA ACTGCAAGTCCAGCCAGAGTGTTTGTACAGC TCCAACAGTCACAACTACTTAGCTTGGTACCA GCAGAAACCAGGACAGCCTCCTAAACTGCTCA TTTACTGGGCATCTATCCGGGAATCCGGGGTC CCTGACCGATTCAGTGGCAGCGGGTCTGGGAC AGATTTCACTCTCTCCATCAGCAGCCTGCAGG CTGAAGATGTGGCAGTTATTACTGTCAGCAA TATTATAGTACTCCGTGCAGTTTTGGCCAGGG GACCAAGCTGGAGATCAAA |
| | | | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGAC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACTGGCCGTATATTACTGTGCGTATAGTAGT GGCTGGTACAAATTTGACTACTGGAGCCAGGGA ACCCTGGTCACCGTCTCCTCA |
| | | | SEQ ID NO: 25821 |
| | | AA | DIVMTQSPDSLAVSLGERATINCKSSQSVLYSSN SHNYLAWYQQKPGQPPKLLIYWASIRESGVPDR FSGSGSGTDFTLTISSLQAEDVAVYYCQQYYSTP CSFGQGTKLEIK |
| | | | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS |
| | | | SEQ ID NO: 25822 |
| | | | SEQ ID NO: 29828 |
| iPS:434637 | 21-225_78E7 | NA | GAAATTGTGTTGACGCAGTCGCCAGGCACCCT GTCTTTGTCTCCAGGGGAGAGAGCCACCCTCT CCTGCAGGGCCAGTCAGAATGTTGACAGCAAC TACTTAGCCTGGTACCAGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTACTGTCAGCAGTATGAACGCTCACCG TGGACGTTCGGCCAAGGGACCAAGGTGGAAA TCAAA |
| | | | CAGGTGCAGCTACAGCAGTGGGGCGCAGGACTG TTGAAGCCTTCGGAGACCCTGTCCCTCACCTGCG CTGTCTATGGTGGGTCCATCAGTGGTTCCTACTG GAGCTGGATCCGCCAGCCCCAGGGAAGGGGCT GGAGTGGATTGGGAAATCAATCTTAGTGGAAG CACCAACTACAACCCGTCCCTCAAGAGTCGAGTC ACCATATCAGTAGACACGTCCAAGAGCCAGTTCT CCCTGACGCTCTGTGACCGCCGCGGACAC GGCTGTGTATTACTGTGCGAGAGACTACGGTGGC CTTGACTACTGGGGCCAGGGAACCCTGGTCACCG TCTCCTCA |
| | | | SEQ ID NO: 25823 |
| | | | SEQ ID NO: 29829 |

FIGURE 50
(Continued)

| | | | |
|---|---|---|---|
| iPS:434639 | 21-225_74B7 | AA | EIVLTQSPGTLSLSPGERATLSCRASQNVDSNYLAWYQQKPGQAPRLLIYGASSRATGIPDRFSGSGSGTDFTLTISRLEPEDFAVFYCQQYERSPWTFGQGTKVEIK<br>SEQ ID NO: 25824 | QVQLQQWGAGLLKPSETLSLTCAVYGGSLSGSYWSWIRQPPGKGLEWIGEINLSGSTNYNPSLKSRVTISVDTSKSQFSLTLRSVTAADTAVYYCARDYGGLDYWGQGTLVTVSS<br>SEQ ID NO: 29830 |
| | | NA | GACATCGTGATGACCCAGTCTCCAGACTCCCTGGCTGTGTCTCTGGGCGAGAGGGCCACCATCAACTGCAAGTCCAGCCAGAGTGTTTACACAGCTCCAACAATTATAACTACTTAGTTGGTACCAGCAGAAGCCAGGACAGCCCCCTAAGGTGCTCATTTACTGGACATCTACCCGGGAATCCGGGGTCCCTGACCGATTCAGTGGCAGGGGTCTGGAACAGATTTCACTCTCACCATCAGCAGCCTGCAGGCTGAAGATGTGGCAGTTTATTACTGTCAGCAATATTTTAGTAGTCCTCCGACGTTCGGCCAAGGGACCAAGGTGGAAATCAAA<br>SEQ ID NO: 25825 | CAGGTGCAGCTGGTGCAGTCTGGGGCTGAGGTGAAGAAGCCTGGGGCTCAGTGAAGGTCTCTGCAAGGCTTCTGGATACACCTTCCCAATTATGATATCAACTGGGTGCGACAGGCCACTGGACAAGGCTTGAGTGGATGGGATGAACCCTAACAGTGGTAACACAGGCTATGCACAGAAGTTCCAGGGCAGAGTCACCATGACCAGGAACACCTCCATAAGCAGCCTACATGGAGCTGAGCAGCCTGAGATCTGAGGACACGGCCGTGTATTATTGTGCGGTTTCCAGTGGCTGCACTGGTTCGACCCCTGGGGCCAGGGAACCCTGGTCACCGTCGCCTCA<br>SEQ ID NO: 29831 |
| | | AA | DIVMTQSPDSLAVSLGERATINCKSSQTVLHSSNNYNYLAWYQQKPGQPPKVLIYWFSTRESGVPDRFSGSGSGTDFTLTISSLQAEDVAVYYCQQYFSSPPTFGQGTKVEIK<br>SEQ ID NO: 25826 | QVQLVQSGAEVKKPGASVKVSCKASGYTFPNYDINWVRQATGQGLEWMGWMNPNSGNTGYAQKFQGRVTMTRNTSISTAYMELSSLRSEDTAVYYCAVSSGWHWFDPWGQGTLVTVAS<br>SEQ ID NO: 29832 |

FIGURE 50
(Continued)

| | | | | |
|---|---|---|---|---|
| iPS:434649 | 21-225_78E11 | NA | GACATCGTGATGACCCAGTCTCCAGACTCCCT GGCTGTGTCTCTGGGCGAGAGGGCCACCATCA ACTGCAAGTCCAGCGAGAGTGTTTATACAGC TTCAACAATTACAACTACTTAGCTTGGTACCA GCAGAAACCAGGACAGCCTCCTAAGAAGCTC ATTTACTGGGCATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTCCTGTCAGCA ATATTATAGTAGTCCGACGTTCGGCCAAG GGACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTGTGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGTAGCA GTGGCTGGAACTTCTTTGACTACTGGGGCCAGGG AACCCTGGTCACCGTCTCCTCA |
| | | | SEQ ID NO: 25827 | SEQ ID NO: 29833 |
| | | AA | DIVMTQSPDSLAVSLGERATINCKSSQSVLYSFN NYNYLAWYQQKPGQPPKKLIYWASTRESGVPD RFSGSGSGTDFTLTISSLQAEDVAVYSCQQYYSS PPTFGQGTKVEIK | QVQLVQSGAEVKKPGASVKVSCKASGYTFTNYDIN WVRQATGQGLEWMGWMNPNSGNTGCAQKFQGR VTMTRNTSISTAYMELSSLRSEDTAVYYCASSSGW NFFDYWGQGTLVTVSS |
| | | | SEQ ID NO: 25828 | SEQ ID NO: 29834 |
| iPS:434653 | 21-225_74B5 | NA | GACATCGTTATGACCCAGTCTCCAGACTCCCT GGCTGTGTCTCTGGGCGAGAGGGCCACCATCA ACTGCAAGTCCAGCGAGAGTGTTTATTCAGC TCCAACAATTATAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATTATAGTTCTCCGACGTTCGGCCAAGG GACCACGGTGCAAATCAAA | CAGGTGCAGTTGGTGCAGTCTGGGGCTGAGGTGA AGAAGCCTGGGGCCTCCAGTGAAGGTCTCCTGCA AGGCTTCTGGATACACCTTCACCAATTATGATAT CAACTGGGTGCGACAGGCCACTGGACAAGGGCT TGAGTGGATGGGATGGATGCACAGAAGTTCCAGGCAG TAACACAGGCTATGCACAGGAACACCTCCACAAGCAC AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAACTGGTTCGACCCTGGGGCCAGGA ACCCTGGTCACCGTCTCCTCA |
| | | | SEQ ID NO: 25829 | SEQ ID NO: 29835 |

FIGURE 50
(Continued)

| | | | | |
|---|---|---|---|---|
| iPS:434655 | 21-225_78H12 | AA | DIVMTQSPDSLAVSLGERATINCKSSQSVLFSSN NYNYLAWYQQKPGQPPNLLIYWASTRESGVPD RFSGSGSGTDFTLTISSLQAADVAVYYCQQYYSS PPTFGQGTTVQIK<br>SEQ ID NO: 25830 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br>SEQ ID NO: 29836 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTACACAGC TTCAACAATTATAACTACTTAGCTTGGTACCA GCAGAAGCCAGGACAGCCCCTAAGGTGCTC ATTTACTGGACATCTACCCGGGAATCCGGGT CCCTGACCGATTCAGTGGCAGCGGGTCTGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br>SEQ ID NO: 25831 | CAGGTGCAGCTGGTGCAGTCTGGGGCTGAGGTG AAGAAGCCTGGGGCTCAGTGAAGGTCTCCTGC AAGGCTTCTGGATACACCTTCCCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA<br>SEQ ID NO: 29837 |
| | | AA | DIVMTQSPDSLAVSLGERATINCKSSQTVLHSFN NYNYLAWYQQKPGQPPKVLIYWTSTRESGVPD RFSGSGSGTDFTLTISSLQAEDVAVYYCQQYFSS PPTFGQGTKVEIK<br>SEQ ID NO: 25832 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br>SEQ ID NO: 29838 |

FIGURE 50
(Continued)

| | | | | |
|---|---|---|---|---|
| iPS:434657 | 21-225_79G1 | NA | GAAATTGTGTTGACGCAGTCTCCAGGCACCCTGTATTTGTCTCCAGGGGAAAGAGCCACCCTCTCCTGCAGGGCCAGTCAGTCAGAGTGTTTACAGCAGCTACTTAGCCTGGTACCAGCAGAAACCTGCCCAGGCTCCCAGGCTCCTCATTTATGGTGCATCCAGCCGGTCCACTGGCATCCCAGACAGGTTCAGTGGCAGTGGGTCTGGGACAGACTTCGCTCTCACCATCAGCAGACTGGAGCCTGAAGATTTTGCAGTGTATTACTGTCAGCACTATGATAATCACCGTGGACGTTCGGCCAAGGGACCAAGGTGGAAATCAAA | CAGGTGCAGCTACAGCAGTGGGGCGCAGGACTGTTGAAGCCTTCGGAGACCCTGTCCCTCACCTGCGCTGTCCATGGTGGGTCTTCAGTGGTTGTACTGAGCTGGATCCGCCAGCCCCAGGGAAGGGGCTGGAGTGGATTGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA |
| | | | SEQ ID NO: 25833 | SEQ ID NO: 29839 |
| | | AA | EIVLTQSPGTLYLSSGERATLSCRASQSVYSSYLAWYQQKPAQAPRLLIYGASSRSTGIPDRFSGSGSGTDFALTISRLEPEDFAVYYCQHYDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 25834 | SEQ ID NO: 29840 |
| iPS:434663 | 21-225_79F3 | NA | GAAATTGTGTTGACGCAGTCTCCAGGCACCCTGTATTTGTCTCCAGGGGAAAGAGCCACCCTCTCCTGCAGGGCCAGTCAGAGTGTTTACAGCAGCTACTTAGCCTGGTACCAGCAGAAACCTGCCCAGGCTCCCAGGCTCCTCATCTATGGTGCATCCAGCCGGTCCACTGGCATCCCAGACAGGTTCAGTGGCAGTGGGTCTGGGACAGACTTCGCTCTCACCATCAGCAGACTGGAGCCTGAAGATTTTGCAGTGTATTACTGTCAGCACTACTGATGATAACTCACCGTGGACGTTCGGCCAAGGGACCAAGGTGGAAATCAAA | CAGGTGCAGCTACAGCAGTGGGGCGCAGGACTGTTGAAGCCTTCGGAGACCCTGTCCCTCACCTGCGCTGTCCATGGTGGGTCTTCAGTGGTTGTACTGAGCTGGATCCGCCAGCCCCAGGGAAGGAAGGGCTGGAGTGGATTGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA |
| | | | SEQ ID NO: 25835 | SEQ ID NO: 29841 |

FIGURE 50
(Continued)

| | | | | |
|---|---|---|---|---|
| iPS:434665 | 21-225_74G4 | AA | EIVLTQSPGTLYLSPGERATLSCRASQSVYSSYLA WYQQKPAQAPRLLIYGASSRSTGIPDRFSGSGSG TDFALTISRLEPEDFAVYYCQHYDNSPWTFGQG TKVEIK<br>SEQ ID NO: 25836 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29842 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGT TCCAACAATAATAACTACTTAGCTTGGTACCA GCAGAAGGCAGGACAGCCTCCTAAGCTGCTCA TTTACTGGGCATCTACCCGGGAATCCGGGTC CCTGACCGATTCAGTGGCAGCGGGTCTGGGAC AGATTTCACTCTCACCATCAGCAGCCTGCAGG CGGAAGATGTGGCAGTTTATTACTGTCAGCAA TATTATAGTATTCCTCCGACGTTCGGCCAAGG GACCAAGGTGGAAATCAAA<br>SEQ ID NO: 25837 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATG TCAACTGGGTGCGACAGGCCACTGGACAAGGC TTGAATGGATGGGATGCACCTAACAGTGG TAACACAGGCTATGCACAGAAGTTCCAGGGCAG AGTCACCATGACCAGGAACACCTCCATACGAC AGCCTACATGGAGCTGAGCAGCCTGAGATCTGA GGACACGGCCGTGTATTACTGTGCGAGTAGCAGT GGCTGGTACCATTTTGACTACTGGGGCCAGGGAA CCCTGGTCACCGTCTCCTCA<br>SEQ ID NO: 29843 |
| | | AA | DIVMTQSPDSLAVSLGERATINCKSSQSVLYSSN NNNYLAWYQQKAGQPPKLLIYWASTRESGVPD RFSGSGSGTDFTLTISSLQAEDVAVYYCQQYYSI PPTFGQGTKVEIK<br>SEQ ID NO: 25838 | QVQLVQSGAEVKKPGASVKVSCKASGYTFTNYDV NWVRQATGQGLEWMGWMHPNSGNTGYAQKFQG RVTMTRNTSIRTAYMELSSLRSEDTAVYYCASSSG WYHFDYWGQGTLVTVSS<br>SEQ ID NO: 29844 |

FIGURE 50
(Continued)

| | | | | |
|---|---|---|---|---|
| iPS:434669 | 21-225_79F4 | NA | GACATCCAGATGACCCAGTCTCCATCCTCACT GTCTGCATCTGTAGGAGACAGAGTCACCATCA CTTGTCGGGCGAGTCAGGGCATTAGCAAGTAT TTAGCCTGGTTTCAGCAGAAACCAGGAAAGC CCCTAAGTCCCTGATCTATGCTGCATCCAGTTT GCAAGGTGGGGCCCCATCTAAGTTCAGCGGCA GTGGATCTGGGACAGATTTCACTCTCACCATC AGCAGCCTGCAACAGTACAGTAATTTGCAACTTA TTACTGCCAACAGTACAGTAATTACCCACTCA CTTTCGGCGGAGGGACCAGGGTGGAGATCAA A | CAGGTGCAGTTGGTGGAGTCTGGGGGAGGCGTG GTCCAGTCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATGGTATGATGAAGT AATCAAAACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATACTGTGCGAGAGATGGCA GCTATGGTTATGACGGCCTTGACTACTGGGGCCA GGGAACCCTGGTCACCGTCTCCTCA |
| | | AA | DIQMTQSPSSLSASVGDRVTITCRASQGISKYLA WFQQKPGKAPKSLIYAASSLQGGAPSKFSGSGS GTDFTLTISSLQQPEDFATYCQQYSNYPLTFGGG TRVEIK | QVQLVESGGGVVQSGRSLRLSCAASGFTFSNYGM HWVRQAPGKGLEWVAVIWYDGSNQNYADSVKGR FTISRDNSKNTLFLQMNSLRAEDTAVYYCARDGSY GYDGLDYWGQGTLVTVSS |
| | | | SEQ ID NO: 25839 | SEQ ID NO: 29845 |
| | | | SEQ ID NO: 25840 | SEQ ID NO: 29846 |
| iPS:434671 | 21-225_74F4 | NA | GAAATTGTGTTGACGCAGTCTCCAGGCACCCT GTCTTTGTCTCCAGGGGAAAGAGCCACCCTCT CCTGCAGGGCCAGTCAGAGTTTTAGCAGCAGC TACTTAGCCTGGTACCAGCAGAAACCTGGCCA GCTCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTCACGG ACGTTCGGCCAAGGGACCAAGGTGGAAATCA AA | GAGGTGCAGCTGGTGGAGTCTGGGGGAGGCTTG GTAAAGCCTGGGGGGTCCTTAGACTCTCCTGTG CAGCCTCTGGATTCACTTCAGTAACGCTGGAT GAACTGGGTCCGCCAGGCTCCAGGAAGGGCT GGAGTGGGTTGGCGAATTAAAAACAAAATTGA TGGTGGACAACAGACTACGCTGCACCGTGAA AGGCAGATTCACCATCTCAAGAGATGATTCAAA AAACACGCTGTATCTGCAAATGAACAGCCTGAA AACCGAGGACACAGCCGTGTATTACTGTACCACA GTGGGAGCTACTACGGACTACTGGGGCCAGGGA ACCCTGGTCACCGTCTCCTCA |
| | | | SEQ ID NO: 25841 | SEQ ID NO: 29847 |

FIGURE 50
(Continued)

| | | | |
|---|---|---|---|
| iPS:434673 | | AA | EIVLTQSPGTLSLSPGERATLSCRASQIFSSSYLAWYQQKPGQSPRLLIYGASSRATGIPDRFSGSGSGTDFTLTISRLEPEDFAVYYCQQYGSSRTFGQGTKVEIK | EVQLVESGGGLVKPGGSLRLSCAASGFTFSNAWMNWVRQAPGKGLEWVGRIKNKIDGGTTDYAAPVKGRFTISRDDSKNTLYLQMNSLKTEDTAVYYCTTVGATTDYWGQGTLVTVSS |
| | | | SEQ ID NO: 25842 | SEQ ID NO: 29848 |
| | | NA | GAAATAGTGATGACGCAGTCTCCAGCCACCCTGTCTCTGTCTCCAGGGGAAAGAGCCACCCTCCCTGCAGGGCCAGTCTGAGTGTTGTCAACAGCTTAGCCTGTACCAGCAGAAACCTGGCCAGGCTCCCAGGCTCCTCATCTATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATATAATGACTGGCCGTGCATTACTGTCAGCAGTATAATAATGACTGGCCGTGCAGTTTTGGCCAGGGGACCAAGCTGGAGATCAAA | CAGGTGCAGCTGGTGGAGTCTGGGGGAGGCGTGGTCCAGCCTGGGAGGTCCCTGAGACTCTCCTGTACACGCTCTGATTCACCTTCACTGTAGCTATGGCATGCACTGGGTCCGCCAGGCTCCAGGCAAGGGGCTGGAGTGGGTGGCAGTTATTGGTATGATGGAAGTAATAAATACTATGCAGACTCCGTGAAGGGCCGATTCACCATCTCCAGAGACAATTCCAAGAACACGCTGTTTCTGCAAATGAACAGCCTGAGAGCCGAGACACGGCTGTGTATTACTGTGCGAGCGATCGCAATATAGTGGGAGCTACTTACTTTGAGTCCTGGGGCCAGGGAACCCTGGTCACCGTCTCCTCA |
| | | | SEQ ID NO: 25843 | SEQ ID NO: 29849 |
| | 21-225_74E3 | AA | EIVMTQSPATLSLSPGERATLSCRASLSVVNSLAWYQQKPGQAPRLLIYGASTRATGIPARFSGSGSGTEFTLTISSLQSEDFAIYYCQQYNDWPCSFGQGTKLEIK | QVQLVESGGGVVQPGRSLRLSCTASGFTFSSYGMHWVRQAPGKGLEWVAVIWYDGSNKYYADSVKGRFTISRDNSKNTLFLQMNSLRAEDTAVYYCASDRNIVGATYFESWGQGTLVTVSS |
| | | | SEQ ID NO: 25844 | SEQ ID NO: 29850 |

FIGURE 50
(Continued)

| | | | |
|---|---|---|---|
| iPS:434675 | 21-225_79G6 | NA | GACATCGTGATGACCCAGTCTCCAGACTGCCTGGCTGTGTCTCTGGGCGAGAGGGCCACCATCAGCTGCATGTCCAGCAGAGTGTTTACACAGCTTCAACAATAAGAACTACTTAACTTGGTACCAGCAGAAACCAGGACAGCCTCCTAAGCTGCTCATTTACTGGGCATCTACTTGGGAATCCGGGGTCCCTGACCGATTCAGTGGCAGCGGGTCTGGGACAGATTTCAGTCTCCCGATCGGCAGCCTGCAGGCTGAAGATGTGGCAGTTTATTACTGTCAGCAATATTATAGTATTCCTCCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATTCACCTTCACCAATTATGATATCAACTGGGTGCGACAGGCCACTGGACAAGGCTTGAGTGGATGGGATGGATGCACCTAACAGTGGTAACACAGGCTTTGCACAGAAGTTCCAGGGCAGAGTCACCATGACCAGGAACACCTCCATAAGCACAGCCTACATGGAACTGAGCAGCCTGAGATCTGAGGACACGGCCGTGTATTACTGTGCGGGTTTCCAGTGGCTGGTACTGGTTGACCCCTGGGGCCAGGGAACCCTGGTCACCGTCCTCTCA |
| | | | SEQ ID NO: 25845 | SEQ ID NO: 29851 |
| | | AA | DIVMTQSPDCLAVSLGERATISCMSSQSVLHSFNNKNYLTWYQQKPGQPPKLLIYWASTWESGVPDRFSGSGSGTDFSLPIGSLQAEDVAVYYCQQYYSIPPTFGQGTKVEIK | QVQLVQSGAEVKKPGASVKVSCKASGFTFTNYDINWVRQATGQGLEWMGWMHPNSGNTGFAQKFQGRVTMTRNTSISTAYMELSSLRSEDTAVYYCAVSSGWYWFDPWGQGTLVTVSS |
| | | | SEQ ID NO: 25846 | SEQ ID NO: 29852 |
| iPS:434679 | 21-225_79G7 | NA | GACATCGTGATGACCCAGTCTCCAGACTGCCTGGCTGTGTCTCTGGGCGAGAGGGCCACCATCAGCACTGCAAGTCCAGCAGAGTGTTTGTACAGCTCCAACAGTCACAACTACTTAGCTTGGTACCAGCAGAAACCAGGACAGCCTCCTAAACTGCTCATTTTCTGGGCATCTATCCGGGAATCCGGGGTCCCTGACCGATTCAGTGGCAGCGGGTCTGGGACAGATTTCACTCTCCATCAGCAGCATGCAGGCTGAAGATGTGGCAGTTTATTACTGTCAGCAACTGTAGTACTCCGTGCAGTTTGGCCAGGGGACCAAGGTGGAGATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCTCTGGACAAGGACTTGAGTGGATGGGATGCACCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACTCGGCCGTATATTACTGTGTCGTATAGTAGTGGCTGGTACAATTTGACTACTGGAGCCAGGGAACCCTGGTCACCGTCTCCTCA |
| | | | SEQ ID NO: 25847 | SEQ ID NO: 29853 |

FIGURE 50
(Continued)

| | | | | |
|---|---|---|---|---|
| iPS:434685 | | AA | DIVMTQSPDSLAVSLGERATINCKSSQSVLYSSN SHNYLAWYQQKPGQPPKLLIFWASIRESGVPDR FSGSGSGTDFTLSISSMQAEDVAVYYCQQYYSTP CSFGQGTKLEIK<br><br>SEQ ID NO: 25848 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br><br>SEQ ID NO: 29854 |
| | 21-225_79E9 | NA | GACATCGTGATGACCCAGTCTCCAGACTCCCT GGCTGTGTCTCTGGGCGAGAGGGCCACCATCA ACTGTAAGTCCAGCCAGAGTATTTATACAGC TCCAACAATAATAACTACTTAGCTTGGTTCCA GCAGAAACCAGGACAGCCTCCTAAGCTGCTCA TTTATTGGGCATCTCACCCGGGAATCCGGGGTC CCTGACCGATTCAGTGGCAGCGGGTGTGGGAC AGATTTCACTCTCACCATCAGCAGCCTGCAGG CTGAAGATGTGGCAGTTTATTACTGTCAGCAA TATTATATTACTCCTCCGACGTTCGGCCAAGG GACCAAGGTGGAAATCAAA<br><br>SEQ ID NO: 25849 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCATCCTAACAGTGG TAACACAGGCTATGCACAGAAGTTCCAGGGCAG AGTCACCATGACCAGGAACACCTCCATAAGCAC AGCCTACATGGAACTGAGCAGCCTGAGATCTGA GGACACGGCCGTGTATTACTGTGCGAGTAGCAGT GGCTGGTACTACTTTGACTACTGGGGCCAGGGAA CCCTGGTCACCGTCTCCTCA<br><br>SEQ ID NO: 29855 |
| | | AA | DIVMTQSPDSLAVSLGERATINCKSSQSILYSSNN NNYLAWFQQKPGQPPKLLIYWASTRESGVPDRF SGSGCGTDFTLTISSLQAEDVAVYYCQQYYITPP TFGQGTKVEIK<br><br>SEQ ID NO: 25850 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YYFDYWGQGTLVTVSS<br><br>SEQ ID NO: 29856 |

FIGURE 50
(Continued)

| | | | |
|---|---|---|---|
| iPS:4334687 | 21-225_75A5 | NA | GAAATTGTTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA<br><br>SEQ ID NO: 25851 | CAGGTGCAGTGCAGTCTGGGGGCGCAGGACTG TTGAAGCCTTCGGAGACCTCTGCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCGTCCTCCAAGAGTCGAGTC ACCATTTCAGTAGACACGTCCAAGAACCAGTTCT CCCTGAAGCTGAGCTCTGTGCAGGGACTACGGCGGT GGCTGTGTATTACTGTGCGAGGGACTACGGCGGT ATGGACGTCTGGGGCCAAGGGACCACGGTCACC GTCTCCTCA<br><br>SEQ ID NO: 29857 |
| | | AA | EIVLTQSPGTLYLSPGERATLSCRASQSVYSSYLA WYQQKPGQAPRLLIYGASSRATGIPDRFSGSGSG TDFALTISRLEPEDFAVYYCQHYDNSPWTFGQG TKVEIK<br><br>SEQ ID NO: 25852 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29858 |
| iPS:4334689 | 21-225_79G10 | NA | GACATCGTTATGACCCAGTCTCCAGACTCCCT GGCTGTGTCTCTGGGCGAGAGGGCCACCATCA ATTGCAAGTCCAGCCAGAGTGTTTATTCAGC TCCAACAATTATAATTACTTAGCTTGGTACCA GCAGAGACCAGGACAGCCTCATAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCTCCTCGACGTTCGGCCAAGG GACCACGGTGCAAATCAAA<br><br>SEQ ID NO: 25853 | CAGGTGCAGTGGGGCAGTCTGGGGCTGAGGTGA AGAAGCCTGGGGCTCAGTGAAGGTCTCCTGCA AGGCTTCTGGATACACCTTCACCAATTATGATAT CAACTGGGTGCGACAGGCCACTGGACAAGGGCT TGAGTGGATGGGATGGATGAACCTAACAGTGG TAACACAGGCTATGCACAGAAGTTCAGGGCAG AGTCACCATGACCAGGAACACCTCCACAAGCAC AGCCACATGGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCTCCTCA<br><br>SEQ ID NO: 29859 |

FIGURE 50
(Continued)

| | | | |
|---|---|---|---|
| | | AA | DIVMTQSPDSLAVSLGERATINCKSSQSVLFSSN NYNYLAWYQQRPGQPHNLLIYWASTRESGVPD RFSGSGSGTDFTLTISSLQAADVAVYYCQQYHSS PLTFGQGTTVQIK<br>SEQ ID NO: 25854 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br>SEQ ID NO: 29860 |
| iPS:434691 | 21-225_75G7 | NA | GAAATTGTGTTGACGCAGTCTCCAGGCACCCT GTCTTTGTCTCCAGGGGAAAGAGCCACCCTCT CCTGCAGGGCCAGGCAGAGTGTTGACAGCAGT TATTTAGCCTGGTACCAGCAGAAACGTGGCCA GGCTCCCAGGCTCCTCATCTATGTGCATCCA GCAGGGCCACTGCATCCCAGACAGGTTCAGT GGCAGTGGGTCTGGGACAGACTTCACTCTCAC CATCAGCAGGCTGGAGCCTGAAGATTTTGCAG TATATTACTGTCAGCAGTATGAAAGCTCACCG TGGACGTTCGGCCAAGGGACCAAGGTGGAAA TCAAA<br>SEQ ID NO: 25855 | CAGGTGCAGCTACAGCAGTGGGGCGCAGGACTG TTGAAGCCTTCGGAGACCCTGTCCCTCACCTGCA CTGTCTCTATGTGGGGCCTTCAGTGGTTCCTACTG GAGCTGGATCCGCCAGTCCCAGGGAAGGGCT GGAGTGGATTGGGGAAATCAATTATAGGGGAAG CACCAACTACAACCCGTCCCTCAAGAGTCGAGTC ACCATATCAGTAGACACGTCAAGAACCAGTTCT CCCTGAACCTGAGCTCTGTGACCGCCGCAGACAC GGCTGTGTATTACTGTGCGAGGGACTACGGCGGT ATGGACGTCTGGGGCCAAGGGACCACGGTCACC GTCTCCTCA<br>SEQ ID NO: 29861 |
| | | AA | EIVLTQSPGTLSLSPGERATLSCRARQSVDSSYLA WYQQKRGQAPRLLIYGASSRATGIPDRFSGSGSG TDFTLTISRLEPEDFAVYYCQQYESSPWTFGQGT KVEIK<br>SEQ ID NO: 25856 | QVQLQQWGAGLLKPSETLSLTCTVYGGAFSGSYW SWIRQSPGKGLEWIGEINYRGSTNYNPSLKSRVTIS VDTSKNQFSLNLSSVTAADTAVYYCARDYGGMDV WGQGTTVTVSS<br>SEQ ID NO: 29862 |

FIGURE 50
(Continued)

| | | | |
|---|---|---|---|
| iPS:434693 | 21-225_79F11 | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCCATTATGTGTCATCCA GCCGGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGGAAAT CAAA<br>SEQ ID NO: 25857 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCGCCAGCCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGT ATGGACGTCTGGGGCCAAGGGACCACGGTCACC GTCTCCTCA<br>SEQ ID NO: 29863 | EIVLTQSPGTLSLSPGERATLSCRASQSVYSSYLA WYQQKPGQAPRLLIYGASSRATGIPDRFSGSGSG TDFALTISRLEPEDFAVYYCQHSDNSPWTFGQGT KVEIK<br>SEQ ID NO: 25858 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29864 |
| iPS:434697 | 21-225_79F12 | NA | GACATCGTGATGACCCAGTCTCCAGACTCCCT GGCTGTGTCTCTGGGCGAGAGGGCCACCATCA ACTGCAAGTCCAGCCAGAGTGTATTTATACAGC TCCAACAATTACAACTACTTAGCTTGGTACCA GCAGAAACCAGGACAGCCTCCTAAGTTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGGACGTTCGGCCAAGG GACCAAGGTGGAAATCAAA<br>SEQ ID NO: 25859 | CAGGTGCAGCTGGTGCAGTCTGGGGCTGAGGTG AAGAAGCCTGGGGCCTCTGTGAAGGTCTCCTGCA AGGCTTCTGGATACACCTTCACCAATTATGATAT CAACTGGGTGCGACAGGCCACTGGACAAGGGCT TGAGTGGATGGGATGGATGAACCCTAACAGTGG TAACACAGGCTATGCACAGAAACACCTCCATAAG AGTCACCAGGCTGACCAGAGACTGAGATCTGA AGCCTACATGGAGCTGAGCAGCCTGAGATCTGA GGACACGGCCGTATATTACTGTGCGAGTAGCAGT GGCTGGTACTTCTTTGACTACTGGGGCCAGGAA CCCTGGTCACCGTCTCCTCA<br>SEQ ID NO: 29865 | |

FIGURE 50
(Continued)

| | | | | |
|---|---|---|---|---|
| | | AA | DIVMTQSPDSLAVSLGERATINCKSSQSILYSSNN YNYLAWYQQKPGQPPKLLIYWASTRESGVPDRF SGSGSGTDFTLTISSLQAEDVAVYYCQQYYSTP WTFGQGTKVEIK<br><br>SEQ ID NO: 25860 | QVQLVQSGAEVKKPGASVKVSCKASGYTFNYDIN WVRQATGQGLEWMGWMNPNSGNTGYAQKFQGR VTMTRNTSISTAYMELSSLRSEDTAVYYCASSSGW YFFDYWGQGTLVTLSS<br><br>SEQ ID NO: 29866 |
| iPS:434699 | 21-225_79G12 | NA | GAAATTGTGTTGACGCAGTCTCCAGGCACCCT GTATTTGTCTCCAGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 25861 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCAAGGGACCACGGTCACC GTCTCCTCA<br><br>SEQ ID NO: 29867 |
| | | AA | EIVLTQSPGTLYLSPGERATLSCRASQSVYSSYLA WYQQKPGQAPRLLIYGASSRSTGIPDRFSGSGSG TDFALTISRLEPEDCAVYYCQHSDNSPWTFGQG TKVEIK<br><br>SEQ ID NO: 25862 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29868 |

FIGURE 50
(Continued)

| | | | |
|---|---|---|---|
| iPS:434701 | 21-225_80A1 | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGACTTCGCTCTCAC CATCAGCAGAGTGGAGCCTGAAGATTGTGCAG TGTATTACTGTCAGCACTCTGATAACTCACCGT GGACGTTCGGCCAAGGGACCAAGGTGGAAAT CAAA<br>SEQ ID NO: 25863 | CAGGTGCAGCTACAGCAGTGGGGCGCAGGACTG TTGAAGCCTTCGGAGACCCTGTCCCTCACCTGCG CTGTCCATGGTGGGTCTTCAGTGGTTGCTACTG GAGCTGGATCCGCCAGCCCCAGGGAAGGGGCT GGAGTGGATTGGGAATCAATCATAGTGGGAAG CACCAACTACACAACCCGTCCCTCAAGAGTCGAGTC ACCATTTCAGTAGACACGTCAAGAACCAGTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29869 |
| | | AA | EIVLTQSPGTRYLSPGERATLSCRASQSVYSSYL AWYQQKPGQAPRLLIYGASSRSTGIPDRFSGSGC GTDFALTISRVEPEDCAVYYCQHSDNSPWTFGQ GTKVEIK<br>SEQ ID NO: 25864 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29870 |
| iPS:434703 | 21-225_80C1 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGAGTGGAGCCTGAAGATTGTGCAG TGTATTACTGTCAGCACTCTGATAACTCACCGT GGACGTTCGGCCAAGGGACCAAGGTGGAAAT CAAA<br>SEQ ID NO: 25865 | CAGGTGCAGCTACAGCAGTGGGGCGCAGGACTG TTGAAGCCTTCGGAGACCCTGTCCCTCACCTGCG CTGTCCATGGTGGGTCTTCAGTGGTTGCTACTG GAGCTGGATCCGCCAGCCCCAGGGAAGGGGCT GGAGTGGATTGGGAATCAATCATAGTGGGAAG CACCAACTACACAACCCGTCCCTCAAGAGTCGAGTC ACCATTTCAGTAGACACGTCAAGAACCAGTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29871 |

FIGURE 50
(Continued)

| | | | | |
|---|---|---|---|---|
| iPS:434705 | 21-225_80A2 | AA | EIVLTQSPGTLYLYLSPGERATLSCRASQSVYSSYLAWYQQKPGQAPRLLIYGASSRSTGIPDRFSGSGSGTDFALTISRVEPEDCAVYYCQHSDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 25866 | SEQ ID NO: 29872 |
| | | NA | GAATTTATGTTGACGCAGTCTCCAGGCACCCTGTATTTGTCTCCAGGGGAAAGAGCCACCCTCTCGTGCAGGGCCAGTCAGAGTGTTAGCAGCAGCTACTTAGTCTGGTATCAGCAGAAACCTGGCCAGGCTCCCAGGCTCCTCATCTATGGTGCATCCAGCCGGGCCACTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTTGCTCACCGCTCACTTTCGGCGGAGGGACCAAGGTGGAGATCACA | CAGGTGCAGCTGGTGCAGTCTGGGGCTGAGGTGAAGAAGCCTGGGGCTCAGTGAAGGTCTCCTGCAAGGCTTCTGGATACACCTTCACCAATTATGATATCAACTGGGTGCGACAGGTCCCTGGACAAGGCTTGAGTGGATGGGATGCTATGCACAGAAGTTCCAGGGCAGTAACACAGGCTATGCACAGGAAACACTCCATCAGCACAGTCACCATGACCAGGAGCCTGGAGGAGCTCATGACCCTACATGGAGCTGAGCAGCCTGAGATCTGAGGACACGGCCGTGTATTACTGTGCGATTAGTAGTGGCTGGTACTGGTTCGACCCCTGGGGCCAGGAACCCTGGTCACCGTCTCCTCA |
| | | | SEQ ID NO: 25867 | SEQ ID NO: 29873 |
| | | AA | EFMLTQSPGTLYLYLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT | QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS |
| | | | SEQ ID NO: 25868 | SEQ ID NO: 29874 |

FIGURE 50
(Continued)

| | | | |
|---|---|---|---|
| iPS:434707 | 21-225_80D3 | NA | GACATGTGATGACCCAGTCTCCAGATTGCCT<br>GGCTGTGTCTCTGGGCGAGAGGGCCACCATCA<br>ACTGCAAGTCCAGCCAGAGTGTTTATACACC<br>TCCAACAATAACAACTACTTAGCTTGGTACCA<br>GCAGAAACCAGGACAGCCTCCTAAGCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTTGCAGTTTATTATTGTCAGCACT<br>ACAATGAAACTCCAGGAAGTTTGTCCAAGTG<br>ACCAAGGTGGAAATCACA<br><br>SEQ ID NO: 25869 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGCACCTAACAGTGG<br>TAACACAGGCTATGCACAGAAGTTCCAGGGCAG<br>AGTCACCATGACCAGGAACACTTCCATAAGCAC<br>AGCCTACATGGAGCTGAGCAGCCTGAGATCTGA<br>GGACACGGCCGTGTATTACTGTGCGATTAGCAGT<br>GGCTGGTACTGTTCGACCCCTGGGGCCAGGGA<br>ACCCTGGTCACCGTCTCCTCA<br><br>SEQ ID NO: 29875 |
| | | AA | DIVMTQSPDCLAVSLGERATINCKSSQSVLYTSN<br>NNNYLAWYQQKPGQPPKLLIYWASTRESGVPD<br>RFSGSGSGTDFTLTISSLQAEDVAVYYCQHYNET<br>PGKFVQVIKVEIT<br><br>SEQ ID NO: 25870 | QVQLVQSGAEVKKPGASVKVSCKASGYTFTNYDIN<br>WVRQATGQGLEWMGWMHPNSGNTGYAQKFQGR<br>VTMTRNTSISTAYMELSSLRSEDTAVYYCAISSGW<br>YWFDPWGQGTLVTVSS<br><br>SEQ ID NO: 29876 |
| iPS:434709 | 21-225_80E3 | NA | GAAATTGTGTTGACGCAGTCTCCAGGCACCCT<br>GTATTTGTCTTCAGGGAAAAGAGCCACCCTCT<br>CATGCAGGGCCAGTCAGAGTGTTACAGCAGC<br>TACTTAGCCTGGTACCAGCAGAAACCTGGCCA<br>GGCTCCCAGGCTCCTCATTTATGTGCATCCA<br>GCCGGTCCACTGCATCCCAGACAGGTTCAGT<br>GGCAGTGGGTGTGGGACAGACTTCGCTCAC<br>CATCAGCAGAGTGGAGCCTGAAGATTTTGCAG<br>TGTATTACTGTCAGCATTCTGATAACTCACCGT<br>GGACGTTCGGCCAAGGGACCAAGGTGGAAAT<br>CAAA<br><br>SEQ ID NO: 25871 | CAGGTGCAGCTACAGCAGTGGGGCGCAGGACTG<br>TTGAAGCCTTCGGAGACCCTGTCCCTCACCTGCG<br>CTGTCCATGGTGGGTCCTTCAGTGGTTGCTACTG<br>GAGCTGGATCCGCCAGCCCCAGGGAAGGGGCT<br>GGAGTGGATTGGGAAATCAATCATAGTGGAAG<br>CACCAACTACAACCCGTCCCTCAAGAGTCGAGTC<br>ACCATTTCAGTAGACACGTCCAAGAACCAGTTCT<br>CCCTGAAGCTGAGCTCTGTGACCGCCGCGGACAC<br>GGCTGTGTATTACTGTGCGAGGGACTACGGCGGT<br>ATGGACGTCTGGGGCCAAGGGACCAAGGTCACC<br>GTCTCCTCA<br><br>SEQ ID NO: 29877 |

FIGURE 50
(Continued)

| | | | |
|---|---|---|---|
| iPS:434711 | 21-225_80H3 | AA | EIVLTQSPGTLYLSLSSGERATLSCRASQSVYSSYLAWYQQKPGQAPRLLIYGASSRSTGIPDRFSGSGCGTDFALTISRVEPEDFAVYYCQHSDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 25872 | SEQ ID NO: 29878 |
| | | NA | GACATCGTGATGACCCAGTCTCCAGACTCCCTGGCTGTGTCTCTGGGCGAGAGGGCCACCAATTGTAAGTCCAGCCAGAGTGTTTTACACAGGTCCAACAATTACAACTACTTAGCGTGTACCAGCAGAAACCAGGACAGCCTCCTAAGCTCTCATTTACTGGCATCTCACCCGGGAATCCGGGGTCCCTGACCGATTCAGTGGCAGCGGGTCTGGGACAGATTCACTCTCACCATCAGCAGCCTGCAGGCTGAAGATGTGGCAGTTTATTACTGTCAGCAATATTATAGTACTCCTCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCTGCAAGGTTCTGGATACACCTTGACCAATTATGATATCAACTGGGTGCGACAGGCCACTGGACAAGGCTTGAGTGGATGGGATGAACCCTAACAGTGGTAACACAGGCTATGCACAGAAGTTCCAGGGCAGTCACCATGACCAGGAACACCTCCATAAGCACAGCCTACATGGAACTGAGCAGCCTGAGATCTGAGGACACGGCCGTGTATTACTGTGGGAGTACCAGTGGCTGGAACTTCTTTGACTACTGGGGCCAGGGAACCCTGGTCACCGTCTCCTCA |
| | | | SEQ ID NO: 25873 | SEQ ID NO: 29879 |
| | | AA | DIVMTQSPDSLAVSLGERATTNCKSSQSVLHRSNNYNYLAWYQQKPGQPPKLLIYWASTRESGVPDRFSGSGSGTDFTLTISSLQAEDVAVYYCQQYYSTPPTFGQGTKVEIK | QVQLVQSGAEVKKPGASVKVSCKASGYTLTNYDINWVRQATGQGLEWMGWMNPNSGNTGYAQKFQGRVTMTRNTSISTAYMELSSLRSEDTAVYYCGSTSGWNFFDYWGQGTLVTVSS |
| | | | SEQ ID NO: 25874 | SEQ ID NO: 29880 |

FIGURE 50
(Continued)

| | | | |
|---|---|---|---|
| iPS:434715 | 21-225_80D5 | NA | GAACTTGTGTTGACGCAGTCTCCAGGCACCCT GTCTTTGTCTCCAGGGAAAAGAGTCACCCTCT CCTGCAGGGCCAGTCAGTCAGAATATTTACAGCAGC TACTTAGCCTGGTACCAGCAGAAACCTGGCCA GGCTCCCAGACTCCTCATCTATGGTGCATCA GCAGGGCCACTGGCATCCCAGACAGGTTCAGT GGCAGTGGGTCTGGGACAGACTTCACTCTCAC CATCACCAGACTGGAGCCTGAAGATTTTGCAG TGTATTGCTGTCAGCAGTATGAAAGCTCACCG TGGACCTTCGGCCAAGGGACCAAGGTGGAAA TCAAA<br>SEQ ID NO: 25875 | CAAGTGCAGCTACAGCAGTGGGGCGCAGGACTG TTGAAGCCTTCGGAGACCCTGTCCCTCACCTGCG CTGTCTATGGTGGGTCCTTCAGTGGTCCTACTG GAGCTGGATCCGCCAGCCCCCGGAAGGGCT GGAGTGGATTGGGAAATCAATCATAGTGGAAG CACCAACTACAACCGTCCCTCAAGAGTCGAGTC ACCATATCAGTAGACACGTCAAGAACCAGTTCT CCCTGAAACTGACCTCTGTGACCGCCGCGGACAT GGCTGTGTATTACTGTGCGAGAGACTACGGGGGT TTGGACGTCTGGGGCCAAGGGACCACGGTCACC GTCTCCTCA<br>SEQ ID NO: 29881 |
| | | AA | ELVLTQSPGTLSLSPGKRVTLSCRASQNIYSSYLA WYQQKPGQAPRLLIYGASSRATGIPDRFSGSGSG TDFTLTITRLEPEDFAVYCCQQYESSPWTFGQGT KVEIK<br>SEQ ID NO: 25876 | QVQLQQWGAGLLKPSEPLSLTCAVYGGSFSGPYW SWIRQPPGKGLEWIGEINHSGSTNYNPSLKSRVTISV DTSKNQFSLKLTSVTAADMAVYYCARDYGGLDV WGQGTTVTVSS<br>SEQ ID NO: 29882 |
| iPS:434717 | 21-225_80A6 | NA | GAAATTGTGTTGACGCAGTCTCCAGGCACCCT GTCTTTGTCTCCAGGGGAAATACCACCCTCT CCTGCAGGGCCAGTCAGAGTGTTGACAGCGGC TACTTAGCCTGGTACCAGCAGAAACCTGGCCA GGCTCCCAGGCTCCTCATCTATGGTGCATCA GCAGGGCCCCTGGCATCCCAGACAGGTTCAGT GGCAGTGGGTCTGGGACAGACTTCACTCTCAC CATCAGCAGACTGGAACCTGAAGATTTTGCAG TGTATTATTACTGTCAGCAGTATGAAAGCTCACCG TGGACGTTCGGCCAAGGGACCAAGGTGGAAA TCAAA<br>SEQ ID NO: 25877 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCCAGGAAAGGGGCT GGAGTGGATTGGGAAATCAATCATAGTGGAAG GACCAACTACAACCGTCCCTCAAGAGTCGAGTC ACCATATCAGTAGACACGTCCGAGAAGCAGTTCT CCCTGAAGCTGAGCTGTGACGCCCGCGGACAC GGCTGTGTATTACTGTGCGAGAGACTACGGTGGG CTTGACTACTGGGGCCAGGGAACCCTGGTCACCG TCTCCTCA<br>SEQ ID NO: 29883 |

FIGURE 50
(Continued)

| | | | | |
|---|---|---|---|---|
| iPS:434725 | 21-225_80H7 | AA | EIVLTQSPGTLSLSPGEIPTLSLSCRASQSVDSGYLA WYQQKPGQAPRLLIYGASSRAPGIPDRFSGSGSG TDFTLTISRLEPEDFAVYYCQQYESSPWTFGQGT KVEIK<br>SEQ ID NO: 25878 | QVQLQQWGAGLLKPSETLSLTCAVYGGSFSGCYW SWIRQPPGKGLEWIGEINHSGRTNYNPSLKSRVTIS VDTSEKQFSLKLSSVTAADTAVYYCARDYGGLDY WGQGTLVTVSS<br>SEQ ID NO: 29884 |
| | | NA | GAAATTGTGTTGACGCAGTCTCCAGGCACCCT GTCTTTGTCTCCAGGGGAAAGAGCCACCCTCT CCTGCAGGGCCAGTCAGAGTATTAACAGCAAC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTTACTGTCAGCAGTATGAGAGCTCACCG TGGACGTTCGGCCAAGGGACCAAGGTGGAAA TCAAA<br>SEQ ID NO: 25879 | CAGGTGCAGCTACAGCAGTGGGGCGCAGGACTG TTGAAGCCTTCGGAGACCCTGTCCCTCACCTGCG CTGTCTATGTTGGGTCCTTCAGTGGTTCCTACTGG AGCTGGATCCGCCAGCCCCCAGGGAAGGGGCTA GAGTGGATTGGGAAATCAATCAAAGTGGACGC ACCAACTACAACCCGTCCCTCAAGAGTCGAGTCA CCATATCAGTAGACACGTCCAAGAACCAGTTCTC CCTGAAGCTGAGCTCTGTGACCGCCGCGGACACG GCTGTGTATTACTGTGCGAGAGACTACGGGGGTA TAGACGTCTGGGGCCAAGGGACCACGGTCACCG TCTCCTCA<br>SEQ ID NO: 29885 |
| | | AA | EIVLTQSPGTLSLSPGERATLSCRASQSINSNYLA WYQQKPGQAPRLLIYGASSRATGIPDRFSGSGSG TDFTLTISRLEPEDFAVFYCQQYESSPWTFGQGT KVEIK<br>SEQ ID NO: 25880 | QVQLQQWGAGLLKPSETLSLTCAVYVGSFSGSYW SWIRQPPGKGLEWIGEINQSGRTNYNPSLKSRVTIS VDTSKNQFSLKLSSVTAADTAVYYCARDYGGIDV WGQGTTVTVSS<br>SEQ ID NO: 29886 |

FIGURE 50
(Continued)

| | | | |
|---|---|---|---|
| iPS:434729 | 21-225_80B12 | NA | GACATCGTGTTGACCCAGTCGCCAGACTCCCTGGCTGTGTCTCTGGGCGAGAGGGCCACCATCAACTGCAAGTCCAGACAGAGTGTTTATACAGCTCCAACAATTACAACTACTTAACTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGACGTGGCAGTTTATTACTGTCAGCAATATTATAGTTCTCCTCCTACTTTCGGCGGAGGGACCAAGGTGGAGATCAAA<br>SEQ ID NO: 25881 | CAGGTGCAGCTGGTGCAGTCTGGGGCTGAGGTGAAGAAGCCTGGGGCCTCAGTGAAGGTCTCCTGCAAGACTTCTGGATACACCTTCACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGTCAGAGTCACCATGACCAGGAACACCTCCATAAGCACAGCCTACATGGAGCTGAGCAGCCTGAGATCTGAGGACACGGCCGTCTATTACTGTGCGTATAGCAGTGGCTGGTGGTACATCTTTGACTACTGGGGCCAGGGAACCCTGGTCACCGTCTCCTCA<br>SEQ ID NO: 29887 |
| | | AA | DIVLTQSPDSLAVSLGERATINCKSRQSVLYSSNNYNYLTWYQQKPGQPPKLLIYWASTRESGVPDRFSGSGSGTDFTLTISSLQAEDVAVYYCQQYYSSPPTFGGGTKVEIK<br>SEQ ID NO: 25882 | QVQLVQSGAEVKKPGASVKVSCKTSGYTFTNYDINWVRQATGQGLEWMGWMNPNSGNTGYAQKFQVRVTMTRNTSISTAYMELSSLRSEDTAVYYCAYSSGWYIFDYWGQGTLVTVSS<br>SEQ ID NO: 29888 |
| iPS:434731 | 21-225_80E9 | NA | GACATCGTGATGACCCAGTCTCCAGATTGCCTGGCTGTGTCTCTGGGCGAGAGGGCCACCATCAACTGCAAGTCCAGCCAGAGTGTTTATACACCTCCAACAATAACAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTTGCAGTTTATTATTGTCAGCAATATTATAATACTCCGTGGACGTTCGGTCCAAGGGACCAAGGTGGAAATCAAA<br>SEQ ID NO: 25883 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACAGAAGTTCCACGCTTAACACAGGCTATGCACAGAAGTTCCAGGCAGAGTCACCATGACCAGGAACACCTCCATAAGCACAGCCTACATGGAGCTGAGCAGCCTGAGATCTGAGGACACGGCCGTGTATTACTGTGCGATTAGCAGTGGCTGGTACTGGTTCGACCCCTGGGGCCAGGGAACCCTGGTCACCGTCTCCTCA<br>SEQ ID NO: 29889 |

FIGURE 50
(Continued)

| | | | |
|---|---|---|---|
| iPS:434735 | 21-225_80B10 | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQQYYNT PWTFVQGTKVEIK<br>SEQ ID NO: 25884 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29890 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAGC TACTTAGCCTGGTACCAGCAGAAACCTGGCCA GGCTCCCAGGCTCCTCATCTATGGTGCATCCA GCAGGGCCCCTGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATAATAAAGCTCACCG TGGACGTTCGGCCAAGGGACCAAGGTGGAAA TCAAA<br>SEQ ID NO: 25885 | CAGGTGCAGCTACAGCAGTGGGGCGCAGGACTG TTGAAGCCTTCGGAGACCGTCCTCCTCACCGCG CTGTCTATGTGGGTCCTTCAGTGTTGCTACTG GAGCTGGATCCGCCAGCCCCCAGGGAAGGGCT GGAGTGGATTGGGAAATCAATCATAGTGGAAG CACCAACTACAACCCGTCCCTCAAGAGTCGAGTC ACCATATCAGTAGACACGTCAAGAACCAGTTCT CCCTGAAGCTGAGCTCTGTGACCGCCGCGGACAC GGCTGTGTATTACTGTGCGAGAGACTACGGTGGG CTTGACTACTGGGGCCAGGGAACCCTGGTCACCG TCTCCTCA<br>SEQ ID NO: 29891 |
| | | AA | EIVLTQSPGTLSLSPGERATLSCRASQSVDSSYLA WYQQKPGQAPRLLIYGASSRAPGIPDRFSGSGSG TDFTLTISRLEPEDFAVYYCQQYESSPWTFGQGT KVEIK<br>SEQ ID NO: 25886 | QVQLQQWGAGLLKPSETLSLTCAVYGGSFSGCYW SWIRQPPGKGLEWIGEINHSGSTNYNPSLKSRVTISV DTSKNQFSLKLSSVTAADTAVYYCARDYGGLDYW GQGTLVTVSS<br>SEQ ID NO: 29892 |

FIGURE 50
(Continued)

| | | NA | GACATCCAGATGACCCAGTCTCCATCCTCACT GTCTGCATCAGTAGGAGACAGAGTCACCATCA CTTGTCGGGCGAGTCAGGGCATTGCAAGTAT TTAGCCTGTGGTTTCAGCAGAAACCAGGGAAAGC CCCTAAGTCCCTGATCTATACTCAATGCAGTT GCAAAGTGGGGCCCATCAAAGTTCAGGGC AGTGGATCTGGGACAGATTTCACTCTCACCAT CAGCAGCCTGCAGTATGAAGATTTTGCAACTT ATTACTGCCAACAGTACAGTAATTACCCGCTC ACTTTCGGCGGAGGGACCAAGGTGGAGATCA AT<br>SEQ ID NO: 25887 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGGCAG CTATGGTTATGACGGCCTTGACTACTGGGGCCAG GGAACCCTGGTCACCGTCTCCTCA<br>SEQ ID NO: 29893 |
|---|---|---|---|---|
| iPS:434737 | 21-225_74G6 | AA | DIQMTQSPSSLSASVGDRVTITCRASQGIGKYLA WFQQKPGKAPKSLIYTTSSLQSGAPSKFSGSGSG TDFTLTISSLQYEDFATYYCQQYSNYPLTFGGGT KVEIN<br>SEQ ID NO: 25888 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDGSYG YDGLDYWGQGTLVTVSS<br>SEQ ID NO: 29894 |
| iPS:434741 | 21-225_80C11 | NA | GACATCCAGATGACCCAGTCTCCATCCTCACT GTCTGCTTCTGTAGGGACAGAGTCACCATCA CTTGTCGGGCGAGTCAGGGCATTGGCAAGTAT TTAGCCTGTGGTTTCAGCAGAAACCAGGGAGAGC CCCTAAGTCCCTGATCTATACTGCATCCAGTT GCAAAGTGGGGCCCATCAAAGTTCAGCGGC AGTGGATCTGGGACAGCCTGCAGATTTCACTCTCACCAT CAGCAGCCTGCAGCCTGAAGATTTTGCAACTT ATTACTGCCAACAGTACAGTATAATTACCCGCTC ACTTTCGGCGGAGGGACCAAAGTGGAGATCA AT<br>SEQ ID NO: 25889 | CAGGTGCAGCTGGTGGAGTCTGGGGGAGGCGTG GTCCAGCCTGGGAGGTCCCTGAGACTCTCCTGTG CAGCGTCTGGATTCACCTTCAGCAGCTATGGCAT GCACTGGGTCCGCCAGGCTCCAGGCAAGGGCT GGAGTGGGTGGCAGTTATATGGTATGATGGAAGT AATAAAAACTATGCAGACTCCGTGAAGGGCCGA TTCACCATCTCCAGAGACACAATTCCAAGAACACGC TGTCTCTGCAAATGAACAGCCTGAGAGCCGAGG ACACGGCTGTGTATTACTGTGCGAGAGATGGCAG CTATGGTATGACGGCCTTGACTACTGGGGCCAG GGAACCCTGGTCACCGTCTCCTCA<br>SEQ ID NO: 29895 |

FIGURE 50
(Continued)

| | | | |
|---|---|---|---|
| iPS:434743 | 21-225_74A4 | AA | DIQMTQSPSSLSASVGDRVTITCRASQGIGRYLA WFQQKPGRAPKSLIYTASSLQSGAPSKFSGSGSG TDFTLTISSLQPEDFATYYCQQYSNYPLTFGQGT KVEIN<br>SEQ ID NO: 25890 | QVQLVESGGGVVQPGRSLRLSCAASGFTFSSYGMH WVRQAPGKGLEWVAVIWYDGSNKNYADSVKGRF TISRDNSKNTLSLQMNSLRAEDTAVYYCARDGSYG YDGLDYWGQGTLVTVSS<br>SEQ ID NO: 29896 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCGGGTCCACTGGCATCCCAGACAGGTTCAGT GGCAGTGGGTGTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br>SEQ ID NO: 25891 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCCTCAAGAGTCGAGTC ACCATTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29897 |
| | | AA | EIVLTQSPGTLYLSPGERATLSCRASQSVYSSYLA WYQQKPGQAPRLLIYGASSRSTGIPDRFSGSGCG TDFALTISRLEPEDCAVYYCQHSDNSPWTFGQG TKVEIK<br>SEQ ID NO: 25892 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29898 |

FIGURE 50
(Continued)

| | | | |
|---|---|---|---|
| iPS:434747 | 21-225_80C12 | NA | GAAATTGTGTTGACGCAGTCTCCAGGCACCCTGTATTTGTCTCCAGGGGAAAGAGCCACCCTCTCGTGCAGGGCCAGTCAGAGTGTTAGCAGCAGCTACTTAGCCTGGTACCAGCAGAAACCTGGCCAGGCTCCCAGGCTCCTCATCTATGGTGCATCCAGGGCCACTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTAACTCACCGCTCACTTTCGGCGGAGGGACCAAGGTGGAGATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACCTAACAATGGTAACACAGGCTATGCACAGAAGTTCCAGGGCAGAGTCACCATGACCAGGAACACCTCCATAAGCACAGCCTACATGGAGCTGAACAGCCTGAGATCTGAGGACACGGCCGTGTATTACTGTGCGATTAGCAGTGGCTGGTACTGTTCGACCCCTGGGGCCAGGGAACCCTGGTCACCGTCTCCTTA |
| | | | SEQ ID NO: 25893 | SEQ ID NO: 29899 |
| | | AA | EIVLTQSPGTLYLSPGERATLSCRASQSVSSSYLAWYQQKPGQAPRLLIYGASTRATGIPDRFSGSGSGTDFTLTISRLEPEYFAVYYCQQYGNSPLTFGGGTKVEIK | QVQLVQSGAEVKKPGASVKVSCKASGYTFTNYDINWVRQATGQGLEWMGWMHPNGNTGYAQKFQGRVTMTRNTSISTAYMELNSLRSEDTAVYYCAISSGWYWFDPWGQGTLVTVSL |
| | | | SEQ ID NO: 25894 | SEQ ID NO: 29900 |
| iPS:434751 | 21-225_80H12 | NA | GAAATTGTGTTGACGCAGTCTCCAGGCACCCTGTCTTTGTCTCCAGGGGAAAGAGCCACCCTCTCATGCAGGGCCAGTCAGAGTGTTACAGCAGCTACTTAGCCTGGTACCAGCAGAAACCTGGCCAGGCTCCCAGGCTCCTCATTTATGGTGCATCAGCCGGTCCACTGGCATCCCAGACAGGTTCAGTGGCAGTGGGTCTGGGACAGCCTTCGCTCTCACCATCAGCAGACTGGAGCCTGAAGATTTTGCAGTGTATTACTGTCAGCAGCACTCTGATAACTCACCGTGGACGTTCGGCCAAGGGACCAAGGTGGAAATCAAA | CAGGTGCAGCTACAGCAGTGGGGCGCAGGACTGTTGAAGCCTTCGGAGACCCTGTCCCTCACCTGCGCTGTCCATGGTGGGTCCTTCAGTGGTTGCTACTGGAGCTGGATCCGCCAGCCCCCAGGGAAGGGGCTGGAGTGGATTGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA |
| | | | SEQ ID NO: 25895 | SEQ ID NO: 29901 |

FIGURE 50
(Continued)

| | | | |
|---|---|---|---|
| iPS:434759 | 21-225_81C5 | AA | EIVLTQSPGTLSLSPGERATLSCRASQSVYSSYLA WYQQKPGQAPRLLIYGASSRSTGIPDRFSGSGSG TDFALTISRLEPEDFAVYYCQHSDNSPWTFGQGT KVEIK<br>SEQ ID NO: 25896 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29902 |
| | | NA | GAAATTGTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCA GCCGGGTCCACTGGCATCCCAGACAGGTTCAGT GGCAGTGGGGTGTGGGACAGACTTCGCTCTCAC CATCAGCAGAGAGTGGAGCCTGAAGATTGTGCAG TGTATTACTGTCAGCATTCTGATAACTCACCGT GGACGTTCGGCCAAGGGACCAAGGTGGAAAT CAAA<br>SEQ ID NO: 25897 | CAGGTGCAGCTACAGCAGTGGGGCGCAGGACTG TTGAAGCCTTCGGAGACCCTGTCCCTCACCGCG CTGTCCATGTGGGTCCTTCAGTGGTTGTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29903 |
| | | AA | EIVLTQSPGTLYLSSGERATLSCRASQSVYSSYLA WYQQKPGQAPRLLIYGASSRSTGIPDRFSGSGCG TDFALTISRVEPEDCAVYYCQHSDNSPWTFGQG TKVEIK<br>SEQ ID NO: 25898 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29904 |

FIGURE 50
(Continued)

| | | | | |
|---|---|---|---|---|
| iPS:434761 | 21-225_81E5 | NA | GACATCGTTATGACCCAGTCTCCAGACTCCCTGGCTGTGTCTCTGGGCGAGAGGGCCACCATCAATTGCAAGTCCAGCGAGAGTGTTTTATTCAGCTCCAACAATTATATACTTAGTTGGTACCAGCAGAGACCAGGACAGCCTCCTAACCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGCTGATGTGGCAGTTTATTACTGTCAGCAATATTATAGTTCTCCTCGACGTTCGGCCAAGGGACCACGGTGCAAATCAAA<br>SEQ ID NO: 25899 | CAGGTGCAGTTGGTGCAGTCTGGGGCTGAGGTGAAGAAGCCTGGGGCCTCAGTGAAGGTCTCCTGCAAGGCTTCTGATACACCTTCACCAATTATGATATCAACTGGGTGCGACAGGCCACTGGACAAGGCTTGAGTGGATGGATGAACCTAACAGTGGTAACACAGGCTATGCACAGAAGTTCCAGGCAGAGTCACCATGACCAGGAACACCTCCACAAGCACAGCCCACATGGAGCTGAGCAGCCTGAGATCTGAGGACACGGCCGTGTATTACTGTGCGGGTCTCCAGTGGCTGGAACTGGTTCGACCCCTGGGGCCAGGGAACCCTGGTCACCGTCTCCTCA<br>SEQ ID NO: 29905 |
| | | AA | DIVMTQSPDSLAVSLGERATINCKSSQSVLFSSNNYNYLAWYQQRPGQPPNLLIYWASTRESGVPDRFSGSGSGTDFTLTISSLQAADVAVYYCQQYYSSPLTFGQGTTVQIK<br>SEQ ID NO: 25900 | QVQLVQSGAEVKKPGASVKVSCKASGYTFTNYDINWVRQATGQGLEWMGWMNPNSGNTGYAQKFQGRVTMTRNTSTAHMELSSLRSEDTAVYYCAVSSGWNWFDPWGQGTLVTVSS<br>SEQ ID NO: 29906 |
| iPS:434771 | 21-225_81F9 | NA | GACATCGTGATGACCCAGTCTCCAGATTGCCTGGCTGTGTCTCTGGGCGAGAGGGCCACCATCAACTGCAAGTCCAGCCAGAGTGTTTTATACACCTCCAACAATAACAACTACTTAGCTTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTTGCAGTTTATTATTGTCAGCACTACAATGATACTCCAGGAAGTTTGTCAGCAAGGCATCATGGTGGAAATCACA<br>SEQ ID NO: 25901 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACAGAAGTTCACCGAGGCAGAGTCACCATGACCAGGAACACCTCCATAAGCACAGCCTACATGGAGCTGAGCAGCCTGAGATCTGAGGACACGGCCGTGTATTACTGTGCGATTAGCAGTGGCTGGTACTGGTTCGACCCCTGGGGCCAGGGAACCCTGGTCACCGTCTCCTCA<br>SEQ ID NO: 29907 |

FIGURE 50
(Continued)

| | | | |
|---|---|---|---|
| iPS:434773 | 21-225_75D9 | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYRQHYNDT PGKFVQGIMVEIT<br>SEQ ID NO: 25902 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 29908 |
| | | NA | GAAATTGTGTTGACGCAGTCTCCAGGCACCCT GTCTTTGTCTCCAGGGAAAGAGCCACCCTCT CCTGCAGGGCCAGTCAGAGTGTTAGCAGCAGC TACTTAGCCTGGTACCAGCAGAAACGTGGCCA GGCTCCCAGGCTCCTCATCTATGGTGCATCCA GCAGGGCCACTGCATTCCAGACAGGTTCAGT GGCAGTGGGTCTGGGACAGACTTCACTCTCAC CATCAGCAGACTGGAGCCTGAAGATTTTGCAG TGTATTACTGTCAGCAGTATAGAAGTCACCG TGGACGTTCGGCCAAGGGACCAAGGTGGAAA TCAAA<br>SEQ ID NO: 25903 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTCCCTACTG GAGCTGGATCCGCCAGCCCCCAGGGAAGGGGCT GGAGTGGATTGGGGAAATCAATTATAGGGGAAG CACCAACTACAACCCGTCCCTCAAGAGTCGAGTC ACCATTTCAGTAGACACGTCCAAGAACCAGTTCT CCCTGAACCTGAGCTCTGTGACCGCCGCGACAC GGCTGTGTATTACTGTGCGAGGGACTACGGCGGT ATGGACGTCTGGGGCAAGGGACCACGGTCACC GTCTCCTCA<br>SEQ ID NO: 29909 |
| | | AA | EIVLTQSPGTLSLSPGERATLSCRASQSVSSSYLA WYQQKRGQAPRLLIYGASSRATGIPDRFSGSGSG TDFTLTISRLEPEDFAVYYCQQYESSPWTFGQGT KVEIK<br>SEQ ID NO: 25904 | QVQLQQWGAGLLKPSETLSLTCAVYGGSFSGPYW SWIRQPPGKGLEWIGEINYRGSTNYNPSLKSRVTIS VDTSKNQFSLNLSSVTAADTAVYYCARDYGGMDV WGQGTTVTVSS<br>SEQ ID NO: 29910 |

FIGURE 50
(Continued)

| | | | |
|---|---|---|---|
| iPS:434777 | 21-225_81C11 | NA | GAAATTGTGTTGACGCAGTCTCCAGGCACCCG GTATTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCCATTATGGTGCATCA GCCGGTCCACTGGCCTCCCAGACAGGTTCAGT GGCAGTGGGTGTGGGACAGACTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGAAAT CAAA<br>SEQ ID NO: 25905 | CAGGTGCAGCTACAGCAGTGGGGCGCAGGACTG TTGAAGCCTTCGGAGACCTGTCCCTCACCTGCG CTGTCCATGTGGGTCCTTCAGTGGTTGCTACTG GAGCTGGATCGCCAGCCCCCAGGGAAGGGGCT GGAGTGGATTGGGAGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 29911 |
| | | AA | EIVLTQSPGTRYLSPVERATLSCRASQSVYSSYL AWYQQKPGQAPRLLIYGASSRSTGLPDRFSGSG CGTDFALTISRVEPEDCAVYYCQHSDNSPWTFG QGTKVEIK<br>SEQ ID NO: 25906 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br>SEQ ID NO: 29912 |
| iPS:434793 | 21-225_82A5 | NA | GAAATTGTGTTGACGCAGTCTCCAGGCACCCT GTCTTGGTCTCCAGGGGAAAGAGCCACCCTCT CGTGCAGGGCCAGTCAGTCAGAGTGTTAGCAGC TACTTAGCCTGGTACCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAACTCACCG CTCACTTTCGGCGGAGGGACCAAGGTGGAGAT CAAA<br>SEQ ID NO: 25907 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGCACCTAACAATGG TAACACAGGCTATGCACAGAAGTTCCAGGGCAG AGTCACCATGACCAGGAACACCTCCATAAGCAC AGCCTACATGGAGCTGAACAGCCTGAGATCTGA GGACACGGCCGTGTATTACTGTGCGATTAGCAGT GGCTGGTACTGTTCGACCCCTGGGGCCAGGGA ACCCTGGTCACCGTCTCCTTA<br>SEQ ID NO: 29913 |

FIGURE 50
(Continued)

| | | | |
|---|---|---|---|
| iPS:434797 | 21-225_82G5 | AA | EIVLTQSPGTLSWSPGERATLSCRASQSVSSSYLAWYQQKPGQAPRLLIYGASTRATGIPDRFSGSGSGTDFTLTISRLEPEYFAVYYCQQYGNSPLTFGGGTKVEIK | QVQLVQSGAEVKKPGASVKVSCKASGYTFTNYDINWVRQATGQGLEWMGWMHPNNGNTGYAQKFQGRVTMTRNTSISTAYMELNSLRSEDTAVYYCAISSGWYWFDPWGQGTLVTVSL |
| | | | SEQ ID NO: 25908 | SEQ ID NO: 29914 |
| | | NA | GAATTTATGTTGACGCAGTCTCCAGGCACCCTGTATTGGTCTCCAGGGGAAAGAGCCACCCTCCGAGCAGGGCCAGTGACTGAGAGTGTTAGCAGCAGCTACTTAGTCTGGTATCAGCAGAAACCTGGCCAGGCTCCCAGGCTCCTCATCTATGGTGCATCCACCAGGGCCACTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTTGCTCACCGCTCACTTTCGGCGGAGGGACCAAGGTGGAGATCACA | CAGGTGCAGCTGGTGCAGTCTGGGGCTGAGGTGAAGAAGCCTGGGGCTCAGTGAAGGTCTCCTGCAAGGCTTCTGGATACACCTTCACCAATTATGATATCAACTGGGTGCGACAGGTCCCTGGACAAGGCTTGAGTGGATGGGATGGATGCACCTAACAGTGGTAACACAGGCTATGCACAGAAGTTCCAGGGCAGAGTCACCATGACCAGGAACACTCCATCAGCACAGCCTACATGGAGCTGAGCAGCCTGAGATCTGAGGACACGGCCGTGTATTACTGTGCGATTAGTAGTGGCTGGTACTGGTTCGACCCCTGGGGCCAGGGAACCCTGGTCACCGTCCTCCTCA |
| | | | SEQ ID NO: 25909 | SEQ ID NO: 29915 |
| | | AA | EFMLTQSPGTLYWSPGERATLSSRASESVSSSYLVWYQQKPGQAPRLLIYGASTRATGIPDRFSGSGSGTDFTLTISRLEPEYFAVYYCQQYGCSPLTFGGGTKVEIT | QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS |
| | | | SEQ ID NO: 25910 | SEQ ID NO: 29916 |

FIGURE 50
(Continued)

| | | | |
|---|---|---|---|
| iPS:434805 | 21-225_82D9 | NA | GAATTTATGTTGACGCAGTCTCCAGGCACCCT GTCTTGGTCTCCAGGGAAAGAGCCACCCTCT CGTGCAGGGCCAGTGAGAGTGTTAGCAGCAG CTACTTAGTCTGTATCAGCAGAAACCTGGCC AGGCTCCCAGGCTCCTCATCTATGGTGCATCC ACCAGGGCCACTGGCATCCCAGACAGGTTCAG TGGCAGTGGGTCTGGGACAGACTTCACTCTCA CCATCAGCAGACAGATGGAGCCTGAATATTTGCA GTTTATTACTGTCAGCAGTATGGTTGCTCACCG CTCACTTTCGGCGGAGGGACCAAGGTGGAGAT CACA<br><br>SEQ ID NO: 25911 | CAGGTGCAGCTGGTGCAGTCTGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGCTATGCACAGAAGTTCCAGGGCAG AGTCACCATGACCAGGAACACCTCCATCAGCAC AGCCTACATGGAGCTGAGCAGCCTGAGATCTGA GGACACGGCCGTGTATTACTGTGCGATTAGTAGT GGCTGGTACTGTTCGACCCCGTGGGGCCAGGA ACCCTGGTCACCGTCTCCTCA<br><br>SEQ ID NO: 29917 |
| | | AA | EFMLTQSPGTLSWSPGERATLSCRASESVSSSYL VWYQQKPGQAPRLLIYGASTRATGIPDRFSGSGS GTDFTLTISRLEPEYFAVYYCQQYGCSPLTFGGG TKVEIT<br><br>SEQ ID NO: 25912 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 29918 |
| iPS:434809 | 21-225_74F5 | NA | GAAATTGTGTTGACGCAGTCTCCAGGCACCCT GTATTGTCTCCAGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCAGGGCTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGGAAAT CAAA<br><br>SEQ ID NO: 25913 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCAAGGTCACC GTCTCCTCA<br><br>SEQ ID NO: 29919 |

FIGURE 50
(Continued)

| | | | |
|---|---|---|---|
| iPS:434813 | 21-225_82C12 | AA | EIVLTQSPGTLYLSPGERATLSCRASQSVYSSYLA WYQQKPGQAPRLLIYGASSRSTGIPDRFSGSGSG TDFALTISRLEPEDFAVYYCQHSDNSPWTFGQGT KVEIK |
| | | | SEQ ID NO: 25914 |
| | | NA | GAAATTGTGTTGACGCAGTCTCCAGGCACCCT GTCTTGGTCTCCAGGGGAAAGAGCCACCCTCT CGTGCAGGGCCAGTCAGAGTGTTAGCAGCAGC TACTTAGCCTGGTACCAGCAGAAACCTGGCCA GGCTCCCAGGCTCCTCATCTATGGTGCATCA CCAGGGGCCTCTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTAACTCACCG CTCACTTTCGGCGGAGGGACCAAGGTGGAGAT CAAA |
| | | | SEQ ID NO: 25915 |
| | | AA | EIVLTQSPGTLSWSPGERATLSCRASQSVSSSYLA WYQQKPGQAPRLLIYGASTRASGIPDRFSGSGSG TDFTLTISRLEPEYFAVYYCQQYGNSPLTFGGGT KVEIK |
| | | | SEQ ID NO: 25916 |
| | | | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 29920 |
| | | | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCCAGGGCAG TAACACAGGCTATGCACAGAAGTTCCAGGGCAG AGTCACCATGACCAGGAACACTTCCATAAGCAC AGCCTACATGGAGCTGAACAGCTGAGATCTGA GGACACGGCCGTGTATTACTGTGCGATTAGCAGT GGCTGGTACTGGTTCGACCCCTGGGGCCAGGGA ACCCTGGTCACCGTCTCCTTA |
| | | | SEQ ID NO: 29921 |
| | | | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL |
| | | | SEQ ID NO: 29922 |

FIGURE 50
(Continued)

| | | | |
|---|---|---|---|
| iPS:434815 | 21-225_74A11 | NA | GACATCCAGATGACCCAGTCTCCATCCTCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTGTGCTGCATCCAGT TTGCAAAGTGGGGTCCATCAAGGTTCAGCGG CAGTGGATCTGGGACCGAGTTCACTCTCACAA TCAGCAGCCTGCAGCCTGAGGATTTTGCAACT TATTTCTGTCTACAGCATAATGATTACCCATTC ACTTTCGGCCCTGGGACCAAAGTGGATATCA A | CAGGTGCAGCTGGTGCAGTCTGGGGCTGAGGTG AAGAAGCCTGGGGCCTCAGTGAAGGTCTCCTGTA AGGCTTCTGGATACACCTTCACCAGTTATGATAT CAACTGGGTGCGACAGGCCACTGGACAAGGGCT TGAGTGGATGGGATGGATGAACCCTAACAGTGG TAACACAGGCTATGCACAGAAGTTCCAGGGCAG AGTCACCATGACCTGAGAACACCTCCAAAGCAC AGCCTACATGGAGCTGAGCAGCCTGAGATCTGA GGACACGGCCGTGTATTACTGTGCGAGAGGCTTT TACGATACTTTGACTGGTTCCGGCTACTACG TTATGACGTCTGGGGCCAAGGGACCACGGTCA CCGTCTCCTCA |
| | | | SEQ ID NO: 25917 | SEQ ID NO: 29923 |
| | | AA | DIQMTQSPSSLSASVGDRVTITCRASQDIRNDLG WYQQKPGKAPKRLICAASSLQSGVPSRFSGSGS GTEFTLTISSLQPEDFATYFCLQHNDYPFTFGPGT KVDIK | QVQLVQSGAEVKKPGASVKVSCKASGYTFTSYDIN WVRQATGQGLEWMGWMNPNSGNTGYAQKFQGR VTMTWNTSKSTAYMELSSLRSEDTAVYYCARGFY DTLTGSGYYVMDVWGQGTTVTVSS |
| | | | SEQ ID NO: 25918 | SEQ ID NO: 29924 |
| iPS:434821 | 21-225_83G1 | NA | GAAATTGTGTTGACGCAGTCTCCAGGCACCCG GTATTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCA GCCGGTCCACGGTCCTCCCAGACCAGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCCGT ATGGACGTCTGGGGCCAAGGGACCACGGTCACC GTCTCCTCA |
| | | | SEQ ID NO: 25919 | SEQ ID NO: 29925 |

FIGURE 50
(Continued)

| | | | |
|---|---|---|---|
| iPS:434825 | 21-225_83C2 | AA | EIVLTQSPGTRYLSPGERATLSCRASQSVYSSYLAWYQQKPGQAPRLLIYGASSRSTVLPDRFSGSGSGTDFALTISRVEPEDCAVYYCQHSDNSPWTFGQGTKVEIK<br>SEQ ID NO: 25920 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29926 |
| | | NA | GAATTTATGTTGACGCAGTCTCCAGGCACCCTGTGTTTGTCTCCAGGGGAAAGAGCCACCCTCCGTGCAGGGCCAGTCAGAGTGTTAGCAGCAGCTACTTAGTCTGGTATCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTTGCTCACCGCTCACTTTTCGGCGGAGGGACCAAGGTGGAGATCACA<br>SEQ ID NO: 25921 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGTCCCTGGACAAGGCTTGAGTGGATGGGATGGATGCACAGAAGTTCCAGGGCAGTAACACAGGCTATGCACAGAAGTTCCAGGGCAGAGTCACCATGACCAGGAACACTCCATCAGCACAGCCTACATGGAGCTGAGCAGCCTGAGATCTGAGGACACGGCCGTGTATTACTGTGCGATTAGTAGTGGCTGGTACTGGTTCGACCCCTGGGGCCAGGAACCCTGGTCACCGTCTCCTCA<br>SEQ ID NO: 29927 |
| | | AA | EFMLTQSPGTLCLSPGERATLSCRASQSVSSSYLVWYQQKPGQAPRLLIYGASTRATGIPDRFSGSGSGTDFTLTISRLEPEYFAVYYCQQYGCSPLTFGGGTKVEIT<br>SEQ ID NO: 25922 | QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS<br>SEQ ID NO: 29928 |

FIGURE 50
(Continued)

| | | | |
|---|---|---|---|
| iPS:434827 | 21-225_83F3 | NA | GACATCGTGATGACCCAGTCTCCAGATTGCCT GGCTGTGTCTCTGGGCGAGAGGGCCACCATCA ACTGCAAGTCCAGCAGTGTTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATAATGATACTCCATGGAAGTTTGTCCAAGGG ATCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA |
| | | | SEQ ID NO: 25923 | SEQ ID NO: 29929 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYNDT PWKFVQGIKVEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25924 | SEQ ID NO: 29930 |
| iPS:434829 | 21-225_83G3 | NA | GACATCGTGATGACCCAGTCTCCAGATTGCCT GGCTGTGTCTCTGGGCGAGAGGGCCACCATCA ACTGCAAGTCCAGCCAGCAGTGTTTTATACACC TCCAACAATAACAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGCAGTTTATTATTGTCAGCACT ATTATAATACTCCGTGGACGTTTGTCCAAGGG ACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA |
| | | | SEQ ID NO: 25925 | SEQ ID NO: 29931 |

FIGURE 50
(Continued)

| | | | |
|---|---|---|---|
| iPS:434833 | 21-225_83C5 | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYYNT PWTFVQGTKVEIK |  QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25926 | SEQ ID NO: 29932 |
| | | NA | GAATTTATGTTGACGCAGTCTCCAGGCACCCT GTGTTGGTCTCCAGGGGAAAGAGCCACCCTCT CGTGCAGGGCCAGTGAGAGTGTTAGCAGCAG CTACTTAGTCTGGTATCAGCAGAAACCTGGCC AGGCTCCCAGGCTCCTCATCTATGGTGCATCC ACCAGGGCCACTGGCATCCCAGACAGGTTCAG TGGCAGTGGGTCTGGGACAGACTTCACTCTCA CCATCAGCAGACTGGAGCCTGAATATTTTGCA GTTTATTACTGTCAGCAGTATGGTTGCTCACCG CTCACTTTCGGCGGAGGGACCAAGGTGGAGAT CACA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGTCCCTGGACAAGGGC TTGAGTGGATGGGATGGATGCACAGAAGTTCCAGGGCAG TAACACAGGCTATGCACAGAAGTTCCAGGGCAG AGTCACCATGACCAGGAACACTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA |
| | | | SEQ ID NO: 25927 | SEQ ID NO: 29933 |
| | | AA | EFMLTQSPGTLCWSPGERATLSCRASESVSSSYL VWYQQKPGQAPRLLIYGASTRATGIPDRFSGSGS GTDFTLTISRLEPEYFAVYYCQQYGCSPLTFGGG TKVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25928 | SEQ ID NO: 29934 |

FIGURE 50
(Continued)

| | | | | |
|---|---|---|---|---|
| iPS:434835 | 21-225_83B6 | NA | GAAATTGTGTTGACGCAGTCTCCAGGCACTTT GTCTTTGTCTCTGCAGGGCCAGTCAGTCTCT CCTGCAGGGCCAGTCAGTGTTGACAGCGGC TACTTAGCCTGGTACCAGCAGAAACCTGGCCA GGCTCCCAGGCTCCTCATCTATGGTGCATCA GCAGGACCCCTGGCATCCAGACAGTTCAGT GGCAGTGGGTCTGGGACAGACTTCACTCTCAC CATCAGCAGACTGGAGCCTGAAGATTTTGCAG TGTATTACTGTCAGCAGTATGAAAGCTCACCG TGGACGTTCGGCCAAGGGACCAAGGTGGAAA TCAAA SEQ ID NO: 25929 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTACTGG AGCTGGATCCGCCAGCCCCCAGGGAAGGGCTG GAGTGGATTGGGGAAATCAATCATAGTGGAAGG ACCAACTACAACCCCTCCCTCAAGAGTCGAGTCA CCATATCAGTAGACACGTCGAGAACCAGTTCTC CCTGAAGCTGAGCTCTGTGCGAGACACGGCGGGCACG GCTGTGTATTACTGTGCGAGAGACTACGGTGGGC TTGACTACTGGGGCCAGGGAACCCTGGTCACCGT CTCCTCA SEQ ID NO: 29935 |
| | | AA | EIVLTQSPGTLSLSPGERATLSCRASQSVDSGYLA WYQQKPGQAPRLLIYGASSRTPGIPDRFSGSGSG TDFTLTISRLEPEDFAVYYCQQYESSPWTFGQGT KVEIK SEQ ID NO: 25930 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTLVTVSS SEQ ID NO: 29936 |
| iPS:434839 | 21-225_83B7 | NA | GAAATTGTGTTGACGCAGTCTCCAGGCACCCG GTATTGTCTCAGTGAAAGAGCCACCCTCT CATGCAGGGCCAGTCAGTCAGAGTGTTACAGCAGC TACTTAGCGTGGTACCAGCAGAAACCTGGCCA GGCTCCCAGGCTCCTCATTTATGGTGCATCA GCCGGGTCCACTGGCATCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA SEQ ID NO: 25931 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGACACG GCTGTGTATTACTGTGCGAGGGACTACGGCGGT ATGGACGTCTGGGGCCAAGGGACCACGGTCACC GTCTCCTCA SEQ ID NO: 29937 |

FIGURE 50
(Continued)

| | | | |
|---|---|---|---|
| iPS:434841 | 21-225_83G7 | AA | EIVLTQSPGTRYLSSVERATLSCRASQSVYSSYL AWYQQKPGQAPRLLIYGASSRSTGIPDRFSGSGS GTDFALTISRLEPEDCAVYYCQHSDNSPWTFGQ GTKVEIK<br>SEQ ID NO: 25932 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29938 |
| | | NA | GACATCGTGATGACCCAGTCTCCAGACTCCCT GGCTGTGTCTCTGGGCGAGAGGGCCACCATCA TCTGCAAGTCCAGCCAGACTGTTTACACAGC TCCAACAATTATAACTACTTAGCTTGGTACCA GCAGAAGCCAGGACAGCCCCCTAAGGTGCTC ATTTACTGGACATCTACCCGGGAATCCGGGGT CCCTGACCGATTCAGTGGCAGCGGGTCTGGGA CAGATTTCACTCTCACCATCAGCAGCCTGCAG GCTGAAGATGTGGCAGTTTATTACTGTCAGCA ATATTTTAGTAGTCCTCTGACGTTCGGCCAAG GGACCAAGGTGGAAATCAAA<br>SEQ ID NO: 25933 | CAGGTGCAGCTGGTGCAGTCTGGGGCTGAGGTG AAGAAGCCTGGGGCCTCAGTGAAGGTCTCCTGC AAGGCTTCTGGATACACCTTCCCAATTATGATA TCAACTGGGTGCGACAGGCCACTGGACAAGGC TTGAGTGGATGGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA<br>SEQ ID NO: 29939 |
| | | AA | DIVMTQSPDSLAVSLGERATIICKSSQTVLHSSNN YNYLAWYQQKPGQPPKVLIYWTSTRESGVPDRF SGSGSGTDFTLTISSLQAEDVAVYYCQQYFSSPL TFGQGTKVEIK<br>SEQ ID NO: 25934 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br>SEQ ID NO: 29940 |

FIGURE 50
(Continued)

| iPS:434849 | 21-225_83C10 | NA | GAAATTGTGTTGACGCAGTCTCCAGGCACCCT GTCTTTGTCTCCAGGGGAAAGAGCCACCCTCT CCTGCAGGGCCAGTCCGAGTGTTCACAGCAAC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAC CATCAGCAGACTGGAGCCTGAAGATTTTGCAG TGTATTACTGTCAGCAGTATGAAAGTTCACCG TGGACGTTCGGCCAAGGGACCAAGGTGGAAA TCAAA | CAGGTGCAGCTACAGCAGTGGGGCGCAGGACTG TTGAAGCCTTCGGAGACCTTGTCCCTCACCTGCA CTGTCTATGGTGGGTCCTTCAGTGGTTACTACTG GAGCTGGATCCGCCAGCCCCCAGGGAAGGGGCT GGAATGGATTGGGGAAATCAATCATAGTGGAAG CACCAACTTCAACCCGTCCCTCAAGAGTCGAGTC ACCATATCAGTAGACACGTCCAAGAACCAGTTCT CCCTGAAGCTGAGCTCTGTGACCGCCGACACC GGCTGTGTTTTACTGTGCGAGAGACTACGGTGGG CTTGACTACTGGGGCCAGGGAACCCTGGTCACCG TCTCCTCA |
| | | | SEQ ID NO: 25935 | SEQ ID NO: 29941 |
| | | AA | EIVLTQSPGTLSLSPGERATLSCRASPSVHSNYLA WYQQKPGQAPRLLIYGASSRATGIPDRFSGSGSG TDFILTISRLEPEDFAVYYCQQYESSPWTFGQGT KVEIK | QVQLQQWGAGLLKPSETLSLTCTVYGGSFSGYYW SWIRQPPGKGLEWIGEINHSGSTNFNPSLKSRVTISV DTSKNQFSLKLSSVTAADTAVFYCARDYGGLDYW GQGTLVTVSS |
| | | | SEQ ID NO: 25936 | SEQ ID NO: 29942 |
| iPS:434851 | 21-225_75A6 | NA | GACATCGTGATGACCCAGTCGCCAGACTCCCT GGCTGTGTCTCTGGGCGAGAGGGCCACCATCA ACTGCAAGTCCAGACAGAGTGTTTACACAGC TCCAACAATTACAACTACTTAGCTTGGTACCA GCAGAAACCAGGACAGCCTCCTGAACTACTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAGGATGTGGCAGTTTATTACTGTCAGCAA TATTATAGTACTCCTCCTACTTTCGGCGGAGG GACCAAGGTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGATAGCAG TGGCTGGTACATCTTTGACTACTGGGGCCAGGGA ACCCTGGTCACCGTCTCCTCA |
| | | | SEQ ID NO: 25937 | SEQ ID NO: 29943 |

FIGURE 50
(Continued)

| | | | |
|---|---|---|---|
| iPS:434863 | 21-225_84G7 | AA | DIVMTQSPDSLAVSLGERATINCKSRQSVLHSSN NYNYLAWYQQKPGQPPELLIYWASTRESGVPDR FSGSGSGTDFTLTISSLQAEDVAVYYCQQYYSTP PTFGGGTKVEIK<br>SEQ ID NO: 25938 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YIFDYWGQGTLVTVSS<br>SEQ ID NO: 29944 |
| | | NA | GACATCGTGATGACCCAGTCTCCAGACTCCCC GGCTGTGTCTGTGGGCGAGAGGGCCACCATCA TCTGCAAGTCCAGCCAGACTGTTTACACAGC TCCAACAATTATAACTACTTAGCTTGGTACCA GCAGAAGCCAGGACAGCCCCTAAGGTGCTC ATTTACTGGACATCTGACCCGGGAATCCGGGGT CCCTGACCGATTCAGTGGCAGGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br>SEQ ID NO: 25939 | CAGGTGCAGTCTGGTGCAGTCTGGGGCTGAGGTG AAGAAGCCTGGGGCTCAGTGAAGGTCTCCTGC AAGGCTTCTGGATACACCTTCCCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGACA GAGTCACCATGACCAGGAACACCTCCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA<br>SEQ ID NO: 29945 |
| | | AA | DIVMTQSPDSPAVSLGERATIICKSSQTVLHSSNN YNYLAWYQQKPGQPPKVLIYWTSTRESGVPDRF SGSGSGTDFTLTISSLQAEDVAVYYCQQYFSSPP TFGQGTKVEIK<br>SEQ ID NO: 25940 | QVQLVQSGAEVKKPGASVKVSCKASGYTFPNYDIN WVRQATGQGLEWMGWMNPNSGNTGYAQKFQDR VTMTRNTSISTAYMELSSLRSEDTAVYYCAVSSGW HWFDPWGQGTLVTVAS<br>SEQ ID NO: 29946 |

FIGURE 50
(Continued)

| | | | |
|---|---|---|---|
| iPS:434867 | 21-225_79A12 | NA | GACATCCAGATGACCCAGTCTCCATCCTCACTGTCTGCATCTGTAGGAGACAGAGTCACCATCACTTGTCGGGCGAGTCAGGTCATTAGCAGTTATTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTACAGTAATTACCCGCTCACTTTCGGCGGAGGGACCAAGGTGGAGATCAAA SEQ ID NO: 25941 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATGGCAGCTATGGTTACGACGGCCTTGACTACTGGGGCCAGGGAACCCTGGTCGCCGTCTCCTCA SEQ ID NO: 29947 |
| | | AA | DIQMTQSPSSLSASVGDRVTITCRASQVISKYLAWFQQKPGKAPKSLIYAASSLQSGAPSKFSGSGSGTDFTLTISSLQPEDFATYYCQQYSNYPLTFGGGTKVEIK SEQ ID NO: 25942 | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDGSYGYDGLDYWGQGTLVAVSS SEQ ID NO: 29948 |
| iPS:434869 | 21-225_84E12 | NA | GAAATTGTGTTGACGCAGTCTCCAGGCACCCTGTCTTTGTCTCCAGGGGAAAGAGCCACCCTCTCCTGCAGGGCCAGTCAGAGTATTAACAGCAACTACTTAGCCTGGTACCAGCAGAAACCTGGCCAGGCTCCCAGGCTCCTCATCTATGGTGCATCAGGCAGGGCCACTGGCATCCCAGACAGGTTCAGTGGCAGTGGGTCTGGGACAGACTTCACTCTCACCATCAGCAGACTGGAGCCTGAAGATTTTGCAGTGTTTACTGTCAGCAGTATGATGAGAGCTCACCGTGGACGTTCGGCCAAGGGACCAAGGTGGAAATCAAA SEQ ID NO: 25943 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTCCTACTGGAGCTGGATCCGCCAGCCCCCAGGGAAGGGGCTAGAGTGGATTGGGGAAATCAATCAAAGTGGACGCACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGAGACTACGGGGTATAGACGTCTGGGGCCAAGGGACCACGGTCACCGTCTCCTCA SEQ ID NO: 29949 |

FIGURE 50
(Continued)

| | | | |
|---|---|---|---|
| iPS:434871 | | AA | EIVLTQSPGTLSLSPGERATLSCRASQSINSNYLAWYQQKPGQAPRLLIYGASSRATGIPDRFSGSGSGTDFTLTISRLEPDDFAVFYCQQYESSPWTFGQGTKVEIK<br>SEQ ID NO: 25944 | QVQLQQWGAGLLKPSETLSLTCAVYGGSFSGSYWSWIRQPPGKGLEWIGEINQSGRTNYNPSLKSRVTISVDTSKNQFSLKLSSVTAADTAVYYCARDYGGIDVWGQGTTVTVSS<br>SEQ ID NO: 29950 |
| | | NA | GAGATAGTGATGACGCAGTCTCCAGCCACCCTGTCTGTGTCTCCAGGGGAAAGAGCCACCCTCCCTGCAGGGCCAGTCAGGATGTTATCACCTACTTAGCCTGGTACCAGCAGAAACCTGGCCAGGCTCCCAGGCTCCTCATCTATGGTGCATCCACCAGGGCCACTGGTGTGCCCAGCCAGGTTCAGTGGCAGTGGGTCTGGGACAGAGTTCACTCTCACCATCAGCAGCCTGCAGTCTGAAGATAATGACTGGCCGTGCATTACTGTCAGGAGTACTACTTTGCACTTTAGTTTTGGCCAGGGGACCAAGGTGGAGATCAAA<br>SEQ ID NO: 25945 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTACTATGCATACACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCCCTTATAGTGGAGCTACTACTTTGACTACTGGGGCCAGGGAACCCTGGTCACCGTCTCCTCA<br>SEQ ID NO: 29951 |
| 21-225_85H1 | | AA | EIVMTQSPATLSVSPGERATLSCRASQDVITYLAWYQQKPGQAPRLLIYGASTRATGVPARFSGSGSGTEFTLTISSLQSEDFALYYCQEYNDWPCSFGQGTKVEIK<br>SEQ ID NO: 25946 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDPFIVGATYFDYWGQGTLVTVSS<br>SEQ ID NO: 29952 |

FIGURE 50
(Continued)

| | | | |
|---|---|---|---|
| iPS:434877 | 21-225_85H2 | NA | GACAGCATGATGACCAGTCTCCAGACTCCCT GGCTGTGTCTCTGGGCGAGAGGGCCACCATCA ACTGCAAGTCCAGCCAGAGTGTTTTACACAGC TCTAATAAAAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGTCTGCAGG CTGAAGATGTGGCAGTTTATTACTGTCAGCAA TATTATAGGACTCCGTGACGTTCGGACCAAGG GACCAAGGTGGAAATCAAA | CAGGTGCAGCTGGTGCAGTCTGGGGCTGAGGTG AAGAAGCCTGGGGCTTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCCTAATAGTGG TAACACAGGCTATGCACAGAAGTTCCAGGGCAG AGTCACCCTGACCAGGAACACCTCCATAAGCAC AGCCTACATGGAGCTGAGCAGCCTGAGATCTGA GGACACGGCCGTGTATTACTGTGCGGTTTCCAGT GGCTGGTACTGTTCGACCCCTGGGGCCAGGGA ACCCTGGTCACCGTCTCCTCA |
| | | | SEQ ID NO: 25947 | SEQ ID NO: 29953 |
| | | AA | DSMMFQSPDSLAVSLGERATINCKSSQSVLHSSN KKNYLAWYQQKPGQPPKLLIYWASTRESGVPD RFSGSGSGTDFTLTISSLQAEDVAVYYCQQYYRT PWTFGQGTKVEIK | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS |
| | | | SEQ ID NO: 25948 | SEQ ID NO: 29954 |
| iPS:434879 | 21-225_85A3 | NA | GAAATTGTGTTGACGCAGTCTCCAGGCACCCT GTTTTTGTCTCCAGGGGAAAGAGCCACCCTCT CCTGCAGGGCCAGTCAGAGTGTTTACAGCAGC TACTTAGCCTGGTACCAGCAGAAACCTGCCCA GGCTCCCAGGCTCCTCATCTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA |
| | | | SEQ ID NO: 25949 | SEQ ID NO: 29955 |

FIGURE 50
(Continued)

| | | | |
|---|---|---|---|
| iPS:434881 | 21-225_85B4 | AA | EIVLTQSPGTLFLSPGERATLSCRASQSVYSSYLAWYQQKPAQAPRLLIYGASSRASGIPDRFSGSGSGTDFALTISRLEPEDFAVYYCQHYDNSPWTFGQGTKVEIK<br>SEQ ID NO: 25950 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29956 |
| | | NA | GAAATTGTGTTGACGCAGTCTCCAGGCACCCTGTTTTTGTCTCCAGGGGAAAGAGCCACCCTCTCCTGCAGGGCCAGTCAGAGTGTTTACAGCAGCTACTTAGCCTGGTACCAGCAGAAACCTGGCCAGGCTCCCAGGCTCCTCATCTATGGTGCATCAGCCGGGCCACTGGCATCCCAGACAGGTTCAGTGGCAGTGGGTCTGGGACAGACTTCGCTCTCACCATCAGCAGACTGGAGCCTGAAGATTTTGCAGTGTATTACTGTCAGCACTATGATAATCACCGTGGACGTTCGGCCAAGGGACCAAGGTGGAAATCAAA<br>SEQ ID NO: 25951 | CAGGTGCAGCTACAGCAGTGGGGCGCAGGACTGTTGAAGCCTTCGGAGACCGTCCCTCACCTGCGCTGTCCATGTGGGTCTCCTCAGTGGTTGTACTGGAGCTGGATCCGCCAGCCCCCAGGGAAGGGGCTGGAGTGGATTGGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA<br>SEQ ID NO: 29957 |
| | | AA | EIVLTQSPGTLFLSPGERATLSCRASQSVYSSYLAWYQQKPGQAPRLLIYGASSRATGIPDRFSGSGSGTDFALTISRLEPEDFAVYYCQHYDNSPWTFGQGTKVEIK<br>SEQ ID NO: 25952 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 29958 |

FIGURE 50
(Continued)

| | | | |
|---|---|---|---|
| iPS:434883 | 21-225_85B5 | NA | GAATTTATGTTGACGCAGTCTCCAGGCACCCT GTCTTTGTCTCTCCAGGGAAAGAGCCACCCTCT CGTGCAGGTCCAGTCAGAGTGTTAGCAGCAGC TACTTAGTCTGGTATCAGCAGAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA | CAGGTGCAGCTGGTGCAGTCTGGGGCTGAGGTG AAGAAGCCTGGGGCCTCAGTGAAGGTTCCTGC AAGGCTTCTGGATACACCTTCACCAATTATGATA TCAACTGGGTGCGACAGGTCCTGGACAAGGGC TTGAGTGGATGGGATGGATGCACCTAACAGTGG TAACACAGGGTATGCACAGAAGTTCCAGGGCAG AGTCACCATGACCAGGAACACTTCCATCAGCAC AGCCTACATGGAGCTGAGCAGCCTGAGATCTGA GGACACGGCCGTGTATTACTGTGCGATTAGTAGT GGCTGGTACTGTTCGACCCCTGGGGCCAGGGA ACCCTGGTCACCGTCTCCTCA |
| | | | SEQ ID NO: 25953 | SEQ ID NO: 29959 |
| | | AA | EFMLTQSPGTLSLSPGERATLSCRSSQSVSSSYLV WYQQKPGQAPRLLIYGASTRATGIPDRFSGSGSG TDFTLTISRLEPEYFAVYYCQQYGCSPLTPGGGI KVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25954 | SEQ ID NO: 29960 |
| iPS:434887 | 21-225_85D6 | NA | GAAATTGTGTTGACGCAGTCTCCAGGCACCCT GTTTTTGTCTCAAGGGAAAGAGCCACCCTCT CCTGCAGGGCCAGTCAGAGTGTTAGCAGCAGG TACTTAGCCTGGTACCAGCAGAAACCTGGCCA GGCTCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATATTGCAG TATATTACTGTCAGCATTATGATAGCTCACCGT GGACGTTCGGCCAAGGGACCAAGGTGGAAAT CAAA | CAGGTGCAGCTACAGCAGCAGGGGGCGCAGGACCG TTGAAGCCTTCGGAGACCCTGTCCCTCACCTGCG CTGTCTATGGTGGGTCCTTCAGTGGTTGCTACTG GAGCTGGATCCGCCAGCCCGCCAGGGAAGGGCT GGAGTGGATTGGGAAATCAATTATAGTGGAAG AACCAACTACAACCCGTCCCTCAAGAGTCGAGTC ACCATATCAGTAGACACGTCCAAGAACCAGTTCT CCCTGAAGCTGAGCTCTGTGACCGCGGACAC GGCTGTGTATTACTGTGCGAGAGACTACGGCGGT ATGGACGTCTGGGGCCAAGGGACCACGGTCACC GTCTCCTCA |
| | | | SEQ ID NO: 25955 | SEQ ID NO: 29961 |

FIGURE 50
(Continued)

| | | | |
|---|---|---|---|
| iPS:434891 | 21-225_85G6 | AA | EIVLTQSPGTLFLSQGERATLSCRASQSVSSRYLAWYQQKPGQAPRLLIYGASSRATGIPDRFSGSGSGTDFTLTISRLEPEDFAVYYCQHYDSSPWTFGQGTKVEIK<br>SEQ ID NO: 25956 | QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS<br>SEQ ID NO: 29962 |
| | | NA | GAAATTGCGTTGACGCAGTCTCCAGGCACCCTGTCTTTGTCTCCAGGGGAAAGAGCCACCCTCTCCTGCAGGGCCAGTCCGAGTGTTGACAGCAGCTACTTAGCCTGGTACCAGCAGAAACCTGGCCAGGCTCCCAGGCTCCTCATCTATGGTGCAGCCAGCAGGGCCCCTGCATCCCAGACAGGTTCAGTGGCAGTGGGTCTGGGACAGACTTCACTCTCACCATCAGCAGACTGGAGCCTGAAGACTTTGTAGTGTATTACTGTCAGCAGTATGAAAGTTCACCGTGGACGTTCGGCCAAGGGACCAAGGTGGAAATCAAA<br>SEQ ID NO: 25957 | CAGGTGCAGCTACAGCAGTGGGGCGCAGGACTGTTGAAGCCTTCGGAGACCGTCCTCACCTGCGCTGTCTATGTGGGTCCTTCAGTGATTGCTACTGGAGCTGGATCCGCCAGCCCCCAGGGAAGGGGCTGGAGTGGATTGGGAAATCAATCATAGTGGAAGGACCAACTACAACCGTCCCTCAAGAGTCGAGTCACCATATCAGTAGACACGTCCGAGAACCAGTTCTCCCTGAAGCTGAGCTCTGTGACCGCCGCGGACACGGCTGTGTATTACTGTGCGAGAGACTACGGTGGGCTTGACTACTGGGGCCAGGGAACCCTGGTCACCGTCTCCTCA<br>SEQ ID NO: 29963 |
| | | AA | EIALTQSPGTLSLSPGERATLSCRASPSVDSSYLAWYQQKPGQAPRLLIYGAASRAPGIPDRFSGSGSGTDFTLTISRLEPEDFVVYYCQQYESSPWTFGQGTKVEIK<br>SEQ ID NO: 25958 | QVQLQQWGAGLLKPSETLSLTCAVYGGSFSDCYWSWIRQPPGKGLEWIGEINHSGRTNYNPSLKSRVTISVDTSENQFSLKLSSVTAADTAVYYCARDYGGLDYWGQGTLVTVSS<br>SEQ ID NO: 29964 |

FIGURE 50
(Continued)

| | | | | |
|---|---|---|---|---|
| iPS:434895 | 21-225_74H7 | NA | GAACTTGTGTTGACGCAGTCTCCAGGCACCCT GTCTTTGTCTCCAGGGGAAAGAGCCACCCTCT CCTGCAGGGCCAGTCAGTCAGAATATTTACAGCAGC TACTTAGCCTGGTACCAACAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTGCTGTCAGCAGTATGAAAGCTCACCG TGGACCTTCGGCCAAGGGACCAAGGTGGAAA TCAAA SEQ ID NO: 25959 | CAAGTGCAGCTACAGCAGTGGGGCGCAGGACTG TTGAAGCCTTCGGAGACCCCTGTCCTCACCTGCG CTGTCTATGGTGGGTCCTTCAGTGGTCCTACTG GAGCTGGATCCGCCAGCCCCCGGGAAGGGCT GGAGTGGATTGGGAAATCAATCATAGTGGAAG CACCAACTACACAAACCCGTCCCTCAAGAGTCGAGTC ACCATATCAGTAGACACGTCAAGAACCAGTCT CCCTGAAACTGACCTCTGTGACCGCCGCGGACAC GGCTGTGTATTACTGTGCGAGAGACTACGGGGGT TTGGACGTCTGGGGCCAAGGGACCACGGTCACC GTCTCCTCA SEQ ID NO: 29965 |
| | | AA | ELVLTQSPGTLSLSPGERATLSCRASQNIYSSYLA WYQQKPGQAPRLLIYGASSRATGIPDRFSGSGSG TDFTLTISRLEPEDFAVYCCQQYESSPWTFGQGT KVEIK SEQ ID NO: 25960 | QVQLQQWGAGLLKPSEPLSLTCAVYGGSFSGPYW SWIRQPPGKGLEWIGEINHSGSTNYNPSLKSRVTISV DTSKNQFSLKLTSVTAADTAVYYCARDYGGLDVW GQGTTVTVSS SEQ ID NO: 29966 |
| iPS:434899 | 21-225_85B9 | NA | GAAATTGTGTTGACGCAGTCTCCAGGCACCCT GTTTTTGTCTCCAGGGGAGAGAGCCACCCTCT CCTGCAGGGCCAGTCAGAGTGTTAACAGCAAC TACTTAGCCTGGTACCGGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCATTCTCAT CATCAGCAGACTGGAGCCTGAGGATTTTGCAG TGTATTACTGTCTGCAGCAGTATGAAAGCTCGCCG TGGACGTTCGGCCAAGGGACCAAGGTGGAAA TCAAA SEQ ID NO: 25961 | CAGGTGCAGCTACAACAGTGGGGCGCAGGACTG TTGAAGCCTTCGGAGACCCGTCCTCACTTGCG CTGTCAATGGTGGGCCTTCAGTGGTTGCTACTG GAGCTGGATCCGCCAGCCCCCAGGGAAGGGCT GGAGTGGATTGGGAAATCAATCATAGTGGAAG GACCAACTTCAACCGTCCCTCAAGAGTCGAGTC ACCATATCAGTTGACACGTCCAAGAACCAGTTCT CCCTGAAGCTGAGCTGTGTGACCGCCGCGGACAC GGCTGTGTATTACTGTGCGAGAGACTACGGCGGT ATGGACGTCTGGGGCCAAGGGACCACGGTCACC GTCTCCTCA SEQ ID NO: 29967 |

FIGURE 50
(Continued)

| | | | |
|---|---|---|---|
| iPS:434901 | 21-225_85H9 | AA | EIVLTQSPGTLFLSPGERATLSCRASQSVNSNYLAWYRQKPGQAPRLLIYGASSRATGIPDRFSGSGSGTDFILTISRLEPEDFAVYYCQQYESSPWTFGQGTKVEIK | QVQLQQWGAGLLKPSETLSLTCAVNGGPFSGCYWSWIRQPPGKGLEWIGEINHSGRTNFNPSLKSRVTISVDTSKNQFSLKLSSVTAADTAVYYCARDYGGMDVWGQGTTVTSS |
| | | | SEQ ID NO: 25962 | SEQ ID NO: 29968 |
| | | NA | GACATCGTGATGACCCAGTCTCCAGACTCCCTGGCTGTGTCTCTGGGCGAGAGGGCCACCAATTGTAAGTCCAGCCAGAGTGTTTTACACAGGTCCAACAATTACAACTACTTAGCGTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTACTCCTCCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTGACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGGCAGTCACCATGACCAGGAACACCTCCATAAGCACAGCCTACATGGAACTGAGCAGCCTGAGATCTGAGGACACGGCCGTGTATTACCGTGGAGTACCAGTGGCTGGAACTTCTTTGACTACTGGGGCCAGGGAACCCTGGTCACCGTCTCCTCA |
| | | | SEQ ID NO: 25963 | SEQ ID NO: 29969 |
| | | AA | DIVMTQSPDSLAVSLGERATTNCKSSQSVLHRSNNYNYLAWYQQKPGQPPKLLIYWASTRESGVPDRFSGSGSGTDFTLTISSLQAEDVAVYYCQQYYSTPPTFGQGTKVEIK | QVQLVQSGAEVKKPGASVKVSCKASGYTLTNYDINWVRQATGQGLEWMGWMNPNSGNTGYAQKFQGRVTMTRNTSISTAYMELSSLRSEDTAVYYRGSTSGWNFFDYWGQGTLVTVSS |
| | | | SEQ ID NO: 25964 | SEQ ID NO: 29970 |

FIGURE 50
(Continued)

| | | | |
|---|---|---|---|
| iPS:434907 | 21-225_85G10 | NA | GAAATTGTGTTGACGCAGTCTCCAGGCTCCCTGTCTTTGTCTCCAGGGGAAAGAGCCACCCTCCTGCAGGGCCAGTCAGAGTGTTGGAGCGGCTACTTAGCCTGGTACCAGCAGAAACCTGGCCAGGCTCCCAGGCTCCTCATCTATGGTGCATCTAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTTCTGTCAGCAGTATGAGAGTTCACCGTGGACGTTCGGCCAAGGGACCAAGGTGGAAATCAAA |
| | | | SEQ ID NO: 25965 |
| | | AA | EIVLTQSPGSLSLSPGERATLSCRASQSVWSGYLAWYQQKPGQAPRLLIYGASSRATGIPDRFSGSGSGTDFTLTISRLEPEDFAVYFCQQYESSPWTFGQGTKVEIK |
| | | | SEQ ID NO: 25966 |
| | | NA | CAGGTACAGAGTACAGCAGCGGGGCGCAGGACTGGTCTTGAAGCCTTCGGAGACCTGTCCCTCACCTGCGCTGTCTATGGTGGGTCCTTCAGTGGTTGTTACTGGAGCTGGATCCGCCAGCCCCCGGGAAGGGGCTGGAGTGGATTGGGGAAATCAATCATAGTGGAATCACCAACTACAACCGTCCCTCAAGAGTCGAGTCAACCATATCAGTAGACACGTCCAAGAACCAGTTCTCCCTGAAGCTGACCTCTGTGACCGCCGCGGACACGGCTGTGTATTACTGTGCGAGAGACTACGGTGGTTTGGACGTCTGGGGCCAAGGGACCACGGTCACCGTCTCCTCA |
| | | | SEQ ID NO: 29971 |
| | | AA | QVQLQQRGAGLLKPSETLSLTCAVYGGSFSGCYWSWIRQPPGKGLEWIGEINHSGITNYNPSLKSRVTISVDTSKNQFSLKLTSVTAADTAVYYCARDYGGLDVWGQGTTVTVSS |
| | | | SEQ ID NO: 29972 |
| iPS:434909 | 21-225_85C11 | NA | GACATCGTGATGACCCAGTCTCCAGACTCCCTGGCTGTGTCTCTGGGCGAGAGGGCCACCATCAACTGCAAGTCCAGCCAGAGTGTTTGTACAGCTCCAACAGTCACAACTTCTTAGCTGGTACCAGCAGAAACCAGGACAGCCTCCTAAACTGCTCATTTTCTGGGCATTTATCCGGGAATCCGGGGTCCCTGAAGGATTCAGTGGCAGCGGGTCTGGGACAGATTTCACTCTCTCCATCAGCGGCCTACAGGCAGAAGATGTGGCAGTTTATTACTGTCAGCAATATTATAGTACTCCGTGCAGTTTTGGCCAGGGGACCAAGCTGGAGATCAAA |
| | | | SEQ ID NO: 25967 |
| | | NA | CAGGTGCAGCTGGTGCAGTCTGGGGCTGAGGTGAAGAAGCCTGGGGCCTCAGTGAAGGTCTCCTGCAAGGCTTCGGATACACCTTCACCAATTATGATATCAACTGGGTGCGACAGGCCCCTGGACAAGGGCTTGAGTGGATGGGATGGATGCACAGAAGTTCAGGGCAGTAACACAGGCTATGCACCAGGAACACCTCCATAAGCACAGCCTACATGGAGCTGAGCAGCCTGAGATCTGAGGCTGGTGGCCGTATCAAATTGACTACTGGGGTATAGTGGGCTGGTACAAATTGACTACTGGGGCCAGGGAACCCTGGTCACCGTCTCCTCA |
| | | | SEQ ID NO: 29973 |

FIGURE 50
(Continued)

| iPS:434911 | 21-225_85D11 | AA | DIVMTQSPDSLAVSLGERATINCKSSQSVLYSSN SHNFLAWYQQNPGQPPKLLIFWAFIRESGVPEGF SGSGSGADFTLSISGLQAEDVAVYYCQQYYSTP CSFGQGTKLEIK | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS |
|---|---|---|---|---|
| | | | SEQ ID NO: 25968 | SEQ ID NO: 29974 |
| | | NA | GAATTTATGTTGACGCAGTCTCCAGGCACCCT GTCTTTGTCTACAGGGAAAGAGCCACCCTCT CGTGCAGGTCCAGTCAGAGTGTTAGCAGCAGC TACTTAGTCTGGTATCAGCAGAAACCTGGCCA GGCTCCCAGGCTCCTCATCTATTGGTGCATCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTTGCTCACCGC TCACTTTCGGCGGAGGGACCAAGGTGGAGATC ACA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGTCCCTGGACAAGGC TTGAGTGGATGGGATGGATGCACCTAACAGTGG TAACACAGGCTATGCACAGAAGTTCCAGGGCAG AGTCACCATGACCAGGAACACTTCCATCAGCAC AGCCTACATGGAGCTGAGCAGCCTGAGATCTGA GGACACGGCCGTGTATTACTGTGCGATTAGTAGT GGCTGGTACTGGTTCGACCCCTGGGGCCAGGGA ACCCTGGTCACCGTCTCCTCA |
| | | | SEQ ID NO: 25969 | SEQ ID NO: 29975 |
| | | AA | EFMLTQSPGTLSLSTGERATLSCRSSQSVSSSYLV WYQQKPGQAPRLLIYGASTRATGIPDRFSGSGSG TDFTLTISRLEPEYFAVYYCQQYGCSPLTFGGGT KVEIT | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 25970 | SEQ ID NO: 29976 |

FIGURE 50
(Continued)

| | | | | |
|---|---|---|---|---|
| iPS:434913 | 21-225_86C1 | NA | GAAATTGTGTTGACGCAGTCTCCAGGCACCCT GTATTTGTCTCCAGGGGAAAGAGCCACCCTCT CCTGCAGGGCCAGTCAGTCAGAGTGTTTACAGCAGC TACTTAGCCTGGTACCAGCAGAAACCTGCCCA GGCTCCCAGGCTCCTCATCTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA SEQ ID NO: 25971 | CAGGTGCAGCTACAGCAGTGGGGCGCAGGACTG TTGAAGCCTTCGGAGACCCGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 29977 |
| | | AA | EIVLTQSPGTLYLSPGERATLSCRASQSVYSSYLA WYQQKPAQAPRLLIYGASSRATGIPDRFSGSGSG TDFALTISRLEPEDCAVYYCQHYDNSPWTFGQG TKVEIK SEQ ID NO: 25972 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 29978 |
| iPS:434921 | 21-225_86E4 | NA | GAAATTGTGTTGACGCAGTCTCCAGGCACCCG GTATTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA SEQ ID NO: 25973 | CAGGTGCAGCTACAGCAGTGGGGCGCAGGACTG TTGAAGCCTTCGGAGACCCGTCCCTCACCTGCG CTGTCCATGTGGGTCTTCAGTGGTTGCTACTG GAGCTGGATCCGCCAGCCCCCAGGGAAGGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 29979 |

FIGURE 50
(Continued)

| | | | | |
|---|---|---|---|---|
| iPS:434935 | 21-225_86E9 | AA | EIVLTQSPGTRYLSPGERATLSCRASQSVYSSYL AWYQQKPGQAPRLLIYGASSRSTGIPDRFSGSGS GTDFALTISRLEPEDCAVYYCQHSDNSPWTFGQ GTKVEIK<br>SEQ ID NO: 25974 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 29980 |
| | | NA | GACATCGTGATGACCCAGTCTCCAGACTCCCC GGCTGTGTCTCTGGGCGAGAGGGCCACCATCA ATTGCAAGTCCAGCCAGAGTGTTTGCACAGA TCCAACAATTATAATTACTTAGCTTGGTACCA GCAGAAACCAGGACAGGCTCCTAACCTGCTCA TTTACTGGGCATCTACCCGGGAATCCGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTAGTCCACTGACGTTCGGCCAAGG GACCACGGTGGAAATCAAA<br>SEQ ID NO: 25975 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAGCACCTCCACAAGCA CAGCCCACATGGAGCTGAGCAGCCTGAGATCTG AGGACACGGCCGTGTATTACTGTGCGGTTTCCAG TGGCTGGTCCTGGTTCGACCCCTGGGGCCAGGGA ACCCTGGTCACCGTCTCCTCA<br>SEQ ID NO: 29981 |
| | | AA | DIVMTQCPDSPAVSLGERATINCKSSQSVLHRSN NYNYLAWYQQKPGQPPNLLIYWASTRESGVPD RFSGSGSGTDFTLTISSLQAADVAVYYCQQYHSS PLTFGQGTTVEIK<br>SEQ ID NO: 25976 | QVQLVQSGAEVKKPGASVKVSCKASGYTFTNYDIN WVRQATGQGLEWMGWMNPNSGNTGYAQKFQGR VTMTRSTSTSTAHMELSSLRSEDTAVYYCAVSSGW SWFDPWGQGTLVTVSS<br>SEQ ID NO: 29982 |

FIGURE 50
(Continued)

| | | | |
|---|---|---|---|
| iPS:434939 | 21-225_86C11 | NA | GAAATTGTGTTGACGCAGTCTCCAGGCACCCT GTATTGTCTCTGCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCCTCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 25977 | CAGGTGCAGCTACAGCAGTGGGGCGCAGGACTG TTGAAGCCTTCGGAGACCCTGTCCCTCACCTGCG CTGTCCATGGTGGGTCTTCAGTGGTTGCTACTG GAGCTGGATCCGCCAGCCCCAGGGAAGGGGCT GGAGTGGATTGGGGAAATCAATCATAGTGGAAG CACCAACTACACAACCCGTCCCTCAAGAGTCGAGTC ACCATTTCAGTAGACACGTCAAGAACCAGTTCT CCCTGAAGCTGAGCTCTGTGACCGCCGGACAC GGCTGTGTATTACTGTGCGAGGACTACGGCGGT ATGGACGTCTGGGGCCAAGGGACCACGGTCACC GTCTCCTCA<br><br>SEQ ID NO: 29983 |
| | | AA | EIVLTQSPGTLYLSPGERATLSCRASQSVYSSYLA WYQQKPGQAPRLLIYGASSRSTGLPDRFSGSGSG TDFALTISRLEPEDCAVYYCQHSDNSPWTFGQG TKVEIK<br><br>SEQ ID NO: 25978 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29984 |
| iPS:434943 | 21-225_87H1 | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAAC TACTTAGCCTGGTACCAGCAGAAACCTGGCCA GGCTCCCAGGCTCCTCATCTATGGTGCATCTG CCAGGACCACTGGCATCCCAGACAGGTTCAGT GGCAGTGGGTCTGGGACAGACTTCACTCTCAC CATCAGCAGACTGGAGCCTGAAGATTTTGCAG TGTATTCCTGTCAGCAGTATGAAAGCTCACCG TGGACGTTCGGCCAAGGGACCAAGGTGGAAA TCAAA<br><br>SEQ ID NO: 25979 | CAGGTGCAGCTGCAGCCGTGGGGCGCAGGACTG TTGAAGCCTTCGGAGACCCTGTCCCTCACCTGCG CTGTCTATGGTGGGTCCTTCAGTGGTTACTACTG GAGCTGGATCCGCCAGCCCCAGGGAAGGGGCT GGAGTGGATTGGGGAAATCAATCATAGTGGACG CACCAACTACACAACCCGTCCCTCAAGAGTCGAGTC ACCATATCAGTAGACACGTCAAGGACCAGTTCT CCCTGAAGCTGAGCTCTGTGACCGCCGGGACAC GGCTGTGTATTACTGTGCGAGAGACTACGGTGGT TTGGACGTCTGGGGCCAAGGGACCACGGTCACC GTCTCCTCA<br><br>SEQ ID NO: 29985 |

FIGURE 50
(Continued)

| | | AA | EIVLTQSPGTLSLSPGERATLSCRASQSVDSNYLA WYQQKPGQAPRLLIYGASARTTGIPDRFSGSGSG TDFTLTISRLEPEDFAVYSCQQYESSPWTFGQGT KVEIK<br><br>SEQ ID NO: 25980 | QVQLQPWGAGLLKPSETLSLTCAVYGGSFSGYYW SWIRQPPGKGLEWIGEINHSGRTNYNPSLKSRVTIS VDTSKDQFSLKLSSVTAADTAVYYCARDYGGLDV WGQGTTVTVSS<br><br>SEQ ID NO: 29986 |
|---|---|---|---|---|
| iPS:434945 | 21-225_87E5 | NA | GAATTTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGGCATCCCAGACAGGTTCAGT GGCAGTGGGTCTGGGACAGACTTCACTCTCAC CATCAGCAGAGTGGAGCCTGAAGATTGTGCAG TGTATTACTGTCAGCATTCTGATAACTCACCGT GGACGTTCGGCCAAGGGACCAAGGTGGAAAT CAAA<br><br>SEQ ID NO: 25981 | CAGGTGCAGCTACAGCAGTGGGGCGCAGGACTG TTGAAGCCTTCGGAGACCCTGTCCCTCACCTGCG CTGTCCATGTGGGTCTTCAGTGGTTGTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 29987 |
| | | AA | EFVLTQSPGTLYLSPGERATLSCRASQSVYSSYL AWYQQKPGQAPRLLIYGASSRSTGIPDRFSGSGS GTDFALTISRVEPEDCAVYYCQHSDNSPWTFGQ GTKVEIK<br><br>SEQ ID NO: 25982 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 29988 |

FIGURE 50
(Continued)

| | | | |
|---|---|---|---|
| iPS:434947 | 21-225_87B7 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCACAGTGGGGTCCCATCAAGTTCAGCGGCA GTGGATCTGGGACAGATTTCACTCTCACCATC AGCAGCCTGCAGCCTGAAGATTCTGCAACTTA TTTTCTGCCTACTCTATCTTACTTACCCGCTCAC CTTCGGCCAAGGGACCACGACTGGAGATTAAA<br><br>SEQ ID NO: 25983 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATTTTGG AGTGGGCTACTACGGTATGGACGTCTGGGGCCA AGGGACCACGGTCACCGTCTCCTCA<br><br>SEQ ID NO: 29989 |
| | | AA | DIQMTQSPSSLSASVGDRVTITCRASQGISNYLA WFQQKPGKAPKSLIYAASSLHSGVPSKFSGSGSG TDFTLTISSLQPEDSATYFCLLYLTYPLTFGQGTR LEIK<br><br>SEQ ID NO: 25984 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDFGVG YYGMDVWGQGTTVTVSS<br><br>SEQ ID NO: 29990 |
| iPS:434955 | 21-225_87C9 | NA | GAAATTGTGTTGACGCAGTCTCCAGGCACCCT GTATTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGCTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGGAAAT CAAA<br><br>SEQ ID NO: 25985 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCAATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br><br>SEQ ID NO: 29991 |

FIGURE 50
(Continued)

| | | | | |
|---|---|---|---|---|
| iPS:434957 | 21-225_87A10 | AA | EIVLTQSPGTLYLSPVERATLSCRASQSVYSSYLAWYQQKPGQAPRLLIYGASSRSTGIPDRFSGSGSGTDFALTISRLEPEDCAVYYCQHSDNSPWTFGQGTKVEIK | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS |
| | | | SEQ ID NO: 25986 | SEQ ID NO: 29992 |
| | | NA | GAATTTGTGTTGACGCAGTCTCCAGGCACCCTGTATTTGTCTCCAGGGGAAAGAGCCACCCTCCGTGCAGGGCCAGTCAGAGTGTTAGCAGCAGCTACTTAGCCTGGTACCAGCAGAAACCTGGCCAGGCTCCCAGGCTCCTCATCTATGGTGCATCAGGCTCCAGGGCCTCTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTAACTCACCGCTCACTTTCGGCGGAGGGACCAAGGTGGAGATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACCTAACAATGGTAACACAGGCTATGCACAGAAGTTCCAGGGCAGAGTCACCATGACCAGGAACACTCCATAAGCACAGCCTACATGGAGCTGAACAGCCTGAGATCTGAGGACACGGCCGTGTATTACTGTGCGATTAGCAGTGGCTGGTACTGGTTCGACCCCTGGGGCCAGGGAACCCTGGTCACCGTCTCCTTA |
| | | | SEQ ID NO: 25987 | SEQ ID NO: 29993 |
| | | AA | EFVLTQSPGTLYLSPGERATLSCRASQSVSSSYLAWYQQKPGQAPRLLIYGASTRASGIPDRFSGSGSGTDFTLTISRLEPEYFAVYYCQQYGNSPLTFGGGTKVEIK | QVQLVQSGAEVKKPGASVKVSCKASGYTFTNYDINWVRQATGQGLEWMGWMHPNNGNTGYAQKFQGRVTMTRNTSISTAYMELNSLRSEDTAVYYCAISSGWYWFDPWGQGTLVTVSL |
| | | | SEQ ID NO: 25988 | SEQ ID NO: 29994 |

FIGURE 50
(Continued)

| | | | |
|---|---|---|---|
| iPS:434959 | 21-225_87E10 | NA | GACATGTGATGACCCAGTCTCCAGACTCCCTGGCTGTGTCTCTGGGCGAGAGGGCCACCATCAAGTGCAAGTCCAGCCAGAGTGTTTTACACAGCTCCAACAATATGAACTACTTAGCTTGGTACCAGCAGAAACCTGGACAGCCTCCTAAACTGCTCATTTACTGGGCATCTACCCGGAAATCCGGGGTCCCTGACCGATTCAGTGGCAGCGGGTCTGGGACAGATTTCACTCTCACCATCAGCAGCCTGCAGGCTGAAGATGTGGCAGTTATTACTGTCAGCAATATTATAGTAGTCCGTGCAGTTTTGGCCAGGGACCAAGCTGAAGATCAAA SEQ ID NO: 25989 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCCTATAGCAGTGGCTGGTACTTCTTTGACTACTGGGGCCAGGGAACCCTGGTCACCGTCTCCTCA SEQ ID NO: 29995 |
| | | AA | DIVMTQSPDSLAVSLGERATIKCKSSQSVLHSSNNMNYLAWYQQKPGQPPKLLIYWASTRKSGVPDRFSGTGSGTDFTLTISSLQAEDVAVYYCQQYYSSPCSFGQGTKLKIK SEQ ID NO: 25990 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYFFDYWGQGTLVTVSS SEQ ID NO: 29996 |
| iPS:434961 | 21-225_87A12 | NA | GAAATTGTGTTGACGCAGTCTCCAGGCACCCGGTATTTGTCTCCAGGGGAAAGAGCCACCCTCTCATGCAGGGCCAGTCAGAGTGTTTACAGCAGCTACTTAGCCTGGTACCAGCAGAAACCTGGCCAGGCTCCCAGGCTCCTCATCTATGGTGCATCAGCCCGGTCCACTGTCATCCCAGACAGGTTCAGTGGCAGTGGGTGTGGGACAGACTTCGCTCTCACCATCAGCAGACTGGAGCCTGAAGATTGTGCAGTGTATTACTGTCAGCACTCTGATAACTCACCGTGGACGTTCGGCCAAGGGACCAAGGTGGAAATCAAA SEQ ID NO: 25991 | CAGGTGCAGCTACAGCAGTGGGGCGCAGGACTGTTGAAGCCTTCGGAGACCCTGTCCCTCACCTGCGCTGTCCATGGTGGGTCCTTCAGTGGTTGCTACTGGAGCTGGATCCGCCAGCCCCCAGGGAAGGGGCTGGAGTGGATTGGGAAATCAATCATAGTGGAAGCACCAACTACAACCCGTCCCTCAAGAGTCGAGTCACCATTTCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA SEQ ID NO: 29997 |

FIGURE 50
(Continued)

| | | | |
|---|---|---|---|
| iPS:434965 | 21-225_88A1 | AA | EIVLTQSPGTRYLSPGERATLSCRASQSVYSSYL AWYQQKPGQAPRLLIYGASSRSTVIPDRFSGSGC GTDFALTISRVEPEDCAVYYCQHSDNSPWTFGQ GTKVEIK | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS |
| | | | SEQ ID NO: 25992 | SEQ ID NO: 29998 |
| | | NA | AATATCGTGATGACCCAGTCTCCAGACTCCCT GGCTGTGTCTCTGGGCGAGAGGGCCACCATCA ACTGCAAGTCCAGCCAGAGTGTTTACACAGC TCCAACAATTACAACTACTTAACTTGGTACCA GCAGAAACCAGGACAGCCTCCTAAGCTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTTCTGTCAGCAA TATTATAGTTCTCCGACGTTCGGCCAAGG GACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG TGGCTGGTACTACTTTGACTACTGGGGCCAGGGA ACCCTGGTCACCGTCTCCTCA |
| | | | SEQ ID NO: 25993 | SEQ ID NO: 29999 |
| | | AA | NIVMTQSPDSLAVSLGARATINCKSSQSVLHSSN NYNYLTWYQQKPGQPPKLLLYWASTRKSGVPD RFSGSGSGTDFTLTISSLQAEDVAVYFCQQYYSS PPTFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS |
| | | | SEQ ID NO: 25994 | SEQ ID NO: 30000 |

FIGURE 50
(Continued)

| | | | |
|---|---|---|---|
| iPS:434969 | 21-225_88H1 | NA | GAAATTGTGTTGACGCAGTCTCCAGGCACCCT GTATTTGTCTCCAGGGGAAAGAGCCACCCTGT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACGGTCATCCCAGACAGGTTCAGT GGCAGTGGGTGTGGGACAGACTTCGCTCTCAC CATCAGCAGAGTGGAGCCTGAAGATTGTGCAG TGTATTACTGTCAGCATTCTGATAACTCACCGT GGACGTTCGGCCAAGGGACCAAGGTGGAAAT CAAA SEQ ID NO: 25995 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA SEQ ID NO: 30001 |
| | | AA | EIVLTQSPGTLYLSPGERATLSCRASQSVYSSYLA WYQQKPGQAPRLLIYGASSRSTVIPDRFSGSGCG TDFALTISRVEPEDCAVYYCQHSDNSPWTFGQG TKVEIK SEQ ID NO: 25996 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30002 |
| iPS:434971 | 21-225_88G2 | NA | GACATCGTGATGACCCAGTCTCCAGATTGCCT GGCTGTGTCTCTGGGCGAGAGGGCCACCATCA ACTGCAAGTCCAGCCAGAGTGTTTATACACC TCCAACAATAACAACAGGAACAGCCTCCTAAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCAA TATTATAATACTCCGTGGACGTTTGGCCAAGG GACCAAGGTGGAAATCAAA SEQ ID NO: 25997 | CAGGTGCAGCTGTGCAGTCTGGGGCTGAGGTG AAGAAGCCTGGGGCCTCAGTGAAGGTCTCCTGC AAGGCTTCGGATACACCTTCACCAATTATGATA TCAACTGGGTGCGACAGGCCACTGGACAAGGGC TTGAGTGGATGGATGGCACCTAACAGTGG TAACACAGGCTATGCACAGAAGTTCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCCTGGGGCCAGGGA ACCCTGGTCACCGTCTCCTCA SEQ ID NO: 30003 |

FIGURE 50
(Continued)

| | | | | |
|---|---|---|---|---|
| iPS:434973 | 21-225_88B4 | AA | DIVMTQSPDCLAVSLGERATINCKSSQSVLYTSNNNNYLAWYQQKPGQPPKLLIYWASTRESGVPDRFSGSGSGTDFTLTISSLQAEDVAVYYCQQYYNTPWTFVQGTKVEIK | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAISSGWYWFDPWGQGTLVTSS |
| | | | SEQ ID NO: 25998 | SEQ ID NO: 30004 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTATACATCTCCAACAATAATAATTACTTAGCTTGGTACCAGCAGAAACCAGGACAGCCTCCTAAACTGCTCATTTACTGGGCATCTACCCGGGAATCCGGGGTCCCTGCCCGATTCAGTGGCAGCGGGTCTGGGACAGATTTCACTCTCACCATCAGCAGCCTGCAGGCTGAAGATGTGGCAGTTTATTACTGTCAGCAATATTATAGTACTCCTCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGAACCCTAACAGTGGTGACACAGGCTATGCACAGAAGTTCCAGGGCAGTGTCACCATGACCAGGAACACCTCCATAACCACAGCCTACATGGAGCTGAGCAGCCTGAGATCTGAGGACACGGCCGTGTATTACTGTGTTCGTATAGCAGTGGCTGGTACTTTGACTACTGGGGCCAGGAACCCTGGTCACCGTCCTCCTCA |
| | | | SEQ ID NO: 25999 | SEQ ID NO: 30005 |
| | | AA | DIVMTQSPDSLAVSLGERATINCKSSQSVLYISNNNNYLAWYQQKPGQPPKLLIYWASTRESGVPARFSGSGSGTDFTLTISSLQAEDVAVYYCQQYYSTPPTFGQGTKVEIK | QVQLVQSGAEVKKPGASVKVSCKASGYTFTNYDINWVRQATGQGLEWMGWMNPNSGDTGYAQKFQGSVTMTRNTSITTAYMELSSLRSEDTAVYYCSYSSGWYYFDYWGQGTLVTSS |
| | | | SEQ ID NO: 26000 | SEQ ID NO: 30006 |

FIGURE 50
(Continued)

| | | | | |
|---|---|---|---|---|
| iPS:434977 | 21-225_88A5 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATTTCACTCTCACAATCAGCAGCCTGCAGCCTGAAGATTTTGCAACTTATTACTGTCTACAGCATAATGATTACCCATTCACTTTCGGCCCTGGGACCAAAGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAGTTATGATATCAACTGGGTGCGACAGGCCACTGGACAAGGCTTGAGTGGATGGGATGAACCCTAACAGTGGTAACACAGGCTATGCACAGAAGTTCCAGGGCAGAGTCACCATGACCGTGGAACACCTCCATACGCACTGCCTACATGGAGCTGAGCAGCCTGAGATCTGAGGACACGGCCGTGTATTACTGTGCGCGAGGGTTTTACGATTTTTGACTGGTTATTCCCCACTACTACTACTACGATATGGACGTCTGGGGCCAAGGGACCACGGTCACCGTCTCCTCA |
| | | | SEQ ID NO: 26001 | SEQ ID NO: 30007 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNDYPFTFGPGTKVEIK | QVQLVQSGAEVKKPGASVKVSCKASGYTFTSYDINWVRQATGQGLEWMGWMNPNSGNTGYAQKFQGRVTMTWNTSIRTAYMELSSLRSEDTAVYYCARGFYDFLTGYSPTYYYYDMDVWGQGTTVTVSS |
| | | | SEQ ID NO: 26002 | SEQ ID NO: 30008 |
| iPS:434981 | 21-225_88E7 | NA | GAAATTGTGTTGACGCAGTCTCCAGGCACCCTGTCTTTGTCTCCAGGGGAAAGAGCCACCCTCTCCTGCAGGGCCAGTCAGAGTGTTTACAGCAGCTACTTAGCCTGGTACCAGCAGAAACCTGGCCAGGCTCCCAGGCTCCTCATTTATGGTGCATCCAGCCGGGCCACTGGCATCCCAGACAGGTTCAGTGGCAGTGGGTCTGGGACAGACTTCGCTCTCACCATCAGCAGAGAGTGGAGCCTGAAGATTGTGCAGTGTATTACTGTCAGCACTCTGATAACTACACCGTGGCTGTGTTCGGCGGAGGGACCAAGGTGGAAATCAAA | CAGGTGCAGCTACAGCAGTGGGGCGCAGGACTGTTGAAGCCTTCGGAGACCCTGTCCCTCACCTGCGCTGTCCATGGTGGGTCCTTCAGTGGTTGCTACTGGAGCTGGATCCGCCAGCCCCCAGGGAAGGGGCTGGAGTGGATTGGGGAAATCAATCATAGTGGAAGACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGGGACTACGGCGGTATGGACGTCTGGGGCCAAGGGACCACGGTCACCGTCTCCTCA |

FIGURE 50
(Continued)

| | | | SEQ ID NO: 26003 | EIVLTQSPGTLSLSPGERATLSCRASQSVYSSYLA WYQQKPGQAPRLLIYGASSRSTGIPDRFSGSGSG TDFALTISRVEPEDCAVYYCQHSDNSPWTFGQG TKVEIK | SEQ ID NO: 30009 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
|---|---|---|---|---|---|---|
| | | AA | SEQ ID NO: 26004 | GAAATTGTGTTGACGCAGTCTCCAGGCACCCT GTCTTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGGAAAT CAAA | SEQ ID NO: 30010 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA |
| iPS:434983 | 21-225_88F7 | NA | SEQ ID NO: 26005 | | SEQ ID NO: 30011 | |
| | | AA | SEQ ID NO: 26006 | EIVLTQSPGTLSLSPGERATLSCRASQSVYSSYLA WYQQKPGQAPRLLIYGASSRSTGIPDRFSGSGSG TDFALTISRLEPEDCAVYYCQHSDNSPWTFGQG TKVEIK | SEQ ID NO: 30012 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |

FIGURE 50
(Continued)

| | | | |
|---|---|---|---|
| iPS:434995 | 21-225_88G9 | NA | GAAATTGTGTTGACGCAGTCTCCAGGCACCCG GTATTTGTCTCCAGGGGAAAGAGCCACCCTCT CCTGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACAGAGTGGAGCCTGAAGATTGTGCAG TGTATTACTGTCAGCACTCTGATAACTCACCGT GGACGTTCGGCCAAGGGACCAAGGTGGAAAT CAAA<br><br>SEQ ID NO: 26007 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCGCCAGCCCCCAGGGAAGGGCT GGAGTGGATTGGGGAAATCAATCATAGTGGAAG CACCAACTACAACCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30013 |
| | | AA | EIVLTQSPGTRYLSPGERATLSCRASQSVYSSYL AWYQQKPGQAPRLLIYGASSRSTGIPDRFSGSGS GTDFALTISRVEPEDCAVYYCQHSDNSPWTFGQ GTKVEIK<br><br>SEQ ID NO: 26008 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30014 |
| iPS:434997 | 21-225_88C10 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATTGGAATTACTTAGCTTGGCACCA GCAGAAACCAGGACAGCCTCCTAAGTTGCTCA TTCACTGGGCATTTACTGGGAAATCCGGGGTC CCTGACCGATTCAGTGGCGGCGGGTCTGGGAC AAATTTCACTCTCACCATCAGCAGCCTGCAGG CTGAAGATGTGGCAGTTTATTACTGTCAGCAA TATTATAGAGCTCCTCCGACGTTCGGCCAAGG GACCAAGGTGGAAATCAAA<br><br>SEQ ID NO: 26009 | CAGGTGCAGCTGGTGCAGTCTGGGGCTGAGGTG AAGAAGCCTGGGGCCTCAGTGAGGGTCTCCTGC AAGGCTTCTGGATACACCTTCAGCAATTATGATA TCAACTGGGTGCGACAGGCCACTGGACAAGGGC TTGAGTGGATGGGATGGATGAACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGAGTAGCAGT GGCTGGTACTACTTTGACTCCTGGGGCCAGGGAA CCCTGGTCACCGTCTCCTTA<br><br>SEQ ID NO: 30015 |

FIGURE 50
(Continued)

| | | | | |
|---|---|---|---|---|
| iPS:434999 | 21-225_75A8 | AA | DIVMTQSPDSLAVSLGERATINCKSSQSVLHSSN NWNYLAWHQQKPGQPPKLLIHWAFTRKSGVPD RFSGGGSGTNFTLTISSLQAEDVAVYYCQQYYR APPTFGQGTKVEIK<br><br>SEQ ID NO: 26010 | QVQLVQSGAEVKKPGASVRVSCKASGYTFSNYDIN WVRQATGQGLEWMGWMTPNSGNTGYAQKFQGR VTMTRNTSISTAYMELSSLRSEDTAVYYCASSSGW YYFDSWGQGTLVTVSL<br><br>SEQ ID NO: 30016 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTCTGATAACTCACCGT GGACGTTCGGCCAAGGGACCAAGGTGAAAT CAAA<br><br>SEQ ID NO: 26011 | CAGGTGCAGCTACAGCAGTGGGGCGCAGGACTG TTGAAGCCTTCGGAGACCCTGTCCCTCACCTGCG CTGTCCATGTGGGTCTTCCAGTGGTTGTACTG GAGCTGGATCCGCCAGCCCCAGGGAAGGGGCT GGAGTGGATTGGGGAAATCAATCATAGTGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30017 |
| | | AA | EIVLTQSPGTLYLSPGERATLSCRASQSVYSSYLA WYQQKPGQAPRLLIYGASSRATGIPDRFSGSGSG TDFALTISRVEPEDCAVYYCQHSDNSPWTFGQG TKVEIK<br><br>SEQ ID NO: 26012 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br><br>SEQ ID NO: 30018 |

FIGURE 50
(Continued)

| | | | |
|---|---|---|---|
| iPS:435009 | 21-225_89G4 | NA | GATATTGTGATGACTCAGTCTCCACTCTCCCTG<br>CCCGTCACCCCTGGAGAGCCGGCCTCCATCTC<br>CTGCAGGTCTAGTCAGAGCCTCCTGCATAGTA<br>GTGGATACAACTATTTGGATTGGTACCTGCAG<br>AAGCCAGGGCAGTCTCCACAGCTCCTGATCTA<br>TTTGGGTTCTAATCGGGCCTCCGGGGTCCCTG<br>ACAGGTTCAGTGCAGTGGTTCAGGCACAGAT<br>TTTACACTGAAAATCAGCAGAGTGGAGGCTGA<br>GGATATTGGGTTTATTACTGCATGCAAGCTC<br>TACATATTCCTCACTTCGGCGGAGGGACC<br>AAGGTGGAGATCAAA |
| | | | SEQ ID NO: 26013 |
| | | AA | DIVMTQSPLSLPVTPGEPASISCRSSQSLLHSSGY<br>NYLDWYLQKPGQSPQLLIYLGSNRASGVPDRFS<br>GSGSGTDFTLKISRVEAEDIGVYYCMQALHIPLT<br>FGGGTKVEIK |
| | | | SEQ ID NO: 26014 |
| | | NA | GAGGTGCAGCTGGTGGAGTCTGGGGGAGGCTTG<br>GTACAGCCGGGGGGGTCCTGAGACTCTCCTGTG<br>CAGCCTCTGGATTCACCTTCAGTAGTTACGACAT<br>GCACTGGGTCCGCCAAGCTACAGGAAAAGGTCT<br>GGAGTGGGTCTCAGTTATTGGTACTGCTGGTGAC<br>ACATACTATCCAGGTCCGTGAAGGGCCGATTCA<br>CCATCTCCAGAGAAAATGCCAAGAACTCCTTGTA<br>TCTTCAAATGAACAGCCTGAGAGCCGGGACAC<br>GGCTGTGTATTTCTGTGCAAGAGCTCTTGACTAC<br>GGTGACTCCTTGGGCTACTACTACTACGGTATGG<br>ACGTCTGGGGCCAAGGGACCACGGTCACCGTCTC<br>CTCA |
| | | | SEQ ID NO: 30019 |
| | | | EVQLVESGGGLVQPGGSLRLSCAASGFTFSSYDMH<br>WVRQATGKGLEWVSAIGTAGDTYYPGSVKGRFTIS<br>RENAKNSLYLQMNSLRAGDTAVYFCARALDYGDS<br>LGYYYYGMDVWGQGTTVTVSS |
| | | | SEQ ID NO: 30020 |
| iPS:435013 | 21-225_89D5 | NA | GAAATTGTGTTGACGCAGTCTCCAGGCACCCT<br>GTATTTGTCTCCAGGGGAAAGAGCCACCCTCT<br>CATGCAGGGCCAGTCAGAGTGTTACAGCAGC<br>TACTTAGCCTGGTACCAGCAGAAACCTGGCCA<br>GGCTCCCAGGCTCCTCATTTATGTGCATCCA<br>GCCGGTCCACTGGCATCCCAGACAGGTTCAGT<br>GGCAGTGGGTCTGGGACAGACTTCGCTCTCAC<br>CATCAGCAGACTGGAGCCTGAAGATTTTGCAG<br>TGTATTACTGTCAGCACTATGATAACTCACCG<br>TGGACGTTCGGCCAAGGGACCAAGGTGGAAA<br>TCAAA |
| | | | SEQ ID NO: 26015 |
| | | NA | CAGGTGCAGCTACAGCAGTGGGGCGCAGGACTG<br>TTGAAGCCTTCGGAGACCCTGTCCCTCACCTGCG<br>CTGTCCATGGTGGGTCCTTCAGTGGTTGCTACTG<br>GAGCTGGATCCGCCAGCCCCCAGGGAAGGGGCT<br>GGAGTGGATTGGGAAATCAATCATAGTGGAAG<br>CACCAACTACAACCCGTCCCTCAAGAGTCGAGTC<br>ACCATTTCAGTAGACACGTCCAAGAACCAGTTCT<br>CCCTGAAGCTGAGCTCTGTGACCGCCGCGACAC<br>GGCTGTGTATTACTGTGCGAGGGACTACGGCGGT<br>ATGGACGTCTGGGGCCAAGGGACCACGGTCACC<br>GTCTCCTCA |
| | | | SEQ ID NO: 30021 |

FIGURE 50
(Continued)

| | | | |
|---|---|---|---|
| iPS:435015 | 21-225_89H5 | AA | EIVLTQSPGTLYLSSGERATLSCRASQSVYSSYLA WYQQKPGQAPRLLIYGASSRSTGIPDRFSGSGSG TDFALTISRLEPEDFAVYYCQHYDNSPWTFGQG TKVEIK<br>SEQ ID NO: 26016 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30022 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAACAGCAAC TACTTAGCCTGGTACCAGCAGAAACCTGGCCA GGCTCCCAGGCTCCTCATCTATGGTGCATTCA GCAGGGCCACTGGCATCCCAGACAGGTTCAGT GGCAGTGGGTCTGGGACAGACTTCAATCTCAT CATCAGCAGACTGGAGCCTGAAGATGAAGCTGTG TGTATTACTGTCAGCAGTATGATAATGAAGCTCAGTG TGGACGTTCGGCCAAGGGACCAAGGTGGAAA TCAAA<br>SEQ ID NO: 26017 | CAGGTGCAGCTACAACAGTGGGGCGCAGGACTG TTGAAGCCTTCGGAGACCCTGTCCCTCACTGCG CTGTCTATGTGGGTCCTTCAGTGGTTGCTACTG GAGCTGGATCCGCCAGCCCCCAGGGAAGGGCT GGAGTGGATTGGGAAATCAATTATAGTGGAAG CACCAACTTCAACCCGTCCTCAAGAGTCGAGTC ACCATATCAGCTGACACGTCCAAGAACCAGTTCT CCCTGAAGCTGAGCTCTGTGACCGCCGCGGACAC GGCTGTGTATTACTGTGCGAGAGACTACGGCGGT ATGGACGTCTGGGGCCAAGGGACCACGGTCACC GTCTCCTCA<br>SEQ ID NO: 30023 |
| | | AA | EIVLTQSPGTLSLSPGERATLSCRASQSVNSNYLA WYQQKPGQAPRLLIYGAFSRATGIPDRVSGSGS GTDFNLIISRLEPEDFAVYYCQQYESSVWTFGQG TKVEIK<br>SEQ ID NO: 26018 | QVQLQQWGAGLLKPSETLSLTCAVYGGSFSGCYW SWIRQPPGKGLEWIGEINYSGSTNFNPSLKSRVTISA DTSKNQFSLKLSSVTAADTAVYYCARDYGGMDV WGQGTTVTVSS<br>SEQ ID NO: 30024 |

FIGURE 50
(Continued)

| | | | | |
|---|---|---|---|---|
| iPS:435025 | 21-225_89E10 | NA | GAAATTGTGTTGACGCAGTCTCCAGGCACCCT GTATTTGTCTCAGGGGAAAGAGCCACCCTCT CCTGCAGGGCCAGTCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGTCATCCCAGACAGTTCAGT GGCAGTGGGTCTGGGACAGACTTCGCTCTCAC CATCAGCAGAGTGGAGCCTGAAGATTTTGCAG TGTATTACTGTCAGCATTCTGATAACTCTCCGT GGACGTTCGGCCAAGGGACCAAGGTGGAAAT CAAA<br>SEQ ID NO: 26019 | CAGGTGCAGCTACAGCAGTGGGGCGCAGGACTG TTGAAGCCTTCGGAGACCCTGTCCCTCACCTGCG CTGTCCATGGTGGTTCCTTCAGTGGTTGCTACTG GAGCTGGATCCGCCAGCCCCCAGGGAAGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCCGACAC GGCTGTGTATTACTGTGCGAGGGACTACGGCGGT ATGGACGTCTGGGGCCAAGGGACCACGGTCACC GTCTCCTCA<br>SEQ ID NO: 30025 |
| | | AA | EIVLTQSPGTLYLSSGERATLSCRASQSVYSSYLA WYQQKPGQAPRLLIYGASSRSTVIPDRFSGSGSG TDFALTISRVEPEDFAVYYCQHSDNSPWTFGQG TKVEIK<br>SEQ ID NO: 26020 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30026 |
| iPS:435029 | 21-225_89A11 | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAAC TTCTTAGCCTGGTACCAGCAGAAACCTGGCCA GGCTCCCAGGCTCCTCATCTATGGTGCATCTG CCAGGACCACTGGCATCCCAGACAGGTTCAGT GGCAGTGGGTCTGGGACAGACTTCACTCTCAC CATCAGCAGACTGGAGCCTGAAGATTTTGCAG TGTATTCCTGTCGTCAGCAGTATGAAATCTCACCG TGGACGTTCGGCCAAGGGACCAAGGTGGAAA TCAAA<br>SEQ ID NO: 26021 | CAGGTGCAGCTGCAGCCGTGGGGCGCAGGACTG TTGAAGCCTTCGGAGACCCTGTCCTCACCTGCG CTGTCTATGGTGGGTCCTTCAGTGGTTACTACTG GAGCTGGATCCGCCAGCCCCCAGGGAAGGGCT GGAGTGGATTGGGAAATCAATCATAGTGGACG CACCAGTACAACCCGTCCCTCAAGAGTCGAGTC ACCATATCAGTAGACACGTCCAAGAACCAGTTCT CCCTGAAGCTGAGCTCTGTGACCGCCGCCGACAC GGCTGTGTATTACTGTGCGAGAGACTACGGTGGT TTGGACGTCTGGGGCCAAGGGACCACGGTCACC GTCTCCTCA<br>SEQ ID NO: 30027 |

FIGURE 50
(Continued)

| | | | |
|---|---|---|---|
| iPS:435039 | 21-225_90G4 | AA | EIVLTQSPGTLSLSPGERATLSCRASQSVDSNFLA WYQQKPGQAPRLLIYGASARTTGIPDRFSGSGSG TDFTLTISRLEPEDFAVYSCQQYEISPWTFGQGT KVEIK<br>SEQ ID NO: 26022 | QVQLQPWGAGLLKPSETLSLTCAVYGGSFSGYYW SWIRQPPGKGLEWIGEINHSGRTSYNPSLKSRVTISV DTSKNQFSLKLSSVTAADTAVYYCARDYGGLDVW GQGTTVTVSS<br>SEQ ID NO: 30028 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGTCTCCAGACAGGTTCAGT GGCAGTGGGTCTGGGACAGACTTCGCTCTCAC CATCAGCAGAGTGGAGCCTGAAGATTGTGCAG TGTATTACTGTCAGCACTCTGATAACTCACCGT GGACGTTCGGCCAAGGGACCAAGGTGAAAT CAAA<br>SEQ ID NO: 26023 | CAGGTGCAGCTACAGCAGTGGGGCGCAGGACTG TTGAAGCCTTCGGAGACCCTGTCCCTCACCTGCG CTGTCCATGTGGGTCCTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 30029 |
| | | AA | EIVLTQSPGTLYLSPGERATLSCRASQSVYSSYLA WYQQKPGQAPRLLIYGASSRSTVIPDRFSGSGSG TDFALTISRVEPEDCAVYYCQHSDNSPWTFGQG TKVEIK<br>SEQ ID NO: 26024 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30030 |

FIGURE 50
(Continued)

| | | | | |
|---|---|---|---|---|
| iPS:435041 | 21-225_90A5 | NA | GAAATTGTGTTGACGCAGTCTCCAGGCACCCT GTATTTGTCTCCAGGGGAAAGAGCCACCCTCT CATGCAGGGCCAGTCAGTCAGAGTGTTTACAGCAGC TACTTAGCCTGGTACCAGCAGAAACCTGGCCA GGCTCCCAGGCTCCTCATTTATGGTGCATCA GCCGGGCCACTGGCATCCCAGACAGGTTCAGT GGCAGTGGGTCTGGGACAGACTTCGCTCTCAC CATCAGCAGAGTGGAGCATGATGAAGATTTTGCAG TGTATTACTGTCAGCACTATGATAACTCACCG TGGACGTTCGGCCAAGGGACCAAGGTGGAAA TCAAA SEQ ID NO: 26025 | CAGGTGCAGCTACAGCAGTGGGGCGCAGGACTG TTGAAGCCTTCGGAGACCCTGTCCCTCACCTGCG CTGTCCATGGTGGTCTTCAGTGGTTGCTACTG GAGCTGGATCCGCCAGCCCAGGAAGGGCT GGAGTGGATTGGGGAAATCAATCATAGTGGAAG CACCAACTACACAAACCCGTCCCTCAAGAGTCGAGTC ACCATTTCAGTAGACACGTCAAGAACCAGTTCT CCCTGAAGCTGAGCTGTGACGCCGCCGGACAC GGCTGTGTATTACTGTGCGAGGGACTACGGCGGT ATGGACGTCTGGGGCCAAGGGACCACGGTCACC GTCTCCTCA SEQ ID NO: 30031 |
| | | AA | EIVLTQSPGTLYLSPGERATLSCRASQSVYSSYLA WYQQKPGQAPRLLIYGASSRATGIPDRFSGSGSG TDFALTISRVEHEDFAVYYCQHYDNSPWTFGQG TKVEIK SEQ ID NO: 26026 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30032 |
| iPS:435043 | 21-225_90G5 | NA | GAAATTGTGTTGACGCAGTCTCCAGGCACCCT GTATTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCA GCCGGGCCACTGGCATCCCAGACAGGTTCAGT GGCAGTGGGTCTGGGACAGACTTCGCTCTCAC CATCAGCAGAGTGGAGCATGATGAAGATTTTGCAG TGTATTACTGTCAGCACTATGATAACTCACCG TGGACGTTCGGCCAAGGGACCAAGGTGGAAA TCAAA SEQ ID NO: 26027 | CAGGTGCAGCTACAGCAGTGGGGCGCAGGACTG TTGAAGCCTTCGGAGACCCTGTCCCTCACCTGCG CTGTCCATGGTGGATCGGCCAGCCCAGGAAGGGCT GGAGTGGATTGGGGAAATCAATCATAGTGGAAG CACCAACTACACAAACCCGTCCCTCAAGAGTCGAGTC ACCATTTCAGTAGACACGTCAAGAACCAGTTCT CCCTGAAGCTGAGCTGTGACGCCGCCGGACAC GGCTGTGTATTACTGTGCGAGGGACTACGGCGGT ATGGACGTCTGGGGCCAAGGGACCACGGTCACC GTCTCCTCA SEQ ID NO: 30033 |

FIGURE 50
(Continued)

| | | | |
|---|---|---|---|
| | | AA | EIVLTQSPGTLYLSPGERATLSCRASQSVYSSYLA WYQQKPGQAPRLIIYGASSRATGIPDRFSGSGSG TDFALTISRVEHEDFAVYYCQHYDNSPWTFGQG TKVEIK<br>SEQ ID NO: 26028 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br>SEQ ID NO: 30034 |
| iPS:435045 | 21-225_90H5 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATTGCATCCAGTT TGCAAAGTGGGGTCCCATCAAGGTTCAGCGGC AGTGGATCTGGGACAGAGAATTCACTCTCACAAT CAGCAGCCTGCAGCCTGAAGATTTTGCAACTT ATTACTGTCTACAGCATATAGTTACCCGATC ACCTTCGGCCAAGGGACACGACTGGAGATTAA A<br>SEQ ID NO: 26029 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGTCTCCAGGCAAGGGGCT GGAGTGGGTGGCAGTTATATGGTATGAAGGAAG TAATACATATACTATGCAGACTCCGTGAAGGGCCGA TTCACCATCTCAAGAGACAATTCCAAGAACACGC TGTATCTGCAAATGAACAGCCTGAGAGCCGAGG ACACGGCTGTATATTACTGTGTGAGAGATGGG GTGGTTAGATGACTACTGGGGCCAGGGAACCCT GGTCACCGTCTCCTCA<br>SEQ ID NO: 30035 |
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPITFGQGTR LEIK<br>SEQ ID NO: 26030 | QVQLVESGGGVVQPGRSLRLSCAASGFTFSDYGM HWVRQSPGKGLEWVAVIWYEGSNTYYADSVKGR FTISRDNSKNTLYLQMNSLRAEDTAVYYCVREMG WLDDYWGQGTLVTVSS<br>SEQ ID NO: 30036 |

FIGURE 50
(Continued)

| | | | |
|---|---|---|---|---|
| iPS:435051 | 21-225_90D9 | NA | GACATCGTGATGACCCAGTCTCCAGACTCCCTGGCTGTGTCTCTGGGCGAGAGGGCCACCATCATCTGCAAGTCCAGCCAGACTGTTTTACACAGCTCCAACAATTATAACTACTTAGCTTGGTACCAGCAGAAGCCAGGACAGCCCCCTAAGGTGCTCATTTACTGGACATCTACCCGGGAATCCGGGGTCCCCTGACCGATTCAGTGGCAGCGGGTCTGGAACAGATTTCACTCTCACCATCAGCAGCCTGCAGGCTGAAGATGTGGCAGTTTATTACTGTCAGCAATATCTTAGTAGTCCTCTGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCCCCAATTATGATATCAACTGGGTGCGACAGGCCACTGGACAAGGCTTGAGTGGATGGGATGGAACCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTATTGTGCGGTTTCCAGTGGCTGGCACTGGTTCGACCCCTGGGGCCAGGGAACCCTGGTCACCGTCACCGTCTCCTCA SEQ ID NO: 30037 |
| | | | SEQ ID NO: 26031 | |
| | | AA | DIVMTQSPDSLAVSLGERATIICKSSQTVLHSSNNYNYLAWYQQKPGQPPKVLIYWTSTRESGVPDRFSGSGSGTDFTLTISSLQAEDVAVYYCQQYLSSPLTFGQGTKVEIK | QVQLVQSGAEVKKPGASVKVSCKASGYTFPNYDINWVRQATGQGLEWMGWMNPNSGNTGYAQKFQGRVTMTRNTSISTAYMELSSLRSEDTAVYYCAVSSGWHWFDPWGQGTLVTVAS |
| | | | SEQ ID NO: 26032 | SEQ ID NO: 30038 |
| iPS:435053 | 21-225_75F9 | NA | GACATCGTGATGACCCAGTCTCCAGACTCCCTGCCTGTGTCTCTGGGCGAGAGGGCCACCGTCAACTGCAAGTCCAGCCAGAGTGTTTTACACAACTCCAACAATAATAACTACTTGGCTTGGTACCAGCAGAAACCAGGACAGCCTCCTAAGCTGCTCATTTACTGGGCATCTACCCGGGAGTCCGGGGTCCCTGACCGATTCAGTGGCAGCGGGTCTGGGACAGTCACCATGACCATCAGCAGCCTGCAGGCTGAAGATGTGGCAGTTTATTACTGTCAACAATATTATAGTAGTCCTCCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACAGAAGTCACGGTAACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCCTATAGCAGTGGCTGGTACATCTTTGACTACTGGGGCCAGGGAACCCTGGTCACCGTCTCCTCA |
| | | | SEQ ID NO: 26033 | SEQ ID NO: 30039 |

FIGURE 50
(Continued)

| | | | | |
|---|---|---|---|---|
| iPS:435055 | 21-225_90F10 | AA | DIVMTQSPDSLPVSLGERATVNCKSSQSVLHNSN NNNYLAWYQQKPGQPPKLLIYWASTRESGVPD RFSGSGSGTDFTLTISSLQAEDVAVYYCQQYYSS PPTFGQGTKVEIK<br>SEQ ID NO: 26034 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YIFDYWGQGTLVTVSS<br>SEQ ID NO: 30040 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAATCACCG TGGACGTTCGGCCAAGGGACCAAGGTGGAAA TCAAA<br>SEQ ID NO: 26035 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCAGGGAAGGGGCT GGAGTGGATTGGGAAATCAATCATAGTGGAAG CACCAACTACAACCCGTCCCTCAAGAGTCGAGTC ACCATTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCAAGGGACCACGGTCACC GTCTCCTCA<br>SEQ ID NO: 30041 |
| | | AA | EIVLTQSPGTLYLSPGERATLSCRASQSVYSSYLA WYQQKPGQAPRLLIYGASSRSTGIPDRFSGSGSG TDFALTISRLEPEDCAVYYCQHYDNSPWTFGQG TKVEIK<br>SEQ ID NO: 26036 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTSS<br>SEQ ID NO: 30042 |

FIGURE 50
(Continued)

| | | | | |
|---|---|---|---|---|
| iPS:435059 | 21-225_90C11 | NA | GATATTGTGATGACTCAGTCTCCACTCTCCCTG CCCGTCACCCTGGAGAGCCGGCCTCCATCTC ATGCAGGTATAGTCAGAGCCTGTGCATAGTA GTGGATACAAACTATTTGGATTGGTACCTGCAG AAGCCAGGGCAGTCTCCACAGCTCGTTATCTA TTTGGGGTTCAATCGGGCCTCCGGGGTCCCTG ACAGGTTCAGTGGCAGTGGATCAGGTTCAGAT TTTACACTGAAGATCAGCAGAGTGGAGGCTGA GGATGTTGGACTTTATTACTGCATGCAAGCTC TACACCCTCCTCCACTTCGGCGGAGGGACC AAGGTGGAGATCAAA<br><br>SEQ ID NO: 26037 | GAGGTGCAGCTGGTGGAGTCTGGGGGAGGCTTG GTACAGCCGGGGGGGTCCCTGAGACTCTCCTGTG CAGCCCTCTGGATTCACCTTCAGTAACTACGACAT GCACTGGGTCCGCCAAGCTACAGGAAAGGTCT GGAGTGGGTCTCAGTATTGGTACTGCTGGTGAC ACATACTATCAGGCTCCGTGAAGGGCCGATTCA CCATCTCCAGAGAAAATGCCAAGAACTCCTTGTA TCTTCAAATGAATGAACAGCCTGAGAGCCGGGACAC GGCTGTGTATTACTGTGCAAGAGTTCTTGACTAC GGTGACTCCTTGGGCTACTACTACGGTATGG ACGTCTGGGGCCAAGGGACCACCGTCACCGTCTC CTCA<br><br>SEQ ID NO: 30043 |
| | | AA | DIVMTQSPLSLPVTPGEPASISCRYSQSLVHSSGY NYLDWYLQKPGQSPQLVIYLGSNRASGVPDRFS GSGSGSDFTLKISRVEAEDVGLYYCMQALHPPL TFGGGTKVEIK<br><br>SEQ ID NO: 26038 | EVQLVESGGGLVQPGGSLRLSCAASGFTFSNYDMH WVRQATGKGLEWVSAIGTAGDTYYPGSVKGRFTIS RENAKNSLYLQMNSLRAGDTAVYYCARVLDYGDS LGYYYYGMDVWGQGTTVTVSS<br><br>SEQ ID NO: 30044 |
| iPS:435071 | 21-225_91F1 | NA | GACATCGTGATGACCCAGTCTCCAGATTGCCT GGCTGTGTCTCTGGGCGAGAGGGCCACCATCA ACTGCAAGTCCAGCCAGAGTGTTTTATACAC TCCAACAATAACAAGGACAGCCTCCTAAGCTGCTCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ATTATAATACTCCGTGGAAGTTGTCAAGGG ACCAAGGTGGAAATCAAA<br><br>SEQ ID NO: 26039 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCAGGCAG TAACACAGGCTATGCACAGAAGTTCAGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGA ACCCTGGTCACCGTCTCCTCA<br><br>SEQ ID NO: 30045 |

FIGURE 50
(Continued)

| | | AA | DIVMTQSPDCLAVSLGERATINCKSSSQSVLYTSN NNNYLAWYQQKPGQPPKLLIYWASTRESGVPD RFSGSGSGTDFTLTISSLQAEDVAVYYCQHYYNT PWKFVQGTKVEIK<br><br>SEQ ID NO: 26040 | QVQLVQSGAEVKKPGASVKVSCKASGYTFNYDIN WVRQATGQGLEWMGWMHPNSGNTGYAQKFQGR VTMTRNTSISTAYMELSSLRSEDTAVYYCAISSGW YWFDPWGQGTLVTVSS<br><br>SEQ ID NO: 30046 |
|---|---|---|---|---|
| iPS:435073 | 21-225_91B2 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGGCATCCCAGACAGGTTCAGT GGCAGTGGGTCTGGGACAGACTTCGCTCTCAC CATCAGCAGAGTGGAGCCTGAAGATTGTGCAG TGTATTACTGTCAGCACTATTATGATAACTCACCG TGGACGTTCGGCCAAGGGACCAAGGTGGAAA TCAAA<br><br>SEQ ID NO: 26041 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30047 |
| | | AA | EIVLTQSPGTLYLSPGERATLSCRASQSVYSSYLA WYQQKPGQAPRLLIYGASSRSTGIPDRFSGSGSG TDFALTISRVEPEDCAVYYCQHYDNSPWTFGQG TKVEIK<br><br>SEQ ID NO: 26042 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30048 |

FIGURE 50
(Continued)

| | | | | |
|---|---|---|---|---|
| iPS:435075 | 21-225_91B3 | NA | GAAATTGTGTTGACGCAGTCTCCAGGCACCCT GTATTTGTCTCTGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCA GCCGGTCCACTGGCATCCCAGACAGGTTCAGT GGCAGTGGGTCTGGGACAGACTTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA<br><br>SEQ ID NO: 26043 | CAGGTGCAGCTACAGCAGTGGGGCGCAGGACTG TTGAAGCCTTCGGAGACCGTCCTCACCTGCG CTGTCCATGGTGGGTCTTCAGTGGTTGCTACTG GAGCTGGATCCGCCAGCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGGAGGGACTACGGCGGT ATGGACGTCTGGGGCCAAGGGACCACGGTCACC GTCTCCTCA<br><br>SEQ ID NO: 30049 |
| | | AA | EIVLTQSPGTLYLSPGERATLSCRASQSVYSSYLA WYQQKPGQAPRLLIYGASSRSTGIPDRFSGSGSG TDFALTISRVEHEDCAVYYCQHYDNSPWTFGQG TKVEIK<br><br>SEQ ID NO: 26044 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30050 |
| iPS:435077 | 21-225_91F3 | NA | GAAATTGTGTTGACGCAGTCTCCAGGCACCCT GTATTTGTCTCTGGGGAAAGAGCCACCCTCT CATGCAGGGCCAGTCAGAGTGTTTACAGCAGC TACTTAGCCTGGTACCAGCAGAAACCTGCCCA GGCTCCCAGGCTCCTCATTTATGGTGCATCA GCCGGTCCACTGGCATCCCAGACAGGTTCAGT GGCAGTGGGTCTGGGACAGACTTCGCTCTCAC CATCAGCAGAGTGGAGCCTGAAGATTGTGCAG TGTATTACTGTCAGCATTCTGATAACTCACCGT GGACGTTCGGCCAAGGGACCAAGGTGGAAAT CAAA<br><br>SEQ ID NO: 26045 | CAGGTGCAGCTACAGCAGTGGGGCGCAGGACTG TTGAAGCCTTCGGAGACCGTCCTCACCTGCG CTGTCCATGGTGGGTCTTCAGTGGTTGCTACTG GAGCTGGATCCGCCAGCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCCAAGAACCAGTTCT CCCTGAAGCTGAGCTCTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30051 |

FIGURE 50
(Continued)

| | | | |
|---|---|---|---|
| | | AA | EIVLTQSPGTLYLSPGERATLSCRASQSVYSSYLA WYQQKPAQAPRLLIYGASSRSTGIPDRFSGSGSG TDFALTISRVEPEDCAVYYCQHSDNSPWTFGQG TKVEIK<br>SEQ ID NO: 26046 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30052 |
| iPS:435079 | 21-225_91B4 | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATCATTTATGGTGCATCA GCCGGTCCACTGGCATCCCAGACAGGTTCAGT GGCAGTGGGTCTGGGACAGACTTCGCTCTCAC CATCAGCAGAGTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 26047 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 30053 |
| | | AA | EIVLTQSPGTLYLSPGERATLSCRASQSVYSSYLA WYQQKPGQAPRLIIYGASSRSTGIPDRFSGSGSG TDFALTISRVEPEDCAVYYCQHYDNSPWTFGQG TKVEIK<br>SEQ ID NO: 26048 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30054 |

FIGURE 50
(Continued)

| | | | |
|---|---|---|---|
| iPS:435087 | 21-225_91G8 | NA | GACATGTGATGACCCAGTCTCCAGATTGCCT GGCTGTGTCTCTGGGCGAGAGGGCCACCATCA ACTGCAAGTCCAGCCAAGTGTTTTATACACC TCCAACAATAACAACTACTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCAA TATTATACTACTCCGTGGACGTTCGGCCAAGG GACCAAGGTGGAAATCAAA<br>SEQ ID NO: 26049 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGTTCGACCCCGTGGGGCCAGGGA ACCCTGGTCACCGTCTCCTCA<br>SEQ ID NO: 30055 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQQYYTT PWTFGQGTKVEIK<br>SEQ ID NO: 26050 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS<br>SEQ ID NO: 30056 |
| iPS:435089 | 21-225_91E9 | NA | GAAATTGTGTTGACGCAGTCTCCAGGCACCCT GTATTTGTCTCCAGGGAAAGAGCCACCCTGT CATGCAGGGCCAGTCAGAGTGTTACAGCAGC TACTTAGCGTGGTACCAGCAGAAACCTGGCCA GGCTCCCAGGCTCCTCATTTATGGTGCATCA GCCGGGCCACGGGCATCCCAGACAGGTTCAGT GGCAGTGGGTGTGGGACAGACTTCGCTCTCAC CATCAGCAGAGTGGAGCAGATGAAGATTGTGCA GTGTATTACTGTCAGCACTCTGATAACTCACC GTGGACGTTCGGCCAAGGGACCAAGGTGGAA ATCAAA<br>SEQ ID NO: 26051 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGACACG GCTGTGTATTACTGTGCGAGGGACTACGGCGGT ATGGACGTCTGGGGCCAAGGGACCACGGTCACC GTCTCCTCA<br>SEQ ID NO: 30057 |

FIGURE 50
(Continued)

| | | | |
|---|---|---|---|
| iPS:435097 | 21-225_92B1 | AA | EIVLTQSPGTLYLSLSPGERATLSCRASQSVYSSYLA WYQQKPGQAPRLLIYGASSRATGIPDRFSGSGSCG TDFALTISRVEHEDCAVYYCQHSDNSPWTFGQG TKVEIK<br>SEQ ID NO: 26052 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30058 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGGCAGCAAC TACTTAGCCTGGTACCAGCAGAAACGTGGCCA GGCTCCCAGGCTCCTCATCTATGGTGCATCCA GCAGGGCCACTGACATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGAAAGTTCACCG TGGACGTTCGGCCAAGGGACCAAGGTGGAAA TCAAA<br>SEQ ID NO: 26053 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTCCTACTGG AGCTGGATCCGCCAGCCCCAGGAAGGGGCTG GAGTGGATTGGGAAATCAATTATAGGGGAAGC ACCAACTACAACCCGTCCCTCAAGAGTCGAGTCG CCATATCAGTAGACACGTCCAAGAACCAGTTCTC CCTGAACCTGACCTCTGTGCGAGGGACTACGGCGGT GCTGTGTATTACTGTGCGAGGGACTACGGCGGTT TGGACGTCTGGGGCCAAGGGACCACGGTCACCG TCTCCTCA<br>SEQ ID NO: 30059 |
| | | AA | EIVLTQSPGTLSLSPGERATLSCRASQSVGSNYLA WYQQKRGQAPRLLIYGASSRATDIPDRFSGSGSG TDFTLTISRLEPEDFAVYYCQQYESSPWTFGQGT KVEIK<br>SEQ ID NO: 26054 | QVQLQQWGAGLLKPSETLSLTCAVYGGSFSGSYW SWIRQPPGKGLEWIGEINYRGSTNYNPSLKSRVAIS VDTSKNQFSLNLTSVTAADTAVYYCARDYGGLDV WGQGTTVTVSS<br>SEQ ID NO: 30060 |

FIGURE 50
(Continued)

| | | | | |
|---|---|---|---|---|
| iPS:435103 | 21-225_92B2 | NA | GATATTGTGATGACTCAGTCTCCACTCTCCCTC CCTGTCACCCCTGGAGAGCCGGCCTCCATCTC ATGCAGGTCTAGTCAGAGCTCGTGCATAGTA GTGGATACAACTATTTGGATTGGTACCTGCAG AAGCCAGGGCAGTCTCCACAACTCGTGATCTA TTTGGGTTCTAATCGGGCCTCCGGGGTCCCTG ACAGGTTCAGTGGCAGTGGTTCAGTCACAGAT TTTACACTGAGAATCAGCAGAGTGGAGGCTGA GGATATTGGGATTTATTATTGCATGCAAGCTC TACATATTCCTCTCACTTTCGGCGGAGGGACC AAGGTGGAGATCAAA<br><br>SEQ ID NO: 26055 | GAGGTGCAGCTGGTGGAGTCTGGGGGAGGCTTG GTACAGCCGGGGGGGTCCCTGAGACTCTCCTGTG CAGCCTCTGATTCACCTTCAGTAACTACGACAT GCACTGGGTCCGCCAAGCTACAGGAAAAGGTCT GGAGTGGGTCTCAGTATTGGTACTGCTGGTGAC ACATACTATCCAGGCTCCGTGAAGGGCCGATTCA CCATCTCCAGAGAAAATGCCAAGAACTCCTTGTA TCTTCAAATGAATAACAGCCTGAGAGCCGGGACAC GGCTGTGTATTTCTGTGCAAGAGCTCTTGACTAC GGTGACTCCTTGGGCTACTACTACGGTATGG ACGTCTGGGGCCAAGGGACCACCGGTCACCGTCTC CTCA<br><br>SEQ ID NO: 30061 |
| | | AA | DIVMTQSPLSLPVTPGEPASISCRSSQSLVHSSGY NYLDWYLQKPGQSPQLVIYLGSNRASGVPDRFS GSGSVTDFTLRISRVEAEDIGIYYCMQALHIPLTF GGGTKVEIK<br><br>SEQ ID NO: 26056 | EVQLVESGGGLVQPGGSLRLSCAASGFTFSNYDMH WVRQATGKGLEWVSAIGTAGDTYYPGSVKGRFTIS RENAKNSLYLQMNNSLRAGDTAVYFCARALDYGDS LGYYYYGMDVWGQGTTVTVSS<br><br>SEQ ID NO: 30062 |
| iPS:435109 | 21-225_92H5 | NA | GAAATAGTGATGACGCAGTCTCCAGCCACCCT GTCTGTGTCTCCAGGGGAAAGAGCCACCCTCT CCTGCAGGGCCAGTCAGAGTGTTATCAACCTAC TTAGCCTGGTACCAGCAGAAACCTGGCCAGGC TCCCAGGCTCCTCATCTATGGTGCATCCACCA GGGCCACTGGTGTCCCAGCCAGGTTCAGTGGC AGTGGGTCTGGGACAGAGTTCACTCTCACCAT CACCAGCCTGCAGTCTGAAGATATAATGACTGCCGTGC ATTACTGTCAGGAGTATAATGACTGGAGATCAA GTTTTGGCCAGGGGACCAAGCTGGAGATCAA A<br><br>SEQ ID NO: 26057 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCCTT TATAGTGGAGCTACTTACTTTGACTACTGGGGC CAGGGAACCCTGGTCACCGTCTCCTCA<br><br>SEQ ID NO: 30063 |

FIGURE 50
(Continued)

| | | | |
|---|---|---|---|
| iPS:435111 | 21-225_92D6 | AA | EIVMTQSPATLSVSVSPGERATLSCRASQDVITYLA WYQQKPGQAPRLLIYGASTRATGVPARFSGSGS GTEFTLTITSLQSEDFALYYCQEYNDWPCSFGQG TKLEIK<br>SEQ ID NO: 26058 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDPFIV GATYFDYWGQGTLVTVSS<br>SEQ ID NO: 30064 |
| | | NA | GAAATTGTGTTGACGCAGTCTCCAGGCACCCT GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGTCCACTGTCATCCCAGACAGGTTCAGT GGCAGTGGGTGTGGGACAGACTTCGCTCTCAC CATCAGCAGACTGGAGCCTGAAGATTGTGCAG TGTATTACTGTCAGCATTATGATAACTCTCCGT GGACGTTCGGCCAAGGGACCAAGGTGGAAAT CAAA<br>SEQ ID NO: 26059 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCAAGAACCAGTTCT CCCTGAAGCTGAGCTCTGTGACCGCCGCAGACAC GGCTGTGTATTACTGTGCGAGGGACTACGGCGGT ATGGACGTCTGGGGCCAAGGGACCACGGTCACC GTCTCCTCA<br>SEQ ID NO: 30065 |
| | | AA | EIVLTQSPGTLYLSPGERATLSCRASQSVYSSYLA WYQQKPGQAPRLLIYGASSRSTVIPDRFSGSGCG TDFALTISRLEPEDCAVYYCQHYDNSPWTFGQG TKVEIK<br>SEQ ID NO: 26060 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 30066 |

FIGURE 50
(Continued)

| | | | |
|---|---|---|---|
| iPS:435113 | 21-225_92E6 | NA | GACATGTGATGACCCAGTCTCCAGACTCCCT GGCTGCGTCTCTGGGCGAGAGGCCACCATCA ACTGCAAGTCCAGTCAGTCAGAATATTTATCCAGC TCCAACAATAAGAACCAGACTACTTAACTGGTACCA GCAGAAACCAGGACAGCCTCCTAAAATACTCA TTTACTGGACATCTACCCGGGAATCCGGGGTC CCTGACCGATTCAGTGGCAGCGGGGTTTGGGAC AGATTTCACTCTCACCATCAGCAGCCTGCAGG CTGAAGATGTGGCTGTTTATTACTGTCAGCAA TATTTTAGTGTTCCTCCGACGTTCGGCCAAGG GACCAAGGTGGAAATCAAA | CAGGTGCAGCTGGTGCAGTCTGGGGCTGAGGTG AAGAAACCTGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATGAGCAC AGCCTACATGGAGCTGAGCAGCCTGAGATCTGA GGACACGGCCGTGTATTACTGTGCCATAGCAGT GGCTGGTACTTTTTGACTACTGGGGCCAGGGAA CCCTGGTCACCGTCTCCTCA |
| | | | SEQ ID NO: 26061 | SEQ ID NO: 30067 |
| | | AA | DIVMTQSPDSLAASLGERATINCKSSQNILSSSNN KNYLTWYQQKPGQPPKILIYWTSTRESGVPDRFS GSGFGTDFTLTISSLQAEDVAVYYCQQYFSVPPT FGQGTKVEIK | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS |
| | | | SEQ ID NO: 26062 | SEQ ID NO: 30068 |
| iPS:435115 | 21-225_77C5 | NA | GAAATTGTGTTGACGCAGTCTCCAGGCACCCT GTCTTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGAAATCAATCATAGTGGAAG CACCAACTACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA |
| | | | SEQ ID NO: 26063 | SEQ ID NO: 30069 |

FIGURE 50
(Continued)

| | | | |
|---|---|---|---|
| iPS:435167 | 21-225_92F12 | AA | EIVLTQSPGTLSLSPGERATLSCRASQSVYSSYLAWYQQKPGQAPRLLIYGASSRSTGIPDRFSGSGSGTDFALTISRLEPEDFAVYYCQHYDNSPWTFGQGTKVEIK<br>SEQ ID NO: 26064 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS<br>SEQ ID NO: 30070 |
| | | NA | GACATCGTGATGACCCAGTCTCCAGACTCCCTGGCTGTGTCTCTGGGCGAGAGGGCCACCAATTGTAAGTCCAGCCAGAGTGTTTTACACAGGTCCAACAATTACAACTACTTAGCGTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTACTCCTCGACGTTCGGCCAAGGGACCAAGGTGGAAATCAAA<br>SEQ ID NO: 26065 | CAGGTGCAGCTGGTGCAGTCTGGGGCTGAGGTGAAGAAGCCTGGGGCCTCAGTGAAGGTCTCTGCAAGGCTTCTGGATACACCTTGACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGGCAGTCACCATGACCAGGAACACCTCCATAAGCACAGCCTACATGGAACTGAGCAGCCTGAGATCTGAGGACACGGCCGTGTATTACCGTGGAGTACCAGTGGCGGGAAGTTCTTCGACTACTGGGGCCAGGGAACCCTGGTCACCGTCTCCTCA<br>SEQ ID NO: 30071 |
| | | AA | DIVMTQSPDSLAVSLGERATTNCKSSQSVLHRSNNYNYLAWYQQKPGQPPKLLIYWASTRESGVPDRFSGSGSGTDFTLTISSLQAEDVAVYYCQQYYSTPPTFGQGTKVEIK<br>SEQ ID NO: 26066 | QVQLVQSGAEVKKPGASVKVSCKASGYTLTNYDINWVRQATGQGLEWMGWMNPNSGNTGYAQKFQGRVTMTRNTSISTAYMELSSLRSEDTAVYYRGSTSGGKFFDYWGQGTLVTVSS<br>SEQ ID NO: 30072 |

FIGURE 50 (Continued)

| | | | |
|---|---|---|---|
| iPS:435171 | 21-225_93C2 | NA | GAAATTGTGTTGACGCAGTCTCCAGGCACCCT GTATTGTCTCCAGGGGAAAGAGCCACCCTCT CCTGCAGGGCCAGTCAGTCAGAGTGTTTACAGCAGC TACTTAGCCTGGTACCAGCAGAAACCTGGCCA GGCTCCCAGGCTCCTCATCTATGGTGCATCCA GCCGGGCCACTGGCATACCAGACAGGTTCAGT GGCAGTGGGTCTGGGACAGACTTCGCTCTCAC CATCAGCAGACTGGAGCATGAAGATTGTGCAG TGTATTACTGTCAGCACTATGATAACTCACCG TGGACGTTCGGCCAAGGGACCAAGGTGGAAA TCAAA<br><br>SEQ ID NO: 26067 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30073 |
| | | AA | EIVLTQSPGTLVLSPGERATLSCRASQSVYSSYLA WYQQKPGQAPRLLIYGASSRATGIPDRFSGSGSG TDFALTISRLEHEDCAVYYCQHYDNSPWTFGQG TKVEIK<br><br>SEQ ID NO: 26068 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30074 |
| iPS:435177 | 21-225_93E4 | NA | GAAATTGTGTTGACGCAGTCTCCAGGCACCCT GTATTGTCTCCAGGGGAAAGAGCCACCCTCT CATGCAGGGCCAGTCAGTGTTTACAGCAGC TACTTAGCCTGGTACCAGCAGAAACCTGGCCA GGCTCCCAGGCTCCTCATTTATGGTGCATCCA GCCGGGTCCACTGGCATCCAGACAGGTTCAGT GGCAGTGGGTGTGGGACAGAGTTCGCTCTCAC CATCAGCAGAGTGGAGCCTGAAGATTTTGCAG TGTATTACTGTCAGCACTCTGATAACTCACCGT GGACGTTCGGCCAAGGGACCAAGGTGGAAAT CAAA<br><br>SEQ ID NO: 26069 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGCTACTG GAGCTGGATCCGCCAGCCCCCAGGGAAGGGCT GGAGTGGATTGGGGAAATCAATCATAGTGGAAG CACCAACTACAAACCCGTCCCTCAAGAGTCGAGTC ACCATTTCAGTAGACACGTCCAAGAACCAGTTCT CCCTGAAGCTGAGCTGTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30075 |

FIGURE 50
(Continued)

| | | | |
|---|---|---|---|
| iPS:435183 | 21-225_93E9 | AA | EIVLTQSPGTLYLSLSPGERATLSCRASQSVYSSYLA WYQQKPGQAPRLLIYGASSRSTGIPDRFSGSGCG TDFALTISRVEPEDFAVYYCQHSDNSPWTFGQG TKVEIK SEQ ID NO: 26070 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS SEQ ID NO: 30076 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGACAGCAGC TACCTAGCCTGGTACCAGCAGAAAACTGGCCA GGCTCCCAGGCTCCTCATCTATGGTGCATCCA GCAGGGCCCCTGCATCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGAAAGCTCACCG TGGACGTTCGGCCAAGGGACCAAGGTGGAAA TCAAA SEQ ID NO: 26071 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATCATAGTGGAAG GACCAACTACAACCGTCCCTCAAGAGTCGAGTC ACCATATCAGTAGACACGTCCGAGAACAAGTTCT CCCTGAAGCTGAGCTCTGTGACCGCCGCGGACAC GGCTGTGTATTACTGTGCGAGAGACTACGGTGGG CTTGACTACTGGGGCCAGGGAACCCTGGTCACCG TCTCCTCA SEQ ID NO: 30077 |
| | | AA | EIVLTQSPGTLSLSPGERATLSCRASQSVDSSYLA WYQQKTGQAPRLLIYGASSRAPGIPDRFSGSGSG TDFTLTISRLEPEDFAVYYCQQYESSPWTFGQGT KVEIK SEQ ID NO: 26072 | QVQLQQWGAGLLKPSETLSLTCAVYGGSFSGCYW SWIRQPPGKGLEWIGEINHSGRTNYNPSLKSRVTIS VDTSENKFSLKLSSVTAADTAVYYCARDYGGLDY WGQGTLVTVSS SEQ ID NO: 30078 |

FIGURE 50
(Continued)

| | | | |
|---|---|---|---|
| iPS:435195 | 21-225_94D3 | NA | GAAATTGTGTTGACGCAGTCTCCAGGCACCCT GTCTTTGTCTCAAGGGCCAGTCAGAGCCACCCTCT CCTGCAGGGCCAGTCAGAGTGTTAGCAGCAGG TACTTAGCCTGGTACCAGCAGAAACCTGGCCA GGCTCCCAGACTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCATTATGATAGTCACCGT GGACGTTCGGCCAAGGGACCAAGGTGAAAA TCAA<br>SEQ ID NO: 26073 | CAGGTGCAGCTACAGCAGGGGGGCGAGGACCG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGCT GGAGTGGATTGGGGAAATCAATTATAGTGGAAG AACCAACTACAACCCGTCCCTCAAGAGTCGAGTC ACCATATCAGTAGACACGTCCAAGAACCAGTTCT CCCTGAAGCTGAGCTCTGTGACCGCCGGACAC GGCTGTGTATTACTGTGCGAGAGACTACGGCGGT ATGGACGTCTGGGGCCAAGGGACCACGGTCACC GTCTCCTCA<br>SEQ ID NO: 30079 |
| | | AA | EIVLTQSPGTLSLSQGERATLSCRASQSVSSRYLA WYQQKPGQAPRLLIYGASSRATGIPDRFSGSGSG TDFTLTISRLEPEDFAVYYCQHYDSHPWTFGQGT KVENQ<br>SEQ ID NO: 26074 | QVQLQQGGAGPLKPSETLSLTCAVYGGSFSGCYWS WIRQPPGKGLEWIGEINYSGRTNYNPSLKSRVTISV DTSKNQFSLKLSSVTAADTAVYYCARDYGGMDV WGQGTTVTVSS<br>SEQ ID NO: 30080 |
| iPS:435197 | 21-225_94F3 | NA | GACATCCAGATGACCCAGTCTCCATCCTCCCT GTCTGCATCTGTAGGAGACAGAGTCACCATCA CTTGCCGGGCAAGTCAGGCCATTAGAGATGAT TTAGGCTGGTATCAGCAGAAAACCAGGGAAAG CCCCTCAGCGCCTGATCTTTGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTCCAGCATTATAGTTACCCTCGGA CGTTCGGCCAGGGACCAAGGTGGCAATCAA A<br>SEQ ID NO: 26075 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACGATATCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATTAACAGCTGAGAGCCGAGG ACACGGCTGTGTATTTCTGTGCGAGAGAAAATA TAGCAGTGGCTGGTACGACTACGGTATGGACGTC TGGGGCCAAGGGACCACGGTCACCGTCTCCTCA<br>SEQ ID NO: 30081 |

FIGURE 50
(Continued)

| | | | |
|---|---|---|---|
| iPS:435203 | 21-225_75A7 | AA | DIQMTQSPSSLSASVGDRVTITCRASQAIRDDLG WYQQKPGKAPQRLLIFAASSLQSGVPSRFSGSGSG TEFTLTISSLQPEDFATYYCLQHYSYPRTFGRGT KVAIK<br>SEQ ID NO: 26076 | QVQLVESGGGVVQPGRSLRLSCAASGFTFSNDIMH WVRQAPGKGLEWVAVIWYDGSNKYYADSVKGRF TISRDNSKNTLYLQINSLRAEDTAVYFCAREKYSSG WYDYGMDVWGQGTTVTSS<br>SEQ ID NO: 30082 |
| | | NA | GACATCGTGATGACCCAGTCTCCAGACTCCCT GGCTGTGTCTCTGGGCGAGAGGGCCACCATCA ACTGCAAGTCCAGCCAGACTGTTTACACAGC TCCAACAATTATAACTACTTAGCTTGGTACCA GCAGAAGCCAGGACAGCCCCTAAGGTGCTC ATTTACTGGACATCTACCCGGGAATCCGGGGT CCCTGACCGATTCAGTGGCAGGGGTCTGGGA CAGATTTCACTCTCACCATCAGCAGCCTGCAG GCTGAAGATGTGGCAGTTTATTACTGTCAGCA ATATTTTAGTAGTCCTCCGACGTTCGGCCAAG GGACCAAGGTGGAAATCAAA<br>SEQ ID NO: 26077 | CAGGTGCAGCTGGTGCAGTCTGGGGGCTGAGGTG AAGAAGCCTGGGGCTCAGTGAAGGTCTCCTGC AAGGCTTCTGGATACACCTTCCCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGACA GAGTCACCATGACCAGGAACACCTCATAAGCA CAGCCTACATGGAGCTGAGCAGCCTGAGATCTG AGGACACGGCCGTGTATTATTGTGCGGTTTCCAG TGGCTGGCACTGGTTCGACCCCTGGGGCCAGGGA ACCCTGGTCACCGTCGCCTCA<br>SEQ ID NO: 30083 |
| | | AA | DIVMTQSPDSLAVSLGERATINCKSSSQTVLHSSN NYNYLAWYQQKPGQPPKVLIYWSTRESGVPD RFSGSGSGTDFTLTISSLQAEDVAVYYCQQYFSS PPTFGQGTKVEIK<br>SEQ ID NO: 26078 | QVQLVQSGAEVKKPGASVKVSCKASGYTFPNYDIN WVRQATGQGLEWMGWMNPNSGNTGYAQKFQDR VTMTRNTSISTAYMELSSLRSEDTAVYYCAVSSGW HWFDPWGQGTLVTVAS<br>SEQ ID NO: 30084 |

FIGURE 50
(Continued)

| | | | | |
|---|---|---|---|---|
| iPS:435209 | 21-225_75A10 | NA | AATATCGTGATGACCCAGTCTCCAGACTCCCT GGCTGTGTCTCTGGGCGAGGGCCACCATCA ACTGCAAGTCCAGCAGTGTTTTACACAAC TCCAACAATTACAACTACTTAACTGGTACCA GCAGAAACCAGGACAGCCTCCTAAGCTGCTC TTTACTGGGCATCTACCCGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTTCTGTCAGCAA TATTATAGTTCTCCTCCGACGTTCGGCCAAGG GACCAAGGTGGAAATCAAA<br><br>SEQ ID NO: 26079 | CAGGTGCAGCTGGTGCAGTCTGGGGCTGAGGTG AAGAAGCCTGGGGCCTCAGTGAAGGTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG TGGCTGGTACTACTTTGACTACTGGGGCCAGGGA ACCCTGGTCACCGTCCTCTCA<br><br>SEQ ID NO: 30085 |
| | | AA | NIVMTQSPDSLAVSLGARATINCKSSQSVLHNSN NYNYLTWYQQKPGQPPKLLLYWASTRKSGVPD RFSGSGSGTDFTLTISSLQAEDVAVYFCQQYYSS PPTFGQGTKVEIK<br><br>SEQ ID NO: 26080 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YYFDYWGQGTLVTVSS<br><br>SEQ ID NO: 30086 |
| iPS:435211 | 21-225_94E11 | NA | GACATCGTTATGACCCAGTCTCCAGACTCCCT GGCTGTGTCTCTGGGCGAGAGGGCCACCATCA ATTGCAAGTCCAGCAGTGTTTTATTCAGC TCCAACAATTATAATTACTTAGCTTGGTACCA GCAGAGACCAGGACAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGATGGCAGTTTATTACTGTCAGCAA TATCATATAGTTCTCCTCGACGTTCGGCCAAGG GACCACGGTGCAAATCAAA<br><br>SEQ ID NO: 26081 | CAGGTGCAGTTGGTGCAGTCTGGGGCTGAGGTGA AGAAGCCTGGGGCCTCAGTGAAGGTCTCCTGCA AGGCTTCTGATACACCTTCACCAATTATGATAT CAACTGGGTGCGACAGGCCACTGGACAAGGGCT TGAGTGGATGGGATGGATGCACAGAAGTTCCAGGCAG TAACACAGGCTATGCACCAGGAACACCTCCACAAGCA AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAAGTGGTTCGACCCCTGGGGCCAGGGA ACCCTGGTCACCGTCTCCTCA<br><br>SEQ ID NO: 30087 |

FIGURE 50
(Continued)

| | | | |
|---|---|---|---|
| iPS:435215 | 21-225_94E12 | AA | DIVMTQSPDSLAVSLGERATINCKSSQSVLFSSN NYNYLAWYQQKPGQPPNLLIYWASTRESGVPD RFSGSGSGTDFTLTISSLQAADVAVYYCQQYHSS PLTFGQGTTVQIK<br>SEQ ID NO: 26082 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW KWFDPWGQGTLVTVSS<br>SEQ ID NO: 30088 |
| | | NA | GACATCGTGATGACCCAGTCTCCAGACTCCCT GGCTGTGTCTCTGGGCGAGAGGGCCACCATCA ATTGTAAGTCCAGCCAGAGTGTTTTACACAGG TCCAACAATTACAACTACTTAGCGTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA<br>SEQ ID NO: 26083 | CAGGTGCAGCTGGTGCAGTCTGGGGCTGAGGTG AAGAAGCCTGGGGCTCAGTGAAGGTCTCCTGC AAGGCTTCTGGATACACCTTGACCAATTATGATA TCAACTGGGTGCGACAGGCCACTGGACAAGGC TTGAGTGGATGGGATGAACCCTAACAGTG GTAACACAGGCTATGCACAGAAGTTCCAGGGCA GAGTCACCATGACCAGGAACACCTCCATAAGCA CAGCCTACATGGAACTGAGCAGCCTGAGATCTG AGGACACGGCCGTGTATTACCGTGGAGTACCA GTGGCTGGAAGTTCTTTGACTACTGGGGCCAGGG AACCCTGGTCACCGTCACCGTCTCCTCA<br>SEQ ID NO: 30089 |
| | | AA | DIVMTQSPDSLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK<br>SEQ ID NO: 26084 | QVQLVQSGAEVKKPGASVKVSCKASGYTLTNYDI NWVRQATGQGLEWMGWMNPNSGNTGYAQKFQG RVTMTRNTSISTAYMELSSLRSEDTAVYYRGSTSG WKFFDYWGQGTLVTVSS<br>SEQ ID NO: 30090 |

FIGURE 50
(Continued)

| | | | |
|---|---|---|---|
| iPS:435217 | 21-225_94F12 | NA | GAAATTGTGTTGACGCAGTCTCCAGGCACCCT GTATTTGTCTCCAGGGGAAAGAGCCACCTTCT CATGCAGGGCCAGTCAGTCAGAGTGTTTACAGCAGC TACTTAGCGTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGACTGGAGCCTGAAGATTTTGCAG TGTATTACTGTCAGCATTATGATAACTCACCGT GGACGTTCGGCCAAGGGACCAAGGTGGAAAT CAAA<br><br>SEQ ID NO: 26085 | CAGGTGCAGCTACAGCAGTGGGGCGCAGGACTG TTGAAGCCTTCGGAGACCCTGTCCCTCACCTGCG CTGTCCATGGTGGTCTTCAGTGGTTGCTACTG GAGCTGGATCCGCCAGCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCAAGAACCAGTCT CCCTGAAGCTGAGCTGTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30091 |
| | | AA | EIVLTQSPGTLYLSPGERATFSCRASQSVYSSYLA WYQQKPGQAPRLLIYGASSRSTGIPDRFSGSGSG TDFALTISRLEPEDFAVYYCQHYDNSPWTFGQG TKVEIK<br><br>SEQ ID NO: 26086 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30092 |
| iPS:435219 | 21-225_95D2 | NA | GAAATTGTGTTGACGCAGTCTCCAGGCACCCT GTCTTTGTCTCCAGGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATCTATGGTGCATCA GCCGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCACTATGATAACTCACCG TGGACGTTCGGCCAAGGGACCAAGGTGGAAA TCAAA<br><br>SEQ ID NO: 26087 | CAGGTGCAGCTACAGCAGTGGGGCGCAGGACTG TTGAAGCCTTCGGAGACCCTGTCCCTCACCTGCG CTGTCCATGGTGGGTCTTCAGTGGTTGCTACTG GAGCTGGATCCGCCAGCCCCAGGGAAGGGCT GGAGTGGATTGGGGAAATCAATCATAGTGGAAG CACCAACTACACAACCCGTCCCTCAAGAGTCGAGTC ACCATTTCAGTAGACACGTCAAGAACCAGTCT CCCTGAAGCTGAGCTGTGTGACCGCCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30093 |

FIGURE 50
(Continued)

| | | | | |
|---|---|---|---|---|
| iPS:435221 | 21-225_95G2 | AA | EIVLTQSPGTLSLSPGERATLSCRASQSVYSSYLA WYQQKPGQAPRLLIYGASSRATGIPDRFSGSGSG TDFALTISRLEPEDCAVYYCQHYDNSPWTFGQG TKVEIK | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 26088 | SEQ ID NO: 30094 |
| | | NA | GAAATAGTGATGACGCAGTCTCCAGCCACCCT GTCTCTGTCTCTGCAGGGGAAAGAGCCACCCTCT CCTGCAGGGCCAGTATGAGTGTTGTCAACAGC TTAGCCTGGTACCAGCAGAAACCTGGCCAGGC TCCCAGGCTCCTCATCTATGGTGCATCCACCA GGGCCACTGGTATCCCAGCAGGTTCAGTGGC AGTGGGTCTGGGACAGAGTTCACTCTCACCAT CAGCAGCCTGCAGTCTGAAGATATTGCAATTT ATTACTGTCAGCAGTATAATGACTGGCCGTGC AGTTTTGGCCAGGGGACCAAGCTGGAGATCAA A | CAGGTGCAGCTGGTGGAGTCTGGGGGAGGCGTG GTCCAGCCTGGGAGGTCCCTGAGACTCTCCTGTA CAGCGTCTGGATTCACCTTCAGTAGCTATGGCAT GCACTGGGTCCGCCAGGCTCCAGGCAAGGGGCT GGAGTGGGTGGCAGTTATTTGGTATGATGAAGT AATAAATACTATGCAGACTCCGTGAAGGGCCGA TTCACCATCTCCAGAGACAATTCCAAGAACACGC TGTTTCTGCAAATGAACAGCCTGAGAGCCGAGG ACACGGCTGTGTATTACTGTGCGAGCGATCGCAA TATAGTGGGAGCTACTTACTTTGAGTCCTGGGGC CAGGGAACCCTGGTCACCGTCTCCTCA |
| | | | SEQ ID NO: 26089 | SEQ ID NO: 30095 |
| | | AA | EIVMTQSPATLSLSPGERATLSCRASMSVVNSLA WYQQKPGQAPRLLIYGASTRATGIPARFSGSGSG TEFTLTISSLQSEDFAIYYCQQYNDWPCSFGQGT KLEIK | QVQLVESGGGVVQPGRSLRLSCTASGFTFSSYGMH WVRQAPGKGLEWVAVIWYDGSNKYYADSVKGRF TISRDNSKNTLFLQMNSLRAEDTAVYYCASDRNIV GATYFESWGQGTLVTVSS |
| | | | SEQ ID NO: 26090 | SEQ ID NO: 30096 |

FIGURE 50
(Continued)

| | | | |
|---|---|---|---|
| iPS:435227 | 21-225_95G4 | NA | GACATGTTATGACCCAGTCTCCAGACTCCCT GGCTGTGTCTCTGGGCGAGAGGGCCACCATCA ATTGCAAGTCCAGTCAGAGTGTTTTATTCAGA TCCAACAATTATATACTTAGCTTGGTACCA GCAGAGACCAGGACAGCCTCATAACCTGCTCA TTTACTGGGCATCTACCCGGGAATCCGGGGTC CCTGACCGATTCAGTGGCAGCGGGTATGGGAC AGATTTCACTCTCACCATCAGCAGCGTGCAGG CTGCTGATGTGGCAGTTTATTACTGTCAGCAA TATCATAGTTCTCCTCTGACGTTCGGCCAAGG GACCACGGTGCAAATCAAA SEQ ID NO: 26091 | CAGGTGCAGTTGGTGCAGTCTGGGCTGAGGTGA AGAAGCCTGGGGCCTCAGTGAAGGTCTCTGCA AGGCTTCTGGATACACCTTCACCAATTATGATAT CAACTGGGTGCGACAGGCCACTGGACAAGGCT TGAGTGGATGGGATGGATGAACCCTAACAGTGG TAACACAGGCTATGCACAGAAGTTCCAGGGCAG AGTCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCCCTCA SEQ ID NO: 30097 |
| | | AA | DIVMTQCPDSLAVSLGERATINCKSSQSVLFRSN NYNYLAWYQQRPGQPHNLLIYWASTRESGVPD RFSGSGYGTDFTLTISSVQAADVAVYYCQQYHS SPLTFGQGTTVQIK SEQ ID NO: 26092 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS SEQ ID NO: 30098 |
| iPS:435235 | 21-225_95F9 | NA | GAAATTGTGTTGACGCAGTCTCCAGGCACCCT GTATTTGTCTCCAGGGAAAGAGCCACCCTCT CCTGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGCTTGCTCTCAC CATCAGCAGACTGGAGCCTGAAGATTTTGCAG TGTATTACTGTCAGCACTATGATAACTCACCG TGGACGTTCGGCCAAGGGACCAAGGTGGAAA TCAAA SEQ ID NO: 26093 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACGAGCCGCCGACAC GGCTGTGTATTACTGTGCGAGGGACTACGGCGGT ATGGACGTCTGGGGCCAAGGGACCACGGTCACC GTCTCCTCA SEQ ID NO: 30099 |

FIGURE 50
(Continued)

| | | AA | EIVLTQSPGTLYLSPGERATLSCRASQSVYSSYLA WYQQKPGQAPRLLIYGASSRSTGIPDRFSGSGCG TDFALTISRLEPEDFAVYYCQHYDNSPWTFGQG TKVEIK<br><br>SEQ ID NO: 26094 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30100 |
|---|---|---|---|---|
| iPS:435237 | 21-225_95G9 | NA | GAAATTGTGTTGACGCAGTCTCCAGGCACCCT GTATTTGTCTTCAGGGGAAAGAGCCACCCTCT CATGCAGGGCCAGTCAGAGTGTTTACAGCAGC TACTTAGCGTGGTACCAGCAGAAACCTGGCCA GGCTCCCAGGCTCCTCATTTATGGTGCATCCA GCCGGTCCACTGGCATCCCAGACAGGTTCAGT GGCAGTGGGTCTGGGACAGACTTCGCTCTCAC CATCAGCAGAGTGGAGCATGAAGATTGTGCA GTGTATTACTGTCAGCACTATGATAACTCACC GTGGACGTTCGGCCAAGGGACCAAGGTGGAA ATCAAA<br><br>SEQ ID NO: 26095 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 30101 |
| | | AA | EIVLTQSPGTLYLSSGERATLSCRASQSVYSSYLA WYQQKPGQAPRLLIYGASSRSTGIPDRFSGSGSG TDFALTISRVEHEDCAVYYCQHYDNSPWTFGQG TKVEIK<br><br>SEQ ID NO: 26096 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 30102 |

FIGURE 50
(Continued)

| | | | |
|---|---|---|---|
| iPS:435239 | 21-225_95H10 | NA | GAAATTGTGTTGTGTCGCAGTCTCCAGGCATCCT<br>GTATTTGTTCTCAGGGGAAAGAGCCACCCTCT<br>CCTGCAGGGCCAGTCAGAGTGTTTACAGCAGC<br>TACTTAGCCTGGTACCAGCAGAAACCTGGCCA<br>GGCTCCCAGGCTCCTCATTTATGGTGCATCCA<br>GCCGGGGCCACTGGCATCCCAGACAGGTTCAGT<br>GGCAGTGGGTCTGGGACAGACTTCGCTCTCAC<br>CATCAGCAGACTGGAGCCTGAAGATTTTGCAG<br>TGTATTACTGTCAGCACTATGATAACTCTCCGT<br>GGACGTTCGGCCAAGGGACCAAGGTGGAAAT<br>CAAA<br><br>SEQ ID NO: 26097 | CAGGTGCAGCTACAGCAGTGGGGCGCAGGACTG<br>TTGAAGCCTTCGGAGACCCTGTCCCTCACCTGCG<br>CTGTCCATGTGGGTCCTTCAGTGGTTGTACTG<br>GAGCTGGATCCGCCAGCCCCCAGGGAAGGGCT<br>GGAGTGGATTGGGGAAATCAATCATAGTGGAAG<br>CACCAACTACAACCCGTCCCTCAAGAGTCGAGTC<br>ACCATTTCAGTAGACACGTCCAAGAACCAGTTCT<br>CCCTGAAGCTGAGCTCTGTGACCGCCGGACAC<br>GGCTGTGTATTACTGTGCGAGGGACTACGGCGGT<br>ATGGACGTCTGGGGCCAAGGGACCACGGTCACC<br>GTCTCCTCA<br><br>SEQ ID NO: 30103 |
| | | AA | EIVLSQSPGILYLSSGERATLSCRASQSVSSYLA<br>WYQQKPGQAPRLLIYGASSRATGIPDRFSGSGSG<br>TDFALTISRLEPEDFAVYYCQHYDNSPWTFGQG<br>TKVEIK<br><br>SEQ ID NO: 26098 | QVQLQQWGAGLLKPSETLSLTCAVHGGSFSGCYW<br>SWIRQPPGKGLEWIGEINHSGSTNYNPSLKSRVTISV<br>DTSKNQFSLKLSSVTAADTAVYYCARDYGGMDV<br>WGQGTTVTVSS<br><br>SEQ ID NO: 30104 |
| iPS:435245 | 21-225_95E12 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTTATACAGC<br>TCCAACAATGGCAACTACTTAGCTTGGTACCA<br>GCAGAAACCAGGACAGCCTCCTAACCTGTTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTACTGTCAGCAA<br>TATTATAGTACTCCGTGCAGTTTTGGCCAGGG<br>GACCAAGGTGGAGATCAAA<br><br>SEQ ID NO: 26099 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAACAAGGC<br>TTGAGTGGATGGGATGGATGCACAGAAGTTCAGTG<br>GTAACACAGGCTATGCACAGAAGTTCCAGGCA<br>GAGTCACCATGACCAGGAACACCTCCATAAGCA<br>CAGCCTACATGGAGCTGAGCAGCCTGAGATCTG<br>AGGACACGGCCGTGTATTACTGTGCGATTAGCAG<br>TGGCTGGTACTGGTTCGACCCCTGGGGCCAGGA<br>ACCCTGGTCACCGTCTCCTCA<br><br>SEQ ID NO: 30105 |

FIGURE 50
(Continued)

| | | | | |
|---|---|---|---|---|
| iPS:435247 | 21-225_96G1 | AA | DIVMTQSPDSLAVSLGERATINCKSSQSVLYSSN NANYLAWYQQKPGQPPNLFIYWASTRESGVPD RFSGSGSGTDFTLTISSLQAEDVAVYYCQQYYST PCSFGQGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAISSGW YWFDPWGQGTLVTVSS |
| | | | SEQ ID NO: 26100 | SEQ ID NO: 30106 |
| | | NA | GAAATTGTGTTGACGCAGTCTCCAGGCACCCT GTCTTTGTCTACAGGGGAAAGAGCCACCCTCT CGTGCAGGGCCAGTCAGAGTCGTTAGCAGCAG CTACTTAGCTTGGTACCAGCAGAAACCTGGCC AGCCTCCCAGGCTCCTCATTTATGGTGCATCC ACCAGGGCCTCTGGCATCCCAGACAGGTTCAG TGGCAGTGGGTCTGGGACAGACTTCACTCTCA CCATCAGCAGACTGGAGCCTGAAGATGTTGCA GTTTATTACTGTCAGCAGTATGTAACTCACC GCTCACTTTCGGCGGAGGGACCAAGGTGGAG ATCAAA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCCAGGGCAG TAACACAGGCTATGCACAGAAGTTCCAGGGCAG AGTCACCATGACCAGGAACACCTCCATAAGCAC AGCCTACATGGAGCTGAACAGCTGAGATCTGA GGACACGGCCGTGTATTACTGTGCGATTAGCAGT GGCTGGTACTGGTTCGACCCCTGGGGCCAGGGA ACCCTGGTCACCGTCTCCTTA |
| | | | SEQ ID NO: 26101 | SEQ ID NO: 30107 |
| | | AA | EIVLTQSPGTLSLSTGERATLSCRASQSVSSSYLA WYQQKPGQPPRLLIYGASTRASGIPDRFSGSGSG TDFTLTISRLEPEYFAVYYCQQYGNSPLTFGGGT KVEIK | QVQLVQSGAEVKKPGASVKVSCKASGYTFTNYDIN WVRQATGQGLEWMGWMHPNNGNTGYAQKFQGR VTMTRNTSISTAYMELNSLRSEDTAVYYCAISSGW YWFDPWGQGTLVTVSL |
| | | | SEQ ID NO: 26102 | SEQ ID NO: 30108 |

FIGURE 50
(Continued)

| | | | |
|---|---|---|---|
| iPS:435249 | 21-225_96E2 | NA | GACAGCGTGATGACCCAGTCTCCAGACTCCT GGCTGTGTCTGTGGGCGAGAGGGCCACCATCA ACTGCAAGTCCAGCCAGAGTGTTTTACACAGC TCTAATAAAAGAACTACTTAGTTGGTACCA GCAGAAACCAGGACAGCCTCCTAAGCTGCTCA TTTACTGGGCATCTCACCTGGGAATCCGGGGTC CCTGACCGATTCAGTGGCAGCGGGTCTGGGAC AGATTTCACTCTCACCATCAGCAGTCTGCAGG CTGAAGATGTGGCAGTTTATTACTGTCAGCAA TATTATAGGACTCCGTGACGTTCGCGCCAAGG GACCAAGGTGGAAATCAAA<br>SEQ ID NO: 26103 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAATAGTGG TAACAGGCTATGCACAGAAGTTCCAGGGCAG AGTCACCCTGACCAGGAACACCTCCATAAGCAC AGCCTACATGGAGCTGAGCAGCCTGAGATCTGA GGACACGGCCGTGTATTACTGTGCGGTTTCCAGT GGCTGGTACTGGTTTGACCCCTGGGGCCAGGGA ACCCTGGTCACCGTCTCCTCA<br>SEQ ID NO: 30109 |
| | | AA | DSVMTQSPDSLAVSLGERATINCKSSQSVLHSSN KKNYLAWYQQKPGQPPKLLIYWASTWESGVPD RFSGSGSGTDFTLTISSLQAEDVAVYYCQQYYRT PWTFGQGTKVEIK<br>SEQ ID NO: 26104 | QVQLVQSGAEVKKPGASVKVSCKASGYTFTNYDIN WVRQATGQGLEWMGWMHPNSGNTGYAQKFQGR VTLTRNTSISTAYMELSSLRSEDTAVYYCAVSSGW YWFDPWGQGTLVTVSS<br>SEQ ID NO: 30110 |
| iPS:435251 | 21-225_96A3 | NA | GACATCCAGATGACCCAGTCTCCATCTCCCT GTCTGCTTCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCACTTT TGCAAAGTGGGGTCCCATCAAGGTTCAGCGGC AGTGGATCTGGGACAGCAGAATTCACTCTCACAAT CAGCGGCCTGCAGCGTGAAGATTTTGCAACTT ATCACTGTCTACAGCATAGTAGTACCCCGCTC ACTTTCGGCGGAGGGACCAAGGTGGAGATCA AA<br>SEQ ID NO: 26105 | CAGCTGCAGCTGCAGGAGTCGGGCCCAGGACTG GTGAAGCCTTCGGAGACCCTGTCCTCATCTGTA CTGTCTCTGGTGGCTCCATCAGCAGTAGTAATTA CTACTGGGGCTGGATCCGCCAGCCCCCAGGGAA GGATACACCTCTACAACCCGTCCTCCTCAAGAGTC GAGTCACCATATCCGTAGACTCGTCCAAGAACCA CTTTCCCTGAGGCTGAGCTCTGTGACCGCCGCA GACACGGCTGTGTATTACTGTGCGAGACTTGACT CTAACTGGGTCTTGACTACTGGGGCCAGGGAAC CCTGGTCACCGTCTCCTCA<br>SEQ ID NO: 30111 |

FIGURE 50
(Continued)

| | | | | |
|---|---|---|---|---|
| iPS:435253 | 21-225_96A4 | AA | DIQMTQSPSSLSASVGDRVTITCRASQGIRNDLGWYQQKPGKAPKRLIYAASTLQSGVPSRFSGSGSGTEFTLTISGLQREDFATYHCLQHSNYPLTFGGGTKVEIK<br>SEQ ID NO: 26106 | QLQLQESGPGLVKPSETLSLICTVSGGSISSSNYYWGWIRQPPGKGLEWIGSIYSGYTSYNPSLKSRVTISVDSSKNHFSLRLSSVTAADTAVYYCARLDSNWGLDYWGQGTLVTVSS<br>SEQ ID NO: 30112 |
| | | NA | GACATCCAGATGACCCAGTCTCCATCCTCCTGTCTGCATCTGTAGGAGACAGAGTCACCATCACTTGCCGGGCAAGTCAGGACATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACCGAATTCACTCTCACAATCAGCAGCCTGCAGCCTGAAGATTTTGCAACTTATTACTGTCTACAGCATAATGATTACCCATTCACTTTCGGCCGTGGGACCAAAGTGGATATCAAA<br>SEQ ID NO: 26107 | CAGGTGCAGCTGCAGTCTGGGCTGAGGTGAAGAAGCCTGGGCCTCAGTGAAGGTCTCCTGCAAGGCTTCTGGATACACCTTCACCAGTTATGATATCAACTGGGTGCGACAGGCCACTGGACAGGGCTTGAGTGGATGGGATGGAACCCTAACAGTGGTAACACAGGCTATGCACAGAAGTTCCAGGGCAGAGTCACCATGACCTGGGAACACCTCCAAAGCACAGCCTACATGGAGCTGAGTAGCCTGAGATCTGAGGACACGGCCGTGTATTACTGTGCGGAGAGGCTTTTACGATACTTTGACTGGTTCCGGCTACTACGTTATGGACGTCTGGGGCCAAGGGACCACGGTCACCGTCTCCTCA<br>SEQ ID NO: 30113 |
| | | AA | DIQMTQSPSSLSASVGDRVTITCRASQDIRNDLGWYQQKPGKAPKRLIYGVSSLQSGVPSRFSGSGSGTEFTLTISSLQREDFATYYCLQHNDYPFTFGRGTKVDIK<br>SEQ ID NO: 26108 | QVQLVQSGAEVKKPGASVKVSCKASGYTFTSYDINWVRQATGHGLEWMGWMNPNSGNTGYAQKFQGRVTMTWNTSKSTAYMELSSLRSEDTAVYYCARGFYDTLFGSGYYVMDVWGQGTTVTVSS<br>SEQ ID NO: 30114 |

FIGURE 50
(Continued)

| | | | | |
|---|---|---|---|---|
| iPS:435255 | 21-225_96D5 | NA | GACATCGTGATGACCCAGTCTCCAGACTCCCT GGCTGTGTCTCTGGGCGAGAGGGCCACCATCA ACTGCAAGTCCAGCAGTGTTTTGCACAGC TCCAACAATTATAATTACTTAGTTGGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATTATAGTAGTCCACGACGTTCGGCCAAGG GACCACGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCTAACAGTG GTAACACAGGCTATGCACAGAAGTTCCAGGCA GAGTCCACCATGACCAGGACACCTCCACAAGCA CAGCCCACATGGAGCTGAGCAGCCTGAGATCTG AGGACACGGCCGTGTATTACTGTGCGGTTTCCAG TGGCTGGTCCTGGTTCGACCCCTGGGGCCAGGGA ACCCTGGTCACCGTCCTCTCA |
| | | | SEQ ID NO: 26109 | SEQ ID NO: 30115 |
| | | AA | DIVMTQSPDSLAVSLGERATINCKSSQSVLHSSN NYNYLAWYQQKPGQPPKLLIYWASTRESGVPD RFSGSGSGTDFTLTISSLQAADVAVYYCQQYYSS PPTFGQGTTVEIK | QVQLVQSGAEVKKPGASVKVSCKASGYTFTNYDIN WVRQATGQGLEWMGWMNPNSGNTGYAQKFQGR VTMTRSTSTAHMELSSLRSEDTAVYYCAVSSGW SWFDPWGQGTLVTVSS |
| | | | SEQ ID NO: 26110 | SEQ ID NO: 30116 |
| iPS:435257 | 21-225_96H5 | NA | GACATCGTGATGACCCAGTCTCCAGACTCCCT GGCTGTGTCTCTGGGCGAGAGGGCCACCATCA ACTGCAAGTCCAGCCAGTACTTTGTACAGC TCCAACAGTCACAACTAGCTTGGTACCA GCAGAAACCAGGACAGCCTCCTAAACTGCTCA TTTACTGGGCATCTATCCGGGAATCCGGGGTC CCTGACCGATTCAGTGGCAGCGGGTCTGGGAC AGATTTCACTCTCACTCTCCATCAGCATGCAGG CTGAAGATGTGGCAGTTTATTACTGTCAGCAA TATTATAGTACTCCGTGCAGTTTGGCCAGGG GACCAAGGTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCCTGGACAAGGAC TTGAGTGGATGGGATGGATGCACAGAAGTTCCAGGCA TAACACAGGCTATGCACAGAAGTTCCAGGCAG AGTCCACCATGACCAGGAACACCTCCATAAGCAC AGCCTACATGGAGCTGAGCAGCCTGAGATCTGA GGACTCGGCCGTATATTACTGTGCGTATAGTAGT GGCTGGTACAAATTTGACTACTGGAGCCAGGGA ACCCTGGTCACCGTCCTCA |
| | | | SEQ ID NO: 26111 | SEQ ID NO: 30117 |

FIGURE 50
(Continued)

| | | | |
|---|---|---|---|
| iPS:435259 | 21-225_96C6 | AA | DIVMTQSPDSLAVSLGERATINCKSSQSVLYSSN SHNYLAWYQQKPGQPPKLLIYWASIRESGVPDR FSGSGSGTDFTLSISSMQAEDVAVYYCQQYYSTP CSFGQGTKVEIK<br>SEQ ID NO: 26112 | QVQLVQSGAEVKKPGASVKVSCKASGYTFTNYDIN WVRQASGQGLEWMGWMHPNSGNTGYAQKFQGR VTMTRNTSISTAYMELSSLRSEDSAVYYCAYSSGW YKFDYWSQGTLVTVSS<br>SEQ ID NO: 30118 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCTTCCAGTTT GCAAAGTGGGGTCCCCTCAAAGTTCAGCGGCA GTGGATCTGGGACAGATTTCACTCTCACCATC AACAGCCTGCAGCCTGAAGATTTTGCAACTTA TTACTGCCACCAGTATATAATGATTACCCATTCA CTTTCGGCCCTGGGACCAAAGTGGATATCAAA<br>SEQ ID NO: 26113 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGTCAGGCCACTGGACAAGGGC TTGAGTGGATGGGATGGATGAACCCTAACAGTCG TAACACAGGCTATGCACAGAAGTTCCAGGCAG AGTCACCATGACCTGGAACACCTCCATAAGCACA GCCTACATGGAGCTGAGCAGCCTGAGATCTGAG GACACGGCCGTGTATTACTGTGCGAGAGGCGGCT ACGATGTTTGCCTGGGAATAACTACTACTACGA TATGGACGTCTGGGGCCAAGGGACCACGGTCAC CGTCTCCTCA<br>SEQ ID NO: 30119 |
| | | AA | DIQMTQSPSSLSASVGDRVTITCRASQGISNYLA WFQQKPGKAPKSLIYAASSLQSGVPSKFSGSGSG TDFTLTINSLQPEDFATYYCHQYNDYPFTFGPGT KVDIK<br>SEQ ID NO: 26114 | QVQLVQSGAEVKKPGASVKVSCKASGYTFTSYDIN WVRQATGQGLEWMGWMNPNSRNTGYAQKFQGR VTMTWNTSISTAYMELSSLRSEDTAVYYCARGGY DVLPGNNYYYDMDVWGQGTTVTVSS<br>SEQ ID NO: 30120 |

FIGURE 50
(Continued)

| | | | |
|---|---|---|---|
| iPS:435267 | 21-225_96D10 | NA | GACATGTGATGACCCAGTCTCCAGACTCCCT GGCTGTGTCTCTGGGCGAGAGGGCCACCATCA ATTGCAAGTCCAGTCAGAACTCAGAATATTTATCCAGC TCCAACAATAAGAACCAGTACTTAACTTGGTACCA GCAGAAACCAGGACAGCCTCCTAAAATACTCA TTTACTGGACATCTACCCGGGAATCCGGGGTC CCTGACCGATTCAGTGGCAGCGGGGTTTGGGAC AGATTTCACTCTCACCATCAGCAGCCTGCAGG CTGAAGATGTGGCTGTTTATTACTGTCAGCAA TATTTTAGTGTTCCTCCGACGTTCGGCCAAGG GACCAAGGTGGAAATCAAA SEQ ID NO: 26115 | CAGGTGCAGCTGGTGCAGTCTGGGGCTGAGGTG AAGAAACCTGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATGAGCAC AGCCTACATGGAGCTGAGCAGCCTGAGATCTGA GGACACGGCCGTGTATTACTGTGCCATAGCAGT GGCTGGTACTTTTTGACTACTGGGGCCAGGGAA CCCTGGTCACCGTCTCCTCA SEQ ID NO: 30121 |
| | | AA | DIVMTQSPDSLAVSLGERATINCKSSQNILSSSNN KNYLTWYQQKPGQPPKILIYWTSTRESGVPDRFS GSGFGTDFTLTISSLQAEDVAVYYCQQYFSVPPT FGQGTKVEIK SEQ ID NO: 26116 | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS SEQ ID NO: 30122 |
| iPS:435273 | 21-225_97A2 | NA | GAAATTGTGTTGACGCAGTCTCCAGGCACCCT GTATTTGTCTCCAGGGAAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGTCCACTGGCATCCCAGACAGGTTCAGT GGCAGTGGGTGTGGGACAGCTTCGCTCTCAC CATCAGCAGACTGGAGCCTGAAGATTGTGCAG TGTATTACTGTCAGCATTCTGATAACTCACCGT GGACGTTCGGCCAAGGGACCAAGGTGGAAAT CAAA SEQ ID NO: 26117 | CAGGTGCAGCTACAGCAGTGGGGCGCAGGACTG TTGAAGCCTTCGGAGACCCTGTCCCTCACCTGCG CTGTCCATGGTGGGTCCTTCAGTGGTTGCTACTG GAGCTGGATCCGCCAGCCCCCAGGGAAGGGGCT GGAGTGGATTGGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTGTGAGACCGCCGCGACAC GGCTGTGTATTACTGTGCGAGGGACTACGGCGGT ATGGACGTCTGGGGCCAAGGGACCAAGGTCACC GTCTCCTCA SEQ ID NO: 30123 |

FIGURE 50
(Continued)

| | | | |
|---|---|---|---|
| | | AA | EIVLTQSPGTLYLSLSSGERATLSCRASQSVYSSYLA WYQQKPGQAPRLLIYGASSRSTGIPDRFSGSGSCG TDFALTISRLEPEDCAVYYCQHSDNSPWTFGQG TKVEIK | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 26118 | SEQ ID NO: 30124 |
| iPS:435279 | 21-225_97H4 | NA | GACATCGTGATGACCCAGTCTCCAGATTGCCT GGCTGTGTCTCTGGGCGAGAGGGCCACCATCA ACTGCAAGTCCAGCCAGAGTGTTTATACACC TCCAACAATAACTACTTAGCTTGGTACCA GCAGAAACCAGGACAGCCTCCTAAGCTCTCA TTTACTGGGCATCTCACCCCGGGAATCCGGGTC CCTGACCGATTCAGTGGCAGCGGGTCTGGGAC AGATTTCACTCTCACCATCAGCAGCCTGCAGG CTGAAGATGTTGCAGTTTATTATTGTCAGCACT ACAATGATACTCCATGGAAGTTTGTCCAAGG ACCAAGGTGGAAATCACA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGATTAGCAGT GGCTGGTACTGGTTCGACCCCTGGGGCCAGGGA ACCCTGGTCACCGTCTCCTCA |
| | | | SEQ ID NO: 26119 | SEQ ID NO: 30125 |
| | | AA | DIVMTQSPDCLAVSLGERATINCKSSQSVLYTSN NNNYLAWYQQKPGQPPKLLIYWASTRESGVPD RFSGSGSGTDFTLTISSLQAEDVAVYYCQHYNDT PWKFVQGTKVEIT | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAISSGW YWFDPWGQGTLVTVSS |
| | | | SEQ ID NO: 26120 | SEQ ID NO: 30126 |

FIGURE 50
(Continued)

| | | | |
|---|---|---|---|
| iPS:435281 | 21-225_97E5 | NA | GAAATTGTGTTGACGCAGTCTCCAGGCACCCT<br>GTCTTTGTCTCCAGGGGAAAGAGCCACCCTCT<br>CATGCAGGGCCAGTCAGAGTGTTTACAGCAGC<br>TACTTAGCCTGGTACCAGCAGAAACCTGGCCA<br>GGCTCCCAGGCTCCTCATTTATGGTGCATCCA<br>GCCGGGCCACTGGCATCCCAGACAGGTTCAGT<br>GGCAGTGGGTGTGGGACAGACTTCGCTCTCAC<br>CATCAGCAGACAGAGTGGAGCCTGAAGATTGTGCAG<br>TGTATTACTGTCAGCACTCTGATAACTCACCGT<br>GGACGTTCGGCCAAGGGACCAAGGTGGAAAT<br>CAAA<br><br>SEQ ID NO: 26121 | CAGGTGCAGCTACAGCAGTGGGGCGCAGGACTG<br>TTGAAGCCTTCGGAGACCTGTCCCTCACCTGCG<br>CTGTCCATGTGGGTCCTTCAGTGGTTGCTACTG<br>GAGCTGGATCCGCCAGCCCCCAGGGAAGGGCT<br>GGAGTGGATTGGGAGAAATCAATCATAGTGGAAG<br>CACCAACTACAACCGTCCTCAAGAGTCGAGTC<br>ACCATTCAGTAGACACGTCCAAGAACCAGTTCT<br>CCCTGAAGCTGAGCTCTGTGACCGCCGGACAC<br>GGCTGTGTATTACTGTGCGAGGGACTACGGCGGT<br>ATGGACGTCTGGGGCCAAGGGACCACGGTCACC<br>GTCTCCTCA<br><br>SEQ ID NO: 30127 |
| | | AA | EIVLTQSPGTLSLSPGERATLSCRASQSVYSSYLA<br>WYQQKPGQAPRLLIYGASSRATGIPDRFSGSGCG<br>TDFALTISRVEPEDCAVYYCQHSDNSPWTFGQG<br>TKVEIK<br><br>SEQ ID NO: 26122 | QVQLQQWGAGLLKPSETLSLTCAVHGGSFSGCYW<br>SWIRQPPGKGLEWIGEINHSGSTNYNPSLKSRVTISV<br>DTSKNQFSLKLSSVTAADTAVYYCARDYGGMDV<br>WGQGTTVTVSS<br><br>SEQ ID NO: 30128 |
| iPS:435291 | 21-225_146E1 | NA | GACATCAAGATGACCCAGTCTCCATCTTCCGT<br>GTCTGCATCTGTAGGAGACAGAGTCACCATCA<br>CTTGTCGGGCGAGTCAGGGTATTAACAACTGG<br>TTAGTCTGGTATCAGCAGAAACCAGGGAAAGC<br>CCCTAAGCTCCTGATCTATGCTGCATCCAGTTT<br>GCAAAGTGGGGTCCCATCAAGGTTCCGGCA<br>GTGGATCTGGGACAGATTTCACTCTCACCATC<br>AGCAGCCTGCAGCCTGAAGATTTTGCAACTTA<br>CTATTGTCAACAGGCTAACAGTTTCCCATTCA<br>CTTTCGGCCCTGGGACCAAAGTGGATATCAAA<br><br>SEQ ID NO: 26123 | CAGGTGCAGCTGGTGGAGTCTGGGGGAGGCGTG<br>GTCCAGCCTGGGAGGTCCCTGAGACTCTCCTGTG<br>AAGCGTCTGGAATCACCTTCAGTAGTATGGCAT<br>GCACTGGGTCCGCCAGGCTCCAGGCAAGGGGCT<br>GGAGTGGGTGGCAATTATATGGTATGATGGAAGT<br>AATAAATACTATGCAGACTCCGTGAAGGGCCGA<br>TTCACCATCTCCAGAGACAATTCCAAGAACACGC<br>TGTTTCTGCAAATGAACAGCCTGAGAGCCGAGG<br>ACACGGCTGTGTATTACTGTGCGAGAGATCGTTT<br>AGTGGGAGTACCGCTGATGCTTTTGATATCTGG<br>GGCCAAGGGACAATGGTCACCGTCTCTTCA<br><br>SEQ ID NO: 30129 |

FIGURE 50
(Continued)

| | | | |
|---|---|---|---|
| iPS:435293 | 21-225_146F1 | AA | DIKMTQSPSSVSASVGDRVTITCRASQGINNWLV WYQQKPGKAPKLLIYAASSLQSGVPSRFRGSGS GTDFTLTISSLQPEDFATYYCQQANSFPFTFGPGT KVDIK | QVQLVESGGGVVQPGRSLRLSCEASGITFSSYGMH WVRQAPGKGLEWVAIIWYDGSNKYYADSVKGRFT ISRDNSKNTLFLQMNSLRAEDTAVYYCARDRLVGA TADAFDIWGQGTMVTVSS |
| | | | SEQ ID NO: 26124 | SEQ ID NO: 30130 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CGGTGGATCTGGGACAGAATTCACTCTCACAA TCAGCAGCCTGCAGCCTGAAGATTTTGCAACT TATTACTGTCTTCAGCATAGTACTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGAAGTATATATTATAGT GGGAGTACCTCCTACAACCCGTCCTCCAAGAGTC GAGTCACCATATCCGTCGACACGTCCAAGAACCA GTTCTCCCTGAAGCTGAGCTCTGTGACCGCCGCA GACACGGCTGTTTATTACTGTGCGAGACTTGATC TCCTGTGGAGTTTTGACTACTGGGGCCAGGGAAC CCTGGTCACCGTCTCCTCA |
| | | | SEQ ID NO: 26125 | SEQ ID NO: 30131 |
| | | AA | DIQMTQSPSSLSASVGDRVTITCRASQGIRNDLG WYQQKPGKAPKRLIYAASSLQSGVPSRFSGGGS GTEFTLTISSLQPEDFATYYCLQHSTYPLTFGGGT KVEIK | QLQLQESGPGLVKPSETLSLTCTVSGGSISRSSYYW GWIRQPPGKGLEWIGSIYYSGSTSYNPSLKSRVTISV DTSKNQFSLKLSSVTAADTAVYYCARLDLLWSFDY WGQGTLVTVSS |
| | | | SEQ ID NO: 26126 | SEQ ID NO: 30132 |

FIGURE 50
(Continued)

| | | | |
|---|---|---|---|
| iPS:435295 | 21-225_146H1 | NA | GACATCCAGATGACCCAGTCTCCATCTCCCT GTCTGCATCTGTAGGAGACAGAGTCACCATCA CTTGCCGGGCAAGTCAGAGACATTAGCGACTAT TTAAATTGGTATCAGCAAAACCAGGGAAAG CCCCTAAGGTCCTGATCTATACTACATCCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGAGTTACAGTACCCCACT TTCGGCGGAGGGACCAAGGTGGAGATCAAA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTCGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCAAACGGGTGACG GACTACGGTGTAACGACTGGTTCGACCCCTGGG GCCAAGGGAACCCTGGTCACCGTCTCCTCA |
| | | | SEQ ID NO: 30133 |
| | | AA | DIQMTQSPSSLSASVGDRVTITCRASQSISDYLN WYQQKPGKAPKVLIYTSSLQSGVPSRFSGSGSG TDFTLTISSLQPEDFATYYCQQSYSTPFGGGTK VEIK | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS |
| | | | SEQ ID NO: 26128 | SEQ ID NO: 30134 |
| iPS:435297 | 21-225_146B3 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGAAAGACTATTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGCTTTATCACTGCATGCAAAG TATACAGCTTCCGTGGACGTTCGGCCAAGGGA CCAAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAGTTATATGCAGACTCCGTGAAGGGCCGAT TATAAATACTATGCAGACTCCGTGAAGGGCCGAT TCACCATCTCCAGAGACAATTCCAAGAACACGCT GGATCTGCAAATGAACAGCCTGAGAGCCGAGGA CACGGCTGTGTATTACTGTGTGAAAATGGGTATA GAAGTGGCTGTGACTACTACGGTATGGACG TCTGGGGCCAAGGGACCACGGTCACCGTCTCCTC A |
| | | | SEQ ID NO: 26129 | SEQ ID NO: 30135 |

FIGURE 50
(Continued)

| | | | |
|---|---|---|---|
| iPS:435299 | 21-225_146D4 | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGLYHCMQSIQLPW TFGQGTKVEIK<br>SEQ ID NO: 26130 | QVQLVESGGGVVQPGRSLRLSCAASGFTFSSYGMH WVRQAPGKGLEWVAVIWYDGSYKYYADSVKGRF TISRDNSKNTLDLQMNSLRAEDTAVYYCVKMGIEV AVDYYYGMDVWGQGTTVTVSS<br>SEQ ID NO: 30136 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATAACAACTACTTAGCTTGGTACCA GCAGAAACCAGGACAGCCTCCTAAGCTGGTCA TTTACTGGGCATCTCACCCGGGAATCCGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAAGCTGGAGATCAAA<br>SEQ ID NO: 26131 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGGTGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGGGAGCAG TGGCTGGTACTACTTTGACTACTGGGGCCAGGGA ACCCTGGTCACCGTCCTCCTCA<br>SEQ ID NO: 30137 |
| | | AA | DIVMTQSPDSLAVSLGERATINCKSSQSVLYSSN NNNYLAWYQQKPGQPPKLVIYWASTRESGVPD RFSGSGSGTDFTLTISSLQAEDVAVYYCQQYYST PCSFGQGTKLEIK<br>SEQ ID NO: 26132 | QVQLVQSGAEVKKPGASVKVSCKASGYTFTNYDIN WVRQATGQGLEWMGWVHPNSGNTGYAQKFQGR VTMTRNTSISTAYMELSSLRSEDTAVYYCAGSSGW YYFDYWGQGTLVTVSS<br>SEQ ID NO: 30138 |

FIGURE 50
(Continued)

| | | | |
|---|---|---|---|
| iPS:435301 | 21-225_146G4 | NA | GAAATTGTATTGACGCAGTCTCCAGGCACCCT GTCTTTATTTCCAGGGGAAAGAGCCACCCTCT CCTGCAGGGCCAGTCAGAGAATATTATCAGCAGC TATTTAGCCTGGTACCAGCAGAAACCTGGCCA GGCTCCCAGGCTCCTCATCTTTGGTGTATCTAG TCGGGCCACTGGCATCCCAGACAGACAGGTTCAGTG GCAGTGGGTCTGGGACAGACTTCACTCTCACC ATCAGCAGACTGGAGCCTGAAGATTTTGCAGT GTATTACTGTCAACAATATGGTAGGTCACCAT TCAATTTTCGGGCCCCTGGGACCAAAGTGGATATC AAC<br><br>SEQ ID NO: 26133 | CAGGTGCAGCTGCAGGAGTCGGGCCCAGGACTG GTGAAGCCTTCACAGACCCTGTCCCTCAATTGCA CTGTCTCTGGTGGCTCCATCAGCAGCAGTGGTTA CTACTGGAGCTGGATCCGCCAGCACCCAGGAA GGGCCTGGAATGGATTGGGTACAGCTATTACAGT GGGAGCACCTACTACAACCCGTCCCTCAAGAGTC GAATTACCATATCAGTAGACACGTCTAACAACCA GTTCTCCCTGAAGCTGACCTCTGTGACTGCCGG GACACGGCCGTGTATTACTGTGCGAGAGGAAA TATAACTGGAACCATGCTTTTGATATCTGGGGCC AAGGGACAATGGTCACCGTCTCTTCA<br><br>SEQ ID NO: 30139 |
| | | AA | EIVLTQSPGTLSLFPGERATLSCRASQNIISSYLA WYQQKPGQAPRLLIFGVSSRATGIPDRFSGSGSG TDFTLTISRLEPEDFAVYYCQQYGRSPFNFGPGT KVDIN<br><br>SEQ ID NO: 26134 | QVQLQESGPGLVKPSQTLSLNCTVSGGSISNSGYY WSWIRQHPGKGLEWIGYSYYSGSTYYNPSLKSRITI SVDTSNNQFSLKLTSVTAADTAVYYCARGKYNWN HAFDIWGQGTMVTVSS<br><br>SEQ ID NO: 30140 |
| iPS:435303 | 21-225_146A6 | NA | GACATCCAGATGACCCAGTCTCCAGTCTTCCGT GTCTGCATCTGTGGGAGACAGAGTCACCATAA CTTGTCGGGCGAGTCAGGTATTAGCAGCTGG TTAGCCTGGTATCAGCAGAAACCAGGGAAAG CCCCTAAACTCCTGATCTATGCTGCATCCAGTT TGCAAGGTGGGGTCCCATCAAGGTTCACTGGC AGTGGATCTGGGACAGATTTCACTCTCACCAT CAGCAGCCTGCAGCCTGAAGATTTTGCAACTT ACTATTGTCAACAGACTGACAGTTTCCCATTC ACTTTCGGCCCTGGGACCAAAGTGGATATCAA A<br><br>SEQ ID NO: 26135 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAACTGGGTCCGCCAGGCTCCAGGGAAGGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACACT GTATCTGCAAATGAACAGCCTGAGAGCCGAGGA CACGGCCGTATATTACTGTGCGAAAAGGATAAT GATTACGTTTGGGGAGTCCTTACTTTGACTACT GGGGCCAGGGAACCCTGGTCACCGTCTCCTCA<br><br>SEQ ID NO: 30141 |

FIGURE 50
(Continued)

| | | | |
|---|---|---|---|
| iPS:435305 | 21-225_146C9 | AA | DIQMTQSPASVSASVGDRVTITCRASQGISNWLAWYQQKPGKAPKLLIYAASSLQGVPSRFSGSGSGTDFTLSISSLQPEDFATYYCQQTDSFPFTFGPGTKVDIK<br>SEQ ID NO: 26136 | EVQLLESGGGLVQPGGSLRLSCAASGFTFNSYAMNWVRQAPGKGLEWVSAISGSGGNTFYADSVKGRFTISRDNSKNTLYLQMNSLRAEDTAVYYCAKKDNDYVWGSPYFDYWGQGTLVTVSS<br>SEQ ID NO: 30142 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAACAATTATAATTACTTAGCTTGGTACCAGCAGAAACCAGGACAGCCTCCTAAGGTGCTCATTTACTGGGCATCTACCCGGGAAATCCGGGGTCCCTGACCGATTCAGTGGTAGCGGGTCTGGGACAGATTTCACTCTCACCATCAGCAGCCTGCAGGCTGAAGATGTGGCAGTTTATTATTGTCAGCAATATTATAGTACTCCGTGCAGTTTTGGCCAGGGGACCAAGCTGGAGATCAAA<br>SEQ ID NO: 26137 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACCCTAACAGTGGTAACACAGGCTATGCACAGAAGTTCCAGGGCAGAGTCACCATGACCTGGAACACCTCCATAAGCACAGCCTACATGGCCCTGAGCAGCCTGAGATCTGAGGACACGGCCGTGTATTACTGTGCGTATAGCAGTGGCTGGTACTCCTTTGACTACTGGGGCCAGGGAACCCTGGTCACCGTCTCCTCA<br>SEQ ID NO: 30143 |
| | | AA | DIVMTQSPDSLAVSLGERATINCKSSQSVLHSSNNYNYLAWYQQKPGQPPKVLIYWASTRKSGVPDRFSGSGSGTDFTLTISSLQAEDVAVYYCQQYYSTPCSFGQGTKLEIK<br>SEQ ID NO: 26138 | QVQLVQSGAEVKKPGASVKVSCKASGYTFTNYDINWVRQATGQGLEWMGWMHPNSGNTGYAQKFQGRVTMTWNTSISTAYMALSLRSEDTAVYYCAYSSGWYSFDYWGQGTLVTVSS<br>SEQ ID NO: 30144 |

FIGURE 50
(Continued)

| | | | |
|---|---|---|---|
| iPS:435307 | 21-225_146E9 | NA | GACATCCAGATGACCCAGTCTCCATCCTCCCTGTCTGCATCTGTAGGAGACAGAGTCACCATCACTTGCCGGGCAAGTCAGAGCATTAGCGACTATTTAAATTGGTATCAGCTGAAACCAGGAAAGCCCCTAAGGTCCTGATCTATACATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTTCTGTCAACAGAGTTACAGTACCCCACTTTCGGCGGAGGGACCAAGGTGGAGATCAAA SEQ ID NO: 26139 | GAGGTGCAGCTGTTGGAGTCTGGGGGAGGCTTGGTACAGCCTGGGGGGTCCCTGAGACTCTCCTGTGCAGCCCTCTGATTCACCTTTAGCAGCTATGCCATGAGCTGGGTCCGCCAGGCTCCAGGGAAGGGCTGGAGTGGGTCTCAGCTATTAGTGGTGGTGGTGGTAACACATTCTACGCAGACTCCGTGAAGGGCCGGTTCACCATCTCCAGAGACAATTCCAAGAACAACACTATATCTGCAAATGAACAGCCTGAGAGCCGAGGACACGGCCGTATATTACTGTGCGAAACGGGTGACGGACTACGGTGTAACGACTGGTTCGACCCCTGGGGCCAGGGAACCCTGGTCACCGTCTCCTCA SEQ ID NO: 30145 |
| | | AA | DIQMTQSPSSLSASVGDRVTITCRASQSISDYLNWYQLKPGKAPKVLIYTTSSLQSGVPSRFSGSGSGTDFTLTISSLQPEDFATYFCQQSYSTPFGGGTKVEIK SEQ ID NO: 26140 | EVQLLESGGGLVQPGGSLRLSCAASGFTFSSYAMSWVRQAPGKGLEWVSAISRGGNTFYADSVKGRFTISRDNSKKTLYLQMNSLRAEDTAVYYCAKRVTDYGGNDWFDPWGQGTLVTVSS SEQ ID NO: 30146 |
| iPS:435309 | 21-225_146F9 | NA | GACATCGTGATGACCCAGTCTCCAGACTCCCTGGCTGTGTCTCTGGGCGAGAGGGCCACCATCAACTGCAAGTCCAGCCAGAGTATTTTACACAGCTCCAACAATAACAACTACTTAGCTTGGTACCAGCAGAAACCAGGACAGCCTCCTACCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTACTCCGTCAGTTTTGGCCAGGGGACCAAGCTGGAGATCACT SEQ ID NO: 26141 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGCACCGAAGACTAACAGTGGTAACACAGGCTATGCACAGAAGTTCAGGCAGAGTCACCATGACCAGGAACACCTCCATAAGCACAGCCTACATGGAGCTGAGCAGCCTGAGATCTGAGGACACGGCCGTGTATTACTGTGCGGAGTTGTAGCAGTGGCTGGTAGTGTTTTTGACTACTGGGGCCAGGGAACCCTGGTCACCGTCTCCTCA SEQ ID NO: 30147 |

FIGURE 50
(Continued)

| | | | |
|---|---|---|---|
| iPS:435311 | 21-225_146H9 | AA | DIVMTQSPDSLAVSLGERATINCKSSQNILHSSN NNNYLAWYQQKPGQPPYLLIYWASTRESGVPD RFSGSGSGTDFTLTITSLQAEDVAVYYCQQYYT PCSFGQGTKLEIT<br>SEQ ID NO: 26142 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YFFDYWGQGTLVTVSS<br>SEQ ID NO: 30148 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATATAGTTACCCGCTC ACTTTCGGCGGAGGGACCAAGGTGGAGATCA AA<br>SEQ ID NO: 26143 | CAGGTGCAGCTGGTGGAGTCTGGGGGAGGCGTG GTCCAGCCTGGGAGGTCCCTGAGACTCTCCTGTG CAGCGTCTGGATTCAGTTCAGTAGCTATGGCAT GCACTGGGTCCGCCAGGCTCCAGGCAAGGGGCT GGAGTGGGTGGCAGTGATATGGTTTGATGAAAGT AATAAACACTATGGAGACTCCGTGAAGGGCCGA TTCACCATCTCCAGGGACACAATTCCAAGAACACGC TGTATCTGCAAATGAACAGCCTGAGAGCCGAGG ACACGGCTGTGTATTACTGTGCGAGAGAATTGGG ATTTCTCTGACTATTGGGGCCAGGGAACCCTG GTCACCGTCTCCTCA<br>SEQ ID NO: 30149 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 26144 | QVQLVESGGGVVQPGRSLRLSCAASGFSFSSYGMH WVRQAPGKGLEWVAVIWFDESNKHYGDSVKGRF TISRDNSKNTLYLQMNSLRAEDTAVYYCARELGFL SDYWGQGTLVTVSS<br>SEQ ID NO: 30150 |

FIGURE 50
(Continued)

| | | | | |
|---|---|---|---|---|
| iPS:435313 | 21-225_146G11 | NA | GACATCCAGATGACCCAGTCTCCATCCTCCCT GTCTGCATCTGTAGGAGACAGAGTCACCATCA CTTGCCGGGCAAGTCAGGACATTAGGAAATAAT TTTGGCTGGTATCAGCAGAAACCAGGGAAAGC CCCTAAGCGCCTGATCTATGCTGCATCCAGTTT GCAAAGTGGGGTCCCATTAAGGTTCAGCGGCA GTGGATCTGGGACAGAATTCACTCTCACAATC AGCAGCCTGCAGCCTGAAGATTTTGCAACTTA TTACTGTCTCCAACATGATAGTTACCCGCTCAC TTTCGGCGGAGGGACCAAGGTGGAGATCAAA<br><br>SEQ ID NO: 26145 | GAGGTGCAGCTGGTGGAGTCTGGGGGAGGCCTG GTCAAGCCTGGGGGGTCCCTGAGACTCTCCTGTG CAGCCCTCTGGATTCACCTTCAGTAGTAGCAT GAACTGGGTCCGCCAGGCTCCAGGGAAGGGCT GGAGTGGGTCTCATCCATTAGTGGTAGTGGTAGC TACACATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTAGCAG CTCGTCCGGGTTTGACTACTGGGGCCAGGGAACC CTGGTCACCGTCTCCTCA<br><br>SEQ ID NO: 30151 |
| | | AA | DIQMTQSPSSLSASVGDRVTITCRASQDIRNNFG WYQQKPGKAPKRLIYAASSLQSGVPLRFSGSGS GTEFTLTISSLQPEDFATYYCLQHDSYPLTFGGG TKVEIK<br><br>SEQ ID NO: 26146 | EVQLVESGGGLVKPGGSLRLSCAASGFTFSSYSMN WVRQAPGKGLEWVSSISGSGSYTYYADSVKGRFTI SRDNAKNSLYLQMNSLRAEDTAVYYCARGSSSSGF DYWGQGTLVTVSS<br><br>SEQ ID NO: 30152 |
| iPS:435315 | 21-225_147B2 | NA | GATATTGTGATGACCCAGACTCCCCTCTCTCTG TCCGTCACGCCTGGACAGCCGGCCTCCATCTC CTGCAAGTCTAGTCAGAGCCTCCTGCATAGTG CTGGAAAAGACCTATTTGTATTGGTACCTGCAG AAGCCAGGCCAGCCTCCACAGCTCCTGATCTA TGAAGTTTCCCACCGGTTCTGGAGTGCCAG ATAGGTTCAGTGGCAGGGGTCAGGGACAGA TTTCACAGTGAAAATCAGCCGGGTGGAGGCTG AGGATGTTGGGGTTTATTACTGCATGCAAAGT ACACAGTTTCCTCCCACTTTCGGCCCTGGGAC CAAAGTGGATATCAAA<br><br>SEQ ID NO: 26147 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGAGGTATAG CAGCAGCTGGTGCGGGGGTATGACGTCTGGGG CCAAGGGACCACGGTCACCGTCTCCTCA<br><br>SEQ ID NO: 30153 |

FIGURE 50
(Continued)

| | | | |
|---|---|---|---|
| iPS:435317 | 21-225_147D2 | AA | DIVMTQTPLSLSVTPGQPASISCKSSQSLLHSEGK TYLYWYLQKPGQPPQLLIYEVSHRVSGVPDRFS GSGSGTDFTVKISRVEAEDVGVYYCMQSTQFPP TFGPGTKVDIK<br>SEQ ID NO: 26148 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTSS<br>SEQ ID NO: 30154 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTGGCAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAGCTTATTCA CTTTCGGCCCTGGGACCAAAGTGGATATCAAA<br>SEQ ID NO: 26149 | CAGGTGCTACTGCAGGAGTCGGGCCCAGGACTG GTGAAGCCTTCACAGACCCTGTCCCTCACCTGCG CTGTCTCTGGTGGCCCCATCAGCAGTGGTGATTA CTACTGGAACTGGATCCGCCAGCCCAGGGAA GGGCCTGGAGTGGATTGGGTTCATCTATTACACT GGGAGCACCTACTACAACCCGTCCCTCAAGAGTC GAGTTTCCATATCGGAAGACACGTCTGAGAACCA GTTCTCCCTGAACCTGAGTTCTGTGACTGCCGCG GACACGGCCGTGTATTACTGTGCGAGAGGGGA GCTTACTACTCCTACTACGGTATGGACGTCTGGG GCCAAGGGACCACGGTCACCGTCTCCTCA<br>SEQ ID NO: 30155 |
| | | AA | EIVLTQSPGTLSLSPGERATLSCRASQSVGSSYLA WYQQKPGQAPRLLIYGASSRATGIPDRFSGSGSG TDFTLTISRLEPEDFAVYYCQQYGSLFTFGPGTK VDIK<br>SEQ ID NO: 26150 | QVLLQESGPGLVKPSQTLSLTCAVSGGPISSGDYYW NWIRQRPGKGLEWIGFIYYTGSTYNPSLKSRVSIS EDTSENQFSLNLSSVTAADTAVYYCARGGAYYSYY GMDVWGQGTTVTSS<br>SEQ ID NO: 30156 |

FIGURE 50
(Continued)

| | | | | |
|---|---|---|---|---|
| iPS:435319 | 21-225_147E3 | NA | GAAATTGTGTTGACGCAGTCTCCAGGCACCCT GTCTTTGTCTCTGGGGGAAAGAGCCACCCTCT CCTGCAGGGCCAGTCAGAGTGTTATCAGTAGC TACTTAGCCTGGTACCAGCAGAAACCTGGCCA GGCTCCCAGGCTCCTCATCTATGGTGCATCCA GCAGGGCCACTGCCATCCCAGACAGCTTCAGT GGCAGTGGGTCTGGGACAGACTTCACTCTCAC CATCAGCAGACTGGAGCCTGAAGATTTTGCAG TGTATTACTGTCAACAATATGGTAGGTCACCA TTCAATTTCGGCCCTGGGACCAAAGTGGATAT CAAA<br><br>SEQ ID NO: 26151 | CAGGTGCAGCTGCAGGAGTCGGGCCCAGGACTG GTGAAGCCTTCACAGACCCTGTCCCTCACCTGCA CTGTCTCTGGTGGCTCCATCACCAGTAATAGTGTTA CTACTATAGCTGGAATCGCCAGCACCCAGGGAA GGGCTGGAATGGATTGGGTACATCTATTACAGT GGGGGCACTTACTACAACCCGTCCCTCAAGAGTC GAATTACCATATCAGTGGACACGTCTAACAACCA GTTCTCCCTGAAGCTGAGCTCTGTGACTGCCGG GACACGGCCGTGTATTACTGTGCGAGAGGGGA TATAACTGGAACCATGCTTTTGATTTCTGGGGCC AAGGGACAATGGTCACCGTCTCTTCA<br><br>SEQ ID NO: 30157 |
| | | AA | EIVLTQSPGTLSLSPGERATLSCRASQSVISSYLA WYQQKPGQAPRLLIYGASSRATAIPDRFSGSGSG TDFTLTISRLEPEDFAVYYCQQYGRSPFNFGPGT KVDIK<br><br>SEQ ID NO: 26152 | QVQLQESGPGLVKPSQTLSLTCTVSGGSITNSGYYY SWIRQHPGKGLEWIGYIYYSGGTYYNPSLKSRITISV DTSNQFSLKLSSVTAADTAVYYCARGGYNWNHA FDFWGQGTMVTVSS<br><br>SEQ ID NO: 30158 |
| iPS:435321 | 21-225_147E4 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATTACAACTACTTAGCTTGGTACCA GCTGAAACCAGGACAGCCTCCTAAGCTGCTCA TTTACTGGGCATCTACCCGGGAATCCGGGGTC CCTGACCGATTCAGTGGCCGCGGGTCGGGGAC AGACTTCACTCTCACCATCAGCAGCCTGCAGG CTGAAGATGTGGCAATTTATTACTGTCAGCAA TATTATAGTACTCCATCCACTTTCGGCCCTGGG ACCAAAGTGGAGATCAAA<br><br>SEQ ID NO: 26153 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTACTTTTGACTGTGCGAGTAGCA GTGGCTGGTACTTTTTGACTACTGGGGCCAGGG AACCCTGGTCACCGTCTCCTCA<br><br>SEQ ID NO: 30159 |

FIGURE 50
(Continued)

| | | AA | DIVMTQSPDSLAVSLGERATINCKSSQSVLHSSN NYNYLAWYQLKPRQPPKLLIYWASTRESGVPDR FSGRGSGTDFTLTISSLQAEDVAIYYCQQYYSTPS TFGPGTKVEIK | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YFFDYWGQGTLVTVSS |
|---|---|---|---|---|
| | | | SEQ ID NO: 26154 | SEQ ID NO: 30160 |
| iPS:435323 | 21-225_147D5 | NA | GACACTGCTGATGACCCAGTCTCCAGACTCCCT GGCTGTGTCTCTGGGCGAGAGGGCCACCATCA ACTGCAAGTCCAGCCAGAGTGTTTATACAGC TCCAACAATAACAACTACTTAGCTTGGTACCA GCAGAAACCAGGACAGCCTCCTAAACTGCTCA TTTACTGGGCATCTACCCGGGAATCCGGGTC CCTGACCGATTCAGTGGCAGTGGGTCTGGGAC AGATTTCACTCTCTCCATCAGCAGCCTGCAGG CTGAAGATGTGGCAGTTTATTACTGTCACCAA TATTATAGTACTCCGTCAGTTTTGGCCAGGG GACCAAAACTGGAGAGATCAAA | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGGTGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGG GGACACGGCCGTGTATTACTGTGCGGGAGCAG TGGCTGGTACTACTTTGACTACTGGGGCCAGGGC ACCCTGGTCACCGTCTCCTCA |
| | | | SEQ ID NO: 26155 | SEQ ID NO: 30161 |
| | | AA | DIVMTQSPDSLAVSLGERATINCKSSQSVLYSSN NNNYLAWYQQKPGQPPKLLIYWASTRESGVPD RFSGSGSGTDFTLSISSLQAEDVAVYYCHQYYST PCSFGQGTKLEIK | QVQLVQSGAEVKKPGASVKVSCKASGYTFTNYDIN WVRQATGQGLEWMGWVHPNSGNTGYAQKFQGR VTMTRNTSISTAYMELSSLRSGDTAVYYCAGSSGW YYFDYWGQGTLVTVSS |
| | | | SEQ ID NO: 26156 | SEQ ID NO: 30162 |

FIGURE 50
(Continued)

| | | | | |
|---|---|---|---|---|
| iPS:435325 | 21-225_147H5 | NA | GACATCCAGATGACCCAGTCTCCATCCTCCCTGTCTGCATCTGTAGGAGACAGAGTCACCATCACTTGCCGGGCAAGTCGGGCATTAGAGATGATTTAGGCTGGTATCAGCAGAAACCAGGAAAGCCCCTAAGCGCCTGATCTATGCTGCATCCAGTTTGCAGAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATTATAGTTATCCTCGGACGTTCGGCCAAGGGACCAAGGTGGAAATCAAA | CAGGTGCAGCTGGTGGAGTCTGGGGGAGGCGTGGCCCAGCCTGGGAGGTCCCTGAGACTCTCCTGTCAGCGTCTGGATTCACCTTCAGTGACTATGGCATGCACTGGGTCCGCCAGGCTCCAGGCAAGGGCTGGAGTGGGTGGCAGTTATATGGTATGATGGAAGTAATAAGTACTATGCAGACTCCGTGAAGGGCCGACTCACCATCTCCAGAGACAATTCCAAGAACACGTTGTATCTGCAAATGAACAGCCTGAGCGCCGAGGACACGGCTGTGTATTACTGTGCGAGAGAGAGGTATAGCAGTGGCTGGTACGACTACGGTTTGGACGTCTGGGGCCAAGGGACCACGGTCACCGTCTCCTCA |
| | | | SEQ ID NO: 26157 | SEQ ID NO: 30163 |
| | | AA | DIQMTQSPSSLSASVGDRVTITCRASRGIRDDLGWYQQKPGKAPKRLIYAASSLQSGVPSRFSGSGSGTEFTLTISSLQPEDFATYYCLQHYSYPRTFGQGTKVEIK | QVQLVESGGGVAQPGRSLRLSCAASGFTFSDYGMHWVRQAPGKGLEWVAVIWYDGSNKYYADSVKGRLTISRDNSKNTLYLQMNSLSAEDTAVYYCARERYSSGWYDYGLDVWGQGTTVTVSS |
| | | | SEQ ID NO: 26158 | SEQ ID NO: 30164 |
| iPS:435327 | 21-225_147G6 | NA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATAAGAACTACTTAGCTTGGTACCAGCAGAAACCAGGACAGCCTCCTAAGCTGCTCATTTACTGGGCATCTGCCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAACTGTATACTACTCCTCCCACTTTCGGCGGAGGGACCAAGGTGGAGATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGTTGGATGCACAGAAGTTCAGGGCAGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGTATAGCAGTGGCTGGTACTGGTTCGACCCCTGGGGCCAGGGAACCCTGGTCACCGTCTCCTCA |
| | | | SEQ ID NO: 26159 | SEQ ID NO: 30165 |

FIGURE 50
(Continued)

| iPS:435329 | 21-225_147A8 | AA | DIVMTQSPDSLAVSLGERATINCKSSQSVLYSSN SNNYLAWYQQKPGQPPKLLIYWASARESGVPD RFSGSGSGTDFTLTISSLQAEDVAVYYCQQYYTT PPTFGPGTKVDIK<br>SEQ ID NO: 26160 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YWFDPWGQGTLVTVSS<br>SEQ ID NO: 30166 |
|---|---|---|---|---|
| | | NA | GATATTGTGATGACCCAGACTCCACTCTCTCT GTCCGTCACCCCTGGACAGCCCTCCATCT CCTGCAAGACTAGTCAGAGCCTCCTGCATAGT GAAGGAAAGACCTATTTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGACAG ATTTCACACTGAAAATCAGCCGGGTGGAGGCT GAGGATGTTGGGGTTTATTACTGCATGCAAAG TATACAGCTAATCACCTTCGGCCAAGGGACAC GACTGGAGATTAAA<br>SEQ ID NO: 26161 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAGGTATAG CAGCAGCTGACGGGGGGTATGGACGTCTGGGG CCAAGGGACCACGGTCACCGTCTCCTCA<br>SEQ ID NO: 30167 |
| | | AA | DIVMTQTPLSLSVTPGQPASISCKTSQSLLHSEGK TYLYWYLQKPGQPPQLLIYEVSNRFSGVPDRFSG SGSGTDFTLKISRVEAEDVGVYYCMQSIQLITFG QGTRLEIK<br>SEQ ID NO: 26162 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WTGGMDVWGQGTTVTVSS<br>SEQ ID NO: 30168 |

FIGURE 50
(Continued)

| | | | |
|---|---|---|---|
| iPS:435331 | 21-225_147G8 | NA | CAAATTGTGTTGACGCAGTCTCCAGGCACCCT GTCTTTGTCTCCAGGGGAAAGAGCCACCCTCT CCTGCAGGGCCAGTCAGTCAGAGAATTTTCAGCAAC TACTTAGCCTGGTACCAGCAGAAAGCCTGGCCA GGCTCCCAGGATCCTCATCTATGGTGCATCCA GCAGGGCCACTGGCATCCCAGACAGGATCAGT GGCAGTGGGTCTGGGACAGACTTCACTCTCAC CATCACCAGGCTGGAGCCTGAAGATGATAGCTCACG TGTATTACTGTCAGCAGTATGATAGCTCACG TGGACGTTCGGCCAAGGGACCAAGGTGGAAA TCAAC<br>SEQ ID NO: 26163 | CAGGTGCAGCTACAGCAGTGGGGCGCAGGACTG TTGAAGCCTTCGGAGACCCTGTCCCTCACCTGCG GTGTCTATGGTGGGTCCTTCAGTGCTTACTACTG GAGCTGGATCCGCCAGCCCCCAGGGAAGGGGCT GGAGTGGATTGGGGAAATCAATCATAGTGGAAG TACCAACTACAAACCGTCCCTCAAGAGTCGAGTC ACCATATCAGTAGACACGTCAAGAACCAGTTCT CCCTGAAGCTGAGCTCTGTGACCGCCGCGGACAC GGCTGTGTATTACTGTGCGAGAGACTACGGTGTT TTTGACTACTGGGGCCAGGGAACCCTGGTCACCG TCTCCCTCA<br>SEQ ID NO: 30169 |
| | | AA | QIVLTQSPGTLSLSPGERATLSCRASQRIFSNYLA WYQQKPGQAPRILYGASSRATGIPDRISGSGSGT DFTLTITRLEPEDFAVYYCQQYDSSPWTFGQGTK VEIN<br>SEQ ID NO: 26164 | QVQLQQWGAGLLKPSETLSLTCGVYGGSFSAYYW SWIRQPPGKGLEWIGEINHSGSTNYKPSLKSRVTISV DTSKNQFSLKLSSVTAADTAVYYCARDYGVFDYW GQGTLVTVSS<br>SEQ ID NO: 30170 |
| iPS:435333 | 21-225_147E9 | NA | GACATCCAGATGACCCAGTCTCCATCCTCACT GTCTGCATCTGTAGGAGACAGAGTCACCATCA CTTGTCGGGCGAGTCAGGACAGTCAGGAAAGC TTAGCCTGTTTCAGCAGAAAACCAGGGAAAGC CCCTAAGTCCCTGATCGTGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGAGTATATAAGTTACCCTCTCA CTTTCGGCGGAGGGACCAAGGTGGAGATCAA A<br>SEQ ID NO: 26165 | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTTTCATCCATTAGTAGTGGAAACACT GCCATATACTATGCAGACTCTGTGAAGGGCCGAT TCACCATCTCCAGAGACAACAATGCCAAGAACTCACT GTATCTGCAAATGAACAGCCTGAGAGAGAGGA CACGGCTGTTTATTACTGTGTTCGAGAGATCGGGC AGTTGCTGGGGCCAGGGAACCCTGGTCACCGTCT CCTCA<br>SEQ ID NO: 30171 |

FIGURE 50
(Continued)

| | | | | |
|---|---|---|---|---|
| iPS:435335 | 21-225_147D10 | AA | DIQMTQSPSSLSASVGDRVTITCRASQDINNYLAWFQQKPGKAPKSLIVAASSLQSGVPSKFSGSGSGTDFTLTISSLQPEDFATYYCQQYNSYPLTFGGGTKVEIK | EVQLVESGGGLVQPGGSLRLSCAASGFTFSSYSMNWVRQAPGKGLEWVSSISGRNTTIYYADSVKGRFTISRDNAKNSLYLQMNSLRDEDTAVYYCSRDRGSCWGQGTLVTVSS |
| | | | SEQ ID NO: 26166 | SEQ ID NO: 30172 |
| | | NA | GACATCCAGATGACCCAGTCTCCAGCTTCCGTGTCTGCATCTGTAGGAGACAGAGTCACCATAACTTGTCGGGCGAGTCAGATATTAGCAACTGGTTAACCTGGTATCAGCAGAAACCAGGGAAAGCCCCTAAGCTCCTGATCTATGCTGCATCCAGTTTGCAAAGTGGGGTCCCATCAAGGTTCACTGGCAGTGGATCTGGGACAGATTTCACTCTCCATCAGCAGCCTGCAGCCTGAAGATTTTGCAACTTACTATTGTCAACAGAGTTGACAGTTTCCCATCACTTTCGGCCCTGGGACCAAAGTGGATGTCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTATTAGTGGTCGTGGTGGTAACACATTCTACGCAGACTCCGTGAAGGGCCGTTCACCATCTCCAGAGACAATTCCAAGAACAACGCTCTATCTGCAAATGAACAGCCTGAGAGCCGAGGACACGGCCGTATATTACTGTGCGAAAAAGGATTATGATTACGTTTGGGGAGTCCTTACTTTGACTACTGGGGCCAGGGAACCCTGGTCACCGTCTCCTCA |
| | | | SEQ ID NO: 26167 | SEQ ID NO: 30173 |
| | | AA | DIQMTQSPASVSASVGDRVTITCRASQNISNWLTWYQQKPGKAPKLLIYAASSLQSGVPSRFSGSGSGTDFTLSISSLQPEDFATYYCQQTDSFPFTFGPGTKVDVK | EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS |
| | | | SEQ ID NO: 26168 | SEQ ID NO: 30174 |

FIGURE 50
(Continued)

| | | | | |
|---|---|---|---|---|
| iPS:435339 | 21-225_147D12 | NA | GACATCCAGATGACCCAGTCTCCAGCTTCCGT GTCTGCATCTGTAGGAGACAGAGTCACCATAA CTTGTCGGGCGAGTCAGGTATTAGCAACTGG TTAGCCTGGTATCAGGAGAAACCAGGGAAAG CCCCTAAACTCCTGATCTATGCTGCATCCAGTT TGCAAAGTGGGGTCCCATCAAGGTTCAGCGGC AGTGGATCCGGGACAGATTTCACTCTCCCAT CAGCAGCCTGCAGCCTGAAGATTTTGCAACTT ACTATTGTCAACAGACTGACAGTTTCCCATTC ACTTTCGGCCCTGGGACCAAAGTGGATGTCAA A | GAGGTGCAGCTGTTGGAGTCTGGGGGAGGCTTG GTACAGTCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGCT TCACCATCTCCAGAGACAATTCCAAGAACACGCT CTATCTGCAAATGAACAGCCTGAGAGCCGAGGA CACGGCCGTATATTACTGTGCGAAAAGGATTAT GATTACGTTTGGGGGAGTCTTACTTTGACTACT GGGGCCAGGGAACCCTGGTCACCGTCTCCTCA |
| | | | SEQ ID NO: 26169 | SEQ ID NO: 30175 |
| | | AA | DIQMTQSPASVSASVGDRVTITCRASQGISNWLA WYQEKPGKAPKLLIYAASSLQSGVPSRFSGSGSG TDFTLSISSLQPEDFATYYCQQTDSFPFTFGPGTK VDVK | EVQLLESGGGLVQSGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS |
| | | | SEQ ID NO: 26170 | SEQ ID NO: 30176 |
| iPS:435341 | 21-225_148B2 | NA | GCTATTGTGATGACCCAGACTCCACTCTCTG TCCGTCACCCTGGACAGCCGGCTCCCATCTC CTGCAAGTCTAGTCAGAGCCTCCTGCATGGTG ATGGAAAGACCTATTTTATTGGTACCTGCAG AAGCCAGGCCAGCCTCCACAGCTCCTGATCTA TGAAGTTTCCCACCGGTTCTCTGGAGTGCCAG ATAGGTTCAGTGGCAGCGGGTCAGGGACAGA TTTCACACTGAAAATCAGCGGGTGGAGGCTG AGGATGTTGGGGTTTATTACTGTATGCAAAGT ATACAGATTCCGTGACGTTCGGCCAAGGGAC CAAGGTGGAAATCAAA | CAGGTGCAGCTGCAGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATCTGGTATGATGGAAGT TATAAATACTATGCAGACTCCGTGAAGGGCCGAT TCACCATCTCCAGAGACAATTCCAAGAACACGCT GTATCTGCAAATGAACAGCCTGAGTGCCGAGGA CACGGCTGTGTATTACTGTGCGAGAGATCATTTC GATTTTTGGAGTGGTCACTTTGACTACTGGGGCC AGGGAACCCTGGTCACCGTCTCCTCA |
| | | | SEQ ID NO: 26171 | SEQ ID NO: 30177 |

FIGURE 50
(Continued)

| | | | |
|---|---|---|---|
| iPS:435343 | 21-225_148E2 | AA | AIVMTQTPLSLSVTPGQPASISCKSSQSLLHGDGKTYFYWYLQKPGQPPQLLIYEVSHRFSGVPDRFSGSGSGTDFTLKISRVEAEDVGVYYCMQSIQPWTFGQGTKVEIK | QVQLVESGGGVVQPGRSLRLSCAASGFTFSSYGMHWVRQAPGKGLEWVAIIWYDGSYKYYADSVKGRFTISRDNSKNTLYLQMNSLSAEDTAVYYCARDHFDFWSGHFDYWGQGTLVTVSS |
| | | | SEQ ID NO: 26172 | SEQ ID NO: 30178 |
| | | NA | GACATCCAGATGACCCAGTCTCCAGCTTCCGTGTCTGCATCTGTAGGAGACAGAGTCACCATCACTTGTCGGGCGAGTCAGGGTATTAGCAACTGGCTTAGCCTGGTATCAGCAGAAACCAGGGAAAGCCCCTAAGCTCCTGATCTATGCTGCATCCAGTTTGCAAAGTGGGGTCCCATCAAGGTTCACTCTCTCCAATGAAATCTGGGACAGATTTCACTCTCCATCAGCAGCCTGCAGCCTGAAGATTTTGCAACTTACTATTGTCAACAGAGTTACAGTTCCCATCACTTTCGGCCCTGGGACCAAAGTGGATGTCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTCGTGGTGGTAACACATTCTACGCAGACTCCGTGAAGGGCCGCTTCACCATCTCCAGAGACACATTCCAAGAACACGCTCTATCTGCAAATGAACAGCCTGAGAGCCGAGGACACGGCCGTATATTACTGTGCGAAAAGGATTATGATTACGTTTGGGGAGTCCTTACTTTGACTACTGGGGCCAGGGAACCCTGGTCACCGTCTCCTCA |
| | | | SEQ ID NO: 26173 | SEQ ID NO: 30179 |
| | | AA | DIQMTQSPASVSASVGDRVTITCRASQGISNWLAWYQQKPGKAPKLLIYAASSLQSGVPSRFSGNESGTDFTLSISSLQPEDFATYYCQQTDSFPFTFGPGTKVDVK | EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS |
| | | | SEQ ID NO: 26174 | SEQ ID NO: 30180 |

FIGURE 50
(Continued)

| | | | |
|---|---|---|---|
| iPS:435345 | 21-225_148G3 | NA | GACATCGTGATGACCCAGTCTCCAGACTCCCT GGCTGTGTCTCTGGGCGAGAGGGCCACCATCC ACTGCAAGTCCAGCCAGTGTTTTACACAGC TCCAACAATTATAACTACTTAGCTGGTACCA GCAGAAACCAGGACAGCCTCCTAAGCTGCTCA TTTACTGGGCATCTACCCGGGATTCCGGGGTC CCTGACCGATTCAGTGGCAGCGGGTCTGGGGC CGATTTCACTCTCACCATCAGCAGCCTGCAGG CTGAAGATGTGGCACTTTATTACTGTCAGCAA TATTATAGTACTCCATTCACTTTCGGCCCTGGG ACCAAAGTGGATATCAAA<br><br>SEQ ID NO: 26175 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCTCTGGACAAGGC TTGAGTGGATGGGATGGATGCACCTAACAGTGG TAACACAGGCTATGCACAGAAACTTCCAGGGCAG AGTCACCATGACCAGGAACACCTCCATAAGCAC AGCCTACATGGAGCTGAGCAGCCTGAGATCTGA GGACACGGCCGTGTATTACTGTGCGAGTAGCAGT GGCTGGTACTTTTTGACTACTGGGGCCAGGGAA CCCTGGTCACCGTCTCCTCA<br><br>SEQ ID NO: 30181 |
| | | AA | DIVMTQSPDSLAVSLGERATIHCKSSQRVLHSSN NYNYLAWYQQKPGQPPKLLIYWASTRDSGVPD RFSGSGSGADFTLTISSLQAEDVALYYCQQYYST PFTFGPGTKVDIK<br><br>SEQ ID NO: 26176 | QVQLVQSGAEVKKPGASVKVSCKASGYTFTNYDIN WVRQASGQGLEWMGWMHPNSGNIGYAQNFQGR VTMTRNTSISTAYMELSSLRSEDTAVYYCASSSGW YFFDYWGQGTLVTVSS<br><br>SEQ ID NO: 30182 |
| iPS:435347 | 21-225_148C4 | NA | GACATCCAGATGACCCAGTCTCCATCCTCCCT GTCTGCATCTGTAGGAGACAGAGTCACCATCA CTTGCCGGGCAAGTCAGAGCATTAACTAT TTAAATTGGTATCAGCAGAAACCAGGGAAAG CCCCTAAGGTCCTGATCTATGCTGCATCCAGTT TACAGAGTGGGGTCCCATCAAGGTTCAGTGGC AGTGGATCTGGGACAGATTTCACTCTCACCAT CAGCAGTCTGCAACCTGAAGATTTTACAACTT ACTACTGTCAACAGAGTTACAGTACCCCCACT TTCGGCGGAGGGACCAAGGTAGAGATCGAA<br><br>SEQ ID NO: 26177 | GAGGTGCAGCTCTTGGAGTCTGGGGGAGGCTTGG TACAGCCTGGGGGGTCCCTGAGACTCTCCTGTGC AGCCTCTGGATTCACCTTTAGCAGTCAGCTATGCATG AACTGGGTCCGCCAGGCTCCAGGGAAGGGGCTG GAGTGGGTCTCAGCTATTAGTGGTAGTGGTGGTA ACACATTCTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAACGGGTGACG GACTACGGTGTAACGACTGGTTCGACCCTGGG GCCAGGGAACCCTGGTCACCGTCTCCTCA<br><br>SEQ ID NO: 30183 |

FIGURE 50
(Continued)

| | | | | |
|---|---|---|---|---|
| iPS:435349 | 21-225_148F5 | AA | DIQMTQSPSSLSASVGDRVTITCRASQSIINYLNW YQQKPGKAPKVLIYTASSLQSGVPSRFSGSGSGT DFTLTISSLQPEDFFTTYYCQQSYSTPTFGGGTKVE IE | EVQLLESGGGLVQPGGSLRLSCAASGFTFSSYAMN WVRQAPGKGLEWVSAISGSGGNTFYADSVKGRFTI SRDNSKNTLYLQMNSLRAEDTAVYYCAKRVTDYG GNDWFDPWGQGTLVTVSS |
| | | | SEQ ID NO: 26178 | SEQ ID NO: 30184 |
| | | NA | GATATTGTGATGACCCAGACTCCACTCTCTCT GTCCGTCACCCTGACAGCGCGGCCTCCATCT CCTGTAAGTCTAGTCAGAGCCTCCTGCATAGT GAAGGAAAGACCTATTTGTATTGGTACCTGCA GAAGCCAGGCCAGTCCTCCACAGCTCCTGATCT ATGAAGTTTCCTACCGGGTCTCTGGAGTGCCA GATAGATTCAGTGGCAGCGGGTCAGGGACAG ATTTCACACTGAAAATCAGCCGGGTGGAGGCA GAGGATGTTGGGGTCTATTTCTGCATGCAAAG TATACAGCTTCCGCTCACTTTCGGCGGAGGGA CCAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCCAT GCACTGGGTCCGCCAGGCTCCAGGCAAGGGGCT GGAGTGGGTGGCAGTTATATGCAGACTCCGTAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGGAGGTATAG CAGCAGCTGGTGGGGGGTATGGACGTCTGGGG CCAAGGGACCACGGTCACCGTCTCCTCA |
| | | | SEQ ID NO: 26179 | SEQ ID NO: 30185 |
| | | AA | DIVMTQTPLSLSVTPGQPASISCKSSQSLLHSEGK TYLYWYLQKPGQPPQLLIYEVSYRVSGVPDRFS GSGSGTDFTLKISRVEAEDVGVYFCMQSIQLPLT FGGGTKVEIK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARRYSSS WSGGMDVWGQGTTVTVSS |
| | | | SEQ ID NO: 26180 | SEQ ID NO: 30186 |

FIGURE 50
(Continued)

| | | | | |
|---|---|---|---|---|
| iPS:435351 | 21-225_148B6 | NA | GACATCCAGATGACCCAGTCTCCATCCTCACTGTCTGCATCTGTAGGAGACAGAGTCAGCATCACTTGTCGGGCGAGTCAGGGCATTAGCAAATATTTAGCCTGGTTTCAGCAGAAACCAGGGAAAGCCCCTAAGTCCCTGATCTTTGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATAATAGTTTCCCATTCACTTTCGGCGCCTGGGACCAAAGTGGATATCAAA<br>SEQ ID NO: 26181 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGTCTTGAGTGGATGGGTTGGATCCACCTAACAATGGTGGCACAAACTATGCACAGGGACACGTCATCAGCACAGTCACCATGACCAGGGACACGTCATCAGCACAGTCTACATGGAGCTGAGCAGGCTGAGATCTGACGACACGGCCGTGTATTACTGTGCGAGAGATCCTGTAGTAGTACCAGCTGCCCCCCTTTGACTACTGGGGCCAGGGAACCCTGGTCACCGTCTCCTCA<br>SEQ ID NO: 30187 |
| | | AA | DIQMTQSPSSLSASVGDRVSITCRASQGISKYLAWFQQKPGKAPKSLIFAASSLQSGVPSKFSGSGSGTDFTLTISSLQPEDFATYYCQQYNSFPFTFGPGTKVDIK<br>SEQ ID NO: 26182 | QVQLVQSGAEVKKPGASVKVSCKASGYTFTGYYMHWVRQAPGQGLEWMGWIHPNNGTNYAQTFQGRVTMTRDTSISTVYMELSRLRSDDTAVYYCARDPVVVPAAPFDYWGQGTLVTVSS<br>SEQ ID NO: 30188 |
| iPS:435353 | 21-225_148F8 | NA | GACATCGTGATGACCCAGTCTCTAGACTCCTGGCTGTGTCTCTGGGCGAGAGGGCCACCATCAACTGCAAGTCCAGCCAGAGTGTTCTTACACAGCTCCAACAATTACAACTACTTAGCTTGGTACCAGCAGAAACCAGGACAGCCTCCTAAACTGCTCATTTACTGGGCATCTACCCGGGAAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTATTCCCGACGTTCGGCCAAGGGACCAAGGTGGAAATCAAA<br>SEQ ID NO: 26183 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGCCAGGCCACTGGACAAGGGCTTGAGTGGATGGGATGGATGAACAGAAGTTCCAGGCAGTAACACAGGCTATGCACCAGGAACACCTCCATAAGCAGAGCTACATGAGCTGAGCAGCCTGAGATCTGAGGACACGGCCGTGTACTACTTTGACTGTGCGAGTAGCAGTGGCTGGTACTACTTTGACTACTGGGGCCAGGGAACCCTGGTCACCGTCTCCTCA<br>SEQ ID NO: 30189 |

FIGURE 50
(Continued)

| | | | |
|---|---|---|---|
| iPS:435355 | 21-225_148H9 | AA | DIVMTQSLDSLAVSLGERATINCKSSQSALHSSN NYNYLAWYQQKPGQPPKLLIYWASTRKSGVPD RFSGSGSGTDFTLTISSLQAEDVAVYYCQQYYSI PPTFGQGTKVEIK<br>SEQ ID NO: 26184 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YYFDYWGQGTLVTVSS<br>SEQ ID NO: 30190 |
| | | NA | GACATCCAGATGACCCAGTCTCCATCTCCCT GTCTGCATCTGTAGGAGACAGAGTCACCATCA CTTGCCGGGCAAGTCAGAGCATTAGTAACTAT TTAAATTGGTATCAGCAGAAACCAGGGAAAG CCCCTAAGGTCCTGATCTATATTGCATCCAGTT TGCAAAGTGGGGTCCCATCTAGGTTCAGTGGC AGTGGATCTGGGACAGATTTCACTCTCACCAT CAGCAGTCTGCAACCTGAAGATTTTGCAACTT ACTACTGTCAACAGAGTTACAGTACCCCCACT TTCGGCGGAGGGACCAAGGTGGAGATCAAA<br>SEQ ID NO: 26185 | GAGGTGCAGCTGTTGGAGTCTGGGGGAGGCTTG GTACAGCCGGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACACAATTCCAAGAACACACT ATATTTGCAAATGAACAGCCTGAGAGCCGAGGA CACGGCCGTATATTACTGTGCGAAACGGGTGACG GACTACGGTGGTAAGACTGGTTCGACCCCCTGGG GCCAGGGAACCCTGGTCACCGTCTCCTCA<br>SEQ ID NO: 30191 |
| | | AA | DIQMTQSPSSLSASVGDRVTITCRASQSISNYLN WYQQKPGKAPKVLIYIASSLQSGVPSRFSGSGSG TDFTLTISSLQPEDFATYYCQQSYSTPFGGGTK VEIK<br>SEQ ID NO: 26186 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br>SEQ ID NO: 30192 |

FIGURE 50
(Continued)

| | | | |
|---|---|---|---|
| iPS:435357 | 21-225_148G10 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAAGACTATTTGTATTGGTACCTGCA GAGGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCGGGTGGAGGCT GAGGATGTTGGGGTTTATTACTGCATGCAAAG TATACAGCTTCCGTGGACGTTCGGCCAAGGGA CCAAGGTGGAAATCAAA<br>SEQ ID NO: 26187 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAAG ACACGGCTGTGTATTACTGTGCGAGAGATCGTTA CGATTTTTGGAGTGGTCACTTTGACTACTGGGGC CAGGGAACCCTGGTCACCGTCTCCTCA<br>SEQ ID NO: 30193 |
| | | AA | DIVMTQTPLSLSVTPGQPASISCKSSQSLLHGDG KTYLYWYLQRPGQPPQLLIYEVSNRFSGVPDRFS GSGSGTDFTLKISRVEAEDVGVYYCMQSIQLPW TFGQGTKVEIK<br>SEQ ID NO: 26188 | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCARDRYDF WSGHFDYWGQGTLVTVSS<br>SEQ ID NO: 30194 |
| iPS:435359 | 21-225_148H10 | NA | GATATTGTGATGACCCAGACTCCACTCTCTCT GTCCGTCACTCCTGGACAGCCGGCCTCCATCT CCTGCAAGTCTAGTCAGAGCCTCCTGCATAGT GATGGAAAAGACTATTTGTATTGGTACCTGCA GAAGCCAGGCCAGCCTCCACAGCTCCTGATCT ATGAAGTTTCCTACCGGGTTCTCTGGAGTGCCA GATAGGTTCAGTGGCAGCGGGTCAGGGACAG ATTTCACACTGAAAATCAGCGGGGTGGAGGCA GAGGATGTTGGGGTCTATTACTGCATGCAGAG TATACAGCTTCCGCTCACTTTCGGCGGAGGGA CCAAGGTGGAGATCAAA<br>SEQ ID NO: 26189 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATGCCAAGAACACGC TGTATCTGCAAATGAACAGCCTGAGAGCCGAGG ACACGGCTGTGTATTATTGTGCGAGGAGGTATAG CAGCAGCTGGTATGACGTCTGGGG CCAAGGGACCACGGTCACCGTCTCCTCA<br>SEQ ID NO: 30195 |

FIGURE 50
(Continued)

| | | | |
|---|---|---|---|
| iPS:435361 | 21-225_148E11 | AA | DIVMTQTPLSLSVTPGQPASISCKSSQSLLHSEGK TYLYWYLQKPGQPPQLLIYEVSYRVSGVPDRFS GSGSGTDFTLKISRVEAEDVGVYYCMQSIQLPLT FGGGTKVEIK |
| | | | SEQ ID NO: 26190 |
| | | NA | GACATCCAGATGACCCAGTCTCCATCCTCCT GTCTGCATCTGTAGGAGACAGACCAGTCACCATCA CTTGCCGGGCAAGTCAGGGCATTAGAAATGAT TTAGGCTGGTATCAGCAGAAACCAGGGAAAG CCCCTAAGCGCCTGATCTCTGCTGCATCCAGT TGCAAAGTGGGGTCCATCAAGGTTCACCGGC AGTGGATCTGGGACAGAATTCACTTTCACAAT CAGCAGCGTGCAGCCTGAAGATTTTGCAACTT ATTACTGTCTACAGCATCGTAATTACCCGCTC ACTTTCGGCGGAGGGACCAAGGTGGAGATCA AA |
| | | | SEQ ID NO: 26191 |
| | | AA | DIQMTQSPSSLSASVGDRVTITCRASQGIRNDLG WYQQKPGKAPKRLISAASSLQSGVPSRFTGSGSG TEFTFTISSVQPEDFATYYCLQHRNYPLTFGGGT KVEIK |
| | | | SEQ ID NO: 26192 |
| | | AA | QVQLVESGGGVVQPGRSLRLSCAASGFTFSSYGMH WVRQAPGKGLEWVAVIWYDGSNKYYGDSVKGRF TISRDNSKNTLYLQMNSLRAEDTAVYYCARRYSSS WSGGMDVWGQGTTVTSS |
| | | | SEQ ID NO: 30196 |
| | | | CAGCTGCAGCTGCAGGAGTCGGGCCAGGACTG GTGAAGCCTTCGGAGACCCTGTCCCTCACCTGCA CTGTCTCTGGTGTCTCCATCAGCAGAAGTAGTTA CTACTGGGGCTGGATCCGCCAGCCCCCAGGGAA GGGGCTGGAGTGGATTGGAGTATCTATTATAGT GGGAGCACCTCCTACAACCCGTCCCTCAAGAGTC GAGTCACCATATCCGTAGACACGTCCAAGAACC AGTTCTCCCTGAAGCTGAGCTCTGTGACCGCCGC AGACACGGCTGTGTTTACTGTGCGAGACTTGAT CCCCAGTGGAGTTTGACTACTGGGGCCAGGGAA TCCTGGTCACCGTCTCCTCA |
| | | | SEQ ID NO: 30197 |
| | | AA | QLQLQESGPGLVKPSETLSLTCTVSGVSISRSSYYW GWIRQPPGKGLEWIGSIYYSGSTSYNPSLKSRVTISV DTSKNQFSLKLSSVTAADTAVFYCARLDPQWSFDY WGQGILVTVSS |
| | | | SEQ ID NO: 30198 |

FIGURE 50
(Continued)

| | | | | |
|---|---|---|---|---|
| iPS:435363 | 21-225_148F12 | NA | GACATCCAGATGACCCAGTCTCCTTCCTCCCT GTCTGCATCTGTAGGAGACAGAGTCACCATCA CTTGCCGGGCAAGTCAGGGCATTAGAAATGCC TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTTCTGTCTACAGCATAATAGTTACCCTCTC ATTTTCGGCGGAGGGACCAAGGTGGAGATCA AA | CAGGTGCAGCTGCAGGAGTCGGGCCCAGGACTG GTGAAGCCTTCACAGACCCTGTCCCTCACCTGCA CTGTCTCTGGTGGCTCCATCAGCAGCAATGGTGTTA CTACTGGAACTGGATCCGCCAGCACCCAGGAA GGGCCTGGAGTGGATTGGGTACATCTATTACAGT TGGGAGCACCTACTACAACCCGTCCCTCAAGAGTC AAATTACCATATCAGTGGACACGTCTAAGGACCA GTTCTCCCTGAGGCTGAGCTCTGTGACTGCCGCG GACACGGCCGTGTATTACTGTGCGAGGTACAGTA CCTACGACTACTACGGTATGGACGTCTGGGG CCAAGGGACCACGGTCACCGTCTCCTCA |
| | | | SEQ ID NO: 26193 | SEQ ID NO: 30199 |
| | | AA | DIQMTQSPSSLSASVGDRVTITCRASQGIRNALG WYQQKPGKAPKRLIYAASSLQSGVPSRFSGSGS GTEFTLTISSLQPEDFATYFCLQHNSYPLIFGGGT KVEIK | QVQLQESGPGLVKPSQTLSLTCTVSGGSISNGGYY WNWIRQHPGKGLEWIGYIYYSGSTYYNPSLKSQITI SVDTSKDQFSLRLSSVTAADTAVYYCARYSTYDYY YGMDVWGQGTTVTVSS |
| | | | SEQ ID NO: 26194 | SEQ ID NO: 30200 |
| iPS:435365 | 21-225_149F1 | NA | GATATTGTGATGACCCAGTCTCCACTCTCTG TTCGTCACTCCTGGACAGCCGGCCTCCATCTCC TACAAGTCTAGTCAGAGCCTCCTGCATGGTGA TGGAAAGAACCTATTTTTATTGGTACCTGCAGA AGCCAGGCCAGCCTCCACAGCTCTTGATTTAT GAAGTTTCCCACCGGTTCTCTGGAGTGCCAGA TAGGTTCAGTGGCAGGGGTCAGGGACAGATT TCACACTGAAAATCAGCCGGGTGGAGGCTGA GGATGTGGGGTTTATTACTGCATGCAAGTA TACAGATTCCGTGACGTTCGGCCAAGGGACC AAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAATTATCTGATGTATGAGAAGT TATAAATACTATGCAGACTCCGTGAAGGGCCGAT TCACCATCTCCAGAGACAATTCCAAGAACACGCT GTATCTGCAAATGAACAGCCTGAGTGCCGAGGA CACGGCTGTGTATTACTGTGCGAGAGATCATTTC GATTTTTGGAGTGGTCACTTTGACTACTGGGGCC AGGGAACCCTGGTCACCGTCTCCTCA |
| | | | SEQ ID NO: 26195 | SEQ ID NO: 30201 |

FIGURE 50
(Continued)

| | | | |
|---|---|---|---|
| iPS:435367 | 21-225_149G1 | AA | DIVMTQSPLSLFVTPGQPASISYKSSQSLLHGDG KTYFYWYLQKPGQPPQLLIYEVSHRFSGVPDRFS GSGSGTDFTLKISRVEAEDVGVYCMQSIQIPWT FGQGTKVEIK<br>SEQ ID NO: 26196 | QVQLVESGGGVVQPGRSLRLSCAASGFTFSSYGMH WVRQAPGKGLEWVAIIWYDGSYKYYADSVKGRFT ISRDNSKNTLYLQMNSLSAEDTAVYYCARDHFDF WSGHFDYWGQGTLVTVSS<br>SEQ ID NO: 30202 |
| | | NA | GACATCCAGATGACCCAGTCTCCATCCTCCCT GTCTGCATCTGTAGGAGCCAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAAT TTGCAAAGTGGGGTCCCATCAAGGTTCAGTGG CAGTGGATCTGGGACAGAATTCACTCTCACAA TCAGCAGCCTGCAGCCTGAAGATTTTGCAACT TATTACTGTCTACAGCATATAATAGTTACCCGCTC ACTTTCGGCGGAGGGACCAAGGTGGAGATCA AA<br>SEQ ID NO: 26197 | CAGGTGCAGTTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGGTATGATGGAAG TAATAAATACTATGCAGACTCCGTGAAGGGCCG ATTCACCATCTCCAGAGACAATTCCAAGAACATG TTGTATCTGCAAATGAACAGCCTGAGAGCCGAG GACACGGCTGTGTATTACTGTGCGAGAGAAATAG GATTCAGTAGGGACTACTGGGGCCAGGGAACCC TGGTCACCGTCTCCTCA<br>SEQ ID NO: 30203 |
| | | AA | DIQMTQSPSSLSASVGARVTITCRASQGIRNDLG WYQQKPGKAPKRLIYAASNLQSGVPSRFSGSGS GTEFTLTISSLQPEDFATYYCLQHNSYPLTFGGG TKVEIK<br>SEQ ID NO: 26198 | QVQLVESGGGVVQPGRSLRLSCAASGFTFSDYGM HWVRQAPGKGLEWVAVIWYEGSNKYYADSVKGR FTISRDNSKNMLYLQMNSLRAEDTAVYYCAREIGF SEDYWGQGTLVTVSS<br>SEQ ID NO: 30204 |

FIGURE 50
(Continued)

| | | | |
|---|---|---|---|
| iPS:435369 | 21-225_149A2 | NA | GACATCGTGATGACCCAGTCTCCAGACTCCCT GGCTGTGTCTCTGGGCGAGAGGGCCACCATCA ACTGCAAGTCCAGCCAGAGTGTTTATACAGT CCCAACAATAACAACTACTTAGCTTGGTACCA GCAGAAACCAGGACAGCCCCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTGGCCAGGG GACCAAGGTGGAGATCAAA<br><br>SEQ ID NO: 26199 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGGTGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGGGAGCAG TGGCTGGTACTACTTTGACTACTGGGGCCAGGGA ACCCTGGTCACCGTCTCCTCA<br><br>SEQ ID NO: 30205 |
| | | AA | DIVMTQSPDSLAVSLGERATINCKSSQSVLYSPN NNNYLAWYQQKPGQPPKLLIYWASTRESGVPD RFSGSGSGTDFTLTISSLQAEDVAVYYCQQYYST PCSFGQGTKVEIK<br><br>SEQ ID NO: 26200 | QVQLVQSGAEVKKPGASVKVSCKASGYTFTNYDIN WVRQATGQGLEWMGWVHPNSGNTGYAQKFQGR VTMTRNTSISTAYMELSSLRSEDTAVYYCAGSSGW YYFDYWGQGTLVTVSS<br><br>SEQ ID NO: 30206 |
| iPS:435371 | 21-225_149A3 | NA | GACATCCAGATGACCCAGTCTCCATCCTCCCT GTCTGCATCTGTAGGAGACAGAGTCACCATCA CTTGCCGGGCAAGTCAGAGCATTAGCAGTTAT TTAAATTGGTATCAGCAGAAACCAGGGAAAG CCCCTAAGGTCCTGATCTATACTGCATCCAGT TTGCAAAGTGGGGTCCCATCAAGGTTCAGTGG CAGTGGATCTGGGACAGATTTCACTCTCACCA TCAACAGTCTGCAACCTGAAGATTTTGCAACT TACTACTGTCAACAGAGTTACAGTATCCCCAC TTTCGGCGGAGGGACCAAGGTGGAGATCAAA<br><br>SEQ ID NO: 26201 | GAGGTGCAGCTGTTGGAGTCTGGGGGAGGCTTG GTACAGCCTGGGGGGTCCCTGAGACTCTCCTGTG CAGCCTCTGGATTCACCTTTAGCAACTATGCCAT GACCTGGGTCCGCCAGGCTCCAGGGAAGGGCT GGAGTGGGTCTCAGCTATTAGTGGTCGTGGTGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTACGAACAAACGGGTGACG GACTACGGTGTAACGACTGGTTCGACCCTGGG GCCAGGGAACCCTGGTCACCGTCTCCTCA<br><br>SEQ ID NO: 30207 |

FIGURE 50
(Continued)

| | | | |
|---|---|---|---|
| iPS:435373 | 21-225_149E3 | AA | DIQMTQSPSSLSASVGDRVTITCRASQSISSYLNW YQQKPGKAPKVMIYTASSLQSGVPSRFSGSGSGT DFTLTINSLQPEDFATYYCQQSYSIPTFGGGTKVE IK | EVQLLESGGGLVQPGGSLRLSCAASGFTFSNYAMT WVRQAPGKGLEWVSAISGRGNTFYADSVKGRFTI SRDNSKNTLYLQMNSLRAEDTAVYYCTKRVTDYG GNDWFDPWGQGTLVTVSS |
| | | | SEQ ID NO: 26202 | SEQ ID NO: 30208 |
| | | NA | GACATCGTGATGACCCAGTCTCCAGACTCCCT GGCTGTGTCTCTGGGCGAGAGACTGTTACACAAC GCTGCAAGTCCAGCCAGACTGTTTACACAAC TCCAATAATCACAATTACTTTGCTTGGTACCA GCAGAAACCAGGACAGCCTCCTAAGCTGCTCA TTTACTGGGCATCTACCCTGAGATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCGACGTTCGCGCAAGG GACCAAGGTGGAAATCAAA | CAGGTGCAGCTGGTGCAGTCTGGGGCTGAGGTG AAGAAGCCTGGGGCTCAGTGAAGGTCTCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGACATCTGA GGACACGGCCGTGTATTACTGTGCATATAGCAGT GGCTGGTACTGGTTTGACTACTGGGGCCAGGGAA CCCTGGTCACCGTCCTCCTCA |
| | | | SEQ ID NO: 26203 | SEQ ID NO: 30209 |
| | | AA | DIVMTQSPDSLAVSLGERATISCKSSQTVLHNSN NHNYFAWYQQKPGQPPKLLIYWASTLRSGVPD RFSGSGSGTDFTLTISSLQAEDVAVYYCQQYYST PPTFGQGTKVEIK | QVQLVQSGAEVKKPGASVKVSCKASGYTFTNYDIN WVRQATGQGLEWMGWMHPNSGNTGYAQKFQGR VTMTRNTSISTAYMELSSLTSEDTAVYYCAYSSGW YWFDYWGQGTLVTVSS |
| | | | SEQ ID NO: 26204 | SEQ ID NO: 30210 |

FIGURE 50
(Continued)

| | | | |
|---|---|---|---|
| iPS:435375 | 21-225_149H4 | NA | GACATCGTGATGACCCAGTCTCCAGACTCCCTGGCTGTGTCTCTGGGCGAGAGGGCCACCATCAACTGCAAGTCCAGCCAGAGTGTTTTATCGTACCAACGATAACAACTACTTAGTTGGTACCATCCAACGATAACAACTACTTAGTTGGTACCAACAGAAACCAGGACAGCCTCCTAAGCTGCTCATTTACTGGTCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCACCAATATTATAGTTATCCCGACGTTCGGCCAAGGGACCAAGGTGGAAATCAAA |
| | | | SEQ ID NO: 26205 |
| | | AA | DIVMTQSPDSLAVSLGERATINCKSSQSVLSSSNDNNYLAWYQQKPGQPPKLLIYWSSTRESGVPDRFSGSGSGTDFTLTISSLQAEDVAVYYCHQYYSYPPTFGQGTKVEIK |
| | | | SEQ ID NO: 26206 |
| | | NA | GACATCCAGATGACCCAGTCTCCTTCCTCCCTGTCTGCATCTGTAGGAGACAGAGTCACCATCACTTGCCGGGCAAGTCAGGGCATTAGAAATGCCTTAGGCTGGTTTCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAAGCAGCCTGCAGCCTGAAGATTTTGCAACTTATTACTGTCTACAGCATAATAGTTACCCTCTCACTTTCGGCGGAGGGACCAAGGTGGAGATCAAA |
| | | | SEQ ID NO: 26207 |
| iPS:435377 | 21-225_149G5 | | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTTATTACTGGAACTGGATCCGCCAGCACCCAGGGAAGGGCCTGGAGTGGATTGGGTACATCTATTACAGTGGGAGCACCTACTACAACCCGTCCCTCAAGAGTCGAGTTACCATATCAGTAGACACGTCTAAGAACCAGTTCTCCCTGAGGCTGAGCTCTGTGACTGCCGCGGACACGGCCGTGTATTACTGTGCGAGTACAGTACCTACGACTACTACGGTATGGACGTCTGGGGCCAAGGGACCACGGTCACCGTCTCCTCA |
| | | | SEQ ID NO: 30213 |

| | | | |
|---|---|---|---|
| | | | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACCCTAACAGTGGTAACACAGACTATGCACAGAAGTTCCAGGCAGAGTCACCATGACCAGGAACACCTCCATAACCACAGTTTACATGGAGCTGAGCAGCCTGAGATCTGAGGACACGGCCGTGTACTTTGACTACTGGGGCCAGGGAACCCTGGTCACCGTCTCCTCA |
| | | | SEQ ID NO: 30211 |
| | | AA | QVQLVQSGAEVKKPGASVKVSCKASGYTFTNYDINWVRQATGQGLEWMGWMHPNSGNTDYAQKFQGRVTMTRNTSITVYMELSSLRSEDTAVYYCFDYWGQGTLVTVSS
YYFDYWGQGTLVTVSS |
| | | | SEQ ID NO: 30212 |

FIGURE 50
(Continued)

| | | AA | DIQMTQSPSSLSASVGDRVTITCRASQGIRNALG WFQQKPGKAPKRLIYAASSLQSGVPSRFSGSGSG TEFTLTISSLQPEDFATYYCLQHNSYPLTFGGGT KVEIK<br>SEQ ID NO: 26208 | QVQLQESGPGLVKPSQTLSLTCTVSGGSISNGGYY WNWIRQHPGKGLEWIGYIYYSGSTYNPSLKSRVT ISVDTSKDQFSLRLSSVTAADTAVYYCARYSTYDY YYGMDVWGQGTTVTVSS<br>SEQ ID NO: 30214 |
|---|---|---|---|---|
| iPS:435379 | 21-225_149B6 | NA | GACATCCAGATGACCCAGTCTCCATCTTCCGT GTCGGGCATCTGTAGGAGACAGAGTCACCATCA CTTGTCGGGCGAGTCAGGGTATTATCAGTTGG TTAGCCTGGTATCAGCAGAAACCAGGAAAAG CCCCTAAGCTCCTGATCTATGCTGCATCCAGTT TGCAAAGTGGGGTCCCATCCAAGGTTCAGCGGC AGTGGATCTGGGACAGATTTCACTCTCACCAT CAGCAGCCTGCAGCCTGAAGATTTTGCAACTT ACTATTGTCAACAGGGTAACAGTTTCCCATTC ACTTTCGGCCCTGGGACCAAAGTGGATATCAA A<br>SEQ ID NO: 26209 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AGCACATTCTACGCAGACTCCGTGAAGGGCCGGT TCACCATCTCCAGAGACAATTCCAAGAACACGCT GTTTCTGCAAATGAACAGCTGAGAGCCGAGGA CACGGCCGTATATTACTGTGCGAAACGAACTCCG GAAGATGTTTTGATATCTGGGGCCAAGGGACAA TGGTCACCGTCTCTTCA<br>SEQ ID NO: 30215 |
| | | AA | DIQMTQSPSSVSASVGDRVTITCRASQGIISWLA WYQQKPGKAPKLLIYAASSLQSGVPSRFSGSGS GTDFTLTISSLQPEDFATYYCQQGNSFPFTFGPGT KVDIK<br>SEQ ID NO: 26210 | EVQLLESGGGLVQPGGSLRLSCAASGFTFSSYAMS WVRQAPGKGLEWVSVISGSGGSTFYADSVKGRFTI SRDNSKNTLFLQMNSLRAEDTAVYYCAKRTPEDVF DIWGQGTMVTVSS<br>SEQ ID NO: 30216 |

FIGURE 50
(Continued)

| | | | | |
|---|---|---|---|---|
| iPS:435381 | 21-225_149C6 | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGCTGGTATCAGCAGAAACCAGGGAGAG CCCCTAAGCTCCTGATCTATGCTGCATCCAGTT TGCAAGGTGGGGTCCCATCAAGGTTCAGCGGC AGTGGATCTGGGACAGATTACACTCTCTCCAT CAGCAGCCTGCAGCCTGAAGATTTTGCAACTT ACTATTGTCAACAGACTGACAGTTTCCATTC ACTTTCGGCCCTGGGACCAAAGTGGATATCAA A | GAGGTGCAGCTGTTGGAGTCTGGGGGAGGCTTA GTACAGCCTGGGGGGTCCCTGAGACTCTCCTGTG CAGCCCTCTGAATTCACCTTTAGCAGCTATGCCAT GAGCTGGGTCCGCCAGGCTCCAGGGAAGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACGCT GTATCTGCACATGAACAGCCTGAGAGCCGAGGA CACGGCCGTTTATTACTGTGCGAAAAAGGATTAT GATTACGTTTGGGGGGAGTCCTTACTTTGACTACT GGGGCCAGGGAACCCTGGTCACCGTCTCATCA |
| | | | SEQ ID NO: 26211 | SEQ ID NO: 30217 |
| | | AA | DIQMTQSPASVSASVGDRVTITCRASQGISNWLA WYQQKPGRAPKLLIYAASSLQGGVPSRFSGSGS GTDYTLSISSLQPEDFATYYCQQTDSFPFTFGPGT KVDIK | EVQLLESGGGLVQPGGSLRLSCAASGFTFSSYAMS WVRQAPGKGLEWVSAISGSGGNTFYADSVKGRFTI SRDNSKNTLYLHMNSLRAEDTAVYYCAKKDYDYV WGSPYFDYWGQGTLVTVSS |
| | | | SEQ ID NO: 26212 | SEQ ID NO: 30218 |
| iPS:435383 | 21-225_149D7 | NA | GAAATTGTGTTGACGCAGTCTCCAGGCACCCT GTCTTTGTCTCCAGGGGAAAGAGTCACCCTCT CCTGCAGGGCCAGTCAGAGTATTATCAGCAAC TACTTAGCCTGGTACCAGCAGAAACCTGGCCA GGCTCCCAGGCTCCTCATCTTTGGTGTATCTAG TAGGGCCACTGGCATCCCAGACAGGTTCAGTG GCAGTGGGTCTGGGACAGACTTCACTCTCACC ATCAGCAGACTGGAGCCTGAAGATTTTGCAGT GTATTACTGTCAACAATGGTCGGTCACCAT TCAATTTCGGCGGAGGGACCAAAGTGGATATC AAA | CAGGTGCAGCTGCAGGAGTCGGGCCCAGGACTG GTGAAGCCTTCACAGACCCTGTCCCTCAATTGCA CTGTCTCTGGTGGCTCCATCAGCAACAGTGGTTA CTACTGGAGCTGGATCCGCCAGCACCCAGGGAA GGGAGCACTGGAATGGATTGGGTACATCTATTACAGT GGGAGCACCTACTACAACCCGTCCCTCAAGAGTC GAATTACCATATCAGTAGACACGTCTAACAACCA GTTCTCCCTGAAGCTGAGCTCTGTGACTGCCGCG GACACGGCCGTGTATTACTGTGCGAGAGGGGA TATAACTGGAACCATGCTTTTGATATCTGGGGCC AAGGGACAATGGTCATCGTCTCTTCA |
| | | | SEQ ID NO: 26213 | SEQ ID NO: 30219 |

FIGURE 50
(Continued)

| | | | |
|---|---|---|---|
| | | AA | EIVLTQSPGTLSLFPGERVTLSCRASQSIISNYLAWYQQKPGQAPRLLIFGVSSRATGIPDRFSGSGSGTDFTLTISRLEPEDFAVYYCQQYGRSPFNFGPGTKVDIK | QVQLQESGPGLVKPSQTLSLNCTVSGGSISNSGYYWSWIRQHPGKGLEWIGYSYYSGSTYYNPSLKSRITISVDTSNNQFSLKLSSVTAADTAVYYCARGGYNWNHAFDIWGQGTMVIVSS |
| | | | SEQ ID NO: 26214 | SEQ ID NO: 30220 |
| iPS:435391 | 21-225_149F8 | NA | GACATCCAGATGACCCAGTCTCCAGCTTCCGTGTCTGCATCTGTAGGAGACAGAGTCACCATAACTTGTCGGGCGAGTCAGGGTATTAGCAACTGGTTAGCCTGGTATCAGCAGAAACCAGGGAAAGCCCCTAAGCTCCTGATCTATGCTGTCATCCAGTTTGCAAAGTGGGGTCCCATCAAGGTTCAGCGGCAATGAATCTGGGACAGATTTCACTCTCTCCATCAGCAGCCTGCAGCCTGAAGATTTTGCAATTTACTATTGTCAACAGACTGACAGTTTCCCATTCACTTTCGGCCCTGGGACCAAAGTGGATGTCAAA | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTATTAGTGGTCGTGGTGGTAACACATTCTACGCAGACTCCGTGAAGGGCCGCTTCACCATCTCCAGAGACAATTCCAAGAACACGCTCTATCTGCAAATGAACAGCCTGAGAGCCGAGGACACGGCCGTATATTACTGTGCGAAAAAGGATTATGATTACGTTTGGGGGAGTCCTTACTTTGACTACTGGGGCCAGGGAACCCTGGTCACCGTCTCCTCA |
| | | | SEQ ID NO: 26215 | SEQ ID NO: 30221 |
| | | AA | DIQMTQSPASVSASVGDRVTITCRASQGISNWLAWYQQKPGKAPKLLIYAASSLQSGVPSRFSGNESGTDFTLSISSLQPEDFAIYYCQQTDSFPFTFGPGTKVDVK | EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS |
| | | | SEQ ID NO: 26216 | SEQ ID NO: 30222 |

FIGURE 50
(Continued)

| | | | |
|---|---|---|---|
| iPS:435393 | 21-225_149D10 | NA | GACATCCAGATGACCCAGTCTCCATCCTCCCT GTCTGCATCTGTAGGAGACAGAGTCACCATCA CTTGCCGGGCAAGTCTGGGGCATTAGAAATGAT TTAGGCTGGTATCAGCAGAAACCAGGGAAAG CCCCTAAGCGCCTGATCTATGCTGCATCCAGT TTGCAGAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTATCCTCGG ACGTTCGGCCAAGGGACCAAGGTGAAATCA AA | CAGGTGCAGCTGGTGGAGTCTGGGGGAGGCGTG GCCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGCAGACTCCGTGAAGT AATAAGTACTATGCAGACTCCGTGAAGGGCGA CTCACCATCTCCAGAGACAATTCCAAGAACACGC TGTATCTGCAAATGAACAGCCTGAGAGCCGAGG ACACGGCTGTGTATTACTGTGCGAGAGAGGTA AGCAGTGGCTGGTACGACTACGGTATGGACGTC TGGGGCCAAGGGACCACGGTCACCGTCTCCTCA |
| | | SEQ ID NO: 26217 | SEQ ID NO: 30223 |
| | | AA | DIQMTQSPSSLSASVGDRVTITCRASQSGIRNDLG WYQQKPGKAPKRLIYAASSLQSGVPSRFSGSGS GTEFTLTISSLQPEDFATYYCLQHYSYPRTFGQG TKVEIK | QVQLVESGGGVAQPGRSLRLSCAASGFTFSDYGM HWVRQAPGKGLEWVAVIWYDGSNKYYADSVKGR LTISRDNSKNTLYLQMNSLRAEDTAVYYCARERYS SGWYDYGMDVWGQGTTVTVSS |
| | | SEQ ID NO: 26218 | SEQ ID NO: 30224 |
| iPS:435395 | 21-225_149D11 | NA | GACATCCAGATGACCCAGTCTCCAGTCTTCCGT GTCTGCATCTGTAGGAGACAGAGTCACCATCA CTTGTCGGGCGAGTCAGGATGTCAGCAGTCAACTGG TTAACCTGGTATCAGCAGAAACCAGGGAAAG CCCCTAAGTCCCTGATCTATGCTGCATCCAGTT TGCAAAGTGGGGTCCCATCAAGGTTCACTCTCT GCAAAGTGGGGTCCCATCAAGGTTCACTCTCCAT AGTGGATCTGGGACAGATTTCACTCTCACCATC CAGCAGCCTGCAGCCTGAAGATTTTGCAACTT ACTATTGTCAACAGACTGACAGTTTCCCATTC ACTTTCGGCCCTGGGACCAAAGTGGATGTCAA A | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTTATGCCAT GAGCTGGGTCCGCCAGGCTCCAGGGAAGGGCT GGAGTGGGTCTCAGCTATTAGTGGTGGTGGTGT AACACATTCTACGCAGACTCCGTGAAGGGCCGT TCACCATCTCCAGAGACAATTCCAAGAACACGCT CTATCGGCAAATGAACAGCCTGAGAGCCGAGGA CACGGCCGTATATTACTGTGCGAAAAGGATTAT GATTACGTTTGGGGAGTCCTTACTTTGACTACT GGGGCCAGGGAACCCTGGTCACCGTCTCCTCA |
| | | SEQ ID NO: 26219 | SEQ ID NO: 30225 |

FIGURE 50
(Continued)

| | | | |
|---|---|---|---|
| iPS:435397 | 21-225_149F12 | AA | DIQMTQSPASVSASVGDRVTITCRASQNISNWLT WYQQKPGKAPKLLIYAASSLQSGVPSRFSGSGS GTDFTLSISSLQPEDFATYYCQQTDSFPFTFGPGT KVDVK<br><br>SEQ ID NO: 26220 | EVQLLESGGGLVQPGGSLRLSCAASGFTFSSYAMS WVRQAPGKGLEWVSAISGRGGNTFYADSVKGRFTI SRDNSKNTLYRQMNSLRAEDTAVYYCAKKDYDY VWGSPYFDYWGQGTLVTVSS<br><br>SEQ ID NO: 30226 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAAT TTGCAAAGTGGGGTCCCATCAAGGTTCAGCGG CAGTGGATCTGGGACAGATCACTCTCACAA TCAGCAGCCTGCAGCCTGAAGATTTTGCAATT TATTACTGTCTACAGCATATAGTTACCCGCTC ACTTTCGGCGGAGGGACCAAGGTGGAGATCA AA<br><br>SEQ ID NO: 26221 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGCAGACTCCGTGAAGAAA TAATAAATACTATGCAGACTCCGTGAAGGGCCG ATTCACCATCTCCAGAGACAATTCCAAGAACACG CTGTTTCTGCAAATGAACAGCCTGAGAGCCGAGG ACACGGCTGTGTATTACTGTGCGAGAGAATAGG GTTCAGTGAGGACTACTGGGGCCAGGGAACCCT GGTCACCGTCTCCTCA<br><br>SEQ ID NO: 30227 |
| | | AA | DIQMTQSPSSLSASVGDRVTITCRASQGIRNDLG WYQQKPGKAPKRLIYAASNLQSGVPSRFSGSGS GTEFTLTISSLQPEDFAIYYCLQHNSYPLTFGGGT KVEIK<br><br>SEQ ID NO: 26222 | QVQLVESGGGVVQPGRSLRLSCAASGFTFSDYGM HWVRQAPGKGLEWVAVIWYEENNKYYADSVKGR FTISRDNSKNTLFLQMNSLRAEDTAVYYCAREIGFS EDYWGQGTLVTVSS<br><br>SEQ ID NO: 30228 |

FIGURE 50
(Continued)

| | | | |
|---|---|---|---|
| iPS:435399 | 21-225_150D2 | NA | GACATCGTGATGACCCAGTCTCCAGACTCCCT GGCTGTGTCTCTGGGCGAGAGGGCCACCATCA AGTGCAAGTCCAGCCAGAGTGTTTATAGACAGA TCCAACAGTAAGAAATACTTAACTGGTACCA GCAGAAACCAGGACAGCCTCCTAAGCTGTTCA TTTATTGGGCATCTACCCGGAAATCGGGGTC CCTGACCGATTCAGTGGCAGCGGGTCTGGGAC AGATTTCACTCTCACCATCAGCAACCTGCAGG CTGAAGATGTGGCAGTTTATTTCTGTCAGCAA TATTTTAGTACTCCGTACAATTTTGGCCAGGG GACCAAGAGGGAGATCAAA SEQ ID NO: 26223 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCTTATAGCAGT GGCTGGTACTACTTTGACTACTGGGGCCAGGGAA CCCTGGTCACCGTCTCCTCA SEQ ID NO: 30229 |
| | | AA | DIVMTQSPDSLAVSLGERATIKCKSSQSVLYRSN SKKYLTWYQQKPGQPPKLFIYWASTRKSGVPDR FSGSGSGTDFTLTISNLQAEDVAVYFCQQYFSTP YNFGQGTKREIK SEQ ID NO: 26224 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS SEQ ID NO: 30230 |
| iPS:435401 | 21-225_150E2 | NA | GACATCCAGATGACCCAGTCTCCATCCTCCCT GTCTGCATCTGTGGGAGACAGAGTCACCATCT CTTGCCGGGCAAGTCAGGGCATTGGAAATGAT TTAGGCTGGTATCAGCAGAAACCAGGAAAG CCCCTAAGCGCCTACGGTCCATCAAGGTTCAGCGGC TGCAAAGTGGGGTCCCATCAAGGTTCAGCGGC AGTGGATCTGGGACAGAATTCACTCTCACTAT CAGCAGCCTGCAGCCTGACAACATTATAGTTTCCCGTACA GTTTTGGCCAGGGGACCAAGCTGGAGATCAAA SEQ ID NO: 26225 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGCTCCAGGCAAGGGCT GGAGTGGGTGGCAGTTATATGCAGACTCCGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGAGTA TAGCAGCAGCTGGTACGGGTACGGTATGGACGT CTGGGGCCAAGGGACCACGGTCACCGTCTCCTCA SEQ ID NO: 30231 |

FIGURE 50
(Continued)

| | | | |
|---|---|---|---|
| iPS:435403 | 21-225_150C5 | AA | DIQMTQSPSSLSASVGDRVTISCRASQGIGNDLG WYQQKPGKAPTRLIYAASSLQSGVPSRFSGSGSG TEFTLTISSLQPADFATYYCLQHYSFPYSFGQGT KLEIK<br>SEQ ID NO: 26226 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVYYCAREEYSS SWYGYGMDVWGQGTTVTVSS<br>SEQ ID NO: 30232 |
| | | NA | GACATCCAGATGACCCAGTCTCCAGTTCCGT GTCTGCATCTGTAGGAGACAGAGTCACCATAA CTTGTCGGGCGAGTCAGGGTATTAACAACTGG TTAGCCTGGTATCAGCAGAAACCAGGGAAAG CCCCTAAGCTCCTGATCTATGCTGCATCCAGTT TGCAAGGTGGGGTCCCATCAAGGTTCAGCGGC AGTGGATCTGGGACAGATTTCACTCTCTCCAT CAGCAGCCTGCAGCCTGAAGATTTTGCAACTT ACTATTGTCAACAGACTGACAGTTCCCATTC ACTTTCGGCCCTGGGACCAAAGTGGATATCAA A<br>SEQ ID NO: 26227 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTAGTGGTGGT AACACATTCTACGCAGACTCCGTGAAGGGCCGT TCACCATCTCCAGAGACAATTCCAAGAACACGCT GTATCTGCAAATGAACAGCTGAGAGCCGAGGA CACGGCCGTATATTACTGTGCGAAAAAGGATTAT GATTACGTTTGGGGAGTCCTTACTTTGACTACT GGGGCCAGGGAACCCTGGTCACCGTCTCCTCA<br>SEQ ID NO: 30233 |
| | | AA | DIQMTQSPGSVSASVGDRVTITCRASQGINNWL AWYQQKPGKAPKLLIYAASSLQGGVPSRFSGSG SGTDFTLSISSLQPEDFATYYCQQTDSFPFTFGPG TKVDIK<br>SEQ ID NO: 26228 | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKKDYDYV WGSPYFDYWGQGTLVTVSS<br>SEQ ID NO: 30234 |

FIGURE 50
(Continued)

| | | | |
|---|---|---|---|
| iPS:435405 | 21-225_150B7 | NA | GACATGTGATGACCCAGTCTCCAGACTCCCT GGCTGTGTCTCTGGGCGAGAGGGCCACCATCA ACTGCAAGTCCAGCCAGAATGTTTTATACAGC TCCCACAATAACAACTACTTAGCTTGGTACCA GCAGAAACCAGGGCAGCCTCCTAAACTACTCA TTTACTGGGCATCTACCCGGAAATCCGGGGTC CCTGACCGATTCAGTGGCAGCGGGTCTGGGAC AGATTTCACTCTCACCATCACCAGCCTGCAAG CTGAAGATGTGGCAGTTTATTACTGTCAGCAA TATTATAGTACTCCATTCACTTTCGGCCCTGGG ACCAAAGTGGATATCAAA | CAGGTGCAGCTGGTGCAGTCTGGGCTGAGGTA AGAAGCCTGGGGCCTCAGTGACGGTCCTGCA AGGCTTCTGGATTCCCCTTCACCAATTATGATAT CAACTGGGTGCGACAGGCCACTGGACAAGGCT TGAGTGGATGGGATGGATGCACCTAACAGTGGT AACACAGGCTATGCACAGAAGTTCCAGGGCAGA GTCACCATGACCAGGAACACCTCCATAAGCACA GCCTACTTGGAGCTGAGCAGCCTGAGATCTGAGG ACACGGCCGTGTATTACTGTGCGAGTAGCAGTGG CTGGTACTTTTTTGACTACTGGGGCCAGGGAACC CTGGTCACCGTCTCCTCA |
| | | | SEQ ID NO: 26229 | SEQ ID NO: 30235 |
| | | AA | DIVMTQSPDSLAVSLGERATINCKSSQNVLYSSH NNNYLAWYQQKPGQPPKLLIYWASTRKSGVPD RFSGSGSGTDFTLTITSLQAEDVAVYYCQQYYST PFTFGPGTKVDIK | QVQLVQSGAEVKKPGASVTVSCKASGFPFTNYDIN WVRQATGQGLEWMGWMHPNSGNTGYAQKFQGR VTMTRNTSISTAYLELSSLRSEDTAVYYCASSSGWY FFDYWGQGTLVTVSS |
| | | | SEQ ID NO: 26230 | SEQ ID NO: 30236 |
| iPS:435407 | 21-225_150E7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAAT TTGCAAAGTGGGGTCCCATTAAGGTTCAGCGG CAGTGGATCTGGGACAGATTCACTCTCACAA TCAGCAGCCTGCAGCCTGAAGATTTTGCAGCT TATTACTGTCTACAGCATAATAGTTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGGCAT GCACTGGGTCCGCCAGGCTCCAGGCAAGGGCT GGAGTGGGTGGCAGTTATATGGTATGAAGAAAA TAATAACCATCCAGAGACAATTCCAAGAACACG ATTCACCATCTCCAGAGACAACAGCCAAGAACACG CTGTTTCTGCAAATGAACAGCCTGAGAGCCGAGG ACACGGCTGTGTATTACTGTGCGAGAGAAATAGG GTTCAGTGAGGACTACTGGGGCCAGGGAACCCT GGTCACCGTCTCCTCA |
| | | | SEQ ID NO: 26231 | SEQ ID NO: 30237 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASNLQSGVPLRFSGSGS GTDFTLTISSLQPEDFAAYYCLQHNSYPLTFGGG TKVEIK<br>SEQ ID NO: 26232 | QVQLVESGGGVVQPGRSLRLSCAASGFTFSDYGM HWVRQAPGKGLEWVAVIWYEENNKYYADSVKGR FTISRDNSKNTLFLQMNSLRAEDTAVYYCAREIGFS EDYWGQGTLVTVSS<br>SEQ ID NO: 30238 |
| iPS:435409 | 21-225_150G8 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGAAAGC CCCTAAGTCCCTGATCTATGTTGCATCCAGTTT GCAAAATGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATAATAATTACCCGCTCA CTTTCGGCGGAGGGACCAAGGTGGAGATCAA A<br>SEQ ID NO: 26233 | GAGGTGCAGCTGGTGGAGTCTGGGGGAGGCTTG GTGCAGCCTGGGGGGTCCCTGAGACTCTCCTGTG CAGCCTCCGGATTCACTTTCAGTGACTACCATGCAT GACTTGGGTCCGCCAGGCTCCAGGGAAGGGGCT GGACTGGGTTTCATACATTAGTAGGAGTAGTAGT ACCATATACTACGCAGACTCTGTGAAGGGCCGAT TCTCCATCTCCAGAGACAATGCCAAGAACTACT GTATCTGCAAATGAACAGCTGAGAGACGAGGA CACGGCTCTGTATTACTGTGCGAGATCGGCATTT AGCCCTTTTGATTACTGGGGCCAGGGAACCCTGG TCACCGTCTCCTCA<br>SEQ ID NO: 30239 |
| | | AA | DIQMTQSPSSLSASVGDRVTITCRASQGISHYLA WFQQKPGKAPKSLIYVASSLQNGVPSRFSGSGSG TDFTLTISSLQPEDFATYYCQQYNNYPLTFGGT KVEIK<br>SEQ ID NO: 26234 | EVQLVESGGGLVQPGGSLRLSCAASGFTFSTYSMT WVRQAPGKGLDWVSYISRSSSTIYYADSVKGRFSIS RDNAKNSLYLQMNSLRDEDTALYYCARSAFSPFD YWGQGTLVTVSS<br>SEQ ID NO: 30240 |

FIGURE 50
(Continued)

| | | | |
|---|---|---|---|
| iPS:435413 | 21-225_150B11 | NA | GATATTGTGATGACCCAGACTCCACTCTCT GTCCGTCACCCCTGGACAGCCGGCCTCCATC CCTGCAAGTCTAGTCAGAGCTCCTGCATGGT GATGGAAAGACCTATTTGTATTGGTACCTGCA GAGGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACATTGAAAATCAGCGGGTGGAGGCT GAGGATGTTGGGGTTTATTACTGCATGCAAAG TATACAGCTTCCGTGGACGTTCGGCCAAGGGA CCAAGGTGGAAATCAAA <br><br>SEQ ID NO: 26235 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAATTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAAG ACACGGCTGTGTATTACTGTGCGAGAGATCGTTA CGATTTTGGAGTGGTCACTTTGACTACTGGGGC CAGGGAACCCTGGTCACCGTCTCCTCA <br><br>SEQ ID NO: 30241 |
| | | AA | DIVMTQTPLSLSVTPGQPASISCKSSQSLVHGDG KTYLYWYLQRPGQPPQLLIYEVSNRFSGVPDRFS GSGSGTDFTLKISRVEAEDVGVYYCMQSIQLPW TFGQGTKVEIK <br><br>SEQ ID NO: 26236 | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCARDRYDF WSGHFDYWGQGTLVTVSS <br><br>SEQ ID NO: 30242 |
| iPS:435415 | 21-225_150C11 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTATTTACACT TTCGGCGGAGGGACCAAGGTGGAGATCAAA <br><br>SEQ ID NO: 26237 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAGTGGGTCTCAGCTATTAGTAGTGGTAGTGGT AACACATTCTACGCAGACTCCGTGAAGGGCCGGT TCACCATCTCCAGAGACAATTCCAAGAACACGCT GAATCTGCAAATGAGCAGCCTGAGAGCCGAGGA CACGGCCGTATATATTACTGCGCGAAACGGGTGAC GGACTACGGTGGTAACGACTGGTTCGACCCCTGG GGCCAGGGAACCCTGGTCACCGTCTCCTCA <br><br>SEQ ID NO: 30243 |

FIGURE 50
(Continued)

| | | | |
|---|---|---|---|
| iPS:435417 | 21-225_150D11 | AA | DIQMTQSPSSLSASVGDRVTITCRASQSISSYLNWYQQKPGKAPKLLIYTASSLQSGVPSRFSGSGSGTDFTLTISSLQPEDFATYYCQQSYSIYTFGGGSKVEIK<br>SEQ ID NO: 26238 | EVQLLESGGGLVQPGGSLRLSCAASGFTFSSYAMNWVRQAPGKGLEWVSAISGSGGNTFYADSVKGRFTISRDNSKNTLNLQMSSLRAEDTAVYYCAKRVTDYGGNDWFDPWGQGTLVTVSS<br>SEQ ID NO: 30244 |
| | | NA | GATATTGTGATGACCCAGACTCCACTCTCTCTGTCCGTCACTCCTGGACAGCCGGCCTCCATCTCCTGCAAGTCTAGTCAGAGCCTCCTGCATAGTGAGGGAAAGAACCTATTTGTATTGGTACCTGCAGAAGCCAGGCCAGTCTCCACAGCTCCTGATCTATGAAGTTTCCTACCGGTTCTCTGGAGTGCCAGATAGGTTCAGTGGCAGCGGGTCAGGGACAGATTTCACACTGAAAATCAGCCGGGTGGAGGCTGAGGATGTTGGGGTTTATTACTGCATGCAAGGTATACAGCTTCCGCTCACTTTCGGCGGAGGGACCAAGGTGGAGATCAAA<br>SEQ ID NO: 26239 | CAGGTGCAGCTGTGGTGGAGTCTGGGGGAGGCGTGGTCCAGCCTGGGAGGTCCCTGAGACTCTCCTGTCAGCGTCTGGATTCACCTTCAGTAGCTATGCCATGCACTGGGTCCGCCAGGCTCCAGGCAAGGGGCTGGAGTGGGTGGCAGTTATATTCTATGATGGAAGTAATAAACACTATGCAGACTCCGTGAAGGGCCGATTCACCATCTCCAGAGACAATTCCAAGAACACGCTGTATCTGCAAATGAACAGCCTGAGAGCCGAGGACTCGGCTGTGTATTACTGTACGAGGAGGTTTAGCAGCAGCTGGTGGGGGTATGGACGTCTGGGGCCAAGGGACCACGGTCACCGTCTCCTCA<br>SEQ ID NO: 30245 |
| | | AA | DIVMTQTPLSLSVTPGQPASISCKSSQSLLHSEGKTYLYWYLQKPGQPPQLLIYEVSYRFSGVPDRFSGSGSGTDFTLKISRVEAEDVGVYYCMQGIQLPLTFGGGTKVEIK<br>SEQ ID NO: 26240 | QVQLVESGGGVVQPGRSLRLSCAASGFTFSSYGMHWVRQAPGKGLEWVAVIFYDGSNKHYADSVKGRFTISRDNSKNTLYLQMNSLRAEDSAVYYCTRRFSSSWSGGMDVWGQGTTVTVSS<br>SEQ ID NO: 30246 |

FIGURE 50
(Continued)

| | | | |
|---|---|---|---|
| iPS:435419 | 21-225_150C12 | NA | GACATCCAGATGACCCAGTCTCCATCCTCCCT GTCTGCATCTGTAGGAGACAGAGTCACCATCA CTTGCCGGGCAAGTCAGAGCATTAGCGACTAT TTAAATTGGTATCAGCAGAAACCAGGGAAAG CCCCTAAGGTCCTGATCTATACTACATCCAGTT TGCAAAGTGGGGTCCCATCAAGGTTCAGTGGC AGTGGATCTGGGACAGATTTCACTCTCACCAT CAGCAGTCTGCAGCCTGAAGATTTTGCAACTT ACTACTGTCAACAGAGTTTCAGTACCCCACT TTCGGCGGAGGGACCAAGGTGGAGATCAAA<br><br>SEQ ID NO: 26241 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCAAAACGGGTGACG GACTACGGTGGTAACGACTGGTTCGACCCCTGGG GCCAGGGAACCCTGGTCACCGTCTCCTCA<br><br>SEQ ID NO: 30247 |
| | | AA | DIQMTQSPSSLSASVGDRVTITCRASQSISDYLN WYQQKPGKAPKVLIYTTSSLQSGVPSRFSGSGSG TDFTLTISSLQPEDFATYYCQQSFSTPTFGGGTKV EIK<br><br>SEQ ID NO: 26242 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br><br>SEQ ID NO: 30248 |
| iPS:435421 | 21-225_151F1 | NA | GAAATGGTGATGACGCAGTCTCCAGCCACCCT GTCTGTGTCTCCAGGGGAAAGAGCCACCCTCT CCTGCAGGGCCAGTCAGAGTGTTAACATCAAT ATAGCCTGGTACCAGCAGAAAACCTGGCCAGGC TCCCAGGCTCCTCATCTATGTGCATCCACCA GGGCCACTGGTATCCCAGCCAGGTTCAGTGGC AGTGGGTCTGGGACAGTTCACTCTCACCAT CAGCAGCCTGCAGTCTGAAGATTTTGCAGTTT ATTACTGTCAGCAGCAGTATAATGACTGGCCTCCG TGGACGTTCGGCCAAGGGACCAAGGTGGAAA TCAAA<br><br>SEQ ID NO: 26243 | GAGGTGCAGCTGGTGGTGAGTCTGGGGGAGGCCTG GTCAAGCCTGGGGGGTCCTGAGACTCTCCTGTG CAGCCTCTGGATACACCTTCAGGAGCTTAGCAT GAACTGGGTCCGCCAGGCTCCAGGGAAGGGGCT GGAGTGGGTCTCATCCATTAGTAGTAGTAGTTAT TACCATTCCAGAGACAACGCAGCCAAGAACTACT GTATCTGCAAATGAACAGCCTGTGCGAGAGCCGAAGA CACGGCTGTGTATTATTGCAGAGATACACCA CTGGTTTACTGGGGCCAGGGAACCCTGGTCACCG TCTCCTCA<br><br>SEQ ID NO: 30249 |

FIGURE 50
(Continued)

| | | | |
|---|---|---|---|
| iPS:435423 | 21-225_151G5 | AA | EMVMTQSPATLSVSPGERVTLSCRASQSININIA WYQQKPGQAPRLLIYGASTRATGIPARFSGSGSG TEFTLTISSLQSEDFAVYYCQQYNDWPPWTFGQ GTKVEIK<br>SEQ ID NO: 26244 | EVQLVESGGGLVKPGGSLRLSCAASGYTFRSFSMN WVRQAPGKGLEWVSSISSSSYYIYYADSVKGRFTIS RDNAKNSLYLQMNSLRAEDTAVYYCARDTPLVY WGQGTLVTVSS<br>SEQ ID NO: 30250 |
| | | NA | GATATTGTGATGACCCAGACTCCACTCTCTCT GTCCGTCACCCCTGGACAGCCGGCCTCCATCT CCTGCAAGTCTAGTCAGCGCCTCCTGCATGGT GATGGAAAGAACCTATTTGTATTGGTACCTGCA GAAGCCAGGCCAGCCTCCACAGCTCCTGCTCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGGTTCCGTGGACGTTCGGCCAAGGGA CCAAGGTGGAAATCAAA<br>SEQ ID NO: 26245 | CAGGTGCAGCTGATGGAGTCTGGGGGAGGCGTG GTCCAGCCTGGGAGGTCCCTGAGACTCTCCTGTG CAGCGTCTGGATTCATCTTCAGTAGCTATGGCAT GCACTGGGTCCGCCAGGCTCCAGGCAAGGGGCT GGAGTGGGTGGCAATTATATGATGTATGAGAAGT AATAAATACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAGATGATA CGATTTTTGGAGTGGTCACTTGACTCTGGGGC CAGGGAACCCTGGTCACCGTCTCCTCA<br>SEQ ID NO: 30251 |
| | | AA | DIVMTQTPLSLSVTPGQPASISCKSSQRLLHGDG KTYLYWYLQKPGQPPQLLLYEVSNRFSGVPDRF SGSGSGTDFTLKISRVEAEDVGVYYCMQSIQVP WTFGQGTKVEIK<br>SEQ ID NO: 26246 | QVQLMESGGGVVQPGRSLRLSCAASGFIFSSYGMH WVRQAPGKGLEWVAIIWYDGSNKYYADSVKGRFT ISRDNSKNTLYLQMNSLRAEDTAVYYCARDRYDF WSGHFDYWGQGTLVTVSS<br>SEQ ID NO: 30252 |

FIGURE 50
(Continued)

| | | | |
|---|---|---|---|
| iPS:435425 | 21-225_151B12 | NA | GACATACAGATGACCCAGTCTCCATCCTCCT GTCTGCGTCTGTAGGAGACAGAGTCACCATCA CTTGCCGGGCAAGTCAGAGACAGATTCAGCAACTTT TTAAATTGGTATCAGCAGAAACCAGGGAAAG CCCCTAAGGTCCTGATCTATACTGCATCCAGTT TGGAAAGTGGGGTCCATCAAGGTTCAGTGGC AGTGAATCGGACAGATTCACTCTCACCAT CAGCAGTCTGCAACCTGAAGATTTTGCAACTT ACTACTGTCAACAGAGTTACAGTACCCCCACT TTCGGCGGAGGGACCAGGGTGGAGATCAAA<br><br>SEQ ID NO: 26247 | GAGGTGCAGCTGTTGGAGTCTGGGGGAGGCTTG GTACAGCCTGGGGGGTCCCTGAGACTCTCCTGT GCAGCCTCTGGATTCACCTTTAGCAGCTATGCCAT GAACTGGGTCCGCCAGGCTCCAGGGAAGGGCT GGAGTGGGTCTCAGTTATTAGTGGTAGTGGTAAA AACACATTCTACGCAGACTCCGTGAAGGGCCGGT TCACCATCTCCAGAGACAATTCCAAGAACACGT GTATCTGCAAATGAACAGCCTGAGAGCCGAGGA CACGGCCGTATATTACTGTGCGAAAGGGGTGACG GACTACGGTGTAACGACTGGTTCGACCCCTGGG GCCAGGGAACCCTGGTCACCGTCTCCTCA<br><br>SEQ ID NO: 30253 |
| | | AA | DIQMTQSPSSLSASVGDRVTITCRASQSISNFLNW YQQKPGKAPKVLIYTASSLESGVPSRFSGSESGT DFTLTISSLQPEDFATYYCQQSYSTPTFGGGTRV EIK<br><br>SEQ ID NO: 26248 | EVQLLESGGGLVQPGGSLRLSCAASGFTFSSYAMN WVRHAPGKGLEWVSAISGSGKNTFYADSVKGRFTI SRDNSKNTLYLQMNSLRAEDTAVYYCAKRVTDYG GNDWFDPWGQGTLVTVSS<br><br>SEQ ID NO: 30254 |
| iPS:435427 | 21-225_151C9 | NA | GACATCCAGATGACCCAGTCTCCATCCTCCACT GTCTGCTTCTGTAGGAGACAGAGTCACCATCA CTTGTCGGGCGAGTCAGGGCATTAGCAAGTAT TTAGCCTGGTTTCAGCAGAAACCAGGGAAAGC CCCTAAGTCTCTGATCTATGATGCATCCAGTT GCAAAGTGGGGTCCCATCAAAGTTCAGCGGCA GTGGATCTGGGACAGATTTCACTCTCACCATC AGCAGCCTGCAGCCAGAAGATATTTGCAACTTA TTACTGTCCATCAGTATAAACATTACCCGATCA CCTTCGGCCAAGGGACACGACTGGAGATTAAA<br><br>SEQ ID NO: 26249 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATGATTC ACTATGGTTCGGGGAGCTAGAAGATGACTGGTTC GACCCCTGGGGCCAGGGAACCCTGGTCACCGTCT CCTCA<br><br>SEQ ID NO: 30255 |

FIGURE 50
(Continued)

| | | | |
|---|---|---|---|
| iPS:435429 | 21-225_151A10 | AA | DIQMTQSPSSLSASVGDRVTITCRASQGISKYLA WFQQKPGKAPKSLIYDASRLQSGVPSKFSGSGSG TDFTLTISSLQPEDFASYYCHQYKHYPITFGQGT RLEIK<br>SEQ ID NO: 26250 | QVQLVESGGGVVQPGRSLRLSCAASGFTFSSYGMH WVRQAPGKGLEWVAVISYDGSNKYYADSVKGRFT ISRDNSKNTLYLQMNSLRAEDTAVYYCARGVLLW FGELEDDWFDPWGQGTLVTVSS<br>SEQ ID NO: 30256 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTATTGGTACCTACA GAAGCCAGGCCAGCCTCCACAGCTCCTGATCT ATGAAGTTTCCAACCGGGTTCTCTGGAGTGCCA GATAGGTTCAGTGGCAGCGGGTCAGGGACAG ATTTCACACTGAAAATCAGCCGGGTGGAGGCT GAGGATGTTGGGGTTATTACTGCATGCAAAG TATACAGATTCCGTGGACGTTCGGCCAAGGGA CCAAGGTGGAAATCAAA<br>SEQ ID NO: 26251 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTTGCAATTATATCGACTCCAGGAAGT AATAAATACTATGCAGACTCCGTGAAGGGCCGA TTCACCATCTCCAGAGACAACAATTCCAAGAACACGC TGTATCTACAAATGAACAGCCTGAGAGCCGAGG ACACGGCTGTGTATTACTGTGCGAGAGATCATTA CGATTTTGGAGTGGTCACTTGACTACTGGGGC CAGGGAACCCTGGTCACCGTCTCCTCA<br>SEQ ID NO: 30257 |
| | | AA | DIVMTQTPLSLSVTPGQPASISCKSSQSLLHGDG KTYLYWYLQKPGQPPQLLIYEVSHRFSGVPDRFS GSGSGTDFTLKISRVEAEDVGVYYCMQSIQIPWT FGQGTKVEIK<br>SEQ ID NO: 26252 | QVQLVESGGGVVQPGRSLRLSCAASGFTFSNYGM HWVRQAPGKGLEWLAIIWYDGSNKYYADSVKGRF TISRDNSKNTLYLQMNSLRAEDTAVYYCARDHYDF WSGHFDYWGQGTLVTVSS<br>SEQ ID NO: 30258 |

FIGURE 50
(Continued)

| | | | |
|---|---|---|---|
| iPS:435431 | 21-225_152D2 | NA | GACATCCAGATGACCCTGTCTCCATCTCCCT GTCTGCATCTGTAGGAGACAGAGTCACCATCA CTTGCCGGGCAAGTCAGAGCATTAGCGACTAT TTAAATTGGTATCAGCTGAAACCAGGAAAGC CCCTAAGGTCTGATCTATACTACATCCAGTTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTTCTGTCAACAGAGTTACAGTACCCCACTTT CGGCGGAGGGACCAAGGTGGAGATCAAA |
| | | | SEQ ID NO: 26253 |
| | | AA | DIQMTLSPSSLSASVGDRVTITCRASQSISDYLN WYQLKPGKAPKVLIYTTSSLQSGVPSRFSGSGSG TDFTLTISSLQPEDFATYFCQQSYSTPFGGGTKV EIK |
| | | | SEQ ID NO: 26254 |
| | | NA | GAGGTGCAGCTGTTGGAGTCTGGGGGAGGCTTG GTACAGCCTGGGGGGTCCCTGAGACTCTCCTGT GCAGCCTCTGGATTCACCTTTAGCAGCTATGCCAT GAGCTGGGTCCGCCAGGCTCCAGGGAAGGGCT GGAGTGGGTCTCAGCTATTAGTGGTCGTGGTGGT AACACATTCTACGCAGACTCCGTGAAGGGCCGGT TCACCATCTCCAGAGACAACATTCCAAGAAACACT ATATCTGCAAATGAACAGCCTGAGAGCCGAGGA CACGGCCGTATATTACTGTGCGAAACGGGTGACG GACTACGGTGTAACGACTGGTTTGACCCCCTGGG GCCAGGGAACCCTGGTCACCGTCTCCTCA |
| | | | SEQ ID NO: 30259 |
| iPS:435433 | 21-225_152E3 | AA | EVQLLESGGGLVQPGGSLRLSCAASGFTFSSYAMS WVRQAPGKGLEWVSAISGRGGNTFYADSVKGRFTI SRDNSKKTLYLQMNSLRAEDTAVYYCAKRVTDYG GNDWFDPWGQGTLVTVSS |
| | | | SEQ ID NO: 30260 |
| | | NA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGAGTAGCAGT GGCTGGTACTTTTTGACTACTGGGGCCAGGGAA CCCTGGTCACCGTCTCCTCA |
| | | | SEQ ID NO: 30261 |

FIGURE 50
(Continued)

| | | | | |
|---|---|---|---|---|
| iPS:435435 | 21-225_152H3 | AA | DIVMTQSPDSLAVSLGERATINCKSSQSVLHSSN NYNYLVWYQQKPGQSPKRLIYWASTRESGVPD RFSGSGSGTDFSLTISSLQAEDVAVYYCQQYYST PFTFGPGTKVDIK<br><br>SEQ ID NO: 26256 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCASSSGW YFFDYWGQGTLVTVSS<br><br>SEQ ID NO: 30262 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTGCACAGC TCCAACAATTACAACTACTTAACTTGGTACCA GCAGAAACCAGGACAGCCTCCTAAACTGCTCA TTTACTGGGCATCTCACCCGGAAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAAGCTGGAGATCAAA<br><br>SEQ ID NO: 26257 | CAGGTGCAGCTGGTGCAGTCTGGGGCTGAGGTG AAGAAGCCTGGGGCTCAGTGAAGGTCTCCTGC AAGGCTTCTGGATACACCTTCCCAATTATGATA TCAACTGGGTGCGACAGGCCACTGGACAAGCC TTGAGTGGATGGGATGGATGCACAGAAGTTCCAGGGCAG TAACACAGGCTATGCACAGAACACTTCATAAGCAC AGTCACCATGACCAGGAACACTCCATAAGCAC AGCCTACATGGAGCTGAGCAGCCTGAGATCTGA GGACACGGCCGTGTATTACTGTGCATATAGCAGT GGCTGGTACTGGTTTGACTACTGGGGCCAGGGAA CCCTGGTCACCGTCTCCTCA<br><br>SEQ ID NO: 30263 |
| | | AA | DIVMTQSPDSLAVSLGEKATINCKSSQSVLHSSN NYNYLTWYQQKPGQPPKLLIYWASTRKSGVPD RFSGSGSGTDFTLTISSLQAEDVAVYYCQQYYST PCSFGQGTKLEIK<br><br>SEQ ID NO: 26258 | QVQLVQSGAEVKKPGASVKVSCKASGYTFPNYDIN WVRQATGQGLEWMGWMHPNSGNTGYAQKFQGR VTMTRNTSISTAYMELSSLRSEDTAVYYCAYSSGW YWFDYWGQGTLVTVSS<br><br>SEQ ID NO: 30264 |

FIGURE 50
(Continued)

| | | | |
|---|---|---|---|
| iPS:435437 | 21-225_152F4 | NA | GACATCGTGATGACCCAGTCTCCAGACTCCCT GGCTGTGTCTCTGGGGGAGAGGGCCACCATCA ACTGCAAGTCCAGCCAGAGTGTTTTATACAGC TCCAACAATTACAAGAAGTACTTAGCTTGGTACCA GCAGAAACCAGGGCAGCCTCCTAAACTGCTCA TTTACTGGGCATCTACCCGGAAATCCGGGGTC CCTGACCGATTCAGTGGCAGCGGGTCTGGGAC AGATTTCACTCTCACCGTCAGCAGCCTGCAGG CTGAAGATGTGGCAGTTTATTACTGTCAGCAA TATTTTAATACTCCTCCACTTTCGGCCCCTGGG ACCAAAGTGGATATCAAA<br><br>SEQ ID NO: 26259 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA CGACACGGCCGTGTATTACTGTGCGTATAGCAGT GGCTGGTACTGGTTCGACCCCTGGGGCCAGGA ACCCTGGTCACCGTCCTCTCA<br><br>SEQ ID NO: 30265 |
| | | AA | DIVMTQSPDSLAVSLGERATINCKSSQSVLYSSN NYNYLAWYQQKPGQPPKLLIYWASTRKSGVPD RFSGSGSGTDFTLTVSSLQAEDVAVYYCQQYFN TPPTFGPGTKVDIK<br><br>SEQ ID NO: 26260 | QVQLVQSGAEVKKPGASVKVSCKASGYTFTNYDIN WVRQATGQGLEWMGWMHPNSGNTGYAQKFQGR VTMTRNTSISTAYMELSSLRSDDTAVYYCAYSSGW YWFDPWGQGTLVTVSS<br><br>SEQ ID NO: 30266 |
| iPS:435439 | 21-225_152G4 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAAAAACCAGGGAAAG CCCCTAAGGTCCTGATCTATATCTAGAGGTTCAGTGGC TGCAAAGTGGGGTCCCATCAAGGTTCAGTGGCAGCTTCACTCTCAAC AGTGGATCTGGGACAGATTTCACTCTCAC CAGCAGTCTGCAACAGAGTTACAGTACCCCACT TCGGCGGAGGGACCAAGGTGGAGATCAAA<br><br>SEQ ID NO: 26261 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTAGTGTCGTGGTGTGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGTAACGACTGGTTCGACCCCTGGG GCCAGGGAACCCTGGTCACCGTCTCCTCA<br><br>SEQ ID NO: 30267 |

FIGURE 50
(Continued)

| | | | |
|---|---|---|---|
| iPS:435441 | 21-225_152F6 | AA | DIQMTQSPSSLSASVGDRVTITCRASQSISDYLN WYQQKPGKAPKVLIYTSSLQSGVPSRFSGSGSG TDFTLTISSLQPEDFATYFCQQSYSTPTFGGGTKV EIK<br>SEQ ID NO: 26262 | EVQLLESGGGLVQPGGSLRLSCAASGFTFSSYAMS WVRQAPGKGLEWVSAISGRGNTFYADSVKGRFTI SRDNSKNTLYLQMNSLRAEDTAVYYCAKRVTDYG GNDWFDPWGQGTLVTVSS<br>SEQ ID NO: 30268 |
| | | NA | GATATTGTGATGACCCAGACTCCACTCTCTCT GTCCGTCACCCCTGGACAGCCGGCCTCCATCT CCTGCAAGTCTAGTTGCAGAGCCTCCGGCATGGT GATGGAAAGACCTATTTGACTTGGTACCTACA GAGGCCAGGCCAGGCCTCCACAGGTCCTGATCC ATGAAATTTCCAAGCGGTTCACTGGAGTGCCA GATAGGTTCAGTGGCAGCGGGTCAGGACAG ATTTCACACTGAACATCAGCCGGGTGGAGGCT GAGGATGTTGGCTTTTATTACTGCATGCAAAG TATACAGGTTCCGTGGACGTTCGGCCAAGGGA CCAAGGTGGAAATCAAA<br>SEQ ID NO: 26263 | CAGGTGCAGCTGTGGTGGAGTCTGGGGGAGGCGTG GTCCAGCCTGGGAGGTCCCTGAGACTCTCCTGTG CAGCGTCTGGATTCACCTTCAGTAGTATGGCAT GCACTGGGTCCGCCAGGCTCCAGGCAAGGGGCT GGAGTGGGTGGCAATTATATGTATGATGGAAGT TATAAATACTATGCAGACTCCGTGAAGGGCCGAT TCACCATCTCCAGAGACAATTCCAAGAATACGCT GTATCTGCAAATGAACAGCTGAGAGCCGAGGA CACGGCTGTGTATTACTGTGCGAGAGAGGGTAC GATTTTTGGAGTGGTTACCTTGGCTACTGGGGCC AGGGAACCCTGGTCACCGTCTCCTCA<br>SEQ ID NO: 30269 |
| | | AA | DIVMTQTPLSLSVTPGQPASISCKSSQSLRHGDG KTYLTWYLQRPGQPPQVLIHEISKRFTGVPDRFS GSGSGTDFTLNISRVEAEDVGFYYCMQSIQVPW TFGQGTKVEIK<br>SEQ ID NO: 26264 | QVQLVESGGGVVQPGRSLRLSCAASGFTFSSYGMH WVRQAPGKGLEWVAIIWYDGSYKYYADSVKGRFT ISRDNSKNTLYLQMNSLRAEDTAVYYCAREGYDF WSGYLGYWGQGTLVTVSS<br>SEQ ID NO: 30270 |

FIGURE 50
(Continued)

| | | | |
|---|---|---|---|
| iPS:435443 | 21-225_152E7 | NA | GAAATTGTGTTGACGCAGTCTCCAGGCACCCT GTCTTTGTTTCCAGGGGAAAGAGCCACCCTCT CCTGCAGGGCCAGTCAGAGTGTTATCAGCAGC TACTTAGCCTGGTACCAGCAGAAACCTGGCCA GGCTCCCAGGCTCCTCATCTTTGGTGTATCTAG TAGGGCCACTGGCATCCCAGACAGACTTCAGT GCAGTGGGTCTGGGACAGACTTCACTCTCACC ATCAGCAGACTGGAGCCTGAAGATTTTGCAGT GTATTACTGTCAACAATATGGTAGGTCACCAT TCAATTTCGGCCCCTGGGACCAAAGTGGATATC AAA<br>SEQ ID NO: 26265 | CAGGTGCAGCTGCAGGAGTCGGGCCCAGGACTG GTGAAGCCTTCACAGACCCTGTCCCTCAATTGCA CTGTCTCTGGTGGCTCCATCAGCAGCAGTGGTTA CTACTGGAGCTGGATCCGCCAGCACCCAGGCAA GGGCCTGGAATGGATTGGGTACAGTTATTACAGT GGGAGCACTTACTACAACCCGTCCCTCAAGAGTC GAATTACCATATCAGTAGACACGTCTAACAACCA GTTCTCCCTGAACCTGAGCTCTGTGACTGCCGCG GACACGGCCGTGTATTACTGTGCGAGAGGGGA TATAACTGGAACCATGCTTTTGATATCTGGGGCC AAGGGACAATGGTCACCGTCTCTTCA<br>SEQ ID NO: 30271 |
| | | AA | EIVLTQSPGTLSLFPGERATLSCRASQSVISSYLA WYQQKPGQAPRLLIFGVSSRATGIPDRFSGSGSG TDFTLTISRLEPEDFAVYYCQQYGRSPFNFGPGT KVDIK<br>SEQ ID NO: 26266 | QVQLQESGPGLVKPSQTLSLNCTVSGGSISNSGYY WSWIRQHPGKGLEWIGYSYYSGSTYYNPSLKSRITI SVDTSNNQFSLNLSSVTAADTAVYYCARGGYNWN HAFDIWGQGTMVTVSS<br>SEQ ID NO: 30272 |
| iPS:435445 | 21-225_152F7 | NA | GACATCCAGATGACCCAGTCTCCATCCTCCCT GTCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGATTCACTCTCACAA TCAGCAGCCTACAGCCTGAAGATTTTGCAACT TATTACTGTCTACAGCATTATAATTCCCGTAC AGTTTTGGCCAGGGGACCAAGCTGGAGATCAA A<br>SEQ ID NO: 26267 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTCAT GCACTGGGTCCGCCAGGCTCCAGGCAAGGGCT GGAGTGGGTGGCAGTTATATGCAGACTCCGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTGCGAGAGAGGAGTA TAGCAGCAGCTGGTACGGGTACGGTATGGACGT CTGGGGCCAAGGGACCACGGTCACCGTCTCCTCA<br>SEQ ID NO: 30273 |

FIGURE 50
(Continued)

| | | | |
|---|---|---|---|
| iPS:435447 | 21-225_152H7 | AA | DIQMTQSPSSLSASVGDRVTITCRASQGIRNDLG WYQQKPGKAPKRLIYATSSLQSGVPSRFSGSGSG TEFTLTISSLQPEDFATYYCLQHYNFPYSFGQGT KLEIK<br>SEQ ID NO: 26268 | QVQLVESGGGVVQPGRSLRLSCAASGFTFSSYIMH WVRQAPGKGLEWVAVIWYDGSNKYYADSVKGRF TISRDNSKNTLYLQMNSLRAEDTAVYYCAREEYSS SWYGYGMDVWGQGTTVTVSS<br>SEQ ID NO: 30274 |
| | | NA | GACATCCAGATGACCCAGTCTCCAGCTTCCGT GTCTGCATCTGTGGGAGACAGAGTCACCATAA CTTGTCGGGCGAGTCAGGATCAGATATTAGCAACTGG TTAGCCTGGTATCAGCAGAAACCAGGGAAAG CCCCTAAACTCCTGATCTATGCTGCATCCAGTT TGCAAGGTGGGGTCCCATCAAGGTTCAGCGGC AGTGGATCTGGGACAGATTTCACTCTCTCCAT CAGCAGCCTGCAGCCTGAAGATTTTGCAACTT ACTATTGTCAACAGACTGACAGTTTCCCATTC ACTTTCGGCCCTGGGACCAAAGTGGATATCAA A<br>SEQ ID NO: 26269 | GAGGTGCAGCTGTTGGAGTCTGGGGGAGGCTTG GTACAGCCTGGGGGGTCCCTGAGACTCTCCTGTG CAGCCTCTGGATTCACCTTTAACAGCTATGCCAT GAACTGGGTCCGCCAGGCTCCAGGGAAGGGGCT GGAGTGGGTCTCAGTATTAGTGGTAGTGGTGGT AACACATTCTACGCAGACTCCGTGAAGGGCCGT TCACCATCTCCAGAGACAATCCAAGAACACACT GTATCTGCAAATGAACAGCCTGAGAGCCGAGGA CACGGCCGTATATTACTGTGCGAAAAAGGATAAT GATTACGTTTGGGGAGTCCTTACTTTGACTACT GGGGCCAGGGAACCCTGGTCACCGTCTCCTCA<br>SEQ ID NO: 30275 |
| | | AA | DIQMTQSPASVSASVGDRVTITCRASQDISNWLA WYQQKPGKAPKLLIYAASSLQGGVPSRFSGSGS GTDFTLSISTLQPEDFATYYCQQTDSFPFTFGPGT KVDIK<br>SEQ ID NO: 26270 | EVQLLESGGGLVQPGGSLRLSCAASGFTFNSYAMN WVRQAPGKGLEWVSAISGSGGNTFYADSVKGRFTI SRDNSKNTLYLQMNSLRAEDTAVYYCAKKDNDYV WGSPYFDYWGQGTLVTVSS<br>SEQ ID NO: 30276 |

FIGURE 50
(Continued)

| | | | |
|---|---|---|---|
| iPS:435449 | 21-225_152H9 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATCGTGCATCCAGT TTGCAAAGTGGGGTCCCATCAAGGTTCACCGG CAGTGGATCTGGGACAGAATTCACTTTCACAA TCAGCAGCCTGCAGCCTGAAGATTTTGCAACT TATTACTGTCTACAGCATAGTAATTACCCGCTC ACTTTCGGCGGAGGGACCAAGGTGGAGATCA AA<br>SEQ ID NO: 26271 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGGCTGGAGTGGATTGGGAGTATCTATTATAGT GGGAGCGCCTCCTACAACCCGTCCCTCAAGAGTC GAGTCACCATATCCGTAGACACGTCCAAGAACC AGTTCTCCCTGAAGCTGAGCTCTGTGACCGCGC AGACACGGCTGTGTTTACTGTGCGAGACTTGAT CTCCAGTGGAGTTTTGACTTCTGGGGCCAGGGAA CCCTGGTCACCGTCCTCA<br>SEQ ID NO: 30277 |
| | | AA | QLQLQESGPGLVKPSETLSLTCTVSGGSISRSSYYW GWIRQPPGKGLEWIGSIYYSGSASYNPSLKSRVTIS VDTSKNQFSLKLSSVTAADTAVFYCARLDLQWSFD FWGQGTLVTVSS<br>SEQ ID NO: 30278 |
| | | | DIQMTQSPSSLSASVGDRVTITCRASQGIRNDLG WYQQKPGKAPKRLIYAASSLQSGVPSRFTGSGS GTEFTFTISSLQPEDFATYYCLQHSNYPLTFGGGT KVEIK<br>SEQ ID NO: 26272 | |
| iPS:435451 | 21-225_152D10 | NA | GGCATCGTGATGACCCAGTCTCCAGACTCCT GGCTGTGTCTCTGGGCGCGAGGGCCACCATCG ACTGCAAGTCCAGCCAGAGTGTTTTATACAGC TCCAACAATAAGAACTACTTAGCTTGGTACCA GCAGAAACCAGGACAGCCTCCTAAGTTGCTCA TTTACTGGGCATCTACCCGGGAATCCGGGGTC CCTGACCGATTCAGTGGCAGCGGATCTGGGAC AGATTTCACTCTCACCATCTACAGCCTGCAGG CTGAAGATGTGGCAGTTTATTACTGTCAGCAA TATTATCGTAGTCCTAGTTTGGCCAGGGGAC CAAGCTGGAGATCAAA<br>SEQ ID NO: 26273 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCGCCGGGAAGGACT GGAGTGGATTGGGCGTATCGATACCAGTGGGATC ACCAACTACAACCCCTCCCTCAAGAGTCGAGTCA CCATGTCAGTGGACACGTCAAGAACCAGTTCTC CCTGAAGCTGACCTCTGTGACCGCCGCGGACACG GCCGTGTATTACTGTGCGAGAGAGGGGGATTG GGAGCTACCTTCTTTGACTACTGGGGCCAGGGAA CCCTGGTCACCGTCTCCTCA<br>SEQ ID NO: 30279 |

FIGURE 50
(Continued)

| | | | |
|---|---|---|---|
| iPS:435453 | 21-225_152G10 | AA | GIVMTQSPDSLAVSLGARATIDCKSSQSVLYSSN NKNYLAWYQQKPGQPPKLLIYSLQAEDVAVYCQQYYR SPSFGQGTKLEIK<br>SEQ ID NO: 26274 | QVQLQESGPGLVKPSETLSLTCTVSGGSISNYYWS WIRQPAGKGLEWIGRIDTSGITNYNPSLKSRVTMSV DTSKNQFSLKLTSVTAADTAVYYCAREGGLGATFF DYWGQGTLVTVSS<br>SEQ ID NO: 30280 |
| | | NA | GACATCCAGATGACCCAGTCTCCAGCTTCCGT GTCTGCATCTGTAGGAGACAGAGTCACCATAA CTTGTCGGGCGAGTCAGGGTATTAGCAACTGG TTAGCCTGGTATCAGCAGAAACCAGGGAAAG CCCCTAAGCTCCTGATCTGCTGCATCCAGTT TGCAAAGTGGGGTCCCATCAAGGTTCAGCGGC AATGAATCTGGGACAGATTTCACTCTCTCCAT CAGCAGCCTGCAGCCTGAAGATTTTGCAACTT ACTATTGTCAACAGACTGACAGTTTCCCATTC ACTTTCGGCCCTGGGACCAAAGTGGATGTCAA A<br>SEQ ID NO: 26275 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTATTAGTGGTCGTGGTGGT AACACATTCTACGCAGACTCCGTGAAGGGCCGCT TCACCATCTCCAGAGACAATTCCAAGAACACGCT CTATCTGCAAATGAACAGCCTGAGAGCCGAGGA CACGGCCGTATATTACTGTGCGAAAAAGGATTAT GATTACGTTTGGGGGAGTCCTTACTTTGACTACT GGGGCCAGGGAACCCTGGTCACCGTCTCCTCA<br>SEQ ID NO: 30281 |
| | | AA | DIQMTQSPASVSASVGDRVTITCRASQGISNWLA WYQQKPGKAPKLLISAASSLQSGVPSRFSGNESG TDFTLSISSLQPEDFATYYCQQTDSFPFTFGPGTK VDVK<br>SEQ ID NO: 26276 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKKDYDYV WGSPYFDYWGQGTLVTVSS<br>SEQ ID NO: 30282 |

FIGURE 50
(Continued)

| | | | | |
|---|---|---|---|---|
| iPS:435455 | 21-225_152B11 | NA | GACATCCAGATGACCCAGTCTCCATCCTCCCT GTCTGCATCTGTAGGAGACAGAGTCACCATCA CTTGCCGGGCAAGTCAGAGCATTAGCGACTAT TTAAATTGGTATCAGCAGAAACCAGGGAAAG CCCCTAAGGTCCTGATCTATACTACATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTTCTGTCAACAGAGTTACAGTACCCCCACT TTCGGCGGAGGGACCAAGGTGGAGATCAAA<br><br>SEQ ID NO: 26277 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAACTGGGTCCGCCAGGCTCCAGGGAAGGGCT GGAGTGGGTCTCAGCTATTAGTAGTGGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGGTGTAACGACTGGTTCGACCCCTGGG GCCAGGGAACCCTGGTCACCGTCTCCTCA<br><br>SEQ ID NO: 30283 |
| | | AA | | EVQLLESGGGLVQPGGSLRLSCAASGFTFSSYAMN WVRQAPGKGLEWVSAISGRGGNTFYADSVKGRFTI SRDNSKNTLYLQMNSLRAEDTAVYYCAKRVTDYG GNDWFDPWGQGTLVTVSS<br><br>SEQ ID NO: 30284 |
| iPS:435457 | 21-225_152C11 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTATATTGGTACCTGCA GAAGCCAGGCCAGCCTCCACAGATCTCTGATCT ATGAAGTTTCCAACCGGTTCTCTGGAGTGCCA GATAGGTTCAGTGGCAGCGGGTCAGGGACAG ATTTCACACTGAAACATCAGCGGGTGGAGGCT GAGGATGTTGGGGTTTATTACTGCATGCAAAGG TATACAGATTCCGTGGACGTTCGGCCAAGGGA CCAAGGTGGACATCAAA<br><br>SEQ ID NO: 26279 | CAGGTACAACTGGTGGAGTCTGGGGGAGGCGTG GTCCAGCCTGGGAGGTCCCTGAGACTCTCCTGTG CAGCGTCTGGATTCACCTTCCGTAACTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAGCTTA CGATTTTTGGAGTGGTTATTTGACTACTGGGGC CAGGGAATTCTGGTCACCGTCTCCTCA<br><br>SEQ ID NO: 30285 |

FIGURE 50
(Continued)

| | | | |
|---|---|---|---|
| iPS:435459 | 21-225_152E12 | AA | DIVMTQAPLSLSVTPGQPASISCKSSQSLLHGDGKTYLYWYLQKPGQPPQILIYEVSNRFSGVPDRFSGSGSGTDFTLNISRVEAEDFGFYYCMQSIQIPWTFGQGTKVDIK<br>SEQ ID NO: 26280 | QVQLVESGGGVVQPGRSLRLSCAASGFTFRNYGMHWVRQAPGKGLEWVAIIWYDGSNKYYADSVKGRFTISRDNSKNTLYLQMNSLRAEDTAVYYCAREAYDFWSGYFDYWGQGILVTVSS<br>SEQ ID NO: 30286 |
| | | NA | GCCGTCGTGATGACCCAGTCTCCAGACTCCCTGGCTGTGTCTCTGGGCGAGAGGGCCACCATCAACTGCAAGTCCAGCCAGAGTATTTACACAGCTCCAATAATTACAACTACTTAGTTGGTACCAGCAGAAACCAGGACAGCCTCCTAAATTGCTCATTTACTGGCATCTCACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAACAATATTATAGTGGTCCGTGCAGTTTTTGGCCAGGGGACCAAGCTGGAGATCAAA<br>SEQ ID NO: 26281 | CAGGTGCAGCTGGTGCAGTCTGGGGCTGAGGTGAAGAAGCCTGGGGCCTCAGTGAAGGTCTCTGCAAGGCTTCTGGATACACCTTCACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGGCAGAGTCACCATGACCAGGAACACCTCCATAAGCAGCCTACATGGAGCTGAGCAGCCTGAGATCTGAGGACACGGCCGTGTACTATTACTGTGCTTATAGCAGTGGCTGGTACTACTTTGACTACTGGGGCCAGGGAACCCTGGTCACCGTCCTCCTCA<br>SEQ ID NO: 30287 |
| | | AA | AVVMTQSPDSLAVSLGERATINCTSSQSILHSSNNYNYLAWYQQKPGQPPKLLIYWASTRESGVPDRFSGSGSGTDFTLTISSLQAEDVAVYYCQQYYSGPCSFGQGTKLEIK<br>SEQ ID NO: 26282 | QVQLVQSGAEVKKPGASVKVSCKASGYTFTFNYDINWVRQATGQGLEWMGWMNPNSGNTGYAQKFQGRVTMTRNTSISTAYMELSSLRSEDTAVYYCAYSSGWYYFDYWGQGTLVTVSS<br>SEQ ID NO: 30288 |

FIGURE 50
(Continued)

| | | | |
|---|---|---|---|
| iPS:435461 | 21-225_153A1 | NA | GACATCAGATGACCCAGTCTCCATCCTCACT GTCTGCATCTGTAGGAGACAGAGTCACCATCA CTTGTCGGGCGAGTCAGGTCATTAGCAATTAT TTAGCCTGGTTTCAGCAGAAACCAGGGAAAGC CCCTAAGTCCCTGATCTCTGCTGCATCCAGTTT GCGAAGTGGGGTCCCATCAAACTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATTTCAAA |
| | | | SEQ ID NO: 26283 |
| | | AA | DIQMTQSPSSLSASVGDRVTITCRASQVISNYLA WFQQKPGKAPKSLISAASSLRSGVPSNFSGSGSG TDFTLTISSLQPEDFATYYCQQYHSYPFTFGPGT KVDFK |
| | | | SEQ ID NO: 26284 |
| | | | GAGGTGCAGCTGTGTTGGAGTCTGGGGGAGGCTTG GTACAGCCTGGGGGGTCCCTGAGACTCTCCTGTG CAGCCTCTGGATTCAGCTTTAGCAGCTATGTCAT GAGTTGGGTCCGCCAGGTCCAGGGAAGGGGCT GGAGTGGGTCTCAGTATTAGTGGAAGTGGTGAT AGAACATACTACGCAGACTCCGTGAAGGGCCGG TTCACCATCTCCAGAGACAATTCCAAGAACACGC TGTACCTGCAAATGAACAGCCTGAGAGCCGAGG ACACGGCCGTATATTACTGTGCGCGTACGGCGAC TAAGGACTACTGGGGCCAGGGAACCCTGGTCAC CGTCTCCTCA |
| | | | SEQ ID NO: 30289 |
| iPS:435463 | 21-225_153D2 | AA | EVQLLESGGGLVQPGGSLRLSCAASGFSFSSYVMS WVRQGPGKGLEWVSAISGSGDRTYYADSVKGRFTI SRDNSKNTLYLQMNSLRAEDTAVYYCARTATKDY WGQGTLVTVSS |
| | | | SEQ ID NO: 30290 |
| | | NA | GATATTGTGATGACCCAGACTCCACTCTCT GTCCGGTCACCCTGGACAGCCGGCCTCCATCT CCTGCAAGTCTAGTCAGAGCCTCCTGCATGGT GATGGAAAGAACCTATTTGACTTGGTACCTACA GAGGCCAGGCCAGCCTCCACAGGTCCTGATCC ATGAAGTTTCAAGCGGTTCACTGGAGTGCCA GATAGGTTCAGTGGCAGCGGGTCAGGACAG ATTTCACACTGAAACATCAGCGGGTGGAGGCT GAGGATGTTGGGGTTTTATTACTGCATGCAAAG TATACAGGTTCCGTGGACGTTCGGCCAAGGGA CCAAGGTGGAAATCAAA |
| | | | SEQ ID NO: 26285 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCAATTATATATGGTATGGAAGT TATAAATACTATGCAGACTCCGTGAAGGGCCGAT TCACCATCTCCAGAGACAATTCCAAGAACAGCGGT GTATCTGCAAATGAACAGCCTGAGAGCCGAGGA CACGGCTGTATATTACTGTGCGAGAGAGGGGTAC GATTTTTGAGTGGTTACTTGGTCTGCTACTGGGGCC AGGGAACCCTGGTCACCGTCTCCTCA |
| | | | SEQ ID NO: 30291 |

FIGURE 50
(Continued)

| | | | |
|---|---|---|---|
| | | AA | DIVMTQTPLSLSVTPGQPASISCKSSQSLRHGDGKTYLTWYLQRPGQPPQVLIHEVSKRFTGVPDRFSGSGSGTDFTLNISRVEAEDVGFYYCMQSIQVPWTFGQGTKVEIK<br>SEQ ID NO: 26286 | QVQLVESGGGVVQPGRSLRLSCAASGFTFSSYGMHWVRQAPGKGLEWVAIIWYDGSYKYYADSVKGRFTISRDNSKNTVYLQMNSLRAEDTAVYYCAREGYDFWSGYLGYWGQGTLVTVSS<br>SEQ ID NO: 30292 |
| iPS:435465 | 21-225_153A6 | NA | GAAATTGTGTTGACGCAGTCTCCAGGCACCCTGTCTTTGTTTCCAGGGGAAAGAGCCCCTCTCCTGCAGGGCCAGTCAGAGTGTTATCAGCAGCTACTTAGCCTGGTACCAGCAGAAACCTGGCCAGGCTCCCAGGCTCCTCATCTTTGGTGTATCTAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAACAATATGGTAGGTCACCATTCAATTTCGGCCCCTGGGACCAAAGTGGATATCAAA<br>SEQ ID NO: 26287 | CAGGTGCAGCTGCAGGAGTCGGGCCAGGACTGGTGAAGCCTTCACAGACCCTGTCCCTCAATTGCACTGTCTCTGGTGGCTCCATCAGCAGCAGTGGTTACTACTGGAGCTGGATCCGCCAGCACCCAGGGAAGGGCCTGGAATGGATTGGGTACAGTATTACAGTGGGAGCACCTACTACAACCCGTCCCTCAAGAGTCGAATTACCATATCAGTAGACACGTCTAACAACCAGTTCTCCCTGAACCTGAGCTCTGTGACTGCCGCGGACACGGCCGTGTATTACTGTGCGAGAGGGGATATAACTGGAACCATGCTTTTGATATCTGGGCCAAGGGACAATGGTCACCGTCTCCTCA<br>SEQ ID NO: 30293 |
| | | AA | EIVLTQSPGTLSLFPGERAPLSCRASQSVISSYLAWYQQKPGQAPRLLIFGVSSRATGIPDRFSGSGSGTDFTLTISRLEPEDFAVYYCQQYGRSPFNFGPGTKVDIK<br>SEQ ID NO: 26288 | QVQLQESGPGLVKPSQTLSLNCTVSGGSISNSGYYWSWIRQHPGKGLEWIGYSYYSGSTYYNPSLKSRITISVDTSNNQFSLNLSSVTAADTAVYYCARGGYNWNHAFDIWGQGTMVTVSS<br>SEQ ID NO: 30294 |

FIGURE 50
(Continued)

| | | | |
|---|---|---|---|
| iPS:435467 | 21-225_153B9 | NA | GGCATCGTGATGACCCAGTTTCCAGATTCCCT GGCTGTGTCTCTGGGCGAGAGGGCCACCATCA ACTGCAAGTCCAGCCAGAGTGTTTATACAGC TCCAACAATAAGAACTACTTAGCTTGGTACCA GCAGAAACCAGGACAGCCTCATAAGTTGCTCA TTTACTGGGCATCTACCCGGGAATTTGGGGTC CCTGACCGATTCAGTGGCAGCGGGTGTGGAC AGATTTCACTCTCACCATCTCACAGCGTGCAGG CTGAAGATGTGGCAGTTTATTACTGTCAGCAA TATAATCGTAGTCTTAGTTTTTGGCCAGGGGAC CAAGCTGGAGATCAAA | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCCCGGGAAGGACT GGAGTGGATTGGGCGTATCGATACCAGTGGATC ACCAACTACAACCCCTCCCTCAAGAGTCGAGTCA CCATGTCAGTGGACACGTCCAAGAACCAGTTCTC CCTGAAGCTGACCTCTGTGACCGCCGCGGACACG GCCGTGTATTACTGTGCGAGAGAGGGGAGTG GGAGCTACGTACTTGACTACTGGGGCCAGGGA ACCCTGGTCACCGTCTCCTCA |
| | | | SEQ ID NO: 30295 |
| | | AA | GIVMTQFPDSLAVSLGERATINCKSSQSVLYSSN NKNYLAWYQQKPGQPHKLLIYWASTREFGVPD RFSGSGCGTDFTLTIYSVQAEDVAVYYCQQYNR SLSFGQGTKLEIK | QVQLQESGPGLVKPSETLSLTCTVSGGSISSYYWSW IRQPAGKGLEWIGRIDTSGITNYNPSLKSRVTMSVD TSKNQFSLKLTSVTAADTAVYYCAREGGVGATYF DYWGQGTLVTVSS |
| | | | SEQ ID NO: 26289 | SEQ ID NO: 30296 |
| iPS:435469 | 21-225_153G9 | NA | GATATTGTGATGACCCAGACTCCCTCTCTG TCCGTCACCCCTGGACAGCCGGCCTCCATCTC CTGCAAGTCTAGTCAGAGCCTCCTGCATAGTG ATGGAAAGACCTATTTGTATTGGTACCTGCAG AAGCCAGGCCAGCCTCCACAGTTCCTGATCTA TGAAGTTCCAACCGGTTCTCTGGAGTGCCAG ATAGGTTCAGTGGCAGCGGGTCAGGGACAGA TTTCACACTGAAAATCAGCCGGGTGGAGGCTG ACGATGTTGGGGTTTATTACTGCATGCAAAAT ATAAAGTATCCGCTCACTTTCGGCGGAGGGAC CAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCACTTATATTCTATGATGGAAGT AATAAATACTATGCAGACTCCGTGAAGGGCCGA TTCACCATCTCCAGAGACAACGCCAAGAACACGC TGTATCTGCAAATAAACAGCCTGAGAGCCGAGG ACACGGCTGTGTATTTCTGTGCGCGACGCTATAG CCGCAGCTGGGCCGGGGTATGGACGTCTGGGG CCAAGGGACCGGGTCACCGTCTCCTCA |
| | | | SEQ ID NO: 26291 | SEQ ID NO: 30297 |

FIGURE 50
(Continued)

| | | | | |
|---|---|---|---|---|
| iPS:435471 | 21-225_153F11 | AA | DIVMTQTPFSLSVTPGQPASISCKSSQSLLHSDGK TYLYWYLQKPGQPPQFLIYEVSNRFSGVPDRFSG SGSGTDFTLKISRVEADDVGVYYCMQNIKYPLT FGGGTKVEIK<br>SEQ ID NO: 26292 | QVQLVESGGGVVQPGRSLRLSCAASGFTFSSYGMH WVRQAPGKGLEWVALIFYDGSNKYYADSVKGRFT ISRDNSKNTLYLQINSLRAEDTAVYFCARRYSRSW AGGMDVWGQGTAVTVSS<br>SEQ ID NO: 30298 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATTACAAGTACTTAGCTTGGTACCA GCAGAAACCAGGACAGCCTCCTAACCTGCTCA TTTACTGGGCATCTACCCGGGAAATCCGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCGTGCAGTTTTGGCCAGGG GACCAAGCTGGAGATCAAA<br>SEQ ID NO: 26293 | CAGGTGCAGCTGGTGCAGTCTGGGGCTGAGGTG AAGGAGCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAATACCTCCATAAACAC AGCCTACATGGAGCTGAGCAGCCTGAGATCTGA GGACACGGCCGTGTATTACTGTGCGTATAGCAGT GGCTGGTACTTCTTTGACAACTGGGGCCAGGAA CCCTGGTCACCGTCTCCTCA<br>SEQ ID NO: 30299 |
| | | AA | DIVMTQSPDSLAVSLGERATINCKSSQSVLYSSN NYKYLAWYQQKPGQPPNLLIYWASTRKSGVPD RFSGSGSGTDFTLTISSLQAEDVAVYYCQQYYST PCSFGQGTKLEIK<br>SEQ ID NO: 26294 | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YFFDNWGQGTLVTVSS<br>SEQ ID NO: 30300 |

FIGURE 50
(Continued)

| | | | | |
|---|---|---|---|---|
| iPS:435475 | 21-225_154H6 | NA | GACATCGTGATGACCCAGTCTCCAGACTCCCTGGCTGTGTCTCTGGGCGAGAGGGCCACCATCAACTGCAAGTCCAGCCAGAGTGTTTTACACAGTTCCAACAATTACAACTATTTAGCTGGTACCAGCAGAAACCAGGACAGCCTCCTAAGCTGCTCATTTACTGGACATCTACCCGGAAATCCGGGGTCCCTGACCGATTCAGTGGCAGCGGGTCTGGGACACATTTCACTCTCTCCATCAGCAGCCTGCAGGCTGAAGATGTGGCAGTTTATTACTGTCAGCATTATTATAGTACTCCGTCAGTTTTGGCCAGGGGACCAAGCTGGAGATCAAA<br/><br/>SEQ ID NO: 26295 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGCAGAGTCACATGGAGCTGAGCAGCCTGAGATCTGCAGCCTACATGGAGCTGAGCAGCCTGAGATCTGAGGACACGGCCGTGTATTACTGTGCGTATAGCAGTGGCTGGTACATCTTTGACTACTGGGGCCAGGGAACCCTGGTCACCGTCTCCTCA<br/><br/>SEQ ID NO: 30301 |
| | | AA | DIVMTQSPDSLAVSLGERATINCKSSQSVLHSSNNYNYLAWYQQKPGQPPKLLIYWTSTRKSGVPDRFSGSGSGTHFTLSISSLQAEDVAVYYCQHYYSTPCSFGQGTKLEIK<br/><br/>SEQ ID NO: 26296 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYIFDYWGQGTLVTVSS<br/><br/>SEQ ID NO: 30302 |
| iPS:435479 | 21-225_154E9 | NA | GACATTCAGATGACCCTGTCTCCATCCTCCGTGTATGCATTGTGTGGAGACAGAGTCACCATCACTTGTGTGGCGAGTCAGGATATTAGCAACTGGTTAGCCTGGTATCAGCAGAGACCAGGGAAAGCCCCTAAGGTCCTGATCTATGCTGCATCCAGTTTGCAAAGTGGGGTCCCATCAAGATTCAGCGGCAGTGGATCTGGGACAGATTTCACTCTCACCATCAGCAGCCTGCAGCCTGAAGATTTTGCAACTTACTATTGTCAACAGGGTAACAGTTTCCCGCTCACTTTCGGCGGAGGGACCAAGGTGGACATCAAA<br/><br/>SEQ ID NO: 26297 | GAGGTGAAGTTGTTGGAGTCTGGGGGAGGCTTGGTACAGCCGGGGGGGTCCCTGAGACTCTCCTGTGCAGCCTCTGGATTCACCTTTAGCAGTCAGTATGCCATGAGCTGGGTCCGCCAGGCTCCAGGGAAGGGGCTGGAGTGGGTCTCAGCTATTAGTGGTGGTGGTAACACATTCTACGCAGACTCCGTGAAGGGCCGGTTCACCATCTCCAGAGACAATTCCAAGAACACGCTGTTTCTGCAAATGAACAGCCTGAGAGCCGAGGACACGGCCGTATATTACTGTGCAAAAGGGGATTTCGATTTTTGGAGTGGTTGGGGGCTTTGACTACTGGGGCCAGGGAACCCTGGTCACCGTCTCCTCA<br/><br/>SEQ ID NO: 30303 |

FIGURE 50
(Continued)

| | | | |
|---|---|---|---|
| iPS:435481 | 21-225_154A11 | AA | DIQMTLSPSSVYASVGDRVTITCRASQDISNWLA WYQQRPGKAPKVLIYAASSLQSGVPSRFSGSGS GTDFTLTISSVQPEDFATYYCQQGNSFPLTFGGG TKVDIK<br>SEQ ID NO: 26298 | EVKLLESGGGLVQPGGSLRLSCAASGFTFSSYAMS WVRQAPGKGLEWVSAISGRGNTFYADSVKGRFTI SRDNSKNTLFLQMNSLRAEDTAVYYCAKRGFRFLE WLGGFDYWGQGTLVTVSS<br>SEQ ID NO: 30304 |
| | | NA | GACATCGTGATGACCCAGTCTCCAGACTCCCT GGCTGTGTCTCTGGGCGAGAGGGCCACCATCA ACTGCAGGTCAAGTCAGAGTGTTTTACACAGC TCCAACAATTATAACTACTTAGCTTGGTACCA GCAGAAACCAGGACAGCCTCCTAAGCTGCTCA TTTACTGGGCATCTAAACGGATTCCGGGGTC CCTGACCGATTCAGTGGCAGCGGGTCTGGGAC AGATTTCACTCTCACCATCAGCAGCCTGCAGG CTGAGGATGTGGCAGTTTATTACTGTCAGCAA TATTTTAGTTCTCCGGACGTTCGGCCAAGG GACCAAGGTGGAAATCAAG<br>SEQ ID NO: 26299 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAGGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGAGTAGCA GTGGCTGGTACTACTTCGACTACTGGGGCCAGGG AACCCTGGTCACCGTCTCCTCA<br>SEQ ID NO: 30305 |
| | | AA | DIVMTQSPDSLAVSLGERATINCRSSQSVLHSSN NYNYLAWYQQKPGQPPKLLIYWASKRDSGVPD RFSGSGSGTDFTLTISSLQAEDVAVYYCQQYFSS PRTFGQGTKVEIK<br>SEQ ID NO: 26300 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YYFDYWGQGTLVTVSS<br>SEQ ID NO: 30306 |

FIGURE 50
(Continued)

| | | | |
|---|---|---|---|
| iPS:435483 | 21-225_155A4 | NA | GACATCCAGATGACCCAGTCTCCAGTTCCGT GTCTGCATCTGTAGGAGACAGAGTCACCATAA CTTGTCGGGCGAGTCAGGTATTAGCAACTGG TTAGCCTGGTATCACCAGAAACCAGGGAAAGC CCCTAAGCTCCTGATCTATGCTGCATCCAGTTT GCAAGGTGGGGTCCCATCAAGGTTCAGCGGCA GTGGATCTGGGACAGATTTCACTCTCTCCATC AGCAGCCTGCAGCCTGAAGATTTTGCAACTTA CTATTGTCACCAGACTGACAGTTTCCATTCAC TTTCGGCCCTGGGACCAAAGTGGATATCAAA

SEQ ID NO: 26301 | GAGGTGCAGCTGTTGGAGTCTGGGGGAGGCTTG GTACAGCCTGGGGGGGTCCCTGAGACTCTCTGTG CAGCCTCTGATTCACCTTTAACAGCTATGCCAT GAGCTGGGTCCGCCAGGCTCCAGGGAAGGGCT GGAGTGGGTCTCAGTTATTAGTGGTAGTGGTGGT AACACATTCTACGCAGACTCCGTGAAGGGCCGCT TCACCATCTCCAGAGACAATTCCAAGAACACGCT GTATCTGCAAATGAACAGCCTGAGAGCCGAGGA CACGGCCGTATATTACTGTGCGAAAAGGATTAT GATTACGTTTGGGGGAGTCTTACTTTGACTACT GGGGCCAGGGAACCCTGGTCACCGTCTCCTCA

SEQ ID NO: 30307 |
| | | AA | DIQMTQSPASVSASVGDRVTITCRASQGISNWLA WYHQKPGKAPKLLIYAASSLQGGVPSRFSGSGS GTDFTLSISSLQPEDFATYCHQTDSFPFTFGPGT KVDIK

SEQ ID NO: 26302 | EVQLLESGGGLVQPGGSLRLSCAASGFTFNSYAMS WVRQAPGKGLEWVSAISGSGGNTFYADSVKGRFTI SRDNSKNTLYLQMNSLRAEDTAVYYCAKKDYDYV WGSPYFDYWGQGTLVTVSS

SEQ ID NO: 30308 |
| iPS:435485 | 21-225_155B4 | NA | GACATCCAGATGACCCAGTCTCCAGTTCCGT GTCTGCATCTGTAGGAGACAGAGTCACCATAA CTTGTCGGGCGAGTCAGGATATTAGCAACTGG TTAGCCTGGTATCAGCAGAAACCAGGGAAAG CCCCTAAGCTCCTGATCTATGCTGCATCCAGTT TGCAAGGTGGGGTCCCATCAAGGTTCAACGGC AGTGGATCTGGGACAGCTGACAGATTTCACTC CAGCAGCCTGCAGCCTGAAGATTTTGCAACTT ACTATTGTCACCAGACTGACAGTTTCCATTC ACTTTCGGCCCTGGGACCAAAGTGGATATCAA A

SEQ ID NO: 26303 | GAGGTGCAGCTGTTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATTCTACGCAGACTCCGTGAAGGGCCGCT TCACCATCTCCAGAGACAATTCCAAGAACACGCT GTATCTGCAAATGAACAGCCTGAGAGCCGAGGA CACGGCCGTATATTACTGTGCGAAAAGGATTAT GATTACGTTTGGGGGAGTCTTACTTTGACTACT GGGGCCAGGGAACCCTGGTCACCGTCTCCTCA

SEQ ID NO: 30309 |

FIGURE 50
(Continued)

| | | | |
|---|---|---|---|
| iPS:435487 | 21-225_155C4 | AA | DIQMTQSPASVSASVGDRVTITCRASQDISNWLA WYQQKPGKAPKLLIYAASSLQGGVPSRFNGSGS GTDFTLSISSLQPEDFATYYCHQTDSFPFTFGPGT KVDIK<br>SEQ ID NO: 26304 | EVQLLESGGGLVQPGGSLRLSCAASGFTFSSYAMS WVRQAPGKGLEWVSAISGSGGNTFYADSVKGRFTI SRDNSKNTLYLQMNSLRAEDTAVYYCAKKDYDYV WGSPYFDYWGQGTLVTVSS<br>SEQ ID NO: 30310 |
| | | NA | GACATCCAGATGACCCAGTCTCCATCCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTTTACTGCATCCAGTT TGCAAAGTGGGGTCCCATCAAGATTCAGTGGC AGTGGATCTGGGACAGATTTCACTCTCACCAT CAGCAGTCTGCAACCTGAAGATTTTGCAACTT ACTACTGTCAACAGAGAGTTACAGTACCCCACT TTCGGCGGAGGGACCAGGGTGGAGATCAAA<br>SEQ ID NO: 26305 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAACACGCT GTATCTGCAAATGAACAGTCTGAGAGCCGAGGA CACGGCCGTATATTACTGTGCGAAACGGGTGACG GACTACGGTGGTAAGGACTGGTTCGACCCCTGGG GCCAGGGAACCCTGGTCACCGTCTCCTCA<br>SEQ ID NO: 30311 |
| | | AA | DIQMTQSPSSLSASVGDRVTITCRASQSISSYLNW YQQKPGKAPKVLIFTASSLQSGVPSRFSGSGSGT DFTLTISSLQPEDFATYYCQQSYSTPTFGGGTRV EIK<br>SEQ ID NO: 26306 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br>SEQ ID NO: 30312 |

FIGURE 50
(Continued)

| | | | |
|---|---|---|---|
| iPS:435489 | 21-225_155A5 | NA | GATATTGTGATGACCCAGACTCCACTCTCTCT GTCCGTCACCCCTGGACAGCCGGCCTCCATCT CCTGCAAGTCTAGTCAGAGCTCCTGCATGTT GATGGAAAGAGACCTATTTGTATTGGTACCTGCA GAAGCCAGGCCAGCCTCCACAGCTCCTGATTT ATGAAGTTTCCAATCGGTTCTCTGGAGTGCCA GATAGGTTCAGTGGCAGCGGTTCAGGGACAG ATTTCACACTGAAAATCAGCGGGTGGAGGCT GAGGATGTTGGAGTTTATTACTGCATGCAAAG TATACAGGTTCCGTGGACGTTCGGCCAAGGGA CCAAGGTGGAAATCAAA<br><br>SEQ ID NO: 26307 | CAGGTGCAGCTAGTGGAGTCTGGGGGAGACGTG GTCCAGCCTGGGAGGTCCCTGAGGCTCTCCTGTG CAGCGTCTGGATTCACCTTCAGTAGTAGCTATGGCAT GCACTGGGTCCGCCAGGCTCCAGGCAAGGGCT GGAGTGGGTGGCAATTATATGGTATGGATGAAGT AGTAAATACTATGCAGACTCCGTGAAGGGCCGA TTCACCATCTCCAGAGACAATTCCAAGAACACGC TGTATCTGCACATGAACAGCCTGAGAGCCGAGG ACACGGCAGTGTATTACTGTGCGAGAGATCGATA CGATTTTTGGAGTGGTCACTTTGACTACTGGGGC CAGGGAACCCTGGTCACCGTCTCCTCA<br><br>SEQ ID NO: 30313 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGFYYCMQSIQVPW TFGQGTKVEIK<br><br>SEQ ID NO: 26308 | QVQLVESGGDVVQPGRSLRLSCAASGFTFSSYGMH WVRQAPGKGLEWVAIIWYDGSSKYYADSVKGRFT ISRDNSKNTLYLHMNSLRAEDTAVYYCARDRYDF WSGHFDYWGQGTLVTVSS<br><br>SEQ ID NO: 30314 |
| iPS:435491 | 21-225_155E5 | NA | GACATCGTGATGACCCAGTCTCCAGACTCCCT GGCTGTGTCTCTGGGCGAGAGGGCCACCATCA ACTGCAAGTCCAGCCAGAGTGTTTTATCCAGC TCCAACAATAATAATTATTTAGCTTGGTACCA GCAGAAACCAGGACAGCCTCCTAAGCTGCTCA TTTACTGGGCATCTACCCGGGAGAAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATAGTACTCCGTGCAGTTTGGCCAGGG GACCAAGCTGGAGATCAAG<br><br>SEQ ID NO: 26309 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGAACAGAGGTTCCAGGCAG TAGTACAGGCTATGCACAGAGGTTCCAGGCAG AGTCACCATGACCAGGAACACCTCCATAAGCAC AGCCTACATGGAGCTGAGCAGCCTGAGATCTGA GGACACGGCCGTGTATTACTGTGCGTTTAGCAGT GGCTGGTACTATTTTGACTACTGGGGCCAGGGAA CCCTGGTCACCGTCTCCTCA<br><br>SEQ ID NO: 30315 |

FIGURE 50
(Continued)

| | | | |
|---|---|---|---|
| iPS:435495 | 21-225_155B6 | AA | DIVMTQSPDSLAVSLGERATINCKSSQSVLSSSNNNNYLAWYQQKPGQPPKLLIYWASTRKSGVPDRFSGSGSGTDFTLTISSLQAEDVAVYYCQQYYSTPCSFGQGTKLEIK<br>SEQ ID NO: 26310 | QVQLVQSGAEVKKPGASVKVSCKASGYTFTNYDINWVRQATGQGLEWMGWMHPNSGSTGYAQRFQGRVTMTRNTSISTAYMELSSLRSEDTAVYYCAFSSGWYYFDYWGQGTLVTVSS<br>SEQ ID NO: 30316 |
| | | NA | GACATCGTGATGACCCAGTCTCCAGACTCCCTGGCTGTGTCTCTGGGCGAGAGGGCCACCATCAACTGCAAGTCCAGCCAGAGTGTTTTACACAGCTCCAATAATTACAACTACTTAGCTTGGTACCAGCAGAAACCAGGACAGCCCCCTAAACTGCTCATTTACTGGACATCTACCCGGGCAGCGGGTCTGGGACCCTGACCGATTCAGTGGCAGCGGGTCTGGGACAGATTCACTCTCACCATCAGCAGCCTGCAGGCTGAAGATGTGGCAGTTTATTACTGTCAACAATATTATAGTACTCCGTGCAGTTTTGGCCAGGGGACCAAGTTGGAGATCAAA<br>SEQ ID NO: 26311 | CAGGTGCAGCTGGTGCAGTCTGGGGCTGAGGTGAAGAAGCCTGGGGCCTCAGTGAAGGTCTCTGCAAGGCTTCTGGATACACCTTCACCAATTATGATATCAACTGGGTGCGACAGGCCACTGGACAAGGGCTTGAGTGGATGGGATGGATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCTTTATAGCAGTGGCTGGTACTACTTTGACTACTGGGGCCAGGGAACCCTGGTCACCGTCTCCTCA<br>SEQ ID NO: 30317 |
| | | AA | DIVMTQSPDSLAVSLGERATINCKSSQSVLHSSNNYNYLAWYQQKPGQPPKLLIYWTSTRESGVPDRFSGSGSGTDFTLTISSLQAEDVAVYYCQQYYSTPCSFGQGTKLEIK<br>SEQ ID NO: 26312 | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYYFDYWGQGTLVTVSS<br>SEQ ID NO: 30318 |

FIGURE 50
(Continued)

| | | | | |
|---|---|---|---|---|
| iPS:435497 | 21-225_155H9 | NA | GAAATAGTGATGACGCAGTCTCCAGCCACCCT GTCTGTGTCTCCAGGGGAAAGAGCCACCCTCT CCTGCAGGGCCAGTCAGAGTGTTAGTAGTAAC TTAGCCTGGTACCAGCAGAAACCTGGCCAGGC TCCCAGACTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTACTGTCAGCAGTATGATGACTGGCCTCCG TGGACGTTCGGCCAAGGGACCAAGGTGGAAA TCAAA<br>SEQ ID NO: 26313<br>EIVMTQSPATLSVSPGERATLSCRASQSVSSNLA WYQQKPGQAPRLLIYGASTRATGIPARFSGSGSG TEFTLTISSLQSEDFAVYYCQQYDDWPPWTFGQ GTKVEIK<br>SEQ ID NO: 26314 | GAGGTGCAACTATTGGAGTCTGGGGGAGGCTTG GTTCAGCCTGGGGGGTCCCTGAGACTCTCCTGTG CAGCCTCTGGATTCACCTTTAGCAGCTATGCCAT GAACTGGGTCCGCCAGGCTCCAGGGAAGGGGCT GGAATGGGTCTCAACTATTAGTGGTAGAGGTCTT GGCACATACTACGCAGACTCCGTGAAGGGCCGG TTCACCATCTCCAGAGACAATTCCAAGAACACGC TGTATCTGCAACTGAACAGCCTGAGAGCCGAGG ACACGGCCGTATATTACTGTGCAAAGACCATGA CTACGGTTGACTACATATCTACTTTGACTACTGG GGCCAGGGAACCCTGGTCACCGTCTCCTCA<br>SEQ ID NO: 30319<br>EVQLLESGGGLVQPGGSLRLSCAASGFTFSSYAMN WVRQAPGKGLEWVSTISGRGLGTYYADSVKGRFTI SRDNSKNTLYLQLNSLRAEDTAVYYCAKDHDYGD YNIYFDYWGQGTLVTVSS<br>SEQ ID NO: 30320 |
| iPS:435499 | 21-225_156G1 | NA | GACATCCAGATGACCCAGTCTCCATCTCCCT GTCTGCATCTGTAGGAGACAGAGTCACCATCA CTTGCCGGGCAAGTCAGAGTCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCAGCAGCCTGCAGCCTGAAGATTTTGCAACT TATTACTGTCTGTCTACAGCATAGTAATTACCCGCTC ACTTTCGGCGGAGGGACCAAGGTGGAGATCA AA<br>SEQ ID NO: 26315 | CAGCTGCAGCTGCAGGAGTCGGGCCCAGGACTG GTGAAGCCTTCGGAGACCCTGTCCCTCACCTGCA CTGTCTCTGGTGGCTCCATCAGCAGAAGTAGTTA CTACTGGGGCTGGATCCGCCAGCCCCCAGGGAA GGGAGCGCCTCCTACAACCCGTCCTCCAAGAGTC GAGTCACCATATCGTAGACACGTCCAAGAACC AGTTCTCCCTGAAGCTGAGCTCTGTGACCGCGC AGACACGGCTGTGTTTACTGTGCGAGACTTGAT CTCCAGTGGAGTTTGACTTCTGGGGCCAGGGAA CCCTGGTCACCGTCTCCTCA<br>SEQ ID NO: 30321 |

FIGURE 50
(Continued)

| | | | |
|---|---|---|---|
| iPS:435501 | 21-225_156H1 | AA | DIQMTQSPSSLSASVGDRVTITCRASQGIRNDLGWYQQKPGKAPKRLIYAASSLQSGVPSRFSGSGSGTEFTFTISSLQPEDFATYYCLQHSNYPLTFGGGTKVEIK |
| | | | QLQLQESGPGLVKPSETLSLTCTVSGGSISRSSYYWGWIRQPPGKGLEWIGSIYSGSASYNPSLKSRVTISVDTSKNQFSLKLSSVTAADTAVFYCARLDLQWSFDFWGQGTLVTVSS |
| | | | SEQ ID NO: 26316 |
| | | | SEQ ID NO: 30322 |
| | | NA | GACATCGTGATGACCCAGTCTCCTGGCTGTGTCTGTGGCGAGAGGCCACCATCAACTGCAAGTCCAGCCAGAGTGTTTTATACAGCTCCAACAATAACAACTACTTAGCTTGGTACCAGCAGAAACCAGGACAGCCTCCTAAGCTGCTCATTTACTGGGCATCTACCCGGGAATCCGGGGTCCCTGCCCGATTCAGTGGCAGCGGGTCTGGGACAGATTTCACTCTCACCATCAGCAGCCTGCAGGCTGAAGATGTGGCAGTTTATTACTGTCACCAATATTATAGTACTCCGTGCAGTTTTGGCCAGGGGACCAAGCTGGAGATCAAA |
| | | | CAGGTGCAGCTGGTGCAGTCTGGGGCTGAGGTGAAGAAGCCTGGGGCTCAGTGAAGGTCTCTGCAAGGCTTCTGGATACACCTTCACCAATTATGATATCAACTGGGTGCGACAGGCCACTGGACAAGGCTTGAGTGGATGGGATGGGTGCACCTAACAGTGGTAACACAGGCTATGCACAGAAGTTCCAGGGCAGTCACCATGACCAGGAACACCTCCATAAGCACAGCCTACATGGAGCTGAGCAGCCTGAGATCTGAGGACACGGCCGTGTATTACTTTGACTACTGGGGCCAGGGAACCCTGGTCACCGTCTCCTCA |
| | | | SEQ ID NO: 26317 |
| | | | SEQ ID NO: 30323 |
| | | AA | DIVMTQSPDSLAVSLGERATINCKSSQSVLYSSNNNNYLAWYQQKPGQPPKLLIYWASTRESGVPARFSGSGSGTDFTLTISSLQAEDVAVYYCHQYYSTPCSFGQGTKLEIK |
| | | | QVQLVQSGAEVKKPGASVKVSCKASGYTFTNYDINWVRQATGQGLEWMGWVHPNSGNTGYAQKFQGRVTMTRNTSISTAYMELSSLRSEDTAVYYCAGSSGWYYFDYWGQGTLVTVSS |
| | | | SEQ ID NO: 26318 |
| | | | SEQ ID NO: 30324 |

FIGURE 50
(Continued)

| | | | |
|---|---|---|---|
| iPS:435503 | 21-225_156E4 | NA | GACATCCAGATGACCCAGTCTCCATCCTCCCT GTCTGCATCTGTAGGAGACAGAGTCACCATCA CTTGCCGGGCAAGTCAGAGCATTAGCAGCTAT TTAAATTGGTATCAGCAGAAACCAGGGAAAG CCCCTAAGGTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGTTACAGTGCCCCCACT TTCGGCGGAGGGACCAAGGTGGAGATCAAA<br><br>SEQ ID NO: 26319 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATTCCAAGAACACACT ATATCTGCAAATGAACAGCCTGAGAGCCGAGGA CACGGCCGTATATTACTGTGCGAAACGGGTGACG GACTACGGTGGTAACGACTGGTTCGACCCCTGGG GCCAGGGAACCCTGGTCACCGTCTCCTCA<br><br>SEQ ID NO: 30325 |
| | | AA | DIQMTQSPSSLSASVGDRVTITCRASQSISSYLNW YQQKPGKAPKVLIYTASSLQSGVPSRFSGSGSGT DFTLTISSLQPEDFATYYCQQSYSAPTFGGGTKV EIK<br><br>SEQ ID NO: 26320 | EVQLLESGGGLVQPGGSLRLSCAASGFTFSSYAMS WVRQAPGKGLEWVSAISGRGGNTFYADSVKGRFTI SRDNSKNTLYLQMNSLRAEDTAVYYCAKRVTDYG GNDWFDPWGQGTLVTVSS<br><br>SEQ ID NO: 30326 |
| iPS:435505 | 21-225_157C1 | NA | GACATCCAGATGACCCAGTCTCCATCCTCACT GTCTGCATCTATAGGAGACAGAGTCACCCTCA CTTGTCGGGCGAGTCAGGGCATTAGCAATTAT TTAGCCTGGTTTCAGCAGAGACCAGGGAAAGC CCCTAAGTCCCTGATCTATGCTGCATCCAGTTT GCTAAGTGGGGTCCCATCAAAGTTCAGCGGCA GTGGATCTGGGACAGATTTCACTCTCACCATC AGCAGCCTGCAGCCTGAAGATTATACAACTTA TTACTGCCAACAGAGTATATAGGTTTTCATTCAC TTTCGGCGGAGGGACCAAGGTGGAGCTCAAA<br><br>SEQ ID NO: 26321 | GAGGTGCAGCTGTGGTGGAGTCTGGGGGAGGCCTG GTCAAGCCTGGGGGGGTCCCTGAGACTCTCCTGTG CAGCCTCTGGATTCACCTTCAGTAGTAGCTATAGAAT GAACTGGGTCCGCCAGGCTCCAGGGAAGGGGCT GGAGTGGGTCTCATCCATGAGTCAGTCAGTAGTAGT TCCATATACTACGCAGAGACAATCAGTGAAGGGCGAT TCACCATCTCCAGAGACAACGCCAAGAACTCACT GTATCTGCAAATGAACAGCCTGAGAGCCGAGGA CACGGCTGTGTATTACTGTGCGAGACAGGCAGCC CAGGACTACTGGGGCCAGGGAACCCTGGTCACC GTCTCCTCA<br><br>SEQ ID NO: 30327 |

FIGURE 50
(Continued)

| | | | |
|---|---|---|---|
| iPS:435509 | 21-225_157H1 | AA | DIQMTQSPSSLSASIGDRITLTCRASQGISNYLAW FQQRPGKAPKSLIYAASSLSGVPSKFSGSGSGT DFTLTISSLQPEDFATYYCQQYNSFPFTFGGGTK VELK<br>SEQ ID NO: 26322 | EVQLVESGGGLVKPGGSLRLSCAASGFTFSSYRMN WVRQAPGKGLEWVSSMSNSSSSIYYADSVKGRFTI SRDNAKNSLYLQMNSLRAEDTAVYYCARQAAQD YWGQGTLVTVSS<br>SEQ ID NO: 30328 |
| | | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGTCTGGTTTCAGCAGAGACCAGGAAAGC CCCTAGGTCCCTGATCTATGCTGCATCCAGTTT GCAAAGTGGGGTCCCATCTAAGTTCAGCGGCA GTGGATCTGGGACAGATTTCACTCTCACCATC AGCAGCCTGCAGCCTGAAGATTTTGCAACTTA TTACTGCCAACAATATCATAGTTACCCATTCA CTTTCGGCCCTGGGACCAAAGTGGATATCAAA<br>SEQ ID NO: 26323 | GAGGTGCAGCTGTTGGAGTCTGGGGGAGGGTTG GTACAGCCTGGGGGGTCCCTGAGACTCTCCTGTG CAGCCTCTGGATTCACCTTTAGCAGTTATGCCAT GAGGTGGATCCGCCAGGCTCCAGGGAAGGGGCT GCAGTGGGTCTCAGATATTAGTGGTAGTGGTGGT ACCACATACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGACCTACCT CTGGGGCCAGGGAACCCTGGTCACCGTCTCCTCA<br>SEQ ID NO: 30329 |
| | | AA | DIQMTQSPSSLSASVGDRVTITCRASQDISNYLV WFQQRPGKAPRSLIYAASSLQSGVPSKFSGSGSG TDFTLTISSLQPEDFATYYCQQYHSYPFTFGPGT KVDIK<br>SEQ ID NO: 26324 | EVQLLESGGGLVQPGGSLRLSCAASGFTFSSYAMR WIRQAPGKGLQWVSDISGSGGTTYYADSVKGRFTI SRDNSKNTLYLQMNSLRAEDTAVYYCAKTYLWGQ GTLVTVSS<br>SEQ ID NO: 30330 |

FIGURE 50
(Continued)

| | | | |
|---|---|---|---|
| iPS:435511 | 21-225_157C3 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTCATCTATGCTGCATCCAGTTTGCAAAGTGGGGTCCCATCAAGGTTCAGCGGCAGTGGATCTGGGACAGACTTCACTCTCACAATCAGCAGCCTGCAGCCTGATGACTTTGCAACTTATTACTGTCTACAGCATAATAGTTACCCATTCACTTTCGGCCCTGGGACCAAAGTGGATATCAAA SEQ ID NO: 26325 | CAGGTGCAGCTGGTGGAGTCTGGGGGAGGCGTGGTCCAGCCTGGGAGGTCCCTGAGACTCTCCTGTCAGCGTCTGGATTCACCTTCAGTACCTATGGCATGCACTGGGTCCGCCAGGCTCCAGGCAAGGGCTGGAGTGGGTGGCGTGTATATGGTATGATGTAAATAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAGTCTGGGGTTCCTCTCTGACTATTGGGGCCAGGGAACCCTGGTCACCGTCTCCTCA SEQ ID NO: 30331 |
| | | AA | DIQMTQSPSSLSASVGDRVTITCRASQGIRNDLGWYQQKPGKAPKRLIYAASSLQSGVPSRFSGSGSGTDFTLTISSLQPDDFATYYCLQHNSYPFTFGPGTKVDIK SEQ ID NO: 26326 | QVQLVESGGGVVQPGRSLRLSCAASGFTFSTYGMHWVRQAPGKGLEWVAVIWYDVNKYYADSVKGRFTISRDNSKNTLYLQMNSLRAEDTAVYYCARELGFLSDYWGQGTLVTVSS SEQ ID NO: 30332 |
| iPS:435513 | 21-225_157F3 | NA | GACATCCAGATGACCCAGTCTCCATCCTCCCTGTCTGCATCTGTAGGAGACAGAGTCACCATCACTTGCCGGGCAAGTCAGAGCATTAGACAGTTATTTAAATTGGTATCAGCTGAAACCAGGGAAAGCCCCTAAACCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAGGATTTTGCAACTTACTACTGTCTACAAGATTACAATACCCCACGTGGACGTTCGGCCAAGGGACCAAGGTGGAAATCAAA SEQ ID NO: 26327 | GAGGTGCAACTGTTGGAGTCTGGGGGAGGCTTGGTACAGCCTGGGGGGTCCCTGAGACTCTCCTGTCAGCCTCTGGAATTCACCTTTAGCACTATGCCATGAGCTGGGTCCGCCAGGCTCCAGGGAAGGGGCTGGAGTGGGTCTCAGTTATTAGTGGTAGTGGTGTTAGCACATACTACGCAGACTCCGTGAAGGGCCGGTTCACCATCTCCAGAGACAATGAACAGCCTGAGAGCCGAGGACACGGCCGTATTACTGTGCGAAAGGAGCAGTGGCTGGTACGAGGATGCTCTTGATATCTGGGGCCAAGGGACAATGGTCACCGTCTCTTCA SEQ ID NO: 30333 |

FIGURE 50
(Continued)

| | | | |
|---|---|---|---|
| iPS:435515 | | AA | DIQMTQSPSSLSASVGDRVTITCRASQNISSYLN WYQLKPGKAPKLLIYTASSLQSGVPSRFSGSGSG TDFTLTISSLQPEDFATYYCQQSYNTPTWTFGQG TKVEIK<br>SEQ ID NO: 26328 | EVQLLESGGGLVQPGGSLRLSCAASEFTFSTYAMS WVRQAPGKGLEWVSVISGSGGSTYYADSVKGRFTI SRDNSKNTLYLQMNSLRAEDTAVYYCAKRSSGWY EDALDIWGQGTMVTVSS<br>SEQ ID NO: 30334 |
| | 21-225_157E4 | NA | GACATCCAGATGACCCAGTCTCCATCCTCACT GTCTGCATCTGTAGGAGACAGAGTCACCTTCA CTTGTCGGGCGAGTCAGGGCATTAGCAATTAT TTAGCCTGGTTTCAGCAGAAACCAGGGAGAGC CCCTAAGTCCCTGATCTATGCTGCATCCAGTTT GCGAAGTGGGGTCCCATCACAGTTCAGCGGCA GTGGATCTGGGACAGATTTCACTCTCACCATC AACAGCCTGCAGCCTGAAGATTTTGCAACTTA TTACTGCCAACAGTATCATAGTTATCCATTCAC TTTCGGCCCTGGGACCAAAGTGGATATCAAA<br>SEQ ID NO: 26329 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGCTATGCCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCTGAAAGCCGAGGA CACGGCTGTGTATTACTGTGCGAGAGTAGCTACC TTTGACTACTGGGGCCAGGGAACCCTGGTCACCG TCTCCTCA<br>SEQ ID NO: 30335 |
| | | AA | DIQMTQSPSSLSASVGDRVTFTCRASQGISNYLA WFQQKPGRAPKSLIYAASSLRSGVPSQFSGSGSG TDFTLTINSLQPEDFATYYCQQYHSYPFTFGPGT KVDIK<br>SEQ ID NO: 26330 | EVQLVESGGGLVKPGGSLRLSCAASGFTFSSYTMN WVRQAPGKGLEWVSSISGSSSYIYYADSVKGRFTIS RDNAKNSLYLQMNSLKAEDTAVYYCARVATFDY WGQGTLVTVSS<br>SEQ ID NO: 30336 |

FIGURE 50
(Continued)

| | | | | |
|---|---|---|---|---|
| iPS:435521 | 21-225_157H4 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATCCTGCATCCAGTT TACAAACTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGGATAATAGTTACCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGCT GGAGTGGGTCTCATCCATTAGTAGTAGTAGTACT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATAGAGGG TCCATCTGGGGCCAGGGAACCCTGGTCACCGTCT CCTCA |
| | | | SEQ ID NO: 26331 | SEQ ID NO: 30337 |
| | | AA | DIQMTQSPSSLSASVGDRVTITCRASQGIRNDLG WYQQKPGKAPKRLIYPASSLQTGVPSRFSGSGSG TEFTLTISSLQPEDFATYYCLQDNSYPFTFGPGTK VDIK | EVQLVESGGGLVKPGGSLRLSCAASGFTFSSYSMN WVRQAPGKGLEWVSSISSSSTYIYYADSVKGRFTIS RDNAKNSLYLQMNSLRAEDTAVYYCARDRGSIWG QGTLVTVSS |
| | | | SEQ ID NO: 26332 | SEQ ID NO: 30338 |
| iPS:435523 | 21-225_157G5 | NA | GACATCCAGATGACCCAGTCTCCATCCTCACT GTCTGCATCTGTAGGGGACAGAGTCACCATCA CTTGTCGGGCGAGTCAGGGCATTAGCAGTTTAACAATTAT TTAGCCTGGTTTCAGCAGAAACCAGGGAAAGC CCCTGAGTCCTGATCTATGCTGCATCCAGTTT ACAAAGTGGGGTCCCATCACAGTTCAGCGGCA GTGGATCTGGGACAGATTTCACTCTCACCATC AGCAGCCTGCAGCCTGAAGATTTTGCAACTTA TTACTGCCAACAGTATATAGTTATCCATTCA CTTTCGGCGGCCCTGGGACCAAAGTGGATATCAAA | GAGGTGCAGCTGTTGGAGTCTGGGGGAGGCTTG GTACAGCCGGGGGGGTCCCTGAGACTCTCCTGTG CAGCCTCTGGATTCACCTTTAGTAGCTATGTCAT GAGCTGGGTCCGCCAGGCTCCAGGGAAGGGACT GGAGTGGGTCTCAGCTATTAGTAGTGGTGGTGGT AGAACATACTACGCAGACTCCGTGAAGGGCCGG TTCACCATCTGCAAATGAACAGCCTGAGAGACACGC TGTATCTGCAAATGAACAGCCTGAGAGCCGAGG ACACGGCCGTGTATTACTGTGCGAAGTATACCTG GAACGGCTACTGGGGCCAGGGAACCCTGGTCAC CGTCTCCTCA |
| | | | SEQ ID NO: 26333 | SEQ ID NO: 30339 |

FIGURE 50
(Continued)

| | | | |
|---|---|---|---|
| iPS:435525 | 21-225_157E7 | AA | DIQMTQSPSSLSASVGDRVTITCRASQGINNYLAWFQQKPGKAPESLIYAASSLQSGVPSQFSGSGSGTDFTLTISSLQPEDFATYYCQQYNSYPFTFGPGTKVDIK | EVQLLESGGGLVQPGGSLRLSCAASGFTFSSYVMSWVRQAPGKGLDWVSAMSGSGGRTYADSVKGRFTISRDNSKNTLYLQMNSLRAEDTAVYYCAKYTWNGYWGQGTLVTVSS |
| | | | SEQ ID NO: 26334 | SEQ ID NO: 30340 |
| | | NA | GACATCCAGATGACCCAGTCTCCATCCTCCCTGTCTGCATCTGTAGGAGACAGAGTCACCATCACTTGCCGGGCAAGTCAGAGCTTTAGCAGCAGTATTTAAAATTGGTATCAGCAGAAACCAGGGATAGCCCCTAAACTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAAGAGAGTTATATGTATCCGCTTCGCCTTCGGCCAAGGGACACACGACTGGAGATTAAA | CAGCTGCACCTGCAGGAGTCGGGCCCAGGACTGGTGAAGCCTTCGGAGACCCTGTCCCTCACCTGCACTGTCTCTGGTGGCTCCATCAGCAGTGGTAGTTACTACTGGGGCTGGATCCGCCAGCCCCAGGGAAGGGACTGGAGTGGATTGGAGTATCTACTATAGTGGGAGCACCTACTACAATCCGTCCCTCAAGAGTCGAGTCACCATATCCGTAGACACGTCCAAGAACCAGTTCTCCCTGAACCTGAGCTCTGTGACCGCCGCAGACACGGCTGTCTATTACTGTGCGAGACATAAAGTGGCTGGTCCCTTTGACTACTGGGGCCAGGGAACCCTGGTCACCGTCTCCTCA |
| | | | SEQ ID NO: 26335 | SEQ ID NO: 30341 |
| | | AA | DIQMTQSPSSLSASVGDRVTITCRASQSFSSYLNWYQQKPGIAPKLLIYAASSLQSGVPSRFSGSGSGTDFTLTISSLQPEDFATYYCQESYSIRFAFGQGTRLEIK | QLHLQESGPGLVKPSETLSLTCTVSGGSISSGSYYWGWIRQPPGKGLEWIGSIYYSGSTYYNPSLKSRVTISVDTSKNQFSLNLSSVTAADTAVYYCARHKVAGPFDYWGQGTLVTVSS |
| | | | SEQ ID NO: 26336 | SEQ ID NO: 30342 |

FIGURE 50
(Continued)

| | | | |
|---|---|---|---|
| iPS:435527 | 21-225_157G7 | NA | GACATTCAGATGACTCAGTCTCCATCCTCCCT GTGTGCATCAGTAGGAGACAGAGTCACCATCA CTTGCCGGGCAAGTCAGGGACATTAGAAATGAT TTAGGCTGGTATCAGCAGAAACCAGGAAAG CCCCTAAGCGCTTGATCAATGTTGCATCCAGT TTGCAAAGTGGGGTCCCATCAAGGTTCAGCGG CAGTGGATCTGGGACAGAATTCACTCTCACAA TCAGCAGCGTGCAGCGTGAAGATAATAGTCACCATT TATTACTGTATACAGGATAATAGTCACCCATT CACTTTCGGCCCTGGGACCAAAGTGGAAATCA AA<br><br>SEQ ID NO: 26337 | GAGGTGCAACTGGTGGAGTCTGGGGGAGGCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGCT GGAGTGGGTCTCATCCATTAGTGGTAGTAGTACG TACATATACTACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGTGCGAGAGATCGGGGC AGCAGCTGGGGCCAGGGAACCCTGGTCACCGTC TCCTCA<br><br>SEQ ID NO: 30343 |
| | | AA | DIQMTQSPSSLCASVGDRVTITCRASQGIRNDLG WYQQKPGKAPKRLINVASSLQSGVPSRFSGSGS GTEFTLTISSVQREDFATYYCIQDNSHPFTFGPGT KVEIK<br><br>SEQ ID NO: 26338 | EVQLVESGGGLVKPGGSLRFSCAASGFTFSSYSMN WVRQAPGKGLEWVSSISGSSTYIYYADSVKGRFTIS RDNAKNSLYLQMNSLRAEDTAVYYCARDRGSSW GQGTLVTVSS<br><br>SEQ ID NO: 30344 |
| iPS:435529 | 21-225_157H7 | NA | GACATCCAGATGACCCAGTCTCCATCCTCACT GTCTGCATCTGTAGGAGACAGAGTCACCATCA CTTGTCGGGCGAGTCAGGACATTAGCACTTTT TTAGCCTGGTATCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATATTGCAACTTA TTACTGCCAACAGTATCATAGTTACCGATCA CCTTCGGCCAAGGGACACGACTGGAGATTAAA<br><br>SEQ ID NO: 26339 | GAGGTGCAGCTGGTGGAGTCTGGGGGAGGCTG GTCAAGCCTGGGGGGTCCCTGAGACTCTCCTGTG CAGCCTCTGGATTCACATTCAGTAGCTATAGCAT GAACTGGGTCCGCCAGGCTCCAGGGAAGGGCT AGAGTGGGTCTCATGCATTAGTGGTAGTAGT TACATATATTATGCAGACTCAGTGAAGGGCCGAT TCACCATGTCCAGAGACAACAGCCAAGAACTCACT GTATCTGCAAATGAACAGCCTGAGAGCCGAGGA CACGGCTGTGTATTACTGTGTGAGAGATCGAGGG GGCTATTGGGGCCAGGGAACCCTGGTCACCGTCT CCTCA<br><br>SEQ ID NO: 30345 |

FIGURE 50
(Continued)

| | | | |
|---|---|---|---|
| iPS:435531 | 21-225_157G8 | AA | DIQMTQSPSSLSASVGDRVTITCRASQDISNFLA WFQQKPGKAPKSLVSTASSLQSGVPSKFSGSGSG TDFTLTISSLQPEDFATYYCQQYHSYPITFGQGTR LEIK<br>SEQ ID NO: 26340 | EVQLVESGGGLVKPGGSLRLSCAASGFTFSSYSMN WVRQAPGKGLEWVSCISGSGSSYIYYADSVKGRFTM SRDNAKNSLYLQMNSLRAEDTAVYYCVRDRGGY WGQGTLVTVSS<br>SEQ ID NO: 30346 |
| | | NA | GATATTGTGATGACCCAGACTCCACTCTCTCT GTCCGTCACCCCTGGACAGCCGTCCATCT CCTGCAAGTCTAGTCAGAGCCTCCTGCATGGT GATGGAAAGACCTATTTATATTGGTACCTGCA GAAGCCAGGCCAGTCTCCACAACTCCTGATCT ATGAAATTTCCAACGGTTCTCTGGAGTGCCA GATAGGTTCAGTGGCAGCGGGTCAGGACAG ATTTCACACTGAAAATCAGCCGGGTGGAGGCT GAGGATGTTGGGGTTTACTACTGCATGCAAAG TATACAGGTTCCGTGGACGTTCGGCCAAGGGA CCAAGGTGGAAATCAAA<br>SEQ ID NO: 26341 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAATTATGGCAT GCACTGGGTCCGCCAGGCTCCAGGCAAGGGGCT GGAGTGGGTGGCAATTATATGATGTATGATGAAGT TATAAATACTATGCAGACTCCGTGAAGGGCCGAT TCACCGTCTCCAGAGACAATTCCAAGAACACGCT GTATCTGCAAATGAACAGCTGAGAGCCGAGGA CACGGCTGTGTATTACTGTGCGAGAGAGGATAC GATTTTTGGAGTGGTTTCTTTGACTCCTGGGCCA GGGAACCCTGGTCACCGTCTCCTCA<br>SEQ ID NO: 30347 |
| | | AA | DIVMTQTPLSLSVTPGQPASISCKSSQSLLHGDG KTYLYWYLQKPGQSPQLLIYEISKRFSGVPDRFS GSGSGTDFTLKISRVEAEDVGVYYCMQSIQVPW TFGQGTKVEIK<br>SEQ ID NO: 26342 | QVQLVESGGGVVQPGRSLRLSCAASGFTFSNYGM HWVRQAPGKGLEWVAIIWYDGSYKYYADSVKGR FTVSRDNSKNTLYLQMNSLRAEDTAVYYCAREGY DFWSGFFDSWGQGTLVTVSS<br>SEQ ID NO: 30348 |

FIGURE 50
(Continued)

| | | | | |
|---|---|---|---|---|
| iPS:435533 | 21-225_157H8 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCAGCAGCCTGCAGCCTGATGACTTTGCAACT TATTACTGTCTACAGCATAATAGTTACCCATTC ACTTTCGGCCCTGGGACCAAAGTGGATATCAA A SEQ ID NO: 26343 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCCGCCAGGCTCCAGGCAAGGGGCT GGAGTGGGTGGCTGTTATATGATATGATGTAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCTGGG GTTCCTCTCGACTACTGGGGCCAGGGAACCCTG GTCACCGTCTCCTCA SEQ ID NO: 30349 |
| | | AA | DIQMTQSPSSLSASVGDRVTITCRASQGIRNDLG WYQQKPGKAPKRLIYAASSLQSGVPSRFSGSGS GTDFTLTISSLQPDDFATYYCLQHNSYPFTFGPG TKVDIK SEQ ID NO: 26344 | QVQLVESGGGVVQPGRSLRLSCAASGFTFSSYGMH WVRQAPGKGLEWVAVIWYDVNKYYADSVKGRF TISRDNSKNTLYLQMNSLRAEDTAVYYCARELGFL SDYWGQGTLVTVSS SEQ ID NO: 30350 |
| iPS:435535 | 21-225_157H10 | NA | GACATCCAGATGACCCAGTCTCCATCCTCACT GTCTGCATCTGTAGGAGACAGAGTCACCATCA CTTGTCGGGCGAGTCAGGGCATTAGCAGTGCA TTAGCCTGGTTTCAGCAGAAACCAGGGAAAGC CCCTAAGTCCCTGATCTATACTGCATCCAATTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA SEQ ID NO: 26345 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATACCAT GAACTGGGTCCGCCAGGCTCCAGGGAAGGGGCT GGAGTGGGTCTCATCCATTAGTGGTAGCAGTAGT TACATAAACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTGGCTCA CTTTGACTACTGGGGCCAGGGAACCCTGGTCACC GTCTCCTCA SEQ ID NO: 30351 |

FIGURE 50
(Continued)

| | | | |
|---|---|---|---|
| | | AA | DIQMTQSPSSLSASVGDRVTITCRASQGITNYLA WFQQKPGKAPKSLIYTASNLQSGVPSKFSGSGSG TDFTLTISSLQPEDFATYYCQQYHSYPFTFGPGT KVDIK<br><br>SEQ ID NO: 26346 | EVQLVESGGGLVKPGGSLRLSCAASGFTFSSYTMN WVRQAPGKGLEWVSSISGSSSYINYADSVKGRFTIS RDNAKNSLYLQMNSLRAEDTAVYYCARVAHFDY WGQGTLVTVSS<br><br>SEQ ID NO: 30352 |
| iPS:435537 | 21-225_157H12 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTTGGCTGGTATCAGCAGAAGACCAGGGAAAGC CCCTAAGTCGCTGATTCATCGTGCATCCAGTTT ACAGAGTGGGGTCCCATCAAGGTTCAGCGGCA GTGGATCTGGGACAGACCTGAAGATTTTGCAACTA AGCAGCCTGAAGATTATAGTTACCCATTCAC TTACTGTCTACACAGCATTATAGTTACCCATTCAC TTTCGGCCCTGGGACCAAAGTGGATATCAAA<br><br>SEQ ID NO: 26347 | GAGGTGCAGTGGGTGGAGTCTGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTGGTAGT TACATAAACTACGCAGACTCAGTGAAGGGCCGG TTCACCATCTCCAGAGACAACGCCAAGAACTCAC TGTATCTGCAAGTGAACGGCCTGAGAGCCGAGG ACACGGCTGTGTATTACTGTGCGAGATCCAAGTT TGACTCCTGGGGCCAGGGAACCCTGGTCACCGTC TCCTCA<br><br>SEQ ID NO: 30353 |
| | | AA | DIQMTQSPSSLSASVGDRVTITCRASQGIRNDFG WYQQRPGKAPKCLIHAASSLQSGVPSRFSGSGS GTEFTLTISSLQPEDFATYYCLQHYSYPFTFGPGT KVDIK<br><br>SEQ ID NO: 26348 | EVQWVESGGGLVKPGGSLRLSCAASGFTFSSYSMN WVRQAPGKGLEWVSSISGSGSYINYADSVKGRFTIS RDNAKTSLYLQVNGLRAEDTAVYYCARSKFDSWG QGTLVTVSS<br><br>SEQ ID NO: 30354 |

FIGURE 50
(Continued)

| | | | |
|---|---|---|---|
| iPS:435539 | 21-225_158G1 | NA | GACATCCAGATGACCCAGTCTCCATCCTCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATGTGGGACAGAATTCACTCTCACAG TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 26349 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATGGCAT GAACTGGGTCCGCCAGGCTCCAGGGAAGGGGCT GGAGTGGATCTCATCCATTAGTGGTAGTGGTAGT TACATATACTACGCAGACTCAGTGAAGGGCCGAT TCACCATTTCCAGAGACAACGCCAAGAACTCACT GTATCTGCAAATGAACAGCCTGAGAGCCGAGGA CACGGCTGTGTATTACTGTGCGATTAGCAGTGGC TGGTCTTGGGGCCAGGGAACCCTGGTCACCGTCT CCTCA SEQ ID NO: 30355 |
| | | AA | DIQMTQSPSSLSASVGDRVTITCRASQGIRNDLG WYQQKPGKAPKRLIYTASNLQSVPSRFSGSGC GTEFTLTVSSLQPEDFATYYCLQHNSYPWTFGQ GTKVEIK SEQ ID NO: 26350 | EVQLVESGGGLVKPGGSLRLSCAASGFTFSSYGMN WVRQAPGKGLEWISSISGSGSYIYYADSVKGRFTIS RDNAKNSLYLQMNSLRAEDTAVYYCAISSGWSWG QGTLVTVSS SEQ ID NO: 30356 |
| iPS:435543 | 21-225_158D4 | NA | GACATCCAGATGACCCAGTCTCCATCCTCCT GTCTGCATCTGTAGGAGACAGAGTCACCATCA CTTGCCGGGCAAGTCAGGACATTAGAAAGGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTTGCAACT TCAGCAGCCTGCAGCCTGAAGATTTTGCAACT TATTACTGTCTACAGCATTATAGTTACCCTCGG ACGTTCGGCCAAGGGACCAAGGTGGAAATCA AA SEQ ID NO: 26351 | CAGGTGCAGCTGGTGGAGTCTGGGGGAGGCGTG GTCCAGCCTGGGAGGTCCCTGAGACTCTCCTGTG CAGCGTCTGGATTCACCTCAGTGACTATGTCAT GCACTGGGTCCGCCAGGCTCCAGGCAAGGGGCT GGAGTGGGTGTCAGTTATATGGTATGATGGAAGT AATAAATACTATGCAGACTCCGTGAAGGGCCGA TTCACCATCTCCAGAGACACAATTCCAAGAACACAC TGTATCTGCAAATGAACAGCCTGAGAGCCGAGG ACACGGCTGTGTATTACTGTGCGAGAGAACCGTA TACTAGTGGTGGTACGACTACGGTATGGACGTC TGGGGCCAAGGGACCACGGTCACCGTCTCCTCA SEQ ID NO: 30357 |

FIGURE 50
(Continued)

| | | | |
|---|---|---|---|
| iPS:435545 | 21-225_158F4 | AA | DIQMTQSPSSLSASVGDRVTITCRASQDIRKDLG WYQQKPGKAPKRLIYAASSLQSGVPSRFSGSGS GTEFTLTFSSLQPEDFATYYCLQHYSYPRTFGQG TKVEIK<br>SEQ ID NO: 26352 | QVQLVESGGGVVQPGRSLRLSCAASGFTFSDYVM HWVRQAPGKGLEWVSVIWYDGSNKYYADSVKGR FTISRDNSKNTLYLQMNSLRAEDTAVYYCAREPYT SGWYDYGMDVWGQGTTVTVSS<br>SEQ ID NO: 30358 |
| | | NA | GACATCCAGATGACCCAGTCTCCATCCTCCCT GCCTGCATCTGTAGGAGACAGAGTCACCATCA CTTGCCGGGCAAGTCAGAGACATTAGAAAGTAT TTACATTGGTATCAGTTCTTACCAGGAAAGC CCCTAAGCTCCTGATCTATACTGCATCCACTTT ACAAAGTGGGGTCCCATCAAGGTTCAGTGGCA GCGGATCTGGGACAGATTTCACTCTCACCATC AGCAGTCTGCAACCTGAAGATTACAATATTCA CTACTGTCAACAGAGTTACAATATTTCATTCA CTTTCGGCCCTGGGACCAAAGTGGATATCAAA<br>SEQ ID NO: 26353 | CAGGTGCAGCTGCAGGAGTCGGGCCCAGGACTG GTGAAGCCTTCGGAGACCCCTGTCCCTCACCTGCA CTGTCTCTGGTGGCTCCATCAGTAGTCACTTCTG GAGCTGGATCCGGCAGCCCGCGGAAGGGACT GGAGTGGATTGGCCGTATCTATACCAGTGGGACC ACCAACTACACACCCCCTCCCTCAAGAGTCGAGTCA CCATGTCAGTAGACAGTCCAAGAACCAGTTCTC CCTGAAGCTGAGCTCTGTGACCGCCGCGGACACG GCCGTGTATTACTGTGCGAGATTGAGCAGTGGCT GGTTTGACTACTGGGGCCAGGGAACCCTGGTCAC CGTCTCCTCA<br>SEQ ID NO: 30359 |
| | | AA | DIQMTQSPSSLPASVGDRVTITCRASQNIRKYLH WYQFLPGKAPKLLIYTASTLQSGVPSRFSGSGSG TDFTLTISSLQPEDFATYYCQQSYNISFTFGPGTK VDIK<br>SEQ ID NO: 26354 | QVQLQESGPGLVKPSETLSLTCTVSGGSISSHFWSW IRQPAGKGLEWIGRIYTSGTTNYTPSLKSRVTMSVD TSKNQFSLKLSSVTAADTAVYYCARLSSGWFDYW GQGTLVTVSS<br>SEQ ID NO: 30360 |

FIGURE 50
(Continued)

| | | | |
|---|---|---|---|
| iPS:435547 | 21-225_158F5 | NA | GACATTCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCAATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGGATAATAGTCACCCATT CACTTTCGGCCCTGGGACCAAAGTGGAAATCA AA SEQ ID NO: 26355 | GAGGTGCAACTGGTGGAGTCTGGGGGAGGCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTACG TACATATACTACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGTGCGAGAGATCGGGGC AGCAGCTGGGGCCAGGGAACCCTGGTCACCGTC TCCTCA SEQ ID NO: 30361 |
| | | AA | DIQMTQSPSSLSASVGDRVTITCRASQGIRNDLG WYQQKPGKAPKRLINAASSLQSGVPSRFSGSGS GTEFTLTISSLQPEDFATYYCLQDNSHPFTFGPGT KVEIK SEQ ID NO: 26356 | EVQLVESGGGLVKPGGSLRFSCAASGFTFSSYSMN WVRQAPGKGLEWVSSISGSSTYIYADSVKGRFTIS RDNAKNSLYLQMNSLRAEDTAVYYCARDRGSSW GQGTLVTVSS SEQ ID NO: 30362 |
| iPS:435549 | 21-225_158H5 | NA | GACATCCAGATGATCCAGTCTCCATCCTTCCT GTTTGCATCTGTAGGAGACAGAGTTACCATCA CTTGCCGGGCAAGTCAGGGCATGAGAATTGAT TTAGGTGGTATCAGCAGAAACCAGGAAAAG CCCCTAAGCGCCTGATTTATGGTGCATCCAGT TGCAAAGTGGGGTCCCATCAAGGTTCAGCGGC AGTGGATGTGGGACAGAATTCACTCTCACAAT CAGCAGCCGTGAGCCTGAAGATTTTGCAAGTT ATTACTGTGTACAGCATATAATAGTTACCCTCTC ACTTTCGGCGGAGGGACCAAGGTGGAGATCA AA SEQ ID NO: 26357 | GAGGTGCAACTGGTGGAGTCTGGGGGAGGCTG GTCAAGCCTGGGGGGTCCCTGAGACTCTCCTGTG CAGCCTCTGGGTTCACCTTCAGTAGCTATAGCAT GAACTGGGTCCGCCAGGCTCCAGGGAAGGGGCT GGAGTGGGTCTCATCCATCAGTGGTAGTAGTACT TACATATACTACGCAGACTCAGTGAAGGGCCGAT TCACCATCTCCAGAGACAACGCCAAGAACTCACT GCATCTGCAAATGAACAGCCTGAGAGCCGAGGA CACGGCTGTGTATTACTGTGCGAGAGATCGGGGC AGCAGCTGGGGCCAGGGAACCCTGGTCACCGTC TCCTCA SEQ ID NO: 30363 |

FIGURE 50
(Continued)

| | | | |
|---|---|---|---|
| iPS:435551 | | AA | DIQMIQSPSPSFLFASVGDRVTITCRASQGMRIDLG WYQQKPGKAPKRLIYRASSLQSGVPSRFSGSGC GTEFTLTISSVQREDFASYYCVQHNSYPLTFGGG TKVEIK<br>SEQ ID NO: 26358 | EVQLVESGGGLVKPGGSLRLSCAASGFTFSSYSMN WVRQAPGKGLEWVSSISGSSTYYYADSVKGRFTIS RDNAKNSLHLQMNSLRAEDTAVYYCARDRGSSW GQGTLVTVSS<br>SEQ ID NO: 30364 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAGTGAT TTAGGCTGGTATCAGCAGAAACCAGGGAAAG CCCCTAAGCGCCTGATCTATCGTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTGTCTACAGCATATAGTTACCCATTC ACTTTCGGCCCTGGGACCAAAGTGGACATCAA A<br>SEQ ID NO: 26359 | CAGGTGCAGCTGGTGGAGTCTGGGGGAGGCGTG GTCCAGCCTGGGAGGTCCCTGAGACTCTCCTGTG CAGTGTCTGGATTCACCTTCAGTAGCTATAGCAT GCACTGGGTCCGCCAGGCTCCAGGCAAGGGGCT GGAGTGGGTGGCAGTTATATGATGTATGTAACT AATAAATACTATGCAGACTCCGTGAAGGGCCGA TTCACCATCTCCAGAGACAATTCCAAGAACACGC TGTATCTGCAAATGAACAGCCTGAGAGACGAGG ACACGGCTGTGTATTATTGTGTGAGAGAACTGGG ATGGGGGAGGACTACTGGGGCCAGGGAACCCT GGTCACCGTCTCCTCA<br>SEQ ID NO: 30365 |
| | 21-225_158H6 | AA | DIQMTQSPSSLSASVGDRVTITCRASQGIRSDLG WYQQKPGKAPKRLIYTASSLQSGVPSRFSGSGSG TEFTLTISSLQPEDFATYYCLQHNSYPFTFGPGTK VDIK<br>SEQ ID NO: 26360 | QVQLVESGGGVVQPGRSLRLSCAVSGFTFSSYGMH WVRQAPGKGLEWVAVIWYDVTNKYYADSVKGRF TISRDNSKNTLYLQMNSLRDEDTAVYYCVRELGW AEDYWGQGTLVTVSS<br>SEQ ID NO: 30366 |

FIGURE 50
(Continued)

| | | | |
|---|---|---|---|
| iPS:435553 | 21-225_158G8 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATGTATACTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A SEQ ID NO: 26361 | GAGGTGCAGCTGGTGGAGTCTGGGGGAGGCTG GTCACGCCTGGGGGGTCCCTGAGACTCTCCTG CAGCCTCTGGATTCACCTTCAGTAGCTATACCAT GAACTGGGTCCGCCAGGCTCCAGGGAAGGGGCT GGAGTGGGTCTCATTGATTAGTGGCAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGATCGAGGC AGCCTCTGGGGCCAGGGAACCCTGGTCACCGTCT CCTCA SEQ ID NO: 30367 |
| | | AA | DIQMTQSPSSLSASVGDRVTITCRASQDIRNDLG WYQQKPGKAPKRLMYTASSLQSGVPSRFSGSGS GTEFTLTISSLQPEDFATYYCLQHNSYPFTFGPGT KVDIK SEQ ID NO: 26362 | EVQLVESGGGLVTPGGSLRLSCAASGFTFSSYTMN WVRQAPGKGLEWVSLISGSSSYIYYADSVKGRFTIS RDNAKNSLYLQMNSLRAEDTAVYYCARDRGSLW GQGTLVTVSS SEQ ID NO: 30368 |
| iPS:435557 | 21-225_158B12 | NA | GACATCGTGATGACCCAGTCTCCAGACTCCCC GGCTGTGTCTCTGGGCGAGAGGGCCACCATCA ACTGCAAGTCCAGCCAGAATGTTTTACACAGC TCCAACATAACAACTACTTAACTTGGTACCA GCAGAAACCAGGACAGCCTCCTAAGTTGCTCA TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA SEQ ID NO: 26363 | CAGGTGCAGCTGGTGCAGTCTGGGGCTGAGGTG AGGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG ATTCACCATGACCAGGAACACCTCCATAAGCACA GCCTACATGGAGCTGAGCAGCCTGAGATCTGAG GACACGGCCGTGTATTACTGTGCCTATAGCAGTG GCTGGTACCGCCTTTGACTACTGGGGCCAGGGAAC CCTGGTCACCGTCCTCA SEQ ID NO: 30369 |

FIGURE 50
(Continued)

| | | AA | DIVMTQSPDSPAVSLGERATINCKSSQNVLHSSN NNNYLTWYQQRPGQPPKLLIYWASTRESGVPDR FSGSGSGTEFTLTISSLQAEDVAVYYCQQYYSTP PTFGQGTKVEIK<br><br>SEQ ID NO: 26364 | QVQLVQSGAEVRKPGASVKVSCKASGYTFTNYDIN WVRQATGQGLEWMGWMHPNSGNTGYAQKFQGR FTMTRNTSISTAYMELSSLRSEDTAVYYCAYSSGW YRFDYWGQGTLVTVSS<br><br>SEQ ID NO: 30370 |
|---|---|---|---|---|
| iPS:435559 | 21-225_158H12 | NA | GACATCCAGATGACCCAGTCTCCATCCTCACT GTCTGCATCTGTAGGAGACAGAGTCACCATCA CTTGTCGGGCGAGTCAGGCATTAACAATTAT TTAGCCTGGTTTCAGCAGAAACCAGGGAAAGC CCCTAAGTCCCTGATCTCTGCTGCATCCAGTTT ACAAAAGTGGGGTCCCATCAAAGTTCAGCGGCA GTGGATCTGGGACAGATTTCACTCTCAGTATC AGCAGCCTACAGCCTGAAGATTTTGCAACTTA TTACTGTCAACAGTATCATAGTTACCCATTCAC TTTCGGCCCTGGGACCAAAGTGGATATCAAA<br><br>SEQ ID NO: 26365 | GAGGTGCAGCTGGTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGGCTCCAGGGAAGGGGCT GGAGTGGGTCTCAGTATTAGTGGTAGTGGTGGT AGGACAGACTACGCAGACTCCGTAAAGGCCGG TTCACCATCTCCAGAGACAATTCCAAGAACACGC TGTATCTGCAAATGAACAGCCTGAGAGCCGAGG ACACGGCCGTATATTACTGTGCGAAAGGGGGCT GGAACCACGACTGGGGCCAAGGGACCACGGTCA CCGTCTCCTCA<br><br>SEQ ID NO: 30371 |
| | | AA | DIQMTQSPSSLSASVGDRVTITCRASQGINNYLA WFQQKPGKAPKSLISAASSLQSGVPSKFSGSGSG TDFTLSISSLQPEDFATYYCQQYHSYPFTFGPGTK VDIK<br><br>SEQ ID NO: 26366 | EVQLVESGGGLVQPGGSLRLSCAASGFTFSSYVMS WVRQAPGKGLEWVSAISGSGRTDYADSVKGRFTI SRDNSKNTLYLQMNSLRAEDTAVYYCAKGGWNH DWGQGTVTVSS<br><br>SEQ ID NO: 30372 |

FIGURE 50
(Continued)

| | | | | |
|---|---|---|---|---|
| iPS:435561 | 21-225_159F1 | NA | GACATCCAGATGACCCAGTCTCCATCCTCCCT GTCTGCATCGGTAGGAGACAGAGTCACCATCA CTTGCCGGGCAAGTCAGCGCGTCAGAAATGAT TTAGGCTGGTATCAGCAGAAACCAGGGAAAG CCCCTAAGCGCATCATTTTCGATGCATCCAATT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATCATAGTTTCCGATCA CCTTCGGCCAAGGGACCCGACTGGAGATTAAA<br>SEQ ID NO: 26367 | GAGGTGCAGCTGGTGGAGTCTGGGGGAGGCTG GTCAAGCCGGGGGGTCCCTGAGACTCTCCTGTG CAGCCTCTGGATTCACCTTCAGTAGCTATAGAAT GAACTGGGTCCGCCAGGCTCCAGGGAAGGGGCT GGAGTGGGTCTCATCCATAAGTGGTAGTGGTAAT TACATAGACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGAGGTTGGGA CGTCTGGGGCCAAGGGACCACGGTCACCGTCTCC TCA<br>SEQ ID NO: 30373 |
| | | AA | DIQMTQSPSSLSASVGDRVTITCRASQRVRNDLG WYQQKPAKAPKRIIFDASNLQSGVPSRFSGSGSG TEFTLTISSLQPEDFATYYCLQHHSFPITFGQGTR LEIK<br>SEQ ID NO: 26368 | EVQLVESGGGLVKPGGSLRLSCAASGFTFSSYRMN WVRQAPGKGLEWVSSISGSGNYIDYADSVKGRFTI SRDNAKNSLYLQMNSLRAEDTAVYYCARGWDVW GQGTTVTVSS<br>SEQ ID NO: 30374 |
| iPS:435563 | 21-225_159H2 | NA | GACATCCAGATGACCCAGTCTCCATCCTCCCT GTCTGCATCTGTAGGAGACAGAGTCACCATCA CTTGCCGGGCAAGTCAGAGCATTAGCAAATAT TTAAATTGGTATCAGCAGAAAACCAGGGAAAG CCCCTGAACTCCTGATCTATGCTACATCCAATT TGCAAAGTGGGGTCCCATCAAGGTTCAGTGGC AGTGGATCTGGGACAGATTTCACTCTCACCAT CAGCAGCCTGCAACCTGAAGATTTTGTAACTT ACTACTGTCAACAGAGTTACAGTCTCCCGGTC ACTTTCGGCGGAGGGACCAAGGTAGAGATCA AA<br>SEQ ID NO: 26369 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGATGACAGAAGTTCAGGGCA GTAACACAGGCTATGTACCAGGAACACCTCCATAAGCA GAGTCACCATGACCAGGGACTGAGCAGCCTGAGATCTG AGGACACGGCCGTGTATTACTGTGCGAGAAAGA AAACTGGGACTACTGGGGCCAGGGAACCCTGG TCACCGTCTCCTCA<br>SEQ ID NO: 30375 |

FIGURE 50
(Continued)

| | | | |
|---|---|---|---|
| iPS:435565 | | AA | DIQLTQSPSSLSASVGDRVTITCRASQSISKYLNW YQQKPGKAPELLIYATSNLQSGVPSRFSGSGSGT DFTLTISTLQPEDFVTYYCQQSYSLPVTFGGGTK VEIK | QVQLVQSGAEVKKPGASVKVSCKASGYTFTSYDIN WVRQATGQGLEWMGWMNPNSGNTGYVQKFQGR VTMTRNTSISTAYMELSSLRSEDTAVYYCARKKTG DYWGQGTLVTVSS |
| | | | SEQ ID NO: 26370 | SEQ ID NO: 30376 |
| | 21-225_159C4 | NA | GACATCCAGATGACCCAGTCTCCATCCTCCCT GTCTGCATCTGTAGGAGACAGAGTCACCATCA CTTGCCAGGCGAGTCAGGACATTAGCGACTAT TTAAATTGGTATCAACAGAAACCAGGGAAAG CCCCTAAACTCCTGATCTACGATGCCTCCACTT TGGAAACAGGGGTCCCATCAAGGTTCAGTGGA AGTGGATCTGGGACAGATTTTACTTTCACCAT CAGCAGCCTGCAGCCTGAAGATATTGCAACAT ATTTCTGTCAACAACAATATGATAATCTCCGATC ACCTTCGGCCAAGGGACACGACTGGAGATTAA A | CAGGTGCAGCTGGTGGAGTCTGGGGGAGGCGTG GTCCAGCCTGGGAGGTCCCTGAGACTCTCCTGTG CAGCCTCTGGATTCACCTTCAGTAACTATGGCAT GCACTGGGTCCGCCAGGCTCCAGGCAAGGGGCT GGAGTGGGTGGCAGTTATATCAGACTCCGTGAAAC AATAAATACTATGCAGACTCCGTGAAGGGCCGA TTCACCATCTCCAGAGACAATTCCAAGAACACGC TGTATCTGCAGTTGAACAGCTGTGCGAGACGAGGA CATGGCTGTGTATTACTGTGCGAGACGAGCAGC TCGTGGGGGGCTAGGTATGGACGTCTGGGGC CACGGGACCACGGTCACCGTCTCCTCA |
| | | | SEQ ID NO: 26371 | SEQ ID NO: 30377 |
| | | AA | DIQMTQSPSSLSASVGDRVTITCQASQDISDYLN WYQQKPGKAPKLLIYDASTLETGVPSRFSGSGS GTDFTFTISSLQPEDIATYFCQQYDNLPITFGQGT RLEIK | QVQLVESGGGVVQPGRSLRLSCAASGFTFSNYGM HWVRQAPGKGLEWVAVISYSGNNKYYADSVKGR FTISRDNSKNTLYLQLNSLRAEDMAVYYCARRSSS WGGYGMDVWGHGTTVTVSS |
| | | | SEQ ID NO: 26372 | SEQ ID NO: 30378 |

FIGURE 50
(Continued)

| | | | |
|---|---|---|---|
| iPS:435569 | 21-225_159C5 | NA | GACATCCAGATGACCCAGTCTCCATCCTCCCT GTCTGCATCTGTAGGAGACAGAGTCACCATCA CTTGCCGGACAAGTCAGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCATCAGCCTGCAGCCTGATGACTTTGCAACT TATTACTGTCTACAGCATAATAGTTATCCATTC ACTTTCGGCCCTGGGACCAAAGTGGATATCAA A<br>SEQ ID NO: 26373 |
| | | AA | DIQMTQSPSSLSASVGDRVTITCRTSQGIRNDLG WYQQKPGKAPKRLIYAASSLQSGVPSRFSGSGS GTDFTLTISLQPDDFATYYCLQHNSYPFTFGPGT KVDIK<br>SEQ ID NO: 26374 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT ACACTGGGTCCGCCAGGCTCCAGGCAAGGGCT GGAGTGGGTGGCTGTGTATGGTATGGTATGATGTAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGTGGG GTTCCTCCTGACTACTGGGGCCAGGGAACCCTG GTCACCGTCTCCTCA<br>SEQ ID NO: 30379 |
| | | | QVQLVESGGGVVQPGRSLRLSCAASGFTFSSYGIH WVRQAPGKGLEWVAVVWYDVNKYYADSVKGR FTISRDNSKNTLYLQMNSLRAEDTAVYYCARELGF LSDYWGQGTLVTVSS<br>SEQ ID NO: 30380 |
| iPS:435571 | 21-225_159C8 | NA | GACATCCAGATGACCCAGTCTCCATCCTCCCT GTCTGCATCTGTAGGAGACAGAGTCACCATCA CTTGCCGGGCAAGTCAGGACATTAGAAAGGAT TTAGGGTGGTATCAGCAGAAACCAGGGAAAG CCCCTAACCGCCTGATCTATGCTGCATCCAGTT TGCAAAGTGGGGTCCCATCAAGGTTCAGCGGC AGTGGATCTGGGACAGCCTGCAGCCTGAAGATTCACTCTCACATT CAGCAGCCTGCAGCCTGAAGATTTTGCAACTT ATTACTGTCTACAGCATCATAGTTATCCTCGG ACGTTCGGCCAAGGGACCAAGGTGGAAATCA AA<br>SEQ ID NO: 26375 | CAGGTGCAACTGGTGGAGTCTGGGGGAGGCGTG GTCCAGCCTGGGAGGTCCCTGAGACTCTCCTGTG CAGCGTCTGGATTCACCTTAGTAGTGACTATGTCAT GCAGTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAATAGTGGTGGTACGACTACGTATGGACGTC TGGGGCCAAGGGACCACGGTCACCGTCTCCTCA<br>SEQ ID NO: 30381 |

FIGURE 50
(Continued)

| | | | | |
|---|---|---|---|---|
| iPS:435573 | 21-225_159D8 | AA | DIQMTQSPSSLSASVGDRVTITCRASQDIRKDLG WYQQKPGKAPNRLIYAASSLQSGVPSRFSGSGS GTEFTLTFSSLQPEDFATYYCLQHHSYPRTFGQG TKVEIK | QVQLVESGGGVVQPGRSLRLSCAASGFTFSDYVM QWVRQAPGKGLEWVAVIWYDGSNKYYADSVKGR FTISRDNSKNTLYLQMNSLRAEDTAVYYCAREPYN SGWYDYGMDVWGQGTTVTVSS |
| | | | SEQ ID NO: 26376 | SEQ ID NO: 30382 |
| | | NA | GACATCCAGATGACCCAGTCTCCATCCTCCCT GTCTGCATCTGTTGGAGACAGAGTCACCATCA CTTGCCGGGCAAGTCGGGACATTGAAATGAT TTAGGCTGGTATCAGCAGAAACCAGGAAAG CCCCTAAGCGCCTGATCTCTGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGCG CAGCGTCTGGATTCACCTTCAGTGACTATGTCAT GCACTGTGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAGTAGTGGCTGGTACGACTACGGTATGGACGTC TGGGGCCAAGGGACCACGGTCACCGTCTCCTCA |
| | | | SEQ ID NO: 26377 | SEQ ID NO: 30383 |
| | | AA | DIQMTQSPSSLSASVGDRVTITCRASRDIGNDLG WYQQKPGKAPKRLISAASSLQSGVPSRFSGSGSG TEFTLTFSSLQPEDFATYYCLQHYSYPRTFGQGT KVEIK | QVQLVESGGGVVQPGRSLRLSCAASGFTFSNYVM HCVRQAPGKGLEWVAVIWYDGSNKYYADSVKGR FTISRDNSKNTLYLQMNSLRAEDTAVYYCAREPYS SGWYDYGMDVWGQGTTVTVSS |
| | | | SEQ ID NO: 26378 | SEQ ID NO: 30384 |

FIGURE 50
(Continued)

| | | | |
|---|---|---|---|
| iPS:435575 | 21-225_159H11 | NA | GACATCCAGATGACCCAGTCTCCATCCTCACT GTCTGCATCTGTAGGAGACAGAGTCACCATCA CTTGTCGGGCGAGTCAGGGCATTAGCAAATAT TTAGTCTGGTTTCAGCAGAAACCAGGGAAAGC CCCTAAGTCCCTGATCTATGCTGCATCCAGTCT GCAAAGTGGGGTCCCATCAAAGTTCAGCGGCA GTGGATCTGGGACAGATTTCACTCTCACCATC AGCAACCTGCAGCCTGAAGATTTTGCAACTTA TTACTGCCAACAGTATAATAGTTACCCATTCA CTTTCGGCCCTGGGACCAAAGTGGATATCAAA<br><br>SEQ ID NO: 26379 | GAGGTGCAGCTGGTGGAGTCTGGGGGAGGCTG GTCAAGCCTGGGGGGTCCCTAAGACTCTCCTG CAGCCCTCTGGATTCACCTTCAGTAGCTATACCAT GAACTGGGTCCGCCAGGCTCCAGGGAAGGGGCT GGAGTGGGTCTCACCATTAGTGGTAGTAGTAGT TACATATACTACGCAGAGACTCAGTGAAGGGCCGAT TCACCATCTCCAGAGACAACGCCAAGAACTCACT GTATCTGCAAATGAACAGCCTGAGAGCCGAGGA CACGGCTGTATATTACTGTGCGCAGTGAGCTGG GCTGACTGCTGGGGCCAGGGAACCCTGGTCACC GTCTCCTCA<br><br>SEQ ID NO: 30385 |
| | | AA | DIQMTQSPSSLSASVGDRVTITCRASQGISKYLV WFQQKPGKAPKSLIYAASSLQSGVPSKFSGSGSG TDFTLTISNLQPEDFATYYCQQYNSYPFTFGPGT KVDIK<br><br>SEQ ID NO: 26380 | EVQLVESGGGLVKPGGSLRLSCAASGFTFSSYTMN WVRQAPGKGLEWVSSISGSSSYIYYADSVKGRFTIS RDNAKNSLYLQMNSLRAEDTAVYYCARVSWADC WGQGTLVTVSS<br><br>SEQ ID NO: 30386 |
| iPS:435577 | 21-225_160B1 | NA | GATATTGTGATGACCCAGACTCCACTCTCT GTCCGTCACCCTGGACAGCCGGCCTCCATCT CCTGCAAGTCTAGTCAGAGCCTCCTGCATGGT GATGGGAAGACCTATTTCTATTGGTACCTGCA GAAGCCAGGCCAGCCTCCACAGGTCCTGATCT ATGAAGTATCCAAGCGGTTCTCTGGAGTGTCA GAAAGGTTCAGTGGCAGCGGGTCAGGGACAG ATTTCACACTGAAAATCAGCCGGGTGGAGGCT GAGGATGTGGGGTTTATTACTGCATGCAAAG TATACAGATTCCGTGGACGTTCGGCCAAGGGA CCAAGGTGGAAATCAAA<br><br>SEQ ID NO: 26381 | CAGGTGCAGCTGGTGGAGTCTGGGGGAGGCGTG GTCCAGCCTGGGAGGTCCCTGAGACTCTCCTGTG CAGCGTCTGGATTCACCTCAGTAGCTATGGCAT GCACTGGGTCCGCCAGGCTCCAGGCAAGGGGCT GGAGTGGGTGGCAGTTATATGGTATGATGGAAGT TATAAATACTATGCAGACTCCGTGAAGGGCCGAT TCACCATCTCCAGAGACAATTCCAAGAACACGCT GTATCTTCAAATGAACAGCCTGAGAGCCGAGGA CACGGCTGTGTATTACTGTGCGAGAGAGGCCTAC GATTTTTGGAGTGGTTATTATGACTACTGGGGCC AGGGAACCCTGGTCACCGTCTCCTCA<br><br>SEQ ID NO: 30387 |

FIGURE 50
(Continued)

| | | | | |
|---|---|---|---|---|
| iPS:435579 | 21-225_160G1 | AA | DIVMTQTPLSLSVTPGQPASISCKSSQSLLHGDGKTYFYWYLQKPGQPPQVLIYEVSKRFSGVSERFSGSGSGTDFTLKISRVEAEDVGVYYCMQSIQIPWTFGQGTKVEIK<br>SEQ ID NO: 26382 | QVQLVESGGGVVQPGRSLRLSCAASGFTFSSYGMHWVRQAPGKGLEWVAVIWYDGSYKYYADSVKGRFTISRDNSKNTLYLQMNSLRAEDTAVYYCAREAYDFWSGYYDYWGQGTLVTSS<br>SEQ ID NO: 30388 |
| | | NA | GACATCCAGATGACCCAGTCTCCATCCTCGCTGTCTGCCTCTGTAGGAGACAGAGTCACCATCACTTGTCGGGCGAGTCAGGACAGTTAACAATTATTTAGCCTGGTTTCAGCAGAAACCAGGGAAAGCCCCTACGTCCCCTGATCTATGCTTCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAATATATCATAGTTACCCATTCACTTTCGGCCCTGGGACCAAAGTGGATATCAGA<br>SEQ ID NO: 26383 | GAGGTGCAGCTGTTGGAGTCTGGGGGAGGCTTGGTACAGCCTGGGGGGTCCCTGAGACTCTCCTGTGCAGCCTCTGGATTCACCTTTAGCAGCTATGTCATGAGCTGGGTCCGCCAGGCTCCAGGGAAGGGGCTGGAGTGGGTCTCAGTATGAGTGGTAGTGGTGGTCACACATACTACGCAGACTCCGTGAAGGGCCGGTTCACCATCTCCAGAGACAATTCCAAGAACACGGTGTATCTGCAAATGAACAGCCTGAGAGCCGAGGACACGGCCGTATATTACTGTGTGAAACATGGATACAGCTGGGGCCAGGGAACCCTGGTCACCGTCTCCTCA<br>SEQ ID NO: 30389 |
| | | AA | DIQMTQSPSSLSASVGDRVTITCRASQDINNYLAWFQQKPGKAPTSLIYASSSLQSGVPSKFSGSGSGTDFTLTISSLQPEDFATYYCQQYHSYPFTFGPGTKVDIR<br>SEQ ID NO: 26384 | EVQLLESGGGLVQPGGSLRLSCAASGFTFSSYVMSWVRQAPGKGLEWVSAMSGSGGHTYYADSVKGRFTISRDNSKNTVYLQMNSLRAEDTAVYCVKHGYSWGQGTLVTSS<br>SEQ ID NO: 30390 |

FIGURE 50
(Continued)

| | | | |
|---|---|---|---|
| iPS:435581 | 21-225_160H1 | NA | GACATCCAGATGACCCAGTCTCCATCCTCCCT GTCTGCATCTGTAGGAGACAGAGTCACCATCA CTTGCCGGGCAAGTCAGAGACATTAGAAATGAT TTAGGCTGGTATCAGCAGAAACCAGGGAAAG CCCCTAAGCGCCTGATCTATGCTGCATCCAGT TTGCAGAATGGGGTCCCATCAAGGTTCAGCGG CAGTGGATCTGGGACAGAATTCACTCTCACAA TCAGCAGCCTGCAGCCTGAAGATTTTACAACT TATTACTGTCTACAGCATAATAGTTTCCCGTGG ACGTTCGGCCAAGGGACCAAGGTGGAAATCA AA |
| | | | SEQ ID NO: 26385 |
| | | AA | DIQMTQSPSSLSASVGDRVTITCRASQDIRNDLG WYQQKPGKAPKRLIYAASSLQNGVPSRFSGSGS GTEFTLTISSLQPEDFTTYYCLQHNSFPWTFGQG TKVEIK |
| | | | SEQ ID NO: 26386 |
| iPS:435583 | 21-225_160F2 | NA | GACATCCAGATGACCCAGTCTCCATCCTCCCT GTCTGCATCTGTAGGAGACAGAGTCACCATCA CTTGCCGGGCAAGTCAGAGACATTAGAAATGAT TTAGGCTGGTATCAGCAGAAACCAGGGAAAG CCCCTAAGCGCCTGATCTATGCTGCATCCAAT TTGCAAAGTGGGGTCCCATCAAGGTTCAGCGG CAGTGGATCTGGGACAGAATTCACTCTCACAG TCAGCAGCCTGCAGCCTGAAGATTTTGCAACT TATTACTGTCTACAGCATAATAGTACCCCGTG GACGTTCGGCCAAGGGACCAAGGTGGAAATC AAA |
| | | | SEQ ID NO: 26387 |

| | | | |
|---|---|---|---|
| | | | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTAGTTATCGCAT GAACTGGGTCCGCCAGGCTCCAGGGAAGGGCT GGAGTGGGTCTCATCATTAGTAGTAGTACTGGT TACAATGTACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTTCTGTGCGAGAGATAAAGAT TACTGGGGCCAGGGAACCCTGGTCACCGTCTCCT CA |
| | | | SEQ ID NO: 30391 |
| | | | EVQLVESGGGLVKPGGSLRLSCAASGFTFSSYRMN WVRQAPGKGLEWVSSISSSTGYMYYADSVKGRFTI SRDNAKNSLYLQMNSLRAEDTAVYFCARDKDYW GQGTLVTVSS |
| | | | SEQ ID NO: 30392 |
| | | | GAGGTGCAGCTGGTGGAATCTGGGGGAGGCTG GTCAAGCCTGGGGGGTCCCTGAGACTCTCCTGTG CAGCCTCTGGATTCACCTTCAGTAGTTATGGCAT GAACTGGGTCCGCCAGGCTCCAGGGAAGGGCT GGAGTGGATCTCATTCATTAGTGGTAGTGGTAGT TACATATACTACGCAGACTCAGTGAAGGGCCGAT TCACCATTTCCAGAGACAACGCCAAGAACTCACT GTATCTGCAAATGAACAGCCTGAGAGCCGAGGA CACGGCTGTGTATTACTGTGCGATTAGCAGTGGC TGGTCTTGGGGCCAGGAACCCTGGTCACCGTCT CCTCA |
| | | | SEQ ID NO: 30393 |

FIGURE 50
(Continued)

| | | | | |
|---|---|---|---|---|
| iPS:435585 | 21-225_160G3 | AA | DIQMTQSPSSLSASVGDRVTITCRASQGIRNDLG WYQQKPGKAPKRLIYTASNLQSGVPSRFSGSGS GTEFTLTVSSLQPEDFATYYCLQHNSYPWTFGQ GTKVEIK<br><br>SEQ ID NO: 26388 | EVQLVESGGGLVKPGGSLRLSCAASGFTFSSYGMN WVRQAPGKGLEWISSISGSGSYIYYADSVKGRFTIS RDNAKNSLYLQMNSLRAEDTAVYYCAISSGWSWG QGTLVTVSS<br><br>SEQ ID NO: 30394 |
| | | NA | GACATCCAGATGACCCAGTCTCCATCCTCGCT GTCTGCCTCTGTAGGAGACAGAGTCACCATCA CTTGTCGGGCGAGTCAGGACATTAACAATTAT TTAGCCTGGTTTCAGCAGAAGACCAGGGAAAGC CCCTACGTCCCGATCTATGCTTCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAATATCATAGTTACCCATTCA CTTTCGGCCCTGGGACCAAAGTGGATATCAAA<br><br>SEQ ID NO: 26389 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGTCAT GAGCTGGGTCCGCCAGACTCCAGGGAAGGGACT GGAGTGGGTCTCAGTTATGAGTGGTAGTGGTGGT CACACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCATATATTACTGTGTGAAACATGGATA CAGCTGGGGCCAGGGAACCCTGGTCACCGTCTCC TCA<br><br>SEQ ID NO: 30395 |
| | | AA | DIQMTQSPSSLSASVGDRVTITCRASQDINNYLA WFQQRPGKAPTSLIYASSSLQSGVPSKFSGSGSG TDFTLTISSLQPEDFATYYCQQYHSYPFTFGPGT KVDIK<br><br>SEQ ID NO: 26390 | EVQLLESGGGLVQPGGSLRLSCAASGFTFSSYVMS WVRQTPGKGLEWVSAMSGSGGHTYADSVKGRF TISRDNSKNTLYLQMNSLRAEDTAIYYCVKHGYSW GQGTLVTVSS<br><br>SEQ ID NO: 30396 |

FIGURE 50
(Continued)

| | | | |
|---|---|---|---|
| iPS:435587 | 21-225_160H3 | NA | GACATCGTGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATTTATGCTGCATCCAGTT TGCAAAGTGGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAGTAATTACCCGCTC ACTTTCGGCGGAGGGACCCAGGTGGAGAGCA AA<br><br>SEQ ID NO: 26391 | CAGCTGCAGCTGCAGGAGTCGGGCCCAGGACTG GTGAAGCCTTCGGAGACCCTGTCCCTCACCTGCA CCGTCTCTGGTGGCTCCATCAGCAGAAGTAGTTA CTACTGGGGCTGGATCCGCCAGCCCCCAGGGAA GGGACTGGAGTGGATTGGGAGTATCTATTATAGT GGGAGTACCTCTACAACCCGTCTCTCGAGTC GAGTTACCATATCCGTAGACACGTCCAAGAACCA GTTCTCCCTGAAGCTGAGCTCTGTGACCGCCGCC GACACGGCTGTGTTTACTGTGCGAGACTCTC AACGGTGGACTTTGACTACTGGGGCCAGGGAA CCCTGGTCACCGTCTCCTCA<br><br>SEQ ID NO: 30397 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHSNYPLTFGGG TQVESK<br><br>SEQ ID NO: 26392 | QLQLQESGPGLVKPSETLSLTCTVSGGSISRSSYYW GWIRQPPGKGLEWIGSIYYSGSTSYNPSLESRVTISV DTSKNQFSLKLSSVTAADTAVFYCARLSQRWDFDY WGQGTLVTVSS<br><br>SEQ ID NO: 30398 |
| iPS:435589 | 21-225_160A4 | NA | GACATCGTGATGACCCAGTCTCCAGACTCCT GGCTGTGTCTCTGGGCGAGAGGGCCACCATCA ACTGCAAGTCCAGCCAGAGTGTTTTACACAGC ACTGCAAGTCCAGCCAGAGTGTTTTACACAGC TCCAACAATAATAACTACTTAGCTTGGTACCA GCAGAAACCAGGACAGCCTCCTAAGCTACTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATAAGTAGTCCGTGCAGTTTGGCCAGGG GACCAAGCTGGAGATCAAA<br><br>SEQ ID NO: 26393 | CAGGTGCAGCTGGTGCAGTCTGGGACTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGAC CTGAGTGGATGGGATGGATGCACCCTAACAGTG GTAACACAGGCTATCCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCGTATAGCAG CGGCTGGTACATTTTGACTACTGGGGGCCAGGGA ACCCTGGTCACCGTCTCCTCA<br><br>SEQ ID NO: 30399 |

FIGURE 50
(Continued)

| | | | |
|---|---|---|---|
| iPS:435591 | 21-225_160C4 | AA | DIVMTQSPDSLAVSLGERATINCKSSQSVLHSSN NNNYLAWYQQKPGQPPKLLIYWASTRESGVPD RFSGSGSGTDFTLTISSLQAEDVAVYYCQQYYNS PCSFGQGTKLEIK<br>SEQ ID NO: 26394 | QVQLVQSGTEVKKPGASVKVSCKASGYTFTNYDIN WVRQATGQGPEWMGWMHPNSGNTGYPQKFQGR VTMTRNTSISTAYMELSSLRSEDTAVYYCAYSSGW YIFDYWGQGTLVTVSS<br>SEQ ID NO: 30400 |
| | | NA | GACATCCAGATGACCCAGTCTCCATCCTCCT GTCTGCATCTGTAGGAGACAGAGTCACCATCA CTTGCCGGGCAAGTCAGGACATTAGAAAGGAT TTAGGGGTGGTATCAGCAGAAACCAGGAAAG CCCCTAACCGCCTGATCTATGCTGCATCCAGTT TGCAAAGTGGGGTCCCATCAAGGTTCAGCGGC AGTGGATCTGGGACAGATTCACTCTCACATT CAGCAGCCTGCAGCCTGAAGATTTTGCAACTT ATTACTGTCTACAGCATTATAGTTATCCTCGGA CGTTCGGCCAAGGGACCAAGGTGAAATCAA A<br>SEQ ID NO: 26395 | CAGGTGCAACTGGTGCAGTCTGGGGGAGGCGTG GTCCAGCCTGGGAGGTCCCTGAGACTCTCCTGTG CAGCGTCTGGATTCACCTTTAGTGACTATGTCAT GCAGTGGGTCCGCCAGGCTCCAGGCAAGGGGCT GGAGTGGGTGGCAGTTATATGCTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAATAGTGGCTGGTACGACTACGGTATGGACGTC TGGGGCCAAGGGACCACGGTCACCGTCTCCTCA<br>SEQ ID NO: 30401 |
| | | AA | DIQMTQSPSSLSASVGDRVTITCRASQDIRKDLG WYQQKPGKAPNRLIYAASSLQSGVPSRFSGSGS GTEFTLTFSSLQPEDFATYCLQHYSYPRTFGQG TKVEIK<br>SEQ ID NO: 26396 | QVQLVESGGGVVQPGRSLRLSCAASGFTFSDYM QWVRQAPGKGLEWVAVIWYDGSNKYYADSVKGR FTISRDNSKNTLYLQMNSLRAEDTAVYYCAREPYN SGWYDYGMDVWGQGTTVTVSS<br>SEQ ID NO: 30402 |

FIGURE 50
(Continued)

| | | | |
|---|---|---|---|
| iPS:435593 | 21-225_160F4 | NA | GACATTCAGATGACCCAGTCTCCATCCTCCC GTCTGCATCTGTAGGAGACAGAGTCACCATCA CTTGCCCGGGCAAGTCAGGGCATTAGAAATGAT TTAGGCTGGTATCAGCAGAAACCAGGGAAAG CCCCTAAGCGCTTGATCAATGTTGCATCCAGT TGCAAAGTGGGGTCCCATCAAGGTTCAGCGG CAGTGGATCTGGGACAGATTCACTCTTACAA TCAGCAGCGTGCAGCCTGAAGATATAGTCACCATT TATTACTGTCGTATACAGGATAATAGTCACCCTT CACTTTCGGCCCTGGGACCAAAGTGGAAATCA AA <br><br> SEQ ID NO: 26397 | GAGGTGCAACTGGTGGAGTCTGGGGGAGGCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTACG TACATATACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGTGCGAGAGATCGGGGC AGCAGCTGGGGCCAGGGAACCCTGGTCACCGTC TCCTCA <br><br>SEQ ID NO: 30403 |
| | | AA | DIQMTQSPSSPSASVGDRVTITCRASQGIRNDLG WYQQKPGKAPKRLINVASSLQSGVPSRFSGSGS GTEFTLTISSVQPEDFATYYCIQDNSHPFTFGPGT KVEIK<br><br>SEQ ID NO: 26398 | EVQLVESGGGLVKPGGSLRFSCAASGFTFSSYSMN WVRQAPGKGLEWVSSISGSSTYIYADSVKGRFTIS RDNAKNSLYLQMNSLRAEDTAVYYCARDRGSSW GQGTLVTVSS<br><br>SEQ ID NO: 30404 |
| iPS:435595 | 21-225_160H4 | NA | GACATCCAGATGACCCAGTCTCCATCCTCACT GTCTGCATCTGTAGGAGACAGAGTCACCATCA CTTGTCTGGGCGAGTCAGGACAGATCAGTAATTAT TTAGTCTGGTTTCAGCAGAGAAATTAGGGAAAGC CCCTAAGTCCCTGATCTATGTTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATATAAGTTACCCTCTCA CTTTCGGCGGAGGGACCAAAGTAGAGATCAA A<br><br>SEQ ID NO: 26399 | GAGGTGCAGCTGGTGGAGTCTGGGGGAGGCTG GTCAAGTCTGGGGGGTCCCTGAGACTCTCCTGTG CAGCCTCTGGATTCACCTTCAGTAGCTATAGGAT GAACTGGGTCCGCCAGGCTCCAGGGAAGGGGCT GGAGTGGGTCTCATCCATTAGTGGTAGTAGT TACATAGACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAAAGAGTTG GTTTGACTACTGGGGCCAGGGAACCCTGGTCACC GTCTCCTCA<br><br>SEQ ID NO: 30405 |

FIGURE 50
(Continued)

| | | AA | DIQMTQSPSSLSASVGDRVTITCRASQDISNYLV WFQQKLGKAPKSLIYAASSLQSGVPSRFSGSGSG TDFTLTISSLQPEDFATYYCQQYNSYPLTFGGGT KVEIK | EVQLVESGGGLVKSGGSLRLSCAASGFTFSSYRMN WVRQAPGKGLEWVSSISGSSSYIDYADSVKGRFTIS RDNAKNSLYLQMNSLRAEDTAVYYCARKSWFDY WGQGTLVTVSS |
|---|---|---|---|---|
| | | | SEQ ID NO: 26400 | SEQ ID NO: 30406 |
| iPS:435599 | 21-225_160B10 | NA | GACATCCAGATGACCCAGTCTCCATCCTCCC GTCTGCATCTGTAGGAGACAGAGTCACCATCA CTTGCCGGGCAAGTCAGGGCATTAGAAATGAT TTAGGCTGGTATCAGCAGAAACCAGGGACAG CCCCTAAGCGCCTTATCTATGCTGCATCCAGTT TGCAAAGTGGGGTCCCATCAAGGTTCAGCGGC AGTGGATCTGGGACAGATTCACTCTCACAAT CAGCAACCTGCAGCCTGAGGATTTTGCAACTT ATTACTGTCTACAGCATAGTAGTTACCCGCTC ACTTTCGGCGGAGGGACCAAGGTGGAGATCA AA | CAGCTGCAGCTGCAGGAGTCGGGCCCAGGACTG GTGAAGCCTTCGGAGACCCTGTCCCTCACCTGCA CTGTCTCTGGTGGCTCCATCAGTAGAAGTAGCTA CTACTGGGGCTGGATCCGCCAGTACCCAGGGAA GGGGCTGGAGTGGATTGGGAATATCTATTATAGT GGGAGCGCCTACCACATTCCGTCTCCTCAAGAGTC GAGTCACCATATCCGTAGACACGTCCAAGAACC AGTTCTCCCTGAAGTTGAACTCTGTGACCGCGC AGACACGGCTGTGTATTACTGTGTGAGACATGAC CCAAACTGGGGAGTTGACTACTGGGGCCAGGGA ACCCTGGTCACCGTCTCCTCA |
| | | | SEQ ID NO: 26401 | SEQ ID NO: 30407 |
| | | AA | DIQMTQSPSSPSASVGDRVTITCRASQGIRNDLG WYQQKPGTAPKRLIYAASSLQSGVPSRFSGSGSG TEFTLTISNLQPEDFATYYCLQHSSYPLTFGGGT KVEIK | QLQLQESGPGLVKPSETLSLTCTVSGGSISRSSYYW GWIRQYPGKGLEWIGNIYYSGSAYHIPSLKSRVTIS VDTSKNQFSLKLNSVTAADTAVYYCVRHDPNWGV DYWGQGTLVTVSS |
| | | | SEQ ID NO: 26402 | SEQ ID NO: 30408 |

FIGURE 50
(Continued)

| | | | | |
|---|---|---|---|---|
| iPS:435601 | 21-225_160G10 | NA | GCTATTGTGATGACCCAGACTCCACTCTCTG TCCGTCACCCCTGGACAGCCGGCTCCATCTC CTGCAAGTCTAGTCAGAGCCTTCTGCACGTG ATGGAAAGAACCTATTTGTATTGGTACCTGCAG AAGCCAGGCCAGCCTCCACACCTCCTGATCTA TGAAGTTCAAACGGTTCTCTGGAGTGCCAG ATAGGTTCAGTGGCAGCGGGTCAGGGACAGA TTTCACACTGAAAATCAGCCGGGTGGAGGCTG AGGATGTTGGGCTTTATTACTGACATGCAAAGT ATACAGCTTCCGTGGACGTTGTCCAAGGGAC CAAGGTGGAAATCACA | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTTTGGCAT GCACTGGGTCCGCCAGGCTCCAGGCAAGGGCCT GGAGTGGGTGGCAGTCATATGGTATGATGGAAG TTATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGTTGGTAT AGAAGTGGCTGGTGACTACTTCGGTATGGAA GTCTCTGGGGCCAAGGGACCACGGTCACCGTCTCCT CA |
| | | | SEQ ID NO: 26403 | SEQ ID NO: 30409 |
| | | AA | AIVMTQTPLSLSVTPGQPASISCKSSQSLLHGDG KTYLYWYLQKPGQPPHLLIYEVSKRFSGVPDRFS GSGSGTDFTLKISRVEAEDVGLYYCMQSIQLPW TFVQGTKVEIT | QVQLVESGGGVVQPGRSLRLSCAASGFTFSSFGMH WVRQAPGKGLEWVAVIWYDGSYKYYADSVKGRF TISRDNSKNTLYLQMNSLRAEDTAVYYCARVGIEV AGDYYFGMEVWGQGTTVTVSS |
| | | | SEQ ID NO: 26404 | SEQ ID NO: 30410 |
| iPS:435605 | 21-225_161A4 | NA | GAAATAGTGATGACGCAGTCTCCAGCCACCCT GTCTGTGTCTCCAGGGGAAAGAGCCTCCCTCT CCTGCAGGTCCAGTCAGAGTGTTAAACAGCAAC TTAGCCTGGTACCAGCAGAGACCTGGCCAGGC TCTCAGGCTCCTCATCTATGGTGCATCCATCAG GGCCACTGGTATCCCAGCCAGGTTCAGTGGCA GTGGGTCTGGGACAGAGTTCACTCTCACCATC AGCAGCCTGCAGTCTGAAGATTTTGCAGTTTA TTTCTGTCAGCAGTATAATAACTGGTGGACGT TCGGCCAAGGGACCACGGTGGAAATCAAA | GAGGTGCAGCTGGTGGAGTCTGGAGGAGGCTTG ATCCAGCCTGGGGGGTCCCTGAGACTCTCCTGTG CAGCCTCTGGTTCACCGTCAGTAGCAACTACAT GAGCTGGGTCCGCCAGGCTCCAGGGAAGGGGCT GGAGTGGGTCTCAGTTATTATACCGGTGGTAGC ACATACAACGCAGACTCCGTGAAGGGCCGATTC ACCATCTCCAGAGACAATTCCAAGAACACGCTGT ATCTTCAAATGAACAGCCTGAGAGCCGAGGACA CGGCCGTGTATTACTGTGCGAGAAATTGGGAAT GGCTGGCCCTTTGACTACTGGGGCCAGGGAACC CTGGTCACCGTCTCCTCA |
| | | | SEQ ID NO: 26405 | SEQ ID NO: 30411 |

FIGURE 50
(Continued)

| | | | |
|---|---|---|---|
| | | AA | EIVMTQSPATLSVSPGERASLSCRSSQSVNSNLA WYQQRPGQALRLLIYGASIRATDIPARFNGSGSG TEFTLTISSLQSEDFAVYFCQQYNNWTFGQGT TVEIK | EVQLVESGGGLIQPGGSLRLSCAASGFTVSSNYMS WVRQAPGKGLEWVSVIYTGGSTYNADSVKGRFTIS RDNSKNTLYLQMNSLRAEDTAVYYCARNWGMAG PFDYWGQGTLVTVSS |
| | | | SEQ ID NO: 26406 | SEQ ID NO: 30412 |
| iPS:435607 | 21-225_161G4 | NA | GACATCCAGATGACCCAGTCTCCATCCTCCT GTCTGCATCTGTAGGAGACAGAGTCACCATCA CTTGCCAGGCGAGTCAGGACATTTACAATTAT TTAAATTGGTATCAGCAGAAACCAGGGAAAG CCCCTAAGCTCCTGATCTACGATGCATCCAAT TTGGAAACAGGGGTCCCATCAAGGTTCAGTGG AAGTGGATCTGGGACAGATTTACTTTCGCCA TCAGCAGCCTGCAGCCTGAAGATATTGCAACA TATTACTGTCAACAGTATGATATTCTCCCGATC ACCTTCGGCCAAGGGACACGACTGGAGATTAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTTATGGCAT GCACTGGGTCCGCCAGGCTCCAGGCAAGGGGCT GGAGTGGGTGGCAGTTATATCATATGGTGGAAGT AATAAATACCATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGTGAGACGGAGCAG CTCGTCGGGGGCTACGGTATGGACGTCTGGGGC CAAGGGACCACGGTCACCGTCTCCTCA |
| | | | SEQ ID NO: 26407 | SEQ ID NO: 30413 |
| | | AA | DIQMTQSPSSLSASVGDRVTITCQASQDIYNYLN WYQQKPGKAPKLLIYDASNLETGVPSRFSGSGS GTDFTFAISSLQPEDIATYYCQQYDILPITFGQGT RLEIK | QVQLVESGGGVVQPGRSLRLSCAASGFTFSSYGMH WVRQAPGKGLEWVAVISYGGSNKYHADSVKGRFT ISRDNSKNTLYLQMNSLRAEDTAVYYCVRRSSSSG GYGMDVWGQGTTVTVSS |
| | | | SEQ ID NO: 26408 | SEQ ID NO: 30414 |

FIGURE 50
(Continued)

| | | | |
|---|---|---|---|
| iPS:435609 | 21-225_161F7 | NA | GACATCCAGATGACCCAGTCTCCATCCTCCCT GTCTGCATCTGTAGGCGACAGAGAGTCACCATCA CTTGCCGGGCAAGTCAGGGCATTAGAAATGAT TTGGGCTGGTATCAGCAGAAACCAGGAAAG CCCCTAAGCGCCTGATCTATGCTGCATCCACTT TGCAAAGTGGGGTCCCATCGCGGTTCAGCGGC AGTGGATCTGGGCAGAATTCACTGTCACAAT CGGCAGCGTGCAGCGTGAAGATTTTGCAACTT ATTACGGTCTACTATATATTCGTTACCATTCA CTTTTGGCCGTGGGACCAAGTGGATATCAAA SEQ ID NO: 26409 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTTTGGCTT GCACTGGGTCCGCCAGGCTCCAGGCCAGGGACT GGAGTGGGTGGCAGTTATATGGTTTGATGAAGT AATAAATACTATGCAGACTCCGTGAAGGGCCGA TTCACCATTTCAGAGACAATTCCAAGAACACGC TGTATCTGCAAATGAACAGCCTGAGAGCCGAGG ACACGGCTGTGTATTACTGTGCGAGAGATTGG CTGGCTCTGACTACTGGGGCCAGGGAACCCTG GTCACCGTCTCCTCA SEQ ID NO: 30415 |
| | | AA | DIQMTQSPSSLSASVGDRVTITCRASQGIRNDLG WYQQKPGEAPKRLIYAASTLQSGVPSRFSGSGS GAEFTVTIGSVQREDFATYYGLLYIRYPFTFGRG TKVDIK SEQ ID NO: 26410 | QVQLVESGGGVVQPGRSLRLSCAASGFTFSDFGLH WVRQAPGQGLEWVAVIWFDGSNKYYADSVKGRF TIFRDNSKNTLYLQMNSLRAEDTAVYYCAREIGWL SDYWGQGTLVTVSS SEQ ID NO: 30416 |
| iPS:435611 | 21-225_161F10 | NA | GACATCCAGATGACCCAGTCTCCATCCTCCCT GTCTGCATCTGTAGGAGACAGAGTCACCATCA CTTGCCAGGCGAGTCAGGACATTTACAACCAT TTAAGTTGGTATCAGCAGCAGAAACCAGGGAAAG CCCCTAAGCTCCTGATCTACGATGCATCCAAT TGGGAAACAGGGGTCCCATCCAGGTTCAGTGG AAGTGGATCTGGGACAGATTTTACTTTCACCA TCAGCAGCCTGCAGCCTGAAGATATTGCAACA TATTACTGTCAACAGTATGAAAATCTCCCGCT CACCTTCGGCGGAGGGACCAAGGTGGAGATC AAA SEQ ID NO: 26411 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAATGGGTGGCAATTATATCATATTCTGGAAGA AATGATTTCTATGCAGACTCCGTGAAGGGCCGAT TCACCATCTCCAGAGACAATTCCAAGAACACGCT GTATCTGCAAATGAACAGCCTGAGAGCTGAGGA CACGGCTGTGTCACTACGGTATGGACGTCTGGGCC GCAGCGGGACCACGGTCACCGTCTCCTCA AAGGGACCACGGTCACCGTCTCCTCA SEQ ID NO: 30417 |

FIGURE 50
(Continued)

| | | | | |
|---|---|---|---|---|
| iPS:435613 | 21-225_161D11 | AA | DIQMTQSPSSLSASVGDRVTITCQASQDIYNHLSWYQQKPGKAPKLLIYDASNWETGVPSRFSGGGSGTDFTFTISSLQPEDFATYYCQQYENLPLTFGGGTKVEIK<br><br>SEQ ID NO: 26412 | QVQLVESGGGVVQPGRSLRLSCAASGFTFSSYGMHWVRQAPGKGLEWVAIISYSGRNDFYADSVKGRFTISRDNSKNTLYLQMNSLRAEDTAVYYCARRIAAAGHYGMDVWGQGTTVTVSS<br><br>SEQ ID NO: 30418 |
| | | NA | GACATCCAGATGACCCAGTCTCCATCCTCCCTGTCTGCATCTGTAGGCGACAGAGTCACCATCACTTGCCGGGCAAGTCAGAGCATTAGAAATGATTTGGGCTGGTATCAGCAGAAACCAGGGAAAGCCCCTAAGCGCCTGATCTATGCTGCATCCACTTTGCAAAGTGGGGTCCCATCGCGGTTCAGCGGCAGTGGATCTGGGACAGAATTCACTCTCACAATCGGCAGCGTGCAGCGTGAAGATTTTGCAACTTATTACGGTCTACAATATAATCGTTACCCATTCACTTTTGGCCGTGGGACCAAAGTGGATATCAAA<br><br>SEQ ID NO: 26413 | CAGGTGCAGCTGGTGGAGTCTGGGGGAGGCGTGGTCCAGCCTGGGAGGTCCCTGAGACTCTCCTGTGCAGCCGTCTGAGATTCACCTTCAGTGACTTTGGCTTGCACTGGGTCCGCCAGGCTCCAGGCCAGGACTGGAGTGGGTGGCAGTTATATGGTTTGATGGAAGTAATAAATACTATGCAGACTCCGTGAAGGGCCGATTCACCATTTTCAGAGACAATTCAAGAACACGCTGTATCTGCAAATGAACAGCCTGAGAGCCGAGGACACGGCTGTGTATTACTGTGCGAGAGATTGGCTGGCTCTCTGACTACTGGGGCCAGGGAACCCTGGTCACCGTCTCCTCA<br><br>SEQ ID NO: 30419 |
| | | AA | DIQMTQSPSSLSASVGDRVTITCRASQGIRNDLGWYQQKPGEAPKRLIYAASTLQSGVPSRFSGSGSGAEFTLTIGSVQREDFATYYGLQYNRYPFTFGRGTKVDIK<br><br>SEQ ID NO: 26414 | QVQLVESGGGVVQPGRSLRLSCAASGFTFSDFGLHWVRQAPGQGLEWVAVIWFDGSNKYYADSVKGRFTIFRDNSKNTLYLQMNSLRAEDTAVYYCAREIGWLSDYWGQGTLVTVSS<br><br>SEQ ID NO: 30420 |

FIGURE 50
(Continued)

| | | | | |
|---|---|---|---|---|
| iPS:435615 | 21-225_161G12 | NA | GACATCCAGATGACCCAGTCTCCATCTCCG GTCTGCATCTGTAGGAGACAGAGTCACCATCA CTTGCCGGGCAAGTCAGGACATTAGAAAGGAT TTAGGGTGGTATCAGCAGAAACCAGGGAAAG CCCCTAACCGCCTGATCTATGCTGCATCCAGTT TGCAAAGTGGGGTCCCATCAAGGTTCAGCGGC AGTGGATCTGGGACAGAGATTCACTCTCACATT CAGCAGCCTGCAGCCTGAAGATTTTGCAACTT ATTACTGTCTACAGCATCATAGTTATCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCCGTCTGGATTCACCTTTAGTGACTATGTCAT GCAGTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAATAGTGGCTGGTACGACTACGGTATGGACGTC TGGGGCCAAGGGACCACGGTCACCGTCTCCTCA |
| | | | SEQ ID NO: 26415 | SEQ ID NO: 30421 |
| | | AA | DIQMTQSPSSLSASVGDRVTITCRASQDIRKDLG WYQQKPGKAPNRLIYAASSLQSGVPSRFSGSGS GTEFTLTFSSLQPEDFATYYCLQHHSYPRTFGQG TKVEIK | QVQLVESGGGVVQPGRSLRLSCAASGFTFSDYVM QWVRQAPGKGLEWVAVIWYDGSNKYYADSVKGR FTISRDNSKNTLYLQMNSLRAEDTAVYYCAREPYN SGWYDYGMDVWGQGTTVTVSS |
| | | | SEQ ID NO: 26416 | SEQ ID NO: 30422 |
| iPS:435617 | 21-225_162F2 | NA | GACATTCAGATGACCCAGTCTCCATCCTCCCT GTGTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCTTGATCAATGCTGCATCCAGT TTGCAAAGTGGGGTCCCATCAAGGTTCAGCGG CAGTGGATCTGGGACAGATTTCACTCTCACAA TCAGCAGCGTGCAGCCTGAAGATTTTGCAACT TATTACTGTCTATACAGGATAATAGTACACCATT CACTTTCGGCCCTGGGACCAAAGTGGAAATCA AA | GAGGTGCAACTGGTGGAGTCTGGGGGAGGCTG GTCAAGCCTGGGGGGTCCCTGAGATTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTAGTGGTAGTACG TACATATACTCCAGAGACAACGCCAAGAACTCACT GTATCTGCAAATGAACAGCCTGAGAGCCGAAGA CACGGCTGTGTATTACTGCGCGAGAGATCGGGGC AGCAGCTGGGGCCAGGGAACCCTGGTCACCGTC TCCTCA |
| | | | SEQ ID NO: 26417 | SEQ ID NO: 30423 |

FIGURE 50
(Continued)

| | | | | |
|---|---|---|---|---|
| iPS:435621 | 21-225_162H3 | AA | DIQMTQSPSSLSASVGDRVTITCRASQGIRNDLG WYQQKPGKAPKRLINAASSLQSGVPSRFSGSGS GTEFTLTISSVQPEDFATYYCIQDNSHPFTFGPGT KVEIK<br><br>SEQ ID NO: 26418 | EVQLVESGGGLVKPGGSLRFSCAASGFTFSSYSMN WVRQAPGKGLEWVSSISGSSTYIYYADSVKGRFTIS RDNAKNSLYLQMNSLRAEDTAVYYCARDRGSSW GQGTLVTVSS<br><br>SEQ ID NO: 30424 |
| | | NA | GACATTCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCTTGATCAATGCTGCATCCAGT TTGCAAAGTGGGGTCCCATCCAAGGTTCAGCGG CAGTGGATCTGGGACAGATCTCACTCTCACAA TCAGCAGCCTGCAGCCTGAAGATTTTGCAACT TATTACTGTCTACAGGATAATAGTCACCCATT CACTTTCGGCCCTGGGACCAAAGTGGAAATCA AA<br><br>SEQ ID NO: 26419 | GAGGTGCAACTGGTGGAGTCTGGGGGAGGCTG GTCAAGCCTGGGGGGTCCTTGAGATTCTCCTGTG CAGCCTCTGGATTCACCTTCAGTAGTTATAGCAT GAACCGGGTCCGCCAGGCTCCAGGGAAGGGCT GGAGTGGGTCTCATTCATTAGTGGTAGTAGTACG TACATATACTACGCAGACTCAGTGAAGGGCCGAT TCACCATCTCCAGAGACAACGCCAAGAACTCACT GTATCTGCAAATGAACAGCCTGAGAGCCGAAGA CACGGCTGTGTATTACTGCGCGAGAGATCGGGGC AGCAGCTGGGGCCAGGGAACCCTGGTCACCGTC TCCTCA<br><br>SEQ ID NO: 30425 |
| | | AA | DIQMTQSPSSLSASVGDRVTITCRASQGIRNDLG WYQQKPGKAPKRLINAASSLQSGVPSRFSGSGS GTEFTLTISSLQPEDFATYYCLQDNSHPFTFGPGT KVEIK<br><br>SEQ ID NO: 26420 | EVQLVESGGGLVKPGGSLRFSCAASGFTFSSYSMN RVRQAPGKGLEWVSSISGSSTYIYYADSVKGRFTIS RDNAKNSLYLQMNSLRAEDTAVYYCARDRGSSW GQGTLVTVSS<br><br>SEQ ID NO: 30426 |

FIGURE 50
(Continued)

| | | | |
|---|---|---|---|
| iPS:435623 | 21-225_162D5 | NA | GACATTGTGATGACCCAGTCTCCAGACTTCCG TAATGTGTCTATGGGCGAGAGGGCCATCATCA ACTTCAAGTCCAACACATAGTGTTTTATACAGG TCCAACAATAATCAATACTTAGCTTGGTACCA GCGGAAACCAGGACAGCCTCCTAAGTTGCTCA TTTACCGGACATCTATCCGGAAATCCGGGTC CCTGACCGATTCAGTGGCAGCGGGTGTGGAC AGATTTCACTCTCACCATGACAGCCTGCAGG CTGAAGATGTGGCAGTTTATTACTGTCAGCAA TATTATATACTCCTCCACTTTCGGCGGAGG GACCAAGGTGGAGATCAAA SEQ ID NO: 26421 | CAGGTGCAGCTGGTGCAGTCTGGGTCTGAGGTGA AGAAGCCTGGGGCCTCAGTGAAGGTCTCCTGCA AGGCTTCTGATACACCTTCACCAATTATGATAT CAACTGGGTGCGACAGGCCACTGGACAAGGCT TGAGTGGATGGGATGGATGCACCTAACAGTGGT AACACAGGCTATGCACAGAAGTTCCAGGCAGA GTCACCATGACCAGGAACACCTCCATAGACACA GCCTACATGGAACTGAGCAGCCTGAGTTCTGAGG ACACGGCCGTGTATTTCTGTGCGTTTAGCAGTGG CTGGTACTTCTTTGACTACTGGGGCCAGGGAACC CTGGTCACCGTCTCCTCA SEQ ID NO: 30427 |
| | | AA | DIVMTQSPDFRNVSMGERATIFKSNHSVLYRSN NNQYLAWYQRKPGQPPKLLIYRTSIRKSGVPDR FSGSGCGTDFTLTIDSLQAEDVAVYYCQQYYSTP PTFGGGTKVEIK SEQ ID NO: 26422 | QVQLVQSGSEVKKPGASVKVSCKASGYTFTNYDIN WVRQATGQGLEWMGWMHPNSGNTGYAQKFQGR VTMTRNTSIDTAYMELSSLSSEDTAVYFCAFSSGW YFFDYWGQGTLVTVSS SEQ ID NO: 30428 |
| iPS:435627 | 21-225_162F6 | NA | GACATCGTGATGACCCAGTCTCCAGACTCCT GGCTGTGTCTCTGGGCGAGAGGGCCACCATCA ACTGCAAGTCCAGCCAGAATGTTTACAGC TCCAACAATAACAACTACTTAACTTGGTACCA GCAGAGACCAGGACAGCCTCCTAAGTTGCTCA TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAA TATTATAGTACTCCTCCGACGTTCGGCCAAGG GACCAAGGTGGAAATCAAA SEQ ID NO: 26423 | CAGGTGCAGCTGGTGCAGTCTGGGGCTGAGGTG AGGAAGCCTGGGGCCTCAGTGAAGGTCTCCTGC AAGGCTTCTGATACACCTTCACCACCATTATGATA TCAACTGGGTGCGACAGGCCACTGGACAAGGC TTGAGTGGATGGGATGGATGCACCCTAACAGTGG TAACACAGGCTATGCACAGAAGTTCCAGGCAG ATTCACCATGACCAGGAACACCTCCATAAGCACA GCCTACATGGAGCTGAGCAGCCTGAGATCTGAG GACACGGCCGTGTATTACTGTGCCTATAGCAGTG GCTGGTACCGCTTTGACTACTGGGGCCAGGGAAC CCTGGTCACCGTCTCCTCA SEQ ID NO: 30429 |

FIGURE 50
(Continued)

| | | | | |
|---|---|---|---|---|
| iPS:435629 | 21-225_162H6 | AA | DIVMTQSPDSLAVSLGERATINCKSSQNVLHSSN NNNYLTWYQQRPGQPPKLLIYWASTRESGVPDR FSGSGSGTEFTLTISSLQAEDVAVYYCQQYYSTP PTFGQGTKVEIK<br><br>SEQ ID NO: 26424 | QVQLVQSGAEVRKPGASVKVSCKASGYTFTNYDIN WVRQATGQGLEWMGWMHPNSGNTGYAQKFQGR FTMTRNTSISTAYMELSSLRSEDTAVYYCAYSSGW YRFDYWGQGTLVTVSS<br><br>SEQ ID NO: 30430 |
| | | NA | GATATTGTGATGACCCAGACTCCACTCTCTCT GTCCGTCACCCCTGGACAGCCGGCCTCCATCT CCTGCAAGTCTACTCAGAGCCTCCTGCATGGT GATGGAAAGACCTATTTGTATTGGTACCTGCA GAAGCCAGGCCAGCCTCCACAACTCCTGATCT ATGAAGTTTCCAAGCGGTTCTCTGGAGTGCCA GAAAGGTTCAGTGGCAGCGGGTCAGGGACAG ATTTCACACTGAAAATCAGCGCGGGTGGAGCT GAGGATGTTGGGGTTTATTACTGCAAGCAAAG TATACAGCTTCCGTGGACGTTCGGCCAAGGGA CCAAGGTGGAAATCAAA<br><br>SEQ ID NO: 26425 | CAGGTGCAGCTGGTGCAGTCTGGGGGAGGCGTG GTCCAGCCTGGGAGGTCCCTGAGACTCTCCTGTG CAGCGTCTGGATTCACCTTCAATAACTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAAAAGGTAT AGCAGCAGTTGGAGACTACTACTACGGTATGGA CGTCTGGGGCCAAGGGACCACGGTCACCGTCTCC TCA<br><br>SEQ ID NO: 30431 |
| | | AA | DIVMTQTIPLSLSVTPGQPASISCKSTQSLLHGDG KTYLYWYLQKPGQPPQLLIYEVSKRFSGVPERFS GSGSGTDFTLKISRVEAEDVGVYYCKQSIQLPWT FGQGTKVEIK<br><br>SEQ ID NO: 26426 | QVQLVESGGGVVQPGRSLRLSCAASGFTFNNYGM HWVRQAPGKGLEWVAVIWYDGSNKYYADSVKGR FTISRDNSKNTLYLQMNSLRAEDTAVYYCARKGIA AVGDYYYGMDVWGQGTTVTVSS<br><br>SEQ ID NO: 30432 |

FIGURE 50
(Continued)

| | | | |
|---|---|---|---|
| iPS:435635 | 21-225_163F1 | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTT GCAAAGTGGGGTCCCATCAAAGTTCAGCGGCA GTGGATCTGGGACAGATTCACTCTCACCATC AGCAGCCTGCAACAGTATAATAGTTACCAGCTTA TTACTGCCAACAGTATAATAGTTACCATTCA CTTTCGGCCCTGGGACCAAGTGGATGCCCAA | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTGGTAGT TACATATACTACGCAGACTCAGTGAAGGGCCGAT TCACCACCTCCAGAGACAACGCCAAGAACTCACT GTATCTGCAAATGAACAGCTGAGCGCCGACGA CACGGCTGTTTATTACTGTACGCTCTATAGCAGC TCGCACTATTGGGGCCAGGGAACCCTGGTCACCG TCTCCCTCA |
| | | | SEQ ID NO: 26427 | SEQ ID NO: 30433 |
| | | AA | DIQMTQSPSSLSASVGDRVTITCRASQDISNYLA WFQQKPGKAPKSLIYAASSLQSGVPSKFSGSGSG TDFTLTISSLQPEDFAAYYCQQYNSYPFTFGPGT QVDAQ | EVQLVDSGGGLVKPGGSLRLSCAASGFTFSSYSMN WVRQAPGKGLEWVSSISGSGSYIYYADSVKGRFTI SRDNAKNSLYLQMNSLSADDTAVYYCTLYSSSHY WGQGTLVTVSS |
| | | | SEQ ID NO: 26428 | SEQ ID NO: 30434 |
| iPS:435637 | 21-225_163E2 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATCCTGCATCCAGTT TGCAAAGTGGGGTCCCATCAAGGTTCAGCGGC AGTGGATCTGGGACAGACCTGAACTTCAACTT CAGTAGCCTGCAGCCTGAAGATTTTGCAACTT ATTACTGTCTACAGCATAATAGTCACCCATTC ACTTTCGGCCCTGGGACCAAGTGGATATCAA A | GAGGTGCAACTGGTGGAGTCTGGGGGAGGCTG GTCCAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCTCCACTAGTGGGAGTTCTACT TACATATACTACGCAGACTCAGTGAAGGGCCGAT TCACCATCTCCAGAGACAACGCCAAGAACTTAGT GTATCTGCAAATGAACAGCTGAGAGCCGAGGA CACGGCTGTATTACTGTGTGCGAGATCGAGGC AGCCCTCGGGGGCCAGGGAACCCTGGTCACCGTCT CCTCA |
| | | | SEQ ID NO: 26429 | SEQ ID NO: 30435 |

FIGURE 50
(Continued)

| | | | | |
|---|---|---|---|---|
| iPS:435639 | 21-225_163G6 | AA | DIQMTQSPSSLSASVGDRVTITCRASQDIRNDLG WYQQKPGKAPTRLIYPASSLQSGVPSRFSGSGSG TEFTLSISSLQPEDFATYYCLQHNSHPFTFGPGTK VDIK<br>SEQ ID NO: 26430 | EVQLVESGGGLVQPGGSLRLSCAASGFTFSSYSMN WVRQAPGKGLEWVSSTSGSSTYIYADSVKGRFTI SRDNAKNLVYLQMNSLRPEDTAVYYCARDRGSLW GQGTLVTVSS<br>SEQ ID NO: 30436 |
| | | NA | GACATCCAGATGACCCAGTCTCCATCCTCACT GTCTGCATCTGTAGGAGACAGAGTCACCATCA CTTGTCGGGCGAGTCAGGACAGCATTAGCAAT TAT TTAGTCTGGTTTCAGCAGAAACCAGGGAAAGC CCCTAAGTCCCTGATCTATGCTGCATCCAGTTT GCTAAGTGGGGTCCCTCAAAGTTCACTCTCACA GTGGATCTGGGACAGATTTCACTCTCACCATC AGCAGCCTGCAGCCTGAAGATTTTGCAACTTA TTACTGCCAACACAGTATCATAGTTACCCGCTCA CTTTCGGCGGAGGGACCAAGGTGGCGATCAA A<br>SEQ ID NO: 26431 | GAGGTGCAGCTGGTGGAGTCTGGGGGAGGCTG GTCAAGCCTGGGGGGTCCCTGAGACTCTCCTGTG CAGCCTCTGGATTCACCTTCAGTAGTTATAGCAT GAGCTGGGTCCGCCAGGCTCCAGGGAAGGGGCT GGAGTGGGTCTCATCCATTAGTGGTAGTGGTGCT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGATTGAGCGGT ATGGACGTCTGGGGCCAAGGGACCACGGTCACC GTCTCCTCA<br>SEQ ID NO: 30437 |
| | | AA | DIQMTQSPSSLSASVGDRVTITCRASQDISNYLV WFQQKPGKAPKSLIYAASSLLSGVPSKFSGSGSG TDFTLTISSLQPEDFATYYCQQYHSYPLTFGGGT KVAIK<br>SEQ ID NO: 26432 | EVQLVESGGGLVKPGGSLRLSCAASGFTFSSYSMS WVRQAPGKGLEWVSSISGSSAYIYADSVKGRFTIS RDNAKNSLYLQMNSLRAEDTAVYYCARLSGMDV WGQGTTVTVSS<br>SEQ ID NO: 30438 |

FIGURE 50
(Continued)

| | | | | |
|---|---|---|---|---|
| iPS:435641 | 21-225_163F9 | NA | GACATCCAGATGACCCAGTCTCCATCCTCCCT GTCTGCATCTGTAGGAGACAGAGTCACCATCA CTTGCCGGGCAAGTCAGGACAGATTAGAGATGAT TTAGGCTGGTATCAGCAGAAACCAGGGAAAG CCCCTAAGCGCCTGATCTATCCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAGCTT ATTACTGTCTACAGGATAATAGTTACCCATTC ACTTTCGGCCCTGGGACCAAAGTGGATATCAA A | GAGGTGCAGCTGGTGGAGTCTGGGGGAGGCTG GTCCAGCCTGGGGGGGGGGTCCCTGAGACTCTCCTGTG CAGCCTCTGATTCACCTTCAGTAGTAGCAT GAACTGGGTCCGCCAGGCTCCAGGGAAGGGCT GGAGTGGGTCTCATCCATTAGTGGTAGTAGTACT TACATATACTACGCAGACTCAGTGAAGGGCCGAT TCACCATCTCCAGAGACAACAGCCAAGAACTCACT GTATCTGCAAATGAACAGCCTGAGAGCCGAGGA CACGGCTGTGTATTACTGTGCGAGAGATCGAGGC AGCCTCGGGGCCAGGGAACCCTGGTCACCGTCT CCTCA |
| | | | SEQ ID NO: 26433 | SEQ ID NO: 30439 |
| | | AA | DIQMTQSPSSLSASVGDRVTITCRASQDIRDDLG WYQQKPGKAPKRLIYPASSLQSGVPSRFSGSGSG TEFTLTISSLQPEDFAAYYCLQDNSYPFTFGPGTK VDIK | EVQLVESGGGLVQPGGSLRLSCAASGFTFSSYSMN WVRQAPGKGLEWVSSISGSSTYIYADSVKGRFTIS RDNAKNSLYLQMNSLRAEDTAVYYCARDRGSLW GQGTLVTVSS |
| | | | SEQ ID NO: 26434 | SEQ ID NO: 30440 |
| iPS:435643 | 21-225_163G10 | NA | GACATCCAGATGACCCAGTCTCCATCCTCCCT GTCTGCATCTGTAGGAGACAGAGTCACCATCA CTTGCCGGGCAAGTCAGGACAGATTAGAAATAAT TTAGGCTGGTATCAGCAGAAACCAGGGAAAG CCCCTAAGCGCCTGATCTATCCTGCATCCAGTT TGCAAAGTGGGGTCCCATCAAGGTTCAGCGGC AGTGGATCTGGGACAGCCTGACACTCACTCTCACAAT CAGCAGCCTGCAGCCTGAAGATTTTGCAACTT ATTACTGTCTACAGGATTATAGTTACCATTCA CTTTCGGCCCTGGGACCAAAGTGGATATCAAA | GAGGTGCAGTTGGTGGAGTCTGGGGGAGGCTG GTCAAGCCTGGGGGGTCCCTGAGACTCTCCTGTG CAGCCTCTGATTCACCTTCAGTAGCTATAGCAT GAACTGGGTCCGCCAGGCTCCAGGGAAGGGCT GGAGTGGGTCTCATCCATTAGTGGTAGTAGTACT TACATATACTACGCAGACTCAGTGAAGGGCCGAT TCACCATCTCCAGAGACAACAGCCAAGAACTCACT GTATCTGCAAATGAACAGCCTGAGAGCCGAGGA CACGGCTGTGTATTACTGTGCGAGAGCCCGTATG GAGGTCTGGGGCCAAGGACCACGGTCACCGTC TCCTCA |
| | | | SEQ ID NO: 26435 | SEQ ID NO: 30441 |

FIGURE 50
(Continued)

| | | | |
|---|---|---|---|
| iPS:435649 | 21-225_165H2 | AA | DIQMTQSPSSLSASVGDRVTITCRASQDIRNNLGWYQQKPGKAPKRLIYPASSLQSGVPSRFSGSGSGTEFTLTISSLQPEDFATYYCLQDYSYPFTFGPGTKVDIK<br>SEQ ID NO: 26436 | EVQLVESGGGLVKPGGSLRLSCAASGFTFSSYSMNWVRQAPGKGLEWVSSISGSSTYYADSVKGRFTISRDNAKNSLYLQMNSLRAEDTAVYYCARARMDVWGQGTTVTVSS<br>SEQ ID NO: 30442 |
| | | NA | GACATCGTGATGACCCAGTCTCCAGACTCCCTGACTGTGTCTCCGGGCGAGAGGGCCACCATCAACTGCAAGTCCAGCCAGAGTGTTTTACACAGCTCCAACAATAAGAACTACTTAACTTGGTACCAGCAGAAACCAGGACAGCCTCCTAAACTGCTCATTTACTGGGCATCTACCCGAGAATCCGGGGTCCCTGTCCGATTCAGTGGCAGCGGGTCGGGACAGATTTCACTGTCCCCATCAGCAGCATGCAGGATGATGTGGCAGTTTATTACCGTCAGCAATCTTATAGTATTCCTCCCACTTTCGGCCCCGGGACCAACGTGGATATCAAA<br>SEQ ID NO: 26437 | CAGGTGCAGCTGGTGCAGTCTGGGGCTGAGGTGAAGAAGCCTGGGGCTCAGTGAAGGTCTCCTGCAAGGCTTCTGGATACACCTTCACCATTATGATATCAACTGGGTGCGACAGGCCACTGGACAAGGCTTGAGTGGGTGGGATGCACAGAAGTTCCAGGGCAGTAAGACAGGCTATGCACCAAGGAACCAACCACGACCATGACCATGACCTACATGGACCTCAGCAGCCTGTATTACTGTGCTTATAGCAGTGGACACGGCCGTGTACATGTTGACTACTGGGGCCAGGGAACCCTGGTCACCGTCTCCTCA<br>SEQ ID NO: 30443 |
| | | AA | DIVMTQSPDSLTVSPGERATINCKSSQSVLHSSNNKNYLTWYQQKPGQPPKLLIYWASTRESGVPVRFSGSGSGTDFTVPISSMQDDDVAVYYRQQSYSIPPTFGPGTNVDIK<br>SEQ ID NO: 26438 | QVQLVQSGAEVKKPGASVKVSCKASGYTFTHYDINWVRQATGQGLEWVGWMHPNSHKTGYAQKFQGRVTMTRNTSNSTAYMDLSSLRSEDTAVYYCAYSSGWYMFDYWGQGTLVTVSS<br>SEQ ID NO: 30444 |

FIGURE 50
(Continued)

| | | | |
|---|---|---|---|
| iPS:435653 | 21-225_166H12 | NA | GACATCCAGATGACCCAGTCTCCATCCTCACT GTCTACATCTGTAGGAGACAGAGTCACCATCA CTTGTCGGGCGAGTCAGGACATTAGCCATTAT TTAGCCTGGTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAATAGTTTCCCGCTCA CTTTCGGCGGAGGGACCAAGGTGGAGATCAC A<br>SEQ ID NO: 26439 | GAGGTGCAGCTGGTGGAGTCTGGGGGAGCCTG GTCAAGCCTGGGGGGTCCCTGAGACTCTCCTG CAGCCCTCTGGATTCACCTTCAGTAGCTATAGCAT GAGCTGGGTCCGCCAGGCTCCAGGGAAGGGGCT GGGGTGGGTCTCATCCATTAGTGGGAGTAGTAGT TACAGTTACTACGCAGATCAGTGAAGGGCCGAT TCACCATCTCCAGAGACAATGCCAAGAACTCACT GTATCTGCAAATGAACAGCCTGAGAGCCGAGGA CACGGCTGTGTATTACTGTGCGAGACTAACTGGC TTTGACTACTGGGGCCAGGGAACCCTGGTCACCG TCTCCTCA<br>SEQ ID NO: 30445 |
| | | AA | DIQMTQSPSSLSTSVGDRVTITCRASQDISHYLA WFQQKPGKAPKSLIYAASSLQSGVPSKFSGSGSG TDFTLTISSLQPEDFATYYCQQYNSFPLTFGGGT KVEIT<br>SEQ ID NO: 26440 | EVQLVESGGALVKPGGSLRLSCAASGFTFSSYSMS WVRQAPGKGLGWVSSISGSSSYYADSVKGRFTI SRDNAKNSLYLQMNSLRAEDTAVYYCARLTGFDY WGQGTLVTVSS<br>SEQ ID NO: 30446 |
| iPS:435655 | 21-225_167E2 | NA | GATATTGTGATGACCCAGACTCCACTCTCT GTCCGGTCACCCTGGACAGCCGGCTCCATCT CCTGTAAGTCTAGTCAGAGCCTCCTGCACGGT GATGGGAAGACCTATTTGTATTGGTACCTGCA GAAGCCAGGCCAGCCTCCACACTCCTGATCT ATGAAGTTTCCAAACGGTTCTCTGGAGTGCCA GATAGGTTCAGTGGCAGCGGGTCAGGGACAG ATTTCACACTGAAGATCAGCCGGGTGGAGGCT GAGGATGTTGGGGTTTATCACTGCATGCAAAG CATACAGCTTCCGTGACGTTCGGCCAAGGGA CCAAGGTGGAAATCAAA<br>SEQ ID NO: 26441 | CAGGTGCAGCTGGTGGAGTCTGGGGGAGGCGTG GTCCAGCCTGGGAGGTCCCTGAGACTCTCCTG CAGCGTCTGGATTCACCTTAGTAGCTTTGGCAT GCACTGGGTCCGCCAGGCTCCAGGCAAGGGCCT GGAGTGGGTGGCAGTCATATGGTATGATGGAACT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGTTGGTATT GAAGTGGCTGGTGACTACTACGGTATGGAAAG TCTGGGGCCAAGGGACCACGGTCACCGTCTCCTC A<br>SEQ ID NO: 30447 |

FIGURE 50
(Continued)

| | | | | |
|---|---|---|---|---|
| iPS:435657 | 21-225_167H10 | AA | DIVMTQTPLSLSVTPGQPASISCKSSQSLLHGDGKTYLYWYLQKPGQPPHLLIYEVSKRFSGVPDRFSGSGSGTDFTLKISRVEAEDVGLYHCMQSIQLPWTFGQGTKVEIK<br>SEQ ID NO: 26442 | QVQLVESGGGVVQPGRSLRLSCAASGFTSSFGMHWVRQAPGKGLEWVAVIWYDGTYKYYADSVKGRFTISRDNSKNTLYLQMNSLRAEDTAVYYCARVGIEVAGDYYYGMEVWGQGTTVTVSS<br>SEQ ID NO: 30448 |
| | | NA | GATATTGTGATGACCCAGACTCCACTCTCTCTGTCCGTCACCCCTGGACAGCCGGCCTCCATCTCCTGCAAGTCTAGTCAGAGCCTCCTGCACGGTGATGGAAAGAACCTATTTGTATTGGTACCTGCAGAAGCCAGGCCAGCCTCCACACTCCTGATCTATGAAGTTTCCAAACGGTTCTCTGGAGTGCCAGATAGGTTCAGTGGCAGCGGGTCAGGGACAGATTTCACACTGAAAATCAGCCGGGTGGAGGCTGAGGATGTTGGGCTTTATCACTGCATGCAAAGCATACAGCTTCCGTGACGTTCGGCCAAGGGACCCAAGGTGGAAATCAAA<br>SEQ ID NO: 26443 | CAGGTGCAGTTGGTGGAGTCTGGGGGAGGCGTGGTCCAGCCTGGGAGGTCCCAGAGACTCTCCTGTGCAGCGTCTGGATTCACCTTTAGTAGCTTTGGCATGCACTGGGTCCGCCAGGCTCCAGGCAAGGCTGGAGTGGGTGGCAGTCATATGGTATGATGGAAGTTATAAGTACCATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGTTGGTATAGAAGTGGCTGGTGACTACTACTACGGTATGGAAGTCTGGGGCCAAGGGACCACGGTCACCGTCTCCTCA<br>SEQ ID NO: 30449 |
| | | AA | DIVMTQTPLSLSVTPGQPASISCKSSQSLLHGDGKTYLYWYLQKPGQPPHLLIYEVSKRFSGVPDRFSGSGSGTDFTLKISRVEAEDVGLYHCMQSIQLPWTFGQGTKVEIK<br>SEQ ID NO: 26444 | QVQLVESGGGVVQPGRSQRLSCAASGFTSSFGMHWVRQAPGKGLEWVAVIWYDGSYKYHADSVKGRFTISRDNSKNTLYLQMNSLRAEDTAVYYCARVGIEVAGDYYYGMEVWGQGTTVTVSS<br>SEQ ID NO: 30450 |

FIGURE 50
(Continued)

| | | | |
|---|---|---|---|
| iPS:435659 | 21-225_167D12 | NA | GACATCCAGATGACCCAGTCTCCATCCTCACT GTCTGCATCTGTAGGGGACAGAGTCACCATCA CTTGTCGGGCGAGTCAGGGCATTAACAATTAT TTAGCCTGGTTTCAGCAGAAACCAGGGAAAGC CCCTGAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTTCTGCCAACAGTATAATAGTTATCCATTCAC TTTCGGCCCTGGGACCAAAGTGGATATCAAA SEQ ID NO: 26445 | GAGGTGCAGCTGTTGGAGTCTGGGGGAGGCTTG GTACAGCCGGGGGGGTCCCTGAGACTCTCCTGTG CAGCCTCTGGATTCACCTTTAGTAGCTATGTCAT GAGCTGGGTCCGCCAGGCTCCAGGGAAGGGGCT GGAGTGGGTCTCAGCTATGAGTGGTAGTGGTGGT AGAACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTGTATTACTGTGCGAAGTATACCTG GAACGGCTACTGGGGCCAGGGAACCCTGGTCAC CGTCTCCTCA SEQ ID NO: 30451 |
| | | AA | DIQMTQSPSSLSASVGDRVTITCRASQGINNYLA WFQQKPGKAPESLIYAASSLQSGVPSKFSGSGSG TDFTLTISSLQPEDFATYFCQQYNSYPFTFGPGTK VDIK SEQ ID NO: 26446 | EVQLLESGGGLVQPGGSLRLSCAASGFTFSSYVMS WVRQAPGKGLEWVSAMSGSGGRTYYADSVKGRF TISRDNSKNTLYLQMNSLRAEDTAVYYCAKYTWN GYWGQGTLVTVSS SEQ ID NO: 30452 |
| iPS:435663 | 21-225_169B1 | NA | GACATCCAGATGACCCAATCTCCATCCTCCCT GTCTGCATCTGTAGGAGACAGAGTCACCATCA CTTGCCGGGCTAGTCAGGGCATTAGAAAATGAT TTAGGCTGGTATCAGCAGAAACCAGGGAAAG CCCCTAAGCGCCTGATCTGTGCTGAATCCAGT TTGCAAAGTGGGGTCCCATCAAGGTTCAGCGG CAGTGGATCTGGGACAGAATTCACTCTCACAA TCAGCGGCCTGCAGCCTGAAGATTTTGCAACT TATTACTGTCTACAGCATTATAGTTACCCGCTC ACTTTCGGCGGAGGGACCAAAGTGGAGATCA AA SEQ ID NO: 26447 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGGCAT GCACTGGGTCCGCCAGGCTCCAGGCAAGGGGCT GGAGTGGGTGGCAGTTATATGTGGTATGATGAAGT AATAAATACTATGCAGACTCCGTGAGGGGCCGA TTCACCATCTCCAGAGACACATTCCAAGAACACGC TGTATCTGCAAATGAACAGCCTGAGAGCCGAAG ACACGGCTGTGTATTACTGTGCGAGAGATCCCTT ACGTGGATACAATGACCCGGTTATGGACTACTGG GGCCAGGGAACCCTGGTCACCGTCTCCTCA SEQ ID NO: 30453 |

FIGURE 50
(Continued)

| | | | |
|---|---|---|---|
| iPS:435665 | | AA | DIQMTQSPSSLSASVGDRVTITCRASQGIRNDLG WYQQKPGKAPKRLLIGAESSLQSGVPSRFSGSGSG TEFTLTISGLQPEDFATYYCLQHYSYPLTFGGGT KVEIK | QVQLVESGGGVVQPGRSLRLSCAASGFTFSSYGMH WVRQAPGKGLEWVAVIWYDGSNKYYADSVRGRF TISRDNSKNTLYLQMNSLRAEDTAVYYCARDPLRG YNDPVMDYWGQGTLVTSS |
| | | | SEQ ID NO: 26448 | SEQ ID NO: 30454 |
| | 21-225_169F2 | NA | GACATCGTGATGACCCAGTCTCCAGACTCCCT GGCTGTGTCTCTGGGCGAGAGGGCCACCATCA ACTGCAAGTCCAGCCAGAGTGTTTATACATC TCCAACAATAAAAACTACTTAGCTTGGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATCGTGCTCCCACCTTCGGCCAAGGGAC ACGACTGGAGATTAAA | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGTTGGATCCGGCAGCCCGCCGGGAAGGGACT GGAGTGGATTGGGCGTATCGATACCAGTGGGATC ACCAACTACAACCCCTCCCTCAAGAGTCGAGTCA CCATGTCAATAGACACGTCCAAGAGCCAGATCTC CCTGAAGCTGAGCTCTGTGACCGCCGCGGACACG GCCGTGTATTACTGTGCGAGAGAGGAGGAGTG GGAGCTACTACTTTGACTACTGGGGCCAGGGAA CCCTGGTCACCGTCTCCTCA |
| | | | SEQ ID NO: 26449 | SEQ ID NO: 30455 |
| | | AA | DIVMTQSPDSLAVSLGERATINCKSSQSVLYISN NKNYLAWYQQKPGQPPKLLIYWASTRESGVPD RFSGSGSGTDFTLTISSLQAEDVAVYYCQQYYR APTFGQGTRLEIK | QVQLQESGPGLVKPSETLSLTCTVSGGSISSYYWSW IRQPAGKGLEWIGRIDTSGITNYNPSLKSRVTMSIDT SKSQISLKLSSVTAADTAVYYCAREGGVGATYFDY WGQGTLVTVSS |
| | | | SEQ ID NO: 26450 | SEQ ID NO: 30456 |

FIGURE 50
(Continued)

| | | | |
|---|---|---|---|
| iPS:435667 | 21-225_169E3 | NA | GACATTGTGATGACTCAGTCTCCACTCTCCCTG CCCGTCACCCCTGGAGAGCGGCCTCCATCTC CTGCAGGTCTAGTCAGAGCCTCCTGCATAATA ATGGATACAAGTATTTGGATTGGTACCTGCAG AAGCCAGGGCAGTCTCCACAGCTCCTGATCTA TTTGGGGTTCTAATGGGGCCTCCGGGGTCCCTG ACAGGTTCAGTGCCAGTGGATCAGGCACAGAT TTTACACTGAAAATCAGCAGAGTGGAGGCTGA GGATGTTGGGGTTTATTACTGCATGCAAGTTC TACAAACTCCGTGACGTTCGGCCAAGGGACC AAGGTGGAAATCAAA<br>SEQ ID NO: 26451 |
| | | | GAGGTGCAACTGGTGGAGTCTGGGGGAGGCTTG GTACAGCCGGGGGGGTCCCTGAGACTCTCCTGTG CAGCCTCAGGATTCACCTTCAGTGGCCATAGCAT GAACTGGGTCCGCCAGGCTCCAGGGAAGGGCT GGAGTGGGTTGCATACATTAGCCTTAGTGGTAGT ACCATAAAGTACGCAGACTCTGTGAAGGCCGA TTCACCATCTCCAGAGACAATGCCAGGACTCAC TGTATCTGCAAATGAACAGCCTGAGAGACGAGG ACACGGCTGTGTATTACTGTGCGAGAAGGGGAT TACTGTGTTCGGAATGAGGACGGTTTGACGTC TGGGGCCAAGGGACCACGGTCACCGTCTCCTCA<br>SEQ ID NO: 30457 |
| | | AA | DIVMTQSPLSLPVTPGEPASISCRSSQSLLHNNGY KYLDWYLQKPGQSPQLLIYLGSNRASGVPDRFS ASGSGTDFTLKISRVEAEDVGVYYCMQVLQTPW TFGQGTKVEIK<br>SEQ ID NO: 26452 | EVQLVESGGGLVQPGGSLRLSCAASGFTFSGHSMN WVRQAPGKGLEWVAYISLSGSTIKYADSVKGRFTI SRDNARDSLYLQMNSLRDEDTAVYYCARRGITVV RNEDGLDVWGQGTTVTVSS<br>SEQ ID NO: 30458 |
| iPS:435669 | 21-225_169F9 | NA | GACATCCAGATGACCCAGTCTCCATCCTCCCT GTCTGCATCTGTAGGAGACAGAGTCACCATCA CTTGCCGGGCAAGTCAGGCATTAGAAATGAT TTAGGCTGGTATCAGCAGAAACCAGGGAAAG CCCCTAAGCGCCTGATCTTTGCTGCATCCAGTT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATTATAGTACCCGCTCA CTTTCGGCGGAGGGACCAAGGTGGAGATCAA A<br>SEQ ID NO: 26453 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTATGGCAT GCACTGGGTCCGCCAGGCTCCAGGCAAGGGGCT GGAGTGGGTGGTGTCAATTATATGCAGACTGAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGAGATCCCTT AGTGGATACAATGACCGGTTATGACTACTGG GGCCAAGGGAACCCTGGTCACCGTCTCCTCA<br>SEQ ID NO: 30459 |

FIGURE 50
(Continued)

| | | | |
|---|---|---|---|
| iPS:435671 | 21-225_169H5 | AA | DIQMTQSPSSLSASVGDRVTITCRASQGIRNDLG WYQQKPGKAPKRLIFAASSLQSGVPSRFSGSGSG TEFTLTISSLQPEDFATYYCLQHYSYPLTFGGGT KVEIK |
| | | | SEQ ID NO: 26454 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATACATC TCCAACAATAAAAACTACTTAGCTTGGTACCA GCAGAAACCAGGACAGCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATCGTGCTCCCACCTTCGGCCAAGGGAC ACGACTGGAGATTAAA |
| | | | SEQ ID NO: 26455 |
| | | AA | DIVMTQSPDSLAVSLGERATINCKSSQSVLYISN NKNYLAWYQQKPGQPPKLLIYWASTRESGVPD RFSGSGSGTDFTLTISSLQAEDVAVYYCQQYYR APTFGQGTRLEIK |
| | | | SEQ ID NO: 26456 |
| | | AA | QVQLVESGGGVVQPGRSLRLSCAASGFTFSTYGMH WVRQAPGKGLEWVSIIWYDGTNKYADSVKGRFT ISRDNSKNTLYLQLNSLRAEDTAVYYCARDPLRGY NDPVMDYWGQGTLVTVSS |
| | | | SEQ ID NO: 30460 |
| | | | CAGGTGCAGCTGCAGGAGTCGGGCCAGGACTG GTGAAGCCTTCGGAGACCCTGTCCCTCACCTGCA CTGTCTCTGGTGGCTCCATCAGTAGTACTACTG GAGTTGGATCCGGCAGCCCGCGGGAAGGGACT GGAGTGGATTGGGCGTATGGTCAGTGGGATG ACCAACTACAACCCCTCCCTCAAGAGTCGAGTCA CCATGTCAGTAGACACGTCCAAGAGCCAGATCTC CCTGAAGCTGAGCTCTGTGACCGCCGCGGACACG GCCGTGTATTACTGTGCGAGAGAGGAGAGTG GGAGCTACTACTTTGACTATTGGGCCAGGGAA CCCTGGTCACCGTCTCCTCA |
| | | | SEQ ID NO: 30461 |
| | | AA | QVQLQESGPGLVKPSETLSLTCTVSGGSISSYYWSW IRQPAGKGLEWIGRIDTSGITNYNPSLKSRVTMSVD TSKSQISLKLSSVTAADTAVYYCAREGGVGATYFD YWGQGTLVTVSS |
| | | | SEQ ID NO: 30462 |

FIGURE 50
(Continued)

| | | | | |
|---|---|---|---|---|
| iPS:435673 | 21-225_169E6 | NA | GACATTGTGATGACTCAGTCTCCACTCTCCCTG CCCGTCACCCCTGGAGAGCGGCCTCCATCTC CTGCAGGTCTAGTCAGAGCCTCCTGCATAATA ATGGATACAACAAGTATTTGGATTGGTACCTGCAG AAGCCAGGGCAGTCTCCACAGCTCCTGATCTA TTTGGGGTTCTAATGCCCAGTGGATCAGGCACAGAT ACAGGTTCAGTGCCAGTGATCAGGACAGAGGACTGA TTTACACTGAAAATCAGCAGAGTGGAGGCTGA GGATGTTGGGGTTTATTACTGCATGCAAGTTC TACAAACTCCGTGGACGTTCGGCCAAGGGACC AAGGTGGAAATCAAA<br><br>SEQ ID NO: 26457 | GAGGTGCAACTGGTGGAGTCTGGGGGAGGCTTG GTACAGCCTGGGGGGTCCCTGAGACTCTCCTGTG CAGCCTCAGGATTCACCTTCAGTGGCCATAGCAT GAACTGGGTCCGCCAGGCTCCAGGGAAGGGCT GGAGTGGGTTGCATACATTAGCATTAGTAGTAGT ACCATAAAGTACGCAGACTCTGTGAAGGCCGA TTCACCATCTCCAGAGACAATGCCAGGACTCAC TGTATCTGCAAATGAACAGCCTGAGAGACGAGG ACACGGCTGTGTATTACTGTGCGAGAAGGGGAT TACTGTGTTCGGAATGAGGACGGTTTGACGTC TGGGGCCAAGGGACCACGGTCACCGTCTCCTCA<br><br>SEQ ID NO: 30463 |
| | | AA | DIVMTQSPLSLPVTPGEPASISCRSSQSLLHNNGY KYLDWYLQKPGQSPQLLIYLGSNRASGVPDRFS ASGSGTDFTLKISRVEAEDVGVYYCMQVLQTPW TFGQGTKVEIK<br><br>SEQ ID NO: 26458 | EVQLVESGGGLVQPGGSLRLSCAASGFTFSGHSMN WVRQAPGKGLEWVAYISISSSTIKYADSVKGRFTIS RDNARDSLYLQMNSLRDEDTAVYYCARRGITVR NEDGLDVWGQGTTVTVSS<br><br>SEQ ID NO: 30464 |
| iPS:435675 | 21-225_169D7 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTGTCTACAGCATCATAGTTGCCCGTG GACGTTCGGCCAAGGGACCAAGGTGGAAATC AAA<br><br>SEQ ID NO: 26459 | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GACCTGGATCCGGCAGCCCGCCGGGAAGGACT GGAGTGGATTGGGCGTATCTATACCAGTGGGAGC ACCAACTACAACCCCTCCCTCAAGAGTCGAGTCA CCATGTCAGTAGACACGTCCAAGAACCAGTTCTC CCTGAAGCTGAGCTCTGTGACCGCCGCGGACACG GCCGTGTATTTCTGTGCGAAAGTCGGGAGGTACT ACTACGGTATGGACGTTCTGGGGCCAAGGGACCA CGGTCACCGTCTCCTCA<br><br>SEQ ID NO: 30465 |

FIGURE 50
(Continued)

| | | | |
|---|---|---|---|
| iPS:435677 | 21-225_169C10 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHHSCPWTFGQGTKVEIK | QVQLQESGPGLVKPSETLSLTCTVSGGSISSYYWTWIRQPAGKGLEWIGRIYTSGSTNYNPSLKSRVTMSVDTSKNQFSLKLSSVTAADTAVYFCAKVGRYYYGMDVWGQGTTVTVSS |
| | | | SEQ ID NO: 26460 | SEQ ID NO: 30466 |
| | | NA | GACATCCAGATGACCCAGTCTCCATCCTCACTGTCTGCATCTGTAGGAGACAGAGTCACCATCACTTGTCGGGCGAGTCAGGACATTAGCAATTATTTAGCCTGGTTTCAGCAGAAACCAGGGAAAGCCCCTAAGTCCCTAATCTTTTCTGCATCCAGTTTGCAAAGTGGGGTCCCATCAAAATTCAGCGGCAGTGGATCTGGGACAGATTTCAATCTCACCATCAGCAGCCTGCAGCCTGAAGATTTTGCAACTTATTACTGCCAACAATCTGATAGTTACCCTCTCACTTTCGGGGGAGGGACCAAGGTGGAGATCAAA | CAGGTGCAGCTGGTGCAGTCTGGGGCTGAGGTGAAGAAGCCTGGGGCCTCAGTGAGGGTCTCTGCAAGGCTTCTGGATACACCTTCACCGGCTACTTATGCACTGGGTGCGACAGGCCCCTGGACAAGGCTTGAGTGGATGGGATGGATCAAGCCTAAGAGTGGTGCACAAACTCTGCACCAGAGGTTTCAGGCAGGGTCACCATGACCAGGGACACGTCCATCAACACAGCCTACATGGAGCTGAACAGGCTGAGATCTGACGACACGGCCGTGTATTACTGTGCGAGAGGGGGACTACGGTGGCTACGTGGGGGGTCTTTGACTACTGGGGCCAGGGAACCCTGGTCACCGTCTCCTCA |
| | | | SEQ ID NO: 26461 | SEQ ID NO: 30467 |
| | | AA | DIQMTQSPSSLSASVGDRVTITCRASQDISNYLAWFQQKPGKAPKSLIFSASSLQSGVPSKFSGSGSGTDFNLTISSLQPEDFATYYCQQSDSYPLTFGGGTKVEIK | QVQLVQSGAEVKKPGASVRVSCKASGYTFTGYFMHWVRQAPGQGLEWMGWIKPKSGGTNSAQRFQGRVTMTRDTSINTAYMELNRLRSDDTAVYYCARGGTTVATWGFDYWGQGTLVTVSS |
| | | | SEQ ID NO: 26462 | SEQ ID NO: 30468 |

FIGURE 50
(Continued)

| | | | |
|---|---|---|---|
| iPS:435679 | 21-225_169D10 | NA | GACATCCAGATGACCCAGTCTCCATCTTCACT GTCTGCATCTGTAGGAGACAGAGTCACCATCA CTTGTCGGGCGAGTCAGGACATTAGCAATTAT TTAGCCTGGTTTCAGCAGAAACCAGGGAAAGC CCCTAAGTCCCTGATCTATGCTGCATCCAGTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA<br><br>SEQ ID NO: 26463 | GAGGTGCAGTTGTTGGAGTCTGGGGGAGGCTTGG TGCAGTCTGGGGGGTCCCTGAGACTCTCCTGTGC AGCCTCTGGATTCACCTTTAGCAGCTATGTCATG AGTTGGGTCCGCCAGGCTCCAGGGAAGGGGCTG GAGTGGGTCTCAGTTATTAGTGGTAGTGGTAGTA GAATATACTACGCGGACTCCGTGAAGGGCCGGTT CACCATCTCCAGAGACAATTCCAAGAACACGCTG TATCTGCAAATGAACAGCCTGAGAGCCGAGGAC ACGGCCTTATATTACTGTGCGAGAGTGGCTTTCT TTGACTATTGGGGCCAGGGAACCCTGGTCACCGT CTCCTCA<br><br>SEQ ID NO: 30469 |
| | | AA | DIQMTQSPSSLSASVGDRVTITCRASQDISNYLA WFQQKPGKAPKSLIYAASSLQSGVPSKFSGSGSG TDFTLTISSLQPEDFATYYCQQYHSYPFTFGPGT KVDIK<br><br>SEQ ID NO: 26464 | EVQLLESGGGLVQSGGSLRLSCAASGFTFSSYVMS WVRQAPGKGLEWVSAISGSGSRIYYADSVKGRFTI SRDNSKNTLYLQMNSLRAEDTALYYCARVAFFDY WGQGTLVTVSS<br><br>SEQ ID NO: 30470 |
| iPS:435681 | 21-225_169D11 | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAACAGAAACCAGGGAAAG TCCCTAAGCGCCTGATATATGCTGCATCCAGT TTGCAAAGTGGGGTCCCATCAAGGTTCAGCGG CAGTGGATCTGGGACAGAATTCACTCTCACAA TCAGCAGCCTACAGCCTGAAGATTTTGCAACT TATTACTGTCTTCAGCATTATAGTTACCCTCGG ACGTTCGGCCAAGGGACCAAGGTGGAAATCA AA<br><br>SEQ ID NO: 26465 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGTGGTATGAAGT AATAAATACTATGCAGACTCCGTGAAGGGCCGA TTCACCATCTCCAGAGACAATTCCAAGAACACGC TGTATCTGCAATTGAACAGCCTGAGAGCCGAGG ACACGGCTGTGTATTACTGTGCGAGAGAAGGTA TAGCAGTGGCTGTACGACTACGTATGACCGTC TGGGGCCAAGGGACCACGGTCACCGTCTCCTCA<br><br>SEQ ID NO: 30471 |

FIGURE 50
(Continued)

| | | | |
|---|---|---|---|
| iPS:435683 | 21-225_170A1 | AA | DIQMTQSPSSLSASVGDRVTITCRASQGIRDDLG WYQQKPGKVPKRLIYAASSLQSGVPSRFSGSGS GTEFTLTISSLQPEDFATYYCLQHYSYPRTFGQG TKVEIK |
| | | | SEQ ID NO: 26466 |
| | | NA | GAGATTGTGATGACCCAGACTCCACTCTCCT GTCCGTCACCCCTGGACAGCCGGCCTCCATCT CCTGCAAGTCTAGTCAGAGCCTCCTGCATGGT GATGGAAAGAACCTATTTGTTTGGTACCTGCA GAAGCCAGGCCAGCCTCCACAGGTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATTCAGCTTCCGTGGACGTTCGGCCAAGGGA CCAAGGTGGAAATCAAA |
| | | | SEQ ID NO: 26467 |
| | | AA | EIVMTQTPLFLSVTPGQPASISCKSSQSLLHGDGK TYLFWYLQKPGQPPQVLIYEVSNRFSGVPDRFSG SGSGTDFTLKISRVEAEDVGVYYCMQSIQLPWTF GQGTKVEIK |
| | | | SEQ ID NO: 26468 |
| | | AA | QVQLVESGGGVVQPGRSLRLSCAASGFTFSDYM HWVRQAPGKGLEWVAVIWYDGSNKYYADSVKGR FTISRDNSKNTLYLQLNSLRAEDTAVYYCARERYSS GWYDYGMDVWGQGTTVTVSS |
| | | | SEQ ID NO: 30472 |
| | | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAATTATATGGTATGATGGAAGT TATAAATACTATGCAGATTCCGTGAAGGGCCGAT TCACCATCTCCAGAGACAATTCCAAGAACACACT GTATCTGCAAATGAACAGCCTGAGAGCCGAGGA CACGGCTGTGTATTACTGTGCGAGAGATGCCAC GATTTTTGGAGTGGTTACTTTGACTCCTGGGCC AGGGAACCCTGGTCACCGTCTCCTCA |
| | | | SEQ ID NO: 30473 |
| | | AA | QVQLVESGGGVVQPGRSLRLSCAASGFTFSSYGMH WVRQAPGKGLEWVAIIWYDGSYKYYADSVKGRFT ISRDNSKNTLYLQMNSLRAEDTAVYYCARDAHDF WSGYFDSWGQGTLVTVSS |
| | | | SEQ ID NO: 30474 |

FIGURE 50
(Continued)

| | | | |
|---|---|---|---|
| iPS:435685 | 21-225_170E1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGTATCATAGTTACCCATTCA CTTTCGGCCCTGGGACCAAAGTGGATATCAAA | GAGGTGCAGTTGTTGGAGTCTGGGGGAGGCTTGG TACAGCCTGGGGGGTCCTGAGACTCTCCTGTGC AGCCTCTGGATTCACCTTTAGCAGCTATGTCATG AGTTGGGTCCGCCAGGCTCCAGGGAAGGGCTG GAGTGGGTCTCAGTTATTAGTGGTAGTGGTAATA GAATATACTACGCAGACTCCGTGAAGGGCCGGTT CACCATCTCCAGAGACAATTCCAAGAACACGCTG TATCTGCAAATGAACAGCCTGAGAGCCGAGAC ACGGCCTTATATTACTGTGCGAGAGTGGCTTTCT TTGACTATTGGGGCCAGGGAACCCTGGTCACCGT CTCCTCA |
| | | | SEQ ID NO: 26469 |
| | | AA | DIQMTQSPSSLSASEGDRVTITCRASQGISNYLA WFQQKPGKAPKSLIYAASSLQSGVPSKFSGSGSG TDFTLTISSLQPEDFATYYCQQYHSYPFTFGPGT KVDIK | EVQLLESGGGLVQPGGSLRLSCAASGFTFSSYVMS WVRQAPGKGLEWVSAISGSGNRIYYADSVKGRFTI SRDNSKNTLYLQMNSLRAEDTALYYCARVAFFDY WGQGTLVTVSS |
| | | | SEQ ID NO: 26470 | SEQ ID NO: 30475 |
| iPS:435687 | 21-225_170H1 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTACATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCAACT TATTATTGTCTACAGCATAGTAACCCGTG GACGTTCGGCCAAGGGACCAAGGTGGAAAGC AAA | CAGGTGCAGCTGCAGGAGTCGGGCCCAGGACTG GTGAAGCCTTCGGAGACCCTGTCCTCACCTGCA CTGTCTCTGGTGGCTCCATCAGTAGTTATTACTGG AGCTGGATCCGGCAGCCCCCAGGGAAGGGACTG GAGTGGATTGGGCGTATCTATACCAGTGGGAGCA CCAACTACAACCCCTCCCTCAAGAGTCGAGTCAC CATGTCAGTAGACACGTCCAAGAACCAGTTCTCC CTGAAGCTGAGCTCTGTGACCGCCGCGGACACG GCCGTGTATTACTGTGCGAGAGTCGGGAGGTACT ACTATGGTATGGACGTCTGGGGCCAAGGGACCA CGGTCACCGTCTCCTCA |
| | | | SEQ ID NO: 26471 | SEQ ID NO: 30477 |

FIGURE 50
(Continued)

| | | | |
|---|---|---|---|
| iPS:435689 | 21-225_170F3 | AA | DIQMTQSPSSLSASVGDRVTITCRASQGIRNDLG WYQQKPGKAPKRLIYATSSLQSGVPSRFSGSGSG TEFTLTISSLQPEDFATYYCLQHSSNPWTFGQGT KVESK | QVQLQESGPGLVKPSETLSLTCTVSGGSISSYYWSW IRQPAGKGLEWIGRIYTSGSTNYNPSLKSRVTMSVD TSKNQFSLKLSSVTAADTAVYYCARVGRYYYGMD VWGQGTTVTVSS |
| | | | SEQ ID NO: 26472 | SEQ ID NO: 30478 |
| | | NA | GACATCCAGATGACCCAGTCTCCATCCTCCCT GTCTGCTTCTGTAGGAGACAGAGTCACCATCA CTTGCCGGGCAAGTCGGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAACAGCCTGCAGCCTGAAGATTTTGCAACT TATTACTGTCTACAGCATTATAGTAACCCTCGG ACGTTCGGCCAAGGGACCAAGGTGGAAATCA AA | CAGGTGCAGCTGGTGGAATCTGGGGGAGGCGTG GTCCAGCCTGGGAGGTCCCTGAGACTCTCCTGTG CAGCGTCTGGATTCTCCTTCAGTGACTATGTCAT GCACTGGGTCCGCCAGGCTCCAGGCAAGGGGCT GGAGTGGGTGGCAGTTATAGACTCCGTGAAGGT AATAAATACTATGAAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGACGTA TAGCAGCAGCTGGTACGACTACGGTATGGACGTC TGGGGCCAAGGGACCACGGTCACCGTCTCCTCA |
| | | | SEQ ID NO: 26473 | SEQ ID NO: 30479 |
| | | AA | DIQMTQSPSSLSASVQDRVTITCRASRGIRNDLG WYQQKPGKAPKRLIYAASSLQSGVPSRFSGSGS GTEFTLTINSLQPEDFATYYCLQHYSYPRTFGQG TKVEIK | QVQLVESGGGVVQPGRSLRLSCAASGFSFSDYVMH WVRQAPGKGLEWVAVIWYDGSNKYYEDSVKGRF TISRDNSKNTLYLQMNSLRAEDTAVYYCARETYSS SWYDYGMDVWGQGTTVTVSS |
| | | | SEQ ID NO: 26474 | SEQ ID NO: 30480 |

FIGURE 50
(Continued)

| | | | |
|---|---|---|---|
| iPS:435693 | 21-225_170G4 | NA | GACATCCAGATGACCCAGTCTCCATCTCCT GTCTGCATCTGTAGGAGACAGAGTCACCATCA CTTGCCGGGCAAGTCAGGGACATTAGAAATGAT TTAGGCTGGTATCACCAGAAACCGGGAAAG CCCCTAAGGCGCCTGATCTATGCTGCATCCACTT TGCAAAGTGGGGTCCATCAAGGTTCAGCGGC AGTGGATCTGGGACAGAATTCACTCTCACAAT CAGCAGCCTGCAGCCTGAAGATTTTGCAACTT ATTACTGTCTACAGCATTATAGTTACCCGCTCA CTTTCGGCGGAGGGACCAAGGTGGAGATCAA A<br><br>SEQ ID NO: 26475 | CAGGTGCAGCTGGTGGAGTCTGGGGGAGGCGTG GTCCAGCCTGGGAGGTCCCTGAGACTCTCCTGTA CAGCGTCTGGATTCACCTTCAGTACTACCTATGGCAT GCACTGGGTCCGCCAGGCTCCAGGCAAGGGCT GGAGTGGGTGTCAATTATATGGTATGATGAACT AATAAATACTATGCAGACTCCGTGAAGGCCGA TTCACCATCTCCAAGAGACAATTCCAAGAACACGC TGTTTCTGCAACTGAACAGCCTGAGAGCCGAGGA CACGGCTATGTATTACTGTGCGCAGATCCCTTA CGTGGATACAATGACCGGTTATGGACTACTGGG GCCCAGGGAACCCTGGTCACCGTCTCCTCA<br><br>SEQ ID NO: 30481 |
| | | AA | DIQMTQSPSSLSASVGDRVTITCRASQGIRNDLG WYHQKPGKAPKRLIYAASTLQSGVPSRFSGSGS GTEFTLTISSLQPEDFATYYCLQHYSYPLTFGGG TKVEIK<br><br>SEQ ID NO: 26476 | QVQLVESGGGVVQPGRSLRLSCTASGFTFSTYGMH WVRQAPGKGLEWVSIIWYDGTNKYYADSVKGRFT ISRDNSKNTLFLQLNSLRAEDTAMYYCARDPLRGY NDPVMDYWGQGTLVTVSS<br><br>SEQ ID NO: 30482 |
| iPS:435695 | 21-225_170D5 | NA | GACATCCAGATGACCCAGTCTCCATCTCCCT GTCTGCATCTGTCGTCGGAGACAGAGTCACCATCA CTTGCCGGGCAAGTCAGGGACAGTTAGAAATGAT TTAGGCTGGTATCAGCAGAAACCAGGGAAAG CCCCTAAACACTGGATCTATGCTGCATCCAGT TTGCAAAATGGGGTCCCATCAAGGTTCAGCGG CAGTGGATCTGGGACAGAGTTCACTCTCACAA TCAGCAGCCTGCAGCCTGAAGATTTTGCAACT TATTACTGTCTACAGCATTATAGTTACCCGCTC ACTTTCGGCGGAGGGACCAAGGTGGAGATCA AA<br><br>SEQ ID NO: 26477 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTACTATGGCAT GCACTGGGTCCGCCAGGCTCCAGGCAAGGGCT GGAGTGGGTGGCAATTATATGTATGATGAACT TTCACCATCTCCAGAGACAATTCCAAGAACACGC TGTATCTGCAACTGAACAGCCTGAGAGCCGAGG ACACGGCTGTATTACTGTGCGGAGATCCCTT AGTGGATACAATGACCGGTTATGGACTACTGG GGCCAGGGAACCCTGGTCACCGTCTCCTCA<br><br>SEQ ID NO: 30483 |

FIGURE 50
(Continued)

| | | | | |
|---|---|---|---|---|
| iPS:435697 | 21-225_170G5 | AA | DIQMTQSPSSLSASVGDRVTITCRASQGIRNDLGWYQEKPGKAPKHLIYAASSLQNGVPSRFSGSGSGTEFTLTISSLQPEDFATYYCLQHYSFPLTFGGGTKVEIK | QVQLVESGGGVVQPGGSLRLSCAASGFTFSSYGMHWVRQAPGKGLEWVAIIWYDGTNKYYADSVKGRFTISRDNSKNTLYLQLNSLRAEDTAVYYCARDPLRGYNDPVMDYWGQGTLVTSS |
| | | | SEQ ID NO: 26478 | SEQ ID NO: 30484 |
| | | NA | GACATCCAGATGACCCAGTCTCCATCCCCTGTCTGCATCTGTAGGAGACAGAGTCACCATCACTTGCCGGGCAAGTCAGGGCATTAGAACTGATTTAGGCTGGTTTCAGCAGAAACCAGGGAAAGCCCCTAAGCGCCTGATCTATACTGCATCCAGTTTGCAAAGTGGGGTCCCATCAAGGTTCAGCGGCAGTGGATCTGGGACAGACCTGAAGATTTTGCAACTTACAGCAGCCTGCAGCCTGAAGATTTTGCAACTTATTACTGTCTACAGCATTATAGTTACCCGCTCACTTTCGGCGGAGGGACCAAGGTGGAGATCAAA | CAGGTGCAGCTGGTGGAGTCTGGGGGAGGCGTGGTCCAGCCTGGGGGGTCCCTGAGACTCTCCTGTGCAGCGTCTGGCTTCACCTTCAGTAGCTACGGCATGCACTGGGTCCGCCAGGCTCCAGGCAAGGGGCTGGAGTGGGTGGCAATTATATGGTATGATGGACTAATAAATACTATGCAGACTCCGTGAAGGGCCGATTCACCATCTCCAGAGACAACAGCAAGAACACGCTGTATCTGCAAATGAACAGCCTGAGAGCCGAGGACACGGCTGTGTATTTCTGTGCGAGAGATCCCTTACGTGGATACAATGACCCGGTTATGGACTACTGGGGCCAGGGAACCCTGGTCACCGTCTCCTCA |
| | | | SEQ ID NO: 26479 | SEQ ID NO: 30485 |
| | | AA | DIQMTQSPSSLSASVGDRVTITCRASQGIRTDLGWFQQKPGKAPKRLIYTASSLQSGVPSRFSGSGSGTEFTLTISSLQPEDFATYYCLQHYSYPLTFGGGTKVEIK | QVQLVESGGGVVQPGGSLRLSCAASGFTFSTYGMHWVRQAPGKGLEWVTIIWYDGTNKYYADSVKGRFTISRDNSKSTLYLQMNSLRAEDTAVYFCARDPLRGYNDPVMDYWGQGTLVTSS |
| | | | SEQ ID NO: 26480 | SEQ ID NO: 30486 |

FIGURE 50
(Continued)

| | | | |
|---|---|---|---|
| iPS:435699 | 21-225_170D6 | NA | GACATCCAGATGACCCAGTCTCCATCCTCTCT<br>GTCTGCATCTGTAGGAGACAGAGTCGCCATCA<br>CTTGTCGGGCGAGTCAGGACATTGGCAATTGT<br>TTAGCCTGGTTTCAGCAGAAACCAGGGAAAGC<br>CCCTAAGTCCCGATCTATTCTGCGTCCAGTTT<br>GCAAAGTGGGGTCCCATCAAAGTTCAGCGGCA<br>GTGGATCTGGGACAGATTTCACTCTCACCATC<br>AGCAGCCTGCAGCCTGAAGATTTTGCAACTTA<br>TTACTGCCAACAATCTGATAGTTACCCTCTCAC<br>TTTCGGCGGAGGGACCAAGGTGGAGATCAAA<br><br>SEQ ID NO: 26481 | CAGGTGCAGCTGGTGCAGTCTGGGGCTGAGGTG<br>AAGAAGCCTGGGGCCTCAGTGAGGGTCTCCTGC<br>AAGGCTTCTGGATACACCTTCACCGGCTACTTTA<br>TACACTGGGTGCGACAGGCCCCTGGACAAGGGC<br>TTGAGTGGATGGGATGGATCAAGCCTAACAGTG<br>GTGGCACAAACTCTGCACAGAGGTTTCAGGGCA<br>GGGTCACCATGACCAGGGACACGTCCATCAACA<br>CAGCCTACATGGAGCTGAACAGGCTGAGATCTG<br>ACGACACGGCCGTGTATTACTGTGCGAGAGGGG<br>GGACTACGGTGGCTACGTGGGGGTCTTTGACTA<br>CTGGGGCCAGGGAACCCTGGTCACCGTCTCCTCA<br><br>SEQ ID NO: 30487 |
| | | AA | DIQMTQSPSSLSASVGDRVAITCRASQDIGNCLA<br>WFQQKPGKAPKSLIYSASSLQSGVPSKFSGSGSG<br>TDFTLTISSLQPEDFATYYCQQSDSYPLTFGGGT<br>KVEIK<br><br>SEQ ID NO: 26482 | QVQLVQSGAEVKKPGASVRVSCKASGYTFTGYFIH<br>WVRQAPGQGLEWMGWIKPNSGGTNSAQRFQGRV<br>TMTRDTSINTAYMELNRLRSDDTAVYYCARGGTT<br>VATWGVFDYWGQGTLVTVSS<br><br>SEQ ID NO: 30488 |
| iPS:435701 | 21-225_170F6 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTTACACAGC<br>TCCAACAATTACAACTACTTAGCTTGGTACCA<br>GCAGAAACCAGGACAGCCTCCTAAAGTGCTCA<br>TTCACTGGGCATCTACCCGAGAAATCCGGGGTC<br>CCTGACCGATTCAGTGGCAGCGTGTCTGGGAC<br>AGATTTCACTCTCACCATCAACAGCCTGCAGG<br>CTGAAGATGTGGCAGTTTATTACTGTGTCAGCAA<br>TATTATAGTACTCCGTGACGTTCGGCCAAGG<br>GACCAAGGTGGAAATCAAA<br><br>SEQ ID NO: 26483 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGGC<br>TTGAGTGGATGGGATGGATGAACCTAACAGTG<br>GTAACACAGGCTATGCACAGAAGTTCCAGGACA<br>GAGTCACCATGACCAGGCACACCTCCATAAGCA<br>CAGCCTACATGGAGCTGAGCAGCCTGAGATCTG<br>AGGACACGGCCGTGTACTACTGTGCGATTAGCAG<br>TGGCTGGTACTGGTTCGACGTTCGACCCCTGGGGCCAGGGA<br>ACCCTGGTCACCGTCTCCTCA<br><br>SEQ ID NO: 30489 |

FIGURE 50
(Continued)

| | | | | |
|---|---|---|---|---|
| iPS:435703 | | AA | DIVMTQSPDSLAVSLGARATINCKSSQSVLHSSN NYNYLAWYQQRPGQPPKVLIHWASTRKSGVPD RFSGSVSGTDFTLTINSLQAEDVAVYYCQQYYST PWTFGQGTKVEIK | QVQLVQSGAEVKKPGASVKVSCKASGYTFTNYDIN WVRQATGQGLEWMGWMNPNSGNTGYAQKFQDR VTMTRHTSISTAYMELSSLRSEDTAVYYCAISSGW YWFDPWGQGTLVTVSS |
| | | | SEQ ID NO: 26484 | SEQ ID NO: 30490 |
| | 21-225_170D11 | NA | GACATCCAGATGACCCAGTCTCCATCCTCCCT GTCTGCATCTGTGGAGACAGAGTCACCATCA CTTGCCGGGCAAGTCAGGGACATTAGAAATGAT TTAGGCTGGTATCAGCAGAAACCAGGAAAG CCCCTAAACACCTGATCTATGCTGCATCCAGT TTGCAAAAATGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTTCCCGCTC ACTTTCGGCGGAGGGACCAAGGTGGAGATCA GA | CAGGTGCAGCTGGTGCAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGCT GGAGTGGGTGGCAATTATATGGTATGATGGAACT AATAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCTT AGGTGGATACAATGACCGGTTATGGACTACTGG GGCCAGGGAACCCTGGTCACCGTCTCCTCA |
| | | | SEQ ID NO: 26485 | SEQ ID NO: 30491 |
| | | AA | DIQMTQSPSSLSASVGDRVTITCRASQGIRNDLG WYQQKPGKAPKHLIYAASSLQNGVPSRFSGSGS GTEFTLTISSLQPEDFATYYCLQHYSFPLTFGGGT KVEIR | QVQLVESGGGVVQPGRSLRLSCVASGFTFSSYGMH WVRQAPGKGLEWVAIIWYDGTNKYYADSVKGRF TISRDNSKNTLYLQLNSLRAEDTAVYYCARDPLRG YNDPVMDYWGQGTLVTVSS |
| | | | SEQ ID NO: 26486 | SEQ ID NO: 30492 |

FIGURE 50
(Continued)

| | | | | |
|---|---|---|---|---|
| iPS:435705 | 21-225_171C3 | NA | GACATCCAGATGACCCAGTCTCCATCTCCCT GTCTGCATCTGTAGGAGACAGAGTCACCATCA CTTGCCGGGCAAGTCAGGGCATTAGAAACTGAT TTAGGCTGGTTTCAGCAGAAACCAGGGAAAGC CCCTAAGCGCCTGATCTATACTGCATCCAGTT GCAAAGTGGGGTCCCATCAAGGTTCAGCGGCA GTGGATCTGGGACAGATTTCACTCTCACGATC AGCAGCCTGCAGCCTGAAGATTTTGCAACTTA TTACTGTCTACAGCATTATAGTTACCCGCTCAC TTTCGGCGGAGGGACCAAGGTGGAGATCAAA | CAGGTGCAGCTGGTGGAGTCTGGGGGAGGCGTG GTCCAGCCTGGGGGGTCCCTGAGACTCTCCTGTG CAGCGTCTGGCTTCACCTTCAGTACTACTATGGCAT GCACTGGGTCCGCCAGGCTCCAGGCAAGGGGCT GGAGTGGGTGACAATTATATGGTATGATGGACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCCCT ACGTGGATACAATGACCGGTTATGGACTACTGG GGCCAGGGAACCCTGGTCACCGTCTCCTCA |
| | | | SEQ ID NO: 26487 | SEQ ID NO: 30493 |
| | | AA | DIQMTQSPSSLSASVGDRVTITCRASQGIRTDLG WFQQKPGKAPKRLIYTASSLQSGVPSRFSGSGSG TEFTLTISSLQPEDFATYYCLQHYSYPLTFGGGT KVEIK | QVQLVESGGGVVQPGGSLRLSCAASGFTFSTYGMH WVRQAPGKGLEWVTIIWYDGTNKYYADSVKGRFT ISRDNSKNTLYLQMNSLRAEDTAVYYCARDPLRGY NDPVMDYWGQGTLVTVSS |
| | | | SEQ ID NO: 26488 | SEQ ID NO: 30494 |
| iPS:435709 | 21-225_171A4 | NA | GACATCCAGATGACCCAGTCTCCATCTCCCT GTCTGCATCTGTAGGAGACAGAGTCACCATCA CTTGCCGGGCAAGTCAGGGCATTAGAAACTGAT TTAGGCTGGTATCAGCAGAAACCAGGGAAAG CCCCTAAGCGCCTGATCTATACTGCATCCAGT TTGCAAAGTGGGGTCCCATCAAGGTTCAGCGG CAGTGGATCTGGGACAGCTGAAGATTTGCAACT TCAGCAGCCTGCAGCCTGAAGATTTTGCAACT TATTACTGTCTACAGCATTATAGTAGTTACCCGCTC ACTTTCGGCGGAGGGACCAAGGTGGAGATCA AA | CAGGTGCAACTGGTGGAGTCTGGGGGAGGCGTG GTCCAGCCTGGGGGGTCCCTGAGACTCTCCTGTG CAGCGTCTGGCTTCACCTTCAGTACTACTATGGCAT GCACTGGGTCCGCCAGGCTCCAGGCAAGGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAAG ACACGGCTGTGTATTACTGTGCGAGAGATCCCTT ACGTGGATACAATGACCGGTTATGCCTACTACTGG GGCCAGGGAACCCTGGTCACCGTCTCCTCA |
| | | | SEQ ID NO: 26489 | SEQ ID NO: 30495 |

FIGURE 50
(Continued)

| | | | | |
|---|---|---|---|---|
| iPS:435711 | | AA | DIQMTQSPSSLSASVGDRVTITCRASQGIRNDLG WYQQKPGKAPKRLIYTASSLQSGVPSRFSGSGSG TEFTLTISSLQPEDFATYYCLQHYSYPLTFGGGT KVEIK | QVQLVESGGGVVQPGGSLRLSCAASGFTFSTYGMH WVRQAPGKGLEWVAIIWYDGSNKYYADSVKGRFTI SRDNSKNTLYLQMNSLRAEDTAVYYCARDPLRGY NDPVMDYWGQGTLVTVSS |
| | | | SEQ ID NO: 26490 | SEQ ID NO: 30496 |
| | 21-225_171G4 | NA | GACATCCAGATGACCCAGTCTCCATCTTCCGT GTCTGCATCTGTAGGAGACAGAGTCACCATCA CTTGTCGGGCGAGTCAGGGTGTTAACGACTGG TTAGCCTGGTATCAGCAGAAACCAGGGAGAG CCCCTAAGCTCCTGATCTATGATGCATCAAGT TTGCAAAGTGGGGTCCCATCAAGGTTCAGCGG CAGTGGATCTGGGACAGATTTCACTCTCACCA TCAGCAGCCTGCAGCCTGAAGATTTTGCAACT TACTATTGTCAACAGGCTAACAGTTTCCCGTG GACGTTCGGCCAAGGGACCAAGGTGGAAATC AAA | GAGGTGCAGCTGTTGGAGTCTGGGGGAGACTTA GTACAGCCTGGGGGGTCCCTGAGACTCTCCTGTG CAGCCTCTGGATTCACCTTCAGCAGCTGTGCCAT GACCTGGGTCCGCCAGGCTCCAGGGAAGGGGCT GGAGTGGGTCTCAGCTATTAGTGGTCGTGGTGGT ACCACGTTCTACGCAGACTCCGTGAGGGGCCGGT TCACCATCTCAAGAGACAATTCCAAGAACACGCT GTTTCTGCAAATGAACAGCCTGAGAGCCGAGGA CACGGCCGTATATTACTGTGCGAAAGATCTTATT GGGGGAGCTACTACTTTGACTACTGGGGCCAGG GAACCCTGGTCACCGTCTCCTCA |
| | | | SEQ ID NO: 26491 | SEQ ID NO: 30497 |
| | | AA | DIQMTQSPSSVSASVGDRVTITCRASQGVNDWL AWYQQKPGRAPKLLIYDASSLQSGVPSRFSGSGS GTDFTLTISSLQPEDFATYYCQQANSFPWTFGQG TKVEIK | EVQLLESGGDLVQPGGSLRLSCAASGFTFSSCAMT WVRQAPGKGLEWVSAISGRGGTTFYADSVRGRFTI SRDNSKNTLFLQMNSLRAEDTAVYYCAKDLIGGAI YFDYWGQGTLVTVSS |
| | | | SEQ ID NO: 26492 | SEQ ID NO: 30498 |

FIGURE 50
(Continued)

| | | | |
|---|---|---|---|
| iPS:435713 | 21-225_171D7 | NA | GATATTGTGATGACTCAGTCTCCACTCTCCCTGCCCGTCACCCCTGAGAGCCGGCCTCCATCTCCTGCAGGTCTAGTCAGAGCCCTCGTATCATAATGGATACAACTATTTGGATTGGTACCTGCAGAAGACAGGGCAGTCTCCACAGCTCCTGATCTATGTGGGTTCTAATGGGCCTCCGGGGTCCCTGACAGGTTCAGTGCAGTGGATCAGGACAGATTTTACACTGAAAATCAGCAGAGTGGAGGCTGAGGATGTTGGGGTTTATTACTGCATGCAAACTCTACAAACTCCGCTCACTTTCGGCGGAGGGACCAAGGTGGAGATCAAA |
| | | | SEQ ID NO: 26493 |
| | | AA | DIVMTQSPLSLPVTPGEPASISCRSSQSLLYHNGYNYLDWYLQKTGQSPQLLIYVGSNRASGVPDRFSGSGSGTDFTLKISRVEAEDVGVYYCMQTLQTPLTFGGGTKVEIK |
| | | | SEQ ID NO: 26494 |
| | | NA | GCCATCCAGATGACCCAGTCTCCATCTTCCGTGTCTGCATCTGTAGGAGACAGAGTCACCATCACTTGTCGGGCGAGTCAGGGTATTAGCAACTGGTTAGCCTGGTATCAGCAGAAACCAGGGAAAGCCCCTAAGCTCCTGATCTATGCTGCATTCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGACTAACAGTTTCCCGTGGACGTTCGGCCAAGGGACCAAGGTGGAAATCAAA |
| | | | SEQ ID NO: 26495 |
| iPS:435715 | 21-225_171A8 | | CAGGTGCAGCTGGTGGAGTCTAGGGGAGGCGTGGTCCAGCCTGGAGGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAGTTATATCATATGACGGAAACAATAGACACTATGCAGACTCCGTGCAGGGCCGATTCACCATTTCCAGAGACAATTCCAAGAACACGCTGTCTCTGCAAATGAACAGCCTGGGAGCTGAGGACACGGCTGTGTATTACTGTGCGAGAGATCGTCACCGTTTGGACTACTACGCTTTGGACGTCTGGGGCCAAGGGACCACGGTCACCGTCTCCTCA |
| | | | SEQ ID NO: 30499 |
| | | | QVQLVESRGGVVQPGRSLRLSCAASGFTFSSYGMHWVRQAPGKGLEWVAVISYDGNNRHYADSVQGRFTISRDNSKNTLSLQMNSLGAEDTAVYYCARDRHRLDYYALDVWGQGTTVTVSS |
| | | | SEQ ID NO: 30500 |
| | | | GAGGTGCAGTTGGTTGTTGGAGTCTGGGGGAGGCTTGGTACAGCCTGGGGGGTCCCTGAGACTCTCCTGTGCAGCCTCTGGATTCACCTTTAGGAGCTCTGCCATGAGCTGGGTCCGCCAGGCTCCAGGGAAGGGGCTGGAGTGGGTCTCAGTTATTAGTGGTAGTGGTAGCACAATTCTACACAGACTCCGTGAAGGGCCGGTTCACCATCTCCAGAGACAATTCCAAGAACACGCTGTATCTGCAAATGAACAGCCTGAGAGCCGAGGACACGGCCGTATTACTGTGCGAAATGAATAGCAGTGGCTGGTTGACTACTGGGGCCAGGGAACCCTGGTCACCGTCTCCTCA |
| | | | SEQ ID NO: 30501 |

FIGURE 50
(Continued)

| | | | | |
|---|---|---|---|---|
| | | AA | AIQMTQSPSSVSASVGDRVTITCRASQGISNWLA WYQQKPGKAPNLMIHAAFSLQGGVPSRFSGSGS GTDFTLTISSLQPEDFATYYCQQTNSFPWTFGQG TKVEIK | EVQLLESGGGLVQPGGSLRLSCAASGFTFRSSAMS WVRQAPGKGLEWVSVISGSGSTFYTDSVKGRFTI SRDNSKNTLYLQMNSLRAEDTAVYYCAKSNSSGW FDYWGQGTLVTVSS |
| | | | SEQ ID NO: 26496 | SEQ ID NO: 30502 |
| iPS:435717 | 21-225_171A9 | NA | GACATCCAGATGACCCAGTCTCCATCTCCGT GTCTGCATCTGTAGGAGACAGAGTCACCATCA CTTGTCGGGCGAGTCAGGATATTACCACCTGG TTAGCCTGGTATCAGCAGAAACCAGGGAAAG CCCCTAAGCTCCTGATCTATGATGCATCCAGTT TGCAAAGTGGCGGTCCCATCAAGGTTCAGCGC AGTGGATCTGGGACAGATTTCACTCTCACCGT CAGCAGTTTGCAGCCTGAAGATTTTGCAACTT ACTATTGTCTACAGACTAACAGTTTCCCGTGG ACGTTCGGCCAAGGGACCAAGGTGGAGATCA AG | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGCCATG ACTTGGGTCCGCCAGGCTCCAGGGAAGGGGCTG GAGTGGGTCTCAGCTATTAGTGGTAGTGGTGTA ACACATTCAACGCAGACTCCGTGAAGGGCCGGTT CCACCATCTCCAGAGACAATTCCAAGAACACGCTG TATCTGCAAATGAACAGCCTGAGAGCCGAGGAC ACGGCCGTATATTACTGTGCAAAGCTGGGGATCG ACTACTACTACGGTATGGACGTCTGGGGCCA AGGGACCACGGTCACCGTCTCCTCA |
| | | | SEQ ID NO: 26497 | SEQ ID NO: 30503 |
| | | AA | DIQMTQSPSSVSASVGDRVTITCRASQDITTWLA WYQQKPGKAPKLLIYDASSLQSAVPSRFSGSGS GTDFTLTVSSLQPEDFATYYCLQTNSFPWTFGQG TKVEIK | EVQLLESGGGLAQPGGSLRLSCAASGFTFSSYAMT WVRQAPGKGLEWVSAISGSGGNTFNADSVKGRFTI SRDNSKNTLYLQMNSLRAEDTAVYYCAKLGIDYY YYGMDVWGQGTTVTVSS |
| | | | SEQ ID NO: 26498 | SEQ ID NO: 30504 |

FIGURE 50
(Continued)

| | | | |
|---|---|---|---|
| iPS:435719 | 21-225_171A11 | NA | GACATCCAGATGACCCAGTCTCCATCCTCCT GTCTGCATCTGTAGGAGACAGAGTCACCATCA CTTGCCGGGCAAGTCAGGGCATTAGAAATAAT TTAGGCTGTATCAGCAGCAGAAACCAGGGAAAG CCCCTAAGCGCCTGATCTATCCTGCATCCAGTT TGCAAAGTGGGGTCCATCAAGGTTCAGCGGC AGTGGATCTGGGACAGAATTCACTCTCACAAT CAGCAGCCTGCAGCCTGAAGATTTTGCAACTT ATTACTGTCTACAGGATCATAGTTACCCATTC ACTTTCGGCCCTGGGACCAAAGTGGATATCAA A | GAGGTGCAGCTGGTGGAGTCTGGGGGAGGCTG GTCAAGCCTGGGGGGTCCCTGAGACTCTCCTGTG CAGCCCTCTGGATTCACCTTCAGTAGCTATAGCAT GAACTGGGTCCGCCAGGCTCCAGGGAAGGGGCT GGAGTGGGTCTCATCCATTAGTGGTAGTAGTAGT TACATATACTACGCAGAGACTCAGTGAAGGGCCGAT TCACCATCTCCAGAGACAACGCCAAGAACTCACT GTATCTGCAAATGAACAGCCTGAGAGCCGAGA CACGGCTGTGTATTACTGTGCGAGAGATAGGGC AGCTCCTGGGGCCAGGGAATCCTGGTCACCGTCT CCTCA |
| | | | SEQ ID NO: 26499 | SEQ ID NO: 30505 |
| | | AA | DIQMTQSPSSLSASVGDRVTITCRASQGIRNNLG WYQQKPGKAPKRLIYPASSLQSGVPSRFSGSGSG TEFTLTISSLQPEDFATYYCLQDHSYPFTFGPGTK VDIK | EVQLVESGGGLVKPGGSLRLSCAASGFTFSSYSMN WVRQAPGKGLEWVSSISGSSSYIYYADSVKGRFTIS RDNAKNSLYLQMNSLRAEDTAVYYCARDRGSSW GQGILVTVSS |
| | | | SEQ ID NO: 26500 | SEQ ID NO: 30506 |
| iPS:435721 | 21-225_172B3 | NA | GACATCCAGATGACCCAATCTCCATCCTCCCT GTCTGCATCTGTAGGAGACAGAGTCACCATCA CTTGCCGGGCTAGTCAGGGCATTAGAAATGAT TTAGGCTGTATCAGCAGCAGAAACCAGGGAAAG CCCCTAAGCGCCTGATCGTGTGCTGAATCCAGT TTGCAAAGTGGGGTCCATCAAGGTTCAGCGG CAGTGGATCTGGGACAGAATTCACTCTCACAA TCAGCGGCCTGCAGCCTGAAGATTTTGCAACT TATTACTGTCTACAGCATTATAGTTACCCGCTC ACTTTCGGCGGAGGGACCAAAGTTGGAGATCA AA | CAGGTGCAGCTGGTGGAGTCTGGGGGAGGCGTG GTCCAGCCTGGGAGGCCCCTGAGACTCTCCTGTG CAGCGTCTGGATTCACCTCAGTACCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCCCTT ACGTGGATACAATGACCCGGTTATGGACTACTGG GGCCAGGGAACCCTGGTCACCGTCTCCTCA |
| | | | SEQ ID NO: 26501 | SEQ ID NO: 30507 |

FIGURE 50
(Continued)

| | | | |
|---|---|---|---|
| iPS:435723 | 21-225_172B7 | AA | DIQMTQSPSSLSASVGDRVTITCRASQGIRNDLG WYQQKPGKAPKRLIGAESSLQSGVPSRFSGSGSG TEFTLTISGLQPEDFATYYCLQHYSYPLTFGGGT KVEIK<br>SEQ ID NO: 26502 | QVQLVESGGGVVQPGRPLRLSCAASGFTFSTYGMH WVRQAPGKGLEWVAVIWYDGSNKYYADSVKGRF TISRDNSKNTLYLQMNSLRAEDTAVYYCARDPLRG YNDPVMDYWGQGTLVTVSS<br>SEQ ID NO: 30508 |
| | | NA | GATATTGTGATGACCCAGACTCCACTCTCTCT GTCCGTCACCCTGGACAGCCGGCCTCCATCT CCTGCAAGTCTAGTCAGAGCCTCCTGCATGGT GATGGAAAGACCTATTTCTATTGGTACCTGCA GAAGCCAGGCCAGCCTCCACAGGTCCTGTTAT TTGAAGTTTCCCACCGGGTTCTCTGGAGTGCCA GATAGGTTCAGTGGGCGGGTCAGGGACAG ATTTCACACTGAAGATCAGCCGGGTGGAGGCT GAGGATGTTGGGGTTTACTATTGCATGCAAAG TATACAGTTTCCGTGGACGTTCGGCCAAGGGA CCAGGGTGGACATCAAA<br>SEQ ID NO: 26503 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT AGAGTGGGTGGCAATTATATGGTATGATGGAAGT AATAAATACTATGTAGACTCCGTGAAGGGCCGAT TCACCATCTCCAGAGACAATTCCAAGAACACGCT GTATCTCCAAATGAACAGCCTGAGAGCCGAAGA CACGGCTGTGTACTATTGTGCGAGAGAGGCGTAC GATTTTTGGAGTGGTTATTGGGACTACTGGGGCC AGGGAACCCTGGTCACCGTCTCCTCA<br>SEQ ID NO: 30509 |
| | | AA | DIVMTQTPLSLSVTPGQPASISCKSSQSLLHGDG KTYFYWYLQKPGQPPQVLLFEVSHRFSGVPDRF SGGGSGTDFTLKISRVEAEDVGVYYCMQSIQFP WTFGQGTRVDIK<br>SEQ ID NO: 26504 | QVQLVESGGGVVQPGRSLRLSCAASGFTFSNYGM HWVRQAPGKGLEWVAIIWYDGSNKYYVDSVKGR FTISRDNSKNTLYLQMNSLRAEDTAVYYCAREAYD FWSGYWDYWGQGTLVTVSS<br>SEQ ID NO: 30510 |

FIGURE 50
(Continued)

| | | | |
|---|---|---|---|
| iPS:435725 | 21-225_172G8 | NA | GACATCCAGATGACCCAGTCTCCATCCCCT GTCTGCATCTGTGGAGACAGAGTCACCATCA CTTGCCGGGCAAGTCAGGGCGTTAGAAATGAT TTAGGCTGGTATCAGCAGAAACCAGGAAAG CCCCTAAACACCTGATCTATGCTGCATCCAGT TTGCAAAATGGGGTCCCATCAAGGTTCAGTGG CAGTGGCTCTGGGACAGAATTCACTCTCACAA TCAGCAGCCTGCAGCCTGAAGATTTTGCCACT TATTACTGTCTACACCATTATAGTTTCCCGCTC ACTTTCGGCGGAGGGACCAAGGTGGAGATCA AA | CAGGTGCAGATGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAATGGATGGCAATTATATGTGATGGAACT AATAAATACTATGCAGACTCCGTGAAGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCCTT ACGGTGGATACAATGACCCGGTTATGGACTACTGG GGCCAGGGAACCCTGGTCACCGTCTCCTCA |
| | | | SEQ ID NO: 26505 | SEQ ID NO: 30511 |
| | | AA | DIQMTQSPSSLSASVGDRVTITCRASQGVRNDLG WYQQKPGKAPKHLIYAASSLQNGVPSRFSGSGS GTEFTLTISSLQPEDFATYYCLHHYSFPLTFGGGT KVEIK | QVQMVESGGGVVQPGRSLRLSCAASGFTFSSYGM HWVRQAPGKGLEWMAIIWYDGTNKYYADSVKGR FTISRDNSKNTLYLQLNSLRAEDTAVYYCARDPLR GYNDPVMDYWGQGTLVTVSS |
| | | | SEQ ID NO: 26506 | SEQ ID NO: 30512 |
| iPS:435727 | 21-225_172E11 | NA | GACATCGTGATGACCCAGTCTCCAGACTCCCT GGCGGTGTCTCTGGGCGAGAGGGCCACCATCA ACTGCAAGTCCAGCCAGAGTGTTTTACACAGC TCCAACAATAACAACTACTTAGCTTGGTACCA GCAGAAACCAGGACAGCCTCCTAAGCTGCTCA TTTACTGGGCATCTACTCGGGAATCCGGGGTC CCTGACCGATTCAGTGGCAGCGGGTCTGGGAC AGATTTCATTCTCACCATCAGCGGCCTGCAGG CTGAAGATGTGGCAGTTTATTACTGTCAGCAA TATTTTACTACTCCGTGCAGTTTGGCCAGGGG ACCAAGCTGGAGATCAAA | CAGGTGCAGCTGGTGCAGTCTGGGGCTGAGGTG AAGAAGCCTGGGGCCTCAGTGATGGTCTCCTGCA AGGCTTCTGGATACACCTTCACCAGTTATGATAT CAACTGGGTGCGACAGGCCACTGGACAAGGGCT TGAGTGGATGGGATGGATGCACAGAAGTTCAGGCAGA AACACAGGCTATGCACCAGGAACACCTCCATAAGCACA GTCACCATGACCAGGGACACGTCCATAAGCAACA GCCTACATGGAGCTGAGCAGCCTGAGATCTGAG GACACGGCCGTGTATTACTGTGCGTATAGCAGTG GCTGGTACCGGTTTGACTACTGGGGCCAGGGAAC CCTGGTCACCGTCTCCTCA |
| | | | SEQ ID NO: 26507 | SEQ ID NO: 30513 |

FIGURE 50
(Continued)

| | | | |
|---|---|---|---|
| iPS:435729 | 21-225_173E7 | AA | DIVMTQSPDSLAVSLGERATINCKSSQSVLHSSN NNNYLAWYQQKPGQPPKLLIYWASTRESGVPD RFSGSGSGTDFILTISGLQAEDVAVYYCQQYFTT PCSFGQGTKLEIK<br>SEQ ID NO: 26508 | QVQLVQSGAEVKKPGASVMVSCKASGYTFTNYDI NWVRQATGQGLEWMGWMHPNSGNTGYAQKFQG RVTMTRNTSISTAYMELSSLRSEDTAVYYCAYSSG WYRFDYWGQGTLVTVSS<br>SEQ ID NO: 30514 |
| | | NA | GACATCCAGATGACCCAGTCTCCATCCTCCCG GTCTGCATGTATAGGAGACAGAGCCACCATCA CTTACCGTGCAAGTCAGACCAGACCATTAGCAACTAT TTAAATTGGTATCAGCAGAAACCAGGGAAAG CCCCTAAACTCCTATCTATGCTGCATCCAGTT TGCAAATTGGGGTCCCATCCAAGGTTCAGTGGC AGTGGATCTGGGACAGATTTCACTCTCACCAT CAGCAGTTGTCAACAGAGTTACAGAACCCCTCAG ACTTCTGTCAACAGTATTTGCAACTT TGGACGTTCGGCCAAGGGACCAAGGTGGAAA TCAAA<br>SEQ ID NO: 26509 | GAGGTGCAGTTGTTGGAGTCTGGGGGAGGCTCG GTACAGCCTGGGGGGTCCCTGAGACTCTCCGTG CAGCCTCTGGATTCACCTTTAGCAGCTATGCCAT GAGCTGGGTCCGCCAGGCTCCAGGGAAGGGGCT GGAGTGGGTCTCATTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCTGCAAGCCGAGGA CACGGCCGTATATTACTGTACGAAAAGGGATACC TACAACGGTTGGGATGCTTTTGATATCTGGGGCC AAGGGACAATGGTCACCGTCTCTTCA<br>SEQ ID NO: 30515 |
| | | AA | DIQMTQSPSSRSACIGDRATITYRASQTISNYLN WYQQKPGKAPKLLIYAASSLQIGVPSRFSGSGSG TDFTLTISSVQPEDFATYFCQQSYRTPQWTFGQG TKVEIK<br>SEQ ID NO: 26510 | EVQLLESGGGSVQPGGSLRLSCAASGFTFSSYAMS WVRQAPGKGLEWVSFISGSGGNTFYADSVKGRFTI SRDNSKNTLYLQMNSLQAEDTAVYYCTKRDTYNG WDAFDIWGQGTMVTVSS<br>SEQ ID NO: 30516 |

FIGURE 50
(Continued)

| | | | |
|---|---|---|---|
| iPS:435731 | 21-225_173A11 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAAGACCTATTTGTATTGGTACCTGCA GAAGCCAGGCCAGCCTCCACAGTCCTGATCT ATGAAGTTTCCAACCGGTTCTCTGGCGTGCCA GATAGGTTCAGTGGCAGCGGGTCAGGGACAG ATTTCACACTGAAAATCAGCGGGTGGAGGCT GAGGATGTTGGGGTTTTTTGTCATGCAAAG TATACAGGTTCCGTGGACGTTCGGCCAAGGGA CCAAGGTGGAAATCAAA<br><br>SEQ ID NO: 26511 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT AGAGTGGGTGGCAATTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGCCTA CGATTTTTGGAGTGGTTTCTTTGACTCCTGGGGCC AGGGAACCCTGGTCACCGTCTCCTCA<br><br>SEQ ID NO: 30517 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVFFCMQSIQVPWT FGQGTKVEIK<br><br>SEQ ID NO: 26512 | QVQLVESGGGVVQPGRSLRLSCAASGFTFSSYGMH WVRQAPGKGLEWVAIIWYDGSNKYYADSVKGRFT ISRDNSKNTLYLQMNSLRAEDTAVYYCAREAYDF WSGFFDSWGQGTLVTVSS<br><br>SEQ ID NO: 30518 |
| iPS:435733 | 21-225_173C11 | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GAGGAAAAGACCTACTTGTATTGGTACCTGCA GAAGCCAGGCCAGCCTCCACAGTCCTGATCT ATGAAGTTTCCAACCGGTTCTCTGAGTGCCA GATAGGTTCAGTGGCAGCGGGTCAGGGACAG ATTTCACACTGAAAATCAGCGGGGTGGAGGCT GAGGATGTGTGGGGTTTATTACTGCATGCAAAG TATACAGCTCTCACTTTCGGCGGAGGGACCA AGGTGGAGATCAAA<br><br>SEQ ID NO: 26513 | CAGGTGCAGCTGGTGGAGTCGGGGGGAGGCGTG GTCCAGCCTGGGAGGTCCCTGAGACTCTCCTGTG CAGCGTCTGGATTCACCTTCAGTAGTTATGGCAT ACACTGGGTCCGCCAGGCTCCAGGCAAGGGACT GGAGTGGGTGGCACTTATATTTATGATGAAGT AATAAATACTATGCAGACTCCGTGAAGGGCCGA TTCACCATCTCCAGAGACAATTCCAAGAACACGC TGTATCTGCATATGAACAGCCTGAGAGCCGAGG ACACGGCTGTGTATTACTGTGCGAGAGACGGTATAG CAGCAGCTGGTCCGGTGATGGACGTCTGGGGGC CAAGGGACCACGGTCACCGTCTCCTCA<br><br>SEQ ID NO: 30519 |

FIGURE 50
(Continued)

| | | | |
|---|---|---|---|
| iPS:435735 | 21-225_173H12 | AA | DIVMTQTPLSLSVTPGQPASISCKSSQSLLHSEGK TYLYWYLQKPGQPPQLLIYEVSHRFSGVPDRFSG SGSGTDFTLKISRVEAEDVGVYYCMQSIQLLTFG GGTKVEIK |
| | | | SEQ ID NO: 26514 |
| | | | QVQLVESGGGVVQPGRSLRLSCAASGFTFSSYGIH WVRQAPGKGLEWVALIFYDGSNKYYADSVKGRFT ISRDNSKNTLYLHMSSLRAEDTAVYYCARRYSSSW SGGMDVWGQGTTVTVSS |
| | | | SEQ ID NO: 30520 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGAAGTTAGCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAAGT TATTACTGTCTACAGCATTATAGTTTCCCGAAC ACTTTCGGCGGAGGGACCAAGGTGGAGATCA AA |
| | | | SEQ ID NO: 26515 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAATTATATGCAGACTCCGTGA AACAAATACTATGCAGACTCCGTGAAGGGCCGA TTCACCATCTCCAGAGACAATTCCAAGAACACGC TGTATCTGCAACTGAACAGCCTGAGAGCCGAGG ACACGGCTGTGTATTACTGTGCGCGAGATCCCTT AGTGGATACAATGACCCGGTTATGGACTACTGG GGCCAGGGAACCCTGGTCACCGTCTCCTCA |
| | | | SEQ ID NO: 30521 |
| | | AA | DIQMTQSPSSLSASVGDRVTITCRASQGIRNDLG WYQQKPGKAPKRLIYTSSLQSGVPSRFSGSGSG TEFTLTISSLQPEDFASYYCLQHYSFPNTFGGGTK VEIK |
| | | | SEQ ID NO: 26516 |
| | | | QVQLVESGGGVVQPGRSLRLSCAASGFTFSSYGMH WVRQAPGKGLEWVAIIWYDGTNKYYADSVKGRF TISRDNSKNTLYLQLNSLRAEDTAVYYCARDPLRG YNDPVMDYWGQGTLVTVSS |
| | | | SEQ ID NO: 30522 |

FIGURE 50
(Continued)

| | | | |
|---|---|---|---|
| iPS:435737 | 21-225_174G5 | NA | GACATGTGATGACCCAGTCTCCAGATTCCCT GGCTGTGTCTCTGGGCGCGAGGGCCACCATCA ATTGCAAGTCCAGCAGTGTATTACTGGTACCA GCAGAAATCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATCGTACTCCGTGGACGTTCGGCCAAGG GACCAAGGTGGAAATCAAA SEQ ID NO: 26517 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGGTTAGCAGT GGCTGGTACTGGTTCGACCCCTGGGGCCAGGGA ACCCTGGTCACCGTCTCCTCA SEQ ID NO: 30523 |
| | | AA | DIVMTQSPDSLAVSLGARATINCKSSQSVLHSSN NYNYLTWYQQKSGQPPKLLIYWASTRESGVPDR FSGSGSGTDFTLTISSLQAEDVAVYYCQQYYRTP WTFGQGTKVEIK SEQ ID NO: 26518 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAVSSGW YWFDPWGQGTLVTVSS SEQ ID NO: 30524 |
| iPS:435739 | 21-225_174G7 | NA | GCCATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTATCAGCAGAAACCAGGGAAAG CCCCTAAACCTCCTGATCCATGCTGCATTCAGTT TGCAAGGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGACTAACAGTTTCCCGTGG ACGTTCGGCCAAGGGACCAAGGTGGAAATCA AA SEQ ID NO: 26519 | GAGGTGCAGTTGTTGGAGTCTGGGGGAGGCTTGG TACAGCCTGGGGGGTCCCTGAGACTCTCCTGTGC AGCCTCTGGATTCACCTTTAGGAGCTGCCATG AGCTGGGTCCGCCAGGCTCCAGGGAAGGGGCTG GAGTGGGTCTCAGTTATTAGTGGTAGTGGTGGTA GCACATTCTACACAGACTCCGTGAAGGGCCGGTT CACCATCTCCAGAGACAACAATTCCAAGAACACGCTG TATCTGCAAATGAACAGCCTGAGAGCCGAGGAC ACGGCCGTATATTACTGTGCGAATCGAATAGCA GTGGCTGGTTTGACTACTGGGGCCAGGGAACCCT GGTCACCGTCTCCTCA SEQ ID NO: 30525 |

FIGURE 50
(Continued)

| | | | |
|---|---|---|---|
| iPS:435741 | 21-225_174G10 | AA | AIQMTQSPSSVSASVGDRVTITCRASQGISNWLA WYQQKPGKAPNLLIHAAFSLQGGVPSRFSGSGS GTDFTLTISSLQPEDFATYYCQQTNSFPWTFGQG TKVEIK |
| | | | SEQ ID NO: 26520 |
| | | NA | GACATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAACAGAAACCAGGAAAG TCCCTAAGCGCCTGATATATGCTGCATCCAGT TTGCAAAGTGGGGTCCCATCAAGGTTCAGCGG CAGTGGATCTGGGACAGATTCACTCTCACAA TCAGCAGCCTACAGCCTGAAGATTTTGCAACT TATTACTGTCTTCAGCATCATAGTTACCCTCGG ACGTTCGGCCAAGGGACCAAGGTGGAAATCA AA |
| | | | SEQ ID NO: 26521 |
| | | AA | DIQMTQSPSSLSASVGDRVTITCRASQGIRDDLG WYQQKPGKVPKRLIYAASSLQSGVPSRFSGSGS GTEFTLTISSLQPEDFATYYCLQHHSYPRTFGQG TKVEIK |
| | | | SEQ ID NO: 26522 |

| EVQLLESGGGLVQPGGSLRLSCAASGFTFRSSAMS WVRQAPGKGLEWVSVISGSGSTFYTDSVKGRFTI SRDNSKNTLYLQMNSLRAEDTAVYYCAKSNSSGW FDYWGQGTLVTVSS |
|---|
| SEQ ID NO: 30526 |
| CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGCAGTCCTGAAGGGCCGA AATAAATACTATGCAGACTCCGTGAAGGGCCGA TTCACCATCTCCAGAGACACAATTCCAAGAACACGC TGTATCTGCAATTGAACAGCCTGAGAGCCGAGG ACACGGCTGTGTATTACTGTGCGAGAGAAAGGTA TAGCAGTGGCTGGTACGACTACGGTATGGACGTC TGGGGCCAAGGGACCACGGTCACCGTCTCCTCA |
| SEQ ID NO: 30527 |
| QVQLVESGGGVVQPGRSLRLSCAASGFTFSDYVM HWVRQAPGKGLEWVAVIWYDGSNKYYADSVKGR FTISRDNSKNTLYLQLNSLRAEDTAVYYCARERYSS GWYDYGMDVWGQGTTVTVSS |
| SEQ ID NO: 30528 |

FIGURE 50
(Continued)

| | | | |
|---|---|---|---|---|
| iPS:435743 | 21-225_175G1 | NA | GACATCCAGATGACCCAGTCTCCATCCTCCCTGTCTGCATCTGTAGGAGACAGAGTCACCATCACTTGCCGGGCAAGTCAGGGCATTAGAACCTGATTTAGGCTGGTATCAGCAGAAACCAGGGAAAGCCCCTAAGCGCCTGATCTATACTGCATCCAGTTTGCAAAGTGGGGTCCCATCAAGGTTCAGCGGCAGTGGATCTGGGACAGAATTCACTCTCACGATCAGCAGCCTGCAGCCTGAAGATTTTGCAACTTATTACTGTCTACAGCATTATAGTTACCCGCTCACTTTCGGCGGAGGGACCAAGGTGGAGATCAAG | CAGGTGCAACTGGTGGAGTCTGGGGGAGGCGTGGTCCAGCCTGGGGGGTCCCTGAGACTCTCCTGTCAGCGTCTGCTTCACCTTCAGTACTACTATGGCATGCACTGGGTCCGCCAGGCTCCAGGCAAGGGCTGGAGTGGGTGGCAGTTATATGGTATGATGAAGTAATAAATACTATGCAGACTCCGTGAAGGGCCGATTCACCATATCCAGAGACAATTCCAAGAACACGCTGTATCTGCAAATGAACAGCCTGAGAGCCGAGGACACGGCTGTGTATTACTGTGCGAGAGATCCCTTACGTGGATACAATGACCCGGTTATGGACTACTGGGGCCAGGGAACCCTGGTCACCGTCTCCTCA |
| | | | SEQ ID NO: 26523 | SEQ ID NO: 30529 |
| | | AA | DIQMTQSPSSLSASVGDRVTITCRASQGIRTDLGWYQQKPGKAPKRLIYTASSLQSGVPSRFSGSGSGTEFTLTISSLQPEDFATYYCLQHYSYPLTFGGGTKVEIK | QVQLVESGGGVVQPGGSLRLSCAASGFTFSTYGMHWVRQAPGKGLEWVAVIWYDGSNKYYADSVKGRFTISRDNSKNTLYVQMNSLRAEDTAVYYCARDPLRGYNDPVMDYWGQGTLVTVSS |
| | | | SEQ ID NO: 26524 | SEQ ID NO: 30530 |
| iPS:435745 | 21-225_175G3 | NA | GACATCCAGATGACCCAGTCTCCATCCTCCACTGTCTGCATCTGTAGGAGACAGAGTCACCATCACTTGTGTCGGGCGAGTCAGGACATTAGCAATGATTTAGCCTGGTTTCAGCAGAAACCAGGGAAAGCCCCTAAGCGTCCTGATCTTTCTGCATCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAACTTATTACTGCCAACAATCTGATAGTAGTTACCCTCTCACTTTCGGCGGAGGGACCAAGGTTGAGATCAAA | CAGGTACAGGTGGTGCAGTCTGGGGCTGAGGTGAAGAAGCCTGGGGCCTCAGTGAAGGTCTCCTGCAAGGCTTCTGGATACACCTTCACCGGCTACTTTATGCACTGGGTGCGACAGGCCCCTGGACAAGGGCTTGAATGGATGGGATGGATCAACAGAGGTTTCAGGGCAGTGGCACAAACTGTGCACAGGGACACGTCCATCACCAGGGTCACCATGACCAGGGACACGTCCATCACCAGCCTACATGGAACTGAGCAGGCTGCGATCTGACGACACGGCCGTGTATTATTGTGTGAGAGGGGGACTACGGTTGACTACGGTGGGGGTCTTTGACTACTGGGGCCAGGGAACCATGGTCACCGTCTCCTCA |
| | | | SEQ ID NO: 26525 | SEQ ID NO: 30531 |

FIGURE 50
(Continued)

| | | | | |
|---|---|---|---|---|
| iPS:435747 | 21-225_175C4 | AA | DIQMTQSPSSLSASVGDRVTITCRASQDISNDLAWFQQKPGKAPKSLIFSASSLQSGVPSKFSGSGSGTDFTLTISSLQPEDFATYYCQQSDSYPLTFGGGTKVEIK<br><br>SEQ ID NO: 26526 | QVQVVQSGAEVKKPGASVKVSCKASGYTFTGYFMHWVRQAPGQGLEWMGWIKPKSGGTNCAQRFQGRVTMTRDTSITTAYMELSRLRSDDTAVYYCVRGGTTVTTWGVFDYWGQGTMVTVSS<br><br>SEQ ID NO: 30532 |
| | | NA | GACATCCAGATGACCCAGTCTCCATCCTCACTGTCTGCATCTGTAGGAGACAGAGTCACCATCACTTGTCGGGCGAGTCAGGGCATTGGGAATTATTTAGCCTGGTTTCAGCAGAAACCAGGGAAAGCCCCTAAGTCCCTGATCTATGCTGCATCCGGTTTGCAAAGTGGGGTTCCCATCAAAATTCAGCGGCAGTGGATCTGGGACAGATTTCACTCTCACCATCAGCAGCCTACAGCCTGAAGATTATTGCCAACTATTACTGCCAACAGTATTAGTTACCCATTCACTTTCGGCCCTGGGACCAAAGTGGATATCAAA<br><br>SEQ ID NO: 26527 | GAGGTGCAGCTGTTGGAGTCTGGGGGAGGCTTGGTGCAGCCTGGGGGGTCCCTGAGACTCTCCTGTGCAGCCTCTGCATTCACCTTTAGCAGCTATGTCATGAGCTGGGTCCGCCAGGCTCCAGGGAAGGGGCTGGAGTGGGTCTCTGCTATTAGTGGTAGTGGTGATAGAACATACTACGCAGACTCCGTGAAGGGCCGGTTCACCATCTCCAGAGACAACGCATTCCAATACCACGCTGTATCTGCAAATGAACAGCCTGAGAGCCGAGGACACGGCCGTATATTACTGTGCGAGAACAGCGGGCTTTGACTACTGGGGCCAGGGAACCCTGGTCACCGTCTCCTCA<br><br>SEQ ID NO: 30533 |
| | | AA | DIQMTQSPSSLSASVGDRVTITCRASQGIGNYLAWFQQKPGKAPKSLIYAASGLQSGFPSKFSGSGSGTDFTLTISSLQPEDFATYYCQQYYSYPFTFGPGTKVDIK<br><br>SEQ ID NO: 26528 | EVQLLESGGGLVQPGGSLRLSCAASAFTFSSYVMSWVRQAPGKGLEWVSAISGSGDRTYYADSVKGRFTISRDDSNTTLYLQMNSLRAEDTAVYYCARTAGFDYWGQGTLVTVSS<br><br>SEQ ID NO: 30534 |

FIGURE 50
(Continued)

| | | | |
|---|---|---|---|
| iPS:435749 | 21-225_175C10 | NA | GACATCCAGATGACCCAGTCTCCATCTTCCGT GTCTGCATCTGTAGGAGACAGAGTCACCATCA CTTGTCGGGCGAGTCAGGGTATTACCGACTGG TTAGCCTGGTATCAGCAGAAACCAGGGAAAG CCCCTAAGCTCCTGATCTATGCTGCATCCAGT TGCAAAGTGGGGTCCCATCAAGGTTCAGCGGC AGTGGATCTGGGACAGATTTCACTCTCACCTT CAGCAGCCTGCAGCCTGACGATTTGCAACTT ACTATTGTCAACAGAGTAACAGTTCCCGTGG ACGTTCGGCCAAGGGACCAAGGTGGAAATCA AA SEQ ID NO: 26529 | GAGGTGCAACTGTTGGAGTCTGGGGGAGGCTTG GTACAGCCTGGGGGGTCCCTGAGACTCTCCTG CAGCCCTCTGGATTCACCTTTAGCAGCTATGCCAT GAGTGGGTCCGCCAGGCTCCAGGGAAGGGGCT GGAGTGGGTCTCGTCTATTAGTGGTCGTGGTGGT AGCACGTTCTACGCAGACTCCGTGAAGGGCCGT TCACCGTCTCCAGAGACAATTCCAAGAACACGCT GTATCTGCAAATGAACAGCCTGAGAGCCGAGGA CACGGCCGTATATTACTGTGCGAAATCGAATAGC AGTGGCTGGTTTGACTACTGGGGCCAGGGAACCC TGGTCACCGTCTCCTCA SEQ ID NO: 30535 |
| | | AA | DIQMTQSPSSVSASVGDRVTITCRASQGITDWLA WYQQKPGKAPKLLIYAASSLQSGVPSRFSGSGS GTDFTLTFSSLQPDDFATYYCQQTNSFPWTFGQ GTKVEIK SEQ ID NO: 26530 | EVQLLESGGGLVQPGGSLRLSCAASGFTFSSYAMS WVRQAPGKGLEWVSSISGRGGSTFYADSVKGRFT VSRDNSKNTLYLQMNSLRAEDTAVYYCAKSNSSG WFDYWGQGTLVTVSS SEQ ID NO: 30536 |
| iPS:435751 | 21-225_175D10 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAGC TCCAACAATAACAACTACTTAGCTTGGTACCA GCAGAAACCAGGACAGCCTCCTAACCTGCTCA TTTACTGGACATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA CTGTACAGTACTCCTCCGACGTTCGGCCAAGG GACCAAGGTGGAAATCAAA SEQ ID NO: 26531 | CAGGTGCAGTCGTGCAGTCTGGGCTGAGGTG AAGAAGCCTGGGGCCTCAGTGAAGGTCTCCTGC AAGGCTTCGGTTACACCTTCACCAATTATGATC TCAACTGGGTGCGACAGGCCACTGGACAAGGC TTGAGTGGATGGGATGGCACCTAACAGTGG TAACACAGGCTATGCACAGAAGTTCAGGGCAG AGTCACCATGACCAGGAACACCTCCATAAGCAC AGTTTACATGGAGCTGAGCAGCCTGAGATCTGAG GACACGGCCGTGTACTTGACTACTGGGGCCAGGAAC CCTGGTCACCGTCTCCTCA SEQ ID NO: 30537 |

FIGURE 50
(Continued)

| | | AA | DIVMTQSPDSLAVSLGERATINCKSSQSVLYSSN NNNYLAWYQQKPGQPPNLLIYWTSTRESGVPDR FSGSGSGTNFTLTISSLQAEDVAVYYCQQYYSTP PTFGQGTKVEIK | QVQLVQSGAEVKKPGASVKVSCKASGYTFTNYDL NWVRQATGQGLEWMGWMHPNSGNTGYAQKFQG RVTMTRNTSISTVYMELSSLRSEDTAVYYCAYSSG WYYFDYWGQGTLVTVSS |
| | | | SEQ ID NO: 26532 | SEQ ID NO: 30538 |
| iPS:435753 | 21-225_175G10 | NA | GACATCCAGATGACCCAGTCTCCATCCTCCCT GTCTGCATCTGTAGGAGACAGAGTCATCATCA CTTGCCGGGCAAGTCAGAGACCATTGGCAACTAT TTAAATTGGTATCAGCAGACAGAAACCAGGAGAG CCCCTAAGCTCCTGATCTATGCTGCATCCAGTT TGCACAGTGGGGGTCCCATCCAGGTTCAGTGGC AGTGGATCTGGGACAGATTTCACTCTCACCAT CAGCAGTCTGCAACCTGAAGATTTTGCAACTT ACTTCTGTCAACAGAGTTACAGAACCCCTCAG TGGACGTTCGGCCAAGGGACCAAGGTGGAAA TCAAA | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGCCATG AGCTGGGTCCGCCAGACTCCAGGGAAGGGGCTG GAGTGGGTCTCAATTATTAGTGGTAGTGGTGGTA ACACATACTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGAAAAGGGATACCT GGAACGGTTGGGATGCTTTTGATATCTGGGGCCA AGGGACAATGGTCACCGTCTCTTTA |
| | | | SEQ ID NO: 26533 | SEQ ID NO: 30539 |
| | | AA | DIQMTQSPSSLSASVGDRVIITCRASQTIGNYLN WYQQKPGRAPKLLIYAASSLHSGVPSGFSGSGS GTDFTLTISSLQPEDFATYFCQQSYRTPQWTFGQ GTKVEIK | EVQLLESGGGLVQPGGSLRLSCAASGFTFSSYAMS WVRQTPGKGLEWVSIISGSGGNTYYADSVKGRFTI SRDNSKNTLYLQMNSLRAEDTAVYYCAKRDTWN GWDAFDIWGQGTMVTVSL |
| | | | SEQ ID NO: 26534 | SEQ ID NO: 30540 |

FIGURE 50
(Continued)

| | | | | |
|---|---|---|---|---|
| iPS:435755 | 21-225_176H4 | NA | GATATTGTGATGACCCAGACTCCACTCTCTCTGTCCGTCACCCCTGGACAGCCGGCCTCCATCTCCTGCAAGTCTAGTCAGAGCTCCTGCATGTGATGGAAAGAGACTATTTGTATTGGTACCTGCAGAAGCCAGGCCAGCCTCCACAGCTCCTGATCTATGAAGTTTCAACCGGTTCTCTGGAGTGCCAGATAGGTTCAGTGCAGCGGTCAGGGACAGATTTCACACTGAAAATCAGCGGGTGGAGGCTGAGGATGTTGGGGATTTATTACTGCATGCAAAGTATACAGATTCCGTGGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGCTGGAGTGGGTGGCAATTATATGGTATGATGGAAGTTATAAATACTATGCAGACTCCGTGAAGGGCCGATTCACCATCTCCAGAGACACAATTCCAAGAACACGCTGTATCTGCAAATGAGCAGCCTGAGAGCCGAGGACACGGCTGTGTATTACTGTGCGAGAGATGCCCACGATTTTTGGAGTGGTTACTTGCCTACTGGGGCCAGGGAGCCCTGGTCACCGTCTCCTCA |
| | | AA | DIVMTQTPLSLSVTPGQPASISCKSSQSLLHGDGKTYLYWYLQKPGQPPQLLIYEVSNRFSGVPDRFSGSGSGTDFTLKISRVEAEDVGIYYCMQSIQIPWTFGQGTRVEIK | QVQLVESGGGVVQPGRSLRLSCAASGFTFSSYGMHWVRQAPGKGLEWVAIIWYDGSYKYYADSVKGRFTISRDNSKNTLYLQMSSLRAEDTAVYYCARDAHDFWSGYFAYWGQGALVTVSS |
| | | | SEQ ID NO: 26535 | SEQ ID NO: 30541 |
| | | | SEQ ID NO: 26536 | SEQ ID NO: 30542 |
| iPS:435759 | 21-225_176E6 | NA | GACATTGTGATGACTCAGTCTCCACTCTCCCTGCCCGTCACCCCTGGAGAGCCGGCCTCCATCTCCTGCAGGTCTAGTCAGAGCCTCCTGCATAATAATGGATACAAGTATATTGGTACCTGCAGAAGCCAGGGCAGTCTCCACAGTCCTGATCTAATTTGGGTTCTAATGGGCCCTCCGGGGTCCCTGACAGGTTCAGTGCCAGTGGATCAGGCACAGATTTTACACTGAAAATCAGCAGAGTGGAGGCTGAGGATGTTGGGGTTTATTACTGCATGCAAGTCTACAAAACTCCGTGGACGTTCGGCCAAGGGACCAAGGTGGAAATCAAA | GAGGTGCAACTGGTGGAGTCTGGGGGAGGCTTGGTACAGCCTGGGGGGTCCCTGAGACTCTCCTGTGCAGCCTCAGGATTCACCTTCAGTGGCCATAGTATGAACTGGGTCCGCCAGGCTCCAGGGAAGGGGCTGGAGTGGGTTGCATACATTAGCATTAGTGGTAGTACCATAAAAGTACGCAGACTCTGTGAAGGGCCGATTCATCATCTCCAGAGACAATGCCAGGATTCACTGTATCTGCAAATGAACAGCCTGAGAGACGAGGACACCGGCTGTGTATTACTGTGCGAGAAGGGGGATTACTGTGGTTCGGAATGAGGACGGTTTGGACGTCTGGGGCCAAGGGACCACGGTCACCGTCTCCTCA |
| | | | SEQ ID NO: 26537 | SEQ ID NO: 30543 |

FIGURE 50
(Continued)

| | | | |
|---|---|---|---|
| iPS:435761 | 21-225_176B11 | AA | DIVMTQSPLSLPVTPGEPASISCRSSQSLLHNNGYKYLDWYLQKPGQSPQLLIYLGSNRASGVPDRFSASGSGTDFTLKISRVEAEDVGVYYCMQVLQTPWTFGQGTKVEIK<br>SEQ ID NO: 26538 | EVQLVESGGGLVQPGGSLRLSCAASGFTFSGHSMNWVRQAPGKGLEWVAYISISGSTIKYADSVKGRFIISRDNARDSLYLQMNSLRDEDTAVYYCARRGITVVRNEDGLDVWGQGTTVTVSS<br>SEQ ID NO: 30544 |
| | | NA | GACATCCAGATGACCCAGTCTCCATCTCCCTGTCTGCATCTGTAGGAGACAGAGTCACCATCACTTGCCGGGCAAGTCAGGCATTAGAAATGATTTAGGCTGGTTTCAGCAGAAACCAGGGAAAGCCCCTAAGCGCCTGATCTATCTGCATCCAGTTTGCAAAGTGGGGTCCCATCAAGGTTCAGCGGCAGTGGATCTGGGACAGACGCCTGAAGATTTTGCAACTTATTGTCTACAGCATTATAGTTACCCGCTCACTTTCGGCGGAGGGACCAAGGTGGAGATCAAA<br>SEQ ID NO: 26539 | CAGGTGCAGCTGGTGGAGTCTGGGGGAGGCGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGCTGGAGTGGGTGTCAATTATATGGTATGATGGAACTAATAAATACTATGCAGACTCCGTGAAGGGCCGATTCACCATCTCCAGAGACAACAATTCCAAGAACACGCTGTTTCTGCAACTGAACAGCCTGTGCCGCAGATCCCTACACGGCTGTCTATTACTGTGCGGAGATCCCTTACGTGGATACAATGACCCGGTTTTGGACTACTGGGGCCAGGGAACCCTGGTCACCGTCTCCTCA<br>SEQ ID NO: 30545 |
| | | AA | DIQMTQSPSSLSASVGDRVTITCRASQGIRNDLGWFQQKPGKAPKRLIYAASSLQSGVPSRFSGSGSGTEFTLTLSSLQPEDFATYYCLQHYSYPLTFGGGTKVEIK<br>SEQ ID NO: 26540 | QVQLVESGGGVVQPGRSLRLSCAASGFTFSTYGMHWVRQAPGKGLEWVSIIWYDGTNKYYADSVKGRFTISRDNSKNTLFLQLNSLRAEDTAVYYCARDPLRGYNDPVLDYWGQGTLVTVSS<br>SEQ ID NO: 30546 |

FIGURE 50
(Continued)

| | | | |
|---|---|---|---|
| iPS:435763 | 21-225_176H12 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAACCGCTCGATCTATGCTGCATCCAGTT TGCAAAGTGGGGTCCCATCACGGTTCAGCGGC AGTGGATCTGGGACAGAATTCACTCTCACAAT CAGCAGCCTGCAGCCTGAAGATTTTGCAACTT ATTACGGTCTACAGCATATAGTTACCCTCGC AGTTTTGGCCAGGGGACCAAGCTGGAGATCAA A<br>SEQ ID NO: 26541 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGCAGTTATATGGTATGATGGAAGT AATAAATACTATGCCGACTCCGTGAAGGGCCGAT TCACCATCTCCAGAGACAATTCCAAGAACACGCT GTATCTGCAAATGAACAGCTGAGAGCCGAGGA CACGGCTGTATATTACTGTGCAGAGAAAAGTAT AGCAGCAACTGGTACGACTACGGTATGGACGTCT GGGGCCAAGGGACCACGGTCACCGTCTCCTCA<br>SEQ ID NO: 30547 |
| | | AA | DIQMTQSPSSLSASVGDRVTITCRASQGIRNDLG WYQQKPGKAPNRLIYAASSLQSGVPSRFSGSGS GTEFTLTISSLQREDFATYYGLQHNSYPRSFGQG TKLEIK<br>SEQ ID NO: 26542 | QVQLVESGGGVVQPGRSLRLSCAASGFTFSDYVM HWVRQAPGKGLEWVAVIWYDGSNKYYADSVKGR FTISRDNSKNTLYLQMNSLRAEDTAVYYCAREKYS SNWYDYGMDVWGQGTTVTVSS<br>SEQ ID NO: 30548 |
| iPS:435765 | 21-225_177D3 | NA | GACATCCAGATGACCCAGTCTCCATCCTCACT GTCTGCTTCTGGGCGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATATTGCAACTTA TTACTGCCAACAGTATATAGTTACCCATTCA CTTTCGGCGGAGGGACCAAGGTGGATATCAA A<br>SEQ ID NO: 26543 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCAGTATGTCATG AACTGGGTCCGCCAGGCTCCAGGGAAGGGGCTG GAGTGGGTCTCAGGTATGAGCGGTAGTGGTGTA GAACATACTACGCAGACTCCGTGAAGGACCGGT TCACCATCTCCAGAGACAATTCCAAGAACACGCT GTCTCTGCAAATGAACAGCCTGAGGGCCGAGGA CACGGCCGTATATTACTGTGCGAGAGTGACTTTC TTTGACTATTGGGGCCAGGGAACCCTGGTCACCG TCTCCTCA<br>SEQ ID NO: 30549 |

FIGURE 50
(Continued)

| | | | | |
|---|---|---|---|---|
| | | AA | DIQMSQSPSSLSASVGDRVTITCRASQGITNYLAWFQQKPGKAPKSLIYAASSLQSGVPSKFSGSGSGTDFTLTISSLQPEDFATYYCQQYNSYPFTFGPGTKVDIK | EVQLLESGGGLVQPGGSLRLSCAASGFTFSSYVMNWVRQAPGKGLEWVSGMSGSGGRTYYADSVKDRFTISRDNSKNTLSLQMNSLRAEDTAVYYCARVTFFDYWGQGTLVTVSS |
| | | | SEQ ID NO: 26544 | SEQ ID NO: 30550 |
| iPS:435767 | 21-225_177B4 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATCACTCTCACAATCAGCAGCCTGCAGCCTGAAGATTTTGCAACTTATTACTGTCTACAGCATTATAGTTTCCCTGCAGTTTTGGCCAGGGGACCAAGCTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGATTATGTCATGCACTGGGTCCGCCAGGCTCCAGGCAAGGGGCTGGAGTGGGTGGCAGTTATATGCAGACTCCGTATGATGAAGTAATAAATACTATGCAGACTCCGTGAAGGGCCGATTCATAGTCTCCAGAGACAATGAACAGCCTGAGAGCCGAGGACACGGCTGTGTATTACTGTGCGAGAGAAAAGTATAGCAGCAGCTGTGACTACGGTTTGGACGTCTGGGGCCAAGGGACCACGGTCACCGTCTCCTCA |
| | | | SEQ ID NO: 26545 | SEQ ID NO: 30551 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSFPRSFGQGTKLEIK | QVQLVESGGGVVQPGRSLRLSCAASGFTFSDYYMHWVRQAPGKGLEWVAVIWYDGSNKYYADSVKGRFIVSRDNSKNTLYLQMNSLRAEDTAVYYCAREKYSSSWYDYGLDVWGQGTTVTSS |
| | | | SEQ ID NO: 26546 | SEQ ID NO: 30552 |

FIGURE 50
(Continued)

| | | | | |
|---|---|---|---|---|
| iPS:435769 | 21-225_177B6 | NA | GACATCCAGATGACCCAGTCTCCATCCTCCCT GTCTGCATCTGTAGGAGACAGAGTCACCATCA CTTGCCGGGCAAGTCAGGACATTAGCAATGAT TTAGGCTGGTATCAGCAGAAACCAGGGAAAG CCCCTAAGCGCCTGATCTATGCTGCATCCAGT TTGCAAAGTGGGGGTCCCATCAAGGTTCAGCGG CAGTGGTTCTGGGACAGAATTCACTCTCACAA TCAACAGCCTGCAGCCTGAAGATTTTGCAACT TATTACTGTCTACAGCTTAATAGTTACCCATTC ACTTTCGGCCCTGGGACCAAAGTGGATATCAA A | GAGGTGCAGCTGTTGGAGTCTGGGGGAGGCTTG GTACAGCCGGGGGGGTCCCGGAGACTCCTCTGTG AAGCCTCTGGATTCACCTTTAGCAGTTATGCCAT GAGCTGGGTCCGCCAGGCTCCAGGGAAGGGCT GGAGTGGGTCTCAGTTATTAGTGGTAGTGGTAGT AACACATACTACGTAGACTCCGTGAAGGGCCGG TTCACCATCTCCAGAGACAATTCCAAGAACAGC TGAATCTGCAAATGAACAGCCTGAGAGCCGAGG ACTCGGCCGTATATTACTGTACGAAAGGTTACTA TGATAGTAGTAGGGTTATTACTACCCCTTTGACTTCT GGGGCCAGGGAACCCTGGTCACCGTCCTCA SEQ ID NO: 30553 |
| | | AA | DIQMTQSPSSLSASVGDRVTITCRASQDISNDLG WYQQKPGKAPKRLIYAASSLQSGVPSRFSGSGS GTEFTLTINSLQPEDFATYYCLQLNSYPFTFGPGT KVDIK SEQ ID NO: 26548 | EVQLLESGGGLVQPGGSRRLSCEASGFTFSSYAMS WVRQAPGKGLEWVSVISGSGSNTYYVDSVKGRFTI SRDNSKNTLNLQMNSLRAEDSAVYYCTKGYYDSS GYYYPFDFWGQGTLVTVSS SEQ ID NO: 30554 |
| iPS:435771 | 21-225_177B11 | NA | GATATTGTGATGACCCAGACTCCACTCTCT GTCCGTCACTCCTGGACAGCCGGCCTCCATCT CCTGCAAGTCTAGTCAGCGCCTCCTGCATGGT GATGGAAAGACCTATTTGTATTGGTACCTGCA GAAGCCAGGCCAGCCTCCACAGATCTGATCT ATGAAGTTTCCAACCGGTTCTCTGGAGTGCCA GATAGGTTCAGTGGCAGCGGGTCAGGGACAG AGTTCACACTTAAAATCAGCCGGGTGGAGGCT GAGGATGTTGGGGTTTATTACTGCATGCAAAG TATACAGATTCCGTGGACGTTCGGCCAAGGGA CCAAGGTGGAAATCAAA | CAGGTGCAACTGGTGGAGTCTGGGGGAGGCGTG GTCCAGCCTGGGGAGGTCCCTGAGACTCTCACCTGTG CAGCGTCTGGATTCACCTTCAGTAGCTATGGCAT GCACTGGGTCCGCCAGGCTCCAGGCAAGGGGCT GGAGTGGGTGGCAATTATATCATGTATGATGAAGT TATAAATACTATACAGACTCCGTGAAGGGCCGAT TCACCATCTCCAGAGACAATTCCAAGAACACGT GTATCTGCAAATGAACAGCCTGAGAGCCGAGGA CACGGCCTGTATTACTGTGCGAGAGAGACTTAC GATTTTTGGAGTGGTTATTTGTCTTCTGGGGCCA GGGAACCCTGGTCACCGTCCTCA SEQ ID NO: 30555 |
| | | | SEQ ID NO: 26549 | |

FIGURE 50
(Continued)

| | | | |
|---|---|---|---|
| iPS:435773 | 21-225_177B12 | AA | DIVMTQTPLSLSVTPGQPASISCKSSQRLLHGDGKTYLYWYLQKPGQPPQILIYEVSNRFSGVPDRFSGSGSGTEFTLKISRVEAEDVGVYYCMQSIQIPWTFGQGTKVEIK<br>SEQ ID NO: 26550 |
| | | | QVQLVESGGGVVQPGRSLRLTCAASGFTFSSYGMHWVRQAPGKGLEWVAIIWYDGSYKYTDSVKGRFTISRDNSKNTLYLQMNSLRAEDTAVYYCARETYDFWSGYFVFWGQGTLVTVSS<br>SEQ ID NO: 30556 |
| | | NA | GACATCGTGATGACCCAGTCTCCAGACTCCCTGGCTGTGTCTCTGGGCGAGAGGGCTACCGTCAACTGCAAGTCCAGCCAGAGTGTTTTACACAGCTCCAACAATAACAACTACTTAACTTGGTACCAGCAGAAACCAGGACAGCCTCCTAAGCTGCTCATTTACTGGGCATCTACCCGGGAGTCCGGGGTCCCTGACCGATTCAGTGGCAGTGGGTCTGGGACAGATTTCACTCTCACCATCAGCAGCCTGCAGGCTGAAGATGTGGCAGTTTATTACTGTCAGCAATATTATAGTAGTCCCGACGTTCGGCCAAGGGACCAAGGTGGAAATCAAA<br>SEQ ID NO: 26551 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATAATCAACTGGGTGCGACAGGCCACTGGACAAGGCTTGAGTGGATGGGATGCACCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGTATAGCAGTGGCTGGTACTTTGACTTTCTGGGCCAGGGAACCCTGGTCACCGTCTCCTCA<br>SEQ ID NO: 30557 |
| | | AA | DIVMTQSPDSLAVSLGERATVNCKSSQSVLHSSNNNNYLTWYQQKPGQPPKLLIYWASTRESGVPDRFSGSGSGTDFTLTISSLQAEDVAVYYCQQYYSSPPTFGQGTKVEIK<br>SEQ ID NO: 26552 | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDFWGQGTLVTVSS<br>SEQ ID NO: 30558 |

FIGURE 50
(Continued)

| | | | |
|---|---|---|---|
| iPS:435775 | 21-225_178A5 | NA | GACATCCAGATGACCCAGTCTCCATCTTCCGT GTCTGCATCTGTAGGAGACAGAGTCACCATCA CTTGTCGGGCGAGTCAGGTATTAGCAACTGG TTAGCCTGGTATCAGCAGAAACCAGGGAAAG CCCCTAAGCTCCTGATCTATGCTGCTTCCAGTT TGCAAAGTGGGGTCCCATCAAGGTTCAACGGC AGTGGATCTGGGACAGATTTCACTCTCACCAT CAGCAGCCTGCAGCCTGAAGATTTTGCAACTT ACTGTTGTCAACAGGCTAACAGTTTACCGTGG ACGTTCGGCCAAGGGACCAAGGTGGAAATCA AA | GAGGTGCACCTGTTGGAGTCTGGGGGAGGCTTGG TACAGACTGGGGGGTCCCTGAGACTCTCCTGTGC AGCCTCTGGATTCACCTTTAGCAGCTATGCCATG ACCTGGGTCCGCCAGGCTCCAGGGAAGGGGCTG GAGTGGGTCTCAGTTATTAGTGGTAGTGGTGTA ATACATTCTACGCAGACTCCGTGAAGGGCCGGTT CACCATCTCCAGAGACAATTCCAAGAATACGCTG TATCTGCAAATGAACAGCCTGAGAGCCGAGGAC ACGGCCGTATATTACTGTGCGCGCCGGGACGGTG ACTACTTTGACTACTGGGGCCAGGGAACCCTGGT CACCGTCTCCTCA |
| | | | SEQ ID NO: 26553 | SEQ ID NO: 30559 |
| | | AA | DIQMTQSPSSVSASVGDRVTITCRASQGISNWLA WYQQKPGKAPKLLIYAASSLQSGVPSRFNGSGS GTDFTLTISSLQPEDFATYCCQQANSLPWTFGQG TKVEIK | EVHLLESGGGLVQTGGSLRLSCAASGFTFSSYAMT WVRQAPGKGLEWVSVSVISGSGGNTFYADSVKGRFTI SRDNSKNTLYLQMNSLRAEDTAVYYCARRDGDYF DYWGQGTLVTVSS |
| | | | SEQ ID NO: 26554 | SEQ ID NO: 30560 |
| iPS:435777 | 21-225_178F7 | NA | GACATCCAGATGACCCAGTCTCCATCTTCCGT GTCTGCATCTGTAGGAGACAGAGTCACCATCA CTTGTCGGGCGAGTCAGGATATTACTGACTGG TTAGCCTGGTATCAGCAGAGAAACCAGGGAAAG CCCTAAACTCCTGATCTCTGCTGCATCCAGTT TGCAGAGTGGGGTCCCATCAAGGTTCAGCGGC AGTGGATCTGGGACAGATTTCACTCTCGCCAT CAGCAGCCTGCAGCCTGAAGATTTTGCAACTT ACTATTGTCAACAGGCTAACAGTTTACCGTGG ACGTTCGGCCAAGGGACCAAGGTGGAAATCA AA | GAGGTGCACCTGTTGGAGTCTGGGGGAGGCTTGG TACAGACTGGGGGGTCCCTGAGACTCTCCTGTGC AGCCTCTGGATTCACCTTTAGCAGCTATGCCATG ACCTGGGTCCGCCAGGCTCCAGGGAAGGGGCTG GAGTGGGTCTCAGTTATTAGTGGTAGTGGTGTA ACACATTCTACGCAGACTCCGTGAAGGGCCGGTT CACCATCTCCAGAGACAATTCCAAGAACACGCTG TATCTGCAAATGAACAGCCTGAGAGCCGAGGAC ACGGCCGTATATTACTGTGCGCGCCGGTACGGTG ACTACTTTGACTACTGGGGCCAGGGAACCCTGGT CACCGTCTCCTCA |
| | | | SEQ ID NO: 26555 | SEQ ID NO: 30561 |

FIGURE 50
(Continued)

| | | AA | DIQMTQSPSSVSASVGDRVTITCRASQDITDWLAWYQQKPGKAPKLLISAASSLQSGVPSRFSGSGSGTDFTLAISSLQPEDFATYYCQQANSLPWTFGQGTKVEIK | EVHLLESGGGLVQTGGSLRLSCAASGFTFSSYAMTWVRQAPGKGLEWVSVISGSGGNTFYADSVKGRFTISRDNSKNTLYLQMNSLRAEDTAVYYCARRYGDYFDYWGQGTLVTVSS |
|---|---|---|---|---|
| | | | SEQ ID NO: 26556 | SEQ ID NO: 30562 |
| iPS:435779 | 21-225_178B10 | NA | GACATCCAGATGACCCAGTCTCCATCCTCCTGTCTGCATCTGTCGGAGACAGAGTCACCATCACTTGCCGGGCAAGTCAGGGCATTAGAGAAATGATTTAGGCTGGTATCAGCAGAAACCAGGGAAAGCCCCTAAACACCTGATCTATGCTGCATCCAGTTTGCAAATGGGGTCCCATCAAGGTTCAGCGGCAGTGGCTCTGGGACAGAATTCACTCTCACAATCAGCAGCCTGCAGCCTGAAGATTTTGCCACTTATTACTGTCTACACCATTATAGTTTCCCGCTCACTTTCGGCGGAGGGACCAAGGTGGAGATCAAA | CAGGTGCAGCTGGTGGAGTCGGGGGGAGGCGTGGTCAGCCTGGGAGGTCCCTGAGACTCTCCTGTGTAGCGTCTGGATTCACCTCCAGTACCTATGGCATGCACTGGGTCCGCCAGGCTCCAGGCAAGGGGCTGGAATGGATGGCAATTATATGGTATGATGGAACTAATAAATACTATGCAGACTCCGTGAAGGGCCGATTCACCATCTCCAGAGACAATTCCAAGAACACGCTGTATCTGCAACTGAACAGCCTGAGAGCCGAGGACACGGCTGTGTATTACTGTGCCGAGATCCTTACGTGGATACAATGACCCGGTTATGGACTACTGGGGCCAGGGAACCCTGGTCACCGTCTCCTCA |
| | | | SEQ ID NO: 26557 | SEQ ID NO: 30563 |
| | | AA | DIQMTQSPSSLSASVGDRVTITCRASQGIRNDLGWYQQKPGKAPKHLIYAASSLQNGVPSRFSGSGSGTEFTLTISSLQPEDFATYYCLHHYSFPLTFGGGTKVEIK | QVQLVESGGGVVQPGRSLRLSCVASGFTSSTYGMHWVRQAPGKGLEWMAIIWYDGTNKYYADSVKGRFTISRDNSKNTLYLQLNSLRAEDTAVYYCARDPLRGYNDPVMDYWGQGTLVTVSS |
| | | | SEQ ID NO: 26558 | SEQ ID NO: 30564 |

FIGURE 50
(Continued)

| | | | |
|---|---|---|---|
| iPS:435781 | 21-225_178G10 | NA | CATATTGTGATGACCCAGACTCCACTCTCTG TCCGTCACCCCTGGAGACAGCCGGCCTCCATCTC CTGCAAGTCTAGTGACAGCCCTCGCATGGTG ATGGAAAGACCTATTTGTATTGGTACCTGCAG AAGCCAGGCCAGCCTCCACAGCTCCTGATCTA TGAAGTTTCCAACGGTTTCTGGAGTGCCAG ACAGACTCAGTGGCGCGGGTCAGGGACAGA TTTCACACTACTGAAAATCAGCCGGTGGAGGCTG AGGATGTTGGCATTTATTACTGCATGCAAAGT ATACAGGTTCCGTGACGTTCGGCCAAGGGAC CAAGGTGGAAATCAA <br><br>SEQ ID NO: 26559 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTATATGGTATGATGAAGT AATAAATACTACGAGACTCCGTGAAGGGCCGA TTCACCATCTCCAGAGACAATTCAAGAACACGC TGTATCTGCAAATGAACAGCCTGAGAGCCGAGG ACACGGCTGTTTATTACTGTGCGAGAGAACGGTA CGATTTTGGAGTGGTCATTTGACTACTGGGGC CAGGGAACCCTGGTCACCGTCTCCTCA <br><br>SEQ ID NO: 30565 |
| | | AA | HIVMTQTPLSLSVTPGQPASISCKSSQSLLHGDG KTYLYWYLQKPGQPPQLLIYEVSNRFSGVPDRL SGGGSGTDFTLKISRVEAEDVGIYYCMQSIQVPW TFGQGTKVEIK <br><br>SEQ ID NO: 26560 | QVQLVESGGGVVQPGRSLRLSCAASGFTFSTYGMH WVRQAPGKGLEWVAVIWYDGSNKYYADSVKGRF TISRDNFKNTLYLQMNSLRAEDTAVYYCARERYDF WSGHFDYWGQGTLVTVSS <br><br>SEQ ID NO: 30566 |
| iPS:435783 | 21-225_179G1 | NA | GACATCCAGATGACCCAGTCTCCATCTTCCGT GTCTGCATCTGTAGGAGACAGAGTCACCATCA CTTGTCGGGCGAGTCAGGATATTAGCGACTGG TTAGCCTGGTATCAGCAAAATCAGGGAAAGC CCCTAAACTCCTGATCTCTGCTGCATCCAGTTT GCAAAGTGGGGTCCCATCAAGGTTCGGCGGCA GTGGATCTGGGACAGATTTCACTCTCACCATC AGCAGCCTGCAACAGGCTAACGATTTTGCAACTTA CTATTGTCAACAGGCTAACAGTTTACCGTGA CGTTCGGCCAAGGGACCAAGGTGGAAATCAA A <br><br>SEQ ID NO: 26561 | GAGGTGCAGCTGGTGGAGTCGGGGGGAGGCTTG GTACAGACTGGGGGGTCCCTGAGACTCTCCTGTG CAGCCTCTGGATTCACCTTTAGCAGCTATGCCAT GACCTGGGTCCGCCAGGCTCCAGGGAAGGGCT GGAGTGGGTCTCAGTTATTAGTGGTTTGGTGGT AACACATTCTACGCAGACTCCGTGAAGGGCCGGT TCACCATCTCCAGAGACAATTCCAAGAGCACGCT GTATCTGCAAATGAACAGCCTGAGAGCCGAGGA CACGGCCGTATATTACTGTGCGCGCCGGTACGGT GACTACTTTGACTACTGGGGCCAGGGAACCCTGG TCACCGTCTCCTCA <br><br>SEQ ID NO: 30567 |

FIGURE 50
(Continued)

| | | | |
|---|---|---|---|
| iPS:435785 | 21-225_179C2 | AA | DIQMTQSPSSVSASVGDRVTITCRASQDISDWLA WYQQKSGKAPKLLISAASSLQSGVPSRFGGSGS GTDFTLTISSLQPEDFATYYCQQANSLPWTFGQG TKVEIK<br>SEQ ID NO: 26562 | EVHLLESGGGLVQTGGSLRLSCAASGFTFSSYAMT WVRQAPGKGLEWVSVISGFGGNTFYADSVKGRFTI SRDNSKNTLYLQMNSLRAEDTAVYYCARRYGDYF DYWGQGTLVTVSS<br>SEQ ID NO: 30568 |
| | | NA | GATATTGTGATGACCCAGACTCCACTCTCTCT GTCCGTCACCCCTGGACAGCCGTCCATCT CCTGCAAATCTAGTCAGAGCCTCCTGCATAGT GAGGGAAAGACCTACTTTGTATTGGTACCTGCA GAAGCCAGGCCAGCCTCCACAGCTCCTGATCT ATGAGGTTTCCCACCGGTTCTCTGGAGTGCCA GATAGGTTCAGTGGCAGCGGGTCAGGGACAG ATTTCACACTGAAAATCAGCGGGGTGAGGCT GAGGATGTTGGGGTTTATTACTGCATGCAAAG TATACAGGTTCTCACTTTCGGCGGAGGGACCA AGGTGGAGATCAAA<br>SEQ ID NO: 26563 | CAGGTGCAGCTGGTGGAGTCGGGGGAGGCGTG GTCCAGCCTGGGAGGTCCCTGAGACTCTCCTGTG CAGCGTCTGGATTCACCTTCAGTAGTACTATGCAT GCACTGGGTCCGCCAGGCTCCAGGCAAGGGGCT GGAGTGGGTGGCACTTATATTTATGATGGAAGT AATAAATACTATGCAGACTCCGTGAAGGGCCGA TTCACCATCTCCAGAGACAACGCCAAGAACACGC TGTTTCTGCAAATGAACAGCCTGAGAGCCGAGG ACACGGCTGTGTATTACTGTGCGAGACGGTATAG CGGCAGCTGGTCCGGTGGTATGGACGTCTGGGGC CAAGGGACCACGGTCACCGTCTCCTCA<br>SEQ ID NO: 30569 |
| | | AA | DIVMTQTPLSLSVTPGQPASISCKSSQSLLHSEGK TYLYWYLQKPGQPPQLLIYEVSHRFSGVPDRFSG SGSGTDFTLKISRVEAEDVGVYYCMQSIQVLTFG GGTKVEIK<br>SEQ ID NO: 26564 | QVQLVESGGGVVQPGRSLRLSCAASGFTFSSYGMH WVRQAPGKGLEWVALIFYDGSNKYYADSVKGRFT ISRDNSKNTLFLQMNSLRAEDTAVYYCARRYSGSW SGGMDVWGQGTTVTVSS<br>SEQ ID NO: 30570 |

FIGURE 50
(Continued)

| | | | | |
|---|---|---|---|---|
| iPS:435787 | 21-225_180A3 | NA | GACATCCAGATGACCCAGTCTCCATCTTCCGT GTCTGCATCTGTAGGAGACAGAGTCACCATCA CTTGTCGGGCGAGTCAGGATATTACCAGCTGG TTAGCCTGGTATCAGCAGAAACCAGGGAAAG CCCCTAAGCTCCTGATCTATGCTGCATCCAGT TGCAAAGTGGGGTCCCATCAAGGTTCAGCGGC AGTGGATCTGGGACAGATTTCATTCTCACCAT CAGCAGCCTGCAGCCTGAAGATTTTGCATTT ACCATTGTCAACAGGCTAACAGTATCCCATTC ACTTTCGGCCCTGGGACCAAAGTGGACATCAA C | GAGGTGCAGCTGTTGGAGTCTGGGGGAGGCTTG GAACAGCCTGGGGGGTCCCTGAGACTCTCCTGTG CAGCCTCTGGATTCACCTTTAGCAGCTTTGCCAT GAACTGGGTCCGCCAGGCTCCAGGGAAGGGGCT GGAGTGGGTCTCAGTTATTAGCGGTCGCGGTGT AACACATTCTACGCAGACTCCGTGAAGGGCCGGT TCACCATCTCCAGAGACAATTCCAAGAACACGCT GTTTCTGCAAATGAACAGCCTGAGAGCCGAGGA CACGGCCGTATATTTCTGTGCGAAACGGACTGGG GATGATGTTTTGATGTCTGGGGCCAAGGGACAA TGGTCACCGTCTCTCA |
| | | | SEQ ID NO: 26565 | SEQ ID NO: 30571 |
| | | AA | DIQMTQSPSSVSASVGDRVTITCRASQDITSWLA WYQQKPGKAPKLLIYAASSLQSGVPSRFSGSGS GTDFILTISSLQPEDFAFYHCQQANSIPFTFGPGT KVDIN | EVQLLESGGGLEQPGGSLRLSCAASGFTFSSFAMN WVRQAPGKGLEWVSVISGRGGNTFYADSVKGRFTI SRDNSKNTLFLQMNSLRAEDTAVYFCAKRTGDDV FDVWGQGTMVTVSS |
| | | | SEQ ID NO: 26566 | SEQ ID NO: 30572 |
| iPS:435789 | 21-225_180C4 | NA | GATATTGTGATGACCCAGACTCCACTCTCT GTCCGTCACCCTGGACAGCCGGCTCCCATCT CCTGCAAGTCTAGTCAGAGCCTCCTGCATGGT GATGGAAAGACCTATTTGTATTGGTACCTGCA GAAGCCAGGCCAGCTCCACAGCTCCTGATCT ATGCAACTTCCAACGGTTCCCTGGAGTGTCA GATAGGTTCAGTGGCAGCGGGTCAGGTACAG ACTTCACACTGAAATCAGCGGGTGCATGAGCT GAGGATGTTGGGGTTTATTACTGCATGCAAAG TATACAGGTTCCGTGACGTTCGGCCAAGGGA CCAAGGTGGAAATCAAA | CAGGTGCAGCTGGTGGAGTCTGGGGGAGGCGTG GTCCAGCCTGGGAGGTCCCTGAGACTCTCCTGTG CAGCGTCTGGATTCACCTCAGTGCTATGCAT GCACTGGGTCCGCCAGGCTCCAGGCAAGGGGCT GGAGTGGGTGACAATTATTGGTATGATGGAAGT TATAAATACTATGCAGACTCCGTGAAGGGCCGAT TCGCCATCTCCAGAGACACGCTGAATAACGCT GTATCTGCAAATGAACAGCCTGAGAGCCGAGGA CACGGCTGTGTATTACTGTGCGAGAACGGTGTG GATCCCTGGACTACTACAACGAATGACGTCT GGGGCCAAGGGACCACGGTCACCGTCTCCTCA |
| | | | SEQ ID NO: 26567 | SEQ ID NO: 30573 |

FIGURE 50
(Continued)

| | | | |
|---|---|---|---|
| iPS:435791 | | AA | DIVMTQTPLSLSVTPGQPASISCKSSQSLLHGDG KTYLYWYLQKPGQPPQLLIYATSNRFPGVSDRFS GSGSGTDFTLKISRVEAEDVGVYYCMQSIQVPW TFGQGTKVEIK<br>SEQ ID NO: 26568 | QVQLVESGGGVVQPGRSLRLSCAASGFTFSAYGM HWVRQAPGKGLEWVTIIWYDGSYKYYADSVKGRF AISRDNSKNTLYLQMNSLRAEDTAVYYCARTGVDP WDYYNGMDVWGQGTTVTVSS<br>SEQ ID NO: 30574 |
| | 21-225_180H7 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATACTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCATCT TATTACTGTCTACAGCATATAAGTTACCCATTC ACTTTCGGCCCTGGGACCAAAGTGGATTTCAA A<br>SEQ ID NO: 26569 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGACT GGAGTGGGTGGCAGTTATATGGTATGATGAAAAT AATAAACACTATGCAGACTCCGCGAAGGGCCGA TTCACCATCTCCAGAGACAATTCCAAGAACACGC TGTATCTGCAAATGAACAGCCTGAGAGTCGAAG ACACGGCTGTGTATTACTGTGCGAGAGAGGTTGG CTGGTCCGATGACTACTGGGGCCAGGGAACCCTG GTCACCGTCTCCTCA<br>SEQ ID NO: 30575 |
| | | AA | DIQMTQSPSSLSASVGDRVTITCRASQGIRNDLG WYQQKPGKAPKRLIYTASSLQSGVPSRFSGSGSG TEFTLTISSLQPEDFASYYCLQHNSYPFTFGPGTK VDFK<br>SEQ ID NO: 26570 | QVQLVESGGGVVQPGRSLRLSCAASGFTFSDYGM HWVRQAPGKGLEWVAVIWYDENNKHYADSAKGR FTISRDNSKNTLYLQMNSLRVEDTAVYYCAREVG WSDDYWGQGTLVTVSS<br>SEQ ID NO: 30576 |

FIGURE 50
(Continued)

| | | | | |
|---|---|---|---|---|
| iPS:435793 | 21-225_180F8 | NA | GACATCCAGATGACCCAGTCTCCATCCTCCCT GTCTGCATCTGTAGGAGACGGAGTCACCATCA CTTGCCGGGCAAGTCAGACAGATTCAGCTAT TTAAATTGGTATCAGCAGAAACCAGGGAAAG CCCCTAAACTCCTGATCTATGCTGTATCCAGTT TACAAAGTGGGGTCCCATCAAGGTTCAGTGGC AGTGGATCGGGACAGATTTCTCTCACCAT CAGCAGTCTGCAACCTGCAAGATTTTGCAACTT ACTACTGTCAGCAGAGTTACAGTACCCCATTC ACTTTCGGCCCTGGGACCAAAGTGGATATCAA A<br>SEQ ID NO: 26571 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGTCAGTTATATGGTATGATGAAGT GATAAATACTATCCAGAGACAATTCCAAGAACACGC TTCACCATCTCCAGAGACAATGAACAGCCTGAGG TGTATCTGCAAATGAACAGCCTGAGAGCCGAGG ACACGGCTGTGTATTACTGTGCGAGAGATCATCC CCGGTGAGCTACGGAGACTACTGGGGCCAGGG AACCCTGGTCACCGTCTCCTCA<br>SEQ ID NO: 30577 |
| | | AA | DIQMTQSPSSLSASVGDRVTITCRASQTIQLSYLN WYQQKPGKAPKLLIYGVSSLQSGVPSRFSGSGS GTDFSLTISSLQPEDFATYYCQQSYSTPFTFGPGT KVDIK<br>SEQ ID NO: 26572 | QVQLVESGGGVVQPGRSLRLSCAASGFTFSSYGMH WVRQAPGKGLEWVSVIWYDGSDKYYEDSVKGRF TISRDNSKNTLYLQMNSLRAEDTAVYYCARDHPR WSYGDYWGQGTLVTVSS<br>SEQ ID NO: 30578 |
| iPS:435795 | 21-225_181C2 | NA | GAAATTGTGATGACCCAGACTCCACTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAAGCCAGGCCAGCCTCCACAGCTCCTGATCC ATGAAGTTTCCAACCGGTTCTCTGGAGTGCCA GATAGGTTCAGTGGCAGCGGGTCAGGACAG ATTTCACACTGAAAATCAGCGGGGTGGAGGCT GAGGATGTTGGGGTTTATTACTGCATGCAAAG TATACAGGTTCCCTGACGTTCGGCCAAGGGA CCAAGGTGGAAATCAAA<br>SEQ ID NO: 26573 | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGCT GGAATGGGTGACAATTATATGTATGATGGAAGT TATAAATACTATCCAGAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATCATTAC GATTTTTGGAGTGGGCACTTGACTTCTGGGGCC AGGGAACCCTGGTCACCGTCTCCTCA<br>SEQ ID NO: 30579 |

FIGURE 50
(Continued)

| | | | |
|---|---|---|---|
| iPS:435797 | 21-225_181G2 | AA | EIVMTQTPLSLSVTPGQPASISCKSSQSLLHGDGK TYLYWYLQKPGQPPQLLIHEVSNRFSGVPDRFSG SGSGTDFTLKISRVEAEDVGVYYCMQSIQVPWT FGQGTKVEIK<br>SEQ ID NO: 26574 | QVQLVESGGGVVQPGRSLRLSCVASGFTFSSYGMH WVRQAPGKGLEWVTIIWYDGSYKYYADSVKGRFT ISRDNSKNTLYLQMNSLRAEDTAVYYCARDHYDF WSGHFDFWGQGTLVTVSS<br>SEQ ID NO: 30580 |
| | | NA | GACATCCAGATGACCCAGTCTCCATCCTCACT GTCTGCATCTATAGGAGAGAGAGTCACCATCA CTTGTCGGGCAAGTCAGGGCATTAGCAATTAT TTAGCCTGGATTCAGCAGAAACCAGGACAGC CCCTAAGTCCCTGATCTATGCTGCATCCAGTTT GCAAAGTGGGGTCTCATCAAGGTTCAGCGGCA GTGGATTTGGGACAGATTTCACTCTCACCATC AGTAGTCTGCAGCCTGAAGATTTTGCAACTTA TTACTGCCAACAGTATATAATGGTTACCCATTCA CTTTCGGCCCTGGGACCAAAGTGGATATCAAA<br>SEQ ID NO: 26575 | CAGGTGCAGCTGGTGCAGTCTGGGGCTGAAGTG AAGACGCCTGGGGCTCAGTGAAGGTCCTGCA GGGCTTCTGGATACACCTTCACCAGCTACAATAT GCACTGGGTGCGACAGGTCCCTGGACAAGGGCT TGAGTGGATGGGATGGATCAACAATGGT GGCTCAAACTATACACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br>SEQ ID NO: 30581 |
| | | AA | DIQMTQSPSSLSASIGERVTITCRASQGISNYLAW IQQKPGTAPKSLIYAASSLQSGVSSRFSGSGFGTD FTLTISSLQPEDFATYYCQQYNGYPFTFGPGTKV DIK<br>SEQ ID NO: 26576 | QVQLVQSGAEVKTPGASVKVSCRASGYTFTSYNM HWVRQVPGQGLEWMGWINPNNGGSNYTQKFQGR VTMTRDTSISTAYMELSRLRSDDTAVYYCARKFGD WGQGTLVTVSS<br>SEQ ID NO: 30582 |

FIGURE 50
(Continued)

| | | | |
|---|---|---|---|
| iPS:435799 | 21-225_181G3 | NA | GACATCCAGATGACCCAGTCTCCATCCCCT GTCTGCATCTGTAGGAGACAGAGTCAACATCA CTTGCCGGGCAAGTCACAGATTAGCAACTAT TTAAATTGGTATCAGCAGAAAGCAGGAAAG CCCCTAACCTCTTGATCTATACTACATTGAATT TGCAAAGTGGGGGTCCCATCAAGGTCAGTGGC AGTGGATCGGGACAGATTTCACTCTCACCAT CAGCAGTCTGCAACCTGCAAGATTTTGCAACTT ACTACTGTCAACAGAGTTACAGTTCTCCG TGGACGTTCGGCCAAGGGACCAAGGTGAAA TCAAA<br><br>SEQ ID NO: 26577 | GAGGTGCAACTGTTGGAGTCTGGGGGAGGCTTG GTACAGCCTGGGGGGTCCCTGAGACTCTCCTGTG CAGCCCTCTGATTCACCTTTAGCAGCTATGCCAT GAGTTGGGTCCGCCAGGCTCCAGGGAAGGGCT GGAGTGGGTCTCAGTTATTAGTGGTAGTGGTGGT AACACATTCTACGGAGACTCCGTGAAGGGCCGG TTCACCATCTCCAGAGACAATTCCAAGAACACGC TGTATCTGCAAATGAACAGCCTGAGAGCCGAGG ACACGGCCATATATTACTGTGCGAAACGGGAGA CCTACGACTGGGGATCCGATGCTTTTGATATCTG GGGCCAAGGGACAATGGTCACCGTCTCTTCA<br><br>SEQ ID NO: 30583 |
| | | AA | DIQMTQSPSSLSASVGDRVNITCRASHSISNYLN WYQQKAGKAPNLLIYTITLNLQSGVPSRFSGSGS GTDFTLTISSLQPEDFATYCQQSYSSPPWTFGQ GTKVEIK<br><br>SEQ ID NO: 26578 | EVQLLESGGGLVQPGGSLRLSCAASGFTFSSYAMS WVRQAPGKGLEWVSVISGSGGNTFYGDSVKGRFTI SRDNSKNTLYLQMNSLRAEDTAIYYCAKRETYDW GSDAFDIWGQGTMVTVSS<br><br>SEQ ID NO: 30584 |
| iPS:435801 | 21-225_181E5 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGC TCCAACAATTACAACTACTTAACTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCATCAG TATTTTTATTACTCCGGTGACGTTCGGCCAAGG GACCAAGGTGAAATCAAA<br><br>SEQ ID NO: 26579 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGAACAGAAGTTCCAGGGCA GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTACTTTGACTACTGGGAGTAGTAG TGGCTGGTACATCTTTGACTACTGGGGCCAGGGA ACCCTGGTCACCGTCTCCTCA<br><br>SEQ ID NO: 30585 |

FIGURE 50
(Continued)

| | | | |
|---|---|---|---|
| iPS:435805 | | AA | DIVMTQSPDSLAVSLGERATINCKSSQSVLHSSN NYNYLTWYQQKPGQPPKLLIYWASTRESGVPDR FSGSGSGTDFTLTISSLQAEDVAVYYCHQYFITP WTFGQGTKVEIK<br><br>SEQ ID NO: 26580 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YIFDYWGQGTLVTVSS<br><br>SEQ ID NO: 30586 |
| | | NA | GACATCCAGATGACCCAGTCTCCATCCTCCCT GTCTGCATCTGTAGGAGACAGAGTCACCATCA CTTGCCGGGCAAGTCAGAGCATTAGAAATGAT TTAGGCTGGTATCAGCAGAAACCAGGAAAAG CCCCTAAGCGCCTGATCTATACTGCATCCAGT TTGCAAAGTGGGGTCCCATCAAGGTTCAGCGG CAGTGGATCTGGGACAGATTTCACTCTCACAA TCAGCAGCCTGCAGCCTGAAGATTTTGCATCT TATTACTGTCTACAGCATATAAGTTACCCATTC ACTTTCGGCCCTGGGACCAAAGTGGATTTCAA A<br><br>SEQ ID NO: 26581 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGACT GGAGTGGGTGGCAGTTATATGCAGACTCCGGA AATAAACACTATGCAGACTCCGGAAGGCCGA TTCACCATCTCCAGAGACAATTCCAAGAACACGC TGTATCTGCAAATGAACAGCCTGAGAGCCGAAG ACACGGCTGTGTATTACTGTGCGAGAGAGGTTGG CTGGTCCGATGACTACTGGGGCCAGGGAACCCTG GTCATCGTCTCCTCA<br><br>SEQ ID NO: 30587 |
| 21-225_181A8 | | AA | DIQMTQSPSSLSASVGDRVTITCRASQGIRNDLG WYQQKPGKAPKRLIYTASSLQSGVPSRFSGSGSG TDFTLTISSLQPEDFASYYCLQHNSYPFTFGPGTK VDFK<br><br>SEQ ID NO: 26582 | QVQLVESGGGVVQPGRSLRLSCAASGFTFSDYGM HWVRQAPGKGLEWVAVIWYDENNKHYADSAKGR FTISRDNSKNTLYLQMNSLRAEDTAVYYCAREVG WSDDYWGQGTLVTVSS<br><br>SEQ ID NO: 30588 |

FIGURE 50
(Continued)

| | | | | |
|---|---|---|---|---|
| iPS:435807 | 21-225_181C10 | NA | GATATTGTGATGACCCAGACTCCACTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAAGCCAGGCCAGCCTCCACAGCTCCTGATCT ATGAAGTTTCCAATCGGTTCTCTGGAGTGCCA GATAGGTTCAGTGGCAGCGGGTCAGGGACAG ATTTCACACTTAAAATCAGCCGGGTGCAAAG GAGGATGTTGGGGTTTATCACTGCATGCAAAG TATACAGATTCCCTGGACGTTCGGCCAAGGGA CCAAGGTGGAAATCAAA<br><br>SEQ ID NO: 26583 | CAGGTGCAACTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCTT GGAGTGGATGGCAATTATATGGTATGATGGAAGT TATAAATACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGATCATTAC GATTTTTGGAGTGGGCACTTTGACTACTGGGGCC AGGGAACCCTGGTCACCGTCTCCTCA<br><br>SEQ ID NO: 30589 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYHCMQSIQPWT FGQGTKVEIK<br><br>SEQ ID NO: 26584 | QVQLVESGGGVVQPGRSLRLSCAASGFTFSSYGMH WVRQAPGKGLEWMAIIWYDGSYKYYADSVKGRF TISRDNSKNTLYLQMNSLRAEDTAVYYCARDHYDF WSGHFDYWGQGTLVTVSS<br><br>SEQ ID NO: 30590 |
| iPS:435809 | 21-225_182H5 | NA | GACATCCAGATGACCCAGTCTCCATCTCCGT GTATGCATCTGTTGGAGACAGAGTCACCATCA CTTGTCGGGCGAGTCAGGATATTACCAGCTGG TTAGCCTGGTATCAGCAGAAACCAGGGAAAG CCCCTAAACTCCTGATCTATGCTGCATCCAGTT TACAAAGTGGGGTCCCATCAAGGTTCAGCGGC AGTGGATCTGGGACAGATTTCATTCTCACCAT CACCAGCGTGCAGCCTGATGATTTTGCAACTT ACTATTGTCAACAGGTTAACAGTTTCCCATTC ACTTTCGGCCACGGGACCAAAGTGGATATCAA A<br><br>SEQ ID NO: 26585 | GAGGTGCAGCTGTGTTGGAGTCTGGGGGAGGCTTG GTACAGCCTGGGGGGTCCCTGAGACTCTCCTGTG CAGCCTCTGGATTCACCTTTAGCAGCTATGCCAT GAGTTGGGTCCGCCAGGCTCCAGGGAAGGGGCT GGAGTGGGTCTCAGTTATTAGTGGTAGAGGTGGT ACCACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGAAACGACTGGG GATGATGTTTTTGATATCTGGGGCCAAGGGACAA TGGTCACCGTCTCTTCA<br><br>SEQ ID NO: 30591 |

FIGURE 50
(Continued)

| | | | | |
|---|---|---|---|---|
| iPS:435811 | 21-225_183H6 | AA | DIQMTQSPSSVYASVGDRVTITCRASQDITSWLA WYQQKPGKAPKLLIYAASSLQSGVPSRFSGSGS GTDFILTITSVQPDDFATYYCQQVNSFPFTFGHG TKVDIK<br>SEQ ID NO: 26586 | EVQLLESGGGLVQPGGSLRLSCAASGFTFSSYAMS WVRQAPGKGLEWVSVISGRGGTTFYADSVKGRFTI SRDNSKNTLYLQMNSLRAEDTAVYYCAKRTGDDV FDIWGQGTMVTVSS<br>SEQ ID NO: 30592 |
| | | NA | GACATCCAGATGACCCAGTCTCCATCCTCCCT GTCTGCATCTGTAGGAGACAGAGTCACCATCG CTTGCCAGGCGAGTCAGGACATTAGCAACTAT TTAAATTGGTATCAGCAGAAACCAGGGAAAGC CCCTAAGGCTCCTGATCTACGCTGCATCCAATT TGGAAACAGGGGGTCCCAGCAGGTTCAGTGG AAGTGGATCTGGGACAGATTTTACTTTCACCA TCAGCAGCCTGCAGCCTGAAGATATTGCAACA TATTACTGTCAACAGTATGATAATCTCCCTCTC ACTTTCGGCGGAGGGACCAAGGTGGACATCA AA<br>SEQ ID NO: 26587 | CAGGTGCAGCTGCTGGTGGAGTCTGGGGGAGGCGTG GTCCAGCCTGGGAGGTCCCTGAGACTCTCCTGTG CAGCCTCTGGATTCACCTTCAGTAGCTATGCAT GCACTGGGTCCGCCAGGCTCCAGGCAAGGGGCT GGAGTGGGTGGCAATTATATCAGACTCCGTGAAGGCCGAT ACTAAATTCTATGCAGACTCCGTGAAGGGCCGAT TCACCATCTCCAGAGACAACAATTCCAAGAACACGCT GTATCTGCAAATGAACAGCTGAGAGCTGAGGA CACGGCTGTGTATTACTGTGTGAGAAGGCCCCG CAGTGGCTGGTAGAGGGCTACGGTATGGACGTCT GGGGCCAAGGGACCACGGTCACCGTCTCCTCA<br>SEQ ID NO: 30593 |
| | | AA | DIQMTQSPSSLSASVGDRVTIACQASQDISNYLN WYQQTPGKAPKVLIYDASNLETGVPARFSGSGS GTDFTFTISSLQPEDIATYYCQQYDNLPLTFGGG TKVDIK<br>SEQ ID NO: 26588 | QVQLVESGGGVVQPGRSLRLSCAASGFTFSSYGMH WVRQAPGKGLEWVAIISYAGSTKFYADSVKGRFTI SRDNSKNTLYLQMNSLRAEDTAVYYCVRRPPQWL VEGYGMDVWGQGTTVTVSS<br>SEQ ID NO: 30594 |

FIGURE 50
(Continued)

| | | | |
|---|---|---|---|
| iPS:435813 | 21-225_183A12 | NA | GACATCCAGATGACCCAGTCTCCATCCTCCT GTGTCCTCTGTAGGAGACAGAGTCACCATCA CTTGCCGGGCAAGTCAGAACATCAGCAACTAT TTAAATTGGTATCAGCAGAAACCAGGGAAAG CCCCTAAGCTCCTGATCTATGTTGTATCCAGTT TGCAAAGTGGGGTCCCATCAAGGTTCAGTGGC AGTGGATCTGGGACAGATTCACTCTCACCAT CAGCAGTCTACAACCTGAAGAGTTTTGCAACTT ACTACTGTCAACAGAGTTACAGTTCCCCTCCG TGGACGTTCGGCCAAGGGACCAAGGTGGATAT CAGA<br>SEQ ID NO: 26589 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATCTGCTGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTATTGTGCGAGAAGGTATAG CAGTGGCTGGGACTGGTTCGACCCCTGGGGCCAG GGAACCCTGGTCACCGTCTCCTCA<br>SEQ ID NO: 30595 |
| | | AA | DIQMTQSPSSLSASVGDRVTITCRASRNISNYLN WYQQKPGKAPKLLIYVVSSLQSGVPSRFSGSGS GTDFTLTISSLQPEDFATYCQQSYSSPPWTFGQ GTKVDIR<br>SEQ ID NO: 26590 | QVQLVESGGGVVQPGRSLRLSCAASGFTFSSYGMH WVRQAPGKGLEWVAVISSAGSNKYYADSVKGRFT ISRDNSKNTLYLQMNSLRAEDTAVYYCARRYSSG WDWFDPWGQGTLVTVSS<br>SEQ ID NO: 30596 |
| iPS:435815 | 21-225_190G10 | NA | GAAATTGTGTTGACGCAGTCTCCAGGCACCCT GTCTTTGTCTCCAGGGGAAAGAGCCACCCTCT CCTGCAGGGCCAGTCCGAGTGTTAGCAGCAGA TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CAACAGCAGACTGGAGCCTGAAGATTTTGCAG TGTATTACTGTCAGCAGTATGGTAGCTCACCT CCGTGGACGTTCGGCCAAGGGACCAAGGTAG AAATCAAA<br>SEQ ID NO: 26591 | GAGGTGCAGCTGGTGGAGTCTGGGGGAGGCCTG GTCAAGCCTGGGGGGTCCCTGAGACTCTCCTGTG CAGCCTCTGGATTCACCTTCACCTTCAGGACTATAGCAT GAACTGGGTCCGCCAGGCTCCAGGGAAGGGGCT GGAGTGGGTCTCATCTATTAGTAGTGGTAGTGGT TACATACACTACCGACAGACTCAGTGAAGGGCCGA TTCACCATCTCCAGAGACAATGAACAAGCCAAGAACTCAC ACACGGCTGTGTATTACTGTGCGCGAGCAACTAT GGCCCTTGACTACTGGGGCCAGGGAACCCTGGTC ACCGTCTCCTCA<br>SEQ ID NO: 30597 |

FIGURE 50
(Continued)

| | | | |
|---|---|---|---|
| iPS:435817 | 21-225_190B11 | AA | EIVLTQSPGTLSLSPGERATLSCRASPSVSSRFLA WYQQKPGQAPRLLIYGASSRATGIPDRFSGSGSG TDFTLTNSRLEPEDFAVYYCQQYGSSPPWTFGQ GTKVEIK |
| | | | SEQ ID NO: 26592 |
| | | | EVQLVESGGGLVKPGGSLRLSCAASGFTFRDYSMN WVRQAPGKGLEWVSSISSGSGYIHYADSVKGRFTIS RDNAKNSLYLQMNSLRAEDTAVYYCARATMALD YWGQGTLVTVSS |
| | | | SEQ ID NO: 30598 |
| | | NA | GAAATTGTGCTGACTCAGTCTCCAGACTTTCA GTCTGTGGCTCCAAAGGAGAAAGTCACCATCA CCTGCCGGGCCAGTCAGAGTATTGGTAGTAAC TTACACTGGTACCAGCAGAAACCAGATCAGTC TCCGAAACTCTCATCAAGTCTGCTTCCCAGTC CTTCTCAGGGTCCCCTCGAGGTTCAGTGGCA GTGGATCTGGGACAGATTTCACCCTCACCATC AATAGCCTGGAAACTGAAGATGCTGCAAGTA TTACTGTCAGCAGAGTAGTAGTTTACCGTGGA CGTTCGGCCAAGGGACCAAGGTGGAAATCAA A |
| | | | SEQ ID NO: 26593 |
| | | | CAGGTGCAGCTGCAGGAGTCGGGCCAGGACTG GTGAAGCCTTCGGAGACCCTGTCCCTCACCTGCA CTGTCTCTGGTGGCTCCATCAATAATTACTACTG GAGCTGGATCCGGCAGCCCGCGGGAAGGGACT GGAGTGGATTGGGCGTATATACCAGTGGGAGC ACCAACTACAACCCCTCCCTCAAGAGTCGAGTCA CCATGTCAGTAGACACGTCCAAGAACCAGTTCTC CCTGAAGCTGAGCTCTGTGACCGCCGCGGACACG GCCGTGCATTACTGTGCGAGAGATCGGGGATACT ATGGCTACTACGGTATGGACGTCTGGGGCCAAG GGACCACGGTCACCGTCTCCTCA |
| | | | SEQ ID NO: 30599 |
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK |
| | | | SEQ ID NO: 26594 |
| | | | QVQLQESGPGLVKPSETLSLTCTVSGGSINNYYWS WIRQPAGKGLEWIGRIYTSGSTNYNPSLKSRVTMS VDTSKNQFSLKLSSVTAADTAVHYCARDRGYYGY YGMDVWGQGTTVTVSS |
| | | | SEQ ID NO: 30600 |

FIGURE 50
(Continued)

| | | | |
|---|---|---|---|
| iPS:435819 | 21-225_190C11 | NA | GACATCCAGATGACCCAGTCTCCTTCCTCACTGTCTGCATCTGTAGGAGACAGAGTCACCATCACTTGTCGGACGAGTCAGGGCATTGGCAATTATTTAGCCTGGTTTCAGCAGAGAACCAGGGAAAGCCCCTAAGTCCCTGCTCTATAAAACATCCAGTTTACAAAGTGGGGGTCCCATCAAAGTTCAGCGGCAGTGGATCTGGGACAGATTTCACTCTCACCATCAGCAGCCTGCAGCCTGAAGATTTTGCAACTTATTACTGCCAACAGTATATGACTTACCCGCTCACTTTCGGCGGAGGGACCAAGGTGGAGATCAAA SEQ ID NO: 26595 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGGAAGTAATAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGGCGTGGGCTACGACGGTTTGACGGTCTGGGGCCAAGGGACCACGGTCACCGTCTCCTCA SEQ ID NO: 30601 |
| | | AA | DIQMTQSPSSLSASVGDRVTITCRTSQGIGNYLAWFQQKPGKAPKSLLYKTSSLQSGVPSKFSGSGSGTDFTLTISSLQPEDFATYYCQQYMTYPLTFGGGTKVEIK SEQ ID NO: 26596 | QVQLVESGGGVVQPGRSLRLSCAASGFTFSSYGMHWVRQAPGKGLEWVAVIWYDGSNKYMQTPVKGRFTISRDNSKNTLYLQMNSLRAEDTAVYYCARDQGVGYDGLDVWGQGTTVTVSS SEQ ID NO: 30602 |
| iPS:435821 | 21-225_190E11 | NA | GAAATAGTGATGACGCAGTCTCCAGCCACCCTGTCTGTGTCTCCAGGGGAAAGAGCCACCCTCTCCTGCAGGGCCAGTCAGAGTTTTCGCATCAACTTAGCCTGGTACCAGCAGAGACCTGGCCAGGCTCCCAGGCTCCTCATCTATGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATAATAACTGGCCGCTCACTTTCGGCGGAGGGACCAAGGTGGAGATCAAA SEQ ID NO: 26597 | CAGGTGCAGCTGGTGGAGTCTGGGGGAGGCGTGGTCCAGCCTGGGAGGTCCCTGAGACTCTCCTGTACAGCGTCTGGATTCACCTTCAGTAACTATGGCATGCACTGGGTCCGCCAGGCTCCAGGCAAGGGCTGGAGTGGGTGGCAATTATATGGTTTGATGGAAGTAATAAATACTATGCAGACTCCGTGAAGGGCCGATTCACCATCTCCAGAGACACGTGACAAGCTGCAAATAACACGCTGTATCTGCAAATGAACAGCCTGCGAGCCGAGGACACGGCTGTATTACGTTATGACGTTGGGACGTCTGGGGCCAAGGGACCACGGTCACCGTCTCCTCA SEQ ID NO: 30603 |

FIGURE 50
(Continued)

| | | | | |
|---|---|---|---|---|
| iPS:435823 | 21-225_190F11 | AA | EIVMTQSPATLSVSPGERATLSCRASQSFRINLA WYQQRPGQAPRLLIYGASTRATGIPARFSGSGSG TEFTLTISSLQSEDFAVYYCQQYNNWPLTFGGGT KVEIK | QVQLVESGGGVVQPGRSLRLSCTASGFTFSNYGMH WVRQAPGKGLEWVAIIWFDGSNKYADSVKGRFT ISRDNSNNTLYLQMNSLRAEDTAVYYCAKAQGVY YYVMDVWGQGTTVTVSS |
| | | | SEQ ID NO: 26598 | SEQ ID NO: 30604 |
| | | NA | GAAATTGTGCTGACTCAGTCTCCAGACTCTCA GTCTGTGACTCCAAAGGAGAAAGTCACCATCA CCTGCCGGGCCAGTCAGAGCAGAAACATTGGTAGC TTACACTGGTACCAGCAGAAACCAGAACAGTC TCCAAAGGTCCTCATCAAGTATGCTTCCCAGT CCTTCTCAGGGGTCCCCTCGAGGTTCAGTGGC AGTGGATCTGGGACAGATTTCACCCTCACCAT CAATAGCCTGGAAGCTGAAGATGCTGCAAGCT ATTACTGTCATCAGAGTAGTAGTTTCCCTCGG ACGTTCGGCCAAGGGACCAAGGTGGAAATCA AA | GAGGTGCAGCTGTTGGACTCTGGGGGAGGCTTGG GACAGCCTGGGGGGTCCCTGAGACTCTCCTGTGC AGCCTCTGGATTCACCTTTGACAGTATGCCATG AACTGGGTCCGCCAGGCTCCAGGGAAGGGGCTG GAGTGGGTCTCAACTATTAGTGGTACTGGTGTA GGACATATACGCAGACTCCGTGAAGGGCCGGT TCACCATCTCCAGAGACAATTCCAAGAACACGCT GTATCTGCAAATGAATAGCCTGAGAGCCGAGGA CACGGCCGTATATTACTGTGCGAAAGAGGAGGA TTACTATGATAGTAGTGGCCGGGGTTGACCCC TGGGGCCAGGGAACCCTGGTCACCGTCTCCTCA |
| | | | SEQ ID NO: 26599 | SEQ ID NO: 30605 |
| | | AA | EIVLTQFPDSQSVTPKEKVTITCRASQNIGSSLHW YQQKPEQSPKVLIKYASQSFSGVPSRFSGSGSGT DFTLTINSLEAEDAATYCHQSSSFPRTFGQGTK VEIK | EVQLLDSGGGLGQPGGSLRLSCAASGFTFDSYAMN WVRQAPGKGLEWVSTISGTGRRTYADSVKGRFTI SRDNSKNTLYLQMNSLRAEDTAVYYCAKEEDYYD SSGPGFDPWGQGTLVTVSS |
| | | | SEQ ID NO: 26600 | SEQ ID NO: 30606 |

FIGURE 50
(Continued)

| | | | |
|---|---|---|---|
| iPS:435825 | 21-225_190G11 | NA | GACATCCAGATGACCCAGTCTCCTTCCTCACT GTCTGCATCTGTAGGAGACAGAGTCACCATCA CTTGTCGGACGAGTCAGGCATTGGCAATTAT TTAGCCTGGTTTCAGCAGAAACCAGGGAAAGC CCCTAAGTCCCTGCTCTATAAAGCATCCAGTTT GCAAAGTGGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATATGACTTACCCGCTCA CTTTCGGCGGAGGGACCAAGGTGGAGATCAA A SEQ ID NO: 26601 | CAGGTGCAGCTGGTGGAGTCTGGGGGAGGCGTG GTCCAGCCTGGGAGGTCCCTGAGACTCTCCTGTG CAGCGTCTGGATTCACCTTCAGTATTTATGGCAT GCACTGGGTCCGCCAGGCTCCAGGCAAGGGCT GGAGTGGGTGGCAGTTATATGGTATGATGAAGT AATAAAAACTATGCAGAGACTCCGTGAAGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA SEQ ID NO: 30607 |
| | | AA | DIQMTQSPSSLSASVGDRVTITCRTSQGIGNYLA WFQQKPGKAPKSLLYKASSLQSGVPSKFSGSGS GTDFTLTISSLQPEDFATYCQQYMTYPLTFGG GTKVEIK SEQ ID NO: 26602 | QVQLVESGGGVVQPGRSLRLSCAASGFTFSIYGMH WVRQAPGKGLEWVAVIWYDGSNKNYADSVKGRF TISRDNSKNTLYLQMNSLRAEDTAVYYCARDQGV GYDGLDVWGQGTTVTVSS SEQ ID NO: 30608 |
| iPS:435827 | 21-225_190H11 | NA | GATATTGTGATGACCCAGACTCCACTCTCTCT GTCCGTCACCCCTGGACAGCCGGCCTCCATCT CCTGCAAGTCTAGTCAGAGCCTCCTCCATAGT GATGGAAGGACCTATTTGTATTGGTACCTGCA GAAGCCAGGCCAGTCTCCACAGCTCCTGATCT GTGAGGTTTCCAACCGGTTCCGTGGAGTGACA GATAGGTTCAGTGGCAGCGGGTCAGGGACAG ATTTCACACTGAAAATCAGCGGGGTGGAGGCT GGGGATGTGTTGGGGTTTATTACTGCATGCAAAG TATACAGTTCCCTGGACGTTCGGCCAAGGGA CCAAGGTGGAAATCAAA SEQ ID NO: 26603 | CAGCTGCAGCTGCAGGAGTCGGGCCCAGGACTG GTGAAGCCTTCGGAGACCCTGTCCTCACCTGCA CTGTCTCTGGTGGCTCCATCAGAAGTACCACTG GAGCTGGATCCGGCAGCCCCCGGGAAGGGACT GGAGTGGGATTGGCTTATCTATACCAGTAGGAGC ACCATTTACAACCCTCCCTCAAGATCGAGTCA CCCTGTCAGTAGACACGTCAAGAACCAGTTCTC CCTGAAGCTGAGCTCTGTGACCGCCGCGGACACG GCCGTGTATTATTGTGCGAGACTCCGGTATAACT GGAACTTCCCTTACTTTGACTACTGGGGCCAGGG AACCCTGGTCACCGTCTCCTCA SEQ ID NO: 30609 |

FIGURE 50
(Continued)

| | | | | |
|---|---|---|---|---|
| iPS:435829 | 21-225_190B12 | AA | DIVMTQTPLSLSVTPGQPASISCKSSQSLLHSDGR TYLYWYLQKPGQPPQLLICEVSNRFAGVTDRFS GSGSGTDFTLKISRVEAGDVGVYYCMQSIQFPW TFGQGTKVEIK | QLQLQESGPGLVKPSETLSLTCTVSGGSIRSYHWSW IRQPAGKGLEWIGLIYTSRSTYNPSLKSRVTLSVDT SKNQFSLKLSSVTAADTAVYYCARLRYNWNFPYF DYWGQGTLVTVSS |
| | | | SEQ ID NO: 26604 | SEQ ID NO: 30610 |
| | | NA | GAAATTGTGCTGACTCAGTCTCCAGACTTTCA GTCTGTGACTCCAAAGGAGAAAGTTCACCATCA CCTGCCGGGCCAGTCAGAGTATTGGTAGTAGC TTACACTGGTACCAGCAGAAACCAGATCAGTC TCCAAAGCTCCTCATCAAGTATGCTTCCCAGT CCTTCTCAGGGGACCCCTCGAGGTTCAGTGGC AGTGGATCTGGGACAGATTTCACCCTCACCAT CAATAGCCTGGAAGCTGAAGATGCTGCAAGT ATTACTGTCATCAGACTAGAAGTTTACCTCTC ACTTTCGGCGGAGGGACCAAGGTGGAGATCA AA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTAGTGGTTA CTACTGGAACTGGATCCGCCAGCACCCAGGGAA GGGCCTGGAGTGGATTGGGTATATCTATTACAGT GGGAGCACCTACTACAACCCGTCCCTCAAGAGTC GAGTTACCATATCAGTAGACAGTCTAAGAACCA GTTTTCTGAAGCTGAACTCTGTGCTGAGATCCGGT GACACGGCCGTGTATTACTGTGCGACCCCTGGGCC ATAATTGGGACGCGGGGTCGACCCCTGGGCC GGGGAACCCTGGTCACCGTCTCCTCA |
| | | | SEQ ID NO: 26605 | SEQ ID NO: 30611 |
| | | AA | EIVLTQSPDFQSVTPKEKVTITCRASQSIGSSLHW YQQKPDQSPKLLIKYASQSFSGDPSRFSGSGSGT DFTLTINSLEAEDAATYYCHQTRSLPLTFGGGTK VEIK | QVQLQESGPGLVKPSQTLSLTCTVSGGSISSGGYYW NWIRQHPGKGLEWIGYIYYSGSTYYNPSLKSRVTIS VDTSKNQFFLKLNSVTAADTAVYYCARSGYNWDA GVDPWGRGTLVTVSS |
| | | | SEQ ID NO: 26606 | SEQ ID NO: 30612 |

FIGURE 50
(Continued)

| | | | |
|---|---|---|---|
| iPS:435831 | 21-225_190C12 | NA | GACATCCAGATGACCCAGTCTCCATCTCCCT GTCTGCATCTGTAGGAGACAGAGTCACCATCA CTTGCCGGGCAAGTCAGGGCATTAGAAAAGAT TTAGGCTGGTATCAGCAGAAACCAGGGAAAG CCCCTAAGCGCCTGATCCATACTGCATCCAGT TTGCAAAGTGGGGGTCCCATTAAGGTTCAGTGG CAGTGGATCTGGGACAGAATTCACTCTCACAA TCAGCAGCCTGCAGCTGAAGATTTTGCAACT TATTACTGTCTACAGCATAATAGTTACCCGTG GACGTTCGGCCAAGGGACCAAGGTGGAAATC AAA<br><br>SEQ ID NO: 26607 | CAGGTGCAGCTGGTGGAGTCTGGGGGAGGCGTG GTCCAGCCTGGGAGGTCCCTGAGACTCTCCTGTG CAGCCTCTGATTCACCTTCAGTAGTAGCTATGGCAT GCACTGGGTCCGCCAGGCTCCAGGCAAGGGCT GGAGTGGGTGGCAGTTATATCATATGATGGAAGT TATAAAACTATGTAGACTCCGTGAAGGGCCGAT TCACCATCTCCAGAGACAATTCCAAGAACACGCT GTATCTGCAAATGAATAGCCTGAGAGCTGAGGA CACGGCTGTGTATTACTGTGCGAGAGGTACCAC GGGTACTACACGGTGTGGACGTCTGGGGCCAA GGGACCACGGTCACCGTCTCCTCA<br><br>SEQ ID NO: 30613 |
| | | AA | DIQMTQSPSSLSASVGDRVTITCRASQGIRKDLG WYQQKPGKAPKRLIHTASSLQSGVPLRFSGSGS GTEFTLTISSLQPEDFATYYCLQHNSYPWTFGQG TKVEIK<br><br>SEQ ID NO: 26608 | QVQLVESGGAVVQPGRSLRLSCAASGFTFSSYGMH WVRQAPGKGLEWVAVISYDGGYKNYVDSVKGRF TISRDNSKNTLYLQMNSLRAEDTAVYYCARGTHG YYYGVDVWGQGTTVTVSS<br><br>SEQ ID NO: 30614 |
| iPS:435833 | 21-225_190D12 | NA | GACATTCAGATGACCCAGTCTCCATCTCCCT GTCTGCATCTGTAGGAGACAGAGTCACCATCA CTTGCCGGGCGAGTCAGGGCATTAGCAATTAT TTAGCCTGGTATCAGCAGAAACCAGGGAAAGT CCCTAAACCTCTGATCTATGTTGCATCCACTTT GCAATCAGGGGTCCCATCTCGGTTCAGTGGCA GTGGATCTGGGACAGATTTCACTCTCACCATC AGCAGCCTGCAGCCTGAAGATGTTGCAACTTA TTACTGTCAAAAGTATAACAGTGCCCATTCA CTTTCGGCCCTGGGACCAAAGTGGATATCAAA<br><br>SEQ ID NO: 26609 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGTCAGTGCCAT GAGCTGGGTCCGCCAGGCTCCAGGGAAGGGGCT GGAGTGGGACTCAGCTATTATTGGTAATGGTGGT AGGACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGATATGGG TAGATACAGTATGGTTTCTTTGACTACTGGGGC CAGGGAACCCTGGTCACCGTCTCCTCA<br><br>SEQ ID NO: 30615 |

FIGURE 50
(Continued)

| | | | | |
|---|---|---|---|---|
| iPS:435835 | 21-225_190F12 | AA | DIQMTQSPSSLSASVGDRVTITCRASQGISNYLAWYQQKPGKVPKLLIYVASTLQSGVPSRFSGSGSGTDFTLTISSLQPEDVATYYCQKYNSAPFTFGPGTKVDIK | EVQLLESGGGLVQPGGSLRLSCAASGFTFSSYAMSWVRQAPGKGLEWDSAIIGNGGRTYYADSVKGRFTISRDNSKNTLYLQMNSLRAEDTAVYYCAKDMGRYSYGFFDYWGQGTLVTVSS |
| | | | SEQ ID NO: 26610 | SEQ ID NO: 30616 |
| | | NA | GACATCCAGATGACCCAGTCTCCATCCTCACTGTCTGCATCTGTGGGAGACAGAGTCACCATCACTTGTCGGGCGAGTCAGGGCATTGGCAAGTATTTAGCCTGGTTTCAGCAGAAACCAGGGAAAGCCCCTAAGTCACTGATCTATGCTGCATCCAGTTTGCAAAGTGGGGTCCCATCAAAATTCAGCGGCAGTGGATCTGGGACAGATTTCACTCTCACCATCAGCAGCCTGCAGCCTGACGATTTTGCAACTTATTACTGCCAACGATATGATACTTACCCATTCACTTTCGGCCCTGGGACCAAAGTGGATATCAAA | CAGGTCAGCTGGTGGAGTCTGGGGGAGGCGTGGTCCAGCCTGGGAGGTCCCTGAGACTCTCCTGTGCAGCGTCTGGATTCACCTTCAGGAACTATGGCATGCACTGGGTCCGCCAGGCTCCAGGCAAGGGGCTGGAGTGGGTGGCAGTTATATGGTTTGATGGAAGTAATGACTACTATGCAGACTCCGTGAAGGGCCGATTCACCATCTCCAGAGACAATTCCAAGAACACGCTGTCACTGCAAATGAACAGCCTGAGAGCCGAGGACACGGCTGTGTATTACTGTGCGAGAGATAGAAGCGTCGGCTACGAGGGTTTAGATGTCTGGGGCCAAGGGACCACGGTCACCGTCTCCTCA |
| | | | SEQ ID NO: 26611 | SEQ ID NO: 30617 |
| | | AA | DIQMTQSPSSLSASVGDRVTITCRASQGIGKYLAWFQQKPGKAPKSLIYAASSLQSGVPSKFSGSGSGTDFTLTISSLQPDDFATYYCQRYDTYPFTFGPGTKVDIK | QVQLVESGGGVVQPGRSLRLSCAASGFTFRNYGMHWVRQAPGKGLEWVAVIWFDGSNDYYADSVKGRFTISRDNSKNTLSLQMNSLRAEDTAVYYCARDRSVGYDGLDVWGQGTTVTVSS |
| | | | SEQ ID NO: 26612 | SEQ ID NO: 30618 |

FIGURE 50
(Continued)

| | | | |
|---|---|---|---|
| iPS:435837 | 21-225_198G3 | NA | GACATCCAGATGGCCCAGTCTCCTTCCTCACTGTCTGCATCTGTAGGAGACAGAGTCACCATCACTTGTCGGACGAGTCAGGGCATTGGCAAGTATTTAGCCTGGTTTCAGCAGAAAGCCAGGAAAGCCCCTAAGTCCCTGCTCTATAAAGCATCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAACTTATTACTGTCCAACAGTATATGACTTACCCGCTCACTTTCGGCGGAGGGACCAAGGTGGAGATCAAA | CAGGTGCAGCTGGTGCAGAGTGGGGGAGGCGTGGTCCAGCCTGGGAGGTCCCTGAAACTCTCCTGTGCAGCGTCTGGATTCACCTTCAGTACTTACGGCATGCACTGGGTCCGCCAGGCTCCAGGCAAGGACTGGAGTGGGTGGCAGTTATATGGTATGATGGAACTAATAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGGCGTGGGCTACGACGGTTTGGACGGTCTGGGGCCAAGGGACCACGGTCACCGTCCTCA |
| | | | SEQ ID NO: 30619 |
| | | AA | DIQMAQSPSSLSASVGDRVTITCRTSQGIGKYLAWFQQKPGKAPKSLLYKASSLQGVPSKFSGSGSGTDFTLTISSLQPEDFATYYCQQYMTYPLTFGGGTKVEIK | QVQLVESGGGVVQPGRSLKLSCAASGFTFSTYGMHWVRQAPGKGLEWVAVIWYDGTNKNYADSVKGRFTISRDNSKNTLQMNSLRAEDTAVYYCARDQGVGYDGLDVWGQGTTVTVSS |
| | | | SEQ ID NO: 26614 | SEQ ID NO: 30620 |
| iPS:435839 | 21-225_191B1 | NA | GACATTGTGATGACCCAGACTCCACTCTCTGTCCGTCACCCCTGGACAGCCGGCCTCCATCTCCTGTAGGTCTAGTGAGAGCCTCCTGCATAGTGATGGAAAGACCTATTTGTTTGGTACCTGCAGAAGCCAGGCCAGCCTCCACAGGTTCTCTGAGTCCTGATCTATGAACTTTCCAACCGGTTCTCTGGAGTCCCAGATAGGTTCAGTGGCAGCGGGTCAGGGACAGATTTCACACTGAAAATCAGCAGGGTTGAGGCTGAGGATGTTGGGGTTTATTACTGCATGCAAAGTTTCCAGTTCCCTCCGACGTTCGGTCAAGGGACCAAGGTGGAAATCAAT | CAGGTGCAGCTGCAGGAGTCGGGCCCAGGACTGGTGAAGCCTTCGGAGACCCTGTCCTCACCTGCACTGTCTCTGGTGGCTCCATCAGTAGTTATCACTGGAGCTGGATCCGGCAGCCCCGGGAAGGGACTGGAGTGGATTGGCCATATCTATACCAGTGGGAGCACCAAGTACAACCCCTCCCTCAAGAGTCGAGTCACCATGTCAGTAGACACGTCCAAGAACCAGTTCTCCCTGAAGCTGAGCTCTGTGACCGCCGCGGACACGGCCGTGTATTATTGTGTGAGACTCCGTATAACTGGAACTCCCTTCTTGACTATTGGGGCCAGGGAACCCTGGTCACCGTCTCCTCA |
| | | | SEQ ID NO: 26615 | SEQ ID NO: 30621 |

FIGURE 50
(Continued)

| | | | | |
|---|---|---|---|---|
| iPS:435841 | 21-225_191D8 | AA | DIVMTQTPLSLSVTPGQPASISCRSSQSLLHSDGK TYLFWYLQKPGQPPQVLIYELSNRFSGVPDRFSG SGSGTDFTLKISRVEAEDVGVYYCMQSFQLPWT FGQGTKVEIN<br>SEQ ID NO: 26616 | QVQLQESGPGLVKPSETLSLTCTVSGGSISSYHWSW IRQPAGKGLEWIGHIYTSGSTKYNPSLKSRVTMSVD TSKNQFSLKLSSVTAADTAVYYCARLRYNWNFPFF DYWGQGTLVTVSS<br>SEQ ID NO: 30622 |
| | | NA | GACATCATGATGACCCAGTCTCCAGACTCCCT GGCTGTGTCTCTGGGCGAGAGAGGGCCATCATCA GCTGCAGGTCCAGCCAGAGTGTTTTACACAGC TCCAACAATTACAACTACTTAGCTTGGTACCA GCAGAAACCAGGACATCCTCCTAAACTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTATTACTGTCAACAA TATTATAGTACTCCTCCGACGTTCGGCCTAGG GACCAAGGTGGAAATCAAA<br>SEQ ID NO: 26617 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGATGGATGCACCTAACAGTGG TAACACAGGCTATGCACAGAAGTTCCAGGGCAG AGTCACCATGACCAGGAACACTTCCATAAGCAC AGCCTACATGGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCTCCTCA<br>SEQ ID NO: 30623 |
| | | AA | DIMMTQSPDSLAVSLGERAIHSCRSSQSVLHSSNN YNYLAWYQQKPGHPPKLLIYWASTRESGVPDRF SGSGSGTDFTLTISSLQAEDVAVYYCQQYYSTPP TFGLGTKVEIK<br>SEQ ID NO: 26618 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS<br>SEQ ID NO: 30624 |

FIGURE 50
(Continued)

| | | | | |
|---|---|---|---|---|
| iPS:435843 | 21-225_191F1 | NA | GAAATTGTGTTGACGCAGTCTCCAGGCACCCT GTCTTTGTCTCCAGGGGAAAGAGCCACCCTCT CCTGCAGGGCCAGTCAGTCAGAGTATTAGCCTCAAC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAATAGACTGGAGCCTGAAGATTTTGCAG TGTATTACTGTCAGCAGTATGGTAGGTCACCG TGGACGTTCGGCCAAGGGACCAAGGTGGAAG TCAAA<br><br>SEQ ID NO: 26619 | CAGGTGCAGCTGCAGGAGTCGGGCCCAGGACTG GTGAAGCCTTCACAGACCCTGTCCCTCACCTGCA CTGTTTCTGGTGGCTCCATCAACAGTGGTGGTTA CTACTGGAACTGGATCCGCCAGCACCCAGGGAA GGGCCTGGAGTGGATTGGGTACATCTTTTACAGT GGGAGCACTACTACAACCGTCCCTCAAGAGTC GAGTCACCATATCAGTAGACACGTCTAAGAACC AGTTCTCCCTGAAGCTGAGCTCTGTGACTGCCGC GGACACGGCCGTGTATTACTGTGCGAGAGGGA TTACGATGGTTCGGGGAGTTATCACTACTATTAC GGTATGGACGTCTGGGGCCAAGGGACCACGGTC ACCGTCTCCTCA<br><br>SEQ ID NO: 30625 |
| | | AA | EIVLTQSPGTLSLSPGERAALSCRASQSISLNFLA WYQQKPGQAPRLLIYGASSRATGIPDRFSGSGSG TDFTLTINRLEPEDFAVYYCQQYGRSPWTFGQG TKVEVK<br><br>SEQ ID NO: 26620 | QVQLQESGPGLVKPSQTLSLTCTVSGGSINSGGYY WNWIRQHPGKGLEWIGYIFYSGSTYYNPSLKSRVTI SVDTSKNQFSLKLSSVTAADTAVYYCARGDYDGS GSYHYYGMDVWGQGTTVTVSS<br><br>SEQ ID NO: 30626 |
| iPS:435845 | 21-225_191G1 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCGCTGATCTATGCTGCATCCAGTTT GCAAAGTGGGGTCCCATCAAGGTTCAGCGGCA GTGGATCTGGAACAGATTTCACTCTCACCATC AGCAGCCTGCAGCCTGAAGATTTTGCAACTTA TTACTGCCAACATTATCTTACTTACCCTCTCAC TTTCGGCGGAGGGACCAAGGTGGAGATCAAA<br><br>SEQ ID NO: 26621 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATACGGTTTGACGTCTGGGGCCAA GGTGGTTACTACGGTTTGACGTCTGGGGCCAA GGGACCACGGTCACCGTCTCCTCA<br><br>SEQ ID NO: 30627 |

FIGURE 50
(Continued)

| | | | |
|---|---|---|---|
| iPS:435847 | | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK<br><br>SEQ ID NO: 26622 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS<br><br>SEQ ID NO: 30628 |
| | 21-225_191A3 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAATATGGTAACTCACCG TGGGCGTTCGGCCAAGGGACCAAGGTGGAAG TCAAA<br><br>SEQ ID NO: 26623 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTGTATTACTGTGCGAGAGGGATT GACACGGCCGTGTATTACTGTGCGAGAGGGGATT ACGATGGTTCGGGGAGTTATCACTACTACGG TATGGACGTCTGGGGCCAAGGGACCACGGTCAC CGTCTCCTCA<br><br>SEQ ID NO: 30629 |
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEVK<br><br>SEQ ID NO: 26624 | QVQLQESGPGLVKPSQTLSLTCTVSGGSISSGDYYW NWIRQHPGKGLEWIGYIFYSGSTYNPSLKSRVTIS VDTSKNQFSLKLSSVTAADTAVYYCARGDYDGSG SYHYYGMDVWGQGTTVTVSS<br><br>SEQ ID NO: 30630 |

FIGURE 50
(Continued)

| | | | | |
|---|---|---|---|---|
| iPS:435849 | 21-225_191C3 | NA | GAAATTGTGTTGACGCAGTCTCCAGGCACCCT GTCTTTGTCTCTCCAGGGGAAAGAGCCACCCTCT CCTGCAGGGCCAGTCAGTCAGAGTATTCGCAGCAGC TTCTTAGCCTGGTATCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br><br>SEQ ID NO: 26625 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGTCCCAGGGAA GGGCCTGGAGTGGATTGGGTACATCTTTTACAGT GGGAGCACTTACTACAACCCGTCCCTCAAGAGTC GACTTACCATATCAGTGGACAGTCTAAGAACCA GTTCTCCCTGAAACTGAACTCTGTGACTGCCCG GACACGGCCGTGTATTACTGTGCGAGAGGGATT ACGATGGTTCGGGGAGTTATCACTTCTACTACGG TATGGACGTCTGGGGCCAAGGGACCACGGTCAC CGTCTCCTCA<br><br>SEQ ID NO: 30631 |
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK<br><br>SEQ ID NO: 26626 | QVQLQESGPGLVKPSQTLSLTCTVSGGSISSGDYYW NWIRQLPGKGLEWIGYIFYSGSTYYNPSLKSRLTISV DTSKNQFSLKLNSVTAADTAVYYCARGDYDGSGS YHFYYGMDVWGQGTTVTVSS<br><br>SEQ ID NO: 30632 |
| iPS:435851 | 21-225_191D3 | NA | GAAATTGTGTTGACGCAGTCTCCAGGCACCCT GTCTTTGTCTCTCCAGGGGAAAGAGCCACCCTCT CCTGCAGGGCCGGTCAAAGTATTAGAACCAAC TTCTTAGCCTGGTACCAGCAGCCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAGCTCACCG TGGACGTTCGGCCAAGGGACCAAGGTGGAAA TCAAA<br><br>SEQ ID NO: 26627 | CAGGTGCAACTGAAGGAGTCGGGCCCAGGACTG GTGAAGCCTTCACAGACCCTGTCCCTCACCTGCA CTGTCTCTGGTGGCTCCATCAACACAGTGGTGATTA CTACTGGAACTGGATCCGCCAGCACCCAGGGAA GGGCCTGGACTGGATTGGGTACATCTTTACAGT GGGAGCACCTACTACAACCCGTCCCTCAAGAGTC GAGTTACCATATCAGTAGACAGTCTAAGAACCA GTTCTCCCTGAAGCTGAGCTCTGTGACTGCCCG GACACGGCCGTGTATTACTGTGCGAGAGGGGATT ACGATGGTTCGGGGAGTTATCACTACTATTACGG TATGGACGTCTGGGGCCAAGGGACCACGGTCAC CGTCTCCTCA<br><br>SEQ ID NO: 30633 |

FIGURE 50
(Continued)

| | | | |
|---|---|---|---|
| iPS:435853 | 21-225_191E3 | AA | EIVLTQSPGTLSLSPGESATLSCRAGQSIRTNFLAWYQQQPGQAPRLLIYGASSRATGIPDRFSGSGSGTDFTLTINRLEPEDFAVYYCQQYGSSPWTFGQGTKVEIK |
| | | | QVQLKESGPGLVKPSQTLSLTCTVSGGSINSGDYYWNWIRQHPGKGLDWIGYIFYSGSTYNPSLKSRVTISVDTSKNQFSLKLSSVTAADTAVYYCARGDYDGSGSYHYYGMDVWGQGTTVTVSS |
| | | | SEQ ID NO: 26628 / SEQ ID NO: 30634 |
| | | NA | GATATTGTAATGACCCAGACTCCACTCTCTCTGTCCGTCACCCCTGGACAGCCGGCCTCCATCTCCTGCAAGTCTAGTCAGAGCCTCCTCCATAGTGATGGAAGGACCTATTTGTATTGGTACCTGCAGAAGCCAGGCCAGTCTCCACAGCTCCTGATCTGTGAGGTTTCCAACCGGTTCGCTGGAGTGACAGATAGGTTCAGTGGCAGCGGGTCAGGGACAGATTTCACACTGAAAATCAGCCGGGTGGAGGCTGGGGATGTTGGGGTTATTACTGCATGCAAAGTATACAACTTCCCTGGACGTTCGGCCAAGGGACCAAGGTGGAAATCAAA |
| | | | CAGCTGCAGCTGCAGGAGTCGGGCCCAGGACTGGTGAAGCCTTCGGAGACCCTGTCCCTCACCTGCACTGTCTCTGGTGGCTCCATCAGAAGTACTACCACTGGAGCTGGATCCGGCAGCCCGCGGGAAGGGACTGGAGTGGATTGGACTTATCTATACCAGTGAGAGCACCAATTACAACCCCTCCCTCAAGAGTCGAGTCACCATGTCAGTTGACACGTCCAAGAACCAGTTCTCCCTGAAGCTGAACTCTGTGACCGCCGCGGACACGGCCGTGTATTACTGTGCGAGACTCCGGTATAACTGGAACTTCCCTACTTTGACTACTGGGGCCAGGGAACCCTGGTCACCGTCTCCTCA |
| | | | SEQ ID NO: 26629 / SEQ ID NO: 30635 |
| | | AA | DIVMTQTPLSLSVTPGQPASISCKSSQSLLHSDGRTYLYWYLQKPGQPPQLLICEVSNRFAGVTDRFSGSGSGTDFTLKISRVEAGDVGVYYCMQSIQLPWTFGQGTKVEIK |
| | | | QLQLQESGPGLVKPSETLSLTCTVSGGSIRSYHWSWIRQPAGKGLEWIGLIYTSRSTNYNPSLKSRVTMSVDTSKNQFSLKLNSVTAADTAVYYCARLRYNWNFPYFDYWGQGTLVTVSS |
| | | | SEQ ID NO: 26630 / SEQ ID NO: 30636 |

FIGURE 50
(Continued)

| | | | | |
|---|---|---|---|---|
| iPS:435855 | 21-225_191G3 | NA | GACATCGTGATGACCCAGTCTCCAGACTCCCT GGCTGTGTCTCTGGGCGAGAGGGCCACCATCG ACTGTAAGTCCAGCCAGAGTGTTTTACACAGC TCCAACAGTTACACAACTACTTAGCTGGTACCA GCAGAAATTAGGACAGCCTCCTAAACTGCTCA TTTACTGGGCATCTACCGAAAATCCGGGGTC CCTGACCGATTCAGTGGCAGCGGGTCTGGGAC AGATTTCACTCTCACCATCAGCAGCCTGCAGG CTGAAGATGTGGCATTTTATTACTGTCAGCAA TATTATAGTAGTCCTCCCACTTTCGGCCCTGGG ACCAAAATGGATATCAAA SEQ ID NO: 26631 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGACGGATGAACCCTAACAGTG GTAACACAGGCTATGCACAGAAGTTCCAGGGCA GAGTCACCATGACCAGGAACACCTCCATAAGCA CAGCCTACATGGAGCTGAGCAGCCTGAGATCTG AGGACACGGCCGTGTATTACTGTGCCCATAGCAG TGGCTGGTACACTCTTTGACTACTGGGGCCAGGA ACCCTGGTCACCGTCCTCA SEQ ID NO: 30637 |
| | | AA | DIVMTQSPDSLAVSLGERATIDCKSSQSVLHSSN SYNYLAWYQQKLGQPPKLLIYWASTRKSGVPD RFSGSGSGTDFTLTISSLQAEDVAFYYCQQYYSS PPTFGPGTKMDIK SEQ ID NO: 26632 | QVQLVQSGAEVKKPGASVKVSCKASGYTFTNYDIN WVRQATGQGLEWMGRMNPNSGNTGYAQKFQGR VTMTRNTSISTAYMELSSLRSEDTAVYYCAHSSGW YIFDYWGQGTLVTVSS SEQ ID NO: 30638 |
| iPS:435857 | 21-225_191A4 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCATCTATGCTGCATCCAGT TTGCAAATGGGGTCCCATTAAGGTTCAGCGG CAGTGGATCTGGGACAGACATTCACTCTCACAA TCAGCAGCCTGCAGCCTGAAGATTTTGCAACT TATTACTGTCTACAGCATAATAGTTACCCGTG GACGTTCGGCCAAGGGACCAAGGTGGAAATC AAA SEQ ID NO: 26633 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATATGAGGAGGT TATAAAACTATGCAGACTCCGTGAAGGGCCGA TTCACCATCTCCAGAGACAATTCCAAGAACACGC TGTATCTGCAAATGAATAGCCTGAGAGCTGAGGA CACGGCTGTGTATTACTGTGCGAGAGGTACCCAC GGTACTACTACGGTGTGACGTCTGGGGCCAA GGGACCACGGTCACCGTCCTCA SEQ ID NO: 30639 |

FIGURE 50
(Continued)

| | | | |
|---|---|---|---|
| iPS:435859 | 21-225_190E6 | AA | DIQMTQSPSSLSASVGDRVTITCRASQGIRKDLG WYQQKPGKAPKRLIHTASSLQNGVPLRFSGSGS GTEFTLTISSLQPEDFATYYCLQHNSYPWTFGQG TKVEIK | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTSS |
| | | | SEQ ID NO: 26634 | SEQ ID NO: 30640 |
| | | NA | GACATCCAGATGACCCAGTCTCCTTCCTCACT GTCTGCATCTGTAGGAGACAGAGTCACCATCA CTTGTCGGACGAGTCAGGGCATTGGCAATTAT CTTAGCCTGGTTTCAGCAGAAACCAGGAAAGC CCCTAAGTCCTGATCTATGCTATAAAGCATCCAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAGTATATGACTTACCCGCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCAGACTCCGTGAAGGGCCGA AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA |
| | | | SEQ ID NO: 26635 | SEQ ID NO: 30641 |
| | | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYMTYPLTFGGG TKVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTSS |
| | | | SEQ ID NO: 26636 | SEQ ID NO: 30642 |

FIGURE 50
(Continued)

| | | | |
|---|---|---|---|
| iPS:435861 | 21-225_190A5 | NA | GACATCCAGATGACCCAGTCTCCATCCTCACT GTCTGCATCTGTAGGAGACAGAGTCACCATCA CTTGTCGGGCGAGTCAGGGATTGGCAATCAT TAGCCTGGTTTCAGCAGAAACCAGGGAAAGC CCCTAAGTCCCTGATCCATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATAGTAATTACCCAGTCA CTTTCGGCCCTGGGACCAAAGTGGATATCAAA | CAGGTGCAGTTGGTGGAGTCTGGGGGAGGCGTG GGCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAGTTATATGGTATGATGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATTTCTC TGTAGGGTACGACGGTATGGACGTCTGGGGCCA AGGGACCACGGTCACCGTCCTCA |
| | | | SEQ ID NO: 30643 |
| | | SEQ ID NO: 26637 | |
| | | AA | DIQMTQSPSSLSASVGDRVTITCRASQGIGNHLA WFQQKPGKAPKSLIHAASSLQSGVPSKFSGSGSG TDFTLTISSLQPEDFATYYCQQYSNYPVTFGPGT KVDIK | QVQLVESGGGVGQPGRSLRLSCAASGFTFSSYGMH WVRQAPGKGLEWVAVIWYDGSNKNYADSVKGRF TISRDNSKNTLYLQMNSLRAEDTAVYYCARDFSVG YDGMDVWGQGTTVTVSS |
| | | | SEQ ID NO: 30644 |
| | | SEQ ID NO: 26638 | |
| iPS:435863 | 21-225_191H4 | NA | GAAATTGTGCTGACTCAGTCTCCAGACTTTCA GTCTGTGACTCCAAAGGAGAAAGTCACCATCA CCTGCCGGGCCAATCAGAGCATTGGTAGTAGC TTACACTGGTACCAGCAGAAACCAGATGCAGTC TCCAAAGCTCCTCATCAAGTATGCTCCCAGT CCCTCTCAGGGGTCCCCTCGAGGTTCAGTGCC AGTGGATCTGGGACAGATTTCACCCTCACCAT CAATAGCCTGGAAGCTGAAGATGCTGCAACGT ATTACTGTCATCAGACTGGTAGTTACCTCTC ACTTTCGGCGGAGGGACCAAGGTGGAGATCA AA | CAGGTGCAGCTGCAGGAGTCGGGCCCAGGACTG GTGAAGCCTTCACAGACCCTGTCCTCACCTGCA CTGTCTCTGGTGCTCCATCAGCAGTGGTGGTTA CTACTGGAGCTGGATCCGCCAGCACCCAGGGAA GGGCCTGGAGTGGATTGGATATATCTATTACAGT GGGAGCACCTACTACAACCCGTCCCTCAGGAGTC GACTTACCATATCAATAGACACGTCTAAGAACCA GTTCTCCCTGAAGCTGACCTCTGTGACTGCCGCG GACACGGCCGTATATTACTGTGTGGAGATCCGGGT ATAACTGGGACAACGGGGTGCGACCCCTGGGGCC AGGGAACCCTGGTCACCGTCTCCTCA |
| | | | SEQ ID NO: 30645 |
| | | SEQ ID NO: 26639 | |

FIGURE 50
(Continued)

| | | | | |
|---|---|---|---|---|
| iPS:435865 | 21-225_191.A5 | AA | EIVLTQSPDFQSVTPKEKVTITCRANQSIGSSLHW YQQKPDQSPKLLIKYASQSLSGVPSRFSASGSGT DFTLTINSLDAEDAATYYCHQTGRLPLTFGGGT KVEIK<br>SEQ ID NO: 26640 | QVQLQESGPGLVKPSQTLSLTCTVSGGSISSSGYYW NWIRQHPGKGLEWIGYIFYSGSTYYNPSLRSRLTISI DTSKNQFSLKLTSVTAADTAVYYCGRSGYNWDNG VDPWGQGTLVTSS<br>SEQ ID NO: 30646 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGG TTCTTAGCCTGGTACCAGCAGAAACCTGGCCA GGCTCCCAGGCTCCTCATCTATGTGTCTTCCA ACAGGGCCACTGGCATCCCCGACAGGTTCAGT GGCAGTGGGTCTGGGACAGACTTCACTCTCAC CATCAGCAGACTGGAGCCTGAAGATTTTGCAG TGTATTACTGTCAGCAGTATGGTGTTCACCTC CGTGGACGTTCGTCCAAGGGGACCAAGGTGGA AATCAAA<br>SEQ ID NO: 26641 | GAGATACAGGTTGGTGGAGTCTGGGGGAGGCCTG GTCAAGCCTGGGGGGTCCCTGAGACTCTCCTGTG CAGCCTCTGGATTCACCTTCAGAGACTATAGCAT GAACTGGGTCCGCCAGGCTCCAGGGAAGGGGCT GGAGTGGGTCTCATCATTAGTAGTGGTAGTGGT TACATATATTATGCAGATCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGCTACTATG GCCCTTGACTACTGGGGCCAGGGAGCCCTGGTCA CCGTCTCCTCA<br>SEQ ID NO: 30647 |
| | | AA | EIVLTQSPGTLSLSPGERATLSCRASQSVSSRFLA WYQQKPGQAPRLLIYGASNRATGIPDRFSGSGS GTDFTLTISRLEPEDFAVYYCQQYGGSPPWTFVQ GTKVEIK<br>SEQ ID NO: 26642 | EIQVVESGGGLVKPGGSLRLSCAASGFTFRDYSMN WVRQAPGKGLEWVSSISSGSGYIYYADSVKGRFTIS RDNAKNSLYLQMNSLRAEDTAVYYCARATMALD YWGQGALVTVSS<br>SEQ ID NO: 30648 |

FIGURE 50
(Continued)

| | | | |
|---|---|---|---|
| iPS:435867 | 21-225_191E5 | NA | GAAATTGTGCTGACTCAGTTCCAGACTCTCA GTCTGTGACTCCAAAGGAGAAAGTCACCATCA CCTGCCGGGCCAGTCAGTCAGACAGAAAGTCC CTGCCGGGCCAGTCAGAGCAGAAACCAGATCAGTC TTACACTGGTACCAGCAGAAACCAGATCAGC TCCAAAGCTCCTCATCAAGTATGCTTCCCAGT CCTTCTCAGGGGTCCCCTGAGGTTCAGTGGC AGTGGATCTGGGACAGATTTCACCCTCACCAT CAATAGTCTGGAGGCTGAAGATGCTGCAACGT ATTACTGTCATCAGAGTAGTAGTTTCCCTCCG ACGTTCGGCCAAGGGACCAAGGTGAAATCA AA<br><br>SEQ ID NO: 26643 | GAGGTGCAGCTGTTGGACTCTGGGGGAGGCTTGG GACAGCCTGGGGGGGTCCCTGAGACTCTCCTGTGC AGCCTCTGGATTCACCTTTGACAGCTATGCCATG AACTGGGTCCGCCAGGCTCCAGGGAAGGGGCTG GAGTGGGTCTCAACTATTAGTGGTACTGGTCGTA GGACATACTACGCAGACTCCGTGAAGGGCCGGT TCACCATCTCCAGAGACAATTCCAAGAACACGCT GTATCTGCAAATGAATAGCCTGAGAGCCGAGGA CACGGCCGTATATTACTGTGCAAAGAGGAGGA TTACTATGATAGTAGTGGCCGGGGTTGACCCC TGGGGCCAGGGAACCCTGGTCACCGTCTCCTCA<br><br>SEQ ID NO: 30649 |
| | | AA | EIVLTQFPDSQSVTPKEKVTITCRASQSIGSSLHW YQQKPDQSPKLLIKYASQSFSGVPSRFSGSGSGT DFTLTINSLEAEDAATYYCHQSSSFPRTFGQGTK VEIK<br><br>SEQ ID NO: 26644 | EVQLLDSGGGLGQPGGSLRLSCAASGFTFDSYAMN WVRQAPGKGLEWVSTISGTGRRTYYADSVKGRFTI SRDNSKNTLYLQMNSLRAEDTAVYYCAKEEDYYD SSGPGFDPWGQGTLVTVSS<br><br>SEQ ID NO: 30650 |
| iPS:435869 | 21-225_190B1 | NA | GACATCCAGATGACCCAGTCTCCATCCTCACT GTCTGCATCTGTTGGAGACAGAGTCACCATCA CTTGTCGGGCGAGTCAGGGCATTAGAAATTAT TTAGCCTGGTTTCAGCAGAAACCAGGGAAAGC CCCTAAGTCCCTGATCTATGTTGCATCCAGTTT GGAAAGTGGGGTCCCATCAAGTTCAGTGGCA GTGGATCTGGGACAGATTTCACTCTCACCATC AGCAGCCTGCAACAGTATCTTAATTACCCAGTCA TTACTGCCAACAGTATCTTAATTACCCAGTCA CTTTCGGCCCTGGGACCAAAGTGGATATCAGA<br><br>SEQ ID NO: 26645 | CAGGTGCAGCTGCAGGAGTCTGGGGGAGGCGTG GTCCAGCCTGGGAGGTCCCTGAGACTCTCCTGTG CAACGTCTGGATTCACCTTCAGTAGCTATGGCAT GCACTGGGTCCGCCAGGCTCCAGGCAAGGGGCT GGAGTGGGTGGCAGTTATATGTATGATGGAAGT AATAAACATTATGCAGACTCCGTGAAGGGCCGA TTCACCATCTCCAGAGACACAATTCCAAGAACACAC TATATCTGCAAATGAACAGCCTGAGAGCCGAGG ACACGGCTGTTTATTACTGTGCGAGAGATAGAAC AGTGGGATACTCCGGTATGAGCGTCTGGGGCCA AGGGACCACGGTCACCGTCTCCTCA<br><br>SEQ ID NO: 30651 |

FIGURE 50
(Continued)

| | | | |
|---|---|---|---|
| iPS:435871 | 21-225_191E6 | AA | DIQMTQSPSSLSASVGDRVTITCRASQGIRNYLAWFQQKPGKAPKSLIYVASSLESGVPSKFSGSGSGTEFTLTISSLQPEDFGTYYCQQYLNYPVTFGPGTKVDIR<br>SEQ ID NO: 26646 | QVQLVESGGGVVQPGRSLRLSCATSGFTFSSYGMHWVRQAPGKGLEWVAVIWYDGSNKHYADSVKGRFTISRDNSKNTLYLQMNSLRAEDTAVYYCARDRTVGYSGMDVWGQGTTVTVSS<br>SEQ ID NO: 30652 |
| | | NA | GATATTGTGATGACCCAGACTCCACTCTCTCTGTCCGTCACCCCTGGACAGCCGGCCTCCATCTCCTGCAAGTCTAGTCAGAGCCTCCTCCATAGTGATGGAAGGACCTATTTGTATTGGTACCTGCAGAAGCCAGGCCAGCCTCCACAGCTCCTGATCTGTGAGGTTTCCAACCGGTTCGCTGGAGTGACAGATAGGTTCAGTGGCAGCGGGTCAGGGACAGATTTCACACTGAAAATCAGCCGGGTGGAGGCTGGGGATGTTGGGGATTTATTACTGCATGCAAAGTATACATTTTCCCTGGACGTTCGGCCAAGGGACCAAGGTGGAAATCAAA<br>SEQ ID NO: 26647 | CAGCTGCAGCTGCAGGAGTCGGGCCCAGGACTGGTGAAGCCTTCGGAGACCCTGTCCCTCACCTGCACTGTCTCTGGTGGCTCCATCAGAAGTACCACTGGAGCTGGATCCGGCAGCCCGCCGGAAGGGACTGGAGTGGATTGGGCTTATCTATACCAGTAGGAGCACCAATTACAACCCCTCCCTCAAGAGTCGAGTCACCATGTCAGTAGACACGTCCAAGAACCAGTTCTCCCTGAAGCTGAGCTCTGTGACCGCCGCGGACACGGCCGTGTATTACTGTGCGAGACTCCGGTATAACTGGAACTTCCCTACTTTGACTTCTGGGGCCAGGGAACCCTGGTCACCGTCTCCTCA<br>SEQ ID NO: 30653 |
| | | AA | DIVMTQTPLSLSVTPGQPASISCKSSQSLLHSDGRTYLYWYLQKPGQPPQLLICEVSNRFAGVTDRFSGSGSGTDFTLKISRVEAGDVGIYYCMQSIHFPWTFGQGTKVEIK<br>SEQ ID NO: 26648 | QLQLQESGPGLVKPSETLSLTCTVSGGSIRSYHWSWIRQPAGKGLEWIGLIYTSRSTNYNPSLKSRVTMSVDTSKNQFSLKLSSVTAADTAVYYCARLRYNWNFPYFDFWGQGTLVTVSS<br>SEQ ID NO: 30654 |

FIGURE 50
(Continued)

| | | | | |
|---|---|---|---|---|
| iPS:435873 | 21-225_190G4 | NA | GACATCCAGATGACCCAGTCTCCATCCTCACTGTCTGCATCTGTAGGAGACAGAGTCACCATCACTTGTCGGGCGAGTCAGGACAGTTGGCAGATATTAGCCTGTGGTTTCAGCAGAAGCCAGGGAAAGCCCCTAAGTCCCTGATCTATGCTGCATCCAGTTTGCAAAGTGGGGTCCCATCAAAGTTCACTCTCACCATCAGCAGCCTGCAGCCTGAAAATTTTGCAACTTATTACTGTCAACAATATAGTACTTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGAAGTAATAAAAACTACGCAGACTCCGTGAAGGGCGATTCACCATCTCCAGAGACAATTCCAAGAACACGCTGTATCTGCAAATGAACAGCCTGAGAGCCGAGGACACGGCTATGTATTACTGTGCGAGAGATCAGGGCGTGGGCTACGACGGTTTGACGACGTCTGGGGCCAAGGGACCACGGTCACCGTCTCCTCA |
| | | AA | DIQMTQSPSSLSASVGDRVTITCRASQDIGRYLAWFQQKPGKAPKSLIYAASSLQSGVPSKFSGSGSGTDFTLTISSLQPENFATYYCQQYSTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAMYYCARDQGVGYDGLDVWGQGTSVTVSS |
| | | | SEQ ID NO: 26649 | SEQ ID NO: 30655 |
| | | | SEQ ID NO: 26650 | SEQ ID NO: 30656 |
| iPS:435875 | 21-225_190B9 | NA | GACATCCAGATGACCCAGTCTCCATCTTCCGTGTCTGCATCTGTAGGAGACAGAGTCACCATCACTTGTCGGGCGAGTCAGGGTATTAACAACTGGTTAGCCTGGTATCAGCAGAAACCAGGGAAAGCCCCTAAGTCCCTGATCTATGCTGTGTTTCCAGTTTGCAGAGTGGGGTCCCATCAAGGTTCAGCGGCAGTGGATCTGGGACAGATTTCACTCTCACCATCAGCAGCCTGCAGCCTGAAGATTTTGCAACTTACTCTTGTCAACAGGCTAACAGTTTCCCGTGGACGTTCGGCCAAGGGACCAAGGTGGAAATCAGA | GAGGTGCAGCTGTTGGAGTCTGGGGGAGGCTTGGTACAGCCTGGGGGGTCCCTGAGACTCTCCTGTGCAGCCTCTGGATTCACCTTTAGCACCTACTGCCATGAGTTGGGTCCGCCAGGCTCCAGGGAAGGGGCTGGAGTGGGTCTCAGCTATTAGTGGTAGTGGTGGTAACACACTACGCAGACTCCGTGAAGGGCCGGTTCACCATCTCCAGAGACAATTCCAAGAATACGCTGTATCTGCAAATGAACAGCCTGAGAGCCGAGGACACGGCCGTATATTCCGTGCGAAAGATGATTCGGTGGAGCTCCTACTTTGACTACTGGGGCCAGGGAACCCTGGTCACCGTCTCCTCA |
| | | | SEQ ID NO: 26651 | SEQ ID NO: 30657 |

FIGURE 50
(Continued)

| | | | |
|---|---|---|---|
| iPS:435877 | 21-225_184E7 | AA | DIQMTQSPSSVSASVGDRVTITCRASQGINNWLAWYQQKPGKAPKLLIYGVSSLQSGVPSRFSGSGSGTDFTLTISSLQPEDFATYSCQQANSFPWTFGQGTKVEIR<br>SEQ ID NO: 26652 | EVQLLESGGGLVQPGGSLRLSCAASGFTFSTYAMSWVRQAPGKGLEWVSAISRSGGNTHYADSVKGRFTISRDNSKNTLYLQMNSLRAEDTAVYYSCAKDGFGGSSYFDYWGQGTLVTVSS<br>SEQ ID NO: 30658 |
| | | NA | GACATCCAGATGACCCAGTCTCCATCCTCACGGTCTGCATCTATAGGAGAGACAGTCACCATCACTTGTCGGGCGAGTCAGGGCATTAGCAATAATCTTGTAGCCTGGATTCAGCAGAAACCAGGGACAGCCCCTAAGTCCCTTATTTATGCTGCATCCAGTTTGCAAAGTGGGGTTTCATCAAGGTTTAGCGGCAGTGGATTTGGGACAGATTTCACTATCACCATCAGTAGTGTGCAGCCTGAAGATTTTGCAACTTATTACTGCCAACAGTATATGGTTACCCATTCACTTTCGGCGGAGGGACCAAAGTGGATATCAAA<br>SEQ ID NO: 26653 | CAGGTGCAGCTGGTGCAGTCTGGGGCTGAAGTGAAGACGCCTGGGGCCTCAGTGAAGGTCCTGCAAGGGCTTCTGGATACACCTTCACCAGCTACAATATGCACTGGGTGCGACAGGTCCCTGGACAAGGGCTTGAGTGGATGGGATGGATCAACCCTAACAATGGTGGCTCAAACTATACACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGAGAAAGTTTGGGGACTGGGGCCAGGGAACCCTGGTCACCGTCTCCTCA<br>SEQ ID NO: 30659 |
| | | AA | DIQMTQSPSSRSASIGERVTITCRASQGISNYLAWIQQKPGTAPKSLIYAASSLQSGVSSRFSGSGFGTDFTITISSVQREDFATYCCQQYNGYPFTFGHGTKVDIK<br>SEQ ID NO: 26654 | QVQLVQSGAEVKTPGASVKVSCRASGYTFTSYNMHWVRQVPGQGLEWMGWINPNNGGSNYTQKFQGRVTMTRDTSISTAYMELSRLRSDDTAVYYCARKFGDWGQGTLVTVSS<br>SEQ ID NO: 30660 |

FIGURE 50
(Continued)

| | | | | |
|---|---|---|---|---|
| iPS:435879 | 21-225_184H10 | NA | GACATCCAGATGACCCAGTCTCCATCCTCCCT GTCTGCATCTGTAGGAGACAGAGTCACCATCA CTTGCCGGGCAAGTCAGGACAGATTAGAAATGAT TTAGGCTGGTATCAGCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGATTTCACTCTCACAAT CAGCAGCCTGCAGCCTGAAGATTTTGCAACTT ATTACTGTCTACAGCATATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG TAGCGTCTGGATTCACCTTCAGTGACTATGGCAT GCACTGGGTCCGCCAGGCTCCAGGCAAGGGGCT GGAGTGGGTGGCAGTTATTTGGTATGATGAAACT AATAAACACTATGGAGACTCCGTGAAGGGCCGA TTCACCATCTCCAGAGACAATTCCAAGGACACGC TGTATCTGCAAATGAACAGCCTGAGAGCCGAGG ACACGGCTGTGTATTACTGTGCGAGAGAGGTTGG CTGGCACGATGACTATTGGGGCCAGGGAACCCT GGTCACCGTCTCCTCA |
| | | | SEQ ID NO: 26655 | SEQ ID NO: 30661 |
| | | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPFTFGPGTK VDIK | QVQLVESGGGVVQPGRSLRLSCVASGFTFSDYGM HWVRQAPGKGLEWVAVIWYDETNKHYGDSVKGR FTISRDNSKDTLYLQMNSLRAEDTAVYYCAREVG WHDDYWGQGTLVTVSS |
| | | | SEQ ID NO: 26656 | SEQ ID NO: 30662 |
| iPS:435881 | 21-225_184D11 | NA | GACATCCAGATGACCCAGTCTCCATCCTCCCT GTCTGCATCTGTAGGAGACAGAGTCACCATCA CTTGCCGGGCAAGTCAGGACAGATTAGAAATGAT TTAGGCTGGTATCAGCAGCAGAAACCAGGGAAAG CCCCTAAGCGCCTGATCTATATTGCATCCAGTT TGCAAAGTGGGGTCCCATCAAGGTTCAGCGGC AGTGGATCTGGGACAGATTTCACTCTCACAAT CAGCAGCCTGCAGCCTGAAGATTTTGCAACTT ATTACTGTCTACAGCATATAATAGTTACCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATTTGGTATGATGAAACT AATAAACACTATGGAGACTCCGTGAAGGGCCGA TTCACCATCTCCAGAGACAATTCCAAGGACACGC TGTATCTGCAAATGAACAGCCTGAGAGCCGAGG ACACGGCTGTGTATTACTGTGCGAGAGAGGTTGG CTGGCACGATGACTATTGGGGCCAGGGAACCCT GGTCACCGTCTCCTCA |
| | | | SEQ ID NO: 26657 | SEQ ID NO: 30663 |

FIGURE 50
(Continued)

| | | | | |
|---|---|---|---|---|
| iPS:435883 | 21-225_185A1 | AA | DIQMTQSPSSLSASVGDRVTITCRASQGIRNDLG WYQQKPGKAPKRLIYIASSLQSGVPSRFSGSGSG TEFTLTISSLQPEDFATYYCLQHNSYPFTFGPGTK VDIK<br><br>SEQ ID NO: 26658 | QVQLVESGGGVVQPGRSLRLSCAASGFTFSDYGM HWVRQAPGKGLEWVAVIWYDETNKHYGDSVKGR FTISRDNSKDTLYLQMNSLRAEDTAVYYCAREVG WHDDYWGQGTLVTVSS<br><br>SEQ ID NO: 30664 |
| | | NA | GACATCCAGATGACCCAGTCTCCATCCTCACT GTCTGCATCTGTAGGAGACAGAGTCACCATCA CTTGTCGGGCGAGTCAGGGCATTAGGCAATTAT TTAGCCTGGTTTCAGCAGAAACACCAGGGAAAGC CCCTAAGTCCCTGATCTCTGTTGCATCCAGTTT GCAAAGTGGGGTCCCATCAAGATTCAGCGCCA GTGGATCTGGGACAGATTTCACTCTCACCATC AGCAGCCTGCAGCCTGAAGATTTATCATAGTT TACTGCCGACAATATCATAGTTACCCATTCA CTTTCGGCCCTGGGACCAAAGTGGATATCAAA<br><br>SEQ ID NO: 26659 | GAGGTGCAGCTGGTGGAGTCTGGGGGAGGCCTG GTCAAGCCTGGGGGGTCCCTGAGACTCTCCTGTG CAGCCTCTGGATTCACCTTCAATAGCTATAGCAT GAACTGGGTCCGCCAGGCTCCAGGGAAGGGGCT GGAGTGGGTCTCATCCATTAGCAGTAGTGGTAGT TACATATATTACGCAGACTCAGTGAAGGGCCGAT TCACCATCTCCAGAGACAACGCCAAGAACTCACT GTATCTGCAAATGCACAGCCTGAGAGCCGAGGA CACGGCTGTGTATTACTGTGCGAGAAGCAACCTT TTTGACTGCTGGGGCCAGGGAACCCCGGTCACCG TCTCCTCA<br><br>SEQ ID NO: 30665 |
| | | AA | DIQMTQSPSSLSASVGDRVTITCRASQGISNYLA WFQQTPGKAPKSLISVASSLQSGVPSRFSASGSG TDFTLTISSLQPEDFATYYCRQYHSYPFTFGPGTK VDIK<br><br>SEQ ID NO: 26660 | EVQLVESGGGLVKPGGSLRLSCAASGFTFNSYSMN WVRQAPGKGLEWVSSISSSGSYIYYADSVKGRFTIS RDNAKNSLYLQMHSLRAEDTAVYYCARSNLFDCW GQGTPVTVSS<br><br>SEQ ID NO: 30666 |

FIGURE 50
(Continued)

| | | | | |
|---|---|---|---|---|
| iPS:435885 | 21-225_185F10 | NA | GACATCCAGATGACCCAGTCTCCATCCTCACGGTCTGCATCTATAGGAGAGAGTCACCATCACTTGTCGGGCGAGTCAGGGCATTAGCAATTATTTAGCCTGGATTCAGCAGAAACCAGGACAGCCCCTAAGTCCCTTATCTATGCTGCATCCAGTTTGCAAAGTGGGGTTTCATCAAGGTTTAGCGGCAGTGGATTTGGGACAGATTTCACTCTCACCATCAGTAGTCTGCAGCCTGAAGATTTTGCAACTTATTACTGCCAACAGTATAATGGTTACCCATTCACTTTCGGCCCTGGGACCAAAGTGGATATCAAA<br><br>SEQ ID NO: 26661 | CAGGTGCAGCTGGTGCAGTCTGGGGCTGAAGTGAAGACGCCTGGGGCCTCAGTGAAGGTCTCCTGCAAGGCTTCTGGATACACCTTCACCAGCTACAATATGCACTGGGTGCGACAGGTCCCTGGACAAGGGCTTGAGTGGATGGGATGGATCAACCCTAACAATGGTGGCTCAAACTATACACAGAAGTTTCAGGCAGGGTCACCATGACCAGGGACACGTCCATCAGCACAGCCTACATGGAGCTGAGCAGGCTGAGATCTGACGACACGGCCGTGTATTACTGTGCGAGAAAGTTTGGGGACTGGGGCCAGGGAACCCTGGTCACCGTCTCCTCA<br><br>SEQ ID NO: 30667 |
| | | AA | DIQMTQSPSSRSASIGERVTITCRASQGISNYLAWIQQKPGTAPKSLIYAASSLQSGVSSRFSGSGFGTDFTLTISSLQPEDFATYYCQQYNGYPFTFGPGTKVDIK<br><br>SEQ ID NO: 26662 | QVQLVQSGAEVKTPGASVKVSCRASGYTFTSYNMHWVRQVPGQGLEWMGWINPNNGGSNYTQKFQGRVTMTRDTSISTAYMELSRLRSDDTAVYYCARKFGDWGQGTLVTVSS<br><br>SEQ ID NO: 30668 |
| iPS:435887 | 21-225_186F7 | NA | GATGTTGTGATGGCCCAGACTCCACTCTCTGTCCGTCACCCTGGACAGCCGGCCTCCATCTCCTGCAAGTCTAGTCAGAGCCTCCTGCATGGTGATGGAAAGACCTATTTGTGTTGGTACCTCAGAAGCCAGGCCAGCCTCCACAGCTCCTGATCTATGAAGTTTCCAAGCGGTTCTCTGGAGTGCCAGATAGGTTCAGTGGCAGCGGGTCAGGGACAGATTTCACACTGAAAATCAGCCGGGTGGAGGCTGAGGATGTGGGGTCTATTACTGCATGCAAAGTATACAGGTTCCCTGACGTTCGGCCAAGGGACCAAGGTGGAAATCAAA<br><br>SEQ ID NO: 26663 | CAGGTGCAGCTGGTGGAGTCTGGGGGAGGCGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGGCTGGAGTGGGTGGCAATTATATGGTATGATGGAAGTTATAAATATTATGCAGACACCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCATTACGATTTTTGGAGTGGCACTTGACTACTGGGGCCAGGGAACCCTGGTCACCGTCTCCTCA<br><br>SEQ ID NO: 30669 |

FIGURE 50
(Continued)

| | | | |
|---|---|---|---|
| iPS:435889 | 21-225_186A11 | AA | DVVMAQTPLSLSVTPGQPASISCKSSQSLLHGDG KTYLCWYLQKPGQPPQLLIYEVSKRFSGVPDRFS GSGSGTDFTLKISRVEAEDVGVYYCMQSIQVPW TFGQGTKVEIK<br>SEQ ID NO: 26664 | QVQLVESGGGVVQPGRSLRLSCAASGFTFSTYGMH WVRQAPGKGLEWVAIIWYDGSYKYYADSVKGRFT ISRDNSKNTLYLQMNSLRAEDTAVYYCARDHYDF WSGHFDYWGQGTLVTVSS<br>SEQ ID NO: 30670 |
| | | NA | GACATCCAGATGACCCAGTCTCCATCTTCCGT GTCTGCATCTGTTGGAGACAGAGTCACCATCA CTTGTCGGGCGAGTCAGGATCAGGATATTAGCAGCTGG TTAGCCTGGTATCAGCAGAAACCAGGAAAG CCCCTAAACTCCTGATCTATGCTGCATCCAGTT TACAAAGTGGGTCCCATCAAGGTTCAGCGGC AGTGGATCTGGGACAGATTTCATTCTCACCAT CACCAGCGTGCAGCCTGATGATTTGCAACTT ACTATTGTCAACAGTTAACAGTTCCCATTC ACTTTCGGCCATGGGACCAAAGTGGATATCAA A<br>SEQ ID NO: 26665 | GAGGTGCAGCTGTTGGAGTCTGGGGGAGGCTTG GTACAGCCTGGGGGGTCCTGAGACTCTCCTGTG CAGCCTCTGGATTCACCTTTAGCAGCTATGCCAT GAGTTGGGTCCGCCAGGCTCCAGGGAAGGGCT GGAGTGGGTCTCAGTTATTAGTGGTAGAGGTGGT ACCACATTCTACGCAGACTCCGTGAAGGGCCGGT TCACCATCTCCAGAGACAATTCCAAGAACACGCT GTATCTGCAAATGAACAGCTGAGAGCCGAGGA CACGGCCGTATATTACTGTGCGAAACGGACTGGG GATGATGTTTTTGATATCTGGGGCCAAGGGACAA TGGTCACCGTCTCTTCA<br>SEQ ID NO: 30671 |
| | | AA | DIQMTQSPSSVSASVGDRVTITCRASQDITSWLA WYQQKPGKAPKLLIYAASSLQSGVPSRFSGSGS GTDFILTITSVQPDDFATYCQQVNSFPFTFGHG TKVDIK<br>SEQ ID NO: 26666 | EVQLLESGGGLVQPGGSLRLSCAASGFTFSSYAMS WVRQAPGKGLEWVSVISGRGTTFYADSVKGRFTI SRDNSKNTLYLQMNSLRAEDTAVYYCAKRTGDDV FDIWGQGTMVTVSS<br>SEQ ID NO: 30672 |

FIGURE 50
(Continued)

| | | | |
|---|---|---|---|
| iPS:435891 | 21-225_188H5 | NA | GACATCCAGATGACCCAGTCTCCATCCTCACT GTCTGCATCTATAGGAGAGAGAGTCACCATCA CTTGTCGGGCGAGTCAGGGCATTAGCAATTAT TTAGCCTGGCTTCAGCAGAAACCAGGGACAGC CCCTAAGTCCCTGATCTATGCTGCTTCCAGTT TGCAAAGTGGGGTCTCATCAAGGTTCAGCGGCA GTGGATTTGGGACAGATTTCACTCTCACCATC AGTAGTCTGCAGCCTGAAGATTTTGCAACTTA TTACTGCCAACAGTATAATAGTTATCCATTCA CTTTCGGCCCTGGGACCAAGTGGATATCAAA<br><br>SEQ ID NO: 26667 | CAGGTGCAGCTGGTGCAGTCTGGGGCTGAGGTG AAGACGCCTGGGGCCTCAGTGAAGGTCTCCTGCA GGGCTTCTGGATACACCTTCACCAGCTACAATAT GCACTGGGTACGACAGGTCCCTGGACAAGGGCT TGAGTGGATGGGATGGATCAACAGAAGTTTCAGGGCAGG GGCTCAAACTATACACCAGGGACACGTCCATCAGCACA ATCACCATGACCAGGGACACGTCCATCAGCACA GCCTACATGAGCTGAGCAGGCTGAGATCTGAC GACACGGCCGTATATTATTACTGTGCGAGAAAGTTTG GGGACTGGGGCCAGGGAACCCTGGTCACCGTCT CCTCA<br><br>SEQ ID NO: 30673 |
| | | AA | DIQMTQSPSSLSASIGERVTITCRASQGISNYLAW LQQKPGTAPKSLIYAASSLQSGVSSRFSGSGFGT DFTLTISSLQPEDFATYYCQQYNSYPFTFGPGTK VDIK<br><br>SEQ ID NO: 26668 | QVQLVQSGAEVKTPGASVKVSCRASGYTFTSYNM HWVRQVPGQGLEWMGWINPNSGGSNYTQKFQGRI TMTRDTSISTAYMELSRLRSDDTAVYYCARKFGD WGQGTLVTVSS<br><br>SEQ ID NO: 30674 |
| iPS:435895 | 21-225_188E8 | NA | GACATCCAGATGACCCAGTCTCCATCCTCCGT GTCTGCATCTGTAGGAGACAGAGTCACCATCA CTTGTCGGGCGAATCAGGATATTCAGCTGG TTAGCCTGGTATCAGCAGAAACCAGGGAAAG CCCCTAAGCTCCTGATCTATGCTGCATCCAATT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAGCAGGCTAACAGTTTCCCGTGG ACGTTCGGCCAAGGGACCAAGGTGGAAATCA AG<br><br>SEQ ID NO: 26669 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTGCCAT GAACTGGGTCCGCCAGGCTCCAGGGAAGGGGCT GGAGTGGGTCTCAGTTATTAGTGGTAGTGGTGGT TACACATACTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTTCTGTGCGAAAAGGAACACC GATGATGCTTTTGATATCTGGGGCCAAGGGACAA TGGTCACCGTCTCTTCA<br><br>SEQ ID NO: 30675 |

FIGURE 50
(Continued)

| | | | |
|---|---|---|---|
| | | AA | DIQMTQSPSSVSASVGDRVTITCRANQDISSWLA WYQQKPGKAPKLLIYAASNLQSGVPSGFSGSGS GTDFTLTISSLQPEDFATYYCQQANSFPWTFGQG TKVEIK<br><br>SEQ ID NO: 26670 | EVQLLESGGGLVQPGGSLRLSCAASGFTFSSSAMN WVRQAPGKGLEWVSVISGSGGYTYYADSVKGRFT ISRDNSKNTLYLQMNSLRAEDTAVYFCAKRNTDDA FDIWGQGTMVTVSS<br><br>SEQ ID NO: 30676 |
| iPS:435897 | 21-225_188B9 | NA | GACATCCAGATGACCCAGTCTCCATCCTCACT GTCTGCATCTATAGGAGAGAGATCACCATCA CTTGTCGGGCGAGTCAGGCATTAGCAATTAT TTAGCCTGGCTTCAGCAGAAACCAGGACAGC CCCTAAGTCCCTGATCTATGCTGCATCCAGTTT GCAAAGTGGGGTCTCATCAAGGTTCAGCGGCA GTGGATTTGGGACAGATTTCACTCTCACCATC AGTAGTCTGCAGCCTGAAGATTATAGTTACCCATCA TTACTGCCAACAGTATATAGTTACCCATTCA CTTTCGGCCCCTGGGACCAAAGTGGATATCAAA<br><br>SEQ ID NO: 26671 | CAGGTGCAGCTGGTGCAGTCTGGGGCTGAGGTG AAGAAGCCTGGGGCCTCAGTGAAGGTCCTGCA GGGCTTCTGGATACACCTTCACCAGCTACAATAT GCACTGGGTGCGACAGGTCCCTGGACAAGGGCT TGAGTGGATGGGATGGATCAACCTAACAGTGGT GGCTCAAACTATACACAGAAGTTTCAGGGCAGG GTCACCATGACCAGGGACACGTCCATCAGCACA GCCTACATGGAGCTGAGCAGGCTGAGATCTGAC GACACGGCCGTGTATTACTGTGCGAGAAAGTTTG GGGACTGGGGCCAGGGAACCCTGGTCACCGTCT CCTCA<br><br>SEQ ID NO: 30677 |
| | | AA | DIQMTQSPSSLSASIGERVTITCRASQGISNYLAW LQQKPGTAPKSLIYAASSLQSGVSSRFSGSGFGT DFTLTISSLQPEDFATYYCQQYNSYPFTFGPGTK VDIK<br><br>SEQ ID NO: 26672 | QVQLVQSGAEVKTPGASVKVSCRASGYTFTSYNM HWVRQVPGQGLEWMGWINPNSGGSNYTQKFQGR VTMTRDTSISTAYMELSRLRSDDTAVYYCARKFGD WGQGTLVTVSS<br><br>SEQ ID NO: 30678 |

FIGURE 50
(Continued)

| | | | |
|---|---|---|---|
| iPS:435899 | 21-225_188G11 | NA | GATATTGTGATGACCCAGACTCCACTCTCTCT<br>GTCCGTCACCCCTGGACAGCCGGCCTCCATCT<br>CCTGCAGTCTAGTCAGAGCCTCCTGCATGGT<br>GATGGAAAAGACCTATTTATATTGGTACCTGCA<br>GAAGCCCGGCCAGCCTCCACAGCTCCTGATCT<br>ATGAAGTTTCCAACCGGTTCTCTGGAGTGCCA<br>GATACGTTCAGTGGCAGCGGGTCAGGGACAG<br>ATTTCACACTGAAAATCAGCGGGTGAAGGCT<br>GAGGATGTTGGGGTTTATTACTGCATGCAAAG<br>TATACAGATTCCTTGGACGTTCGGCCAAGGGA<br>CCAAGGTGGAAATCAAA<br><br>SEQ ID NO: 26673 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTTATGGCAT<br>GCACTGGGTCCGCCAGGCTCCAGGCAAGGGCT<br>GGAGTGGGTGACAATTATATGGTATGATGGAAGT<br>TATAAATACTATGCAGACTCCGTGAAGGGCCGAT<br>TCACCATCTCCAGAGACAATTCCAAGAACACGCT<br>GTTTCTGCAAATGAACAGCCTGAGAGCCGAAGA<br>CACGGCTGTGTATTACTGTGCGAGAGAGATAC<br>GATTTTTGGAGTGGTCATTTTGACTACTGGGGCC<br>AGGGAACCCTGGTCACCGTCTCCTCA<br><br>SEQ ID NO: 30679 |
| | | AA | DIVMTQTPLSLSVTPGQPASISCMSSSQSLLHGDG<br>KTYLYWYLQKPGQPPQLLIYEVSNRFSGVPDTFS<br>GSGSGTDFTLKISRVEAEDVGVYYCMQSIQIPWT<br>FGQGTKVEIK<br><br>SEQ ID NO: 26674 | QVQLVESGGGVVQPGRSLRLSCAASGFTFSSYGMH<br>WVRQAPGKGLEWVTIIWYDGSYKYYADSVKGRFT<br>ISRDNSKNTLFLQMNSLRAEDTAVYYCARERYDF<br>WSGHFDYWGQGTLVTVSS<br><br>SEQ ID NO: 30680 |
| iPS:435901 | 21-225_189G2 | NA | GATATTGTGATGACCCAGACTCCACTCTCTCT<br>GTCCGTCACCCCTGGACAGCCGGCCTCCATCT<br>CCTGCAAGTCTAGTCAGAGCCTCCTGCATGGT<br>GATGGAAAAGACCTATTTGTTTGGTACCTGCA<br>GAAGCCAGGCCAGCCTCCACAACTCCTGATCT<br>ATGAAGTTCCAACCGGTTCTCTGGAGTGTCA<br>GATAGGTTCAGTGGCAGCGGGTCAGGGACAG<br>ATTTCACACTGAAAATCAGCGGGTGGAGGCT<br>GAGGATGTTGGGGTTTACTACTGCATGCAAAG<br>TATACAGATTCCGTGGACGTTCGGCCAAGGGA<br>CCAAGGTGGAGATCAAA<br><br>SEQ ID NO: 26675 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTATGGCAT<br>GCACTGGGTCCGCCAGGCTCCAGGCAAGGGCT<br>GGAGTGGGTGGCAATTATATGGTATGATGGAAGT<br>TATAAATACTATGCAGACTCCGTGAAGGGCCGAT<br>TCACCATCTCCAGAGACAATTCCAAGAACACGCT<br>GTATCTGCAAATGAACAGCCTGAGAGCCGAGGA<br>CACGGCTGTGTATTATTGTGCGAGAGATCGATTC<br>GATTTTTGGAGTGGTTATTCCGACTACTGGGGCC<br>AGGGAACCCTGGTCACCGTCTCCTCA<br><br>SEQ ID NO: 30681 |

FIGURE 50
(Continued)

| | | | | |
|---|---|---|---|---|
| iPS:435903 | 21-225_190E2 | AA | DIVMTQTPLSLSVTPGQPASISCKSSQSLLHGDG KTYLFWYLQKPGQPPQLLIYEVSNRFSGVSDRFS GSGSGTDFTLKISRVEAEDVGVYYCMQSIQIPWT FGQGTKVEIK<br>SEQ ID NO: 26676 | QVQLVESGGGVVQPGRSLRLSCAASGFTFSNYGM HWVRQAPGKGLEWVAIIWYDGSYKYYADSVKGR FTISRDNSKNTLYLQMNSLRAEDTAVYYCARDRFD FWSGYSDYWGQGTLVTSS<br>SEQ ID NO: 30682 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAAC TCCAACAATAAGAACTACTTAGCTTGGTACCA GCAGAAACCAGGTCAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCATGCAGG CTGAAGATGTGGCAGTTTATTACTGTCAGCAA TATTGTAGTCTTCCATTCACTTTCGGCCCTGGG ACCAAAGTGGATATCAGA<br>SEQ ID NO: 26677 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGCTTTCATACATTAGTAGTAGTGGTACT ACCGTATTCTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br>SEQ ID NO: 30683 |
| | | AA | DIVMTQSPDSLAVSLGERATINCKSSQSVLFNSN NKNYLAWYQQKPGQPKPGQPPNLLIYWASTRESGVPD RFSGSGSGTDFTLTISSMQAEDVAVYYCQQYCS LPFTFGPGTKVDIR<br>SEQ ID NO: 26678 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTSS<br>SEQ ID NO: 30684 |

FIGURE 50
(Continued)

| | | | |
|---|---|---|---|
| iPS:435905 | 21-225_190A3 | NA | GAAATTATGTTGACGCAGTCTCCAGGCACCCT GTCTTTGTCTCCAGGGGAAAGAGCCACCCTCT CCTGCAGGGCCAGTGGTACCAGCAGAAACTGGCC CTTCTTAGCTGGTACCAGCAGAAACCTGGCC AGGCTCCCAGGCTCTCATCTATGGTGCATCC AGCAGGGCCACTGGCATCCCAGACAGATTCAG TGGCAGTGGTGTCTGGGACAGACTTCACTCTCA CCATCAACAGACTGGAGCCTGAAGATTTTGCG GTGTATTACTGTCAGCAGTATGGTAACTCACC GTGGACGTTCGGCCAAGGGACCAAGGTGGAA ATCAAA<br><br>SEQ ID NO: 26679 | CAGGTGCAGCTGCAGGAGTCGGGCCCAGGACTG GTGAAGCCTTCACAGACCCTGTCCCTCACCTGCA CTGTCTCTGGTGGCTCCATCAACAGTGGTGTTA CTACTGAACTGGATCCGCCAGCACCCAGGGAA GGGCCTGGAGTGGATTGGGTTCATCTTTATAGT GGGAGCACTTACTACAACCCGTCCCTCAAGAGTC GAGTTACCATATCAGTAGACACGTCTAAGAACCA GTTCTCCCTGAAGCTGAACTCTGTGACTGCCGCG GACACGGCCGTGTATTACTGTGCGAGAGGGGATT ACGATGGTTCGGGGAGTTATCACTACTATTAGGG TATGGACGTCTGGGGCCAAGGGACCACGGTCAC CGTCTCCTCA<br><br>SEQ ID NO: 30685 |
| | | AA | EIMLTQSPGTLSLSPGERATLSCRASQNIRSNFLA WYQQKPGQAPRLLIYGASSRATGIPDRFSGSVSG TDFTLTINRLEPEDFAVYYCQQYGNSPWTFGQG TKVEIK<br><br>SEQ ID NO: 26680 | QVQLQESGPGLVKPSQTLSLTCTVSGGSINSGVT WNWIRQHPGKGLEWIGFIFYSGSTYYNPSLKSRVTI SVDTSKNQFSLKLNSVTAADTAVYYCARGDYDGS GSYHYYGMDVWGQGTTVTVSS<br><br>SEQ ID NO: 30686 |
| iPS:435907 | 21-225_190G3 | NA | GACATCCAGATGACCCAGTCTCCATCCTCCCT GTCTGCATCTGTAAGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATTAAGGTTCAGCGG CAGTGGATCTGGGACAGACTTCACTCTCACAA TCAGCAGCCTGCAGCCTGAAGATTTGCAACT TATTACTGTCTACAGCATATAATAGTTACCCGTG GACGTTCGGCCAAGGGACCAAGGTGGAAATC AAA<br><br>SEQ ID NO: 26681 | CAGGTGCAGCTGCAGGAGTCGGGCCCAGGACTG GTCCAGCCTGGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCATATGATGGAGGT TATAAAAACTATGTAGACTCCGTGAAGGGCCGAT TCACCATCTCCAGAGACAATTCCAAGAACACGCT GTATCTGCAAATGAATAGCCTGAGAGCTGAGGA CACGGCTGTGTATTACTGTGCGAGAGGTACCAC GGTACTACTACGGTGTGGACGTCTGGGGCCAA GGGACCACGGTCACCGTCTCCTCA<br><br>SEQ ID NO: 30687 |

FIGURE 50
(Continued)

| | | | |
|---|---|---|---|
| iPS:435909 | | AA | DIQMTQSPSSLSASVRDRVTITCRASQGIRKDLGWYQQKPGKAPKRLIHTASSLQSGVPLRFSGSGSGTEFTLTISSLQPEDFATYYCLQHNSYPWTFGQGTKVEIK | QVQLVESGGGVVQPGRSLRLSCAASGFTFSSYGMHWVRQAPGKGLEWVAVISYDGGYKNYVDSVKGRFTISRDNSKNTLYLQMNSLRAEDTAVYYCARGTHGYYYGVDVWGQGTTVTSS |
| | | | SEQ ID NO: 26682 | SEQ ID NO: 30688 |
| | | NA | GACATCCAGATGACCCAGTCTCCATCTTCCGTGTCTGCATCTGTAGGAGACAGAGTCACCATCACTTGTCGGGCGAGTCAGGGTCTTAACAACTGGCTTGTCCTGGTATCAGCTGAAACCAGGAAAGCCCCTAAGCTCCTGATCTATGCTGTGTCCAGTTTGCAAAGTGGGGTCCCATCAAGGTTCAGCGGCAGTGGATCTGGGTCAGCAGTTCACTCTCACCATCAGCAGCCTGCAGCCTGAAGATTTTGCAACTTACCATTGTCAACAGGCTAACAGTCTCCCGTGACGTTCGGCCAAGGGACCAAGGTGGAAATCAAA | GAGGTGCAACTGTTGGAGTCTGGGGGAGGCTTGGTACAGCCTGGGGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTCGTGGTGGTAACACATACTACGCAGACTCCGTGAAGGGCCGGTTCACCATCTCCAGAGACAATTCCAAGAACACGCTGTATCTGCAAATGAACAGTTTGAGAGCCGAGGACACGGCCGTATATTACTGTGCGAAAGATGGATTCGGTGGGAGCTCCTATTTTGACTACTGGGGCCAGGGAACCCTGGTCACCGTCTCCTCA |
| | | | SEQ ID NO: 26683 | SEQ ID NO: 30689 |
| | 21-225_190H3 | AA | DIQMTQSPSSVSASVGDRVTITCRASQGLNNWLAWYQLKPGKAPKLLIYAVSSLQSGVPSRFSGSGSGSEFTLTISSLQPEDFATYHCQQANSLPWTFGQGTKVEIK | EVQLLESGGGLVQPGGSLRLSCAASGFTFSSYAMSWVRQAPGKGLEWVSAISGRGGNTYYADSVKGRFTISRDNSKNTLYLQMNSLRAEDTAVYYCAKDGFGGSSYFDYWGQGTLVTVSS |
| | | | SEQ ID NO: 26684 | SEQ ID NO: 30690 |

FIGURE 50
(Continued)

| | | | |
|---|---|---|---|
| iPS:435911 | 21-225_190B4 | NA | GAAATTGTGTTGACGCAGTCTCCAGGCACCCT GTCTTTGTCTCTCCAGGGGAAAGAGCCACACTCT CCTGCAGGGCCAGTCAGAGTATTGCAGCAGC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGGCGTTCGGCCAAGGGACCAAGGTGGAAA TCAAA<br>SEQ ID NO: 26685 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTATATTACTGTGCGAGAGGGATT ACGATGGTTCGGGGAGTTATCACTACTACTACGG TATGGACGTCTGGGGCCAAGGGACCACGGTCAC CGTCTCCTCA<br>SEQ ID NO: 30691 |
| | | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK<br>SEQ ID NO: 26686 | QVQLQESGPGLVKPSQTLSLTCTVSGGSISSGDYYW NWIRQHPGKGLEWIGYIFYSGSTYYNPSLKSRVTIS VDTSKNQFSLKLSSVTAADTAVYYCARGDYDGSG SYHYYGMDVWGQGTTVTVSS<br>SEQ ID NO: 30692 |
| iPS:435913 | 21-225_190A7 | NA | GAAATTGTGTTGACGCAGTCTCCAGGCACCCT GTCTTTGTCTCTCCAGGGGAAAGAGCCACCTCT CCTGCAGGGCCAGTCAGAGTGTTAGAAGCAAC TTCTTAGCCTGGTACCAGCAGAAACCTGGCCA GGCTCCCAGGCTCCTCATCTATGGTGCATACC GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTATTACTGTCAGCAGTATGGTAACTCACCG TGGACGTTCGGCCAAGGGACCAAGGTGGAAA TCAAA<br>SEQ ID NO: 26687 | CAGGTGCAGCTGCAGGAGTCGGGCCCAGGACTG GTGAACCCTTCACAGACCCTGTCCCTCACCTGCA CTGTCTCTGGTGGCTCCATCAGCAGTGGTGTTTA CTACTGGAGCTGGATCCGCCAGCACCCAGGGAA GGGCCTGGAGTGGATTGGGAACATCTATTACAGT GGGAGCACCTACAACAACCCGTCCCTCAAGAGT CGAATTATCATATCAGTAGACACGTCTAAGAACC AGTTCTCCCTGAAGCTGAGCTCTGTGACTGCCGC GGACACGGCCGTGTATTACTGTGCGAGAGGGGA TTACGATGGTTCGGGGAGTTATCACTACTACTAC GGTTTGGACGTCTGGGGCCAAGGGACCACGGTC ACCGTCTCCTCA<br>SEQ ID NO: 30693 |

FIGURE 50
(Continued)

| | | | |
|---|---|---|---|
| iPS:435915 | 21-225_190H4 | AA | EIVLTQSPGTLSLSPGERATLSCRASQSVRSNFLAWHQQKPGQAPRLLIYGAYRRATGIPDRFSGSGSGTDFTLTINRLEPEDFAVYYCQQYGNSPWTFGQGTKVEIK | QVQLQESGPGLVNPSQTLSLTCTVSGGSISSGVYYWSWIRQHPGKGLEWIGNIYSGSTYNNPSLKSRIIISVDTSKNQFSLKLSSVTAADTAVYYCARGDYDGSGSYHYYYGLDVWGQGTTVTVSS |
| | | | SEQ ID NO: 26688 | SEQ ID NO: 30694 |
| | | NA | GCCAACGTGATGACCCAGTCTCCAGACTCCCTGGCTGTGTCTCTGGGCGAGAGGACCACCATCAACTGCAAGTCCAGCCAGAGTGTTTTACACAGCTCCAACAATTACAACTACTTAGCTTGGTACCGGCAGAAACCAGGACAGCCTCCTAAGCTCCTCATCTACTGGGCATCTACCCGGGAATCCGGGGTCCCTGACCGATTCAGTGGCAGCGGGTCTGGTACAGATTTCACTCTCACCATCAGCAGCCTGCAGGCTGAAGATGTGGCAGTTTATTACTGTCAGCAATATTATAGTATTCCCCACTTTTGGCCCTGGGACCAAAGTGGATATCAAA | CAGGTGCAGCTGGTGCAGTCTGGGGCTGAGGTGAAGAAGCCTGGGGCCTCAGTGAAGGTCTCCTGCAAGGCTTCTGGAAACACCTTCACCAATTATGATATCAACTGGGTGCGACAGGCCACTGGACAAGGCTTGAGTGGATGGGATGGATGAACCCTAACAGTGGTAACACAGGCTATGCACAGAAGTTCCAGGGCAGTCACCATGACCAGGAACACCTCCATAAGCACAGCCTACATGGAGCTGAGCAGCCTGAGATCTGAGGACACGGCCGTGTATTACTGTGCCATAGCAGTGGCTGGTACATCTTTGACTACTGGGGCCAGGGAACCCTGGTCACCGTCTCCTCA |
| | | | SEQ ID NO: 26689 | SEQ ID NO: 30695 |
| | | AA | ANVMTQSPDSLAVSLGERTTINCKSSQSVLHSSNNYNYLAWYRQKPGQPPKLLIYWASTRESGVPDRFSGSGSGTDFTLTISSLQAEDVAVYYCQQYYSIPPTFGPGTKVDIK | QVQLVQSGAEVKKPGASVKVSCKASGNTFTNYDINWVRQATGQGLEWMGWMNPNSGNTGYAQKFQGRVTMTRNTSISTAYMELSSLRSEDTAVYYCAHSSGWYIFDYWGQGTLVTVSS |
| | | | SEQ ID NO: 26690 | SEQ ID NO: 30696 |

FIGURE 50
(Continued)

| | | | | |
|---|---|---|---|---|
| iPS:435917 | 21-225_190D5 | NA | GAAATTGTGCTGACTCAGTCTCCAGACTTTCA GTCTGTGGCTCCAAAGGAGAAAGTCACCATCA CCTGCCGGGCCAGTCAGAGTATTGTAGTAAC CTTACACTGGTACCAGCAGAAACCTGATCAGTC TCCAAAGCTCCTCATCAAGTCTGCTTCCAGTC CTCTCAGGGGTCCCCTGAGGTTCAGTGGCA GTGGATCTGGGACAGATTTCACCCTCACCATC AATAGCCTGGAAACTGAAGATGCTGCAACGTA TTACTGTCAGCAGAGTAGTAGTTTACGTGGA CGTTCGGCCAAGGGACCAAGGTGGAAATCAA A | CAGGTGCAGCTGCAGGAGTCGGGCCCAGGACTG GTGAAGCCTTCGGAGACCCTGTCCCTCACCTGCA CTGTCTCTGGTGGCTCCATCAATAATTACTACTG GAGCTGGATCCGGCAGCCCGCCGGGAAGGACT GGAGTGGATTGGGCGTATCTATGCCAGTGGAGC ACCAACTACAACCCCTCCCTCAAGAGTCGAGTCA CCATGTCAATAGACACGTCCAAGAACCAGTTCTC CCTGAAGCTGAGCTCTGTGACCGCCGCGGACACG GCCGTGTATTACTGTGCGAGAGATCGGGGATACT ATGGCTACTACGGTATGGACGTCTGGGGCCAAG GGACCACGGTCACCATCTCCTCA |
| | | | SEQ ID NO: 26691 | SEQ ID NO: 30697 |
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK | QVQLQESGPGLVKPSETLSLTCTVSGGSINNYYWS WIRQPAGKGLEWIGRIYASGSTNYNPSLKSRVTMSI DTSKNQFSLKLSSVTAADTAVYYCARDRGYYGYY GMDVWGQGTTVTISS |
| | | | SEQ ID NO: 26692 | SEQ ID NO: 30698 |
| iPS:435919 | 21-225_190H5 | NA | GACATCCAGATGACCCAGTCTCCATCCTCCCT GTCTGCATCTGTAGGAGACAGAGTCACCATCA CTTGCCGGGCAAGTCAGAGTCATTAGAAAGAT TTAGGCTGGTATCAGCAGAAACCAGGGAAAG CCCCTAAGCGCCTGATCTACTGCATCCAGT TTGCAAAGTGGGGTCCCATTAAGGTTCAGCGG CAGTGGATCTGGGACAGATTCACTCTCACAA TCAGCAGCCTGCAGCCTGAAGATTTTGCAACT TATTACTGTCTGTCTACAGCATATAATTACCCGTG GACGTTCGGCCAAGGGACCAAGGTGGAAATC AAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGCT GGAGTGGGTGGCAGTTATATCATGATGAGGT TATAAAACTATGCAGACTCCGTGAAGGGCCGA TTCACCATCTCCAGAGACAACGTTCCAAGAACACGC TGTATCTGCAAATGAATAGCCTGAGAGCTGAGGA CACGGCTGTGTATTACTGTGCGAGAGGTACCAC GGGTACTACTACGGTGTGGACGTCTGGGGCCAA GGGACCACGGTCACCGTCTCCTCA |
| | | | SEQ ID NO: 26693 | SEQ ID NO: 30699 |

FIGURE 50
(Continued)

| | | AA | DIQMTQSPSSLSASVGDRVTITCRASQGIRKDLG WYQQKPGKAPKRLIHTASSLQSGVPLRFSGSGS GTEFTLTISSLQPEDFATYYCLQHNNYPWTFGQG TKVEIK | QVQLVESGGGVVQPGRSLRLSCAASGFTFSSYGMH WVRQAPGKGLEWVAVISYDGGYKNYADSVKGRF TISRDNSKNTLYLQMNSLRAEDTAVYYCARGTHG YYYGVDVWGQGTTVTSS |
|---|---|---|---|---|
| | | | SEQ ID NO: 26694 | SEQ ID NO: 30700 |
| iPS:435921 | 21-225_190D6 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCTGAAACCAGGAAAGC CCCTAAGCGCCTGATTTATGCTGCATCCAGTT GCAAAGTGGGGTCCCATCAAGGTTCAGCGGCA GTGGATCTGGGCCAGCCTGAAGATTTTGCAACTTA TTACTGTCTACAGCATTATAGTTTCCCATTCAC TTTCGGCCCTGGGACCAAAGTGGATATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTATCAT GCACTGGGTCCGCCAGGCTCCAGGCAGGGGCT GGAGTGGGTGGCAGTTATATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGAGTA TAGCAGTGGCTGGTTCGGGTACGGTATGGACGTC TGGGGCCAAGGGACCACGGTCACCGTCTCCTCA |
| | | | SEQ ID NO: 26695 | SEQ ID NO: 30701 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK | QVQLVESGGGVVQPGRSLRLSCAASGFTFSSFIMH WVRQAPGRGLEWVAVIWYDGSNKYADSVKGRF TISRDNSKNTLYLQMNSLRAEDTAVYYCAREEYSS GWFGYGMDVWGQGTTVTSS |
| | | | SEQ ID NO: 26696 | SEQ ID NO: 30702 |

FIGURE 50
(Continued)

| | | | |
|---|---|---|---|
| iPS:435923 | 21-225_190H6 | NA | CAGGTGCAACTGGTGGAGTCTGGGGGAGGCTTG<br>GTCAAGCCTGGAGGGTCCCTGAGACTCTCCTGT<br>GCAGCCTCTGGATTCACCTTCAGTGACTACTACAT<br>GAGCTGGATCCGCCAGGCTCCAGGGAAGGGCT<br>GGAGTGGCTTTCATACATTAGTAGTAGTGGTACT<br>ACCGTATTCTACGCAGACTCTGTGAAGGGCCGAT<br>TCACCATCTCCAGGGACAACGCCAAGAACTCACT<br>GTATCTGCAAATGAACAGCCTGAGAGCCGAGGA<br>CACGGCCGTGTATTACTGTGCGAGAGAATGGGTG<br>GGAGCCGACTACTGGGGCCAGGGAACCCTGGTC<br>ACCGTCTCCTCA<br><br>SEQ ID NO: 30703 |
| | | AA | DIVMTQSPDSLAVSLGERATINCKSSQSVLFNSN<br>NKNYLAWYQQKPGQPPNLLIYWASTRESGVPD<br>RFSGSGCGTDFTLTISSLQAEDVAVYYCQQYCSL<br>PFTFGPGTKVDIR<br><br>SEQ ID NO: 26698 | QVQLVESGGGLVKPGGSLRLSCAASGFTFSDYYMS<br>WIRQAPGKGLEWLSYISSSGTTVFYADSVKGRFTIS<br>RDNAKNSLYLQMNSLRAEDTAVYYCAREWVGAD<br>YWGQGTLVTVSS<br><br>SEQ ID NO: 30704 |
| iPS:435925 | 21-225_190D7 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTTATTCAACAA<br>TCCAACAATTACAACTATTTAGTTTGGTATCA<br>GCAGAAACCAGGACAGCCTCCTAAGCTGCTCA<br>TTTACTGGGCATCTACCCGGGAAATCCGGGGTC<br>CCTGACCGATTCAGTGGCAGCGGGTCTGGGAC<br>AGATTTTACTCTCACCATCAGCAGCCTGCAGG<br>CTGATGACGTGGCAGTTTATTACTGTCAACAA<br>TATTATCGTACTCCGTGACGTTCGGCCAAGG<br>GACCAAGGTGGAGATCAAA<br><br>SEQ ID NO: 26699 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGAACAGAAGTTCCAGGCAG<br>TAATACAGGCTATGCACAGAAGTTCCAGGCAG<br>AGTCACCATGACCAGGAATACCTCCATAAGCAC<br>AGCCTACATGGAGCTGAGCAGCCTGAGATCTGA<br>GGACACGGCCGTGTATTACTGTGCGAGTAGCAGT<br>GGCTGGTACTTCTTTGACTACTGGGGCCAGGGAA<br>CCCTGGTCACCGTCTCCTCA<br><br>SEQ ID NO: 30705 |

FIGURE 50
(Continued)

| | | | |
|---|---|---|---|
| iPS:435927 | 21-225_190E7 | AA | DIVMTQSPDSLAVSLGERATINCKSSQSVLSSSN NYNYLVWYQQKPGQPPKLLIYWASTRKSGVPD RFSGSGSGTDFTLTISSLQADDVAVYYCQQYYR TPWTFGQGTKVEIK<br>SEQ ID NO: 26700 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCASSSGW YFFDYWGQGTLVTVSS<br>SEQ ID NO: 30706 |
| | | NA | GATATTGTGTTGACCCAGACTCCACTCTCTCTG TCCGTCACCCCTGGACAGCCGGCCTCCATCTC CTGCAAGTCTAGTCAGAGCCTCCTCCATAGTG ATGGAAGGACCTATTTGTATTGGTACCTGCAG AAACCAGGCCAGCCTCCAACGGTTCTCTGATCTG TGAGGTTTCCAACCGGTTCTCTGGAGTGCCAG ATAGGTTCAGTGCAGGGGTCAGGGACAGA TTTCACACTGAAAATCAGCCGGGTGGAGGCTG GAGATGTTGGGGTTTATTACTGCATGCAAAGT ATACAGCTTCCCTGGACGTTCGGCCAAGGGAC CAAGGTGGAAATCAAA<br>SEQ ID NO: 26701 | CAGCTGCAGCTGCAGGAGTCGGGCCAGGACTG GTGAAGCCTTCGGAGACCCTGTCCCTCACCTGCA CTGTCTCTGGTGGCTCCATCAGAAGTTACCACTG GAGTTGGATCCGGCAGCCGCCGGGAAGGGACT GGAGTGGATTGGGCATATATACCAGTAGGAGC ACCAACTACAACCCCTCCCTCAAGAGTCGAGTCA CCATTTCAGTAGACACGTCCAAGAACCAGTTCTC CCTGAAGCTGAGCTCTGTGACCGCCACGGACACG GCCGTGTATTACTGTGCGAGACTCCGGTATAACT GGAACTTCCCTACTTTGACTACTGGGGCCAGGG AACCCTGGTCACCGTCCTCTCA<br>SEQ ID NO: 30707 |
| | | AA | DIVLTQTPLSLSVTPGQPASISCKSSQSLLHSDGR TYLYWYLQKPGQPPQVLICEVSNRFSGVPDRFS GSGSGTDFTLKISRVEAGDVGVYYCMQSIQLPW TFGQGTKVEIK<br>SEQ ID NO: 26702 | QLQLQESGPGLVKPSETLSLTCTVSGGSIRSYHWSW IRQPAGKGLEWIGHIYTSRSTNYNPSLKSRVTISVDT SKNQFSLKLSSVTATDTAVYYCARLRYNWNFPYFD YWGQGTLVTVSS<br>SEQ ID NO: 30708 |

FIGURE 50
(Continued)

| | | | |
|---|---|---|---|
| iPS:435929 | 21-225_190D9 | NA | GAAATTGTGCTGACTCAGTTTCCAGACTCTCAGTCTGTGACTCCAAAGGAGAAAGTCACCATCACCTGCCGGGCCAGTCAGAGCAGAAACCAGATCAGTCTTACACTGGTACCAGCAGAAACCAGATCAGTCTCCAAAGCTCCTCATCAAGTATGCTTCCCAGTCCTTCTCAGGGGTCCCCTGAGGTTCAGTGGCAGTGGATCGGGACAGATTTCACCCTCACCATCAATAGCCTGGAAGCTGAAGATGCTGCAACATATTACTGTGTCATCAGAGTAGTAGTTTCCCTCGGACGTTCGGCCAAGGGACCAAGGTGGAAATCAAA |
| | | | SEQ ID NO: 26703 |
| | | AA | EIVLTQFPDSQSVTPKEKVTITCRASQSQSIGSSLHWYQQKPDQSPKLLIKYASQSFSGVPSRFSGSGSGTDFTLTINSLEAEDAATYYCHQSSSFPRTFGQGTKVEIK |
| | | | SEQ ID NO: 26704 |
| | | NA | GAGGTGCAGCTGTTGGACTCTGGGGGAGGCTTGGGACAGCCTGGGGGGTCCCTGAGACTCTCCTGTGCAGCCTCTGGATTCACCTTTGACAGCTATGCCATGAGTTGGGTCCGCCAGGCTCCAGGGAAGGGGCTGGAGTGGGTCTCAACTATTAGTGGTACTGGTCGTAGGACATACTACGCAGACTCCGTGAAGGGCCGGTTCACCATCTCCAGAGACAATTCCAAGAACACGCTGTATCTGCAAATGAATAGCCTGAGAGCCGAGGACACGGCCGTATATTACTGTGCGAAAGAGGAGGATTACTATGATAGTAGTGGCCGGGGTTGACCCCTGGGGCCAGGGAACCCTGGTCACCGTCTCCTCA |
| | | | SEQ ID NO: 30709 |
| iPS:435933 | 21-225_190F8 | AA | EVQLLDSGGGLGQPGGSLRLSCAASGFTFDSYAMSWVRQAPGKGLEWVSTISGTGRRTYYADSVKGRFTISRDNSKNTLYLQMNSLRAEDTAVYYCAKEEDYYDSSGPGFDPWGQGTLVTVSS |
| | | | SEQ ID NO: 30710 |
| | | NA | CAGGTGCAGCTGGTGGAGTCTGGGGGAGGCGTGGTCCAGCCTGGGAGGTCCCTGAGACTCTCCTGTGCAGCGTCTGGATTCACCTTCAGTACTTATGGCATGCACTGGGTCCGCCAGGCTCCAGGCAAGGGGCTGGAGTGGGTGGCAGTTATATGTGATGAAGTAATAAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGGCGTGGGCTACGACGGTTTGGACGTCTGGGGCCAAGGGACCACGGTCACCGTCTCCTCA |
| | | | SEQ ID NO: 30711 |
| | | NA | GACATCCAGATGACCCAGTCTCCTTCCACTGTCTGCATCTGTAGGAGACAGAGTCACCATCACTTGTCGGACGAGTCAGGCATTGGCAATTATTTAGCCTGGTTTCAGCAGAAACCAGGGAAAGCCCCTAAGTCCCTGATCTATACTGCATCCAGTTTACAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATATGACTTACCACTCACTTTCGGCGGAGGGACCAAGGTGGAGATCAAA |
| | | | SEQ ID NO: 26705 |

FIGURE 50
(Continued)

| | | | |
|---|---|---|---|
| iPS:435935 | 21-225_190H8 | AA | DIQMTQSPSSLSASVGDRVTITCRTSQGIGNYLAWFQQKPGKAPKSLLYKASSLQSGVPSKFSGSGSGTDFTLTISSLQPEDFATYYCQQYMTYPLTFGGGTKVEIK | QVQLVESGGGVVQPGRSLRLSCAASGFTFSTYGMHWVRQAPGKGLEWVAVIWYDGSNKNYADSVKGRFTISRDNSKNTLYLQMNSLRAEDTAVYYCARDQGVGYDGLDVWGQGTTVTVSS |
| | | | SEQ ID NO: 26706 | SEQ ID NO: 30712 |
| | | NA | GAAATTGTGCTGACTCAGTTTCCAGACTCTCAGTCTGTGACTCCAAAGGAGAAAGTCACCATCACCTGCCGGGCCAGTCAGAGTCAGAGATTAGTGGATCCTTACACTGGTACCAGCAGAAACCAGATCAGTCCTCCAAAGCTCCTCATCAAGTATGCTTCCCAGTCCTTCTCAGGGGTCCCCTCGAGGTTCAGTGGCAGTGGATCTGGGACAGATTTCACCCTCACCATCAATAGCCTGGAAGCTGAAGATGCTGCAAGTTATTACTGTCATCAGAGTAGTAGTTTCCCTCGGACGTTCGGCCAAGGGACCAAGGTGGAAATCAAA | GGGGTACAACTGTTGGACTCTGGGGGAGGCTTGGGACAGCCTGGGGGGTCCCTGAGACTCTCCTGTGCAGCCTCTGGATTCACCTTTGACAGCTATGCCATGAGCTGGGTCCGCCAGGCTCCAGGGAAGGGGCTGGAGTGGGTCTCAACTATTACGCGAGACTCCGTGAAGGGCCGGTTCACCATCTCCAGAGACAATTCCAAGAACACACTGTATCTGCAGATGAATAGCCTGAGAGCCGAGGACACGGCCGTATATTACTGTGCGAAAGAGGATTACTATGATAGTAGTGCCCGGGGGTTGACCCCTGGGGCCAGGGAACCCTGGTCACCGTCTCCTCA |
| | | | SEQ ID NO: 26707 | SEQ ID NO: 30713 |
| | | AA | EIVLTQFPDSQSVTPKEKVTITCRASQSIGSSLHWYQQKPDQSPKLLIKYASQSFSGVPSRFSGSGSGTDFTLTINSLEAEDAATYYCHQSSSFPRTFGQGTKVEIK | GVQLLDSGGGLGQPGGSLRLSCAASGFTFDSYAMSWVRQAPGKGLEWVSTISGTGRRTYADSVKGRFTISRDNSKNTLYLQMNSLRAEDTAVYYCAKEEDYYDSSGPGFDPWGQGTLVTVSS |
| | | | SEQ ID NO: 26708 | SEQ ID NO: 30714 |

FIGURE 50
(Continued)

| | | | |
|---|---|---|---|
| iPS:435937 | 21-225_190H9 | NA | GACATCCAGATGACCCAGTCTCCATCCTCACT GTCTGCATCTGTGGGAGACAGAGTCACCATCA CTTGTCGGGCGAGTCAGGCATTGGCAAGTAT TTAGCCTGGTTTCAGCAGAAACCAGGGAAAGC CCTTAAGTCACTGATCTATGCTGCATCCAGTTT GCAAAGTGGGGTCCCATCAAAATTCACGGCA GTGGATCTGGGACAGATTTCACTCTCACCATC AGCAGCCTGCAGCCTGACGATTTTGCAACTTA TTACTGCCAACGATATGATACTTACCCATTCA CTTTCGGCCCTGGGACCAAAGTGGATATCAAA <br> SEQ ID NO: 26709 <br> DIQMTQSPSSLSASVGDRVTITCRASQGIGKYLA WFQQKPGKALKSLIYAASSLQSGVPSKFSGSGSG TDFTLTISSLQPDDFATYYCQRYDTYPFTFGPGT KVDIK <br> SEQ ID NO: 26710 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGCT GGAGTGGGTGGCAGTTATATGGTTTGATGAAGT AATGACTACTATGCAGAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA <br> SEQ ID NO: 30715 <br> QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS <br> SEQ ID NO: 30716 |
| iPS:435939 | 21-225_191H7 | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCGAC TTCTTAGCCTGGTACCAGCAGCAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTTCTGTCAGCAGTATGGTAGCTCACCGT GGACGTTCGGCCAAGGGACCAAGGTGGAAAT CAAT <br> SEQ ID NO: 26711 | CAGGTGCAACTGCAGGAGTCGGGCCCAGGACTG GTGAAGCCTTCACAGACCCTGTCCCTCACCTGCA CTGTCTCTGGTGGCTCCATCAACAGTGGTGATTA CTACTGGAACTGGATCCGCCAGCACCCAGGGAA GGGCCTGGAGTGGATTGGGTACATCTTTACAGT GAGCAGCACTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGATT ACGATGGTTCGGGGAGTTATCACTACTATTACGG TATGGACGTCTGGGGCCAAGGGACCACGGTCAC CGTCTCCTCA <br> SEQ ID NO: 30717 |

FIGURE 50
(Continued)

| | | | |
|---|---|---|---|
| iPS:435941 | 21-225_191E8 | AA | EIVLTQSPGTLSLSPGESATLSCRAGQSIRTDFLA WYQQKPGQAPRLLIYGPSSRATGIPDRFSGSGSG TDFTLTINRLEPEDFAVYFCQQYGSSPWTFGQGT KVEIN<br>SEQ ID NO: 26712 | QVQLQESGPGLVKPSQTLSLTCTVSGGSINSGDYY WNWIRQHPGKGLEWIGYIFYSGSTYYNPSLKSRVTI SVDTSKNQFSLKLSSVTAADTAVYYCARGDYDGS GSYHYYGMDVWGQGTTVTVSS<br>SEQ ID NO: 30718 |
| | | NA | GAAATAGTGATGACGCAGTCTCCAGCCACCCT GTCTGTGTCTCCAGGGGAAAGAGCCACCCTCT CCTGCAGGCCCAGTCAGAGTTTTAGCAGAAAC TTAGCCTGGTACCAGCAGAAACCTGGCCAGGC TCCCAGGCTCCTCATCTATGGTGCATCCACTA GGGCCACTGGTATCCCATCCAGGTTCAGTGGC AGTGGGTCTGGGACAGAGTTCACTCTCACCAT CAGCAGCCTGGAGCCTGAAGATTTTGCAGTTT ACTACTGTCAGCAGTATAATAACTGGCCGCTC ACTTTCGGCGGAGGGATCAAGGTGGAGATCA AA<br>SEQ ID NO: 26713 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAATTATATGCCATCCGTGATGAAGT AATCAATACTATGCCGACTCCGTGAAGGGCCGAT TCACCATCTCCAGAGACAATTCCAAGAACACGCT GTATCTGCAATTGAACAGCCTGAGAGCCGAGGA CACGGCTGTCTATTACTGTGCGAGAGCCCACGGG GTCTACTACGCTATGGACGTCTGGGGCCAAG GGACCACGGTCACCGTCTCCTCA<br>SEQ ID NO: 30719 |
| | | AA | EIVMTQSPATLSVSPGERATLSCRPSQSFSRNLA WYQQKPGQAPRLLIYGASTRATGIPSRFSGSGSG TEFTLTISSLESEDFAVYYCQQYNNWPLTFGGGI KVEIK<br>SEQ ID NO: 26714 | QVQLVESGGGVVQPGRSLRLSCAASGFTFSNYGM HWVRQAPGKGLEWVAIIWFDGSNQYYADSVKGRF TISRDNSKNTLYLQLNSLRAEDTAVYYCARAHGVY YYAMDVWGQGTTVTVSS<br>SEQ ID NO: 30720 |

FIGURE 50
(Continued)

| | | | |
|---|---|---|---|
| iPS:435943 | 21-225_191C9 | NA | GAAATTGTGCTGACTCAGTCTCCAGACTTTCAGTCTGTGACTCCAAAGGAGAAAGTCACCATCACCTGCCGGGCCAGTCAGAGTATTGGTAGTAGTTTACACTGGTACCAGCAGAAACCAGATCAGTCTCCAAAGCTCCTCATCAAGTATGCTTCCCAGTCCCTTCTCAGGGGACCCCTCGAGGTTCAGTGGCAGTGGATCTGGGACAGATTTCACTCTCACCATCAATAGCCTGGAAGCTGAAGATGCTGCAAACGTATTACTGTCATCAGACTAGAAGTTTACCTCTCACTTTCGGCGGAGGGACCAAGGTGGAGATCAA |
| | | | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGGTTACTACTGGAACTGGATCCGCCAGCACCCAGGGAAGGGCCTGGATTGGATTGGGTATATCTATTACAGTGGGAGCACCTACTACAACCCGTCCCTCAAGAGTCGAGTTACCATATCAGTAGACACGTCTAAGAACCAGTTCTCCCTGAAGCTGAACTCTGTGACTGCCGCGGACACGGCCGTGTATTACTGTGCGAGATCCGGTATAATTGGGACGCCGGGGTCGACCCTGGGGCCAGGGAACCCTGGTCACCGTCCTCA SEQ ID NO: 26715 |
| | | AA | EIVLTQSPDFQSVTPKEKVTITCRASQSIGSSLHWYQQKPDQSPKLLIKYASQSFSGDPSRFSGSGSGTDFTLTINSLEAEDAATYYCHQTRSLPLTFGGGTKVEIK SEQ ID NO: 26716 |
| | | | QVQLQESGPGLVKPSQTLSLTCTVSGGSISSGGYYWNWIRQHPGKGLDWIGYIYYSGSTYYNPSLKSRVTISVDTSKNQFSLKLNSVTAADTAVYYCARSGYNWDAGVDPWGQGTLVTVSS SEQ ID NO: 30721 |
| iPS:435945 | 21-225_191A10 | NA | GACATCCAGATGACCCAGTCTCCATCCTCACTGTCTGCATCTGTAGGAGACAGAGTCACCATCACTTGTCGGGCGAGTCAGGGCATTGGCAAGTATTTAGCCTGGTTTCAGCAGAAACCAGGGAAAGCCCCTAAGTCCCTGATCTATGCTGCATCCAGTTTGCAAAGTGGGGTCCCATCAAAGTTCAGCGGCAGTGGATATGGGACAGATTTCACTCTCACCATCAGCAGCCTGCAGCCTGAAGATTTTGCAACTTATTACTGCCAACAGTAGTTAGTACTTACCCGCTCACTTTCGGCGGAGGGACCAAGGTGGAGATCAAA SEQ ID NO: 26717 |
| | | | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCACTGGGTCCGCCAGGCTCCAGGCAAGGGGCTGGAGTGGGTGGCAGTTATATGGTATGATGGAAGTAATAAAAACTACGCAGACTCCGTGAAGGGCCGATTCACCATCTCCAGAGACAATTCCAAGAACACGCTGTATCTGCAAATGAACAGCCTGAGAGCCGAGGACACGGCTATGTATTACTGTGCGAGAGATCAGGCGTGGGCTACGACGGTTTGGACGTCTGGGGCCAAGGGACCACGGTCACCGTCTCCTCA SEQ ID NO: 30723 |

FIGURE 50
(Continued)

| | | | |
|---|---|---|---|
| iPS:435947 | 21-225_191E10 | AA | DIQMTQSPSSLSASVGDRVTITCRASQGIGKYLAWFQQKPGKAPKSLIYAASSLQSGVPSKFSGSGYGTDFTLTISSLQPENFAIYYCQQYSTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAMYYCARDQGVGYDGLDVWGQGTSVTVSS |
| | | | SEQ ID NO: 26718 | SEQ ID NO: 30724 |
| | | NA | GACATCCAGATGACCCAGTCTCCATCCTCACTGTCTGCATCTGTAGGAGACAGAGTCACCATCACTTGTCGGGCGAGTCAGGGCATTGGCAAGTATCTTAGCCTGGTTTCAGCAGAAACCAGGGAAAGCCCCTAAGTCCCTGATCTATGCTGCATCCAGTTTGCAAAGTGGGGTCCCATCAAGTTCAGCGGCAGTGGATCTGGGACAGATTTCACTCTCACCATCAGCAGCCTGCAGCCTGAAAATTTTGCAACTTATTACTGCCAACAGTATAGTACTTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTACGCAGACTCCGTGAAGGGCCGATTCACCATCTCCAGAGACAATTCCAAGAACACGCTGTATCTGCAAATGAACAGCCTGAGAGCCGAGGACACGGCTATGTATTACTGTGCGAGAGATCAGGGCGTGGGCTACGACGGTTTGGACGTCTGGGGCCAAGGGACCTCGGTCACCGTCTCCTCA |
| | | | SEQ ID NO: 26719 | SEQ ID NO: 30725 |
| | | AA | DIQMTQSPSSLSASVGDRVTITCRASQGIGKYLAWFQQKPGKAPKSLIYAASSLQSGVPSKFSGSGSGTDFTLTISSLQPENFATYYCQQYSTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAMYYCARDQGVGYDGLDVWGQGTSVTVSS |
| | | | SEQ ID NO: 26720 | SEQ ID NO: 30726 |

FIGURE 50
(Continued)

| | | | |
|---|---|---|---|
| iPS:435953 | 21-225_191B12 | NA | GACATCGTGATGACCCAGTCTCCAGACTCCCTGGCTGTGTCTCTGGGCGAGAGGGCCACCATCAACTGCAAGTCCAGCCAGAGTGTTTTATTCAACTCCAACAATAAGAACTACTTAGCTTGGTACCAGCAGAAACCAGGTCAGCCTCCTAAACTGCTCATTTACTGGGCCTCTACCCGGGAATCCGGGGTCCCTGACCGATTCAGTGGCAGCGGGTCTGGGACAGATTTCACTCTCACCATCAGCAACCTGCAGGCTGAAGATGTGGCAATTTATTACTGTCAGCAATATTCTAGTCTTCCATTCACTTTCGGCCCTGGGACCAAAGTGGATATCAAA<br><br>SEQ ID NO: 26721 | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTACATGAGCTGGATCCGCCAGGCTCCAGGGAAGGGCTGGAGTGGGTTTCATACATTAGTAGTAGTGGTACTACCGTATTCTACGCAGACTCTGTGAAGGGCCGATTCACCATCTCCAGGGACAACGCCAAGAACTCACTGTATCTGCAAATGAACAGCCTGAGAGCCGAGGACACGGCCGTGTATTACTGTGCGAGAGAATGGGTGGGAGCCGACTACTGGGGCCAGGGAACCCTGGTCACCGTCTCCTCA<br><br>SEQ ID NO: 30727 |
| | | AA | DIVMTQSPDSLAVSLGERATINCKSSQSVLFNSNNKNYLAWYQQKPGQPPKLLIYWASTRESGVPDRFSGSGSGTDFTLTISNLQAEDVAIYYCQQYSSLPFTFGPGTKVDIK<br><br>SEQ ID NO: 26722 | QVQLVESGGGLVKPGGSLRLSCAASGFTFSDYYMSWIRQAPGKGLEWVSYISSSGTTVFYADSVKGRFTISRDNAKNSLYLQMNSLRAEDTAVYYCAREWVGADYWGQGTLVTVSS<br><br>SEQ ID NO: 30728 |
| iPS:435957 | 21-225_191G12 | NA | GACATCCAGATGACCCAGTCTCCTTCCTCACTGTCTGCATCTGTAGGAGACAGAGTCACCATCACTTGTCGGACGAGTCAGGGCATTGGCAATTATTTAGCCTGGTTTCAGCAGAAACCAGGGAAAGCCCCTAAGTCCCTGATCTATAAAGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATATCACTTACCCGCTCACTTTCGGCGGAGGGTCCAAGGTGGAGATCAAA<br><br>SEQ ID NO: 26723 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCACTGGGTCCGCCAGGCTCCAGGCAAGGGGCTGGAGTGGGTGGCAGTTATATATGGTATGATGGAAGTAATAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGCGTGGGCTACGACGGTTTGGACGTCTGGGGCCAAGGGACCACGGTCACCGTCTCCTCA<br><br>SEQ ID NO: 30729 |

FIGURE 50
(Continued)

| | | | |
|---|---|---|---|
| iPS:435961 | 21-225_192A2 | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYITYPLTFGGGS KVEIK<br>SEQ ID NO: 26724 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30730 |
| | | NA | GACATCCAGATGACCCAGTCTCCATCCTCACT GTCTGCATCTGTAGGAGACAGAGTCACCATCA CTTGTCGGGCAATCAGGCATTAACAATTAT TTAGCCTGGTTCAGCAGAAACCAGGGAAAGC CCCTAAGTCCCTGATCTATGCTGCATCCAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAGTATATAACTTACCCATTCA CTTTCGGCCCTGGGACCAAAGTGGATATCAAA<br>SEQ ID NO: 26725 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT TATAAATACTATGCAGACTCCGTGAAGGGCCGAT TCACCATCTCCAGAGACAATTCCAAGAACACGCT GTATCTGCAAATGAACAGCTGAGAGCCGAGGA CACGGCTGTGTATTACTGTGCGAGAGAGGATTCC CCTTATAGTGGCTACGCCTTGGACTACTTCTACG GTATGGACGTCTGGGGCCAAGGGACCACGGTCA CCGTCTCCTCA<br>SEQ ID NO: 30731 |
| | | AA | DIQMTQSPSSLSASVGDRVTITCRANQGINNYLA WFQQKPGKAPKSLIYAASSLQSGVPSKFSGSGSG TDFTLTISSLQPEDFATYYCQQYNSYPFTFGPGT KVDIK<br>SEQ ID NO: 26726 | QVQLVESGGGVVQPGRSLRLSCAASGFTFSSYGMH WVRQAPGKGLEWLAVIWYDGSKYYADSVKGRF TISRDNSKNTLYLQMNSLRAEDTAVYYCAREDSPY SGYALDYFYGMDVWGQGTTVTVSS<br>SEQ ID NO: 30732 |

FIGURE 50
(Continued)

| | | | |
|---|---|---|---|
| iPS:435963 | 21-225_192D2 | NA | GACATCCAGATGATTCAGTCTCCATCTCACT GTCTGCATCTGTAGGAGACAGAGTCACCATCA CTTGTCGGGCGAGTCAGGGCATTAGCAATTAT TTAGCCTGGTTTCAGCAGAAACCAGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACATTATGTTACTTACCCGAACA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGCAGACTCCGTGAAGT AATAAAACTATGCAGACTCCGTGAAGGGCCGA TTCACCATCTCCAGAGACAATTCCAAGAACATGT TGTATCTGCAAATGAACAGCCTGAGAGCCGAGG AAACGGCTGTGTATTACTGTGCGAGAGATCGTGG GGTTGGCTACTACGGTATGACGTCTGGGGCCAA GGGACCACGGTCACCGTCTCCTCA |
| | | | SEQ ID NO: 26727 | SEQ ID NO: 30733 |
| | | AA | DIQMIQSPSPSSLSASVGDRVTITCRASQGISNYLA WFQQKPGKAPKSLIYAASSLQSGVPSKFSGSGSG TDFTLTISSLQPEDFATYYCQHYVTYPNTFGGGT KVEIK | QVQLVESGGGVVQPGRSLRLSCAASGFTFSSYGMH WVRQAPGKGLEWVAVIWYDGSNKNYADSVKGRF TISRDNSKNMLYLQMNSLRAEETAVYYCARDRGV GYYGMDVWGQGTTVTVSS |
| | | | SEQ ID NO: 26728 | SEQ ID NO: 30734 |
| iPS:435965 | 21-225_192H2 | NA | GACATCCAGATGACCCAGTCTCCATCTTCCGT GTCTGCATCTGTAGGAGACAGAGTCACCATCA CTTGTCGGGCGAGTCAGGGTATAAGTAGTTGG ATAGCCTGGTATCAGCAGAAACCAGGGAAAG CCCCTAAGTCCCTGATCTATGTGCATCCAGTT TGCAAAGTGGGGTCCCATCAGGTTCAGCGGC AGTGGATCTGGGACAGATTTCACTCTCACCAT CAGCAGCCTGCAGCCTGAAGATTTGCAACTT ACTATTGTCAACAGTCTAACAGTTTCCATTCA CTTTCGGCCCTGGGACCAAAGTGGATGTCAAA | GAGGTGCAGCTGTTGGAATCTGGGGGAGACTTA ATACAGCCTGGGGGGTCCCTGAGACTCTCCTGTG CAGCCTCTGGATTCACCTTTAGCAGCTCTGCCAT GAGCTGGGTCCGCCAGGCTCCAGGGAAGGGGCT GGAGTGGGTCTCAGCCATTAGTAGTGGTAGTGGT AACACATTCTACGCAGACTCCGTGAAGGGCCGGT TCACCATCTCCAGAGACAATTCCAAGAACACGCT GTATCTGCAAATGAACAGCCTGAGAGCCGAAGA CACGGCCGTTATTACTGTGCGAAACTCTATAGCA GTAGTTGGGTCCCACTACTTTGACTACTGGGGCC AGGGAACCCTGGTCACCGTCTCCTCA |
| | | | SEQ ID NO: 26729 | SEQ ID NO: 30735 |

FIGURE 50
(Continued)

| | | | |
|---|---|---|---|
| iPS:435967 | 21-225_192B3 | AA | DIQMTQSPSSVSASVGDRVTITCRASQGISSWIA WYQQKPGKAPKLLIYGASSLQSGVPSRFSGSGS GTDFTLTISSLQPEDFATYYCQQSNSFPFTFGPGT KVDVK<br>SEQ ID NO: 26730 | EVQLLESGGDLIQPGGSLRLSCAASGFTFSSSAMSW VRQAPGKGLEWVSAISGSGGNTFYADSVKGRFTIS RDNSKNTLYLQMNSLRAEDTAVYYCAKLIAVVGS HYFDYWGQGTLVTVSS<br>SEQ ID NO: 30736 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTCGCAGCAGC TTCCTTGCCTGGTACCAGCAGAAACCTGGCCA GGCTCCCAGGCTCCTCATCTATGGTGCATCTA GCAGGGCCACTGGCATCCCAGACAGGTTCAGT GGCAGTGGGTCTGGGACAGACTTCACTCTCAC CATCAGCAGACTGGAGCCTGAAGATTTTGCTG TGTATTACTGTCAGCAGTATGGTAACTCACCG TGGGCGTTCGGCCAAGGGACCAAGGTGGAAA TCAAA<br>SEQ ID NO: 26731 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAATGGATTGGGTTCATCTTTTACAGT GGGAGCACCTACTACAACCCGTCCCTCAAGAGTC GAGTTACCATATCAGTAGACAGTCTAAGAACCA GTTCTCCCTGAAGCTGAGCTGTATTACTGTGCGAGAGGGATT GACACGGCCGTGTATTACTGTGCGAGAGGGATT ACGATGGTTCGGGGAGTTATCACCACTACTACGG TATGGACGTCTGGGGCCAAGGGACCACGGTCAC CGTCTCCTCA<br>SEQ ID NO: 30737 |
| | | AA | EIVLTQSPGTLSLSPGERATLSCRASQSVRSSFLA WYQQKPGQAPRLLIYGASSRATGIPDRFSGSGSG TDFTLTISRLEPEDFAVYYCQQYGNSPWAFGQG TKVEIK<br>SEQ ID NO: 26732 | QVQLQESGPGLVKPSQTLSLTCTVSGGSISSGDYYW NWIRQHPGKGLEWIGFIFYSGSTYYNPSLKSRVTIS VDTSKNQFSLKLSSVTVADTAVYYCARGDYDGSG SYHHYYGMDVWGQGTTVTVSS<br>SEQ ID NO: 30738 |

FIGURE 50
(Continued)

| | | | |
|---|---|---|---|
| iPS:435971 | 21-225_192D3 | NA | GACATCCAGATGACCCAGTCTCCATCCTCACT GTCTGCATCTGTAGGAGACAGAGTCACCATCA CTTGTCGGGCGAGTCAGGCATTAGCAATTAT TTAGCCTGGTTTCAGCAGAAACCAGGGAAAGC CCCTAAGTCCCGATCTATGCTGCATCCAGTTT GCAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCTACATTATCTTACTTACCCTCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATAGGGG GGTGGGTTACTACGGTTTGGACGTCTGGGGCCAA GGGACCACGGTCACCGTCCCTCA |
| | | | SEQ ID NO: 26733 | SEQ ID NO: 30739 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLHYLTYPLTFGGGT KVEIK | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS |
| | | | SEQ ID NO: 26734 | SEQ ID NO: 30740 |
| iPS:435973 | 21-225_192H3 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAAC TTCTTAGCCTGGTACCAGCAGAAACCTGGCCA GGCTCCCAGGCTCCTCATCTTTGGTGCATCCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAATATGGTATCTCACCGT TGGACGTTCGGCCAAGGGACCAAGGTGGAAAT CAAA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGTTAGTTA CTACTGGAGCTGGATCCGCCAGCCCCCAGGGAA GGGCCTGGAGTGGATTGGGAAACCTCTATTCAGT GGGAGCACCTACTACAACCCGTCCCTCAGGAGTC GAGTTACCATATCAGTAGACACGTCTAAGAACC AGTTCTCCCTGAAGCTGAGTTCTGTGACTGCCGC GGACACGGCCGTGTATTACTGTGTACGAGAGGGA TTACGATGGTTCGGGAGTTATCACTACTACCAC GGTATGGACGTCTGGGGCCAAGGGACCACGGTC ACCGTCTCCTCA |
| | | | SEQ ID NO: 26735 | SEQ ID NO: 30741 |

FIGURE 50
(Continued)

| | | | | |
|---|---|---|---|---|
| iPS:435977 | 21-225_192E4 | AA | EIVLTQSPGTLSLSPGERATLSCRASQSVSSNFLAWYQQKPGQAPRLLIFGASSRATGIPDRFSGSGSGTDFTLTINRLEPEDFAVYYCQQYGISPWTFGQGTKVEIK | QVQLQESGPGLVKPSQTLSLTCTVSGGSISSVSYYWSWIRQRPGKGLEWIGNLYYSGSTYNPSLRSRATISVDTSKNQFSLKLSSVTAADTAVYYCTRGDYDGSGSYHYYHGMDVWGQGTTVTVSS |
| | | | SEQ ID NO: 26736 | SEQ ID NO: 30742 |
| | | NA | GACATCCAGATGACCCAGTCTCCATCCTCACTGTCTGCATCTGTAGGAGACAGAGTCACCATCACTTGTCGGGCGAGTCAGGGCATTGGCAATTATTTAGCCTGGTTTCAGCAGAAACCAGGGAAAGCCCCTAAGTCCCTGATCTATGTTGTATCCAGTTTACAAAGTGGGGTCCCATCAAGGTTCAGCGGCAGTGGATCTGGGACAGATTTCACTCTCACCATCAGCAGCCTGCAGCCTGAAGATTTTGCGACTTATTACTGCCAACGGTATGATACTTACCATTCACTTTCGGCCCTGGGACCAAAGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCACTGGGTCCGCCAGGCTCCAGGCAAGGGGCTGGAGTGGGTGGCAGTTATATGATCCGTGAGGGCCGAAACAAAACTATGTAGACTCCGTGAGGGCCGATTCACCATCTCCAGAGACAACGCCAAGAACACGCTGTATCTGCAAATGAACAGCCTGAGAGCCGAGGACACGGCTGTGTATTATTGTGCGAGAGATAGAAGCGTCGGCTACGACGGTATGGACGTCTGGGGCCAAGGGACCACGGTCACCGTCTCCTCA |
| | | | SEQ ID NO: 26737 | SEQ ID NO: 30743 |
| | | AA | DIQMTQSPSSLSASVGDRVTITCRASQGIGNYLAWFQQKPGKAPKSLIYVSSLQSGVPSRFSGSGSGTDFTLTISSLQPEDFATYYCQRYDTYPFTFGPGTKVDIK | QVQLVESGGGVVQPGRSLRLSCAASGFTFSSYGMHWVRQAPGKGLEWVAVIWYDGSNKNYVDSVRGRFTISRDNSKNTLYLQMNSLRAEDTAVYYCARDRSVGYDGMDVWGQGTTVTVSS |
| | | | SEQ ID NO: 26738 | SEQ ID NO: 30744 |

FIGURE 50
(Continued)

| | | | |
|---|---|---|---|
| iPS:435979 | 21-225_192H4 | NA | GACATCCAGATGACCCAGTCTCCATCCTCACT GTCTGCATCTGTAGGAGACAGAGTCACCATCA CTTGTGTGGGCGAGTCAGACAGTCAGGACATTAGCAATTAT TTAGCCTGGTTTCAGCAGAAACCAGGGAAAGC CCCTAAGTCCCTGATCTCTGCTGCATCCAGTT GCAAAGTGGGGTCCCATCAAAGTTCAGCGGCA GTAGATCTGGGACAGATTTCACTCTCACCATC AGCAGCCTGCAGCCTGAAGATTTTGCAACTTA TTACGGGCCTACATTATCTCAATTACCGCTCAC TTTCGGCGGAGGGACCAGGGTGGAGATCAGA<br>SEQ ID NO: 26739 | CAGGTGCAGTTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGAAG CAATAAAACTATGCAGACTCCGTGAAGGCCG ATTCACCATCTCCAGAGACAATTCCAAGAACACG CTGTATCTGCAAATGAACAGCCTGAGAGCCGAG GACACGGCTGTGTATTACTGTGCGAGAGATCAAG GTGTGGGGTACTACGGTATGGACGTCTGGGGCCA AGGGACCACGGTCACCGTCTCCTCA<br>SEQ ID NO: 30745 |
| | | AA | DIQMTQSPSSLSASVGDRVTITCRASQDISNYLA WFQQKPGKAPKSLISAASSLQSGVPSKFSGSRSG TDFTLTISSLQPEDFATYYGLHYLNYPLTFGGGT RVEIR<br>SEQ ID NO: 26740 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYYGMDVWGQGTTVTVSS<br>SEQ ID NO: 30746 |
| iPS:435983 | 21-225_192E5 | NA | GAAATTGTTCTGACTCAGTCTCCAGATTTTCAG TCTGTGACTCCAAAGGAGAAAGTCACCATCAC CTGCCGGGCCAGTCAGAGCATTGGTAGGAGTT TACACTGGTACCAGCAGAAACCAGATCAGTCT CCAAAGCTCCTCATCAAGTATGCTTCCCAGTC ATTCTCAGGGGTCCCCTCGAGGTTCAGTGGCA GTGGATCTGGGACAGATTTCACCCTCACCATC AATAGCCTCGAGGCTGAAGATGCTGCAACGTA TTACTGTCATCAGAGTAGTCGTTTACCGCTCAC TTTCGGCGGAGGGACCAAGGTGGAGATCAAA<br>SEQ ID NO: 26741 | CAGGTGCAGCTGCAGGAGTCGGGCCCAGGACTG GTGAAGCCTTCACAGACCCTGTCCCTCACCTGCA CTGTCTCTGGTGACTCATCAATAATGGTGGATA CTACTGGAGCTGGATCCGCCAGCACCCAGGGAA GGGCCTGGAGTGGATTGGATACATCTTTACAGC GGGAGCACCTACTACAACCCGTCCCTCAAGAGTC GAGTTACCATATCAGTTGACAGTCTAAGAATCA GTTCTCCCTGAAACTGAACTCTGTGACTGCCGCG GACACGGCCGCGTGTATTTTGTGCGAGAGCGGGAT ATAACTGGGACAACGGTTTGACTACTGGGGCC AGGGAACCCTGGTCACCGTCTCCTCA<br>SEQ ID NO: 30747 |

FIGURE 50
(Continued)

| | | | |
|---|---|---|---|
| iPS:435985 | 21-225_192F6 | AA | EIVLTQSPDFQSVTPKEKVTITCRASQSIGRSLHW YQQKPDQSPKLLIKYASQSFSGVPSRFSGSGSGT DFTLTINSLEAEDAATYYCHQSSRLPLTFGGGTK VEIK |
| | | | SEQ ID NO: 26742 |
| | | | QVQLQESGPGLVKPSQTLSLTCTVSGDSINNGYY WSWIRQHPGKGLEWIGYIFYSGSTYNPSLKSRVTI SVDTSKNQFSLKLNSVTAADTAVYFCARAGYNWD NGFDYWGQGTLVTVSS |
| | | | SEQ ID NO: 30748 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCTGAAACCAGGAAAGC CCCTAAGCGCCTGATCTATGCTGCATCCAGTT GCAAAGTGGGGTCCCATCAAGGTTCAGCGGCA GTGGATCTGGGCCAGACCTGAAGATTTTGCAACTTA AGCAGCCTGAAGATTTTGCAACTTA TTACTGTCTACACAGCATTATAGTTTCCCATTCAC TTTCGGCCCTGGGACCAAAGTGGATATCAAA |
| | | | SEQ ID NO: 26743 |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTTTATCAT GCACTGGGTCCGCCAGGCTCCAGGCAGGGGGCT GGAGTGGGTGGCAGTTATATGACTCCGTGAAGGCCGAT AATAAATACTATGTAGACTCCGTGAAGGGCCGAT TCACCATCTCCAGAGACAACAATTCCAAGAACACGCT GTATCTGCAAATGAACAGCTGAGAGCCGAGGA CACGGCTGTGTACTACTGTGCGAGAGAGGAGTAT AGTAGCGGCTGGTTCGGGTACGGTATGGACGTCT GGGGCCAAGGGACCACGGTCACCGTCTCCTCA |
| | | | SEQ ID NO: 30749 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK |
| | | | SEQ ID NO: 26744 |
| | | | QVQLVESGGGVVQPGRSLRLSCAASGFTFSSFIMH WVRQAPGRGLEWVAVIWYDGSNKYYVDSVKGRF TISRDNSKNTLYLQMNSLRAEDTAVYYCAREEYSS GWFGYGMDVWGQGTTVTSS |
| | | | SEQ ID NO: 30750 |

FIGURE 50
(Continued)

| | | | |
|---|---|---|---|
| iPS:435987 | 21-225_192G6 | NA | GACATCCAGATGACCCAGTCTCCTTCCTCACTGTCTGCATCTGTAGGAGACAGAGTCACCATCACTTGTCGGACGAGTCAGGCATTAGCAATTATTTAGCCTGGTTTCAGCAGAAACCAGGGAAAGCCCCTAAGTCCCTGCTCTATAAAGCATCCAGTTTGCAAAGTGGGGTCCCATCAAAGTTCAGCGGCAGTGGATCTGGGACAGATTTCACTCTCACCATCAGCAGCCTGCAGCCTGAAGATATTGCAACTTATTACTGCCAACAGTATATGACTTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTTATGGTATGATGAACTAATAAAACTATGCAGAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGGCGTGGGCTACGACGGTTTGGACGTCTGGGGCCAAGGGACCACGGTCACCGTCTCCTCA |
| | | | SEQ ID NO: 26745 | SEQ ID NO: 30751 |
| | | AA | DIKMTQSPSSLSASVGDRVTITCRTSQGIGNYLAWFQQKPGKAPKSLLYKASSLQSGVPSKFSGSGSGTDFTLTISSLQPEDFATYYCQQYMTYPLTFGGGTKVEIK | QVQLVESGGGVVQPGRSLRLSCAASGFTFSSYGMHWVRQAPGKGLEWVAVLWYDGTNKNYADSVKGRFTISRDNSKNTLYLQMNSLRAEDTAVYYCARDQGVGYDGLDVWGQGTTVTVSS |
| | | | SEQ ID NO: 26746 | SEQ ID NO: 30752 |
| iPS:435989 | 21-225_192F7 | NA | GACATCCAGATGACCCAGTCTCCATCCTCCCTGTCTGCGTCTGTAGGAGACAGAGTCACCATCACTTGCCGGGCAAGTCAGGGCATTAGAAATGATTTAGGCTGGTATCAACAGAAACCAGGGAAAGCCCCCTAAGCGCCTAATCTACTGCATCCAGTTTGCAAAGTGGGGTCCCATTAAGGTTCAGCGGCAGTGGATCTGGGACAGACGCCTGAAGATTCACTCACAATCAGCAGCCTGCAGCCTGAAGATTTTGCAACTTATTACTGTCTGTCACAGCATAACTAGTTACCCGTGGACGTTCGGCCAAGGGACCAAGGTGGAAATCAAG | CAGGTGCAGCTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCAGTTATATCAGATGAGGTTATAAAAACTATGCAGAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAGGTACCCACGGGTACTACTACGGTGTGGACGTCTGGGGCCAAGGGACCACGGTCACCGTCCTCA |
| | | | SEQ ID NO: 26747 | SEQ ID NO: 30753 |

FIGURE 50
(Continued)

| | | | |
|---|---|---|---|
| | | AA | DIQMTQSPSSLSASVGDRVTITCRASQGIRKDLG WYQQKPGKAPKRLIHTASSLQSGVPLRFSGSGS GTEFTLTISSLQPEDFATYYCLQHTSYPWTFGQG TKVEIY<br>SEQ ID NO: 26748 | QVQLVESGGGVVQPGRSLRLSCAASGFTFSSYGMH WVRQAPGKGLEWVTVISYDGGYKNYADSVKGRF TISRDNSKNTLYLQMNSLRAEDTAVYYCARGTHG YYYGVDVWGQGTTVTVSS<br>SEQ ID NO: 30754 |
| iPS:435993 | 21-225_192C8 | NA | GACATCCAGATGACCCAGTCTCCATCCTCACT GTCTGCATCTGTAGGAGACAGAGTCACCATCA CTTGTCGGGCAGTCAGGGCATTAGCAATGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGAACAGATTTCACTCTCACCATC AGCAGCCTGCAGCCTGAGGATTTTGCTACTTA TTACTGCCAACATTATCTTACTTACCCTCTCAC TTTCGGCGGAGGGACCAAGGTGGAGATCAAA<br>SEQ ID NO: 26749 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGCAGACTCCGTGAAGGGCCGA TTCATGATCTCCAGAGACAATTCCAAGAACACGC TGTATCTGCAAATGAACAGCCTGAGAGCCGAGG ACACGGCTGTGTATTACTGTGCGAGAGATAGGGG AGTGGGTTACTACGGTATGGACGTCTGGGGCCAA GGGACCACGGTCACCGTCTCCTCA<br>SEQ ID NO: 30755 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK<br>SEQ ID NO: 26750 | QVQLVESGGGVVQPGRSLRLSCAASGFTFSSYGMH WVRQAPGKGLEWVAVIWYDGSNEHYADSVKGRF MISRDNSKNTLYLQMNSLRAEDTAVYYCARDRGV GYYGMDVWGQGTTVTVSS<br>SEQ ID NO: 30756 |

FIGURE 50
(Continued)

| | | | |
|---|---|---|---|
| iPS:435995 | 21-225_192F8 | NA | GAAATTGTGTTGACGCAGTCTCCAGGCACCCT GTCTTTGTCTCCAGGGGAAAGAGCCACCCTCT CCTGCAGGGCCAGTCAGAGTATTAGCAGCAGC TACTTAGCCTGGTACCAGCAGAAACCTGGCCA GGCTCCCCGGCTCCTCATCTATGGTGCATCCA GCAGGGCCACTGGCATCCCAGCCAGGTTCAGT GGCAGTGGGTCTGGGACAGACTTCACTCTCAC CATCAGCAGACTGGAGCCTGAAGATTTTGCAG TGTATTACTGTCAGCAGTATGAGAGTTCACCG TGGACGTTCGGCCAAGGGACCAAGGTGGAAA TCAAA<br><br>SEQ ID NO: 26751 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCCAGGGAAGGGGCT GGAGTGGATTGGGGAAATCAATCAAGTGGAAG GTCCAACTACAACCCGTCCCTCAAGAGTCGAGTC ACCATTTCAGTAGACACGTCCACGAACCAGTTCT CCCTGAAGCTGAGATCTGTGCAGACTACGGTGTC GGCTGTGTATTACTGTGCGAGAGACTACGGTGTC TTTGACTACTGGGGCCAGGGCACCCTGGTCACCG TCTCCTCA<br><br>SEQ ID NO: 30757 |
| | | AA | EIVLTQSPGTLSLSPGERATLSCRASQSISSSYLA WYQQKPGQAPRLLIYGASSRATGIPARFSGSGSG TDFTLTISRLEPEDFAVYYCQQYESSPWTFGQGT KVEIK<br><br>SEQ ID NO: 26752 | QVQLQQWGAGLLKPSETLSLTCAVYGGSFSGCYW SWIRQPPGKGLEWIGEINQSGRSNYNPSLKSRVTIS VDTSTNQFSLKLRSVTAADTAVYYCARDYGVFDY WGQGTLVTVSS<br><br>SEQ ID NO: 30758 |
| iPS:435997 | 21-225_192G8 | NA | GACATCCAGATGACCCAGTCTCCTTCCTCACT GTCTGCATCTGTAGGAGACAGAGTCACCATCA CTTGTCGGAGAGTCAGGGCATTGGCAATTAT TTAGCCTGGTTTCAGCAGAAAACCAGGAAAGC CCCTAAGTCCTGCTCTATAAAGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAGTATATCACTTACCCGCTCA CTTTCGGCGGAGGGACCAAGGTGGAGATCAA A<br><br>SEQ ID NO: 26753 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGCAT GCACTGGGTCGCCAGGCTCCAGGCAAGGGGCT GGAGTGGGTGGCAGTTATATGGTATGATGGAAGT AATAAAAACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCAGGG CGTGGGCTACGACGGTTTGGACGTCTGGGGCCAA GGGACCACGGTCACCGTCTCCTCA<br><br>SEQ ID NO: 30759 |

FIGURE 50
(Continued)

| | | | |
|---|---|---|---|
| iPS:435999 | 21-225_192F9 | AA | DIQMTQSPSSLSASVGDRVTITCRTSQGIGNYLA WFQQKPGKAPKSLLYKASSLQSGVPSKFSGSGS GTDFTLTISSLQPEDFATYYCQQYITYPLTFGGGT KVEIK<br>SEQ ID NO: 26754 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS<br>SEQ ID NO: 30760 |
| | | NA | GATATTGTAATGACCCAGACTCCACTCTCTCT GTCCGTCACCCCTGGACAGCCGGCCTCCATCT CCTGCAAGTCTAGTCAGAGCCTCCTCCATAGT GATGGAAGGACCTATTTGTATTGGTACCTGCA GAGGCCAGGCCAGTCTCCACAGCTCCTGATCT GTGAGGTTTCCAACCGGTTCGCTGGAGTGACA GATAGGTTCAGTGGCAGCGGGTCAGGGACAG ATTTCACACTGAAAATCAGCCGGGTGGAGGCT GGGGATGTTGGGGTTTATTACTGCATGCAAAG TATACAGCTTCCCTGGACGTTCGGCCAAGGGA CCAAGGTGGAAATCAAA<br>SEQ ID NO: 26755 | CAGCTGCAGCTGCAGGAGTCGGGCCCAGGACTG GTGAAGCCTTCGGAGACCCTGTCCCTCACCTGCA CTGTCTCTGGTGGCTCCATCAGAAGTTACCACTG GAGCTGGATCCGGCAGCCCGCGGGAAGGGACT GGAGTGGATTGGGCTTATCTATACCAGTAGGAGC ACCAATTACAACCCCTCCCTCAAGAGTCGAGTCA CCATGTCAGTTGACACGTCCAAGAACCAGTTCTC CCTGAAGCTGAACTCTGTGACCGCCGCGGACACG GCCGTGTATTACTGTGCGAGACTCCGGTATAACT GGAACTTCCCTACTTTGACTACTGGGGCCAGGG AACCCTGGTCACCGTCTCCTCA<br>SEQ ID NO: 30761 |
| | | AA | DIVMTQTPLSLSVTPGQPASISCKSSQSLLHSDGR TYLYWYLQRPGQPPQLLICEVSNRFAGVTDRFS GSGSGTDFTLKISRVEAGDVGVYYCMQSIQLPW TFGQGTKVEIK<br>SEQ ID NO: 26756 | QLQLQESGPGLVKPSETLSLTCTVSGGSIRSYHWSW IRQPAGKGLEWIGLIYTSRSTNYNPSLKSRVTMSVD TSKNQFSLKLNSVTAADTAVYYCARLRYNWNFPY FDYWGQGTLVTVSS<br>SEQ ID NO: 30762 |

FIGURE 50
(Continued)

| | | | |
|---|---|---|---|
| iPS:436001 | 21-225_192C10 | NA | GACATCCAGATGACCCAGTCTCCATCCTCACT GTCTGCATCTGTGGGAGACAGAGTCACCATCA CTTGTGGGGCGAGTCAGGGACATTGGCAAGTAT TTAGCCTGGTTTCAGCAGAAACCAGGAAAGC CCCTAAGTCACTGATCTATGCTGCATCCAGTTT GCAAAGTGGGGTCCCATCAAAGTTCAGCGGCA GTGGGTCTGGGACAGATTCACTCTCACCATC AGCAGCCTGCAGCCTGACGATTTTGCAACTTA TTACTGCCAACGATATGATACTTACCCATTCA CTTTCGGCCCTGGGACCAAAGTGGATTTCAAA SEQ ID NO: 26757 | CAGGTGCAGCTGGTGGAGTCTGGGGGAGGCGTG GTCCAGCCTGGGAGGTCCCTGAGACTCTCCTGTG CATCGTCTCTGATTCACCTTCAGGAACTATGGCAT GCACTGGGTCCGCCAGGTCCAGGCAAGGGCT GAAATGGGTGGCAGTTATATGGTTTGATGGAAGT AATGACTACTATGCAGACTCCGTGAAGGGCCGAT TCACCATCTCCAGAGACAATTCCAAGAACACGCT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCTCCTCA SEQ ID NO: 30763 |
| | | AA | DIQMTQSPSSLSASVGDRVTITCRASQGIGKYLA WFQQKPGKAPKSLIYAASSLQSVPSKFSGSGSG TDFTLTISSLQPDDFATYYCQRYDTYPFTFGPGT KVDFK SEQ ID NO: 26758 | QVQLVESGGGVVQPGRSLRLSCASSGFTFRNYGMH WVRQAPGKGLKWVAVIWFDGSNDYYADSVKGRF TISRDNSKNTLSLQMNSLRAEDTAVYYCARDRSVG YDGLDVWGQGTTVTVSS SEQ ID NO: 30764 |
| iPS:436003 | 21-225_192G10 | NA | GACATCCAGATGACCCAGTCTCCATCTCCCT GTCTGCATCTGTAGGAGACAGAGTCACCATCA CTTGCCGGGCAAGTCAGAGCATTAGCAACTAT TTAAATTGGTATCAGCAGAAACCAGGAAAAGC CCCTAAGCTCCTGATCTATGCTGAATCCAGTTT ACAAAGTGGGGTCCCATCAAGGTTCAGTGGCA GTGGATCTGGGACAGATTTCACTCTCACCATC AGCAGTCTGCAACCTGAAGATTTTGCAACTTA CTCCTGTCAACAGAGTTACAGTTCCCCTCCGT GGACGTTCGGCCAAGGGACCAAGGTGGAAAT CAAA SEQ ID NO: 26759 | GAGGTGCAGCTGTTGGAGTCTGGGGGAGGCTTG GTACAGCCTGGGGGGTCCCTGAGACTCTCCTGTT CAGCCTCTGATTCACCTTTAGCAGTCAGTATGCCAT GAGCTGGGTCCGCCAGGCTCCAGGAAGGGGCT GGAGTGGGTCTCAGCTATTACGAGACTCCGTGAAGGGCCGGT AGTACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTCTATTACTGTGCGCGACGTTTAGCA CTGGATGCTATGATGCTTTGATATCTGGGGCC AAGGGACAATGGTCACCGTCTCTTCA SEQ ID NO: 30765 |

FIGURE 50
(Continued)

| | | | |
|---|---|---|---|
| iPS:436005 | 21-225_192H10 | AA | DIQMTQSPSSLSASVGDRVTITCRASQSISNYLN WYQQTPGKAPKLLIYAESSLQSGVPSRFSGSGSG TDFTLTISSLQPEDFATYSCQQSYSSPPWTFGQGT KVEIK | EVQLLESGGGLVQPGGSLRLSCSASGFTFSSYAMS WVRQAPGKGLEWVSAISGRGGSTFYADSVKGRFTI SRDNSKNTLYLQMNSLRAEDTAVYYCARRLALDG YDAFDIWGQGTMVTVSS |
| | | | SEQ ID NO: 26760 | SEQ ID NO: 30766 |
| | | NA | GACATCCAGATGACCCAGTCTCCATCCTCACT GTCTGCATCTGTAGGAGACAGAGTCACCATCA CTTGTCGGGCGAGTCAGGGCATTGGCAAGTAT TTAGCCTGGTTTCAGCAGAAACCAGGGAAAGC CCCTAAGTCCCTGATCTATGCTGAATCCAGTTT GCAAAGTGGGGTCCCATCAAGTTCAGCGGCA GTGGATATGGGACAGATTTCACTCTCACCATC AGCAGCCTGCAGCCTGAAAATTTTGCAACTTA TTACTGCCAACAGTATAGTACTTACCCGCTCA CTTTCGGCGGAGGGACCAAGGTGGAGATCAA G | CAGGTGCAGCTGTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGGCT GGAGTGGGTGGCAGTTATATGGTATGATGAAGT AATAAAAACTACGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCAGG CGTGGGCTACGACGGTTTGGACGTCTGGGGCCAA GGGACCTCGGTCACCGTCTCCTCA |
| | | | SEQ ID NO: 26761 | SEQ ID NO: 30767 |
| | | AA | DIQMTQSPSSLSASVGDRVTITCRASQGIGKYLA WFQQKPGKAPKSLIYAASSLQSGVPSKFSGSGY GTDFTLTISSLQPENFATYYCQQYSTYPLTFGGG TKVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS |
| | | | SEQ ID NO: 26762 | SEQ ID NO: 30768 |

FIGURE 50
(Continued)

| | | | |
|---|---|---|---|
| iPS:436007 | 21-225_192G12 | NA | GAAATTGTGTTGACGCAGTCTCCAGGCACCCT GTCTTTGTCTCTCCAGGGGAAAGAGCCACCCTCT CCTGCAGGGCCAGTCAGTGTTAGCAGAAGCGA CTTCTTAGCCTGGTCTCCAGCAGAGAAACCTGGCC AGGCTCCCAGGCTCCTCATCTATGGTGTATCC CGCAGGGGCCACTGGCATCCCAGACAGGTTCAG TGGCAGTGGGTCTGGGACAGACTTCACTCTCA CCATCAACAGACTGGAGCCTGAAGATTTTGCA GTGTATTACTGTCAGCAGTATGGTAACTCACC GTGGACGTTCGGCCAAGGGACCAAGGTGGAA ATCAAA<br>SEQ ID NO: 26763 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTTA CCACTGGAGCTGGATCCGCCAGCACCCAGGGAA GGGCCTGGAGTGGATTGGGAACATCCATTACAG CGGGAGCACCTACAACAACCCGTCCCTCAAGAG TCGAGTTACCATATCAGTAGACACGTCTAAGAAC CAGTTCTCCCTGAAGCTGAGCTCTGTGACTGCCG CGGACACGGCCGTGTATTACTGTGCGAGAGGG ATTACGATGGTTCGGGGAGTTATCACTACTA CGTATGACGTCTGGGGCCAAGGGACCACGGT CACCGTCTCCTCA<br>SEQ ID NO: 30769 |
| | | AA | EIVLTQSPGTLSLSPGERATLSCRASQSVRSDFLA WLQQKPGQAPRLLIYGVSRRATGIPDRFSGSGSG TDFTLTINRLEPEDFAVYYCQQYGNSPWTFGQG TKVEIK<br>SEQ ID NO: 26764 | QVQLQESGPGLVKPSQTLSLTCTVSGGSISSGVYHW SWIRQHPGKGLEWIGNIHYSGSTYNNPSLKSRVTIS VDTSKNQFSLKLSSVTAADTAVYYCARGDYDGSG SYHYYGMDVWGQGTTVTVSS<br>SEQ ID NO: 30770 |
| iPS:436009 | 21-225_193A1 | NA | GAAATTGTGTTGACGCAGTCTCCAGGCACCCT GTCTTTGTCTCTCCAGGGGAAAGAGCCACCCTCT CTTGTAGGGCCAGTCAGTGTTAGAAGCAAC TTCTTAGCCTGGCACCAGAGAAACCTGGCCA GGCTCCCAGGCTCTTCATCTATGGTGCATCC GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAACTCACCG TGGACGTTCGGCCAAGGGACCAAGGTGGAAA TCAAA<br>SEQ ID NO: 26765 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTTA CTACTGGAGCTGGATCCGCCAGCACCCAGGGAA GGGCCTGGAGTGGATTGGGAACATCTATTACAGT GGGAGCACCTACAACAACCCGTCCCTCAAGAGT CGAGTTACCATATCAGCAGACACGTCTAAGAACC AGTTCTCCCTGAAGCTGAGCTCTGTGACTGCCGC GGACACGGCCGTGTATTACTGTGCGAGAGGGA TTACGATGGTTCGGGGAGTTATCACTACTAC GGTATGGACGTCTGGGGCCAAGGGACCACGGTC ACCGTCTCCTCA<br>SEQ ID NO: 30771 |

FIGURE 50
(Continued)

| | | | |
|---|---|---|---|
| iPS:436011 | 21-225_193B1 | AA | EIVLTQSPGTLSLSPGERATLSCRASQSVRSNFLAWHQQKPGQAPRLFIYGASRRATGIPDRFSGSGSGTDFTLTINRLEPEDFAVYYCQQYGNSPWTFGQGTKVEIK | QVQLQESGPGLVKPSQTLSLTCTVSGGSISSGVYYWSWIRQHPGKGLEWIGNIYSGSTYNNPSLKSRLTISADTSKNQFSLKLSSVTAADTAVYYCARGDYDGSGSYHYYGMDVWGQGTTVTVSS |
| | | | SEQ ID NO: 26766 | SEQ ID NO: 30772 |
| | | NA | GAAATTGTGTTGACGCAGTCTCCAGGCACCCTGTCTTTGTCTCCAGGGGACAGAGCCACCCTCTCTTGCAGGGCCAGTCAGAGTCAGAAGCAACTTCTTAGCCTGGCACCAGCAGAAACCTGGCCAGGCTCCCAGGCTCCTCATCTATGGTGCATCCAGGAGGGCCACTGGCATCCCAGACAGGTTCAGTGGCAGTGGGTCTGGGACAGACTTCACTCTCACCATCAACAGACTGGAACTGAAGATTTTGCAGTGTATTTCTGTCAGCAGTATGGTAACTCACCGTGGACGTTCGGCCAAGGGACCAAGGTGGAAATCAAA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGTTTACTACTGGAGCTGGATCCGCCAGCACCCAGGGAAGGGCCTGGAGTGGATTGGGAACATCTATTACAGTGGGAGCACCTACAACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGGGATTACGATGGTTCGGGGAGTTATCACTACTACGGTATGGACGTCTGGGGCCAAGGGACCACGGTCACCGTCTCCTCA |
| | | | SEQ ID NO: 26767 | SEQ ID NO: 30773 |
| | | AA | EIVLTQSPGTLSLSPGDRATLSCRASQSVRSNFLAWHQQKPGQAPRLLIYGASRRATGIPDRFSGSGSGTDFTLTINRLEPEDFAVYFCQQYGNSPWTFGQGTKVEIK | QVQLQESGPGLVKPSQTLSLTCTVSGGSISSGVYYWSWIRQHPGKGLEWIGNIYSGSTYNNPSLKSRVTISVDTSKNQFSLKLSSVTAADTAVYYCARGDYDGSGSYHYYGMDVWGQGTTVTVSS |
| | | | SEQ ID NO: 26768 | SEQ ID NO: 30774 |

FIGURE 50
(Continued)

| | | | | |
|---|---|---|---|---|
| iPS:436013 | 21-225_193F2 | NA | GACATCCAGATGACCCAGTCTCCATCTTCCGT GTCTGCATCTGTAGGAGACAGAGTCACCATCA CTTGTCGGGCGAGTCAGGGTATTAACAACTGG TTAGCCTGGTATCAGCAGAAACCAGGGAAAG CCCCTAAGCTCCTGATCTATGGTGTTTCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAACTT ACTCTTGTCAACAGGCTAACAGTTTCCCGTGG ACGTTCGGCCAAGGGACCAAGGTGAAATCA GA | GAGGTGCAGCTGTTGGAGTCTGGGGGAGGCTTG GTACAGCCTGGGGGGTCCCTGAGACTCTCCTGT CAGCCTCTGATTCACCTTTAGCACCTTTGCCAT GAGTTGGGTCCGCCAGGCTCCAGGGAAGGGCT GGAGTGGGTCTCAGTTATTAGTCGTAGTGGTGGT AACACACACTACGCAGACTCCGTGAAGGGCCGG TTCACCATCTCCAGAGACAATTCCAAGAATACGC TGTATCTGCAAATGAACAGCCTGAGAGCCGAGG ACACGGCCGTATATTCCTGTGCGAAAGATGGATT CGGTGGGAGCTCCTACTTTGACTACTGGGGCCAG GGAACCCTGGTCACCGTCTCCTCA |
| | | | SEQ ID NO: 26769 | SEQ ID NO: 30775 |
| | | AA | DIQMTQSPSSVSASVGDRVTITCRASQGINNWLA WYQQKPGKAPKLLIYGVSSLQSGVPSRFSGSGS GTDFTLTISSLQPEDFATYSCQQANSFPWTFGQG TKVEIR | EVQLLESGGGLVQPGGSLRLSCAASGFTFSTFAMS WVRQAPGKGLEWVSAISRSGGNTHYADSVKGRFTI SRDNSKNTLYLQMNSLRAEDTAVYSCAKDGFGGS SYFDYWGQGTLVTVSS |
| | | | SEQ ID NO: 26770 | SEQ ID NO: 30776 |
| iPS:436015 | 21-225_193D3 | NA | GAAATTGTGTTGACGCAGTCTCCAGGCACCCT GTCTTTGTCTCCAGGGGAAAGAGCCACCCTCT CCTGCAGGGCCAGTCAGAGTATTCGCAGCAGC TTCTTAGCCTGGTATCAGCAGAAACCTGGCCA GGCTCCCAGGCTCCTCATCTATGGTGCATCCA ACAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGACGTTCGGCCAAGGGACCAAGGTGGAAA TCAAA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGTCCCAGGGAA GGGCCTGGAGTGGATTGGGTACATCTTTACAGT GGGAGCACTACTACAACCCGTCCCTCAAGAGTC GACTTACCATATCAGTGGACAGGTCTAAGAACCA GTTCTCCCTGAAGCTGAGCTCTGTGACTGCCGCG GACACGGCCGTGTATTACTGTACAAGGGGGGATT ACGATGGTTCGGGGGAGTTATCACTTCTACTACGG TATGGACGTCTGGGGCCAAGGGACCACGGTCAC CGTCTCCTCA |
| | | | SEQ ID NO: 26771 | SEQ ID NO: 30777 |

FIGURE 50
(Continued)

| | | | |
|---|---|---|---|
| iPS:436017 | 21-225_193F3 | AA | EIVLTQSPGTLSLSPGERATLSCRASQSIRSSFLA WYQQKPGQAPRLLIYGASNRATGIPDRFSGSGS GTDFTLTISRLEPEDFAVYYCQQYGNSPWAFGQ GTKVEIK<br>SEQ ID NO: 26772 | QVQLQESGPGLVKPSQTLSLTCTVSGGSISSGDYW NWIRQLPGKGLEWIGYIFYSGSTYYNPSLKSRLTISV DTSKNQFSLKLSSVTAADTAVYYCTRGDYDGSGSY HFYYGMDVWGQGTTVTVSS<br>SEQ ID NO: 30778 |
| | | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCGAC TTCTTAGTCTGGTACCAGCAGCAACCTGGCCA GGCTCCCAGGCTCCTCATCTATGGTGCATCA GCAGGGCCACTGGCTTCCCAGAGAGGTTCAGT GGCAGTGGGTCTGGGACAGACTTCACTCTCAC CATCAACAGACTGGAGCCTGAAGATTTTGCAG TGTATTACTGTCAGCAGTATGGAAGTCACCG TGGACGTTCGGCCAAGGGACCAAGGTGGAAA TCAAT<br>SEQ ID NO: 26773 | CAGGTGCAACTGCAGGAGTCGGGCCCAGGACTG GTGAAGCCTTCACAGACCCTGTCCCTCACCTGCA CTGTCTCTGGTGGCTCCATCAACAGTGGTGATTA CTACTGGAACTGGATCCGCCAGCACCAGGAA GGGCTGGAGTGGATTGGGTACATCTTTTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTATTACGG TATGGACGTCTGGGGCCAAGGGACCACGGTCAC CGTCTCCTCA<br>SEQ ID NO: 30779 |
| | | AA | EIVLTQSPGTLSLSPGESATLSCRAGQSIRTDFLV WYQQQPGQAPRLLIYGASSRATGFPERFSGSGSG TDFTLTINRLEPEDFAVYYCQQYGSSPWTFGQGT KVEIN<br>SEQ ID NO: 26774 | QVQLQESGPGLVKPSQTLSLTCTVSGGSINSGDYY WNWIRQHPGKGLEWIGYIFYSGSTYYNPSLKSRVTI SVDTSKNQFSLKLSSVTAADTAVYYCARGDYDGS GSYHYYYGMDVWGQGTTVTVSS<br>SEQ ID NO: 30780 |

FIGURE 50
(Continued)

| | | | |
|---|---|---|---|
| iPS:436019 | 21-225_193C4 | NA | GACATCCAGATGACCCAGTCTCCATCTCCT<br>GTCTGCATCTGTTGGAGACAGAGTCACCATCA<br>CTTGCCGGCCGAGTCAGGGACATTAGCATTTAT<br>TTAGCCTGGTATCAGCAGAAACCAGGGAATGT<br>TCCTAAGCTCCTGATCTATGCTGCATCCACTTT<br>ACAATCAGGGGTCCCATCTCGGTTCAGTGGCA<br>GTGGATCTGGGACAGATTTCACTCTCACCATC<br>AGCAGCCTGCAGCCTGAAGATGTTGCAACTTA<br>TTACTGTCAAAAGTATAACAGTGCCCATTCA<br>CTTTCGGCCCTGGGACCAAAGTGGATATCAAA<br><br>SEQ ID NO: 26775 | GAGGTGCAGCTGTTGGAGTCTGGGGGAGGCTTG<br>GCACAGCCTGGGGGGGTCCCTGAGACTCTCCTGTG<br>CAGCCTCTGGATTCACCTTTAGCAGCTATGCCAT<br>GAACTGGGTCCGCCAGGCTCCAGGGAAGGGCT<br>GGAGTGGGTCTCAGTTATTATTGGTAATGGTGGT<br>AGAACATACTACGCAGACTCCGTGAAGGGCCGG<br>TTCTCCATCTCCAGAGACAATTCCAAGAACACGC<br>TGTTTCTGCAAATGAACAGCCTGAGAGCCGAGG<br>ACACGGCCGTATATTACTGTGCGAAAGATCTGGG<br>TAGATACAGCTATGTTTCTTTGACTACTGGGGC<br>CAGGGAACCCTGGTCACCGTCTCCTCA<br><br>SEQ ID NO: 30781 |
| | | AA | DIQMTQSPSSLSASVGDRVTITCRPSQGISIYLAW<br>YQQKPGNVPKLLIYAASTLQSGVPSRFSGSGSGT<br>DFTLTISSLQPEDVATYYCQKYNSAPFTFGPGTK<br>VDIK<br><br>SEQ ID NO: 26776 | EVQLLESGGGLAQPGGSLRLSCAASGFTFSSYAMN<br>WVRQAPGKGLEWVSAIIGNGGRITYADSVKGRFSI<br>SRDNSKNTLFLQMNSLRAEDTAVYYCAKDLGRYS<br>YGFFDYWGQGTLVTVSS<br><br>SEQ ID NO: 30782 |
| iPS:436021 | 21-225_193G4 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTTATACAGC<br>TCCAACAATTATAAACTACTTGACTTGGTACCA<br>GCAGAAACCAGGACAGCCTCCTAAGCTGCTCA<br>TTTACTGGGCATCTACCCGAAAATCCGGGGTC<br>CCTGACCGATTCAGTGGCAGCGGGTCTGGGAC<br>AGATTTCACTCTCACCATCAGCAGCCTGCAGG<br>CTGACGATGTGGCAGTTTATTACTGTCAGCAA<br>TATTATATTACTCCGTGGACGTTCGGCCAAGG<br>GACCAAGGTGGACATCAAA<br><br>SEQ ID NO: 26777 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGAACCCTAACAGTG<br>GTAACACAGGCTATGCACAGAAGTTCCAGGGCA<br>GAGTCACCATGACCAGGAACACCTCCATAAGAA<br>CAGCCTACATGGAGCTGAACAGCCTGAGATCTG<br>AGGACACGGCCGTGTATTACTGTGCGAGTAGCA<br>GTGGCTGGTACTTCTTTGACTACTGGGGCCAGGG<br>AACCCTGGTCACCGTCTCCTCA<br><br>SEQ ID NO: 30783 |

FIGURE 50
(Continued)

| | | | |
|---|---|---|---|
| iPS:436023 | 21-225_193A5 | AA | DIVMTQSPDSLAVSLGERATINCKSSQSVLYSSN NYNYLTWYQQKPGQPPKLLIYWASTRKSGVPD RFSGSGSGTDFTLTISSLQADDVAVYYCQQYYIT PWTFGQGTKVDIK<br>SEQ ID NO: 26778 | QVQLVQSGAEVKKPGASVKVSCKASGYTFTNYDIN WVRQATGQGLEWMGWMNPNSGNTGYAQKFQGR VTMTRNTSIRTAYMELNSLRSEDTAVYYCASSSGW YFFDYWGQGTLVTVSS<br>SEQ ID NO: 30784 |
| | | NA | CAGGTGCAGTCTGGTGCAGTCTGGGGCTGAGGTG AAGAAGCCTGGGGCCTCAGTGAAGGTCTCCTGC AAGGCTTCTGGATACACCTTCATCAGTTATGATA TCAACTGGGTGCGACAGGCCACTGGACAAGGC TTGAGTGGATGGGATGGATGAACCCTAAAAGGG GTAACACAGGCTATGCACAGAAGTTCCAGGGCA GAGTCACCATGACCAGGGACACCTCCATAAGCA CAGCCTACATGGAGCTGAGCAGCCTGAGATCTG AGGACACGGCCGTTTATTACTGTGCGAGAGGAG ACCCGTATAACTGGAACTCCTACGTATGGACGT CTGGGGCCAAGGGGCCACGGTCACCGTCTCCTCA<br>SEQ ID NO: 26779 | SEQ ID NO: 30785 |
| | | AA | DIQMTQSPSSLFASVGDRVIISCRASQGIRNDLG WYQQYPGKAPKRVIYAASSLQSQVPSRFSGSGF GTEFTITISSVQPEDFETYYCLQHNDFPFTFGGGT KVEIK<br>SEQ ID NO: 26780 | QVQLVQSGAEVKKPGASVKVSCKASGYTFISYDIN WVRQATGQGLEWMGWMNPKRGNTGYAQKFQGR VTMTRDTSISTAYMELSSLRSEDTAVYYCARGDPY NWNSYAMDVWGQGATVTVSS<br>SEQ ID NO: 30786 |

FIGURE 50
(Continued)

| | | | |
|---|---|---|---|
| iPS:436025 | 21-225_193B5 | NA | GAAATTGTGCTGACTCAGTCTTCCA GTCTGTGACTCCAAAGGAGAGAAGTCACCATCA CCTGCCGGGCCAGTCAGAGATCAGAGAAGTCATTGGTAGC TTACACTGGTACCAGCAGCAGAAACCAGATCCAGTC TCCAAAGCTCCTCATCAAGTATGCTTCCCAGT CCCTTCTCAGGGGTCCCCTGAGGTTCAGTGGC AGTGGATCTGGGACAGATTTCACCCTCACCAT CAATAGCCTGGAAGCTGAAGATGTTGCAACGT ATTACTGTCATCAGAGTAGTGTTTACCATTCA CTTTCGGCCCCTGGGACCAAAGTGGATATCAAA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCACCCAGGGAA GGGCCTGGAGTGGATTGGGTACATCTATTACAGT GGGAGCACCTACTACAACCCGTCCCTCAAGAGTC GAGTTACCATATCAGTAGACACGTCTAAGAACCA GTTCTCCCTGAAGCTGAGCTCTGTGACCGCTGCCG GACACGGCCGTGTATTATTGTGCGAGAGGAGAGT ATAACTGAACCACGGTATGGACGTCTGGGGCC AAGGGACCACGGTCACCGTCTCCTCA |
| | | | SEQ ID NO: 26781 | SEQ ID NO: 30787 |
| | | AA | EIVLTQSPDFQSVTPKEKVTITCRASQSIGSSLHW YQQKPDQSPKLLIKYASQSFSGVPSRFSGSGST DFTLTINSLEAEDAATYCHQSSVYHSRLPFTFGPGTK VDIK | QVQLQESGPGLVKPSQTLSLTCTVSGGSISSGGVYW SWIRQHPGKGLEWIGYIYYSGSTYYNPSLKSRVTIS VDTSKNQFSLKLSSVAADTAVYYCARGEYNWNH GMDVWGQGTTVTVSS |
| | | | SEQ ID NO: 26782 | SEQ ID NO: 30788 |
| iPS:436027 | 21-225_193E6 | NA | GAAATTGTGTTGTGGCGCAGTCTCCAGGCACCCT GTCTTTGTCTCCAGGGGAAAGAGCCACCCTCT CCTGCAGGGCCAGTCAGAGTGTTAGGAGCGGT TACTTAGCCTGGTACCAGCAGAAACCTGGCCA GGCTCCCAGGCTCCTCATCTATGGTGCATCCA GCAGGGCCACTGGCATCCCAGACAGGTTCGGT GGCAGTGGGTCTGGGACAGACTTCACTCTCAC CATCAGCAGACTGGAGCCTGAAGATTTTGCAG TGTATTACTGTCAGCAGTATGAGAGTTCACCG TGGACGTTCGGCCAAGGGACCAAGGTGGAAA TCAAA | CAGGTGCAGCTACAGCAGTGGGGCGCAGGACTG TTGAAGCCTTCGGAGACCCTGTCCCTCACCTGCG CTGTCTTTGGTGGGTCCTCAGTGTCCTACTGG AGTTGGATCCGCCAGCCCCAGGGAAGGGGCTG GAGTGGATTGGGGAATCAATCATAGTGGACGC ACCAACTACAACCCGTCCCTCAAGAGTCGAGTCA CCATATCAGTGGACACGTCCAAGAACCAGTTCTC CCTGAGGCTGAGCTCTGTGACCGCCGCGGACACG GCTGTGTATTACTGTGCGAGAGACTACGTGGTT TGGACTACTGGGGCCAGGGAACCCTGGTCACCGT CTCCTCA |
| | | | SEQ ID NO: 26783 | SEQ ID NO: 30789 |

FIGURE 50
(Continued)

| | | | |
|---|---|---|---|
| iPS:436029 | 21-225_193H6 | AA | EIVLAQSPGTLSLSPGERATLSCRASQSVRSGYLAWYQQKPGQAPRLLIYGASSRATGIPDRFGGSGSGTDFTLTISRLEPEDFAVYYCQQYESSPWTFGQGTKVEIK<br>SEQ ID NO: 26784 | QVQLQQWGAGLLKPSETLSLTCAVFGGSFSGPYWSWIRQPPGKGLEWIGESNHSGRTNYNPSLKSRVTISVDTSKNQFSLRLSSVTAADTAVYYCARDYGGLDYWGQGTLVTVSS<br>SEQ ID NO: 30790 |
| | | NA | GAAATTGTGTTGACGCAGTCTCCAGGCACCCTGTCTTTGTCTCCAGGGGAAAGCGCCACCCTCTCCTGCAGGGCCCGGTCAAAGTATTAGAACCAACTTCTTAGCCTGGTACCAGCAGCAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAACAGACTGGAGCCTGAAGATTTTGCAGTGTATTTCTGTCAGCAGTATGGTAGCTCACCGTGGACGTTCGGCCAAGGGACCAAGGTGGAAATCAAT<br>SEQ ID NO: 26785 | CAGGTGCAACTGCAGGAGTCGGGCCCAGGACTGGTGAAGCCTTCACAGACCCTGTCCCTCACCTGCACTGTCTCTGGTGGCTCCATCAACAGTGGTGATTACTACTGGAACTGGATCCGCCAGCACCAGGAACTACTGGAGTGGATTGGGTACATCTTTTACAGTGGGAGCACCTACTACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGGGGATTACGATGGTTCGGGGAGTTATCACTACTATTACGGTATGGACGTCTGGGGCCAAGGGACCACGGTCACCGTCTCCTCA<br>SEQ ID NO: 30791 |
| | | AA | EIVLTQSPGTLSLSPGESATLSCRAGQSIRTNFLAWYQQQPGQAPRLLIYGASSRATGIPDRFSGSGSGTDFTLTINRLEPEDFAVYFCQQYGSSPWTFGQGTKVEIN<br>SEQ ID NO: 26786 | QVQLQESGPGLVKPSQTLSLTCTVSGGSINSGDYYWNWIRQHPGKGLEWIGYIFYSGSTYYNPSLKSRVTISVDTSKNQFSLKLSSVTAADTAVYYCARGDYDGSGSYHYYYGMDVWGQGTTVTVSS<br>SEQ ID NO: 30792 |

FIGURE 50
(Continued)

| | | | |
|---|---|---|---|
| iPS:436031 | 21-225_193C7 | NA | GACATCCAGATGACCCAGTCCTCATCCTCACT GTCTGCATCTGTAGGAGACAGAGTCACCATCA CTTGTCGGGCGAGTCAGGGCATTGGCAAGTAT TTAGCCTGGTTTCAGCAGAAACCAGGGAAAGC CCCTAAGTCCCTGATCTATGCTGCATCCAGTTT GCAAAGTGGGGTCCCATCAAGTTCAGCGGCA GTGGATCTGGGACAGATTCACTCTCACCATC AGCAGCCTGCAGCCTGAAGATTTTGCAACTTA TTACTGCCAACAGTATACTTACCCGCTCA CTTTCGGCGGAGGGACCAAGGTGGAGATCAA A<br><br>SEQ ID NO: 26787 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAAAACTACGCAGACTCCGTGAAGGGCCGA TTCACCATCTCCAGAGACAATTCCAAGAACACGC TGTATCTGCAAATGAACAGCCTGAGAGCCGAGG ACACGGCTATGTATTACTGTGCGAGAGATCAGGG CGTGGGCTACGACGGCTTGGACGTCTGGGGCCA AGGGACCTCGGTCACCGTCTCCTCA<br><br>SEQ ID NO: 30793 |
| | | AA | DIQMTQSPSSLSASVGDRVTITCRASQGIGKYLA WFQQKPGKAPKSLIYAASSLQSGVPSKFSGSGSG TDFTLTISSLQPEDFATYYCQQYSTYPLTFGGGT KVEIK<br><br>SEQ ID NO: 26788 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAMYYCARDQGV GYDGLDVWGQGTSVTVSS<br><br>SEQ ID NO: 30794 |
| iPS:436033 | 21-225_193E7 | NA | GACATCCAGATGACCCAGTCTCCATCCTCCCT GTCTGCATCTGTAGGAGACAGAGTCACCATCA CTTGCCGGGCAAGTCAGAGCATTAGAAATGAT TTAGGCTGGTATCAGCAGAAACCAGGGAAAG CCCCTAAGCGCCTAATCTATTCTGCATCCAGTT TGCAAAGTGGGGTCCCATCAAGATTCAGCGGC AGTGGATCTGGGACAGATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA AA<br><br>SEQ ID NO: 26789 | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTACTTCTGG ACCTGGATCCGCCAGCCCCAGGGAAGGGGCTG GAGTGGATTGGGGAAATCAATCATAGTGGAAGC ACCAACTACAACCCGTCCCTCAAGAGTCGCGTCA CCATATCAGTAGACACGTCCAAGAACCAGTTCTC CCTGAAGCTGAGCTCTGTGACCGCCGCGGACACG GCTGTGTATTACTGTGCGAGAGACTACGGTGCTG ACTACTGGGGCCAGGGAACCCTGGTCGCCGTCTC CGCA<br><br>SEQ ID NO: 30795 |

FIGURE 50
(Continued)

| | | | |
|---|---|---|---|
| | | AA | DIQMTQSPSSLSASVGDRVTITCRASQGIRNDLGWYQQKPGKAPKRLIYSASSLQRGVPSRFSGSGSGTEFTLTISSLQPEDFATYYCLQHKRYPLTFGGGTKVEIK | QVQLQQWGAGLLKPSETLSLTCAVYGGSFSGYFWTWIRQPPGKGLEWIGEINHSGSTNYNPSLKSRVTISVDTSKNQFSLKLSSVTAADTAVYYCARDYGADYWGQGTLVAVSA |
| | | | SEQ ID NO: 26790 | SEQ ID NO: 30796 |
| iPS:436035 | 21-225_193C8 | NA | GAAATTGTGTTGACGCAGTCTCCAGGCACCCTGTTTTGTCTCCAGGGGAAAGAGCCACCCTCCCTGCAGGGCCAGTGCAGAGTATTCGCAGCAGCTTCTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCTGAAGATTTTGCAGTGTATTACTGTCAGCAATATGGTAACTCACCGTGGGCGTTCGGCCAAGGGATCAAGGTGGAAGTCAAA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGATTACTACTGGAACTGGATCCGCCAGCACCAGGAAGGGCTGGAGTGGATTGGGTACATCTTTTACAGTGGGAGCACCTACTACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGGGGATTACGATGGTTCGGGGAGTTATCACTACTACGGTATGGACGTCTGGGGCCAAGGGACCACGGTCACCGTCTCCTCA |
| | | | SEQ ID NO: 26791 | SEQ ID NO: 30797 |
| | | AA | EIVLTQSPGTLFLSPGERATLSCRASQSIRSSFLAWYQQKPGQAPRLLIYGASSRATGIPDRFSGSGSGTDFTLTISRLEPEDFAVYYCQQYGNSPWAFGQGIKVEVK | QVQLQESGPGLVKPSQTLSLTCTVSGGSISSGDYYWNWIRQHPGKGLEWIGYIFYSGSTYYNPSLKSRVTISVDTSKNQFSLKLSSVTAADTAVYYCARGDYDGSGSYHYYGMDVWGQGTTVTVSS |
| | | | SEQ ID NO: 26792 | SEQ ID NO: 30798 |

FIGURE 50
(Continued)

| | | | |
|---|---|---|---|
| iPS:436037 | 21-225_193D8 | NA | GAAATTGTGTTGAAGCAGTCTCCAGGCACCCTGTTTTTGTCTCCAGGGGAGAGCAGCCCTCCTGCAGGGCCAGTCAGTCAGAGTATAAGGACCAACTTCTTAGCTGGTACCAGCAGAAACCTGGCCAGGCTCCCAGGCTCCTCATCTATGGTGCATCAGCAGGGCCACTGGCATCCCAGACAGTTCAGTGGCAGTGGGTCTGGGACAGACTTCACTCTCACCATCAACAGACTGGAGCTGAAGATTTTGCAGTGTATTACTGTCAGCAGTATGTAACTCACCGTGGACGTTCGGCCAAGGGACCAAGGTGGAAATCAAA |
| | | | SEQ ID NO: 26793 |
| | | AA | EIVLKQSPGTLFLSPGERATLSCRASQSIRTNFLAWYQQKPGQAPRLLIYGASSRATGIPDRFSGSGSGTDFTLTINRLEPEDFAVYYCQQYGNSPWTFGQGTKVEIK |
| | | | SEQ ID NO: 26794 |
| iPS:436039 | 21-225_193F8 | NA | GACATCCAGATGATCCAGTCTCCATCCTCACTGTCTGCATCTGTAGGAGACAGAGTCACCATCACTTGTGTCGGGCGAGTCAGGGCGTTAGCAATCATTTAGCCTGGTTTCAGCAGAAACCAGGGAGAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAACAGTATATAGTTGCAACTTATTACTGTCAACAGAGTTTAAATAGTTACCCATTCACTTTCGGCCCTGGGACCAAAGTGGATATCAAA |
| | | | SEQ ID NO: 26795 |

| | | | |
|---|---|---|---|
| | | | CAGGTGCAGCTGCAGGAGTCGGGCCCAGGACTGGTGAAGCCTTCACAGACCCTGTCCCTCACCTGCACTGTCTCTGGTGGCTCCATCAACAGTGGTGGTTACTACTGGAACTGGATCCGCCAGCACCCAGGGAAGGGCCTGGAGTGGATTGGGTTCATCTTTACAGTGGGAGCACTTACTACAACCCGTCCCTCAAGAGTCGAGTTTCCATATCAGTAGACACGTCTAAGAACCAGTTCTCCCTGAAGCTGAGCTCTGTGACTGCCGCGGACACGGCCGTGTATTACTGTGCGAGAGGGGATTACGATGGTTCGGGGAGTTATCACTACTATTACGGTATGGACGTCTGGGGCCAAGGGACCACGGTCACCGTCTCCTCA |
| | | | SEQ ID NO: 30799 |
| | | | QVQLQESGPGLVKPSQTLSLTCTVSGGSINSGGYYWNWIRQHPGKGLEWIGFIFYSGSTYYNPSLKSRVSISVDTSKNQFSLKLSSVTAADTAVYYCARGDYDGSGSYHYYGMDVWGQGTTVTVSS |
| | | | SEQ ID NO: 30800 |
| | | | CAGGTGCAGCTGGTGGAGTCTGGGGGAGGCGTGGTCCAGCCTGGGAGGTCCCTGAGACTCTCCTGTGCAGCGTCTGGATTCACCTTCAGTATCTATGGCATGGACTGGGTCCGCCAGGCTCCAGGCAAGGGGCTGGAGTGGGTGGCAGTTATATCGAGACTCCGTGAAGGGCCGATTCACCATCTCCAGAGACAATTCCAAGAACACGCTGTATCTGCAAATGAACAGCCTGAGAGCCGAGGACACGGCTGTGTATTATTGTGTGAGACTACTACGCCTTATAGTGGCTACGGCTTGGACTACTACGGTATGGACGTCTGGGGCCAAGGGACCACGGTCACCGTCTCCTCA |
| | | | SEQ ID NO: 30801 |

FIGURE 50
(Continued)

| | | | | |
|---|---|---|---|---|
| iPS:436041 | 21-225_193G8 | AA | DIQMIQSPSPSSLSASVGDRVTITCRASQGVSNHLA WFQQKPGRAPKSLIYAASSLQSGVPSKFSGSGSG ADFTLTISSLQPEDFATYYCQQYNSYPFTFGPGT KVDIK | QVQLVESGGGVVQPGRSLRLSCAASGFTFSIYGMD WVRQAPGKGLEWVAVIWYDGSYKYYADSVKGRF TISRDNSKNTLYLQMNSLRAEDTAVYYCVREDSPY SGYGLDYYYGMDVWGQGTTVTVSS |
| | | | SEQ ID NO: 26796 | SEQ ID NO: 30802 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTAGAACCAAC TTCTTAGCCTGGCACCAGCAGAAACCTGGCCA GGCTCCCAGGCTCCTCATCTATGGTGCATCC GCAGGGCCACTGGCATCCCAGACAGGTTCAGT GGCAGTGGGTCTGGGACAGACTTCACTCTCAC CATCAACAGACTGGAGCCTGAAGATTTTGCAC TGTATTACTGTCAGCAGTATGGTAACTCACCG TGGACGTTCGGCCAAGGGACCAAGGTGGAAA TCAAA | CAGGTGCAGCTGCAGGAGAGAAAGGCCCAGGACTG GTGAAGCCTTCACAGACCCTGTCCCTCACCTGCA CTGTCTCTGGTGGCTCCGTCAGCAGTGGTGTTTA CTACTGGAGCTGGATCCGCCAGCACCCAGGGAA GGGCCTGGAGTGGATTGGGAACATCTATTACAGT GGGAGCACCTACAACAACCCGTCCCTCAAGAGT CGAGTTACCATATCAGTAGACACGTCTAAGAACC AGTTCTCCCTGAAGCTGACTCTGTGCGCAGGGAT GGACACGGCCGTCTATTACTGTGCGCGAGGGGAT TACGATGGTTCGGGAGTTATCACTTCTACTACG GTTTGACGTCTGGGGCCATGGACCACGGTCAC CGTCTCCTCA |
| | | | SEQ ID NO: 26797 | SEQ ID NO: 30803 |
| | | AA | EIVLTQSPGTLSLSPGERATLSCRASQSVRTNFLA WHQQKPGQAPRLLIYGASRRATGIPDRFSGSGSG TDFTLTINRLEPEDFALYYCQQYGNSPWTFGQG TKVEIK | QVQLQEKGPGLVKPSQTLSLTCTVSGGSVSSGVYY WSWIRQHPGKGLEWIGNIYYSGSTYNNPSLKSRVTI SVDTSKNQFSLKLNSVTAADTAVYYCARGDYDGS GSYHFYYGLDVWGHGTTVTVSS |
| | | | SEQ ID NO: 26798 | SEQ ID NO: 30804 |

FIGURE 50
(Continued)

| | | NA | GAAATTGTACTGACTCAGTCTCCAGATTTTCA GTCTGTGACTCCAAAGGAGAAAGTCACCATCA CCTGCCGGGCCAGTCAGAGCATTGGTAGGAGT TTACACTGGTACCAGCAGAGACCAGATCAGTC TCTAAAGCTCCTCATCAAGTATGTCTCCAGTC ATTCTCAGGGGTCCCCTCGAGGTTCAGTGGCA GTGGATCTGGGACAGATTTCACCCTCACCATC AATAGCCTGGAGGCTGAAGATGCTGCAACGTA TTTCTGTCATCAGAGTAGTCGTTTACCGCTCAC TTTCGGCGGCGGGACCAAGGTGGAGATCAAA<br><br>SEQ ID NO: 26799 | CAGGTGCAGCTGCAGGAGTCGGGCCCAGGACTG GTGAAGCCTTCACAGACCCTGTCCCTCACCTGCA CTGTCTCTGGTGACTCCATCAATAATGGTGGATA CTACTGGAGCTGGATCCGCCAGCACCCAGGGAA GGGCCTGGAGTGGATTGGGTACATCTTTTACAGC GGGAGCACCTACTACAACCCGTCCCTCAAGAGTC GAGTTACCATATCAGTTGACACGTCTAAGAATCA GTTCTCCCTGAAGCTGAACTCTGTGACTGCCGCG GACACGGCCGTGTATTTTTGTGCGAGAGCGGGAT ATAACTGGGACAACGGTTTGACTACTGGGGCC AGGGAACCCTGGTCACCGTCCTCA<br><br>SEQ ID NO: 30805 |
|---|---|---|---|---|
| iPS:436043 | 21-225_193G9 | AA | EIVLTQSPDFQSVTPKEKVTITCRASQSIGRSLHW YQQRPDGQSLKLLIKYASQSFSGVPSRFSGSGSGT DFTLTINSLEAEDAATYFCHQSSRLPLTFGGGTK VEIK<br><br>SEQ ID NO: 26800 | QVQLQESGPGLVKPSQTLSLTCTVSGDSINNGGYY WSWIRQHPGKGLEWIGYIFYSGSTYYNPSLKSRVTI SVDTSKNQFSLKLNSVTAADTAVYFCARAGYNWD NGFDYWGQGTLVTVSS<br><br>SEQ ID NO: 30806 |
| iPS:436045 | 21-225_193A10 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGAACAGATTTCACTCTCACCATC AGCAGCCTGCAGCCTGAAGATTTTGCAACTTA TTTCTGCCAACATTATTACTTACCCTCTCAC TTTCGGCGGAGGGACCAAGGTGGAGATCAAA<br><br>SEQ ID NO: 26801 | CAGGTGCAGCTGCAGGAGTCGGGGAGTCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACGGTTTGACTGTGCGAGAGATAGGGG GGTGGTTACTACGGTTTGACGTCTGGGGCCAA GGGACCACGGTCACCGTCCTCA<br><br>SEQ ID NO: 30807 |

FIGURE 50
(Continued)

| | | | |
|---|---|---|---|
| iPS:436047 | 21-225_193B10 | AA | DIQMTQSPSSLSASVGDRVTITCRASQGISNYLA WFQQKPGKAPKSLIYAASSLQSGVPSKFSGSGSG TDFTLTISSLQPEDFATYFCQHYLTYPLTFGGGT KVEIK<br>SEQ ID NO: 26802 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS<br>SEQ ID NO: 30808 |
| | | NA | GAAATTGTGTTGACGCAGTCTCCAGGCACCCT GTCTTTGTCTCCAGGGGAAAGAGCCACCCTCT CCTGCAGGGCCAGTCCGAGTGTTAGCAGCAGC TACTTAGCCTGGTACCAGCAAAAACCTGGCCA GGCTCCCAGGCTCGTCATCTATGGTGCATCA GGAGGGCCACTGGCATCCCAGACAGGTTCAG AGGCAGTGGGTCTGGGACAGACTTCACTCTCA CCATCAGTAGACTGGAGCCTGAAGATTTTGCA GTGTATTACTGTCAGCAGTATGGTAGCTCACC TCCGTGGACGTTCGGCCAAGGGACCAAGGTGG AAATCAAA<br>SEQ ID NO: 26803 | GAGGTGCAGTTGGTGGAGTCTGGGGGAGGCCTG GTCAAGCCTGGGGGGTCCCTGAGACTCTCCTGTG CAGCCTCTGGATTCACCTTCAGGACTTCAGGACAT GAACTGGGTCCGCCAGGCTCCAGGGAAGGGGCT GGAGTGGGTCTCATTAGTAGTGCTGGTGGT TACATATACTACGACACTACTGAAGGGCCGAT TCACCATCTCCAGAGACAACGCCAAAAACTCACT GTATCTGCAAATGAACAGCTGAGAGCCGAGGA CACGGCTGTGTATTACTGTGCGAGAGCAACTATG GCCCTTGACTACTGGGGCCAGGGAACCCTGGTCA CCGTCTCCTCA<br>SEQ ID NO: 30809 |
| | | AA | EIVLTQSPGTLSLSPGERATLSCRASPSVSSSYLA WYQQKPGQAPRLVIYGASRRATGIPDRFRGSGS GTDFTLTISRLEPEDFAVYYCQQYGSSPPWTFGQ GTKVEIK<br>SEQ ID NO: 26804 | EVQLVESGGGLVKPGGSLRLSCAASGFTFRDYSMN WVRQAPGKGLEWVSSISSAGGYIYYADSLKGRFTI SRDNAKNSLYLQMNSLRAEDTAVYYCARATMALD YWGQGTLVTVSS<br>SEQ ID NO: 30810 |

FIGURE 50
(Continued)

| | | | |
|---|---|---|---|
| iPS:436049 | 21-225_193B12 | NA | GAAATTGTGTTGACGCAGTCTCCAGGCACCCT GTCTTTGTCTCTGCAGGGGAAAGAGCCACCCTCT CCTGCAGGGCCAGTCAGTGTTAGCAGCAGC TTCTTAGCCTGGTATCAGCAGAAACCTGGCCA GGCTCCCAGGCTCCTCATCTATGATGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br>SEQ ID NO: 26805 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGCTGATTA CTACTGGAACTGGATCCGCCAGTCCCAGGGAA GGGCCTGGAGTGGATTGGGTACATCTTTTACAGT GGGAGCACTTACTACAACCCGTCCCTCAAGAGTC GACTTACCATATCAGTGGACAGTCTAAGAACCA GTTCTCCCTGAAGCTGAGCTCTGTGACTGCCCG GACACGGCCGTGTATTACTGTGCGAGAGGGATT ACGATGGTTCGGGGAGTTATCACTTCTACTACGG TATGGACGTCTGGGGCCAAGGGACCACGGTCAC CGTCTCCTCA<br>SEQ ID NO: 30811 |
| | | AA | EIVLTQSPGTLSLSPGERATLSCRASQSIRSSFLA WYQQKPGQAPRLLIYDASSRATGIPDRFSGSGSG TDFTLTISRLEPEDFAVYYCQQYGNSPWAFGQG TKVEIK<br>SEQ ID NO: 26806 | QVQLQESGPGLVKPSQTLSLTCTVSGGSISSADYYW NWIRQSPGKGLEWIGYIFYSGSTYYNPSLKSRLTISV DTSKNQFSLKLSSVTAADTAVYYCARGDYDGSGS YHFYYGMDVWGQGTTVTVSS<br>SEQ ID NO: 30812 |
| iPS:436051 | 21-225_193G12 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAGCAGC TTAGCCTGGTATCAGCAGAAACCTGGCCAGGC TCCCAGGACTCCTCATCTGTGGTGCATCCACCA GGGCCACTGGTATCCCAGCCAGGTTCAGTGGC AGTGGGTCTGGGACAGAGTTCACTCTCACCAT CAGCAGCCTGCAGTCTGAGATTTTGCAGTTT ATTACTGCCAGCAGCAGTATAATAACTGGCCTGC AGTTTTGGCCAGGGGACCAAGCTGGAGATCAA A<br>SEQ ID NO: 26807 | CAGGTGCAGCTGGTGGAGTCTGGGGGAGGCGTG GTCCAGCCTGGGAGGTCCCTGAGACTCTCCTGTG GAGCGTCTGGATTCACCTTCAGTAGCTATGCCAT GAGCTGGGTCCGCCAGGCTCCAGGCAAGGGCT GCAGTGGGTGGCAGTTATATGGAGACTCCGTGAAGT AATAAATACTATGGAGACTCCGTGAAGGGCCGA TTCACCATCTCCAGAGACAATTCCAAGAACACGC TGAATCTGCAAATGAACAGCCTGAGAGCCGAGG ACACGGCTGTCTATTACTGTGCGAGAGATTTCAC TATAACTGGAGCTACATATTTTGACTACTGGGGC CAGGGAACCCTGGTCACCGTCTCCTCA<br>SEQ ID NO: 30813 |

FIGURE 50
(Continued)

| | | | |
|---|---|---|---|
| iPS:436054 | 21-225_194C1 | AA | EIVMTQSPATLSVSPGERATLSCRASQSVSSSLA WYQQKPGQAPRILISGASTRATGIPARFSGSGSG TEFTLTISSLQSADFAVYYCQQYNNWPCSFGQG TKLEIK<br>SEQ ID NO: 26808 | QVQLVESGGGVVQPGRSLRLSCGASGFTFSSYAMH WVRQAPGKGLEWVAVIWYDGTNKYYGDSVKGRF TISRDNSKNTLNLQMNSLRAEDTAVYYCARDFTIT GATYFDYWGQGTLVTVSS<br>SEQ ID NO: 30814 |
| | | NA | GACATCCAGATGACCCAGTCTCCATCCTCACT GTCTGCATCTGTAGGAGACAGAGTCACCATCA CTTGTCGGGCGAGTCAGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCTACATTATATCTTACTTACCCTCTCAC TTTCGGCGGAGGGACCAAGGTGGAGATCAAA<br>SEQ ID NO: 26809 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCAT GCACTGGGTCCGCCAGGCTCCAGGCAAGGGGCT GGAGTGGGTGGCAGTTATATGCAGACTCCGTGAAGGGCCGA AATGAACACTATGCAGACTCCGTGAAGGGCCGA TTCACCATCTCCAGAGACAACAGCCTGAGAGCCGAGG ACACGGCTGTGTATTACTGTGCGAGAAATAGGGG GGTGGGTTACTACGGTTTGGACGTCTGGGGCCAA GGGACCACGGTCACCGTCTCCTCA<br>SEQ ID NO: 30815 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLHYLTYPLTFGGGT KVEIK<br>SEQ ID NO: 26810 | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARNRGV GYYGLDVWGQGTTVTVSS<br>SEQ ID NO: 30816 |

FIGURE 50
(Continued)

| | | | | |
|---|---|---|---|---|
| iPS:436056 | 21-225_194C3 | NA | GAAATTGTGCTGACTCAGTCTCCAGACTTCA GTCTGTGGCTCCAAAGGAGAAAGTCACCATCA CCTGCCGGGCCAGTCAGAGTATTGGTAGTAAC TTACACTGGTACCAGCAGAAACCTGATCAGTC TCCAAAGCTCCTCATCAAGTCTGCTTCCCAGTC CTTCTCAGGGGTCCCCTCGAGGTTCAGTGGCA GTGGATCTGGGACAGATTTCACCCTCACCATC AATAGCCTGGAAACTGAAGATGCTGCAACGTA TTACTGTCAGCAGAGTAGTTTACCGTGGA CGTTCGGCCAAGGGACCAAGGTGGAAATCAA A | CAGGTGCAGCTGCAGGAGTCGGGCCCAGGACTG GTGAAGCCTTCGGAGACCCTGTCCCTCACTGCA CTGTCTCTGGTGCTCCATCAATTACTACTG GAGCTGGATCCGGCAGCCCGCCGGGAAGGGACT GGAGTGGATTGGGCGTATCTATGCCAGTGGAGC ACCAACTACAACCCCTCCCTCAAGAGTGAGTCA CCATGTCAATAGACACGTCCAAGAACCAGTTCTC CCTGAAGCTGAGCTCTGTGACCGCCGCGGACACG GCCGTGCATTACTGTGCGAGAGATCGGGGATACT ATGGCTACTACGGTATGGACGTCTGGGGCCAAG GGACCACGGTCACCATCTCCTCA |
| | | | SEQ ID NO: 26811 | SEQ ID NO: 30817 |
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK | QVQLQESGPGLVKPSETLSLTCTVSGGSINNYYWS WIRQPAGKGLEWIGRIYASGSTNYNPSLKSRVTMSI DTSKNQFSLKLSSVTAADTAVHYCARDRGYYGYY GMDVWGQGTTVTISS |
| | | | SEQ ID NO: 26812 | SEQ ID NO: 30818 |
| iPS:436058 | 21-225_194A4 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAACATC TACTTAGCCTGGTACCAACAGAAACCTGGCCA GGCTCCCAGGCTCCTCATCTATGGTGCTTCCA ACAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCACAATGATTACTCAATG TTCACTTTCGGCCCTGGGACCAAAGTGGATAT CAAA | CAGGTGCAGCTGGTGGTGCAATCTGGGACTGAGGTGA AGAAGCCTGGGGCCTCTTGAAGGTCTCCTGCAA GGCTTCTGATACACCTTCACCGTCTACTATTG AACTGGGTGCGACAGGCCCCTGGACAAGGGCTT GAGTGGATGGGATGGATCAACAGAAGTTTCAGGCAGG GGCACAAACTATGCACAGGGACACGTCCATCAGCACA GTCACCATGAGAACGACCAGGGACACGTCCATCAGCACA GCCTACATGAACGCAGGCAGGCTGAGATCTGAC GACACGGCCGTGTATTACTGTGCGAGAGGCTACG ATATTTTGACTGGTTGGGGCCAGGGAACCCTGGT CACCGTCTCCTCA |
| | | | SEQ ID NO: 26813 | SEQ ID NO: 30819 |

FIGURE 50
(Continued)

| | | | |
|---|---|---|---|
| iPS:436060 | 21-225_194F4 | AA | EIVLTQSPGTLSLSPGERATLSCRASRGVSNIYLAWYQQKPGQAPRLLIYGASNRATGIPDRFSGSGSGTDFTLTISRLEPEDFAVYYCQHNDYSMFTFGPGTKVDIK | QVQLVQSGTEVKKPGASLKVSCKASGYTFTVYLNWVRQAPGQGLEWMGWINPNSGGTNYAQKFQGRVTMTRDTSISTAYMELSRLRSDDTAVYYCARGYDILTGWGQGTLVTVSS |
| | | | SEQ ID NO: 26814 | SEQ ID NO: 30820 |
| | | NA | GATATTGTGATGACCCAGACTCCACTCTCTGTCCGTCACCCCTGGACAGCCGCCTCCATCTCCTGCAAGTCTAGTCAGAGCCTCCTCCATAGTGATGAAGGACCTATTTGTATTGGTACCTGCAGAAGCCAGGCCAGCCTCCACAGCTCCTGATCTGTGAGGTTTCCAACCGTTCTGTGGAGTGCCAGATAGGTTCAGTGCAGCGGGTCAGGGACAGATTTCACACTGAAAATCAGCCGGGTGGAGGCTGGGGATGTTGGGGTTATTACTGCATGCAAAGTATACAGCTTCCCTGGACGTTCGGCCAAGGGACCAAGGTGGAAATCAAA | CAGCTGCAGCTGCAGGAGTCGGGCCCAGGACTGGTGAAGCCTTCGGAGACCCTGTCCCTCACCTGCACTGTCTCTGGTGGCTCCATCAGTAGTTACCACTGGAGCTGGATCCGGCAGCCCGCGGGAAGGGACTGGAGTGGATTGGACTTATCTATACCAGTAGGAGCACCAACTACAACCCCTCCCTCAAGAGTCGAGTCACCATGTCAGTAGACACAGGTCCAAGAGCCAGTTCTCCCTGAAGCTGAGCTCTGTGACCGCCGCGGACACGGCCGTGTATTACTGTGCGAGACTCCGGTATAACTGGAACTTCCCTACTTTGACTACTGGGGCCAGGGAACCCTGGTCACCGTCTCCTCA |
| | | | SEQ ID NO: 26815 | SEQ ID NO: 30821 |
| | | AA | DIVMTQTPLSLSVTPGQPASISCKSSQSLLHSDGRTYLYWYLQKPGQPPQLLICEVSNRFSGVPDRFSGSGSGTDFTLKISRVEAGDVGVYYCMQSIQLPWTFGQGTKVEIK | QLQLQESGPGLVKPSETLSLTCTVSGGSISSYHWSWIRQPAGKGLEWIGLIYTSRSTNYNPSLKSRVTISVDRSKSQFSLKLSSVTAADTAVYYCARLRYNWNFPYFDYWGQGTLVTVSS |
| | | | SEQ ID NO: 26816 | SEQ ID NO: 30822 |

FIGURE 50
(Continued)

| | | | |
|---|---|---|---|
| iPS:436062 | 21-225_194E5 | NA | GAAATTGTGTTGACGCAGTCTCCAGGCACCCT GTCTTTGTCTCCAGGGGAAAGCGCCACCCTCT CCTGCAGGGCCGGTCAAAGTATTAGAACCAAC TTCTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAACAGACTGGAGCCTAAAGATTTTGCAG TGTATTACTGTCAGCAGTATGGTAGTTCACCG TGGACGTTCGGCCAAGGGACCAAGGTGGAAA TCAAA SEQ ID NO: 26817 | CAGGTGCAACTGCAGGAGTCGGGCCCAGGACTG GTGAAGCCTTCACAGACCCTGTCCCTCACCTGCA CTGTCTCTGGTGGCTCCATCAACAGTGGTGATTA CTACTGGAACTGGATCCGCCACCACCCAGGGAA GGGCCTGGAGTGGATTGGGTACATCTTTTACAGT GGGAGCACTTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTATATTACTGTGCGAGAGGGGATT ACGATGGTTCGGGGAGTTATCACTACTATTACGG TATGGACGTCTGGGGCCAAGGGACCACGGTCAC CGTCTCCTCA SEQ ID NO: 30823 |
| | | AA | EIVLTQSPGTLSLSPGESATLSCRAGQSIRTNFLA WYQQKPGQAPRLLIYGASSRATGIPDRFSGSGSG TDFTLTINRLEPKDFAVYYCQQYGSSPWTFGQG TKVEIK SEQ ID NO: 26818 | QVQLQESGPGLVKPSQTLSLTCTVSGGSINSGDYY WNWIRHHPGKGLEWIGYIFYSGSTYYNPSLKSRVTI SVDTSKNQFSLKLSSVTAADTAVYYCARGDYDGS GSYHYYYGMDVWGQGTTVTVSS SEQ ID NO: 30824 |
| iPS:436064 | 21-225_194E6 | NA | GAAATTGTGTTGACGCAGTCTCCAGGCACCCT GTCTTTGTCTCCAGGGGAAAGAGCCACCCTCT CCTGCAGGGCCAGTCAGAGTATTAGCAGCAAC TTCTTAGCCTGGTATCAGCAGAAACCTGGCCA GGCTCCCAGGCTCCTCATCTATGGTGCATCCA GCAGGGCCACTGGCATCCCAGACAGGTTCAGT GGCAGTGTGTCTGGGACAGGCCTGAAGATTTTGCAG TGTATTATTACTGTCAGCAGTATGGTAGTCACCG TGGACGTTCGGCCAAGGGACCAAGGTGGAAA TCAAA SEQ ID NO: 26819 | CAGGTGCAGCTGCAGGAGTCGGGCCCAGGACTG GTGAAGCCTTCACAGACCCTGTCCCTCACCTGCA CTGTCTCTGGTGACTCCATCAACAGTGGTGATTA CTACTGGAACTGGATCCGCCAGCACCCAGGGAA GGGCCTGGAGTGGATTGGATTCATCTTTACAGT GGGAGCACTACTACAATAGACACGTCTAAGAACCA GTTCTCCCTGAAGCTGAGCTCTGTGAATGTCGCG GACACGGCCGTGTATTACTGTGCGAGAGGGGATT ACGATGGTTCGGGGAGTTATCACTACTATTACGG TATGGACGTCTGGGGCCAAGGGACCACGGTCAC CGTCTCCTCA SEQ ID NO: 30825 |

FIGURE 50
(Continued)

| | | | |
|---|---|---|---|
| iPS:436066 | 21-225_194B7 | AA | EIVLTQSPGTLSLSPGERATLSCRASQSIRSNFLAWYQQKPGQAPRLLIYGASSRATGIPDRFSGSVSGTDFTLTINRLEPEDFAVYYCQQYGSSPWTFGQGTKVEIK<br>SEQ ID NO: 26820 | QVQLQESGPGLVKPSQTLSLTCTVSGDSINSGDYYWNWIRQHPGKGLEWIGFIFYSGSTYNPSLKSRVTISIDTSKNQFSLKLSSVNVADTAVYYCARGDYDGSGSYHYYGMDVWGQGTTVTVSS<br>SEQ ID NO: 30826 |
| | | NA | GACATCCAGATGACCCAGTCTCCATCCTCACTGTCTGCATCTGTAGGAGACAGAGTCACCATCACTTGTCGGGCGAGTCAGGGCATTAGCAAATATTTAGCCTGGTTTCAGCAGAAACCAGGGAAAGCCCCTAAGTCCCTGATCTATGGTGCATCCAGGTTGCAAAGTGGGGTCCCATCAAGGTTCAGCGGCAGTGGATCTGGGACAGACTTCACTCTCACCATCAGCAGCCTGCAGCCTGAAGATTTTGCAACTTATTACTGCCAACATTATCTTAATTACCCTCTCACCTTCGGCCAAGGGACACGACTGGAGATTAAA<br>SEQ ID NO: 26821 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATCGAGACTCCGTGAAGGGCCGAAATAAAACTATGCAGAGACAATTCCAAGAACACGCTTCACCATCTCCAGAGACAATGAACAGCCTGAGAGCCGAGGTGTATCTGCAAATGAACAGCCTGAGAGAGATCGGTCACACGGCTGTGTATTATTGTGCGAGAGATCGGTCTAAGGGTTACGACGGTATGGACGTCTGGGGCCAAGGGACCACGGTCACCGTCTCCTCA<br>SEQ ID NO: 30827 |
| | | AA | DIQMTQSPSSLSASVGDRVTITCRASQGISKYLAWFQQKPGKAPKSLIYGASRLQSGVPSKFSGSGSGTDFTLTISSLQPEDFATYYCQHYLNYPLTFGQGTRLEIK<br>SEQ ID NO: 26822 | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRSKGYDGMDVWGQGTTVTVSS<br>SEQ ID NO: 30828 |

FIGURE 50
(Continued)

| | | | |
|---|---|---|---|
| iPS:436068 | 21-225_194F7 | NA | GACATCCAGATGACCCAGTCTCCATCTTCCGT GTCTGCATCTGTAGGAGACAGAGTCACCATCA CTTGTCGGGCGAGTCAGGTATTAGCAGGTGG TTAGCCTGGTTTCAGCAGAAACCAGGGAAAGC CCCTAAGACTCCTGATCTATGCTGCATCCAGTT GCAAAGTGGGGGTCCCATCAAGGTTCAGCGGCA GTGGATCTGGGACAGATTTCACTCTCACCATC AGCAGCCTGCAGCCTGAAGATTTTGCAACTTA CTATTGTCAACAGGCTAACAGTTTCCCGTGA CGTTCGGCCAAGGGACCAAGGTGGAAATCAA A | CAGGTGCAGCTGGTGGTGCAGTCTGGGGCTGAGGTG AAGAAGCCTGGGGCCTCAGTGAAGGTCTCCTGC AAGGCTTCTGGATACACCTTCACCGACTACTACA TACACTGGGTGCGACAGGCCCCTGGACAAGGGC TTGAGTGGATGGGATGGATCAACCCTAACAATGG TGGCACAAACTATGCACAGAAATTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGAACCC CTTGGTTACTATGGTTCGGGGAGTTATGGGCCT ACGGTATGGACGTCTCGGGGCCAAGGGACCACGG TCACCGTCTCCTCA |
| | | | SEQ ID NO: 26823 | SEQ ID NO: 30829 |
| | | AA | DIQMTQSPSSSVSASVGDRVTITCRASQGISRWLA WFQQKPGKAPKILIYAASSLQSGVPSRFSGSGSG TDFTLTISSLQPEDFATYYCQQANSFPWTFGQGT KVEIK | QVQLVQSGAEVKKPGASVKVSCKASGYTFTDYYIH WVRQAPGQGLEWMGWINPNNGGTNYAQKFQGRV TMTRDTSISTAYMELSRLRSDDTAVYYCAREPLGY YGSGSYGAYGMDVWGQGTTVTVSS |
| | | | SEQ ID NO: 26824 | SEQ ID NO: 30830 |
| iPS:436072 | 21-225_194C10 | NA | GAAATTGTGTTGACGCAGTCTCCAGGCACCCT GTCTTTGTCTCCAGGGGAAAGAGCCACCCTCT CCTGCAGGGCCAGTCCGAGTGTTAAACAGCGGC TACTTAGCCTGGTACCAGCAGAAGCCTGGCCA GACTCCCAGGCTCCTCATCTTTGGTGCATCCA GCAGGGCCACTGGCATCCCCGACAGGTTCAGT GCCAGTGGGTCTGGGACAGCTTCACTCTCAC CATCAGTAGACTGGAGCCTGAAGATTTTGCAG TGTATTTTCTGTCAGCAGTATGAAAGCTCACCG TGGACGTTCGGCCAAGGGACCAAGGTGGAAA TCAAA | CAGGTGCAGCTACAGCAGTGGGCCAGGACTG TTGAAGCCTTCGGAGACCCTGTCCCTCACCTGCG CTGTCTCTGGTGGCTCCTCAGATATTACTACTGG AGCTGGATCCGCCAGCCCCCGGGAAGGGCTG GAGTGGTTTGGGGAAATCAATCATAGTGGAAGC ACCAACTACAACCCGTCCCTCAAGAGTCGAGTCA CCATATCAATAGACACGTCCAAGAACCAGTTCTC CCTGAAGCTGAGTCTGTGCGAGACGCCGCGACAC GGCTGTGTATTACTGTGGGGCCAAGGACTACGGTGCT TTTGATATCTGGGGCCAAGGGACAATGGTCACCG TCTCTTCA |
| | | | SEQ ID NO: 26825 | SEQ ID NO: 30831 |

FIGURE 50
(Continued)

| | | | |
|---|---|---|---|
| iPS:436074 | 21-225_194F10 | AA | EIVLTQSPGTLSLSPGERATLSCRASPSVNSGYLA WYQQKPGQTPRLLIFGASSRATGIPDRFSASGSG TDFTLTISRLEPEDFAVYFCQQYESSPWTFGQGT KVEIK<br>SEQ ID NO: 26826 | QVQLQQWGAGLLKPSETLSLTCAVSGGSFRYYYW SWIRQPPGKGLEWFGEINHSGSTNYNPSLKSRVTISI DTSKNQFSLKLRSVTAADTAVYYCARDYGAFDIW GQGTMVTVSS<br>SEQ ID NO: 30832 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCTGAAACCAGGGAAAGC CCCTAAGCGCCTGATCTATGCTGCATCCAGTTT ACAAAGTGGGGTCCCATCAAGGTTCAGCGGCA GTGGATCTGGGCCAGACCTGAAGATTTTGCAACTTA AGCAGCCTGCAGCCTGAAGATTTTGCAACTTA TTACTGTCTACAGCATTATAGTTTCCCATTCAC TTTCGGCCCTGGGACCAAAGTGGATATCAAA<br>SEQ ID NO: 26827 | CAGGTGCAGCTGGTGCAGTCGGGGGGAGGCGTG GTCCAGCCTGGGAGGTCCCTGAGACTCTCCTGTG CAGCGTCTGAGATTCACCTTCAGTAGCTTTATCAT GCACTGGGTCCGCCAGGCTCCAGGCAGGGGGCT GGAGTGGGTGGCAGTTATATGCAGACTCCGTGAAGT AATAAATACTATGCAGACTCCGTGAAGGGCCGA TTCACCATCTCCAGAGACAACAATTCCAAGAACACGC TGTATCTGGAAATGAACAGCCTGAGAGTGAGG ACACGGCTGTGTATTACTGTGCGAGAGAGGAGTA TAGCAGTGGCTGGTTCGGGTACGGTATGGACGTC TGGGGCCAAGGGACCACGGTCACCGTCTCCTCA<br>SEQ ID NO: 30833 |
| | | AA | DIQMTQSPSSLSASVGDRVTITCRASQGIRNDLG WYQLKPGKAPKRLIYAASSLQSGVPSRFSGSGSG PEFTLTISSLQPEDFATYYCLQHYSFPFTFGPGTK VDIK<br>SEQ ID NO: 26828 | QVQLVESGGGVVQPGRSLRLSCAASGFTFSSFIMH WVRQAPGRGLEWVAVIWYDGSNKYYADSVKGRF TISRDNSKNTLYLEMNSLRVEDTAVYYCAREEYSS GWFGYGMDVWGQGTTVTVSS<br>SEQ ID NO: 30834 |

FIGURE 50
(Continued)

| | | | |
|---|---|---|---|
| iPS:436076 | 21-225_194H11 | NA | GACATCCAGATGACCCAGTCTCCATCCTCACT GTCTGCATCTGTAGGAGACAGAGTCACCATCA CTTGTGTCGGGCGAGTCAGGGCATTAGCAATTAT TTAGCCTGGTTTCAGCAGAAACCAGGGAAAGC CCCTAAGTCCCTGATCTATGCTGCATCCAGTTT ACAAAGTGGGGTCCCATCAAAGTTCAGCGGCA GTGGATCTGGAACAGATTTCACTCTCACCATC AGCAGCCTGCAGCCTGAAGATTTTGCAACTTA TTACTGCCAACATTATCTTACTTACCCTCTCAC TTTCGGCGGAGGGACCAAGGTGGAGATCAAA SEQ ID NO: 26829 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGCTATGGCAT GCACTGGGTCCGCCAGGCTCCAGGCAAGGGCT GGAGTGGGTGGCAGTTATATGTATGATGGAAGT AATGAACACTATGCAGACTCCGTGAAGGGCCGA TTCACCATCTCCAGAGACAATTCCAAGAACACGC TGTCTCTGCAAATGAACAGCCTGAGAGCCGAGG ACACGGCTGTGTATTACTGTGCGAGAGATAGGGG GGTGGGTTATTACGGTTTGGACGTCTGGGGCCAA GGGACCACGGTCACCGTCCTCTCA SEQ ID NO: 30835 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCQHYLTYPLTFGGGT KVEIK SEQ ID NO: 26830 | QVQLVESGGGVVQPGRSLRLSCAASGFTFSSYGMH WVRQAPGKGLEWVAVIWYDGSNEHYADSVKGRF TISRDNSKNTLSLQMNSLRAEDTAVYYCARDRGVG YYGLDVWGQGTTVTVSS SEQ ID NO: 30836 |
| iPS:436078 | 21-225_194H12 | NA | GACATCCAGATGACCCAGTCTCCATCCTCACT GTCTGCATCTGTGGGAGACAGAGTCACCATCA CTCGTCGGGCGAGTCAGGGCATTGGCAAGTAT TTAGCATGGTTTCAGCAGAAACCAGGGAAAGC CCTTAAGTCACTGATCTATATGTGCATCCAGTTT GCAAAGTGGGGTCCCATCAAAATTCAGCGGCA GTGGATCTGGGACAGATTTCACTCTCACCATC AGCAGCCTGCAACGATATCAGCTTACCCTCTC TTACTGCCAACGATATGATACTTACCCATTCA CTTTCGGCCCTGGGACCAAAGTGGATATCAAA SEQ ID NO: 26831 | CAGGTGCAGCTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGCT GGAGTGGGTGGCAGTTATATGTGTTTGATGAAGT AATGACTACTATGCAGACTCCGTGAAGGGCCGAT TCACCATCTCCAGAGACAATTCCAAGAACACGT GTCACTGCAAATGAACAGCCTGAGAGCCGAGGA CACGGCTGTGTATTACTGTGCGAGAGATAGAAGC GTCGGCTACGACGGTTTAGATGTCTGGGGCCAAG GGACCACGGTCACCGTCCTCTCA SEQ ID NO: 30837 |

FIGURE 50
(Continued)

| | | | |
|---|---|---|---|
| iPS:436080 | 21-225_195B1 | AA | DIQMTQSPSSLSASVGDRVTITRRASQGIGKYLA WFQQKPGKALKSLIYAASSLQSGVPSKFSGSGSG TDFTLTISSLQPDDFATYYCQRYDTYPFTFGPGT KVDIK<br>SEQ ID NO: 26832 |
| | | | QVQLVESGGGVVQPGRSLRLSCAASGFTFRNYGM HWVRQAPGKGLEWVAVIWFDGSNDYYADSVKGR FTISRDNSKNTLSLQMNSLRAEDTAVYYCARDRSV GYDGLDVWGQGTTVTVSS<br>SEQ ID NO: 30838 |
| | | NA | GAAATTGTGTTGACGCAGTCTCCAGGCACCCT GTCTTTGTCTCAGGGGAAAGAGCCACCCTCT CCTGCAGGGCCAGTCCGAGTGTTAACAGTAAC TACTTAGCCTGGTATCAGCAGAAACCTGGCCA GACTCCCAGGCTCCTCATCTATGGTGCATCCA ACAGGGCCACTGGCGTCCCAGACAGGTTCAGT GCCAGTGGGTCTGGGACAGACTTCACTCTCAC CATCAGAAGACTGGAGCCTGAAGATTTTGCAG TGTATTTCTGTCAGCAGTATGAAAGCTCACCG TGGACGTTCGGCCAAGGGACCAAGGTGGAAA TCAAA<br>SEQ ID NO: 26833 |
| | | | CAGGTGCAGTTACAGCAGTGGGGCGCAGGACTG TTGAAGCCTTCGGAGACCCTGTCCCTCACCTGCG CTGTCTCTGGTGGGTCCTTCAGATATTACTTCTGG AGCTGGATCCGCCAGTCCCCCGGGAAGGGGCTG GAGTGGTTTGGGGAAATCAATCATAGTGGACGC ACCAACTACAACCGTCCCTCAAGAGTCGAGTCA CCATATCAGTAGACACGTCCAAGAACCAGTTCTC CCTGAAGCTGAGGTCTGTGACCGCCGCGGACAC GGCTGTGTATTACTGTGCGAGAGACTACGGTGCT TTTGATATCTGGGGCCAAGGCACATTGGTCACCG TCTCTTCA<br>SEQ ID NO: 30839 |
| | | AA | EIVLTQSPGTLSLSSGERATLSCRASPSVNSNYLA WYQQKPGQTPRLLIYGASNRATGVPDRFSASGS GTDFTLTIRRLEPEDFAVYFCQQYESSPWTFGQG TKVEIK<br>SEQ ID NO: 26834 |
| | | | QVQLQQWGAGLLKPSETLSLTCAVSGGSFRYYFW SWIRQSPGKGLEWFGEINHSGRTNYNPSLKSRVTIS VDTSKNQFSLKLRSVTAADTAVYYCARDYGAFDI WGQGTLVTVSS<br>SEQ ID NO: 30840 |

FIGURE 50
(Continued)

| | | | | |
|---|---|---|---|---|
| iPS:436082 | 21-225_195D9 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGCTGCATCCAGT TGCTAGGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACGGGCTAACAGTTTCCCTGC AGTTTTTGGCCAGGGGACCAAGCTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTCAGTCACTATGTCAT GCACTGGGTCCGCCAGGCTCCAGGCAAGGGCT GGAGTGGGTGGCAGTTATTTGGTATGATGAACT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATTGGTT CGGGGAGGGGAACTACTACGGTATGGAGTCTG GGGCCAAGGGACCACGGTCACCGTCTCCTCA |
| | | | SEQ ID NO: 26835 | SEQ ID NO: 30841 |
| | | AA | DIQMTQSPSSVSASVGDRVTITCRASQGISRWLA WYQQKPGKAPKLLIYAASSLLGGVPSRFSGSGS GTDFTLTISSLQPEDFATYYCQRANSFPCSFGQG TKLEIK | QVQLVESGGGVVQPGRSLRLSCAASGFTFSHYVM HWVRQAPGKGLEWVAVIWYDGTNKYYADSVKGR FTISRDNSKNTLYLQMNSLRAEDTAVYYCARDWF GEGNYYGMDVWGQGTTVTVSS |
| | | | SEQ ID NO: 26836 | SEQ ID NO: 30842 |
| iPS:436084 | 21-225_195F2 | NA | GAAATTGTGTCGACTCAGTCTCCAGACTTTCA GTCTGTGACTCCAAAGGAGAAAGTCACCATCA CCTGCCGGGCCAGTCAGAGCATTGGTAGTAGC TTACACTGGTACCAGCAGAAACCAGATCAGTC TCCAAAGCTCCTCATCAAGTATGCTTCCCAGT CCTTCTCAGGGGTCCCCTCGAGGTTCAGTGGC AGTGGATCTGGGACAGATTTCGCCCTCACCAT CAGTAGCCTGGAAGCTGAAGATGCTGCAACGT ATTACTGTCATCAGAGTAGAACTTTACCGCTC ACTTTCGGCGGAGGGACCAAGGTGGAGATCA AA | CAGGTGCAGCTGCAGGAGTCGGGCCCAGGACTG GTGAAGCCTTCACAGACCCTGTCCCTCACCTGCA CTGTCTCTGGTGACTCCATCAGCAGCGGTGGTTA CTACTGGAGCTGGATCCGCCAGCACCCAGGGAA GGGAGCACCAACTATAACCCGTCCCTCAAGAGTC GAGTTACCATATCAGTAGACATGTCTAAGAACCA GTTCTCCCTGAAGCTGAGCTCTGTGACTGCCGCG GACACGGCCGCGTGTATTATTGTGCAGAGGGGGT ATAACTGGAACAACGGGTTTGACTACTGGGGCC AGGGAGCCCTGGTCACCGTCTCCTCA |
| | | | SEQ ID NO: 26837 | SEQ ID NO: 30843 |

FIGURE 50
(Continued)

| | | | |
|---|---|---|---|
| iPS:436086 | 21-225_191G10 | AA | EIVLTQSPDFQSVTPKEKVTITCRASQSIGSSLHW YQQKPDQSPKLLIKYASQSFSGVPSRFSGSGSGT DFALTISSLEAEDAATYCHQSRTLPLTFGGGTK VEIK | QVQLQESGPGLVKPSQTLSLTCTVSGDSISSGGYYW SWIRQHPGKGLEWIGYSYYSGSTNYNPSLKSRVTIS VDMSKNQFSLKLSSVTDADTAVYYCARGGYNWN NGFDYWGQGALVTVSS |
| | | | SEQ ID NO: 26838 | SEQ ID NO: 30844 |
| | | NA | GACATCCAGATGACCCAGTCTCCTTCCTCACT GTCTGCATCTGTAGGAGACAGAGTCACCATCA CTTGTCGACGAGTCAGGGCATTGGCAAGTAT TTAGCCTGGTTTCAGCAGAAACCAGGGAAAGC CCCTAAGTCCCTGCTCTATAAAGTATCCAGTTT GCAAAGTGGGGTCCCATCAAGGTTCAGCGGCA GTGGATCTGGGACAGATTTCACTCTCACCATC AGCAGCCTGCAACAGTAGCCTGAAGATTTGCAACTTA TTACTGCCAACACAGTATATGACTTACCGCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCAGACTCCGTGAAGGAAGT AATAAAAACTATGCAGACTCCGTGAAGGCCGA TTCACCATCTCCAGAGACACAATTCCAAGAACACGC TGTATCTGCAAATGAACAGCCTGAGAGCCGAGG ACACGGCTGTGTATTACTGTGCGAGAGATCAGG CGTGGGCTACGACGGTTTGGACGTCTGGGGCCAA GGGACCACGGTCACCGTCTCCTCA |
| | | | SEQ ID NO: 26839 | SEQ ID NO: 30845 |
| | | AA | DIQMTQSPSSLSASVGDRVTITCRTSQGIGKYLA WFQQKPGKAPKSLLYKVSSLQSGVPSKFSGSGS GTDFTLTISSLQPEDFATYYCQQYMTYPLTFGGG TKVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDQGV GYDGLDVWGQGTTVTVSS |
| | | | SEQ ID NO: 26840 | SEQ ID NO: 30846 |

FIGURE 50
(Continued)

| | | | | |
|---|---|---|---|---|
| iPS:436088 | 21-225_195C8 | NA | GAAATTGTGTTGACGCAGTCTCCAGGCACCCT GTCTTTGTCTCCAGGGGAAAGAGCCACCCTCT CCTGCAGGGCCAGTCAGTACCAACAGAAACCTGGCCA TTCTTAGCCTGGTACCAACAGAAACCTGGCCA GGCTCCCAGGCTCCTCATCTATGGTGCATTA GTAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGTAACTCACCG TGGGCGTTCGGCCAAGGGACCAAGGTGGAAA TCAAA<br><br>SEQ ID NO: 26841 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGTCCCCAGGGAA GGGCCTGGAGTGGATTGGGTACATCTTTACAGT GGGAGCACTTACTACAACCGTCCCTCAAGAGTC GACTTACCATATCAGTGGACAGTCTAAGAACCA GTTCTCCCTGAAGCTGAGCTCTGTGACTGCCGCG GACACGGCCGTGTATTACTGTGCGAGAGGGATT ACGATGGTTCGGGGAGTTATCACTTCTACTACGG TATGGACGTCTGGGGCCAAGGGACCACGGTCAC CGTCTCCTCA<br><br>SEQ ID NO: 30847 |
| | | AA | EIVLTQSPGTLSLSPGERATLSCRASQSIRSSFLA WYQQKPGQAPRLLIYGAFSRATGIPDRFSGSGSG TDFTLTISRLEPEDFAVYYCQQYGNSPWAFGQG TKVEIK<br><br>SEQ ID NO: 26842 | QVQLQESGPGLVKPSQTLSLTCTVSGGSISSGDYYW NWIRQLPGKGLEWIGYIFYSGSTYYNPSLKSRLTISV DTSKNQFSLKLSSVTAADTAVYYCARGDYDGSGS YHFYYGMDVWGQGTTVTVSS<br><br>SEQ ID NO: 30848 |
| iPS:436090 | 21-225_195A9 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGAACAGATTCACTCTCACCATC AGCAGCCTGCAACATTATCTTACTTACCCTCAC TTTCGGCGGAGGGACCAAGGTGGAGATCAAA<br><br>SEQ ID NO: 26843 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GCAGTGGGTGGCAGTTATATGGTATGATGGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATACTACGGTTTGATCGTGCGAGAGATAGGGG GGTGGGTTACTACGGTTTGACGTCTGGGGCCAA GGGACCACGGTCACCGTCTCCTCA<br><br>SEQ ID NO: 30849 |

FIGURE 50
(Continued)

| | | | |
|---|---|---|---|
| iPS:436092 | 21-225_195B9 | AA | DIQMTQSPSSLSASVGDRVTITCRASQGISNYLAWFQQKPGKAPKSLIYAASSLQSGVPSKFSGSGSGTDFTLTISSLQPEDFATYYCQHYLTYPLTFGGGTKVEIK | QVQLVESGGGVVQPGRSLRLSCAASGFTFSSYGMHWVRQAPGKGLQWVAVIWYDGSNEHYADSVKGRFTISRDNSKNTLYLQMNSLRAEDTAVYYCARDRGVGYYGLDVWGQGTTVTVSS |
| | | | SEQ ID NO: 26844 | SEQ ID NO: 30850 |
| | | NA | GACATCCAGATGACCCAGTCTCCATCCTCCCTGTCTGCATCTGTAGGAGACAGAGTCACCATCACTTGCCGGGCAAGTCAGGGCATAAGAAATAACTTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATCTCACTCTCACAATCAGCAGCCTGCAGCCTGAAGATTTTGCAACTTATTGCTGTCTACAGCATTATCGTTACCCATTCACTTTCGGCCCTGGGACCAAAGTGGATTTCAAA | CAGGTGCAACTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAGTTATATGCATGTATGGAAGTAATAAATACTATGCAGACTCCGTGAAGGGCCGATTCACCATCTCCAGAGACAACAGCAAGAACACGCTGTATCTGCAAATGAACAGCCTGAGAGCCGAGGACACGGCTGTGTATTACTGTGCGAGAGATGGCTACAATTCAGGTACTACTACGGTATGGACGTCTGGGGCCAAGGGACCACGGTCACCGTCTCCTCA |
| | | | SEQ ID NO: 26845 | SEQ ID NO: 30851 |
| | | AA | DIQMTQSPSSLSASVGDRVTITCRASQGIRKDLGWYQQKPGKAPKRLIYAASDLQSGVPSRFSGSGSGTEFTLTISSLQPEDFATYCCLQHYRYPFTFGPGTKVDFK | QVQLVESGGGVVQPGRSLRLSCAASGFTFSSYGMHWVRQAPGKGLEWVAVIWYDGSNKYADSVKGRFTISRDNSKNTLYLQMNSLRAEDTAVYYCAREWLQFRYYYGMDVWGQGTTVTVSS |
| | | | SEQ ID NO: 26846 | SEQ ID NO: 30852 |

FIGURE 50
(Continued)

| | | | | |
|---|---|---|---|---|
| iPS:436094 | 21-225_195B10 | NA | GAAATTGTGCTGACTCAGTCTCCAGACTTTCAGTCTGTGACTCCAAAGGAGAAAGTCACCATCACCTGCCGGGCCAGTCAGAGCAGAAACCAGATCAGTGGTTATACACTGGTACCAGCAGAAACCAGATCAGTCCTAAAGCTCCTCATCAAGTATGCTTCCCAGTCCTTCTCAGGGGTCCCCTCGAGGTTCAGTGGCAGTGGATCGGGACAGATTTCACCCTCACCATCAATAGCCTGGAAGCTGAAGATGCTGCAAGCGTATTACTGTCATCAGAGTGGTCGTTTACCGCTCACTTTCGGCGGAGGGACCAAGGTGGAGATCAA | CAGGTGCAGCTGCAGGAGTCGGGCCCAGGACTGGTGAAGCCTTCACAGACCCTGTCCCTCACCTGCACTGTCTCTGGTGGCTCCATCAGCAATAGTGGTTACTACTGGAGCTGGATCCGCCAGCACCCAGGGAAGGGCCTGGAATGGATTGGGTACATGTATTACAGTGGGAGCACTTACTACAACCCGTCCCTCAAGAGTCGGGTTTATCTGAAGCTGAGCGCTGTGACTGCCGCGGACACGGCCGTGTATTACTGTGCGAAAGGGGGTATAACTGGAACAATGGGTTTGACTGTTGGGGCCAAGGGAACCCTGGTCACCGTCCTCTCA |
| | | | SEQ ID NO: 26847 | SEQ ID NO: 30853 |
| | | AA | EIVLTQSPDFQSVTPKEKVTITCRASQSIGSSLHWYQQKPDQSPKLLIKYASQSFSGVPSRFSGSGSGTDFTLTINSLEAEDAATYYCHQSGRLPLTFGGGTKVEIK | QVQLQESGPGLVKPSQTLSLTCTVSGGSISNSGYYWSWIRQHPGKGLEWIGYMYYSGSTYYNPSLKSRVTISVDTSKNQFYLKLSAVTAADTAVYYCAKGGYNWNNGFDCWGQGTLVTVSS |
| | | | SEQ ID NO: 26848 | SEQ ID NO: 30854 |
| iPS:436096 | 21-225_195E10 | NA | GAAATTGTGCTGACTCAGTCTCCAGACTTTCAGTCTGTGACTCCAAAGGAGAAAGTCACCATCACCTGCCGGGCCAGTCAGAGTCAGAGCATTGGTAGCTTACACTGGTACCAGCAGAAACCAGATCAGTCCTAAAGCTCCTCATCAAGTATGCTTCCCAGTCCTTCTCAGGGGTCCCCTCGAGGTTCAGTGGCAGTGGATCGGGACAGATTTCACCCTCACCATCAATAGCCTGGAAGCTGAAGATGCTGCAACGTATTACTGTCATCAGAGTAGTCGTTTACCATTCACTTTCGGCCCTGGGACCAAAGTGGATATCAAA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGTTACTACTGGAGCTGGATCCGCCAGCACCCAGGGAAGGGCCTGGAGTGGATTGGGTACATCTATTACAGTGGGAGCACTTACTACAACCCGTCCCTCAAGAGTCGAGTTACCATATCAGTAGACACGTCTAAGAACCAGTTCTCCCTGAAGCTGAGCTCTGTGGCTGCCGCGGACACGGCCGTGTATTGTGCGAGAGGGGGTATAACTGGAACCACGGTATGGACGTCTGGGGCCAAGGGACCACGGTCACCGTCTCCTCA |
| | | | SEQ ID NO: 26849 | SEQ ID NO: 30855 |

FIGURE 50
(Continued)

| | | | | |
|---|---|---|---|---|
| iPS:436098 | 21-225_195G11 | AA | EIVLTQSPDFQSVTPKEKVTITCRASQSIGSSLHW YQQKPDQSPKLLIKYASQSFSGVPSRFSGSGSGT DFTLTINSLEAEDAATYYCHQSSRLPFTFGPGTK VDIK<br>SEQ ID NO: 26850 | QVQLQESGPGLVKPSQTLSLTCTVSGGSISSGGYYW SWIRQHPGKGLEWIGYIYSGSTYYNPSLKSRVTIS VDTSKNQFSLKLSSVAAADTAVYYCARGGYNWN HGMDVWGQGTTVTVSS<br>SEQ ID NO: 30856 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAAC TCCAACAATAAGAACTACTTAGCTTGGTACCA GCAGAAACCCGGTCAGCCTCCTAAGCTGCTCA TTTACTGGGCATCTACCCTGGAATCTGGGGTC CCTGACCGATTCAGTGGCAGCGGGTGTGGAC AGATTTCACTCTCACCATCAGCAGCATGCAGG CTGAAGATGTGGCAGTTTATTACTGTCAGCAA TATTGTAGTTTTCCATTCACTTTCGGCCCTGGG ACCAAAGTGGATATCAGA<br>SEQ ID NO: 26851 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGCTTTCATACATTAGTAGTAGTGGTACT ACCGTATTCTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br>SEQ ID NO: 30857 |
| | | AA | DIVMTQSPDSLAVSLGERATINCKSSQSVLFNSN NKNYLAWYQQKPGQPPNLLIYWASTLESGVPD RFSGSGCGTDFTLTISSMQAEDVAVYYCQQYCS FPFTFGPGTKVDIR<br>SEQ ID NO: 26852 | QVQLVESGGGLVKPGGSLRLSCAASGFTFSDYMS WIRQAPGKGLEWLSYISSSGTTVFYADSVKGRFTIS RDNAKNSLYLQMNSLRAEDTAVYYCAREWVGAD YWGQGTLVTVSS<br>SEQ ID NO: 30858 |

FIGURE 50
(Continued)

| | | | |
|---|---|---|---|
| iPS:436100 | 21-225_195G12 | NA | GACATCCAGATGACCCAGTCTCCATCTTCCGT GTCTGCATCTGTAGGAGACAGAGTCACCATCA CTTGTCGGGCGAGTCAGGGTATTAACAACTGG TTAGCCTGGTATCAGCAGAAACCAGGGAAAG CCCCTAAGCTCCTGATCTATGGTGTTTCCAGTT TGCAGAGTGGGGGTCCCATCAAGGTTCAGCGGC AGTGGATCTGGGACAGATTTCACTCTCACCAT CAGCAGCCTGCAGCCTGAAGATTTTGCAACTT ACTCTTGTCAACAGGCTAACAGTTTCCCGTGG ACGTTCGGCCCTGAGGGACCAAGGTGAAAATC AG | GAGGTGCAGCTGTTGGAGTCTGGGGGAGGCTTG GTACAGCCTGGGGGGTCCCTGAGACTCTCCTGTG CAGCCCTCTGATTCACCTTTAGCACCTATGCCAT GAGTTGGGTCCGCCAGGCTCCAGGGAAGGGCT GGAGTGGGTCTCAGTTATTAGTCGTAGTGGTGGT AACACACTACGCAGACTCCGTGAAGGGCCGG TTCACCATCTCCAGAGACAATTCCAAGAATACGC TGTATCTGCAAATGAACAGCCTGAGAGCCGAGG ACACGGCCGTATATTCCTGTGCGAAAGATGGATT CGGTGGGAGCTCCTACTTTGACTACTGGGGCCAG GGAACCCTGGTCACCGTCTCCTCA |
| | | | SEQ ID NO: 26853 | SEQ ID NO: 30859 |
| | | AA | DIQMTQSPSSVSASVGDRVTITCRASQGINNWLA WYQQKPGKAPKLLIYGVSSLQSGVPSRFSGSGS GTDFTLTISSLQPEDFATYSCQQANSFPWTFGRG TKVENQ | EVQLLESGGGLVQPGGSLRLSCAASGFTFSTYAMS WVRQAPGKGLEWVSAISRSGGNTHYADSVKGRFTI SRDNSKNTLYLQMNSLRAEDTAVYSCAKDGFGGS SYFDYWGQGTLVTVSS |
| | | | SEQ ID NO: 26854 | SEQ ID NO: 30860 |
| iPS:436102 | 21-225_196B1 | NA | GACATCGTGATGACCCAGTCTCCAGACTCCCT GGCTGTGTTTCTGGGCGAGAGGGCCACCATCA ACTGCAAGTCCAGCCAGAGTATTTATTCAGC TCCAACAATAAGAGGTACTTAGCTTGGTATCA GCAGAAACCAGGACAGCCTCCTAAGCTGCTCA TTTACTGGGCATCTATCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTCTAGTCTTCCATTCACTTTCGGCCCTGGG ACCAAAGTGGATATCAAA | CAGGTGCAGCTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGATTTCATACATTAGTAGTAGTGGTATT ACCATGTACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCGACTACTGGGGCCAGGGAACCCTGGTC ACCGTCTCCTCA |
| | | | SEQ ID NO: 26855 | SEQ ID NO: 30861 |

FIGURE 50
(Continued)

| | | | |
|---|---|---|---|
| iPS:436104 | 21-225_196C1 | AA | DIVMTQSPDSLAVFLGERATINCKSSQSILFSSNN KRYLAWYQQKPGQPPKLLIYWASIRESGVPDRF SGSGSGTDFTLTISSLQAEDVAVYYCQQYSSLPF TFGPGTKVDIK<br><br>SEQ ID NO: 26856 | QVQLVESGGGLVKPGGSLRLSCAASGFTFSDYYMS WIRQAPGKGLEWISYISSSGITMYADSVKGRFTIS RDNAKNSLYLQMNSLRAEDTAVYYCAREWVGAD YWGQGTLVTVSS<br><br>SEQ ID NO: 30862 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATTCAAC TCCAACAATAAGAACTACTTAGCTTGGTACCA GCAGAAACCCGGTCAGTCTCCTAACCTGCTCA TTTACTGGGCATCTACCCCTGGAATCTGGGGTC CCTGACCGATTCAGTGGCAGCGGGTCTGTGGAC AGATTTCACTCTCACCATCAGCAGCATGCAGG CTGAAGATGTGGCAGTTTATTACTGTCAGCAA TATTGTAGTTTTCCATTCACTTTCGGCCCTGGG ACCAAAGTGGATATCAGA<br><br>SEQ ID NO: 26857 | CAGGTGCAACTGGTGGAGTCTGGGGGAGGCTTG GTCAAGCCTGGAGGGTCCCTGAGACTCTCCTGTG CAGCCTCTGGATTCACCTTCAGTGACTACTACAT GAGCTGGATCCGCCAGGCTCCAGGGAAGGGGCT GGAGTGGCTTTCATACATTAGTAGTAGTGGTACT ACCGTATTCTACGCAGACTCTGTGAAGGGCCGAT TCACCATCTCCAGGGACAACGCCAAGAACTCACT GTATCTGCAAATGAACAGCCTGAGAGCCGAGGA CACGGCCGTGTATTACTGTGCGAGAGAATGGGTG GGAGCCGACTACTGGGGCCAGGGAACCCTGGTC ACCGTCTCCTCA<br><br>SEQ ID NO: 30863 |
| | | AA | DIVMTQSPDSLAVSLGERATINCKSSQSVLFNSN NKNYLAWYQQKPGQLPNLLIYWASTLESGVPD RFSGSGCGTDFTLTISSMQAEDVAVYYCQQYCS FPFTFGPGTKVDIR<br><br>SEQ ID NO: 26858 | QVQLVESGGGLVKPGGSLRLSCAASGFTFSDYYMS WIRQAPGKGLEWLSYISSSGTTVFYADSVKGRFTIS RDNAKNSLYLQMNSLRAEDTAVYYCAREWVGAD YWGQGTLVTVSS<br><br>SEQ ID NO: 30864 |

FIGURE 50
(Continued)

| | | | | |
|---|---|---|---|---|
| iPS:436106 | 21-225_196F2 | NA | GACATCCAGATGACCCAGTCTCCATCTTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAACTCCTGATCTATGCTGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAACTT ACTATTGTCAACAGACTAACAGTGTCCATTC ACTTTCGGCCCTGGGACCAAAGTAGATATCAA A | CAGGTGCAGCTGGTGGAGTCTGGGGGAGGCGTG GTCCAGCCTGGGAGGTCCCTGAGACTCTCCTGTG CAGCCTCTGATTCACCTTCAGTAGTCTTTGGCAT GCACTGGGTCCGCCAGGCTCCAGGCAAGGGCT GGAGTGGGTGGCAGTTATATTAATGATGAAGT AATAAAAAGTGTGCAGACTCGTGAAGGCCGA TGCACCATTCCAGAGACAACTCCAAGAACACGC TGTATCTGCAAATGAACAGCCTGAGAGCTGAGG ACACGGCTGTTTATTACTGTGCGAGAGACAGCA GTGGCTGGTAACGGTGTGACGTCTGGGGCCA GGGGACCACGGTCACCGTCTCCTCA |
| | | | SEQ ID NO: 26859 | SEQ ID NO: 30865 |
| | | AA | DIQMTQSPSSVSASVGDRVTITCRASQGISSWLA WYQQKPGKAPKLLIYAASSLQSGVPSRFSGSGS GTDFTLTISSLQPEDFATYCQQTNSVPFTFGPGT KVDIK | QVQLVESGGGVVQPGRSLRLSCAASGFTFSSFGMH WVRQAPGKGLEWVAVILNDGSNKKCADSVKGRC TISRDNSKNTLYLQMNSLRAEDTAVYYCARGQQW LVNGVDVWGQGTTVTVSS |
| | | | SEQ ID NO: 26860 | SEQ ID NO: 30866 |
| iPS:436110 | 21-225_196F4 | NA | GACTTTCAGATGATCCAGTCTCCATCCTCCTG TCTGCATCTGTAGGCGACAGAGTCACCATCAC TTGCCGGGCAAGTCAGGCCATTCACAGCTATT TAAATTGGTATCAGCAGAAACCAGGGAAAGC TCCTAAGCTCCTGATCTATACTGCATCCAGTTT GCAAGGTGGGTCCCATCAAGGTTCAGTGGCA GTGGATCTGGGACAGATTTCACTCTCACCATC AGCAGTCTGCAGCCTGAAGATTTTGCAACTTA CTACTGTCAACAGAGCTACGGTCCCTCCTCA CTTTCGGCGGAGGGACCAAGGTGGAGATCAA A | GAGGTGCAGCTGTTGGAGTCTGGGGGAGGCTTG GTACAGCCTGGGGGGTCCCTGAGATTCTCCTGTG CAGCCTCTGGATTCACCTTTAGCAGCTGTGCCAT GACCTGGGTCCGCCAGGCTCCAGGGAAGGGGCT GGAGTGGGTCTCAGCTATTAGTAGTAGTGGTGGT AGCACATACTACGCAGACTCCGTGAAGGGCCGG TTCACCATTTCCAGAGACAATTCCAAGAACAGC TGTATCTGCAAATGAACAGCCTGAGAGCCGAGG ACACGGCCGTATATTACTGTGCGAAAGTGGGG GTTTGACTGGCTCCTACTACTACTACGGTATGA CGTCTGGGGCCAAGGGACCACGGTCACCGTCTCC TCA |
| | | | SEQ ID NO: 26861 | SEQ ID NO: 30867 |

FIGURE 50
(Continued)

| | | | | |
|---|---|---|---|---|
| | | AA | DFQMIQSPSSLSASVGDRVTITCRASQRIHSYLN WYQQKPGKAPKLLIYTASSLQGGVPSRFSGSGS GTDFTLTISSLQPEDFATYYCQQSYGSPLTFGGG TKVEIK | EVQLLESGGGLVQPGGSLRFSCAASGFTFSSCAMT WVRQAPGKGLEWVSAISGSGGSTYYADSVKGRFTI SRDNSKNTLYLQMNSLRAEDTAVYYCAKVGGLTG SYYYYGMDVWGQGTTVTVSS |
| | | | SEQ ID NO: 26862 | SEQ ID NO: 30868 |
| iPS:436112 | 21-225_196C7 | NA | GACATCCAGATGACCCAGTCTCCATCCTCACT GTCTGCATCTGTAGGAGACAGAGTCACCATCA CTTGTCGGGCAATCAGCCATTAGCAATTAT TTAGCCTGGTTTCAGCAGAAACCAGGGAAAGC CCCTAAGTCCCTGATCTATGCTGCATCCAGTTT GCAAAGTGGGGTCCCATCAAGTTCAGCGGCA GTGGATCTGGAACAGATTTCACTCTCACCATC AGCAGCCTGCAGCCTGAAGATTTTGCAACTTA TTACTGCCAACATTATCTCACTTACCCTCTCAC TTTCGGGGGAGGGACCAAGGTGGAGATCAAA | CAGGTGCAGCTGGTGGAGTCTGGGGGAGGCGTG GTCCAGCCTGGGGAGGTCCCTGAGACTCTCCTGTG CAGCGTCTGCTGATTCACCTTCAGTAGTAGTGCAT GCACTGGGTCCGCCAGGCTCCAGGCAAGGGGCT GGAGTGGGTGGCAGTTATATGCAGACTCCGTGAAGGGCCGA AATGAACACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAGATAGGGG GGTGGGTTACTACGGTTTGGACGTCTGGGGCCAA GGGACCACGGTCACCGTCTCCTCA |
| | | | SEQ ID NO: 26863 | SEQ ID NO: 30869 |
| | | AA | DIQMTQSPSSLSASVGDRVTITCRANQAISNYLA WFQQKPGKAPKSLIYAASSLQSGVPSKFSGSGSG TDFTLTISSLQPEDFATYYCQHYLTYPLTFGGGT KVEIK | QVQLVESGGGVVQPGRSLRLSCAASGFTFSSYGMH WVRQAPGKGLEWVAVIWYDGSNEHYADSVKGRF TISRDNSKNTLYLQMNSLRAEDTAVYYCARDRGV GYYGLDVWGQGTTVTVSS |
| | | | SEQ ID NO: 26864 | SEQ ID NO: 30870 |

FIGURE 50
(Continued)

| | | | |
|---|---|---|---|
| iPS:436114 | 21-225_196G8 | NA | GACATCGTGATGACCCAGTCTCCAGACTCCCTGACTGTGTCTGTGGGCGAGAGGGCCACCGTCAACTGCAAGTCCAGCCAGAGTGTTTTACACAGCTCCAACAATAACAACTACTTAGCTTGGTACCAGCAGAAACCAGGACAGCCTCCTAAGCTGCTCATTTACTGGGCATCTACCCGGGAATCCGAGTCCCTGACCGATTCAGTGGCAGCGGGTCTGGGACAGATTTCACTCTCGCCATCAGCAGCCTGCAGGCTGAAGATGTGGCGGTTTATTACTGTCAGCAATATTATAATACTCCTCGACAATTGGCCAAGGGACCAAGGTGGAAATCAAA SEQ ID NO: 26865 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGATGCGGCAGGCCACTGGTCAAGGCTTGAGTGGATGGGATGGATGCACCTTAACAGTGGTAACAGGCTATGCACCGAAGTTCCAGGGCAGAGTCACCATGACCAGGGACACCTCCATAAGCACAGCCTTCATGGAGCTGAGCAGCCTGAGATCTGAGGACACGGCCGTGTACTATTGTGCCTATAGCGGTGGCTGGTACGTGTTTGACCCCTGGGGCCAGGGAACCCTGGTCACCGTCTCCTCA SEQ ID NO: 30871 |
| | | AA | DIVMTQSPDSLTVSLGERATVNCKSSQSVLHSSNNNNYLAWYQQKPGQPPKLLIYWASTRESGVPDRFSGSGSGTDFTLAISSLQAEDVAVYYCQQYYNTPPTFGQGTKVEIK SEQ ID NO: 26866 | QVQLVQSGAEVKKPGASVKVSCKASGYTFTNYDINWMRQATGQGLEWMGWMHLNSGNTGYAPKFQGRVTMTRDTSISTAFMELSSLRSEDTAVYYCAYSGGWYVFDPWGQGTLVTVSS SEQ ID NO: 30872 |
| iPS:436116 | 21-225_196B9 | NA | GACATCCAGATGACCCAGTCTCCATCTTCCGTGTCTGCATCTGTAGGAGACAGAGTCACCATCACTTGTCGGGCGAGTCAGGGTATTAGCAACTGCTTAGCCTGGTATCAGCAGAAACCAGGGAAAGCCCCTAAGTTCCTGATCTGTGCTGCATCCAGTTTGCAAAGTGCGGTCCCATCAAGGTTCAGCGGCAGTGGATCTGGGACAGATTTCACTCTCACCATCAGCAGCCTGCAGCCTGAAGATTTTGCATCTTACTATTGTCAAAGGGTGACAGTTTCCCTCCGACGTTCGGCCAAGGGACCAAGGTGAATTCAGA SEQ ID NO: 26867 | CAGGTGCAGCTGGTGCAGTCTGGGGCTGAGGTGAAGAAGCCTGGGGCCTCAATGAAGGTCTCCTGCAAGGCTTCTGGATACACCTTCACCGGCTACTATATGCACTGGGTGCGACAGGCCCCTGGACAAGGGCTTGAGTGGATGGGATGGATCAACCCTAACAGTGGTGGCACAAACTTTGCACAGAAGTTTCGGGGCAGGGTCACCATGACCAGGGACACGTCCATCAGCACAGCCTACATGGAGCTGAGCAGCCTGAGATCTGACGACACGGCCGTGTATTACTGTGCGAGAGGGGGCGTTCGGGGAGTTCCCAACTACTACTACGTTATGGACGTCTGGGGCCAAGGGACCACGGTCACCGTCTCCTCA SEQ ID NO: 30873 |

FIGURE 50
(Continued)

| | | | |
|---|---|---|---|
| | | AA | DIQMTQSPSSVSASVGDRVTITCRASQGISNCLAWYQQKPGKAPKFLICAASSLQSAVPSRFSGSGSGTDFTLTISSLQPEDFASYYCQQGDSFPPTFGQGTKVEFR | QVQLVQSGAEVKKPGASMKVSCKASGYTFTGYYMHWVRQAPGQGLEWMGWINPNSGGTNFAQKFRGRVTMTRDTSISTAYMELSRLSSDDTAVYYCARGGVRGVPNYYVMDVWGQGTTVTSS |
| | | | SEQ ID NO: 26868 | SEQ ID NO: 30874 |
| iPS:436118 | 21-225_196A10 | NA | GACATCCAGATGACCCAGTATCCATCTTACGTGTCTGCATCTGTAGGAGACAGAGTCAGATCACTTGTCGGGCGAGTCAGGGTATTAGCAGCAGGTGGTTAGCCTGGTATCAGCAGAAGCCAGGGAAAGCCGCCAAGTTCCTGATCTATGCTGCATCCAGTTTGCTAGGTGGGGTCTCATCAAGGTTCAGCGGCAGTGGATCTGGGACAGATTTCACTCTCACCATCAGCAGCCTGCAGCCTGAAGATTTTGCAATTTACTATTGTCAACGGGATAAACAGTTACCGTGCAGTTTTGGCCAGGGGACCAAGCTGGAGATCAAA | CAGGTGCAGCTGGTGGAGTCTGGGGGAGGCGTGGTCCAGCCTGGGAGGTCCCTGAGACTCTCCTGTGCAGCGTCTGATTCACCTTCAGTCACTATGTCATGCACTGGGTCCGCCAGGCTCCAGGCAAGGGGCTGGAGTGGGTGGCAGTTATTTGGTATGATGGAACTAATAAATACTATGCAGACTCCGTGAAGGGCCGATTCACCATCTCCAGAGACAACAATTCCAAGAACACGCTGTATCTGCAAATGAACAGCCTGAGAGCCGAGGACACGGCTGTGTATTACTGTGCGAGAGATTGGTCGGGGAGGGAACTACTACGGTATGGACGTCTGGGGCCAAGGGACCACGGTCACCGTCTCCTCA |
| | | | SEQ ID NO: 26869 | SEQ ID NO: 30875 |
| | | AA | DIQMTQYPSYVSASVGDRVSITCRASQGISRWLAWYQQKPGKAAKFLIYAASSLLGGVSSRFSGSGSGTDFTLTISSLQPEDFAIYYCQRDNSLPCSFGQGTKLEIK | QVQLVESGGGVVQPGRSLRLSCAASGFTFSHYMHWVRQAPGKGLEWVAVIWYDGTNKYYADSVKGRFTISRDNSKNTLYLQMNSLRAEDTAVYYCARDWFGEGNYYGMDVWGQGTTVTSS |
| | | | SEQ ID NO: 26870 | SEQ ID NO: 30876 |

FIGURE 50
(Continued)

| | | | | |
|---|---|---|---|---|
| iPS:436120 | 21-225_196C10 | NA | GACATCCAGATGACCCAGTCTCCATCCTCCTGTCTGCATCTGTAGGAGACAGAGTCACCATCACTTGCCGGGCAAGTCAGGGCATTAGAGGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGTTCTGGGACAGAATTCACTCTCACAATCAGCAGCCTGCAGCCTGAAGATTTTGCAACTTATTACTGTCTACAATATAATAGTTACCCTCTCACTTTCGGCGGAGGGACCAAGGTGGAGATCAAA | CAGGTGCAGCTGCAGGAGTCGGGCCCAGGACTGGTGAAGCCTTCACAGACCCTGTCCCTCACCTGCACTGTCTCTGGTGGCTCCATGAGGAGTGGTGGTGACTACTGGAGCTGGATCCGCCAGCACCCAGGGAACTGGGCCTGGAGTGGTTTGGGTTCATCTATTACAGTGGGAGCACCTACTACAATCCGTCCCTCAAGAGTCGAGTTACCTTATCAGTAGACACGTCTAAGAACCAGTTCTCCCTGAAGCTGAGCTCTGTGACTGCCGCGGACACGGCCGTGTATTACTGTGCGAGAATGGACTACAGTAACTACTACGGTATGGACGTCTGGGGCCAAGGGACCACGGTCACCGTCCTCCTCA |
| | | AA | SEQ ID NO: 26871<br>DIQMTQSPSSLSASVGDRVTITCRASQGIRNDLGWYQQKPGKAPKRLIYAASSLQSGVPSRFSGSGSGTEFTLTISSLQPEDFATYYCLQYNSYPLTFGGGTKVEIK | SEQ ID NO: 30877<br>QVQLQESGPGLVKPSQTLSLTCTVSGGSMRSGGDYWSWIRQHPGKGLEWFGFIYYSGSTYYNPSLKSRVTLSVDTSKNQFSLKLSSVTAADTAVYYCARMDYSNYYYGMDVWGQGTTVTVSS |
| | | | SEQ ID NO: 26872 | SEQ ID NO: 30878 |
| iPS:436122 | 21-225_196G10 | NA | GAAATTGTGTTGACGCAGTCTCCAGGCACCCTGTTATTGTCTCCGGGGAAAGAGCCACCCTCTCCTGCAGGGCCAGTCCGAGTGTTAGCAACAGCTTCTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCAACAGCAGACTGGAGCCTGAAGATTTTGCAGTGTATTACTGTCAGCAGTATGGTAGCTCACCTCCGTGGACGTTCGGCCAAGGGACCAAGGTAGAACTCAAA | GAGGTGCAGCTGGTGGTGGAGTCTGGGGGAGGCCTGGTCAAGCCTGGGGGGTCCCTGAGACTCTCCTGTGCAGCCTCTGGATTCACCTTCAGGACTACTAGCATGAACTGGGTCCGCCAGGCTCCAGGGAAGGGCTGGAGTGGGTCTCATCATTAGTAGTAGTGGTTACATACACTACGCAGACTCAGTGAAGGGCCGATTCACCATCTCCAGAGACAACGCCAAGAACTCACTGTATCTGCAAATGAACAGCCTGAGAGCCGAGGACACGGCTGTGTATTACTGTGCGAGCAACTATGGCCCTTGACTACTGGGGCCAGGGAACCCTGGTCACCGTCTCCTCA |
| | | | SEQ ID NO: 26873 | SEQ ID NO: 30879 |

FIGURE 50
(Continued)

| | | | |
|---|---|---|---|
| iPS:436132 | 21-225_196C12 | AA | EIVLTQSPGTLLLSPGERATLSCRASPSVSNSFLA WYQQKPGQAPRLLIYGASSRATGIPDRFSGSGSG TDFTLTNSRLEPEDFAVYYCQQYGSSPWTFGQ GTKVELK<br>SEQ ID NO: 26874 | EVQLVESGGGLVKPGGSLRLSCAASGFTFRDYSMN WVRQAPGKGLEWVSSISSGSGYIHYADSVKGRFTIS RDNAKNSLYLQMNSLRAEDTAVYYCARATMALD YWGQGTLVTVSS<br>SEQ ID NO: 30880 |
| | | NA | GACATCCAGATGACCCTGTCTCCATCTCCT GTTTGCATGTCTAGGAGACAGAGTCATCATCA CTTGCCGGGCAAGTCAGGCATTAGAAATGAT CTAGGCTGGTCTCAGCAGAATCAGGGAAAGC CCCTAAGCGCCTGATCTATGCTGCATCCAGTTT GCAAAGTGGGGTCCCATCAAGGTTCAGCGGCA GTGGATCTGGGACAGAGATTCACTACTCACAATC AGCAGCCTGAGCCTGAAGATTTTGAAACTTA TTACTGTCTACAGCATAATGATTCCCGTTCAC TTTCGGCCGAGGGACCAAGGTGGAGATCAAA<br>SEQ ID NO: 26875 | CAGGTGCAGCTGGTGCAGTCTGGGGCTGAGGTG AAGAAGCCTGGGGCTCAGTGAAGGTCTCCTGC AAGGCTTCTGGATACACCTTCATCAGTTATGATA TCAACTGGGTGCGACAGGCCACTGGACAAGGC TTGAGTGGATGGATGGATGAACCCTAAAAGGG GTAACACAGGCTATGCACAGAAGTTCCAGGGCA GAGTCACCATGACCAGGACACCTCCATAAGCA CAGCCTACATGGAGCTGAGCAGCCTGAGATCTG AGGACACGGCCGTTTATTACTGTGCGAGAGGAG ACCCGTATAACTGAACTCCTACGTATGGACGT CTGGGGCCAAGGGACCACGGTCACCGTCTCCTCA<br>SEQ ID NO: 30881 |
| | | AA | DIQMTLSPSSLFACVGDRVIITCRASQGIRNDLG WSQQNPGKAPKRLIYAASSLQSGVPSRFSGSGSG TEFTITISSLQPEDFETYYCLQHNDFPFTFGRGTK VEIK<br>SEQ ID NO: 26876 | QVQLVQSGAEVKKPGASVKVSCKASGYTFISYDIN WVRQATGQGLEWMGWMNPKRGNTGYAQKFQGR VTMTRDTSISTAYMELSSLRSEDTAVYYCARGDPY NWNSYAMDVWGQGATVTVSS<br>SEQ ID NO: 30882 |

FIGURE 50
(Continued)

| | | | | |
|---|---|---|---|---|
| iPS:436134 | 21-225_196H12 | NA | GAAATTGTGTTGACGCAGTCTCCAGGCACCCT GTTTTGTCTCCAGGGGAAAGAGCCACCCTCT CCTGCAGGGCCAGTCAGTGTTAGAAGCAAC TTCTTAGCCTGGCACCAGCAGAAACCTGGCCA GGCTCCCAGGCTCCTCATCTATGGTGCATAC CGCAGGGCCACTGGCATCCCAGACAGGTTCAGT GGCAGTGGGTCTGGGACAGATTCACTCTCAC CATCAACAGACTGGAGCCTGAAGATTTTGCAG TGTATTACTGTCAGCAGTATGGTAACTCACCG TGGACGTTCGGCCAAGGGACCAAGGTGGAAA TCAAA<br><br>SEQ ID NO: 26877 | CAGGTGCAGCTGCAGGAGTCGGGCCCAGGACTG GTGAACCCTTCACAGACCCTGTCCCTCACCTGCA CTGTCTCTGGTGGCTCCATCAGCAGTGGTGTTTA CTACTGGAGCTGGATCCGCCAGCACCCAGGGAA GGGCCTGGAGTGGATTGGGAACATCTATTACAGT GGGAGCACTACAACAACCGTCCCTCAAGAGT CGAATTATCATATCAGTAGACACGTCTAAGAACC AGTTCTCCCTGAAGCTGAGCTCTGTGACTGCCGC GGACACGGCCGTGTATTACTGTGCGAGAGGGA TTACGATGGTTCGGGGAGTTATCACTACTACTAC GGTTTGGACGTCTGGGGCCAAGGGACCACGGTC ACCGTCTCCTCA<br><br>SEQ ID NO: 30883 |
| | | AA | EIVLTQSPGTLFLSPGERATLSCRASQSVRSNFLA WHQQKPGQAPRLLIYGAYRRATGIPDRFSGSGS GTDFTLTINRLEPEDFAVYYCQQYGNSPWTFGQ GTKVEIK<br><br>SEQ ID NO: 26878 | QVQLQESGPGLVNPSQTLSLTCTVSGGSISSGVYYW SWIRQHPGKGLEWIGNIYYSGSTYNNPSLKSRIIISV DTSKNQFSLKLSSVTAADTAVYYCARGDYDGSGS YHYYYGLDVWGQGTTVTVSS<br><br>SEQ ID NO: 30884 |
| iPS:436138 | 21-225_197F2 | NA | GACATCCAGATGATCCAGTCTCCTTCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGATCTATAAAACATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTTCCAACAATATATCACTTACCCGCTCAC TTTCGGCGGAGGGACCAAGGTGGAGATCAAA<br><br>SEQ ID NO: 26879 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGACT GGAGTGGGTGGCAGTTATATGGTATGATGGAAGT AATAAAACTATGCAGACTCCGTGAAGGGCCGA TTCACCATCTCCAGAGACAACGCCAAGAACACGC TGTATCTGCAAATGAACAGCCTGAGAGCCGAGG ACACGGCTGTATTACTGTGCGAGAGATCAGG CGTGGGCTACGACGGTTTGGACGTCTGGGGCCAA GGGACCACGGTCACCGTCTCCTCA<br><br>SEQ ID NO: 30885 |

FIGURE 50
(Continued)

| | | | |
|---|---|---|---|
| iPS:436140 | 21-225_197G3 | AA | DIQMIQSPSPSSLSASVGDRVTITCRTSQGIGNYLA<br>WFQQKPGKAPKSLLYKTSSLQSGVPSKFSGSGS<br>GTDFTLTISSLQPEDFATYFQQYITYPLTFGGGT<br>KVEIK<br>SEQ ID NO: 26880 | QVQLVESGGGVVQPGRSLRLSCAASGFTFSSYGMH<br>WVRQAPGKGLEWVAVIWYDGSNKNYADSVKGRF<br>TISRDNSKNTLYLQMNSLRAEDTAVYYCARDQGV<br>GYDGLDVWGQGTTVTVSS<br>SEQ ID NO: 30886 |
| | | NA | GACATCCAGATGACCCAGTCTCCGTCCTCACT<br>GTCTGCATCTGTAGGAGACAGAGTCACCATCA<br>CTTGTCGGGCGAGTCAGGGCATTGGCAATCAT<br>TTAGCCTGGTTTCAGCAGAAACCAGGGAAAGC<br>CCCTAAGTCCCTGATCTATGCTGCATCCAGTTT<br>GCAAAGTGGGGTCCCATCAAAGTTCAGCGGCA<br>GTAGATCTGGGACAGATTTCTCTCTCACCATC<br>AGCAGCCTGCAGCCTGAAGATTTTGCAACTTA<br>TTACTGCCAACAGTATAGTAATTACCCGGTCA<br>CTTTCGGCCCTGGGACCAAAGTGGATATCAAG<br>SEQ ID NO: 26881 | CAGGTGCAACTGGTGGAGTCTGGGGGAGGCGTG<br>GTCCAGCCTGGGAGGTCCCTGAGACTCTCCTGTG<br>TAGCGTCTGGGTTCACCTTCAGTAGCTATGGCAT<br>GCACTGGGTCCGCCAGGCTCCAGGCAAGGGGCT<br>GGAGTGGGTGGCAGTTATATGCAGACTCCGTGAAGGGCCGA<br>AATAAAACTATGCAGACTCCGTGAAGGGCCGA<br>TTCACCATCTCCAGAGACAACAGCCTGAGAGCCGAGG<br>TGTATCTGCAAATGAACAGCCTGAGAGCCGAGG<br>ACACGGCTGTGTATTACTGTGCGAGAGATCCTC<br>TGTAGGGTACGACGGTATGGACGTCTGGGGCCA<br>AGGGACCACGGTCACCGTCTCCTCA<br>SEQ ID NO: 30887 |
| | | AA | DIQMTQSPSSLSASVGDRVTITCRASQGIGNHLA<br>WFQQKPGKAPKSLIYAASSLQSGVPSKFSGSRSG<br>TDFSLTISSLQPEDFATYYCQQYSNYPVTFGPGT<br>KVDIK<br>SEQ ID NO: 26882 | QVQLVESGGGVVQPGRSLRLSCVASGFTFSSHGMH<br>WVRQAPGKGLEWVAVIWYDGSNKNYADSVKGRF<br>TISRDNSKNTLYLQMNSLRAEDTAVYYCARDPSVG<br>YDGMDVWGQGTTVTVSS<br>SEQ ID NO: 30888 |

FIGURE 50
(Continued)

| | | | |
|---|---|---|---|
| iPS:436146 | 21-225_197F4 | NA | GAAATTGTGTTGACGCAGTCTCCAGGCACCCT GTCTTTGTCTCCAGGGGAAGGAGCCACCCTCT CCTGCAGGGCCAGTCAGTCAGAGTATTCGCAGCAGC TTCTTAGCCTGGTACCTGCAGAAGCCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGGAAACTCACCG TGGGGCGTTCGGCCAAGGGACCAAGGTGGAAA TCAAA |
| | | | SEQ ID NO: 26883 |
| | | AA | EIVLTQSPGTLSLSPGEGATLSCRASQSIRSSFLA WYLQKPGQAPRLLIYGASSRATGIPDRFSGSGSG TDFTLTISRLEPEDFAVYYCQQYGNSPWAFGQG TKVEIK |
| | | | SEQ ID NO: 26884 |
| iPS:436150 | 21-225_197H4 | NA | GACATCATGATGACCCAGTCTTCAGACTCCCT GACTGTGTCTCTGGGCGAGAGGGCCATCATCA GCTGCAGGTCCAGCCAGAGTGTTTTACACAGC TTCAACAATTACAAACTACTTAGCTTGGTACCA GCAGAAAGCCAGGACAGTCTCCTAACCTGCTCA TTTACTGGGCATCTACCCGGGAATCCGGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTACTCCTCCGACGTTCGGCCTAGG GACCAAGGTGGAAATCAAA |
| | | | SEQ ID NO: 26885 |

| | |
|---|---|
| CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGATCCGCCAGCACCCAGGGAA GGGCCTGGAGTGGATTGGGTACATCTTTTACAGT GGGAGCACCTACTACAACCCGTCCCTCAAGAGTC GAATTACCATATCAGTAGACACGTCTAAGAACCA GTTCTCCCTGAAGCTGAGCTCTGTGACTGCCGCG GACACGGCCGTGTATTACTGTGCGAGAGGGGATT ACGATGGTTCGGGGAGTTATCACTACTACTACGG TTTGGACGTCTGGGGCCAAGGGACCACGGTCACC GTCTCCTCA | |
| SEQ ID NO: 30889 | |
| QVQLQESGPGLVKPSQTLSLTCTVSGGSISSGDYYW NWIRQHPGKGLEWIGYIFYSGSTYYNPSLKSRITISV DTSKNQFSLKLSSVTAADTAVYYCARGDYDGSGS YHYYYGLDVWGQGTTVTVSS | |
| SEQ ID NO: 30890 | |
| CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGGC TTGAGTGGATGGGATGGATGCACAGAAGTTCAGGCAG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCTCCTCA | |
| SEQ ID NO: 30891 | |

FIGURE 50
(Continued)

| | | | |
|---|---|---|---|
| iPS:436152 | | AA | DIMMTQSSDSLTVSLGERAIISCRSSQSVLHSFNN YNYLAWYQQKAGHPPNLLIYWASTRESGVPDR FSGSGSGTDFTLPISSLQAEDVAVYYCQQYYSTP PTFGLGTKVEIK<br>SEQ ID NO: 26886 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS<br>SEQ ID NO: 30892 |
| | 21-225_197B6 | NA | GACATCCAGATGACCCAGTCTCCATCCTCACT GTCTGCATCTGTAGGAGACAGAGTCACCATCA CTTGTCGGGCGAGTCAGGGCATTGGCAAATAT TTAGCCTGGTTTCAGCAGAAACCAGGGAAAGC CCCTAAGTCCCTGATCTATGGTGCATCCAGTTT GCAAAGTGGGGTCCCATCAAGTTCAGCGGCA GTGGATCTGGGACAGATTTCACTCTCACCATC AGCAGCCTGCAGCCTGAACAATATAGTACTTACCCGCTCA TTACTGCCAACAATATAGTACTTACCCGCTCA CTTTCGGCGGAGGGACCAAGGTGGAGATCAA A<br>SEQ ID NO: 26887 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAAAACTACGCAGACTCCGTGAAGGGCCGA TTCACCATCTCCAGAGACAATTCCAAGAACATGT TGTATCTGCAAATGAACAGCCTGAGAGCCGAGG ACACGGCTATGTATTACTGTGCGAGAGATCAGG CGTGGGCTACGACGGTTTGGACGTCTGGGGCCAA GGGACCTCGGTCACCGTCTCCTCA<br>SEQ ID NO: 30893 |
| | | AA | DIQMTQSPSSLSASVGDRVTITCRASQGIGKYLA WFQQKPGKAPKSLIYGASSLQSGVPSKFSGSGSG TDFTLTISSLQPENFATYYCQQYSTYPLTFGGGT KVEIK<br>SEQ ID NO: 26888 | QVQLVESGGGVVQPGRSLRLSCAASGFTFSSYGMH WVRQAPGKGLEWVAVIWYDGSNKNYADSVKGRF TISRDNSKNMLYLQMNSLRAEDTAMYYCARDQGV GYDGLDVWGQGTSVTVSS<br>SEQ ID NO: 30894 |

FIGURE 50
(Continued)

| | | | |
|---|---|---|---|
| iPS:436154 | 21-225_197C6 | NA | GACATCATGATGACCCAGTCTCCAGACTCCCT GGCTGTGTCTCTGGGCGAGAGGGCCATCATCA GCTGCAGGTCCAGCCAGAGTGTTTTACACAGC TCCAACAATTACAACTACTTAGCTTGGTACCA GCAGAAACCAGGACAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAA TATTATAGTACTCCTCGACGTTCGGCCTAGG GACCAAGGTGGAAATCAAA<br>SEQ ID NO: 26889 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCCATAGCAGT GGCTGGTACTACTTGACTACTGGGGCCAGGGAA CCCTGGTCACCGTCTCCTCA<br>SEQ ID NO: 30895 |
| | | AA | DIMMTQSPDSLAVSLGERAIISCRSSQSVLHSSNN YNYLAWYQQKPGQHPPNLLIYWASTRESGVPDRF SGSGSGTDFTLTISSLQAEDVAVYYCQQYYSTPP TFGLGTKVEIK<br>SEQ ID NO: 26890 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAHSSGW YYFDYWGQGTLVTVSS<br>SEQ ID NO: 30896 |
| iPS:436156 | 21-225_197C8 | NA | GACATCGTGATGACCCAGTCTCCAGACTCCCT GGCTGTGTCTCTGGGCGAGAGGGCCACCATCA ACTGCAAGTCCAGCCAGAGTGTTTTACACAGT TCCAACAATAAGAACTACTTAGCTTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAG TCTTATACTATTCACTTCACTTTCGGCCCTGGG ACCAAAGTGGATAACAAA<br>SEQ ID NO: 26891 | GAGGTGCAACTATTGGAGTCTGGGGGAGGCTTG GTGCAGCCTGGGGGGTCCCTGAGACTCTCCTGTG CAGCCTCTGGATTCACCTTTAGCAGCTCTGCCAT GACCTGGGTCCGCCAGGCTCCAGGGAAGGGACT GGAGTGGGTCTCAGTCATACATTGGTAATGGTGT AGAGCATACTACGCAGACTCGTGAAGGGCCGG TTCACCATCCAGAGACAATTCCAAGAACACGC TGTATCTGCAAATGAACAGCCTGAGAACCGAGG ACACGGCCGTATATTACTGTGCGAAAGATCGGG GATATAGCAGGATAGCAGTGGCTGGTACCTTGA CTACTGGGGCCAGGGAACCCTGGTCACCGTCTCC TCA<br>SEQ ID NO: 30897 |

FIGURE 50
(Continued)

| | | | |
|---|---|---|---|
| iPS:436158 | 21-225_197G8 | AA | DIVMTPSPDSLAVSLGERATINCKSSQSVLHSSN NKNYLAWYQQKPGQPPKLLIYWASTRESGVPD RFSGSGSGTDFTLSISSLQAEDVAVYYCQQSYTIP FTFGPGTKVDNK<br>SEQ ID NO: 26892 | EVQLLESGGGLVQPGGSLRLSCAASGFTFSSSAMT WVRQAPGKGLEWVSAIIGNGGRAYYADSVKGRFT ISRDNSKNTLYLQMNSLRTEDTAVYYCAKDRGYSR IAVAGTFDYWGQGTLVTVSS<br>SEQ ID NO: 30898 |
| | | NA | GAGATTGTGATGACCCAGACTCCACTTTCTCT GTCCGTCATCCTGGACAGCCGGCCTCCATCT CCTGCAAGTCTAGTCAGAACCTCCTGCATAGT GATGGAAAGACCTATTTGTATTGGTACCTGCA GAAGCCAGGCCAGCCTCCACAGGTCCTGATCT ATGAAGTTTCCAACCGGTTCTGTGGGTGCCA GATAGGTTCAGTGGCAGCGGGTCAGGACAG ATTTCACACTGAAAATTAGCCGGGTGGAGGCT GAGGATGTTGGGGTTTATTCCTGCATGCAAAG TATACAGCTTCCCTGGACGTTCGCCCAAGGGT CCAAGGTGGAAATCAAA<br>SEQ ID NO: 26893 | CAGGTGCAATCTGCAGGAGTCGGGCCCAGGACTG GTGAAGCCTTCTGGTGCTCCATCAGTGCTACTCCTGG CTGTCTCTGGTGGCTCCATCAGTGCTACTCCTGG AGCTGGATCCGGCAGCCCGCGGAAGGGACTG GAGTGGATTGGGCGTCTCTCCTGTGGGAGCA CCAACTTCAACCCTCCCCTCAAGAGTCGAGTCAC CATGTCAGTAGACACGTCCAAGAACCAGTCTCC CTGAGGCTGAGCTCTGTGACCGCCGCGACACG GCCGTTTATTACTGTGCGAGACTCCGGTATAACT GGAACTTCCCTACTTTGACTACTGGGGCCAGGG AGCCCTGGTCACCGTCTCCTCA<br>SEQ ID NO: 30899 |
| | | AA | EIVMTQTPLSLSVIPGQPASISCKSSQNLLHSDGK TYLYWYLQKPGQPPQVLIYEVSNRFSGVPDRFS GSGSGTDFTLKISRVEAEDVGVYSCMQSIQLPWT FAQGSKVEIK<br>SEQ ID NO: 26894 | QVHLQESGPGLVKPSETLSLTCTVSGGSISAYSWSW IRQPAGKGLEWIGRLSPGGSTNFNPSLKSRVTMSVD TSKNQFSLRLSSVTAADTAVYYCARLRYNWNFPYF DYWGQGALVTVSS<br>SEQ ID NO: 30900 |

FIGURE 50
(Continued)

| | | | | |
|---|---|---|---|---|
| iPS:436160 | 21-225_197C9 | | GACATCCAGATGACCCAGTCTCCATCTTCCGT GTCTGCATCTGTAGGAGACAGAGTCACCATCA CTTGTCGGGCGAGTCAGGGTATTAGCAACTGG TTAGCCTGGTTTCAGCAGAAACCAGGGAAAGC CCCTCAAGCTCCTGATCTATGCTGCATCCAGTT GCAAAGTGGGGGTCCCATCAAGGTTCAGCGGCA GTGGATCTGGGACAGACTTCAGTCTCACCATC AGCAGCCTGCAGCCTGAAGATTTTGCAACTTA CTATTGTCAAACAGGCTAACAGTTTCCGTGA CGTTCGGGCAAGGGACCAAGGTGGAAATCAA A | GAGGTGCAGCTGTTGGAGTCTGGGGGAGGCTTG GCACAGCCGGGGGGTCCCTGAGACTCTCCTGTG CAGCCCTCTGATTCACCTTTAGGAGCTATGCCAT GAGCTGGGTCCGCCAGGCTCCAGGGAAGGGCT GGAGTGGGTCTCAGTTATTAGTGGTAGAGGTGGT AACACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAGGCATAGC AGTGGCTGCTCGCACTACTTTGACTACTGGGGC CAGGGAACCCTGGTCACCGTCTCCTCA |
| | | NA | SEQ ID NO: 26895 | SEQ ID NO: 30901 |
| | | AA | DIQMTQSPSSVSASVGDRVTITCRASQGISNWLA WFQQKPGKAPQLLIYAASSLQSGVPSRFSGSGSG TDFSLTISSLQPEDFATYYCQQANSFPWTFGQGT KVEIK | EVQLLESGGGLAQPGGSLRLSCAASGFTFRSYAMS WVRQAPGKGLEWVSVISGRGGNTYYADSVKGRFT ISRDNSKNTLYLQMNSLRAEDTAVYYCAKGIAVAG SHYFDYWGQGTLVTVSS |
| | | | SEQ ID NO: 26896 | SEQ ID NO: 30902 |
| iPS:436164 | 21-225_197G10 | NA | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAGTTACATGTATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAATGGC TACAATTTAGGTACTACGTATAGACGTTG GGGCCAAGGGACCACGGTCACCGTCTCCTCA | CAGGTGCAGCTGGTGGAGTCTGGGGGAGGCGTG GTCCAGCCTGGGAGGTCCCTGAGACTCTCCTGTG TAGCGTCTGGATTCACCTTCAGTAGCTATGGCAT GCACTGGGTCCGCCAGGCTCCAGGCAAGGGGCT GGAGTGGGTGGCAGTTACATGTATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGAGAATGGC TACAATTTAGGTACTACGTATAGACGTTG GGGCCAAGGGACCACGGTCACCGTCTCCTCA |
| | | | SEQ ID NO: 26897 | SEQ ID NO: 30903 |

FIGURE 50
(Continued)

| | | | |
|---|---|---|---|
| iPS:436167 | | AA | DIQMTQSPSSLSASVGDRVTITCRASQGIRNDLGWYQQKPGKAPKRLIYGASSLQSGVPSRFSGSGSGTEFTLTISSLQPEDFATYYCLQHYRYPFTFGPGTKVDIK | QVQLVESGGGVVQPGRSLRLSCVASGFTFSSYGMHWVRQAPGKGLEWVAVTWYDGSNKYYADSVKGRFTISRDNSKNTLYLQMNSLRAEDTAVYYCAREWLQFRYYYGIDVWGQGTTVTSS |
| | | | SEQ ID NO: 26898 | SEQ ID NO: 30904 |
| | | NA | GACATCCAGATGACCCAGTCTCCATCCTCGCTGTCTGCATCTGTGGGAGACAGAGTCACCATCACTTGTCGGGCGAGTCAGGGCATTAACAAGTATCTTGCCTGGTTTCAGCAGAAACCAGGGAAAGCCCCTAAGTCACTGATCTATGCTGCATCCAGTGTGCAAAGTGGGGTCCCATCAAAATTCAGCGGCAGTGGATCTGGGACAGATTTCACTCTCACCATCAGCCGCCTGCAGCCTGACGATATGACACTTATTACGGCCAACGATATGACACTTACCATTCACTTTCGGCCCTGGGACCAAAGTGGATATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGGAACTATGGCATGCACTGGGTCCGCCAGGCTCCAGGCAAGGGCTGGAGTGGGTGGCAGTTATATGGAGACTCCGTGAAGGGCCGATAATGACTACTATGCAGACTCCGTGAAGGGCCGATTCACCATCTCCAGAGACAATGCAAGAACACGCTGTACCTGCAAATGAACAGCCTGAGAGCCGAGACACGGCTGTGTATTACTGTGCGAGAGATAGAAGCGTCGGCTACGAGGGTTTAGATGTCTGGGGCCAAGGGACCACCGTCACCGTCTCCTCA |
| | | | SEQ ID NO: 26899 | SEQ ID NO: 30905 |
| | 21-225_197E11 | AA | DIQMTQSPSSLSASVGDRVTITCRASQGINKYLSWFQQKPGKAPKSLIYAASSVQSGVPSKFSGSGSGTDFTLTISRLQPDDFATYYGQRYDTYPFTFGPGTKVDIK | QVQLVESGGGVVQPGRSLRLSCAASGFTFRNYGMHWVRQAPGKGLEWVAVIWFDGSNDYYADSVKGRFTISRDNSKNTLSLQMNSLRAEDTAVYYCARDRSVGYDGLDVWGQGTTVTSS |
| | | | SEQ ID NO: 26900 | SEQ ID NO: 30906 |

FIGURE 50
(Continued)

| | | | |
|---|---|---|---|
| iPS:436173 | 21-225_197G12 | NA | GACATCCAGATGATCCAGTCTCCTTCCTCACT<br>GTCTGCATCTGTAGGAGACAGAGTCACCATCA<br>CTTGTGTGGACGAGTCAGGGCATTGGCAATTAT<br>TTAGCCTGGTTTCAGCAGAAACCAGGGAAAGC<br>CCCTAAGTCCCTGCTCTATAAAACATCCAGTTT<br>GCAAAGTGGGGTCCCATCAAAGTTCAGCGGCA<br>GTGGATCTGGGACAGATTTCACTCTCACCATC<br>AGCAGCCTGCAGCCTGAAGATTTTGCAACTTA<br>TTACTTCCAACAATATATGACTTACCCGCTCAC<br>TTTCGGCGGAGGGACCAAGGTGGAGATCAAA | CAGGTGCAGCTGGTGGAGTCTGGGGGAGGCGTG<br>GTCCAGCCTGGGAGGTCCCTGAGACTCTCCTGTG<br>CAGCGTCTGATTCACCTTCAGTAGCTATGGCAT<br>GCACTGGGTCCGCCAGGCTCCAGGCAAGGGACT<br>GGAGTGGGTGGCAGTTATATGGTATGATGAAGT<br>AATAAAACTATGCAGAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGATCAGGG<br>CGTGGGCTACGACGGTTTGACGTCTGGGGCCAA<br>GGGACCACGGTCACCGTCTCCTCA |
| | | | SEQ ID NO: 26901 | SEQ ID NO: 30907 |
| | | AA | DIQMIQSPSSLSASVGDRVTITCRTSQGIGNYLA<br>WFQQKPGKAPKSLLYKTSSLQSGFPSKFSGSGSG<br>TDFTLTISSLQPEDFATYYFQQYMTYPLTFGGGT<br>KVEIK | QVQLVESGGGVVQPGRSLRLSCAASGFTFSSYGMH<br>WVRQAPGKGLEWVAVIWYDGSNKNYADSVKGRF<br>TISRDNSKNTLYLQMNSLRAEDTAVYYCARDQGV<br>GYDGLDVWGQGTTVTVSS |
| | | | SEQ ID NO: 26902 | SEQ ID NO: 30908 |
| iPS:436177 | 21-225_198B1 | NA | GAAATTGTGTTGACGCAGTCTCCAGGCACCCT<br>GTCTTTGTCTCCAGGGGAAAGCGCCACCCTCT<br>CCTGCAGGGCCGGTCAAAGTATTAGAACCAAC<br>TTCTTAGCCTGGTACCAGCAGCAACCTGGCCA<br>GGCTCCCAGGCTCCTCATCTATGGTGCATCCA<br>GCAGGGCCACTGGCATCCCAGACAGGTTCAGT<br>GGCAGTGGGTCTGGGACAGACTTCACTCTCAC<br>CATCAACAGACTGGAGCCTGAAGATTTTGCAG<br>TGTATTACTGTCAGCAGTATGGTAGCTCACCG<br>TGGACGTTCGGCCAAGGGACCAAGGTGGAAA<br>TCAAA | CAGGTGCAACTGAAGGAGTCGGGCCAGGACTG<br>GTGAAGCCTTCACAGACCCTGTCCCTCACCTGCA<br>CTGTCTCTGGTGGCTCCATCAACAGTGGTGATTA<br>CTACTGGAACTGGTTCCGCCAGCACCCAGGGAA<br>GGGCCTGGAGTGGATTGGGTACATCTTCCACAGT<br>GGGAGCACCACTACAACAACCCGTCCCTCAAGAGTC<br>GAGTAACCGTATCAGTAGACACGTCTAAGAACC<br>AGTTCTCCCTGAAGCTGAGTTCTGTGACTGCCGC<br>GGACACGGCCGTGTATTACTGTGCGAGAGGGGA<br>TTACGATGGTTCGGGGAGTTATCACTACTATTAC<br>GGTATGGACGTCTGGGGCCGAGGGACCACGGTC<br>ACCGTCTCCTCA |
| | | | SEQ ID NO: 26903 | SEQ ID NO: 30909 |

FIGURE 50
(Continued)

| | | | |
|---|---|---|---|
| iPS:436179 | 21-225_198E1 | AA | EIVLTQSPGTLSLSPGESATLSCRAGQSIRTNFLAWYQQQPGQAPRLLIYGASSRATGIPDRFSGSGSGTDFTLTINRLEPEDFAVYYCQQYGSSPWTFGQGTKVEIK | QVQLKESGPGLVKPSQTLSLTCTVSGGSINSGDYYWNWFRQHPGKGLEWIGYIFHSGSTYYNPSLKSRVTVSVDTSKNQFSLKLSSVTAADTAVYYCARGDYDGSGSYHYYGMDVWGRGTTVTVSS |
| | | | SEQ ID NO: 26904 | SEQ ID NO: 30910 |
| | | NA | GAAATTGTGTTGACGCAGTCTCCAGGCACCCTGTCTTTGTCTCCAGGGGAAAGAGCCACCCTCCTGCAGGGCCAGTCAGAGTATAAGGAGACACTTCTTAGCCTGGTACCAGCAGAAACCTGGCCAGGCTCCCAGGCTCCTCATCTATGGTGCATCAGTAGGGCCACTGGCATCCCAGACAGGTTCAGTGGCAGTGGGTCTGGGACAGACTTCACTCTCACCATCAACAGACTGGAGCCTGAAGTATGTGTATTACTGTCAGCAGTATGGTAATTCACCGTGGACGTTCGGCCAAGGGACCAAGGTGGAAATCAAA | CAGGTGCAGCTGCAGGAGTCGGGCCCAGGACTGGTGAAGCCTTCACAGACCCTGTCCCTCACCTGCACTGTCTCTGGTGGCTCCATCAACAGTGGTGTACTACTGGAACTGGATCCGCCAGCACCCAGGGAAGGGCCTGGAGTGGATTGGGTTCATCTTTTACAGTGGGAGCACCTACTACAACCCGTCCCTCAAGAGTCGACTTTCCATATCAGTAGACACGTCTAAGAACCAGTTCTCCCTGAAGCTGAGCTCTGTGACTGCCGCGGACACGGCCGTGTATTACTGTGCGAGAGGGGATTACGATGGTTCGGGGAGTTATCACTACTATTACGGTATGGACGTCTGGGGCCAAGGGACCACGGTCACCGTCTCCTCA |
| | | | SEQ ID NO: 26905 | SEQ ID NO: 30911 |
| | | AA | EIVLTQSPGTLSLSPGERATLSCRASQSIRSNFLAWYQQKPGQAPRLLIYGAFSRATGIPDRFSGSGSGTDFTLTINRLEPEDFAVYYCQQYGNSPWTFGQGTKVEIK | QVQLQESGPGLVKPSQTLSLTCTVSGGSINSGGYYWNWIRQHPGKGLEWIGFIFYSGSTYYNPSLKSRLSISVDTSKNQFSLKLSSVTAADTAVYYCARGDYDGSGSYHYYGMDVWGQGTTVTVSS |
| | | | SEQ ID NO: 26906 | SEQ ID NO: 30912 |

FIGURE 50
(Continued)

| | | | | |
|---|---|---|---|---|
| iPS:436181 | 21-225_198C2 | NA | GAAATTGTGGTGACGCAGTCTCCAGGCACCCTGTCTTTGTCTCCAGGGGAAAGAGCCACCCTCTCCTGCAGGGCCAGTCAGAGTGTTAGAAGCAGCTACTTAGCCTGGTACCAGCAGAAACCTGGCCAGGCTCCCAGGCTCCTCATCTGTGGTGCATTCAGCAGGGCCAGTGGCATCCCAGACAGGTTCAGTGGCAGTGGGTCTGGGACAGACTTCACTCTCACCATCAGCAGACTGGAGCCTGAAGATTTTGCGAGTGTACTACTGTCAGCAGTATGGTAACTCACCGTGGACGTTGGGCCACGCGACCAAGGTGGAAATCAAA | CAGGTGCAGCTGCAGGAGTCGGGCCCAGGACTGGTGAAGCCCTCACAGACCCTATCCTCACCTGCACTGTCTCTGGTGGCTCCATCAGCAGTGGTGGTTACTACTGGAGCTGGATCCGCCAGCACCCAGGGAAGGGCCTGGAGTGGATTGGGAACATCTATTACAGTGGGAGCACTTACTACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGGGGATTACTATGGTTCGGGGAGTTATCACAACTACTACGGTTTGACGTCTGGGGCCAAGGGACCACGGTCACCGTCTCCTCA |
| | | AA | EIVVTQSPGTLLLYSEERSTLSCRASQSVRSSYLAWYQQKPGQAPRLLICGAFSRASGIPDRFSGSGSGTDFTLTISRLEPEDFAVYYCQQYGNSPWTLGHATKVEIK | QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARGDYYGSGSYHNYYGLDVWGQGTTVTVSS |
| | | | SEQ ID NO: 26907 | SEQ ID NO: 30913 |
| iPS:436189 | 21-225_198B6 | NA | GACATCCAGATGACCCAGTCTCCATCCTCACTGTCTGCATCTGTAGGAGACAGAGTCACCATCACTTGTCGGGCGAGTCAGGGCATTAGCAATTATTTAGCCTGGTTTCAGCAGAAACCAGGGAAAGCCCCTAAGTCCCTGATCTATGCTGCATCCAAAGTTGCAAAGTGGGGTCCATCAAGGTTCAGCGGCAATAGATCTGGGACAGATTTCACTCTCACCATCAGCAGCCTGCAGCCTGAAGATTTTGCAACTTATTACTGCCAAACAATATAGTACTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCACTGGGTCCGCCAGGCTCCAGGCAAGGGGCTGGAGTGGGTGGCAGTTATATGGTATGATGGAAGTAATAAACACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGCGTGGGCTACTACGGTATGGACGTCTGGGGCCAAGGGACCACGGTCACCGTCTCCTCA |
| | | | SEQ ID NO: 26908 | SEQ ID NO: 30914 |
| | | | SEQ ID NO: 26909 | SEQ ID NO: 30915 |

FIGURE 50
(Continued)

| | | | |
|---|---|---|---|
| iPS:436191 | 21-225_198B9 | AA | DIQMTQSPSSLSASVGDRVTITCRASQGIGNYLAWFQQKPGKAPKSLIYAASSLQSGVPSKFSGNRSGTDFTLTISSLQPEDFATYYCQQYSTYPLTFGGGTKVEIK | QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARDQGVGYYGMDVWGQGTTVTSS |
| | | | SEQ ID NO: 26910 | SEQ ID NO: 30916 |
| | | NA | GACATCCAGATGACCCAGTCTCCATCCTCCTGTCTGCATCTGTAGGAGACAGAGTCACCATCACTTGCCGGGCAAGTCAGGGCATAAGAAAGACTTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGATCTCACTCTCACAATCAGCAGCCTGCAGCCTGAAGATTTTGCAACTTATGTCTGTCTACAACATTATCGTTACCCTTTCACTTTCGGCCCTGGGACCAAAGTGGATTTCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAATTATATGTAGACTCCGTGAAGGGCCGATAATAAATACTATGTAGACTCCGTGAAGGGCCGATTCACCATCTCCAGAGACAATTCCAAGAACACGCTGTTTCTGCAAATGAGCAGCCTGAGAGCCGAGGACACGGCTGTGTATTATTGCGCGAGAGAATGGCTACAATTCAGGTACTACTACGGTATGGACGTCTGGGGCCAAGGGACCACGGTCACCGTCTCCTCA |
| | | | SEQ ID NO: 26911 | SEQ ID NO: 30917 |
| | | AA | DIQMTQSPSSLSASVGDRVTITCRASQGIRKDLGWYQQKPGKAPKRLIYAASSLQSGVPSRFSGSGSGTEFTLTISSLQPEDFATYVCLQHYRYPFTFGPGTKVDFK | QVQLVESGGGVVQPGRSLRLSCAASGFTFSNYGMHWVRQAPGKGLEWVAIIWFDGSNKYYVDSVKGRFTISRDNSKNTLFLQMSSLRAEDTAVYYCAREWLQFRYYYGMDVWGQGTTVTVSS |
| | | | SEQ ID NO: 26912 | SEQ ID NO: 30918 |

FIGURE 50
(Continued)

| iPS:436193 | 21-225_198A10 | NA | GATATTGTGTTGACCCAGACTCCACTCTCTG<br>TCCGTCACCCCTGGAGACAGCCGGCTCCATATC<br>GTGCAAGTCTAGTCAGAGCCTCCTATAGTG<br>ATGGAAGGACCTATTTGTATTGGTACCTGCAG<br>AAACCAGGCCAGCTCCACAGGTCCTGATCTG<br>TGAGGGTTCCAACCGGTTCTCTGGAGTCCAG<br>ATAGGTTCAGTGGCAGCGGGTCAGGGACAGA<br>TTTCACACTGAAAATCAGCCGGGTGGAGGCAG<br>GAGATGTTGGGGTTTATTACTGCATGCAAAGT<br>ATACAGCTTCCCTGACGTTCGGCCAAGGGAC<br>CAAGGTGGAAATCAAA | CAGCTGCAGCTGCAGGAGTCGGGCCAGGACTG<br>GTGAAGCCTTCGGAGACCCTGTCCCTCACCTGCA<br>CTGTCTCTGGTGGCTCCATCAGAAGTTACCACTG<br>GAGTTGGATCCGGCAGCCGCCGGGAAGGACT<br>GGAGTGGATTGGCATATCTATACCAGTAGGAGC<br>ACCAACTACAACCCTCCCTCAAGAGTCGAGTCA<br>CCATTTCAGTAGACACGTCCAAGAACCAGTTCTC<br>CCTGAAGCTGAGCTCTGTGACCGCCACGGACACG<br>GCCGTGTATTACTGTGCGAGACTCCGGTATAACT<br>GGAACTTCCCTTACTTTGACTACTGGGGCCAGGG<br>AACCCTGGTCACCGTCCTCA |
|---|---|---|---|---|
| | | | SEQ ID NO: 26913 | SEQ ID NO: 30919 |
| | | AA | DIVLTQTPLSLSVTPGQPASISCKSSQSLLYSDGR<br>TYLYWYLQKPGQPPQVLICEVSNRFSGVPDRFS<br>GSGSGTDFTLKISRVEAGDVGVYYCMQSIQLPW<br>TFGQGTKVEIK | QLQLQESGPGLVKPSETLSLTCTVSGGSIRSYHWSW<br>IRQPAGKGLEWIGHIYTSRSTNYNPSLKSRVTISVDT<br>SKNQFSLKLSSVTATDTAVYYCARLRYNWNFPYFD<br>YWGQGTLVTVSS |
| | | | SEQ ID NO: 26914 | SEQ ID NO: 30920 |
| iPS:436195 | 21-225_198G10 | NA | GAAATTGTGTTGACGCAGTCTCCAGGCACCCT<br>GTCTTTGTCTCCAGGGGAAAGAGCCACCCTCT<br>CCTGCAGGGCCAGTCAGAGTATTCGCAGCAGC<br>TTCTTAGCCTGGTATCAGCAGAAACCTGGCCA<br>GGCTCCCAGGCTCCTCATCTATGGTGCATCCA<br>GCAGGGCCACTGGCATCCCAGACAGGTTCAGT<br>GGCAGTGGGTCTGGGACAGACTTCACTCTCAC<br>CATCAGCAGACTGGAGCCTGAAGATTTTGCAG<br>TGTATTACTGTCAGCAGTATGGTAACTCACCG<br>TGGGGCGTTCGGCCAAGGGACCAAGGTGGAAA<br>TCAAA | CAGGTGCAGCTGCAGGAGTCGGGCCAGGACTG<br>GTGAAGCCTTCACAGACCCTGTCCCTCACCTGCA<br>CTGTCTCTGGTGGCTCCATCAGCAGTGGTGATTA<br>CTACTGGAACTGGATCCGCCAGCTCCCAGGGAA<br>GGGCCTGGAGTGGATTGGGTACATCTTTACAGT<br>GGGAGCACTACTACAACCCGTCCCTCAAGAGTC<br>GACTTACCATATCAGTGGACAGTCTAAGAACCA<br>GTTCTCCCTGAAGCTGAGTTCTGTGACTGCCGCG<br>GACACGGCCGTGTATTACTGTGCGAGAGGGATT<br>ACGATGGTTCGGGGAGTTATCACTTCTACTACGG<br>TATGGACGTCTGGGGCCAAGGGACCACGGTCAC<br>CGTCTCCTCA |
| | | | SEQ ID NO: 26915 | SEQ ID NO: 30921 |

FIGURE 50
(Continued)

| | | | | |
|---|---|---|---|---|
| iPS:436197 | 21-225_199C2 | AA | EIVLTQSPGTLSLSPGERATLSCRASQSIRSSFLA WYQQKPGQAPRLLIYGASSRATGIPDRFSGSGSG TDFTLTISRLEPEDFAVYYCQQYGNSPWAFGQG TKVEIK | QVQLQESGPGLVKPSQTLSLTCTVSGGSISSGDYYW NWIRQLPGKGLEWIGYIFYSGSTYYNPSLKSRLTISV DTSKNQFSLKLSSVTAADTAVYYCARGDYDGSGS YHFYYGMDVWGQGTTVTSS |
| | | | SEQ ID NO: 26916 | SEQ ID NO: 30922 |
| | | NA | GAAATTGTGTTGACGCAGTCTCCAGGCACCCT GTCTTTGTCTCCAGGGGAAAGAGCCACCCTCT CCTGCAGGGCCAGTGCAGTCAGAGTATTCGCAGCAGC TTCTTAGCCTGGTACCAGCAGAAACCTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAACAGACTGGAGCCTGAAGATTTGCAG TGTATTACTGTCAGCAGTATGGTAACTCACCG TGGGCGTTCGGCCAAGGGACCAAGGTGGAAA TCAAA | CAGGTGCAGTCGAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGCTCCGCCAGCCACCAGGGAA GGGCCTGGAGTGGATTGGGTACATCTTTACAGT GGGAGCACCTACTACAACCCGTCCCTCAAGAGTC GAGTTACCATATCAGTGGACACGTCTATGACCA GTTCTCCCTGAAGCTGACCTCTGTGACTGCCGCG GACACGGCCGTGTATTACTGTGCGAGAGGGGATT ACGATGGTTCGGGGAGTTATCACTACTACTACGG TATGGACGTCTGGGGCCAAGGGACCACGGTCAC CGTCTCCTCA |
| | | | SEQ ID NO: 26917 | SEQ ID NO: 30923 |
| | | AA | EIVLTQSPGTLSLSPGERATLSCRASQSIRSSFLA WYQQKPGQAPRLLIYGASSRATGIPDRFSGSGSG TDFTLTINRLEPEDFAVYYCQQYGNSPWAFGQG TKVEIK | QVQLQESGPGLVKPSQTLSLTCTVSGGSISSGDYYW NWLRQHPEKGLEWIGYIFYSGSTYYNPSLKSRVTIS VDTSMTQFSLKLTSVTAADTAVYYCARGDYDGSG SYHYYGMDVWGQGTTVTSS |
| | | | SEQ ID NO: 26918 | SEQ ID NO: 30924 |

FIGURE 50
(Continued)

| | | | | |
|---|---|---|---|---|
| iPS:436199 | 21-225_199E3 | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATTTCTTCTGCATCCAGTTTGCAAAGGGGGGTCCCATCAAGATTCAGCGGCAGTGGATCTGGGACAGAATTCACTCTCACAATCAGCAGCCTGCAGCCTGAAGATTTTGCAACTTATTACTGTCTACAGCATAAAAGGTACCCGCTCACTTTCGGCGGAGGGACCAAGGTGGAGATCAAA | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTACTTCTGGACCTGGATCCGCCAGCCCCCAGGGAAGGGGCTGGAGTGGATTGGGGAAATCAATCATAGTGGAAGCACCAACTACAACCCGTCCCTCAAGAGTCGCGTCACCATATCAGTAGACACGTCCAAGAACCAGTTCTCCCTGAAGCTGAGCTCTGTGACCGCCGCGGACACGGCTGTGTATTACTGTGCGAGAGACTACGGTGCTGACTACTGGGGCCAGGGAACCCTGGTCGCCGTCTCCGCA |
| | | | SEQ ID NO: 26919 | SEQ ID NO: 30925 |
| | | AA | DIQMTQSPSSLSASVGDRVTITCRASQGIRNDLGWYQQKPGKAPKRLISSASSLQRGVPSRFSGSGSGTEFTLTISSLQPEDFATYYCLQHKRYPLTFGGGTKVEIK | QVQLQQWGAGLLKPSETLSLTCAVYGGSFSGYFWTWIRQPPGKGLEWIGEINHSGSTNYNPSLKSRVTISVDTSKNQFSLKLSSVTAADTAVYYCARDYGADYWGQGTLVAVSA |
| | | | SEQ ID NO: 26920 | SEQ ID NO: 30926 |
| iPS:436201 | 21-225_199C5 | NA | GACATCCAGATGACACAGTCTCCATCCTCACTGTCTGCATCTGTAGGAGACAGAGTCACCATCACTTGTCGGGCGAGTCAGGGCATTAGCAAGTATTTAGCCTGGTTTCAGCAGAAACCAGGGAAAGCCCCTAAGTCCCTGATCTATGCTGCATCCAGTTTGCAAAGTGGGGTCCCATCAAAGTTCAGCGGCAGTGGATCTGGGACAGATTTCACTCTCACCATCAGCAGCCTGCAGCCTGAAGATTTTGCAGCTTATTACTGCCAACAGTATCTTACTTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCAGGGCGTGGGCTACTACGGTATGGACGTCTGGGGCCAAGGGACCACGGTCACCGTCTCCTCA |
| | | | SEQ ID NO: 26921 | SEQ ID NO: 30927 |

FIGURE 50
(Continued)

| | | | | |
|---|---|---|---|---|
| | | AA | DIQMTQSPSSLSASVGDRVTITCRASQGISKYLAWFQQKPGKAPKSLIYAASSLQSGVPSKFSGSGSGTDFTLTISSLQPEDFAAYYCQQYLTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDQGVGYYGMDVWGQGTTVTVSS |
| | | | SEQ ID NO: 26922 | SEQ ID NO: 30928 |
| iPS:436203 | 21-225_199.A6 | NA | GACATAGTGATGACGCAGTCTCCAGCCACCCTGTCTGTGTCTCCAGGGGATAGAGCCACCCTCTCCTGCAGGCCCAGTCAGTCAGAGTTTAGCAGAAACTTAGCCTGGTACCAGCAGAAACCTGGCCAGGCTCCCAGGCTCCTCATCTATGGTGCATCCACTAGGGCCACTGGTATCCCAGGTTCAGTGGCAGTGGGTCTGGGACAGAGTTCACTCTCACCATCAGCAGCCTGCAGCCTGAAGATTTTGCAGTTTACTACTGTCAGCAGTATAATAACTGGCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTAACTATGGCATGCACTGGGTCCGCCAGGCTCCAGGCAAGGGGCTGGAGTGGGTGGCAATTATATGCCTGGTGATGAAGTAATCAATACTATGCCGACTCCGTGAAGGGCCGATTCACCATCTCCAGAGACACAATTCCAAGAACACGCTGTATCTGCAATTGAACAGCCTGAGAGCCGAGGACACGGCTGTCTATTACTGTGCGAGAGCCCACGGGGTCTACTACGCTATGGACGTCTGGGGCCAAGGGACCACGGTCACCGTCTCCTCA |
| | | | SEQ ID NO: 26923 | SEQ ID NO: 30929 |
| | | AA | DIVMTQSPATLSVSPGDRATLSCRPSQSFSRNLAWYQQKPGQAPRLLIYGASTRATGIPARFSGSGSGTEFTLTISSLECEDFAVYYCQQYNNWPLTFGGGTKVEIK | QVQLVESGGGVVQPGRSLRLSCAASGFTFSNYGMHWVRQAPGKGLEWVAIIWFDGSNQYYADSVKGRFTISRDNSKNTLYLQLNSLRAEDTAVYYCARAHGVYYYAMDVWGQGTTVTVSS |
| | | | SEQ ID NO: 26924 | SEQ ID NO: 30930 |

FIGURE 50
(Continued)

| | | | | |
|---|---|---|---|---|
| iPS:436205 | 21-225_199A7 | NA | GACATCCAGATGACCCAGTCTCCATCCTCCCT GTCTGCATCTGTAGGAGACAGAGTCACCATCA CTTGCCGGGCAAGTCAGGGCATAAGAAAAGA TTTAGGCTGGTATCAGCAGAAACCAGGAAA GCCCCTAAGCGCCTGATCTATGCTGCATCCAG TTTGCAAAGTGGGGTCCCATCAAGGTTCAGCG GCAGTGGATCTGGGACAGAATTCACTCTCACA ATCAGCAGCCTGCAGCCTGAAGATTTTGCAAC TTATGTCTGTCTACAACATTATCGTTACCTTT CACTTTCGGCCCTGGGACCAAAGTGGATTTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAATTATATGTTTGATGAAGT AATAAATACTATGCAGACTCCGTGAAGGCCGA TTCACCATCTCCAGAGACAATTCCAAGAACACGC TGTTTCTGCAAATGAGCAGCCTGAGAGCCGAGG ACACGGCTGTGTATTACTGTGCGAGAGAATGGCT ACAATTCAGGTACTACTACGGTATGGACGTCTGG GGCCAAGGGACCACGGTCACCGTCTCCTCA |
| | | | SEQ ID NO: 26925 | SEQ ID NO: 30931 |
| | | AA | DIQMTQSPSSLSASVGDRVTITCRASQGIRKDLG WYQQKPGKAPKRLIYAASSLQSGVPSRFSGSGS GTEFTLTISSLQPEDFATYVCLQHYRYPFTFGPGT KVDFK | QVQLVESGGGVVQPGRSLRLSCAASGFTFSNYGM HWVRQAPGKGLEWVAIIWFDGSNKYYADSVKGRF TISRDNSKNTLFLQMSSLRAEDTAVYYCAREWLQF RYYYGMDVWGQGTTVTVSS |
| | | | SEQ ID NO: 26926 | SEQ ID NO: 30932 |
| iPS:436207 | 21-225_199C7 | NA | GAAATTGTGTTGACGCAGTCTCCAGGCACCCT GTCTTTGTCTCCAGGGGAAAGAGCCACCCTCT CCTGCAGGGCCAGTCAGTCAGAGTATAAGGACCAA CTTCTTAGCCTGGTACCAGCAGAAACCTGGCC AGGCTCCCAGGCTCCTCATCTATGGTGCATCC AGCAGGGCCACTGGCATCCCAGACAGGTTCAG TGGCAGTGGGTCTGGGACAGACTTCACTCTCA CCATCAACAGACTGGAGCCTGAAGATTTTGCA GTGTATTACTGTCAGCAGTATGGTAACTCACC GTGGACGTTCGGCCAAGGGACCAAGGTGGAA ATCAAA | CAGGTGCAGCTGCAGGAGTCGGGCCCAGGACTG GTGAAGCCTTCACAGACCCTGTCCCTCACCTGCA CTGTCTCTGGTGGCTCCATCAACAGTGGTGGTTA CTACTGGAACTGGATCCGCCAGCACCCAGGGAA GGGCCTGGAGTGGATTGGGTTCATCTTTTACAGT GGGAGCACCTACTACAACCCGTCCCTCAAGAGTC GAGTTTCCATATCAGTAGACACGTCTAAGAACCA GTTCTCCCTGAAGCTGAGCTCTGTGACTGCCGCG GACACGGCCGTGTATTACTGTGCGAGAGGGATT ACGATGGTTCGGGGAGTTATCACTACTATTACGG TATGGACGTCTGGGGCCAGGGGACCACGGTCAC CGTCTCCTCA |
| | | | SEQ ID NO: 26927 | SEQ ID NO: 30933 |

FIGURE 50
(Continued)

| | | | | |
|---|---|---|---|---|
| iPS:436210 | 21-225_199G11 | AA | EIVLTQSPGTLSLSPGERATLSCRASQSIRTNFLA WYQQKPGQAPRLLIYGASSRATGIPDRFSGSGSG TDFTLTINRLEPEDFAVYYCQQYGNSPWTFGQG TKVEIK<br><br>SEQ ID NO: 26928 | QVQLQESGPGLVKPSQTLSLTCTVSGGSINSGGYY WNWIRQHPGKGLEWIGFIFYSGSTYNPSLKSRVSI SVDTSKNQFSLKLSSVTAADTAVYYCARGDYDGS GSYHYYYGMDVWGQGTTVTVSS<br><br>SEQ ID NO: 30934 |
| | | NA | GAAATTGTGGTGACGCAGTCTCCAGGCACCCT GTCTTTGTCTCCAGGGGAAAGAGCCACCCTCT CCTGCAGGGCCAGTGCAGTCAGAGTGTTAGAAGCAGC TACTTAGCCTGGTACCAGCAGAAACCTGGCCA GGCTCCCAGGCTCCTCATCTATGGTGCATTCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTACTACTGTCAGCAGTATGGTAACTCACCG TGGACGTTCGGCCAAGGGACCAAGGTGGAAA TCAAA<br><br>SEQ ID NO: 26929 | CAGGTGCAGCTGCAGGAGTCGGGCCCAGGACTG GTGAAGCCCTCACAGACCCTATCCCTCACCTGCA CTGTCTCTGTGGTCTCCATCAGCAGTGGTGTTA CTACTGGAGCTGGATCCGCCAGCACCCAGGAA GGGCTGGAGTGGATTGGGAACATCTATTACAGT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGGGGATT ACTATGGTTCGGGAGTTATCACAACTACTACGG TTTGGACGTCTGGGGCCAAGGGACCACGGTCACC GTCTCCTCA<br><br>SEQ ID NO: 30935 |
| | | AA | EIVVTQSPGTLSLSPGERATLSCRASQSVRSSYLA WYQQKPGQAPRLLIYGAFSRATGIPDRFSGSGSG TDFTLTISRLEPEDFAVYYCQQYGNSPWTFGHGT KVEIK<br><br>SEQ ID NO: 26930 | QVQLQESGPGLVKPSQTLSLTCTVSGGSISSGGYYW SWIRQHPGKGLEWIGNIYYSGSTYNPSLKSRVTIS VDTSKNQFSLKLSSVTAADTAVYYCARGDYYGSG SYHNYYGLDVWGQGTTVTVSS<br><br>SEQ ID NO: 30936 |

FIGURE 50
(Continued)

| | | | | |
|---|---|---|---|---|
| iPS:436212 | 21-225_200G1 | NA | GACATCCAGATGACCCAGTCTCCATCCTCCT GTCTGCATCTGTAGGAGACAGAGTCACCATCA CTTGCCGGGCAAGTCAGAGACTTAGCAGTTAT TTAAATTGGTTTCAGCAGAAACCAGGGAAAGC CCCTAAGCTCCTGATCTATGCTGAGTCCAGTTT ACAAAGTGGGGGTCCCATCAAGGTTCAGTGGCA GTGGATCTGGGACAGATTTCACTCTCACCATC AGCAGTCTGCAACCTGAAGATTTTGCAACTTA TTCCTGTCAACAGAGTTACAGTTCCCCTCCGTG GACGTTCGGCCAAGGGACCAAGGTGGAGTTC AAA | GAGGTGCAACTGTTGGAGTCTGGGGGAGGCTTG GTGCAGCCTGGGGGGTCCCTGAGACTCTCCTGT CAGCCCTCTGATTCACCTTTAGCAGCTATGCCAT GAGCTGGGTCCGCCAGGCTCCAGGGAAGGGCT GGAGTGGGTCTCAGTATTACGCAGACTCCGTGA AATACATTCTACGCAGACTCCGTGAGGGGCCGGT TCACCATCTCCAGAGACAATTCCAAGAACACGCT GTATCTGCAAATGAACAGCCTGAGAGCCGAGGA CACGGCCGTATATTACTGTGCGCGACGTATAGCA GTGGATGGCTATGATGCTTTTGATGTCTGGGGCC AAGGGACAATGGTCACCGTCTCTTCA |
| | | | SEQ ID NO: 26931 | SEQ ID NO: 30937 |
| | | AA | DIQMTQSPSSLSASVGDRVTITCRASQSISSYLNW FQQKPGKAPKLLIYAESSLQSGVPSRFSGSGSGT DFTLTISSLQPEDFATYSCQQSYSSPPWTFGQGT KVEFK | EVQLLESGGGLVQPGGSLRLSCAASGFTFSSYAMS WVRQAPGKGLEWVSAISGRGGNTFYADSVRGRFTI SRDNSKNTLYLQMNSLRAEDTAVYYCARRIAVDG YDAFDVWGQGTMVTVSS |
| | | | SEQ ID NO: 26932 | SEQ ID NO: 30938 |
| iPS:436214 | 21-225_200F6 | NA | GACATCCAGATGACCCAGTCTCCATCCTCCT GTCTGCATCTGTAGGAGACAGAGTCACCATCA CTTGCCGGGCAAGTCAGGACAGATTAGAAACCAGGGAA TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGACTTCACTCTCACAA TCAGCAGCCTGCAGCCTGAAGATTTTGCAACT TATCACTGTCTCACAGCATTATCGTTACCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGCAGACTCCGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGGTACGAGAAGAATGGCT ACAATTAGGTATTACTACGGTATGACGTCTGG GGCCAAGGGACCACGGTCACCGTCTCCTCA |
| | | | SEQ ID NO: 26933 | SEQ ID NO: 30939 |

FIGURE 50
(Continued)

| | | | | |
|---|---|---|---|---|
| iPS:436216 | 21-225_200B7 | AA | DIQMTQSPSSLSASVGDRVTITCRASQDIRNDLGWYQQKPGKAPKRLIYAASSLQSGVPSRFSGSGSGTEFTLTISSLQPEDFATYHCLQHYRYPFTFGPGTKVDIK<br>SEQ ID NO: 26934 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCTREWLQFRYYYGMDVWGQGTTVTVSS<br>SEQ ID NO: 30940 |
| | | NA | GAAATTGTGCTGACTCAGTCTCCAGACTTTCAGTCTGTGACTCCAAAGGAGAAAGTCACCATCACCTGCCGGGCCAGTCAGAGACAGAACATTGGTAATACCTTGCACTGGTACCAGCAGAAACCAGATCAGTCTCCTAAGCTCCTCATCAAGTATGCTTCCAGTCCTTCTCAGGGTCCCTCGAGTTCATCCTCCAGTGGCAGTGGGTCTGGGACAGATTTCATCCTCACCATCAATAGCCTGGAAGCTGAAGATGCTGCAACGTATTACTGTCATCAGAGTGGTAGTTTACCTCAGACGTTCGGCCAAGGGACCAAGGTGGAAATCAAA<br>SEQ ID NO: 26935 | CAGGTGCAGCTGCAGGAGTCGGGCCAGGACTGGTGAAGCCTTCACAGACCCTGTCCCTCACCTGCCTGTCTCTGGTGCTCCATCAGCAGTGGTGGTTACTACTGGAGCTGGATCCGCCAGCACCCAGGGAAGGGCCTGGAGTGGATTGGGTACATCTTTACAGTGGGAGCACCAACTACAACCCGTCCCTCAGGAGTCGAGTTACCATATCAGTAGACACGTCTAAGAACCAGTTCTCCCTGAAACTGAGTTCTGTGACTGCCGCAGGACACGGCCGTGTATTACTGTGCGAGAGCCGGGTATAACTGAACAACGGTATGACGTCTGGGGCCAAGGGACCACGGTCACCGTCTCCTCA<br>SEQ ID NO: 30941 |
| | | AA | EIVLTQSPDFQSVTPKEKVTITCRASQNIGNTLHWYQQKPDQSPKLLIKYASQSFSGVPSRFSGSGSGTDFILTINSLEAEDAATYYCHQSGSLPQTFGQGTKVEIK<br>SEQ ID NO: 26936 | QVQLQESGPGLVKPSQTLSLTCTVSGGSISSGGYYWSWIRQHPGKGLEWIGYIFYSGSTNYNPSLRSRVTISVDTSKNQFSLKLSSVTAADTAVYYCARAGYNWNNGMDVWGQGTTVTVSS<br>SEQ ID NO: 30942 |

FIGURE 50
(Continued)

| | | | | |
|---|---|---|---|---|
| iPS:436218 | 21-225_200G7 | NA | GACATCGTGATGACCCAGTCTCCAGACTCCC GACTGCGTCTCTGGGCGAGAGGGCCACCGTCA AATGCAAGTCCAGCAGTCCAACAACTACTTAGCTTGGTACCA TCCAACAATAACAACCAGCCTCCTAAGCTGCTCA GCAGAAACCAGGACAGCCTCCTAAGCTGCTCA TTTACTGGGCATCTACCCGGGAATCCGAGTC CCTGACCGATTCAGTGGCAGCGGGTCTGGGAC AGATTTCACTCTCGCCATCAGCAGCCTGCAGG CTGAAGATGTGGCGGTTTATTACTGTCAGCAA TATTATAATACTCCTCGACACATTGGCACAAGG GACCAAGGTGGAAATCAAA <br><br> SEQ ID NO: 26937 | CAGGTGCAGCTGGTGCAGTCTGGGGCTGAGGTG AAGAAGCCTGGGGCCTCAGTGAAGGTCTCCTGC AAGGCTTCTGGATACGACCTTCACCAATTATGATA TCAACTGATGCGGCAGGCCACTGGTCAAGGC TTGAGTGGATGGATGGATGCACTTAACAGTGG TAACACAGGCTATGCACCGAAGTTCCAGGGCAG AGTCACCATGACCAGGGACACCTCCATAAGCAC AGCCTTCATGGAGCTGAGCAGCTGAGATCTGAG GACACGGCCGTGTATTACTGTGCCTATAGCGGTG GCTGGTACGGTTTGACCCTGGGCCAGGGAAC CCTGGTCACCGTCTCCTCA <br><br> SEQ ID NO: 30943 |
| | | AA | DIVMTQSPDSPTASLGERATVKCKSSQSVLHSSN NNNYLAWYQQKPGQPPKLLIYWASTRESGVPD RFSGSGSGTDFTLAISSLQAEDVAVYYCQQYYN TPPTFGQGTKVEIK <br><br> SEQ ID NO: 26938 | QVQLVQSGAEVKKPGASVKVSCKASGYTFTNYDIN WMRQATGQGLEWMGWMHLNSGNTGYAPKFQGR VTMTRDTSISTAFMELSSLRSEDTAVYYCAYSGGW YVFDPWGQGTLVTVSS <br><br> SEQ ID NO: 30944 |
| iPS:436220 | 21-225_200F8 | NA | GAAATTGTGCTGACTCAGTCTCCAAGACTTTCA GTCTGTGGCTCCAAAGGAGAAAGTCACCATCA CCTGCCGGCCAGTCCAGAGTATTGGTAGTAAC TTACACTGGTACCAGCAGAAAACCAGATCAGTC TCCGAAACTCCTCATCAAGTCTGCTTCCCAGTC CTTCTCAGGGGTCCCCTCGAGGTTCAGTGGCA GTGGATCTGGGACAGATTTCACCCTCACCATC AATAGCCTGGAAACTGAAGATGCTGCAACGTA TTACTGTCAGCAGAGTAGTAGTTTACCGTGGA CGTTCGGCCAAGGGACCAAGGTGGAAATCAA A <br><br> SEQ ID NO: 26939 | CAGGTGCAGCTGCAGGAGTCGGGCCCAGGACTG GTGAAGCCTTCGGAGACCCTGTCCTCACCTGCA CTGTCTCTGGTGGCTCCATCAATAATTACTACTG GAGCTGGATCCGGCAGCCCCGGGAAGGGACT GGAGTGGATTGGGCGTATCTATACCAGTGGAGC ACCAACTACAACCCCTCCCTCAAGAGTCGAGTCA CCATGTCAGTAGACACGTCCAAGAACCAGTTCTC CCTGAAGCTGAGCTCTGTGACCGCCGCGGACACG GCCGTGTATTACTGTGCAGAGATCGGGGATACT ATGGCTACTACGGTATGGACGTCTGGGGCCAAG GGACCACGGTCACCGTCCTCA <br><br> SEQ ID NO: 30945 |

FIGURE 50
(Continued)

| | | | |
|---|---|---|---|
| | | AA | EIVLTQSPDFQSVAPKEKVTITCRASQSIGSNLHW YQQKPDQSPKLLIKSASQSFSGVPSRFSGSGSGT DFTLTINSLETEDAATYYCQQSSSLPWTFGQGTK VEIK | QVQLQESGPGLVKPSETLSLTCTVSGGSINNYYWS WIRQPAGKGLEWIGRIYTSGSTNYNPSLKSRVTMS VDTSKNQFSLKLSSVTAADTAVYYCARDRGYYGY YGMDVWGQGTTVTVSS |
| | | | SEQ ID NO: 26940 | SEQ ID NO: 30946 |
| iPS:436222 | 21-225_200C9 | NA | GACATCCAGATGACCCAGTCTCCATCCTCCCT GTCTGCATCTGTTGGAGACAGAGTCACCATCA CTTGCCGGGCAACTCAGGCATTAGAAAAGAT TTAGGCTGGTATCAGCAGAAACCAGGGAAAG CCCCTAAGCGCCTGATCTATGCATCCAGT TTGCAAAGTGGGGTCCCATTAAGGTTCAGCGG CAGTGGATCTGGGACAGATTCACTCTCACAA TCAGCAGCCTGCAGCCTGAAGATTTTGCAACT TATTACTGTCTACAGCATATAGTTACCCGTG GACGTTCGGCCAAGGGACCAAGGTGGAAATC AAA | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGCAGTTATATCACCTCCGTGAAGGGCCGAT TATAAAACTATATAGACTCCGTGAAGGGCCGAT TCACCATCTCCAGAGACAATTCCAAGAACACGCT GTATCTGCAAATGAACAGCTGAGAGCTGAGGA CACGGCTGTGTTTACTGTGCGAGAGGTACCAC GGGTACTACTACGGTGTGGACGTCTGGGGCCAA GGGACCACGGTCACCGTCTCCTCA |
| | | | SEQ ID NO: 26941 | SEQ ID NO: 30947 |
| | | AA | DIQMTQSPSSLSASVGDRVTITCRATQGIRKDLG WYQQKPGKAPKRLIHTASSLQSGVPLRFSGSGS GTEFTLTISSLQPEDFATYYCLQHNSYPWTFGQG TKVEIK | QVQLVESGGGVVQPGRSLRLSCAASGFTFSSYGMH WVRQAPGKGLEWVAVISYDGGYKNYIDSVKGRFT ISRDNSKNTLYLQMNSLRAEDTAVFYCARGTHGYY YGVDVWGQGTTVTVSS |
| | | | SEQ ID NO: 26942 | SEQ ID NO: 30948 |

FIGURE 50
(Continued)

| | | | |
|---|---|---|---|
| iPS:436226 | 21-225_200F10 | NA | GAAATTGTGTTGACGCAGTCTCCAGGCACCCT GTCTTTGTCTCCAGGGGAAAGAGCCACCCTCT CCTGCAGGGCCAGTCAGTCAGAATATTCGCAGCAGC TTCTTAGCCTGGTACCAACAGAAACTGGCCA GGCTCCCAGGCTCCTCATCTATGGTGCATCA GCAGGGCCACTGGCATCCCAGACAGGTTCAGT GGCAGTGGGTCTGGGACAGACTTCACTCTCAC CATCAACAGACTGGAGCCTGAAGATTTTGCAG TGTATTACTGTCAGCAGTATGGTAACTCACCG TGGGCGTTCGGCCAAGGGACCAAGGTGGAAA TCAAA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGATTA CTACTGGAACTGGCTCCGCCAGCACCCAGAGAA GGGCCTGGAGTGGATTGGGTACATCTTTACAGT GGGAGCACCTACTACAACCGTCCCTCAAGAGTC GAATTACCATATCAGTGACACGTCTATGACCA GTTCTCCCTGAAGCTGACCTCTGTGACTGCCGCG GACACGGCCGTGTATTACTGTGCGAGAGGGATT ACGATGGTTCGGGGAGTTATCACTACTACGG TATGGACGTCTGGGGCCAAGGGACCACGGTCAC CGTCTCCTCA |
| | | | SEQ ID NO: 26943 | SEQ ID NO: 30949 |
| | | AA | EIVLTQSPGTLSLSPGERATLSCRASQNIRSSFLA WYQQKPGQAPRLLIYGASSRATGIPDRFSGSGSG TDFTLTINRLEPEDFAVYYCQQYGNSPWAFGQG TKVEIK | QVQLQESGPGLVKPSQTLSLTCTVSGGSISSGDYYW NWLRQHPEKGLEWIGYIFYSGSTYYNPSLKSRITISV DTSMTQFSLKLTSVTAADTAVYYCARGDYDGSGS YHYYYGMDVWGQGTTVTVSS |
| | | | SEQ ID NO: 26944 | SEQ ID NO: 30950 |
| iPS:436228 | 21-225_200F12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAGAG CCCCTAAGCGCCTGATCTATTCTGCATCCAGTT TGCATACTGGGGTCCCATCAAGGTTCAGCGGC AGTGGATCTGGGACAGATTTCACTCTCACAAT CAGCAGCCTGCAGCCTGAAGATTTTGCAACTT ATTACTGTCTACAGCATAAGAGTTACCCGCTC ACTTTCGGCGGAGGGACCAAGGTGGAGATCA AA | CAGGTGCAGCTGCAGTACAGCAGTGGGGCCAGGACTG TTGAAGCCTTGGAGACCCTGTCCCTCACCTGCG CTGTCTCTATGGTGGGTCCTTCAGTGGTTACTTCTGG ACCTGGATACGCCAGCCCCCAGGGAAGGGACTG GAGTGGATTGGGGAAATCAGTCATAGTGGAAGC ACCAACTACAACCGTCCCTCCAAGAGTCGAGTCA CCATATCAGTAGACACGTCCAAGAACCAGTTCTC CCTGAAGGTGAGCTCTGTGACGGCCGCGGACAC GGCTGTGTATTACTGTGCGAGGGACTACGGGCG GACTACTGGGGCCAGGGAACCCTGGTCACCGTCT CCTCA |
| | | | SEQ ID NO: 26945 | SEQ ID NO: 30951 |

FIGURE 50
(Continued)

| | | | |
|---|---|---|---|
| | | AA | DIQMTQSPSSLSASVGDRVTITCRASQGIRNDLG WYQQKPGKAPKRLIYSASSLHTGVPSRFSGSGSG TEFTLTISSLQPEDFATYYCLQHKSYPLTFGGGT KVEIK<br>SEQ ID NO: 26946 | QVQLQQWGAGLLKPSETLSLTCAVYGGSFSGYFW TWIRQPPGKGLEWIGEISHSGSTNYNPSLKSRVTISV DTSKNQFSLKVSSVTAADTAVYYCARDYGADYW GQGTLVTVSS<br>SEQ ID NO: 30952 |
| iPS:436230 | 21-225_201A1 | NA | GACATCCAGATGACCCAGTCTCCATCCTCCCT GTCTGCATCTGTAGGAGACAGAGTCACCATCA CTTGCCGGGCAAGTCAGGGCATTAGGAATGAT TTAGGCTGGTATCAGCAGAAACCAGGGAAAG CCCCTAAGCGCCTGATCTATTCTGCATCCATTT TACAAAGGGGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAAAAGTTACCCCTCTC ACTTTCGGCGGAGGGACCAAGGTGGAGGTCA AA<br>SEQ ID NO: 26947 | CAGGTGCAGCTACAGCAGTGGGGCGCAGGACTG TTGAAACCTTCGGAGACCCTGTCCCTCACCTGCG CTGTCACTGGTGGGTCCTCAGTGGTTACTTCTGG ACCTGGATCCGCCAGCCCCCAGGGAAGGGGCTG GAGTGGATTGGGGAAATCAGTCATAGTGGACGC ACCAACTACAACCCGTCCCTCAAGAGTCGAGTCA CCATATCAGGAGACACGTCCAAGAACCAGTTCTC CCTGAAGCTGAGCTCTGTGACCGCCGCGGACACG GCTGTGTATTACTGTGCGAGGGACTACGGGGCGG ACTACTGGGGCCAGGGAACCCTGGTCACCGTCTC CTCA<br>SEQ ID NO: 30953 |
| | | AA | DIQMTQSPSSLSASVGDRVTITCRASQGIRNDLG WYQQKPGKAPKRLIYSASILQRGVPSRFSGSGSG TEFTLTISSLQPEDFATYYCLQHKSYPLTFGGGT KVEVK<br>SEQ ID NO: 26948 | QVQLQQWGAGLLKPSETLSLTCAVTGGSFSGYFWT WIRQPPGKGLEWIGEISHSGRTNYNPSLKSRVTISG DTSKNQFSLKLSSVTAADTAVYYCARDYGADYWG QGTLVTVSS<br>SEQ ID NO: 30954 |

FIGURE 50
(Continued)

| | | | |
|---|---|---|---|
| iPS:436232 | 21-225_201E1 | NA | GAAATTGTGTTGACGCAGTCTCCAGACACCCT GTCTTTGTCTCCAGGGGAAAGAGCCACCCTCT CCTGCAGGGCCAGTCCAGTATTAACAGCGGC TTCTTAGCCTGGTACCAGCAGAAACCTGGCCA AGCTCCCAGGCTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAA TGTTTCACTGTCACCAGTATGAGACCTCACG TGGACGTTCGGCCAAGGGACCAAGGTGGAGA TCAAA SEQ ID NO: 26949 | CAGGTGCAGCTACAGCAGTGGGGCGCAGGACTG TTGAAGCCTTCGGAGACCCTGTCCCTCACCTGCG CTGTCTTTGATGGTTCCTTCAGTCCTTACTACTGG AGCTGGATCCGCCAGCCCCCAGGGAAGGGGCTG GAGTGGATTGGGGAAGTCAATCATAGTGGAAGC ACCAACTACAACCCGTCCCTCAAGAGTCGAGTCA CCATATCAGTAGACACGTCCAAGAACCAGTTCTC CCTGAAGCTGAGCTCTGTGACCGCCGCGACACG GCTGTGTATTACTGTGCGAGAGACTACGGGGGTT TAGACTACTGGGGCCAGGGAGCCCTGGTCACCG TCTCCTCA SEQ ID NO: 30955 |
| | | AA | EIVLTQSPDTLSLSPGERATLSCRASPSINSGFLA WYQQKPGQAPRLLIYGASSRATGIPDRFSGSGSG TDFTLTISRLEPEDFAMFHCQYETSPWTFGQGT KVEIK SEQ ID NO: 26950 | QVQLQQWGAGLLKPSETLSLTCAVFDGSFSPYYWS WIRQPPGKGLEWIGEVNHSGSTNYNPSLKSRVTISV DTSKNQFSLKLSSVTAADTAVYYCARDYGGLDYW GQGALVTVSS SEQ ID NO: 30956 |
| iPS:436234 | 21-225_51E3 | NA | CAGTCTGTGCTGACTCAGCCACCCTCAGCGTC TGGGACCCCCGGGCAGAGGGTCACCATCTCTT GTTCTGGAAGCAACTCCAACATCGGAAGTAAT ATTGTAAACTGGTACCAGCAGCTCCCAGGAAC GGCCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTACAGCATGGGATGACAGCCTG AATGGTTGGGTGTTCGGCGGAGGGACCACCGCT GACCGTCCTA SEQ ID NO: 26951 | CAGGTTCAGCTGGTGCAGTCTGGAGCTGAGGTGA AGAAGCCTGGGGCCTCAGTGAAGGTCTCCTGCA AGGCTTCAGGTTACACCTTTACACAGCTATGGTAT CAGCTGGGGTGCGACTGGCCCCTGGACAAGGCTT GAGTGGATGGGATGGATCAGCGCTTATAATGGTA ACACAAAGAATGCACCAGAGGTTCCAGGGCAGAG TCACCATGACCACAGACACATCCACGAGCACGG CCTACATGGAGCTGAGGAGCCTGAGATCTGACG ACACGGCCGTTTATTACTGTGCGAGACACGATTT TTGGAGTGGTTATTATAAGGTATGAGACGTCTGG GGCCAAGGGACCACGGTCACCGTCCTCA SEQ ID NO: 30957 |

FIGURE 50
(Continued)

| | | | |
|---|---|---|---|
| iPS:436236 | 21-225_201F7 | AA | QSVLTQPPSASGTPGQRVTISCSGSNSNIGSNIVTWYQQLPGTAPKLLIYSNDQRPSGVPDRFSGSKSGTSASLAISGLQSEDEADYYCTAWDDSLNGWVFGGGTTLTVL | QVQLVQSGAEVKKPGASVKVSCKASGYTFNSYGISWVRLAPGQGLEWMGWISAYNGNTKNAQRFQGRVTMTDTSTSTAYMELRSLRSDDTAVYYCARHDFWSGYYKGMDVWGQGTTVTVSS |
| | | | SEQ ID NO: 26952 | SEQ ID NO: 30958 |
| | | NA | GAAATAGTGATGACGCAGTCTCCAGCCACCCTGTCTGTGTCTCCAGGGGAAAGAGCCACCCTCTCCTGCAGGGCCAGTCAGTCAGATATTAAAAACAACTTAGCCTGGTACCAGCAGAAACCTGGCCAGGCTCCCAGGCTCCTCATCTTTGGTGCATCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTTTTATAACTGGCTGTGCAGTTTTGGCCAGGGGACCAAGCTGGAGCTCAAA | CAGGTACAGCTGCAGCAGTCAGGTCCAGGACTGGTGAAGCCCTCGCAGACCCTCTCACTCACCTGTGCCATCTCCGGGGACAGTGTCTCTAGCAACAGTGCTGCTTGGAACTGGATCAGGCAGTCCCCATCGAGAGGCCTTGAGTGGCTGGGAAGGACATACTACAGGTCCAAGTGGTATATAATTATTATGAAGTATCTGTGAGAAGTCGAATAACCATCAACCAGACACATCCAAGAACCAGTTCTCCCTGCAGCTGAACTCTGTGACTCCCGAGGACACGGCTGTATATTTCTGTGCGAGAGATCAACGGTACTACGGTATGGACGTCTGGGGCCAAGGGACCACGGTCACCGTCTCCTCA |
| | | | SEQ ID NO: 26953 | SEQ ID NO: 30959 |
| | | AA | EIVMTQSPATLSVSPGERATLSCRASQNIKNNLAWYQQKPGQAPRLLIFGASTRATGIPARFSGSGSGTEFTLTISSLQSEDFAVYYCQQFYNWLCSFGQGTKLELK | QVQLQQSGPGLVKPSQTLSLTCAISGDSVSSNSAAWNWIRQSPSRGLEWLGRTYYRSKWYNYEVSVRSRITNPDTSKNQFSLQLNSVTPEDTAVYFCARDQRYYGMDVWGQGTTVTVSS |
| | | | SEQ ID NO: 26954 | SEQ ID NO: 30960 |

FIGURE 50
(Continued)

| | | | |
|---|---|---|---|
| iPS:436238 | 21-225_201B2 | NA | GAAATTGTGTTTGACGCAGTCTCCAGGCACCCTGTCTTTGTCTCCAGGGGAAAGAGCCACCCTCCTGCAGGGCCAGTCAGAGTGTTAGCAGCAACTACTTAGCCTGGTATCAGCAGAGACCTGGCCAGGCTCCCAGACTCCTCATCTATGGTGCATCAGCAGGGCCACTGGCATCCCAGACAGATTCAGTGGCAGTGGGTCTGGGACAGACTTCACTCTCACCATCAGCAGACTGGAGCCTGAAGATTTTGCAGTGTATTTCTGTCAGCAGTATGAAAACTCACGTGGACGTTCGGCCAAGGGACCAAGGTGGAAATCAAA SEQ ID NO: 26955 |
| | | AA | EIVLTQSPGTLSLSPGERATLSCRASQSVSSNYLAWYQQRPGQAPRLLIYGASSRATGIPDRFSGSGSGTDFTLTISRLEPEDFAVYFCQQYENSPWTFGQGTKVEIK SEQ ID NO: 26956 |
| | | | CAGGTGCAGCTACAGCAGTGGGGCGCAGGACTGTTGAAGCCTTCGGAGACCCTGTCCCTCACCTGCGCTGTCTCTTTGGTGGGTCCATCAGTGTTTACTACTGGCACCTGGATCCGCCAGCCCCCAGGGAAGGGGCTGGAGTGGATTGGGGAAATCAATCATAGTGGAAGCACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGGGACTATGGTGTCTTTGATTACTGGGGCCAGGGAACCCTGGTCACCGTCTCCTCA SEQ ID NO: 30961 |
| | | | QVQLQQWGAGLLKPSETLSLTCAVFGGSISVYYWTWIRQPPGKGLEWIGEINHSGSTNYNPSLKSRVTISVDTSKNQFSLKLSSVTAADTAVYYCARDYGVFDYWGQGTLVTVSS SEQ ID NO: 30962 |
| iPS:436240 | 21-225_201E8 | NA | GAAATTGTGTTGACGCAGTCTCCAGGCACCCTGTCTGTGACTCCAAAGGAGAAAGCCACCATCACCTGCGGGGCCAGTCAGAGTCAGAACATTGGTGCTGTACACTGGTACCAGCAGAAACCAGATCTCCCAGTTACAAAACTCCTCATCAAGTATGCTTCCAGTCCTTCTCAGGGGTCCCCTGAGGTTCAGTGGCAGTGGATCTGGGACAGAGTTCACCCTCACCATCAATAGCCTGGAAGCTGAAGATGTGGAAGTTTACCGCTCACTTCTGTCATCAGAGTGAAGTGAAGATCAAGACGTGAAGGTGAAGATCA CGACACGGCCGTGTTTACTGTGCGAAGATCAAGGGTATAACTGAACTCTTTGACTACTGGGGCCAGGGAACCCTGGTCACCGTCTCCTCA SEQ ID NO: 26957 |
| | | | CAGGTGCAGCTGGTACAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGGATGGATCGACCCTAACAGTGGTGGCACAAACTATCCACAGAAGTTTCAGGGCAGGGTCACCATGACCAGGGACACGTCCATCAGCACAGCCTACATGGAACTGAGCAGGCTGAGATCTGACGACACGGCCGTGTATTACTGTGCGAAAGATCAAGGGTATAACTGAACTCTTTTGACTACTGGGGCCAGGGAACCCTGGTCACCGTCTCCTCA SEQ ID NO: 30963 |

FIGURE 50
(Continued)

| | | | |
|---|---|---|---|
| iPS:436242 | 21-225_201A10 | AA | EIVLTQSPAFQSVTPKEKVTITCRASQNIGRSLHW YQQKPDQSPKLLIKYASQSFSGVPSRFSGSGSGT NFTLTINSLEAEDAVTYYCHQSRSLPLTFGGGTK VEIR<br>SEQ ID NO: 26958 | QVQLVQSGAEVKKPGASVKVSCKASGYTFTGYYM HWVRQAPGQGLEWMGWIDPNSGGTNYPQKFQGR VTMTRDTSISTAYMELSRLRSDDTAVFYCAKDQGY NWNSFDYWGQGTLVTVSS<br>SEQ ID NO: 30964 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAGAG CCCCTAAGCGCCTGATCTATTCTACATCCAGTT TGCATTCTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATAGTTACCCGCTC ACTTTCGGCGGAGGGACCAAGGTGGAGATCA AA<br>SEQ ID NO: 26959 | CAGGTGCAGCTACAGCAGTGGGGCGCAGGACTG TTGAAGCCTTCGGAGACAGTCCCTGTCCTCACCTGCG CTGTCTATGTGGGTCCTTCAGTGTTACTTCTGG ACCTGGATACGCCAGCCCCAGGAAGGGACTG GAGTGGATTGGGAAATCAGTAGTAGTGGAAGC ACCAACTACAACCCGTCCCTCAAGAGTCGAGTCA CCATATCAGTAGACACGTCCAAGAACCAGTTCTC CCTGAAGGTGAACTCTGTGACCGCCGCGGACAC GGCTGTGTATTACTGTGCGAGGGACTACGGGGCG GACTACTGGGGCCAGGGAACCCTGGTCACCGTCT CCTCA<br>SEQ ID NO: 30965 |
| | | AA | DIQMTQSPSSLSASVGDRVTITCRASQGIRNDLG WYQQKPGRAPKRLIYSTSSLHSGVPSRFSGSGSG TEFTLTISSLQPEDFATYYCLQHNSYPLTFGGGT KVEIK<br>SEQ ID NO: 26960 | QVQLQQWGAGLLKPSETLSLTCAVYGGSFSGYFW TWIRQPPGKGLEWIGEISHSGSTNYNPSLKSRVTISV DTSKNQFSLKVNSVTAADTAVYYCARDYGADYW GQGTLVTVSS<br>SEQ ID NO: 30966 |

FIGURE 50
(Continued)

| | | | |
|---|---|---|---|
| iPS:436244 | 21-225_201H10 | NA | GACATCCAGATGACCCAGTCTCCATCTCCT GTCTGCATCTGTTGGAGACAGAGTCACCATCA CTTGCCGGGCAAGTCACAACATTAACAGCTAT TTAAATTGGTATCAGCAGAAATCAGGGAAAGC CCCTAAACTCCTAATCTATGCTGCATCCAGTTT GCAAAGTGGGGTCCCGTCAAGGTTCAGTGGCA GTGGATCTGGGACAGATTTCACTCTCACCTTC AGTAGTCTACAACCTGAAGATTTTGCAACTTA CTACTGTCAACAGAGTTACAGTTTCCCGCTCA CTTTCGGCGGAGGGACCAAGGTGGAGATGAG G |
| | | | SEQ ID NO: 26961 |
| | | AA | DIQMTQSPSSLSASVGDRVTITCRASHNINSYLN WYQQKSGKAPKLLIYAASSLQSGVPSRFSGSGS GTDFTLTFSSLQPEDFATYYCQQSYSFPLTFGGG TKVEMR |
| | | | SEQ ID NO: 26962 |
| | | NA | CAGGTGCAGCTGGTGCAGTCTGGGGCTGAGGTG AAGAAGCCTGGGGCTTCAGTGAAGGTCTCCTGC AAGGCTTCTGGATACACCTTCACCGGCTACTATA TCCACTGGGTGCGACAGGCCCCTGGACAAGGC TTGAGTGGATGGCATGGATCAACCCTAATAGTGG TGGCACAAACTATGCACAGAAGTTCAGGGCAG GGTCACCATGACCAGGGACACGTCCATCACCAC AACCTACATGGAGCTGAGCAGGCTGAGATCTGA CGACACGGCCGTGTATTACTGTGCGAGAGGATAC AGCTATGGTTACAACTGGTTCGACCCCTGGGGCC AGGGAACCCTGGTCACCGTCTCCTCA |
| | | | SEQ ID NO: 30967 |
| | | AA | QVQLVQSGAEVKKPGASVKVSCKASGYTFTGYYIH WVRQAPGQGLEWMAWINPNSGGTNYAQKFQGRV TMTRDTSITTYMELSRLRSDDTAVYYCARGYSYG YNWFDPWGQGTLVTVSS |
| | | | SEQ ID NO: 30968 |
| iPS:436246 | 21-225_201G6 | NA | GAGGTGCAGCTGTTGGAGTCTGGGGGAGGCTTG GTACAGCCTGGGGGGTCCCTGAGACTCTCCTGTG TAGCCTCTGGATTCACCTTTAGCAGCTATGCCAT GAGCTGGGTCCGCCAGGCTCCAGGGAAGGGGCT GGAGTGGGTCTCAACTATTAGTGGTGGTAGTGTT AGAACATACTACGCAGACTCCGTGAAGGGCCGG TTCACCATCTCCAGAGACAATTCCAAGAACACGC TGTTTCTGCAAATGAACAGCCTGAGAGCCGAGGA CACGGCCGTATATTACTGTGCGAAAGGGGAAG CTAGGAGCAGTGGCTGTTCCACTTTGACTACTG GGGCCAGGGAACCCTGGTCACCGTCTCCTCA |
| | | | SEQ ID NO: 30969 |

FIGURE 50
(Continued)

| | | | |
|---|---|---|---|
| iPS:436248 | | AA | DIVMTQSPLSLPVTPGEPASISCRSSQSLLHNNRY NHLDWYLQKPGQSPQLLIYLGSNRASGVPDRFS GSGSGTDFTLKISRVEAEDVGVYYCMQALQTPT FGGGTKVEIK | EVQLLESGGGLVQPGGSLRLSCVASGFTFSSYAMS WVRQAPGKGLEWVSTISGSGVRTYYADSVKGRFTI SRDNSKNTLFLQMNSLRAEDTAVYYCAKGGARSS GWFHFDYWGQGTLVTVSS |
| | | | SEQ ID NO: 26964 | SEQ ID NO: 30970 |
| | 21-225_202A3 | NA | GACATCCAGATGTCCAATCTCCATCCTCCT GTCTGCATCTGTTGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTGTGCTGCATCCAGG TTGCAAAGTGGGGTCCCATCCAAGGTTCAGCGG CAGTGGATCTGGGACAGATTCACTCTCACAA TCAGCAGCCTGCAGCCTGAAGATTTTGCAATT TATTACTGTCTACAGCATCATGACTACCCATTC ACTTTCGGCCCTGGGACCAAAGTGGATATCAA A | CAGGTGCAGCTGGAGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACAGGACAAGGGC TTGAGTGGCTGGGATGGATGAACCCTAAGAGAG GTAACACAGGCTATGCACAGGAATTCCAGGGCA GAGTCACCATGACCAGGAATACCTCATAAGCA CAGCCACATGGAGCTGAGCAGCCTGAGATCTG AGGACACGGCCGTGTATTACTGTGCGAGAGGAA GGTATAGCAGGGAGGATTACTACTACTATTATGA TATGGACGTCTGGGGCCAAGGGACCACGGTCAC CGTCTCCTCA |
| | | | SEQ ID NO: 26965 | SEQ ID NO: 30971 |
| | | AA | DIQMSQSPSSLSASVGDRVTITCRASQGIRNDLG WYQQKPGKAPKRLICAASRLQSGVPSRFSGSGS GTEFTLTISSLQPEDFAIYYCLQHHDYPFTFGPGT KVDIK | QVQLEQSGAEVKKPGASVKVSCKASGYTFTSYDIN WVRQATGQGLEWLGWMNPKRGNTGYAQKFQGR VTMTRNTSISTAHMELSSLRSEDTAVYYCARGRYS REDYYYYDMDVWGQGTTVTVSS |
| | | | SEQ ID NO: 26966 | SEQ ID NO: 30972 |

FIGURE 50
(Continued)

| | | | | |
|---|---|---|---|---|
| iPS:436250 | 21-225_201A4 | NA | GAAATAGTGATGACGCAGTCTCCAGCCACCCT GTCTGTGTCTCCAGGGGAAAGAGCCACCCTCT CCTGCAGGTCCAGTCAGAATATTAAAAGCAAC TTAGCCTGGTACCAGCAGAAACCTGGCCAGGC TCCCAGGCTCCTCATCTTTGGTGCATCCACCAG GGCCACTGGTATCCCAGCCAGTTCAGTGGCA GTGGGTCTGGGACAGAGTTCACTCTCACCATC AGCAGCCTGCAGTCTGAAGATTTTGCAGTTTA TTACTGTCAGCAGTTTTATAACTGGCTGTGCA GTTTTGGCCAGGGGACCAAGCTGGAGCTCAAA | CAGGTACAGCTGCAGCAGTCAGGTCCAGGACTG GTGAAGCCCTCGCAGACCCTCTCACTCACCTGTG CCATCTCCGGGGACAGTGTCTGTAGCAACAGTGC TGCTTGGAACTGGATCAGGCAGTCCCCATCGAGA GGCCTTGAGTGGCTGGGAAGGACATACTACAGG TCCAAGTGGTATAATTATTATGAAGTATCTGTGA AAAGTCGAATAACCATCAACCAGACACATCCA AGAACCAGTTCTCCTGCAGCTGAACTCTGTGAC TCCCGAGGACACGGCTGTATATTCTGTGCGAGA GATCAACAGGTACTACGGTATGGACGTCTGGGGCC AAGGGACCACGGTCACCGTCTCCTCA |
| | | | SEQ ID NO: 26967 | SEQ ID NO: 30973 |
| | | AA | EIVMTQSPATLSVSPGESATLSCRSSQNIKSNLA WYQQKPGQAPRLLIFGASTRATGIPARFSGSGSG TEFTLTISSLQSEDFAVYYCQQFYNWLCSFGQGT KLELK | QVQLQQSGPGLVKPSQTLSLTCAISGDSVSSNSAA WNWIRQSPSRGLEWLGRITYRSKWYNYYEVSVKS RITINPDTSKNQFSLQLNSVTPEDTAVYFCARDQRY YGMDVWGQGTTVTVSS |
| | | | SEQ ID NO: 26968 | SEQ ID NO: 30974 |
| iPS:436252 | 21-225_202A8 | NA | GAAATAGTGATGACGCAGTCTCCAGCCACCCT GTCTGTGTCTCCAGGGGAAAGAGCCACCCTCT CCTGCAGGCCAGTCAGAGTCAGAGAATTAACAACAA CTTAGCCTGGTACCAGCAGAGAAACCCTGGCCAGG CTCCCAGGCTCCTCATTTATGTGCATCCACCA GGGCCACTGGTGTCCCGGCCAGGTTCAGTGGC AGTGGGTCTGGGACAGAGTTCACTCTCACCAT CAGCAGCCTGCAGTCTGAAGACTTTACAGTTT ATTACTGTCACAGTATTATAATAACTGGCTGTGC AGTTTTGGCCAGGGGACCAAGCTGGAGATCAG A | CAGGTACAGCTGCAGCAGTCAGGTCCAGGACTG GTGAAGCCCTCGCAGACCCTCTCACTCACCTGTG CCATCTCCGGGGACAGTGTCTAGCAACAGTGC TGCTTGGAACTGGATCAGGCAGTCCCCATCGAGA GGCCTTGAGTGGCTGGGAAGGACATACTACAGG TCCAAGTGGTATAATGAGTATGCAGTATCTGTGA GAAGTCGAATAACCATCAACCAGACACATCCA AGAACCAGTTCTCCTGCAGCTGAACTCTGTGAC TCCCGAGGACACGGCTCTGTATTACTGTACAAGA GATCAACGGTACTACGGTATGGACGTCTGGGGCC AAGGGACCCCGGTCACCGTCTCCTCA |
| | | | SEQ ID NO: 26969 | SEQ ID NO: 30975 |

FIGURE 50
(Continued)

| | | | |
|---|---|---|---|
| iPS:436254 | 21-225_202C12 | AA | EIVMTQSPATLSVSPGERATLSCRASQRINNNLA WYQQNPGQAPRLLIYGASTRATGVPARFSGSGS GTEFTLTISSLQSEDFTVYYCQQYYNWLCSFGQG TKLEIR |
| | | | SEQ ID NO: 26970 |
| | | NA | GATATTGTGCTGACTCAGTCTCCACTCTCCCTG CCCGTCACCCCTGGAGAGCCGGCTCCATCTC CTGCAGGTCTAGTCAGAGCCTCCTGCATAATA ATAAATACAACCATTTGGATTGGTACCTGCAG AAGCCAGGGCAGTCTCCACAGCTCCTGATCTA TTTGGGTTCTAATCGGGCCTCCGGGGTCCCTG ACAGGTTCAGTGGCAGTGGATCAGGCACAGAT TTTACACTGAAAATCAGCAGAGTGGAGGCTGA GGATGTTGGGGTTTATTACTGCATGCAAGCTC TACAAACTCCCACTTTCGGCGGAGGGACCAAG GTGGAGATCAAA |
| | | | SEQ ID NO: 26971 |
| | | AA | DIVLTQSPLSLPVTPGEPASISCRSSQSLLHNNKY NHLDWYLQKPGQSPQLLIYLGSNRASGVPDRFS GSGSGTDFTLKISRVEAEDVGVYYCMQALQTPT FGGGTKVEIK |
| | | | SEQ ID NO: 26972 |
| | | | QVQLQQSGPGLVKPSQTLSLTCAISGDSVSSNSAA WNWIRQSPSRGLEWLGRTYYRSKWYNEYAVSVRS RITINPDTSKNQFSLQLNSVTPEDTALYYCTRDQRY YGMDVWGQGTPVTVSS |
| | | | SEQ ID NO: 30976 |
| | | | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAACTATTAGTGGTAGTGGTGTT AGAACATACTACGCAGACTCCGTGAAGGGCCGG TCCACCATCTCCAGAGACAATTCCAAGAATACGC TGTTTCTGCAAATGAACAGCCTGAGAGCCGAGG ACACGGCCGTATATTACTGTGCGAAGGGGGAG CTAGGAGCAGTGGCTGGTTCCACTTTGACTACTG GGGCCAGGGAACCCTGGTCACCGTCTCCTCA |
| | | | SEQ ID NO: 30977 |
| | | | EVQLLESGGGLVQPGGSLRLSCAASGFTFSSYAMS WVRQAPGKGLEWVSTISGSGVRTYYADSVKGRSTI SRDNSKNTLFLQMNSLRAEDTAVYYCAKGGARSS GWFHFDYWGQGTLVTVSS |
| | | | SEQ ID NO: 30978 |

FIGURE 50
(Continued)

| | | | |
|---|---|---|---|
| iPS:436256 | 21-225_202D9 | NA | GAAATTGTGTTGACGCAGTCTCCAGACACCCT GTCTTTGTCTCCAGGGGAAAGAGCCACCCTCT CCTGCAGGGCCAGTCAGAGTGTTAACAGCGGC TACTTAGCCTGGTACCAGCAGAAACCTGGCCA GTCTCCCAGGCTCCTCATCTATGGTGCATCCA GCAGGGCCACTGGCATCCCAGACAGGTTCAGT GGCAGTGGGTCTGGGACAGATTCACTCTCAC CATCAGCAGACTGGAGCCTGAAGATTTTGCAG TGCATTACTGTCAACAATATGAGACCTCACCG TGGACGTTCGGCCAAGGGACCAAGGTGGAAA TCAAA | CAGGTGCAGCTACAGCAGTGGGGCGCAGGACTG GTCTTGAAGCCTTCGGAGACCTGTCCCTCACCTGCG CTGTCTATGATGGTCCTTCAGTCCTTACTACTGG AGCTGGATCCGCCAGCCCCCAGGGAAGGGGCTG GAGTGGATTGGGGAAATCAATCATAGTGGAAGC ACCAACTACAATCCGTCCCTCAAGAGTCGAGTCA CCATATCAGTAGACACGTCCAAGAACCAGTTCTC CCTGAAGCTGAGCTCTGTGACCGCCGCGGACACG GCTGTATATTACTGTGCGAGAGACTACGGGGGTT TAGACTACTGGGGCCAGGGAACCCTGGTCACCGT CTCCTCA |
| | | | SEQ ID NO: 26973 | SEQ ID NO: 30979 |
| | | AA | EIVLTQSPDTLSLSPGERATLSCRASQSVNSGYLA WYQQKPGQSPRLLIYGASSRATGIPDRFSGSGSG TDFTLTISRLEPEDFAVHYCQQYETSPWTFGQGT KVEIK | QVQLQQWGAGLLKPSETLSLTCAVYDGSFSPYYW SWIRQPPGKGLEWIGEINHSGSTNYNPSLKSRVTISV DTSKNQFSLKLSSVTAADTAVYYCARDYGGLDYW GQGTLVTVSS |
| | | | SEQ ID NO: 26974 | SEQ ID NO: 30980 |
| iPS:436258 | 21-225_202F12 | NA | GAAATAGTGATGACGCAGTCTCCAGCCACCCT GTCTGTGTCTCCAGGGGAAAGAGCCACCCTCT CCTGCAGGGCCAGTCAGAGTGTTCTGAACAAC TTAGCCTGGTACCAGCAGAGACCTGGCCAGGC TCCCAGGCTCCTCATCTATGGTGCACTA GGGCCACTGGTATCCCAGCCAGGTTCAGTGGC AGTGGGTCTGGGACAGTTCACTCTCACCAT CAGCAGCCTGCAGTCTGAAGATTTTGCAGTT ATTACTGTCAGCAGTATGATAACTGGCCTCCG TGCAGTTTTGGCCAGGGGACCAAGCTGGAGAT CAAA | CAGGTGCAGCTGGTGGAGTCTGGGGGAGGCGTG GTCCAGCCTGGGAGGTCCCTGAGACTCTCCTGTG AAGCGTCTGGATTCACCTTCAGTTACTATGGCAT GCACTGGGTCCGCCAGGCTCCAGGCAAGGGACT GGAGTGGGTGGCAATTATATGGTATGATGGAAGT AATAAATTCTATGCAGATTCCGTGAAGGGCCGAT TCACCATCTCCAGAGACACGTTCAAGAACACGCT GTATCTGCAAATGAACAGCCTGAGAGCCGAGGA CACGGCTGTGTATTACTGTGCGAGTAATATAGCA GCAGCTGCCCCTTACTTTGACTACTGGGGCCAGG GAACCCTGGTCACCGTCTCCTCA |
| | | | SEQ ID NO: 26975 | SEQ ID NO: 30981 |

FIGURE 50
(Continued)

| | | | | |
|---|---|---|---|---|
| iPS:436260 | 21-225_203H1 | AA | EIVMTQSPATLSVSPGERATLSCRASQSVLNNLAWYQQRPGQAPRLLIYGASTRATGIPARFSGSGSGTEFTLTISSLQSEDFAVYYCQQYDNWPPCSFGQGTKLEIK | QVQLVESGGGVVQPGRSLRLSCEASGFTFSSYYGMHWVRQAPGKGLEWVAIIWYDGSNKFYADSVKGRFTISRDSSKNTLYLQMNSLRAEDTAVYYCASNIAAAAPYFDYWGQGTLVTVSS |
| | | | SEQ ID NO: 26976 | SEQ ID NO: 30982 |
| | | NA | GACATCCAGATGACCCAGTCTCCATCCTCACTGTCTGCATCTGTCGGAGACAGAGTCACCATCACTTGTCGGGCGAGTCAGGGCATTGGCAATTATTTAGCCTGGTTTCAGCAGAAACCAGGGAAAGCCCCTAAGTCCCTGATCTATGGTGCATCCAGGTTGCAAAGTGGGGTCCCATCAAGGTTCAGCGGCAGCTGGATCTGGGTCAGCTTCACTCTCACCATCAGCAGCCTGCCAACGGTATCATACTTACCGCTCATTACTGCCAACGGTATCATACTTACCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGAGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGAACAGTTGGCTACAACGGTATGGACGTCTGGGGCCAAGGGACCACGGTCACCGTCTCCTCA |
| | | | SEQ ID NO: 26977 | SEQ ID NO: 30983 |
| | | AA | DIQMTQSPSSLSASVGDRVTITCRASQGIGNYLAWFQQKPGKAPKSLIYVASRLQSGVPSKFSGTGSGSDFTLTISSLQPDDFATYYCQRYHTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRTVGYNGMDVWGQGTTVTVSS |
| | | | SEQ ID NO: 26978 | SEQ ID NO: 30984 |

FIGURE 50
(Continued)

| | | | |
|---|---|---|---|
| iPS:436262 | 21-225_203E3 | NA | GACATCCAGATGACCCAGTCTCCATCCTCCCC GTCTGCATCTGTTGGAGACAGAGTCACCATCA CTCGCCGGGCAAGTCACAACATTAACAGCTAT TTAAATTGGTATCAGCAGAAAATCAGGAAAGC CCCTAAACTCCTATCTATCTGCATCCAGTTT GCAAAGTGGGGTCCCGTCAAGGTTCAGTGGCA GTGGATCTGGGACAGATTTCACTCTCACTTTC AGTAGTCTACAACCTGAAGATTTTGCAACTTA CTACTGTCAACAGAGTTACAGTTTCCCGCTCA CTTTCGGCGGAGGGACCAAGGTGGAGATGAG G | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTCAGGCAG GTCACCATGACCAGGGACACGTCCATCACCAC AGCCTACATGGAGCTGAGCAGGCTGAGATCTGA CGACACGGCCGTGTACAACTGGTTCACCGGTTACACCGGTCACCGTCCTCA AGGGAACCCTGGTCACCGTCTCCTCA |
| | | | SEQ ID NO: 26979 | SEQ ID NO: 30985 |
| | | AA | DIQMTQSPSPSASVGDRVTITRRASHNINSYLN WYQQKSGKAPKLLIYAASSLQSGVPSRFSGSGS GTDFTLTFSSLQPEDFATYYCQQSYSFPLTFGGG TKVEMR | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS |
| | | | SEQ ID NO: 26980 | SEQ ID NO: 30986 |
| iPS:436264 | 21-225_203F7 | NA | GACATCCAGATGACCCAGTCTCCATCCTCCCG TTTTGCATCTGTAGGAGACAGAGTCACCATCA CTTGCCGGGCAAGTCAGGGCATTAGAGACATGAT TTAGGCTGGTATCAGCAGCAGAAAACCAGGGAAAG CCCTTAAGCGCTTGATATATGCTGCATCCAGTT TGCAAAGTGGGGTCCCATCAAGGTTCAGCGGC AGTGGATGTGGGACAGATTCACTCTCACAAT CAGCAGCCTGCAGCCTGAAGATTTTGCAAATT ATTACTGTCTACAGCATTATAGTTCCCCTCGGA CGTTCGGCCAAGGGACCAAGGTGGAAATCAA A | CAGGTGCAGCTGGTGCAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGCT GGAGTGGGTGGCAGTTATATGTAGACTCCGTGAAGT AATAAATACTATGTAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGGTAT AGCAGTGGCTTGTACGACTACGGTATGGACGTCT GGGGCCAAGGGACCACGGTCACCGTCTCCTCA |
| | | | SEQ ID NO: 26981 | SEQ ID NO: 30987 |

FIGURE 50
(Continued)

| | | | |
|---|---|---|---|
| iPS:436268 | 21-225_203B9 | AA | DIQMTQSPSSLSASVGDRVTITCRASQGIRHDLGWYQQKPGKALKRLIYAASSLQSGVPSRFSGSGCGTEFLTISSVQPEDFANYYCLQHYSFPRTFGQGTKVEIK<br>SEQ ID NO: 26982 | QVQLVESGGGVVQPGRSLRLSCAASGFTFSDYMHWVRQAPGKGLEWVAVIWYDGSNKYYVDSVKGRFTISRDNSRNTLYLQMNSLRAEDTAVYYCARERYSSGLYDYGMDVWGQGTTVTVSS<br>SEQ ID NO: 30988 |
| | | NA | GACATCCAGATGACCCAGTCTCCATCCTCCCTGTCTGCATCTGTAGGAGACAGAGTCACCATCACTTGCCGGGCAAGTCAGGGCATTAGACATGATTTAGGCTGGTATCAGCAGAAACCAGGGAAAGCCCCTAAGCGCCTGATCTATGCGGCATCCAGTGTGCAAAATGGGGTCCCATCAAGGTTCAGCGGCAGTGGATCTGGGACAGATTCACTCTCACAATCAGCAGCCTGCAGCCTGAAGATTTTGCAACTTATCACTGTCTACAGCATAATAGTTACCCATTCACTTTCGGCCCTGGGACCAAAGTGGATATCAAA<br>SEQ ID NO: 26983 | CAGGTGCAGCTGGTGGAGTCTGGGGGAGGCGTGGTCCAGCCTGGGAGGTCCCTGAGACTCTCCTGTGCAGCGTCAGGATTCACCTTCAGTAGTTTTGGCATGCACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACAATCTCCAGAGACAATTCCAAGAACACGCTGTATCTCCAAATGAACAGCCTGAGACCCGAGGACACGGCTGTGTATTACTGTGCGAGAGAACTGGGGTTCCTCTCTGACTACTGGGGCCAGGGAATCCTGGTCACCGTCTCCTCA<br>SEQ ID NO: 30989 |
| | | AA | DIQMTQSPSSLSASVGDRVTITCRASQGIRNDLGWYQQKPGKAPKRLIYRASSVQNGVPSRFSGSGSGTEFTLTISSLQPEDFATYHCLQHNSYPFTFGPGTKVDIK<br>SEQ ID NO: 26984 | QVQLVESGGGVVQPGRSLRLSCAASGFTLSSFGMHWVRQAPGKGLEWVAVIWYDVNNKYYADSVKGRFTISRDNSKNTLYLQMNSLRPEDTAVYYCARELGFLSDYWGQGILVTVSS<br>SEQ ID NO: 30990 |

FIGURE 50
(Continued)

| | | | | |
|---|---|---|---|---|
| iPS:436270 | 21-225_203F10 | NA | GACATCGTGATGACCCAGTCTCCAGACTCCCTGGCTGTGTCTCTGGGCGAGAGGGCCACCATCAACTGCAAGTCCAGCCAGAGTGTTTTTTCCACTCGAACAATAAGAACTACTTAGCTTGGTACCAGCAGAAACCAGGACAGCCTCCTAAGTTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGACAGTTTATTACTGTCAACAATATTTTAGTCTCCATTCACTTTCGGCCCTGGGACCAAAGTGGATATCACA | CAGGTGCAACTGGTGGAGTCTGGGGGAGGCTTGGTCAAGCCTGGAGGGTCCCTGAGACTCTCCTGTCAGCCCTCTGATTCACCTTCAGTGACTGACTACTACATGAGCTGGATCCGCCAGGCTCCAGGGAAGGGCTGGAGTGGGTTTATACATTAGTGGTAGTGGTACTACCACATACTACGCAGACTCTGTGAAGGGCCGATTCACCATCTCCAGGGACAACGCCAAGAACTCACTGTATCTGCAAATGAACAGCCTGAGAGCCGAGGACACGGCCGTGTATTACTGTGCGAGAGATAGGGGGGGTTTGACGTCTGGGGCCAAGGGACCACGGTCACCGTCTCCTCA |
| | | | SEQ ID NO: 26985 | SEQ ID NO: 30991 |
| | | AA | DIVMTQSPDSLAVSLGERATINCKSSQSVFFHSNNKNYLAWYQQKPGQPPKLLIYWASTRESGVPDRFSGSGSGTDFTLTISSLQAEDVTVYYCQQYFSLPFTFGPGTKVDIT | QVQLVESGGGLVKPGGSLRLSCAASGFTFSDYYMSWIRQAPGKGLEWVLYISGSGTTYYADSVKGRFTISRDNAKNSLYLQMNSLRAEDTAVYYCARDRGGLDVWGQGTTVTVSS |
| | | | SEQ ID NO: 26986 | SEQ ID NO: 30992 |
| iPS:436272 | 21-225_201F5 | NA | GACATCGTGATGACCCAGTCTCCAGAGTCCTGGCTGTGTCTCTGGGCGAGAGGGCCACCATCAACTGCAAGTCCAGCAGTGTTTATACAGTTCCAACAATAAGAACCAGGACAGCCTCTAAGTTTGGTACCAGCAGAAACCAGGACAGCCTCTACCGGGAATCCGGGGTCTTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCTGCAATATTATATAGTACTCCTCGACGTTCGGCCAAGGGACCAAGGTGGAAATCAAA | CAGGTGCAGCTGGTGCAGTCTGGGGCTGCGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACAGAAGTTCAGGGCAGTAACACAGGCTATGCACAGAAGTTCAGGGCAGAGTCACCATGACCAGGAACACCTCCATAAGCACAGCCTACATGGAGCTGAGCAGCCTGAGATCTGAGGACACGGCCGTGTATTACTGTGCCTATAGCAGTGGCTGGTACTACTTTGACTACTGGGGCCAGGGAACCCTGGTCACCGTCTCCTCA |
| | | | SEQ ID NO: 26987 | SEQ ID NO: 30993 |

FIGURE 50
(Continued)

| | | | |
|---|---|---|---|
| | | AA | DIVMTQSPESLAVSLGERATINCKSSQSVLYSSN NKNYLVWYQQKPGQPPKLLIYWASTRESGVPD RFSGSGSGTDFTLTISSLQAEDVAVYYCQQYYST PPTFGQGTKVEIK | QVQLVQSGAAVKKPGASVKVSCKASGYTFTNYDI NWVRQATGQGLEWMGWMHPNSGNTGYAQKFQG RVTMTRNTSISTAYMELSSLRSEDTAVYYCAYSSG WYYFDYWGQGTLVTVSS |
| | | | SEQ ID NO: 26988 | SEQ ID NO: 30994 |
| iPS:436274 | 21-225_204H3 | NA | GACATCCAGATGACCCAGTCTCCATCCTCCCT GTCTGCATCTGTAGGAGACAGAGTCACCATCA CTTGCCCGGGCAAGTCAGGGACATTAGAAATGAT TTAGGCTGGTATCAGCAGAAACCAGGGAAAG CCCCTGAACTCCTGATCTATGCTGCAGCCAGT TTGCAAGGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAACTCC AA | CAGGTGCAGCTGGTGGAGTCTGGGGGAGGCGTG GGCCAGCCTGGGAGGTCCCTGAGACTCTCCTGTA CAGCGTCTGGATTCACCTTCAGTAGCTATGTCAT GCACTGGGTCCGCCAGGCTCCAGGCAAGGGGCT GGAGTGGGTGGCAGTTATATGCAGACTCCGTGAAGT AATAAATATAATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAACCGTA TAGCAGCAGCTGGTACGACTACGGTATGGACGTC TCGGGCCAAGGGACCACGGTCACCGTCTCCTCA |
| | | | SEQ ID NO: 26989 | SEQ ID NO: 30995 |
| | | AA | DIQMTQSPSSLSASVGDRVTITCRASQGIRNDLG WYQQKPGKAPELLIYAAASLQGGVPSRFSGSGS GTEFTLTISSLQPEDFATYYCLQHYSYPRTFGQG TKVELQ | QVQLVESGGGVGQPGRSLRLSCTASGFTFSSYVMH WVRQAPGKGLEWVAVIWYDGSNKYNADSVKGRF TISRDNSKNTLYLQMNSLRAEDTAVYYCAREPYSS SWYDYGMDVSGQGTTVTVSS |
| | | | SEQ ID NO: 26990 | SEQ ID NO: 30996 |

FIGURE 50
(Continued)

| | | | |
|---|---|---|---|
| iPS:436276 | 21-225_204H4 | NA | GACATCCAGATGACCCTGTCTCCATCTCCC<br>GTCTGCATTTGTTGGAGACAGAGTCACCATCA<br>CTCGCCGGGCAAGTCACAACATTAACAGCTAT<br>TTAAATTGGTATCAGCAGAAATCAGGAAAGC<br>CCCTAAACTCCTATCTATGCTGCATCCAGTTT<br>GCAAAGTGGGGGTCCCGTCAAGGTTCAGTGGCA<br>GTGGATCTGGGACAGATTTCACTCTCACTTTC<br>AGTAGTCTACAACCTGAAGATTTTGCAACTTA<br>CTACTGTCAACAGAGTTACAGTTTCCGCTCA<br>CTTTCGGCGGAGGGACCAAGGTGGAGATGAG<br>G | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTATA<br>TCCACTGGGTGCGACAGGCCCCTGGACAAGGGC<br>TTGAGTGGATGGCATGGATCAACCCTAATAGTGG<br>TGGCACAAACTATGCACAGAAGTTTCAGGGCAG<br>GGTCACCATGACCAGGGACACGTCCATCACCAC<br>AGCCTACATGGAGCTGAGCAGGCTGAGATCTGA<br>CGACACGGCCGTGTATTACTGTGCGAGAGGATAC<br>AGCTATGGTTACAACTGGTTCGACCCCTGGGGCC<br>AGGGAACCCTGGTCACCGTCCTCA |
| | | | SEQ ID NO: 26991 | SEQ ID NO: 30997 |
| | | AA | DIQMTLSPSSPSAFVGDRVTITRRASHNINSYLN<br>WYQQKSGKAPKLLIYAASSLQSGVPSRFSGSGS<br>GTDFTLTFSSLQPEDFATYYCQQSYSFPLTFGGG<br>TKVEMR | QVQLVQSGAEVKKPGASVKVSCKASGYTFTGYYIH<br>WVRQAPGQGLEWMAWINPNSGGTNYAQKFQGRV<br>TMTRDTSITTAYMELSRLRSDDTAVYYCARGYSYG<br>YNWFDPWGQGTLVTVSS |
| | | | SEQ ID NO: 26992 | SEQ ID NO: 30998 |
| iPS:436278 | 21-225_201F2 | NA | GAGATAGTGATGACGCAGTCTCCAGCCACCCT<br>GTCTGTGTCTCCAGGGGAAAGAGCCACCCTCT<br>CCTGCAGGGCCAGTCAGAATATTAAAAGCAAC<br>TTAGCCTGGTACCAGCAGAAACCTGGCCAGGC<br>TCCCAGGCTCCTCATCTTTGGTGCATCCACCAG<br>GGCCACTGGTATCCCAGCCAGGTTCAGTGGCA<br>GTGGGTCTGGTACAGATTCACTCTCACCATC<br>AGCAGCCTGCAGTCTGAAGATTTTGCAGTGTA<br>TTACTGTCAGCAGTTTTATAACTGGCTGTGCA<br>GTTTTGGCCAGGGGACCAAGCTGGAGCTCAAG | CAGGTACAGCTGCAGCAGTCAGGTCCAGGACTG<br>GTGAAGCCCTCGCAGACCCTCTCACTCACCTGTG<br>CCATCTCCGGGGACAGTGTCTTAGCAACAGTGC<br>TGCTTGGAACTGGATCAGGCAGTCCCATCGAGA<br>GGCCTTGAGTGGCTGGAAGGACATACTACAGG<br>TCCAAGTGGTATAATTATTATGAAGTATCTGTGA<br>GAAGTCGAGTAACCATCAACCAGACACATCCA<br>AGAACCAGTTCTCCCTGCAACTGAACTCTGTGAC<br>TCCCGAGGACACGGCTGTGTATTCTGTGCGAGA<br>GATCAACGGTACTACGGTATGGACGTCTGGGGCC<br>AAGGGACCACGGTCACCGTCTCCTCA |
| | | | SEQ ID NO: 26993 | SEQ ID NO: 30999 |

FIGURE 50
(Continued)

| | | | |
|---|---|---|---|
| iPS:436280 | 21-225_204D6 | AA | EIVMTQSPATLSVSPGERATLSCRASQNIKSNLA WYQQKPGQAPRLLIFGASTRATGIPARFSGSGSG TEFTLTISSLQSEDFAVYYCQQFYNWLCSFGQGT KLELK<br>SEQ ID NO: 26994 | QVQLQQSGPGLVKPSQTLSLTCAISGDSVSSNSAA WNWIRQSPSRGLEWLGRTYYRSKWYNYYEVSVRS RVTINPDTSKNQFSLQLNSVTPEDTAVYFCARDQR YYGMDVWGQGTTVTVSS<br>SEQ ID NO: 31000 |
| | | NA | GACAGCCAGATGACCCAGTCTCCATCCTCCCT GTCTGCATCTGTAGGAGACAGAGTCACCATCA CTTGCCGGGCAAGTCGGAGCGTTCACACCTAT TTAAATTGGTATCAACAGAAGCCAGGGAAAG CCCCTAAGGTCCTGATCTATGGTGCATCCAGT TTGCAACGTGGGGTCCCATCAAGGTTCAGTGG CAGTGGATCTGGGACAGATTTCACTCTCACCA TCAGCAGTCTGCAACCTGAAGATTGTTGCAACT TACTACTGTCAACAGAGTTACAGTTCCCGCT CACTTTCGGCGGGGGACCAAGGTGGAGATCC AA<br>SEQ ID NO: 26995 | GAGGTGCAGGTGTTGGAGTCTGGGGGAGGCTTG GTGCAGCCTGGGGGGTCCCTGCGACTCTCCTGTG CAGCCTCTGGATTCACCTTTAGCACCTATGCCAT GAGCTGGGTCCGCCAGGCTCCAGGGAAGGGCT GGAGTGGGTCTCAGTATTAGTGGTAGTGGTGGT AGCACATATTACGCAGACTCCGTGAAGGGCCGG TTCACCATCTCCAGAGACAATTCCAAGAACACGC TGTATCTGCAAATGGACAGCCTGAGAGCCGAGG ACACGGCCGTATATTACTGTGCAAAGGGATAA GTGGAACCGGCTCCTACTACTACTACGGTGTGGA CGTCTGGGGCCAAGGGACCACGGTCACCGTCTCC TCA<br>SEQ ID NO: 31001 |
| | | AA | DSQMTQSPSSLSASVGDRVTITCRASRSVHTYLN WYQQKPGKAPKVLIYGASSLQRGVPSRFSGSGS GTDFTLTISSLQPEDVATYYCQQSYSSPLTFGGG TKVEIQ<br>SEQ ID NO: 26996 | EVQVLESGGGLVQPGGSLRLSCAASGFTFSTYAMS WVRQAPGKGLEWVSAISGSGGSTYYADSVKGRFTI SRDNSKNTLYLQMDSLRAEDTAVYYCAKGISGTGS YYYYGVDVWGQGTTVTVSS<br>SEQ ID NO: 31002 |

FIGURE 50
(Continued)

| | | | |
|---|---|---|---|
| iPS:436282 | 21-225_204G6 | NA | GACATCCGGATGACCCAGTCTCCATCCTCACT GTCTGCATCTGTAGGAGACAGAGTCACCATCA CTTGTCGGACGAGTCAGGGCATTGGCAATTAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTCACTCTCACCATC AGCAGCCTGCAGCCTGAAGATTTTGCAACTTA TTACTGCCAACACTATCTTAGTTACCCTCTCAC TTTCGGCGGAGGGACCAAGGTGGAGATCAAA <br> SEQ ID NO: 26997 | CAGGTGCAGCTGGTGGAGTCTGGGGGAGGCGTG GTCCAGCCTGGGAGGTCCCTGAGACTCTCCTGTA CAGCGTCTGATTCACCTTCAGTAGTAGCTATGGCAT GCACTGGGTCCGCCAGGCTCCAGGCAAGGGCT GGAGTGGGTGGCAGTTATATGCAGACTCCGTGAAGT AATAAAACTATGCAGAGACAATTCCAAGAACACGC TTCACCATCTCCAGAGACACAATGAACAGCCTGAGAGCCGAGG ACACGGCTGTGTATTACTGTGCGAGAGATCGAGG TGTCGGCTACGACGGTATGGACGTCTGGGGCCAA GGGACCACGGTCACCGTCCTCTCA <br> SEQ ID NO: 31003 |
| | | AA | DIRMTQSPSSLSASVGDRITITCRTSQGIGNYLAW FQQKPGKAPKSLIYAASSLQSGVPSRFSGSGSGT DFTLTISSLQPEDFATYYCQHYLSYPLTFGGGTK VEIK <br> SEQ ID NO: 26998 | QVQLVESGGGVVQPGRSLRLSCTASGFTFSSYGMH WVRQAPGKGLEWVAVIWYDGSNKNYADSVKGRF TISRDNSKNTLYLQMNSLRAEDTAVYYCARDRGV GYDGMDVWGQGTTVTVSS <br> SEQ ID NO: 31004 |
| iPS:436284 | 21-225_204G8 | NA | GACATCCAGATGACCCAGTCTCCATCCTCACT GTCTGCATCTGTAGGAGACAGAGTCACCATCA CTTGTCGGGCGAGTCAGGGCATAAGTAATCAT TTAGCCTGGTTTCAGCAGAAACCAGGGAAAGC CCCTAAGTCCCTGATCTTTGCTGCATCCAGTTT GCAAAGTGGGGTCCCATCACAGTTCAGCGGCA GTGGATCTGGGACCGAATTCACTCTCACCATC AGCAGCCTGCAACAACTATCTAGATAGTAATTACCCGGTCA CTTTCGGCGGAGGGACCAAGGTGGAGATCAA A <br> SEQ ID NO: 26999 | CAGGTGCAGCTGGTGGAGTCTGGGGGAGACGTG GTCCAGCCTGGGAGGTCCCTGAGACTCTCATGTG CAGCGTCTGATTCACCTTCAGTAGTAGCTATGGCAT GCACTGGGTCCGCCAGGCTCCAGGCAAGGGCT GGAGTGGGTGGCAGTTATATGCCTCCGTGAAGGGCCGAT AATGAAAATTATGTAGCCTCCGTGAAGGGCCGAT TCACCATCTTCAGAGACACAGCCTGAAGAACACGCT GTATCGCAAATGAACAGCCTGAGAGCCGAGGA CACGGCTGTGTATTACGGTATGGACGTCTGGGGGCAAG ATAGGGTATATTACGGTATGGACGTCTGGGGCCAAG GGACCACGGTCACCGTCCTCTCA <br> SEQ ID NO: 31005 |

FIGURE 50
(Continued)

| | | | |
|---|---|---|---|
| iPS:436286 | 21-225_204H8 | AA | DIQMTQSPSSLSASVGDRVTITCRASQGISNHLA WFQQKPGKAPKSLIFAASSLQSGVPSQFSGSGSG TEFTLTISSLQPEDFATYYCQQYSNYPVTFGGGT KVEIK<br>SEQ ID NO: 27000 | QVQLVESGGDVVQPGRSLRLSCAASGFTFSSYGMH WGRQAPGKGLEWVAVIWYDGSNENYVASVKGRF TIFRDNSKNTLYLQMNSLRAEDTAVYYCARDLGIG YYGMDVWGQGTTVTVSS<br>SEQ ID NO: 31006 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATTCTGCATCCAGTT TGCAAAGTGGGGTCCCATCAAGGTTCAGCGGC CGTGGATCGGGACAGAATTCACTCTCACAGT CAGCAGCCTGCAGCCTGAAGATTTTGCAACTT ATTACTGTCTACAACATAATAGTTACCCTCTCA CTTTCGGCGGAGGGACCAAGGTGGAGATCAA A<br>SEQ ID NO: 27001 | CAGGTGCAGCTACAGCAGTGGGGCGCAGGACTG TTGAAGCCTTCGGAGACCGTCCTCCTCACCTGCG CTGTCTATGGTGGGTCCTTCAGTGGTTACTTCTGG ACCTGGGTCCGCCAGCCCCCAGGGAAGGACTG GAGTGGATTGGGAAATCAGTCAGTGGAAGC ACCAGTTACAACCCGTCCCTCAAGAGTCGAGTCA CCATATCAGTAGACAAGTCCAAGAACCAGTTCTC CCTGAAGCTGAGCTCTGTGACCGCCGCGGACACG GCTGTGTATTACTGTGCGAGGGACTACGGGGCCG ACTACTGGGGCCAGGGAACCCTGGTCACCGTCTC CTCA<br>SEQ ID NO: 31007 |
| | | AA | DIQMTQSPSSLSASVGDRVTITCRASQGIRNDLG WYQQKPGKAPKRLIYSASSLQSGVPSRFSGRGS GTEFTLTVSSLQPEDFATYYCLQHNSYPLTFGGG TKVEIK<br>SEQ ID NO: 27002 | QVQLQQWGAGLLKPSETLFLTCAVYGGSFSGYFW TWVRQPPGKGLEWIGEISHSGSTSYNPSLKSRVTIS VDKSKNQFSLKLSSVTAADTAVYYCARDYGADY WGQGTLVTVSS<br>SEQ ID NO: 31008 |

FIGURE 50
(Continued)

| | | | |
|---|---|---|---|
| iPS:436290 | 21-225_205G3 | NA | GAAATCGTGTTGACGCAGTCTCCAGGCACCCT GTCTTTGTCTCCAGGGGAAAGAGCCACCCTCT CCTGCAGGGCCAGTCAGAATGTTAGTTACAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGATTCACTCTCAC CATCAGCAGACTGGAGCCTGAAGATTTTGCAG TGTATTACTGTCAGCAGTATGGTAGCTCACCG TGCAGTTTTGGCCAGGGGACCAAGCTGGAGAT CAAA<br><br>SEQ ID NO: 27003 | CAGGTGCAGCTACAGCAGTGGGGCGCAGGACTG TTGAAGCCTTCGGAGACCCTGTCCCTCACCTGCG CTGTCTTTGGTGGGTCCTTCAGTGGTCACTACTGG AGCTGGATCCGCCAGCCCCCAGGGAAGGGGCTG GAGTGGATTGGGGAAATGTATCATTTTGAAACA CCAACTACAACCGTCCCTCAAGAGTCGAGTCAC CATGTCAGTAGACACGTCCAAGAAACAGTTCTCC CTGAAGCTGAGCTCTGTGACCGCCGCGGACACG GCTGTGTATTACTGTGCGAGAGTGGGGCAGTGGC TGGCTTTTGATATCTGGGGCCAAGGGACAATGGT CACCGTCTCTTCA<br><br>SEQ ID NO: 31009 |
| | | AA | EIVLTQSPGTLSLSPGERATLSCRASQNVSYSYLA WYQQKPGQAPRLLIYGASRRATGIPDRFSGSGSG TDFTLTISRLEPEDFAVYYCQQYGSSPCSFGQGT KLEIK<br><br>SEQ ID NO: 27004 | QVQLQQWGAGLLKPSETLSLTCAVFGGSFSGHYW SWIRQPPGKGLEWIGEMYHFETNYNPSLKSRVTM SVDTSKKQFSLKLSSVTAADTAVYYCARVGQWLA FDIWGQGTMVTVSS<br><br>SEQ ID NO: 31010 |
| iPS:436292 | 21-225_205H3 | NA | GACATCCCGATGACCCAGTCTCCATCCTCACT GTCTGCATCTGTAGGAGACAGAGTCACCATCA CTTGTCGGGCAGTCAGGCCATTAGTAATCAT TTAGCCTGGTTTCAGCTGAAACCAGGGAAAGC CCCTAAGTCCCTGATCTATGCTGCATCCAGTTT GCAAAGTGGGGTCCCATCAAAGTTCAGCGGCA GTGGATCTGGGTCAGATTTCACTCTCACCATC AGCAGCCTGCAGCCTGAAGATTTTGCAACTTA TTACTGCCAACAATATAGTAATTACCCACTCA CTTTCGGCGGAGGGACCAAGGTGGAGATCAA A<br><br>SEQ ID NO: 27005 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGATAGATC AGTTGGCTACGACGGTACGGACGACGTCTGGGCCA AGGGACCACGGTCACCGTCTCCTCA<br><br>SEQ ID NO: 31011 |

FIGURE 50
(Continued)

| | | | |
|---|---|---|---|
| | AA | DIPMTQSPSSLSASVGDRVTITCRASQAISNHLA WFQLKPGKAPKSLIYAASSLQSGVPSKFSGSGSG SDFTLTISSLQPEDFATYYCQQYSNYPLTFGGGT KVEIK | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRSVG YDGTDVWGQGTTVTSS |
| | | SEQ ID NO: 27006 | SEQ ID NO: 31012 |
| iPS:436294 | NA | GAAATAGTGATGACGCAGTCTCCAGCCACCCT GTCTGTGTCTCCAGGGGAAAGAGCCACCCTCT CCTGCAGGGCCAGTCAGTTCAGAATATTAAAGCAAC TTAGCCTGGTACCAGCAGAAACCTGGCCAGGC TCCCAGGCTCCTCATCTTTGGTGCATCCACCAG GGCCACTGGTATCCCAGCCAGGTTCAGTGGCA GTGGGTCTGGGACAGAGTTCACTCTCACCATC AGCAGCCTGCAGCCTGAAGATTTTGCAGTTTA TTACTGTCAGCAGTTTATAACTGGCTGTGCA GTTTTGGCCAGGGACCAAGCTGGAGCTCAAA | CAGGTACAGCTGCAGCAGTCAGGACTG GTGAAGCCCTGCAGACCCTCACTCACCGTG CCATCTCCGGGACAGTGTCTCTAGCAACAGTGC TGCTTGGAACTGGATCAGGCAGTCCCATCGAGA GGCCTTGAGTGGCTGGGAAGGACATATTACAGGT CCAAGTGGTATAATTATTATGAAGTATCTGTGAG AAGTGAATAACCATCAACCAGACACATCCAA GAACCAGTTCTCCCTGCAGCTGAATTCTGTGACT CCCGAGGACACGGCTGTGTATTTCTGTGCGAGAG ATCAACGGTACTACGGTATGGACGTCTGGGGCCA AGGGACCACGGTCACCGTCTCCTCA |
| | | | SEQ ID NO: 31013 |
| 21-225_205G4 | AA | EIVMTQSPATLSVSPGERATLSCRASQNIKSNLA WYQQKPGQAPRLLIFGASTRATGIPARFSGSGSG TEFTLTISSLQSEDFAVYYCQQFYNWLCSFGQGT KLELK | QVQLQQSGPGLVKPSQTLSLTCAISGDSVSSNSAA WNWIRQSPSRGLEWLGRTYYRSKWYNYEVSVRS RITINPDTSKNQFSLQLNSVTPEDTAVYFCARDQRY YGMDVWGQGTTVTSS |
| | | SEQ ID NO: 27007 | |
| | | SEQ ID NO: 27008 | SEQ ID NO: 31014 |

FIGURE 50
(Continued)

| | | | |
|---|---|---|---|
| iPS:436296 | 21-225_205F5 | NA | GACATCCAGATGACCCAGTCCTCATCCTCACTGTCTGCATCTGTAGGAGACAGAGTCACCATCACTTGTCGGGCGAGTCAGGGCATTGGCAATTATTTAGCCTGGTTTCAGCAGAAACCAGGGAAAGCCCCTAAGTCCCTGATCTATGCTGTCTCCAGTTTGCAAAGTGGGGTCCCATCAAGTTCAGCGGCAGTGGATCTGGGACAGATTTCACTCTCACCATCAGCAGCCTGCAGCCTGAAGATTTTGCAACTTATACTGCCAACAATATAGTAATTACCCTCTCACTTTCGGCGGAGGGACCAAGGTGGACATCAGA | CAGGTGCAGCTGGTGCAGTCTGGGGGAGGCGTGGTCCAGCCTGGGAGGTCCCTGAGACTCTCCTGTGCAGCGTCTGGATTCACCTTCAGTAGATATGGCATGCACTGGGTCCGCCAGGCTCCAGGCAAGGGACTGGAGTGGGTGGCAGTTATATGTATGATGGAAGTAATGAGAATTATGTAGACTCCGTGAAGGGCCGATTCACCATCTCCAGAGACACTTCCAAGAAAATGCTGTTTCTGCAAATGAACAGCCTGAGAGAACCGATGACACGGCTGTGTATTACTGTGCGAGAGATATGGGGATAGGGTATTATGGTATGGACGTCTGGGGCCAAGGGACCACGGTCACCGTCTCCTCA |
| | | AA | DIQMTQSPSSLSASVGDRVTITCRASQGIGNYLAWFQQKPGKAPKSLIYGVSSLQSGVPSKFSGSGSGTDFTLTISSLQPEDFATYTCQQYSNYPLTFGGGTKVDIR. | QVQLVESGGGVVQPGRSLRLSCAASGFTFSRYGMHWVRQAPGKGLEWVAVIWYDGSNENYVDSVKGRFTISRDTSKKMFLQMNSLRTDDTAVYYCARDMGIGYYGMDVWGQGTTVTVSS |
| | | | SEQ ID NO: 27009 | SEQ ID NO: 31015 |
| | | | SEQ ID NO: 27010 | SEQ ID NO: 31016 |
| iPS:436302 | 21-225_205G7 | NA | GAAATTGTGTTGACGCAGTCTCCAGGCACCCTGTCTTTGTCTCCAGGGGAAAGAGCCACCCTCTCCTGCAGGGCCAGTCAGAGTGTTTTCAGCAACTACTTAGCCTGGTACCAGCAGAAACCTGGCCAGGCTCCCAGGCTCCTCATCTATGGTGCATCAGCAGGGCCACTGGCATCCCCGACAGGTTCAGTGGCAGTGGGTCTGGGACAGACTTCACTCTCACCATCAGCAGACTGGAGCCTGAAGATTTTGCAGTGTATTACTGTCAGCAGTATGAAAGTTCACCGTGGACGTTCGGCCAAGGGACCAAGGTGGAAATCAAA | CAGGTGCAGCTGCAGTACAGCAGTGGGGCGCAGGACTGTTGAAGCCTTCGGAGACCCTGTCCCTCACCTGCGCTGTCTATGGTGGGTCCTTCAGTGTTATTACTGGAGCTGGATCCGCCAGCCCCCAGGGAAGGGGCTGGAGTGGATTGGGAAAGCAATCAGAGTGGACGCACCACCTACTACAACCCGTCCCTCAAGAGTCGAGTCACCATATCAGTAGACACGTCCAAGAACCAGTTCTCCCTGAATCTGATCTCTGTGACCGCCGCGGACACGGCTGTGTATTACTGTGCGAGGGACTACGGTGTCTTGACTACTGGGGCCAGGGAACCCTGGTCACCGTCTCCTCA |
| | | | SEQ ID NO: 27011 | SEQ ID NO: 31017 |

FIGURE 50
(Continued)

| | | | | |
|---|---|---|---|---|
| iPS:436304 | 21-225_201F3 | AA | EIVLTQSPGTLSLSPGERATLSCRASQSVFSNYLAWYQQKPGQAPRLLIYGASSRAAGIPDRFSGSGSGTDFTLTISRLEPENFAVYYCQQYESSPWTFGQGTKVEIK | QVQLQQWGAGLLKPSETLSLTCAVYGGSFSVYYWSWIRQPPGKGLEWIGESNQSGRTTYNPSLKSRVTISVDTSKNQFSLNLISVTAADTAVYYCARDYGVFDYWGQGTLVTVSS |
| | | | SEQ ID NO: 27012 | SEQ ID NO: 31018 |
| | | NA | GATATTGTGATGACTCAGTCTCCACTCTCCCTGCCCGTCACCCCTGGAGAGCCGGCTCCATCTCTGCAGGTCTAGTCAGAGCCTCCTGCATAATAATAGATACAACCATTTGGATTGGTACCTGCAGAAGCCAGGGCAGTCTCCACAGCTCCTGATCTATTTGGGTTCTAATCGGGCCTCCGGGGTCCCTGACAGGTTCAGTGGCAGTGGATCAGGCACAGATTTTACACTGAAAATCAGCAGAGTGGAGCCTGAGGATGTTGGGGTTTATTACTGCATGCAAGCTCTACAAACTCCCACTTTCGGCGGAGGGACCAAGGTGGAGATCAAA | GAGGTGCAACTGTTGGAGTCTGGGGGAGGCTTGGTACAGCCTGGGGGGTCCCAGAGACTCTCCTGTGCAGCCTCTGAGATTCACCTTTAGCAGCTATGCCATGAGCTGGGTCCGCCAGGCTCCAGGGAAGGGGCTGGAGTGGGTCTCAACTATTAGTGGTAGTGGTGTTAGAACATACTACGCAGACTCCGTGAAGGGCCGGTTCACCATCTCCAGAGACAATTCCAATAACAGCCTGTTTCTGCAAATGAACAGCCTGAGAGCCGAGGACACGGCCGTATATTACTGTGCGAAAGGGGAGCTAGGAGCAGTGGCTGGTTCCACTTTGACTACTGGGGCCAGGGAACCCTGGTCACCGTCTCCTCA |
| | | | SEQ ID NO: 27013 | SEQ ID NO: 31019 |
| | | AA | DIVMTQSPLSLPVTPGEPASISCRSSQSLLHNNRYNHLDWYLQKPGQSPQLLIYLGSNRASGVPDRFSGSGSGTDFTLKISRVEAEDVGVYYCMQALQTPTFGGGTKVEIK | EVQLLESGGGLVQPGGSQRLSCAASGFTFSSYAMSWVRQAPGKGLEWVSTISGSGVRTYYADSVKGRFTISRDNSNTLFLQMNSLRAEDTAVYYCAKGGARSSGWFHFDYWGQGTLVTVSS |
| | | | SEQ ID NO: 27014 | SEQ ID NO: 31020 |

FIGURE 50
(Continued)

| | | | |
|---|---|---|---|
| iPS:436306 | 21-225_201H4 | NA | GAAATAGTGATGACGCAGTCTCCAGCCACCCTGTCTGTGTCTCCAGGGGAAAGAGCCACCCTCCTGCAGGGCCAGTCAGAGTCAGAGAGTGTTAATAGCTACTTAGCCTGGTACCAGCAGAAACCTGGCCAGGCTCCCAGGCTCCTCATCTATGGTGCATCCACCAGGGCCACTGGTATCCCAGCCAGGTTCAGTGGCAGTGGGTCTGGGACAGAGAATTCACTCTCACCATCAGCAGCCTGCAGTCTGAAGATATTGACTGGCCGTGCATTACTGTCAAGAGTATATGACTGGCCTGCAGTTTAGTTTTGGCCAGGGACCAACCTGGAGATCAA A | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGCCATGCACTGGGTCCGCCAGGCTCCAGGCAAGGGGCTGGAGTGGGTGGCAGCTATATGGTATGATGGAAGTAATAAATACAATTCCAAGAGACAATTCCAAGAACACGATTCACCATCTCCAGAGACAATGAACAGCCTGAGAGCCGAGGACACGGCTGTATACTACTGTGCGAGAGATGTGGGTACAGTGGGAGCTACTACTTTGACTGCTGGGGCCCGGGAACCCTGGTCACCGTCTCCTCA SEQ ID NO: 31021 |
| | | AA | EIVMTQSPATLSVSPGERATLSCRASQSVNSYLAWYQQKPGQAPRLLIYGASTRATGIPARFSGSGSGTEFTLTISSLQSEDFAVYYCQEYNDWPCSFGQGTNLEIK SEQ ID NO: 27015 | QVQLVESGGGVVQPGRSLRLSCAASGFTFSSYAMHWVRQAPGKGLEWVAAIWYDGSNKYNADSVKGRFTISRDNSKNTLYMQMNSLRAEDTAVYYCARDVGTVGATYFDCWGPGTLVTVSS SEQ ID NO: 31022 |
| iPS:436308 | 21-225_205H8 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACAAGGGAAAGCCCCTAAGCTCCTGATCTATTCTGCATCCTTTTGCAAAGAGGGGTCCCATCAAGATTCAGCGGCAGTGGATCTGGGACAGACAGCCTCACTCTCACAATCAGCAGCCTGCAGCCTGAAGATTTTGCAGCTTATTACTGTCTACAGCATAATAGTTACCCGCTCACTTTCGGCGGAGGGACCAAGGTGGAAGATCAAAA SEQ ID NO: 27017 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTACTTCTGGAGCTGGATCCGCCAGCCCCCAGGGAAGGGGCTGGAGTGGATTGGGGAAATCAGTCATAGTGGACGCACCAACTACAACCCGTCCCTCAAGAGCCGAGTCACCATATCAGTAGACACGTCCAAGAACCAGTTCTCCCTGAAGGTGAGCTCTGTGACCGCCGCGACACGGCTGTGTATTACTGTGCGAGGGACTACGGGGCGGACTACTGGGGCCAGGGAACCCTGGTCACCGTCTCCTCA SEQ ID NO: 31023 |

FIGURE 50
(Continued)

| | | | |
|---|---|---|---|
| iPS:436310 | 21-225_202D11 | AA | DIQMTQSPSSLSASVGDRVTITCRASQGIRNDLG WYQQKQGKAPKLLIYSASFLQRGVPSRFSGSGS GTEFTLTISSLQPEDSAAYYCLQHNSYPLTFGGG TTVKIK<br><br>SEQ ID NO: 27018 | QVQLQQWGAGLLKPSETLSLTCAVYGGSFSGYFW SWIRQPPGKGLEWIGEISHSGRTNYNPSLKSRVTISV DTSKNQFSLKVSSVTAADTAVYYCARDYGADYW GQGTLVTVSS<br><br>SEQ ID NO: 31024 |
| | | NA | GAAATTGTGTTGACGCAGTCTCCAGGCACCCT GTCTTTGTCTCCAGGGGAAAGAGCCACCCTCT CCTGCAGGGCCAGTCAGAGTATTAACAGCAAC TACTTAGCCTGGTACCAGCAGAAGCCTGGCCA GGCTCCCAGGGTCCTCATCTATGGTGCATCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TGTTTTACTGTCAGCAGTATGAAAACTCACCG TGGACGTTCGGCCAAGGGACCAAGGTGGAAA TCAAA<br><br>SEQ ID NO: 27019 | CAGGTGCAGCTACAGCAGCGGGGCGCAGGACTG TTGAAGCCTTCGGAGACCCTGTCCCTCACCTGCG CTGCCTATGGTGGGTCCTTCAGTGGTCCCTACTG GAGCTGGATCCGCCAGCCCCAGGGAAGGGCCT GGAGTGGATTGGGAAATCAATCATAGTGGAAG CACCAACTACAACCCGTCCCTCAAGAGTCGAGTC ACCATATCAGTAGACACGTCAAGAACCAGTTCT CCCTGAAGCTGAGCTCTGTGACCGCCGCGGACAC GGCTGTTTACTACTGTGCGAGGGACTACGGTGTC CTTGACTACTGGGGCCAGGGAACCCTGGTCACCG TCTCCTCA<br><br>SEQ ID NO: 31025 |
| | | AA | EIVLTQSPGTLSLSPGERATLSCRASQSINSNYLA WYQRKPGQAPRVLIYGASSRATGIPDRFSGSGSG TDFTLTISRLEPEDFAVFYCQQYENSPWTFGQGT KVEIK<br><br>SEQ ID NO: 27020 | QVQLQQRGAGLLKPSETLSLTCAAYGGSFSGPYWS WIRQPPGKGLEWIGEINHSGSTNYNPSLKSRVTISV DTSKNQFSLKLSSVTAADTAVYYCARDYGVLDYW GQGTLVTVSS<br><br>SEQ ID NO: 31026 |

FIGURE 50
(Continued)

| | | | |
|---|---|---|---|
| iPS:436312 | 21-225_206A4 | NA | GACATCCAGATGACCCTGTCTCCATCTCCC GTCTGCATTTGTTGGAGACAGAGTCACCATCA CTCGCCGGGCAAGTCACAACATTAACAGCTAT TTAAATTGGTATCAGCAGAAATCAGGGAAAGC CCCTAAACTCCTATCTGTCTGCATCCAGTTT GCAAAGTGGGGGTCCCGTCAAGGTTCAGTGGCA GTGGATCTGGGACAGATTTCACTCTCACTTTC AGTAGTCTACAACCTGAAGATTTTGCAACTTA CTACTGTCAACAGAGTTACAGTTTCCGCTCA CTTTCGGCGGAGGGACCAAGGTGGAGATGAG G | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGCACAGAAGTTCAGGGCAG TGGCACAAACTATGCACAGAAGTTCAGGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTCGACCCCTGGGGCC AGGGAACCCTGGTCACCGTCCTCA |
| | | | SEQ ID NO: 27021 | SEQ ID NO: 31027 |
| | | AA | DIQMTLSPSSPSAFVGDRVTITRRASHNINSYLN WYQQKSGKAPKLLICAASSLQSGVPSRFSGSGSG TDFTLTFSSLQPEDFATYYCQQSYSFPLTFGGGT KVEMR | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS |
| | | | SEQ ID NO: 27022 | SEQ ID NO: 31028 |
| iPS:436314 | 21-225_206G4 | NA | GAAATTGTGCTGACTCAGTCTCCAGACTTTCA GTCTGTGACTCCAAAGGAGAAAGTCACCATCA CCTGCCGGCCAGTCAGGGCATTGGTAGTAGC TACACTGGTTACCAGCAGAAACCAGATCAGTC TTACACTGGTTACCAGCAGAAACCAGATCAGTC TCCAAAACTCCTCATCAAGTATGCTCCCAGT CCTTCTCAGGGGTCCCCTCGAGGTTCAGTGGC AGTGGATCTGGGACAGATTTCACCCTCACCAT CAATAGCCTGGAAGCTGAAGATGCTGCAACGT ATTACTGTCATCAGAGTAGAAGTTTACCGCTC ACTTTCGGCGGAGGGACCAAGGTGGAGATCA AA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATGCACAGAAGTTCAGGGCAG TGGCACAAACTATGCACAGAAGTTCAGGGCAG AATCACCATGACCAGGGACACGTCCATCAGTAC AGCCTACATGAACTGAGCAGGCTGAGATCTGA CGACACGGCCGTGTTTTACTGTGCGAAAGATCAA GGGTATAACTGGAACTCTTTGACTACTGGGGCC AGGGAACCCTGGTCACCGTCCTCA |
| | | | SEQ ID NO: 27023 | SEQ ID NO: 31029 |

FIGURE 50
(Continued)

| | | | |
|---|---|---|---|
| iPS:436316 | 21-225_206A5 | AA | EIVLTQSPDFQSVTPKEVTITCRASQSIGRSLHW YQQKPDQSPKLLIKYASQSFSGVPSRFSGSGSGT DFTLTINSLEAEDAATYYCHQSRSLPLTFGGGTK VEIK<br>SEQ ID NO: 27024 | QVQLVQSGAEVKKPGASVKVSCKASGYTFTGYYIH WVRQAPGQGLEWMGWIDPNSGGTNYAQKFQGRI TMTRDTSISTAYMELSRLRSDDTAVFYCAKDQGYN WNSFDYWGQGTLVTVSS<br>SEQ ID NO: 31030 |
| | | NA | GACATCCAGATGACCCAGTCTCCATCCTCCC GTCTGCATCTGTTGGAGACAGAGTCACCATCA CTCGCCGGGCAAGTCACAACATTAACAGCTAT TTAAATTGGTATCAGCAGAAATCAGGGAAAGC CCCTAAACTCCTTATCTGTGCTGCATCCAGTTT GCAAAGTGGGGTCCCGTCAAGGTTCAGTGGCA GTGGATCTGGGACAGATTTCACTCTCACTTTC AGTAGCTACAACCTGAAGATTTTGCAACTTA CTACTGTCAACAGAGTTACAGTTCCCGCTCA CTTTCGGCGGAGGGACCAAGGTGGAGATGAG G<br>SEQ ID NO: 27025 | CAGGTGCAGCTGGTGCAGTCTGGGGCTGAGGTG AAGAAGCCTGGGGCTCAGTGAAGGTCTCCTGC AAGGCTTCTGGATACACCTTCACCGGCTACTATA TCCACTGGGTGCGACAGGCCCCTGGACAAGGC TTGAGTGGATGGCATGGATCAACCTAATAGTGG TGGCACAAACTATGCACAGAAGTTTCAGGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGTATGGTTACAACTGGTTCGACCCCTGGGGCC AGGGAACCCTGGTCACCGTCTCCTCA<br>SEQ ID NO: 31031 |
| | | AA | DIQMTQSPSSPSASVGDRVTITRRASHNINSYLN WYQQKSGKAPKLLICAASSLQSGVPSRFSGSGSG TDFTLTFSSLQPEDFATYYCQQSYSFPLTFGGGT KVEMR<br>SEQ ID NO: 27026 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br>SEQ ID NO: 31032 |

FIGURE 50
(Continued)

| | | | |
|---|---|---|---|
| iPS:436324 | 21-225_207G6 | NA | GATATCCAGATGACCCAGTCTCCATCCTCACT GTCTGCATCTGTAGGAGACAGAGTCACCATCA CTTGTCGGGCGAGTCAGGGCATTAGAAATTAT TTAGCCTGGCTTCAGCAGAAACCAGGGAAGGC CCCTAAGTCCCTGATCCATGCTGCATCCAGTT GCAAAGTGGGGTCCCATCAAGGTTCAGCGGCA ATAGATCTGGGACAGATTTCACTCTCACCATC AGCAGCCTGCAGCCTGAAGATTTTGCAACTTA TTACTGCCAACAGTACAGTAATTACCCTCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAAAACTATGCAGAGTCCGTGAAGGGCCGA TTCACCATCTCCAGAGACAATTCCAAGAACACGC TGTATCTGCAAATGAACAGCCTGAGAGCCGAGG ACACGGCTGTGTATTATTGTGCGAGAGATGCGGG TATTGGATACTACGGTATAGACGTCTGGGGCCAA GGGACCACGGTCACCGTCTCCTCA |
| | | | SEQ ID NO: 31033 |
| | | AA | DIQMTQSPSSLSASVGDRVTITCRASQGIRNYLA WLQQKPGKAPKSLIHAASSLQSGVPSKFSGNRS GTDFTLTISSLQPEDFATYYCQQYSNYPLTFGGG TKVEIK | QVQLVESGGGVVQPGRSLRLSCAASGFTFSSYGMH WVRQAPGKGLEWVAVIWYDGSNKNYAESVKGRF TISRDNSKNTLYLQMNSLRAEDTAVYYCARDAGIG YYGIDVWGQGTTVTVSS |
| | | | SEQ ID NO: 27028 | SEQ ID NO: 31034 |
| iPS:436328 | 21-225_207F12 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTTCTGTCTACAGCATAATAGTTACCCTCTC ACCTTCGGCCAAGGGACACGACTGGAAATTAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAGTTATATGGTATGATGAAAT TCACCATCTCCAGAGACAATTCCGTGAAGGGCCGAT TCACCATCTCCAGAGACAATGAACAGCCTGAGAGCCGAGGA CACGGCTGTGTATTACTGTGCGAGAGAACTGGGG GTATCTGCAAATGAACAGCCTGAGAGCCGAGGA CACGGCTGTGTATTACTGTGCGAGAGAACTGGGG TTCCTCTTTGACTACTGGGGCCAGGGAACCCTGG TCACCGTCTCCTCA |
| | | | SEQ ID NO: 27029 | SEQ ID NO: 31035 |

FIGURE 50
(Continued)

| | | | | |
|---|---|---|---|---|
| | | AA | DIQMTQSPSSLSASVGDRVTITCRASQGIRNDLGWYQQKPGKAPKRLIYAASSLQSGVPSRFSGSGSGTEFTLTISSLQPEDFATYFCLQHNSYPLTFGQGTRLEIK | QVQLVESGGGVVQPGRSLRLSCAASGFTFSNYGMHWVRQAPGKGLEWVAVIWYDGDSVKGRFTISRDNSKNTLYLQMNSLRAEDTAVYYCARELGFLFDYWGQGTLVTVSS |
| | | | SEQ ID NO: 27030 | SEQ ID NO: 31036 |
| iPS:436332 | 21-225_208B2 | NA | GACATCCAGATGACCCAGTCTCCATCCTCCTGTCTGCATCTGTAGGAGACAGAGTCACCATCACTTGCCGGGCAAGTCAGGGCATTAGACATGATTTAGGCTGGTATCAACAGAAACCAGGGAAAGCCCCTAAGCGCCTGATCTATGCTGCATCCAGTTTGCAAAGTGGGGTCCCATCAGGGTTCAGCGGCAGTGGATCTGGGACAGATCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTGTGTCATGCACTGGGTCCGCCAGGCTCCAGGCAAGGGGCTGGAGTGGGTGGCAGTTATATGACTCCGTGAAGGGCCGATAATAAATACTATGTAGACTCCGTGAAGGGCCGATTCACCATCTCCAGAGACAATTCCAGGAACACGCTGTATCTGCAAATGAACAGCCTGAGAGCCGAGGACACGGCTGTGTATTACTGTGCGAGAGAAACGGTATAGCAGTGGCTTGTACGACTACGGTTTGGACGTCTGGGGCCAAGGGACCACGGTCACCGTCTCCTCA |
| | | | SEQ ID NO: 27031 | SEQ ID NO: 31037 |
| | | AA | DIQMTQSPSSLSASVGDRVTITCRASQGIRHDLGWYQQKPGKAPKRLIYAASSLQSGVPSGFSGSGSGTEFTLTISSLQPEDFATYYCLQHYSYPRTFGQGTKVEIK | QVQLVESGGGVVQPGRSLRLSCAASGFTFSDCVMHWVRQAPGKGLEWVAVIWYDGSNKYYVDSVKGRFTISRDNSRNTLYLQMNSLRAEDTAVYYCARERYSSGLYDYGLDVWGQGTTVTVSS |
| | | | SEQ ID NO: 27032 | SEQ ID NO: 31038 |

FIGURE 50
(Continued)

| | | | |
|---|---|---|---|
| iPS:436334 | 21-225_208G3 | NA | GATATTGTGCTGACTCAGTCTCCACTCCCTG CCCGTCACCCCTGGAGAGCCGGCCTCCATCTC CTGCAGGTCTAGTGAGAGCCCTCGCATAATA ATAAATACAACCATTTGGATTGGTACCTGCAG AAGCCAGGGCAGTCTCCACAGCTCCTGATCTA TTTGGGTTCTAATCGGGCCTCCGGGTCCCTG ACAGGTTCAGTGCAGTGGATCAGCAGCACAGAT TTTACACTGAAAATCAGAGAGTGGAGGCTGA GGATGTTGGGGTTTATTACTGCATGCAAGCTC TACAAACTCCCACTTTCGGCGGAGGGACCAAG GTGGAGATCAAA<br><br>SEQ ID NO: 27033 | GAGGTGCAGCTGGTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGGCT GGAGTGGGTCTCAACTATTAGTGGTAGTGGTGTT AGAACATACTACGCAGACTCCGTGAAGGGCCGG TCCACCATCTCCAGAGACAATTCCAAGAATACGC TGTTTCTGCAAATGAACAGCCTGAGAGCCGAGG ACAAGGCCGTATATTACTGTGCGAAAGGGGGAG CTAGGAGCAGTGGCTGGTTCCACTTTGACTACTG GGGCCAGGGAACCCTGGTCACCGTCTCCTCA<br><br>SEQ ID NO: 31039 |
| | | AA | DIVLTQSPLSLPVTPGEPASISCRSSQSLLHNNKY NHLDWYLQKPGQSPQLLIYLGSNRASGVPDRFS GSGSGTDFTLKISRVEAEDVGVYYCMQALQTPT FGGGTKVEIK<br><br>SEQ ID NO: 27034 | EVQLLESGGGLVQPGGSLRLSCAASGFTFSSYAMS WVRQAPGKGLEWVSTISGSGVRTYYADSVKGRSTI SRDNSKNTLFLQMNSLRAEDKAVYYCAKGGARSS GWFHFDYWGQGTLVTVSS<br><br>SEQ ID NO: 31040 |
| iPS:436336 | 21-225_208B5 | NA | GAAATTGTTTTGACGCAGTCTCCAGGCACCCT GTCTTTGTCTCCAGGGGAAAGAGCCACCCTCT CCTGCAGGGCCAGTCAGAGTGTTAGCAGCAAC TACTTAGCCTGGTATCAGCAGAAACCTGGCCA GGCTCCCAGACTCCTCATCTATGGTGCATCCA GCAGGGCCACTGGCATCCCAGACAGATTCAGT GGCAGTGGGTCTGGGACAGACTTCACTCTCAC CATCAGCAGACTGGAGCCTGAAGATTTTGCAG TGTATTTCTGTCAGCACTACGAAAACTCACCG TGGACGTTCGGCCAAGGGACCAAGGTGGAAA TCAAA<br><br>SEQ ID NO: 27035 | CAGGTGCAGCTACAGCAGTGGGGCGCAGGACTG TTGAAGCCTTCGGAGACCCTGTCCCTCACCTGCG CTGTCTTTGGTGGGTCCATCAGTGTTACTACTGG ACCTGGATCCGCCAGCCCCCAGGGAAGGGGCTG GAGTGGATTGGGGAAATCAATCATAGTGGAAGC ACCAACTACTACAACCCGTCCCTCAAGAGTCGAGTCA CCATATCAGTAGACACGTCCAAGAACCAGTTCTC CCTGAAGCTGAGCTCTGTGACCGCCGCGGACACG GCTGTGTATTACTGTGCGAGGGACTATGGTGTCT TTGATTACTGGGGCCAGGGAACCCTGGTCACCGT CTCCTCA<br><br>SEQ ID NO: 31041 |

FIGURE 50
(Continued)

| | | | | |
|---|---|---|---|---|
| | | AA | EIVLTQSPGTLSLSPGERATLSCRASQSVSSNYLA WYQQRPGQAPRLLIYGASSRATGIPDRFSGSGSG TDFTLTISRLEPEDFAVYFCQHYENSPWTFGQGT KVEIK | QVQLQQWGAGLLKPSETLSLTCAVFGGSISVYYWT WIRQPPGKGLEWIGEINHSGSTNYNPSLKSRVTISV DTSKNQFSLKLSSVTAADTAVYYCARDYGVFDYW GQGTLVTVSS |
| | | | SEQ ID NO: 27036 | SEQ ID NO: 31042 |
| iPS:436338 | 21-225_208E8 | NA | GACATCCAGATGACCCAGTCTCCATCCTCCC GTCTGCATTTGTTGGAGACAGAGTCACCATCA CTCGCCGGGCAAGTCACAACATTAACAGCTAT TTAAATTGGTATCAGCAGAAATCAGGGAAAGC CCCTAAACTCCTTATCTATGCTGCATCCAGTT GCAAAGTGGGGTCCCGTCAAGGTTCAGTGGCA GTGGATCTGGGACAGATTTCACTCTCACTTTC AGTAGTCTACAACCTGAAGATTTTGCAACTTA CTACTGTCAACAGAGTTACAGTTTCCCGCTCA CTTTCGGCGGAGGGACCAAGGTGGAGATGAG G | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGATCAACAGAAGTTCAGGGCAG TGGCACAAACTATGCACAGGGACACGTCCATCACC GGTCACCATGACCAGGGACAGTCCATCACCAC AGCCTACATGGAGCTGAGCAGGCTGAGATCTGA CGACACGGCCGTGTATTACTGTGCGAGAGGATAC AGTATGGTTACAACTGGTTCGACCCCTGGGGCC AGGGAACCCTGGTCACCGTCTCCTCA |
| | | | SEQ ID NO: 27037 | SEQ ID NO: 31043 |
| | | AA | DIQMTQSPSSPSAFVGDRVTITRRASHNINSYLN WYQQKSGKAPKLLIYAASSLQSGVPSRFSGSGS GTDFTLTFSSLQPEDFATYYCQQSYSFPLTFGGG TKVEMR | QVQLVQSGAEVKKPGASVKVSCKASGYTFTGYIH WVRQAPGQGLEWMAWINPNSGGTNYAQKFQGRV TMTRDTSITTAYMELSRLRSDDTAVYYCARGYSYG YNWFDPWGQGTLVTVSS |
| | | | SEQ ID NO: 27038 | SEQ ID NO: 31044 |

FIGURE 50
(Continued)

| | | | | |
|---|---|---|---|---|
| iPS:436340 | 21-225_208A9 | NA | GAAATTGTGTTGACGCAGTCTCCAGGCACCCTGTCTTTGTCTCCAGGGGAAAGAGCCACCCTCTCCTGCAGGGCCAGTCAGAGTGTTAGCAACAACTACTTAGCCTGGTACCAGCAGAAACCTGGCCAGGCTCCCAGGGCTCCTCATCTATGGTGCATCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCACTATCATAGCTCACCGTGGACGTTCGGCCAAGGGACCAAGGTGGAAATCAAA<br>SEQ ID NO: 27039 | CAGGTGCAGCTACAGCAGTGGGGCGCAGGACTGTTGAAGCCTTCGGAGACCCTGTCCCTCACCTGCGCTGTCTATGGTGGGTCCTTCAGTGTTTCCTACTGGAGCTGGATCCGCCAGCCCCCAGGGAAGGGGCTGGAGTGGATTGGGGAAATCAATCATAGTGGACGCGCCAACTACAACCCGTCCCTCAAGAGTCGAGTCACCATATCAATAGACACGTCCAAGAACCAGTTCTCCCTGAAGCTGAGCTCTGTGACCGCCGCGGACACGGCTGTGTATTACTGTGCGAGGGACTACGGTGTCCTTGACTACTGGGGCCAGGGAACCCTGGTCACCGTCTCCTCA<br>SEQ ID NO: 31045 |
| | | AA | EIVLTQSPGTLSLSPGERATLSCRASQSVSNNYLAWYQQKPGQAPRVLIYGASSRATGIPDRFSGSGSGTDFTLTISRLEPEDFAVYYCQHYHSSPWTFGQGTKVEIK<br>SEQ ID NO: 27040 | QVQLQQWGAGLLKPSEPLSLTCAVYGGSFSVSYWSWIRQPPGKGLEWIGEINHSGRANYNPSLKSRVTISIDTSKNQFSLKLSSVTAADTAVYYCARDYGVLDYWGQGTLVTVSS<br>SEQ ID NO: 31046 |
| iPS:436344 | 21-225_208B11 | NA | GACATCCAGATGACCCAGTCTCCATCCTCCCGTCTGCATCTGTTGGAGACAGAGTCACCATCACTTGCCGGGCAAGTCAGAGCATTAACAGCTATTTAAATTGGTATCAGCAGAAATCAGGGAAAGCCCCTAAACTCCTGATCTATGCTGCATCCAGTTTGCAAAGTGGGGTCCCGTCAAGGTTCAGTGGCAGTGGATCTGGGACAGATTTCACTCTCACTTAAGTCTACAACTGAAGATTTTGCAACTTACTACTGTCAACAGAGTTACAGTTTCCCGCTCACTTTCGGCGGAGGGACCAAGGTGGAGATGAGG<br>SEQ ID NO: 27041 | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATAATGCACTGGGTGCGACAGGCCCCTGACAAGGGCTTGAGTGGATGGGATGGATCAACCCTAATAGTGGTGGCACAAACTATGCACAGAAGTTCCAGGGCAGGGTCACCATGACCAGGGACACGTCCATCAGCACAGCCTACATGGAGCTGAGCAGGCTGAGATCTGACGACACGGCCGTGTATTACTGTGCGAGAGGATACAGTATGGTTACAACTGGTTCGACCCCTGGGGCCAGGGAACCCTGGTCACCGTCTCCTCA<br>SEQ ID NO: 31047 |

FIGURE 50
(Continued)

| | | | |
|---|---|---|---|
| iPS:436350 | 21-225_210E4 | AA | DIQMTQSPSPSASVGDRVTITCRASHNINSYLN WYQQKSGKAPKLLIYAASSLQSGVPSRFSGSGS GTDFTLTFSSLQPEDFATYYCQQSYSFPLTFGGG TKVEMR<br>SEQ ID NO: 27042 | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS<br>SEQ ID NO: 31048 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br>SEQ ID NO: 27043 | CAGGTGCAGCTGGTGGAGTCTGGGGGAGGCGTG GTCCAGCCTGGGAGGTCCCTGAGACTCTCCTGTG CAGCGTCTGGATTCACCCTCATTAACTATGGCAT GCACTGGGTCCGCCAGGCTCCAGGCAAGGGGCT GGAGTGGGTGGCAGTTATATGTAGACTCCGTGAAGGGCCGAT AATAAATACTATGTAGACTCCGTGAAGGGCCGAT TCACCATCTCAGAGACAGATTCCAAGAACACGCT GTATCTGCAAATGAACAGCTGAGAGCCGAGGA CTCGGCTGTGTATTACTGTGCGAGAGAGACGGGT TTCTTGAGCGACTACTGGGGCCAGGGAACCCTGG TCACCGTCTCCTCA<br>SEQ ID NO: 31049 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 27044 | QVQLVESGGGVVQPGRSLRLSCAASGFTLINYGMH WVRQAPGKGLEWVAVIWYDENNKYYVDSVKGRF TISRDDSKNTLYLQMNSLRAEDSAVYYCARETGFL SDYWGQGTLVTVSS<br>SEQ ID NO: 31050 |

FIGURE 50
(Continued)

| | | | | |
|---|---|---|---|---|
| iPS:436352 | 21-225_210G5 | NA | GACATCCAGATGACCCAGTCTCCATCCTCCT GTCTGCATCTGTAGGAGACAGAGTCACCATCA CTTGCCGGGCAAGTCAGGGACATTAGACATGAT TTAGGCTGGTATCAACAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACACCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGTGTCAT GCACTGGGTCCGCCAGGCTCCAGGCAAGGGGCT GGAGTGGGTGGCAGTTATATGGTATGATGGAAGT AATAAATACTATGTAGACTCCGTGAAGGGCGAT TCACCATCTCCAGAGACAATTCCAAGAACACGCT GTATCTGCAAATGAACAGCCTGAGAGCCGAGGA CACGGCTGTGTATTACTGTGCGAGAGAACGGTAT AGCAGGTGCTTGTACGACTACGGTTTGACGTCT GGGGCCAAGGGACCACGGTCACCGTCTCCTCA |
| | | | SEQ ID NO: 27045 | SEQ ID NO: 31051 |
| | | AA | DIQMTQSPSSLSASVGDRVTITCRASQGIRHDLG WYQQKPGKAPKRLIYAASSLQSGVPSGFSGSGS GTEFTLTISSLQPEDFATYYCLHHYSYPRTFGQG TKVEIK | QVQLVESGGGVVQPGRSLRLSCAASGFTFSDCVMH WVRQAPGKGLEWVAVIWYDGSNKYYVDSVKGRF TISRDNSRNTLYLQMNSLRAEDTAVYYCARERYSS GLYDYGLDVWGQGTTVTVSS |
| | | | SEQ ID NO: 27046 | SEQ ID NO: 31052 |
| iPS:436354 | 21-225_210G10 | NA | GACATCCAGATGACCCAGTCTCCATCCTCCT GTCTGCATCTGTAGGAGACAGAGTCACCATCA CTTCCGGACAAGTCAGGGACATTAGCAACTCA CTTCCGGACAAGTCAGCAGCAACCAGGGAAAA CCCCTAAGCGCCATGATTTATGCTGCATCCAGT TTGTTTAGTGGGGTCCCATCAAGGTTCAGCGG CAGTAGATCTGGGACAGATTTCACTCTCACAA TCAGCAGCCTGCAGCCTGAAGATTTTGCAACT TATTACTGTCTACAGTATAATAGTTACCCTCCC ACCTTCGGCCAAGGGACCACGACTGGAGATTAA A | CAGGTGCAGCTGCAGGAGTCGGGCCCAGGACTG GTGAAGCCTTCGGAGACCCTGTCCCTCAACTGCA CTGTCTCTGGTGGCTCCATCAGAGTTACTACTG GAGTTGGATCCGGCAGCCCGCCGGAAGGGACT GGAGTGGATTGGGGTATCTATACCAGTGGGAGC ACCGACTACAACCCCTCCCTCAAGAGTCGAATCA CCATGTCAGTAGACACGTCCAAGAACCAGTTCTC TTTGAAGCTGAGCTCTGTGACCGCCGCGGACACG GCCGTGTATTACTGTGCGAGAGGGGTTCGGTGACT GGGACTACTGGGGCCAGGGAACCCTGGTCACCG TCTCCTCA |
| | | | SEQ ID NO: 27047 | SEQ ID NO: 31053 |

FIGURE 50
(Continued)

| | | | |
|---|---|---|---|
| iPS:436356 | 21-225_210H10 | AA | DIQMTQSPSSLSASVGDRVTITFRTSQGIRNDLG WYQQQPGKTPKRMIYAASSLFSGVPSRFSGSRS GTDFTLTISSLQPEDFATYYCLQYNSYPPTFGQG TRLEIK<br>SEQ ID NO: 27048 | QVQLQESGPGLVKPSETLSLNCTVSGGSIRSYYWS WIRQPAGKGLEWIGRIYTSGSTDYNPSLKSRITMSV DTSKNQFSLKLSSVTAADTAVYYCARGFGDWDYW GQGTLVTVSS<br>SEQ ID NO: 31054 |
| | | NA | GAAATAGTGATGACGCAGTCTCCAGCCACCCT GTCTGTGTCTCCAGGGGAAAGAGCCACCCTCT CCTGCAGGGCCAGTCAGAGTGTTAAAAGCAAC TTAGCCTGGTACCAGCAGAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCTGCAGTCTGAAGATTTTGCAGTTT ATTCCTGTCAGCAGTATTATAACTGGCTGTGC AGTTTTTGGCCAGGGGACCAAGCTGGAGATCAA A<br>SEQ ID NO: 27049 | CAGGTACAGCTGCAGCAGTCAGGTCCAGGACTG GTGAAGCCCTCGCAGACCCTCACTCACCTGTG CCATCTCCGGGACAGTGTCTCTAGCAACAGTGC TGCTTGGAACTGATCAGGCAGTCCCCATCGAGA GGCCTGAGTGGCTGGGAAGGACATACTACAGG TCCAAGTGGTATATAATTATTATCCAGTATCTGTGA GAAGTGAATAACCATCAACCAGACACATCCA AGAACCAGTTCTCCCTGCTGCTGAACTCTGTGAC TCCCGAGGACACGGCTGTGTATTACTGTGCAAGA GATCAACGGTACTACGGTATGGACGTCTGGGGCC AAGGGACCACGGTCACCGTCTCCTCA<br>SEQ ID NO: 31055 |
| | | AA | EIVMTQSPATLSVSPGERATLSCRASQSVKSNLA WYQQKPGQAPRLLIYGASTRATGIPARFSGSGSG TEFTLTISSLQSEDFAVYSCQQYNWLCSFGQGT KLEIK<br>SEQ ID NO: 27050 | QVQLQQSGPGLVKPSQTLSLTCAISGDSVSSNSAA WNWIRQSPSRGLEWLGRTYYRSKWYNYPVSVRS RITINPDTSKNQFSLLLNSVTPEDTAVYYCARDQRY YGMDVWGQGTTVTVSS<br>SEQ ID NO: 31056 |

FIGURE 50
(Continued)

| | | | | |
|---|---|---|---|---|
| iPS:436358 | 21-225_210D11 | NA | GACATCCAGATGACCCAGTCTCCATCTCCCT GTCTGCATCTGTTGGAGACAGAGTCACCATCA CTTGCCGGGCAAGTCAGAGTCACAACATTAACAGCTAT TTAAATTGGTATCAGCAGAAATCAGGGAAAGC CCCTAAAACTCCTAATCTATGCTGCATCCAGTTT GCAAAGTGGGGTCCCGTCAAGGTTCAGTGGCA GTGGATCTGGGACAGATTTCACTCTCACCTTC AGTAGTCTACAACCTGAAGATTTTGCAACTTA CTACTGTCAACAGAGTTACAGTTTCCGCTCA CTTTCGGCGGAGGGACCAAGGTGGAGATGAG G | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TCCACTGGGTGCGACAGGCCCCTGGACAAGGGC TTGAGTGGATGGCATGGATCAACCCTAATAGTGG TGGCACAAACTATGCACAGAAGTTCAGGCAG GGTCACCATGACCAGGGACACGTCCATCACCAC AGCCTACATGGAGCTGAGCAGGCTGAGATCTGA CGACACGGCCGTGTATTACTGTGCGAGAGGATAC AGCTATGGTTACAACTGGTTCGACCCCTGGGCC AGGGAACCCTGGTCACCGTCTCCTCA |
| | | AA | DIQMTQSPSSLSASVGDRVTITCRASHNINSYLN WYQQKSGKAPKLLIYAASSLQSGVPSRFSGSGS GTDFTLTFSSLQPEDFATYYCQQSYSFPLTFGGG TKVEMR | QVQLVQSGAEVKKPGASVKVSCKASGYTFTGYYIH WVRQAPGQGLEWMAWINPNSGGTNYAQKFQGRV TMTRDTSITTAYMELSRLRSDDTAVYYCARGYSYG YNWFDPWGQGTLVTVSS |
| | | | SEQ ID NO: 27051 SEQ ID NO: 27052 | SEQ ID NO: 31057 SEQ ID NO: 31058 |
| iPS:436360 | 21-225_210H11 | NA | GACATCCAGATGACCCAGTCTCCATCTTCCGT GTCTGCTTCTGTAGGAGACAGAGTCACCATCA CTTGTCGGGCGAGTCAGGGTATTAGCAGTTGG TTAGCCTGGTATCAGCAGAAAACCAGGGAAAG CCCCTAAGTCACCTCCTGATCTATGCTGCATCCAGTT TGCAAAGTGGGGTCCCATCAAGGTTCAGCGGC AGAGGATCTGGGACAGATTTCACTCTCACCAT CAGCAGCCTGCAGCCTGAAGATTTTGCAACTT ACTATTGTCAACAGGCTAAAAGTTTCCCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCCATGGCAT GCACTGGGTCCGCCAGGCTCCAGGCAAGGGCT GGAGTGGGTGGCAGTTACATGGTATGATGGAAG TGATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGCGAGACCGGC TAGTGGGAGCTACTACCGATGCTGTTTTGATATCTG GGGCCAAGGGACAATGGTCACCGTCTCTTCA |
| | | | SEQ ID NO: 27053 | SEQ ID NO: 31059 |

FIGURE 50
(Continued)

| | | | | |
|---|---|---|---|---|
| iPS:436362 | 21-225_210C12 | AA | DIQMTQSPSSVSASVGDRVTITCRASQGISIWLA WYQQKPGKAPNLLIYAASSLQSGVPSRFSGRGS GTDFTLTISSLQPEDFATYYCQQAKSFPFTFGPGT KVDIK<br>SEQ ID NO: 27054 | QVQLVESGGGVVQPGRSLRLSCAASGFTFSSHGMH WVRQAPGKGLEWVAVTWYDGSDKYYADSVKGR FTISRDNSKNTLYLQMNSLRAEDTAVYYCARDRLV GATTDAFDIWGQGTMVTVSS<br>SEQ ID NO: 31060 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTGCATTATA ATGGATACAAACTTTTGGATTGGTACCTGCAG AAGCCAGGGCAGTCTCCACAGCTCCTGATCTA TTTGGTTTCTAATCGGGCCTCCGGGGTCCCTGA CAGGTTCAGTGGCAGTCAGGCAGGCACAGATT TTACACTGAAAATCAGCAGAGTGGAGGCTGA GGATGTTGGGGTTTATTACTGCATGCAAGCTC TACAAACTCCCATGTGCAGTTTTGGCCAGGGG ACCAAGTTGGAGATCAAA<br>SEQ ID NO: 27055 | CAGGTTCAGCTGGTGCAGTCTGGAGCTGAGGTGA CGAAGCCTGGGGCCTCAGTGAAGGTCTCCTGCAA GGCTTCTGGTTACACCTTTACCAACAATGGTATC AGCTGGGTGCGACAGGCCCCTGGACAAGGGCTT GAGTGGATGGGATGGATCAACGCTTACAATGGTC ACACAAACTATGCACAGACACATTCCAGGGCAGAG TCAACATGACCACAGACACATCCACGAGCACAG CCTACATGGAGCTGAGGAGCCTGAGATCTGACG ACACGGCCGTGTATTACTGTGCGAGAGATCCTAC GGTGACCCACTACTATTACTACGTATGGAGCGTC TGGGGCCAAGGGACCACGGTCACCGTCTCCTCA<br>SEQ ID NO: 31061 |
| | | AA | DIVMTQSPLSLPVTPGEPASISCRSSQSLLHYNGH NFLDWYLQKPGQSPQLLIYLVSNRASGVPDRFS GSGSGTDFTLKISRVEAEDVGVYYCMQALQTPM CSFGQGTKLEIK<br>SEQ ID NO: 27056 | QVQLVQSGAEVTKPGASVKVSCKASGYTFTNNGIS WVRQAPGQGLEWMGWINAYNGHTNYAQKFQGR VTMTTDTSTSTAYMELRSLRSDDTAVYYCARDPTV THYYYGMDVWGQGTTVTVSS<br>SEQ ID NO: 31062 |

FIGURE 50
(Continued)

| | | | |
|---|---|---|---|
| iPS:436364 | 21-225_211A11 | NA | GACATCCGAGATGACCCAGTCTCCATCCTCACTGTCTGCATCTGTAGGAGACAGAGTCACCATCACTTGTCGGGCGAGTCAGGGCATTGGCAATTATTTAGCCTGGTTTCAGCAGAAACCAGGGAAAGCCCCTAAGGTCCCTGATCTATGATGCATCCAGTTTGGAAAGTGGGGTCCCATCAAAGTTCAGCGGCAGTAGGTCTGGGACAGATTTCACTCTCACCATCGGCAGCCTGCAGCCTGAAGATTTTGCAACTTATTACTGCCAACACTATGACTTACCCGCTCACTTTCGGCGGAGGGACCAAGGTGGAGATCAA | CAGGTGCAGCTGGTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAATGGGTGGCAGTTCTTTGGTTTGATGAAGTAATAGAAACTATGCAGAGACAATTCCAAGAACACGCTTCACCATCTCCAGAGACACAGCCTGAGAGCCGAGGACACGGCTGTGTATTACTGTGCGAGAGATCGGGGAGTGGGCTACTACGGTACGGACGTCTGGGGCCAAGGGACCACGGTCACCGTCTCCTCA |
| | | | SEQ ID NO: 27057 | SEQ ID NO: 31063 |
| | | AA | DIQMTQSPSSLSASVGDRVTITCRASQGIGNYLAWFQQKPGKAPRSLIYDASSLESGVPSRFSGSRSGTDFTLTIGSLQPEDFATYYCQHYMTYPLTFGAGTKVEIK | QVQLVGSGGVVQPGRSLRLSCAASGFTFSSYGMHWVRQAPGKGLEWVAVLWFDGSNRNYADSVKGRFTISRDNSKNTLYLQMNSLRAEDTAVYYCARDRGVGYYGTDVWGQGTTVTVSS |
| | | | SEQ ID NO: 27058 | SEQ ID NO: 31064 |
| iPS:436366 | 21-225_211A3 | NA | GACATCCGGATGACCCAGTCTCCATCCTCACTGTCTGCATCTGTAGGAGACAGAGTCACCATCACTTGTCGGGCGAGTCAGGCCATTGGGAAACATTTAGCCTGGTTTCAGCAGAAACCTGGGAAAGCCCCTAAGGTCCCTGATCTATGCTGCATCCAGATTGCAAAGTGGGGTCCCATCAAAGTTCAGCGGCAGTGGGATCTGGGACAGATCTCACTCTCACCATCAGCAGCCTGCAGCCTGAAGATCTTGAACTTATTACTGTCAACAGTATAGTAATTATCCGCTCACTTTCGGCGGAGGGACCAAGGTGGAGATCAAA | CAGGTGCAGCTGGTGGTGGAGTCTGGGGGAGGCGTGGTCCAGCCTGGGAGGTCCCTGAGACTCTCCTGTGCAGTGTCTGGAATCACCTTCAGTAGTTATGCATGCACTGGGCCCGCCAGGCTCCAGGCAAGGGCTGGAGTGGGTGGCAGTTATATGTGGTATGATGAAGTAATAAAAACTATGAAGACTCCGTGAAGGGCCGATTCACCATCTCCAGAGACAACTCCAAGAACACGCTGTATCTGCAAATGAACAGCCTGAGAGCCGAGGACACGGCTGTGTTACGACGTATGCGAGAGATGGGAGTTATGGTTACGACGGTATGGACGTCTGGGGCCAATGGGACCACGGTCACCGTCTCCTCA |
| | | | SEQ ID NO: 27059 | SEQ ID NO: 31065 |

FIGURE 50
(Continued)

| | | | |
|---|---|---|---|
| iPS:436368 | 21-225_211G3 | AA | DIRMTQSPSSLSASVGDRVTITCRASQAIGKHLAWFQQRPGKAPKSLIYAASRLQSGVPSKFSGSGSGTDFTLTISSLQPEDLATYYCQQYSNYPLTFGGGTKVEIK |
| | | | SEQ ID NO: 27060 |
| | | NA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTTCTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGTTAGCTCACCGCTCACTTTCGGCGGAGGGACCAAGGTGGAGATCAAA |
| | | | SEQ ID NO: 27061 |
| | | AA | EIVLTQSPGTLSLSPGERATLSCRASQSVSSSFLAWYQQKPGQAPRLLIYGASSRATGIPDRFSGSGSGTDFTLTISRLEPEDFAVYYCQQYVSSPLTFGGGTKVEIK |
| | | | SEQ ID NO: 27062 |
| | | | QVQLVESGGGVVQPGRSLRLSCAVSGITFSSYGMHWARQAPGKGLEWVAVIWYDGSNKNYEDSVKGRFTISRDNSKNTLYLQMNSLRAEDTAVYYCARDGSYGYDGMDVWGQGTTVTVSS |
| | | | SEQ ID NO: 31066 |
| | | | CAGGTGCAGCTGGTGGTGGAGTCTGGGGGAGGCGTGGTCCAGCCTGGGAGGTCCCTGAGACTCTCCTGTGCAGCGTCTGGAATTCACCTTCAGTAGTTACGGCATGCACTGGGTCCGCCAGGCTCCAGGCAAGGGGCTGGAGTGGGTGGCAGTTATATCGAGATCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGTTAGACTACAGTAACTACGGTGGTTCGACCCCTGGGCCAGGGAACCCTGGTCACCGTCTCCTCA |
| | | | SEQ ID NO: 31067 |
| | | | QVQLVESGGGVVQPGRSLRLSCAASGFTFSNYGMHWVRQAPGKGLEWVAVIWHDGSNKYADSVKGRFTISRDNSKNTLYLQMNSLRAEDTAVYYCARLDYSNYGWFDPWGQGTLVTVSS |
| | | | SEQ ID NO: 31068 |

FIGURE 50
(Continued)

| | | | |
|---|---|---|---|
| iPS:436370 | 21-225_211A6 | NA | GACATCGAGATGACCCAGTCTCCATCCTCACT GTCTCTGCATCTGTAGGAGACAGCGTCACCATCA CTTGTGTGGGCGAGTCAGGGCATTGGCAAGTAT TTAGCCTGGTTTCAGCAGAAACCAGGGAAAGC CCCTAAGTCCCTGATCTATGCTGCATCCAGTTT GCTAAGTGGGGTCCCATCAAGGTTCAGCGGCA GTGGATCTGGGACAGATTTCACTCTCACCATC AGCAGCCTTCAGCCTGAAGATTTTGCCACTTA TTACTGCCAAAAGTATGATACTTACCATTCA CTTTCGGCCCTGGGACCAAAGTGGATATCAAA<br>SEQ ID NO: 27063 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAAAACTATGCAGACTCCGTGAAGGGCCGA TTCACCATCTCCAGAGACAACTCCAAGAACACGC TGTATCTGCAAATGAACAGCCTGAGAGCCGAGG ACACGGCTGTGTTTTACTGTGCGAGAGATAGGAC GGTGGGCTATGATGGTTTTGATATCTGGGGCCAA GGGACAATGGTCACCGTCTCTTCA<br>SEQ ID NO: 31069 |
| | | AA | DIQMTQSPSSLSASVGDSVTITCRASQGIGKYLA WFQQKPGKAPKSLIYAASSLLSGVPSKFSGSGSG TDFTLTISSLQPEDFATYYCQKYDTYPFTFGPGT KVDIK<br>SEQ ID NO: 27064 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVFYCARDRTVG YDGFDIWGQGTMVTVSS<br>SEQ ID NO: 31070 |
| iPS:436372 | 21-225_211A8 | NA | GACATCGAGATGACCCAGTCTCCACCTCACT GTCTCTGCATTTGTAGGAGACAGAGTCACCATCA CTTGTGTGGGCGAGTCAGGGCATTAGCAGATAT TTAGCCTGGTTCAGCAGAAACCAGGGAAAG CCCCTAAGTCCCTGATCTATGCTGCATCCAGTT TGCAAAGTGGGGTCTCATCAAGGTTCACTCTCA AGTGGATCTGGGACAGATTTCACTCTCACCAT CAGCAGCCTGCAGCCTGAAGATTTGCAACTT ATTACTGCCTACGTATGATACTTACCCTCTCA TTTTCGGCGGAGGGACCAAGGTGGAGATCAA G<br>SEQ ID NO: 27065 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATGAACACTATGCAGACTCCGTGAAGGGCCGA TTCACCATCTCCAGAGACAATTCCAAGAAACGC TGTATCTGCAAATGAACAGCCTGAGAGCCGAGG ACACGGCTGTGTATTACTGTGCGAGAGACCACGG TGTCGGGTACTACGGTATGGACGTCTGGGGCCAA GGGACCACGGTCACCGTCTCCTCA<br>SEQ ID NO: 31071 |

FIGURE 50
(Continued)

| | | | |
|---|---|---|---|
| iPS:436374 | 21-225_211C10 | AA | DIEMTQSPPSLSAFVGDRVTITCRASQGISRYLA WVQQKPGKAPKSLIYAASSLQSGVSSRFSGSGSG TDFTLTISSLQEPEDFATYYCLRYDTYPLIFGGGTK VEIK | QVQLVESGGGVVQPGRSLRLSCAASGFTFSSYGMH WVRQAPGKGLEWVAVIWYDGSNEHYADSVKGRF TISRDNSKKTLYLQMNSLRAEDTAVYYCARDHGV GYYGMDVWGQGTTVTSS |
| | | | SEQ ID NO: 27066 | SEQ ID NO: 31072 |
| | | NA | GATATTGTGATGACTCAGTCTCCACTCTCCCTG CCCGTCACCCCTGGAGAGCCGGCCTCCATCTC CTGCAGGTCTAGTCAGAGCCTCCTCCATAGTA ATGGATACAACTATTTGGATTGGTACCTGCTG AAGCCAGGGCAGTCTCCACAGCTCCTGATCTA TTTGGGTTCTAATCGGGCCTCCGGGGTCCCTG ACAGGTTCAGTGGCAGTGGATCAGGCACAGAT TTTACACTGAAAATCAGCAGAATGGAGGCTGA GGATGTTGGGATTTATTACTGCATGCAAGCTC TACTAACTCCCGTGTGCAGTTTTGGCCAGGGG ACCAAGCTGGAGATCAAA | CAGGTTCAGTCTGTGGTGCAGTCTGGAGCTGAGGTGA AGAAGCCTGGGGCCTCAGTGAAGGTCTCCTGCA AGGCTTCTGGTTACACCTTTACCAGCCATGGTAT CAGCTGGGTGCGACTGGCCCCTGGACAAGGGCTT GAGTGGATGGGATGGATCAGCGCTTACAATGGTC TCACAAACTATGCACAGAAGTTCCAGGGCAGAG TCACCATGACCACAGACACATCCACGAGCACAG GCTACATGGAGCTGCGAGCCTGAGATCTGACG ACACGGCCGTGTATTACTGTGCGAGAGATCCTAC GGTGACCCACTACTACTACTACGTATGGACGTC TGGGGCCAAGGGACCACGGTCACCGTCTCCTCA |
| | | | SEQ ID NO: 27067 | SEQ ID NO: 31073 |
| | | AA | DIVMTQSPLSLPVTPGEPASISCRSSQSLLHSNGY NYLDWYLLKPGQSPQLLIYLGSNRASGVPDRFS GSGSGTDFTLKISRMEAEDVGIYYCMQALLTPV CSFGQGTKLEIK | QVQLVQSGAEVKKPGASVKVSCKASGYTFTRHGIS WVRLAPGQGLEWMGWISAYNGLTNYAQKFQGRV TMTTDTSTSTGYMELRSLRSDDTAVYYCARDPTVT HYYYYGMDVWGQGTTVTSS |
| | | | SEQ ID NO: 27068 | SEQ ID NO: 31074 |

FIGURE 50
(Continued)

| | | | |
|---|---|---|---|
| iPS:436376 | 21-225_212E6 | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGCAAGC CCCTAAGTCCCTGATCTATGCTGCATCCAGTTT GCAAAGTGGGGTCCCATCAAAGTTCAGCGGCA GTAGATCTGGGACAGATTTCACTCTCACCATC AGCAGCCTGCAGCCTGAAGATTTTGCAACTTA TTACTGCCAACAGTATGTTACCTACCCTCTCAC TTTCGGCGGAGGGACCAAGGTGGAGATCAAA SEQ ID NO: 27069 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGCTATGGCAT GCACTGGGTCCGCCAGGCTCCAGGCAAGGGCT GGAGTGGGTGGCAGTTATATGTATGATGGAAGT AATAAAAACTATGTAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGACTACGG TGTCGGGTACTACGGTACGGACGTCTGGGGCCAA GGGACCACGGTCACCGTCTCCTCA SEQ ID NO: 31075 |
| | | AA | DIQMTQSPSSLSASVGDRVTITCRASQGISNHLA WFQQKPGQAPKSLIYAASSLQSGVPSKFSGSRSG TDFTLTISSLQPEDFATYYCQQYVTYPLTFGGGT KVEIK SEQ ID NO: 27070 | QVQLVESGGGVVQPGRSLRLSCAASGFTFSSYGMH WVRQAPGKGLEWVAVIWYDGSNKNYVDSVKGRF TISRDNSKNTLYLQMNSLRAEDTAVYYCARDYGV GYYGTDVWGQGTTVTVSS SEQ ID NO: 31076 |
| iPS:436378 | 21-225_212D7 | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCTGATCTATGCTGCATCCAGTTT GCAAAGTGGGGTCCCATCAAAGTTCAGCGGCA ATAGATCTGGGACAGATTTCACTCTCACCATC AACAACCTGCAGCCTGAAGATATAGTAACTTA TTACTGCCAGCAGTAGTATAGTAATTACCCTCTCA CTTTCGGCGGAGGGACCAAGGTGGAGATCAAA SEQ ID NO: 27071 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGTATGATGGAAGT AATAAAAATTATGCAGACTCCGTGAAGGGCCGA TTCACCATCTCCAGAGACAATTCCAAGAACACGC TGTCTCTGCAAATGAACAGCCTGAGAGCCGAGG ACACGGCTGTGTATTACTGTGCGAGAGACTACGG TGTCGGGTACTACGGTACGGACGTCTGGGGCCAA GGGACCACGGTCACCGTCTCCTCA SEQ ID NO: 31077 |

FIGURE 50
(Continued)

| | | | |
|---|---|---|---|
| iPS:436380 | 21-225_212H9 | AA | DIQMTQSPSSLSASVGDRVTITCRASQGISNHLAWFQQKPGKAPKSLIHAASSLQSGVPSKFSGNRSGTDFTLTINNLQPEDFVTYYCQQYSNYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLSLQMNSLRAEDTAVYYCARDYGVGYYGTDVWGQGTTVTSS |
| | | | SEQ ID NO: 27072 | SEQ ID NO: 31078 |
| | | NA | GACATCGAGATGACCCAGTCTCCATCCTCACTGTCTGCATCTGTAGGAGACAGAGTCACCATCACTTGTCGGGCGAGTCAGGGCATTAGCAGTTATCTTAGCCTGGCTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTCGCAACTTATTATTGCCTACGGTATGATACTTACCCTCTCACTTTCGGGGGAGGGACCAAGGTGGAGATCAAG | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGGAAGTAATGAACACTATGCAGACTCCGTGAAGGGCCGATTCACCATCTCCAGAGACAATTCCAAGAAAACGCTGTATCTGCAAATGAACAGCCTGAGAGCCGAGGACACGGCTGTGTATTACTGTGCGAGAGACCACGGTGTCGGGTACTACGGTATGGACGTCTGGGGCCAAGGGACCACGGTCACCGTCTCCTCA |
| | | | SEQ ID NO: 27073 | SEQ ID NO: 31079 |
| | | AA | DIEMTQSPSSLSASVGDRVTITCRASQGISSYLAWLQQKPGKAPKSLIYAASSLQSGVPSRFSGSGSGTDFTLTISSLQPEDFATYYCLRYDTYPLTFGGGTKVEIK | QVQLVESGGGVVQPGRSLRLSCAASGFTFSSYGMHWVRQAPGKGLEWVAVIWYDGSNEHYADSVKGRFTISRDNSKKTLYLQMNSLRAEDTAVYYCARDHGVGYYGMDVWGQGTTVTSS |
| | | | SEQ ID NO: 27074 | SEQ ID NO: 31080 |

FIGURE 50
(Continued)

| | | | |
|---|---|---|---|
| iPS:436382 | 21-225_212C10 | NA | GAAATAGTGATGACGCAGTCTCCAGCCACCCTGTCTGTGTCTCCAGGGGAAAGAGCCACCCTCTCCTGCAGGGCCAGTCAGAGTGTTGCCAGCAGCTTAGCCTGGTACCAGCAGAAGCCTGGCCAGGCTCCCAGGCTCCTCATCCATGGTACATCCACCAGGGCCACTGATGTCCCAGCCAGGTTCAGTGGCTTTGGGTCTGGGACTTCACTCTCACCATCAGCAGCCTGCAGTCTGAAGATTTTGCAGTTATTCCTGTCAGCAGTATAATGACTGGCCGTGCAGTTTTGGCCAGGGGACCAAGCTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAATGGGTGACAGTATATGGTATGATGAAGTCATAAATACTATACAGATTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGAGTATAGTGGGAGCTACCTACTTTGACTACTGGGGCCAGGGAACCCTGGTCACCGTCTCCTCA |
| | | AA | EIVMTQSPATLSVSPGERATLSCRASQSVASSLAWYQQKPGQAPRLLIHGTSTRATDVPARFSGFGSGSDFTLTISSLQSEDFAVYSCQQYNDWPCSFGQGTKLEIK | QVQLVESGGGVVQPGRSLRLSCAASGFTFSSYGMHWVRQAPGKGLEWVTAIWYDGSHKYYTDSVKGRFTISRDNSKNTLYLQMNSLRAEDTAVYYCARDRSIVGATYFDYWGQGTLVTVSS |
| | | | SEQ ID NO: 27075 SEQ ID NO: 27076 | SEQ ID NO: 31081 SEQ ID NO: 31082 |
| iPS:436384 | 21-225_212F10 | NA | GACATCCAGATGACCCAGTCTCCATCCTCACTGTCTGCATCTGTAGGAGACAGAGTCACCATCACTTGTGTGCGAGTCAGGGCATTAGCAATTATTTAGACTGGTTTCAGCAGAAACCAGGGAAAGCCCCTAAGGTCCCTGATCTATTCTGCATCCAATTTGCAAAGTGGGGTCCCATCAAAGTTCAGCGGCAGTAGATCTGGGACAGATTTCACTCTCACCATCAGCAGCCTGCAGCCTGAAGATTTTGCAACTTATTACTGCCAACACTATAGTAATTACCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGATATGGCATGCACTGGGTCCGCCAGGCTCCAGGCAAGGGGCTGGAGTGGGTGGCAGTTATATGTATGATGGAAGTAATAAACACTATGCAGACTCCGTGAAGGGCCGATTCACCATCTCCAGAGACAATTCCAAGAATACGTTGTATCTGCAAATGAACAGTCTGAGAGGCGAGGACACGGCTACAACGGTATGGACGTCTGGGGCCAAGGGACCACGGTCACCGTCTCCTCA |
| | | | SEQ ID NO: 27077 | SEQ ID NO: 31083 |

FIGURE 50
(Continued)

| | | | |
|---|---|---|---|
| iPS:436386 | 21-225_212B11 | AA | DIQMTQSPSSLSASVGDRVTITCRASQGISNYLD WFQQKPGKAPKSLIYSASNLQSGVPSKFSGSRSG TDFTLTISSLQPEDFATYYCQHYSNYPLTFGGGT KVEIK | QVQLVESGGGVVQPGRSLRLSCAASGFTFSRYGMH WVRQAPGKGLEWVAVIWYDGSNKHYADSVKGRF TISRDNSKNTLYLQMNSLRGEDTAVYYCARDRGV GYNGMDVWGQGTTVTVSS |
| | | | SEQ ID NO: 27078 | SEQ ID NO: 31084 |
| | | NA | GACATCCAGATGACCCAGTCTCCATCTTCCCT GCCTGCATCTGTAGGAGACAGAGTCACCATCA CTTGCCGGGCAAGTCAGGGCATTAGAAATGAT TTAGGCTGGTTTCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGATTCATTCTCACAA TCAGCAGCCTGCAGCCTGAAGATTTTGCAACT TATTACTGTCTACTGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGTAGGACTACGGTATGGACGTCT GGGGCCAAGGGACCACGGTCACCGTCTCCTCA |
| | | | SEQ ID NO: 27079 | SEQ ID NO: 31085 |
| | | AA | DIQMTQSPSSLPASVGDRVTITCRASQGIRNDLG WYQQKPGKAPKRLIYAASSLQSGVPSRFSGSGS GTEFILTISSLQPEDFATYYCLLHYSYPRTFGQGT KVEIK | QVQLVESGGGVVQPGRSLRLSCAASGFTFSDYYM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 27080 | SEQ ID NO: 31086 |

FIGURE 50
(Continued)

| | | | | |
|---|---|---|---|---|
| iPS:436388 | 21-225_212H11 | NA | GACATCCGGATGACCCAGTCTCCATCCTCACTGTCTGCATCTGTAGGAGACAGAGTCACCATCACTTGTCGGGCGAGTCAGGCCATTCAGCAGAAACATTTAGCCTGGTTTCAGCAGAGACCTGGGAAAGCCCCTAAGTCCCTGATCTATGCTGCATCCAGATTGCAAAGTGGGGTCCCATCAAAGTTCAGCGGCAGTGGATCTGGGACAGATTTCACTCTCACCATCAGCAGCCTGCAGCCTGAAGATCTTGCAACTTATTACTGTCAACACTATAGTAATATCCGCTCACTTTTGTCGGGAGGGACCAAGGTGGAGATCACA<br>SEQ ID NO: 27081 | CAGGTGCAGCTGGTGGAGTCTGGGGGAGGCGTGGTCCAGCCTGGGAGGTCCCTGAGACTCTCCTGTGCAGTGTCTGAATCACCTTCAGTAGTAGTATGGCATGCACTGGGTCCGCCAGGCTCCAGGCAAGGGCTGGAGTGGGTGGCAGTTATATGAGACTCGTGATGGAAGTAATAAAACTATGAAGACTCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATGGGAGTTATGGTTACGACGGTATGGACGTCTGGGGCCAAGGGACCACGGTCACCGTCTCCTCA<br>SEQ ID NO: 31087 |
| | | AA | DIRMTQSPSSLSASVGDRVTITCRASQAIGKHLAWFQQRPGKAPKSLIYAASRLQSGVPSKFSGSGSGTDFTLTISSLQPEDLATYYCQHYSNYPLTFVGGTKVEIT<br>SEQ ID NO: 27082 | QVQLVESGGGVVQPGRSLRLSCAVSGITFSSYGMHWARQAPGKGLEWVAVIWYDGSNKNYEDSVKGRFTISRDNSKNTLYLQMNSLRAEDTAVYYCARDGSYGYDGMDVWGQGTTVTVSS<br>SEQ ID NO: 31088 |
| iPS:436390 | 21-225_213D2 | NA | GACATCCAGATGACCCAGTCTCCATCCTCACTGTCTGCATCTGTAGGAGACAGAGTCACCATCACTTGTCGGGCGAGTCAGGGCATTAGCAGCTATTTAGCCTGGTATCAGCAGAAACCAGGGAAAGCCCCTAAGTCCCTGATCATGCTGCATCCAGTTTGCAAAGTGGGGTCCATCAAGGTTCAGCGGCAGTGGATCTGGGACAGATTTCACTCTCACCATCAGCGGACTGCCACCTGTATAATAACAACCTGCAACACTATAGTAATATTACCCCTCACTTTCGGGGAGGGACCAAGGTGGAGATCAAA<br>SEQ ID NO: 27083 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGCAGACTCCGTGAAGGGCCGATTCACCATCTCCAGAGACAATTCCAAGAACACGCTGTCTCTGCAAATGAACAGCCTGAGAGCCGAGGACACGGCTGTGTATTACTGTGCGAGAGACTACGGTGTCGGGTACTACGGTACGGACGTCTGGGGCCAAGGGACCACGGTCACCGTCTCCTCA<br>SEQ ID NO: 31089 |

FIGURE 50
(Continued)

| | | | |
|---|---|---|---|
| iPS:436392 | 21-225_213B3 | AA | DIQMTQSPSSLSASVGDRVTITCRASQGISNHLAWFQQKPGKAPKSLIHAASSLQSGVPSKFSGNRSGTDFTLTINNLQPEDFVTYYCHQYSNYPLTFGGGTKVEIK<br>SEQ ID NO: 27084 | QVQLVESGGGVVQPGRSLRLSCAASGFTFSSYGMHWVRQAPGKGLEWVAVIWYDGSNKNYADSVKGRFTISRDNSKNTLSLQMNSLRAEDTAVYYCARDYGVGYYGTDVWGQGTTVTVSS<br>SEQ ID NO: 31090 |
| | | NA | GACATCCAGATGACCCAGTCTCCATCCTCACTGTCTGCATCTGTAGGAGACAGAGTCACCATCACTTGTCGGGCGAGTCAGGGCATTGGCAAGTATTTAGCCTGGTTTCAGCAGAAACCAGGGAAAGCCCCTAAGTCCCTGATCTCTGCTGCATCCAGTGTGCTAAGTGGGGTCCCATCAAAGTTCAGCGGCAGTGGATCTGGGACAGATTTCACTCTCACCATCAGCAGCCTCAGCCTGAAGATTTTGCCACTTATTACTGCCAAAAGTATATGATACTTACCATTCACTTTCGGCCCTGGGACCAAAGTGGATATCAA<br>SEQ ID NO: 27085 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATAGGACGGTGGGCTATGATGGTTTTGATATCTGGGGCCAAGGGACAATGGTCACCGTCTCTTCA<br>SEQ ID NO: 31091 |
| | | AA | DIQMTQSPSSLSASVGDRVTITCRASQGIGKYLAWFQQKPGKAPKSLISAASSVLSGVPSKFSGSGSGTDFTLTISSLQPEDFATYYCQKYDTYPFTFGPGTKVDIK<br>SEQ ID NO: 27086 | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRTVGYDGFDIWGQGTMVTVSS<br>SEQ ID NO: 31092 |

FIGURE 50
(Continued)

| | | | |
|---|---|---|---|
| iPS:436394 | 21-225_213C4 | NA | GACATCCGGATGACCCAGTCTCCATCCTCACTGTCTGCATCTGTAGGAGACAGAGTCACCATCACTTGTCGGGCGAGTCAGGCCATTAGGAATTATTTAGCCTGGTGTCAGCAGAAACCAGGGAAAGCCCCTAAGACCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATAGTAATTACCCTCTCACTTTCGGCGGAGGGACCAAGGTGGAGATCAA | CAGGTGCAGTTGGTGGAGTCTGGGGGAGGCGTGGTCCAGCCTGGGAGGTCCCTGAGACTCTCCTGTGCAACGTCTGGATTCACCTTCAGTAGCTATGGCATGCACTGGGTCCGCCAGGCTCCAGGCAAGGGCTGGAGTGGGTGGCAGTTATATGGTATGATGAAGTAATAAACACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGACTACGGTGTCGGGTACGACGGTATGGACGTCTGGGGCCAAGGGACCACGGTCACCGTCTCCTCA |
| | | | SEQ ID NO: 31093 |
| | | AA | DIHMTQSPSSLSASVGDRVTITCRASQAIRNYLAWCQQKPGKAPKTLIYAASSLQSGVPSKFSGSGSGTDFTLTISSLQPEDFATYYCQQYSNYPLTFGGGTKVEIK | QVQLVESGGGVVQPGRSLRLSCATSGFTFSSYGMHWVRQAPGKGLEWVAVIWYDGSNKHYADSVKGRFTISRDNSKNTLYLQMNSLRAEDTAVYYCARDYGVGYDGMDVWGQGTTVTVSS |
| | | | SEQ ID NO: 27088 | SEQ ID NO: 31094 |
| iPS:436396 | 21-225_213E5 | NA | GACATCCGGATGACCCAGTCTCCATCCTCACTGTCTGCATCTGTAGGAGACAGAGTCACCATCACTTGTCGGGCGAGTCAGGCCATTGGGAAACATTTAGCCTGGTTTCAGCAGAAGCCTGGAAAAGCCCCTAAGTCCCTGATCTATGCTGCATCCAGATTGCAAAGTGGGGTCCCATCAAAGTTCAGCGGCAGTGGATCTGGGACAGATTTCACTCTCACCATCAGCAGCCTGCAGCCTGAAGATCTTGCAACTTATTACTGTCAACACTATAATATCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGTGTCTGAATCACCTTCAGTAGTTATGGCATGCACTGGGCCCGCCAGGCTCCAGGCAAGGGCTGGAGTGGGTGGCAGTTATATGGTATGATGAAGTAATAAAAACTATGAAGACTCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATGGAGTTATGGTTACGACGGTATGACGTCTGGGGCCAAGGGACCACGGTCACCGTCTCCTCA |
| | | | SEQ ID NO: 27089 | SEQ ID NO: 31095 |

FIGURE 50
(Continued)

| | | | |
|---|---|---|---|
| iPS:436398 | 21-225_213B8 | AA | DIRMTQSPSSLSASVGDRVTITCRASQAIGKHLAWFQQRPGKAPKSLIYAASRLQSGVPSKFSGSGSGTDFTLTISSLQPEDLATYYCQHYSNYPLTFGGGTKVEIK<br>SEQ ID NO: 27090 | QVQLVESGGGVVQPGRSLRLSCAVSGITFSSYGMHWARQAPGKGLEWVAVIWYDGSNKNYEDSVKGRFTISRDNSKNTLYLQMNSLRAEDTAVYYCARDGSYGYDGMDVWGQGTTVTVSS<br>SEQ ID NO: 31096 |
| | | NA | GACATCCAGATGACCCAGTCTCCATCCTCACTGTCTGCATCTGTAGGAGACAGAGTCACCATCACTTGTCGGGCGAGTCAGGGCATTAGCAAGCATCTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAACAGTATATGAATAATCCTCTTATTACTGCCAACAGTATATGATAATTACCCCTCTCACTTTCGGCGGAGGGACCAAGGTGGAGATCAAA<br>SEQ ID NO: 27091 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGCAGACTCCGTGAAGGGCCGAAATAAACACTATGCAGACTCCGTGAAGGGCCGATTCACCATCTCCAGAGACAATGAACAGCCTGAGAGCCGAGGTGTATCTGCAAATGAACAGCCTGAGAGCCGAGGACACGGCTGTGTATTACTGTGCGAGAGACTACGGTGTCGGGTACTACGGTACGGACGTCTGGGGCCAAGGGACCACGGTCACCGTCTCCTCA<br>SEQ ID NO: 31097 |
| | | AA | DIQMTQSPSSLSASVGDRVTITCRASQGISNHLAWFQQKPGKAPKSLIYAASSLQSGVPSKFSGSGSGTDFTLTISSLQPEDFATYYCQQYSNYPLTFGGGTKVEIK<br>SEQ ID NO: 27092 | QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARDYGVGYYGTDVWGQGTTVTVSS<br>SEQ ID NO: 31098 |

FIGURE 50
(Continued)

| | | | |
|---|---|---|---|
| iPS:436400 | 21-225_213H7 | NA | GACATCGTGATGACCCAGTCTCCAGACTCCCT GGCTGTGTCTCTGGGCGAGAGGGCCACCATCA ACTGCAAGTCCAGCAGAATGTTTTAGACATC TCCAACAATAAGAATTCCTTAGGTTGGTTCCA GCAGAAACCAGGTCAGCCTCCAAGCTGCTCA TTAACTGGGCATCTACCGGGAATCCGGGGTC CCTGACCGCTTCAGTGGCAGCGGGTCTGGGAC AGATTTCACTCTCACCATCAGCAGCCTGCAGA CTGAAGATGTGGCAGTTTATCACTGTCAGCAA TATTATAACATTCCTCGACGTTCGGCCGAGG GACCAAGGTGGAAATCAAA SEQ ID NO: 27093 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACCATA TGCACTGGGTGCGACAGGCCCCTGGACAAGGGC TTGAGTGGATGGGATGGATCAATCCTAAGAGTGA TGGCACAAACTATGCACAGAAGTTCAGGGCAG GGTCACCATGACCAGGACACGTCCATCAGCAC AGCCTACATGGAGCTGAGCAGGCTGAGATCTGA CGACACGGCCGTGTATTACTGTGCGAGAGAAAA GCCTGGGAGCTACTACAAATACTGGGGCCAGGG AACCCTGGTCACCGTCTCCTCA SEQ ID NO: 31099 |
| | | AA | DIVMTQSPDSLAVSLGERATINCKSSQNVLDISN NKNSLGWFQQKPGQPPKLLINWASTRESGVPDR FSGSGSGTDFTLTISSLQTEDVAVYHCQQYYNIP PTFGRGTKVEIK SEQ ID NO: 27094 | QVQLVQSGAEVKKPGASVKVSCKASGYTFTGYHM HWVRQAPGQGLEWMGWINPKSDGTNYAQKFQGR VTMTRDTSISTAYMELSRLRSDDTAVYYCAREKPG SYYKYWGQGTLVTVSS SEQ ID NO: 31100 |
| iPS:436402 | 21-225_213H12 | NA | GACATCGTGATGACCCAGTCTCCAGACTCCCT GGCTGTGTCTCTGGGCGAGAGGGCCACCATCA CCTGCAAGTCCAGCCAGAACTACTTAGTGACC TCCAACAATAAGAACTACTTAGCTTGGTACCA GCAGAAACCAGGACAGCCTCTAAGGTGCTCA TTTACTGGGCATCTACCCGGGAATCCGGGGTC CCTGACCGATTCAGTGGCAGCGGGTCTGGGAC AGATTTCACTCTCATCATCAGCAGCCTGCAGG CTGAAGATGTGGCAGTTTATTACTGTCTCCAA CATTATATAGTATTCCGTGACCTTCGGCCAAGG GACCAAGGTGGAAATCAAG SEQ ID NO: 27095 | CAGGTTCAGCTGGTGCAGTCTGGAGCTGAGGTGA AGAAGCCTGGGCCTCAGTGAAGGTCTCCTGCA AGGCTTCTGGTTCACCTTTACCAGTGGTATC AACTGGGTGCGACAGGCCCCTGGACAAGGGCTT GAGTGGATGGGATGGATCAGCGTTCACATGGT AACACAGACTATGCACAGAAGTTCCAGGGCAGA GTCACCATGACCACAGACACATCCAGAGCACA GCCTACATGGAACTGAGGAGCCTGAGATCTGAC GACACGGCCGTGTATTACTGTGCGAGAGACTACT ACTACGGTATGGACGTCTGGGGCCAAGGGACCA AGGTCACCGTCTCCTCA SEQ ID NO: 31101 |

FIGURE 50
(Continued)

| | | | |
|---|---|---|---|
| iPS:436404 | 21-225_214C3 | AA | DIVMTQSPDSLAVSLGERATITCKSSQNVLKTSN NRNYLAWYQQKPGQPPKVLIYWASTRESGVPD RFSGSGSGTDFTLTISSLQAEDVAVYYCHQYYSIP WTFGQGTKVEIK<br>SEQ ID NO: 27096 | QVQLVQSGAEVKKPGASVKVSCKASGFTFTSYGIN WVRQAPGQGLEWMGWISVHNGNTDYAQKFQGRV TMTDTSTSTAYMELRSLRSDDTAVYYCARDYYY GMDVWGQGTKVTVSS<br>SEQ ID NO: 31102 |
| | | NA | GACATCCAGATGACCCAGTCTCCATCCTCACT GTCTGCATCTGTTGGAGACAGAGTCACCATAA CTTGTCGGGCGAGTCAGGCATTGGCAATTAT TTAGCCTGGTTTCAGCAGAAACCAGGTAAAGT CCCTAAGTCCCTGATCTATGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATATGACTTACTA TTACTGCCAACAATATATGACTTACCAATCA CTTTCGGCCCTGGGACCAAAGTGGATATCAAA<br>SEQ ID NO: 27097 | CAGGTGCAGCTGGTGCAGTCTGGGGGAGGCGTG GTCCAGCCTGGGAGGTCCCTGAGACTCTCCTGTG AAGCGTCTGGATTCACCTTCAGTAGCTATGGCAT GCACTGGGTCCGCCAGGCTCCAGGCAAGGGGCT GGAGTGGGTGGCAGTTATATGGTATGATGAAGT AATAAAAACTATGGAGACTCCGTGAAGGGCCGA TTCACCATCTCCAGAGACAATTCCAAGAATACGC TGTATCTGCAAATGAACAGCCTGAGAGCCGAGG ACACGGCTGTGTATTACTGTGCGAGAGATCGGGG AGTGGGCTACGACGGAATGGACGTCTGGGGCCA AGGGACCACGGTCACCGTCTCCTCA<br>SEQ ID NO: 31103 |
| | | AA | DIQMTQSPSSLSASVGDRVTITCRASQGIGNYLA WFQQKPGKVPKSLIYAASSLQSGVPSKFSGSGSG TDFTLTISSLQPEDFFTYYCQQYMTYPITFGPGTK VDIK<br>SEQ ID NO: 27098 | QVQLVESGGGVVQPGRSLRLSCEASGFTFSSYGMH WVRQAPGKGLEWVAVIWYDGSNKNYGDSVKGRF TISRDNSKNTLYLQMNSLRAEDTAVYYCARDRGV GYDGMDVWGQGTTVTSS<br>SEQ ID NO: 31104 |

FIGURE 50
(Continued)

| | | | |
|---|---|---|---|
| iPS:436406 | 21-225_214E4 | NA | GACATCCAGATGACCCAGTCTCCATCCTCACT<br>GTCTGCATCTGTAGGAGACAGAGTCACCATCA<br>CTTGTGTGGGCGAGTCAGGCATTAGCAATTAT<br>TTAGCCTGGTTTCAGCAGAAACCAGGGAAAGC<br>CCCTAAGTCCCTGATCTATGCTGCATCCAGTTT<br>GCAAAGTGGGGTCCCATCAAAGTTCAGCGGCA<br>GTGGATCTGGGACAGATTTCACTCTCACCATC<br>AGCAGCCTGCAACAGTATCTTACTTACCCATTCAC<br>TTTCGGCCCTGGGACCAAAGTGGATATCAAA<br><br>SEQ ID NO: 27099 | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGCT<br>GGAGTGGGTGGCAGTTATATGGTATGATGAAGT<br>AATGAAAACTATGCAGACTCCGTGAAGGGCCGA<br>ATCACCATCTCCAGAGACAATTCCAAGAACACGC<br>TGTATCTGCAAATGAACAGCCTGAGAGCCGAGG<br>ACACGGCTGTGTATTACTGTGCGAGAGATAGGAC<br>GGTGGGCTATGATGGTTGTGATATCTGGGGCCAA<br>GGGCAATGGTCACCGTCTCTTCA<br><br>SEQ ID NO: 31105 |
| | | AA | DIQMTQSPSSLSASVGDRVTITCRASQGISNYLA<br>WFQQKPGKAPKSLIYAASSLQSGVPSKFSGSGSG<br>TDFTLTISSLQPEDFATYYCQQYLTYPFTFGPGTK<br>VDIK<br><br>SEQ ID NO: 27100 | QVQLVESGGGVVQPGRSLRLSCAASGFTFSSYGMH<br>WVRQAPGKGLEWVAVIWYDGSNENYADSVKGRI<br>TISRDNSKNTLYLQMNSLRAEDTAVYYCARDRTVG<br>YDGCDIWGQGAMVTVSS<br><br>SEQ ID NO: 31106 |
| iPS:436408 | 21-225_214H8 | NA | GAAATTGTGCTGACTCAGTCTCCAGACTTTCA<br>GTCTGTGACTCCAAAGGAGAAAGTCACCATCA<br>CCTGCCGGCCAGTCAGAGCATTGGTGTTAGC<br>TTACACTGGTACCAGCAGAAACCAGATCAGTC<br>TCCACAACTCCTCATCAAGTATGCTTCCCAGTC<br>CTTCTCAGGGGTCCCCTCGAGGTTCAGTGGCA<br>GTGGATCTGGGACAGATTTCACCCTCACCATC<br>AATAGCCTGGAAGCTGAAGATGCTGCAACGTA<br>TTACTGTCATCAGAGTCGTAGTTTACCATTCAC<br>TTTCGGCCCTGGGTCCAAAGTGGATATCAAA<br><br>SEQ ID NO: 27101 | CAGGTCCAGCTGGTGCAGTCTGGGGCTGAGGTG<br>AAGAAGCCTGGGGCCTCAGTGAAGGTCTCCTGC<br>AAGGCTTCTGGATACACCTTCACCGGCCACTATA<br>TACACTGGGTGCGACAGGCCCCTGGACAAGGGC<br>TTGAGTGGATGGGATGGATCAACTCTAACAGTGG<br>TGGCACAAACTATGCACAGAAGTTTCAGGGCAG<br>GGTCACCATGACCAGGGACACGTCCATCAGCAC<br>AGCCTACATGGAGCTGAGCAGGCTGAGATCTGA<br>CGACACGGCCGTATATTACTGTGCGAAAGACGG<br>GAGATACAGTATGTTACGACTGGTTCGACCCC<br>TGGGGCCAGGGAACCCTGGTCACCGTCTCCTCA<br><br>SEQ ID NO: 31107 |

FIGURE 50
(Continued)

| | | | |
|---|---|---|---|
| iPS:436410 | 21-225_212E10 | AA | EIVLTQSPDFQSVTPKEKVTITCRASQSIGVSLHW YQQKPDQSPQLLIKYASQSFSGVPSRFSGSGSGT DFTLTINSLEAEDAATYYCHQSRSLPFTFGPGSK VDIK |
| | | | QVQLVQSGAEVKKPGASVKVSCKASGYTFTGHYIH WVRQAPGQGLEWMGWINSNSGGTNYAQKFQGRV TMTRDTSISTAYMELSRLRSDDTAVYYCAKDGRYS YGYDWFDPWGQGTLVTVSS |
| | | | SEQ ID NO: 27102 |
| | | | SEQ ID NO: 31108 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATCAT TTAGCCTGGTTTCAGCAGAAACCAGGGAAAGC CCCTAAGTCCCTGATCTATGCTGCATCCAGTTT GCAAAGTGGGGTCCCATCAAGGTTCAGCGGCA GTGGATCTGGGACAGATTTCACTCTCACCATC AGCAGCCTGCAGCCTGAAGATTTTGCAACTTA TTACTGCCAACAGAGTATAGTAATTACCCTCTCA CTTTCGGCGGAGGGACCAAGGTGGAGATCAA A |
| | | | CAGGTGCAGTTGGTGCAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCAGACTCCGTAATGTATGATGGAAGT AATAAATACTATGCAGACTCCGTGAAGGGCCGA TTCACCATCTCAAGAGACAATTCCAAGAACACGC TGTCTCTGCAAATGAACAGCCTGAGAGCCGAGG ACACGGCTGTGTATTACTGTGCGAGAGACTACGG TGTCGGGTACTACGGTACGGACGTCTGGGGCCAA GGGACCACGGTCACCGTCTCCTCA |
| | | | SEQ ID NO: 27103 |
| | | | SEQ ID NO: 31109 |
| | | AA | DIQMTQSPSSLSASVGDRVTITCRASQGISNHLA WFQQKPGKAPKSLIYAASSLQSGVPSKFSGSGSG TDFTLTISSLQPEDFATYYCQQYSNYPLTFGGGT KVEIK |
| | | | QVQLVESGGGVVQPGRSLRLSCAASGFTFSSYGMH WVRQAPGKGLEWVAVIWYDGSNKYYADSVKGRF TISRDNSKNTLSLQMNSLRAEDTAVYYCARDYGVG YYGTDVWGQGTTVTVSS |
| | | | SEQ ID NO: 27104 |
| | | | SEQ ID NO: 31110 |

FIGURE 50
(Continued)

| | | | |
|---|---|---|---|
| iPS:436412 | 21-225_214H9 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCGCCAAGGGACCAAGGTGGAAATCA AA<br><br>SEQ ID NO: 27105 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGTCAT GCACTGGGTCCGCCAGGTCCAGGCAAGGGCT GGAGTGGGTGGCAGTTATATGGTATGATGAAGT AATAAATACTATGCAGAGACAATTCCAAGAACACGC TTCACCATCTCCAGAGACAATTCCAAGAACACGC TGTATCTGCAAATGAACAGCCTGAGAGCCGAGG ACACGGCTGTATTTACTGTGCGAGAGAGAGTA TACCAGCAGCTGGTACGACTACGGTATGACGTC TGGGGCCAAGGGACCACGGTCACCGTCTCCTCA<br><br>SEQ ID NO: 31111 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEIK<br><br>SEQ ID NO: 27106 | QVQLVESGGGVVQPGRSLRLSCAASGFTFSSYVMH WVRQAPGKGLEWVAVIWYDGSNKYYADSVKGRF TISRDNSKNTLYLQMNSLRAEDTAVFYCARERYTS SWYDYGMDVWGQGTTVTVSS<br><br>SEQ ID NO: 31112 |
| iPS:436414 | 21-225_214G10 | NA | GACATCCAGATGACCCTGTGTCCATCTTCCCC GCCTGCATCTGTTGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGCCTGAAGATTTGCAACT TATTACTGTCTACTGCATATAATAGTTACCCTCGG ACGTTCGGCCAAGGGACCAAGGTGGAAATCA AA<br><br>SEQ ID NO: 27107 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGTCCAGGCAAGGGCT GGAGTGGGTGGCAGTTATATGGTATGATGAAGT AATAAATATTATGCAGAGACATCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA<br><br>SEQ ID NO: 31113 |

FIGURE 50
(Continued)

| | | | |
|---|---|---|---|
| iPS:436416 | 21-225_214G12 | AA | DIQMTLCPSSPPASVGDRVTITCRASQGIRNDLG WYQQKPGKAPKRLIYAASSLQSGVPSRFSGSGS GTEFILTISSLQPEDFATYYCLLHNSYPRTFGQGT KVEIK | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 27108 | SEQ ID NO: 31114 |
| | | NA | GACATCCAGATGACCCAGTCTCCATCTTCCCC GCCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCATTCTCACAAT CAGCAGCCTGCAGCCTGAAGATTTTGCAACTT ATTACTGTGTAATGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA |
| | | | SEQ ID NO: 27109 | SEQ ID NO: 31115 |
| | | AA | DIQMTQSPSSPPASVGDRVTITCRASQGIRNDLG WYQQKPGKAPKRLIYAASSLQSGVPSRFSGSGS GTEFILTISSLQPEDFATYYCVMHYSYPRTFGQG TKVEIK | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 27110 | SEQ ID NO: 31116 |

FIGURE 50
(Continued)

| | | | |
|---|---|---|---|
| iPS:436418 | 21-225_215E3 | NA | GACATCCAGATGACCCAGTCTCCATCCTCCC<br>GCCTGCATCTGTAGGAGACAGAGTCACCATCA<br>CTTGCCGGGCAAGTCAGGGCATTAGAAATGAT<br>TTAGGCTGGTATCAGCAGAAACCAGGGAAAG<br>CCCCTAAGCGCCTTATCTATGCTGCATCCAGTT<br>TGCAAAGTGGGGTCCCATCAAGGTTCAGCGGC<br>AGTGGATCTGGGACAGAATTCACTCTCACAAT<br>CAGCAGCCTGCAGCCTGAAGATTTTGCAACTT<br>ATTACTGTGTAATGCATAATAGTTACCCTCGG<br>ACGTTCGGCCAAGGGACCAAGGTGGAAATCA<br>AA |CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTATGTCAT<br>ACACTGGGTCCGCCAGGCTCCAGGCAAGGGCT<br>GGAGTGGGTGACAGTTATATGTATGGAAGT<br>AATAAATATTATGCAGAGACAATTCCAAGAACACGT<br>TCACCATCTCCAGAGACAATGTGAGAGCCGAGGA<br>GTATCTGCAAATGAACAGTGTGAGAGCCGAGGA<br>CACGGCTGTGTATTACTGTGCGAGAGAACGTTAT<br>AGCAGTGGCTGGTACGACTACGGTATGGACGTCT<br>GGGGCCAAGGGACCACGGTCACCGTCTCCTCA |
| | | | SEQ ID NO: 27111 | SEQ ID NO: 31117 |
| | | AA | DIQMTQSPSSPPASVGDRVTITCRASQGIRNDLG<br>WYQQKPGKAPKRLIYAASSLQSGVPSRFSGSGS<br>GTEFTLTISSLQPEDFATYYCVMHNSYPRTFGQG<br>TKVEIK | QVQLVESGGGVVQPGRSLRLSCAASGFTFSDYVIH<br>WVRQAPGKGLEWVTVIWYDGSNKYYADSVKGRF<br>TISRDNSKNTLYLQMNSVRAEDTAVYYCARERYSS<br>GWYDYGMDVWGQGTTVTVSS |
| | | | SEQ ID NO: 27112 | SEQ ID NO: 31118 |
| iPS:436420 | 21-225_215B5 | NA | GACATCCAGATGACCCAGTCTCCATCCTCCACT<br>GTCTGCATCTGTAGGAGACAGAGTCACCATCA<br>CTTGTCGGGCGAGTCAGGGCATTAGCAATCAT<br>TTAGCCTGGTTTCAGCAGAAACCAGGGAAAGC<br>CCCTAAGTCCCTGATCTATGCTGCATCCAGTTT<br>GCAAAGTGGGGTCCCATCAAAATTCAGCGGCA<br>ATAGATCTGGGACAGATTTCACTCTCACCATC<br>AACAACCTGCAGCCTGAAGATATTAACCCTCAC<br>TTACTGCCAGCAGTAATTAATTACCCTCTCAC<br>TTTCGGCGGAGGGACCAAGGTGGAGATCAAA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTAGTTATGGCAT<br>GCACTGGGTCCGCCAGGCTCCAGGCAAGGGCT<br>GGAGTGGGTGGCAGTTATATGCAGACTCCGTGAAGT<br>AATAAAAATTATGCAGACTCCGTGAAGGGCCGA<br>TTCACCATCTCCAGAGACAATTCCAAGAACACGC<br>TGTCTCTGCAAATGAACAGCCTGAGAGCCGAGG<br>ACACGGCTGTGTATTACTGTGCGAGAGACTACGG<br>TGTCGGTACTACGGTACGACGTCTGGGGCCAA<br>GGGACCACGGTCACCGTCTCCTCA |
| | | | SEQ ID NO: 27113 | SEQ ID NO: 31119 |

FIGURE 50
(Continued)

| | | | | |
|---|---|---|---|---|
| iPS:436422 | 21-225_215D6 | AA | DIQMTQSPSSLSASVGDRVTITCRASQGISNHLAWFQQKPGKAPKSLIHAASSLQSGVPSKFSGNRSGTDFTLTINNLQPEDFVTYYCQQYINYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLSLQMNSLRAEDTAVYYCARDYGVGYYGTDVWGQGTTVTVSS |
| | | | SEQ ID NO: 27114 | SEQ ID NO: 31120 |
| | | NA | GACATCCAGATGACCCAGTCTCCATCCTCACTGTCTGCATCTGTAGGAGACAGAGTCACCATCACTTGTCGGGCGAGTCAGGGCATTAGCAATCATCTTAGCCTGGTTTCAGCAGAAACCAGGGAAAGCCCCTAAGTCCCTGATCTATGCTGCATCCAGTTTGCATAGTGGGGTCCCATCAAGGTTCAGCGGCAGTAGATCTGGGACAGATTCACTCTCACCATCAGCAGCCTGCAGCCTGAAGATTTTGCAACTTATTACTGCCAACAGTATATTAACTATCCTCTCACTTTCGGCGGAGGGACCAAGGTGGAGATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAAAACTATGCAGATTCCGTGAAGGGCCGATTCACCATCTCCAGAGACAATTCCAAGAACACACTGTATCTGCAAATGAACAGCCTGAGAGCCGAGGACACGGCTGTGTATTACTGTGCGAGAGACTGCGGTGTCGGATACTACGGTACGGACGTCTGGGGCCAAGGGACCACGGTCACCGTCTCCTCA |
| | | | SEQ ID NO: 27115 | SEQ ID NO: 31121 |
| | | AA | DIQMTQSPSSLSASVGDRVTITCRASQGISNHLAWFQQKPGKAPKSLIYAASSLHSGVPSKFSGSRSGTDFTLTISSLQPEDFATYYCQQYVTYPLTFGGGTKVEIK | QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDCGVGYYGTDVWGQGTTVTVSS |
| | | | SEQ ID NO: 27116 | SEQ ID NO: 31122 |

FIGURE 50
(Continued)

| | | NA | GAAATTGTGCTGACTCAGTCTCCAGACTTTCA GTCTGTGACTCCAAAGGAGAAAGTCACCATCA CCTGCCGGGCCAGTCAGAGCATCGGTGTTAGC TTACACTGGTACCAGCAGAAACCAGATCAGTC TCCACAGCTCCTCATCAAGTATGCTTCCCAGTC CCTCTCAGGGGTCCCCTCGAGGTTCAGTGGCA GTGGATCTGGGACAGATTTCACCTCACCATC AATAGCCTGGAAGCTGAAGATGCTGCAACGTA TTACTGTCATCAGAGTCGCAGTTTACCATTCAC TTTCGGCCCTGGGTCCAAAGTGGATATCAAA<br><br>SEQ ID NO: 27117 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCCACTATA TACACTGGGTGCGACAGGCCCCTGGACAAGGGC TTGAGTGGATGGGATGGATCAACTCTAACAGTGG TGGCACAAATTATGCAGAGAAGTTCAGGCAG GGTCACCATGACCAGGGACACGTCCATCAGCAC AGCCTACATGGAGCTGAGCAGGCTGAGATCTGA CGACACGGCCGTGTATTACTGTGCGAAAGACGG GAGATACAGCTATGGTCACGACTGGTTCGACCCC TGGGGCCAGGGAACCCTGGTCACCGTCTCCTCA<br><br>SEQ ID NO: 31123 |
| iPS:436424 | 21-225_215H6 | AA | EIVLTQSPDFQSVTPKEKVTITCRASQSIGVSLHW YQQKPDQSPQLLIKYASQSLSGVPSRFSGSGSGT DFTLTINSLEAEDAATYYCHQSRLPFTFGPGSK VDIK<br><br>SEQ ID NO: 27118 | QVQLVQSGAEVKKPGASVKVSCKASGYTFTGHYIH WVRQAPGQGLEWMGWINSNSGGTNYAEKFQGRV TMTRDTSISTAYMELSRLRSDDTAVYYCAKDGRYS YGHDWFDPWGQGTLVTVSS<br><br>SEQ ID NO: 31124 |
| iPS:436426 | 21-225_215C7 | NA | GAAATTGTGTTGACGCAGTCTCCAGGCACCCT GTCTTTGTCTCCAGGGGAAAGAGTCACCCTCT CCTGCAGGGCCAGTCAGAGTGTTAGCAGCAAC TTCTTAGCTTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TTATTACTGTCAGCAGTATGGTAGTTCATTGC TCACTTTCGGCGGAGGGACCAAGGTGGAGATC AAA<br><br>SEQ ID NO: 27119 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTACTATGGCAT GCACTGGGTCCGCCAGGCTCCAGGCAAGGGGCT GGAGTGGGTGGCAGTTATATGCATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCGTGTATTACTGTGCGAGGTTAGACT ACAGTAATTACGGGTGGTTCGACCCCTGGGGCCA GGGAACCCTGGTCACCGTCTCCTCA<br><br>SEQ ID NO: 31125 |

FIGURE 50
(Continued)

| | | | |
|---|---|---|---|
| | | AA | EIVLTQSPGTLSLSPGERVTLSCRASQRITTNFLAWYQQKPGQAPRLLIYGASSRATGIPDRFSGSGSGTDFTLTISRLESEDFAVYYCQQYVSSLLTFGGGTKVEIK | QVQLVESGGGVVQPGRSLRLSCAASGFTFSYYGMHWVRQAPGKGLEWVAVIWHDGSNKYYADSVKGRFTISRDNSKNTLYLQMNSLRAEDTAVYYCARLDYSNYGWFDPWGQGTLVTVSS |
| iPS:436428 | 21-225_215E11 | | SEQ ID NO: 27120 | SEQ ID NO: 31126 |
| | | NA | GACATCCAGATGACCCAGTGTCCATCTTCCCCGCCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTTATCTATGCTGCATCCAGTTTGCAAAGTGGGGTCCCATCAAGGTTCAGCGGCAGTGGATCTGGGACAGATTCATTCTCACAATCAGCAGCGTGCAGCGTGAAGATTTTGCAACTTATTACTGTGTAATGCATTATAGTTACCCTCGGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGACTATGTCATGCACTGGGTCCGCCAGGCTCCAGGCAAGGGGCTGGAGTGGGTGGACAGTTATATGGTATGATGGAAGTAATAAATATTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACGTTATAGCAGTGGCTGTAGGACTACGGTTATGGACGTCTGGGGCCAAGGGACCACGGTCACCGTCTCCTCA |
| | | | SEQ ID NO: 27121 | SEQ ID NO: 31127 |
| | | AA | DIQMTQCPSSPPASVGDRVTITCRASQGIRNDLGWYQQKPGKAPKRLIYAASSLQSGVPSRFSGSGSGTEFILTISSVQREDFATYYCVMHYSYPRTFGQGTKVEIK | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS |
| | | | SEQ ID NO: 27122 | SEQ ID NO: 31128 |

FIGURE 50
(Continued)

| | | | |
|---|---|---|---|
| iPS:436430 | 21-225_215A12 | NA | GACATCCAGATGACCCAGTCTCCATCCTCACT GTCTGCATCTGTAGGAGACAGAATCACCATCA CTTGTGTCGGACGAGTCAGGACATTGGCAATTAT TTAGCCTGGTTTCAGCAGAAACCAGGGAAAGC CCCTAAGTCCCGATCTATGCTGCATCCAGTTT ACAGAGAGTGGGGTCCCATCAAAGTTCAGCGGCA GTAGATCTGGGACAGATTTCACTCTCACCATC AGCAGCCTGCAGTCTGAAGATTTTGCAACTTA TTACTGCCAACAGTATGTTACTTACCCGCTCAC TTTCGGCGGAGGGACCAAGGTGGAGATCAAA<br>SEQ ID NO: 27123 | CAGGTGCAACTGGTGGAGTCTGGGGGAGGCGTG GTCCAGCCTGGGAGGTCCCTGAGACTCTCCTGTG CAGCGTCTGGACTCACCTTCAGTAGCTATGGCAT GCACTGGGTCCGCCAGGTCCAGGCAAGGGCT GGAGTGGGTGGCAGTTATATGTATGATGAAGT AATGAACACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGG AGTGGGCTACTACGGTATGAGCGTCGGGGCCA AGGGACCACGGTCACCGTCTCCTCA<br>SEQ ID NO: 31129 |
| | | AA | DIQMTQSPSSLSASVGDRITITCRTSQDIGNYLAW FQQKPGKAPKSLIYAASSLQSGVPSKFSGSRSGT DFTLTISSLQSEDFATYYCQQYVTYPLTFGGGTK VEIK<br>SEQ ID NO: 27124 | QVQLVESGGGVVQPGRSLRLSCAASGLTFSSYGMH WVRQAPGKGLEWVAVIWYDGSNEHYADSVKGRF TISRDNSKNTLYLQMNSLRAEDTAVYYCARDRGV GYYGMDVWGQGTTVTVSS<br>SEQ ID NO: 31130 |
| iPS:436432 | 21-225_215H12 | NA | GAAATTGTGTTGACGCAGTCTCCAGGCACCCT GTCTTTGTCTCCAGGGGAAAGAGCCACCCTCT CCTGCAGGGCCAGTCAGAGTGTTAGCAGCAGC TTCTTAGCTTGGTACCAGCAGAAACCTGGCCA GGCTCCCAGGCTCCTCATGTATGGTGCATCCA GCAGGGCCATTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGTATAGTTAGACT CTCACTTTCGGCGGAGGGACCAAGGTGGAGAT CAAA<br>SEQ ID NO: 27125 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAGTTATATGCATGATGGAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTGTGTATTACTGTGCGAGGTTAGACT ACAGTAACTACGGTGGTTGCACCCCTGGGGCCA GGGAACCCTGGTCACCGTCTCCTCA<br>SEQ ID NO: 31131 |

FIGURE 50
(Continued)

| | | | |
|---|---|---|---|
| iPS:436434 | 21-225_216B10 | AA | EIVLTQSPGTLSLSPGERATLSCRASQSVSSSFLAWYQQKPGQAPRLLMYGASSRAIGIPDRFSGSGSGTDFTLTISRLEPEDFAVYYCQQYVSSPLTFGGGTKVEIK<br>SEQ ID NO: 27126 | QVQLVESGGGVVQPGRSLRLSCAASGFTFSNYGMHWVRQAPGKGLEWVAVIWHDGSNKYYADSVKGRFTISRDNSKNTLYLQMNSLRAEDTAVYYCARLDYSNYGWFDPWGQGTLVTVSS<br>SEQ ID NO: 31132 |
| | | NA | GAAATAGTGATGACGGAGTCTCCAGCCACCCTGTCTGTGTCTCCAGGGGAAAGAGCCACCCTCTCCTGCAGGGCCAGTCAGAGTGTTAACAACTTAGCCTGGTACCGGCAGAAACCTGGCCAGGCTCCCAGGCTCCTCATCTATGGTGCATCCACCAGGGCCACTGGTATCCCACCAGGTTCAGTGGCAGTGGGTCTGGGACAGAGTTCACTCTCCATCAGCAGCCTGCAGTCTGAAGATTTTGCAGTTATTACTGTCAGCAGTATAATGACTGGCCGTGCAGTTTTGGCCAGGGGACCAAACTGGAGATCAGA<br>SEQ ID NO: 27127 | CAGGTGCAGCTGGTGGAGTCGGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGCATGATGGAAGTAATAAATACTATGCAGACTCCGTGAAGGGCCGATTCACCATCTCCAGAGACAATTCCAAGCGACGCTGTATCTGCAGATGAACAGCCTGAGAGCCGAGGACACGGCTGTGTATTACTGTGCGAGAGATCCAACATAGTGGAGCTACTTGGTTTGACTACTGGGGCCAGGGAACCCTGGTCACCGTCTCCTCA<br>SEQ ID NO: 31133 |
| | | AA | EIVMTESPATLSVSPGERATLSCRASQSVNNNLAWYRQKPGQAPRLLIYGASTRATGIPPRFSGSGSGTEFTLSISSLQSEDFAVYYCQQYNDWPCSFGQGTKLEIR<br>SEQ ID NO: 27128 | QVQLVESGGGVVQPGRSLRLSCAASGFTFSSYGMHWVRQAPGKGLEWVAAIWYDGSNKYYADSVKGRFTISRDNSKRTLYLQMNSLRAEDTAVYYCARDPNIVGATWFDYWGQGTLVTVSS<br>SEQ ID NO: 31134 |

FIGURE 50
(Continued)

| | | | |
|---|---|---|---|
| iPS:436436 | 21-225_216F10 | NA | GAAGTTGTGTTGTTGACGCAGTCTCCAGGCACCCT GTCTTTGTCTCCAGGGGAAAGAGCCACCCTCT CCTGCAGGGCCAGTCAGAGTGTTAGCAGCAGC TTCTTAGCCTGGTACCAGCAGAAACCTGGCCA GGCTCCCAGGCTCCTCCATCTATGGTGCATCA CCAGGGCCACTGGCATCCTGACAGGTTCAGT GGCAGTGGGTCTGGGACAGACTTCATTCTCAC CATCAGCAGACTGGAGCCTGAAGATGCTGCAG TATATTACTGTCAACAGTATGATAGGTCACCA TTCACTTTCGGCCCTGGGACCAAAGTGGATAT CAAA SEQ ID NO: 27129 | GAGGTACAGCTGGTGGAGTCTGGGGGAGGCTTG GTACAGCCTGGGGGGTCCCTGAGACTCTCCTGT GCAGCCTCTGGATTCTCCTTCAGAAGCTATAGCAT GAACTGGGTCCGCCAGGCTCCAGGGAAGGGGCT GGAGTGGGTTCATACATTACATTACTGTGTAGTAGT ACCATATACTACGCAGACTCTGTGAAGGCCGAT TCACCATCTCCAGAGACAATGCCAAGAACTCACT GTATCTGCAAATGAACAGCCTGAGAGACGAGGA CACGGCTGTGTATTACTGTGCGAGATCGGGTTTA GCAGTGGAGGACTACTGGGGCCAGGGAACCCTG GTCACCGTCTCCTCA SEQ ID NO: 31135 |
| | | AA | EVVLTQSPGTLSLSPGERATLSCRASQSVSSSFLA WYQQKPGQAPRLLIYGTSTRATGIPDRFSGSGSG TDFILTISRLEPEDFAVYYCQQYDRSPFTFGPGTK VDIK SEQ ID NO: 27130 | EVQLVESGGGLVQPGGSLRLSCAASGFSFRSYSMN WVRQAPGKGLEWVSYITGSSSTIYADSVKGRFTIS RDNAKNSLYLQMNSLRDEDTAVYYCARSGLAVED YWGQGTLVTVSS SEQ ID NO: 31136 |
| iPS:436438 | 21-225_216E8 | NA | GACATCCAGATGACCCAGTCTCCATCTTCCCT GCCTGCATCTGTAGGAGACAGAGTCACCATCA CTTGCCGGGCAAGTCAGGGCATTAGAAATGAT TTAGGCTGGTATCAGCAGAAAACCAGGGAAAG CCCCTAAGCGCCTTATCTATGCTGCATCCAGTT TGCAAAGTGGGGTCCCATCAAGGTTCAGCGGC AGTGGATCTGGGACAGAATTCATTCTCACAAT CAGCAGCCTGCAGCCTGAAGATTTTGCAACTT ATTACTGTCTAATGCATTATAGTTACCCTCGGA CGTTCGGCCAAGGGACCAAGGTGGAAATCAA A SEQ ID NO: 27131 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGGTGCTGGTACGACTACGGTATGGACGTCT GGGGCCAAGGGACCACGGTCACCGTCTCCTCA SEQ ID NO: 31137 |

FIGURE 50
(Continued)

| | | | |
|---|---|---|---|
| iPS:436440 | 21-225_216H12 | AA | DIQMTQSPSSLPASVGDRVTITCRASQGIRNDLGWYQQKPGKAPKRLIYAASSLQSGVPSRFSGSGSGTEFILTISSLQPEDFATYYCLMHYSYPRTFGQGTKVEIK | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS |
| | | | SEQ ID NO: 27132 | SEQ ID NO: 31138 |
| | | NA | GACATCCAGATGACCCAGTCTCCATCTTCCCTGCCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTAATCTATGGTGCATCCAGTTTGCAAAGTGGGGTCCCATCAAGGTTCAGCGGCAGTGGATCTGGGACAGAATTCATTCTCACAATCAGCAGCCTGCAGCCTGAAGATTTTGCAACTTATTACTGTGTAATGCATAATAGTTACCCTCGACGTTCGGCCAAGGGACCAAGGTGAAATCAAA | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGTCATGCACTGGGTCCGCCAGGCTCCAGGCAAGGGGCTGGAGTGGGTGACAGTTATATGGTATGATGGAAGTAATAAATATTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAACGTTATAGCAGTGGCTGTGATACGGTACGGTATGGACGTCTGGGGCCAAGGGACCACGGTCACCGTCTCCTCA |
| | | | SEQ ID NO: 27133 | SEQ ID NO: 31139 |
| | | AA | DIQMTLSPSSLPASVGDRVTITCRASQGIRNDLGWYQQKPGKAPKRLIYGASSLQSGVPSRFSGSGSGTEFILTISSLQPEDFATYYCVMHNSYPRTFGQGTKVEIK | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS |
| | | | SEQ ID NO: 27134 | SEQ ID NO: 31140 |

FIGURE 50
(Continued)

| | | | |
|---|---|---|---|
| iPS:436448 | 21-225_217A3 | NA | GAAATTGTGCTGACTCAGTCTCCAGACTTTAA GTCTGTGACTCCAAAGGAGAAAGTCACCATCA CCTGCCGGGCCAGTCAGAGCAGAAAACCAGTCA TTACACTGGTACCAGCAGAAACCAGATCAGTC TCCAAAGCTCCTCGTCAAGTATGCTTCCCAGT CCTTCTCAGGGGTCCCCTCGAGTTCAGTGGC AGTGGATCGGGACAGATTTCACCCTCACCAT CAACAGCCTGGAGGCTGAAGATGGTGCAACG TATTACTGTCATCAGAGTAGAAGTTTACCGTG GACGTTCGGCCAAGGGACCAAGGTGGAAATC AAA | GAGGTGCAACTGGTGGAGTCGGGGGAGGCTTG GTACAGCCTGGGGGGTCCCTGAGACTCTCCTGT CAGCCCTCTGGATTCACCTTCAGTAGCTATATAT GAACTGGGTCCGCCAGGCTCCAGGGAAGGCT GGAGTGGGTTTCATACATTAGTAGTAGTCGTAAT ATCATATATTACGCAGACTCTGTGAAGGGCCGAT TCACCATCTCCAGAGAAAATGCCAAGAACTACT GTCTCTGCAAATGGACAGCCTGAGAGACGAGGA CACGGCTGTGTATTACTGTGCGCGAGATGGCTCT TATAGCAGTGGCTGGTACTGGGGTTTTGACTACT GGGGCCAGGGCACCCTGGTCACCGTCTCCTCA |
| | | | SEQ ID NO: 27135 | SEQ ID NO: 31141 |
| | | AA | EIVLTQSPDFKSVTPKEKVTITCRASQSIGSSLHW YQQKPDQSPKLLVKYASQSFSGVPSRFSGSGSGT DFTLTINSLEAEDGATYYCHQSRSLPWTFGQGT KVEIK | EVQLVESGGGLVQPGGSLRLSCAASGFTFSSYNMN WVRQAPGKGLEWVSYISSSRNIIYADSVKGRFTIS RENAKNSLSLQMDSLRDEDTAVYYCARDGSYSSG WYWGFDYWGQGTLVTVSS |
| | | | SEQ ID NO: 27136 | SEQ ID NO: 31142 |
| iPS:436450 | 21-225_217E5 | NA | GACATCCAGATGACCCAGTGTCCATCTTCCCC GCCTGCATTTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTGTGCTGCATCCAGTT TGCAAAGTGGGGTCCCATCAAGGTTCAGCGGC AGTGGATCTGGGACAGCCTCCATTCACACTT CAGCAGCCTGCAGCCTGAAGATTTTGCAACTT ATTACTGTGTAATGTAATAATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGGACAGTTATATGCGACTCCGTG AATAAATATTATGCAGAGACAATTCCAAGAACACGCT TCACCATCTCCAGAGACAATTCCAAGAACACGCT GTATCTGCAAATGAACAGCCTGAGAGCCGAGGA CACGGCTGTGTATTACTGTGCGAGAGAACGTTAT AGCAGTGGCTGGTACGACTACGGTATGGACGTCT GGGGCCAAGGGACCACGGTCACCGTCTCCTCA |
| | | | SEQ ID NO: 27137 | SEQ ID NO: 31143 |

FIGURE 50
(Continued)

| | | | |
|---|---|---|---|
| iPS:436452 | 21-225_217G5 | AA | DIQMTQCPSSPPPAFVGDRVTITCRASQGIRNDLG WYQQKPGKAPKRLICAASSLQSGVPSRFSGSGS GTEFILTISSLQPEDFATYYCVMHNSYPRTFGQG TKVEIK<br>SEQ ID NO: 27138 | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS<br>SEQ ID NO: 31144 |
| | | NA | GACATCCTGATGACCCAGTCTCCATCCTCACT GTCTGCATCTGTAGGAGACAGAGTCACCATCA CTTGTCGGGCGAGTCAGGGCATTAGGAATTAT TTAGCCTGGTTTCAGCAGAAGACCAGGAAAGC CCCTAAGTCCCTGATCTATGCTGCATCCAGTTT GCAAAGTGGGGTCCCATCAAAGTTCAGCGGCA CTGGATCTGGGACAGATTTCACTCTCACCATC AGCAGCCTGCAGCCTGACGATTTTGCAACTTA TTACTGCCAACAGTATGTTAATTACCCTCTCAC TTTCGGGGGAGGGACCAAGGTGGAGATCAAC<br>SEQ ID NO: 27139 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCAATGGCAT GCACTGGGTCCGCCAGGCTCCAGGCAAGGGGCT GGAGTGGGTGGCAGTTATATGCAGACTCCGTGAAGGGCCGA AATAAAACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTGTATTACTGTGCGAGAGACTACGG TGTCGGGTACTACGGTCTGGACGTCTGGGGCCAA GGGACCACGGTCACCGTCTCCTCA<br>SEQ ID NO: 31145 |
| | | AA | DILMTQSPSSLSASVGDRVTITCRASQGIGNYLA WFQQRPGKAPKSLIYAASSLQSGVPSKFSGTRSG TDFTLTISSLQPDDFATYYCQQYVNYPLTFGGGT KVEIN<br>SEQ ID NO: 27140 | QVQLVESGGGVVQPGRSLRLSCAASGFTFSSNGMH WVRQAPGKGLEWVAVIWYDGSNKNYADSVKGRF TISRDNSKNTLYLQMNSLRAEDTAVYYCARDYGV GYYGLDVWGQGTTVTVSS<br>SEQ ID NO: 31146 |

FIGURE 50
(Continued)

| | | | |
|---|---|---|---|
| iPS:436454 | 21-225_217B10 | NA | GACATCCAGATGACCCAGTCTCCATCCTCACT GTCTGCATCTGTAGGAGACAGAGTCACCATCA CTTGTCGGGCGAGTCAGGCCATTGGGAAACAT TTAGCCTGGTTTCAGCAGAGGCCAGGGAAAGC CCCTAAGTCCCTGATCTATGCTGCATCCAGATT CAAAGTGGGGGTCCCATCAAAGTTCAGCGGCA GCAAAGTGGGGTCCCATCAAAGTTCACTCTCACCATC AGCAGCGTGCAGCCTGAAGATCTTGCAACTTA TTACCGTCAACACACCAGTAAATCTCCAGTGC AGCTTGTCGGAGGCACCAAGGTGGAGATCAC A SEQ ID NO: 27141 | CAGGTGCAGCTGGTGGAGTCTGGGGGAGGCGTG GTCCAGCCTGGGAGGTCCCTGAGACTCTCCTGTG CAGTGTCTGAATCACCTTCAGTAGTTATGGCAT GCACTGGGCCCGCCAGGCTCCAGGCAAGGGCT GGAGTGGGTGGCAGTTATATGAGTATGATGAAGT AATAAAAACTATGAAGACTCCGTGAAGGGCGA TTCACCATCTCCAGAGACAACTCCAAGAACACGC TGTATCTGCAAATGAACAGCCTGAGAGCCGAGG ACACGGCTGTGTATTACTGTGCGAGAGATGGGAG TTATGGTTACGACGGTATGGACGTCTGGGGCAA GGGACCACGGTCACCGTCTCCTCA SEQ ID NO: 31147 |
| | | AA | DIRMTQSPSSLSASVGDRVTITCRASQAIGKHLA WFQQRPGKAPKSLIYAASRLQSGVPSKFSGSGSG TDFTLTISSVQPEDLATYYRQHTSKSPVQLVGGT KVEIT SEQ ID NO: 27142 | QVQLVESGGGVVQPGRSLRLSCAVSGITFSSYGMH WARQAPGKGLEWVAVIWYDGSNKNYEDSVKGRF TISRDNSKNTLYLQMNSLRAEDTAVYYCARDGSYG YDGMDVWGQGTTVTVSS SEQ ID NO: 31148 |
| iPS:436456 | 21-225_217G10 | NA | GACATCCAGATGACCCAGTCTCCATCTTCCCC GCCTCTGTCATCTGTAGGAGACAGAGTCACCATCA CTTGCCGGGCAAGTCAGGGCCATTAGAAATGAT TTAGGCTGGTATCAGCAGAAACCAGGGAAAG CCCCTAAGCGCCTTATCTATGCTGCATCCAGTT TGCAAAGTGGGGTCCCATCAAGGTTCAGCGGC AGTGGATCTGGGACAGACAGAATTCATTCTCACTAT CAGCAGCCTGCAGCCTGAAGATTTTGCAACTT ATTACTGTGTAATGTAATAATAGTTACCCTCCG ACGTTCGGCCAAGGGACCAAGGTGGAAATCA AA SEQ ID NO: 27143 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGGGACAGTTATATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAGAAACGTTAT AGCAGTGGCTGGTACGACTACGGTATGAGCGTCT GGGGCCAAGGGACCACGGTCACCGTCTCCTCA SEQ ID NO: 31149 |

FIGURE 50
(Continued)

| | | | | |
|---|---|---|---|---|
| iPS:436458 | 21-225_217H12 | AA | DIQMTQSPSSPPASVGDRVTITCRASQGIRNDLGWYQQKPGKAPKRLIYAASSLQSGVPSRFSGSGSGTEFILTISSLQPEDFATYYCVMHNSYPRTFGQGTKVEIK | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS |
| | | | SEQ ID NO: 27144 | SEQ ID NO: 31150 |
| | | NA | GACATCCAGATGACCCAGTCTCCATCTTCCCCGCCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTTATCTATGCTGCATCCAGTTTGCAAAGTGGTCCCATCAAGGTTCAGCGGCAGTGGATCTGGGACAGAATTCATTCTCACAATCAGCAGCCTGCAGCCTGAAGATTTTGCAACTTATTACTGTCTAATGCATTAAGTTACCCTCGGACGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTCAGCGTCTGACTTCACCTTCAGTGACTATGTCATGCACTGGGTCCGCCAGGCTCCAGGCAAGGGGCTGGAGTGGGTGACAGTTATATGGTATGATGGAAGTAATAAATATTATGCAGACTCCGTGAAGGGCCGATTCACCATCTCCAGAGACAATGAACAGCTCAAGAACACGCTGTATCTGCAAATGAACAGCTCTGAGAGCCGAGGACACGGCTGTGTATTACTGTGCGAGAGAACGTTATAGCAGTGGCTGGTACGACTACGGTATGGACGTCTGGGGCCAAGGGACCACGGTCACCGTCTCCTCA |
| | | | SEQ ID NO: 27145 | SEQ ID NO: 31151 |
| | | AA | DIQMTQSPSSPPASVGDRVTITCRASQGIRNDLGWYQQKPGKAPKRLIYAASSLQSGVPSRFSGSGSGTEFILTISSLQPEDFATYYCLMHYSYPRTFGQGTKVEIK | QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS |
| | | | SEQ ID NO: 27146 | SEQ ID NO: 31152 |

FIGURE 50
(Continued)

| | | | | |
|---|---|---|---|---|
| iPS:436462 | 21-225_218C4 | NA | GACATCCAGATGACCCAGTCTCCATCTTCCCC GCCTCTGCATTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTTATCTATGCTGCATCCAGTT TGCAAAGTGGGGGTCCCATCAAGGTTCAGCGGC AGTGGATCTGGGACAGAATTCATTCTCACAAT CAGCAGCGTGCAGCGTGAAGATTTTGCAACTT ATTACTGTGTAATGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGTCAT GCACTGGGTCCGCCAGGTCCAGGCAAGGGCT GGAGTGGGTGACAGTTATATGGTATGATGGAAGT AATAAATATTATGCAGACACCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGAACGTTAT AGCAGTGGCTGGTACGACTACGGTATGGACGTCT GGGGCCAAGGGACCACGGTCACCGTCTCCTCA |
| | | | SEQ ID NO: 27147 | SEQ ID NO: 31153 |
| | | AA | DIQMTQCPSSPPAFVGDRVTITCRASQGIRNDLG WYQQKPGKAPKRLIYAASSLQSGVPSRFSGSGS GTEFILTISSVQREDFATYYCVMHYSYPRTFGQG TKVEIK | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 27148 | SEQ ID NO: 31154 |
| iPS:436464 | 21-225_219H1 | NA | GACATCCAGATGACCCAGTCTCCATCCTCACA GTCTGCATCTGTAGGAGACAGAGTCACCATCA CTTGTCGGGCGAGTCAGGGCATTAGCAATTAT TTAGACTGGTTTCAGCAGAAACCAGGGAAAGC CCCTAAGTCCCTGATCTATTCTGCATCCAATTT GCAAAGTGGGGTCCCATCAAAGTTCAGCGGCA GTAGATCTGGGACAGATTTCACTCTCACCATC AGCAGCCTGCAGCCTGAAGATTTTGCAACTTA TTACTGCCAACACTATAGTAATTACCCGCTCA CTTTCGGCGGAGGGACCAAGGTGGAGATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGATATGGCAT GCACTGGGTCCGCCAGGTCCAGGCAAGGGCT GGAGTGGGTGGCAGTTATATGGTATGATGGAAGT AATAAACACTATGCAGACTCCGTGAAGGGCCGA TTCACCATCTCCAGAGACAATTCCAAGAATACGT TGTATCTGCAAATGAACAGTCTGAGAGGCGAGG ACACGGCTGTGTATTACTGTGCGAGAGATCGGG AGTGGGCTACAACGGTATGGACGTCTGGGGCCA AGGGACCACGGTCACCGTCTCCTCA |
| | | | SEQ ID NO: 27149 | SEQ ID NO: 31155 |

FIGURE 50
(Continued)

| | | AA | DIQMTQSPSSQSASVGDRVTITCRASQGISNYLD WFQQKPGKAPKSLIYSASNLQSGVPSKFSGSRSG TDFTLTISSLQPEDFATYYCQHYSNYPLTFGGGT KVEIK | QVQLVESGGGVVQPGRSLRLSCAASGFTFSRYGMH WVRQAPGKGLEWVAVIWYDGSNKHYADSVKGRF TISRDNSKNTLYLQMNSLRGEDTAVYYCARDRGV GYNGMDVWGQGTTVTVSS |
| | | | SEQ ID NO: 27150 | SEQ ID NO: 31156 |
| iPS:436472 | 21-225_220E1 | NA | GAAATTGTGTTGACGCAGTCTCCAGGCACCCT GTCTTTGTCTCCAGGGGAAAGAGCCACCCTCT CCTGCAGGGCCAGTCAGAGTATTAGCCGCAGC CACTTAGTCTGGTACCAGCAGAAACCTAACCA GGCTCCCAGGCTCCTCTATGTTACATCCAG CAGGGCCACTGGCATCCCAGACAGGTTTAGTG GCAGTGGGTCTGGGACAGACTTCACTCTCACC ATCAGAAGTCTGGAGCCTGAAGATTTTGCAAT GTATTACTGTCAGCAGTATGGTAGTCACCGT GGACGTTCGGCCAAGGGACCAAGGTGAAAT CAAA | CAGGTGCAGCTGCAGGAGTCGGGCCCAGGACTG GTGAAGCCTTCGGAGACCCTGTCCCTCACCTGCA CTGTCTCTGGTGGCTCCATCAGTAGTTACTACTG GAGCTGGATCCGGCAGCCCCCAGGGAAGGACT GGAGTGGATTGGGTATATCTATTACAGTGGACC ACCAACTACAACCCCTCCCTCAAGAGTCGAGTCA CCATATCAGTAGACACGTCCAAGAACCAGTTCTC CCTGAAGCTGAGCTCTGTGACCGCTGCGGACACG GCCGTGTATTACTGTGCGAGAGACTACTACGGTAT TGGTACGTGGGAGGGACAACTACTACTACGGTATT GGACGTCTGGGGCCAAGGGACCACCGGTCACCGT CTCCTCA |
| | | | SEQ ID NO: 27151 | SEQ ID NO: 31157 |
| | | AA | EIVLTQSPGTLSLSPGERATLSCRASQSISRSHLV WYQQKPNQAPRLLYVTSSRATGIPDRFSGSGS GTDFTLTIRSLEPEDFAMYYCQQYGSSPWTFGQ GTKVEIK | QVQLQESGPGLVKPSETLSLTCTVSGGSISTYYWSW IRQPPGKGLEWIGYIYYSGTTNYNPSLKSRVTISVDT SKNQFSLKLSSVTAADTAVYYCARDQQWLVRGRD NYYYGMDVWGQGTTVTVSS |
| | | | SEQ ID NO: 27152 | SEQ ID NO: 31158 |

FIGURE 50
(Continued)

| | | | |
|---|---|---|---|
| iPS:436480 | 21-225_220F8 | NA | GACATCCAGATGACCCTGTCTCCATCTCCC GCCTGCATTGTAGGAGACAGAGTCACCATCA CTCGCCGGGCAAGTCAGGGCATTAGAAATGAT TTAGGCTGGTATCAGCAGAAACCAGGAAAG CCCCTAAGCGCCTTATATGTGTGCATCCAGT TTGCAAAGTGGGGTCCATCAAGGTTCAGCGG CAGTGGATCTGGGACAGAATTCATTCTCACAA TCAGCAGCCTGCAGCGTGAAGATTTTGCAACT TATTACTGTGTAATGCATAATAGTTACCCTCG GACGTTCGGCCAAGGGACCAAGGTGGAAATC AAA |
| | | | SEQ ID NO: 27153 |
| | | AA | DIQMTLSPSSPPAFVGDRVTITRRASQGIRNDLG WYQQKPGKAPKRLICGASSLQSGVPSRFSGSGS GTEFILTISSLQREDFATYYCVMHNSYPRTFGQG TKVEIK |
| | | | SEQ ID NO: 27154 |
| iPS:436488 | 21-225_221A6 | NA | GACATCCAGATGACCCAGTCTCCATCTCCGT GTCTGCATCTGTAGGAGACAGAGTCACCATCA CTTGTCGGGCGAGTCAGGGTATTAGCAGCTGG TTAGCCTGGTATCAGCAGAAACCAGGGAAAG CCCCTAAGCGCCTGATCTATACTGCATCCAATT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A |
| | | | SEQ ID NO: 27155 |

| | | | |
|---|---|---|---|
| | | | CAGGTGCAGCTGGTGGAGTCTGGGGGAGGCGTG GTCCAGCCTGGGGAGGTCCCTGAGACTCTCCTGTG CAGCGTCTGGATTCACCTTCAGTGACTATGTCAT GCACTGGGTCCGCCAGGCTCCAGGCAAGGGGCT GGAGTGGGTGACAGTTATATGCAGACTCGTGAAGT AATAAATATTATGCAGACACAATTCAAGAACACGCT TCACCATTCTGCAAATGAACAGCCTGAGAGCCGAGGA GTATCTGCAAATGAACAGCTGTGCGAGAGAACGTTAT CACGGCTGTGTATTACTGTGCGAGAGAACGTTAT AGCAGTGGCTGGTACGACTACGGTATGGACGTCT GGGGCCAAGGGACCACGGTCACCGTCTCCTCA |
| | | | SEQ ID NO: 31159 |
| | | | QVQLVESGGGVVQPGRSLRLSCAASGFTFSDYVM HWVRQAPGKGLEWVTVIWYDGSNKYYADSVKGR FTISRDNSKNTLYLQMNSLRAEDTAVYYCARERYS SGWYDYGMDVWGQGTTVTVSS |
| | | | SEQ ID NO: 31160 |
| | | | CAGGTGCAGCTGGTGGTGCAGTCTGGGGCTGAGGTG AAGAAGCCTGGGGCCTCAGTGAAGGTCTCCTGC AAGGACTTCTGGATACACCTTCACCGGCTACTATA TGCACTGGGTGCGACAGGCCCCTGGACAAGGGC TTGAGTGGATGGGATGGATCCACCTAACAGTGG TGGCACAAACTATGCACAGAAATTTCAGGGCAG GGTCACCTGACCAGGACACGTCCATCAGCAC AGCCTACATGGACCTGAGCAGGCTGAGATCTGA CGACACGGCCGTGTATTACTGTGCGAGAGATGG GACCAGTCGTTTGACTACTGGGGCCAGGGAACC CTGGTCACCGTCTCCTCA |
| | | | SEQ ID NO: 31161 |

FIGURE 50
(Continued)

| | | | |
|---|---|---|---|
| iPS:436490 | 21-225_221F6 | AA | DIQMTQSPSSVSASVGDRVTITCRASQGISSWLAWYQQKPGKAPKLLIYTASNLQSGVPSRFSGSGSGTDFTLTISSLQPEDFATYYCQQANSFPFTFGPGTKVDIK |
| | | | QVQLVQSGAEVKKPGASVKVSCKTSGYTFTGYYMHWVRQAPGQGLEWMGWIHPNSGGTNYAQKFQGRVTLTRDTSISTAYMDLSRLRSDDTAVYYCARDGTSSFDYWGQGTLVTVSS |
| | | | SEQ ID NO: 27156 |
| | | | SEQ ID NO: 31162 |
| | | NA | GACATCCAGATGACCCAGTCTCCATCCTCACTGTCTGGATCTGTAGGAGACAGAGTCACCATCACTTGTCGGGCGAGTCAGGGCATTAGCAGTTGGTTAGCCTGGTATCAGCAGAAACCAGGGAAAGCCCCTAAATCCCTGATCTATACTGCATCCAATTTACAAAGTGGGGTCCCATCAAGGTTCAGCGGCAGTAGATCTGGGACAGATTTCACTCTCACCATCAGCAGCCTGCAGCCTGAAGATTTTGCAACTTATTACTGCCAACAGTATATGACTTACCCGCTCACTTTCGGCGGAGGGACCAGGGTGGAGATCAAA |
| | | | CAGGTGCAGCTGGTGCAGTCTGGGGGAGGCGTGGTCCAGCCTGGGAGGTCCCTGAGACTCTCCTGTGCAGCGTCTGGATTCACCTTCAGTAGCAATGGCATGCACTGGGTCCGCCAGGCTCCAGGCAAGGGGCTGGAGTGGGTGGCAGTTATATGTGATGGAAGTAATGAAAACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGAAGTGGGGCTACAACGGTATGACGTCTGGGGCCAAGGGACCACGGTCACCGTCTCCTCA |
| | | | SEQ ID NO: 27157 |
| | | | SEQ ID NO: 31163 |
| | | AA | DIQMTQSPSSLSGSVGDRVTITCRASQGISNYLAWFQQKPGKAPKSLIYAASNLQSGVPSKFSGSRSGTDFTLTISSLQPEDFATYYCQQYMTYPLTFGGGTRVEIK |
| | | | QVQLVESGGGVVQPGRSLRLSCAASGFTFSSNGMHWVRQAPGKGLEWVAVIWYDGSNENYADSVKGRFTISRDNSKNTLYLQMNSLRAEDTAVYYCARDRTVGYNGMDVWGQGTTVTVSS |
| | | | SEQ ID NO: 27158 |
| | | | SEQ ID NO: 31164 |

FIGURE 50
(Continued)

| | | | |
|---|---|---|---|
| iPS:436494 | 21-225_221F12 | NA | GACATCCAGATGACCCAGTCTCCATCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAGCTCCTGATCTATACTGCATCCAATTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGGCTAACAGTTTCCCATTCACTTTCGGCCCTGGGACCAAAGTGGATATCAAA<br>SEQ ID NO: 27159 | CAGGTGCAGCTGGTGCAGTCTGGGGCTGAGGTGAAGAAGCCTGGGGCCTCAGTGAAGGTCTCCTGCAAGACTTCTGGATACACCTTCACCGGCTACTATATGCACTGGGTGCGACAGGCCCCTGGACAAGGCTTGAGTGGATGGGATGCACAGAAATTTCAGGCAGTGGCACAAACTATGCACAGGGACACGTCCATCAGCACGGTCACCTGACCAGGGACAGCAGGCTGAGATCTGAAGCCTACATGGACCTGTATTACTGTGCGAGAGATGGCGACACGGCCGTGTATTACTGTGGGGCCAGGAACCCTGGTCACCGTCTCCTCA<br>SEQ ID NO: 31165 |
| | | AA | DIQMTQSPSSLSASVGDRVTITCRASQGISSWLAWYQQKPGKAPKLLIYTASNLQSGVPSRFSGSGSGTDFTLTISSLQREDFATYYCQQANSFPFTFGPGTKVDIK<br>SEQ ID NO: 27160 | QVQLVQSGAEVKKPGASVKVSCKTSGYTFTGYYMHWVRQAPGQGLEWMGWIHPNSGGTNYAQKFQGRVTLTRDTSISTAYMDLSRLRSDDTAVYYCARDGTSSFDYWGQGTLVTVSS<br>SEQ ID NO: 31166 |
| iPS:436496 | 21-225_222E1 | NA | GACATCCAGATGACCCAGTCTCCATCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAGCTCCTGATCTATACTGCATCCAATTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGGCTAACAGTTTCCCATTCACTTTCGGCCGTGGGACCAAAGTGGATATCAAA<br>SEQ ID NO: 27161 | CAGGTGCAGCTGGTGCAGTCTGGGGCTGAGGTGAAGAAGCCTGGGGCCTCAGTGAAGGTCTCCTGCAAGACTTCTGGATACACCTTCACCGGCTACTATATGCACTGGGTGCGACAGGCCCCTGGACAAGGCTTGAGTGGATGGGATGCACAGAAATTTCAGGCAGTGGCACAAACTATGCACAGGGACACGTCCATCAGCACGGTCACCTGACCAGGGACAGCAGGCTGAGATCTGACGACACGGCCGTGTTTGACTACTGTGGGGCCAGGAACCCTGGTCACCGTCTCCTCA<br>SEQ ID NO: 31167 |

FIGURE 50
(Continued)

| | | | | |
|---|---|---|---|---|
| iPS:436500 | 21-225_222H3 | AA | DIQMTQSPSSVSASVGDRVTITCRASQGISSWLA WYQQKPGKAPKLLIYTASNLQSGVPSRFSGSGS GTDFTLTISSLQPEDFATYYCQQANSFPFTFGRGT KVDIK | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS |
| | | | SEQ ID NO: 27162 | SEQ ID NO: 31168 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTGAAAAGT TCCAACCATAGGAACTACTTAGCTTGGTACCA ACAGAAACCAGGGCAGCCTCCTCAGCTTCTCA TTTACTGGGCATCTACCCGGGAAACCGGGGTC CCTGACCGATTCAGTGGCAGCGGGTCTGGGAC AGATTTCACTCTCACCATCAGCAGCCTTCAGG CTGAAGATGTGTCAGTTTATTCCTGTCAGCAA TATTCTTCTATTCCGTGACGTTCGGCCAAGG GACCAAGGTGGAAATCAAT | CAGGTTCAGTGCTGGTGCAGTCTGGAGCTGAGGTGA AGAAGCCTGGGGCCTCAGTGAAGGTCTCCTGCA AGGCTTCTGGTTTCACCTTTACCAGCTATGGTATC AACTGGGTGCGACAGGCCCCTGGACAAGGGCTT GAGTGGATGGGATGGATCAGCGTTTACAATGGTA ACACAAACTATGCACAGAAGCTCCAGGGCAGAG TCACCATGACCACAGACACATCCACGAGCACAG CCTACATGGAGCTGAGGAGCCTGAGATCTGACG ACACGGCCGTGTATTACTGTGCGAGAGACTACTA CTACGGTTTTGACGTCTGGGGCCAAGGGACCACG GTCACCGTCTCCTCA |
| | | | SEQ ID NO: 27163 | SEQ ID NO: 31169 |
| | | AA | DIVMTQSPDSLAVSLGERATINCKSSQSVLKSSN HRNYLAWYQQKPGQPPQLLIYWASTRETGVPD RFSGSGSGTDFTLTISSLQAEDVSVYSCQQYSSIP WTFGQGTKVEIN | QVQLVQSGAEVKKPGASVKVSCKASGFTFTSYGIN WVRQAPGQGLEWMGWISVYNGNTNYAQKLQGR VTMTDTSTSTAYMELRSLRSDDTAVYYCARDYY YGFDVWGQGTTVTVSS |
| | | | SEQ ID NO: 27164 | SEQ ID NO: 31170 |

FIGURE 50
(Continued)

| | | | |
|---|---|---|---|
| iPS:436502 | 21-225_222A11 | NA | GACATCCAGATGACCCAGTCTCCATCCTCACT GTCTGCATCTGTAGGAGACAGAGTCACCATCA CTTGTCGGGCGAGTCAGGCATTAGCAATTAT TTGGCCTGGTTTCAGCAGAAACCAGGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGTAGCCTGCAGCCTGAAGATTTTGCAACTTA TTACTGCCTATATTATCTTAATTATCCGCTCAC TTTCGGCGGAGGGACCAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAATGGGTGGCAGTTATATGGTATGATGAAGT AATAAAAACTATGCAGAGACTCCGTGAAGGCCGA TTCACCATCTCCAGAGACAATTCCAAGAACACGC TGTATCTGCAAATGAACAGCCTGAGAGCCGAGG ACACGGCTGTATATTACTGTGCGAGAGATCGGA TGTCGGGTACAACGGTATGGACGTCTGGGGCCA AGGGACCACGGTCACCGTCTCCTCA |
| | | | SEQ ID NO: 27165 | SEQ ID NO: 31171 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLYLNYPLTFGGGT KVEIK | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRDV GYNGMDVWGQGTTVTVSS |
| | | | SEQ ID NO: 27166 | SEQ ID NO: 31172 |
| iPS:436504 | 21-225_222H4 | NA | GACATCCAGATGACCCATTCTCCATCCTCCCT GTCTGCATCTGTAGGAGACAGAGTCACCATCA CTTGCCGGGCAAGTCAGAACATTAGTAATTAT GTTAATTGGTATCCGCTGATCTATACTGCATCGAGTT CCCCTAAGTCTGTGGGTCGTCACGGTTCAGTGGC TGCAAAGTGGGGTCTGGACAGATTTCACTCTCAC AGTGGATCTGGGACAGATTTCACTCTCACCAT CAGCAGTCTGCACCGTGACGATTTGCAATTT ACTATTGTCAGCAGTATTACTTACCCCATTCA CTTTCGGCCGTGGGACCAAAGTGGATATCAAA | GAGGTGCAGCTATTGGAGTCTGGGGGAGGCTTG GTACAGCCTGGGGGGTCCCTGAGACTCTCCTGTG CAGCCTCTGGTTCACCTTAGCAACTTTGCCAT GAGTTGGGTCCGCCAGGCTCCAGGGAAGGGACT GGAGTGGGTCTCAAGTATTGTTGGTAGTGGTGGT CGCACGTACTACGCAGACTCCGTGAAGGGCCGG TTCACCATCTCCAGAGACAATTCCAAGAACAGC TGTATCTGCAAATGAACAGCCTGAGAGCCGAGG ACACGGCCGTATATATTGTGCAAAAGACCCTTA TCGTGTAGCAGTGGCTGGGCCTTTGACTACTGG GGCCAGGGAACCCTGGTCACCGTCTCCTCA |
| | | | SEQ ID NO: 27167 | SEQ ID NO: 31173 |

FIGURE 50
(Continued)

| | | | |
|---|---|---|---|
| iPS:436506 | 21-225_222C7 | AA | DIQMTHSPSSLSASVGDRVTITCRASQNISNYVN WYQQKPGKAPKFLIYTASSLQSGVSSRFSGSGSG TDFTLTISSVHRDDFAIYYCQQYFTPFTFGRGT KVDIK<br>SEQ ID NO: 27168 | EVQLLESGGGLVQPGGSLRLSCAASGFTFSNFAMS WVRQAPGKGLEWVSSIVGSGGRTYYADSVKGRFTI SRDNSKNTLYLQMNSLRAEDTAVYYCAKDPYRVA VAGAFDYWGQGTLITVSS<br>SEQ ID NO: 31174 |
| | | NA | GAAATTGTGTTGACGCAGTCTCCAGGCACCCT GTCTTTGTCTCCAGGGGAAAGAGCCACCCTCT CCTGCAGGGCCAGTCAGAGTGTTTACAGCAAC TACTTAGCCTGGTACCAGCAGAAACCTGGCCA GGCTCCCAGGCTCCTCATCTATGGTGCATCAA GCAGGGGCCACTGGCATCCCAGACAGGTTCGGT GGCAGTGGGTCTGGGACAGACTTCACTCTGC CATAAGCAGACTGGAGCCTGAAGACTTTACAA TATATTACTGTCAGCAGTATGAAGACTCACCG TGGACGTTCGGCCAAGGGACCAAGGTGGAAA TCAAA<br>SEQ ID NO: 27169 | CAGGTGCAGCTACAGCAGTGGGGCGCAGGACTG TTGAAGCCTTCGGAGACCGTCCCTCACCTGCG CTGTCTATGTGGGTCCTTCAGTGTCGTACTG GAGCTGGATCCGCCAGCCCCCAGGGAAGGGCT GGAGTGGATTGGGGAAATCAATCATAGTGGAAG CGCCAACTACAACCCGTCCCTCAAGAGTCGAGTC ACCATATCAGTAGACACGTCAAGAACCAGTTCT CCCTGAAGCTGAGTTCTGTGACCGCCGCGGACAC GGCTGTATATTACTGTGCGAGAGACTACGGCGCC CTTGATTTCTGGGGCCAAGGGACAATGGTCACCG TCTCTCTCA<br>SEQ ID NO: 31175 |
| | | AA | EIVLTQSPGTLSLSPGERATLSCRASQSVYSNYLA WYQQKPGQAPRLLIYGASSRATGIPDRFGGSGS GTDFTLAISRLEPEDFTIYYCQQYEDSPWTFGQG TKVEIK<br>SEQ ID NO: 27170 | QVQLQQWGAGLLKPSETLSLTCAVYGGSFSGRYW SWIRQPPGKGLEWIGEINHSGSANYNPSLKSRVTIS VDTSKNQFSLKLSSVTAADTAVYYCARDYGALDF WGQGTMVTVSS<br>SEQ ID NO: 31176 |

FIGURE 50
(Continued)

| | | | |
|---|---|---|---|
| iPS:436508 | 21-225_222F7 | NA | GACATCCAGATGACCCAGTCTCCATCTTCCGT GTCTGCATCTGTAGGAGACAGAGTCACCATCA CTTGTCGGGCGAGTCAGGTATTAGCAGCTGG TTAGCCTGGTATCAGCAGAAACCAGGGAAAG CCCCTAAGCTCCTGATCTATACTGCATCCAATT TGCAAAGTGGGGTCCCATCAAGGTTCAGCGGC AGTGGATCTGGGACAGATTTCACTCTCACCAT CAGCAGCGTGCAGCCTGAAGATTTTGCAACTT ACTATTGTCAACAGGCTAACAGTTTCCCATTC ACTTTCGGCCCTGGGACCAAAGTGGATATCAA A<br>SEQ ID NO: 27171 | CAGGTGCAGCTGGTGCAGTCTGGGGCTGAGGTG AAGAAGCCTGGGGCCTCAGTGAAGGTCTCCTGC AAGACTTCTGGATACACCTTCACCGGCTACTATA TGCACTGGGTGCGACAGGCCCCTGGACAAGGGC TTGAGTGGATGGGATGGATCCACAGAAATTTCAGGGCAG TGGCACAAACTATGCACAGAAATTTCAGGGCAG GGTCACCCTGACCAGGGACACGTCCATCAGCAC AGCCTACATGGACCTGAGCAGGCTGAGATCTGA CGACACGGCCGTGTATTACTGTGCGAGAGATGG GACCAGTCGTTTGACTACTGGGGCCAGGGAACC CTGGTCACCGTCTCCTCA<br>SEQ ID NO: 31177 |
| | | AA | DIQMTQSPSSVSASVGDRVTITCRASQGISSWLA WYQQKPGKAPKLLIYTASNLQSGVPSRFSGSGS GTDFTLTISSVQPEDFATYYCQQANSFPFTFGPGT KVDIK<br>SEQ ID NO: 27172 | QVQLVQSGAEVKKPGASVKVSCKTSGYTFTGYYM HWVRQAPGQGLEWMGWIHPNSGGTNYAQKFQGR VTLTRDTSISTAYMDLSRLRSDDTAVYYCARDGTS SFDYWGQGTLVTVSS<br>SEQ ID NO: 31178 |
| iPS:436510 | 21-225_222H8 | NA | GACATCCAGATGACCCAGTCTCCATCTTCCCTG TCTGCATCTGTAGGAGACAGAGTCACCATCAC TTGCCGGGCAAGTCAGAGCATTAGTAATTATG TAATTGGTATCAGCAGAAACCAGGGAAAGCC CCTAAGTTCCTGATCTATATTGCATCGAGTTTG CAAAGTGGGGTCTCGTCACGTTCAGTGGCAG TGGATCTGGGACAGATTTCACTCTCACCATCA GCAGTGTGCACCGTGACGATTTTGCAATTTAC TACTGTCAGCAGTATTACTTTACCCCATTCACT TTCGGCCGTGGGACCAAAGTGGATATCAAA<br>SEQ ID NO: 27173 | GAGGTGCAGCTATTGGAGTCTGGGGGAGGCTTG GTACAGCCTGGGGGGTCCCTGAGACTCTCCTGTG CAGCCTCTGGCTTCACCTTTAGCAACTTTGCCAT GAGTTGGGTCCGCCAGGCTCCAGGGAAGGGACT GGAGTGGGTCTCAAGTATTGTTGGTAGTGGTGGT CGCACGTACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATTATTGTGCGAAAGACCCTTA TCGTGTAGCAGTGGCTGGGCCTTTGACTACTGG GGCCAGGGAACCCTGATCACCGTCTCCTCA<br>SEQ ID NO: 31179 |

FIGURE 50
(Continued)

| | | | |
|---|---|---|---|
| | | AA | DIQMTHSPSSLSASVGDRVTITCRASQNISNYVN WYQQKPGKAPKFLIYIASSLQSGVSSRFSGSGSG TDFTLTISSVHRDDFAIYYCQQYFTPFTFGRGT KVDIK<br><br>SEQ ID NO: 27174 | EVQLLESGGGLVQPGGSLRLSCAASGFTFSNFAMS WVRQAPGKGLEWVSSIVGSGGRTYYADSVKGRFTI SRDNSKNTLYLQMNSLRAEDTAVYYCAKDPYRVA VAGAFDYWGQGTLTVSS<br><br>SEQ ID NO: 31180 |
| iPS:436514 | 21-225_222D10 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTGGCCTGGTTTCAGCAGAAACCAGGGAAAGC CCCTAAGTCCCTGATCTACGCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCTACACATTATCTCTAATTACCCGCTCAC TTTCGGGGGAGGGACCAAGGGTGGAGATCAAA<br><br>SEQ ID NO: 27175 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGCAGACTCCGTGAAGGGCCGA AATAAAACTATGCAGACTCCGTGAAGGGCCGA TTCACCATCTCCAGAGACAACGCAAGAACACGC TGTATCTGCAAATGAACAGCCTGAGAGCCGAGG ACACGGCTGTGTATTACTGTGCGAGAGATCGGGA TGTCGGGTACAACGGTATGGACGTCTGGGCCA AGGGACCACCGGTCACCGTCTCCCTCA<br><br>SEQ ID NO: 31181 |
| | | AA | DIQMTQSPSSLSASVGDRVTITCRASQGISNYLA WFQQKPGKAPKSLIYAASSLQSGVPSKFSGSGSG TDFTLTISSLQPEDFATYYCLHYLNYPLTFGGGT RVEIK<br><br>SEQ ID NO: 27176 | QVQLVESGGGVVQPGRSLRLSCAASGFTFSSYGMH WVRQAPGKGLEWVAVIWYDGSNKNYADSVKGRF TISRDNSKNTLYLQMNSLRAEDTAVYYCARDRDV GYNGMDVWGQGTTVTVSS<br><br>SEQ ID NO: 31182 |

FIGURE 50
(Continued)

| | | | |
|---|---|---|---|
| iPS:436516 | 21-225_222C12 | NA | GACATCCAGATGACTCAGTGTCCATCTCCGTGTCTGCATCTGTAGGAGACAGAGTCACCATCACTTGTCGGGTGAGTCAGGTATTAGCAGCTGGTTAGCCTGGTATCAGCAGAAACCAGGGAAAGCCCCTTAAGCTCCTGATCTATACTGCATCCAATTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGGATAACAGTTTCCCATTCACTTTCGGCGGAGGGACCAAAGTGGATATCAAA<br>SEQ ID NO: 27177 | CAGGTGCAGCTGGTGCAGTCTGGGGCTGAGGTGAAGAAGCCTGGGGCCTCAGTGAAGGTCTCCTGCAAGACTTCTGGATACACCTTCACCGGCTACTATATGCACTGGGTGCGACAGGCCCCTGGACAAGGCTTGAGTGGATGGGATGGATCCACCTAACAGTGGTGGCACAAACTATGCACAGAAATTTCAGGGCAGGGTCACCCTGACCAGGGACACGTCCATCAGCACAGCCTACATGGACCTGAGCAGGCTGAGATCTGACGACACGGCCGTGTATTACTGTGCGAGAGATGGGACCAGTCGTTTGACTACTGGGGCCAGGGAACCCTGGTCACCGTCTCCTCA<br>SEQ ID NO: 31183 |
| | | AA | DIQMTQCPSSVSASVGDRVTITCRVSQGISSWLAWYQQKPGKALKLVIYTASNLQSGVPSRFSGSGSGTDFTLTISSVQREDFATYYCQQDNSFPFTFGRGTKVDIK<br>SEQ ID NO: 27178 | QVQLVQSGAEVKKPGASVKVSCKTSGYTFTGYYMHWVRQAPGQGLEWMGWIHPNSGGTNYAQKFQGRVTLTRDTSISTAYMDLSRLRSDDTAVYYCARDGTSSFDYWGQGTLVTVSS<br>SEQ ID NO: 31184 |
| iPS:436520 | 21-225_223G10 | NA | GACATCGTGATGACCCAGTCTCCAGACTCCCTGGCTGTGTCTCTGGGCGAGAGGGCCACCATCAACTGCAAGTCCAGCCAGAGTATTTACTCAGCTCCAACATAAGAACTCAGCCTCTAAGCTGCACAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCTGCAATATTTTAGTACTCCGGACGTTCGGCCAAGGGACCAAGGTGGAAATCAAA<br>SEQ ID NO: 27179 | CAGGTTCAGCTGGTGCAGTCTGGAGCTGAGGTGAAGAAGCCTGGGGCCTCAGTGAAGGTCTCCTGCAAGGCTTCTGGTTCACCTTTACCAGCTACTATGGTATCAACTGGGTGCGACAGGCCCCTGGACAAGGACTTGAGTGGATGGGATGGATCAGAGATCAGGTTTACAGTGGTAACACAAACTATGCACAGAAGTTCCAGGGCAGAGTCACCATGACCACAGATACATCCACGAGCACAGCCTACATGGAGCTGAGGAGCCTGAGATCTGACGACACGGCCGTGTATGACGTCTGGGGCCAAGGGACCACGGTCACCGTCTCCTCA<br>SEQ ID NO: 31185 |

FIGURE 50
(Continued)

| | | | |
|---|---|---|---|
| iPS:436522 | 21-225_223H10 | AA | DIVMTQSPDSLAVSLGERATINCKSSQSILLSSNN KNYLAWHQQKPGQPPKLLIYWASTRESGVPDRF SGSGSGTDFTLTISSLQAEDVAVYYCLQYFSTPW TFGQGTKVEIK<br>SEQ ID NO: 27180 | QVQLVQSGAEVKKPGASVKVSCKASGFTFTSYGIN WVRQAPGQGLEWMGWISVYSGNTNYAQKLQGRV TMTDTSTSTAYMELRSLRSDDTAVYYCARDYYY GMDVWGQGTTVTVSS<br>SEQ ID NO: 31186 |
| | | NA | GACATCCAGATGACCCAGTCTCCATCCTCACT GTCTGCATCTGTAGGAGACAGAGTCACCATCA CTTGTCGGGCGAGTCAGGCATTAGTAATTAT TTGGCCTGGTTTCAGCAGAAACCAGGGAAAGC CCCTAAGTCCCTGATCTACGCTGCATCCAATTT GCAAAGTGGGGTCCCATCAAGTTCAGCGGCA GTGGGTCTGGGACAGATTTCACTCTCACCATC AGCAGCCTGCAGCCTGAAGATTTTGCAACTTA TTACTGCCTACATTATTCTACCCCACTCAC TTTCGGGGAGGGACCAAGGTGGAGATCAAA<br>SEQ ID NO: 27181 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGTATGCAT GCACTGGGTCCGCCAGGCTCCAGGCAAGGGGCT GGAGTGGGTGGCAGTTATATCAGACTCCGTGAAGGT AATAAAAACTATGCAGACTCCGTGAAGGGCCGA TTCACCATCTCCAGAGACAACGCCAAGAACACGC TGTATCTGCAAATGAACAGCCTGAGAGCCGAGG ACACGGCTGTGTATTACTGTGCGAGAGATCGGGA TGTCGGGTACAACGGTATGGACGTCTGGGGCCA AGGGACCACGGTCACCGTCTCCTCA<br>SEQ ID NO: 31187 |
| | | AA | DIQMTQSPSSLSASVGDRVTITCRASQGISNYLA WFQQKPGKAPKSLIYAASNLQSGVPSKFSGSGS GTDFTLTISSLQPEDFATYYCLHYLNYPLTFGGG TKVEIK<br>SEQ ID NO: 27182 | QVQLVESGGGVVQPGRSLRLSCAASGFTFSSYGMH WVRQAPGKGLEWVAVIWYDGSNKNYADSVKGRF TISRDHSKNTLYLQMNSLRAEDTAVYYCARDRDV GYNGMDVWGQGTTVTVSS<br>SEQ ID NO: 31188 |

FIGURE 50
(Continued)

| | | | |
|---|---|---|---|
| iPS:436526 | 21-225_224A1 | NA | GACATCCAGATGACCCAGTCTCCATCCTCCT GTCTGCATCTGTAGGAGACAGAGTCACCATCA CTTGCCGGGCAAGTCAGGGACATTAGTGAAAATGAT TTAGGCTGGTATCAGCAGAAGCCAGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCGCTC ACTTTCGGCGGTGGGACCAAGGTGGAGATCAA A<br>SEQ ID NO: 27183 | GAGGTGCAGGTGTTGGAGTCTGGGGGAGGCTTG GTACAGCCTGGGGGGTCCCTGAGACTCTCCTGTG CAGCCCTCTGATTCACCTTTAGCAGCTATGCCAT GAGCTGGGTCCGCCAGGCTCCAGGGAAGGGGCT GGAGTGGGTCTCAGCTATTAGTGGCAGAGGCGG CAGCACATACTACGCAGACGCGTGAAGGCCG GTTCACCATCTCCAGAGACAATTCCAAGAACACG CTGTATCTGCAAATGAACAGCCTGAGAGCCGAG GACACGGCCGTATATTACTGCGCAAAGGCTCCT ACGATAGTAGTGGTTATTACCACTACTTAGACCA CTGGGCCAGGGAACCCTGGTCACCGTCTCCTCA<br>SEQ ID NO: 31189 |
| | | AA | DIQMTQSPSSLSASVGDRVTITCRASQGIENDLG WYQQKPGKAPKRLIYAASSLQSGVPSRFSGSGS GTEFTLTISSLQPEDFATYYCLQHNSYPLTFGGG TKVEIK<br>SEQ ID NO: 27184 | EVQVLESGGGLVQPGGSLRLSCAASGFTFSSYAMS WVRQAPGKGLEWVSAISRGGSTYYADAVKGRFT ISRDNSKNTLYLQMNSLRAEDTAVYYCAKGSYDSS GYYHYLDHWGQGTLVTVSS<br>SEQ ID NO: 31190 |
| iPS:436528 | 21-225_224B1 | NA | GACATCCAGATGACCCAGTCTCCATCCTCCCT GTCTGCATCTGTGGGAGACAGAGTCACCATCA CTTGCCGGGCAAGTCAGGGCATTAGTAATGAT TTAGGCTGGTATCAGCAGAAGCCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TATCACTGTCTACAGCATAATAGTTATCTCCT ACTTTCGGCGGAGGGACCAAGGTGGAGATCA AA<br>SEQ ID NO: 27185 | GAGGTGCAGGTGTTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGGCT GGAGTGGGTCTCAGCTATTAGTGGTAGTGGTGGT AACACATACTACGCAGACTCCGTGAAGGGCCGG TTCACCATCTCCAGAGACAATTCCAAGAACACGC TGTATCTGCACATGAACAGCCTGAGAGCCGAGG ACACGGCCGTATATTACTGTGCGGGAGAGGGGG GCTACTACTATTACTACGGTGTGACGTCTGGGG CCAAGGGACCACGGTCACCGTCTCCTCA<br>SEQ ID NO: 31191 |

FIGURE 50
(Continued)

| | | | | |
|---|---|---|---|---|
| iPS:436534 | 21-225_224F1 | AA | DIQMTQSPSSLSASVGDRVTITCRASQGISNDLG WYQQKPGKAPKRLIYAASSLQSGVPSRFSGSGS GTEFTLTISSLQPEDFATYHCLQHNSYPPTFGGGT KVEIK | EVQVLESGGGLVQPGGSLRLSCAASGFTFSSYAMS WVRQAPGKGLEWVSAISGSGGNTYYADSVKGRFT ISRDNSKNTLYLHMNSLRAEDTAVYYCAGEGGYY YYYGVDVWGQGTTVTSS |
| | | | SEQ ID NO: 27186 | SEQ ID NO: 31192 |
| | | NA | GCCATCCAGATGACCCAGTCTCCATCCTCCCT GTCTGCATCTGTAGGAGACAGAGTCACCATCA CTTGCCGGGCAAGTCAGGGCATTAGAGATGAT TTAGGCTGGTATCAGCAGAAACCAGGGAAAG CCCCTAAGCGCCTGATCTATGCTGCATCCAGT TTGCAAAGTGGGGTCCCGTCAAGGATTCAGCGG CAGTGGATCTGGGACAGAATTCACTCTCACAA TCAGCAGCCTGCAGCCTGAAGATTTTGCAATT TATTACTGTCTACAGCATTATAGTTACCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATATCAT GCACTGGGTCCGCCAGGCTCCAGGCAAGGGGCT GGAGTGGGTGGCAGTTATATCGAGACTCCGTAA AATAAATACTATGCAGACACCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGAGTA TAGCAGCAACTGTGACTACGGTATGGACGTC TGGGGCCAAGGGACCACGGTCACCGTCTCCTCA |
| | | | SEQ ID NO: 27187 | SEQ ID NO: 31193 |
| | | AA | AIQMTQSPSSLSASVGDRVTITCRASQGIRDDLG WYQQKPGKAPKRLIYAASSLQSGVPSRISGSGSG TEFTLTISSLQPEDFAIYYCLQHYSYPRTFGQGTK VEIK | QVQLVESGGGVVQPGRSLRLSCAASGFTFSSYIMH WVRQAPGKGLEWVAVIWYDGSNKYYADSVKGRF TISRDNSKNTLYLQMNSLRAEDTAVYYCARERYSS NWYDYGMDVWGQGTTVTSS |
| | | | SEQ ID NO: 27188 | SEQ ID NO: 31194 |

FIGURE 50
(Continued)

| | | NA | GATATTGTGATGACCCAGACTCCACTCTCTCT GTCCGTCACCCCTGGACAGCCGGCCTCCATCT CCTGCAAGTCTGGTCAGAGCCTCCTGCATAGT GATGGAAAAGACCTTTTGTCTTGGTACCTGCA GAAGCCAGGCCAGCCTCCACAGCTCCTGATCT ATGAAAATTTCCAACCGGTTCTCTGGAGTGCCA GATAGGTTCAGTGGCAGCGGTCAGGACAG ATTTCACACTGAAAATCAGCGGGTGGAGGCT GAGGATGTTGGGATTTTTACTGCATGCAAAG TACACAGCTTCCTCGGACGTTCGGCCAAGGGA CCAAGGTGGAAATCAAA<br><br>SEQ ID NO: 27189 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGGAGACACGTTCAGGGCAG AGTCACCATGACCAGGGACACGTCCATCAGCAC AGCCTACATGGAACTGAGCAGGCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTTC A<br><br>SEQ ID NO: 31195 |
| iPS:436536 | 21-225_224G1 | AA | DIVMTQTPLSLSVTPGQPASISCKSGQSLLHSDG KTFLSWYLQKPGQPPQLLIYEISNRFSGVPDRFSG SGSGTDFTLKISRVEAEDVGIFYCMQSTQLPRTF GQGTKVEIK<br><br>SEQ ID NO: 27190 | QVQLVQSGAEVKKPGASVKVSCKASGYTFTGYYIH WVRQAPGQGLEWMGWINPYSGDTNYAQKFQGRV TMTRDTSISTAYMELSRLRFDDTAVFYCARDWGG YSSYYYGMDVWGQGTTVTVSS<br><br>SEQ ID NO: 31196 |
| iPS:436538 | 21-225_224C3 | NA | GACATCCAGATGACCCAGTCTCCATCTCCCT GTCTCTGCATCTGTAGGAGACAGAGTCACCATCA CTTGCCGGGCAAGTCAGGACATTAGAAATGAT CTTAGGCTGGTATCAGCAGAAACCAGGGAAAG CCCCTAAGCGCCTGATCTATGCTACACCAGT TTGCAAAGTGGGGTCCCATCAAGGTTCAGCGG CAGTGGATCTGGGACAGAGATTCACTCTCACAA TCAGCAGCCTGCAGCCTGAAGATTTTGCAACT TATTACTGTCTACAGCATAATAGTTACCCGCTC ACTTTCGGCGGAGGGACCAAGGTGGAGATCA AA<br><br>SEQ ID NO: 27191 | CAGCTGCAGCTGCAGGAGTCGGGCCCAGGACTG GTGAAGTCTTCGGCGGTCCCTGTCCCTCACCTGCA CTGTCTCTGGCGGCTCCATCAGCAGAAGTAGTTA CTACTGGGGCTGGATCCGCCAGCCCCAGGGAA GGGAGCACTACTACAACCCGTCCCTCAAGAGTC GAGTCACCATATCCGTAGACACGTCCAAGAACC AGTTCTCCCTGAAGCTGACTGTGTGACCGCGC AGACACGCTGTGTATTACTGTGCGAGACAGGGT CGGGACTGGGGCTGTTGACTACGGGGGCCAGGGA ACCCTAGTCACCGTCTCCTCA<br><br>SEQ ID NO: 31197 |

FIGURE 50
(Continued)

| | | AA | DIQMTQSPSSLSASVGDRVTITCRASQDIRNDLGWYQQKPGKAPKRLIYATSSLQSGVPSRFSGSGSGTEFTLTISSLQPEDFATYYCLQHNSYPLTFGGGTKVEIK | QLQLQESGPGLVKSSETLSLTCTVSGGSISRSSYYWGWIRQPPGKGLEWIGNIYSGSTYYNPSLKSRVTISVDTSKNQFSLKLSSVTAADTAVYYCARQGRDWGVDYGGQGTLVTVSS |
| | | | SEQ ID NO: 27192 | SEQ ID NO: 31198 |
| iPS:436540 | 21-225_224F3 | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAACAGAAACCAGGGAAAGCCCCTGAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTTCAGCATTATAATTACCCTCGGGCGTTCGGCCAAGGGACCAAGGTGGAAATCAAA | CAGGTGCAGCTGGTGGAGTCTGGGGGAGGCGTGGTCCAGCCTGGGAGGTCCCTGAGACTCTCCTGTCAGCGTCTGATTCAGTTCAGTAGCTATGGCATGCACTGGGTCCGCCAGGCTCCAGGCAAGGGGCTGGAGTGGGTGGCAGTTATATGCAGATCCGTGAAGGGCCGAAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAGGTATAGCAGCAGCTGGTACGACTACGGTATGGACGTCTGGGGCCAAGGGACCACGGTCACCGTCTCCTCA |
| | | | SEQ ID NO: 27193 | SEQ ID NO: 31199 |
| | | AA | DIQMTQSPSSLSASVGDRVTITCRASQGIRNDLGWYQQKPGKAPERLIYAASSLQSGVPSRFSGSGSGTEFTLTISSLQPEDFATYYCLQHYNYPRAFGQGTKVEIK | QVQLVESGGGVVQPGRSLRLSCAASGFSFSSYGMHWVRQAPGKGLEWVAVIWYDGSNKYYADSVKGRFTISRDNSKNTLYLQMNSLRAEDTAVYYCARERYSSWYDYGMDVWGQGTTVTSS |
| | | | SEQ ID NO: 27194 | SEQ ID NO: 31200 |

FIGURE 50
(Continued)

| | | | | |
|---|---|---|---|---|
| iPS:436544 | 21-225_224H5 | NA | GACATCGTGATGACCCAGTCTCCAGACTCCCTGGCTGTGTCTCTGGGCGAGAGGGCCACCATCAACTGCAAGTCCAGCCAGAGTGTTTTATACAGCTCCAACAATTTCAACTACTTAACTTGGTATCAGCAGAAACCAGGACAGCCTCCTAAGTTGCTCATTTACTGGGCATCTACCCGGGAATCCGGGGTCCCTGACCGATTCAGTGGCAGCGGGTCTGGGACAGATTTCACTCTCACCATCAACAGCCTGCAGGCTGAAGATGTGGCAGTTTATTACTGTCAGCAATATTATAGTACTCCTCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGAGTTCCAGTGGCTGGAACTGGTTCGACCCCTGGGGCCAGGGAACCCTGGTCACCGTCTCCTCA |
| | | | SEQ ID NO: 27195 | SEQ ID NO: 31201 |
| | | AA | DIVMTQSPDSLAVSLGERATINCKSSQSVLYSSNNFNYLTWYQQKPGQPPKLLIYWASTRESGVPDRFSGSGSGTDFTLTINSLQAEDVAVYYCQQYYSTPPTFGQGTKVEIK | QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWNWFDPWGQGTLVTVSS |
| | | | SEQ ID NO: 27196 | SEQ ID NO: 31202 |
| iPS:436546 | 21-225_224D6 | NA | GACATCCAGATGACCCAGTCTCCATCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGGCTAACAGTTTCCCGTGGACGTTCGGCCAAGGGACCAAGGTGGAAATCA | GAGGTGCAGGTGTTGGAGTCTGGGGGAGGCTTGGTACAGCCTGGGGGGTCCCTGAGACTCTCCTGTGCAGCCTCTGGATTCACCTTTAGCAGCGATGCCATGAGCTGGGTCCGCCAGGCTCCAGGGAAGGGGCTGGAGTGGGTCTCAGCTATTAGTGGTAGTGGTAATACATTCTACGCAGACTCCGTGAAGGGCCGGTTCACCATCTCCAGAGACAATTCCAAGAACACGCTGTATCTGCAAATGAACAGCCTGAGAGCCGAGGACACGGCCGTATATTACTGTGCGAAAGTCTATAGTGCTACGATTCTCACTGGTTCGACCCCTGGGGCCAGGGAACCCTGGTCACCGTCTCCTCA |
| | | | SEQ ID NO: 27197 | SEQ ID NO: 31203 |

FIGURE 50
(Continued)

| | | | | |
|---|---|---|---|---|
| iPS:436548 | 21-225_224A7 | AA | DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGPGTKVEIK | EVQVLESGGGLVQPGGSLRLSCAASGSTFSSDAMSWVRQAPGKGLEWVSAISGSGDNTFYADSVKGRFTISRDNSKNTLYLQMNSLRAEDTAVYYCAKVYSAYDSHWFDPWGQGTLVTVSS |
| | | | SEQ ID NO: 27198 | SEQ ID NO: 31204 |
| | | NA | GATATTGTGATGACCCAGACTCCACTCTCTCTGTCCGTCAAGTCTCTGACAGCGGCCTCCATCTCCTGCAAGTCTAGTCAGAGCCTCCTGCATAGTGATGGAAAGACCTTTTTGTATTGGTTCCTGCAGAAGCCAGGCCAGCCTCCACAGCTCCTGATCTATGAAATTTCCAACCGGTTCTCTGGAGTGCCAGATAGGTTCAGTGGCAGCGGGTCAGGGACAGATTTCACACTGTTGGGATTTATTACTGCATGCAAAGTACACAGCTTCCTGGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCCTGCAAGGCTTCTGATACACCTTCACCGGCTACTATATACACTGGGTGCGACAGGCCCCTGGACAAGGGCTTGAGTGGATGGGATGGATCAACCTTACAGTGGTGACACAAACTATGCACAGAAGTTTCAGGGCAGGGTCACCATGACCAGGGACACGTCCATCACCAGCCTACATGGAACTGAGCAGGCTGAGATTTGACGACGCCGTGTTTACTGTGCGAGAGATTGGGGTGGCTACAGTTCTTACTACTACGGTATGGACGTCTGGGGCCAAGGGACCACGGTCACCGTCTCTCA |
| | | | SEQ ID NO: 27199 | SEQ ID NO: 31205 |
| | | AA | DIVMTQTPLSLSVTPGQPASISCKSSQSLLHSDGKTFLYWFLQKPGQPPQLLIYEISNRFSGVPDRFSGSGSGTDFTLKISRVEAEDVGIYYCMQSTQLPRTFGQGTKVEIK | QVQLVQSGAEVKKPGASVKVSCKASGYTFTGYYIHWVRQAPGQGLEWMGWINPYSGDTNYAQKFQGRVTMTRDTSITTAYMELSRLRFDDTAVFYCARDWGGYSSYYYGMDVWGQGTTVTVSS |
| | | | SEQ ID NO: 27200 | SEQ ID NO: 31206 |

FIGURE 50
(Continued)

| | | | |
|---|---|---|---|
| iPS:436550 | 21-225_224D8 | NA | GACATCGTGATGACCCAGTCTCCAGACTCCCTGGCTGTGTCTCTGGGCGAGAGGGCCATCAACTGCAAGTCCAGCCAGAGTGTTTTATACAGCTCCAACAATAAGAACTACTTAGCTTGGTACCAGCAGAAACCAGGACAGCCTCCTAAGCTGCTCATTTATTGGTCGTCTACCCGGAAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTTTAGTACTCCTCCGACGTTCGGCCAAGGGACCAAGGTGGAAATCAAA<br><br>SEQ ID NO: 27201 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGCTTGAGTGGATGGTTGTACCTAACAGTGGTAACACAGGCTATGCACAGAAGTTCCAGGCAGAGTCACCATGACCAGGAACACCTCCATAAGCACAGCCTACATGGAGCTGAGCAGCCTGAGATCTGAGGACACGGCCGTGTATTACTGTGCTTATAGCAGTGGCTGGTACTACTTTGACTACTGGGGCCAGGGAACCCTGGTCATCGTCTCCTCA<br><br>SEQ ID NO: 31207 |
| | | AA | DIVMTQSPDSLAVSLGERAAINCKSSQSVLYSSNNKNYLAWYQQKPGQPPKLLIYWSSTRKSGVPDRFSGSGSGTDFTLTISSLQAEDVAVYYCQQYFSTPPTFGQGTKVEIK<br><br>SEQ ID NO: 27202 | QVQLVQSGAEVKKPGASVKVSCKASGYTFTNYDINWVRQATGQGLEWMGWLYPNSGNTGYAQKFQGRVTMTRNTSISTAYMELSSLRSEDTAVYYCAYSSGWYYFDYWGQGTLVIVSS<br><br>SEQ ID NO: 31208 |
| iPS:436554 | 21-225_224C10 | NA | GACATCGTGATGACCCAGTCTCCAGACTCCCTGGCTGCGTCTCTGGGCGAGAGGGCCACCATCAACTGCAAGTCCAGCCAGAGTGTTTTATACAATTCCAACAATAAGAACTACTTAGCTTGGTACCAGCAGAAACCAGGACAGCCTCCTAAGCTGCTCATTTACTGGTCATCTACCCGGGAGTCCGGGGTCCCTGACCGATTCAGTGGCAGCGGGTCTGGGACAGATTTCACTCTCACCATCAGCAGCCTGCAGGCTGAAGATGTGGCAATTTATTACTGTCAACAATATTATATTAATCCGTGCAGTTTTGGCCAGGGACCAAGGCTGGAGATCAAA<br><br>SEQ ID NO: 27203 | CAGGTGCAGCTGGTGCAGTCTGGGGCTGAGGTGAAGAAGCCTGGGGCCTCAGTGAAGGTCTCCTGCAAGGCTTCTGGATCCACCTTCACCAATTATGATATCAACTGGGTGCGACAGGCCACTGGACAAGGCTTGAGTGGATGGGATGCACAGAAGTCACACGTAACAGTGGTAACACAGGCTATGCACAGAAGTTCCAGGCAGAGTCACCATGACCAGGAACACCTCCATAAGCACAGCCTACATGGAGCTGAGCAGCCTGAGATCTGAGGACACGGCCGTGTATTACTGTCCTATAGCAGTGGCTGGTACAAGTTTGACTACTGGGGCCAGGGAACCCTGGTCACCGTCTCCTCA<br><br>SEQ ID NO: 31209 |

FIGURE 50
(Continued)

| | | | |
|---|---|---|---|
| iPS:436556 | 21-225_224D10 | AA | DIVMTQSPDSLAASLGERATITCKSSQSVLYNSN NKNYLAWYQQKPGQPPKLLIYWASTRESGVPD RFSGSGSGTDFTLTISSLQAEDVAIYYCQQYYINP CSFGQGTRLEIK<br>SEQ ID NO: 27204 | QVQLVQSGAEVKKPGASVKVSCKASGSTFTNYDIN WVRQATGQGLEWMGWMHPNSGNTGYAQKFQGR VTMTRNTSISTAYMELSSLRSEDTAVYYCAYSSGW YKFDYWGQGTLVTVSS<br>SEQ ID NO: 31210 |
| | | NA | GACATCCTGATGACCCAGTCTCCATCTCCCT GTCTGCATCTGTAGGAGACAGAGTCACCATCA CTTGCCGGGCAAGTCAGGACAGTCAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCGCGGTTCAGCGG CAGTGGATCTGGGACAGATTCACTCTCACAA TCAGCAGCCTGCAGCCTGAAGATTTTGCAACT TATTACTGTCTACAACATAATAGTTACCCGCTC ACTTTTGGCGGAGGGACCAAGGTGGAGATCA AA<br>SEQ ID NO: 27205 | CAGGTGCAGCTGGTGGAGTCTGGGGGAGGCCTG GTCCAGCCTGGGGAAAGTCCCTGAGACTCTCCTGTG CAGCGTCTGGATTCACCTTCAGTAGTAGTGGCAT GCACTGGGTCCGCCAGGCTCCAGGCAAGGGGCT GGAGTGGGTGGCAGTTATATGACTCCGTGAGGGGCCGA TAATAAATACTACTATGTAGACTCCGTGAGGGGCCGA TTCACCATCTCCAGAGACAATTCCAAGAGTACGC TGTATCTGCAAATGAACAGCCTGCGAGCCGAGG ACACGGCTGTGTATTACTGTGTGAGAGAGCTAGG CTTCCAGTCTGACTACTGGGGCCAGGGAACCCCG GTCACCGTCTCCTCA<br>SEQ ID NO: 31211 |
| | | AA | DILMTQSPSSLSASVGDRVTITCRASQGIRNDLG WYQQKPGKAPKRLIYAASSLQSGVPSRFSGSGS GTEFTLTISSLQPEDFATYYCLQHNSYPLTFGGG TKVEIK<br>SEQ ID NO: 27206 | QVQLVESGGGLVQPGKSLRLSCAASGFTFSSYGMH WVRQAPGKGLEWVAVIWYEGSNKYYVDSVRGRF TISRDNSKSTLYLQMNSLRAEDTAVYYCVRELGFQ SDYWGQGTPVTVSS<br>SEQ ID NO: 31212 |

FIGURE 50
(Continued)

| | | | | |
|---|---|---|---|---|
| iPS:436558 | 21-225_224C11 | NA | GATTTTGTGATGACCCAGACTCCACTCTCTG TCCGTCACCCCTGGACAGCCGGCTCCATCTC CTGCAAGTCAGTCAGAGCCTCCTGCATAGTG ATGGAAAGACCTTTTTGTATTGGTACCTGCAG AAGCCAGGCCAGCCTCCACAGCTCCTGATCTA TGAAATTTCCAACCGGTTCTCTGGAGTGCCAGA ATAGGTTCAGTGGCAGCGGGTCAGGGACAGA TTTCACACTGAAAATCAGCCGGGTGGAGGCTG AGGATGTTGGGATTTATTACTGCATGCAAAGT ACACAGTTCCTCGACGTTCGGCCAAGGGAC CAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACGGCTACTATA TACACTGGGTGCGACAGGCCCCTGGACAAGGGC TTGAGTGGATGGGATGGATCAACCCTTACAGTGG TGACACAAACTATGCACAGGAGACACGTTCAGGGCAG GGTCACCATGACCAGGGACACGTCCATCAGCAC AGCCTACATGGAACTGAGGAGGCTGAGATTTGA CGACACGGCCGTGTTTTACTGTGCGAGAGATTGG GGTGGCTACAGTTCTTACTACTTCGGTATGGACG TCTGGGGCCAAGGGACCACGGTCACCGTCTCTTC A |
| | | | SEQ ID NO: 27207 | SEQ ID NO: 31213 |
| | | AA | DFVMTQTPLSLSVTPGQPASISCKSSQSLLHSDG KTFLYWYLQKPGQPPQLLIYEISNRFSGVPDRFS GSGSGTDFTLKISRVEAEDVGIYYCMQSTQLPRT FGQGTKVEIK | QVQLVQSGAEVKKPGASVKVSCKASGYTFTGYYIH WVRQAPGQGLEWMGWINPYSGDTNYAQKFQGRV TMTRDTSISTAYMELRRLRFDDTAVFYCARDWGG YSSYYFGMDVWGQGTTVTVSS |
| | | | SEQ ID NO: 27208 | SEQ ID NO: 31214 |
| iPS:436560 | 21-225_224F11 | NA | AACATCGTGATGACCCAGTCTCCAGACTCCCT GGCTGTCTCTCTGGACGAGAGGGCCACCATCA ACTGCAAGTCCAGCCAGAGTGTTTTATCCAGC TCCAACAATCACAACTACTTAGCTTGGTACCA GCAGAAACCAGGACAGCCTCCTAAGATGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATACTACTCCGTGCAGTTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGGATGGATGCACAGAAGTTCCAGGCA GTAACACAGGCTATGCACAGGAACACCTCCATAAGCA GAGTCACCATGACCAGGGAGCTGAGCAGCCTCAAGA CAGCCTACATGGAGCTGAGCAGCCTGAGATCTG AGGACACGGCCGTGTACTGTGCCTATAGCAG TGGCTGGTACAAGTTTGACTACTGGGGCCAGGA ACCCTGGTCACCGTCTCCTCA |
| | | | SEQ ID NO: 27209 | SEQ ID NO: 31215 |

FIGURE 50
(Continued)

| | | | |
|---|---|---|---|
| iPS:436562 | 21-225_224H11 | AA | NIVMTQSPDSLAVSLDERATINCKSSQSVLSSSN NHNYLAWYQQKPGQPPKMLIYWASTRESGVPD RFSGSGSGTDFTLTISSLQAEDVAVYYCQQYYT PCSFGQGTKLEIK<br>SEQ ID NO: 27210 | QVQLVQSGAEVKKPGASVKVSCKASGYTFTNYDIN WVRQATGQGLEWMGWMNPNSGNTGYAQKFQGR VTMTRNTSISTAYMELSSLRSEDTAVYYCAYSSGW YKFDYWGQGTLVTVSS<br>SEQ ID NO: 31216 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGAACCTTTTTGTATTGGTACCTGCA GAAGCCAGGCCAGCCTCCACAGCTCCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA<br>SEQ ID NO: 27211 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGAGCCCCTGGACAAGGGC TTGAGTGGATGGGATGGATCAACCTTACAGTGG TGACACAAACTATGCACAGAAGTTTCAGGGCAG GGTCACCATGACCAGGGACACGTCCATCAGCAC AGCCTACATGGAACTGCGCAGGCTGAGATTTGAC GACACGGCCGTCTTTACTGTGCGAGAGATTGGG GTGGCTACAGTTCTTACTACGGTATGGACGT CTGGGGCCAAGGGACCACGGTCACCGTCTCTTCA<br>SEQ ID NO: 31217 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br>SEQ ID NO: 27212 | QVQLVQSGAEVKKPGASVKVSCKASGYTFTGYIH WVRQTPGQGLEWMGWINPYSGDTNYAQKFQGRV TMTRDTSISTAYMELRRLRFDDTAVFYCARDWGG YSSYYYGMDVWGQGTTVTVSS<br>SEQ ID NO: 31218 |

FIGURE 50
(Continued)

| | | | |
|---|---|---|---|
| iPS:436564 | 21-225_225A1 | NA | GACATCCAGATGACCCAGTCTCCATCCTCCCTGTCTGCATCTGTAGGAGACAGAGTCACCATCACTTGCCGGGCAAGTCAGGGCATTAGAGATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGACAATTCACTCTCACAATCAGCAGCCTGCAGCCTGAAGATTTTGCAACTTATTACTGTCTGCAGCATTATAGTTACCCTCGGACGTTCGGCCAAGGGACCAAGGTGGAAATCAAA<br><br>SEQ ID NO: 27213 | CAGGTGCAGCTGGTGGAGTCTGGGGGAGGCGTGGTCCAGCCTGGGAGGTCCCTGAGACTCTCCTGTCAGCGTCTGGATTCACCTTCAGTGACTATGTCATCCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGAGAGGTAAGCAGTGGCTGGTACGACTACGGTATGGACGTCTGGGGCCAAGGGACCACGGTCACCGTCTCCTCA<br><br>SEQ ID NO: 31219 |
| | | AA | DIQMTQSPSSLSASVGDRVTITCRASQGIRDDLGWYQQIPGKAPKRLIYAASSLQSGVPSRFSGSGSGTEFTLTISSLQPEDFATYYCLQHYSYPRTFGQGTKVEIK<br><br>SEQ ID NO: 27214 | QVQLVESGGGVVQPGRSLRLSCAASGFTFSDYVIHWVRQAPGKGLEWVAVIWYDGSNKYYADSVKGRFTISRDNSKNTLYLQMNSLRAEDTAVYYCARERYSSGWYDYGMDVWGQGTTVTVSS<br><br>SEQ ID NO: 31220 |
| iPS:436568 | 21-225_225B3 | NA | GAAATTGTGCTGACGCAGTCTCCAGGCACCCTGTCTTTGTCTCCAGGGGAAAGAGCCACCCTCTCCTGCAGGGCCAGTCAGAGTCTTAGCAGCAGCTACTTAGGCTGGTACCAGCAGAAACCTGGCCAGGCTCCCAGACTCCTCATCTATGATACATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACTCATGTGCAGTTTTGGCCAGGGGACCAAGCTGGAGATCAAA<br><br>SEQ ID NO: 27215 | CAGGTGCAACTGGTGCAGTCTGGGGCTGAGGTGAAGAAGCCTGGGGCCTCAGTGAAGGTTTCCTGCAAGGCATCTGGATACACCTTCACCAGCTACTATATGCACTGGGTGCGACAGGCCCCTGGACAAGGGCTTGAGTGGATGGGAATAATCAACCCTAGTGGTGGTAGCACAAGCTACGCACAGAAGTTCCAGGGCAGAGTCACCATGACCAGGGACACGTCCACGAGCACAGTCTACATGGAGCTGAGCAGCCTGAGATCTGCGGACACGGCCGTGTATTACTGTGCGAGGGATTTAGCAGTCGTTCTTACTACTACTACTTCGGTATGGACGTCTGGGGCCAAGGGACCACGGTCACCGTCTCCTCA<br><br>SEQ ID NO: 31221 |

FIGURE 50
(Continued)

| | | | | |
|---|---|---|---|---|
| iPS:436570 | 21-225_225F4 | AA | EIVLTQSPGTLSLSPGERATLSCRASQNLSSSYLG WYQQKPGQAPRLLIYDTSSRATGIPDRFSGSGSG TDFTLTISRLEPEDFAVYYCQEYGSSLMCSFGQG TKLEIK<br>SEQ ID NO: 27216 | QVQLVQSGAEVKKPGASVKVSCKASGYTFTSYYM HWVRQAPGQGLEWMGIINPSGGSTSYAQKFQGRV TMTRDTSTSTVYMELSSLRSADTAVYYCARDLAAR SYYYYFGMDVWGQGATVTVSS<br>SEQ ID NO: 31222 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTTATATAGC TCCAACAATAAGAACTACTTAGCTTGGTACCA GCAGAAACCAGGACAGCCTCCTAAACTACTCA TTTACTGGGCATCTACCCGGGAATCCGGGGTC CCTGACCGATTCACTGGCAGCGGGTCTGGGAC AGATTTCACTCTCACCATCAGCTGCGTGCAGC CGGAAGATGTGGCAGTTTATTACTGTCACCAA TATCATAATTCTCCTCCCACTTTCGGCCACGGG ACCGAAGTGGATATCAAA<br>SEQ ID NO: 27217 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGCACAGAAGTTCCAGGGCAG TAGCACAGGCTATGCACAGGAACACCTCCATAAGCAC ACTCACCATGGAACATGAAACAGCTGAGATCTGA AGTCTACACGGCCGTGTATTATTGTGCGAGTAGCAGT GGACACGGCCGTGGTTCGACCCCTGGGGCCAGGGA GGCTGGTACTGGTTCGACCCCTGGGGCCAGGGA ACCCTGGTCACCGTCTCCTCA<br>SEQ ID NO: 31223 | 
| | | AA | DIVMTQSPDSLAVSLGERATINCKSSQSVLYSSN NKNYLAWYQQKPGQPPKLLIYWASTRESGVPD RFTGSGSGTDFTLTISCVQPEDVAVYYCHQYHN SPPTFGHGTEVDIK<br>SEQ ID NO: 27218 | QVQLVQSGAEVKKPGASVKVSCKASGYTFTNYDIN WVRQATGQGLEWMGWMHPNSGSTGYAQKFQGR LTMTRNTSISTVYMELNSLRSEDTAVYYCASSSGW YWFDPWGQGTLVTVSS<br>SEQ ID NO: 31224 |

FIGURE 50
(Continued)

| | | | |
|---|---|---|---|
| iPS:436572 | 21-225_225G4 | NA | GATATTGTGATGACCCAGACTCCACTCTCTCT<br>GTCCGTCACCCCTGGACAGCCGGCCTCCATCT<br>CCTGCAAGTCTAGTCAGAGCCTCCTGCATAGT<br>GATGGAAAAGACCTTTTGTATTGGTACCTGCA<br>GAAGCCAGGCCAGCCTCCACAGCTCCTGATCT<br>ATGAAATTTCCAACCGGTTCTCTGGAGTGCCA<br>GATAGGTTCAGTGGCAGCGGGTCAGGGACAG<br>ATTTCACACTGAAAATCAGCGGGTGGAGGCT<br>GAGGATGTTGGGATTTATTACTGCATGCAAAG<br>TACACAGCTTCCTCGGACGTTCGGCCAAGGGA<br>CCAAGGTGGAAATCAAA<br><br>SEQ ID NO: 27219 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTATA<br>TACACTGGGTGCGACAGGCCCCTGGACAAGGGC<br>TTGAGTGGATGGGATGGATCAACCCTTACAGTGG<br>TGACACAAACTATGACCAGGACACGTTCAGGGCAG<br>GGTCACCATGACCAGGGACACGTCCATCAGCAC<br>AGCCTACATGGAACTGCGCAGGCTGAGATTTGAC<br>GACACGGCCGTCTTTTACTGTGCGAGAGATTGGG<br>GTGGCTACAGTTCTTACTACTACGGTATGACGT<br>CTGGGGCCAAGGGACCACGGTCACCGTCTCTTCA<br><br>SEQ ID NO: 31225 |
| | | AA | DIVMTQTPLSLSVTPGQPASISCKSSQSLLHSDGK<br>TFLYWYLQKPGQPPQLLIYEISNRFSGVPDRFSGS<br>GSGTDFTLKISRVEAEDVGIYYCMQSTQLPRTFG<br>QGTKVEIK<br><br>SEQ ID NO: 27220 | QVQLVQSGAEVKKPGASVKVSCKASGYTFTGYYIH<br>WVRQAPGQGLEWMGWINPYSGDTNYAQKFQGRV<br>TMTRDTSISTAYMELRLRFDDTAVFYCARDWGG<br>YSSYYYGMDVWGQGTTVTVSS<br><br>SEQ ID NO: 31226 |
| iPS:436574 | 21-225_225F5 | NA | GACATCGTGATGACCCAGTCTCCAGACTCCCT<br>GGCTGTGTCTCTGGGCGAGAGGGCCACCATCA<br>ACTGCAAGTCCAGCCAGAGTGTTTTATACAAC<br>TCCAACAATAACAACTACTTAGCTTGGTACCA<br>GCAGAAACCAGGACAGCCTCCTAACCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTTCTGTCAGCAA<br>TATTATAGTTCTCCGACGTTCGGCCAAGG<br>GACCAAGGTGGAAATCAAC<br><br>SEQ ID NO: 27221 | CAGGTGCAGCTGGTGCAGTCTGGGGCTGAGGTG<br>AAGAAGCCTAGGGCCTCAGTGAAGGTCTCCTGC<br>AAGGCTTCTGGACACACCTTCACCAATTATGATA<br>TCAACTGGGTGCGACAGGCCACTGGACAAGGC<br>TTGAGTGGATGGGATGGATGCATCCTAACAGTGG<br>TAACACAGGCTTTGCACAGAAGTTCCAGGGCAG<br>AGTCACCATGACCAGGAACACCTCCATAAGCAC<br>AGCCTACATGGAGCTGAGCAGCCTGAGATCTGA<br>GGACACGGCCGTGTATTACTGTGCATATAGCAGT<br>GGCTGGTACCGCTTTGACTACTGGGGCCAGGGAA<br>CCCTGGTCACCGTCTCCTCA<br><br>SEQ ID NO: 31227 |

FIGURE 50
(Continued)

| | | | |
|---|---|---|---|
| iPS:436576 | 21-225_225B6 | AA | DIVMTQSPDSLAVSLGERATINCKSSQNVLYNSN NNNYLAWYQQKPGQPPNLLIYWASTRESGVPD RFSGSGSGTDFTLTISSLQAEDVAVYFCQQYYSS PPTFGQGTKVEIN<br>SEQ ID NO: 27222 | QVQLVQSGAEVKKPRASVKVSCKASGHTFTNYDIN WVRQATGQGLEWMGWMHPNSGNTGFAQKFQGR VTMTRNTSISTAYMELSSLRSEDTAVYYCAYSSGW YRFDYWGQGTLVTSS<br>SEQ ID NO: 31228 |
| | | NA | GACATCCAGATGACCCAGTCTCCATCCTCCCT GTCTGCATCTGTAGGAGACAGAGTCATCATCA CTTGCCGGGCAAGTCAGGGCATGAGAAAAGA TTTAGGCTGGTATCAGCAGAAACCAGGGAAA GCCCCTAAGCGCCTGATCTATGCTGCAACCAG TTTGCAAAGTGGGGTCCCATCAAGGTTCAGCG GCAGTGGATCTGGGACAGATTCACTCTCACA ATCAGCAGCCTGCAGCTGACCATAGTTATCCATT TTATTACTGTCTACAGCATAATAGTTATGCAAC CACTTTCGGCCCTGGGACCAAAGTGGATATCA AA<br>SEQ ID NO: 27223 | CAGGTGCGGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAAAAT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAAGTGGG ATTCACTGAGGACTACTGGGGCCAGGGAACCCT GGTCACCGTCTCCTCA<br>SEQ ID NO: 31229 |
| | | AA | DIQMTQSPSSLSASVGDRVIITCRASQGMRKDLG WYQQKPGKAPKRLIYAATSLQSGVPSRFSGSGS GTEFTLTISSLQPEDFATYYCLQHNSYPFTFGPGT KVDIK<br>SEQ ID NO: 27224 | QVRLVESGGGVVQPGRSLRLSCAASGFTFSDYGMH WVRQAPGKGLEWVAVIWYDENNKYYADSVKGRF TISRDNSKNTLYLQMNSLRAEDTAVYYCAREVGFT EDYWGQGTLVTSS<br>SEQ ID NO: 31230 |

FIGURE 50
(Continued)

| | | | |
|---|---|---|---|
| iPS:436578 | 21-225_225D6 | NA | GACATCCAGATGACCCAGTCTCCATCCTCCT GTCTGCATCTGTAGGAGACAGAGTCACCATCA CTTGCCGGGCAAGTCAGGACAGGGCATTAGAAATGAT TTAGGCTGGTATCAGCAGAAACCAGGGAAAG CCCCTAAGCGCCTGATCTATGCTGCATCCAGT TTACAAAGTGGGGTCCCATCAAGGTTCAGCGG CAGTGGATCTGGGACAGATTCACTCTCACAA TCAGCAGCCTGCAGCCTGAAGATTTTGCAACT TATTGCTGTCTTCAGCATATACTTACCATTC ACTTTCGGCCCTGGGACCAAAGTGGATATCAA A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACGTGGGTCCGCCAGGCTCCAGGCAAGGGCT GGAGTGGGTGGCAGTTATATGGTATGAAAAT AATAAATACTATGCAGACTCCGTGAAGGGCGA TTCACCATCTCCAGAGACAATTCCAGAACACGC TGTATCTGCAAATGACCAGCCTGAGAGCCGAGG ACACGGCTGTGTATTACTGTGCGAGAGAAGTGGG ATTCACTGAGGACTACTGGGGCCAGGGAACCCT GGTCACCGTCTCCTCA |
| | | | SEQ ID NO: 27225 | SEQ ID NO: 31231 |
| | | AA | DIQMTQSPSSLSASVGDRVTITCRASQGIRNDLG WYQQKPGKAPKRLIYAASSLQSGVPSRFSGSGS GTEFTLTISSLQPEDFATYCCLQHNTYPFTFGPGT KVDIK | QVQLVESGGGVVQPGRSLRLSCAASGFTFSNYGM HWVRQAPGKGLEWVAVIWYDENNKYADSVKGR FTISRDNSQNTLYLQMTSLRAEDTAVYYCAREVGF TEDYWGQGTLVTVSS |
| | | | SEQ ID NO: 27226 | SEQ ID NO: 31232 |
| iPS:436580 | 21-225_225E7 | NA | GAAATTGTGTTGACGCAGTCTCCAGGCACCCT GTCTTTGTCTCCAGGGGAAAGAGCCACCCTCT CCTGCAGGGCCAGTCAGAGTGTTACAGCAGC TACTTAGCCTGGTACCAGCAGAAACCTGGCCA GGCTCCCAGGCTCCTCATCTATGGTGCATCCA GCAGGGCCACTGGCATCCCAGACAGGTTCAGT GGCAGTGGGTCTGGGACAGACTTCACTCTCAC CATCAGCAGACTGGAGCCTGAAGATTTTGCAG TATATTACTGTCAGCAGTATGGTACCTCACCTC GGACGTTCGGCCAAGGGACCAAGGTGGAAAT CAAA | CAGGTGCAGCTGCAGGAGTCGGGCCCAGGACTG GTGAAGCCTTCACAGACCCTGTCCCTCACCTGCA CTGTCTCTGGTAACTCCATCAGCAGTGGTCATTA CTACTGGAGCTGGATCCGCCAGCACCCAGGGAA GGGCCTTGAGTGGATTGGGTTCATCTATTACACT GGGAGCACCTACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGAGGCC GGTGACTACGGCTACTACGGTATGGACGTCTGGG GCCAAGGGACCACGGTCACCGTCTCCTCA |
| | | | SEQ ID NO: 27227 | SEQ ID NO: 31233 |

FIGURE 50
(Continued)

| | | | |
|---|---|---|---|
| iPS:436582 | 21-225_225F8 | AA | EIVLTQSPGTLSLSPGERATLSCRASQSVYSSYLAWYQQKPGQAPRLLIYGASSRATGIPDRFSGSGSGTDFTLTISRLEPEDFAVYYCQQYGTSPRTFGQGTKVEIK<br><br>SEQ ID NO: 27228 | QVQLQESGPGLVKPSQTLSLTCTVSGNSISSGHYYWSWIRQHPGKGLEWIGFIYYTGSTYYNPSLKSRVTISVDTSKNQFSLKLSSVTAADTAVYYCAREAGDYGYYGMDVWGQGTTVTVSS<br><br>SEQ ID NO: 31234 |
| | | NA | GACATCCAGATGACCCAGTCTCCATCCTCCCTGTCTGCATCTGTAGGAGACAGAGTCACCATCACTTGCCGGGCAAGTCAGGGCATTAGAAATGATTTAGGCTGGTATCAGCAGAAACCAGGGAAAGCCCCTAAGCGCCTGATATATGCTGCATCCAGTTTGCTAGGTGGTGTCCCATCAAGATTCAGCGGCAGTGGATCTGGGACAGATTCACTCTCACAATCAGCAGCCTGCAGCCTGAAGATTTTGCAACTTATTACTGTCTACAACATAATAGTTACCCATTCACTTTCGGCCCTGGGACCAAGGTGGATATCAAA<br><br>SEQ ID NO: 27229 | CAGGTGCAGCTGGTGGAGTCTGGGGGAGGCGTGGTCCAGCCTGGGAGGTCCCTGAGACTCTCCTGTCAGCGTCTGGATTCACCTTCAGTAGCTATGGCATGCACTGGGTCCGCCAGGCTCCAGGCAAGGGGCTGGAGTGGGTGGCAGTTATATGTAGACTCCGTGAAGGGCCGATAATAAATACTATGTAGACTCCGTGAAGGGCCGATTCACCATCTCAGAGACAATTCCAAGAACACGCTGTATCTGCAAATGAACAGCCTGAGAGCCGAGGACACGGCTGTGTATTACTGTGCAGAGAAGTGGGATTTACTGAGGACTACTGGGGCCAGGGAACCCTGGTCACCGTCTCCTCA<br><br>SEQ ID NO: 31235 |
| | | AA | DIQMTQSPSSLSASVGDRVTITCRASQGIRNDLGWYQQKPGKAPKRLIYAASSLLGGVPSRFSGSGSGTEFTLTISSLQPEDFATYYCLQHNSYPFTFGPGTKVDIK<br><br>SEQ ID NO: 27230 | QVQLVESGGGVVQPGRSLRLSCAASGFTFSSYGMHWVRQAPGKGLEWVAVIWYDENNKYYVDSVKGRFTISRDNSKNTLYLQMNSLRAEDTAVYYCAREVGFTEDYWGQGTLVTVSS<br><br>SEQ ID NO: 31236 |

FIGURE 50
(Continued)

| | | | |
|---|---|---|---|
| iPS:436584 | 21-225_225B9 | NA | GACATCGTGATGACCCAGTCTCCAGATTCCT GGCTGTGTCTCTGGGCGAGAGGGCCACCATCA ACTGCAAGTCCAGCAGTCCAGAGTGTTTATACAGC TCCAACAATAACAACTACTTAGCTTGGTACCA ACAAAAACCAGGACAGCCTCCTAAGCTGCTCA TTTTCTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAACAC TCCAAGAGTATTCCTGTAAGTTTGGGCAGGG GATCAAACTGGAGATCCAA SEQ ID NO: 27231 | CAGGTGCAGCTGGTGCAGTCTGGGACTGAGGTG AGGAAGCCTGGGCCTCAGTGAAGGTCTCCTGC AAGGCTTCTGGATACACCTTCACCAATTATGATA TCAACTGGGTACGACAGGCCACTGGACAAGGC TTGAGTGGATGGGATGGATGCACCTAACAGTGG TAACACAGGCTATGCACAGAAGTTCCGGGCAG AGTCACCATGACCAGGAACACCTCCATAAACAC AGCCTACATGGAGCTGAACAGCCTGAGATCTGA GGACACGGCCGTATATTATTGTGCATATAGCAGT GGCTGGACCCTTTTTGACTACTGGGGCCAGGGAA CCCTGGTCACCGTCCTCA SEQ ID NO: 31237 |
| | | AA | DIVMTQSPDSLAVSLGERATINCKSSQSVLYSSN NNNYLAWYQQKPGQPPKLLIFWASTRESGVPDR FSGSGSGTDFTLTISSLQAEDVAVYYCQHSKSIPG KFGQGIKLEIQ SEQ ID NO: 27232 | QVQLVQSGTEVRKPGASVKVSCKASGYTFTNYDIN WVRQATGQRLEWMGWMHPNSGNIGYAQKFRGR VTMTRNTSINTAYMELNSLRSEDTAVYYCAYSSG WTLFDYWGQGTLVTVSS SEQ ID NO: 31238 |
| iPS:436586 | 21-225_225F11 | NA | GACATCGTGATGACCCAGTCTCCAGACTCCT GGCTGTGTCTCTGGGCGAGAGGGCCACCATCA ACTGCAAGTCCAGCCAGTCCAGAGTGTTTATACAGC TCCAACAATTACAACTACTTAGCTTGGTACCA GCAGAAACCAGGACAGCCTCCTAAGCTGCTCA TTTACTGGGCTTCTACCCGGGAATCCGGGGTC CCTGACCGATTCAGTGGCAGCGGGTCTGGGCC AGATTTCACTCTCACCATCAGCAGCCTGCAGG CTGAAGATGTGGCAGTTTATTACTGTCAGCAA TATTATACTACTCCTCCGACGTTCGGCCAAGG GACCAAGGTGGAAATCAAA SEQ ID NO: 27233 | CAGGTGCAGCTGGTGCAGTCTGGGGCTGAGGTG AAGAAGCCTGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCATAAACAC AGCCTACATGGAGCTGAGCAGCCTGAGATCTGA GGACACGGCCGTGTATTACTGTGCGTATAGCAGT GGCTGGTACCGCTTTGACTACTGGGGCCAGGGAA CCCTGGTCACCGTCCTCA SEQ ID NO: 31239 |

FIGURE 50
(Continued)

| | | | | |
|---|---|---|---|---|
| iPS:436588 | 21-225_225F12 | AA | DIVMTQSPDSLAVSLGERATINCKSSQSVLYSSN NYNYLAWYQQRPGQPPKLLIYWASTRESGVPD RFSGSGSGPDFTLTISSLQAEDVAVYYCQQYYT PPTFGQGTKVEIK | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YRFDYWGQGTLVTVSS |
| | | | SEQ ID NO: 27234 | SEQ ID NO: 31240 |
| | | NA | GACATCGTGATGACCCAGTCTCCAGACTCCCT GGCTGTGTCTCTGGGCGAGAGGGCCACCATCA ACTGCAAGTCCAGCCAGAGTGTTTATACAGC TCCAACAATCAGAACTACTTAGCTTGGTACCA GCAGAAACCAGGACAGCCTCCTAGGCTGCTCA TTTACTGGACATCTGGAATCCCGGGGTC CCTGACCGATTCAGTGGCAGCGGGTCTGGGAC AGATTTCACTCTCACCATCAGCAACCTGTCAGCA CTGAAGATGTGGCTGTTTATTACTGTCAGCAA TATTATATCACCCGTGCAGTTTTGGCCAGGG GACCAAAACTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCATATGATA TCAACTGGGTGCGACAGGCCACTGGACAAGGC TTGAGTGGATGGGATGGATGCACCAAACAGTG GTAACACAGGCTATGCACAGAAGTTCCAGGGCA GAGTCACCATGGCCAGGAACACCTCCATAAGCA CAGCCTACATGGAGCTGAGCAGCCTGAGATCTG AGGACACGGCCGTGTATTACTGTGCCTATAGCAG TGGCTGGTACAAGTTTGACTACTGGGGCCAGGGA ACCCTGGTCACCGTCCTCA |
| | | | SEQ ID NO: 27235 | SEQ ID NO: 31241 |
| | | AA | DIVMTQSPDSLAVSLGERATINCKSSQSVLYSSN NQNYLAWYQQKPGQPPRLLIYWTSTRESGVPDR FSGSGSGTDFTLTISNLQAEDVAVYYCQQYYITP CSFGQGTKLEIK | QVQLVQSGAEVKKPGASVKVSCKASGYTFTHYDIN WVRQATGQGLEWMGWMHPNSGNTGYAQKFQGR VTMARNTSISTAYMELSSLRSEDTAVYYCAYSSGW YKFDYWGQGTLVTVSS |
| | | | SEQ ID NO: 27236 | SEQ ID NO: 31242 |

FIGURE 50
(Continued)

| | | | |
|---|---|---|---|
| iPS:436590 | 21-225_225H12 | NA | GACATCGTGATGACCCAGTCTCCAGACTCCCT GGCTGTGTCTCTGGGCGAGAGGGCCACCATCA ACTGCAAGTCCAGCCAGAGTGTTTTATACAAC TCCAACAATAACAACTACTTAGCTTGGTACCA GCAGAAACCAGGACAGCCTCCTAAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGA CTGAAGATGTGGCAGTTTATTACTGTCAGCAA TATTATATTACTCCGTGCAGTTTTGGCCAGGG GACCAAGCTGGAGATCAAA<br><br>SEQ ID NO: 27237 | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCCTCTCA<br><br>SEQ ID NO: 31243 |
| | | AA | DIVMTQSPDSLAVSLGERATINCKSSQSVLYNSN NNNYLAWYQQKPGQPPNLLIYWASTRESGVPD RFSGSGSGTDFTLTISSLQTEDVAVYYCQQYYIT PCSFGQGTKLEIK<br><br>SEQ ID NO: 27238 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTVSS<br><br>SEQ ID NO: 31244 |
| iPS:436592 | 21-225_226B1 | NA | GATATTGTGATGACCCAGACTCCACTCTCTCT GTCCGTCACCCCTGGACAGCCGGCCTCCATCT CCTGCAAGTCTAGTCAGAGCCTCCTGCATGGT GATGGAAAGACCTATTTGTATTGGTACCTGCA GAGGCCAGGCCAGCCTCCACAGTCCTGATCA ATGAAGTTTCCATCCGGTTCTCTGGAGTGCCA GATAGGTTCAGTGGCAGCGGGTCAGGACAG ATTTTCACACTGAAAATCAGCGGGGTGGAGGCT GAGGATGTTGGGGTTTACTACTGCATGCAAAG TATACAGATTCCGTGGACGTTCGGCCAGGGGA CCAAGGTGGACATCAAA<br><br>SEQ ID NO: 27239 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTACTGGCAT GCACTGGGTCCGCCAGGCTCCAGGCAAGGGCT GGAGTGGGTGGCAATTATATGTATGATGGAAGGT TATAAATACTATGCAGACTCCGTGAAGGGCCGAT TCACCATCTCCAGAGACAATTCCAAGAACACGCT GTTTCTGCAAATGAACAGCCTGAGAGCCGAGGA CACGGCTGTGTATTACTGTGCGAGAGATCACTAC GATTTTTGGAGTGGTTATCTTACCCACTGGGCC AGGGAACCCTGGTCACCGTCCTCA<br><br>SEQ ID NO: 31245 |

FIGURE 50
(Continued)

| | | AA | DIVMTQTPLSLSVTPGQPASISCKSSQSLLHGDG KTYLYWYLQRPGQPPQLLINEVSIRFSGVPDRFS GSGSGTDFTLKISRVEAEDVGVYYCMQSIQIPWT FGQGTKVDIK | QVQLVESGGGVVQPGRSLRLSCAASGFTFSTYGMH WVRQAPGKGLEWVAIIWYDGGYKYYADSVKGRF TISRDNSKNTLFLQMNSLRAEDTAVYYCARDHYDF WSGYLTHWGQGTLVTVSS |
|---|---|---|---|---|
| | | | SEQ ID NO: 27240 | SEQ ID NO: 31246 |
| iPS:436594 | 21-225_226A5 | NA | GATATTGTGATGACCCAGACTCCACTCTCTCT GTCCGTCACCCCTGGACAGCCGGCCTCCATCT CCTGCAAGTCTAGTCAGAGCCTCCTACACATGGT GATGGAAAGAACCTATTTGTATTGGTACCTGCA GAAGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGGTTTATTACTGCATGCAAAG TATACAGATTCCGTGGACGTTCGGCCAAGGGA CCAAGGTGGAGATCAAA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAATTATATGGTATGATGGAACT AATAAATACTATACAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTCA CGATTTTTGGAGTGGCTTTTTTGTACTGGGGCC AGGGAACCCTGGTCACCGTCTCCTCA |
| | | | SEQ ID NO: 27241 | SEQ ID NO: 31247 |
| | | AA | DIVMTQTPLSLSVTPGQPASISCKSSQSLLHGDG KTYLYWYLQKPGQPPQLLIYEVSNRFSGVPDRFS GSGSGTDFTLKISRVEAEDVGVYYCMQSIQIPWT FGQGTKVEIK | QVQLVESGGGVVQPGRSLRLSCAASGFTFSNYGM HWVRQAPGKGLEWVAIIWYDGTNKYYTDSVKGR FTISRDNSKNTLYLQMNSLRAEDTAVYYCAREGHD FWSGFFCYWGQGTLVTVSS |
| | | | SEQ ID NO: 27242 | SEQ ID NO: 31248 |

FIGURE 50
(Continued)

| | | | |
|---|---|---|---|
| iPS:436596 | 21-225_226C6 | NA | GACATCGTGATGACCCAGTCTCCATCCTCCCT GTCTGCATCTATAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGTGG CAGTGGATCTGGGACAGAATTCACTCTCACAA TCAGCAACCTGCAGCTGAAGATTTTGCAACT TATTACTGTCTACAGCATTATAATTACCCTCGG GCGTTCGGCCAAGGGACCAAGGTGGAAATCC AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCTCCAGAGACAATTCCAAGAACACGC TGTATCTGCAAACGAACAGCCTGAGAGCCGAGG ACACGGCTGTGTATTACTGTGCGAGAGAGAGGTA TAGCAGCAGCTGGTACGACTACGGTATGGACGTC TGGGGCCAAGGGACCACGGTCACCGTCTCCTCA |
| | | | SEQ ID NO: 27243 | SEQ ID NO: 31249 |
| | | AA | DIQMTQSPSSLSASIGDRVTITCRASQGIRNDLG WYQQKPGKAPKRLIYAASSLQSGLPSRFSGSGSG TEFTLTISNLQPEDFATYYCLQHYNYPRAFGQGT KVEIQ | QVQLVESGGGVVQPGRSLRLSCAASGFTFSDYGM HWVRQAPGKGLEWVAVIWYDGSNKYYADSVKGR FTISRDNSKNTLYLQTNSLRAEDTAVYYCARERYSS SWYDYGMDVWGQGTTVTVSS |
| | | | SEQ ID NO: 27244 | SEQ ID NO: 31250 |
| iPS:436598 | 21-225_226D6 | NA | GACATCGTGATGACCCAGTCTCCAGACTCCCT GGCTGTGTCTCTGGGCGAGAGGGCCACCATCA ACTGCAGGTCCAGCAGTGATATTTATACATC AAGGCTTCTGGATACACCTTCACCAATTATGATA TCCAACAATAAGAACTACTTAGCTTGGTACCA TCAACTGGGTGCGACAGGCCACTGGACAAGGC GCAGAAACCAGGACAGCCTCCTAAGATGCTCA TTGAGTGGATGGGATGGATGCACAGAAGTTCAGGCAG TTTACTGGGCATCTACCCGGGAATCCGGGGTC TAACACAGGCTATGCACAGAAGTTCCAGGCAC CCTGACCGATTCAGTGGCAGCGGGTCTGGGAC AGTCACCATGACCAGGAACACCTCCATAAGCAC AGATTTCACTCTCACCATCAGCAGCCTGCAGG AGCCTACATGGAGCTGAGCAGCCTGAGATCTGA CTGAAGATGTGGCAGTTTATTACTGTCAGCAA GGACACGCCGTGTATTACTGTGCCTATAGCAGT TATTATATGTTCCGTGCAGTTTGGCCAGGG GGCTGGTACAAGTTTGACTACTGGGGCCAGGGA GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCAGGCAG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGCCGTGTATTACTGTCCTATAGCAGT GGCTGGTACAAGTTTGACTACTGGGGCCAGGGA ACCCTGGTCACCGTCTCCTCA |
| | | | SEQ ID NO: 27245 | SEQ ID NO: 31251 |

FIGURE 50
(Continued)

| | | | |
|---|---|---|---|
| | | AA | DIVMTQSPDSLAVSLGERATINCRSSQSILYISNN KNYLAWYQQKPGQPPKMLIYWASTRESGVPDR FSGSGSGTDFTLTISSLQAEDVAVYYCQQYYSSP CSFGQGTKLEIK<br>SEQ ID NO: 27246 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTSS<br>SEQ ID NO: 31252 |
| iPS:436600 | 21-225_226F6 | NA | GACATCGTGATGACCCAGTCTCCAGACTCCCT GGCTGTGTCTGTGGGCGAGAGGGCCACCATCA ACTGCAAGTCCAGCCAGAGTATTTATACAGC TCCAACAATTACAAACTACTTAGCTTGGTACCA GCAGAAGCCAGGACAGCCTCCTAAGCTGCTCA TTTACTGGGCTTCTACCCGGGAATCCGGGGTC CCTGACCGATTCAGTGGCAGCGGGTCTGGGCC AGATTTCACTCTCACCATCAGCAGCCTGCAGG CTGAAGATGTGGCAGTTTATTACTGTCAGCAA TATTATACTACTCCTCCGACGTTCGGCCAAGG GACCAAGGTGGAAATCAAA<br>SEQ ID NO: 27247 | CAGGTGCAGCTGGTGCAGTCTGGGGCTGAGGTG AAGAAGCCTGGGGCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGGCAG AGTCACCATGACCAGGAACACCTCCATAAACAC AGCCTACATGGAGCTGAGCAGCCTGAGATCTGA GGACACGGCCGTGTATTACTGTGCGTATAGCAGT GGCTGGTACCGCTTTGACTACTGGGGCCAGGGAA CCCTGGTCACCGTCCTCCTCA<br>SEQ ID NO: 31253 |
| | | AA | DIVMTQSPDSLAVSLGERATINCKSSQSILYSSNN YNYLAWYQQKPGQPPKLLIYWASTRESGVPDRF SGSGSGPDFTLTISSLQAEDVAVYYCQQYYTTPP TFGQGTKVEIK<br>SEQ ID NO: 27248 | QVQLVQSGAEVKKPGASVKVSCKASGYTFTNYDIN WVRQATGQGLEWMGWMHPNSGNTGYAQKFQGR VTMTRNTSINTAYMELSSLRSEDTAVYYCAYSSGW YRFDYWGQGTLVTSS<br>SEQ ID NO: 31254 |

FIGURE 50
(Continued)

| | | | |
|---|---|---|---|
| iPS:436602 | 21-225_226E7 | NA | GATATTGTGATGACCCAGACTCCACTCTCTCT GTCCGTCACCCCTGGACAGCCGGCCTCCATCT CCTGCAAGTCTAGTCAGAGCTCCTGCATGGT GATGGAAAGAACCTATTTGTATTGGTACCAGCA GAAGCCAGGCCAGCCTCCACAGATCCTGATCT ATGAAGTTTCCAACCGGTTCTCTGGAGTGCCA GATAGGTTCAGTGGCAGCGGTCAGGGACAG ACTTCACACTGAAAATCAGCGGGTGGAGGCT GAGGATGTTGGGGTTTATTACTGCATGCAAAG TATACAGGTTCCGTGGACGTTCGGCCAAGGGA CCAAGGTGGAGATCAAA SEQ ID NO: 27249 | CAGGTGCAGCTGGTGGAGTCTGGGGGAGGCGTG GTCCAGCCTGGGAGGTCCCTGAGACTCTCCTGTG CAGCGTCTGGATTCACCTTCAGTACTTACGGCAT GCACTGGGTCCGCCAGGCTCCAGGCAAGGGCT GGAATGGGTGGCAATTATATGGTATGATGAAGT AATAAATACTATGCAGACTCCGTGAAGGGCCGA TTCACCATCTCCAGAGACAATTTCAAGAACACGC TGTATCTGCAAATGCACAGCCTGAGAGCCGACG ACACGGCTGTGTATTACTGTGCGAGAGAATTA CGATTTTGGAGTGGTTATTATGCTACTGGGGC CAGGGAACCCTGGTCACCGTCTCCTCA SEQ ID NO: 31255 |
| | | AA | DIVMTQTPLSLSVTPGQPASISCKSSQSLLHGDG KTYLYWYQQKPGQPPQILIYEVSNRFSGVPDRFS GSGSGTDFTLKISRVEAEDVGVYYCMQSIQVPW TFGQGTKVEIK SEQ ID NO: 27250 | QVQLVESGGGVVQPGRSLRLSCAASGFTFSTYGMH WVRQAPGKGLEWVAIIWYDGSNKYYADSVKGRFT ISRDNFKNTLYLQMHSLRADDTAVYYCARENYDF WSGYYGYWGQGTLVTVSS SEQ ID NO: 31256 |
| iPS:436604 | 21-225_226F7 | NA | GACATCCAGATGACCCAGTCTCCATCTCCCT GTCTGCATCTGTTGGAGACAGAGTCACCATCA CTTGCCGGGCAAGTCAGGGCATTGGGAATGAT TTAGGCTGGTATCAGCAGAAACCAGGGAAAG CCCCTAAGCGCCTGATCTATGCTGCCTCCAGTT TGCAAAGTGGGGTCCCATCAAGGTTCAGCGGC AGTGTATCTGGGACAGACTTCATTCTCACAAT CAGCAGCCTGCAGCCTGAAGATTTTGCAACTT ATTACTGTCTACATTCATTATAGTTACCCTCGGA CGTTCGGCCAAGGGACCAAGGTGGAAATCAA A SEQ ID NO: 27251 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGCT GGAGTGGGTGGCAATTATATGGTATGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTA TAACAGCGGCTGGTACGACTACGGTTTGGACGTC TGGGGCCAAGGGACCACGGTCACCGTCTCCTCA SEQ ID NO: 31257 |

FIGURE 50
(Continued)

| | | | |
|---|---|---|---|
| iPS:436606 | | AA | DIQMTQSPSSLSASVGDRVTITCRASQGIGNDLGWYQQKPGKAPKRLIYAASSLQSGVPSRFSGSVSGTEFILTISSLQPEDFATYYCLHHYSYPRTFGQGTKVEIK | QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARERYNSGWYDYGLDVWGQGTTVTVSS |
| | | | SEQ ID NO: 27252 | SEQ ID NO: 31258 |
| | | NA | GATATTGTGATGACCCAGACTCCACTCTCTCTGTCCGTCACCCCTGGACAGCCGGCCTCCATCTCCTGCAAGTCTAGTCAGAGCCTCCTGCATAGTGATGGAAAGAACCTTTTTGTATTGGTACCTGCAGAAGCCAGGCCAGCCTCCACAGCTCCTGATCTATGAAATTTCCAACCGGTTCTCTGGAGTCCAGATAGGTTCAGTGGCAGTGGGTCAGGACAGATTTCACACTGAAAATCAGCCGGGTGGAGGCTGAGGATGTTGGGGATTTATTACTGCATGCAAAGTACACAGCTTCCTCGGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATACACTGGGTGCGACAGGCCCCTGGACAAGGGCTTGAGTGGATGGGATGGATCAACCCTTACAGTGGTGACACAAAGTATGCACAGAAGTTTCAGGCAGGGTCACCATGACCAGGGACACGTCCATCAGCACAGCCTACATGGAACTGAGCAGGCTGAGATTTGACGAGGCCGTGTTTTACTGTGCGAGAGATTGGGGTGGCTACAGTTCTTACTACTACGGTATGGACGTCTGGGGCCAAGGGACCACGGTCACCGTCTCTCA |
| | | | SEQ ID NO: 27253 | SEQ ID NO: 31259 |
| | 21-225_226G8 | AA | DIVMTQTPLSLSVTPGQPASISCKSSQSLLHSDGKTFLYWYLQKPGQPPQLLIYEISNRFSGVPDRFSGSGSGTDFTLKISRVEAEDVGIYYCMQSTQLPRTFGQGTKVEIK | QVQLVQSGAEVKKPGASVKVSCKASGYTFTGYYIHWVRQAPGQGLEWMGWINPYSGDTKYAQKFQGRVTMTRDTSISTAYMELSRLRFDDTAVFYCARDWGGYSSYYYGMDVWGQGTTVTVSS |
| | | | SEQ ID NO: 27254 | SEQ ID NO: 31260 |

FIGURE 50
(Continued)

| | | | |
|---|---|---|---|
| iPS:436608 | 21-225_226A9 | NA | GACATCCAGATGACCCAGTCTCCATCCTCCCTGTCTGCATCTGTAGGAGACAGAGTCACCATCACTTGCCGGGCAAGTCAGGACAGATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGCGGCAGTGGATCTGGGACAGAATTCACTCTCACAATCAGCAGCCTGCAGCCTGAAGATTTTGCAACTTATTACTGTCTACAGCATAATAGTTACCCATTCACTTTCGGCCCTGGGACCAAAGTGGATATCAAA | CAGGTGCAGCTGGTGCAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAGTTATATACAGACTCCGTGAAGGGCGTAATAAATACTATACAGACTCCGTGAAGGGCCGATTCACCATCTCCAGAGACAATTCCAAGAACACGCTGTTTCTGCAAATGAACAGCCTGAGAGCCGAGGACACGGCTGTGTATTACTGTGCGAGAGAAGTGGGATTCACTGAGGACTACTGGGGCCAGGGAACCCTGGTCACCGTCTCCTCA |
| | | | SEQ ID NO: 31261 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK | QVQLVESGGGVVQPGRSLRLSCAASGFTFSNYGMHWVRQAPGKGLEWVAVIWYEESNKYYTDSVKGRFTISRDNSKNTLFLQMNSLRAEDTAVYYCAREVGFTEDYWGQGTLVTVSS |
| | | | SEQ ID NO: 27256 | SEQ ID NO: 31262 |
| iPS:436610 | 21-225_226F9 | NA | GATATTGTGATGACCCAGACTCCACTCTCTGTCCGGTCACCCTGGACAGCCGGCCTCCATCTCCTGCAAGTCTAGTCAGAGCCTCCTGCATAGTGATGGAAAGAACCTTTTGTATTGGTACCTGCAGAAGCCAGGCCAGCCTCCACAGCTCCTGATCTATGAAATTTCAACCGGTTCTCTGGAGTGCCAGATAGGTTCAGTGCAGCGGGTCAGGACAGATTTCACACTGAAAATCAGCCGGGTGGAGGCTGAGGATGTGGGAGTTTATTACTGCATGCAAAGTACACAGCTTCCTCCGACGTTCGGCCAAGGGACCAAGGTGGAAATCAAA | CAGGTGCAGCTGCAGTCTGGGGCTGAGGTGAAGAAGCCTGGGCCTCAGTGAAGGTCTCCTGCAAGGCTTCTGGATACACCTTCACCGGCTACTATATACACTGGGTGCGACAGGCCCCTGGACAAGGGCTTGAGTGGATGGGATGGATCAACCCTAACAGTGGTGACACAAAGTATGCACAGAAGTTTCAGGGCAGGGTCACCATGACCAGGGACACGTCCATCAGCACAGCCTACATGGAACTGAGCAGGCTGAGATTTGACGACACGGCCGTGTTTTACTGTGCGAGAGATTGGGGTGGCTACAGTTCTTACTACTACGGTATGGACGTCTGGGGCCAAGGGACCACGGTCACCGTCTCCTTCA |
| | | | SEQ ID NO: 27257 | SEQ ID NO: 31263 |

FIGURE 50
(Continued)

| | | | | |
|---|---|---|---|---|
| iPS:436612 | 21-225_226H9 | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK | QVQLVQSGAEVKKPGASVKVSCKASGYTFTGYYIH WVRQAPGQGLEWMGWINPYSGDTKYAQKFQGRV TMTRATSISTAYMELSRLRFDDTAVFYCARDWGG YSSYYYGMDVWGQGTTVTVSS |
| | | | SEQ ID NO: 27258 | SEQ ID NO: 31264 |
| | | NA | GATATTGTGATGACCCAGACTCCACTCTCTCT GTCCGTCATCCTGGACAGCCGGCCTCCATCT CCTGCAAGTCTAGTCAGAGCCTCCTGCATAGT GATGGAAAGAACCTTTTTGTATTGGTACCTGCA GAGGCCAGGCCAGCCTCCACAGCTCCTGATCT ATGAAGTTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACATA CACTGGGTGCGACAGGCCCCTGGACAAGGGC TTGAGTGGATGGGATGGATCAACCCTTACAGTGG TGACACAAACTCTGCACAGAAGTTTCAGGCCG GGTCACCATGACCAGGGACACGTCCATCAGCAC AGCCTACATGGAACTGAGCAGGCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTC A |
| | | | SEQ ID NO: 27259 | SEQ ID NO: 31265 |
| | | AA | DIVMTQTPLSLSVIPGQPASISCKSSQSLLHSDGK TFLYWYLQRPGQPPQLLIYEVSNRFSGVPDRFSG SGSGTDFTLKISRVEAEDVGIYYCMQSTQLPRTF GQGTKVEIK | QVQLVQSGAEVKKPGASVKVSCKASGYTFTGYYIH WVRQAPGQGLEWMGWINPYSGDTNSAQKFQGRV TMTRDTSISTAYMELSRLRFDDTAVFYCARDWGG YSSYYYGMDVWGQGTTVTVSS |
| | | | SEQ ID NO: 27260 | SEQ ID NO: 31266 |

FIGURE 50
(Continued)

| | | | |
|---|---|---|---|
| iPS:436614 | 21-225_226F10 | NA | GATATTGTGATGACCCAGACTCCACTCTCT GTCCGTCACCCCTGGACAGCCGCCTCCATCT CCTGCAAGTCTAGTCAGAGCTTCCTGCATAGT GATGGAAAGAACCTTTTGTATTGGTACCTGCA GAAGCCAGGCCAGCCTCCACAGCTCCTGATCT ATGAAAATTTCCAACCGGTTCTCTGGGGTGCCA GATAGGTTCAGTGCAGCGGGTCAGGACAG ATTTCACACTGAAAATCAGCGAGTGGAGGCT GAGGATGTTGGGATTTATTACTGCATGCAAAG TACACAGCTTCCTCGGACGTTCGGCCAAGGGA CCAAGGTGGAAATCAAA |
| | | | SEQ ID NO: 27261 |
| | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK |
| | | | SEQ ID NO: 27262 |
| | | NA | CAGGTGCAGCTGGTGCAGTCTGGGGGTGAGGTG AAGAAGCTGAGGGCCTCAGTGAAGGTCTCCTGC AAGGCTTCTGGATACACCTTCACCGGCTATTATA TACACTGGGTGCGACAGGCCCCTGGACAAGGGC TTGAGTGGATGGGATGGATCAACCATACAGTGG TGACACAAACTATGCACAGGAGACAAGTTCAGGGCAG GGTCACCATGACCAGGGACACGTCCGTCAGCAC AGCCTACATGAACTGAGCAGGTTGAGATTGA CGACACGGCCGTGTTTTACTGTGCGAGAGATTGG GGTGGCTACAGTTCTTACTACTACGGTATGGACG TCTGGGGCCAAGGGACCCCGGTCACCGTCTCTTC A |
| | | | SEQ ID NO: 31267 |
| | AA | QVQLVQSGGEVKKLRASVKVSCKASGYTFTGYYIH WVRQAPGQGLEWMGWINPYSGDTNYAQKFQGRV TMTRDTSVSTAYMELSRLRLDDTAVFYCARDWGG YSSYYYGMDVWGQGTPVTVSS |
| | | | SEQ ID NO: 31268 |
| iPS:436616 | 21-225_226D11 | NA | GACATCGTGATGACCCAGTCTCCAGACTCCT GGCTGTGTCTCTGGGCGAGAGGGCCACCATCA ACTGCAAGTCCAGCCAGAATGTTTTACACAGC TCCAACAGTAATAACTACTTAGTTTGGTACCA GCAGAAACCAGGACAGCCTCCTAAACTGCTCA TTTACTGGGCATCTACCCGGGAATCCGGGGTC CCTGACCGATTCAGAGGCAGCGGGTCTGGGAC AGATTTCACTCTCACCATCAGCAGCCTGCAGG CTGAAGATGTGGCAGTTTATTACTGTCAGCAA TATTATAAAACTCCGTGACGTTCGGCCAAGG GACCAAGGTGGAAATCAAA |
| | | | SEQ ID NO: 27263 |
| | | | CAGGTGCAGCTGGTGCAGTCTGGGGCTGAGGTG AAGAAGCCTGGGGCCTCAGTGAAGGTCTCCTGC AGGTCTCTGGATACACCTTCACCAATTATGATA TCAACTGGGTGCGACAGGCCACTGGACAAGGC TTGAGTGGATGGGATGGATGCACCCTAACAGTGG TAACACAGGCTATGCACAGAAGTTCCAGGGCAG AGTCACCATGACCAGGAACACCTCCATAAGCAC AGCCTACATGAGCTGAGCAGCCTGAGATCTGA GGACACGGCCGTGTATTACTGTGCTATAGCAGT GGCTGGTACTACTTTGACTACTACTACTACGGT CCCTGGGGCCAGGAA CCCTGGTCACCGTCTCCTCA |
| | | | SEQ ID NO: 31269 |

FIGURE 50
(Continued)

| | | | |
|---|---|---|---|
| iPS:436618 | 21-225_226E11 | AA | DIVMTQSPDSLAVSLGERATINCKSSQNVLHSSN SNNYLVWYQQKPGQPPKLLIYWASTRESGVPDR FRGSGSGTDFTLTISSLQAEDVAVYYCQQYYKTP WTFGQGTKVEIK<br>SEQ ID NO: 27264 | QVQLVQSGAEVKKPGASVKVSCRSSGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS<br>SEQ ID NO: 31270 |
| | | NA | GATATTGTGATGACCCAGACTCCACTCTCTCT GTCCGTCACCCCTGGACAGCCGGCCTCCATCT CCTGCAAGTCTAGTCAGAGCCTCCTGCATAGT GATGGAAAGAAGACCTTTTTGTATTGGTACCTGCA CAAGCCAGGCCAGCCTCCACACCTCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGATTTATTACTGCATGCAAAG TACACAGCTTCCTCGGACGTTCGGCCAAGGGA CCAAGGTGGAAATCAAA<br>SEQ ID NO: 27265 | CAGGTGCAGCTGGTGCAGTCTGGGGCTGAGGTG AAGAAGCCTGGGGCCTCAGTGAAGGTCTCCTGC AAGGCTCTGATACACCTTCACGGCTACTATA TACACTGGGTGCGACAGGCCCCTGGACAAGGGC TTGAGTGGATGGGATGGATGCAACAGAAGTTCAGGCAG TGACACAAACTATGCACAGAAGTTCAGGCAG GGTCACCATGACCAGGGACACGTCCATCAGCAC AGCCTACATGGAACTGAGCAGGCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTC A<br>SEQ ID NO: 31271 |
| | | AA | DIVMTQTPLSLSVTPGQPASISCKSSQSLLHSDGK TFLYWYLHKPGQPPHLLIYEISNRFSGVPDRFSGS GSGTDFTLKISRVEAEDVGIYYCMQSTQLPRTFG QGTKVEIK<br>SEQ ID NO: 27266 | QVQLVQSGAEVKKPGASVKVSCKASGYTFTGYYIH WVRQAPGQGLEWMGWINPYSGDTNYAQKFQGRV TMTRDTSISTAYMELSRLRFDDTAVFYCARDWGG YSSYYYGMDVWGQGTTVTVSS<br>SEQ ID NO: 31272 |

FIGURE 50
(Continued)

| | | | | |
|---|---|---|---|---|
| iPS:436620 | 21-225_226H11 | NA | GACATCGTGATGACCCAGTCTCCAGACTCCCTGTCTGCCGGACAAGTCAGGGCATTAGAGACAGTCACCATCACTTGCCGGACAAGTCAGGGCATTAGAAATGATTTAGGCTGGTATCAGCAGAAACCAGGGAAAGCCCCTAAGCGCCTGATCTATGCTGCATCCAGTTTGCAAAGTGGGGTCCCATCAAGGTTCAGTGGCAGTGGATCTGGGACAGATTTCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAATCAAA | CAGGTGCAGTTGGTGGAGTCTGGGGGAGGCGTGGTCCAGCCTGGGAGGTCCCTGAGACTCTCCTGTCAGCGTCTGGATTCACCTTCAGTAACTGTGGCATGCACTGGGTCCGCCAGGCTCCAGGCAAGGGCTGGAGTGGGTGACAGTTATATGGTATGATGGAAGTAATAAATACTATGCAGACTCCGTGAAGGGCCGATTCACCATCTCCAGAGACAATTCCAAGAACACGCTCAGCAGCCTGCAGCCTGAAGATGAACAGCCTGAGAGCCGAGGTGTATTACTGTGCGAGAGAGCTGTATACACGGCTGTGTATTACTGTGCGACTACGGTTTGACGTCTGGGGCCAAGGGACCACCGTCACCGTCTCCTCA |
| | | | SEQ ID NO: 27267 | SEQ ID NO: 31273 |
| | | AA | DIQMTQSPSSLSASVGDRVTITCRTSQGIRNDLGWYQQKPGKAPKRLIYAASSLQSGVPSRFSGSGSGTDFTLTISSLQPEDFATYCLQHYSYPRTFGQGTKVEIK | QVQLVESGGGVVQPGRSLRLSCAASGFTFSNCGMHWVRQAPGKGLEWVTVIWYDGSNKYYADSVKGRFTISRDNSKNTLYLQMNSLRAEDTAVYYCARELYSSWYDYGLDVWGQGTTVTVSS |
| | | | SEQ ID NO: 27268 | SEQ ID NO: 31274 |
| iPS:436622 | 21-225_226A12 | NA | GACATCGTGATGACCCAGTCTCCAGACTCCCTGGCTGTGTCTCTCGGCGAGAGGGCCACCATCAACTGCAAGTCCAGCCAGAGTGTTTTATACAGTTCCAACAATAACAACTACTTAGCTTGGTACCAGCAGAAACCTGGACAGCCTCCTAAGCTCCTGATTTACTGGGCATCTACCCGGGAATCCGGGGTCCCTGACCGATTCAGTGGCAGCGGGTCTGGGACAGATTTCACTCTCACCATCAGCAGCCTGCAGGCTGAAGATGTGGCAGTTTATTACTGTCAGCAATATTATAGTAGTCCTCCGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACAGAAGTTCAGGGCAGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGCCCGTGTATTACTGTTATAGCAGTGGCTGGTACTACTTTGACTACTGGGGCCAGGGAACCCTGGTCACCGTCTCCTCA |
| | | | SEQ ID NO: 27269 | SEQ ID NO: 31275 |

FIGURE 50
(Continued)

| | | AA | DIVMTQSPDSLAVSLGERATINCKSSQNVLYSSN NNNYLAWYQQTPGQPPKLLFYWASTRKSGVPD RFSGSGSGTDFTLTISSLQAEDVAVYYCQQYYSS PPTFGQGTKVEIK<br><br>SEQ ID NO: 27270 | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YYFDYWGQGTLVTVSS<br><br>SEQ ID NO: 31276 |
|---|---|---|---|---|
| iPS:436624 | 21-225_226H12 | NA | GATATTGTGATGACCCAGACTCCACTCTCTCT GTCCGTCACCCCTGGACAGCCGGCCTCCATCT CCTGCAAGTCTAGTAAGACCCTCCTGCATAGT GATGGAAAGACCTTTTTGTATTGGTACCTGCA GAAGCCAGGCCAGCTCCACAGCCCCTGATCT ATGAAATTTCCAACCGGTTCTCTGGAGTGCCA GATAGGTTCAGTGGCAGCGGGTCAGGGACAG ATTTCACACTGAAAATCAGCCGGGTGGAGGCT GAGGATGTTGGGGATTTATTACTGCATGCAAAG TACACAGCTTCCTCGGACGTTCGGCCAAGGGA CCAAGGTGGAAATCAAA<br><br>SEQ ID NO: 27271 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGAAGTTTCAGGGCAG GGTCACCATGACCAGGGACACGTCCATCAGCAC AGCCTACATGGAACTGAGCAGCCTGAGATTTGA CGACAGGCCCGTGTTTACTGTGCGAGAGATTGG GGTGGCTACAGTTCTTACTACTACGGTATGGACG TCTGGGGCCAAGGGACCACGGTCACCGTCTCTC A<br><br>SEQ ID NO: 31277 |
| | | AA | DIVMTQTPLSLSVTPGQPASISCKSSKTLLHSDGK TFLYWYLQKPGQPPQPLIYEISNRFSGVPDRFSGS GSGTDFTLKISRVEAEDVGIYYCMQSTQLPRTFG QGTKVEIK<br><br>SEQ ID NO: 27272 | QVQLVQSGAEVKKPGASVKVSCKASGYTFTFGYIH WVRQAPGQGLEWMGWINPYSGDTNYAQKFQGRV TMTRDTSISTAYMELRRLRFDDTAVFYCARDWGG YSSYYYGMDVWGQGTTVTVSS<br><br>SEQ ID NO: 31278 |

FIGURE 50
(Continued)

| | | | | |
|---|---|---|---|---|
| iPS:436626 | 21-225_227C1 | NA | GATATTGTGATGACCCAGACTCCACTCTCTCTGTCCGTCACCCCTGGACAGCCGGCCTCCATCTCCTGCAAGTCTAGTCAGAGCCTCCTGCATAGTGATGGAAAGACCTTTTTGTATTGGTACCTGCAGAAGCCAGGCCAGCCTCCACAGCTCCTGATCTATGAAAATTTCCAACCGGTTCTCTGGAGTGCCAGATAGGTTCAGTGGCAGCGGGTCAGGGACAGATTTCACACTGAAAATCAGCGGGTGGAGGCTGAGGATGTTGGGGATTTATTACTGCATGCAAAGTACACAGCTTCCTCGGACGTTCGGCCAAGGGACCAAGGTGGAAATCAAA | CAGGTGCAGCTGGTGCAGTCTGGGGCTGAGGTGAAGAAGCCTGGGGCCTCAGTGAAGGTCTCCTGCAAGGCTTCTGGATACACCTTCACGGGCTACTATACACACTGGGTGCGACAGGCCCCTGGACAAGGCTTGAGTGGATGGGATGGATCAACCCTTACAGTGGTGGCACAAACTATGCACAGGAGACACGTTCAGGGCAGGGTCACCATGACCATGGAACTGAGCAGGCTGAGATTTGAAGCCTACACTGTATTACTGTGCGAGAGATTGGCGACACGGCCGTGTACAGTTCTTACTACGGTATGGACGGGTGGCTACAGTTCTTACTACGGTATGGACGTCTGGGGCCAAGGGACCACGGTCACCGTCTCTTCA |
| | | | SEQ ID NO: 27273 | SEQ ID NO: 31279 |
| | | AA | DIVMTQTPLSLSVTPGQPASISCKSSQSLLHSDGKTFLYWYLQKPGQPPQLLIYEISNRFSGVPDRFSGSGSGTDFTLKISRVEAEDVGIYYCMQSTQLPRTFGQGTKVEIK | QVQLVQSGAEVKKPGASVKVSCKASGYTFTGYYTHWVRQAPGQGLEWMGWINPYSGGTNYAQKFQGRVTMTRDTSISTAYMELSRLRFDDTAVYYCARDWGGYSSYYYGMDVWGQGTTVTVSS |
| | | | SEQ ID NO: 27274 | SEQ ID NO: 31280 |
| iPS:436628 | 21-225_227F2 | NA | GATATTGTGATGACCCAGACTCCACTCTCTCTGTCCGTCACCCCTGGACAGCCGGCCTCCATCTCCTGCAAGTCTAGTCAGAGCCTCCTGCATAGTGATGGAAAGACCTTTTTGTATTGGTACCTGCAGAAGCCAGGCCAGCCTCCACAGCTCCTGATCTATGAAAATTTCCAACCGGTTCTCTGGAGTGCCAGATAGGTTCAGTGGCAGCGGGTCAGGGACAGATTTCACACTGAAAATCAGCGGGTGGAGGCTGAGGATGTTGGGGATTTATTACTGCATGCAAAGTACACAGCTTCCTCGGACGTTCGGCCAAGGGACCAAGGTGGAAATCAAA | CAGGTGCACCTGGTGCAGTCTGGGGCTGAGGTGAAGAAGCCTGGGGCCTCAGTGAAGGTCTCCTGCAAGGCTTCTGGATACACCTTCACGGGCTACTATACACACTGGGTGCGACAGGCCCCTGGACAAGGCTTGAGTGGATGGGATGGATCAACCCTTACAGTGGTGACACAAAGTATGCACAGGAGACACGTTCAGGGCAGGGTCACCATGACCAGGGACACGTCATCAGCACAGCCTACATGGAACTGAGCAGGCTGAGATTTGACGACACGGCCGTGTTTTACTGTGCGAGAGATTGGACGGGTGGCTACAGTTCTTACTACTACGGTATGGACGTCTGGGGCCAAGGGACCACGGTCACCGTCTCTTCA |
| | | | SEQ ID NO: 27275 | SEQ ID NO: 31281 |

FIGURE 50
(Continued)

| | | | |
|---|---|---|---|
| iPS:436630 | 21-225_227G3 | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTKVEIK<br>SEQ ID NO: 27276 | QVHLVQSGAEVKKPGASVKVSCKASGYTFTGYYIH WVRQAPGQGLEWMGWINPYSGDTKYAQKFQGRV TMTRDTSISTAYMELSRLRFDDTAVFYCARDWGG YSSYYYGMDVWGQGTTVTVSS<br>SEQ ID NO: 31282 |
| | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGCAGATTTTGCAACT TATTACTGTCTACACCATAATAGTTACCCATTC ACTTTCGGCCCTGGGACCAAAGTGGATATCAA A<br>SEQ ID NO: 27277 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGCAGTCCGTGAAGGCCGAT AATCAATACTATGCAGACTCCGTGAAGGGCCGAT TCACCATCTCAGAGACAATTCCAAGAACACGCT GTATCTGCAAATGAGCAGCCTGAGAGCCGAGGAGA CACGGCTGTGTATTACTGTGCGAGAGAAGTGGGA TTCACTGAGGACTACTGGGGCCAGGGAACCCTG GTCACCGTCTCCTCC<br>SEQ ID NO: 31283 |
| | | AA | DIQMTQSPSSLSASVGDRVTITCRASQGIRNDLG WYQQKPGKAPKRLIYAASSLQSGVPSRFSGSGS GTEFTLTISSLQPADFATYYCLHHNSYPFTFGPGT KVDIK<br>SEQ ID NO: 27278 | QVQLVESGGGVVQPGRSLRLSCAASGFTFSSYGMH WVRQAPGKGLEWVAVIWYVGSNQYYADSVKGRF TISRDNSKNTLYLQMSSLRAEDTAVYYCAREVGFT EDYWGQGTLVTVSS<br>SEQ ID NO: 31284 |

FIGURE 50
(Continued)

| | | | |
|---|---|---|---|
| iPS:436632 | 21-225_227F4 | NA | GACATCCTGATGACCCAGTCTCCATCTTCCGT GTCTGCATCTGTAGGAGACAGAGTCACCATCA CTTGTCGGGCGAGTCAGGGTATTATCAACTGG TTAGCCTGGTATCAGCAGAAACCAGGGAAAG CCCCTAAGCTCCTGATCTATGCGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAATTT ACTATTGTCAACAGGCTAACAGTTCCCGTGG ACGTTCGGCCAAGGGACCAAGGTGGAAATCA AA SEQ ID NO: 27279 | GAGGGGCAGCTATTGGAGTCTGGGGGAGGCTTG GTACAGCCTGGGGGGTCACTGAGACTCTCCTGTA CAGCCTCTGGATTCACCTTTAGCACTTTTGCCATG ACCTGGGTCCGCCAGGCTCCAGGGAAGGGGCTG GAGTGGGTCTCAGTTATTAGTGGTAGAGGTGTA GCTCATTCTACGCAGACTCCGTGAAGGGCCGGTT CACCATCTCCAGAGACAATACCAAGAACACGCT GTATCTGCAAATGAACAGCCTGAGAGCCGAGGA CACGGCCGTATATTACTGTGCAAAGATCAACTA TGGTTTGACTACTGGGGCCAGGGAACCCTGGTCA CCGTCTCCTCA SEQ ID NO: 31285 |
| | | AA | DILMTQSPSSVSASVGDRVTITCRASQGIINWLA WYQQKPGKAPKLLIYAASSLQSGVPSRFSGSGS GTDFTLTISSLQPEDFAIYYCQQANSFPWTFGQG TKVEIK SEQ ID NO: 27280 | EGQLLESGGGLVQPGGSLRLSCTASGFTFSTFAMT WVRQAPGRGLEWVSVISGRGGSSFYADSVKGRFTI SRDNTKNTLYLQMNSLRAEDTAVYYCAKDQLWFD YWGQGTLVTVSS SEQ ID NO: 31286 |
| iPS:436634 | 21-225_227H5 | NA | GACATCCAGATGACCCAGTCTCCATCCTCCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGCTGCCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A SEQ ID NO: 27281 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGACTGGGTGGCAGTTATATGGTATGATGGAAAG TAATAAATACTATGCAGACTCCGTGAAGGGCCG ATTCACCATCTCCAGAGACAATTCCAAGAACACG CTGTATCTGCAAATGAACAGCCTGAGAGCCGAG GACACGGCTATGTATTACTGTGCGAGAGAAGTGG GATTCACTGAGGACTACTGGGGCCAGGGAACCC TGGTCACCGTCTCCTCA SEQ ID NO: 31287 |

FIGURE 50
(Continued)

| | | | |
|---|---|---|---|
| iPS:436636 | 21-225_227E6 | AA | DIQMTQSPSSLSASVGDRVTITCRASQDIRNDLG WYQQKPGKAPKRLIYAASSLQSGVPSRFSGSGS GTEFTLTISSLQPEDFATYYCLQHNSYPFTFGPGT KVDIK | QVQLVESGGGVVQPGRSLRLSCAASGFTFSNYGM HWVRQAPGKGLDWVAVIWYEESNKYYADSVKGR FTISRDNSKNTLYLQMNSLRAEDTAMYYCAREVGF TEDYWGQGTLVTSS |
| | | | SEQ ID NO: 27282 | SEQ ID NO: 31288 |
| | | NA | GACATCGTGATGACCCAGTCTCCAGACTCCCT GACTGTGTCTCTGGGCGAGAGGGCCACCATCA ACTGCAAGTCCAGCCAGAGTGTTTTATACAGC TCCAACGATAAGAACTACTTAGCTTGGTACCA GCAGAAACCAGGACAGCCTCCTAAGATGCTCA TTTACTGGGCATCTCACCCGGGAATCCGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATATTACTCCGTGCAGTTTTGGCCAGGG GACCAAGCTGGAGATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGCACCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCCTATAGCAGT GGCTGGTACAAGTTTGACTACTGGGGCCAGGGA ACCCTGGTCACCGTCTCCTCA |
| | | | SEQ ID NO: 27283 | SEQ ID NO: 31289 |
| | | AA | DIVMTQSPDSLTVSLGERATINCKSSQSVLYSSN DKNYLAWYQQKPGQPPKMLIYWASTRESGVPD RFSGSGSGTDFTLTISSLQAEDVAVYYCQQYYIT PCSFGQGTKLEIK | QVQLVQSGAEVKKPGASVKVSCKASGYTFTNYDIN WVRQATGQGLEWMGWMHPNSGNTGYAQKFQGR VTMTRNTSISTAYMELSSLRSEDTAVYYCAYSSGW YKFDYWGQGTLVTSS |
| | | | SEQ ID NO: 27284 | SEQ ID NO: 31290 |

FIGURE 50
(Continued)

| | | | |
|---|---|---|---|
| iPS:436638 | 21-225_227C7 | NA | GACATCGTGATGACCCAGTCTCCAGACTCCCT GGCTGTGTCTCTGGGCGAGAGGGCCACCATCA ACTGCAGGTCCAGCCAGATTGTTTATCGAC TCCAACAATAACAACTACTTAGCTTGGTACCA GCAGAAACCAGGACAGCCTCCTAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTTCTGTCAGCAA TATTATAGTTCTCCTCCGACGTTCGGCCAAGG GACCAAGGTGGAAATCAAA<br><br>SEQ ID NO: 27285 | CAGGTGCAGCTGGTGCAGTCTGGGGCTGAGGTG AAGAAGCCTAGGGCCTCAGTGAAGGTCTCCTGC AAGGCTTCTGGACACACCTTCACCAATTATGATA TCAACTGGGTGCGACAGGCCACTGGACAAGGC TTGAGTGGATGGGATGGCATCCTAACAGTGG TAACACAGGCTATGCACAGAAGTTCCAGGCAG AGTCACCATGACCAGGAACACCTCCATAAGCAC CGCCTACATGGAGCTGAGCAGCCTGAGATCTGA GGACACGGCCGTGTATTACTGTGCATATAGCAGT GGCTGGTACGCCTTTGACTACTGGGGCCAGGGAA CCCTGGTCACCGTCTCCTCA<br><br>SEQ ID NO: 31291 |
| | | AA | DIVMTQSPDSLAVSLGERATINCRSSQIVLSDSNN NNYLAWYQQKPGQPPNLLIYWASTRESGVPDRF SGSGSGTDFTLTISSLQAEDVAVYFCQQYYSSPP TFGQGTKVEIK<br><br>SEQ ID NO: 27286 | QVQLVQSGAEVKKPRASVKVSCKASGHTFTNYDIN WVRQATGQGLEWMGWMHPNSGNTGYAQKFQGR VTMTRNTSISTAYMELSSLRSEDTAVYYCAYSSGW YRFDYWGQGTLVTVSS<br><br>SEQ ID NO: 31292 |
| iPS:436640 | 21-225_227A8 | NA | GATATTGTGATGACCCAGACTCCACTCTCT GTCCGTCACCCTGGACAGCGCGGCCTCCATCT CCTGCAAGTCTAGTCAGAGCCTCCTGCATAGT GATGGAAAGACCTTTTTGTATTGGTATCTGCA GAAGCCAGGCCAGCCTCCACAGCTCCTGATCT ATGAAAATTTCCAACCGGTTCTCTGGGGTGCCA GATAGGTTCAGTGGCAGCGGGTCAGGGACAG ATTTTCACACTGAAAATCAGTGAGTGAGGCT GAGGATGTTGGAGATTATTACTGCATGCAAAG TACACAGTTCCTCGACGTTCGGCCAAGGGA CCAGGGTGGAAATCAAA<br><br>SEQ ID NO: 27287 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGGGC TTGAGTGGATGGGATGGATCAACCCTTACAGTGG TGACACAAACTATGCACAGAAGTTTCAGGGCAG GGTCACCATGACCAGGGACACGTCCGTCAGCAC AGCCTACATGGAACTGAGCAGCCTGAGATTTGA CGACACGGCCGTGTTTTACTGTGCGAGAGATTGG GGTGGCTACAGTTCTTACTACTACGGTATGGACG TCTGGGGCCAAGGGACCACGGTCACCGTCTCTTC A<br><br>SEQ ID NO: 31293 |

FIGURE 50
(Continued)

| | | | | |
|---|---|---|---|---|
| iPS:436644 | | AA | DIVMTQTPLSLSVTPGQPASISCKSSQSLLHSDGK TFLYWYLQKPGQPPQLLIYEISNRFSGVPDRFSGS GSGTDFTLKISRVEAEDVGIYYCMQSTQLPRTFG QGTRVEIK | QVQLVQSGAEVKKPGASVKVSCKASGYTFTGYYIH WVRQAPGQGLEWMGWINPYSGDTNYAQKFQGRV TMTRDTSVSTAYMELSRLRFDDTAVFYCARDWGG YSSYYYGMDVWGQGTTVTVSS |
| | | | SEQ ID NO: 27288 | SEQ ID NO: 31294 |
| | 21-225_227G9 | NA | GACATCGTGATGACCCAGTCTCCAGACTCCCT GGCTGTGTCTCTGGGCGAGAGGGCCACCATCA ACTGCAAGTCCAGCCAGAGTGTTTACACAGC TCCAACAATAACAAGGATACTTAGCTTGGTATCA GCAGAAACCAGGACAGCCTCCTAAGCTGCTCA TTTACTGGGGATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTGCTCCGTACAGTTTTGGCCAGGG GACCAAGTTGGAGATCAAA | CAGGTGCAGCTGGTGCAGTCTGGGGCTGAGGTG AAGAAGCCTGGGGCTCAGTGAAGGTCTCCTGC AGGGCTTCTGGATACACCTTCACCAATTATGATA TCAACTGGGTGCGACAGGCCACTGGACGAGGGC TTGAGTGGATGGGATGGATGTACCCTAACAGTGG TAACACAGGCTATGCACAGAAGTTCCAGGGCAG AGTCACCATGACCAGGAACACCTCCATAAGCAC AGCCTACATGGAGCTGAGCAGCCTGAGATCTGA GGACACGGCCGTGTATTACTGTGCGCTTAGCAGT GGCTGGTACTGGTTCGACCCCTGGGGCCAGGGA ACCCTGGTCACCGTCCTCTCA |
| | | | SEQ ID NO: 27289 | SEQ ID NO: 31295 |
| | | AA | DIVMTQSPDSLAVSLGERATINCKSSQSVLHSSN NNNYLAWYQQKPGQPPKLLIYWGSTRESGVPD RFSGSGSGTDFTLTISSLQAEDVAVYYCQQYYSA PYSFGQGTKLEIK | QVQLVQSGAEVKKPGASVKVSCRASGYTFTNYDIN WVRQATGRGLEWMGWMYPNSGNTGYAQKFQGR VTMTRNTSISTAYMELSSLRSEDTAVYYCALSSGW YWFDPWGQGTLVTVSS |
| | | | SEQ ID NO: 27290 | SEQ ID NO: 31296 |

FIGURE 50
(Continued)

| | | | |
|---|---|---|---|
| iPS:436646 | 21-225_227D11 | NA | GACATGTGATGACCCAGTCTCCAGACTCCCTGGCTGTGTCTCTGGACGAGAGGGCCACCATCAACTGCAAGTCCAGCCAGAGTGTTTTACACAGTTCCAACAATAATAACTACTTAGCTTGGTACCAGCAGAAGCCAGGACAGCCTCCTAAGCTGCTCATTTACTGGGCATCTACCCGGGAATCCGGGATCCCTGACCGATTCAGTGGCAGCGGGTCTGGGACAGATTTCACTCTCACCATCAGCAGCCTGCAGGCTGAGGATGTGGCAGTTTATTACTGTCAGCAATATTATAATACTCCGTGCAGTTTGGCCAGGGACCAAGCTGGAGATCAAA SEQ ID NO: 27291 |
| | | AA | DIVMTQSPDSLAVSLDERATINCKSSQSVLHSSNNNNYLAWYQQKPGQPPKLLIYWASTRESGIPDRFSGSGSGTDFTLTISSLQAEDVAVYYCQQYYNTPCSFGQGTKLEIK SEQ ID NO: 27292 |
| | | NA | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGCCACTGGACAAGGGCTTGAGTGGATGGGATGGATGCACCCTAACAGTGGTAACACAGGCTATGCACAGAAGTTCCAGGGCAGAGTCACCATGACCAGGAACACCTCCATAAGCACAGCCTACATGGAACTGAGCAGCCTGAGATCTGAGGACACGGCCGTGTATTACTGTGCGTATAGCAGTGGCTGGTACTACTTTGACTACTGGGGCCAGGGAACCCTGGTCACCGTCTCCTCA SEQ ID NO: 31297 |
| | | | QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDYWGQGTLVTVSS SEQ ID NO: 31298 |
| iPS:436648 | 21-225_227F11 | NA | GATGTTGTGATGACTCAGTCTCCACTCCCCTGCCCGTCACCCCTGGAGAGCCGGCCTCCATCTCTGCTCTGGTCTGTAGTCAGAGCCTCCTGCATAGTAATGGATACAACTATTTGGATTGGTACCTGCAGAAGCCAGGCCAGTCTCCACAGGTCCTGATCTATTTGGGTTCTAATCGGGCCTCCGGGGTCCCTGACAGGTTCAGTGGCAGTGGATCAGGCACAGATTTTACACTGAAAATCAGCAGAGTGGAGGCTGAGGATGTTGGGGTTTATTACTGCATGCAAGCTCTACAAACTCCTCTCACCTTCGGCCAAGGGACACGACTGGAGATTAAA SEQ ID NO: 27293 | GAGGTGCAGCTGGTGGAGTCTGGGGGAGGCCTGGTCAAGCCTGGGGGGTCCCTGAGACTCTCCTGTGCAGTCTCTGGATTCACCTTCAGTAGCTACTATAGCATGAACTGGGTCCGCCAGGCTCCAGGGAAGGGGCTGGAGTGGGTCTCATCCATTAGTAGTAGTAGTAGTTACATGTACTACTGCAGACTCCAGGACAAGCAACGCCAAGAACTCACTGTATCTGCAAATGAACAGCCTGAGAGCCGAGGACCTGGGCTGTGTATTACTGTGCAGATTAGGGGTCTACTGGGGCCAGGGAACCCTGGTCACCGTCTCCTCA SEQ ID NO: 31299 |

FIGURE 50
(Continued)

| | | | |
|---|---|---|---|
| iPS:436650 | 21-225_227C12 | AA | DVVMTQSPLSLPVTPGEPASISCWSSQSLLHSNG YNYLDWYLQKPGQSPQVLIYLGSNRASGVPDRF SGSGSGTDFTLKISRVEAEDVGVYCMQALQTP LTFGQGTRLEIK<br>SEQ ID NO: 27294 | EVQLVESGGGLVKPGGSLRLSCAVSGFTFSTYSMN WVRQAPGKGLEWVSSISSSINYMYYADSVKGRFTI SRDNAKNSLYLQMNSLRAEDSAVYYCARLGVYW GQGTLVTVSS<br>SEQ ID NO: 31300 |
| | | NA | GACATCCAGATGACCCAGTCTCCATCCTCCCT GTCTGCATCTGTAGGAGACAGAGTCACCATCA CTTGCCCGGGCAAGTCAGGGACAGATTAGAAATGAT TTAGGCTGGTATCAGCAGAAACCAGGAAAG CCCCTAAGCGCCTGATCTATCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATAATAGTTACCCATTC ACTTTCGGCCCTGGGACCAAAGTGGATATCAA A<br>SEQ ID NO: 27295 | CAGGTGCAGCTGGTGGAGTCTGGGGGAGGCGTG GTCCAGCCTGGGAAGTCCCTGAGACTCTCCTGTG CAGCGTCTGTGATTCACCTTCAGTAACTATGCAT GCACTGGGTCCGCCAGGCTCCAGGCAAGGGGCT GGAGTGGGTGGCAGTTATATGCGACTCCGTGAAGGGCCGAT AATCAATAACTATGCGACTCCGTGAAGGGCCGAT TCACCATCTCAGAGACAATTCCAAGAACACGCT GTATCTGCAAATGAGCAGCCTGAGAGCCGAGA CACGGCTGTGTATTACTGTGCGAGAGAAGTGGGA TTCACTGAGGACTACTGGGGCCAGGGAACCCTG GTCACCGTCTCCTCC<br>SEQ ID NO: 31301 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHNSYPFTFGPGT KVDIK<br>SEQ ID NO: 27296 | QVQLVESGGGVVQPGKSLRLSCAASGFTFSNYGM HWVRQAPKGLEWVAVIWYIGSNQYYADSVKGR FTISRDNSKNTLYLQMSSLRAEDTAVYYCAREVGF TEDYWGQGTLVTVSS<br>SEQ ID NO: 31302 |

FIGURE 50
(Continued)

| | | | |
|---|---|---|---|
| iPS:436652 | 21-225_146B11 | NA | TCCTATGAGCTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCCC<br>TGTGCTGGTCATCTATCAAGATAGCAAGCGGC<br>CCTCAGGGATCCCTGAGGGATTCTCTGGCTCC<br>AACTCTGGGAACACAGCCACTCTGACCATCAG<br>CGGGATCCAGGCTATGGATGAGGCTGACTATT<br>ACTGTCAGGCGTGGGACAGCAGCACTGTGTA<br>TTCGGCGGAGGGACCAAGCTGACCGTCCTA<br><br>SEQ ID NO: 27297 | GAGGTGCAACTGTTGGAGTCTGGGGGAGGCTTG<br>GTACAGCCTGGGGGGTCCCTGAGACTCTCCTGTG<br>CAGCCTTCTGGATTCACCTTTAGCAGCTATGCCAT<br>GAGCTGGGTCCGCCAGGCTCCAGGGAAGGGGCT<br>GGAGTGGGTCTCAGTTATTAGTGGTGGTGGTAGT<br>AGCACATACTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGCGAG<br>GTAACCCCACTGACTACGTATGACGTCTGGGG<br>CCAAGGGACCACGGTCACCGTCTCCTCA<br><br>SEQ ID NO: 31303 |
| | | AA | SYELTQPPSVSVSPGQTASITCSGDKLGDKYASW<br>YQQKPGQSPVLVIYQDSKRPSGIPERFSGSNSGN<br>TATLTISGIQAMDEADYYCQAWDSSTVFGGGT<br>KLTVL<br><br>SEQ ID NO: 27298 | EVQLLESGGGLVQPGGSLRLSCAASGFTFSSYAMS<br>WVRQAPGKGLEWVSVISGGGSSTYYADSVKGRFTI<br>SRDNSKNTLYLQMNSLRAEDTAVYYCAKWRGNPT<br>DYGMDVWGQGTTVTVSS<br><br>SEQ ID NO: 31304 |
| iPS:436654 | 21-225_146C11 | NA | TCCTATGAACTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCCC<br>TGTGCTGGTCATCTATCAAGATAGCAAGCGGC<br>CCTCAGGGATCCCTGAGGGATTCTCTGGCTCC<br>AACTCTGGGAACACAGCCACTCTGACCATCAG<br>CGGGATCCAGGCTATGGATGAGGCTGACTATT<br>ACTGTCAGGCCGTGGGACAGCAGCACTGTGTA<br>TTCGGCGGAGGGACCAAGCTGACCGTCCTA<br><br>SEQ ID NO: 27299 | GAGGTGCAACTGTTGGAGTCTGGGGGAGGCTTG<br>GTACAGCCGGGGGGGTCCCTGAGACTCTCCTGTG<br>CAGCCTCTGGAATCACCTTTAGCAGCTATGCCAT<br>GAGCTGGGTCCGCCAGGCTCCAGGGAAGGGGCT<br>GGAGTGGGTCTCAGTTATTAGTGGTGGTGGTAGT<br>AGCACATACTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGCGAG<br>GTAACCCCACTGACTACGTATGACGTCTGGGG<br>CCAAGGGACCACGGTCACCGTCTCCTCA<br><br>SEQ ID NO: 31305 |

FIGURE 50
(Continued)

| | | | |
|---|---|---|---|
| iPS:436658 | 21-225_146A2 | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGITFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS |
| | | | SEQ ID NO: 27300 | SEQ ID NO: 31306 |
| | | NA | TCCTATGAGCTGACTCAGCCACCCTCAGTGTC CGTGTCCCAGGACAGACCAGCATCACCT GCTCTGAGATAAATTGGGGATAAATATGCT TCCTGGTATCAGCAGAAGCCAGGCCAGTCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGCTGACCGTCCTA | GAGGTGCAACTGTTGGAGTCTGGGGGAGGCCTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTACATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA |
| | | | SEQ ID NO: 27301 | SEQ ID NO: 31307 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYAMS WVRQAPGKGLEWVSVISGGSSTYYADSVKGRFTI SRDNSKNTLHLQMNSLRAEDTAVYYCAKWRGNPT DYGMDVWGQGTTVTVSS |
| | | | SEQ ID NO: 27302 | SEQ ID NO: 31308 |

FIGURE 50
(Continued)

| | | | | |
|---|---|---|---|---|
| iPS:436660 | 21-225_146D8 | NA | CAGTCTGTACTGACTCAGCCACCTCAACGTC TGGGACCCCGGGCAGAGGGTCACCATCTCT TGTTCTGGAAGCAGCTCCTACATCGGAAGTAAT ACTGTAGACTGGTACCAGCAGCTCCCAGGAAC GGCCCCCAAACTCCTCATCTATAGTAATAATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTGCAGCATGGGATGACAGCCTT AATGGCGTGGTATTCGGCGGAGGGACCAAACT GACCGTCCTA | GAGGTGCAGCTGGTGGAGTCTGGGGGAGGCTTG GTACAGCCTGGGGGGTCCCTGAGACTCTCCTGTG CAGCCTCTGATTCACCTTCAGTAACTATAACAT GAACTGGGTCCGCCAGGCTCCAGGGAAGGGGCT GGAGTGGGTTTCATACATTAGTAGAAGTAGTAAT ACCAAATACTATGTAGACTCTGTGAAGGGCCGAT TCACCATCTCCAGAGACAATGCCAAGAACTCATT GTATCTGCAAATGAACAGCCTGAGAGACGAGGA CACGGCTGTGTATTACTGTGCGAGAGATAGGAGT GGGAGTCACGGGTACTTCTACTACTACGGTTTGG ACGTCTGGGGCCAAGGGACCACGGTCACCGTCTC CTCA |
| | | | SEQ ID NO: 27303 | SEQ ID NO: 31309 |
| | | AA | QSVLTQPPSTSGTPGQRVTISCSGSSSYIGSNTVD WYQQLPGTAPKLLIYSNNQRPSGVPDRFSGSKS GTSASLAISGLQSEDEADYYCAAWDDSLNGVVF GGGTKLTVL | EVQLVESGGGLVQPGGSLRLSCAASGFTFSNYNMN WVRQAPGKGLEWVSYISRSSNTKYYVDSVKGRFTI SRDNAKNSLYLQMNSLRDEDTAVYYCARDRSGSY GYFYYYGLDVWGQGTTVTVSS |
| | | | SEQ ID NO: 27304 | SEQ ID NO: 31310 |
| iPS:436662 | 21-225_147D7 | NA | TCCTATGAGTTGACTCAGCCACCTCAGTGTC CGTGTCCCCAGGACAGACAGCCAGCATCACCT CTCTGGAGATAAATTGGGGATAAATTTGCT GCTGGTATCAGCAGAAACCAGGCCAGTCCCC TGTACTGGTCATCTATCAAGATAGGAAGCGGC CCTCAGGGATCCTGAGCGATTCTCTGGCTCC AACTCTGGGAACACAGGCCACTCTGACCATCAG CGGGACCCAGGCTGTATGATGAGGCTGACTATT ACTGTCAGGCGTGGGACACGGAACACCGCTGTC TTCGGAACTGGGACCAAGGTCACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGATGAACCTAATAGTGG TAACACAGGCTATGCACAGAAGTTCCAGGGCAG AGTCACCATGACCAGGAACACCTCCATAAGCAC AGCCTATATGGAGCTGAGAAGCTGAGATCTGA GGACACGCCGTGTATTACTGTGCGAGAGCGGA TATTGTATTAGTACCAGCTGCTATCCTTATAATT ACTACTTCGCTATGGACGTCTGGGGCCAAGGGAC CACGGTCACCGTCTCCTCA |

FIGURE 50
(Continued)

| | | | | |
|---|---|---|---|---|
| iPS:436664 | 21-225_147E7 | AA | SEQ ID NO: 27305<br>SYELTQPPSVSVSPGQTASITCSGDKLGDKFACW<br>YQQKPGQSPVLVIYQDRKRPSGIPERFSGSNSGN<br>TATLTISGTQAMDEADYYCQAWDRNTAVFGTG<br>TKVTVL<br>SEQ ID NO: 27306 | SEQ ID NO: 31311<br>QVQLVQSGAEVKKPGASVKVSCKASGYTFTSYDIN<br>WVRQATGQGLEWMGWMNPNSGNTGYAQKFQGR<br>VTMTRNTSISTAYMELRSLRSEDTAVYYCARADIV<br>LVPAAIPYNYFAMDVWGQGTTVTSS<br>SEQ ID NO: 31312 |
| | | NA | TCCTATGAGCTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCC<br>TGTGCTGGTCATCTATCAAGATAGCAAGGCGC<br>CCTCAGGGATCCCTGAGCGATTCTCTGGCTCC<br>AACTCTGGGAACACAGCCACTCTGACCATCAG<br>CGGGATCCAAGGCTATGGATGAGGCTGACTATT<br>ACTGTCAGGCGTGGGACAGCAGCACTGTGGTA<br>TTCGGCGGAGGGACCAAGCTGACCGTCCTA | GAGGTGCAACTGTTGGAGTCTGGGGGAGGCTTG<br>GTACAGCCTGGGGGGTCCCTGAGACTCTCCTGTG<br>CAGCCTCTGGATTCACCTTTAGCAGCTATGCCAT<br>GAGCTGGGTCCGCCAGGCTCCAGGGAAGGGGCT<br>GGAGTGGGTCTCAGTTATTAGTGGTGGTGGTAGT<br>AGTACATACTACGCAGACTCCGTGAAGGGCCGG<br>TTCACCCTCTCCAGAGACAATTCCAAGAACACGC<br>TGTATCTGCAAATGAACAGCCTGAGAGCCGAGG<br>ACACGGCCGTTTTTACTGTGCGAAATGGGCGAGG<br>TAACCCCACTGACTACGGTATGGACGTCTGGGGC<br>CAAGGGACCACGGTCACCGTCTCCTCA |
| | | AA | SEQ ID NO: 27307<br>SYELTQPPSVSVSPGQTASITCSGDKLGDKYASW<br>YQQKPGQSPVLVIYQDSKRPSGIPERFSGSNSGN<br>TATLTISGIQAMDEADYYCQAWDSSTVVFGGGT<br>KLTVL<br>SEQ ID NO: 27308 | SEQ ID NO: 31313<br>EVQLLESGGGLVQPGGSLRLSCAASGFTFSSYAMS<br>WVRQAPGKGLEWVSVISGGGSSTYYADSVKGRFT<br>LSRDNSKNTLYLQMNSLRAEDTAVFYCAKWRGNP<br>TDYGMDVWGQGTTVTSS<br>SEQ ID NO: 31314 |

FIGURE 50
(Continued)

| | | | | |
|---|---|---|---|---|
| iPS:436666 | 21-225_147B8 | NA | TCCTATGAACTGACTCAGCCACCTCAGTGTCCGTGTCCCCAGGACAGACAGCCAGTATCACCTGCTCTGGAGATAAATTGGGGGATAAATATGTTTGCTGGTATCAGCAGAAGCCAGGCCAGTCCCCTGAGCTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGGACAGTAACACTGTGTGGTATTCGGCGGAGGGACCAAGCTGACCGTCCTA | CAGGTGCAGCTGGTGCAGTCTGGGGCTGAGGTGAAGAAGCCTGGGGCCTCAGTGAAGGTCTCTGCAAGGCTTCTGGATACACCTTCACCGACTACTATTTGCACTGGGTGCGACAGGCCCCTGGACAAGGGCTTGAGTGGATGGGATGGATCAACCCTAACAGTGGTGACACAAACTATGCACAGGAGACACGTCCATCAGCACGGTCACCATGACCAGGGACACGTCCATCAGCACAGCCTACATGGAGCTGAGCAGGCTGAGATCTGAGACACGGCCGTGTATTACTGTGCGAGAGATCGGGACTCGGTTCGGGGAGTTACCCCTACTACTACTACGGTATGGACGTCTGGGGCCAAGGGACCACGGTCACCGTCTCCTCA |
| | | | SEQ ID NO: 27309 | SEQ ID NO: 31315 |
| | | AA | SYELTQPPSVSVSPGQTASITCSGDKLGDKYVCWYQQKPGQSPELVIYQDRKRPSGIPERFSGSNSGNTATLTISGTQAMDEADYYCQAWGSNTAVVFGGGTKLTVL | QVQLVQSGAEVKKPGASVKVSCKASGYTFTDYYLHWVRQAPGQGLEWMGWINPNSGDTNYAQKFQGRVTMTRDTSISTAYMELSRLRSDDTAVYYCARDRDSGSGSYPYYYYYGMDVWGQGTTVTVSS |
| iPS:436668 | 21-225_147B9 | NA | TCCTATGAGCTGACTCAGCCACCCTCAGTGTCCGTGTCCCCAGGACAGACAGCCAGCATCACCTGCTCTGGAGATAAATTGGGGGATAAATATGTTTCCTGGTATCAGCAGAAGCCAGGCCAGTCCCCTGTGCTGGTCATCTATCAAGATAGGAAGCGGCCCTCAGGGATCCCTGAGCGATTCTCTGGCTCCAACTCTGGGAACACAGCCACTCTGACCATCAGCGGGACCCTGGCCGTGGGACACAGCAGCACTTTTGTGACTGTCTGGCGTGGGAGGGACCAAGTTGACCGTCCTA | CAGGTGCAGTTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGTGACTACGGTGACCCCCCTACTACTACTACGGTCTACGGTATGGACGTCTGGGGCCAAGGGACCACGGTCACCGTCTCCTCA |
| | | | SEQ ID NO: 27310 | SEQ ID NO: 31316 |

FIGURE 50
(Continued)

| | | | |
|---|---|---|---|
| iPS:436670 | 21-225_147D9 | AA | SEQ ID NO: 27311<br>SYELTQPPSVSVSPGQTASITCSGDKLGDKYVSW YQQRPGQSPVLVIYQDRKRPSGIPERFSGSNSGN TATLTISGTLAVDEADYYCLAWDSSTFVVFGGG TKLTVL<br>SEQ ID NO: 27312 | SEQ ID NO: 31317<br>QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS<br>SEQ ID NO: 31318 |
| | | NA | TCCTATGAGCTGACTCAGCCACCCTCAGTGTC CGTGTCCCCAGGACAGACAGCCAGCATCACCT CCTGTGAGATAAATTGGGTAATAAATATGTT TGCTGGTATCAGCAGAGGCCAGGCCAGTCCCC TGTGCTGGTCATCTATCAAGATAGCAAGCGGC CCTCAGGGATCCCTGAGCGATTCTCTGGCTCC AACTCGGGAACACAGCCACTCTGACCATCAG CGGGACCCAGGCTATGAGGCTGACTATT ACTGTCAGGCGTGGACAGGAACACTTATGTG GTGTTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGATATAGTAGACTCCGTGAGT AATAAATACTATATGTAGACTCCGTGAAGGACCGAT TCACCATCTCCAGAGACAATTCCAAGAACACGCT GTATCTGCAAATGAACAGCTGAGAGCCGAGGA CACGGCTGTTTATTACTGTGCGAGAGATCGGGTG GAGGGTTCGGGGACTCCCTACTACTACTACGTA TGGACGTCTGGGGCCAAGGGACCACGGTCACCG TCTCCTCA |
| | | AA | SEQ ID NO: 27313<br>SYELTQPPSVSVSPGQTASITSSGDKLGNKYVCW YQQRPGQSPVLVIYQDSKRPSGIPERFSGSNSGN TATLTISGTQAMDEADYYCQAWDRNTYVVFGG GTKLTVL<br>SEQ ID NO: 27314 | SEQ ID NO: 31319<br>QVQLVESGGGVVQPGRSLRLSCAASGFTFSSYGMH WVRQAPGKGLEWVADIWFDGSNKYYVDSVKDRF TISRDNSKNTLYLQMNSLRAEDTAVYYCARDRVEG SGTPYYYYGMDVWGQGTTVTVSS<br>SEQ ID NO: 31320 |

FIGURE 50
(Continued)

| iPS:436672 | 21-225_147F9 | NA | TCCTATGAGCTGACTCAGCCACCCTCAGTGTC CGTGTCCCAGGAGACAGAGCCAGCATCACCT GTTCTGGAGATGAATTGGGGAATAAATATGCT TGCTGGTATCAGCAGAAGCCAGGCCAGTCCCC TGTGCTGGTCATCTATCAAGATAGCAAGCGGC CCCTCAGGGATCCCGAGCGATTCTCTGGCTCC AACTCTGGAAACACAGCCACTCTGACCATCAG CGGGACCCAGGCTATGGATGAGGCTGACTATT ACTGTCAGGGCTGCCACAGCAGCACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTATATGGTATGGTGAAGT GATAAAGACTATGCAGACTCCGTGAAGGGCCGA TTCACCATCTCCAGAGACAATTCCAAGAACACGC TGTATCTGCAAATGAACAGCTGAGAGCCGAGG ACACGCTGTGTATTACTGTGCGAGAGATCGGGA TTATTGTAGTTGGTGTACTTGTCCTTACTACTACT ACTACGTATGGACGTCTGGGGCCAAGGGACCA CGGTCACCGTCTCCTCA |
| | | | SEQ ID NO: 27315 | SEQ ID NO: 31321 |
| | | AA | SYELTQPPSVSVSPGQTASITCSGDELGNKYACW YQQKPGQSPVLVIYQDSKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGTCPYYYYYGMDVWGQGTTVTVSS |
| | | | SEQ ID NO: 27316 | SEQ ID NO: 31322 |

FIGURE 50
(Continued)

| iPS:436674 | 21-225_147G9 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCC TGTGTCTGGTCATCTATCAAGATAGGAAGCGGC CCTCAGGGATCCCGAGCGATTCTCTGGCTCC AACTCTGGGAACACAGCCACTCTGACCATTAG CGGAGACCAGGCTATGGCACAGAGCTGGTA ACTGTCAGGGTGCACAGCAGTACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTATATGGTATGGTGAAGT GATAAAGACTATGCAGACTCCGTGAAGGGCCGA TTCACCATCTCCAGAGACACATTCCAAGAACACGC TGTATCTGCAAATGAACAGCCTGAGAGCCGAGG ACACGGCTGTGTATTACTGTGCGAGAGATCGGGA TTATTGTAGTGGTGGTAGCTGCCCTTACTACTACT ACTACGGTATGGACGTCTGGGGCCAAGGGACCA CGGTCACCGTCTCCTCA |
| | | | SEQ ID NO: 27317 | SEQ ID NO: 31323 |
| | | AA | SYELTQPPSVSVSPGQTASITCSGDKLGDKYACW YQQKPGQSPVLVIYQDRKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGSCPYYYYYGMDVWGQGTTVTVSS |
| | | | SEQ ID NO: 27318 | SEQ ID NO: 31324 |

FIGURE 50
(Continued)

| | | | |
|---|---|---|---|
| iPS:436676 | 21-225_147E11 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGATTCACCTTTAGCAACTATGTCAT GAGCTGGGTCCGCCAGGCTCCAGGGAAGGGCT GGAGTGGGTCTCAGTTATTAGTGGTGGTAGT AGTACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA |
| | | | SEQ ID NO: 27319 | SEQ ID NO: 31325 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVFGGGT KLTVL | EVQLLESGGGLVQPGGSLRLSCAASGFTFSNYVMS WVRQAPGKGLEWVSVISGGSSTYYADSVKGRFTI SRDNSKNTLYLQMNSLRAEDTAVYYCAKWRGNPT DYGMDVWGQGTTVTVSS |
| | | | SEQ ID NO: 27320 | SEQ ID NO: 31326 |
| iPS:436678 | 21-225_147B12 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTGGTCATCTATCAAGATAGCAAGCGGC CCTCAGGGATCCCTGAGCGATTCTCTGGCTCC AACTCTGGGAACGCAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGATTCACCTTTAGCAGTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA |
| | | | SEQ ID NO: 27321 | SEQ ID NO: 31327 |

FIGURE 50
(Continued)

| | | | |
|---|---|---|---|
| iPS:436680 | 21-225_147H12 | AA | SYELTQPPSVSVSPGQTASITCSGDKLGDKYASWYQQKPGQSPVLVIYQDSKRPSGIPERFSGSNSGNAATLTISGIQAMDEADYYCQAWDSSTVFGGGTKLTVL | EVQLLESGGGLVQPGGSLRLSCAASGFTFSSYAMSWVRQAPGKGLEWVSVISGGGSTYYADSVKGRFTISRDNSKNTLYLQMNSLRAEDTAVYYCAKWRGNPTDYGMDVWGQGTTVTVSS |
| | | | SEQ ID NO: 27322 | SEQ ID NO: 31328 |
| | | NA | CAGTCTGTGTTGACTCAGCCACCCTCAGCGTCTGGGACCCCGGGCAGCAGTCCAACATCGGAAGTTATGTTCTGGAAGCAGCTCCAACATCGGAAGTTATGCTGTAAACTGGTATCAGCAGCTCCCAGGAACGGCCCCCAAACTCCTCATTTATAGTAATAATCACCGGCCCTCAGGGGTCCCTGACCGATTCTCTGGCTCCAAGTCTGGCACCTCAGCCTCCCTGGCCATCAGTGGGCTCCAGTCTGAAGCATGGGATGACAGCTGATTATTACTGTGCGGTATTCGGCGGAGGGACCAAGCTGACCGTCCTA | CAGGTGCAGCTGCAGGAGTCGGGCCCAGGACTGGTGAATCCTCACAGACCCTGTCCCTCACCTGCGCTGTCTCTGGTGGCTCCATCAGCAGTGGTTATTACCACTGGAGCTGGATCCGCCAGCACCCAGGGAAGGGCCTGGAGTGGATTGGGTACATCTATTACAGTGGGAGCACCTACTACAACCCGTCCCTCAAGAGTCGAGTTACCATATCAGTTGACACGTCTAAGAACCAGTTCTCCCTGAAGCTGACCTCTGTGACTGCCGCGGACACGGCCGTGTATTACTGTGCGAGAGATTGGGGTGGCTACGATTCGAGTGGCGTGGTTCGACCCTGGGGCCAGGGAACCCTGGTCACCGTCTCCTCA |
| | | | SEQ ID NO: 27323 | SEQ ID NO: 31329 |
| | | AA | QSVLTQPPSASGTPGQRVTISCSGSSSNIGSYAVNWYQQLPGTAPKLLIYSNNHRPSGVPDRFSGSKSGTSASLAISGLQSEDEADYYCEAWDDSLNGPVFGGGTKLTVL | QVQLQESGPGLVNPSQTLSLTCAVSGGSISSGYYHWSWIRQHPGKGLEWIGYIYYSGSTYYNPSLKSRVTISVDTSKNQFSLKLTSVTAADTAVYYCARDWGGYDSSGWFDPWGQGTLVTVSS |
| | | | SEQ ID NO: 27324 | SEQ ID NO: 31330 |

FIGURE 50
(Continued)

| | | | | |
|---|---|---|---|---|
| iPS:436682 | 21-225_146A8 | NA | CAGTCTGTGCTGACTCAGCCACCCTCAGCGTC TGGGACCCCCGGGCAGAGCTCCAACATCGGAAGTAAT GTTCTGGAAGCAGCTCCAACATCGGAAGTAAT TCTATAAACTGGTACCAGCAACTCCAAGAAC GGCCCCAAACTCCTCATCTATAGTAATGATC AGCGGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTGCAGCATGGGATGACAGCCTA AACGGCGTGGTATTCGGCGGAGGGACCAAGC TGACCGTCCTA | GAGGTGAAGCTGGTGGAGTCTGGGGGAGGCTTG GTACAGCCTGGGGAGTCCTGAGACTCTCCTGTG TAGCCTCTGGATTCACCTTCAGTAACTATAACAT GAACTGGGTCCGCCAGGCTCCAGGGAAGGACT GGAGTGGGTTTCATACATTAGTAGAAGTAGTAAT ACCAAATACTACGCAGACTCTGTGAGGGCCGA TTCACCATCTCCAGAGACAATGCCAAGAATTCAC TATATCTGCAAATGAACAGCCTGAGAGACGAGG ACACGGCTGTGTATTACTGTGCGAGAGATAGGAG TGGGAGCTACGGGTACTTCTACTACGGTTTG GACGTCTGGGGCCAAGGGACCACGGTCACCGTC TCCTCA |
| | | | SEQ ID NO: 27325 | SEQ ID NO: 31331 |
| | | AA | QSVLTQPPSASGTPGQRVTISCSGSSSNIGSNSIN WYQQLPRTAPKLLIYSNDQRPSGVPDRFSGSKSG TSASLAISGLQSEDEADYYCAAWDDSLNGVVFG GGTKLTVL | EVKLVESGGGLVQPGESLRLSCVASGFTFSNYMN WVRQAPGKGLEWVSYISRSSNTKYYADSVRGRFTI SRDNAKNSLYLQMNSLRDEDTAVYYCARDRSGSY GYFYYGLDVWGQGTTVTVSS |
| | | | SEQ ID NO: 27326 | SEQ ID NO: 31332 |
| iPS:436684 | 21-225_146B6 | NA | CAGTCTGTGCTGACTCAGCCACCCTCAGCGTC TGGGACCCCCGGGCAGAGCTCCAACATCGGAAGTAAT GTTCTGGAAGCAGCTCCAACATCGGAAGTAAT GCTGTAAACTGGTACCAGCAGCTCCCAGGAAC GGCCCCCAAACTCCTCATCTATAGTAATAATC AGCGGCCCTCAGGGGTCCCTGACCGGTTCTCT GGCTCCAAGTCTGGCACCTCAGCTCCCTGGC CATCAGTGGGCTCCAGTCTGAGGATGAGGCTG ATTATTACTGTGCAGCATGGGATGACAGCCTG AATGGCGTGGTATTCGGCGGAGGGACCAAGCT GACCGTCCTA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGTACATAACAT GAACTGGGTCCGCCAGGCTCCAGGGAAGGGGCT GGAGTGGGTTTCATACATTAGTAGAAGTAGTAAT ACCAAACACTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGCGAGAGATAGGAG TGGGAGCTACGGGTACTTCTACTACGGTTTG GACGTCTGGGGCCAAGGGACCACGGTCACCGTC TCCTCA |
| | | | SEQ ID NO: 27327 | SEQ ID NO: 31333 |

FIGURE 50
(Continued)

| | | | |
|---|---|---|---|
| iPS:436686 | 21-225_148G6 | AA | QSVLTQPPSASGTPGQRVTISCSGSSSNIGSNAVN WYQQLPGTAPKLLIYSNNQRPSGVPDRFSGSKS GTSASLAISGLQSEDEADYYCAAWDDSLNGVF GGGTKLTVL | EVQLVESGGGLVQPGGSLRLSCAASGFTFSSYNMN WVRQAPGKGLEWVSYISRSSNTKHYADSVKGRFTI SRDNAKNSLYLQMDSLRDEDTAVYYCARDRSGSY GYFYYGLDVWGQGTTVTVSS |
| | | | SEQ ID NO: 27328 | SEQ ID NO: 31334 |
| | | NA | TCCTATGAGCTGACTCAGCCACCCTCAGTGTC CGTGTCCCCAGGACAGAGACAGCATCACCT GCTCTCTGGAGATAAATTGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATATGCCAT GAGCTGGGTCCGCCAGGCTCCAGGAAGGGGCT GGAGTGGGTCTCAGTTATTAGTGTGTGGTAGT AGCACATACTACGCAGACTCCGTGAAGGGCCGG TTCACCATCTCCAGAGACAATTCCAAGAACATGC TGCATCTGCAAATGAACAGCCTGAGAGCCGAG ACACGGCCGTATATTACTGTGCGAAATGGCAG GTAACCCCACTGACTACGGTATGGACGTCTGGGG CCAAGGGACCACGGTCACCGTCTCCTCA |
| | | | SEQ ID NO: 27329 | SEQ ID NO: 31335 |
| | | AA | SYELTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYAMS WVRQAPGKGLEWVSVISGGGSSTYYADSVKGRFTI SRDNSKNMLHLQMNSLRAEDTAVYYCAKWRGNP TDYGMDVWGQGTTVTVSS |
| | | | SEQ ID NO: 27330 | SEQ ID NO: 31336 |

FIGURE 50
(Continued)

| | | NA | TCCTATGAGCTGACTCAGCCCGCCCTCAGTGTC CGTGTCCCCAGGACAGACAGCAGCAGCATCACCT GCTCTGGAGATAAATTGGGGATAAATATGTT TCCTGGTATCAGCAGAAGCCAGGCCAGTCCCC TATACTGGTCATCTATCAAGATAGGAAGGGC CCTCAGGGACCCCTGAGCGATTCTCTGGCTCC AACTCTGGGAACACAGCCACTCTGACCATCAG CGGGACCCAGGCTATGGATGAGGCTGATTATT ACTGTCTGCGCTGGGACAGCAGCACTTTTGTG GTATTCGGCGGAGGGACCAAGTTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGTGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGTGA CTACGGTGACCCCCCTACTACTACTACGGT ATGGACGTCTGGGGCCAAGGGACCACGGTCACC GTCTCCTCA |
| iPS:436688 | 21-225_148C8 | | SEQ ID NO: 27331 | SEQ ID NO: 31337 |
| | | AA | SYELTQPPSVSVSPGQTASITCSGDKLGDKYVSW YQQKPGQSPILVIYQDRKRPSGTPERFSGSNSGN TATLTISGTQAMDEADYYCLAWDSSTFVVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS |
| | | | SEQ ID NO: 27332 | SEQ ID NO: 31338 |
| | | NA | TCCTATGAGCTGACTCAGCCACCCTCAGTGTC CGTGTCCCCAGGACAGACAGCAGCAGCATCACCT GTTCTGGAGATAAATTGGGGAATAAATATGT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGGCCACTCTGACCATCAG CGGGACCCAGGCCGTGCACAGCAGCACTGTGTA ACTGTCAGGGCGTGGCACAGCAGCACTGTGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGTGAAGT GATAAAGACTATGCAGACACATTTCCAAGAACACGC TTCACCATCTCCAGAGACACATTTCCAAGAACACGC TGTATCTGCAAATGAACAGCCTGAGAGCCGAGG ACACGGCTGTGTATTACTGTGCGAGAGATCGGGA TTATTGTAGTGGTGGTACTTGTCCTTACTACTACT ACTACGGTATGGACGTCTGGGGCCAAGGGACCA CGGTCACCGTCTCCTCA |
| iPS:436690 | 21-225_148A9 | | SEQ ID NO: 27333 | SEQ ID NO: 31339 |

FIGURE 50
(Continued)

| | | AA | SYELTQPPSVSVSPGQTASITCSGDKLGNKYVCW YQQKPGQSPVLVIYQDSKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVIWYGGSDKDYADSVKGRF TISRDISKNTLYLQMNSLRAEDTAVYYCARDRDYC SGGTCPYYYYGMDVWGQGTTVTVSS |
| | | | SEQ ID NO: 27334 | SEQ ID NO: 31340 |
| iPS:436694 | 21-225_148G11 | NA | TCCTATGAGCTGACTCAGCCACCCTCAGTGTC CGTGTCCCCAGGACAGACAGCCAGCATCACCT GCTCTGGAGATAAATTGGGGATAAATTTGCT TCCTGGTATCAGCAGAAGCCAGGCCAGTCCCC TGTGCTCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATCCAT GAGCTGGGTCCGCCAGGCTCCCGGGAAGGGCT GGAGTGGGTCTCAGTTATTAGTGGTGGTGGTAGT AGTGCATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA |
| | | | SEQ ID NO: 27335 | SEQ ID NO: 31341 |
| | | AA | SYELTQPPSVSVSPGQTASITCSGDKLGDKFASW YQQKPGQSPVLVIYQDSKRPSGIPERFSGSNSGN TATLTISGIQAMDEADYYCQAWDSSTVVFGGGT KLTVL | EVQLLESGGGLVQPGGSLRLSCAASGFTFSSYPMS WVRQAPGKGLEWVSVISGGGSSAYYADSVKGRFTI SRDNSKNTLYLQMNSLRAEDTAVYYCAKWRGNPT DYGMDVWGQGTTVTVSS |
| | | | SEQ ID NO: 27336 | SEQ ID NO: 31342 |

FIGURE 50
(Continued)

| | | | |
|---|---|---|---|
| iPS:436696 | 21-225_149A1 | NA | CAGTCTGTCTGCTGACTCAGCCACCTCAGCGTC TGGGACCCCGGGCAGAGGGTCACCATCTCTT GTTCTGGAAGCAGCTCCAACATCGGAAGTAAT GCTGTAAACTGGTACCAGCAGCTCCCAGGAAC GGCCCCAAACTCCTCATCTATAGTAATAATC AGCGGCCCTCAGGGGTCCCTGACCGGTTCTCT GGCTCCAAGTCTGGCACCTCAGCCTCCTGGC CATCAGTGGGCTCCAGTCTGAGGATGAGGCTG ATTATTACTGTGCAGCATGGGATGACAGCCTG AATGGCGTGGTATTCGGCGGAGGGACCAAGCT GACCGTCCTA | GAGGTGCAGCTGGTGGAGTCTGGGGGAGGCTTG GTACAGCCTGGGGGGTCCCTGAGACTCTCCTGTG CAGCCTCTGATTCACCTTCAGTAGTCATAACAT GAACTGGGTCCGCCAGGCTCCAGGGAAGGGGCT GGAGTGGGTTTCATACATTAGTAGAAGTAGTAAT ACCAAACACTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGCGAGAGATAGGAG TGGGAGCTACGGGTACTTCTACTACGGTTTG GACGTCTGGGGCCAAGGGACCACGGTCACCGTC TCCTCA |
| | | | SEQ ID NO: 27337 | SEQ ID NO: 31343 |
| | | AA | QSVLTQPPSASGTPGQRVTISCSGSSSNIGSNAVN WYQQLPGTAPKLLIYSNNQRPSGVPDRFSGSKS GTSASLAISGLQSEDEADYYCAAWDDSLNGVVF GGGTKLTVL | EVQLVESGGGLVQPGGSLRLSCAASGFTFSSYNMN WVRQAPGKGLEWVSYISRSSNTKHYADSVKGRFTI SRDNAKNSLYLQMNSLRDEDTAVYYCARDRSGSY GYFYYGLDVWGQGTTVTVSS |
| | | | SEQ ID NO: 27338 | SEQ ID NO: 31344 |
| iPS:436698 | 21-225_149B5 | NA | TCCTATGAACTGACTCAGCCACCCTCAGTGTC CGTGTCCCCAGGACAGACAGCCAGCATCACCT GCTCTGGATATAAATTGGGGTATAAATATGTT TGCTGGTATCAGCAGAAGCCAGGCCAGTCCCC TGTACTGGTCATCTTTCAAAATAACCAGCGGC CCTCAGGGATCCCTGAGCGATTCTCTGGCTCC AACTCTGGGAACACAGCCTCTCTGACCATCAG CGGGACCCAGGCTGTGGGACAGCAGCACTGTGGTA ACTGTCAGGGCGTGGGACGTGACCGTCCTA | GAGGTGCAGCTGGTGGAGTCTGGGGGAGGCTTG GTCCAGCCTGGGGGGTCCCTGAGACTCTCCTGTG CAGCCTCTGGATTCACCTTTAGTGGCTATTGGAT GAACTGGGTCCGCCAGGCTCCAGGGAAGGGGCT GGAGTGGGTGGCCAACATAAAGCAAGATGAAG TGAGAAATACTATGTGGACTCTGTGAAGGGCCGA TTCACCATCTCCAGAGACAACGCCAAGAATTCAC TGTATCTGCAAATGAACAGCCTGAGAGCCGAGG ACACGGCTGTGTATTACTGTGCGAGAGGGATGTA TAGCAGTGGCTGGTACGTCTTTGACTACTGGGGC CAGGGAACCCTGGTCACCGTCTCCTCA |
| | | | SEQ ID NO: 27339 | SEQ ID NO: 31345 |

FIGURE 50
(Continued)

| | | | | |
|---|---|---|---|---|
| iPS:436700 | 21-225_149C7 | AA | SYELTQPPSVSVSPGQTASITCSGYKLGYKYVCW YQQKPGQSPVLVIFQNNQRPSGSNSGN TASLTISGTQAMDEADYYCQAWDSSTVFGGG TKLTVL | EVQLVESGGGLVQPGGSLRLSCAASGFTFSGYWM NWVRQAPGKGLEWVANIKQDGSEKYYVDSVKGR FTISRDNAKNSLYLQMNSLRAEDTAVYYCARGMY SSGWYVFDYWGQGTLVTVSS |
| | | | SEQ ID NO: 27340 | SEQ ID NO: 31346 |
| | | NA | TCCTATGAGCTGACTCAGCCACCCTCAGTGTC CGTGTCCCAGGACAGACAGCCAGCATCACCT GCTCTCTGAAATAAATTGGGGATAAATATGCT TCCTGGTATCAGCAGAAGCCAGGCCAGTCCC TGTGCTGGTCATCTATCAAGATAGCAAGCGGC CCTCAGGGATCCCTGAGCGATTCTCTGGCTCC AAGTCTGGGAACACAGGCTATGATGAGGCTGACTATT ACTGTCAGGCGTGGGACAGCAGCACTGTGGTA TTCGGCGGAGGGACCAAGCTGACCGTCCCA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCACTGACTACGGTATGGACGTCTGGGG CCAAGGGACCACGGTCACCGTCTCCTCA |
| | | | SEQ ID NO: 27341 | SEQ ID NO: 31347 |
| | | AA | SYELTQPPSVSVSPGQTASITCSGNKLGDKYASW YQQKPGQSPVLVIYQDSKRPSGIPERFSGSKSGN TATLTISGIQAMDEADYYCQAWDSSTVFGGGT KLTVP | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS |
| | | | SEQ ID NO: 27342 | SEQ ID NO: 31348 |

FIGURE 50
(Continued)

| | | | |
|---|---|---|---|
| iPS:436702 | 21-225_149E8 | NA | CAGGCTGTGTCGACTCAGCCGTTCCCTCTCT<br>GCATCTCCTGAGCATCAGCCAGTCTCACCTG<br>CACCTTACGCAGTGGCATCATCGTGTTACTACCT<br>ATAGGATATACTGGTACCAGCAGAAGCCAGG<br>GAGTCCTCCCAGTTTCTCTGCGTACACATC<br>AGACTCAGATAAACACCAGGGCTCTGGAGTCC<br>CCAGCCGCTTCTCTGGATCCAAAGATGCTTCG<br>GCCAATGCAGGGATTTTATTCATCTCTGGGCT<br>CCAGTCTGAGGATGAGGCTGACTATTACTGTA<br>TGATTTGGCACAGCAGCGCTTGGGTGTTCGGC<br>GGAGGGACCAAGCTGACCGTCCTA<br><br>SEQ ID NO: 27343 | GAGGTGCAGCTGGTGGAGTCTGGGGGAGGCTG<br>GTCAAGCCTGGGGGGTCCCTGAGACTCTCCTGTG<br>CAGCCCTCTGATTCACCTTCAGTAGTAGTAGCAT<br>GAACTGGGTCCGCCAGGCTCCAGGGAAGGGCT<br>GGAGTGGGTCTCAGCCATTAGTAGTAGTACTGGTAGT<br>TACATATATTACGCAGACTCAGTGAAGGGCCGAT<br>TCACCATCTCCAGAGACAACGCCAAGAACTCACT<br>GTATCTGCAAATGAACAGCCTGAGAGCCGAGGA<br>CACGGCTGTGTATTACTGTGCGAGGACGGCAGTG<br>GCTGGTACTGGGTGGTTCGACCCGTCGGGGCCAGG<br>GAACCCTGGTCACCGTCTCCTCA<br><br>SEQ ID NO: 31349 |
| | | AA | QAVSTQPSSLSASPGASASLTCTLRSGITVTTYRI<br>YWYQQKPGSPPQFLLRYTSDSDKHQSGSVPSRF<br>SGSKDASANAGILFISGLQSEDEADYYCMIWHSS<br>AWVFGGGTKLTVL<br><br>SEQ ID NO: 27344 | EVQLVESGGGLVKPGGSLRLSCAASGFTFSSYSMN<br>WVRRAPGKGLEWVSAISSTGSYIYYADSVKGRFTIS<br>RDNAKNSLYLQMNSLRAEDTAVYYCARTAVAGTG<br>WFDPWGQGTLVTVSS<br><br>SEQ ID NO: 31350 |
| iPS:436704 | 21-225_149C10 | NA | TCCTATGAGCTGACTCAGCCACCCTCAGTGTC<br>CGTGTCCCCAGGACAGACAGCCAGCATCACCT<br>GCTCTGGAGATAAATTGGGGGATAAATATGCT<br>TCCTGGTATCAGCAGAAGCCAGGCCAGTCCCC<br>TGTGCTGGTGGTCTCATCATCAAGATAACAAGCGGC<br>CCTCAGGGATCCCTGAGCGATTCTCTGGCTCC<br>AACTCTGGGAACACAGCCACTCTGACCATCGG<br>CGGGATCCAGGCTATGGATGAGGCTGACTATT<br>ACTGTCAGGCGTGGGACAGCAGCACTGTGTA<br>TTCGGCGGAGGGACCAAGCTGACCGTCCTA<br><br>SEQ ID NO: 27345 | GAGGTGCAACTGTTGGAGTCTGGGGGAGGCTTG<br>GTACAGCCTGGGGGGTCCCTGAGATTCTCCTGTG<br>CAGCCTCTGGATTCACCTTTAGCAGCCACGCCAT<br>GAGCTGGGTCCGCCAGGCTCCAGGGAAGGGCT<br>GGAGTGGGTCTCAGTTATAAGTGGAGGTGGTAGT<br>AGCACATATTACGCAGACTCCGTGAAGGGCCGG<br>TTCACCATCTCCAGAGACAATTCCAAGAACACGC<br>TGTATCTGCAAATGAACAGCCTGAGAGCCGAGG<br>ACACGGCCGTATATTACTGTGCGAAATGGCGAG<br>GTAACCCACTGACTACGGTATGACGTCTGGGG<br>CCAAGGGACCACGGTCACCGTCTCCTCA<br><br>SEQ ID NO: 31351 |

FIGURE 50
(Continued)

| | | AA | SYELTQPPSVSVSPGQTASITCSGDKLGDKYASW YQQKPGQSPVLVIYQDNKRPSGSNSGN TATLTIGGIQAMDEADYYCQAWDSSTVVFGGGT KLTVL | EVQLLESGGGLVQPGGSLRFSCAASGFTFSSHAMS WVRQAPGKGLEWVSVISGGGSSTYYADSVKGRFTI SRDNSKNTLYLQMNSLRAEDTAVYYCAKWRGNPT DYGMDVWGQGTTVTVSS |
|---|---|---|---|---|
| | | | SEQ ID NO: 27346 | SEQ ID NO: 31352 |
| iPS:436706 | 21-225_149A11 | NA | TCCTATGAACTGACTCAGCCGCCCTCAGTGTC CGTGTCCCAGGACAGACCAGCATCACCT GCTCTGGAGATAAATTGGGAGCCAGCATCACCT TCCTGGTATCAGCAGAAGCCAGGCCAGTCCCC TGTGCTGGTCATCTATCAAGATAGCAGGCGGC CCTCAGGGATCCCTGAGCGATTCTCTGGCTCC AACTCTGGGAACACAGCCACTCTGACCATCAG CGGGACCCAGGCTATGGACAGCAGCAGCTGACTTTTGTG ACTGTCTGGCGTGGGAGAGCAGCAGCACTTTTGTG GTCTTCGGCGGAGGGACCAAGTTGACCGTCCT A | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCCATGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCAGAGATCGTGA CTACGGTGACCCCCCCTACTACTACTACGGT ATGGACGTCTGGGGCCAAGGGACCACGGTCACC GTCTCCTCA |
| | | | SEQ ID NO: 27347 | SEQ ID NO: 31353 |
| | | AA | SYELTQPPSVSVSPGQTASITCSGDKLGNKYVSW YQQKPGQSPVLVIYQDSRRPSGSNSGN TATLTISGTQAMDEADYYCLAWDSSTVVFGGG TKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS |
| | | | SEQ ID NO: 27348 | SEQ ID NO: 31354 |

FIGURE 50
(Continued)

| | | | |
|---|---|---|---|
| iPS:436708 | 21-225_150D3 | NA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTATATGGTATGGTGGAAGT AATAAAGACTATGCAGACTCCGTGAAGGGCCGA TTCACCATCTCCAGAGACAATTCCAAGAACACGC TGTATCTGCAAATGAACAGTTTGAGAGCCGAGGA CACGGCTGTGTATTACTGTGCGAGAGATCGGAT TATTGTAGTGGTGGTACCTGCCCTTACTACTACTA CTACGGTATGGACGTCTGGGGCCAAGGGACCAC GGTCACCGTCTCCTCA<br>TCCTATGAGCTGACTCAGCCACCCTCAGTGTC CGTGTCCCCAGGACAGACAGCCAGCATCACCT GCTCTGGAGATGAATTGGGGAATAAATATGCT TGCTGGTATCAGCAGAAGCCAGGCCAGTCCCC TGTGCTGGTCATCTATCAAGATAACAAGCGGC CCTCAGGGATCCCTGAGCGATTCTCTGGCTCC AGCTCTGGGAACACAGCCACTCTGACCATCAG CGGACCCAAGGCTATGGATGAGGCTGACTATT ACTGTCAGGCGTGGCACAGCAGCACTGTGGTA TTCGGCGGAGGGACCAAGCTGACCGTCCTA<br><br>SEQ ID NO: 27349 | SEQ ID NO: 31355 |
| | | AA | SYELTQPPSVSVSPGQTASITCSGDELGNKYACW YQQKPGQSPVLVIYQDNKRPSGIPERFSGSSSGN TATLTISGTQAMDEADYYCQAWHSSTVFGGG TKLTVL<br><br>SEQ ID NO: 27350 | QVQLVESGGGVVQPGRSLRLSCAASGFTFSTYGMH WVRQAPGKGLEWVAVIWYGGSNKDYADSVKGRF TISRDNSKNTLYLQMNSLRAEDTAVYYCARDRDY CSGGTCPYYYYGMDVWGQGTTVTVSS<br><br>SEQ ID NO: 31356 |

FIGURE 50
(Continued)

| | | | |
|---|---|---|---|
| iPS:436710 | 21-225_150F6 | NA | TCCTATGAGCTGACTCAGCCACCTCAGTGTC CGTGTCCCCAGGACAGACAGCCAGCATCACCT GCTCTGGAGATAAATTGGGGATAAAGCCACCT TCCTGGTATCAGCAGAAGCCAGGCCAGTCCCC TGTGTGGTCATCTGTCAAGATAGCAAGCGGC CCTCAGGGATCCCTGAGCGATTCTCTGGCTCC AACTCTGGGAACACAGCCACTCTGACCATCAG CGGGATCCAGGCTATGATGAGGCTGACTATT GCTGTCAGGCGTGGGACAGCAGCACTGTGTA TTCGGCGGAGGGACCAAGCTGACCGTCCTA<br><br>SEQ ID NO: 27351 | GAGGTGCAACTGTTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA<br><br>SEQ ID NO: 31357 |
| | | AA | SYELTQPPSVSVSPGQTASITCSGDKLGDKYASW YQQKPGQSPVLVICQDSKRPSGIPERFSGSNSGN TATLTISGIQAMDEADYCCQAWDSSTVVFGGGT KLTVL<br><br>SEQ ID NO: 27352 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31358 |
| iPS:436712 | 21-225_150F9 | NA | CAGTCTGTGCTGACTCAGCCACCTCAGCGTC TGGGACCCCCGGGCAGAGGGTCACCATCTCTT GTTCTGGAAGCAGCTCCAACATCGAAGTAAT GCTGTAAACTGGTACCAGCAGCTCCCAGGAAC GGCCCCCAAACTCCTCATCTATAGTAATAGTC AGCGGCCCTCAGGGGTCCCTGACCGTTCTCT GGCTCCAAGTCTGGCACCTCAGCTCCCTGGC CATCAGTGGGCTCCAGTCTGAGGATGAGGCTG ATTATTTCTGCGCAGCATGGGATGACAGCCTG AATGGCGTGGTATTCGGCGGAGGGACCAAGCT GACCGTCCTA<br><br>SEQ ID NO: 27353 | GAGATGCAGCTGGTGGAGTCTGGGGGAGGCTTG GTACAGCCTGGGGGGTCCCTGAGACTCTCCTGTG CAGCCTCTGGATTCACCTTCAGTAGCTATAACAT GAACTGGGTCCGCCAGGTTCCAGGGAAGGGCT GGAGTGGGTTTCATACATTAGTAGAAGTAGTAAT ACCAAACACTACGCAGACTCTGTGAAGGCCGA TTCACCATCTCCAGAGACAATGCCAAGAACTCAC TGTATCTGCAAATGAACAGCTGAGAGACGAGG ACACGGCTGTGTATTACTGTGCGAGAGATAGGAG TGGGAGCTACGGTACTTCTACTACTACGGTTTG GACGTCTGGGGCCAAGGGACCACGGTCACCGTC TCCTCA<br><br>SEQ ID NO: 31359 |

FIGURE 50
(Continued)

| | | | |
|---|---|---|---|
| iPS:436714 | 21-225_150H11 | AA | QSVLTQPPSASGTPGQRVTISCSGSSSNIGSNAVN WYQQLPGTAPKLLIYSNSQRPSGVPDRFSGSKSG TSASLAISGLQSEDEADYFCAAWDDSLNGVVFG GGTKLTVL |
| | | | SEQ ID NO: 27354 |
| | | | EMQLVESGGGLVQPGGSLRLSCAASGFTFSSYNMN WVRQVPGKGLEWVSYISRSSNTKHYADSVKGRFTI SRDNAKNSLYLQMNSLRDEDTAVYYCARDRSGSY GYFYYGLDVWGQGTTVTVSS |
| | | | SEQ ID NO: 31360 |
| | | NA | TCCTATGAGCTGACTCAGCCACCCTCAGTGTC CGTGTCCCCAGGACAGAGACCAGCATCACCT GCTCTGGAGATAAATTGGGGATAAATATGCT TCCTGGTATCAGCAGAAGCCAGGCCAGTCCC TGTGCTCGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGATGAGGCTGACTTTT ACTGTCAGGCGTGGGACAGCAGCACTGTGTA TTCGGCGGAGGGACCAAGCTGACCGTCCTA |
| | | | SEQ ID NO: 27355 |
| | | | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTACAACATG AGCTGGGTCCGCCAGGCTCCAGGGAAGGGGCT GGAGTGGGTCTCAATTATTAGTGTGGTGTAGT AGCACATACTACGCAGACTCCGTGAAGGGCCGG TTCACCATCTCCAGAGACAATTCCAAGAACACGC TGTATCTGCAAATGAACAGCCTGAGAGCCGAG ACACGGCCGTATATTACTGTGCGAAATGGCAG GTAACCCCACTGACTACGGTATGGACGTCTGGGG CCAAGGGACCACGGTCACCGTCTCCTCA |
| | | | SEQ ID NO: 31361 |
| | | AA | SYELTQPPSVSVSPGQTASITCSGDKLGDKYASW YQQKPGQSPVLVIYQDSKRPSGIPERFSGSNSGN TATLTISGIQAMDEADFYCQAWDSSTVFGGGT KLTVL |
| | | | SEQ ID NO: 27356 |
| | | | EVQLLESGGGLVQPGGSLRLSCAASGFTFSTYAMS WVRQAPGKGLEWVSIISGGGSSTYYADSVKGRFTI SRDNSKNTLYLQMNSLRAEDTAVYYCAKWRGNPT DYGMDVWGQGTTVTVSS |
| | | | SEQ ID NO: 31362 |

FIGURE 50
(Continued)

| | | | | |
|---|---|---|---|---|
| iPS:436716 | 21-225_151F3 | NA | TCTTATGAGCTGACTCAGCCACCCTCAGTGTC CGTGTCCCCAGGACAGAGACAGCCAGCATCACCT GCTCTGGAGATAAATTGGGGGATAAATATGTT TGCTGGTATCAGCAGAAGCCAGGCCAGTCCCC TGTGCTGGTCATCTATCAAGATCGCAAGCGGC CCTCAGGGATCCCGAGCGATTCTCTGGCTCC AACTCTGGGAACACAGCCACTCTGACCATCAG CGGGACCCAGGCTATGAGGCTGACTATT ACTGTCAGGGTGCACAGCAGCACTGTGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTATATGGTATGGTGAAGT AATACAGACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGA TTATTGTAGTGGTACTAGCTGCCCTTACTACTACT ACTACGGTATGGACGTCTGGGGCCAAGGGACCA CGGTCACCGTCTCCTCA |
| | | | SEQ ID NO: 27357 | SEQ ID NO: 31363 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVIWYGGSNTDYADSVKGRF TISRDISKNTLYLQMNSLRAEDTAVYYCARDRDYC SGTSCPYYYYYGMDVWGQGTTVTVSS |
| | | | SEQ ID NO: 27358 | SEQ ID NO: 31364 |

FIGURE 50
(Continued)

| | | | | |
|---|---|---|---|---|
| iPS:436718 | 21-225_151H5 | NA | TCCTATGAGCTGACTCAGCCACCCTCAGTGTC CGTGTCCCCAGGACAGACAGCCAGCATGCCT GCTCTGGAGATAAATTGGGGGATAAATATGCT TCCTGGTATCAACAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGATTCACCTTCAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA |
| | | | SEQ ID NO: 27359 | SEQ ID NO: 31365 |
| | | AA | SYELTQPPSVSVSPGQTASIACSGDKLGDKYASW YQQKPGQSPVLVIYQDSKRPSGIPERFSGSNSGN TATLTISGIQAMDEADYYCQAWDSSTVFGGGT KLTVL | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS |
| | | | SEQ ID NO: 27360 | SEQ ID NO: 31366 |
| iPS:436720 | 21-225_151H6 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGAGAAGCCAGGCCAGTCCCC TGTGCTGGTCATCTATCAAGATAACCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTTATGTC TTCGGAACTGGGACCAAGGTCACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTGACTGGCAT GCACTGGGTCCGCCAGGCTCCAGGCAAGGGCT GGAGTGGGTGGCACTTATATGTATGATGGAAGT AATAAATACTATGCAGACTCCGTGAAGGGCCGA TTCACCATCTACAGAGACAATTCCAAGAACAGC TGTATCTACAAATGAACAGCCTGAGAGCCGAGG ACACGGCTGTGTATTACTGTGCGAGAGATGACCG ATCTTGTAGTAGAACCAGCTGCCTTACTACTAC TACTACGGTTTGGACGTCTGGGGGCCAAGGGACCA CGGTCATCGTCCTCA |
| | | | SEQ ID NO: 27361 | SEQ ID NO: 31367 |

FIGURE 50
(Continued)

| | | | | |
|---|---|---|---|---|
| iPS:436722 | | AA | SYELTQPPSVSVSPGQTASITCSGDKLGDKYACW YQQKPGQSPVLVIYQDTKRPSGIPERFSGSNSGN TATLTISGTQAMDEADYYCQAWDSSTYVFGTGT KVTVL<br>SEQ ID NO: 27362 | QVQLVESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVISS<br>SEQ ID NO: 31368 |
| | 21-225_151H7 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA<br>SEQ ID NO: 27363 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGGAG GTAACCCCACTGACTACGGTATGGACGTCTGGGG CCAAGGGACCACGGTCACCGTCTCCTCA<br>SEQ ID NO: 31369 |
| | | AA | SYDLTQPPSVSVSPGQTASITCSGDKLGDKYASW YQQKPGQSPVLVIYQDSKRPSGIPERFSGSNSGN TATLTISGIQAMDEADYYCQAWDSSTVVFGGGT KLTVL<br>SEQ ID NO: 27364 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTSS<br>SEQ ID NO: 31370 |

FIGURE 50
(Continued)

| | | | | |
|---|---|---|---|---|
| iPS:436724 | 21-225_151B9 | NA | TCCTATGAGCTGACTCAGCCACCCTCAGTGTC CGTGTCCCCAGGACAGACAGCCAGCATGCCT GCTCTGGAGATAAATTTGGGGGATAAATATGCT TCCTGGTATCAACAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA<br><br>SEQ ID NO: 27365 | GAGGTGCAACTGTTGGAGTCTGGGGGAGGCTTG GTACAGCCTGGGGGGTCCCTGAGACTCTCCTGTG CAGCCCTCTGATTCACCTTCAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA<br><br>SEQ ID NO: 31371 |
| | | AA | SYELTQPPSVSVSPGQTASIACSGDNLGDKYASW YQQKPGQSPVLVIYQDSKRPSGIPERFSGSNSGN TATLTISGIQAMDEADYYCQAWDSSTVFGGGT KLTVL<br><br>SEQ ID NO: 27366 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31372 |
| iPS:436726 | 21-225_152G5 | NA | TCCTATGAGATGACTCAGCCACCCTCAGTGTC CGTGTCCCCAGGACAGACAGCCAGCATCACCT GCTCTGGAGATAAATTTGGGGGATAAATATGCT TGCTGGTATCAACAGAAGCCAGGCCAGTCCCC TGTGCTGGTCATCTATCAAGATTCCAAGCGGC CCCTCAGGGATCCCTGAGCGATTCTCTGGCTCC AACTCTGGGAACACAGGCCACTCTGACCATCAG CGGGACCCAGGCCGTATGGATGAGGCTGACTATT ACTGTCAGGCGTGGGACAGCAGCACTTATGTC TTCGGAACTGGGACCAAGGTCACCGTCCTA<br><br>SEQ ID NO: 27367 | CAGGTGCAGCTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGCT GGAGTGGGTGGCACTTATATGGTATGATGGAAGT AATAAATACTATGCAGACTCCGTGAAGGGCCGA TTCACCATCTCCAGAGACAATTCCAAGAACACGC TGTATCTACAAATGAACAGCCTGAGAGCCGAGG ACACGGCTGTGTATTACTGTGCGAGAGATGACCG ATCTTGTAGTAGAACCAGCTGCCTTACTACTAC TACTACGGTTTGGACGTCTGGGGCCAAGGGACCA CGGTCATCGTCCTCA<br><br>SEQ ID NO: 31373 |

FIGURE 50
(Continued)

| | | AA | SYEMTQPPSVSVSPGQTAIITCSGDKLGDKYAC WYQQKPGQSPVLVIYQDSKRPSGIPERFSGSNSG NTATLTISGTQAMDEADYYCQAWDSSTYVFGT GTKVTVL<br><br>SEQ ID NO: 27368 | QVQLVESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVISS<br><br>SEQ ID NO: 31374 |
| iPS:436728 | 21-225_152G6 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGAACACAGCCACTCTGACCATCAG CGGGATCCAGGCTCTGGATGAGGCTGACTATT ACTGTCAGGCGTGGGACAACAGCACTGTGTA TTCGGCGGAGGGACCAAGCTGACCGTCCTA<br><br>SEQ ID NO: 27369 | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCCTCCTCA<br><br>SEQ ID NO: 31375 |
| | | AA | SYELTQPPSVSVSPGQTASITCSGDKLGDKYASW YQQKPGQSPVLVIYQDSKRPSGIPERFSGSNSGN TATLTISGIQALDEADYYCQAWDNSTVVFGGGT KLTVL<br><br>SEQ ID NO: 27370 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br><br>SEQ ID NO: 31376 |

FIGURE 50
(Continued)

| | | | |
|---|---|---|---|
| iPS:436730 | 21-225_152D7 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCCTCAGGGATCCCTGAGCGATTCTCTGGCTCC AACTCTGGGAACACAGCCACTCTGACCATCAG CGGGATCCAGGCTATGATGAGGCTGACTATT ACTGTCAGGCGTGGGACAGCAGCACTGTGTA TTCGGCGGAGGGACCAAGCTGACCGTCCTA |
| | | | SEQ ID NO: 27371 |
| | | AA | SYELTQPPSVSVSPGQTASITCSGDKLGDKYASW YQQKPGQSPVLVIYQDSKRPSGIPERFSGSNSGn TATLTISGIQAMDEADYYCQAWDSSTVFGGGT KLTVL |
| | | | SEQ ID NO: 27372 |
| | | | GAGGTGCAACTGTTGGAGTCTGGGGGAGGCTTG GTACAGCCTGGGGGGTCCCTGAGACTCTCCTGTG CAGCCTCTGATTCACCTTTAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTCCGGTATGACGTCTGGGG CCAAGGGACCACGGTCACCGTCTCCTCA |
| | | | SEQ ID NO: 31377 |
| | | | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DSGMDVWGQGTTVTVSS |
| | | | SEQ ID NO: 31378 |
| iPS:436732 | 21-225_152B12 | NA | TCCTATGAGCTGACTCAGCCACCCTCAGTGTC CGTGTCCCCAGGACAGACAGCCAGCATCACCT GCTCTGGCGATAAATTGGGAAATAAATATGCT TGCTGGTATCAGCAGAAGCCAGGCCAGTCCCC TGTGCTGGTCATCTATCAAGATACCAAGCGGC CCCTCAGGGATCCCTGAGCGATTCTCTGGCTCC AACTCTGGGAACACAGCCACTCTGACCATCAG CGGGACCCAGGCTATGATGAGGCTGACTTATGTC ACTGTCAGGGCTGGGACCAAGGTCACCGTCCTA TTCGGAACTGGGACCAAGGTCACCGTCCTA |
| | | | SEQ ID NO: 27373 |
| | | | CAGGTGCAGGTGGTGGAGTCTGGGGGAGGCGTG GTCCAGCCTGGGAGGTCCCTGAGACTCTCCTGTG CAGCGTCTGGATTCACCTTCAGTGACTGATGGCAT GCACTGGGTCCGCCAGGCTCCAGGCAAGGGGCT GGAGTGGGTGGCAGTTATATGCAGACTCCGTGAAGGT AATAAATACTATGCAGACTCCGTGAAGGGCCGA TTCACCATCTCCAGAGACAATGAACAGCCTGAGAGCCGAGG TGTATCTACAAATGAACAGCCTGAGAGCCGAGG ACACGGCTGTGTATTACTGTGCGAGAGATGACCG ATCTTGTAGTAGTACCAGCTGCCCTTACTACTAC TACTACGGTTTGGACGTCTGGGGCCAAGGGACCA CGGTCACCGTCCTCA |
| | | | SEQ ID NO: 31379 |

FIGURE 50
(Continued)

| | | | | |
|---|---|---|---|---|
| iPS:436734 | 21-225_153A8 | AA | SYELTQPPSVSVSPGQTASITCSGDKLGNKYACW YQQKPGQSPVLVIYQDTKRPSGIPERFSGSNSGN TATLTISGTQAMDEADYYCQAWDSSTYVFGTGT KVTVL | QVQVVESGGGVVQPGRSLRLSCAASGFTFSDYGM HWVRQAPGKGLEWVAVIWYDGSNKYYADSVKGR FTISRDNSKNTLYLQMNSLRAEDTAVYYCARDDRS CSSTSCPYYYYGLDVWGQGTTVTVSS |
| | | | SEQ ID NO: 27374 | SEQ ID NO: 31380 |
| | | NA | TCCTATGAGCTGACTCAGCCACCCTCAGTGTC CGTGTCCCCAGGCAGACAGCCAGCATCACCT GCTCTGGAGATAAATTGGGGATAAATATGCT TGCTGGTATCAGCAGAAGCCAGGCCAGTCCCC TGTGCTCGTCATCTATCAAGATACCAAGCGGC CCTCAGGGATCCCTGAGCGATTCTCTGGCTCC AACTCTGGGAACACAGGCTATGAGGCTGACT CAG CGGGACCCAGGCTGCAGGCGTGGGACAGCAGCACTTATGTC ACTGTCAGGGCGTGGGACACCAAGGTCACCGTCCTA | CAGGTGCAGCTGATGGAGTCTGGGGGAGGCGTG GTCCAGCCTGGGAGGTCCCTGAGACTCTCCTGTG CAGCGCTCTGGATTCACCTTCAGTGACTATGGCAT GCACTGGGTCCGCCAGGCTCCAGGCAAGGGCT GGAGTGGGTGGCACTTATATGGTATGGATGGAAGT AATAAATACTATGCAGACTCCGTGAAGGGCCGA TTCACCATCTCCAGAGACAATTCCAAGAACACGC TTTATCTACAAATGAACAGCTGAGAGCTGAGG ACACGGCTGTGTATTACTGTGCGAGAGATGACCG ATCTTGTAGTAGAACCAGCTGCCCTTACTACTAC TACTACGGTTTGGACGTCTGGGGCCAAGGGACCA CGGTCATCGTCTCCTCA |
| | | | SEQ ID NO: 27375 | SEQ ID NO: 31381 |
| | | AA | SYELTQPPSVSVSPGQTASITCSGDKLGDKYACW YQQKPGQSPVLVIYQDTKRPSGIPERFSGSNSGN TATLTISGTQAMDEADYYCQAWDSSTYVFGTGT KVTVL | QVQLMESGGGVVQPGRSLRLSCAASGFTFSDYGM HWVRQAPGKGLEWVALIWYDGSNKYYADSVKGR FTISRDNSKNTLYLQMNSLRAEDTAVYYCARDDRS CSRTSCPYYYYGLDVWGQGTTVIVSS |
| | | | SEQ ID NO: 27376 | SEQ ID NO: 31382 |

FIGURE 50
(Continued)

| | | | |
|---|---|---|---|
| iPS:436736 | 21-225_153E8 | NA | TCCTATGAGCTGACTCAGCCACCCTCAGTGTCCGTGTCCCCAGGACAGACAGCCAGCATCACCTGCTCTGGAAGTAAATTGGGTAATAAATATGTTTGCTGGTATCAGCAGAGGCCAGGCCAGTCCCCTGTACTGGTCATCTATCAAGATAACAAGCGGCCCTCAGGGATCCCTGAGCGATTCTCTGGCTCCAACTCCGGAAACACAGCCACTCTGACCATCAGCGGGACCCAGGCTATGGATGAGGCTGGCTATTACTGTCAGGCGTGGGACAGCAGCACTACTGTGATATTCGGCGGAGGGACCAAGCTGACCGTCCTA |
| | | | SEQ ID NO: 27377 |
| | | AA | SYELTQPPSVSVSPGQTASITCSGSKLGNKYVCWYQQRPGQSPVLVIYQDNKRPSGIPERFSGSNSGNTATLTISGTQAMDEAGYYCQAWDSSTYVIFGGGTKLTVL |
| | | | SEQ ID NO: 27378 |
| iPS:436736 | 21-225_153E8 | | CAGGTGCAGCTGGTGGAGTCTGGGGGAGGCGTGGTCCAGCCTGGGAGGTCCCTGAGACTCTCCTGTCAGCGTCTGATTCACCCTCAGTAACTATGGCATGCACTGGGTCCGCCAGGCTCCAGGCAAGGGGCTGGAGTGGGTGGCAGTTATATGGTTTGATGGCAGTAATAAATACTATGTTGACTCCGTGAAGGACCGATTCACCATCTCCAGAGACAATTCCAAGAACACGCTATATCTGCAAATGAACAGCCTGAGAGCCGAAGACACGGCTGTGTATTACTGTGCGAGAGATCGGGTGGAGGGTTCGGGGGACTCCTACTACTACTACGGTATGGACGTCTGGGGCCAAGGGACCACGGTCACCGTCTCCTCA |
| | | | SEQ ID NO: 31383 |
| | | | QVQLVESGGGVVQPGRSLRLSCAASGFTLSNYGMHWVRQAPGKGLEWVAVIWFDGSNKYYVDSVKDRFTISRDNSKNTLYLQMNSLRAEDTAVYYCARDRVEGSGTPYYYYGMDVWGQGTTVTVSS |
| | | | SEQ ID NO: 31384 |
| iPS:436738 | 21-225_153D9 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGTACTGGTATCAGCAGAAGCCAGGCCAGTCCCCTGTACTGGTCATCTATCAAGATAGGAAGCGGCCCTCAGGGATCCCTGAGCGATTCTCTGGCTCCAACTCTGGGAACACAGGCGTTGGCACAGCAGTACTGTGGTAACTGTCAGGCGTGGGACAGCAGTACTGTGGTATTCGGCGGAGGGACCAAGGTGACCGTCCTA |
| | | | CAGGTGCAGCTGGTGGAGTCTGGGGGAGGCGTGGTCCAGCCTGGGAGGTCCCTGAGACTCTCCTGTCAGCGTCTGATTCACCGTCAGTACCTATGGCATGCACTGGGTCCGCCAGGCTCCAGGCAAGGGGCTGGAGTGGGTGGCAGTTATATGGTATGGTGAAGTAATAAAGACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGGATTATTGGTGGTAGCGTCCTTACTACTACTACTACGGTATGGACGTCTGGGGCCAAGGGACCACGGTCACCGTCTCCTCA |

FIGURE 50
(Continued)

| | | | | |
|---|---|---|---|---|
| iPS:436740 | 21-225_154C3 | AA | SEQ ID NO: 27379<br><br>SYELTQPPSVSVSPGQTASITCSGDKLGDKYACW YQQKPGQSPVLVIYQDRKRPSGIPERFSGSNSGN TATLTISGTQAMDEADYYCQAWHSSTVFGGG TKVTVL | SEQ ID NO: 31385<br><br>QVQLVESGGGVVQPGRSLRLSCAASGFTVSTYGM HWVRQAPGKGLEWVAVIWYGGSNKDYADSVKGR FTISRDISKNTLYLQMNSLRAEDTAVYYCARDRDY CSGGSCPYYYYGMDVWGQGTTVTVSS |
| | | NA | SEQ ID NO: 27380<br><br>TCCTATGAGCTGACTCAGCCACCCTCAGTGTC CGTGTCCCCAGGACAGACAGCCAGCATCACCT GCTCTGGAGATAAATTGGGGGATAAATATGTT TGCTGGTATCAGCAGAAGCCAGGCCAGTCCCC TGTGTTGGTCATCTATCAAGATAGGAAGCGGC CCTCAGGGATCCCTGAGCGATTCTCTGGCTCC AACTCTGGGAACACAGCCACTCTGACCATCAC CGGAACCCAGGCTATGGATGAGGCTGACTATT ACTGTCAGGCGTGGCACAGCACTGTGGTA TTCGGCGGAGGGACCAAGCTGACCGTCCTA | SEQ ID NO: 31386<br><br>CAGGTGCAGCTGGTGGAGTCTGGGGGAGGCGTG GTCCAGCCTGGGAGGTCCCTGAGACTCTCCTGTA CAGCGTCTGGATTCACCGTCAGTACCTATGGCAT GCACTGGGTCCGCCAGGCTCCAGGCAAGGGGCT GGAGTGGGTGGCAGTTGTATGGTATGGTGAAAT AATAAAGACTATGCAGACTCCGTGAAGGGCCGA TTCACCATCTCCAGAGACAATTCCAAGAACACAC TGTATCTGCAAATGAACAGCCTGAGAGCCGAGG ACACGGCTGTGTATTACTGTGCGAGAGATCGGGA TTATTGTAGTGGTGGTAGCTGCCCTTACTACT ACTACGGTATGGACGTCTGGGGCCAAGGGACCA CGGTCACCGTCTCCTCA |
| | | AA | SEQ ID NO: 27381<br><br>SYELTQPPSVSVSPGQTASITCSGDKLGDKYVCW YQQKPGQSPVLVIYQDRKRPSGIPERFSGSNSGN TATLTITGTQAMDEADYYCQAWHSSTVFGGG TKLTVL | SEQ ID NO: 31387<br><br>QVQLVESGGGVVQPGRSLRLSCTASGFTFSTYGMH WVRQAPGKGLEWVAVVWYGGNNKDYADSVKGR FTISRDISKNTLYLQMNSLRAEDTAVYYCARDRDY CSGGSCPYYYYGMDVWGQGTTVTVSS |
| | | | SEQ ID NO: 27382 | SEQ ID NO: 31388 |

FIGURE 50
(Continued)

| | | | |
|---|---|---|---|
| iPS:436742 | 21-225_154C4 | NA | TCCTATGAGCTGACTCAGCCACCCTCAGTGTC CGTGTCCCCAGGACAGACAGCCAGAATCACCT GCTCTGGAGATAAATTGGGGGATAAATATGCT TCCTGGTATCAGCAGAAGCCAGGCCAGTCCCC TGTGCTGGTCATCTATCAAGATAGCAAGCGGC CCTCAGGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA<br>SEQ ID NO: 27383 |
| | | AA | SYELTQPPSVSVSPGQTARITCSGDKLGDKYASW YQQKPGQSPVLVIYQDSKRPSGIPERFSGSNSGN TATLTISGIQAMDEADYYCQAWDSSTVFGGGT KLTVL<br>SEQ ID NO: 27384 | GAGGTGCAACTGTTGGAGTCTGGGGGAGGCTTG ATACAGCCTGGGGGGTCCCTGAGACTCTCCTGT CAGCCTCTGATTCACCTTTAGCAGCTATGCCAT GAGCTGGGTCCGCCAGGCTCCAGGGAAGGGCT GGAGTGGGTCTCAGTTATTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA<br>SEQ ID NO: 31389 |
| | | | EVQLLESGGGLIQPGGSLRLSCAASGFTFSSYAMSW VRQAPGKGLEWVSVISGGSSTYADSVKGRFTIS RDNSKNTLYLQMNSLRAEDTAVYYCAKWRGNPT DYGMDVWGQGTTVTVSS<br>SEQ ID NO: 31390 |
| iPS:436744 | 21-225_154F4 | NA | TCCTATGAGCTGACTCAGCCACCCTCAGTGTC CGTGTCCCCAGGACAGACAGCCAGCATCACCT GCTCTGGAGATAAATTGGGAAATATGTT TGTTGGTATCAGCAGAAGCCAGGCCAGTCCCC TGTGGAAGTCATCTATAAAGATAGTAAGCGGC CCTCAGGGGATCCCTGAGCGATTCTCTGGCTC AATTCTGGGAACACAGCCACTCTGACCATCAG CGGGACCCAGGCTGTGGATGAGGCTGACTATT ACTGTCAGGCGTGGGACAACAGTACTTAGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATATTACTGTGCGAGAGAGATTC CTATTGTAGTGGTACCAGCGCCCTACTACTAC TACTACGGTATGGACGTCTGGGGCCAAGGGACC ACGGTCACCGTCTCCTCA |

FIGURE 50
(Continued)

| | | | | |
|---|---|---|---|---|
| iPS:436746 | 21-225_154E10 | AA | SEQ ID NO: 27385<br>SYELTQPPSVSVSPGQTASITCSGDKLGNKYVCW YQQKPGQSPVEVIYKDSKRPSGIPERFSGSNSGN TGTLTISGTQAMDEADYYCQAWDNSTLVFGGG TKLTVL<br>SEQ ID NO: 27386 | SEQ ID NO: 31391<br>QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCAREDSYC SGTSCPYYYYGMDVWGQGTTVTVSS<br>SEQ ID NO: 31392 |
| | | NA | TCCTATGAGCTGACTCAGCCACCCTCAGTGTC CGTGTCCCCAGGACAGACAGCCAGCATCACCT GCTCTGGAGATAAATTGGGGAACCAGCATCACCT TCCTCGGTATCAGCAGAAGCCAGGTCAGTCCCC TGTGCTGTGGTCATCTATCAAGATAGCAAGCGGC CCTCAGGGATCCCTGAGCGATTCTCTGGCTCC AACTCTGGGAACACAGGCCACTCTGACCATCAG CGGGATCCAGGCTATGGATGAGGCTGACTATT ACTGTCAGGCGTGGGACAACAGCACTGTGGTA TTCGGCGGAGGGACCAAGCTGACCGTCCTA | GAGGTGCAACTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGTTATTAGTAGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGGTATGGACGTCTGGGG CCAAGGGACCACGGTCACCGTCTCCTCA |
| | | AA | SEQ ID NO: 27387<br>SYELTQPPSVSVSPGQTASITCSGDKLGDKYASW YQQKPGQSPVLVIYQDSKRPSGIPERFSGSNSGN TATLTISGIQAMDEADYYCQAWDNSTVVFGGGT KLTVL<br>SEQ ID NO: 27388 | SEQ ID NO: 31393<br>EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br>SEQ ID NO: 31394 |

FIGURE 50
(Continued)

| | | | |
|---|---|---|---|
| iPS:436748 | 21-225_154D11 | NA | TCCTATGAGCTGACTCAGCCACCCTCAGTGTC CGTGTCCCAGGAGACAGAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAAGAAGCGGC CCCTCAGGGATCCCGAGCGATTCTCTGGCTCC AACTCTGGGAACATAGCCACTCTGACCATCAG CGGGACCCAGGCTATGGATGAGGCTGACTATT ACTGTCAGGCGTGGCACAGCAGTATTGTGTA TTCGGCGGAGGGACCAAGCTGACCGTCCTA | CAGGTGCAGCTGGTGGAGTCTGGGGGAGGGTG GTCCAGCCTGGGAGGTCCCTGAGACTCTCCTGTG CAGCGTCTGGATTCAACGTCAGTACCTATGGCAT GCACTGGGTCCGCCAGGCTCCAGGCAAGGGCT GGAGTGGGTGGCAGTTATATGGTATGGTGAAGT AATAAAGACTATGCAGACTCTGTGAAGGGCCGA TTCACCATCTCCAGAGACAGCAGTTCCAAGAACACGC TGTATCTGCAAATGAACAGCCTGAGAGCCGAGG ACACGGCTGTGTATTACTGTGCGAGAGATCGGA TTATTGTAGTTGTGTGGTAGTTGCCCTTACTACT ACTACGGTATGGACGTCTGGGGCCAAGGGACCA CGGTCACCGTCTCCTCA |
| | | | SEQ ID NO: 27389 | SEQ ID NO: 31395 |
| | | AA | SYELTQPPSVSVSPGQTASITCSGDKLGDKYACW YQQKPGQSPVLVIYQDKKRPSGIPERFSGSNSGNI ATLTISGTQAMDEADYYCQAWHSSIVFGGGTK LTVL | QVQLVESGGGVVQPGRSLRLSCAASGFNVSTYGM HWVRQAPGKGLEWVAVIWYGGSNKDYADSVKGR FTISRDSSKNTLYLQMNSLRAEDTAVYYCARDRDY CSGGSCPYYYYGMDVWGQGTTVTVSS |
| | | | SEQ ID NO: 27390 | SEQ ID NO: 31396 |

FIGURE 50
(Continued)

| | | | | |
|---|---|---|---|---|
| iPS:436750 | 21-225_154G12 | NA | CAGTCTGTGTTGACTCAGCCACCCTCAGCGTC TGGGACCCCCGGGCAGAGGGTCACCATCTCTT GTTCTGGAAGCAGCTCCAACATCGGAAATAAT GCTGTAAGCTGGTATCAGCAGCTCCCAGGAAC GGCCCCAAACTCCTCATCTATAGTAATGATC ACCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTGCAGCATGGGATGACAGCCTG AAGGGTCCGGTATTCGGCGGAGGGACCAAGC TGACCGTCCTA<br><br>SEQ ID NO: 27391 | CAGGTGCAGCTGCAGGAGTCGGGCCCAGGACTG GTGAATCCTTCACAGACCCTGTCCCTCACCTGCG GTGTCTCTGGTGGCTCCATCAGCAGTGGTTATTA CTACTGGAGCTGGATCCGCCAGCACCCAGGGAA GGGCCTGGAGTGGATTGGGTACATCTATTATAGT GGGAGCACCTACTACAACCCGTCCCTCAAGAGTC GAGTTTCCATATCATTAGACACGCCTAAGAACCA GTTCTCCCTGAAGCTGACCTCTGTGACTGCCGCG GACACGGCCGTGTATTACTGTGCGAGAGATTGGG GTGGCTACGATTCGAGTGGCTGGTTCGACCCCTG GGGCCAGGGAACCCTGGTCACCGTCTCCTCA<br><br>SEQ ID NO: 31397 |
| | | AA | QSVLTQPPSASGTPGQRVTISCSGSSNIGNNAVS WYQQLPGTAPKLLIYSNDHRPSGVPDRFSGSKS GTSASLAISGLQSEDEADYYCAAWDDSLKGPVF GGGTKLTVL<br><br>SEQ ID NO: 27392 | QVQLQESGPGLVNPSQTLSLTCGVSGGSISSGYYY WSWIRQHPGKGLEWIGYIYYSGSTYYNPSLKSRVSI SLDTPKNQFSLKLTSVTAADTAVYYCARDWGGYD SSGWFDPWGQGTLVTVSS<br><br>SEQ ID NO: 31398 |
| iPS:436752 | 21-225_155H1 | NA | CAGTCTGTGCTGACGCAGCCGCCCTCAGTGTC TGGGGCCCCAGGGCAGAGGGTCACCATCTCCT GCACTGGGAGCAGCTCCAATATCGGGGCAGTT TATGATGTACACTGGTACCAGCAGCTTCCAGG AACAGCCCCCAAACTCCTCATCTATGGTAACA GCAATCGGCCCTCAGGGGTCCCTGACCGATTC TCTGGCTCCAAGTCTGGCACCTCAGCCTCCCT GGCCATCACTGGCCTCCAGGCTGAGGATGAGG CTGATTATCACTGCCAGTCCTATGACAGCAGC CTGAGTGGTCCTGTGATATTCGGCGGAGGGAC CAAGCTGACCGTCCTA<br><br>SEQ ID NO: 27393 | GAGGTGCAGCTAGTGCAGTCTGGAGCAGAGGTG AAAAAGCCCGGGGAGTCTCTGAAGATCTCCTGTA AGGGTTCTGGATACAGCTTTACCAGCTACTGGAT CGGCTGGGTGCGCCAGATGCCCGGGAAGGCCT GGAGTGGATGGGGCTCATCTATCCTGGTGCTCT GATACCAGATACAGCCCGTCCTTCCAAGGCCAGG TCACCATCTCAGCCGACAAGTCCATCAGCACCGC CTACCTGCAGTGGAGCAGCCTGAAGGCCTGGA CACCGCCATGTATTACTGTGCGAGACAGGCCATA GCAAGTCGAGGGAGGTACTACTACTACGGTATG GACGTCTGGGGCCAAGGGACCACGGTCACCGTC TCCTCA<br><br>SEQ ID NO: 31399 |

FIGURE 50
(Continued)

| | | | |
|---|---|---|---|
| iPS:436754 | | AA | QSVLTQPPSVSGAPGQRVTISCTGSSSNIGAGYD VHWYQQLPGTAPKLLIYGNSNRPSGVPDRFSGS KSGTSASLAITGLQAEDEADYHCQSYDSSLSGPV IFGGGTKLTVL | EVQLVQSGAEVKKPGESLKISCKGSGYSFTSYWIG WVRQMPGKGLEWMGLIYPGASDTRYSPSFQGQVT ISADKSISTAYLQWSSLKASDTAMYYCARQAIASR GRYYYYGMDVWGQGTTVTVSS |
| | | | SEQ ID NO: 27394 | SEQ ID NO: 31400 |
| | 21-225_155G3 | NA | TCCTATGAGCTGACTCAGCCACCCTCAGTGTC CGTGTCCCCAGGACAGAGCCAGCATCACCT GCTCTCTGAGATAAGTTGGGGATAAATATGTT TGCTGGTATCAGCAGAAGCCAGGCCAGTCCCC TATGTTGGTCATCTATCAAGATAGTAAGCGGC CCTCAGGGATCCCTGAGCGATTCTCTGGCTCC AACTCTGGGAACACAGGCTATGAGGCTACTCAG CGGGACCCAGGCTGTGGGACAATAGTATTATGTC ACTGTCAGGCGTGGGGACCAAGGTCACCGTCCTA | CAGGTGCAGCTGGTGGAGTCTGGGGGAGGCGTG GTCCAGCCTGGGAGGTCCCTGAGACTCTCCTGTA CAGCCTCTGGATTCACCTTCAGTAGCTATGGCAT GCACTGGGTCCGCCAGGCTCCAGGCAAGGGGCT GGAGTGGGTGGCAGTTATATCAGAACTCCGTGAAGGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGATACGGA GAGATGGCTACCATACTCCTACGGTATGGACGTC TGGGGCCAAGGGACCACGGTCACCGTCTCCTCA |
| | | | SEQ ID NO: 27395 | SEQ ID NO: 31401 |
| | | AA | SYELTQPPSVSVSPGQTASITCSGDKLGDKYVCW YQQKPGQSPMLVIYQDSKRPSGIPERFSGSNSGN TATLTISGTQAMDEADYYCQAWDNSIYVFGTGT KVTVL | QVQLVESGGGVVQPGRSLRLSCTASGFTFSSYGMH WVRQAPGKGLEWVAVISYDGSNKYYADSVKGRFT ISRDNSKNTLYLQMNSLRAEDTAVYYCARDTERW LPYSYGMDVWGQGTTVTVSS |
| | | | SEQ ID NO: 27396 | SEQ ID NO: 31402 |

FIGURE 50
(Continued)

| iPS:436756 | 21-225_146A10 | NA | TCCTATGAGCTGACTCAGCCACCCTCAGTGTC CGTGTCCCCAGGACAGAGACAGCCAGCATCACCT GCTCTGGAGATAAATTGGGGATAAATATGTT TGCTGGTATCAGCAGAAGCCAGGCCAGTCCCC TGTGCTGGTCATCTTTCAAGATAGAAAGCGGC CCTCAGGGATCCCGAGCGATTCTCTGGCTCC AACTCTGGGAACACAGCCACTCTGACCATCAG CGGGACCCAGGCTATGAGGATGAGGCTGACTATT ACTGTCAGGGTGGGACAGCAGCACTGTGGTG TTCGGCGGAGGGACCAAAGTTACCGTCCTA | CAGGTGCAGCTGGAGGAGTCTGGGGGAGGCGTG GTCCAGCCTGGGAGGTCCCTGAGACTCTCCTGTG CAGCGTCTGGATTCACCTTCAGTGGCTATGGCAT GCACTGGGTCCGCCAGGCTCCAGGCAAGGGCT GGAGTGGATGACACTTATACGGTATGATGAAG CGATAAAAACTATGCAGACTCCGTGAAGGGCCG ATTCACCATCTCCAGAGACAACGCAGCCTGAGAGCCGAG CTGTATCTGCAAATGAACAGCCTGAGAGCCGAG GACACGGCTGTGATTACTGTGCGAGAGATCGGG TTTTTTGTAGTAGTACCAGCTGCCTCTCTTACTAC TACTACTACGGTATGGACGTCTGGGGCCAAGGG ACCACGGTCACCGTCTCCTCA |
| | | | SEQ ID NO: 27397 | SEQ ID NO: 31403 |
| | | AA | SYELTQPPSVSVSPGQTASITCSGDKLGDKYVCW YQQKPGQSPVLVIFQDRKRPSGIPERFSGSNSGN TATLTISGTQAMDEADYYCQAWDSSTVFGGG TKVTVL | QVQLEESGGGVVQPGRSLRLSCAASGFTFSGYGMH WVRQAPGKGLEWMTLIRYDGSDKNYADSVKGRF TISRDNSKNTLYLQMNSLRAEDTAVYYCARDRVFC SSTSCLSYYYYYGMDVWGQGTTVTVSS |
| | | | SEQ ID NO: 27398 | SEQ ID NO: 31404 |

FIGURE 50
(Continued)

| | | | |
|---|---|---|---|
| iPS:436758 | 21-225_155C10 | NA | TCCTATGAGCTGACTCAGCCACCCTCAGTGTC CGTGTCCCAGGAGACAGCAGTCAGCATCACCT GCTCTGGAGATAAATTGGGGGATAAATATGTT TCCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGATCCAGGCTATGGATGAGGCTGACTATT ACTGTCAGGCGTGGGACAGCAGCACTGTGTA TTCGGCGGAGGGACCAAGCTGACCGTCCTA<br><br>SEQ ID NO: 27399 | TCCTATGAGCTGACTCAGCCACCCTCAGTGTC GTACAGCCTGGGGGGTCCCTGAGACTCTCCTGTG CAGCCCTCTGATTCACCTTTAGCAGCTATGCCAT GAGCTGGGTCCGCCAGGCTCCAGGGAAGGGCT GGAGTGGGTCTCAGTTATTAGTGGTGGTGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGACGTCTGGGG CCAAGGGACCACGGTCACCGTCTCCTCA<br><br>SEQ ID NO: 31405 |
| | | AA | SYELTQPPSVSVSPGQTVSITCSGDKLGDKYVSW YQQKPGQSPVLVIYQDSKRPSGIPERFSGSNSGn TATLTISGIQAMDEADYYCQAWDSSTVFGGGT KLTVL<br><br>SEQ ID NO: 27400 | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS<br><br>SEQ ID NO: 31406 |
| iPS:436760 | 21-225_155E10 | NA | TCCTATGAGCTGACTCAGCCGCCCTCAGTGTC CGTGTCCCCAGGACAGACAGCCAGCATCACCT GCTCTGGAGATAAATTGGGGGATAAATATGTT TCCTGGTATCAGCAGAAGCCAGGCCAGTCCCC TGTGCTGGTCATCTATCAAGATAGGAAGCGGC CCTCAGGGACCCTGAGCGATTCTCTGGCTCC AACTCTGGGAACACAGCCACTCTGACCATCAG CGGGACCCAGGCTATGGATGAGGCTGACTATT ACTGTCTGGCGTGGGACAGCAGCACTTTGTG GTATTCGGCGGAGGGACCAAGTTGACCGTCCT A<br><br>SEQ ID NO: 27401 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGCAGATAATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGTGA CTACGGTGACCCCCCTACTACTACTACTACGGT ATGGACGTCTGGGGCCAAGGGACCACGGTCACC GTCTCCTCA<br><br>SEQ ID NO: 31407 |

FIGURE 50
(Continued)

| | | | |
|---|---|---|---|
| iPS:436762 | | AA | SYELTQPPSVSVSPGQTASITCSGDKLGDKYVSW YQQKPGQSPVLVIYQDRKRPSGTPERFSGSNSGN TATLTISGTQAMDEADYYCLAWDSSTFVVFGGG TKLTVL<br>SEQ ID NO: 27402 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRDY GDPPYYYYGMDVWGQGTTVTVSS<br>SEQ ID NO: 31408 |
| | 21-225_156H2 | NA | CAGTCTGTGGTGACTCAGCCACCCTCAGCGTC TGGGACCCCGGGCAGAGGGTCACCATCTCTT GTTCTGGAAGCAGCTCCAACATCGGAAGTAAT ACTGTAAATTGGTACCAGCAGCTCCCAGGAAC GGCCCCCAAACTCCTCATCTATAGTAGTAATC AGCGGCCCTCAGGGGTCCCTGACCGATTGTCT GGCTCCAAGTCTGGCACCTCAGCCTCCCTGGC CATCAGTGGGCTCCAGTCTGAGGATGACAGCCTG ATTATTACTGTGCAGCATGGGATGACAGCCTG AATGGCGTGGTATTCGGCGGAGGGACCAAGG TGACCGTCCTA<br>SEQ ID NO: 27403 | GAGGTGCAGCTGGTGGAGTCTGGGGGAGGCTTG ATACAGCCTGGGGGGTCCCTGAGACTCTCCTGTG CAGCCTCTGGATTCACCTTCAGTAACTATAACAT GAACTGGGTCCGCCAGGCTCCAGGGAAGGGCT GGAGTGGGTTCATACATTAGTAGAAGTAGTAAT ACCAAATACTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGCGAGAGATAGGAG TGGGAGTACGGTACTTCTACTACTACGGTATG GACGTCTGGGGCCAAGGGACCACGGTCACCGTC TCCTCA<br>SEQ ID NO: 31409 |
| | | AA | QSVVTQPPSASGTPGQRVTISCSGSSSNIGSNTVN WYQQLPGTAPKLLIYSSNQRPSGVPDRLSGSKSG TSASLAISGLQSEDEADYYCAAWDDSLNGVVFG GGTKVTVL<br>SEQ ID NO: 27404 | EVQLVESGGGLIQPGGSLRLSCAASGFTFSNYNMN WVRQAPGKGLEWVSYISRSSNTKYYADSVKGRFTI SRDNAKNSLYLQMNSLRDEDTAVYYCARDRSGSY GYFYYYGMDVWGQGTTVTVSS<br>SEQ ID NO: 31410 |

FIGURE 50
(Continued)

| | | | |
|---|---|---|---|
| iPS:436764 | 21-225_158E9 | NA | TCCTATGACCTGACTCAGCCACCCTCAGTGTCCGTGTCCCCAGGACAGACAGCCAGCATCACCTGCTCTGGAGATAAATTGGGGGATAAATATGTTTGCTGGTATCAGCAGAAGCCAGGCCAGTCCCCTGTGCTGGTCATCTATCAAGATAGTAAGCGGCCCTCAGGGATCCCTGAGCGATTCTCTGGCTCCAACTCTGGGAACACAGCCACTCTGACCATCACCGGGACCCAGGCTATGGATGAGGCTAACTATTACTGTCAGGCGTGGGACAACAGCAGCTTTGTGCTATTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGGAAGTAGTAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGGTTTTTGTAGTGGTACCAGCTGCCCTTACTACTACTACTACGGTATGGACGTCTGGGGCCAAGGGACCACGGTCACCGTCTCCTCA |
| | | | SEQ ID NO: 27405 | SEQ ID NO: 31411 |
| | | AA | SYDLTQPPSVSVSPGQTASITCSGDKLGDKYVCWYQQKPGQSPVLVIYQDSKRPSGIPERFSGSNSGNTATLTITGTQAMDEANYYCQAWDNSSFVLFGGGTKLTVL | QVQLVESGGGVVQPGRSLRLSCAASGFTFSSYGMHWVRQAPGKGLEWVAVIWYDGSSKYYADSVKGRFTISRDNSKNTLYLQMNSLRAEDTAVYYCARDRVFCSGTSCPYYYYYGMDVWGQGTTVTVSS |
| | | | SEQ ID NO: 27406 | SEQ ID NO: 31412 |

FIGURE 50
(Continued)

| iPS:436766 | 21-225_158D10 | NA | TCCTATGAGCTGACTCAGCCACCCTCAGTGAC CGTGTCCCCAGGACAGAGCCAGCATCACCT GCTCTGGAGATAAATTGGGGGATAAATATGTT TGCTGGTATCAGCAGAAGCCAGGCCAGTCCCC TGTGCTGGTCATCTATCAAGATCGCAAGGGC CCTCAGGGATCCCGAGCGATTGTCTGGCTCC AACTCTGGGAACACAGCCACTCTGACCATCAG CGGGACCCAGGCTCTGGATGAGGCTGACTATT ACTGTGCAGGCGTGGGGACAACAGCTTTGTG GTATTCGGCGGAGGGACCAAGCTGACCGTCCT A | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GCACTGGGTCCGCCAGGCTCCAGGCAAGGGCT GGAGTGGGTGGCAGTTATATCGAGTGATGGAAGT AATAAATACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT TTCTTGTAGTAGTACCAGCTGCCCTTACTACTACT ACTACGGTATGGACGTTCTGGGGCCAAGGGACCA CGGTCACCGTCTCCTCA |
|---|---|---|---|---|
| | | | SEQ ID NO: 27407 | SEQ ID NO: 31413 |
| | | AA | SYELTQPPSVTVSPGQTASITCSGDKLGDKYVC WYQQKPGQSPVLVIYQDRKRPSGIPERLSGSNSG NTATLTISGTQALDEADYYCQAWGNSSFVVFGG GTKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRVSC SSTSCPYYYYYGMDVWGQGTTVTVSS |
| | | | SEQ ID NO: 27408 | SEQ ID NO: 31414 |

FIGURE 50
(Continued)

| | | | |
|---|---|---|---|
| iPS:436768 | 21-225_159H8 | NA | TCCTATGAGCTGACTCAGCCACCCTCAGTGTCCGTGTCCCCAGGACAGACAGCCAGCATCACCTGCTCTGGAGATAAATTGGGGGATAAATATGTTTGCTGGTATCAGCAGAAGCCAGGCCAGTCCCCTGTGTTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTCTGGATGAGGCTGACTATTACTGTGTCAGGCGTGGGCAACAGCAGCTTTGTGGTATTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTACCTATGGCATGCACTGGGTCCGCCAGGCTCCAGGCAAGGGCTGGAGTGGGTGGCAGTTATATGGTATGATGAAGTAATAAATACTATGCAGACTCCGTGAAGGGCGATTCACCATCTCCAGAGACAATTCCAAGAACACGCTGTATCTGCAAATGAACAGCCTGAGAGCCGAGGACACGGCTGTGTATTACTGTGCGAGAGATCGGGTTTCTTGTAGTAGTACCAGCTGCCCTTACTACTACTACTACGGTATGGACGTCTGGGGCCAAGGGACCACGGTCACCGTCTCCTCA |
| | | | SEQ ID NO: 27409 | SEQ ID NO: 31415 |
| | | AA | SYELTQPPSVSVSPGQTASITCSGDKLGDKYVCWYQQKPGQSPVLVIYQDRKRPSGIPERFSGSNSGNTATLTISGTQALDEADYYCQAWGNSSFVVFGGGTKLTVL | QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARDRVSCSSTSCPYYYYYGMDVWGQGTTVTVSS |
| | | | SEQ ID NO: 27410 | SEQ ID NO: 31416 |

FIGURE 50
(Continued)

| | | | |
|---|---|---|---|
| iPS:436770 | 21-225_160B12 | NA | TCCGATGAGCTGACTCAGTCACCCTCAGTGTC CGTGTCCCCAGGACAGAGCCAGCATCACCT GCTCTGGAGATAAATTGGGGGATAAATATGTT TGCTGGTATCAGCAGAAGCCAGGCCAGTCCCC TGTGTTGGTCATCTATCAAGATAGCAAGGGC CCTCAGGGATCCCTGAGCGATTCTCTGGCTCC AACTCTGGGAACACAGCCACTCTGACCATCAG CGGGACCCAGGCTCTGGATGAGGCTGACTATT ACTGTCAGGCGTGGGGACAACAGCAGCTTTGTG GTATTCGGCGGAGGGACCAAGCTGACCGTCCT A |
| | | | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGT TTCTTGTAGTAGTACCAGCTGCCCTTACTACTACT ACTACGGTATGGACGTCTGGGGCCAAGGGACCA CGGTCACCGTCTCCTCA |
| | | | SEQ ID NO: 27411 |
| | | | SEQ ID NO: 31417 |
| | | AA | SDELTQSPSVSVSPGQTASITCSGDKLGDKYVCW YQQKPGQSPVLVIYQDSKRPSGIPERFSGSNSGN TATLTISGTQALDEADYYCQAWGNSSFVVFGGG TKLTVL |
| | | | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCARDRVSC SSTSCPYYYYYGMDVWGQGTTVTVSS |
| | | | SEQ ID NO: 27412 |
| | | | SEQ ID NO: 31418 |

FIGURE 50
(Continued)

| | | | | |
|---|---|---|---|---|
| iPS:436772 | 21-225_161H3 | NA | TCCTTATGAGCTGACTCAGCCACCTCAGTGTCCGTGTCCCCAGGACAGACAGCAGCATCACCTGCTCTGGAGATAGATCAGCAGCCAGTCCCTGCTGGTATCAGCAGAAGCCAGGCCAGTCCCCTGTACTGGTCATCTTTCAAGATAACAAGCGGCCCTCAGGGATCCCTGAGCGATTCTCTGGCTCCAACTCTGGGAACACAGCCACTCTGACCATCAGCGGGACCCAGGCTCTGGATGAGGCTGACTATTACTGTCAGGCGTGGGTCAACAACACTGCAGTGGTTTTCGGCGGCGAGGGGACCAAGCTGACCGTCCTA | CAGGTGCAGCTGGTGGAGTCTGGGGGAGGCGTGGTCCAGCCTGGGAGGTCCCTGAGACTCTCCTGTCAGCGCTGTCTGGATTCACCTTCAGTAGTCATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTTCACCATCTGCAAATGAACAGCCTGAGAGCCGAGGACACGGCTGTGTATTACTGTGCGAGAGTCGGGTATAGCGGTGGCTGGTACATCTTTGACTACTGGGGCCAGGGAACCCTGGTCACCGTCTCCTCA |
| | | | SEQ ID NO: 27413 | SEQ ID NO: 31419 |
| | | AA | SYELTQPPSVSVSPGQTASITCSGDRLGDKYVCWYQQKPGQSPVLVIFQDNKRPSGIPERFSGSNSGNTATLTISGTQALDEADYYCQAWVNNTAVVFGGGTKLTVL | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVGYSGWYIFDYWGQGTLVTVSS |
| | | | SEQ ID NO: 27414 | SEQ ID NO: 31420 |
| iPS:436774 | 21-225_161E10 | NA | TCCTTTGACCTGACTCAGCCACCCTCAGTGTCCGTGTCCCCAGGACAGACAGCAGCATCACCTGCTCTGGAGATAAATTGGGGGATAAATATGTTTGCTTGGTATCAGCAGAAGCCAGGCCAGTCCCCCTGTGGTGGTCATCTATCAAGATAGCAAGCGGCCCTCAGGGATCCCTGAGCGAATCTCTGGCTCCAACTCTGGGAACACAGCCACTCTGACCATCAGCGGGACCCAGGCTATGGAGGACACAGTGATTACTACTGTCAGACGTGGGACACCAGTAGCGACAGTGCGCTTTTCGGCGGAGGGACCAAGCTGACCGTCCTA | CAGGTGCAGCTGGTGGAGTCTGGGGGAGGCGTGGTCCAGCCTGGGAGGTCCCTGAGACTCTCCTGTCAGCGCTGTCTGGATTCACCTTCAGTAGTCATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGTTTTTTGTAGTGGTACCAGCTGCCCTTACTACTACTACTACGGTATGGACGTCTGGGGCCAAGGGACCACGGTCACCGTCTCCTCA |
| | | | SEQ ID NO: 27415 | SEQ ID NO: 31421 |

FIGURE 50
(Continued)

| | | | |
|---|---|---|---|
| iPS:436776 | | AA | SFDLTQPPSVSVSPGQTASITCSGDKLGDKYVCW YQQKPGQSPVLVIYQDSKRPSGIPERISGSNSGNT ATLTISGTQAMDEADYYCQTWDNSSFALFGGGT KLTVL | QVQLVESGGGVVQPGRSLRLSCAASGFTFSSYGMH WVRQAPGKGLEWVAVIWYDGSNKYYVDSVKGRF TISRDNSKNTLYLQMNSLRAEDTAVYYCARDRVFC SGTSCPYYYYGMDVWGQGTTVTVSS |
| | | | SEQ ID NO: 27416 | SEQ ID NO: 31422 |
| | | NA | TCCTATGAGCTGACTCAGCCACCCTCAGTGTC CGTGTCCCCAGGACAGACAGCCAGCATCACCT GCTCTGGAGATAAATTGGGTGATAAATATGCT TGCTGTGTATCAGCAGAAGCCAGGCCAGTCCC TGTGCTGGTCATCTATCAAGATACCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGGTGGGACAGCACCAAGCTGACCGTCCTA TTCGGCGGAGGGACCAAGCTGACCGTCCTA | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTGTTA CTACTGGAGCTGGATCCGCCAGCAGTCACCAGGGAA GGGCCTGGAGTGGATTGGGTACATCTATTACAGT GGGAGCCCCTACTACAACCCGTCCCTCAAGAGTC GAATTACCATATCAATAGACACGTCTAAGAACCA GTTCTCCCTGAAGCTGAACTCTGTGCCGAGATCGAATT GACACGGCCGTGTATTACTGTGCGAGATCGAATT GTAGTAGTGCAAACTGCTATACGGTGGGTTCTA CTACTACGGTTTGACTGTCGGGCCCGAGGACC ACGGGTCACCGTCCTCA |
| | | | SEQ ID NO: 27417 | SEQ ID NO: 31423 |
| | 21-225_161F12 | AA | SYELTQPPSVSVSPGQTASITCSGDKLGDKYACW YQQKPGQSPVLVIYQDTKRPSGIPERFSGSNSGN TATLTISGTQAMDEADYYCQAWDSTTLVFGGG TKLTVL | QVQLQESGPGLVKPSQTLSLTCTVSGGSISSGGYYW SWIRQHPGKGLEWIGYIYYSGSPYYNPSLKSRITISI DTSKNQFSLKLNSVTAADTAVYYCARSNCSSANCY TVGFYYYGLDVWGRGTTVTVSS |
| | | | SEQ ID NO: 27418 | SEQ ID NO: 31424 |

FIGURE 50
(Continued)

| iPS:436780 | 21-225_165H3 | NA | TCCTATGAGCTGACTCAGCCACCCTCAGTGTC CGTGTCCCAGGACAGAGCCAGCATCACCT GCTCTGGAGATAAATTGGGTGATAAATATGCT TGCTGGTATCAGCAGAAGCCAGGCCAGTCCC TGTGCTGGTCATCTATCAAGATAGCAAGCGGC CCTCAGGGATCCCTGAGCGATTCTCTGGCTCC AACTCTGGGAACACAGGCCACTCTGACCATCAG CGGGACCCAGGCTATGGATGAGGCTGACTATT ACTGTCAGGCGTGGGACACAGCACCACTCTGGTT TTCGGCGGAGGGACCAAGCTGACCGTCCTA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTTA CTACTGGAGCTGGATCCGCCAGCACCCAGGGAA GGGCCTGGAGTGGATTGGGTACATCTATTACAGT GGGAGCCCCTACTACAATCGTCCCTCAAGAGTC GAATTACCATATCAATAGACACGTCTAAGAACCA GTTCTCCCTGAAGCTGAACTCTGTGACTGCCGCG GACACGGCCGTGTATTACTGTGCGAGATCGAATT GTAGTAGTGCCAACTGCTATACGGTGGGGTTCTA CTACTACGGTATGGACGTCTGGGGCCAAGGGAC CACGGTCACCGTCTCCTCA |
| --- | --- | --- | --- | --- |
| | | | SEQ ID NO: 27419 | SEQ ID NO: 31425 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDSTTLVFGGG TKLTVL | QVQLQESGPGLVKPSQTLSLTCTVSGGSISSGGVTW SWIRQHPGKGLEWIGYIYYSGSPYYNPSLKSRITISI DTSKNQFSLKLNSVTAADTAVYYCARSNCSSANCY TVGFYYYGMDVWGQGTTVTVSS |
| | | | SEQ ID NO: 27420 | SEQ ID NO: 31426 |

FIGURE 50
(Continued)

| | | | |
|---|---|---|---|
| iPS:436782 | 21-225_166G11 | NA | TCCTATGAGCTGAGTCAGCCACCCTCAGTGTC CGTGTCCCAGGACAGAGCCAGCATCACCT GCTCTGGAGATAAATTGGGGATAAATATGTT CACTGGTATCAGCAGAAGCCAGGCCAGTCCC TGTGTTGGTCATCTATCAAGATAGCAAGCGC CCTCAGGGATCCCGAGCGATTCTCTGGCTCC AACTCTGGGAACACAGCCACTCTGACCATCAG CGGAGACCAGGCTATGATGAGGCTGATTATT ACTGTCAGGCGTGGGACAACAGCACTGCGGTA TTCGGCGGAGGGACCAAGTTGACCGTCCTA<br><br>SEQ ID NO: 27421 | CAGGTGCAGCTGGTGGAGTCTGGGGGAGGCGTG GTCCAGCCTGGGAGGTCCCTGAGACTCTCCTGTG CAGCGTCTGGATTCACCTTCAATGGCTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAACTTCCAAGAACACGC TGTTTCTGCAAATGAACAGCCTGACAGCCGAGGA CACGGCTGTGTATTACTGTGCGAGAGATAGA TATTGTAGTAGTCCCACCTGCCATCTTACTACTA CTACTACGGTCTGGACGTCTGGGGCCAAGGGACC ACGGTCACCGTCTCCTCA<br><br>SEQ ID NO: 31427 |
| | | AA | SYELSQPPSVSVSPGQTASITCSGDKLGDKYVHW YQQKPGQSPVLVIYQDSKRPSGIPERFSGSNSGN TATLTISGTQAMDEADYYCQAWDNSTAVFGGG TKLTVL<br><br>SEQ ID NO: 27422 | QVQLVESGGGVVQPGRSLRLSCAASGFTFNGYGM HWVRQAPGKGLEWVAVIWYDGSNKYYADSVKGR FTISRDTSKNTLFLQMNSLTAEDTAVYYCARDRY CSSPTCHPYYYYGLDVWGQGTTVTVSS<br><br>SEQ ID NO: 31428 |

FIGURE 50
(Continued)

| | | | |
|---|---|---|---|
| iPS:436784 | 21-225_169C1 | NA | TCCTATGAGCTGACTCAGCCACCCTCAGTGTC CGTGTCCCCAGGACAGACAGCCAGCATCACCT GCTCTGGAGATAAATTGGGGATAAATATGTT TGTTGGTATCAGCAGAAGCCAGGCCAGTCCCC TTTGCTGGTCATCTATAAAGATATCAAGGGC CCTCAGGGATCCCTGAGCGATTCTCTGGCTCC AACTCTGGTAACACAGCCACTCTGACCATCAG CGGGACCCAGGCTATGGATGAGGCTGACTATT ACTGTCAGGCGTGGGACACCAACACTGTGATA TTCGGCGGAGGGACCAAGCTGACCGTCCTA | CAGGTGCAGTTGGTGGAGTCTGGGGGAGGCGTG GTCCAGCCTGGGAGGTCCCTGAGACTCTCCTGTG CAGCGTCTGGATTCACTTTGAGTAGCAATGGCAT GCACTGGGTCCGCCAGGCTCCAGGCAAGGGCT GGAGTGGGTGGCAGTTATATGCAGACTCCGTGAAGGT AATAAATACTATGCAGACTCCGTGAAGGGCCGA TTCACCATCTCCAGAGACAACGCTGAGAGCCGAGG TGTATCTGCAAATGAACAGCCTGAGAGCCGAGG ACACGGCTGTGTATTACTGTGCGAGAGATCAGTA CAACCGGAACGACGACCAGCTTACTACTA CTACTACGGTTTGGACGTCTGGGGCCAAGGGACC ACGGTCACCGTCTCCTCA |
| | | | SEQ ID NO: 27423 | SEQ ID NO: 31429 |
| | | AA | SYELTQPPSVSVSPGQTASITCSGDKLGDKYVCW YQQKPGQSPLLVIYKDIKRPSGIPERFSGSNSGNT ATLTISGTQAMDEADYYCQAWDTNTVIFGGGT KLTVL | QVQLVESGGGVVQPGRSLRLSCAASGFTLSSNGMH WVRQAPGKGLEWVAVIWYDGSNKYYADSVKGRF TISRDTSKNTLYLQMNSLRAEDTAVYYCARDQYNR NDGPPAYYYYYGLDVWGQGITVTVSS |
| | | | SEQ ID NO: 27424 | SEQ ID NO: 31430 |

FIGURE 50
(Continued)

| | | | | SEQ ID NO |
|---|---|---|---|---|
| iPS:436786 | 21-225_169A6 | NA | TCCTATGAGCTGACTCAGCCACCCTCAGTGTCCGTGTCCCCAGGACAGAGCAGCATCACCTGCTCTGGAGATAAATTGGGGGATAAATATGTTTGTTGGTATCAGCGGAAGCCAGGCCAGTCCCCTGTTCTGGTCATCTATCAGGATTACAAGCGGCCCTCAGGGATCCCGAGCGATTCTCTGGCTCCAACTCTGGGAACACAGCCACTCTGACCATCAGCGGGACCCAGGCTATGGATGAGGCTGACTATTACTGTCAGGCGTGGGACACCAACACTGTTCCTGTTCGGCGGAGGGACCAAGCTGACCGTCCTG | 27425 |
| | | | CAGGTGCAGCTGGTGGAGTCTGGGGGAGGCGTGGTCCAGCCTGGGAGGTCCCTGAGACTCTCCTGTGCAGCGTCTGGATTCACTTTGAGCAGCAATGCATGCACTGGGTCCGCCAGGCTCCAGGCAAGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTCTCTGCAAATGAACAGCCTGAGAGCCGAGGACACGGCTGTGTATTACTGTGCGAGAGATCAGTACAACCGGAACGACGACCACCAGCTTACTACTACTACTACGGTATGGACGTCTGGGGCCAAGGGACCACGGTCACCGTCTCCTCA | 31431 |
| | | AA | SYELTQPPSVSVSPGQTASITCSGDKLGDKYVCWYQRKPGQSPVLVIYQDYKRPSGIPERFSGSNSGNTATLTISGTQAMDEADYYCQAWDTNTVLFGGGTKLTVL | 27426 |
| | | | QVQLVESGGGVVQPGRSLRLSCAASGFTLSSNGMHWVRQAPGKGLEWVAVIWYDGSNKYYADSVKGRFTISRDNSKNTLSLQMNSLRAEDTAVYYCARDQYNRNDGPPAYYYYYGMDVWGQGTTVTVSS | 31432 |

FIGURE 50
(Continued)

| | | | |
|---|---|---|---|
| iPS:436788 | 21-225_169B7 | NA | GCCTATGAGCTGACTCAGCCACCCTCAGTGTC CGTGTCCCCAGGACAGACAGCCAGAATCACCT GCTCTGGAGATAAACAGAGCCAGGCCAGTCCC TCCTGGTATCAACAGAAGCCAGGCCAGTCCCC TGTGCTGGTCATCTATCAAGATAGGAAGCGGC CCTCAGGGATCCCTGAGCGATTCTCTGGCTCC AACTCTGGAAACACAGCCACTCTGACCATCAG CGGGACCCAGGCTATGGATGAGGCTGACTATT ACTGTCAGGCGTGGGACAAGAACACTGTGGTA TTCGGCGGAGGGACCAAGCTGACCGTCCTA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCTT GAACTGGGTCCGCCAGGCTCCAGGGAAGGGCT GGAGTGGGTTTCATACATGGTAGTAGTGGCAGT ATCATATTCTACGCAGACTCGTGAAGGCCGAT TCACCATCTCCAGAGACAATGCCAAGAACTACT GTATCTGCAAATGAACAGCCTGAGAGACGAGGA CACGGCTGTGTATTACTGTGCGAGAGGGATACA GCTGGGGTTACCTATTACTACGGTATGGACGTCT GGGGCCAAGGGACCACGGTCACCGTCTCCTCA |
| | | | SEQ ID NO: 27427 | SEQ ID NO: 31433 |
| | | AA | AYDLTQPPSVSVSPGQTARITCSGDKLGGKYAS WYQQKPGQSPVLVIYQDRKRPSGIPERFSGSNSG NTATLTISGTQAMDEADYYCQAWDKNTVVFGG GTKLTVL | EVQLVESGGGLVQPGGSLRLSCAASGFTFSSYSLN WVRQAPGKGLEWVSYIGSSGSIIFYADSVKGRFTIS RDNAKNSLYLQMNSLRDEDTAVYYCARGDTAGVT YYYGMDVWGQGTTVTVSS |
| | | | SEQ ID NO: 27428 | SEQ ID NO: 31434 |
| iPS:436790 | 21-225_169G11 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGTAAGCGGC CCTCAGGGATCCCTGAGCGATTCTCTGGCTCC AACTCTGGAACACAGCCACTCTGACCATCAG CGGGACCCAGGCCGTGGGACAACAGCACTGGGTA ACTGTCAGGCGTGGGACACCTGTGACGTCCTA TTCGGCGGAGGGACCAAGCTGACCGTCCTA | CAGGTGCAGCTGCAGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGGGG CTACGTATTAACTACGGTTCGGGGAGTTATTATCC GGCTACTAACTACGGTATGGACGTCTGGGGCCAA GGGACCACGGTCACCGTCTCCTCA |

FIGURE 50
(Continued)

| | | | |
|---|---|---|---|
| | | SEQ ID NO: 27429 | SEQ ID NO: 31435 |
| | AA | SYELTQPPSVSVSPGQTASITCSGDKLGDKYACW YQQKPGQSPVLVIYQDSKRPSGIPERFSGSNSGN TATLTISGTQAMDEADYYCQAWDNSTAVFGGG TKLTVL | QVQLVESGGGVVQPGRSLRLSCAASGFTFSSYGMH WVRQAPGKGLEWVAIIWYDGSNKYYADSVKGRFT ISRDNSKNTLYLQMNSLRAEDTGVYYCAREGATY YHGSGSYYPATNYGMDVWGQGTTVTVSS |
| | | SEQ ID NO: 27430 | SEQ ID NO: 31436 |
| iPS:436792 | NA | AATTTATGCTGACTCAGCCCCCACTCTGTGTCG GAGTCTCCGGGGAAGACGGTAACCATCTCCTG CACCCGCAGCAGTGGCAGCATTACGGCAACT ATGTGCAGTGGCACCAGCAGCGCCCGGGCAAT TCCCCCACCACTCTTGATCTATATGAGGATAAAAA AAGACCCTCGACAGCTCCCTCCAACTCTGCCTCC GCTCCATCGACAGCTCCCTCCAACTCTGGTTCTG CTCACCATCTCTGGACTCAGTCTGAAGACTGAGGACGA GGCTGACTATTACTGTCAGTCTTATTATAGCG GCAATTGGGTGTTCGGCGGAGGGACCAAGCTG ACCGTCCTG | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATATTATGCAGACTCCGTGAAGGGCCGAT TCACCATCTCCAGAGACAATTCCAAGAACACGCT GTATCTGCAAATGAACAGCCTGAGAGCCGAGGA CACGGCTGTGTATTACTGTGCGAGTCCCCTTTAC GATATGGGACTCTACTACGATATGGACGTCTGGG GCCAAGGGACCACGGTCACCGTCTCCTCA |
| | | SEQ ID NO: 27431 | SEQ ID NO: 31437 |
| 21-225_169D12 | AA | NFMLTQPHSVSESPGKTVTISCTRSSGSITGNYVQ WHQQRPGNSPTTLIYEDKKRPSGVPDRFSGSIDS SSNSASLTISGLKTEDEADYYCQSYYSGNWVFG GGTKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCASPLYDM GLYYDMDVWGQGTTVTVSS |
| | | SEQ ID NO: 27432 | SEQ ID NO: 31438 |

FIGURE 50
(Continued)

| | | NA | TCCTATGAGTTGAGTCAGCAGCCCTCAGTGTCCGTGTCCCCAGGACAGAGCCAGCATCACCTGCTCTGGAGATAAATTGGGGGATAAATATTCTTGCTGGTATCAGCAGAAGCCAGGCCAGTCCCCTGTGCTGGTCATCTATCAAGATAGTAAGCGGCCCTCAGGGATCCCGCACGATTCTCTGGCTCCAACTCTGGGAACACAGCCACTCTGACCATCAGCGGGACCCAGGCTATGAGGATGAGGCTGATTATTACTGTCAGGCGTGGGACAGCAACACTGACCGTCCTATTCGGCGGAGGGACCAAACTGACCGTCCTA | CAGGTGCAGCTGGTGGAGTCTGGGGGAGGCGTGGTCCAGCCTGGGAGGTCCCTGAGACTCTCCTGTGCAGCGTCTGGATTCACCTTCAGTGGCTATGGCATGAACTGGGTCCGCCAGGCTCCAGGCAAGGGCTGGAGTGGGTGGCAATTATATCGAGACTCCGTGATGGAAATAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGATCGGGTTATTGTAGTAGTACCAGCTGCCATCCCTATTACTACTACTACGCTATGGACGTCTGGGGCCAAGGGACCACGGTCACCGTCTCCTCA |
| iPS:436794 | 21-225_170F1 | | SEQ ID NO: 27433 | SEQ ID NO: 31439 |
| | | AA | SYELSQPPSVSVSPGQTASITCSGDKLGDKYSCWYQQKPGQSPVLVIYQDSKRPSGIPARFSGSNSGNTATLTISGTQAMDEADYYCQAWDSNTAVFGGGTKLTVL | QVQLVESGGGVVQPGRSLRLSCAASGFTFSGYGMNWVRQAPGKGLEWVAIIWYDGNNKYYADSVKGRFTISRDNSKNTLYLQMNSLRAEDTAVYYCARDRVYCSSTSCHPYYYYAMDVWGQGTTVTVSS |
| | | | SEQ ID NO: 27434 | SEQ ID NO: 31440 |

FIGURE 50
(Continued)

| | | | | |
|---|---|---|---|---|
| iPS:436796 | 21-225_170A5 | NA | TCCTATGACCTGACTCAGCCACCCTCAGTGTC CGTGTCCCCAGGACAGAGCAGCATCACCT GCTCTGGAGATAAATTGGGGATAAATATGCT TGTTGGTATCAGCAGAAGCCAGGCCAGTCCCC TATACTGGTCATCTATCAAGATTACAAGGGC CCTCAGGGATCCCGAGCGATTCTCTGGCTCC AACTCTGGGAACACAGCCACTCTGACCATCAG CGGGACCCAGGCTATGGATGAGGCTGACTATT ATTGTCAGGCCGTGGACAACAGCACTATGGTA TTCGGCGGAGGGACCAGGCTGACCGTCCTA | CAGGTGCAGCTGGTGGAGTCTGGGGGAGGCGTG GTCCAGCCTGGGAGGTCCCTGAGACTCTCCTGTG CAGCGTCTGGACTCACCTTCAGTAACTGTGCAT GCACTGGGTCCGCCAGGCTCCAGGCAAGGGCT GGAGTGGGTGGCAATTATATGGTATGATGGAAGT AATAAATACTATGCAGACTCCGTGAAGGGCCGA TTCACCATCTCCAGAGACAATTCCAAGAACACGC TGGATCTGCAAATGAACAGCCTGAGAGCCGAGG ACACGGCTGTGTATTACTGTGCGAGAGATCAGTA CAACAGGAACGACGGACCACCAGCTTACTACTA CTACTACGGTTTGGACGTCTGGGGCCAAGGGACC ACGGTCACCGTCTCCTCA |
| | | | SEQ ID NO: 27435 | SEQ ID NO: 31441 |
| | | AA | SYDLTQPPSVSVSPGQTASITCSGDKLGDKYAC WYQQKPGQSPILVIYQDYKRPSGIPERFSGSNSG NTATLTISGTQAMDEADYYCQAWDNSTMVFGG GTRLTVL | QVQLVESGGGVVQPGRSLRLSCAASGLTFSNCGM HWVRQAPGKGLEWVAIIWYDGSNKYYADSVKGR FTISRDNSKNTLDLQMNSLRAEDTAVYYCARDQYN RNDGPPAYYYYGLDVWGQGTTVTVSS |
| | | | SEQ ID NO: 27436 | SEQ ID NO: 31442 |

FIGURE 50
(Continued)

| | | | |
|---|---|---|---|
| iPS:436798 | 21-225_171F5 | NA | GCCTATGACTCTGACTCAGCCACCCTCAGTGTCCGTGTCCCCAGGACAGACAGCCAGCATCACCTGCTCTGGAGATAAATTGGGGGGAAAATATGCTTCCTGGTATCAACAGAAGCCAGGCCAGTCCCCTGTGCTGGTCATCTATCAAGATAGGAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAAGAACACTGTGGTATTCGGCGGAGGGACCAAGCTGACCGTCCTA | GAGGTGCAGCTGGTGGAGTCTGGGGGAGGCTTGGTACAGCCTGGGGGGTCCCTGAGACTCTCCTGTGCAGCCTCTGGATTCACCTTCAGTAGCTATAGCTTGAACTGGGTCCGCCAGGCTCCAGGGAAGGGGCTGGAGTGGGTTTCATACATTGGTAGTAGTGGCAGTATCATATCTACGCAGACTCTGTGAAGGCCGATTCACCATCTCCAGAGACAATGAACAGCCTGAGAGACGAGGATATCTGCAAATGAACAGCCTGAGAGACGAGGACACGGCTGTGTATTACTGTGCGAGAGGGATACACGCTGGGGTTACTATTACTACGGTATGGACGTCTGGGGCCAAGGGACCACGGTCACCGTCTCCTCA |
| | | AA | SEQ ID NO: 27437 |
| | | | AYDLTQPPSVSVSPGQTASITCSGDKLGKYASWYQQKPGQSPVLVIYQDRKRPSGIPERFSGSNSGNTATLTISGTQAMDEADYYCQAWDKNTVFGGGTKLTVL | SEQ ID NO: 31443 |
| | | | | EVQLVESGGGLVQPGGSLRLSCAASGFTFSSYSLNWVRQAPGKGLEWVSYIGSSGSIIFYADSVKGRFTISRDNAKNSLYLQMNSLRDEDTAVYYCARGDTAGVTYYYGMDVWGQGTTVTVSS |
| | | | SEQ ID NO: 27438 | SEQ ID NO: 31444 |
| iPS:436800 | 21-225_171D12 | NA | TCTTCTGAGCTGACTCAGGACCCTGCTGTGTCTGTGGCCTTGGACAGCCTCAGGACAGTCACAGGATCACATGCCAAGGAGACAGCCTCAGAAGCCTCAGAAGCCTCAGAAGGCTATTATGCAAGCTGGTACCAGCAGAAGCCAGGACAGGCCCCTATACTTGTCATCTATGCTAAAAACAACCGGCCCTCAGGGATCCCAGACCGATTCTCTGGCTCCAACTCAGGAAACACAGCTTCCTTGACCATCACTGGGGCTCAGGCGGAAGATGAGGCTGACTATTACTGTAACTACTCCGGGACAGCAGTGGCAGCCATGTGGTATTCGGCGGAGGGACCAAACTGACCGTCCTA | CAGGTGCAGCTGGTGCAGTCTGGGGCTGAGGTGAAGAAGCCTGGGGCCTCAGTGAAGGTTCCTGCAAGGCATCTGGATACACCTTCAACAGTTACTATATGTATTGGGTGCGACAGGCCCCTGGACAAGGGCTTGAGTGGATGGGAATAATCAACCTAGTGGTGGTAGCACAAACTACGCACAGAAGTTCCAGGGCAGAGTCACCATGACCAGGGACACGTCCACGAGCACACTCTACATGGAGCTGAACAGCCTGAGATCTGAGGACACGGCCGTGTATTACTGTGCGAGTGGTTGGAGTTAAACTACTGGGGCCAGGGAACCCTGGTCACCGTCTCCTCA |
| | | | SEQ ID NO: 27439 | SEQ ID NO: 31445 |

FIGURE 50
(Continued)

| | | AA | SSELTQDPAVSVALGQTVRITCQGDSLRSYYAS WYQQKPGQAPILVIYAKNNRPSGIPDRFSGSNSG NTASLTITGAQAEDEADYYCNSRDSSGSHVVFG GGTKLTVL<br>SEQ ID NO: 27440 | QVQLVQSGAEVKKPGASVKVSCKASGYTFNSYYM YWVRQAPGQGLEWMGIINPSGGSTNYAQKFQGRV TMTRDTSTSTLYMELNSLRSEDTAVYYCASGWELN YWGQGTLVTVSS<br>SEQ ID NO: 31446 |
|---|---|---|---|---|
| iPS:436802 | 21-225_171E12 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCCC TGTGCTGGTCATCTATCAAGATCGCAAGCGG CCCTCAGGGATCCCTGAGCGATTCTCTGGCTCC AACTCTGGGAACACAGCCACCCTGACCATCAG CGGGACCCAGGCTATGGATGAGGCTGACTATT ACTGTCAGGCGTGGGACACATCAGCACTTATGTG GTATTCGGCGGAGGGACCAAACTGACCGTCCT A<br>SEQ ID NO: 27441 | CAGGTGCAGCTGGTGCAGTCTGGGGGAGGCGTG GTCCAGCCTGGGAGGTCCCTGAGACTCTCCTGTG CAGCGTCTGGATTCACCTTCAGTAGTTATGGCAT GCACTGGGTCCGCCAGGCTCCAGGCAAGGGGCT GGAGTGGGTGGCAGTTATATGGAATGATGAGG TAATAAATATAATCACCATTCCAAGAGACAATTCCAAGAACACG CTGTATCTGCAAATGAACAGTCTGAGAGCCGAG GACACGGCTGTGTATTACTGTGCGAGAGACCGTA CGTATTACTCTGGTTCGGGGAGCCCCCCTACTA CTACTACGGTATGGACGTCTGGGGCCAAGGG ACCACGGTCACCGTCTCCTCA<br>SEQ ID NO: 31447 |
| | | AA | SYELTQPPSVSVSPGQTASITCSGDKLGDKYACW YQQKPGQSPVLVIYQDRKRPSGIPERFSGSNSGN TATLTISGTQAMDEADYYCQAWDISTYVVFGGG TKLTVL<br>SEQ ID NO: 27442 | QVQLVESGGGVVQPGRSLRLSCAASGFTFSSYGMH WVRQAPGKGLEWVAVIWNDGGNKYNGDSVKGRF TISRDNSKNTLYLQMNSLRAEDTAVYYCARDRTYY SGSGSPPYYYYGMDVWGQGTTVTVSS<br>SEQ ID NO: 31448 |

FIGURE 50
(Continued)

| | | | | |
|---|---|---|---|---|
| iPS:436804 | 21-225_172C3 | NA | TCTTCTCTGAGCTGACTCAGGACCCTGCTGTGTCT GTGGCCTTGGGACAGAGCCTCAGGACAGTCAGGATCACATG CCAAGGAGACAGCCTCAGAACTATTATGTAA GCTGGTACCAGCAGAAGCCAGGACAGGCCCC TATACTTGTCATCTATACTAAAAACAGCGGC CCTCAGGGATCCCAGACCGATTCTCTGGCTCC ACCTCAGGAAACACAGCTTCCTTGACCATCAC TGGGACTCAGGCGGAAGATGAGGCTGACTATT ACTGTAACTCCCGGGACAGCAGTGGCAACCAT GTGGTATTCGGCGGCGAGGGACCAAGCTGACCGT CCTA<br>SEQ ID NO: 27443 | CAGGTGCAGCTGGTGCAGTCTGGGGCTGAGGTG AAGAAGCTGGGGCTCAGTGACGGTTTCCTGCA AGGCATCTGGATACACCTTCAGAAGTTACTATAT GTATTGGGTGCGACAGGCCCCTGGACAAGGGCTT GAGTGGGTGGGAACAATCAACCCTAGTGGTGGT AGCACAAACTACGCACAGAAGTTCCAGGGCAGA GTCACCATGACCAGGGACACGTCCAGAGCACA CTCTACATGGAGCTGAACAGCCTGAGATCTGAGG ACACGGCCGTGTATTACTGTGCGAGTGGCTGGGA GTTAAACTACTGGGGCCAGGGAACCCTGGTCACC GTCTCCTCA<br>SEQ ID NO: 31449 |
| | | AA | SSELTQDPAVSVALGQTVRITCQGDSLRNYYVS WYQQKPGQAPILVIYTKNSRPSGIPDRFSGSTSG NTASLTITGTQAEDEADYYCNSRDSSGNHVVFG GGTKLTVL<br>SEQ ID NO: 27444 | QVQLVQSGAEVKKPGASVKVSCKASGYTFRSYYM YWVRQAPGQGLEWVGTINPSGGSTNYAQKFQGRV TMTRDTSTSTLYMELNSLRSEDTAVYYCASGWELN YWGQGTLVTVSS<br>SEQ ID NO: 31450 |
| iPS:436806 | 21-225_172B12 | NA | TCTTCTCTGAGCTGACTCAGGACCCTGCTGTGTCT GTGGCCTTGGGACAGAGCCTCAGGACAGTCAGGATCACATG CCAAGGAGACAGCCTCAGAACTATTATGCAA GCTGGTACCAGCAGAAGCCCCTGGACAGGCCCC TATACTTGTCATCTATACTAAAAACAGCGGC CCTCAGGGATCCCAGACCGATTCTCTGGCTCC ACCTCAGGAAACACAGCTTCCTTGACCATCAC TGGGGCTCAGGCGGGAAGATGAGGCTGACTATT ACTGTAACTCCCGGGACAGCAGTGGCAACCAT GTGGTATTCGGCGGCGAGGGACCAAGCTGACCGT CCTA<br>SEQ ID NO: 27445 | CAGGTGCAGCTGGTGCAGTCTGGGGCTGAGGTG AAGAAGCTGGGGCCTCAGTGACGGTTTCCTGCA AGGCATCTGATACACCTTCAGAAGTTACTATAT GTATTGGGTGCGACAGGCCCCTGGACAAGGGCTT GAGTGGGTGGGAACAATCAACCTAGTGGTGGT AGCACAGACTACGCACAGAAGTTCCAGGGCAGA GTCACCATGACCAGGGACACGTCCACGAGCACA CTCTACATGGAGCTGAACAGCCTGAGATCTGAGG ACACGGCCGTGTATTACTGTGCGAGTGGCTGGGA ATTAAACTACTGGGGCCAGGGAACCCTGGTCACC GTCTCCTCA<br>SEQ ID NO: 31451 |

FIGURE 50
(Continued)

| | | | |
|---|---|---|---|
| iPS:436808 | 21-225_173F8 | AA | SSELTQDPAVSVALGQTVRITCQGDSLRNYYAS WYQQKPGQAPILVIYTKNSRPSGIPDRFSGSTSG NTASLTITGAQAEDEADYYCNSRDSSGNHVVFG GGTKLTVL<br>SEQ ID NO: 27446 | QVQLVQSGAEVKKPGASVTVSCKASGYTFRSYYM YWVRQAPGQGLEWMGIINPSGGSTDYAQKFQGRV TMTRDTSTSTLYMELNSLRSEDTAVYYCASGWELN YWGQGTLVTVSS<br>SEQ ID NO: 31452 |
| | | NA | TCCTATGAGCTGACTCAGCCACCCTCAGTGTC CGTGTCCCCAGGACAGACAGCCAGCATCACCT GCTCTCTGAAATAAATTGGGAATACAGCATATGTT TGCTGGTATCAGCAGAAGCCAGGCCAGTCCCC TGTGCTGGTCATCTCTCAAGATAGCAGGCGGC CCTCAGGGATCCCTGAGCGATTCTCTGGCTCC AACTCTGGGAACACAGGCTATGATGAGGCTGACTATT ACTGTCAGGCGTGGGACAGCTTCACTGTGGTA TTCGGCGGAGGGACCAAGCTGACGTCCTA<br>SEQ ID NO: 27447 | CAGGTGCAGCTGGTGGAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAATGGGTGGCAGTTATATCATATGATGGAAGT CCTAAATACTGTGCAGACTCCGTGAAGGGCCGAT TCACCATCTCCAGAGACAACAATTCCAAGAACACGCT GTTTCTCCAAATGAACAGCCTGAGAGCTGAGGAC ACGGCTGTGTATTATTGTGCGAGAGATGAAAGGC AGTGGCTGCCGCCCCTACGGTATGGACGTCTG GGGCCAAGGGACCACGGTCACCGTCTCCTCA<br>SEQ ID NO: 31453 |
| | | AA | SYELTQPPSVSVSPGQTASITCSGNKLGNKYVCW YQQRPGQSPVLVISQDSRRPSGIPERFSGSNSGNT ATLTISGTQAMDEADYYCQAWDSFTVVFGGGT KLTVL<br>SEQ ID NO: 27448 | QVQLVESGGGVVQPGRSLRLSCAASGFTFSSYGMH WVRQAPGKGLEWVAVISYDGSPKYCADSVKGRFT ISRDNSKNTLFLQMNSLRAEDTAVYYCARDERQW LPAPYGMDVWGQGTTVTSS<br>SEQ ID NO: 31454 |

FIGURE 50
(Continued)

| | | | |
|---|---|---|---|
| iPS:436810 | 21-225_175F4 | NA | CAGTCTGCCCTGACTCAGCCTGCCTCCGTGTCT GGGTCTCCTGGACAGTCGATCACCATCTCCTG CACTGGAACCAGCAGTGATGTTGGACGTTTA ACCTTGTCTCCTGGTACCAACAGCACCCAGGC TACGCCCCAAACTCATGATTTATGAGGTCAG TAAGCGGCCCTCAGGGGTTTCTAATGCTTCT CTGGCTCCAAGTCTGGCAACACGGCCTCCCTG ACAATCTCTGGGCTCCAGGCTGAGGACGAGGC TGATTATTACTGCTGCTCATATGCAGGTAGTA GCACCTATGTGGTATTCGGCGGAGGGACCAAG CTGACCGTCCTG |
| | | | CAGGTACAGCTGCAGCAGTCAGGTCCAGGACTG GTGAAGCCCTCGCAGACCCTCTCACTCACCTGTG CCATCTCCGGGGACAGTGTCTCTAGCAACAGTGC TGCTTGGAACTGGATCAGGCAGTCCCCATCGAGA GGCCTTGAGTGGCTGGGAAGGACATACTACAGG TCCAAGTGGTATAAATGCTTATCCAGTATCTATGG AAAGTCGAATATCATCAACCAGACACATCCA AGAACCAGTTCTCCCTGCAGCTGAACTCTGTGAC TCCCGAGGACACGGCTGTTTATTACTGTGCAAGA GATAAGGCAGCTGGGAGGAATGACTTCTACTACT ACGGTATGGACGTCTGGGGCCAAGGGACCACGG TCACCGTCTCCTCA |
| | | | SEQ ID NO: 27449 |
| | | AA | QSALTQPASVSGSPGQSITISCTGTSSDVGRFNLV SWYQQHPGYAPKLMIYEVSKRPSGVSNRFSGSK SGNTASLTISGLQAEDEADYYCCSYAGSSTYVVF GGGTKLTVL |
| | | | QVQLQQSGPGLVKPSQTLSLTCAISGDSVSSNSAA WNWIRQSPSRGLEWLGRTYYRSKWYNAYPVSMES RISINPDTSKNQFSLQLNSVTPEDTAVYYCARDKAA GRNDFYYYGMDVWGQGTTVTVSS |
| | | | SEQ ID NO: 31455 |
| | | | SEQ ID NO: 27450 |
| iPS:436812 | 21-225_175C6 | NA | TCCTATGACCTGACTCAGCCACCTCAGTGTC CGTGTCCCCAGGACAGACAGCCAGCATCACCT GCTCTGGAGATAAATTGGGGGATAAATATGCT TGTTGGTATCAGCAGAAGCCAGGCCAGTCCCC TATACTGGTCATCTATCAAGATTACAAGCGGC CCTCAGGGATCCCTGAGCGATTCTCTGGCTCC AACTCTGGGAACACAGCCACTCTGACCATCAG CGGGACCCAGGCTGTGGGACAACAGGCTGACTATT ATTGTCAGGCGTGGGACAGCAGCACTACTGTA TTCGGCGGAGGGACCCAGGCTGACCGTCCTA |
| | | | CAGGTGCAGCTGGTGGAGTCTGGGGGAGGCGTG GTCCAGCCTGGGAGGTCCCTGAGACTCTCCTGTG CAGCGTCTGGACTCACCTTCAGTAACTGTGGCAT GCACTGGGTCCGCCAGGCTCCAGGCAAGGGGCT GGAGTGGGTGGCAATTATATGTATGATGGAAGT AATAAATACTATGCAGACTCCGTGAAGGGCCGA TTCACCGTCTCCAGAGACAATTCCAAGAACACGC TGTATCTGCAAATGAACAGCCTGAGAGCCGAGG ACACGGCTGTGTATTACTGTGCGAGAGATCAGTA CAACAGGAACGACGGACCACCAGTTACTACTA CTACTACGGTTTGGACGTCTGGGGCCAAGGGACC ACGGTCACCGTCTCCTCA |
| | | | SEQ ID NO: 31456 |

FIGURE 50
(Continued)

| | | | |
|---|---|---|---|
| | | SEQ ID NO: 27451 | SEQ ID NO: 31457 |
| | AA | SYDLTQPPSVSVSPGQTASITCSGDKLGDKYAC WYQQKPGQSPILVIYQDYKRPSGIPERFSGSNSG NTATLTISGTQAMDEADYYCQAWDNSTMVFGG GTRLTVL | QVQLVESGGGVVQPGRSLRLSCAASGLTFSNCGM HWVRQAPGKGLEWVAIIWYDGSNKYYADSVKGR FTVSRDNSKNTLDLQMNSLRAEDTAVYYCARDQY NRNDGPPAYYYYGLDVWGQGTTVTVSS |
| | | SEQ ID NO: 27452 | SEQ ID NO: 31458 |
| iPS:436814 | NA | CAGTCTGCCCTGACTCAGCCTCCCTCCGTGTCT GGGTCTCCTGGACAGTCGATCACCATCTCCTG CACTGGAACCAGCAGTGATGTTGGACGTTTA ACCTTGTCCTGGTACCAACACCACCAGGC AACGCCCCCAAACTCATGATTTATGAAGTCAG TAAGCGGCCCTCAGGGGTTTCTAATCGCTTCT CTGGCTCCAAGTCTGGCAACACGGCCTCCCTG ACAATCTCTGGGCTCCAGGCTGAGGACGAGGC TGATTATTACTGCTGCTCATATGCAGGTAGTA GCACCTTTGTAGTATTCGGCGGAGGGACCAAG CTGACCGTCCTA | CAGGTACAGCTGCAGCAGTCAGGTCAGGACTG GTGAAGCCCTCGCAGACCCTCTCACTCACCTGTG CCATCTCCGGGGACAGTGTCTAGCAACAGTGC TGCTTGGAACTGATCAGGCAGTCCCATGAGA GGCCTTGAGTGGCTGGGAAGGACATACTACAGG TCCAAGTGGTATAGTGCTTATCCAGTATCTATGG AAAGTCGAGTATCCATCAACCAGACACATCCA AGAACCAGTTCTCCCTGCAGTGTTTATTACTGTGCTGTGAC TCCGAGGACACGGCTGTTTATTACTGTGCAAGA GATAAGGCAGCTGGAGAAGAATGACTTCTACTACT ACGGTATGGACGTCTGGGGCCAAGGGACCACGG TCACCGTCTCCTCA |
| 21-225_I78H10 | | SEQ ID NO: 27453 | SEQ ID NO: 31459 |
| | AA | QSALTQPASVSGSPGQSITISCTGTSSDVGRFNLV SWYQHHPGNAPKLMIYEVSKRPSGVSNRFSGSK SGNTASLTISGLQAEDEADYYCCSYAGSSTFVVF GGGTKLTVL | QVQLQQSGPGLVKPSQTLSLTCAISGDSVSSNSAA WNWIRQSPSRGLEWLGRTYYRSKWYSAYPVSMES RVSINPDTSKNQFSLQLNSVTPEDTAVYYCARDKA AGRNDFYYGMDVWGQGTTVTVSS |
| | | SEQ ID NO: 27454 | SEQ ID NO: 31460 |

FIGURE 50
(Continued)

| | | | | |
|---|---|---|---|---|
| iPS:436816 | 21-225_179H5 | NA | TCTTCTGAGCTGACTCAGGACCCTGCTGTGTCT<br>GTGGCCTTGGGACAGACAGTCAGGATCACATG<br>CCAAGGAGACAGTCTCAGAAGCTCAGAACAGGCCCC<br>GCTGGTACCAGCAGAAGCCAGGACAGGCCCC<br>TGTATTTGTCATCTATGGTAAAAACAACCGGC<br>CCTCAGGGATCCCAGACCGATTCTCTGGCTCC<br>AGGTCAGGAAACACAGCTTCCTTGACCATCAC<br>TGGGGCTCAGGCGGAAGATGAGGCTGACTATT<br>ACTGTAACTCCCGGGACAGCAGTGGTAACCAT<br>TGGGTGTTCGGCGGAGGGACCAAACTGACCGT<br>CCTA<br>SEQ ID NO: 27455 | CAGGTGCAGTTGGTGGAGTCTGGGGGAGGCGTG<br>GTCCAGCCTGGGAGGTCCCTGAGACTCTCCTGTG<br>CAGCGTCTGGATTCACCTTCAGTAGCTATGGCAT<br>GCACTGGGTCCGCCAGGCTCCAGGCAAGGGCT<br>GGAGTGGGTGGCAGTTATATGTATGATGGAAGT<br>AATGAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGATATCCG<br>GAACTACTACGGTTTGGACGTCTGGGGCCAA<br>GGGACCACGGTCACCGTCTCCTCA<br>SEQ ID NO: 31461 |
| | | AA | SSELTQDPAVSVALGQTVRITCQGDSLRNYYAS<br>WYQQKPGQAPVFVIYGKNNRPSGIPDRFSGSRS<br>GNTASLTITGAQAEDEADYYCNSRDSSGNHWVF<br>GGGTKLTVL<br>SEQ ID NO: 27456 | QVQLVESGGGVVQPGRSLRLSCAASGFTFSSYGMH<br>WVRQAPGKGLEWVAVIWYDGSNEYYADSVKGRF<br>TISRDNSKNTLYLQMNSLRAEDTAVYYCARDIRNY<br>YYGLDVWGQGTTVTVSS<br>SEQ ID NO: 31462 |
| iPS:436818 | 21-225_179C7 | NA | TCCTATGAGCTGACTCAGCCACCTCAGTGTC<br>CGTGTCCCCAGGACAGACAGCCAGTATCACCT<br>GCTCTGGAGATAAATTGGGGATAAAATATGTT<br>TGCTGGTATCAACAGAGGCCGGGCCAGTCCCC<br>TGTGCTGGTCATCTATCAGGATAGTAAGCGGC<br>CCTCAGGGATCCCTGAGCGATTCTCTGGCTCC<br>AACTCTGGGAACACAGCCACTCTGACCATCCG<br>CGGGACCCAGGCTATGGATGAGGCTGACTATT<br>ACTGTCAGGCGTGGGACAGCAACACTGCAGTG<br>GTATTCGGCGGAGGGACCAAGCTGACCGTCCT<br>A<br>SEQ ID NO: 27457 | CAGGCGCAGCTGGTGGAGTCTGGGGGAGGCGTG<br>GTCCAGCCTGGGAGGTCCCTGAGACTCTCCTGTG<br>CAGCGTCTGGATTCACCTTCAGTAACTCTGGCAT<br>GCACTGGGTCCGCCAGGTCCAGGCAAGGGGCT<br>GGAGTGGGTGGCAGATTATATTATGATGGAAGT<br>TATAAATACAATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTATATTACTGTGCGAGAGACCGTCA<br>TTACGATTTCCACGTTCCTACTATTACTACG<br>GTATGGACGTCTGGGGCCAAGGGACCACGGTCA<br>CCGTCTCCTCA<br>SEQ ID NO: 31463 |

FIGURE 50
(Continued)

| | | | |
|---|---|---|---|
| iPS:436820 | 21-225_179D10 | AA | SYELTQPPSVSVSPGQTASITCSGDKLGDKYVCW YQQRPGQSPVLVIYQDSKRPSGIPERFSGSNSGN TATLTIRGTQAMDEADYYCQAWDSNTAVFGG GTKLTVL<br>SEQ ID NO: 27458 | QAQLVESGGGVVQPGRSLRLSCAASGFTFSNSGMH WVRQAPGKGLEWVAIIYDGSYKYNADSVKGRFT ISRDNSKNTLYLQMNSLRAEDTAVYYCARDRHYD FHVPYYYYGMDVWGQGTTVTVSS<br>SEQ ID NO: 31464 |
| | | NA | CAGTCTGTGTTGACGCAGCCGCCCTCAGTGTC TGGGGCCCCAGGGCAGAGGGTCACCATCTCCT GCACTGGGAGCAGCTCCAACTTCGGGACAGAT TATGATGTACACTGGTACCAGCAATTCCAGG AACAGCCCCAAACTCCTCATCTATGGTCACA GCAACCGGCCCTCAGGGGTCCCTGACCGATTT TCTGGCTCCAAGTCTGGCACCTCAGCCTCCT GGCCATCACTGGGCTCCAGGCTGAGGATGAGG CTGATTATTACTGCCAGTCCTATGATAGAAGC CTGAATGTGGTCTTCGGCGGAGGGACCAAGCT GACCGTCCTA<br>SEQ ID NO: 27459 | GAGGTGCAGCTGGTGGAGTCTGGGGGAGGCTTG GTACAGCCTGGGGGGTCCCTGAGATTCTCCTGTG CAGCCTCTGGATTCACCTTCAGTAGCTATAGCAT GAACTGGGTCCGCCAGGCTCCAGGGAAGGGGCT GGAGTGGGTTGCATACATTAGTAGTAGTGGAAGT ACCACATACTACGCAGACTCTGTGCAGGGCCGAT TCACCATCTCCAGAGACAATGCCAAGAACTCACT GTATCTGCAAATGAACAGCCTGAGAGACGAGGA CACGGCTGTGTATCGCTGTGCGAGAGATAGTAGG AAGGGGTTCTACTACGGTCTGGACGTCTGGGCC AAGGGATCACCGTCACCGTCTCCTCA<br>SEQ ID NO: 31465 |
| | | AA | QSVLTQPPSVSGAPGQRVTISCTGSSSNFGTDYD VHWYQQFPGTAPKLLIYGHSNRPSGVPDRFSGS KSGTSASLAITGLQAEDEADYYCQSYDRSLNVV FGGGTKLTVL<br>SEQ ID NO: 27460 | EVQLVESGGGLVQPGGSLRFSCAASGFTFSSYSMN WVRQAPGKGLEWVAYISSSGSTTYYADSVQGRFTI SRDNAKNSLYLQMNSLRDEDTAVYRCARDSRKGF YYGLDVWGQGITVSS<br>SEQ ID NO: 31466 |

FIGURE 50
(Continued)

| | | | |
|---|---|---|---|
| iPS:436822 | 21-225_180D4 | NA | TCCTATGAGCTGACTCAGGACACCCTCAGTGTC CGTGTCCCAGGAGATAGATTGGGGACAGCAGCCT GCTCTGGAGATAGATTGGGGATAAATATGCT TGCTGGTATCAGCAGAAGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGTGACTATT ACTGTCAGGGCGTGGACAGTAGGAAAGTGGT ATTCGGCGGAGGGACCAAGCTGACCGTCCTA<br><br>SEQ ID NO: 27461 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTTTGGCAT GCACTGGGTCCGCCAGGCTCCAGGCAAGGGCT GGAGTGGGTGGCAATTATATGGTATGATGGAAGT GATAAATACTATGCAGACTCCGTGAAGGCCGA TTCACCATCTCCAGAGACAATTCCAAGAACACGC TGTATCTGCAAATGAACACCCTGAGAGCCGAAG ACACGGCTGTGTATTCTGTGCGAGAGGGGGCC CCCGTTCTCTACGGTGACTATGTACTTTGACTACT GGGGCCAGGGAACCCTGGTCACCGTCTCCTA<br><br>SEQ ID NO: 31467 |
| | | AA | SYELTQTPSVSVSPGQTASITCSGDRLGDKYACW YQQKPGQSPVLVIYEDRKRPSGIPERFSGSNSGN TATLTISGTQAMDEGDYYCQAWDSRKVVFGGG TKLTVL<br><br>SEQ ID NO: 27462 | QVQLVESGGGVVQPGRSLRLSCAASGFTFSNFGMH WVRQAPGKGLEWVAIIWYDGSDKYYADSVKGRFT ISRDNSKNTLYLQMNTLRAEDTAVYFCARGGPPFS TVTMYFDYWGQGTLVTVSS<br><br>SEQ ID NO: 31468 |
| iPS:436824 | 21-225_180C5 | NA | TCCTATGAACTGACTCAGCCACCCTCAGTGTC CGTGTCCCAGGAGACAGCAGCCAGCATCACCT GCTCTGGAGATAAATTGGGGGACAAAATATGCT TGCTGGTATCAGCAGAAGCCAGGCCAGTCCCC TGTACTGGTCATCTATCAAGATAGAAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGCGGTA TTCGGCGGAGGGACCAAGCTGACCGTCCTA<br><br>SEQ ID NO: 27463 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGGATTCATTCTTGAATG ATGATAAGGCTACAGCCCATCTCTGAAGAGCA GCCTCACCATCACCAAGGACACCTCCAAAAACC AGGTGGTTCTTATAATGACCAACATGACCCTGT GGACAGCCACATATTACTGTGCACACAAGG AGCAGCTGTTGCTTTGATATCTGGGGCCAAGGG ACAAATGGTCACCGTCTCTTCA<br><br>SEQ ID NO: 31469 |

FIGURE 50
(Continued)

| | | | | |
|---|---|---|---|---|
| iPS:436826 | 21-225_180G5 | AA | SYELTQPPSVSVSPGQTASITCSGDKLGEKYACW YQQKPGQSPVLVIYQDRKRPSGIPERFSGSNSGN TATLTISGTQAMDEADYYCQAWDSSTAVFGGG TKLTVL<br>SEQ ID NO: 27464 | QITLKESGPTLVKPTQTLTLTCTFSGFSLSTSGVVG WIRQPPGKALEWLGFISWNDDKRYSPSLKSSLTITK DTSKNQVVLIMTNMDPVDTATYYCAHKAAAVAFD IWGQGTMVTVSS<br>SEQ ID NO: 31470 |
| | | NA | TCCTATGAGCTGACTCAGCCACCCTCAGTGTC CGTGTACCAGGACAGCAGCATCACCT GCTCTGGAGATATCAACAGACCAGTATATGTT AGCTGGTATCAACAGAAGCCAGGCCAGTCCCC TGTTCTGGTCATCTATCAAGATAGCAAGCGC CCTCAGGGATCCCTGAGCGATTCTCTGGCTCC AACTCTGGGAACCCAGCTCTCTGACCATCAG CGGAACCCAGGCTATGGAGGCTGAGGACATT ACTGTCAGGGCTGGGACATCACCACTGCGGTA TTCGGCGGAGGGACCAAGCTGACCGTCCTA<br>SEQ ID NO: 27465 | CAGGTGCAGCTGGTGCAGTCTGGGCTGAGGTG AAGAAGCCTGGGGCCTCAGTGAAGGTCCTGC AAGGCTTCTGGATACACCTTCACCAGTTATGATA TCAACTGGGTGCGACAGGCCACTGGACAAGGC TTGAGTGGATGGGATGGATGAACCCTAACAGTG GTAACACAGGCTATGCACAGAAGTTCCAGGCA GAGTCACCATGACCAGGAACACCTCCATAAGCA CAGCCTACATGGAGCTGAGCAGCCTGAGATCTG AGGACACGGCCGTGTATTACTGTGCGAGAGGGTT TTATTACTACGGTTCGGGAGTCATGTCCCTTACC ACTACTACGGTTTGGACGTCTGGGGCCAAGG GACCACGGTCACCGTCTCCTCA<br>SEQ ID NO: 31471 |
| | | AA | SYELTQPPSVSVYPGQTASITCSGDKLGDKYVS WYQQKPGQSPVLVIYQDSKRPSGIPERFSGSNSG NPASLTISGTQAMDEADYYCQAWDITTAVFGGG TKLTVL<br>SEQ ID NO: 27466 | QVQLVQSGAEVKKPGASVKVSCKASGYTFTSYDIN WVRQATGQGLEWMGWMNPNSGNTGYAQKFQGR VTMTRNTSISTAYMELSSLRSEDTAVYYCARGFYY YGSGSHVPYHYYYGLDVWGQGTTVTVSS<br>SEQ ID NO: 31472 |

FIGURE 50
(Continued)

| | | | |
|---|---|---|---|
| iPS:436828 | 21-225_181H1 | NA | TCCTATGAGCTGACTCAGGACCCTCAGTGTC CGTGTCCCCAGGACAGAGCCAGCATCACCT GCTCTGGAGATAAATTGGGGATAAATATGCT TGCTGGTATCAGCAGAAGCCAGGCCAGTCCCC TGTGCTGGTCATCTATGAAGATAGGAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGGAAAGTGGT ATTCGGCGGAGGGACCAAGCTGACCGTCCTA<br>SEQ ID NO: 27467 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGGCAT GCACTGGGTCCGCCAGGCTCCAGGCAAGGGCT GGAGTGGGTGGCAATTATATGGTATGGATGAAGT GATAAATACTATGCAGACTCCGTGAAGGGCCGA ATCACCATCTCCAGAGACAATTCCAAGAACACG TGTATCTGCAAATGAACACCCTGAGAGCCGAAG ACACGGCTGTGTATTTCTGTGCGGAGGGGGCC CCCGTTTCTACGGTGACTATGTACTTCGACTACT GGGGCCAGGGAACCCTGGTCACCGTCTCCTA<br>SEQ ID NO: 31473 |
| | | AA | SYELTQPSVSVSPGQTASITCSGDKLGDKYAC WYQQKPGQSPVLVIYEDRKRPSGIPERFSGSNSG NTATLTISGTQAMDEADYYCQAWDSRKVVFGG GTKLTVL<br>SEQ ID NO: 27468 | QVQLVESGGGVVQPGRSLRLSCAASGFTFSNYGM HWVRQAPGKGLEWVAIIWYDGSDKYYADSVKGRI TISRDNSKNTLYLQMNTLRAEDTAVYFCARGGPPF STVTMYFDYWGQGTLVTVSS<br>SEQ ID NO: 31474 |
| iPS:436830 | 21-225_51F4 | NA | CAGTCTGTGCTGACTCAGCCACCTCAGCGTC TGGGACCCCCGGGCAGAGGGTCACCATCTCTT GTTCTGGAAGCAGTCCAACATCGAAGTAAT ATTGTGACCTGGTACCAGCAGCTCCCAGGAAC GGCCCCCCAAACTCCTCATCTATAGTAATGATC AGCGGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTACAGCATGGGATGACAGCCGCT AATGGTTGGTGTTCGGCGGAGGGACCAAGCT GACCGTCCTA<br>SEQ ID NO: 27469 | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGTCATGGTAT CAGCTGGGTGCGACAGGCCCCTGGACAAGGGCT TGAGTGGATGGGATGGATCAGCGCTTATAATGGT AACACAAAGTATGCACAGAAGCTCCAGGGCAGA GTCACCATGACCACAGACACATCCAGAGCACA GCCTACATGGAGCTGAGGAGCCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTA<br>SEQ ID NO: 31475 |

FIGURE 50
(Continued)

| | | AA | QSVLTQPPSASGTPGQRVTISCSGSSSNIGSNIVTWYQQLPGTAPKLLIYSNDQRPSGVPDRFSGSKSGTSASLAISGLQSEDETDYYCTAWDDSLNGWVFGGGTTLTVL<br>SEQ ID NO: 27470 | QVQLVQSGAEVKKPGASVKVSCKASGYTFNSYGISWVRQAPGQGLEWMGWISAYNGNTKYAQKLQGRVTMTDTSTSTAYMELRSLRSDDTAVYYCARHDFWSGYYKGMDVWGQGTTVTVSS<br>SEQ ID NO: 31476 |
|---|---|---|---|---|
| iPS:436832 | 21-225_51D8 | NA | CAGTCTGTGCTGACGCAGCCGCCCTCAGTGTCTGGGGCCCCAGGGCAGAGGGTCACCATCCTGCACTGGGAGCAGCTCCAACATCGGGCAGGTTTTGAAGTACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGGCACCTCAGCCTCCCTGGCCATCACTGGGCTCCAGGCTGAGGATGAGGCTGATTATTACTGCCAGTCCTATGACAGCAGCCTGAGTGGTTATGTCTTCGGAACTGGGACCAAGGTCACCGTCCTA<br>SEQ ID NO: 27471 | CAGGTACAGCTGCAGCAGTCAGGTCCAGGACTGGTGAAGCCCTCGCAGACCCTCTCACTCACCTGTGCCATCTCCGGGGACAGTGTCTCTAGTAACAGTGCTGCTTGGAACTGGATCAGGCAGTCCCCATCGAGAGGCCTTGAGTGGCTGGAAGGACATACTACAGGTCCAAGTGGTATAATGATTATCAGTATCTGTGAAAAGTCGAATAACCTTCAACCGGACACATCCAGAACCAGTTCTCCCTGCGGCTGAACTCTGTGACTCCCGAGGACACGGCTGTGTATTACTGTGCAAGAGACCGCTATAACTGGAACTACCCCTACTGGTACTTCGATCTCTGGGGCCGTGGCACCCTGGTCACTGTCTCCTCA<br>SEQ ID NO: 31477 |
| | | AA | QSVLTQPPSVSGAPGQRVTISCTGSSSNIGAGFEVHWYQQLPGTAPKLLIYGNSNRPSGVPDRFSGSKSGTSASLAITGLQAEDEADYYCQSYDSSLSGYVFGTGTKVTVL<br>SEQ ID NO: 27472 | QVQLQQSGPGLVKPSQTLSLTCAISGDSVSSNSAAWNWIRQSPSRGLEWLGRTYYRSKWYNDYAVSVKSRITFNPDTSKNQFSLRLNSVTPEDTAVYYCARDRYNWNYPYWYFDLWGRGTLVTVSS<br>SEQ ID NO: 31478 |

FIGURE 50
(Continued)

| | | | |
|---|---|---|---|
| iPS:436834 | 21-225_52F1 | NA | CAGTCTGTGTTGACTCAGCCACCTCAGCGTCTGGGACCCCGGGCAGAGGGTCACCATCTCTTGTTCTGGAAGCAGCTCCAACATCGGAAGTAATATTGTGACCTGGTACCAGCAGCTCCCAGGAACGGCCCCCAAACTCCTCATCTATAGTAATGATCAGCGGCCCTCAGGGGTCCCTGACCGATTCTCTGGCTCCAAGTCTGGCACCTCAGCCTCCCTGGCCATCAGTGGGCTCCAGTCTGAGGATGAGGCTGATTATTACTGTGCAGCATGGGATGACAGCCTGAATGGTTGGGTGTTCGGCGGAGGGACCACCGCTGACCGTCCTA | CAGGTTCAGCTGGTGCAGTCTGGAGCTGAGGTGAAGAAGCCTGGGGCCTCAGTGAAGGTCTCCTGCAAGGCTTCTGGTTACACCTTTAACAGTATGTGTCAGCTGGGTGCGACAGGCCCCTGGACAAGGCTTGAGTGGATGGGATGGATCAGCGCTTATAATGGTAACAGAAAGTATGCACAGAAGCTCCAGGGCAGAGTCTCCATGACCACAGACACATCCACGAGCACAGCCTACATGGAGCTGAGGAGCCTGAGATCGACGACACGGCCGTGTATTACTGTGCGAGACACGATTTTTGGAGTGGTTATTATAAGGGTATGGACGTCTGGGGCCAAGGGACCACGGTCACCGTCTCCTCA |
| | | | SEQ ID NO: 27473 | SEQ ID NO: 31479 |
| | | AA | QSVLTQPPSASGTPGQRVTISCSGSSSNIGSNIVTWYQQLPGTAPKLLIYSNDQRPSGVPDRFSGSKSGTSASLAISGLQSEDEADYYCAAWDDSLNGWVFGGGTTLTVL | QVQLVQSGAEVKKPGASVKVSCKASGYTFNSYGVSWVRQAPGQGLEWMGWISAYNGNRKYAQKLQGRVSMTTDTSTSTAYMELRSLRSDDTAVYYCARHDFWSGYYKGMDVWGQGTTVTVSS |
| | | | SEQ ID NO: 27474 | SEQ ID NO: 31480 |
| iPS:436836 | 21-225_52H1 | NA | TCCTATGAGCTGACTCAGCCACCTCAGTGTTCGTGTCCCCAGGACAGACAGCCAGCATCACCTCCTCTGGAGATAAATTGGGGGATAAATATGTTTCCTGGTATCAGCAGAAGCCAGGCCAGTCCCCTGTGCTGGTCATCTATCAAGATAGAAAGCGGCCCTCAGGGATCCCTGAGCGATTCTCTGGCTCCAATTCTGGGAATACAGCCACTCTGACCATCAGCGGGACCCAGGCTGTGGACACAGCAGCTATGATGAGGCTGACTATTATTGTGTCGGCGGGACCAAGCTGACCGTCCTA | CAGGTGCAGCTGGTGGAGTCTGGGGGAGGCGTGGTCCAGCCCGGGAGGTCCCTGAGACTCTCCTGTGCAGCGTCTGGATTCACCTTCAGTGACTATGGCATGCACTGGGTCCGCCAGGCTCCAGGCAAGGGGCTGGAGTGGGTGGCAGTTATATGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTTTATTACTGTGCGAGAGATCGGGTCTATTGTAGTAGTTCCAGCTGCTCATATTACTACTACTACTACGGTATGGACGTCTGGGGCCAAGGGACCACGGTCACCGTCTCCTCA |

FIGURE 50
(Continued)

| | | | | |
|---|---|---|---|---|
| iPS:436838 | 21-225_52H4 | AA | SEQ ID NO: 27475<br>SYELTQPPSVFVSPGQTASITSSGDKLGDKYVSW<br>YQQKPGQSPVLVIYQDRKRPSGIPERFSGSNSGN<br>TATLTISGTQAMDEADYYCQAWDNSTVVFGGG<br>TKLTVL<br>SEQ ID NO: 27476 | SEQ ID NO: 31481<br>QVQLVESGGGVVQPGRSLRLSCAASGFTFSGYGM<br>HWVRQAPGKGLEWVAVIWYDGSNKYADSVKGR<br>FTISRDNSKNTLYLQMNSLRAEDTAVYYCARDRVY<br>CSSSSCSYYYYYGMDVWGQGTTVTVSS<br>SEQ ID NO: 31482 |
| | | NA | CAGTCTGCCCTGACTCAGCCTGCCTCCGTGTCT<br>GGGTCTCCTGGACAGTCGATCACCATCTCCTG<br>CACTGGAACCAGCAGTGACGTTGGTGGTTATA<br>ACTATGTCTCCTGGTACCAACAGCACCCAGGC<br>AAAGCCCCCAAACTCATGATTTATGAGGTCAG<br>TAATCGGCCCTCAGGGGTTTCTAATCGCTTCTC<br>TGGCTCCAAGTCTGGCAATACGGCCTCCCTGA<br>CCATCTCTGGGCTCCAGGCTGAGGACGAGGCT<br>GATTATTACTGCAACTCATATACAAGCAACAT<br>CACTGGGGTGTTCGGCGGAGGGACCAAGCTGA<br>CCGTCCTA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGGCTACGGCAT<br>GCACTGGGTCCGCCAGGCTCCAGGCAAGGGGCT<br>GAAATGGGTGGCAGTTATTTGGTATGATGGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGAGGGACTG<br>GAACTACGAGGGTTTGACTACTGGGGCCAGGG<br>AACCCTGGTCACCGTCTCCTCA |
| | | AA | SEQ ID NO: 27477<br>QSALTQPASVSGSPGQSITISCTGTSSDVGGYNY<br>VSWYQQHPGKAPKLMIYEVSNRPSGVSNRFSGS<br>KSGNTASLTISGLQAEDEADYYCNSYTSNITWVF<br>GGGTKLTVL<br>SEQ ID NO: 27478 | SEQ ID NO: 31483<br>QVQLVESGGGVVQPGRSLRLSCAASGFTFSHFGMH<br>WVRQAPGKGLKWVAVIWYDGSNKYYADSVKGRF<br>TISRDNSKNTLYLQMNSLRAEDTAVYYCARGDWN<br>YEGFDYWGQGTLVTVSS<br>SEQ ID NO: 31484 |

FIGURE 50
(Continued)

| | | | |
|---|---|---|---|
| iPS:436840 | 21-225_53E9 | NA | TCCTATGAGCTGACTCAGCCACCCTCAGTGTC CGTGTCCCCAGGACAGACAGCCAGCATCACCT GCTCTGGAACTAAATTGGGGATAAATATGTT TGCTGGTATCAACAGAAGCCAGGCCAGTCCCC TGTGTTGGTCATCAATCAAGATACAATGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGACGTGGGACACAGCAGCACTGCGGT TTCGGCGGAGGGACCACGCTGACCGTCCTA<br>SEQ ID NO: 27479 | CAGGTGCAGCTGGTGCAGTCTGGGGCTGAGGTG AAGAAGCCTGGGGCCTCAGTGAAGGTCTCCTGC AAGGCTTCTGGAAACACCTTCACCGGCTACTATA TGCACTGGGTGCGACAGCCCCTGGACAAGGGC TTGAGTGGATGGGATGGATCATCCTAACAGTGG TGACACAAACTATGCACAGAAGTTCAGGGCAG GGTCACCATGACCAGGGACACGTCCATCAGCAC AGCCTACATGGAGCTGAGCAGGCTGAGATCTGA CGACACGGCCGTCTATTACTGTGCGAGAGATGGG TATAGCAGTGGCTGGTTCAACTGGTTCGACCCCT GGGGCCAGGGAACCCTGGTCACCGTCTCCTA<br>SEQ ID NO: 31485 |
| | | AA | SYELTQPPSVSVSPGQTASITCSGTKLGDKYVCW YQQKPGQSPVLVINQDTMRPSGIPERFSGSNSGN TATLTISGTQAMDEADYYCQTWDSSTAVFGGGT TLTVL<br>SEQ ID NO: 27480 | QVQLVQSGAEVKKPGASVKVSCKASGNTFTGYYM HWVRQAPGQGLEWMGWIIPNSGDTNYAQKFQGR VTMTRDTSISTAYMELSRLRSDDTAVYYCARDGYS SGWFNWFDPWGQGTLVTVSS<br>SEQ ID NO: 31486 |
| iPS:436842 | 21-225_54E9 | NA | CAGTCTGTGCTGACTCAGCCACCCTCAGCGTC TGGGACCCCCGGGCAGAGGGTCACCATCTCTT GTTCTGGAAGCAACTCCAACATCGAAATAAT AGCGTCACCTGGTACCAGCAGCTCCCAGGAAC ATTGTCACCTGGTACCAGCAGCTCCCAGGAAC GGCCCCCAAACTCCTCATCTATGTAATGATC AGCGGCCCCTCAGGGTCCCTGACCGATTCTCT GGCTCCAAGTCTGGCACCTCTGCCTCCTGC CATCAGTGGGCTCCAGTCTGAGGATGAGGCTG ATTATTACTGTGCAGCATGGGATGGCGGGGGGACCACGCT GACCGTCCTA<br>SEQ ID NO: 27481 | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGTCATGGTAT CAGCTGGGTGCGACTGGCCCCTGGACAAGGGCTT GAGTGGATGGGATGGATTAGTGCTTATAATGGTA ACACAAAGAATGCACAGAAGCTCCAGGCAGAG TCACCATGACCACAGAGACACATCCACGAGCAG CCTACATGGAGCTGAGGAGCTGAGATCTGACG ACACGGCCGTGTTTATTACTGTGCGAGACACGATTT TGGAGTGGTTATTATAAGGTATGGACGTCTGG GGCCAAGGGACCACGGTCACCGTCTCCTA<br>SEQ ID NO: 31487 |

FIGURE 50
(Continued)

| | | | | |
|---|---|---|---|---|
| | | AA | QSVLTQPPSASGTPGQRVTISCSGSNSNIGNNIVT WYQQLPGTAPKLLIYVNDQRPSGSVPDRFSGSKS GTSASLAISGLQSEDEADYYCAAWDDSLNGWV FGGGTTLTVL | QVQLVQSGAEVKKPGASVKVSCKASGYTFNSYGIS WVRLAPGQGLEWMGWISAYNGNTKNAQKLQGRV TMTDTSTSTAYMELRSLRSDDTAVYYCARHDFW SGYYKGMDVWGQGTTVTVSS |
| | | | SEQ ID NO: 27482 | SEQ ID NO: 31488 |
| iPS:436844 | 21-225_56G1 | NA | CAGTCTGTGCTGACTCAGCCACCCTCAGGGTC TGGGACCCCGGGCAGAGGGTCACCATCTCTT GTTCTGGAAGCAGCTCCAACATCGGAAGTCAT ATTGTTACCTGGTACCAGCAGCTCCCAGGAAC GGCCCCCAAACTCCTCATCTACAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTGCAGTATGGGATGACAGCCTG ATTGGTTGGGTGTTCGGCGGAGGGACCACGCT GACCGTCCTA | CAGGTTCAGTCTGTGCAGTCTGGAGCTGAGGTGA AGAAGCCTGGGGCCTCAGTGAAGGTCTCCTGCA AGGCTTCTGGCTACACCTTTAACAGTATGGTAT CAGCTGGGTGCGACAGGCCCCTGACAAGGGCT TGAGTGGATGGGATGGATCAGCGCTTATAATGGT AACACAAAGTATGCACAGAAGTTCCAGGGCAGA GTCACCATGACCACAGACACATCCACGAGCACA GCCTACATGGAGCTGAGGAGCCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTCA |
| | | | SEQ ID NO: 27483 | SEQ ID NO: 31489 |
| | | AA | QSVLTQPPSASGTPGQRVTISCSGSSSNIGSHIVT WYQQLPGTAPKLLIYSNDQRPSGSVPDRFSGSKS GTSASLAISGLQSEDEADYYCAVWDDSLIGWVF GGGTTLTVL | QVQLVQSGAEVKKPGASVKVSCKASGYTFNSYGIS WVRQAPGQGLEWMGWISAYNGNTKYAQKFQGRV TMTDTSTSTAYMELRSLRSDDTAVYYCARHDFW SGYYKGMDVWGQGTTVTVSS |
| | | | SEQ ID NO: 27484 | SEQ ID NO: 31490 |

FIGURE 50
(Continued)

| | | | |
|---|---|---|---|
| iPS:436846 | 21-225_56E3 | NA | CAGTCTGTGCTGACTCAGCCACCCTCAGCGTC TGGGACCCCGGGAAGCAGTCCAAGCAGAGGGTCACCATCTCTT GTTCTGGAAGCAGTCCAACATCGGAAGTAAT ATTGTTACCTGGTACCAGCAGCTCCCAGGAAC GGCCCCAAAACTCCTCATCTATAGTAATAATC AGCGGCCCTCAGGGGTCCCTGACCGATTCTCT GGCTCCAAGTCTGGCACCTCAGCCTCCCTGGC CATCAGTGGACTCCAGTCTGAGGATGAGGCTG ATTATTGCTGTGCAGCATGGGATGACAGCCTG AATGGTTGGGTGTTCGGCGGAGGGACCACGCT GACCGTCCTA | CAGGTTCAACTGGTGCAGTCTGGAGCTGAGGTGA AGAAGCCTGGGGCCTCAGTGAAGGTCTCCTGCA AGGCTTCTGGTTACACCTTTAACAGCTATGGTTTC AGCTGGGTGCGACAGGCCCCTGGACAAGGGCTT GAGTGGATGGGATGGATCAGCGTTATAATGGTA ACACAAAGGAAGCACAGACACATCCAGAGCACAG TCACCATGACCACAGACACATCCACGAGCACAG CCTACATGGAGCTGAGGAGCCTGAGAGCTGACG ACACGGCCGTGTATTACTGTGCGAGACACGATTT TTGGAGTGGTTATTATAAGGGTATGGACGTCTGG GGCCAAGGGACCACGGTCACCGTCTCCTCA |
| | | | SEQ ID NO: 27485 | SEQ ID NO: 31491 |
| | | AA | QSVLTQPPSASGTPGQRVTISCSGSSSNIGSNIVT WYQQLPGTAPKLLIYSNNQRPSGVPDRFSGSKS GTSASLAISGLQSEDEADYCCAAWDDSLNGWVF GGGTTLTVL | QVQLVQSGAEVKKPGASVKVSCKASGYTFNSYGF SWVRQAPGQGLEWMGWISAYNGNTKEAQKFQGR VTMTDTSTSTAYMELRSLRADDTAVYYCARHDF WSGYYKGMDVWGQGTTVTVSS |
| | | | SEQ ID NO: 27486 | SEQ ID NO: 31492 |
| iPS:436848 | 21-225_57F1 | NA | TCCTATGAGCTGACTCAGCCACCCTCAGCGTC CGTGTCCCAGGACAGAGCAGCCAGCATCACCT GCTCTGGAGATAAACTGGGGGATAAAAATATGCT TGCTGGTATCAGCAGAAGCCAGGCCAGTCCCC TGTGTTGGTCATCTATCAAGATAGGAAGCGGC CCTCAGGGATCCCTGAGCGATTCTCTGGCTCC AATTCTGGGAACACAGCCACTCTGACCATCAG CGGGACCCAGGCTATGGACGAGCAGCACTGTGTA ACTGTCAGGCGGTGGGACACGCAGCACTGTGTA TTCGGCGGAGGGACCAAACTGACCGTCCTA | CAGATCACCTTGAAGGAGTCTGGTCCTACGCTGG TGAAACCCACACAGACCCTCACGCTGACCTGCAC CTTCTCTGGGTTCTCACTCAGTACTAGTGGAGTG GGTGTGGGCTGATCGTCAGCCGCCCAGGAAAG GCCCTGGAGTGGCTTGCACTCATTATTGGCATG AAGATAAGCGCTACAGCCCATCTCTGAAGAGCA GGCTCACCATCACTGAGGACACCTCCAAAAACC AGGTGGACCTTACAATGACCAACATGGCCCTGT GGACACAGCCACATATTACTGTGCACACGTCACA GGTATAGCAGCTCCCTACTGGGGCCAGGAACC CTGGTCACCGTCTCCTCA |
| | | | SEQ ID NO: 27487 | SEQ ID NO: 31493 |

FIGURE 50
(Continued)

| | | | | |
|---|---|---|---|---|
| | | AA | SYELTQPPSASVSPGQTASITCSGDKLGEKYACW YQQKPGQSPVLVIYQDRKRPSGIPERFSGSNSGN TATLTISGTQAMDEADYYCQAWDSSTVFGGG TKLTVL | QITLKESGPTLVKPTQTLTLTCTFSGFSLSTSGVG WIRQPPGKALEWLALIYWHEDKRYSPSLKSRLTITE DTSKNQVDLTMTNMAPVDTATYYCAHVTGIAAPY WGQGTLVTVSS |
| | | | SEQ ID NO: 27488 | SEQ ID NO: 31494 |
| iPS:436850 | 21-225_57D9 | NA | TCCTATGAGCTGACTCAGCCACCTCAGTGTC CGTGTCCCAGGACAGACAGCCAGCATCACCT GCTCTGAGAGAAATTGGGGAAAATTTGCT TGCTGGTCAGCAGAAGCCAGGCCAGTCCC TGTGTTGGTCATCTATCAAGATAGCAAGCGGC CCTCAGGGATCCCTGAGCGATTCTCTGGCTCC AACTCTGGGAACACAGGCTATGATGAGGCTGACTATT ACTGTCAGGCGTGGGACAGCAGCACTGTGTA TTCGGCGGAGGGACCAAGCTGACCGTCCTA | CAGATCACCTTGAAGGAGTCTGGTCCTATGCTGG TGAAACCCACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGCGCTACAGTCCATCCTCTGAAGAGCAG GCTCACCATCACCGAGGACACCTCAAAAACCA GGTGGTCCTTACAATGACCAACATGGACACATGTGTG GACACAGCCACATATTACTGTGCACATGCAGTGG CTGTCTCCTTTGACTACTGGGGCCAGGGAACCCT GGTCACCGTCTCCTCA |
| | | | SEQ ID NO: 27489 | SEQ ID NO: 31495 |
| | | AA | SYELTQPPSVSVSPGQTASITCSGEKLGEKFACW SQQKPGQSPVLVIYQDSKRPSGIPERFSGSNSGNT ATLTISGTQAMDEADYYCQAWDSSTVFGGGT KLTVL | QITLKESGPMLVKPTQTLTLTCTFSGFSLSTSGVGV GWIRQPPGKALEWLALIYWNDDKRYSPSLKSRLTI TEDTSKNQVLTMTNMDPVDTATYYCAHAVAVSF DYWGQGTLVTVSS |
| | | | SEQ ID NO: 27490 | SEQ ID NO: 31496 |

FIGURE 50
(Continued)

| | | | | |
|---|---|---|---|---|
| iPS:436852 | 21-225_57H11 | NA | TCCTATGCTGACTCAGCCACCCTCAGCGTC CGTGTCCCAGGACAGACAGCCAGCATCACCT GCTCTGGAGATAAACTGGGGGAAAAATATGCT TGCTGGTATCAGCAGAAGCCAGGCCAGTCCCC TGTGGTTGGTCATCTATCAAGATAGGAAGCGGC CCTCAGGGATCCCTGAGGCGATTCTCTGGCTCC AATTCTGGGAACACAGCCACTCTGACCATCAG CGGGACCCAGGCTATGGATGAGGCTGACTATT ACTGTCAGGCGTGGGACCAGCAGCACTGTGTA TTCGGCGGAGGGACCAAACTGACCGTCCTA | CAGATCACCTTGAAGGAGTCTGGTCCTACGCTGG TGAAACCCACACAGACCCTCACGCTGACCTGCAC CTTCTCTGGGTTCTCACTCACTACTAGTGGAGTG GGTGTGGGCTGGATCCGTCAGCCCCCAGGAAAG GCCCTGGAGTGGCTTGCACTCATTTATTGGCATG AAGATAGGCGCTACAGCCCATCTCTGAAGAGCA GGCTCACCATCACTGAGGACACCTCCAAAAACC AGGTGGACCTTACAATGACCAACATGGCCCTGT GGACACAGCCACATATTACTGTGCACACGTCACA GGTATAGCAGCTCCCTACTGGGGCCAGGGAACC CTGGTCACCGTCTCCTCA |
| | | AA | SYALTQPPSASVSPGQTASITCSGDKLGEKYACW YQQKPGQSPVLVIYQDRKRPSGIPERFSGSNSGN TATLTISGTQAMDEADYYCQAWDSSTVVFGGG TKLTVL | QITLKESGPTLVKPTQTLTLTCTFSGFSLTTSGVG WIRQPPGKALEWLALIYWHEDRRYSPSLKSRLTITE DTSKNQVDLTMTNMAPVDTATYYCAHVTGIAAPY WGQGTLVTVSS |
| | | | SEQ ID NO: 27491 | SEQ ID NO: 31497 |
| | | | SEQ ID NO: 27492 | SEQ ID NO: 31498 |
| iPS:436854 | 21-225_58C1 | NA | TCCTATGAGCTGACTCAGCCACCCTCAGTGTC CGTGTCCCAGGACAGACAGCCAACAGCCACCT GCTCTGGAGATAAATTGGGGAATAAATATGCT TGCTGGTATCAGCAGAAGCCAGGCCAGTCCCC TGTATTGGTCATCTATCAAGATAGGAAGCGGC CCTCAGGGATCCCTGAGGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTCCTC GGCGGAGGGACCAAGCTGACCGTCCTC | CAGATCACCTTGAAGGAGTCTGGTCCTACGCTGG TGAAACCCACACAGACCCTCACGCTGACCTGCAC CTTCTCTGGGTTCTCACTCACTACTAGTGGAGTG GGTGTGGGCTGGATCCGTCAGCCCCCAGGAAAG ATGCTGGAGTGGCTTGCACTCATTTATTGGGATG GGCTCACCATCACCGAGGACACCTCCAAAAACC AGGTGGTCCTTACAATGACCAACATGACCCTGT GGACACAGCCACATATTACTGTCACACCTTATA GCAGTGGCCTTTGACTCCTGGGGCCAGGGAACCC TGGTCACCGTCTCCTCA |
| | | | SEQ ID NO: 27493 | SEQ ID NO: 31499 |

FIGURE 50
(Continued)

| | | | | |
|---|---|---|---|---|
| iPS:436856 | 21-225_58C5 | AA | SYELTQPPSVSVSPGQTANITCSGDKLGNKYAC WYQQKPGQSPVLVIYQDRKRPSGIPERFSGSNSG NTATLTISGTQAMDEADYYCQAWDSSTAFGGG TKLTVL<br><br>SEQ ID NO: 27494 | QITLKESGPTLVKPTQTLTLTCTFSGFSLSTSGVVG WIRQPPGKALEWLALIYWDDDKRYSPSLKSRLTITE DTSKNQVVLTMTNMDPVDTATYYCAHLIAVAFDS WGQGTLVTVSS<br><br>SEQ ID NO: 31500 |
| | | NA | CAGTCTGTGTTGACGCAGCCGCCCTCAGTGTC TGGGGCCCCAGGACAGAAGGTCACCATCTCCT GCTCTGGAAGCAGCTCCAACATTGGGAATAAT TATGTATCCTGGTACCAGCAGCTCCCAGGAAC AGCCCCCAAACTCCTCATTTATGACAATAATA AGCGACCCTCAGGGATTCCTGACCGATTTTCT GGCTCCAAGTCTGGCACGTCAGCCACCCTGG CATCACCGGACTCCAGACTGGGGACGAGCC GATTATTACTGCGGAACATGGGATATCAGTCT GAGTGTTGGGGTATTCGGCGGAGGGACCAAG CTGACCGTCCTA<br><br>SEQ ID NO: 27495 | GAGGTGCAGTTGGTGGAGTCTGGGGGAGGCCTG GTCAAGCCTGGGGGGTCCCTGAGACTCTCCTGTG CAGCCTCTGGATTCACCTTCAATAGCTATAGCAT GAACTGGGTCCGCCAGGCTCCAGGAAGGGCT GGAGTGGATCTCATCATTAGTAGTAGTAGTTAT TACTTATATACTACGCAGACTCAGTGAAGGCCGAT TCACCATCTCCAGAGACAACAGCGCCAAGAATTCACT GTATCTGCAAATGAACAGCTGAGAGCCGAGGA CACGGCTGTATATTACTGTGCGAGGACCTATAGT GGGAGTTTTGACTACTGGGGCCAGGGAACCCTG GTCACCGTCCTCCTCA<br><br>SEQ ID NO: 31501 |
| | | AA | QSVLTQPPSVSAAPGQKVTISCSGSSSNIGNNYVS WYYQLPGTAPKLLIYDNNKRPSGIPDRFSGSKSG TSATLGITGLQTGDEADYYCGTWDISLSVGVFG GGTKLTVL<br><br>SEQ ID NO: 27496 | EVQLVESGGGLVKPGGSLRLSCAASGFTNSYSMN WVRQAPGKGLEWISSISSSSYYLYYADSVKGRFTIS RDSAKNSLYLQMNSLRAEDTAVYYCARTYSGSFD YWGQGTLVTVSS<br><br>SEQ ID NO: 31502 |

FIGURE 50
(Continued)

| | | | |
|---|---|---|---|
| iPS:436858 | 21-225_58E7 | NA | TCCTATGAACTGACTCAGTCAGTCACCCTCGGTGTC CGTGTCCCAGGACAGACAGCCAGCATCACCT GTTCTGGAGATAAATTGGGGGATAAATATACT TGCTGGTATCAGAAGAAGCCAGGCCAGTCCCC TGTGCTGGTCATCTATCAAGATAACAAGCGGC CCTCAGGGATCCCGAGCGATTCTCTGGCTCC AACTCTGGGAACACAGCCACTCTGACCATCAG CGGGACCCAGGCTATGGATGAGGCTGACTATT TCTGTCAGGCGTGGAACAACTACACTGTGTA TTCGGCGGAGGGACCAAGCTGACCGCTCTA<br><br>SEQ ID NO: 27497 | CAGGTGCAGTTGGTGGAGTCTGGGGGAGGCGTG GTCCAGCCTGGGAGGTCCCTGAGACTCTCCTGTG CAGCCTCTGGATTCACCTTCAGTTTCTATGGCAT GCACTGGGTCCGCCAGGCTCCAGGCAAGGGCT GGAGTGGGTGGCAGTTACATCATATGATGAAGT GATAAATACTATGCAGACTCCGTGAAGGGCCGA TTCTCCATCTCCAGAGACAATTCCAAGAACACGC TGTATCTGCAAATGAGCAGCCTGAGAGCTGAGG ACACGGCTATGTATTACTGTGCGAGAGATGACTA TGGTTCGGGGAGTCCCTATACTACGGTATGAC GTCTGGGGCCAAGGGACCACGGTCACCGTCTCCT CA<br><br>SEQ ID NO: 31503 |
| | | AA | SYELTQSPSVSVSPGQTASITCSGDKLGDKYTCW YQKKPGQSPVLVIYQDNKRPSGIPERFSGSNSGN TATLTISGTQAMDEADYFCQAWNNYTVVFGGG TKLTAL<br><br>SEQ ID NO: 27498 | QVQLVESGGGVVQPGRSLRLSCAASGFTFSFYGMH WVRQAPGKGLEWVAVTSYDGSDKYYADSVKGRF SISRDNSKNTLYLQMSSLRAEDTAMYYCARDDYGS GSPLYYGMDVWGQGTTVTVSS<br><br>SEQ ID NO: 31504 |
| iPS:436860 | 21-225_58F7 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGAAGAAGCCAGGCCAGTCCCC TGTGCTGGTCATCTATCAAGATAGGAAGCGGC CCTCAGGGATCCCGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTGTTA TTCGGCGGAGGGACCAAGCTGACCGTCCTA<br><br>SEQ ID NO: 27499 | GAGGTGCAGCTGGTGGAGTCTGGGGGAGGCTTG GTCCAGCCTGGGGGGTCCCTGAGACTCTCCTGTG CAGCCTCTGGATTCACCTTTAGTAGCTTTTGGATG AGCTGGGTCCGCCAGGCTCCAGGGAAGGGCTG GAGTGGGTGGCCCACATAAAGCAAGATGAAGT GAGAAATACTATGTGGACTCTGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGGGACCTC CCATACAGCTCGGGCTACTACTACGGTATGACG TCTGGGGCCAAGGGACCACGGTCACCGTCTCTC A<br><br>SEQ ID NO: 31505 |

FIGURE 50
(Continued)

| | | | |
|---|---|---|---|
| iPS:436862 | 21-225_58F8 | AA | SYELTQPPSVSVSPGQTASITCSGDKLGDKYACW YQQKPGQSPVLVIYQDRKRPSGIPERFSGSNSGN TATLTISGTQAMDEADYYCQAWDSSTVVFGGG TKLTVL<br>SEQ ID NO: 27500 | EVQLVESGGGLVQPGGSLRLSCAASGFTFSSFWMS WVRQAPGKGLEWVAHIKQDGSEKYYVDSVKGRF TISRDNAKNSLYLQMNSLRAEDTAVYYCARGDLPY SSGYYYGMDVWGQGTTVTVSS<br>SEQ ID NO: 31506 |
| | | NA | TCCTATGAGCTGACTCAGCCACCCTCAGTGTC CGTGTCCCCAGGACAGACAGCCAGCATCACCT GCTCTGGAGATATCAGCGGAGATAAATATGCT TGCTGGTATCAGCAGAAGCCAGGCCAGTCCCC TGTACTGGTCATCTATCAAGATAGCAAGCGGC CCTCAGGGATCCCTGAGCGATTCTCTGGCTCC AACTCTGGGAACACAGCCACTCTGACCATCAG CGGAACCCAGGCTATGGAGGCTGACTATT ACTGTCAGGCCTGGGACAGCAGCACTGTGTA TTCGGCGGAGGGACCAAACTGACCGTCCTA<br>SEQ ID NO: 27501 | CAGGTGCAACTGGTGGAGTCTGGGGGAGGCGTG GTCCAGCCTGGGGAGTCCCTGAGACTCTCCTGTG CAGCCTCTGGATTCACCTTCAGTAGCTTCTGGAT GCACTGGGTCCGCCAGGCTCCAGGCAAGGGCT GGAGTGGGTGGCAGTTATATCATATGAAGT AATAAATACTATGCAGACTCCGTGAAGGGCCGA TTCACCATCTCCAGAGACAATTCCAAGAACACGT TGTATCTGCAAATGAACAGCCTGAGAGCTGAGG ACACGGCTGTGTATTACTGTGCGAGAGATGAGGG ACGTGGATATGGTGCTACGAGAGGGATATTA CTACTACTACGGTATGGACGTCTGGGGCCAA GGGACCACGGTCACCGTCTCCTCA<br>SEQ ID NO: 31507 |
| | | AA | SYELTQPPSVSVSPGQTASITCSGDKLGNKYACW YQQKPGQSPVLVIYQDSKRPSGIPERFSGSNSGN TATLTISGTQAMDEADYYCQAWDSSTVVFGGG TKLTVL<br>SEQ ID NO: 27502 | QVQLVESGGGVVQPGRSLRLSCAASGFTFSSYGMH WVRQAPGKGLEWVAVISYDGSNKYYADSVKGRFTI ISRDNSKNTLYLQMNSLRAEDTAVYYCARDEGRG YGGYERGYYYYYGMDVWGQGTTVTVSS<br>SEQ ID NO: 31508 |

FIGURE 50
(Continued)

| | | | |
|---|---|---|---|
| iPS:436864 | 21-225_58G11 | NA | TCCTATGAGCTGACTCAGCCACCCTCAGTGTC CGTGTCCCCAGGACAGACAGCCAGCATCACT GCTCTGGAGATAAATTGGGGGATAAATATGCT TCCTGGTATCAGCAGAAGCCAGGCCAGTCCCC TGTGCTGGTCATCTATCAAGATAACAAGCGGC CCTCAGGGATCCCGAGCGTTCTCTGGCTCC AACTCTGGGAACACAGCCACTCTGACCATCAG CGGGACCCAGGCTATGGATGAGGCTGACTATT ACTGTCAGGCGTGGAACAACACACTGTAATG TTCGGCGGAGGGACCAAGCTGACCGTCCTA<br><br>SEQ ID NO: 27503 | GAGGTGCAGCTGGTGGTGGAATCTGGGGGAGGCTTG GTACAGCCTGGGGGGTCCCTGAGACTCTCCTGTG CAGCCCTCTGATTCACCTTCAGTAGTAGCTATAGCAT GAACTGGGTCCGCCAGGCTCCAGGGAAGGGCT GGAGTGGATTTCATACATTAGTACTAGTAGTAGT ACCATATTCTACGCAGACTCTGTGAAGGGCCGAT TCACCATCTCCAGAGACAACAGTGCCAAGAACTCACT GTATCTGCAAATGAACAGCCTGAGAGACGAGGA CACGGCTGTGTATTACTGTGCGAGGGGGATACA GCTATGGTCCTCTACTACTACGGTATGGACGTCT GGGGCCAAGGGACCACGGTCACCGTCTCCTCA<br><br>SEQ ID NO: 31509 |
| | | AA | SYELTQPPSVSVSPGQTASITCSGDKLGDKYASW YQQKPGQSPVLVIYQDNKRPSGIPERFSGSNSGN TATLTISGTQAMDEADYYCQAWNNNTVMFGGG TKLTVL<br><br>SEQ ID NO: 27504 | EVQLVESGGGLVQPGGSLRLSCAASGFTFSSYSMN WVRQAPGKGLEWISYISTSSSTIFYADSVKGRFTISR DSAKNSLYLQMNSLRDEDTAVYYCARGDTAMVL YYYGMDVWGQGTTVTVSS<br><br>SEQ ID NO: 31510 |
| iPS:436866 | 21-225_59F2 | NA | TCCTATGAACTGACTCAGCCACCCTCAGTGTC CGTGTCCCCAGGACAGACAGCCAGCATCACT GCTCTGGAGATAAATTGGGGGATAAATATGCT TCTTGGTATCAGCAGAAGCCAGGCCAGTCCCC TGTGTTGGTCATCTATCAAGATAACAAGCGGC CCTCAGGGATCCCGAGCGATTCTCTGGCTCC AACTCTGGGAACACAGCCACTCTGACCATCAG CGGGACCCAGGCTATGGATGAGGCTGACTATT ACTGTCAGGCGTGTGGACAACAACACTGTGGTC TTCGGCGGAGGGACCAAGCTGACCGTCCTA<br><br>SEQ ID NO: 27505 | GAGGTGCAGCTGGTGGAGTCTGGGGGAGGCTTG GTACAGCCTGGGGGGTCCCTGAGACTCTCCTGTG GAGCCCTCTGATTCACCTTCAGTAGCTATAGCAT GAACTGGGTCCGCCAGGCTCCAGGGAAGGGACT GGAGTGGGTTTCATACATTAGTGGAGTAGTAAT ATCATACTACACAGACTCTGTGAAGGGCCGAT TCACCATCTCCAGAGACAATGCCAAGAACTCACT GTATCTGCAAATGAACAGCCTGAGAGACGAGGA CACGGCTGTGTATTACTGTGCGAGAGCGGATACA CCTATGGTCCTTACTTCTACGGTATGGACGTCTG GGGCCAAGGGACCACGGTCACCGTCCTCA<br><br>SEQ ID NO: 31511 |

FIGURE 50
(Continued)

| | | | |
|---|---|---|---|
| iPS:436868 | 21-225_59B11 | AA | SYELTQPPSVSVSPGQTASITCSGDKLGDKYASW YQQRPGQSPVLVIYQDNKRPSGIPERFSGSNSGN TATLTISGTQAMDEADYYCQAWDNNTVFGGG TKLTVL<br>SEQ ID NO: 27506 | EVQLVESGGGLVQPGGSLRLSCGASGFTFSSYSMN WVRQAPGKGLEWVSYISGSSNIIYYTDSVKGRFTIS RDNAKNSLYLQMNSLRDEDTAVYYCARADTPMVL YFYGMDVWGQGTTVTVSS<br>SEQ ID NO: 31512 |
| | | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGG CCTCAGGGATCCTTGAGCGATTCTCTGGCTCC AATTCTGGGAACACAGCCACTCTGACCATCAG CGGAACCCAGGCTATGGACGAGGCTGACTATT ACTGTCAGGCGTGGGACGACAGCACTTATGTG GTATTCGGCGGAGGGACCAAGCTGACCGTCCT A<br>SEQ ID NO: 27507 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTTATAGCGT GCACTGGGTCCGCCAGGCTCCAGGCAAGGGCT GGAGTGGGTGGCAGCTATATGGTATGGAAG TAATAAATACTATGCAGACTCCGTGAAGGGCCG ATTCACCATCTCCAGAGACAACAATTCCAAGAACACG CTGTATCTGCAATGAACAGCCTGAGAGCCGAGG ACACGGCTGTGTATTACTGTGCGAGAGATAGGA CTATTGTAGTAGTTCCAGCTGCCCTTACTACTACT ACTACGGTATGGACGTCTGGGGCCAAGGGACCA CGGTCACCGTCTCCTCA<br>SEQ ID NO: 31513 |
| | | AA | SYELTQPPSVSVSPGQTASITCSGDKLGDKYACW YQQKPGQSPVLVIYQDSKRPSGILERFSGSNSGN TATLTISGTQAMDEADYYCQAWDSSTYVFGG GTKLTVL<br>SEQ ID NO: 27508 | QVQLVESGGGVVQPGRSLRLSCAASGFTFSSYGVH WVRQAPGKGLEWVAAIWYDGSNKYYADSVKGRF TISRDNSKNTLYLLMNSLRAEDTAVYYCARDRDYC SSSSCPYYYYGMDVWGQGTTVTVSS<br>SEQ ID NO: 31514 |

FIGURE 50
(Continued)

| | | | |
|---|---|---|---|
| iPS:436870 | 21-225_60B1 | NA | TCCTATGAGCTGACTCAGCCACCCTCAGCGTC<br>CGTGTCCCAGGAGACAGCAGCCAGCATCACCT<br>GCTCTGGAGATAAACTGGGGGAAAAATATGCT<br>TGCTGGTATCAGCAGAAGCCAGGCCAGTCCCC<br>TGTGTTGGTCATCTATCAAGATAGGAAGCGGC<br>CCTCAGGGATCCCTGAGCGATTCTCTGGCTCC<br>AATTCTGGGAACACAGCCACTCTGACCATCAG<br>CGGGACCCAGGCTATGGATGAGGCTGACTATT<br>ACTGTCAGGCGTGGGACAGCAGCACTGTGTA<br>TTCGGCGGAGGGACCAAACTGACCGTCCTA<br><br>SEQ ID NO: 27509 | CAGATCACCTTGAAGGAGTCTGGTCCTACGCTGG<br>TGAAACCACACAGACCCTCACGCTGACCTGCAC<br>CTTCTCTGGGTTCTCACTCAGTAGTAGTGGAGTG<br>GGTGTGGGCTGGATCCGTCAGCCCCCAGGAAAG<br>GCCCTGGAGTGGCTTGCACTCATTTATTGGCATG<br>AAGATAAGCGCTACAGCCCATCTGAAGAGCA<br>GGCTCACCATCACTGAGGACACCTCCAAAAACC<br>AGTTGGACCTTACAATGACCAACATGGCCCCTGT<br>GGACACAGCCACATATTACTGTGCACACGTCACA<br>TATATAGCAGCTCCTACTGGGGCCAGGGAACCC<br>TGGTCACCGTCTCCTCA<br><br>SEQ ID NO: 31515 |
| | | AA | SYELTQPPSASVSPGQTASITCSGDKLGEKYACW<br>YQQKPGQSPVLVIYQDRKRPSGIPERFSGSNSGN<br>TATLTISGTQAMDEADYYCQAWDSSTVVFGGG<br>TKLTVL<br><br>SEQ ID NO: 27510 | QITLKESGPTLVKPTQTILTLTCTFSGFSLSTSGVVG<br>WIRQPPGKALEWLALIYWHEDKRYSPSLKSRLTITE<br>DTSKNQVDLTMTNMAPVDTATYYCAHVTYIAAPY<br>WGQGTLVTVSS<br><br>SEQ ID NO: 31516 |
| iPS:436872 | 21-225_60D2 | NA | TCCTATGAACTGACTCAGCCACCCTCAGTGTC<br>CGTGTCCCAGGAGACAGCAGCCAGCATCACCT<br>GCTCTGGAGAAATAAATTGGGGGATAAATATGCT<br>TCTTGGTATCAGCAGAGGCCAGGCCAGTCCCC<br>TGTATTAGTAGTCATCTATCAAGATAACAAGCGGC<br>CCTCAGGGATCCCTGAGCGATTCTCTGGCTCC<br>AACTCTGGAAACACAGCCACTCTGACCATCAG<br>CGGGACCCAGACTATGAGGCTGACTATT<br>ACTGTCAGGCGTGGGACAACAACACTGTGGTC<br>TTCGGCGGAGGGACCAAGCTGACCGTCCTA<br><br>SEQ ID NO: 27511 | GAGGTGCAGCTGGTGGAGTCTGGGGGAGGCTTG<br>GTACAGCCTGGGGGGTCCCTGAGACTCTCCTGTG<br>GAGCCTCTGGATTCACCTTCAGTAGTAGTAGCAT<br>GAACTGGGTCCGCCAGGCTCCAGGAAAGGGACT<br>GGAGTGGGTTTCATACATTAGTGAGAGTAGTAAT<br>ATCATATACTACACAGACTCTGTGAAGGGCCGAT<br>TCACCATCTCCAGAGACAATGCCATGAACTCACT<br>GTATCTGCAAATGAACAGCCTGAGAGACGGAGGA<br>CACGGCTGTGTATTACTGTGCGAGAGCGGATACA<br>CCTATGGTCCTTTACTTCTACGGTATGGACGTCTG<br>GGGCCAAGGGACCACGGTCACCGTCTCCTCA<br><br>SEQ ID NO: 31517 |

FIGURE 50
(Continued)

| | | | | |
|---|---|---|---|---|
| iPS:436874 | 21-225_60A12 | AA | SYELTQPPSVSVSPGQTASITCSGNKLGDKYASWYQQRPGQSPVLVIYQDNKRPSGIPERFSGSNSGNTATLTISGTQTMDEADYYCQAWDNNTVFGGGTKLTVL | EVQLVESGGGLVQPGGSLRLSCGASGFTFSSYSMNWVRQAPGKGLEWVSYISESSNIIYTDSVKGRFTISRDNAMNSLYLQMNSLRDEDTAVYYCARADTPMVLYFYGMDVWGQGTTVTSS |
| | | | SEQ ID NO: 27512 | SEQ ID NO: 31518 |
| | | NA | TCCTATGAGCTGACTCAGCCACCTCAGTGTCCGTGTCCCCAGGACAGACAGCCAACATCACCTGCTCTGGAGATAAATTGGGAATAAATATGCTTGCTGGTATCAGCAGAAGCCAGGCCAGTCCCCTGTATTGGTCATTTATCAAGATAGGAAGCGGCCCTCAGGGATCCCTGAGCGATTCTCTGGCTCCAACTCTGGGAACACAGGCTATGATGAGGCTGACTATTACTGTCAGGCGTGGGACAACAGCAACTGCTTTCGGCGGAGGGACCAAGCTGACCGTCCTC | CAGATCACCTTGAAGGAGTCTGGTCCTACGCTGGTGAAACCCACAGAGACCCTCACGCTGACCTGCACCTTCTCTGGGTTCTCACTCAGCAGTACTAGTGGAGTGGGTGTGGGCTGGATCCGTCAGCCCCCAGGAAAGGCCCTGGAGTGGCTTGCACTCATTTATTGGGATGATGATAAGCGCTACAGCCCATCTCTGAAGAGCAGGCTCACCATCACCGAGGACACCTCCAAAAACCAGGTGGTCCTTACAAGTGACCAACATGACCCTGTGGACACAGCCACATATTACTGTGCACACCTTATAGCAGTGGCCTTTGACTCCTGGGGCCAGGGAACCCTGGTCACCGTCTCCTCA |
| | | | SEQ ID NO: 27513 | SEQ ID NO: 31519 |
| | | AA | SYELTQPPSVSVSPGQTANITCSGDKLGNKYACWYQQKPGQSPVLVIYQDRKRPSGIPERFSGSNSGNTAILTISGTQAMDEADYYCQAWDSSTAFGGGTKLTVL | QITLKESGPTLVKPTQTLTLTCTFSGFSLSTSGVGVGWIRQPPGKALEWLALIYWDDDKRYSPSLKSRLTITEDTSKNQVVLTMTNMDPVDTATYYCAHLIAVAFDSWGQGTLVTVSS |
| | | | SEQ ID NO: 27514 | SEQ ID NO: 31520 |

FIGURE 50
(Continued)

| | | | |
|---|---|---|---|
| iPS:436876 | 21-225_61F5 | NA | TCCTATGAGCTGACTCAGCCACCCTCAGTGTC CGTGTCCCAGGAGACAGCAGCCAGCATCACCT GCTCTGGAGATAAATTGGGGGAAAAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AATTCTGGGAACACAGCCACTCTGACCATCAG CGGGACCCAGGCTATGGATGAGGCTGACTATT ACTGTCAGGCGTGGGACAGCAGCACTGTGGTT TTCGGCGGAGGGACCAAACTGACCGTCCTA | CAGATCACCTTGAAGGAGTCTGGTCCTACGCTGG TGAAACCCACACAGACCCTCACGCTGACCTGCAC CTTCTCTGGGTTCTCACTCAGTACTAGTGGGTTGG GTGTGGGCTGGATCCGTCAGCCCCCAGGAAAGG CCCTGGAGTGGCTTGCACTCATTTATTCACATGA AGATAAGGCTACAGCCATCTCTGAAGAGCAG GCTCACCATCACTGAGGACACCTCCAAAAACCA GGTGGACCTTACAATGACCAACATGGCCCCTGTG GACACAGCCACATATTACTGTGCACACGTCACAG GTATAGCAGCTCCCTACTGGGGCCAGGGAACCCT GGTCACCGTCCTCTCA |
| | | AA | SYELTQPPSVSVSPGQTASITCSGDKLGEKYACW YQQKPGQSPVLVIYQDSKRPSGIPERFSGSNSGN TATLTISGTQAMDEADYYCQAWDSSTVVFGGG TKLTVL | QITLKESGPTLVKPTQTLTLTCTFSGFSLSTSGLGVG WIRQPPGKALEWLALIYSHEDKRYSPSLKSRLTITE DTSKNQVDLTMTNMAPVDTATYYCAHVTGIAAPY WGQGTLVTVSS |
| | | | SEQ ID NO: 27515 | SEQ ID NO: 31521 |
| | | | SEQ ID NO: 27516 | SEQ ID NO: 31522 |
| iPS:436878 | 21-225_62E3 | NA | TCCTATGACCTGACTCAGCCACCCTCAGTGTC CGTGTCCCAGGAGACAGCAGCCAGCATCACCT GCTCTGGAGATAAATTGGGGAATAAATATGCT TGCTGGTATCAGCAGAAGCCAGGCCAGTCCCC TGTGGTGGTCATCTATCAAGATAGGAAGCGGC CCCTGGAGTGGCTTGCACTCATTAATTGGAATG GGTTCACCATCACCAGGGACACCTCCAAAGACC AGGTGGTCCTTACAATGACCAACATGACCCTGT ACTGTCAGGCCGTGGGACAGCAGCACTGCGGTA TTCGGCGGAGGGACCAAGCTGACCGTCCTA | CAGATCACCTTGAAGGAGTCTGGTCCTACGCTGG TGAAACCCACACAGACCCTCACGCTGACCTGCAC CTTCTCTGGGTTCTCGCTCAGCACTAGTGGAGTG GCCCTGGAGTGGCTTGCACTCATTAATTGGAATG ATGATAAGGCTACAGCCCATCTCTGAAGAGCA GGTTCACCATCACCAGGGACACCTCCAAAGACC AGGTGGTCCTTACAATGACCAACATGACCCTGT GGACACAGCCACATATTACTGTGCACATAAAGCT ACCTGGGTGGCTTTTGATATCTGGGGCCAAGGGA CAATGGTCACCGTCTCTCA |
| | | | SEQ ID NO: 27517 | SEQ ID NO: 31523 |

FIGURE 50
(Continued)

| | | | |
|---|---|---|---|
| iPS:436880 | | AA | SYDLTQPPSVSVSPGQTASITCSGDKLGNKYACWYQQKPGQSPVVVIYQDRKRPSGIPERFSGSNSGNTATLTISGTQAMDEADYYCQAWDSSTAVFGGGTKLTVL | QITLKESGPTLVKPTQTLTLTCTFSGFSLSTSGVGVGWIRQPPGKALEWLALINWNDDKRYSPSLKSRFTITRDTSKDQVVLTMTNMDPVDTATYYCAHKATWVAFDIWGQGTMVTVSS |
| | | | SEQ ID NO: 27518 | SEQ ID NO: 31524 |
| | 21-225_62E8 | NA | TCCTATGACCTGACTCAGCCACCTCAGTGTCCGTGTCCCCAGGACAGACCAGCATCACCTGCTCTGGAGATAGATTGGGAATAAATATGCTTCCTGGTATCAGCAGAAGCCAGGCCAGTCCCCTGTGGTGGTCATCTATCAGGATAGGAAGCGGCCCTCAGGGATCCCTGAGCGATTCTCTGGCTCCAACTCTGGGAACACAGGCTATGAGGCTGACTATTACTGTCAGGCGTGGGACAGCAGCACTGCGGTATTCGGCGGAGGGACCAAGCTGACCGTCCTA | CAGATCACCTTGAAGGAGTCTGGTCCTACGCTGGTGAAACCCACACAGACCCTCACGCTGACCTGTACCTTCTCTGGGTTCTCACTCAGCACTAGTGGAGTGGGTGTGGGCTGGATCCGTCAGCCCCCAGGAAAGGCCCTGGAGTGGCTTGCACTCATTAATTGGAATGATGATAAGCGCTACAGCCCATCTCTGAAGAGCAGGTTCACCATCACCAGGGACACCTCCAAAGACCAGGTGGTCCTTACAATGACCAACATGGACCCTGTGGACACAGCCACATATTACTGTGCACATAAAGCTACCTGGGTGGCTTTTGATATCTGGGGCCAAGGAACAATGGTCACCGTCTCTTCA |
| | | | SEQ ID NO: 27519 | SEQ ID NO: 31525 |
| | | AA | SYDLTQPPSVSVSPGQTASITCSGDRLGNKYASWYQQKPGQSPVVVIYQDRKRPSGIPERFSGSNSGNTATLTISGTQAMDEADYYCQAWDSSTAVFGGGTKLTVL | QITLKESGPTLVKPTQTLTLTCTFSGFSLSTSGVGVGWIRQPPGKALEWLALINWNDDKRYSPSLKSRFTITRDTSKDQVVLTMTNMDPVDTATYYCAHKATWVAFDIWGQGTMVTVSS |
| | | | SEQ ID NO: 27520 | SEQ ID NO: 31526 |

FIGURE 50
(Continued)

| | | | |
|---|---|---|---|
| iPS:436882 | 21-225_62D10 | NA | TCCTATGACCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AACTCTGGAACACAGCCACTCTGACCATCAG CGGGACCCAGGCTATGGATGAGGCTGACTATT ACTGTCAGGCGTGGGACCAGCAGCACTGCGGTA TTCGGCGGAGGGACCAAGCTGACCGTCCTA
SEQ ID NO: 27521 | CAGATCACCTTGAAGGAGTCTGGTCCTACGCTGG TGAAATCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTAATTGGAATG ATGATAAGCGCTACAGCCCATCTCTGAAGAGCA GGTTCACCATCTCCAAGGACACCTCCAAAGACC AGTGGTCCTTACAATGACCAACATGACCCTGT GGACACAGCCACATATTACTGTGCACATAAAGCT ACCTGGGTGGCTTTGATATCTGGGCCAAGGGA CAATGGTCACCGTCTCTTCA
SEQ ID NO: 31527 |
| | | AA | SYDLTQPPSVSVSPGQTASITCSGDKLGNKYAC WYQQKPGQSPVVVIYQDRKRPSGIPERFSGSNSG NTATLTISGTQAMDEADYYCQAWDSSTAVFGG GTKLTVL
SEQ ID NO: 27522 | QITLKESGPTLVKSTQTLTLTCTFSGFSLSTSGVGVG WIRQPPGKALEWLALINWNDDKRYSPSLKSRFTITR DTSKDQVLTMTNMDPVDTATYYCAHKATWVAF DIWGQGTMVTVSS
SEQ ID NO: 31528 |
| iPS:436884 | 21-225_62A12 | NA | TCCTATGACCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AACTCTGGAACACAGCCACTCTGACCATCAG CGGGACCCAGGCTATGGATGAGGCTGACTATT ACTGTCAGGCGTGGGACCAGCAGCACTGCGGTA TTCGGCGGAGGGACCAAGCTGACCGTCCTA
SEQ ID NO: 27523 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTAATTGGAATG ATGATAAACGCTACAGCCCATCTCTGAAGAGCA GGTTCACCATCACCAGGGACACCTCCAAAGACC AGTGGTCCTTACAATGACCAACATGACCCTCT GGACACAGCCACATATTACTGTGCACATAAAACT ACCTGGGTGGCTTTGATATCTGGGCCAAGGGA CAATGGTCACCGTCTCTTCA
SEQ ID NO: 31529 |

FIGURE 50
(Continued)

| | | | |
|---|---|---|---|---|
| iPS:436886 | 21-225_62B12 | AA | SYDLTQPPSVSVSPGQTASITCSGDKLGNKYAC WYQQKPGQSPVVIYQDRKRPSGIPERFSGSNSG NTATLTISGTQAMDEADYYCQAWDSSTAVFGG GTKLTVL | QITLKESGPTLVKPTQTLTLTCTFSGFSLSTSGVGVG WIRQPPGKALEWLALINWNDDKRYSPSLKSRFTITR DTSKDQVVLTMTNMDPLDTATYYCAHKTWVAF DIWGQGTMVTVSS |
| | | | SEQ ID NO: 27524 | SEQ ID NO: 31530 |
| | | NA | TCCTATGACCTGACTCAGCCACCTCAGTGTC CGTGTCCCAGGACAGACAGCCAGCATCACCT GCTCTGGAGATAAATTGGGAATAAATATACT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AATTCTGGGAACACAGGCTATGAGGCTGACTATT CGGGACCCAGGCTATGATGAGGCTGACTATT ACTGTCAGGCGTGGGACAGCAGCACTGCGGTA TTCGGCGGAGGGACCAAGCTGACCGTCCTA | CAGATCACCTTGAAGGAGTCTGGTCCTACGCTGG TGAAACCACACAGACCCTCACGCTGACCTGCAC CTTCTCTGGGTTCTCACTCAACACTAGTGGAGTG GGTGTGGGCTGGATCCGTCAGCCCCCAGGAAAG GCCCTGGAGTGGCTTGCACTCATTAATTGGAATG ATGATAAGCGCTACAGCCCGTCTGAAAGCA GGTTCACCATCACCAGGGACACCTCCAAAGACC AGGTGGTCCTTACAATGACCAACATGGACCCTGT GGACACAGCCACATATTACTGTGCACATAAAGCT ACCTGGGTGGCTTTTGATATCTGGGGCCAAGGA CAATGGTCACCGTCTCTCA |
| | | | SEQ ID NO: 27525 | SEQ ID NO: 31531 |
| | | AA | SYDLTQPPSVSVSPGQTASITCSGDKLGNKYTCW YQQKPGQSPVVIYQDRKRPSGIPERFSGSNSGN TATLTISGTQAMDEADYYCQAWDSSTAVFGGG TKLTVL | QITLKESGPTLVKPTQTLTLTCTFSGFSLNTSGVGVG WIRQPPGKALEWLALINWNDDKRYSPSLKSRFTITR DTSKDQVVLTMTNMDPVDTATYYCAHKATWVAF DIWGQGTMVTVSS |
| | | | SEQ ID NO: 27526 | SEQ ID NO: 31532 |

FIGURE 50
(Continued)

| | | | |
|---|---|---|---|
| iPS:436888 | 21-225_63G7 | NA | AATTTTATGCTGACTCAGCCCCACTCTGTGTCG GAGTCTCCGGGGAAGACGGTAACCATCTCCTG CACCCGCAGCAATGGCAGCATTGTCAGCAACT ATGTGCAGTGGTACCAGCAGCGCCCGGGCAGT TCCCCACCACTACTGATCTATGAGGATAGCCG AAGACCCTCTGGGGGTCCCTGATCGGTTCTCT GCTCCATGACAGCTCCTCCAACTCTGCCTCC CTCACCATCTCTGGACTGAAGACTGAGGACGA GGCTGACTACTCCTGTCAGTCTTATGATGGCA TCAATGTGGTATTCGGCGGAGGGACCAAGCTG ACCGTCCTA |
| | | | SEQ ID NO: 27527 |
| | | AA | NFMLTQPHSVSESPGKTVTISCTRSNGSIVSNYV QWYQQRPGSSPTTMIYEDSRRPSGVPDRFSGSID SSSNSASLTISGLKTEDEADYSCQSYDGINVFG GGTKLTVL |
| | | | SEQ ID NO: 27528 |
| | | NA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCAT GAACTGGGTCCGCCAGGCTCCGGGAAGGGGCT GGAGTGGGTTTCATACATTAGTAGTAGTACTAGT ACCATATACTACGCAGCCTCTGTGAAGGGCGAT TCACCATCTCCAGAGACAATGCCAAGAACTACT GTATCTGCAAATGAACAGCCTGAGAGACGAGGA CACGGCTGTGTATTACTGTGCGAGAGATCACCGT TACTATGATAGTAGTGGTTATTACTCTGATGCTTT TGATATCTGGGGCCAAGGGACAATGGTCACCGTC TCTTCA |
| | | | SEQ ID NO: 31533 |
| | | AA | EVQLVESGGGLVQPGGSLRLSCAASGFTFSSYSMN WVRQAPGKGLEWVSYISSSTSTIYYAASVKGRFTIS RDNAKNSLYLQMNSLRDEDTAVYYCARDHRYYD SSGYYSDAFDIWGQGTMVTVSS |
| | | | SEQ ID NO: 31534 |
| iPS:436890 | 21-225_63A10 | NA | AATTTTATGCTGACTCAGCCCCACTCTGTGTCG GAGTCTCCGGGGAAGACGGTAACCATCTCCTG CACCCGCAGCAATGGCAGCAGCATTGTCAGCAACT ATGTGCAGTGGTACCAGCAGCGCCCGGGCAGT TCCCCCACCACTGTCAGGGGTCCCTGATCGGTTCTCT AAGACCCTCAGGGGTCCCTGATCGGTTCTCT GCTCCATGACAGCTCCTCCAACTCTGCCTCC CTCACCATCTCTGGACTGAAGACTGAGGACGA GGCTGACTACTACTGTCAGTCTTATGATAGCA TCAATGTGGTATTCGGCGGAGGGACCAAGCTG ACCGTCCTA |
| | | | SEQ ID NO: 27529 |
| | | NA | GAGGTGCAGCTGGTGGAGTCTGGGGGAGGCTTG GTACAGCCTGGGGGGTCCCTGAGACTCTCCTGTG CAGCCTCTGGATTCACCTTCAGTAGCTATAGCAT GAACTGGGTCCGCCAGGCTCCGGGAAGGGGCT GGAGTGGGTTTCATACATTAGTAGTAGTACTAGT ACCATATACTACGCAGCCTCTGTGAAGGGCCGAT TCACCATCTCCAGAGACAATGCCAAGAATTCACT GTATCTGCAAATGAACAGCCTGAGAGACGAGGA CACGGCTGTGTATTACTGTGCGAGAGATCACCGT TACTATGATAGTAGTGGTTATTACTCTGATGCTTT TGATATCTGGGGCCAAGGGACAATGGTCACCGTC TCTTCA |
| | | | SEQ ID NO: 31535 |

FIGURE 50
(Continued)

| | | | |
|---|---|---|---|
| iPS:436892 | 21-225_65E9 | AA | NFMLTQPHSVSESPGKTVTISCTRSNGSIVSNYV QWYQQRPGSSPTTVIYEDKRRPSGVPDRFSGSID SSSNSASLTISGLKTEDEADYYCQSYDSINVVFG GGTKLTVL<br><br>SEQ ID NO: 27530 | EVQLVESGGGLVQPGGSLRLSCAASGFTFSSYSMN WVRQAPGKGLEWVSYISSSTSTIYYAASVKGRFTIS RDNAKNSLYLQMNSLRDEDTAVYYCARDHRYYD SSGYYSDAFDIWGQGTMVTVSS<br><br>SEQ ID NO: 31536 |
| | | NA | TCCTATGAGCTGACTCAGCCACCCTCAGTGTC CGTGTCCCCAGGACAGAGGACAGCCAGCATCACCT GCTCTGAGATAAATTGGGAATACAAAATATGAT TACTGGTATCAGCAGAAGCCAGGCCAGTCCCC TGTGCTGGTCATCTATCAAGATAGAAAGCGGC CCTCAGGGATCCCTGAGCGATTCTCTGGCTCC AACTCTGGGAACACAGCCACCCTGACCATCAG CGGGACCCAGGCTATGATGAGGCTGACTATT ACTGTCAGGCGTGGGACAACAGCACTGTGGTA TTCGGCGGAGGGACCAAACTGACCGTCCTA<br><br>SEQ ID NO: 27531 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAGTGG TGGCACAAATTATGCACAGAAGTTTCAGGCAG GGTCACCATGACCAGGGACACGTCCATCAGCAC AGCCTACATGGAGCTGAGCAGGCTGAGATCTGA CGACACGGCCGTGTATTACTGTGCGAGAGCGTAT TATTATGGTTCGGGGAGTTATTATATAATGAATTTG ATATGTGGGGCCAAGGGACAATGGTCACCGTCTC TTCA<br><br>SEQ ID NO: 31537 |
| | | AA | SYELTQPPSVSVSPGQTASITCSGDKLGNKYDY WYQQKPGQSPVLVIYQDRKRPSGIPERFSGSNSG NTATLTISGTQAMDEADYYCQAWDNSTVVFGG GTKLTVL<br><br>SEQ ID NO: 27532 | QVQLVQSGAEVKKPGASVKVSCKASGYTFTGYYM HWVRQAPGQGLEWMGWINPNSGGTNYAQKFQGR VTMTRDTSISTAYMELSRLRSDDTAVYYCARAYYY GSGSYYNEFDMWGQGTMVTVSS<br><br>SEQ ID NO: 31538 |

FIGURE 50
(Continued)

| | | | | |
|---|---|---|---|---|
| iPS:436894 | 21-225_66G9 | NA | TCCTATGAACTGACTGACTCAGCCACCCTCAGTGAC CGTGTCCCCAGGACAGAGCCAGCATCACCT GCTCTGGAGATAAATTGGGGATAAATATGCT TGCTGGTATCAGCAGAAGCCAGGCCAGTCCCC TGTGGTGGTCATCTATCAAGATAGGAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACATCAACACTGCGGTA TTCGGCGGAGGGACCAAGCTGACCGTCCTA | CAGATCACCTTGAAGGAGTCTGGTCCTACGCTGG TGAAACCACACAGACCCTCACGTCACCTGCAC CTTCTCTGGGTTCTCACTCAGCACTAGTGGAGTG GGTGGGCTGGATCCGTCAGCCCCCAGGAAAG GCCCTGGAGTGGCTTGCACTCATTAATTGGAATG ATGATAAGGCGTTCAGCCATCCTGAAGAGCAG GTTCACCATCACCAGGACACCTCCAAAGACCA GTGGTCCTTACAATGACCAACATGGACCCTGTG GACACAGCCACATATTACTGTGCACATAAGCTA CCTGGGTGGCTTTTGATATCTGGGGCCAAGGGAC AATGGTCACCGTCTCTTCA |
| | | | SEQ ID NO: 27533 | SEQ ID NO: 31539 |
| | | AA | SYDLTQPPSVTVSPGQTASITCSGDKLGNKYAC WYQQKPGQSPVVVIYQDRKRPSGIPERFSGSNSG NTATLTISGTQAMDEADYYCQAWDINTAVFGG GTKLTVL | QITLKESGPTLVKPTQTLTLTCTFSGFSLSTSGVGVG WIRQPPGKALEWLALINWNDDKRFSPSLKSRFTITR DTSKDQVLTMTNMDPVDTATYYCAHKATWVAF DIWGQGTMVTVSS |
| | | | SEQ ID NO: 27534 | SEQ ID NO: 31540 |
| iPS:436896 | 21-225_67F10 | NA | TCCTATGAACTGACTCAGCCACCCTCAGTTTCC GTGTCCCCAGGACAGAGCCAGCATCACCTG CTCTGGAGATAAATTGGGGTATAAATATGCTT GGTGGTATCAGCAGAAGCCAGGCCAGTCCCCT GTGCTGGTCATCTTTGAAGATAGGAAGCGGCC CTCAGGGATCCCTGAGCGATTCTCTGGCTCCA ACTCTGGGAACACAGCCACTCTGACCATCAGC GGGACCCAGGCTATGGATGAGGCTGACTATTA CTGTCAGGCGTGGGACACACAGCACTGTGGTAT TCGGCGGAGGGACCAAGGCTGACCGTCCTA | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGGATGGATCAACCCTAACAGTGG TGGCACAAACTATGCACAGGAGTTTCAGGGCAG GGTCACCATGACCAGGGACACGTCCATCAGCAC AGCCTACATGGAGCTGAGCAGGCTGAGATCTGA CGACACGGCCGTATATTACTGTGCGAGAACGTAT TTCTATGTTCGGGGAGTTATTATAACGGCTTTG ACTACTGGGGCCAGGGAACCCTGGTCACCGTCTC CTCA |
| | | | SEQ ID NO: 27535 | SEQ ID NO: 31541 |

FIGURE 50
(Continued)

| | | | |
|---|---|---|---|
| iPS:436898 | | AA | SYELTQPPSVSVSPGQTASITCSGDKLGYKYAW WYQQKPGQSPVLVIFEDRKRPSGIPERFSGSNSG NTATLTISGTQAMDEADYYCQAWDNSTVVFGG GTRLTVL | QVQLVQSGAEVKKPGASVKVSCKASGYTFTGYM HWVRQAPGQGLEWMGWINPNSGGTNYGQKFQGR VTMTRDTSISTAYMELSRLRSDDTAVYYCARTYFY GSGSYYNGFDYWGQGTLVTVSS |
| | | | SEQ ID NO: 27536 | SEQ ID NO: 31542 |
| | 21-225_68D8 | NA | TCCTATGAGCTGACTCAGCCACCTCAGTGTC CGTGTCCCAGGACAGACAGCCAGCATCACCT GCTCTGGAGATAAATTGGGGATACAAATATGCT TGCTTGGTATCAGCAGAAGCCAGGCCAGTCCC TGTGTTGGTCATCTATCAAGATAGCAAGCGGC CCTCAGGGATCCCTGAGCGATTCTCTGGCTCC AACTCTGGGAACACAGGCTATGATGAGGCTGACTATT ACTGTCAGGCGTGGGACAACAGCACTGTGGTA TTCGGCGGAGGGACCAAGCTGACCGTCCTA | CAGGTACAGCTGCAGCAGTCAGGACTG GTGAAGCCCTCGCAGACCCTCACTCACCTGTG CCATCTCCGGGACAGTGTCTCAGCAACAGTGC TGCTTGGAACTGGATCAGCAGCAGTCCCATCGAGA GGCCTTGAGTGGCTGGAAGGACATACTACAGG TCCGAGTGCTATAATGATTATGCAGTATCTGTGC AGAGTGGAATAACCATCAACCAGACACATCCA AGAACCAGTTCTCCCTGCACCTGTATTTCTGTGCAAGA TCCCGAGGACACGCCTGTGATAGAGGGTTCTACGGTATGGAC GTCTGGGGCCAAGGGACCACGGTCACCGTCTCCT CA |
| | | | SEQ ID NO: 27537 | SEQ ID NO: 31543 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDNSTVVFGGG TKLTVL | QVQLQQSGPGLVKPSQTLSLTCAISGDSVSSNSAA WNWIRQSPSRGLEWLGRTYYRSECYNDYAVSVQS RITINPDTSKNQFSLHLNSVTPEDTAVYFCARDRGH RGFYGMDVWGQGTTVTSS |
| | | | SEQ ID NO: 27538 | SEQ ID NO: 31544 |

FIGURE 50
(Continued)

| | | | |
|---|---|---|---|
| iPS:436900 | 21-225_69B9 | NA | TCCTATGAGCTGACTCAGCCACCCTCAGTGTC CGTGTCCCAGGAGACAGCAGCAGCATCACCT GCTCTGGAGATAAATTGGGGATAAATATGAT TACTGGTATCAGCAGAAGCCAGGCCAGTCCC TGTGCTGGTCATCTATCAAGATAGAAAGCGGC CCTCAGGGATCCCTGAGCGATTCTCTGGCTCC AACTCTGGGAACACAGCCACCCTGACCATCAG CGGGACCCAGGCTATGGATGAGGCTGACTATT ACTGTCAGGCGTGGGACAACAGCACTGTGTA TTCGGCGGAGGGACCAAACTGACCGTCCTA<br><br>SEQ ID NO: 27539 | CAGGTGCAGATGGTGCAGTCTGGGGATGAGGTG AAGAAGCCTGGGGCCTCAGTGAAGGTCTGTGC AAGGCTTCGGGATACACCTTCACGGCTACCATA TGCACTGGGTGCGACAGGCCCCTGGACAAGGGC TTGAGTGGATGGGATGGATCAACCCTAACAGTGG TGGCACAAATTATGCACAGGAGCACGTCAGGCAG GGTCACCATGACCAGGGACACGTCCATCAGCAC AGCCTACATGGAGCTGAGCAGGATGAGATCTGA CGACACGGCCGTGTATTACTGTGCGAGAGCGTAT TATTATGTTCGGGGAGTTATTATAATGAATCTG ATATGTGGGGCCAAGGGACAATGGTCACCGTCTC TTCA<br><br>SEQ ID NO: 31545 |
| | | AA | SYELTQPPSVSVSPGQTASITCSGDKLGNKYDY WYQQKPGQSPVLVIYQDRKRPSGIPERFSGSNSG NTATLTISGTQAMDEADYYCQAWDNSTVFGG GTKLTVL<br><br>SEQ ID NO: 27540 | QVQMVQSGDEVKKPGASVKVSCKASGYTFTGYH MHWVRQAPGQGLEWMGWINPNSGGTNYAQKFQ GRVTMTRDTSISTAYMELSRMRSDDTAVYYCARA YYYGSGSYYNESDMWGQGTMVTVSS<br><br>SEQ ID NO: 31546 |
| iPS:436902 | 21-225_69B11 | NA | TCCTATGAGCTGACTCAGCCACCCTCAGTGTC CGTGTCCCAGGAGACAGCAGCAGCATCACCT GCTCTGGAGATAAATTGGGGATAAATATGCT TGGTGGTATCAGCAGAAGCCAGGCCAGTCCCC TGTGCTGGTCATCTATGAAGATAGGAAGCGGC CCTCAGGGATCCCTGAGCGATTCTCTGGCTCC AACTCTGGGAACACACCACTCTGACCATCAG CGGGACCCAGGCTATGGATGAGGCTGACTATT ACTGTCAGGCGTGGGACAACAGCACTGTGTA TTCGGCGGAGGGACCAAGCTGACCGTCCTA<br><br>SEQ ID NO: 27541 | CAGGTGCAGCTGGTGCAGTCCGGGGCTGAGGTG AAGAAGCCTGGGGCCTCAGTGAGGGTCTCCTGC AAGGCTTCTGGATACACCTTCACGGCTACTATA TGCACTGGGTGCGACAGGCCCCTGGACAAGGGC TTGAGTGGATGGGATGGATCAACCCTAACAGTGG TGGCACAAACTATGACCAGGAAGTTTCAGGACAG GGTCACCATGACCAGGGACACGTCCATCAGCAC AGCCTTCATGGAGCTGAGCAGGCTGAGATCTGAC GACACGGCGCATATTACTGTGCGAGAACGTATT ACTATGGGTCGGGGAGTTATTATAACGGCTTTGA CTACTGGGGCCAGGGAACCCTGGTCACCGTCTCC TCA<br><br>SEQ ID NO: 31547 |

FIGURE 50
(Continued)

| | | | |
|---|---|---|---|
| | | AA | SYELTQPPSVSVSPGQAASITCSGDKLGDKYAWWYQQKPGQSPVLVIYEDRKRPSGIPERFSGSNSGNTATLTISGTQAMDEADYYCQAWDNSTVVFGGGTKLTVL | QVQLVQSGAEVKKPGASVRVSCKASGYTFTGYYMHWVRQAPGQGLEWMGWINPNSGGTNYGQKFQDRVTMTRDTSISTAFMELSRLRSDDTAAYYCARTYYYGSGSYYNGFDYWGQGTLVTVSS |
| | | | SEQ ID NO: 27542 | SEQ ID NO: 31548 |
| iPS:436904 | 21-225_71D4 | NA | TCCTATGAGCTGACTCAGCCACCCTCAGTGTCCGTGTCTCCAGGACAGACAGCCATCACCTGCTCTGGAGATAAATTGGGGGATAAATATGCTTACTGGTATCAGCAGAAACCAGGCCAGTCCCCTGTGGTTGTCATCTATCAAGATAGGAAGCGGCCCTCAGGGATCCCTGAGCGATTCTCTGGCTCCAACTCTGGGAACACAGGCTATGATGAGGCTGACTATTCGGGACCCAGGCGTGGGTCAACAGCACTGTGGTATTCGCGGCGAGGGACCAAGCTGACCGTCCTA | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTGTATGCACTGGGTGCGACAGGCCCCTGGACAAGGGCTTGAGTGGATGGGATGGATCAACCCTAACAGTGGTGGCACAAACTATGCACAGAAGTTTCAGGTCAGGGTCACCATGACCAGGGACACGTCCGTCAGCACAGTCTACATGGACCTGAGCAGGCTGAGATCTGACGACACGGCCGTGTATTACTGTGCGAGAGCTATTACTATGGTTCGGGGACTTATCATAACGAATTGACTACTGGGGCCAGGGAAGTTTGGTCACCGTCTCCTCA |
| | | | SEQ ID NO: 27543 | SEQ ID NO: 31549 |
| | | AA | SYELTQPPSVSVSPGQTASITCSGDKLGDKYAYWYQQKPGQSPVVVIYQDRKRPSGIPERFSGSNSGNTATLTISGTQAMDEADYYCQAWVNSTVVFGGGTKLTVL | QVQLVQSGAEVKKPGASVKVSCKASGYTFTGYCMHWVRQAPGQGLEWMGWINPNSGGTNYAQKFQVRVTMTRDTSVSTVYMDLSRLRSDDTAVYYCARAYYYGSGTYHNEFDYWGQGSLVTVSS |
| | | | SEQ ID NO: 27544 | SEQ ID NO: 31550 |

FIGURE 50
(Continued)

| | | | |
|---|---|---|---|
| iPS:436906 | 21-225_72B4 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGGTGGTATCAGCAGAGGCCAGGCCAGTCCCC TGTGCTGGTCATCTATGAAGATAGGAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAACAGCACTGTGTA TTCGGCGGAGGGACCAAGCTGACCGTCCTA SEQ ID NO: 27545 |
| | | AA | SYELTQPPSVSVSPGQTASITCSGDKLGDKYAW WYQQRPGQSPVLVIYEDRKRPSGIPERFSGSNSG NTATLTISGTQAMDEADYYCQAWDNSTVVFGG GTKLTVL SEQ ID NO: 27546 |
| | | | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGC TTGAGTGGATGGGATGGATCAACCCTAACAGTGG TGGCACAAACTATGACAGAAGTTTCAGGCAG GGTCACCATGACCAGGGACACGTCCATCAGCAC AGCCTACATGGAGCTGAGCAGGCTGAGATCTGA CGACACGGCCGTATATTACTGTGCGAGAACGTAT TACTATGTTCGGGGAGTTATTATAACGGCTTTG ACTACTGGGGCCAGGGAACCCTGGTCACCGTCTC CTCA SEQ ID NO: 31551 |
| | | | QVQLVQSGAEVKKPGASVKVSCKASGYTFTGYYM HWVRQAPGQGLEWMGWINPNSGGTNYDRSFRQ VTMTRDTSISTAYMELSRLRSDDTAVYYCARTYY YGSGSYYNGFDYWGQGTLVTVSS SEQ ID NO: 31552 |
| iPS:436908 | 21-225_72D5 | NA | TCCTATGACCTGACTCAGCCACCCTCAGTGTC CGTGTCCCCAGGACAGACAGCCAGCATCACCT GCTCTGGAGATAAATTGGGGGAATAAATATGCT TGCTGGTATCAGCAGAAGCCAGGCCAGTCCCC TGTGGTGGTCATCTATCAAGATAGGAAGCGGC CCTCAGGGATCCCTGAGCGATTCTCTGGCTCC AACTCTGGGAACACAGGCTACTCTGACCATCAG CGGGACCCAGGCTATGGACAGCAGCACTGCGGTA ACTGTCAGGCGTGGGACAGCAGCACTGCGGTA TTCGGCGGAGGGACCAAGCTGACCGTCCTA SEQ ID NO: 27547 |
| | | | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTGAATG ATGATAAGGCTACACCCATCTGCACTCTGAAGAGCA GGTTCACCATCACCAGGGACACCTCCAAAGACC AGGTGGTCTTTACAATGACCAACATGGACCCTGT GGACACGAGCACATATTACTGTGCACATAAAGCT ACCTGGTGGCTTTGATATCTGGGGCCAAGGGA CAATGGTCACCGTCTCTCA SEQ ID NO: 31553 |

FIGURE 50
(Continued)

| | | | |
|---|---|---|---|
| iPS:436910 | 21-225_73G1 | AA | SYDLTQPPSVSVSPGQTASITCSGDKLGNKYAC WYQQKPGQSPVVVIYQDRKRPSGIPERFSGSNSG NTATLTISGTQAMDEADYYCQAWDSSTAVFGG GTKLTVL<br>SEQ ID NO: 27548 | QITLKESGPTLVKPTQTLTLTCTFSGFSLSTSGVGVG WIRQPPGKALEWLALINWNDDKRYSPSLKSRFTITR DTSKDQVVFTMTNMDPVDTGTYYCAHKATWVAF DIWGQGTMVTVSS<br>SEQ ID NO: 31554 |
| | | NA | CAGACTCTGTGGTGACCCAGGAGCCATCGTTCTC AGTGTCCCCTGAGCTCTGGCTCAGTCTCTACTAGTT GTGGCTTGACTCTGCCTCAGTCTCTACTAGTT ACTACCCCAGCTGGTACCAGCAGACCCCAGGC CAGGCTCCACGCTCATCTACAAGACAAA CACTCGCTCTTCTGGGGTCCCTGATCGCTTCTC TGGCTCCATCCTTGGGAACAAAGCTGCCCTCA CCATCACGGGGGCCCAGGCAGATGATGAATCT GATTATTACTGTGTTCTATATGGGGACCAAGTT AATTGGGTGTTCGGCGGAGGGACCAAGTTGAC CGTCCTA<br>SEQ ID NO: 27549 | CAGGTGCAGCTGGTGGAGTCTGGGGGAGGCGTG GTCCAGCCTGGGAGGTCCCTGAGACTCTCCTGTG CAGGCACTGGATTCACCTTCAGTTACTATGGCAT GCACTGGGTCCGCCAGGCTCCAGGCAAGGGGCT GGAGTGGGTGGCAGTTACAACATGATGAAG TAATAATACTATGCAGAGTCCGTGAAGGGCCG ATTCACCAGTCCAGAGACAATTCCAAGAACAC GCTGTATCTGCAAATGAATAGCTGAGAGCTGAG GACACGGCTGTGTATCACTGTGCGAGAGAGACT GGAACCTGGGCTTTTGATATCTGGGGCCAAGGGA CAATGGTCACCGTCCTCTTA<br>SEQ ID NO: 31555 |
| | | AA | QTVVTQEPSFSVSPGGTVTLTCGLSSGSVSTSYY PSWYQQTPGQAPRTLIYNTNTRSSGVPDRFSGSI LGNKAALTITGAQADDESDYYCVLYMGSAIWV FGGGTKLTVL<br>SEQ ID NO: 27550 | QVQLVESGGGVVQPGRSLRLSCAGTGFTFSYYGM HWVRQAPGKGLEWVAVTTYDGSNKYYADSVKGR FTSSRDNSKNTLYLQMNSLRAEDTAVYHCARETGT WAFDIWGQGTMVTVSL<br>SEQ ID NO: 31556 |

FIGURE 50
(Continued)

| | | | |
|---|---|---|---|
| iPS:436912 | 21-225_73C4 | NA | TCCTATGACTGACTGACCCTCAGTGTC CGTGTCCCCAGGAGACAGAGCCAGCATCACCT GCTCTGGAGATAAATTGGGACAGCCAGTCCT TGCTGGTATCAGCAGAAGCCAGGCCAGTCCCC TGTGGTGGTCATCTATCAAGATATGAAGCGGC CCTCAGGGATCCCTGAGGCGATTCTCTGGCTCC AACTCTGGGAACACAGCCACTCTGACCATCAG CGGGACCCAGGCTATGGATGAGGCTGACTATT ACTGTCAGGCGTGGGACCAGCAGCACTGCGGTA TTCGGCGGAGGGACCAAGCTGACCGTCCTA<br><br>SEQ ID NO: 27551 | CAGATCACCCTGAAGGAGTCTGGTCCTACGCTGG TGAAACCACACAGACCCCTCACGCTGACCTGCAC CTTCTCTGGGTTCTCACTCAGCACTAGTGGAGTG GGTGTGGGCTGGATCCGTCAGCCCCAGGAAAG GCCCTGGAGTGGCTTGCACTCATTAATTGGAATG ATGATAAGCGCTACAGCCCATCTCTGAAGAGCA GGTTCACCATCTCCAAGGACACCTCCAAAGACC AGGTGGTCCTTACAATGACCAACATGGACCCTGT GGACACAGCCACATATTACTGTGCACATAAAACT ACCTGGGTGGCTTTGATATCGGGGCCAAGGGA CAATGGTCACCGTCTCTTCA<br><br>SEQ ID NO: 31557 |
| | | AA | SYDLTQPPSVSVSPGQTASITCSGDKLGNKYAC WYQQKPGQSPVVVIYQDMKRPSGIPERFSGSNS GNTATLTISGTQAMDEADYYCQAWDSSTAVFG GGTKLTVL<br><br>SEQ ID NO: 27552 | QITLKESGPTLVKPTQTLTLTCTFSGFSLSTSGVVG WIRQPPGKALEWLALINWNDDKRYSPSLKSRFTITR DTSKDQVLTMTNMDPVDTATYYCAHKTTWVAF DIWGQGTMVTVSS<br><br>SEQ ID NO: 31558 |
| iPS:436914 | 21-225_76B4 | NA | CCCTATGAGCTGAATCAGACACACCCTCAGTGTC CGTGTCCCCAGGAGACAGAGCCAGCATCACCT GCTCTGGAGATAGATTGGGGACTAAATTTGCT TGCTGGTATCAGCAGAAGCCAGGCCAGTCCCC TGTGGTGGTCATTTATCAAGATAGCAAGCGGC CCTCAGGGATCCCTGAGGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTATTC GGCGGAGGGACCAAGCTGACCGTCCTA<br><br>SEQ ID NO: 27553 | CAGATCACCCTGAAGGAGTCTGGTCCTACGCTGG TGAAACCACACAGACCCCTCACGCTGACCTGCAC CTTCTCTGGGTTCTCACTCAGCACTGGTGGAGTG GGTGTGGGCTGGATCCGTCAGCCCCAGGAAAG GCCCTGGAGTGGCTTGCACTCATTATTGGGATG ATGATAAGCGCTACAGCCCATCTCTGAAGAGCA GGCTCACCATCACCAAGGACACCCCAAAAACC AGGTGGTCCTTACAATGACCAACATGGACCCTGT GGACACAGCCACATATTACTGTGCACACCTTATA GCAGTGGCCTTTGACTACTGGGGCCAGGGAACCC TGGTCACCGTCTCCTCA<br><br>SEQ ID NO: 31559 |

FIGURE 50
(Continued)

| | | | | |
|---|---|---|---|---|
| iPS:436916 | 21-225_74A9 | AA | PYELNQTPSVSVSPGQTASITCSGDRLGTKFACW YQQKPGQSPVLVIYQDSKRPSGIPERFSGSNSGN TATLTISGTQAMDEADYYCQAWDSSTVFGGGT KLTVL<br>SEQ ID NO: 27554 | QITLKESGPTLVKPTQTLTLTCTFSGFSLSTGGVGVG WIRQPPGKALEWLALIYWDDDKRYSPSLKSRLTIT KDTPKNQVVLTMTNMDPVDTATYYCAHLIAVAFD YWGQGTLVTVSS<br>SEQ ID NO: 31560 |
| | | NA | TCCTATGAGCTGACTCAGCCACCCTCAGTGTC CGTGTCCCCAGGACAGACAGCCAGCATCACCT GCTCTGGAGATAAATTGGTAATAAATATGTT TGTTGGTATCAGCAGAAGCCAGGCCAGTCCCC TGTGCTGGTCATCTATCAAGATAACAGGCGC CCTCAGGGATCCCTGAGCGATTCTCTGGCTCC AACTCTGGGAACACAGCCACTCTGACCATCAG CGGAACCCAGGCTATGGAGGACAGTCCTGTATA ACTGTCAGGGCTGTGGGACAGCAGTCCTGTGATA TTCGGCGGAGGGACCAAACTGACCGTCCTA<br>SEQ ID NO: 27555 | CAGGTGCAACTGGTGGAGTCTGGGGGAGGCGTG GTCCAGCCTGGGAGGTCCCTGAGACTCTCCTGTG CAGCGTCTGGATTCACCTTCAGTAGTATGGCAT GCACTGGGTCCGCCAGGCTCCAGGCAAGGGCT GGAGTGGGTGGCAGTTATATGTATGATGAAAT AATAAATCCTATGCAGAGACTCCGTGAAGGCCGAT TCACCATCTCCAGAGACATTTCCAAGAACACGCT GTTTCTGCAAATGAACAGCCTGAGAGCCGATGAC ACGGCTGTGTATTACTGTGCGAGAGATCGAGATT ATTGTAGTGGTACCAGCTGCCCTTATTATTACTAC TACGGTATGGACGTCTGGGGCCAAGGGACCACG GTCACCGTCCTCCTCA<br>SEQ ID NO: 31561 |
| | | AA | SYELTQPPSVSVSPGQTASITCSGDKLGNKYVCW YQQKPGQSPVLVIYQDNRRPSGIPERFSGSNSGN TATLTISGTQAMDEADYYCQAWDSSPVIFGGGT KLTVL<br>SEQ ID NO: 27556 | QVQLVESGGGVVQPGRSLRLSCAASGFTFSSYGMH WVRQAPGKGLEWVAVIWYDGNNKSYADSVKGRF TISRDISKNTLFLQMNSLRADDTAVYYCARDRDYC SGTSCPYYYYGMDVWGQGTTVTVSS<br>SEQ ID NO: 31562 |

FIGURE 50
(Continued)

| | | | |
|---|---|---|---|
| iPS:436918 | 21-225_77A2 | NA | TCCTATGAGCTGACTCAGCCACCCTCAGTGTC CGTGTCCCCAGGACAGACAGCCAGCATCACCT GCTCTGGAGATAGATTGGGGGATAAATATGCT TGCTGGTATCAGCAGAAGCCAGGCCAGTCCCC TGTACTGGTCATCTATCAAGATAGGAAGGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGTACTGCGGTA TTCGGCGGAGGGACCAAGCTGACCGTCCTA<br><br>SEQ ID NO: 27557 | CAGATCACCTTGAAGGAGTCTGGTCCTTCGCTGG TGAAACCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGTATTCATTTATTGGATG ATGATAAGGCTACAGCCATCTCTGAAGAGCA GGCTCACCATCACCAAGGACACCTCCAAAAACC AGTTGGTCCTTACAATGACCAACATGGACCCTGT GGACACAGCCACATATTACTGTGCACACCTTATA GCAGTGGCCTTTGACTACTGGGGCCAGGGAACCC TGGTCACCGTCTCCTCA<br><br>SEQ ID NO: 31563 |
| | | AA | SYELTQPPSVSVSPGQTASITCSGDRLGDKYACW YQQKPGQSPVLVIYQDRKRPSGIPERFSGSNSGN TATLTISGTQAMDEADYYCQAWDSSTAVFGGG TKLTVL<br><br>SEQ ID NO: 27558 | QITLKESGPSLVKPTQTLTLTCTFSGFSLSTSGVVG WIRQPPGKALEWLVFIYWDDDKRYSPSLKSRLTIT KDTSKNQVVLTMTNMDPVDTATYYCAHLIAVAFD YWGQGTLVTVSS<br><br>SEQ ID NO: 31564 |
| iPS:436920 | 21-225_74E5 | NA | CAGACTGTGTGACTCAGGAGCCCTCACTGAC TGTGTCCCCAGGAGGACAGTCACTCTCACCT GTGCTTCCAGCACTGAAACAGTCACCAGTGGT TCTTATCCGAACTGGTTCCAGCAGAAACCTGG ACAAGCACCCAGGCACTGATTTATAGTACAA GCAACAAACACTCCTGACCCCTGCCCGGTTC TCAGGCTCCCTCCTTGGGGGCAAAGCTGCCT GACACTGTCAGATGTGCAGCCTGAGGACGAG GCTGAGTATTACTGCCTGCTCTCTACTATGGTGGT GCTCAACTGTATTCGGCGGAGGGACCAAGCT GACCGTCCTA<br><br>SEQ ID NO: 27559 | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTTA CTACTGGAGCTGGATCCGCCAGCACCCAGGGAA GGGAGCACTACTACAACCCGTCCTCAGGAGTC GAGCTTCCATATCAGTAGACAGCTTCAAGAACCA GTTCTCCCTGAAGCTGAGCTCTGTGACTGCCGCG GACACGGCCGTGTATTACTGTGCGAGAGATTCAC CAGTGGCTGGTACTGACTACTGGGGCCAGGGAA CCCTGGTCACCGTCTCCTCA<br><br>SEQ ID NO: 31565 |

FIGURE 50
(Continued)

| | | | |
|---|---|---|---|---|
| iPS:436922 | 21-225_78E9 | AA | QTVVTQEPSLTVSPGGTVTLTCASSTETVTSGSYPNWFQQKPGQAPRALIYSTSNKHSWTPARFSGSLLGGKAALTLSDVQPEDEAEYYCLLYYGGAQLVFGGGTKLTVL<br>SEQ ID NO: 27560 | QVQLQESGPGLVKPSQTLSLTCTVSGGSIRSGGYYWSWIRQHPGKGLEWIGYIYYSGSTYNPSLRSRASISVDTSKNQFSLKLSSVTAADTAVYYCARDSPVAGTDYWGQGTLVTVSS<br>SEQ ID NO: 31566 |
| | | NA | TCTTATGAGTTGACTCAGCCACCCTCAGAGTCTGTGTCCCCAGGACAGACAGCCAGCATCACGTGCTCAGGAGATAAATTGGGAATAAATATGTTTCCTGGTATCAGCAGAAGCCAGGCCAGTCCCCTGTGCTGGTCATCTATCAAGATAACAGGCGCCGTCAGGGATCCCTGAGCCACTTTGACCATCAGAACTCTGGGAGCACAGCCATGGAGGCTGACTATTACTGTGCAGCTGTGGGACAGCAGCCCTGTGATATTCGGCGGAGGGACCAAGCTGACCGTCCTA<br>SEQ ID NO: 27561 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATGGTATGATGAAATAATAAATCCTATGCAGAGACTCCGTGAAGGGCCGATTCACCATCTCCAGAGACACATTCCAAAAACACGCTGTATCTGCAAATGAACAGCCTGAGAGCCGAGGACACGGCTGTGTATTACTGTGCGAGGGATCGAGATTATTGTAGTAGTACCAGCTGCCCTTATTACTACTACGGTATGGACGTCTGGGGCCAAGGGACCACGGTCACCGTCTCCTCA<br>SEQ ID NO: 31567 |
| | | AA | SYELTQPPSESVSPGQTASITCSGDKLGNKYVSWYQQKPGQSPVLVIYQDNRRPSGIPERFSGSNSGTATLTISGTQAMDEADYYCQAWDSSPVIFGGGTKLTVL<br>SEQ ID NO: 27562 | QVQLVESGGGVVQPGRSLRLSCAASGFTFSSYGMHWVRQAPGKGLEWVAVIWYDGNNKSYADSVKGRFTISRDISKNTLYLQMNSLRAEDTAVYYCARDRDYCSSTSCPYYYYGMDVWGQGTTVTVSS<br>SEQ ID NO: 31568 |

FIGURE 50
(Continued)

| | | | |
|---|---|---|---|
| iPS:436924 | 21-225_74B3 | NA | TCCTATGAGCTGACTCAGCCACCCTCAGTGTC CGTGTCCCCAGGACAGAGCAGCATCACCT GCTCTGGAGATAAATTGGGGGATAAATATGCT TGCTGGTATCAGCAGAAGCCAGGCCAGTCCC TGTGCTGGTCATCTATCAAGATAGCAAGCGC CCTCAGGGATCCCGAGCGATTCTCTGGCTCC AACTCTGGGAACACAGCCACTCTGACCATCAG CGGGACCCAGGCTATGGATGAGGCTGACTATT ACTGTCAGGCGTGGGACAGCACCACTGTGGTA TTCGGCGGAGGGACCAAGCTGACCGTCCTA<br><br>SEQ ID NO: 27563 | CAGGTGCAGCTGGTGGAGTCTGGGGGAGGCGTG GTCCAGCCTGGGGAGGTCCCTGAGACTCTCCTGT CAGCGTCGGGATTCACCTTCAGTCGATATGGCAT GCACTGGGTCCGCCAGGCTCCAGGCAAGGGCT GGAGTGGGTGGCAGTTTTTGGTATGATGAAGT AATAAAGACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTATTACTGTGCGAGAGATCGAGA TTATTGTAGTAGTACCAGCTGCCCTTACTACTACT ACTACGTATGGACGTCTGGGGCCAAGGGACCA CGGTCACCGTCTCCTCA<br><br>SEQ ID NO: 31569 |
| | | AA | SYELTQPPSVSVSPGQTASITCSGDKLGDKYACW YQQKPGQSPVLVIYQDSKRPSGIPERFSGSNSGN TATLTISGTQAMDEADYYCQAWDSTTVVFGGG TKLTVL<br><br>SEQ ID NO: 27564 | QVQLVESGGGVVQPGRSLRLSCAASGFTFSRYGMH WVRQAPGKGLEWVAVFWYDGSNKDYADSVKGRF TISRDNSKNTLYLQMNSLRAEDTAVYYCARDRDY CSSTSCPYYYYGMDVWGQGTTVTVSS<br><br>SEQ ID NO: 31570 |

FIGURE 50
(Continued)

| | | | |
|---|---|---|---|
| iPS:436926 | 21-225_78D10 | NA | CAGACTGTGGTGACTCAGGAGCCCTCACTGAC TGTGTCCCCAGGAGGGACAGTCACTCTCACCT GTGCTTCCAGCACTGAGCAGTCAGTCACCAGTGGT TACTTTCCAAACTGGTTCCAGCAGAAACCTGG ACAAGCACCCAGGGCACTGATTTATAGTACAG ACAACAAACACTCCTGGAACCCGTGCCCGGTTC TCAGGCTCCCTGTCCTTGGGGGCAAAGTGCCCT GACACTGTCAGGTGTGCAGCCTGAGGACGAG GCTGAGTATTACTGCCTCCTCTACTATGGTGGT GCTCAGCTGATGTTCGGCGGAGGGACCAAGCT GACCGTCCTA<br><br>SEQ ID NO: 27565 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAGCTGGATCCGCCAGCACCCAGGAA GGGCCTGGAGTGGATTGGGTACATCTATTACATT GGGAGTGTTACTACAAACCCGTCCTCAAGAGTC GAGTTACCATATCAGTAGACACGTCTAAGAACCA GTTCTCCCTGAAGCTGAGCTCTGTGACTGCCGG GACACGGCCGTGTACTACTGTGCGAGAGATGCCC CCGACTTCGGTATGGACGTCTGGGGCCAAGGGA CCACGGTCACCGTCCTCA<br><br>SEQ ID NO: 31571 |
| | | AA | QTVVTQEPSLTVSPGGTVTLTCASSTGAVTSGYF PNWFQQKPGQAPRALIYSTDNKHSWTPARFSGS LLGGKAALTLSGVQPEDEAEYYCLLYYGGAQL MFGGGTKLTVL<br><br>SEQ ID NO: 27566 | QVQLQESGPGLVKPSQTLSLTCTVSGGSISSGGYYW SWIRQHPGKGLEWIGYIYYIGSVYYNPSLKSRVTIS VDTSKNQFSLKLSSVTAADTAVYYCARDAPDFGM DVWGQGTTVTVSS<br><br>SEQ ID NO: 31572 |
| iPS:436928 | 21-225_79E7 | NA | TCCTATGAGCTGACTCAGCCACCCTCAGTGTC CGTGTCCCCAGGACAGACAGCCAGCATCACCT GCTCAGGAGATAAATTGGGGAACAGCCAGTCC TCCTGGTATCAGCAGAAGCCAGGCCAGTCCCC TGTGCTGGTCGGTCATCTATCAAGATAACAGGCGGC CCTCAGGGATCCCTGAGCGATTCTCTGGCTCC AACTCTGGGAACACAGCCACTCTGACCATCAG CGGGACCCAGGCTATGGACGAGGCTGACTATT ACTGTCAGGGCGTGGGACAGCAGCCCTGTGATA TTCGGCGGAGGGACCAAGCTGACCGTCCTA<br><br>SEQ ID NO: 27567 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGCAGACTCCGTGAAAT AATAAATCTATGCAGACTCCGTGAAGGGCCGAT TCACCATCTCCAGAGACAATTCCAAAAACACGCT GTATCTGCAAATGAACAGCTGAGAGCCGAGGA CACGGCTGTGTATTACTGTGCGAGGGATCGAGAT TATTGTAGTAGTACCAGCTGCCCTATTATTACTA CTACGGTATGGACGTCTGGGGCCAAGGGACCAC GGTCACCGTCTCCTCA<br><br>SEQ ID NO: 31573 |

FIGURE 50
(Continued)

| | | AA | SYELTQPPSVSVSPGQTASITCSGDKLGNKYVSW YQQKPGQSPVLVIYQDNRRPSGIPERFSGSNSGS TATLTISGTQAMDEADYYCQAWDSSPVIFGGT KLTVL | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYYGMDVWGQGTTVTVSS |
| | | | SEQ ID NO: 27568 | SEQ ID NO: 31574 |
| iPS:436932 | 21-225_92A4 | NA | TCCTATGAGCTGACTCAGCCACCCTCAGTGTC CGTGTCCCCAGGACAGACAGCCAACATCACCT GCTCTGGAGATAAATTGGGGAATAAATATGTT TGCTGGTATCAACAGAAGCCAGGCCAGTCCCC TGTGTTGGTCATCTATCAAGATAACAGGCGGC CCTCAGGGATCCCTGAGCGATTCTCTGGCTCC AACTCTGGGAACACAGGCTATGATGAGGCTGACTATT CGGGACCCAGGCGTGGGACAGCAGCCCTGTGATA ACTGTCAGGGCGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGCT GGAGTGGGTGGCAGTTATATGGTATGATGGAAAT AATAAATCTATGCAGACTCCGTGAAGGGCCGAT TCACCATCTACAGAGACATTTCCAAGAACACGCT GTATCTGCAAATGAACAGCTGAGAGCCGAGGA CACGGCTGTGTATTACTGTGCAGAGATCGAGAT TATTGTAGTAGTACCAGCTGCCCTTATTATTACTA CTACGGTATGGACGTCTGGGGCCAAGGGACCAC GGTCACCGTCTCCTCA |
| | | | SEQ ID NO: 27569 | SEQ ID NO: 31575 |
| | | AA | SYELTQPPSVSVSPGQTANITCSGDKLGNKYVC WYQQKPGQSPVLVIYQDNRRPSGIPERFSGSNSG NTATLTISGTQAMDEADYYCQAWDSSPVIFGGG TKLTVL | QVQLVESGGGVVQPGRSLRLSCAASGFTFSSYGMH WVRQAPGKGLEWVAVIWYDGNNKSYADSVKGRF TIYRDISKNTLYLQMNSLRAEDTAVYYCARDRDYC SSTSCPYYYYYGMDVWGQGTTVTVSS |
| | | | SEQ ID NO: 27570 | SEQ ID NO: 31576 |

FIGURE 50
(Continued)

| | | | |
|---|---|---|---|
| iPS:436934 | 21-225_96B5 | NA | CCCTATGAGCTGAATCAGACACCCTCAGTGTC CGTGTCCCCAGGACAGATAGATTGGGGACAGCCAGCATCACCT GCTCTGGAGATAGATTGGGGACTAAATTTGCT TGCTGGTATCAGCAGAAGCCAGGCCAGTCCCC TGTGCTGGTCATTTATCAAGATAGCAAGCGGC CCCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGGCGTGGGACAGCAGCACTGTCCTA GGGCGAGGGACCAAGCTGACCGTCCTA SEQ ID NO: 27571 | CAGATCACCTTGAAGGAGTCTGGTCCTACGCTGG TGAAACCCACACAGACCCTCACGCTGACCTGCAC CTTCTCTGGGTTCTCACTCAGCAGCTGGTGAGTG GGTGTGGGCTGGATCCGTCAGCCCCCAGGAAAG GCCCTGGAGTGGCTTGCACTCAGCCATGCATTATTGGGATG ATGATAAGCGCTACAGCCCATCTGAAGAGCA GGCTCACCATCACCAAGGACACCCCAAAACC AGGTGGTCCTTACAATGACCAACATGACCCTGT GGACACAGCCACATATTACTGTGCACACCTTATA GCAGTGGCCTGTGACTACTGGGGCCAGGGAACC CTGGTCACCGTCTCCTCA SEQ ID NO: 31577 |
| | | AA | PYELNQTPSVSVSPGQTASITCSGDRLGTKFACW YQQKPGQSPVLVIYQDSKRPSGIPERFSGSNSGN TATLTISGTQAMDEADYYCQAWDSSTVFGGGT KLTVL SEQ ID NO: 27572 | QITLKESGPTLVKPTQTLTLTCTFSGFSLSTGGVVG WIRQPPGKALEWLALIYWDDDKRYSPSLKSRLTIT KDTPKNQVVLTMTNMDPVDTATYYCAHLIAVACD YWGQGTLVTVSS SEQ ID NO: 31578 |
| iPS:436936 | 21-225_97E6 | NA | TCCTATGAGCTGACTCAGCCACCCTCAGTGTC TGTGTCCCCAGGACAGACAGTCAGCATCACCT GCTCTGGAGATAAATTGGGGAATAAATATGT TCCTGGTATCAGCAGAAGCCAGGCCAGTCCCC TGTGCTGGTCATCTATCAAGATAACAGGCGGC CGTCAGGGATCCCTGAGCGATTCTCTGGCTCC AACTCTGGGAACACAGGCTATGGATGAGGCTGACTATT CGGGACCCAGGCTATGGATGAGGCTGACTATT ACTGTCAGGCGGTGGGACAGCACCCTGTGATA TTCGGCGGAGGGACCAAGCTGACCGTCCTA SEQ ID NO: 27573 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATCGAGACTCCGTGATGGTATGATGGAAAT AATAAATCTATGCAGACTCCGTGAAGGGCCGAT TCACCATCTCCAGAGACAATTCCAAAAACACGCT GTATCTGCAAATGAACAGCCTGAGAGCCGAGGA CACGGCTGTGTATTACTGTGCGAGGGATCGAGAT TATTGTAGTAGTACCAGCTGCCCTTATTATTACTA CTACGGTATGGACGTCTGGGGCCAAGGGACCAC GGTCACCGTCTCCTCA SEQ ID NO: 31579 |

FIGURE 50
(Continued)

| | | | | |
|---|---|---|---|---|
| | | AA | SYELTQPPSVSVSPGQTVSITCSGDKLGNKYVSW YQQKPGQSPVLVIYQDNRRPSGIPERFSGSNSGS TATLTISGTQAMDEADYYCQAWDSTPVIFGGGT KLTVL | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYGMDVWGQGTTVTVSS |
| | | | SEQ ID NO: 27574 | SEQ ID NO: 31580 |
| | | NA | TCCTATGCGATGACTCAGCCACCCTCAATGTC CGTGTCCCCAGGACAGAGACCAGCATCACCT GCTCTGGAATAAATTGGGGAATAGATATGCT TGCTGGTATCAGCAGAAGCCAGGCCAGTCCC TGTGCTGGTCATCTATCAAGATAGCAAGCGGC CCTCAGGGATCCCTGAGGGATTCTCTGGCTCC AACTCTGGGAACATAGCCACTCTGACCATCAG CGGGACCCAGGCTATGGATGAGGCTGACTATT ACTGTCAGGCGTGGGACAGCAGCACTGTGTA TTCGGCGGAGGGACCAAGCTGACCGTCCTA | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGCT GGAGTGGGTCTCAGTTATTAGTGGTGGTGGTACT ACCACATACGCAGACTCCGTGAAGGGCCGG TTCACCATCTCCAGAGACAATGAACAGCCTGAGG TGTATCTGCAAATGAACAGCCTGAGAGCCGAGG ACACGGCCGTATATTACTGTGCGAAATGGGAG GTAACCCCACTGACTACGGTATGGACGTCTGGGG CCAAGGGACCACGGTCACCGTCTCCTCA |
| | | | SEQ ID NO: 27575 | SEQ ID NO: 31581 |
| iPS:436938 | 21-225_146A3 | AA | SYAMTQPPSMSVSPGQTASITCSGNKLGNRYAC WYQQKPGQSPVLVIYQDSKRPSGIPERFSGSNSG NIATLTISGTQAMDEADYYCQAWDSSTVVFGGG TKLTVL | EVQLLESGGGLVQPGGSLRLSCAASGFTFSSYAMS WVRQAPGKGLEWVSVISGGGTTTYYADSVKGRFTI SRDNSKNTLYLQMNSLRAEDTAVYYCAKWRGNPT DYGMDVWGQGTTVTVSS |
| | | | SEQ ID NO: 27576 | SEQ ID NO: 31582 |

FIGURE 50
(Continued)

| iPS:436940 | 21-225_146B8 | NA | TCCTATGAGCTGACTCAGCCACCCTCAGTGTC CGTGTCCCCAGGACAGAGACAGCCAGCATCACCT GCTCTGGAGATAAATTGGGGATAAATATGTT TGCTGGTATCAGCAGAAGCCAGGCCAGTCCCC TGTGTTGGTCATCTATCAAGATAGGAAGCGC CCTCAGGGATCCCGAGCGATTCTCTGGCTCC AACTCTGGGAACACAGCCACTCTGACCATCAG CGGGACCCAGGCTATGAGGATGAGGCTGACTATT ACTGTCAGGCGTGGCACAGCAGCACTGTGGTA TTCGGCGGAGGGACCAAGCTGACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTACCTATGGCAT GCACTGGGTCCGCCAGGCTCCAGGCAAGGGCT GGAGTGGGTGGCAGTTGTATGGTATGGTGAAAT GATAAAGACTTTGCAGACTCCGTGACGGGCCGAT TCACCATCTCCAGAGACATTTCCAAGAACACACT GTATCTGCAAATGAACAGCCTGAGAGCTGAGGA CACGGCTGTGTATTACTGTGCGAGAGATCGGAT TATTGTAGTGGTGGTAGCTGCCCTTACTACTACT ACTACGTATGGACGTCTGGGGCCAAGGGACCA CGGTCACCGTCTCCTCA |
| | | | SEQ ID NO: 27577 | SEQ ID NO: 31583 |
| | | AA | SYELTQPPSVSVSPGQTASITCSGDKLGDKYVCW YQQKPGQSPVLVIYQDRKRPSGIPERFSGSNSGN TATLTISGTQAMDEADYYCQAWHSSTVFGGG TKLTVL | QVQLVESGGGVVQPGRSLRLSCAASGFTFSTYGMH WVRQAPGKGLEWVAVVWYGGNDKDFADSVTGR FTISRDISKNTLYLQMNSLRAEDTAVYYCARDRDY CSGGSCPYYYYGMDVWGQGTTVTSS |
| | | | SEQ ID NO: 27578 | SEQ ID NO: 31584 |

FIGURE 50
(Continued)

| | | | |
|---|---|---|---|
| iPS:436942 | 21-225_146H8 | NA | TCCTATGAGCTGACTCAGCCACCCTCAGTGTCCGTGTCCCCAGGACAGACAGCCAGCATCACCTGCTCTGGAGATAAATTGGGGGATAAATATGCTTGCTCAGCAGAAGCCAGGCCAGTCCCCTGTGCTGGTATCAGCAGAAGCCAGGCCAGTCCCCTGTGTCTGGTCATCTATCAAGATAAGAAGCGGCCCTCAGGGATCCCGAGCGATTCTCTGGCTCCAACTCTGGGAACACAGCCACTCTGACCATCAGCGGGACCCAGGTTATGGATGAGGCTGACTATTACTGTCAGGCGTGGGACACATCAGAACTGTGGTATTCGGCGGAGGGACCAAGCTGACCGTCCTA | CAGGTGCAGCTGGTGCAGTCTGGGGCTGAGGTGAAGAAGCCTGGGGCCTCAGTGAAGGTCTCCTGCAAGGCTTCTGGATACACCTTCATCAGTTATGATATCAATTGGGTGCGACAGGCCACTGGACAAGGCTTGAGTGGATGGGATGGATGAACCTAACAGTGGTAACACAGGCTATGCACAGAAGTTCCAGGGCAGAGTCACCATGACCAGGAACACCTCCAAAGCAGAGTCCTACATGGAGCTGAGCAGCCTGAGATCTGAGGACACGGCCGTGTATTACTGTGCGAGAGAGATTATTACTACTATGATAGTAGTGGTCACCAGCCTTACTACTACTACGGTATGGACGTCTGGGGCCAAGGGACCACGGTCACCGTCTCCTCA |
| | | | SEQ ID NO: 27579 | SEQ ID NO: 31585 |
| | | AA | SYELTQPPSVSVSPGQTASITCSGDKLGDKYACWYQQKPGQSPVLVIYQDKKRPSGIPERFSGSNSGNTATLTISGTQVMDEADYYCQAWDIRTVFGGGTKLTVL | QVQLVQSGAEVKKPGASVKVSCKASGYTFISYDINWVRQATGQGLEWMGWMNPNSGNTGYAQKFQGRVTMTRNTSKSTAYMELSSLRSEDTAVYYCARGDYYYDSSGHQPYYYYGMDVWGQGTTVTVSS |
| | | | SEQ ID NO: 27580 | SEQ ID NO: 31586 |

FIGURE 50
(Continued)

| | | NA | TCCTATGAGCTGACTCAGCCACCCTCAGTGTC CGTGTCCCCAGGACAGACAGCCAGCATCACCT GCTCTGGAGATAAATTGGGGGAGAAATATGCT TGCTGGTATCAGCAGAAGTCAGGCCAGTCCCC TGTGTTGGTCATCTATCAAGATAAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACCAGTAGAACTGCGGTA TTCGGCGGAGGGACCAAGCTGACCGTCCTA<br><br>SEQ ID NO: 27581 | CAGATCACCTTGAAGGAGTCTGGTCCTACGCTGG TGAAACCCACAGCCCTCACTGACCTGTAC CTTCTCTGGGTTCTCACTCAGCACTACTGGAGTG GGTGTGGGCTGGATCCGTCAGCCCCCAGGAAAG GCCCTGGAGTGGCTTGGAATCCTTTTTGGAATG ATGATGAGCGCTACAGCCCATCTCTGAAGAGCA GGCTCACCATCACCAAGGACACCTCAAAAACC AGGTGGTCCTTACAATGACAACATGACCCTGT GGACACAGCCACATATTACTGTGCACACAAATCG CAGCTCGTCTACTTTGACTACTGGGGCCAGGGAA CCCTGGTCACCGTCCTCA<br><br>SEQ ID NO: 31587 |
|---|---|---|---|---|
| iPS:436944 | 21-225_182D12 | AA | SYELTQPPSVSVSPGQTASITCSGDKLGEKYACW YQQKSGQSPVLVIYQDRKRPSGIPERFSGSNSGN TATLTISGTQAMDEADYYCQAWDSRTAVFGGG TKLTVL<br><br>SEQ ID NO: 27582 | QITLKESGPTLVKPTQPLTLTCTFSGFSLSTTGVGVG WIRQPPGKALEWLGILFWNDERYSPSLKSRLTITK DTSKNQVLTMTNMDPVDTATYYCAHKSQLVYFD YWGQGTLVTVSS<br><br>SEQ ID NO: 31588 |
| iPS:436946 | 21-225_183F4 | NA | TCCTATGAGCTGACTCAGCCACCCTCAGTGTC CGTGTCCCCAGGACAGACAGCCAGCATCACCT GCTCTGGAGATAAATTGGGGATAAATATGCT TGCTGGTATCAGCAGAAGTCAGGCCAGTCCCC TGTGTTGGTCATCTATCAAGATAAGAAACGGC CCTCAGGGATCCCTGAGCGATTCTCTGGCTCC AACTCTGGAAACACAGCCACTCTGACCATCAG CGGGACCCAGGCTATGGACGAACAGCACTGTG ACTGTCAGGCGTGGACCAGCAAACTGACCGTCGTG GTATTCGGCGGAGGGACCAAACTGACCGTCCT A<br><br>SEQ ID NO: 27583 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGCTATGGCAT GCACTGGGTCCGCCAGGCTCCAGGCAAGGGCT GGAGTGGGTGGCAGTTATATGCAGACTCCGTGAAGT AATAAATACTATGCAGACTCCGTGAAGGGCCGA TTCACCATCTCCAGAGACAATTCCAAGAACAGC TGTATCTGCAAATGAACAGCCTGAGAGCCGAGG ACACGGCTGTGTATTACTGTGCGAGAGAAGGA CGTATTGTAGTGGTACCACCTGCCCTACTACTA CTACTACGGTCTGGGGGTCTGGGGCCAAGGGACC ACGGTCACCGTCTCCTCA<br><br>SEQ ID NO: 31589 |

FIGURE 50
(Continued)

| | | | |
|---|---|---|---|
| iPS:436948 | 21-225_183F5 | AA | SYELTQPPSVSVSPGQTASITCSGDKLGDKYACWYQQKPGQSPVLVIYQDKKRPSGIPERFSGSNSGNTATLTISGTQAMDEADYYCQAWDNSTAVVFGGGTKLTVL<br><br>SEQ ID NO: 27584 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERTYCSGTTCPYYYYYGLGVWGQGTTVTVSS<br><br>SEQ ID NO: 31590 |
| | | NA | CAGACTGTGGTGACCCAGGAGCCATCGTTCTCAGTGTCCCCTGGAGGGACAGTCACACTCACTTGTGGCTTGAGCTCTGGCTCAGTCTCTACTACTTTCTACCCCAGCTGGTACCAGCAGCAGACCCCAGGCCAGGCTCCACGCACGCTCTGGGGTCCCTGATCGTTCTCCACTGCCTCCATCCTTGGGAACAAAGTGCCCTCACCATCACGGGGGCCCAGGCAGATGATGAATCTGATTATTACTGTGCTTATATGGGTAGTGGCATTTGGGGTGTTCGGCGGAGGGACCAAGCTGACCGTCCTA<br><br>SEQ ID NO: 27585 | CAGGTACAGCTGGTGGAGTCTGGGGGAGGCGTGGTCCAGCCTGGGAGGTCCCTGAGACTCTCCTGTGCAGCGTCTGGATTCACCTTCAGTAGTTATGGCATGCTCTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACACTGTATCTGCAAATGAACAGCCTGAGAGCCGAGGACACGGCTGTTTATTACTGTGCGAGAGAGAATTTTGGAGTGGTGACTACTGGGGCCAGGGAACCCTGGTCACCGTCTCCTCA<br><br>SEQ ID NO: 31591 |
| | | AA | QTVVTQEPSFSVSPGGTVTLTCGLSSGSVSTFYPSWYQQTPGQAPRTLIYNTNTRSSGVPDRFSGSILGNKAALTITGAQADDESDYYCVLYMGSGIWVFGGGTKLTVL<br><br>SEQ ID NO: 27586 | QVQLVESGGGVVQPGRSLRLSCAASGFTFSSYGMLWVRQAPGKGLEWVTVIWYDGSKYYADSVKGRFTISRDNSKNTLYLQMNSLRAEDTAVYYCARENFWSGDYWGQGTLVTVSS<br><br>SEQ ID NO: 31592 |

FIGURE 50
(Continued)

| | | | | |
|---|---|---|---|---|
| iPS:436950 | 21-225_184G4 | NA | TCCTATGAGCTGACTCAGCCACCCTCAGTGTCCGTGTCCCCAGGACAGAGACAGCCAGCATCACCTGCTCTGGAGATAAATTGGGGGATAAATTTGCTTGCTGGTATCAGCAGAAGCCAGGCCAGTCCCCTGTGTGCTGGTCATCTATGAAGATAGGAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGCCGCACTGTGGTATTCGGCGGAGGGACCCAGCTGACCGTCCTA SEQ ID NO: 27587 | CAGGTGCAGCTGGTGGAGTCTGGGGGAGGCGTGGTCCAGCCTGGGAGGTCCCTGAGACTCTCCTGTGCAGTGTCTGGATTCACCTTTAGTAGTAGCTATGGCATGCACTGGGTCCGCCAGGCTCCAGGCAAGGGCTGGAGTGGGTGGCAATTATATGGTATGATGGAAGTAATAAATACTATGCAGACTCCGTGAAGGGCCGATTCACCATCTCCAGAGACAATGAACAGCCTGAAGACCTGAGAGCCGAGGTGTATCTGCAAATGAACAGCCTGAGAGCCGAGGACACGGCTGTGTATTACTGTGCGAGAGGGGGCCCCGTTCTCTACGGTGACTATGTTTGACTACTGGGGCCAGGGAACCCTGGTCACCGTCTCCTCA SEQ ID NO: 31593 |
| | | AA | SYELTQPPSVSVSPGQTASITCSGDKLGDKFACWYQQKPGQSPVLVIYEDRKRPSGIPERFSGSNSGNTATLTISGTQAMDEADYYCQAWDSRTVVFGGGTQLTVL SEQ ID NO: 27588 | QVQLVESGGGVVQPGRSLRLSCAVSGFTFSSYGMHWVRQAPGKGLEWVAIIWYDGSNKYYADSVKGRFTISRDNSKNTLYLQMNSLRAEDTAVYYCARGGPPFSTVTMYFDYWGQGTLVTVSS SEQ ID NO: 31594 |
| iPS:436952 | 21-225_185D2 | NA | TCCTATGAGCTGACTCAGACACCCTCAGTGTCCGTGTCCCCAGGACAGAGACAGCCAGCATCACCTGCTCTGGAGATAAATTGGGGGATAAATATGCTTGCTGGTATCAGCAGAAGCCAGGCCAGTCCCCTGTGTGCTGGTCATCTATGAAGATAGGAAGCGGCCCTCAGGGATCCCTGACCGATTCTCTGGCTCCAACTCTGGGAACACAGCCACTCTGACCATCAGCGGGACCCAGGCTATGGATGAGGCTGACTATTACTGTCAGGCGTGGGACAGCAGGAAAGTGGTATTCGGCGGAGGGACCAAGCTGACCGTCCTA SEQ ID NO: 27589 | CAGGTGCAGCTGGTGGAGTCTGGGGGAGGCGTGGTCCAGCCTGGGAGGTCCCTGAGACTCTCCTGTCAGCGTCTGGATTCACCTTCAGTAACTATGGCATGCACTGGGTCCGCCAGGCTCCAGGCAAGGGCTGGAGTGGGTGGCAATTATATGGTATGATGGAAGTGATAAATACTATGCAGACTCCGTGAAGGGCCGATTCACCATCTCCAGAGACAATTCCAAGAACACGCTGTATCTGCAAATGAACACCCTGAGAGCCGAAGACACGGCTGTGTATTTCTGTGCGAGAGGGGGCCCCGTTCTCTACGGTGACTATGTTTGACTACTGGGGCCAGGGAACCCTGGTCACCGTCTCCTCA SEQ ID NO: 31595 |

FIGURE 50
(Continued)

| | | | |
|---|---|---|---|
| | | AA | SYELTQTPSVSVSPGQTASITCSGDKLGDKYAC WYQQKPGQSPVLVIYEDRKRPSGIPDRFSGSNSG NTATLTISGTQAMDEADYYCQAWDSRKVVFGG GTKLTVL<br>SEQ ID NO: 27590 | QVQLVESGGGVVQPGRSLRLSCAASGFTFSNYGM HWVRQAPGKGLEWVAIIWYDGSDKYYADSVKGR FTISRDNSKNTLYLQMNTLRAEDTAVYFCARGGPP FSTVTMYFDYWGQGTLVTVSS<br>SEQ ID NO: 31596 |
| iPS:436954 | 21-225_185G7 | NA | TCCTATGAGCTGACTCAGCCACCTCAGTGTC CGTGTCCCAGGACAGACAGCCAGCATCACCT GCTCTCTGGAGATAAATTGGGGGCCAGTCCTGTT TGCTGGTATCAGCAGAAGCCAGGCCAGTCCCC TGTGTTGGTCATCTATCAAGATCGCAAGCGGC CCTCAGGGATCCCTGAGCGATTCTCTGGCTCC AACTCTGGGAACACAGGCTATGATGAGGCTGACTATT CGGGACCCAGGCTGTGGGACAGCAGGTATTC ACTGTCAGGGCGTGGGGACAGCAGACGTGACCGTCCTA GGGCGGAGGACCAAGCTGACCGTCCTA<br>SEQ ID NO: 27591 | CAGATCACCCTGAAGGAGTCTGGTCCTACGCTGG TGAAACCCACACAGACCCTCACGTTGACCTGCAC CTTCTCTGGGTTCTCACTCACCACTGGTGGAGTG GGTGTGGGCTGGATCCGTCAGCCCCCAGGAAAG GCCCTGGAGTGGCTTGCACTCATTTATTGGAATG ATGATGAGCGCTACAGCCCATCTCTGAAGAGCA GGCTCACCATCACCAAGGACACACCTCAAAAACC AGGTGGTCCTTACAATGACCAACATGACCCTGT GGACACAGCCACATATTACTGTGCACACATTATA GCAGTGGCCTTCCAGCATTGGGGCCAGGGCACCC TGGTCACCGTCTCCTCA<br>SEQ ID NO: 31597 |
| | | AA | SYELTQPPSVSVSPGQTASITCSGDKLGHKFVCW YQQKPGQSPVLVIYQDRKRPSGIPERFSGSNSGN TATLTISGTQAMDEADYYCQAWDSSTVFGGGT KLTVL<br>SEQ ID NO: 27592 | QITLKESGPTLVKPTQTLTLTCTFSGFSLTTGGVGV GWIRQPPGKALEWLALIYWNDDERYSPSLKSRLTIT KDTSKNQVVLTMTNMDPVDTATYCAHIIAVAFQ HWGQGTLVTVSS<br>SEQ ID NO: 31598 |

FIGURE 50
(Continued)

| | | | | |
|---|---|---|---|---|
| iPS:436956 | 21-225_186H6 | NA | TCCTATGAGCTGACTCAGCCACCCTCAGTGTC CGTGTCCCCAGGACAGACAGCCAGCATCACCT GCTCTGGAGATAAAATGGGGGAAAAATATGC TTGCTGTATCAGCAGAAGCCAGGCCAGTCCC CTGTGCTGGTCATTTATCAAGATAGAAAGCGG CCCTCAGGGATCCTGAGCGATTCTCTGGCTC CAACTCTGGGAACAGCCACTCTGACCATCA GCGGGACCCAGGCTATGATGAGGCTGACTAT TACTGTCAGGCGTGGGACAGCAGCACTGCGGT ATTCGGCGGAGGGACCAAGCTGACCGTCCTA | CAGATCACCTTGAAGGAGTCTGGTCCTACGCTGG TGAAACCCACAGACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGGATTCATTTCTTGGAATG ATGATAAGGCTACAGCCATCTGAAGAGCA GCCTCACCATCACCAAGGACACCTCCAAAACC AGGTGGTCCTTACAATGACCAACATGACCCTGT GGACACAGCCACATATTACTGTGCACACAAGC AGCAGCTGTGTTTGATATCTGGGGCCAAGGG ACAATGGTCACCGTCTCTCA |
| | | | SEQ ID NO: 27593 | SEQ ID NO: 31599 |
| | | AA | SYELTQPPSVSVSPGQTASITCSGDKMGEKYAC WYQQKPGQSPVLVIYQDRKRPSGIPERFSGSNSG NTATLTISGTQAMDEADYYCQAWDSSTAVFGG GTKLTVL | QITLKESGPTLVKPTQTILTCTFSGFSLSTSGVVG WIRQPPGKALEWLGFISWNDDKRYSPSLKSSLTITK DTSKNQVVLTMTNMDPVDTATYYCAHKAAAVAF DIWGQGTMVTVSS |
| | | | SEQ ID NO: 27594 | SEQ ID NO: 31600 |
| iPS:436958 | 21-225_190D1 | NA | CAGACTGTGGTGACTCAGGAGCCCTCACTGAC TGTGTCCCCAGGAGGACAGTCACTCTCACCT GTGCTTCCAGCACTGGAGCAGTCAGTCACCAGTGGT TCCTATCCAAACTGGTTCCAGCAGAAACCTGG ACAAGCACCCAGGCACTGATTTACAGTACAA GTAACAAACACTCCTGGACCCTGCCCGGTTC TCAGGCTCCCTCCTTGGGGGCAAAGCTGCCT GACACTGTCAGGTGTGCAGCCTGAGGACGAG GCTGACTATTACTGCCTCTCTACTATGGTGGT GCTGACTGGGCATTCGGCGGAGGGACCAAGTT GACCGTCCTA | CAGGTGCAGCTGCAGGAGTCGGGCCCAGGACTG GTGAAGCCTTCACAGACCCTGTCCTCACCTGCA CTGTCTCTGGCTTCCATCAGCAGTGGTTA CTACTGGAGCTGGATCCGCCAGCACCCAGGGAA GGGAGCACTACTACAACCCGTCCCTCAAGAGTC GAGTCACCATATCAGTAGACACGTCTAAGAACC AGTTCTCCCTGAAGCTGAGCTGTGACTGCCGC GGACACGCCGTTTATTACTGTGCGAGAGATTCC CCAACTACGAGGCTTGACTACTGGGGCCAGGGA ACCCTGGTCACCGTCTCCTCA |
| | | | SEQ ID NO: 27595 | SEQ ID NO: 31601 |

FIGURE 50
(Continued)

| | | | | |
|---|---|---|---|---|
| iPS:436960 | 21-225_198D2 | AA | QTVVTQEPSLTVSPGGTVTLTCASSTGAVTSGSY PNWFQQKPGQAPRALIYSTSNKHSWTPARFSGS LLGGKAALTLSGVQPEDEADYYCLLYYGGAQV AFGGGTKLTVL<br>SEQ ID NO: 27596 | QVQLQESGPGLVKPSQTLSLTCTVSGGSISSSGGYYW SWIRQHPGKGLEWIGYIYYSGSTYYNPSLKSRVTIS VDTSKNQFSLKLSSVTAADTAVYYCARDSPLRGFD YWGQGTLVTVSS<br>SEQ ID NO: 31602 |
| | | NA | CAGTCTGTGTTGACGCAGCCGCCCTCAGTGTC TGGGGCCCCAGGACAGAAGGTCACCATCTCCT GCTCTGGAAGCAGCTCCAACATTGGGAGTAAT TATGTTTCCTGGTACCAACAGCTCCCAGGAAC AGCCCCCAAAGTCCTCATTTATGACAATATA AGGGACCCTCAGGGATTCCTGACCGATTCTCT GGCTCCAAGTCTGGCACGTCAGCCACCCTGG CATCACCGGACTCCAGACTGGGGACGAGGCC GATTATTACTGCGGAACATGGGATAGCAGACT GAATGTTGGGGTATTCGGCGGAGGGACCAAG CTGACCGTCCTA<br>SEQ ID NO: 27597 | CAGGTGCAGCTGGTGGAGTCTGGGGGAGGCGTG GTCCAGCCTGGGAGGTCCCTGAGACTCTCCTGTG CAGCCTCTGGATTCACCTTCAGAAGCTATGGCAT GCATTGGGTCCGCCAGGCTCCAGGCAAGGGGCT GGAGTGGGTGGCAGTTATAATATGATGGAAGT TATAAGTACTACTGCAGACTCCGTGAAGGGCCGAT TCACCATCTCAGAGACAATTCCAAGAACACGCT GTATCTGCAAATGAACAGCTGAGAGCTGAGGA CACGGCTGTGTATTACTGTGCGAGAACGTATAGC GGGGGTATGGACGTCTGGGGCCAAGGGACCACG GTCACCGTCTCCTCA<br>SEQ ID NO: 31603 |
| | | AA | QSVLTQPPSVSAAPGQKVTISCSGSSSNIGSNYVS WYQQLPGTAPKVLIYDNNKRPSGIPDRFSGSKSG TSATLGITGLQTGDEADYYCGTWDSRLNVGVFG GGTKLTVL<br>SEQ ID NO: 27598 | QVQLVESGGGVVQPGRSLRLSCAASGFTFRSYGMH WVRQAPGKGLEWVAVIIYDGSYKYYADSVKGRFT ISRDNSKNTLYLQMNSLRAEDTAVYYCARTYSGG MDVWGQGTTVTVSS<br>SEQ ID NO: 31604 |

FIGURE 50
(Continued)

| | | | |
|---|---|---|---|
| iPS:436962 | 21-225_190H1 | NA | TCCTATGAGTTGACTCAGCCACCTCAGTGTCCGTGTCCCCAGGACAGACAGCCAGCATCACCTGCTCTGGAGATAAATTGGGGACAGATTTGCTTACTGGTATCAGCAGAAGCCAGGCCAGTCCCCTGTACTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAAGGCGTGGGACAGCAGCACTGTGGTATTCGGCGGAGGGACCAAGCTGACCGTCCTA SEQ ID NO: 27599 | CAGGTACAGCTGCAGCAGTCAGGTCCAGGACTGGTGAAGCCCTCGCAGACCCTCACTCTGTGACATCTCCGGGGACCAGTGTCTCTAGGAAAGTGCTACTTGGAACTGGATCAGCAGTCCCATCGAGAGGCCTTGAGTGGCTGGGAAAGACATACTACAGGTCCAAGTGGTATAATGATTATGCAGTATCTGTGAAAAGTCGAATAACCATCAATCAGACACATCCAAGAACCAGTTCTCCCTGCAATTGAACTCTGTGACTCCCGAGGACACGGCTGTGTATTACTGTGCAAGAGATCCGGGTGGCCTCTTTGACTACTGGGGCCAGGGAACCCTGGTCACCGTCCTCA SEQ ID NO: 31605 |
| | | AA | SYELTQPPSVSVSPGQTASITCSGDKLGDRFAYWYQQKPGQSPVLVIYQDSKRPSGIPERFSGSNSGNTATLTISGTQAMDEADYYCKAWDSSTVVFGGGTKLTVL SEQ ID NO: 27600 | QVQLQQSGPGLVKPSQTLSLTCDISGDSVSRKSATWNWIRQSPSRGLEWLGKTYYRSKWYNDYAVSVKSRITINPDTSKNQFSLQLNSVTPEDTAVYYCARDPGGLFDYWGQGTLVTVSS SEQ ID NO: 31606 |
| iPS:436964 | 21-225_190B3 | NA | TCTTCTGAGCTGACTCAGGACCCTGCTGTCTGTGGCCTTGGGACAGACAGTCAGGATCACATGCCAAGGAGACAAAACTCAGAAGCTCAGAGTGCAAGCTGGTACCAGCAGAAGCCAGGACAGGCCCTGTACTTGTCGTCTATGGAAAAACAACCGGCCCTCAGGGATCCCAGACCGATTCTCTGGCTCCAGCTCAGGAAACACAGCTTCCTTGACCATCACTGGGGCTCAGGCGGAAGATGAGGCTGACTATTACTGTAACTCCCGGGACAGCAGTGTAACCATCTTGTACTATTGGCGGGACAGGGACCAAGCTGACCGTCCTA SEQ ID NO: 27601 | CAGGTGCAGCTGGTGGAATCTGGGGGAGGCGTGGTCCAGCCTGGGAGGTCCCTGAGACTCTCCTGTGCAGCGTCTGGATTCACCTTCACCTAACTATGGCATACACTGGGTCCGCCAGGCTCCAGGCAAGGGCTGGAGTGGGTGGCAGTTATATGTCCGTGAAGGCCGAATAAATACTACAGACTCCGTGAAGGGCCGATTCACCATCTCCAGAGACAATTCCAAGAACACGCTGTATCTGCAAATGAACAGCCTGAGAGCCGAAGACACGGCTGTGTATTACTGTGCGAGAGATAACTGGAACTACGGCGATCACTACTACTTCGGTATGGACGTCTGGGGCCAAGGGACCACGGTCACCGTCTCCTCA SEQ ID NO: 31607 |

FIGURE 50
(Continued)

| | | | |
|---|---|---|---|
| | | AA | SSELTQDPAVSVALGQTVRITCQGDKLRTYYAS WYQQKPGQAPVLVVYGKNNRPSGIPDRFSGSSS GNTASLTITGAQAEDEADYCNSRDSSGNHLVL FGGGTKLTVL | QVQLVESGGGVVQPGRSLRLSCAASGFTFNNYGIH WVRQAPGKGLEWVAVIWFDGDNKYYADSVKGRF TISRDNSKNTLYLQMNSLRAEDTAVYYCARDNWN YGDHYYFGMDVWGQGTTVTVSS |
| | | | SEQ ID NO: 27602 | SEQ ID NO: 31608 |
| iPS:436966 | 21-225_190C3 | NA | CAGTCTGTGTTGACGCAGCCGCCCTCAGTGTC TGGGGCCCCAGGACAGAAGGTCACCATCTCCT GCTCTGAAGCAGTCCAACATTGGAAATAAT TATGTATCCTGGTACCAGCAGCTCCCAGGAAC AGCCCCCAAACTCCTCCTTTATGACAGTAATA AGCGACCCTCAGGGATTCCTGGCCGATTCTCT GGCTCCAAGTCTGGCACGTCAGCCACCCTGG CATCACCGGCCTCCAGACTGGGGACCAGCCTG ATTATTACTGCGGAACATGGGATAGCAGCCTA AGTACTGTGGTATTTCGGCGGAGGGACCAAGCT GACCGTCCTA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCCAGACTGGTACTA CTACTACGGTATGGACGTCTGGGGCCAAGGG ACCACGGTCACCGTCTCCTCA |
| | | | SEQ ID NO: 27603 | SEQ ID NO: 31609 |
| | | AA | QSVLTQPPSVSAAPGQKVTISCSGSSSNIGNNYVS WYQQLPGTAPKLLLYDSNKRPSGIPGRFSGSKSG TSATLGITGLQTGDEADYYCGTWDSSLSTVVFG GGTKLTVL | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYYCANWYYY YYGMDVWGQGTTVTVSS |
| | | | SEQ ID NO: 27604 | SEQ ID NO: 31610 |

FIGURE 50
(Continued)

| | | | |
|---|---|---|---|
| iPS:436968 | 21-225_190B10 | NA | CAGTCTGTGTTGACGCAGCCGCCCTCAGTGTC TGCGGCCCAGGACAGACAGTCCAACATTGGAATAAT GCTCTGGAATCCTGGTACCAGCATCTCCCAGAAC TATGTATCCTGGTACCAGCATCTCCCAGAAC AGCCCCAAACTCCTCATTTATGACAATAATA AGGGACCCTCAGGGATTCCTGACCGATTCTCT GGCTCCAAGTCTGGCAGTCAGCCACCCTGGG CATCACCGGACTCCAGACTGGGGACGAGGCC GATTATTACTGCGGAACATGGGATAGCAGCCT GAGTGCTGGGGTTTTCGGCGGAGGGACCAAGC TGACCGTCCTA SEQ ID NO: 27605 | CAGGTGCAGCTGGTGGAGTCTGGGGGAGGCGTG GTCCAGCCTGGGAGGTCCCTGAGACTCTCCTGTG TAGCCGTCTGGATTCACCTTCAGTAGTAGTATGCAT GCACTGGGTCCGCCAGGCTCCAGGCAAGGGCT GGAGTGGGTGGCAGTTATATGAGACTCGTGAAGGGCCG TAAAAATACCATCTCCAGAGACAATTCCAAGAACACG ATTTACCATCTCCAGAGACAATTCCAAGAACACG CTGTATCTGCAAATGAACAGCCTGAGAGCCGAG GACACGGCTCTGTATTACTGTGCGAGAGATCTGG ATAAGAGAACTTCCTTATTACTACTACTACGG TATGGACGTCTGGGGCCAAGGGACCACGGTCAC CGTCTCCTCA SEQ ID NO: 31611 |
| | | AA | QSVLTQPPSVSAAPGQKVTISCSGSSSNIGNNYVS WYQHLPGTAPKLLIYDNNKRPSGIPDRFSGSKSG TSATLGITGLQTGDEADYYCGTWDSSLSAGVFG GGTKLTVL SEQ ID NO: 27606 | QVQLVESGGGVVQPGRSLRLSCVASGFTFSSYGMH WVRQAPGKGLEWVAVIWNDGSKKYHVDSVKGRF TISRDNSKNTLYLQMNSLRAEDTALYYCARDLDKR NFPYYYYGMDVWGQGTTVTVSS SEQ ID NO: 31612 |
| iPS:436970 | 21-225_190B8 | NA | TCTTCTGAGCTGACTCAGGACCCTGCTGTGTCT GTGGCCTTGGGACAGACAGTCAGATCAGATCACATG CCAAGGAGACACCCTCAGAGCCTATTATGTAA GCTGGTACCAGCAGAAGCCAGGACAGGCCC TGTACTTGTCATCTATGGTAAAAACAACCGGC CCTCAGGGATCCCAGACCGATTCTCTGGCTCC AGCTCAGGAAACACAGCTTCCTTGACCATCAC TGGGGCTCAGGCGGAAGATGAGGCTGACTATT ACTGTAACTCCCGGGACAGCAGCAGTGGTAACCAT CTTGTGGTATTCGGCGGAGGGACCAAGCTGAC CGTCCTA SEQ ID NO: 27607 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGTAGTATGGCAT GCACTGGGTCCGCCAGGCTCCAGGCAAGGGCT GGAGTGGGTGGCAGTTATATGTTGATGGAAGT AATAAATACTATACAGACTCCGTGAAGGGCCGA TTCACCATCTCCAGAGACAATTCCAAGAACAGC TGTATCTGCAAATGAACCTGAGAGCCGAGG ACACGGCTGTATATTATTGTGCGAGAGATAACTG GAACTACGGCGATTACTACTACTACGGTATG GACGTCTGGGGCCAAGGGACCACGGTCACCGTC TCCTCA SEQ ID NO: 31613 |

FIGURE 50
(Continued)

| | | | |
|---|---|---|---|
| iPS:436972 | 21-225_190C7 | AA | SSELTQDPAVSVALGQTVRITCQGDTLRPYYVSWYQQKPGQAPVLVIYGKNNRPSGIPDRFSGSSSGNTASLTITGAQAEDEADYYCNSRDSSGNHLVVFGGGTKLTVL | QVQLVESGGGVVQPGRSLRLSCAASGFTFSSYGMHWVRQAPGKGLEWVAVIWFDGSNKYYTDSVKGRFTISRDNSKNTLYLQMNSLRAEDTAVYYCARDNWNYGDYYYYGMDVWGQGTTVTVSS |
| | | | SEQ ID NO: 27608 | SEQ ID NO: 31614 |
| | | NA | CAGTCTGTGTTGACGCAGCCGCCCTCAGTGTCTGCGGGCCCCAGGACAGAAGGTCACCATCCTGCTCTGCAGGCAGTCCAACATTGGGAATAATTATGTATCCTGGTTTCAGCAGTCCCAGGAACAGCCCCCAAATTCTCATTATGACAATAATAAGCGACCCTCAGGGATTCCTGACCGATTCTCTGGCTCCAAGTCTGGCACGTCAGCCACCCTGGGCATCACCGGACTCCAGACATGGGATCGGAGGCCGATTATTACTGCGGAACATGGGATCGGGGGAGGACCAAGCTGACCGTCCTA | CAGGTGCAGCTGGTGCAGTCTGGGGCTGAGGTGAAGAAGCCTGGGGCCTCAGTGAAGGTCTCCTGCAAGGCTTCTGATACACCTTCACCGGCTACTATATGCACTGGGTGCGACAGGCCCCTGGACAAGGGCTTGAGTGGATGGGATGGATCAACCTAACAGTGGTGGCACAAACTATGCACAGAAGTTTCAGGGCAGGGTCACCATGACCAGGGACACGTCCATCAGCACAGCCTACATGGAACTGAGCAGGCTGAGATCTGACGACGTCCGTGTATTACTGTGCGAGAGATAGAGCAGTGGCTGGAAACTACTTCTACTACGGTATGGACGTCTGGGGCCAAGGGACCACGGTCACCGTCTCCTCA |
| | | | SEQ ID NO: 27609 | SEQ ID NO: 31615 |
| | | AA | QSVLTQPPSVSAAPGQKVTISCSGGSSNIGNNYVSWFQQFPGTAPKFLIYDNNKRPSGSKSGTSATLGITGLQTGDEADYCGTWDRTLSDWVFGGGTKLTVL | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDRAVAGNYFYFGMDVWGQGTTVTVSS |
| | | | SEQ ID NO: 27610 | SEQ ID NO: 31616 |

FIGURE 50
(Continued)

| | | | | |
|---|---|---|---|---|
| iPS:436974 | 21-225_190H7 | NA | CAGTCTGTGTTGACGCAGCCGCCCTCAGTGTCTGCGGCCCCAGGACAGAAGGTCACCATCTCCTGCTCTGGAAGCAGCTCCAACATTGGGAGTAATTATGTTTCCTGGTACCAACAGCTCCCAGGAACAGCCCCCAAAGTCCTCATTTATGACAATAATAAGCGACCCTCAGGGATTCCTGACCGATTCTCTGGCTCCAAGTCTGGCACGTCAGCCACCCTGGGCATCACCGGACTCCAGACTGGGGACGAGGCCGATTATTACTGCGAACATGGGATGCAGACTGAATGTTGGGGTATTCGGCGGAGGGACCAAGCTGACCGTCCTA<br>SEQ ID NO: 27611 | CAGGTGCAGCTGGTGGAGTCTGGGGGAGGCGTGGTCCAGCCTGGGAGGTCCCTGAGACTCTCCTGTGCAGCCTCTGGATTCAACTTCAGAAGCTATGGCATGCATTGGGTCCGCCAGGCTCCAGGCAAGGGGCTGGAGTGGGTGGCAGTTATATATATGGAAGTTATAAGTACTATGCAGACTCCGTGAAGGGCCGATTCACCATCTCCAGAGACAATTCCAAGAACACGCTGTATCTGCAAATGAACAGCCTGAGAGCTGAGGACACGGGGGTATGGACGTCTGGGGCCAAGGGACCACGGTCACCGTCTCCTCA<br>SEQ ID NO: 31617 |
| | | AA | QSVLTQPPSVSAAPGQKVTISCSGSSSNIGSNYVSWYQQLPGTAPKVLIYDNNKRPSGIPDRFSGSKSGTSATLGITGLQTGDEADYYCGTWDGRLNVGVFGGGTKLTVL<br>SEQ ID NO: 27612 | QVQLVESGGGVVQPGRSLRLSCAASGFNFRSYGMHWVRQAPGKGLEWVAVIYDGSYKYYADSVKGRFTISRDNSKNTLYLQMNSLRAEDTAVYYCARTYSGGMDVWGQGTTVTVSS<br>SEQ ID NO: 31618 |
| iPS:436976 | 21-225_190D8 | NA | CAGTCTGTGTTGACGCAGCCGCCCTCAGTGTCTGCGGCCCCAGGACAGAAGGTCACCATCTCCTGCTCTGGAAGCAGCTCCAACATTGGGAATCATTATGTCTCCTGGTACCAGCAGCTTCCAGGAACAGCCCCCAAACTCCTCATTTATGACAGTAGTAAGCGACCCTCAGAGATTCCTGACCGATTCTCTGGCTCCAAGTCTGGCACGTCCGCCACCCTGGGCATCACCGGACTCCAGACTGGGGACGAGGCCGATTATTACTGCGAACATGGGATAGTGTCTGAGTACTGTGGTATTCGGCGGAGGGACCAAGCTGACCGTCCTA<br>SEQ ID NO: 27613 | CAGGTGCAGCTGGTGGAGTCTGGGGGAGACGTGGTCCAGCCTGGAAGGTCCCTGAGACTCTCCTGTAAGCGTCTGGATTCACCTTCAGTAGCTATGGCCTGCACTGGGTCCGCCAGGCTCCCGGCAAGGGACTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGACACGGCTGTGTATTACTGTGCGAACCTGAACCTGTACTACTACTACGGTATGGACGTCTGGGGCCAAGGGACCACGGTCACCGTCTCCTCA<br>SEQ ID NO: 31619 |

FIGURE 50
(Continued)

| | | | | |
|---|---|---|---|---|
| iPS:436978 | 21-225_190G9 | AA | QSVLTQPPSVSAAPGQKVTISCSGSSSNIGNHYVS WYQQLPGTAPKLLIYDSSKRPSGSKSGT SATLGITGLQTGDEADYYCGTWDSSLSTVVFGG GTKLTVL | QVQLVESGGDVVQPGRSLRLSCEASGFTFSSYGLH WVRQAPGKGLEWVAVIWYDGSNKYYADSVKGRF TISRDNSKNTLYLQMNSLRAEDTAVYYCANWYYY YYGMDVWGQGTTVTVSS |
| | | | SEQ ID NO: 27614 | SEQ ID NO: 31620 |
| | | NA | TCCTATGAGCTGACTCAGCCACCCTCAGTGTC CGTGTCCCCAGGACAGACAGCCAGCATCACCT GCTCTCTGAGATAAATTGGGGATAGATTTGCT TACTGGTATCAGCAGAAGCCAGGCCAGTCCCC TGTGCTGGTCATCTATCAAGATAACAAGCGGC CCTCAGGGATCCCTGAGCGATTCTCTGGCTCC AACTCTGGGAACACAGCCTCTGATGAGGCTGACTATT CGGGACCCAGGCTATGGGACAGCAGCACTGTGGTA ACTGTCAGGGCGTGGGACAGCAGCACTGTGGTA TTCGGCGGAGGGACCAGGCTGACCGTCCTA | CAGGTACAGTTGCAGCAGTCAGGACTG GTGAAGCCCTGCAGACCCTCACTCACCTGTG CCATCTCCGGGGACAGTGTCTCTAGGAAAGTGC TACTTGGAACTGGATCAGGCAGTCCCATCGAGA GGCCTTGAGTGGCTGGGAAGGACATACTACAGG TCCAAGTGGTATAATGATTATGCAGTATCTGTGA AAAGTCGAATAATCATCAATCCAGACACATCCA AGAACCAGTTCTCCCTGCAGCTGAACTCTGTGAC TCCCGAGGACACGGCTGTGTATTACTGTGCAAGA GATCCGGGTGGCCTCTTTGACTACTGGGGCCAGG GAACCCTGGTCACCGTCTCCTCA |
| | | | SEQ ID NO: 27615 | SEQ ID NO: 31621 |
| | | AA | SYELTQPPSVSVSPGQTASITCSGDKLGDRFAYW YQQKPGQSPVLVIYQDNKRPSGIPERFSGSNSGN TASLTISGTQAMDEADYYCQAWDSSTVVFGGG TRLTVL | QVQLQQSGPGLVKPSQTLSLTCAISGDSVSRKSAT WNWIRQSPSRGLEWLGRTYYRSKWYNDYAVSVK SRIHNPDTSKNQFSLQLNSVTPEDTAVYYCARDPGG LFDYWGQGTLVTVSS |
| | | | SEQ ID NO: 27616 | SEQ ID NO: 31622 |

FIGURE 50
(Continued)

| | | | |
|---|---|---|---|
| iPS:436980 | 21-225_190C10 | NA | TCTTCTGAGCTGACTCAGGACCCTGCTGTCT<br>GTGGCCTTGGGACAGACAGTCAGATCACATG<br>CCAAGGAGACAGCCTCAGACCCTATTATGCAA<br>GCTGGTACCAGCAGCAGAAGCCAGGACAGCCC<br>TGTACTTGTCATCTATGGTAAAACAACCGGC<br>CCTCAGGGATCCCAGACCGATTCTCTGGCTCC<br>AGTTCAGGAAACAACAGCTTCCTGACCATCAC<br>TGAGGCTCAGGCGGAAGATGAGGCTGACTATT<br>ACTGTAACTCCCGGGACAGCAGTGGTAACCAT<br>CTTGTGGTATTCGGCGGAGGGACCAAGCTGAC<br>CGTCCTA | CAGGTGCAGCTGGTGGAGTCTGGGGGAGGCGTG<br>GTCCAGCCTGGGAGGTCCCTGAGACTCTCCTGTG<br>CAGCGTCTGGATTCACCCTCAGTAACTATGGCAT<br>GCACTGGGTCCGCCAGGCTCCAGGCAAGGGGCT<br>GGAGTGGGTGGCAGTTATATGGTTTGGTGGAGAT<br>AATAAATACTATGCAGACTCCGTGAGGGGCCGA<br>TTCACCATCTCCAGAGACAATTCCAAGAACACGC<br>TGTATCTGCAAATGAACAGCCTGAGAGCCGAGG<br>ACACGGCTGTGTTTTACTGTGCAGAGATAACTG<br>GAACTACGGCGATCACTACTATTACGGAATG<br>GACGTCTGGGGCCAAGGGACCACGGTCACCGTC<br>TCCTCA |
| | | | SEQ ID NO: 27617 | SEQ ID NO: 31623 |
| | | AA | SSELTQDPAVSVALGQTVRITCQGDSLRPYYAS<br>WYQQKPGQAPVLVIYGKNNRPSGIPDRFSGSSSG<br>NTASLTITEAQAEDEADYYCNSRDSSGNHLVF<br>GGGTKLTVL | QVQLVESGGGVVQPGRSLRLSCAASGFTLSNYGM<br>HWVRQAPGKGLEWVAVIWFGGDNKYYADSVRGR<br>FTISRDNSKNTLYLQMNSLRAEDTAVFYCARDNW<br>NYGDHYYYGMDVWGQGTTVTVSS |
| | | | SEQ ID NO: 27618 | SEQ ID NO: 31624 |
| iPS:436982 | 21-225_190D10 | NA | CAGTCTGTGTTGACGCAGCCGCCCTCAGTGTC<br>TGCGGGCCCCAGGACAGAAGGTCACCATCTCCT<br>GCTCTGGAAGCAGCTCCAACATTGGGAGTAAT<br>TATGTTTCCTGGTACCAACAGCTCCCAGGAAC<br>AGTCCCAAAGTCCTCATTTATGACAATAATA<br>AGCGACCCTCAGGGATTCCTGACCGATTCTCT<br>GGCTCCAAGTCTGGCACGTCAGCCACCCTGGG<br>CATCACCGGACTCCAGACTGGGGACGAGGCC<br>GATTATTACTGCGAACATGGGGGAGGGACACT<br>GAATGTTGGGTATTCGGCGGAGGGACCAAG<br>CTGACCGTCCTA | CAGGTGCAGCTGGTGGAGTCTGGGGGAGGCGTG<br>GTCCAGCCTGGGAGGTCCCTGAGACTCTCCTGTG<br>CAGCCTCTGGATTCACCTTCAGAAGCTATGGCAT<br>GCATTGGGTCCGCCAGGCTCCAGGCAAGGGGCT<br>GGAGTGGGTGGCAGTTATAATATGATGGAAGT<br>TATAAGTACTATGCAGAGACTCCGTGAAGGGCCGAT<br>TCACCATCTCCAGAGACAATTCCAAGAACACGCT<br>GTATCTGCAAATGAACAGCCTGAGAGCTGAGGA<br>CACGGCTGTATTACTGTGCGAGAACGTATAGC<br>GGGGTATGACGTCTGGGGCCAAGGGACCACG<br>GTCACCGTCTCCTCA |
| | | | SEQ ID NO: 27619 | SEQ ID NO: 31625 |

FIGURE 50
(Continued)

| | | | | |
|---|---|---|---|---|
| iPS:436984 | 21-225_190F10 | AA | QSVLTQPPSVSAAPGQKVTISCSGSSSNIGSNYVS WYQQLPGTVPKVLIYDNNKRPSGIPDRFSGSKSG TSATLGITGLQTGDEADYYCGTWDSRLNVGVFG GGTKLTVL | QVQLVESGGGVVQPGRSLRLSCAASGFTFRSYGMH WVRQAPGKGLEWVAVIIYDGSYKYYADSVKGRFT ISRDNSKNTLYLQMNSLRAEDTAVYYCARTYSGG MDVWGQGTTVTVSS |
| | | | SEQ ID NO: 27620 | SEQ ID NO: 31626 |
| | | NA | CAGACTGTGGTGACTCAGGAGCCCTCACTGAC TGTGTCCCCAGGAGGGACAGTCACTCTCACTT GTGTTTTTAGCACTGGAGCAGTCACCAGTGGT TCCTTTCCAAACTGGTTCCAGCAGAAACTGG ACAAGCACCCAGGGCACTGATTTATAGTACAA GCAACAAACACTCCTGGACCCTGCCCGGTTC TCAGGCTCCCTCCCTGGGGCAAAGCTGCCCT GACACTGTCAGGTGTGCAGCCTGAGGACGAG GCTGACTATTACTGCCTGCTCTACTGTGGTGGT GCTCAGTGGTGTTCGGCGGAGGGACCAAGCT GACCGTCCTA | CAGGTGCAGCTGCAGGAGTCGGGCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGGA GGGCTGGAGTGGATTGGGTACATCTATTACAGT GGGATCACCTACTACAATCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATAGC AGTCGCGGGGTATGGACGTCTGGGGCCAAGGG ACCACGGTCACCGTCTCCTCA |
| | | | SEQ ID NO: 27621 | SEQ ID NO: 31627 |
| | | AA | QTVVTQEPSLTVSPGGTVTLTCVFSTGAVTSGSF PNWFQQKPGQAPRALIYSTSNKHSWTPARFSGS LLGGKAALTLSGVQPEDEADYYCLLYCGGAQL VFGGGTKLTVL | QVQLQESGPGLVKPSQTLSLTCTVSGGSIRSGGDY WSWIRQHPGEGLEWIGYIYYSGITYYNPSLKSRVTI SVDTSKNQFSLKLSSVTAADTAVYYCARDSSSRGM DVWGQGTTVTVSS |
| | | | SEQ ID NO: 27622 | SEQ ID NO: 31628 |

FIGURE 50
(Continued)

| | | | |
|---|---|---|---|
| iPS:436986 | 21-225_191A1 | NA | CAGTCTGTGTTGACGCAGCCGCCCTCAGTGTC TGCGGCCCAGGACAGCAGTCCAACCTGGTCAC CATCCCTGCTCTGGAAGCAGCTCCAACAGTTC CAGGACTCCAGGAACTTTGTATCCTGGTACCA GCAGTCCAGGAACAGCCCCAAACTCTCATTT ATGACAATTATAAGGGACCCTCAGGGATTCCT GACCGATTCTCTGTCTCCAAGTCTGGCACGTC AGCACCTGGGACTGGGACCCATCACCGGACT CCAGAACTGGCGGAACATGGGGATAGCAGCC TGATTATTACTGCGGAACATGGGATAGCAGCCT GAATACTGGGGTATTCGGCGGAGGGACCAAG CTGACCGTCCTA<br><br>SEQ ID NO: 27623 | CAGGTGCAGCTGCAGGAGTCGGGCCCAGGACTG GTGAAGCCTTCGGAGACCCTGTCCCTCACCTGCA CTGTCTCTGGTGGCTCCATCAGAAGTTACTACTG GATCTGGATCCGGCAGCCCCAGGGAAGGACT GGAGTGGATTGGGTATATCTATTACAGTGGAGT ACTAAGTACAAACCCTCCCTCAAGAGTCGAGTCA CCATATCAGTAGACACGTCCAAGAACCAGTTCTC CCTGAAACTGAGCTCTGTGACCGCTGCGGACACG GCCGTGTATTACTGTGCGAGAAAGGGAGTGGGA ACCATCACTTTGACTACTGGGGCCAGGGAACCC TGGTCACCGTCTCCTCA<br><br>SEQ ID NO: 31629 |
| | | AA | QSVLTQPPSVSAAPGQRVTISCSGSSSNLGNNFV SWYQQFPGTAPKLLIYDNYKRPSGIPDRFSVSKS GTSATLGITGLQTGDEADYYCGTWDSSLNTGVF GGGTKLTVL<br><br>SEQ ID NO: 27624 | QVQLQESGPGLVKPSETLSLTCTVSGGSIRSYYWIW IRQPPGKGLEWIGYIYYSGSTKYNPSLKSRVTISVDT SKNQFSLKLSSVTAADTAVYYCARKGVGTIHFDY WGQGTLVTVSS<br><br>SEQ ID NO: 31630 |
| iPS:436988 | 21-225_191A2 | NA | CAGACTGTGGTGACTCAGGAGTCCACTGAC TGTGTCCCCAGGAGGACAGTCACTCTCACTT GTGTTCTTAGCACTGGAGACTGGGTCACCAGTGGT TCCTTTCCAAACTGGTTCCAGCAGAAACTGG ACAAGCACCCAGGGCACTGATTTATAGTACAA GCAACAAACACTCCTGACCTGTCCCCGTTT TCAGGCTCCCTCGGGGGCAAAGCTGCCCT GACACTGTCAGGTGTGCAGCTGAGGACGAG GCTGACTATTACTGCATGTCTCTACTGTGGTGT GCTCAGCTGGTTCGGCGGAGGGACCAAGCT GACCGTCCTA<br><br>SEQ ID NO: 27625 | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGAA GGGCTGGAGTGGATTGGATACATCTATTACAGT GGGATCACCTACTACAATCCGTCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATAGC AGCTGGCGGGGTATGGACGTCTGGGGCCAAGG ACCACGGTCACCGTCCTCA<br><br>SEQ ID NO: 31631 |

FIGURE 50
(Continued)

| | | | |
|---|---|---|---|
| | | AA | QTVVTQEPSLTVSPGTVTLTCVLSTGAVTSGSFPNWFQQKPGQAPRALIYSTSNKHSWTPARFSGSLLGGKAALTLSGVQPEDEADYYCMLYCGGAQLVFGGGTKLTVL<br>SEQ ID NO: 27626 | QVQLQESGPGLVKPSQTLSLTCTVSGGSIRSGGDYWSWIRQHPGEGLEWIGYIYYSGITYYNPSLKSRVTISVDTSKNQFSLKLSSVTAADTAVYYCARDSSSRGMDVWGQGTTVTVSS<br>SEQ ID NO: 31632 |
| iPS:436992 | 21-225_191B8 | NA | TCTTCTGAGCTGACTCAGGACCCTGCTGTGTCTGTGGCCTTGGGACAGACAGTCAGGATCACATGCCAAGGAGACACCCTCAGACCCTATTATGCAAGTTGGTACCAGCAGAAGCCAGGACAGGCCCCTGTACTTGTCATCTATGGTAAAAACAACGGCCCTCAGGGATCTCAGACCGATTCTCTGGCTCAGCTCAGGAAACACAGCTTCCTTGACCATCACTGGGGCTCAGGCGGAAGATGAGGCTGACTATTACTGTAACTCCCGGACAGCAGTGGTAACCATCTTGTGGTATTCGGCGGAGGGACCAAGCTGACCGTCCTA<br>SEQ ID NO: 27627 | CAGGTGCAGCTGGTGGAGTCTGGGGGAGGCGTGGTCCAGCCTGGGAGGTCCCTGAGACTCTCCTGTGCAGCGTCTGGATTCACCCTCAGTAGCTATGGCATGCACTGGGTCCGCCAGGCTCCAGGCAAGGGCTGGAGTGGGTGGCAGTTATATGGTTTGATGAAGTAATAAATACTATGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAGATAACTGGAACTACGGCGATCACTACTACTACTACGGTATGGACGTCTGGGGCCAAGGGACCACGGTCACCGTCTCCTCA<br>SEQ ID NO: 31633 |
| | | AA | SSELTQDPAVSVALGQTVRITCQGDTLRPYYASWYQQKPGQAPVLVIYGKNNRPSGISDRFSGSSSGNTASLTITGAQAEDEADYYCNSRDSSGNHLVVFGGGTKLTVL<br>SEQ ID NO: 27628 | QVQLVESGGGVVQPGRSLRLSCAASGFTLSSYGMHWVRQAPKGLEWVAVIWFDGSNKYYADSVKGRFTISRDNSKNTLYLQMNSLRAEDTAVYYCARDNWNYGDHYYYGMDVWGQGTTVTVSS<br>SEQ ID NO: 31634 |

FIGURE 50
(Continued)

| | | | |
|---|---|---|---|
| iPS:436994 | 21-225_191A9 | NA | TCTTCTCTGAGCTGACTCAGGACCCTGCTGTCT GTGGCCTTGGGACAGAGACAGTCAGGATCACATG CCAAGGAGACAGCCTCAGACCCTATTATGCAA GCTGGTACCAGCAGAAGCCAGGACAGGCCCC TGTACTTGTCATCTATGGTAAAAACAACCGGC CCTCAGGGATCCCAGACCGATTCTCTGGCTCC AGCTCAGGAAACACAGCTTCCTTGACCATCAC TGAGGCTCAGGCGGGAAGATGAGGCTGACTATT ACTGTAACTCCCGGGACAGTGTGTAACCAT CTTGTGTATTCGGCGGAGGGACCAAGCTGAC CGTCCTA<br><br>SEQ ID NO: 27629 | CAGGTGCAGCTGGTGGAGTCTGGGGGAGGCGTG GTCCAGCCTGGGAGGTCCCTGAGACTCTCCTGTG CAGCGTCTGGATTCACCCTCAGTATTATGGCAT GCACTGGGTCCGCCAGGCTCCAGGCAAGGGCT GGAGTGGGTGGCAGTTATATGGTTTGGTGGAGAT AATAAATACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTTTTACTGTGCAGAGATAACTG GAACTACGGCGATCACTACTATTACGGTATG GACGTCTGGGGCCAAGGGACCACGGTCACCGTC TCCTCA<br><br>SEQ ID NO: 31635 |
| | | AA | SSELTQDPAVSVALGQTVRITCQGDSLRPYYAS WYQQKPGQAPVLVIYGKNNRPSGIPDRFSGSSSG NTASLTITEAQAEDEADYYCNSRDSCGNHLVF GGGTKLTVL<br><br>SEQ ID NO: 27630 | QVQLVESGGGVVQPGRSLRLSCAASGFTLSNYGM HWVRQAPGKGLEWVAVIWFGGDNKYYADSVKGR FTISRDNSKNTLYLQMNSLRAEDTAVFYCARDNW NYGDHYYYGMDVWGQGTTVTVSS<br><br>SEQ ID NO: 31636 |
| iPS:436996 | 21-225_191B9 | NA | CAGTCTGTGTTGACGCAGCCGCCCTCAGTGTC TGCGGCCCCAGGACAGAAGGTCACCATCTCCT GCTCTGGAAGCAGCTCCAACATCGGAATAAT TATGTATCCTGGTACCAGCAGCTCCCAGGAAC AGCCCCCAAACTCCTCATTTATGACAATAAAA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGAACATGGGATAGCAGCCT GAGTGGCTTTTGTGTTCGGAACTGGGACCAAGG TCACCGTCCTA<br><br>SEQ ID NO: 27631 | CAGGTGCAGCTGGTGGAGTCTGGGGGAGGCGTG GTCCAGCCTGGGAGGTCCCTGAGACTCTCCTGTG CAGCGTCTGGATTCACCTTCAGTTCCATGGCAT GCACTGGGTCCGCCAGGCTCCAGGCAAGGGCT GGAGTGGGTGGCAGTTATATGTGATGAAGT AAAAATACTATGCAGACTCCGTGAAGGGCCGA TTCACCATCTCCAGAGACAATTCCAAGAACACGC TGCATCTGCAAATGAACAGTCTGAGAGCCGAGG ACACGGCTGTATTACTGTGCGAAAAGGGTA TAGCAGTGGCTTTTACAGGGGGTTTGACAACTGG GGCCAAGGGAACCCTGGTCACCGTCTCCTCA<br><br>SEQ ID NO: 31637 |

FIGURE 50
(Continued)

| | | | |
|---|---|---|---|
| iPS:437000 | 21-225_191G9 | AA | QSVLTQPPSVSAAPGQKVTISCSGSSSNIGNNYVS WYQQLPGTAPKLLIYDNKKRPSGIPDRFSGSKSG TSATLGITGLQTGDEADYYCGTWDSSLSVCVFG TGTKVTVL<br>SEQ ID NO: 27632 | QVQLVESGGGVVQPGRSLRLSCAASGFTFSFHGMH WVRQAPGKGLEWVAVIWYDGSKKYYADSVKGRF TISRDNSKNTLHLQMNSLRAEDTAVYYCAKEGYSS GFYRGFDNWGQGTLVTVSS<br>SEQ ID NO: 31638 |
| | | NA | CAGGCTGTGTGTCGACTCGGCCGTCTTCCCTCTCT GCATCTCCTGGAGCATCAGCCAGTCTCACCTG CACCTTACGCAGTGGCATCAATGTTGGTACCT ACAGGATATACTGGTACCAGCAGAAGCCAGG GAGTCCTCCCAGTATCTCCTGAGGTACAAAT CAGACTCAGATAAGCAGCAGGCTCTGGAGTC CCCAGCCGCTTCTCTGGATCCAAAGATGCTTC GGCCAATGCAGGGATTTTACTCATCTCTGGGC TCCAGTCTGAGGATGAGGCTGACTATTACTGT ATGATTTGGCACACAGCGCGTGTGGTATTCGG CGGAGGGACCAAGCTGACCGTCCTA<br>SEQ ID NO: 27633 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCAGTTACCTGCAT GCACTGGGTCCGCCAGGCTCCAGCAAGGGCT GGAGTGGGTGACACTTATATGGTTTGATGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGCTGTGTATTACTGTGCGAGAGATCGGGT GGGAGGTACTAGTCCTCCTTACTACTACTAC GGTATGGACGTCTGGGGCCAAGGGACCACGGTC ACCGTCTCCTCA<br>SEQ ID NO: 31639 |
| | | AA | QAVSTRPSSLSASPGASASLTCTLRSGINVGTYRI YWYQQKPGSPPQYLLRYKSDSDKQQGSGVPSRF SGSKDASANAGILLISGLQSEDEADYCMIWHSS AVVFGGGTKLTVL<br>SEQ ID NO: 27634 | QVQLVESGGGVVQPGRSLRLSCAASGFTFSTYGMH WVRQAPGKGLEWVTLIWFDGSNKYYADSVKGRFT ISRDNSKNTLYLQMNSLRAEDTAVYYCARDRVGG TSPPYYYYGMDVWGQGTTVTSS<br>SEQ ID NO: 31640 |

FIGURE 50
(Continued)

| | | | |
|---|---|---|---|
| iPS:437002 | 21-225_191H9 | NA | CAGACTGTGGTGACTCAGGAGCCCTCACTGACTGTGTCCCCAGGAGGGACAGTCAGTCTCACCTGTGCTTCCAGCACTGGAGCAGTCAGTCACCAGTGCTTACTATCCAAACTGGTTGCAGAGATATCAAACAAGCACCCAGGAGACACTCCTGGACCCCTGCCCGGTTCACAACAAACACTCCTGGACCCCTGCCCGGTTCTCAGGGTCCTCCCTGGGGCAAAGCTGCCCTGACACTGTCAGATGTGCCTGATCTTCTATGGTGTGCTGAGTATTACTGCCTGATCTTCTATGGTGTGTACATGATATTTGGGGGAGGGACCAAGCTGACCGTCCTA SEQ ID NO: 27635 | CAGGTGCAGCTGGTGCAGTCTGGGGCTGAGGTGAAGAAGCCTGGGGCCTCAGTGAAGGTCTCCTGTAAGGTTTCTGGATATACCTTCACCGGCTACAATATGCACTGGGTGCGACAGGCCCCTGGACAAGGCTTGAGTGGATGGGATGGATCAACCCTAATAGTGGTGGCACAAACTATGCACAGGGACACGTCATCAGCACAGTCACCATGACCAGGGACACGTCATCAGCAGCCTACATGGAGCTGAGCAGGCTGAGATCTGACGACACGGCCGTGTATTACTGTGCGAGAGATTTCTATGATAGTGGTGGAGAAGGGTTGGTTCGACCCCTGGGGCCAGGGAACCCTGGTCACCGTCCTCCTCA SEQ ID NO: 31641 |
| | | AA | QTVVTQEPSLTVSPGGTVTLTCASSTGAVTSAYYPNWLQQKPGQAPRTLIYSTNKHSWTPARFSGSLLGGKAALTLSDVQPEDEAEYYCLIFYGGVHVIFGGGTKLTVL SEQ ID NO: 27636 | QVQLVQSGAEVKKPGASVKVSCKVSGYTFTGYNMHWVRQAPGQGLEWMGWINPNSGGTNYAHKFQGRVTMTRDTSISTAYMELSRLRSDDTAVYYCARDFYDSGGEGWFDPWGQGTLVTVSS SEQ ID NO: 31642 |
| iPS:437006 | 21-225_192G2 | NA | CAGTCTGTGTTGACGCAGCCGCCCTCAGTGTCTGCGGCCCAGGACAGAAGGTCACCATCCCTGCTCTGGAAGCAGTCCAACATTGGAATAATTATGTATCCTGGTACCAGCAGCTCCCAGGAACAGCCCCCAAACTCCTCATTTATGACAATAATAAGCGACCCTCAAGGATTCCTGACCGATTCTCTGGCTCCAAGTCTGGCACGTCAGCCACCCTGGGCATCACCGGACTCAGAACTGCGGAGGACGAGGCCGATTATTACTGCGAACATGGATAGCAGCCTGAGTGCTGGGGTATTCGGCGGAGGGACCAAGCTGACCGTCCTA SEQ ID NO: 27637 | CAGGTGCAGCTGGTGCAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGCTGGAGTGGGTGGCAGTTATATCGAGACTCCGTGAAGGGCCGATTTACCATCTCCAGAGACAATTCCAAGAACACGCTGTATCTGCAAATGAACAGCCTGAGAGCCGAGGACACGGCCGTCTGTATTACTGTGCGAGAGATCGATACTACGGATATGGAACGTCTGGGGCCAAGGGACCACGGTCAGACTACGGATATGGAACGTCTGGGGCCAAGGGACCACGGTCACCGTCTCCTCA SEQ ID NO: 31643 |

FIGURE 50
(Continued)

| | | | |
|---|---|---|---|
| iPS:437008 | 21-225_192E3 | AA | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL<br>SEQ ID NO: 27638 | QVQLVESGGGVVQPGRSLRLSCAASGFTFSSYGMHWVRQAPGKGLEWVTVIWNDGSNKYYADSVKGRFTISRDNSKNTLYLQMNSLRAEDTALYYCARDLDKRNFPYYYYGMDVWGQGTTVTVSS<br>SEQ ID NO: 31644 |
| | | NA | CAGACTGTGGTGACTCAGGAGCCCTCACTGACTGTGTCCCCAGGAGGACAGTCACTCTCACCTGTGCTTTCAGCACTGGATCAGTCACCAGTGGTTCCTATCCAAACTGGTTCCAGCAGAAACTGGACAAGCACCACCAGGGCACTGATTTATAGTACAAACAACAAACACTCCTGGACACCCCTGCCCGGTTCTCAGGCTCCCTCCTGGGGGCAAAGCTGCCCTGACACTGTCAGGTGTGCAGCGTGAGGACGAGGCTGAGTATTACTGCCTGCTATACTATGGTGGTGCTCAGTGGTGTTCGGCGGAGGGACCAAGCTGACCGTCCTA<br>SEQ ID NO: 27639 | CAGGTGCAGCTGCAGGAGTCGGGCCCAGGACTGGTGAAGCCTTCACAGACCCTGTCCCTCACCTGCACTGTCTCTGGTGGCTCCATCAGCAGTAGTTACTACTGGAGCTGGATCCGCCAGCCCCCAGGGAAGGGGCTGGAGTGGATTGGGTACATCTATTACACTGGGAGCACCTACTACAACCCGTCCCTCAAGAGTCGAGTTACCATATCAGTAGACACGTCTAAGAACCAGTTCTCCCTGAAGCTGAGCTGTGTGACCGCTGAGGACACGGCCGTGTATTACTGTGCGAGAGACGATCCCCTCTACGGAATGGACGTCTGGGGCCAAGGGACCACGGTCACCGTCTCCTCA<br>SEQ ID NO: 31645 |
| | | AA | QTVVTQEPSLTVSPGGTVTLTCAFSTGSVTSGSYPNWFQQKPGQAPRALIYSTNNKHSWTPARFSGSLLGGKAALTLSGVQREDEAEYYCLLYYGGAQLVFGGGTKLTVL<br>SEQ ID NO: 27640 | QVQLQESGPGLVKPSQTLSLTCTVSGGSISSGGYYWSWIRQPPGKGLEWIGYIYYTGSTYNPSLKSRVTISVDTSKNQFSLKLSSVTAADTAVYYCARDDPLYGMDVWGQGTTVTVSS<br>SEQ ID NO: 31646 |

FIGURE 50
(Continued)

| | | | |
|---|---|---|---|
| iPS:437010 | 21-225_192G3 | NA | CAGGTGCAGCTGGTGCAGTCTGGGGCTGAGGTGAAGAAGCCTGGGGCCTCAGTGAAGGTCTCCTGCAAGGCTTCTGGATACACCTTCACCAGCTACTATATGCACTGGGTGCGACAGGCCCCTGGACAAGGGCTTGAGTGGATGGGAATAATCAACCCTAGTGGTGGTAGCACAAGCTACGCACAGAAGTTCCAGGGCAGAGTCACCATGACCAGGGACACGTCCACGAGCACAGTCTACATGGAGCTGAGCAGCCTGAGATCTGAGGACACGGCCGTGTATTACTGTGCGAGAGATCGGGGAGTCAGTGGCTGGTTCGACCCCTGGGGCCAGGGAACCCTGGTCACCGTCTCCTCA |
| | | | SEQ ID NO: 31647 |
| | | AA | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDRGVSGWFDPWGQGTLVTVSS |
| | | | SEQ ID NO: 31648 |
| iPS:437012 | 21-225_192G7 | NA | CAGTCTGTGCTGACTCAGGACCCTGCTGTGTCCGTGGCCCTGGGACAGACAGTCAGGATCACATGCCAAGGAGACAGCCTCAGAAGCTATTATGCAAGCTGGTACCAGCAGAAGCCAGGACAGGCCCCTGTACTTGTCATCTATGGTAAAAACAACCGGCCCTCAGGGATCCCAGACCGATTCTCTGGCTCCAGCTCAGGAAACACAGCTTCCTTGACCATCACTGGGGCTCAGGCGGAAGATGAGGCTGACTATTACTGTAACTCCCGGGACAGCAGTGGTAACCATCTTCGGGCGGAGGGACCAAGCTGACCGTCCTA | CAGAGTGTGTTGACGCAGCCGCCCTCAGTGTCTGGGGCCCCAGGGCAGAGGGTCACCATCTCCTGCACTGGGAGCAGCTCCAACATCGGGGCAGGTTATGATGTACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGGCACCTCAGCCTCCCTGGCCATCACTGGGCTCCAGGCTGAGGATGAGGCTGATTATTACTGCCAGTCCTATGACAGCAGCCTGAGTGGTTGGGTGTTCGGCGGAGGGACCAAGCTGACCGTCCTA |
| | | | SEQ ID NO: 27643 |
| | | NA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGGTTACTACTGGAGCTGGATCCGCCAGCACCCAGGGAAGGGCCTGGAGTGGATTGGGTACATCTATTACAGTGGGAGCACCAACTACAACCCCTCCCTCAAGAGTCGAGTCACCATATCAGTAGACACGTCTAAGAACCAGTTCTCCCTGAAGCTGAGCTCTGTGACCGCCGCAGACACGGCTGTGTATTACTGTGCGAAAGGGTGGGAGCTAAACTACTGGGGCCAGGGAACCCTGGTCACCGTCTCCTCA |
| | | | SEQ ID NO: 31649 |

FIGURE 50
(Continued)

| | | | | |
|---|---|---|---|---|
| iPS:437014 | 21-225_192H8 | AA | QTVVTQEPSLTVSPGGTVTLTCASSTGAVTSGNYPQWFQQKPGQAPRALIYSTTNRHSWTPARFSGSLLGGKAALTLSGVQPEDEAEYYCLFYYGGAQVIFGGGTKLTVL | QVQLQESGPGLVKPSQTLSLTCTVSGGSISSGGYYWSWIRQHPGKGLEWIGYIYYRGSTYYNPSLKSRVTISVDTSKNQFSLKLNSVTAADTAVYYCARDSPVTGFDYWGQGILVTVSS |
| | | | SEQ ID NO: 27644 | SEQ ID NO: 31650 |
| | | NA | CAGACTGTGGTGACTCAGGAACCCTCACTGACTGTGTCCCCAGGAGGACAGTCACTCTCACCTGTGCTTCAGCACTGGAACAGTCACCAGTGGTTTCTATCCAAACTGGTTCCAGCAGAAACCTGGACAAGCACCCAGGGACACTCCTGACCCTCATCTATTCAACAGCAACAGACACTCCTGGACCCCTGCCCGGTTCTCAGGCTCCCTCCCTGGGGCATGGCTGCCTGACACTGTCAGGTGTGCAGCCTGAGGACGAGGCTGATTATTACTGCCTGTTCTATGTGGTGCTCAGCTGATGTTCGGCGGAGGGACCAAGCTGACCGTCCTA | CAGGTGCAGCTGCAGGAGTCGGGCCCAGGAGTGGTGAAGCCTTCACAGACCCTGTCCCTCACCTGCACTGTCTCTGGTGGCTCCATCAGCAGTGGTGGTTGCAGCTACTGGAGCTGGATCCGGCCAGCACCCAGGGAAGGGCCTGGAGTGGATTGGGTACATCTATTACAGTGGGCCCACCTACTACAACCCGTCCCTCAAGAGTCGACTTACCATGTCAGCAGACACGTCTAAGAACCAGTTCTCCCTGAAGCTGAGCTCTGTGACTGCCGCGGACACGGCCGTGTATTACTGTGCGAGAGATAGCTCCCTCTACGGTATGACGTCTGGGGCCAAGGGACAACGGTCACCGTCCTCCTCA | |
| | | | SEQ ID NO: 27645 | SEQ ID NO: 31651 |
| | | AA | QTVVTQEPSLTVSPGGTVTLTCAFSTGTVSGFYPNWFQQKPGQAPRALIYNTSNRHSWTPARFSGSLLGGMAALTLSGVQPEDEADYYCLLYYGGAQLMFGGGTKLTVL | QVQLQESGPGVVKPSQTLSLTCTVSGGSISSGGDYWSWIRQHPGKGLEWIGYIYYSGPTYYNPSLKSRLTMSADTSKNQFSLKLSSVTAADTAVYYCARDSSLYGMDVWGQGTTVTVSS |
| | | | SEQ ID NO: 27646 | SEQ ID NO: 31652 |

FIGURE 50
(Continued)

| | | | | |
|---|---|---|---|---|
| iPS:437016 | 21-225_193A6 | NA | TCTTCTGAGCTGACTCAGGACCCTGCTGTGTCT GTGGCCTTGGGACAGACAGTCAGGATCACATG CCAAGGAGACAGCCTCAGAAGCTCAGAAGTTATGCAA ACTGGTACCAGCAGAAGCCAGGACAGGCCCC TGTACTTTCATCTATGCTAAGAACAACCGGC CCTCAGGGATCCCAGACCGATTCTCTGGCTCC AACTCAGGAAACACAGCTTCTTGACCATCAC TGGGGCTCAGGCGGAAGATGAGGCTGAATATT ACTGTAATTCCCGGACAGCAGTGGTAACCAT CTGGTATTCGGCGGAGGGACCAAGCTGACCGT CCTA | CAGGTGCAGCTGACTCAGGAGTCGGGCCAGGACTG GTGAAGCCTTCGGTGGCTCCATCAGTAGTTACTACTG CTGTCTCTGGTTGGCTCCATCAGTAGTTACTACTG GAGCTGGATCCGGCAGCCCCCAGGGAAGGGACT GGAGTGGATTGGGTATATCTATTACAGTGGGAGC ACCAACTACAACCCCTCCCTCAAGAGTCGAGTCA CCATATCAGTAGACACGTCCAAGAACCAGTTCTC CCTGAAGCTGAGCTCTGTGACCGCTGCGACACG GCCGTGTATTACTGTGCGGGAGGATGGGAGCTAA ACTACTGGGGCCAGGGAACCCTGGTCACCGTCTC CTCA |
| | | | SEQ ID NO: 27647 | SEQ ID NO: 31653 |
| | | AA | SSELTQDPAVSVALGQTVRITCQGDSLRSYYAN WYQQKPGQAPVLFIYAKNNRPSGIPDRFSGSNSG NTASLTITGAQAEDEADYYCNSRDSSGNHLVFG GGTKLTVL | QVQLQESGPGLVKPSETLSLTCTVSGGSISSYYWSW IRQPPGKGLEWIGYIYYSGSTNYNPSLKSRVTISVDT SKNQFSLKLSSVTAADTAVYYCAGGWELNYWGQ GTLVTVSS |
| | | | SEQ ID NO: 27648 | SEQ ID NO: 31654 |
| iPS:437018 | 21-225_193H5 | NA | TCCTATGAACTGACTCAGCCACTCAGTGTC CGTGTCCCCAGGACAGACAGCCAGCATCACCT GCTCTGGAGATAAATTGGGGATAGATTTGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACACAGCAGCACTGCGGTA TTCGGCGGAGGGACCAAGCTGACCGTCCTA | GAGGTGCAGCTGGTGGAGTCTGGGGGAGGCTTG GTAATGCCTGGGGGGTCCCTTAGCCTCTCTGTG CAGCCTCTGGATTCACTTTCAGTAAGCCTACAT GACCTCTGGGTCCGCCAGGCTCCAGGAAGGGCT GGAGTGGGTTGGCCGTATTAAAAGCAAAACTGA TGGTGGGACAAACAGATACGCTGCACCGTGAA AGGCAGATTCACCATCTCAAGAGATGATTCAAA AAACACGCTGTATCTGCAAATGAACAGCCTGAA AACCGAGGACACAGCCGTGTATTACTGTGTACCACA GATCCCGGTGGTATCTTTGACTACTGGGGCCAGG GAACCCTGGTCACCGTCTCCTCA |
| | | | SEQ ID NO: 27649 | SEQ ID NO: 31655 |

FIGURE 50
(Continued)

| | | | |
|---|---|---|---|
| iPS:437020 | | AA | SYELTQPSSVSVSPGQTASITCSGDKLGDRFACW YQQKPGQSPVLVIYQDSKRPSGIPERFSGSNSGN TATLTISGTQAMDEADYYCQAWDSSTAVFGGG TKLTVL<br>SEQ ID NO: 27650 | EVQLVESGGGLVMPGGSLSLSCAASGFTFSNAYMT WVRQAPGKGLEWVGRIKSKTDGGTTDYAAPVKG RFTISRDDSKNTLYLQMNSLKTEDTAVYYCTTDPG GIFDYWGQGTLVTVSS<br>SEQ ID NO: 31656 |
| | 21-225_193F11 | NA | CAGTATGTGTTGACGCAGCCGCCATCAGTGTC TGGGGCCCCAGGACAGAAGGTCACCATCTCCT GCTTCGGAGGCAGCTCCAACATTGGGAATAAT TATGTATCCTGGTTCCAGCAGTCCCAGGAAC AGCCCCAAATTCTCATTTATGACAATATA AGCGACCCTCAGGGATTCTTGACCGATTATCT GGCTCCAAGTCTGGCACGTCAGCCACCCTGA CATCACCGGACTCCAGAATGGGATGCACCAT GATTATTACTGCGGAACATGGGATAGCAGCC GAGTGATTGGGTATTCGGCGGAGGGACCAAG CTGACCGTCCTA<br>SEQ ID NO: 27651 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTTACAGTGG TGGCACAAACTATGCACAGAAGTTTCAGGGCAG GGTCACCATGACCAGGGACACGTCCATCAGCAC AGCCTACATGGAACTGAGCAGGCTGAGATCTGA CGACACGGCCGTGTATTACTGTGCGAGAGATAG AGCAGTGGCTGGAAACTACTTCTACTACGGTATG GACGTCTGGGGCCAAGGGACCACGTCACCGTC TCCTCA<br>SEQ ID NO: 31657 |
| | | AA | QYVLTQPPSVSAAPGQKVTISCFGGSSNIGNNYV SWFQQFPGTAPKFLIYDNNKRPSGILDRLSGSKS GTSATLDITGLQNGDEADYYCGTWDRTMSDWV FGGGTKLTVL<br>SEQ ID NO: 27652 | QVQLVQSGAEVKKPGASVKVSCKASGYTFTGYYM HWVRQAPGQGLEWMGWINPYSGGTNYAQKFQGR VTMTRDTSISTAYMELSRLRSDDTAVYYCARDRAV AGNYFYYGMDVWGQGTTVTVSS<br>SEQ ID NO: 31658 |

FIGURE 50
(Continued)

| | | | |
|---|---|---|---|
| iPS:437022 | 21-225_194G5 | NA | CAGACTGTGTTGACTCAGGAGCCCTCACTGAC TGTGTCCCCAGGAGGGACAGTCACTCTCACCT GTGCTTCCAGCACTGAGCAGTCAGTCACCAGTGGT AACTATCCAAACTGGTTCCAGCAGAAACCTGG ACAAACACCCAGGGCACTGATTTATAGTACAA GCAAACAAACACTCCTGGACCCTGCCCGGTTC TCAGGCTCCCTCCTTGGGGGCAAAGGTGCCCT GACACTGTCAGGTGTGCAGCCTGAGGACGAG GCTGAGTATTACTGCCTGATCTACTATGGTGG TGCTCAGCTGATGTTCGGCGGAGGGACCAAGC TGACCGTCCTA SEQ ID NO: 27653 | CAGGTGCAGCTGCAGGAGTCGGGCCCAGGACTG GTGAAGCCTTCACAGACCCTGTCCTCATCTGCA CTGTCTCTGGTGCTCCATCAGAAGTGGTGGTGA CTACTGGAGCTGGATCCGCCAGCACCAGGAA GGGCCTGGAGTGGATTGGGTACATCTATTACAGT GGGAGCACTACTACAACCCGTCTCTCAAGAGTC GAGTTACCATATCAGTAGACACGTCTAAGAACCA GTTCTCCCTGAAGCTGAGCTCTGTGACTGCCCG GACACGGCCGTTTATTACTGTGCGAGAGATCACT CCCTCTACGGTATGGACGTCTGGGGCCAAGGAC CACGGTCACCGTCTCCTCA SEQ ID NO: 31659 |
| | | AA | QTVVTQEPSLTVSPGGTVTLTCASSTGAVTSGNY PNWFQQKPGQTPRALIYSTSNKHSWTPARFSGSL LGGKGALTLSGVQPEDEAEYYCLIYYGGAQLMF GGGTKLTVL SEQ ID NO: 27654 | QVQLQESGPGLVKPSQTLSLICTVSGGSIRSGGDYW SWIRQHPGKGLEWIGYIYYSGSTYYNPSLKSRVTIS VDTSKNQFSLKLSSVTAADTAVYYCARDHSLYGM DVWGQGTTVTVSS SEQ ID NO: 31660 |
| iPS:437024 | 21-225_194F11 | NA | CAGTCTGTGTTGACGCAGCCGCCCTCAGTGTC TGCGGCCCAGGACAGAAGGTCACCATCTCCT GCTCTGGAAGCAGTCCAACATTGGGAATAAT TATGTATCCTGGTACCAGCAGCTCCCAGGAAC AGCCCCCAAACTCCTCATTTATGACAATAATA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGAACATGGGATAGCAGCCT GAGTGCTGGGGTTTTCGGCGGAGGGACCAAGC TGACCGTCCTA SEQ ID NO: 27655 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTAGTGGCAT GCACTGGGTCCGCCAGGCTCCAGGCAAGGGCT GGAGTGGGTGGCAGTTATATGACTCCGTGAAGGAAG TAAAAATACCATGTAGACTCCGTGAAGGGCCG ATTTACCATCTCCAGAGACAATTCCAAGAACACG CTGTATCTGCAAATGAACAGCCTGAGAGCCGAG GACACGGCTCTGTATTACTGTGCGAGAGATCTGG ATAAGAGGAACTTCCTTATTACTACTACTACGG TATGGACGTCTGGGGCCAAGGGACCACGGTCAC CGTCTCCTCA SEQ ID NO: 31661 |

FIGURE 50
(Continued)

| | | | |
|---|---|---|---|
| iPS:437026 | 21-225_194D12 | AA | QSVLTQPPSVSAAPGQKVTISCSGSGSSSNIGNNYVSWYQQLPGTAPKLLIYDNNKRPSGIPDRFSGSKSGTSATLGITGLQTGDEADYYCGTWDSSLSAGVFGGGTKLTVL<br>SEQ ID NO: 27656 | QVQLVESGGGVVQPGRSLRLSCAASGFTFSSYGMHWVRQAPGKGLEWVAVIWNDGSKKYHVDSVKGRFTISRDNSKNTLYLQMNSLRAEDTALYYCARDLDKRNFPYYYYGMDVWGQGTTVTVSS<br>SEQ ID NO: 31662 |
| | | NA | CAGACTGTGGTGACTCAGGAGCCCTCACTGACTGTGTCCCAGGAGGACAGTCACTCTCACCTGTGCTTCCAGCACTGGAGCAGTCCAGTGGTTCCTTTCCAAGCTGGTTCCAGCAGAAACCTGGACAAGCACCCAGGGCACTGATTTATAGTACAAGCAACAGACACTCTCGACCCCTGCCCGGTTCTCAGGCTCCCTCCTTGGGGGCAAAGCAGCCTGACACTGTCAGGTGTGCAGCCTGAGGACGAGGCTGACTATTACTGCCTGATCTACTATGGTGGTGCTCAGCTGGCATTCGGCGGAGGGACCAAGCTGACCGTCCTA<br>SEQ ID NO: 27657 | CAGGTGCAGCTGCAGGAGTCGGGCCCAGGACTGGTGAAGCCTTCACAGACCCTGTCCCTCACCTGCACTGTCTCTGGTGGCTCCATCAGCAGTAGTGGTGGTGACTACTGGAGCTGGATCCGCCAGCACCCAGGGAAGGGCCTGGAGTGGATTGGGTACATCTATTACAGTGGGAGTACCTACTACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGATGGGCTCGGCACGGTATGGACGTCTGGGGCCAAGGGACCACGGTCACCGTCTCCTCA<br>SEQ ID NO: 31663 |
| | | AA | QTVVTQEPSLTVSPGGTVTLTCASSTGAVTSGSFPSWFQQKPGQAPRALIYSTSNRHSSTPARFSGSLLGGKAALTLSGVQPEDEADYYCLIYYGGAQLAFGGGTKLTVL<br>SEQ ID NO: 27658 | QVQLQESGPGLVKPSQTLSLTCTVSGGSISSGGDYWSWIRQHPGKGLEWIGYIYYSGSTYNPSLKSRVTISVDTSKNQFSLKLSSVTAADTAVYYCARDGARHGMDVWGQGTTVTVSS<br>SEQ ID NO: 31664 |

FIGURE 50
(Continued)

| | | | | | |
|---|---|---|---|---|---|
| iPS:437028 | 21-225_194G12 | NA | CAGTCTCTGTGTTGACGCAGCCGCCCTCAGTGTC TGCGGCCCAGGACAGAAGGTCACCATCCCT GCTCTGGAAGCAGCAGCTCCAACATTGGAATAAT TATGTATCCTGGTACCAGCAGCTCCCAGAAC AGCCCCAAACTCCTCATTTATGACAATAATA AGGGACCCTCAAGGATTCCTGACCGATTCTCT GGCTCCAAGTCTGGCACGTCAGCCACCCTGGG CATCACCGGACTCCAGACTGGGGAGGAGGCC GATTATTACTGCGGAACATGGGATAGCAGCCT GAGTGTTGGGGTATTCGGCGGAGGGACCAAG CTGACCGTCTTA<br><br>SEQ ID NO: 27659 | CAGGTGCAGCTGGTGGAGTCTGGGGGAGGCGTG GTCCAAGCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGACAGTTATATGGAATGATGAAAG TAATAAATACTATGCAGACTCCGTGAAGGGCCG ATTTACCATCTCCAGAGACAATTCCAAGAACACG CTGTATCTGCAAATGAACAGCCTGAGAGCCGAG GACACGGCTCTGTATTACTGTGCGAGAGATCTGG ATAAGAGAACTTTCCTTATTACTACTACGG TATGGACGTCTGGGGCCAAGGGACCACGGTCAC CGTCTCCTCA<br><br>SEQ ID NO: 31665 |
| | | AA | QSVLTQPPSVSAAPGQKVTISCSGSSSNIGNNYVS WYQQLPGTAPKLLIYDNNKRPSGIPDRFSGSKSG TSATLGITGLQTGEEADYYCGTWDSSLSVGVFG GGTKLTVL<br><br>SEQ ID NO: 27660 | QVQLVESGGGVVQPGRSLRLSCAASGFTFSSYGMH WVRQAPGKGLEWVTVIWNDENKYYADSVKGRF TISRDNSKNTLYLQMNSLRAEDTALYYCARDLDKR NFPYYYYGMDVWGQGTTVTVSS<br><br>SEQ ID NO: 31666 |
| iPS:437030 | 21-225_195E3 | NA | TCCTATGAGCTGACTCAGCCACCCTCAGTGTC CGTGTCCCCAGGACAGACAGCCAGCATCACCT GCTCTGGAGATAAATTGGGGTATAGATCTGTT TGCTGGTATCAGCAGAAGCCAGGCCAGTCCCC TGTGCTGGTCATCTATGAAGATAGCAAGCGAC CCTCAGGGATCCCTGAGGATTCTCTGGCTCC AACTCTGGGAACACAGCCACTCTGACCATCAG CGGGACCCAGGCTATGGATGAGGCTGACTATT ACTGTCAGGCGTGGGACAGTAGTCACTGTGTA TTCGGCGGAGGGACCAAGCTGACTGTCCTA<br><br>SEQ ID NO: 27661 | CAGGTGCAGCTGGTGGAGTCTGGGGGAGGCTTG GTCAAGCCTGGAGGGTCCCTGAGACTCTCCCTGTG CAGCCTCTGATTCACCTTCAGTGACTACTACAT GAGCTGGATCCGCCAGGCTCCAGGGAAGGGGCT GGAGTGGGTTTCATATATTACTAGTAGTGGTAAT ACCATATACTACGCAGACTCTGTGAAGGGCCGAT TCACCATCTCCAGGGACAACGCCAAGAACTCACT GTATCTGCAAATGAACAGCCTGAGAGCCGAGGA CACGGCCGTATATTACTGTGCGAGAGATAGTCGA TATTTTGACTGGTTGACTACTGGGGCCAGGGAA CCCTGGTCACCGTCTCTTCA<br><br>SEQ ID NO: 31667 |

FIGURE 50
(Continued)

| | | AA | SYELTQPPSVSVSPGQTASITCSGDKLGYRSVCW YQQKPGQSPVLVIYEDSKRPSGIPERFSGSNSGNT ATLTISGTQAMDEADYYCQAWDSVTVFGGGT KLIVL<br><br>SEQ ID NO: 27662 | QVQLVESGGGLVKPGGSLRLSCAASGFTFSDYYMS WIRQAPGKGLEWVSYITSSGNTIYYADSVKGRFTIS RDNAKNSLYLQMNSLRAEDTAVYYCARDSRYFD WFDYWGQGTLVTVSS<br><br>SEQ ID NO: 31668 |
|---|---|---|---|---|
| iPS:437032 | 21-225_195H6 | NA | CAGTCTGTGCTGACTCAGCCACCCTCAGGTC TGGGACCCCCGGGCAGAGGGTCACCATCTCTT GTTCTGGAAGCAGCTCCAACATCGGAAGTCAT ACTGTAAACTGGTACCAGCAACTCCCAGGAAC GGCCCCCAAACTCCTCATCTATAATAATTATC AGCGGCCCTCAGGGGTCCCTGACCGATTCTCT GGCTCCAAGTCTGGCACCTCAGCCTCCCTGAC CATCAGTGGGCTCCAGTCTGAGGATGACAGCTG ATTATTACTGTGCAACATGGGATGACAGCCTGA GTGTTTGGGTGTTCGGCGGAGGGACCAAGGT GACCGTCCTA<br><br>SEQ ID NO: 27663 | CAGGTGCAGCTGCAGGAGTCGGGCCCAGGACTG GTGAAGCCTTCGGAGACCCTGTCCCTCACCTGCA CTGTCTCTGGTGGCTCCATCAGGAATTACTACTG GAGCTGGATCCGGCAGCCCGCCGGGAAGGGACT GGAGTGGATTGGGCGTATCTATAGCAGTGGGAG CACCAACTACAACCCCTCCCTCAAGAGTCGAGTC TCCATGTCAGTAGACACGTCCAAGAACCAGTTCT CCCTGAAGCTGAGTTCTGTGACCGCCGCGGACAC GGCCGTGTATTACTGTACGAGAGAGGGTGGGAGCTA AACAACTGGGGCCAGGGAACCCTGGTCACCGTC TCCTCA<br><br>SEQ ID NO: 31669 |
| | | AA | QSVLTQPPSASGTPGQRVTISCSGSSSNIGSHTVN WYQQLPGTAPKLLIYNNYQRPSGVPDRFSGSKS GTSASLTISGLQSEDEADYYCATWDDSLSVWVF GGGTKVTVL<br><br>SEQ ID NO: 27664 | QVQLQESGPGLVKPSETLSLTCTVSGGSIRNYYWS WIRQPAGKGLEWIGRIYSSGSTNYNPSLKSRVSMSV DTSKNQFSLKLSSVTAADTAVYYCTRGWELNNWG QGTLVTVSS<br><br>SEQ ID NO: 31670 |

FIGURE 50
(Continued)

| | | | |
|---|---|---|---|
| iPS:437034 | 21-225_195E9 | NA | TCCTATGAGCTGACTCAGCCACCCTCAGTGTCCGTGTCCCAGGAGATAAATTGGGACAGCAGCCAGCCATCACCTGCTCAGGAGATCAGCAGAAGCCAGGCCAGTCCTTACTGGTATCAGCAGAAGCCAGGCCAGTCCCCTGTGCTGGTCATCTATCAAGATAGGAAGCGGCCCTCAGGGATCCCTGAGCGATTCTCTGGCTCCAATTCTGGGAACACAGGCCACTTTGACCATCAGCGGGACCCAGGGTATGGATGAGGCTGACTATTACTGTCAGGCGTGGGACAGAGGAATTGTGGTATTCGGCGGAGGGACCAAGCTGACCGTCCTA<br><br>SEQ ID NO: 27665 | CAGGTGCAGGTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGCCTTGAGTGGATGGGATGGATCAACCCTAACAGTGGTGCCACAAACTATGCACAGAAGTTTCAGGGCAGGGTCACCATGACCAGGGACACGTCCATCAGCACAGCCTACATGGAGCTGAACAGGCTGAGATCTGAGACACGGCCGTGTATTACTGTGCGAGAGCCTATTACTATGTTCGGGGACTTATTATAACGAGTTCGACTACTGGGGCCAGGGAACCCTGGTCACCGTCTCCTCA<br><br>SEQ ID NO: 31671 |
| | | AA | SYELTQPPSVSVSPGQTASITCSGDKLGNKYAYWYQQKPGQSPVLVIYQDRKRPSGIPERFSGSNSGNTGLTLTISGTQGMDEADYYCQAWDRGIVVFGGGTKLTVL<br><br>SEQ ID NO: 27666 | QVQVVQSGAEVKKPGASVKVSCKASGYTFTGYYMHWVRQAPGQGLEWMGWINPNSGATNYAQKFQGRVTMTRDTSISTAYMELNRLRSDDTAVYYCARAYYYGSGTYYNEFDYWGQGTLVTVSS<br><br>SEQ ID NO: 31672 |
| iPS:437036 | 21-225_195H9 | NA | CAGTATGTGTTGACGCAGCCGCCCTCAGTGTCTGCGGCCCAGGACAGAAGGTCACCATCTCCTGTTCTGGAAGCAGCTCCAACATTGGGAATAATTATGTATCCTGGTTCCAGCAGTTCCCAGGAACAGCCCCCAAATTCCTCATTTATGACAATAATAAGCGACCCTCAGGGATTCTTGACCGATTCTCTGGCTCCAAGTCTGGCACGTCAGCCACCCTGGGCATCACCGGACTCCAGACTGGGGACGAGGCCGATTATTACTGCGGAACATGGGATGCACCATGAGTGATTGGGTATTCGGCGGAGGGACCAAGCTGACCGTCCTA<br><br>SEQ ID NO: 27667 | CAGGTGCAGCTGGTGCAGTCTGGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGCCTTGAGTGGATGGGATGGATCAACCCTTACAGTGGTGGCACAAACTATGCACAGAAGTTTCAGGACAGGGTCACCATGACCAGGGACACGTCCATCAACACAGCCTACATGGAACTGAGCAGGCTGAGATCTGACGACACGGCCGTGTATTACTGTGCGAGAGATAGAGCAGTGGCTGGAAACTACTTCTACTACGGTATGGACGTCTGGGGCCAGGGGACCACGGTCACCGTCTCCTCA<br><br>SEQ ID NO: 31673 |

FIGURE 50
(Continued)

| | | | |
|---|---|---|---|
| iPS:437040 | 21-225_196E7 | AA | QYVLTQPPSVSAAPGQKVTISCSGGSSNIGNNYV SWFQQFPGTAPKFLIYDNNKRPSGILDRFSGSKS GTSATLGITGLQTGDEADYYCGTWDRTMSDWV FGGGTKLTVL<br>SEQ ID NO: 27668 | QVQLVQSGAEVKKPGASVKVSCKASGYTFTGYYM HWVRQAPGQGLEWMGWINPYSGGTNYAQKFQDR VTMTRDTSITTAYMELSRLRSDDTAVYYCARDRAV AGNYFYYGMDVWGQGTTVTVSS<br>SEQ ID NO: 31674 |
| | | NA | CAGACTGTGGTGACTCAGGAGCCCTCACTGAC TGTGTCCCCAGGAGGACAGTCACTCTCACCT GTGCTTCCAGCACTGGAGCAGTCAACCAGTGCT TACTATCCAAACTGGTTGCAGCAGAAACCTGG ACAAGCACCCAGGACACTGATTATATACAA ACAACAAACACTCCTGGACCCCTGCCGGTTC TCAGGCTCCCTCCTGGGGCAAAGCTGCCCT GACACTGTCAGATGTGCAGCCTGAGGACGAG GCTGAGTATTACTGCCTGATTTCTATGGTGGT GTACATGTGATATTTGGGGAGGGACCAAGCT GACCGTCCTA<br>SEQ ID NO: 27669 | CAGGTGCAGCTGGTGCAGTCTGGGGCTGAGGTG AAGAAGCCTGGGGCTCAGTGAAGGTCTCCTGTA AGGTTTCTGGATATACCTTCACCGGCTACAATAT GCACTGGGTGCGACAGGCCCCTGGACAAGGGCT TGAGTGATGGATGGATCAACCTAATAGTGGT GGCACAAACTATGCACACAAGTTTCAGGCAGG GTCACCATGACCAGGGACACGTCCATCAGCACA GCCTACATGGAACTGAGCAGGCTGAGATCCGAC GACACGGCCGTGTATTACTGTGCGAGAGATTACT ATGATACTAGTGGAGAAGGGTGGTTCGACCCTG GGGCCAGGGAACCCTGGTCACCGTCTCCTCA<br>SEQ ID NO: 31675 |
| | | AA | QTVVTQEPSLTVSPGGTVTLTCASSTGAVTSAYY PNWLQQKPGQAPRTLIYSTNNKHSWTPARFSGS LLGGKAALTLSDVQPEDEAEYYCLIFYGGVHVIF GGGTKLTVL<br>SEQ ID NO: 27670 | QVQLVQSGAEVKKPGASVKVSCKVSGYTFTGYNM HWVRQAPGQGLEWMGWINPNSGGTNYAHKFQGR VTMTRDTSISTAYMELSRLRSDDTAVYYCARDYYD TSGEGWFDPWGQGTLVTVSS<br>SEQ ID NO: 31676 |

FIGURE 50
(Continued)

| | | | | |
|---|---|---|---|---|
| iPS:437042 | 21-225_197E8 | NA | CAGTCTCTGTGTTGACGCAGCCGCCCTCAGTGTCTGCGGCCCAGGACAGAAGGTCACCATCCTCTGCTCTGGAAGCAGCTCCAACAGTCAGTTCCCAGGAATATATGTATCCTGGTACCAGCAGCTCCCAGGAACAGCCCCCAAAACTCCTCATTTATGACAATAATAAGCGACCCTCAAAGATTCCTGACCGATTCTCTGGCTCCAAATCTGGCAGTCAGCCACCCTGGGCATCAACCGGACTCCTGACTGGGACGAGGCCGATTATTACTGCGGAATATGGGATCGCAGTCTGAGTGTTATGTTCGGCGGAGGGACCAAGCTGACCGTCCTA <br> SEQ ID NO: 27671 | CAGGTGCAGTCTGCTGCAGTCTGGGGCTGAGGTGAGGAAGCCTGGGGCCTCAGTGAAGGTCTCCTGCAAGGCTTCTGGATACACCTTCACCGGCTACTATATACACTGGGTGCGACAGGCCCCTGGACAAGGGCTTGAGTGGATGGGATGGATCAACCCTAACAGTGGTGGCACAAACTATGCACAGAGGTTCAGGCAGGGTCACCATGACCAGGGACACGTCCATCAGCACAGCCTACATGGAGCTGAGCAGGCTGAGATCTGAGGACACGGCCGTGTATTACTGTGCGAGAGAGATAGCAGTGGCTGGGAACTACTTCTACTACGGTATGGGCCGTCTGGGGCCAAGGGACCACGGTCGCCGTCTCCTCA <br> SEQ ID NO: 31677 |
| | | AA | QSVLTQPPSVSAAPGQKVTISCSGSSSNIGNKYVSWYQQFPGTAPKLLIYDNNKRPSKIPDRFSGSKSGTSATLGITGLLTGDEADYYCGIWDRSLSVMVFGGGTKLTVL <br> SEQ ID NO: 27672 | QVQLLQSGAEVRKPGASVRVSCKASGYTFTGYYIHWVRQAPGQGLEWMGWINPNSGGTNYAQRFQGRVTMTRDTSISTAYMELSRLRSDDTAVYYCAREIAVAGNYFYYGMGVWGQGTTVAVSS <br> SEQ ID NO: 31678 |
| iPS:437044 | 21-225_197F9 | NA | CAGTCTGTGTTGACTCAGCCACCTCAGCGTCTGGGACCCCCGGGCAGAGGGTCACCATCTCTTGTTCTGGAAGCAGCTCCAACATCGAAGTAATACTGTAAACTGGTACCAGCAACTCCCAGGAACGGCCCCCAAACTCCTCATTTATAGTAATAATCAGCGGCCCTCAGGGGTCCCTGACCGATTCTCTGGCTCCAAGTCTGGCACCTCAGCCTCCCTGGCCATCAGTGGGCTCCAGTCTGAGGATGAGGCTGATTATTACTGTGCAGCATGGGATGACAGTATGAATGGTCGGTTCGGCGGAGGGACCAAGCTGACCGTCCTA <br> SEQ ID NO: 27673 | CAGGTGCAGCTGCAGGAGTCGGGCCCAGGACTGGTGAAGCCTTCGGAGACCCTGTCCCTCACCTGCACTGTCTCTGGTGGCTCCATCAGAATTTACTACTGGAGCTGGATCCGGCAGCCCCCAGGGAAGGGACTGGAGTGGATTGGGTATGTCTATTACAGTGGGAGCACCACTACAACCCCTCCCTCAAGAGTCGAGTCACCATATCAGTAGACACGTCCAAGAACCAGTTCTCCTGAAGCTGAACTCTGTGACCGCTGCGGACACGGCCGTGTATTACTGTGCGAGAGAAAGGGGGAGTAGCCACAGATGGGGGGACTACTACGGAATGGACGTCTGGGGCCGAGGGACCACGGTCACCGTCTCCTCA <br> SEQ ID NO: 31679 |

FIGURE 50
(Continued)

| | | | |
|---|---|---|---|
| iPS:437048 | 21-225_197B11 | AA | QSVLTQPPSASGTPGQRVTISCSGSSSNIGSNTVN WYQQLPGTAPKLLIYSNNQRPSGVPDRFSGSKS GTSASLAISGLQSEDEADYYCAAWDDSMNGPVF GGGTKLTVL<br>SEQ ID NO: 27674 | QVQLQESGPGLVKPSETLSLTCTVSGGSIRIYYWSW IRQPPGKGLEWIGYVYYSGSTTYNPSLKSRVTISVD TSKNQFSLKLNSVTAADTAVYYCVRERGSSHRWG DYYGMDVWGRGTTVTVSS<br>SEQ ID NO: 31680 |
| | | NA | CAGACTCTGTGGTGACTCAGGAGCCCTCACTGAC TGTGTCCCCAGGAGGGACAGTCACTCTCACCT GTGCTTTCAGCACTGGATCAGTCACCAGTGGT TCCTATCCAAACTGGTTCCAGCAGAAACCTGG ACAAGCACCCAGGACACTGATTTATAGTACAA ACAACAAACACTCCTGGAGTCCCTGACCCTGCCCGGTTC TCAGGCTCCCTCCTTGGGGGCAAAGCTGCCCT GACACTGTCAGGTGTGCAGCCTGAGGACGAG GCTGAGTATTACTGCCTGCTCTACTATGGTGGT GCTCAGCTGGTGTTCGGCGGAGGGACCAAGCT GACCGTCCTA<br>SEQ ID NO: 27675 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CTACTGGAGCTGGATCCGCCAGCCCCCAGGGAA GGGGCTGGAGTGGATTGGGTACATCTATTACACT GGGAGCACCACTACAACCCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGACGATC CCCTCTACGGAATGGACGTCTGGGGCCAAGGGA CCACGGTCACCGTCCTCCTCA<br>SEQ ID NO: 31681 |
| | | AA | QTVVTQEPSLTVSPGGTVTLTCAFSTGSVTSGSY PNWFQQKPGQAPRALIYSTNNKHSWTPARFSGS LLGGKAALTLSGVQPEDEAEYYCLLYYGGAQL VFGGGTKLTVL<br>SEQ ID NO: 27676 | QVQLQESGPGLVKPSQTLSLTCTVSGGSISSGGYYW SWIRQPPGKGLEWIGYIYYTGSTYNPSLKSRVTIS VDTSKNQFSLKLSSVTAADTAVYYCARDDPLYGM DVWGQGTTVTVSS<br>SEQ ID NO: 31682 |

FIGURE 50
(Continued)

| | | | |
|---|---|---|---|
| iPS:437050 | 21-225_197C11 | NA | CAGACTGTGGTGACTCAGGAGCCCTCACTGAC TGTGTCCCCAGGAGGGACAGTCAGTCACCTCACCT GTGCTTCCAGCACTGAGCAGTCAGTCACCAGTGCT TACTATCCAAACTGGTTGCAGCAGAAACCTGG ACAAGCACCCAGGACACTCCAGGACACTGATTTATAGTACAA GCAAACAAACACTCCTGGACCCCTGCCCGGTTC TCAGGCTCCCTCCTTGGGGGCAAAGCTGCCCT GACACTGTCAGATGTGCCTGATCTTCTATGGTGT GCTGAGTATTACTGCCTGATCTTCTATGGTGT GTACATGGATATTTGGCGGAGGGACCAAGCT GACCGTCCTA<br>SEQ ID NO: 27677 | CAGGTGCAGCTGGTGCAGTCTGGGGCTGAGGTG AAGAAGCCTGGGGCCTCAGTGAAGGTCTCCTGTA AGGTTTCTGGATATACCTTCACCGGCTACAATAT GCACTGGGTGCGACAGGCCCCTGGACAAGGCT TGAGTGGATGGGATGGATCAACCTAATAGTGGT GGCACAAACTATGCACACAAGTTTCAGGCAGG GTCACCATGACCAGGGACACGTCATCAGCACA GCCTACATGGAGCTGAGCAGGCTGAGATCTGAC GACACGGCCGTGTATTACTGTGCGAGAGATTACT ATGATAGTAGTGGAGAAGGGTGGTTCGACCCTG GGGCCAGGGAACCCTGGTCACCGTCTCCTCA<br>SEQ ID NO: 31683 |
| | | AA | QTVVTQEPSLTVSPGGTVTLTCASSTGAVTSAYY PNWLQQKPGQAPRTLIYSTSNKHSWTPARFSGS LLGGKAALTLSDVQPEDEAEYYCLIFYGGVHVIF GGGTKLTVL<br>SEQ ID NO: 27678 | QVQLVQSGAEVKKPGASVKVSCKVSGYTFTGYNM HWVRQAPGQGLEWMGWINPNSGGTNYAHKFQGR VTMTRDTSISTAYMELSRLRSDDTAVYYCARDYYD SSGEGWFDPWGQGTLVTVSS<br>SEQ ID NO: 31684 |
| iPS:437054 | 21-225_194G3 | NA | CAGTCTGTGTTGACGCAGCCGCCCTCAGTGTC TGCGGCCCCAGGACAGAAGGTCACCATCTCCT GCTCTGGAAGCAGCTCCAACATCGGAATAAT TATATATCCTGGTACCAGCAGCTCCCAGGAAC AGCCCCCAAACTCCTCATTTATGACAATAAAA AGCGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGAACATGGAATGGATAGCAGCCT GAGTGGTTTGTGTCTTCGGAACTGGGAACCAAG TCACCGTCCTA<br>SEQ ID NO: 27679 | CAGGTGCAGCTGGTGGAGTCTGGGGGAGGCGTG GTCCAGCCTGGGAGGTCCCTGAGACTCTCCTGTG CAGCGTCTGGATTCACCTTTAGTTCCATGGCAT GCACTGGGTCCGCCAGGCTCCAGGCAAGGGCT GGAGTGGGTGGCAGTTATATGTGATGAAGT AAAAATACTATGCAGACTCCGTGAAGGGCCGA TTCACCATCTCCAGAGACAATTCCAAGAACACGC TGCATCTGCAAATGAACAGTCTGAAGCCGAGG ACACGGCTGTGTATTACTGTGCGAAAGAAGGGTT TAGCAGTGGCTTTTACAGGGGGTTTGACAACTGG GGCCAGGGAACCCTGGTCACCGTCTCCTCA<br>SEQ ID NO: 31685 |

FIGURE 50
(Continued)

| | | | |
|---|---|---|---|
| iPS:437056 | 21-225_198B8 | AA | QSVLTQPPSVSAAPGQKVTISCSGSSSNIGNNYIS WYQQLPGTAPKLLIYDNKKRPSGIPDRFSGSKSG TSATLGITGLQTGDEADYYCGTWDSSLSVCVFG TGTKVTVL | QVQLVESGGGVVQPGRSLRLSCAASGFTFSFHGMH WVRQAPGKGLEWVAVIWYDGSKKYYADSVKGRF TISRDNSKNTLHLQMNSLRAEDTAVYYCAKEGFSS GFYRGFDNWGQGTLVTVSS |
| | | | SEQ ID NO: 27680 | SEQ ID NO: 31686 |
| | | NA | CAGACCGTGGTGACTCAGGAGTCCTCACTGAC TGTGTCCCAGGAGGACAGTCACTCTACTT GTGTTCTTAGCACTGGAGCAGTCACCAGTGGT TCCTTTCCAAACTGGTTCCAGCAGAAACTGG ACAAGCACCAGGGCTCTGATTTATAGTACAA GCAACAAACATTCTGGACCCCTGCCCGTTT TCAGGCTCCCTCCCTGGGGGCAAAGCTGCCCT GACATTGTCAGGTGTGCAGCTGAGGACGAGG CTGATTATTACTTCATGCTTTACAGTGGTGAG CTCAGATGGTGTTCGGCGGAGGGACCAAGCTG ACCGTCCTA | CAGGTGCAGCTGCAGGAGTCGGGCCCAGGACTG GTGAAGCCTTCACAGACCCTGTCCCTCACCTGCA CTGTCTCTGGTGGCTCCATCAGAAGTGGTGGTGA CTACTGGAGCTGGATCCGCCAGCACCCAGGGA AGGGCCTGGAGTGGATTGGGTACATCTATTACAGT GGGATCACCTACTACAATCGTCCCTCAAGAGTC GAGTTACCATATCAGTAGACACGTCTAAGAACCA GTTCTCCCTGAAGCTGAGCTCTGTGACTGCCGCG GACACGGCCGTGTATTACTGTGCGAGAGATAGC AGTCGCGGGGTATGGACGTCTGGGGCCAAGGG ACCACGGTCACCGTCTCCTCA |
| | | | SEQ ID NO: 27681 | SEQ ID NO: 31687 |
| | | AA | QTVVTQESSLTVSPGGTVTLTCVLSTGAVTSGSF PNWFQQKPGQAPRALIYSTSNKHSWTPARFSGS LLGGKAALTLSGVQPEDEADYYFMLYSGGAQM VFGGGTKLTVL | QVQLQESGPGLVKPSQTLSLTCTVSGGSIRSGGDY WSWIRQHPGEGLEWIGYIYYSGITYYNPSLKSRVTI SVDTSKNQFSLKLSSVTAADTAVYYCARDSSSRGM DVWGQGTTVTVSS |
| | | | SEQ ID NO: 27682 | SEQ ID NO: 31688 |

| | | | | |
|---|---|---|---|---|
| | | AA | QSVLTQPPSASGTPGQRVTISCSGSSSNIGSNTVN WYQQLPGTAPKLLIYSNNQRPSGVPDRFSGSKS GTSASLAISGLQSEDEADYYCAAWDDSLNGPVF GGGTKLTVL | QVQLQESGPGLVKPSETLSLTCTVSGGSIRIYYWSW IRQTPGKGLEWIGYIYSGSTTYNPSLKSRVTISVDT SKNQFSLKLNSVTAADTAVYYCVRERGSSHRWGD YYGMDVWGRGTTVTVSS |
| | | | SEQ ID NO: 27686 | SEQ ID NO: 31692 |
| iPS:437062 | 21-225_200H1 | NA | CAGACTGTGGTGACTCAGGAGCCCTCACTGAC TGTGTCCCAGGAGGACAGTCACTCTCACCT GTGCTTCCAACACTGGAGCAGTCACCAGTGGT TCCTATCCAAACTGGTTCCAGCAGAAACCTGG ACAGGCACCCAGGGACACTGATTTATCATACAA ACAACAAACACTCCTGGACCCTCGCCCGGTTC TCAGGCTCCCTCCTGGGGCAAAGCTGCCCT GACACTGTCAGGTGTGCAGCCTGAGGACGAG GCTGAATATTACTGTCTGATCTACTATGGTGGT GCTCAGCTGGTGTTCGGCGGAGGGACCAAGCT GACCGTCCTA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGTGA CTATTGGAGCTGGATCCGCCAGCACCCAGGGAA GGGCTGGAGTGGATTGGGTACATCTATTATAGT GGGAGCACCTACTACAACCCGTCCCTCAAGAGTC GAGTTACCATATCAGTAGACAGTCTAAGAACCA GTTCTCCCTGAAGCTGAACTGTGTGCGAGAGATGA GACACGGCCGTGTATTACTGTGCGAGAGATGA GCAGCTCTGGGTATGGACGTCTGGGGCCAAGGG ACCACGGTCACCGTCTCCTCA |
| | | | SEQ ID NO: 27687 | SEQ ID NO: 31693 |
| | | AA | QTVVTQEPSLTVSPGGTVTLTCASNTGAVTSGSY PNWFQQKPGQAPRALIYHTNNKHSWTPARFSGS LLGGKAALTLSGVQPEDEAEYYCLIYYGGAQLV FGGGTKLTVL | QVQLQESGPGLVKPSQTLSLTCTVSGGSISSGGDYW SWIRQHPGKGLEWIGYIYSGSTYNPSLKSRVTIS VDTSKNQFSLKLNSVTAADTAVYYCARDGAALGM DVWGQGTTVTVSS |
| | | | SEQ ID NO: 27688 | SEQ ID NO: 31694 |

FIGURE 50
(Continued)

| | | | |
|---|---|---|---|
| iPS:437064 | 21-225_200G8 | NA | CAGTCTGTGTTGACGCAGCCGCCCTCAGTGTC TGCGGCCCCAGGACAGAGAGGTCACCATCCCT GCTCTGGAAGCAGTCCAACCTTGGAAATAAT TTTGTATCCTGGTACCAGCAGTTCCCAGGAAC AGCCCCCAAACTCCTCATTTATGACAATTATA AGGGACCCTCAGGGATTCCTGACCGATTCTCT GTCTCCAAGTCTGGCACGTCAGCCACCCTGGG CATCACCGGACTCCAGACTGGGGACGAGGCC GATTATTACTGCGGAACTTGGGATAGCAGCCT GAATACTGGGGTATTCGGCGGAGGGACCAAG CTGACCGTCCTA | CAGGTGCAGCTGCAGGAGTCGGGCCCAGGACTG GTGAAGCCTTCGGAGACCCTGTCCCTCACCTGCA CTGTCTCTGGTGGCTCCATCAGAAGTTACTACTG GAGCTGGATCCGGCAGCCCCAGGAAGGACT GGAGTGGATTGGGTATATCTATTACAGTGGGAGT ACTAAGTACAACCCCTCCCTCAAGAGTCGAGTCA CCATATCAGTAGACACGTCCAAGAACCAGTTCTC CCTGAAACTGAGCTCTGTGACCGCTGCGGACACG GCCGTGTACTACTGTGCGAGAAAGGGAGTGGGA ACCATCCACTTTGACTACTGGGGCCAGGGAACCC TGGTCACCGTCTCCTCA |
| | | | SEQ ID NO: 27689 | SEQ ID NO: 31695 |
| | | AA | QSVLTQPPSVSAAPGQRVTISCSGSSSNLGNNFV SWYQQFPGTAPKLLIYDNYKRPSGIPDRFSVSKS GTSATLGITGLQTGDEADYYCGTWDSSLNTGVF GGGTKLTVL | QVQLQESGPGLVKPSETLSLTCTVSGGSIRSYYWS WIRQPPGKGLEWIGYIYYSGSTKYNPSLKSRVTISV DTSKNQFSLKLSSVTAADTAVYYCARKGVGTIHFD YWGQGTLVTVSS |
| | | | SEQ ID NO: 27690 | SEQ ID NO: 31696 |
| iPS:437066 | 21-225_200G9 | NA | CAGACTGTGGTGACTCAGGAGCCCTCACTGAC TGTGTCCCCAGGAGGACAGTCACTCTCACCT GTGCTTCCAACACTGGAGCAGTGACCAGTGGT TCCTATCCAAATTGGTTACAGCAGAAACCTGG ACAAGCACCCAGGCACTGATTTATCATACAG ACAACAAACACTCCTGACCCTGCCCGGTTC TCAGGCTCCCTCCTTGGGGGCAAAGCTGCCCT GACACTGTCAGGTGCGCAGCCTGAGGACGAG GCTGAATATTACTGTCTGATCTACTATGGTGGT GCTCAGCTGGTGTTCGGCGGAGGGACCAAGCT GACCGTCCTA | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTGA CTACTGGAGCTGGATCCGCCAGCACCCAGGGAA GGGCCTGGAGTGGATTGGGTACATCTATTACAGT GGGAGCACCTACTACAACCCGTCCCTCAAGAGTC GAGTTACCATATCAGTAGACACGTCTAAGAACCA GTTCTCCCTGAAGCTGAACTCTGTGACTGCCGCG GACACGGCCGTGTATTACTGTGCGAGAGATGGA GCAGCTCTGGTATGACGTCTGGGGCCAAGGG ACCACGGTCACCGTCTCCTCA |
| | | | SEQ ID NO: 27691 | SEQ ID NO: 31697 |

FIGURE 50
(Continued)

| | | | |
|---|---|---|---|
| iPS:437068 | 21-225_200A11 | AA | QTVVTQEPSLTVSPGGTVTLTCASNTGAVTSGSYPNWLQQKPGQAPRALIYHTDNKHSWTPARFSGSLLGGKAALTLSGAQPEDEAEYYCLIYYGGAQLVFGGGTKLTVL | QVQLQESGPGLVKPSQTLSLTCTVSGGSISSGGDYWSWIRQHPGKGLEWIGIYYSGSTYYNPSLKSRVTISVDTSKNQFSLKLNSVTAADTAVYYCARDGAALGMDVWGQGTTVTVSS |
| | | | SEQ ID NO: 27692 | SEQ ID NO: 31698 |
| | | NA | CAGACTGTGGTGACTCAGGAGCCCTCACTGACTGTGTCCCAGGAGGGACAGTCACTCTCACCTGTGCTTCCAGCACTGGAGCAGTCACCAGTGGTTACTATCCAAACTGGTTCCAGCAGAAACCTGGACAAGTACCAGGGCACTGATTATAGTACAAACAACAAACACTCCTGGACCCCTGCCCGGTTCTCAGGCTCCCTCCTTGGGGGCAAGCTGCCCTGACACTGTCAGGTGTGCAGCTGAGGACGAGGCTGACTATTACTGCCTCTGCTATTATGGTGGTGCTCACCTGGCATTCGGCGGAGGGACCAAGCTGACCGTCCTG | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGGTGACTACTGGAGCTGGATCCGCCAGCACCCAGGGAAGGGCCTGGAGTGGATTGGGTACATCTATTACAGAGGGAGCACCTACTACAACCCGTCCCTCAAGAGTCGAGTTACCATATCAGTAGACACGTCTAAGAACCAGTTCTCCCTGAAGCTGAGCTCTGTGACTGCCGCGGACACGGCCGTGTATTACTGTGCGAGAGATGCAGCAGCCCAAGGCATGGACGTCTGGGGCCAAGGGACCACGGTCACCGTCTCCTCA |
| | | | SEQ ID NO: 27693 | SEQ ID NO: 31699 |
| | | AA | QTVVTQEPSLTVSPGGTVTLTCASSTGAVTSGYYPNWFQQKPGQVPRALIYSTNNKHSWTPARFSGSLLGGKAALTLSGVQPEDEADYYCLLYYGGAHLAFGGGTKLTVL | QVQLQESGPGLVKPSQTLSLTCTVSGGSISSGGDYWSWIRQHPGKGLEWIGIYYRGSTYYNPSLKSRVTISVDTSKNQFSLKLSSVTAADTAVYYCARDAAAHGMDVWGQGTTVTVSS |
| | | | SEQ ID NO: 27694 | SEQ ID NO: 31700 |

FIGURE 50
(Continued)

| | | | |
|---|---|---|---|
| iPS:437070 | 21-225_201G11 | NA | TCCTATGAGCTGACTCAGCCACCCTCAGTGTCCGTGTCCCCAGGACAGACAGCCAGCATCACCTGTTCTGGAGATAAATTGGGGGATAGATTTGCTTGCTGGTATCAACAGAAGCCAGGCCAGTCCCCTGTGCTGGTCATCTATCAAGATAGCAAGCGGCCCTCAGGGATCCCTGAGCGATTCTCTGGCTCCAACTCTGGGAACACAGCCACTCTGACCATCAGCGGGACCCAGGCTATGGATGAGGCTGACTATTACTGTCAGGCGTGGGACAGCAGCACTGTGGTATTCGGCGGAGGGACCAAGCTGACCGTCCTA |
| | | | SEQ ID NO: 27695 |
| | | AA | SYELTQPPSVSVSPGQTASITCSGDKLGDRFACWYQQKPGQSPVLVIYQDSKRPSGIPERFSGSNSGNTATLTISGTQAMDEADYYCQAWDSSTVVFGGGTKLTVL |
| | | | SEQ ID NO: 27696 |
| | | | CAGGTACAGCTGCAGCAGTCAGGTCCAGGACTGGTGAAGCCCTCGCAGACCCTCACTCTGTGCCATCTGGGGACAGTGTCTCTGCCATCAATCCTACTTGGAACTGGATCAGGCAGTCCCCATGAGAGGCCTTGAGTGGCTGGGAAGGACATACTACAGGTCCAAGTGGTATCATGTTTATGCAGTATCTGTGAAAGTCGAATAACCATCAACCCAGACACATCCAGAACCAGTTCTCCTGCAGCTGAATTCTGTGACTCCCGAGGACACGGCAGTGTATTACTGTGCAAGAGATCCTGGGGGGCTCTTTGACTACTGGGGCCAGGGAACCCTGGTCACCGTCTCCTCA |
| | | | SEQ ID NO: 31701 |
| iPS:437074 | 21-225_203B2 | NA | TCCTATGAGCTGACTCAGCCACTCTCAGTGTCAGTGGCCCTGGGACAGACGGCCAGGATTACCTGTGGGGGAAACAACATTGGAAGAAAAATGTGCACTGGTACCAGCAGAAGCCAGGCCAGTCCCCTGTGTTGATCATCATCCATAGGGATTCTGGCTCCCCCTCTGGGATCCCTGAGCGATTCTCTGGCTCCAACTCGGGGAACACGGCCACCCTGACCATCAGCAGAGCCCAAGCAGGTGTGGGACAGGCGGCACTGCGGTATTCGGCGGAGGGACCAAGCTGACCGTCCTA |
| | | | SEQ ID NO: 27697 |
| | | | CAGGTGCAGCTGGTGGAGTCTGGGGGAGGCGTGGTCCAGCCGGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAATTATATGGTTTGATGGAAGTAATGAATACTATGCAGACTCCGTGAAGGGCCGATTCACCATCTCCAGAGACAATTCCATGAGCACGCTGTATCTGCAAATGAACAGCCTGAGAGCCGAGGACACGGCTATGCTCTTTATACTGTGCGAGAGAAAGTGGAGCTATGCTCTTTATATCTGGGGCCAAGGGACAATGGTCACCGTCTCTTCA |
| | | | SEQ ID NO: 31703 |

FIGURE 50
(Continued)

| | | | |
|---|---|---|---|
| iPS:437076 | | AA | SYELTQPLSVSVALGQTARITCGGNNIGRKNVH WYQQKPGQSPVLIIHRDSDRPSGIPERFSGSNSGN TATLTISRAQAGDEADYYCQVWDSGTAVFGGG TKLPVL<br>SEQ ID NO: 27698 | QVQLVESGGGVVQPGRSLRLSCAASGFTFSNYGM HWVRQAPGKGLEWVAIIWFDGSNEYYADSVKGRF TISRDNSMSTLYLQMNSLRAEDTAVYYCARESGSY ALYIWGQGTMVTVSS<br>SEQ ID NO: 31704 |
| | | NA | TCCTATGAACTGACTCAGCCACCCTCAGTGTC CGTGTCCCAGGAGCAGACAGCCAGCATCACCT GTTCTGGAGATAAATTGGGGGATAGATTTGCT TGCTGGTATCAACAGAAGCCAGGCCAGTCCC TGTACTGGTCATCTATCAAGATAACAAGCGGC CCTCAGGGATCCCTGAGCGATTCTCTGGCTCC AACTCTGGGAACACAGTCTATGATGAGGCTGACTATT ACTGTCAGGCGTGGGACAGCAGCACTGTGTA TTCGGCGGAGGGACCAAGCTGACCGTCCTG<br>SEQ ID NO: 27699 | CAGGTTCAGCTGCAGCAGTCAGGTCCAGGACTG GTGAAGCCCTCGCAGACCCTCTCACTCACCTGTG CCATCTCCGGGGACAGTGTCTCTGCACCAATCC TACTTGGAACTGGATCAGGCAGTCCCATCGAGA GGCCTTGAGTGGCTGGGAAGGACATACTACAGG TCCAAGTGGTATCATGTTTATGCACTATCTGTGA AAAGTCGAATAACCATCACCCCAGACACATCCA AGAACCAGTTCTCCCTGCAGCTGAACTCTGTGAC TCCCGAGGACACGGCTGTGTATTACTGTGCAAGA GATCCTGGGGGCCTCTTTGACTACTGGGGCCAGG GAACCCTGGTCACCGTCTCCTCA<br>SEQ ID NO: 31705 |
| | 21-225_203G6 | AA | SYELTQPPSVSVSPGQTASITCSGDKLGDRFACW YQQKPGQSPVLVIYQDNKRPSGIPERFSGSNSGN TATLTISGTQSMDEADYYCQAWDSSTVVFGGGT KLTVL<br>SEQ ID NO: 27700 | QVQLQQSGPGLVKPSQTLSLTCAISGDSVSRTNPTW NWIRQSPSRGLEWLGRTYYRSKWYHVYALSVKSRI TITPDTSKNQFSLQLNSVTPEDTAVYYCARDPGGLF DYWGQGTLVTVSS<br>SEQ ID NO: 31706 |

FIGURE 50
(Continued)

| | | | |
|---|---|---|---|
| iPS:437082 | 21-225_205E12 | NA | TCCTATGAGCTGACTCAGCCACTCTCAGTGTC AGCGGCCCTGGACAGACGGCCAGGATTACCT GTGGGGAAACAACATTGGAAGAAAAATGT GCACTGGTACCAGCAGAAGCCAGGCCAGTCCC CTGTGTTGATCATCCATAGGGATAGGGACCGG CCCTCTGGGATCCCTGAGCGATTCTCTGGCTCC AACTCGGGAACACGGCCACCTGACCATCAG CAGAGCCCAAGCGCGGGATGAGGCTGACTATT ACTGTCAGGTGTGGGACAGCGGCACTGCGGTA TTCGGCGGAGGGACCAAGCTGACCGTCCTA SEQ ID NO: 27701 | CAGGTGCAGCTGGTGGAGTCTGGGGGAGGCGTG GTCCAGCCGGGGAGGTCCCTGAGACTCTCCTGTG CAGCGTCTGGATTCACCTTCAGTAACTATGGCAT GCACTGGGTCCGCCAGGCTCCAGGCAAGGGGCT GGAGTGGGTGGCAATTATATGGTTTGATGGAAGT AATGAATACTATGCAGACTCCGTGAAGGGCCGA TTCACCATCTCCAGAGACAATTCCATGAGCACGC TGTATCTGCAAATGAACAGCCTGAGAGCCGAGG ACACGGCTGTATTACTGTGCGAGAGAAAGTGG GAGCTATGCTCTTTATATCTGGGGCCAAGGGACA ATGGTCACCGTCTCTTCA SEQ ID NO: 31707 |
| | | AA | SYELTQPLSVSAALGQTARITCGNNIGRKNVH WYQQKPGQSPVLIIHRDSDRPSGIPERFSGSNSGN TATLTISRAQAGDEADYYCQVWDSGTAVFGGG TKLPVL SEQ ID NO: 27702 | QVQLVESGGGVVQPGRSLRLSCAASGFTFSNYGM HWVRQAPGKGLEWVAIIWFDGSNEYYADSVKGRF TISRDNSMSTLYLQMNSLRAEDTAVYYCARESGSY ALYIWGQGTMVTVSS SEQ ID NO: 31708 |
| iPS:437084 | 21-225_206B5 | NA | TCCTATGAATTGACTCAGCCACTCTCAGTGTC AGTGGCCCTGGACAGACGGCCAGGATTGCCT GTGGGGGAAACAACATTGGAAGAAAAATGT GCACTGGTACCAGCAGAAGCCAGGCCTGGCCC CTGTGCTGGTCGTCATCNTAGGGATAGCTACCGA TCTTCTGGAGTCCCTGACAGATTCTCTGGCTCC AACTCGGGAACAACGACCACCGTGACCATCA GCAGAGCCCAAGCGCGGGGAGGAGGCAGAGTA TTATTGTCAGGATTGGGACAGCAGCACTGTGG TGTTCGGCGGAGGGACCAAACTGACCGTCCTA SEQ ID NO: 27703 | CAGGTGCAGCTGGTGGAGTCCGGGGGAGGCGTG GTCCAGCCTGGGAGGTCCCTGAGACTCTCCTGTG CAGCGTCTGGATTCACCTTCAGTAGCTATGGCAT GCACTGGGTCCGCCAGGCTCCAGGCAAGGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATAACTGTGCGAGAGAGGGTG GGAGCTACCACCTTGACTACTGGGGCCAGGGAA TCCTGGTCACCGTCTCCTCA SEQ ID NO: 31709 |

FIGURE 50
(Continued)

| | | | |
|---|---|---|---|
| iPS:437086 | 21-225_209A8 | AA | SYELTQPLSVSVALGQTARIACGGNNIGRKNVH WYQQKPGLAPVPVIXRDSYRSSGIPDRFSGSNCG NTTTVTISRAQAGEEAEYYCQDWDSSTVVFGGG TKLTVL<br>SEQ ID NO: 27704 | QVQLVESGGGVVQPGRSLRLSCAASGFTFSSYGMH WVRQAPGKGLEWVAVIWYDGSNKYYADSVKGRF TISRDNSKNTLYLQMNSLRAEDTAVYNCAREGGSY HLDYWGQGILVTVSS<br>SEQ ID NO: 31710 |
| | | NA | CAGTCTGTGTTGACGCAGCCGCCCTCAGTGTC TGGGGCCCCAGGACAGAAGGTCACCATCTCT GCTCTGGAAGCAGCTCCAACATTGGGAGTAAT TTTTTATCCTGGTACCAGCAGCTCCAGGAAC AGCCCCCAAACTCCTCATTTATGACAATAATA AGGGACCCTCAGGGATTCCTGACCGATTCTCT GGCTCCAAGTCTGGCACGTCAGCCACCCTGGG CATCACCGGACTCCAGACTGGGGACGAGGCC GATTATTACTGCGGAACATGGGATAGCAGCCT GAGTGCTGGGGTATTCGGCGGAGGGACCAAG CTGACCGTCCTA<br>SEQ ID NO: 27705 | GAGGTGCAGCTGGTGGAGTCTGGGGGAGGCTTG GTACAGCCTGGGGGGTCCCTGAGACTCTCCTGTG CAGCCTCTGGATTCACTTTCAGAAGTTATAGCAT GAACTGGGTCCGCCAGGCTCCAGGGAAGGGGCT GGAGTGGGTTTTATACATTAGTAGTAGTAGT ATCAAAAAGTACGCAGACTCTGTGAAGGGCCGA TTCACCATCTCCAGAGACAATGCCAAGAACTCAC TGTATCTGCAAATGAACAGCCTGAGAGACGAGG ACACGGCTGTGTATTACTGTGTGAGAGATGATGG GAGCTACTACTTTGACTACTGGGGCCAGGGAACC CTGGTCACCGTCCTCCTCA<br>SEQ ID NO: 31711 |
| | | AA | QSVLTQPPSVSAAPGQKVTISCSGSSSNIGSNFLS WYQQLPGTAPKLLIYDNNKRPSGIPDRFSGSKSG TSATLGITGLQTGDEADYYCGTWDSSLSAGVFG GGTKLTVL<br>SEQ ID NO: 27706 | EVQLVESGGGLVQPGGSLRLSCAASGFTFRSYSMN WVRQAPGKGLEWVLYISSSSIKKYADSVKGRFTIS RDNAKNSLYLQMNSLRDEDTAVYYCVRDDGSYF DYWGQGTLVTVSS<br>SEQ ID NO: 31712 |

FIGURE 50
(Continued)

| | | | |
|---|---|---|---|
| iPS:437088 | 21-225_209H10 | NA | TCCTATGAATGACTCAGCCACTCTCAGTGTCAGTGGCCCTGGGACAGAGCGGCCAGGATTGCCTGTGGGGGAAACAACATTGGAAGAAAAAATGTGCACTGTGCGCCAGCAGAAGCCAGGCCTGGCCCCTGTGCCGGTCATCCTTAGGGATAGCTACCGGTCTTCTGGGATCCCTGACAGATTCTCTGGCTCCAACTGGGGAACACGGCCACCGTGACCATCAGCAGAGCCAAGCTGGGACAGCAGCACTGTGGTTATTGTCAGGATTGGGACAGCAGCACTGTGGTGTTCGGCGGAGGGACCAAACTGACCGTCCTA<br>SEQ ID NO: 27707 | CAGGTGCAGCTGGTGGTGGAGTCCGGGGGAGGCGTGGTCCAGCCTGGGAGGTCCCTGAGACTCTCCTGTGCAGCCGTCTGGATTCACCTTCAGTAGCTATGGCATGCACTGGGTCCGCCAGGCTCCAGGCAAGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATAACTGTGCAGAGAGGGTGGGAGCTACCACCTGACTACTGGGGCCAGGGAATCCTGGTCACCGTCTCCTCA<br>SEQ ID NO: 31713 |
| | | AA | SYELTQPLSVSVALGQTARIACGGNNIGRKNVHWYQQKPGLAPVPVILRDSYRSSGIPDRFSGSNWGNTATVTISRAQAGEEAEYYCQDWDSSTVVFGGGTKLTVL<br>SEQ ID NO: 27708 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYNCAREGGSYHLDYWGQGILVTVSS<br>SEQ ID NO: 31714 |
| iPS:437090 | 21-225_210F11 | NA | CAGACTGTGGTGACTCAGGAGCCCTCACTGACTGTGTCCCCAGGAGGGACAGTCACTCTCACCTGTGCTTTCAGCACTGGAGCAGTGCAGCACTGGTCTGTCTCAGGCTGGTATCAACAGAAACCTGGAATTATCCAAACTGGTTCCAGCAGAAACCTGGACAAGCACCACCAGGCACTGATTTACAGTACAAGCAACAAACACCTGGAGACACCTGCCGGTTCTCAGGCTCCCTCCCCTTGGGGGGCAAAGCTGCCCTGACACTGTCAGGTGTGCAGCCTGAGGACGAGGCTGAATATTACTGCCTGCTCTACTATGTGTGCTCAGCTGGTGTTCGGCGGAGGGACCAAGCTGACCGTCCTA<br>SEQ ID NO: 27709 | CAGGTGCAGCTGCAGGAGTCGGGCCCAGGACTGGTGAAGCCGTCACAGACCCTGTCCTCACCTGCACTGTCTCTGGTGGCTCCATCAGCAGCACCACCAGGAACTACTGGAGCTGGATCCGCCAGCACCCAGGGAAGGGCCTGGAGTGGATTGGGTACATCTATTACATTGGGACCACCTACTACAACCCGTCCCTCAAGAGTCGAGTTACCATATCAGTAGACACGTCTAAGAACCAGTTCTCCCTGAAACTGAGCTCTGTGACTGCCGCGGACACGGCCGTGTATTACTGTGCGAGAGATGAGCCATTGACCGTATGACGGTCTGGGGCCAAGGGACCACGGTCACCGTCCTCA<br>SEQ ID NO: 31715 |

FIGURE 50
(Continued)

| | | | |
|---|---|---|---|
| iPS:437092 | 21-225_210B12 | AA | QTVVTQEPSLTVSPGGTVTLTCAFSTGAVTSGNYPNWFQQKPGQAPRALIYSTSNKHSWTPARFSGSLLGGKAALTLSGVQPEDEAEYYCLLYYGGAQLVFGGGTKLTVL<br>SEQ ID NO: 27710 | QVQLQESGPGLVKPSQTLSLTCTVSGGSISSGGSYWSWIRQHPGKGLEWIGYIYYIGTTYNPSLKSRVTISVDTSTNHFSLKLSSVTAADTAVYYCARDEPLTGMDVWGQGTTVTVSS<br>SEQ ID NO: 31716 |
| | | NA | CAGTCTGCCCTGACTCAGCCTGCCTCCGTGTCTGGGTCTCCTGGAACCAGTCACTCTCCTGCACTGGAACCAGCAGTGACGTTGGTGTTATAACTATGTCTCCTGGTACCAACACCCAGGCAAAGCCCCCAAATTCATGATTTATAGGTCAGGAATCGGCCCTCAGGGGTTTCTAATCGCTCTCTGGCTCCAAGTCTGGCAACACGGCCTCCTGACCATCTCTGGGCTCCAGGCTGAGGACGAGGCTGATTATTACTGCAGTCTCATATACCAGCAGCCGCACTCTGGTATTCGGCGGAGGGACCAAGTTGACCGTCCTA<br>SEQ ID NO: 27711 | CAGGTGCAGCTGGTGCAGTCTGGGGCTGAGGTGAAGAAGCCTGGGGCCTCAGTGAAGATCTCCTGCAAGGCTTCTGGATTCACCTTCACCGACTACTATAGAACTGGGTGCGACAGGCCCCTGGACAAGGCTTGAGTGGATGGGATGGATCAACAGAAGTTTCAGGCAGTGGCACAAACTATGCACCAGGGACACGTCCATCAGCACGGTCACCATGACCAGGGACACGTCCATCAGCACAGCCTACATGGAGCTGAGTAGGCTGAGATCTGACGACACGGCCGTGTATTACTGTGCGAGAGGGTATGACTCGTTCGCCCCTGGGCCAGGGAACCCTGGTCACCGTCTCCTCA<br>SEQ ID NO: 31717 |
| | | AA | QSALTQPASVSGSPGQSITISCTGTSSDVGGYNYVSWYQQHPGKAPKFMIYEVRNRPSGVSNRFSGSKSGNTASLTISGLQAEDEADYYCSSYTSSRTLVFGGGTKLTVL<br>SEQ ID NO: 27712 | QVQLVQSGAEVKKPGASVKISCKASGFTFTDYYMNWVRQAPGQGLEWMGWINPNSGGTNYAQKFQGRVTMTRDTSISTAYMELSRLRSDDTAVYYCARGYDSFAPWGQGTLVTVSS<br>SEQ ID NO: 31718 |

FIGURE 50
(Continued)

| | | | |
|---|---|---|---|
| iPS:437094 | 21-225_210D12 | NA | CAGTCTGCCCTGACTCAGCCTGCCTCCGTGTCT<br>GGGTCTCCTGGACAGTCGATCACCATCTCCTG<br>CACTGGAACCAGCAGTGACGTTGGTGGTTATA<br>ATTATGTCTCTGGTACCAACAACACCAGTC<br>AAAGCCCCCAAACTCTTGATTTATGAGGTCAG<br>TAATCGGCCCTCAGGGGTTTCTAATCGCTTCTC<br>TGGCTCCAAGTCTGGCAACACGGCCTCCCTGA<br>CCATCTCTGGGCTCCAGGCTGAGGACGAGGCT<br>GATTATTACTGCAACTGCATATACAAGCAGCAT<br>CACTTGGGGTGTTCGGCGGAGGGACCAAGCTGA<br>CCGTCCTA<br>SEQ ID NO: 27713 | CAGGTGCAGTTGGTGGAGTCTGGGGGAGGCGTG<br>GTCCAGCCTGGGAGGTCCCTGAGACTCTCCTGTG<br>CAGCGTCTGGATTCACCTTCAGTCAGTCACTATGGCAT<br>GCACTGGGTCCGCCAGGCTCCAGGCAAGGGCT<br>GGAGTGGGTGGCAGTTATATGTATGGAAGT<br>AATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTGTATTACTGTGCGAGGGGGACTG<br>GAACCCCGAGGGTTTGGACGTCTGGGGCCAAGG<br>GACCACGGTCACCGTCTCCTCA<br>SEQ ID NO: 31719 |
| | | AA | QSALTQPASVSGSPGQSITISCTGTSSDVGGYNY<br>VSWYQQHPVKAPKLLIYEVSNRPSGVSNRFSGS<br>KSGNTASLTISGLQAEDEADYYCNSYTSSITWVF<br>GGGTKLTVL<br>SEQ ID NO: 27714 | QVQLVESGGGVVQPGRSLRLSCAASGFTFSHYGM<br>HWVRQAPGKGLEWVAVIWYDGSNKYYADSVKGR<br>FTISRDNSKNTLYLQMNSLRAEDTAVYYCARGDW<br>NPEGLDVWGQGTTVTVSS<br>SEQ ID NO: 31720 |
| iPS:437096 | 21-225_210E12 | NA | CAGTCTGCCCTGACTCAGCCTGCCTCCGTGTCT<br>GGGTCTCCTGGACAGTCGATCACCATCTCCTG<br>CACTGGAACCAGCAGTGACGTTGGTGGTTATA<br>CAGCGTCTGGATTCACCTTCAGTAACTATGGCAT<br>ACTATGTCTCCTGGTACCAACAACACCAGGC<br>GCACTGGGTCCGCCAGGCTCCAGGCAAGGGCT<br>AAAGCCCCCAAACTCATGATTTATGAGGTCAG<br>GGAGTGGGTGGCAGTTATATGTATGGAAGT<br>TAATCGGCCCTCAGGGGTTTCTAATCGCTTCTC<br>AATAAATACTATGCAGACTCCGTGAAGGGCCGA<br>TGGCTCCAAGTCTGGCAACACGGCCTCCCTGA<br>TTCACCATCTCCAGAGACAATTCCAAGAACACGC<br>CCATCTCTGGGCTCCAGGCTGAGGACGAGGCT<br>TGTATCTGCAAATGAACAGCCTGAGAGCCGAGG<br>GATTATTACTGCGGCTCATATGTAAAAGGCAT<br>ACACGGCTGTGTATTACTGTGCGAGGGGGACTG<br>CACTTGGGGTGTTCGGCGGAGGGACCAGTCTAA<br>GAACCCCGAGGGTATGGACGTCTGGGGCCAAGG<br>CCGTCCTC<br>GACCACGGTCATCGTCTCCTCA<br>SEQ ID NO: 27715 | SEQ ID NO: 31721 |

FIGURE 50
(Continued)

| | | | |
|---|---|---|---|
| iPS:437098 | 21-225_211C1 | AA | QSALTQPASVSGSPGQSITISCTGTSSDVGGYNYVSWYQQHPGKAPKLMIYEVSNRPSGVSNRFSGSKSGNTASLTISGLQAEDEADYYCGSYVKGITWVFGGGTSLTVL<br>SEQ ID NO: 27716 | QVHLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVTVSS<br>SEQ ID NO: 31722 |
| | | NA | CAGTCTGCCCTGACTCAGCCTGCCTCCGTGTCTGGGTCTCCTGGACAGTCGATCACCATCTCCTGCACTGGAACCAGTAGTGACGTTGGTAGTTATAACTATGTCTCCTGGTACCAACAGCACCCAGGCAAAGCCCCCAAACTCATGATTTATGAGGTCAGTAATCGGCCCTCAGGGGTTTCTAATCGCTTCTCTGGCTCCAAGTCTGGCAACACGGCCTCCCTGACCATCTCTGGGCTCCAGGCTGAGGACGAGGCTGATTATTACTGCGGCTCATATACAAGCAGCATCACTTGGGTGTTCGGCGGAGGGACCAAGCTGACCGTCCTA<br>SEQ ID NO: 27717 | CAGGTGCAGCTGGTGGAGTCTGGGGGAGGCGTGGTCCAGCCTGGGAGGTCCCTGAGACTCTCCTGTCAGCGTCTGGATTCACCTTCAGTCAGTTCACTATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATGAACACCCTCAAGAACACGCTGTATCTGCAAATGAACAGCCTGAGAGCCGAGGACACCGGCTATCTATTACTGTGCGAGGGGGACTGGAACCCGAGGGTTTGGACGTCTGGGGCCAAGGGACCACGGTCACCGTCTCCTCA<br>SEQ ID NO: 31723 |
| | | AA | QSALTQPASVSGSPGQSITISCTGTSSDVGSYNYVSWYQQYPGKAPKLMIYEVSNRPSGVSNRFSGSKSGNTASLTISGLQAEDEADYYCNSYTSSITWVFGGGTKLTVL<br>SEQ ID NO: 27718 | QVQLVESGGGVVQPGRSLRLSCAASGFTFSHYGMHWVRQAPGKGLEWVAVIWYDGSNKYYADSVKGRFTISRDNSKNTLYLQMNTLRAEDTAIYYCARGDWNPEGLDVWGQGTTVTVSS<br>SEQ ID NO: 31724 |

FIGURE 50
(Continued)

| | | | | |
|---|---|---|---|---|
| iPS:437100 | 21-225_211H2 | NA | TCCTATGAACTGACTCAGCCACTCTCAGTGTC AGTGGCCCTGGGACAGACGGCCAGGATTACCT GTGGGGGAAACAACATTGGACGTAGAAATGT GCACTGGTACCAACAGAAGCCAGGCCAGGCC CCTATACTGGTCATCTATAGAGATCGCGACCG GCCCCTCTGGGATCCCTGAGCGATTCTCTGGCT CCAACTCGGGGAACACGGCCACCCTGACCATC AGCAGAGCCCAAGCCGGGGATGAGGCTGACT ATTTCTGTCAGGTGTGGGACAGCAGTACTGCG GTGTTCGGCGGAGGGACCAAACTGAGGCTGACCGTCCT A | CAGGTGCAGCTGGTGGAGTCTGGGGAGGCGTG GTCCAGCCTGGGAGGTCCCTGAGACTCTCCTGTG CAGCGTCTGGATTCACCTTCAGTAGCTATGCCAT GCACTGGGTCCGCCAGGCTCCAGGCAAGGGCT GGAGTGGGTGGCAGTTATATGGTATGATGAAGT AATAAATACTATGCAGACTCCGTGAAGGGCCGA TTCACCATCGCCAGAGACAATTCCAAGAACACGC TGTATCTGCAAATGAACAGCCTGAGAGCCGAGG ACACGGCTGTGTATTACTGTGCGAGAGATCCTGG GAGCTACGGGTTGACCCCTGGGGCCAGGGAAC CCTGGTCACCGTCTCCTCA |
| | | | SEQ ID NO: 27719 | SEQ ID NO: 31725 |
| | | AA | SYELTQPLSVSVALGQTARITCGGNNIGRRNVH WYQQKPGQAPILVIYRDRDRPSGIPERFSGSNSG NTATLTISRAQAGDEADYFCQVWDSSTAVFGGG TKLTVL | QVQLVESGGGVVQPGRSLRLSCAASGFTFSSYAMH WVRQAPGKGLEWVAVIWYDGSNKYYADSVKGRF TIARDNSKNTLYLQMNSLRAEDTAVYYCARDPGSY GFDPWGQGTLVTVSS |
| | | | SEQ ID NO: 27720 | SEQ ID NO: 31726 |
| iPS:437102 | 21-225_211E5 | NA | TCCTATGAGCTGACACAGCCACCCTCGGTGTC AGTGTCCCCAGGACAGACGGCCAGGATCACCT GTTCTGGAGATGCATTGCCAAAGCAATATGCT TATTGGTACCAGCAGAAGCCAGGCCAGGCCCC AGTGCTGGTGATATATAAAGACAGTGCGAGGC CCTCAGGGATCCCTGAGCGATTCTCTGGCTCC CGCTCAGGGACAACAGTCACGTTGACCGTCAG TGGAGTCCAGGCAGAAGACGAGGCTGACTATT ACTGTCAATTAGTGTACAGCAGTGATACTTAT GTCTTCGGAACTGGGACCATGTCACCGTCCT A | CAGGTGCAGCTGGTGGAGTCTGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGGCT GGAGTGGGTGTCAATTATATGGTTTGATGGAAGT GATCAATAATACTATGCAGACTCCGTGAAGGGCGAT TCACCATCTCCAGAGACAACTCCAAGAACAGCT GTACCTGCAAATGAACAGCCTGAGAGCCGAGGA CACGGCTGTTTATTACTGTGCGAGAGCCTCTCT GTCTACTACTACGGTATGGGCGTCTGGGGCCAAG GGACCACGGTCACCGTCTCCTCA |
| | | | SEQ ID NO: 27721 | SEQ ID NO: 31727 |

FIGURE 50
(Continued)

| | | |
|---|---|---|
| iPS:437104<br>21-225_211G5 | AA | SYELTQPPSVSVSPGQTARITCSGDALPKQYAYWYQQKPGQAPVLVIYKDSARPSGIPERFSGSRSGTTVTLTVSGVQAEDEADYYCQLVYSSDTYVFGTGTMLTVL<br>SEQ ID NO: 27722 |
| | | QVQLVESGGGVVQPGRSLRLSCAASGFTFRNYGMHWVRQAPGKGLEWVSIIWFDGSDQYYADSVKGRFTISRDNSKNTLYLQMNSLRAEDTAVYYCARGLSVYYYGMGVWGQGTTVTVSS<br>SEQ ID NO: 31728 |
| | NA | CAGGTGCAGCTGGTGGAGTCTGGGGGAGGCGTGGTCCAGCCTGGGAGGTCCCTGAGACTCTCCTGTCAGCGTCTGGATTCACCTTCAGTCAGTCACTATGGCATGCACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATTCCAAGAACACGCTGTATCTACAAATGAACAGCCTGAGAGCCGAGGACACGGCTGTGTATTACTGTGCGAGGGGGGACTGAAACCCGAGGGTTTGGACGTCTGGGGCCAAGGGACCACGGTCACCGTCTCCTCA<br>SEQ ID NO: 31729 |
| | AA | QSALTQPASVSGSPGQSITISCTGTSSDVGGYNYVSWYQQHPGKAPKLMIYEVSNRPSGVSNRFSGSKSGNTASLTISGLQAEDEADYYCNSYTRSITWVFGGGTKLTVL<br>SEQ ID NO: 27723 | | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS<br>SEQ ID NO: 31730 |
| | | SEQ ID NO: 27724 | |

FIGURE 50
(Continued)

| | | | |
|---|---|---|---|
| iPS:437106 | 21-225_211H7 | NA | CAGACTGTGGTGACTCAGGAGCCCTCACTGAC<br>TGTGTCCCCAGGAGGGACAGTCACTCTCACCT<br>GTGCTTTCAGCACTGGAGCAGTCAGTCACCAGTGGT<br>AACTATCCAAGTTGGTTCCAGCAGAAACCTGG<br>ACAAGTTCCAGGGCACTGATTTATAGTACAA<br>GCAACAGACACTCCTGGACCCTGCCCGTTT<br>TCTGGCTCCCTCCTTGGGGCAAAGCTGCCT<br>GACACTGTCAGGTGTGCAGCCTGAGGACGAG<br>GCTGAATATTACTGCCTGCTCTACTATGGTGT<br>GCTCAGCGTGTGTTCGGCGGAGGGACCAAGCT<br>GACCGTCCTA<br><br>SEQ ID NO: 27725 | CAGGTGCAGCTGCAGGAGTCGGGCCCAGGACTG<br>GTGAAGCCTTCACAGACCCTGTCCCTCACCTGCA<br>CTGTCTCTGGTGGCTCCATCAGCAGTGGTGGTTA<br>CTACTGGAGCTGGATCCGGCAGCACCAGGAA<br>GGGCTGGAGTGGATTGGGTACATCTATTACGTT<br>GGGAGCACCTACTACAACCCGTCCCTCAAGAGTC<br>GAGTTACCATATCAGTAGACACGTCTAAGAACCA<br>GTTCTCCCTGAAGCTGAGTTCTGTGACTGCCGCG<br>GACACGGCCGTGTATTACTGTGCGAGAGATGGG<br>CCATTGAGCGGTATGAGCGTCTGGGCCAAGGG<br>ACCACGGTCACCGTCCTCA<br><br>SEQ ID NO: 31731 |
| | | AA | QTVVTQEPSLTVSPGGTVTLTCAFSTGAVTSGNY<br>PSWFQQKPGQVPRALIYSTSNRHSWTPARFSGSL<br>LGGKAALTLSGVQPEDEAEYYCLLYYGGAQLV<br>FGGGTKLTVL<br><br>SEQ ID NO: 27726 | QVQLQESGPGLVKPSQTLSLTCTVSGGSISSGGYYW<br>SWTRQHPGKGLEWIGYIYYVGSTYYNPSLKSRVTIS<br>VDTSKNQFSLKLSSVTAADTAVYYCARDGPLSGM<br>DVWGQGTTVTVSS<br><br>SEQ ID NO: 31732 |
| iPS:437108 | 21-225_211C9 | NA | CAGACTGTGTGACTCAGGAGCCCTCACTGAC<br>TGTGTCCCCAGGAGGGACAGTCACTCTCACCT<br>GTGGTTCCAGCACTGGATCAGTCAGCAGTGGT<br>TACTTTCCAAACTGGTTCCAGCAGAAACCTGG<br>ACAAGCACCCAGGCCACTCCTGGACCCTGTTC<br>ACAACAAGCACTCCTGGACCCTGCCCGGTTC<br>TCAGGCTCCCTCCTTGGGGGCAAAGCTGCCT<br>GACACTGTCAGATGTGCAGCCTGAGGACGAG<br>GCTGACTATTACTGCCTGCTCTACTATGGTGGT<br>GCTCAGCTGGCATTCGGCGGAGGGACCAAACT<br>GACCGTCCTA<br><br>SEQ ID NO: 27727 | CAGGTGCAGCTGCAGGAGTCGGGCCCAGGACTG<br>GTGAAGCCTTCACAGACCCTGTCCCTCACCTGCA<br>CTGTCTCTGGTGGCTCCATCAGAAGTGGTGGTGA<br>CTACTGGAGCTGGATCCGCCAGCACCAGGAA<br>GGGAGCACCTACTACAACCCGTCCCTCAAGAGTC<br>GAGTTACCATATTACTGAGACACGTCTAAGAACCA<br>GTTCTCCCTGAAGCTGAGTCTGTGACTGCCGCG<br>GACACGGCCGTGTATTACTGTGCGAGAGATTCAG<br>CAGTGTACAATATGGACGTCTGGGGCCAAGGGA<br>CCACGGTCACCGTCTCCTCA<br><br>SEQ ID NO: 31733 |

FIGURE 50
(Continued)

| | | | | |
|---|---|---|---|---|
| iPS:437110 | 21-225_211E9 | AA | QTVVTQEPSLTVSPGGTVTLTCGSSTGSVTSGYFPNWFQQKPGQAPRPLIYSTNNKHSWTPARFSGSLLGGKAALTLSDVQPEDEADYYCLLYYGGAQLAFGGGTKLTVL | QVQLQESGPGLVKPSQTLSLTCTVSGGSIRSGGDYWSWIRQHPGKGLEWIGYIYYSGSTYYNPSLKSRVTILLDTSKNQFSLKLSSVTAADTAVYYCARDSAVYNMDVWGQGTTVTVSS |
| | | | SEQ ID NO: 27728 | SEQ ID NO: 31734 |
| | | NA | CAGACTGTGGTGACTCAGGAGCCCTCACTGACTGTGTCCCCAGGAGGGACAGTCACTCTCACCTGTGCTTCCAGCACTGGAGCAGTCACCAGTGGTAACTATCCAAACTGGTTCCAGCAGAAACCTGGACAAGCACCCAGGACCACTGATTTATAGTACAATCAACAAACACTCCGGGACCCCTGCCCGGTTTACAGGCTTCCTCCTTGGGGGCAAGCTGCCCTGACACTGTCAGGTGTACAGCCTGAGGACGAGGCTGAGTATTACTGCCTGCTCTACTATGGTGGTGCTCAGCTGGCATTCGGCGGAGGGACCAAGCTGACCGTCCTA | CAGGTGCAGCTGCAGGAGTCGGGCCCAGGACTGGTGAAGCCTTCACAGACCCTGTCCCTCACCTGCACTGTCTCTGGTGGCTCCATCAGCAGTGGTGGTGACTACTGGAGCTGGATCCGCCAGCACCCAGGGAAGGGCCTGGAGTGGATTGGGTACATCTATTACACTGGGAGCAACTACTACAACCCGTCCCTCAAGAGTCGAGTTACCATATCAGTAGACACGTCTAAGAACCAGTTCTCCCTGAACCTGAGCTCTGTGACTGCCGCGGACACGGCCGTGTATTACTGTGCGAGAGATTCAGCAGTGTACGGTATGGACGTCTGGGGCCAAGGGACCACGGTCACCGTCTCCTCA |
| | | | SEQ ID NO: 27729 | SEQ ID NO: 31735 |
| | | AA | QTVVTQEPSLTVSPGGTVTLTCASSTGAVTSGNYPNWFQQKPGQAPRALIYSTINKHSGTPARFTGFLLGGKAALTLSGVQPEDEAEYYCLLYYGGAQLAFGGGTKLTVL | QVQLQESGPGLVKPSQTLSLTCTVSGGSISSGGDYWSWIRQHPGKGLEWIGYIYYTGSNYYNPSLKSRVTISVDTSKNQFSLNLISVTAADTAVYYCARDSAVYGMDVWGQGTTVTVSS |
| | | | SEQ ID NO: 27730 | SEQ ID NO: 31736 |

FIGURE 50
(Continued)

| | | | | |
|---|---|---|---|---|
| iPS:437112 | 21-225_212C2 | NA | CAGTCTGCCCTGACTCAGCCTGCCTCCGTGTCTGGGTCTCCTGGACAGTCGATCACCATCCCTGCACTGGAACCAGCAGTGACGTTGGTGGTTATAACTATGTCTCCTGGTACCAACAACCAGGCAAAGCCCCCAAACTCATGATTTATGAGGTCAGAAATCGGCCCTCAAGTCTGGCAACACGGCTCCTCTCTGGCTCCAAGTCTGGGCTCCAGGCTGAGGACGAGGCACCATCTCTGGGCTCCAGGCTGAGGACGAGGCTGATTATTACTGCAGCTCATATACACGCAGCATCACTTGGGTGTTCGGCGGAGGGACCAAGCTGACCGTCCTA | CAGGTGCAACTGGTGGAGTCTGGGGGAGGCGTGGTCCAGCCTGGGAGGTCCCTGAGACTCTCCTGTGCAGCGTCTGGATTCACCTTCAGTCAGTCACTATGGCATGCACTGGGTCCGCCAGGCTCCAGGCAAGGGCTGGAGTGGGTGGCAGTTATATGGTATGATGAAGTAATAAATACTATGCAGAGACAATTCCAAGAACACGCTTCACCATCTCCAGAGACAATGAACAGCCTGAGAGCCGAGGTGTATCTGCAAATGAACAGCCTGAGAGCCGAGACACGGCTGTGTATTACTGTGCGAGGGGGACTGGAACCCCGAGGGTATGGACGTCTGGGGCCAAGGGACCTCGGTCACCGTCTCCTCA |
| | | | SEQ ID NO: 27731 | SEQ ID NO: 31737 |
| | | AA | QSALTQPASVSGSPGQSITISCTGTSSDVGGYNYVSWYQQHPGKAPKLMIYEVRNRPSGVSNRFSGSKSGNTASLTISGLQAEDEADYYCSSYTRSITWVFGGGTKLTVL | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGMDVWGQGTSVTVSS |
| | | | SEQ ID NO: 27732 | SEQ ID NO: 31738 |
| iPS:437114 | 21-225_212A4 | NA | CAGTCTGCCCTGACTCAGCCTGCCTCCGTGTCTGGGTCTCCTGGACAGTCGATCACCATCCCTGCACTGGAACCAGCAGTGACGTTGGTGGTTATAACTATGTCTCCTGGTACCAACAACCAGGCAAAGCCCCCAAACTCATGATTTATGAGGTCAGTAATCGGCCCTCAAGTGGGTTTCTAATCGCTTCTCTGGCTCCAAGTCTGGCAACACGGCCTCCCTGACCATCTCTGGGCTCCAGGCTGAGGACGAGGCTGATTATTACTGCTCGGCTCATATGTAAAGGCATCACTTGGGTGTTCGGCGGAGGGACCAGTCTAACCGTCCTC | CAGGTGCACCTGGTGCACTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGCTGGAGTGGGTGGCAGTTATATGGTATGATGAAGTAATAAATACTATGCAGAGACAATTCCAAGAACACGCTTCACCATCTCCAGAGACAATGAACAGCCTGAGAGCCGAGGTGTATCTGCAAATGAACAGCCTGAGAGCCGAGACACGGCTGTGTATTACTGTGCGAGGGGGACTGGAACCCCGAGGGTATGGACGTCTGGGGCCAAGGGACCACCAGGGTCATCGTCTCCTCA |
| | | | SEQ ID NO: 27733 | SEQ ID NO: 31739 |

FIGURE 50
(Continued)

| | | | |
|---|---|---|---|
| iPS:437116 | 21-225_212F6 | AA | QSALTQPASVSGSPGQSITISCTGTSSDVGGYNYVSWYQQHPGKAPKLMIYEVSNRPSGVSNRFSGSKSGNTASLTISGLQAEDEADYYCGSYVKGITWVFGGGTSLTVL<br>SEQ ID NO: 27734 | QVHLVESGGGVVQAGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVIVSS<br>SEQ ID NO: 31740 |
| | | NA | CAGGTGTCAGCTGTGGAGTCTGGGGGAGGCGTGGTCCAGCTGGGGAGGTCCCTGAGACTCTCCTGTCAGCGTCTGGATTCACCTTCAGTCAGTCACTATGCATGCACTGGGTCCGCCAGGCTCCAGGCAAGGGGCTGGAGTGGGTGGCAGTTATAGTTATGATGGAAGTAATAAATACTATGCGACTCCGTGAAGGGCCGATTCACCATCTCCAGAGACAACAATTCCAAGAACACGCTGTATCTGCAAATGAACAGCCTGAGAGCCGAGGACACGGCTGTGTATTACTGTGCGAGGGGGACTGGAACCCGAGGGTTTGGACGTCTGGGCCAAGGGACCACGGTCACCGTCTCCTCA<br>SEQ ID NO: 31741 | |
| | | AA | QSALTQPASVSGSPGQSITISCTGTSSDVGGYNYVSWYQQYPGKAPKLMIYEVSNRPSGVSNRFSGSKSGNTASLTISGLQAEDEADYYCNSYTSSITWVFGGGTKLTVL<br>SEQ ID NO: 27736 | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS<br>SEQ ID NO: 31742 |

FIGURE 50
(Continued)

| | | | |
|---|---|---|---|
| iPS:437118 | 21-225_212G7 | NA | CAGTCTGCCCTGACTCAGCCTGCCTCCGTGTCT GGGTCTCCTGGACAGTCGATCACCATCCTG CACTGGAACCAGCAGTGACGTTGGTGGTTATA ATTATGTCTCTGGTACCAACAGCACCCAGGC AAAACCCCAAACTCATGATTTATGAGGTCAG TAATCGGCCCTCAGGGGTTTCTAATCGCTTCTC TGGCTCCAAGTCTGGCAACACGGCCTCCCTGA CCATCTCTGGGCTCCAGGCTGAGGACGAGGCT GATTATTACTGCAACTCATATACAAGCAGCAT CACTTGGGGTGTTCGGCGGAGGGACCAAGCTGA CCGTCCTA<br>SEQ ID NO: 27737 | CAGGTGCAGTTGGTGGAGTCTGGGGGGAGGCGTG GTCCAGCCTGGGAGGTCCCTGAGACTCTCCTGTG CAGCGTCTGGATTCACCTTCAGTCAGTCACTATGGCAT GCACTGGGTCCGCCAGGCTCCAGGCAAGGGCT GGAGTGGGTGGCAGTTATATGTATGATGGAAGT AATAAATACTGTGCAGACTCCGTGAAGGGCCGA TTCACCATCTCCAGAGACAATTCCACGAACACGC TGTATCTGCAAATGAACAGCCTGAGAGCCGAGG ACACGGCTGTGTATTACTGTGCGAGGGGAGACTG AACCCCGAGGGTTTGGACGTCTGGGGCCAAGG GACCACGGTCACCGTCTCCTCA<br>SEQ ID NO: 31743 |
| | | AA | QSALTQPASVSGSPGQSITISCTGTSSDVGGYNY VSWYQQHPGKTPKLMIYEVSNRPSGVSNRFSGS KSGNTASLTISGLQAEDEADYYCNSYTSSITWVF GGGTKLTVL<br>SEQ ID NO: 27738 | QVQLVESGGGVVQPGRSLRLSCAASGFTFSHYGM HWVRQAPGKGLEWVAVIWYDGSNKYCADSVKGR FTISRDNSTNTLYLQMNSLRAEDTAVYYCARGDW NPEGLDVWGQGTTVTVSS<br>SEQ ID NO: 31744 |
| iPS:437120 | 21-225_212A9 | NA | CAGACTGTGGTGACTCAGGAGCCCTCACTGAC TGTGTCCCCAGGAGGACAGTCACTCTCACCT GTGCTTCCAGCACTGGAGCAGTGACAGTCGGT TACTATCCAAACTGGTTCCAGCAGAAACCTGG ACAAGCACCCAGGGCACTGATTTATAGTACAA ACAACAAACACTCCTGGACCCTGACCCTGACCCCGGTTC TCAGGCTCCCCTCCTTGGGGGCAAAGCTGCCCT GACACTGTCAGGTGTACAGCCTGACGAGAGG CTGACTATTACTGCCTGCTCTACTATGGTGTG CTCAGGTGGGATTCGGCGGAGGGACCAAGCT GACCGTCCTA<br>SEQ ID NO: 27739 | CAGGTGCAGCTGCAGGAGTCGGGCCCAGGACTG GTGAAGCCTTCACAGACCCTGTCCCTCACCTGCA GTGTCTCTGGTGGCTCCATCAGAAGTGGTGGTGA CTACTGGAGCTGGATCCGCCAGCACCCAGGGAA GGGAGCACTACTACACCCGTCCCTCAAGAGTC GAGTTACCATATCAGTAGACACGTCTAAGAACCA GTTCTCCCTGAAGCTGAGTTCTGTGACTGTCGCG GACACGCCGTGTATTACTGTGCGCGAGATTCAG CAGTGTACGGTATGGACGTCTGGGGCCAAGGA CCACGGTCACCGTCTCCTCA<br>SEQ ID NO: 31745 |

FIGURE 50
(Continued)

| | | | | |
|---|---|---|---|---|
| iPS:437124 | 21-225_212H12 | AA | QTVVTQEPSLTVSPGGTVTLTCASSTGAVTSGYYPNWFQQKPGQAPRALIYSTNKHSWTPARFSGSLLGGKAALTLSGVQPDDEADYYCLLYYGGAQVGFGGGTKLTVL<br>SEQ ID NO: 27740 | QVQLQESGPGLVKPSQTLSLTCSVSGGSIRSGGDYWSWIRQHPGKGLEWIGYMYYSGSTYYNPSLKSRVTISVDTSKNQFSLKLSSVTAADTAVYYCARDSAVYGMDVWGQGTTVTVSS<br>SEQ ID NO: 31746 |
| | | NA | CAGACTGTGGTGACTCAGGAGCCCTCACTGACTGTGTCCCAGGAGGACAGTCACTCTCACCTGTGCTTCCAGCACTGGAGCAGTCACCAGTGGTTACTATCCAAACTGGTTCCAGCAGAAACCTGGACAAGCACCCAGGGCACTGATTTATAGTACAAGCAACAAACACTCCTGGACCCCTGCCCGGTTCTCAGGCTCCCTCCTTGGGGGCAAGCTGCCCTGACACTGTCAGGTGTGCAGCCTGAGGACGAGGCTGAGTATTACTGCCTGCTCTACTATGGTGGTGCTCATGTGGTATTCGGCGGAGGGACCAAGCTGACCGTCCTA<br>SEQ ID NO: 27741 | CAGGTGCAGCTGCAGGAGTCGGGCCCAGGACTGGTGAAGCCTTCACAGACCCTGTCCCTCACCTGCACTGTCTCTGGTGGCTCCATCAGAAGTGGTGGTGACTACTGGAGTTGGATCCGCCAGCACCCAGGGAAGGGCCTGGAGTGGATTGGGTACATGTATTACAGTGGGAGCACCTACTACAACCCGTCCCTCAAGAGTCGAGTTACCATATCAGGAGACACAGTCTAAGAACCAGTTCTCCCTGAAGCTGAGCTCTGTGACTGCCGCTGGACACGGCCGTGTATTACTGTGCGAGGGATAGCAGTCCTACGGTATGGACGTCTGGGGCCAAGGGACCACGGTCACCGTCCTCCTCA<br>SEQ ID NO: 31747 |
| | | AA | QTVVTQEPSLTVSPGGTVTLTCASSTGAVTSGYYPNWFQQKPGQAPRALIYSTNKHSWTPARFSGSLLGGKAALTLSGVQPEDEAEYYCLLYYGGAHVVFGGGTKLTVL<br>SEQ ID NO: 27742 | QVQLQESGPGLVKPSQTLSLTCTVSGGSIRSGGDYWSWIRQHPGKGLEWIGYIYYSGSTYYNPSLKSRVTISGDTSKNQFSLKLSSVTAADTAVYYCARDSSSYGMDVWGQGTTVTVSS<br>SEQ ID NO: 31748 |

FIGURE 50
(Continued)

| | | | |
|---|---|---|---|
| iPS:437128 | 21-225_213G3 | NA | CTGTCTGCCCTGACTCAGCCTGCTCCGTGTCT GGGTCTCCTGGACAGTCGATCACCATCTCCTG CACTGGAACCAGCAGTGACGTTGGTGGTTATA ACTATGTCTCCTGGTACCAACAACACCAGGC AAAGCCCCCAAACTCATGATTTCTGAGGTCAG GAATCGGCCCTCAGGGGTTTCTAATCGCTTCT CTGGCTCCAAGTCTGGCAACACGGCCTCCCTG ACCATCTCTGGGCTCCAGGCTGAGGACGAGGC TGATTATTACTGCAACTCATATACACGCAGCA TCACTTGGGGTGTTCGGCGGAGGGACCAAGCTG ACCGTCCTA<br>SEQ ID NO: 27743 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCAGTCACTATGGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGCATCTGCAAATGAACAGCCTGAGAGCCGAGG ACACGGCTGTGTATTACTGTGCGAGGGGGACTG GAACCCGAGGGTATGGACGTCTGGGGCCAAGG GACCTCGGTCACCGTCCTCA<br>SEQ ID NO: 31749 |
| | | AA | LSALTQPASVSGSPGQSITISCTGTSSDVGGYNYV SWYQQHPGKAPKLMISEVRNRPSGVSNRFSGSK SGNTASLTISGLQAEDEADYYCNSYTRSITWVFG GGTKLTVL<br>SEQ ID NO: 27744 | QVQLVESGGGVVQPGRSLRLSCAASGFTFSHYGM HWVRQAPGKGLEWVAVIWYDGSNKYYADSVKGR FTISRDNSKNTLHLQMNSLRAEDTAVYYCARGDW NPEGMDVWGQGTSVTVSS<br>SEQ ID NO: 31750 |
| iPS:437130 | 21-225_213D5 | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ACTATGTCTCCTGGTACCAACAACACCAGGC AAAGCCCCCAAACTCGTGATTTATGAGGTCAG TAATCGGCCCTCAGGGGTTTCTACTCGCTTCTC TGGCTCCAAGTCTGGCAACAAGGCCTCCCTGA CCATCTCTGGGCTCCAGGCTGAGGACGAGGCT GATTATTACTGCTCTCATATACAAGAAGAAT CACTTGGGTGTTCGGCGGAGGGACCAAGCTGA CCGTCCTG<br>SEQ ID NO: 27745 | CAGGTGCAGCTGGTGGAGTCTGGGGGAGGCGTG GTCCAGCCTGGGAGGTCCCTGAGACTCTCCTGTG CAGCGTCTGGATTCACCTTCAGTCACTATGCAT GCACTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATTCCAAGAACACGC TGTTTCTGCAAATGAACAGCCTGAGAGTCGAGGA CACGGCTGTGTATTATTGTGCGAGGGGGACTGG AACCCGAGGGTATGGACGTCTGGGGCCAAGGG ACCACGGTCACCGTCTCCTCA<br>SEQ ID NO: 31751 |

FIGURE 50
(Continued)

| | | | |
|---|---|---|---|
| iPS:437132 | 21-225_213F5 | AA | QSALTQPASVSGSPGQSITISCTGTSSDVGGYNYVSWYQQHPGKAPKLVIYEVRNRPSGVSTRFSGSKSGNKASLTISGLQAEDEADYYCCSYTRRITWVFGGGTKLTVL<br>SEQ ID NO: 27746 | QVQLVESGGGVVQPGRSLRLSCAASGFTFSHYGMHWVRQAPGKGLEWVAVIWYDGSNKYYADSVKGRFTISRDNSKNTLFLQMNSLRVEDTAVYYCARGDWNPEGMDVWGQGTTVTVSS<br>SEQ ID NO: 31752 |
| | | NA | CAGACTGTGGTGACTCAGGAGCCCTCACTGACTGTGTCCCAGGAGGACAGTCACTCTCACCTGTGGTTCCAGCACTGGATCAGTCACCAGTGGTTACTTTCCAAACTGGTTCCAGCAGAAACCTGGACAAACACCCAGGCCACTCCTGGACCCCTGCCCGGTTCTCAGGCTCCCTCCCTGGGGCAAAACTGCCCTGACACTGTCAGATGTGCAGCCTGAGGACGAGGCTGACTATTACTGCCTGCTCTACTTTGGTGGTGCTCAGTGGACTTCGGGGAGGGAGGGACCAAAACTGACCGTCCTA<br>SEQ ID NO: 27747 | CAGGTGCAGCTGCAGGAGTCGGGCCCAGGACTGGTGAAGCCTTCACAGACCCTGTCCCTCACCTGCACTGTCTCTGGTGGCTCCATCAGAAGTGGTGGTGACTACTGGAGCTGGATCCGCCAGCACCCAGGGAAGGGCCTGGAGTGGATTGGGTACATCTATTATAGTGGGAGCACCTACTACAACCCGTCCCTCAAGAGTCGAGTTACCATATCACTAGACACGTCTAAGAACCAGTTCTCCCTGAAGCTGAGCTCTGTGACTGTCGCGACACGGCCGTGTATTACTGTGCGAGAGATTCAGCAGTGTACAATATGGACGTCTGGGGCCAAGGGACCACGGTCACCGTCTCCTCA |
| | | AA | QTVVTQEPSLTVSPGGTVTLTCGSSTGSVTSGYFPNWFQQKPGQTPRPLIYSTNNKHSWTPARFSGSLLGGKTALTLSDVQPEDEADYYCLLYFGGAQLAFGGGTKLTVL<br>SEQ ID NO: 27748 | QVQLQESGPGLVKPSQTLSLTCTVSGGSIRSGGDYWSWIRQHPGKGLEWIGYIYYSGSTYYNPSLKSRVTISLDTSKNQFSLKLSSVTVADTAVYYCARDSAVYNMDVWGQGTTVTVSS<br>SEQ ID NO: 31754 |
| | | | | SEQ ID NO: 31753 |

FIGURE 50
(Continued)

| | | | |
|---|---|---|---|
| iPS:437134 | 21-225_213A7 | NA | CAGTCTGTGCCCTGACTCAGCCTGCCTCCGTGTCTGGGTCTCCTGGACAGTCGATCACCATCTCCTGCACTGGAACCAGCAGTGACGTTGGTGGTTATAACTATGTCTCCTGGTACCAACAGCACCCAGGCAAAGCCCCCAAATTCATGATTTATGAGGTCAGGAATCGGCCCTCAGGGGTTTCTAATCGCTTCTCTGGCTCCAAGTCTGGCAACACGGCCTCCCTGACCATCTCTGGGCTCCAGGCTGAGGACGAGGCTGATTATTACTGCAGCTCATATACCAGCAGCGCACTCTGGTATTCGGCGGAGGGACCAAGTTGACCGTCCTA<br>SEQ ID NO: 27749 |
| | | AA | QSALTQPASVSGSPGQSITISCTGTSSDVGGYNYVSWYQQHPGKAPKFMIYEVRNRPSGVSNRFSGSKSGNTASLTISGLQAEDEADYYCSSYTSSRTLVFGGGTKLTVL<br>SEQ ID NO: 27750 |
| | | NA | CAGGTGCAGCTGGTGCAGTCTGGGGCTGAGGTGAAGAAGCCTGGGGCCTCCGTGAAGATCTCCTGCAAGGCTTCTGGATTCACCTTCACCGACTACTATATGAACTGGGTGCGACAGGCCCCTGGACAAGGGCTTGAGTGGATGGGATGGATCAACCCTAAGAATGGTGGCACAAACTATGCACAGAAGTTTCAGGGCAGGGTCACCATGACCAGGGACACGTCCCTCAGCAGAGCCTACATGGAGCTGAGTAGGCTGAGATCTGACGACACGGCCGTGTATTACTGTGCGAAAGGGTATGATTCGTTCGCCCCCTGGGGCCAGGGAACCCTGGTCACCGTCTCCTCA<br>SEQ ID NO: 31755 |
| | | AA | QVQLVQSGAEVKKPGASVKISCRASGFTFTDYYMNWVRQAPGQGLEWMGWINPKNGTNYAQKFQGRVTMTRDTSLSRAYMELSRLRSDDTAVYYCAKGYDSFAPWGQGTLVTVSS<br>SEQ ID NO: 31756 |
| iPS:437136 | 21-225_214H3 | NA | CAGACTGTGGTGACTCAGGAGCCCTCACTGACTGTGTCCCCAGGAGGGACAGTCACTCTCACCTGTGCTTCCAGCACTGGAGCAGTCACCAGTGGTTACTATCCAAACTGGTTCCAGCAGAAACCTGGACAAGCACCACCAGGGCCACTGATTTATAGTACAACAAACAAACACTCCTGTACCCTGCCCTTCAGGGTCTCAGGCTCCCTGGGGCAAGTGCCCTGACACTGTCAGGTGTGCAGCCTGAGGACGAGGCTGAGTATTACTGCCTGCTCTACTATGTGTGCTCATGGTATTACGGGCGGGAGGGACCAAGCTGACCGTCCTA<br>SEQ ID NO: 27751 |
| | | | CAGGTGCAGCTGCAGGAGTCGGGCCCAGGACTGGTGAAGCCTTCACAGACCCTGTCCCTCACCTGCACTGTCTCTGGTGGCTCCATCAGAAGTGGTGGATACTACTGGAGTTGGATTCGCCAGCACCCAGGGAAGGGCCTGGAGTGGATTGGGTACATCTATTACAGTGGGAGCACCTACTACAACCCGTCCCTCAAGAGTCGAGTTACCATATCAGGAGACACGTCTAAGAACCAGTTCTCCCTGAAGCTGAGCTCTGTGACTGCCGCGGACACGGCCGTGTATTACTGTGCGAGGGATAGCAGCTCCTACTAGGTATGACGTCTGGGGCCAAGGGACCACGGTCACCGTCTCCTCA<br>SEQ ID NO: 31757 |

FIGURE 50
(Continued)

| | | | |
|---|---|---|---|
| iPS:437138 | 21-225_214D8 | AA | QTVVTQEPSLTVSPGGTVTLTCASSTGAVTSGYY PNWFQQKPGQAPRALIYSTSNKHSCTPARFSGSL LGGKAALTLSGVQPEDEAEYYCLLYYGGAHVV FGGGTKLTVL | QVQLQESGPGLVKPSQTLSLTCTVSGGSIRSGDY WSWIRQHPGKGLEWIGYIYYSGSTYYNPSLKSRVTI SGDTSKNQFSLKLSSVTAADTAVYYCARDSSSYGM DVWGQGTTVTSS |
| | | | SEQ ID NO: 27752 | SEQ ID NO: 31758 |
| | | NA | CAGTCTGTGTTGACGCAGCCGCCCTCAGTGTC TGGGGCCCCAGGACAGAAGGTCACCATCTCCT GCTCTGGAAGCAGCTCCAACATTGGGAATAAT TATGTATCCTGGTACCAGCAGTTCCCAGGAAC AGCCCCCAAACTCCTCATTCATGACAATAATA AGCGACCCTCAGGGATTCCTGACCGATTCTCT GGCTCCAAGTCTGGCACGTCAGCCACCCTGG CATCACCGGACTCCAGACTGGGGACGAGGCC GATTATTACTGCGGAGCATGGGATAGCAGCCT GAGTGCTGTGGTAATCGGGGGAGGGGAGCAAG CTGACCGTCCTA | CAGGTGCAGCTGCAGGAGTCGGGCCAGGACTG GTGAAGCCTTCACAGACCCTGTCCCTCACCTGCA CTGTCTCTGGTGGCTCCATCAGTACTGCTTTTTAC TACTGGAGCTGGATCCGCCAGCACCCAGGAAG GGCCTGGAGTGGATTGGGTACATCTATTTCAGTG GGAGCACCTACTACAACCCGTCCCTCAAGAGTCG AGTTACCATATCAGTAGACACGTCTAAGAACCAG TTCTCCCTGAACCTGAGCTCTGTGCCGAGAGCAGGCAAGG ACACGGCCGTGTATTACTGTGCGAGAGCAAGG GATATCACTACAGTATCTTTGACTACTGGGGCCA GGGAACCCTGGTCACCGTCTCCTCA |
| | | | SEQ ID NO: 27753 | SEQ ID NO: 31759 |
| | | AA | QSVLTQPPSVSAAPGQKVTISCSGSSSNIGNNYVS WYQQFPGTAPKLLIHDNNKRPSGIPDRFSGSKSG TSATLGITGLQTGDEADYYCGAWDSSLSAVVIG GGSKLTVL | QVQLQESGPGLVKPSQTLSLTCTVSGGSISTAFYYW SWIRQHPGKGLEWIGYIYFSGSTYYNPSLKSRVTIS VDTSKNQFSLNLSSVTAADTAVYYCARARGYHYSI FDYWGQGTLVTVSS |
| | | | SEQ ID NO: 27754 | SEQ ID NO: 31760 |

FIGURE 50
(Continued)

| | | | |
|---|---|---|---|
| iPS:437140 | 21-225_214E12 | NA | CAGACTGTGGTGACTCAGGAGCCCTCACTGAC TGTGTCCCAGGAGGACAGTCACTCTCACCT GTGCTTCCAGCACTGAGCAGTCAGTCACCAGTGGC TACTATCCAAACTGGTTCCAACAGAAACCTGG ACAAGCACCCAGGGCACTGATTTATAGTACAA GCAATAAACACTCCTGGACCCTGCCCGTTC TCAGGCTCCCTCCTTGGGGGCAAAGCTGCCT GACACTGTCAGATGTGCCTGCTCTACTGTGATGGT GCTGAGTATTACTGCCTGCTCTACTGTGATGGT GCCCAGCTGTGTTCGGCGGAGGGACCAAACT GACCGTCCTA<br><br>SEQ ID NO: 27755 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTGA TTACTGGAGCTGGATCCGCCAGCACCCAGGAA AGGGCCTGGAGTGGATTGGGTACATCTATTACAGT GGGCCACCACTACTACAACCCGTCCTCAAGAGTC GAGTTACCATATCAGTAGACACGTCTAAGAACCA GTTCTCCCTGAAGCTGAGCTCTGTGACTGCCGCG GACACGGCCGTGTATTATTGTGCGAGAGATGGGG CTGCGGAGGGTATGACGTCTGGGGCCAAGGGA CCACGGTCACCGTCCTCTCA<br><br>SEQ ID NO: 31761 |
| | | AA | QTVVTQEPSLTVSPGGTVTLTCASSTGAVTSGYY PNWFQQKPGQAPRALIYSTSNKHSWTPARFSGS LLGGKAALTLSDVQPEDEAEYYCLLYCDGAQL VFGGGTKLTVL<br><br>SEQ ID NO: 27756 | QVQLQESGPGLVKPSQTLSLTCTVSGGSISSGGDYW SWIRQHPGKGLEWIGYIYYSGPTYYNPSLKSRVTIS VDTSKNQFSLKLSSVTAADTAVYYCARDGAAEGM DVWGQGTTVTVSS<br><br>SEQ ID NO: 31762 |
| iPS:437142 | 21-225_215A3 | NA | CAGACTGTGGTGACTCAGGAGCCCTCACTGAC GGTGTCCCAGGAGGACAGTCACTCTCACCT GTGCTTCCAGCACTGAAGCCGTCACCAGTGGT AACTATCCAAGTGGTTCCAGCAGAAACTGG ACAAGCACCCAGGGCACTGATTTATAGTACAA GCAACAAACACTCCGGTACCCCTGCCCGTTT ACAGGCTCCCTCCTTGGGGGCAAAGCTGCCT GACACTGTCAGGTGTACAGCTGAGGACGAG GCTGAGTATTACTGCCTGCTCTACTATGTGG CGCTCAGGTAGCTGGCATTCGGCGGAGGGACCAAGC TGGCCGTCCTA<br><br>SEQ ID NO: 27757 | CAGGTGCAGTTGCAGGAGTCGGGCCCAGGACTG GTGAAGCCTTCACAGACCCTGTCCCTCACCTGCA CTGTCTCTGGTGGCTCCATCAGCAGTGGTGGTGA CTACTGGAGCTGGATCCGCCAGCACCCAGGGAA GGGAGCAACTACTACAACCCGTCCCTCAAGAGTC GAGTTACCATATCAGTAGACACGTCTAAGAATCA GTTCTCCCTGAAGGTGATCTGTGACTGCCGCG GACACGGCCGTGTATTACTGTGCGAGAGATTCAG CAGTGTACGGTATGGACGTCTGGGGCCAAGGGA CCACGGTCACCGTCTCCTCA<br><br>SEQ ID NO: 31763 |

FIGURE 50
(Continued)

| | | | |
|---|---|---|---|
| iPS:437144 | 21-225_215B3 | AA | QTVVTQEPSLTVSPGTVTLTCASSTEAVTSGNYPSWFQQKPGQAPRALIYSTSNKHSGTPARFTGSLLGGKAALTLSGVQPEDEAEYYCLLYYGGAQLAFGGGTKLAVL<br>SEQ ID NO: 27758 | QVQLQESGPGLVKPSQTLSLTCTVSGGSISSGGDYWSWIRQHPGKGLEWIGYIYYTGSNYYNPSLKSRVTISVDTSKNQFSLKVISVTAADTAVYYCARDSAVYGMDVWGQGTTVTVSS<br>SEQ ID NO: 31764 |
| | | NA | TCCTATGAGCTGACTCAGCCACCCTCAGTGTCCGTGTCCCCAGGACAGACAGCCAGCATCACCTGCTCTGGAGATAAATTGGGGATAAAATTTGCTTGCTGGTATCAGCAGAAGCCAGGCCAGTCCCCTGTGCTCGGTCATCTATCAAGATAGCAAGCGGCCCTCAGGGATCCCTGAGCGATTCTCTGGCTCCAACTCTGGGAACACAGGCTATGATGAGGCTGACTATTACTGTGCAGGCGTGGGACAGCAGCACTGTGGTATTCGGCGGAGGGACCAAGCTGACCGTCCTA<br>SEQ ID NO: 27759 | GAGGTGCAGCTGGTGGAGTCTGGGGGAGGCTTGGTAAAGCCTGGGGGGTCCCTTAGACTCTCCTGTGCAGCCTCTGGATTCACTTTCAGTAACGCTGGATGCACTGGGTCCGCCAGGCTCCAGGGAAGGGCTGGAGTGGGTTGGCCGTATTACGCAAAACTAATGGTGGGACAACAGACTACGCTGCACCCGTGAAAGGCAGATTCACCATTTCAAGAGATGATTCAAAAACACGCTGTATCTGCAAATGAACAGCCTGAAACCGAGGACACAGCCGTGTATTACTGTACCACAGATCCGGGGGGATCTTTGACTACTGGGGCCAGGGAACCCTGGTCACCGTCTCCTCA<br>SEQ ID NO: 31765 |
| | | AA | SYELTQPPSVSVSPGQTASITCSGDKLGDKFACWYQQKPGQSPVLVIYQDSKRPSGIPERFSGSNSGNTATLTISGTQAMDEADYCQAWDSSTVVFGGGTKLTVL<br>SEQ ID NO: 27760 | EVQLVESGGGLVKPGGSLRLSCAASGFTFSNAWMHWVRQAPGKGLEWVGRIKSKTNGGTTDYAAPVKGRFTISRDDSKNTLYLQMNSLKTEDTAVYYCTTDPGGIFDYWGQGTLVTVSS<br>SEQ ID NO: 31766 |

FIGURE 50
(Continued)

| | | | |
|---|---|---|---|
| iPS:437146 | 21-225_215D3 | NA | CAGTCTGTGCCCTGACTCAGCCTGCCTCCGTGTCTGGGTCTCCTGGACAGTCGATCACCATCTCCTGCACTGGAACCAGCAGTGACATTGGTGGTTATAACTATGTCTCCTGGTACCAACAACCAGGCAAAGCCCCACACTCATGATTTATGAGGTCAGTAATCGGCCCTCAGGGGTTTCTAATCGCTTCTCTGGCTCCAAGTCTGGCAACACGGCCTCCCTGACCATCTCTGGGCTCCAGGCTGAGGACGAGGCTGATTATTACTGCAACTCATATAAAAGGGCAGCACTTGGGGTGTTCGGCGGAGGGACCAAGGTGACCGTCCTA SEQ ID NO: 27761 | CAGACGCAGCTGGTGGAGTCTGGGGGAGGCGTGGTCCAGCCTGGGAGGTCCCTGAGACTCTCCTGTCAGCGTCTGGATTCACCTTCAGTCAGTCACTATGGCATGCACTGGGTCCGCCAGGCTCCAGGCAAGGGCTGGAATGGGTGGCAGTTATATGGTATGATGAAGTAATGAGTACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGGGGACTGGAACCCGAGGGTATGGACGTCTGGGGCCAAGGGACCACGGTCACCGTCTCCTCA SEQ ID NO: 31767 |
| | | AA | QSALTQPASVSGSPGQSITISCTGTSSDIGGYNYVSWYQQHPGKAPTLMIYEVSNRPSGVSNRFSGSKSGNTASLTISGLQAEDEADYYCNSYKRGSTWVFGGGTKVTVL SEQ ID NO: 27762 | QTQLVESGGGVVQPGRSLRLSCAASGFTFSHYGMHWVRQAPGKGLEWVAVIWYDGSNEYYADSVKGRFTISRDNSKNTLYLQMNSLRAEDTAVYYCARGDWNPEGMDVWGQGTTVTVSS SEQ ID NO: 31768 |
| iPS:437148 | 21-225_215H3 | NA | CAGACTGTGTGACTCAGGAGCCCTCACTGACTGTGTCCCCAGGAGGGACAGTCACTCTCACCTGTGCTTCCAGCACTGGAGCAGTCACCAGTGGTTACTATCCAAACTGGTTCCAGCAGAAACCTGGACAAGCACCCAGGGCACTGATTTATAGTACAACAACAAAACACTCCTGTGGACCTGCCCTTCAGGCTCCTCCTTGGGGGCAAAGTGCCCTGACACTGTCAGGGTGTACAGCCTGAGACGAGGCTGACTATTACTGCCTCTCTACTATGGTGTGCTCAGGTGGGATTCGGCGGAGGGACCAAGCTCACCGTCCTA SEQ ID NO: 27763 | CAGGTGCAGCTGCAGGAGTCGGGCCCAGGACTGGTGAAGCCTTCACAGACCCTGTCCTCACCTGCACTGTCTCTGGTGGCTCCATCAGAAGTGGTGGTGACTACTGGAGCTGGATCCGCCAGCACCCAGGGAAGGGCCTGGAGTGGATTGGGTATATCCCTCAAGAGTCGAGTTACCATATCAGTAGACACGTCTAAGAACCAGTTCTCCCTGAAGCTGAGTTCTGTGACTGCTGCGGACACGGCCGTGTATTACTGTGCGAGATTCAGCAGTGTACGGTATGGACGTCTGGGGCCAAGGGACCACGGTCACCGTCTCCTCA SEQ ID NO: 31769 |

FIGURE 50
(Continued)

| | | | | |
|---|---|---|---|---|
| iPS:437150 | 21-225_216A3 | AA | QTVVTQEPSLTVSPGTVTLTCASSTGAVTSGYYPNWFQQKPGQAPRALIYSTNNKHSCGPARFSGSLLGKAALTLSGVQPDDEADYYCLLYYGGAQVGFGGGTKLTVL<br>SEQ ID NO: 27764 | QVQLQESGPGLVKPSQTLSLTCSVSGGSIRSGGDYWSWIRQHPGKGLEWIGYMYYSGSTYYNPSLKSRVTISVDTSKNQFSLKLSSVTADTAVYYCARDSAVYGMDVWGQGTTVTSS<br>SEQ ID NO: 31770 |
| | | NA | CAGTCTGCCCTGACTCAGCCTGCCTCCGTGTCTGGGTCTCCTGGAACAGTCAGTGATCACCATCTGCACTGGAACCAGCAGTGACGTTGGTGGTTATAATTATGTCTCCTGGTACCAACAACACCCAGGCAAAGCCCCCAAACTCATGATTTATAGTAATAACGCTCCCAAGTCTGGCAACACGGCCTCCTGAGCCTCTCTGGCTCCAAGTCTGGCAACACGGCCTCCTGACCATCTCTGGGCTCCAGGCTGAGGACGAGGCTGATTATTACTGCAACTCATATACAAGCAGCATCACTTGGGTGTTCGGCGGAGGGACCAAGCTGACCGTCCTA<br>SEQ ID NO: 27765 | CAGGTGCAGCTGGTGGAGTCTGGGGGAGGCGTGGTCCAGCCTGGGAGGTCCCTGAGACTCTCCTGTGCAGCGTCTGGATTCACCTTCAGTCAGTCACTATGGCATGCACTGGGTCCGCCAGGCTCCAGGCAAGGGGCTGGAGTGGGTGGCAGTTATATGCAGACTCCGTGAAGGGCCGAAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGGGGACTGGAACCCGAGGGTTTGGACGTCTGGGGCCAAGGGACCACGGTCACCGTCTCCTCA<br>SEQ ID NO: 31771 |
| | | AA | QSALTQPASVSGSPGQSITISCTGTSSDVGGYNYVSWYQQHPGKAPKLMIYEVSNRPSGVSNRFSGSKSGNTASLTISGLQAEDEADYYCNSYTSSITWVFGGGTKLTVL<br>SEQ ID NO: 27766 | QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS<br>SEQ ID NO: 31772 |

FIGURE 50
(Continued)

| | | | |
|---|---|---|---|
| iPS:437154 | 21-225_216A7 | NA | CAGACTGTGGTGACTCAGGAGCCCTCACTGAC TGTGTCCCCAGGAGGGACAGTCACTCTCACCT GTGCTTCCAGCACTGGAGCAGTCAGTCACCAGTGGT TACTATCCAAACTGGTTCCAGCAGAAACCTGG ACAAGCACCCAGGGCACTGATTTATAGTACAA ACAAACACCCCTGTACCCTGCCGGTTC TCAGGGCTCCCTCCTTGGGGCAAAGCTGCCT GACACTGTCAGGTGTACAGCCTGAGGACGAGG CTGACTATTACTGCCTGCTCTACTATGGTGGT CTCAGGTGGGATTCGGCGGAGGGACCAAGCT GACCGTCCTA<br><br>SEQ ID NO: 27767 | CAGGTGCAGCTGCAGGAGTCGGGCCCAGGACTG GTGAAGCCTTCACAGACCCTGTCCTCACCTGCA GTGTCTCTGGTGGCTCCATCAGCAGAAGTGGTGGTGA CTACTGGAGCTGGATCCGCCAGCACCCAGGAA GGGCCTGGAGTGGATTGGGTATATGTATTACAGT GGGAGCACCTACTACAACCCGTCCCTCAAGAGTC GAGTTACCATATCAGTAGACACGTCTAAGAACCA GTTCTCCCTGAAGCTGAGTTCTGTGACTGTCGCG GACACGGCCGTGTATTACTGTGCGAGATTCAG CAGTGTACGGTATGGACGTCTGGGGCCAAGGGA CCACGGTCACCGTCCTCA<br><br>SEQ ID NO: 31773 |
| | | AA | QTVVTQEPSLTVSPGGTVTLTCASSTGAVTSGYY PNWFQQKPGQAPRALIYSTNNKHSCTPARFSGSL LGGKAALTLSGVQPDDEADYYCLLYYGGAQVG FGGGTKLTVL<br><br>SEQ ID NO: 27768 | QVQLQESGPGLVKPSQTLSLTCSVSGGSIRSGGDY WSWIRQHPGKGLEWIGYMYYSGSTYYNPSLKSRV TISVDTSKNQFSLKLSSVTVADTAVYYCARDSAVY GMDVWGQGTTVTVSS<br><br>SEQ ID NO: 31774 |
| iPS:437158 | 21-225_216H11 | NA | CAGACTGTGTGTGACTCAGGAGCCCTCACTGAC TGTGTCCCCAGGAGGGACAGTCACTCTCACCT GTGCTTCCAGCACTGGAGCAGTCAGTCACCAGTGGC TACTATCCAAACTGGTTCAACAGAAACCTGG ACAAGCACCCAGGGCACTGATTTATAGTACAA GCAATAAACACTCCTGGACCCTGCCCGGTTC TCAGGCTCCCTCCTTGGGGCAAAGCTGCCT GACACTGTCAGATGTGCAGCTGAGGACGAG GCTGAGTATTACTGCCTGCTCTACTGTGATGGT GCTCAGCTGTGTTCGGCGGAGGGACCAAACT GACCGTCCTA<br><br>SEQ ID NO: 27769 | CAGGTGCAGCTGCAGGAGTCGGGCCCAGGACTG GTGAAGCCTTCACAGACCCTGTCCTCACCTGCA CTGTCTCTGGTGGCTCCATCAGCAGTGGTGGTGA TTACTGGAGCTGGATCCGCCAGCACCCAGGGAA GGGCCTGGAGTGGATTGGGTACATCTATTACAGT GGGAGTTACCATATCAGTAGACACGTCTAAGAACCA GTTCTCCCTGAAGCTGAGTCTGTGACTGCCGCG GACACGGCCGTGTATTGTGCAGAGATGGGG CTGCGAGGGTTTGGACGTCTGGGGCCAAGGGA CCACGGTCACCGTCTCCTA<br><br>SEQ ID NO: 31775 |

FIGURE 50
(Continued)

| | | | |
|---|---|---|---|
| iPS:437160 | 21-225_216B12 | AA | QTVVTQEPSLTVSPGGTVILTCASSTGAVTSGYY PNWFQQKPGQAPRALIYSTSNKHSWTPARFSGS LLGGKAALTLSDVQPEDEAEYYCLLYCDGAQL VFGGGTKLTVL<br>SEQ ID NO: 27770 | QVQLQESGPGLVKPSQTLSLTCTVSGGSISSGGDYW SWIRQHPGKGLEWIGYIYYSGPTYYNPSLKSRVTIS VDTSKNQFSLKLSSVTAADTAVYYCARDGAAEGL DVWGQGTTVTSS<br>SEQ ID NO: 31776 |
| | | NA | TCCTATGAGCTGACTCAGCCACTCTCAGTGTC AGTGGCCCTGGAGCAGCGGCCAGGATTACCT GTGGGGGAGACAACATTAGAAGAAGAAATGT GCACTGGTACCAGCAGAAGCCAGGCCAGGCC CCTGTGCTGGTCATCTATAGGGATAGCAACCG GCCCTCTGGGATCCCTGAGCGATTCTCTGGCT CCAACTGGGGAACACGGCCACCCTGACCATC AGCAGAGCCCAAGCGCGGGATGAGGCTGACT ATTACTGTCAGTGTGGGACAGCAGCACTGGG GTGTTCGGCGGAGGGACCAAGCTGACCGTCCT A<br>SEQ ID NO: 27771 | CAGGTGCAGCTGGTGGAGTCTGGGGGAGGCGTG GTCCAGCCTGGGAGGTCCCTGAGACTCTCCTGTG CAGCGTCTGGATTCACCTTCAGTAGCTATGCCAT GCACTGGGTCCGCCAGGCTCCAGGCAAGGGGCT GGAGTGGGTGGCAGTTATATGCTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCTGGG ACTGGGATACTTCTTTGACTACTGGGGCCAGGGA ACCCTAGTCACCGTCTCCTCA<br>SEQ ID NO: 31777 |
| | | AA | SYELTQPLSVSVALGQTARITCGGDNIRRRNVH WYQQKPGQAPVLVIYRDSNRPSGIPERFSGSNSG NTATLTISRAQAGDEADYYCQVWDSSTGVFGG GTKLTVL<br>SEQ ID NO: 27772 | QVQLVESGGGVVQPGRSLRLSCAASGFTFSSYAMH WVRQAPGKGLEWVAVIWYDGSNKYYADSVKGRF TISRDNSKNTLYLQMNSLRAEDTAVYYCARDLGLG YFFDYWGQGTLVTVSS<br>SEQ ID NO: 31778 |

FIGURE 50
(Continued)

| | | | | |
|---|---|---|---|---|
| iPS:437162 | 21-225_217B2 | NA | CAGTCTGCCCTGACTCAGCCTGCCTCCGTGTCTGGGTCTCCTGGACAGTCGATCACCATCTCCTGCACTGGAACCAGCAGTGACGTTGGTGGTTATAACTATGTCTCCTGGTACCAACAACACCAGCAAAGCCCCAAACTCTTGATTTATGAGGTCAGTAATCGGCCCTCAGGGGTTTATAATCGCTTCTCTGGCTCCAAGTCTGGCAACACGGCCTCCCTGACCATCTCTGGGCTCCAGGCTGAGGACGAGGCTGATTATTACTGCGGCTCATATGTAAAAGGCATCACTTGGGTGTTCGGCGGAGGGACCAGTCTGACCGTCCTC<br>SEQ ID NO: 27773 | CAGGTGCACCTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGCTGGAGTGGGTGGCAGTTATATGGTATGATGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTATTGTGCGAGGGGGACTGGAACCCGAGGGTATGGACGTCTGGGGCCAAGGGACCACGGTCATCGTCTCCTCA<br>SEQ ID NO: 31779 |
| | | AA | QSALTQPASVSGSPGQSITISCTGTSSDVGGYNYVSWYQQHPGKAPKLLIYEVSNRPSGVYNRFSGSKSGNTASLTISGLQAEDEADYYCGSYVKGITWVFGGGTSLTVL<br>SEQ ID NO: 27774 | QVHLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVIVSS<br>SEQ ID NO: 31780 |
| iPS:437164 | 21-225_217C6 | NA | TCCTATGAGCTGACACAGCCACCCTGGTGTCAGTGTCCCAGGACAGCAGACGGCCAGGATCACCTGCTCTGGAGATGCATTGCAAAGCAATATGCTTATTGGTACCAGCAAGCCAGGCCAGGCCCCAGTGCTGGTGATATAAAGACAGTGAGAGCCCTCAGGGATTCCTGAGCGATTCACTGGCTCCGGCTCAGGGACAACAGTCACGTTGACCATCAGAGGAGTCCAGGCAGAAGACGAGGCTGACTATTACTGTCAATTAATAGTCAGCAGTGATACTTATGTCTTCGGAACTGGGACCAAGGTCACCGTCCTA<br>SEQ ID NO: 27775 | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGCTGGAGTGGGTGGCAGTTATATGGTTTGATGAAGTGATGAATACTATGCAGACTCCGTGAAGGGCCGATTCACCATCTCCAGAGACAATTCCAAGAACACGATGTATCTGCAAATGAACAGCCTGAGAGCCGAAGACACGGCTGTGTATTACTGTGCGAGAGGCCTATCTGTCTACTACTACGGTATGGACGTCTGGGGCCAAGGGACCACGGTCACCGTCTCCTCA<br>SEQ ID NO: 31781 |

FIGURE 50
(Continued)

| | | | | |
|---|---|---|---|---|
| iPS:437166 | 21-225_217G11 | AA | SYELTQPPSVSVSPGQTARITCSGDALPKQYAYW YQQKPGQAPVLVIYKDSERPSGIPERFSGSRSGTT VTLTIRGVQAEDEADYYCQLIVSSDTYVFGTGT KVTVL | QVQLVESGGGVVQPGRSLRLSCAASGFTFSNYGM HWVRQAPGKGLEWMAIIWFDGSDEYYADSVKGRF TISRDNSKNTMYLQMNSLRAEDTAVYYCARGLSV YYYGMDVWGQGTTVTVSS |
| | | | SEQ ID NO: 27776 | SEQ ID NO: 31782 |
| | | NA | TCCTATGAGCTGACACAGCCACCCTCGGTGTC AGTGTCCCAGGACAGGCCAGGATCACCT GCTCTGGAGATGCATTGCCAAAACAATATGCT TATTGGTACCAGCAGAAGCCAGGCCAGGCCCC AGTACTGGTGATATATAAAGACAGTGAGAGG CCCTCAGGGATCCCTGAGCGATTCTCTGGCTC CCGTCAGGGACAACAGTCACGTTGACCGTCA GTGGAGTCCAGGCAGAAGACGAGGCTGACTA TTACTGTCAATTAGTGTACAGCAGTGATACTT ATGTCTTCGGAACTGGGACCAAGGTCACCGTC CTA | CAGGTGCAGTTGGTGGAGTCTGGGGGAGGCGTG GTCCAGCCTGGGAGGTCCCTGAGACTCTCCTGTG CAGCGTCTGGATTCACCTTCAGGAACTATGGCAT GCACTGGGTCCGCCAGGCTCCAGGCAAGGGGCT GGAGTGGGTGTCAATTATATGGTTTGATGGAAGT GATCAGTACTACTATGCAGACTCCGTGAAGGGCCGAT TCACCATCTCCAGAGACAATTCCAAGAACACGCT GTATCTGCAAATGAACAGCCTGAGAGCCGAGGA CACGGCTGTATATTACTGTGCGAGAGGCCCTCT GTCTACTACGGTATGGACGTCTGGGGCCAAG GGACCACGGTCACCGTCTCCTCA |
| | | | SEQ ID NO: 27777 | SEQ ID NO: 31783 |
| | | AA | SYELTQPPSVSVSPGQTARITCSGDALPKQYAYW YQQKPGQAPVLVIYKDSERPSGIPERFSGSRSGTT VTLTIVSGVQAEDEADYYCQLVYSSDTYVFGTGT KVTVL | QVQLVESGGGVVQPGRSLRLSCAASGFTFRNYGM HWVRQAPGKGLEWVSIIWFDGSDQYYADSVKGRF TISRDNSKNTLYLQMNSLRAEDTAVYYCARGLSVY YYGMDVWGQGTTVTVSS |
| | | | SEQ ID NO: 27778 | SEQ ID NO: 31784 |

FIGURE 50
(Continued)

| | | | |
|---|---|---|---|
| iPS:437168 | 21-225_218G4 | NA | CAGTCTGTGTTGACGCAGCCGCCTCAGTGTCTGCGGCCCAGGACAGAAGGTCACCATCCCTGCTCTGGAAGCAGCAGCTCCAACATTGGAATAATTATGTATCCTGGTACCAGCAGCTCCCAGGAACAGCCCCCAAACTCCTCCTTTATGACAGTAATAAGGGACCCTCAGGGATTCCTGCCGATTCTCTGGCTCCAAGTCTGGCAGTCAGCCACCCTGGGCATCACCGGACTCCAGACTGGGGACGAGGCCGATTATTACTGCGGAACATGGGATAGCAGCCTGAATACTGTGGTATTCGGCGGAGGGACCAAGCTGACCGTCCTA | CAGGTGCAGCTGGTGGAGTCTGGGGGAGGCGTAGTCCAGCCTGGGAGGTCCCTGAGACTCTCCTGTGCAGCGTCTGGATTCACCTTCAGTAGCTATGGCTTGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGTCGAGGACACGGCTGTGTACTACTGTGCGAACTGGTACTACTATTACTACGGTATGGACGTCTGGGGCCAAGGGACCACGGTCACCGTCTCCTCA |
| | | | SEQ ID NO: 27779 | SEQ ID NO: 31785 |
| | | AA | QSVLTQPPSVSAAPGQKVTISCSGSSSNIGNNYVSWYQQLPGTAPKLLLYDSNKRPSGIPARFSGSKSGTSATLGITGLQTGDEADYYCGTWDSSLNTVVFGGGTKLTVL | QVQLVESGGGVVQPGRSLRLSCAASGFTFSSYGLHWVRQAPGKGLEWVAVIWYDGSNKYYADSVKGRFTISRDNSKNTLYLQMNSLRVEDTAVYYCANWYYYYYGMDVWGQGTTVTVSS |
| | | | SEQ ID NO: 27780 | SEQ ID NO: 31786 |
| iPS:437170 | 21-225_218E5 | NA | TCCTATGAGCTGACACAGCCACCCTGGTGTCAGTGTCCCAGGACAGACGGCCAGGATCACCTGCTCTAGAGATGTATTGCCGAAGCAATATGCTTATTGGTACCAGCAAGCCAGGCCAGGCCCCAGTACTGGTGATATATAAAGACAGTGAGAGGCCCTCAGGGATCCCTGAGCGATTCTCTGGCTCCGGCTCAGGGACAACAGTCACGTTGACCATCAGAGGAGTCCAGGCAGAAGACGAGGCTGACTATTACTGTCAATTAGTTGTCAGCAGTGATACTTAGCTCTTCGGAACTGGGACCAAGGTCACCGTCCTA | CAGGTGCAGTTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGCTGGAGTGGATGGCAATTATATGTTTGATGGAAGTGATGAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTATATTACTGTGCGAGAGGCCTATCTGTCTACTACTACGGTATGGACGTCTGGGGCCAAGGGACCACGGTCACCGTCTCCTCA |
| | | | SEQ ID NO: 27781 | SEQ ID NO: 31787 |

FIGURE 50
(Continued)

| | | | |
|---|---|---|---|
| iPS:437172 | 21-225_219A7 | AA | SYELTQPPSVSVSPGQTARITCSRDVLPKQYAYW YQQKPGQAPVLVIYKDSERPSGIPERFSGSRSGTT VTLTIRGVQAEDEADYYCQLVVSSDTYVFGTGT KVTVL<br>SEQ ID NO: 27782 | QVQLVESGGGVVQPGRSLRLSCAASGFTFSNYGM HWVRQAPGKGLEWMAIIWFDGSDEYYADSVKGRF TISRDNSKNTLYLQMNSLRAEDTAVYYCARGLSVY YYGMDVWGQGTTVTVSS<br>SEQ ID NO: 31788 |
| | | NA | CAGTCTGCCCTGACTCAGCCTGCCTCCGTGTCT GGGTCTCCTGGACAGTCGATCACCATCTCCTG CACTGGAACCAGCAGTGACGTTGGTGGTTATA ATTATGTCTCCTGGTACCAACAGCACCCAGGC AAAGCCCCCAAACTCATGATTTATGAGGTCAG AAATCGGCCCTCAAGTCTGGCAACACGGCTCCCTG CTGGCTCCAAGTCTGGCAACACGGCTCCCTG ACCATCTCTGGGCTCCAGGCTGAGGACGAGGC TGATTATTACTGCTGCTCATATACAAGGAGCA TCACTTGGGTGTTCGGCGGAGGGACCAAGTTG ACCGTCCTA<br>SEQ ID NO: 27783 | CAGGTGCAGCTGGTGGAGTCTGGGGGAGGCGTG GTCCAGCCTGGGAGGTCCCTGAGACTCTCCTGTC CAGCGTCTGGATTCACCTTCAGTCAGCTATGGCAT GCACTGGGTCCGCCAGGCTCCAGGCAAGGGGCT GGAGTGGGTGGCAGTCATATGGTATGATGGAAG TAATAAATACTATGCAGACTCCGTGAAGGGCCG ATTCACCATCTCCAGAGACAACATTCCAAGAATATG CTGTATCTGCAAATGAACAGCCTGAGAGCCGAG GACACGGCTGTGTATTACTGTGCGAGGGGGACT GGAACCCGAGGGTATGGACGTCTGGGGCCAAG GGACCACGGTCACCGTCTCCTCA<br>SEQ ID NO: 31789 |
| | | AA | QSALTQPASVSGSPGQSITISCTGTSSDVGGYNY VSWYQQHPGKAPKLMIYEVRNRPSGVSNRFSGS KSGNTASLTISGLQAEDEADYYCCSYTRSITWVF GGGTKLTVL<br>SEQ ID NO: 27784 | QVQLVESGGGVVQPGRSLRLSCPASGFTFSHYGMH WVRQAPGKGLEWVAVIWYDGSNKYYADSVKGRF TISRDNSKNMLYLQMNSLRAEDTAVYYCARGDWN PEGMDVWGQGTTVTVSS<br>SEQ ID NO: 31790 |

FIGURE 50
(Continued)

| | | | |
|---|---|---|---|
| iPS:437182 | 21-225_221H2 | NA | CTGTCTGCCCTGACTCAGCCTGCCTCCGTGTCTGGGTCTCCTGGACAGTCGATCACCATCCCTGCACTGGAACCAGCAGTGACGTTGGTGGTTATAACTATGTCTCCTGGTACCAACAACCAGGCAAAGCCCCCAAACTCATGATTTCTGAGGTCAGGAATCGGCCCTCAGGGTTTCTAATCGCTTCTCTGGCTCCAAGTCTGGCAACACGGCCTCCCTGACCATCTCTGGGCTCCAGGCTGAGGACGAGGCTGATTATTACTGCAACTCATATACACGCAGCATCACTTGGGTGTTCGGCGGAGGGACCAAGCTGACCGTCCTA<br><br>SEQ ID NO: 27785 |
| | | | LSALTQPASVSGSPGQSITISCTGTSSDVGGYNYVSWYQQHPGKAPKLMISEVRNRPSGVSNRFSGSKSGNTASLTISGLQAEDEADYYCNSYTRSITWVFGGGTKLTVL<br><br>SEQ ID NO: 27786 |
| | | AA | CAGGTGCAGCTGGTGGAGTCTGGGGGAGGCGTGGTCCAGCCTGGGAGGTCCCTGAGACTCTCCTGTGCAGCGTCTGGATTCACCTTCAGTCACTATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGCATCTGCAAATGAACAGCCTGAGAGCCGAGGACACGGCTGTGTATTACTGTGCGAGGGGGACTGGAACCCCGAGGGTCACCGTCTCCTCA<br><br>SEQ ID NO: 31791 |
| | | | QVQLVESGGGVVQPGRSLRLSCAASGFTFSHYGMHWVRQAPGKGLEWVAVIWYDGSNKYYADSVKGRFTISRDNSKNTLHLQMNSLRAEDTAVYYCARGDWNPEGMDVWGQGTTVTVSS<br><br>SEQ ID NO: 31792 |
| iPS:437184 | 21-225_221G4 | NA | CAGTCTGCCCTGACTCAGCCTGCCTCCGTGTCTGGGTCTCCTGGACAGTCGATCACCATCCCTGCACTGGAACCAGCAGTGACGTTGGTGGTTATAACTATGTCTCCTGGTACCAACAACCAGGCAAAGCCCCCAAACTCATGATTTATGAGGTCAGGAATCGGCCCTCAGGGTTTCTAATCGCTTCTCTGGCTCCAAGTCTGGCAACACGGCCTCCCTGACCATCTCTGGGCTCCAGGCTGAGGACGAGGCTGATTATTACTGCAACTCATATACACGCAGCATCACTTGGGTGTTCGGCGGAGGGACCAAGCTGACCGTCCTA<br><br>SEQ ID NO: 27787 |
| | | | CAGGTGCAGCTGGTGGAGTCTGGGGGAGGCGTGGTCCAGCCTGGGAGGTCCCTGAGACTCTCCTGTGCAGCGTCTGGATTCACCTTCAGTCACTATGGCATGCACTGGGTCCGCCAGGCTCCAGGCAAGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGCATCTGCAAATGAACAGCCTGAGAGCCGAGGACACGGCTGTGTATTACTGTGCGAGGGGGACTGGAACCCCGAGGGTATGGACGTCTGGGGCCAAGGGACCTCGGTCACCGTCTCCTCA<br><br>SEQ ID NO: 31793 |

FIGURE 50
(Continued)

| | | | |
|---|---|---|---|
| iPS:437186 | 21-225_224H2 | AA | QSALTQPASVSGSPGQSITISCTGTSSDVGGYNY VSWYQQHPGKAPKLMIYEVRNRPSGVSNRFSGS KSGNTASLTISGLQAEDEADYYCNSYTRSITWVF GGGTKLTVL<br>SEQ ID NO: 27788 | QVQLVESGGGVVQPGRSLRLSCAASGFTFSHYGM HWVRQAPGKGLEWVAVIWYDGSNKYYADSVKGR FTISRDNSKNTLHLQMNSLRAEDTAVYYCARGDW NPEGMDVWGQGTSVTVSS<br>SEQ ID NO: 31794 |
| | | NA | TCCTATGAGCTGACTCAGCCATCCTCAGTGTC CGTGTCCCAGGACAGCAGCCAGCATCACCT GCTCTGGAGATAATTTGGGGGTTAAATATACT TACTGGTATCAGCAGAAGCCAGGCCAGTCCC TGTGCTAGTCGTCTATCAAGATAGCAAGCGGC CCTCAGGGATCCCTGAGCGATTCTCTGGCTCC AACTCTGGGAACACAGGCTACTCTGACCATCAG CGGGACCCAGGCTGTGGACAGCAGCACTGTGTA ACTGTCAGGCGTGGGACCAAGCTGACCGTCCTA<br>SEQ ID NO: 27789 | CAGGTACAGCTGCAGCAGTCAGGTCCAGGACTG GTGAAGCCCTCGCAGACCCTCTCACTCACCTGTG ACATCTCCGGGACAGTGTCTCTAGCAACAGTGC TGCTTGGAACTGGATCAGGCAGTCCCCATCGCGA GGCCTTGAGTGGCTGGAAGGACATACTACAGG TCCAAGTGGTATAATGATTATGCAGTATCTGTGA AAAGTCGAGTAACCATCAACCAGACACATCCA AGAACCAGTTCTCCCTGCAGCTGAACTCTGTGAC TCCCGAGGACACGGCTGTGTATTACTGTGCAAGA GAGGGGGGCCTAGGATATGTAGTAGTACCAGCT GCTATGGAGGCTGGTTCACCGTCCTCA<br>SEQ ID NO: 31795 |
| | | AA | SYELTQPSSVSVSPGQTASITCSGDNLGVKYTYW YQQKPGQSPVLVVYQDSKRPSGIPERFSGSNSGN TATLTISGTQAMDEADYYCQAWDSSTVFGGG TKLTVL<br>SEQ ID NO: 27790 | QVQLQQSGPGLVKPSQTLSLTCDISGDSVSSNSAA WNWIRQSPSRGLEWLGRTYYRSKWYNDYAVSVK SRVTINPDTSKNQFSLQLNSVTPEDTAVYYCAREGG LGYCSSTSCYGGWFDPWGQGTLVTVSS<br>SEQ ID NO: 31796 |

FIGURE 50
(Continued)

| | | | |
|---|---|---|---|
| iPS:437188 | 21-225_224B11 | NA | CAGTCTGTGCTGACGCAGCCGCCCTCAGTGTC TGGGGCCCAGGACAGAGGGTCACCATCTCCT GCACTGGGAGCAGCTCAACATGGGCAGG TTATGATGTACACTGGTACCAGCAGCTTCCAG GAACAGCCCCAAACTCCTCATCTTTGGTAAC AGCAATCGGCCCTCAGGGGTCCCTGACCGATT CTCTGGCTCCAAGTCTGGCACCTCAGCCTCCCT GGCCATCACTGGGCTCCAGGCTGAGGATGAGG CTGATTATTCACTGCCAGTCCTATGACAACAGC CTGAGTGGTGTGTTCGGCGGAGGGACCAAGCT GACCGTCCTA | CAGGTACACCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGACAAGGC TTGAGTGGATGGGATGGATCAACCCTAAAAATG GTGGCACAAACTATGCACAGAAGTTTCAGGGCA GGGTCACCATGACCAGGGACGCGTCATCAGCA CAACCTACATGGAGCTGAGCAGGCTGAGATCTG ACGACACGGCCGTGTATTACTGTGCGAGAGAG CGTTTGATTACTTCTACTACTACGCTATGGACGTC TGGGGCCAAGGGACCACGGTCACCGTCTCCTCA |
| | | AA | QSVLTQPPSVSGAPGQRVTISCTGSSSNIGAGYD VHWYQQLPGTAPKLLIFGNSNRPSGVPDRFSGS KSGTSASLAITGLQAEDEADYHCQSYDNSLSGV FGGGTKLTVL | QVHLVQSGAEVKKPGASVKVSCKASGYTFTGYYIH WVRQAPGQGLEWMGWINPKNGGTNYAQKFQGRV TMTRDASISTTYMELSRLRSDDTAVYYCARGAFDY FYYYAMDVWGHGTTVTVSS |
| | | | SEQ ID NO: 27791 |
| | | | SEQ ID NO: 31797 |
| | | | SEQ ID NO: 27792 |
| | | | SEQ ID NO: 31798 |
| iPS:437190 | 21-225_225A9 | NA | TCCTATGAGCTGACTCAGCCACCCTCAGTGTC CGTGTCCCCAGGACAGACAGCCAGCATCACCT GCTCTGGAGATAAATTGGGAATAAATATGCT TGCTGGTATCAGCAGAAGCCAGGCCAGTCCCC TGTGTTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTGTGGACGAGGCTGACTATT ACTGTCAGGCGTGGGACAGCAGCACTGTCATG GTCTTCGGAACTGGGACCAAGGTCACCGTCCT A | CAGGTGCAGCTGGTGGAGTCTGGGGGAGGCGTG GTCCAGCCTGGGGGGTCCCTGAGACTCTCCTGTG CAGCGTCTGGATTCACCTTCAGTACTTACTATGGCAT GCACTGGGTCCGCCAGGCTCCAGGCAAGGGCT GGAGTGGGTGGCAGTTATATGGTATGATGGAAGT AATAAATACTATGCAGACTCCGTGAAGGGCCGA TTCACCATCTCCAGAGACAATTCCAAGAACACGC TGTATCTGCAAATGAACAGCTGAGAGCCGAGG ACACGGCTGTGTAGTAGTACCGTGCGAGAGATAACCA CTATTGTACTTCGTATTACTGTGCTACACTAC TACTACTTCGTATGGACGTCTGGGCAAGGGA CCACGGTCACCGTCTCCTCA |

FIGURE 50
(Continued)

| | | | SEQ ID NO: 27793 | | SEQ ID NO: 31799 | |
|---|---|---|---|---|---|---|
| | | AA | SYELTQPPSVSVSPGQTASITCSGDKLGNKYACW YQQKPGQSPVLVIYQDSKRPSGIPERFSGSNSGN TATLTISGTQAMDEADYYCQAWDSNTACVFGT GTKVTVL | | QVQLVESGGGVVQPGGSLRLSCAASGFTFSTYGMH WVRLAPGKGLEWVAVIWYDGSNKYYADSVKGRF TISRDISQNTLYLQMNSLRAEDTAVYYCARDNHYC SSTSCSPYYYFGMDVWGQGTTVTVSS | |
| | | | SEQ ID NO: 27794 | | SEQ ID NO: 31800 | |
| iPS:437192 | 21-225_225E9 | NA | TCCTATGACCTGACTCAGCCACCTCAGTGTC CGTGTCCCCAGGACAGACAGCCAGCATCACCT GCTCTGGAGATAATTTGGGACAGAATAGATATGCT TGCTGGTATCAGCAGAAGCCAGGCCAGTCCC TGTACTGGTCATGTATCAAGATCGCAAGCGGC CCTCAGGGATCCCTGAGCGATTCTCTGGCTCC AACTCTGGGAACACAGGCTACTCTGACCATCAG CGGGACCCAGGCGTGGGACACAGAACTGCTGTG ACTGTCAGGCGTGGGAGGGACCAAGCTGACCGTCCT GTATTCGGCGGAGGGACCAAGCTGACCGTCCT A | | CAGGTGCAGTTGGTGGAGTCTGGGGGAGGCGTG GTCCAGCCTGGGAGGTCCCTGAGACTCTCCTGTG AAGCGTCTGGATTCATCTTCAGTAGCTATGGCAT GCACTGGGTCCGCCAGGCTCCAGGCAAGGGGCT GGAGTGGGTGGCAGTTATGTGGTATGATGGGAGGT AATAAAGACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGAGATCGGGA ATATTGTACTAGTACCAGCTGCCCTTACTACTAC TACTACGGTATGGACGTCTGGGGCCAAGGGACC ACGGTCACCGTCTCCTCA | |
| | | | SEQ ID NO: 27795 | | SEQ ID NO: 31801 | |
| | | AA | SYDLTQPPSVSVSPGQTASITCSGDNLGNRYAC WYQQKPGQSPVLVMYQDRKRPSGIPERFSGSNS GNTATLTISGTQAMDEADYYCQAWDSRTAVVF GGGTKLTVL | | QVQLVESGGGVVQPGRSLRLSCEASGFIFSSYGMH WVRQAPGKGLEWVAVMWYDGGNKDYADSVKGR FTISRDNSKNTLYLQMNSLRAEDTAVYYCARDREY CTSTSCPYYYYGMDVWGQGTTVTVSS | |
| | | | SEQ ID NO: 27796 | | SEQ ID NO: 31802 | |

FIGURE 50
(Continued)

| | | | |
|---|---|---|---|
| iPS:437194 | 21-225_226B2 | NA | TCCTATGAGCTGACTCAGCCACCCTCAGTGTC CGTGTCCCAGGAGATACATTGGGGGTAAATATGCT GCTCTGGAGATACATTGGGGGTAAATATGCT TGGTGGTATCAGCAGAGGCCAGGCCAGTCCCC TGTGCTGGTCATCTATCAAGATCGCAAGCGGC CCTCAGGGATCCCTGAGCGATTCTCTGGCTCC AGCTCTGGGAACACAGCCACTCTGACCATCAG CGGGACCCAGGCTATGGATGAGGCTGACTATT ACTGTCAGGCGTGGGACAACGGCGCTGCGGTT TTCGGCGGAGGGACCAAGCTGACCGTCCTA |
| | | | SEQ ID NO: 27797 |
| | | AA | SYELTQPPSVSVSPGQTASITCSGDTLGGKYAW WYQQRPGQSPVLVIYQDRKRPSGIPERFSGSSSG NTATLTISGTQAMDEADYYCQAWDNGAAVFGG GTKLTVL |
| | | | SEQ ID NO: 27798 |
| iPS:437196 | 21-225_226B7 | NA | TCCTTTGAGCTGACACAGCCACCTCGGTGTC AGTGTCCCAGGACACGGCCAGGATCACCT GCTCTGGAGATGCATTGCCAAGGCATTATGTT TATTGGTACCAGCAGCAGAACCCAGGCCAGGCCC TGTGCTGGTGATATATAAAGACAGTGAGAGGC CCTCAGGGATCCCTGAGCGATTCTCTGGCTCC AGCTCAGGGACAACAGTCACGTTGACCATCAG TGGAGTCCAGGCAGAAGACAGAGGCTGACTATT ACTGTCAATCAGCAGCAGCAGTGTACTTAT GTCTTCGGAACTGGGACCAAGGTCACCGTCCT A |
| | | | SEQ ID NO: 27799 |

| | |
|---|---|
| CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTTTA TGCACTGGGTGCGACAGGCCCCTGGACAAGGGC TTGAGTGGATGGGATGGATCAACCCTAACAGTGG TGACACAAACTATGCACAGGAGACACGTCCCAACAC GGTCACCATGACCAGGGACACATCATGAGCTGAGCAGGCTGAGATCTGA AGCTACATGAGCTGAGCAGGCTGAGATCTGA CGACACGGCCATTATTACTGTGCGAGAGGACT TACTATGTTCGGGGAGTTATTTTAACGAACTTG ACTCCTGGGGCCAGGGAACCCTGGTCACCGTCTC CTCA |
| SEQ ID NO: 31803 |
| QVQLVQSGAEVKKPGASVKVSCKASGYTFTGYFM HWVRQAPGQGLEWMGWINPNSGDTNYAQKFQGR VTMTRDTSLNTAYMELSRLRSDDTAIYYCARGTYY GSGSYFNELDSWGQGTLVTVSS |
| SEQ ID NO: 31804 |
| CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGAC TTGAGTGGATGGGATGGATCAACCCTAACAGTGG AGGCACAAACTATGCACAGAAGTTTCAGGACAG GGTCACCATGACCAGGGACACGTCCATCAGCAC AGCCCACATGGAGCTGAGCAGGCTGAGATCTGA CGACACGGCCGTGTATTATTGTGCGAGAGGATAT TACTATGTTCGGGGAGTTATTATAACTGGTTCG ACTCCTGGGGCCAGGGAACCCTGGTCACCGTCTC CTCA |
| SEQ ID NO: 31805 |

FIGURE 50
(Continued)

| | | | |
|---|---|---|---|
| iPS:437198 | 21-225_226F8 | AA | SFELTQPPSVSVSPGQTARITCSGDALPRHYVYWYQQNPGQAPVLVIYKDSERPSGIPERFSGSSSGTTVTLTISGVQAEDEADYYCQSADSSGTYVFGTGTKVTVL<br>SEQ ID NO: 27800 | QVQLVQSGAEVKKPGASVKVSCKASGYTFTGYYMHWVRQAPGQGLEWMGWINPNSGGTNYAQKFQDRVTMTRDTSISTAHMELSRLRSDDTAVYYCARGYYYGSGSYYNWFDSWGQGTLVTVSS<br>SEQ ID NO: 31806 |
| | | NA | CAGTCTGTGCTGACGCAGCCGCCCTCAGTGTCTGGGGCCCCAGGGCAGAGGGTCACCATCCCTGCACTGGGAGCAGCTCCAACATCGGGGCAGGTTATGATGTACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGACACCTCAGCCTCCCTGGCCATCACTGGGCTCCAGGCTGAGGATGAGGCTGATTATTACTGCCAGTCCTATGACAACAGCCTGAGTGGTGTGTTCGGCGGAGGGACCAAGCTGACCGTCCTA<br>SEQ ID NO: 27801 | CAGGTGCAACTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGACTGAGATCTGACGACACGGCCGTGTATTACTGTGCGAGAGGCGTTTGATTACTACTACTGGTTTGACGTCTGGGGCCAAGGGACCACGGTCACCGTCTCCTCA<br>SEQ ID NO: 31807 |
| | | AA | QSVLTQPPSVSGAPGQRVTISCTGSSSNIGAGYDVHWYQQLPGTAPKLLIYGNSNRPSGVPDRFSGSKSDTSASLAITGLQAEDEADYYCQSYDNSLSGVFGGGTKLTVL<br>SEQ ID NO: 27802 | QVQLVQSGAEVKKPGASVKVSCKASGYTFTGYYIHWVRQAPGQGLEWMGWINPNSGGTNYARKFQGRVTMTRDTSISTAYMELSRLRSDDTAVYYCARGAFDYYYYYALDVWGQGTTVTVSS<br>SEQ ID NO: 31808 |

FIGURE 50
(Continued)

| | | | |
|---|---|---|---|
| iPS:437200 | 21-225_226A10 | NA | TCCTATGAGCTGACTCAGCCACCCTCAGTGTCCGTGTCCCAGGAGATACAGAGACAGCAGCATCACCTGCTCTGGAGATATACATTGGGGATAAATATGCTTGGTGGTATCAGCAGAAGCCAGGCCAGTCCCCTGTGCTGGTCATCTATCAAGATGCAAGCGGCCCTCAGGGATCCCTGAGCGATTCTCTGGCTCCAGCTCTGGGAACACAGCCACTCTGACCATTAGCGGGACCCAGGCTATGGATGAGGCTGACTATTACTGTGTCAGGGCGTGGGACAACGGCGCCGCTGCGGTTTTCGGCGGAGGGACCAAGCTGACCGTCCTA<br>SEQ ID NO: 27803 | CAGGTGCAACTGGTGCAGTCTGGGGCTGAGGTGAAGAAGCCTGGGGCCTCAGTGAAGGTCTCCTGCAAGGCTTCTGGATACACCTTCACCGGCTACTTTATGCACTGGGTGCGACAGGCCCCTGGACAAGGGCTTGAGTGGATGGGTTGGATCAACCCTAACAGTGGTGACACAAACTATGCACAGGAGACACGTCCCTCAGCACGGTCACCATGACCAGGGACACGTCCATCAGCACAGCTACATGGAGCTGAGCAGGCTGAGATCTGACGACACGGCCATTTATTACTGTGCGAGAGGACTTACTATGTTCGGGGAGTTATTTTAACGAACTTGACTCCCTGGGGCCAGGGAACCCTGGTCACCGTCTCCTCA<br>SEQ ID NO: 31809 |
| | | AA | SYELTQPPSVSVSPGQTASITCSGDTLGGKYAWYQQKPGQSPVLVIYQDRKRPSGIPERFSGSSSGNTATLTISGTQAMDEADYYCQAWDNGAAVFGGGTKLTVL<br>SEQ ID NO: 27804 | QVQLVQSGAEVKKPGASVKVSCKASGYTFTGYFMHWVRQAPGQGLEWMGWINPNSGDTNYAQKFQGRVTMTRDTSLSTAYMELSRLRSDDTAIYYCARGTYYGSGSYFNELDSWGQGTLVTVSS<br>SEQ ID NO: 31810 |
| iPS:437202 | 21-225_227D3 | NA | CAGTCTGTGCTGACGCAGCCGCCCTCAGTGTCTGGGGCCCCAGGGCAGAGGGTCACCATCTCCTGCACTGGGAGCAGCTCCAACATCGGGGCAGGTTATGATGTAACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGACACCTCAGCCTCCCTGGCCATCACTGGGCTCCAGGCTGAGGATGAGGCTGATTATTACTGTGCAGTCCTATGCAACAGCCTGAGTGGTGTTCGGCGGAGGGACCAAGCTGACCGTCCTA<br>SEQ ID NO: 27805 | CAGGTGCAATTGGTGCAGTCTGGGGCTGAGGTGAAGAAGCCTGGGGCCTCAGTGAAGGTCTCCTGCAAGGCTTCTGGATACACCTTCACCGGCTACTATATGCACTGGGTGCGACAGGCCCCTGGACAAGGGCTTGAGTGGATGGGATGATCAACCCTAAGAGTGGTGGCACAAACTTTGCACAGGAAGTTTCAGGCAGGGTCACCATGACCAGGGACACGTCCATCAGCACAGCCTACATGGAACTGAGCAGGCTGAGATCTGACGACACGGCCGTGTATTACTACTGTGCGCGAGAGAGCGTTTGATTACTTCTACTACTACGTATGGACGTCTGGGGCCAAGGGACCACGGTCACCGTCTCCTCA<br>SEQ ID NO: 31811 |

FIGURE 50
(Continued)

| | | | |
|---|---|---|---|
| iPS:437204 | 21-225_227E5 | AA | QSVLTQPPSVSGAPGQRVTISCTGSSSNIGAGYDVHWYQQLPGTAPKLLIYGNSNRPSGVPDRFSGSKSDTSASLAITGLQAEDEADYYCQSYDNSLSGVFGGGTKLTVL<br>SEQ ID NO: 27806 | QVQLVQSGAEVKKPGASVKVSCKASGYTFTGYMHWVRQAPGQGLERMGWINPKSGGTNFAQKFQGRVTMTRDTSISTAYMELSRLRSDDTAVYYCARGAFDYFYYYGMDVWGQGTTVTVSS<br>SEQ ID NO: 31812 |
| | | NA | TCCTATGAGCTGACTCAGCCACCCTCAGTGTCCGTGTCCCCAGGACAGACAGCCAGCATCACCTGCTCTGGAGATAAATTGGGGGAAAAATATGCTTGCTGGTATCAGCAGAAGCCAGGCCAGTCCCCTGTGCTGGTCATCTATCAAGATAGGAAGCGGCCCTCAGGGATCCCTGAGCGATTCTCTGGCTCCAACTCTGGGAACAAAGCTATGAGGCTGACTATTACTGGGACCCAGGCTGGGTCAACAACACTATGATATTCGGCGGAGGGACCAAGCTGACCGTCCTA<br>SEQ ID NO: 27807 | GAGGTGCAGCTGTTGGAGTCTGGGGGAGGCTTGGTACAGCCTGAGGGTCCCTGAGACTCTCCTGTGCAGCCTCTGGATTCACCTTTAGCAGCTATGCCATGAGCTGGGTCCGCCAGGCTCCAGGGAAGGGGCTGGAGTGGGTCTCAGTTATTAGTGGTAGTGGTGGTAGCACATACTACGCAGACTCCGTGAAGGGCCGGTTCACCATCTCCAGAGACAATTCCAAGAACACGCTGTGTCTGCAAATGAACAGCCTGAGAGCCGAGGACACGGCCGTATATTACTGTGCGAAAGAATATTGGTTGGTGACTGCTATTCCCCTTACTACTACTACTACGGTATGGACGTCTGGGGCCAAGGGACCACGGTCACCGTCTCCTCA<br>SEQ ID NO: 31813 |
| | | AA | SYELSQPPSVSVSPGQTASITCSGDKLGEKYACWYQQKPGQSPVLVIYQDRKRPSGIPERFSGSNSGNKATLTISGTQAMDEADYYCQAWNNTMIFGGGTKLTVL<br>SEQ ID NO: 27808 | EVQLLESGGGLVQPEGSLRLSCAASGFTFSSYAMSWVRQAPGKGLEWVSAISGSGGSTYYADSVKGRFTISRDNSKNTLCLQMNSLRAEDTAVYYCAKEYCGGDCYSPYYYYGMDVWGQGTTVTVSS<br>SEQ ID NO: 31814 |

FIGURE 50
(Continued)

| | | | |
|---|---|---|---|
| iPS:437208 | 21-225_227C10 | NA | CAGTCTCTGTGCTGACGCAGCCGCCCTCAGTGTC TGGGGCCCCAGGACAGAGGGTCACCATCTCCT GCACTGGGAGCAGCTCCAACATGTGGGGCAGG TTATGATGTACACTGGTACCAGCAGCTTCCAG GAACAGCCCCCAAACTCCTCATCTATGGTAAC AGCAATCGGCCCTCAGGGGTCCCTGACCGATT CTCTGGCTCCAAGTCTGACACCTCAGCCTCCCT GGCCATCACTGGGCTCCAGGCTGAGGATGAGG CTGATTATTACTGCCAGTCCTATGACAACAAC CTGAGTGGTGTGTTCGGCGGAGGGACCAAGCT GACCGTCCTA<br><br>SEQ ID NO: 27809 | CAGGTGCAATTGGTGCAGTCTGGGGCTGAGGTGA AGAAGCCTGGGGCCTCAGTGAAGGTCTCCTGCA AGGCTTCTGGATACACCTTCACCGGCTACTATAT GCACTGGGTGCGACAGGCCCCTGGACAAGGGCT TGAGCGGATGGGATGGATCAACCCTAAGAGTGG TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGCGCGAGAGGAGC GTTTGATTACTTCTACTACTACGGTATGGACGTCT GGGGCCAAGGGACCACGGTCACCGTCTCCTCA<br><br>SEQ ID NO: 31815 |
| | | AA | QSVLTQPPSVSGAPGQRVTISCTGSSSNIGAGYD VHWYQQLPGTAPKLLIYGNSNRPSGVPDRFSGS KSDTSASLAITGLQAEDEADYYCQSYDNNLSGV FGGGTKLTVL<br><br>SEQ ID NO: 27810 | QVQLVQSGAEVKKPGASVKVSCKASGYTFTGYYM HWVRQAPGQGLERMGWINPKSGGTNYAQKFQGR VTMTRDTSISTAYMELSRLRSDDTAVYYCARGAFD YFYYYGMDVWGQGTTVTVSS<br><br>SEQ ID NO: 31816 |
| iPS:437210 | 21-225_227E12 | NA | TCCTATGAACTGACTCAGCCACCCTCAGTGTC CGTGTCCCCAGGACAGAGACAGCCAGCATCACCT GCTCTGGAGATAAATTGGGGGATAAATATGT TGTTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTATGGAACAGCAGCAATGTGGTA ACTGTCAGGGCGTGAACAGCAGCAATGTGGTA TTCGGCGGAGGGACCAAGCTGACCGTCCTA<br><br>SEQ ID NO: 27811 | CAGATCACCTTGAAGGAGTCTGGTCCTACGCTGG TGAAACCCACACAGACCCTCACGCTGACCTGCAC CTTCTCTGGGTTCTCACTCAGCACTAGTGGAGTG GGTGTGGGCTGGATCCGTCAGCCCCCAGGAAAG GCCCTGGAGTGGCTTGCACTCATTTATTGGAATG ATGATAAGGTCTACAGCCCATCTCTGAAGAGCAG GCTCACCATCACCAAGTACACCCTCCAAAACCAG GTGGTCCTTACAATGACCAACATGACCCTGTGG ACACAGCCACATATTACTGTGCACACAGGGAC AGCAGCTGGCCCTGACTACTGGGGCCAGGGAA CCCTGGTCACCGTCTCCTCA<br><br>SEQ ID NO: 31817 |

FIGURE 50
(Continued)

| | | | | |
|---|---|---|---|---|
| iPS:437214 | 21-225_48B12 | AA | SYELTQPPSVSVSPGQTASITCSGDKLGDKYVCW YQQKPGQSPVLVIYQDSKRPSGIPERFSGSNSGN TATLTISGTQAMDEADYYCQAWNSSNVFGGG TKLTVL | QITLKESGPTLVKPTQTLTLTCTFSGFSLSTSGVVG WIRQPPGKALECLSLIYWNDDKVYSPSLKSRLTITK YTSKNQVVLTMTNMDPVDTATYYCAHRGQQLAL DYWGQGTLVTVSS |
| | | | SEQ ID NO: 27812 | SEQ ID NO: 31818 |
| | | NA | TCCTATGAGCTGACACAGCCACCCTCGGTGTC AGTGTCCCAGGACAAACGGCCAGGATCACCT GCTCTGGAGATGCATTGCCAAAAAATATGCT TATTGGTACCAGCAGAAGTCAGGCCAGGCCCC TGTGCTGGTCATCTATGAGGACAGCAAACGAC CCTCCGGATCCCTGAGAGATTCTCTGGCTCC AGCTCAGGAGACAATGGCCACCTTGACTATCAG TGGGGCCCAGGTGGAGGATGAAGCTGACTACT ACTGTAACTCAACAGACAGCAGTGGTAATCAT GTGTATTCGGCGGAGGGACCAAGCTGACCGT CCTA | GAGGTGCAGCTGTTGGAGTCTGGGGGAGGCTTG GTACAGCCTGGGGGGTCCCTGAGACTCTCCTGT GCAGCCTCTGGATTCACCTTTAGCAGCTATGCCAT GAACTGGGTCCGCCAGGCTCCAGGGAAGGGGCT GGAGTGGGTCTCAGCTATTAGTGGTCGTGGTGGT AACACATTCTACGCAGACTCCGTGAAGGGCCGGT TCACCATCTCCAGAGACAATGCCAAGAACACGCT GTATCTGCAAATGAACAGCCTGAGAGCCGAGGA CACGGCCGTATATTACTGTGCGAAAAGAGAC GTATAACTGAACTACGAAGGGTTTGACTACTGG GGCCAGGGAACCCTGGTCACCGTCTCCTCA |
| | | | SEQ ID NO: 27813 | SEQ ID NO: 31819 |
| | | AA | SYELTQPPSVSVSPGQTARITCSGDALPKKYAYW YQQKSGQAPVLVIYEDSKRPSGIPERFSGSSSGT MATLTISGAQVEDEADYYCNSTDSSGNHVFGG GTKLTVL | EVQLLESGGGLVQPGGSLRLSCAASGFTFSSYAMN WVRQAPGKGLEWVSAISGRGGNTFYADSVKGRFTI SRDNSKNTLYLQMNSLRAEDTAVYYCAKRETYNW NYEGFDYWGQGTLVTVSS |
| | | | SEQ ID NO: 27814 | SEQ ID NO: 31820 |

FIGURE 50
(Continued)

| | | | |
|---|---|---|---|
| iPS:437216 | 21-225_51D5 | NA | GACATCCAGATGACCCAGTCTCCATCCTGCT GTCTGCATCTGTAGGAGACAGAGTCACCATCA CTTGTCGGGCGAGTCAGGGCATTAACAATTAT TTAGCCTGGTTTCAGCAGAAACCAGGGAAGC CCCTAAGTCCCTGATCTATGCTGCATCCAGTT GCGAAGTGGGGTCCCATCACAGTTCAGCGGCA GTGGATCTGGAACAGATTCATTCTCACCATC AGCAGCCTGCAACAGTATTATAGTTTGCAACTTA TTACTGCCAACAGTATTATAGTTACCCATTCAC TTTCGGCCCTGGGACCAAAGTGGATATATCAAA<br><br>SEQ ID NO: 27815 | GAGGTGCAGTTGTTGGAGTCTGGGGGAGGCTTGG TACAGCCTGGGGGGTCCCTGAGACTCTCCTGTGC AGCCTCTGGATTCACCTTTAGCAGCTATGTCATG AGCTGGGTCCGCCAGACTCCAGGGAAGGGGCTG GAGTGGGTCTCAACTATGAGTGGTAGTGGTGTC GCACATACTACGCAGACTCCGTGAACGGCCGATT CACCGTCTCCAGAGACAATTCCAAGAACACGCTG TATTTGCAAATGAGCAGCCTGAGAGCCGAGGAC ACGGCCGTATATTACTGTGCGCGGGGTGACTGCTT TTGACTACTGGGGCCAGGGAACCCTGGTCACCGT CTCCTCA<br><br>SEQ ID NO: 31821 |
| | | AA | DIQMTQSPSSLSASVGDRVTITCRASQGINNYLA WFQQKPGEAPKSLIYAASSLRSGVPSQFSGSGSG TDFILTISSLQPEDFATYYCQQYYSYPFTFGPGTK VDIK<br><br>SEQ ID NO: 27816 | EVQLLESGGGLVQPGGSLRLSCAASGFTFSSYVMS WVRQTPGKGLEWVSTMSGSGGRTYYADSVNGRFT VSRDNSKNTLYLQMSSLRAEDTAVYYCARVTAFD YWGQGTLVTVSS<br><br>SEQ ID NO: 31822 |
| iPS:437220 | 21-225_55H6 | NA | GACATCCAGATGACCCAGTCTCCATCCTCCCT GTCTGCATCTGTAGGAGACAGAGTCACCATCA CTTGCCGGGCAAGTCAGGGCATTAGAAACGAT TTAGGCTGGTATCAGCAGAAACCAGGGAAAG CCCCTAAGCGCCTGATCTATGGTGCATCCAGT TTGCAAAGTGGGGTCCCATCAAGATTCAGCGG CAGTGGATCTGGGACAGATTCACTCTCACAA TCAGCAGCCTGCAGCCTGAAGATTTTGCAGCT TATTACTGTCTACAGCGTGATAGTTACCCGTTC ACTTTCGGCGGAGGGACCAAGGTGGAGATCA AA<br><br>SEQ ID NO: 27817 | GAGGTGCACCTGGTGGAGTCTGGGGGAGGCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTGGTAGTGGTAGT ACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTACTGTGCGAGAGAACTGGGGTC TTTGACTACTGGGGCCAGGGAACCCTGGTCACCG TCTCCTCA<br><br>SEQ ID NO: 31823 |

FIGURE 50
(Continued)

| | | | |
|---|---|---|---|
| iPS:437224 | 21-225_56H1 | AA | DIQMTQSPSSLSASVGDRVTITCRASQGIRNDLG WYQQKPGKAPKRLIYGASSLQSGVPSRFSGSGS GTEFTLTISSLQPEDFAAYYCLQRDSYPFTFGGG TKVEIK<br>SEQ ID NO: 27818 | EVHLVESGGGLVKPGGSLRLSCAASGFTFSSYSMN WVRQAPGKGLEWVSSISGSSTYYADSVKGRFTIS RDNAKNSLYLQMNSLRAEDTAVYYCARTGVFDY WGQGTLVTVSS<br>SEQ ID NO: 31824 |
| | | NA | GACATCCAGATGACCCAGTCTCCATCCTCACT GTCTGCATCTGTAGGAGACAGAGTCACCATCA CTTGTCGGGCGAGTCAGGGCATTAGCAATGAT TTAGCCTGGTTTCAGCAGAAACCAGGGAAAGC CCCTCAGTCCCTGATGTCTGCTGCATCCGGTTT GCAAAGTGGGGTCCCTTCAAAGTTCAGCGGCA GTGGATCTGGGACAGATTTCACTCTCACCATC AGCAGCCTGCAGCCTGAAGATTTTGCAACTTA CTACTGTCAACAATATCAGAATTACCCCTTCA CTTTCGGCCCTGGGACCAAAGTGGATATCAAA<br>SEQ ID NO: 27819 | GAGGTGCAGCTGGTGGAATCTGGGGGAGGCTG GTCAAGCCGGGGGGGTCCCTGAGACTCTCCTGTG CAGCCTCTGGATTCACCTTCAGTAGTTACTATGAAT GAACTGGGTCCGCCAGGTCCAGGGAAGGGGCT GGAGTGGATCTCATCCATTAGTGGTAGTAGTACT GACATATACTACGCAGACTCAGTGAAGGGCCGA TTCACCATCTCCAGAGACAACGCCAAGAACTCAC TGTATCTGCAAATGAACAGCCTGAGAGCCGAGG ACACGGCTGTGTATTACTGTGCGAGAGTGGCCTC CTTTGACTACTGGGGCCAGGGAACCCTGGTCACC GTCTCCTCA<br>SEQ ID NO: 31825 |
| | | AA | DIQMTQSPSSLSASVGDRVTITCRASQGISHYLA WFQQKPGKAPQSLMSAASGLQSGVPSKFSGSGS GTDFTLTISSLQPEDFATYYCQQYQNYPFTFGPG TKVDIK<br>SEQ ID NO: 27820 | EVQLVESGGGLVKPGGSLRLSCAASGFTFSNYRMN WVRQGPGKGLEWISSISGSSTDIYYADSVKGRFTIS RDNAKNSLYLQMNSLRAEDTAVYYCARVASFDY WGQGTLVTVSS<br>SEQ ID NO: 31826 |

FIGURE 50
(Continued)

| | | | |
|---|---|---|---|
| iPS:437226 | 21-225_57C2 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACCTACTTGAATTGGTTTCAGCAG AGGCCAGGCCAATCTCCAAGGCGCCTAATTTA TGAGGTTTCTAACTGGGACTCTGGGGTCCCAA ACAGATTCAGCGGCCAGTGGGTCAGGCACTGAT TTCACACTGGAAAATCAGTGCGGTGGAGGCTGA GGATGTTGGGGTTTATTACTGCGTGCAAGGTA CACACTGGCCTCGACGTTCGGCCAAGGGACC AAGGTGGAAATCAAA<br>SEQ ID NO: 27821 | GAGGTGCAGCTGGTGGAGTCTGGGGGAGGCTTG GTCAAGCCTGGGGGGGTCCCTGAGACTCTCCTGTG CAGCCCTCTGGATTCACCTTCAGTAGCTTTGGCAT GAACTGGGTCCGCCAGGCTCCAGGGAAGGGGCT GGAGTGGGTCTCATCTATTAGTAGTAGTACTGGT TACATATACAACGCAGACTCAGTGAAGGGCCGA TTCACCATCTCCAGAGACAACGCCAAGAACTCAC TGTATCTGCAAATGAACAGCCTGAGAGCCGAAG ACACGGCTGTGTATTACTGTGCGAGAACCTATAG TGGGAGCCTGGACGTCTGGGGCCAAGGGACCAC GGTCACCGTCTCCTCA<br>SEQ ID NO: 31827 |
| | | AA | EVQLVESGGGLVKPGGSLRLSCAASGFTFSSFGMN WVRQAPGKGLEWVSSISSSTGYIYNADSVKGRFTIS RDNAKNSLYLQMNSLRAEDTAVYYCARTYSGLD VWGQGTTVTVSS<br>SEQ ID NO: 31828 | |
| iPS:437228 | 21-225_60C11 | NA | GAAATAGTGATGACGCAGTCTCCAGCCACCCT GTCTGTGTCTCCAGGGGAAAGAGCCACCCTCT CCTGCAGGGCCAGTCAGAGTGTTAGCAACGAC TTAGCCTGGTACCAGCAGAAAACCTGGCCAGGC TCCCAGGCTCCTCATCTATGGTGCATCCACCA GGGCCACTGGTATCCCAGCCAGGTTCAGTGGC AGTGGGTCTGGGACAGAGTTCACTCTCACCAT CAGCAGCCCTGCAGTCTGAACATTTTGCAGTTT ATTACTGTCAGCAGTATAGTAACTGGCCATTC ACTTTCGGCCCTGGGACCAAAGTGGATATCAA A<br>SEQ ID NO: 27823 | GAGGTGCAGCTGTTGGAGTCTGGGGGAGGCTTG GTACAGCCTGGGGGGTCCCTGAGACTCTCCTGTG CAGCCTCTGGATTCCCCTTTAGCAGCTATGCCAT GAGCTGGGTCCGCCAGGCTCCAGGGAAGGGGCT GGAGTGGGTCTCAGTCTATTAGTGGTAGTGGTGGT AACACATTCTACGCAGACTCCGTGAAGGGCCGGT TCACCATCTCCAGAGACAATGAACAGCCTGAAGA GTATCTGCAAATGAACAGCCTGAGAGCCGAGGA CACGGCCGTATATTACTGTGCGAGAAATTTTCGT GTAGTGGAGTCGGGTGCTTTGACTACTGGGGCC AGGGAACCCTGGTCACCGTCTCCTCA<br>SEQ ID NO: 31829 |

FIGURE 50
(Continued)

| | | AA | EIVMTQSPATLSVSPGERATLSCRASQSVSNDLA WYQQKPGQAPRLLIYGASTRATGIPARFSGGGS GTEFTLTISALQSEHFAVYYCQQYSNWPFTFGPG TKVDIK<br>SEQ ID NO: 27824 | EVQLLESGGGLVQPGGSLRLSCAASGFPFSSYAMS WVRQAPGKGLEWVSAISGSGGNTFYADSVKGRFTI SRDNSKNTLYLQMNSLRAEDTAVYYCAKFFGVVG VGCFDYWGQGTLVTVSS<br>SEQ ID NO: 31830 |
|---|---|---|---|---|
| iPS:437230 | 21-225_62H10 | NA | GACATCCAGATGACCCAGTCTCCATCCCCT GTCTGCATCTGTAGGAGACAGAGTCACCATCA CTTGCCGGGCAAGTCAGAGCATTACCAGCTAT TTAAATTGGTATCAGCAGAAACCAGGGAAAGT CCCTAAGCTCCTGATCTCTACTGCATCCAGTT GCAAAGTGGGGTCCCATCAAGGTTCAGTGGCA GTGGATCTGGGACAGATTTCACTCTCACCATC AGCAGTCTGCAACCTGAAGATTTTGCAACTTA CTACTGTCAACAGAGTCACAGTTTCCCATTCA CTTTCGGCCCTGGGACCAATGTGGATTTCAAA<br>SEQ ID NO: 27825 | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGCTATAGCAT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGGGGTTCG AGGGGGTTCGACCCCTGGGGCCAGGGAACCCTG GTCACCGTCTCCTCA<br>SEQ ID NO: 31831 |
| | | AA | DIQMTQSPSSLSASVGDRVTITCRASQSITSYLN WYQQKPGKVPKLLISTASSLQSGVPSRFSGSGSG TDFTLTISSLQPEDFATYYCQQSHSFPFTFGPGTN VDFK<br>SEQ ID NO: 27826 | EVQLVESGGGLVKPGGSLRLSCAASGFTFSSYSMN WVRQAPGKGLEWVSSISSSSYIYYADSVKGRFTIS RDNAKNSLYLQMNSLRAEDTAVYYCARGGSRGFD PWGQGTLVTVSS<br>SEQ ID NO: 31832 |

FIGURE 50
(Continued)

| | | | |
|---|---|---|---|
| iPS:437232 | 21-225_63E1 | NA | GACATTCAGATGACCCAGTCTCCATCTTCCGT GTATGCATCTGTAGGAGACAGAGTCACCATCA CTTGTCGTGCGAGTCAGGTATTAGCAGTAC TTAGCCTGGTATCAGCAGAAACCAGGGAAAG CCCCTAAGCTCCTGATCTATGCTGCATCCAGTT TGCAAAGTGGGGTCCCATCAAGATTCAGCGGC AGTGGGTCTGGGACAGATTTCACTCTCACCAT CAGCAGCCTGCAGCCTGAAGATTTTGCAACTT ACTATTGTCAACAGGCTAACAGTTTCCCGCTC ACTTTCGGCGGAGGGACCAAGGTGGAGATCA AA | GAGGTGCAGATGTTGGAGTCTGGGGGAGGCTTG GGACAGTCGGGGGGTCCCTGAGACTCCTGTA CAGCCTCTGGATTCACCTTCACCACTTCTGCCAT GAGCTGGGTCCGCCAGGCTCCAGGGAAGGGCT GGAGTGGGTCTCAGTATTAGCGCAGACTGGTGCT AACACATTCTACGCAGACTCCGTGAAGGGCCGGT TCACCGTCTCCAGAGACAATTCCAAGAACACGCT GTATCTGCAAATGATGAACAGCCTGACAGCCGAGGA CACGGCCGTTTATTATTGTGTGAAAGTTATAGCA GTGGCTGGAGGGCACTTTTCGACCCTCCTCA AGGGAACCCTGGTCACCGTCTCCTCA |
| | | | SEQ ID NO: 31833 |
| | | | EVQMLESGGGLGQSGGSLRLSCTASGFTFTTSAMS WVRQAPGKGLEWVSAISGSGANTFYADSVKGRFT VTRDNSKNTLYLQMNSLTAEDTAVYYCVKVIAVA GGHFFDPWGQGTLVTVSS |
| | | SEQ ID NO: 27827 | SEQ ID NO: 31834 |
| | | AA | DIQMTQSPSSVYASVGDRVTITCRASQGISSYLA WYQQKPGKAPKLLIYAASSLQSGVPSRFSGSGS GTDFTLTISSLQPEDFATYYCQQANSFPLTFGGG TKVEIK | |
| | | SEQ ID NO: 27828 | |
| iPS:437234 | 21-225_64E2 | NA | GACATCCAGATGACCCAGTCTCCATCTTCCGT GTCTGCATCTGTGGGCGACAGAGTCACCATCA CTTGTCGGGCGAGTCAGGTATTAGCAGTAC TTAGCCTGGTATCAGCAGAAACCAGGGAAAG CCCCTAAGCTCCTGATCTATGCTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAACTT ACTATTGTCAACAGGCTAACAGTTTCCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TGCACTGGGTGCGACAGGCCCCTGGACAAGGGC TTGAGTGGATGGGATGGATCAACCTAACAATAA TGGCACAAACTATGCACAGAAGTTTCAGGGCAG GGTCACCATGACCAGGGACACGTCCATCAGCAC AGCCTACATGGAGCTGAGCAGGCTGAGATCTGA CGACACGGCCGTGTATTACTGTGCGAGAGATGG GAGCAGTGGCTTTGACTACTGGGGCCAGGGAAC CCTGGTCACCGTCTCCTCA |
| | | SEQ ID NO: 27829 | SEQ ID NO: 31835 |

FIGURE 50
(Continued)

| | | | | |
|---|---|---|---|---|
| iPS:437248 | 21-225_97H3 | AA | DIQMTQSPSSVSASVGDRVTITCRASQGISRWLAWYQQKPGKAPKLLIYAASSLQSGVPSRFSGSGSGTDFTLTISSLQPEDFATYYCQQANSFPFTFGPGTKVDIK | QVQLVQSGAEVKKPGASVKVSCKASGYTFTGYYMHWVRQAPGQGLEWMGWINPNNNGTNYAQKFQGRVTMTRDTSISTAYMELSRLRSDDTAVYYCARDGSSGFDYWGQGTLVTVSS |
| | | | SEQ ID NO: 27830 | SEQ ID NO: 31836 |
| | | NA | GATATTGTGATGATTCAGTCTCCACTCTCCCTGCCCGTCACCCCTGGAGAGCCGGCCTCCATCTCCTGCAGGTCTAGTCAGAGCCTCCTGCATAGTAATGGAACAAACTATTTGGATTGGTACCTACAGAAGCCAGGGCCGGTCTCCACAGCTCTGATCTATTTGGGGTTCTCTAATCGGGCCTCCGGGGTCCTGAGAGGTTCAGTGGCAGTGGATCAGGCACAGATTTTACACTGAAAATCAGCAGAGTGGAGGCTGAGGATGTTGGGGTTTATTACTGCATGCAACCTCTACAAACTCCGTTCACTTTCGGCGGAGGGACCAAGGTGGAGATCAAA | CAGGTGCAGGTACAGCAGTGGGGCGCAGGACTGTTGAAGCCTTCGGAGACCCGTCCCTCACCTGCGCTGTCTATGTGGGTCCTCACTGATTACTACTGGAGCTGGATCCGCCAGCCCCCAGGGAAGGGGCTGGAGTGGATTGGGGAAATCAATCATAGTGGAGACACCAACTACAACCCGTCCCTCAAGAGTCGAGTCACCATATCAGTAGACACGTCCAAGAACCAGTTCTCCCTGAAGCTGAGTTCTGTGCCGAGAGAGTTCCATATAGCTGTGTATTACTGTGCGAGAGAGTTCCATATAGTGAAGCTACCTCTACTACGGTATGGACGTCTGGGGCCAAGGGACCACGGTCACCGTCTCCTCA |
| | | | SEQ ID NO: 27831 | SEQ ID NO: 31837 |
| | | AA | DIVMIQSPLSLPVTPGEPASISCRSSQSLLHSNGHNYLDWYLQKPGRSPQLLIYLGSNRASGVPERFSGSGSGTDFTLKISRVEAEDVGVYYCMQPLQTPFTFGGGTKVEIK | QVQVQQWGAGLLKPSETLSLTCAVYGGSFTDYYWSWIRQPPGKGLEWIGEINHSGDTNYNPSLKSRVTISVDTSKNQFSLKLSSVTAADTAVYYCAREFPYSGSYLYYGMDVWGQGTTVTVSS |
| | | | SEQ ID NO: 27832 | SEQ ID NO: 31838 |

FIGURE 50
(Continued)

| | | | | |
|---|---|---|---|---|
| iPS:437250 | 21-225_148C6 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACTTACTTGAATTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGTCAGGCACTGAT TTCACACTGAAAATCAGCAGGGTGGAGGCTGA CACACTGGTCGCTCACTTTCGGCGGAGGGACC AAGGTGGAGATCAAA SEQ ID NO: 27833 | GAGGTGCAACTGTTGGAGTCTGGGGGAGGCTTG GTACAGCCTGGGGGGTCCCTGAGACTCTCCTGTG CAGCCTCTGATTCACCTTTAGCAGTCAGTATGCCAT GAGCTGGGTCCGCCAGGCTCCAGGGAAGGGCT GGAGTGGGTCTCAGTTATTAGTGGTGGTGGTAGT AGTACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGGACGTCTGGGG CCAAGGGACCACGGTCACCGTCTCCTCA SEQ ID NO: 31839 |
| | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWS LTFGGGTKVEIK SEQ ID NO: 27834 | EVQLLESGGGLVQPGGSLRLSCAASGFTFSSYAMS WVRQAPGKGLEWVSVISGGGSSTYYADSVKGRFTI SRDNSKNTLYLQMNSLRAEDTAVYYCAKWRGNPT DYGMDVWGQGTTVTVSS SEQ ID NO: 31840 |
| iPS:437252 | 21-225_148H11 | NA | GATGTTGTGATGACTCAGTCTCCACTCTCCCTG CCCGTCACCCTTGGACAGCCGGCCTCCATCTC CTGCAGGTCTAGTCAAAGCCTCGTATACAGTG ATGGAAACACTTACTTGAATTGGTTTCAGCAG AGGCCAGGCCAATCTCCAAGGCGCCTAATTTA TAAGGTTTCTAACTGGGACTCTGGGGTCCCAG ACAGATTCAGCGGCAGTGGGTCAGGCACTGAT TTCACACTGAAAATGAACAGGGTGGAGGCTGA GGATGTTGGGGTTTATTACTGCATGCAAGGTA CACACTGGTTGCTCACTTTCGGCGGAGGGACC AAGGTGGAGATCAAA SEQ ID NO: 27835 | GAGGTGCAACTGTTGGAGTCTGGGGGAGGCTTG GTACAGCCTGGGGGGTCCCTGAGACTCTCCTGTG CAGCCTCTGATTCACCTTTAGCAGTCAGTATGCCAT GAGCTGGGTCCGCCAGGCTCCAGGGAAGGGCT GGAGTGGGTCTCAGTTATTAGTGGTGGTGGTAGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAATGGCGAG GTAACCCCACTGACTACGTATGGACGTCTGGGG CCAAGGGACCACGGTCACCGTCTCCTCA SEQ ID NO: 31841 |

FIGURE 50
(Continued)

| | | | |
|---|---|---|---|
| iPS:437254 | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWL LTFGGGTKVEIK<br>SEQ ID NO: 27836 | EVQLLESGGGLVQPGGSLRLSCAASGFTFSSYAMS WVRQAPGKGLEWVSVISGGSSTYYADSVKGRFTI SRDNSKNTLYLQMNSLRAEDTAVYYCAKWRGNPT DYGMDVWGQGTTVTVSS<br>SEQ ID NO: 31842 |
| | 21-225_149F2 | NA | GATGTTGTGATGACTCAGTCTCCACTCTCCCTG CCCGTCACCCTTGGACAGCCGGCCTCCATCTC CTGCAGGTCTAGTCAAAGCCTGGTATACAGTG ATGGAAACACCTCCTTGAATTGGTTTCAGCAG AGGCCAGGCCAATCTCCAAGGCGCCTAATTTA TAAGGTTTCTAACTGGGACTCTGGGGTCCCAG TCAGATTCAGGGGCAGTGGGTCAGGCACTGAT TTCACACTGGAAAATCAGCAGGGTGGAGGCTGA GGATGTTGGGATTTATTACTGCATGCAAGGTA CACACTGGCCTCCCACTTTCGGCGGAGGGACC AAGGTGGAGATCAAA<br>SEQ ID NO: 27837 | CAGGTGCAGCTGGGGGAGGCTGGGGGAGGCGTG GTCCAGCCTGGGAGGTCCCTGAGACTCTCCTGTG CAGCGTCTGGATTCACCTTCAGTCGTTATGGCAT GCACTGGGTCCGCCAGGCTCCAGGCAAGGGCT GGAGTGGGTGGCTTTTATATGGTATGATGAAGT GAGAACTACTATGCAGACTCCGTGAAGGCCGA TTCACCATCTCCAGAGTCAATTCCAGAACACGC TGTATCTGCAAATGAACAGCCTGAGAGCCGAGG ACACGGCTGTGTATTACTGTGCGAGAGATCGGGT GGAGGGTTCGGGACTCCCTACTACTACTACGGT ATGGACGTCTGGGGCCAAGGGACCACGGTCACC GTCTCCTCA<br>SEQ ID NO: 31843 |
| | | AA | DVVMTQSPLSLPVTLGQPASISCRSSQSLVYSDG NTSLNWFQQRPGQSPRRLIYKVSNWDSGVPVRF SGSGSGTDFTLKISRVEAEDVGIYYCMQGTHWP PTFGGGTKVEIK<br>SEQ ID NO: 27838 | QVQLGEAGGGVVQPGRSLRLSCAASGFTFSRYGM HWVRQAPGKGLEWVAFIWYDGSENYYADSVKGR FTISRVNSRNTLYLQMNSLRAEDTAVYYCARDRVE GSGTPYYYGMDVWGQGTTVTVSS<br>SEQ ID NO: 31844 |

FIGURE 50
(Continued)

| | | | |
|---|---|---|---|
| iPS:437256 | 21-225_150F11 | NA | GATGTGTGATGAGTCAGTATCCACTCTCCCT GCCCGTCACCTTTGGACAGGGCCTCCATCT CATGCAGGTCTAGTCAAAGCCTCGTATACAGT GATGGAAACACCTCCTTGAATTGGTTTCAGCA GAGGCCAGGCCAATATCCAAGGCGCTTAATTT ATAAGGTTTCTAACTGGGACTATGGGGTCCA GTCAGATTCAGCGGCAGTGGGTCAGGCACTGA TTTCACACTGAAAATCAGCAGGGTGGAGGCTG AGGATGTTGGGATTTATTACTGCATGCAAGGT ACACACTGGCCTCCCACTTTCGGCGGAGGGAC CAAGGTGGAGATCAAA | CAGGTGCAGCTGGGGGAGGCTGGGGGAGGCGTG GTCCAGCCTGGGAGGTCCCTGAGACTCTCCTGTG CAGCGTCTGATTCACCTTCAGTCGTATGCAT GCACTGGGTCCGCCAGGCTCCAGGCAAGGGCT GGAGTGGGTGGCTTTTATATGGTATGATGAAGT GAGAACTACTATGCAGACTCCGTGAAGGGCCGA TTCACCATCTCCAGAGTCAATTCCAGAACACGC TGTATCTGCAAATGAACAGCCTGAGAGCCGAGG ACACGGCTGTGTATTACTGTGCGAGAGATCGGGT GGAGGGTTCGGGGACTCCTACTACTACTACGGT ATGGACGTCTGGGGCCAAGGGACCACGGTCACC GTCTCCTCA |
| | | | SEQ ID NO: 27839 | SEQ ID NO: 31845 |
| | | AA | DVVMSQYPLSLPVTFGQPASISCRSSQSLVYSDG NTSLNWFQQRPGQYPRRLLYKVSNWDYGVPVR FSGSGSGTDFTLKISRVEAEDVGIYYCMQGTHW PPTFGGGTKVEIK | QVQLGEAGGGVVQPGRSLRLSCAASGFTFSRYGM HWVRQAPGKGLEWVAFIWYDGSENYYADSVKGR FTISRVNSRNTLYLQMNSLRAEDTAVYYCARDRVE GSGTPYYYYGMDVWGQGTTVTVSS |
| | | | SEQ ID NO: 27840 | SEQ ID NO: 31846 |
| iPS:437258 | 21-225_153F9 | NA | GACATCCAGATGACCCAGTCTCCATCCTCACT GTCTGCATCTGTAGGAGACAGAGTCACCATCA CTTGTCGGGCGAGTCAGGGCATTAGCAATTAT TTAGCCTGGTTTCAGCAGAAAGCCAGGGAAAGC CCCTAAGTCCCTGATCTCTGCTGCATCCAGTTT GCAAAGTGGGGGTCCCATCAAGGTTCAGCGGCA GTGGATCTGGGACAGATTTCACTCTCACCATC AGCAGCCTGCCAACAGTATATAGTTACCCGCTCA TTACTGCCAACAGTATATAGTTACCCGCTCA GTTTCGGCGGAGGGACCAAGGTGGAGATCAA A | CAGGTACACCTGGTGGAGTCTGGGGGAGGCGTG GTCCAGCCTGGGAGGTCCCTGAGACTCTCCTGTG CAGCGTCTGATTCACCATCAGTACGTACCTATGGCAT GCACTGGGTCCGCCAGGTCCAGGCAAGGGCT GGAGTGGGTGGCAGTTATATGGTATGTGGAAGT GATACAGACTATGCAGACTCCGTGAGGGGCCGA TTCACCATCTCCAGAGACAATTCCAAGAACACGC TGTATCTGCAAATGAACAGCCTGAGAGCCGAGG ACACGGCTGTGTATTACTGTGCGAGAGATCGGGA TATTGTAGTGGTGGTAACTGCCCTTACTACTACT ACTACGGTATGGACGTCTGGGGCCAAGGGACCA CGGTCACCGTCTCCTCA |

FIGURE 50
(Continued)

| | | | SEQ ID NO: 27841 | SEQ ID NO: 31847 |
|---|---|---|---|---|
| | | AA | DIQMTQSPSSLSASVGDRVTITCRASQGISNYLAWFQQKPGKAPKSLISAASSLQSGVPSKFSGSGSGTDFTLTISSLQPEDFATYYCQQYNSYPLSFGGGTKVEIK | QVHLVESGGGVVQPGRSLRLSCAASGFTISTYGMHWVRQGPGKGLEWVAVIWYGGSDTDYADSVRGRFTISRDISKNTLYLQMNSLRAEDTAVYYCARDRDYCSGGNCPYYYYYGMDVWGQGTTVTVSS |
| iPS:437260 | 21-225_170D1 | | SEQ ID NO: 27842 | SEQ ID NO: 31848 |
| | | NA | GACATCCAGATGACCCAGTCTCCATCCTCACTGGCTGCATCTGTAGGAGACAGAGTCACCATCACTTGTCGGGCGAGTCAGGACATTAGCAATTATCTGTCGGGCGAGTCAGGACATTAGCAATTATTTAGCCTGGTTTCAGCAGAAACCAGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTACTGCCAACAGTATAGTTTCCCTCTCACTTTCGGCGGAGGGACCAAGGTGGAGATCAAA | CAGGTGCAGTTGGTGCAGTCTGGGGGCTGAGGTGAAGAAGCCTGGGGCCTCAGTGAAGGTCTCCTGCAAGGCTTCTGGATACACCTTCACCGGCTACTTTATGCACTGGGTGCGACAGGCCCCTGGACAAGGGCTTGAGTGGATGGGATGGATCAAGCCTAAAGCGGTGGCACAAACTGTGCACCAGGACACGTCCAGGCAGGGTCACCATGACCAGGGACACAGTCCAGCAGCACAGCCTACATGGAGCTGAGCAGGCTGACATCTGACGACACGGCCGTGTACTACTGTGCGAGAGGGGGGCTACGGTGACTACGTGGGGGCTCTTTGACTACTGGGGCCAGGGAACCCTGGTCACCGTCTCCTCA |
| | | | SEQ ID NO: 27843 | SEQ ID NO: 31849 |
| | | AA | DIQMTQSPSSLAASVGDRVTITCRASQDISNYLAWFQQKPGKAPKSLIYAASSLQSGVPSRFSGSGSGTDFTLTISSLQPEDFATYYCQQCDSFPLTFGGGTKVEIK | QVQLVQSGAEVKKPGASVKVSCKASGYTFTGYFMHWVRQAPGQGLEWMGWIKPKSGGTNCAQKFQGRVTMTRDTSSSTAYMELSRLTSDDTAVYYCARGGATVTTWGVFDYWGQGTLVTVSS |
| | | | SEQ ID NO: 27844 | SEQ ID NO: 31850 |

FIGURE 50
(Continued)

| | | | |
|---|---|---|---|
| iPS:437262 | 21-225_170E4 | NA | GACATCCAGATGACCCAGTCTCCATCCTCCCT GTCTGCATCTGTAGGAGACAGAGTCACCATCA CTTGCCGGGCAAGTCAGGGACATTAGAAATGAT TTAGGCTATTATCAGCAGAAACCAGGGAAAGC CCCTAAGCGCCTGATCTATGTTGCATCCGGTTT CCCTAAGTCCATCAAGGTTCAGCGGCA GTGGATCTGGGACAGAATTCACTCTCACAATC AGCAGCCTGCAGCCTGAAGATTTTGCAACTTA TTACTGTCTACAGCACAATAGTTACCCTCCGT GGACGTTCGGCCAAGGGACCAAGGTGGATAT CAAA<br><br>SEQ ID NO: 27845 | GAGGTGCAACTGGTGGAGTCTGGGGGAGGCTCG GTACAGCCTGGGGGGTCCCTGAGACTCTCCTGTG CAGCCTCTGATTCACCTTCAGTAGTAGCAT GAACTGGGTCCGCCAGGCTCCAGGGAAGGGCT GGAGTGGGTTCATACATTAGCAGTAGTGGTAGT ACCAAATACTACGCAGACTCTGTGGAGGCCGA TTCACCATCTCCAGAGACAATGCCAAGAATTCAC TGGATCTGCAAATGAACAGCCTGAGAGACGAGG ACACGGCTGTGTATCGCTGTGCGAGAGATAGTAG GAAGGGGTTCTACTACGGTCTCGGACGTCTGGGGC CAAGGGACCACGGTCACCGTCTCCTCA<br><br>SEQ ID NO: 31851 |
| | | AA | DIQMTQSPSSLSASVGDRVTITCRASQGIRNDLG YYQQKPGKAPKRLIYVASGLQSGVPSRFSGSGS GTEFTLTISSLQPEDFATYYCLQHNSYPPWTFGQ GTKVDIK<br><br>SEQ ID NO: 27846 | EVQLVESGGGSVQPGGSLRLSCAASGFTFSSYSMN WVRQAPGKGLEWVSYISSSGSTKYYADSVEGRFTI SRDNAKNSLDLQMNSLRDEDTAVYRCARDSRKGF YYGLDVWGQGTTVTVSS<br><br>SEQ ID NO: 31852 |
| iPS:437264 | 21-225_171H12 | NA | GACATCCAGATGACCCAGTCTCCATCCTCCACT GTCTGCATCTGTAGGAGACAGAGTCACCATCA CTTGTCGGGCGAGTCAGGACATTAGCAATTAT TTAGCCTGGTTTCAGCAGAAGCCAGGGAAAGC CCCTAAGTCCCTGATCTATTCTGCATCCAGTTT GCAAAGTGGGGTCCCATCAAGTTCAGCGGCA GTGGATCTGGGACAGATTTCACTCTCACCATC AGCAGCCTGCAGCCTGAAGATTTTGCAACTTA TTACTGCCAACAATCTGATAGTTACCCTCTCAC TTTCGGCGGAGGGACCAAGGTGGAGATCAAA<br><br>SEQ ID NO: 27847 | CAGGTGCAGCTGGTGCAGTCTGGGGCTGAGGTG AAGAAGCCTGGGGCCTCAGTGAAGGTCTCTGC AAGGCTTCTGGATACACCTTCACCGGCTACTTA TGCACTGGGTGCGACAGGCCCCTGGACAAGGC TTGAGTGGATGGGATGGATCAAGCTAAGAGTG GTGGCACAAACTCTGCACAGAGGTTTCAGGGCA GGGTCACCATGACCAGGGACACGTCCATCAACA CAGCCTACATGGAGCTGAACAGGCTGAGATCTG ACGACACGGCCGTATATTACTGTGCGAGAGGGG GGACTACGGTGGCTACGGTGGGGGTCTTTGACTA CTGGGGCCAGGGAACCCTGGTCACCGTCTCCTCA<br><br>SEQ ID NO: 31853 |

FIGURE 50
(Continued)

| | | | | |
|---|---|---|---|---|
| iPS:437266 | 21-225_177A5 | AA | DIQMTQSPSSLSASVGDRVTITCRASQDISNYLA WFQQKPGKAPKSLIYSASSLQSGVPSKFSGSGSG TDFTLTISSLQPEDFATYYCQQSDSYPLTFGGGT KVEIK<br>SEQ ID NO: 27848 | QVQLVQSGAEVKKPGASVRVSCKASGYTFTGYFM HWVRQAPGQGLEWMGWIKPKSGGTNSAQRFQGR VTMTRDTSINTAYMELNRLRSDDTAVYYCARGGT TVATWGVFDYWGQGTLVTVSS<br>SEQ ID NO: 31854 |
| | | NA | GACATCCAGATGACCCAGTCTCCATCCTCACT GTCTGCATCTGTAGGAGACAGAGTCACCATCA CTTGTCGGGCGAGTCAGGACATTAGCAATTAT TTAGCCTGGTTTCAGCAGAAGCCAGGAAAGC CCCTAAGTCCCTGATCTATTCTGCATCCAGTTT GCAAAGTGGGGTCCCATCAAAGTTCAGCGGCA GTGGATCTGGGACAGATTTCACTCTCACCATC AGCAGCCTGCAGCCTGAAGATTTTGCAACTTA TTACTGCCAACAATCTGATAGTTACCCTCTCAC TTTCGGGGGAGGGACCAAGGTGGAGATCAAA<br>SEQ ID NO: 27849 | CAGGTGCAGCTGGTACAGTCTGGGGCTGAGGTG AAGAAGCCTGGGGCCTCAGTGCGGGTCTCCTGCA AGGCTTCTGGATACACCTTCACCGGCTACTTTAT GCACTGGGTGCGACAGGCCCCTGGACAAGGGCT TGAGTGGATGGGATGGATCAAGCCTAAGAGTGG TGGCACAAACTCTGCACAGAGATTTCAGGGCAG GGTCACCATGACCAGGGACACAGTCCATCAACAC AGCCTACATGGAGCTGAACTGGCTGAGATCTGAC GACACGGCCGTATATTACTGTGCGAGAGGGGGG ACTACGGTGGCTACGTGGGGGTCTTTGACTACT GGGGCCAGGGAACCCTGGTCACCGTCTCCTCA<br>SEQ ID NO: 31855 |
| | | AA | DIQMTQSPSSLSASVGDRVTITCRASQDISNYLA WFQQKPGKAPKSLIYSASSLQSGVPSKFSGSGSG TDFTLTISSLQPEDFATYYCQQSDSYPLTFGGGT KVEIK<br>SEQ ID NO: 27850 | QVQLVQSGAEVKKPGASVRVSCKASGYTFTGYFM HWVRQAPGQGLEWMGWIKPKSGGTNSAQRFQGR VTMTRDTSINTAYMELNWLRSDDTAVYYCARGGT TVATWGVFDYWGQGTLVTVSS<br>SEQ ID NO: 31856 |

FIGURE 50
(Continued)

| | | | |
|---|---|---|---|
| iPS:437268 | 21-225_177D2 | NA | GATGTTGTGATGACTCAGTCTCCACTCTCCCTG CCCGTCACCCTTGGACAGCCGGCCTCCATCTC CTGCAGGTCTAGTCAAAGCCTCTGTATACAGTG ATGGAAACACTTACTTGAATTGGTTTCAGCAG AGGCCAGGCCAATCTCCAAGGCGCCTAATTTA TAAGGTTTCTAACTGGGACTGGGGTCCCAG ACAGATTCAGCGGCAGTGGTCAGGCACTGAT TTCACACTGAAAATCAGCAGGTGGAGGCTGA GGATGTTGGGGTTTATTACTGCAAGTA CACACTGGCCTCTCACTTTCGGCGGAGGGACC AAGGTGGAGATCAAA<br>SEQ ID NO: 27851 | CAGGTGCAGCTGGTGGAGTCTGGGGGAGGCGTG GTCCAGCCTGGGAGGTCCCTGAGACTCTCCTGTG CAGCGTCTGATTCACCTTCAGTAGCTATGGCAT GGACTGGGTCCGCCAGGCTCCAGGCAAGGGCT GGAGTGGGTGGCAATTATATGGTTTGATGGAAGT AATAAATACTATGCAGACTCCGTGAAGGGCGA TTCACCATCTCCAGAGACAATTCCAAGAACACGC TGTATCTGCAAATGAACAGCCTGAGAGCCGAGG ACACGGCTGTGTATTACTGTGCGAGAGCATATTG TGGTGGTGACTGCTATTTCCCCCATCTCCATTACT ACGGTATGGACGTCTGGGGCCAAGGGACCACGG TCACCGTCTCCTCA<br>SEQ ID NO: 31857 |
| | | AA | DVVMTQSPLSLPVTLGQPASISCRSSQSLVYSDG NTYLNWFQQRPGQSPRRLIYKVSNWDSGVPDRF SGSGSGTDFTLKISRVEAEDVGVYYCMQGTHWP LTFGGGTKVEIK<br>SEQ ID NO: 27852 | QVQLVESGGGVVQPGRSLRLSCAASGFTFSSYGMD WVRQAPGKGLEWVAIIWFDGSNKYYADSVKGRFT ISRDNSKNTLYLQMNSLRAEDTAVYYCARAYCGG DCYFPHLHYYGMDVWGQGTTVTSS<br>SEQ ID NO: 31858 |
| iPS:437270 | 21-225_178H4 | NA | GACATCCAGATGACCCAGTCTCCATCCTCACT GTCTGCATCTGTAGGAGACAGAGTCACCATCA CTTGTCGGGCGAGTCAGGATCATTAGCACTTAT TTAGCCTGGTTTCAGCAGAAACCAGGAAAGC CCCTAAGGTCCCTGATCTTTCTGCATCCAGTTT GCAAAGTGGGGGGTCCATCAAGGTTCAGGGCA GTGGATCTGGGACAGATTTCACTCTCACCATC AGCAACCTGCAGCCTGAAGATTTGCAACTTA TTACTGCCAACAATCTAATAGTTACCCCTCTCAC TTTCGGCGGAGGGACCAAGGTGGAGATCAAA | CAGGTACAGCTGGTGCAGTCTGGGGCTGAGGTG AAGAAGCCTGGGGCCTCAGTGAAGGTCTCCTGC AAGGCTTCTGGATACACCTTCACCGGCTACTTTA TGCACTGGGTGCGACAGGCCCCTGGACAAGGGC TTGAGTGGATGGGATGGATCAACGCTAAAGTG GTGGCACAAACTGTGCACAGGACACGTCCATCAGCA GGGTCACCATGACCAGGGACACGTCCATCAGCA CAGCCTACATGGAACTGAGCAGCCTGAGATCTG ACGACACGGCCGTGTATTATTGTGTGAGAGGGGG GACTACGGTGACTACGGTGGGGGTCTTTGACTAC TGGGGCCAGGGAACCATGGTCACCGTCTCCTCA |

FIGURE 50
(Continued)

| | | | |
|---|---|---|---|
| | | | SEQ ID NO: 27853 |
| | | AA | DIQMTQSPSSLSASVGDRVTITCRASQDISNYLAWFQQKPGKAPKSLIFSASSLQSGVPSKFSGSGSGTDFTLTISNLQPEDFATYYCQQSNSYPLTFGGGTKVEIK |
| | | | SEQ ID NO: 27854 |
| iPS:437274 | 21-225_196D4 | NA | GACATCCAGATGACCCAGTCTCCATCCTCACTGTCTGCATCTGTAGGAGACAGAGTCACCATCACTTGTCGGGCGAGTCAGGGCATTAGCAATTATCTTAGCCTGGTTTCAGCAGAAACCAGGGAAAGCCCCTAAGTCCCTTATCTATGCTGCATCCAGTTTGCAAAGTGGGGTCCCATCAAAGTTCAGCGGCAGTGGATGTGGGACAGATTTCACTCTCACCATCAGCAGCCCGCAACATTATCTTAATTACCCTCTCACTTACTGCCAACATTATCTTAATTACCCTCTCACCTTCGGCCAAGGGACCACGACTGGAGATTAAA |
| | | | SEQ ID NO: 27855 |
| | | AA | DIQMTQSPSSLSASVGDRVTITCRASQGISNYLAWFQQNPGKAPKSLIYAASSLQSGVPSKFSGSGSGTDFTLTISSPQPEDVATYYCQHYLNYPLTFGQGTRLEIK |
| | | | SEQ ID NO: 27856 |
| | | | SEQ ID NO: 31859 |
| | | | QVQLVQSGAEVKKPGASVKVSCKASGYTFTFGYFMHWVRQAPGQGLEWMGWIKPKSGGTNCAQKFQGRVTMTRDTSISTAYMELSRLRSDDTAVYYCVRGGTTVTTWGVFDYWGQGTMVTVSS |
| | | | SEQ ID NO: 31860 |
| | | | CAGGTGCAGGTGGTGGAGTCTGGGGGAGGCGTGGTCCAGCCTGGGGAGGTCCCTGAGACTCTCCTGTGCAGCGTCTGGATTCACCTTCAGTAGTAGTTATGGCATGCACTGGGTCCGCCAGGCTCCAGGCAAGGGGCTGGAGTGGGTGGCAGTTATATGTATGATGGAAGTAATAGAAACTATGCAGACTCCGTGAAGGGCCGATTCACCATCTCCAGAGACAATTCCAAGAACACGCTGTATCTGCAAATGAACAGCCTGAGAGTCGAGGACACGGCTGTGTATTACTGTGCGAGAGATCGGTCTAAGGGTTACGACGGTATGGACGTCTGGGGCCAAGGGACCACGGTCACCGTCTCCTCA |
| | | | SEQ ID NO: 31861 |
| | | | QVQVVESGGGVVQPGRSLRLSCAASGFTFSSYGMHWVRQAPGKGLEWVAVIWYDGSNRNYADSVKGRFTISRDNSKNTLYLQMNSLRVEDTAVYYCARDRSKGYDGMDVWGQGTTVTVSS |
| | | | SEQ ID NO: 31862 |

FIGURE 50
(Continued)

| | | | |
|---|---|---|---|
| iPS:437280 | 21-225_203C10 | NA | GACATCCAGATGACCCAGTCTCCATCCTCCT GTCTGCATCTGTAGGAGACAGAGTCACCATCA CTTGCCGGGCAAGTCAGGACATTAGAAATGAT TTAGGCTGGTATCAGCAGAAACCAGGGAAAG CCCCTAAGCGCCTGATCTATGAGGCATCCAGT TTGCAAAGTGGGGTCCCATCACGCTTCAGCGG CAGTGGATCTGGGACAGAATTCACTCTCACAA TCAGCAGCCTGCAGCCTGAAGATTTTGCCGCT TATTACTGTCTACAGCATAATAGTTACCCGTG GACGTTCGGCCAAGGGACCAAGGTGGAGATC AAA<br><br>SEQ ID NO: 27857 | CAGGTGCAGCTGGTGGTGGAGTCTGGGGGAGGCGTG GTCCAGCCTGGGAGGTCCCTGAGACTCTCCTGTG CAGCGTCTGGATTCACCTTCAGTGACTATGGCAT GCACTGGGTCCGCCAGGCTCCAGGCAAGGGGCT GGAGTGGGTGGCAGTTATATGGTATGATGAGGT AATACACATTATACAGACTCCGTGAAGGGCCGAT TCACCATCTCCAGAGACAATTCCAAGAACACGCT GTATCTGCAAATGAACAGCCTGAGAGCCGAGGA CACGGCTGTATATTACTGTGCGAGAGAAGTGGGT TGGCTTGATGACTACTGGGGCCAGGGAACCCTGG TCACCGTCTCCTCA<br><br>SEQ ID NO: 31863 |
| | | AA | DIQMTQSPSSLSASVGDRVTITCRASQDIRNDLG WYQQKPAKAPKRLIYRASSLQSGVPSRFSGSGS GTEFTLTISSLQPEDFAAYYCLQHNSYPWTFGQG TKVEIK<br><br>SEQ ID NO: 27858 | QVQLVESGGGVVQPGRSLRLSCAASGFTFSDYGM HWVRQAPGKGLEWVAVIWYDGNTHYTDSVKGR FTISRDNSKNTLYLQMNSLRAEDTAVYYCAREVG WLDDYWGQGTLVTVSS<br><br>SEQ ID NO: 31864 |
| iPS:437282 | 21-225_207C9 | NA | GACAACCAGATGACCCAGTCTCCATCCTCCCT GTCTGCATCTGTAGGAGACAGAGTCACCATCA CTTGCCGGGCAAGTCAGAGGTTTAGTAACTAT TTAAAATTGGTATCAGCAGAAACCAGGGAAAG CCCCTAAGCTCCTGATCTATACTGCATCCAGT TGCAAAGTGGGGTCCCATCAAGGTTCAGTGCC AGTGTCTCTGGGACAGACTTCACTCTCACCAT CAGCAGTCTGCAACCTGAAGATTTTGCAACTT ATTACTGTCAACAGAGTTACAGTATTCCGCTC ACTTTCGGCGGAGGGACCAAGGTGGAGATCA AA<br><br>SEQ ID NO: 27859 | GAGGTGCAGCTGTTGGAGTCTGGGGGAGGCTTG GTACAGCCTGGGGGGTCCCTGAGACTCTCCTGTG CAGCCTCTGGATTCACCTTTAGCAGCTATGCCAT GAGCTGGGTCCGCCAGGCTCCAGGGAAGGGGCT GGAGTGGGTCTCAGCTATTAGTAGTGGTAGTGGT AGCACATACTACGCAGACTCCGTGAAGGGCCGG TTCACCATCTCCAGAGACAATTCCAAGAACACGC TGTATCTGCAAATGAACAGCCTGAGAGCCGAGG ACACGGCCGTATATTACTGTGCGAAAGCTGGTGG AACTACGGGGAGCTACTACTACTACGGTATGA CGTCTGGGGCCAAGGGACCACGGTCACCGTCTCC TCA<br><br>SEQ ID NO: 31865 |

FIGURE 50 (Continued)

| | | | | |
|---|---|---|---|---|
| iPS:437286 | 21-225_208F1 | AA | DNQMTQSPSSLSASVGDRVTITCRASQRFSNYLN WYQQKPGKAPKLLIYTASSLQSGVPSRFSASVSG TDFTLTISSLQPEDFATYYCQQSYSIPLTFGGGTK VEIK<br><br>SEQ ID NO: 27860 | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYYCAKAGGTTG SYYYNGMDVWGQGTTVTSS<br><br>SEQ ID NO: 31866 |
| | | NA | GACATCCAGATGACCCAGTCTCCATCCTCCT GTCTGCATCTGTAGGAGACAGAGTCACCATCA CTTGCCGGGCAAGTCAGGGCATTAGACATGAT TTAGGCTGGTATCAGCAGAAACCAGGGAAAG CCCCTAAGCGCCTGATCTTTGCTGCATCCAGTT TGCAAAGTGGGGTCCCATCTAGATTCAGCGGC AGTGGATCTGGGACAGATTCACTCTCACAAT CAGCAGCCTGCAGCCTGAAGATTTTGCAACTT ATTACTGTCTACAGCATTATAGTTTCCCTCGGA CGTTCGGCCAAGGGACCAAGGTGAAATCAA A<br><br>SEQ ID NO: 27861 | CAGGTGCAGCTGGTGGAGTCTGGGGGAGGCGTG GTCCAGCCTGGGAGGTCCCTGAGACTCTCCTGTG CAGCGTCTAGATTCACCTTCAGTGACTATGTCAT GCACTGGGTCCGCCAGGCTCCAGGCAAGGGGCT GGAGTGGGTGGCAGTTATATGGTATGATGGAAGT AATAAATACTATTGTAGACTCCGTGAAGGGCGAT TCACCATCTCCAGAGACAATTCCAGGAACACGCT GTATCTGCAAATGAACAGCCTGAGAGCCGAGGA CACGGCTGTATATTACTGTGCGAGAGAACGGTAT AGCAGTGGCTTGTACGACTACGGTATGGACGTCT GGGGCCAAGGGACCACGGTCACCGTCTCCTCA<br><br>SEQ ID NO: 31867 |
| | | AA | DIQMTQSPSSLSASVGDRVTITCRASQGIRHDLG WYQQKPGKAPKRLIFAASSLQSGVPSRFSGSGSG TEFTLTISSLQPEDFATYYCLQHYSFPRTFGQGTK VEIK<br><br>SEQ ID NO: 27862 | QVQLVESGGGVVQPGRSLRLSCAASRFTFSDYVMH WVRQAPGKGLEWVAVIWYDGSNKYYVDSVKGRF TISRDNSRNTLYLQMNSLRAEDTAVYYCARERYSS GLYDYGMDVWGQGTTVTSS<br><br>SEQ ID NO: 31868 |

FIGURE 50
(Continued)

| | | | |
|---|---|---|---|
| iPS:437290 | 21-225_210G6 | NA | GACATCCAGATGACCCAGTCTCCATCCTCCCG<br>TTTTGCATTTGTAGGAGACAGAGTCACCATCA<br>CTTGCCGGGCAAGTCAGGGCATTAGACATGAT<br>TTAGGCTGGTATCAGCAGAAACCAGGAAAG<br>CCCTTAAGCGCTTGATATATGCTGCATCCAGTT<br>CGCAAAGTGGGGTCCCATCAAGGTTCAGCGGC<br>AGTGGATGTGGGACAGAATTCACTCTCACAAT<br>CAGCAGCGTGCAGCGCGAAGATTTTGCAAATT<br>ATTACTGTGTACAGCATTATAGTTTCCCTCGA<br>CGTTCGGCCAAGGGACCAAGGTGGAAATCAAA | CAGGTGCAGCTGGTGGAGTCTGGGGGAGGCGTG<br>GTCCAGCCTGGGAGGTCCCTGAGACTCTCCTGTG<br>CAGCGTCTGGATTCACCTTCAGTGACTAGTCAT<br>GCACTGGGTCCGCCAGGCTCCAGGCAAGGGCT<br>GGAGTGGGTGGCAGTTATATGTATGATGGAAGT<br>AATAAATACTATGTAGACTCCGTGAAGGGCCGAT<br>TCACCATCTCCAGAGACAATTCCAGGAACACGT<br>GTATCTGCAAATGAACAGCCTGAGAGCCGAGGA<br>CACGGCTGTGTATTACTGTGCGAGAGAACGTAT<br>AGCAGTTGGCTTGTAGCGACTACGGTATGACGTCT<br>GGGGCCAAGGGACCACGGTCACCGTCCTCCTCA |
| | | | SEQ ID NO: 27863 | SEQ ID NO: 31869 |
| | | AA | DIQMTQSPSSRFAFVGDRVTITCRASQGIRHDLG<br>WYQQKPGKALKRLIYAASSSQSGVPSRFSGSGC<br>GTEFTLTISSVQREDFANYYCVQHYSFPRTFGQG<br>TKVEIK | QVQLVESGGGVVQPGRSLRLSCAASGFTFSDYVM<br>HWVRQAPGKGLEWVAVIWYDGSNKYYVDSVKGR<br>FTISRDNSRNTLYLQMNSLRAEDTAVYYCARERYS<br>SGLYDYGMDVWGQGTTVTVSS |
| | | | SEQ ID NO: 27864 | SEQ ID NO: 31870 |
| iPS:437294 | 21-225_216D5 | NA | GATGTTGTGATGACTCAGTCTCCACTCTCCCTG<br>CCCGTCACCCTTGGACAGCCGGCCTCCATCTC<br>CTGCAGGTCTAGTCAAAGCCTGTATACAGTG<br>ATGGAAACACCTACTTGAATTGGTTTCAGCAG<br>AGGCCAGGCCAATCTCCAAGGCGCCTCATTTA<br>TAAGGTTTCTAACTGGGACTCTGGGGTCCCAG<br>ACAGAATCAGCGGCAGTGGGTCAGGCACTGA<br>TTTCACACTGAAAATCAGCAGGGTGGAGGCTG<br>AGGATGTTGGGATTTATTACTGCATGCAAGGT<br>GCACAACTGGTTCACCTTCGGCCAAGGGACACG<br>ACTGGAGATTAAA | CAGGTGCAGCTGCAGGAGTCGGGCCCAGGACTG<br>GTGAAGCCTTCACAGACCCTGTCCTCACCTGCA<br>CTGTCTCTGGTGGCTCCATCAGCAGTGGTGTTA<br>CTACTGGAGCTGGATCCGCCAGCACCCAGGGAA<br>GGGGAGCACTACTACAACCCGTCCCTCAAGAGTC<br>GAGTTACCATATCAGTAGACACGTCTAAGAACCA<br>ATTCTCCCTGAAACTGAACTCTGTGACTGCCGCG<br>GACACGGCCGTGTATTCTGTGCGAGAGATTCCC<br>CTGACAGGGGGTTTGACTACTGGGGCCAGGGAA<br>CCCTGGTCACCGTCTCCTCA |
| | | | SEQ ID NO: 27865 | SEQ ID NO: 31871 |

FIGURE 50
(Continued)

| | | | | |
|---|---|---|---|---|
| iPS:437302 | 21-225_225B11 | AA | DVVMTQSPLSLPVTLGQPASISCRSSQSLVYSDG NTYLNWFQQRPGQSPRRLIYKVSNWDSGVPDRI SGSGSGTDFTLKISRVEAEDVGIYYCMQGAHWF TFGQGTRLEIK<br><br>SEQ ID NO: 27866 | QVQLQESGPGLVKPSQTLSLTCTVSGGSISSGGYYW SWIRQHPGKGLEWIGYIYYSGSTYYNPSLKSRVTIS VDTSKNQFSLKLNSVTAADTAVYFCARDSPDRGFD YWGQGTLVTVSS<br><br>SEQ ID NO: 31872 |
| | | NA | GACATCCAGATGACCCAGTCTCCATCCTCCCT GTCTGCATCTATAGGAGACAGAGTCACCATCA CTTGCCAGGCGAGTCAGGACATTTTCAACTAT TTAAATTGGTATCAGCAGAAACCAGGGAAAG CCCCTAAGCTCCTGATCTACGATGCATCCACTT TGGAAACAGGGGTCCCATCAAGGTTCAGTGGA AGTGGATCTGGGACAGATTTTACTTTCACCAT CAGCAGCCTGCAGCCTGAAGATATGATAATCTCCCGATC ATTACTGTCAACAGTATGATAATCTCCCGATC ACCTTCGGCCAAGGGACACGACTGGAGATTAA A<br><br>SEQ ID NO: 27867 | CAGGTGCAGCTGGTGCAGTCTGGGGGAGGCGTG GTCCAGCCTGGGAGGTCCCTGAGACTCTCCTGTG CAGCCTCTGGATTCACCTTCAGTAGCTATGGCAT GCACTGGGTCCGCCAGGCTCCAGGCAAGGGGCT GGAGTGGGTGGACAATTATATGCATCATATGGAAGT AATAAATACTATGCAGACTCCGTGAAGGGCCGA TTCACCATCTCCAGAGACAATTCCAAGAACACGC TGTATCTGCAAATGAACAGCCTGAGAGCTGAGG ACACGGCTGTGTATTACTGTGCGAGACGGGGATA CAGCTATGCGGGTACGGTATGGACGTCTGGGG CCAAGGGACCACGGTCACCGTCTCCTCA<br><br>SEQ ID NO: 31873 |
| | | AA | DIQMTQSPSSLSASIGDRVTITCQASQDIFNYLNW YQQKPGKAPKLLIYDASTLETGVPSRFSGSGSGT DFTFTISSLQPEDIATYCQQYDNLPITFGQGTRL EIK<br><br>SEQ ID NO: 27868 | QVQLVESGGGVVQPGRSLRLSCAASGFTFSSYGMH WVRQAPGKGLEWVTIISYSGSNKYYADSVKGRFTI SRDNSKNTLYLQMNSLRAEDTAVYYCARRGYSYG GYGMDVWGQGTTVTVSS<br><br>SEQ ID NO: 31874 |

FIGURE 50
(Continued)

| | | | |
|---|---|---|---|
| iPS:437320 | 21-225_75A1 | NA | GATATTGTGATGACTCAGTCTCCACTCTCCCTGCCCGTCACCCCTGGAGAGCCGGCCTCCATCTCCTGCAGGTCTAGTCAGAGCCTCCTGCATAGTAATGGACACAACTATTTGGATTGGTACCTACAGAAGCCAGGGCGGTCTCCACAGCTCCTGATCTATTTGGGTTCTAATCGGGCCTCCGGGGTCCCTGAGAGGTTCAGTGGCAGTGGATCAGGCACAGATTTTACACTGAAAATCAGCAGAGTGGAGGCTGAGGATGTTGGGGTTTATTACTGCATGCAACCTCTACAAACTCCGTTCACTTTCGGCGGAGGGACCAAGGTGGAGATCAAA<br>SEQ ID NO: 27869 | CAGGTGCAGGTACAGCAGTGGGGCGCAGGACTGTTGAAGCATTCGGAGACCCTGTCCTCACCTGCGCTGTCTATGGTGGGTCCTTCACTGATTACTACTGGAGCTGGATCCGCCAGCCCCAGGGAAGGGGCTGGAGTGGATTGGGGAAATCAATCATAGTGGAGACACCAACTACAACCCGTCCCTCAAGAGTCGAGTCACCATATCAGTAGACACGTCCAAGAACCAGTTCTCCCTGAAGCTGAGTTCTGTGACCGCCGCGGACACGGCTGTGTATTACTGTGCGAGAGAGTTTCATATAGTGGAAGCTACCTCTACTACGGTATGGACGTCTGGGGCCAAGGGACCACGGTCACCGTCTCCTCA<br>SEQ ID NO: 31875 |
| | | AA | DIVMTQSPLSLPVTPGEPASISCRSSQSLLHSNGHNYLDWYLQKPGRSPQLLIYLGSNRASGVPDRFSGSGSGTDFTLKISRVEAEDVGVYYCMQPLQTPFTFGGGTKVEIK<br>SEQ ID NO: 27870 | QVQVQQWGAGLLKHSETLSLTCAVYGGSFTDYYWSWIRQPPGKGLEWIGEINHSGDTNYNPSLKSRVTISVDTSKNQFSLKLSSVTAADTAVYYCAREFPYSGSYLYYYGMDVWGQGTTVTVSS<br>SEQ ID NO: 31876 |
| iPS:437322 | 21-225_75B1 | NA | GAATTTATTGTTGACGCAGTCTCCAGGCACCCTGTATTGGTCTCCAGGGGAAAGAGCCACCATCTCGAGCAGGCCAGTCAGAGTGTTAGCAGCAGCTACTTAGTCTGGTATCAGCAGAAACCTGGCCAGGCTCCCAGGCTCCTCATCTATGGTGCATCCACCAGGGCCACTGGCATCCCAGACAGGTTCAGTGGCAGTGGGTCTGGGACAGACTTCACTCTCACCATCAGCAGACTGGAGCCTGAAGATTTTGCAGTTTATTACTGTCAGCAGTATGGTTGCTCACCGCTCACTTTCGGCGGAGGGACCAAGGTGGAGATCACA<br>SEQ ID NO: 27871 | CAGGTGCAGCTGGTGCAGTCTGGGGCTGAGGTGAAGAAGCCTGGGGCCTCAGTGAAGGTCTCCTGCAAGGCTTCTGGATACACCTTCACCAATTATGATATCAACTGGGTGCGACAGGTCCTGGACAAGGCTTGAGTGGATGGGATGGATGCACAGAAGTTCAGGGCTAACACAGGCTATGCACAGAAGTTCCAGGGCAGAGTCACCATGACCAGGAACACCTCCATCAGCACAGCCTACATGGAGCTGAGCAGCCTGAGATCTGAGGACACGGCCGTGTATTACTGTGCGATTAGTAGTGGCTGGTACTGGTTCGACCCCTGGGGCCAGGGAACCCTGGTCACCGTCTCCTCA<br>SEQ ID NO: 31877 |

FIGURE 50
(Continued)

| | | | | |
|---|---|---|---|---|
| | | AA | EFMLTQSPGTLYWSPGERATISSRASQSVSSSYL VWYQQKPGQAPRLLIYGASTRATGIPDRFSGSGS GTDFTLTISRLEPEYFAVYYCQQYGCSPLTFGGG TKVEIT<br><br>SEQ ID NO: 27872 | QVQLVQSGAEVKKPGASVKVSCKASGYTFTNYDIN WVRQVPGQGLEWMGWMHPNSGNTGYAQKFQGR VTMTRNTSISTAYMELSSLRSEDTAVYYCAISSGW YWFDPWGQGTLVTVSS<br><br>SEQ ID NO: 31878 |
| | | NA | GAAATTGTGTTGACGCAGTCTCCAGGCACCCG GTATTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATCTATGGTGCATCA GCCGGGGCCACTGGCATCCCAGACAGGTTCAGT GGCAGTGGGTCTGGGACAGACTTCGCTCTCAC CATCAGCAGACTGGAGCCTGAAGATTGTGCAG TGTATTACTGTCAGCAGTACTATGATAACTCACCG TGGACGTTCGGCCAAGGGACCAAGGTGGAAA TCAAA<br><br>SEQ ID NO: 27873 | CAGGTGCAGCTACAGCAGTGGGGCGCAGGACTG TTGAAGCCTTCGGAGACCCTGTCCCTCACCTGCG CTGTCCATGTGGGTCTTCCTTCAGTGGTTGTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGACAC GGCTGTGTATTACTGTGCGAGGGACTACGGCGGT ATGGACGTCTGGGGCCAAGGGACCACGGTCACC GTCTCCTCA<br><br>SEQ ID NO: 31879 |
| iPS:437324 | 21-225_75C2 | AA | EIVLTQSPGTRYLSPGERATLSCRASQSVYSSYL AWYQQKPGQAPRLLIYGASSRATGIPDRFSGSGS GTDFALTISRLEPEDCAVYYCQHYDNSPWTFGR GTKVEIK<br><br>SEQ ID NO: 27874 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 31880 |

FIGURE 50
(Continued)

| | | | |
|---|---|---|---|
| iPS:437326 | 21-225_75C10 | NA | GACATCCAGATGACCCAGTCTCCGTCTCCGT<br>GTCTGTGTCTCTGTAGGAGACAGAGTCATCATCA<br>CTTGTCGGGCGAGTCAGGGCATTAGCATCTGG<br>TTAGCCTGGTATCAGCAGAAACCAGGGAAAG<br>CCCCTAAGCTCCTGATCTATGCTGCATCCAGTT<br>TGCAAAGTGGGGTCCCATTAAGGTTCAGCGGC<br>AGTGGATCTGGGACAGATTTCACTCTCACCAT<br>CAGCAGCCTGCAGCCTGAAGATTTTGCAACTT<br>ACTATTGTCAACAGGCTAAAAGTTTCCCGCTC<br>ACTTTCGGCGGAGGGACCAAGGTGGAGATCA<br>AA |
| | | | SEQ ID NO: 27875 |
| | | AA | DIQMTQSPSSVSASVGDRVIITCRASQGISIWLAW<br>YQQKPGKAPKLLIYAASSLQSGVPLRFSGSGSGT<br>DFTLTISSLQPEDFATYYCQQAKSFPLTFGGGTK<br>VEIK |
| | | | SEQ ID NO: 27876 |
| | | | CAGGTGCAACTGGTGGAGTCTGGGGGAGGCGTG<br>GTCCAGCCTGGGAGGTCCCTGAGACTCTCCTGTG<br>CAGCCGTCTGGATTCACCTTCAGTAGTTATGGCAT<br>GCATTGGGTCCGCCAGGCTCCAGGCAAGGGGCT<br>GGAGTGGGTGGCAGTTATATGGTATGATGAAGT<br>GATAAATACTATGCAGACTCCGTGAAGGGCCGA<br>TTCACCATCTCCAGAGACAATTCCAAGAACACGC<br>TGTATCTGCAAATGAACAGCCTGAGAGCCGAGG<br>ACACGGCTGTATTACTGTGCGAGAGATCGGTT<br>AGTGGGAGCTACGGTTGATGCTTTGATATCTGG<br>GGCCAAGGGACAATGGTCACCGTCTCCTCA |
| | | | SEQ ID NO: 31881 |
| | | | QVQLVESGGGVVQPGRSLRLSCAASGFTFSSYGMH<br>WVRQAPGKGLEWVAVIWYDGSDKYYADSVKGRF<br>TISRDNSKNTLYLQMNSLRAEDTAVYYCARDRLVG<br>ATVDAFDIWGQGTMVTVSS |
| | | | SEQ ID NO: 31882 |
| iPS:437328 | 21-225_75D3 | NA | GAAATTGTGTTGACGCAGTCTCCAGGCACCCT<br>GTATTTGTCTCCAGGGGAAAGAGCCACCCTCT<br>CATGCAGGGCCAGTCAGAGTGTTACAGCAGC<br>TACTTAGCCTGGTACCAGCAGAAACCTGGCCA<br>GGCTCCCAGGCTCATCATTATGGTGCATCA<br>GCCGGTCCACTGGCATACCAGACAGGTTCAGT<br>GGCAGTGGGTCTGGGACAGATTCGCTCAC<br>CATCAGCAGACTGGAGCATGAAGATTGTGCA<br>GTGTATTACTGTCAGCACTATGATAACTCACC<br>GTGGACGTTCGGCCAAGGGACCAAGGTGGAA<br>ATCAAA |
| | | | SEQ ID NO: 27877 |
| | | | CAGGTGCAGCTACAGCAGTGGGGCGCAGGACTG<br>TTGAAGCCTTCGGAGACCCTGTCCCTCACCTGCG<br>CTGTCCATGGTGGGTCCTTCAGTGGTTGCTACTG<br>GAGTCTGGATCCGCCAGCCCCAGGGAAGGGCT<br>GGAGTGGATTGGGGAAATCAATCATAGTGGAAG<br>CACCAACTACAACCCGTCCCTCAAGAGTCGAGTC<br>ACCATTTCAGTAGACACGTCCAAGAACCAGTTCT<br>CCCTGAAGCTGAGCTCTGTGACCGCCGCGACAC<br>GGCTGTGTATTACTGTGCGAGGGACTACGGCGGT<br>ATGGACGTCTGGGGCCAAGGGACCACGGTCACC<br>GTCTCCTCA |
| | | | SEQ ID NO: 31883 |

FIGURE 50
(Continued)

| | | | |
|---|---|---|---|
| iPS:437332 | 21-225_75F3 | AA | EIVLTQSPGTLYLSPGERATLSCRASQSVYSSYLAWYQQKPGQAPRLLIYGASSRSTGIPDRFSGSGCYWTDFALTISRVEHEDCAVYYCQHYDNSPWTFGQGTKVEIK SEQ ID NO: 27878 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS SEQ ID NO: 31884 |
| | | NA | GAAATTGTGTTGACGCAGTCTCCAGGCACCCTGTATTTGTCTCCAGGGGAAAGAGCCACCCTCTCATGCAGGGCCAGTCAGAGTGTTTACAGCAGCTACTTAGCCTGGTACCAGCAGAAACCTGGCCAGGCTCCCAGGCTCCTCATTTATGGTGCATCCAGCCGGGCCACTGGCATCCCAGACAGGTTCAGTGGCAGTGGGTGTGGGACAGACTTCGCTCTCACCATCAGCAGACTGGAGCATGAAGATATAACTCACCGTGTATTACTGTCAGCACTATGATAATCCACGTGGACGTTCGGCCAAGGGACCAAGGTGGAAATCAAA SEQ ID NO: 27879 | CAGGTGCAGCTACAGCAGTGGGGCGCAGGACTGTTGAAGCCTTCGGAGACCTGTCCCTCACCTGCGCTGTCCATGTGGGTCTTCAGTGGTTGTACTGGAGCTGGATCCGCCAGCCCCCAGGGAAGGGGCTGGAGTGGATTGGGGAAATCAATCATAGTGGAAGCACCAACTACAACCCGTCCCTCAAGAGTCGAGTCACCATTTCAGTAGACACGTCCAAGAACCAGTTCACCCCTGAAGCTGAGTCTGTGACCGCCGCGGACACGGCTGTGTATTACTGTGCGAGGGACTACGGCGGTATGGACGTCTGGGGCCAAGGGACCACGGTCACCGTCTCCTCA SEQ ID NO: 31885 |
| | | AA | EIVLTQSPGTLYLSPGERATLSCRASQSVYSSYLAWYQQKPGQAPRLLIYGASSRATGIPDRFSGSGSGCGTDFALTISRLEHEDFAVYYCQHYDNSPWTFGQGTKVEIK SEQ ID NO: 27880 | QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS SEQ ID NO: 31886 |

FIGURE 50
(Continued)

| | | | |
|---|---|---|---|
| iPS:437334 | 21-225_75F11 | NA | GAAATAGTGATGACGCAGTCTCCAGCCACCCT GTTTGTGTCTCCAGGGGAAAGAGCCACCCTCT CCTGCAGGGCCAGTCAGAGTGTTAGCAGAAAT TTAGCCTGGTTCCAGCAGAAACCTGGCCAGGC TCCCAGGCTCCTCTTTATGGTGCATCCATCAG GGCCACTGGTATCCCAGCCAGGTTCAGTGGCA GTGGGTCTGGGACAGAGTTCACTCTCACCATC TACAGCCTGCAGCAGTATGAAGATTTTGCAGTTA TTACTGTCAGCAGTATAATAACTGGCCTCCGC TCACTTTCGGCGGAGGGACCAAGGTGGAGATC AAA | CAGATCACCTTGAAGGAGTCTGGTCCTACGCTGG TGAAACCCACACAGAGACCCTCACGTCACTGACT CTTCTCTGGGTTCTCACTCAGCACTGGTTGGAGTG GGTGTGGGCTGGATCCGTCAGCCCCAGGAAAG GCCCTGGAGTGGCTTGCACTCATTATTGGGATG ATGATAAGGCTACAGCCCATCTGAAGAGCA GGCTCACCATCACCAAGGACACCTCCAAAAACC AGGTGGTCCTTACAATGACCAACATGGACCCTGT GGACACAGCCACATATTACTGTGCACACTTATA GCAGTGGCCTTTGACTACTGGGGCCAGGGAACCC TGGTCACCGTCTCCTCA |
| | | | SEQ ID NO: 27881 | SEQ ID NO: 31887 |
| | | AA | EIVMTQSPATLFVSPGERATLSCRASQSVSRNLA WFQQKPGQAPRLLFYGASIRATGIPARFSGSGSG TEFTLTIYSLQYEDFAVYYCQQYNNWPPLTFGG GTKVEIK | QITLKESGPTLVKPTQTLTLTCTFSGFSLSTGGVGVG WIRQPPGKALEWLALIYWDDKRYSPSLKSRLTIT KDTPKNQVVLTMTNMDPVDTATYYCAHLIAVAFD YWGQGTLVTVSS |
| | | | SEQ ID NO: 27882 | SEQ ID NO: 31888 |
| iPS:437340 | 21-225_75G9 | NA | GAAATTGCGTTGACGCAGTCTCCAGGCACCCT GTCTTTGTCTGTCTCCAGGGAAAGAGCCACCCTCT CCTGCAGGGCCAGTCAGAGTGTTGACAGCAGC TACTTAGCCTGGTACCAGCAGAAACCTGGCCA GGCTCCCAGGCTCCTCATCTATGGTGCATCCA GCAGGGCCCCTGGCATCCCAGACAGGTTCAGT GGCAGTGGGTCTGGGACAGACTTCACTCTCAC CATCAGCAGACTGGAGCCTGAAGATTTTGCAG TGTATTACTGTCAGCAGTATGAAAGTTCACCG TGGACGTTCGGCCAAGGGACCAAGGTGGAAA TCAAA | CAGGTGCAGCTACAGCAGTGGGGCGCAGGACTG TTGAAGCCTTCGGAGACCCTGTCCCTCACCTGCG CTGTCTATGGTGGGTCCTTCAGTGGTTGCTACTG GAGCTGGATCCGCCAGCCCCAGGGAAGGGCT GGAGTGGATTGGGAAATCAATCATAGTGGAAG GACCAACTACAACCCGTCCCTCAAGAGTCGAGTC ACCATATCAGTAGACACGTCCGAGAACCAGTTCT CCCTGAAGCTGAGCTCTGTGCGAGAGACTACGGCGACAC GGCTGTGTATTACTGTGCGAGAGACTACGGTGGG CTTGACTACTGGGGCCAGGGAACCCTGGTCACCG TCTCCTCA |
| | | | SEQ ID NO: 27883 | SEQ ID NO: 31889 |

FIGURE 50
(Continued)

| | | | | |
|---|---|---|---|---|
| iPS:437344 | 21-225_75G12 | AA | EIALTQSPGTLSLSLSPGERATLSCRASPSVDSSYLA WYQQKPGQAPRLLIYGASSRAPGIPDRFSGSGSG TDFTLTISRLEPEDFAVYYCQQYESSPWTFGQGT KVEIK<br>SEQ ID NO: 27884 | QVQLQQWGAGLLKPSETLSLTCAVYGGSFSGCYW SWIRQPPGKGLEWIGEINHSGRTNYNPSLKSRVTIS VDTSENQFSLKLSSVTAADTAVYYCARDYGGLDY WGQGTILVTVSS<br>SEQ ID NO: 31890 |
| | | NA | GAAATTGTGTTGACGCAGTCTCCAGGCACCCT GTATTTGTCTCCAGGGAAAGAGCAGTCACCCTGT CATGCAGGGCCAGTCAGAGTGTTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTCTGGGACAGACTTCGCTCTCAC CATCAGCAGAGTTGGAGCCTGAAGATTGTGCAG TGTATTACTGTCAGCACTATGATAACTCACCG TGGACGTTCGGCCAAGGGACCAAGGTGGAAA TCAAA<br>SEQ ID NO: 27885 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCCAGGGAAGGGGCT GGAGTGGATTGGGAAATCAATCATAGTGGAAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br>SEQ ID NO: 31891 |
| | | AA | EIVLTQSPGTLYLSLSPGERATLSCRASQSVYSSYLA WYQQKPGQAPRLLIYGASSRATGIPDRFSGSGSG TDFALTISRVEPEDCAVYYCQHYDNSPWTFGQG TKVEIK<br>SEQ ID NO: 27886 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br>SEQ ID NO: 31892 |

FIGURE 50
(Continued)

| | | | |
|---|---|---|---|
| iPS:437346 | 21-225_75H7 | NA | GACATTCAGATGACCCAATCTCCATCCTCCG GTATGCATCTGTAGGAGACAGAGTCACCATCA ATAGCCGGGCAAGTCAGGGCATAAGAAATGA TTTAGGCTGGTATCAACAGAAACCAGGAAAT CCCCTCAGCGCCTGATTTATGATGCATCCAGT TGCAAAGTGGGGTCCATCAAGGTTCAGCGGC AGTGGATCTGGGACAGAATTCACTCTCACAAT CAGCAGCGTGCAGCCTGAAGATTTTGGTGTT ATTACTGTATACAGCATAGTAATTACCCGCTC ACTTTCGGCGGAGGGACCAAGGTGGAGATCA AA | CAGCTGCAGCTGCAGGAGTGGGCCCAGGACTG GTGACGCCTTCGGAGAGACCCTGTCCCTCACTGCA CTGTCTCTGGCGCTCCATCAGCAGGAGTAGTTA CTACTGGGGCTGGATCCGCCAGCCCCAGGAA GGGGCTGGAGTGGATTGGGAGTATCTATTATAGT GGGAGCGCTACTCAACCGTCCCTCAAGAGTC GAGTCACCATATCGTGAAGCTGAGCTCTGTGACCGCGC AGTTCTCCCTGAAGCTGTGTGCGAGACTGAC GGACACGGCTCTGTTTTACTGTGCGAGACTGAC TCTAACTGGGTCTTGACTACTGGGGCCAGGGAA CCCTGGTCACCGTCTCCTCA |
| | | | SEQ ID NO: 27887 | SEQ ID NO: 31893 |
| | | AA | DIQMTQSPSSRYASVGDRVTINSRASQGIRNDLG WYQQKPGKSPQRLIYDASSLQSGVPSRFSGSGSG TEFTLTISSVQPEDFGVYYCIQHSNYPLTFGGGTK VEIK | QLQLQESGPGLVTPSETLSLTCTVSGGSISRSSYYW GWIRQPPGKGLEWIGSIYYSGSAYSNPSLKSRVTIS VDTSKNQFSLKLSSVTAADTALFYCARLDSNWGLD YWGQGTLVTVSS |
| | | | SEQ ID NO: 27888 | SEQ ID NO: 31894 |
| iPS:437350 | 21-225_74A3 | NA | GAAATTGTGTTGACGCAGTCTCCAGGCACCCT GTCTTTGTCTCCAGGGAAAGAGCCACCCTCT CATGCAGGGCCAGTCAGAGTGTTACAGCAGC TACTTAGCCTGGTACCAGCAGAAACCTGGCCA GGCTCCCAGGCTCCTCATTTATGGTGCATCCA GCCGGGCCACTGGCATCCCAGACAGGTTCAGT GGCAGTGGGTGTGGGACAGCTTCGCTCTCAC CATCAGCAGACTGGAGCCTGAAGATTTTGCAG TGTATTACTGTCAGCACTCTGATAACTCACCGT GGACGTTCGGCCAAGGGACCAAGGTGGAAAT CAAA | CAGGTGCAGCTACAGCAGTGGGGCGCAGGACTG TTGAAGCCTTCGGAGACCCTGTCCCTCACCTGCG CTGTCCATGGTGGGTCCTTCAGTGGTGCTACTG GAGCTGGATCCGCCAGCCCCCAGGGAAGGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCAGACAC GGCTGTGTATTACTGTGCGAGGGACTACGGCGGT ATGGACGTCTGGGGCCAAGGGACCACGGTCACC GTCTCCTCA |
| | | | SEQ ID NO: 27889 | SEQ ID NO: 31895 |

FIGURE 50
(Continued)

| | | | | |
|---|---|---|---|---|
| iPS:437356 | 21-225_74B1 | AA | EIVLTQSPGTLSLSPGERATLSCRASQSVYSSYLA WYQQKPGQAPRLLIYGASSRSTGIPDRFSGSGCG TDFALTISRLEPEDFAVYYCQHSDNSPWTFGQGT KVEIK | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS |
| | | | SEQ ID NO: 27890 | SEQ ID NO: 31896 |
| | | NA | GACATCGTGATGACCCAGTCTCCAGACTTCCT GGCTGTGTCTCTGGGCGAGAGGGCCACCACCA ATTGTAAGTCCAGCCAGAGTGTTTTACACAGG TCCAACAATTACAACTACTTAGCGTGGTACCA GCAGAAACCAGGACAGCCTCCTAAGCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGAAGATGTGGCAGTTTATTACTGTCAGCAA TATTATAGTACTCCTCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATACACCTTGACCAATTATGATA TCAACTGGGTGCGACAGGCCACTGGACAAGGC TTGAGTGGATGGGATGGATGAACCCTAACAGTG GTAACACAGGCTATGCACAGAAGTTCCAGGGCA GAGTCACCATGACCAGGAACACCTCCATAAGCA CAGCCTACATGGAACTGAGCAGCCTGAGATCTG AGGACACGGCCGTGTATTACTGTGGGAGTACCA GTGGCTGGAACTTCTTTGACTACTGGGGCCAGGG AACCCTGGTCACCGTCTCCTCA | 
| | | | SEQ ID NO: 27891 | SEQ ID NO: 31897 |
| | | AA | DIVMTQSPDFLAVSLGERATTNCKSSQSVLHRSN NYNYLAWYQQKPGQPPKLLIYWASTRESGVPD RFSGSGSGTDFTLTISSLQAEDVAVYYCQQYYST PPTFGQGTKVEIK | QVQLVQSGAEVKKPGASVKVSCKASGYTLTNYDI NWVRQATGQGLEWMGWMNPNSGNTGYAQKFQG RVTMTRNTSISTAYMELSSLRSEDTAVYYCGSTSG WNFFDYWGQGTLVTVSS |
| | | | SEQ ID NO: 27892 | SEQ ID NO: 31898 |

FIGURE 50
(Continued)

| | | | |
|---|---|---|---|
| iPS:437361 | 21-225_74C1 | NA | GACATCGTGATGACCCAGTCTCCAGACTCCC<br>GGCTGTGTCTCTGGGCGAGAGGGCCTCCATCA<br>ATTGCAAGTCCAGCCAGAGTATTTTACACAGC<br>TCCAACAATTACAATTACTTAGCTTGGTACCA<br>GCAGAAACCAGGACATCCTCATAAGCTGCTCA<br>TTTACTGGGCATCTACCCGGGAATCCGGGGTC<br>CCTGACCGATTCAGTGGCAGCGGGTATGGGAC<br>AGATTTCACTCTAACCATCAGCAGCCTGCAGG<br>CTGAAGATGTGGCAGTTTATTACTGTCAGCAA<br>TATTATAGTACTCCGTGGACGTTCGGCCAAGG<br>GACCAAGGTGGAAATCAAA<br>SEQ ID NO: 27893 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGAACCTGACAGTG<br>GTAACACAGGCTTTGCACAGAAGTTCAGGGCA<br>GAGTCACCATGACCAGGAACACCTCCATAAGCA<br>CAGCCTACATGGAGCTGAGCAGCCTGAGATCTG<br>AGGACACGGCCGTGTATTACTGTGCGGTTTCCAG<br>TGGCTGGTACTGGTTCGACCCCTGGGGCCAGGGA<br>ACCCTGGTCACCGTCTCCTCA<br>SEQ ID NO: 31899 |
| | | AA | DIVMTQCPDSPAVSLGERASINCKSSQSILHSSNN<br>YNYLAWYQQKPGHPHKLLIYWASTRESGVPDR<br>FSGSGYGTDFTLTISSLQAEDVAVYYCQQYYSTP<br>WTFGQGTKVEIK<br>SEQ ID NO: 27894 | QVQLVQSGAEVKKPGASVKVSCKASGYTFTNYDIN<br>WVRQATGQGLEWMGWMNPDSGNTGFAQKFQGR<br>VTMTRNTSISTAYMELSSLRSEDTAVYYCAVSSGW<br>YWFDPWGQGTLVTVSS<br>SEQ ID NO: 31900 |
| iPS:437363 | 21-225_74C10 | NA | GACATCGTGATGACCCAGTCTCCAGACTCCT<br>GGCTGTGTCTCTGGGCGAGAGGGCCACCATCA<br>ACTGCAAGTCCAGCCAGAGTGTTTATACAGC<br>TCCAACAATGGAACTACTTAGCTTGGTACCA<br>GCAGAAACCAGGACAGCCTCCTAACCTGCTCA<br>TTTACTGGGCATCTACCCGGGAATCCGGGGTC<br>CCTGACCGATTCAGTGGCAGCGGGTCTGGGAC<br>AGATTTCACTCTCACCATCAGCAGCCTGCAGG<br>CTGAAGATGTGGCAGTTTATTACTGTCAGCAA<br>TATTATAGTACTCCGTGCAGTTTGGCCAGGG<br>GACCAAGGCTGGAGATCAAA<br>SEQ ID NO: 27895 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCAATTATGATA<br>TCAACTGGGTGCGACAGGCCACTGGACAAGGC<br>TTGAGTGGATGGGATGGATGAACCTAACAGTG<br>GTAACATAGGCTATGCACAGAAGTTCAGGGCA<br>GAGTCACCATGACCAGGAACACCTCCATAAGCA<br>CAGCCTACATGGAGCTGAGCAGCCTGAGATCTG<br>AGGACACGGCCGTGTATTACTGTGATTAGCAG<br>TGGCTGGTACTGGTTCGACCCCTGGGGCCAGGGA<br>ACCCTGGTCACCGTCTCCTCA<br>SEQ ID NO: 31901 |

FIGURE 50
(Continued)

| | | | | |
|---|---|---|---|---|
| iPS:437369 | 21-225_74D6 | AA | DIVMTQSPDSLAVSLGERATINCKSSQSVLYSSN NANYLAWYQQKPGQPPNLLIYWASTRESGVPD RFSGSGSGTDFTLTISSLQAEDVAVYYCQQYYST PCSFGQGTKLEIK<br><br>SEQ ID NO: 27896 | QVQLVQSGAEVKKPGASVKVSCKASGYTFTNYDIN WVRQATGQGLEWMGWMNPNSGNIGYAQKFQGR VTMTRNTSISTAYMELSSLRSEDTAVYYCAISSGW YWFDPWGQGTLVTVSS<br><br>SEQ ID NO: 31902 |
| | | NA | GAAATTGTGTTGACGCAGTCTCCAGGCACCCT GTCTTTGTCTCCAGGGGAAAGAGCCACCCTCT CATGCAGGGCCAGTCAGAGTGTTTACAGCAGC TACTTAGCCTGGTACCAGCAGAAACCTGGCCA GGCTCCCAGGCTCCTCATTTATGTGCATCCA GCCGGGCCACTGGCATCCCAGACAGGTTCAGT GGCAGTGGGTGTGGGACAGACTTCGCTCTCAC CATCAGCAGACTGGAGCCTGAAGATTTTGCAG TGTATTACTGTCAGCATTATGATAACTCACCGT GGACGTTCGGCCAAGGGACCAAGGTGAAAT CAAA<br><br>SEQ ID NO: 27897 | CAGGTGCAGCTACAGCAGTGGGGCGCAGGACTG TTGAAGCCTTCGGAGACCCTGTCCCTCACCTGCG CTGTCCATGTGGGTCCTTCAGTGGTTGTACTG GAGCTGGATCCGCCAGCCCCAGGGAAGGGCT GGAGTGGATTGGGAAATCAATCATAGTGGAAG CACCAACTACAACCCGTCCCTCAAGAGTCGAGTC ACCATTTCAGTAGACACGTCCAAGAACCAGTTCT CCCTGAAGCTGAGCTCTGTGACCGCCGCGGACAC GGCTGTGTATTACTGTGCGAGGGACTACGGCGGT ATGGACGTCTGGGGCCAAGGGACCACGGTCACC GTCTCCTCA<br><br>SEQ ID NO: 31903 |
| | | AA | EIVLTQSPGTLSLSPGERATLSCRASQSVYSSYLA WYQQKPGQAPRLLIYGASSRATGIPDRFSGSGCG TDFALTISRLEPEDFAVYYCQHYDNSPWTFGQG TKVEIK<br><br>SEQ ID NO: 27898 | QVQLQQWGAGLLKPSETLSLTCAVHGGSFSGCYW SWIRQPPGKGLEWIGEINHSGSTNYNPSLKSRVTISV DTSKNQFSLKLSSVTAADTAVYYCARDYGGMDV WGQGTTVTVSS<br><br>SEQ ID NO: 31904 |

FIGURE 50
(Continued)

| | | | | |
|---|---|---|---|---|
| iPS:437371 | 21-225_74D8 | NA | GATATTGTGATGACTCAGTCTCCACTCTCCCTG CCCGTCACCCCTGGAGAGCGGCCTCCATCTC ATGCAGGTCTAGTCAGAGCTCTGTGCATAGTA GTGGATACAACTATTTGGATTGGTACCTGCAG AAGCCAGGGCAGTCTCCACAGCTCGTTATCTA TTTGGGGTTCTAATCGGGCCTCCGGGGTCCCTG ACAGGTTCAGTGGCAGTGGATCAGGCTCAGAT TTTACACTGAAGATCAGCAGAGTGGAGGCTGA GGATGTTGGACTTTATTACTGCATGCAAGCTC TACACCCTCCTCACTTTCGGCGGAGGGACC AAGGTGGAGATCAAA<br><br>SEQ ID NO: 27899 | GAGGTGCAGCTGGTGGAGTCTGGGGGAGGCTTG GTACAGCCGGGGGGGTCCCTGAGACTCTCCTGTG CAGCCTCTGGATTCACCTTCAGTAACTACGACAT GCACTGGGTCCGCCAAGCTACAGGAAAAGGTCT GGAGTGGGTCTCAGTATTGGTACTGCTGGTGAC ACATACTATTCCAGGCTCCGTGAAGGGCGATTCA CCATCTCCAGAGAAAATGCCAAGAACTCCTTGTA TCTTCAAATGAACAGCCTGAGAGCCGGGACAC GGCTGTGTATTACTGTGCAAGAGTTCTTGACTAC GGTGACTCCTTGGGCTACTACTACGGTATGG ACGTCTGGGGCCAAGGGACCACGGTCACCGTCTC CTCA<br><br>SEQ ID NO: 31905 |
| | | AA | DIVMTQSPLSLPVTPGEPASISCRSSQSLVHSSGY NYLDWYLQKPGQSPQLVIYLGSNRASGVPDRFS GSGSGSDFTLKISRVEAEDVGLYYCMQALHPPL TFGGGTKVEIK<br><br>SEQ ID NO: 27900 | EVQLVESGGGLVQPGGSLRLSCAASGFTFSNYDMH WVRQATGKGLEWVSAIGTAGDTYYPGSVKGRFTIS RENAKNSLYLQMNSLRAGDTAVYYCARVLDYGDS LGYYYYGMDVWGQGTTVTVSS<br><br>SEQ ID NO: 31906 |
| iPS:437377 | 21-225_74G9 | NA | GAATTTATTGTGACGCAGTCTCCAGGCACCCT GTCTTTGTCTCCAGGGGAAAGAGCCACCCTCT CCTGCAGGGCCAGTCAGAGTGTTAGCAGCAGC TACTTAGTCTGGTATCAGCAGAAAACCTGGCCA GGCTCCCAGGCTCCTCATCTATGGTGCATCCA CCAGGGCCACTGGCATCCCAGACAGGTTCAGT GGCAGTGGGTCTGGGACAGACTTCACTCTCAC CATCAGCAGACTGGAGCCTGAATATTTTGCAG TTTATTACTGTCAGCAGTATGGTGCTCACCGC TCACTTTCGGCGGAGGGACCAAGGTGGAGATC ACA<br><br>SEQ ID NO: 27901 | CAGATCACCTTGAAGGAGTCTGGTCCTACGCTGG TGAAACCCACACAGACCCTCACGCTGACCTGCAC CTTCTCTGGTTCTCACTCAGCACTGGTGAGTG GGTGTGGGCTGGATCCGTCAGCCCCAGGAAAG GCCCTGGAGTGGCTTGCACTCATTATTGGGATG ATGATAAGCGCTACAGCCCATCTCTGAAGAGCA GGCTCACCATCACCAAGGACACCTCCAAAAACC AGGTGGTCCTTACAATGACCAACATGACCCTGT GGACACAGCCACATATTACTGTGCACACCTTATA CAGTGGCCTTTGACTACTGGGGCCAGGGAACCC TGGTCACCGTCTCCTCA<br><br>SEQ ID NO: 31907 |

FIGURE 50
(Continued)

| | | | | |
|---|---|---|---|---|
| iPS:437379 | | AA | EFMLTQSPGTLSLSPGERATLSCRASQSVSSSYL VWYQQKPGQAPRLLIYGASTRATGIPDRFSGSGS GTDFTLTISRLEPEYFAVYYCQQYGCSPLTFGGG TKVEIT | QITLKESGPTLVKPTQTLTLTCTFSGFSLSTGGVVG WIRQPPGKALEWLALIYWDDDKRYSPSLKSRLTIT KDTPKNQVLTMTNMDPVDTATYYCAHLIAVAFD YWGQGTLVTVSS |
| | | | SEQ ID NO: 27902 | SEQ ID NO: 31908 |
| | 21-225_74H2 | NA | GACATCGTGATGACCCAGTCTCCAGACTCCCT GGCTGTGTCTCTGGCGGTGAGAGGCCACCATCA ACTGCAAGTCCAGCCAGAGTGTTTTACACAGC TCCAACAATAAGAACTACTTAACTTGGTACCA GCAGAAACCAGGACAGCCTCATAAGCTGCTCA TTTACTGGGCATCTCGGGAATCCGGGGTC CCTGACCGATTCAGTGGCAGCGGGTCTGGGAC AGATTTCAGTCTCACGATCGCAGCCTGCAGG CTGAAGATGTGGCAGTTTATTACTGTCAGCAA TATTATAGTATTCCTCGACGTTCGGCCAAGG GACCAAGGTGGAAATCAAA | CAGGTGCAGCTGGTGCAGTCTGGGGCTGAGGTG AAGAAGCCTGGGGCTCAGTGAAGGTCTCCTGC AAGGCTTCTGGATTCACCTTCACCAATTATGATA TCAACTGGGTGCGACAGGCCACTGGACAAGGC TTGAGTGGATGGGATGGATGCACCTAACAGTGG TAACACAGGCTTTGCACAGAGAACACTCCAGGGCAG AGTCACCATGACCAGGAACACTCCATAAGCAC AGCCTACATGAACTGAGCAGCCTGAGATCTGA GGACACGGCCGTGTATTACTGTGCGGTTCCAGT GGCTGGTACTGGTTCGACCCCTGGGGCCAGGGA ACCCTGGTCACCGTCCTCTCA |
| | | | SEQ ID NO: 27903 | SEQ ID NO: 31909 |
| | | AA | DIVMTQSPDSLAVSLGERATINCKSSQSVLHSSN NKNYLTWYQQKPGQPHKLLIYWASTRESGVPD RFSGSGSGTDFSLTIGSLQAEDVAVYYCQQYYSI PPTFGQGTKVEIK | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS |
| | | | SEQ ID NO: 27904 | SEQ ID NO: 31910 |

FIGURE 50
(Continued)

| | | | |
|---|---|---|---|
| iPS:437383 | 21-225_74H8 | NA | GAAATTGTGTTGACGCAGTCTCCAGGCACCCTGTCTTTGTCTCCAGGGGAAAGAGCCACCCTCTCCTGCAGGGCCAGTCAGTGTTAGCAGCAGCTACTTAGCCTGGTACCAGCAGAAACCTGGCCAGGCTCCCAGGCTCCTCATTTATGGTGCATCCAGCAGGGCCACTGGCATCCCAGACAGTTCAGTGGCAGTGGGTCTGGGACAGACTTCACTCTCACCATCAGCAGACTGGAGCCTGAAGATTTTGCAGTGTATTACTGTCAGCAGTATGGTAGCTCAAGGACGTTCGGCCAAGGGACCAAGGTGGAAATCAA | GAGGTGCACCTGGTGGAGTCTGGGGGAGGCTTGGTAAAGCCTGGGGGGTCCCTGAGACTCTCCTGTGCAGCCCTCTGATTCACTTTCAGTAACGCTGGATGAACTGGGTCCGCCAGGCTCCAGGGAAGGGGCTGGAGTGGGTTGGCCGTATTAAAAGCAAACTGATGTGTGGGACAACAGACTACGCTGCACCGTGAAAGGCAGATTCACCATCTCAAGAGATGATTCAAAAAACACGCTGTATCTGCAAATGAACAGCCTGAAACCGAGGACACAGCCGTGTATTACTGTGGGGCCAGGGAACCCTGGTCACCGTCTCCTCA |
| | | | SEQ ID NO: 27905 | SEQ ID NO: 31911 |
| | | AA | EIVLTQSPGTLSLSPGERATLSCRASQSFSSSYLAWYQQKPGQAPRLLIYGASSRATGIPDRFSGSGSGTDFTLTISRLEPEDFAVYYCQQYGSSRTFGQGTKVEIK | EVHLVESGGGLVKPGGSLRLSCAASGFTFSNAWMNWVRQAPGKGLEWVGRIKSKTDGGTTDYAAPVKGRFTISRDDSKNTLYLQMNSLKTEDTAVYYCTIVGATTDYWGQGTLVTVSS |
| | | | SEQ ID NO: 27906 | SEQ ID NO: 31912 |
| iPS:438664 | 21-225_216G1 | NA | GACATCGAGATGACCCAGTCTCCATCCTCACTGTCTGCATCTGTAGGAGACAGAGTCACCATCACTTGTGCGGGCGAGTCAGGGCATTAGCAGTTATTTAGCCTGGTTTCAGCAGAAACCAGGGAAAGCCCCTAAGTCCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTCGCAACTTATTATTGCCTACGGTATGATACTTACCCTCACTTTCGGCGGAGGGACCAAGGTGGAGATCAAG | CAGGTGCACCTGGTGGAGTCTGGGGGAGGCGTGGTCCAGCCTGGGAGGTCCCTGAGACTCTCCTGTGCAGCGTCTGGATTCACCTTCAGTAACTATGGCATGCACTGGGTCCGCCAGGCTCCAGGCAAGGGGCTGGAGTGGGTGGCAGTTATATGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGGGGGACTGGAACCCCGAGGTATGGACGTCTGGGGCCAAGGGACCACGGTCATCGTCTCCTCA |
| | | | SEQ ID NO: 27907 | SEQ ID NO: 31913 |

FIGURE 50
(Continued)

| | | | |
|---|---|---|---|
| iPS:441468 | 21-225_25A4.001.001 | AA | DIEMTQSPSSLSASVGDRVTITCRASQGISSYLAWLQQKPGKAPKSLIYAASSLQSGVPSRFSGSGSGTDFTLTISSLQPEDFATYYCLRYDTYPLTFGGGTKVEIK<br>SEQ ID NO: 27908 | QVHLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVTVSS<br>SEQ ID NO: 31914 |
| | | NA | GACATCGTGATGACCCAGTTTCCAGACTCCCTGGCTGTGTCTCTGGGCGAGAGGGCCACCATCAAGTGTAAGTCCAGCCAGAGTGTTTTATACAGCTCCCACAATAACAACTACTTAGCTTGGTACCAGCAGAAACCAGGACAGCCTCCTAAGTTGCTCCTTTACTGGGCATCTACCCGGGAATCCGGGGTCCCTGACCGATTCAGTGGCAGTGGGTCTGGGACAGAATTCACTCTCACCATCAGCAGCCTGGAGGCTGAAGATGTGGCAGTTTATTACTGTCAGCAGTATTATAGTACTCCTCGACGTTCGGCCAAGGGACCAAGGTGGAAATCAAA<br>SEQ ID NO: 27909 | CAGGTGCTCCTGGTGCAGTCTGGGGCTGAGGTGAAGAGGCCTGGGGCCTCAGTGAAGGTCAGCTGCAAGGCTTCTGGATACACCTTCACCAATTATGATATTAATTGGGTGCGACAGGCCACTGGACAAGGGCTTGAGTGGATGGGATGGATGTACCTAACAGTGGTAGCACAGGCTATGACCAGGACACCTCCATCAGCACAGTCACCATGACCAGGGACACCTCCATCAGCACAGCCTACATGGAGCTGAGCAGCCTGAGATCTGAGGACACGGCCGTCTATTACTGTGCGAGTAGCAGTGGCTGGTACTACTTTGACTACTGGGGCCAGGGAACCCTGGTCACCGTCTCCTCA<br>SEQ ID NO: 31915 |
| | | AA | DIVMTQFPDSLAVSLGERATIKCKSSQSVLYSSHNNNYLAWYQQKPGQPPKLLLYWASTRESGVPDRFSGSGSGTEFTLTISSLEAEDVAVYYCQQYYSTPPTFGQGTKVEIK<br>SEQ ID NO: 27910 | QVLLVQSGAEVKRPGASVKVSCKASGYTFTNYDINWVRQATGQGLEWMGWMYPNSGSTGYAQKFQGRVTMTRDTSISTAYMELSSLRSEDTAVYYCASSSGWYYFDYWGQGTLVTVSS<br>SEQ ID NO: 31916 |

FIGURE 50
(Continued)

| | | | |
|---|---|---|---|
| iPS:441475 | 21-225_25A4.001.002 | NA | GACATCGTGATGACCCAGTTTCCAGACTCCT<br>GGCTGTGTCTCTGGGCGAGAGGGCCACCATCA<br>AGTGTAAGTCCAGCCAGAGTGTTTTATACAGC<br>TCCCACAATAACAACTACTTAGCTTGGTACCA<br>GCAGAAACCAGGACAGCCTCCTAAGTTGCTC<br>TTTACTGGGCATCTACCCGGAATCCGGGGTC<br>CCTGACCGATTCAGTGGCAGCGGGTCTGGAC<br>AGAATTCACTCTCACCATCAGCAGCCTGGAGG<br>CTGAAGATGTGGCAGTTTATTACTGTCAGCAG<br>TATTATAGTACTCCTCGACGTTCGGCCAAGG<br>GACCAAGGTGGAAATCAAA<br>SEQ ID NO: 27911 | CAGGTGCTCCTGGTGCAGTCTGGGGCTGAGGTGA<br>AGAGGCCTGGGCCTCAGTGAAGGTCAGCTGCA<br>AGGCTTCTGATACACCTTCACCAATTATGATAT<br>TAATTGGGTGCGACAGGCCACTGGACAAGGCT<br>TGAGTGGATGGATGGATGTACCCTAACAGTGGT<br>AACGCAGGCTATGCACCAGGGACACCTCCATCAGCACA<br>GTCACCATGACCAGGGACACCTCAGCACA<br>GCCTACATGGAGCTGAGCAGCCTGAGATCTGAG<br>GACACGGCCGTCTATTACTGTGCGAGTAGCAGTG<br>GCTGGTACTACTTTGACTACTGGGGCCAGGGAAC<br>CCTGGTCACCGTGTCCTCA<br>SEQ ID NO: 31917 |
| | | AA | DIVMTQFPDSLAVSLGERATIKCKSSQSVLYSSH<br>NNNYLAWYQQKPGQPPKLLLYWASTRESGVPD<br>RFSGSGSGTEFTLTISSLEAEDVAVYYCQQYYST<br>PPTFGQGTKVEIK<br>SEQ ID NO: 27912 | QVLLVQSGAEVKRPGASVKVSCKASGYTFTNYDIN<br>WVRQATGQGLEWMGWMYPNSGNAGYAQKFQGR<br>VTMTRDTSISTAYMELSSLRSEDTAVYYCASSSGW<br>YYFDYWGQGTLVTVSS<br>SEQ ID NO: 31918 |
| iPS:441482 | 21-225_25A4.001.003 | NA | GACATCGTGATGACCCAGTTTCCAGACTCCT<br>GGCTGTGTCTCTGGGCGAGAGGGCCACCATCA<br>AGTGTAAGTCCAGCCAGAGTGTTTTATACAGC<br>TCCCACAATAACAACTACTTAGCTTGGTACCA<br>GCAGAAACCAGGACAGCCTCCTAAGTTGCTC<br>TTTACTGGGCATCTACCCGGAATCCGGGGTC<br>CCTGACCGATTCAGTGGCAGCGGGTCTGGAC<br>AGAATTCACTCTCACCATCAGCAGCCTGGAGG<br>CTGAAGATGTGGCAGTTTATTACTGTCAGCAG<br>TATTATAGTACTCCTCGACGTTCGGCCAAGG<br>GACCAAGGTGGAAATCAAA<br>SEQ ID NO: 27913 | CAGGTGCTCCTGGTGCAGTCTGGGGCTGAGGTGA<br>AGAGGCCTGGGCCTCAGTGAAGGTCAGCTGCA<br>AGGCTTCTGATACACCTTCACCAATTATGATAT<br>TAATTGGGTGCGACAGGCCACTGGACAAGGCT<br>TGAGTGGATGGATGGATGTACCCTAACAGTGGT<br>AACGTAGGCTATGCACAGAAATTCCAGGCAGA<br>GTCACCATGACCAGGGACACCTCCATCAGCACA<br>GCCTACATGGAGCTGAGCAGCCTGAGATCTGAG<br>GACACGGCCGTCTATTACTGTGCGAGTAGCAGTG<br>GCTGGTACTACTTTGACTACTGGGGCCAGGGAAC<br>CCTGGTCACCGTGTCCTCA<br>SEQ ID NO: 31919 |

FIGURE 50
(Continued)

| | | | |
|---|---|---|---|
| iPS:441489 | 21-225_25A4.001.004 | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK | QVLLLVQSGAEVKRPGASVKVSCKASGYTFTNYDIN WVRQATGQGLEWMGWMYPNSGNVGYAQKFQGR VTMTRDTSISTAYMELSSLRSEDTAVYYCASSSGW YYFDYWGQGTLVTSS |
| | | | SEQ ID NO: 27914 | SEQ ID NO: 31920 |
| | | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGTGGGTCTGGGAC AGAATTCACTCTCACCATCAGCAGCCTGGAGG CTGAAGATGTGGCAGTTTATTACTGTCAGCAG TATTATAGTACTCCTCCGACGTTCGGCCAAGG GACCAAGGTGGAAATCAAA | CAGGTGCTCCTGGTGCAGTCTGGGGCTGAGGTGA AGAGGCCTGGGGCCTCAGTGAAGGTCAGCTGCA AGGCTTCTGGATACACCTTCACCAATTATGATAT TAATTGGGTGCGACAGGCCACTGGACAAGGGCT TGAGTGGATGGGATGGATGTACCCTAACAGTGGT CAAACAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA |
| | | | SEQ ID NO: 27915 | SEQ ID NO: 31921 |
| | | AA | DIVMTQFPDSLAVSLGERATIKCKSSQSVLYSSH NNNYLAWYQQKPGQPPKLLLYWASTRESGVPD RFSGSGSGTEFTLTISSLEAEDVAVYYCQQYYST PPTFGQGTKVEIK | QVLLLVQSGAEVKRPGASVKVSCKASGYTFTNYDIN WVRQATGQGLEWMGWMYPNSGQTGYAQKFQGR VTMTRDTSISTAYMELSSLRSEDTAVYYCASSSGW YYFDYWGQGTLVTVSS |
| | | | SEQ ID NO: 27916 | SEQ ID NO: 31922 |

FIGURE 50
(Continued)

| | | | |
|---|---|---|---|
| iPS:441496 | 21-225_25A4.001.005 | NA | GACATCGTGATGACCCAGTCTCCAGACTCCCTGGCTGTGTCTCTGGGCGAGAGGGCCACCATCAAGTGTAAGTCCAGCCAGAGTGTTTTATACAGCTCCCACAATAACAACTACTTAGCTTGGTACCAGCAGAAACCAGGACAGCCTCCTAAGTTGCTCCTTTACTGGGCATCTACCCGGGAATCCGGGGTCCCTGACCGATTCAGTGGCAGCGGGTCTGGGACAGAATTCACTCTCACCATCAGCAGCCTGCAGGCTGAAGATGTGGCAGTTTATTACTGTCAGCAGTATTATATAGTACTCCTCGACGTTCGGCCAAGGGACCAAGGTGGAAATCAAA<br><br>SEQ ID NO: 27917 | CAGGTGCAACTGGTGCAGTCTGGGGCTGAGGTGAAGAGGCCTGGGGCCTCAGTGAAGGTCAGTGCAAGGCTTCTGGATACACCTTCACCAATTATGATATTAATTGGGTGCGACAGGCCACTGGACAAGGCTTGAGTGGATGGGATGTACCCTAACAGTGGTAGCACAGGCTATGCACAGAAATTCCAGGCAGAGTCACCATGACCAGGGACACACTCCATCAGCACAGCCTACATGGAGCTGAGCAGCCTGAGATCTGAGGACACGGCCGTCTATTACTGTGCGAGTAGCAGTGGCTGGTACTACTTGACTACTGGGGCCAGGGAACCCTGGTCACCGTGTCCTCA<br><br>SEQ ID NO: 31923 |
| | | AA | DIVMTQSPDSLAVSLGERATIKCKSSQSVLYSSHNNNYLAWYQQKPGQPPKLLLYWASTRESGVPDRFSGSGSGTEFTLTISSLQAEDVAVYYCQQYYSTPPTFGQGTKVEIK<br><br>SEQ ID NO: 27918 | QVQLVQSGAEVKRPGASVKVSCKASGYTFTNYDINWVRQATGQGLEWMGWMYPNSGSTGYAQKFQGRVTMTRDTSISTAYMELSSLRSEDTAVYYCASSSGWYYFDYWGQGTLVTVSS<br><br>SEQ ID NO: 31924 |
| iPS:441505 | 21-225_25A4.001.006 | NA | GACATCGTGATGACCCAGTCTCCAGACTCCCTGGCTGTGTCTCTGGGCGAGAGGGCCACCATCAAGTGTAAGTCCAGCCAGAGTGTTTTATACAGCTCCCACAATAACAACTACTTAGCTTGGTACCAGCAGAAACCAGGACAGCCTCCTAAGTTGCTCCTTTACTGGGCATCTACCCGGGAATCCGGGGTCCCTGACCGATTCAGTGGCAGCGGGTCTGGGACAGAATTCACTCTCACCATCAGCAGCCTGCAGGCTGAAGATGTGGCAGTTTATTACTGTCAGCAGGGCTGGTACTACTTTGACTACTGGGGCCAGGGAACCCTGGTCACCGTGTCCTCA<br><br>SEQ ID NO: 27919 | CAGGTGCAACTGGTGCAGTCTGGGGCTGAGGTGAAGAGGCCTGGGGCCTCAGTGAAGGTCAGTGCAAGGCTTCTGGATACACCTTCACCAATTATGATATTAATTGGGTGCGACAGGCCACTGGACAAGGCTTGAGTGGATGGGATGTACCCTAACAGTGGTAACGCAGGCTATGCACAGAAATTCCAGGCAGAGTCACCATGACCAGGGACACACTCCATCAGCACAGCCTACATGGAGCTGAGCAGCCTGAGATCTGAGGACACGGCCGTCTATTACTGTGCGAGTAGCAGTGGCTGGTACTACTTTGACTACTGGGGCCAGGGAACCCTGGTCACCGTGTCCTCA<br><br>SEQ ID NO: 31925 |

FIGURE 50
(Continued)

| | | | |
|---|---|---|---|
| iPS:441512 | 21-225_25A4.001.007 | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK | QVQLVQSGAEVKRPGASVKVSCKASGYTFTNYDIN WVRQATGQGLEWMGWMYPNSGNAGYAQKFQGR VTMTRDTSISTAYMELSSLRSEDTAVYYCASSSGW YYFDYWGQGTLVTSS |
| | | | SEQ ID NO: 27920 | SEQ ID NO: 31926 |
| | | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTC TTTACTGGGCATCTACCCGGGGTC CCTGACCGATTCAGTGGCAGTGGGTCTGGGAC AGAATTCACTCTCACCATCAGCAGCCTGCAGG CTGAAGATGTGGCAGTTTATTACTGTCAGCAG TATTATAGTACTCCTCCGACGTTCGGCCAAGG GACCAAGGTGGAAATCAAA | CAGGTGCAACTGGTGCAGTCTGGGGCTGAGGTG AAGAGGCCTGGGGCTCAGTGAAGGTCAGCTGC AAGGCTTCTGGATACACCTTCACCAATTATGATA TTAATTGGGTGCGACAGGCCACTGGACAAGGC TTGAGTGGATGGGATGGATGTACCCTAACAGTGG TAACGTAGGCTATGCACAGAAATTCCAGGGCAG AGTCACCATGACCAGGGACACACTCCATCAGCAC AGCCTACATGGAGCTGAGCAGCCTGAGATCTGA GGACACGGCCGTCTATTACTGTGCGAGTAGCAGT GGCTGGTACTACTTTGACTACTGGGGCCAGGGAA CCCTGGTCACCGTGTCCTCA |
| | | | SEQ ID NO: 27921 | SEQ ID NO: 31927 |
| | | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK | QVQLVQSGAEVKRPGASVKVSCKASGYTFTNYDIN WVRQATGQGLEWMGWMYPNSGNVGYAQKFQGR VTMTRDTSISTAYMELSSLRSEDTAVYYCASSSGW YYFDYWGQGTLVTSS |
| | | | SEQ ID NO: 27922 | SEQ ID NO: 31928 |

FIGURE 50
(Continued)

| | | | |
|---|---|---|---|
| iPS:441519 | 21-225_25A4.001.008 | NA | GACATCGTGATGACCCAGTCTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGCAGCCTGCAGG CTGAAGATGTGGCAGTTTATTACTGTCAGCAG TATTATAGTACTCCTCGACGTTCGGCCAAGG GACCAAGGTGGAAATCAAA<br>SEQ ID NO: 27923 | CAGGTGCAACTGGTGCAGTCTGGGGCTGAGGTG AAGAGGCCTGGGCCTCAGTGAAGGTCAGCTGC AAGGCTTCTGGATACACCTTCACCAATTATGATA TTAATTGGGTGCGACAGGCCACTGGACAAGGC TTGAGTGGATGGGATGGATGTACCTAACAGTGG TCAAACAGGCTATGCACAGAAATTCCAGGCAG AGTCACCATGACCAGGGACACCTCCATCAGCAC AGCCTACATGGAGCTGAGCAGCCTGAGATCTGA GGACACGGCCGTCTATTACTGTGCGAGTAGCAGT GGCTGGTACTACTTTGACTACTGGGGCCAGGGAA CCCTGGTCACCGTGTCCTCA<br>SEQ ID NO: 31929 |
| | | AA | DIVMTQSPDSLAVSLGERATIKCKSSQSVLYSSH NNNYLAWYQQKPGQPPKLLLYWASTRESGVPD RFSGSGSGTEFTLTISSLQAEDVAVYYCQQYYST PPTFGQGTKVEIK<br>SEQ ID NO: 27924 | QVQLVQSGAEVKRPGASVKVSCKASGYTFTNYDIN WVRQATGQGLEWMGWMYPNSGQTGYAQKFQGR VTMTRDTSISTAYMELSSLRSEDTAVYYCASSSGW YYFDYWGQGTLVTVSS<br>SEQ ID NO: 31930 |
| iPS:441554 | 21-225_25A4.001.013 | NA | GACATCGTGATGACCCAGTTTCCAGACTCCCT GGCTGTGTCTCTGGGCGAGAGGGCCACCATCA AGTGTAAGTCCAGCCAGAGTGTTTTATACAGC TCCCACAATAACAACTACTTAGCTTGGTACCA GCAGAAACCAGGACAGCCTCCTAAGTTGCTCC TTTACTGGGCATCTACCCGGGAATCCGGGGTC CCTGACCGATTCAGTGGCAGCGGGTCTGGGAC AGAATTCACTCTCACCATCAGTTATTACTGTCAGCAG CTGAAGATGTGGCAGTTTATTACTGTCAGCAG TATTATAGTACTCCTCGACGTTCGGCCAAGG GACCAAGGTGGAAATCAAA<br>SEQ ID NO: 27925 | CAGGTGCTCCTGGTGCAGTCTGGGGCTGAGGTGA AGAGGCCTGGGCCTCAGTGAAGGTCAGCTGCA AGGCTTCTGGATACACCTTCACCAATTATGATAT TAATTGGGTGCGACAGGCCACTGGACAAGGCT TGAGTGGATGGGATGGATGCACAGAAATTCCAGGCAGA AGCACAGGCTATGCACAGAAATTCCAGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br>SEQ ID NO: 31931 |

FIGURE 50
(Continued)

| | | | |
|---|---|---|---|
| iPS:441595 | 21-225_25A4.001.019 | AA | DIVMTQFPDSLAVSLGERATIKCKSSQSVLYSSH NNNYLAWYQQKPGQPPKLLIYWASTRESGVPD RFSGSGSGTEFTLTISSLQAEDVAVYYCQQYYST PPTFGQGTKVEIK<br>SEQ ID NO: 27926 | QVLLLVQSGAEVKRPGASVKVSCKASGYTFTNYDIN WVRQATGQGLEWMGWMYPNSGSTGYAQKFQGR VTMTRDTSISTAYMELSSLRSEDTAVYYCASSSGW YYFDYWGQGTLVTVSS<br>SEQ ID NO: 31932 |
| | | NA | GACATCGTGATGACCCAGTCTCCAGACTCCCT GGCTGTGTCTCTGGGCGAGAGGGCCACCATCA ACTGTAAGTCCAGCCAGAGTGTTTATACAGC TCCCACAATAACAACTACTTAGCTTGGTACCA GCAGAAACCAGGACAGCCTCCTAAGTTGCTC TTTACTGGGCATCTACCCGGGAATCCGGGGTC CCTGACCGATTCAGTGGCAGTGGGTCTGGGAC AGAATTCACTCTCACCATCAGCAGCCTGGAGG CTGAAGATGTGGCAGTTTATTACTGTCAGCAG TATTATAGTACTCCTCCGACGTTCGGCCAAGG GACCAAGGTGGAAATCAAA<br>SEQ ID NO: 27927 | CAGGTGCAACTGTGCAGTCTGGGCTGAGGTG AAGAAGCCTGGGGCTCAGTGAAGGTCAGCTGC AAGGCTTCTGGATACACCTTCACCAATTATGATA TTAATTGGGTGCGACAGGCCCCTGGACAAGGCT TGAGTGGATGGGATGGATGTACCTAACAGTGGT AGCACAGGCTATGCACAGAAATTCCAGGGCAGA GTCACCATGACCAGGGACACCTCCATCAGCACA GCCTACATGGAGCTGAGCAGCCTGAGATCTGAG GACACGGCCGTCTATTACTGTGCGAGTAGCAGTG GCTGGTACTACTTTGACTACTGGGGCCAGGGAAC CCTGGTCACCGTGTCCTCA<br>SEQ ID NO: 31933 |
| | | AA | DIVMTQSPDSLAVSLGERATINCKSSQSVLYSSH NNNYLAWYQQKPGQPPKLLIYWASTRESGVPD RFSGSGSGTEFTLTISSLEAEDVAVYYCQQYYST PPTFGQGTKVEIK<br>SEQ ID NO: 27928 | QVQLVQSGAEVKRPGASVKVSCKASGYTFTNYDIN WVRQAPGQGLEWMGWMYPNSGSTGYAQKFQGR VTMTRDTSISTAYMELSSLRSEDTAVYYCASSSGW YYFDYWGQGTLVTVSS<br>SEQ ID NO: 31934 |

FIGURE 50
(Continued)

| | | | |
|---|---|---|---|
| iPS:441604 | 21-225_25A4.001.020 | NA | GACATCGTGATGACCCAGTCTCCAGACTCCCTGGCTGTGTCTCTGGGCGAGAGGGCCACCATCAACTGTAAGTCCAGCCAGAGTGTTTTATACAGCTCCCACAATAACAACTACTTAGCTTGGTACCAGCAGAAACCAGGACAGCCTCCTAAGTTGCTCCTTTACTGGGCATCTACCCGGGAATCCGGGGTCCCTGACCGATTCAGTGGCAGCGGGTCTGGGACAGAATTCACTCTCACCATCAGCAGCCTGCAGGCTGAAGATGTGGCAGTTTATTACTGTCAGCAGTATTATAGTACTCCTCCGACGTTCGGCCAAGGGACCAAGGTGGAAATCAAA |
| | | | SEQ ID NO: 27929 |
| | | AA | DIVMTQSPDSLAVSLGERATINCKSSQSVLYSSHNNNYLAWYQQKPGQPPKLLLYWASTRESGVPDRFSGSGSGTEFTLTISSLQAEDVAVYYCQQYYSTPPTFGQGTKVEIK |
| | | | SEQ ID NO: 27930 |
| | | | CAGGTGCTTCTGGTTGTGCAGTCTGGGGCTGAGGTGAAGAGGCCTGGGGCCTCAGTGAAGGTCAGCTGCAAGGCTTCTGATACACCTTCACCAATTATGATATTAATTGGGTGCGACAGGCCCCTGGACAAGGCTTGAGTGGATGGATGTACCTAACAGTGGTCAAACAGGCTATGCACCAGGGACACCTCCATCAGCACAGCTCACCATGAGCTGAGCAGCCTGAGATCTGAAGACTACGGCGTCTATTACTGTGCGAGCAGTGGCCACGGCGTCTATTACTGTGCGAGCAGTGGCCAGGAACCCTGGTCACCGTGTCCTCA |
| | | | SEQ ID NO: 31935 |
| | | | QVLLVQSGAEVKRPGASVKVSCKASGYTFTNYDINWVRQAPGQGLEWMGWMYPNSGQIGYAQKFQGRVTMTRDTSISTAYMELSSLRSEDTAVYYCASSSGWYYFDYWGQGTLVTVSS |
| | | | SEQ ID NO: 31936 |
| iPS:441613 | 21-225_25A4.001.021 | NA | GACATCGTGATGACCCAGTCTCCAGACTCCCTGGCTGTGTCTCTGGGCGAGAGGGCCACCATCAACTGTAAGTCCAGCCAGAGTGTTTTATACAGCTCCCACAATAACAACTACTTAGCTTGGTACCAGCAGAAACCAGGACAGCCTCCTAAGTTGCTCCTTTACTGGGCATCTACCCGGGAATCCGGGGTCCCTGACCGATTCAGTGGCAGCGGGTCTGGGACAGAATTCACTCTCACCATCAGCAGCCTGCAGGCTGAAGATGTGGCAGTTTATTACTGTCAGCAGTATTATAGTACTCCTCCGACGTTCGGCCAAGGGACCAAGGTGGAAATCAAA |
| | | | SEQ ID NO: 27931 |
| | | | CAGGTGCAACTGGTGCAGTCTGGGGCTGAGGTGAAGAGGCCTGGGGCCTCAGTGAAGGTCAGCTGCAAGGCTTCTGATACACCTTCACCAATTATGATATTAATTGGGTGCGACAGGCCACTGGACAAGGCTTGAGTGGATGGATGTACAGAAATTCCAGGGCAGTAACGCAGGCTATGCACAGGGACACCTCCATCAGCAGCACCATGACCAGGGCACCACCATGAGCTGAGCAGCCTGAGATCTGAGGACACGGCCGTCTATTACTGTGCGAGTAGCAGTGGCTGGTACTACTTTGACTACTGGGGCCAGGGAACCCTGGTCACCGTGTCCTCA |
| | | | SEQ ID NO: 31937 |

FIGURE 50
(Continued)

| | | | |
|---|---|---|---|
| iPS:441841 | 21-225_4A2.001.001 | AA | DIVMTQSPDSLAVSLGERATINCKSSQSVLYSSH NNNYLAWYQQKPGQPPKLLLYWASTRESGVPD RFSGSGSGTEFTLTISSLQAEDVAVYYCQQYYST PPTFGQGTKVEIK<br>SEQ ID NO: 27932 | QVQLVQSGAEVKRPGASVKVSCKASGYTFTNYDIN WVRQATGQGLEWMGWMYPNSGNAGYAQKFQGR VTMTRDTSISTAYMELSSLRSEDTAVYYCASSSGW YYFDYWGQGTLVTSS<br>SEQ ID NO: 31938 |
| | | NA | GACATCGTGATGACCCAGTCTCCAGACTCCCT GGCTGTGTCTCTGGGCGAGAGGGCCACCATCA ACTGCAAGTCCAGCCAGAGTATTTACACAGC TCCAACAATAACAACTACTTAGCTTGGTTCCA GCAGAAACCAGGACAGCCTCCTAAACTGCTC TTTACTGGGCATCTCACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA<br>SEQ ID NO: 27933 | CAGGTGCAGCTGGTGCAGTCTGGAGCTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGTACAGAAGTCCAGGGCAG TAACACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31939 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br>SEQ ID NO: 27934 | QVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTSS<br>SEQ ID NO: 31940 |

FIGURE 50
(Continued)

| | | | |
|---|---|---|---|
| iPS:441847 | 21-225_4A2.001.002 | NA | GACATCGTGATGACCCAGTCTCCAGACTCCCT GGCTGTGTCTCTGGGCGAGAGGGCCACCATCA ACTGCAAGTCCAGCCAGTCCATCCTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATGCTCCAGTCACTTTCGGCCCTGGG ACCAAAGTGGGTATCAAA<br><br>SEQ ID NO: 27935 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31941 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNAP VTFGPGTKVGIK<br><br>SEQ ID NO: 27936 | QVQLVQSGTEVKKPGASVKVSCKASGYTFTNYDIN WVRQATGQGLEWMGWMHPNSGNTGYAQKFQGR VTLTRDTSISTAYMELSSLRSEDTAVYYCASSSGWY YFDYWGQGTLVTVSS<br><br>SEQ ID NO: 31942 |
| iPS:441853 | 21-225_4A2.001.003 | NA | GACATCGTGATGACCCAGTCTCCAGACTCCCT GGCTGTGTCTCTGGGCGAGAGGGCCACCATCA ACTGCAAGTCCAGCCAGTCCATCCTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATCAAACTCCAGTCACTTTCGGCCCTGG GACCAAAGTGGGTATCAAA<br><br>SEQ ID NO: 27937 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31943 |

FIGURE 50
(Continued)

| | | | | |
|---|---|---|---|---|
| iPS:441859 | 21-225_4A2.001.004 | AA | DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYQTPVTFGPGTKVGIK<br>SEQ ID NO: 27938 | QVQLVQSGTEVKKPGASVKVSCKASGYTFTNYDINWVRQATGQGLEWMGWMHPNSGNTGYAQKFQGRVTLTRDTSISTAYMELSSLRSEDTAVYYCASSSGWYYFDYWGQGTLVTVSS<br>SEQ ID NO: 31944 |
| | | NA | GACATCGTGATGACCCAGTCTCCAGACTCCCTGGCTGTGTCTCTGGGCGAGAGGGCCACCATCAACTGCAAGTCCAGCCAGAGTATTTTACACAGCTCCAACAATAACAACTACTTAGCTTGGTTCCAGCAGAAACCAGGACAGCCTCCTAAACTGCTCCTGCAGATCCGGGGTTTACTGGGCATCTACCCGGGAATCCGGGGTCCCTGACCGATTCAGTGGCAGCGGGTCTGGGACAGATTTCACTCTCACCATCAGCAGCCTGCAGCCTGAAGATGTGGCAGTTTATTACTGTCAGCAATATTATAATACTCCAGTCACTTTCGGCCCTGGGACCAAAGTGGGTATCAAA<br>SEQ ID NO: 27939 | CAGGTGCAGCTGGTGCAGTCTGGGACTGAGGTGAAGAAGCCTGGGGCCTCAGTGAAGGTGTCCTGCAAGGCTTCTGGATACACCTTCACCAATTATGATATCAACTGGGTGCGACAGGCCACTGGACAAGGCCTTGAGTGGATGGGATGGATGCACCCTAACAGTGGTAACGCAGGCTATGCACAGAAGTTCCAGGGCAGAGTCACCTTGACCAGGGACACCTCCATCAGCACAGCCTACATGGAACTGAGCAGCCTGAGATCTGAGGACACGGCCGTGTATTACTGTGCGAGTAGCAGTGGCTGGTACTACTTTGACTACTGGGGCCAGGGAACCCTGGTCACCGTGTCCTCA<br>SEQ ID NO: 31945 |
| | | AA | DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYNTPVTFGPGTKVGIK<br>SEQ ID NO: 27940 | QVQLVQSGTEVKKPGASVKVSCKASGYTFTNYDINWVRQATGQGLEWMGWMHPNSGNAGYAQKFQGRVTLTRDTSISTAYMELSSLRSEDTAVYYCASSSGWYYFDYWGQGTLVTVSS<br>SEQ ID NO: 31946 |

FIGURE 50
(Continued)

| | | | | |
|---|---|---|---|---|
| iPS:441866 | 21-225_4A2.001.005 | NA | GACATCGTGATGACCCAGTCTCCAGACTCCCT GGCTGTGTCTCTGGGCGAGAGGGCCACCATCA ACTGCAAGTCCAGCCAGAGTGTATTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGGTATCAAA<br>SEQ ID NO: 27941 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAGCACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31947 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br>SEQ ID NO: 27942 | QVQLVQSGTEVKKPGASVKVSCKASGYTFTNYDIN WVRQATGQGLEWMGWMHPNSGSTGYAQKFQGR VTLTRDTSISTAYMELSSLRSEDTAVYYCASSSGWY YFDYWGQGTLVTVSS<br>SEQ ID NO: 31948 |
| iPS:441873 | 21-225_4A2.001.006 | NA | GACATCGTGATGACCCAGTCTCCAGACTCCCT GGCTGTGTCTCTGGGCGAGAGGGCCACCATCA ACTGCAAGTCCAGCCAGAGTGTATTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCCTGGG ACCAAAGTGGGGTATCAAA<br>SEQ ID NO: 27943 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TCAAACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31949 |

FIGURE 50
(Continued)

| iPS:441880 | 21-225_4A2.001.007 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVGIK<br><br>SEQ ID NO: 27944 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31950 |
|---|---|---|---|---|
| | | NA | GACATCGTGATGACCCAGTCTCCAGACTCCCT GGCTGTGTCTCTGGGCGAGAGGGCCACCATCA ACTGCAAGTCCAGCCAGAGTATTTACACAGC TCCAACAATAACAATTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA<br><br>SEQ ID NO: 27945 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TCAAACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br><br>SEQ ID NO: 31951 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK<br><br>SEQ ID NO: 27946 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br><br>SEQ ID NO: 31952 |

FIGURE 50
(Continued)

| | | | |
|---|---|---|---|
| iPS:441884 | 21-225_4A2.001.008 | NA | GACATCGTGATGACCCAGTCTCCAGACTCCCT GGCTGTGTCTCTGGGCGAGAGGGCCACCATCA ACTGCAAGTCCAGCCAGAGTGTATTTACACAGC TCCAACAATAACAACTACTTAGCTTGGTTCCA GCAGAAACCAGGACAGCCTCCTAAACTGCTC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCCTGGG ACCAAAGTGGGTATCAAA SEQ ID NO: 27947 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TAACGCAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31953 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK SEQ ID NO: 27948 | QVQLVQSGTEVKKPGASVKVSCKASGYTFTNYDIN WVRQATGQGLEWMGWMHPNSGNAGYAQKFQGR VTLTRDTSISTAYMELSSLRSEDTAVYYCASSSGWY YFDYWGQGTLVTVSS SEQ ID NO: 31954 |
| iPS:441888 | 21-225_4A2.001.009 | NA | GACATCGTGATGACCCAGTCTCCAGACTCCCT GGCTGTGTCTCTGGGCGAGAGGGCCACCATCA ACTGCAAGTCCAGCCAGAGTGTATTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATGCTCCAGTCACTTTCGGCCCTGGG ACCAAAGTGGGTATCAAA SEQ ID NO: 27949 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACCTAACAGTGG TCAAACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA SEQ ID NO: 31955 |

FIGURE 50
(Continued)

| | | | | |
|---|---|---|---|---|
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNAP VTFGPGTKVGIK<br>SEQ ID NO: 27950 | QVQLVQSGTEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS<br>SEQ ID NO: 31956 |
| iPS:441892 | 21-225_4A2.001.010 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATCAAACTCCAGTCACTTTCGGCCCTGG GACCAAAGTGGGTATCAAA<br>SEQ ID NO: 27951 | CAGGTGCAGCTGGTGCAGTCTGGGACTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGCACCTAACAGTGG TAACGCAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31957 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYQTP VTFGPGTKVGIK<br>SEQ ID NO: 27952 | QVQLVQSGTEVKKPGASVKVSCKASGYTFTNYDIN WVRQATGQGLEWMGWMHPNSGNAGYAQKFQGR VTLTRDTSISTAYMELSSLRSEDTAVYYCASSSGWY YFDYWGQGTLVTVSS<br>SEQ ID NO: 31958 |

FIGURE 50
(Continued)

| | | | |
|---|---|---|---|
| iPS:441896 | 21-225_4A2.001.011 | NA | GACATCGTGATGACCCAGTCTCCAGACTCCCTGGCTGTGTCTCTGGGCGAGAGGGCCACCATCAACTGCAAGTCCAGCCAGAGTCCAGAGTATTTACACAGCTCCAACAATAACAACTACTTAGCTTGGTTCCAGCAGAAACCAGGACAGCCTCCTAAACTGCTCTTTACTGACCGATTCAGTGGCAGCGGGTCTGGGACCCTGACCGATTCAGTGGCAGCGGGTCTGGGACAGATTTCACTCTCACCATCAGCAGCCTGCAGCCTGAAGATGTGGCAGTTTATTACTGTCAGCAATATTATCAAACTCCAGTCACTTTCGGCCCTGGGACCAAAGTGGGTATCAAA<br>SEQ ID NO: 27953 | CAGGTGCAGCTGGTGCAGTCTGGGACTGAGGTGAAGAAGCCTGGGGCCTCAGTGAAGGTGTCCTGCAAGGCTTCTGGATACACCTTCACCAATTATGATATCAACTGGGTGCGACAGGCCACTGGACAAGGCTTGAGTGGATGGGATGCACCTAACAGTGGTCAAACAGGCTATGCACAGAAGTTCCAGGCAGAGTCACCTTGACCAGGACACCTCCATCAGCACAGCCTACATGGAACTGAGCAGCCTGAGATCTGAGGACACGGCCGTGTATTACTGTGCGAGTAGCAGTGGCTGGTACTACTTTGACTACTGGGGCCAGGGAACCCTGGTCACCGTGTCCTCA<br>SEQ ID NO: 31959 |
| | | AA | DIVMTQSPDSLAVSLGERATINCKSSQSILHSSNNNYLAWFQQKPGQPPKLLLYWASTRESGVPDRFSGSGSGTDFTLTISSLQPEDVAVYYCQQYYQTPVTFGPGTKVGIK<br>SEQ ID NO: 27954 | QVQLVQSGTEVKKPGASVKVSCKASGYTFTNYDINWVRQATGQGLEWMGWMHPNSGQTGYAQKFQGRVTLTRDTSISTAYMELSSLRSEDTAVYYCASSSGWYYFDYWGQGTLVTVSS<br>SEQ ID NO: 31960 |
| iPS:441900 | 21-225_4A2.001.012 | NA | GACATCGTGATGACCCAGTCTCCAGACTCCCTGGCTGTGTCTCTGGGCGAGAGGGCCACCATCAACTGCAAGTCCAGCCAGAGTCCAGAGTATTTACACAGCTCCAACAATAACAACTACTTAGCTTGGTTCCAGCAGAAACCAGGACAGCCTCCTAAACTGCTCTTTACTGACCGATTCAGTGGCAGCGGGTCTGGGACCCTGACCGATTCAGTGGCAGCGGGTCTGGGACAGATTTCACTCTCACCATCAGCAGCCTGCAGCCTGAAGATGTGGCAGTTTATTACTGTCAGCAATATTATCAAACTCCAGTCACTTTCGGCCCTGGGACCAAAGTGGGTATCAAA<br>SEQ ID NO: 27955 | CAGGTGCAGCTGGTGCAGTCTGGGACTGAGGTGAAGAAGCCTGGGGCCTCAGTGAAGGTGTCCTGCAAGGCTTCTGGATACACCTTCACCAATTATGATATCAACTGGGTGCGACAGGCCACTGGACAAGGCTTGAGTGGATGGGATGCACCTAACAGTGGTAGCACAGGCTATGCACAGAAGTTCCAGGCAGAGTCACCTTGACCAGGACACCTCCATCAGCACAGCCTACATGGAACTGAGCAGCCTGAGATCTGAGGACACGGCCGTGTATTACTGTGCGAGTAGCAGTGGCTGGTACTACTTTGACTACTGGGGCCAGGGAACCCTGGTCACCGTGTCCTCA<br>SEQ ID NO: 31961 |

FIGURE 50
(Continued)

| | | | |
|---|---|---|---|
| iPS:441955 | 21-225_4A2.001.022 | AA | DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYQTPVTFGPGTKVGIK<br>SEQ ID NO: 27956 | QVQLVQSGTEVKKPGASVKVSCKASGYTFTNYDINWVRQATGQGLEWMGWMHPNSGSTGYAQKFQGRVTLTRDTSISTAYMELSSLRSEDTAVYYCASSSGWYYFDYWGQGTLVTVSS<br>SEQ ID NO: 31962 |
| | | NA | GACATCGTGATGACCCAGTCTCCAGACTCCCTGGCTGTGTCTCTGGGCGAGAGGGCCACCATCAACTGCAAGTCCAGCCAGAGTATTTTACACAGCTCCAACAATAACAACTACTTAGCTTGGTTCAGCAGAAAACCAGGACAGCCTCCTAAACTGCTCCTTTACTGGGCATCTACCCGGGAATCCGGGGTCCCTGACCGATTCAGTGGCAGCGGGTCTGGGACAGATTTCACTCTCACCATCAGCAGCCTGCAGCCTGAAGATGTGGCAGTTTATTACTGTCAGCAATATTATAGTACTCCAGTCACTTTCGGCCCTGGGACCAAAGTGGGTATCAAA<br>SEQ ID NO: 27957 | CAGGTGCAGCTGGTGCAGTCTGGGGCTGAGGTGAAGAAGCCTGGGGCCTCAGTGAAGGTGTCCTGCAAGGCTTCTGGATACACCTTCACCAATTATGATATCAACTGGGTGCGACAGGCCACTGGACAAGGCCTTGAGTGGATGGGATGGATGCACCCTAACAGTGGTAACACAGGCTATGCACAGAAGTTCCAGGGCAGAGTCACCTTGACCAGGGACACCTCCATCAGCACAGCCTACATGGAACTGAGCAGCCTGAGATCTGAGGACACGGCCGTGTATTACTGTGCGAGTAGCAGTGGCTGGTACTACTTTGACTACTGGGGCCAGGGAACCCTGGTCACCGTGTCCTCA<br>SEQ ID NO: 31963 |
| | | AA | DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYSTPVTFGPGTKVGIK<br>SEQ ID NO: 27958 | QVQLVQSGAEVKKPGASVKVSCKASGYTFTNYDINWVRQATGQGLEWMGWMHPNSGNTGYAQKFQGRVTLTRDTSISTAYMELSSLRSEDTAVYYCASSSGWYYFDYWGQGTLVTVSS<br>SEQ ID NO: 31964 |

FIGURE 50
(Continued)

| | | | | |
|---|---|---|---|---|
| iPS:441962 | 21-225_4A2.001.023 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCAAGG GACCAAAGTGGAAATCAAA
SEQ ID NO: 27959 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCCCTGGACAAGGC TTGAGTGGATGGGATGGATGCACCTAACAGTGG TAACACAGGCTATGCACAGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA
SEQ ID NO: 31965 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGQGTKVEIK
SEQ ID NO: 27960 | QVQLVQSGAEVKKPGASVKVSCKASGYTFTNYDIN WVRQAPGQGLEWMGWMHPNSGNTGYAQKFQGR VTLTRDTSISTAYMELSSLRSEDTAVYYCASSSGWY YFDYWGQGTLVTVSS
SEQ ID NO: 31966 |
| iPS:441971 | 21-225_4A2.001.024 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTATTGTCAGCAA TATTATAGTACTCCAGTCACTTTCGGCCCTGGG ACCAAAGTGGGTATCAAA
SEQ ID NO: 27961 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGGCCACTGGACAAGGC TTGAGTGGATGGGATGGATGCACAGAAGTTCCAGGGCAG TCAAACAGGCTATGCACAGGAAGTTCCAGGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA
SEQ ID NO: 31967 |

FIGURE 50
(Continued)

| | | | |
|---|---|---|---|
| iPS:441999 | 21-225_4A2.001.028 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGPGTKVGIK | QVQLVQSGAEVKKPGASVKVSCKASGYTFTNYDIN WVRQATGQGLEWMGWMHPNSGQTGYAQKFQGR VTLTRDTSISTAYMELSSLRSEDTAVYYCASSSGWY YFDYWGQGTLVTVSS |
| | | | SEQ ID NO: 27962 | SEQ ID NO: 31968 |
| | | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAGTACTCCAGTCACTTTCGGCCAAGG GACCAAAGTGGAAATCAAA | CAGGTGCAGCTGGTGCAGTCTGGGGCTGAGGTG AAGAAGCCTGGGGCTCAGTGAAGGTGTCCTGC AAGGCTTCTGGATACACCTTCACCAATTATGATA TCAACTGGGTGCGACAGGCCCCTGGACAAGGC TTGAGTGGATGGGATGCACAGAAGTTCCAGGCA TCAAACAGGCTATGCACCAGGACACCTCCATCAGCACA AGTCACCTTGACCAGGGACACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTCTCCTCA |
| | | | SEQ ID NO: 27963 | SEQ ID NO: 31969 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGQGTKVEIK | QVQLVQSGAEVKKPGASVKVSCKASGYTFTNYDIN WVRQAPGQGLEWMGWMHPNSGQTGYAQKFQGR VTLTRDTSISTAYMELSSLRSEDTAVYYCASSSGWY YFDYWGQGTLVTVSS |
| | | | SEQ ID NO: 27964 | SEQ ID NO: 31970 |

FIGURE 50
(Continued)

| | | | |
|---|---|---|---|
| iPS:442006 | 21-225_4A2.001.029 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC AGATTTCACTCTCACCATCAGCAGCCTGCAGC CTGAAGATGTGGCAGTTTATTACTGTCAGCAA TATTATAATACTCCAGTCACTTTCGGCCAAGG GACCAAAGTGGAAATCAAA<br>SEQ ID NO: 27965 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGCCCCTGGACAAGGGC TTGAGTGGATGGGATGGATGCACCTAACAGTGG TAGCACAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31971 |
| | | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYSTP VTFGQGTKVEIK<br>SEQ ID NO: 27966 | QVQLVQSGAEVKKPGASVKVSCKASGYTFTNYDIN WVRQAPGQGLEWMGWMHPNSGSTGYAQKFQGR VTLTRDTSISTAYMELSSLRSEDTAVYYCASSSGWY YFDYWGQGTLVTVSS<br>SEQ ID NO: 31972 |
| iPS:442020 | 21-225_4A2.001.031 | NA | GACATCGTGATGACCCAGTCTCCAGACTCCCT GGCTGTGTCTCTGGGCGAGAGGGCCACCATCA ACTGCAAGTCCAGCCAGAGTATTTTACACAGC TCCAACAATAACAACTACTTAGCTTGGTTCCA GCAGAAACCAGGACAGCCTCCTAAACTGCTCC TTTACTGGGCATCTACCCGGGAATCCGGGGTC CCTGACCGATTCAGTGGCAGCGGGTCTGGGAC TAACGAAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 27967 | CAGGTGCAGCTGGTGCAGTCTGGGGCTGAGGTG AAGAAGCCTGGGGCCTCAGTGAAGGTGTCCTGC AAGGCTTCTGGATACACCTTCACCAATTATGATA TCAACTGGGTGCGACAGCCCTGGACAAGGGC TTGAGTGGATGGGATGGATGCACCTAACAGTGG TAACGAAGGCTATGCACAGAAGTTCCAGGCAG AGTCACCTTGACCAGGGACACCTCCATCAGCACA GCCTACATGGAACTGAGCAGCCTGAGATCTGAG GACACGGCCGTGTATTACTGTGCGAGTAGCAGTG GCTGGTACTACTTTGACTACTGGGGCCAGGGAAC CCTGGTCACCGTGTCCTCA<br>SEQ ID NO: 31973 |

FIGURE 50
(Continued)

| | | | |
|---|---|---|---|
| iPS:442050 | 21-225_4H6.004 | AA | DIVMTQSPDSLAVSLGERATINCKSSQSILHSSNN NNYLAWFQQKPGQPPKLLLYWASTRESGVPDR FSGSGSGTDFTLTISSLQPEDVAVYYCQQYYNTP VTFGPGTKVEIK<br>SEQ ID NO: 27968 | QVQLVQSGGEVKKPGASVKVSCKASGYTFTNYDIN WVRQAEGQGLEWMGWMHPNSGNEGYAQKFQGR VTLTRDTSISTAYMELSSLRSEDTAVYYCASSSGWY YFDYWGQGTLVTVSS<br>SEQ ID NO: 31974 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGTGG TTAGCCTGGTATCAGCAGAAACCAGGGAAAG CCCCTAAGCTCCTGATCTATGGTGCATCCAGTT TGCAAAGTGGGTGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A<br>SEQ ID NO: 27969 | CAGGTGCAGCTGGTACAGTCTGGGGGCTGAGGTG AAGAAGCCTGGGGCCTCAGTGAAGGTCAGCTGC AAGGCTTCTGGATACACCTTCACCGACTACATT TGCACTGGGTGCGACAGGCCCCTGGACAAGGTCT TGAGTGGATGGGATGGATCCAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGGTAC CAGTCTGTTTGACTACTGGGGCCAGGGAACCCTG GTCACCGTGTCCTCA<br>SEQ ID NO: 31975 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPTFGPGT KVDIK<br>SEQ ID NO: 27970 | QVQLVQSGAEVKKPGASVKVSCKASGYTFTFDYYL HWVRQAPGQGLEWMGWIHPNSGGTNYAQKFQGR VTMTRDTSISTAYMELSSLRSDDTAVYYCARDGTS SFDYWGQGTLVTVSS<br>SEQ ID NO: 31976 |

FIGURE 50
(Continued)

| | | | | |
|---|---|---|---|---|
| iPS:442059 | 21-225_4H6.005 | NA | GACATCCAGATGACCCAGTCTCCATCTTCCGT GTCTGCATCTGTAGGAGACAGAGTCACCATCA CTTGTCGGGCGAGTCAGGTATTAGCAGGTGG TATCCTGGTATCAGCAGAAACCAGGGAAAG CCCCTAAGCTCCTGATCTATGGTGCATCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAAGTGGATATCAA A | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCACCAGTGGT GGCACAAACTATGCACAGAGGACACGTCCATCAGCA GTCACCATGACCAGGGACACGTCCATCAGCACA GCCTACATGGAGCTGAGCAGTCTGAGATCTGACG ACACGGCCGTGTATTACTGTGCGAGAGATGGTAC CAGCTCGTTTGACTACTGGGGCCAGGGAACCCTG GTCACCGTGTCCTCA |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGQGT KVDIK | SEQ ID NO: 31977 QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDGTS SFDYWGQGTLVTVSS |
| | | | SEQ ID NO: 27972 | SEQ ID NO: 31978 |
| iPS:442065 | 21-225_4H6.006 | NA | GACATCCAGATGACCCAGTCTCCATCTTCCGT GTCTGCATCTGTAGGAGACAGAGTCACCATCA CTTGTCGGGCGAGTCAGGTATTAGCAGGTGG TATCCTGGTATCAGCAGAAACCAGGGAAAG CCCCTAAGCTCCTGATCTATGGTGCATCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAACTT ATTATTGTCAACAGGCTAACAGTTTCCCATTC ACTTTCGGCCAAGGGACCAAAGTGGATATCAA A | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCACCAGTGGT GGCACAAACTATGCACAGAGGACACGTCCATCAGCA GTCACCATGACCAGGGACACGTCCATCAGCACA GCCTACATGGAGCTGAGCAGTCTGAGAGATGTGACG ACACGGCCGTGTATTACTGTGCGAGAGATGGTAC CAGCTCGTTGACTACTGGGGCCAGGGAACCCTG GTCACCGTGTCCTCA |
| | | | SEQ ID NO: 27973 | SEQ ID NO: 31979 |

FIGURE 50
(Continued)

| | | | | |
|---|---|---|---|---|
| iPS:442071 | 21-225_4H6.007 | AA | DIQMTQSPSSVSASVGDRVTITCRASQGISRWLA WYQQKPGKAPKLLIYGASSLQSGVPSRFSGSGS GTDFTLTISSLQPEDFATYYCQQANSFPFTFGQG TKVDIK<br>SEQ ID NO: 27974 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDGTS SFDYWGQGTLVTVSS<br>SEQ ID NO: 31980 |
| | | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A<br>SEQ ID NO: 27975 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCATCCAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGCTAC CAGCTCGTTTGACTACTGGGGCCAGGGAACCCTG GTCACCGTGTCCTCA<br>SEQ ID NO: 31981 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGPGT KVDIK<br>SEQ ID NO: 27976 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SFDYWGQGTLVTVSS<br>SEQ ID NO: 31982 |

FIGURE 50
(Continued)

| | | | |
|---|---|---|---|
| iPS:442078 | 21-225_4H6.008 | NA | GACATCCAGATGACCCAGTCTCCATCTTCCGT GTCTGCATCTGTAGGAGACAGAGTCACCATCA CTTGTCGGGCGAGTCAGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCCTGGGACCAAAGTGGATATCAA A SEQ ID NO: 27977 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCAGGGCAGG GGCACAAACTATGCACAGGGACACGTCCATCAGCAAC GTCACCATGACCAGGGACACGTCCATCAGCACA GCCTACATGGAGCTGAGCAGTCTGAGATCTGACG ACACGGCCGTGTATTACTGTGCGAGAAGTGGTAC CAGCTCGTTGACTACTGGGGCCAGGGAACCCTG GTCACCGTGTCCTCA SEQ ID NO: 31983 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGPGT KVDIK SEQ ID NO: 27978 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARSGTSS FDYWGQGTLVTVSS SEQ ID NO: 31984 |
| iPS:442085 | 21-225_4H6.009 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAGGTGGATATCAA A SEQ ID NO: 27979 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACAGAAGTTCAGGGCAGG GGCACAAACTATGCACAGAAGTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAAGTGGTAC CAGCTCGTTGACTACTGGGGCCAGGGAACCCTG GTCACCGTGTCCTCA SEQ ID NO: 31985 |

FIGURE 50
(Continued)

| | | | |
|---|---|---|---|
| iPS:442089 | 21-225_4H6.010 | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGQGT KVDIK<br>SEQ ID NO: 27980 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARSGTSS FDYWGQGTLVTVSS<br>SEQ ID NO: 31986 |
| | | NA | GACATCCAGATGACCCAGTCTCCATCTTCCGT GTCTGCATCTGTAGGAGATAGAGTCACCATCA CTTGTCGGGCGAGTCAGGGTCAGGGTATTAGCAGGTGG TTAGCCTGGTATCAGCAGAAACCAGGGAAAG CCCCTAAGCTCCTGATCTATGGTGCATCCAGTT TGCAAAGTGGGTCCCATCAAGGTTCAGCGGC AGTGGATCTGGGACAGATTTCACTCTCACCAT CAGCAGCCTGCAGCCTGAAGATTTTGCAATTT ATTATTGTCAACAGGCTAACAGTTTCCCATTC ACTTTCGGCCAAGGGACCAAAGTGGATATCAA A<br>SEQ ID NO: 27981 | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCATCCAACAGTGGT GGCACAAACTATGCACAGAAGTTTCAGGGCAGG GTCACCATGACCAGGGACACGTCCATCAGCACA GCCTACATGGAGCTGAGCAGTCTGAGATCTGACG ACACGGCCGTGTATTACTGTGCGAGAGATGCTAC CAGTCTGTTTGACTACTGGGGCCAGGGAACCCTG GTCACCGTGTCCTCA<br>SEQ ID NO: 31987 |
| | | AA | DIQMTQSPSSVSASVGDRVTITCRASQGISRWLA WYQQKPGKAPKLLIYGASSLQSGVPSRFSGSGS GTDFTLTISSLQPEDFAIYYCQQANSFPFTFGQGT KVDIK<br>SEQ ID NO: 27982 | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SFDYWGQGTLVTVSS<br>SEQ ID NO: 31988 |

FIGURE 50
(Continued)

| | | | | |
|---|---|---|---|---|
| iPS:442093 | 21-225_4H6.011 | NA | GACATCCAGATGACCCAGTCTCCATCTTCCGT GTCTGCATCTGTAGGAGACAGAGTCACCATCA CTTGTCGGGCGAGTCAGGGTATTAGCAGGTGG TTAGCCTGGTATCAGCAGAAACCAGGGAAAG CCCCTAAGCTCCTGATCTATGGTGCATCCAGTT TGCAAAGTGGGGTCCATCAAGGTTCAGCGGC AGTGGATCTGGGACAGATTTCACTCTCACCAT CAGCAGCCTGCAGCCTGAAGATTTTGCAACTT ATTATTGTCAACAGGCTAACAGTTTCCCATTC ACTTTCGGCCAAGGGACCAAAGTGGATATCAA A | CAGGTGCAGCTGGTACAGTCTGGGGCTGAGGTG AAGAAGCCTGGGGCCTCAGTGAAGGTCAGCTGC AAGGCTTCTGGATACACCTTCACCGACTACTATT TGCACTGGGTGCGACAGGCCCCTGGACAAGGTCT TGAGTGGATGGGATGGATCCACCCTAACAGTGGT GGCACAAACTATGCACAGAAGTTCAGGCAGG GTCACCATGACCAGGGACACGTCCATCAGCACA GCCTACATGGAGCTGAGCAGTCTGAGATCTGACG ACACGGCCGTGTATTACTGTGCGAGAGATGCTAC CAGCTCGTTTGACTACTGGGGCCAGGGAACCCTG GTCACCGTGTCCTCA |
| | | | SEQ ID NO: 27983 | SEQ ID NO: 31989 |
| | | AA | DIQMTQSPSSVSASVGDRVTITCRASQGISRWLA WYQQKPGKAPKLLIYGASSLQSGVPSRFSGSGS GTDFTLTISSLQPEDFATYYCQQANSFPFTFGQG TKVDIK | QVQLVQSGAEVKKPGASVKVSCKASGYTFTDYYL HWVRQAPGQGLEWMGWIHPNSGGTNYAQKFQGR VTMTRDTSISTAYMELSSLRSDDTAVYYCARDATS SFDYWGQGTLVTVSS |
| | | | SEQ ID NO: 27984 | SEQ ID NO: 31990 |
| iPS:442115 | 21-225_5E5.003 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTGCGAGAGAGGTATA TAGCAGTGGCTGGTACGACTACGGTATGGACGTC TGGGGCCAAGGGACCACGGTCACCGTGTCCTCA |
| | | | SEQ ID NO: 27985 | SEQ ID NO: 31991 |

FIGURE 50
(Continued)

| | | | | |
|---|---|---|---|---|
| iPS:442122 | 21-225_5E5.004 | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK | QVQLVESGGGVVQPGRSLRLSCAASGFTFSNYMHWVRQAPGKGLEWVAVIWYDASNKYYADSVKGRFTISRDNSKNTLYLQMNSLRAEDTAVYYCTREVYSSGWYDYGMDVWGQGTTVTVSS |
| | | | SEQ ID NO: 27986 | SEQ ID NO: 31992 |
| | | NA | GACATCCAGATGACCCAGTCTCCATCCTCCTGTCTGCATCTGTAGGAGACAGAGTCACCATCACTTGCCGGGCAAGTCAGGGCATTAGAAATGATTTAGGCTGGTATCAGCAGAAACCAGGAAAGCCCCTAAGCGCCTGATCTATGCTGCATCCAGTTTGCAAAGTGGGGTCCCATCCAAGGTTCAGCGGCAGTGGATCTGGGACAGAATTCACTCTCACAATCAGCAGCCTGCAGCCTGAAGATTTTGCAACTTATTACTGTCTACAGCATTATAGTTACCCTCGGACGTTCGGCCAAGGGACCAAGGTGGAAGTCAAA | CAGGTGCAGCTGGTGGAGTCTGGGGGAGGCGTGGTCCAGCCTGGGAGGTCCCTGAGACTCTCCTGTGCAGCGTCTGGATTCACCTTCAGTAACTATGTCATGCACTGGGTCCGCCAGGCTCCAGGCAAGGGGCTGGAGTGGGTGGCAGTTATCTGGTATGATGAAGTAATAAATACTATGCATGGACAATCCGTGAAGGGCCGATTCACCATCTCCAGAGACAACAATTCCAAGAACACGCTGTATCTGCAAATGAACAGCCTGAGAGCCGAGGACACGGCTGTGTATTACTGTACGAGAGAGGTATATAGCAGTGGCTGGTACGACTACGGTATGGACGTCTGGGGCCAAGGGACCACGGTCACCGTCTCCTCA |
| | | | SEQ ID NO: 27987 | SEQ ID NO: 31993 |
| | | AA | DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVK | QVQLVESGGGVVQPGRSLRLSCAASGFTFSNYMHWVRQAPGKGLEWVAVIWYDGSNKYYAESVKGRFTISRDNSKNTLYLQMNSLRAEDTAVYYCTREVYSSGWYDYGMDVWGQGTTVTVSS |
| | | | SEQ ID NO: 27988 | SEQ ID NO: 31994 |

FIGURE 50
(Continued)

| | | | |
|---|---|---|---|
| iPS:442129 | 21-225_5E5.005 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGTCCAGGCAAGGGCT GGAGTGGGTGGCAGTTATCTGGTATGGAAGT AATAAATACTATGCAGGCTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGACTACGGTATA TAGCAGTGGCTGGTACGACTACGGTATGGACGTC TGGGGCCAAGGGACCACCGTCACCGTCTCCTCA |
| | | | SEQ ID NO: 27989 | SEQ ID NO: 31995 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDGSNKYYAGSVKGR FTISRDNSKNTLYLQMNSLRAEDTAVYYCTREVYS SGWYDYGMDVWGQGTTVTVSS |
| | | | SEQ ID NO: 27990 | SEQ ID NO: 31996 |
| iPS:442136 | 21-225_5E5.006 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGTCCAGGCAAGGGCT GGAGTGGGTGGCAGTTATCTGGTATGGAAGT AATAAATACTATGCAGACGCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACCGTCACCGTCTCCTCA |
| | | | | SEQ ID NO: 31997 |

FIGURE 50
(Continued)

| | | | | |
|---|---|---|---|---|
| iPS:442171 | 21-225_5E5.011 | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDGSNKYYADAVKG RFTISRDNSKNTLYLQMNSLRAEDTAVYYCTREVY SSGWYDYGMDVWGQGTTVTVSS |
| | | | SEQ ID NO: 27992 | SEQ ID NO: 31998 |
| | | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG GCACTGGGTCCGCCAGGCTCCAGGCAAGGGCT CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGATGCAGTCAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTGTCCTCA |
| | | | SEQ ID NO: 27993 | SEQ ID NO: 31999 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDASNKYYAESVKGR FTISRDNSKNTLYLQMNSLRAEDTAVYYCTREVYS SGWYDYGMDVWGQGTTVTVSS |
| | | | SEQ ID NO: 27994 | SEQ ID NO: 32000 |

FIGURE 50
(Continued)

| | | | |
|---|---|---|---|
| iPS:442178 | 21-225_5E5.012 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGTCCAGGCAAGGGCT GGAGTGGGTGGCAGTTATCTGGTATGATGGCAAGT AATAAATACTATGCAGAGACGCCGTGAAGGGCCGA TTCACCATCTCCAAGAGACAATTCCAAGAACACGC TGTATCTGCAAATGAACAGCCTGAGAGCCGAGG ACACGGCTGTGTATTACTGTACGACTACGGTATGACGTC TAGCAGTGGCTGGTACGACTACGGTATGACGTC TGGGGCCAAGGGACCACGGTCACCGTGTCCTCA |
| | | | SEQ ID NO: 27995 | SEQ ID NO: 32001 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDASNKYYADAVKG RFTISRDNSKNTLYLQMNSLRAEDTAVYYCTREVY SSGWYDYGMDVWGQGTTVTVSS |
| | | | SEQ ID NO: 27996 | SEQ ID NO: 32002 |
| iPS:442199 | 21-225_5E5.015 | NA | GACATCCAGATGACCCAGTCTCCATCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGATTCACTCTCACAA TCAGCAGCCTGCAGCCTGAAGATTTTGCAACT TATTACTGTCTACAGCATTATAGTAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGTCCAGGCAAGGGCT GGAGTGGGTGGCAGTTATCTGGTATGATGGCAAGT AATAAATACTATGCAGAGACTCCGTGAAGGGCCGA TTCACCATCTCCAAGAGACAATTCCAAGAACACGC TGTATCTGCAAATGAACAGCCTGAGAGCCGAGG ACACGGCTGTATTACTGTACGAGAGAGGTATA TAGCAGTGGCTATTACGACTACGGTATGACGTC TGGGGCCAAGGGACCACGGTCACCGTGTCCTCA |
| | | | SEQ ID NO: 27997 | SEQ ID NO: 32003 |

FIGURE 50
(Continued)

| | | | | |
|---|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYM HWVRQAPGKGLEWVAVIWYDASNKYYADSVKGR FTISRDNSKNTLYLQMNSLRAEDTAVYYCTREVYS SGYYDYGMDVWGQGTTVTVSS |
| | | | SEQ ID NO: 27998 | SEQ ID NO: 32004 |
| iPS:442206 | 21-225_5E5.016 | NA | GACATCCAGATGACCCAGTCTCCATCCTCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGCAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTTCTACGACTACGGTATGGACGTC TGGGGCCAAGGGACCACGGTCACCGTGTCCTCA |
| | | | SEQ ID NO: 27999 | SEQ ID NO: 32005 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYM HWVRQAPGKGLEWVAVIWYDASNKYYADSVKGR FTISRDNSKNTLYLQMNSLRAEDTAVYYCTREVYS SGFYDYGMDVWGQGTTVTVSS |
| | | | SEQ ID NO: 28000 | SEQ ID NO: 32006 |

FIGURE 50
(Continued)

| | | | | |
|---|---|---|---|---|
| iPS:442213 | 21-225_5E5.017 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGAATCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGAGAGAGGTATA TAGCAGTGGCTATTACGACTACGGTATGGACGTC TGGGGCCAAGGGACCACGGTCACCGTCTCCTCA |
| | | AA | SEQ ID NO: 28001 | SEQ ID NO: 32007 |
| | | | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDGSNKYYAESVKGR FTISRDNSKNTLYLQMNSLRAEDTAVYYCTREVYS SGYYDYGMDVWGQGTTVTVSS |
| | | | SEQ ID NO: 28002 | SEQ ID NO: 32008 |
| iPS:442220 | 21-225_5E5.018 | NA | GACATCCAGATGACCCAGTCTCCATCTCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTAGTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGACTCCGTGAAGGGCCGA TTCACCATCTCCAGAGACAATTCCAAGAACACGC TGTATCTGCAAATGAACAGCCTGAGAGCCGAGG ACACGGCTGTATTACTGTACGAGAGAGGTATA TAGCAGTGGCTATTACGACTACGGTATGGACGTC TGGGGCCAAGGGACCACGGTCACCGTCTCCTCA |
| | | | SEQ ID NO: 28003 | SEQ ID NO: 32009 |

FIGURE 50
(Continued)

| | | | | |
|---|---|---|---|---|
| | | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYM HWVRQAPGKGLEWVAVIWYDGSNKYYADSVKGR FTISRDNSKNTLYLQMNSLRAEDTAVYYCTREVYS SGYYDYGMDVWGQGTTVTVSS |
| | | | | SEQ ID NO: 28004 | SEQ ID NO: 32010 |
| iPS:442227 | 21-225_5E5.019 | | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGGAAGT AATAAATACTATGCAGACTCCGTGAAGGGCCGA TTCACCATCTCCAGAGACAACTCCAAGAACACGC TGTATCTGCAAATGAACAGCCTGAGAGCCGAGG ACACGGCTGTGTATTACTGTACGAGAGAGGTATA TAGCAGTGGCTTCTACGACTACGGTATGGACGTC TGGGGCCAAGGGACCACGGTCACCGTGTCCTCA |
| | | | | SEQ ID NO: 28005 | SEQ ID NO: 32011 |
| | | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYM HWVRQAPGKGLEWVAVIWYDGSNKYYADSVKGR FTISRDNSKNTLYLQMNSLRAEDTAVYYCTREVYS SGFYDYGMDVWGQGTTVTVSS |
| | | | | SEQ ID NO: 28006 | SEQ ID NO: 32012 |

FIGURE 50
(Continued)

| | | | | |
|---|---|---|---|---|
| iPS:442255 | 21-225_5E5.023 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGCT GGAGTGGGTGGCAGTTATCTGGTATGATGCAAGT AATAAATACTATGCAGAATCCGTGAAGGGCCGA TTCACCATCTCCAGAGACAATTCCAAGAACACGC TGTATCTGCAAATGAACAGCCTGAGAGCCGAGG ACACGGCTGTGTATTACTGTACGACTACGGTATA TAGCAGTGGCTATTACGACTACGGTATGACGTC TGGGGCCAAGGGACCACGGTCACCGTCTCCTCA |
| | | | SEQ ID NO: 28007 | SEQ ID NO: 32013 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDASNKYYAESVKGR FTISRDNSKNTLYLQMNSLRAEDTAVYYCTTTVYS SGYYDYGMDVWGQGTTVTVSS |
| | | | SEQ ID NO: 28008 | SEQ ID NO: 32014 |
| iPS:442262 | 21-225_5E5.024 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTACCCTCGG ACGTTCGGCCAAGGGACCAAGGTGGAAGTCA AA | CAGGTGCAGCTGGTGGAGTCTGGGGGAGGCGTG GTCCAGCCTGGGAGGTCCCTGAGACTCTCCTGTG CAGCGTCTGGATTCACCTTCAGTAACTATGTCAT GCACTGGGTCCGCCAGGCTCCAGGCAAGGGCT GGAGTGGGTGGCAGTTATCTGGTATGATGCAAGT AATAAATACTATGCAGAGACCGTGAAGGGCCGA TTCACCATCTCCAGAGACAATTCCAAGAACACGC TGTATCTGCAAATGAACAGCCTGAGAGCCGAGG ACACGGCTGTATTACTGTACGAGAGAGGTATA TAGCAGTGGCTATTACGACTACGGTATGACGTC TGGGGCCAAGGGACCACGGTCACCGTCTCCTCA |
| | | | SEQ ID NO: 28009 | SEQ ID NO: 32015 |

FIGURE 50
(Continued)

| | | | |
|---|---|---|---|
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | QVQLVESGGGVVQPGRSLRLSCAASGFTFSNYVM HWVRQAPGKGLEWVAVIWYDASNKYYADAVKG RFTISRDNSKNTLYLQMNSLRAEDTAVYYCTREVY SSGYYDYGMDVWGQGTTVTSS |
| | | | SEQ ID NO: 28010 | SEQ ID NO: 32016 |
| iPS:442269 | 21-225_5E5.025 | NA | GACATCCAGATGACCCAGTCTCCATCCTCCCT GTCTGCATCTGTAGGAGACAGAGTCACCATCA CTTGCCGGGCAAGTCAGGGCATTAGAAATGAT TTAGGCTGGTATCAGCAGAAACCAGGAAAG CCCCTAAGCGCCTGATCTATGCTGCATCCAGT TTGCAAAGTGGGGTCCCATCAAGGTTCAGCGG CAGTGGATCTGGGACAGAATTCACTCTCACAA TCAGCAGCCTGCAGCCTGAAGATTTTGCAACT TATTACTGTCTACAGCATTATAGTTACCCTCGG ACGTTCGGCCAAGGGACCAAGGTGGAAGTCA AA | GAGGTGCAGCTGGTGGAGTCTGGGGGAGGCGTG GTCCAGCCTGGGGGGTCCCTGAGACTCTCCTGTG CAGCGTCTGGATTCACCTTCAGTAACTATGTCAT GCACTGGGTCCGCCAGGCTCCAGGCAAGGGGCT GGAGTGGGTGGCAGTTATCTGGTATGATGAAGT AATAAATACTATGCAGAATCCGTGAAGGGCCGA TTCACCATCTCCAGAGACAATGCCAAGAACACGC TGTATCTGCAAATGAACAGCCTGAGAGCCGAGG ACACGGCTGTGTATTACTGTACGAGAGAGGTATA TAGCAGTGGCTGGTACGACTACGGTATGGACGTC TGGGGCCAAGGGACCACGGTCACCGTGTCCTCA |
| | | | SEQ ID NO: 28011 | SEQ ID NO: 32017 |
| | | AA | DIQMTQSPSSLSASVGDRVTITCRASQGIRNDLG WYQQKPGKAPKRLIYAASSLQSGVPSRFSGSGS GTEFTLTISSLQPEDFATYYCLQHYSYPRTFGQG TKVEVK | EVQLVESGGGVVQPGGSLRLSCAASGFTFSNYVMH WVRQAPGKGLEWVAVIWYDGSNKYYAESVKGRF TISRDNAKNTLYLQMNSLRAEDTAVYYCTREVYSS GWYDYGMDVWGQGTTVTSS |
| | | | SEQ ID NO: 28012 | SEQ ID NO: 32018 |

FIGURE 50
(Continued)

| | | | | |
|---|---|---|---|---|
| iPS:442311 | 21-225_7E11.001.001 | NA | GACATCCAGATGACCCAGTCTCCATCCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA <br><br>SEQ ID NO: 28013 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCAGAGACTCCGTGAAGGGCCGA AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTCCTCA <br><br>SEQ ID NO: 32019 |
| | | AA | DIQMTQSPSSLSASVGDRVTITCRASQNIISYLNW YQQKPGKAPKFLIYTASSLQSGVPSRFSGSGSGT DFTLTISSLQPEDFAIYYCQQTYSTPLTFGGGTKV EIK <br><br>SEQ ID NO: 28014 | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS <br><br>SEQ ID NO: 32020 |
| iPS:442317 | 21-225_7E11.001.002 | NA | GACATCCAGATGACCCAGTCTCCATCCTCCCT GTCTGCATCTGTAGGAGACAGAGTCACCATTA CTTGCCGGGCAAGTCAAAACATTATCAGCTAT TTAAATTGGTATCAACAGAAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCCGCTC ACTTTCGGCGGAGGGACCAAGGTGGAGATCA AA <br><br>SEQ ID NO: 28015 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCAGAGACTCCGTGAAGGGCCGA AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTCCTCA <br><br>SEQ ID NO: 32021 |

FIGURE 50
(Continued)

| | | | |
|---|---|---|---|
| iPS:442323 | 21-225_7E11.001.003 | AA | DIQMTQSPSSLSASVGDRVTITCRASQNIISYLNWYQQKPGKAPKLLIYTASSLQSGVPSRFSGSGSGT DFTLTISSLQPEDFATYYCQQTYSTPLTFGGGTK VEIK<br>SEQ ID NO: 28016 | QVQLVESGGGVVQPGRSLRLSCAASGFTFSSFGMH WVRQAPGKGLEWVAIIWHDGSNKYYADSVKGRFT ISRDNSKNTLYLQMSSLRAEDTAVYYCARDLSMGG MDVWGQGTTVTVSS<br>SEQ ID NO: 32022 |
| | | NA | GACATCCAGATGACCCAGTCTCCATCCTCCCT GTCTGCATCTGTAGGAGACAGAGTCACCATTG CTTGCCGGGCAAGTCAAAACATTATCAGCTAT TTAAATTGGTATCAACAGAAACCAGGAAAG CCCCTAAATTCCTGATCTATACTGCATCCAGTT TGCAAAGTGGATGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA<br>SEQ ID NO: 28017 | CAGGTGCAGCTGGTGGAGTCTGGGGGAGGCGTG GTCCAGCCTGGGAGGTCCCTGCGACTCTCCTGTG CAGCGTCTGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32023 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 28018 | QVQLVESGGGVVQPGRSLRLSCAASGFTFSSFGMH WVRQAPGKGLEWVAIIWHSGSNKYYADSVKGRFT ISRDNSKNTLYLQMSSLRAEDTAVYYCARDLSMGG MDVWGQGTTVTVSS<br>SEQ ID NO: 32024 |

FIGURE 50
(Continued)

| | | | |
|---|---|---|---|
| iPS:442330 | 21-225_7E11.001.004 | NA | GACATCCAGATGACCCAGTCTCCATCCTCCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA<br><br>SEQ ID NO: 28019 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCAGATCGTGAAGGAAAG TAATAAATACTATGCAGACTCCGTGAAGGGCCG ATTCACCATCTCCAGAGACAATTCCAAAAACACG CTGTATCTGCAAATGAGCAGCCTGCGAGCCGAG GACACGGCTGTGTATTACTGTGCGAGAGATCGA GTATGGCGGTATGGACGTCTGGGGCCAAGGGA CCACGGTCACCGTCCTCA<br><br>SEQ ID NO: 32025 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28020 | QVQLVESGGGVVQPGRSLRLSCAASGFTFSSFGMH WVRQAPGKGLEWVAIIWHEGSNKYYADSVKGRFT ISRDNSKNTLYLQMSSLRAEDTAVYYCARDLSMGG MDVWGQGTTVTVSS<br><br>SEQ ID NO: 32026 |
| iPS:442337 | 21-225_7E11.001.005 | NA | GACATCCAGATGACCCAGTCTCCATCCTCCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA<br><br>SEQ ID NO: 28021 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCAGATCGTGATGCAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTCCTCA<br><br>SEQ ID NO: 32027 |

FIGURE 50
(Continued)

| | | | |
|---|---|---|---|
| iPS:442344 | 21-225_7E11.001.006 | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHDASNKYYADSVKGRFT ISRDNSKNTLYLQMSSLRAEDTAVYYCARDLSMGG MDVWGQGTTVTVSS |
| | | | SEQ ID NO: 28022 | SEQ ID NO: 32028 |
| | | NA | GACATCCAGATGACCCAGTCTCCATCCTCCCT GTCTGCATCTGTAGGAGACAGAGTCACCATC CTTGCCCGGGCAAGTCAAAACATTATCAGTAT TTAAATTGGTATCAACAAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATT ACTACTGTCAACAGACTTACAGTACCCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGAAGT AATAAATACTATGCAGAATCCGTGAAGGGCCGA TTCACCATCTCCAGAGACAATCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28023 | SEQ ID NO: 32029 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHDGSNKYYAESVKGRFT ISRDNSKNTLYLQMSSLRAEDTAVYYCARDLSMGG MDVWGQGTTVTVSS |
| | | | SEQ ID NO: 28024 | SEQ ID NO: 32030 |

FIGURE 50
(Continued)

| | | | |
|---|---|---|---|
| iPS:442351 | 21-225_7E11.001.007 | NA | GACATCCAGATGACCCAGTCTCCATCCTCCT GTCTGCATCTGTAGGAGACAGAGTCACCATC CTTGCCGGGCAAGTCAAAACATTATCAGCTAT TTAAATTGGTATCAACAGAAACCAGGGAAAG CCCCTAAATTCCTGATCTATACTGCATCCAGT TGCAAAGTGGGGGTCCCATCAAGGTTCAGTGGC AGTGGATCGGGACAGATTTCACTCTCACCAT CAGCAGTCTGCAACCTGAAGATTTTGCAATT ACTACTGTCAACAGAGACTTACAGTACCCGCTC ACTTTCGGCGGAGGGACCAAGGTGGAGATCA AA
SEQ ID NO: 28025 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGATGGAAGT AATAAATACTATGCAGACGCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA
SEQ ID NO: 32031 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK
SEQ ID NO: 28026 | QVQLVESGGGVVQPGRSLRLSCAASGFTFSSFGMH WVRQAPGKGLEWVAIIWHDGSNKYYADAVKGRF TISRDNSKNTLYLQMSSLRAEDTAVYYCARDLSMG GMDVWGQGTTVTVSS
SEQ ID NO: 32032 |
| iPS:442358 | 21-225_7E11.001.008 | NA | GACATCCAGATGACCCAGTCTCCATCCTCCCT GTCTGCATCTGTAGGAGACAGAGTCACCATC CTTGCCGGGCAAGTCAAAACATTATCAGCTAT TTAAATTGGTATCAACAGAAACCAGGGAAAG CCCCTAAATTCCTGATCTATACTGCATCCAGT TGCAAAGTGGGGGTCCCATCAAGGTTCAGTGGC AGTGGATCTGGGACAGATTTCACTCTCACCAT CAGCAGTCTGCAACCTGAAGATTTTGCAATT ACTACTGTCAACAGAGACTTACAGTACCCGCTC ACTTTCGGCGGGGGGACCAAGGTGGAGATCA AA
SEQ ID NO: 28027 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGAAGGAAG TAATAAATACTATGCAGAGACGCCGTGAAGGGCCG ATTCACCATCTCCAGAGACAATTCCAAAAACACG CTGTATCTGCAAATGAGCAGCCTGCGAGCCGAG GACACGGCTGTGTATTACTGTGCGAGAGATCTGA GTATGGGCGGTATGGACGTCTGGGGCCAAGGGA CCACGGTCACCGTGTCCTCA
SEQ ID NO: 32033 |

FIGURE 50
(Continued)

| | | | |
|---|---|---|---|
| iPS:442365 | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHEGSNKYYADAVKGRF TISRDNSKNTLYLQMSSLRAEDTAVYYCARDLSMG GMDVWGQGTTVTVSS |
| | | | SEQ ID NO: 28028 | SEQ ID NO: 32034 |
| | 21-225_7E11.001.009 | NA | GACATCCAGATGACCCAGTCTCCATCCTCCCT GTCTGCATCTGTAGGAGACAGAGTCACCATTG CTTGCCGGGCAAGTCAAAACATTATCAGTTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATGAAGGAAG TAATAAATACTATGCAGATGCAGTCAAGGGCCG ATTCACCATCTCCAGAGACACAATTCCAAAAACACG CTGTATCTGCAAATGAGCAGCCTGCGAGCCGAG GACACGGCTGTGTATTACTGTGCGAGAGATCTGA GTATGGGGGTATGGACGTCTGGGGCCAAGGGA CCACGGTCACCGTGTCCTCA |
| | | | SEQ ID NO: 28029 | SEQ ID NO: 32035 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHEGSNKYYAESVKGRFT ISRDNSKNTLYLQMSSLRAEDTAVYYCARDLSMGG MDVWGQGTTVTVSS |
| | | | SEQ ID NO: 28030 | SEQ ID NO: 32036 |

FIGURE 50
(Continued)

| | | | |
|---|---|---|---|
| iPS:442372 | 21-225_7E11.001.010 | NA | GACATCCAGATGACCCAGTCTCCATCCTCCT GTCTGCATCTGTAGGAGACAGAGTCACCATC CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGAGACTTACAGTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATAGTGGAAGT AATAAATACTATGCAGAATCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 32037 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK | QVQLVESGGGVVQPGRSLRLSCAASGFTFSSFGMH WVRQAPGKGLEWVAIIWHSGSNKYYAESVKGRFT ISRDNSKNTLYLQMSSLRAEDTAVYYCARDLSMGG MDVWGQGTTVTVSS |
| | | | SEQ ID NO: 28032 | SEQ ID NO: 32038 |
| iPS:442379 | 21-225_7E11.001.011 | NA | GACATCCAGATGACCCAGTCTCCATCCTCCT GTCTGCATCTGTAGGAGACAGAGTCACCATC CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGAGACTTACAGTACCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCTGGCATAGTGGAAGT AATAAATACTATGCAGAACCGTGAAGGGCCGA TTCACCATCTCCAGAGACAATTCCAAAAACACGC TGTATCTGCAAATGAGCAGCCTGCGAGCCGAGG ACACGGCTGTATTACTGTGCGAGAGATCTGAG TATGGGCGGTATGGACGTCTGGGGCCAAGGGAC CACGGTCACCGTGTCCTCA |
| | | | SEQ ID NO: 28033 | SEQ ID NO: 32039 |

FIGURE 50
(Continued)

| | | | |
|---|---|---|---|
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br><br>SEQ ID NO: 28034 | QVQLVESGGGVVQPGRSLRLSCAASGFTFSSFGMH WVRQAPGKGLEWVAIIWHSGSNKYYADAVKGRFT ISRDNSKNTLYLQMSSLRAEDTAVYYCARDLSMGG MDVWGQGTTVTVSS<br><br>SEQ ID NO: 32040 |
| iPS:442386 | 21-<br>225_7E11.001.012 | NA | GACATCCAGATGACCCAGTCTCCATCCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA<br><br>SEQ ID NO: 28035 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br><br>SEQ ID NO: 32041 |
| | | AA | DIQMTQSPSSLSASVGDRVTITCRASQNIISYLNW YQQKPGKAPKFLIYTASSLQSGVPSRFSGSGSGT DFTLTISSLQPEDFAIYYCQQTYSTPLTFGGGTKV EIK<br><br>SEQ ID NO: 28036 | QVQLVESGGGVVQPGRSLRLSCAASGFTFSSFGMH WVRQAPGKGLEWVAIIWHSGSNKYYADSVKGRFT ISRDNSKNTLYLQMSSLRAEDTAVYYCARDLSMGG MDVWGQGTTVTVSS<br><br>SEQ ID NO: 32042 |

FIGURE 50
(Continued)

| | | | |
|---|---|---|---|
| iPS:442390 | 21-225_7E11.001.013 | NA | GACATCCAGATGACCCAGTCTCCATCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGAGACTTACAGTACCCGCTC ACTTTCGGCGGAGGGACCAAGGTGGAGATCA AA<br><br>SEQ ID NO: 28037 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCAGAGAATCCGTGAAGT AATAAATACTATGCAGACAATTCCAAAAACACGC TTCACCATCTCCAGAGACACTTCACTGTACCTGCAGATGAACAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br><br>SEQ ID NO: 32043 |
| | | AA | DIQMTQSPSSLSASVGDRVTITCRASQNIISYLNW YQQKPGKAPKFLIYTASSLQSGVPSRFSGSGSGT DFTLTISSLQPEDFAIYYCQQTYSTPLTFGGGTKV EIK<br><br>SEQ ID NO: 28038 | QVQLVESGGGVVQPGRSLRLSCAASGFTFSSFGMH WVRQAPGKGLEWVAIIWHDGSNKYYAESVKGRFT ISRDNSKNTLYLQMSSLRAEDTAVYYCARDLSMGG MDVWGQGTTVTVSS<br><br>SEQ ID NO: 32044 |
| iPS:442394 | 21-225_7E11.001.014 | NA | GACATCCAGATGACCCAGTCTCCATCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGAGGGACCAAGGTGGAGATCA AA<br><br>SEQ ID NO: 28039 | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGCT GGAGTGGGTGGCAATTATCAGAGAATCCGTGAAGT AATAAATACTATGCAGACAATTCCAAAAACACGC TTCACCATCTCCAGAGACACTTCACTGTACCTGCAGATGAACAGCCTGCGAGCCGAGG ACACGGCTGTATTACTGTGCGAGAGATCTGAG TATGGGCGGTATGGACGTCTGGGGCCAAGGGAC CACGGTCACCGTGTCCTCA<br><br>SEQ ID NO: 32045 |

FIGURE 50
(Continued)

| | | | |
|---|---|---|---|---|
| | | AA | DIQMTQSPSSLSASVGDRVTITCRASQNIISYLNW YQQKPGKAPKFLIYTASSLQSGVPSRFSGSGSGT DFTLTISSLQPEDFAIYYCQQTYSTPLTFGGGTKV EIK | QVQLVESGGGVVQPGRSLRLSCAASGFTFSSFGMH WVRQAPGKGLEWVAIIWHSGSNKYYAESVKGRFT ISRDNSKNTLYLQMSSLRAEDTAVYYCARDLSMGG MDVWGQGTTVTVSS |
| | | | SEQ ID NO: 28040 | SEQ ID NO: 32046 |
| iPS:442398 | 21-225_7E11.001.015 | NA | GACATCCAGATGACCCAGTCTCCATCCTCCCT GTCTGCATCTGTAGGAGACAGAGTCACCATTA CTTGCCGGGCAAGTCAAAACATTATCAGCTAT TTAAATTGGTATCAACAGAAACCAGGAAAG CCCCTAAACTCCTGATCTATACTGCATCCAGTT TGCAAAGTGGATGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGACTTACAGTACCCCGCTC ACTTTCGGCGGAGGGACCAAGGTGGAGATCA AA | CAGGTGCAGCTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGCTCCAGGCAAGGGGCT GGAGTGGGTGGCAATTATCTGGCATAGTGGAAGT AATAAATACTATGCAGACTCCGTGAAGGGCCGA TTCACCATCTCCAGAGACAATTCCAAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA |
| | | | SEQ ID NO: 28041 | SEQ ID NO: 32047 |
| | | AA | DIQMTQSPSSLSASVGDRVTITCRASQNIISYLNW YQQKPGKAPKLLIYTASSLQSGVPSRFSGSGSGT DFTLTISSLQPEDFATYYCQQTYSTPLTFGGGTK VEIK | QVQLVESGGGVVQPGRSLRLSCAASGFTFSSFGMH WVRQAPGKGLEWVAIIWHSGSNKYYADSVKGRFT ISRDNSKNTLYLQMSSLRAEDTAVYYCARDLSMGG MDVWGQGTTVTVSS |
| | | | SEQ ID NO: 28042 | SEQ ID NO: 32048 |

FIGURE 50
(Continued)

| | | | |
|---|---|---|---|
| iPS:442402 | 21-225_7E11.001.016 | NA | GACATCCAGATGACCCAGTCTCCATCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGACTTACAGTACCCGCTC ACTTTCGGCGGCGGGACCAAGGTGGAGATCA AA<br>SEQ ID NO: 28043 | CAGGTGCAGCTGGTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGTCCAGGCAAGGGCT GGAGTGGGTGGCAATTATCTGGCATAGTGAAGT AATAAATACTATGCAGAATCCGTGAAGGCCGA TTCACCATCTCCAGAGACAATTCCAAAACACGC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32049 |
| | | AA | DIQMTQSPSSLSASVGDRVTITCRASQNIISYLNW YQQKPGKAPKLLIYTASSLQSGVPSRFSGSGSGT DFTLTISSLQPEDFATYYCQQTYSYPLTFGGGTK VEIK<br>SEQ ID NO: 28044 | QVQLVESGGGVVQPGRSLRLSCAASGFTFSSFGMH WVRQAPGKGLEWVAIIWHSGNKYYAESVKGRFT ISRDNSKNTLYLQMSSLRAEDTAVYYCARDLSMGG MDVWGQGTTVTVSS<br>SEQ ID NO: 32050 |
| iPS:442406 | 21-225_7E11.001.017 | NA | GACATCCAGATGACCCAGTCTCCATCTCCCT GTCTGCATCTGTAGGAGACAGAGTCACCATTA CTTGCCGGGCAAGTCAAAACATTATCAGCTAT TTAAATTGGTATCAACAGAAACCAGGGAAAG CCCCTAAACTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAACTT ACTACTGTCAACAGAGACTTACAGTACCCGCTC ACTTTCGGCGGCGGGACCAAGGTGGAGATCA AA<br>SEQ ID NO: 28045 | CAGGTGCAGCTGGTGGTGGAGTCTGGGGGAGGCGTG GTCCAGCCTGGGAGGTCCCTGCGACTCTCCTGTG CAGCGTCTGGATTCACCTTCAGTAGCTTTGGCAT GCACTGGGTCCGCCAGGTCCAGGCAAGGGCT GGAGTGGGTGGCAATTATCTGGCATGAAGGAAG TAATAAATACTATGCAGAGACGCCGTGAAGGCCG ATTCACCATCTCCAGAGACAATTCCAAAACACG CTGTATCTGCAAATGAGCAGCCTGCGAGCCGAG GACACGGCTGTGTATTACTGTGCGAGAGATCTGA GTATGGGCGGTATGGACGTCTGGGGCCAAGGGA CCACGGTCACCGTGTCCTCA<br>SEQ ID NO: 32051 |

FIGURE 50
(Continued)

| | | | | |
|---|---|---|---|---|
| iPS:442410 | 21-225_7E11.001.018 | AA | DIQMTQSPSSLSASVGDRVTITCRASQNIISYLNWYQQKPGKAPKLLIYTASSLQSGVPSRFSGSGSGTDFTLTISSLQPEDFATYYCQQTYSTPLTFGGGTKVEIK | QVQLVESGGGVVQPGRSLRLSCAASGFTFSSFGMHWVRQAPGKGLEWAIIWHEGSNKYYADAVKGRFTISRDNSKNTLYLQMSSLRAEDTAVYYCARDLSMGGMDVWGQGTTVTVSS |
| | | | SEQ ID NO: 28046 | SEQ ID NO: 32052 |
| | | NA | GACATCCAGATGACCCAGTCTCCATCCTCCCTGTCTGCATCTGTAGGAGACAGAGTCACCATTACTTGCCGGGCAAGTCAAAACATTATCAGTTATTTAAATTGGTATCAACAGAAACCAGGGAAAGCCCCTAAATTCCTGATCTATACTGCATCCAGTTTGCAAAGTGGTGGGTCCCATCAAGGTTCAGTGGCAGTGGATCTGGGACAGATTTCACTCTCACCATCAGCAGTCTGCAACCTGCAAGATTTTGCAATTTACTACTGTCAACAGACTTACAGTACCCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGCGACTCTCCTGTGCAGCGTCTGGATTCACCTTCAGTAGCTTTGGCATGCACTGGGTCCGCCAGGCTCCAGGCAAGGGGCTGGAGTGGGTGGCAATTATCAGAATCCGTGAAGGGCGAAATAAATACTATGCAGACACAATTCCAAAAACACGCTTCACCATCTCCAGAGACAATGAGCAGCCTCGCGAGCCGAGGTGTATCTGCAAATGAGCAGCCTGTGCGAGAGATCTGAGACACGGCTGTGTATTACTGTGCGAGAGATCTGAGTATGGGCGGTATGGACGTCTGGGGCCAAGGGACCACGGTCACCGTGTCCTCA |
| | | | SEQ ID NO: 28047 | SEQ ID NO: 32053 |
| | | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK | QVQLVESGGGVVQPGRSLRLSCAASGFTFSSFGMHWVRQAPGKGLEWAIIWHDASNKYYAESVKGRFTISRDNSKNTLYLQMSSLRAEDTAVYYCARDLSMGGMDVWGQGTTVTVSS |
| | | | SEQ ID NO: 28048 | SEQ ID NO: 32054 |

FIGURE 50
(Continued)

| | | | |
|---|---|---|---|
| iPS:442417 | 21-225_7E11.001.019 | NA | GACATCCAGATGACCCAGTCTCCATCCTCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGATTACAGTACCCGCTC ACTTTCGGCGGGGGACCAAGGTGGAGATCA AA<br>SEQ ID NO: 28049 | GAGGTGCAGCTGGTGGAGTCTGGGGGAGGCGTG GTCCAGCCTGGGGGGTCCCTGCGACTCTCCTGTG CAGCGTCTGGATTCACCTTCAGTAGCTTTGGCAT GCACTGGGTCCGCCAGGTCCAGGCAAGGGCT GGAGTGGGTGGCAATTATCAGCATGATGAAGT AATAAATACTATGCAGAGATCCGTGAAGGGCCGA TTCACCATCTCCAGAGACAATGAGCAGCCTGTATC TGTATCTGCAAATGAGCAGCCTGCGAGCCGAGG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32055 |
| | | AA | DIQMTQSPSSLSASVGDRVTIACRASQNIISYLN WYQQKPGKAPKFLIYTASSLQSGVPSRFSGSGSG TDFTLTISSLQPEDFAIYYCQQTYSTPLTFGGGTK VEIK<br>SEQ ID NO: 28050 | EVQLVESGGGVVQPGGSLRLSCAASGFTFSSFGMH WVRQAPGKGLEWVAIIWHDGSNKYYAESVKGRFT ISRDNAKNTLYLQMSSLRAEDTAVYYCARDLSMG GMDVWGQGTTVTVSS<br>SEQ ID NO: 32056 |
| iPS:442431 | 21-225_7E11.001.021 | NA | GACATCCAGATGACCCAGTCTCCATCCTCCCT GTCTGCATCTGTAGGAGACAGAGTCACCATTG CTTGCCGGGCAAGTCAAAACATTATCAGCTAT TTAAATTGGTATCAACAGAAACCAGGGAAAG CCCCTAAATTCCTGATCTATACTGCATCCAGTT TGCAAAGTGGGGTCCCATCAAGGTTCAGTGGC AGTGGATCTGGGACAGATTTCACTCTCACCAT CAGCAGTCTGCAACCTGAAGATTTTGCAATTT ACTACTGTCAACAGACTTACAGTACCCCGCTC ACTTTCGGCGGGGGGACCAAGGTGGAGATCA AA<br>SEQ ID NO: 28051 | GAGGTGCAGCTGGTGGAGTCTGGGGGAGGCGTG GTCCAGCCTGGGGGGTCCCTGCGACTCTCCTGTG CAGCGTCTGGATTCACCTTCAGTAGCTTTGGCAT GCACTGGGTCCGCCAGGTCCAGGCAAGGGCT GGAGTGGGTGGCAATTATCAGCATGATGAAGT AATAAATACTATGCAGAGATCCGTGAAGGGCCGA TTCACCATCTCCAGAGACAATGAGCAGCCTGTATC TGTATCTGCAAATGTATTACTGTGCGAGAGATCTGAG ACACGGCTGTGTATTACTGTGCGAGAGATCTGAG TATGGGCGGTATGGACGTCTGGGGCCAAGGGAC CACGGTCACCGTGTCCTCA<br>SEQ ID NO: 32057 |

FIGURE 50
(Continued)

| | | | | |
|---|---|---|---|---|
| iPS:442438 | 21-225_7E11.001.022 | AA | DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIK | EVQLVESGGGVVQPGGSLRLSCAASGFTFSSFGMHWVRQAPGKGLEWVAIIWHSGSNKYAESVKGRFTISRDNAKNTLYLQMSSLRAEDTAVYYCARDLSMGGMDVWGQGTTVTSS |
| | | | SEQ ID NO: 28052 | SEQ ID NO: 32058 |
| | | NA | GACATCCAGATGACCCAGTCTCCATCCTCCTGTCTGCATCTGTAGGAGACAGAGTCACCATTACTTGCCGGGCAAGTCAAACATTATCAGTTATTTAAATTGGTATCAACAGAAACCAGGGAAAGCCCCTAAATTCCTGATCTATACTGCATCCAGTTTGCAAAGTGGGGTCCCATCAAGGTTCAGTGGCAGTGGATCTGGGACAGATTTCACTCTCACCATCAGCAGTCTGCAACCTGCAAGATTTTGCAATTTACTACTGTCAACAGACTTACAGTACCCCGCTCAGTTTCGGCGGAGGGACCAAGGTGGAGATCAA | GAGGTGCAGCTGGTGGAGTCTGGGGGAGGCGTGGTCCAGCCTGGGGGGTCCCTGCGACTCTCCTGTCAGCGTCTGATTCACCTTCAGTAGCTTTGGCATGCACTGGGTCCGCCAGGCTCCAGGCAAGGGGCTGGAGTGGGTGGCAATTATCTGGCATGAAGGAAGTAATAAATACTATGCAGAGAATCCGTGAAGGGCCGATTCACCATCTCCAGAGACAATGCCAAAAACACGCTGTATCTGCAAATGAGCAGCCTGCGAGCCGAGGACACGGCTGTGTATTACTGTGCGAGAGATCTGAGTATGGGCGGTATGGACGTCTGGGGCCAAGGGACCACGGTCACCGTGTCCTCA |
| | | | SEQ ID NO: 28053 | SEQ ID NO: 32059 |
| | | AA | DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK | EVQLVESGGGVVQPGGSLRLSCAASGFTFSSFGMHWVRQAPGKGLEWVAIIWHEGSNKYAESVKGRFTISRDNAKNTLYLQMSSLRAEDTAVYYCARDLSMGGMDVWGQGTTVTSS |
| | | | SEQ ID NO: 28054 | SEQ ID NO: 32060 |

FIGURE 50
(Continued)

| | | | |
|---|---|---|---|
| iPS:442568 | 21-225_149D8 | NA | GAAATTGTGTTGACGCAGTCTCCAGGCACCCT GTCTTTGTTTCCAGGGGAAAGAGCCACCCTCT CCTGCAGGGCCAGTCAGAGTGTGATCAGCAGC TACTTAGCCTGGTACCAGCAGAAACCTGGCCA GGCTCCCAGGCTCCTCATCTTTGGTGTATCTAG GCTGGCCACTGGCATCCCAGACAGACTTCAGT GCAGTGGGTCTGGGACAGACTTCACTCTCACC ATCAGCAGACTGGAGCCTGAAGATTTTGCAGT GTATTACTGTCAACAATATGTAGGTCACCAT TCAATTTCGGCCCCTGGGACCAAAGTGATATC AAA<br/>SEQ ID NO: 28055 | CAGGTGCAGCTGCAGGAGTCGGGCCCAGGACTG GTGAAGCCTTCACAGACCCTGTCCCTCAATTGCA CTGTCTCTGGTGGCTCCATCAGCAGCAGTGGTTA CTACTGGAGCTGGATCCGCCAGCACCCAGGAA GGGCCTGGAATGGATTGGGTACAGCTATTACAGT GGGAGCACTACTACAACCCGTCCCTCAAGAGTC GAATTACCATATCAGTAGACACGTCTAACAACCA GTTCTCCCTGAAGCTGAGCTCTGTGACTGCCCG GACACGGCCGTGTATTACTGTGCGAGAGGGGA TATAACTGGAACCATGCTTTTGATATCTGGGGCC AAGGGACAATGGTCACCGTCTCTTCA<br/>SEQ ID NO: 32061 |
| | | AA | EIVLTQSPGTLSLFPGERATLSCRASQSVISSYLA WYQQKPGQAPRLLIFGVSSWATGIPDRFSGSGSG TDFTLTISRLEPEDFAVYYCQQYGRSPFNFGPGT KVDIK<br/>SEQ ID NO: 28056 | QVQLQESGPGLVKPSQTLSLNCTVSGGSISNSGYY WSWIRQHPGKGLEWIGYSYYSGSTYYNPSLKSRITI SVDTSNNQFSLKLSSVTAADTAVYYCARGGYNWN HAFDIWGQGTMVTVSS<br/>SEQ ID NO: 32062 |
| iPS:443003 | 21-225_43F11_LC2 | NA | CAGTCTGTGCTGACGCAGCCGCCCTCAGTGTC TGGGGCCCCAGGGCAGAGGGTCACCATCCCT GCACTGGGAGCAGTCCAACATGGGGCAGG TTATGATGTACACTGGTACCAGCAGTTCCAG GAACAGCCCCCAAACTCCTCATCTATGGTAAC AGCAATGGCCCCTCAAGTCTGGCACCTCAGCCTCCT CTCTGGCTCCAAGTCTGGCACCTCAGCCTCCT GGCCATCACTGGGCTCCAGGCTGAGGATGAGG CTGATTATTACTGCCAGTCTATGATGACAACAGC CTGAGTGGTTCGGTATTCGGCGGAGGGACCAA GCTGACCGTCCTA<br/>SEQ ID NO: 28057 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTATA TACACTGGGTGCGACAGGCCCCTGGACAAGCC TTGAGTGGATGGGATGGATCAACCCTAACAGTGG TGGCACAAACTATGCACAGAAGTTTCAGGGCGG GGTCACCATGACCAGGGACACGTCCATCAACACA GCCTACATGGACCTGAGCAGGCTGAGATCTGAC GACACGGCCGTGTATTACTGTGCGAGAGGAGGG AATTACTTCTACAACCACGTTATGGACGTCTGGG GCCAAGGGACCCCGGTCACCGTCTCCTCA<br/>SEQ ID NO: 32063 |

FIGURE 50
(Continued)

| | | | |
|---|---|---|---|
| iPS:443005 | 21-225_43F11_LC1 | AA | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSGSVFGGGTKLTVL |
| | | | SEQ ID NO: 28058 |
| | | NA | GATGTTGTGATGACTCAGTCTCCACTCTCCCTGCCCGTCACCCTTGGACAGCCGGCCTCCATCTCCTGCAGGTCTAGTCAAAGCCTCGTATACAGTGATGGAAACACCTACTTGAATTGGTTTCAGCAGAGGCCAGGCCAATCTCCAAGGCGCCTAATTTATAAGGTTTCTAACTGGGACTCTGGGGTCCCAGACAGATTCAGCGGCCAGTGGGTCAGGCACTGATTTCACACTGAAAATCAGCAGGTGGAGGCTGAGGATGTTGGGGTTTATTACTGCATGCAAGGTACACACTGGCCGCTCACTTTCGGCGGAGGGACCAAGGTGGAGATCAAA |
| | | | SEQ ID NO: 28059 |
| | | AA | DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPLTFGGGTKVEIK |
| | | | SEQ ID NO: 28060 |
| | | | QVQLVQSGAEVKKPGASVKVSCKASGYTFTGYYIHWVRQAPGQGLEWMGWINPNSGGTNYAQKFQGGVTMTRLTSINTAYMDLSRLRSDDTAVYYCARGGNYFYNHVMDVWGQGTPVTVSS |
| | | | SEQ ID NO: 32064 |
| | | | CAGGTGCAGCTGGTGCAGTCTGGGGCTGAGGTGAAGAAGCCTGGGGCCTCAGTGAAGGTCTCCTGCAAGGCTTCTGGATACACCTTCACCGGCTACTATATACACTGGGTGCGACAGGCCCCTGGACAAGGCCTTGAGTGGATGGGATGGATCAACCCTAACAGTGGTGGCACAAACTATGCACAGAAGTTTCAGGGCGGGGTCACCATGACCAGGCTCACGTCCATCAACACATACATGGACCTGAGCAGGCTGAGATCTGACGACACGGCCGTGTATTACTGTGCGAGAGGAGGGAATTACTTCTACAACCACGTTATGGACGTCTGGGGCCAAGGGACCCCGGTCACCGTCTCCTCA |
| | | | SEQ ID NO: 32065 |
| | | | QVQLVQSGAEVKKPGASVKVSCKASGYTFTGYYIHWVRQAPGQGLEWMGWINPNSGGTNYAQKFQGGVTMTRLTSINTAYMDLSRLRSDDTAVYYCARGGNYFYNHVMDVWGQGTPVTVSS |
| | | | SEQ ID NO: 32066 |

FIGURE 50
(Continued)

| | | | |
|---|---|---|---|
| iPS:443006 | 21-225_25A4.001.029 | NA | GACATGTGATGACCCAGTTTCCAGACTCCCTGGCTGTGTCTCTGGGCGAGAGGGCCACCATCAGTGTAAGTCCAGCCAGAGTGTTTTATACAGCTCCCACAATAACAACTACTTAGCTTGGTACCAGCAGAAACCAGGACAGCCTCCTAAGTTGCTCCTTTTACTGGGCATCTACCCGGAATCCGGGGTCCCTGACCGATTCAGTGGCAGCGGGTCTGGGACAGAATTCACTCTCACCATCAGCAGCCTGCAGGCTGAAGATGTGGCAGTTTATTACTGTCAGCAGTATTATAGTACTCCTCCGACGTTCGGCCAAGGGACCAAGGTGGAAATCAAA | CAGGTGCTCCTGGTGCAGTCTGGGGCTGAGGTGAAGAGGCCTGGGGCCTCAGTGAAGGTCAGCTGCAAGGCTTCTGGATACACCTTCACCAATTATGATATTAATTGGGTGCGACAGGCCACTGGACAAGGCTTGAGTGGATGGGATGGATGTACCTAACAGTGGTCAAACAGGCTATGCACAGGAGACACCTCCATCAGCACAGTCACCATGACCAGGGACTGAGGAGCCTGAGATCTGAGGCCTACATGGAGCTGAGCAGCCTGAGATCTGAGGACACGGCCGTCTATTACTGTGCGAGTAGCAGTGGCTGGTACTACTTTGACTACTGGGGCCAGGGAACCCTGGTCACCGTGTCCTCA |
| | | | SEQ ID NO: 28061 | SEQ ID NO: 32067 |
| | | AA | DIVMTQFPDSLAVSLGERATIKCKSSQSVLYSSHNNNYLAWYQQKPGQPPKLLLYWASTRESGVPDRFSGSGSGTEFTLTISSLQAEDVAVYYCQQYYSTPPTFGQGTKVEIK | QVLLVQSGAEVKRPGASVKVSCKASGYTFTNYDINWVRQATGQLEWMGWMYPNSGQTGYAQKFQGRVTMTRDTSISTAYMELSSLRSEDTAVYYCASSSGWYYFDYWGQGTLVTVSS |
| | | | SEQ ID NO: 28062 | SEQ ID NO: 32068 |
| iPS:443016 | 21-225_4H6.014 | NA | GACATCCAGATGACCCAGTCTCCATCTTCCGTGTCTGCATCTGTAGGAGACAGAGTCACCATCACTTGTCGGGCGAGTCAGGGTATTAGCAGCAGGTGGTTAGCCTGGTATCAGCAGAAACCAGGGAAAGCCCCTAAGCTCCTGATCTATGGTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTATTATTGTCAACAGGCTAACAGTTTCCCATTCACTTTCGGCCCTGGGACCAAAGTGGATATCAAA | CAGGTGCAGCTGGTACAGTCTGGGGCTGAGGTGAAGAAGCCTGGGGCCTCAGTGAAGGTCAGCTGCAAGGCTTCTGGATACACCTTCACCGACTACTATTTGCACTGGGTGCGACAGGCCCCTGGACAAGGTCTTGAGTGGATGGGATGGATCAACCCTAACAGTGGTGGCACAAACTATGCACAGGAGTTCAGGGCAGGGTCACCATGACCAGGGACACGTCCATCAGCACAGCCTACATGGGGCTGAGCAGTCTGAGATCTGAGGACACGGCCGTGTATTACTGTGCGAGAGATGCTACCAGCTCGTTTGACTACTGGGGCCAGGGAACCCTGGTCACCGTCTCCTCA |
| | | | SEQ ID NO: 28063 | SEQ ID NO: 32069 |

FIGURE 50
(Continued)

| | | | |
|---|---|---|---|
| iPS:443027 | | AA | DIQMTQSPSSVSASVGDRVTITCRASQGISRWLAWYQQKPGKAPKLLIYGASSLQSGVPSRFSGSGSGTDFTLTISSLQPEDFATYYCQQANSFPFTFGPGTKVDIK | QVQLVQSGAEVKKPGASVKVSCKASGYTFTDYLHWVRQAPGQGLEWMGWIHPNSGGTNYAQKFQGRVTMTRDTSISTAYMGLSSLRSDDTAVYYCARDATSSFDYWGQGTLVTVSS |
| | | | SEQ ID NO: 28064 | SEQ ID NO: 32070 |
| | 21-225_7E11.001.023 | NA | GACATCCAGATGACCCAGTCTCCATCCTCCTGTCTGCATCTGTAGGAGACAGAGTCACCATTGCTTGCCGGGCAAGTCAAACATTATCAGTTATTAAATTGGTATCAACAGAAACCAGGGAAAGCCCCTAAATTCCTGATCTATACTGCATCCAGTTTGCAAAGTGGGTCCCATCCAAGGTTCAGTGGCAGTGGATCTGGGACAGATTTCACTCTCACCATCAGCAGTCTGCAACCTGAAGATTTTGCAATTTACTACTGTCAACAGAGCTTACAGTACCCCGCTCACTTTCGGCGGAGGGACCAAGGTGGAGATCAAA | CAGGTGCAGCTGGTGGAGTCTGGGGGAGGCGTGGTCCAGCCTGGGAGGTCCCTGCGACTCTCCTGTGCAGCGTCTGGATTCACCTTCAGTAGCTTTGGCATGCACTGGGTCCGCCAGGCTCCAGGCAAGGGGCTGGAGTGGGTGGCAATTATCTGGCATGATGCAAGTAATAAATACTATGCAGACGCCGTGAAGGGCCGATTCACCATCTCCAGAGACAACGCCAAAAACACGCTGTATCTGCAAATGAGCAGCCTGCGAGCCGAGGACACGGCTGTGTATTACTGTGCGAGAGATCTGAGTATGGGCGGTATGGACGTCTGGGGCCAAGGGACCACGGTCACCGTCTCCTCA |
| | | | SEQ ID NO: 28065 | SEQ ID NO: 32071 |
| | | AA | DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIK | QVQLVESGGGVVQPGRSLRLSCAASGFTFSSFGMHWVRQAPGKGLEWVAIIWHDASNKYYADAVKGRFTISRDNSKNTLYLQMSSLRAEDTAVYYCARDLSMGGMDVWGQGTTVTVSS |
| | | | SEQ ID NO: 28066 | SEQ ID NO: 32072 |

FIGURE 50
(Continued)

| | | | |
|---|---|---|---|
| iPS:446086 | 21-225_94D8 | NA | GACATCGTGTTGACCCAGTCGCCAGACTCCCTGGCTGTGTCTCTGGGCGAGAGGGCCACCATCAACTGCAAGTCCAGACAGAGTGTTTATACAGCTCCAACAATTACAACTACTTAACTGGTACCAGCAGAAACCAGGACAGCCTCCTAAGCTGCTCATTTACTGGGCATCTACCCGGGAATCCGGGGTCCCTGACCGATTCAGTGGCAGCGGGTCTGGGACAGATTTCACTCTCACCATCAGCAGCCTGCAGCTGAAGACGTGGCAGTTTATTACTGTCAGCAATATTATAGTTCTCCTCCTACTTTCGGCGGAGGGACCAAGGTGGAGATCAAA SEQ ID NO: 28067 | CAGGTGCAGCTGGTGCAGTCTGGGGCTGAGGTGAAGAAGCCTGGGGCCTCAGTGAAGGTCTCCTGCAAGACTTCTGGATACACCTTCACCAATTATGATATCAACTGGGTGCGACAGGCCACTGGACAAGGCTTGAGTGGATGGGATGGAACCCTAACAGTGGTAACACAGGCTATGACACAGAAGTTCCAGGTCAGAGTCACCATGACCAGGAACACCTCCATAAGCACAGCCTACATGGAGCTGAGCAGCCTGAGATCTGAGGACACGGCCGTCTATTACTGTGCGTATAGCAGTGGCTGGTACATCTTTGACTACTGGGGCCAGGGAACCCTGGTCACCGTCTCTTCA SEQ ID NO: 32073 |
| | | AA | DIVLTQSPDSLAVSLGERATINCKSRQSVLYSSNNYNYLTWYQQKPGQPPKLLIYWASTRESGVPDRFSGSGSGTDFTLTISSLQAEDVAVYYCQQYYSSPPTFGGGTKVEIK SEQ ID NO: 28068 | QVQLVQSGAEVKKPGASVKVSCKTSGYTFTNYDINWVRQATGQGLEWMGWMNPNSGNTGYAQKFQVRVTMTRNTSISTAYMEVSSLRSEDTAVYYCAYSSGWYIFDYWGQGTLVTVSS SEQ ID NO: 32074 |
| iPS:446094 | 21-225_77E1 | NA | GACATCGTGATGACCCAGTCTCCAGACTCCCTGGCTGTGTCTCTGGGCGAGAGGGCCACCATCAACTGCAAGTCCAGCCAGAGTGTCTTATACAGCTCCAACAATTATAACTACTTAGCTTGGTACCAGCAGAAACCAGGACAGCCACCCAAGCTCCTCATTTACTGGACATCTACCCGGGAATCCGGGGTCCCATGACCGATTCAGTGGCAGCGGGTCTGGGACAGATTTCACTCTCACCATCAGCAGCCTGCAGGCTGAAGATGTGGCAGTTTATTACTGTCACAATATCTTAGTAGTCCTCTGACGTTCGGCCAAGGGACCAAGGTGGAAATCAAA SEQ ID NO: 28069 | CAGGTGCAGCTGGTGCAGTCTGGGGCTGAGGTGAAGAAGCCTGGGGCCTCAGTGAAGGTCTCCTGCAAGGCTTCTGGATACACCTTCCCAATTATGATATCAACTGGGTGCGACAGGCCACTGGACAAGGCTTGAGTGGATGGGATGGAACCCTAACAGTGGTAACACAGGCTATGACACAGAAGTTCCAGGGCAGAGTCACCATGACCAGGAACACCTCCATAAGCACAGCCTACATGGAGCTGAGCAGCCTGAGATCTGAGGACACGGCCGTGTATTATTGTGCGGTTTCCAGTGGCTGGCACTGGTTCGACCCCTGGGGCCAGGGAACCCTGGTCACCGTCGCCTCA SEQ ID NO: 32075 |

FIGURE 50
(Continued)

| | | | |
|---|---|---|---|
| | | AA | DIVMTQSPDSLAVSLGERATINCKSSQTVLHSSN NYNYLAWYQQKPGQPPKVLIYWTSRESGVHD RFSGSGSGTDFTLTISSLQAEDVAVYYCHQYLSS PLTFGQGTKVEIK<br>SEQ ID NO: 28070 | QVQLVQSGAEVKKPGASVKVSCKASGYTFPNYDIN WVRQATGQGLEWMGWMNPNSGNTGYAQKFQGR VTMTRNTSISTAYMELSSLRSEDTAVYYCAVSSGW HWFDPWGQGTLVTVAS<br>SEQ ID NO: 32076 |
| iPS:448904 | 21-225_65C12 | NA | GAGATAGTGATGACGCAGTCTCCAGCCACCCT GTCTGTGTTTCCAGGGAAGGAGCCACCCTCT CCTGCAGGGCCAGTCAGTCAGAGTGTTAGCATCAAC CTAGCCTGGTACCAGCAGAAACCTGGCCAGGC TCCCAGACTCCTCATCTATGGTGCATCCACCA GGGCCACTGGTATCCCAGCCAGGTTCAATGCC AGTGGGTCTGGGACAGAGTTCACTCTCCAT CAGCAGCCTGCAGTCTGAAAATTTGCAGTT ATTACTGTCAGCAGTATAATACCTGGCCTCTC ACTTTCGGCGGAGGGACCAAGGTGGAAATCA AA<br>SEQ ID NO: 28071 | GAGGTGCAGCTGGTGGAGTCTGGGGGAGGCTG GTCAAGCCTGGGGGGTCCCTGAGACTCTCCTGTG CAGCCTCTGGATTCACCTTCAGGAGCTTTAGCTT GAACTGGGTCCGCCAGGCTCCAGGGAAGGGGCT GGAGTGGGTCTCATCCATTAGTAGTAGTAGTAGT TACATATACTACGCAGACTCAGTGAAGGGCCGAT TCACCATCTCCAGAGACAACGCCAAGAACTCACT GTATCTGCAAATGAACAGCTGAGAGCCGAGGA CACGGCTGTGTATTACTGTGCGAGAGATGCGTAT AGCCACTACTGGGGCCAGGGAACCCTGGTCACC GTCTCCTCA<br>SEQ ID NO: 32077 |
| | | AA | EIVMTQSPATLSVFPGEGATLSCRASQSVSINLA WYQQKPGQAPRLLIYGASTRATGIPARFNASGS GTEFTLSISSLQSENFAVYYCQQYNTWPLTFGGG TKVEIK<br>SEQ ID NO: 28072 | EVQLVESGGGLVKPGGSLRLSCAASGFTFRSFSLN WVRQAPGKGLEWVSSISSSSYIYYADSVKGRFTIS RDNAKNSLYLQMNSLRAEDTAVYYCARDAYSHY WGQGTLVTVSS<br>SEQ ID NO: 32078 |

FIGURE 50
(Continued)

| | | | |
|---|---|---|---|
| iPS:448906 | 21-225_72G9 | NA | GACATCCAGATGACCCAGTCTCCATCCTCCCT GTCTGCATCTGTAGGAGACAGAGTCACCATCA CTTGCCGGGCAAGTCAGAGCATTACCAGCTAT TTAAATTGGTATCAGCAGAAACCAGGGAAAG CCCCTAAGCTCCTGATCTATACTGCATCCAGT TGCAAAGTGGGGTCCCATCAAGGTTCAGTGGC AGTGGATCTGGGACAGATTTCACTCTCACCAT CAGCAGTCTGCAACCTGAAGAGTCACAGTT ACTACTGTCAACAGAGTCACAGTTTCCCATTC ACTTTCGGCCCTGGGACCAAAGTGGATATCAA A | GAGGTGCAGCTGGTGGAGTCTGGGGGAGGCCTG GTCAAGCCTGGGGGGTCCCTGAGACTCTCCTGTG CAGCCTCTGGATTCACCTTCAGTAGTTATAGCAT GAACTGGGTCCGCCAGGCTCCAGGGAAGGGGCT GGAGTGGGTCTCATCCATTAGTGGTAGTAGTAGT TACATATACTACGCAGACTCAGTGAAGGGCCGAT TCACCATCTCCAGAGACAACGCCAAGAACTCACT GTATCTGCAAATGAACAGCCTGAGAGCCGAGGA CACGGCTGTGTATTTCTGTGCGAGAGGGGTTCG AGGGGGTTGACCCCTGGGGCCAGGGAACCCTG GTCACCGTCTCCTCA |
| | | | SEQ ID NO: 28073 | SEQ ID NO: 32079 |
| | | AA | DIQMTQSPSSLSASVGDRVTITCRASQSITSYLN WYQQKPGKAPKLLIYTASSLQSGVPSRFSGSGSG TDFTLTISSLQPEDFATYYCQQSHSFPFTFGPGTK VDIK | EVQLVESGGGLVKPGGSLRLSCAASGFTFSSYSMN WVRQAPGKGLEWVSSISGSSSYIYADSVKGRFTIS RDNAKNSLYLQMNSLRAEDTAVYFCARGGSRGFD PWGQGTLVTVSS |
| | | | SEQ ID NO: 28074 | SEQ ID NO: 32080 |
| iPS:448908 | 21-225_50G9 | NA | TCCTATGAGCTGACTCAGCCACCCTCAGTGTC CGTGTCCCCAGGACAGACAGCCAGCATCACCT GCTCTGGAGATAAATTGGGGGATAAATATGCT TGCTGGTATCAGCAGAAGCCAGGCCAGTCCCC TGTGCTGGTCATCTATCAAGATAGCAAGCGGC CCTCAGGGATCCCTGAGCGATTCTCTGGCTCC AACTCTGGGAACACAGCCACTCTGACCATCAG CGGGACCCAGGCTAGGGATGAGGCTGAATATT ACTGTCAGGCGCGGAACAGCCCGCAGAGGGT ATTCGGCGGAGGGACCAGGCTGACCGTCCTA | CAGGTGCAGCTGGTGGAGTCTGGGGGAGGCGTG GTCCAGCCTGGGGAGGTCCCTGAGACTCTCCTGTG CAGCCTCCGGATTCATCTTCAGTAGCTATGGCAT GCACTGGGTCCGCCAGGCTCCAGGCAAGGGGCT GGAGTGGGTGGCAGTTATATCACAAGATGAATT ATTAGATACTATGCAGACACCCGTGAAGGGCCGAT TCACCATCTCCAGAGACAATTCCAAGAACACGCT GTATCTGCAAATGAACAGCCTGAGAGCTGAGGA CACGGCTGTGTATTACTGTGCGAGAGATGTGAAG CAGTGGCTGGTACGGACCTACCGGTCGTATGACGTCT GGGGCCAAGGGACCACGGTCACCGTCTCCTCA |
| | | | SEQ ID NO: 28075 | SEQ ID NO: 32081 |

FIGURE 50
(Continued)

| | | | |
|---|---|---|---|
| iPS:451102 | 21-225_45F6 | AA | SYELTQPPSVSVSPGQTASITCSGDKLGDKYACWYQQKPGQSPVLVIYQDSKRPSGIPERFSGSNSGNTATLTISGTQARDEAEYYCQARNSRRGVFGGGTRLTVL<br>SEQ ID NO: 28076 | QVQLVESGGGVVQPGRSLRLSCAASGFIFSSYGMHWVRQAPGKGLEWVAVISQDGIIRYYADSVKGRFTISRDNSKNTLYLQMNSLRAEDTAVYYCARDVKQWLVRTYGMDVWGQGTTVTVSS<br>SEQ ID NO: 32082 |
| | | NA | TCCTATGAGCTGACTCAGCCACCCTCAGTGTCCGTGTCCCCAGGACAGACAGCAGCATCACCTGCTCTGGAGATAAATTGGGGGATAAATATGCTTCCTGGTATCAGCAGAAGCCAGGCCAGTCCCCTGTGCTGGTCATCTATCAAGATAGTAAGCGGCCCTCAGGGATCCCTGAGCGATTCTCTGGCTCCAACTCTGGAAACACAGCCACTCTGACCATCAGCGGGACCCAGGCTATGGATGAGGCTGAGTATTACTGTCAGGCGCGGAACAGAACTATGTATTCGGCGGAGGGACCAAGCTGACCGTCCTA<br>SEQ ID NO: 28077 | CAGGTGCAGCTGGTGGAGTCTGGGGGAGGCGTGGTCCAGCCTGGGAGGTCCCTGAGACTCTCCTGTGCAGCCTCTGGATTCACCTTCAGTTACTATGGCTTGCACTGGGTCCGCCAGGCTCCAGGCAAGGGGCTGGAGTGGGTGGCAGTTATATCAGACTCCTGAAGGGAAGTAATAAATATTATGCAGACTCCGTGAAGGGCCGATTCACCATCTCCAGAGACAACAATTCCAAGAACACGCTGTATCTGCAAATGAACAACCTGAGAGCTGAGGACACGGCTGTGTTTTACTGTGCGAGAGAGATCGATATTGTAGTGGTACCAGCTGCCCTACTACTACTACGGTATGGACGTCTGGGGCCAAGGGACCACGGTCACCGTCTCCTCA<br>SEQ ID NO: 32083 |
| | | AA | SYELTQPPSVSVSPGQTASITCSGDKLGDKYASWYQQKPGQSPVLVIYQDSKRPSGIPERFSGSNSGNTATLTISGTQAMDEADYYCQAWDNRTMVFGGGTKLTVL<br>SEQ ID NO: 28078 | QVQLVESGGGVVQPGRSLRLSCAASGFTFSYYGLHWVRQAPGKGLEWVAVISYDGSNKYYADSVKGRFTISRDNSKNTLYLQMNNLRAEDTAVFYCAREDRYCSGTSCPYYYYYGMDVWGQGTTVTVSS<br>SEQ ID NO: 32084 |

FIGURE 50
(Continued)

| | | | |
|---|---|---|---|
| iPS:451104 | 21-225_49C5 | NA | CAGTCTGTGCTGACTCAGCCACCCTCAGCGTC TGGGACCCCGGGCAGAGGGTCACCATCTCT GTTCTGGAAGCAGCTCCAACATCGGAAGTAAT ATTGTGACTGGTACCAGCAGCTCCCAGGAAC GCCCCCAAACTCCTCATCTATAGTAATGATC AGCGGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTACAGCATGGGATGACAGCCTG AATGGTTGGGTGTTCGGCGGAGGGACCACGCT GACCGTCCTA SEQ ID NO: 28079 |
| | | AA | QSVLTQPPSASGTPGQRVTISCSGSSSNIGSNIVT WYQQLPGTAPKLLIYSNDQRPSGVPDRFSGSKS GTSASLAISGLQSEDEADYYCTAWDDSLNGWVF GGGTTLTVL SEQ ID NO: 28080 |
| | | NA | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGCTATGGTAT CAGCTGGGTGCGACAGGCCCCTGGACAAGGCT TGAGTGGATGGGATGGATCAGCGTTATAATGGT AACACAAAGTATGCACAGAAGCTCCAGGCAGA GTCACCATGACCACAGACACATCCACGAGCACA GCCTACATGGAGCTGAGGAGCCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTCA SEQ ID NO: 32085 |
| | | AA | QVQLVQSGAEVKKPGASVKVSCKASGYTFNSYGIS WVRQAPGQGLEWMGWISAYNGNTKYAQKLQGR VTMTTDTSTSTAYMELRSLRSDDTAVYYCARHDF WSGYYKGMDVWGQGTTVTVSS SEQ ID NO: 32086 |
| iPS:451106 | 21-225_49D10 | NA | CAGTCTGTGCTGACTCAGCCACCCTCAGCGTC TGGGACCCCGGGCAGAGGGTCACCATCTCTT GTTCTGGAAGCAGCTCCAACATCGGAAGTAAT ATTGTAACCTGGTACCAGCAGCTCCCAGGAAC GCCCCCAAACTCCTCATCTATAGTAATGATC AGCGGCCCTCAGGGGTCCCTGACCGATTCTCT GGCTCCAAGTCTGGCACCTCAGCTCCCTGGC CATCAGTGGGCTCCAGTCTGAGGATGAGGCTG ATTATTACTGTGCAGCATGGGATGACAGCCTG AATGGTTGGGTGTTCGGCGGAGGGACCACGCT GACCGTCCTA SEQ ID NO: 28081 | | | CAGGTTCAGCTGGTGCAGTCTGGAGCTGAGGTGA AGAAGCCTGGGGCCTCAGTGAAGGTCTCCTGCA AGGCTTCTGTTACACCTTTAACAGCTATGTAT CAGCTGGGTGCGACTGGCCCCTGGACAAGGGTTT GAGTGGATGGGATGGATCAGCGTTATAATGGTA ACACAAAGAATGCACAGAAGCTCCAGGCAGAG TCACCATGACCACAGACACATCCACGAGCACAG CCTACATGGAGCTGAGGAGCCTGAGATCTGACG ACACGGCCGTGTTTATTACTGTGCGAGACACGATTT TGGAGTGGTTATTATAAGGGTATGGACGTCTGG GGCCAAGGGACCACGGTCACCGTCTCCTCA SEQ ID NO: 32087 |

FIGURE 50
(Continued)

| | | | | |
|---|---|---|---|---|
| | | AA | QSVLTQPPSASGTPGQRVTISCSGSNSNIGSNIVT WYQQLPGTAPKLLIYSNDQRPSGVPDRFSGSKS GTSASLAISGLQSEDEADYYCAAWDDSLNGWV FGGGTTLTVL<br>SEQ ID NO: 28082 | QVQLVQSGAEVKKPGASVKVSCKASGYTFNSYGIS WVRLAPGQGFEWMGWISAYNGNTKNAQKLQGRV TMTDTSTSTAYMELRSLRSDDTAVYYCARHDFW SGYYKGMDVWGQGTTVTVSS<br>SEQ ID NO: 32088 |
| iPS:451108 | 21-225_53E8 | NA | CAGTCTGTGCTGACTCAGCCACCCTCAGCGTC TGGGACCCCGGGCAGAGGGTCACCATCTCTT GTTCTGGAAGCTGCTCCAACATCGAAGTAAT ATTGTGACCTGGTACCAGCAGCTCCCAGGAAC GGCCCCCAAACTCCTCATCTATAGTAATGATC AGCGGCCCTCAGGGGTCCCTGACCGATTCTCT GGCTCCAAGTCTGGCACCTCAGCCTCCCTGGC CATCAGTGGGCTCCAGTCTGAGGATGAGGCTG ATTATTACTGTACAGCATGGGATGACAGCCTG AATGATTGGGTGTTCGGCGGAGGGACCACGCT GACCGTCCTA<br>SEQ ID NO: 28083 | CAGGTTCAGCTGGTGCAGTCTGGAGCTGAGGTGA AGAAGCCTGGGGCCTCAGTGAAGGTCTCCTGCA AGGCTTCTGGTTACACCTTTAACAGCTATGGTAT CAGCTGGGTGCGACAGGCCCCTGGACAAGGCT TGAGTGGATGGGATGGATCAGCGCTTATAATGGT AACACAAAGTTTGCACAGAAGCTCCAGGGCAGA GTCACCATGACCACAGACACATCCACGAGCACA GCCTACATGGAACTGAGGAGCCTGAGATCTGAC GACACGGCCGTGTATTACTGTGCGAGACACGATT TTTGGAGTGGTTATTATAAGGGTATGGACGTCTG GGGCCAAGGGACCACGGTCACCGTCTCCTCA<br>SEQ ID NO: 32089 |
| | | AA | QSVLTQPPSASGTPGQRVTISCSGSGSCSNIGSNIVT WYQQLPGTAPKLLIYSNDQRPSGVPDRFSGSKS GTSASLAISGLQSEDEADYYCTAWDDSLNDWVF GGGTTLTVL<br>SEQ ID NO: 28084 | QVQLVQSGAEVKKPGASVKVSCKASGYTFNSYGIS WVRQAPGQGLEWMGWISAYNGNTKFAQKLQGRV TMTDTSTSTAYMELRSLRSDDTAVYYCARHDFW SGYYKGMDVWGQGTTVTVSS<br>SEQ ID NO: 32090 |

FIGURE 50
(Continued)

| | | | |
|---|---|---|---|
| iPS:451110 | 21-225_74C9 | NA | TCTTATGAGCTGACTCAGCCACCCTCAGAGTC TGTGTCCCCAGGACAGACAGCCAGCATCACCT GCTCAGGAGATAAATTGGGGAAGCCAGGCCAGTCAAGGCCAGTCAAAATATGTT TCCTGGTATCAGCAGAAGCCAGGCCAGTCCCC TGTGCTGGTCATCTATCAAGATAACAGGCGGC CGTCAGGGATCCCTGAGCGATTTCTGGCTCC AACTCTGGGAACAGCCACTTTGACCATCAG CGGGACCCAGGCTATGGATGAGGCTGACTATT ACTGTCAGGCGTGGGACAGCACCCTGTGATA TTCGGCGGAGGGACCAAGCTGACCGTCCTA | CAGGTGCAGCTGGTGGAGTCTGGGGAGGCGTG GTCCAGCCTGGGAGGTCCCTGAGACTCTCCTGTG CAGCGTCTGGATTCACCTTCAGTGCTATGGCAT GCACTGGGTCCGCCAGGCTCCAGGCAAGGGCT GGAGTGGGTGGCAGTTATATGTGGTATGAAAT AATAAATCCTATGCAGACTCCGTGAAGGGCCGAT TCACCATCTCCAGAGACATTTCCAAAAACACGCT GTATCTGCAAATGAACAGCTGAGAGCCGAGGA CACGGCTGTGTATTACTGTGCGAGGATCGAGAT TATTGTAGTAGTACCAGCTGCCCTTATTACTA CTACGGTATGGACGTCTGGGGCCAAGGGACCAC GGTCACCGTCTCCTCA |
| | | | SEQ ID NO: 28085 |
| | | | SEQ ID NO: 32091 |
| | | AA | SYELTQPPSESVSPGQTASITCSGDKSGNKYVSW YQQKPGQSPVLVIYQDNRRPSGIPERFSGSNSGS TATLTISGTQAMDEADYYCQAWDSTPVIFGGGT KLTVL | QVQLVESGGGVVQPGRSLRLSCAASGFTFSSYGMH WVRQAPGKGLEWVAVIWYDGNNKSYADSVKGRF TISRDISKNTLYLQMNSLRAEDTAVYYCARDRDYC SSTSCPYYYYYGMDVWGQGTTVTVSS |
| | | | SEQ ID NO: 28086 |
| | | | SEQ ID NO: 32092 |
| iPS:451112 | 21-225_53D10 | NA | TCCTATGAGCTGACTCAGCCACCCTCAGTGTC CGTGTCCCCAGGACAGACAGCCAGCATCACCT GCTCTGGAGATAAATTGGGGAAGCCAGGCCAGTCAAAATATGCT TGCTGGTATCAGCAGAGGCCAGGCCAGTCCCC TGTGCTGGTCATCTATCAAGATCGCAAGCGGC CCTCAGGGATCCCTGAGCGATTCTCTGGCTCC AACTCTGGGAACACAGCCACTCTGACCATCAG CGGGACCCAGGCTATGGATGAGGCTGACTATT ACTGTCAGGCGTGGGACAGCAGCACTGTGGTA TTCGGCGGAGGGACCAAGCTGACCGTCCTA | CAGGTGCAGTTGGTGCAGTCTGGGGCTGAGGTGA AGAAGCCTGGGGCCTCAGTGAAGGTCTCCTGCA AGGCTTCTGGATACATTTTCACCGGCTACTATAT ACACTGGGTGCGACAGGCCCCTGGACAAGGGCT TGAGTGGATGGGATGGATCAACCCTAACAGTGGT GGCACAAACTATGCACAGAAGTTTCAGGGCAGG GTCACCATGACCAGGGACACGTCCATCAGCACA GCCTACATGGAGCTGATCAGGCTGAGATCTGACG ACACGGCCGTGTATTATTGTGCGAGAGAAAACG AAAGTCTAGCAACTCGTCTTTCTACGACTACTA CGGTATGGACGTCTGGGGCCAAGGGACCACGGT CACCGTCTCCTCA |

FIGURE 50
(Continued)

| | | | |
|---|---|---|---|
| | | SEQ ID NO: 28087 | SEQ ID NO: 32093 |
| | | AA | SYELTQPPSVSVSPGQTASITCSGDKLGNKYACW YQQRPGQSPVLVIYQDRKRPSGIPERFSGSNSGN TATLTISGTQAMDEADYYCQAWDSSTVFGGG TKLTVL | QVQLVQSGAEVKKPGASVKVSCKASGYIFTGYYIH WVRQAPGQGLEWMGWINPNSGGTNYAQKFQGRV TMTRDTSISTAYMELIRLRSDDTAVYYCARENESLA TRPFYDYGMDVWGQGTTVTSS |
| | | SEQ ID NO: 28088 | SEQ ID NO: 32094 |
| iPS:451114 | 21-225_159A3 | NA | GACATCCAGATGACCCAGTCTCCATCCCCT GTCTGCATCTGTAGGAGACAGAGTCACCATCA CTTGCCCGGGCAAGTCAGGACATTAGAAAGGAT TTAGGCTGGTATCAGCAGAAACCAGGGAAAG CCCCTAACCGCCTGATCTATGCTGCATCCAGTT TGCAAAGTGGGGTCCCATCAAGGTTCAGCGGC AGTGGATCTGGGACAGAATTCACTCTCACATT CAGCAGCCTGCAGCCTGAAGATTTTGCAACTT ATTACTGTCTACAGCATCATAGTTATCCTCGG ACGTTCGGCCAAGGGACCAAGGTGGAAATCA AA | CAGGTGCAGCTGGTGGAGTCTGGGGGAGGCGTG GTCCAGCCTGGGAGGTCCCTGAGACTCTCCTGTG CAGCGTCTGGATTCACCTTTAGTGACTATGTCAT GCAGTGGGTCCGCCAGGCTCCAGGCAAGGGCT GGAGTGGGTGGCAGTTATATGTATGATGGAAGT AATAAATACTATGCAGACTCCGTGAAGGGCCGA TTCACCATCTCCAGAGACAATGAACAGCCTGAGAGCCGAGG TGTATCTGCAAATGAACAGCCTGAGAGCCGAGG ACACGGCTGTGTATTACTGTGCGAGAGAACCGTA TAATAGTGGCTGGTACGACTACGGTATGGACGTC TGGGGCCAAGGGACCACGGTCACCGTCTCCTCA |
| | | SEQ ID NO: 28089 | SEQ ID NO: 32095 |
| | | AA | DIQMTQSPSSLSASVGDRVTITCRASQDIRKDLG WYQQKPGKAPNRLIYAASSLQSGVPSRFSGSGS GTEFTLTFSSLQPEDFATYYCLQHHSYPRTFGQG TKVEIK | QVQLVESGGGVVQPGRSLRLSCAASGFTFSDYVM QWVRQAPGKGLEWVAVIWYDGSNKYYADSVKGR FTISRDISKNTLYLQMNSLRAEDTAVYYCAREPYNS GWYDYGMDVWGQGTTVTVSS |
| | | SEQ ID NO: 28090 | SEQ ID NO: 32096 |

FIGURE 50
(Continued)

| | | | | |
|---|---|---|---|---|
| iPS:451116 | 21-225_164A4 | NA | GACATCGTGATGACCCAGTATCCAGACTCCG GGCTGTGTCTCTGGGCGAGAGGGCCACCATCA AGTGCAAGTCCAGCCAGAGTGTTTATACAGC TCCAACAATAAGAACTACTTAACTGGTACCA GCAGAAACCAGGACAGCCTCCCAAACTGTTCA TTTACTGGGCATCTACCCGGGAATCCGGGGTT CCTGACCGATTCAGTGGCAGCGGGTGTGGGAC AGATTTCACTCTCACCATCAGCAGCGTGCAGG CCGAAGATGTGGCAGTTTATTACTGTCAGCAA TATTTTAGTACTCCGTGACGTTCGGCCAAGG GACCAAGGTGGAAATCAAA | CAGGTGCAGCTGGTGCAGTCTGGGGCTGAGGTG AAGAAGCCTGGGGCCTCAGTGAAGGTCCTGC AAGGCTTCTGGATTCACCTTCCCAATTATGATA TCAACTGGGTGCGACAGGCCACTGGACAAGCC TTGAGTGGATGGATGGACACCTAACAGTGG TAACACAGGCTATGCACAGAAGTTCCAGGCAG AGTCACCATGACCAGGAACACCTCCATAAGCAC AGCCTACATGGAGCTGAGCAGCCTGAGATCTGA GGACACGGCCGTGTATTACTGTGCGAGTAGCAGT GGCTGGTACTTCTTTGACTACTGGGGCCAGGGAA CCCTGGTCACCGTCTCCTCA |
| | | | SEQ ID NO: 28091 | SEQ ID NO: 32097 |
| | | AA | DIVMTQYPDSRAVSLGERATIKCKSSQSVLYSSN NKNYLTWYQQKPGQPPKLFIYWASTRESGVPDR FSGSGCGTDFTLTISSVQAEDVAVYYCQQYFSTP WTFGQGTKVEIK | QVQLVQSGAEVKKPGASVKVSCKASGFTFPNYDIN WVRQATGQGLEWMGWMHPNSGNTGYAQKFQGR VTMTRNTSISTAYMELSSLRSEDTAVYYCASSSGW YFFDYWGQGTLVTVSS |
| | | | SEQ ID NO: 28092 | SEQ ID NO: 32098 |
| iPS:451118 | 21-225_191C8 | NA | GAAATAGTGATGACCCAGTCTCCAGCCACCCT GTCTGTGTCTCTCAGGGGAAAGAGCCACCCTCT CCTGCAGGGCCAGTCAGAGTGTTCGCAGTAAC TTAGCCTGGTACCAGCAGGAACCTGGCCAGGC TCCCAGGCTCCTCATCTATGGTGCATCCACCA GGGCCACTGGTATCCCAGCCAGGTTCAGTGGC AGTGGGTCTGGGACAGAGAATTCACTCTCACCAT CAGCAGCCTGCAGTCTGAAGATTTTGCAGTTT ATTACTGTCAGCAGTAGTTTACCTGGCTCGGA CGTTCGGCCAAGGGACCAAGGTGGAAATCAA A | CAGGTGCAGCTGCAGGAGTCGGGCCCAGGACTG GTGAAGCCTTCGGAGACCCTGTCCCTCACCTGCA CTGTCTCTAGTGGCTCCGTCAGCAGTGGTGGTTA CTACTGGAGCTGGATCCGGCAGCCCCCAGGGAA GGGACTGGAGTGGATTGGGTATATCTATTACAGT GGGACCACCATTTACAACCCCTCCCTCAAGAGTC GAGTCACCATATCAGTAGCTGACACGTCCAAGAACC AGTTCTCCCTGAAGCTGACCTCTGTGACGCCGTTGC GGACACGGCCGTGTATTACTGTGCGGAGACAC GTTTTGCTTTGATGGTGTGGTATTCTTTGACT CCTGGGGCCAGGGAACCCTGGTCACCGTCTCCTC A |
| | | | SEQ ID NO: 28093 | SEQ ID NO: 32099 |

FIGURE 50
(Continued)

| | | | | |
|---|---|---|---|---|
| iPS:451120 | 21-225_197D3 | AA | EIVMTQSPATLSVSPGERATLSCRASQSVRSNLA WYQQEPGQAPRLLIYGASTRATGIPARFSGSGSG TEFTLTISSLQSEDFAVYYCQQSFTWLRTFGQGT KVEIK<br>SEQ ID NO: 28094 | QVQLQESGPGLVKPSETLSLTCTVSSGSVSSGYY WSWIRQPPGKGLEWIGYIYYSGTTYNPSLKSRVTIS VDTSKNQFSLKLTSVTVADTAVYYCARDTFCFDGC GYFFDSWGQGTLVTVSS<br>SEQ ID NO: 32100 |
| | | NA | GACATCCAGATGACCCAGTCTCCATCCTCACT GTCTGCATCTGTAGGAGACAGAGTCACCATCA CTTGTCGGGCGAGTCAGGGCATTAGAAATTAT TTAGCCTGGTTTCAGCAGAAACCAGGGAAAGC CCCTAAGTCCCTGATCTATGCTGCATCCAGTTT GCAAAGTGGGGTCCCTCAAAGTTCAGCGGCA GTGGATCTGGGACAGATTTCACTCTCACCATC AGCAGCCTGCAGCCTGAAGATTTTGCAACTTA TTACTGCCAACATTATCTTACTCCGCTCAC TTTCGGGGAGGGACCAAGGTGGAGATCAAA<br>SEQ ID NO: 28095 | CAGGTGCAGCTGGTGGAGTCTGGGGGAGGCGTG GTCCAGCCTGGGAGGTCCCTGAGACTCTCCTGTG CAGCGTCTGGATTCATCTTCAGTAGCCATGCAT GCACTGGGTCCGCCAGGCTCCAGGCAAGGGGCT GGAGTGGGTGGCAGTTATATGCAGACTCCGTGAAGGGCCGA AATGAACACTATGCAGACTCCGTGAAGGGCCGA TTCACCATCTCCAGAGACAACAATTCCAAGAACACGC TGTATCTGCAAATGAACAGCCTGAGAGCCGAGG ACACGGCTGTTTATTACTGTGCGAGAGATCAAGG TGTGGGGTACTACGGTATGGACGTCTGGGGCCAA GGGACCACGGTCACCGTCTCCTCA<br>SEQ ID NO: 32101 |
| | | AA | DIQMTQSPSSLSASVGDRVTITCRASQGIRNYLA WFQQKPGKAPKSLIYAASSLQSGVPSKFSGSGSG TDFTLTISSLQPEDFATYYCQHYLTYPLTFGGGT KVEIK<br>SEQ ID NO: 28096 | QVQLVESGGGVVQPGRSLRLSCAASGFIFSSHGMH WVRQAPGKGLEWVAVIWYDGSNEHYADSVKGRF TISRDNSKNTLYLQMNSLRAEDTAVYYCARDQGV GYYGMDVWGQGTTVTVSS<br>SEQ ID NO: 32102 |

FIGURE 50
(Continued)

| | | | | |
|---|---|---|---|---|
| iPS:451122 | 21-225_200A1 | NA | GAAATTGTGTTGTTGACGCAGTCTCCAGGCATCCT GTCTTTGTATCCAGGGGAAAGAGCCACCCTCT CCTGTAGGGCCAGTCAGAGTGTTAACAGCAAC TATTTAGCCTGGTACCAGCAGAGACCTGGCCA GGCTCCCAGTCTCCTCATTTATGGGCATCA GCAGGGCCACTTGCATCCTGACAGGTTCAGT GGCAGTGGGTGTGGGACAGACTTCACTCTCAC GATCAGCAGACTGGAGCTGAAGATTTTGCAG TGTATTGCTGTCAGCAGTATGAGATCTCACCG TGGACGTTCGGCCAAGGGACCAAGGTGGAAA GCAAA<br><br>SEQ ID NO: 28097 | CAGGTGCAGTCAGCAGGGGGCAGGACTG TTGAAGCCTTCGGAGACCCTGTCCCTCACCTGCG CTGTCTATGGTGGGTCTTCAGTGTTTACTATTGG AGCTGGATCCGCCAGCCCCAGGGAAGGGGCTG GAGTGGATTGGGGAAATCAATCATAGTGGAAGC ACCAACTACAACCGTCCCTCAAGAGTCGAGTCA CCATTTCACTAGACACGTCAAGAACCAGTTCTC CCTGAAGCTGAGCTCTGTGACCGCCGCGACACG GCTGTGTATTACTGTGCGAGAGACTACGGTGTCT TTGACTACTGGGGCCAGGGAACCCTGGTCACCGT CTCCTCA<br><br>SEQ ID NO: 32103 |
| | | AA | EIVLTQSPGILSLYPGERATLSCRASQSVNSNYLA WYQQRPGQAPSLLIYGASSRATGILDRFSGSGCG TDFTLTISRLEPEDFAVYCCQQYEISPWTFGQGT KVESK<br><br>SEQ ID NO: 28098 | QVQLQQWGAGLLKPSETLSLTCAVYGGSFSVYYW SWIRQPPGKGLEWIGEINHSGSTNYNPSLKSRVTISL DTSKNQFSLKLSSVTAADTAVYYCARDYGVFDYW GQGTLVTVSS<br><br>SEQ ID NO: 32104 |
| iPS:451124 | 21-225_74F6 | NA | GACATCGTGATGACCCAGTCTCCAGACTCCCT GGCTGTGTCTCTGGGCGAGAGGGCCACCATCA ATTGCAAGTCCAGTCAGAATATTTATCCAGC TCCAACAATAAGAACTACTTAACTTGGTACCA GCAGAAACCAGGACAGCCTCCTAAAATACTCA TTTACTGGACATCTACCCGGGAATCCGGGGTC CCTGACCGATTCAGTGGCAGCGGGTTTGGGAC AGATTTCACTCTCACCATCAGCAGCCTGCAGG CTGAAGATGTGGCTGTGTTATTACTGTCAGCAA TATTTTAGTGTTCCTCGACGTTCGGCCAAGGG ACCAAGGTGGAAATCAAA<br><br>SEQ ID NO: 28099 | CAGGTGCAGCTGGTGCAGTCTGGGGCTGAGGTG AAGAAACCTGGGGCCTCAGTGAGGGTCTCCTGC AAGGCTTCTGGATACACCTTCACCAATTATGATA TCAACTGGGTGCGACAGGCCACTGGACAAGGGC TTGAGTGGATGGATGGATGCACCTAACAGTGG TAACACAGGCTATGCACAGAAGTTCCAGGGCAG AGTCACCATGACCAGGAACACCTCCATGAGCAC AGCCTACATGGAGCTGAGCAGCCTGAGATCTGA GGACACGGCCGTGTATTACTGTGCCATAGCAGT GGCTGGTACTTTTTGACTACTGGGGCCAGGGAA CCCTGGTCACCGTCTCCTCA<br><br>SEQ ID NO: 32105 |

FIGURE 50
(Continued)

| | | | |
|---|---|---|---|
| | | AA | DIVMTQSPDSLAVSLGERATINCKSSQNILSSSNN KNYLTWYQQKPGQPPKILIYWTSTRESGVPDRFS GSGFGTDFTLTISSLQAEDVAVYYCQQYFSVPLT FGQGTKVEIK | QVQLVQSGAEVKKPGASVRVSCKASGYTFTNYDIN WVRQATGQGLEWMGWMHPNSGNTGYAQKFQGR VTMTRNTSMSTAYMELSSLRSEDTAVYYCAHSSG WYFFDYWGQGTLVTVSS |
| | | | SEQ ID NO: 28100 | SEQ ID NO: 32106 |
| iPS:451127 | 21-225_164A7 | NA | GACATCGTGATGACCCAGTCTCCAGACTCCCT GGCTGTGTCTCTGGGCGAGAGGGCCACCATCA ATTGCAAGTCCAGCCAGAGTGTTTACACAGC TCCAACAATAACAACTACTTAGCTTGGTACCA GCAGAAACCAGGACAGCCTCATAAGTTGCTCA TTTACTGGACATCTACCCGGGAATCCGGGGTC CCTGACCGATTCAGTGGCAGCGGGTATGGGAC AGATTTCTCTCACCATCGCCAGCCTGCAGG CTGAAGATGTGGCAGTTTATTACTGTCAGCAA TATTATAGTATTCCTGACGTTCGGCCAAGG GACCAAGGTGGAAATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAATTATGATG TCAACTGGGTGCGACAGGCCACTGGACAAGGC TTGAGTGGATGGGATGGATGCACCTAACAGTGG TAACACAGGCTATGCACAGAAGTTCCAGGGCAG AGTCACCATGACCAGGAACACCTCCACAAGCAC AGCCTACATGGAGCTGAGCAGCCTGAGATCTGA GGACTCGGCCGTGTATTACTGTGCGAGTAGCAGT GGCTGGTACCTCTTTGACTACTGGGGCCAGGGAA CCCTGGTCACCGTCTCCTCA |
| | | | SEQ ID NO: 28101 | SEQ ID NO: 32107 |
| | | AA | DIVMTQCPDSLAVSLGERATINCKSSQSVLHSSN NNNYLAWYQQKPGQPHKLLIYWTSTRESGVPD RFSGSGYGTDFSLTIASLQAEDVAVYYCQQYYSI PLTFGQGTKVEIK | QVQLVQSGAEVKKPGASVKVSCKASGYTFTNYDV NWVRQATGQGLEWMGWMHPNSGNTGYAQKFQG RVTMTRNTSTSTAYMELSSLRSEDSAVYYCASSSG WYLFDYWGQGTLVTVSS |
| | | | SEQ ID NO: 28102 | SEQ ID NO: 32108 |

FIGURE 50
(Continued)

| | | | |
|---|---|---|---|
| iPS:451129 | 21-225_94D2 | NA | GACATCGTGATGACCCAGTCTCCAGACTCCCT GGCTGTGTCTCTGGGCGAGAGGGCCACCATCA ACTGCAAGTCCAGCAGTGTTTTACACAGC TCCAACAATAAGAACTACTTAACTTGGTACCA GCAGAAACCAGGACAGCCTCATAAGCTGCTCA TTTACTGGGCATCTACTCGGGAATCCGGGGTC CCTGACCGATTCAGCGGCAGCGGGTCTGGGAC AGATTTCAGTCTCACGATCGGCAGCCTGCAGC ATGAAGATGTGGCAGTTTATTACTGTCAGCAA TATCATAGTATTCCTCGACGTTGGCCACGG GACCAAGGTGGAAATCAAA  SEQ ID NO: 28103 | CAGGTGCAGCTGGTGCAGTCTGGGGCTGAGGTG AAGAAGCCTGGGGCCTCAGTGAAGGTCTCCTGC AAGGCTTCTGGATTCACCTTCACCTTATGATA TCAACTGGGTGCGACAGGCCACTGGACAAGGC TTGAGTGGATGGGATGGATGCACCTAACAGTGG TAACACAGGCTTTGCACAGAAGTTCCAGGCAG AGTCACAATGACCAGGAACACTCCATAAGCAC AGCCTACATGAACTGAGCAGCCTGAGATCTGA GGACACGGCCGTGTATTACTGTGCGGTTCCAGT GGCTGGTACTGGTTGACCCCTGGGGCCAGGGA ACCCTGGTCACCGTCTCCTCA  SEQ ID NO: 32109 |
| | | AA | DIVMTQSPDSLAVSLGERATINCKSSQSVLHSSN NKNYLTWYQQKPGQPHKLLIYWASTRESGVPD RFSGSGSGTDFSLTIGSLQHEDVAVYYCQQYHSI PPTFGHGTKVEIK  SEQ ID NO: 28104 | QVQLVQSGAEVKKPGASVKVSCKASGFTFTNYDIN WVRQATGQGLEWMGWMHPNSGNTGFAQKFQGR VTMTRNTSISTAYMELSSLRSEDTAVYYCAVSSGW YWFDPWGQGTLVTVSS  SEQ ID NO: 32110 |
| iPS:451131 | 21-225_160A7 | NA | GACATCGTGCTGACCCAGTCTCCAGACTCCCC GGCTGTGTCTCTGGGCGAGAGGGCCACCATCA ATTGCAAGTCCAGCAGCAGTGTTTATCCAAC TCCCACAATAACAACTACTTAGCTTGGTACCA GCAGAGACCAGGACATCCTCCAAAACTTCCTCA TTTTCTGGGCATCTACCCGGGAATCCGGGGTC CCTGACCGATTCAGTGGCAGCGGGTATGGGAC AGTCACCATGACCAGGAACACTCCATAAACAC AGCCTACATGAGCTGAGCAGCCTGAGATCTGA CTGAAGATGTGGCAGTTTATTACTGTCAGCAA TATTATAGTACTCCGTGCAGTTTGGCCAGGG GACCAAGCTGGAGATCAAA  SEQ ID NO: 28105 | CAGGTGCAGCTGGTGCAGTCTGGGGCTGAAGTG AAGAAGCCTGGGGCCTCAGTGAAGGTCTCCTGC AAGGCTTCTGGATACACCTTCACCAATTATGATA TCAACTGGGTGCGACAGGCCACTGGACAAGGC TTGAGTGGATGGGATGGATGCACAGAAGTTCCAGGCAG TAACACAGGCTATGCACAGAAGTTCCAGGCAG AGTCACCATGACCAGGAACACCTCCATAAACAC AGCCTACATGAGCTGAGCAGCCTGAGATCTGA GGACACGGCCGTGTATTACTGTGCCCATAGCAGT GGCTGGTACTACTTTGACTACTGGGGCCAGGGAA CCCTGGTCACCGTCTCCTCA  SEQ ID NO: 32111 |

FIGURE 50
(Continued)

| | | | | |
|---|---|---|---|---|
| iPS:451133 | 21-225_95H4 | AA | DIVLTQSPDSPAVSLGERATINCKSSQSVLSNSHN NNYLAWYQQRPGHPHKLLIFWASTRESGVPDRF SGSGYGTDFTLTISSLQAEDVAVYYCQQYYSTPC SFGQGTKLEIK<br>SEQ ID NO: 28106 | QVQLVQSGAEVKKPGASVKVSCKASGYTFTNYDIN WVRQATGQGLEWMGWMHPHSGNTGYAQKFQGR VTMTRNTSINTAYMELSSLRSEDTAVYYCAHSSGW YYFDYWGQGTLVTVSS<br>SEQ ID NO: 32112 |
| | | NA | GACATCGTTATGACCCAGTCTCCAGACTCCCCT GGCTGTGTCTCTGGGCGAGAGGGCCACCATCA ATTGCAAGTCCAGCCAGAGTGTTTATTCAGC TCCAACAATTATATAATTACTTAGCTTGGTACCA GCAGAGACCAGGACAGCCTCATAACCTGCTCA TTTACTGGGCATCTACCCGGGAATCCGGGGTC CCTGACCGATTCAGTGGCAGCGGGTCTGGGAC AGATTTCACTCTCACCATCAGCAGCCTGCAGG CTGCTGATGTGGCAGTTTATTACTGTCAGCAA TATCATAGTTCTCCTGACGTTCGGCCAAGG GACCACGGTGCAAATCAAA<br>SEQ ID NO: 28107 | CAGGTGCAGTTGGTGCAGTCTGGGGCTGAGGTGA AGAAGCCTGGGGCCTCAGTGAAGGTCTCCTGCA AGGCTTCTGGATACACCTTCACCAATTATGATAT CAACTGGGTGCGACAGGCCACTGGACAAGGGCT TGAGTGGATGGGATGGATGCACAGAAGTTCCAGGGCAG TAACACAGGCTATGCACAGAACACCTCCATCAACGCAC AGTCCACCATGACCAGGAACACCTCCACAAGCAC AGCCCACATGGAGCTGAGCAGCCTGAGATCTGA GGACACGGCCGTGTATTACTGTGCGGTCTCCAGT GGCTGGAACTGGTTCGACCCCTGGGGCCAGGGA ACCCTGGTCACCGTCTCCTCA<br>SEQ ID NO: 32113 | |
| | | AA | DIVMTQCPDSLAVSLGERATINCKSSQSVLFSSN NYNYLAWYQQRPGQPHNLLIYWASTRESGVPD RFSGSGSGTDFTLTISSLQAADVAVYYCQQYHSS PLTFGQGTTVQIK<br>SEQ ID NO: 28108 | QVQLVQSGAEVKKPGASVKVSCKASGYTFTNYDIN WVRQATGQGLEWMGWMNPNSGNTGYAQKFQGR VTMTRNTSTSTAHMELSSLRSEDTAVYYCAVSSGW NWFDPWGQGTLVTVSS<br>SEQ ID NO: 32114 | |

FIGURE 50
(Continued)

| iPS:437240 | 21-225_84H12 | NA | GACATCCAGATGACCCAGTCTCCATCCTACCA GTCTGCATCTGTGGGAGACAGAGTCACCATCA CTTGCCGGCAAGTCAGGCATTAGAAATGAT TTAGGCTGGTTCAGCAGAAACCAGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTTTACAGCATAATGATTACCATTCAC TTTCGGCCCTGGGACCAAAGTGGATATCAAA | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGCTGAACCTCACAGTGG TAACACAGGCTATGCACAGAAGTTCCAGGGCAG AATCACCATGACCTGAACACCTCCATACGCACT GCCTACATGGAGCTGAGCAGCCTGAGATCTGAG GACACGGCCGTGTATTACTGTGCGAGAGGGTTTT ACGATATTTTGACTGGTTATTCCCCACCTACTAC TACTACGATATGGACGTCTGGGGCCAAGGGACC ACGGTCACCGTCTCCTCA |
|  |  |  | SEQ ID NO: 28109 | SEQ ID NO: 32115 |
|  |  | AA | DIQMTQSPSYQSASVGDRVTITCRASQGIRNDLG WFQQKPGKAPKRLIYAASSLQSGVPSRFSGSGSG TEFTLTISSLQPEDFATYYCLQHNDYPFTFGPGTK VDIK | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYYDMDVWGQGTTVTVSS |
|  |  |  | SEQ ID NO: 28110 | SEQ ID NO: 32116 |

FIGURE 50
(Continued)

| | | | |
|---|---|---|---|
| iPS:434577 | 21-225_75C11 | NA | GACATCCAGATGACCCAGTCTCCATCCTCCT GTCTGCATCTGTGGGAGACAGAGTCACCATCA CTTGCCGGGCAAGTCAGGGCATTAGAAATGAT TTAGGCTGGTTTCAGCAGAAACCAGGAAAGC CCCTAAGCGCCTGATCTATGCTGCATCCAGTTT GCAAAGTGGGGTCCCATCAAGGTTCAGCGGCA GTGGATCTGGGACAGAATTCACTCTCACAATC AGCAGCCTGCAGCCTGAAGATTTTGCAACTTA TTACTGTCTACAGCATATTGACTTACCATTCAC TTTCGGCCCTGGGACCAAAGTGGATATCAAA<br><br>SEQ ID NO: 28111 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGCTGAACCCTCACAGTGG TAACACAGGCTATGCACAGAAGTTCCAGGGCAG AATCACCATGACCTGAACACCTCCATACGCACT GCCTACATGGAGCTGAGCAGCCTGAGATCTGAG GACACGGCCGTGTATTACTGTGCGAGAGGTTTT GACACGATATTTTGACTGGTTATTCCCCACTACTAC TACTACGATATGGACGTCTGGGGCCAAGGGACC ACGGTCACCGTCTCCTCA<br><br>SEQ ID NO: 32117 |
| | | AA | DIQMTQSPSSLSASVGDRVTITCRASQGIRNDLG WFQQKPGKAPKRLIYAASSLQSGVPSRFSGSGSG TEFTLTISSLQPEDFATYYCLQHNDYPFTFGPGTK VDIK<br><br>SEQ ID NO: 28112 | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYYDMDVWGQGITVTVSS<br><br>SEQ ID NO: 32118 |

FIGURE 50
(Continued)

| | | | | |
|---|---|---|---|---|
| iPS:435477 | 21-225_154E8 | NA | GACATCCAGATGACCCAGTCTCCATCTTCCGT GTCTGCATCTATAGAGACAGAGTCACCATCA CTTGTCGGGCGAGTCAGTTATTAGCAGCTGG TTAGCCTGCTGGTATCAGCAGAAACCAGGGAAAG CCCCTAAGTCCCTGATCTATACTGCATCCAGTT TGCAAAGTGGGGGTCCCATCAAGGTTCAGCGGC AGTGGATCTGGGACAGATTTCACTCTCACCAT CAGCAGCCTGCAGCCTGAAGATTTTGCAACTT ACTGTTGTCAACAGGCTAACAGTTTCCCGTGG ACGTTCGGCCAAGGGACCAAGGTGGAATTCA AC | GAGGTGCAGCTGTTGGAGTCTGGGGAGGCTTG GTACAGCCTGGGGGGTCCCTGAGACTCTCCTGTG CAGCCTCTGATTCACCTTTAGCAGTCAGTGCCAT GAGCTGGGTCCGCCAGGCTCCAGGGAGGGGGCT GGAGTGGGTCTCAGTATTAGTGGTAGTGGTGGT AACACATTCTACGCAGACTCCGTGAAGGGCCGGT TCACCATCTCCAGAGACAATTCCAAGAACACGCT GTATCTGCAAATGAACAGCCTGAGAGCCGAGGA CACGGCCGTATATTACTGTGCGATCACGGTATA GCAGTGGCTGTACTGGGGCTCACTACTTTGACT ACTGGGGCCAGGGAACCCTGGCCACCGTCTCCTC A |
| | | | SEQ ID NO: 28113 | SEQ ID NO: 32119 |
| | | AA | DIQMTQSPSSVSASIGDRVTITCRASQFISSWLAW YQQKPGKAPKLLIYTASSLQSGVPSRFSGSGSGT DFTLTISSLQPEDFATYCCQQANSFPWTFGQGTK VEFN | EVQLLESGGGLVQPGGSLRLSCAASGFTFSSYAMS WVRQAPGRGLEWVSAISGSGGNTFYADSVKGRFTI SRDNSKNTLYLQMNSLRAEDTAVYYCAIHGIAVAG TGAHYFDYWGQGTLATVSS |
| | | | SEQ ID NO: 28114 | SEQ ID NO: 32120 |
| iPS:434553 | 21-225_76H12 | NA | GACATCCAGATGACCCAGTCTCCATCCTCCCT GTCTGCATCTGTGGGAGACAGAGTCACCATCA CTTGCCGGGCAAGTCAGGGCATTAGAAATGAT TTAGGCTGGTTTCAGCAGAAACCAGGGAAAGC CCCCAAGGCGCCTGATCTATGCTGCCATCCAGAT TGCAAAGTGGGGTCCCATCAAGGTTCAGCGGC AGTGGATCTGGGACAGAATTCACTCTCACAAT CAGCAGCCTGCAGCCTGAAGATTTTGCAACTT ATTACTGTCTACAGCATAATGATTACCCATTC ACTTTCGGCCCTGGGACCAAAGTGGATATCAA A | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGCTGAACCCTCACAGTGG TAACACAGGCTATGCACAGAAGTTCCAGGGCAG AATCACCATGACCTGGAACACTCCATACGCACT GCCTACATGGAGCTGAGCAGCCTGAGATCTGAG GACACGGCCGTGTATTACTGTGCGAGAGGGTTTT ACGATATTTGACTGGTTATTCCCCACTACTAC TACTACGATATGGACGTCTGGGGCCAAGGGACC ACGGTCACCGTCTCCTCA |

FIGURE 50
(Continued)

| | | | SEQ ID NO: 28115 | DIQMTQSPSSLSASVGDRVTITCRASQGIRNDLG WFQQKPGKAPKRLIYAASRLQSGVPSRFSGSGS GTEFTLTISSLQPEDFATYYCLQHNDYPFTFGPGT KVDIK | SEQ ID NO: 32121 | QVQLVQSGAEVKKPGASVKVSCKASGYTFTSYDIN WVRQATGQGLEWMGWLNPHSGNTGYAQKFQGRI TMTWNTSIRTAYMELSSLRSEDTAVYYCARGFYDI LTGYSPTYYYDMDVWGQGTTVTVSS |
| | | AA | SEQ ID NO: 28116 | GACATCCAGATGACCCAGTCTCCATCCCCT GTCTGCATCTGTAGGAGACAGAGTCACCATCA CTTGCCGGGCAAGTCAGGGCATTAGAAATGAT TTAGGCTGGTTTCAGCAGAAACCAGGAAAG CCCCTAAGCGCCTGATCTATGCTGCCAGT TTGCAAAGTGGGGTCCCATCAAGGTTCAGCGG CAGTGGATCTGGGACAGCAGATTCACTCTCACAA TCAGCAGCCTGCAGCCTGAAGATTTTGCAACT TATCACTGTCTACAGCATAATGATTACCCATTC ACTTTCGGCCCTGGGACCAAAGTGGAAATCAA A | SEQ ID NO: 32122 | CAGGTGCAGCTGGTGCAGTCTGGGGCTGAGGTG AAGAAGCCTGGGGCCTCAGTGAAGGTCTCCTGC AAGGCTTCTGGATACACCTTCACCAGTTATGATA TCAACTGGGTGCGACAGGCCACTGGACAAGGC TTGAGTGGATGGGATGGATGAACCCTAACAGTG GTAACACAGGCTATGCACAGAAGTTCCAGGCA GAGTCACCATGACCTGGAACACCTCCATACGCAC TGCCTACATGGAGCTGAGCAGCCTGAGATCTGAG GACACGGCCGTGTATTACTGTGCGAGAGGGTTT ACGATATTTGACTGGTATTCCCCACCTACTAC TACTACGATATGGACGTCTGGGGCCAAGGGACC ACGGTCACCGTCTCCTCA |
| | NA | SEQ ID NO: 28117 | DIQMTQSPSSLSASVGDRVTITCRASQGIRNDLG WYQQKPGKAPKRLIYAASSLQSGVPSRFSGSGS GTEFTLTISSLQPEDFATYHCLQHNDYPFTFGPGT KVEIK | SEQ ID NO: 32123 | QVQLVQSGAEVKKPGASVKVSCKASGYTFTSYDIN WVRQATGQGLEWMGWMNPNSGNTGYAQKFQGR VTMTWNTSIRTAYMELSSLRSEDTAVYYCARGFYD ILTGYSPTYYYDMDVWGQGTTVTVSS |
| iPS:434927 | 21-225_86E5 | AA | SEQ ID NO: 28118 | | SEQ ID NO: 32124 | |

FIGURE 50
(Continued)

| iPS:435385 | 21-225_149G7 | NA | GACATCCAGATGACCCAGTCTCCATCTTCCGT
GTCTGCATCTGTAGGAGACAGAGTCACCATCA
CTTGTCGGGCGAGTCAGTTTATTAGCAGCTGG
TTAGCCTGGTATCAGCAGAAACCAGGGAAAG
CCCCTAAGTTCCTGATCTATGCTGCATCCAGT
TGCAAAGTGGGGTCCCATCAAGGTTCAGCGGC
AGTGGATCTGGGACAGATTTCACTCTCACCAT
CAGCAGCCTGCAGCCTGAAGATTTTGCAACTT
ACTATTGTCAACAGGCTAACAGTTTCCCGTGG
ACGTTCGGCCAAGGGACCAAGGTGGAAATCA
AC | GAGGTGCAGCTGTTGGAGTCTGGGGGAGGCTTG
GTACAGCCTGGGGGGTCCCTGAGACTCTCCTGTG
CAGCCTCTGGATTCACCTTTAGCAGCTATGCCAT
GAGCTGGGTCCGCCAGGCTCCAGGGAAGGGGCT
GGAGTGGGTCTCAGCTATTAGTGGTAGTGGTGGT
AACACATTCTACGCAGACTCCGTGAAGGGCCGGT
TCACCATCTCCAGAGACAATTCCAAGAACACGCT
GTATCTGCAAATGAACAGCCTGAGAGCCGAGGA
CACGGCCGTATATTACTGTGCGATCCACGGTATA
GCAGTGGCTGGTACTGGGCTCACTACTTTGACT
ACTGGGGCCAGGGAACCCTGGCCACCGTCTCCTC
A |
| | | | SEQ ID NO: 28119 | SEQ ID NO: 32125 |
| | | AA | DIQMTQSPSSVSASVGDRVTITCRASQFISSWLA
WYQQKPGKAPKFLIYAASSLQSGVPSRFSGSGSG
TDFTLTISSLQPEDFATYYCQQANSFPWTFGQGT
KVEIN | EVQLLESGGGLVQPGGSLRLSCAASGFTFSSYAMS
WVRQAPGKGLEWVSAISGSGGNTFYADSVKGRFTI
SRDNSKNTLYLQMNSLRAEDTAVYYCAIHGIAVAG
TGAHYFDYWGQGTLATVSS |
| | | | SEQ ID NO: 28120 | SEQ ID NO: 32126 |

FIGURE 51 (Table 4)
Standard IgG Antibody Variable Region Protein Alignment
CDRs defined by Kabat
Alignment numbering defined by Amgen Reference (AHo)

| KAPPA_VARIABLE | Germline | SEQ ID NO: | K_FR1 | K_CDR1 | K_FR2 | K_CDR2 | K_FR3 | K_CDR3 | K_FR4 |
|---|---|---|---|---|---|---|---|---|---|
| VK4|B3|K3 | | | DIVMTQSPDSLAVSLGERATINC | KSS--QSVLYSSNNKNYLA | WYQQKPGQPPKLLIY | W------ASTRES | GVPDRFSGSGSG--TDFTLTISSLQAEDVAVYYC | QQYYS------TPFT | FGPGTKVDIK |
| iPS:426 126 | 21-225_6G6 | | VK4|B3|K3 DIVMTQSPDSLAV SLGERATINC | KSS--QSVLHSSNNYN YLA | WYQQKPGQ PPNLLIF | W------ ASTRES | GVPDRFSGSGSFG-- TDFTLNISSLQAEDVAVYYC | QQYYD------TPFT | FGHGT KVDIK |
| iPS:412 232 | 21-225_4A2 | | VK4|B3|K3 DIVMTQSPDSLAV SLGERATINC | KSS--QSILHSSNNMN YLA | WFQQKPGQ PPKLLLY | W------ ASTRES | GVPDRFSGSGSG-- TDFTLTISSLQPEDVAVYYC | QQYYN------TPVT | FGPGT KVGIK |
| iPS:451 141 | 21-225_164B1 | | VK4|B3|K3 DIVMTQSPDSLAV SLGERATINC | KSS--QSLLKSSNNKS YLA | SYQQKPGQ LPKLLIY | W------ ASSRES | GVPDRFSGSGSG-- TDFTLTISSLQAEDVALYYC | QQYYS------IPPT | FGHGT NVDIT |
| iPS:423 314 | 21-225_12F11 | | VK4|B3|K3 DIVMTQSPDSLAV SLGERATINC | KSS--QSVLHSSNNYN YLA | WYQQKPGQ PPNLLIF | W------ ASTRES | GVPDRFSGSGSFG-- TDFTLNISSLQAEDVAVYYC | QQYYD------TPFT | FGPGT KVDIK |
| iPS:435 327 | 21-225_147G6 | | VK4|B3|K3 DIVMTQSPDSLAV SLGERATINC | KSS--QSVLYSSNSNN YLA | WYQQKPGQ PPKLLIY | W------ ASARES | GVPDRFSGSGSG-- TDFTLTISSLQAEDVAVYYC | QQYYT------TPPT | FGPGT KVDIK |
| iPS:435 345 | 21-225_148G3 | | VK4|B3|K3 DIVMTQSPDSLAV SLGERATINC | KSS--QRVLHSSNNYN YLA | WYQQKPGQ PPKLLIY | W------ ASTRDS | GVPDRFSGSGSG-- ADFTLTISSLQAEDVALYYC | QQYYS------TPFT | FGPGT KVDIK |
| iPS:435 405 | 21-225_150B7 | | VK4|B3|K3 DIVMTQSPDSLAV SLGERATINC | KSS--QMVLYSSHNMN YLA | WYQQKPGQ PPKLLIY | W------ ASTRKS | GVPDRFSGSGSG-- TDFTLTITSSLQAEDVAVYYC | QQYYS------TPFT | FGPGT KVDIK |
| iPS:435 433 | 21-225_152E3 | | VK4|B3|K3 DIVMTQSPDSLAV SLGERATINC | KSS--QSVLHSSNNYN YLV | WYQQKPGQ SPKRLIY | W------ ASTRES | GVPDRFSGSGSG-- TDFSLITISSLQAEDVAVYYC | QQYYS------TPFT | FGPGT KVDIK |
| iPS:435 437 | 21-225_152F4 | | VK4|B3|K3 DIVMTQSPDSLAV SLGERATINC | KSS--QSVLYSSNNYN YLA | WYQQKPGQ PPKLLIY | W------ ASTRKS | GVPDRFSGSGSG-- TDFTLTISSLQAEDVAVYYC | QQYFN------TPPT | FGPGT KVDIK |
| iPS:435 649 | 21-225_165H2 | | VK4|B3|K3 DIVMTQSPDSLTV SPGERATINC | KSS--QSVLHSSNNKN YLT | WYQQKPGQ PPKLLIY | W------ ASTRES | GVPVRFSGSGSG-- TDFTVPISSMQDDDVAVYYR | QQSYS------IPPT | FGPGT NVDIK |
| iPS:435 855 | 21-225_191G3 | | VK4|B3|K3 DIVMTQSPDSLAV SLGERATIDC | KSS--QSVLHSSNSYN YLA | WYQQKLGQ PPKLLIY | W------ ASTRKS | GVPDRFSGSGSG-- TDFILTISSLQAEDVAFYYC | QQYYS------SPPT | FGPGT KMDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435 903 | 21-225_190E2 | VK4|B3/JK3 | DIVMTQSPDSLAV SLGERATINC | KSS------QSVLFNSNNKN YLA | WYQQKPGQ PPNLLIY | W-------ASTRES | GVPDRFSGSGSG------TDFTLTISSMQAEDVAVYYC | QQYCS---------LPFT | FGPGT KVDIR |
| iPS:435 915 | 21-225_190H4 | VK4|B3/JK3 | ANVMTQSPDSLAV SLGERTTINC | KSS------QSVLHSSNNYN YLA | WYRQKPGQ PPKLLIY | W-------ASTRES | GVPDRFSGSGSG------TDFTLTISSLQAEDVAVYYC | QQYYS---------IPFT | FGPGT KVDIK |
| iPS:435 923 | 21-225_190H6 | VK4|B3/JK3 | DIVMTQSPDSLAV SLGERATINC | KSS------QSVLFNSNNKN YLA | WYQQKPGQ PPNLLIY | W-------ASTRES | GVPDRFSGSGCG------TDFTLTISSLQAEDVAVYYC | QQYCS---------LPFT | FGPGT KVDIR |
| iPS:435 953 | 21-225_191B1 2 | VK4|B3/JK3 | DIVMTQSPDSLAV SLGERATINC | KSS------QSVLFNSNNKN YLA | WYQQKPGQ PPKLLIY | W-------ASTRES | GVPDRFSGSGSG------TDFTLTISNLQAEDVAIYYC | QQYSS---------LPFT | FGPGT KVDIK |
| iPS:436 098 | 21-225_195G1 | VK4|B3/JK3 | DIVMTQSPDSLAV SLGERATINC | KSS------QSVLFNSNRNKN YLA | WYQQKPGQ PPNLLIY | W-------ASTLES | GVPDRFSGSGCG------TDFTLTISSMQAEDVAVYYC | QQYCS---------FPFT | FGPGT KVDIR |
| iPS:436 102 | 21-225_196B1 | VK4|B3/JK3 | DIVMTQSPDSLAV FLGERATINC | KSS------QSILFSSNNKR YLA | WYQQKPGQ PPFKLLIY | W-------ASIRES | GVPDRFSGSGSG------TDFTLTISSLQAEDVAVYYC | QQYSS---------LPFT | FGPGT KVDIK |
| iPS:436 104 | 21-225_196C1 | VK4|B3/JK3 | DIVMTQSPDSLAV SLGERATINC | KSS------QSVLFNSNNWN YLA | WYQQKPGQ LPNLLIY | W-------ASTLES | GVPDRFSGSGCG------TDFTLTISSMQAEDVAVYYC | QQYCS---------FPFT | FGPGT KVDIR |
| iPS:436 156 | 21-225_197C8 | VK4|B3/JK3 | DIVMTPSPDSLAV SLGERATINC | KSS------QSVLHSSNNKN YLA | WYQQKPGQ PPKLLIY | W-------ASTRES | GVPDRFSGSGSG------TDFTLSISSLQAEDVAVYYC | QQSYT---------IPFT | FGPGT KVDNK |
| iPS:436 270 | 21-225_203F10 | VK4|B3/JK3 | DIVMTQSPDSLAV SLGERATINC | KSS------QSVFFHSNNKN YLA | WYQQKPGQ PPKLLIY | W-------ASTRES | GVPDRFSGSGSG------TDFTLTISSLQAEDVTVYYC | QQYFS---------LPFT | FGPGT KVDIT |
| iPS:436 570 | 21-225_225F4 | VK4|B3/JK3 | DIVMTQSPDSLAV SLGERATINC | KSS------QSVLYSSNNKN YLA | WYQQRPGQ PPKLLIY | W-------ASTRES | GVPDRFSGSGSG------TDFTLTISCVQPEDVAVYYC | HQYHN---------SPPI | FGHGI EVDIK |
| iPS:394 065 | 21-225_11E2 | VK4|B3/JK3 | DIVMTQSPDSLAV SLGERATINC | KSN------QRVLSSNNHAN YLA | WYQQKPGQ PPKLLIY | W-------ASTRES | GVPDRFSGSGSG------TDFTLTISSLQAEDVAVYYC | QQYFS---------IPFT | FGPGT KVDIK |
| Germline | | | K_FR1 | K_CDR1 | K_FR2 | K_CDR2 | K_FR3 | K_CDR3 | K_FR4 |
| VK1|A30|JK5 | | | | | | | | | |
| iPS:473 253 | 21-225_7C3_L C1 | VK1|A30/JK5 | DIQMTQSPSSLSA SVGDRVTITC | RAS------QGIR------SDLG | WYQQNPVK APKRLIY | A-------ASSLQS | GVPSRFSGSGSG------TEFTLTVSSLQPEDFAFYYC | LQHNS---------YLPIT | FGQGT RLEIK |
| iPS:473 256 | 21-225_9F12_LC2 | VK1|A30/JK5 | DIQMTQSPSSLSA SVGDRVTITC | RAS------QGIR------NDLG | WYQQKPVK APKRLIY | A-------ASSLQS | GVPSRFSGSGSG------TEFTLTISSLQPEDFATYYC | LQHNS---------YLPIT | FGQGT RLEIK |
| iPS:453 449 | 21-225_208A2 | VK1|A30/JK5 | DIQMTQSPSSLSA SVGDRVTITC | RTS------QGIR------NDLG | WYQQQPGK TPKRLIY | A-------ASSLLS | GVPSRFSGSRSG------TDFTLTISSLQPEDFATYYC | LQYNS---------YPPT | FGQGT RLEIK |
| iPS:434 467 | 21-225_73H8 | VK1|A30/JK5 | DIQMTQSPSSLYA SVGDRVTIIR | RAS------QDIR------NDLG | WYQQKPGN ALKRVIY | A-------ASSLQS | GVPSSFSGSGSG------TEFTLTISSLQPEDFATYYG | IQHNS---------YPPIT | VGQGT RLEIK |
| iPS:435 045 | 21-225_90H5 | VK1|A30/JK5 | DIQMTQSPSSLSA SVGDRVTITC | RAS------QGIR------NDLG | WYQQKPGK APKRLIY | I-------ASSLQS | GVPSRFSGSGSG------TEFTLTISSLQPEDFATYYC | LQHNS---------YPIT | FGQGT RLEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:435561 | 21-225_159F1 | VK1|A30/JK5 | DIQMTQSPSSLSASVGDRVTITC | RAS--QRVR-----NDLG | WYQQKPAKAPKRIIF | D------ASNLQS | GVPSRFSGSGSG--TEFTLTISSLQPEDFATYYC | LQHHS-------------FPFT | FGQGTRLEIK |
| iPS:436328 | 21-225_207F12 | VK1|A30/JK5 | DIQMTQSPSSLSASVGDRVTITC | RAS--QGIR-----NDLG | WYQQKPGKAPKRLIY | A------ASSLQS | GVPSRFSGSGSG--TEFTLTISSLQPEDFATYFC | LQHNS-------------YPLT | FGQGTRLEIK |
| iPS:436354 | 21-225_210G1 | VK1|A30/JK5 | DIQMTQSPSSLSASVGDRVTIIF | RTS--QGIR-----NDLG | WYQQQPGKTPKRMIY | A------ASSLFS | GVPSRFSGSGRSG--TDFTLTISSLQPEDFATYYC | LQYNS-------------YPPT | FGQGTRLEIK |
| iPS:393094 | 21-225_34C4 | VK1|A30/JK5 | DIQMTQSPSSLSASVGDRVTITC | RAS--QGIR-----NDLG | WYQQKPGKAPKRLIY | T------ASNLQS | GVPSRFSGSGSG--TEFTLTISSLQPEDFATYYC | LQHSS-------------YFIT | FGQGTRLEIK |
| iPS:398484 | 21-225_18D4 | VK1|A30/JK5 | DIQMTQSPSSLSASVGDRVTITC | RAS--QGIR-----NDLG | WYQQKPGKAPKRLIY | A------ASSLES | GVPSRFSGSGSG--TEFTLTVSSLQPEDFATYYC | LHHNN-------------YLPIT | FGQGTRLEIK |
| | Germline | | K_FR1 | K_CDR1 | K_FR2 | K_CDR2 | K_FR3 | K_CDR3 | K_FR4 |
| | VK1|L5/JK3 | | | | | | | QQANS | |
| iPS:473254 | 21-225_7C3_L C2 | VK1|L5/JK3 | DIQMTQSPSSVSASLGDRVTITC | RAS--QGIS-----SWLA | WYQQKQGKAPKLLIF | A------ASRLQS | GAPSRFSGSGSG--TDFTLTISSLQPEDFATYYC | QQANS-------------FFFT | FGPGTKVDIK |
| iPS:473255 | 21-225_9F12_LC1 | VK1|L5/JK3 | DIQMTQSPSSVSASVGDRVTITC | RAS--QGIS-----RWLA | WYQQKPGKAPKLLIY | A------ASRLQS | GVPSRFSGSGSG--TDFTLTISSLQPEDFATYYC | QQANS-------------FFFT | FGPGTKVDFK |
| iPS:426108 | 21-225_10G6 | VK1|L5/JK3 | DIQMTQSPSSVSASVGDRVTITC | RAS--QGIS-----KWLA | WYQQKPGKAPKLLIY | A------AYSLQS | GVPARFSGSGSG--TDFTLTIRSLQPEDFATYYC | QQANS-------------FFFT | FGPGTKVDIK |
| iPS:426110 | 21-225_12E9 | VK1|L5/JK3 | DIQMTQSPSSVSASVGDRVTITC | RAS--QGIS-----SWLA | WYQQKPGEAPKLLIY | A------ASRLQS | GVPSRFSGSGSG--TDFTLTISSLQPEDFATYYC | QQANS-------------FFFT | FGPGTKVDIK |
| iPS:453447 | 21-225_65F10 | VK1|L5/JK3 | DIQMTQSPSSVSASVGDRVTITC | RGG--QGIS-----TWLA | WYQQKPGKAPKLLIY | A------ASILQS | GVPSRFSGSGSG--TDFTLTISSLQPEDFATYYC | QQGNI-------------FFFT | FGPGTKVDIK |
| iPS:453451 | 21-225_52G11 | VK1|L5/JK3 | DIQMTQSPSSVSASVGDRVTITC | RAS--QGIS-----KWLA | WYQQKPGKAPKLLIY | A------ASSLQS | GVPSRFSGSGSG--TDFTLTISSLQPEDFATYYC | QQANS-------------FFFT | FGPGTKVVVK |
| iPS:453453 | 21-225_53F2 | VK1|L5/JK3 | DIQMTQSPSSVSASVGDRVTITC | RAS--QGIS-----KWLA | WYQQKPGKAPNLLIY | A------ASSLQS | GVPSRFSGSGSG--TDFTLTISSLQPEDFATYYC | QQANS-------------FFFT | FGPGTKVDVK |
| iPS:433915 | 21-225_43H9 | VK1|L5/JK3 | DIQMTQSPSSVSASVGDRVTITC | RAS--QDIS-----SWLA | WYQQKKPGKAPKLLIY | D------ASSLQS | GVPSRFSGSGSG--TDFTLTISSLQPEDFATFPC | QQANS-------------FFFT | FGPGTKVDIK |
| iPS:433925 | 21-225_44F3 | VK1|L5/JK3 | DIQMTQSPSSVSASVGDRVTITC | RAS--QGIS-----DWLA | WYQQKPGKAPKLLIY | A------ASSLQS | GVPSRFSASGSG--TDFTLTISSLQPEDFATYYC | QQANS-------------FFFT | FGPGTKVVVK |
| iPS:433953 | 21-225_45H4 | VK1|L5/JK3 | DIQMTQSPSSVSASVGDRVTITC | RAS--QDIS-----SWLA | WYQQKPGKAPKYLIY | D------ASSLQS | GVPSKFSGSGSG--TDFILTISSLQPEDFATYFC | QQANS-------------LFFT | FGPGTKVDIK |
| iPS:433959 | 21-225_45C9 | VK1|L5/JK3 | DIQMTQSPSSVSASVGDRVTITC | RAS--QDIS-----DWLA | WYQQRPGKAPKLLIY | A------ASSLES | GVPSRFSGSGSG--TDFTLTISSLQPEDFATYYC | QQANS-------------FFFT | FGPGTKVDIK |
| iPS:434023 | 21-225_49F1 | VK1|L5/JK3 | DIQMTQSPSSVSASVGDRVTITC | RAS--RDIN-----GWLA | WYQQKPGKAPKLLIY | A------ASSLQS | GVPSRFSGSGFG--TDFTLTISSLQPEDFATYYC | QQSNS-------------LFFT | FGPGTKVDIK |
| iPS:434027 | 21-225_49H5 | VK1|L5/JK3 | DIQMTQSPSSVSASVGDRVTITC | RAS--QGFS-----TWLA | WYQQKPGKAPKLLIY | T------VSSLQS | GVPSRFSGSGFG--TDFTLTISSLQPEDFATYYC | QQTNS-------------FFFT | FGPGTKVDIK |
| iPS:434035 | 21-225_49F10 | VK1|L5/JK3 | DIQMTQSPSSVSASVGDRVTITC | RAS--QGIS-----RWLA | WFQQKPGKAPKVLIY | A------ASTLQS | GVPSRFSGSGSG--TDFTLTISSLQPEDFATYYC | QQANS-------------FFFT | FGPGTKVDIK |
| iPS:434061 | 21-225_51C7 | VK1|L5/JK3 | DIQMTQSPSSVSASVGDRVTITC | RAS--QDVN-----NYLA | WFQQKPGKAPKLLIY | A------ASSLQN | GVPSRFSGSGSG--TDFTLLTISSLLPEDFATYYC | QQTNS-------------FFFT | FGPGTKVDIK |

Figure 51 (Continued)

| ID | | | | | | | | | | |
|---|---|---|---|---|---|---|---|---|---|---|
| iPS-434 065 | 21-225 50D4 | VK1|L5/J K3 | DIQMTQSPSSVSA SVGDRLTITC | RAS--QGIS- -----RWLA | WYQQKPGK APKVLIY | A------- ASTLQS | GVPSRFSGSGSG--- TDFTLTISSLQPEDFATYYC | QQANS------ | ----FPFT | FGPGT KVDIR |
| iPS-434 069 | 21-225 51E9 | VK1|L5/J K3 | DIQMTQSPSSVSA SVGDRVTITC | RAS--QGIS- -----SWLA | WYQQKPGK APKLLIY | A------- ASSLQS | GVPSRFSGSGSG--- TDFTLTIRSLQPEDFATYYC | QQAKS------ | ----FPFT | FGPGT KVDIK |
| iPS-434 079 | 21-225 52B1 | VK1|L5/J K3 | DIQMTQSPSSVST FVGDRITITC | RAS--QDIR- -----TWLA | WYQQKPGK APKLLIY | A------- ASSLQN | GAPSRFSGSGSG--- TDFTLTISSLQPEDFATYYC | QQAKS------ | ----FPFT | FGPGT KVDIK |
| iPS-434 097 | 21-225 52H10 | VK1|L5/J K3 | DIQMTQSPSSVSA SVGDRVTITC | RAS--QDIN- -----SWLA | WYQQKPGK APKLLIY | V------- ASSLQS | GVPSRFSGSGSG--- TDFTLTIRSLQPEDFATYYC | QQAKS------ | ----FPFT | FGPGT KVDIK |
| iPS-434 123 | 21-225 53F7 | VK1|L5/J K3 | DIQMTQSPSSVSA SVGDRVTITC | RAS--QGIS- -----RWLA | WYQQKPGK APNLLIY | A------- ASSLQS | GVPSRFSGSGSG--- TDFTLTISSLQPEDFATYYC | QQANS------ | ----FPFT | FGPGT KVDIK |
| iPS-434 145 | 21-225 55B1 | VK1|L5/J K3 | DIQMTQSPSSVSA SVGDRVTITC | RAS--QVIS- -----RWLA | WYQQKPGK APNLLIY | A------- ASRLQS | GVPSRFSGSGSG--- TDFLTISSLQPEDFATYYC | QQANS------ | ----FPFT | FGPGT KVDLK |
| iPS-434 167 | 21-225 50F3 | VK1|L5/J K3 | DIQMTQSPSSVSA SVGDRVTITC | RVS--QDIS- -----KWLA | WFQQKPGK APKFLIY | A------- ASGLQS | GVPSRFSGSGSG--- TDFLTITSSLQPEDFATYYC | QQTNS------ | ----FPFT | FGPGT KVDIK |
| iPS-434 189 | 21-225 56E5 | VK1|L5/J K3 | DIQMTQSPSSITC SVGDRVSITC | RAS--QDIS- -----SWLA | WYQQKPGK APKLLIY | A------- ASSLQN | GVPSRFSGSGSG--- TDFTLTISSLQPEDFATYYC | QQANS------ | ----FPFT | FGPGT KVDIK |
| iPS-434 193 | 21-225 56C6 | VK1|L5/J K3 | DIQMTQSPSSVSA SVGDRVTITC | RAS--QGIR- -----KWLA | WYQQKPGK APKLLIY | A------- ASSLQS | GVPSRFSGSGSG--- TYFTLTIISSQSEDFATYYC | QQANS------ | ----FPFT | FGPGT KVDIK |
| iPS-434 195 | 21-225 56F6 | VK1|L5/J K3 | DIQMTQSPSSVSA YVGDRVTITC | RAS--QGIS- -----KWLA | WYQQKPGK APKFLIY | V------- ASGLQS | GVPSRFSGSGSG--- TDFLTITSSLQPEDFATYYC | QQANS------ | ----FPFT | FGPGT KVDLK |
| iPS-434 273 | 21-225 57E4 | VK1|L5/J K3 | DIQMTQSPSFSITC SVGDRVTITC | RAS--QDIS- -----NWLA | WFQQKPGK APKFLIY | A------- ASGLQS | GVPSRFSGSGSG--- TDFLTITSSLQPEDFATYYC | QQGNS------ | ----FPFT | FGPGT KVDIK |
| iPS-434 277 | 21-225 57A7 | VK1|L5/J K3 | DIQMTQSPSSVSA SVGDRVTITC | RAS--QGIS- -----KWLA | WYQQKPGK APKLLIY | A------- ASNLQS | GVPSRFSGSGSG--- TDFTLTISSLQPEDFATYYC | QQANS------ | ----FPFT | FGPGT KVDIK |
| iPS-434 355 | 21-225 64G12 | VK1|L5/J K3 | DIQMTQSPSSVSA SVGDRVTITC | RAS--QNIT- -----TWLA | WYQQKPGK APKLLIS | A------- ASSLQS | GVPSRFSGSGSG--- TDFTLTISSVQPEDFATYYC | QQANS------ | ----FPFT | FGPGT KLDIK |
| iPS-434 389 | 21-225 66F11 | VK1|L5/J K3 | DIQMTQSPSSVCA SVGDRVTITC | RES--QGIS- -----IWLA | WYQQKPGK APKLLIY | A------- ASSLQS | GVPSRFSGSGSG--- TDFTLTISSLQPEDFATYYC | QQANS------ | ----FPFT | FGPGT KVDIK |
| iPS-434 423 | 21-225 70D1 | VK1|L5/J K3 | DIKMTQSPSSVSA SVGDRVTITC | RAS--QGIN- -----NWLV | WYQQKPGK APKLLIY | A------- ASSLQS | GVPSRFSGSGSG--- TDFTVTISSLQPEDFATYYC | QQAKS------ | ----FPFT | FGPGT KVLVK |
| iPS-435 291 | 21-225 146E1 | VK1|L5/J K3 | DIQMTQSPSSVSA SVGDRVTITC | RAS--QGIV- -----NWLV | WYQQKPGK APKLLIY | A------- ASSLQS | GVPSRFSGSGSG--- TDFTLTISSLQPEDFATYYC | QQANS------ | ----FPFT | FGPGT KVDIK |
| iPS-435 303 | 21-225 146A6 | VK1|L5/J K3 | DIQMTQSPASVSA SVGDRVTITC | RAS--QGIV- -----NWLV | WYQQKPGK APKLLIY | A------- ASSLQG | GVPSRFSGSGSG--- TDFTLTISSLQPEDFATYYC | QQTDS------ | ----FPFT | FGPGT KVDIK |
| iPS-435 335 | 21-225 147D10 | VK1|L5/J K3 | DIQMTQSPASVSA SVGDRVTITC | RAS--QNIS- -----NWLT | WYQQKPGR APKLLIY | A------- ASSLQG | GVPSRFSGSGSG--- TDFLTISSLQPEDFATYYC | | | |
| iPS-435 339 | 21-225 147D12 | VK1|L5/J K3 | DIQMTQSPASVSA SVGDRVTITC | RAS----- -----NWLA | WYQEKPGK APKLLIY | A------- ASSLQS | GVPSRFSGNESG--- TDFTLSISSLQPEDFATYYC | QQTDS------ | ----FPFT | FGPGT KVDVK |
| iPS-435 343 | 21-225 148E2 | VK1|L5/J K3 | DIQMTQSPASVSA SVGDRVTITC | RAS--QGVS- -----NWLA | WYQQKPGK APKLLIY | A------- ASSLQS | GVPSRFSGNESG--- TDFTLSISSLQPEDFATYYC | | | FGPGT KVLVK |
| iPS-435 379 | 21-225 149B6 | VK1|L5/J K3 | DIQMTQSPASVSA SVGDRVTITC | RAS--QGII- -----SWLA | WYQQKPGK APKLLIY | A------- ASSLQS | GVPSRFSGSGSG--- TDFTLTISSLQPEDFATYYC | QQGNS------ | ----FPFT | FGPGT KVDIK |
| iPS-435 381 | 21-225 149C6 | VK1|L5/J K3 | DIQMTQSPASVSA SVGDRVTITC | RAS--QGIS- -----NWLA | WYQQKPGR APKLLIY | A------- ASSLQG | GVPSRFSGSGSG--- TDYTLSISSLQPEDFATYYC | QQTDS------ | ----FPFT | FGPGT KVDIK |

Figure 51 (Continued)

| | | | | | | | | |
|---|---|---|---|---|---|---|---|---|
| iPS:435 391 | 21-225_149F8 | VK1|L5/J K3 | DIQMTQSPASVSA SVGDRVTITC | RAS--QGIS--- ----NWLA | WYQQKPGK APKLLIY | A------- ASSLQS | GVPSRFSGNESG-- TDFTLSISSLQPEDFAIYYC | QQTDS----------- -------PPFT | FGPGT KVDVK |
| iPS:435 395 | 21-225_149D1 | VK1|L5/J K3 | DIQMTQSPASVSA SVGDRVTITC | RAS--QNIS--- ----NWLT | WYQQKPGK AFKLLIY | A------- ASSLQS | GVPSRFSGSGSG-- TDFTLSISSLQPEDFATYYC | QQTDS----------- -------FPFT | FGPGT KVDIK |
| iPS:435 403 | 21-225_150C5 | VK1|L5/J K3 | DIQMTQSPGSVSA SVGDRVTITC | RAS--QGIN--- ----NWLA | WYQQKPGK AFKLLIY | A------- ASSLQG | GVPSRFSGSGSG-- IDFTLTISSLQPEDFATYYC | QQTDS----------- -------FPFT | FGPGT KVDIK |
| iPS:435 447 | 21-225_152H7 | VK1|L5/J K3 | DIQMTQSPASVSA SVGDRVTITC | RAS--QDIS--- ----NWLA | WYQQKPGK APKLLIY | A------- ASSLQG | GVPSRFSGSGSG-- TDFTLTISSLQPEDFATYYC | QQTDS----------- -------FPFT | FGPGT KVDIK |
| iPS:435 453 | 21-225_152G1 | VK1|L5/J K3 | DIQMTQSPASVSA SVGDRVTITC | RAS--QGIS--- ----NWLA | WYQQKPGK APKLLIY | A------- ASSLQS | GVPSRFSGNESG-- TDFTLSISSLQPEDFATYYC | QQTDS----------- -------FPFT | FGPGT KVDVK |
| iPS:435 483 | 21-225_155A4 | VK1|L5/J K3 | DIQMTQSPASVSA SVGDRVTITC | RAS--QGIS--- ----NWLA | WYHQKPGK APKLLIY | A------- ASSLQG | GVPSRFSGSGSG-- TDFTLSISSLQPEDFATYYC | HQTDS----------- -------FPFT | FGPGT KVDIK |
| iPS:435 485 | 21-225_155B4 | VK1|L5/J K3 | DIQMTQSPASVSA SVGDRVTITC | RAS--QDIS--- ----NWLA | WYQQKPGK AFKLLIY | A------- ASSLQG | GVPSRFNGSGSG-- TDFTLSISSLQPEDFATYYC | HQTDS----------- -------FPFT | FGPGT KVDIK |
| iPS:435 787 | 21-225_180A3 | VK1|L5/J K3 | DIQMTQSPSSVSA SVGDRVTITC | RAS--QDIT--- ----SWLA | WYQQKPGK APKLLIY | A------- ASSLQS | GVPSRFSGSGSG-- TDFTLTISSLQPEDFAFYHC | QQANS----------- -------IPFT | FGPGT KVDIN |
| iPS:435 809 | 21-225_182H5 | VK1|L5/J K3 | DIQMTQSPSSVSYA SVGDRVTITC | RAS--QDIT--- ----SWLA | WYQQKPGK APKLLIY | A------- ASSLQS | GVPSRFSGSGSG-- TDFTLTISSVQPPDFATYYC | QQVNS----------- -------FPFT | FGHGT KVDIK |
| iPS:435 889 | 21-225_186A1 | VK1|L5/J K3 | DIQMTQSPSSVSA SVGDRVTITC | RAS--QDIT--- ----SWLA | WYQQKPGK APKLLIY | A------- ASSLQS | GVPSRFSGSGSG-- TDFTLTSVQPDDFATYYC | QQVNS----------- -------FPFT | FGHGT KVDIK |
| iPS:435 965 | 21-225_192H2 | VK1|L5/J K3 | DIQMTQSPSSVSA SVGDRVTITC | RAS--QGIS--- ----SWLA | WYQQKPGK APKLLIY | G------- ASSLQS | GVPSRFSGSGSG-- TDFTLTISSLQPEDFATYYC | QQSNS----------- -------FPFT | FGPGT KVDVK |
| iPS:436 106 | 21-225_196F2 | VK1|L5/J K3 | DIQMTQSPSSVSA SVGDRVTITC | RAS--QGIS--- ----SWLA | WYQQKPGK AFKLLIY | A------- ASSLQS | GVPSRFSGSGSG-- TDFTLSISSLQPEDFATYYC | QQTNS----------- -------FPFT | FGPGT KVDIK |
| iPS:436 360 | 21-225_210H1 | VK1|L5/J K3 | DIQMTQSPSSVSA SVGDRVTITC | RVS--QGIS--- ----IWLA | WYQQKPGK APNLLIY | A------- ASSLQS | GVPSRFSGRGSG-- TDFTLTISSVQPEDFATYYC | QQAKS----------- -------VPFT | FGPGT KVDIK |
| iPS:436 488 | 21-225_221A6 | VK1|L5/J K3 | DIQMTQSPSSVSA SVGDRVTITC | RAS--QGIS--- ----SWLA | WYQQKPGK APKLLIY | T------- ASNLQS | GVPSRFSGSGSG-- TDFTLTISSLQPEDFATYYC | QQANS----------- -------FPFT | FGRGT KVDIK |
| iPS:436 496 | 21-225_222E1 | VK1|L5/J K3 | DIQMTQSPSSVSA SVGDRVTITC | RAS--QGIS--- ----SWLA | WYQQKPGK APKLLIY | T------- ASNLQS | GVPSRFSGSGSG-- TDFTLTITSSLQPEDFATYYC | QQANS----------- -------PPFT | FGPGT KVDIK |
| iPS:436 508 | 21-225_222F7 | VK1|L5/J K3 | DIQMTQSPSSVSA SVGDRVTITC | RAS--QGIS--- ----SWLA | WYQQKPGK AFKLLIY | A------- ASSFQS | GVPSRFSGSGSG-- TDFTLTISSLQPEDFATYYC | QQANS----------- -------FPFT | FGPGT KVDIK |
| iPS:436 516 | 21-225_222C1 | VK1|L5/J K3 | DIQMTQCPSSVSA SVGDRVTITC | RAS--QGIS--- ----SWLA | WYQQKPGK APKLLIY | T------- ASSLQG | GVPSRFSGSGSG-- TDFTLTISSVQREDFATYYC | QQDNS----------- -------FPFT | FGPGT KVDIK |
| iPS:437 234 | 21-225_64E2 | VK1|L5/J K3 | DIQMTQSPSSVSA SVGDRVTITC | RAS--QGIS--- ----RWLA | WYQQKPGK APKLLIY | A------- ASSLQS | GVPSRFSGSGSG-- TDFTLTITSSLQPEDFATYYC | QQANS----------- -------FPFT | FGRGT KVDIK |
| iPS:392 996 | 21-225_28B1 | VK1|L5/J K3 | DIQMTQSPSSVSA SVGDRVTITC | RAS--QAIN--- ----DWLA | WYQQKPGK AFKLLIY | A------- ASSFQS | GVPSRFSGSGSG-- TDFTLTITSSLQPEDFATYYC | QQASS----------- -------FPFT | FGPGT KVDIK |
| iPS:393 010 | 21-225_25E11 | VK1|L5/J K3 | DIQMTQSPSSVSA SVGDRVTITC | RAS--QGIS--- ----NWLA | WYQQKPGK APKLLIY | T------- ASSLQG | GVPSRFSGSGSG-- TDFTLTISSLQPEDFATYYC | QQANS----------- -------FPII | FGPGT KVDIK |
| iPS:393 016 | 21-225_28F11 | VK1|L5/J K3 | DIQMTQSPSSVSA SVGDRVTITC | RAS--------- -------- | WYQQKPGK ALKLVIY | A------- ASNLQS | GVPSRFRGSGSG-- TDFTLTISSLQPEDFATYCC | QQANS----------- -------LPFT | FGPGT KVDIK |

Figure 51 (Continued)

| | | | K_FR1 | K_CDR1 | K_FR2 | K_CDR2 | K_FR3 | K_CDR3 | | K_FR4 |
|---|---|---|---|---|---|---|---|---|---|---|
| iPS:393 024 | 21-225_31H9 | VK1\|L5/JK3 | DIQMTQSPSSVSA SVGDRVTITC | RAS--QGIT-----SWLT | WYQQRPGK APKLLIY | D------TSSLQS | GVPSRFSGSGSG---TDFTLTISSLQPEDFATYYC | QQGNS---------- | -----FPFT | FGQGT KVDIK |
| iPS:393 080 | 21-225_34F3 | VK1\|L5/JK3 | DIQMTQSPSSVSA TVGDRVTSTC | RAS--QGIS-----KWLA | WYQQKPGK APKLLIY | A------ASSLQS | GVPSRFSGSGSG---TDFTLTISSLQPEDSATYYC | QQANS---------- | -----FPFT | FGPGT KVDIK |
| iPS:393 084 | 21-225_35C6 | VK1\|L5/JK3 | DIQMTQSPSSVSA SVGDRVTITC | RAS--QGIS-----KWLA | WYQQKPGK APKPLIY | A------ASSLQS | GVPTRFSGSGSG---TDFTLTISSLQPEDFAIYYC | QQANS---------- | -----FPFT | FGPGT KVDIK |
| iPS:393 086 | 21-225_36H5 | VK1\|L5/JK3 | DIQMTQSPSSVSA SVGDRVTITC | RAS--QGIS-----RWLA | WYQQKPGK APELLIY | A------ASRLQS | GIPSRFSGSGSG---TDFTLTISSLQPEDFATYYC | QQANS---------- | -----FPFT | FGPGT KVDIK |
| iPS:393 098 | 21-225_35G6 | VK1\|L5/JK3 | DIQMTQSPSSVSA SVGDRLTITC | RAS--QGIS-----RWLA | WYQQKVGK VPKLLIY | A------ASRLQS | GVPSRFSGSGSG---TAFTLTIGSLQPEDFATYYC | QQANS---------- | -----FPFT | FGPGT KVDLK |
| iPS:393 112 | 21-225_33G1 | VK1\|L5/JK3 | DIQMTQSPSSVSA SVGDRVTITC | RAS--QGIS-----RWLA | WYQQKPGK APKLLIY | G------AYSLQS | GVPSRFSGSGSG---TDFTLTISSLQPEDFATYYC | QQANS---------- | -----FPFT | FGPGT KVDIK |
| iPS:393 116 | 21-225_34G7 | VK1\|L5/JK3 | DIQMTQSPSSVSA SVGDRVTITC | RAS--QLIS-----KWLA | WYQQKPGK APKLLIY | A------ASSLQS | GVPLRFSGSGSG---TDFTLTISSLQPEDFATYYC | QQANI---------- | -----FPFT | FGPGT KVDLK |
| iPS:393 132 | 21-225_33H7 | VK1\|L5/JK3 | DIQMTQSPSSVSA SVGDRVTITC | RAS--QGIS-----RWLA | WYQQKVGK VPKLLIY | A------ASRLQS | GVPSRFSGSGSG---TDFTLTISSLQPEDFATYYC | QQANS---------- | -----FPFT | FGPGT KVDIK |
| iPS:393 140 | 21-225_35H12 | VK1\|L5/JK3 | DIQMTQSPSSVSA SVGDRVTITC | RAS--QGIS-----RWLA | WYQQKPGK APELLIY | A------ASRLQS | GIPSRFSGSGSG---TDFTLTISSLQPEDFATYYC | QQANS---------- | -----FPFT | FGPGT KVDIK |
| iPS:393 954 | 21-225_4H6 | VK1\|L5/JK3 | DIQMTQSPSSVSA SVGDRVTITC | RAS--QGIS-----RWLA | WYQQKPGK APKLLIY | G------ASSLQS | GVPSRFSGSGSG---TDFTLTISSLQPEDFAIYYC | QQANS---------- | -----FPFT | FGPGT KVDIK |
| iPS:398 502 | 21-225_23B11 | VK1\|L5/JK3 | DIQMTQSPSSVSA SVGDRVTITC | RAS--QGIT-----KWLA | WYQQKPGK APKVLIY | A------ASSLQS | RVFSRFSGSRSG---TDFTLTISSLQPEDFATYYC | QQANS---------- | -----FPFT | FGPGT KVDIK |
| iPS:398 520 | 21-225_31C4 | VK1\|L5/JK3 | DIQMTQSPSSVSA SVGDRVTITC | RAS--QGIS-----KWLA | WYQQKPGK APKPLIY | A------ASSLQS | GVPTRFSGSGSG---TDFTLTISSLQPEDFATYYC | QQANS---------- | -----FPFT | FGPGT KVDIK |
| iPS:402 223 | 21-225_30A11 | VK1\|L5/JK3 | DIQMTQSPSSVSA SVGDRVTITC | RAS--QGIS-----RWLA | WYQQKPGR APELLIY | A------ASRLQS | GIPSRFSGSGSG---TDFTLTISSLQPEDFATYYC | QQANS---------- | -----FPFT | FGPGT KVDNK |
| Germline | VK4\|B3/JK1 | | DIVMTQSPDSLAV SLGERATINC | KSS---QSVLFSSNNKN YLA | WYQQKPGQ PPKLLIY | W------ASTRES | GVPDRFSGSGSG---TDFTLTISSLQAEDVAVYYC | QQYYS---------- | -----TPWT | FGQGT KVELK |
| iPS:426 112 | 21-225_12F12 | VK4\|B3/JK1 | DIVMTQSPDSLAV SLGERATINC | KSS---QTVLFSSNNNH YLA | WYQQKPGQ PPNLLIY | W------ASTRAS | GVPDRFSGSGSG---TDFTLTISSLQAEDVAVYYC | QQYYS---------- | -----SPWT | FGQGT KVEIK |
| iPS:451 137 | 21-225_74A7 | VK4\|B3/JK1 | DIVMTQSPDSLAV SLGERATINC | KSS---QSVLFSSNNYN YLA | WYQQRPGQ PPNLLIY | W------ASTRES | GVPDRFSGSGSG---TDFTLTISSLQAADVAVYYC | QQYHS---------- | -----SPPT | FGQGT TVQIK |
| iPS:433 909 | 21-225_43D8 | VK4\|B3/JK1 | DIVMTQSPDSLAV SLGERATINC | KSS---QSVLMTSNDKN YLT | WYQQRPGQ PPKLLIY | W------ASTRES | GVPDRFSGSGSG---TDFTLTISSLQAEDVAVYYC | QQYYS---------- | -----TPPT | FGQGT KVEIK |
| iPS:434 177 | 21-225_56A1 | VK4\|B3/JK1 | DIVMTQSPDSLAV SLGERATINC | KSS---QSVLHSSNNKN YLV | WYQLKPGQ PPKKLIY | W------ASTRES | GVPDRFSGSGSG---TDFTLTISSLQAEDVAVYYC | QQYYS---------- | -----TPPT | FGQGT KVEIK |
| iPS:434 237 | 21-225_61B5 | VK4\|B3/JK1 | DIVMTQSPDSLAV SLGERATINC | KSS---QSVLYSSNNNM SLT | WYQLKPGQ PPKKLIY | W------ASTRES | GVPDRFSGSGSG---TDFTLTISSLQAEDVAVYYC | QQYYS---------- | -----TPPT | FGQGS KVEIK |

Figure 51 (Continued)

| ID | Name | Type | Seq1 | Seq2 | Seq3 | Seq4 | Seq5 | Seq6 |
|---|---|---|---|---|---|---|---|---|
| iPS:434 285 | 21-225_57A11 | VK4|B3/J K1 | DIVMTQSPDSLTV SLGERATINC | KSS--- QSVLHSSNNYN YLA | WYQQRPGQ PPKLVIY | W------ ASTRAS | GVPDRFSGSGSG-- TDFTLTISSLQAEDMAVYYC | QQYYS------ ------TPWT | FGQGT KVEFK |
| iPS:434 295 | 21-225_58B9 | VK4|B3/J K1 | DIVMTQSPDSLAV SLGERATINC | KSG--- QSILYSSNNKN YLA | WYQQKPGQ PPKKLIY | W------ ASTRDS | GVPARFSGSGSG-- TDFTLTISSLQAEDVAVYYC | QQYFS------ ------TPPT | FGGGS KVEIK |
| iPS:434 321 | 21-225_59F10 | VK4|B3/J K1 | DIVMTQFPDSLAV SLGERATINC | KSS--- QTVLYRSNNYN YLA | WYQQKPGQ PPKLLIY | W------ ASTRES | GVPDRFSGSGSG-- TDFTLTISSLQAEDVAVYYC | QQYFS------ ------TPPT | FGQGT KVEIK |
| iPS:434 431 | 21-225_70E7 | VK4|B3/J K1 | DIVMTQSPDSLAV SLGERATINC | KSS--- QSVLYSSRNNN YLA | WYQQKPGQ PPKFLIY | W------ ASTRES | GVPDRFSGSGSG-- TDFTLTISSLQAEDVAVYYC | QQYYN------ ------IPPT | FGQGT KVEIK |
| iPS:434 475 | 21-225_74F9 | VK4|B3/J K1 | DIVMTQSPDSLAV SLGERATINC | KSS--- QSVLYSSRNYN YLA | WYQQKPGQ PPKKLIY | W------ ASTRES | GVPDRFSGSGSG-- TDFTLTISSLQAEDVAVYYC | QQYYS------ ------SPPT | FGQGT KVEIK |
| iPS:434 477 | 21-225_74A6 | VK4|B3/J K1 | DIVMTQSPDSLAV SPGERATINC | KSS--- QSVLHSSNNNN YLA | WYQQKPGQ PPDLLIY | W------ ASTRES | GVPDRFSGSGSG-- TDFTLTISSLQAEDVAVYYC | QQYFS------ ------TPWT | FGQGT QVEIK |
| iPS:434 481 | 21-225_74B10 | VK4|B3/J K1 | DIVMTQSPDSLAV SLGERATINC | KSS--- QSVLHSSNNIN YLT | WYQQKPGQ PPFRLLIY | W------ ASTRES | GVPDRFSGSGSG-- TDFTLTIGSLQVEDVAVYYC | QQYYS------ ------IPPT | FGQGT KVEIK |
| iPS:434 487 | 21-225_76G2 | VK4|B3/J K1 | DIVMTQSPDSLAV SLGERATINC | KSS--- QSVLHSSNNIN YLA | WYQQKPGQ PPKLLIY | W------ ASTRES | GVPDRFSGSGSG-- TDFSLITIGSLQVEDVAVYYC | QQYYS------ ------SPPT | FGQGT KVEIK |
| iPS:434 493 | 21-225_76F3 | VK4|B3/J K1 | DIVMTQCPDSPAV SLGERATINC | KSS--- QSVLFSSNNYN YLA | WYQQRPGQ PHDLLIY | W------ ASTRES | GVPDRFSGSGSG-- TDFTLTISSLQAADVAVYYC | QQYHS------ ------SPLT | FGQGT TVQIK |
| iPS:434 509 | 21-225_76F5 | VK4|B3/J K1 | VIVLTQSPDSLAV SLGERATINC | KSS--- QSVLHSSNSYN YLA | WYQQKPGQ SPKVLIY | W------ TSTRES | GVPDRFSGSGSG-- TDFTLTISSLQAEDVAVYYC | QQYYS------ ------SPPT | FGQGT KVEIK |
| iPS:434 525 | 21-225_76E8 | VK4|B3/J K1 | DIVMTQSPDSLAV SLGERATINC | KSS--- QTVLHSSNNYN YLA | WYQQKPGQ PPKVLIY | W------ TSTRES | GVPDRFSGSGSG-- TDFTLTISSLQAEDVAVYYC | QQYFS------ ------SPLT | FGQGT KVEIK |
| iPS:434 549 | 21-225_76E11 | VK4|B3/J K1 | DIVMTQSPDSLAV SLGERATINC | KSR--- QSVLHSSNNYN YLA | WYQQKAGQ PPKLLIY | W------ ASTRES | GVPDRFSGSGSG-- TDFTLTISSLQAEDVAVYYC | QQYYS------ ------TPPT | FGQGT KVEIR |
| iPS:434 551 | 21-225_75C4 | VK4|B3/J K1 | DIVMTQSPDSLAV SLGERATINC | KSS--- QSILYSSNNNN YLA | WFQQKPGQ PPKLLIY | W------ ASTRES | GVPDRFSGSGSG-- TDFTLTISSLQAEDVAVYYC | QQYYI------ ------TPPT | FGQGT KVEIK |
| iPS:434 575 | 21-225_77C7 | VK4|B3/J K1 | DIVMTQSPDSLAV SLGERATINC | KSS--- QTVLHSSNNYN YLA | WYQQKPGQ PPKVLLY | W------ TSTRES | GVPDRFSGSGSG-- TDFTLTISSLQAEDVAVYYC | QQYFS------ ------SPPT | FGQGT KVEIK |
| iPS:434 597 | 21-225_77C10 | VK4|B3/J K1 | DIVMTQSPDSLAV SLGERATINC | KSS--- QSVLYTSNNNN YLA | WYQQKPGQ PPKLLIY | W------ ASTRES | GVPDRFSGSGSG-- TDFTLTISSLQAEDVAVYYC | QHYYN------ ------TPWK | FVQGT KVEIT |
| iPS:434 617 | 21-225_74B8 | VK4|B3/J K1 | DSVMTQSPDSLAV SLGERATINC | KSS--- QSVLHSSNKKN YLA | WYQQKPGQ PPKLLIY | W------ ASTRES | GVPDRFSGSGSG-- TDFTLTISSLQAEDVAVYYC | QQYYR------ ------TPWT | FGQGT KVEIK |

Figure 51 (Continued)

| | | | | | | | | | |
|---|---|---|---|---|---|---|---|---|---|
| iPS:434 619 | 21-225_78C1 | VK4lB3/J K1 | DIVMTQSPDCLAV SLGERATINC | KSS--- QSVLYTSNNNN YLA | WYQQKPGQ PPKLLIY | W------ ASTRES | GVPDRFSGSGSG-- TDFTLTISSLQAEDVAVYYC | QHYYN------------ ----------TPWK | FVQGI KVEIK |
| iPS:434 639 | 21-225_74B7 | VK4lB3/J K1 | DIVMTQSPDSLAV SLGERATINC | QTVLHSSNNYN YLA | WYQQKPGQ PPKVLIY | W------ TSTRES | GVPDRFSGSGSG-- TDFTLTISSLQAEDVAVYYC | QQYFS------------ ----------SPPT | FGQGT KVEIK |
| iPS:434 649 | 21-225_78E11 | VK4lB3/J K1 | DIVMTQSPDSLAV SLGERATINC | KSS--- QSVLYSFRNNYN YLA | WYQQKPGQ PPKKLIY | W------ ASTRES | GVPDRFSGSGSG-- TDFTLTISSLQAEDVAVYSC | QQYYS------------ ----------SPPT | FGQGT KVEIK |
| iPS:434 653 | 21-225_74B5 | VK4lB3/J K1 | DIVMTQSPDSLAV SLGERATINC | KSS--- QSVLFSSRNYN YLA | WYQQKPGQ PPNLLIY | W------ ASTRES | GVPDRFSGSGSG-- TDFTLTISSLQAADVAVYYC | QQYYS------------ ----------SPPT | FGQGT TVQIK |
| iPS:434 655 | 21-225_78H12 | VK4lB3/J K1 | DIVMTQSPDSLAV SLGERATINC | KSS--- QTVLHSFRNNN YLA | WYQQKPGQ PPKVLIY | W------ TSTRES | GVPDRFSGSGSG-- TDFTLTISSLQAEDVAVYYC | QQIFS------------ ----------SPPT | FGQGT KVEIK |
| iPS:434 665 | 21-225_74G4 | VK4lB3/J K1 | DIVMTQSPDSLAV SLGERATINC | KSS--- QSVLYSSNNNN YLA | WYQQKAGQ PPKLLIY | W------ ASTRES | GVPDRFSGSGSG-- TDFTLTISSLQAEDVAVYYC | QQYYS------------ ----------IPPT | FGQGT KVEIK |
| iPS:434 675 | 21-225_79G6 | VK4lB3/J K1 | DIVMTQSPDSLAV SLGERATISC | MSS--- QSVLHSFNNKN YLT | WFQQKPGQ PPKLLIY | W------ ASTWES | GVPDRFSGSGCG-- TDFTLTISSLQAEDVAVYYC | QQYYI------------ ----------IPPT | FGQGT KVEIK |
| iPS:434 685 | 21-225_79E9 | VK4lB3/J K1 | DIVMTQSPDSLAV SLGERATINC | KSS--- QSILYSSNNNYN YLA | WYQQRPGQ PHMLLIY | W------ ASTRES | GVPDRFSGSGSG-- TDFTLTISSLQAADVAVYYC | QQYHS------------ ----------SPLT | FGQGT TVQIK |
| iPS:434 689 | 21-225_79G10 | VK4lB3/J K1 | DIVMTQSPDSLAV SLGERATINC | KSS--- QSILYSSNNYN YLA | WYQQKPGQ PPKLLIY | W------ ASTRES | GVPDRFSGSGSG-- TDFTLTISSLQAEDVAVYYC | QQYS------------- ----------TPWT | FVQGT KVEIK |
| iPS:434 697 | 21-225_79F12 | VK4lB3/J K1 | DIVMTQSPDSLAV SLGERATINC | KSS--- QSVLFSSNNYN YLA | WYQQKPGQ PPNLLIY | W------ ASTRES | GVPDRFSGSGSG-- TDFTLTISSLQAEDVAVYYC | QHYNE------------ ----------TPGK | FVQVT KVEIK |
| iPS:434 707 | 21-225_80D3 | VK4lB3/J K1 | DIVMTQSPDSLAV SLGERATINC | KSS--- QSVLYTSNNNN YLA | WYQQKPGQ PPKLLIY | W------ ASTRES | GVPDRFSGSGSG-- TDFTLTISSLQAEDVAVYYC | QQYYS------------ ----------TPPT | FGQGT KVEIK |
| iPS:434 711 | 21-225_80H3 | VK4lB3/J K1 | DIVMTQSPDCLAV SLGERATINC | KSS--- QSVLHRSNNYN YLA | WYQQKPGQ PPKLLIY | W------ ASTRES | GVPDRFSGSGSG-- TDFTLTISSLQAEDVAVYYC | QQYYS------------ ----------TPPT | FGQGT KVEIK |
| iPS:434 731 | 21-225_80E9 | VK4lB3/J K1 | DIVMTQSPDSLAV SLGERATINC | KSS--- QSVLFSSNNYN YLA | WYQQKPGQ PHMLLIY | W------ ASTRES | GVPDRFSGSGSG-- TDFTLTISSLQAEDVAVYYC | QQYYN------------ ----------TPWT | FVQGI KVEIK |
| iPS:434 761 | 21-225_81E5 | VK4lB3/J K1 | DIVMTQSPDSLAV SLGERATINC | KSS--- QSVLFSSNNYN YLA | WYQQKPGQ PPNLLIY | W------ ASTRES | GVPDRFSGSGSG-- TDFTLTISSLQAADVAVYYC | QQYYS------------ ----------SPLT | FGQGT TVQIK |
| iPS:434 771 | 21-225_81F9 | VK4lB3/J K1 | DIVMTQSPDCLAV SLGERATINC | KSS--- QSVLYTSNNNN YLA | WYQQKPGQ PPKLLIY | W------ ASTRES | GVPDRFSGSGSG-- TDFTLTISSLQAEDVAVYIR | QHYND------------ ----------TPGK | FGQGI MVEII |
| iPS:434 827 | 21-225_83F3 | VK4lB3/J K1 | DIVMTQSPDCLAV SLGERATINC | KSS--- QSVLYTSNNNN YLA | WYQQKPGQ PPKLLIY | W------ ASTRES | GVPDRFSGSGSG-- TDFTLTISSLQAEDVAVYYC | QHYND------------ ----------TPWK | FVQGI KVEIK |

Figure 51 (Continued)

| | | | | | | | | |
|---|---|---|---|---|---|---|---|---|
| iPS:434 829 | 21- 225_83G3 | VK4|B3/J K1 | DIVMTQSPDCLAV SLGERATINC | KSS--- QSVLYTSNNNN YLA | WYQQKPGQ PPKLLIY | W--------- ASTRES | GVPDRFSGSGSG-- TDFTLTISSLQAEDVAVYYC | QHYN--------- ----------TPWT | FVQGT KVEIK |
| iPS:434 841 | 21- 225_83G7 | VK4|B3/J K1 | DIVMTQSPDSLAV SLGERATIIC | KSS--- QTVLHSSNNYN YLA | WYQQKPGQ PPKVLIY | W--------- TSTRES | GVPDRFSGSGSG-- TDFLTISSLQAEDVAVYYC | QQYFS--------- ----------SPLT | FGQGT KVEIK |
| iPS:434 863 | 21- 225_84G7 | VK4|B3/J K1 | DIVMTQSPDPAV SLGERATIIC | KSS--- QTVLHSSNNYN YLA | WYQQKPGQ PPKVLIY | W--------- TSTRES | GVPDRFSGSGSG-- TDFLTISSLQAEDVAVYYC | QQYFS--------- ----------SPPT | FGQGT KVEIK |
| iPS:434 877 | 21- 225_85H2 | VK4|B3/J K1 | DSMMTQSPDCLAV SLGERATINC | KSS--- QSVLHSSNKKN YLA | WYQQKPGQ PPKLLIY | W--------- ASTRES | GVPDRFSGSGSG-- TDFTLTISSLQAEDVAVYYC | QQYR--------- ----------TPWT | FGQGT KVEIK |
| iPS:434 901 | 21- 225_85H9 | VK4|B3/J K1 | DIVMTQSPDSLAV SLGERATINC | KSS--- QSVLHRSNNYN YLA | WYQQKPGQ PPKLLIY | W--------- ASTRES | GVPDRFSGSGSG-- TDFTLTISSLQAADVAVYYC | QQYFS--------- ----------TPPT | FGQGT KVEIK |
| iPS:434 935 | 21- 225_86E9 | VK4|B3/J K1 | DIVMTQCPDSFAV SLGERATINC | KSS--- QSVLHRSNNYN YLA | WYQQKPGQ PPNLLIY | W--------- TSTRES | GVPDRFSGSGSG-- TDFLTISSLQAEDVAVYYC | QQYHS--------- ----------SPLT | FGQGT TVEIK |
| iPS:434 965 | 21- 225_88A1 | VK4|B3/J K1 | NIVMTQSPDSLAV SLGERATINC | KSS--- QSVLYTSNNNN YLT | WYQQKPGQ PPKLLIY | W--------- ASTRKS | GVPDRFSGSGSG-- TDFTLTISSLQAEDVAVYYC | QQYS--------- ----------SPPT | FGQGT KVEIK |
| iPS:434 971 | 21- 225_88G2 | VK4|B3/J K1 | DIVMTQSPDSLAV SLGERATINC | KSS--- QTVLHSSNNYN YLA | WYQQKPGQ PPKVLIY | W--------- TSTRES | GVPDRFSGSGSG-- TDFLTISSLQAEDVAVYYC | QQYN--------- ----------TPWT | FVQGT KVEIK |
| iPS:434 973 | 21- 225_88B4 | VK4|B3/J K1 | DIVMTQSPDSLAV SLGERATINC | KSS--- QSVLYISNNNN YLA | WYQQKPGQ PPKLLIY | W--------- ASTRES | GVPARFSGSGSG-- TDFTLTISSLQAEDVAVYYC | QQYS--------- ----------TPPT | FGQGT KVEIK |
| iPS:434 997 | 21- 225_88C10 | VK4|B3/J K1 | DIVMTQSPDSLAV SLGERATINC | KSS--- QSVLHSSNNWN YLA | WHQQKPGQ PPKLLIH | W--------- AFTRKS | GVPDRFSGGGSG-- TNFTLTISSLQAEDVAVYYC | QQYR--------- ----------APPT | FGQGT KVEIK |
| iPS:435 051 | 21- 225_90D9 | VK4|B3/J K1 | DIVMTQSPDSLAV SLGERATINC | KSS--- QTVLHSSNNYN YLA | WYQQKPGQ PPKVLIY | W--------- TSTRES | GVPDRFSGSGSG-- TDFLTISSLQAEDVAVYYC | QQYLS--------- ----------SPLT | FGQGT KVEIK |
| iPS:435 053 | 21- 225_75F9 | VK4|B3/J K1 | DIVMTQSPDSLPV SLGERATINC | KSS--- QSVLHNSNNNN YLA | WYQQKPGQ PPKLLIY | W--------- ASTRES | GVPDRFSGSGSG-- TDFTLTISSLQAEDVAVYYC | QQYS--------- ----------SPPT | FGQGT KVEIK |
| iPS:435 071 | 21- 225_91F1 | VK4|B3/J K1 | DIVMTQSPDCLAV SLGERATINC | KSS--- QSVLYISNNNN YLA | WYQQKPGQ PPKILIY | W--------- ASTRES | GVPARFSGSGSG-- TDFTLTISSLQAEDVAVYYC | QHYN--------- ----------TPWK | FVQGT KVEIK |
| iPS:435 087 | 21- 225_91G8 | VK4|B3/J K1 | DIVMTQSPDCLAV SLGERATINC | KSS--- QSVLYTSNNNN YLA | WYQQKPGQ PPKLLIY | W--------- ASTRES | GVPDRFSGSGSG-- TDFTLTISSLQAEDVAVYYC | QQYT--------- ----------TPWT | FGQGT KVEIK |
| iPS:435 113 | 21- 225_92E6 | VK4|B3/J K1 | DIVMTQSPDSLAA SLGERATINC | KSS--- QMLSSSNNKN YLT | WYQQKPGQ PPKILIY | W--------- TSTRES | GVPDRFSGSGFG-- TDFLTISSLQAEDVAVYYC | QQYFS--------- ----------VPPT | FGQGT KVEIK |
| iPS:435 167 | 21- 225_92F12 | VK4|B3/J K1 | DIVMTQSPDSLAV SLGERATINC | KSS--- QSVLHRSNNYN YLA | WYQQKPGQ PPKLLIY | W--------- ASTRES | GVPDRFSGSGSG-- TDFLTISSLQAEDVAVYYC | QQYS--------- ----------TPPT | FGQGT KVEIK |

Figure 51 (Continued)

| | | | | | | | | |
|---|---|---|---|---|---|---|---|---|
| iPS:435 203 | 21-225_75A7 | VK4|B3|J K1 | DIVMTQSPDSLAV SLGERATINC | KSS--- QTVLHSSRNYN YLA | WYQQKPGQ PPKVLIY | W------ TSTRES | GVPDRFSGSGSG-- TDFTLTISSLQAEDVAVYYC | QQYFS------- ------SPPT | FGGGT KVEIK |
| iPS:435 209 | 21-225_75A10 | VK4|B3|J K1 | NIVMTQSPDSLAV SLGERATINC | KSS--- QSVLHNSRNYN YLT | WYQQKPGQ PPKLLIY | W------ ASTRKS | GVPDRFSGSGSG-- TDFTLTISSLQAEDVAVYFC | QQYYS------- ------SPPT | FGGGT KVEIK |
| iPS:435 211 | 21-225_94E11 | VK4|B3|J K1 | DIVMTQSPDSLAV SLGERATINC | KSS--- QSVLFSSRNYN YLA | WYQQKPGQ PPNLLIY | W------ ASTRES | GVPDRFSGSGSG-- TDFTLTISSLQAADVAVYYC | QQYHS------- ------SPLT | FGGGT TVQIK |
| iPS:435 215 | 21-225_94E12 | VK4|B3|J K1 | DIVMTQSPDSLAV SLGERATINC | KSS--- QSVLHRSRNYN YLA | WYQQKPGQ PPKLLIY | W------ ASTRES | GVPDRFSGSGSG-- TDFTLTISSLQAEDVAVYYC | QQYYS------- ------TPPT | FGGGT KVEIK |
| iPS:435 227 | 21-225_95G4 | VK4|B3|J K1 | DIVMTQCPDSLAV SLGERATINC | KSS--- QSVLFRSRNYN YLA | WYQQKPGQ PHNLLIY | W------ ASTRES | GVPDRFSGSGYG-- TDFTLTISSVQAADVAVYYC | QQYHS------- ------SPLT | FGGGT TVQIK |
| iPS:435 245 | 21-225_95E12 | VK4|B3|J K1 | DIVMTQSPDSLAV SLGERATINC | KSS--- QSVLYSGNNAN YLA | WYQQKPGQ PPNLFIY | W------ ASTRES | GVPDRFSGSGSG-- TDFTLTISSLQAEDVAVYYC | QQYYS------- ------TPCS | FGGGT KVEIK |
| iPS:435 249 | 21-225_96E2 | VK4|B3|J K1 | DSVMTQSPDSLAV SLGERATINC | KSS--- QSVLHSSNKKN YLA | WYQQKPGQ PPKLLIY | W------ ASTWES | GVPDRFSGSGSG-- TDFTLTISSLQAEDVAVYYC | QQYYR------- ------TPWT | FGGGT KVEIK |
| iPS:435 255 | 21-225_96D5 | VK4|B3|J K1 | DIVMTQSPDSLAV SLGERATINC | KSS--- QSVLHSSNNYN YLA | WYQQKPGQ PPNLFIY | W------ ASTRES | GVPDRFSGSGSG-- TDFTLTISSLQAEDVAVYYC | QQYYS------- ------SPPT | FGGGT KVEIK |
| iPS:435 257 | 21-225_96H5 | VK4|B3|J K1 | DIVMTQSPDSLAV SLGERATINC | KSS--- QSVLYSSNSHN YLA | WYQQKPGQ PFKLLIY | W------ ASIRES | GVPDRFSGSGSG-- TDFTLSISISMQAEDVAVYYC | QQYYS------- ------TPCS | FGGGT KVEIK |
| iPS:435 267 | 21-225_96D10 | VK4|B3|J K1 | DIVMTQSPDSLAV SLGERATINC | KSS--- QNILSSSNNKN YLT | WYQQKPGQ PPKLLIY | W------ TSTRES | GVPDRFSGSGFG-- TDFTLTISSLQAEDVAVYYC | QQYFS------- ------VPPT | FVQGT KVEII |
| iPS:435 279 | 21-225_97H4 | VK4|B3|J K1 | DIVMTQSPDCLAV SLGERATINC | KSS--- QSVLYTSNNNN YLA | WYQQKPGQ PPKLLIY | W------ ASTRES | GVPDRFSGSGSG-- TDFTLTISSLQAEDVAVYYC | QHYND------- ------TPWK | FGGGT KVEIK |
| iPS:435 321 | 21-225_147E4 | VK4|B3|J K1 | DIVMTQSPDSLAV SLGERATINC | KSS--- QSVLHSSNNYN YLA | WYQLKPRQ PPKLLIY | W------ ASTRKS | GVPDRFSGRGSG-- TDFTLTISSLQAEDVAIYYC | QQYYS------- ------TPST | FGPGT KVEIK |
| iPS:435 353 | 21-225_148F8 | VK4|B3|J K1 | DIVMTQSLDSLAV SLGERATINC | KSS--- QSALHSSNNYN YLA | WYQQKPGQ PFKLLIY | W------ ASTRES | GVPDRFSGSGSG-- TDFTLTISSLQAEDVAVYYC | QQYYS------- ------IPPT | FGGGT KVEIK |
| iPS:435 369 | 21-225_149A2 | VK4|B3|J K1 | DIVMTQSPDSLAV SLGERATINC | KSS--- QSVLYSPNNNN YLA | WYQQKPGQ PPKLLIY | W------ ASTRES | GVPDRFSGSGSG-- TDFTLTISSLQAEDVAVYYC | QQYYS------- ------TPCS | FGGGT KVEIK |
| iPS:435 373 | 21-225_149E3 | VK4|B3|J K1 | DIVMTQSPDSLAV SLGERATISC | KSS--- QTVLHNSNNHN YFA | WYQQKPGQ PPKLLIY | W------ ASTLRS | GVPDRFSGSGSG-- TDFTLTISSLQAEDVAVYYC | QQYYS------- ------TPPT | FGGGT KVEIK |
| iPS:435 375 | 21-225_149H4 | VK4|B3|J K1 | DIVMTQSPDSLAV SLGERATINC | KSS--- QSVLSSSNDNN YLA | WYQQKPGR PPKLLIY | W------ SSTRES | GVPDRFSGSGSG-- TDFTLTISSLQAEDVAVYYC | HQYYS------- ------YPPT | FGGGT KVEIK |

Figure 51 (Continued)

| | | | | | | | | | |
|---|---|---|---|---|---|---|---|---|---|
| iPS-435 481 | 21-225_154A1 | VK4|B3/J K1 | DIVMTQSPDSLAV SLGERATINC | RSS--- QSVLHSSNNYN YLA | WYQQKPGQ PPKLLIY | W------- ASKRDS | GVPDRFSGSGSG--- TDFTLTISSLQAEDVAVYYC | QQYFS----------SPRT | FGQGT KVEIK |
| iPS-435 557 | 21-225_155B1 | VK4|B3/J K1 | DIVMTQSPDSPAV SLGERATINC | KSS--- QNVLHSSNNNN YLT | WYQQRPGQ PPKLLIY | W------- ASTRES | GVPDRFSGSGSG--- TEFTLTISSLQAEDVAVYYC | QQYYS----------TPPT | FGQGT KVEIK |
| iPS-435 627 | 21-225_162F6 | VK4|B3/J K1 | DIVMTQSPDGLAV SLGERATINC | KSS--- QNVLHSSNNNN YLT | WYQQRPGQ PPKLLIY | W------- ASTRES | GVPDRFSGSGSG--- TEFTLTISSLQAEDVAVYYC | QQYYS----------TPPT | FGQGT KVEIK |
| iPS-435 701 | 21-225_170F6 | VK4|B3/J K1 | DIVMTQSPDSLAV SLGERATINC | KSS--- QSVLHSSNNNN YLA | WYQQRPGQ PPKVLIH | W------- ASTRKS | GVPDRFSGSGSG--- IDFTLTINSSLQAEDVAVYYC | QQYYS----------TPWT | FGQGT KVEIK |
| iPS-435 737 | 21-225_174G5 | VK4|B3/J K1 | DIVMTQSPDSLAV SLGERATINC | KSS--- QSVLHSSNNYN YLT | WYQQKSGQ PPKLLIY | W------- ASTRES | GVPDRFSGSGSG--- TDFTLTISSLQAEDVAVYYC | QQYYR----------TPWT | FGQGT KVEIK |
| iPS-435 751 | 21-225_175D1 | VK4|B3/J K1 | DIVMTQSPDSLAV SLGERATINC | KSS--- QNVLHSSNNNN YLA | WYQQKPGQ PPNLLIY | W------- TSTRES | GVPDRFSGSGSG--- TNFTLTISSLQAEDVAVYYC | QQYYS----------TPPT | FGQGT KVEIK |
| iPS-435 773 | 21-225_177B1 | VK4|B3/J K1 | DIVMTQSPDSLAV SLGERATVNC | KSS--- QSVLHSSNNNN YLT | WYQQKPGQ PPKLLIY | W------- ASTRES | GVPDRFSGSVSG--- TDFTLTISSLQAEDVAVYYC | QQYYS----------SPPT | FGQGT KVEIK |
| iPS-435 801 | 21-225_181E5 | VK4|B3/J K1 | DIMMTQSPDSLAV SLGERATINC | RSS--- QSVLHSSNNNN YLA | WYQQKPGH PPKLLIY | W------- ASTRES | GVPDRFSGSGSG--- TDFTLTISSLQAEDVAVYYC | HQYFI----------TPWT | FGLGT KVEIK |
| iPS-435 841 | 21-225_191D8 | VK4|B3/J K1 | DIVMTQSPDSLAV SLGERATINC | KSS--- QSVLSSSNNYN YLT | WYQQKPGQ PPKLLIY | W------- ASTRKS | GVPDRFSGSGSG--- TDFTLTISSLQADDVAVYYC | QQYYR----------TPPT | FGQGT KVEIK |
| iPS-435 925 | 21-225_190D7 | VK4|B3/J K1 | DIVMTQSPDSLAV SLGERATINC | KSS--- QSVLYSSNNNN YLT | WYQQKPGQ PPKLLIY | W------- ASTRES | GVPDRFSGSGSG--- TDFTLTISSLQAEDVAVYYC | QQYYI----------TPWT | FGQGT KVDIK |
| iPS-436 021 | 21-225_193G4 | VK4|B3/J K1 | DIVMTQSPDSLAV SLGERATINC | KSS--- QSVLYSSNNNN ILT | WYQQKPGQ PPKLLIY | W------- ASTRKS | GVPDRFSGSGSG--- IDFTLTISSLQAEDVAVYYC | QQYYS----------TPWT | FGQGT KVEIK |
| iPS-436 114 | 21-225_196G8 | VK4|B3/J K1 | DIVMTQSPDSLIV SLGERATVNC | KSS--- QSVLHSFNNNN YLA | WYQQKAGH PPKLLIY | W------- ASTRES | GVPDRFSGSGSG--- TDFTLAISSLQAEDVAVYYC | QQYYN----------TPPT | FGQGT KVEIK |
| iPS-436 150 | 21-225_197H4 | VK4|B3/J K1 | DIMMTQSSDSLIV SLGERAIISC | KSS--- QSVLHSFNNNN YLA | WYQQKPGH PPNLLIY | W------- ASTRES | GVPDRFSGSGSG--- TDFTLPISSLQAEDVAVYYC | QQYYS----------TPPT | FGQGT KVEIK |
| iPS-436 154 | 21-225_197C6 | VK4|B3/J K1 | DIMMTQSPDSLAV SLGERAIISC | RSS--- QSVLHSSNNNN YLA | WYQQKPGH PPNLLIY | W------- ASTRES | GVPDRFSGSGSG--- TDFTLTISSLQAEDVAVYYC | QQYYS----------TPPT | FGLGT KVEIK |
| iPS-436 218 | 21-225_200G7 | VK4|B3/J K1 | DIVMTQSPDSPTA SLGERATVKC | KSS--- QSVLYSSNNKN YLA | WYQQKPGQ PPKLLIY | W------- ASTRES | GVPDRFSGSGSG--- TDFTLAISSLQAEDVAVYYC | QQYYN----------TPPT | FGLGT KVEIK |
| iPS-436 272 | 21-225_201F5 | VK4|B3/J K1 | DIVMTQSPESLAV SLGERATINC | IKSS--- QSVLYSSNNKN YLV | WYQQKPGQ PPKLLIY | W------- ASTRES | GVPDRFSGSGSG--- TDFTLTISSLQAEDVAVYYC | QQYYS----------TPPT | FGQGI KVEIK |

Figure 51 (Continued)

| | | | | | | | | |
|---|---|---|---|---|---|---|---|---|
| iPS:436400 | 21-225_213H7 | VK4)B3/J K1 | DIVMTQSPDSLAV SLGERATINC | KSS---QNVLDISNNRN SLG | WFQQKPGQ PPKLLIN | W-------ASTRES | GVPDRFSGSGSG-TDFTLTISSLQTEDVAVYHC | QQYYN----------IPPT | FGRGT KVEIK |
| iPS:436402 | 21-225_213H11 | VK4)B3/J K1 | DIVMTQSPDSLAV SLGERATITC | KSS---QNVLKTSNNRN YLA | WYQQKPGQ PPKVLIY | W-------ASTRES | GVPDRFSGSGSG-TDFTLTISSLQAEDVAVYYC | HQYYS----------IPWT | FGQGT KVEIK |
| iPS:436500 | 21-225_222H3 | VK4)B3/J K1 | DIVMTQSPDSLAV SLGERATINC | KSS---QSVLKSSNHRN YLA | WYQQKPGQ PPQLLIY | W-------ASTRET | GVPDRFSGSGSG-TDFTLTISSLQAEDVSVYSC | QQYSS----------IPWT | FGQGT KVEIN |
| iPS:436520 | 21-225_223G10 | VK4)B3/J K1 | DIVMTQSPDSLAV SLGERATINC | KSS---QSILLSSNNKN YLA | WHQQKPGQ PPKLLIY | W-------ASTRES | GVPDRFSGSGSG-TDFTLTISSLQAEDVAVYYC | LQYFS----------TPWT | FGQGT KVEIK |
| iPS:436544 | 21-225_224H5 | VK4)B3/J K1 | DIVMTQSPDSLAV SLGERATINC | KSS---QSVLYSSNNFN YLT | WYQQKPGQ PPKLLIY | W-------ASTRES | GVPDRFSGSGSG-TDFTLTINSLQAEDVAVYYC | QQYYS----------TPPT | FGQGT KVEIK |
| iPS:436550 | 21-225_224D8 | VK4)B3/J K1 | DIVMTQSPDSLAV SLGERAAINC | KSS---QSVLYSSNNRN YLA | WYQQKPGQ PPKLLIY | W-------SSTRKS | GVPDRFSGSGSG-TDFTLTISSLQAEDVAVYYC | QQYFS----------TPPT | FGQGT KVEIK |
| iPS:436574 | 21-225_225F5 | VK4)B3/J K1 | DIVMTQSPDSLAV SLGERATINC | KSS---QNVLYNSNNNN YLA | WYQQKPGQ PPFNLLIY | W-------ASTRES | GVPDRFSGSGSG-TDFTLTISSLQAEDVAVYFC | QQYYS----------SPFT | FGQGT KVEIN |
| iPS:436586 | 21-225_225F11 | VK4)B3/J K1 | DIVMTQSPDSLAV SLGERATINC | KSS----QSILYSSNNYN YLA | WYQQKPGQ PPKLLIY | W-------ASTRES | GVPDRFSGSGSG-PDFTLTISSLQAEDVAVYYC | QQYYT----------TPPT | FGQGT KVEIK |
| iPS:436600 | 21-225_226F6 | VK4)B3/J K1 | DIVMTQSPDSLAV SLGERATINC | KSS---QSVLHRSNNYN YLA | WYQQKPGQ PPKLLIY | W-------ASTRES | GVPDRFSGSGSG-TDFTLTISSLQAEDVAVYYC | QQYYT----------SPFT | FGQGT KVEIK |
| iPS:436616 | 21-225_226D1 | VK4)B3/J K1 | DIVMTQSPDSLAV SLGERATINC | KSS---QNVLHSSNSNN YLV | WPFQQKPGQ PPKLLIY | W-------ASTRES | GVPDRFGSGSG--TDFTLTISSLQAEDVAVYYC | QQYYK----------TPWT | FGQGT KVEIK |
| iPS:436622 | 21-225_226A1 | VK4)B3/J K1 | DIVMTQSPDSLAV SLGERATINC | KSS---QNVLYSSNNNN YLA | WYQQTPGQ PPKLFY | W-------ASTRKS | GVPDRFSGSGSG-TDFTLTISSLQAEDVAVYYC | QQYYS----------SPFT | FGQGT KVEIK |
| iPS:436638 | 21-225_227C7 | VK4)B3/J K1 | DIVMTQSPDSLAV SLGERATINC | RSS---QIVLSDSNRNN YLA | WYQQKPGQ PPFNLLIY | W-------ASTRES | GVPDRFSGSGSG-TDFTLTISSLQAEDVAVYFC | QQYYS----------SPFT | FGQGT KVEIK |
| iPS:437356 | 21-225_74B1 | VK4)B3/J K1 | DIVMTQSPDFLAV SLGERATINC | KSS---QSVLHRSNNYN YLA | WYQQKPGQ PFKLLIY | W-------ASTRES | GVPDRFSGSGSG-TDFTLTISSLQAEDVAVYYC | QQYYS----------TPWT | FGQGT KVEIK |
| iPS:437361 | 21-225_74C1 | VK4)B3/J K1 | DIVMTQSPDSLAV SLGERASINC | KSS---QSILHSSNNYN YLA | WYQQKPGH PHKLLIY | W-------ASTRES | GVPDRFSGSGYG-TDFLTITSSLQAEDVAVYYC | QQYYS----------TPWT | FGQGT KVEIK |
| iPS:437379 | 21-225_74H2 | VK4)B3/J K1 | DIVMTQSPDSLAV SLGERATINC | KSS---QSVLHSSNNKN YLT | WYQQKPGQ PHKLLIY | W-------ASTRKS | GVPDRFSGSGSG-TDFSLITIGSSLQAEDVAVYYC | QQYYS----------IPPT | FGQGT KVEIK |
| iPS:446094 | 21-225_77E1 | VK4)B3/J K1 | DIVMTQSPDSLAV SLGERATINC | KSS---QTVLHSSNNYN YLA | WYQQKPGQ PPKVLIY | W-------TSTRES | GVHDRFSGSGSG-TDFTLTISSLQAEDVAVYYC | HQYLS----------SPLT | FGQGT KVEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:451116 | 21-225_164A4 | VK4|B3/J K1 | DIVMTQYPDSRAV SLGERATIKC | KSS---QSVLYSSNNKN YLT | WYQQKPGQ PPKLFIY | W------ASTRES | GVPDRFSGSGSG---TDFTLTISSVQAEDVAVYYC | QQYFS------ ---------TPWT | FGQGT KVEIK |
| iPS:451124 | 21-225_74F6 | VK4|B3/J K1 | DIVMTQSPDSLAV SLGERATINC | KSS---QNLSSSNNKN YLT | WYQQKPGQ PPKLLIY | W------TSTRES | GVPDRFSGSGFG---TDFTLTISSLQAEDVAVYYC | QQYFS------ ---------VPLT | FGQGT KVEIK |
| iPS:451127 | 21-225_164A7 | VK4|B3/J K1 | DIVMTQCPDSLAV SLGERATINC | KSS---QSVLHSSNNNN YLA | WYQQKPGQ PHKLLIY | W------TSTRES | GVPDRFSGSGYG---TDFSLTIASLQAEDVAVYYC | QQYYS------ ---------IPLT | FGQGT KVEIK |
| iPS:451129 | 21-225_94D2 | VK4|B3/J K1 | DIVMTQSPDSLAV SLGERATINC | KSS---QSVLHSSNRKN YLI | WYQQKPGQ PPKLLIY | W------ASTRES | GVPDRFSGSGSG---TDFSLTIGSLQHEDVAVYYC | QQYHS------ ---------IPPT | FGHGT KVEIK |
| iPS:451133 | 21-225_95H4 | VK4|B3/J K1 | DIVMTQCPDSLAV SLGERATINC | KSS---QSVLFSSNRYN YLA | WYQQRPGQ PHNLLIY | W------ASTRES | GVPDRFSGSGSG---TDFTLTISSLQAADVAVYYC | QQYHS------ ---------SPLT | FGQGT TVQIK |
| iPS:392786 | 21-225_24E1 | VK4|B3/J K1 | DIVMTQSPDSLAV SLGERATINC | KSS---QSVLYTSNNWN YLT | WYQQKPGQ RPNLLIY | W------ASTRES | GVPDRFSGSGYG---TDFSLTISSLQAEDVAVYYC | QQFYS------ ---------TPPT | FGQGT KVEIK |
| iPS:392886 | 21-225_23A12 | VK4|B3/J K1 | DIVMTQSPDSLAV SLGERATINC | KSS---QSVLYSSNNWN YLA | WYQQKPGQ PPKLLIY | W------TSTRES | GVPDRFSGSGSG---TDFTLTISSLQAEDVAVYYC | QQYYD------ ---------TPPT | FGQGT KVEIK |
| iPS:392928 | 21-225_25A4 | VK4|B3/J K1 | DIVMTQFPDSLAV SLGERATINC | KSS---QSVLYSSHNWN YLA | WYQQKPGQ PPKLLIY | W------ASTRES | GVPDRFSGSGSG---TEFTLTISSLBAEDVAVYYC | QQYYS------ ---------TPPT | FGQGT KVEIK |
| iPS:392960 | 21-225_29E6 | VK4|B3/J K1 | DIVMTQFPDSLAV SLGERATINC | KSS---QSVLYSSHNNY YLT | WYQQKPGQ PHKLLIY | W------ASSRES | GVPSRFSGSGSG---TEFTLTISSLQAEDVAVYYC | QQYYS------ ---------TPPT | FGQGT KVEIK |
| iPS:392992 | 21-225_26C4 | VK4|B3/J K1 | DIVMTQSPDSLAV SLGERATINC | KSS---QSVLYRSNNYN YLA | WYQHKPGQ PPKLLIY | W------ASTRES | GVPDRFSGSGSG---TNFTLTISSLQAEDVAVYYC | QQYYS------ ---------TPPT | FGQGT KVEFK |
| iPS:393368 | 21-225_29H8 | VK4|B3/J K1 | DIVMTQSPDSLAV SLGERATINC | RSS---QTILHSSNNYN YLA | WYQQKPGQ PPKLLIY | W------ASTRES | GVPSRFSGSGSG---TDFTLTISSLQAEDVAVYYC | QQYYS------ ---------TPPT | FGQGT KVEIK |
| iPS:393942 | 21-225_11E5 | VK4|B3/J K1 | DIVMTQSPDSLAV SLGERATINC | KSS---QSVLYSSNNNN YLT | WYQQKPGQ RPKLLIY | W------ASSLQS | GVPDRFSGSGSG---TDFTLTISSLQEDVAVYYC | QQYYS------ ---------TPPT | FGQGT KVEIK |
| iPS:398506 | 21-225_23G12 | VK4|B3/J K1 | DIVMTQSPDSLAV SLGERATINC | KSS---QSILFSSNNNN YLA | WYQQKPGQ PPFLLIY | W------ASTRES | GVPDRFSGSGSG---TDFTLTISSLQAEDVAVYFC | QQYSS------ ---------TPWT | FGQGT KVEIK |
| | Germline | VK1|A30|JK2 | DIQMTQSPSSLSA SIGDRVTITC | RAS---QGIR------NDLG | WYQQKPGK APKRLIY | A------ASSLQS | GVPSRFSGSGSG---TEFTLTISSLQPEDFATYYC | LQHYS------ ---------YPRS | FGQGT KLEIK |
| iPS:426114 | 21-225_28H2 | VK1|A30/ JK2 | DIQMTQSPSSLSA SIGDRVTITC | RAS---QGIR------NDLG | WYQQKPGK APKRLIY | A------ASSLQS | GVPSRFSGSGSG---TEFTLTISSLQPEDFATYYC | LQHYS------ ---------YPRS | FGQGT KLEIK |
| iPS:426116 | 21-225_29E2 | VK1|A30/ JK2 | DIQMTQSPSSLSA SVGDRVTITC | RAS---QAIR------NDLG | WYQQRPGK APKRLIY | A------ASSLQS | GVPSRFSGSGSG---TEFLLTISSLQPEDFATYYC | LQHYN------ ---------YPRS | FGQGT KLEIK |
| iPS:434231 | 21-225_61F2 | VK1|A30/ JK2 | DIQMTQSPSSLSA SVGDRVTYTC | RAS---QGIR------DDLG | WYQQKPGK APERLIY | A------ASSLQS | GVPSRFSGSGSG---TEFTLTISSLQPEDFATYYC | LQHYS------ ---------YPRS | FGQGT KLEIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| PS:435 401 | 21-225 150E2 | VK1A30/JK2 | DIQMTQSPSSLSA SVGDRVTIISC | RAS--QGIG------NDLG | WYQQKPGK APTRLIY | A------ASSLQS | GVPSRFSGSGSG--- TEFTLTISSLQPADFATYC | LQHYS-------FPYS | FGGGT KLEIK |
| PS:435 445 | 21-225 152F7 | VK1A30/JK2 | DIQMTQSPSSLSA SVGDRVTIITC | RAS--QGIR------NDLG | WYQQKPGK APKRLIY | TSSLQS | GVPSRFSGSGSG--- TEFTLTISSLQPEDFATYC | LQHYN-------FPYS | FGGGT KLEIK |
| PS:435 763 | 21-225 176H1 | VK1A30/JK2 | DIQMTQSPSSLSA SVGDRVTIITC | RAS--QGIR------NDLG | WYQQKPGK APNRLIY | A------ASSLQS | GVPSRFSGSGSG--- TEFTLTISSLQREDFATYC | LQHNS-------YPRS | FGGGT KLEIK |
| PS:435 767 | 21-225 177B4 | VK1A30/JK2 | DIQMTQSPSSLSA SVGDRVTIITC | RAS--QGIR------NDLG | WYQQKPGK APKRLIY | A------ASSLQS | GVPSRFSGSGSG--- TEFTLTISSLQPEDFATYC | LQHYS-------FPRS | FGGGT KLEIK |
| PS:392 974 | 21-225 26A11 | VK1A30/JK2 | DIQMTQSPISLSA SVGDRVTIITC | RAS--QAIR------NDLG | WYQQRPGK APKRLIY | A------ASSLQS | GVPSRFSGSGSG--- TEFTLTISSLQPEDFATYC | LQHYN-------YPRS | FGGGT KLEIR |
| PS:393 046 | 21-225 25A12 | VK1A30/JK2 | DIQMTQSPSSLSA SVGDRVTVTC | RAS--QAIR------DDLG | WYQQRPGK APKRLIY | A------ASSLQS | GVPSRFSGSGSG--- TEFTLTISSLQPEDFATYC | LQHYN-------YPRS | FGGGT KLEIK |
| | Germline | | | | | | | | |
| | VK1O12/JK4 | | | | | | | | |
| PS:426 118 | 21-225 7A10 | VK1O12/JK4 | DIQMTQSPSSLSA SVGDRVTIITC | RAS--QNIY------SYLN | WYQQKPGK APKLVIY | S------TSSLQS | GVPSRFSGSGSG--- TDFSLTISNLQPEDFSTYC | QQSYS-------PPLT | FGGGT KVEIR |
| PS:426 124 | 21-225 32D6 | VK1O12/JK4 | DIQMTQSPSSLST SVGDRVTIITC | RAS--QNII------SYLN | WYQQKPGK APKLLMY | V------ASRLQS | GVPSRFSGSGSG--- TDFFLTISSLQAEDFATYC | QQSYS-------TPYT | FGGGT KVAIK |
| PS:451 135 | 21-225 64A11 | VK1O12/JK4 | DIQMTQSPFSLSA SVGDRITIITC | RAS--RSVS------RYLN | WYQQILGK ALKLLIS | V------ASRLQS | TDFFLTISSVQREDFATYC | QQSDS-------FPLT | FGGGT KVEIK |
| PS:434 011 | 21-225 48B10 | VK1O12/JK4 | DIQMTQSPSSLSA SVGDRVTIITC | RAS--QSIR------KYLN | WYQKTPGK APKLLIY | A------ASSLQS | GVPSRFSGSGSG--- TDFFLTISSVQREDFATYC | QQTYS-------NPLT | FGGGT KVEFT |
| PS:434 015 | 21-225 48F12 | VK1O12/JK4 | DIQMTQSPSSLSA SVGDRVTIITC | RAS--QSIR------KYLN | WYQQKTPGK APKLLIY | A------ASSLQS | GVPSRFSGSGSG--- TDFFLTISSVQPEDFATYC | QQTYS-------NPLT | EVEIK |
| PS:434 017 | 21-225 48G12 | VK1O12/JK4 | DIQMTQSPSSLSA SVGDRVTIITC | RAS--QSIR------KYLN | WYQKTPGK APKLLIY | A------ASSLQS | GVPSRFSGSGSG--- TDFFLTISSVQPEDFATYC | QQTYS-------NPLT | FGGGT EVEIT |
| PS:434 165 | 21-225 50F2 | VK1O12/JK4 | DIQMTQSPSSLSA SVGDRVTIITC | RAS----------SYLN | WYQQKPGK APKLLIY | V------ASSFQS | GVPSRFSGSGSG--- TDFFLTISSLQPDDFATYC | QQSYS-------PPLT | FGGGT KVEIK |
| PS:434 191 | 21-225 56B6 | VK1O12/JK4 | DIQMTQSPSSLSA SVGDRVTIITC | RAS--QSIP------RYLN | WYQQKPGR APKLLIF | A------ASSFQS | GVPSRFSGSGSG--- TDFFLTISSVQREDFATYC | QQTYS-------PPLT | FGGGT KVEIK |
| PS:434 247 | 21-225 62D2 | VK1O12/JK4 | DIQMTQSPSSLSA SVGDRVTIITC | RAS--QSII------SYLN | WYQQKPGK APKLLIS | A------ASSLQS | GVPSRFSGSGSG--- TDFFLTISSLQPEDFATYC | QQTYS-------PPLT | FGGGT KVEIK |
| PS:434 335 | 21-225 63C10 | VK1O12/JK4 | DIQMTQSPSSLSI SVGDRVTIITC | RAS--QSIF------SYLH | WYQQKLIS APKLLIS | A------ASSLQS | GVPSRFSGSGSG--- TDFFLTISSLQPEDFATYC | QQTYS-------PPLT | FGGGT KVEIK |
| PS:434 341 | 21-225 64F7 | VK1O12/JK4 | DIQMTQSPSSLSA SVGDRVTIITC | RAS--QNIK------KYLN | WYQQKPGK APKFLIY | G------ASSLQS | GVPSRFSGSGSG--- TDFFLTISSLQPEDFAAYC | QQSYN-------ISFT | FGGGT KVELK |
| PS:435 295 | 21-225 146H1 | VK1O12/JK4 | DIQMTQSPSSLSA SVGDRVTIITC | RAS----------DYLN | WYQQKPGK APKVLIY | T------TSSLQS | GVPSRFSGSGSG--- TDFFLTISSLQPEDFATYC | QQSY--------STPT | FGGGT KVEIK |
| PS:435 307 | 21-225 146E9 | VK1O12/JK4 | DIQMTQSPSSLSA SVGDRVTIITC | RAS--QSIS------QSLN | WYQLKPGK APKVLIY | T------ASSLQS | GVPSRFSGSGSG--- TDFFLTISSLQPEDFATYC | QQSY--------STPT | FGGGT KVEIK |
| PS:435 347 | 21-225 148C4 | VK1O12/JK4 | DIQMTQSPSSLSA SVGDRVTIITC | RAS----------NYLN | WYQQKPGK APKVLIY | T------TSSLQS | GVPSRFSGSGSG--- TDFFLTISSLQPEDFTTYC | QQSY--------STPT | FGGGT KVEIK |
| PS:435 355 | 21-225 148H9 | VK1O12/JK4 | DIQMTQSPSSLSA SVGDRVTIITC | RAS--QSIS------NYLN | WYQQKPGK APKVLIY | I------ASSLQS | GVPSRFSGSGSG--- TDFFLTISSLQPEDFATYC | QQSY--------STPT | FGGGT KVEIK |

Figure 51 (Continued)

| ID | V/J | Seq1 | Seq2 | Seq3 | Seq4 | Seq5 | Seq6 | Seq7 | Seq8 |
|---|---|---|---|---|---|---|---|---|---|
| iPS-435_371 | VK1|O12/JK4 | DIQMTQSPSSLSA SVGDRVTITC | RAS--QSIS ---SYLN | WYQQKPGK APKVMIY | T------ ASSLQS | GVPSRFSGSGSG-- TDFTLTINSSLQPEDFATYYC | QQSY---------- | ----SIPT | FGGGT KVEIK |
| iPS-435_415 | VK1|O12/JK4 | DIQMTQSPSSLSA SVGDRVTITC | RAS--QSIS ---SYLN | WYQQKPGK APKLLIY | A------ ASSLQS | GVPSRFSGSGSG-- TDFTLTISSLQPEDFATYFC | QQSY---------- | ----SIYT | FGGGS KVEIK |
| iPS-435_419 | VK1|O12/JK4 | DIQMTQSPSSLSA SVGDRVTITC | RAS--QSIS ---DYLN | WYQQKPGK APKVLIY | T------ TSSLQS | GVPSRFSGSGSG-- TDFTLTISSLQPEDFATYYC | QQSF---------- | ----STPT | FGGGT KVEIK |
| iPS-435_425 | VK1|O12/JK4 | DIQMTQSPSSLSA SVGDRVTITC | RAS--QSIS ---NFLN | WYQQKPGK APKLLIY | T------ ASSLES | GVPSRFSGSESG-- TDFTLTISSLQPEDFATYYC | QQSY---------- | ----STPT | FGGGT RVEIK |
| iPS-435_431 | VK1|O12/JK4 | DIQMTLSPSSLSA SVGDRVTITC | RAS--QSIS ---DYLN | WYQLKPGK APKVLIY | T------ TSSLQS | GVPSRFSGSGSG-- TDFTLTISSLQPEDFATYFC | QQSY---------- | ----STPT | FGGGT KVEIK |
| iPS-435_439 | VK1|O12/JK4 | DIQMTQSPSSLSA SVGDRVTITC | RAS--QSIS ---SYLN | WYQQKPGK APKVLIY | T------ ASSLQS | GVPSRFSGSGSG-- TDFTLTIISSLQPEDFATYYC | QQSY---------- | ----STPT | FGGGT KVEIK |
| iPS-435_455 | VK1|O12/JK4 | DIQMTQSPSSLSA SVGDRVTITC | RAS--QSIS ---DYLN | WYQQKPGK APKVLIY | T------ TSSLQS | GVPSRFSGSGSG-- TDFTLTISSLQPEDFATYFC | QQSY---------- | ----STPT | FGGGT KVEIK |
| iPS-435_487 | VK1|O12/JK4 | DIQMTQSPSFSLSA SVGDRVTITC | RAS--QSIS ---SYLN | WYQLKPGK APKVLIF | T------ ASSLQS | GVPSRFSGSGSG-- TDFTLTISSLQPEDFATYYC | QQSY---------- | ----STPT | FGGGT RVEIK |
| iPS-435_503 | VK1|O12/JK4 | DIQMTQSPSSLSA SVGDRVTITC | RAS--QSIS ---SYLN | WYQQKPGK APKLLIY | T------ ASSLQS | GVPSRFSGSGSG-- TDFTLTISSLQPEDFATYFC | QQSY---------- | ----SAPT | FGGGT KVEIK |
| iPS-435_563 | VK1|O12/JK4 | DIQLTQSPSSLSA SVGDRVTITC | RAS--QSIS ---KYLN | WYQQKPGK APELLIY | A------ TSNLQS | GVPSRFSGSGSG-- TDFTLTISTLQPEDFVTYYC | QQSYS--------- | ----LPVT | FGGGT KVEIK |
| iPS-436_110 | VK1|O12/JK4 | DFQMIQSPSSLSA SVGDRVTITC | RAS--QRIH ---SYLN | WYQQKPGK APKLLIY | T------ ASSLQG | GVPSRFSGSGSG-- TDFTLTISSLQPEDFATYYC | QQSYG--------- | ----SPLI | FGGGT KVEIK |
| iPS-436_244 | VK1|O12/JK4 | DIQMTQSPSSLSA SVGDRVTITC | RAS--HNIN ---SYLN | WYQQKSGK APKLLIY | A------ ASSLQS | GVPSRFSGSGSG-- TDFTLTFSSLQPEDFATYYC | QQSYS--------- | ----FPLI | FGGGT KVEMR |
| iPS-436_262 | VK1|O12/JK4 | DIQMTQSPSFSA SVGDRVTITR | RAS--HNIN ---SYLN | WYQQKSGK APKLLIY | A------ ASSLQS | GVPSRFSGSGSG-- TDFTLTFSSLQPEDFATYYC | QQSYS--------- | ----FPLI | FGGGT KVEMR |
| iPS-436_276 | VK1|O12/JK4 | DIQMTLSPSSPSA FVGDRVTITR | RAS--HNIN ---SYLN | WYQQKSGK APKLLIY | A------ ASSLQS | GVPSRFSGSGSG-- TDFTLTFSSLQPEDFATYYC | QQSYS--------- | ----FPLI | FGGGT KVEMR |
| iPS-436_280 | VK1|O12/JK4 | DSQMTQSPSSLSA SVGDRVTITC | RAS--RSVH ---TYLN | WYQQKPGK APKVLIY | G------ ASSLQR | GVPSRFSGSGSG-- TDFTLTISSLQPEDVATYYC | QQSYS--------- | ----SPLT | FGGGT KVELQ |
| iPS-436_312 | VK1|O12/JK4 | DIQMTQSPSSPSA FVGDRVTITR | RAS--HNIN ---SYLN | WYQQKPGK APKVLIY | A------ ASSLQG | GVPSRFSGSGSG-- TDFTLTISSLQPEDFATYYC | QQSYS--------- | ----SPLT | FGGGT KVEMR |
| iPS-436_316 | VK1|O12/JK4 | DIQMTQSPSSPSA SVGDRVTITR | RAS--HNIN ---SYLN | WYQQKSGK APKLLIC | A------ ASSLQS | GVPSRFSGSGSG-- TDFTLTFSSLQPEDFATYYC | QQSYS--------- | ----FPLI | FGGGT KVEMR |
| iPS-436_338 | VK1|O12/JK4 | DIQMTQSPSSPSA FVGDRVTITR | RAS--HNIN ---SYLN | WYQQKSGN APKLLIY | A------ ASSLQS | GVPSRFSGSGSG-- TDFTLTFSSLQPEDFATYYC | QQSYS--------- | ----FPLI | FGGGT KVEMR |
| iPS-436_344 | VK1|O12/JK4 | DIQMTQSPSSPSA SVGDRVTITR | RAS--HNIN ---SYLN | WYQQKSGN APKLLIY | A------ ASSLQS | GVPSRFSGSGSG-- TDFTLTFSSLQPEDFATYYC | QQSYS--------- | ----FPLI | FGGGT KVEMR |
| iPS-436_358 | VK1|O12/JK4 | DIQMTQSPSSLSA SVGDRVTITC | RAS--HNIN ---SYLN | WYQQKSGK APKLLIY | A------ ASSLQS | GVPSRFSGSGSG-- TDFTLTFSSLQPEDFATYYC | QQSYS--------- | ----FPLI | FGGGT KVEMR |

Figure 51 (Continued)

| | | | | | | | | |
|---|---|---|---|---|---|---|---|---|
| iPS:437 282 | 21-225_207C9 | VK1|O12/ JK4 | DIQMTQSPSSLSA SVGDRVTITC | RAS---QRFS---NYLN | WYQQKPGK APKLLIY | T------ ASSLQS | GVPSRFSASVSG--- TDFTLTISSLQPEDFATYYC | QQSYS------IPLT | FGGGT KVEIK |
| iPS:392 636 | 21-225_17A6 | VK1|O12/ JK4 | DIQMTQSPSSLSA SVGDRVTITC | RAS---QTIS---NYLN | WYHQKPGK APKLLIY | A------ ASSLQS | GVPSRF------ TDFTLTISSLQPEDFATYYC | QQSHT------SPLT | FGGGT KVEIK |
| iPS:392 648 | 21-225_16D11 | VK1|O12/ JK4 | DIQMTQSPSSLSA SVGDRVTITC | RAS---QTIS---NYLN | WYHQKPGK APKLLIY | A------ ASSLQS | GVPSRFSGGSG--- TDFTLTISSLQPEDFATYYC | QQSHS------SPLT | FGGGT KVEIK |
| iPS:392 664 | 21-225_20F6 | VK1|O12/ JK4 | DIQMTQSPSSLSA SVGDRVTITC | RAS---QSII---TYLN | WYQQKPGK APKVLIH | T------ ASSLQS | GVPSRFSGGSG--- TDFTLTISSLQPEDFATYYC | QQTYS------PPLT | FGGGT KVEIK |
| iPS:392 738 | 21-225_18G4 | VK1|O12/ JK4 | DIHMTQSPSSLSA SVGDRVTITC | RAS---QSII---SYLN | WYQQKPGK APKVLIY | T------ ASSLQT | GVPSGFSGGSG--- TDFTLTISSLQPEDFATYYC | QQTYS------PPLT | FGGGT KVEIK |
| iPS:392 798 | 21-225_22C7 | VK1|O12/ JK4 | DIQMTQSPSSLSA SVGDRVTITC | RAS---QNII---SYLN | WYQQKPEK APKLLIH | I------ ASSLQS | GVPSRFSGGSG--- TDFTLTISSLQPEDFATYYC | QQTYS------TPLT | FGGGT KVEIK |
| iPS:392 922 | 21-225_30G4 | VK1|O12/ JK4 | DIQMTQSFPPSLST SVGDRVTITC | RAT---QNIF---SYLN | WHQQKPGK APKLLIH | T------ ASSLQG | GVFSRFSGGSG--- TDFTLTITISMQPEDFSTYYC | QLSYS------PPYT | FGGGT KVEIK |
| iPS:393 002 | 21-225_30G1 | VK1|O12/ JK4 | DIQMTQSPSSLSA SVGDRVTITC | RAS---QNIY---SYLN | WYQQKPGK APKLLIY | A------ ASSLHS | GVPSRFSGGSG--- TDFTLTISSLQPEDFSTYYC | QQSYS------PPYT | FGGGT KVEIK |
| iPS:393 042 | 21-225_31F1 | VK1|O12/ JK4 | DIQMTQSPSSLSA SVGDRVTITC | RAS---QRIS---SYLN | WYQQKPGK APKLLIF | T------ ASSSQS | GVPSRFSGGSG--- TDFTLTISSLQPEDFATYYC | QQSYI------TPLT | TVEIR FGGGT |
| iPS:393 066 | 21-225_34D3 | VK1|O12/ JK4 | DIQMTQSPSSLSA SVGDRVTITC | RAS---QNIY---SYLN | WYQQKPGK DPKLLIY | T------ ASSLHS | GVPSRFSGGSG--- TDFTLTISSLQPEDFATFYC | QQSYS------TPLT | FGGGT KVEIK |
| iPS:393 082 | 21-225_34C11 | VK1|O12/ JK4 | DIQMTQFPSSLST SVGDRVTITC | RAS---QNIR---NFLN | WYQQKPEK DPKLQIY | G------ ASTLQS | GVFSRFSGSFG--- TDFTLTISSLQPKDFATYYC | QQTCS------TFLT | FGGGT KVEIK |
| iPS:393 092 | 21-225_33C12 | VK1|O12/ JK4 | DIQMTQSPSSLST SVGDRVTITC | RAS---QSII---SYLN | WYQQKPGK APKLLIY | V------ ASSLQG | GVPSRFNGGSG--- TYFFLTISSLQPEDFATYYC | QQSYS------TPYT | FGGGT KMEIK |
| iPS:393 100 | 21-225_36B8 | VK1|O12/ JK4 | DIQMTQSPSSLST SVGDRVTITC | RAS---QSII---SYLN | WYQQKPGK APKLLIF | V------ ASSLQS | GVPSRFSGGSG--- TDFTLTISSLQPEDFATYYC | QQSYS------TPYT | FGGGT KMEIK |
| iPS:393 108 | 21-225_34G11 | VK1|O12/ JK4 | DIQMTQSPSSLSA SVGDRVTITC | RAS---QNIN---RYLN | WYQGRPGK APKLLIY | G------ ASSLQS | GVPSRFSGGSG--- TDFTLTISTLQPEDFATYYC | QQTYI------TFLT | FGGGT RVEIN |
| iPS:393 122 | 21-225_33B2 | VK1|O12/ JK4 | DIQMTQSPSSLST SVGDRVTITC | RAS---QSII---SYLN | WFQQKPGK APKLMIY | A------ ASSSQS | GVPSRFSGGSG--- TDFTVTISSLQPEDFATYYC | QQSYS------PPFT | FGGGA KVEID |
| iPS:393 134 | 21-225_34C2 | VK1|O12/ JK4 | DIQMTQSPSSLST FVGDRVTITC | RAS---QRII---SYLN | WYQQKPGK APKLLIF | V------ ASSLQS | GVPSRFSGGSG--- TYFFLTISSLQPEDFATYYC | QQSYS------TPYT | FGGGT KMEIK |
| iPS:393 136 | 21-225_34D8 | VK1|O12/ JK4 | DIQMTQSPSSLST SVGDRVTITC | RAS---QIII---SYLN | WYQEKPGK APKLLIY | V------ ASSLQS | GVPSRFSGSSG--- TDFTLTISSLQPEDFATYYC | QQNYS------PPLT | FGGGT KVEIK |
| iPS:393 840 | 21-225_3F8 | VK1|O12/ JK4 | DFQMTQSPSSLSA SVGDRVTITC | RAS---QSIL---SYLN | WYRQKPGR APQVLIH | T------ ISSLQS | TVFFLTISSLQPEDFATYYC TVFFLTISSLQPEDFATYYC | QQTYS------TFLT | FGGGT RVEIN |
| iPS:393 844 | 21-225_3G7 | VK1|O12/ JK4 | DIQMTQSPSSLSA SVGDRVTITC | RAS---QNIY---RYLN | WYQGRPGK APKLMIY | A------ ASSSQS | GVPSRFSGGSG--- TDFTLTISSLQPEDFATYYC | QQSYS------PPFT | FGGGA KVEID |
| iPS:393 852 | 21-225_12A10 | VK1|O12/ JK4 | DVQMTQSPSSLSA SAGDRVTITC | RAS---QNIY---SYLN | WYQQKPGK APKLLIH | V------ ASSLQS | GVPSRFSGGSG--- ADFTLTINSLQPEDFATYYC | QQSYS------PPLT | FGGGT KVEIK |
| iPS:393 900 | 21-225_10E12 | VK1|O12/ JK4 | DIQMTQSPSSLSA SVGDRVTITC | RAS---QNIY---SYLN | WYQEKPGK APKLLIY | A------ ISSLQS | GVPSRFSGGSGG--- TDFTLTISSLQPEDFATYYC | QQNYS------PPLT | FGGGT KVEIK |
| iPS:393 920 | 21-225_1H12 | VK1|O12/ JK4 | DIQMTQSPSSLSA SVGDRVTITC | RAS---QTII---RYLN | WYQEKPGK APKLLIY | T------ ASSLQS | GVPSRFSGSDSG--- TDFTLTISSLQPEDFATYYC | QQSYS------PPLT | FGGGT KVEIK |
| iPS:393 926 | 21-225_4G4 | VK1|O12/ JK4 | DIQMTQSPSSLAA SVGDRVTITC | RAS---QTII---SYLN | WYQQKPGK APKLLIH | T------ ASSLQS | GVPSRFSGGSG--- TDFTLTISSLQPEDFATYYC | QQTYS------TPLT | FGGGT KVEIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:393 930 | 21-225_7E11 | VK1/O12/ JK4 | DIQMTQSPSSLSA SVGDRVTIAC | RAS--QNI I------SYLN | WYQQKPGK APKFLIY | T------ ASSLQS | GVPSRFSGSGSG--- TDFTLTISSLQPEDFATYYC | QQTYS------ | ------TPLT FGGGT KVEIK |
| iPS:393 932 | 21-225_10F5 | VK1/O12/ JK4 | DIQMTQSPSSLSA SVGDRVTITC | RAS--QNIY------RYLN | WYQEKPGR APKLLIY | T------ ASSLQS | GVPSRFSGSGSG--- TDFTLTISSLQPEDFATYYC | QQSYS------ | ------PPLT FGGGT KVEIK |
| iPS:393 964 | 21-225_6G1 | VK1/O12/ JK4 | DIQMTQSPSSLSA SVGDRVTITC | RTS--QNII------SYLN | WYQQKPGK APKVLIY | T------ ASNLQT | GVPSGFSGSGSG--- TDFTLTISSLQPEDFATYYC | QQPHS------ | ------PPLT FGGGT KVEIK |
| iPS:394 012 | 21-225_15A3 | VK1/O12/ JK4 | DIQMTQSPSSLSA SVGDRVTITC | RAS--QSII------SYLN | WYLQKPGK APKFLIY | T------ ASSLQS | GVPSRFSGSGSG--- TDFTLTISSLQPEDFATYYC | QQTYS------ | ------TPLT FGGGT KVEIK |
| iPS:394 016 | 21-225_13D4 | VK1/O12/ JK4 | DIQMTQSPSSLSA SVGDRVTITC | RAS--QSIF------SYLN | WYQQKPGK APKLLIC | T------ ASSLQN | GVPSRFSGSGSG--- TDFTLTISSLQPEDFATYYC | QQTYS------ | ------LPLT FGGGT KVEIK |
| iPS:394 083 | 21-225_16E6 | VK1/O12/ JK4 | DIQMTQSPSSLSA SVGDRVTITC | RAS--QSII------SYLN | WYQQKPGK APKFLIY | T------ TSSLQS | GVPSRFSGSGSG--- TDFTLTISSLQPEDFATYYC | QQTYS------ | ------TPLT FGGGT KVEIK |
| iPS:398 480 | 21-225_17G4 | VK1/O12/ JK4 | DIQMTQSPSSLSA SAGDRVTITC | RTS--QNIS------NYLN | WYQOKPGK APKLLIY | V------ ASSFPS | TEFTLTISSLQPEDFATYYC | QQSNF------ | ------FPLT FGGGT KVEII |
| iPS:398 486 | 21-225_19A1 | VK1/O12/ JK4 | DIQMTQSPSSLSA SVGDRVTITC | RAS--HTII------SYLN | WYQQKPGK APKFLIY | A------ TSNLQS | GVPSRFSGSGSG--- TDFFTISSLQPEDFAIYYC | QQSYN------ | ------FPLI FGGGT KVEIK |
| Germline | | VK2A18/JK 4 | DIVMTQTPLSLSV TPGQPASISC | KSS---QSLLHSD-GKTYLY | WYLQKPGQ PPQLLIY | E------ VSSRFS | GVPDRFSGSGSG--- TDFTLKISRVEAEDVGVYYC | MQSIH------ | ------LPLT FGGGT KVEIK |
| iPS:451 139 | 21-225_71A6 | VK2A18/ JK4 | DIVMTQTPLSLSV TPGQPASISC | KSS---QSLLRSD-GKTHLY | WYLQKPGQ FPPLLIY | E------ VSNRFS | GVSDRFSGSGSG--- TDFTLKISRVEAEDVGVYYC | MQSKQ------ | ------LPLT FGGGT KVEFK |
| iPS:433 937 | 21-225_44B10 | VK2A18/ JK4 | HIVMTQTPLSLSV TPGQPASISC | KSS---QSLLHSE-GRTYLY | WYLQKPGQ PPQLLIY | E------ ISHRFS | GVPDRFSGSGSG--- TDFTLKISRVEAEDVGVYYC | MQSIH------ | ------LPFT FGGGT KVEIK |
| iPS:433 979 | 21-225_46B9 | VK2A18/ JK4 | DIVMTQTPLSLSV TPGQPASISC | KSS---QSLLHSE-GKTYLY | WYLQKPGQ PPQLLIY | E------ VSYRFS | GVPDRFSGSGSG--- TDFTLKISRMEAEDVGVYYC | MHSIQ------ | ------YPLT FGGGT KVEIQ |
| iPS:434 201 | 21-225_59A12 | VK2A18/ JK4 | DIVMTQTPLSLSV TPGQPASISC | KSS---QSLQHGE-GKTYLY | WYVQKPGQ PPQLLIY | E------ VSNRFS | GVPDRFSGSGSG--- TDFTLKISRVEVEDVGVYYC | MQSTQ------ | ------LPLT FGGGT KVEIK |
| iPS:434 205 | 21-225_60G2 | VK2A18/ JK4 | DIVMTQTPLSLSV TPGQPASISC | KSS---QSLLHSE-GKTYLY | WYLQKPGQ PPQLLIY | E------ VSNRIS | GVPDRFSGSGSG--- TDFTLKISRVEAEDVGVYYC | MQSIQ------ | ------LPLT FGGGT KVEIK |
| iPS:434 223 | 21-225_60C12 | VK2A18/ JK4 | DIVMTQTPLSLSV TPGQPASISC | KSS---QSLLHSE-GKTYLY | WYLQKPGQ PPQFLIY | E------ VSYRFS | GVPDRFSGSGSG--- TDFTLKISRVEAEDVGIYYC | MQSIK------ | ------YPLT FGGGT KVEIK |
| iPS:434 233 | 21-225_61B3 | VK2A18/ JK4 | DIVMTQTPLSLSV TPGQPASISC | KSS---QSLLHSE-GKTYLY | WYLQKPGQ PPQLLIY | E------ VSNRFS | GVPDRFSGSGSG--- TDFTLKISRVEAEDVGVYYC | MQSTQ------ | ------LPLT FGGGT KVEIK |
| iPS:434 303 | 21-225_58H11 | VK2A18/ JK4 | DIVMTQTPLSLSV TPGQPASISC | KSS---QSLLHSE-GKTYLY | WYVQKPGQ FPPLLIY | E------ VSYRFS | GVPDRFSGSGSG--- TDFTLKISRVEAEDVGVYYC | MQSIQ------ | ------LPLT FGGGT KVEIK |
| iPS:435 349 | 21-225_148F5 | VK2A18/ JK4 | DIVMTQTPLSLSV TPGQPASISC | KSS---QSLLHSE-GKTYLY | WYLQKPGQ PPQLLIY | E------ VSYRVS | GVPDRFSGSGSG--- TDFTLKISRVEAEDVGVYFC | MQSIQ------ | ------LPLT FGGGT KVEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:435_359 | 21-225_148H10 | VK2|A18/JK4 | DIVMTQTPLSLSV TPGQPASISC | KSS---QSLLHSE-GKTYLY | WYLQKPGQ PPQLLIY | E------VSYRVS | GVPDRFSGSGSG-- TDFTLKISRVEAEDVGVYYC | MQSIQ------LPLT | FGGGT KVEIK |
| iPS:435_417 | 21-225_150D1 | VK2|A18/JK4 | DIVMTQTPLSLSV TPGQPASISC | KSS---QSLLHSE-GKTYLY | WYLQKPGQ PPQLLIY | E------VSYRFS | GVPDRFSGSGSG-- TDFTLKISRVEAEDVGVYYC | MQGIQ------LPLT | FGGGT KVEIK |
| iPS:435_469 | 21-225_153G9 | VK2|A18/JK4 | DIVMTQTPFSLSV TPGQPASISC | KSS---QSLLHSD-GKTYLY | WYLQKPGQ PPQFLIY | E------VSNRFS | GVPDRFSGSGSG-- TDFTLKISRVEADDVGVYYC | MQNIK------YPLT | FGGGT KVEIK |
| iPS:435_733 | 21-225_173C1 | VK2|A18/JK4 | DIVMTQTPLSLSV TPGQPASISC | KSS---QSLLHSE-GKTYLY | WYLQKPGQ PPQLLIY | E------VSHRFS | GVPDRFSGSGSG-- TDFTLKISRVEAEDVGVYYC | MQSI-------QLLT | FGGGT KVEIK |
| iPS:435_785 | 21-225_179C2 | VK2|A18/JK4 | DIVMTQTPLSLSV TPGQPASISC | KSS---QSLLHSE-GKTYLY | WYLQKPGQ PPQLLIY | E------VSHRFS | GVPDRFSGSGSG-- TDFTLKISRVEAEDVGVYYC | MQSI-------QVLT | FGGGT KVEIK |
| iPS:392_618 | 21-225_16F10 | VK2|A18/JK4 | DIVMTQTPLSLSV IPGQPASISC | KSS---QSLLHSD-GKTHLN | WYLQKPGQ PPQLLIY | E------VSYRFS | GVPDRFSGSGSG-- TVFTLEISRVEAADVGVYYC | FQSIQ------LPLT | FGGGT KVEIK |
| iPS:392_860 | 21-225_22H8 | VK2|A18/JK4 | DIVMTQTPLSLSV TPGQPASISC | KSS---QSLLHSD-GKTYLY | WYLQKPGH PPQLLIY | E------VSNRFS | GVPDRFSGSGSG-- TDFTLKISRVEAEDVGIYYC | MQSIQ------LPLS | FGGGI KVEIN |
| iPS:392_888 | 21-225_25A2 | VK2|A18/JK4 | DIVMNQTPLSLSV TPGQPASISC | KSS---QSLLHSE-GKTYLY | WYLQKPGQ PPQLLIY | E------ISNRFS | GVPARLSGSGSG-- TDFTLKISRVEAEDVGVYYC | MQSTQ------FPLT | FGGGT KVEIK |
| iPS:392_938 | 21-225_29H4 | VK2|A18/JK4 | DIVMTQTPLSLSV TPGQPASISC | KSS---QSLLHSD-GKTYLY | WYLQKPGQ PPQLLIF | E------VSHRFS | GLPDRFSGSGSG-- TDFTLKISRVEAEDVGVYYC | MQSIQ------HPFT | FGGGT RVEIK |
| iPS:392_994 | 21-225_26G11 | VK2|A18/JK4 | DIVMTQTPLSLSV TPGQPASISC | KSS---QTLLHGE-GKTYLY | WYLQKPGQ PPHLLIY | E------VSNRFS | GVPDRFSGSGSG-- TDFTLKISRVEAEDVGIYYC | MQSIK------LPLI | FGGGT KVEIK |
| iPS:393_012 | 21-225_26G7 | VK2|A18/JK4 | DILMTQTPLSLSV TPGQPASISC | KSS---QSLLHSE-GKTYLY | WYLQKPGQ PPQFLIY | E------VSHRLS | GVPDRFSGSGSG-- TDFTLKISRVEAEDVGVYYC | MQSIQ------LPLT | FGGGT KVEIK |
| iPS:393_144 | 21-225_34D2 | VK2|A18/JK4 | DIVMTQTPLSLSV TPGQPASISC | KSS---QSLLHSD-GKTYLY | WYLQKPGQ PPQLLIY | E------VSNRFS | GVPDRFSGSGSG-- TDFTLKISRVEAEDVGVYYC | MQSK-------QLPP | FGGGT KVEIR |
| | VK1|L1|K3 | Germline | | | | | | | |
| iPS:451_143 | 21-225_66H11 | VK1|L1/JK3 | DIQMTQFPSSLFA FVGDRVTITC | PAS---QGIS-------NYLA | WFQQKPGK APKSLIY | G------AFNLHS | GVPSKFSGSGSFG- TDFTLTINSLQPEDFANYYC | QQYSC------YPFT | FGHGT KVDIK |
| iPS:468_814 | 21-225_223D1 | VK1|L1/JK3 | DIQMTQSPSSLSA SVGDRVTITC | RAS---QGIS-------NYLA | WFQQKPGK APKSLIY | A------ASTLQS | GVPSKFSGSRSG-- TDFNLTISNLQPEDFATYYC | QQYSG------YPFT | FGPGT KVDTK |
| iPS:433_901 | 21-225_43A4 | VK1|L1/JK3 | DIQMTQSPSSLSA SVGDRVTITC | RAS---QGIN-------NYLA | WFQQKPGK APKSLIN | A------ASSLQS | GVPSRFSGSGSG-- TDFTLAISSLQPEDFATYYC | QQYYS------YPFT | FGPGT KVDIK |
| iPS:433_961 | 21-225_45D9 | VK1|L1/JK3 | DIQMTQSPSSLSA SVGDRVTITC | RAS---QGIN-------NYLA | WFQQKPGK APKSLIN | A------ASSLQS | GVPSRFSGSGSG-- TDFTLAISSLQPEDFATYYC | QHYIS------YPFT | FGRGT KVDIK |

Figure 51 (Continued)

| | | | | | | | | |
|---|---|---|---|---|---|---|---|---|
| iPS-434_059 | 21-225_51C5 | VK1\|L1/J K3 | DIQMTQSPSSLSA SVGDRVTITC | RAS--QGIS- ----NYLA | WFQQKPGE APKSLIY | A------- ASSLRS | GVPSQFSGSGSG-- TDFTLTISSLQPEDFATYYC | QQYYS------------YPFT | FGPGT KVDIK |
| iPS-434_085 | 21-225_52E3 | VK1\|L1/J K3 | DIQMTQSPSSLSA SVGDRVTITC | RAS--QGIS- ----NYLA | WFQQKPGK APKSLIN | A------- ASSLQS | GVPSKFSGSGSG-- TDFTLTIISSLQPEDFATYYC | QQYNS------------FPFT | FGPGT KVDIK |
| iPS-434_115 | 21-225_53E4 | VK1\|L1/J K3 | DIQMTQSPSSLSA SVGDRVTITC | RAS--QVIS- ----NYLA | WFQQKPGK APKSLIS | A------- ASSLQS | GVPSKFSGSGSG-- TDFTLTIISSLQPEDFATYY | QQYHS------------YPLT | FGRGT KVDIK |
| iPS-434_213 | 21-225_60A4 | VK1\|L1/J K3 | DIQMTQSPSSLSA SVGDRVTITC | RAS--QGIS- ----NYLA | WFQQKPGK APKSLIY | A------- ASSLQS | GVPSKFSGSGSG-- TDFTLTISSLQSEDFATYYC | QQYKS------------HPFT | FGPGT KVDIK |
| iPS-434_215 | 21-225_60F7 | VK1\|L1/J K3 | DIQMTQSPSSLSA SVGDRVTISC | RAS--QVIK- ----NYLV | WVQQKPGK APKSLIY | A------- ASSLQS | GVPSTFSGSGSG-- TDFTLTISSLQPEDFATYYC | LQFHS------------YPFT | FGPGT KMDIK |
| iPS-434_261 | 21-225_56F7 | VK1\|L1/J K3 | DILMTQSPSSLSA SVGDRVTITC | RAS--QGIS- ----TYLA | WFQQIPGT APKSLIY | A------- ASSLQG | GVPSKFSGSGSG-- TDFTLTIISSLQPEDFATYYC | HQYNS------------FPFK | FGRGT KVDIT |
| iPS-434_331 | 21-225_63H8 | VK1\|L1/J K3 | DIQMTQSPSSLSA SVGDRVTITC | RAS--QGIS- ----NYLA | WFQQKPGK AHKSLIY | A------- ASSLQS | GVPSKFSGSGSG-- TDFTLTIISSLQPEDFATYYC | QQYHS------------YPFT | FGPGT KVDIR |
| iPS-434_361 | 21-225_65D5 | VK1\|L1/J K3 | DIQMTQSPSSLSA SVGDRVTITC | RAS--QVIS- ----NYLA | WFQQKPGK APRSLIY | A------- ASSLHS | GVPSQFSASGSG-- SDFTLTISSLQPEDFATYYC | PLYKS------------YPLT | FGPGT KVDIK |
| iPS-434_405 | 21-225_68E6 | VK1\|L1/J K3 | DIQMTQSPSSLSA SVGDRVTITC | RAS--QVIK- ----YYLA | WFQQKPGR APKSLIY | V------- ASSRFS | GVPSRFSGSGSG-- TDFTLTINSLQPEDFATYYC | QQYDS------------YPFT | FGPGT KVDIR |
| iPS-435_259 | 21-225_96C6 | VK1\|L1/J K3 | DIQMTQSPSSLSA SVGDRVTITC | RAS--QGIS- ----NYLA | WFQQKPGK APKSLIY | A------- ASSLQS | GVPSKFSGSGSG-- TDFTLTINSLQPEDFATYYC | HQYND------------YPFT | FGPGT KVDIK |
| iPS-435_351 | 21-225_148B6 | VK1\|L1/J K3 | DIQMTQSPSSLSA SVGDRVSITC | RAS--QGIS- ----KYLA | WFQQKPGK APKSLIF | A------- ASSLQS | GVPSKFSGSGSG-- TDFTLTIISSLQPEDFATYYC | QQYNS------------FPFT | FGPGT KVDIK |
| iPS-435_461 | 21-225_153A1 | VK1\|L1/J K3 | DIQMTQSPSSLSA SVGDRVTITC | RAS--QVIS- ----NYLA | WFQQKPGK APKSLIS | A------- ASSLQS | GVPSNFSGSGSG-- TDFTLTIISSLQPEDFATYYC | QQYHS------------YPFT | FGPGT KVDFK |
| iPS-435_509 | 21-225_157H1 | VK1\|L1/J K3 | DIQMTQSPSSLSA SVGDRVTITC | RAS--QDIN- ----NYLV | WFQQRPGK APRSLIY | A------- ASSLRS | GVPSKFSGSGSG-- TDFTLTISSLQPEDFATYYC | QQYHS------------YPFT | FGPGT KVDIK |
| iPS-435_515 | 21-225_157E4 | VK1\|L1/J K3 | DIQMTQSPSSLSA SVGDRVTFTC | RAS--QGIN- ----NYLA | WFQQKPGR APTSLIY | A------- APESLIY | GVPSQFSGSGSG-- TDFTLTINSSLQPEDFATYYC | QQYHS------------YPFT | FGPGT KVDIK |
| iPS-435_523 | 21-225_157G5 | VK1\|L1/J K3 | DIQMTQSPSSLSA SVGDRVTITC | RAS--QGII- ----NYLA | WFQQKPGK APTSLIY | T------- ASNLQS | GVPSQFSGSGSG-- TDFTLTIISSLQPEDFATYYC | QQYNS------------YPFT | FGPGT KVDIK |
| iPS-435_535 | 21-225_157H10 | VK1\|L1/J K3 | DIQMTQSPSSLSA SVGDRVTITC | RAS--QDIS- ----NYLA | WFQQKPGK APKSLIY | A------- ASSLQS | GVPSKFSGSGSG-- TDFTLTISSLQPEDFATYYC | QQYHS------------YPFT | FGPGT KVDIK |
| iPS-435_559 | 21-225_158H2 | VK1\|L1/J K3 | DIQMTQSPSSLSA SVGDRVTITC | RAS--QGIS- ----NYLA | WFQQKPGK APKSLIS | A------- ASSLQS | GVPSKFSGSGSG-- TDFTLTIISSLQPEDFATYYC | QQYHS------------YPFT | FGPGT KVDIK |
| iPS-435_575 | 21-225_159H1 | VK1\|L1/J K3 | DIQMTQSPSSLSA SVGDRVTITC | RAS--QDIN- ----KYLA | WFQQKPGK APKSLIY | A------- ASSLQS | GVPSKFSGSGSG-- TDFTLTISNLQPEDFATYYC | QQYHS------------YPFT | FGPGT KVDIK |
| iPS-435_579 | 21-225_160G1 | VK1\|L1/J K3 | DIQMTQSPSSLSA SVGDRVTITC | RAS--QDIS- ----NYLA | WFQQKPGK APTSLIY | S------- SSSLQS | GVPSKFSGSGSG-- TDFTLTIISSLQPEDFATYYC | QQYHS------------YPFT | FGPGT KVDIR |
| iPS-435_585 | 21-225_160G3 | VK1\|L1/J K3 | DIQMTQSPSSLSA SVGDRVTITC | RAS--QDIN- ----NYLA | WFQQRPGK APTSLIY | S------- SSSLQS | GVPSKFSGSGSG-- TDFTLTISSLQPEDFATYYC | QQYHS------------YPFT | FGPGT KVDIK |
| iPS-435_635 | 21-225_163F1 | VK1\|L1/J K3 | DIQMTQSPSSLSA SVGDRVTITC | RAS--QDIS- ----NYLA | WFQQKPGK APKSLIY | A------- ASSLQS | GVPSKFSGSGSG-- TDFTLTIISSLQPEDFAAYYC | QQYNS------------YPFT | FGPGT QVDAQ |

Figure 51 (Continued)

| | | | | | | | | | |
|---|---|---|---|---|---|---|---|---|---|
| iPS:435659 | 21-225_167D1 | VK1jL1/J K3 | DIQMTQSPSSLSA SVGDRVTITC | RAS--QGIN------NYLA | WFQQKPGK APESLIY | A-------ASSLQS | GVPSKFSGSGSG--TDFTLTISSLQPEDFATYYC | QQYNS-----------YPFT | FGPGT KVDIK |
| iPS:435679 | 21-225_169D1 | VK1jL1/J K3 | DIQMTQSFSSLSA SVGDRVTITC | RAS--QDIS------NYLA | WFQQKPGK APKSLIY | A-------ASSLQS | GVPSKFSGSGSG--TDFTLTISSLQPEDFATYYC | QQYHS-----------YPFT | FGPGT KVDIK |
| iPS:435685 | 21-225_170E1 | VK1jL1/J K3 | DIQMTQSPSSLSA SEGDRVTITC | RAS--QGIS------NYLA | WFQQKPGK APKSLIY | A-------ASGLQS | GFPSKFSGSGSG--TDFTLTISSLQPEDFATYYC | QQYYS-----------YPFT | FGPGT KVDIK |
| iPS:435747 | 21-225_175C4 | VK1jL1/J K3 | DIQMTQSPSSLSA SVGDRVTITC | RAS--QGIT------NYLA | WFQQKPGK APKSLIY | A-------ASSLQS | GVPSKFSGSGSG--TDFTLTISSLQPEDFATYYC | QQYNS-----------YPFT | FGPGT KVDIK |
| iPS:435765 | 21-225_177D3 | VK1jL1/J K3 | DIQMSQSPSSLSA SVGDRVTITC | RAS--QGIS------NYLA | WIQQKPGT APKSLIY | A-------ASSLQS | GVSSRFSGSGSG--TDFTLTISSLQPEDFATYYC | QQYNG-----------YPFT | FGPGT KVDIK |
| iPS:435797 | 21-225_181G2 | VK1jL1/J K3 | DIQMTQSPSSLSA SIGERVTITC | RAS--QGIS------NYLA | WFQQKPGK APKSLIY | A-------ASSLQS | GVPSKFSGSGSG--TDFTLTISSLQPEDFATYYC | QRYDT-----------YPFT | FGPGT KVDIK |
| iPS:435835 | 21-225_190F12 | VK1jL1/J K3 | DIQMTQSPSSLSA SVGDRVTITC | RAS--QGIG------KYLA | WFQQKPGK APKSLIH | A-------ASSLQS | GVPSKFSGSGSG--TDFTLTISSLQPEDFATYYC | QQYSN-----------YPVT | FGPGT KVDIK |
| iPS:435861 | 21-225_190A5 | VK1jL1/J K3 | DIQMTQSPSSLSA SVGDRVTITC | RAS--QGIG------NHLA | WFQQKPGK APKSLIY | V-------ASSLES | GVPSKFSGSGSG--TEFTLTISSLQPEDFGTYYC | QQYLN-----------YPVT | FGPGT KVDIR |
| iPS:435869 | 21-225_190B1 | VK1jL1/J K3 | DIQMTQSPSSLSA SVGDRVTITC | RAS--QGIR------NYLA | WIQQKPGT APKSLIY | A-------ASSLQS | GVSSRFSGSGFG--TDFTLTISSVQREDFATYYC | QQYNG-----------YPFT | FGHGT KVDIK |
| iPS:435877 | 21-225_184E7 | VK1jL1/J K3 | DIQMTQSPSSRSA SIGERVTITC | RAS--QGIS------NYLA | WFQQTPGK APKSLIS | V-------ASSLQS | GVSSRFSASGSG--TDFTLTISSLQPEDFATYYC | RQYHS-----------YPFT | FGPGT KVDIK |
| iPS:435883 | 21-225_185A1 | VK1jL1/J K3 | DIQMTQSPSSRSA SVGDRVTITC | RAS--QGIS------NYLA | WIQQKPGT APKSLIY | A-------ASSLQS | GVSSRFSGSGFG--TDFTLTISSLQPEDFATYYC | QQYNG-----------YPFT | FGPGT KVDIK |
| iPS:435885 | 21-225_185E1 | VK1jL1/J K3 | DIQMTQSPSSLSA SIGERVTITC | RAS--QGIS------NYLA | WLQQKPGK APKSLIY | A-------ASSLQS | GVSSKFSGSGFG--TDFTLTISSLQPEDFATYYC | QQYNS-----------YPFT | FGPGT KVDIK |
| iPS:435891 | 21-225_188H5 | VK1jL1/J K3 | DIQMTQSPSSLSA SIGERVTITC | RAS--QGIS------NYLA | WLQQKPGT APKSLIY | A-------ASSLQS | GVSSRFSGSGFG--TDFTLTISSLQPEDFATYYC | QQYNS-----------YPFT | FGPGT KVDIK |
| iPS:435897 | 21-225_188B9 | VK1jL1/J K3 | DIQMTQSPSSLSA SIGERVTITC | RAS--QGIS------KYLA | WFQQKPGK ALKSLIY | A-------ASSLQS | GVPSKFSGSGSG--TDFTLTISSLQPEDFATYYC | QRYDT-----------YPFT | FGPGT KVDIK |
| iPS:435937 | 21-225_190H9 | VK1jL1/J K3 | DIQMTQSPSSLSA SVGDRVTITC | RAN--QGIN------NYLA | WFQQKPGK APKSLIY | A-------ASSLQS | GVPSKFSGSGSG--TDFTLTISSLQPEDFATYYC | QQYNS-----------YPFT | FGPGT KVDIK |
| iPS:435961 | 21-225_192A2 | VK1jL1/J K3 | DIQMTQSPSSLSA SVGDRVTITC | RAS--QGIS------NYLA | WFQQKPGK APKSLIY | V-------VSSLQS | GVPSKFSGSGFG--TDFTLTISSLQPEDFATYYC | QRYDT-----------YPFT | FGPGT KVDIK |
| iPS:435977 | 21-225_192E4 | VK1jL1/J K3 | DIQMTQSPSSLSA SIGERVTITC | RAS--QGIG------NYLA | WFQQKPGK APKSLIY | A-------ASSLQS | GVPSKFSGSGSG--TDFTLTISSLQPEDFATYYC | QRYDT-----------YPFT | FGPGT KVDIK |
| iPS:436001 | 21-225_192C1 | VK1jL1/J K3 | DIQMTQSPSSLSA SVGDRVTITC | RAS--QGIG------KYLA | WFQQKPGK APKSLIY | A-------ASSLQS | GVPSKFSGSGSG--TDFTLTISSLQPEDFATYYC | QRYDT-----------YPVT | FGPGT KVDIK |
| iPS:436039 | 21-225_193F8 | VK1jL1/J K3 | DIQMIQSPSSLSA SVGDRVTITC | RAS--QGVS------NHLA | WFQQKPGK APKSLIY | A-------ASSLQS | GVSSKFSGSGSG--ADFTLTISSLQPEDFATYYC | QQYNS-----------YPFT | FGPGT KVDIK |
| iPS:436078 | 21-225_194H1 | VK1jL1/J K3 | DIQMTQSPSSLSA SVGDRVTITR | RAS--QGIG------KYLA | WFQQKPGK ALKSLIY | A-------ASSLQS | GVPSKFSGSGSG--TDFTLTISSLQPEDFATYYC | QRYDT-----------YPFT | FGPGT KVDFK |
| iPS:436140 | 21-225_197G3 | VK1jL1/J K3 | DIQMTQSPSSLSA SVGDRVTITC | RAS--NHLA------NHLA | WFQQKPGK APKSLIY | A-------ASSLQS | GVPSKFSGSRSG--TDFSLTISSLQPEDFATYYC | QQYSN-----------YPVT | FGPGI KVDIK |

Figure 51 (Continued)

| | | | | | | | | | |
|---|---|---|---|---|---|---|---|---|---|
| iPS:436_167 | 21-225_197E1 | VK1jL1/J K3 | DIQMTQSPSSLSA SVGDRVTITC | RAS---QGIN- ----KYLS | WFQQKPGK APKSLIY | A------ ASSVQS | GVPSKFSGSGSG-- TDFTLTISRLQPDFATYYG | QRYDT------ | FGPGT KVDIK |
| iPS:436_370 | 21-225_211A6 | VK1jL1/J K3 | DIQMTQSPSSLSA SVGDSVTITC | RAS---QGIG- ----KYLA | WFQQKPGK APKSLIY | A------ ASSLLS | GVPSKFSGSGSG-- TDFTLTISSLQPEDFATYYC | QKYDT-------YPFT | FGPGT KVDIK |
| iPS:436_392 | 21-225_213B3 | VK1jL1/J K3 | DIQMTQSPSSLSA SVGDRVTITC | RAS---QGIG- ----KYLA | WFQQKPGK APKSLIS | A------ ASSVLS | GVPSKFSGSGSG-- TDFTLTISSLQPEDFATYYC | QKYDT-------YPFT | FGPGT KVDIK |
| iPS:436_404 | 21-225_214C3 | VK1jL1/J K3 | DIQMTQSPSSLSA SVGDRVTITC | RAS---QGIG- ----KYLA | WFQQKPGK VPKSLIY | A------ ASSLQS | GVPSKFSGSGSG-- TDFTLTISSLQPEDFTTYYC | QQYMT-------YPIT | FGPGT KVDIK |
| iPS:436_406 | 21-225_214E4 | VK1jL1/J K3 | DIQMTQSPSSLSA SVGDRVTITC | RAS---QGIS- ----NYLA | WFQQKPGK AFKSLIY | A------ ASSLQS | GVPSKFSGSGSG-- TDFTLTISSLQPEDFATYYC | QQYLT-------YPFT | FGPGT KVDIK |
| iPS:437_216 | 21-225_51D5 | VK1jL1/J K3 | DIQMTQSPSSLSA SVGDRVTITC | RAS---QGIN- ----NYLA | WFQQKPGE APKSLIY | A------ ASSLRS | GVPSKFSGSGSG-- TDFTLTISSLQPEDFATYYC | QQYYS-------YPFT | FGPGT KVDIK |
| iPS:437_224 | 21-225_56H1 | VK1jL1/J K3 | DIQMTQSPSSLSA SVGDRVTITC | RAS---QGIS- ----HYLA | WFQQKPGK AFQSLMS | A------ ASGLQS | GVPSKFSGSGSG-- TDFTLTISSLQPEDFATYYC | QQYQN-------YPFT | FGPGT KVDIK |
| iPS:392_620 | 21-225_17H5 | VK1jL1/J K3 | DIQMTQSPSSLSA SVGDRVTITC | RAS---QGIS- ----NYLA | WFQQKPGK APKSLIN | A------ ASSLQS | GVPSKFSGSGSG-- TDFTLTISSLQPEDFATYYC | QQYHS-------YPFT | FGPGT KVDIK |
| iPS:392_692 | 21-225_18G10 | VK1jL1/J K3 | DIQMTQSPSSLSA SVGDRVTITC | RAS---QDIS- ----YYLA | WFQQKPGK AFKSLIY | V------ ASSLQS | GVPSKFGGSGFG-- TDFTLTISSLQPEDFATYYC | LQYNS-------YPFT | FGPGT KVDIK |
| iPS:392_708 | 21-225_18D11 | VK1jL1/J K3 | DIQMTQSPSSLFA FVGDRVTITC | RAS---QGIS- ----YYLA | WFQQKPGK APKSLIY | A------ ASSLQS | GVPSKFSGSGFG-- TDFTLTISSLQPEDFATYYC | QQYNT-------YPFT | FGPGT TVDIK |
| iPS:392_714 | 21-225_16G12 | VK1jL1/J K3 | DIQMTQSPSSLSA SVGDRVTITC | RAS---QDIS- ----NYLA | WFQQKPGK APKSLIY | A------ ASSLQS | GVPSKFSGSGSG-- TDFTLTISNLQPEDFASYYC | QQYHS-------FPFT | FGPGT KVDIK |
| iPS:392_746 | 21-225_20H7 | VK1jL1/J K3 | DIQMTQSPSSLSA SVGDRVTITC | RTS---QGIN- ----NYLV | WFQQKPGK APKRLIY | A------ ASSLQS | GVPSKFSGSGSG-- TDFTLTISSLQPEDFATYYC | QQYYS-------YPFT | FGPGT KMDFK |
| iPS:392_782 | 21-225_22B12 | VK1jL1/J K3 | DIQMTQSPSSLSA SVGDRVTITC | RAS---QDIS- ----NYLA | WFQEKPGK AHKSLIY | G------ ASSLRS | GVPSNFSGSGSG-- TDFNLTISSLQPEDLATYYC | QQYHS-------YFFT | FGPGT KVDFK |
| iPS:392_784 | 21-225_23C7 | VK1jL1/J K3 | DIQMTQSPSSLSA SVGDRVTITC | RAS---QGIG- ----IYLA | WFQQKPGK APKSLIS | A------ ASSLQS | GVPSKFSGSGSG-- TEFTLTISSLQPEDFATYYC | QQYNS-------YPFT | FGPGT KVDIK |
| iPS:392_802 | 21-225_23E7 | VK1jL1/J K3 | DIQMTQSPSSLSA SVGDRVTITC | RAS---QGIS- ----YYLA | WFQQIPGK APKSLIY | A------ ASSLQS | GVPSKFSGSGSG-- TDFTLTISSLQPEDFATYYC | QQFYS-------YPFT | FGPGT KVDIN |
| iPS:392_826 | 21-225_20B9 | VK1jL1/J K3 | DIQMTQSPSSLSA SVGDRVTITC | RAS---QDIS- ----NYLA | WFQQKPGK APKSLIY | V------ ASSLQS | GVPSKFSGSGSG-- TDFTLTISSLQPEDFATYYC | QQYNT-------YPFT | FGPGT KVDIK |
| iPS:392_840 | 21-225_23G1 | VK1jL1/J K3 | DIQMTQSPSSLSA SVGDRVTITC | RAS---QGIS- ----NYLA | WFQQKPGK AFKSLIS | A------ ASSLQS | GVPSQFSGSGFG-- TDFTLTISSLQPEDFATYYC | QQYNS-------YPFT | FGPGT KVDIK |
| iPS:392_842 | 21-225_23G8 | VK1jL1/J K3 | DIQMTQSPSSLSA SVGDRVTITC | RAS---QGIR- ----NYLA | WFQQKPGK AFKSLIY | A------ ASSLRS | GVPSNFSGSGSG-- TDFTLTISSLQPEDLATYYC | QQYHS-------YFFT | FGPGT KVDFK |
| iPS:392_890 | 21-225_20H9 | VK1jL1/J K3 | DIQMTQSPSSLSA SVGDRVTITC | RAS---QGIS- ----IYLA | WFQQKPGK APKSLIS | A------ ASSLQS | GVPSKFSGSGSG-- TDFTLTISSLQPEDFATYYC | QQYNS-------YPFT | FGPGT KVDIK |
| iPS:392_892 | 21-225_20C11 | VK1jL1/J K3 | DIQMTQSPSSLSA SVGDRVTITC | RAS---QDIS- ----NYLA | WFQQKPGK APKSLIY | A------ ASSLQS | GVPSKFSGSGSG-- TDFTLTISSLQPEDFATYYC | QQYHS-------FPFT | FGPGT KVDVK |
| iPS:392_950 | 21-225_25C10 | VK1jL1/J K3 | DIQMTQSPSSLSA SVGDRVTITC | RAS---QGIS- ----NYLA | WFQQKPGK AFKSLIY | A------ ASSLQS | GPSKFSGSGSG--- TDFTLTISSLQPEDFATYYC | QQYHS-------YPFT | IGPGI KVDIK |
| iPS:392_952 | 21-225_26G1 | VK1jL1/J K3 | DIQMTQSPSSLSA SVGDRVTITC | RAS---QDIS- ----NYLA | WFQQKPGK AFKSLIY | A------ ASSLRS | GVPSNFSGSGSG-- TDFTLTISSLQPENHATYYC | QQYNS-------YPFT | FGPGT KVDIK |
| iPS:392_962 | 21-225_30A1 | VK1jL1/J K3 | DIQMTQSPSSLSA SVGDRVTITC | RAS---QGIS- ----NYLA | WFQQKPGK AFKSLIS | A------ ASSLQT | GVPSKFSGSGSG-- TDFTLTISSLQPEDFATYYC | QQYNS-------YPFT | FGPGI KVDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:392 976 | 21-225_27H12 | VKıL1/JK3 | DIQMTQSPSSLSA SVGDRVTITC | RAS--QGIS-----NYLA | WFQQKPGK APKSLIN | G------ASSLQS | GVPSKFSGSGSG-TDFTLTISSLQPEDFATYYC | QQYYS-------YPFT | FGPGT KVNIN |
| iPS:393 090 | 21-225_33A5 | VKıL1/JK3 | DIQMTQSPSSLSA SVGDRVTITC | RAS--QGIS-----NYLA | WFQQKPGK APKSLIS | A------ASSLQS | GVPSKFSGSGSG-TDFTLTISSLQPEDFATYYC | QQYNS-------YPFT | FGPGT NVDIK |
| iPS:393 120 | 21-225_35H8 | VKıL1/JK3 | DIQMTQSPSSLSA SVGDRVTITC | RAS--QAIS-----NYLA | WFQQKPGK APKSLIY | G------ASGLQS | GVPSKFSGSGSG-TDFTLTISSLQPEDFATYYC | QQYYS-------YPFT | FGPGT KVDFK |
| iPS:393 836 | 21-225_15A2 | VKıL1/JK3 | DIQMTQSPSSLFA FIGDRVTITC | RAS--QGIS-----NYLA | WFQQKPGK APKSLIF | A------ASSLQS | GVPSKFSGSGFG-TDFTFPISSLQPEDFANYYC | QQYYS-------YPFT | QVDVK |
| iPS:393 870 | 21-225_7B1 | VKıL1/JK3 | DIQMTQAPSSLSA SVGDRVTITC | RAS--QDI3-----NHLV | WFQQKPGK APKSLIF | A------ASSLQS | GVPSQFSGSGSG-TDFTLTISSLQPEDFATYYC | HQYNS-------YPFT | FGPGT KVDFK |
| iPS:393 894 | 21-225_5E11 | VKıL1/JK3 | VIQMTQSPSSLSA SVGDRVTITC | RAS--QGIS-----NYLA | WFQQKPGK APKSLIN | ASSVQS | GVPSKFSGSGFG-TDFTLTISSLQPEDFATYYC | HQYHS-------YPFT | FGPGT KVDIK |
| iPS:393 896 | 21-225_2A4 | VKıL1/JK3 | DIQMTQSPSSLFA SVGDRVTITC | RAS--QGIS-----NYLA | WFQQKPGK APKRLIY | T------ASSVQS | GVPSKFSGSGSG-TDFTLTISSLQPEDFATYYC | QQYNS-------YPFT | FGPGT KVDIV |
| iPS:393 914 | 21-225_16B8 | VKıL1/JK3 | DIQMTQSPSSLSA SVGDRVTITC | RAS--QGIS-----NYLA | WFQQKPGK ALKSLIN | A------ASSVQS | GVPSKFSGSGSG-TDFTLTISSLQPEDFATYYC | HQYHS-------YPFT | FGPGT KVDIK |
| iPS:393 968 | 21-225_5A5 | VKıL1/JK3 | DIQMTQSPSSLSA SVGDRVTITC | RAS--QGIS-----NYLA | WFQQKPGK APKSLIS | A------ASSLQS | GVPSKFSGSGSG-TDFTLTISSLQPEDFATYYC | QQYNS-------YPFT | FGPGT KVDIK |
| iPS:393 992 | 21-225_14H8 | VKıL1/JK3 | DIQMTQSPSSLSA SVGDRVTITC | RAS--QGIS-----YYLA | WFQQKPGK APKSLIY | V------ASSLQS | GVPSNFSGSGSG-TDFTLTISSLQPEDFATYYC | QQYNS-------YPFT | FGPGT KVDIN |
| iPS:394 018 | 21-225_15B1 | VKıL1/JK3 | DIQMTQSPSSLSA SVGDRVTITC | RAS--QGIS-----NYLA | WFQQKPGK APKSLIS | A------ASSLQS | GVPSKFSGSGSG-TDFTLTISSLQPEDFATYYC | QQYNS-------YPFT | FGPGT KVDIK |
| iPS:394 026 | 21-225_16C7 | VKıL1/JK3 | DIQMTQSPSSLSA SVGDRVTITC | RAS--QGIS-----NYLA | WFQQKPGK APKSLIS | A------ASSLQS | GVPSTFSGSGSG-TDFTLTISSLQPEDFATYYC | QQYDS-------YPFT | FGPGT KVDIK |
| iPS:394 055 | 21-225_9C8 | VKıL1/JK3 | DIQMTQSPSSLSA SVGDRVTITC | RAS--QGIN-----YYLA | WFQQKPGK APKSLIY | V------ASSLQS | GVPSKFSGSGSG-TDFTLTISSLQPEDFATYYC | QQYDS-------YPFT | FGPGT KVDIK |
| iPS:398 482 | 21-225_17H6 | VKıL1/JK3 | DIQMTQSPSSLSA SVGDRVTITC | RAS--RDIS-----NYLA | WFQQKPGK APKSLIS | T------ASTLQS | GVPSKFSGSGSG-TDFTLTISSLQPEDFAIYYC | QQYHS-------YPFT | FGPGT KVDIQ |
| iPS:398 500 | 21-225_23A11 | VKıL1/JK3 | DIQMTQSPSSLST SVGDRVTITC | RAS--QDIS-----NYLA | WFQQKPGK APKRLIY | A------ASSLQS | GVPSKFSGSGSG-TDFTLTISSLQPEDFATYYC | QQYNS-------YPFT | FGPGT KVDLK |
| iPS:398 526 | 21-225_32B3 | VKıL1/JK3 | DIQMTQSPSSLSA SIGDRVTITC | RAS--QGIS-----NYLA | WFQQKPGK APRSLIY | A------ASSLQS | GVPSTFSGSGSG-TDFTLTISSLQPEDFATYYC | QQYNS-------YPFT | FGPGT KVDIK |
| iPS:402 235 | 21-225_20F10 | VKıL1/JK3 | DIQLTQSPSSLSA SVGDRVTITC | RAS--QGIN-----NYLA | WFQQKPGK APKSLIY | A------ASSLQS | GVPSRFSGSGSG-TDFTLTISRLEPEDFAVYYC | QQYGS-------YPFT | FGPGT KVDNK |
| | Germline | | K_FR1 | K_CDR1 | K_FR2 | K_CDR2 | K_FR3 | K_CDR3 | K_FR4 |
| | VK3jA27/JK1 | | | | | | | | FGQGT KVEIK |
| iPS:468 810 | 21-225_74D5 | VK3jA27/JK1 | EIVLTQSPGTLSL SPGERATLSC | RAS--QSVNS----NYLA | WYRQKPGQ APRLLIY | G------ASSRAT | GIPDRFSGSGSG-TDFTLTISRLEPEDFAVYYC | QQYES-------SPWT | FGQGT KVEIK |
| iPS:468 834 | 21-225_94G10 | VK3jA27/JK1 | EIVLTQSPGTLSL SPGERATLSC | RAS--QSVNS----NYLA | WYRQKPGQ APRLLIY | G------ASSRAT | GIPDRFSGSGSG-TDFTLIISRLEPEDFAVYYC | QQYES-------SPWT | FGQGT KVEIK |
| iPS:468 838 | 21-225_80E12 | VK3jA27/JK1 | EIVLTQCPGTLSL SPGERATVSC | RAS--QSVNS----NYLA | WYRQKPGK APRLLIY | G------ASSRAT | GVPSTFSGSGSG-TDFTLTISSLQPEDFATYYC | QQYNS-------SPWT | FGQGT KVEIK |
| iPS:468 820 | 21-225_76E10 | VK3jA27/JK1 | EIVLTQSPGTLSL SPGERATLSC | RAS--QSVNS----NYLA | WYRQKPGQ APRLLIY | G------ASSRAT | GIPDRFSGSGSG-TDFTLIISRLEPEDFAVYYC | QQYES-------SPWT | FGQGT KVEIK |
| iPS:433 931 | 21-225_44F6 | VK3jA27/JK1 | EIVLTQSPGTLSL SPGERATLSC | RAS--QSVSG----SYLA | WYQQKPGQ APRLLIY | G------ASSRAT | GIPDRFSGSGSG-TDFTLTISRLEPEDFAVYYC | QQYGS-------SPWT | FGQGT KVEIK |

Figure 51 (Continued)

| | | | | | | | | | | |
|---|---|---|---|---|---|---|---|---|---|---|
| PS:434 307 | 21-225_59B2 | VK3|A27/ JK1 | EIVLTQSPGTLSL SPGERATLSC | WAS--QSVVS- ---SFLA | WFQQKSGQ APRLLIY | G------ ASSRAT | GIPDRFSGSGSG-- TDFTLTISRLEPEDFAVFYC | QQYGT- | ----SPWT | FGGGT KVEIK |
| PS:434 471 | 21-225_75G3 | VK3|A27/ JK1 | EIVLTQSPGTLSL SPGERATLSC | RAR--QNVDS- ---SYLA | WYQQKPGQ APRLLIY | G------ ASSRAT | GIPDRFSGSGSG-- TDFTLTISRLEPEDFAVYC | QQYER- | ----SPWT | FGQGT KVEIK |
| PS:434 473 | 21-225_76D1 | VK3|A27/ JK1 | EIVLTQSPGTLSL SPGERATLSC | RAS--QNIYS- ---NYLA | WYQEKPGQ APRLLIY | G------ ASSRAT | GIPDRFSGSGSG-- TDFTLTISRLEPEDFVVYC | QQYES- | ----SPWT | FGGGT KVEIK |
| PS:434 495 | 21-225_74B2 | VK3|A27/ JK1 | EIVLTQSPGTLSL SPGERATLSC | RAS--QNIYS- ---SYLA | WYQQKPGQ APRLLIY | G------ ASSRAT | GIPDRFSGSGSG-- TDFTLTISRLEPEDFAVYC | QQYES- | ----SPWT | FGGGT KVEIK |
| PS:434 497 | 21-225_76A4 | VK3|A27/ JK1 | EIVLTQSPGTLSL SPGERATLSC | RAS--QSVVS- ---SYLA | WYQQKPGQ APRLLIY | G------ ASSRAT | TDFALTISRLEPEDFAVYC | QHSDN- | ----SPWT | FGGGT KVEIK |
| PS:434 501 | 21-225_76G4 | VK3|A27/ JK1 | EIVLTQSPGTLSL SPGERATLSC | RAS--QSVYS- ---SYLA | WYQQKPGQ APRLLIY | G------ ASSRAT | GIPDRFSGSGSG-- TDFALTISRLEPEDCAVYYC | QHSDN- | ----SPWT | FGGGT RVEIK |
| PS:434 507 | 21-225_74C5 | VK3|A27/ JK1 | EIVLTQSPGTLSL SPGERATLSC | RAS--QSVNS- ---NYLA | WYQQKPGQ APRLLIY | APSRAT | TDFNLISRLEPEDFAVYC | QQYES- | ----SPWT | FGGGT KVEIK |
| PS:434 517 | 21-225_76A7 | VK3|A27/ JK1 | EIALTQSPGTLSL SPGERATLSC | RAS--PSVDS- ---SYLA | WYQQKPGQ APRLLIY | G------ ASSRAP | GIPDRFSGSGSG-- TDFTLTISRLEPEDFAVYC | QQYES- | ----SPWT | FGGGT KVEIK |
| PS:434 519 | 21-225_74C7 | VK3|A27/ JK1 | EIVLTQSPGTLSL SPGERATLSC | RTS--PNVDS- ---SYLA | WYQQKPGQ APRLLIY | G------ ASSRAT | GIPDRFSGSGSG-- TDFALTISRLEPEDFAVFYC | QQYER- | ----SPWT | FGGGT KVEIK |
| PS:434 523 | 21-225_75C3 | VK3|A27/ JK1 | EIVLTQSPGTLSL SQGERATLSC | RAS--QSVSS- ---RYLA | WYQQKPGQ APRLLIY | G------ ASSRAT | TDFALTISRLEPEDFAVYC | QHYDS- | ----SPWT | FGGGT KVEIK |
| PS:434 531 | 21-225_76C9 | VK3|A27/ JK1 | EIVLTQSPGTLSL SPGERATLSC | RAS--QSVSS- ---SYLS | WYQQKPGQ APRLLIY | G------ ASSRAT | GIPDRFSGSGSG-- TDFTLTISRLEPEDFAVYC | QQYG-- | ----RSRT | FGGGI KVEIR |
| PS:434 533 | 21-225_85F7 | VK3|A27/ JK1 | EPVLTQSPGTLSL SPGERATLSC | RAS--QNIYS- ---NYLA | WYQQKPGQ APRLLIY | G------ ATSRAT | GIPDRFSGSGSG-- TDFTLTISRLEPEDFAVYC | QQYES- | ----SPWT | FGGGT KVEIK |
| PS:434 547 | 21-225_74H5 | VK3|A27/ JK1 | EIVLTQSPGTLSL SPGERATLSC | RAS--QSVNS- ---NYLA | WYQQKPGQ APRLLIY | G------ ASSRAP | GIPDRFSGSGSG-- TDFTLTINRLEPEDFAVYC | QQYES- | ----SPWT | FGGGT KVEIK |
| PS:434 559 | 21-225_74D11 | VK3|A27/ JK1 | EIVLTQSPGTLSL SPGERATLSC | RAS--QSVYS- ---SYLA | WYQQKPGQ APRLLIY | G------ ASSRAT | GIPDRFSGSGCG-- TDFTLTISRVEHEDCAVYYC | QHYDN- | ----SPWT | FGGGT KVEIK |
| PS:434 561 | 21-225_77G1 | VK3|A27/ JK1 | EIVLTQSPGTLYL SPGERATLSC | RAS--QSVYS- ---SYLA | WYQQKPGQ APRLLIY | G------ ASSRAT | GIPDRFSGSGSG-- TDFALTISRLEPEDFAVYYC | QQYES- | ----SPWT | FGGGT KVEIK |
| PS:434 565 | 21-225_75B10 | VK3|A27/ JK1 | EIVLTQSPGTLSL SPGERATLSC | RAS--PSVNS- ---YYLA | WYQQKPGQ APRLLIF | G------ ASSRST | TDFALTISRLEPADFAVYC | QQYED- | ----SPWT | FGGGT KVEIK |
| PS:434 571 | 21-225_74D2 | VK3|A27/ JK1 | EIVLTQSPGTLSL SPGERATLSC | RAS--QSVDS- ---NYLA | WYQQKPGQ APRLLIY | G------ ASSRAP | GIPDRFSGSGSG-- TDFTLTISRLEPEDFAVYC | QQYES- | ----SPWT | FGGGT KVEIK |
| PS:434 579 | 21-225_77F7 | VK3|A27/ JK1 | EIVLTQSPGTLYL SPGERATLSC | RAS--QSVYS- ---SYLA | WYQQKPGQ APRLLIY | G------ ASSRAT | GIPDRFSGSGCG-- TDFALTISRVEHEDCAVYYC | QHYDN- | ----SPWT | FGGGT KVEIK |
| PS:434 581 | 21-225_74B12 | VK3|A27/ JK1 | EIVLTQSPGTLSL SPGERATLSC | RAS--QSVSS- ---SYLA | WYQQKPGQ APRLLIY | G------ ASSRAT | GIPDRFSGSGSG-- TDFALTISRLEPEDFAVYYC | QQYES- | ----SPWT | FGGGT KVEIK |
| PS:434 585 | 21-225_75A12 | VK3|A27/ JK1 | EIVLTQSPGTLSL SPGERATLSC | RAS--PSVSS- ---RYLA | WYQQKPGQ APRLLIY | G------ ASSRAT | GIPDRFSGSGSG-- TDFTLTISRLEPADFAVYC | QHYDS- | ----SPWT | FGGGT KVEIK |
| PS:434 595 | 21-225_77A10 | VK3|A27/ JK1 | EIVLTQSPGTLSL SPGERATLSC | RAS--QSVHS- ---RYLA | WYQQKPGQ APKLLIF | G------ ASSRAT | GIPDRFSGSGSG-- TDFTLTISRLEPEDFAVYC | QHYDS- | ----SPWT | FGGGT KVEIK |
| PS:434 611 | 21-225_77C12 | VK3|A27/ JK1 | EIVLTQSPGTLSL SPGERATLSC | RAR--QSVDS- ---SYLA | WYQQKRPGQ APRLLIY | G------ ASSRAT | GIPDRFSGSGSG-- TDFTLTISRLEPEDFAVYYC | QQYES- | ----SPWT | FGGGT KVEIK |
| PS:434 633 | 21-225_74G8 | VK3|A27/ JK1 | EIVLTQSPGTLSL SPGERATLSC | RAS--QSFSS- ---AYLA | WYQQKPGQ APRLLIY | TSSRAI | TDFTLTIGRLEPEDFAVYC | QQYG-- | ----NSRT | FGGGT KVEIK |

Figure 51 (Continued)

| | | | | | | | | | |
|---|---|---|---|---|---|---|---|---|---|
| PS:434 637 | 21-225_78E7 | VK3/A27/ JK1 | EIVLTQSPGTLSL SPGERATLSC | RAS--QNVDS- ----NYLA | WYQQKPGQ APRLLIY | G------ ASSRAT | GIPDRFSGSGSG-- TDFTLTISRLEPEDFAVYYC | QQYER- ---SSRT | FGQGT KVEIK |
| PS:434 657 | 21-225_79G1 | VK3/A27/ JK1 | EIVLTQSPGTLYL SSGERATLSC | RAS--QSVYS- ---SYLA | WYQQKPAQ APRLLIY | ASSRST | GIPDRFSGSGSG-- TDFALTISRLEPEDFAVYYC | QHYDN- ---SPWT | FGQGT KVEIK |
| PS:434 663 | 21-225_79F3 | VK3/A27/ JK1 | EIVLTQSPGTLYL SPGERATLSC | RAS--QIFSS- ---SYLA | WYQQKPGQ SPRLLIY | G------ ASSRSI | GIPDRFSGSGSG-- TDFTLTISRLEPEDFAVYYC | QQYG-- ---SSRT | FGQGT KVEIK |
| PS:434 671 | 21-225_74F4 | VK3/A27/ JK1 | EIVLTQSPGTLYL SPGERATLSC | RAS--QSVYS- ---SYLA | WYQQKPGQ APRLLIY | G------ ASSRAT | GIPDRFSGSGSG-- TDFTLTISRLEPEDFAVYYC | QHYDN- ---SPWT | FGQGT KVEIK |
| PS:434 687 | 21-225_75A5 | VK3/A27/ JK1 | EIVLTQSPGTLSL SPGERATLSC | RAR--QSVDS- ---SYLA | WYQQKRGQ APRLLIY | G------ ASSRST | GIPDRFSGSGSG-- TDFALTISRLEPEDFAVYYC | QQYES- ---SPWT | FGQGT KVEIK |
| PS:434 691 | 21-225_75G7 | VK3/A27/ JK1 | EIVLTQSPGTLSL SPGERATLSC | RAS--QSVYS- ---SYLA | WYQQKPGQ APRLLIY | G------ ASSRAT | GIPDRFSGSGSG-- TDFALTISRLEPEDFAVYYC | QHSDN- ---SPWT | FGQGT KVEIK |
| PS:434 693 | 21-225_79F11 | VK3/A27/ JK1 | EIVLTQSPGTLYL SPGERATLSC | RAS--QSVYS- ---SYLA | WYQQKPGQ APRLLIY | G------ ASSRST | TDFALTISRVEPEDCAVYYC | QHSDN- ---SPWT | FGQGT KVEIK |
| PS:434 699 | 21-225_79G12 | VK3/A27/ JK1 | EIVLTQSPGTLYL SPGERATLSC | RAS--QSVYS- ---SYLA | WYQQKPGQ APRLLIY | G------ ASSRAT | GIPDRFSGSGCG-- TDFTLTISRLEPEDFAVYYC | QHSDN- ---SPWT | FGQGT KVEIK |
| PS:434 701 | 21-225_80A1 | VK3/A27/ JK1 | EIVLTQSPGTRYL SPGEIPTLSC | GYLA | WYQQKPGQ APRLLIY | G------ ASSRST | TDFTLTISRLEPEDFAVYYC | QHSDN- ---SPWT | FGQGT KVEIK |
| PS:434 703 | 21-225_80C1 | VK3/A27/ JK1 | EIVLTQSPGTLSL SPGERATLSC | RAS--QSINS- ---NYLA | WYQQKPGQ APRLLIY | G------ ASSRAT | GIPDRFSGSGSG-- TDFALTISRLEPEDFAVYYC | QQYES- ---SPWT | FGQGT KVEIK |
| PS:434 709 | 21-225_80E3 | VK3/A27/ JK1 | EIVLTQSPGTLSL SPGERATLSC | RAS--QSVYS- ---SYLA | WYQQKPGQ APRLLIY | G------ ASSRAP | TDFALTISRVEPEDCAVYYC | QHSDN- ---SPWT | FGQGT KVEIK |
| PS:434 715 | 21-225_80D5 | VK3/A27/ JK1 | EIVLTQSPGTLSL SPGKRVTLSC | RAS--QNIYS- ---SYLA | WYQQKPGQ APRLLIY | G------ ASSRAP | GIPDRFSGSGCG-- TDFTLTISRLEPEDFAVYYC | QQYES- ---SPWT | FGQGT KVEIK |
| PS:434 717 | 21-225_80A6 | VK3/A27/ JK1 | EIVLTQSPGTLSL SPGEIPTLSC | RAS--QSVDS- ---GYLA | WYQQKPGQ APRLLIY | G------ ASSRST | GIPDRFSGSGSG-- TDFTLTISRLEPEDFAVYYC | QHSDN- ---SPWT | FGQGT KVEIK |
| PS:434 725 | 21-225_80H7 | VK3/A27/ JK1 | EIVLTQSPGTLSL SPGERATLSC | RAS--QSINS- ----NYLA | WYQQKPGQ APRLLIY | G------ ASSRAT | GIPDRFSGSGSG-- TDFALTISRLEPEDFAVYYC | QHSDN- ---SPWT | FGQGT KVEIK |
| PS:434 735 | 21-225_80B10 | VK3/A27/ JK1 | EIVLTQSPGTLSL SPGERATLSC | RAS--QSVDS- ---SYLA | WYQQKPGQ APRLLIY | G------ ASSRAP | GIPDRFSGSGSG-- TDFALTISRVEPEDCAVYYC | QQYES- ---SPWT | FGQGT KVEIK |
| PS:434 743 | 21-225_74A4 | VK3/A27/ JK1 | EIVLTQSPGTLYL SPVERATLSC | RAS--QNIYS- ---SYLA | WYQQKPGQ APRLLIY | G------ ASSRAP | GIPDRFSGSGSG-- TDFALTISRLEPEDFAVYYC | QHSDN- ---SPWT | FGQGT KVEIK |
| PS:434 751 | 21-225_80H12 | VK3/A27/ JK1 | EIVLTQSPGTLYL SPGERATLSC | RAS--QSVYS- ---SYLA | WYQQKPGQ APRLLIY | G------ ASSRST | GIPDRFSGSGCG-- TDFALTISRLEPEDFAVYYC | QHSDN- ---SPWT | FGQGT KVEIK |
| PS:434 759 | 21-225_81C5 | VK3/A27/ JK1 | EIVLTQSPGTRYL SPGERATLSC | RAS--QSVYS- ---SYLA | WYQQKPGQ APRLLIY | G------ ASSRST | GLPDRFSGSGSG-- TDFALTISRLEPEDFAVYYC | QQYES- ---SPWT | FGQGT KVEIK |
| PS:434 773 | 21-225_75D9 | VK3/A27/ JK1 | EIVLTQSPGTLYL SPGERATLSC | RAS--QSVYS- ---SYLA | WYQQKPGQ APRLLIY | G------ ASSRAI | GIPDRFSGSGSG-- TDFALTISRLEPEDFAVYYC | QHSDN- ---SPWT | FGQGT KVEIK |
| PS:434 777 | 21-225_81C11 | VK3/A27/ JK1 | EIVLTQSPGTLYL SPGERATLSC | RAS--QSVYS- ---SYLA | WYQQKPGQ APRLLIY | G------ ASSRSI | GIPDRFSGSGSG-- TDFTLTISRLEPEDFAVYYC | QHSDN- ---SPWT | FGQGT KVEIK |
| PS:434 809 | 21-225_74F5 | VK3/A27/ JK1 | EIVLTQSPGTLYL SPGERATLSC | RAS--QSVYS- ---SYLA | WYQQKPGQ APRLLIY | G------ ASSRSI | VLPDRFSGSGSG-- TDFALTISRVEPEDCAVYYC | QHSDN- ---SPWT | FGQGT KVEIK |
| PS:434 821 | 21-225_83G1 | VK3/A27/ JK1 | EIVLTQSPGTRYL SPGERATLSC | RAS--QSVDS- ---SYLA | WYQQKPGQ APRLLIY | G------ ASSRST | GIPDRFSGSGSG-- TDFALTISRLEPEDFAVYYC | QHSDN- ---SPWT | FGQGT KVEIK |
| PS:434 835 | 21-225_83B6 | VK3/A27/ JK1 | EIVLTQSPGTLSL SPGERATLSC | RAS--QSVDS- ---GYLA | WYQQKPGQ APRLLIY | G------ ASSRTF | GIPDRFSGSGSG-- TDFTLTISRLEPEDFAVYYC | QQYES- ---SPWT | FGQGT KVEIK |

Figure 51 (Continued)

| ID | | | | | | | | | |
|---|---|---|---|---|---|---|---|---|---|
| PS:434 839 | 21- 225_83B7 | VK3|A27/ JK1 | EIVLTQSPGTRYL SSVERATLSC | RAS--QSVVS- ----SYLA | WYQQKPGQ APRLLIY | G------ ASSRST | GIPDRFSGSGSG-- TDFALTISRLEPEDCAVYYC | QHSDN---- ----SPWT | FGQGT KVEIK |
| PS:434 849 | 21- 225_83C10 | VK3|A27/ JK1 | EIVLTQSPGTLSL SPGERATLSC | RAS--PSVHS- ----NYLA | WYQQKPGQ APRLLIY | G------ ASSRAT | GIPDRFSGSGSG-- TDFTLTISRLEPEDFAVYYC | QQYES---- ----SPWT | FGQGT KVEIK |
| PS:434 869 | 21- 225_84E12 | VK3|A27/ JK1 | EIVLTQSPGTLSL SPGERATLSC | RAS--QSINS- ----NYLA | WYQQKPGQ APRLLIY | G------ ASSRAT | TDFTLTISRLEPEDFAVYYC GIPDRFSGSGSG-- | QQYES---- ----SPWT | FGQGT KVEIK |
| PS:434 879 | 21- 225_85A3 | VK3|A27/ JK1 | EIVLTQSPGTLFL SPGERATLSC | RAS--QSVVS- ----SYLA | WYQQKPGAQ APRLLIY | G------ ASSRAS | GIPDRFSGSGSG-- TDFTLTISRLEPEDFAVYYC | QHYDN---- ----SPWT | FGQGT KVEIK |
| PS:434 881 | 21- 225_85B4 | VK3|A27/ JK1 | EIVLTQSPGTLFL SPGERATLSC | RAS--QSVYS- ----SYLA | WYQQKPGQ APRLLIY | G------ ASSRAT | GIPDRFSGSGSG-- TDFALTISRLEPEDCAVYYC | QHYDS---- ----SPWT | FGQGT KVEIK |
| PS:434 887 | 21- 225_85D6 | VK3|A27/ JK1 | EIVLTQSPGTLFL SQGERATLSC | RAS--QSVSS- ----RYLA | WYQQKPGQ APRLLIY | G------ ASSRAT | GIPDRFSGSGSG-- TDFTLTISRLEPEDFAVYYC | QHYDS---- ----SPWT | FGQGT KVEIK |
| PS:434 891 | 21- 225_85G6 | VK3|A27/ JK1 | EIALTQSPGTLSL SPGERATLSC | RAS--PSVDS- ----SYLA | WYQQKPGQ APRLLIY | G------ AASRAP | GIPDRFSGSGSG-- TDFTLTISRLEPEDFVVYYC | QQYES---- ----SPWT | FGQGT KVEIK |
| PS:434 895 | 21- 225_74H7 | VK3|A27/ JK1 | EIVLTQSPGTLSL SPGERATLSC | RAS--QNIYS- ----SYLA | WYQQKPGQ APRLLIY | G------ ASSRAT | GIPDRFSGSGSG-- TDFTLTISRLEPEDFAVYYC | QQYES---- ----SPWT | FGQGT KVEIK |
| PS:434 899 | 21- 225_85B9 | VK3|A27/ JK1 | EIVLTQSPGTLFL SPGERATLSC | RAS--QSVNS- ----NYLA | WYRQKPGQ APRLLIY | G------ ASSRAT | GIPDRFSGSGSG-- TDFALTISRLEPEDCAVYYC | QQYES---- ----SPWT | FGQGT KVEIK |
| PS:434 907 | 21- 225_85G10 | VK3|A27/ JK1 | EIVLTQSPGSLSL SPGERATLSC | RAS--QSVWS- ----GYLA | WYQQKPGQ APRLLIY | G------ ASARTT | GIPDRFSGSGSG-- TDFTLTISRLEPEDFAVYYC | QHYDN---- ----SPWT | FGQGT KVEIK |
| PS:434 913 | 21- 225_86C1 | VK3|A27/ JK1 | EIVLTQSPGTLSL SPGERATLSC | RAS--QSVYS- ----SYLA | WYQQKPGQ APRLLIY | G------ ASSRST | GIPDRFSGSGSG-- TDFALTISRLEPEDFAVYYC | QHSDN---- ----SPWT | FGQGT KVEIK |
| PS:434 921 | 21- 225_86E4 | VK3|A27/ JK1 | EIVLTQSPGTRYL SPGERATLSC | RAS--QSVYS- ----SYLA | WYQQKPGQ APRLLIY | G------ ASSRST | GIPDRFSGSGSG-- TDFALTISRLEPEDCAVYYC | QHSDN---- ----SPWT | FGQGT KVEIK |
| PS:434 939 | 21- 225_86C11 | VK3|A27/ JK1 | EIVLTQSPGTLYL SPGERATLSC | RAS--QSVYS- ----SYLA | WYQQKPGQ APRLLIY | G------ ASSRSI | GLPDRFSGSGCG-- TDFALTISRVEPEDCAVYYC | QQYES---- ----SPWT | FGQGT KVEIK |
| PS:434 943 | 21- 225_87H1 | VK3|A27/ JK1 | EIVLTQSPGTLSL SPGERATLSC | RAS--QSVDS- ----NYLA | WYQQKPGQ APRLLIY | G------ ASARTT | GIPDRFSGSGSG-- TDFTLTISRLEPEDFAVYYC | QHSDN---- ----SPWT | FGQGT KVEIK |
| PS:434 945 | 21- 225_87E5 | VK3|A27/ JK1 | EFVLTQSPGTLYL SPGERATLSC | RAS--QSVYS- ----SYLA | WYQQKPGQ APRLLIY | G------ ASSRST | GIPDRFSGSGSG-- TDFALTISRVEPEDCAVYYC | QHSDN---- ----SPWT | FGQGT KVEIK |
| PS:434 955 | 21- 225_87C9 | VK3|A27/ JK1 | EIVLTQSPGTLSL SPVERATLSC | RAS--QSVYS- ----SYLA | WYQQKPGQ APRLLIY | G------ ASSRST | GIPDRFSGSGSG-- TDFALTISRLEPEDCAVYYC | QHSDN---- ----SPWT | FGQGT KVEIK |
| PS:434 961 | 21- 225_87A12 | VK3|A27/ JK1 | EIVLTQSPGTRYL SPGERATLSC | RAS--QSVYS- ----SYLA | WYQQKPGQ APRLLIY | G------ ASSRSI | VIPDRFSGSGSG-- TDFALTISRVEPEDCAVYYC | QHSDN---- ----SPWT | FGQGT KVEIK |
| PS:434 969 | 21- 225_88H1 | VK3|A27/ JK1 | EIVLTQSPGTLYL SPGERATLSC | RAS--QSVYS- ----SYLA | WYQQKPGQ APRLLIY | G------ ASSRSI | VIPDRFSGSGCG-- TDFALTISRVEPEDCAVYYC | QQYES---- ----SPWT | FGQGT KVEIK |
| PS:434 981 | 21- 225_88E7 | VK3|A27/ JK1 | EIVLTQSPGTLSL SPGERATLSC | RAS--QSVYS- ----NYLA | WYQQKPGQ APRLLIY | G------ ASSRST | GIPDRFSGSGSG-- TDFTLTISRLEPEDFAVYYC | QHSDN---- ----SPWT | FGQGT KVEIK |
| PS:434 983 | 21- 225_88F7 | VK3|A27/ JK1 | EIVLTQSPGTLSL SPGERATLSC | RAS--QSVYS- ----SYLA | WYQQKPGQ APRLLIY | G------ ASSRST | GIPDRFSGSGSG-- TDFALTISRLEPEDCAVYYC | QHSDN---- ----SPWT | FGQGT KVEIK |
| PS:434 995 | 21- 225_88G9 | VK3|A27/ JK1 | EIVLTQSPGTRYL SPGERATLSC | RAS--QSVVS- ----SYLA | WYQQKPGQ APRLLIY | G------ ASSRSI | GIPDRFSGSGSG-- TDFALTISRVEPEDCAVYYC | QHSDN---- ----SPWT | FGQGT KVEIK |
| PS:434 999 | 21- 225_75A8 | VK3|A27/ JK1 | EIVLTQSPGTLYL SPGERATLSC | RAS--QSVYS- ----SYLA | WYQQKPGQ APRLLIY | G------ ASSRAT | GIPDRFSGSGSG-- TDFALTISRLEPEDCAVYYC | QHSDN---- ----SPWT | FGQGT KVEIK |
| PS:435 013 | 21- 225_89D5 | VK3|A27/ JK1 | EIVLTQSPGTILYL SSGERATLSC | RAS--QSVYS- ----SYLA | WYQQKPGQ APRLLIY | G------ ASSRSI | GIPDRFSGSGSG-- TDFALTISRLEPEDFAVYYC | QHYDN---- ----SPWT | FGQGT KVEIK |

Figure 51 (Continued)

| | | | | | | | | | |
|---|---|---|---|---|---|---|---|---|---|
| PS-435_015 | 21-225_89H5 | VK3/A27/JK1 | EIVLTQSPGTLSLSPGERATLSC | RAS----QSVNS------NYLA | WYQQKPGQAPRLLIY | G------AFSRAT | GIPDRVSGSGSG--TDFNLTISRLEPEDFAVYYC | QQYES------SVWT | FGGGTKVEIK |
| PS-435_025 | 21-225_89E10 | VK3/A27/JK1 | EIVLTQSPGTLYLSSGERATLSC | RAS----QSVYS------SYLA | WYQQKPGQAPRLLIY | ASSRAT | VIPDRFSGSGSG--TDFALTISRVEPEDFAVYYC | QHSDN------SPWT | FGQGTKVEIK |
| PS-435_029 | 21-225_89A11 | VK3/A27/JK1 | EIVLTQSPGTLSLSPGERATLSC | RAS----QSVDS------NFLA | WYQQKPGQAPRLLIY | G------ASARTI | VIPDRFSGSGSG--TDFTLTISRLEPEDFAVYYC | QQYEI------SPWT | FGGGTKVEIK |
| PS-435_039 | 21-225_90G4 | VK3/A27/JK1 | EIVLTQSPGTLYLSSGERATLSC | RAS----QSVYS------SYLA | WYQQKPGQAPRLLIY | ASSRST | TDFALTISRVEPEDCAVYYC | QHSDN------SPWT | FGQGTKVEIK |
| PS-435_041 | 21-225_90A5 | VK3/A27/JK1 | EIVLTQSPGTLSLSPGERATLSC | RAS----QSVYS------SYLA | WYQQKPGQAPRLLIY | G------ASSRAT | GIPDRFSGSGSG--TDFALTISRVEHEDFAVYYC | QHYDN------SPWT | FGQGTKVEIK |
| PS-435_043 | 21-225_90G5 | VK3/A27/JK1 | EIVLTQSPGTLYLSSGERATLSC | RAS----QSVYS------SYLA | WYQQKPGQAPRLLIY | ASSRAI | TDFALTISRVEHEDCAVYYC | QHYDN------SPWT | FGQGTKVEIK |
| PS-435_055 | 21-225_90F10 | VK3/A27/JK1 | EIVLTQSPGTLSLSPGERATLSC | RAS----QSVYS------SYLA | WYQQKPGQAPRLLIY | G------ASSRST | GIPDRFSGSGSG--TDFALTISRVEPEDFAVYYC | QHYDN------SPWT | FGQGTKVEIK |
| PS-435_073 | 21-225_91B2 | VK3/A27/JK1 | EIVLTQSPGTLYLSSGERATLSC | RAS----QSVYS------SYLA | WYQQKPGQAPRLLIY | ASSRST | TDFALTISRVEPEDCAVYYC | QHYDN------SPWT | FGQGTKVEIK |
| PS-435_075 | 21-225_91B3 | VK3/A27/JK1 | EIVLTQSPGTLSLSPGERATLSC | RAS----QSVYS------SYLA | WYQQKPGQAPRLLIY | G------ASSRST | GIPDRFSGSGSG--TDFALTISRVEHEDFAVYYC | QHSDN------SPWT | FGQGTKVEIK |
| PS-435_077 | 21-225_91F3 | VK3/A27/JK1 | EIVLTQSPGTLYLSSGERATLSC | RAS----QSVYS------SYLA | WYQQKPGQAPRLLIY | ASSRST | TDFALTISRVEPEDCAVYYC | QHYDN------SPWT | FGQGTKVEIK |
| PS-435_079 | 21-225_91B4 | VK3/A27/JK1 | EIVLTQSPGTLSLSPGERATLSC | RAS----QSVYS------SYLA | WYQQKPGQAPRLLIY | G------ASSRST | GIPDRFSGSGSG--TDFALTISRVEPEDFAVYYC | QHSDN------SPWT | FGQGTKVEIK |
| PS-435_089 | 21-225_91E9 | VK3/A27/JK1 | EIVLTQSPGTLYLSSGERATLSC | RAS----QSVYS------SYLA | WYQQKPGQAPRLLIY | ASSRST | TDFALTISRVEHEDCAVYYC | QHYDN------SPWT | FGQGTKVEIK |
| PS-435_097 | 21-225_92B1 | VK3/A27/JK1 | EIVLTQSPGTLSLSPGERATLSC | RAS----QSVGS------NYLA | WYQQKRGQAPRLLIY | G------ASSRAI | DIPDRFSGSGSG--TDFTLTISRLEPEDFAVYYC | QQYES------SPWT | FGGGTKVEIK |
| PS-435_111 | 21-225_92D6 | VK3/A27/JK1 | EIVLTQSPGTLYLSSGERATLSC | RAS----QSVYS------SYLA | WYQQKPGQAPRLLIY | ASSRST | TDFALTISRVEPEDCAVYYC | QHYDN------SPWT | FGQGTKVEIK |
| PS-435_115 | 21-225_77C5 | VK3/A27/JK1 | EIVLTQSPGTLSLSPGERATLSC | RAS----QSVYS------SYLA | WYQQKPGQAPRLLIY | G------ASSRAT | GIPDRFSGSGSG--TDFALTISRLEPEDFAVYYC | QHSDN------SPWT | FGQGTKVEIK |
| PS-435_171 | 21-225_93C2 | VK3/A27/JK1 | EIVLTQSPGTLYLSSGERATLSC | RAS----QSVYS------SYLA | WYQQKPGQAPRLLIY | ASSRST | TDFALTISRLEHEDCAVYYC | QHSDN------SPWT | FGQGTKVEIK |
| PS-435_177 | 21-225_93E4 | VK3/A27/JK1 | EIVLTQSPGTLSLSPGERATLSC | RAS----QSVYS------SYLA | WYQQKPGQAPRLLIY | G------ASSRST | GIPDRFSGSGSG--TDFALTISRVEPEDFAVYYC | QHYDN------SPWT | FGQGTKVEIK |
| PS-435_183 | 21-225_93E9 | VK3/A27/JK1 | EIVLTQSPGTLSLSPGERATLSC | RAS----QSVDS------SYLA | WYQQKTGQAPRLLIY | G------ASSRAP | TDFTLTISRLEPEDFAVYYC | QQYES------SPWT | FGGGTKVEIK |
| PS-435_195 | 21-225_94D3 | VK3/A27/JK1 | EIVLTQSPGTLYLSSQGERATLSC | RAS----QSVSS------RYLA | WYQQKPGQAPRLLIY | ASSRAI | TDFTLTISRVEPEDCAVYYC | QHYDS------SPWT | FGQGTKVENQ |
| PS-435_217 | 21-225_94F12 | VK3/A27/JK1 | EIVLTQSPGTLSLSPGERATFSC | RAS----QSVYS------SYLA | WYQQKPGQAPRLLIY | G------ASSRAI | GIPDRFSGSGSG--TDFTLTISRLEPEDFAVYYC | QHYDN------SPWT | FGQGTKVEIK |
| PS-435_219 | 21-225_95D2 | VK3/A27/JK1 | EIVLTQSPGTLYLSSGERATLSC | RAS----QSVYS------SYLA | WYQQKPGQAPRLLIY | ASSRAI | TDFALTISRLEPEDCAVYYC | QHYDN------SPWT | FGQGTKVEIK |
| PS-435_235 | 21-225_95F9 | VK3/A27/JK1 | EIVLTQSPGTLSLSPGERATLSC | RAS----QSVYS------SYLA | WYQQKPGQAPRLLIY | G------ASSRST | GIPDRFSGSGSG--TDFALTISRLEPEDFAVYYC | QHYDN------SPWT | FGGGTKVEIK |
| PS-435_237 | 21-225_95G9 | VK3/A27/JK1 | EIVLTQSPGTILSLSSGERATLSC | RAS----QSVYS------SYLA | WYQQKPGQAPRLLIY | ASSRST | GIPDRFSGSGSG--TDFALTISRVEHEDCAVYYC | QHYDN------SPWT | FGQGTKVEIK |

Figure 51 (Continued)

| ID | | | | | | | | | | |
|---|---|---|---|---|---|---|---|---|---|---|
| iPS-435239 | 21-225_95H10 | VK3/A27/JK1 | EIVLSQSPGILYLSSGERATLSC | RAS--QSVYS-----SYLA | WYQQKPGQAPRLLIY | G-------ASSRAT | GIPDRFSGSGSG---TDFALTISRLEPEDFAVYYC | QHYDN------ | ---SPWT | FGGGTKVEIK |
| iPS-435273 | 21-225_97A2 | VK3/A27/JK1 | EIVLTQSPGTLYLSSGERATLSC | RAS--QSVYS-----SYLA | WYQQKPGQAPRLLIY | G-------ASSRST | GIPDRFSGSGSG---TDFALTISRLEPEDCAVYYC | QHSDN------ | ---SPWT | FGGGTKVEVK |
| iPS-435281 | 21-225_97E5 | VK3/A27/JK1 | EIVLTQSPGTLSLSPGERATLSC | RAS--QSVYS-----SYLA | WYQQKPGQAPRLLIY | G-------ASSRAI | TDFALTISRVEPEDCAVYYC | QHSDN------ | ---SPWT | FGGGTKVEIK |
| iPS-435331 | 21-225_147G8 | VK3/A27/JK1 | QIVLTQSPGTLSLSPGERATLSC | RAS--QRIFS-----NYLA | WYQQKPGQAPRLLIY | G-------ASSRAT | GIPDRISGSGSG---TDFTLTISRLEPEDFAVYYC | QQYDS------ | ---SPWT | FGGGTKVEIK |
| iPS-435815 | 21-225_190G10 | VK3/A27/JK1 | EIVLTQSPGTLSLSPGESATLSC | RAS--PSVSS-----RFLA | WYQQKPGQAPRLLIY | G-------ASSRAT | GIPDRFSGSGSG---TDFTLTISRLEPEDFAVYYC | QQYGS------ | ---SPPWT | FGGGTKVEIK |
| iPS-435843 | 21-225_191F1 | VK3/A27/JK1 | EIVLTQSPGTLSLSPGERAALSC | RAS--QSISL-----NFLA | WYQQKPGQAPRLLIY | G-------ASNRAT | TDFTLTINRLEPEDFAVYYC | QQYGN------ | ---SPWT | FVQGTKVEVK |
| iPS-435847 | 21-225_191A3 | VK3/A27/JK1 | EIVLTQSPGTLSLSPGERATLSC | RAS--QSIRS-----SFLA | WYQQKPGQAPRLLIY | G-------ASSRAT | GIPDRFSGSGSG---TDFTLTISRLEPEDFAVYYC | QQYGN------ | ---SPWA | FGGGTKVEVK |
| iPS-435849 | 21-225_191C3 | VK3/A27/JK1 | EIMLTQSPGTLSLSPGERATLSC | RAS--QSIRS-----NFLA | WYQQKPGQAPRLLIY | G-------ASSRAI | GIPDRFSGSGSG---TDFTLTISRLEPEDFAVYYC | QQYGN------ | ---SPWT | FGGGTKVEIK |
| iPS-435851 | 21-225_191D3 | VK3/A27/JK1 | EIVLTQSPGTLSLSPGESATLSC | RAG--QSIRT-----NFLA | WYQQQPGQAPRLLIY | G-------ASSRAT | GIPDRFSGSVSG---TDFTLTINRLEPEDFAVYYC | QQYGS------ | ---SPWA | FGGGTKVEIK |
| iPS-435865 | 21-225_191A5 | VK3/A27/JK1 | EIVLTQSPGTLSLSPGESATLSC | RAS--QSVSS-----RFLA | WYQQKPGQAPRLLIY | G-------ASSRAT | GIPDRFSGSGSG---TDFTLTISRLEPEDFAVYYC | QQYGG------ | ---SPPWT | FVQGTKVEIK |
| iPS-435905 | 21-225_190A3 | VK3/A27/JK1 | EIMLTQSPGTLSLSPGERATLSC | RAS--QNIRS-----NFLA | WYQQKPGQAPRLLIY | G-------ASSRAT | GIPDRFSGSVSG---TDFTLTINRLEPEDFAVYYC | QQYGN------ | ---SPWT | FGGGTKVEIK |
| iPS-435911 | 21-225_190B4 | VK3/A27/JK1 | EIVLTQSPGTLSLSPGERATLSC | RAS--QSIRS-----SFLA | WYQQKPGQAPRLLIY | G-------ASSRAI | GIPDRISGSGSG---TDFTLTISRLEPEDFAVYYC | QQYGN------ | ---SPWA | FGGGTKVEIK |
| iPS-435913 | 21-225_190A7 | VK3/A27/JK1 | EIVLTQSPGTLSLSPGESATLSC | RAS--QSVRS-----NFLA | WHQQKPGQAPRLLIY | G-------AYRRAT | GIPARFSGSGSG---TDFTLTISRLEPEDFAVYYC | QQYGS------ | ---SPWT | FGGGTKVEIK |
| iPS-435939 | 21-225_191H7 | VK3/A27/JK1 | EIVLTQSPGTLSLSPGESATLSC | RAG--QSIRT-----DFLA | WYQQQPGQAPRLLIY | G-------PSSRAT | GIPDRFSGSGSG---TDFTLTINRLEPEDFAVYYC | QQYGI------ | ---SPWT | FGGGTKVEIN |
| iPS-435967 | 21-225_192B3 | VK3/A27/JK1 | EIVLTQSPGTLSLSPGERATLSC | RAS--QSVKS-----SFLA | WYQQKPGQAPRLLIY | G-------ASSRAT | GIPDRFSGSGSG---TDFTLTISRLEPEDFAVYYC | QQYGN------ | ---SPWA | FGGGTKVEIK |
| iPS-435973 | 21-225_192H3 | VK3/A27/JK1 | EIVLTQSPGTLSLSPGERATLSC | RAS--QSVSS-----NFLA | WYQQKPGQAPRLLIF | G-------ASSRAT | GIPDRFSGSGSG---TDFTLTISRLEPEDFAVYYC | QQYES------ | ---SPWT | FGGGTKVEIK |
| iPS-435995 | 21-225_192F8 | VK3/A27/JK1 | EIVLTQSPGTLSLSPGERATLSC | RAS--QSISS-----SYLA | WYQQKPGQAPRLLIY | G-------ASNRAT | GIPARFSGSGSG---TDFTLTINRLEPEDFAVYYC | QQYGN------ | ---SPWA | FGGGTKVEIK |
| iPS-436007 | 21-225_192G12 | VK3/A27/JK1 | EIVLTQSPGTLSLSPGERATLSC | RAS--QSVRS-----DFLV | WLQQKPGQAPRLLIY | G-------VSRRAT | GIPDRFSGSGSG---TDFTLTISRLEPEDFAVYYC | QQYGS------ | ---SPWT | FGGGTKVEIK |
| iPS-436009 | 21-225_193A1 | VK3/A27/JK1 | EIVLTQSPGTLSLSPGERATLSC | RAS--QSIKS-----NFLA | WHQQKPGFIYAPRLFIY | G-------ASRRAT | GIPDRFSGSGSG---TDFTLTINRLEPEDFAVYYC | QQYGN------ | ---SPWT | FGGGTKVEIK |
| iPS-436011 | 21-225_193B1 | VK3/A27/JK1 | EIVLTQSPGTLSLSPGERATLSC | RAS--QSVRS-----NFLA | WHQQKPGQAPRLLIY | G-------ASRRAT | GIPDRFSGSGSG---TDFTLTISRLEPEDFAVYYC | QQYGN------ | ---SPWA | FGGGTKVEIK |
| iPS-436015 | 21-225_193D3 | VK3/A27/JK1 | EIVLTQSPGTLSLSPGERATLSC | RAS--QSIRT-----NFLA | WYQQKPGQAPRLLIY | G-------ASNRAT | GIPARFSGSGSG---TDFTLTINRLEPEDFAVYYC | QQYGN------ | ---SPWA | FGGGTKVEIK |
| iPS-436017 | 21-225_193F3 | VK3/A27/JK1 | EIVLTQSPGESATLSC | RAG--QSIRT-----DFLV | WYQQQPGQAPRLLIY | G-------ASSRAT | GFPERFSGSGSG---TDFTLTINRLEPEDFAVYYC | QQYGS------ | ---SPWT | FGGGTKVEIN |

Figure 51 (Continued)

| | | | | | | | | |
|---|---|---|---|---|---|---|---|---|
| iPS-436 027 | 21-225_193E6 | VK3|A27/ JK1 | EIVLAQSPGTLSL SPGERATLSC | RAS--QSVRS- ----GYLA | WYQQKPGQ APRLLIY | G------- ASSRAT | GIPDRFGGSGSG--- TDFTLTISRLEPEDFAVYYC | QQYES------- -------SPWT | FGQGT KVEIK |
| iPS-436 029 | 21-225_193H6 | VK3|A27/ JK1 | EIVLTQSPGSATLSC | RAG--QSIRT- ----NFLA | WYQQQPGQ APRLLIY | G------- ASSRAT | GIPDRFSGSGSG--- TDFTLTINRLEPEDFAVYFC | QQYGS------- -------SPWT | FGQGT KVEIN |
| iPS-436 035 | 21-225_193C8 | VK3|A27/ JK1 | EIVLTQSPGTLFL SPGERATLSC | RAS--QSIRT- ----SFLA | WYQQKPGQ APRLLIY | G------- ASSRAT | GIPDRFSGSGSG--- TDFTLTISRLEPEDFAVYYC | QQYGN------- -------SPWA | FGQGT KVEVK |
| iPS-436 037 | 21-225_193D8 | VK3|A27/ JK1 | EIVLKQSPGTLFL SPGERATLSC | RAS--QSIRT- ----NFLA | WYQQKPGQ APRLLIY | G------- ASSRAT | GIPDRFSGSGSG--- TDFTLTISRLEPEDFAVYYC | QQYGN------- -------SPWT | FGQGT KVEIK |
| iPS-436 041 | 21-225_193G8 | VK3|A27/ JK1 | EIVLTQSPGTLSL SPGERATLSC | RAS--QSVRT- ----NFLA | WHQQKPGQ APRLLIY | G------- ASRRAT | GIPDRFSGSGSG--- TDFTLTINRLEPEDFALYC | QQYGN------- -------SPWT | FGQGT KVEIK |
| iPS-436 047 | 21-225_193B1 0 | VK3|A27/ JK1 | EIVLTQSPGTLSL SPGERATLSC | RAS--PSVGS- ----SYLA | WYQQKPGQ APRLVIY | G------- ASRRAT | GIPDRFSGSGSG--- TDFTLTISRLEPEDFAVYYC | QQYGS------- ------SPPWT | FGQGT KVEIK |
| iPS-436 049 | 21-225_193B1 2 | VK3|A27/ JK1 | EIVLTQSPGTLSL SPGESATLSC | RAS--QSIRS- ----SFLA | WYQQKPGQ APRLLIY | D------- ASSRAT | GIPDRFSGSGSG--- TDFTLTINRLEPKDFAVYYC | QQYGN------- -------SPWT | FGQGT KVEIK |
| iPS-436 062 | 21-225_194E5 | VK3|A27/ JK1 | EIVLTQSPGTLSL SPGERATLSC | RAS--QSIRS- ----NFLA | WYQQKPGQ APRLLIY | G------- ASSRAT | GIPDRFSGSGSG--- TDFTLTINRLEPEDFAVYYC | QQYGS------- -------SPWT | FGQGT KVEIK |
| iPS-436 064 | 21-225_194E6 | VK3|A27/ JK1 | EIVLTQSPGTLSL SPGESATLSC | RAS--PSVNS- ----SFLA | WYQQKPGQ APRLLIF | G------- ASSRAT | GIPDRFSGSVSG--- TDFTLTINRLEPEDFAVYYC | QQYGS------- -------SPWT | FGQGT KVEIK |
| iPS-436 072 | 21-225_194C1 0 | VK3|A27/ JK1 | EIVLTQSPGTLSL SPGERATLSC | RAS--PSVNS- ----SFLA | WYQQKPGQ TPRLLIF | G------- ASSRAT | ADFTLTINRLEPEDFAVYYC TDFTLTINRLEPEDFAVYYC | QQYES------- -------SPWA | FGQGT KVEIK |
| iPS-436 080 | 21-225_195B1 | VK3|A27/ JK1 | EIVLTQSPGTLFL SSGERATLSC | RAS--PSVNS- ----NYLA | WYQQKPGQ TPRLLIY | G------- ASNRAT | GVPDRFSASGSG--- TDFTLTIRRLEPEDFAVYFC | QQYES------- -------SPWT | FGQGT KVEIK |
| iPS-436 088 | 21-225_195C8 | VK3|A27/ JK1 | EIVLTQSPGTLSL SPGERATLSC | RAS--QSIRS- ----SFLA | WYQQKPGQ AFRLLIY | G------- AFSRAT | GIPDRFSGSGSG--- TDFTLTISRLEPEDFAVYYC | QQYGN------- -------SPWA | FGQGT KVEIK |
| iPS-436 122 | 21-225_196G1 | VK3|A27/ JK1 | EIVLTQSPGTLLL SPGERATLSC | RAS--PSVSN- ----SFLA | WYQQKPGQ APRLLIY | G------- AFSRAT | GIPDRFSGSGSG--- TDFTLTINRLEPEDFAVYYC | QQYGN------- ------SPPWT | FGQGT KVEIK |
| iPS-436 134 | 21-225_196H1 2 | VK3|A27/ JK1 | EIVLTQSPGTLFLL YSSERSTLSC | RAS--QSVRS- ----SYLA | WYQQKPGQ APRLLIC | G------- AFPSRAS | GIPDRFSGSGSG--- TDFTLTISRLEPEDFAVYYC | QQYGS------- -------SPWT | FGQGT KVEIK |
| iPS-436 146 | 21-225_197F4 | VK3|A27/ JK1 | EIVLTQSPGTLSL SPGERATLSC | RAS--QSIRS- ----SFLA | WYLQKPGQ APRLLIY | G------- AYRRAT | GIPDRFSGSGSG--- TDFTLTINRLEPEDFAVYYC | QQYGN------- -------SPWA | FGQGT KVEIK |
| iPS-436 177 | 21-225_198B1 | VK3|A27/ JK1 | EIVLTQSPGSATLSC | RAG--QSIRT- ----NFLA | WYQQQPGQ APRLLIY | G------- ASSRAT | GIPDRFSGSGSG--- TDFTLTINRLEPEDFAVYYC | QQYGS------- -------SPWT | FGQGT KVEIK |
| iPS-436 179 | 21-225_198E1 | VK3|A27/ JK1 | EIVLTQSPGTLSL SPGERATLSC | RAS--QSVRS- ----NFLA | WYQQKPGQ APRLLIY | G------- ASSRAT | GIPDRFSGSGSG--- TDFTLTINRLEPEDFAVYYC | QQYGN------- -------SPWT | FGQGT KVEIK |
| iPS-436 181 | 21-225_198C2 | VK3|A27/ JK1 | EIVLTQSPGTLLL SPGERATLSC | RAS--QSVRS- ----SYLA | WYQQKPGQ APRLLIC | G------- AFPSRAS | GIPDRFSGSGSG--- TDFTLTISRLEPEDFAVYYC | QQYGN------- -------SPWT | LGHAI KVEIK |
| iPS-436 195 | 21-225_198G1 | VK3|A27/ JK1 | EIVLTQSPGTLSL SPGERATLSC | RAS--QSIRS- ----SFLA | WYQQKPGQ APRLLIY | G------- ASSRAT | GIPDRFSGSGSG--- TDFTLTINRLEPEDFAVYYC | QQYGN------- -------SPWT | FGQGT KVEIK |
| iPS-436 197 | 21-225_199C2 | VK3|A27/ JK1 | EIVLTQSPGTLSL SPGERATLSC | RAS--QSIRS- ----SFLA | WYQQKPGQ APRLLIY | G------- ASSRAT | GIPDRFSGSGSG--- TDFTLTINRLEPEDFAVYYC | QQYGN------- -------SPWA | FGQGT KVEIK |

Figure 51 (Continued)

| | | | | | | | | | |
|---|---|---|---|---|---|---|---|---|---|
| iPS:436 207 | 21-225_199C7 | VK3/A27/ JK1 | EIVLTQSPGTLSL SPGERATLSC | RAS--QSIRT- ----NFLA | WYQQKPGQ APRLLIY | G------ ASSRAT | GIPDRFSGSGSG- TDFTLTINRLEPEDFAVYYC | QQYGN------ ---------SPWT | FGQGT KVEIK |
| iPS:436 210 | 21-225_199G1 | VK3/A27/ JK1 | EIVVTQSPGTLSL SPGERATLSC | RAS--QSVRS- -----SYLA | WYQQKPGQ APRLLIY | AFSRAT | GIPDRFSGSGSG- TDFTLTINRLEPEDFAVYFC | QQYGN------ ---------SPWA | FGHGT KVEIK |
| iPS:436 226 | 21-225_200F10 | VK3/A27/ JK1 | EIVLTQSPGTLSL SPGERATLSC | RAS--QNIRS- -----SFLA | WYQQKPGQ APRLLIY | G------ ASSRAT | GIPDRFSGSGSG- TDFTLTISRLEPEDFAVYYC | QQYGN------ ---------SPWT | FGQGT KVEIK |
| iPS:436 232 | 21-225_201E1 | VK3/A27/ JK1 | EIVLTQSPDTLSL SPGERATLSC | RAS--PSINS- ----GFLA | WYQQKPGQ APRLLIY | G------ ASSRAT | GIPDRFSGSGSG- TDFTLTISRLEPEDFAMFHC | HQYET------ ---------SFWT | FGQGT KVEIK |
| iPS:436 238 | 21-225_201B2 | VK3/A27/ JK1 | EIVLTQSPGTLSL SPGERATLSC | RAS--QSVSS- ----NYLA | WYQQKPGQ APRLLIY | G------ ASSRAT | GIPDRFSGSGSG- TDFTLTISRLEPEDFAVYFC | QQYEN------ ---------SPWT | FGQGT KVEIK |
| iPS:436 256 | 21-225_202D9 | VK3/A27/ JK1 | EIVLTQSPDTLSL SPGERATLSC | RAS--QSVNS- ----GYLA | WYQQKPGQ SPRLLIY | G------ ASSRAT | GIPDRFSGSGSG- TDFTLTISRLEPEDFAVHYC | QQYET------ ---------SPWT | FGQGT KVEIK |
| iPS:436 302 | 21-225_205G7 | VK3/A27/ JK1 | EIVLTQSFGTLSL SPGERATLSC | RAS--QSVFS- ----NYLA | WYQQKPGQ APRLLIY | G------ ASSRAA | GIPDRFSGSGSG- TDFTLTISRLEPENFAVYYC | QQYES------ ---------SPWT | FGQGT KVEIK |
| iPS:436 310 | 21-225_202D1 | VK3/A27/ JK1 | EIVLTQSPGTLSL SPGERATLSC | RAS--QSINS- ----NYLA | WYQRKPGQ APRVLIY | G------ ASSRAT | GIPDRFSGSGSG- TDFTLTISRLEPEDFAVFYC | QQYEN------ ---------SPWT | FGQGT KVEIK |
| iPS:436 336 | 21-225_208B5 | VK3/A27/ JK1 | EIVLTQSPGTLSL SPGERATLSC | RAS--QSVSS- ----NYLA | WYQQKPGQ APRLLIY | G------ ASSRAT | GIPDRFSGSGSG- TDFTLTISRLEPEDFAVYFC | QHYEN------ ---------SPWT | FGQGT KVEIK |
| iPS:436 340 | 21-225_208A9 | VK3/A27/ JK1 | EIVVTQSPGTLSL SPGERATLSC | RAS--QSVSN- ----NYLA | WYQQKPGQ APRVLIY | G------ ASSRAT | GIPDRFSGSGSG- TDFALTISRLEPEDCAVYYC | QHYHS------ ---------SPWT | FGQGT KVEIK |
| iPS:436 472 | 21-225_220E1 | VK3/A27/ JK1 | EIVLTQSPGTLSL SPGERATLSC | RAS--QSIGR- ----SHLV | WYQQKPNQ APRLLIY | V------ TSSRAT | GIPDRFSGSGSG- TDFALTISRVEHEDCAVYYC | QQYGS------ ---------SPWT | FGQGT KVEIK |
| iPS:436 506 | 21-225_222C7 | VK3/A27/ JK1 | EIVLTQSPGTLSL SPGERATLSC | RAS--QSVYS- ----NYLA | WYQQKPGQ APRLLIY | G------ ASSRAT | GIPDRFSGSGSG- TDFTLAISRLEPEDFTIYYC | QQYED------ ---------SPWT | FGQGT KVEIK |
| iPS:436 580 | 21-225_225E7 | VK3/A27/ JK1 | EIVLTQSPGTLSL SPGERATLSC | RAS--QSVYS- ----SYLA | WYQQKPGQ APRLLIY | G------ ASSRAT | GIPDRFSGSGSG- TDFTLTISRLEPEDFAVYYC | QQYGT------ ---------SPRT | FGQGT KVEIK |
| iPS:437 324 | 21-225_75C2 | VK3/A27/ JK1 | EIVLTQSPGTRYL SPGERATLSC | RAS--QSVYS- ----SYLA | WYQQKPGQ APRLLIY | G------ ASSRAP | GIPDRFSGSGSG- TDFALTISRVEPEDCAVYYC | QHYDN------ ---------SPWT | FGKGT KVEIK |
| iPS:437 328 | 21-225_75D3 | VK3/A27/ JK1 | EIVLTQSPGTLYL SPGERATLSC | RAS--QSVYS- ----SYLA | WYQQKPGQ APRLLIY | G------ ASSRST | GIPDRFSGSGCG- TDFALTISRVEHDCAVYYC | QHYDN------ ---------SPWT | FGQGT KVEIK |
| iPS:437 332 | 21-225_75F3 | VK3/A27/ JK1 | EIVLTQSPGTLYL SPGERATLSC | RAS--QSVYS- ----SYLA | WYQQKPGQ APRLLIY | G------ ASSRST | GIPDRFSGSGSG- TDFALTISRLEHEDFAVYYC | QHYDN------ ---------SPWT | FGQGT KVEIK |
| iPS:437 340 | 21-225_75G9 | VK3/A27/ JK1 | EIALIQSPGTLSL SPGERATLSC | RAS--PSVDS- -----SYLA | WYQQKPGQ APRLLIY | G------ ASSRAP | GIPDRFSGSGSG- TDFTLTISRLEPEDFAVYYC | QQYES------ ---------SPWT | FGQGT KVEIK |
| iPS:437 344 | 21-225_75G12 | VK3/A27/ JK1 | EIVLTQSPGTLYL SPGERATLSC | RAS--QSVYS- ----SYLA | WYQQKPGQ APRLLIY | G------ ASSRAT | GIPDRFSGSGCG- TDFALTISRVEPEDCAVYYC | QHYDN------ ---------SPWT | FGQGT KVEIK |
| iPS:437 350 | 21-225_74A3 | VK3/A27/ JK1 | EIVLTQSPGTLSL SPGERATLSC | RAS--QSVYS- ----SYLA | WYQQKPGQ APRLLIY | G------ ASSRST | GIPDRFSGSGSG- TDFALTISRLEPEDFAVYYC | QHSDN------ ---------SPWT | FGQGT KVEIK |
| iPS:437 369 | 21-225_74D6 | VK3/A27/ JK1 | EIVLTQSPGTLSL SPGERATLSC | RAS--QSVYS- ----SYLA | WYQQKPGQ APRLLIY | G------ ASSRAT | GIPDRFSGSGCG- TDFALTISRLEPEDFAVYYC | QHYDN------ ---------SPWT | FGQGT KVEIK |
| iPS:437 383 | 21-225_74H8 | VK3/A27/ JK1 | EIVLTQSPGTLSL SPGERATLSC | RAS--QSFSS- ----SYLA | WYQQKPGQ APRLLIY | G------ ASSRAT | GIPDRFSGSGSG- TDFTLTISRLEPEDFAVYYC | QQYG------- ---------SSRT | FGQGT KVEIK |
| iPS:451 122 | 21-225_200A1 | VK3/A27/ JK1 | EIVLTQSPGILSL YPGERATLSC | RAS--QSVNS- ----NYLA | WYQQRPGQ APSLLIY | G------ ASSRAT | CILDRFSGSGCG- TDFTLTISRLEPEDFAVYCC | QQYEI------ ---------SPWT | FGQGT KVESK |

Figure 51 (Continued)

| | | | K_FR1 | K_CDR1 | K_FR2 | K_CDR2 | K_FR3 | K_CDR3 | | K_FR4 |
|---|---|---|---|---|---|---|---|---|---|---|
| iPS:392_864 | 21-225_23B9 | VK3\|A27/JK1 | EIVLTQSPGTLSL SPGERATLSC | RAS--QNVYS---SYLA | WYQQKPGQ TPRLLIY | G-------ASSRAS | GIPDRFSGSGSG--TDFTLTISRLEPEDFAVYYC | QQYGS | --------SPRT | FGGGT KVEIK |
| iPS:468_812 | 21-225_48H4 | VK1\|A30/JK4 | DIQMTQFPSSLSA SVGDRVTITC | RAS--RDIR---NDLG | WYQQKPGK APFKRLIY | A-------ASSLQS | GVPSRFSGSGSG--TEFTLTISSLQPEDFATYYC | LQHYS | --------YPLT | FGGGT KVEIK |
| iPS:468_824 | 21-225_73G6 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIK |
| iPS:468_818 | 21-225_190C8 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFETYYC | LQHND | --------YPFT | FGGGT KVEIK |
| iPS:468_840 | 21-225_200H9 | VK1\|A30/JK4 | DIQMTQSPSSLSA SVGDRVTITC | RAS--QGIR-----NDLG | WYQQKPGK APKRLIY | A-------ASSLQS | GIPDRFSGSGSG--TEFTLTISSLQPEDFATYYC | LQHNS | --------YPLT | FGGGT KVEIK |
| iPS:468_868 | 21-225_74A1 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHDS | --------YPLT | FGGGA KVEIK |
| iPS:392_920 | 21-225_29G4 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIT |
| iPS:433_899 | 21-225_43C3 | VK1\|A30/JK4 | DIQMTQSPSSLSA SVGDRVTITC | RAS--QGIR-----NDLG | WYQQKPGK AFKRLIY | A-------ASSLQS | GVPSRFSGSGGSG--TEFTLTISSLQPEDFATYYC | LQHNS | --------YPLT | FGGGT KVGIT |
| iPS:433_921 | 21-225_44C3 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHSS | --------YPLT | FGGGT KVEIK |
| iPS:433_947 | 21-225_44E12 | VK1\|A30/JK4 | DIQMTQSPSSLSA SVGDRVTITC | RTS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIK |
| iPS:433_963 | 21-225_46B1 | VK1\|A30/JK4 | DIQMTQSPSSLSA SVGDRVTITC | RAS--QGIR-----NDLG | WYQQKPGK AFKRLIY | A-------ASSLQS | GVPSRFSGSGSG--TEFTLTISSLQPEDFATYYC | LQHNS | --------YPLT | FGGGT KVEIK |
| iPS:433_969 | 21-225_46F3 | VK1\|A30/JK4 | DIQMTQSPSSLSA SVGDRVTITC | RAS--QGIR-----KDLG | WYQQKPGK APKRLIY | A-------ASSLQS | GVPSRFSGSGSG--TEFLTISSLQPEDFATYYC | LQHNS | --------YPLT | FGGGT KVEIK |
| iPS:433_975 | 21-225_46C6 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIT |
| iPS:433_977 | 21-225_46D8 | VK1\|A30/JK4 | DIQMTQSPSSLSA SVGDRVTITC | RAS--QGIR-----KDLG | WYQQKPGK APKRLIY | A-------ASSLQS | GVPSRFSGSGSG--TEFTLTISSLQPEDFATYYC | LQHNS | --------YPLT | FGGGT KVEIK |
| iPS:433_983 | 21-225_47A1 | VK1\|A30/JK4 | DIQMTQSPSSLSA SVGDRVTITC | RAS--QDIR-----NDLG | WYQQKPGK APKRLIY | A-------AFSLQS | GVPSRFSGSRSG--TEFTLTISSLQPEDFATYYC | LQHNS | --------YPLT | FGGGT KVEIK |
| iPS:433_987 | 21-225_47A5 | VK1\|A30/JK4 | DIQMTQSPSSLSA SVGDRVTITC | RAS--QGIR-----NDLG | WYQQKPGK AFKRLIY | A-------ASSLQS | GFPSRFSGSGSG--TEFTLTISSLQPEDFATYYC | LQHNS | --------YPLT | FGGGT KVEIK |
| iPS:434_013 | 21-225_48D12 | VK1\|A30/JK4 | DIQMTQSPSSLSA SVGDRVTITC | RAS--QGIR-----NDLG | WYQQKPGK APKRLIY | A-------ASTLQS | GVPSRFSGSGSG--TEFTLTISSLQPEDFATYYC | LQHNS | --------YPLT | FGGGT KVEIK |
| iPS:434_019 | 21-225_49A1 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIK |
| iPS:434_029 | 21-225_49C6 | VK1\|A30/JK4 | DIQMTQSPSSLSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPLT | FGGGT KVEIK |
| iPS:434_043 | 21-225_50G10 | VK1\|A30/JK4 | DIQMTQSPSSLSA SVGDRVTITC | RAS--QGIR-----NNLG | WYQQKPGK VEKRLIY | A-------ASSLQS | GVPSRFSGSGSG--TEFTLTISSLQPEDFATYYC | LQYNS | --------YPFT | FGGGT KVESK |
| iPS:434_077 | 21-225_51F11 | VK1\|A30/JK4 | DIQMTQSPSALSA SVGDRVTITC | RAS--QGIR-----NDLG | WYQQKPGK APKRLIY | A-------ASSLQS | GVPSRFSGSGSG--TEFTLTISSLQPEDFATYYC | LQHNS | --------YPFT | FGGGT KVEIK |
| iPS:434_081 | 21-225_52B2 | VK1\|A30/JK4 | DIQMTQSPSSLSA SVGDRVTITC | RAS--QGIR-----NDLG | WYQQKPGK AFRRLIY | A-------ASFLQS | GVPSTFSGSGSG--TEFTLTISSLQPEDFATYYC | LQHNS | --------YPLT | FGGGT KVEIK |

Figure 51 (Continued)

| | | | | | | | | | |
|---|---|---|---|---|---|---|---|---|---|
| iPS:434_105 | 21-225_53D2 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- TEFTLTISSLQPEDFATYYC | LQHNR------YPLT | FGGGT KVEIK |
| iPS:434_119 | 21-225_53E6 | VK1/A30/ JK4 | DIQMTQSPSSLSA SVGARVTITC | RAS---QGIR------NDLG | WYQQNPGK APKRLIY | A-------ASNLQS | GVPSRFSGSGSG--- TEFTLTISSLQPEDFATYYC | LQHNR------YPLT | FGGGT KVEIK |
| iPS:434_141 | 21-225_54C6 | VK1/A30/ JK4 | DIQMTQSPSSLSA SVGDRVTITC | RAS---QGIR------NDLG | WYQQNPGK APKRLIY | A-------ASNLQS | GVPSRFSGSGSG--- TEFTLTISSLQPEDFATYYC | LQHNS------YPLT | FGGGT KVGIK |
| iPS:434_159 | 21-225_55B8 | VK1/A30/ JK4 | DIQMTQSPSSLSS SVGDRVTITC | RAS---QAIR------NDLG | WYQQKPGK APKRLIH | A-------AFRLQS | GVPSRFSGSGSG--- TEFTLTISSLQPEDFATYYC | LQHNS------YPLT | FGGGT KVGIK |
| iPS:434_179 | 21-225_56F1 | VK1/A30/ JK4 | DIQMTQSPSSLSA SVGDRVTITC | RAS---QGIR------NNLG | WYQQKPGK APKRLIN | A-------ASSLQS | GVPSRFSGSGSG--- TEFTLTISSLQPEDFATYYC | LQDNS------HPFT | FGGGT KVEIK |
| iPS:434_217 | 21-225_60E8 | VK1/A30/ JK4 | DIQMTQSPSSLSA SVGDRVTFTC | RAS---QGIR------NDLG | WFQQKPGK APKRLIY | A-------ASSLQS | GVPSRFSGSGSG--- TEFTLTISSLQPEDFATYYC | LQHSS------YPLT | FGGGT KVEIK |
| iPS:434_249 | 21-225_62E2 | VK1/A30/ JK4 | DIQMTQSPSSLSA SVGDRVTITC | RAS---QGIR------NDLG | WYQQKPGK APKRLIY | A-------ASRLQS | GVPSRFSGSGSG--- TEFTLTISSLQPEDFATYYC | LQHSN------YPLT | FGGGT RVEIK |
| iPS:434_253 | 21-225_62E4 | VK1/A30/ JK4 | DIQMTQSPSSLSA SVGDRVTITC | RAS---QGIR------NDLG | WYQQKPGK APKRLIY | A-------AFSLQS | GVPSRFSGSGSG--- TEFTLTISSLQPEDFATYYC | LQHNS------YPLT | FGGGT KVEIK |
| iPS:434_313 | 21-225_59E6 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- TEFTLTISSLQPEDFATYYC | LQHNR------YPLT | FGGGT KVEIK |
| iPS:434_337 | 21-225_64E1 | VK1/A30/ JK4 | DIQMTQSPSSLSA SVGDRVTITC | RAS---QGIR------NDLG | WYQQKPGK APKRLIY | A-------ASSLQS | GVPSRFSGSGSKSG--- TEFTLTISSLQPEDFATYYC | LQHSN------YPLT | FGGGT KVEIK |
| iPS:434_411 | 21-225_68F11 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- PEFTLTISSLQPEDFATYYC | LQHSN------YPFT | FGGGT KVEIK |
| iPS:434_413 | 21-225_68D12 | VK1/A30/ JK4 | DIQMTQSPSSLSA SVGDRVTITC | RAS---QGIR------NDLG | WYQQKPGK APKRLIY | A-------AFSLQS | GVPSRFSGSGSG--- TEFTLTISGLQPEDFATYYC | LQHST------YPLT | FGGGT KVEIK |
| iPS:434_433 | 21-225_70E8 | VK1/A30/ JK4 | DIQMTQSPSSLST SVGDRVTITC | RAS---QGIR------KDLG | WYQQKPGK APKRLIY | A-------ASSLQS | GVPSRFSGSGSG--- TEFTLTISSLQPEDFATYYC | LQHNR------YPLT | FGGGT KVEIK |
| iPS:434_439 | 21-225_70E12 | VK1/A30/ JK4 | DIQMTQSPSSLSA SVGDRVTITC | RAS---QGIN------NNLN | WFQQKPGK APKRLIY | A-------ASSLQS | GVPSRFSGSGSG--- TEFTLTISSLQPEDFATYYC | LQHSN------YPLT | FGGGS KVEIK |
| iPS:434_489 | 21-225_74E4 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- TEFTLTISSLQPEDFATYYC | LQHSN------YPLT | FGGGT KVEIK |
| iPS:434_503 | 21-225_74D7 | VK1/A30/ JK4 | DIQMTQSPSSLSA SVGDRVTITC | RAS---QGIR------NDLG | WYQQKPGK APKRLIY | A-------ASSLQS | GVPLRFSGSGSG--- TEFTLTISSLQPEDFATYYC | LQHDS------YPLT | FGGGT KVEIK |
| iPS:435_251 | 21-225_96A3 | VK1/A30/ JK4 | DIQMTQSPSSLSA SVGDRVTITC | RAS---QDIR------NNFG | WYQQKPGK APKRLIY | A-------ASTLQS | GVPSRFSGSGFG--- TEFTLTISGLQREDFATYHC | LQHRN------YPLT | FGGGT KVEIK |
| iPS:435_293 | 21-225_146F1 | VK1/A30/ JK4 | DIQMTQSPSSLSA SVGDRVTITC | RAS---QGIR------NDLG | WYQQKPGK APKRLIS | A-------ASSLQS | GVPSRFSGSGSG--- TEFTLTISGLQPEDFATYYC | LQHST------YPLT | FGGGT KVEIK |
| iPS:435_311 | 21-225_146H9 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- TEFTLTISSLQPEDFATYYC | LQHSN------YPLT | FGGGT KVEIK |
| iPS:435_313 | 21-225_146G1 | VK1/A30/ JK4 | DIQMTQSPSSLSA SVGDRVTITC | RAS---QGIR------NDLG | WYQQKPGK APKRLIY | A-------ASSLQS | GVPSRFSGSGSG--- TEFTLTISSLQPEDFATYYC | LQHDS------YPLT | FGGGT KVEIK |
| iPS:435_361 | 21-225_148E1 | VK1/A30/ JK4 | DIQMTQSPSSLSA SVGDRVTITC | RAS---QGIR------NALG | WYQQKPGK APKRLIY | A-------ASSLQS | GVPSRFTSGSGSG--- TEFTLTISSVQPEDFATYYC | LQHRN------YPLI | FGGGT KVEIK |
| iPS:435_363 | 21-225_148F12_1 | VK1/A30/ JK4 | | | | | | | |

Figure 51 (Continued)

| | | | | | | | | |
|---|---|---|---|---|---|---|---|---|
| iPS-435_367 | 21-225_149G1 | VK1|A30/ JK4 | DIQMTQSPSSLSA SVGARVTITC | RAS--QGIR- ----NDLG | WYQQKPGK APKRLIY | A------ ASNLQS | GVPSRFSGSGSG-- TEFTLTISSLQPEDFATYYC | LQHNS------ -------YPLT | FGGGT KVEIK |
| iPS-435_377 | 21-225_149G5 | VK1|A30/ JK4 | DIQMTQSPSSLSA SVGDRVTITC | RAS--QGIR- ----NALG | WFQQKPGK APKRLIY | A------ ASSLQS | GVPSRFSGSGSG-- TEFTLTISSLQPEDFATYYC | LQHNS------ -------YPLT | FGGGT KVEIK |
| iPS-435_397 | 21-225_149F12 | VK1|A30/ JK4 | DIQMTQSPSSLSA SVGDRVTITC | RAS--QGIR- ----NDLG | WYQQKPGK APKRLIY | A------ ASNLQS | GVPLRFSGSGSG-- TEFTLTISSLQPEDFAIYYC | LQHNS------ -------YPLT | FGGGT KVEIK |
| iPS-435_407 | 21-225_150E7 | VK1|A30/ JK4 | DIQMTQSPSSLSA SVGDRVTITC | RAS--QGIR- ----NDLG | WYQQKPGK APKRLIY | A------ ASNLQS | GVPLRFSGSGSG-- TDFTLTITSSLQPEDFAAYYC | LQHSN------ -------YPLT | FGGGT KVEIK |
| iPS-435_449 | 21-225_152H9 | VK1|A30/ JK4 | DIQMTQSPSSLSA SVGDRVTITC | RAS--QGIR- ----NDLG | WYQQKPGK APKRLIY | A------ ASSLQS | GVPSRFTGSGSG-- TEFTFTISSLQPEDFATYYC | LQHSN------ -------YPLT | FGGGT KVEIK |
| iPS-435_499 | 21-225_156G1 | VK1|A30/ JK4 | DIQMTQSPSSLSA SVGDRVTITC | RAS--QGMR- ----NDLG | WFQQKPGK APKRLIY | A------ ASSLQS | GVPSRFSGSGSG-- TEFTLTISSLQPEDFATYYC | LQHSM------ -------YPLT | FGGGT KVEIK |
| iPS-435_549 | 21-225_158H5 | VK1|A30/ JK4 | DIQMIQSPSFLFA SVGDRVTITC | RAS--QGMR- ----IDLG | WYQQKPGK APKRLIY | R------ ASSLQS | GVPSRFSGSGCG-- TEFTLTISVQREDFASYYC | VQHNS------ -------YPLT | FGGGT KVEIK |
| iPS-435_587 | 21-225_160H3 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHSN------ -------YPLT | QVESK |
| iPS-435_599 | 21-225_160B1 | VK1|A30/ JK4 | DIQMTQSPSFSA SVGDRVTITC | RAS--QGPGT ----NDLG | WYQQKPGT APKRLIY | A------ ASSLQS | GVPSRFSGSGSG-- TEFTLTISNLQPEDFATYYC | LQHSS------ -------YPLT | FGGGT KVEIK |
| iPS-435_663 | 21-225_169B1 | VK1|A30/ JK4 | DIQMTQSPSSLSA SVGDRVTITC | RAS--QGIR- ----NDLG | WYQQKPGK APKRLIG | A------ ESSLQS | GVPSRFSGSGSG-- TEFTLTISGLQPEDFATYYC | LQHYS------ -------YPLT | FGGGT KVEIK |
| iPS-435_669 | 21-225_169F9 | VK1|A30/ JK4 | DIQMTQSPSSLSA SVGDRVTITC | RAS--QGIR- ----NDLG | WYQQKPGK APKRLIF | A------ ASSLQS | GVPSRFSGSGSG-- TEFTLTISSLQPEDFATYYC | LQHYS------ -------YPLT | FGGGT KVEIK |
| iPS-435_693 | 21-225_170G4 | VK1|A30/ JK4 | DIQMTQSPSSLSA SVGDRVTITC | RAS--QGIR- ----NDLG | WYHQKPGK APKRLIY | A------ ASTLQS | GVPSRFSGSGSG-- TEFTLTISSLQPEDFATYYC | LQHYS------ -------YPLT | FGGGT KVEIK |
| iPS-435_695 | 21-225_170D5 | VK1|A30/ JK4 | DIQMTQSPSSLSA SVGDRVTITC | RAS--QGIR- ----NDLG | WYQEKPGK APKHLIY | A------ ASSLQN | GVPSRFSGSGSG-- TEFTLTISSLQPEDFATYYC | LQHYS------ -------FPLT | FGGGT KVEIK |
| iPS-435_697 | 21-225_170G5 | VK1|A30/ JK4 | DIQMTQSPSSLSA SVGDRVTITC | RAS--QGIR- ----TDLG | WFQQKPGK APKRLIY | T------ ASSLQS | GVPSRFSGSGSG-- TEFTLTISSLQPEDFATYYC | LQHYS------ -------YPLT | FGGGT KVEIK |
| iPS-435_703 | 21-225_170D1 | VK1|A30/ JK4 | DIQMTQSPSSLSA SVGDRVTITC | RAS--QGIR- ----NDLG | WYQQKPGK APKHLIY | A------ ASSLQN | GVPSRFSGSGSG-- TEFTLTISSLQPEDFATYYC | LQHYS------ -------FPLT | FGGGT KVEIR |
| iPS-435_705 | 21-225_171C3 | VK1|A30/ JK4 | DIQMTQSPSSLSA SVGDRVTITC | RAS--QGIR- ----IDLG | WFQQKPGK APKRLIY | T------ ASSLQS | GVPSRFSGSGSG-- IEFTLTISGLQPEDFATYYC | LQHYS------ -------YPLT | FGGGT KVEIK |
| iPS-435_709 | 21-225_171A4 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHYS------ -------YPLT | FGGGT KVEIK |
| iPS-435_721 | 21-225_172B3 | VK1|A30/ JK4 | DIQMTQSPSSLSA SVGDRVTITC | RAS--QGIR- ----NDLG | WYHQKPGK APKRLIG | A------ ESSLQS | GVPSRFSGSGSG-- TEFTLTISSLQPEDFATYYC | LQHYS------ -------YPLT | FGGGT KVEIK |
| iPS-435_725 | 21-225_172G8 | VK1|A30/ JK4 | DIQMTQSPSSLSA SVGDRVTITC | RAS--QGVR- ----NDLG | WYQQKPGK APKHLIY | A------ ASSLQN | GVPSRFSGSGSG-- TEFTLTISSLQPEDFATYYC | LHHYS------ -------FPLT | FGGGT KVEIK |
| iPS-435_735 | 21-225_173H1 | VK1|A30/ JK4 | DIQMTQSPSSLSA SVGDRVTITC | RAS--QGIR- ----NDLG | WYQQKPGK APKHLIY | T------ TSSLQS | GVPSRFSGSGSG-- TEFTLTISSLQPEDFATYYC | LQHYS------ -------FPNI | FGGGT KVEIK |
| iPS-435_743 | 21-225_175G1 | VK1|A30/ JK4 | DIQMTQSPSSLSA SVGDRVTITC | RAS--QGIR- ----TDLG | WYQQKPGK APKRLIY | A------ ASSLQS | GVPSRFSGSGSG-- TEFTLTISSLQPEDFATYYC | LQHYS------ -------YPLT | FGGGT KVEIK |

Figure 51 (Continued)

| ID | V/J | Seq1 | Seq2 | Seq3 | Seq4 | Seq5 | Seq6 | Seq7 | Seq8 |
|---|---|---|---|---|---|---|---|---|---|
| iPS:435 761 | 21-225_176B1 | VK1A30/ JK4 | DIQMTQSPSSLSA SVGDRVTITC | RAS---QGIR- ----NDLG | WFQQKPGK APKRLIY | A------ ASSLQS | GVPSRFSGSGSG--- TEFTLTISSLQPEDFATYYC | LQHYS------ ------ | FGGGT KVEIK |
| iPS:435 779 | 21-225_178B1 | VK1A30/ JK4 | DIQMTQSPSSLSA SVGDRVTITC | RAS---QGIR- ----NDLG | WYQQKPGK APKRHLIY | A------ ASSLQN | GVPSRFSGSGSG--- TEFTLTISSLQPEDFATYYC | LHHYS------ ---FPLT | FGGGT KVEIK |
| iPS:436 023 | 21-225_193A5 | VK1A30/ JK4 | DIQMTQSPSSLFA SVGDRVIISC | RAS---QGIR- ----NDLG | WYQQYPGK APKRVIY | A------ ASSLQS | GVPSRFSGSGFG--- TEFTLTISSVQPEDFETYYC | LQHND------ ---FPFT | FGGGT KVEIK |
| iPS:436 033 | 21-225_193E7 | VK1A30/ JK4 | DIQMTQSPSSLSA SVGDRVTITC | RAS---QGIR- ----NDLG | WYQQKPGK APKRLIY | S------ ASSLQR | GVPSRFSGSGSG--- TEFTLTISSLQPEDFATYYC | LQHKR------ ---YPLT | FGGGT KVEIK |
| iPS:436 120 | 21-225_196C1 | VK1A30/ JK4 | DIQMTQSPSSLSA SVGDRVTITC | RAS---QGIR- ----NDLG | WYQQKPGK APKRLIY | A------ ASSLQS | GVPSRFSGSGSG--- TEFTLTISSLQPEDFATYYC | LQYNS------ ---YPLT | FGGGT KVEIK |
| iPS:436 199 | 21-225_199E3 | VK1A30/ JK4 | DIQMTQSPSSLSA SVGDRVTITC | RAS---QGIR- ----NDLG | WYQQKPGK APKRLIS | S------ ASSLQR | GVPSRFSGSGSG--- TEFTLTISSLQPEDFATYYC | LQHKR------ ---YPLT | FGGGT KVEIK |
| iPS:436 228 | 21-225_200F12 | VK1A30/ JK4 | DIQMTQSPSSLSA SVGDRVTITC | RAS---QGIR- ----NDLG | WYQQKPGK APKRLIY | S------ ASSLHT | GVPSRFSGSGSG--- TEFTLTISSLQPEDFATYYC | LQHKS------ ---YPLT | FGGGT KVEIK |
| iPS:436 230 | 21-225_201A1 | VK1A30/ JK4 | DIQMTQSPSSLSA SVGDRVTITC | RAS---QGIR- ----NDLG | WYQQKPGK APKRLIY | S------ ASILQR | GVPSRFSGSGSG--- TEFTLTISSLQPEDFATYYC | LQHKS------ ---YPLT | FGGGT KVEVK |
| iPS:436 242 | 21-225_201A1 | VK1A30/ JK4 | DIQMTQSFSSLSA SVGDRVTITC | RAS---QGIR- ----NDLG | WYQQKFGK APKRLIY | S------ TSSLHS | GVPSRFSGSGSG--- TEFTLTISSLQPEDFATYYC | LQHNS------ ---YPLT | FGGGT KVEIK |
| iPS:436 286 | 21-225_204H8 | VK1A30/ JK4 | DIQMTQSPSSLSA SVGDRVTITC | RAS---QGIR- ----NDLG | WYQQKPGK APKRLIY | S------ ASSLQS | GVPSRFSGRGSG--- TEFTLTVSSLQPEDFATYYC | LQHNS------ ---YPLT | FGGGT KVEIK |
| iPS:436 308 | 21-225_205H8 | VK1A30/ JK4 | DIQMTQSPSSLSA SVGDRVTITC | RAS---QGIR- ----NDLG | WYQQKQGK APKRLLIY | S------ ASFLQR | GVPSRFSGSGSG--- TEFTLTISSLQPEDSAAYYC | LQHNS------ ---YPLT | FGGGT KVEIK |
| iPS:436 526 | 21-225_224A1 | VK1A30/ JK4 | DIQMTQSFSSLSA SVGDRVTITC | RAS---QGIE- ----NDLG | WYQQKPGK APKRLIY | A------ ASSLQS | GVPSRFSGSGSG--- TEFTLTISSLQPEDSAAYYC | LQHNS------ ---YPLT | FGGGT KVEIK |
| iPS:436 528 | 21-225_224B1 | VK1A30/ JK4 | DIQMTQSPSSLSA SVGDRVTITC | RAS---QGIS- ----NDLG | WYQQKPGK APKRLIY | A------ ASSLQS | GVPSRFSGSGSG--- TEFTLTISSLQPEDFATYHC | LQHNS------ ---YPPT | FGGGT KVEIK |
| iPS:436 538 | 21-225_224C3 | VK1A30/ JK4 | DIQMTQSPSSLSA SVGDRVTITC | RAS---QGIR- ----NDLG | WYQQKPGK APKRLIY | A------ ASSLQS | GVPSRFSGSGSG--- TEFTLTISSLQPEDFATYYC | LQHNS------ ---YPLT | FGGGT KVEIK |
| iPS:436 556 | 21-225_224D1 | VK1A30/ JK4 | DILMTQSPSSLSA SVGDRVTITC | RAS---QDIR- ----NDLG | WYQQKPGK APKRLIY | TSSLQS |  | GVPSRFSGSGSG--- TEFTLTISSLQPEDFATYYC | LQHNS------ ---YPLT | FGGGT KVEIK |
| iPS:437 220 | 21-225_55H6 | VK1A30/ JK4 | DIQMTQSPSSLSA SVGDRVTITC | RAS---QGIR- ----NDLG | WYQQKPGK APKRLIY | G------ ASSLQS | GVPSRFSGSGSG--- TEFTLTISSLQPEDFAAYYC | LQRDS------ ---YPFT | FGGGT KVEIK |
| iPS:437 346 | 21-225_75H7 | VK1A30/ JK4 | DIQMTQSPSSRYA SVGDRVTINS | RAS---QGIR- ----NDLG | WYQQKPGK SPQRLIY | D------ ASSLQS | GVPSRFSGSGSG--- TEFTLTISSVQPEDFGVYYC | IQHSN------ ---YPLT | FGGGT TVKIK |
| iPS:472 730 | 21-225_14B1_LC1 | VK1A30/ JK4 | DIQMTQSPSYLSA SVGDRVTITC | RAS---QGIS- ----DNLG | WYQQKPGK APKRLIY | T------ AYSLQS | GVPSRFSGSGSG--- TEFTLTISSLQPEDFATYYC | LQHYN------ ---YPPT | FGGGT KVEIK |
| iPS:392 622 | 21-225_17H8 | VK1A30/ JK4 | DIQMTQSPSSLSA SVGDRVTITC | RAS---QGIR- ----NDLG | WYQQKPGK APKRLIY | G------ ASSLQS | GVPSRFSGSGSG--- TEFTLTISSLQPEDFTTYYC | LQHNS------ ---YPLT | FGGGT KVEIK |
| iPS:392 624 | 21-225_17H12 | VK1A30/ JK4 | DIQMTQSPSSLSA SVGDRVTITC | RAS---QDIR- ----NDLG | WYQQKAGK APKRLIN | A------ ASSLQS | GVPSRFSGIGSG--- TEFTLTITGLQPEDFATYYC | LQHYS------ ---YMFT | FGGGT KVEIK |

Figure 51 (Continued)

| | | | | | | | | | |
|---|---|---|---|---|---|---|---|---|---|
| PS:392 628 | 21-225_20C2 | VK1|A30/ JK4 | DIQMTQSPSSLSA SVGDRVTITC | RAS--QGIR- ----NDLG | WYQQKPGK APKRLIE | A------ ASSLQS | GVPSRFSGSGSG-- TEFTLTISSLQPEDFATYYC | LQHAS------YPLT | FGGGT KVEIE |
| PS:392 630 | 21-225_20E5 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 638 | 21-225_17F9 | VK1|A30/ JK4 | DIQMTQSPSSLSA SVGDRVTITC | RAS--QVIR- ----NDLG | WYQQKPGK APKRLIY | A------ VSSLQS | GVPSRFSGSGSG-- TEFTLTINSLQPEDFATYYC | LQHNT------YPLT | FGGGT KVEFK |
| PS:392 640 | 21-225_18A1 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 642 | 21-225_18C6 | VK1|A30/ JK4 | DIQMTQSPSSLSA SVGDRVTITC | RTS--QGIR- ----NDLG | WYQQKPGK APKRLIY | A------ ASSLQS | GVPSRFSGSGSG-- TEFTLTISSLQPEDFATYYC | LQHSS------YPLT | FGGGT KVEIK |
| PS:392 644 | 21-225_19E1 | VK1|A30/ JK4 | DIQMTQSPSSLSA SVGDRVTITC | RAS--QGIR- ----NDLG | WYQQKPGK APKRLIY | A------ ASNLQS | GVPSRFSGSGSG-- TEFTLTISSLQPEDFATYYC | LQHNS------FPLT | FGGGT KVEIK |
| PS:392 646 | 21-225_20G2 | VK1|A30/ JK4 | DIQMTQSPSSLSA SVGDRVTITC | RAS--QGIR- ----NDLG | WYQQKPGK APKRLIY | A------ ASSFQS | GVPSRFSGSGSG-- TEFTLTISSLQPEDFASYYC | LQHNS------YPLT | FGGGT KVEIK |
| PS:392 654 | 21-225_17A10 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHAS------YPLT | FGGGT KVEIK |
| PS:392 656 | 21-225_1F2 | VK1|A30/ JK4 | DIQMTQSPSSLSA SVGDRVTITC | RAS--QGIR- ----NDLG | WYQQKPGK APKRLIY | A------ ASSVQS | GVPSRFSGSGSG-- TEFTLTISSLQPEDFATYYC | LQHNS------YPLT | FGGGT KVEIT |
| PS:392 658 | 21-225_18E8 | VK1|A30/ JK4 | DIQMTQAPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 666 | 21-225_16F11 | VK1|A30/ JK4 | DIQMTQSPSSLSA SVGDRVTITC | RAS--QGIR- ----NDLG | WYQQKPGK APKRLIY | A------ ASSVQS | GVPSRFSGSGSG-- TEFTLTISSLQPEDFATYYC | LQHNS------YPLT | FGGGT KVEIK |
| PS:392 676 | 21-225_19F3 | VK1|A30/ JK4 | DIQMTQSPSSLSA SVGDRVTITC | RAS--QGIR- ----NDLG | WYQQKPGK APKRLIY | A------ VSSLQS | GVPSRFSGSGSG-- TEFSFTISSLQPEDFATYYC | LQHNS------YPLT | FGGGT KVEIK |
| PS:392 680 | 21-225_20A7 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHAS------YPLT | FGGGT KVEIK |
| PS:392 700 | 21-225_16E12 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 706 | 21-225_18A3 | VK1|A30/ JK4 | DIQMTQSPSSLSA SVGDRVTITC | RAS--QGIR- ----NDLG | WYQQKPGK APKRLIF | V------ ASSLQS | GVPSRFNGSGSG-- TEFTLTISSLQPEDFATYYC | LQHSS------YPLT | FGGGT KVEIK |
| PS:392 716 | 21-225_17B5 | VK1|A30/ JK4 | DIQMTQSPSSLSA SVGDRVTITC | RAS--QGIR- ----NDLG | WYQQKPGK APKRLIY | A------ ASNLQS | GVPSRFSGSGSG-- TDFILTISSLQPEDFATYYC | LQHNT------YPFT | FGGGT KVEIK |
| PS:392 744 | 21-225_20D5 | VK1|A30/ JK4 | DIQMTQSPSSLSA SVGDRVTITC | RAS--QGIR- ----NDLG | WYQQKPGK APKRLIY | A------ ASSLQS | GVPSRFSFSGSG-- TEFTLTISSLQPEDFATYYC | LQHNS------YPLT | FGGGT KVEIK |
| PS:392 750 | 21-225_20A10 | VK1|A30/ JK4 | DIQMTQSPSSLSA SVGDRVTITC | RAS--QGIR- ----NDLG | WYQQKQGK APKRLIN | A------ ASSLQS | GVPSRFSGSGSG-- TEFTLTISSLQPEDFATYYC | LQHMR------YPLT | FGGGT KVEIK |
| PS:392 772 | 21-225_20E12 | VK1|A30/ JK4 | DIQMTQSPSSLSA SVGDRVTITC | RAS--QGIR- ----NDLG | WYQQKPGK APKRLIF | A------ ASSLQS | GVPSRFSGSGSG-- TEFTLTISSLQPEDFATYYC | LQHNS------YPPT | FGGGT KVEIK |
| PS:392 774 | 21-225_21F3 | VK1|A30/ JK4 | DIQMTQSPSSLSA SVGDRVTITC | RAS--QGIR- ----NDLG | WYQQKPGK APKRLIY | A------ ASSLQS | GVPSRFSGSGSG-- TEFTLTISSLQPEDFATYYC | LQHSS------YPLT | FGGGT KVEIK |
| PS:392 780 | 21-225_22B7 | VK1|A30/ JK4 | DIQMTQSPSSLSA SVGDRVTITC | RAS--QGIR- ----NDLG | WYQQKPGK APKRLIY | T------ ASSLQS | GVPSRFSGSGSG-- TEFTLTISSLQPEDFATYYC | LQHNT------YPLT | FGGGT KVEIK |
| PS:392 788 | 21-225_20C8 | VK1|A30/ JK4 | DIQMTQSPSSLSA SVGDRVTITC | RAS--QGIR- ----NDLG | WYQKKPGK APKRLIY | A------ ASSLQS | GVPSRFSGSGSG-- TEFTLTISSLQPEDFATYYC | LQHNS------YPFT | FGGGT KVEIT |
| PS:392 794 | 21-225_21H3 | VK1|A30/ JK4 | DIQMTQSPSSLSA SVGDRVTITC | RAS--QGIR- ----NDLG | WYQQKPGK APKRLIY | A------ ASSVQI | GVPSRFSGSGSG-- TEFTLTISSLQAEDLAIYYC | LQHNS------YPLT | FGGGT KVEIK |

Figure 51 (Continued)

| | | | | | | | | |
|---|---|---|---|---|---|---|---|---|
| PS:392 800 | 21-225 22D12 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TDFTLTISSLQPEDFATYYC | LQHST------YPLT | FGGGT KVEIK |
| PS:392 810 | 21-225 20H12 | VK1/A30/ JK4 | DIQMTQSPSSLSA SVGDRVTITC | RAS--QGIR-----NDLD | WYQQKPGK APKRLIY | A------ ASSLQS | GVPSRFSGSGSG-- TEFTLTISSLQPEDFATYYC | LQHNS------YPLT | FGGGT KVEIK |
| PS:392 820 | 21-225 23D1 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTVSSLQPEDFATYYC | LQHSS------YPLT | FGGGT KVEIK |
| PS:392 822 | 21-225 23C8 | VK1/A30/ JK4 | DIQMTQSPSSRSA SVGDRVTITC | RAS--QDIR-----NDLG | WYQQKPGR APKRLIN | G------ ASSVQS | GVPSRFSGSGSG-- TEFTLTVSSLQPEDFVIYYC | LQHNS------YPLT | FGGGT KVEIK |
| PS:392 824 | 21-225 24E5 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTISSLQPEDFATYYC | LQHSN------YPLT | FGGGT KVEIK |
| PS:392 834 | 21-225 22C1 | VK1/A30/ JK4 | DIQMTQSPSSLSA SVGDRVTITC | RTS--QGIR-----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 838 | 21-225 22G8 | VK1/A30/ JK4 | DIQMTQSPSSLFA SVGDRVTITC | RTS--QGIR-----NDLG | WYQQKPGK APKRLIY | A------ ASSLQS | GVPSKFSGSGSG-- TEFTLTISSLQPEDFATYYC | LQHNS------YPLT | FGGGT KVEIK |
| PS:392 850 | 21-225 20H10 | VK1/A30/ JK4 | GIQMTQSPSSLSA SVGDRVTITC | RAS--QGIK-----NNLG | WYQQKPGK GPKCLIY | A------ TSSLQS | GVPSRFSGSGSG-- TEFTLTISSLQPEDFATYYC | LQHNS------YPLT | FGGGT KVEIK |
| PS:392 854 | 21-225 21E5 | VK1/A30/ JK4 | DIQMTQSPSSLSA SVGDRVTITC | RAS--QGIR-----NDLG | WYQQKPGK APKRLIY | A------ ASSVQS | GVPSRFSGSGSG-- TEFTLTISSLQPEDFATYYC | LQHST------YPLT | FGGGT KVEIK |
| PS:392 858 | 21-225 22H4 | VK1/A30/ JK4 | DIQMTQSPSSLSA SVGDRVTITC | RAS--QGIR-----NDLG | WYQQKPGK APKRLIY | A------ ASSLQS | GVPSKFSGSGSG-- TEFTLTISSLQPEDFALYYC | LQHNS------YPLT | FGGGT KVEIK |
| PS:392 866 | 21-225 23H11 | VK1/A30/ JK4 | DIQMTQSPSSLSA SVGDRVTITC | RAS--QGIR-----NDLD | WYQQKPGK APKRLIY | A------ ASSLQS | GVPSRFSGSGSG-- TEFTLTISSLQPEDFATYYC | LQHMR------YPLT | FGGGT KVEIK |
| PS:392 870 | 21-225 20G9 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTISSLQPEDFATYYC | LQHST------YPLT | FGGGT KVEIK |
| PS:392 880 | 21-225 22F9 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTISSLQPEDFATYYC | LQHNS------YPLT | FGGGT KVEIK |
| PS:392 882 | 21-225 23A3 | VK1/A30/ JK4 | DIQMTQSPSSLSA SVGDRVTITC | RAS--QGIR-----NDLG | WYQQKPGK APKRLIY | A------ ASSVQS | GVPSRFSGSGSG-- TEFTLTISSLQPEDFATYFC | LQHAS------YPLT | FGGGT KVEIK |
| PS:392 896 | 21-225 21G7 | VK1/A30/ JK4 | DIQMTQSPSSLSA SVGDRVTITC | RAS--QGVR-----NDLG | WYQQKPGK APQRLIY | A------ ASSLQS | GVPSRFNGSGSG-- TEFTLTISSLQPEDFATYYC | LQHSS------YPLT | FGGGT KVEIK |
| PS:392 900 | 21-225 22F2 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTISSLQPEDFATYYC | LQHTI------YPLT | FGGGT KVEIK |
| PS:392 904 | 21-225 22G9 | VK1/A30/ JK4 | DIQMTQSPSSLSA SVGDRVTITC | RAS--QGIR-----NDLG | WYQQKPGK APKRLIY | A------ ASSLQS | GVPSRFSGSGSG-- TEFTLTISSLQPEDFATYYC | LQHAS------YPLT | FGGGT KVEIK |
| PS:392 942 | 21-225 30E9 | VK1/A30/ JK4 | DIQMTQSPSSLSA SVGDRVTITC | RAS--QDIR-----DDLG | WYQQKPGK APRRLIY | G------ AFSLQS | GVPSRFSGSGSG-- TEFTLTISSLQPEDFATYYC | LQHTS------YPPT | FGGGT KVEIK |
| PS:392 944 | 21-225 31H5 | VK1/A30/ JK4 | DIQMTQSPSSLSA SVGDRFTISF | RAS--QDIR-----SDLG | WYQQKPGK AHKRIIY | A------ ASSLQS | GVPSRFSGSVSGSG-- TEFTLTISSMQPDDFSNYYC | IQHII------YPPT | FGGGT KVEIK |
| PS:392 964 | 21-225 31A8 | VK1/A30/ JK4 | DIQMTQSPSSLSA SVGDRVTITC | RAS--QDIR-----SDLG | WYQQKPGK APKRLIY | A------ VSSLQS | GVPSRFSGSGSG-- TEFTLTISSLQPEDFATYYC | LQHTI------YPPT | FGGGT KVEIK |
| PS:392 980 | 21-225 29H6 | VK1/A30/ JK4 | DIQMTQSPSSLSA SVGDRVTITC | RAS--QGIR-----NDLG | WYQQKSGK TPKRLIY | A------ ASSLQS | GVPSRFSGSGSG-- TEFTLTISSLQPEDFATYYC | LQHNS------YPLT | FGGGT KVEIK |
| PS:392 982 | 21-225 30D1 | VK1/A30/ JK4 | DIQMTQSPSSLSA SVGDRVTITC | RAS--QDIR-----SDLG | WYQQKPGK APERLIY | A------ ASSLQS | GVPSRFSGSGSG-- TEFTLTISSLQPEDFTTYYC | LQHTI------YPPT | FGGGT KVEIK |
| PS:392 986 | 21-225 31B8 | VK1/A30/ JK4 | DIQMTQSPSSLSA SVGDRVTITC | RAS--QDIR-----SDLG | WYQQKPGK APKRLIY | G------ ASSLQS | GVPSRFSGSGSG-- TEFTLTISSLQPEDFATYYC | LQHII------YPPT | FGGGT KVEIK |

Figure 51 (Continued)

| | | | | | | | | | |
|---|---|---|---|---|---|---|---|---|---|
| PS:392988 | 21-225_25E6 | VK1|A30/JK4 | DIQMTQSPSSLSA SVGDRVTITC | RAS--QGIR----NDLG | WYQRKPGK APKRLIY | A------ ASSLQS | GVPSRFSGSGSG--- TEFTLTISSLQPEDFATYYC | LQHNS------- ----YPLT | FGGGT KVEIK |
| PS:392990 | 21-225_25H10 | VK1|A30/JK4 | DIQMTQSPSSLSA SVGDRVTITC | RAS--RGIR----NDLG | WYQQKPGK APKRLIY | A------ AFSLQS | GVPSRFSGSGSG--- TEFTLTISSLQPEDFATYYC | LQHNS------- ----YPLT | FGGGT KVEIK |
| PS:393004 | 21-225_30G11 | VK1|A30/JK4 | DIQMTQSPSSLSA SVGDRVTITC | RAS--QDIR----SDLG | WYQQKPGK APKRLIY | A------ ASSLQS | GVPSRFSGSGSG--- TEFTLTISSLQPEDFATYYC | LQHTI------- ----YPPT | FGGGT KVEIK |
| PS:393018 | 21-225_29B8 | VK1|A30/JK4 | DIQMTQSPSSLSA SVGDRVTITC | RAS--QGIR----NDLG | WYQQKPGK APKRLIY | A------ ASSLQS | GVPSRFSGSRSG--- TEFTLTISSLQPEDFATYYC | LQHNS------- ----YPLT | FGGGT KVEIK |
| PS:393030 | 21-225_25H11 | VK1|A30/JK4 | DIQMTQSPSSLSA SVGDRVTITC | RAS--QGIR----TDLG | WYQQKPGK APKRLIY | A------ ASSLQS | GVPSRFSGSGSG--- TEFTLTISSLQPEDFATYYC | LQHNS------- ----YPLT | FGGGT KVEIK |
| PS:393034 | 21-225_27F2 | VK1|A30/JK4 | DIQMTQSPSSLSA SVGDRVTITC | RAS--QGIR----NDLG | WYQQKPGK APKRLIY | V------ ASSLQS | GVPSRFSGSGSG--- TEFTLTISSLQPEDFATYYC | LQHNS------- ----YPLT | FGGGT KVEIK |
| PS:393040 | 21-225_30E3 | VK1|A30/JK4 | DIQMTQSPSSLSA SVGDRVTITC | RAS--QDIR----DDLG | WYQQKPGK APRRLIY | A------ AFSLQS | GVPSRFSGSGSG--- TEFTLTISSLQPEDFATYYC | LQHTS------- ----YPPT | FGGGT KVEIK |
| PS:393048 | 21-225_27C3 | VK1|A30/JK4 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | LQHNR------- ----YPLT | FGGGT KVEIK |
| PS:393054 | 21-225_29G8 | VK1|A30/JK4 | DIQMTQSPSSLSA SVGDRVTITC | RAS--QGIR----NDLG | WYQLKPGK APKRLIY | A------ ASSLQS | GVPSRFSGSGSG--- TEFTLTISSLQPEDFATYNC | LQHNS------- ----YPLT | FGGGT KVEIK |
| PS:393056 | 21-225_30F3 | VK1|A30/JK4 | DIQMTQSPSSLSA SVGDRVTITC | RAS--QDIR----SDLG | WYQQKPGK APKRLIY | T------ ASSLQS | GVPSRFSGSGSG--- TDFTLTISSLQPEDFATYYC | LQHTS------- ----YPPT | FGGGT KVEIK |
| PS:393058 | 21-225_31H3 | VK1|A30/JK4 | DIQMTQSPSSLSA SVGDRVTITC | RAS--QDIR----DDLG | WYQQKPGK APRRLIY | A------ AFSLQS | GVPSRFSGSGSG--- TEFTLIVSSLQPEDFATYYC | LQHTI------- ----YPPT | FGGGT KVEIK |
| PS:393060 | 21-225_32G12 | VK1|A30/JK4 | DIQMTQSPSSLSA SVGDRVTITC | RAS--QDIR----SDLG | WYQQKPGK APKRLIY | A------ ASSLQR | GVPSRFSGSGSG--- TEFTLTISSLQPEDFARYYC | LQHYS------- ----YPPT | FGGGT KVEIK |
| PS:393068 | 21-225_34G9 | VK1|A30/JK4 | DIQMTQSPSSLSA SVGDRVTITC | RAS--QGIR----SDLG | WYQQKPGK APKRLIY | A------ ASSLQS | GVPSRFSGSGSG--- TEFTLTISSLQPEAFAYYC | LQHTI------- ----YPPT | FGGGT KVWIK |
| PS:393072 | 21-225_36C5 | VK1|A30/JK4 | DIQMTQSPSSLSA SVGDRVTITC | RAS--QDIR----SDLG | WYQQKPGK APKRLIY | A------ ASSLQS | GVPSRFTGSGSG--- TEFTLTISSVQPEDFATYYC | LHHPI------- ----YPPT | FGGGT KVWIK |
| PS:393074 | 21-225_33B1 | VK1|A30/JK4 | DIQMTQSPSSLSA SVGDRVTITC | RTS--QGIR----SDLG | WFQQKPGK APKRLIY | A------ ASSLQS | GVPSRFSGSGSG--- TEFTLTISSLQPEDFATYYC | LQHTI------- ----YPLT | FGGGT KVEVK |
| PS:393076 | 21-225_33A4 | VK1|A30/JK4 | DIQMTQSPSSLSA SVGDRVTITC | RAS--QGIR----NDVG | WYQQKPGK APERLIY | A------ ASSLQR | GVPSRFSGSGSG--- TEFTLTISSLQPEDFARYYC | LQHYS------- ----YPPT | FGGGT KVEIK |
| PS:393096 | 21-225_34D11 | VK1|A30/JK4 | DIQMTQSPSSLSA SVGDRVTITC | RAS--QDIR----SDLG | WYQQKPGK APKRLIY | A------ ASSLQS | GVPSRFSGSGSG--- TEFTLIVISSLQPEDFATYYC | LQHTI------- ----YPPT | FGGGT KVGIK |
| PS:393102 | 21-225_33F1 | VK1|A30/JK4 | DIQMTQSPSSLSA SVGDRVTITC | RAS--QDIR----SDLG | WYQQKPGK APKRLIY | A------ ASSLQS | GVPSRFSGSGSG--- TEFTLTISSLQPEDFATYYC | LQHTI------- ----YPPT | FGGGT KVEIK |
| PS:393104 | 21-225_33A7 | VK1|A30/JK4 | DIQMTQSPSSLSA SVGDRVTITC | RAS--QDIR----NDLG | WYQQKPGK APKRLIY | V------ ASSLQS | GVPSRFSGSGSG--- TEFTLTISSLQPEDFAAYYC | LQHTI------- ----YPPT | FGGGT KVEIK |
| PS:393106 | 21-225_34A6 | VK1|A30/JK4 | DIQMTQSPSSLSA SVGDRIITC | RTS--QDIR----NDLG | WYQQKPGK APKRLIF | A------ ASSLQS | GVPSRFSGSGSG--- TEFTLTVSSLQPEDFATYYC | LQHNS------- ----YPPT | FGGGT KVEIK |
| PS:393110 | 21-225_35B7 | VK1|A30/JK4 | DIQMTQSPSSLSA SVGDRVTITC | RAS--QDIR----SDLG | WYQQKPGK APERLIY | A------ ASSLQS | GVPSRFSGSGSG--- TEFTLTISSLQPEDFATYYC | LQHTI------- ----YPPT | FGGGT KVEIK |
| PS:393118 | 21-225_34H11 | VK1|A30/JK4 | DIQMTQSPSSLSA SVGDRVTITC | RAS--QGIR----NDLG | WYQQKPGK APKRLIY | A------ ISSLQS | GVPSRFSGSGSG--- TEFTLTISSLQPEDFATYYC | LQHNS------- ----YPPT | FGGGT KVEIK |
| PS:393124 | 21-225_33G7 | VK1|A30/JK4 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | LQHYS------- ----YPPT | FGGGT KVEIK |

Figure 51 (Continued)

| | | | | | | | | | |
|---|---|---|---|---|---|---|---|---|---|
| PS:393 126 | 21-225_35D1 | VK1/A30/ JK4 | DIQMTQSPSSLSA SVGDRVTITC | RAS--QDIR ----SDLG | WYQQKPGK APKRLIY | A------ ASSLQS | GVPSRFSGSGSG-- TEFTLTISSLQPEDFATYYC | LQHTI----- ------YPPT | FGGGT KVEIK |
| PS:393 128 | 21-225_35F11 | VK1/A30/ JK4 | DIQMTQSPSSLSA SVGDRVTITC | RAS--QDIR ----SDLG | WYQQKPGK APKRLIY | A------ ASSLQS | GVPSRFSGSGSG-- TEFTLTISSLQPEDFATYYC | LQHTV----- ------YPPT | FGGGT KVEIK |
| PS:393 146 | 21-225_34G8 | VK1/A30/ JK4 | DIQMTQSPSSLSA SVGDRVTITC | RAS--QDIR ----SDLG | WYQQKPGK APKRLIY | A------ ASSLQS | GVPSRFSGSGSG-- TEFTLTISSLQPEDFATYYC | LQHTI----- ------YPPT | FGGGT KVEIK |
| PS:393 150 | 21-225_36A5 | VK1/A30/ JK4 | DIQMTQSPSSLSA SVGDRVTITC | RTS--QDIR ----SDLG | WYQQKPGK APKRLIF | A------ ASSLQS | GVPSRFSGSGSG-- TEFTLTISSLQPEDFATYYC | LHHNS----- ------YPPK | FGGGI KVEIT |
| PS:393 804 | 21-225_5H7 | VK1/A30/ JK4 | DIQMTQSPSSLSA SVGDRVTITC | RAS--QGIR ----NDLG | WYQQKPGK APKRLIY | V------ ISSLQG | GVPSRFSGSGSG-- TEFTLTISSLQPEDFATYYC | LQHSS----- ------YPLT | FGGGT KVEIK |
| PS:393 806 | 21-225_6A6 | VK1/A30/ JK4 | DIQMTQSPSSLSA SVGDRVTITC | RAS--QGIR ----NDLG | WYQQKPGK APKRLIY | A------ ASSLQS | GVPSRFSGSGSG-- TEFTLTISSLQPEDFATYYC | LQHSS----- ------YPLT | FGGGT KVEIK |
| PS:393 808 | 21-225_1A2 | VK1/A30/ JK4 | DIQMTQSPSSLSA SVGDRVTITC | RAS--QGIR ----NDLG | WYQQKPGK APKRLIY | A------ ASSLQS | GVPSRFSGSGSG-- TEFTLTISSLQPEDFATYYC | LQHNS----- ------HPLT | FGGGT KVEIK |
| PS:393 814 | 21-225_7F4 | VK1/A30/ JK4 | DIQMTQSPSSLSA SVGDRVTITC | RTS--QDIR ----NDLG | WYQQKPGK APKRLIY | A------ ASNLQS | GVPSRFSGSGSG-- TEFTLTISSLQPEDFATYYC | LQRSA----- ------YPLT | FGGGT KVEIK |
| PS:393 816 | 21-225_6D4 | VK1/A30/ JK4 | DIQMTQSPSSLSA SVGDRVTITC | RAS--QAIR ----NDLG | WYQQKPGK APKRLIY | A------ ASSLQS | GVPSRFSGSGSG-- TEFTLTISSLQPEDFATYYC | LQHSS----- ------YPLT | FGGGT KVEIR |
| PS:393 818 | 21-225_6G12 | VK1/A30/ JK4 | DIQMTQSPSSLSA SVGDRVTITC | RAS--QGIR ----NDLG | WYQQKPGK APKRLIY | A------ ASTLQS | GVPSRFSGSGSG-- TEFTLTISSLQPEDFATYYC | LQHNS----- ------YPLT | FGGGT KVEIK |
| PS:393 820 | 21-225_8H7 | VK1/A30/ JK4 | DIQMTQSPSSLSA SVGDRVTITC | RAS--QGIR ----NDLG | WYQQKPGK APKRLIY | A------ ASSLQS | GVPSRFSGSGSG-- TEFTLTISSLQPEDFATYYC | LQHNS----- ------YPFT | FGGGT KVEIK |
| PS:393 826 | 21-225_10G5 | VK1/A30/ JK4 | DIQMTQSPSSLSA SVGDRVTITC | RTS--QDIR ----NDLG | WYQQKPGK APKRLIY | V------ ISSLQG | GVPSRFSGSGSG-- TEFTLTISSLQPEDFATYYC | LQSLQG----- ------YPLT | FGGGT KVEIK |
| PS:393 828 | 21-225_10H12 | VK1/A30/ JK4 | DIQMTQSPSSLSA SVGDRVTITC | RAS--QGIR ----NDLG | WYQQKPGK APKRLIY | G------ ASSLQS | GVPSRFSGSGSG-- TEFTLTISSLQPEDFATYYC | LQHSS----- ------YPLT | FGGGT KVEIK |
| PS:393 830 | 21-225_12A1 | VK1/A30/ JK4 | DIQMTQSPSSLSA SVGDRVTITC | RAS--QGIR ----NDLG | WYQQKPGK APKRLIY | A------ ACSFQS | GVPSRFSGSGYG-- TEFTLTISIMQPEDFATYYC | LQHNL----- ------YPLT | FGGGT KVEIK |
| PS:393 832 | 21-225_14B2 | VK1/A30/ JK4 | DIQMTQSPSSLSA SVGDRVTITC | LAS--QGIR ----NDLG | WYQQKPGK APKRLIY | A------ ASSLQS | GVPSRFSGSGSG-- TEFTLTISSVQREDFATYYC | VQHNS----- ------YPLT | FGGGT KVEIK |
| PS:393 854 | 21-225_7H11 | VK1/A30/ JK4 | DIQMTQSPSSLSA SVGDRVIIIC | RAS--QGIR ----NDLD | WYQQKPGK APKRLIY | S------ ASSLQS | GVPSRFSGSGCG-- TEFTLTISSLQREDFAAYYS | VQHYS----- ------YPFT | FGGGT KVEIK |
| PS:393 856 | 21-225_14C2 | VK1/A30/ JK4 | DIQMTQSPSSLSA SVGDRVTITC | RAS--QGIR ----NDLG | WYQQKPGK APQRLIS | A------ ASSLQS | IDFTLTISSLQPEDFATYYC GVPSRFSGSGSG-- | LQHNS----- ------YPLT | FGGGT KMEIK |
| PS:393 866 | 21-225_14E3 | VK1/A30/ JK4 | DIQMTQSPSSLSP SVGDRVTITC | RAS--QGIR ----NDLG | WYQQKPGK APKRLIY | A------ ASSLQS | GVPSRFSGSGSG-- TEFTLTISSLQPEDFATYYC | LQHNS----- ------YPLT | FGGGT KVEIK |
| PS:393 872 | 21-225_2A11 | VK1/A30/ JK4 | DIQMIQSPSFLFA CVGDRVIIIC | RAS--QGIR ----NDLG | WYQQKPGK APKRLIY | A------ ASSLQS | GVPSRFSGSVSG-- TEFTLTISSLQPEDFASYYC | LQHNS----- ------YFVK | FGGGT KVEIK |
| PS:393 874 | 21-225_4C8 | VK1/A30/ JK4 | DIQMTQSPSSLSA SVGDRVIIIC | RAS--QGIR ----NDLG | WYQQKPGK APKRLIY | A------ ASSQS | GVPSRFSGSGSG-- | LHNSS----- ------YPLT | FGGGT KVEIT |
| PS:393 880 | 21-225_15A1 | VK1/A30/ JK4 | DIQMTQSPSSLFA SVGDRVTITC | RAS--QGIR ----NDLG | WYQQKPGK APKRLIY | A------ ASSSQS | GVPSRFSGSRSG-- TEFTLTVSSLQPEDLAAYYC | LQHHS----- ------YPLT | FGGGT EVEIY |
| PS:393 882 | 21-225_15E3 | VK1/A30/ JK4 | DIQMTQSPSFSA SVGDRVTITC | RAS--QGIR ----NDLG | WYQQKSGK APKRLIY | V------ ASSLQS | GVPSRFSGSGSG-- TEFTLTISSVQPEDFATYYC | IQHNS----- ------YPFT | FGGGT KVEIK |
| PS:393 884 | 21-225_16F4 | VK1/A30/ JK4 | | | | | | | |

Figure 51 (Continued)

| | | | | | | | | | |
|---|---|---|---|---|---|---|---|---|---|
| PS:393886 | 21-225_2G9 | VK1(A30)/JK4 | DIQMTQSPSSLFA SVGDRVTITC | RAS--QGIR------NDLG | WYQQKPGK APQRLIY | A------ ASSLQS | GVPSRFSGSGFG--- TEFTLTISSLQLEDFATYYC | LQHES------ ------YPLT | FGGGT KVEIK |
| PS:393922 | 21-225_2B2 | VK1(A30)/JK4 | DIQMTQSPSSLSA SVGDRVTIITC | RAS--QGIR------NDLG | WYQQKPGK APKRLIY | A------ ASSLQS | GVPSRFSGSGSG--- TEFTLTISSLQPEDLATYHC | LQHNS------ ------YPLT | FGGGT KVEIK |
| PS:393928 | 21-225_4E10 | VK1(A30)/JK4 | DIQMTQSPSSLFA SVGDRVTITC | RAS--QGIR------NDLG | WYQQKPGK APKRLIY | A------ ASSLQS | GVPSRFSGSGFG--- TEFTLTISSLQLEDFATYYC | LQHDN------ ------YPLT | FGGGT KVEIK |
| PS:393934 | 21-225_13E6 | VK1(A30)/JK4 | DIQVTQSPSSLSA SVGDRVTIITS | RAS--QGIR------NDLG | WYQQKPGK APKRLIY | A------ ASSLQS | GVPSRFSGSGSG--- TEFTLTISSLQPEDFATYYC | VQHNS------ ------YPLT | FGGGT KVAIK |
| PS:393958 | 21-225_5H2 | VK1(A30)/JK4 | DIQMTQSPSSLSA SVTDRVTITC | RAS--QGIR------NDLG | WYQQKPGK APKRLIY | A------ ASSLQS | GVPSRFSGSGSG--- TEFTLTISSLQPEDFATYYC | LQHNS------ ------YPLT | FGGGT KVEIK |
| PS:393962 | 21-225_7H7 | VK1(A30)/JK4 | DIQMTQSPSSLSA SVGDRVTITC | RAS--QGIR------NDLG | WYQQKPGK APKRLIY | A------ ASSLQS | GVTSRFSGSGSG--- TEFTLTISSLQPEDFATYYC | LQHSS------ ------YPFT | FVGGT KVEIK |
| PS:393974 | 21-225_7C4 | VK1(A30)/JK4 | DIQMTQSPSSLFA SVGDRVTITC | RAS--QGIR------NDLG | WYQQKPGK AHKRLIY | A------ ASSLQS | GVPSRFSGSGSG--- TIFFLTISSLQPEDFATYYC | LQHNS------ ------YPLT | FGGGT KVEIK |
| PS:393976 | 21-225_7E9 | VK1(A30)/JK4 | DIQMTQSPSSLFA SVGDRVTITC | RAS--QGIR------NDLG | WYEQKPGK APKRLIY | A------ ASSLQS | GVPSRFSGSGSG--- TEFTLTISSLQPEDFATYYC | LQHNS------ ------YPLT | FGGGT KVEIK |
| PS:393982 | 21-225_6C12 | VK1(A30)/JK4 | DIQMTQSPSSLSA SVGRGTITC | RAS--QGIR------SNLG | WYQQKPGK APKRLIY | A------ ASSLES | GIPSRFSGSGFG--- TEFTLTISSLQPEDFATYPC | LQDNS------ ------YPFT | FGGGT RVEIK |
| PS:393984 | 21-225_4F12 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFATYYC | LQHNS------ ------YALT | FGGGT KVEIK |
| PS:393990 | 21-225_11G7 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFATYYC | LQHSN------ ------YPLT | FGGGT MVEIR |
| PS:393994 | 21-225_8C9 | VK1(A30)/JK4 | DIQMTQSPSSLSA SIGDRVTITC | RAS--QAIR------NDLD | WYQQKPGK APKRLIY | T------ ASSLQS | GVPSRFSGSGSG--- TEFTLTISSLQTEDFATYYC | LQHNS------ ------YPLT | FGGGT KVEIK |
| PS:394002 | 21-225_15G7 | VK1(A30)/JK4 | DIQMTQSPSSLSA SVGDRVTITC | RAS--QGIR------NDLG | WYQQKPGK APKRLIY | A------ ASSLES | GIPSRFSGSGFG--- TEFTLTISSLQPEDFATYYC | LQHNS------ ------YPLT | FGGGT KVEIK |
| PS:394008 | 21-225_15H8 | VK1(A30)/JK4 | DIQMTQSPSSLSA SVGDRVTITC | RAS--QGIR------NDLG | WYQQKPGK APKRLIF | A------ ASSLQS | GVPSRFSGSGSG--- TEFTLTISSLQPEDFATYYC | LQHNS------ ------YPLT | FGGGT KVEIK |
| PS:394020 | 21-225_15H10 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFASYC | LQHNS------ ------YPLT | FGGGT KVEIN |
| PS:394024 | 21-225_16B7 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFATYYC | LQHNS------ ------YPLT | FGGGT KVEIK |
| PS:394037 | 21-225_4F4 | VK1(A30)/JK4 | DIQMTQSPSSLSA SVGDRVTITC | RAS--QGIR------NDLG | WYQQKPGK APKRLIY | A------ ASSVQI | GVPSRFSGSGSG--- TEFTLTISSLQTEDFAIYYC | LQHNS------ ------YPLT | FGGGT KVEEN |
| PS:394045 | 21-225_4H4 | VK1(A30)/JK4 | DIQMTQSPSSLSA SVGDRVTITC | RAS--QGIR------NDLG | WYQQKPGK APKRLIY | A------ ASSVQS | GVPSRFSGSGSG--- TEFTLTISSLQPEDFATYYC | LQHNS------ ------YPLT | FGGGT KVEIK |
| PS:394049 | 21-225_13H5 | VK1(A30)/JK4 | DIQMTQSPSSLSA SVGDRVTITC | RAS--QGIR------NDLG | WYQQKPGK APKRLIY | A------ ASSLQT | GVPSRFSGSGSG--- TEFTLTISSLQPEDFATYYC | LQHSS------ ------YPLT | FGGGT KVEIK |
| PS:394053 | 21-225_11F10 | VK1(A30)/JK4 | DIQMTQSPSSLSA SVGDRVTITC | RAS--QGIR------NDLG | WYQQKPGK APKRLIY | A------ ASSLQS | GVPSRFNGSGSG--- TEFTLTVSSLQPEDFATYYC | LQHSS------ ------YPLT | FGGGT KVEIK |
| PS:394057 | 21-225_15H1 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFATYYC | LQHNS------ ------YPLT | FGGGT KVEIK |
| PS:394063 | 21-225_16A1 | VK1(A30)/JK4 | DIQMTQSPSSLSA SVGDRVTITC | RAS--QGIR------NDLG | WYQQKPGK APKRLIY | A------ ASSLQS | GVPSRFSGSGSG--- TEFTLTISSLQPEDFATYYC | LHHSN------ ------YPLT | FGGGT KVEIE |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:394 073 | 21-225_15C9 | VK1|A30/ JK4 | DIQMTQSPSSLSA SVGDRVTITC | RAS--QGIR-----NDLG | WYQQKPGK APKRLIY | A------ASSLQS | GVPSRFSGSGSG--TEFTLTISSLQPEDFATYYC | LQHTS----------YPLT | FGGGT KVEIK |
| iPS:394 075 | 21-225_8D12 | VK1|A30/ JK4 | DIQMTQSPSSLSA SVGDRVTITC | RAS--QGIR-----NDLG | WYQQKPGK APKRLIY | A------ASSLQS | GVPSRFNGSGSG--TEFTLTISSLQPEDFATYYC | LQHSS----------YPLT | FGGGT KVEIK |
| iPS:394 079 | 21-225_11F5 | VK1|A30/ JK4 | DIQMTQSPSSLSA SVGDRVTITC | RAS--QGIR-----NDLG | WYQQKPGK AFKRLIY | A------ASSVQS | GVPSRFSGSGSG--TEFTLTISSLQPEDFATYYC | LQHNS----------YPLT | FGGGT KVEIK |
| iPS:394 091 | 21-225_13H3 | VK1|A30/ JK4 | DIQMTQSPSSLSA SVGDRVTITC | RAS--QGIR-----NDLG | WYQQKPGK APKRLIY | A------ASSLQS | GVPSRFSGSGSG--TEFTLTISSLQPEDFATYYC | LQHNS----------YPLT | FGGGT KVEIK |
| iPS:398 528 | 21-225_32G1 | VK1|A30/ JK4 | DIQMTQSPSSLSA SVGDRVTITC | RAS--QDMR-----SDLG | WYQQKPGK APKRLIY | A------ASSLQS | GVPSRFSGSGSG--TEFTLTISSLQPEDFATYYC | LQHTI----------SPPT | FGGGT KVEIK |
| iPS:398 534 | 21-225_33B8 | VK1|A30/ JK4 | DIQMTQSPSSLSA SVGDRVTITC | RAS--QDIR-----SDLG | WYQQKPGK APKRLIY | A------ASSLQS | GVPSRFSGSGSG--TEFTLTISSLQPEDFATYFC | LQHTI----------YPPT | FGGGT KVEIK |
| iPS:398 540 | 21-225_35A6 | VK1|A30/ JK4 | DIQMTQSPSSLSA SVGDRVTITC | RAS--QDIR-----SDLG | WYQQKPGK APKRLIY | A------TSSLQS | GVPSRFSGSGSG--TEFTLTISSLQPEDFATYYC | LQHTI----------YPPT | FGGGT KVEIK |
| iPS:402 219 | 21-225_1C12 | VK1|A30/ JK4 | DIQMTQSPSSLSA SVGDRVTITC | RAS--QGIR-----NDLG | WYQQKPGK AFKRLIY | A------ASSLQS | GVPSRFSGSGSG--TEFTLTISSLQPEDFATYYC | LQHNS----------YPLT | FGGGT KVAIK |
| iPS:403 868 | 21-225_19D11 | VK1|A30/ JK4 | DIQMTQSPSSLSA SVGDRVTITC | RAS--QGIR-----NDLG | WYQQKPGK APKRLIY | A------TSSLQS | GVPSRFSGSGSG--TEFTLTISSLQPEDFATYYC | LQYYS----------YPLT | FGGGT EVEIK |
| iPS:403 872 | 21-225_8F11 | VK1|A30/ JK4 | DIQMTQSPSSLSA SVGDRVTITC | RAS--QGIR-----SDLG | WFQQKPGK APKRLIF | D------ASSVQS | GVPSRFSGSGSG--TEFTLTISSLQPEDFATYYC | LQHYT----------YPLT | FGGGT KVEIK |
| Germline | | K_FR1 | K_CDR1 | K_FR2 | K_CDR2 | K_FR3 | K_CDR3 | K_FR4 |
| VK2|A18|JK 5 | | DIVMTQTPLSLSV TPGQPASISC | KSS---QSLLHSD-GKTYLN | WYLQKPGQ SPQLLIY | E------VSNRFS | GVPDRFSGSGSG--TDFTLKISRVEAEDVGVYYC | MQSIQ----------LPIT | FGQGT RLEIK |
| iPS:468 816 | 21-225_52G8 | VK2|A18/ JK5 | DIVMTQTPLSLSV TPGQPASMSC | KSS---QSLLHSE-GKTYLY | WYLQKTGQ PPHLLIY | E------VSKRLS | GVPDRFSGSGSG--TDFTLKISRMEAEDVGVYYC | MQSMQ----------LPIT | FGQGT RLEIK |
| iPS:434 021 | 21-225_49C1 | VK2|A18/ JK5 | DIVMTQTPLSLSV TPGQPASISC | KSS---QSLLHRE-GKTYLY | WYLQKPGQ APQFLIF | E------VSHRFS | GVPDRFSGSGSG--TDFTLKISRVEAEDVGVYYC | MQSIQ----------IPIT | LGQGT RLEIK |
| iPS:434 025 | 21-225_49G3 | VK2|A18/ JK5 | DIVMTQTPLSLSV TPGQPASMSC | KSS---QSLLHSE-GKTYLY | WYLQKTGQ PPHLLIY | E------VSNRLS | GVPDRFSGSGSG--TDFTLKISRMEAEDVGVYFC | MQSMQ----------LPIT | FGQGT RLEIK |
| iPS:434 031 | 21-225_49E7 | VK2|A18/ JK5 | DIVMTQTPLSLSV TPGQPAFMSC | KSS---QIFLHSE-GKTYLY | WYLQKTGQ PPHLLIY | E------VSKRLS | GVPDRFSGSGSG--TDFTLKISRMEAEDVGVYYC | MQSMQ----------LPIT | FGQGT RLEIK |
| iPS:434 033 | 21-225_49F9 | VK2|A18/ JK5 | DIVMTQTPLSLSV TPGQPASISC | KSN---QSLVHNE-GKTYLY | WYLQKPGQ PPQLLIF | E------VSNRFS | GVPDRFSGSGSG--TDFTLKISRVEAEDVGVYYC | MQSIQ----------YPIT | FGQGT RLEIK |
| iPS:434 093 | 21-225_52D10 | VK2|A18/ JK5 | DIVMTQTPLSLSV TPGQPASISC | KSS---QSLLHSE-GKTYLY | WYLQKPGQ PPQLLIF | E------VSNRVS | GVPDRFSGSGSG--TDFTLKISRVEAEDVGVYYC | MQSIQ----------YPIT | FGQGT RLEIK |
| iPS:434 151 | 21-225_55C2 | VK2|A18/ JK5 | DVMMTQIPLSLSV TPGQPASISC | KSS---QSLVHSE-GKTYLY | WYLQKPGQ PPQLLIY | E------VSNRVS | GVPDRFSGRGSG--TDFTLKISRVEAEDVGVYYC | MQSIL----------YPIT | FGQGT RLEIK |
| iPS:434 161 | 21-225_55F9 | VK2|A18/ JK5 | DIVMTQTPLSLSV TPGQSASISC | KSS---QSLLHSE-GKTYLY | WYLQKPGQ PPQLLIY | E------VSNRFS | GVPDRFSGSGSG--TDFTLKISRVEAEDVGVYYC | IQSIQ----------LPIT | FGQGT RLEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:435 329 | 21-225_147A8 | VK2/A18/ JK5 | DIVMTQTPLSLSV TPGQPASISC | KTS--- QSLLHSE- GKTYLY | WYLQKPGQ PPQLLIY | E------- VSNRFS | GVPDRFSGSGSG-- TDFTLKISRVEAEDVGVYYC | MQSI------------QLIT | FGQGT RLEIK |
| iPS:392 924 | 21-225_32H2 | VK2/A18/ JK5 | DIVMTQTPLSLSV TPGQPASISC | RSS--- QSLLHSD- GRTYLY | WYLQKPGQ PPQLLIY | E------- LSNRFS | GVPDRFSGSGSG-- TDFTLKISRVEAEDVGIYSC | LQSIQ-----------YPIT | FGQGT RLEIK |
| | Germline | VK2/A18/JK 1 | DIVMTQTPLSLSV TPGQPASISC | KSS--- QSLLHSD- GKTYLY | WYLQKPGQ PPQLLIY | E------- VSNRFS | GVPDRFSGSGSG-- TDFTLKISRVEAEDVGVYYC | MQSI------------LPWT | FGQGT KVEIK |
| iPS:468 822 | 21-225_147E1 0 | VK2/A18/ JK1 | AIVMTQTPLSLSV TPGQPASISC | KSS--- QRLLHGD- GKTYLY | WYLQKPGQ PPHLLIS | E------- VSNRFS | GVPDRFSGSGSG-- TDFTLKISRVEAEDVGVYYC | MQSIQ------------VPWT | FGQGT KVEIK |
| iPS:433 917 | 21-225_43E11 | VK2/A18/ JK1 | DIVMTQTPLSLSV TPGQPASISC | KSS--- QSLLHSD- GRTYLY | WYLQKPGQ PPQLLIY | E------- VSNRFS | GVPDRFSGSGSG-- TDFTLKISRVEAEDVGVYYC | MQSIQ------------LPWT | FGQGT KVEIK |
| iPS:433 965 | 21-225_46F2 | VK2/A18/ JK1 | DIVMTQTPLSLIV TPGQPASISC | KSS--- QSLLHGD- GKTYLY | WYLQKPGQ PPQVLIY | E------- VSNRFS | GVPDRFSGSGSG-- TDFTLKLSRVEAEDVGVYYC | MQSIQ------------LPWT | FGQGT KVEIK |
| iPS:433 985 | 21-225_47C1 | VK2/A18/ JK1 | DIVMTQTPLSLSV TPGQPASISC | TSS--- QSLLHSE- GKTYLY | WYLQKPGQ PPQLLIY | E------- VSNRFS | GVPDRFSGSGSG-- TDFALKISRVEAEDVGVFYC | MQSIQ------------LPWT | FGQGT KAEIK |
| iPS:433 991 | 21-225_47E7 | VK2/A18/ JK1 | EIVMTQTPLSLSV TPGQPASISC | KSS--- QSLLHGD- GKTYLY | WYLQKPGQ PPQLLIY | E------- VSNRFS | GVPDRFSGSGSG-- TDFTLKISRVEAEDVGVYYC | MQSIQ------------LPWT | FGQGT KVEIK |
| iPS:434 345 | 21-225_64H9 | VK2/A18/ JK1 | DIVMTQTPLSLSV TPGQPASISC | KSS--- QSLLHGD- GKTYLF | WYLQRPGQ PPQLLIY | E------- VSNRLC | GVPDRFSGSGSG-- TDFSLKISRVEAEDVGVYYC | MQSIQ------------VPWT | FGQGT KVEIT |
| iPS:435 297 | 21-225_146B3 | VK2/A18/ JK1 | DIVMTQTPLSLSV TPGQPASISC | KSS--- QSLLHGD- GKTYLY | WYLQKPGQ PPQLLIY | E------- VSNRFS | GVPDRFSGSGSG-- TDFTLKISRVEAEDVGLYHC | MQSIQ------------LPWT | FGQGT KVEIK |
| iPS:435 341 | 21-225_148B2 | VK2/A18/ JK1 | AIVMTQTPLSLSV TPGQPASISC | KSS--- QSLLHGD- GKTYLY | WYLQRPGQ PPQLLIY | E------- VSNRFS | GVPDRFSGSGSG-- TDFTLKISRVEAEDVGVYYC | MQSIQ------------IPWT | FGQGT KVEIK |
| iPS:435 357 | 21-225_148G1 0 | VK2/A18/ JK1 | DIVMTQTPLSLSV TPGQPASISC | KSS--- QSLLHGD- GKTYLY | WYLQKPGQ PPQLLIY | E------- VSNRFS | GVPDRFSGSGSG-- TDFTLKISRVEAEDVGVYYC | MQSIQ------------LPWT | FGQGT KVEIK |
| iPS:435 365 | 21-225_149F1 | VK2/A18/ JK1 | DIVMTQSPLSLFV TPGQPASISY | KSS--- QSLVHGD- GKTYFY | WYLQRPGQ PPQLLIY | E------- VSNRFS | GVPDRFSGSGSG-- TDFTLKISRVEAEDVGVYYC | MQSIQ------------IPWT | FGQGT KVEIK |
| iPS:435 413 | 21-225_150B1 1 | VK2/A18/ JK1 | DIVMTQTPLSLSV TPGQPASISC | KSS--- QSLLHGD- GKTYLY | WYLQKPGQ PPQLLIY | E------- VSNRFS | GVPDRFSGSGSG-- TDFTLKISRVEAEDVGVYYC | MQSIQ------------LPWT | FGQGT KVEIK |
| iPS:435 423 | 21-225_151G5 | VK2/A18/ JK1 | DIVMTQTPLSLSV TPGQPASISC | KSS--- QRLLHGD- GKTYLY | WYLQKPGQ PPQLLIY | E------- VSNRFS | GVPDRFSGSGSG-- TDFTLKISRVEAEDVGVYYC | MQSIQ------------VPWT | FGQGT KVEIK |

Figure 51 (Continued)

| | | | | | | | | |
|---|---|---|---|---|---|---|---|---|
| iPS:435 429 | 21-225_151A1 | VK2A18/ JK1 | DIVMTQTPLSLSV TPGQPASISC | KSS--- QSLLHGD- GKTYLY | WYLQKPGQ PPQLLIY | E------ VSKRFS | GVPDRFSGSGSG-- TDFTLKISRVEAEDVGVYYC | MQSIQ------ ------IPWT | FGQGT KVEIK |
| iPS:435 441 | 21-225_152F6 | VK2A18/ JK1 | DIVMTQTPLSLSV TPGQPASISC | KSS--- QSLRHGD- GKTYLT | WYLQRPGQ PPQVLIH | E------ ISKRFT | GVPDRFSGSGSG-- TDFTLNISRVEAEDVGPFYYC | MQSIQ------ ------VPWT | FGQGT KVEIK |
| iPS:435 457 | 21-225_152C1 | VK2A18/ JK1 | DIVMTQAPLSLSV TPGQPASISC | KSS--- QSLLHGD- GKTYLY | WYLQKPGQ PPQILIY | E------ VSNRFS | GVPDRFSGSGSG-- TDFTLNISRVEAEDFGFYYC | MQSIQ------ ------IPWT | FGQGT KVDIK |
| iPS:435 463 | 21-225_153D2 | VK2A18/ JK1 | DIVMTQTPLSLSV TPGQPASISC | KSS--- QSLRHGD- GKTYLT | WYLQRPGQ PPQVLIH | E------ VSKRFT | GVPDRFSGSGSG-- TDFTLNISRVEAEDVGPFYYC | MQSIQ------ ------VPWT | FGQGT KVEIK |
| iPS:435 489 | 21-225_155A5 | VK2A18/ JK1 | DIVMTQTPLSLSV TPGQPASISC | KSS--- QSLLHGD- GKTYLY | WYLQKPGQ PPQLLIY | E------ VSNRFS | GVPDRFSGSGSG-- TDFTLKISRVEAEDVGPFYYC | MQSIQ------ ------VPWT | FGQGT KVEIK |
| iPS:435 531 | 21-225_157G8 | VK2A18/ JK1 | DIVMTQTPLSLSV TPGQPASISC | KSS--- QSLLHGD- GKTYLY | WYLQKPGQ SPQLLIY | E------ ISKRFS | GVPDRFSGSGSG-- TDFTLKISRVEAEDVGLYYC | MQSIQ------ ------VPWT | FGQGT KVEIK |
| iPS:435 577 | 21-225_160B1 | VK2A18/ JK1 | DIVMTQTPLSLSV TPGQPASISC | KSS--- QSLLHGD- GKTYLY | WYLQKPGQ PPQVLIY | E------ VSKRFS | GVSERFSGSGSG-- TDFTLKISRVEAEDVGVYYC | MQSIQ------ ------IPWT | FVQGT KVEIT |
| iPS:435 601 | 21-225_160G1 | VK2A18/ JK1 | AIVMTQTPLSLSV TPGQPASISC | KSS--- QSLLHGD- GKTYLY | WYLQKPGQ PPHLLIY | E------ VSNRFS | GVPDRFSGSGSG-- TDFTLKISRVEAEDVGLYYC | MQSIQ------ ------iPWT | FGQGT KVEIK |
| iPS:435 629 | 21-225_162H6 | VK2A18/ JK1 | DIVMTQTPLSLSV TPGQPASISC | KST--- QSLLHGD- GKTYLY | WYLQKPGQ PPQLLIY | E------ VSKRFS | GVPERFSGSGSG-- TDFTLKISRVEAEDVGVYYC | KQSIQ------ ------LPWT | FGQGT KVEIK |
| iPS:435 655 | 21-225_167E2 | VK2A18/ JK1 | DIVMTQTPLSLSV TPGQPASISC | KSS--- QSLLHGD- GKTYLY | WYLQKPGQ PPHLLIY | E------ VSKRFS | GVPDRFSGSGSG-- TDFTLKISRVEAEDVGLYHC | MQSIQ------ ------LPWT | FGQGT KVEIK |
| iPS:435 657 | 21-225_167H1 | VK2A18/ JK1 | DIVMTQTPLSLSV TPGQPASISC | KSS--- QSLLHGD- GKTYLY | WYLQKPGQ PPHLLIY | E------ VSKRFS | GVPDRFSGSGSG-- TDFTLKISRVEAEDVGLYYC | MQSIQ------ ------LPWT | FGQGT KVEIK |
| iPS:435 683 | 21-225_170A1 | VK2A18/ JK1 | DIVMTQTPLFLSV TPGQPASISC | KSS--- QSLLHGD- GKTYLF | WYLQKPGQ PPQVLIY | E------ VSHRFS | GVPDRFSGSGSG-- TDFTLKISRVEAEDVGVIYC | MQSIQ------ ------LPWT | FGQGT KVEIK |
| iPS:435 723 | 21-225_172B7 | VK2A18/ JK1 | DIVMTQTPLSLSV TPGQPASISC | KSS--- QSLLHGD- GKTYLY | WYLQKPGQ PPQVLIF | E------ VSKRFS | GVPDRFSGSGSG-- TDFTLKISRVEAEDVGVFFC | MQSIQ------ ------FPWT | FGQGT KVEIK |
| iPS:435 731 | 21-225_173A1 | VK2A18/ JK1 | DIVMTQTPLSLSV TPGQPASISC | KSS--- QSLLHGD- GKTYLY | WYLQKPGQ PPQLLIY | E------ VSNRFS | GVPDRFSGSGSG-- TDFTLKISRVEAEDVGIYYC | MQSIQ------ ------VPWT | FGQGT KVEIK |
| iPS:435 755 | 21-225_176H4 | VK2A18/ JK1 | DIVMTQTPLSLSV TPGQPASISC | KSS--- QSLLHGD- GKTYLY | WYLQKPGQ PPQLLIY | E------ VSNRFS | GVPDRFSGSGSG-- TDFTLKISRVEAEDVGIYYC | MQSIQ------ ------IPWT | FGQGT KVEIK |
| iPS:435 771 | 21-225_177B1 | VK2A18/ JK1 | DIVMTQTPLSLSV TPGQPASISC | KSS--- QRLLHGD- GKTYLY | WYLQKPGQ PPQILIY | E------ VSNRFS | GVPDRFSGSGSG-- TDFTLKISRVEAEDVGVYYC | MQSIQ------ ------IPWT | FGQGT KVEIK |

Figure 51 (Continued)

| | | | | | | | | |
|---|---|---|---|---|---|---|---|---|
| iPS:435 781 | 21-225_178G10 | VK2/A18/ JK1 | HIVMTQTPLSLSV TPGQPASISC | KSS--- QSLLHGD- GRTYLY | WYLQKPGQ PPQLLIY | E------ VSNRFS | GVPDRLSGGSG--- TDFTLKISRVEAEDVGIYYC | MQSIQ--------- ---------VPWT | FGQGT KVEIK |
| iPS:435 789 | 21-225_180C4 | VK2/A18/ JK1 | DIVMTQTPLSLSV TPGQPASISC | KSS--- QSLLHSD- GKTYLY | WYLQKPGQ PPQLLIY | A------ TSNRFP | GVSDRFSGSGSG--- TDFTLKISRVEAEDVGVYYC | MQSIQ--------- ---------VPWT | FGQGT KVEIK |
| iPS:435 795 | 21-225_181C2 | VK2/A18/ JK1 | EIVMTQTPLSLSV TPGQPASISC | KSS--- QSLLHGD- GRTYLY | WYLQKPGQ PPQLLIH | E------ VSNRFS | GVPDRFSGSGSG--- TDFTLKISRVEAEDVGVYYC | MQSIQ--------- ---------VPWT | FGQGT KVEIK |
| iPS:435 807 | 21-225_181C10 | VK2/A18/ JK1 | DIVMTQTPLSLSV TPGQPASISC | KSS--- QSLLHGD- GKTYLY | WYLQKPGQ PPQLLIC | E------ VSNRFS | GVPDRFSGSGSG--- TDFTLKISRVEAEDVGVYYC | MQSIQ--------- ---------LPWT | FGQGT KVEIK |
| iPS:435 827 | 21-225_190H1 | VK2/A18/ JK1 | DIVMTQTPLSLSV TPGQPASISC | KSS--- QSLLHSD- GRTYLY | WYLQKPGQ PPQLLIC | E------ VSNRFA | GVTDRFSGSGSG--- TDFTLKISRVEAGDVGVYYC | MQSIQ--------- ---------FPWT | FGQGT KVEIK |
| iPS:435 839 | 21-225_191B1 | VK2/A18/ JK1 | DIVMTQTPLSLSV TPGQPASISC | KSS--- QSLLHSD- GKTYLY | WYLQKPGQ PPQVLIY | E------ LSNRFS | GVPDRFSGSGSG--- TDFTLKISRVEAEDVGVYYC | MQSFQ--------- ---------LPWT | FGQGT KVEIN |
| iPS:435 853 | 21-225_191E3 | VK2/A18/ JK1 | DIVMTQTPLSLSV TPGQPASISC | KSS--- QSLLHSD- GRTYLY | WYLQKPGQ PPQLLIC | E------ VSNRFA | GVTDRFSGSGSG--- TDFTLKISRVEAGDVGVYYC | MQSIQ--------- ---------LPWT | FGQGT KVEIK |
| iPS:435 871 | 21-225_191E6 | VK2/A18/ JK1 | DIVMTQTPLSLSV TPGQPASISC | KSS--- QSLLHGD- GRTYLY | WYLQKPGQ PPQLLIC | E------ VSNRFA | GVTDRFSGSGSG--- TDFTLKISRVEAGDVGVYYC | MQSIH--------- ---------FPWT | FGQGT KVEIK |
| iPS:435 887 | 21-225_186F7 | VK2/A18/ JK1 | DVVMAQTPLSLSV TPGQPASISC | KSS--- QSLLHSD- GRTYLY | WYLQKPGQ PPQLLIY | E------ VSKRFS | GVPDRFSGSGSG--- TDFTLKISRVEAEDVGVYYC | MQSIQ--------- ---------VPWT | FGQGT KVEIK |
| iPS:435 899 | 21-225_188G1 | VK2/A18/ JK1 | DIVMTQTPLSLSV TPGQPASISC | MSS--- QSLLHSD- GKTYLY | WYLQKPGQ PPFQLLIY | E------ VSNRFS | GVPDTFSGSGSG--- TDFTLKISRVEAEDVGVYYC | MQSIQ--------- ---------IPWT | FGQGT KVEIK |
| iPS:435 901 | 21-225_189G21 | VK2/A18/ JK1 | DIVMTQTPLSLSV TPGQPASISC | KSS--- QSLLHGD- GKTYLF | WYLQKPGQ PPQLLIC | E------ VSNRFS | GVSDRFSGSGSG--- TDFTLKISRVEAEDVGVYYC | MQSIQ--------- ---------VPWT | FGQGT KVEIK |
| iPS:435 927 | 21-225_190E7 | VK2/A18/ JK1 | DIVLTQTPLSLSV TPGQPASISC | KSS--- QSLLHSD- GKTYLY | WYLQKPGQ PPQVLIY | E------ VSNRFS | GVPDRFSGSGSG--- TDFTLKISRVEAEDVGVYYC | MQSIQ--------- ---------IPWT | FGQGT KVEIK |
| iPS:435 999 | 21-225_192F9 | VK2/A18/ JK1 | DIVMTQTPLSLSV TPGQPASISC | KSS--- QSLLHSD- GRTYLY | WYLQRPGQ PPQLLIC | E------ VSNRFA | GVTDRFSGSGSG--- TDFTLKISRVEAGDVGVYYC | MQSIQ--------- ---------LPWT | FGQGT KVEIK |
| iPS:436 060 | 21-225_194F4 | VK2/A18/ JK1 | DIVMTQTPLSLSV TPGQPASISC | KSS--- QSLLHSD- GRTYLY | WYLQKPGQ PPQLLIC | E------ VSNRFS | GVPDRFSGSGSG--- TDFTLKISRVEAGDVGVYYC | MQSIQ--------- ---------LPWT | FGQGT KVEIK |
| iPS:436 158 | 21-225_197G8 | VK2/A18/ JK1 | EIVMTQTPLSLSV IPGQPASISC | KSS--- QNLLMSD- GKTYLY | WYLQKPGQ PPQVLIY | E------ VSNRFS | GVPDRFSGSGSG--- TDFTLKISRVEAEDVGVYSC | MQSIQ--------- ---------LPWT | FAQGS KVEIK |
| iPS:436 193 | 21-225_198A10 | VK2/A18/ JK1 | DIVLTQTPLSLSV TPGQPASISC | KSS--- QSLLYSD- GKTYLY | WYLQKPGQ PPQVLIC | E------ VSNRFS | GVPDRFSGSGSG--- TDFTLKISRVEAGDVGVYYC | MQSIQ--------- ---------LPWT | FGQGT KVEIK |

Figure 51 (Continued)

| | | | | | | | | |
|---|---|---|---|---|---|---|---|---|
| iPS:436 536 | 21-225_224G1 | VK2/A18/ JK1 | DIVMTQTPLSLSV TPGQPASISC | KSG--- QSLLHSD- GKTFLS | WYLQKPGQ PPQLLIY | E------ ISNRFS | GVPDRFSGSGSG-- TDFTLKISRVEAEDVGIFYYC | MQSTQ------ ------LPRT | FGQGT KVEIK |
| iPS:436 548 | 21-225_224A7 | VK2/A18/ JK1 | DIVMTQTPLSLSV TPGQPASISC | KSS--- QSLLHSD- GKTFLY | WFLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 558 | 21-225_224C1 | VK2/A18/ JK1 | DFVMTQTPLSLSV TPGQPASISC | KSS--- QSLLHSD- GKTFLY | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 562 | 21-225_224H1 | VK2/A18/ JK1 | DIVMTQTPLSLSV TPGQPASISC | KSS--- QSLLHSD- GKTFLY | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 572 | 21-225_225G4 | VK2/A18/ JK1 | DIVMTQTPLSLSV TPGQPASISC | KSS--- QSLLHSD- GKTFLY | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 592 | 21-225_226B1 | VK2/A18/ JK1 | DIVMTQTPLSLSV TPGQPASISC | KSS--- QSLLHGD- GKTYLY | WYLQKPGQ PPQLLIY | E------ VSIRFS | GVPDRFSGSGSG-- TDFTLKISRVEAEDVGIYYC | MQSIQ------ ------IPWT | FGQGT KVDIK |
| iPS:436 594 | 21-225_226A5 | VK2/A18/ JK1 | DIVMTQTPLSLSV TPGQPASISC | KSS--- QSLLHGD- GKTYLY | WYLQKPGQ PPQLLIY | E------ VSNRFS | GVPDRFSGSGSG-- TDFTLKISRVEAEDVGIYYC | MQSIQ------ ------IPWT | FGQGT KVEIK |
| iPS:436 602 | 21-225_226E7 | VK2/A18/ JK1 | DIVMTQTPLSLSV TPGQPASISC | KSS--- QSLLHGD- GKTYLY | WYQQKPGQ PPQFLIY | E------ VSNRFS | GVPDRFSGSGSG-- TDFTLKISRVEAEDVGIYYC | MQSTQ------ ------VPWT | FGQGT KVEIK |
| iPS:436 606 | 21-225_226G8 | VK2/A18/ JK1 | DIVMTQTPLSLSV TPGQPASISC | KSS--- QSLLHSD- GKTFLX | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 610 | 21-225_226F9 | VK2/A18/ JK1 | DIVMTQTPLSLSV TPGQPASISC | KSS--- QSLLHSD- GKTFLX | WYLQRPGQ PPQLLIY | E------ VSNRFS | GVPDRFSGSGSG-- TDFTLKISRVEAEDVGIYYC | MQSTQ------ ------LPRT | FGQGT KVEIK |
| iPS:436 612 | 21-225_226H9 | VK2/A18/ JK1 | DIVMTQTPLSLSV TPGQPASISC | KSS--- QSLLHSD- GKTFLX | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 614 | 21-225_226F10 | VK2/A18/ JK1 | DIVMTQTPLSLSV IPGQPASISC | KSS--- QSLLHSD- GKTFLX | WYLHKPGQ PPHLLIY | E------ ISNRFS | GVPDRFSGSGSG-- TDFTLKISRVEAEDVGIYYC | MQSTQ------ ------LPRT | FGQGT KVEIK |
| iPS:436 618 | 21-225_226E1 | VK2/A18/ JK1 | DIVMTQTPLSLSV TPGQPASISC | KSS--- KTLLHSD- GKTFLX | WYLQKPGQ PPQPLIY | E------ VSNRFS | GVPDRFSGSGSG-- TDFTLKISRVEAEDVGIYYC | MQSTQ------ ------LPRT | FGQGT KVEIK |
| iPS:436 624 | 21-225_226H1 2 | VK2/A18/ JK1 | DIVMTQTPLSLSV TPGQPASISC | KSS--- QSLLHSD- GKTFLX | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 626 | 21-225_227C1 | VK2/A18/ JK1 | DIVMTQTPLSLSV TPGQPASISC | KSS--- QSLLHSD- GKTFLX | WYLQKPGQ PPQLLIY | E------ ISNRFS | GVPDRFSGSGSG-- TDFTLKISRVEAEDVGIYYC | MQSTQ------ ------LPRT | FGQGT KVEIK |
| iPS:436 628 | 21-225_227F2 | VK2/A18/ JK1 | DIVMTQTPLSLSV TPGQPASISC | KSS--- QSLLHSD- GKTFLX | WYLQKPGQ PPQLLIY | E------ ISNRFS | GVPDRFSGSGSG-- TDFTLKISRVEAEDVGIYYC | MQSTQ------ ------LPRT | FGQGT KVEIK |

Figure 51 (Continued)

| | | | | | | | | | |
|---|---|---|---|---|---|---|---|---|---|
| iPS:436 640 | 21-225_227A8 | VK2|A18/ JK1 | DIVMTQTPLSLSV TPGQPASISC | KSS---QSLLHSD-GKTFLY | WYLQKPGQ PPQLLIY | E------ISNRFS | GVPDRFSGSGSG-TDFTLKISRVEAEDVGIYYC | MQSTQ------LPRT | FGQGT RVEIK |
| iPS:392 814 | 21-225_22A1 | VK2|A18/ JK1 | DIVMTQTPLSLSV TPGQPASISC | KSS---QSLLHSG-GKTYLY | WYLQKPGQ PPQLLIY | E------VSNRFS | GLPDRFSGSGSG-TDFTLKISRVEAADVGVYYC | MQTLH------LPWT | FGQGT KVEIK |
| iPS:392 930 | 21-225_25H9 | VK2|A18/ JK1 | DIVMTQTPLSLSV TPGQPASISC | KSS---QSLLHGD-GKTYLF | WYLQKPGQ PPQLLIY | E------VSNRFS | GVPDRFSGSGSG-TDFTLKISRVEAEDVGVYYC | MQSIQ------LPWT | FGQGT KVEIK |
| iPS:393 032 | 21-225_26F8 | VK2|A18/ JK1 | DIVMTQTPLSLSV TPGQPASISC | KSS---QSLLHGD-GKTYLY | WYLQKPGQ PPQLLIY | E------VSNRFS | GVPDRFSGSGSG-TDFTLKISRVEAEDVGVYYC | MQSIQ------LPWT | FGQGT KVEIK |
| iPS:393 036 | 21-225_28G3 | VK2|A18/ JK1 | EIVMTQTPLSLSV TPGQPASISC | KSS---QSLLHGD-GKTYLY | WYLQKPGQ PPQLLIY | E------VSNRFS | GVPERFSGSGSG-TDFTLKISRVEAEDVGVYYC | MQSIQ------IPWT | FGQGT KVEIK |
| | | K_FR1 | K_CDR1 | K_FR2 | K_CDR2 | K_FR3 | K_CDR3 | K_FR4 |
| | VK1|A30|JK1 | Germline | DIQMTQSPSSLSA SVGDRVTITC | RAS---QGIR----NDLG | WYQQKPGK APKRLII | A------ASSLQS | GVPSRFSGSGSG-TEFTLTISSLQPEDFATYYC | LQHYS------YPRT | FGQGT KVEIK |
| iPS:468 826 | 21-225_201C5 | VK1|A30/ JK1 | DIQMTQSPSSLSA SVGDRVTITC | RAS---QGIR----HDLG | WYQQKPGK APKRLII | A------ASSLQS | GVPSRFSGSGSG-TEFTLTISSLQPEDFATYYC | LQHYS------FPRT | FGQGT KVEIK |
| iPS:468 842 | 21-225_50H4 | VK1|A30/ JK1 | DIQMTQSPSSLSA SVGDRVTITC | RAS---QGIR----DDLG | WYQQKPGK APKRLII | A------ASSLQS | GVPSRFSGSGSG-TEFTLTISSLQPEDFATYYC | LQHYS------YPRT | FGQGT KVEIK |
| iPS:468 858 | 21-225_148C9 | VK1|A30/ JK1 | DIQMTQSPSSLSA SVGDRVTITC | RAS---RGIR----DDLG | WYQQKPGK APKRLII | A------ASSLQS | GVPSRFSGSGSG-TEFTLTISSLQPEDFATYYC | LQHYS------YPRT | FGQGT KVEIK |
| iPS:468 860 | 21-225_224E7 | VK1|A30/ JK1 | DIQMTQSPSSLSA SVGDRVTITC | RAS---QGIR----NDLG | WYQQKPGK APTRLIY | A------ASSLQS | GVPSRFSGSGSG-TEFTLTISSLQPEDFATYYC | LQHYS------YPRT | FGQGT KVEIT |
| iPS:433 919 | 21-225_44B3 | VK1|A30/ JK1 | DIQMTQSPSSLSA SVGDRVTITC | RAS---QGIR----NDLG | WYQQKPGK APKRLII | A------ASSLQS | GVPSRFSGSGSG-TEFTLTISSLQPEDFATYYC | LLHYN------YPRT | FGQGT KVEIK |
| iPS:433 923 | 21-225_44D3 | VK1|A30/ JK1 | DIQMTQSPSSLSA SVGDRVTFTC | RAS---QGIR----DDLG | WYQQKPGK APKRLII | A------ASSLQS | GVPSRFSGSGSG-REPTLTISSLQPEDFATYYC | LQHYS------YPRT | FGQGT KVEIK |
| iPS:433 929 | 21-225_44D5 | VK1|A30/ JK1 | DIQMTQSPSSLSA SVGDRVTITC | RAS---QGIR----DDLG | WYQQKPGK APKRLII | A------ASTLES | GVPSRFSGSGSG-TEFTLTISSLQPEDFATYYC | LQHYS------YPRT | FGQGT KVEIK |
| iPS:433 935 | 21-225_44F9 | VK1|A30/ JK1 | DIQMTQSPSSLSA SVGDRVTITC | RAS---QGIR----KDLG | WYQQKPGK APKRLII | A------ASSLQS | GVPSRFSGSGSG-TEFTLTISSLQPEDFATYYC | LQHYS------FPWT | FGQGT KVEIK |
| iPS:433 939 | 21-225_44C10 | VK1|A30/ JK1 | DVQMTQSPSSLSA SVGDRVTITC | RAS---QGIR----NDLG | WYQQKPGK APKRLII | A------ASSLQS | GVPSRFSGSGSG-TEFTLTISSLQPEDFATYYC | LHHYN------YPRT | FGQGT KVEIK |
| iPS:433 951 | 21-225_45B4 | VK1|A30/ JK1 | DIQMTQSPSSLSA SVGDRVTFTC | RAS---QGIR----DDLG | WYQQKPGK APKRLII | A------TSSLQS | GVPSRFSGSGSG-TEFTLTISSLQPEDFATYYC | LQHYS------YPRT | FGQGT KVEIK |
| iPS:433 955 | 21-225_45B8 | VK1|A30/ JK1 | DIQMTQSPSSLSA SVGDRVTFTC | RAS---QDIR----DDLG | WYQQKPGK APKRLII | A------ASSLQS | GVPSRFSGSGSG-TEFTLTISSLQPEDFATYYC | LQHYN------YPRT | FGQGT KVEIK |
| iPS:433 967 | 21-225_46C3 | VK1|A30/ JK1 | DIQMTQSPSSLSA SVGDRVTITC | RAS---QGIR----DDLG | WYQQKPGK APKRLII | A------ASSLQS | GVPSRFSGSGSR-TEFTLTISSLQPEDFATYYC | LQHYS------YPRT | FGQGT KVEIK |
| iPS:433 971 | 21-225_46D4 | VK1|A30/ JK1 | DIQMTQSPSSLSA SVGDRVTITC | RAS---QDIR----KDLG | WYQQKVGK APKRLII | A------ASSLES | GVPARFSGSGSG-TEFTLTISSLQPEDFATYYC | LQHYS------YPRT | FGQGT KVEIK |
| iPS:433 997 | 21-225_48C1 | VK1|A30/ JK1 | DIQMTQSPSSLSA SVGDRVTITC | RTS---QDIR----NDLG | WYQQKPGK APKRLII | R------ASSLQS | GVPARFSGSGSG-IEFTLTISSLQPEDFATYYC | LQHNF------FPWT | FGQGT KVEIK |

Figure 51 (Continued)

| ID | V/J | | | | | | | | |
|---|---|---|---|---|---|---|---|---|---|
| iPS:434_001 | VK1|A30/ JK1 | DIQMTQSPSSLSA SVGDRVTITC | RAS--RGIR----DDLG | WYQQKPGK PPKRLIY | A------- ASSLQS | GVPSRFNGSGSG------ TEFTLTISSLQSEDLATYYC | LQQYS---------- | --------YPRI | FGQGT KVEIK |
| iPS:434_009 | VK1|A30/ JK1 | DIQMTQSPSSLSA SVGDRVTIIC | RAS--QGIR----NDLG | WYQQKPGK APKRLIY | I------- ASSLQS | GVPSRFSGSGSG------ TEFTLTISSLQPEDFAIYYC | LQHNR---------- | --------YPWT | FGQGT KVEIK |
| iPS:434_047 | VK1|A30/ JK1 | DIQMTQSPSSLSA SVGDRVTIIC | RAS--QGIR----NDLG | WYQQKPGK APKRLIY | T------- ASNLQS | GVPSRFSGSGSG------ TEFTLTISSLQPEDFAIYYC | LQHNS---------- | --------YPWT | FGQGT KVEIK |
| iPS:434_067 | VK1|A30/ JK1 | DIQMTQSPSSLSA SVGDRVTIIC | RAS--QGIR----NDLG | WYQQKPGK APKRLIY | A------- ASSLQS | GVPSRFSGSGSG------ THFTLTISSLQPEDFATYYC | LQHNS---------- | --------YFWT | FGQGT KVEIK |
| iPS:434_135 | VK1|A30/ JK1 | DIQMTQSPSSLSA SVGDRVTIIC | RAS--QDIR----NILG | WYQQKPGK APKRLIY | A------- ASNLQS | GVPSRFSGSGSG------ TEFTLTISSLQPEDFATYYC | LQYNS---------- | --------YPWT | FGQGT KVEIK |
| iPS:434_197 | VK1|A30/ JK1 | DIQMTQSPSSLSA SVGDRVTIIC | RAS--QGIR----NDLG | WYQQKPGK APKRLIY | T------- ASNLQS | GVPSRFSGSGSG------ TEFTLTISSLQPEDFATYYC | LQHNS---------- | --------YPWT | FGLGT KVEIK |
| iPS:434_203 | VK1|A30/ JK1 | DIQMTQSPSSLSA SVGDRVTIIC | RAS--QGIR----KDLG | WYQQKPGK APKRLIY | A------- ASSLQS | GVPSRFSGSGSG------ TEFTLTISSLQPEDFATYYC | LQHNS---------- | --------YPWT | FGQGT KVEIK |
| iPS:434_209 | VK1|A30/ JK1 | DIQMTQSPSSLSA SVGDRITIC | RAS--QGIR----NDLG | WYQQKPGK APKRLIY | S------- ASSLQS | GVPSRFSGSGSG------ TEFTLTISSLQPEDFATYYC | LQHNS---------- | --------YPWT | FGQGT KVEIK |
| iPS:434_229 | VK1|A30/ JK1 | DIQMTQSPSSLSA SVGDRVTIIC | RAS--QGIR----KDLG | WYQQKPGK APKRLIF | A------- ASSLQS | GVPSRFSGSGSG------ TEFTLTISSLQPEDFATYYC | LQHNS---------- | --------YFWT | FGQGT KVEIK |
| iPS:434_241 | VK1|A30/ JK1 | DIQMTQSPSSLSA SVGDRVTIIC | RAS--QDIR----NDLG | WYQQKPGK APERLIY | A------- ASSLQS | GVPSRFSGSGSG------ TEFTLTISSLQPEDFATYYC | LQHNS---------- | --------FPPWT | FGQGT KVEIK |
| iPS:434_257 | VK1|A30/ JK1 | DIQMTQSPSSLSA SVGDRVTIIC | RAS--QGIR----NDLG | WYQQKPGK APKRLIY | P------- ASRLQS | GVPSRFSGSGSG------ TEFTLTISSLQPEDFATYYC | LQYNS---------- | --------YPPWT | FGGGS KVEIK |
| iPS:434_281 | VK1|A30/ JK1 | DIQMTQSPSSLSA SVGDRITIC | RAS--QGIG----NDLG | WYQQKPGK APERLIY | A------- ASSLQS | GVPSRFSGSGSG------ TEFTLTISSLQPEDFATYYC | LQHNS---------- | --------FPPWT | FGQGT KVEIK |
| iPS:434_315 | VK1|A30/ JK1 | DIQMTQSPSSLSA SVGDRVTIIC | RAS--QAIR----NDLG | WYQQKPGK APKRLIY | S------- ASSLQS | GVPSRFSGSGSG------ TEFTLTISSLQPEDFATYYC | LQHNS---------- | --------YPWT | FGQGT KVEIK |
| iPS:434_319 | VK1|A30/ JK1 | DIQMTQFPSQSA SVGDRVTIIC | RAS--QDIR----NDLG | WYQQKPGK AHKRLIY | A------- ASSCQS | GVPSRFSGTRSG------ TEFTLTISSMQREDFATYYC | LQHNS---------- | --------YFWT | FGQGT KVEIK |
| iPS:434_339 | VK1|A30/ JK1 | DIQMTQSPSRSA SVGDRVTIIC | RAS--QGIR----NDLG | WYQQKPGK APKRLIY | I------- AFRLQI | GVPSRFSGSGSG------ TEFTLTISISSMQREDFATYYC | IHHNS---------- | --------YPWT | FGQGT KVEIK |
| iPS:434_343 | VK1|A30/ JK1 | DIQMTQSPSSLSA AVGDRVTIIC | RAS--QGIR----NDLG | WYQQKPGK APFKCLIY | A------- ASSLQS | GVPSRFSGSGSG------ TEFTLTISSLQPEDFATYYC | LHHYS---------- | --------YPRT | FGQGT KVEIK |
| iPS:434_385 | VK1|A30/ JK1 | DIQMTQSPSSLSA SVGDRVTIIC | RAS--QAIR----NDLG | WYQQKPGK APKRLIY | P------- ASSLQS | GVPSRFSGSGSG------ TEFTLTISSLQPEDFATYYC | LQYNS---------- | --------YFPPWI | FGQGS KVEIK |
| iPS:434_387 | VK1|A30/ JK1 | DIQMTQFPSQSA SVGDRVTIIC | RAS--QGIR----NDLG | WYQQKPGK APKRLIY | A------- ASSLQS | GVPSRFSGSGSG------ TEFTLTISSLQPEDFATYYC | IVHNS---------- | --------YPWT | FGQGT KVEIK |
| iPS:434_441 | VK1|A30/ JK1 | DIQMTQSPSSLSA SVGDRVTIIC | RAS--QRLIF----NDLG | WYQQKPGK APQRLIF | A------- ASSCQS | GVPSRFSGSGSG------ TEFTLTISSMQREDFATYYC | IHHNS---------- | --------YPRT | FGQGT KVEIK |
| iPS:434_469 | VK1|A30/ JK1 | DIQMTQSPSSLSA SVGDRVTIIC | RAS--QGIR----NDLG | WYQQKPGK APKRLIY | A------- ASSLQS | GVPSRFSGSGSG------ TEFTLTISSLQPEDFATYYC | LQHYS---------- | --------YPRT | FGQGT KVEIK |
| iPS:435_197 | VK1|A30/ JK1 | DIQMTQSPSSLSA SVGDRVTIIC | RAS--QAIR----DDLG | WYQQKPGK APQRLIF | A------- ASSLQS | GVPSRFSGSGSG------ TEFTLTISSLQPEDFATYYC | LQHYS---------- | --------YPRI | FGRGT KVAIK |
| iPS:435_325 | VK1|A30/ JK1 | DIQMTQSPSSLSA SVGDRVTIIC | RAS--RGIR----DDLG | WYQQKPGK APKRLIY | A------- ASSLQS | GVPSRFSGSGSG------ TEFTLTISSLQPEDFATYYC | LQHYS---------- | --------YPRT | FGQGT KVEIK |
| iPS:435_393 | VK1|A30/ JK1 | DIQMTQSPSSLSA SVGDRVTIIC | RAS-------NDLG | WYQQKPGK APKRLIY | A------- ASSLQS | GVPSRFSGSGSG------ TEFTLTISSLQPEDFATYYC | LQHYS---------- | --------YPRI | FGQGT KVEIK |

Figure 51 (Continued)

| | | | | | | | | |
|---|---|---|---|---|---|---|---|---|
| iPS-435_539 | 21-225_158G1 | VK1|A30/JK1 | DIQMTQSPSSLSA SVGDRVTITC | RAS---QGIR-----NDLG | WYQQKPGK APKRLIY | T-------ASNLQS | GVPSRFSGSGSG---TEFTLTFSSLQPEDFATYYC | LQHNS--------YPWT FGQGT KVEIK |
| iPS-435_543 | 21-225_158D4 | VK1|A30/JK1 | DIQMTQSPSSLSA SVGDRVTITC | RAS---QDIR-----KDLG | WYQQKPGK APKRLIY | A-------ASSLQS | GVPSRFSGSGSG---TEFTLTISSLQPEDFATYYC | LQHYS--------YPRT FGQGT KVEIK |
| iPS-435_571 | 21-225_159C8 | VK1|A30/JK1 | DIQMTQSPSSLSA SVGDRVTITC | RAS---QDIR-----KDLG | WYQQKPGK APNRLIY | A-------ASSLQS | GVPSRFSGSGSG---TEFTLTISSLQPEDFATYYC | LQHHS--------YPRT FGQGT KVEIK |
| iPS-435_573 | 21-225_159D8 | VK1|A30/JK1 | DIQMTQSPSSLSA SVGDRVTITC | RAS---RDIG-----NDLG | WYQQKPGK APKRLIS | A-------ASSLQN | GVPSRFSGSGSG---TEFTLTFSSLQPEDFATYYC | LQHYS--------YPRT FGQGT KVEIK |
| iPS-435_581 | 21-225_160H1 | VK1|A30/JK1 | DIQMTQSPSSLSA SVGDRVTITC | RAS---QDIR-----NDLG | WYQQKPGK APKRLIY | A-------ASSLQN | GVPSRFSGSGSG---TEFTLTISSLQPEDFTTYYC | LQHNS--------FPWT FGQGT KVEIK |
| iPS-435_583 | 21-225_160F2 | VK1|A30/JK1 | DIQMTQSPSSLSA SVGDRVTITC | RAS---QGIR-----NDLG | WYQQKPGK APKRLIY | T-------ASNLQS | GVPSRFSGSGSG---TEFTLTVSSLQPEDFATYYC | LQHNS--------YPWT FGQGT KVEIK |
| iPS-435_591 | 21-225_160C4 | VK1|A30/JK1 | DIQMTQSPSSLSA SVGDRVTITC | RAS---QDIR-----KDLG | WYQQKPGK APNRLIY | A-------ASSLQS | GVPSRFSGSGSG---TEFTLTISSLQPEDFATYYC | LQHYS--------YPRT FGQGT KVEIK |
| iPS-435_615 | 21-225_161G1 | VK1|A30/JK1 | DIQMTQSPSSRSA SVGDRVTITC | RAS---QDIR-----NDLG | WYQQKPGK APKRLIY | A-------ASSLQS | GVPSRFSGSGSG---TEFTLTISSLQPEDFATYYC | LQHHS--------YPRT FGQGT KVEIK |
| iPS-435_675 | 21-225_169D7 | VK1|A30/JK1 | DIQMTQSPSSLSA SVGDRVTITC | RAS---QGIR-----NDLG | WYQQKPGK AFKRLIY | A-------ASSLQS | GVPSRFSGSGSG---TEFTLTISSLQPEDFATYYC | LQHHS--------CPWT FGQGT KVESK |
| iPS-435_681 | 21-225_169D1 | VK1|A30/JK1 | DIQMTQSPSSLSA SVGDRVTITC | RAS---QGIR-----DDLG | WYQQKPGK VPKRLIY | A-------ASSLQS | GVPSRFSGSGSG---TEFTLTISSLQPEDFATYYC | LQHYS--------YPRT FGQGT KVEIK |
| iPS-435_687 | 21-225_170H1 | VK1|A30/JK1 | DIQMTQSPSSLSA SVGDRVTITC | RAS---QGIR-----NDLG | WYQQKPGK APKRLIY | A-------TSSLQS | GVPSRFSGSGSG---TEFTLTISSLQPEDFATYYC | LQHSS--------NPWT FGQGT KVESK |
| iPS-435_689 | 21-225_170F3 | VK1|A30/JK1 | DIQMTQSPSSLSA SVRDRVTITC | RAS---RGIR-----NDLG | WYQQKPGK APKRLIH | A-------ASSLQS | GVPSRFSGSGSG---TEFTLTISSLQPEDFATYYC | LQHYS--------YPRT FGQGT KVEIK |
| iPS-435_741 | 21-225_174G10 | VK1|A30/JK1 | DIQMTQSPSSLSA SVGDRVTITC | RAS---QGIR-----DDLG | WYQQKPGK VPKRLIY | A-------ASSLQS | GVPSRFSGSGSG---TEFTLTISSLQPEDFATYYC | LQHNN--------YPRT FGQGT KVEIK |
| iPS-435_831 | 21-225_190C12 | VK1|A30/JK1 | DIQMTQSPSSLSA SVGDRVTITC | RAS---QGIR-----NDLG | WSQQNPGK AFKRLIH | T-------ASSLQN | GVPSRFSGSGSG---TEFTLTISSLQPEDFATYYC | LQHTS--------YPWT FGQGT KVEIY |
| iPS-435_857 | 21-225_191A4 | VK1|A30/JK1 | DIQMTQSPSSLSA SVGDRVTITC | RAS---QGIR-----KDLG | WYQQKPGK APKRLIH | T-------ASSLQS | GVPLRFSGSGSG---TEFTLTISSLQPEDFATYYC | LQHNS--------YPWT FGQGT KVEIK |
| iPS-435_907 | 21-225_190G3 | VK1|A30/JK1 | DIQMTQSPSSLSA SVGDRVTITC | RAS---QGIR-----KDLG | WYQQKPGK APKRLIY | T-------ASSLQS | GVPLRFSGSGSG---TEFTLTISSLQPEDFATYYC | LQHYS--------YPWT FGQGT KVEIK |
| iPS-435_919 | 21-225_190H5 | VK1|A30/JK1 | DIQMTQSPSSLSA SVGDRVTITC | RAS---QGIR-----KDLG | WYQQKPGK APKRLIH | T-------ASSLQS | GVPLRFSGSGSG---TEFTLTISSLQPEDFATYYC | LQHNS--------YPWT FGQGT KVEIK |
| iPS-435_989 | 21-225_192F7 | VK1|A30/JK1 | DIQMTQSPSSLSA SVGDRVTITC | RAT---QGIR-----KDLG | WYQQKPGK APKRLIY | T-------ASSLQS | GVPLRFSGSGSG---TEFTLTISSLQPEDFATYYC | LQHTS--------YPWT FGQGT KVEIY |
| iPS-436_132 | 21-225_196C12 | VK1|A30/JK1 | DIQMTLSPSSLFA CVGDRVTITC | RAS---QGIR-----HDLG | WSQQNPGK ALKRLIY | A-------ASSLQS | GVPSRFSGSGSG---TEFTLTISSLQPEDFETYYC | LQHND--------FPFT FGRGT KVEIK |
| iPS-436_222 | 21-225_200C9 | VK1|A30/JK1 | DIQMTQSPSSLSA SVGDRVTITC | RAS---QGIR-----NDLG | WYQQKPGK APKRLIY | A-------ASSLQS | GVPSRFSGSGSG---TEFTLTISSLQPEDFATYYC | LQHNS--------YPWT FGQGT KVEIK |
| iPS-436_264 | 21-225_203F7 | VK1|A30/JK1 | DIQMTQSPSSRFA SVGDRVTITC | RAS-----------HDLG | WYQQKPGK ALKRLIY | A-------ASSLQS | GVPSRFSGSGCG---TEFTITISSVQPEDFANYYC | LQHYS--------FPRT FGQGT KVEIK |

Figure 51 (Continued)

| ID | V/J | Seq1 | Seq2 | Seq3 | Seq4 | Seq5 | Seq6 | Seq7 | Seq8 |
|---|---|---|---|---|---|---|---|---|---|
| iPS:436_274 | 21-225_204H3 | VK1|A30/JK1 | DIQMTQSPSSLSA SVGDRVTITC | RAS--QGIR------NDLG | WYQQKPGK APELLIY | A------AASLQG | GVPSRFSGSGSG------ TEFLTISSLQPEDFATYYC | LQHYS------- ---------YPRT | FGQGT KVEIQ |
| iPS:436_332 | 21-225_208B2 | VK1|A30/JK1 | DIQMTQSPSSLSA SVGDRVTITC | RAS--QGIR------HDLG | WYQQKPGK AFKRLIY | A------ASSLQS | GVPSGFSGSGSG------ TEFLTISSLQPEDFATYYC | LQHYS------- ---------YPRT | FGQGT KVEIK |
| iPS:436_352 | 21-225_210G5 | VK1|A30/JK1 | DIQMTQSPSSLSA SVGDRVTITC | RAS--QGIR------HDLG | WYQQKPGK APKRLIY | A------ASSLQS | GVPSGFSGSGSG------ TEFLTISSLQPEDFATYYC | LHHYS------- ---------YPRT | FGQGT KVEIK |
| iPS:436_386 | 21-225_212B1 | VK1|A30/JK1 | DIQMTQSPSSLPA SVGDRVTITC | RAS--QGIR------NDLG | WYQQKPGK APKRLIY | A------ASSLQS | GVPSRFSGSGSG------ TEFLTISSLQPEDFATYYC | LLHYS------- ---------YPRT | FGQGT KVEIK |
| iPS:436_412 | 21-225_214H9 | VK1|A30/JK1 | DIQMTQSPSSLSA SVGDRVTITC | RAS--QGIR------NDLG | WYQQKPGK APKRLIY | A------ASSLQS | GVPSRFSGSGSG------ TEFLTISSLQPEDFATYYC | LQHYS------- ---------YPRT | FGQGT KVEIK |
| iPS:436_414 | 21-225_214G1 | VK1|A30/JK1 | DIQMTLCPSSPPA SVGDRVTITC | RAS--QGIR------NDLG | WYQQKPGK APKRLIY | A------ASSLQS | GVPSRFSGSGSG------ TEFLTISSLQPEDFATYYC | LLHNS------- ---------YPRT | FGQGT KVEIK |
| iPS:436_416 | 21-225_214G10 | VK1|A30/JK1 | DIQMTQSPSSPPA SVGDRVTITC | RAS--QGIR------NDLG | WYQQKPGK APKRLIY | A------ASSLQS | GVPSRFSGSGSG------ TEFLTISSLQPEDFATYYC | VMHYS------- ---------YPRT | FGQGT KVEIK |
| iPS:436_418 | 21-225_215E3 | VK1|A30/JK1 | DIQMTQSPSSPPA SVGDRVTITC | RAS--QGIR------NDLG | WYQQKPGK APKRLIY | A------ASSLQS | GVPSRFSGSGSG------ TEFLTISSLQPEDFATYYC | VMHNS------- ---------YPRT | FGQGT KVEIK |
| iPS:436_428 | 21-225_215E1 | VK1|A30/JK1 | DIQMTQCFSSPPA SVGDRVTITC | RAS--QGIR------NDLG | WYQQKPGK AFKRLIY | A------ASSLQS | GVPSRFSGSGSG------ TEFLTISSLQREDFATYYC | VMHYS------- ---------YPRT | FGQGT KVEIK |
| iPS:436_438 | 21-225_216E8 | VK1|A30/JK1 | DIQMTQSPSSLPA SVGDRVTITC | RAS--QGIR------NDLG | WYQQKPGK APKRLIY | A------ASSLQS | GVPSRFSGSGSG------ TEFLTISSLQPEDFATYYC | LMHYS------- ---------YPRT | FGQGT KVEIK |
| iPS:436_440 | 21-225_216H1 | VK1|A30/JK1 | DIQMTQSPSSPPA SVGDRVTITC | RAS--QGIR------NDLG | WYQQKPGK APKRLIY | G------ASSLQS | GVPSRFSGSGSG------ TEFLTISSLQPEDFATYYC | VMHNS------- ---------YPRT | FGQGT KVEIK |
| iPS:436_450 | 21-225_217E5 | VK1|A30/JK1 | DIQMTQCFSSPPA FVGDRVTITC | RAS--QGIR------NDLG | WYQQKPGK APKRLIC | A------ASSLQS | GVPSRFSGSGSG------ TEFLTISSLQREDFATYYC | VMHNS------- ---------YPRT | FGQGT KVEIK |
| iPS:436_456 | 21-225_217G1 | VK1|A30/JK1 | DIQMTQSPSSPPA SVGDRVTITC | RAS--QGIR------NDLG | WYQQKPGK APKRLIY | A------ASSLQS | GVPSRFSGSGSG------ TEFLTISSLQPEDFATYYC | VMHNS------- ---------YPRT | FGQGT KVEIK |
| iPS:436_458 | 21-225_217H1 | VK1|A30/JK1 | DIQMTQSPSSLSA SVGDRVTITC | RAS--QGIR------NDLG | WYQQKPGK APKRLIY | A------ASSLQS | GVPSRFSGSGSG------ TEFLTISSLQPEDFATYYC | LMHYS------- ---------YPRT | FGQGT KVEIK |
| iPS:436_462 | 21-225_218C4 | VK1|A30/JK1 | DIQMTQCFSSPPA FVGDRVTITC | RAS--QGIR------NDLG | WYQQKPGK APKRLIY | A------ASSLQS | GVPSRFSGSGSG------ TEFLTISSVQREDFATYYC | VMHYS------- ---------YPRT | FGQGT KVEIK |
| iPS:436_480 | 21-225_220F8 | VK1|A30/JK1 | DIQMILFSSPPA FVGDRVTITC | RAS--QGIR------NDLG | WYQQKPGK AFKRLIC | G------ASSLQS | GVPSRFSGSGSG------ TEFLTISSLQREDFATYYC | VMHNS------- ---------YPRT | FGQGT KVEIK |
| iPS:436_534 | 21-225_224F1 | VK1|A30/JK1 | AIQMTQSPSSLSA SVGDRVTITC | RAS--QGIR------DDLG | WYQQKPGK APKRLIY | A------ASSLQS | GVPSRISGSGSG------ TEFLTISSLQPEDFATYYC | LQHYS------- ---------YPRT | FGQGT KVEIK |
| iPS:436_540 | 21-225_224F3 | VK1|A30/JK1 | DIQMTQSPSSLSA SVGDRVTITC | RAS--QGIR------NDLG | WYQQKPGK APERLIY | A------ASSLQS | GVPSRFSGSGSG------ TEFLTISSLQPEDFATYYC | LQHYN------- ---------YPRA | FGQGT KVEIK |
| iPS:436_564 | 21-225_225A1 | VK1|A30/JK1 | DIQMTQSPSSLSA SVGDRVTITC | RAS--QGIPG-----RLIY | WYQQIPGK APKRLIY | A------ASSLQS | GVPSRFSGSGSG------ TEFLTISSLQPEDFATYYC | LQHYS------- ---------YPRT | FGQGT KVEIK |
| iPS:436_596 | 21-225_226C6 | VK1|A30/JK1 | DIQMTQSPSSLSA SIGDRVTITC | RAS--QGIR------NDLG | WYQQKPGK APKRLIY | A------ASSLQS | GLPSRFSGSGSG------ TEFLTISNLQPEDFATYYC | LQHYN------- ---------YPRA | FGQGT KVEIQ |

Figure 51 (Continued)

| | | | | | | | | | |
|---|---|---|---|---|---|---|---|---|---|
| iPS:436 604 | 21-225_226F7 | VK1|A30/ JK1 | DIQMTQSPSSLSA SVGDRVTITC | RAS---QGIG--- ----NDLG | WYQQKPGK APKRLIY | A------ ASSLQS | GVPSRF SGSVSG--- TEFTLTISSLQPEDFATYYC | LHHYS----------- ---------YPRT | FGQGT KVEIK |
| iPS:436 620 | 21-225_226H1 | VK1|A30/ JK1 | DIQMTQSPSSLSA SVGDRVTITC | RTS---QGIR--- ----NDLG | WYQQKPGK APKRLIY | A------ ASSLQS | GVPSRF SGSGSG--- TDFTLTISSLQPEDFATYYC | LQHYS----------- ---------YPPWT | FGQGT KVDIK |
| iPS:437 262 | 21-225_170E4 | VK1|A30/ JK1 | DIQMTQSPSSLSA SVGDRVTITC | RAS---QGIR--- ----NDLG | YYQQKPGK APKRLIY | V------ ASGLQS | GVPSRF SGSGSG--- TEFTLTISSLQPEDFATYYC | LQHNS----------- ---------YPPWT | FGQGT KVDIK |
| iPS:437 280 | 21-225_203C1 | VK1|A30/ JK1 | DIQMTQSPSSLSA SVGDRVTITC | RAS---QDIR--- ----NDLG | WYQQKPAK APKRLIY | R------ ASSLQS | GVPSRF SGSGSG--- TEFTLTISSLQPEDFAAYYC | LQHNS----------- ---------YFRT | FGQGT KVEIK |
| iPS:437 286 | 21-225_208F1 | VK1|A30/ JK1 | DIQMTQSPSSLSA SVGDRVTITC | RAS---QGIR--- ----HDLG | WYQQKPGK APKRLIF | A------ ASSLQS | GVPSRF SGSGSG--- TEFLTITSSLQPEDFATYYC | LQHYS----------- ---------FPRT | FGQGT KVEIK |
| iPS:437 290 | 21-225_210G6 | VK1|A30/ JK1 | DIQMTQSPSSRFA FVGDRVTITC | RAS---QGIR--- ----HDLG | WYQQKPGK ALKRLIY | A------ ASSSQS | GVPSRF SGSGSG--- TEFTLTISSVQREDFATYYC | VQHYS----------- ---------FPRT | FGQGT KVEIK |
| iPS:451 114 | 21-225_159A3 | VK1|A30/ JK1 | DIQMTQSPSSLSA SVGDRVTITC | RAS---QDIR--- ----KDLG | WYQQKPGK APNRLIY | A------ ASSLQS | GVPSRF SGSGSG--- TEFTLTFSSLQPEDFATYYC | LQHNS----------- ---------YFRT | FGQGT KVEIK |
| iPS:392 626 | 21-225_18A5 | VK1|A30/ JK1 | DIQMTQSPSSLSA SVGDRVTITC | RAS---QGIR--- ----NDLG | WYQQKPGK APKRLIY | A------ ASSLQS | GVPSRF SGSGSG--- TEFLTITSSLQPEDFATYYC | LQHNS----------- ---------YPWT | FGQGT KVEIK |
| iPS:392 634 | 21-225_17H3 | VK1|A30/ JK1 | DIQMTQSPSSLSA SVGDRVTITC | RAS---QGIR--- ----SDLG | WYQQKPGK APKRLIY | A------ ASSLQS | GVPSRF SGSGSG--- TEFTLTISSLQPEDFATYYC | LQQYS----------- ---------YPRT | FGQGT KVEIK |
| iPS:392 674 | 21-225_18C2 | VK1|A30/ JK1 | DIQMTQSPSSLSA SVGDRVTITC | RAS---QGIR--- ----HDLG | WYQQKPGK APKRLIY | T------ ASSLQS | GVPSRF SGSGFG--- TEFTLTISSLQPEDFATYYC | LQHNS----------- ---------YFWT | FGLGT KVVIK |
| iPS:392 686 | 21-225_17C7 | VK1|A30/ JK1 | DIQMTQSPSSLSA SVGDRVTITC | RAS---QGIR--- ----QDLG | WYQQKPGK APKRLIY | A------ ASSLQS | GVPSRF SGSGSG--- TEFTLTISSLQPEDFATYYC | LQHNS----------- ---------YPWT | FGQGT KVDIK |
| iPS:392 690 | 21-225_18F2 | VK1|A30/ JK1 | DIQMTQSPSSLSA SVGDRVTITC | RAS---QGIR--- ----NDLG | WYQQKPGK APKRLIY | A------ ASSLQS | GVPSRF SGSGSG--- TEFTLTISRLQPEDFATYYC | LQHNS----------- ---------YPWT | FGLGT KVVIK |
| iPS:392 710 | 21-225_19A10 | VK1|A30/ JK1 | DIQMTQSPSSLSA SVGDRVTITC | RAS---QGIR--- ----TDLG | WYQQRPGK ARKRLIY | T------ AYSLQS | GVPSRF SGSGSG--- TEFTLTISSLQPEDFATYYC | LQHNG----------- ---------YFWT | FGQGT KVEIK |
| iPS:392 740 | 21-225_18H12 | VK1|A30/ JK1 | DIQMTQSPSSLSA SVGDRVTITC | RAS---QGIR--- ----NDLG | WYQQKPGK APKRLIY | A------ ASNLQS | GVPSRF SGSGSG--- TEFTLTISSLQPEDFATYYC | ---------------- ---------YPWT | FGLGT KVVIK |
| iPS:392 742 | 21-225_20B2 | VK1|A30/ JK1 | DIQMTQSPSSLSA SVGDRVNITC | RAS---QGIR--- ----NDLG | WYQQKPGK APKRLIY | A------ ASSLQS | GVPSRF SGSGSG--- TEFTLTISSLQPEDFATYYC | LQHYN----------- ---------YPRA | FGQGT KVDIK |
| iPS:392 758 | 21-225_21G11 | VK1|A30/ JK1 | DIQMTQSPSSLSA SVGDRVTITC | RAS---QGIR--- ----NDLG | WYQQKPGK APKRLIY | T------ ASSLQS | GVPSRF SGSGSG--- TEFTLTISSLQPEDFATYYC | LQHNN----------- ---------YPWT | FGLGT KVVIK |
| iPS:392 790 | 21-225_20D10 | VK1|A30/ JK1 | DIQMTQSPSSLSA SVGDRVTITC | RAS---QGIR--- ----NDLG | WYQQKPGK APKRLIY | V------ ASSLQS | GVPSRF SGSGYG--- TEFTLTISSLQPEDFATYYC | IQQNS----------- ---------YPWT | FGQGT KVEIK |
| iPS:392 796 | 21-225_22A4 | VK1|A30/ JK1 | DIQMTQSPSSLSA SVGDRVTITC | RAS---QGIR--- ----NDLG | WYQQKPGK APKRLIY | A------ ASSLQS | GVPSRF SGSGSG--- TEFTLTISSLQPEDFATYYC | LQHNS----------- ---------YFWT | FGQGT KVEIK |
| iPS:392 832 | 21-225_21H8 | VK1|A30/ JK1 | DIQMTQSPSSLSA SVGDRVTITC | RAS---QGIR--- ----NDLG | WYQQKPGK APKRLIY | T------ ASSLQS | GVPSRF NGSGSG--- TEFTLTISSLQPEDFATYYC | LQHYN----------- ---------YPWT | FGQGT KVDIK |
| iPS:392 836 | 21-225_22F4 | VK1|A30/ JK1 | DIQMTQSPSSLSA SVGDRVTITC | RAS---QVIR--- ----DDLG | WYQQKPGK APKRLIY | A------ ASSLQS | GVPSRF SGSRSG--- TDFTLTISSLQPEDFATYYC | LHHYS----------- ---------YPRT | FGQGT KVEIK |
| iPS:392 844 | 21-225_23E11 | VK1|A30/ JK1 | DIQMTQSPSSLSA SVGDRITITC | RAS---QDIR--- ----NDLG | WYQQKPGK APKRLIY | P------ ASSLQS | GVPSRF SGSGSG--- TEFTLTISSLQTEDFATYYC | LQHNS----------- ---------YPWT | FGQGT KVEIK |
| iPS:392 846 | 21-225_24B6 | VK1|A30/ JK1 | DIQMTQSPSSLSA SVGDRVTITC | RAS---QDIR--- ----NDLG | WYQQKPGK APFRLIY | A------ ASSLHS | GVPSRF SGSGSG--- TEFLTITSSLQPEDFATYYC | LQHYS----------- ---------YPRT | FGQGT KVEVK |

Figure 51 (Continued)

| ID | V/J | Seq1 | Seq2 | Seq3 | Seq4 | Seq5 | Seq6 | Seq7 | Seq8 |
|---|---|---|---|---|---|---|---|---|---|
| PS:392872 | 21-225_20B11 | VK1[A30]/JK1 | DIQMTQSPSSLSA SVGDRVTIITC | RAS--QGIG------NDLG | WYQQKPEK APKRLIY | A------- ASSLHS | GVPSRFSGSGSG-- TEFTLTISSLQPEDFATYYC | LQHYS------- | ------YPRT | FGQGT KVEIK |
| PS:392876 | 21-225_21F7 | VK1[A30]/JK1 | DIQMTQSPSSLSA SVGDRVTIITC | RAS--QDIR------NDLG | WYQQKPGK APKRLIY | A------- ASNFQS | GVPSRFSGSGSG-- TEFTLTIGSLQPEDFATYYC | LQHNN------- | ------YPWT | FGGGT KVEIK |
| PS:392884 | 21-225_23A10 | VK1[A30]/JK1 | DIQMTQSPSSLSA SVGDRVTIITC | RAS--QGIR------NDLG | WYQQKPGK APKRLIY | A------- ASSLQS | GVPSRFSGSGSG-- TEFTLTIGSLQPEDFATYYC | LQHYS------- | ------YPRT | FGLGT KVEIK |
| PS:392894 | 21-225_21G2 | VK1[A30]/JK1 | DIQMTQSPSSLSA SVGDRVTIITC | RAS--QGIR------NDLG | WYQQKPGK APKRLIY | T------- SSSLQS | GVPSRFSGSGSG-- TEFTLTIGSLQPEDFATYYC | LQHNS------- | ------YPWT | FGGGT KVVIK |
| PS:392908 | 21-225_23F12 | VK1[A30]/JK1 | DIQMTQSPSSLSA SVGDRVTIITC | RAS--QGIR------NDLG | WYQQKPGK APKRLIY | V------- ASSLQS | GVPSRFSGSGSG-- TEFTLTISSLQPEDFASYYC | LQHYS------- | ------YPWT | FGQGT KVEIK |
| PS:392914 | 21-225_25D12 | VK1[A30]/JK1 | DIQMTQSPSSLSA SVGDRVTIITC | RTS--QGIR------NDLG | WYQQKPGK APKRLIY | A------- ASSLQS | GVPSRFSGSGSG-- TEFTLTISSLQPEDFATYYC | LQHYS------- | ------FPRT | FGGGT RVEIK |
| PS:392918 | 21-225_28F5 | VK1[A30]/JK1 | DIQMTQSPSSLSA SVGDRVTIITC | RAS--QGIR------NDLG | WYQQKPGK APKRLIY | T------- ASSLQS | GVPSRFSGSGSG-- TEFTLTISSLQPEDFATYYC | LQHNT------- | ------YPWT | FGGGT KVEVK |
| PS:392958 | 21-225_28C7 | VK1[A30]/JK1 | DIQMTQSPSSLSA SVGDRVTIITC | RAS--QGIR------NDLG | WYQQKPGK APKRLIY | I------- ASSLQS | GVPSRFSGSGSG-- TEFTLTISSLQPEHFATYYC | LQHNT------- | ------YPWT | FGQGT KVEIK |
| PS:392972 | 21-225_26A2 | VK1[A30]/JK1 | DIQMTQSPSSLSA SVGDRVTIITC | RAS--QGIR------SDLG | WYQQKPGK APKRLIY | T------- ASSLQS | GVPSRFSGSGSG-- TEFTLTFSSLQPEDFATYYC | LQHNR------- | ------YPWT | FGGGT RVEIK |
| PS:393026 | 21-225_32B6 | VK1[A30]/JK1 | DIQMTQSPSSLSA SVGDRVTIITC | RAS--QGIR------NDLG | WYQQKPGK APKRLIY | A------- ASSLQS | GVPSRFSGSGSG-- TEFTLTISSLQPEDFATYYC | LQHNS------- | ------YPWT | FGQGT KVEIK |
| PS:393130 | 21-225_33C2 | VK1[A30]/JK1 | DIQMTQSPSSLSA SVGDRVTIITC | RAS--QGIR------NDLG | WYQQKPVK APKRLIY | APSLQS | GVPSRFSGSGSG-- TEFTLTISSLQPEHFATYYC | LQHNS------- | ------YPWT | FGQGT KVEIK |
| PS:393812 | 21-225_6A11 | VK1[A30]/JK1 | DIQMTQSPSSLSA SVGDRVTIITC | RAS--QGIR------NDLG | WYQQKPGK APKRLIY | A------- ASSLQS | GVPSRFSGSGYG-- TEFTLTISSLQPEDFATYYC | LQHNS------- | ------YPWT | FGGGT KVEIK |
| PS:393838 | 21-225_6G2 | VK1[A30]/JK1 | DIQMTQSPSSRSA FVGDRVTIITY | RAS--QGIR------NDLG | WYQQKPGK APQRLIY | A------- ASSLQS | GVPSRFSGSGYG-- TEFNIITSSLQPEDFATYYC | IQHNS------- | ------YLWT | FGQGT RVEIT |
| PS:393864 | 21-225_4C5 | VK1[A30]/JK1 | DIQMTQSPSSLSA SVGHRVHLTC | RAS--RGIR------GDLG | WYRQKPGK APKRLIY | A------- ASNLQS | GVPSRFSGSGSG-- TEFTLTIGSLQPEDFATYYC | LQHYS------- | ------YPRT | FGGGT KVEIK |
| PS:393868 | 21-225_9C11 | VK1[A30]/JK1 | DIQMTQSPSSLSA SVGDRVTIITC | RAS--QNIR------NYLN | WYQQKSGR APKLLIY | V------- ASSLQS | GVPSRFSGSGSG-- TEFTLTINSLQPEDFATYYC | HQSNS------- | ------TPLT | FGGGT KVEIK |
| PS:393876 | 21-225_9A1 | VK1[A30]/JK1 | DIQMTQSPSSRSA SVGDRVTIITC | RAS--QGIR------NDLG | WYQQKPGK ARKRLIY | A------- ASSLQS | GVPSRFSGSGSG-- TEFTLTISSLQPEDFATYYC | LQHNS------- | ------YLWT | FGGGT KVEIK |
| PS:393902 | 21-225_14E10 | VK1[A30]/JK1 | DIQMTQSPSSLSA SVGDRVTIITC | RTS--QGIR------NDLG | WYQHKPGQ APKRLIY | A------- ASSLQS | GVPSRFSGSGSG-- TEFTLTISSLQPEDFTAYYC | LQHYS------- | ------YPWT | FGQGT KVEIK |
| PS:393908 | 21-225_10E9 | VK1[A30]/JK1 | DIQMTQSPSSLSA SVGDRVTFTC | RAS--QDIR------SDLG | WYQQKPGK APTRLIF | A------- ASSLQS | GVPSRFSGSGSG-- TEFTLTINSLQPEDLATYYC | LQHNS------- | ------YPRT | FGGGT KVEIK |
| PS:393916 | 21-225_2G4 | VK1[A30]/JK1 | DIQMTQSPSSRSA SVGDRVTIITC | RAS--QGIR------NDLG | WYQQKPGK APTRLIY | A------- ASSLHS | GVPSRFSGSGSG-- TEFTLTISSLQPEDFATYYC | LQHYS------- | ------FPRT | FGGGT KVEIK |
| PS:393948 | 21-225_16A5 | VK1[A30]/JK1 | DIQMTQSPSSLSA SVGDRVTIITC | RAS--QGIR------NDLG | CYQQKPGK APKRLIY | A------- ASSLQS | GVPSRFSGNGYG-- TEFTLTISSLQPEDFATYYC | LQHNS------- | ------YPWT | FGQGT KVEIK |
| PS:393960 | 21-225_7G2 | VK1[A30]/JK1 | DIQMTQSPSSLSA SVGDRVTIITC | RAS--QGIR------NDLG | WYQQKPGK APKRLIY | T------- ASSLQS | GVPSRFSGSGSG-- TEFTLTISSLQPEDFATYYC | LQHNS------- | ------YPWT | FGLGT KVVIK |
| PS:393966 | 21-225_7F8 | VK1[A30]/JK1 | DIQMTQSPSSLSA SVGDRVHLTC | RAS--QGIR------NDLG | WYQQKPGK APKRLIY | A------- ASSLQS | GVPSRFSGSVSG-- TEFTLPSSLQPEDFATYYC | LQHYT------- | ------YPRT | FGQGT KVEIK |
| PS:393972 | 21-225_7C9 | VK1[A30]/JK1 | DIQMTQSPSSLSA SGGDRVTIIC | RAS--QGIR------NDLG | WYQQKPGK APKRLIY | A------- ASSLQS | GVPSRFSGSGSG-- TEFTLTISSLQPEDFATYYC | LQLYS------- | ------YPRT | FGGGT KVDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:393978 | 21-225_4C12 | VK1|A30/JK1 | DIQMTQSPSSLSA SVGDRVTITC | RAS---QGIR------NDLG | WYQQKPGK APTRLIY | A------ASSLHS | GVPSRFSGSGSG---TEFTLTISSLQPEDLATYYC | LQHYS---------FPRT | FGQGT KVEIK |
| iPS:393986 | 21-225_7G4 | VK1|A30/JK1 | DIQMTQSPSSLSA SVGDRVTITC | RAS---QGIR------NDLG | WYQQKRPGK APKRLIY | A------ASSLQS | GVPSRFSGSGSG---TEFTLTISSLQPEDSATYYC | LHQYS---------YPRT | FGQGT KVEIK |
| iPS:393996 | 21-225_15C11 | VK1|A30/JK1 | DIQMTQSPSSLSA SVGDRVTITC | RAS---QGIR------NDLG | WYQQKPGK VFKRLIY | A------ASSLQS | GVPSRFSGSGSG---TEFTLTISSLQPEDFATYYC | LLHYS---------YPRT | FGRGT KVEIK |
| iPS:393998 | 21-225_12B12 | VK1|A30/JK1 | DIQMTQSPSSLSA SVGDRVTITC | RAS---QGIR------NDLG | WYQQKPGK APKRLIY | T------ASSLQS | GVPSRFSGSGSG---TEFTLTISSLQPEDFATYYC | LQHNS---------YPWT | FGLGT KVVIK |
| iPS:394041 | 21-225_5E5 | VK1|A30/JK1 | DIQMTQSPSSLSA SVGDRVTITC | RAS---QGIR------NDLG | WYQQKPGK APKRLIY | A------ASSLQS | GVPSRFSGSGSG---TEFTLTISSLQPEDFATYYC | LQHYS---------YPRT | FGQGT KVEIK |
| iPS:394067 | 21-225_12F2 | VK1|A30/JK1 | DIQMTQSPSSLSA SVGDRVTITC | RAS---QGIR------NDLG | WYQQKPGK APKRLIY | A------ASSLQS | GVPSRFSGSGSG---TEFTLTISSLQPEDFVTYYC | LQHNS---------YPWT | FGQGT RVEIK |
| iPS:394089 | 21-225_12E6 | VK1|A30/JK1 | DIQMTQSPSSLSA SVGDRVTITC | RAS---QGIR------SDLG | WYQQKPGK APKRLIY | A------ASSLQS | GVPSRFSGSGSG---TEFTLTISSLQPEDFATYYC | LQHNS---------YPWT | FGQGT KVEIK |
| iPS:394093 | 21-225_9D12 | VK1|A30/JK1 | DIQMTQSPSSLSA SVGDRVTITC | RAS---QGIR------NDLG | WYQQKPGK APKRLIY | A------ASSLQS | GVPSRFSGSGSG---TEFTLTISSLQPEDFATYYC | LQHNS---------YPWT | FGQGT KVEIK |
| iPS:394095 | 21-225_16H4 | VK1|A30/JK1 | DIQMTQSPSSLSA SVGDRVTITC | RAS---QGIR------NDLG | WYQQKPGK APKRLIY | T------ASSLQS | GVPSRFSGSGSG---TEFTLTISSLQPEDFATYYC | LQHNS---------YPWT | FGQGT RVEIK |
| iPS:394097 | 21-225_16G7 | VK1|A30/JK1 | DIQMTQSPSSLSA SVGDRVTITC | RAS---QGIR------NDLG | WYQQKPGK APKRLIY | A------ASSLQS | GVPSRFSGSGSG---TEFTLTISSLQPEDFATYYC | LQHNS---------YPWT | FGQGT KVEIK |
| VK3|L2|JK2 | Germline | | | | | | | | |
| iPS:468828 | 21-225_162A1 | VK3|L2|JK2 | EIVMTQSPATLSV SPGERATLSC | RAS---QTVN------SNLA | WYQQKSGQ APRLLIF | G------ASTRAT | VIPARINGSGSG---TEFTLTISSLRSEDFAVYPC | QQYND---------WPCS | FGQGT KLEIK |
| iPS:434255 | 21-225_62E6 | VK3|L2|JK2 | EIVMTQSPATLSV SPGERATLSC | RAS---QSVN------SNLA | WYQQKPGQ APRLLIS | V------ASTRAT | GIPARFSGSGSG---TEFTLTISSLQSEDFAVYYC | QQYND---------WPCS | FGQGT KLEIK |
| iPS:434269 | 21-225_57H3 | VK3|L2|JK2 | EIVMTQSPATLSV SPGERATLSC | RAS---QSVS------SSLA | WYQQKPGQ APKRLIY | G------ASTRAT | GFPARFNGSGSG---TEFTLTISSLQSEDFAIYYC | QQYND---------WPCS | FGQGT KLEIK |
| iPS:434363 | 21-225_65A6 | VK3|L2|JK2 | EIVMTQSPVTLFV SPGERATLSC | RAS---QSVN------SNLA | WYQQKPGQ APRLLIY | G------ASTRAT | GIPARFSGSGSG---TEFTLTISSLQSEDFAVYYC | QQYND---------WPCS | FGLGT KLEIK |
| iPS:434393 | 21-225_67C3 | VK3|L2|JK2 | EIVMTQSPATLSV SPGERATLSC | RAS---QSVN------SNLA | WYQQKPGQ APRLLIY | I------ASTRAT | GIPARFSGSGSG---TEFTLTISSLQSEDFAVYYC | QQYND---------WPCS | FGQGT KLEIK |
| iPS:434425 | 21-225_70A5 | VK3|L2|JK2 | EIVMTQSPATFSV SPGERATLSC | RAS---QSVN------SNLA | WYQLKPGQ APRLLIS | G------ASTRAT | GIPPRFSGSGSG---TEFTLTISSLQSEDFAVYYC | QQYND---------WPCS | FGQGT KLEIK |
| iPS:434485 | 21-225_76D2 | VK3|L2|JK2 | EIVMTQSPATLSV SPGERATLSC | RAS---VSVV------NSLA | WYQQKPGQ APRLLIH | G------ASTRAT | GIPARFSGSGSG---TEFTLTISSVQSEDFAVYYC | QQYND---------WPCS | FGQGT KLEIK |
| iPS:434537 | 21-225_74E11 | VK3|L2|JK2 | EIVMTQSPATLSV SPGERATLSC | RAS---LSVV------NSLA | WYQQKPGQ APRLLIY | G------ASTRAT | GIPARFSGSGSG---TEFTLTISSLQSEDFAVYYC | QQYND---------WPCS | FGLET KLEIK |
| iPS:434569 | 21-225_77H5 | VK3|L2|JK2 | EIVMTQSPVTLSV SPGERATLSC | RAS---QSVS------SSLA | WYQQKPGL APRLLIY | G------ASTRAT | GIPARFSGSGSG---TEFSFTISSLQSEDFAVYFC | QQYND---------WPCS | FGQGT KLEIK |
| iPS:434629 | 21-225_74C3 | VK3|L2|JK2 | EIVMTQSPATLSL SPGERATLSC | RAS---QSVA------SSLA | WYQQKPGQ APRLLIF | G------TSTRAT | GIPARFSGSGSG---TEFTLTISSLQSEDFAVYYC | QQYND---------WPCS | FGQGS KLEIQ |
| iPS:434673 | 21-225_74E3 | VK3|L2|JK2 | EIVMTQSPATLSL SPGERATLSC | RAS---LSVV------NSLA | WYQQKPGQ APRLLIY | G------ASTRAT | GIPARFSGSGSG---TEFTLTISSLQSEDFAIYYC | QQYND---------WPCS | FGQGT KLEIK |

Figure 51 (Continued)

| ID | Name | Type | K_FR1 | K_CDR1 | K_FR2 | K_CDR2 | K_FR3 | K_CDR3 | K_FR4 |
|---|---|---|---|---|---|---|---|---|---|
| iPS:435 109 | 21-225_92H5 | VK3|L2/J K2 | EIVMTQSPATLSV SPGERATLSC | RAS--QDVI------TYLA | WYQQKPGQ APRLLIY | G-------ASTRAT | GVPARFSGSGSG------ TEFTLTITSSLQSEDFALYYC | QEYND-----------WPCS | FGQGT KLEIK |
| iPS:435 221 | 21-225_95G2 | VK3|L2/J K2 | EIVMTQSPATLSL SPGERATLSC | RAS--MSVV-----NSLA | WYQQKPGQ APRLLIF | G-------ASTRAT | GIPARFSGSGSG------ TEFLTITISSLQSEDFAIYYC | QQYND-----------WPCS | FGQGT KLELK |
| iPS:436 051 | 21-225_193G1 2 | VK3|L2/J K2 | EIVMTQSPATLSV SPGERATLSC | RAS--QSVS-----SSLA | WYQQKPGQ APRILIS | G-------ASTRAT | GIPARFSGSGSG------ TEFTLTIYSSLQSADFAVYYC | QQYNN-----------WPCS | FGQGT KLEIK |
| iPS:436 236 | 21-225_201F7 | VK3|L2/J K2 | EIVMTQSPATLSV SPGERATLSC | RAS--QNIK-----NNLA | WYQQKPGQ APRLLIF | G-------ASTRAT | TEFTLTITSSLQSEDFAVYYC | QQFYN-----------WLCS | FGQGT KLELK |
| iPS:436 250 | 21-225_201A4 | VK3|L2/J K2 | EIVMTQSPATLSV SPGESATLSC | RSS--QNIK-----SNLA | WYQQKPGQ APRLLIF | G-------ASTRAT | GIPARFSGSGSG------ TEFLTITISSLQSEDFAVYYC | QQFYN-----------WLCS | FGQGT KLELK |
| iPS:436 252 | 21-225_202A8 | VK3|L2/J K2 | EIVMTQSPATLSV SPGERATLSC | RAS--QRIN-----NNLA | WYQQNPGQ APRLLIY | G-------ASTRAT | GVPARFSGSGSG------ TEFTLTITSSLQSEDFTVYYC | QQYN-----------WLCS | FGQGT KLEIK |
| iPS:436 258 | 21-225_202F12 | VK3|L2/J K2 | EIVMTQSPATLSV SPGERATLSC | RAS--QSVL-----NNLA | WYQQKPGQ APRLLIY | G-------ASTRAT | GIPARFSGSGSG------ TEFTLTITSSLQSEDFAVYYC | QQYDN-----------WPPCS | FGQGT KLELK |
| iPS:436 278 | 21-225_201F2 | VK3|L2/J K2 | EIVMTQSPATLSV SPGERATLSC | RAS--QNIK-----SNLA | WYQQKPGQ APRLLIF | G-------ASTRAT | GIPARFSGSGSG------ TEFLTITISSLQSEDFAVYYC | QQFYN-----------WLCS | FGQGT KLELK |
| iPS:436 294 | 21-225_205G4 | VK3|L2/J K2 | EIVMTQSPATLSV SPGERATLSC | RAS--QNIK-----SNLA | WYQQKPGQ APRLLIF | G-------ASTRAT | GIPARFSGSGSG------ TEFLTITISSLQSEDFAVYYC | QQFYN-----------WLCS | FGQGT KLELK |
| iPS:436 306 | 21-225_201H4 | VK3|L2/J K2 | EIVMTQSPATLSV SPGERATLSC | RAS--QSVN-----SYLA | WYQQKPGQ APRLLIY | G-------ASIRAT | GIPARFSGSGSG------ TEFTLTITSSLQSEDFAVYYC | QEYND-----------WPCS | FGQGT NLEIK |
| iPS:436 356 | 21-225_210H1 0 | VK3|L2/J K2 | EIVMTQSPATLSV SPGERATLSC | RAS--QSVK-----SNLA | WYQQKPGQ APRLLIY | G-------ASTRAT | GIPARFSGSGSG------ TEFLTITISSLQSEDFAVYYC | QQYYN-----------WLCS | FGQGT KLEIK |
| iPS:436 382 | 21-225_212C1 0 | VK3|L2/J K2 | EIVMTQSPATLSV SPGERATLSC | RAS--QSVA-----SSLA | WYQQKPGQ APRLLIH | G-------TSTRAT | DVPARFSGSGSG------ SGFTLTITSSLQSEDFAVYSC | QQYND-----------WPCS | FGQGT KLEIK |
| iPS:436 434 | 21-225_216B1 0 | VK3|L2/J K2 | EIVMTQSPATLSV SPGERATLSC | RAS--QSVN-----NNLA | WYQQKPGQ APRLLIY | G-------ASTRAT | GIPPRFSGSGSG------ TEFLTITISSLQSEDFAVYYC | QQYNN-----------WPCS | FGQGT KLEIK |
| iPS:392 806 | 21-225_24H3 | VK3|L2/J K2 | EIVMTQSPATLSV SPGERATLSC | RAS--QSVS-----SNLA | WYQQKPGQ APRLLIY | F-------ASIRAT | GIPARFSGSGSG------ TEFLTITISSLQSEDFAVYYC | QQYNN-----------WPMCS | FGQGT NLEIK |
| | | Germline | K_FR1 | K_CDR1 | K_FR2 | K_CDR2 | K_FR3 | K_CDR3 | K_FR4 |
| | VK3|L2|J4 | | | | | | | | |
| iPS:468 830 | 21-225_191G1 1 | VK3|L2/J K4 | EIVMTQSPATLSV SPGERATLSC | RTS--QSVW-----ISVA | WYHQKPGQ APRLLIY | G-------AATRAT | GIPARFSGSGSG------ TEFLTITISSLQSEDFAVYYC | QQYNY-----------WPLT | FGGGT KVEIK |
| iPS:434 147 | 21-225_55E1 | VK3|L2/J K4 | EIVMTQSPATLSV SPGERATLSC | RAS--QSVS-----SDLA | WYQLKPGQ APRLLIY | G-------ASARAT | GIPARFSGSGSG------ TEFLTITISSLQSEDFAVYYC | QQYYN-----------WFLT | FGGGT KVEIK |
| iPS:434 621 | 21-225_74D1 | VK3|L2/J K4 | EIVMTQSPATLSV SPGERATLSC | RAS--QSVS-----RNLA | WFQQKPGQ APRLLIY | G-------ASIRY | GIPARFSGSGSG------ TEFLTIYSSLQSEDFAVYYC | QQYYN-----------WPPLT | FGGGT KVEIK |
| iPS:435 821 | 21-225_190E1 1 | VK3|L2/J K4 | EIVMTQSPATLSV SPGERATLSC | RAS--QSFR-----INLA | WYQQRPGQ APRLLIY | G-------ASTRAT | GIPARFSGSGSG------ TEFLTITISSLQSEDFAVYYC | QQYYN-----------WPMCS | FGQGT KVEIK |
| iPS:435 941 | 21-225_191E8 | VK3|L2/J K4 | EIVMTQSPATLSV SPGERATLSC | RPS--QSFS-----RNLA | WYQQKPGQ APRLLIY | G-------ASTRAT | GIPSRFSGSGSG------ TEFLTISSLESEDFAVYYC | QQYNN-----------WPLT | FGGGI KVEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:436 203 | 21-225_199A6 | VK3IL2/J K4 | DIVMTQSPATLSV SPGDRATLSC | RPS--QSFS------RNLA | WYQQKPGQ APRLLIY | G-------ASTRAT | GIPARFSGSGSG-- TEFTLTISSLECEDFAVYYC | QQYNN--------------WPLT | FGGGT KVEIK |
| iPS:437 334 | 21-225_75F11 | VK3IL2/J K4 | EIVMTQSPATLFV SPGERATLSC | RAS--QSVS------RNLA | WFQQKPGQ APRLLFY | G-------ASIRAT | GIPARFSGSGSG-- TEFTLIYSLQYEDFAVYYC | QQYNN--------------WPPLT | FGGGT KVEIK |
| iPS:448 904 | 21-225_65C12 | VK3IL2/J K4 | EIVMTQSPATLSV FPGEGATLSC | RAS--QSVS------INLA | WYQQKPGQ APRLLIY | G-------ASTRAT | GIPARFNASGSG-- TEFTLISSLQSENFAVYYC | QQYNT--------------WPLT | FGGGT KVEIK |
| | Germline | VK1IA30/JK3 | DIQMTQSPSSLSA SVGDRVTITC | RAS--QDIS------NDLG | WYQQKPGK APKRLIY | A-------ASSLQS | GVPSRFSGSGSG-- TEFTLTISSLQPEDFATYYC | LQHNS--------------YPFT | FGPGT KVDIK |
| iPS:468 832 | 21-225_76H10 | VK1IA30/JK3 | DIQMTQSPSSLSA SAGDRVTITC | RAS--QDIR------NYLG | WYQKKPGK APKRLIN | A-------ASSLQS | GVPSRFSGSGSG-- TEFTLTISSLQPEDFATFYC | LQYNS--------------YPFT | FGPGT KVDIK |
| iPS:468 836 | 21-225_198E3 | VK1IA30/JK3 | DIQMTQSPSSLSA SVGDRVTITC | RAS--QSIR------KDLG | WYQQKPGK APKRLIY | A-------ASSLQS | GVPSRFSGSGSG-- TEFTLTISSLQPEDFATYYC | LQHYR--------------YPFK | FGPGT KVDIK |
| iPS:468 844 | 21-225_48E10 | VK1IA30/JK3 | DIQMTQSPSSLSA SVGDRVTITC | RAS--QGIR------SDLG | WYQQKPGK APKRLIY | T-------ASSLQS | GVPSRFSGSGSG-- TEFTLTISSLQPEDFATYYC | LQYNS--------------YPFT | FGPGT KVDIK |
| iPS:468 846 | 21-225_53B10 | VK1IA30/JK3 | DIQMTQSPSSLSA SAGDRVTITC | RAS--QDIR------NYLG | WYQQKPGK APKRLIY | G-------ASSLQS | GVPSRFSGSGSG-- TEFTLTISSLQPEDFATFYC | LQYNS--------------YPFT | FGPGT KVDIK |
| iPS:433 895 | 21-225_43E1 | VK1IA30/JK3 | DIQMTQSPSSLSA SVGDRVTITC | RAS--QGIR------NDLG | WYQKKPGK AFKRLIN | A-------ASSLQS | GVPSRFSGSGSG-- TEFTLTVSSLQPEDFATFYC | LQHNS--------------YPFT | FGPGT KVDIK |
| iPS:433 905 | 21-225_43E5 | VK1IA30/JK3 | DIQMTQSPSSLSA SVGDRVTITC | RAS--QGIR------NDLG | WYQQKPGK APKRLIY | G-------ASNLQS | GVPSRFSGSGSG-- TEFTLTVSSLQPEDFATFYC | LQHTS--------------FPFT | FGPGT KVDIK |
| iPS:433 913 | 21-225_43H8 | VK1IA30/JK3 | DIQMTQSPSSLSA SVGDRVTITC | RAS--QGIR------NDLG | WHQQKPGK APKRLIY | A-------ASSLQS | GVPSRFSGSGSG-- TEFTLISISLQPEDFATYYC | LQHNS--------------FPFT | FGPGT KVDIK |
| iPS:433 933 | 21-225_44C8 | VK1IA30/JK3 | DIQMTQSPSSLSA SVGDRVTITC | RAS--QGIR------NDLG | WYQQKPGK APKRLIY | A-------ASNLQS | GVPSRFSGSRSG-- TEFTLTISSLQPEDFATYYC | LQYNS--------------YPFT | FGPGT KVDIK |
| iPS:433 949 | 21-225_45H2 | VK1IA30/JK3 | DIQMTQSPSSLSA SVGDRVTITC | RAS--QGIR------NDLG | WYQQKPGK APKRLIY | G-------ASNLQS | GVPSRFSGSGSG-- TEFTLTVSSLQPEDFATFYC | LQHTS--------------FPFT | FGPGT KVDIK |
| iPS:433 981 | 21-225_46E9 | VK1IA30/JK3 | DIQMTQSPSSLSA SVGDRVTITC | RAS--QGIR------NDLG | WYQQKPGK APKRLIY | A-------ASSLQS | GVPSRFSGSGSG-- TEFTLTISSLQPEDFATFYC | LQHTS--------------FPFT | FGPGT KVDIK |
| iPS:433 995 | 21-225_47H7 | VK1IA30/JK3 | DIQMTQSPSSLSA SVGDRVTITC | RTS--QGIR------NDLG | WYQKKPGK APKRLIY | A-------ASSLQS | GVPSRFSGSGSG-- TEFTLTVSSLQPEDFATFYC | LQHTS--------------FPFT | FGPGT KVDIK |
| iPS:434 039 | 21-225_43B1 | VK1IA30/JK3 | DIQMTQSPSSLSA SVGDRVTITC | RAS--QGIR------NDLG | WYQQKPGK APKRLIY | A-------ASSLQS | GVPSRFSGSGSG-- TEFTLTISSLQPEDFATYYC | LQHTS--------------YPFT | FGPGT KVDIK |
| iPS:434 075 | 21-225_51B11 | VK1IA30/JK3 | AIQMTQSPSSLSA SVGDRVTITC | RTS--QGIR------NDLG | WYQQKPRK APKRLIY | A-------ASSLQS | GVPLRFSGSGSG-- TEFTLTIRSLQPEDFATYYC | LQHNS--------------YPFT | FGPGT KVDIK |
| iPS:434 091 | 21-225_52B9 | VK1IA30/JK3 | AIQMTQSPSSLSA SVGDRVTITC | RAS--QGIR------NDLG | WYQQKPRK APKRLIY | A-------ASSLQS | GVEPLRFSGSGSG-- TEFTLTIFISRLQPEDFATYYC | LQHNS--------------YPFT | FGPGT KVDIK |
| iPS:434 057 | 21-225_51E4 | VK1IA30/JK3 | DIQMTQSPSSLSA SVGDRVTITC | RAS--QGIR------NDLG | WYQQKPGK AFQRLIY | A-------ASSLQS | GVPSRFSGSGSG-- TEFTLTISSLQPEDFAAYYC | LQHNS--------------YPFT | FGPGT KVDIK |
| iPS:434 071 | 21-225_51F9 | VK1IA30/JK3 | DIQMTQSPSSLSA SVGDRVTITC | RAS--QGIR------TDLG | WYQQKPGK APQRLIY | A-------ASSLQR | TGPSRFSGSGSG-- TEFTLTVSSLQPEDFATFYC | LQHTS--------------FPFT | FGPGT KVDIK |
| iPS:434 101 | 21-225_52H12 | VK1IA30/JK3 | DIQMTQSPSSLSA SVGDRVTITC | RAS--QGIR------NNLG | WYQQKPGK APKRLIY | G-------ASSLQS | GVPSRFSGSGSG-- TEFTLTISSLQPEDFATYYC | LQYNS--------------YPFT | FGPGT KVDIK |
| iPS:434 103 | 21-225_53G1 | VK1IA30/JK3 | DIQMTQSPSSLSA SVGDRVTITC | RAS--QGIR------NDLG | WYQQKPGK APKRLIY | P-------ASSLQS | GVPSRFSGSGSG-- TEFSLTISSLQPEDFATYYC | LQDNS--------------YPFT | FGPGT KVDIK |
| iPS:434 129 | 21-225_53B12 | VK1IA30/JK3 | DIQMTQSPSSLSA SVGDRVTITC | RAS--QGIR------NDLG | WYQQKPGK AFKRLIY | A-------ASSLQS | GVPSRFSGSGSG-- TEFTLTISSLQPEDFATYYC | LQHNS--------------YPFT | FGPGT KVDIK |

Figure 51 (Continued)

| | | | | | | | | | |
|---|---|---|---|---|---|---|---|---|---|
| PS:434 131 | 21-225 54D3 | VK1|A30/ JK3 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | LQHNS------LHHNT | FGPGT KVDIK |
| PS:434 143 | 21-225 54G7 | VK1|A30/ JK3 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | ------------YPFT | FGPGT KVDIK |
| PS:434 155 | 21-225 55B3 | VK1|A30/ JK3 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFASYYC | LQHNS------YPFT | FGPGT KVDIK |
| PS:434 169 | 21-225 50C4 | VK1|A30/ JK3 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | LQHNS------YPFT | FGPGT KVDIK |
| PS:434 187 | 21-225 56A5 | VK1|A30/ JK3 | DIQMTQSPSSLSA SVGDRVTITC | RAS--QGIR----NLLG | WYQQKPGK APKRLIY | A------ ASSLQS | GVPSRFSGSGSG--- TEFTLTISSLQPEDFATYYC | LQYNS------YPFT | FGPGT KVDIR |
| PS:434 199 | 21-225 59F11 | VK1|A30/ JK3 | DIQMTQSPSSLSA SVGDRVTITC | RAS--QGIR----NDLG | WYQQKPGK APKRLIY | A------ ASSLQS | GVPSRFSGSGSG--- TEFTLTISSLQPEDFATYYC | LQHNR------YPFT | FGPGT KVDFK |
| PS:434 207 | 21-225 60A3 | VK1|A30/ JK3 | DIQMTQSPSSLSA SVGDRVTITC | RAS--QGIR----NDLG | WYQQKPGK APKRLIY | A------ APSLQS | GVPSRFSGSGSG--- TEFTLTISSLQPEDFATYYC | LQHNS------YPFT | FGPGT KVDIK |
| PS:434 251 | 21-225 62G3 | VK1|A30/ JK3 | DIHMTQSPSSLSA SVGDRVTITC | RAS--QDIR----NNLG | WYQQKPGK APKRLIY | T------ ASSLQS | GVPSRFSGSGSG--- TEFTLTISSLQPEDFATYYC | LQYNS------YPFT | FGPGT KVDIK |
| PS:434 263 | 21-225 56H7 | VK1|A30/ JK3 | DIQLIQSPSSLSA SVGDRVTITC | RAS--QDIR----NDLG | WYQQRPGK APKRLIY | P------ ASSLLS | GVPSRFSGSGSG--- TEFTLTISSLQPEDFATYYC | LQDNS------YPFT | FGPGT RVDSK |
| PS:434 265 | 21-225 57B2 | VK1|A30/ JK3 | DIQMTQSPSSLSA SVGDRVTITC | RAS--QGIR----NALG | WYQQKPGK APKRLIY | A------ ASSLQS | GVPSRFSGSGSG--- TEFTLAISSLRPEDFATYYC | LQHNS------YPFT | FGPGT KVDIK |
| PS:434 271 | 21-225 57A4 | VK1|A30/ JK3 | DIQMTQSPSSLSA SVGDRVTITC | RAS--QGIR----NDLG | WYLQKPGK APKRLIY | A------ ASSLLS | GVPSRFSGSGSG--- TEFTLTISSLQPEDFATYYC | LQHMS------YPFT | FGPGT KVDIK |
| PS:434 275 | 21-225 57F4 | VK1|A30/ JK3 | DIQMTQSPSSLSA SVGDRVTITC | RAS--QVIR----NDLG | WYQQKPGK APKRLIY | A------ ASSLQS | GVPSGFSGSGSG--- TEFTLTISSLQPEDFATYYC | LQYGS------FPFT | FGPGT KVDIK |
| PS:434 293 | 21-225 58F5 | VK1|A30/ JK3 | DIQMTQSPSSLSA SVGDRVTITC | RAS--QGIR----NDLG | WFLQTPGK APKRLIY | A------ ASSLLS | GVPSRFSGSGSG--- TEFTLTISSLQPEDFATYYC | LQHNS------YPFT | FGPGT KVDIK |
| PS:434 299 | 21-225 58D11 | VK1|A30/ JK3 | DIQMTQSPSSLSA SVGDRVTITC | RAS--QGIR----SDLD | WYQQKPGK APKRLIY | A------ ASSLQS | GVPSRFSGSGSG--- TEFTLAISSLRPEDFATYYC | LQHNN------FPFT | FGPGT KVDIK |
| PS:434 351 | 21-225 64A12 | VK1|A30/ JK3 | DIQMTQSPSSLSA SVGDRVTITC | RAS--QGIR----NDLD | WYQQKPGK APTRLIY | T------ ASTLQS | GVPSRFSGSGSG--- TEFTLTISSLQPEDFATYYC | LQHNG------YPFT | FGPGT KVDIK |
| PS:434 383 | 21-225 66F9 | VK1|A30/ JK3 | DIQMTQSPSSLSA SVGDRVTITC | RAS--QGIR----NVLG | WYQQKPGK APKRLIY | A------ ASSLQS | GVPSGFSGSGSG--- TEFTLTISSLQPEDFATYYC | LQYNS------YPFT | FGPGT KVDIK |
| PS:434 399 | 21-225 67B7 | VK1|A30/ JK3 | DIQMTQSPSSLSA SVGDRVTITC | RAS--QGIR----NVLG | WYQQTPGK APKRLIY | A------ ASSLQS | GVPSRFSGSGSG--- TEFTLTISSLQPEDFATYYC | LHHNS------YPFK | FGPGT KVDIK |
| PS:434 407 | 21-225 68G8 | VK1|A30/ JK3 | DIQMTQSPSSLSA SVGDRVTITC | RAS--QGIR----NDLG | WYQQRPGK APKRLIY | A------ ASSVQS | GVPSRFSGSGSG--- TEFTLTISSLQPEDFATYYC | LQYNS------YPFT | FGPGT KVDIK |
| PS:434 447 | 21-225 71B6 | VK1|A30/ JK3 | DIQMTQSPSSLSA SVGDRVTITC | RAS--QGIR----NNLG | WYQQKPGK APQRLIY | A------ ASSLQS | GVPSRFSGSGSG--- TEFTLTISSLQPDDFATYYC | LQHNS------YPFT | FGPGT KVDIK |
| PS:434 449 | 21-225 71H6 | VK1|A30/ JK3 | DIQMTQSPSSLSA SVGDRVTITC | RAS--QGIR----NVLG | WYQQKPGK APKRLIY | A------ ASSLQS | GVPSGFSGSGSG--- TEFTLTISSLQPEDFATYYC | LQYNS------YPFT | FGPGT KVDIK |
| PS:434 453 | 21-225 71B11 | VK1|A30/ JK3 | DIQMTQSPSSLSA SVGDRVTITC | RAS--QGIR----NDLG | WYQQTPGK APKRLIY | A------ ASSLQS | GVPSRFSGSGSG--- TEFTLTISSLQPEDFTTYYC | LQHNT------YPFT | FGPGT KVDIK |
| PS:434 463 | 21-225 73A6 | VK1|A30/ JK3 | DIQMTQSPSSLSA SVGDRVTITC | RAS--QGIR----NDLG | WFQQKPGK APKRLIC | A------ ASNLQS | GVPSRFSGSGSG--- TEFTLTISSLQPEDFDTYYC | LQHNS------YPFT | FGPGT KVVVK |
| PS:434 815 | 21-225 74A11 | VK1|A30/ JK3 | DIQMTQSPSSLSA SVGDRVTITC | RAS--QDIR----NDLG | WYQQKPGK APKRLIC | A------ ASSLQS | GVPSRFSGSGSG--- TEFTLTISSLQPEDFATYFC | LQHND------YPFT | FGPGT KVDIK |

Figure 51 (Continued)

| | | | | | | | | | |
|---|---|---|---|---|---|---|---|---|---|
| iPS:434 977 | 21- 225_88A5 | VK1|A30/ JK3 | DIQMTQSPSSLSA SVGDRVTITC | RAS---QGIR- ----NDLG | WYQQKPGK APKRLIY | A------ ASSLQS | GVPSRFSGSGSG--- TEFTLTISSLQPEDFATYYC | LQHND-------- --------YPFT | FGPGT KVEIK |
| iPS:435 253 | 21- 225_96A4 | VK1|A30/ JK3 | DIQMTQSPSSLSA SVGDRVTITC | RAS---QDIR- ----NDLG | WYQQKPGK APKRLIY | G------ VSSLQS | GVPSRFSGSGSG--- TEFTLTISSLQREDFATYYC | LQHND-------- --------YPFT | FGRGT KVDIK |
| iPS:435 511 | 21- 225_157C3 | VK1|A30/ JK3 | DIQMTQSPSSLSA SVGDRVTITC | RAS---QGIR- ----NDLG | WYQQKPGK APKRLIY | A------ ASSLQS | GVPSRFSGSGSG--- TDFTLTISLQPDDFATYYC | LQHNS-------- --------YPFT | FGPGT KVDIK |
| iPS:435 521 | 21- 225_157H4 | VK1|A30/ JK3 | DIQMTQSPSSLSA SVGDRVTITC | RAS---QGIR- ----NDLG | WYQQKPGK APKRLIY | P------ ASSLQT | GVPSRFSGSGSG--- TEFTLTISSLQPEDFATYYC | LQDNS-------- --------YPFT | FGPGT KVDIK |
| iPS:435 527 | 21- 225_157G7 | VK1|A30/ JK3 | DIQMTQSPSSLCA SVGDRVTITC | RAS---QGIR- ----NDLG | WYQQKPGK APKRLIN | V------ ASSLQS | GVPSRFSGSGSG--- TEFTLTISSVQREDFATYYC | IQDNS-------- --------HPFT | FGPGT KVEIK |
| iPS:435 533 | 21- 225_157H8 | VK1|A30/ JK3 | DIQMTQSPSSLSA SVGDRVTITC | RAS---QGIR- ----NDLG | WYQQKPGK APKRLIY | A------ ASSLQS | GVPSRFSGSGSG--- TDFTLTISSLQPDDFATYYC | LQHNS-------- --------YPFT | FGPGT KVDIK |
| iPS:435 537 | 21- 225_157H1 2 | VK1|A30/ JK3 | DIQMTQSPSSLSA SVGDRVTITC | RAS---QGIR- ----NDFG | WYQQRPGK APKCLIH | A------ ASSLQS | GVPSRFSGSGSG--- TEFTLTISSLQPEDFATYYC | LQHYS-------- --------YPFT | FGPGT KVDIK |
| iPS:435 547 | 21- 225_158F5 | VK1|A30/ JK3 | DIQMTQSPSSLSA SVGDRVTITC | RAS---QGIR- ----NDLG | WYQQKPGK APKRLIN | A------ ASSLQS | GVPSRFSGSGSG--- TEFTLTISSLQPEDFATYYC | LQDNS-------- --------HPFT | FGPGT KVEIK |
| iPS:435 551 | 21- 225_158H6 | VK1|A30/ JK3 | DIQMTQSPSSLSA SVGDRVTITC | RAS---QGIR- ----SDLG | WYQQKPGK APKRLIY | I------ ASSLQS | GVPSRFSGSGSG--- TEFTLTISSLQPEDFATYYC | LQHNS-------- --------YPFT | FGPGT KVDIK |
| iPS:435 553 | 21- 225_158G8 | VK1|A30/ JK3 | DIQMTQSPSSLSA SVGDRVTITC | RAS---QGIR- ----NDLG | WYQQKPGK APKRLMY | T------ ASSLQS | GVPSRFSGSGSG--- TDFTLTISLQPDDFATYYC | LQHNS-------- --------YPFT | FGPGT KVDIK |
| iPS:435 569 | 21- 225_159C5 | VK1|A30/ JK3 | DIQMTQSPSSLSA SVGDRVTITC | RTS---QGIR- ----NDLG | WYQQKPGK APKRLIY | A------ ASSLQS | GVPSRFSGSGSG--- TEFTLTISSLQPEDFATYYC | LQHNS-------- --------YPFT | FGPGT KVDIK |
| iPS:435 593 | 21- 225_160F4 | VK1|A30/ JK3 | DIQMTQSPSFSA SVGDRVTITC | RAS---QGIR- ----NDLG | WYQQKPGK APKRLIY | V------ ASSLQS | GVPSRFSGSGSG--- TEFTLTISSVQREDFATYYC | IQDNS-------- --------YPFT | FGPGT KVDIK |
| iPS:435 609 | 21- 225_161F7 | VK1|A30/ JK3 | DIQMTQSPSSLSA SVGDRVTITC | RAS---QGIR- ----NDLG | WYQQKPGE APKRLIY | A------ ASTLQS | AEFTVTIGSVQREDFATYYG | LLYIR-------- --------YPFT | FGRGT KVDIK |
| iPS:435 613 | 21- 225_161D1 | VK1|A30/ JK3 | DIQMTQSPSSLSA SVGDRVTITC | RAS---QDIR- ----NNLG | WYQQKPGE APKRLIY | A------ ASSLQS | GVPSRFSGSGSG--- AEFTLTISSVQREDFATYYC | LQYNR-------- --------YPFT | FGPGT KVDIK |
| iPS:435 617 | 21- 225_162F2 | VK1|A30/ JK3 | DIQMTQSPSSLCA SVGDRVTITC | RAS---QGIR- ----NDLG | WYQQKPGK APKRLIN | A------ ASSLQS | GVPSRFSGSGSG--- TEFTLTISSVQPEDFATYYC | IQDNS-------- --------HPFT | FGPGT KVEIK |
| iPS:435 621 | 21- 225_162H3 | VK1|A30/ JK3 | DIQMTQSPSSLSA SVGDRVTITC | RAS---QDIR- ----NDLG | WYQQKPGK APKRLIN | A------ ASSLQS | GVPSRFSGSGSG--- TEFTLTISSLQPEDFATYYC | LQDNS-------- --------YPFT | FGPGT KVDIK |
| iPS:435 637 | 21- 225_163E2 | VK1|A30/ JK3 | DIQMTQSPSSLSA SVGDRVTITC | RAS---QGIR- ----NDLG | WYQQKPGK APTRLIY | A------ ASSLQS | GVPSRFSGSGSG--- TEFTLTISISSLQPEDFATYYC | LQHNS-------- --------HPFT | FGPGT KVDIK |
| iPS:435 641 | 21- 225_163F9 | VK1|A30/ JK3 | DIQMTQSPSSLSA SVGDRVTITC | RAS---QGIR- ----DDLG | WYQQKPGK APKRLIY | P------ ASSLQS | GVPSRFSGSGSG--- TEFTLTISSLQPEDFAAYYC | LQHNS-------- --------HPFT | FGPGT KVDIK |
| iPS:435 643 | 21- 225_163G1 0 | VK1|A30/ JK3 | DIQMTQSPSSLSA SVGDRVTITC | RAS---QDIR- ----NNLG | WYQQKPGK APKRLIY | P------ ASSLQS | GVPSRFSGSGSG--- TEFTLTISSLQPEDFATYYC | LQDYS-------- --------YPFT | FGPGT KVDIK |
| iPS:435 719 | 21- 225_171A1 1 | VK1|A30/ JK3 | DIQMTQSPSSLSA SVGDRVTITC | RAS---QGIR- ----NDLG | WYQQKPGT APKRLIY | A------ ASSLQS | GVPSRFSGSGSG--- TEFTLTISSLQPEDFATYYC | LQDHS-------- --------HPFT | FGPGT KVDIK |
| iPS:435 769 | 21- 225_177B6 | VK1|A30/ JK3 | DIQMTQSPSSLSA SVGDRVTITC | RAS---QDIS- ----NDLG | WYQQKPGK APKRLIY | A------ ASSLQS | GVPSRFSGSGSG--- TEFTLTINSLQPEDFATYYC | LQLNS-------- --------YPFT | FGPGT KVDIK |

Figure 51 (Continued)

| | | | | | | | | | |
|---|---|---|---|---|---|---|---|---|---|
| iPS:435_791 | 21-225_180H7 | VK1/A30/JK3 | DIQMTQSPSSLSA SVGDRVTITC | RAS--QGIR-----NDLG | WYQQKPGK APKRLIY | T------ASSLQS | GVPSRFSGSGSG--- TEFTLTISSLQPEDFASYYC | LQHNS--------YPFT | FGPGT KVDFK |
| iPS:435_805 | 21-225_181A8 | VK1/A30/JK3 | DIQMTQSPSSLSA SVGDRVTITC | RAS--QGIR-----NDLG | WYQQKPGK APKRLIY | T------ASSLQS | GVPSRFSGSGSG--- TDFTLTISSLQPEDFASYYC | LQHNS--------YPFT | FGPGT KVDIK |
| iPS:435_879 | 21-225_184H1 | VK1/A30/JK3 | DIQMTQSPSSLSA SVGDRVTITC | RAS--QGIR-----NDLG | WYQQKPGK APKRLIY | I------ASSLQS | GVPSRFSGSGSG--- TEFTLTISSLQPEDFATYYC | LQHNS--------YPFT | FGPGT KVDIK |
| iPS:435_881 | 21-225_184D1 | VK1/A30/JK3 | DIQMTQSPSSLSA SVGDRVTITC | RAS--QGIR-----NDLG | WYQQKPGK APKRLIY | I------ASSLQS | GVPSRFSGSGSG--- TEFTLTISSLQPEDFATYYC | LQHNS--------YPFT | FGPGT KVDIK |
| iPS:435_921 | 21-225_190D6 | VK1/A30/JK3 | DIQMTQSPSSLSA SVGDRVTITC | RAS--QGIR-----NDLG | WYQLKPGK APKRLIY | A------ASSLQS | GVPSRFSGSGSG--- PEFTLTISSLQPEDFATYYC | LQHYS--------FPFT | FGPGT KVDIK |
| iPS:435_985 | 21-225_192F6 | VK1/A30/JK3 | DIQMTQSPSSLSA SVGDRVTITC | RAS--QGIR-----NDLG | WYQLKPGK APKRLIY | A------ASSLQS | GVPSRFSGSGSG--- PEFTLTISSLQPEDFATYYC | LQHYS--------FPFT | FGPGT KVDIK |
| iPS:436_074 | 21-225_194F10 | VK1/A30/JK3 | DIQMTQSPSSLSA SVGDRVTITC | RAS--QGIR-----NDLG | WYQLKPGK APKRLIY | A------ASSLQS | GVPSRFSGSGSG--- PEFTLTISSLQPEDFATYYC | LQHYS--------FPFT | FGPGT KVDIK |
| iPS:436_092 | 21-225_195B9 | VK1/A30/JK3 | DIQMTQSPSSLSA SVGDRVTITC | RAS--QGIR-----KDLG | WYQQKPGK APKRLIY | A------ASDLQS | GVPSRFSGSGSG--- TEFTLTISSLQPEDFAIYYC | LQHYR--------YPFT | FGPGT KVDIK |
| iPS:436_164 | 21-225_197G1 | VK1/A30/JK3 | DIQMTQSPSSLSA SVGDRVTITC | RAS--QGIR-----NDLG | WYQQKPGK APKRLIY | G------ASSLQS | GVPSRFSGSGSG--- TEFTLTISSLQPEDFATYYC | LQHYR--------YPFT | FGPGT KVDIK |
| iPS:436_191 | 21-225_198B9 | VK1/A30/JK3 | DIQMTQSPSSLSA SVGDRVTITC | RAS--QGIR-----KDLG | WYQQKPGK APKRLIY | A------ASSLQS | GVPSRFSGSGSG--- TEFTLTISSLQPEDFAIYYC | LQHYR--------YPFT | FGPGT KVDFK |
| iPS:436_205 | 21-225_199A7 | VK1/A30/JK3 | DIQMTQSPSSLSA SVGDRVTITC | RAS--QGIR-----NDLG | WYQQKPGK APKRLIY | A------ASSVQN | GVPSRFSGSGSG--- TEFTLTISSLQPEDFATYYC | LQHYR--------YPFT | FGPGT KVDIK |
| iPS:436_214 | 21-225_200F6 | VK1/A30/JK3 | DIQMTQSPSSLSA SVGDRVTITC | RAS--QGIR-----NDLG | WYQQKPGK APKRLIY | A------ASSLQS | GVPSRFSGSGSG--- TEFTLTISSLQPEDFATYYC | LQHYS--------YPFT | FGPGT KVDIK |
| iPS:436_248 | 21-225_202A3 | VK1/A30/JK3 | DIQMTQSPSSLSA SVGDRVTITC | RAS--QGMR-----KDLG | WYQQKPGK APKRLIY | A------ATSLQS | GVPSRFSGSGSG--- TEFTLTISSLQPEDFATYHC | LQHYS--------YPFT | FGPGT KVDIK |
| iPS:436_268 | 21-225_203B9 | VK1/A30/JK3 | DIQMTQSPSSLSA SVGDRVTITC | RAS--QGIR-----NDLG | WYQQKPGK APKRLIC | A------ASRLQS | GVPSRFSGSGSG--- TEFTLTISSLQPEDFAIYYC | LQHHD--------YPFT | FGPGT KVDIK |
| iPS:436_350 | 21-225_210E4 | VK1/A30/JK3 | DIQMTQSPSSLSA SVGDRVTITC | RAS--QGIR-----NDLG | WYQQKPGK APKRLIY | R------ASSVQN | GVPSRFSGSGSG--- TEFTLTISSLQPEDFATYHC | LQHNS--------YPFT | FGPGT KVDIK |
| iPS:436_576 | 21-225_225B6 | VK1/A30/JK3 | DIQMTQSPSSLSA SVGDRVTITC | RAS--QGIR-----NDLG | WYQQKPGK APKRLIY | A------ASSLQS | GVPSRFSGSGSG--- TEFTLTISSLQPEDFATYYC | LQHNS--------YPFT | FGPGT KVDIK |
| iPS:436_578 | 21-225_225D6 | VK1/A30/JK3 | DIQMTQSPSSLSA SVGDRVTITC | RAS--QGIR-----KDLG | WYQQKPGK APKRLIY | A------ASSLLG | GVPSRFSGSGSG--- TEFTLTISSLQPEDFATYYC | LQHNT--------YPFT | FGPGT KVDIK |
| iPS:436_582 | 21-225_225F8 | VK1/A30/JK3 | DIQMTQSPSSLSA SVGDRVTITC | RAS--QGIR-----NDLG | WYQQKPGK APKRLIY | A------ASSLQS | GVPSRFSGSGSG--- TEFTLTISSLQPEDFATYYC | LQHNS--------YPFT | FGPGT KVDIK |
| iPS:436_608 | 21-225_226A9 | VK1/A30/JK3 | DIQMTQSPSSLSA SVGDRVTITC | RAS--QGIR-----NDLG | WYQQKPGK APKRLIY | A------ASSLQS | GVPSRFSGSGSG--- TEFTLTISSLQPEDFATYYC | LQHNS--------YPFT | FGPGT KVDIK |
| iPS:436_630 | 21-225_227G3 | VK1/A30/JK3 | DIQMTQSPSSLSA SVGDRVTITC | RAS--QGIR-----NDLG | WYQQKPGK APKRLIY | A------ASSLQS | GVPSRFSGSGSG--- TEFTLTISSLQPADFATYYC | LHHNS--------YPFT | FGPGT KVDIK |
| iPS:436_634 | 21-225_227H5 | VK1/A30/JK3 | DIQMTQSPSSLSA SVGDRVTITC | RAS--QDIR-----NDLG | WYQQKPGK APKRLIY | A------ASSLQS | GVPSRFSGSGSG--- TEFTLTISSLQPEDFATYYC | LQHNS--------YPFT | FGPGT KVDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436 650 | 21-225_227C1 2 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:392 632 | 21-225_16A11 | VKI|A30/ JK3 | DIQMTQSPSSLSA SVGDSVTISC | RAS---QGIR------NHLG | WYQRNPGK APKRLIY | A-------ASSLQS | GVPSRFSGSGSG---TEFTLTISSLQPEDFATYYC | LQYNS----------YPFT | FGPGT KVDIK |
| iPS:392 684 | 21-225_17F4 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFLTISSLQPEDFATYYC | LQHNS----------YPFT | FGPGT KVDIK |
| iPS:392 732 | 21-225_17E5 | VKI|A30/ JK3 | DIQMTQSPSSLSA SVGDRVTITC | RAS---QGIR------NDLG | WYQQKPGK APKRLIY | T-------ASSLQS | GVPSRFSGSGSG---TEFTLTISSLQPEDFATYYC | LQHNS----------YPLT | FGPGT KVVIK |
| iPS:392 778 | 21-225_22H3 | VKI|A30/ JK3 | DIQMTQSPSSLSA SVGDRVTITC | RAS---QDIR------NNLG | WYQQKPGK APKRLIY | P-------ASSLQT | GVPSRFSGSGSG---TEFTLTISSLQPEDFATYYC | LQDNS----------YPFT | FGPGT KVDIK |
| iPS:392 912 | 21-225_25A9 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:392 934 | 21-225_27D5 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:392 940 | 21-225_29D9 | VKI|A30/ JK3 | DIQMTQSPSSLSA SVGDRVTITC | RAS---QGIR------NDLG | WFQQKPGK APKRLIY | A-------ASSLQS | GVPSRFSGSGSG---TEFTLTISSLQPEDFATYYC | LQHNT----------YPFT | FGPGT KVDFK |
| iPS:392 948 | 21-225_25G5 | VKI|A30/ JK3 | DIQMTQSPSSLSA SVGDRVTITC | RAS---QGIR------NDLG | WYQQKPGK APKRLIY | R-------ASSLQS | GVPSRFSGSGSG---TEFTLVSSLQPEDFATYYC | LQHNS----------YPFT | FGPGT KVDIN |
| iPS:392 968 | 21-225_25B6 | VKI|A30/ JK3 | DIQMTQSPSSLSA SVGDRVTITC | RAS---QGIR------NDLG | WYQQKPGK APKRLIY | A-------ASSLQN | GVPSRFSGSGSG---TEFTLTISSLQPEDFATYYC | LQHNR----------YPFT | FGPGT KVDIK |
| iPS:392 978 | 21-225_28B8 | VKI|A30/ JK3 | DIQMTQSPSSLSA SVGDRVTITC | RAS---QGIR------NDLG | WYQHKPGK APKRLIY | A-------ASSLQS | GVPSRFSGSGSG---TEFTLTISSLQPEDFATYYC | LQHNS----------YPFT | FGPGT KVDIK |
| iPS:392 998 | 21-225_28A9 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:393 000 | 21-225_29D7 | VKI|A30/ JK3 | DIQMTQSPSSLSA SVGDRVTITC | RAS---QGIR------NDLG | WYQQKPGK APKRLIY | P-------ASSLQS | GVPSRFSGSGSG---TEFTLTISSLQPEDFATYYC | LQDNS----------YPFT | FGPGT KVDIK |
| iPS:393 006 | 21-225_31G9 | VKI|A30/ JK3 | DIQMTQSPSSLSA SIGDRVTITC | RAS---QGIR------NDLG | WYQQKPGK APKRLVI | A-------ASSLQS | GVPSRFSGSGSG---TEFTLTISSLQPEDFATYYC | LQDNS----------HPFT | FGPGT KVDIT |
| iPS:393 022 | 21-225_30H11 | VKI|A30/ JK3 | DIQMTQSPSSLSA SVGDRVTITC | RAS---QGIR------NDLG | WYQQKPGK APKRLIY | T-------ASSLQS | GVPSRFSGSGSG---TEFTLTISSLQPEDFATYYC | LQHNS----------YPFT | FGPGT KVDIK |
| iPS:393 038 | 21-225_29D8 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:393 822 | 21-225_15B11 | VKI|A30/ JK3 | DIQMTQSPSSLSA SVGDRVTITC | RAS---QGIR------NDLG | WYQQKPGK APKRLIY | A-------ASSLQS | GVPSRFSGSGSG---TEFTLTISSLQPEDFATYYC | LQHNS----------YPFT | FGPGT KVDIK |
| iPS:393 944 | 21-225_14D6 | VKI|A30/ JK3 | DIQMTQSPSSLSA SVGDSVTITC | RAS---QGIR------NHLG | WYQHKPGK APKRLIY | A-------ASSLQS | GVPSRFSGSGSG---TEFTLTISSLQPEDFATYYC | LQYNG----------YPFT | FGPGT KVDIN |
| iPS:394 033 | 21-225_5F4 | VKI|A30/ JK3 | DIQMTQSPSSLSA SVGDRVTITC | RAS---QGIR------DILG | WYQQKPGK APKRLIY | A-------ASSLQS | GVPSRFSGSGSG---TEFTLTISSLQPEDFATYYC | LQYHS----------YPFT | FGPGT KVDIK |
| iPS:394 069 | 21-225_16H1 | VKI|A30/ JK3 | DIQMTQSPSSLSA SVGDRVTITC | RAS---QGIR------NHLG | WYQQKPGK APKRLIY | A-------ASSLQN | GVPSRFSGSGSG---TEFTLTISSLQPEDFATYYC | LQHNS----------YPFI | FGPGT KVDVK |
| iPS:402 229 | 21-225_16H9 | VKI|A30/ JK3 | DIQMTQSPSSLSA SVGDRVTITC | RAS---QGIR------NYLG | WFQQKPGK APKRLIY | G-------ASSLQS | GVPSRIGGSGSG---TEFTLTISSLQPEDFATYYC | LQYHS----------YLFT | FGPGT KVDIK |
| Germline | VKI|O12/J K1 | | | | | | | | |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:468 848 | 21-225_54B1 | VK1|O12/ JK1 | DIQMTQSPSSLSA SIGDRVTITC | RAS--QNIS-----SYLN | WYQQKPGK APKFLIY | A-------ASSLHS | GVPPRFSGSGSG--TDFTLTISSLQPEDFAIYYC | QQSYR-------TPLWT | FGQGT KVEIK |
| iPS:434 239 | 21-225_58F1 | VK1|O12/ JK1 | DIQMTQSPSSLSA SVGDRVTITC | RAS--QSIT-----NFLN | WYQQKPGK AFKLLIF | A-------ASSLQS | GIPSRFSGSGSG--TDFTLTISSLQPEDFATYYC | QQSYS-------IPWT | FGQGT KVEIK |
| iPS:435 513 | 21-225_157F3 | VK1|O12/ JK1 | DIQMTQSPSSLSA SVGDRVTITC | RAS--QNIS-----SYLN | WYQLKPGK APKLLIY | T-------ASSLQS | TDFTLTISSLQPEDFATYYC | QQSYN-------TPTWT | FGQGT KVEIK |
| iPS:435 729 | 21-225_173E7 | VK1|O12/ JK1 | DIQMTQSPSSRSA CIGDRATIY | RAS--QTIS-----NYLN | WYQQKPGK AFKLLIY | A-------ASSLQI | GVPSRFSGSGSG--TDFTLTISSVQPEDFATYFC | QQSYR-------TFQWT | FGQGT KVEIK |
| iPS:435 753 | 21-225_175G1 0 | VK1|O12/ JK1 | DIQMTQSPSSLSA SVGDRVTITC | RAS--QTIG-----NYLN | WYQQKPGR APKLLIY | A-------ASSLHS | GVPSGFSGSGSG--TDFTLTISSLQPEDFATYFC | QQSYR-------TPQWT | FGQGT KVEIK |
| iPS:435 799 | 21-225_181G3 | VK1|O12/ JK1 | DIQMTQSPSSLSA SVGDRVNITC | RAS--HSIS-----NYLN | WYQQKAGK APNLLIY | T-------TLNLQS | GVPSRFSGSGSG--TDFTLTISSLQPEDFATYYC | QQSYS-------SPPWT | FGQGT KVEIK |
| iPS:435 813 | 21-225_183A1 | VK1|O12/ JK1 | DIQMTQSPSSLCA SVGDRVTITC | RAS--RNIS-----NYLN | WYQQKPGK APKLLIY | V-------VSSLQS | GVPSRFSGSGSG--TDFTLTISSLQPEDFATYYC | QQSIS-------SPPWT | FGQGT KVDIR |
| iPS:436 003 | 21-225_192G1 0 | VK1|O12/ JK1 | DIQMTQSPSSLSA SVGDRVTITC | RAS--QSIS-----NYLN | WYQQTPGK APKLLIY | A-------ESSLQS | GVPSRFSGSGSG--TDFTLTISSLQPEDFATYSC | QQSYS-------SPPWT | FGQGT KVEIK |
| iPS:436 212 | 21-225_200G1 0 | VK1|O12/ JK1 | DIQMTQSPSSLSA SVGDRVTITC | RAS--QSIS-----SYLN | WFQQKPGN APKLLIY | A-------ESSLQS | GVPSRFSGSGSG--TDFTLTISSLQPEDFATYYC | QQSYS-------SPPWT | FGQGT KVEFK |
| iPS:392 730 | 21-225_17A1 | VK1|O12/ JK1 | DIQMTQSPSSLSA SVGDRVTITC | RAS--QNIN-----NYLN | WYQQKPGK GPKVLIF | T-------TSSLQS | GVPSRFSGSGSG--TDFTLTISSLQPEDFATYYC | QQSYT-------TPTWT | FGQGT KVEIK |
| iPS:392 736 | 21-225_17B12 | VK1|O12/ JK1 | DIQMTQSPSSLSA SVGDRVSITC | RAS--QNIN-----NYLN | WYQQKPGK GPKVLIL | A-------ASSLQS | GVPSRFSGSGSG--TDFTLTISSLQPEDFATYYC | QQTYT-------TPTWT | FGQGT KVEIK |
| iPS:392 766 | 21-225_23H4 | VK1|O12/ JK1 | DIQMTQSPSSLSA SVGDRVTITC | RSS------RYLN | WYQQKPGR APKLLIC | S-------TSSLQS | TDFTLTISSLQPEDFATYYC | QQSYS-------TPTWT | FGQGT KVEIR |
| iPS:392 770 | 21-225_20C10 | VK1|O12/ JK1 | DIHMTQSPSSLSA SVGDKVSITC | RAS--HHIS-----NYLN | WYQQKPGK GPKVLIL | T-------ASSLQS | GVPGRFSGSGSG--TDFTLTISSLQPEDFATYYC | QQSYR-------TPTWT | FGQGT KVEIK |
| iPS:392 808 | 21-225_20F8 | VK1|O12/ JK1 | DIQMTQSPSSLSA SVGDRVTITC | RAS--QSIS-----RYLN | WYQQKPGK APELLIY | A-------ASSLQS | GVPSRFSGSGSG--TDFTLTISSLQPEDFATYYC | QQSYN-------TPTWT | FGQGT KVEIK |
| iPS:392 954 | 21-225_26A10 | VK1|O12/ JK1 | DIQMTQSPSSLSA SVGDRIITC | RAS--QSIS-----SYLN | WYQQKPGK AFKVLIY | A-------ASTRES | GVPSRFSGSGSG--TDFTLTISSLQPEDFATYYC | QQSYS-------TFTWT | FGQGT KVEIK |
| iPS:393 878 | 21-225_7G12 | VK1|O12/ JK1 | DIQMTQSPSSLSA SVGDRVSITC | RAS--QNIN-----NYLN | WYQQKPGK GPKVLIL | A-------ASSLQS | GVPSRFSGSGSG--TDFTLTINSLQPEDFATYYC | QQSYT-------TPTWT | FGQGT KVEIK |
| iPS:398 474 | 21-225_17B10 | VK1|O12/ JK1 | DIQMTQSPSSLSA SVGDRVTITC | RSS--QSIN-----SYLN | WYQQKPGK AFKLLIF | A-------ASSLHS | GVPGRFSGSGSG--TDFTLTISSLQPEDFATYYC | QQGYN-------TPTWT | FGQGT KVEIK |
| | Germline VK4|B3/JK2 | | | | | | | | |
| iPS:468 850 | 21-225_63F4 | VK4|B3/ K2 | DIVMTQSPDSLAV SLGERATINC | KSS-------QSVLSSSNNNN YLA | WYQQKPGQ PPKLLIY | W-------ASTRES | GIPDRFSGSGSG--TGFTLTISSLQAEDVAVYYC | QQYYT-------TFCS | FGQGT KLEIN |
| iPS:468 852 | 21-225_71F3 | VK4|B3/ K2 | DIVMTQSPEDSLAV SLGARATINC | KSS-------QSVLSN3NNNN YLA | WYQQKPGQ PPKLLIY | W-------ASTRES | GIPDRFSGSGSG--TDFTLTINSLQAEDVAVYYC | QQYYT-------TFCS | FGQGT KLEIK |

Figure 51 (Continued)

| | | | | | | | | |
|---|---|---|---|---|---|---|---|---|
| iPS:468 870 | 21-225_74A8 | VK4|B3/J K2 | DIVMTQSPDSLAV SLGERATINC | KSS---QSVLYSSNSHN YLA | WYQQKPGQ PPKLLIY | W-------ASTRES | GVPDRFSGSGSG--TDFTLTISSLQAEDVAVYYC | QQYYS---------TPCS | FGQGT KLEIK |
| iPS:434 211 | 21-225_60F3 | VK4|B3/J K2 | DIVMTQSPDSLTV SLGERATINC | KSS---QSVLYSSNNKN YLA | WYQQKPGQ PPKLLIY | W-------ASTRES | GVPDRFSGSGSG--TDFTLTISSLQAEDVAIYYC | QQYYS---------TPCS | FGQGT KLEIN |
| iPS:434 235 | 21-225_61E3 | VK4|B3/J K2 | DIVMTQSPDSLAV SLGERATINC | KSS---QSVLHISNNNN YLA | WYQQPGQ PPKLLIY | W-------ASIRES | GVPDRFSGSGSG--TDFTLTISSLQAEDVAVYYC | QQYYS---------IPCS | FGQGT KLEIK |
| iPS:434 287 | 21-225_57F12 | VK4|B3/J K2 | DIVMTQSPDSLAV SLGERATINC | KSS---QSVLFSSRNYN YLA | WYQQKTGQ PPKLIIY | W-------ASTRES | GVPDRFSGSGSG--TDFTLTISSLQAEDVAIYYC | QQYYS---------NPCS | FGQGT KLEIK |
| iPS:434 305 | 21-225_59E1 | VK4|B3/J K2 | DIVMTQSPDSLAV SLGERATINC | KSS---QSVLYSSNRNN YLA | WYQQRPGQ PPKLLIY | W-------SSTRES | GVPDRFSGSGSG--TDFTLTISSLQAEDVAVYYC | QQIFS---------IPCS | FGQGT KLEIK |
| iPS:434 443 | 21-225_71G3 | VK4|B3/J K2 | DIVMTQSPDSLAV SLGERVAINC | KSS---QSVLHSSNNNN YLD | WYQQKPGQ LFKLLIF | W-------ASTREF | GVPDRFSGSGFG--TDFTLTISSLQAEDVADYYC | QQYYI---------TPCS | FGQGT KLEIK |
| iPS:434 483 | 21-225_74C12 | VK4|B3/J K2 | DIVMTQSPDSLAV SLGERATINC | KSS---QSVLYSSNNYN YLA | WYQQKPGQ PPNLLIY | W-------ASTREF | GVPDRFSGSGSG--TDFTLTISSLQAEDVAVYYC | QQYYT---------TPCS | FGQGT KLEIK |
| iPS:434 613 | 21-225_77D12 | VK4|B3/J K2 | DIVMTQSPDSLAV SLGERATINC | RSS---QSVLYSSNNYN YLA | WYQQKPGQ PPKLLIY | W-------ASIRES | GVPDRFSGSGSG--TDFTLTISSLQAEDVAVYYC | QQYYT---------TPCS | FGQGT KLEIK |
| iPS:434 635 | 21-225_78E6 | VK4|B3/J K2 | DIVMTQSPDSLAV SLGERATINC | KSS---QSVLYSSNSHN YLA | WYQQKPGQ PFNLLIY | W-------ASTRES | GVPDRFSGSGSG--TDFTLSISISSLQAEDVAVYYC | QQYYS---------TPCS | FGQGT KLEIK |
| iPS:434 679 | 21-225_79G7 | VK4|B3/J K2 | DIVMTQSPDSLAV SLGERATINC | KSS---QSVLYSSNSHN YLA | WYQQKPGQ PFKLLIY | W-------ASIRES | GVPDRFSGSGSG--TDFTLSISSMQAEDVAVYYC | QQYYS---------TPCS | FGQGT KLEIK |
| iPS:434 909 | 21-225_85C11 | VK4|B3/J K2 | DIVMTQSPDSLAV SLGERATINC | KSS---QSVLYSSNSHN FLA | WYQQNPGQ PPKLLIF | W-------AFIRES | GVPEGFSGSGSG--ADFTLSISGLQAEDVAVYYC | QQYYS---------TPCS | FGQGT KLEIK |
| iPS:434 959 | 21-225_87E10 | VK4|B3/J K2 | DIVMTQSPDSLAV SLGERATINC | KSS---QSVLYSSNNNN YLA | WYQQKPGQ PPKLLIY | W-------ASTRKS | GVPDRFSGTGSG--TDFTLTISSLQAEDVAVYYC | QQYYS---------SPCS | FGQGT KLKIK |
| iPS:435 299 | 21-225_146D4 | VK4|B3/J K2 | DIVMTQSPDSLAV SLGERATINC | KSS---QSVLYSSNNNN YLA | WYQQKPGQ PPKLVIY | W-------ASTRES | GVPDRFSGSGSG--TDFTLTISSLQAEDVAVYYC | QQYYS---------TPCS | FGQGT KLEIK |
| iPS:435 305 | 21-225_146C9 | VK4|B3/J K2 | DIVMTQSPDSLAV SLGERATINC | KSS---QSVLHSSNNYN YLA | WYQQKPGQ PPYLLIY | W-------ASTRKS | GVPDRFSGSGSG--TDFTLTISSLQAEDVAVYYC | QQYYS---------TPCS | FGQGT KLEIK |
| iPS:435 309 | 21-225_146F9 | VK4|B3/J K2 | DIVMTQSPDSLAV SLGERATINC | KSS---QMLHSSNNNN YLA | WYQQKPGQ PPYLLIY | W-------ASTRES | GVPDRFSGSGSG--TDFTLTISSLQAEDVAVYYC | QQYYT---------TPCS | FGQGT KLEIT |
| iPS:435 323 | 21-225_147D5 | VK4|B3/J K2 | DIVMTQSPDSLAV SLGERATINC | KSS---QSVLYSSNNNN YLA | WYQQKPGQ PPKLLIY | W-------ASTRES | GVPDRFSGSGSG--TDFTLSISSLQAEDVAVYYC | HQYYS---------TPCS | FGQGT KLEIK |

Figure 51 (Continued)

| | | | | | | | | | |
|---|---|---|---|---|---|---|---|---|---|
| iPS:435_399 | 21-225_150D2 | VK4|B3/J K2 | DIVMTQSPDSLAV SLGERATINC | KSS--- QSVLYRSNSKK YLT | WYQQKPGQ PPKLFIY | W------- ASTRKS | GVPDRFSGSGSG-- TDFTLTISNLQAEDVAVYYC | QQYFS------------ ----------TPYN | FGQGT KREIK |
| iPS:435_435 | 21-225_152H3 | VK4|B3/J K2 | DIVMTQSPDSLAV SLGEKATINC | KSS--- QSVLHSSNNYN YLT | WYQQKPGQ PPKLLIY | W------- ASTRKS | GVPDRFSGSGSG-- TDFTLTISSLQAEDVAVYYC | QQYYS------------ ----------TPCS | FGQGT KLEIK |
| iPS:435_451 | 21-225_152D1 | VK4|B3/J K2 | GIVMTQSPDSLAV SLGERATINC | KSS--- QSVLYSSNNKN YLA | WYQQKPGQ PPKLLIY | W------- ASTRES | GVPDRFSGSGSG-- TDFTLTIYSLQAEDVAVYYC | QQYY------------- ----------RSFS | FGQGT KLEIK |
| iPS:435_459 | 21-225_152E1 | VK4|B3/J K2 | AVVMTQSPDSLAV SLGERATINC | TSS--- QSILHSSNNYN YLA | WYQQKPGQ PPKMLIY | W------- ASTRES | GVPDRFSGSGSG-- TDFTLTISSLQAEDVAVYYC | QQYYS------------ ----------GPCS | FGQGT KLEIK |
| iPS:435_467 | 21-225_153B9 | VK4|B3/J K2 | GIVMTQFPDSLAV SLGERATINC | KSS--- QSVLYSSNNRN YLA | WYQQKPGQ PHKLLIY | W------- ASTREF | GVPDRFSGSGCG-- TDFTLTIYSVQAEDVAVYYC | QQYN------------- ----------RSLS | FGQGT KLEIK |
| iPS:435_471 | 21-225_153F11 | VK4|B3/J K2 | DIVMTQSPDSLAV SLGERATINC | KSS--- QSVLYSSNNYK YLA | WYQQKPGQ PPNLLIY | W------- ASTRKS | GVPDRFSGSGSG-- TDFTLTISSLQAEDVAVYYC | QQYYS------------ ----------TPCS | FGQGT KLEIK |
| iPS:435_475 | 21-225_154H6 | VK4|B3/J K2 | DIVMTQSPDSLAV SLGERATINC | KSS--- QSVLHSSNNYN YLA | WYQQKPGQ PPKLLIY | W------- TSTRKS | GVPDRFSGSGSG-- THFTLTISSLQAEDVAVYYC | QHYYS------------ ----------TPCS | FGQGT KLEIK |
| iPS:435_491 | 21-225_155E5 | VK4|B3/J K2 | DIVMTQSPDSLAV SLGERATINC | KSS--- QSVLSSSNNNN YLA | WYQQKPGQ PPKLLIY | W------- ASTREF | GVPDRFSGSGSG-- TDFTLTISSLQAEDVAVYYC | QQYYS------------ ----------TPCS | FGQGT KLEIK |
| iPS:435_495 | 21-225_155B6 | VK4|B3/J K2 | DIVMTQSPDSLAV SLGERATINC | KSS--- QSVLHSSNNYN YLA | WYQQKPGQ PPKLLIY | W------- TSTRES | GVPDRFSGSGSG-- TDFTLTISSLQAEDVAVYYC | QQYYS------------ ----------TPCS | FGQGT KLEIK |
| iPS:435_501 | 21-225_156H1 | VK4|B3/J K2 | DIVMTQSPDSLAV SLGERATINC | KSS--- QSVLYSSNNNN YLA | WYQQKPGQ PPKLLIY | W------- ASTRES | GVPARFSGSGSG-- TDFTLTISSLQAEDVAVYYC | HQYYS------------ ----------TPCS | FGQGT KLEIK |
| iPS:435_589 | 21-225_160A4 | VK4|B3/J K2 | DIVMTQSPDSLAV SLGERATINC | KSS--- QSVLHSSNNNN YLA | WYQQKPGQ PPKLLIY | W------- ASTRES | GVPDRFSGSGSG-- TDFTLTISGLQAEDVAVYYC | QQYYN------------ ----------SPCS | FGQGT KLEIK |
| iPS:435_727 | 21-225_172E1 | VK4|B3/J K2 | DIVMTQSPDSLAV SLGERATINC | KSS--- QSVLYSSNNCN YLA | WYQQKPGQ PPKLLIP | W------- ASTRES | GVPDRFSGSGSG-- TDFTLTISGLQAEDVAVYYC | QQYFT------------ ----------TPCS | FGQGT KLEIK |
| iPS:436_560 | 21-225_224F11 | VK4|B3/J K2 | DIVMTQSPDSLAV SLGERATINC | KSS--- QSVLSSSNNHN YLA | WYQQKPGQ PPKMLIY | W------- TSTRES | GVPDRFSGSGSG-- TDFTLTISSLQAEDVAVYYC | QQYYT------------ ----------TPCS | FGQGT KLEIK |
| iPS:436_584 | 21-225_225B9 | VK4|B3/J K2 | DIVMTQSPDSLAV SLGERATINC | KSS--- QSVLYSSNNNN YLA | WYQQKPGQ PPKLLIY | W------- ASTRES | GVPDRFSGSGSG-- TDFTLTISSLQAEDVAVYYC | QHSKS------------ ----------IPGK | FGQGI KLEIQ |
| iPS:436_588 | 21-225_225F12 | VK4|B3/J K2 | DIVMTQSPDSLAV SLGERATINC | KSS--- QSVLYSSNNQN YLA | WYQQKPGQ PPRLLIY | W------- TSTRES | GVPDRFSGSGSG-- TDFTLTISNLQAEDVAVYYC | QQYYI------------ ----------TPCS | FGQGT KLEIK |
| iPS:436_590 | 21-225_225H12 | VK4|B3/J K2 | DIVMTQSPDSLAV SLGERATINC | KSS--- QSVLYNSNWNN YLA | WYQQKPGQ PPNLLIY | W------- ASTRES | GVPDRFSGSGSG-- TDFTLTISSLQTEDVAVYYC | QQYYI------------ ----------TPCS | FGQGT KLEIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:436 598 | 21-225_226D6 | VK4\|B3/JK2 | DIVMTQSPDSLAV SLGERATINC | RSS---QSILYISNNKN YLA | WYQQKPGQ PPKMLIY | W-------ASTRES | GVPDRFSGSGSG---TDFTLTISSLQAEDVAVYYC | QQYYS-------SPCS | FGQGT KLEIK |
| iPS:436 636 | 21-225_227E6 | VK4\|B3/JK2 | DIVMTQSPDSLTV SLGERATINC | KSS---QSVLYSSNDKN YLA | WYQQKPGQ PPKMLIY | W-------ASTRES | GVPDRFSGSGSG---TDFTLTISSLQAEDVAVYYC | QQYYT-------TPCS | FGQGT KLEIK |
| iPS:436 644 | 21-225_227G9 | VK4\|B3/JK2 | DIVMTQSPDSLAV SLGERATINC | KSS---QSVLHSSNNNN YLA | WYQQKPGQ PPKLLIY | W-------GSTRES | GVPDRFSGSGSG---TDFTLTISSLQAEDVAVYYC | QQYYS-------APYS | FGQGT KLEIK |
| iPS:436 646 | 21-225_227D1 | VK4\|B3/JK2 | DIVMTQSPDSLAV SLGERATINC | KSS---QSVLHSSNNNN YLA | WYQQKPGQ PPKLLIY | W-------ASTRES | GIPDRFSGSGSG---TDFTLTISSLQAEDVAVYYC | QQYYN-------TPCS | FGQGT KLEIK |
| iPS:437 363 | 21-225_74C10 | VK4\|B3/JK2 | DIVMTQSPDSLAV SLGERATINC | KSS---QSVLYSSNNAN YLA | WYQQKPGQ PPNLLIY | W-------ASTRES | GVLDRFSGSGSG---TDFTLTISSLQAEDVAVYYC | QQYYS-------TPCS | FGQGT KLEIK |
| iPS:451 131 | 21-225_160A7 | VK4\|B3/JK2 | DIVLTQSPDSPAV SLGERATINC | KSS---QSVLSNSHNNN YLA | WYQQRPGH PHKLLIF | W-------ASTRES | GVLDRFSGSGYG---TDFTLTISSLQAEDVAVYYC | QQYYS-------TPCS | FGQGT KLEIK |
| iPS:393 088 | 21-225_33D1 | VK4\|B3/JK2 | DIVMTQSPDSLSV SLGERATINC | KSI---QSVLYRSNNKN YLT | WYQQKPGQ PRKLFIY | W-------ASTRES | GVLDRFSGSGCG---TDFTLTISSLQAEDVAVYYC | QQYYS-------SPCS | FGQGT KLEIK |
| iPS:394 085 | 21-225_8B11 | VK4\|B3/JK2 | DIVMTQSPDSLAV SLGERATINC | KSS---QNVLYNSNSNVN YLA | WYQQKPGQ PPKLLIY | W-------ASTRKS | GVPDRFSGSGSG---TYFTLTISSLQAEDVAVYYC | QQYYT-------TPCS | FGQGT KLEIK |
| iPS:398 496 | 21-225_22D2 | VK4\|B3/JK2 | DIVMTQSPDSLAV SLGERATITC | KSS---QSVLHSSNNNN YLA | WYQQKPGQ PPKLLIY | W-------ASTRKS | GVPDRFSGSGSG---TDFTLTISSLQAEDVAVYYC | QQYYS-------TPCS | FGQGT KLEIK |
| iPS:398 512 | 21-225_25E12 | VK4\|B3/JK2 | DIVLTQSPDFLAM SLGERATINC | KSS---QSVLYHSNNYN YLA | WYQQKPGQ PPKLLIY | W-------ASTRES | GVPDRFSGSGSG---TYFTLTISSLQAEDVAVYYC | QQYYS-------TPCS | FGQGT NLEIK |
| iPS:398 522 | 21-225_32A1 | VK4\|B3/JK2 | DIVMTQSPDSLAV SLGERATINC | KSS---QSVLYRSNNKN YLA | WYQLKPGQ PPKLLIY | W-------ASTRES | GVPDRFSGSGSG---TDFTLTISSLQTEDVAVYYC | QQYYT-------SPCS | FGQGT KLEIK |
| iPS:398 524 | 21-225_32A5 | VK4\|B3/JK2 | DIVMTQSPDSLAV SLGERATINC | KSS---QSVLYSSNNYN YLA | WYQLKPGQ PPKLLIY | W-------ASTRKS | GVPDRFSGSGSG---TDFTLAISSLQAEDVALYHC | QQYYS-------SPCS | FGQGT GLEIK |
| iPS:398 538 | 21-225_34H7 | VK4\|B3/JK2 | DIVMTQSPDSLAV SLGERATINC | KSS---QSVLYSSNNYN YLA | WYQLKPGQ PPKLLIY | W-------ASTRKS | GVPDRFSGSGSG---TDFTLTISSLQTEDVALYYC | QQYYT-------SPCS | FGQGT KLEIK |
| VK2\|A17\|JK4 | | Germline | DVVMTQSPLSLPV TLGQPASISC | RSS---QSLVYSD-GNTYLN | WFQQRPGQ SPRRLIY | E-------VSKWDS | GVPDRFSGSGSG---TDFTLKISRVEAEDVGVYYC | MQGTH-------WPLT | FGGGT KVEIK |
| iPS:468 854 | 21-225_72C4 | VK2\|A17/JK4 | DVVMTQSPLSLPV TLGQPASISC | RSG---QSLVYSD-GNTYLN | WFQQRPGQ SPRRLIY | E-------VSKWDS | GVPDRFSGSGSG---TNFTLKISRVEAEDVGVFYC | MQGTH-------WPLT | FGGGT KVEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:437250 | 21-225_148C6 | VK2|A17/JK4 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGVYYC | MQGTH------ ------WSLT | FGGGT KVEIK |
| iPS:437252 | 21-225_148H1 | VK2|A17/JK4 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGVYYC | MQGTH------ ------WLLT | FGGGT KVEIK |
| iPS:437254 | 21-225_149F2 | VK2|A17/JK4 | DVVMTQSPLSLPV TLGQPASISC | RSS--- QSLVYSD- GNTYLN | WFQQRPGQ SPRRLIY | K------- VSNWDS | GVPVRFSGSGSG--- TDFTLKISRVEAEDVGIYYC | MQGTH------ ------WPPT | FGGGT KVEIK |
| iPS:437256 | 21-225_150F11 | VK2|A17/JK4 | DVVMSQVFLSLFV TFGQPASISC | RSS--- QSLVYSD- GNTSLN | WFQQRPGQ YPRRLIY | K------- VSNWDY | GVPDRFSGSGSG--- TDFTLKISRVEAEDVGVYYC | MQGTH------ ------WPPT | FGGGT KVEIK |
| iPS:437268 | 21-225_177D2 | VK2|A17/JK4 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGVYYC | MQGTH------ ------WFLT | FGGGT KVEIK |
| iPS:443005 | 21-225_43F11_LC1 | VK2|A17/JK4 | DVVMTQSPLSLPV TLGQPASISC | RSS--- QSLVYSV- GNTSLS | WFQQRPGQ SPRRLIY | K------- VSNWDS | GVPDRFSGSGSG--- TDFTLKISRVEAEDVGVYYC | MQGTH------ ------WFLT | FGGGT KVEIK |
| iPS:398530 | 21-225_32G4 | VK2|A17/JK4 | DVVMTQSPLSLSV TLGQPASISC | RSS--- QSLVYSD- GDTYLN | WFQQRPGQ SPRRQIY | K------- VSNWDS | GVPDRFSGSGSG--- TDFTLKISRVEAEDVGVYYC | MQGI------- ------HWLT | FGPGI KVEIK |
| | Germline | | K_FR1 | K_CDR1 | K_FR2 | K_CDR2 | K_FR3 | K_CDR3 | K_FR4 |
| | VK2|A17|JK3 | | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGVYYC | MQGTH------ ------WPFT | FGGGT KVDIK |
| iPS:468856 | 21-225_77C9 | VK2|A17/JK3 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGYYR | MQGTH------ ------WPFT | FGPGT KVDIK |
| iPS:392936 | 21-225_28B6 | VK2|A17/JK3 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLNISRVEAEDVGIYFC | MHCT------- ------HWLL | FGPGI KVDIK |
| | Germline | | K_FR1 | K_CDR1 | K_FR2 | K_CDR2 | K_FR3 | K_CDR3 | K_FR4 |
| | VK2|A17|JK5 | | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISRVEAEDVGVYYC | MQGTH------ ------WFFT | FGQGT RLEIK |
| iPS:472741 | 21-225_30D9_LC1 | VK2|A17/JK5 | DVVMTQSPLSLPV TLGQPASISC | RSS--- QSLVSSD- GNTFLN | WFQQRPGQ SPRRLIY | K------- VSNWDS | GVPDRFSGSGSG--- TDFTLKISRLEAEDVGVYYC | LQGTH------ ------WPLT | FGQGT RLEIK |
| iPS:437294 | 21-225_216D5 | VK2|A17/JK5 | DVVMTQSPLSLPV TLGQPASISC | RSS--- QSLVYSD- GNTYLN | WFQQRPGQ SPRRLIY | K------- VSNWDS | GVPDRISGSGSG--- TDFTLKISRVEAEDVGVYYC | MQGA------- ------HWFT | FGPGT RLEIK |
| iPS:472732 | 21-225_2B10_LC1 | VK2|A17/JK5 | DVVMTQSPLSLPV TLGQPASISC | RSS--- QSLVYSD- GNTFLN | WFQQRPGQ SPRRLIY | K------- VSNWDS | GVPDRFSGSGSG--- TGFTLKISRVEAEDVGVYYC | IQGTH------ ------WPFP | FGQGT RLEIK |
| iPS:398508 | 21-225_24B1 | VK2|A17/JK5 | DVVMTQSPLSLPV TLGQPASISC | RSS--- QSLVYSD- GNTYLN | WFQQRPGQ SPRRLIY | K------- VSNWDS | GVPDRFSGSGSG--- TDFTLKISWVEAEDVGVCYC | MQGAH------ ------WPIT | FGQGT RLEIK |

Figure 51 (Continued)

| | VK2|A17/JK5 | K_FR1 | K_CDR1 | K_FR2 | K_CDR2 | K_FR3 | K_CDR3 | K_FR4 |
|---|---|---|---|---|---|---|---|---|
| iPS:423_019 | 21-225_31D12_LC1 | DVVMTQSPLSLPVTLGQPASISC | RSS------QSLIYSD-GNTFLN | WFQQRPGQSPRRLIY | K-------VSNWDS | GVPDRFSGSGSG------TDFTLKISRLEADVGIYYC | MQGTH--------WPLI | FGGGTRLEIK |
| | Germline | K_FR1 | K_CDR1 | K_FR2 | K_CDR2 | K_FR3 | K_CDR3 | K_FR4 |
| | VK1|L5/JK1 | | | | | | | |
| iPS:433_897 | 21-225_43C2 | DIQMTQSPSSVSASVGDRVTITC | RAS---QGIS-------NWLA | WYQQKPGKAPKLLIY | A-------ASSLQS | GVPSRFSGSGSG------TDFTLTISNLQPEDFATYYC | QQTNS--------FPWT | FGQGTKVEIK |
| iPS:433_903 | 21-225_43H4 | DIQMTQSPSSVSASVGDRVTITC | RAS---QGII-------NWLA | WYQQKPGKAPKLLIY | A-------ASSLQS | GVPSRFSGSGSG------TDFTLTISNLQPEDFATYYC | QQTNS--------FPWT | FGQGTKVEIK |
| iPS:433_911 | 21-225_43E8 | DIQMNQSPSSVSASVGDRVTITC | RAS---QGIS-------NWLA | WYQQKPGKAPKLLIY | A-------ASSLQS | GVPSRFSGSGSG------TDFTLTISNLQPEDFATYYC | QQTNS--------FPWT | FGQGTKVEIK |
| iPS:433_941 | 21-225_44D10 | DIQMTQSPSSVSASVGDRVTITC | RAS---QGIS-------DWLA | WYQQKPGKAPKLLIY | A-------ASSLQS | GVPSRFSGSGSG------TDFTLTISNLQPEDFATYYC | QQTNS--------FPWT | FGQGTKVEIK |
| iPS:433_945 | 21-225_44C12 | DIQMTQSPSSVSASVGDRVTITC | RAS---QGIS-------NWLA | WYQQKPGKAPKLLIS | A-------AFSLQS | GVPSRFSGSGSG------TDFTLSISSLQPEDFATYYC | QQSNS--------FPWT | FGQGTKVEIK |
| iPS:433_957 | 21-225_45F8 | DIQMTQSPSSVSASVGDRVTITC | RAS---QGIS-------NWLA | WYQQKPGKAPKLLIY | G-------ASSLQS | GVPSRFSGSGSG------TDFTLTISNLQPEDFATYYC | QQTNS--------FPWT | FGQGTKVEIK |
| iPS:433_973 | 21-225_46A6 | DIQMNQSPSSVSASVGDRVTITC | RAS---QGIS-------NWLA | WFQQKPGKVPKLLIY | A-------ASSLQS | GVPSRFSGSGSG------TDFTLTISNLQPEDFATYYC | QQTNS--------FPWT | FGQGTKVEIK |
| iPS:433_993 | 21-225_47G7 | DIQMTQSPSSVSASVGDRVTITC | RAS---QGIS-------NWLA | WYQQKPGKAPKLLIY | A-------ASNLQS | GVPSRFSGSGSG------TDFTLTISSLQPADFATYCC | QQVNS--------FPWT | FGQGTKVEIK |
| iPS:434_007 | 21-225_48D7 | DIQMTQSPSSVSASVGDRVTITC | RAS---QNIT-------SWLA | WYQQKPGKAPKLLIY | S-------ASSLQN | GVPSRFSGSGSG------TDFTLTISSLQPEDFVTYYC | QQANS--------FPWT | FGQGTKVEIK |
| iPS:434_063 | 21-225_51G7 | DIQMTQSPSSVSASVGDRVTITC | RAS---QDIS-------SWLA | WYQQKPGKAPKVLIY | A-------FSNLQS | AVPSRFSGSGSG------TDFTLTISSLQPEDFATYYC | QQAHS--------FPWT | FGQGTKVEIK |
| iPS:434_083 | 21-225_52H2 | DIQMTQSPSSVSASVGDRVTITC | RAS---QNIT-------NWLA | WFQQKPGRAFKLLIY | T-------TSSLQS | GVPSRFSGSGSG------TDFTLTISSLQPEDFATYYC | QQTNS--------FPWT | FGHGTKVEVK |
| iPS:434_133 | 21-225_54G3 | DIQMTQSPSSVSASVGDRVTITC | RAS---QGIS-------SWLA | WYQQKPGKAPKLLIY | D-------ASSLQS | GVPSRFSGSGSE------TDFTLTISSLQPEDFATYYC | QQANS--------FPWT | FGQGTKVEIK |
| iPS:434_221 | 21-225_60A11 | DIQMTQSPSSVSASVGDRVTITC | RAS---QVIS-------NWLA | WYQLKPGKAFKLLIY | T-------ASSLQS | GVPSRFSGNESG------TDFTLTISSLQPEDFATYYC | QQANS--------FPWT | FGQGTKVEIK |
| iPS:434_283 | 21-225_57F8 | DIQMTQSPSSVSASVGDRVTITC | RAS---QGIS-------NWLA | WYQQKPGKAPKLLIY | T-------ASSLQS | TDFTLTISSLQPEDFATYYC | QQANS--------FPWT | FGQGTKVEIK |
| iPS:435_711 | 21-225_171G4 | DIQMTQSPSSVSASVGDRVTITC | RAS---QGVN-------DWLA | WYQQKPGRAFKLLIY | D-------ASSLQS | GVPSRFSGSGSG------TDFTLTISSLQPEDFATYYC | QQTNS--------FPWT | FGQGTKVEIK |
| iPS:435_715 | 21-225_171A8 | AIQMTQSPSSVSASVGDRVTITC | RAS---QGIS-------NWLA | WYQQKPGKAPNLMIH | A-------APSLQG | GVPSRFSGSGSG------TDFTLTISSLQPEDFATYYC | QQTNS--------FPWT | FGQGTKVEIK |
| iPS:435_717 | 21-225_171A9 | DIQMTQSPSSVSASVGDRVTITC | RAS---QDIT-------TWLA | WYQLKPGRAFKLLIY | D-------ASSLQS | AVPSRFSGNESG------TDFTLTVSSLQPEDFATYYC | LQTNS--------FPWT | FGQGTKVEIK |
| iPS:435_739 | 21-225_174G7 | AIQMTQSPSSVSASVGDRVTITC | RAS---QGIS-------NWLA | WYQQKPGKAPNLLIH | A-------AFSLQG | GVPSRFSGSGSG------TDFTLTISSLQPEDFATYYC | QQTNS--------FPWT | FGQGTKVEIK |
| iPS:435_749 | 21-225_175C10 | DIQMTQSPSSVSASVGDRVTITC | RAS---QGIT-------DWLA | WYQQKPGKAPKLLIY | A-------ASSLQS | GVPSRFNGSGSG------TDFTLTIFSSLQPEDFATYYC | QQANS--------LPWT | FGQGTKVEIK |
| iPS:435_775 | 21-225_178A5 | | | | | | | |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:435777 | 21-225_178F7 | VK1|L5/J K1 | DIQMTQSPSSVSA SVGDRVTITC | RAS--QDIT- ----DWLA | WYQQKPGK APKLLIS | A------ ASSLQS | GVPSRFSGSGSG-- TDFTLTIAISSLQPEDFATYYC | QQANS------ -------LFWT | FGQGT KVEIK |
| iPS:435783 | 21-225_179G1 | VK1|L5/J K1 | DIQMTQSPSSVSA SVGDRVTITC | RAS--QIS- ----DWLA | WYQQKSGK APKLLIS | A------ ASSLQS | GVPSRFSGSGSG-- TDFTLTISSLQPEDFATYSC | QQANS------ -------LFWT | FGQGT KVEIK |
| iPS:435875 | 21-225_190B9 | VK1|L5/J K1 | DIQMTQSPSSVSA SVGDRVTITC | RAS--QGIN- ----NWLA | WYQQKPGK APKLLIY | G------ VSSLQS | GVPSRFSGSGSG-- TDFTLTISSLQPEDFATYYC | QQANS------ -------FPWT | FGQGT KVEIK |
| iPS:435895 | 21-225_188E8 | VK1|L5/J K1 | DIQMTQSPSSVSA SVGDRVTITC | RAN--QDIS- ----SWLA | WYQQKPGK APKLLIY | A------ ASNLQS | GVPSGFSGSGSG-- TDFTLTISSLQPEDFATYYC | QQANS------ -------FPWT | FGQGT KVEIK |
| iPS:435909 | 21-225_190H3 | VK1|L5/J K1 | DIQMTQSPSSVSA SVGDRVTITC | RAS--QGLN- ----NWLA | WYQLKPGK APKLLIY | A------ VSSLQS | GVPSRFSGSGSG-- SEFTLTISSLQPEDFATYHC | QQANS------ -------LPWT | FGQGT KVEIK |
| iPS:436013 | 21-225_193F2 | VK1|L5/J K1 | DIQMTQSPSSVSA SVGDRVTITC | RAS--QGIN- ----NWLA | WYQQKPGK APKLLIY | G------ VSSLQS | GVPSRFSGSGSG-- TDFTLTISSLQPEDFATYSC | QQANS------ -------FPWT | FGQGT KVEIK |
| iPS:436068 | 21-225_194F7 | VK1|L5/J K1 | DIQMTQSPSSVSA SVGDRVTITC | RAS--QGIS- ----RWLA | WFQQKPGK APKILLY | A------ ASSLQS | GVPSRFSGSGSG-- TDFTLTISSLQPEDFATYYC | QQANS------ -------FPWT | FGQGT KVEIK |
| iPS:436100 | 21-225_195G1 | VK1|L5/J K1 | DIQMTQSPSSVSA SVGDRVTITC | RAS--QGIN- ----NWLA | WYQQKPGK APKLLIY | G------ VSSLQS | GVPSRFSGSGSG-- TDFTLTISSLQPEDFATYYC | QQANS------ -------FPWT | FGRGT KVENQ |
| iPS:436116 | 21-225_196B9 | VK1|L5/J K1 | DIQMTQSPSSVSA SVGDRVTITC | RAS--QGIS- ----NCLA | WYQQKPGK APKFLIC | A------ ASSLQS | AVPSRFSGSGSG-- TDFTLTISSLQPEDFASYYC | QQGDS------ -------FPPT | FGQGT KVEFR |
| iPS:436160 | 21-225_197C9 | VK1|L5/J K1 | DIQMTQSPSSVSA SVGDRVTITC | RAS--QGIS- ----NWLA | WFQQKPGK APQLLIY | A------ ASSLQS | GVPSRFSGSGSG-- TDFSLTISSLQPEDFATYYC | QQANS------ -------FPWT | FGQGT KVEIK |
| iPS:436546 | 21-225_224D6 | VK1|L5/J K1 | DIQMTQSPSSVSA SVGDRVTITC | RAS--QGIS- ----SWLA | WYQQKPGK APKLLIY | G------ ASSLQS | GVPSRFSGSGSG-- IEFTLTISSLQPEDFATYYC | QQANS------ -------FPWT | FGPGT KVEIK |
| iPS:436632 | 21-225_227E4 | VK1|L5/J K1 | DILMTQSFSSVSA SVGDRVTITC | RAS--QGII- ----NWLA | WYQQKPGK APKLLIY | A------ ASSLQS | GVPSRFSGSGSG-- TDFTLTISSLQPEDFATYYC | QQSDS------ -------FPWT | FGQGT KVEIK |
| iPS:436650 | 21-225_17A4 | VK1|L5/J K1 | DIQMTQSPSSVSA SVGDRVTITC | RAS--QGIG- ----NWLA | WYQQKPGK APKLLIF | A------ ASSLQS | GVPSRFSASGSG-- TDFTLTISSLQPEDFATYCC | QQSDS------ -------FPRT | FGQGT KVEIK |
| iPS:436728 | 21-225_20F7 | VK1|L5/J K1 | DIQMTQSPSSVSA SVGDRVTITC | RAS--QGIS- ----SWLA | WYQQKPGK APKLLIY | A------ ASSLQS | GVPSRFSGSGSG-- TDFTLTISSLQPEDFATYYC | QQANS------ -------FPRT | FGQGT KVEIK |
| iPS:392916 | 21-225_27C5 | VK1|L5/J K1 | DIQMTQSPSSVSA SVGDRVTITC | RAS--QGIS- ----SWLA | WYQQKPGK APKFLIY | G------ ASSLQS | GVPSRFSASGSG-- IEFTLTISSLQPEDFATYCC | QQYDS------ -------FPWT | FGQGT KVEIK |
| iPS:392956 | 21-225_27A11 | VK1|L5/J K1 | DIQMTQSPSSVSA SVGDRVTITC | RAS--QGIS- ----SWLA | WYQQKPGK APKLLIY | A------ ASSLQS | GVPSRFSGSGSG-- TDFTLTISSLQPEDFATYYC | QQSDS------ -------FPRT | FGQGT KVEIK |
| iPS:393014 | 21-225_26D12 | VK1|L5/J K1 | DIQMTQSPSSVSA SVGDRVTITC | RAS--QGIS- ----SWLA | WYQQKPGK APKLLIY | G------ ASSLQS | GVPSRFSASGSG-- TDFTLTISSLQPEDFATYYC | QQSDS------ -------FPRT | FGQGT KVEIK |
| iPS:393028 | 21-225_25D7 | VK1|L5/J K1 | DIQMTQSPSSVFTC SVGDRVTFTC | RAS--QDIF- ----DRLA | WYQQKPGT APKLLIY | A------ ASSLQS | GVPSRFSGSGSG-- INFTLTVSGLQPEDFATYYC | QQAYS------ -------FPWT | FGQGT KVEIK |
| iPS:393152 | 21-225_25B3 | VK1|L5/J K1 | DIQMTQSPSSVSA SVGDRVTITC | RAS--QGIS- ----SWLA | WYQQKPGK APKLLIY | G------ ASSLQS | GVPSRFSGSGSG-- TDFTLTISSLQPEDFATYYC | QQSDS------ -------FPRT | FGQGT KVEIK |
| iPS:393810 | 21-225_5A4 | VK1|L5/J K1 | DIQMTQSPSSVSA SVGDRVTITC | RAS--QGIS- ----TWLA | WYQQKPGK APKLLIY | D------ ASSLQS | GVPSRFSGSGSG-- TDFTLTISSLQPEDFATYYC | QQANS------ -------FPWT | FGQGT KVEIK |
| | Germline | | K_FR1 | K_CDR1 | K_FR2 | K_CDR2 | K_FR3 | K_CDR3 | K_FR4 |

Figure 51 (Continued)

| | | | FR1 | CDR1 | FR2 | CDR2 | FR3 | CDR3 | FR4 |
|---|---|---|---|---|---|---|---|---|---|
| iPS:433 943 | 21-225_44E10 | VK2/A19/ JK3 | DIVMTQSPLSLPV TPGEPASISC | RSS--QSLLHSN-GYSYLE | WYLQKPGQ SPQLLIY | L---GSNRAS | GVPDRFSGSGSG--TDFTLKISRVEAEDVGVYYC | MQILQ-------TPFT | FGPGT KVDIK |
| iPS:433 989 | 21-225_47C7 | VK2/A19/ JK3 | DIVMTQSPLSPPV TPGEPASISC | RSS--QSLLHSN-GYNYLE | WYLQKSGQ SPQFLIY | L---GFNRAS | GVPDRFTGSGSG--TDFTLKISRVEAEDVGVYYC | MQVLQ-------TPFT | FGPGT KVDIK |
| | Germline | VK1|O12/ JK3 | | | | K_CDR2 | K_FR3 | K_CDR3 | K_FR4 |
| iPS:433 999 | 21-225_48D1 | VK1|O12/ JK3 | DIQMTQSPSSLSA SVGDRVNITC | RAS--QSIS------SYLI | WYQQKPGK APKLLIY | A-------ASSLQS | GVPSRFSASGSG--TDFTLTISSLQPEDFASYYC | QQSNS-------IPFT | FGPGT KVDIK |
| iPS:434 003 | 21-225_48C3 | VK1|O12/ JK3 | DIQMTQSPSSLSA SVGDRVNITC | RAS--QSII------SYLI | WYQQKPGK APRLLIY | A-------ASSLQS | GVPSRFSASGSG--TDFTLTISSLQPEDFASYYC | QQTNS-------IPFT | FGPGT KVDIK |
| iPS:434 037 | 21-225_49G12 | VK1|O12/ JK3 | DIQMTQSPSSLSA SVGDRVTIIC | RSS--QSIS------TYLM | WYQQKPGK APKLLIY | A-------ASSLQI | GVPSEFSASGSG--TDFTLTISSLQPEDFATYYC | QQSYS-------IPFT | FGPGT KVDIK |
| iPS:434 041 | 21-225_50H8 | VK1|O12/ JK3 | DIQMTQSPSSLSA SVGDRVNITC | RAS--QSIS------SYLI | WYQQKPGK APKLLIY | A-------ASSLQS | GVPSRFSASGSG--TDFTLTISSLQPEDFASYYC | QQSNS-------LPFT | FGPGT KVDIK |
| iPS:434 045 | 21-225_50H10 | VK1|O12/ JK3 | DIQMTQSPSSLSA SVGDRVNITC | RAS--QSIY------SYLI | WYQQKPGK APKLLIY | A-------ASSLQS | GVPSRFSASGSG--TDFTLTISSLQPEDFASYYC | QQSNS-------IPFT | FGPGT KVDIK |
| iPS:434 049 | 21-225_50B12 | VK1|O12/ JK3 | DIQMTQSPSSLSA SVGDRVTITC | RAS--QSIS------SYLN | WYQHKPGK APRLLIY | A-------ASSLQS | GVPSEFSGSESG--TDFTLTISSLQPEDFTTYYC | QQSYI-------APFT | FGPGT KVDIK |
| iPS:434 073 | 21-225_51H10 | VK1|O12/ JK3 | DIQMTQSPSSLSA SVGDRVTITC | RAS--QSFS------TYLM | WYQQKPGK APKLLIF | A-------ASSLQS | GVPSRFSGSGSG--SDFTLPISSLQPEDFAIYFC | QQSYS-------IPFT | FGPGT KVDIK |
| iPS:434 107 | 21-225_53E2 | VK1|O12/ JK3 | DIQMTQSPSSLSA SVGDRVTITC | RAS--QSFS------HYLN | WYQQKPGK APNLLIF | A-------ASSLQI | GVPSRFSGSGSG--TDFTLTISSLQPEDFAIYFC | QQSFS-------TPFT | FGPGT KVDIK |
| iPS:434 181 | 21-225_56B2 | VK1|O12/ JK3 | DIQMTQSPSSLSA SVGDRVTITC | RAS--QSFS------HYLN | WYQQKPGK AFNLLIF | V-------VSSLQS | GVPSRFSGSGSG--TDFTLTISSLQPEDFAIYFC | QQSYN-------TPFT | FGPGT KVDIK |
| iPS:434 225 | 21-225_60E12 | VK1|O12/ JK3 | DIQMTQSPSSLSA SVGDRVTITC | RAS--QSIS------SYLN | WYQQKPGK APKLLIY | A-------ASSLQS | GVPSRFSGSGSG--TDFTLTISSLQPEDFAPYYC | QQSYN-------ISFT | FGPGT KVDIK |
| iPS:434 227 | 21-225_61A1 | VK1|O12/ JK3 | DIQMTQSPSSLSA SVGDRVTITC | RAS--QSIS------SYLN | WYQQKPGK APKLLIY | A-------ASSLQS | GVPSRLSGNGSG--TDFTLTISSLQPEDFATYYC | QQSYN-------ISFT | FGPGT KVDIK |
| iPS:434 245 | 21-225_62H1 | VK1|O12/ JK3 | DIQMTQSPSSLSA YVGDRVTITC | RAS--QNIF------SYLN | WYQQKPGK APKVLIY | A-------VFSLQS | GVPSRFSGSGSG--TDFTLTISSLQPEDFATYYC | QQSYS-------TPFT | FGPGT KVDIK |
| iPS:434 267 | 21-225_57F2 | VK1|O12/ JK3 | DIQMTQSPSSLSA SVGDRVTITC | RAS--QSIF------SYLN | WYQQKPGK AFKLLIY | A-------ASSLQS | GVPSRFSGSGSG--TDFTLTISSLQPEDFAPYYC | QQSYN-------ISFT | FGPGT KVDIK |
| iPS:434 323 | 21-225_62H8 | VK1|O12/ JK3 | DIQMTQSPSSLSA SVGDRVTITC | RAS--QSIF------SYLN | WYQQKPGK APKLLIF | A-------ASSLQS | GVPSRFSGSGSG--TDFTLTISSLQPEDFATYYC | QQTYS-------VPFT | FGPGT KVDFK |
| iPS:434 379 | 21-225_66A9 | VK1|O12/ JK3 | DIQMTQSPSSLSA SVGDRVTITC | RAG--QTIY------NYLN | WYQQKPGK APKLLIH | V-------ASSLQS | GVPSRFSGSGSG--TDFTLVISSLQPEDFATYYC | QQSYS-------TPFT | FGPGT KVDIK |
| iPS:434 417 | 21-225_69C8 | VK1|O12/ JK3 | DIQMTQSPSSLPA SVGDRVTITC | RAS--QNIR------NYLN | WYQFLPGK APKLLIY | T-------ASTLQS | GVPSRFSGSGSG--TDFTLTISSLQPEDFATYYC | QQSYN-------IPFT | FGPGT KVDIK |
| iPS:435 545 | 21-225_158F4 | VK1|O12/ JK3 | DIQMTQSPSSLSA SVGDRVTITC | RAS--QTIL------KYLH | WYQQKPGK AFKLLIY | G-------VSSLQS | GVPSRLSGNGSG--TDFTLTISSLQPEDFATYYC | QQSYS-------ISFT | FGPGT KVDIK |
| iPS:435 793 | 21-225_180F8 | VK1|O12/ JK3 | DIQMTQSPSSLSA SVGDGVTITC | RAS--QNIS------SYLN | WYQQKPGK APKLLIY | T-------ASSLQS | GVSSRFSGSGSG--TDFTLTISSVHRDEFAIYYC | QQYF-------TPFT | FGRGT KVDIK |
| iPS:436 504 | 21-225_222H4 | VK1|O12/ JK3 | DIQMTHSPSSLSA SVGDRVTITC | RAS--QNIS------NYVN | WYQQKPGK APKFLIY | T-------ASSLQS | | | |

Figure 51 (Continued)

| | | | | | | | | |
|---|---|---|---|---|---|---|---|---|
| PS:436 510 | 21-225 | 222H8 | VK1|O12/ JK3 | DIQMTHSPSSLSA SVGDRVTITC | RAS--QNIS-- ----NYVN | WYQQKPGK APKFLIY | I------- ASSLQS | GVSSRFSGSGSG-- TDFTLTISSVHRDDFATYYC | QQYYF------- -----TPFT | FGHGT KVDIK |
| PS:437 230 | 21-225 | 62H10 | VK1|O12/ JK3 | DIQMTQSPSSLSA SVGDRVTITC | RAS--QSIT-- ----SYLN | WYQQKPGK VPKLLIS | T------- ASSLQS | GVPSRFSGSGSG-- TDFTLTISSLQPEDFATYYC | QQSHS------- -----FPFT | FGPGT NVDFK |
| PS:448 906 | 21-225 | 72G9 | VK1|O12/ JK3 | DIQMTQSPSSLSA SVGDRVTITC | RAS--QSIT-- ----SYLN | WYQQKPGK APKLLIY | I------- ASSLQS | GVPSRFSGSGSG-- TDFTLTISSLQPEDFATYYC | QQSHS------- -----FPFT | FGPGT KVDIK |
| PS:392 652 | 21-225 | 17C6 | VK1|O12/ JK3 | DIQMTQSPSSLSA SVGDRVTITC | RAS--QSIN-- ----TYLN | WYQQKPGK APKLLIY | A------- ASSLQS | GVSSRFSGSGSG-- TDFTLTISSLQPEDFATYYC | QQSYR------- -----TPFFT | FGPGT KVDIK |
| PS:392 660 | 21-225 | 19B3 | VK1|O12/ JK3 | DIQMTQSPSSLSA SVGDRITITC | RAG--QNII-- ----NYLN | WYQQKPGK APNLLIY | V------- ASSLQS | GVPSRFNGSGSG-- TDFTLTISSLQPEDFATYYC | ------------ -----TPFT | FGPGT KVDIK |
| PS:392 668 | 21-225 | 17B4 | VK1|O12/ JK3 | DIQMTQSPSSLSA SVGDRVTITC | RAS--QNIS-- ----SYLN | WYQQKPGK APKLLIF | G------- ASSLQT | GVPSRFSGSGSG-- TDFTLTISSLQPEDFATYYC | QQSYR------- -----TPFFT | FGPGT KVDIK |
| PS:392 678 | 21-225 | 20F3 | VK1|O12/ JK3 | DIQMTQSPSSLSA SVGDRVTITC | RAS--QSIS-- ----SYLY | WYQQKPGK APKLLIY | A------- ASSLQS | GVPSRFSGSGSG-- TDFTLTISSLQPEDFATYYC | QQSYS------- -----APPFT | FGPGT KVDIK |
| PS:392 694 | 21-225 | 19A5 | VK1|O12/ JK3 | DIQMTQSPSSLSA PVGDRVSITC | RAS--QNII-- ----NYLN | WYQQKPGK APKLLID | V------- ASNLQG | GVPSRFSGSGSG-- TDFTLTISSLQPEDFATYYC | QQSYR------- -----TPFT | FGPGT KVDIK |
| PS:392 696 | 21-225 | 20A4 | VK1|O12/ JK3 | DIQMTQSPAASLSA SVGDRVTITC | RAS--QSII-- ----NYLN | WYQQRPGK SPKLLIY | A------- ASSLHS | GVSSRFSGSGSG-- TDFTLTINSLQPEDFATYYC | QQSYR------- -----TPLFT | FGPGT NVDFK |
| PS:392 702 | 21-225 | 17F7 | VK1|O12/ JK3 | DIQMTQSPSSLSA SVGDRVTITC | RAS--QTIS-- ----SFLN | WYQQKPGK APKLLIY | A------- ASSLQS | GVPSRFSGSGSG-- TDFTLTISSLQPEDFATYYC | QQSYR------- -----TPFFT | FGPGT KVDIK |
| PS:392 704 | 21-225 | 17F11 | VK1|O12/ JK3 | DIQMTQSPSSLSA SIGDRVSITC | RAS--RTIN-- ----NYLN | WYQQKPGK APKLLIF | A------- TSSLQS | GVPSRFSGSGSG-- TDFTLTISSLQPEDFATYYC | QQTYS------- -----TPLFA | FGPGT KVDIK |
| PS:392 720 | 21-225 | 17A12 | VK1|O12/ JK3 | DIQMTQSPSSLSA SVGDRVTITC | RAS--QSIS-- ----SYLN | WYHQKPGK APKLLIY | A------- ASSLQS | GVPSRFSGSGSG-- TDFTLTINLQPEDFATYYC | QQSFR------- -----TPLFT | FGPGT KVDIK |
| PS:392 722 | 21-225 | 18E12 | VK1|O12/ JK3 | DIQMTQSPSSLSA SVGDRVTITC | RAS--QSIS-- ----SYLN | WYQQKPGK APTLLIY | A------- ASSLQS | GVSSRFSGSGSG-- TDFTLTISSLQPEDFATYYC | QQSYR------- -----TPFFT | FGPGT KVDIK |
| PS:392 760 | 21-225 | 22G3 | VK1|O12/ JK3 | DIQMTQSPSSLSA SVGDRVTITC | RAS--QSIS-- ----NYLN | WYQQKPGK APKLLIF | A------- ASSLQS | GVPSRFSGSGSG-- TDFTLTISSLGLQPEDFATYYC | QQSFR------- -----TPFFT | FGPGT KVDIK |
| PS:392 762 | 21-225 | 22G5 | VK1|O12/ JK3 | DIQMTQSPSSLSA SVGDRVTITC | RAS--QQKGK-- ----SYLN | WYQQKQGK APKLLIY | A------- ASSLQN | GVPSREGSGSG-- TDFTLTISSLQPEDFATYYC | QQSYN------- -----TPLFT | FGPGT KVDFK |
| PS:392 764 | 21-225 | 22G10 | VK1|O12/ JK3 | DIQMTQSPSSLSA SVGDRVTITC | RAS--QNIG-- ----SYLN | WYHQKPGK APKLLIF | A------- ASSLQS | GVPSRFSGSGSG-- TDFTLTINLQPEDFATYYC | QQSYR------- -----TPLFT | FGPGT KVDFK |
| PS:392 812 | 21-225 | 21F4 | VK1|O12/ JK3 | DIQMTQSPSSLSA SVGDRVTITC | RAS--QNIG-- ----SYLN | WYQQKPGK APKLLIY | A------- ASSLQS | GVPSRFSGSGSG-- TDFTLTISSLQPEDFATYYC | QQSYR------- -----TPFFT | FGPGT KVDIK |
| PS:392 816 | 21-225 | 22E4 | VK1|O12/ JK3 | DIQMTQSPSSLSA SVGDRVTITC | RAS--QTIS-- ----SHLN | WYQRKPGK APKLLIY | A------- ASSLQS | GVPSRFSGSGSG-- TDFTLTISSVQPEDFATYYC | QQSYN------- -----ISFT | FGPGT KVDIK |
| PS:392 830 | 21-225 | 21A5 | VK1|O12/ JK3 | DIQMTQSPSSLSA SVGDRVTITC | RAS--QSIP-- ----SYLN | WYQQKPGK APKLLIY | A------- ASSLQS | GVPSRFSGSGSG-- TDFTLTISSLQPEDFATYYC | QQSYN------- -----TPLFT | FGPGT KVDIK |
| PS:392 852 | 21-225 | 21A2 | VK1|O12/ JK3 | DIQMTQSPSSLSA SVGDRVTITC | RAS--QNIS-- ----SYLN | WYQQKPGK APKLLIY | A------- ASSLQS | GVPSRFSGSGSG-- TDFTLTISSLQPEDFATYYC | QQSYR------- -----TPFFT | FGPGT KVDIK |
| PS:392 878 | 21-225 | 22C5 | VK1|O12/ JK3 | DIQMTQSPASLSA SVGDRVTITC | RAS--QNIS-- ----SYLN | WYQQKPGK APKLLIY | A------- ASVLQH | GIPSRFSGSGSG-- TDFTLTISSLQPEDFATYYC | QQSYR------- -----TPLFT | FGPGT KVDFK |
| PS:392 902 | 21-225 | 22D5 | VK1|O12/ JK3 | DIQMTQSPSSLSA SVGDRVTITC | RAS--QNIF-- ----SYLN | WYHQKPGK APKLLIY | A------- ASSLQS | GVPSRFSGSGSG-- TDFTLTISSLQPEDFATYYC | QQSYS------- -----TPLFT | FGPGT KVDIK |
| PS:392 984 | 21-225 | 30E11 | VK1|O12/ JK3 | DIQMTQSPSSLSA SVGDRVTITC | RAS--QSIS-- ----NYLN | WYQQQTGK APKFLIY | A------- ASSLQS | GVPSRFSGSGSG-- TDFTLTISSLQPEDFATYYC | QQSYS------- -----TPFT | FGPGT KVDIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:393114 | 21-225_33G12 | VK1|O12/JK3 | DIQMTQSPSSLSA SVGDRVTITC | RAS--QSIS-----NYLN | WYQQQTGK APKELIY | A--ASSLQS | GVPSRFSGSGSG--TDFTLTISSLQPEDFATYYC | QQSYS-------TPFT | FGPGT KVDIK |
| iPS:393824 | 21-225_10F12 | VK1|O12/JK3 | DIQMTQSPSSLSA SVGDRVTITC | RAS--QNIS-----SYLN | WYQQKPGK APKLLIY | A--ASSLQS | GVPSRFSGSGSG--TDFTLTISSLQPEDFATYYC | QQSYN-------TPFFT | FGPGT KVDIK |
| iPS:393848 | 21-225_4H2 | VK1|O12/JK3 | DIQMTLSPSSLSA SVGDRVTITC | RAI--QNIS-----SYLN | WYQQKPGK APKLVIY | A--ASSLQS | GVPSRFSGRGSG--TDFTLTIGCVQREFATYYC | QQSYR-------TPLFT | FGPGT KVDIK |
| iPS:393862 | 21-225_5G2 | VK1|O12/JK3 | DIQMTQSPSPSA SVGDRVTIIF | RAS--QNII-----SYLN | WYQQKPGK ARKLVIY | G--ASSLQS | GVPSRFSGSGSG--TDFTLNIRSLQPEDFATYYC | QQSYS-------TPLFT | FGPGT KVDIK |
| iPS:393888 | 21-225_3E3 | VK1|O12/JK3 | DIQMTQSPSSPSA SVGDRVTIIF | RAS--QSIR-----SYLN | WYQQKPGK AHKLVIY | G--TSSLQS | GVPSRFSGSGSG--TDFTLTISSLQPEDFATYYC | QQSYS-------TPLFT | FGPGT KVDIK |
| iPS:393890 | 21-225_4B1 | VK1|O12/JK3 | DIQMTQSPSSLSA SVGDRVTITC | RAS--HIIR-----TYLN | WYQQKPGK APKLLIY | A--ASSLQS | GVFSRINGSGSG--TDFTLTIINLQPEDFATYYC | QQSYN-------ISFT | FGPGT KVDIK |
| iPS:393898 | 21-225_5F7 | VK1|O12/JK3 | DIQMTQSPSSPSA SVGDRVTIIF | RAS--QIIS-----SYLN | WYQQKPGK APKLLIS | A--ASSLQS | GVPSRFSGSGSG--TDFTLTISSLQPEDFATYYC | QQSYN-------TPLFT | FGPGT KVVIK |
| iPS:393904 | 21-225_8H11 | VK1|O12/JK3 | DIQMTQSPSSLSA FVGDRVTITC | RAS--QNII-----SYLN | WYQQKPGK APNLMIY | V--TSSLHS | GVPSRFSGSGSG--TDFTLTISSLQPEDFATYYC | QQSYS-------TPFT | FGPGT KVDIK |
| iPS:393936 | 21-225_14A11 | VK1|O12/JK3 | DIQMTQSPSSLSA SIGERVTITC | RAS--QSIS-----SYLN | WYQQKPGK APKLLIF | A--ASSLQN | GVPSRFSGSGSG--TDFTLTISSLQPEDFATYYC | QQTYS-------SPFFT | FAPGT KVDIK |
| iPS:393980 | 21-225_6D3 | VK1|O12/JK3 | DIQMTQSPSSLSA SVGDRVTITC | RTS--QSIS-----SYLN | WYQQKPGK APKLLIY | A--ASSLQS | GVPSRFSGSGSG--TDFTLTISSLQPEDFATYFC | QQSYR-------TPFFT | FGPGT KVDIK |
| iPS:394014 | 21-225_8G6 | VK1|O12/JK3 | DIQMTQSPSSLSA SVGDRVTITC | RAS--QSIS-----TYLN | WYQQKPGK APKLLIY | A--ASSLQS | GVPSRFSGSGSG--TDFTLTISSLQPEDFATYYC | QQSYR-------TPFFT | FGPGT KVDIK |
| iPS:394022 | 21-225_16H6 | VK1|O12/JK3 | DIQMTQSPSSLSA SVGDRVTITC | RAS--QNIS-----SYLN | WYQQKPGK APKLLIY | A--TSSLQN | GVPSRFSGRGSG--TDFTLTISSLQPEDFATYYC | QQSYR-------TPLFT | FGPGT KVDFK |
| iPS:394043 | 21-225_3B1 | VK1|O12/JK3 | DIQMTQSPSSLSA SVGDRVTITC | RAS--QSIN-----NYLN | WYQQKPGK APKLLIY | A--ASSLQS | GVPSRFSGSGSG--TDFTLTISSLQPEDFATYYC | QQSYS-------TPLFT | FGPGT KVDIN |
| iPS:394051 | 21-225_9E5 | VK1|O12/JK3 | DIQMTQSQSSLSA SVGDRVTITC | RAS--QSIA-----SYLN | WYQQKPGK APKLLIY | G--ASSLQS | GVPSRFSGSGSG--TDFTLTISSLQPEDFATYYC | QQSYS-------TPLFS | FGPGT KVDIK |
| iPS:394077 | 21-225_8E12 | VK1|O12/JK3 | DIQMTQSPSSLSA SVGDRVTITC | RAS--QSIS-----SYLN | WYQQKPGK APKLLIY | A--ASSLQS | GVPSRFSGSGSG--TDFTLTISSLQPEDFATYFC | QQSYR-------TPFFT | FGPGT KVDIK |
| iPS:394087 | 21-225_11A5 | VK1|O12/JK3 | DIQMTQSPSSLSA SVGDRVTITC | RAS--QNIY-----SYLN | WYQQKPGK APKLLIY | A--ASSLQS | GVPSRFSGSGSG--TDFTLTISSLQPEDFATYYC | QQSYN-------TPLFT | FGPGT KVDIK |
| | Germline | VK2|A18|JK3 | DIVMTQTPLSLSV TPGQPASISC | KSS---QSLLHSE---GKTYLY | WYLQKPGQ SPQLLIY | E--VSNRFS | GVPDRFSGSGSG--TEFTLKISRVEAEDVGYYYC | MQSIQ-------LPFT | FGPGT KVDIK |
| iPS:434053 | 21-225_51E1 | VK2|A18/JK3 | DIVMTQTPLSLSV TPGQPASMSC | KSS---QSLLHSE---GKTYLY | WYLRKPGQ PPQFLIF | E--VSNRFS | GVPDRFSGSGSG--TEFTLKISRVEAEDVGYYYC | MQSIQ-------LPFT | FGPGT KVDIK |
| iPS:434137 | 21-225_54D4 | VK2|A18/JK3 | DIVMTQTPLSLSV TPGQPASMSC | KSS---QSLLHSE---GKTYLY | WYLRKPGQ PPQFLIF | E--VSNRFS | GVPDRFSGSGSG--TEFTLKISRVEAEDVGIYYC | MQSIQ-------FPFT | FGPGT KVDIK |
| iPS:434149 | 21-225_55H1 | VK2|A18/JK3 | DIVMTQTPLSLSV TPGQPASISC | KSS---QSLLHSE---GKTYLY | WYLQKPGQ PPQFLIF | E--VSHRFS | GVPDRFSGSGSG--TDFTLKISRVEAEDVGVYYC | MQSIQ-------LPFT | FGPGT KVDIK |

Figure 51 (Continued)

| ID | V/J | K_FR1 | K_CDR1 | K_FR2 | K_CDR2 | K_FR3 | K_CDR3 | K_FR4 |
|---|---|---|---|---|---|---|---|---|
| iPS:435_315 | 21-225_147B2 | VK2|A18/JK3 | DIVMTQTPLSLSVTPGQPASISC | KSS--QSLLHSE-GKTYLY | WYLQKPGQPPQLLIY | E-VSHRVS | GVPDRFSGSGSG-TDFTVKISRVEAEDVGVYYC | MQSTQ------FPPT | FGPGTKVDIK |
| | | Germline | | K_CDR1 | K_FR2 | K_CDR2 | K_FR3 | K_CDR3 | K_FR4 |
| iPS:434_055 | 21-225_51B4 | VK1|O18/JK3 | DIQMTQSPSSLSASVGDRVTITC | QAS--RDIT-----FYLN | WYQQKPGKAPKLLIY | D-ASNLET | TDFTFTISCVMPEDIATYLC | QQYDN------LPFT | FGPGTTVEIK |
| | | Germline | | K_CDR1 | K_FR2 | K_CDR2 | K_FR3 | K_CDR3 | K_FR4 |
| iPS:434_087 | 21-225_52F6 | VK1|O18/JK4 | DIQMTQSPSSLSASVGDRVTITC | QAS--QDIS-----NYLH | WYQQKPGKAPKLLIY | D-ASTLGT | GVPLRFSGSGSG-TEFTFTINSLQPEDIATYSC | QQCDN------LPLT | FGGGTKVEIK |
| iPS:434_111 | 21-225_53H2 | VK1|O18/JK4 | DIQMTQSPSSLSASVGDRVTITC | QAS--QDIS-----NYLH | WYQQKPGKAPQLLIY | D-ASNLET | TDFTFTISSLQPEDIATYYC | HQYDN------LPLT | FGGGTKVEIK |
| iPS:434_121 | 21-225_53F6 | VK1|O18/JK4 | DIQMTQSPSSLSASVGDRVTITC | QAS--QDIT-----NYLD | WYQQKPGKAPKLLIY | D-ASNLGT | GVPSRFSGSGSG-TDFTFTISSLQPEDIATYYC | QQCDN------LPLT | FGGGTKVEIK |
| iPS:434_163 | 21-225_50H1 | VK1|O18/JK4 | DIQMTQSPSSPSASVGDRVTITC | QAS--QDIS-----NYLD | WYQQKPGKAPKLLIY | D-ASNLET | TDFAFTISSLQPEDIATYYC | QQCDN------LPLT | FGGGTKVEIK |
| iPS:435_611 | 21-225_161F10 | VK1|O18/JK4 | DIQMTQSPSSLSASVGDRVTITC | QAS--QDIY-----NHLS | WYQQKPGKAPKLLIY | D-ASNWET | GVPSRFSGGGSG-TDFTFTISSLQPEDIATYYC | QQYEN------LPLT | FGGGTKVEIK |
| iPS:435_811 | 21-225_183H6 | VK1|O18/JK4 | DIQMTQSPSSLSACSVGDRVTITC | QAS--QDIS-----NYLN | WYQQTPGKAPKVLIY | D-ASNLET | GVPSRFSGSGAG-TDFTFTISSLQPEDIATYYC | QQYDN------LPLT | FGGGTKVEIK |
| iPS:394_035 | 21-225_5G9 | VK1|O18/JK4 | DIQMTQSPSSLSASVGDRVTITC | QAS--QGIS-----NSLN | WYQQKPGKAPKLLIY | D-ASNLET | TDFTFTISSLQPEDIATYYC | QQYDN------LPLT | FGGGTKVEIK |
| | | Germline | | K_CDR1 | K_FR2 | K_CDR2 | K_FR3 | K_CDR3 | K_FR4 |
| iPS:434_095 | 21-225_52F10 | VK1|L1/JK1 | DIQMTQSPSSLSVSVGDRVTITC | RAS--QGIS-----NYLG | WFQQKPGKAPKSLIY | A-ASSLQS | GVPSRFSGSGSG-TDFTLTISSLQPEDFATYYC | QQYNS------YPPT | FGGGTKVEIK |
| iPS:392_848 | 21-225_20F9 | VK1|L1/JK1 | DIQMTQSPSSLSASVGDRITITC | RAS--QGIS-----NYLA | WFQQKPGKAPKSLIS | A-ASSLQS | GVPSKFSGSGSG-TDFTLTISSLQPEDFATYYC | QQYHS------YPWT | FGQGTKVEIK |
| iPS:393_078 | 21-225_33H11 | VK1|L1/JK1 | FVQMTQSPSSLSASVGDRVTITC | WAS--QGIN-----SYLA | WFQQRPGKAHKSLIY | A-ASSLQG | GVPSRFSGSGSG-TDFTLTISSLQREDFATYYC | QQFNS------YPLT | FGGGTKVEIK |
| iPS:393_142 | 21-225_33A3 | VK1|L1/JK1 | DIQMTQSPSSLSASVGDRVTITC | RAS--QGIN-----NYLA | WFQQKPGKAPKSLIY | A-ASSLQS | GVPSKFSGSGSG-TDFTLTISSLQPEDFATYYC | QQFNS------YPPT | FGGGTKVEIK |
| iPS:393_946 | 21-225_16A4 | VK1|L1/JK1 | DIQMTQSPSSLSASVGDRVTITC | RAS--QDIS-----NYLA | WFQQKPGKAPKSLIS | A-ASSLQS | GVPSKFSGSGSG-TDFTLTISSLQPEDFATYYC | QQYHS------YPWT | FGGGTKVEIN |
| | | Germline | | K_CDR1 | K_FR2 | K_CDR2 | K_FR3 | K_CDR3 | K_FR4 |
| iPS:434_117 | 21-225_53C6 | VK1|O12/JK5 | DIQMTQSPSSLSASVGDRVTITC | RAS--QYSS-----DYLN | WYQQKPGKAPKVLIF | A-ASSLKS | GVPSRFSGSGSG-TDFTLTISSLEPEDFATYFC | QQSYS------TPFT | FGGGTRLEIK |
| iPS:434_317 | 21-225_59E8 | VK1|O12/JK5 | DIQMTQSPSSLSASVGDRVTITC | RAS--QSIS-----SYLN | WYQQKPGKAPKLLIY | A-ASSLQS | GVPSKFSGSGSG-TDFTLTISSLQPEDFATYYC | QQSFS------NSIT | FGGGTRLEIK |
| iPS:434_327 | 21-225_63G6 | VK1|O12/JK5 | DIQMTQSPSSLSASVGDRVIISC | RAS--QSIF-----SYLN | WYQVKPGKAPKLLIY | D-TSTLQT | GVPSRFSGSGSG-TDFTLTINSLQPEDFATYYC | QQSYG------IPIT | FGGGTRLEIQ |

Figure 51 (Continued)

| | | | K_FR1 | K_CDR1 | | K_FR2 | K_CDR2 | K_FR3 | K_CDR3 | | K_FR4 |
|---|---|---|---|---|---|---|---|---|---|---|---|
| iPS:434_455 | 21-225_72F5 | VK1|O12/JK5 | DIQMTQSPSSLSA SVGDRVIIPC | RAS--QNIS- ----SYLN | WYQQKPGK APKLLIY | A------ ASSLQS | GVPSRFSGSGSG-- TDFTLTISSLQPEDFATYSC | QQTY--- ----STPT | FGQGT RLDIN |
| iPS:435_525 | 21-225_157E7 | VK1|O12/JK5 | DIQMTQSPSSLSA SVGDRVTIIC | RAS--QSFS- ----SYLN | WYQQKPGI APKLLIY | A------ ASSLQS | GVPSRFSGSGSG-- TDFTLTISSLQPEDFATYYC | QESYS-- ----IRFA | FGGGT RLEIK |
| iPS:392_754 | 21-225_21D3 | VK1|O12/JK5 | DIQMTQSPSSLSA SVGDRVTIIC | RAS--QSIT- ----GYSN | WYQQKPGK TPKLLIF | A------ TYSLES | GVPSRFSGSGFG-- TNFTLTISSLQPEDFATYYC | QQSYS-- ----TSIT | FGGGT RLEIK |
| iPS:392_818 | 21-225_22D8 | VK1|O12/JK5 | DIQMTQSPSSLSA SVGDRVTIIC | RTS--QNSN- ----SYLN | WYQQKPGK APKLQIF | A------ AYSLES | GVPSRFSGSGSG-- TEFTLTISSLQPEDFATYYC | QQTYG-- ----TSIT | FGGGT RLEIK |
| iPS:393_064 | 21-225_33A9 | VK1|O12/JK5 | DIQMTQSPSSLSA SVGDRVTIIC | RAS--QSIS- ----RYLS | WYQQKPGR APNLQIY | A------ ASSLQS | GVPSRFSGSGSG-- TDFTLTISSLQPEDFATYYC | QQSYN-- ----IPIT | FGGGT RLEIK |
| iPS:393_148 | 21-225_35E5 | VK1|O12/JK5 | DIQMTQSPSSLSA SVGDRVTIIY | RAS--QSIS- ----SYLN | WYQQKPAK APKLHIY | G------ ASSFQS | WVPSRFSGSGSS-- TDFTLTIISMQPGDYATYYC | HQSYN-- ----LPIT | FGGGT RLEIK |
| iPS:398_536 | 21-225_33D12 | VK1|O12/JK5 | DVQMTQSPSSLSA SLGDRVTIIC | RAS--QSIR- ----SYLN | WYQQKPGN APNLLIY | S------ ASSLQS | GVPSRFSGSGSG-- TDFTLTISSLQPEDFANYYC | QQSYS-- ----IPIT | FGGGT RLEIK |
| | Germline | | K_FR1 | K_CDR1 | | K_FR2 | K_CDR2 | K_FR3 | K_CDR3 | | K_FR4 |
| | VK3|A27/JK2 | | EIVLTQSPGTLSL SPGERATLSC | RAS--QSVSS ----SYLA | WYQQKPGQ APRLLIY | G------ ASSRAT | GIPDRFSGSGSG-- TDFTLTISRLEPEDFAVYYC | QQYGS-- ---- | FGGGT  |
| iPS:434_127 | 21-225_53H8 | VK3|A27/JK2 | EIVLTQSPGTLSL SPGERATLSC | RAS--QSITS ----SYLA | WYQQKPGQ APRLLIY | G------ ASGRAT | GIPDRFSGSGSG-- TDFTLTISRLEPEDFAVYYC | QQFES-- ----SPMCS | FGGGT NLEIK |
| iPS:436_290 | 21-225_205G3 | VK3|A27/JK2 | EIVLTQSPGTLSL SPGERATLSC | RAS--QNVSY ----SYLA | WYQQKPGQ APRLLIY | G------ ASRRAT | GIPDRFSGSGSG-- TDFTLTISRLEPEDFAVYYC | QQYGS-- ----SPCS | FGGGT KLEIK |
| iPS:436_568 | 21-225_225B3 | VK3|A27/JK2 | EIVLTQSPGTLSL SPGERATLSC | RAS--QNLSS ----SYLG | WYQQKPGQ APRLLIY | D------ TSSRAT | GIPDRFSGSGSG-- TDFTLTISRLEPEDFAVYYC | QEYGS-- ----SLMCS | FGGGT KLEIK |
| iPS:392_898 | 21-225_21H10 | VK3|A27/JK2 | EIVLTQSPGTLSL SPGERATLSC | RAS--QSFSS ----SYLA | WYQQKPGQ APRLLIY | G------ ASSRAT | GIPSRFSGSGSG-- TDFTLTISRLEPEDFAVYYC | QQYG--- ----SSRS | FGGGT RLEIK |
| iPS:393_802 | 21-225_3D12 | VK3|A27/JK2 | EIVLTQSPGTLSL SPGERATLSC | RAS--QSVSS ----SYLA | WYQQKPGQ AFRLLIY | G------ TSSRAT | GIPDRFSGSGSG-- TDFTLTISRLEPEDFAVYYC | QQYG--- ----SSRS | FGGGT KLEIK |
| | VK1|L1/JK4 | | K_FR1 | K_CDR1 | | K_FR2 | K_CDR2 | K_FR3 | K_CDR3 | | K_FR4 |
| iPS:434_157 | 21-225_55D4 | VK1|L1/JK4 | DIQMTQSPSSLFA SVGDRVTIIC | RAS--QDIS- ----NYLI | WFQQKPGK APKSLIY | I------ ASSLQS | GVPSKFSGSGFG-- TDFTLTISNLQPEDFATYYC | QQYHS-- ----FPLT | FGGGT RVEIR |
| iPS:434_175 | 21-225_55A11 | VK1|L1/JK4 | DIQMTQSPSSLSA SVGDRVTIIC | RAS--QDIN- ----IYLA | WFQQKPGK APKSLIY | A------ ASSLQS | GVPSKFSGSGSG-- TDFTLTISSLQPEDFATYYC | QQYNS-- ----YPLT | FGGGT KVEIK |
| iPS:434_367 | 21-225_65H11 | VK1|L1/JK4 | DIQMTQSPSSLSA SVGDRVTIIC | RAS--QDIS- ----TYLA | WFQQKPGK APKSLIY | A------ ASSLQS | GVPSKFSGSGSG-- TDFTLTISSLQPEDFATYYC | QQYNS-- ----FPLT | FGGGT KVEIK |
| iPS:434_429 | 21-225_70H6 | VK1|L1/JK4 | DIQMTQSPSSLSA SLGDRVTIIC | RTS--QSIF- ----NYLN | WFQRKPGK APKVLIY | T------ ASSLQS | GIPSRFSGSGSG-- TDFTLTISRLEPEDSATYYC | QQSYS-- ----IPLT | FGGGT RVEIK |
| iPS:434_535 | 21-225_74C8 | VK1|L1/JK4 | DIQMTQSPSSLSA SVGDRVTIIC | RAS--QGIG- ----KYLA | WFQQKPGK APKSLIY | T------ TSNLQS | GVPSKFSGSGSG-- TDFTLTISSLYEPEDFATYYC | QQYSN-- ----YPLT | FGGGT KVEIN |
| iPS:434_573 | 21-225_77E6 | VK1|L1/JK4 | DIQMTQSPSSLSA SVGDRVTIIC | RAS--QGIS- ----KYLA | WFQQKPGK APKSLIY | A------ ASSLQG | GAPSKFSGSGSG-- TDFTLTISSLQPEDFATYYC | QQYSN-- ----YPLT | FGGGT KVEIK |
| iPS:434_615 | 21-225_76C5 | VK1|L1/JK4 | DIQMTQSPSSLSA SVGDRVTIIC | RAS--QVIS- ----KYLA | WFQQKPGK APKSLIY | A------ ASSLQS | GAPSKFSGSGSG-- TDFTLTISRLEPEDFATYYC | QQYSN-- ----YPLT | FGGGT RVEIK |
| iPS:434_669 | 21-225_79F4 | VK1|L1/JK4 | DIQMTQSPSSLSA SVGDRVTIIC | RAS--QGIS- ----KYLA | WFQQKPGK APKSLIY | A------ ASSLQS | GAPSKFSGSGSG-- TDFTLTISSLQPEDFATYYC | QQYSN-- ----YPLT | FGGGT RVEIK |

Figure 51 (Continued)

| ID | Family | Seq1 | Seq2 | Seq3 | Seq4 | Seq5 | Seq6 | Seq7 | Seq8 |
|---|---|---|---|---|---|---|---|---|---|
| iPS:434 737 | 21-225_74G6 | VK1|L1/J K4 | DIQMTQSPSSLSA SVGDRVTITC | RAS--QGIG- ----KYLA | WFQQKPGK APKSLIY | T------ TSSLQS | GAPSKFSGSGSG- TDFTLTISSLQYEDFATYYC | QQYSN----- ---------YPLT | FGGGT KVEIN |
| iPS:434 741 | 21-225_80C11 | VK1|L1/J K4 | DIQMTQSPSSLSA SVGDRVTITC | RAS--QGIG- ----RYLA | WFQQKPGR APKSLIY | T------ ASSLQS | GAPSKFSGSGSG- TDFTLTISSLQPEDFATYYC | QQYSN----- ---------YPLT | FGGGT KVEIN |
| iPS:434 867 | 21-225_79A12 | VK1|L1/J K4 | DIQMTQSPSSLSA SVGDRVTITC | RAS--QVIS- ----KYLA | WFQQKPGK APKSLIY | A------ ASSLQS | GAPSKFSGSGSG- TDFTLTISSLQPEDFATYYC | QQYSN----- ---------YPLT | FGGGT KVEIK |
| iPS:435 333 | 21-225_147E9 | VK1|L1/J K4 | DIQMTQSPSSLSA SVGDRVTITC | RAS--QDIN- ----NYLA | WFQQKPGK APKSLIV | A------ ASSLQS | GVPSKFSGSGSG- TDFTLTISSLQPEDFATYYC | QQYNS----- ---------YPLT | FGGGT KVEIK |
| iPS:435 409 | 21-225_150G8 | VK1|L1/J K4 | DIQMTQSPSSLSA SVGDRVTITC | RAS--QGIS- ----HYLA | WFQQKPGK APKSLIY | V------ ASSLQN | GVPSRFSGSGSG- TDFTLTISSLQPEDFATYYC | QQYNN----- ---------YPLT | FGGGT KVEIK |
| iPS:435 505 | 21-225_157C1 | VK1|L1/J K4 | DIQMTQSPSSLSA SIGDRITLTC | RAS--QDIS- ----NYLA | WFQQKPGK APKSLIY | A------ ASSLLS | GVPSKFSGSGSG- TDFTLTISSLQPEDFATYYC | QQYNS----- ---------FPFT | FGGGT KVELK |
| iPS:435 595 | 21-225_160H4 | VK1|L1/J K4 | DIQMTQSPSSLSA SVGDRVTITC | RAS--QDIS- ----NYLV | WFQQKLGK APKSLIY | V------ ASSLQS | GVPSRFSGSGSG- TDFTLTISSLQPEDFATYYC | QQYNS----- ---------YPLT | FGGGT KVEIK |
| iPS:435 639 | 21-225_163G6 | VK1|L1/J K4 | DIQMTQSPSSLSA SVGDRVTITC | RAS--QDIS- ----NYLV | WFQQKPGK APKSLIY | A------ ASSLLS | GVPSKFSGSGSG- TDFTLTISSLQPEDFATYYC | QQYHS----- ---------YPLT | FGGGT KVAIK |
| iPS:435 653 | 21-225_166H1 2 | VK1|L1/J K4 | DIQMTQSPSSLST SVGDRVTITC | RAS--QDIS- ----HYLA | WFQQKPGK APKSLIY | A------ ASSLQS | GVPSKFSGSGSG- TDFTLTISSLQPEDFATYYC | QQYNS----- ---------FPLT | FGGGT KVEIT |
| iPS:435 677 | 21-225_169C1 0 | VK1|L1/J K4 | DIQMTQSPSSLSA SVGDRVTITC | RAS--QDIS- ----NYLA | WFQQKPGK APKSLIF | S------ ASSLQS | GVPSKFSGSGSG- TDFNLTISSLQPEDFATYYC | QQSDS----- ---------YPLT | FGGGT KVEIK |
| iPS:435 699 | 21-225_170D6 | VK1|L1/J K4 | DIQMTQSPSSLSA SVGDRVTITC | RAS--QDIS- ----NCLA | WFQQKLGK APKSLIY | K------ ASSLQG | GVPSKFSGSGSG- IDFTLTISSLQPEDFATYYC | QQSDS----- ---------YPLT | FGGGT KVEIK |
| iPS:435 745 | 21-225_175G3 | VK1|L1/J K4 | DIQMTQSPSVAIT SVGDRVTITC | RAS--QDIS- ----NDLA | WFQQKPGK APKSLIF | S------ ASSLQS | GVPSKFSGSGSG- TDFTLTISSLQPEDFATYYC | QQSDS----- ---------YPLT | FGGGT KVEIK |
| iPS:435 819 | 21-225_190C1 1 | VK1|L1/J K4 | DIQMTQSPSSLSA SVGDRVTITC | RTS--QGIG- ----NYLA | WFQQKPGK APKSLIY | K------ TSSLQS | GVPSKFSGSGSG- IDFTLTISSLQPEDFATYYC | QQYMT----- ---------YPLT | FGGGT KVEIK |
| iPS:435 825 | 21-225_190G1 | VK1|L1/J K4 | DIQMTQSPSSLSA SVGDRVTITC | RTS--QDIG- ----NYLA | WFQQKPGK APKSLLY | K------ ASSLQG | GVPSKFSGSGSG- IDFTLTISSLQPEDFATYYC | QQYMT----- ---------YPLT | FGGGT KVEIK |
| iPS:435 837 | 21-225_198G3 | VK1|L1/J K4 | DIQMTQSPSSLSA SVGDRVTITC | RTS--QGIG- ----KYLA | WFQQKPGK APKSLLY | K------ ASSLQG | GVPSKFSGSGSG- IDFTLTISSLQPEDFATYYC | QQYMT----- ---------YPLT | FGGGT KVEIK |
| iPS:435 845 | 21-225_191G1 | VK1|L1/J K4 | DIQMTQSPSSLSA SVGDRVTITC | RAS--QGIS- ----NYLA | WFQQKPGK APKSLIY | K------ ASSLQS | GVPSKFSGSGSG- TDFTLTISSLQPEDFATYYC | QHYLT----- ---------YPLT | FGGGT KVEIK |
| iPS:435 859 | 21-225_190E6 | VK1|L1/J K4 | DIQMTQSPSSLSA SVGDRVTITC | RTS--QGIG- ----NYLA | WFQQKPGK APKSLIY | K------ ASSLQS | GVPSKFSGSGSG- IDFTLTISSLQPEDFATYYC | QQYMT----- ---------YPLT | FGGGT KVEIK |
| iPS:435 873 | 21-225_190G4 | VK1|L1/J K4 | DIQMTQSPSSLSA SVGDRVTITC | RAS--QDIG- ----KYLA | WFQQKPGK APKSLLI | A------ ASSLQS | GVPSKFSGSGSG- TDFTLTISSLQPEDFATYYC | QQYST----- ---------YPLT | FGGGT KVEIK |
| iPS:435 933 | 21-225_190F8 | VK1|L1/J K4 | DIQMTQSPSSLSA SVGDRVTITC | RTS--QGIG- ----NYLA | WFQQKPGK APKSLLY | K------ ASSLQS | GVPSKFSGSGSG- IDFTLTISSLQPENFATYYC | QQYMT----- ---------YPLT | FGGGT KVEIK |
| iPS:435 945 | 21-225_191A1 0 | VK1|L1/J K4 | DIQMTQSPSSLSA SVGDRVTITC | RAS--QGIG- ----KYLA | WFQQKPGK APKSLIY | A------ ASSLQS | GVPSKFSGSGYG- TDFTLTISSLQPENFAIYYC | QQYST----- ---------YPLT | FGGGT KVEIK |

Figure 51 (Continued)

| | | | | | | | | |
|---|---|---|---|---|---|---|---|---|
| iPS:435 947 | 21- 225_191E1 0 | VK1\|L1/J K4 | DIQMTQSPSSLSA SVGDRVTITC | RAS--QGIG--- ----KYLA | WFQQKPGK APKSLIY | A------- ASSLQS | GVPSKFSGSGSG-- TDFTLTISSLQPEDFATYYC | QQYST------ | ------YPLT | FGGGT KVEIK |
| iPS:435 957 | 21- 225_191G1 2 | VK1\|L1/J K4 | DIQMTQSPSSLSA SVGDRVTITC | RTS--QGIG--- ----NYLA | WFQQKPGK APKSLIY | K------- ASSLQS | GVSKFSGSGSG--- TDFTLTISSLQPEDFATYYC | QQYIT------ | ------YPNT | FGGGS KVEIK |
| iPS:435 963 | 21- 225_192D2 | VK1\|L1/J K4 | DIQMTQSPSSLSA SVGDRVTITC | RAS--QGIS--- ----NYLA | WFQQKPGK APKSLIY | A------- ASSLQS | GVPSKFSGSGSG-- TDFTLTISSLQPEDFATYYC | QHYVT------ | ------YPLT | FGGGT KVEIK |
| iPS:435 971 | 21- 225_192D3 | VK1\|L1/J K4 | DIQMTQSPSSLSA SVGDRVTITC | RAS--QGIS--- ----NYLA | WFQQKPGK APKSLIY | A------- ASSLQS | GVPSKFSGSGSG-- TDFTLTISSLQPEDFATYYC | LHYLT------ | ------YPLT | FGGGT KVEIK |
| iPS:435 979 | 21- 225_192H4 | VK1\|L1/J K4 | DIQMTQSPSSLSA SVGDRVTITC | RAS--QDIS--- ----NYLA | WFQQKPGK APKSLIS | A------- ASSLQS | GVPSKFSGSGSG-- TDFTLTISSLQPEDFATYYG | LHYLN------ | ------YPLT | FGGGT RVEIR |
| iPS:435 987 | 21- 225_192G6 | VK1\|L1/J K4 | DIKMTQSPSSLSA SVGDRVTITC | RTS--QGIG--- ----NYLA | WFQQKPGK APKSLLY | K------- ASSLQS | GVPSKFSGSGSG-- TDFTLTISSLQPEDFATYYC | QQYMT------ | ------YPLT | FGGGT KVEIK |
| iPS:435 993 | 21- 225_192C8 | VK1\|L1/J K4 | DIQMTQSPSSLSA SVGDRVTITC | RAS--QGIS--- ----NYLA | WFQQKPGK APKSLIY | A------- ASSLQS | GVPSKFSGSGSG-- TDFTLTISSLQPEDFATYYC | QHYLT------ | ------YPLT | FGGGT KVEIK |
| iPS:435 997 | 21- 225_192G8 | VK1\|L1/J K4 | DIQMTQSPSSLSA SVGDRVTITC | RTS--QGIS--- ----NYLA | WFQQKPGK APKSLIY | K------- ASSLQS | GVPSKFSGSGSG-- TDFTLTISSLQPEDFATYYC | QQYIT------ | ------YPLT | FGGGT KVEIK |
| iPS:436 005 | 21- 225_192H1 | VK1\|L1/J K4 | DIQMTQSPSSLSA SVGDRVTITC | RAS--QGIS--- ----NYLA | WFQQKPGK APKSLIY | A------- ASSLQS | GVPSKFSGSGYG-- TDFTLTISSLQPENFATYYC | QQYST------ | ------YPLT | FGGGT KVEIK |
| iPS:436 031 | 21- 225_193C7 | VK1\|L1/J K4 | DIQMTQSPSSLSA SVGDRVTITC | RAS--QGIG--- ----KYLA | WFQQKPGK APKSLIY | A------- ASSLQS | GVSKFSGSGSG--- TDFTLTISSLQPEDFATYYC | QQYST------ | ------YPLT | FGGGT KVEIK |
| iPS:436 045 | 21- 225_193A1 0 | VK1\|L1/J K4 | DIQMTQSPSSLSA SVGDRVTITC | RAN--QAIS--- ----NYLA | WFQQKPGK APKSLIY | A------- ASSLQS | GVSKFSGSGSG--- TDFTLTISSLQPEDFATYYC | QHYLT------ | ------YPLT | FGGGT KVEIK |
| iPS:436 054 | 21- 225_194C1 | VK1\|L1/J K4 | DIQMTQSPSSLSA SVGDRVTITC | RAS--QGIS--- ----NYLA | WFQQKPGK APKSLIY | A------- ASSLQS | GVSKFSGSGSG--- TDFTLTISSLQPEDFATYYC | LHYLT------ | ------YPLT | FGGGT KVEIK |
| iPS:436 076 | 21- 225_194H1 | VK1\|L1/J K4 | DIQMTQSPSSLSA SVGDRVTITC | RAS--QGIS--- ----NYLA | WFQQKPGK APKSLLY | A------- TSSLQS | GVPSKFSGSGSG-- TDFTLTISSLQPEDFATYYC | QHYLT------ | ------YPLT | FGGGT KVEIK |
| iPS:436 086 | 21- 225_191G1 0 | VK1\|L1/J K4 | DIQMTQSPSSLSA SVGDRVTITC | RTS--QGIS--- ----KYLA | WFQQKPGK APKSLIY | K------- VSSLQS | GVSKFSGSGSG--- TDFTLTISSLQPEDFATYYC | QQYMT------ | ------YPLT | FGGGT KVEIK |
| iPS:436 090 | 21- 225_195A9 | VK1\|L1/J K4 | DIQMTQSPSSLSA SVGDRVTITC | RAS--QGIS--- ----NYLA | WFQQKPGK APKSLIY | A------- ASSLQS | GVSKFSGSGSG--- TDFTLTISSLQPEDFATYYC | QHYLT------ | ------YPLT | FGGGT KVEIK |
| iPS:436 112 | 21- 225_196C7 | VK1\|L1/J K4 | DIQMTQSPSSLSA SVGDRVTITC | RAS--QGIS--- ----NYLA | WFQQKPGK APKSLIY | A------- ASSLQS | GVSKFSGSGSG--- TDFTLTISSLQPEDFATYYC | QHYLT------ | ------YPLT | FGGGT KVEIK |
| iPS:436 138 | 21- 225_197F2 | VK1\|L1/J K4 | DIQMTQSPSSLSA SVGDRVTITC | RAS--QGIS--- ----NYLA | WFQQKPGK APKSLLY | K------- ASSLLY | GVPSKFSGSGSG-- TDFTLTISSLQPEDFATYYC | QQYIT------ | ------YPLT | FGGGT KVEIK |
| iPS:436 152 | 21- 225_197B6 | VK1\|L1/J K4 | DIQMTQSPSSLSA SVGDRVTITC | RAS--QGIG--- ----NYLA | WFQQKPGK APKSLLY | G------- ASSLQS | GVPSKFSGSGSG-- TDFTLTISSLQPENFATYYC | QQYST------ | ------YPLT | FGGGT KVEIK |
| iPS:436 173 | 21- 225_197G1 | VK1\|L1/J K4 | DIQMTQSPSSLSA SVGDRVTITC | RTS--QGIS--- ----NYLA | WFQQKPGK APKSLIY | K------- TSSLQS | GFPSKFSGSGSG-- TDFTLTISSLQPEDFATYYF | QQYMT------ | ------YPLT | FGGGT KVEIK |
| iPS:436 189 | 21- 225_198B6 2 | VK1\|L1/J K4 | DIQMIQSPSSLSA SVGDRVTITC | RAS--QGIS--- ----NYLA | WFQQKPGK APKSLIY | A------- ASSLQS | GVPSKFSGNRSG-- TDFTLTISSLQPEDFATYYC | QQYST------ | ------YPLT | FGGGT KVEIK |

Figure 51 (Continued)

| | | | | | | | | | |
|---|---|---|---|---|---|---|---|---|---|
| iPS:436 201 | 21-225 199C5 | VK1|L1/J K4 | DIQMTQSPSSLSA SVGDRVTITC | RAS--QGIS-- ----KYLA | WFQQKPGK APKSLIY | A------ ASSLQS | GVPSKFSGSGSG-- TDFTLTISSLQPEDFAAYYC | QQYLT------YPLT | FGGGT KVEIK |
| iPS:436 260 | 21-225 203H1 | VK1|L1/J K4 | DIQMTQSPSSLSA SVGDRVTITC | RAS--QGIG-- ----NYLA | WFQQKPGK APKSLIY | V------ ASRLQS | SDFTLTISSLQPEDFATGSG-- | QRYHT------YPLT | FGGGT KVEIK |
| iPS:436 282 | 21-225 204G6 | VK1|L1/J K4 | DIRMTQSPSSLSA SVGDRITITC | RTS--QGIG-- ----NYLA | WFQQKPGK APKSLIY | A------ ASSLQS | GVPSRFSGSGSG-- TDFTLTISSLQPEDFATYYC | QHYLS------YPLI | FGGGT KVEIK |
| iPS:436 284 | 21-225 204G8 | VK1|L1/J K4 | DIQMTQSPSSLSA SVGDRVTITC | RAS--QGIS-- ----NHLA | WFQQKPGK APKSLIF | A------ ASSLQS | GVPSQFSGSGSG-- TDFTLTISSLQPEDFATYYC | QQYSN------YPVT | FGGGT KVEIK |
| iPS:436 292 | 21-225 205H3 | VK1|L1/J K4 | DIPMTQSPSSLSA SVGDRVTITC | RAS--QAIS-- ----NHLA | WFQLKPGK APKSLIY | A------ ASSLQS | GVPSKFSGSGSG-- SDFTLTISSLQPEDFATYYC | QQYSN------YPLT | FGGGT KVEIK |
| iPS:436 296 | 21-225 205F5 | VK1|L1/J K4 | DIQMTQSPSSLSA SVGDRVTITC | RAS--QGIG-- ----NYLA | WFQQKPGK APKSLIY | G------ VSSLQS | GVPSKFSGSGSG-- TDFTLTISSLQPEDFATYYC | QQYSN------YPLT | FGGGT KVDLR |
| iPS:436 324 | 21-225 207G6 | VK1|L1/J K4 | DIQMTQSPSSLSA SVGDRVTITC | RAS--QGIR-- ----NYLA | WLQQKPGK APKSLIH | A------ ASSLQS | GVPSKFSGNRSG-- TDFTLTISSLQPEDFATYYC | QQYSN------YPLI | FGGGT KVEIK |
| iPS:436 364 | 21-225 211A1 | VK1|L1/J K4 | DIQMTQSPSSLSA SVGDRVTITC | RAS--QGIG-- ----NYLA | WFQQKPGK AFRSLIY | D------ ASSLES | GVPSKFSGSRSG-- TDFTLTIGSSLQPEDFATYYC | QRYMT------YPLI | FGAGT KVEIK |
| iPS:436 366 | 21-225 211A3 | VK1|L1/J K4 | DIRMTQSPSSLSA SVGDRVTITC | RAS--QAIG-- ----KHLA | WFQQKPGK APKSLIY | A------ ASRLQS | GVPSKFSGSGSG-- TDFTLTISSLQPEDLATYYC | QQYSN------YPLT | FGGGT KVEIK |
| iPS:436 372 | 21-225 211A8 | VK1|L1/J K4 | DIEMTQSPSSLSA FVGDRVTITC | RAS--QGIS-- ----RYLA | WVQQKPGK APKSLIY | A------ ASSLQS | GVSSRFSGSGSG-- TDFTLTISSLQPEDFATYYC | LRYDT------YPLT | FGGGT KVEIK |
| iPS:436 376 | 21-225 212E6 | VK1|L1/J K4 | DIQMTQSPSSLSA SVGDRVTITC | RAS--QGIS-- ----NHLA | WFQQKPGQ APKSLIY | A------ ASSLQS | GVPSKFSGSRSG-- TDFTLTISSLQPEDFATYYC | QQYVT------YPLT | FGGGT KVEIK |
| iPS:436 378 | 21-225 212D7 | VK1|L1/J K4 | DIQMTQSPSSLSA SVGDRVTITC | RAS--QGIS-- ----NHLA | WFQQKPGK APKSLIH | A------ ASSLQS | GVPSKFSGNRSG-- TDFTLTINNLQPEDFVTYYC | QQYSN------YPLT | FGGGT KVEIK |
| iPS:436 380 | 21-225 212H9 | VK1|L1/J K4 | DIEMTQSPSSLSA SVGDRVTITC | RAS--QGIS-- ----SYLA | WLQQKPGK APKSLIY | A------ ASSLQS | GVPSRFSGSGSG-- TDFTLTISSLQPEDFATYYC | LRYDT------YPLT | FGGGT KVEIK |
| iPS:436 384 | 21-225 212F10 | VK1|L1/J K4 | DIQMTQSPSSLSA SVGDRVTITC | RAS--QAIG-- ----NYLD | WFQQKPGK APKSLIY | S------ ASNLQS | GVPSKFSGSGSG-- TDFTLTISSLQPEDFATYYC | QHYSN------YPLT | FGGGT KVEIK |
| iPS:436 388 | 21-225 212H1 | VK1|L1/J K4 | DIRMTQSPSSLSA SVGDRVTITC | RAS--QAIG-- ----KHLA | WFQQKPGK AFRSLIY | A------ ASRLQS | GVPSKFSGSGSG-- TDFTLTISSLQPEDFATYYC | QHYSN------YPLT | FVGGT KVEIT |
| iPS:436 390 | 21-225 213D2 | VK1|L1/J K4 | DIQMTQSPSSLSA SVGDRVTITC | RAS--QGIS-- ----NHLA | WFQQKPGK APKSLIH | A------ ASSLQS | GVPSKFSGNRSG-- TDFTLTINNLQPEDFVTYYC | HQYSN------YPLT | FGGGT KVEIK |
| iPS:436 394 | 21-225 213C4 | VK1|L1/J K4 | DIHMTQSPSSLSA SVGDRVTITC | RAS--QAIR-- ----NYLA | WCQQKPGK AFKTLIY | A------ ASSLQS | GVPSKFSGSGSG-- TDFTLTISSLQPEDFATYYC | QQYSN------YPLT | FGGGT KVEIK |
| iPS:436 396 | 21-225 213E5 | VK1|L1/J K4 | DIRMTQSPSSLSA SVGDRVTITC | RAS--QAIG-- ----KHLA | WFQQRPGK APKSLIY | A------ ASRLQS | GVPSKFSGSGSG-- TDFTLTISSLQPEDLATYYC | QHYSN------YPLT | FGGGT KVEIK |
| iPS:436 398 | 21-225 213B8 | VK1|L1/J K4 | DIQMTQSPSSLSA SVGDRVTITC | RAS--QGIS-- ----NHLA | WFQQKPGK APKSLIY | A------ ASSLQS | GVPSKFSGSGSG-- TDFTLTISSLQPEDFATYYC | QQYSN------YPLT | FGGGT KVEIK |
| iPS:436 410 | 21-225 212E1 | VK1|L1/J K4 | DIQMTQSPSSLSA SVGDRVTITC | RAS--QGIG-- ----NHLA | WFQQKPGK APKSLIH | A------ ASSLQS | GVPSKFSGSGSG-- TDFTLTISSLQPEDFATYYC | QQYSN------YPLT | FGGGT KVEIK |
| iPS:436 420 | 21-225 215B5 | VK1|L1/J K4 | DIQMTQSPSSLSA SVGDRVTITC | RAS--QGIS-- ----NHLA | WFQQKPGK APKSLIY | A------ ASSLHS | GVPSKFSGSRSG-- TDFTLTISSLQPEDFATYYC | QQYIN------YPLT | FGGGT KVEIK |
| iPS:436 422 | 21-225 215D6 | VK1|L1/J K4 | DIQMTQSPSSLSA SVGDRVTITC | RAS--QGIS-- ----NHLA | WFQQKPGK AFKSLIY | A------ ASSLHS | GVPSKFSGSRSG-- TDFTLTISSLQPEDFATYYC | QQYVT------YPLT | FGGGT KVEIK |

Figure 51 (Continued)

| | | | | | | | | | | |
|---|---|---|---|---|---|---|---|---|---|---|
| iPS:436 430 | 21-225_215A1 2 | VK1\|L1/J K4 | DIQMTQSPSSLSA SVGDRITITC | RTS--QDIG- ----NYLA | WFQQKPGK APKSLIY | A------ ASSLQS | GVPSKFSGSRSG--- TDFTLTISSLQSEDFATYYC | QQYVT----- -----YPLT | FGGGT KVEIK |
| iPS:436 452 | 21-225_217G5 | VK1\|L1/J K4 | DILMTQSPSSLSA SVGDRVTITC | RAS--QGIG- ----NYLA | WFQRPGK APKSLIY | A------ ASSLQS | GVPSKFSGTRSG--- TDFTLTISSLQPDDFATYYC | QQYVN----- -----YPLT | FGGGT KVEIN |
| iPS:436 454 | 21-225_217B1 | VK1\|L1/J K4 | DIRMTQSPSSLSA SVGDRVTITC | RAS--QAIG- ----KHLA | WFQQRPGK APKSLIY | A------ ASRLQS | GVPSKFSGSGSG--- TDFTLTISSVQPEDLATYYR | QHTSK----- -----SPVQ | LVGGT KVEIT |
| iPS:436 464 | 21-225_219H1 | VK1\|L1/J K4 | DIQMTQSPSSQSA SVGDRVTITC | RAS--QGIS- ----NYLD | WFQQKPGK APKSLIY | S------ ASNLQS | GVPSKFSGSRSG--- TDFTLTISSLQPEDFATYYC | QHYSN----- -----YPLT | FGGGT KVEIK |
| iPS:436 490 | 21-225_221F6 | VK1\|L1/J K4 | DIQMTQSPSSLSG SVGDRVTITC | RAS--QGIS- ----NYLA | WFQQKPGK APKSLIY | A------ ASNLQS | GVPSKFSGSRSG--- TDFTLTISSLQPEDFATYYC | QQYMT----- -----YPLT | FGGGT RVEIK |
| iPS:436 502 | 21-225_222A1 | VK1\|L1/J K4 | DIQMTQSPSSLSA SVGDRVTITC | RAS--QAIG- ----NYLA | WFQQKPGK APKSLIY | A------ ASRLQS | GVPSKFSGSGSG--- TDFTLTISVQPEDLATYYR | LYYLN----- -----YPLT | FGGGT KVEIK |
| iPS:436 514 | 21-225_222D1 1 | VK1\|L1/J K4 | DIQMTQSPSSLSA SVGDRVTITC | RAS--QGIS- ----NYLA | WFQQKPGK APKSLIY | S------ ASSLQS | GVPSKFSGSGSG--- TDFTLTISSLQPEDFATYYC | LHYLN----- -----YPLT | FGGGT RVEIK |
| iPS:436 522 | 21-225_223H1 0 | VK1\|L1/J K4 | DIQMTQSPSSLSA SVGDRVTITC | RAS--QGIS- ----NYLA | WFQQKPGK APKSLIY | A------ ASSLQS | GVPSKFSGSGSG--- TDFTLTISSLQPEDFATYYC | LHYLN----- -----YPLT | FGGGT KVEIK |
| iPS:437 258 | 21-225_153F9 | VK1\|L1/J K4 | DIQMTQSPSSLSA SVGDRVTITC | RAS--QGIS- ----NYLA | WFQQKPGK APKSLIS | A------ ASSLQS | GVPSKFSGSGSG--- TDFTLTISSLQPEDFATYYC | QQYNS----- -----YPLS | FGGGT KVEIK |
| iPS:437 260 | 21-225_170D1 | VK1\|L1/J K4 | DIQMTQSPSSLAA SVGDRVTITC | RAS--QDIS- ----NYLA | WFQQKPGK APKSLIY | A------ ASSLQS | GVPSRFSGSGSG--- TDFTLTISNLQPEDFATYYC | QQCDS----- -----PPLT | FGGGT KVEIK |
| iPS:437 264 | 21-225_174H1 2 | VK1\|L1/J K4 | DIQMTQSPSSLSA SVGDRVTITC | RAS--QDIS- ----NYLA | WFQQKPGK APKSLIY | S------ ASSLQS | GVPSKFSGSGSG--- TDFTLTISSLQPEDFATYYC | QQSDS----- -----YPLT | FGGGT KVEIK |
| iPS:437 266 | 21-225_177A5 | VK1\|L1/J K4 | DIQMTQSPSSLSA SVGDRVTITC | RAS--QGIS- ----SYLA | WLQQKPGK APKSLIF | S------ ASSLQS | GVPSKFSGSGSG--- TDFTLTISSLQPEDFATYYC | QQSNS----- -----YPLT | FGGGT KVEIK |
| iPS:437 270 | 21-225_178H4 | VK1\|L1/J K4 | DIQMTQSPSSLSA SVGDRVTITC | RAS--QDIS- ----NYLA | WFQQKPGK APKSLIY | A------ ASSLQS | GVPSKFSGSGSG--- TDFTLTISSLQPEDFATYYC | LRYDT----- -----YPLT | FGGGT KVEIK |
| iPS:438 664 | 21-225_216G1 | VK1\|L1/J K4 | DIQMTQSPSSLSA SVGDRVTITC | RAS--QAIS- ----SYLA | WVQQKPGK APKSLIY | A------ ASSLQS | GVPSRFSGSGSG--- TEFTLTISNLQPEDFATYYC | QHYLT----- -----YPLT | FGGGT KVEIK |
| iPS:451 120 | 21-225_197D3 | VK1\|L1/J K4 | DIQMTQSPSSLSA SVGDRVTITC | RAS--QGIR- ----NYLA | WFQQKPGK APKSLIY | A------ ASSLQS | GVPSKFSGSGSG--- TDFTLTISSLQPEDFATYYC | QQYYS----- -----YPLT | FGGGT KVEIK |
| iPS:392 682 | 21-225_16A12 | VK1\|L1/J K4 | DIQMTQSPSSLSA SVGDRVTITC | RAS--QAIR- ----TYLA | WFQQKPGK APKSLIS | A------ ASSLQS | GVPSKFSGSGSG--- TDFTLTISSLQPEDFATYYC | QQYNS----- -----YPLT | FGGGT KVEIK |
| iPS:392 856 | 21-225_22A2 | VK1\|L1/J K4 | DIQMTQSPSSLSA SVGDRVTITC | RAS--QDIS- ----NYLA | WVQQKPGK APKSLIY | A------ ASSLQS | GVPSKFSGSGSG--- TDFTLTISSLQPEDFASYYC | QQYMS----- -----PPLT | FGGGT KVEIK |
| iPS:392 966 | 21-225_32G3 | VK1\|L1/J K4 | DIQMTQSPTSLSA SVGDRVTITC | RAS--QAIS- ----NYLA | WFQQKPGK APKSLIY | D------ TSSLQS | GVPSKFSGSGSG--- TDFTLIISTLQPEDFATYYC | QQYHS----- -----YPLT | FGGGT KVEIK |
| iPS:393 952 | 21-225_1F1 | VK1\|L1/J K4 | DIQMTQSPSSLSA SVGDRVTITC | RAS--QGIN- ----NYLA | WFQQKSGK APKSLIS | V------ ASSLQT | GVPSRFSGSGSG--- TDFTLTISSLQPEDFATYYC | QQYNS----- -----YPLT | FGGGT KVEIK |
| iPS:393 988 | 21-225_7F10 | VK1\|L1/J K4 | DIQMTQSPSALSA SVGDRVTITC | RAS--QDIR- ----NYLA | WFQQKPGK APKSLIS | V------ ASSLQS | GVPSRFSGSGSG--- TDFTLTISSLQPEDFATYYC | QQYNS----- -----YPLT | FGGGT KVEIK |

Figure 51 (Continued)

| | | Germline | K_FR1 | K_CDR1 | K_FR2 | K_CDR2 | K_FR3 | K_CDR3 | K_FR4 |
|---|---|---|---|---|---|---|---|---|---|
| iPS:402 233 | 21-225_16D10 | VKjL1/J K4 | DIQMTQSPSSLSA SVGDRVTITC | RAS--QDIS-----NYLA | WFQQKPGK APKSLIY | A------TPSLQS | GVPSRFSGSGSG-TEFTLTISSLQPEDFATYYC | QQYNS------YPLT | FGQGT KVEIK |
| iPS:402 237 | 21-225_23D11 | VKjL1/J K4 | DIQMTQSPSSLSA SVGDRVTITC | RAS--QGIA-----NYLA | WFQQRPGK APKSLIS | A------ASSLQS | GVPSRFSGSGSG-TEFTLTISSLQPEDFATYYC | QQYHS------YPLT | FGQGS KVEIK |
| VK1|O18|JK5 | | Germline | | K_CDR1 | K_FR2 | K_CDR2 | K_FR3 | K_CDR3 | K_FR4 |
| iPS:434 171 | 21-225_50G4 | VKjO18/ JK5 | DIQMTQSPTSLSA SVGDRVTITC | QAS--QDIT-----NFLN | WYQQKPGK APKLLIY | D------ASNLET | GVPSRFSGSGSG-TDFTFTISSLQPEDIATYFC | QQYD-------NLIT | FGQGT RLEIK |
| iPS:435 565 | 21-225_159C4 | VKjO18/ JK5 | DIQMTQSPSSLSA SVGDRVTITC | QAS--QDIS-----DYLN | WYQQKPGK APKLLIY | D------ASTLET | GVPSRFSGSGSG-TDFTFTISSLQPEDIATYFC | QQYDN------LPIT | FGQGT RLEIK |
| iPS:435 607 | 21-225_161G4 | VKjO18/ JK5 | DIQMTQSPSSLSA SVGDRVTITC | QAS--QDIY-----NYLN | WYQQKPGK APKLLIY | D------ASNLET | GVPSRFSGSGSG-TDFFAISSLQPEDIATYYC | QQYDI------LPIT | FGQGT RLEIK |
| iPS:437 302 | 21-225_225B1 | VKjO18/ JK5 | DIQMTQSPSSLSA SIGDRVTITC | QAS--QDIF-----NYLN | WYQQKPGK APKLLIY | D------ASTLET | GVPSRFSGSGSG-TDFTFTISSLQPEDIATYYC | QQYDN------LPIT | FGQGT RLEIK |
| iPS:393 868 | 21-225_24D6 | VKjO18/ JK5 | DIQMTQSPSSLSA SVGDRVTITC | QAN--QDIT-----NFLN | WYQLKPGK ALKLLIY | D------ASDLET | GVPSRFSGSGSG-TDFTFTISSLQPEDIATYYC | QQYEN------LPIT | FGQGT RLEIK |
| iPS:393 020 | 21-225_30E2 | VKjO18/ JK5 | DIQMTQSPHSLSA SVGDRVTITC | QAS--QYIS-----NYLN | WYQQKSGK APKLLIY | D------ASNLET | GVPSRFSGSGSG-TDFTFTISSLQPEDIATYFC | QQYDN------LPIT | FGQGT RLEIK |
| iPS:393 138 | 21-225_35E3 | VKjO18/ JK5 | DIQMTQSPSSLSA SVGDRVTITC | QAS--QDIF-----NFLN | WYQQKPGK APNLLIY | D------ASTLET | GVPSRFSGSGSG-TDFTFTISSLQPEDVATYFC | QQYDN------LPIT | FGQGT RLDIR |
| iPS:393 892 | 21-225_6G7 | VKjO18/ JK5 | DIQMTQSPSRSA SVGDRVTITC | QAS--QDIS-----NYLN | WCQQKPGK ALKLLIY | D------ASTLET | GVPSRFSGSGSG-TDFTFTISSVQPEDIATYYC | QQYDN------VPIT | FGQGT RLEIK |
| iPS:393 910 | 21-225_15F10 | VKjO18/ JK5 | DIQMTQSPSSLSA SVGDRVTITC | QAS--QDIN-----NYLN | WYQLKPGK APNLLIS | D------ASNLET | GVPSRFSGSGSG-TDFTFTISSLQPEDIATYYC | QQYEN------LPIT | FGQGT RLEIK |
| iPS:393 912 | 21-225_16F6 | VKjO18/ JK5 | DIQMTQSPSSLSA SVGDRVTITC | QAN--QDIT-----NFLN | WYQLKPGK APNLLIS | D------ASNLET | GVPSRFSGSGSG-TDFTFTISSLQPEDVATYYC | QQYDN------LPIT | FGQGT RLEIK |
| iPS:394 000 | 21-225_11A2 | VKjO18/ JK5 | DIQMTQSPSSLSA SVGDRVTITC | QAS--QDIS-----NYLN | WYQQKPGK APKLLIY | D------ASNLET | GVPSRFSGSGSG-TDFTFTISSLQPEDVATYYC | QQYDN------LPIT | FGQGT RLDIR |
| iPS:394 004 | 21-225_13A1 | VKjO18/ JK5 | DIQMTQSPSSLSA SVGDRVTITC | QAS--QDIN-----NYLN | WYQQKLGT APKLLIY | D------GSNLET | GVPSRFSGSGSG-TDFTFTISSLQPEDIATYYC | QQYEN------LPIT | FGQGT RLEIK |
| iPS:394 006 | 21-225_15C2 | VKjO18/ JK5 | DIQMTQSPSSLSA SVGDRVTITC | QAS--QDIT-----NYLN | WYQQKPGK APNLLIY | D------ASNLET | GVPSRFSGSGSG-TDFTFTISSLQPEDIATYYC | QQYDN------LPIT | FAQGT RLEIK |
| iPS:394 029 | 21-225_1B12 | VKjO18/ JK5 | DIQMTQSPSSLSA SVGDRVTITC | QAS--QDIN-----NYLN | WYQQKPGK APKLLIY | D------ASNLET | GVPSRFSGSGSG-TDFTFTISSLQPEDITTYYC | QQYEN------LPIT | FGQGT RLEIK |
| iPS:394 047 | 21-225_5E6 | VKjO18/ JK5 | DIQMTQSPSSLSA SVGDRVTITC | QAS--QDIN-----NYLN | WCQQKPGK APKLLIY | D------ASNLET | GVPSRFSGSGSG-TDFTFTISSLQPEDIATYYC | QQYDN------LPIT | FGQGT RLEIK |
| iPS:394 081 | 21-225_16B3 | VKjO18/ JK5 | DIQMTQSPSSLSA SVGDRVTITC | QAS--QDIN-----NYLN | WYQQKPGR APKLLIY | D------ASNLET | GVPSRFSGSGSG-TDFTFTISSLQPEDIATYYC | QQFDN------LPIT | FGQGT RLEIK |
| VK3|L2/3K3 | | Germline | K_FR1 | K_CDR1 | K_FR2 | K_CDR2 | K_FR3 | K_CDR3 | K_FR4 |
| iPS:434 219 | 21-225_60E9 | VK3|L2/J K3 | EIVMTQSPATLSV SPGERATLSC | RAS--QSVS-----SSLA | WYRQKPGQ APRLLIY | G------ASTRAT | GIFARFSGSGSG-TEFTLTISSLQSEDFAVYCC | QQYNN------WPFT | FGPGT KIDIK |
| iPS:434 279 | 21-225_57F7 | VK3|L2/J K3 | EIVMTQSPAILSV FPGERATLSC | RAS--QSVS-----SDLA | WYQQKPGQ APRLLIY | G------ASTRAT | GMPARFSGSGSG-TEFTLTISSLQSEHFAVYYC | QQYSN------WPFT | FGFGT KVDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 289 | 21-225_57H12 | VK3|L2/JK3 | EIVMTQSPATLSV SPGERATLSC | RAS---QSVS--- ------SDLA | WYQQKPGQ APKLLIY | A------ ASTRAT | GIPARFSGSGSG--- TEFTLTISSLQSEDFAVYYC | QQYDN------ ------WPFT | FGPGT KVDNK |
| iPS:434 291 | 21-225_58A4 | VK3|L2/JK3 | EIVMTQSPATLSV SPGERASLSC | RAS---QSVS--- ------SDLA | WYQQRPGQ APRLLIY | A------ ASTRAT | GIPARFSGSGSG--- TEFTLTISSLQSEDFAVYYC | QQPNN------ ------WPFT | FGPGT KVDIK |
| iPS:434 297 | 21-225_58A10 | VK3|L2/JK3 | EIVMTQSPATLSV CPGERATLSC | RAS---QSVS--- ------SSLA | WYQQKPGQ APKLLIY | G------ ASTRAI | GIPARFSGSGSG--- TEFTLTISSLQSEDFAVYYC | QQYNN------ ------WPFT | FGPGT KVDIK |
| iPS:434 301 | 21-225_58F11 | VK3|L2/JK3 | EIVMTQSPATLSV SPGERATLSC | RAS---QSVS--- ------SDLV | WYQQKPGQ APRLLIY | A------ VSTRAT | GIPARFSGSGSG--- TEFTLTISSLQSEDFAVYYC | QQYNN------ ------WPFT | FGPGT KVDIK |
| iPS:437 228 | 21-225_60C11 | VK3|L2/JK3 | EIVMTQSPATLSV SPGERATLSC | RAS---QSVS--- ------NDLA | WYQQKPGQ APKLLIY | G------ ASTRAT | GIPARFSGSGSG--- TEFTLTISALQSEHFAVYYC | QQYSN------ ------WPFT | FGPGT KVDIK |
| VK2|A19|JK5 Germline | | | DIVMTQSPLSLPV TPGEPASISC | RSS--- QSLLHSN- GYNYLD | WYLQKPGQ SPQLLIY | L------ GSNRAS | GVPDRFSGSGSG--- TDFTLKISRVEAEDVGVYYC | MQALQ------ ------TPLT | FGQGT RLEIK |
| iPS:434 243 | 21-225_62C1 | VK2|A19/JK5 | DIVMTQSPLSLPV TPGEPASISC | RSS--- QSLLHSN- GYNYLD | WYLQKPGQ SPQLLIY | L------ VSNRAS | GVPDRFSGSGSG--- TDFTLKISRVGAEDVGVYFC | LQALQ------ ------TPLT | FGQGT RLEIK |
| iPS:436 648 | 21-225_227F11 | VK2|A19/JK5 | DVVMTQSPLSLPV TPGEPASISC | WSS--- QSLLHSN- GYNYLD | WYLQKPGQ SPQVLIY | L------ GSNRAS | GVPDRFSGSGSG--- TDFTLKISRVEAEDVGVYYC | MQALQ------ ------TPLT | FGQGT RLEIK |
| iPS:394 061 | 21-225_12D2 | VK2|A19/JK5 | DIVMTQSPLSLPV TPGEPASISC | IRSS--- QSLLHSN- GYNYLD | WYLQKPGQ SPQVLIY | L------ GSNRAS | GVPDRFSGSGSG--- TDFTLKISRVEAEDVGVYYC | MQALQ------ ------TPLT | FGQGT RLEIK |
| iPS:394 071 | 21-225_10C7 | VK2|A19/JK5 | DIVMTQSPLSLPV TPGEPASISC | IRSS--- QSLLHSK- GYNYLD | WYLQKPGQ SPQVLIY | L------ GSNRAS | GVPDRFSGSGSG--- TDFTLKISRVEAEDVGVYYC | MQALQ------ ------TPLT | FGQGT RLEIK |
| VK1|L5/JK4 Germline | | | DIQMTQSPSSVSA SVGDRVTITC | RAS---QDIS--- ------SWLA | WYQQNPGK APKLLIF | A------ ASSLQS | GVPSRFSGSGSG--- TDFTLTISSLQPEDFATYYC | QQTNS------ ------FPLT | FGGGT KVEIK |
| iPS:434 259 | 21-225_62G7 | VK1|L5/JK4 | DIQMTQSPSSVSA SVGDRVTITC | RAS---QDIS--- ------SWLA | WYQQNPGK APKLLIY | A------ ASSLQS | GVPSRFSGSGSG--- TNFTLTISSLQPEDFATYYC | QQTNS------ ------FPLT | FGGGT KVEIK |
| iPS:434 333 | 21-225_63C9 | VK1|L5/JK4 | DIQMTQSPSSVSA SVGDRVTITC | RAS---QGIS--- ------SWLA | WYQQKPGK APNLLIY | A------ ASSLQS | GVPSRFSGSGSG--- TDFTLTISSLQPEDFATYFC | QQTNS------ ------FPLT | FGGGT KVAIK |
| iPS:434 347 | 21-225_64H10 | VK1|L5/JK4 | DIQMTQSPSSVSA SVGDRVTITC | RAS---QGIS--- ------SWLA | WYQQKPGK ALKLLIY | A------ ASSLQS | GVPSRFSGSGSG--- TDFTLTISSLQPEDFATYYC | QQYNS------ ------FPLT | FGGGT KVEIK |
| iPS:434 359 | 21-225_65G3 | VK1|L5/JK4 | DIQMTQSPSSVSA SVGDRVTITC | RAS---QGIS--- ------SWLA | WYQQKPGK APKLLIY | A------ ASSLQS | GVPSRFSGSGSG--- TDFTLTISSLQPEDFATYYC | QQYNS------ ------FPLT | FGGGT KVEIK |
| iPS:434 369 | 21-225_66B1 | VK1|L5/JK4 | DIQMTQSPSSVSA SVGDRVTITC | RAS---QGIS--- ------SWLA | WYQQKPGK ALKLLIY | A------ ASSLQS | GVPSRFSGSGSG--- IDFTLTISSLQPEDFATYYC | QQTNS------ ------FPLT | FGGGT KVEIK |
| iPS:434 373 | 21-225_66A7 | VK1|L5/JK4 | DIQMTQSPSSVSA SVGDRVTITC | RAS---QGIS--- ------SWLA | WYQQKPGK APKLLIY | A------ ASSLQS | GVPSRFSGSGSG--- TDFTLTISSLQPEDFATYYC | QQINS------ ------FPLT | FGGGT KVEIK |
| iPS:434 397 | 21-225_67H4 | VK1|L5/JK4 | DIQMTQSPSSVSA SVGDRVTITC | RAS---QGIS--- ------SWLA | WYQQKPGK AFKLLIY | A------ ASSLQS | GVPSRFSGSGSG--- TDFTLTISSLQPEDFATYYC | QQINS------ ------FPLT | FGGGT KVEIK |
| iPS:434 427 | 21-225_70D6 | VK1|L5/JK4 | DIQMTQSPSSVSA SVGDRVTITC | RAS---QGIS--- ------KWLA | WYQQNPGK ALKLLIF | A------ ASSLQS | GVPSRFSGSGSG--- TDFTLTISSLQPEDFANYYC | QQTNS------ ------FPLT | FGGGT KVEIK |
| iPS:434 435 | 21-225_70G9 | VK1|L5/JK4 | DIQMTQSPSSVSA SVGDRVTITC | RAS---QDIS--- ------SWLA | WYQQNPGK APKLLIY | A------ ASSLQS | GVPSRFSGSGSG--- TDFTLTISSLQPEDFATYYC | QQTNS------ ------FPLT | FGGGT KVEIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 437 | 21-225_70A12 | VK1|L5/JK4 | DIQMTQSPSSVSA SVGDRVTITC | RAS--QGIS------SWLA | WYQQKPGK ALKLLIY | A------ASSLQS | GVPSRFSGSGSG--TDFTLTISSVQPEDFATYC | QQINS-------FPLT | FGGGT KVEIK |
| iPS:434 451 | 21-225_71B7 | VK1|L5/JK4 | DIQMTQSPSSVSA SVGDRVTIIC | RAS--QGIS------SWLA | WYQQNPGE APKLLIY | A------ASSLQG | GVPSRFSGSGSG--TDFTLTISSLQPEDFANYC | QQTNS-------FPLT | FGGGT KVEIK |
| iPS:434 459 | 21-225_71A7 | VK1|L5/JK4 | DIQMTQSPSSVSA SVGDRVTIIC | RAS--QGIS------SWLA | WYQQKPGK APKLLIY | A------ASSLQS | GVPSRFSGSGSG--TDFTLTISSLQPEDFATYC | QQVNS-------FPLT | FGGGT KVEIK |
| iPS:434 461 | 21-225_73A3 | VK1|L5/JK4 | DIQMTQSPSSVSA SIGDRVTIIC | RAS--QGIS------NWLA | WYQQKPGK APKLLIY | A------ASSLQS | GVPSRFSGSGSE--TDFTLTISSLQPEDFATYC | QQVNS-------FPLT | FGGGT KVEIK |
| iPS:435 479 | 21-225_154E9 | VK1|L5/JK4 | DIQMTLSPSSVYA SVGDRVTITC | RAS--QDIS------NWLA | WYQQKPGK APKVLIY | A------ASSLQS | GVPSRFSGSGSG--TDFTLTISSVQPEDFATYC | QQGNS-------FPLT | FGGGT KVDIK |
| iPS:437 232 | 21-225_63E1 | VK1|L5/JK4 | DIQMTQSPSSVYA SVGDRVTITC | RAS--QGIS------SYLA | WYQQKPGK APKLLIY | A------ASSLQS | GVPSRFSGSGSG--TDFTLTISSLQPEDFATYC | QQANS-------FPLI | FGGGT KVEIK |
| iPS:437 326 | 21-225_75C10 | VK1|L5/JK4 | DIQMTQSPSSVSA SVGDRVIITC | RAS--QGIS------IMLA | WYQQKPGK APKLLIY | A------ASSLQS | GVPLRFSGSGSG--TDFTLTISSLQPEDFATYC | QQAKS-------FPLT | FGGGT KVEIK |
| | Germline | VK1|O12/JK2 | DIQMTQSPSSLSA SPGERATLSC | RAS--QSIS------SYLN | WYQQKPGK APKLLIY | A------ASSLQS | GVPSRFSGSGSG--TDFTLTISSLQPEDFATYC | QQSYS | FGQGT KLEIK |
| iPS:434 309 | 21-225_59B5 | VK1|O12/JK2 | DIQMTQSPSSLSA SVGDRVTIIC | RAS--QSII------SYLN | WYQQKPGK APKLLIY | G------ASSLQS | GVPSRFSGSGSG--TDFTLISSLQPEDFATYC | QQSYS-------TPMFS | FGQGT KLEIK |
| iPS:392 874 | 21-225_21D2 | VK1|O12/JK2 | DIQMTQSPSSLFA SVGDRVTIIC | RAS--QSIS------DYLN | WYQQKPGK APKLLIY | D------TSSLQS | GVPSRFSGSGSG--TDFTLTINSLQPEDFATYC | QQTYNI-------LPERS | FGRGT KLEIK |
| iPS:393 940 | 21-225_16B2 | VK1|O12/JK2 | GVQMTQSPSSLSA SVGDRVTIIC | RAS--QGIS------GYLN | WYQQKPGK APKLLIY | A------ASSLQS | GVPSRFSGSGSG--TDFTLTISSLQPEDFATYC | QQTYNT-------PPERS | FGQGT KLEIK |
| iPS:393 956 | 21-225_4D7 | VK1|O12/JK2 | DIQMTQSPSSLSA SVGDRVTITC | RAS--QSIS------DYLN | WYQQKPGK APKLLIF | D------TTSLQS | GVPSRFSGSGSG--TDFTLTINSLQPEDFATYC | QQTYNT-------PPERS | FGQGT KLEIK |
| iPS:398 476 | 21-225_17C1 | VK1|O12/JK2 | DIQMTQSPSSLSA SVGDRVTIIC | RAS--QNIN------DYLN | WYQQKPGK APKLLIY | A------ASNLQS | GVPARFSGSGSR--TDFTLTISSLQPEDFATYC | QQTYNT-------PPERS | FGQGT KLEIK |
| iPS:403 870 | 21-225_23G4 | VK1|O12/JK2 | DIQMTQSPSSLSA SVGDRVTIIC | RAS--QNIY------SYLN | WYQQKPGK APKLLIY | A------ASSLQS | GVPSRFSGSGSG--TEFTLTISILQPEDFATYC | QQSYNT-------PPECN | FGQGT KLEIK |
| | Germline | VK3|A27/JK3 | EIVLTQSPGTLSL SPGERATLSC | RAS--QSVS------SYLA | WYQQKPGQ APRLLIY | G------ASSRAT | GIPDRFSGSGSG--TDFTLTISRLEPEDFAVYYC | QQYGS | FGPGT KVDFK |
| iPS:434 311 | 21-225_59H5 | VK3|A27/JK3 | EIVLTQSPGTLSL SPGERATLSC | RAS--QSVSS-----IYLA | WFLQKPGQ APRLLIY | G------ASSRAT | GIPDRFSGSGSG--TDFTLTISRLEPEDFAVYYC | HQYGN-------SPFT | FGPGT KVDFK |
| iPS:435 301 | 21-225_146G4 | VK3|A27/JK3 | EIVLTQSPGTLSL FPGERATLSC | RAS--QNIIS-----SYLA | WYQQKPGQ APRLLIY | G------VSSRAT | GIPDRFSGSGSG--TDFTLTISRLEPEDFAVYYC | QQYGR-------SPFN | FGPGT KVDIN |
| iPS:435 317 | 21-225_147D2 | VK3|A27/JK3 | EIVLTQSPGTLSL SPGERATLSC | RAS--QSVGS-----SYLA | WYQQKPGQ APRLLIY | G------ASSRAT | GIPDRFSGSGSG--TDFTLTISRLEPEDFAVYYC | QQYG--------SLFT | FGPGT KVDIK |
| iPS:435 319 | 21-225_147E3 | VK3|A27/JK3 | EIVLTQSPGTLSL SPGERATLSC | RAS--QSVIS-----SYLA | WYQQKPGQ APRLLIY | G------ASSRAT | AIPDRFSGSGSG--TDFTLTISRLEPEDFAVYYC | QQYGR-------SPFN | FGPGT KVDIK |
| iPS:435 383 | 21-225_14907 | VK3|A27/JK3 | EIVLTQSPGTLSL FPGERVTLSC | RAS--QSIIS-----NYLA | WYQQKPGQ APRLLIE | G------VSSRAT | GIPDRFSGSGSG--TDFTLTISRLEPEDFAVYYC | QQYGR-------SPFN | FGPGT KVDIK |
| iPS:435 443 | 21-225_152E7 | VK3|A27/JK3 | EIVLTQSPGTLSL FPGERATLSC | RAS--QSVIS-----SYLA | WYQQKPGQ APRLLIF | G------VSSRAT | GIPDRFSGSGSG--TDFTLTISRLEPEDFAVYYC | QQYGR-------SPFN | FGPGT KVDIK |
| iPS:435 465 | 21-225_153A6 | VK3|A27/JK3 | EIVLTQSPGTLSL FPGERAPLSC | RAS--QSVIS-----SYLA | WYQQKPGQ APRLLIF | G------VSSRAT | GIPDRFSGSGSG--TDFTLTISRLEPEDFAVYYC | QQYGR-------SPFN | FGPGT KVDIK |

Figure 51 (Continued)

| ID | V/J | K_FR1 | K_CDR1 | K_FR2 | K_CDR2 | K_FR3 | K_CDR3 | K_FR4 |
|---|---|---|---|---|---|---|---|---|
| iPS:436_058 | 21-225_194A4 | VK3|A27/JK3 | EIVLTQSPGTLSLSPGERATLSC | RAS--RGVSN----IYLA | WYQQKPGQ-APRLLIY | G-------ASNRAT | GIPDRFSGSGS--TDFTLTISRLEPEDFAVYYC | QHNDY------------SMFT | FGPGT KVDIK |
| iPS:436_436 | 21-225_216F10 | VK3|A27/JK3 | EVVLTQSPGTLSLSPGERATLSC | RAS---SFLA | WYQQKPGQ-APRLLIY | G-------TSTRAT | GIPDRFSGSGS--TDFTLTISRLEPEDFAVYYC | QQYDR------------SPFT | FGPGT KVDIK |
| iPS:442_568 | 21-225_149D8 | VK3|A27/JK3 | EIVLTQSPGTLSLFPGERATLSC | RAS--QSVIS----SYLA | WYQQKPGQ-APRLLIF | VSSWAI | GIPDRFSGSGS--TDFTLTISRLEPEDFAVYYC | QQYGR------------SFFN | FGPGT KVDIK |
| | Germline VK1|O18/JK1 | | K_CDR1 | K_FR2 | K_CDR2 | K_FR3 | K_CDR3 | K_FR4 |
| iPS:434_353 | 21-225_64B12 | VK1|O18/JK1 | DIQMTQSPSSLSASVGDRVTITC | RAS--QDIS----NYLN | WYQQKPGT-APNLLIS | D-------ASILET | GVPSTFSGSGSG-TDFTFTISSLQPEDIATYYC | QQSDN------------LPCS | FGQGT KVEIK |
| | Germline VK1|A20/JK4 | | K_CDR1 | K_FR2 | K_CDR2 | K_FR3 | K_CDR3 | K_FR4 |
| iPS:434_357 | 21-225_65C1 | VK1|A20/JK4 | DIQLTQSPSSLSASVGDRVTITC | RAS--QVIS----SYLH | WYQQKPGK-VFKVLIY | S-------ASNLQC | GVPSRFSGSGSG-TDFTLTFSSLQPEDVATYYG | QRPYN------------APLT | FGGGT KVEIK |
| iPS:434_375 | 21-225_66C7 | VK1|A20/JK4 | DIQLTQSPSSLSASVGDRVTITR | RAS--QGIS----NYLH | WYQQKPGK-APRLLIY | C-------ASNLQC | GVPSRFSGSGSG-TDFTLTISSLQPEDVATYYC | QQHNN------------SPLT | FGGGT KVEIK |
| iPS:434_457 | 21-225_72G12 | VK1|A20/JK4 | DIQLTQSPSSLSASVGDRVTITC | RAS--QGIS----SYLN | WSQQKPGK-VFKLLIC | G-------ASNLQS | GVPSRFSGSASG-TDFTLTISSLQPEDVTTYYG | QQNYN------------APLT | FGGGT KVEIK |
| | Germline VK3|A27/JK4 | | K_CDR1 | K_FR2 | K_CDR2 | K_FR3 | K_CDR3 | K_FR4 |
| iPS:434_479 | 21-225_76H1 | VK3|A27/JK4 | EFMLTQSPGTLYWSPGERATLSC | RAS----QSVSS----SYLV | WYQQKPGQ-APRLLIY | G-------ASTRAT | GIPDRFSG-SGSG-TDFTLTISRLEPEYFAVYYC | QQYGC------------SPLT | FGGGT KVEIT |
| iPS:434_513 | 21-225_76A6 | VK3|A27/JK4 | EIVLTQSPGTRSWSPGERATLSC | RAS----QSVSS----SYLA | WYQQKPGQ-APRLLIY | G-------ASTRAT | GIPDRFSGSGSG-TDFTLTISRLEPEYFAVYYC | QQYGN------------SPLT | FGGGT KVEIK |
| iPS:434_515 | 21-225_74A5 | VK3|A27/JK4 | EFMLTQSPGTLSLSPGERATLSC | RAS----QSVIS----SYLA | WYQQKPGQ-APRLLIY | G-------ASTRAT | GIPDRFSGSGSG-TDFTLTISRLEPEYFAVYYC | QQYGC------------SPLT | FGGGT KVEIT |
| iPS:434_529 | 21-225_76B9 | VK3|A27/JK4 | EFMLTQSPGTLSWSPGERATLSC | RAS----QSVSS----SYLV | WYQQKPGQ-APRLLIY | G-------ASTRAT | GIPDRFSGSGSG-TDFTLTISRLEPEYFAVYYC | QQYGC------------SPLT | FGGGT KVEIT |
| iPS:434_583 | 21-225_74B6 | VK3|A27/JK4 | EIVLTQSPGTLSLSPGERATLSC | RAS----QSVSS----SYLA | WYQQKPGQ-APRLLIY | G-------ASTRAT | GIPDRFSGSGSG-TDFTLTISRLEPEYFAVYYC | QQYGN------------SPLT | FGGGT KVEIK |
| iPS:434_587 | 21-225_74G3 | VK3|A27/JK4 | EFMLTQSPGTLCWSPGERATLSC | RAS----QSVSS----SYLV | WYQQKPGQ-APRLLIY | G-------ASTRAT | GIPDRFSGSGSG-TDFTLTISRLEPEYFAVYYC | QQYGC------------SPLT | FGGGT KVEIT |
| iPS:434_603 | 21-225_77D11 | VK3|A27/JK4 | EFMLTQSPGTLYWSPGERATLSC | RAS----QSVSS----SYLV | WYQQKPGQ-APRLLIY | G-------ASTRAT | GIPDRFSGSGSG-TDFTLTISRLEPEYFAVYYC | QQYGC------------SPLT | FGGGT KVEIT |
| iPS:434_705 | 21-225_80A2 | VK3|A27/JK4 | EFMLTQSPGTLYLSPGERATLSC | RAS----QSVSS----SYLV | WYQQKPGQ-APRLLIY | G-------ASTRAT | GIPDRFSGSGSG-TDFTLTISRLEPEYFAVYYC | QQYGN------------SPLT | FGGGT KVEIT |
| iPS:434_747 | 21-225_80C12 | VK3|A27/JK4 | EIVLTQSPGTLYLSPGERATLSC | RAS----QSVSS----SYLA | WYQQKPGQ-APRLLIY | G-------ASTRAT | GIPDRFSGSGSG-TDFTLTISRLEPEYFAVYYC | QQYGN------------SPLT | FGGGT KVEIK |
| iPS:434_793 | 21-225_82A5 | VK3|A27/JK4 | EIVLTQSPGTLSCSPGERATLSC | RAS----QSVSS----SYLA | WYQQKPGQ-APRLLIY | G-------ASTRAT | GIPDRFSGSGSG-TDFTLTISRLEPEYFAVYYC | QQYGN------------SPLT | FGGGT KVEIK |
| iPS:434_797 | 21-225_82G5 | VK3|A27/JK4 | EFMLTQSPGTLSSSPGERATLSC | RAS----ESVSS----SYLV | WYQQKPGQ-APRLLIY | G-------ASTRAT | GIPDRFSGSGSG-TDFTLTISRLEPEYFAVYYC | QQYGC------------SPLT | FGGGT KVEIT |
| iPS:434_805 | 21-225_82D9 | VK3|A27/JK4 | EFMLTQSPGTLSWSPGERATLSC | RAS----ESVSS----SYLV | WYQQKPGQ-APRLLIY | G-------ASTRAT | GIPDRFSGSGSG-TDFTLTISRLEPEYFAVYYC | QQYGC------------SPLT | FGGGT KVEIT |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:434 813 | 21-225_82C12 | VK3|A27/ JK4 | EIVLTQSPGTLSW SPGERATLSC | RAS--QSVSS- ----SYLA | WYQQKPGQ APRLLIY | G---------- ASTRAS | GIPDRFSGSGSG- TDFTLTISRLEPEYFAVYYC | QQYGN------------SPLT | FGGGT KVEIK |
| iPS:434 825 | 21-225_83C2 | VK3|A27/ JK4 | EFMLTQSPGTLCL SPGERATLSC | RAS--QSVSS- ----SYLV | WYQQKPGQ APRLLIY | G---------- ASTRAT | GIPDRFSGSGSG- TDFTLTISRLEPEYFAVYYC | QQYGC------------SPLT | FGGGT KVEIT |
| iPS:434 833 | 21-225_83C5 | VK3|A27/ JK4 | EFMLTQSPGTLCW SPGERATLSC | RAS--ESVSS- ----SYLV | WYQQKPGQ APRLLIY | G---------- ASTRAT | GIPDRFSGSGSG- TDFTLTISRLEPEYFAVYYC | QQYGC------------SPLT | FGGGT KVEIT |
| iPS:434 883 | 21-225_85B5 | VK3|A27/ JK4 | EFMLTQSPGTLSL SPGERATLSC | RSS--QSVSS- ----SYLV | WYQQKPGQ APRLLIY | G---------- ASTRAT | GIPDRFSGSGSG- TDFTLTISRLEPEYFAVYYC | QQYGC------------SPLT | FGGGT KVEIK |
| iPS:434 911 | 21-225_85D11 | VK3|A27/ JK4 | EFMLTQSPGTLSL STGERATLSC | RSS--QSVSS- ----SYLV | WYQQKPGQ APRLLIY | G---------- ASTRAT | GIPDRFSGSGSG- TDFTLTISRLEPEYFAVYYC | QQYGN------------SPLT | FGGGT KVEIT |
| iPS:434 957 | 21-225_87A10 | VK3|A27/ JK4 | EFVLTQSPGTLYL SPGERATLSC | RAS--QSVSS- ----SYLA | WYQQKPGQ APRLLIY | G---------- ASTRAS | GIPDRFSGSGSG- TDFTLTISRLEPEYFAVYYC | QQYGN------------SPLT | FGGGT KVEIK |
| iPS:435 247 | 21-225_96G1 | VK3|A27/ JK4 | EIVLTQSPGTLSL STGERATLSC | RAS--QSVSS- ----SYLA | WYQQKPGQ PPRLLIY | G---------- ASTRAS | GIPDRFSGSGSG- TDFTLTISRLEPEYFAVYYC | QQYGN------------SPLT | FGGGT KVEIK |
| iPS:436 368 | 21-225_211G3 | VK3|A27/ JK4 | EIVLTQSPGTLSL SPGERVTLSC | RAS--QSVSS- ----SFLA | WYQQKPGQ APRLLIY | G---------- ASSRAT | GIPDRFSGSGSG- TDFTLTISRLEPEDFAVYYC | QQYVS------------SPLT | FGGGT KVEIK |
| iPS:436 426 | 21-225_215C7 | VK3|A27/ JK4 | EIVLTQSPGTLSC SPGERVTLSC | RAS--QRITT- ----NFLA | WYQQKPGQ APRLLIY | G---------- ASSRAT | GIPDRFSGSGSG- TDFTLTISRLESEDFAVYYC | QQYVS------------SLLT | FGGGT KVEIK |
| iPS:436 432 | 21-225_215H1 2 | VK3|A27/ JK4 | EIVLTQSPGTLSL SPGERATLSC | RAS--QSVSS- ----SFLA | WYQQKPGQ APRLLMY | G---------- ASTRAT | GIPDRFSGSGSG- TDFTLTISRLEPEDFAVYYC | QQYGC------------SPLT | FGGGT KVEIT |
| iPS:437 322 | 21-225_75B1 | VK3|A27/ JK4 | EFMLTQSPGTILYW SPGERATISS | RAS--QSVSS- ----SYLV | WYQQKPGQ APRLLIY | G---------- ASTRAT | GIPDRFSGSGSG- TDFTLTISRLEPEYFAVYYC | QQYGC------------SPLT | FGGGT KVEIK |
| iPS:437 377 | 21-225_74G9 | VK3|A27/ JK4 | EFMLTQSPGTLSL SPGERATLSC | RAS--QSVSS- ----SYLV | WYQQKPGQ APRLLIY | G---------- ASTRAT | GIPDRFSGSGSG- TDFTLTISRLEPEDFAVYYC | QQYGC------------SPLT | FGGGT KVEIK |
| | VK4|B3/JK4 | Germline | DIVMTQSPDSLAV SLGER.INC | KSS--QSVLYSSNNKN PKLLIS | WYQQKPGQ PPKLLIS | W---------- ASTRES | GVPDRFSGSGSG- TDFTLTISSLQAEDVAVYYC | QQYYS------------TPPT | FGGGT KVEIK |
| iPS:434 511 | 21-225_74B11 | VK4|B3/J K4 | DIVMTQSPDSLTV SLGERATINC | KSS---QSILYNSNNN YLA | WYQQKPGQ PPKLLIY | W---------- ASTRES | GVPDRFSGSGSG- TDFTLTISSLQAEDVAVYYC | QQYYS------------TPPT | FGGGT KVEIK |
| iPS:434 729 | 21-225_80B12 | VK4|B3/J K4 | DIVLTQSPDSLAV SLGERATINC | KSR--- QSVLYSSNRYN YLT | WYQQKPGQ PPKLLIY | W---------- ASTRES | GVPDRFSGSGSG- TDFTLTISSLQAEDVAVYYC | QQYYS------------SPPT | FGGGT KVEIK |
| iPS:434 851 | 21-225_75A6 | VK4|B3/J K4 | DIVMTQSPDSLAV SLGERATINC | KSR---QSVLHSSNNYN YLA | WYQQKPGQ PPKLLIY | W---------- ASTRES | GVPDRFSGSGCG- TDFTLTISSLQAEDVAVYYC | QQYYS------------TPPT | FGGGT KVEIK |
| iPS:435 623 | 21-225_162D5 | VK4|B3/J K4 | DIVMTQSPDFRNV SMGERAIINF | KSN--- HSVLYRSNNNQ YLA | WYQRKPGQ PPKLLIY | R---------- TSIRKS | GVPDRFSGSGCG- TDFTLIDSLQAEDVAVYYC | QQYYS------------TPPT | FGGGT KVEIK |
| iPS:446 086 | 21-225_94D8 | VK4|B3/J K4 | DIVLTQSPDSLAV SLGERATINC | KSR--- QSVLYSSNRYN YLT | WYQQKPGQ PPKLLIY | W---------- ASTRES | GVPDRFSGSGSG- TDFTLTISSLQAEDVAVYYC | QQYYS------------SPPT | FGGGT KVEIK |

Figure 51 (Continued)

| VK2JA19JK4 | | | | | | | | |
|---|---|---|---|---|---|---|---|---|
| iPS-434 539 | 21-225_74A2 | VK2JA19/JK4 | DIVMTQSPLSLPV TPGEPASISC | RSS---QSLLHSN-GHNYLD | WYLQKPGR SPQLLIY | L-------GSNRAS | GVPERFSGSGSG-TDFTLKISRVEAEDVGVYYC | MQPLQ------TPFT | FGGGT KVEIK |
| iPS-434 563 | 21-225_75D8 | VK2JA19/JK4 | DIVMTQSPLSLPV TPGEPASISC | RSS---QSLLHSS-GYNYLD | WYLQKPGQ SPQLLIY | L-------GSNRAS | GVPDRFSGSGSG-TDFTLKISRVEAEDVGLYYC | MQALH------PPLT | FGGGT KVEIK |
| iPS-435 009 | 21-225_89G4 | VK2JA19/JK4 | DIVMTQSPLSLPV TPGEPASISC | RSS---QSLLHSS-GYNYLD | WYLQKPGQ SPQLLIY | L-------GSNRAS | GVPDRFSGSGSG-TDFTLKISRVEAEDIGVYYC | MQALH------IPLT | FGGGT KVEIK |
| iPS-435 059 | 21-225_90C11 | VK2JA19/JK4 | DIVMTQSPLSLPV TPGEPASISC | RYS---QSLVHSS-GYNYLD | WYLQKPGQ SPQLVIY | L-------GSNRAS | GVPDRFSGSGSG-SDFTLKISRVEAEDVGLYYC | MQALH------PPLT | FGGGT KVEIK |
| iPS-435 103 | 21-225_92B2 | VK2JA19/JK4 | DIVMTQSPLSLPV TPGEPASISC | RSS---QSLVHSS-GYNYLD | WYLQKPGQ SFQLLIY | L-------GSNRAS | GVPDRFSGSGSV-TDFTLKISRVEAEDIGIYYC | MQALH------IPLT | FGGGT KVEIK |
| iPS-435 713 | 21-225_171D7 | VK2JA19/JK4 | DIVMTQSPLSLPV TPGEPASISC | RSS---QSLLYHN-GYNYLD | WYLQKTGQ SFQLLIY | V-------GSNRAS | GVPDRFSGSGSG-TDFTLKISRVEAEDVGVYYC | MQTLQ------TPLT | FGGGT KVEIK |
| iPS-436 246 | 21-225_201G6 | VK2JA19/JK4 | DIVMTQSPLSLPV TPGEPASISC | RSS---QSLLHNN-RYNHLD | WYLQKPGQ SFQLLIY | L-------GSNRAS | GVPDRFSGSGSG-TDFTLKISRVEAEDVGVYYC | MQAL-------QTPT | FGGGT KVEIK |
| iPS-436 254 | 21-225_202C1 2 | VK2JA19/JK4 | DIVMTQSPLSLPV TPGEPASISC | RSS---QSLLHNN-KYNHLD | WYLQKPGQ SFQLLIY | L-------GSNRAS | GVPDRFSGSGSG-TDFTLKISRVEAEDVGVYYC | MQAL-------QTPT | FGGGT KVEIK |
| iPS-436 304 | 21-225_201F3 | VK2JA19/JK4 | DIVLTQSPLSLPV TPGEPASISC | RSS---QSLLHNN-RYNHLD | WYLQKPGQ SFQLLIY | L-------GSNRAS | GVPDRFSGSGSG-TDFTLKISRVEAEDVGVYYC | MQAL-------QTPT | FGGGT KVEIK |
| iPS-436 334 | 21-225_208G3 | VK2JA19/JK4 | DIVLTQSPLSLPV TPGEPASISC | RSS---QSLLHNN-KYNHLD | WYLQKPGQ SFQLLIY | L-------GSNRAS | GVPERFSGSGSG-TDFTLKISRVEAEDVGVYYC | MQAL-------QTPT | FGGGT KVEIK |
| iPS-437 248 | 21-225_97H3 | VK2JA19/JK4 | DIVMTQSPLSLPV TPGEPASISC | RSS---QSLLHSN-GHNYLD | WYLQKPGR SPQLLIY | L-------GSNRAS | GVPERFSGSGSG-TDFTLKISRVEAEDVGVYYC | MQPLQ------TPFT | FGGGT KVEIK |
| iPS-437 320 | 21-225_75A1 | VK2JA19/JK4 | DIVMTQSPLSLPV TPGEPASISC | RSS---QSLLHSS-GHNYLD | WYLQKPGQ SPQLLIY | L-------GSNRAS | GVPERFSGSGSG-TDFTLKISRVEAEDVGVYYC | MQPLQ------TPFT | FGGGT KVEIK |
| iPS-437 371 | 21-225_74D8 | VK2JA19/JK4 | DIVMTQSPLSLPV TPGEPASISC | RSS---QSLVHSS-GYNYLD | WYLQKPGQ SPQLVIY | L-------GSNRAS | GVPDRFSGSGSG-SDFTLKISRVEAEDVGLYYC | MQALH------PPLT | FGGGT KVEIK |
| iPS-392 718 | 21-225_17B8 | VK2JA19/JK4 | DIVMTQSPLSLPV TPGEPASISC | RSS---QSLLHSN-GNNSLD | WYLQKPGQ SPQLLIY | L-------GSNRAS | GVPDRFSDSGSG-TDFTLKISRVEAEDVGVYYC | MQVLQ------TPFLT | FGGGT KVEIK |
| Germline | | | K_FR1 | K_CDR1 | K_FR2 | K_CDR2 | K_FR3 | K_CDR3 | K_FR4 |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434 871 | 21-225_85H1 | VK3\|L2/J K1 | EIVMTQSPATLSV SPGERATLSC | RAS--QDVI ----TYLA | WYQQKPGQ APRLLIY | ASTRAT | GVPARFSGSGSG- TEFTLTISSLQSEDFAVYYC | QEYND-------- -------MFCS | FGQGT KVEIK |
| iPS:435 421 | 21-225_151F1 | VK3\|L2/J K1 | EMVMTQSPATLSV SPGERVLSC | RAS--QSIN ----INIA | WYQQKPGQ APRLLIY | ASTRAT | GIPARFSGSGSG- TEFTLTISSLQSEDFAVYYC | QQYND-------- -------WPPWT | FGQGT KVEIK |
| iPS:435 497 | 21-225_155H9 | VK3\|L2/J K1 | EIVMTQSPATLSV SPGERATLSC | RAS--QSVS ----SNLA | WYQQKPGQ APRLLIY | ASTRAT | GIPARFSGSGSG- TEFTLTISSLQSEDFAVYYC | QQYDD-------- -------WPPWT | FGQGT KVEIK |
| iPS:435 605 | 21-225_161A4 | VK3\|L2/J K1 | EIVMTQSPATLSV SPGERASLSC | RSS--QSVN ----SNLA | WYQQRPGQ ALRLLIY | ASIRAT | DIPARFNGSGSG- TEFTLTISSLQSEDFAVIFC | QQYN--------- -------NWWT | FGQGT TVEIK |
| iPS:451 118 | 21-225_191C8 | VK3\|L2/J K1 | EIVMTQSPATLSV SPGERATLSC | RAS--QSVR ----SNLA | WYQQEPGQ APRLLIY | ASTRAT | GIPARFSGSGSG- TEFTLTISSLQSEDFAVYFC | QQSFT-------- -------WLRE | FGQGT KVEIK |
| iPS:392 734 | 21-225_17D8 | VK3\|L2/J K1 | EIVMTQSPSTLSV SPGERATLSC | RAS--QSVS ----SNLA | WFQQKPGQ APRLLIN | ASTRAS | GIPARFSGSGSG- TEFTLTISSLQSEDFAVYYC | QQYNN-------- -------WPLT | FGQGT KVEIK |
| iPS:392 768 | 21-225_20B8 | VK3\|L2/J K1 | EIVMTQSPSTLSV SPGERVTLSC | RAS--QSVS ----SNLA | WFQQKPGQ APRLLIN | ASTRAS | GIPARFSGSGSG- TEFTLTISSLQSEDFAVYYC | QQYNN-------- -------CPLT | FGQGT KVEIK |
| iPS:393 044 | 21-225_25B8 | VK3\|L2/J K1 | EIVMTQSPATLSV SPGERATLSC | RAS--QSVR ----SNLA | WYQQKPGQ APRLLIY | ASTRAS | GIPARFSGSGSG- TEFTLTISSLQSEDFALYFC | QQYNN-------- -------WPPWP | FGQGT KVEIK |
| iPS:393 050 | 21-225_28C5 | VK3\|L2/J K1 | EIVMTQSPATLSV SPGERATLSC | RAS--QSVS ----SNLA | WYHQKPGQ APRLLIY | ASTRAT | GIPARFSGSGSG- TEFTLTISSLQSEDFALYYC | QQYNN-------- -------WPPWP | FGQGT KVEIK |
| iPS:393 906 | 21-225_13D3 | VK3\|L2/J K1 | EIVMTQSPATLSV SPGESAILSC | RAS--QTVS ----SNLA | WFQQKPGQ APRLLIN | ASTRAT | GIPARFSGSGSG- TEFTLTISSLQSEDFAVYFC | QQYHD-------- -------WPPT | FGQGT KVEIK |
| | | Germline | K_FR1 | K_CDR1 | K_FR2 | K_CDR2 | K_FR3 | K_CDR3 | K_FR4 |
| VK1\|L1/JK5 | | | DIVMTQSPDSLAV SLGERATINC | KSS---QSVLY SSNNKNYLA | WYQQKPGQ PPKLLIY | WASTRES | GVPDRFSGSGSG- TDFTLTISSLQAEDVAVYYC | QQYYS-------- -------YPLT | FGQGT RLEIK |
| iPS:434 947 | 21-225_87B7 | VK1\|L1/J K5 | DIQMTQSPSSLSA SVGDRVTITC | RAS--QGIS ----NYLA | WFQQKPGK APKSLIY | ASSLHS | GVPSKFSGSGSG- TDFTLTISSLQPEDSAIYFC | LLYLT-------- -------YPLT | FGQGT RLEIK |
| iPS:435 427 | 21-225_151C9 | VK1\|L1/J K5 | DIQMTQSPSSLSA SVGDRVTITC | RAS--QGIS ----KYLA | WFQQKPGK APKSLIY | ASSLHS | TDFTLTISSLQPEDSATYFC GVPSKFSGSGSG- | HQYKH-------- -------YPIT | FGQGT RLEIK |
| iPS:435 529 | 21-225_157H7 | VK1\|L1/J K5 | DIQMTQSPSSLSA SVGDRVTITC | RAS--QDIS ----NFLA | WFQQKPGK APKSLVS | ASRLQS | GVPSKFSGSGSG- TDFTLTISSLQPEDFATYYC | QQYHS-------- -------YPIT | FGQGT RLEIK |
| iPS:436 066 | 21-225_194B7 | VK1\|L1/J K5 | DIQMTQSPSSLSA SVGDRVTITC | RAS--QGIS ----KYLA | WFQQKPGK APKSLIY | ASRLQS | GVPSKFSGSGSG- TDFTLTISSLQPEDFATYYC | QHYLN-------- -------YPLT | FGQGT RLEIK |
| iPS:437 274 | 21-225_196D4 | VK1\|L1/J K5 | DIQMTQSPSSLSA SVGDRVTITC | RAS--QGIN ----NYLA | WFQQNPGK APKSLIY | ASSLQS | GVPSKFSGSGCG- IDFTLTISSQPEDVATYYC | QHYLN-------- -------YPLT | FGQGT RLEIK |
| iPS:392 748 | 21-225_20A8 | VK1\|L1/J K5 | DIQMTQSPSSLSA SVGDRVTITC | RAS--QGIN ----NYLV | WFQQKPGK APKSLIY | ASSLLS | GVPSKFSGSGSG- IDFTLTISSLQPEDFATYYC | QQYNS-------- -------YPIT | FGQGT RLEIK |
| iPS:393 062 | 21-225_33H3 | VK1\|L1/J K5 | DIQMTQSPSSLSA SVGDRVTITC | QAS--QDIS ----NFLN | WFRQKPGK APNSLIY | ASNLVT | GVPSRFSGSGRSG- IDFTFTISSLQPEDFATYFC | QQYDN-------- -------LPIT | FGQGT RLEIK |
| iPS:398 532 | 21-225_33B7 | VK1\|L1/J K5 | DIQMTQSPSSLSA SVGDRVTITC | RAS--QDIS ----NYLA | WFQQKPGK APTSLIY | ASSLQS | GVPSKFSGSGSG- TDFTLTISSLQPEDFATYYC | QQYHS-------- -------YPLT | FGQGT RLEIK |
| iPS:402 221 | 21-225_2C12 | VK1\|L1/J K5 | DIQMTQSPSSLSA SVGDRVTITC | RAS--QGIS ----NYLA | WFQQKSGK APKSLIS | ATSLQS | GVPSQFSGSGSG- TDFTLTISSLQPEDFATYYC | QQYYS-------- -------YPIT | FGQGT RLEIK |
| | | Germline | K_FR1 | K_CDR1 | K_FR2 | K_CDR2 | K_FR3 | K_CDR3 | K_FR4 |
| VK4\|B3/JK5 | | | DIVMTQSPDSLAV SLGERATINC | KSS---QSVLY SSNNKNYLA | WYQQKPGQ PPKLLIY | WASTRES | GVPDRFSGSGSG- TDFTLTISSLQAEDVAVYYC | QQYYS-------- -------YPLT | FGQGT RLEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:435 665 | 21-225_169F2 | VK4|B3/J K5 | DIVMTQSPDSLAV SLGERATINC | KSS-- QSVLYISNNKN YLA | WYQQKPGQ PPKLLIY | W----- ASTRES | GVPDRFSGSGSG-- TDFTLTISSLQAEDVAVYYC | QQYY-------- -------RAFT | FGQGT RLEIK |
| iPS:435 671 | 21-225_169H5 | VK4|B3/J K5 | DIVMTQSPDSLAV SLGERATINC | KSS-- QSVLYISNNKN YLA | WYQQKPGQ PPKLLIY | W----- ASTRES | GVPDRFSGSGSG-- TDFTLTISSLQAEDVAVYYC | QQYY-------- -------RAFT | FGQGT RLEIK |
| iPS:436 554 | 21-225_224C1 | VK4|B3/J K5 | DIVMTQSPDSLAA SLGERATITC | KSS-- QSVLYNSNMKN YLA | WYQQKPGQ PPKLLIY | W----- ASTRES | GVPDRFSGSGSG-- TDFTLTISSLQAEDVAIYYC | QQYY-------- -------NPCS | FGQGT RLEIK |
| iPS:436 510 | 21-225_25A3 | VK4|B3/J K5 | DIVMTQSPDSLTV SLGERATINC | KSS-- QSVLYSSNNKN YLA | WYQQKPGQ PPKLLIY | W----- ASTRES | GVPDRFSGSGSG-- TDFTLTISSLQAEDVAVYYC | QQYYS------- -------TPCS | FGQGT RLEIK |
| iPS:398 516 | 21-225_26A9 | VK4|B3/J K5 | DIVMTQSPDSLAV SLGERATINC | KSS-- QSVLYSSNNKN YLA | WYQQKPGQ PPKLLIY | W----- ASTRES | GVPDRFSGSGSG-- TDFTLTISSLQAEDVAVYYC | QQYYS------- -------SPCS | FGQGT RLEIK |
| Germline | VK2|A19|JK1 | | | | | | | |
| iPS:435 667 | 21-225_169E3 | VK2|A19/ JK1 | DIVMTQSPLSLPV TPGEPASISC | RSS-- QSLLHNN- GKYLD | WYLQKPGQ SPQLLIY | L----- GSNRAS | GVPDRFSASGSG-- TDFTLKISRVEAEDVGVYYC | MQVLQ------- -------TPWT | FGQGT KVEIK |
| iPS:435 673 | 21-225_169E6 | VK2|A19/ JK1 | DIVMTQSPLSLPV TPGEPASISC | RSS-- QSLLHNN- GKYLD | WYLQKPGQ SPQLLIY | L----- GSNRAS | GVPDRFSASGSG-- TDFTLKISRVEAEDVGVYYC | MQVLQ------- -------TPWT | FGQGT KVEIK |
| iPS:435 759 | 21-225_176E6 | VK2|A19/ JK1 | DIVMTQSPLSLPV TPGEPASISC | RSS-- QSLLHNN- GKYLD | WYLQKPGQ SPQLLIY | L----- GSNRAS | GVPDRFSASGSG-- TDFTLKISRVEAEDVGVYYC | MQVLQ------- -------TPWT | FGQGT KVEIK |
| Germline | VK6|A26|JK1 | | | | | | | |
| iPS:435 817 | 21-225_190B1 | VK6|A26/ JK1 | EIVLTQFPDSQSV APKEKVTITC | RAS-- QSIG- -SNLH | WYQQKPDQ SPKLLIK | S----- ASQSFS | GVPSRFSGSGSG-- TDFTLTINSLETEDAATYYC | QQSSS------- -------LPWT | FGQGT KVEIK |
| iPS:435 823 | 21-225_190F11 | VK6|A26/ JK1 | EIVLTQFPDSQSV TPKEKVTITC | RAS-- QNIG- -SSLH | WYQQKPEQ SPKVLIK | Y----- ASQSFS | GVPSRFSGSGSG-- TDFTLTINSLEAEDAATYYC | HQSSS------- -------FPRT | FGQGT KVEIK |
| iPS:435 867 | 21-225_191E5 | VK6|A26/ JK1 | EIVLTQFPDSQSV TPKEKVTITC | RAS-- QSIG- -SSLH | WYQQKPDQ SPKLLIK | Y----- ASQSFS | GVPSRFSGSGSG-- TDFTLTINSLEAEDAATYYC | HQSSS------- -------FPRT | FGQGT KVEIK |
| iPS:435 917 | 21-225_190D5 | VK6|A26/ JK1 | EIVLTQFPDSQSV TPKEKVTITC | RAS-- QSIG- -SNLH | WYQQKPGQ SPKLLIR | S----- ASQSFS | GVPSRFSGSGSG-- TDFTLTINSLETEDAATYYC | QQSSS------- -------LPWT | FGQGT KVEIK |
| iPS:435 929 | 21-225_190D9 | VK6|A26/ JK1 | EIVLTQFPDSQSV TPKEKVTITC | RAS-- QSIG- -SSLH | WYQQKPDQ SPKLLIK | Y----- ASQSFS | GVPSRFSGSGSG-- TDFTLTINSLEAEDAATYYC | HQSSS------- -------FPRT | FGQGT KVEIK |
| iPS:435 935 | 21-225_190H8 | VK6|A26/ JK1 | EIVLTQFPDSQSV APKEKVTITC | RAS-- QSIG- -SSLH | WYQQKPDQ SPKLLIK | Y----- ASQSFS | GVPSRFSGSGSG-- TDFTLTINSLEAEDAATYYC | HQSSS------- -------FPRT | FGQGT KVEIK |
| iPS:436 056 | 21-225_194C3 | VK6|A26/ JK1 | EIVLTQFPDSQSV TPKEKVTITC | RAS-- QSIG- -SNLH | WYQQKPGQ SPKLLIK | S----- ASQSFS | GVPSRFSGSGSG-- TDFTLTINSLETEDAATYYC | QQSSS------- -------LPWT | FGQGT KVEIK |
| iPS:436 216 | 21-225_200B7 | VK6|A26/ JK1 | EIVLTQSPDFQSV TPKEKVTITC | RAS-- QNIG- -NTLH | WYQQKPDQ SPKLLIK | Y----- ASQSFS | GVPSRFSGSGSG-- TDFTLTINSLEAEDAATYYC | HQSGS------- -------LPQT | FGQGT KVEIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:436 220 | 21-225_200F8 | VK6|A26/ JK1 | EIVLTQSPDFQSV APKEKVTITC | RAS--QSIG- ----SNLH | WYQQKPDQ SPKLLIK | S------- ASQSFS | GVPSRFSGSGSG-- TDFTLTINSLEAEDAATYYC | QQSSS------LPWT | FGGGT KVEIK |
| iPS:435 448 | 21-225_217A3 | VK6|A26/ JK1 | EIVLTQSPDFKSV TPKEKVTITC | RAS--QSIG- ----SSLH | WYQQKPDQ SPKLLVK | Y------- ASQSFS | GVPSRFSGSGSG-- TDFTLTINSLEAEDGATYYC | HQSRS------LPWT | FGGGT KVEIK |
| | | VK6|A26/JK 4 Germline | | | | | | | K_FR4 |
| iPS:435 829 | 21-225_190B1 2 | VK6|A26/ JK4 | EIVLTQSPDFQSV TPKEKVTITC | RAS--QSIG- ----SSLH | WYQQKPDQ SPKLLIK | Y------- ASQSFS | GDFSRFSGSGSG-- TDFTLTINSLDAEDAATYYC | HQTRS------LPLT | FGGGT KVEIK |
| iPS:435 863 | 21-225_191H4 | VK6|A26/ JK4 | EIVLTQSPDFQSV TPKEKVTITC | RAN--QSIG- ----SSLH | WYQQKPDQ SPKLLIK | Y------- ASQSLS | GVPSRFSASGSG-- TDFTLTINSLEAEDAATYYC | HQTGR------LPLT | FGGGT KVEIK |
| iPS:435 943 | 21-225_191C9 | VK6|A26/ JK4 | EIVLTQSPDFQSV TPKEKVTITC | RAS--QSIG- ----SSLH | WYQQKPDQ SPKLLIK | Y------- ASQSFS | GDFSRFSGSGSG-- TDFTLTINSLEAEDAATYYC | HQTRS------LPLT | FGGGT KVEIK |
| iPS:435 983 | 21-225_192E5 | VK6|A26/ JK4 | EIVLTQSPDFQSV TPKEKVTITC | RAS--QSIG- ----SSLH | WYQQKPDQ SPKLLIK | Y------- ASQSFS | GVPSRFSGSGSG-- TDFTLTINSLEAEDAATYYC | HQSSR------LPLT | FGGGT KVEIK |
| iPS:436 043 | 21-225_193G9 | VK6|A26/ JK4 | EIVLTQSPDFQSV TPKEKVTITC | RAS--QSIG- ----RSLH | WYQQKPDQ SLKLLIK | Y------- ASQSFS | GVPSRFSGSGSG-- TDFTLTINSLEAEDAATYYC | HQSRT------LPLT | FGGGT KVEIK |
| iPS:436 084 | 21-225_195F2 | VK6|A26/ JK4 | EIVLTQSPDFQSV TPKEKVTITC | RAS--QSIG- ----SSLH | WYQQKPDQ SPKLLIK | Y------- ASQSFS | GVPSRFSGSGSG-- TDFALTINSLEAEDAATYYC | HQSRT------LPLT | FGGGT KVEIK |
| iPS:436 094 | 21-225_195B1 | VK6|A26/ JK4 | EIVLTQSPDFQSV TPKEKVTITC | RAS--QSIG- ----SSLH | WYQQKPDQ SPKLLIK | Y------- ASQSFS | GVPSRFSGSGSG-- TDFTLTINSLEAEDAATYYC | HQSGR------LPLT | FGGGT KVEIK |
| iPS:436 240 | 21-225_201E8 | VK6|A26/ JK4 | EIVLTQSPAFQSV TPKEKVTITC | RAS--QNIG- ----RSLH | WYQQKPDQ SPKLLIK | Y------- ASQSFS | GVPSRFSGSGSG-- TNFTLTINSLEARDAVTYYC | HQSRS------LPLT | FGGGT KVEIR |
| iPS:436 314 | 21-225_206G4 | VK6|A26/ JK4 | EIVLTQSPDFQSV TPKEKVTITC | RAS--QSIG- ----RSLH | WYQQKPDQ SFKLLIK | Y------- ASQSFS | GVPSRFSGSGSG-- TDFTLTINSLEAEDAATYYC | HQSRS------LPLT | FGGGT KVEIK |
| | | VK1|A20/JK 3 Germline | | | | | | | K_FR4 |
| iPS:435 833 | 21-225_190D1 2 | VK1|A20/ JK3 | DIQMTQSPSSLSA SVGDRVTITC | RAS--QGIS- ----NYLA | WYQQKPGK VFKLLIY | V------- ASTLQS | GVPSRFSGSGSG-- TDFTLTISSLQPEDVATYYC | QKYNS------APFT | FGPGT KVDIK |
| iPS:435 019 | 21-225_193C4 | VK1|A20/ JK3 | DIQMTQSPSSLSA SVGDRVTITC | RPS--QGIS- ----IYLA | WYQQKPGN VFKLLIY | A------- ASTLQS | GVPSRFSGSGSG-- TDFTLTISSLQPEDVATYYC | QKYNS------APFT | FGPGT KVDIK |
| iPS:394 010 | 21-225_12G5 | VK1|A20/ JK3 | DIQMTQSPSSLSA SVGDRVTIPC | RAS--QDIS- ----NYLA | WYQQKPGK VPKLLIY | A------- AYILQS | GVPSRFSGSGSG-- TDFTLTISSLQPEDVAAYYC | QKYDS------APFT | FGPGT KVDIK |
| | | VK1|A20/JK 3 Germline | | | | | | | K_FR4 |
| iPS:436 025 | 21-225_193B5 | VK6|A26/ JK3 | EIVLTQSPDFQSV TPKEKVTITC | RAS--QSIG- ----SSLH | WYQQKPDQ SPKLLIK | Y------- ASQSFS | GVPSRFSGSGSG-- TDFTLTINSLEAEDAATYYC | HQSSR------LPFT | FGPGT KVDIK |
| iPS:436 096 | 21-225_195E1 | VK6|A26/ JK3 | EIVLTQSPDFQSV TPKEKVTITC | RAS--QSIG- ----SSLH | WYQQKPDQ SPKLLIK | Y------- ASQSFS | GVPSRFSGSGSG-- TDFTLTINSLEAEDAATYYC | HQSSR------LPFT | FGPGT KVDIK |
| iPS:436 408 | 21-225_214H8 0 | VK6|A26/ JK3 | EIVLTQSPDFQSV TPKEKVTITC | RAS--QSIG- ----VSLH | WYQQKPDQ SFQLLIK | Y------- ASQSFS | GVPSRFSGSGSG-- TDFTLTINSLEAEDAATYYC | HQSRS------LPFT | FGPGS KVDIK |

Figure 51 (Continued)

| | | K_FR1 | K_CDR1 | K_FR2 | K_CDR2 | K_FR3 | K_CDR3 | K_FR4 |
|---|---|---|---|---|---|---|---|---|
| iPS:436_424 | 21-225_215H6 | VK6|A26/ JK3 | EIVLTQSPDFQSV TPKEKVTITC | RAS--QSIG-----VSLH | WYQQKPDQ SPQLLIK | Y------ASQSLS | GVPSRFSGSGSG---TDFTLTINSLEAEDAATYYC | HQSRS-------LPFT | FGPGS KVDIK |
| | | VK1|L5/JK2 Germline | DIQMTQSPSSVSA SVGDRVTITC | RSS----NWLA | WYQQKPGK APKLLIY | A------ASSLQS | GVPSRFSGSGSG---TDFTLTISSLQPEDFATYYC | QRANS-------FPFT | FGQGT KLEIK |
| iPS:436_082 | 21-225_195D9 | VK1|L5/J K2 | DIQMTQSPSSVSA SVGDRVTITC | RAS--QGIS-----RWLA | WYQQKPGK APKLLIY | A------ASSLLG | GVPSRFSGSGSG---TDFTLTISSLQPEDFATYYC | QRANS-------PPCS | FGQGT KLEIK |
| iPS:436_118 | 21-225_196A1 | VK1|L5/J K2 | DIQMTQSPSYVSA SVGDRVSITC | RAS--QGIS-----RWLA | WYQQKPGK AAKFLIY | A------ASSLLG | GVSSRFSGSGSG---TDFTLTISSLQPEDFAIYYC | QRDNS-------LPCS | FGQGT KLEIK |
| | | VK2|A19/JK2 Germline | DIVMTQSPLSLPV TPGEPASISC | RSS----QSLLHSN-GYNYLD | WYLQKPGQ SPQLLI | L------VSNRAS | GVPDRFSGSGSG---TDFTLKISRVEAEDVGVYYC | MQALQ-------TPFT | FGQGT KLEIK |
| iPS:436_362 | 21-225_210C1 | VK2|A19/ JK2 | DIVMTQSPLSLPV TPGEPASISC | RSS----QSLLHYN-GHNFLD | WYLQKPGQ SPQLLIY | L------VSNRAS | GVPDRFSGSGSG---TDFTLKISRVEAEDVGVYYC | MQALQ-------TPMCS | FGQGT KLEIK |
| iPS:436_374 | 21-225_211C1 | VK2|A19/ JK2 | DIVMTQSPLSLPV TPGEPASISC | RSS----QSLLHSN-GYNYLD | WYLLKPGQ SPQLLIY | L------GSNRAS | GVPDRFSGSGSG---TDFTLKISRMEAEDVGIYYC | MQALL-------TPVCS | FGQGT KLEIK |
| | | VK2|A17/JK1 Germline | DIQMTQSPLSLPV TPGQPASISC | RSS----QSLVYSD-GNTYLN | WYQQKPGQ SPRRLI | K------VSNWDS | GVPDRFSGSGSG---TDFTLKISRVEAEDVGVYYC | MQGTH-------WPWT | FGQGT KVEIK |
| iPS:437_226 | 21-225_57C2 | VK2|A17/ JK1 | DVVMTQSPLSLPV TLGQPASISC | RSS----QSLVYSD-GNTYLN | WFQQRPGQ SPRRLIY | E------VSNWDS | GVPNRFSGSGSG---TDFTLKISAVEAERDVGVYYC | VQGTH-------WPRT | FGQGT RVEIK |
| | | VK1|A20/JK5 Germline | DIQMTQSPSSLSA SVGDRVTITC | RAS----QGIS-----NYLA | WYQQKPGK APKLLI | A------ASTLQS | GVPSRFSGSGSG---TDFTLTISSLQPEDFATYYC | QKYNS-------APFT | FGQGT RLEIK |
| iPS:392_726 | 21-225_20B5 | VK1|A20/ JK5 | DIQMTQSPSSLSA SVGDRVTITC | RAS----QGIN-----NYLA | WYQQKPGK IPKLLIY | A------ASTLQS | GVPSRFSGSGSG---TDFTLTISSLQPEDVATYYC | QKYNS-------APPIT | FGQGT RLEIK |
| iPS:392_792 | 21-225_20G12 | VK1|A20/ JK5 | DIQMTQSPSSLSA SVGDRVTITC | RAS----QGIS-----NYLA | WYQQKPGK VPKVLIY | T------ASTLQS | GVPSRFSGSGSG---TDFTLIVSSLQPEDVAIYYC | QKYNS-------APPIT | FGQGT RLEIK |
| iPS:398_478 | 21-225_17C10 | VK1|A20/ JK5 | DIQMTQSPSSQSA SVGDRVTITC | RAS----QGIS-----NYLA | WYQQKPGR VPKLLIY | A------ASTLQS | GVPSRFSGSGSG---TDFTLTISSLQPDDVATIYYC | QKYNS-------APPLT | FGQGT RLEIK |
| | | VK1|L1/JK2 Germline | DIQMTQSPSSLSA SVGDRVTITC | RAS----QGIS-----KYLA | WFQQKPGK APKSLI | A------ASSLQS | GVPSRFSGSGSG---TDFTLTISSLQPEDFATYYC | QQYNS-------YPFT | FGQGT KLEIK |
| iPS:392_776 | 21-225_21A12 | VK1|L1/J K2 | DIQMTQSPSSLSA SVGDRVTITC | RAS----QGIS-----KYLA | WFQQKPGK APKSLIY | A------ASSLQS | GVPSKFSGSGSG---TDFTLTISSLQPEDFATYYC | QQYNS-------YPFR | FGQGT KLEIK |
| | | VK1|A30/JK3 Germline | DIQMTQSPSSLSA SVGDRVTITC | RAS----QGIR-----NDLG | WYQQKPGK APKRLI | A------ASSLQS | GVPSRFSGSGSG---TEFTLTISSLQPEDFATYYC | LQHNS-------YPFT | FGPGT KVDIK |
| iPS:437_240 | 21-225_84H12 | VK1|A30/ JK3 | DIQMTQSPSYQSA SVGDRVTITC | RAS----QGIR-----NDLG | WFQQKPGK APKRLIY | A------ASSLQS | GVPSRFSGSGSG---TEFTLTISSLQPEDFATYYC | LQHND-------YPFT | FGPGT KVDIK |

Figure 51 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:434577 | 21-225_75C11 | VK1fA30/JK3 | DIQMTQSPSSLSASVGDRVTITC | RAS---QGIR------NDLG | WFQQKPGK APKRLIY | A-------ASSLQS | GVPSRFSGSGSG---TEFTLTISSLQPEDFATYYC | LQHND-----------YPFT | FGPGT KVDIK |
| iPS:434553 | 21-225_76H12 | VK1fA30/JK3 | DIQMTQSPSSLSASVGDRVTITC | RAS---QGIR------NDLG | WFQQKPGK APKRLIY | A-------ASRLQS | TEFTLTISSLQPEDFATYYC | LQHND-----------YPFT | FGPGI KVDIK |
| iPS:434927 | 21-225_86E5 | VK1fA30/JK3 | DIQMTQSPSSLSASVGDRVTITC | RAS---QGIR------NDLG | WYQQKPGK APKRLIY | A-------ASSLQS | GVPSRFSGSGSG---TEFTLTISSLQPEDFATYHC | LQHND-----------YPFT | FGPGT KVEIK |
| | | Germline VK1fL5/JK1 | | | | | | | |
| iPS:435477 | 21-225_154E8 | VK1fL5/JK1 | DIQMTQSPSSVSASIGDRVTITC | RAS---QFIS------SWLA | WYQQKPGK APKLLIY | T-------ASSLQS | GVPSRFSGSGSG---TDFTLTISSLQPEDFATYYC | QQANS-----------FPWT | FGGGT KVEFN |
| iPS:435385 | 21-225_149G7 | VK1fL5/JK1 | DIQMTQSPSSVSASVGDRVTITC | RAS---QFIS------SWLA | WYQQKPGK APKFLIY | A-------ASSLQS | GVPSRFSGSGSG---TDFTLTISSLQPEDFATYYC | QQANS-----------PPWT | FGGGT KVEIN |

LAMBDA VARIABLE

| | | | L_FR1 | L_CDR1 | L_FR2 | L_CDR2 | L_FR3 | L_CDR3 | L_FR4 |
|---|---|---|---|---|---|---|---|---|---|
| | | Germline VL3f3r/JL2 | SYELTQP-PSVSVSPGQTASITC | SGD---KLGD------KYAL | WYQQRPGH SPVLVIY | Q-------DSKRPS | GIPERFSGSNSG---NTATLTISGTQAMDEADYYC | QAWDS-----------STAV | FGGGT KLTVL |
| iPS:453445 | 21-225_148E10 | VL3f3r/JL2 | SYELTQP-PSVSVSPGQTASITC | SGD---KLGN------KYVC | WYQRPGH AAVLIIY | Q-------DSKRPS | GIPERFSGSNSG---NTATLTISGTQAMDEADYFC | QAWDR-----------NTYVV | FGGGT KLTVL |
| iPS:472742 | 21-225_30D9_LC2 | VL3f3r/JL2 | SYELTQP-PSVSVSPGQTASITC | SGD---KLGD------KYVI | WFQQKPGQ SPVLVIY | Q-------DRKRPS | GIPERFSGSNSG---NTATLTISGTQALDEADYYC | QAWDN-----------STAV | FGGGT KLTVL |
| iPS:472743 | 21-225_68G6 | VL3f3r/JL2 | SYEVTQP-PSVSVSPGQTASITC | SGD---KLGD------KYTY | WYQQKAGQ SPFLVIY | Q-------DRKRPS | GIPERFSGSNSG---NTATLTISGTQAMDAADFYC | QAWDN-----------STAV | FGGGT KLTVL |
| iPS:436652 | 21-225_146B11 | VL3f3r/JL2 | SYELTQP-PSVSVSPGQTASITC | SGD---KLGD------KYAS | WYQQKPGQ SPVLVIY | Q-------DRKRPS | GIPERFSGSNSG---NTATLTISGTQAMDEADYYC | QAWDS-----------STVV | FGGGT KLTVL |
| iPS:436654 | 21-225_146C11 | VL3f3r/JL2 | SYELTQP-PSVSVSPGQTASITC | SGD---KLGD------KYAS | WYQQKPGQ SPVLVIY | Q-------DRKRPS | GIPERFSGSNSG---NTATLTISGTQAMDEADYYC | QAWDS-----------STVV | FGGGT KLTVL |
| iPS:436658 | 21-225_146A2 | VL3f3r/JL2 | SYELTQP-PSVSVSPGQTASITC | SGD---KLGD------KYAS | WYQQKPGQ SPVLVIY | Q-------DRKRPS | GIPERFSGSNSG---NTATLTISGTQAMDEADYYC | QAWDS-----------STVV | FGGGT KLTVL |
| iPS:436664 | 21-225_147E7 | VL3f3r/JL2 | SYELTQP-PSVSVSPGQTASITC | SGD---KLGN------KYAS | WYQQKPGQ SPVLVIY | Q-------DSKRPS | GIPERFSGSNSG---NTATLTISGTQAMDEADYYC | QAWGS-----------STVV | FGGGT KLTVL |
| iPS:436666 | 21-225_147B8 | VL3f3r/JL2 | SYELTQP-PSVSVSPGQTASITC | SGD---KLGD------KYVC | WYQQKPGQ SPELVIY | Q-------DRKRPS | GIPERFSGSNSG---NTATLTISGTQAMDEADYYC | QAWDS-----------NTAVV | FGGGT KLTVL |
| iPS:436668 | 21-225_147B9 | VL3f3r/JL2 | SYELTQP-PSVSVSPGQTASITC | SGD---KLGD------KYVS | WYQQKPGQ SPVLVIY | Q-------DRKRPS | GIPERFSGSNSG---NTATLTISGTLAVDEADYYC | LAWDS-----------STFVV | FGGGT KLTVL |
| iPS:436670 | 21-225_147D9 | VL3f3r/JL2 | SYELTQP-PSVSVSPGQTASITS | SGD---KLGN------KYVC | WYQQRPGQ SPVLVIY | Q-------DSKRPS | GIPERFSGSNSG---NTATLTISGTQAMDEADYYC | QAWDR-----------NTYVV | FGGGT KLTVL |

Figure 51 (Continued)

| | | | | | | | | | |
|---|---|---|---|---|---|---|---|---|---|
| iPS:4 36672 | 21-225_147F9 | VL3j3r/JL2 | SYELTQP-PSVSVSPGQTASI TC | SGD----ELGN-----KYAC | WYQQKPGQ SPVLVIY | Q-------DSKRPS | GIPERFSGSNSG--NTATLTISGTQAMDEADYYC | QAWHS------------- -----STVV | FGGGT KLTVL |
| iPS:4 36674 | 21-225_147G9 | VL3j3r/JL2 | SYELTQP-PSVSVSPGQTASI TC | SGD-----KYAC | WYQQKPGQ SPVLVIY | Q-------DRKRPS | GIPERFSGSNSG--NTATLTISGTQAMDEADYYC | QAWDS------------- -----STVV | FGGGT KLTVL |
| iPS:4 36676 | 21-225_147E11 | VL3j3r/JL2 | SYELTQP-PSVSVSPGQTASI TC | SGD----KLGD-----KYAS | WYQQKPGQ SPVLVIY | Q-------DSKRPS | GIPERFSGSNSG--NTATLTISGTQAMDEADYYC | QAWDS------------- -----STVV | FGGGT KLTVL |
| iPS:4 36678 | 21-225_147B12 | VL3j3r/JL2 | SYELTQP-PSVSVSPGQTASI TC | SGD----KLGD-----KYAS | WYQQKPGQ SPVLVIY | Q-------DSKRPS | GIPERFSGSNSG--NAATLTISGIQAMDEADYYC | QAWDS------------- -----STVV | FGGGT KLTVL |
| iPS:4 36686 | 21-225_148G6 | VL3j3r/JL2 | SYELTQP-PSVSVSPGQTASI TC | SGD----KLGD-----KYAS | WYQQKPGQ SPVLVIY | Q-------DSKRPS | GIPERFSGSNSG--NTATLTISGIQAMDEADYYC | QAWHS------------- -----STVV | FGGGT KLTVL |
| iPS:4 36688 | 21-225_148C8 | VL3j3r/JL2 | SYELTQP-PSVSVSPGQTASI TC | SGD----KLGD-----KYVS | WYQQKPGQ SFILVIY | Q-------DRKRPS | GIPERFSGSNSG--NTATLTISGTQAMDEADYYC | LAWDS------------- -----STFVV | FGGGT KLTVL |
| iPS:4 36690 | 21-225_148A9 | VL3j3r/JL2 | SYELTQP-PSVSVSPGQTASI TC | SGD----KLGD-----KFAS | WYQQKPGQ SPVLVIY | Q-------DSKRPS | GIPERFSGSNSG--NTATLTISGTQAMDEADYYC | QAWHS------------- -----STVV | FGGGT KLTVL |
| iPS:4 36694 | 21-225_148G11 | VL3j3r/JL2 | SYELTQP-PSVSVSPGQTASI TC | SGD----KLGD-----KYVC | WYQQKPGQ SPVLVIY | Q-------DSKRPS | GIPERFSGSNSG--NTATLTISGTQAMDEADYYC | QAWDS------------- -----STVV | FGGGT KLTVL |
| iPS:4 36698 | 21-225_149B5 | VL3j3r/JL2 | SYELTQP-PSVSVSPGQTASI TC | SGY----KLGY-----KYVC | WYQQKPGQ SPVLVIP | Q-------NNQRPS | GIPERFSGSNSG--NTASLTISGTQAMDEADYYC | QAWDS------------- -----STVV | FGGGT KLTVL |
| iPS:4 36700 | 21-225_149C7 | VL3j3r/JL2 | SYELTQP-PSVSVSPGQTASI TC | SGN----KLGD-----KYAS | WYQQKPGQ SPVLVIY | Q-------DSKRPS | GIPERFSGSKSG--NTATLTISGIQAMDEADYYC | QAWDS------------- -----STVV | FGGGT KLTVP |
| iPS:4 36704 | 21-225_149C10 | VL3j3r/JL2 | SYELTQP-PSVSVSPGQTASI TC | SGD----KLGD-----KYAS | WYQQKPGQ SPVLVIY | Q-------DNKRPS | GIPERFSGSNSG--NTATLTIGGIQAMDEADYYC | QAWDS------------- -----STVV | FGGGT KLTVL |
| iPS:4 36706 | 21-225_149A11 | VL3j3r/JL2 | SYELTQP-PSVSVSPGQTASI TC | SGD----KLGN-----KYVS | WYQQKPGQ SPVLVIY | Q-------DSRRPS | GIPERFSGSNSG--NTATLTISGTQAMDEADYYC | LAWDS------------- -----STFVV | FGGGT KLTVL |
| iPS:4 36708 | 21-225_150D3 | VL3j3r/JL2 | SYELTQP-PSVSVSPGQTASI TC | SGD----ELGN-----KYAC | WYQQKPGQ SPVLVIY | Q-------DSKRPS | GIPERFSGSSSG--NTATLTISGTQAMDEADYYC | QAWDS------------- -----STVV | FGGGT KLTVL |
| iPS:4 36710 | 21-225_150F6 | VL3j3r/JL2 | SYELTQP-PSVSVSPGQTASI TC | SGD----KLGD-----KYAS | WYQQKPGQ SPVLVIY | Q-------DSKRPS | GIPERFSGSNSG--NTATLTISGIQAMDEADYCC | QAWDS------------- -----STVV | FGGGT KLTVL |
| iPS:4 36714 | 21-225_150H11 | VL3j3r/JL2 | SYELTQP-PSVSVSPGQTASI TC | SGD----KLGD-----KYAS | WYQQKPGQ SPVLVIC | Q-------DSKRPS | GIPERFSGSNSG--NTATLTISGIQAMDEADFYC | QAWDS------------- -----STVV | FGGGT KLTVL |
| iPS:4 36716 | 21-225_151F3 | VL3j3r/JL2 | SYELTQP-PSVSVSPGQTASI TC | SGD----KLGD-----KYVC | WYQQKPGQ SPVLVIY | Q-------DRKRPS | GIPERFSGSNSG--NTATLTISGTQAMDEADYYC | QAWHS------------- -----STVV | FGGGT KLTVL |

Figure 51 (Continued)

| | | | | | | | | |
|---|---|---|---|---|---|---|---|---|
| iPS:4 36718 | 21-225_151H5 | VL3j3r/JL2 | SYELTQP-PSVSVSPGQTASIAC | SGD----KLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36722 | 21-225_151H7 | VL3j3r/JL2 | SYDLTQP-PSVSVSPGQTASITC | SGD----KLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36724 | 21-225_151B9 | VL3j3r/JL2 | SYELTQP-PSVSVSPGQTASIAC | SGD----NLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36728 | 21-225_152G6 | VL3j3r/JL2 | SYELTQP-PSVSVSPGQTASITC | SGD----KLGD-----KYAS | WYQQKPGQ-SPVLVIY | Q-------DSKRPS | GIPERFSGSNSG--NTATLTISGIQALDEADYYC | QAWDN--------STVV | FGGGT KLTVL |
| iPS:4 36730 | 21-225_152D7 | VL3j3r/JL2 | SYELTQP-PSVSVSPGQTASITC | SGD----KLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36736 | 21-225_153E8 | VL3j3r/JL2 | SYELTQP-PSVSVSPGQTASITC | SGS----KLGN-----KYVC | WYQQKPGQ-SPVLVIY | Q-------DNKRPS | GIPERFSGSNSG--NTATLTISGIQAMDEADYYC | QAWHS--------STYVI | FGGGT KLTVL |
| iPS:4 36738 | 21-225_153D9 | VL3j3r/JL2 | SYELTQP-PSVSVSPGQTASITC | SGD----KLGD-----KYVC | WYQQKPGQ-SPVLVIY | Q-------DRKRPS | GIPERFSGSNSG--NTATLTISGIQAMDEADYYC | QAWHS--------STVV | FGGGT KVTVL |
| iPS:4 36740 | 21-225_154C3 | VL3j3r/JL2 | SYELTQP-PSVSVSPGQTASITC | SGD----KLGD-----KYAC | WYQQKPGQ-SPVLVIY | Q-------DSKRPS | GIPERFSGSNSG--NTATLTISGIQAMDEADYYC | QAWHS--------STVV | FGGGT KLTVL |
| iPS:4 36742 | 21-225_154C4 | VL3j3r/JL2 | SYELTQP-PSVSVSPGQTARITC | SGD----KLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36744 | 21-225_154F4 | VL3j3r/JL2 | SYELTQP-PSVSVSPGQTASITC | SGD----KLGN-----KYVC | WYQQKPGQ-SPVEVIY | K-------DSKRPS | GIPERFSGSNSG--NTGLTISGTQAMDEADYYC | QAWDN--------STLV | FGGGT KLTVL |
| iPS:4 36746 | 21-225_154E10 | VL3j3r/JL2 | SYELTQP-PSVSVSPGQTASITC | SGD----KLGD-----KYAS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36748 | 21-225_154D11 | VL3j3r/JL2 | SYELTQP-PSVSVSPGQTASITC | SGD----KLGD-----KYAC | WYQQKPGQ-SPVLVIY | Q-------DKKRPS | GIPERFSGSNSG--NTATLTISGTQAMDEADYYC | QAWHS--------SIVV | FGGGT KLTVL |
| iPS:4 36756 | 21-225_146A10 | VL3j3r/JL2 | SYELTQP-PSVSVSPGQTASITC | SGD----KLGD-----KYVC | WYQQKPGQ-SPVLVIF | Q-------DRKRPS | GIPERFSGSNSG--NTATLTISGTQAMDEADYYC | QAWDS--------STVV | FGGGT KVTVL |
| iPS:4 36758 | 21-225_155C10 | VL3j3r/JL2 | SYELTQP-PSVSVSPGQTVSITC | SGD----KLGD-----KYVS | WYQQKPGQ-SPVLVIY | Q-------DSKRPS | GIPERFSGSNSG--NTATLTISGIQAMDEADYYC | QAWDS--------STVV | FGGGT KLTVL |
| iPS:4 36760 | 21-225_155E10 | VL3j3r/JL2 | SYDLTQP-PSVSVSPGQTASITC | SGD----KLGD-----KYVS | WYQQKPGQ-SPVLVIY | Q-------DRKRPS | GIPERFSGSNSG--NTATLTISGIQAMDEADYYC | LAWDS--------STFVV | FGGGT KLTVL |
| iPS:4 36764 | 21-225_158E9 | VL3j3r/JL2 | SYDLTQP-PSVSVSPGQTASITC | SGD----KLGD-----KYVC | WYQQKPGQ-SPVLVIY | Q-------DSKRPS | GIPERFSGSNSG--NTATLTITGTQMDEANYYC | QAWDN--------SSFVL | FGGGT KLTVL |

Figure 51 (Continued)

| | | | | | | | | |
|---|---|---|---|---|---|---|---|---|
| iPS:4 36766 | 21-225_158D10 | VL3J3r/JL2 | SYELTQP-PSVTVSPGQTASITC | SGD----KLGD-----KYVC | WYQQKPGQSPVLVIY | Q-------DRKRPS | GIPERLSGSNSG--NTATLTISGTQALDEADYYC | QAWGN---------SSFVV | FGGGTKLTVL |
| iPS:4 36768 | 21-225_159H8 | VL3J3r/JL2 | SYELTQP-PSVSVSPGQTASITC | SGD----KLGD-----KYVC | WYQQKPGQSPVLVIY | Q-------DRKRPS | GIPERFSGSNSG--NTATLTISGTQALDEADYYC | QAWGN---------SSFVV | FGGGTKLTVL |
| iPS:4 36770 | 21-225_160B12 | VL3J3r/JL2 | SDELTQS-PSVSVSPGQTASITC | SGD----KLGD-----KYVC | WYQQKPGQSPVLVIY | Q-------DSKRPS | GIPERFSGSNSG--NTATLTISGTQALDEADYYC | QAWGN---------SSFVV | FGGGTKLTVL |
| iPS:4 36772 | 21-225_161H3 | VL3J3r/JL2 | SYELTQP-PSVSVSPGQTASITC | SGD----RLGD-----KYVC | WYQQKPGQSPVLVIF | Q-------DNKRPS | GIPERFSGSNSG--NTATLTISGTQALDEADYYC | QAWVN---------NTAVV | FGGGTKLTVL |
| iPS:4 36774 | 21-225_161E10 | VL3J3r/JL2 | SFDLTQP-PSVSVSPGQTASITC | SGD----KLGD-----KYVC | WYQQKPGQSPVLVIY | Q-------DSKRPS | GIPERISGSNSG--NTATLTISGTQAMDEADYYC | QTWDN---------SSFAL | FGGGTRLTVL |
| iPS:4 36776 | 21-225_161F12 | VL3J3r/JL2 | SYELTQP-PSVSVSPGQTASITC | SGD----KLGD-----KYAC | WYQQKPGQSPVLVIY | Q-------DTKRPS | GIPERFSGSNSG--NTATLTISGTQAMDEADYYC | QAWDS---------TTLV | FGGGTKLTVL |
| iPS:4 36780 | 21-225_165H3 | VL3J3r/JL2 | SYELSQP-PSVSVSPGQTASITC | SGD----KLGD-----KYVH | WYQQKPGQSPVLVIY | Q-------DSKRPS | GIPERFSGSNSG--NTATLTISGTQAMDEADYYC | QAWDS---------TTLV | FGGGTKLTVL |
| iPS:4 36782 | 21-225_166G11 | VL3J3r/JL2 | SYELTQP-PSVSVSPGQTASITC | SGD----KLGD-----KYVC | WYQQKPGQSPVLVIY | Q-------DSKRPS | GIPERFSGSNSG--NTATLTISGTQAMDEADYYC | QAWDN---------STAV | FGGGTKLTVL |
| iPS:4 36784 | 21-225_169C1 | VL3J3r/JL2 | SYELTQP-PSVSVSPGQTASITC | SGD----KLGD-----KYVC | WYQQKPGQSFLLVIY | Q-------DIKRPS | GIPERFSGSNSG--NTATLTISGTQAMDEADYYC | QAWDT---------NTVI | FGGGTKLTVL |
| iPS:4 36786 | 21-225_169A6 | VL3J3r/JL2 | SYELTQP-PSVSVSPGQTASITC | SGD----KLGD-----KYVC | WYQRKPGQSPVLVIY | K-------DYKRPS | GIPERFSGSNSG--NTATLTISGTQAMDEADYYC | QAWDT---------NTVL | FGGGTKLTVL |
| iPS:4 36788 | 21-225_169B7 | VL3J3r/JL2 | AYDLTQP-PSVSVSPGQTARI | SGD----KLGD-----KYAS | WYQQKPGQSPVLVIY | Q-------DRKRPS | GIPERFSGSNSG--NTATLTISGTQAMDEADYYC | QAWDN---------NTVV | FGGGTKLTVL |
| iPS:4 36790 | 21-225_169G11 | VL3J3r/JL2 | SYELTQP-PSVSVSPGQTASITC | SGD----KLGD-----KYAC | WYQQKPGQSPVLVIY | Q-------DSKRPS | GIPERFSGSNSG--NTATLTISGTQAMDEADYYC | QAWDN---------STAV | FGGGTKLTVL |
| iPS:4 36794 | 21-225_170F1 | VL3J3r/JL2 | SYELSQP-PSVSVSPGQTASITC | SGD----KLGD-----KYSC | WYQQKPGQSPVLVIY | Q-------DSKRPS | GIPARFSGSNSG--NTATLTISGTQAMDEADYYC | QAWDS---------NTAV | FGGGTKLTVL |
| iPS:4 36796 | 21-225_170A5 | VL3J3r/JL2 | SYDLTQP-PSVSVSPGQTASITC | SGD----KLGD-----KYAC | WYQQKPGQSPVLVIY | Q-------DYKRPS | GIPERFSGSNSG--NTATLTISGTQAMDEADYYC | QAWDN---------STMV | FGGGTKLTVL |
| iPS:4 36798 | 21-225_171F5 | VL3J3r/JL2 | AYDLTQP-PSVSVSPGQTASITC | SGD----KLGG-----KYAS | WYQQKPGQSPVLVIY | Q-------DRKRPS | GIPERFSGSNSG--NTATLTISGTQAMDEADYYC | QAWDK---------NTVV | FGGGTKLTVL |
| iPS:4 36802 | 21-225_171E12 | VL3J3r/JL2 | SYELTQP-PSVSVSPGQTASITC | SGD----KLGD-----KYAC | WYQQKPGQSPVLVIY | Q-------DRKRPS | GIPERFSGSNSG--NTATLTISGTQMDEADYYC | QAWDI---------STYVV | FGGGTKLTVL |

Figure 51 (Continued)

| | | | | | | | | | |
|---|---|---|---|---|---|---|---|---|---|
| iPS:4 36808 | 21-225_173F8 | VL3j3r/JL2 | SYELTQP-PSVSVSPGQTASI TC | SGN----KLGN-----KYVC | WYQQRPGQ SPVLVIS | Q-------DSRRPS | GIPERFSGSNSG--NIATLTISGTQAMDEADYYC | QAWDS--------------FTVV | FGGGT KLTVL |
| iPS:4 36812 | 21-225_175C6 | VL3j3r/JL2 | SYDLTQP-PSVSVSPGQTASI TC | SGD----KLGD-----KYAC | WYQQKPGQ SPILVIY | Q-------DYKRPS | GIPERFSGSNSG--NTATLTISGTQAMDEADYYC | QAWDN--------------STMV | FGGGT KLTVL |
| iPS:4 36818 | 21-225_179C7 | VL3j3r/JL2 | SYELTQP-PSVSVSPGQTASI TC | SGD----KLGD-----KYVC | WYQQKPGQ SPVLVIY | Q-------DSKRPS | GIPERFSGSNSG--NTATLTIRGTQAMDEADYYC | QAWDS--------------NTAVV | FGGGT KLTVL |
| iPS:4 36822 | 21-225_180D4 | VL3j3r/JL2 | SYELTQT-PSVSVSPGQTASI TC | SGD----RLGD-----KYAC | WYQQKPGQ SPVLVIY | E-------DRKRPS | GIPERFSGSNSG--NTATLTISGTQAMDEGDYYC | QAWDS--------------RKVV | FGGGT KLTVL |
| iPS:4 36824 | 21-225_180C5 | VL3j3r/JL2 | SYELTQP-PSVSVSPGQTASI TC | SGD----KLGE-----KYAC | WYQQKPGQ SPVLVIY | Q-------DRKRPS | GIPERFSGSNSG--NTATLTISGTQAMDEADYYC | QAWDS--------------STAV | FGGGT KLTVL |
| iPS:4 36826 | 21-225_180G5 | VL3j3r/JL2 | SYELTQP-PSVSVSPGQTASI TC | SGD----KLGD-----KYVS | WYQQKPGQ SPVLVIY | Q-------DSKRPS | GIPERFSGSNSG--NPASLTISGTQAMDEADYYC | QAWDI--------------TTAV | FGGGT KLTVL |
| iPS:4 36828 | 21-225_181H1 | VL3j3r/JL2 | SYELTQI-PSVFVSPGQTASI TC | SGD----KLGD-----KYAC | WYQQKPGQ SPVLVIY | E-------DRKRPS | GIPERFSGSNSG--NTATLTISGTQAMDEADYYC | QAWDS--------------RKVV | FGGGT KLTVL |
| iPS:4 36836 | 21-225_52H1 | VL3j3r/JL2 | SYELTQP-PSVFVSPGQTASI TS | SGD----KLGE-----KYVS | WYQQKPGQ SPVLVIY | Q-------DRKRPS | GIPERFSGSNSG--NTATLTISGTQAMDEADYYC | QAWDN--------------STVV | FGGGT KLTVL |
| iPS:4 36848 | 21-225_57F1 | VL3j3r/JL2 | SYELTQP-PSASVSPGQTASI TC | SGD----KLGE-----KYAC | WYQQKPGQ SPVLVIY | Q-------DRKRPS | GIPERFSGSNSG--NTATLTISGTQAMDEADYYC | QAWDS--------------STVV | FGGGT KLTVL |
| iPS:4 36850 | 21-225_57D9 | VL3j3r/JL2 | SYELTQP-PSVSVSPGQTASI TC | SGE----KLGE-----KFAC | WSQQKPGQ SPVLVIY | Q-------DSKRPS | GIPERFSGSNSG--NTATLTISGTQAMDEADYYC | QAWDS--------------STVV | FGGGT KLTVL |
| iPS:4 36852 | 21-225_57H11 | VL3j3r/JL2 | SYALTQP-PSASVSPGQTASI TC | SGD----KLGE-----KYAC | WYQQKPGQ SPVLVIY | Q-------DRKRPS | GIPERFSGSNSG--NTATLTISGTQAMDEADYYC | QAWDS--------------STVV | FGGGT KLTVL |
| iPS:4 36854 | 21-225_58C1 | VL3j3r/JL2 | SYELTQP-PSVSVSPGQTANI TC | SGD----KLGN-----KYAC | WYQQKPGQ SPVLVIY | Q-------DSKRPS | GIPERFSGSNSG--NTATLTISGTQAMDEADYYC | QAWD---------------SSTA | FGGGT KLTVL |
| iPS:4 36858 | 21-225_58E7 | VL3j3r/JL2 | SYELTQS-PSVSVSPGQTASI TC | SGD----KLGD-----KYTC | WYQKKPGQ SPVLVIY | Q-------DNKRPS | GIPERFSGSNSG--NTATLTIRGTQAMDEADYFC | QAWNN--------------YTVV | FGGGT KLTAL |
| iPS:4 36860 | 21-225_58F7 | VL3j3r/JL2 | SYELTQP-PSVSVSPGQTASI TC | SGD----KLGD-----KYAC | WYQQKPGQ SPVLVIY | Q-------DRKRPS | GIPERFSGSNSG--NTATLTISGTQAMDEADYYC | QAWDS--------------STVV | FGGGT KLTVL |
| iPS:4 36862 | 21-225_58F8 | VL3j3r/JL2 | SYELTQP-PSVSVSPGQTASI TC | SGD----KLGN-----KYAC | WYQQKPGQ SPVLVIY | Q-------DSKRPS | GIPERFSGSNSG--NTATLTISGTQAMDEADYYC | QAWDS--------------STVV | FGGGT KLTVL |
| iPS:4 36864 | 21-225_58G11 | VL3j3r/JL2 | SYELTQP-PSVSVSPGQTASI TC | SGD----KLGD-----KYAS | WYQQKPGQ SPVLVIY | Q-------DNKRPS | GIPERFSGSNSG--NTATLTISGTQAMDEADYYC | QAWNN--------------NTVM | FGGGT KLTVL |

Figure 51 (Continued)

| | | | | | | | | |
|---|---|---|---|---|---|---|---|---|
| iPS:4 36866 | 21-225_59F2 | VL3j3r/JL2 | SYELTQP-PSVSVSPGQTASI TC | SGD----KLGD-----KYAS | WYQQRPGQ SPVLVIY | Q-------DNKRPS | GIPERFSGSNSG--NTATLTISGTQAMDEADYYC | QAWDN---------NTVV | FGGGT KLTVL |
| iPS:4 36868 | 21-225_59B11 | VL3j3r/JL2 | SYELTQP-PSVSVSPGQTASI TC | SGD----KLGD-----KYAC | WYQQKPGQ SPVLVIY | Q-------DSKRPS | GILERFSGSNSG--NTATLTISGTQAMDEADYYC | QAWDS---------STYVV | FGGGT KLTVL |
| iPS:4 36870 | 21-225_60B1 | VL3j3r/JL2 | SYELTQP-PSASVSPGQTASI TC | SGD----KLGE-----KYAC | WYQQKPGQ SPVLVIY | Q-------DRKRPS | GIPERFSGSNSG--NTATLTISGTQAMDEADYYC | QAWDS---------STVV | FGGGT KLTVL |
| iPS:4 36872 | 21-225_60D2 | VL3j3r/JL2 | SYELTQP-PSVSVSPGQTASI TC | SGN----KLGD-----KYAS | WYQQKPGQ SFVVVIY | Q-------DNKRPS | GIPERFSGSNSG--NTATLTISGTQTMDEADYYC | QAWDN---------NTVV | FGGGT KLTVL |
| iPS:4 36874 | 21-225_60A12 | VL3j3r/JL2 | SYELTQP-PSVSVSPGQTANI TC | SGD----KLGN-----KYAC | WYQQKPGQ SPVLVIY | Q-------DRKRPS | GIPERFSGSNSG--NTATLTISGTQAMDEADYYC | QAWD----------SSTA | FGGGT KLTVL |
| iPS:4 36876 | 21-225_61F5 | VL3j3r/JL2 | SYELTQP-PSVSVSPGQTASI TC | SGD----KLGE-----KYAC | WYQQKPGQ SPVLVIY | Q-------DRKRPS | GIPERFSGSNSG--NTATLTISGTQAMDEADYYC | QAWDS---------STVV | FGGGT KLTVL |
| iPS:4 36878 | 21-225_62E3 | VL3j3r/JL2 | SYDLTQP-PSVSVSPGQTASI TC | SGD----KLGN-----KYAC | WYQQKPGQ SFVVVIY | Q-------DRKRPS | GIPERFSGSNSG--NTATLTISGTQAMDEADYYC | QAWDS---------STAV | FGGGT KLTVL |
| iPS:4 36880 | 21-225_62E8 | VL3j3r/JL2 | SYELTQP-PSVSVSPGQTASI TC | SGD----RLGN-----KYAS | WYQQKPGQ SFVVVIY | Q-------DRKRPS | GIPERFSGSNSG--NTATLTISGTQAMDEADYYC | QAWDS---------STAV | FGGGT KLTVL |
| iPS:4 36882 | 21-225_62D10 | VL3j3r/JL2 | SYDLTQP-PSVSVSPGQTASI TC | SGD----KLGN-----KYAC | WYQQKPGQ SFVVVIY | Q-------DRKRPS | GIPERFSGSNSG--NTATLTISGTQAMDEADYYC | QAWDS---------STAV | FGGGT KLTVL |
| iPS:4 36884 | 21-225_62A12 | VL3j3r/JL2 | SYDLTQP-PSVSVSPGQTASI TC | SGD----KLGN-----KYAC | WYQQKPGQ SPVVVIY | Q-------DRKRPS | GIPERFSGSNSG--NTATLTISGTQAMDEADYYC | QAWDS---------STAV | FGGGT KLTVL |
| iPS:4 36886 | 21-225_62B12 | VL3j3r/JL2 | SYDLTQP-PSVSVSPGQTASI TC | SGD----KLGN-----KYTC | WYQQKPGQ SPVLVIY | Q-------DRKRPS | GIPERFSGSNSG--NTATLTISGTQAMDEADYYC | QAWDS---------STAV | FGGGT KLTVL |
| iPS:4 36892 | 21-225_65E9 | VL3j3r/JL2 | SYELTQP-PSVSVSPGQTASI TC | SGD----KLGN-----KYDY | WYQQKPGQ SPVLVIY | Q-------DRKRPS | GIPERFSGSNSG--NTATLTISGTQAMDEADYYC | QAWDN---------NTAV | FGGGT KLTVL |
| iPS:4 36894 | 21-225_66G9 | VL3j3r/JL2 | SYDLTQP-PSVTVSPGQTASI TC | SGD----KLGN-----KYAC | WYQQKPGQ SPVVVIY | Q-------DRKRPS | GIPERFSGSNSG--NTATLTISGTQAMDEADYYC | QAWDI---------STVV | FGGGT KLTVL |
| iPS:4 36896 | 21-225_67F10 | VL3j3r/JL2 | SYELTQP-PSVSVSPGQTASI TC | SGD----KLGY-----KYAW | WYQQKPGQ SPVLVIF | E-------DRKRPS | GIPERFSGSNSG--NTATLTISGTQAMDEADYYC | QAWDN---------STVV | FGGGT RLTVL |
| iPS:4 36898 | 21-225_68D8 | VL3j3r/JL2 | SYELTQP-PSVSVSPGQTASI TC | SGD----KLGD-----KYAC | WYQQKPGQ SPVLVIY | Q-------DSKRPS | GIPERFSGSNSG--NTATLTISGTQAMDEADYYC | QAWDN---------STVV | FGGGT KLTVL |
| iPS:4 36900 | 21-225_69B9 | VL3j3r/JL2 | SYELTQP-PSVSVSPGQTASI TC | SGD----KLGN-----KYDY | WYQQKPGQ SPVLVIY | Q-------DRKRPS | GIPERFSGSNSG--NTATLTISGTQAMDEADYYC | QAWDN---------STVV | FGGGT KLTVL |

Figure 51 (Continued)

| | | | | | | | | |
|---|---|---|---|---|---|---|---|---|
| iPS:4 36902 | 21-225_69B11 | VL3l3r/JL2 | SYELTQP-PSVSVSPGQAASITC | SGD----KLGD-----KYAW | WYQQKPGQSPVLVIY | E-------DRKRPS | GIPERFSGSNSG--NIATLTISGTQAMDEADYYC | QAWDN-----------STVV | FGGGT KLTVL |
| iPS:4 36904 | 21-225_71D4 | VL3l3r/JL2 | SYELTQP-PSVSVSPGQTASITC | SGD----KLGD-----KYAY | WYQQKPGQSPVVVIY | Q-------DRKRPS | GIPERFSGSNSG--NTATLTISGTQAMDEADYYC | QAWVN-----------STVV | FGGGT KLTVL |
| iPS:4 36906 | 21-225_72B4 | VL3l3r/JL2 | SYELTQP-PSVSVSPGQTASITC | SGD----KLGD-----KYAW | WYQQKPGQSPVLVIY | E-------DRKRPS | GIPERFSGSNSG--NTATLTISGTQAMDEADYYC | QAWDN-----------STVV | FGGGT KLTVL |
| iPS:4 36908 | 21-225_72D5 | VL3l3r/JL2 | SYDLTQP-PSVSVSPGQTASITC | SGD----KLGN-----KYAC | WYQQKPGQSPVVVIY | Q-------DRKRPS | GIPERFSGSNSG--NTATLTISGTQAMDEADYYC | QAWDS-----------STAV | FGGGT KLTVL |
| iPS:4 36912 | 21-225_73C4 | VL3l3r/JL2 | SYDLTQP-PSVSVSPGQTASITC | SGD----KLGN-----KYAC | WYQQKPGQSPVVVIY | Q-------DMKRPS | GIPERFSGSNSG--NTATLTISGTQAMDEADYYC | QAWDS-----------STAV | FGGGT KLTVL |
| iPS:4 36914 | 21-225_76B4 | VL3l3r/JL2 | PYELNQT-PSVSVSPGQTASITC | SGD----RLGT-----KFAC | WYQQKPGQSFVLVIY | Q-------DSKRPS | GIPERFSGSNSG--NTATLTISGTQAMDEADYYC | QAWD------------SSTV | FGGGT KLTVL |
| iPS:4 36916 | 21-225_74A9 | VL3l3r/JL2 | SYELTQP-PSVSVSPGQTASITC | SGD----KLGN-----KYVC | WYQQKPGQSFVLVIY | Q-------DNRRPS | GIPERFSGSNSG--NTATLTISGTQAMDEADYYC | QAWDS-----------SPVI | FGGGT KLTVL |
| iPS:4 36918 | 21-225_77A2 | VL3l3r/JL2 | SYELTQP-PSVSVSPGQTASITC | SGD----RLGD-----KYAC | WYQQKPGQSFVLVIY | Q-------DRKRPS | GIPERFSGSNSG--NTATLTISGTQAMDEADYYC | QAWDS-----------STAV | FGGGT KLTVL |
| iPS:4 36922 | 21-225_78E9 | VL3l3r/JL2 | SYELTQP-PSESVSPGQTASITC | SGD----KLGN-----KYVS | WYQQKPGQSFVLVIY | Q-------DNRRPS | GIPERFSGSNSG--NTATLTISGTQAMDEADYYC | QAWDS-----------SPVI | FGGGT KLTVL |
| iPS:4 36924 | 21-225_74B3 | VL3l3r/JL2 | SYELTQP-PSVSVSPGQTASITC | SGD----KLGD-----KYAC | WYQQKPGQSPVLVIY | Q-------DSKRPS | GIPERFSGSNSG--NTATLTISGTQAMDEADYYC | QAWDS-----------TTVV | FGGGT KLTVL |
| iPS:4 36928 | 21-225_79E7 | VL3l3r/JL2 | SYELTQP-PSVSVSPGQTASITC | SGD----KLGN-----KYVS | WYQQKPGQSPVLVIY | Q-------DNRRPS | GIPERFSGSNSG--NTATLTISGTQAMDEADYYC | QAWDS-----------SPVI | FGGGT KLTVL |
| iPS:4 36932 | 21-225_92A4 | VL3l3r/JL2 | SYELTQP-PSVSVSPGQTANITC | SGD----KLGN-----KYVC | WYQQKPGQSPVLVIY | Q-------DRKRPS | GIPERFSGSNSG--STATLTISGTQAMDEADYYC | QAWDS-----------SPVI | FGGGT KLTVL |
| iPS:4 36934 | 21-225_96B5 | VL3l3r/JL2 | PYELNQT-PSVSVSPGQTASITC | SGD----RLGT-----KFAC | WYQQKPGQSFVLVIY | Q-------DSKRPS | GIPERFSGSNSG--NTATLTISGTQAMDEADYYC | QAWD------------SSTV | FGGGT KLTVL |
| iPS:4 36936 | 21-225_97E6 | VL3l3r/JL2 | SYELTQP-PSVSVSPGQTVSITC | SGD----KLGN-----KYVS | WYQQKPGQSPVLVIY | Q-------DNRRPS | GIPERFSGSNSG--STATLTISGTQAMDEADYYC | QAWDS-----------TPVI | FGGGT KLTVL |
| iPS:4 36938 | 21-225_146A3 | VL3l3r/JL2 | SYAMTQP-PSMSVSPGQTASITC | SGN----KLGN-----RYAC | WYQQKPGQSPVLVIY | Q-------DSKRPS | GIPERFSGSNSG--NIATLTISGTQAMDEADYYC | QAWHS-----------STVV | FGGGT KLTVL |
| iPS:4 36940 | 21-225_146B8 | VL3l3r/JL2 | SYELTQP-PSVSVSPGQTASITC | SGD----KLGD-----KYVC | WYQQKPGQSPVLVIY | Q-------DRKRPS | GIPERFSGSNSG--NTATLTISGTQAMDEADYYC | QAWHS-----------STVV | FGGGT KLTVL |

Figure 51 (Continued)

| | | | | | | | |
|---|---|---|---|---|---|---|---|
| iPS:4 36942 | 21-225_146H8 | VL3j3r/JL2 | SYELTQP-PSVSVSPGQTASITC | SGD----KLGD-----KYAC | WYQQKPGQ-SPVLVIY | Q-------DKKRPS | GIPERFSGSNSG--NTATLTISGTQVMDEADYYC | QAWDI------------RTVV | FGGGT KLTVL |
| iPS:4 36944 | 21-225_182D12 | VL3j3r/JL2 | SYELTQP-PSVSVSPGQTASITC | SGD----KLGE-----KYAC | WYQQKPGQ-SPVLVIY | Q-------DKKRPS | GIPERFSGSNSG--NTATLTISGTQAMDEADYYC | QAWDS------------RTAV | FGGGT KLTVL |
| iPS:4 36946 | 21-225_183F4 | VL3j3r/JL2 | SYELTQP-PSVSVSPGQTASITC | SGD----KLGD-----KYAC | WYQQKPGQ-SPVLVIY | Q-------DKKRPS | GIPDRFSGSNSG--NTATLTISGTQAMDEADYYC | QAWDN------------STAVV | FGGGT KLTVL |
| iPS:4 36952 | 21-225_185D2 | VL3j3r/JL2 | SYELTQT-PSVSVSPGQTASITC | SGD----KLGD-----KYAC | WYQQKPGQ-SFVLVIY | E-------DKKRPS | GIPDRFSGSNSG--NTATLTISGTQAMDEADYYC | QAWDS------------RKVV | FGGGT KLTVL |
| iPS:4 36954 | 21-225_185G7 | VL3j3r/JL2 | SYELTQP-PSVSVSPGQTASITC | SGD----KLGH-----KFVC | WYQQKPGQ-SPVLVIY | Q-------DKKRPS | GIPERFSGSNSG--NTATLTISGTQAMDEADYYC | QAWD-------------SSTV | FGGGT KLTVL |
| iPS:4 36956 | 21-225_186H6 | VL3j3r/JL2 | SYELTQP-PSVSVSPGQTASITC | SGD----KMGE-----KYAC | WYQQKPGQ-SPVLVIY | Q-------DKKRPS | GIPERFSGSNSG--NTATLTISGTQAMDEADYYC | QAWDS------------STAV | FGGGT KLTVL |
| iPS:4 36962 | 21-225_190H1 | VL3j3r/JL2 | SYELTQP-PSVSVSPGQTASITC | SGD----KLGD-----RFAY | WYQQKPGQ-SPVLVIY | Q-------DKKRPS | GIPERFSGSNSG--NTASLTISGTQAMDEADYYC | KAWDS------------STVV | FGGGT KLTVL |
| iPS:4 36978 | 21-225_190G9 | VL3j3r/JL2 | SYELTQP-PSVSVSPGQTASITC | SGD----KLGD-----RFAY | WYQQKPGQ-SPVLVIY | Q-------DSKRPS | GIPERFSGSNSG--NTATLTISGTQAMDEADYYC | QAWDS------------STVV | FGGGT KLTVL |
| iPS:4 37018 | 21-225_193H5 | VL3j3r/JL2 | SYELTQP-SSVSVSPGQTASITC | SGD----KLGD-----RFAC | WYQQKPGQ-SPVLVIY | Q-------DSKRPS | GIPERFSGSNSG--NTATLTISGTQAMDEADYYC | QAWDS------------STAV | FGGGT KLTVL |
| iPS:4 37030 | 21-225_195E3 | VL3j3r/JL2 | SYELTQP-PSVSVSPGQTASITC | SGD----KLGY-----RSVC | WYQQKPGQ-SPVLVIY | E-------DSKRPS | GIPERFSGSNSG--NTATLTISGTQAMDEADYYC | QAWDS------------VTVV | FGGGT KLTVL |
| iPS:4 37034 | 21-225_195G9 | VL3j3r/JL2 | SYELTQP-PSVSVSPGQTASITC | SGD----KLGN-----KYAY | WYQQKPGQ-SPVLVIY | Q-------DRKRPS | GIPERFSGSNSG--NTGLLTISGTQGMDEADYYC | QAWDR------------GIVV | FGGGT KLTVL |
| iPS:4 37070 | 21-225_201G11 | VL3j3r/JL2 | SYELTQP-PSVSVSPGQTASITC | SGD----KLGD-----RFAC | WYQQKPGQ-SPVLVIY | Q-------DSKRPS | GIPERFSGSNSG--NTATLTISGTQAMDEADYYC | QAWDS------------STVV | FGGGT KLTVL |
| iPS:4 37076 | 21-225_203G6 | VL3j3r/JL2 | SYELTQP-PSVSVSPGQTASITC | SGD----KLGD-----RFAC | WYQQKPGQ-SPVLVIY | Q-------DNKRPS | GIPERFSGSNSG--NTATLTISGTQSMDEADYYC | QAWDS------------STVV | FGGGT KLTVL |
| iPS:4 37144 | 21-225_215B3 | VL3j3r/JL2 | SYELTQP-PSVSVSPGQTASITC | SGD----KLGD-----KFAC | WYQQKPGQ-SPVLVIY | Q-------DSKRPS | GIPERFSGSNSG--NTATLTISGTQAMDEADYYC | QAWDS------------STVV | FGGGT KLTVL |
| iPS:4 37186 | 21-225_224H2 | VL3j3r/JL2 | SYELTQP-PSVSVSPGQTASITC | SGD----NLGV-----KYTY | WYQQKPGQ-SPVLVVY | Q-------DSKRPS | GIPERFSGSNSG--NTATLTISGTQAMDEADYYC | QAWDS------------STVV | FGGGT KLTVL |
| iPS:4 37192 | 21-225_225E9 | VL3j3r/JL2 | SYDLTQP-PSVSVSPGQTASITC | SGD----NLGN-----RYAC | WYQQKPGQ-SPVLVMY | Q-------DRKRPS | GIPERFSGSNSG--NTATLTISGTQAMDEADYYC | QAWDS------------RTAVV | FGGGT KLTVL |

Figure 51 (Continued)

| | | | | | | | | |
|---|---|---|---|---|---|---|---|---|
| iPS:4 37194 | 21-225_226B2 | VL3j3r/JL2 | SYELTQP-PSVSVSPGQTASITC | SGD----TLGG-KYAW | WYQQRPGQSPVLVIY | Q-------DRKRPS | GIPERFSGSSSG-NTATLTISGTQAMDEADYYC | QAWDN------------GAAV | FGGGT KLTVL |
| iPS:4 37200 | 21-225_226A10 | VL3j3r/JL2 | SYELTQP-PSVSVSPGQTASITC | SGD----TLGG-KYAW | WYQQKPGQSPVLVIY | Q-------DRKRPS | GIPERFSGSSSG-NTATLTISGTQAMDEADYYC | QAWDN------------GAAV | FGGGT KLTVL |
| iPS:4 37204 | 21-225_227E5 | VL3j3r/JL2 | SYELTQP-PSVSVSPGQTASITC | SGD----KLGE-KYAC | WYQQKPGQSPVLVIY | Q-------DRKRPS | GIPERFSGSNSG-NRATLTISGTQAMDEADYYC | QAWVN------------NTMI | FGGGT KLTVL |
| iPS:4 37210 | 21-225_227E12 | VL3j3r/JL2 | SYELTQP-PSVSVSPGQTASITC | SGD----KLGD-KYVC | WYQQKPGQSPVLVIY | Q-------DSKRPS | GIPERFSGSNSG-NTATLTISGTQAMDEADYYC | QAWNS------------SNVV | FGGGT KLTVL |
| iPS:4 48908 | 21-225_50G9 | VL3j3r/JL2 | SYELTQP-PSVSVSPGQTASITC | SGD----KLGD-KYAC | WYQQKPGQSPVLVIY | Q-------DSKRPS | GIPERFSGSNSG-NTATLTISGTQARDEAEYYC | QARNS------------RRGV | FGGGT RLTVL |
| iPS:4 51102 | 21-225_45F6 | VL3j3r/JL2 | SYELTQP-PSVSVSPGQTASITC | SGD----KLGD-KYAS | WYQQKPGQSPVLVIY | Q-------DRKRPS | GIPERFSGSNSG-NTATLTISGTQAMDEADYYC | QAWDN------------RTMV | FGGGT KLTVL |
| iPS:4 51110 | 21-225_74C9 | VL3j3r/JL2 | SYELTQP-PSESVSPGQTASITC | SGD----KSGN-KYVS | WYQQKPGQSPVLVIY | Q-------DNRRPS | GIPERFSGSNSG-STATLTISGTQAMDEADYYC | QAWDS------------TPVI | FGGGT KLTVL |
| iPS:4 51112 | 21-225_53D10 | VL3j3r/JL2 | SYELTQP-PSVSVSPGQTASITC | SGD----KLGN-KYAC | WYQQRPGQSPVLVIY | Q-------DRKRPS | GIPERFSGSNSG-NTATLTISGTQAMDEADYYC | QAWDS------------STVV | FGGGT KLTVL |
| iPS:4 72731 | 21-225_14B1_LC2 | VL3j3r/JL2 | SFELTQP-PSVSVSPGQTASITC | SGD----KLGD-KYAY | WYQQKPGQSPVLVIY | Q-------DRKRPS | GIPERFSGSNSG-NTATLTISGTQAMDEADYYC | QAWDN------------STVV | FGGGT KLTVL |
| iPS:3 92583 | 21-225_10B10 | VL3j3r/JL2 | SYELTQP-PSVSVSPGQTASITC | SGD----KLGN-KYAW | WYQQKPGQSPVLVIY | Q-------DGKRPS | GIPERFSGSNSG-NTATLTLSGTQAMDEADYYC | QAWDN------------STYVV | FGGGT KLTVL |
| iPS:3 92585 | 21-225_14H11 | VL3j3r/JL2 | TYELTQP-SSVSVSPGQTASITC | SGE----KLGE-KYVC | WYQQKPGQSPVLVIY | Q-------DTKRPS | GIPERFSGSNSG-NTATLTISGTQAMDEADYYC | QAWD-------------SSTI | FGGGT KLTVL |
| iPS:3 92587 | 21-225_18G5 | VL3j3r/JL2 | SYELTQP-PSVSVSPGQTASITC | SGD----KLGD-KYVC | WYQQKPGQSPVLVIY | Q-------DSKRPS | GIPERFSGSNSG-NTATLTISGTQAMDEADYYC | QAWNS------------SNVV | FGGGT KLTVL |
| iPS:3 92589 | 21-225_27H2 | VL3j3r/JL2 | SYELTQP-PSVSVSPGQTASITC | SGD----KLGD-KYAS | WYQQKPGQSPVLVIY | Q-------DRKRPS | GIPERFSGSNSG-NTATLTISGTQAMDEADYYC | QAWDS------------STYVV | FGGGT KLTVL |
| iPS:3 92598 | 21-225_18E10 | VL3j3r/JL2 | SYELTQP-PSVSVSPGQTASITC | SGD----RLGD-KYAW | WYQQKPGQSPVLVIY | Q-------DRKRPS | GIPERFSGSNSG-NTATLTISGTQAMDEADYYC | QAWDS------------STVV | FGGGT KLTVL |
| iPS:3 93166 | 21-225_27G6 | VL3j3r/JL2 | SYELTQP-PSVSVSPGQTASITC | SGD----KLGD-KYAC | WYQQKPGQSPVLVIY | Q-------DRKRPS | GIPERFSGSNSG-NTATLTISGTQTMDEADYYC | QAWDN------------SSYVV | FGGGT KLTVL |
| iPS:3 93168 | 21-225_32B11 | VL3j3r/JL2 | SYELTQP-PSVSVSPGQTASITC | SGD----KLGD-KYAY | WYQQKPGQSPVLVIY | Q-------DSKRSS | GIPERFSGSNSG-NTATLTISGTQAMDEADYYC | QAWDN------------STVV | FGGGT KLTVL |

Figure 51 (Continued)

| | | | | | | | | | |
|---|---|---|---|---|---|---|---|---|---|
| iPS:3 93172 | 21-225_3B12 | VL3l3r/JL2 | SYELSQP-PSVSVSPGQTASITC | SGD----KLGE-KYAC | WYQQKPGQ SPVLVIY | Q------DKRPS | GIPERFSGSNSG-NKATLTISGTQAMDEADYYC | QAWVN-------NTMI | FGGGT KLTVL |
| iPS:3 93176 | 21-225_27E7 | VL3l3r/JL2 | SYELTQP-PSVSVSPGQTASITC | SGD----KLGN-KYAC | WYQQKPGQ SPVEVIY | Q------DSKRPL | GIPERFSGSNSG-NTATLTISGTQAMDEADFYC | QAWDS-------STVV | FGGGT KLTVL |
| iPS:3 93178 | 21-225_34D7 | VL3l3r/JL2 | SYELTQP-PSVSVSPGQTASITC | SGD----KLGE-KYAY | WYQQKPGQ SPVLVLY | Q------DSKRPS | GIPERFSGSNSG-NTATLTISGTQTMDEADFYC | QAWDN-------TTVV | FGGGT KLTVL |
| iPS:3 93182 | 21-225_4B3 | VL3l3r/JL2 | SYELTQP-PSVSVSPRQTVSI | SGD----KLGD-KYAC | WYQQKPGQ SFVLVIY | Q------DKRPS | GIPERFSGSNSG-NTATLTISGTQAMDEADYYC | QAWDN-------NTVI | FGGGT KLTVL |
| iPS:3 93184 | 21-225_15H11 | VL3l3r/JL2 | SYELTQP-PSVSVSPGQTASITC | SGD----KLGE-KYAC | WYQQKPGQ SPVLVIY | Q------DRKRPS | GIPERFSGSNSG-NTATLTISGTQAIDEADYYC | QAWDS-------STAV | FGGGT KLTVL |
| iPS:3 93186 | 21-225_27D9 | VL3l3r/JL2 | SYELTQP-PSMSVSPGQTASITC | SGY----KLGD-KYAC | WFQQKPGQ SPVLVIY | Q------DSKRPS | GIPERFSGSNSG-NTATLTISGTQAMDEADYYC | QAWV--------NNTV | FGGGT KLTVL |
| iPS:3 93188 | 21-225_34B9 | VL3l3r/JL2 | SYELTQA-PSVSVSPGQTASITC | SGD----KLGE-KYVS | WYQQKPGQ SFVLVIY | Q------DSKRPS | GIPERFSGSNSG-NTATLTISGTQAMDEADYYC | QAWD--------SSTV | FGGGT KLTVL |
| iPS:3 93192 | 21-225_12B1 | VL3l3r/JL2 | SYELTQP-PSVSVSPRQTVSI | SGD----KLGD-KYAC | WYQQKPGQ SPVLVIY | Q------DKRPS | GIPERFSGSNSG-NTATLTISGTQAMDEADYYC | QAWDN-------NTVI | FGGGT KLTVL |
| iPS:3 93194 | 21-225_16D2 | VL3l3r/JL2 | SYELTQP-PSVSVSPGQTASITC | SGD----KLGE-KYAC | WYQQKPGQ SFVLVIY | Q------DSKRPS | GIPERFSGSNSG-NTATLTISGTQAMDEADYYC | QAWDS-------STYVV | FGGGT KLTVL |
| iPS:3 93196 | 21-225_16G8 | VL3l3r/JL2 | SYELSQP-PSVSVSPGQTASITC | SGD----KLGE-KYAC | WYQQKPGQ SPVLVIY | Q------DKRPS | GIPERFSGSNSG-NKATLTISGTQAMDEADYYC | QAWVN-------NTMI | FGGGT KLTVL |
| iPS:3 93198 | 21-225_28A11 | VL3l3r/JL2 | SYELTQP-PSVSVSPGQTASITC | SGD----KLGD-KYAC | WYQQKPGQ SPVLVIY | Q------DSKRPS | GIPERFSGSNSG-NTATLTISGTQAMDEADYYC | QAWDS-------STYVV | FGGGT KLTVL |
| iPS:3 93200 | 21-225_35E1 | VL3l3r/JL2 | SYELTQP-PSVSVSPGQTASITC | SGD----KLGE-KYAY | WFQQKPGQ SPVIVIY | Q------DSKRPS | GIPERFSGSNSG-NTATLTISGTQAMDEADYYC | QAWDN-------STAV | FGGGT KLTVL |
| iPS:3 93202 | 21-225_6B4 | VL3l3r/JL2 | SYELTQP-PSVSVSPRQTVSI | SGD----KLGD-KYAC | WYQQKPGQ SPVLVIY | Q------DKRPS | GIPERFSGSNSG-NTATLTISGTQAMDEADYYC | QAWDN-------NTVI | FGGGT KLTVL |
| iPS:3 93206 | 21-225_13F6 | VL3l3r/JL2 | SYELTQP-PSVSVSPGQTASITC | SGD----KLGD-KYAC | WYQQKPGQ SPVVVIY | Q------DSKRPS | GIPERFSGSNSG-NTATLTISGTQAMDEADYYC | QAWGN-------STAVV | FGGGT KLTVL |
| iPS:3 93210 | 21-225_17D3 | VL3l3r/JL2 | SYELTQS-PSVSVSPGGQTASITC | SGD----KLGD-KIVY | WYQQKPGQ SPVVVIY | Q------DRKRPS | GIPERFSGSNSG-NTATLTISGTQAMDEADYYC | QAWDS-------ITAV | FGGGT KLTVR |
| iPS:3 93212 | 21-225_30H6 | VL3l3r/JL2 | SYELTQP-PSVSVSPGQTASITC | SGD----KLGN-KYAC | WYQQKPGQ SPVLVIY | Q------DSKRPS | GIPERFSGSNSG-NTATLTISGTQAMDEADYYC | QAWD--------SSTV | FGGGT KLTVL |

Figure 51 (Continued)

| | | | | | | | | |
|---|---|---|---|---|---|---|---|---|
| iPS:3 93214 | 21-225_33A1 | VL3l3r/JL2 | SYELTQP-PSVSVSPGQTASI TC | SGD----KLGD-----KFVY | WYQQKPGQ SPVLVIY | Q-------DSKRPS | GIPERFSGSNSG--NTATLTISGTQAMDEADYYC | QAWDS---------TTVV | FGGGT KLTVL |
| iPS:3 93218 | 21-225_14G3 | VL3l3r/JL2 | SYELTQP-PSVSVSPGQTASI TC | SGD----KLGD-----KYVC | WYQQKPGQ SPVLVIY | Q-------DRKRPS | GIPERFSGSNSG--NTATLTISGTQAMDEADYYC | QAWGN---------STAVV | FGGGT KLTVL |
| iPS:3 93222 | 21-225_17F5 | VL3l3r/JL2 | SYELTQP-PSVSVSPGQTASI TC | SGD----KLGE-----KYAC | WYQQKPGQ SPVLVIY | Q-------DRKRPS | GIPERFSGSNSG--NTATLTISGTQAMDEADYYC | QAWD----------SSTV | FGGGT KLTVL |
| iPS:3 93224 | 21-225_31C2 | VL3l3r/JL2 | SYELTQP-PSVSVSPGQTASI TC | SGD----KLGN-----KYAC | WYQQKPGQ SPVLVIY | Q-------DSKRPS | GIPERFSGSNSG--NTATLTISGTQAMDEADYYC | QAWD----------SSTV | FGGGT KLTVL |
| iPS:3 93226 | 21-225_33E6 | VL3l3r/JL2 | SYELTQP-PSVSVSPGQTASI TC | SGD----KLGD-----KYAY | WFQQKPGQ SPVLVIY | Q-------DRKRPS | GIPERFSGSNSG--NTATLTISGTQAMDEADYYC | QAWDN---------STAV | FGGGT KLTVL |
| iPS:3 93234 | 21-225_26C10 | VL3l3r/JL2 | SYEVTQP-PSMSVSPGQTASI TC | SGD----KLGD-----KYVC | WFQQKPGQ SPVLVIY | Q-------DRKRPS | GIPERFSGSNSG--NTATLTISGTQAMDEADYYC | QAWV----------NNTV | FGGGT KLTVL |
| iPS:3 93345 | 21-225_5G7 | VL3l3r/JL2 | SYELTQP-PSVSVSPGQTASI TC | SGD----KLGN-----KYAW | WYQQKPGQ SPVLVIY | Q-------DRKRPS | GIPERFSGSNSG--NTATLTISGTQAMDEADYYC | QAWDN---------STVV | FGGGT KLTVL |
| iPS:3 93565 | 21-225_34B11 | VL3l3r/JL2 | SYELTQP-PSVSVSPGQTASI TC | SGD----KLGD-----KYAC | WYQQKPGQ SPVLVIY | Q-------DMKRPS | GIPERFSGSNSG--NTATLTISGTQAMDEADYYC | QAWDN---------STAV | FGGGT KLTVL |
| iPS:3 93950 | 21-225_3H10 | VL3l3r/JL2 | SYELSQP-PSVSVSPGQTASI TC | SGD----KLGE-----KYAC | WYQQKPGQ SPVLVIY | Q-------DRKRPS | GIPERFSGSNSG--NKATLTISGTQAMDEADYYC | QAWVN---------NTMI | FGGGT KLTVL |
| iPS:3 98470 | 21-225_14B7 | VL3l3r/JL2 | SYELTQP-PSVSVSPGRTASI TC | SGD----KLGN-----KYAY | WYQQKPGQ SPVLVIY | Q-------DRKRPS | GIPERFSGSNSG--NTATLTISGTQTMDEADYYC | QAWNN---------STVV | FGGGT KLTVL |
| iPS:3 98472 | 21-225_16E4 | VL3l3r/JL2 | PYELTQP-PSVSVSPGQTASI TC | SGD----KLGD-----KYVY | WYQQKSGQ SPVLVIY | Q-------DSKRPS | GIPERFSGSNSG--NTATLTISGTQAMDEADYYC | QAWDN---------STAV | FGGGT KLTVL |
| iPS:3 98488 | 21-225_19F6 | VL3l3r/JL2 | SYELTQP-PSVSVSPGQTVSI TC | SGD----KLGN-----KYAY | WYQQKPGQ SPVLVIY | Q-------DSKRPS | GIPERFSGSNSG--NTATLTISGTQAMDEADYYC | QAWDN---------NTVV | FGGGT KLTVL |
| iPS:3 98490 | 21-225_21D12 | VL3l3r/JL2 | SYELTQP-PSVSVSPGQTASI TC | SGD----KLGN-----KYAY | WYQQKPGQ SPVLVIY | Q-------DRKRPS | GIPERFSGSNSG--NTATLTISGTQAMDEADFYC | QAWDN---------STVV | FGGGT RLTVL |
| iPS:3 98498 | 21-225_22E6 | VL3l3r/JL2 | SYELTQP-PSVSVSPGQTASI TC | SGD----KLGE-----KYAC | WYQQKPGQ SPVLVIY | Q-------DRKRPS | GIPERYSGSNTG--NTATLTISGTQAMDEADYYC | QAWDS---------STAV | FGGGT KLTVL |
| iPS:3 98504 | 21-225_23D7 | VL3l3r/JL2 | SYELTQP-PSVSVSPGQTASI TC | SGE----KLGD-----KYVC | WYQQKPGQ SPVVVIY | Q-------DSKRPS | GIPERFSGSNSG--NTATLTISGTQAMDEADYYC | QAWNS---------SNVV | FGGGT KLTVL |
| iPS:3 98546 | 21-225_9H10 | VL3l3r/JL2 | SYELTQP-PSVSVSPGQTASI TC | SGD----KLGD-----KYAC | WYQQKPGQ SPVLVIY | Q-------DSKRPS | GIPERFSGSNSG--NTATLTISGTQMDEADYYC | QAWDS---------STYVV | FGGGT KLTVL |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 02225 | 21-225_2B1 | VL3\|3r/JL2 | SYELTQP-PSVSVSPGQTVSITC | SGD---KLGD------KYAC | WYQQKPGQSPVLVIY | Q--------DRKRPS | GIPERFSGSNSG---NTATLLISGTQAMDEADYYC | QAWDN--------------NTVV | FGGGTKLTVL |
| iPS:4 02231 | 21-225_6D9 | VL3\|3r/JL2 | SYELTQP-PSVSVSPGQTASI TC | SGD---KLGE------KYAC | WYQQKPGQSPVLVIY | Q--------DKKRPS | GIPERFSGSNSG---NTATLTISGTQAMDEADYYC | QAWD---------------SSTV | FGGGTKLTVL |
| iPS:4 04090 | 21-225_8D8 | VL3\|3r/JL2 | SYELTQP-PSVSVSPGQTASI TC | SGD---KLGE------KYAC | WYQQKPGQSPVVVIY | Q--------DRKRPS | GIPERFSGSNSG---NTATLTISGTQAIDEADYYC | QAWDS--------------STAV | FGGGTKLTVL |
| iPS:4 23018 | 21-225_31D12_L_C2 | VL3\|3r/JL2 | SYELTQP-PSVSVSPGQTASI TC | SGD---KLGD------KYAY | WFQQKPGQSPVIVIY | Q--------DRKRPS | GIPERFSGSNSG---NTATLTISGTQAMDEADYYC | QAWDN--------------STAV | FGGGTKLTVL |
| | Germline | VL2\|2a2\|L3b | QSALTQS-ASVSGSPGQSITI SC | TGTS---SDVGGY----NYVS | WYQQHPGKAPKLMIY | E--------VSNRPS | GVSNRFSGSKSG---NTASLTISGLQAEDEADYYC | SSYTS--------------SIYV | FGGGTKLTVL |
| iPS:4 68862 | 21-225_178H8 | VL2\|2a2/J L3b | QSALTQS-ASVSGSPGQSITI SC | TGTS-SDVGGY---NFVS | WYQQHPGKVPKFMIY | E--------VSNRPS | GVPNRFSGSKSG---NTASLTISGLQAEDEADYYC | SSYTS--------------SYTWV | FGGGTKLTVL |
| iPS:4 36838 | 21-225_52H4 | VL2\|2a2/J L3b | QSALTQP-ASVSGSPGQSITI SC | TGTS-SDVGGY---NYVS | WYQQHPGKAPKLMIY | E--------VSNRPS | GVSNRFSGSKSG---NTASLTISGLQAEDEADYYC | NSYTS--------------NITWV | FGGGTKLTVL |
| iPS:4 37094 | 21-225_210D12 | VL2\|2a2/J L3b | QSALTQP-ASVSGSPGQSITI SC | TGTS-SDVGGY---NYVS | WYQQHPGKAPKLLIY | E--------VSNRPS | GVSNRFSGSKSG---NTASLTISGLQAEDEADYYC | NSYTS--------------SITWV | FGGGTKLTVL |
| iPS:4 37096 | 21-225_210E12 | VL2\|2a2/J L3b | QSALTQP-ASVSGSPGQSITI SC | TGTS-SDVGGY---NYVS | WYQQHPGKAPKLMIY | E--------VSNRPS | GVSNRFSGSKSG---NTASLTISGLQAEDEADYYC | GSYVK--------------GITWV | FGGGTSLIVL |
| iPS:4 37098 | 21-225_211C1 | VL2\|2a2/J L3b | QSALTQP-ASVSGSPGQSITI SC | TGTS-SDVGSY---NYVS | WYQQHPGKAPKLMIY | E--------VSNRPS | GVSNRFSGSKSG---NTASLTISGLQAEDEADYYC | NSYTS--------------SITWV | FGGGTKLTVL |
| iPS:4 37104 | 21-225_211G5 | VL2\|2a2/J L3b | QSALTQP-ASVSGSPGQSITI SC | TGTS-SDVGGY---NYVS | WYQQHPGKAPKLMIY | E--------VRNRPS | GVSNRFSGSKSG---NTASLTISGLQAEDEADYYC | NSYTR--------------SITWV | FGGGTKLTVL |
| iPS:4 37112 | 21-225_212C2 | VL2\|2a2/J L3b | QSALTQP-ASVSGSPGQSITI SC | TGTS-SDVGGY---NYVS | WYQQHPGKAPKLMIY | E--------VSNRPS | GVSNRFSGSKSG---NTASLTISGLQAEDEADYYC | SSYTR--------------SITWV | FGGGTKLTVL |
| iPS:4 37114 | 21-225_212A4 | VL2\|2a2/J L3b | QSALTQP-ASVSGSPGQSITI SC | TGTS-SDVGGY---NYVS | WYQQHPGKAPKLMIY | E--------VSNRPS | GVSNRFSGSKSG---NTASLTISGLQAEDEADYYC | GSYVK--------------GITWV | FGGGTSLIVL |
| iPS:4 37116 | 21-225_212F6 | VL2\|2a2/J L3b | QSALTQP-ASVSGSPGQSITI SC | TGTS-SDVGGY---NYVS | WYQQHPGKAPKLMIY | E--------VSNRPS | GVSNRFSGSKSG---NTASLTISGLQAEDEADYYC | NSYTS--------------SITWV | FGGGTKLTVL |
| iPS:4 37118 | 21-225_212G7 | VL2\|2a2/J L3b | QSALTQP-ASVSGSPGQSITI SC | TGTS-SDVGGY---NYVS | WYQQHPGKTPKLMIY | E--------VSNRPS | GVSNRFSGSKSG---NTASLTISGLQAEDEADYYC | NSYTS--------------SITWV | FGGGTKLTVL |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 37128 | 21-225_213G3 | VL2|2a2|JL3b | LSALTQP-ASVSGSPGQSITI SC | TGTS-SDVGGY------NYVS | WYQQHPGK APKLMIS | E-------VRNRPS | GVSNRFSGSKSG---NTASLTISGLQAEDEADYYC | NSYTR------SITWV | FGGGT KLTVL |
| iPS:4 37130 | 21-225_213D5 | VL2|2a2|JL3b | QSALTQP-ASVSGSPGQSITI SC | TGTS-SDVGGY------NYVS | WYQQHPGK APKLVIY | E-------VRNRPS | GVSTRFSGSKSG---NKASLTISGLQAEDEADYYC | CSYTR------RITWV | FGGGT KLTVL |
| iPS:4 37146 | 21-225_215D3 | VL2|2a2|JL3b | QSALTQP-ASVSGSPGQSITI SC | TGTS-SDIGGY------NYVS | WYQQHPGK APTLMIY | E-------VSNRPS | GVSNRFSGSKSG---NTASLTISGLQAEDEADYYC | NSYKR------GSTWV | FGGGT KVTVL |
| iPS:4 37150 | 21-225_216A3 | VL2|2a2|JL3b | QSALTQP-ASVSGSFGQSITI SC | TGTS-SDVGGY------NYVS | WYQQHPGK APKLMIY | E-------VSNRPS | GVSNRFSGSKSG---NTASLTISGLQAEDEADYYC | NSYTS------SITWV | FGGGT KLTVL |
| iPS:4 37162 | 21-225_217B2 | VL2|2a2|JL3b | QSALTQP-ASVSGSPGQSITI SC | TGTS-SDVGGY------NYVS | WYQQHPGK APKLLIY | E-------VSNRPS | GVYNRFSGSKSG---NTASLTISGLQAEDEADYYC | GSYVK------GITWV | FGGGT SLTVL |
| iPS:4 37172 | 21-225_219A7 | VL2|2a2|JL3b | QSALTQP-ASVSGSPGQSITI SC | TGTS-SDVGGY------NYVS | WYQQHPGK APKLMIY | E-------VRNRPS | GVSNRFSGSKSG---NTASLTISGLQAEDEADYYC | CSYTR------SITWV | FGGGT KLTVL |
| iPS:4 37182 | 21-225_221H2 | VL2|2a2|JL3b | LSALTQP-ASVSGSPGQSITI SC | TGTS-SDVGGY------NYVS | WYQQHPGK APKLMIS | E-------VRNRPS | GVSNRFSGSKSG---NTASLTISGLQAEDEADYYC | NSYTR------SITWV | FGGGT KLTVL |
| iPS:4 37184 | 21-225_221G4 | VL2|2a2|JL3b | QSALTQP-ASVSGSPGQSITI SC | TGTS-SDVGGY------NYVS | WYQQHPGK APKLLIY | E-------VRNRPS | GVSNRFSGSKSG---NTASLTISGLQAEDEADYYC | NSYTR------SITWV | FGGGT KLTVL |
| VL1|1c|JL2 | Germline | | QSVLTQP-PSASGTPGQRVTI SC | SGSS-SNIGS------NTVN | WYQQLPGT APKLLIY | S-------NNQRPS | GVPDRFSGSKSG---TSASLAISGLQSEDEADYYC | AAWDDS------LNGVV | FGGGT KLTVL |
| iPS:4 68864 | 21-225_60D6 | VL1|1c|JL2 | QSVLTQP-PSASGTPGQRVTI SC | SGSS-SNIGS------NTVN | WYQQLPGT APKLLIY | S-------NNQRPS | GVPDRFSGSKSG---TSASLAISGLQSEDEADYYC | AAWDD-------SLNGP | VGGGT KLTVL |
| iPS:4 36660 | 21-225_146D8 | VL1|1c|JL2 | QSVLTQP-PSTSGTPGQRVTI SC | SGSS-SYIGS------NTVD | WYQQLPGT APKLLIY | S-------NNQRPS | GVPDRFSGSKSG---TSASLAISGLQSEDEADYYC | AAWDDS------LNGVV | FGGGT KLTVL |
| iPS:4 36680 | 21-225_147H12 | VL1|1c|JL2 | QSVLTQP-PSASGTPGQRVTI SC | SGSS-SNIGS------YAVN | WYQQLPGT APKLLIY | S-------NNHRPS | GVPDRFSGSKSG---TSASLAISGLQSEDEADYYC | EAWDDS------LNGPV | FGGGT KLTVL |
| iPS:4 36682 | 21-225_146A8 | VL1|1c|JL2 | QSVLTQP-PSASGTPGQRVTI SC | SGSS-SNIGS------NSIN | WYQQLPRT APKLLIY | S-------NDQRPS | GVPDRFSGSKSG---TSASLAISGLQSEDEADYYC | AAWDDS------LNGVV | FGGGT KLTVL |
| iPS:4 36684 | 21-225_146B6 | VL1|1c|JL2 | QSVLTQP-PSASGTPGQRVTI SC | SGSS-SNIGS------NAVN | WYQQLPGT APKLLIY | S-------NNQRPS | GVPDRFSGSKSG---TSASLAISGLQSEDEADYYC | AAWDDS------LNGVV | FGGGT KLTVL |
| iPS:4 36696 | 21-225_149A1 | VL1|1c|JL2 | QSVLTQP-PSASGTPGQRVTI SC | SGSS-SNIGS------NAVN | WYQQLPGT APKLLIY | S-------NNQRPS | GVPDRFSGSKSG---TSASLAISGLQSEDEADYYC | AAWDDS------LNGVV | FGGGT KLTVL |

Figure 51 (Continued)

| | | | | L_FR1 | L_CDR1 | L_FR2 | L_CDR2 | L_FR3 | L_CDR3 | L_FR4 |
|---|---|---|---|---|---|---|---|---|---|---|
| iPS:4 36712 | 21-225_150F9 | VL1|1c/JL2 | | QSVLTQP-PSASGTPGQRVTISC | SGSS-SNIGS------NAVN | WYQQLPGT APKLLIY | S-------NSQRPS | GVPDRFSGSKSG---TSASLAISGLQSEDEADYFC | AAWDDS-------------LNGVV | FGGGT KLTVL |
| iPS:4 36750 | 21-225_154G12 | VL1|1c/JL2 | | QSVLTQP-PSASGTPGQRVTISC | SGSS-SNIGN------NAVS | WYQQLPGT APKLLIY | S-------NDHRPS | GVPDRFSGSKSG---TSASLAISGLQSEDEADYYC | AAWDDS-------------LKGPV | FGGGT KLTVL |
| iPS:4 36762 | 21-225_156H2 | VL1|1c/JL2 | | QSVLTQP-PSASGTPGQRVTISC | SGSS-SNIGS------NTVN | WYQQLPGT APKLLIY | S-------SNQRPS | GVPDRLSGSKSG---TSASLAISGLQSEDEADYYC | AAWDDS-------------LNGVV | FGGGT KVTVL |
| iPS:4 37044 | 21-225_197F9 | VL1|1c/JL2 | | QSVLTQP-PSASGTPGQRVTISC | SGSS-SNIGS------NTVN | WYQQLPGT APKLLIY | S-------NNQRPS | GVPDRFSGSKSG---TSASLAISGLQSEDEADYYC | AAWDDS-------------MNGPV | FGGGT KLTVL |
| iPS:4 37060 | 21-225_199C3 | VL1|1c/JL2 | | QSVLTQP-PSASGTPGQRVTISC | SGSS-SNIGS------NTVN | WYQQLPGT APKLLIY | S-------NNQRPS | GVPDRFSGSKSG---TSASLAISGLQSEDEADYYC | AAWDDS-------------LNGFV | FGGGT KLTVL |
| iPS:3 93180 | 21-225_4G12 | VL1|1c/JL2 | | QSVLTQP-PSASGTPGQRVNM | SGTN-SNIGS------YTVN | WYQQLPGT APKLLIY | I-------NNQRPS | GVPDRFSGSKSG---TSASLAISGLQSEDEADYYC | AAWDDS-------------LNGHVV | FGGRT KLTVL |
| iPS:3 93230 | 21-225_9G9 | VL1|1c/JL2 | | QSVLTQP-PSASGTPGQRVNM | SGTN-SNIGN------YTVN | WYQQLPGT APKLLIY | I-------NNQRPS | GVPDRFSGSKSG---TSASLAISGLQSEDEADYYC | AAWDDS-------------LNGHVV | FGGRT KLTVL |
| VL|3pJL2 | Germline | | | L_FR1 | L_CDR1 | L_FR2 | L_CDR2 | L_FR3 | L_CDR3 | L_FR4 |
| iPS:4 68866 | 21-225_190C1 | VL3|3p/JL2 | | SYELTQP-PSVSVSPGQTARITC | TGD---AMPK------KYAY | WDQQKSGQ APVLVIS | E-------DSKRPS | GIPERFSGSSSG---TMAPLIISGAQVEDETDYDC | NSTDS--------------SGNRV | FGGGT KLTVL |
| iPS:4 37214 | 21-225_48B12 | VL3|3p/JL2 | | SYELTQP-PSVSVSPGQTARITC | SGD---ALPK------KYAY | WYQQKSGQ APVLVIY | E-------DSKRPS | GIPERFSGSSSG---IMATLIISGAQVEDEADYYC | NSTDSS-------------GNHVV | FGGGT KLTVL |
| VL|1c/JL3b | Germline | | | L_FR1 | L_CDR1 | L_FR2 | L_CDR2 | L_FR3 | L_CDR3 | L_FR4 |
| iPS:4 36234 | 21-225_51E3 | VL1|1c/JL3b | | QSVLTQP-PSASGTPGQRVTISC | SGSN-SNIGS------NIVT | WYQQLPGT APKLLIY | S-------NDQRPS | GVPDRFSGSKSG---TSASLAISGLQSEDEADYYC | AAWDDS-------------LNGWV | FGGGT TLTVL |
| iPS:4 36830 | 21-225_51F4 | VL1|1c/JL3b | | QSVLTQP-PSASGTPGQRVTISC | SGSS-SNIGS------NIVT | WYQQLPGT APKLLIY | S-------NDQRPS | GVPDRFSGSKSG---TSASLAISGLQSEDEADYYC | TAWDDS-------------LNGWV | FGGGT TLTVL |
| iPS:4 36834 | 21-225_52F1 | VL1|1c/JL3b | | QSVLTQP-PSASGTPGQRVTISC | SGSS-SNIGS------NIVT | WYQQLPGT APKLLIY | S-------NDQRPS | GVPDRFSGSKSG---TSASLAISGLQSEDETDYYC | TAWDDS-------------LNGWV | FGGGT TLTVL |
| iPS:4 36842 | 21-225_54E9 | VL1|1c/JL3b | | QSVLTQP-PSASGTPGQRVTISC | SGSN-SNIGN------NIVT | WYQQLPGT APKLLIY | V-------NDQRPS | GVPDRFSGSKSG---TSASLAISGLQSEDEADYYC | AAWDDS-------------LNGWV | FGGGT TLTVL |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 36844 | 21-225_56G1 | VL1|1c/JL 3b | QSVLTQP-PSASGTPGQRVTISC | SGSS-SNIGS------HIVT | WYQQLPGT APKLLIY | S------NDQRPS | GVPDRFSGSKSG---TSASLAISGLQSEDEADYYC | AVWDDS------------LIGWV | FGGGT TLTVL |
| iPS:4 36846 | 21-225_56E3 | VL1|1c/JL 3b | QSVLTQP-PSASGTPGQRVTISC | SGSS-SNIGS------NIVT | WYQQLPGT APKLLIY | S------NNQRPS | GVPDRFSGSKSG---TSASLAISGLQSEDEADYCC | AAWDDS------------LNGWV | FGGGT TLTVL |
| iPS:4 37010 | 21-225_192G3 | VL1|1c/JL 3b | QSVLTQP-PSASGTPGQRVTM SC | SGSS-SNIGS------NTVN | WYQQLPGT APKLLIY | G------NKQRPS | RVPDRFSGSKSG---TSASLAISGLQSEDETDYYC | AAWDDS------------LNGWV | FGGGT KLTVL |
| iPS:4 37032 | 21-225_195H6 | VL1|1c/JL 3b | QSVLTQP-PSASGTPGQRVTISC | SGSS-SNIGS------HTVN | WYQQLPGT APKLLIY | N------NYQRPS | GVPDRFSGSKSG---TSASLTISGLQSEDEADYYC | ATWDDS------------LSVWV | FGGGT KVTVL |
| iPS:4 51104 | 21-225_49C5 | VL1|1c/JL 3b | QSVLTQP-PSASGTPGQRVTISC | SGSS-SNIGS------NIVT | WYQQLPGT APKLLIY | S------NDQRPS | GVPDRFSGSKSG---TSASLAISGLQSEDEADYYC | TAWDDS------------LNGWV | FGGGT TLTVL |
| iPS:4 51106 | 21-225_49D10 | VL1|1c/JL 3b | QSVLTQP-PSASGTPGQRVTISC | SGSN-SNIGS------NIVT | WYQQLPGT APKLLIY | S------NDQRPS | GVPDRFSGSKSG---TSASLAISGLQSEDEADYYC | AAWDDS------------LNGWV | FGGGT TLTVL |
| iPS:4 51108 | 21-225_53E8 | VL1|1c/JL 3b | QSVLTQP-PSASGTPGQRVTISC | SGSC-SNIGS------NIVT | WYQQLPGT APKLLIY | S------NDQRPS | GVPDRFSGSKSG---TSASLAISGLQSEDEADYYC | TAWDDS------------LNDWV | FGGGT TLTVL |
| VL|3r/JL1 | | Germline | SYELTQP-PSVSVSPGQTASI TC | SGD----KLGD---KYAC | WYQQKPGQ SPVLVIY | Q------DSKRPS | GIPERFSGSNSG---NTATLTISGTQAMDEADYYC | QAWDS------------STAYV | FGTGT KVTVL |
| iPS:4 36662 | 21-225_147D7 | VL|3r/JL1 | SYELTQP-PSVSVSPGQTASI TC | SGD----KLGD---KFAC | WYQQKPGQ SPVLVIY | Q------DRKRPS | GIPERFSGSNSG---NTATLTISGTQAMDEADYYC | QAWDR------------NTAV | FGTGT KVTVL |
| iPS:4 36720 | 21-225_151H6 | VL|3r/JL1 | SYELTQP-PSVSVSPGQTASI TC | SGD----KLGD---KYAC | WYQQKPGQ SPVLVIY | Q------DTKRPS | GIPERFSGSNSG---NTATLTISGTQAMDEADYYC | QAWDS------------STYV | FGTGT KVTVL |
| iPS:4 36726 | 21-225_152G5 | VL|3r/JL1 | SYEMTQP-PSVSVSPGQTAII TC | SGD----KLGD---KYAC | WYQQKPGQ SPVLVIY | Q------DTKRPS | GIPERFSGSNSG---NTATLTISGTQAMDEADYYC | QAWDS------------STYV | FGTGT KVTVL |
| iPS:4 36732 | 21-225_152B12 | VL|3r/JL1 | SYELTQP-PSVSVSPGQTASI TC | SGD----KLGN---KYAC | WYQQKPGQ SPVLVIY | Q------DSKRPS | GIPERFSGSNSG---NTATLTISGTQAMDEADYYC | QAWDS------------STYV | FGTGT KVTVL |
| iPS:4 36734 | 21-225_153A8 | VL|3r/JL1 | SYELTQP-PSVSVSPGQTASI TC | SGD----KLGD---KYAC | WYQQKPGQ SPVLVIY | Q------DTKRPS | GIPERFSGSNSG---NTATLTISGTQAMDEADYYC | QAWDS------------STYV | FGTGT KVTVL |
| iPS:4 36754 | 21-225_155G3 | VL|3r/JL1 | SYELTQP-PSVSVSPGQTASI TC | SGD----KLGD---KYVC | WYQQKPGQ SPMLVIY | Q------DSKRPS | GIPERFSGSNSG---NTATLTISGTQAMDEADYYC | QAWDN------------SIYV | FGTGT KVTVL |
| iPS:4 37190 | 21-225_225A9 | VL|3r/JL1 | SYELTQP-PSVSVSPGQTASI TC | SGD----KLGN---KYAC | WYQQKPGQ SPVLVIY | Q------DSKRPS | GIPERFSGSNSG---NTATLTISGTQAMDEADYYC | QAWDS------------NTACV | FGTGT KVTVL |
| | | Germline | L_FR1 | L_CDR1 | L_FR2 | L_CDR2 | L_FR3 | L_CDR3 | L_FR4 |

Figure 51 (Continued)

| | | L_FR1 | L_CDR1 | L_FR2 | L_CDR2 | L_FR3 | L_CDR3 | L_FR4 |
|---|---|---|---|---|---|---|---|---|
| | VL5|5c/JL3b | QSVLTQP-ASLSASPGASASL ICWVCT VTII | TLRS-GSINS-----NYVQ | WYQQKPGS PPQFLLR | YKS DSDKHQGS | GVPSRFSGSKDASANAGILF ISGLQSEDEADYYC | MIWHS---------SASWV | FGGGT KLTVL |
| iPS:4 36702 | 21-225_149E8 VL5|5c/JL 3b | QAVSTQP-SSLSASPGASASL IC | TLRS-GITVTT--YRIY | WYQQKPGS PPQFLLR | YTS DSDKHQGS | GVPSRFSGSKDASANAGILF ISGLQSEDEADYYC | MIWHS---------SAWV | FGGGT KLTVL |
| | Germline VL1|1e/JL2 | QSVLTQP-PSVSGAPGQRVTI SC | TGSS-SNIGAG-----YDVH | WYQQLPGT APKLLIY | YKS NSNRFS | GVPDRFSGSKSG-TSASLAITGLQAEDEADYYC | QSYDSS--------LSGWV | FGGGT KLTVL |
| iPS:4 36752 | 21-225_155H1 VL1|1e/JL 2 | QSVLTQP-PSVSGAPGQRVTI SC | TGSS-SNIGAG-----YDVH | WYQQLPGT APKLLIY | G---NSNRFS | GVPDRFSGSKSG-TSASLAITGLQAEDEADYHC | QSYDSS--------LSGPVI | FGGGT KLTVL |
| iPS:4 36820 | 21-225_179D10 VL1|1e/JL 2 | QSVLTQP-PSVSGAPGQRVTI SC | TGSS-SNFGID-----YDVH | WYQQFPGT APKLLIY | G---HSNRFS | GVPDRFSGSKSG-TSASLAITGLQAEDEADYYC | QSYDR---------SLNVV | FGGGT KLTVL |
| iPS:4 37188 | 21-225_224B11 VL1|1e/JL 2 | QSVLTQP-PSVSGAPGQRVTI SC | TGSS-SNIGAG-----YDVH | WYQQLPGT APKLLIF | G---NSNRFS | GVPDRFSGSKSG-TSASLAITGLQAEDEADYHC | QSYDN---------SLSGV | FGGGT KLTVL |
| iPS:4 37198 | 21-225_226F8 VL1|1e/JL 2 | QSVLTQP-PSVSGAPGQRVTI SC | TGSS-SNIGAG-----YDVH | WYQQLPGT APKLLIY | G---NSNRPS | GVPDRFSGSKSD-TSASLAITGLQAEDEADYYC | QSYDN---------SLSGV | FGGGT KLTVL |
| iPS:4 37202 | 21-225_227D3 VL1|1e/JL 2 | QSVLTQP-PSVSGAPGQRVTI SC | TGSS-SNIGAG-----YDVH | WYQQLPGT APKLLIY | G---HSNRPS | GVPDRFSGSKSD-TSASLAITGLQAEDEADYYC | QSYDN---------SLSGV | FGGGT KLTVL |
| iPS:4 37208 | 21-225_227C10 VL1|1e/JL 2 | QSVLTQP-PSVSGAPGQRVTI SC | TGSS-SNIGAG-----YDVH | WYQQLPGT APKLLIY | G---NSNRPS | GVPDRFSGSKSD-TSASLAITGLQAEDEADYYC | QSYDN---------NLSGV | FGGGT KLTVL |
| iPS:4 43003 | 21-225_43F11_LC 2 VL1|1e/JL | QSVLTQP-PSVSGAPGQRVTI SC | TGSS-SNIGAG-----YDVH | WYQQLPGT APKLLIY | G---NSNRPS | GVPDRFSGSKSG-TSASLAITGLQAEDEADYYC | QSYDNS--------LSGSV | FGGGT KLTVL |
| | Germline VL6|6a/JL3b | NFMLTQP-RSVSESPGKTVTI SC | TRSS-GSITG------NYVQ | WHQQRPGN SPTTLIY | E---DKKRPS | GVPDRFSGSIDSSSNSASLT ISGLKTEDEADYYC | QSYYS---------GNWV | FGGGT KLTVL |
| iPS:4 36792 | 21-225_169D12 VL6|6a/JL 3b | NFMLTQP-RSVSESPGKTVTI SC | TRSS-GSITG------NYVQ | WHQQRPGN SPTTLIY | E---DKKRPS | GVPDRFSGSIDSSSNSASLT ISGLKTEDEADYYC | QSYYS---------GNWV | FGGGT KLTVL |
| | Germline VL3|3I/JL2 | SSELTQD-PAVSVALGQTVRI TC | QGD-----SLRS-----YYAS | WYQQKPGQ APILVIY | A---KNNRPS | GIPDRFSGSNSG-NTASLTITGAQAEDEADYYC | NSRDSS--------GSHVV | FGGGT KLTVL |
| iPS:4 36800 | 21-225_171D12 VL3|3I/JL 2 | SSELTQD-PAVSVALGQTVRI TC | QGD-----SLRN-----YYAS | WYQQKPGQ APILVIY | A---KNNRPS | GIPDRFSGSNSG-NTASLTITGAQAEDEADYYC | NSRDSS--------GSHVV | FGGGT KLTVL |
| iPS:4 36804 | 21-225_172C3 VL3|3I/JL 2 | SSELTQD-PAVSVALGQTVRI TC | QGD-----SLRN-----YYVS | WYQQKPGQ APILVIY | T---KNSRPS | GIPDRFSGSTSG-NTASLTITGTQAEDEADYYC | NSRDSS--------GNHVV | FGGGT KLTVL |

Figure 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 36806 | 21-225 172B12 | VL3l3l/JL2 | SSELTQD-PAVSVALGQTVRITC | QGD---SLRN------YYAS | WYQQKPGQ APILVIY | T--------KMSRPS | GIPDRFSGSTSG--NTASLTITGAQAEDEADYYC | NSRDSS------GNHVV | FGGGT KLTVL |
| iPS:4 36964 | 21-225_190B3 | VL3l3l/JL2 | SSELTQD-PAVSVALGQTVRITC | QGD---KLRT------YYAS | WYQQKPGQ APVLVIY | G--------KNNRPS | GIPDRFSGSSSG--NTASLTITGAQAEDEADYYC | NSRDSS------GNHLVL | FGGGT KLIVL |
| iPS:4 36970 | 21-225_190B8 | VL3l3l/JL2 | SSELTQD-PAVSVALGQTVRITC | QGD---TLRP------YYVS | WYQQKPGQ APVLVIY | G--------KNNRPS | GIPDRFSGSSSG--NTASLTITGAQAEDEADYYC | NSRDSS------GNHLVV | FGGGT KLIVL |
| iPS:4 36980 | 21-225_190C10 | VL3l3l/JL2 | SSELTQD-PAVSVALGQTVRITC | QGD---SLRP------YYAS | WYQQKPGQ APVLVIY | G--------KNNRPS | GIPDRFSGSSSG--NTASLTITEAQAEDEADYYC | NSRDSS------GNHLVV | FGGGT KLIVL |
| iPS:4 36992 | 21-225_191B8 | VL3l3l/JL2 | SSELTQD-PAVSVALGQTVRITC | QGD---TLRP------YYAS | WYQQKPGQ APVLVIY | G--------KNNRPS | GISDRFSGSSSG--NTASLTITGAQAEDEADYYC | NSRDSS------GNHLVV | FGGGT KLIVL |
| iPS:4 36994 | 21-225_191A9 | VL3l3l/JL2 | SSELTQD-PAVSVALGQTVRITC | QGD---SLRP------YYAS | WYQQKPGQ APVLVIY | G--------KNNRPS | GIPDRFSGSSSG--NTASLTITGAQAEDEADYYC | NSRDSC------GNHLVV | FGGGT KLIVL |
| iPS:4 37016 | 21-225_193A6 | VL3l3l/JL2 | SSELTQD-PAVSVALGQTVRITC | QGD---SLRS------YYAN | WYQQKPGQ APVLFIY | A--------KNNRPS | GIPDRFSGSNSG--NTASLTITGAQAEDEADYYC | NSRDSS------GNHLV | FGGGT KLIVL |
| | Germline | | L_FR1 | L_CDR1 | L_FR2 | L_CDR2 | L_FR3 | L_CDR3 | L_FR4 |
| VL2l2b2/JL2 | | | QSALTQP-ASVSGSPGQSITI SC | TGTS-SDVGSY---NLVS | WYQHPKQ APKLMIY | E--------VSKRPS | GVSNRFSGSKST--NTASLTISGLQAEDEADYYC | CSYAGS------STYVV | FGGGT KLTVL |
| iPS:4 36810 | 21-225_175F4 | VL2l2b2/JL2 | QSALTQP-ASVSGSPGQSITI SC | TGTS-SDVGRF---NLVS | WYQHPGY APKLMIY | E--------VSKRPS | GVSNRFSGSKSG--NTASLTISGLQAEDEADYYC | CSYAGS------STYVV | FGGGT KLIVL |
| iPS:4 36814 | 21-225_178H10 | VL2l2b2/JL2 | QSALTQP-ASVSGSPGQSITI SC | TGTS-SDVGRF---NLVS | WYQHPGN APKLMIY | E--------VSKRPS | GVSNRFSGSKSG--NTASLTISGLQAEDEADYYC | CSYAGS------STFVV | FGGGT KLIVL |
| | Germline | | L_FR1 | L_CDR1 | L_FR2 | L_CDR2 | L_FR3 | L_CDR3 | L_FR4 |
| VL3l3l/JL3b | | | SSELTQP-PAVSVALGQTVRI SC | QGD---SLRT------YYAS | WYQQKPGQ APVLVIY | G--------KNNRPS | GIPDRFSGSSSG--NTASLAITGAQAEDEADYYC | NSRDSS------GNHWV | FGGGT KLIVL |
| iPS:4 36816 | 21-225_179H5 | VL3l3l/JL3b | SSELTQD-PAVSVALGQTVRI TC | QGD---SLRN------YYAS | WYQQKPGQ APVFVIY | G--------KNNRPS | GIPDRFSGSRSG--NTASLTITGAQAEDEADYYC | NSRDSS------GNHVV | FGGGT KLIVL |
| | Germline | | L_FR1 | L_CDR1 | L_FR2 | L_CDR2 | L_FR3 | L_CDR3 | L_FR4 |
| VL1l1e/JL1 | | | QSVLTQP-PSVSGAPGQRVTI SC | TGSS-SNIGAG---YDVH | WYQQLPGT APKLLIY | G--------NSNRPS | GIPDRFSGSKSG--TSASLAITGLQAEDEADYYC | QSTFSS------LSGYV | FGTGT KLTVL |
| iPS:4 36832 | 21-225_51D8 | VL1l1e/JL1 | QSVLIQP-PSVSGAPGQRVTI SC | TGSS-SNIGAG---FEVH | WYQQLPGI APKLLIY | G--------NSNRPS | GVFDRFSGSKSG--TSASLAITGLQAEDEADYYC | QSYDSS------LSGYV | FGTGT RVTVL |
| | Germline | | L_FR1 | L_CDR1 | L_FR2 | L_CDR2 | L_FR3 | L_CDR3 | L_FR4 |

Figure 51 (Continued)

| | | | | | | | | | | | |
|---|---|---|---|---|---|---|---|---|---|---|---|
| VL3/3r/JL7 | | | SYELTQP | SGD | KLGD | WYQKPGQ | Q | GIPERFSGSNSG | | QTWDS | FGGGT |
| iPS:4 36840 | 21-225_53E9 | VL3/3r/JL7 | SYELTQP-PSVSVSPGQTASITC | SGT---KLGD----KYVC | WYQQKPGQ SPVLVIN | Q-------DTMRPS | GIPERFSGSNSG-NTATLTISGTQAMDEADYYC | QTWDS-------STAV | FGGGT TLTVL |
| iPS:4 36950 | 21-225_184G4 | VL3/3r/JL7 | SYELTQP-PSVSVSPGQTASITC | SGD---KLGD----KFAC | WYQQKPGQ SPVLVIY | E-------DRKRPS | GIPERFSGSNSG-NTATLTISGTQAMDEADYYC | QAWDS-------RTVV | FGGGT QLTVL |
| Germline | | | L_FR1 | L_CDR1 | L_FR2 | L_CDR2 | L_FR3 | L_CDR3 | L_FR4 |
| VL1|1b/JL2 | | | QSVLTQP | SGSS-SNIGN-NYVS | WYQQLPGT | D | GIPDRFSGSKSG | GTWDSS | FGGGT |
| iPS:4 36856 | 21-225_58C5 | VL1|1b/JL2 | QSVLTQP-PSVSAAPGQKVTISC | SGSS-SNIGN-----NYVS | WYQQLPGT APKLLIY | D-------NNKRPS | GIPDRFSGSKSG-TSATLGITGLQTGDEADYYC | GTWDIS-------LSVGV | FGGGT KLTVL |
| iPS:4 36960 | 21-225_198D2 | VL1|1b/JL2 | QSVLTQP-PSVSAAPGQKVTISC | SGSS-SNIGS-----NYVS | WYQQLPGT APKVLIY | D-------NNKRPS | GIPDRFSGSKSG-TSATLGITGLQTGDEADYYC | GTWDSR-------LNVGV | FGGGT KLTVL |
| iPS:4 36966 | 21-225_190C3 | VL1|1b/JL2 | QSVLTQP-PSVSAAPGQKVTISC | SGSS-SNIGN-----NYVS | WYQQLPGT APKLLIY | D-------SMKRPS | GIPDRFSGSKSG-TSATLGITGLQTGDEADYYC | GTWDSS-------LSTVV | FGGGT KLTVL |
| iPS:4 36968 | 21-225_190B10 | VL1|1b/JL2 | QSVLTQP-PSVSAAPGQKVTISC | SGSS-SNIGN-----NYVS | WYQHLPGT APKLLIY | D-------NNKRPS | GIPDRFSGSKSG-TSATLGITGLQTGDEADYYC | GTWDSS-------LSAGV | FGGGT KLTVL |
| iPS:4 36974 | 21-225_190H7 | VL1|1b/JL2 | QSVLTQP-PSVSAAPGQKVTISC | SGSS-SNIGN-----NYVS | WYQQLPGT APKVLIY | D-------NNKRPS | GIPDRFSGSKSG-TSATLGITGLQTGDEADYYC | GTWDGR-------LNVGV | FGGGT KLTVL |
| iPS:4 36976 | 21-225_190D8 | VL1|1b/JL2 | QSVLTQP-PSVSAAPGQKVTISC | SGSS-SNIGN-----NYVS | WYQQLPGT APKLLIY | D-------SSKRPS | EIPDRFSGSKSG-TSATLGITGLQTGDEADYYC | GTWDSS-------LSTVV | FGGGT KLTVL |
| iPS:4 36982 | 21-225_190D10 | VL1|1b/JL2 | QSVLTQP-PSVSAAPGQKVTISC | SGSS-SNIGS-----NYVS | WYQQLPGT VPKVLIY | D-------NNKRPS | GIPDRFSGSKSG-TSATLGITGLQTGDEADYYC | GTWDSR-------LNVGV | FGGGT KLTVL |
| iPS:4 36986 | 21-225_191A1 | VL1|1b/JL2 | QSVLTQP-PSVSAAPGQKVTISC | SGSS-SNLGN-----NFVS | WYQQFPGT APKLLIY | D-------NYKRPS | GIPDRFSVSKSG-TSATLGITGLQTGDEADYYC | GTWDSS-------LNTGV | FGGGT KLTVL |
| iPS:4 37006 | 21-225_192G2 | VL1|1b/JL2 | QSVLTQP-PSVSAAPGQKVTISC | SGSS-SNIGN-----HYVS | WYQQLPGT APKLLIY | D-------NNKRPS | RIPDRFSGSKSG-TSATLGITGLQTGDEADYYC | GTWDSR-------LSAGV | FGGGT KLTVL |
| iPS:4 37024 | 21-225_194F11 | VL1|1b/JL2 | QSVLTQP-PSVSAAPGQKVTISC | SGSS-SNIGN-----NYVS | WYQQLPGT APKLLIY | D-------NNKRPS | GIPDRFSGSKSG-TSATLGITGLQTGDEADYYC | GTWDSS-------LSAGV | FGGGT KLTVL |
| iPS:4 37028 | 21-225_194G12 | VL1|1b/JL2 | QSVLTQP-PSVSAAPGQKVTISC | SGSS-SNIGN-----NYVS | WYQQLPGT APKLLIY | D-------NNKRPS | RIPDRFSGSKSG-TSATLGITGLQTGEEADYYC | GTWDSS-------LSVGV | FGGGT KLTVL |

Figure 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 37042 | 21-225_197E8 VL1γ1b/JL2 | QSVLTQP-PSVSAAPGQKVTISC | SGSS-SNIGN------KYVS | WYQQFPGT APKLLIY | D------NNKRPS | KIPDRFSGSKSG--TSATLGITGLITGDEADYYC | GIWDRS--------LSVMV | FGGGT KLTVL |
| iPS:4 37064 | 21-225_200G8 VL1γ1b/JL2 | QSVLTQP-PSVSAAPGQRVTISC | SGSS-SNLGN------NFVS | WYQQFPGT APKLLIY | D------NYKRPS | GIPDRFSVSKSG--TSATLGITGLQTGDEADYYC | GTWDSS--------LNTGV | FGGGT KLTVL |
| iPS:4 37086 | 21-225_209A8 VL1γ1b/JL2 | QSVLTQP-PSVSAAPGQKVTISC | SGSS-SNIGS------NFLS | WYQQLPGT APKLLIY | D------NNKRPS | GIPDRFSGSKSG--TSATLGITGLQTGDEADYYC | GTWDSS--------LSAGV | FGGGT KLTVL |
| iPS:4 37138 | 21-225_214D8 VL1γ1b/JL2 | QSVLTQP-PSVSAAPGQKVTISC | SGSS-SNIGN------NYVS | WYQQFPGT APKLLIH | D------NNKRPS | GIPDRFSGSKSG--TSATLGITGLQTGDEADYYC | GAWDSS--------LSAVV | IGGGS KLTVL |
| iPS:4 37168 | 21-225_218G4 VL1γ1b/JL2 | QSVLTQP-PSVSAAPGQKVTISC | SGSS-SNIGN------NYVS | WYQQLPGT APKLLIY | D------SNKRPS | GIPARFSGSKSG--TSATLGITGLQTGDEADYYC | GTWDSS--------LNTVV | FGGGT KLTVL |
| | Germline | L_FR1 | L_CDR1 | L_FR2 | L_CDR2 | L_FR3 | L_CDR3 | L_FR4 |
| VL16a/JL2 | | | | | | | | |
| iPS:4 36888 | 21-225_63G7 VL6γ6a/JL2 | NFMLTQP-HSVSESPGKTVTISC | TRSN-GSIVS------NYVQ | WYQQRPGS SPTTMIY | E------DSRRPS | GVPDRFSGSIDSSNSASLTISGLKTEDEADYSC | QSYDG--------INVV | FGGGT KLTVL |
| iPS:4 36890 | 21-225_63A10 VL6γ6a/JL2 | NFMLTQP-HSVSESPGKTVTISC | TRSN-GSIVS------NYVQ | WYQQRPGS SPTVIY | E------DKRRPS | GVPDRFSGSIDSSNSASLTISGLKTEDEADYYC | QSYDS--------INVV | FGGGT KLTVL |
| | Germline | L_FR1 | L_CDR1 | L_FR2 | L_CDR2 | L_FR3 | L_CDR3 | L_FR4 |
| VL18a/JL3b | | | | | | | | |
| iPS:4 36910 | 21-225_73G1 VL8γ8a/JL3b | QTVVTQE-PSFSVSPGGTVTLTC | GLSS-------GSVSTS-YYPS | WYQQTPGQ APRALIY | N------TNTRSS | GVPDRFSGSILG--NKAALTITGAQADDESDYYC | VLYMG--------SAIWV | FGGGT KLTVL |
| iPS:4 36948 | 21-225_183F5 VL8γ8a/JL3b | QTVVTQE-PSFSVSPGGTVTLTC | GLSS-------GSVSTT-FYPS | WYQQTPGQ APRALIY | N------TNTRSS | GVPDRFSGSILG--NKAALTITGAQADDESDYYC | VLYMG--------SGIWV | FGGGT KLTVL |
| | Germline | L_FR1 | L_CDR1 | L_FR2 | L_CDR2 | L_FR3 | L_CDR3 | L_FR4 |
| VL17a/JL2 | | | | | | | | |
| iPS:4 36920 | 21-225_74E5 VL7γ7a/JL2 | QTVVTQE-PSLTVSPGGTVTLTC | ASSI-----ETVTSG-SYFN | WFQQKPGQ APRALIY | S------TSNKHS | WTPARFSGSLLG--GKAALTLSDVQPEDEAEYYC | LLYYG--------GAQLV | FGGGT KLTVL |
| iPS:4 36926 | 21-225_78D10 VL7γ7a/JL2 | QTVVTQE-PSLTVSPGGTVTLTC | ASSI-----GAVTSG-YFPN | WFQQKPGQ APRALIY | S------TDNKHS | WTPARFSGSLLG--GKAALTLSGVQPEDEAEYYC | LLYYG--------GAQLM | FGGGT KLTVL |
| iPS:4 36958 | 21-225_190D1 VL7γ7a/JL2 | QTVVTQE-PSLTVSPGGTVTLTC | ASSI-----GAVTSG-SYFN | WFQQKPGQ APRALIY | S------TSNKHS | WTPARFSGSLLG--GKAALTLSGVQPEDEADYYC | LLYYG--------GAQVA | FGGGT KLTVL |

Figure 51 (Continued)

| | | | | | | | | |
|---|---|---|---|---|---|---|---|---|
| iPS:4_36984 | 21-225_190F10 | VL7|7a/JL2 | QTVVTQE-PSLTVSPGGTVTLTC | VFST-GAVTSG-SFPN | WFQQKPGQ APRALIY | S-------TSNKHS | WTPARFSGSLLG-GKAALTLSGVQPEDEADYYC | LLYCG-------GAQLV | FGGGT KLTVL |
| iPS:4_36988 | 21-225_191A2 | VL7|7a/JL2 | QTVVTQE-PSLTVSPGGTVTLTC | VLST-GAVTSG-SFPN | WFQQKPGQ APRALIY | S-------TSNKHS | WTPARFSGSLLG-GKAALTLSGVQPEDEADYYC | MLYCG-------GAQLV | FGGGT KLTVL |
| iPS:4_37002 | 21-225_191H9 | VL7|7a/JL2 | QTVVTQE-PSLTVSPGGTVTLTC | ASST-GAVTSA-YYPN | WLQQKPGQ APRTLIY | S-------TNNKHS | WTPARFSGSLLG-GKAALTLSDVQPEDEAEYYC | LIFYG-------GVHVI | FGGGT KLTVL |
| iPS:4_37008 | 21-225_192E3 | VL7|7a/JL2 | QTVVTQE-PSLTVSPGGTVTLTC | AFST-GSVTSG-SYPN | WFQQKPGQ APRALIY | S-------TNNKHS | WTPARFSGSLLG-GKAALTLSGVQREDEAEYYC | LLLYG-------GAQLV | FGGGT KLTVL |
| iPS:4_37012 | 21-225_192G7 | VL7|7a/JL2 | QTVVTQE-PSLTVSPGGTVTLTC | ASST-GAVTSG-NYPQ | WFQQKPGQ APRALIY | S-------TTNRHS | WTPARFSGSLLG-GKAALTLSGVQPEDEAEYYC | LFYYG-------GAQVI | FGGGT KLTVL |
| iPS:4_37014 | 21-225_192H8 | VL7|7a/JL2 | QTVVTQE-PSLTVSPGGTVTLTC | AFST-GTVTSG-FYPN | WFQQKPGQ APRALIY | N-------TSNRHS | WTPARFSGSLLG-GMAALTLSGVQPEDEAEYYC | LLLYG-------GAQLM | FGGGT KLTVL |
| iPS:4_37022 | 21-225_194G5 | VL7|7a/JL2 | QTVVTQE-PSLTVSPGGTVTLTC | ASST-GAVTSG-NYPN | WFQQKPGQ TPRALIY | S-------TSNKHS | WTPARFSGSLLG-GKAALTLSGVQPEDEAEYYC | LIYYG-------GAQLM | FGGGT KLTVL |
| iPS:4_37026 | 21-225_194D12 | VL7|7a/JL2 | QTVVTQE-PSLTVSPGGTVTLTC | ASST-GAVTSG-SFPS | WFQQKPGQ APRALIY | S-------TNNRHS | STPARFSGSLLG-GKAALTLSGVQPEDEAEYYC | LIYYG-------GAQLA | FGGGT KLTVL |
| iPS:4_37040 | 21-225_196E7 | VL7|7a/JL2 | QTVVTQE-PSLTVSPGGTVTLTC | ASST-GAVTSA-YYPN | WLQQKPGQ AFRTLIY | S-------TNNKHS | WTPARFSGSLLG-GKAALTLSDVQPEDEAEYYC | LIFYG-------GVHVI | FGGGT KLTVL |
| iPS:4_37048 | 21-225_197B11 | VL7|7a/JL2 | QTVVTQE-PSLTVSPGGTVTLTC | AFST-GSVTSG-NYPN | WFQQKPGQ APRALIY | S-------TNNKHS | WTPARFSGSLLG-GKAALTLSGVQPEDEAEYYC | LLLYG-------GAQLV | FGGGT KLTVL |
| iPS:4_37050 | 21-225_197C11 | VL7|7a/JL2 | QTVVTQE-PSLTVSPGGTVTLTC | ASST-GAVTSA-YYPN | WLQQKPGQ APRTLIY | S-------TSNKHS | WTPARFSGSLLG-GKAALTLSDVQPEDEAEYYC | LIFYG-------GVHVI | FGGGT KLTVL |
| iPS:4_37056 | 21-225_198B8 | VL7|7a/JL2 | QTVVTQE-SSLTVSPGGTVTLTC | VLST-GAVTSG-SFPN | WFQQKPGQ APRALIY | S-------TNNKHS | WTPARFSGSLLG-GKAALTLSGVQPEDEADYYF | MLYSG-------GAQMV | FGGGT KLTVL |
| iPS:4_37062 | 21-225_200H1 | VL7|7a/JL2 | QTVVTQE-PSLTVSPGGTVTLTC | ASNT-GAVTSG-SYPN | WFQQKPGQ APRALIY | H-------TDNKHS | WTPARFSGSLLG-GKAALTLSGVQPEDEAEYYC | LIYYG-------GAQLV | FGGGT KLTVL |
| iPS:4_37066 | 21-225_200G9 | VL7|7a/JL2 | QTVVTQE-PSLTVSPGGTVTLTC | ASNI-GAVTSG-SYPN | WLQQKPGQ APRALIY | H-------TNNKHS | WTPARFSGSLLG-GKAALTLSGAQPEDEAEYYC | LIYYG-------GAQMV | FGGGT KLTVL |
| iPS:4_37068 | 21-225_200A11 | VL7|7a/JL2 | QTVVTQE-PSLTVSPGGTVTLTC | ASST-GAVTSG-YYPN | WFQQKPGQ VPRALIY | S-------TNNKHS | WTPARFSGSLLG-GKAALTLSGVQPEDEAEYYC | LLLYG-------GAHLA | FGGGT KLTVL |
| iPS:4_37090 | 21-225_210F11 | VL7|7a/JL2 | QTVVTQE-PSLTVSPGGTVTLTC | AFST-GAVTSG-NYPN | WFQQKPGQ APRALIY | S-------TSNKHS | WTPARFSGSLLG-GKAALTLSGVQPEDEAEYYC | LLYYG-------GAQLV | FGGGT KLTVL |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:4 37106 | 21-225_211H7 | VL7|7a/JL2 | QTVVTQE-PSLTVSPGGTVTL TC | AFST-GAVTSG-NYPS | WFQQKPGQ VPRALIY | S-------TSNRHS | WTPARFSGSLLG--GKAALTLSGVQPEDEAEYYC | LLYYG-------GAQLV | FGGGT KLTVL |
| iPS:4 37108 | 21-225_211C9 | VL7|7a/JL2 | QTVVTQE-PSLTVSPGGTVTL TC | GSST-GSVTSG-YFPN | WFQQKPGQ APRPLIY | S-------TNNKHS | WTPARFSGSLLG--GKAALTLSGVQPEDEAEYYC | LLYYG-------GAQLA | FGGGT KLTVL |
| iPS:4 37110 | 21-225_211E9 | VL7|7a/JL2 | QTVVTQE-PSLTVSPGGTVTL TC | ASST-GAVTSG-NYPN | WFQQKPGQ APRALIY | S-------TINKHS | GTPARFTGFLLG--GKAALTLSGVQPEDEAEYYC | LLYYG-------GAQLA | FGGGT KLTVL |
| iPS:4 37120 | 21-225_212A9 | VL7|7a/JL2 | QTVVTQE-PSLTVSPGGTVTL TC | ASST-GAVTSG-YYPN | WFQQKPGQ APRALIY | S-------TNNKHS | WTPARFSGSLLG--GKAALTLSGVQPEDEAEYYC | LLYYG-------GAQVG | FGGGT KLTVL |
| iPS:4 37124 | 21-225_212H12 | VL7|7a/JL2 | QTVVTQE-PSLTVSPGGTVTL TC | GSST-GSVTSG-YYPN | WFQQKPGQ APRALIY | S-------TNNKHS | WTPARFSGSLLG--GKAALTLSGVQPEDEAEYYC | LLYYG-------GAHVV | FGGGT KLTVL |
| iPS:4 37132 | 21-225_213F5 | VL7|7a/JL2 | QTVVTQE-PSLTVSPGGTVTL TC | ASST-GAVTSG-YFPN | WFQQKPGQ APRALIY | S-------TNNKHS | WTPARFSGSLLG--GKTALTLSGVQPEDEAEYYC | LLYFG-------GAQLA | FGGGT KLTVL |
| iPS:4 37136 | 21-225_214H3 | VL7|7a/JL2 | QTVVTQE-PSLTVSPGGTVTL TC | ASST-GAVTSG-YYPN | WFQQKPGQ APRALIY | S-------TNNKHS | CTPARFSGSLLG--GKAALTLSGVQPEDEAEYYC | LLYYG-------GAHVV | FGGGT KLTVL |
| iPS:4 37140 | 21-225_214E12 | VL7|7a/JL2 | QTVVTQE-PSLTVSPGGTVTL TC | ASST-GAVTSG-YYPN | WFQQKPGQ APRALIY | S-------TNNKHS | WTPARFSGSLLG--GKAALTLSGVQPEDEAEYYC | LLYYG-------GAQLV | FGGGT KLTVL |
| iPS:4 37142 | 21-225_215A3 | VL7|7a/JL2 | QTVVTQE-PSLTVSPGGTVTL TC | ASST-EAVTSG-NYPS | WFQQKPGQ TPRPLIY | S-------TNNKHS | GTPARFSGSLLG--GKAALTLSGVQPEDEAEYYC | LLYCD-------GAQLA | FGGGT KLAVL |
| iPS:4 37148 | 21-225_215H3 | VL7|7a/JL2 | QTVVTQE-PSLTVSPGGTVTL TC | ASST-GAVTSG-YYPN | WFQQKPGQ APRALIY | S-------TNNKHS | CGPARFSGSLLG--GKAALTLSGVQPEDEAEYYC | LLYYG-------GAQVG | FGGGT KLTVL |
| iPS:4 37154 | 21-225_216A7 | VL7|7a/JL2 | QTVVTQE-PSLTVSPGGTVTL TC | ASST-GAVTSG-YYPN | WFQQKPGQ APRALIY | S-------TSNKHS | CTPARFSGSLLG--GKAALTLSGVQPEDEAEYYC | LLYYG-------GAQVG | FGGGT KLTVL |
| iPS:4 37158 | 21-225_216H11 | VL7|7a/JL2 | QTVVTQE-PSLTVSPGGTVTL TC | ASST-GAVTSG-YYPN | WFQQKPGQ APRALIY | S-------TSNKHS | WTPARFSGSLLG--GKAALTLSGVQPEDEAEYYC | LLYCD-------GAQLV | FGGGT KLTVL |
| VL1|1b/JL3b | | Germline | QSVLTQP-PSVSAAPGQKVTI SC | SGSS-SNIGN-NYYS | WYQQLPGT APKLLIY | D-------NNKRPS | GIPDRFSGSKSG--TSATLGITGLQTEDEADYYC | GTWSS | FGGGT KLTVL |
| iPS:4 36972 | 21-225_190C7 | VL1|1b/JL3b | QSVLTQP-PSVSAAPGQKVTI SC | SGGS-SNIGN-----NYVS | WFQQFPGT APKFLIY | D-------NNKRPS | GIPDRFSGSKSG--TSAILGITGLQTDEADYYC | GTWDRT-------LSDWV | FGGGT KLTVL |
| iPS:4 37020 | 21-225_193F11 | VL1|1b/JL3b | QYVLTQP-PSVSAAPGQKVTI SC | FGGS-SNIGN-----NYVS | WFQQFPGT APKFLIY | D-------NNKRPS | GILDRLSGSKSG--TSATLDITGLQNGDEADYYC | GTWDRT-------MSDWV | FGGGT KLTVL |

Figure 51 (Continued)

| | | L_FR1 | L_CDR1 | L_FR2 | L_CDR2 | L_FR3 | L_CDR3 | L_FR4 |
|---|---|---|---|---|---|---|---|---|
| iPS:4 37036 | 21-225_195H9 | VL1j1b/JL3b | QSVLTQP-PSVSAAPGQKVTISC | SGGS-SNIGN-----NYVS | WFQQFPGT D------APKLIY NNKRPS | GILDRFSGSKSG--TSATLGITGLQTGDEADYYC | GTWDRT-------MSDWV | FGGGT KLTVL |
| | Germline | VL1j1b/JL1 | QSVLTQP-PSVSAAPGQKVTISC | SGGS-SNIGN-----NYVS | WYQQLPGT D------APKLIY NKKRPS | GIPERFSGSKSC--TSATLGITGLQKEEADYYC | GTWDSS-------LSAVV | FGTGT KVTVL |
| iPS:4 36996 | 21-225_191B9 | VL1j1b/JL1 | QSVLTQP-PSVSAAPGQKVTISC | SGSS-SNIGN-----NYVS | WYQQLPGT D------APKLIY NKKRPS | GIPDRFSGSKSG--TSATLGITGLQTGDEADYYC | GTWDSS-------LSVCV | FGTGT KVIVL |
| iPS:4 37054 | 21-225_194G3 | VL1j1b/JL1 | QSVLTQP-PSVSAAPGQKVTISC | SGSS-SNIGN-----NYIS | WYQQLPGT D------APKLIY NKKRPS | GIPDRFSGSKSG--TSATLGITGLQTDEADYYC | GTWDSS-------LSVCV | FGTGT KVIVL |
| iPS:4 37058 | 21-225_199F3 | VL1j1b/JL1 | QSVLTQP-PSVSAAPGQKVTISC | SGSS-SNIGN-----NYVS | WYQQLPGT D------APKLIY NKKRPS | GIPDRFSGSKSG--TSATLGITGLQTGDEADYYC | GTWDSS-------LSACV | FGTGT KVTVL |
| | Germline | VL5j5c/JL2 | QAVLTQP-ASLSASPGASASL | TLRS GINVGT YRIY | WYQQKPGS PPQYLLR DSDKQQGS | GVPSRFSGSKDASANAGILL ISGLQSEDEADYYC | MIWHS-------SACVV | FGGGT KLTVL |
| iPS:4 37080 | 21-225_191G9 | VL5j5c/JL2 | QAVSTRP-SSLSASPGASASLTC | TLRS-GINVGT-YRIY | WYQQKPGS PPQYLLR DSDKQQGS | GVPSRFSGSKDASANAGILL ISGLQSEDEADYYC | MIWHS-------SAVV | FGGGT KLTVL |
| | Germline | VL3j3j/JL2 | QSVLTQP-LSVSVALGQTARI | GGN---NIES------RNVH | WYQQKPGQ R------APVLVIY DSNRPS | GIPERFSGSNSG--NTATLTISRAQSGDEADYYC | QVWDS-------STAVV | FGGGT KLTVL |
| iPS:4 37074 | 21-225_203B2 | VL3j3j/JL2 | SYELTQP-LSVSVALGQTARITC | GGN---NIGR-----KNVH | WYQQKPGQ R------SPVLIIH DSDRPS | GIPERFSGSNSG--NTATLTISRAQAGDEADYYC | QVWDS-------GTAV | FGGGT KLPVL |
| iPS:4 37082 | 21-225_205E12 | VL3j3j/JL2 | SYELTQP-LSVSAALGQTARITC | GGN---NIGR-----KNVH | WYQQKPGQ R------SPVLIIH DSDRPS | GIPERFSGSNSG--NTATLTISRAQAGDEADYYC | QVWDS-------GTAV | FGGGT KLPVL |
| iPS:4 37084 | 21-225_206B5 | VL3j3j/JL2 | SYELTQP-LSVSVALGQTARITC | GGN---NIGR-----KNVH | WYQQKPGL R------AFVPVIX DSYRSS | GIPDRFSGSNCG--NTTVTISRAQAGEEAEYYC | QDWDS-------STVV | FGGGT KLTVL |
| iPS:4 37088 | 21-225_209H10 | VL3j3j/JL2 | SYELTQP-LSVSVALGQTARIAC | GGN---NIGR-----KNVH | WYQQKPGL R------AFVPVIL DSYRSS | GIPDRFSGSNWG--NTATVTISRAQAGEEEAEYYC | QDWDS-------STVV | FGGGT KLTVL |
| iPS:4 37100 | 21-225_211H2 | VL3j3j/JL2 | SYELTQP-LSVSVALGQTARITC | GGN---NIGR-----RNVH | WYQQKPGQ R------APILVIY DRDRPS | GIPERFSGSNSG--NTATLTISRAQAGDEADYYC | QVWDS-------STAV | FGGGT KLTVL |
| iPS:4 37160 | 21-225_216B12 | VL3j3j/JL2 | SYELTQP-LSVSVALGQTARITC | GGD---NIRR-----RNVH | WYQQKPGQ R------APVLVIY DSNRPS | GIPDRFSGSNSG--NTATLTISRAQAGDEADYYC | QVWDS-------STGV | FGGGT KLTVL |
| iPS:3 92593 | 21-225_3E10 | VL3j3j/JL2 | SYELTQP-HSVSVATAQMARITC | GGN---NIGS-----KAVH | WYQQKPGQ S------DPVLVIY DSNRPS | GIPERFSGSNPG--NTATLTISRIEAGDEADYYC | QVWDSS------SDHVV | FGGGT KLTVL |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:3 93204 | 21-225_8C12 | VL3j3j/JL2 | SYELTQP-HSVSVATAQMARITC | GGN----NIGS-----KAVH | WYQQKPGQ DPVLVIY | S--------DSNRPS | GIPERFSGSNPG--NTATLTISRIEAGDEADYYC | QVWDSS---------SDHVV | FGGGT KLTVL |
| | | Germline | QSALTQP-PSVSGSPGQSITISC | | WYQQHPGK APKLMIY | E--------VSNRPS | GVSNRFSGSKSG--NTASLTISGLQAEDEADYYC | SSYTS | FGGGT KLTVL |
| iPS:4 37092 | 21-225_210B12 | VL2j2a2/JL2 | QSALTQP-ASVSGSPGQSITISC | TGTS-----SDVGGY----NYVS | WYQQHPGK APKFMIY | E--------VRNRPS | GVSNRFSGSKSG--NTASLTISGLQAEDEADYYC | SSYTS---------SRILV | FGGGT KLTVL |
| iPS:4 37134 | 21-225_213A7 | VL2j2a2/J L2 | QSALTQP-ASVSGSPGQSITISC | TGTS-----SDVGGY----NYVS | WYQQHPGK APKFMIY | E--------VRNRPS | GVSNRFSGSKSG--NTASLTISGLQAEDEADYYC | SSYTS---------SRILV | FGGGT KLTVL |
| iPS:4 72733 | 21-225_2B10_LC2 | VL2j2a2/J L2 | QSALTQP-ASVSGSPGQSITISC | TGTS-----SDVGGY----NFVS | WYQQHPGK APKLMIY | E--------VSNRPS | GVSNRFSGSKSG--NTASLTISGLQAEDEADYYC | SSYTS---------TGTVV | IGGGT KLTVL |
| iPS:3 92573 | 21-225_15G2 | VL2j2a2/J L2 | QSALTQP-ASVSGSPGQSITISC | TGTS-----SDVGGY----NYVS | WYQQHPGK APKLMIY | E--------VSNRPS | GVSNRFSGSKSG--NTASLTISGLQAEDEADYYC | TSYTS---------TSTVV | FGGGT KLTVL |
| iPS:3 93232 | 21-225_17F12 | VL2j2a2/J L2 | QSALTQP-ASVSGSPGQSITISC | TGAS-----SDVGDY----NSVS | WYQQHPGK APKLMIY | E--------VSNRPS | GVSNRFSGSKSG--NTASLTISGLQAEDEADYYC | SSYTS---------SITVV | FGGGT KLTVL |
| iPS:3 98494 | 21-225_21H4 | VL2j2a2/J L2 | QSALTQP-ASVSGSPGQSITISC | TGTS-----SDVGGY----NSVS | WYQQHPGK APKLMIY | E--------VSNRPS | GVSNRFSGSKSG--NTASLTISGLQAEDEADYYC | SSYTR---------SSTVV | FGGGT KLTVL |
| | | Germline | | | | | | | |
| iPS:4 37102 | 21-225_211E5 | VL3j3m/J L1 | SYELTQP-PSVSVSPGQTARITC | SGD----ALPK-----QYAY | WYQQKPGQ APVLVIY | K--------DSARPS | GIPERFSGSRSG--TTVTLTVSGVQAEDEADYYC | QLVYS---------SDTYV | FGTGT MLTVL |
| iPS:4 37164 | 21-225_217C6 | VL3j3m/J L1 | SYELTQP-PSVSVSPGQTARITC | SGD----ALPK-----QYAY | WYQQKPGQ APVLVIY | K--------DSERPS | GIPERFSGSRSG--TTVTLTIRGVQAEDEADYYC | QLIVS---------SDTYV | FGTGT KVTVL |
| iPS:4 37166 | 21-225_217G11 | VL3j3m/J L1 | SYELTQP-PSVSVSPGQTARITC | SGD----ALPK-----QYAY | WYQQKPGQ APVLVIY | K--------DSERPS | GIPERFSGSRSG--TTVTLTIRGVQAEDEADYYC | QLVYS---------SDTYV | FGTGT KVTVL |
| iPS:4 37170 | 21-225_218E5 | VL3j3m/J L1 | SYELTQP-PSVSVSPGQTARITC | SRD----VLPK-----QYAY | WYQQKPGQ APVLVIY | K--------DSERPS | GIPERFSGSRSG--TTVTLTIRGVQAEDEADYYC | QLVVS---------SDTYV | FGTGT KVTVL |
| iPS:4 37196 | 21-225_226B7 | VL3j3m/J L1 | SFELTQP-PSVSVSPGQTARITC | SGD----ALPR-----HYVY | WYQQNPGQ APVLVIY | K--------DSERPS | GIPERFSGSSSG--TTVTLTISGVQAEDEADYYC | QSADS---------SGTYV | FGTGT KVTVL |
| | | Germline | | | | | | | |

Figure 51 (Continued)

| | | | L_FR1 | L_CDR1 | L_FR2 | L_CDR2 | L_FR3 | L_CDR3 | L_FR4 |
|---|---|---|---|---|---|---|---|---|---|
| iPS:3 92596 | 21-225_12D8 | VL4|4c/JL2 | LPVLTQP-PSASALLGASIKLTC | TLSS-EHSTY------TIE | WYQQRPGRSPQYIMK | VKS-----DGSHSKGD | GIPDRFMGSSSG--ADRYLTFSNLQSDDEDYHC | GESHTID--------GQVGVV | FGGGTKLTVL |
| iPS:3 93174 | 21-225_15D8 | VL4|4c/JL2 | LPVLTQP-PSASALLGASIKLTC | TLSS-EHSTY------TIE | WYQQRPGRSPQYIMK | VKS-----DGSHSKGD | GIPDRFMGSSSG--ADRYLTFSNLQSDDEEYHC | GESHTID--------GQVGVV | FGGGTKLTVL |
| iPS:3 98544 | 21-225_7C8 | VL4|4c/JL2 | LPVLTQP-PSASALLGASIKLTC | TLSS-EHSTY------TIE | WYQQRPGRSPQYIMK | VKS-----DGSHSKGD | GIPDRFMGSSSG--GDRYLTFSNLQSDDEDYHC | GESHPID--------GQVGVV | FGGGTKLTVL |
| | Germline | | | | | | | | |
| | VL3|3h/JL2 | | | | | | | | |
| iPS:3 93208 | 21-225_16F3 | VL3|3h/JL2 | SYVLTQP-PSVSVAPGQTARITC | GGN----NIGS------KSVH | WYQQKPGQAPVLVVY | D-------DTDRPS | GIPERFSGSNSG--NTATLTISRVEAGDEADYC | QVWDSS--------SDHVV | FGGGTKLTVL |

HEAVY VARIABLE

| | | | H_FR1 | H_CDR1 | H_FR2 | H_CDR2 | H_FR3 | H_CDR3 | H_FR4 |
|---|---|---|---|---|---|---|---|---|---|
| | Germline | | | | | | | | |
| | VH|1-08/D6|6-19|RF1/JH4 | | | | | | | | |
| iPS:4 26126 | 21-225_6G6 | VH|1-08/D6|6-19|RF1/JH4 | QVQLVQS-GAEVRKPGASVKVSCKASG-YTFT | N------YDIN | WVRQATGQGPEWMG | WMHPN---SGNTGYAKKFQG | RVTMTRNTSISAAYMVLSSLRSEDTAVYYCAL | SSGWY---------YFDY | WGQGTLVTVSS |
| iPS:4 12232 | 21-225_4A2 | VH|1-08/D6|6-19|RF1/JH4 | QVQLVQS-GTEVKKPGASVKVSCKASG-YTFT | N------YDIN | WVRQATGQGLEWMG | WMHPN---SGNTGYAQKFQG | RVTLIRNTSISTAYMELSSLRSEDTAVYYCAS | SSGWY---------YFDY | WGQGTLVTVSS |
| iPS:4 26112 | 21-225_12F12 | VH|1-08/D6|6-19|RF1/JH4 | QVQLLQS-GAEVKKPGASVKVSCKASG-YTFT | N------YDIN | WVRQATGQGLEWMG | WMYPN---SGNTGYAQKFQG | RVTMTMNTSISTAYMELSSLRSEDTAVYYCAM | SSGWY---------YFDF | WGQGTLVTVSS |
| iPS:4 51141 | 21-225_164B11 | VH|1-08/D6|6-19|RF1/JH4 | QVQLVQS-GAEVKKPGASVKVSCKASG-YTFT | N------YDIN | WVRQATGQGLEWMG | WMTPN---SGNTGYAQKFRG | RVTMTRNTSMSTAYMELSSLRSEDSAVYYCSY | SSGWY---------MFDY | WGQGTLVTVSS |
| iPS:4 68850 | 21-225_63F4 | VH|1-08/D6|6-19|RF1/JH4 | QVQLVQS-GAEVKKPGASVKVSCKASG-YTFT | N------YDVN | WVRQATGQGLEWMG | WMHPN---SGNTGYAQKFQG | RVTMTRNTSLSTVYMELSSLRSEDTAVYYCAY | SSGWY---------VFDY | WGQGTLVTVSS |
| iPS:4 68852 | 21-225_71F3 | VH|1-08/D6|6-19|RF1/JH4 | QVQLVQS-GAEVKKPGASVKVSCKASG-YTFT | N------YDVN | WVRQATGQGLEWMG | WMHPN---SGNTGYAQKFQG | RVTMTRNTSISTAYMELSSLRSEDTAVYYCAY | SSGWY---------VFDS | WGQGTLVTVSS |

Figure 51 (Continued)

| | | | | | | | | |
|---|---|---|---|---|---|---|---|---|
| iPS:4 68854 | 21-225_72C4 | VH1\|1-08\|D6\|6-19\|RF1/J H4 | QVQLVQS-GAEVKKPGASVKV SCKASG-YTFT | N------YDIN | WVRQVTGQ GLEWMG | WMHPN---- SGNTGYAQK FQG | RVTMTRNTSISTAYMELNSL RSEDTAVYYCSH | SSGWY-------------LFDY | WGQGT LVTVS S |
| iPS:4 68870 | 21-225_74A8 | VH1\|1-08\|D6\|6-19\|RF1/J H4 | QVQLVQS-GAEVKKPGASVKV SCKASG-YTFT | N------YDIN | WVRQASGQ GLEWMG | WMHPN---- SGNTGYAQK FQG | RVTMTRNTSISTAYMELSSL RSEDSAVYYCAY | SSGWY-------------RFDY | WSQGT LVTVS S |
| iPS:4 23314 | 21-225_12F11 | VH1\|1-08\|D6\|6-19\|RF1/J H4 | QVQLVQS-GAEVKKPGASVKV SCKASG-YTFT | N------YDIN | WVRQATGQ GPEWMG | WMHPN---- SGNTGYAKK FQG | RVTMTRNTSISAAYMVLSSL RSEDTAVYYCAL | SSGWY-------------YFDY | WGQGT LVTVS S |
| iPS:4 33909 | 21-225_43D8 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL TSEDTAVYYCAH | SSGWT-------------LFDY | WGQGT LVTVS A |
| iPS:4 34177 | 21-225_56A1 | VH1\|1-08\|D6\|6-19\|RF1/J H4 | QVLLVQS-GAEVKKPGASVKV SCKASG-YTFT | N------YDIN | WVRQATGQ GLEWLG | WMHPN---- SGNTGYAQK FQG | RVTMTRNTSISTAYMELSSL RSEDTAVYYCAY | SSGWY-------------VFDY | WGQGT LVTVS S |
| iPS:4 34211 | 21-225_60F3 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY-------------FFDY | WGQGT LVTVS S |
| iPS:4 34235 | 21-225_61E3 | VH1\|1-08\|D6\|6-19\|RF1/J H4 | QVQLVQS-GAEVKKPGASVKV SCKASG-YTFT | N------YDIN | WVRQATGQ GLEWMG | WMTPN---- SGNTGYAQK FQG | RVTMTRNTSISTAYMELSSL KSEDTAVYYCAY | SSGWY-------------RFDY | WGQGT LVTVS S |
| iPS:4 34237 | 21-225_61B5 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGSTGYAQK FQG | RVTMTRNTSISTAYMELSSL RSEDTAVYYCAY | SSGWY-------------YFDY | WGQGT LVTVS S |
| iPS:4 34295 | 21-225_58B9 | VH1\|1-08\|D6\|6-19\|RF1/J H4 | QVQLVQS-GAEVKKPGASVKV SCKASG-YTFT | N------YDIN | WVRQATGQ GLEWMG | WMNPN---- SGNTGYAQK FQG | RVTMTRNTSISTAYMELSSL RSEDTAVYYCAY | SSGWY-------------YFDY | WGQGT LVTVS S |
| iPS:4 34305 | 21-225_59E1 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAF | SSGWY-------------FFDY | WGQGT LVTVS S |
| iPS:4 34321 | 21-225_59F10 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYNCAV | SSGWY-------------YFDY | WGQGT LVTVS S |
| iPS:4 34431 | 21-225_70E7 | VH1\|1-08\|D6\|6-19\|RF1/J H4 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAY | SSGWY-------------VFDY | WGQGT LVTVS S |

Figure 51 (Continued)

| | | | | | | | | | |
|---|---|---|---|---|---|---|---|---|---|
| iPS:4 34443 | 21-225_71G3 | VH1J1-08/D6J6-19JRF1/JH4 | QVQLVQS-GAEVKKPGASVKVSCKASG-YTFT | N------YDIN | WVRQATGQGLEWMG | WMHPN----SGSTGYAQKFQG | RVTMTRDTSVSTAYMELSSLRSEDTAVYYCAY | SSGWY------- | -------YFDY | WGQGTLVTVSS |
| iPS:4 34475 | 21-225_74F9 | VH1J1-08/D6J6-19JRF1/JH4 | QVQLVQS-GAEVKKPGASVKVSCKASG-YIFT | N------YDIN | WVRQATGQGLEWMG | WMNPN----SGNTGCAQKFQG | RVTMTRNTSISTAYMELSSLRSEDTAVYYCAS | SSGWN------- | -------FFDY | WGQGTLVTVSS |
| iPS:4 34477 | 21-225_74A6 | VH1J1-08/D6J6-19JRF1/JH4 | QVQLVQS-GAEVKKPGASVKVSCKASG-YTFT | N------YDIN | WVRQATGQGLEWMG | WMHPN----SGNTGYAQKFRG | RVTMTWNTSISTAYMELSSLRSEDTAVYYCAG | SSGWY------- | -------YFDY | WGQGTLVTVSS |
| iPS:4 34487 | 21-225_76G2 | VH1J1-08/D6J6-19JRF1/JH4 | QVQLVQS-GAEVKKPGASVKVSCKASG-YTFT | N------YDIN | WVRQATGQGLEWMG | WMNPN----SGSTGYAQKFQG | RVTMTRNTSISTAYMELSSLRSEDTAVYYCAG | SSGWY------- | -------MFDY | WGQGTLVTVSS |
| iPS:4 34511 | 21-225_74B11 | VH1J1-08/D6J6-19JRF1/JH4 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVFYCAY | SSGWY------- | -------YFDY | WGQGTLVTVSS |
| iPS:4 34549 | 21-225_76E11 | VH1J1-08/D6J6-19JRF1/JH4 | QVQLVQS-GAEVKKPGASVKVSCKASG-YTFT | N------YDIN | WVRQATGQGLEWMG | WMNPN----SGNTGYAQKFQG | RLTMTRNTSISTAYMELSSLRSEDTAVYYCAY | SSGWY------- | -------YFDY | WGQGTLVTVSS |
| iPS:4 34551 | 21-225_75C4 | VH1J1-08/D6J6-19JRF1/JH4 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAY | SSGWY------- | -------YFDY | WGQGTLVTVSS |
| iPS:4 34635 | 21-225_78E6 | VH1J1-08/D6J6-19JRF1/JH4 | QVQLVQS-GAEVKKPGASVKVSCKASG-YTFT | N------YDVN | WVRQASCQGLEWMG | WMNPN----SGNTGYAQKFQG | RVTMTRNTSISTAYMELSSLRSEDSAVYYCAY | SSGWY------- | -------KFDY | WGQGTLVTVSS |
| iPS:4 34649 | 21-225_78E11 | VH1J1-08/D6J6-19JRF1/JH4 | QVQLVQS-GAEVKKPGASVKVSCKASG-YTFT | N------YDIN | WVRQATGQGLEWMG | WMHPN----SGNTGCAQKFQG | RVTMTRNTSISTAYMELSSLRSEDTAVYYCAS | SSGWN------- | -------FFDY | WGQGTLVTVSS |
| iPS:4 34665 | 21-225_74G4 | VH1J1-08/D6J6-19JRF1/JH4 | QVQLVQS-GAEVKKPGASVKVSCKASG-YTFT | N------YDVN | WVRQATGQGLEWMG | WMNPN----SGNTGYAQKFQG | RVTMTRNTSIRTAYMELSSLRSEDTAVYYCAY | SSGWY------- | -------HFDY | WSQGTLVTVSS |
| iPS:4 34679 | 21-225_79G7 | VH1J1-08/D6J6-19JRF1/JH4 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDSAVYYCAY | SSGWY------- | -------KFDY | WGQGTLVTVSS |
| iPS:4 34685 | 21-225_79E9 | VH1J1-08/D6J6-19JRF1/JH4 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAS | SSGWY------- | -------YFDY | WGQGTLVTVSS |

Figure 51 (Continued)

| | | | | | | | | |
|---|---|---|---|---|---|---|---|---|
| iPS:4 34697 | 21-225_79F12 | VH1J1-08/D6J6-19/RF1/JH4 | QVQLVQS-GAEVKKPGASVKVSCKASG-YTFT | N------YDIN | WVRQATGQ GLEWMG | WMNPN---- SGNTGYAQK FQG | RVTMTRNTSISTAYMELSSL RSEDTAVYYCAS | SSGWY------------- | -----FFDY | WGQGT LVTLS S |
| iPS:4 34729 | 21-225_80B12 | VH1J1-08/D6J6-19/RF1/JH4 | QVQLVQS-GAEVKKPGASVKVSCKTSG-YTFT | N------YDIN | WVRQATGQ GLEWMG | WMNPN---- SGNTGYAQK FQV | RVTMTRNTSISTAYMELSSL RSEDTAVYYCAY | SSGWY------------- | -----IFDY | WGQGT LVTVS S |
| iPS:4 34851 | 21-225_75A6 | VH1J1-08/D6J6-19/RF1/JH4 | QVQLVQS-GAEVKKPGASVKVSCKASG-YTFT | N------YDIN | WVRQATGQ GLEWMG | WMRPN---- SGNTGYAQK FQG | RVTMTRNTSISTAYMELSSL RSEDTAVYYCAY | SSGWY------------- | -----IFDY | WGQGT LVTVS S |
| iPS:4 34909 | 21-225_85C11 | VH1J1-08/D6J6-19/RF1/JH4 | QVQLVQS-GAEVKKPGASVKVSCKASG-YTFT | N------YDIN | WVRQASGQ GLEWMG | WMHPN---- SGNTGYAQK FQG | RVTMTRNTSISTAYMELSSL RSEDSAVYYCAY | SSGWY------------- | -----KFDY | WSQGT LVTVS S |
| iPS:4 34959 | 21-225_87E10 | VH1J1-08/D6J6-19/RF1/JH4 | QVQLVQS-GAEVKKPGASVKVSCKASG-YTFT | N------YDIN | WVRQATGQ GLEWMG | WMNPN---- SGNTGYAQK FQG | RVTMTRNTSISTAYMELSSL RSEDTAVYYCAY | SSGWY------------- | -----FFDY | WGQGT LVTVS S |
| iPS:4 34965 | 21-225_88A1 | VH1J1-08/D6J6-19/RF1/JH4 | QVQLVQS-GAEVKKPGASVKVSCKASG-YTFT | N------YDIN | WVRQATGQ GLEWMG | WMNPN---- SGNTGYAQK FQG | RVTMTRNTSISTAYMELSSL RSEDTAVYYCAY | SSGWY------------- | -----YFDY | WGQGT LVTVS S |
| iPS:4 34973 | 21-225_88B4 | VH1J1-08/D6J6-19/RF1/JH4 | QVQLVQS-GAEVKKPGASVKVSCKASG-YTFT | N------YDIN | WVRQATGQ GLEWMG | WMNFN---- SGDTGYAQK FQG | SVTMTRNTSISTAYMELSSL RSEDTAVYYCSY | SSGWY------------- | -----YFDY | WGQGT LVTVS S |
| iPS:4 34997 | 21-225_88C10 | VH1J1-08/D6J6-19/RF1/JH4 | QVQLVQS-GAEVKKPGASVRVSCKASG-YTFS | N------YDIN | WVRQATGQ GLEWMG | WMTPN---- SGNTGYAQK FQG | RVTMTRNTSISTAYMELSSL RSEDTAVYYCAS | SSGWY------------- | -----YFDS | WGQGT LVTVS L |
| iPS:4 35053 | 21-225_75F9 | VH1J1-08/D6J6-19/RF1/JH4 | QVQLVQS-GAEVKKPGASVKVSCKASG-YTFS | N------YDIN | WVRQATGQ GLEWMG | WMHPN---- SGNTGYAQK FQG | RVTMTRNTSISTAYMELSSL RSEDTAVYYCAS | SSGWY------------- | -----IFDY | WGQGT LVTVS S |
| iPS:4 35113 | 21-225_92E6 | VH1J1-08/D6J6-19/RF1/JH4 | QVQLVQS-GAEVKKPGASVKVSCKASG-YTFT | N------YDIN | WVRQATGQ GLEWMG | WMNPN---- SGNTGYAQK FQG | RVTMTRNTSISTAYMELSSL RSEDTAVYYCAY | SSGWY------------- | -----FFDY | WGQGT LVTVS S |
| iPS:4 35209 | 21-225_75A10 | VH1J1-08/D6J6-19/RF1/JH4 | QVQLVQS-GAEVKKPGASVKVSCKASG-YTFT | N------YDIN | WVRQATGQ GLEWMG | WMNPN---- SGNTGYAQK FQG | RVTMTRNTSMSTAYMELSSL RSEDTAVYYCAR | SSGWY------------- | -----YFDY | WGQGT LVTVS S |
| iPS:4 35257 | 21-225_96H5 | VH1J1-08/D6J6-19/RF1/JH4 | QVQLVQS-GAEVKKPGASVKVSCKASG-YTFT | N------YDIN | WVRQASGQ GLEWMG | WMHPN---- SGNTGYAQK FQG | RVTMTRNTSISTAYMELSSL RSEDSAVYYCAY | SSGWY------------- | -----KFDY | WSQGT LVTVS S |

Figure 51 (Continued)

| | | | | | | | | |
|---|---|---|---|---|---|---|---|---|
| iPS:4 35267 | 21-225_96D10 | VH1J1-08/D6J6-19/RF1/JH4 | QVQLVQS-GAEVKKPGASVRVSCKASG-YTFT | N------YDIN | WVRQATGQ GLEWMG | WMHPN----SGNTGYAQKFQG | RVTMTRNTSMSTAYMELSSLRSEDTAVYYCAH | SSGWY--------- | ---------FFDY | WGQGTLVTVSS |
| iPS:4 35299 | 21-225_146D4 | VH1J1-08/D6J6-19/RF1/JH4 | QVQLVQS-GAEVKKPGASVKVSCKASG-YTFT | N------YDIN | WVRQATGQ GLEWMG | WVHPN----SGNTGYAQKFQG | RVTMTRNTSISTAYMELSSLRSEDTAVYYCAG | SSGWY--------- | ---------YFDY | WGQGTLVTVSS |
| iPS:4 35305 | 21-225_146C9 | VH1J1-08/D6J6-19/RF1/JH4 | QVQLVQS-GAEVKKPGASVKVSCKASG-YTFT | N------YDIN | WVRQATGQ GLEWMG | WMHPN----SGNTDYAQKFQG | RVTMTWNTSISTAYMALSSLRSEDTAVYYCAY | SSGWY--------- | ---------SFDY | WGQGTLVTVSS |
| iPS:4 35309 | 21-225_146F9 | VH1J1-08/D6J6-19/RF1/JH4 | QVQLVQS-GAEVKKPGASVKVSCKASG-YTFT | N------YDIN | WVRQATGQ GLEWMG | WMHFN----SGNTGYAQKFQG | RVTMTRNTSISTAYMELSSLRSEDTAVYYCAS | SSGWY--------- | ---------FFDY | WGQGTLVTVSS |
| iPS:4 35321 | 21-225_147E4 | VH1J1-08/D6J6-19/RF1/JH4 | QVQLVQS-GAEVKKPGASVKVSCKASG-YTFT | N------YDIN | WVRQATGQ GLEWMG | WMMPN----SGNTGYAQKFQG | RVTMTRNTSISTAYMELSSLRSEDTAVYYCAS | SSGWY--------- | ---------FFDY | WGQGTLVTVSS |
| iPS:4 35323 | 21-225_147D5 | VH1J1-08/D6J6-19/RF1/JH4 | QVQLVQS-GAEVKKPGASVKVSCKASG-YTFT | N------YDIN | WVRQATGQ GLEWMG | WVHPN----SGNTGYAQKFQG | RVTMTRNTSISTAYMELSSLRSEDTAVYYCAG | SSGWY--------- | ---------YFDY | WGQGTLVTVSS |
| iPS:4 35345 | 21-225_148G3 | VH1J1-08/D6J6-19/RF1/JH4 | QVQLVQS-GAEVKKPGASVKVSCKASG-YTFT | N------YDIN | WVRQASGQ GLEWMG | WMHFN----SGNTGYAQKFQG | RVTMTRNTSISTAYMELSSLRSEDTAVYYCAS | SSGWY--------- | ---------FFDY | WGQGTLVTVSS |
| iPS:4 35353 | 21-225_148F8 | VH1J1-08/D6J6-19/RF1/JH4 | QVQLVQS-GAEVKKPGASVKVSCKASG-YTFT | N------YDIN | WVRQATGQ GLEWMG | WMMPN----SGNTGYAQKFQG | RVTMTRNTSISTAYMELSSLRSEDTAVYYCAS | SSGWY--------- | ---------YFDY | WGQGTLVTVSS |
| iPS:4 35369 | 21-225_149A2 | VH1J1-08/D6J6-19/RF1/JH4 | QVQLVQS-GAEVKKPGASVKVSCKASG-YTFT | N------YDIN | WVRQATGQ GLEWMG | WVHPN----SGNTGYAQKFQG | RVTMTRNTSISTAYMELSSLRSEDTAVYYCAG | SSGWY--------- | ---------YFDY | WGQGTLVTVSS |
| iPS:4 35373 | 21-225_149E3 | VH1J1-08/D6J6-19/RF1/JH4 | QVQLVQS-GAEVKKPGASVKVSCKASG-YTFT | N------YDIN | WVRQATGQ GLEWMG | WMMPN----SGNTDYAQKFQG | RVTMTRNTSITTVYMELSSLTSEDTAVYYCAY | SSGWY--------- | ---------WFDY | WGQGTLVTVSS |
| iPS:4 35375 | 21-225_149H4 | VH1J1-08/D6J6-19/RF1/JH4 | QVQLVQS-GAEVKKPGASVKVSCKASG-YTFT | N------YDIN | WVRQATGQ GLEWMG | WMHFN----SGNTGYAQKFQG | RVTMTRNTSTTVMELSSLRSEDTAVYYCTF | SSGWY--------- | ---------YFDY | WGQGTLVTVSS |
| iPS:4 35399 | 21-225_150D2 | VH1J1-08/D6J6-19/RF1/JH4 | QVQLVQS-GAEVKKPGASVKVSCKASG-YTFT | N------YDIN | WVRQATGQ GLEWMG | WMHPN----SGNTGYAQKFQG | RVTMTRNTSISTAYMELSSLRSEDTAVYYCAY | SSGWY--------- | ---------YFDY | WGQGTLVTVSS |

Figure 51 (Continued)

| | | | | | | | | | |
|---|---|---|---|---|---|---|---|---|---|
| iPS:4 35405 | 21-225_150B7 | VH1j1-08/D6j6-19jRF1/JH4 | QVQLVQS-GAEVKKPGASVTV SCKASG-FPFT | N------YDIN | WVRQATGQ GLEWMG | WMHPN---- SGNTGYAQK FQG | RVTMTRNTSISTAYLELSSL RSEDTAVYYCAS | SSGWY--------- | ------FFDY | WGQGT LVTVS S |
| iPS:4 35433 | 21-225_152E3 | VH1j1-08/D6j6-19jRF1/JH4 | QVQLVQS-GAEVKKPGASVKV SCKASG-YIFT | N------YDIN | WVRQATGQ GLEWMG | WMHPN---- SGNTGYAQK FQG | RVTMTRNTSISTAYMELSSL RSEDTAVYYCAS | SSGWY--------- | ------FFDY | WGQGT LVTVS S |
| iPS:4 35435 | 21-225_152H3 | VH1j1-08/D6j6-19jRF1/JH4 | QVQLVQS-GAEVKKPGASVKV SCKASG-YIFP | N------YDIN | WVRQATGQ GLEWMG | WMHPN---- SGNTGYAQK FQG | RVTMTRNTSISTAYMELSSL RSEDTAVYYCAY | SSGWY--------- | ------WFDY | WGQGT LVTVS S |
| iPS:4 35459 | 21-225_152E12 | VH1j1-08/D6j6-19jRF1/JH4 | QVQLVQS-GAEVKKPGASVKV SCKASG-YIFT | N------YDIN | WVRQATGQ GLEWMG | WMNFN---- SGNTGYAQK FQG | RVTMTRNTSISTAYMELSSL RSEDTAVYYCAY | SSGWY--------- | ------YFDY | WGQGT LVTVS S |
| iPS:4 35471 | 21-225_153F11 | VH1j1-08/D6j6-19jRF1/JH4 | QVQLVQS-GAEVKEPGASVKV SCKASG-YIFT | N------YDIN | WVRQATGQ GLEWMG | WMHPN---- SGNTGYAQK FQG | RVTMTRNTSINTAYMELSSL RSEDTAVYYCAY | SSGWY--------- | ------FFDN | WGQGT LVTVS S |
| iPS:4 35475 | 21-225_154H6 | VH1j1-08/D6j6-19jRF1/JH4 | QVQLVQS-GAEVKKPGASVKV SCKASG-YIFT | N------YDIN | WVRQATGQ GLEWMG | WMHPN---- SGNTGYAQK FQG | RVTMTRNTSISTAYMELSSL RSEDTAVYYCAY | SSGWY--------- | ------IFDY | WGQGT LVTVS S |
| iPS:4 35481 | 21-225_154A11 | VH1j1-08/D6j6-19jRF1/JH4 | QVQLVQS-GAEVKKPGASVKV SCKASG-YIFT | N------YDIN | WVRQATGQ GLEWMG | WMNFN---- SGNTGYAQK FQG | RVTMTRNTSISTAYMELSSL RSEDTAVYYCAS | SSGWY--------- | ------YFDY | WGQGT LVTVS S |
| iPS:4 35491 | 21-225_155E5 | VH1j1-08/D6j6-19jRF1/JH4 | QVQLVQS-GAEVKKPGASVKV SCKASG-YIFT | N------YDIN | WVRQATGQ GLEWMG | WMHPN---- SGSTGYAQR FQG | RVTMTRNTSISTAYMELSSL RSEDTAVYYCAF | SSGWY--------- | ------YFDY | WGQGT LVTVS S |
| iPS:4 35495 | 21-225_155B6 | VH1j1-08/D6j6-19jRF1/JH4 | QVQLVQS-GAEVKKPGASVKV SCKASG-YIFT | N------YDIN | WVRQATGQ GLEWMG | WMNPN---- SGNTGYAQK FQG | RVTMTRNTSISTAYMELSSL RSEDTAVYYCAY | SSGWY--------- | ------YFDY | WGQGT LVTVS S |
| iPS:4 35501 | 21-225_156H1 | VH1j1-08/D6j6-19jRF1/JH4 | QVQLVQS-GAEVKKPGASVKV SCKASG-YIFT | N------YDIN | WVRQATGQ GLEWMG | WVHPN---- SGNTGYAQK FQG | RVTMTRNTSISTAYMELSSL RSEDTAVYYCAG | SSGWY--------- | ------YFDY | WGQGT LVTVS S |
| iPS:4 35557 | 21-225_158B12 | VH1j1-08/D6j6-19jRF1/JH4 | QVQLVQS-GAEVKKPGASVKV SCKASG-YIFT | N------YDIN | WVRQATGQ GLEWMG | WMHPN---- SGNTGYAQK FQG | RPTMTRNTSISTAYMELSSL RSEDTAVYYCAY | SSGWY--------- | ------RFDY | WGQGT LVTVS S |
| iPS:4 35589 | 21-225_160A4 | VH1j1-08/D6j6-19jRF1/JH4 | QVQLVQS-GIEVKKPGASVKV SCKASG-YIFT | N------YDIN | WVRQATGQ GPEWMG | WMHPN---- SGNTGYPQK FQG | RVTMTRNTSISTAYMELSSL RSEDTAVYYCAY | SSGWY--------- | ------IFDY | WGQGT LVTVS S |

Figure 51 (Continued)

| | | | | | | | | | |
|---|---|---|---|---|---|---|---|---|---|
| iPS:4 35623 | 21-225_162D5 | VH1J1-08/D6J6-19/RF1/J H4 | QVQLVQS-GSEVKKPGASVKV SCKASG-YTFT | N------YDIN | WVRQATGQ GLEWMG | WMHPN---SGNTGYAQK FQG | RVTMTRNTSIDTAYMELSSL SSEDTAVYFCAF | SSGWY--------- | -------FFDY | WGQGT LVTVS S |
| iPS:4 35627 | 21-225_162F6 | VH1J1-08/D6J6-19/RF1/J H4 | QVQLVQS-GAEVKKPGASVKV SCKASG-YTFT | N------YDIN | WVRQATGQ GLEWMG | WMHPN---SGNTGYAQK FQG | RFTMTRNTSISTAYMELSSL RSEDTAVYYCAY | SSGWY--------- | -------RFDY | WGQGT LVTVS S |
| iPS:4 35649 | 21-225_165H2 | VH1J1-08/D6J6-19/RF1/J H4 | QVQLVQS-GAEVKKPGASVKV SCKASG-YTFT | H------YDIN | WVRQATGQ GLEWVG | WMHPN---SHKTGYAQK FQG | RVTMTRNTSNSTAYMDLSSL RSEDTAVYYCAY | SSGWY--------- | -------MFDY | WGQGT LVTVS S |
| iPS:4 35727 | 21-225_172E11 | VH1J1-08/D6J6-19/RF1/J H4 | QVQLVQS-GAEVKKPGASVMV SCKASG-YTFT | N------YDIN | WVRQATGQ GLEWMG | WMHPN---SGNTGYAQK FQG | RVTMTRNTSISTAYMELSSL RSEDTAVYYCAY | SSGWY--------- | -------RFDY | WGQGT LVTVS S |
| iPS:4 35751 | 21-225_175D10 | VH1J1-08/D6J6-19/RF1/J H4 | QVQLVQS-GAEVKKPGASVKV SCKASG-YTFT | N------YDIN | WVRQATGQ GLEWMG | WMHPN---SGNTGYAQK FQG | RVTMTRNTSSTVYMELSSL RSEDTAVYYCAY | SSGWY--------- | -------YFDY | WGQGT LVTVS S |
| iPS:4 35773 | 21-225_177B12 | VH1J1-08/D6J6-19/RF1/J H4 | QVQLVQS-GAEVKKPGASVKV SCKASG-YTFT | N------YDIN | WVRQATGQ GLEWMG | WMHPN---SGNTGYAQK FQG | RVTMTRNTSISTAYMELSSL RSEDTAVYYCAY | SSGWY--------- | -------YFDF | WGQGT LVTVS S |
| iPS:4 35801 | 21-225_181E5 | VH1J1-08/D6J6-19/RF1/J H4 | QVQLVQS-GAEVKKPGASVKV SCKASG-YTFT | N------YDIN | WVRQATGQ GLEWMG | WMHPN---SGNTGYAQK FQG | RVTMTRNTSISTAYMELSSL RSEDTAVYYCAY | SSGWY--------- | -------IFDY | WGQGT LVTVS S |
| iPS:4 35841 | 21-225_191D8 | VH1J1-08/D6J6-19/RF1/J H4 | QVQLVQS-GAEVKKPGASVKV SCKASG-YTFT | N------YDIN | WVRQATGQ GLEWMG | WMHPN---SGNTGYAQK FQG | RVTMTRNTSISTAYMELSSL RSEDTAVYYCAH | SSGWY--------- | -------YFDY | WGQGT LVTVS S |
| iPS:4 35855 | 21-225_191G3 | VH1J1-08/D6J6-19/RF1/J H4 | QVQLVQS-GAEVKKPGASVKV SCKASG-YTFT | N------YDIN | WVRQATGQ GLEWMG | RMNPN---SGNTGYAQK FQG | RVTMTRNTSISTAYMELSSL RSEDTAVYYCAH | SSGWY--------- | -------IFDY | WGQGT LVTVS S |
| iPS:4 35915 | 21-225_190H4 | VH1J1-08/D6J6-19/RF1/J H4 | QVQLVQS-GAEVKKPGASVKV SCKASG-YTFT | N------YDIN | WVRQATGQ GLEWMG | WMNPN---SGNTGYAQK FQG | RVTMTRNTSISTAYMELSSL RSEDTAVYYCAH | SSGWY--------- | -------IFDY | WGQGT LVTVS S |
| iPS:4 35925 | 21-225_190D7 | VH1J1-08/D6J6-19/RF1/J H4 | QVQLVQS-GAEVKKPGASVKV SCKASG-NIFT | N------YDIN | WVRQATGQ GLEWMG | WMNPN---SGNTGYAQK FQG | RVTMTRNTSISTAYMELSSL RSEDTAVYYCAS | SSGWY--------- | -------FFDY | WGQGT LVTVS S |
| iPS:4 36021 | 21-225_193G4 | VH1J1-08/D6J6-19/RF1/J H4 | QVQLVQS-GAEVKKPGASVKV SCKASG-YTFT | N------YDIN | WVRQATGQ GLEWMG | WMNPN---SGNTGYAQK FQG | RVTMTRNTSIRTAYMELNSL RSEDTAVYYCAS | SSGWY--------- | -------FFDY | WGQGT LVTVS S |

Figure 51 (Continued)

| | | | | | | | | | |
|---|---|---|---|---|---|---|---|---|---|
| iPS:4 36150 | 21-225_197H4 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAH | SSGWY------- | -------YFDY | WGQGTLVTVSS |
| iPS:4 36154 | 21-225_197C6 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAH | SSGWY------- | -------YFDY | WGQGTLVTVSS |
| iPS:4 36272 | 21-225_201F5 | VH1j1-08/D6j6-19jRF1/JH4 | QVQLVQS-GAAVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAY | SSGWY------- | -------YFDY | WGQGTLVTVSS |
| iPS:4 36550 | 21-225_224D8 | VH1j1-08/D6j6-19jRF1/JH4 | QVQLVQS-GAEVKKPGASVKVSCKASG-YTFT | N-----YDIN | WVRQATGQGLEWMG | WLYFN----SGNTGYAQKFQG | RVTMTRNTSISTAYMELSSLRSEDTAVYYCAY | SSGWY------- | -------YFDY | WGQGTLVTVSS |
| iPS:4 36554 | 21-225_224C10 | VH1j1-08/D6j6-19jRF1/JH4 | QVQLVQS-GAEVKKPGASVKVSCKASG-STFT | N-----YDIN | WVRQATGQGLEWMG | WMHPN----SGNTGYAQKFQG | RVTMTRNTSISTAYMELSSLRSEDTAVYYCAY | SSGWY------- | -------KFDY | WGQGTLVTVSS |
| iPS:4 36560 | 21-225_224F11 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAY | SSGWY------- | -------KFDY | WGQGTLVTVSS |
| iPS:4 36574 | 21-225_225F5 | VH1j1-08/D6j6-19jRF1/JH4 | QVQLVQS-GAEVKKPRASVKVSCKASG-HIFT | N-----YDIN | WVRQATGQGLEWMG | WMHFN----SGNTGPAQKFQG | RVTMTRNTSISTAYMELSSLRSEDTAVYYCAY | SSGWY------- | -------RFDY | WGQGTLVTVSS |
| iPS:4 36584 | 21-225_225B9 | VH1j1-08/D6j6-19jRF1/JH4 | QVQLVQS-GTEVKKPGASVKVSCKASG-YTFT | N-----YDIN | WVRQATGQRLEWMG | WMHPN----SGNTGYAQKFRG | RVTMTRNTSINTAYMELNSLRSEDTAVYYCAY | SSGWT------- | -------LFDY | WGQGTLVTVSS |
| iPS:4 36586 | 21-225_225F11 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMARNTSINTAYMELSSLRSEDTAVYYCAY | SSGWY------- | -------RFDY | WGQGTLVTVSS |
| iPS:4 36588 | 21-225_225F12 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAY | SSGWY------- | -------KFDY | WGQGTLVTVSS |
| iPS:4 36590 | 21-225_225H12 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAY | SSGWY------- | -------KFDY | WGQGTLVTVSS |
| iPS:4 36598 | 21-225_226D6 | VH1j1-08/D6j6-19jRF1/JH4 | QVQLVQS-GAEVKKPGASVKVSCKASG-YTFT | N-----YDIN | WVRQATGQGLEWMG | WMHPN----SGNTGYAQKFQG | RVTMTRNTSISTAYMELSSLRSEDTAVYYCAY | SSGWY------- | -------KFDY | WGQGTLVTVSS |

Figure 51 (Continued)

| | | | | | | | | | |
|---|---|---|---|---|---|---|---|---|---|
| iPS:4 36600 | 21-225_226F6 | VH1j1-08/D6j6-19jRF1/J H4 | QVQLVQS-GAEVKKPGASVKV SCKASG-YTFT | N------YDIN | WVRQATGQ GLEWMG | WMHPN----SGNTGYAQK FQG | RVTMTRNTSINTAYMELSSL RSEDTAVYYCAY | SSGWY--------- | --------RFDY | WGQGT LVTVS S |
| iPS:4 36616 | 21-225_226D11 | VH1j1-08/D6j6-19jRF1/J H4 | QVQLVQS-GAEVKKPGASVKV SCRSSG-YIFT | N------YDIN | WVRQATGQ GLEWMG | WMHPN----SGNTGYAQK FQG | RVTMTRNTSTAYMELSSL RSEDTAVYYCAY | SSGWY--------- | --------YFDY | WGQGT LVTVS S |
| iPS:4 36622 | 21-225_226A12 | VH1j1-08/D6j6-19jRF1/J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------- | --------YFDY | WGQGT LVTVS S |
| iPS:4 36636 | 21-225_227E6 | VH1j1-08/D6j6-19jRF1/J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------- | --------KFDY | WGQGT LVTVS S |
| iPS:4 36638 | 21-225_227C7 | VH1j1-08/D6j6-19jRF1/J H4 | QVQLVQS-GAEVKKPGRASVKV SCKASG-HTFT | N------YDIN | WVRQATGQ GLEWMG | WMHPN----SGNTGYAQK FQV | RVTMTRNTSISTAYMELSSL RSEDTAVYYCAY | SSGWY--------- | --------RFDY | WGQGT LVTVS S |
| iPS:4 36646 | 21-225_227D11 | VH1j1-08/D6j6-19jRF1/J H4 | QVQLVQS-GAEVKKPGASVKV SCKASG-YTFT | N------YDIN | WVRQATGQ GLEWMG | WMHPN----SGNTGYAQK FQG | RVTMTRNTSISTAYMELSSL RSEDTAVYYCAY | SSGWY--------- | --------YFDY | WGQGT LVTVS S |
| iPS:4 46086 | 21-225_94D8 | VH1j1-08/D6j6-19jRF1/J H4 | QVQLVQS-GAEVKKPGASVKV SCKTSG-YIFT | N------YDVN | WVRQATGQ GLEWMG | WMHPN----SGNTGYAQK FQG | RVTMTRNTSTAYMEVSSL RSEDTAVYYCAY | SSGWY--------- | --------IFDY | WGQGT LVTVS S |
| iPS:4 51116 | 21-225_164A4 | VH1j1-08/D6j6-19jRF1/J H4 | QVQLVQS-GAEVKKPGASVKV SCKASG-YIFT | N------YDIN | WVRQATGQ GLEWMG | WMHPN----SGNTGYAQK FQG | RVTMTRNTSISTAYMELSSL RSEDTAVYYCAS | SSGWY--------- | --------FFDY | WGQGT LVTVS S |
| iPS:4 51124 | 21-225_74F6 | VH1j1-08/D6j6-19jRF1/J H4 | QVQLVQS-GAEVKKPGASVKV SCKASG-FTFP | N------YDIN | WVRQATGQ GLEWMG | WMHPN----SGNTGYAQK FQG | RVTMTRNTSMSTAYMELSSL RSEDTAVYYCAH | SSGWY--------- | --------FFDY | WGQGT LVTVS S |
| iPS:4 51127 | 21-225_164A7 | VH1j1-08/D6j6-19jRF1/J H4 | QVQLVQS-GAEVKKPGASVKV SCKASG-YIFT | N------YDIN | WVRQATGQ GLEWMG | WMHPN----SGNTGYAQK FQG | RVTMTRNTSINTAYMELSSL RSEDTAVYYCAH | SSGWY--------- | --------LFDY | WGQGT LVTVS S |
| iPS:4 51131 | 21-225_160A7 | VH1j1-08/D6j6-19jRF1/J H4 | QVQLVQS-GAEVKKPGASVKV SCKASG-YIFT | N------YDIN | WVRQATGQ GLEWMG | WMHPN----SGNTGYAQK FQG | RVTMTRNTSISTAYMELSSL RSEDSAVYYCAH | SSGWY--------- | --------YFDY | WGQGT LVTVS S |
| iPS:3 92786 | 21-225_24E1 | VH1j1-08/D6j6-19jRF1/J H4 | QVQLVQS-GAEVKKPGASVKV SCKASG-YIFT | N------YDIN | WVRQATGQ GLEWMG | WMHPN----SGNTGYAQR FQG | RVTMTRNTSTAYMELSSL RSEDTAVYYCAT | SSGWE--------- | --------VFDY | WGQGT LVTVS S |

Figure 51 (Continued)

| | | | | | | | | | |
|---|---|---|---|---|---|---|---|---|---|
| iPS:3 92886 | 21-225_23A12 | VH1j1-08/D6j6-19|RF1/JH4 | QVQLVQS-GAEVKKPGASVKVSCKASG-YFFT | N------YDIN | WVRQATGQ GLEWMG | WMHPN----SGNTGYAQK FQG | RVTMTRNTSINTAYMELSSL RSEDTAVYYCAG | SSGWY--------- | YFDY | WGQGT LVTVS S |
| iPS:3 92928 | 21-225_25A4 | VH1j1-08/D6j6-19|RF1/JH4 | QVLLVQS-GAEVKRPGASVKV SCKASG-YIFT | N------YDIN | WVRQATGQ GLEWMG | WMYPN----SGNTGYAQK FQG | RVTMTRNTSISTAYMELSSL RSEDTAVYYCAS | SSGWY--------- | YFDY | WGQGT LVTVS S |
| iPS:3 92936 | 21-225_28B6 | VH1j1-08/D6j6-19|RF1/JH4 | QVLLVQS-GAEVKRPGASVKV SCKASG-YIFT | N------YDIN | WVRQATGQ GLEWMG | WMHPD----SGNTGYAQK FQG | RVTMTRNTSISTAYMELSSL RSEDTAVYYCAS | SSGWY--------- | YFDY | WGQGT LVTVS S |
| iPS:3 92960 | 21-225_29E6 | VH1j1-08/D6j6-19|RF1/JH4 | QVLLVQS-GAEVKRPGASVKV SCKASG-YIFT | N------YDIN | WVRQAISGQ GLEWMG | WMHFN----SGNTGYAQK FQG | RVTMTRNTSISTAYMELSSL RSEDTAVYYCAS | SSGWY--------- | YFDY | WGQGT LVTVS S |
| iPS:3 92992 | 21-225_26C4 | VH1j1-08/D6j6-19|RF1/JH4 | QVQLVQS-GAEVKKPGASVKV SCKASG-YIFT | N------YDIN | WVRQATGQ GLEWMG | WMNPN----SGNTGYAQR FQG | RVTMTRNTSINTAYMELSSL RSEDTAVYYCAS | SSGWY--------- | YFDY | WGQGT LVTVS S |
| iPS:3 93088 | 21-225_33D1 | VH1j1-08/D6j6-19|RF1/JH4 | QVQLVQS-GPEVKKPGASVKV SCKASG-YIFT | N------YDIN | WVRQATGQ GLEWMG | WMHPN----SGNTGFAQK FRG | RVTMTRNTSISTAYMELSSL RSEDTAVYYCAS | SSGWY--------- | FFDY | WGQGT LVTVS S |
| iPS:3 93144 | 21-225_34D2 | VH1j1-08/D6j6-19|RF1/JH4 | QVQLVQS-GAEVKKPGASVKV SCKASG-YIFT | N------YDIN | WVRQATGQ GLEWVG | WLHFN----SGTTGPAQK FRG | RVTMTRNTSTAYLELSSL RSEDTAVYYCAS | SSGWY--------- | FFDY | WGQGT LVTVS S |
| iPS:3 93368 | 21-225_29H8 | VH1j1-08/D6j6-19|RF1/JH4 | QVQLVQS-GAEVKKPGASVKV SCKASG-YIFT | N------YDIN | WVRQATGQ GLEWMG | WMMPN----SGNTGYAQR FQG | RVTMTRNTSAAYMELSSL RSEDTAVYYCAS | SSGWY--------- | YFDY | WGQGT LVTVS S |
| iPS:3 93942 | 21-225_11E5 | VH1j1-08/D6j6-19|RF1/JH4 | QVQLVQS-GAEVKKPGASVKV SCKASG-YIFT | N------YDIN | WVRQATGQ GLEWMG | WMHPN----SGATGYAQR FQG | RVTMTRNTSISTAYMELSSL RSEDTAVYYCAT | SSGWE--------- | YFDY | WGQGT LVTVS S |
| iPS:3 94085 | 21-225_8B11 | VH1j1-08/D6j6-19|RF1/JH4 | QVQLVQS-GAEVKKPGASVKV SCKASG-YIFT | N------YDIN | WVRQAAGQ GLEWMG | WMHPN----SGNTGYAQK FQG | RVTMTRNTSISTAYMELSSL RSEDTAVYYCAY | SSGWY--------- | FFDY | WGQGT LVTVS S |
| iPS:3 98496 | 21-225_22D2 | VH1j1-08/D6j6-19|RF1/JH4 | QVQLVQS-GAEVKKPGASVKV SCKASG-YIFI | N------YDIN | WVRQATGQ GLEWMG | WMHPD----SGNTGYAQK FQG | RVTMTRNTSISTAYMELSSL RSEDTAVYYCAY | SSGWY--------- | FFDY | WGQGT LVTVS S |
| iPS:3 98522 | 21-225_32A1 | VH1j1-08/D6j6-19|RF1/JH4 | QVQLVQS-GAEVKKPGASVKV SCKASG-YIFT | N------YDIN | WVRQATGQ GLEWMG | WMNPN----SGNTGYAQK FQG | RVTMTRNTSISTAYMELSSL RSEDTAVYYCAS | SSGWY--------- | FFDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 98524 | 21-225_32A5 | VH1\|1-08/D6\|6-19\|RF1/J H4 | QVQLVQS-GAEVKKPGASVKV SCKASG-YTFT | N------YDIN | WVRQATGQ GLEWMG | WMHPN---- SGNTGFAQK FRG | RVTMTRNTSISTAYMELSSL RSEDTAVYYCSS | SSGWY---------FFDY | WGQGT LVTVS S |
| iPS:3 98538 | 21-225_34H7 | VH1\|1-08/D6\|6-19\|RF1/J H4 | QVQLVQS-GAEVKKPGASVKV SCKASG-YTFT | N------YDIN | WVRQATGQ GLEWMG | WMNPN---- SGNTGYAQK FQG | RVTMTRNTSISTAYMELNSL RSEDTAVYYCAS | SSGWY---------FFDY | WGQGT LVTVS S |
| | Germline | VH1\|1-02\|D1\|1-1\|RF1\|JH4 | QVQLVQS-GAEVKKPGASVKV SCKASG-YTFT | G-------YYMH | WVRQAPGQ GLEWMG | WINPNSGGTNFAQK FQG | RVTMTRDTSISTAYMELSSL RSDDTAVYYCAR | DGTS---------SFDY | WGQGT LVTVS S |
| iPS:4 73253 | 21-225_7C3_LC1 | VH1\|1-02\|D1\|1-1\|RF1/JH 4 | QVQLVQS-GAEVKKPGASVKV SCKASG-YTFN | D-------YYLH | WVRQAPGQ GLEWMG | WIHPN---- SGGTNYAQK FQG | RVTMTRDTSISTAYMELSSL RSDDTAVYSCAR | DGTS---------SFDY | WGQGT LVTVS S |
| iPS:4 73254 | 21-225_7C3_LC2 | VH1\|1-02\|D1\|1-1\|RF1/JH 4 | QVQLVQS-GAEVKKPGASVKV SCKASG-YTFN | D-------YYLH | WVRQAPGQ GLEWMG | WIHPN---- SGGTNYAQK FQG | RVTMTRDTSISTAYMELSSL RSDDTAVYSCAR | DGTS---------SFDY | WGQGT LVTVS S |
| iPS:4 73255 | 21-225_9F12_LC1 | VH1\|1-02\|D1\|1-1\|RF1/JH 4 | QVQLVQS-GAEVKKPGASVKV SCKASG-YTFA | D-------YYLH | WVRQAPGQ GLEWMG | WIHPN---- SGGTNFAQK FQG | RVTMTRDTSISTAYLELSSL RSDDTAFYYCAR | DGTS---------SFDY | WGQGT LVTVS S |
| iPS:4 73256 | 21-225_9F12_LC2 | VH1\|1-02\|D1\|1-1\|RF1/JH 4 | QVQLVQS-GAEVKKPGASVKV SCKASG-YTFA | A-------YHMH | WVRQAPGQ GLEWMG | WVHPN---- NNGTNYAQK FQG | RVTMTRDTSISTAYLELSSL RSDDTAFYSCAR | DVTS---------SFDY | WGQGT LVTVS S |
| iPS:4 26108 | 21-225_10G6 | VH1\|1-02\|D1\|1-1\|RF1/JH 4 | QVQLVQS-GAEVKKPGASVKV SCKASG-YTFT | D-------YYLH | WVRQAPGQ GLEWMG | WINPN---- SGGTNFAQK FQD | RVTMTRDTSISTAYMELSSL RSDDTAIYSCAR | DGTS---------SFDY | WGQGT LVTVS S |
| iPS:4 26110 | 21-225_12E9 | VH1\|1-02\|D1\|1-1\|RF1/JH 4 | QVQLVQS-GAEVKKPGASVKV SCKASG-YTFT | D-------YYLH | WVRQAPGQ GLEWMG | WINPN---- RNGTNYAQK FQG | RVTMTRDTSISTAFMELSSL RSDDTAVYYCAR | DGTS---------SFDY | WGQGT LVTVS S |
| iPS:4 53451 | 21-225_52G11 | VH1\|1-02\|D1\|1-1\|RF1/JH 4 | QVQLVQS-GAEVKKPGASVKV SCKASG-YTFT | G-------YYLH | WVRQAPGQ GLEWMG | WINPN---- RNGTNYAQN FQG | RVTMTRDTSISTAFMELSRL RSDDTAVYYCAR | DGTS---------SFDY | WGQGT LVTVS S |
| iPS:4 53453 | 21-225_53F2 | VH1\|1-02\|D1\|1-1\|RF1/JH 4 | QVQLVQS-GAEVKKPGASVKV SCKASG-YTFT | G-------YYLH | WVRQAPGQ GLEWMG | WINPN---- RNGTNYAQN FQG | RVTMTRDTSISTAYMELSRL KSDDTAVYYCAR | DGTS---------SFDY | WGQGT LVTVS S |
| iPS:4 34035 | 21-225_49F10 | VH1\|1-02\|D1\|1-1\|RF1/JH 4 | QVQLVQS-GAEVKKPGASVKV SCKASG-YTFT | G-------YHMH | WVRQAPGQ GLEWMG | WINPN---- NNATNYAQN FQG | RVTLTRDTSISTAYMELSRL RSDDTAVYYCAR | DGTS---------SFDF | WGQGT LVTVS S |

Figure 51 (Continued)

| | | | | | | | | | |
|---|---|---|---|---|---|---|---|---|---|
| iPS:4 34065 | 21-225_50D4 | VH1|1-02/D1|1-1|RF1/JH4 | QVQLVQS-GAEVKKPGASVKVSCKASG-YIFT | G------YHMH | WVRQAPGQGLEWMG | WINPN----NNATNYAQSFQG | RVTLTRDTSISTAYMELSRLRSDDTAVYYCAR | DGTS---------SFDF | WGQGTLVTVSS |
| iPS:4 34069 | 21-225_51E9 | VH1|1-02/D1|1-1|RF1/JH4 | QVQLVQS-GAEVKKPGASVKVSCKASR-YIFT | G------YHIH | WVRQAPGQGLEWMG | WINPN----TNGTQYAQKFQG | RVTMTRDTSISTAYMELSRLRSDDTAVYYCAR | DGTS---------SFDY | WGQGTLVTVSS |
| iPS:4 34079 | 21-225_52B1 | VH1|1-02/D1|1-1|RF1/JH4 | QVQLVQS-GAEVKKPGASVKVSCKASG-YIFT | G------YHMQ | WVRQAPGQGLEWMG | WINPN----SGATNYAQRFQG | RVTMTRDTSISTAYLDLSRLRSDDTAVYYCAR | DGTS---------SFDY | WGQGTLVTVSS |
| iPS:4 34097 | 21-225_52H10 | VH1|1-02/D1|1-1|RF1/JH4 | QVQLVQS-GAEVKKPGASVKVSCKASG-YIFT | G------YHMQ | WVRQAPGQGLEWMG | WINPN----NGGTNYAQKFQG | RVTMTRDTSISTAYMELSRLRSDDTAVYYCAR | DGTS---------SFDY | WGQGTLVTVSS |
| iPS:4 34123 | 21-225_53F7 | VH1|1-02/D1|1-1|RF1/JH4 | QVQLVQS-GAEVKKPGASVKVSCKASG-YIFT | G------YHMH | WVRQAPGQGLEWMG | WINPN----NNGTNYAQKFQG | RVTMTRDTSINTAYMELNRLTSGDTAVYYCAR | DGTS---------SFDY | WGQGTLVTVSS |
| iPS:4 34189 | 21-225_56E5 | VH1|1-02/D1|1-1|RF1/JH4 | QVQLVQS-GAEVKKPGASVKVSCQASG-YIFT | G------YHMH | WVRQAPGQGLEWMG | WINPN----NNATNYAQSFQG | RVTMTRDTSISTAYMELRRLRSDDTAVYYCAR | DGTS---------SFDY | WGQGTLVTVSS |
| iPS:4 35677 | 21-225_169C10 | VH1|1-02/D1|1-1|RF1/JH4 | QVQLVQS-GAEVKKPGASVRVSCKASG-YIFT | G------YFMH | WVRQAPGQGLEWMG | WIKFK----SGGTNSAQRFQG | RVTMTRDTSINTAYMELNRLRSDDTAVYYCAR | GGTTVAT------WGVFDY | WGQGTLVTVSS |
| iPS:4 35699 | 21-225_170D6 | VH1|1-02/D1|1-1|RF1/JH4 | QVQLVQS-GAEVKKPGASVKVSCKASG-YIFT | G------YFIH | WVRQAPGQGLEWMG | WIKPN----SGGTNSAQRFQG | RVTMTRDTSINTAYMELNRLRSDDTAVYYCAR | GGTTVAT------WGVFDY | WGQGTLVTVSS |
| iPS:4 35797 | 21-225_181G2 | VH1|1-02/D1|1-1|RF1/JH4 | QVQLVQS-GAEVKTPGASVKVSCRASG-YIFT | S------YNMH | WVRQVPGQGLEWMG | WINPN----NGGSNYTQKFQG | RVTMTRDTSISTAYMELSRLRSDDTAVYYCAR | KF-----------GD | WGQGTLVTVSS |
| iPS:4 35877 | 21-225_184E7 | VH1|1-02/D1|1-1|RF1/JH4 | QVQLVQS-GAEVKKPGASVKVSCKASG-YIFT | S------YNMH | WVRQVPGQGLEWMG | WINPN----NGGSNYTQKFQG | RVTMTRDTSISTAYMELSRLRSDDTAVYYCAR | KF-----------GD | WGQGTLVTVSS |
| iPS:4 35885 | 21-225_185E10 | VH1|1-02/D1|1-1|RF1/JH4 | QVQLVQS-GAEVKTPGASVKVSCRASG-YIFT | S------YNMH | WVRQVPGQGLEWMG | WINPN----NGGSNYTQKFQG | RVTMTRDTSISTAYMELSRLRSDDTAVYYCAR | KF-----------GD | WGQGTLVTVSS |
| iPS:4 35891 | 21-225_188H5 | VH1|1-02/D1|1-1|RF1/JH4 | QVQLVQS-GAEVKTPGASVKVSCRASG-YIFT | S------YNMH | WVRQVPGQGLEWMG | WINPN----SGGSNYTQKFQG | RITMTRDTSISTAYMELSRLRSDDTAVYYCAR | KF-----------GD | WGQGTLVTVSS |

Figure 51 (Continued)

| | | | | | | | | | |
|---|---|---|---|---|---|---|---|---|---|
| iPS:4 35897 | 21-225_188B9 | VH{1}1-02/D{1}1-1|RF1/JH 4 | QVQLVQS-GAEVKTPGASVKV SCRASG-YTFT | S------YNMH | WVRQVPGQ GLEWMG | WINPN---SGGSNYTQK FQG | RVTMTRDTSISTAYMELSRL RSDDTAVYYCAR | KF---------------GD | WGQGT LVTVS S |
| iPS:4 36400 | 21-225_213H7 | VH{1}1-02/D{1}1-1|RF1/JH 4 | QVQLVQS-GAEVKKPGASVKV SCKASG-YIFT | G------YHMH | WVRQAPGQ GLEWMG | WINPK---SDGTNYAQK FQG | RVTMTRDTSISTAYMELSRL RSDDTAVYYCAR | EKPGS----------YYKY | WGQGT LVTVS S |
| iPS:4 36488 | 21-225_221A6 | VH{1}1-02/D{1}1-1|RF1/JH 4 | QVQLVQS-GAEVKKPGASVRV SCKTSG-YTFT | G------YYMH | WVRQAPGQ GLEWMG | WIHPN---SGGTNYAQK FQG | RVTLTRDTSISTAYMDLSRL RSDDTAVYYCAR | DGTS-----------SFDY | WGQGT LVTVS S |
| iPS:4 36494 | 21-225_221F12 | VH{1}1-02/D{1}1-1|RF1/JH 4 | QVQLVQS-GAEVKKPGASVKV SCKTSG-YTFT | G------YYMH | WVRQAPGQ GLEWMG | WIHPN---SGGTNYAQK FQG | RVTLTRDTSISTAYMDLSRL RSDDTAVYYCAR | DGTS-----------SFDY | WGQGT LVTVS S |
| iPS:4 36496 | 21-225_222E1 | VH{1}1-02/D{1}1-1|RF1/JH 4 | QVQLVQS-GAEVKKPGASVKV SCKTSG-YTFT | G------YYMH | WVRQAPGQ GLEWMG | WIHPN---SGGTNYAQK FQG | RVTLTRDTSISTAYMDLSRL RSDDTAVYYCAR | DGTS-----------SFDY | WGQGT LVTVS S |
| iPS:4 36508 | 21-225_222F7 | VH{1}1-02/D{1}1-1|RF1/JH 4 | QVQLVQS-GAEVKKPGASVKV SCKTSG-YTFT | G------YYMH | WVRQAPGQ GLEWMG | WIHPN---SGGTNYAQK FQG | RVTLTRDTSISTAYMDLSRL RSDDTAVYYCAR | DGTS-----------SFDY | WGQGT LVTVS S |
| iPS:4 36516 | 21-225_222C12 | VH{1}1-02/D{1}1-1|RF1/JH 4 | QVQLVQS-GAEVKKPGASVKV SCKTSG-YTFT | G------YYMH | WVRQAPGQ GLEWMG | WIKPK---SGGTNSAQR FQG | RVTLTRDTSISTAYMELNRL RSDDTAVYYCAR | GGTTVAT--------SFDY | WGQGT LVTVS S |
| iPS:4 37264 | 21-225_171H12 | VH{1}1-02/D{1}1-1|RF1/JH 4 | QVQLVQS-GAEVKKPGASVRV SCKASG-YTFT | G------YFMH | WVRQAPGQ GLDWMG | WIKPK---SGGTNSAQR FQG | RVTMTRDTSINTAYMELNRL RSDDTAVYYCAR | GGTTVAT--------WGVFDY | WGQGT LVTVS S |
| iPS:4 37266 | 21-225_177A5 | VH{1}1-02/D{1}1-1|RF1/JH 4 | QVQLVQS-GAEVKKPGASVKV SCKASG-YTFT | G------YPMH | WVRQAPGQ GLEWMG | WINPN---SGGTNSAQR FQG | RVTMTRDTSINTAYMELNWL RSDDTAVYYCAR | GGTTVAT--------WGVFDY | WGQGT LVTVS S |
| iPS:3 93080 | 21-225_34F3 | VH{1}1-02/D{1}1-1|RF1/JH 4 | QVQLVQS-GAEVKKPGASVKV SCKASG-YIFT | G------YHMH | WVRQAPGQ GLDWMG | WINPN---SGGTNYAQK FQG | RVTMTRDTSISTAYMELSRL RSDDTAVYYCAR | DGTS-----------SFDY | WGQGT LVTVS S |
| iPS:3 93084 | 21-225_35C6 | VH{1}1-02/D{1}1-1|RF1/JH 4 | QVQLVQS-GTEVKKPGASVKV SCKASG-YIFT | G------DYMH | WVRQAPGQ GLEWMG | WISPK---NGGTNYAQK FQG | RVTMTRDTSISTAYMELNRL RSDDTAVYYCAR | DGTG-----------SFDY | WGQGT LVTVS S |
| iPS:3 93086 | 21-225_36H5 | VH{1}1-02/D{1}1-1|RF1/JH 4 | QVQLVQS-GAEVKKPGASMKV SCKASG-YTFT | D------YHMH | WVRQAPGQ GLEWMG | WINPN---RGGTNYAQK FQD | RVTMTRDTSISTAYMELSRL RSDDTAVYFCAR | DGTG-----------SFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93098 | 21-225_35G6 | VH1|1-02/D1|1-1|RF1/JH4 | QVQLVQS-GADVKKPGASVKVSCKASG-YTFT | D------YHIH | WVRQAPGQGLEWMG | WINPN---NGGTHYAQEFQG | RVTMTRDTSISTAYMELSSLRSDDTAVYYCAR | DGTG--------SFDY | WGQGTLVTVSS |
| iPS:3 93112 | 21-225_33G1 | VH1|1-02/D1|1-1|RF1/JH4 | QVQLAQS-GAEVKKPGASVKVSCKASG-YTFT | G------YYMH | WVRQAPGQGLEWMG | WISPN---NGGTNYAQKFQG | RVTMTRDTSISTAYMELSRLRSDDTAVYYCAR | DGTG--------SFDY | WGQGTLVTVSS |
| iPS:3 93116 | 21-225_34G7 | VH1|1-02/D1|1-1|RF1/JH4 | QVQLVQS-GAEVKKPGASVKVSCRASG-YTFT | D------YHIH | WVRQAPGQGLEWMG | WINPN---NGGTHYAQKFQG | RVTMTRDTSISTAYMELSRLRSDDTAVYYCAR | DGTG--------SFDY | WGQGNLVTVSS |
| iPS:3 93132 | 21-225_33H7 | VH1|1-02/D1|1-1|RF1/JH4 | QVQLVQS-GADVKKPGASVKVSCKASG-YTFT | D------YHIH | WVRQAPGQGLEWMG | WINPN---NGGTHYAQEFQG | RVTMTRDTSISTAYMELSSLRSDDTAVYHCAR | DGTG--------SFDY | WGQGTLVTVSS |
| iPS:3 93140 | 21-225_35H12 | VH1|1-02/D1|1-1|RF1/JH4 | QVQLVQS-GAEVKKPGASVKVSCKASG-YTFT | D------YYIH | WVRQAPGQGLEWMG | WINPN---RGGTNYAQKFQG | RVTMTRDTSISTAYMELSRLRSDDTAVYYCAR | DGTG--------SFDY | WGQGTLVTVSS |
| iPS:3 93954 | 21-225_4H6 | VH1|1-02/D1|1-1|RF1/JH4 | QVQLVQS-GAEVKKPGASVKVSCKASG-YTFT | D------YYLH | WVRQAPGQGLEWMG | WIHPN---SGGTNYAQKFQG | RVTMTRDTSISTAYMGLSSLRSDDTAVYYCAR | DGTS--------SFDY | WGQGTLVTVSS |
| iPS:3 98484 | 21-225_18D4 | VH1|1-02/D1|1-1|RF1/JH4 | QVQLVQS-GAEVKKPGASVKVSCKASG-YTFT | G------YYLH | WVRQAPGQGLEWLG | WINPN---SNGTISAQKFQG | RVTMTRDTSISTAYMELSRLISDDTAVYYCAR | DGTS--------SLDY | WGQGTLVTVSS |
| iPS:3 98502 | 21-225_23B11 | VH1|1-02/D1|1-1|RF1/JH4 | QVQLVQS-GAEVKKPGASVKVSCKASG-YTFT | G------YYLH | WVRQAPGQGLEWMG | WINPN---NRGTNYAQKFQG | RVTMTRDTSISTAYMELSRLRSDDTAVYYCAR | DGTS--------SFDY | WGQGTLVTVSS |
| iPS:3 98520 | 21-225_31C4 | VH1|1-02/D1|1-1|RF1/JH4 | QVQLVQS-GTEVKKPGASVKVSCKASG-YTFT | G------DYMH | WVRQAPGQGLEWMG | WISPK---NGGTNYAQKFQG | RVTMTRDTSISTVYMELNRLRSDDTAVYYCAR | DGTG--------SFDY | WGQGTLVTVSS |
| iPS:4 02223 | 21-225_30A11 | VH1|1-02/D1|1-1|RF1/JH4 | QVQLVQS-GAEVKKPGASVKVSCKASG-YTFT | D------YHMH | WVRQAPGQGLEWMG | WINPN---RGGTNYAQKFQD | RVTMTRDTSISTAYMELSRLRSDDTAVYFCAR | DGTG--------SFDY | WGQGTLVTVSS |
| VH3|3-33|D3|6-6|RF1/JH6 | | Germline | QVQLVES-GGGVVQPGRSLRLSCAASG-FTFS | | | | | | |
| iPS:4 26114 | 21-225_28H2 | VH3|3-33/D6|6-6|RF1/JH6 | QVQLVES-GGGVVQPGRSLRLSCAASG-FTFS | N------YVMH | WVRQAPGKGLEWVA | VIWYD---GSNKYYADSVKG | RFTISRDNSKNTLYLQMNSLRAVDIAVYYCAR | EEYSSGW---YDYGMDV | WGQGTTVTVSS |

Figure 51 (Continued)

| | | | | | | | | | | | |
|---|---|---|---|---|---|---|---|---|---|---|---|
| iPS:4 26116 | 21-225_29E2 | VH33-33\|D6\|6-6\|RF1/JH6 | QVQLVES-GGGVVQPGRSLRLSCAASG-FTFS | N------CVMH | | WVRQAPGK GLEWVA | VIWYD----GSNKYYADS VKG | RITISRDNSKNTLYLQMNSL RAEDTAVYYCAR | EEYSSGW---- | ----YDYGMDV | WGQGT TVTVS S |
| iPS:4 68812 | 21-225_48H4 | VH3\|3-33\|D6\|6-6\|RF1/JH6 | QVQLVES-GGGVVQPGRSLRLSCAASG-FTFS | D------SLMH | | WVRQAPGK GLEWVA | VIWYD----GSNKYYTDS VKG | RFTISRDNSKNTLYLQMNSL RAEDTAVYYCAR | ENYSSGW---- | ----YGYGMDV | WGQGT TVTVS S |
| iPS:4 68816 | 21-225_52G8 | VH3\|3-33\|D6\|6-6\|RF1/JH6 | QVQLVES-GGGVVQPGRSLRLSCAASG-FTFS | S------YGMH | | WVRQAPGK GLEWVA | VIWYD----GSNKYYADS VKG | RFTISRDNSKNTLYLQMNSL RAEDTALYYCAR | RYSSSW----- | -----SGGMDV | WGQGT TVTVS S |
| iPS:4 68826 | 21-225_201C5 | VH3\|3-33\|D6\|6-6\|RF1/JH6 | QVQLVES-GGGVVQPGRSLRLSCAASG-FTFS | D------YVMH | | WVRQAPGK GLEWVA | VIWYD----GSNKYYVDS VKG | RFTISRDNSKNTLYLQMNSL RAEDTAVYYCAR | ERYSSGL---- | ----YDYGMDV | WGQGT TVTVS S |
| iPS:4 68842 | 21-225_50H4 | VH3\|3-33\|D6\|6-6\|RF1/JH6 | QVQLVES-GGGVVQPGRSLRLSCAASG-FTFS | S------YVMH | | WVRQAPGK GLEWVA | AIWYD----GSNKYYADS VKG | RFTISRDNSKNTLDLQMNSL RAEDTAVYYCAR | ELYSSNW---- | ----YDYGMDV | WGQGT TVTVS S |
| iPS:4 68858 | 21-225_148C9 | VH3\|3-33\|D6\|6-6\|RF1/JH6 | QVQLVES-GGGVVQPGRSLRLSCAASG-FTFS | D------YGMH | | WVRQAPGK GLEWVA | VIWYD----GSNKYYADS VKG | RLTISRDNSKNTLYLQMNSL RAEDTAVYYCAR | ERYSSGW---- | ----YDYGLDV | WGQGT TVTVS S |
| iPS:4 68860 | 21-225_224E7 | VH3\|3-33\|D6\|6-6\|RF1/JH6 | QVQLVES-GGGVAQPGRSLSLSCAASG-FTFS | S------YVMH | | WVRQAPGK GLEWVA | VIWYD----GSNKYYADS VKG | RFTISRDNSKNTLYLQMNSL RAEDTAVYYCAR | EQYSSSW---- | ----YDFGLDV | WGQGT TVTVS S |
| iPS:4 33917 | 21-225_43E11 | VH3\|3-33\|D6\|6-6\|RF1/JH6 | QVQLVES-GGGVVQPGRSLRLSCTASG-FSFS | D------YGMH | | WVRQAPGK GLEWVA | VIWYD----GSNKYYADS VKG | RLTISRDNSKNTLYLQMNSL RAEDTAVYYCAR | RYVRSW----- | -----VGGMDV | WGQGT TVTVS S |
| iPS:4 33919 | 21-225_44B3 | VH3\|3-33\|D6\|6-6\|RF1/JH6 | QVQLVES-GGGVVQPGRSLRLSCAASG-FTFS | D------YGMH | | WVRQAPGK GLEWVA | VIWYD----GSNKYYADS VKG | RFTISRDNSKNTLYLQMNSL RAEDTAVYYCAR | ERYSSGW---- | ----YDYGMDV | WGQGT TVTVS S |
| iPS:4 33923 | 21-225_44D3 | VH3\|3-33\|D6\|6-6\|RF1/JH6 | QVQLVES-GGGVVQPGRSLRLSCAASG-FTFS | S------YVMH | | WVRQAPGK GLEWVA | VIWYD----GSNKYYADS VKG | RFTISRDNSKNTLYLQMNSL RAEDTAVYYCAR | ERYSSGL---- | ----YDYGMDV | WGQGT TVTVS S |
| iPS:4 33929 | 21-225_44D5 | VH3\|3-33\|D6\|6-6\|RF1/JH6 | QVQLVES-GGGVVQPGRSLRLSCAASG-FTFS | S------YVMH | | WVRQAPGK GLEWVA | VIWYD----GSNKYYADS VKG | RPTISRDNSKNTLYLQMNSL RAEDTAVYYCAR | VPYSSSW---- | ----YDYGMDV | WGQGT TVTVS S |
| iPS:4 33935 | 21-225_44F9 | VH3\|3-33\|D6\|6-6\|RF1/JH6 | QVQLVES-GGGVVQPGRSLRLSCAASG-FTFS | S------YVMH | | WVRQAPGK GLEWVA | VIWYD----GSNKYYADS VKG | RFTISRDNSKNTLYLQMNSL RAEDTAVYYCAR | EPYSSSW---- | ----YDYGMDV | GGQGT TVTVS S |

Figure 51 (Continued)

| | | | | | | | | | |
|---|---|---|---|---|---|---|---|---|---|
| iPS:4 33937 | 21-225_44B10 | VH3|3-33|D6|6-6|RF1|JH6 | QVQLVES-GGGVVQPGRSLRlSCVASG-FTFS | S------YGMH | WVRQAPGK GLEWVA | VIWYD---GSNKYYADS VKG | RFTISRDNSKNTLYLQMNSL RAEDTAVYYCAR | RYSSSW------ ------VGGMDV | WGQGT TVTVS S |
| iPS:4 33339 | 21-225_44C10 | VH3|3-33|D6|6-6|RF1|JH6 | QVQLVES-GGGVVQPGRSLRlSCAASG-FTFS | D------CVMH | WVRQAPGK GLEWVA | VIWYD---GSNKYYADS VKG | RFTISRDNSKNTLYLQMNSL RAEDTAVYYCAR | ERYSSGL------ ------YDYGMDV | WGQGT TVTVS S |
| iPS:4 33951 | 21-225_45B4 | VH3|3-33|D6|6-6|RF1|JH6 | QVQLVES-GGGVVQPGRSLRlSCAASG-FTFS | D------CVMH | WVRQAPGK GLEWVA | VIWYD---GSNKYYADS VKG | RFTISRDNSKNTLYLQMNSL RAEDTAVYYCAR | ERYSSGL------ ------YDYGMDV | WGQGT TVTVS S |
| iPS:4 33955 | 21-225_45B8 | VH3|3-33|D6|6-6|RF1|JH6 | QVQLVES-GGGVVQPGRSLRlSCAASG-FTFS | D------CVMH | WVRQAPGK GLEWVA | VIWYD---GSNKYYADS VKG | RFTISRDNSKNTLYLQMNSL RAEDTAVYYCAR | ERYSSGL------ ------YDYGMDV | WGQGT TVTVS S |
| iPS:4 33967 | 21-225_46C3 | VH3|3-33|D6|6-6|RF1|JH6 | QVQLVES-GGGVVQPGRSLRlSCAASG-FTFS | S------YVMH | WVRQAPGK GLEWVA | VIWYD---GSNKYYADS VKG | RFTISRDNSKNTLYLQMNSL RAEDTAVYYCAR | ERYSSGL------ ------YDYGMDV | WGQGT TVTVS S |
| iPS:4 33971 | 21-225_46D4 | VH3|3-33|D6|6-6|RF1|JH6 | QVQLVES-GGGVVQPGRSLRlSCAASG-FTFS | S------YVMH | WVRQAPGK GLEWVA | VIWYD---GSNKYYADS VKG | RFTISRDNSKNTLYLQMNSL RAEDTAVYYCAR | VPYSSSW------ ------YDYGMDV | WGQGT TVTVS S |
| iPS:4 33979 | 21-225_46B9 | VH3|3-33|D6|6-6|RF1|JH6 | QVQLVES-GGGVVQPGRSLRlSCAASG-FTFS | S------YGMH | WVRQAPGK GLEWVA | VIWYD---GSNKYYADS VKG | RITISRDNSKNTLYLQMNSL RAEDTAVYYCAR | RYSSSW------ ------MGGMDV | WGQGT TVTVS S |
| iPS:4 33985 | 21-225_47C1 | VH3|3-33|D6|6-6|RF1|JH6 | QVQLVES-GGGVVQPGRSLRlSCAASG-FTFS | D------YGMH | WVRQTPGK GLEWVA | VIWYD---GSNKYYADS VKG | RFTISRDNSKNTLFLQMNSL RDEDTAVYYCAR | RYSRSW------ ------VGGMDV | WGQGT TVTVS S |
| iPS:4 33991 | 21-225_47E7 | VH3|3-33|D6|6-6|RF1|JH6 | QVQLVES-GGGVVQPGRSLRlSCAASG-FTFS | I------YGMH | WVRQAPGK GLEWVA | VIWYD---GSNKYYADS VKG | RFTISRDNSKNTLYLQMNSL RAEDTAVYYCAR | RISRSW------ ------VGGMDV | WGQGT TVTVS S |
| iPS:4 34001 | 21-225_48F2 | VH3|3-33|D6|6-6|RF1|JH6 | QVQLVES-GGGVVQPGRSLRlSCAASG-FTFS | N------YVMH | WVRQAPGK GLEWVA | VIWYD---GSNKYYADS VKG | RFTISRDNSKNTLYLQMNSL RAEDTAVYYCAR | ERYSSW------ ------YDYGLDV | WGQGT TVTVS S |
| iPS:4 34021 | 21-225_49C1 | VH3|3-33|D6|6-6|RF1|JH6 | QVQLVES-GGGVVQPGRSLRlSCTASG-FTFS | S------YGMH | WVRQAPGK GLEWVA | VIWYD---GSNKYYADS VKG | RFTISRDNSKNTLYLQMNSL RAEDTAVYYCAR | RYSSW------- ------SGGMDV | WGQGT TVTVS S |
| iPS:4 34025 | 21-225_49G3 | VH3|3-33|D6|6-6|RF1|JH6 | QVQLVES-GGGVVQPGRSLRlSCAASG-FTFS | S------YGMH | WVRQAPGK GLEWVA | VIWYD---GSNKYYADS VKG | RFTISRDNSKNTLYLQMNSL RAEDTAVYYCAR | RYSSSW------ ------SGGMDV | WGQGT TVTVS S |

Figure 51 (Continued)

| | | | | | | | | |
|---|---|---|---|---|---|---|---|---|
| iPS:4 34031 | 21-225_49E7 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTALYYCAR | RYSSSW-------SGGMDV | WGQGTTVTVSS |
| iPS:4 34033 | 21-225_49F9 | VH3/3-33/D6/6-6/RF1/JH6 | QVQLVES-GGGVVQPGRSLRLSCAASG-FTFS | S------YGMH | WVRQAPGKGLEWVA | LIWYD----GRNKYYADSVKG | RFTISRDNPKNTLYLQMNSLRAEDTAVYHCAR | RYSSSW-------SGGMDV | WGQGTTVTVSS |
| iPS:4 34053 | 21-225_51E1 | VH3/3-33/D6/6-6/RF1/JH6 | QVQLVES-GGGVVQPGRSLRLSCAASG-FTFS | S------YGMH | WVRQAPGKGLEWVA | VIWYD----GSSKYYADSVKG | RFTISRDNSKNTLYLQMNSLRAEDTAVYYCAR | RYSSSW-------SGGMDV | WGQGTTVTVSS |
| iPS:4 34093 | 21-225_52D10 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYHADSVKG | RFTISRDNSKNTLYLQMNSLRAEDTAVYYCAR | RYSSSW-------SGGMDV | WGQGTTVTVSS |
| iPS:4 34137 | 21-225_54D4 | VH3/3-33/D6/6-6/RF1/JH6 | QVQLVES-GGGVVQPGRSLRLSCAASG-FTFS | S------YGMH | WVRQAPGKGLEWVA | LIWYD----GSNKYYADSVKG | RFTISRDNSKNTLYLQMNSLRAEDTAVYYCAR | RYSSSW-------SGGMDV | WGQGTTVTVSS |
| iPS:4 34149 | 21-225_55H1 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | RYSSSW-------SGGMDV | WGQGTTVTVSS |
| iPS:4 34151 | 21-225_55C2 | VH3/3-33/D6/6-6/RF1/JH6 | QVQLVES-GGGVVQPGRSLRLSCAASG-FTFS | S------YGMH | WVRQAPGKGLEWVA | LIWYD----GSNKYHADSVKG | RFTISRDNSKNTLYLQMNSLRAEDTAVYYCAR | RYSSSW-------SGGMDV | WGQGTTVTVSS |
| iPS:4 34161 | 21-225_55F9 | VH3/3-33/D6/6-6/RF1/JH6 | QVQLVES-GGGVVQPGRSLRLSCAASG-FTFS | S------YGMH | WVRQAPGKGLEWVA | VIWYD----GNGKYYADSVKG | RFTISRDNSKNTLYLQMNSLRAEDTAVYYCAR | RYSSSW-------SGGMDV | WGQGTTVTVSS |
| iPS:4 34201 | 21-225_59A12 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | RYSSSW-------DGGMDV | WGQGTTVTVSS |
| iPS:4 34205 | 21-225_60G2 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | RYSRSW-------TGGMDV | WGQGTTVTVSS |
| iPS:4 34223 | 21-225_60C12 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | RYSRSW-------TGGMDV | WGQGTTVTVSS |
| iPS:4 34231 | 21-225_61F2 | VH3/3-33/D6/6-6/RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | ERYSSGW------YDYGMDV | WGQGTTVTVSS |

Figure 51 (Continued)

| | | | | | | | | |
|---|---|---|---|---|---|---|---|---|
| iPS:4 34233 | 21-225_61B3 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSRSW--------AGGMDV | WGQGT TVTVS S |
| iPS:4 34303 | 21-225_58H11 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYHADS VKG | RFTISRDNSKNTLYLQMNSL RAEDTAVYYCAR | RYSSSW--------DGGMDV | WGQGT TVTVS S |
| iPS:4 34339 | 21-225_64A4 | VH3j3-33\|D6\|6-6\|RF1\|JH6 | QVQLVES-GGGVVQPGRSLRL SCAASG-FTFS | D------YVMH | WVRQAPGK GLEWVA | VIWYD---- GSNKYYADS VKG | RFTISRDNSQNTLYLQMNSL RAEDTAVYYCAR | ERYSSW--------YDYGMDV | WGQGT TVTVS S |
| iPS:4 34343 | 21-225_64C8 | VH3j3-33\|D6\|6-6\|RF1\|JH6 | QVQLVES-GGGVVQPGRSLRL SCAASG-FTFS | D------YVMH | WVRQAPGK GLEWVA | VIWYD---- GSNKYYADS MKG | RFTISRDNSKNTLYLQMNSL RAEDTAVYYCAR | ERYSSGW--------YDYGMDV | WGQGT TVTVS S |
| iPS:4 34387 | 21-225_66D11 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYADS VKG | RFTISRDNSKNTLSLQMNSL RAEDTAVYYCAR | EMYSSNM--------YDYGLDV | WGQGT TVTVS S |
| iPS:4 34469 | 21-225_73C9 | VH3j3-33\|D6\|6-6\|RF1\|JH6 | QVQLVES-GGGVVQPGRSLRL SCAASG-FTFS | N------YVMH | WVRQAPGK GLEWVA | VIWYD---- GSNKYYADS VKG | RFTISRDNSKNTLYLQMNSL RAEDTALYYCAR | ERYSSW--------FDYGMDV | WGQGT TVTVS S |
| iPS:4 35197 | 21-225_94F3 | VH3j3-33\|D6\|6-6\|RF1\|JH6 | QVQLVES-GGGVVQPGRSLRL SCAASG-FTFS | N------DIMH | WVRQAPGK GLEWVA | VIWYD---- GSNKYYADS VKG | RFTISRDNSKNTLYLQINSL RAEDTAVFCAR | EKIYSSGW--------YDYGMDV | WGQGT TVTVS S |
| iPS:4 35315 | 21-225_147B2 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW--------SGGMDV | WGQGT TVTVS S |
| iPS:4 35325 | 21-225_147H5 | VH3j3-33\|D6\|6-6\|RF1\|JH6 | QVQLVES-GGGVVAQPGRSLRL SCAASG-FTFS | D------YGMH | WVRQAPGK GLEWVA | VIWYD---- GSNKYYADS VKG | RFTISRDNSKNTLYLQMNSL SAEDTAVYYCAR | ERYSSGW--------YDYGMDV | WGQGT TVTVS S |
| iPS:4 35329 | 21-225_147A8 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW--------TGGMDV | WGQGT TVTVS S |
| iPS:4 35349 | 21-225_148F5 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYADS VKG | RFTISRDNSKNTLYLQMNSL RAEDTAVYYCAR | RYSSSW--------SGGMDV | WGQGT TVTVS S |
| iPS:4 35359 | 21-225_148H10 | VH3j3-33\|D6\|6-6\|RF1\|JH6 | QVQLVES-GGGVVQPGRSLRL SCAASG-FTFS | S------YGMH | WVRQAPGK GLEWVA | VIWYD---- GSNKYYGDS VKG | RFTISRDNSKNTLYLQMNSL RAEDTAVYYCAR | RYSSSW--------SGGMDV | WGQGT TVTVS S |

Figure 51 (Continued)

| | | | | | | | | |
|---|---|---|---|---|---|---|---|---|
| iPS:4 35393 | 21-225_149D10 | VH3/3-33|D6|6-6|RF1|JH6 | QVQLVES-GGGVAQPGRSLRLSCAASG-FTFS | D------YGMH | WVRQAPGK GLEWVA | VIWYD----GSNKYYADSVKG | RFTISRDNSKNTLYLQMNSL RAEDTAVYYCAR | ERYSSGW------YDYGMDV | WGQGT TVTVS S |
| iPS:4 35401 | 21-225_150E2 | VH3/3-33|D6|6-6|RF1|JH6 | QVQLVES-GGGVVQPGRSLRLSCAASG-FTFS | S------YVMH | WVRQAPGK GLEWVA | VIWYD----GSNKYYADSVKG | RFTISRDNSKNTLYLQMNSL RAEDTAVYYCAR | EEYSSSW------YGYGMDV | WGQGT TVTVS S |
| iPS:4 35417 | 21-225_150D11 | VH3/3-33|D6|6-6|RF1|JH6 | QVQLVES-GGGVVQPGRSLRLSCAASG-FTFS | S------YGMH | WVQAPGK GLEWVA | VIFYD----GSNKYYADSVKG | RPTISRDNSKNTLYLQMNSL RAEDSAVYYCTR | RFSSW---------SGGMDV | WGQGT TVTVS S |
| iPS:4 35445 | 21-225_152F7 | VH3/3-33|D6|6-6|RF1|JH6 | QVQLVES-GGGVVQPGRSLRLSCAASG-FTFS | S------YIMH | WVRQAPGK GLEWVA | VIWYD----GSNKYYADSVKG | RFTISRDNSKNTLYLQMNSL RAEDTAVYYCAR | EEYSSSW------YGYGMDV | WGQGT TVTVS S |
| iPS:4 35469 | 21-225_153G9 | VH3/3-33|D6|6-6|RF1|JH6 | QVQLVES-GGGVVQPGRSLRLSCAASG-FTFS | S------YGMH | WVRQAPGK GLEWVA | LIFYD----GSNKYYADSVKG | RFTISRDNSKNTLYLQINSL RAEDTAVYFCAR | RYSRSW-------AGGMDV | WGQGT AVTVS S |
| iPS:4 35573 | 21-225_159D8 | VH3/3-33|D6|6-6|RF1|JH6 | QVQLVES-GGGVVQPGRSLRLSCAASG-FTFS | N------YVMH | CVRQAPGK GLEWVA | VIWYD----GSNKYYADSVKG | RFTISRDNSKNTLYLQMNSL RAEDTAVYYCAR | EPYSSGW------YDYGMDV | WGQGT TVTVS S |
| iPS:4 35681 | 21-225_169D11 | VH3/3-33|D6|6-6|RF1|JH6 | QVQLVES-GGGVVQPGRSLRLSCAASG-FTFS | D------YVMH | WVRQAPGK GLEWVA | VIWYD----GSNKYYADSVKG | RFTISRDNSKNTLYLQINSL RAEDTAVYYCAR | ERYSSGW------YDYGMDV | WGQGT TVTVS S |
| iPS:4 35689 | 21-225_170F3 | VH3/3-33|D6|6-6|RF1|JH6 | QVQLVES-GGGVVQPGRSLRLSCAASG-FSFS | D------YVMH | WVRQAPGK GLEWVA | VIWYD----GSNKYYEDSVKG | RFTISRDNSKNTLYLQMNSL RAEDTAVYYCAR | ETYSSSW------YDYGMDV | WGQGT TVTVS S |
| iPS:4 35733 | 21-225_173C11 | VH3/3-33|D6|6-6|RF1|JH6 | QVQLVES-GGGVVQPGRSLRLSCAASG-FTFS | S------YGIH | WVRQAPGK GLEWVA | LIFYD----GSNKYYADSVKG | RFTISRDNSKNTLYLHMSSL RAEDTAVYYCAR | RYSSSW---------SGGMDV | WGQGT TVTVS S |
| iPS:4 35741 | 21-225_174G10 | VH3/3-33|D6|6-6|RF1|JH6 | QVQLVES-GGGVVQPGRSLRLSCAASG-FTFS | D------YVMH | WVRQAPGK GLEWVA | VIWYD----GSNKYYADSVKG | RFTISRDNSKNTLYLQINSL RAEDTAVYYCAR | ERYSSGW------YDYGMDV | WGQGT TVTVS S |
| iPS:4 35763 | 21-225_176H12 | VH3/3-33|D6|6-6|RF1|JH6 | QVQLVES-GGGVVQPGRSLRLSCAASG-FTFS | D------YVMH | WVRQAPGK GLEWVA | VIWYD----GSNKYYADSVKG | RPTISRDNSKNTLYLQMNSL RAEDTAVYYCAR | EKYSSNW------YDYGMDV | WGQGT TVTVS S |
| iPS:4 35767 | 21-225_177B4 | VH3/3-33|D6|6-6|RF1|JH6 | QVQLVES-GGGVVQPGRSLRLSCAASG-FTFS | D------YVMH | WVRQAPGK GLEWVA | VIWYD----GSNKYYADSVKG | RFVSRDNSKNTLYLQMNSL RAEDTAVYYCAR | EKYSSSW------YDYGLDV | WGQGT TVTVS S |

Figure 51 (Continued)

| | | | | | | | | | |
|---|---|---|---|---|---|---|---|---|---|
| iPS:4 35785 | 21-225_179C2 | VH3 3-33/D6 6-6/RF1/JH 6 | QVQLVES-GGGVVQPGRSLRL SCAASG-FTFS | S-----YGMH | WVRQAPGK GLEWVA | LIFYD----GSNKYYADS VKG | RFTISRDNSKNTLFLQMNSL RAEDTAVYYCAR | RYSGW-----------SGGMDV | WGQGT TVTVS S |
| iPS:4 35921 | 21-225_190D6 | VH3 3-33/D6 6-6/RF1/JH 6 | QVQLVES-GGGVVQPGRSLRL SCAASG-FTFS | S-----FIMH | WVRQAPGK GLEWVA | VIWYD----GSNKYYADS VKG | RFTISRDNSKNTLYLQMNSL RAEDTAVYYCAR | EEYSSGW-----------FGYGMDV | WGQGT TVTVS S |
| iPS:4 35961 | 21-225_192A2 | VH3 3-33/D6 6-6/RF1/JH 6 | QVQLVES-GGGVVQPGRSLRL SCAASG-FTFS | S-----YGMH | WVRQAPGK GLEWLA | VIWYD----GSYKYYADS VKG | RFTISRDNSKNTLYLQMNSL RAEDTAVYYCAR | EDSPYSGYA-----------LDYFYGMDV | WGQGT TVTVS S |
| iPS:4 35985 | 21-225_192F6 | VH3 3-33/D6 6-6/RF1/JH 6 | QVQLVES-GGGVVQPGRSLRL SCAASG-FTFS | S-----FIMH | WVRQAPGK GLEWVA | VIWYD----GSNKYYVDS VKG | RFTISRDNSKNTLYLQMNSL RAEDTAVYYCAR | EEYSSGW-----------FGYGMDV | WGQGT TVTVS S |
| iPS:4 36039 | 21-225_193F8 | VH3 3-33/D6 6-6/RF1/JH 6 | QVQLVES-GGGVVQPGRSLRL SCAASG-FTFS | I-----YGMD | WVRQAPGK GLEWVA | VIWYD----GSYKYYADS VKG | RFTISRDNSKNTLYLQMNSL RAEDTAVYYCVR | EDSPYSGYG-----------LDYYYGMDV | WGQGT TVTVS S |
| iPS:4 36074 | 21-225_194F10 | VH3 3-33/D6 6-6/RF1/JH 6 | QVQLVES-GGGVVQPGRSLRL SCAASG-FTFS | S-----FIMH | WVRQAPGK GLEWVA | VIWYD----GSNKYYADS VKG | RFTISRDNSKNTLYLEMNSL RVEDTAVYYCAR | EEYSSGW-----------FGYGMDV | WGQGT TVTVS S |
| iPS:4 36264 | 21-225_203F7 | VH3 3-33/D6 6-6/RF1/JH 6 | QVQLVES-GGGVVQPGRSLRL SCAASG-FTFS | D-----YVMH | WVRQAPGK GLEWVA | VIWYD----GSNKYYVDS VKG | RFTISRDNSRNTLYLQMNSL RAEDTAVYYCAR | ERYSSGL-----------YDYGMDV | WGQGT TVTVS S |
| iPS:4 36274 | 21-225_204H3 | VH3 3-33/D6 6-6/RF1/JH 6 | QVQLVES-GGGVVQPGRSLRL SCTASG-FTFS | S-----YVMH | WVRQAPGK GLEWVA | VIWYD----GSNKYNADS VKG | RFTISRDNSKNTLYLQMNSL RAEDTAVYYCAR | EPYSSW-----------YDYGMDV | SGQGT TVTVS S |
| iPS:4 36332 | 21-225_208B2 | VH3 3-33/D6 6-6/RF1/JH 6 | QVQLVES-GGGVQPGRSLRL SCAASG-FTFS | D-----CVMH | WVRQAPGK GLEWVA | VIWYD----GSNKYYVDS VKG | RFTISRDNSRNTLYLQMNSL RAEDTAVYYCAR | ERYSSGL-----------YDYGLDV | WGQGT TVTVS S |
| iPS:4 36352 | 21-225_210G5 | VH3 3-33/D6 6-6/RF1/JH 6 | QVQLVES-GGGVVQPGRSLRL SCAASG-FTFS | D-----CVMH | WVRQAPGK GLEWVT | VIWYD----GSNKYYVDS VKG | RFTISRDNSRNTLYLQMNSL RAEDTAVYYCAR | ERYSSGL-----------YDYGLDV | WGQGT TVTVS S |
| iPS:4 36386 | 21-225_212B11 | VH3 3-33/D6 6-6/RF1/JH 6 | QVQLVES-GGGVVQPGRSLRL SCAASG-FTFS | D-----YVMH | WVRQAPGK GLEWVA | VIWYD----GSNKYYVDS VKG | RFTISRDNSKNTLYLQMNSL RAEDTAVYYCAR | ERYSSGW-----------YDYGMDV | WGQGT TVTVS S |
| iPS:4 36412 | 21-225_214H9 | VH3 3-33/D6 6-6/RF1/JH 6 | QVQLVES-GGGVVQPGRSLRL SCAASG-FTFS | S-----YVMH | WVRQAPGK GLEWVA | VIWYD----GSNKYYVDS VKG | RFTISRDNSKNTLYLQMNSL RAEDTAVFYCAR | ERYTSSW-----------YDYGMDV | WGQGT TVTVS S |

Figure 51 (Continued)

| | | | | | | | | |
|---|---|---|---|---|---|---|---|---|
| iPS:4 36414 | 21-225_214G10 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36416 | 21-225_214G12 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36418 | 21-225_215E3 | VH3/3-33/D6|6-6|RF1/JH6 | QVQLVES-GGGVVQPGRSLRLSCAASG-FTFS | D------YVIH | WVRQAPGKGLEWVT | VIWYD----GSNKYYADSVKG | RFTISRDNSKNTLYLQMNSVRAEDTAVYYCAR | ERYSSGW------------YDYGMDV | WGQGTTVTVSS |
| iPS:4 36428 | 21-225_215E11 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36438 | 21-225_216E8 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36440 | 21-225_216H12 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36450 | 21-225_217E5 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36456 | 21-225_217G10 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36458 | 21-225_217H12 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36462 | 21-225_218C4 | VH3/3-33/D6|6-6|RF1/JH6 | QVQLVES-GGGVVQPGRSLRLSCAASG-FTFS | D------YVMH | WVRQAPGKGLEWVT | VIWYD----GSNKYYADSVKG | RFTISRDNSKNTLYLQMNSLRAEDTAVYYCAR | ERYSSGW------------YDYGMDV | WGQGTTVTVSS |
| iPS:4 36480 | 21-225_220F8 | VH3/3-33/D6|6-6|RF1/JH6 | QVQLVES-GGGVVQPGRSLRLSCAASG-FTFS | D------YVMH | WVRQAPGKGLEWVA | VIWYD----GSNKYYADSVKG | RFTISRDNSKNTLYLQMNSLRAEDTAVYYCAR | ERYSSGW------------YDYGMDV | WGQGTTVTVSS |
| iPS:4 36534 | 21-225_224F1 | VH3/3-33/D6|6-6|RF1/JH6 | QVQLVES-GGGVVQPGRSLRLSCAASG-FTFS | S------YIMH | WVRQAPGKGLEWVT | VIWYD----GSNKYYADSVKG | RFTISRDNSKNTLYLQMNSLRAEDTAVYYCAR | ERYSSNW------------YDYGMDV | WGQGTTVTVSS |

Figure 51 (Continued)

| | | | | | | | | | |
|---|---|---|---|---|---|---|---|---|---|
| iPS:4 36540 | 21-225_224F3 | VH3]3-33/D6]6-6]RF1/JH6 | QVQLVES-GGGVVQPGRSLRLSCAASG-FSFS | S------YGMH | WVRQAPGKGLEWVA | VIWYD----GSNKYYADSVKG | RFTISRDNSKNTLYLQMNSLRAEDTAVYYCAR | ERYSSSW------------YDYGMDV | WGQGTTVTVSS |
| iPS:4 36564 | 21-225_225A1 | VH3]3-33/D6]6-6]RF1/JH6 | QVQLVES-GGGVVQPGRSLRLSCAASG-FTFS | D------YVIH | WVRQAPGKGLEWVA | VIWYD----GSNKYYADSVKG | RFTISRDNSKNTLYLQMNSLRAEDTAVYYCAR | ERYSSGW------------YDYGMDV | WGQGTTVTVSS |
| iPS:4 36596 | 21-225_226C6 | VH3]3-33/D6]6-6]RF1/JH6 | QVQLVES-GGGVVQPGRSLRLSCAASG-FTFS | D------YGMH | WVRQAPGKGLEWVA | VIWYD----GSNKYYADSVKG | RFTISRDNSKNTLYLQTNSLRAEDTAVYYCAR | ERYSSSW------------YDYGMDV | WGQGTTVTVSS |
| iPS:4 36620 | 21-225_226H11 | VH3]3-33/D6]6-6]RF1/JH6 | QVQLVES-GGGVVQPGRSLRLSCAASG-FTFS | N------CGMH | WVRQAPGKGLEWVT | VIWYD----GSNKYYADSVKG | RFTISRDNSKNTLYLQMNSLRAEDTAVYYCAR | ELYSSSW------------YDYGLDV | WGQGTTVTVSS |
| iPS:4 36744 | 21-225_154F4 | VH3]3-33/D6]6-6]RF1/JH6 | QVQLVES-GGGVVQPGRSLRLSCAASR-FTFS | S------YGMH | WVRQAPGKGLEWVA | VIWYD----GSNKYYVDSVKG | RFTISRDNSKNTLYLQMNSLRAEDTAVYYCAR | EDSYCSGTSC------PYYYYGMDV | WGQGTTVTVSS |
| iPS:4 36946 | 21-225_183F4 | VH3]3-33/D6]6-6]RF1/JH6 | QVQLVES-GGGVVQPGRSLRLSCAASG-FTFS | S------YGMH | WVRQAPGKGLEWVA | VIWYD----GSNKYYADSVKG | RFTISRDNSKNTLYLQMNSLRAEDTAVYYCAR | ERTYCSGTTC------PYYYYGLGV | WGQGTTVTVSS |
| iPS:4 37286 | 21-225_208F1 | VH3]3-33/D6]6-6]RF1/JH6 | QVQLVES-GGGVVQPGRSLRLSCAASG-FTFS | D------YVMH | WVRQAPGKGLEWVA | VIWYD----GSNKYYVDSVKG | RFTISRDNSRNTLYLQMNSLRAEDTAVYYCAR | ERYSSGL------------YDYGMDV | WGQGTTVTVSS |
| iPS:4 37290 | 21-225_210G6 | VH3]3-33/D6]6-6]RF1/JH6 | QVQLVES-GGGVVQPGRSLRLSCAASG-FTFS | D------YVMH | WVRQAPGKGLEWVA | VIWYD----GSNKYYVDSVKG | RFTISRDNSKNTLYLQMNSLRAEDTAVYYCAR | ERYSSGL------------YDYGMDV | WGQGTTVTVSS |
| iPS:3 92634 | 21-225_17H3 | VH3]3-33/D6]6-6]RF1/JH6 | QVQLVES-GGGVVQPGRSLRLSCAASG-FTFS | N------CVMH | WVRQAPGKGLEWVA | VIWYD----GSNKYYADSVKG | RFTISRDNSKNTLYLQMNSLRAEDTAVYYCAR | EKYSSSW------------YDYGMDV | WGQGTTVTVSS |
| iPS:3 92742 | 21-225_20B2 | VH3]3-33/D6]6-6]RF1/JH6 | QVQLVES-GGGVVQPGRSLRLSCAASG-FTFS | N------YVIH | WVRQAPGKGLEWVA | VIWYD----GSNKYYADSVKG | RFTISRDNSKNTLYLQMNSLRAEDTAVYYCAR | EKYSSSW------------YDYGMDV | WGQGTTVTVSS |
| iPS:3 92836 | 21-225_22F4 | VH3]3-33/D6]6-6]RF1/JH6 | QVQLVES-GGGVVQPGRSLRLSCAASG-FTFS | D------YGMH | WVRQAPGKGLEWVA | VIWYD----GSNKYYADSVKG | RFTISRDNSKNTLYLQMNSLRAEDTAVYYCAR | EKYSSSW------------YDYGMDV | WGQGTTVTVSS |
| iPS:3 92846 | 21-225_24B6 | VH3]3-33/D6]6-6]RF1/JH6 | QVQLVES-GGGVVQPGRSPRLSCAASG-FIFS | N------YVMH | WVRQAPGKGLEWVA | VIWYD----GSNKYYADSVKG | RFTISRDNSKNTLYLQMNSLRAEDTAVYYCAR | EEYSSGW------------YDYGMDV | WGQGTTVTVSS |

Figure 51 (Continued)

| | | | | | | | | | |
|---|---|---|---|---|---|---|---|---|---|
| iPS:3 92884 | 21-225_23A10 | VH3|3-33|D6|6-6|RF1|JH6 | QVQLVES-GGGVVQPGRSLRLSCAASG-FTFS | S------YGMH | WVRQAPGK GLEWVA | VIWYD---- GSNKYYADS VKG | RFTISRDNSKNTLYLQMNSL RAEDTAVYYCAR | ERYSSGW------HDYGMDV | WGQGT TVTVS S |
| iPS:3 92888 | 21-225_25A2 | VH3|3-33|D6|6-6|RF1|JH6 | QVQLVES-GGGVVQPGRSLRLSCAASG-FTFS | S------YGMH | WVRQAPGK GLEWVA | VIWYD---- GSNKYYADS VKG | RFTISRDNSKNTLYLQMNSL RAEDTAVYYCAR | RYSSSW-------SGGMDV | WGQGT TVTVS S |
| iPS:3 92914 | 21-225_25D12 | VH3|3-33|D6|6-6|RF1|JH6 | QVQLVES-GGGVVQPGRSLRLSCAASG-FTFS | S------DGMH | WVRQAPGK GLEWVA | VIWYD---- GSNKYYADS VKG | RFTISRDNSKNTLYLQMNSL RAEDTAVYYCAR | ERYSSSW------YDYGMDV | WGQGT TVTVS S |
| iPS:3 92924 | 21-225_32H2 | VH3|3-33|D6|6-6|RF1|JH6 | QVQLVES-GGGVVQPGRSLRLSCAASG-FTFS | S------YGMH | WVRQAPGK GLEWVA | VIWYD---- GSNKYYADS VKG | RFTISRDNSNNTLMLQMNSL RAEDTGVYYCAR | RYSSSW-------TGGMDV | WGQGT TVTVS S |
| iPS:3 92938 | 21-225_29H4 | VH3|3-33|D6|6-6|RF1|JH6 | QVQLVES-GGGVVQPGRSLRLSCAASG-FTFS | S------YGIH | WVRQAPGK GLEWVA | VIWYD---- GSNKYYADS VKG | RFTISRDNSKNTLYLQMNSL RAEDTAVYYCAR | RYSSSW-------SGGMDV | WGQGT TVTVS S |
| iPS:3 92974 | 21-225_26A11 | VH3|3-33|D6|6-6|RF1|JH6 | QVQLVES-GGGVVQPGRSLRLSCAASG-FTFS | N------CVMH | WVRQAPGK GLEWVA | VIWYD---- GSNKYYADS VKG | RFTISRDNSKNTLYLQMNSL RAEDTAVYYCAR | EEYSSGW------YDYGMDV | WGQGT TVTVS S |
| iPS:3 93012 | 21-225_26G7 | VH3|3-33|D6|6-6|RF1|JH6 | QVQLVES-GGGVVQPGRSLRLSCAASG-FTFS | S------YGMH | WVRQAPGK GLEWVA | VIWYD---- GSNKYYADS VKG | RFTISRDNSKNTLYLQMNSL RAEDTAVYYCAR | RYSSSW-------SGGMDV | WGQGT TVTVS S |
| iPS:3 93176 | 21-225_27E7 | VH3|3-33|D6|6-6|RF1|JH6 | QVQLVES-GGGVVQPGRSLRLSCAASG-FTFS | S------YGMH | WVRQAPGK GLEWVA | VIWYD---- GSNKYYADS VKG | RFTISRDNSKNTLYLQMNSL RAEDTAVYYCAR | EDSYCSSTSC----PYYYYGMDV | WGQGT TVTVS S |
| iPS:3 93864 | 21-225_4C5 | VH3|3-33|D6|6-6|RF1|JH6 | QVQLVES-GGGVVQPGRSLRLSCAASG-FTFS | S------YVLH | WVRQAPGK GLEWVA | VIWYD---- GSNKYYADS VKG | RFTISRDNSKNTLYLQMNSL RAEDTAVYYCAR | EKYTSSW------YDYGMDV | WGQGT TVTVS S |
| iPS:3 93902 | 21-225_14E10 | VH3|3-33|D6|6-6|RF1|JH6 | QVQLVES-GGGVVQPGRSLRLSCAASG-FTFS | D------YGMH | WVRQAPGK GLEWVA | VIWYD---- GSNKYYADS VKG | RFTISRDNSKNTLYLQMNSL RAEDTAVYYCAR | EKYSSSW------YDYGMDV | WGQGT TVTVS S |
| iPS:3 93908 | 21-225_10E9 | VH3|3-33|D6|6-6|RF1|JH6 | QVQLVES-GGGVVQPGRSLRLSCAASG-FTFS | N------YVIH | WVRQAPGK GLEWVA | VIWYD---- GSNKYYADS VKG | RFTISRDNSKNTLYLQMNSL RAEDTAVYYCAR | EKYSSSW------YDYGMDV | WGQGT TVTVS S |
| iPS:3 93916 | 21-225_2G4 | VH3|3-33|D6|6-6|RF1|JH6 | QVQLVES-GGGVVQPGRSLRLSCAASG-FTFS | S------YVMH | WVRQAPGK GLEWVA | VIWYD---- GSNKYYADS VKG | RFTISRDNSKNTLYLQMNSL RAEDTAVYYCAR | EKYSSSW------YDYGMDV | WGHGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93950 | 21-225_3H10 | VH3\|3-33\|D6\|6-6\|RF1\|JH6 | QVQLVES-GGGVVQPGRSLRLSCAASG-FTFS | S------YVMH | WVRQAPGKGLEWVA | VIWYD----GSNKYYADSVKG | RFTISRDNSKNTLYLQMNSLRAEDTAVYYCAR | ERYSSGW-------YDYGLDV | WGQGTTVTVSS |
| iPS:3 93972 | 21-225_7C9 | VH3\|3-33\|D6\|6-6\|RF1\|JH6 | QVQLVES-GGGVVQPGRSLRLSCAASG-LTFS | N------YVMH | WVRQAPGKGLEWVA | VIWYD----GSNKYYADSVKG | RFTISRDNSKNTLYLQMNSLRAEDTAVYYCAR | EKYSSSW-------YDYGMDV | WGQGTTVTVSS |
| iPS:3 93978 | 21-225_4C12 | VH3\|3-33\|D6\|6-6\|RF1\|JH6 | QVQLVES-GGGVVQPGRSLRLSCAASG-FTFS | S------YVMH | WVRQAPGKGLEWVA | VIWYD----GSNKYYADSVKG | RFTISRDNSKNTLYLQMNSLRAEDTAVYYCAR | EKYSSNW-------YDYGMDV | WGHGTTVTVSS |
| iPS:3 93986 | 21-225_7G4 | VH3\|3-33\|D6\|6-6\|RF1\|JH6 | QVQLVES-GGGVVQPGRSLRLSCAASG-FTFN | N------YVMH | WVRQAPGKGLEWVA | VIWYD----GSNKYYADSVKG | RFTISRDNSKNTLYLQMNSLRAEDTAVYYCAR | EKYSSNW-------YDYGMDV | WGQGTTVTVSS |
| iPS:3 93996 | 21-225_15C11 | VH3\|3-33\|D6\|6-6\|RF1\|JH6 | QVQLVES-GGGVVQPGRSLRLSCAASG-FTFS | D------YVMH | WVRQAPGKGLEWVA | VIWYD----GSNKYYADSVKG | RFTISRDNSKNTLYLQMNSLRAEDTAVYYCAR | EKYSSSW-------YDYGLDV | WGQGTTVTVSS |
| iPS:3 94041 | 21-225_5E5 | VH3\|3-33\|D6\|6-6\|RF1\|JH6 | QVQLVES-GGGVVQPGRSLRLSCAASG-FTFS | N------YVMH | WVRQAPGKGLEWVA | VIWYD----GSNKYYADSVKG | RFTISRDNSKNTLYLQMTSLRAEDTAVYYCTR | EVYSSGW-------YDYGMDV | WGQGTTVTVSS |
| | Germline | VH3\|3-33\|D2\|2-8\|RF3\|JH4 | QVQLVES-GGGVVQPGRSLRLSCAASG-FTFS | | WVRQAPGKGLEWVA | | RFTISRDNSKNTLYLQMNSLRAEDTAVYYCAR | | WGQGTLVTVSS |
| iPS:4 26118 | 21-225_7A10 | VH3\|3-33\|D2\|2-8\|RF3\|JH4 | QVQLVES-GGGVVQPGRSLRLSCAASG-FNFS | S------YGMH | WVRQAPGKGLEWMA | VIWYD----GSNKYYADSVKG | RFTISRDNSKNTLYLQMHSLRAEDTAVYYCAR | DERLG---------IFDY | WGQGTLVTVSS |
| iPS:3 93844 | 21-225_3G7 | VH3\|3-33\|D2\|2-8\|RF3\|JH4 | QVQLVES-GGGVVQPGRSLRLSCAASG-FNFS | N------YGMH | WVRQAPGKGLEWVA | VIWHD----GSNKYYVDSVKG | RFTISRDNSKNTVYLQMNSLRAEDTAVYYCAR | DERLG---------IFDY | WGQGTLVTVSS |
| iPS:3 93852 | 21-225_12A10 | VH3\|3-33\|D2\|2-8\|RF3\|JH4 | QVQLVES-GGGVVQPGRSLRLSCAASG-FTFS | S------YGMH | WVRQAPGKGLEWVA | VIWHD----ETNKYTDSVKG | RFTISRDNSKNTLYLQMNSLRAEDTAVYYCAR | DERLG---------IFDY | WGQGTLVTVSS |
| iPS:3 93868 | 21-225_9C11 | VH3\|3-33\|D2\|2-8\|RF3\|JH4 | QVQLVES-GGGVVQPGRSLRLSCAASG-FTFS | S------YGMH | WVRQVPGKGLEWVA | VIWHD----ETNKYADSVKG | RFTISRDNSKNTLSLQMNSLRAEDTAVYYCAR | DERLG---------IFDY | WGQGTLVTVSS |
| iPS:3 93900 | 21-225_10E12 | VH3\|3-33\|D2\|2-8\|RF3\|JH4 | QVQLVES-GGGVVQPGRSLRLSCAASG-FNFS | N------YGMH | WVRQVPGKGLEWVA | VIWHD----GSNKYVDSVKG | RFTISRDNSKNTLSLQMNSLRAEDTAVYCCAR | DERLG---------IFDY | WGQGTLVTVSS |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93920 | 21-225_1H12 | VH3J3-33/D2J2-8)RF3/JH4 | QVQLVES-GGGVVQSGRSLRL SCAASG-FNFS | S------YGMH | WVRQAPGK GLEWVA | IIWHD---GSNKYYVDS VKG | RFTISRDNSKNTLYLQMNSL RAEDTAVYYCAR | DERLG--------IFDY | WGQGT LVTVS S |
| iPS:3 93932 | 21-225_10F5 | VH3J3-33/D2J2-8)RF3/JH4 | QVQLVES-GGGVVQPGRSLRL SCAASG-FNFS | S------YGMH | WVRQAPGK GLEWVS | IIWHD---GSNKYYVDS VKG | RFTISRDNSKNTLYLQMNSL RAEDSAVYYCAR | DERLG--------IFDY | WGQGT LVTVS S |
| | Germline | VH3J3-33/D6J6-6)RF1/JH4 | QVQLVES-GGGVVQPGRSLRL SCAASG-FTFS | ------YGMH | WVRQAPGK GLEWVS | VIWYD---GSNKYYADS VKG | RFTISRDNSKNTLYLQMNSL RAEDTAVYYCAR | ENSSS---------YYFDY | WGQGT LVTVS S |
| iPS:4 26124 | 21-225_32D6 | VH3J3-33/D6J6-6)RF1/JH4 | QVQLVES-GGGVVQPGRSLRL SCAASG-FTFS | S------YGMH | WVRQAPGK GLEWVT | VIWHD---GSNAYYADS VKG | RFTISRDNSKNTLYLQMNSL RAEDTAVYYCAR | ENSSS---------YYFDY | WGQGT LVTVS S |
| iPS:3 92922 | 21-225_30G4 | VH3J3-33/D6J6-6)RF1/JH4 | QVQLVES-GGGVVQPGRSLRL SCAASG-FTFS | S------YGMH | WVRQAPFGR GLEWVA | VIWYD---GTDKYYVDS VKG | RFTISRDNSKNTLYLQMNSL RAEDSAVYYCAR | ENSSS---------YYFDY | WGQGT LVTVS S |
| iPS:3 93002 | 21-225_30G1 | VH3J3-33/D6J6-6)RF1/JH4 | QVQLVES-GGGVVQPGRSLRL SCAASG-FTFS | Y------YGMH | WVRQAPGK GLEWVA | VIWHD---GSNKYYVDS VKG | RFTISRDNSKNTLYLQMNSL RAEDTAVYYCAR | ENSSS---------YYFDY | WGQGT LVTVS S |
| iPS:3 93066 | 21-225_34D3 | VH3J3-33/D6J6-6)RF1/JH4 | QVQLVES-GGGVVQPGRSLRL SCAASG-FTFS | Y------YGMH | WVRQAPGK GLEWVA | VIWHD---GSNKYYVDS VKG | RFTISRDNSKNTLYLQMNSL RAEDTAVYYCAR | ENSSS---------FYFDY | WGQGT LVTVS S |
| iPS:3 93092 | 21-225_33C12 | VH3J3-33/D6J6-6)RF1/JH4 | QVQLVES-GGGVVQPGRSLRL SCAASG-FTFS | H------YGMH | WVRQAPGK GLEWVA | VIWHD---GSNKYYADS VKG | RFTISRDNSKNTLYLQMNSL RAEDTAVYYCAR | ENSSS---------YYFDY | WGQGT LVTVS S |
| iPS:3 93100 | 21-225_36B8 | VH3J3-33/D6J6-6)RF1/JH4 | QVQLVES-GGGVVQPGRSLRL SCAASG-FTFS | N------YGMH | WVRQAPGK GLEWVA | VIWHD---GSNKYIGDS VKG | RFTISRDNSKNTLYLQMNSL RAEDTAVYYCAR | ENSSS---------YYFDY | WGQGT LVTVS S |
| iPS:3 93122 | 21-225_33B2 | VH3J3-33/D6J6-6)RF1/JH4 | QVQLVES-GGGVVQPGRSLRL SCAASG-FTFS | N------YGMH | WVRQAPFGR GLEWVA | VIWHD---GSNKYYADS VKG | RFTISRDNSKNTLYLQMNSL RAEDTAVYYCAR | ENSSS---------YYFDY | WGQGT LVTVS S |
| iPS:3 93134 | 21-225_34C2 | VH3J3-33/D6J6-6)RF1/JH4 | QVQLVES-GGGVVQPGRSLRL SCAASG-FTFS | N------YVMH | WVRQAPGK GLEWVA | LIWYD---GSNKYYADS VKG | RFTISRDNSKNTLYLQMNSL RAEDTAVYYCAR | ENSSS---------YYFDY | WGQGT LVTVS S |
| iPS:3 93136 | 21-225_34D8 | VH3J3-33/D6J6-6)RF1/JH4 | QVQLVES-GGGVVQPGRSLRL SCAASG-FTFS | N------YGMH | WVRQAPGK GLEWVA | VIWYD---GSNKYYADS VKG | RFTISRDNSKNTLYLQMNSL RAEDTAVYYCAR | ENSSS---------YYFDY | WGQGT LVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | | VH3|3-30.3|D6|6-19|RF2|JH6 | QVQLVES GGGVVQPGRSLRL SCAASG-FTFS | S-------YAMH | WVRQAPGK GLEWVA | VISYD GSNKYYADS VKG | RFTISRDNSKNTLYLQMNSL RAEDTAVYYCAR | GTVAVAP------YYGMDV | WGQGT TVTVS S |
| iPS:4 51135 | 21-225_64A11 | VH3|3-30.3|D6|6-19|RF2|JH6 | QVQLVES GGGVVQPGRSLRL SCAASG-FTFS | N-------YGMH | WVRQAPGK GLEWVA | VISYV GSNKYYADS VKG | RFTISRDNSKNTLYLQMNTL RAEDTAVYYCAR | RGAVAP------YYGMDV | WGQGT TVTVS S |
| | | Germline | QVQLVQS GAEVKKPGASVKV SCKASG-YTFT | S-------YDIN | WVRQATGQ GLEWMG | WMNPN---- SGNTGYAQK FQG | RVTMTRNTSISTAHMELSSL RSEDTAVYYCAR | GYSSGW------WFDF | WGQGT LVTVS S |
| iPS:4 51137 | 21-225_74A7 | VH1|1-08|D6|6-19|RF1|JH5 | QVQLVQS GAEVKKPGASVKV SCKASG-YTFT | N-------YDIN | WVRQATGQ GLEWMG | WMNPN---- SGNTGYAQK FQG | RVTMTRNTSISTAHMELSSL RSEDTAVYYCAV | SSGWN------WFDP | WGQGT LVTVS S |
| iPS:4 34285 | 21-225_57A11 | VH1|1-08|D6|6-19|RF1|JH5 | QVQLVQS GAEVKKPGASVKV SCKASG-YTFT | N-------YDIN | WVRQATGQ GLEWMG | WMNPN---- SVNTGYAQK FQG | RVTMTRDTSISTAYMELSSL RSEDTAVYYCAI | SSGWN------WFDP | WGQGT LVTVS S |
| iPS:4 34287 | 21-225_57F12 | VH1|1-08|D6|6-19|RF1|JH5 | QVQLVQS GAEVKKPGASVKV SCKASG-YTFT | N-------YDIN | WVRQATGQ GLEWMG | WMNPN---- SGNTGYAQK FQG | RVTMTRNTSISTAYMELSSL RSEDTAVYYCAI | SSGWY------RPDP | WGQGT LVTVS S |
| iPS:4 34479 | 21-225_76H1 | VH1|1-08|D6|6-19|RF1|JH5 | QVQLVQS GAEVKKPGASVKV SCKASG-FTFT | N-------YDIN | WVRQVPGQ GLEWMG | WMHPN---- SGNTGYAQK FQG | RVTMTRNTSISTAYMELSSL RSEDTAVYYCAI | SSGWY------WFDP | WGQGT LVTVS S |
| iPS:4 34481 | 21-225_74B10 | VH1|1-08|D6|6-19|RF1|JH5 | QVQLVQS GAEVKKPGASVKV SCKASG-YTFT | N-------YDIN | WVRQATGQ GLEWMG | WMHPN---- SGNTGFAQK FQG | RVTMTRNTSISTAYMELSSL RSEDTAVYYCAV | SSGWY------WFDP | WGQGT LVTVS S |
| iPS:4 34483 | 21-225_74C12 | VH1|1-08|D6|6-19|RF1|JH5 | QVQLVQS GAEVKKPGASVKV SCKASG-YTFT | N-------YDIN | WVRQATGQ GLEWMG | WMNPN---- SGNTGYAQK FQG | RVTMTRNTSISTAYMELSSL RSEDTAVYYCAI | SSGWN------WFDP | WGQGT LVTVS S |
| iPS:4 34493 | 21-225_76F3 | VH1|1-08|D6|6-19|RF1|JH5 | QVQLVQS GAEVKKPGASVKV SCKASG-YTFT | N-------YDIN | WVRQATGQ GLEWMG | WMNPN---- SGNTGYAQK FQG | RVTMTRNTSISTAYMELSSL RSEDTAVYYCAV | SSGWN------WFDP | WGQGT LVTVS S |
| iPS:4 34509 | 21-225_76F5 | VH1|1-08|D6|6-19|RF1|JH5 | QVQLVQS GAEVKKPGASVKV SCKASG-YTFT | N-------YDIN | WVRQATGQ GLEWMG | WMHPN---- SGNTGYAQK FQG | RVTMTRNTSISTAYMELSSL RSEDTAVYYCAS | SSGWY------WFDP | WGQGT LVTVS S |
| iPS:4 34513 | 21-225_76A6 | VH1|1-08|D6|6-19|RF1|JH5 | QVQLVQS GAEVKKPGASVKV SCKASG-YTFT | N-------YDIN | WVRQATGQ GLEWMG | WMHPN---- NGNTGYAQK FQG | RVTMTRNTSISTAYMELNSL RSEDTAVYYCAI | SSGWY------WFDP | WGQGT LVTVS L |

Figure 51 (Continued)

| | | | | | | | | |
|---|---|---|---|---|---|---|---|---|
| iPS:4 34515 | 21-225_74A5 | VH1j1-08/D6j6-19jRF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34525 | 21-225_76E8 | VH1j1-08/D6j6-19jRF1/J H5 | QVQLVQS-GAEVKKPGASVKV SCKASG-YIFP | N------YDIN | WVRQATGQ GLEWMG | WMNPN---- SGNTGYAQK FQG | RVTMTRNTSISTAYMELSSL RSEDTAVYYCAV | SSGWH---------- | ------WFDP | WGQGT LVTVA S |
| iPS:4 34529 | 21-225_76B9 | VH1j1-08/D6j6-19jRF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34575 | 21-225_77C7 | VH1j1-08/D6j6-19jRF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAV | SSGWH---------- | ------WFDP | WGQGT LVTVS S |
| iPS:4 34583 | 21-225_74B6 | VH1j1-08/D6j6-19jRF1/J H5 | QVQLVQS-GAEVKKPGASVKV SCKASG-YTFT | N------YDIN | WVRQATGQ GLEWMG | WMHPN---- NGNTGYAQK FQG | RVTMTRNTSISTAYMELNSL RSEDTAVYYCAI | SSGWY---------- | ------WFDP | WGQGT LVTVS L |
| iPS:4 34587 | 21-225_74G3 | VH1j1-08/D6j6-19jRF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34597 | 21-225_77C10 | VH1j1-08/D6j6-19jRF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34603 | 21-225_77D11 | VH1j1-08/D6j6-19jRF1/J H5 | QVQLVQS-GAEVKKPGASVKV SCKASG-YTFT | N------YDIN | WVRQVPGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34613 | 21-225_77D12 | VH1j1-08/D6j6-19jRF1/J H5 | QVQLVQS-GAEVKKPGASVKV SCKASG-YTFT | N------YDIN | WVRQATGQ GLEWMG | WMHPN---- SGNTGYAQK FQG | RVTLTRNTSINTAYMELSSL RSEDTAVYYCAI | SSGWY---------- | ------WFDP | WGQGT LVTVS S |
| iPS:4 34617 | 21-225_74B8 | VH1j1-08/D6j6-19jRF1/J H5 | QVQLVQS-GAEVKKPGASVKV SCKASG-YIFT | N------YDIN | WVRQATGQ GLEWMG | WMHPN---- SGNTGYAQK FQG | RVTMTRNTSISTAYMELSSL RSEDTAVYYCAV | SSGWY---------- | ------WFDP | WGQGT LVTVS S |
| iPS:4 34619 | 21-225_78C1 | VH1j1-08/D6j6-19jRF1/J H5 | QVQLVQS-GAEVKKPGASVKV SCKASG-YTFT | N------YDIN | WVRQATGQ GLEWMG | WMHPN---- SGNTGYAQK FQG | RVTMTRNTSISTAYMELSSL RSEDTAVYYCAI | SSGWY---------- | ------WFDP | WGQGT LVTVS S |
| iPS:4 34639 | 21-225_74B7 | VH1j1-08/D6j6-19jRF1/J H5 | QVQLVQS-GAEVKKPGASVKV SCKASG-YIFP | N------YDIN | WVRQATGQ GLEWMG | WMNPN---- SGNTGYAQK FQG | RVTMTRNTSISTAYMELSSL RSEDTAVYYCAV | SSGWH---------- | ------WFDP | WGQGT LVTVA S |

Figure 51 (Continued)

| | | | | | | | | | |
|---|---|---|---|---|---|---|---|---|---|
| iPS:4 34653 | 21-225_74B5 | VH1¦1-08¦D6¦6-19¦RF1¦JH5 | QVQLVQS-GAEVKKPGASVKVSCKASG-YTFT | N------YDIN | WVRQATGQGLEWMG | WMNPN----SGNTGYAQKFQG | RVTMTRNTSISTAHMELSSLRSEDTAVYYCAV | SSGWN-------------- | ----WFDP | WGQGTLVTVSS |
| iPS:4 34655 | 21-225_78H12 | VH1¦1-08¦D6¦6-19¦RF1¦JH5 | QVQLVQS-GAEVKKPGASVKVSCKASG-YIFP | N------YDIN | WVRQATGQGLEWMG | WMNPN----SGNTGYAQKFQG | RVTMTRNTSISTAYMELSSLRSEDTAVYYCAV | SSGWH-------------- | ----WFDP | WGQGTLVTVAS |
| iPS:4 34675 | 21-225_79G6 | VH1¦1-08¦D6¦6-19¦RF1¦JH5 | QVQLVQS-GAEVKKPGASVKVSCKASG-FTFT | N------YDIN | WVRQATGQGLEWMG | WMHPN----SGNTGFAQKFQG | RVTMTRNTSISTAYMELSSLRSEDTAVYYCAV | SSGWY-------------- | ----WFDP | WGQGTLVTVSS |
| iPS:4 34689 | 21-225_79G10 | VH1¦1-08¦D6¦6-19¦RF1¦JH5 | QVQLVQS-GAEVKKPGASVKVSCKASG-YTFT | N------YDIN | WVRQATGQGLEWMG | WMNPN----SGNTGYAQKFQG | RVTMTRNTSISTAHMELSSLRSEDTAVYYCAV | SSGWN-------------- | ----WFDP | WGQGTLVTVSS |
| iPS:4 34705 | 21-225_80A2 | VH1¦1-08¦D6¦6-19¦RF1¦JH5 | QVQLVQS-GAEVKKPGASVKVSCKASG-YTFT | N------YDIN | WVRQVPGQGLEWMG | WMHPN----SGNTGYAQKFQG | RVTMTRNTSISTAYMELSSLRSEDTAVYYCAI | SSGWY-------------- | ----WFDP | WGQGTLVTVSS |
| iPS:4 34707 | 21-225_80D3 | VH1¦1-08¦D6¦6-19¦RF1¦JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY-------------- | ----WFDP | WGQGTLVTVSS |
| iPS:4 34731 | 21-225_80E9 | VH1¦1-08¦D6¦6-19¦RF1¦JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY-------------- | ----WFDP | WGQGTLVTVSS |
| iPS:4 34747 | 21-225_80C12 | VH1¦1-08¦D6¦6-19¦RF1¦JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELNSLRSEDTAVYYCAI | SSGWY-------------- | ----WFDP | WGQGTLVTVSL |
| iPS:4 34761 | 21-225_81E5 | VH1¦1-08¦D6¦6-19¦RF1¦JH5 | QVQLVQS-GAEVKKPGASVKVSCKASG-YTFT | N------YDIN | WVRQATGQGLEWMG | WMNPN----SGNTGYAQKFQG | RVTMTRNTSISTAHMELSSLRSEDTAVYYCAV | SSGWN-------------- | ----WFDP | WGQGTLVTVSS |
| iPS:4 34771 | 21-225_81F9 | VH1¦1-08¦D6¦6-19¦RF1¦JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY-------------- | ----WFDP | WGQGTLVTVSS |
| iPS:4 34793 | 21-225_82A5 | VH1¦1-08¦D6¦6-19¦RF1¦JH5 | QVQLVQS-GAEVKKPGASVKVSCKASG-YTFT | N------YDIN | WVRQATGQGLEWMG | WMHPN----NGNTGYAQKFQG | RVTMTRNTSISTAYMELNSLRSEDTAVYYCAI | SSGWY-------------- | ----WFDP | WGQGTLVTVSL |
| iPS:4 34797 | 21-225_82G5 | VH1¦1-08¦D6¦6-19¦RF1¦JH5 | QVQLVQS-GAEVKKPGASVKVSCKASG-YTFT | N------YDIN | WVRQVPGQGLEWMG | WMHPN----SGNTGYAQKFQG | RVTMTRNTSISTAYMELSSLRSEDTAVYYCAI | SSGWY-------------- | ----WFDP | WGQGTLVTVSS |

Figure 51 (Continued)

| | | | | | | | | | |
|---|---|---|---|---|---|---|---|---|---|
| iPS:4 34805 | 21-225_82D9 | VH1j1-08/D6j6-19jRF1/JH5 | QVQLVQS-GAEVKKPGASVKVSCKASG-YTFT | N------YDIN | WVRQVPGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34813 | 21-225_82C12 | VH1j1-08/D6j6-19jRF1/JH5 | QVQLVQS-GAEVKKPGASVKVSCKASG-YTFT | N------YDIN | WVRQATGQGLEWMG | WMHPN----NGNTGYAQKFQG | RVTMTRNTSISTAYMELNSLRSEDTAVYYCAI | SSGWY------ | ------WFDP | WGQGTLVTVSL |
| iPS:4 34825 | 21-225_83C2 | VH1j1-08/D6j6-19jRF1/JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34827 | 21-225_83F3 | VH1j1-08/D6j6-19jRF1/JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34829 | 21-225_83G3 | VH1j1-08/D6j6-19jRF1/JH5 | QVQLVQS-GAEVKKPGASVKVSCKASG-YTFT | N------YDIN | WVRQVPGQGLEWMG | WMHPN----SGNTGYAQKFQG | RVTMIRNTSISTAYMELSSLRSEDTAVYYCAI | SSGWY------ | ------WFDP | WGQGTLVTVSS |
| iPS:4 34833 | 21-225_83C5 | VH1j1-08/D6j6-19jRF1/JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY------ | ------WFDP | WGQGTLVTVSS |
| iPS:4 34841 | 21-225_83G7 | VH1j1-08/D6j6-19jRF1/JH5 | QVQLVQS-GAEVKKPGASVKVSCKASG-YIFP | N------YDIN | WVRQATGQGLEWMG | WMNFN----SGNTGYAQKFQG | RVTMTRNTSISTAYMELSSLRSEDTAVYYCAV | SSGWH------ | ------WFDP | WGQGTLVTVSS |
| iPS:4 34863 | 21-225_84G7 | VH1j1-08/D6j6-19jRF1/JH5 | QVQLVQS-GAEVKKPGASVKVSCKASG-YTFT | N------YDIN | WVRQATGQGLEWMG | WMHPN----SGNTGYAQKFQD | RVTMTRNTSISTAYMELSSLRSEDTAVYYCAV | SSGWH------ | ------WFDP | WGQGTLVTVA |
| iPS:4 34877 | 21-225_85H2 | VH1j1-08/D6j6-19jRF1/JH5 | QVQLVQS-GAEVKKPGASVKVSCKASG-YTFT | N------YDIN | WVRQVPGQGLEWMG | WMHPN----SGNTGYAQKFQG | RVTLTPNTSISTAYMELSSLRSEDTAVYYCAI | SSGWY------ | ------WFDP | WGQGTLVTVS |
| iPS:4 34883 | 21-225_85B5 | VH1j1-08/D6j6-19jRF1/JH5 | QVQLVQS-GAEVKKPGASVKVSCKASG-YTFT | N------YDIN | WVRQATGQGLEWMG | WMHPN----SGNTGYAQKFQG | RVTMTRNTSISTAYMELSSLRSEDTAVYYCAI | SSGWY------ | ------WFDP | WGQGTLVTVS |
| iPS:4 34911 | 21-225_85D11 | VH1j1-08/D6j6-19jRF1/JH5 | QVQLVQS-GAEVKKPGASVKVSCKASG-YTFT | N------YDIN | WVRQATGQGLEWMG | WMNFN----SGNTGYAQKFQG | RVTMTRNTSISTAHMELSSLRSEDTAVYYCAI | SSGWY------ | ------WFDP | WGQGTLVTVSS |
| iPS:4 34935 | 21-225_86E9 | VH1j1-08/D6j6-19jRF1/JH5 | QVQLVQS-GAEVKKPGASVKVSCKASG-YTFT | N------YDIN | WVRQVPGQGLEWMG | WMNFN----SGNTGYAQKFQG | RVTMTRSTSTAHMELSSLRSEDTAVYYCAV | SSGWS------ | ------WFDP | WGQGTLVTVSS |

Figure 51 (Continued)

| | | | | | | | | | |
|---|---|---|---|---|---|---|---|---|---|
| iPS:4 34957 | 21-225_87A10 | VH1\|1-08\|D6\|6-19\|RF1/JH5 | QVQLVQS-GAEVKKPGASVKVSCKASG-YTFT | N------YDIN | WVRQATGQ GLEWMG | WMHPN----NGNTGYAQK FQG | RVTMTRNTSISTAYMELNSL RSEDTAVYYCAI | SSGWY-----------WFDP | WGQGT LVTVS L |
| iPS:4 34971 | 21-225_88G2 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAI | SSGWY-----------WFDP | WGQGT LVTVS S |
| iPS:4 35051 | 21-225_90D9 | VH1\|1-08\|D6\|6-19\|RF1/JH5 | QVQLVQS-GAEVKKPGASVKVSCKASG-YTFP | N------YDIN | WVRQATGQ GLEWMG | WMRPN----SGNTGYAQK FQG | RVTMTRNTSISTAYMELSSL RSEDTAVYYCAI | SSGWH-----------WFDP | WGQGT LVTVA S |
| iPS:4 35071 | 21-225_91F1 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAI | SSGWY-----------WFDP | WGQGT LVTVS S |
| iPS:4 35087 | 21-225_91G8 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTMTRNTSISTAYMELSSL RSEDTAVYYCAI | SSGWY-----------WFDP | WGQGT LVTVS S |
| iPS:4 35203 | 21-225_75A7 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQD | RVTMTRNTSISTAYMELSSL RSEDTAVYYCAV | SSGWH-----------WFDP | WGQGT LVTVA S |
| iPS:4 35211 | 21-225_94E11 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTMTRNTSISTAHMELSSL RSEDTAVYYCAI | SSGWK-----------WFDP | WGQGT LVTVS S |
| iPS:4 35227 | 21-225_95G4 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTMTRNTSISTAHMELSSL RSEDTAVYYCAV | SSGWN-----------WFDP | WGQGT LVTVS S |
| iPS:4 35245 | 21-225_95E12 | VH1\|1-08\|D6\|6-19\|RF1/JH5 | QVQLVQS-GAEVKKPGASVKVSCKASG-YTFT | N------YDIN | WVRQATGQ GLEWMG | WMNPN----SGNTGYAQK FQG | RVTMTRNTSISTAYMELSSL RSEDTAVYYCAI | SSGWY-----------WFDP | WGQGT LVTVS S |
| iPS:4 35247 | 21-225_96G1 | VH1\|1-08\|D6\|6-19\|RF1/JH5 | QVQLVQS-GAEVKKPGASVKVSCKASG-YTFT | N------YDIN | WVRQATGQ GLEWMG | WMHPN----NGNTGYAQK FQG | RVTMTRNTSISTAYMELNSL RSEDTAVYYCAI | SSGWY-----------WFDP | WGQGT LVTVS L |
| iPS:4 35249 | 21-225_96E2 | VH1\|1-08\|D6\|6-19\|RF1/JH5 | QVQLVQS-GAEVKKPGASVKVSCKASG-YTFT | N------YDIN | WVRQATGQ GLEWMG | WMHPN----SGNTGYAQK FQG | RVTLTRNTSISTAYMELSSL RSEDTAVYYCAV | SSGWY-----------WFDP | WGQGT LVTVS S |
| iPS:4 35255 | 21-225_96D5 | VH1\|1-08\|D6\|6-19\|RF1/JH5 | QVQLVQS-GAEVKKPGASVKVSCKASG-YTFT | N------YDIN | WVRQATGQ GLEWMG | WMNPN----SGNTGYAQK FQG | RVTMTRSISTAHMELSSL RSEDTAVYYCAV | SSGWS-----------WFDP | WGQGT LVTVS S |

Figure 51 (Continued)

| | | | | | | | | | |
|---|---|---|---|---|---|---|---|---|---|
| iPS:4 35279 | 21-225_97H4 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGYAQKFQG | RVTMTRNTSISTAYMELSSL RSEDTAVYYCAI | SSGWY---------- | -------WFDP | WGQGT LVTVS S |
| iPS:4 35327 | 21-225_147G6 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGYAQKFQG | RVTMTRNTSISTAYMELSSL RSEDTAVYYCAY | SSGWY---------- | -------WFDP | WGQGT LVTVS S |
| iPS:4 35437 | 21-225_152F4 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGYAQKFQG | RVTMTRNTSISTAYMELSSL RSEDTAVYYCAY | SSGWY---------- | -------WFDP | WGQGT LVTVS S |
| iPS:4 35701 | 21-225_170F6 | VH1j1-08/D6j6-19/RF1/JH5 | QVQLVQS-GAEVKKPGASVKVSCKASG-YTFT | N------YDIN | WVRQATGQ GLEWMG | WMFPN---SGNTGYAQKFQD | RVTMTRNTSISTAYMELSSL RSEDTAVYYCAY | SSGWY---------- | -------WFDP | WGQGT LVTVS S |
| iPS:4 35737 | 21-225_174G5 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGYAQKFQG | RVTMTRNTSISTAYMELSSL RSEDTAVYYCAV | SSGWY---------- | -------WFDP | WGQGT LVTVS S |
| iPS:4 36544 | 21-225_224H5 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGYAQKFQG | RVTMTRNTSISTAYMELSSL RSEDTAVYYCAS | SSGWN---------- | -------WFDP | WGQGT LVTVS S |
| iPS:4 36570 | 21-225_225F4 | VH1j1-08/D6j6-19/RF1/JH5 | QVQLVQS-GAEVKKPGASVKVSCKASG-YTFT | N------YDIN | WVRQATGQ GLEWMG | WMHFN---SGSTGYAQKFQG | RLIMTRNTSISTVYMELNSL RSEDTAVYYCAS | SSGWY---------- | -------WFDP | WGQGT LVTVS S |
| iPS:4 36644 | 21-225_227G9 | VH1j1-08/D6j6-19/RF1/JH5 | QVQLVQS-GAEVKKPGASVKVSCKASG-YTFT | N------YDIN | WVRQATGR GLEWMG | WMYPN---SGNTGYAQKFQG | RVTMTRNTSISTAYMELSSL RSEDTAVYYCAL | SSGWY---------- | -------WFDP | WGQGT LVTVS S |
| iPS:4 37322 | 21-225_75B1 | VH1j1-08/D6j6-19/RF1/JH5 | QVQLVQS-GAEVKKPGASVKVSCKASG-YTFT | N------YDIN | WVRQVPGQ GLEWMG | WMHPN---SGNTGYAQKFQG | RVTMTRNTSISTAYMELSSL RSEDTAVYYCAI | SSGWY---------- | -------WFDP | WGQGT LVTVS S |
| iPS:4 37361 | 21-225_74C1 | VH1j1-08/D6j6-19/RF1/JH5 | QVQLVQS-GAEVKKPGASVKVSCKASG-YTFT | N------YDIN | WVRQATGQ GLEWMG | WMNPD---SGNIGYAQKFQG | RVTMTRNTSISTAYMELSSL RSEDTAVYYCAS | SSGWY---------- | -------WFDP | WGQGT LVTVS S |
| iPS:4 37363 | 21-225_74C10 | VH1j1-08/D6j6-19/RF1/JH5 | QVQLVQS-GAEVKKPGASVKVSCKASG-YTFT | N------YDIN | WVRQATGQ GLEWMG | WMHPN---SGNTGFAQKFQG | RVTMTRNTSISTAYMELSSL RSEDTAVYYCAI | SSGWY---------- | -------WFDP | WGQGT LVTVS S |
| iPS:4 37379 | 21-225_74H2 | VH1j1-08/D6j6-19/RF1/JH5 | QVQLVQS-GAEVKKPGASVKVSCKASG-FIFT | N------YDIN | WVRQATGQ GLEWMG | WMHPN---SGNTGFAQKFQG | RVTMTRNTSISTAYMELSSL RSEDTAVYYCAV | SSGWY---------- | -------WFDP | WGQGT LVTVS S |

Figure 51 (Continued)

| | | | | | | | | |
|---|---|---|---|---|---|---|---|---|
| iPS:4 46094 | 21-225_77E1 | VH1|1-08/D6|6-19|RF1/JH5 | QVQLVQS-GAEVKKPGASVKVSCKASG-YIFP | N------YDIN | WVRQATGQGLEWMG | WMNPN---SGNTGYAQKFQG | RVTMTRNTSISTAYMELSSLRSEDTAVYYCAV | SSGWH------WFDP | WGQGTLVTVSS |
| iPS:4 51129 | 21-225_94D2 | VH1|1-08/D6|6-19|RF1/JH5 | QVQLVQS-GAEVKKPGASVKVSCKASG-FTFT | N------YDIN | WVRQATGQGLEWMG | WMHPN---SGNTGPAQKFQG | RVTMTRNTSISTAYMELSSLRSEDTAVYYCAV | SSGWY------WFDP | WGQGTLVTVSS |
| iPS:4 51133 | 21-225_95H4 | VH1|1-08/D6|6-19|RF1/JH5 | QVQLVQS-GAEVKKPGASVKVSCKASG-YIFT | N------YDIN | WVRQATGQGLEWMG | WMNPN---SGNTGYAQKFQG | RVTMTRNTSISTAHMELSSLRSEDTAVYYCAV | SSGWN------WFDP | WGQGTLVTVSS |
| iPS:3 98510 | 21-225_25A3 | VH1|1-08/D6|6-19|RF1/JH5 | QVQLVQS-GAEVKKPGASVKVSCKASG-YIFT | N------YDIN | WVRQATGQGLEWMG | WMHPN---SGNTGYAQKFQG | RVTMTRNTSISTANMELSSLRSEDTAVYYCAS | SSGWY------WFDP | WGQGTLVTVSS |
| iPS:3 98516 | 21-225_26A9 | VH1|1-08/D6|6-19|RF1/JH5 | QVQLVQS-GAEVKKPGASVKVSCKASG-YIFT | N------YDIN | WVRQATGQGLEWMG | WMHPN---SGNTGCAQKFQG | RVTMTWNMSISTAYMELSSLRSEDTAVYYCAS | SSGWY------WFDP | WGQGTLVTVSS |
| | Germline | | H_FR1 | H_CDR1 | H_FR2 | H_CDR2 | H_FR3 | H_CDR3 | H_FR4 |
| VH3|3-30.3/D5|5-18|RF3/JH4 | | | QVQLVES-GGSVKPGRSLRLSCAASG-FTFS | S------YAMH | WVRQAPGKGLEWVA | VISYD---GSNKYYADSVKG | RFTISRDNSKNTLYLQMNSLRAEDTAVYYCAR | GVSYG------YYFDY | WGQGTLVTVSS |
| iPS:4 51139 | 21-225_71A6 | VH3|3-30.3/D5|5-18|RF3/JH4 | QVQLVES-GGGVVQPGRSLRLSCAASG-FTFS | N------YGMH | WVRQAPGKGLEWVA | VISYD---GSNEYYADSVKG | RFTISRDNSKNTLYLQMNSLRAEDTAVYYCAR | DHRYGV------RGGFDY | WGQGTLVTVSS |
| | Germline | | H_FR1 | H_CDR1 | H_FR2 | H_CDR2 | H_FR3 | H_CDR3 | H_FR4 |
| VH1|1-18/D6|6-19|RF2/JH5 | | | QVQLVQS-GAEVKKPGASVKVSCKASG-YTFT | S------YGIS | WVRQAPGQGLEWMG | WISAY---NGNTNYAQKLQG | RVTMTTDISTSTAYMELRSLRSEDTAVYYCAR | GIAVA------WFDP | WGQGTLVTVSS |
| iPS:4 51143 | 21-225_66H11 | VH1|1-18/D6|6-19|RF2/JH5 | QVQLVQS-GAEVKKPGASVKVSCKASG-YIFA | T------YGIS | WVRQAPGKGLEWMG | WISAY---NGNTNYAQKLQG | RVTMTIDISTAYMELRSLRSEDTAVYYCAR | GEAVA------VFDP | WGQGTLVTVSS |
| iPS:4 34361 | 21-225_65D5 | VH1|1-18/D6|6-19|RF2/JH5 | QVQLVQS-GAEVKKPGASVKVSCKASG-YTFP | S------YGIS | WVRQAPGQGLEWMG | WISAY---SGNTNYAQKLQG | RVTMTTDTSTSTAYMELRSLRSDDTAVYFCAR | GEAVA------VFDP | WGQGTLVTVSS |
| | Germline | | H_FR1 | H_CDR1 | H_FR2 | H_CDR2 | H_FR3 | H_CDR3 | H_FR4 |
| VH3|3-33/D4|4-23|RF2/JH6 | | | QVQLVES-GGGVVQPGRSLRLSCAASG-FTFS | S------YGMH | WVRQAPGKGLEWVA | VIWFD---GSNKYYVDSVKD | RFTISRDNSKNTLYLQMNSLRAEDTAVYYCAR | DYGMDY------YYGMDV | WGQGTTVTVSS |
| iPS:4 53445 | 21-225_148E10 | VH3|3-33/D4|4-23|RF2/JH6 | QVQLVES-GGGVVQPGRSLRLSCAASG-FTFS | S------YGMH | WVRQAPGKGLEWVA | VIWFD---GSNKYYVDSVKD | RFTISRDNSKNTLYLQMNSLRAEDTAVYYCAR | DRVEGSGIP------YYYYGMDV | WGQGTTVTVSS |

Figure 51 (Continued)

| | | | | | | | | | |
|---|---|---|---|---|---|---|---|---|---|
| iPS:4 36082 | 21-225_195D9 | VH3/3-33/D4/4-23/RF2/JH6 | QVQLVES-GGGVVQPGRSLRLSCAASG-FTFS | H------YVMH | WVRQAPGK GLEWVA | VIWYD----GTNKYYADSVKG | RFTISRDNSKNTLYLQMNSL RAEDTAVYYCAR | DWFGEGN-------YYGMDV | WGQGT TVTVS S |
| iPS:4 36118 | 21-225_196A10 | VH3/3-33/D4/4-23/RF2/JH6 | QVQLVES-GGGVVQPGRSLRLSCAASG-FTFS | H------YVMH | WVRQAPGK GLEWVA | VIWYD----GTNKYYADSVKG | RFTISRDNSKNTLYLQMNSL RAEDTAVYYCAR | DWFGEGN-------YYGMDV | WGQGT TVTVS S |
| iPS:4 36670 | 21-225_147D9 | VH3/3-33/D4/4-23/RF2/JH6 | QVQLVES-GGGVVQPGRSLRLSCAASG-FTFS | S------YGMH | WVRQAPGK GLEWVA | DIWFD----GSNKYYVDSVKD | RFTISRDNSKNTLYLQMNSL RAEDTAVYYCAR | DRVEGSGTP-----YYYYGMDV | WGQGT TVTVS S |
| iPS:4 36720 | 21-225_151H6 | VH3/3-33/D4/4-23/RF2/JH6 | QVQLVES-GGGVVQPGRSLRLSCAASG-FTFS | D------YGMH | WVRQAPGK GLEWVA | LIWYD----GSNKYYADSVKG | RFTISRDNSKNTLYLQMNSL RAEDTAVYYCAR | DDRSCSRTSC-----PYYYYGLDV | WGQGT TVTVS S |
| iPS:4 36726 | 21-225_152G5 | VH3/3-33/D4/4-23/RF2/JH6 | QVQLVES-GGGVVQPGRSLRLSCAASG-FTFS | D------YGMH | WVRQAPGK GLEWVA | LIWYD----GSNKYYADSVKG | RFTISRDNSKNTLYLQMNSL RAEDTAVYYCAR | DDRSCSRTSC-----PYYYYGLDV | WGQGT TVTVS S |
| iPS:4 36732 | 21-225_152B12 | VH3/3-33/D4/4-23/RF2/JH6 | QVVVES-GGGVVQPGRSLRLSCAASG-FTFS | D------YGMH | WVRQAPGK GLEWVA | VIWYD----GSNKYYADSVKG | RFTISRDNSKNTLYLQMNSL RAEDTAVYYCAR | DDRSCSRTSC-----PYYYYGLDV | WGQGT TVTVS S |
| iPS:4 36734 | 21-225_153A8 | VH3/3-33/D4/4-23/RF2/JH6 | QVQLMES-GGGVVQPGRSLRLSCAASG-FTFS | D------YGMH | WVRQAPGK GLEWMT | LIWYD----GSNKYYADSVKG | RFTISRDNSKNTLYLQMNSL RAEDTAVYYCAR | DDRSCSRTSC-----PYYYYGMDV | WGQGT TVTVS S |
| iPS:4 36736 | 21-225_153E8 | VH3/3-33/D4/4-23/RF2/JH6 | QVQLVES-GGGVVQPGRSLRLSCAASG-FILS | N------YGMH | WVRQAPGK GLEWVA | VIWFD----GSNKYYADSVKG | RFTISRDNSKNTLYLQMNSL RAEDTAVYYCAR | DRVEGSGTP-----YYYYGMDV | WGQGT TVTVS S |
| iPS:4 36756 | 21-225_146A10 | VH3/3-33/D4/4-23/RF2/JH6 | QVQLEES-GGGVVQPGRSLRLSCAASG-FTFS | G------YGMH | WVRQAPGK GLEWVA | LIRYD----GSDKNYADSVKG | RFTISRDNSKNTLYLQMNSL RAEDTAVYYCAR | DRVFCSSTSCL---SYYYYGMDV | WGQGT TVTVS S |
| iPS:4 36766 | 21-225_158D10 | VH3/3-33/D4/4-23/RF2/JH6 | QVQLVES-GGGVVQPGRSLRLSCAASG-FTFS | S------YGMH | WVRQAPGK GLEWVA | VIWYD----GSNKYYADSVKG | RFTISRDNSKNTLYLQMNSL RAEDTAVYYCAR | DRVSCSSTSC-----PYYYYGMDV | WGQGT TVTVS S |
| iPS:4 36768 | 21-225_159H8 | VH3/3-33/D4/4-23/RF2/JH6 | QVQLVES-GGGVVQPGRSLRLSCAASG-FTFS | T------YGMH | WVRQAPGK GLEWVA | VIWYD----GSNKYYADSVKG | RFTISRDNSKNTLYLQMNSL RAEDTAVYYCAR | DRVSCSSTSC-----PYYYYGMDV | WGQGT TVTVS S |
| iPS:4 36770 | 21-225_160B12 | VH3/3-33/D4/4-23/RF2/JH6 | QVQLVES-GGGVVQPGRSLRLSCAASG-FTFS | S------YGMH | WVRQAPGK GLEWVA | VIWYD----GSNKYYADSVKG | RFTISRDNSKNTLYLQMNSL RAEDTAVYYCAR | DRVSCSSTSC-----PYYYYGMDV | WGQGT TVTVS S |

Figure 51 (Continued)

| | | | | | | | | |
|---|---|---|---|---|---|---|---|---|
| iPS:4 36782 | 21-225_166G11 | VH3J3-33\|D4J4-23\|RF2\|JH6 | QVQLVES-GGGVVQPGRSLRLSCAASG-FTFN | G-----YGMH | WVRQAPGK GLEWVA | VIWYD----GSNKYYADSVKG | RFTISRDTSKNTLFLQMNSL TAEDTAVYYCAR | DDRYCSSPTCH---------PYYYYYGLDV | WGQGT TVTVS S |
| iPS:4 36794 | 21-225_170F1 | VH3J3-33\|D4J4-23\|RF2\|JH6 | QVQLVES-GGGVVQPGRSLRLSCAASG-FTFS | G-----YGMN | WVRQAPGK GLEWVA | IIWYD----GNNKYYADSVKG | RFTISRDNSKNTLYLQMNSL RAEDTAVYYCAR | DRVYCSTSCH---------PYYYYAMDV | WGQGT TVTVS S |
| iPS:4 36836 | 21-225_52H1 | VH3J3-33\|D4J4-23\|RF2\|JH6 | QVQLVES-GGGVVQPGRSLRLSCAASG-FTFS | G-----YGMH | WVRQAPGK GLEWVA | VIWYD----GSNKYYADSVKG | RFTISRDNSKNTLYLQMNSL RAEDTAVYYCAR | DRVYCSSSCS---------YYYYYGMDV | WGQGT TVTVS S |
| iPS:4 36922 | 21-225_78E9 | VH3J3-33\|D4J4-23\|RF2\|JH6 | QVQLVES-GGGVVQPGRSLRLSCAASG-FTFS | S-----YGMH | WVRQAPGK GLEWVA | VIWYD----GNNKYYADSVKG | RFTISRDISKNTLYLQMNSL RAEDTAVYYCAR | DRDYCSST-C---------PYYYYGMDV | WGQGT TVTVS S |
| iPS:4 36924 | 21-225_74B3 | VH3J3-33\|D4J4-23\|RF2\|JH6 | QVQLVES-GGGVVQPGRSLRLSCAASG-FTFS | R-----YGMH | WVRQAPGK GLEWVA | VFWYD----GSNKYYADSVKG | RFTISRDNSKNTLYLQMNSL RAEDTAVYYCAR | DRDYCSTSC----------PYYYYGMDV | WGQGT TVTVS S |
| iPS:4 36928 | 21-225_79E7 | VH3J3-33\|D4J4-23\|RF2\|JH6 | QVQLVES-GGGVVQPGRSLRLSCAASG-FTFS | S-----YGMH | WVRQAPGK GLEWVA | VIWYD----GNNKYYADSVKG | RFTISRDISKNTLYLQMNSL RAEDTAVYYCAR | DRDYCSST-C---------PYYYYGMDV | WGQGT TVTVS S |
| iPS:4 36932 | 21-225_92A4 | VH3J3-33\|D4J4-23\|RF2\|JH6 | QVQLVES-GGGVVQPGRSLRLSCAASG-FTFS | S-----YGMH | WVRQAPGK GLEWVA | VIWYD----GNNKYYADSVKG | RFTISRDISKNTLYLQMNSL RAEDTAVYYCAR | DRDYCSTSC----------PYYYYGMDV | WGQGT TVTVS S |
| iPS:4 36936 | 21-225_97E6 | VH3J3-33\|D4J4-23\|RF2\|JH6 | QVQLVES-GGGVVQPGRSLRLSCAASG-FTFS | S-----YGMH | WVRQAPGK GLEWVA | VIWYD----GNNKYYADSVKG | RFTISRDNSKNTLYLQMNSL RAEDTAVYYCAR | DRDYCSTSC----------PYYYYGMDV | WGQGT TVTVS S |
| iPS:4 37190 | 21-225_225A9 | VH3J3-33\|D4J4-23\|RF2\|JH6 | QVQLVES-GGGVVQPGRSLRLSCAASG-FTFS | I-----YGMH | WVKLAPGK GLEWVA | VIWYD----GSNKYYADSVKG | RFTISRDISQNTLYLQMNSL RAEDTAVYYCAR | DNHYCSTSC----------PYYYFGMDV | WGQGT TVTVS S |
| iPS:4 37254 | 21-225_149F2 | VH3J3-33\|D4J4-23\|RF2\|JH6 | QVQLGEA-GGGVVQPGRSLRLSCAASG-FTFS | R-----YGMH | WVRQAPGK GLEWVA | FIWYD----GSENYADSVKG | RFTISRVNSRNTLYLQMNSL RAEDTAVYYCAR | DRVEGSGTP----------YYYYGMDV | WGQGT TVTVS S |
| iPS:4 37256 | 21-225_150F11 | VH3J3-33\|D4J4-23\|RF2\|JH6 | QVQLGEA-GGGVVQPGRSLRLSCAASG-FTFS | R-----YGMH | WVRQAPGK GLEWVA | FIWYD----GSENYYADSVKG | RFTISRVNSRNTLYLQMNSL RAEDTAVYYCAR | DRVEGSGTP----------YYYYGMDV | WGQGT TVTVS S |
| iPS:4 51110 | 21-225_74C9 | VH3J3-33\|D4J4-23\|RF2\|JH6 | QVQLVES-GGGVVQPGRSLRLSCAASG-FTFS | S-----YGMH | WVRQAPGK GLEWVA | VIWYD----GNNKYYADSVKG | RFTISRDISKNTLYLQMNSL RAEDTAVYYCAR | DRDYCSTSC----------PYYYYGMDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92589 | 21-225_27H2 | VH3/3-33/D4/4-23/RF2/J H6 | QVQLVES-GGGVVQPGRSLRL SCAASG-FTFS | G-----YGMH | WVRQAPGK GLEWVA | VIWYD----GSNKYYADS VKG | RFTISRDNSKNTLFLQMNSL RAEDTAVYYCAR | DRVYCSTSCS------PYYYYGMDV | WGQGT TVTVS S |
| iPS:3 93166 | 21-225_27G6 | VH3/3-33/D4/4-23/RF2/J H6 | QVQLVES-GGGVVQPGRSLRL SCAASG-FTFS | G-----YGMH | WVRQAPGK GLEWVA | LIWYD----GSKKYNADS VKG | RFTISRDNSKNTLYLQMNSL RAEDTAVYYCAR | DRVYCSTSCS------PYYYYGMDV | WGQGT TVTVS S |
| iPS:3 93198 | 21-225_28A11 | VH3/3-33/D4/4-23/RF2/J H6 | QVQLVES-GGGVVQPGRSLRL SCAASG-FTFS | G-----YGLH | WVRQAPGK GLEWVA | LIWYD----GNNTYYADS VKG | RFTISRDNSKNTLYLQMNSL RAEDTAVYYCAR | DRVYCSTSCS------PYYYYGMDV | WGQGT TVTVS S |
| iPS:3 93204 | 21-225_8C12 | VH3/3-33/D4/4-23/RF2/J H6 | QVQLVES-GGGVVQPGRSLRL SCAASG-FTFG | S-----YGMH | WVRQAPGK GLEWVA | LIWYD----GSNKYYADS VKG | RFTISRDNSKNTLYLQMNSL RAEDTAVYYCAR | DRVSCSSSCY------FYYYYGMDV | WGQGT TVTVS S |
| | Germline | | H_FR1 | H_CDR1 | H_FR2 | H_CDR2 | H_FR3 | H_CDR3 | H_FR4 |
| VH1/1-02/D4/4-11/RF2/JH4 | | | | | | | | | |
| iPS:4 53447 | 21-225_65F10 | VH1/1-02/D4/4-11/RF2/J H4 | QVQLVQS-GAEVKKPGASVKV SCKASG-YTFT | G-----YHMH | WVRQAPGQ GLEWMG | WINPN----NGGTSYAQK FQD | RVNMTRDTSISTAYMELSRL RSDDTAVYYCAR | DSRS-------------SWDY | WGQGT LVTVS S |
| iPS:4 34145 | 21-225_55B1 | VH1/1-02/D4/4-11/RF2/J H4 | QVQLVQS-GAEVKKPGASVKV SCKASG-YTFT | G-----YYFH | WVRQAPGQ GLEWMG | WIHPN----MNATNYAQK FQG | RVTMTRDTSISTAYMELSRL RSDDTAVYYCAR | DGRS-------------SFDY | WGQGT LVTVS S |
| iPS:4 34277 | 21-225_57A7 | VH1/1-02/D4/4-11/RF2/J H4 | QVQLVQS-GAEVKKPGASVKV SCKASG-YTFT | G-----YHIH | WVRQAPGQ DLEWMG | WINPN----NNGTNYAQK FQG | RVTMTRDTSISTAYMELSRL RSDDTAVYYCAR | DGRS-------------GFDY | WGQGT LVTVS S |
| iPS:4 34389 | 21-225_66F11 | VH1/1-02/D4/4-11/RF2/J H4 | QVQLVQS-GAEVKKPGASVKV SCKASG-YTFT | G-----YHMH | WVRQAPGQ GLEWMG | WINPN----NGGTHYAQK FQD | RVTMTRDTSISTAYMELSRL RSDDTAVYYCAR | DSRS-------------SWDY | WGQGT LVSVS S |
| iPS:4 34423 | 21-225_70D1 | VH1/1-02/D4/4-11/RF2/J H4 | QVQLVQS-GAEVKKPGASVKV SCKASG-YTFT | G-----YHMH | WVRQAPGQ GLEWMG | WINPN----SNATNYAQK FQG | WVTMTRDTSISTAYMELSRL RSDDTAVYYCAR | DSIS-------------SWDY | WGQGT LVTVS S |
| iPS:4 37234 | 21-225_64E2 | VH1/1-02/D4/4-11/RF2/J H4 | QVQLVQS-GAEVKKPGASVKV SCKASG-YTFT | G-----YYMH | WVRQAPGQ GLEWMG | WINPN----NNGTNYAQK FQG | RVTMTRDTSISTAYMELSRL RSDDTAVYYCAR | DGSS-------------GFDY | WGQGT LVTVS S |
| | Germline | | H_FR1 | H_CDR1 | H_FR2 | H_CDR2 | H_FR3 | H_CDR3 | H_FR4 |
| VH4/4-59/D/T-27/RF1/JH4 | | | | | | | | | |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 53449 | 21-225_208A2 | VH4|4-59|D7|7-27|RF1|J H4 | QVQLQES-GPGLVKPSETLSLNCTVSG-GSIR | S------YYWS | WIRQPAGKGLEWIG | RIYT----SGSTYNPSLKS | RITMSVDTSKNQFSLKLSSVTAADTAVYYCAR | GFGD------------WDY | WGQGTLVTVSS |
| iPS:4 35451 | 21-225_152D10 | VH4|4-59|D7|7-27|RF1|J H4 | QVQLQES-GPGLVKPSETLSLTCTVSG-GSIS | N------YYWS | WIRQPAGKGLEWIG | RIDT----SGITNYNPSLKS | RVTMSVDTSKNQFSLKLTSVTAADTAVYYCAR | EGGLGA----------TFFDY | WGQGTLVTVSS |
| iPS:4 35467 | 21-225_153B9 | VH4|4-59|D7|7-27|RF1|J H4 | QVQLQES-GPGLVKPSETLSLTCTVSG-GSIS | S------YYWS | WIRQPAGKGLEWIG | RIDT----SGITNYNPSLKS | RVTMSVDTSKNQFSLKLTSVTAADTAVYYCAR | EGGVGA----------TYFDY | WGQGTLVTVSS |
| iPS:4 35545 | 21-225_158F4 | VH4|4-59|D7|7-27|RF1|J H4 | QVQLQES-GPGLVKPSETLSLTCTVSG-GSIS | S------HFWS | WIRQPAGKGLEWIG | RIYT----SGTTNYTPSLKS | RVTMSVDTSKNQFSLKLSSVTAADTAVYYCAR | LSSG------------WFDY | WGQGTLVTVSS |
| iPS:4 35665 | 21-225_169F2 | VH4|4-59|D7|7-27|RF1|J H4 | QVQLQES-GPGLVKPSETLSLTCTVSG-GSIS | S------YYWS | WIRQPAGKGLEWIG | RIDT----SGITNYNPSLKS | RVTMSIDTSKSQISLKLSSVTAADTAVYYCAR | EGGVGA----------TYFDY | WGQGTLVTVSS |
| iPS:4 35671 | 21-225_169H5 | VH4|4-59|D7|7-27|RF1|J H4 | QVQLQES-GPGLVKPSETLSLTCTVSG-GSIS | S------YYWS | WIRQPAGKGLEWIG | RIDT----SGITNYNPSLKS | RVTMSVDTSKSQISLKLSSVTAADTAVYYCAR | EGGVGA----------TYFDY | WGQGTLVTVSS |
| iPS:4 36354 | 21-225_210G10 | VH4|4-59|D7|7-27|RF1|J H4 | QVQLQES-GPGLVKPSETLSLNCTVSG-GSIR | S------YYWS | WIRQPAGKGLEWIG | RIYT----SGSTDYNPSLKS | RITMSVDTSKNQFSLKLSSVTAADTAVYYCAR | GFGD------------WDY | WGQGTLVTVSS |
| | Germline VH4|4-34|D4|4-17|RF2|H6 | | QVQLQQW-GAGLLKPSETLSLTCAVNG-GPFS | G------CYWS | WIRQPPGKGLEWIG | EINY----SGRTNFNPSLKS | RVTISVDTSKNQFSLKLSSVTAADTAVYYCAR | YYGMDV | WGQGTTVTVSS |
| iPS:4 68810 | 21-225_74D5 | VH4|4-34|D4|4-17|RF2|H6 | QVQLQQW-GAGLLKPSETLSLTCAVNG-GPFS | G------CYWS | WIRQPPGKGLEWIG | EINY----SGRTNFNPSLKS | RVTISVDTSKNQFSLKLSSVTAADTAVYYCAR | DYGG------------MDV | WGQGTTVTVSS |
| iPS:4 68832 | 21-225_76H10 | VH4|4-34|D4|4-17|RF2|H6 | QVQLQQW-GAGLLKPSETLSLTCAVNG-GPFS | G------CYWS | WIRQPPGKGLEWIG | EINY----SGRTNFNPSLKS | RVTISVDTSKNQFSLKLSSVTAADTAVYYCAR | DYGG------------MDV | WGQGTTVTVSS |
| iPS:4 68834 | 21-225_94G10 | VH4|4-34|D4|4-17|RF2|H6 | QVQLQQW-GAGLLKPSETLSLTCAVNG-GPFS | G------CYWS | GIRQPPGKGREWIG | EINY----SGRTNFNPSLKS | RVTISVDTSKNQFSLKLSSVTAADTAVYYCAR | DYGG------------MDV | WGQGTTVTVSS |
| iPS:4 68838 | 21-225_80E12 | VH4|4-34|D4|4-17|RF2|H6 | QVQLQQW-GAGLLKPSETLSLTCAVNG-GPFS | G------CYWS | WIRQPPGKGLEWIG | EINY----SGRTNFNPSLKS | RVTISVDTSKNQFSLKLSSVTAADTAVYYCAR | DYGG------------MDV | WGQGTTVTVSS |

Figure 51 (Continued)

| | | | | | | | | |
|---|---|---|---|---|---|---|---|---|
| iPS:4 68820 | 21-225_76E10 | VH4(4-34/D4(4-17)RF2/J H6 | QVQLQQW-GAGLLKPSETLSL TCAVNG-GEFS | G-----SYWS | WIRQPPGK GLEWIG | EINY----LKS | RVTISVDTSKNQFSLKLSSV TAADTAVYYCAR | DYGG--------MDV | WGQGT TVTVS S |
| iPS:4 34473 | 21-225_76D1 | VH4(4-34/D4(4-17)RF2/J H6 | QVQLQQW-GAGLLKPSETLSL TCAVYS-GSFS | G-----CYWS | WIRQPPGK GLEWIG | EINH----SGRTNFNPS LKS | RVTISVDTSKNQFSLKLSSV TAADTAVYYCAR | DYGG--------MDV | WGQGT TVTVS S |
| iPS:4 34495 | 21-225_74B2 | VH4(4-34/D4(4-17)RF2/J H6 | QVQLQQW-GAGLLKPSEFLSL TCAVHG-GSFS | G-----PYWS | WIRQPPGK GLEWIG | EINH----SGSTNYNPS LTS | RVTISVDTSKNQFSLKLTSV TAADSAVYYCAR | DYGG--------LDV | WGQGT TVTVS S |
| iPS:4 34497 | 21-225_76A4 | VH4(4-34/D4(4-17)RF2/J H6 | QVQLQQW-GAGLLKPSETLSL TCAVNG-GEFS | G-----CYWS | WIRQPPGK GLEWIG | EINH----SGRTNFNPS LKS | RVTISVDTSKNQFSLKLSSV TAADTAVYYCAR | DYGG--------MDV | WGQGT TVTVS S |
| iPS:4 34501 | 21-225_76G4 | VH4(4-34/D4(4-17)RF2/J H6 | QVQLQQW-GAGLLKPSETLSL TCAVHG-GSFS | G-----CYWS | WIRQPPGK GLEWIG | EINH----SGSTNYNPS LKS | RVTISVDTSKNQFSLKLTSV TAADTAVYYCAR | DYGG--------MDV | WGQGT TVTVS S |
| iPS:4 34507 | 21-225_74C5 | VH4(4-34/D4(4-17)RF2/J H6 | QVQLQQW-GAGLLKPSETLSL TCAVNG-GEFS | G-----CYWS | WIRQPPGK GLEWIG | EINH----SGCTNFNPS LKS | RVTISVDTSKNQFSLKLSSV TAADTAVYYCAR | DYGG--------MDV | WGQGT TVTVS S |
| iPS:4 34523 | 21-225_75C3 | VH4(4-34/D4(4-17)RF2/J H6 | QVQLQQG-GAGPLKPSETLSL TCAVYG-GSFS | G-----CYWS | WIRQPPGK GLEWIG | EINY----SGRTNYNPS LKS | RVTISVDTSKNQFSLKLSSV TAADTAVYYCAR | DYGG--------MDV | WGQGT TVTVS S |
| iPS:4 34533 | 21-225_85F7 | VH4(4-34/D4(4-17)RF2/J H6 | QVQLQQW-GAGLLKPSEFLSL TCAVYG-GSFS | G-----PYWS | WIRQPPGK GLEWIG | EINH----SGSTNYNPS LKS | RVTISVDTSKNQFSLKLTSV TAADTAVYYCAR | DYGG--------LDV | WGQGT TVTVS S |
| iPS:4 34547 | 21-225_74H5 | VH4(4-34/D4(4-17)RF2/J H6 | QVQLQQW-GAGLLKPSETLSL TCAVYG-GSFS | G-----CYWS | WIRQPPGK GLEWIG | EINH----SGRTNFNPS LKS | RVTISVDTSKNQFSLKLSSV TAADTAVYYCAR | DYGG--------MDV | WGQGT TVTVS S |
| iPS:4 34559 | 21-225_74D11 | VH4(4-34/D4(4-17)RF2/J H6 | QVQLQQW-GAGLLKPSETLSL TCAVNG-GEFS | G-----CYWS | WIRQPPGK GLEWIG | EINH----SGSTNYNPS LKS | RVTISVDTSKNQFSLKLSSV TAADTAVYYCAR | DYGG--------MDV | WGQGT TVTVS S |
| iPS:4 34561 | 21-225_77G1 | VH4(4-34/D4(4-17)RF2/J H6 | QVQLQQW-GAGLLKPSETLSL TCAVHG-GSFS | G-----CYWS | WIRQPPGK GLEWIG | EINH----SGSTNYNPS LKS | RVTISVDTSKNQFSLKLSSV TAADTAVYYCAR | DYGG--------MDV | WGQGT TVTVS S |
| iPS:4 34565 | 21-225_75B10 | VH4(4-34/D4(4-17)RF2/J H6 | QVQLQQW-GAGLLKPSETLSL KCDVYG-GSFS | G-----YYWS | WIRQPPGK GLEWIG | EINH----SGSTNYNPS LKS | RVTISVDTSKNQFSLKLSSV TAADTAVYYCAR | DYGG--------LDV | WGQGT TVTVS S |

Figure 51 (Continued)

| | | | | | | | | |
|---|---|---|---|---|---|---|---|---|
| iPS:4 34579 | 21-225_77F7 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34581 | 21-225_74B12 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34585 | 21-225_75A12 | VH4J4-34\|D4\|4-17\|RF2\|J H6 | QVQLQQG-GAGPLKPSETLSL TCAVHG-GSFS | G------CYWS | WIRQPPGK GLEWIG | EINH------SGRTNYNPS LKS | RVTISVDTSKNQFSLKLSSV TAADTAVYYCAR | DYGG------------MDV | WGQGT TVTVS S |
| iPS:4 34595 | 21-225_77A10 | VH4J4-34\|D4\|4-17\|RF2\|J H6 | QVQLQQG-GAGPLKPSETLSL TCAVYG-GSFS | G------CYWS | WIRQPPGK GLEWIG | EINY------SGRTNYNPS LKS | RVTISVDTSKNQFSLKLSSV TAADTAVYYCAR | DYGG------------MDV | WGQGT TVTVS S |
| iPS:4 34611 | 21-225_77C12 | VH4J4-34\|D4\|4-17\|RF2\|J H6 | QVQLQQW-GAGLLKPSETLSL TCAVYG-GAFS | G------SYWS | WIRQSPGK GLEWIG | EINY------RGSTNYNPS LKS | RVTISVDTSKNQFSLNLSSV TAADTAVYYCAR | DYGG------------MDV | WGQGT TVTVS S |
| iPS:4 34657 | 21-225_79G1 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34663 | 21-225_79F3 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34687 | 21-225_75A5 | VH4J4-34\|D4\|4-17\|RF2\|J H6 | QVQLQQW-GAGLLKPSETLSL TCAVHG-GSFS | G------CYWS | WIRQPPGK GLEWIG | EINY------SGSTNYNPS LKS | RVTISVDTSKNQFSLNLSSV TAADTAVYYCAR | DYGG------------MDV | WGQGT TVTVS S |
| iPS:4 34691 | 21-225_75G7 | VH4J4-34\|D4\|4-17\|RF2\|J H6 | QVQLQQW-GAGLLKPSETLSL TCTVYG-GAFS | G------SYWS | WIKQSPGK GLEWIG | EINY------RGSTNYNPS LKS | RVTISVDTSKNQFSLNLSSV TAADTAVYYCAR | DYGG------------MDV | WGQGT TVTVS S |
| iPS:4 34693 | 21-225_79F11 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34699 | 21-225_79G12 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34701 | 21-225_80A1 | VH4J4-34\|D4\|4-17\|RF2\|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |

Figure 51 (Continued)

| | | | | | | | | |
|---|---|---|---|---|---|---|---|---|
| iPS:4 34703 | 21-225_80C1 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34709 | 21-225_80E3 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34715 | 21-225_80D5 | VH4J4-34/D4/4-17/RF2/J H6 | QVQLQQW-GAGLLKPSEPLSL TCAVYG-GSFS | G------PYWS | WIRQPPGK GLEWIG | EINH----- SGSTNYNPS LKS | RVTISVDTSKNQFSLKLITSV TAADMAVYYCAR | DYGG---------- ---------LDV | WGQGT TVTVS S |
| iPS:4 34725 | 21-225_80H7 | VH4J4-34/D4/4-17/RF2/J H6 | QVQLQQW-GAGLLKPSETLSL TCAVYV-GSFS | G------SYWS | WIRQPPGK GLEWIG | EINQ----- SGRTNYNPS LKS | RVTISVDTSKNQFSLKLSSV TAADTAVYYCAR | DYGG---------- ---------IDV | WGQGT TVTVS S |
| iPS:4 34743 | 21-225_74A4 | VH4J4-34/D4/4-17/RF2/J H6 | QVQLQQW-GAGLLKPSETLSL TCAVYG-GSFS | G------CYWS | WIRQPPGK GLEWIG | EINY----- SGSTNYNPS LKS | RVTISVDTSKNQFSLKLSSV TAADTAVYYCAR | DYGG---------- ---------MDV | WGQGT TVTVS S |
| iPS:4 34751 | 21-225_80H12 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34759 | 21-225_81C5 | VH4J4-34/D4/4-17/RF2/J H6 | QVQLQQW-GAGLLKPSETLSL TCAVHG-GSFS | G------CYWS | WIRQPPGK GLEWIG | EINH----- RGSTNYNPS LKS | RVTISVDTSKNQFSLKLSSV TAADTAVYYCAR | DYGG---------- ---------MDV | WGQGT TVTVS S |
| iPS:4 34773 | 21-225_75D9 | VH4J4-34/D4/4-17/RF2/J H6 | QVQLQQW-GAGLLKPSETLSL TCAVHG-GSFS | G------PYWS | WIRQPPGK GLEWIG | EINH----- SGSTNYNPS LKS | RVTISVDTSKNQFSLNLSSV TAADTAVYYCAR | DYGG---------- ---------MDV | WGQGT TVTVS S |
| iPS:4 34777 | 21-225_81C11 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34809 | 21-225_74F5 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34821 | 21-225_83G1 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |
| iPS:4 34839 | 21-225_83B7 | VH4J4-34/D4/4-17/RF2/J H6 | QVQLQQW-GAGLLKPSETLSL TCAVHG-GSFS | G------CYWS | WIRQPPGK GLEWIG | EINH----- SGSTNYNPS LKS | RVTISVDTSKNQFSLKLSSV TAADTAVYYCAR | DYGG---------- ---------MDV | WGQGT TVTVS S |

Figure 51 (Continued)

| | | | | | | | | |
|---|---|---|---|---|---|---|---|---|
| iPS:4 34869 | 21-225_84E12 | VH4J4-34/D4J4-17/RF2/J H6 | QVQLQQW-GAGLLKPSETLSL TCAVYG-GSFS | G------SYWS | WIRQPPGK GLEWIG | EINQ------SGRTNYNPS LKS | RVTISVDTSKNQFSLKLSSV TAADTAVYYCAR | DYGG---------iDV | WGQGT TVTVS S |
| iPS:4 34879 | 21-225_85A3 | VH4J4-34/D4J4-17/RF2/J H6 | QVQLQQW-GAGLLKPSETLSL TCAVYG-GSFS | G------CYWS | WIRQPPGK GLEWIG | EINH------SGSTNYNPS LKS | RVTISVDTSKNQFSLKLSSV TAADTAVYYCAR | DYGG---------MDV | WGQGT TVTVS S |
| iPS:4 34881 | 21-225_85B4 | VH4J4-34/D4J4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG---------MDV | WGQGT TVTVS S |
| iPS:4 34887 | 21-225_85D6 | VH4J4-34/D4J4-17/RF2/J H6 | QVQLQQG-GAGPLKPSETLSL TCAVYG-GSFS | G------CYWS | WIRQPPGK GLEWIG | EINY------SGRTNYNPS LKS | RVTISVDTSKNQFSLKLSSV TAADTAVYYCAR | DYGG---------MDV | WGQGT TVTVS S |
| iPS:4 34895 | 21-225_74H7 | VH4J4-34/D4J4-17/RF2/J H6 | QVQLQQW-GAGLLKPSEPLSL TCAVYG-GSFS | G------PYWS | WIRQPPGK GLEWIG | EINH------SGSTNYNPS LKS | RVTISVDTSKNQFSLKLITSV TAADTAVYYCAR | DYGG---------LDV | WGQGT TVTVS S |
| iPS:4 34899 | 21-225_85B9 | VH4J4-34/D4J4-17/RF2/J H6 | QVQLQQW-GAGLLKPSETLSL TCAVYG-GSFS | G------CYWS | WIRQPPGK GLEWIG | EINH------SGRTNFMPS LKS | RVTISVDTSKNQFSLKLSSV TAADTAVYYCAR | DYGG---------MDV | WGQGT TVTVS S |
| iPS:4 34907 | 21-225_85G10 | VH4J4-34/D4J4-17/RF2/J H6 | QVQLQQR-GAGLLKPSETLSL TCAVYG-GSFS | G------CYWS | WIRQPPGK GLEWIG | EINH------SGITNYNPS LKS | RVTISVDTSKNQFSLKLTSV TAADTAVYYCAR | DYGG---------LDV | WGQGT TVTVS S |
| iPS:4 34913 | 21-225_86C1 | VH4J4-34/D4J4-17/RF2/J H6 | QVQLQQW-GAGLLKPSETLSL TCAVYG-GSFS | G------CYWS | WIRQPPGK GLEWIG | EINH------SGSTNYNPS LKS | RVTISVDTSKNQFSLKLSSV TAADTAVYYCAR | DYGG---------MDV | WGQGT TVTVS S |
| iPS:4 34921 | 21-225_86E4 | VH4J4-34/D4J4-17/RF2/J H6 | QVQLQQW-GAGLLKPSETLSL TCAVHG-GPFS | G------CYWS | WIRQPPGK GLEWIG | EINH------SGSTNYNPS LKS | RVTISVDTSKNQFSLKLSSV TAADTAVYYCAR | DYGG---------LDV | WGQGT TVTVS S |
| iPS:4 34939 | 21-225_86C11 | VH4J4-34/D4J4-17/RF2/J H6 | QVQLQQW-GAGLLKPSETLSL TCAVYG-GSFS | G------CYWS | WIRQPPGK GLEWIG | EINH------SGRTNYNPS LKS | RVTISVDTSKNQFSLKLSSV TAADTAVYYCAR | DYGG---------MDV | WGQGT TVTVS S |
| iPS:4 34943 | 21-225_87H1 | VH4J4-34/D4J4-17/RF2/J H6 | QVQLQPW-GAGLLKPSETLSL TCAVYG-GSFS | G------YYWS | WIRQPPGK GLEWIG | EINH------SGRTNYNPS LKS | RVTISVDTSKDQFSLKLSSV TAADTAVYYCAR | DYGG---------LDV | WGQGT TVTVS S |
| iPS:4 34945 | 21-225_87E5 | VH4J4-34/D4J4-17/RF2/J H6 | QVQLQQW-GAGLLKPSETLSL TCAVYG-GSFS | G------CYWS | WIRQPPGK GLEWIG | EINH------SGSTNYNPS LKS | RVTISVDTSKNQFSLKLSSV TAADTAVYYCAR | DYGG---------MDV | WGQGT TVTVS S |

Figure 51 (Continued)

| | | | | | | | | |
|---|---|---|---|---|---|---|---|---|
| iPS:4 34955 | 21-225_87C9 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34961 | 21-225_87A12 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34969 | 21-225_88H1 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34981 | 21-225_88E7 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34983 | 21-225_88F7 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34995 | 21-225_88G9 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 34999 | 21-225_75A8 | VH4/4-34/D4/4-17/RF2/J H6 | QVQLQQW-GAGLLKPSETLSL TCAVHG-GSFS | G------CYWS | WIRQPPGK GLEWIG | EINY------SGSTNFNPS LKS | RVTISVDTSKNQFSLKLSSV TAADTAVYYCAR | DYGG------------MDV | WGQGT TVTVS S |
| iPS:4 35013 | 21-225_89D5 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35015 | 21-225_89H5 | VH4/4-34/D4/4-17/RF2/J H6 | QVQLQQW-GAGLLKPSETLSL TCAVHG-GSFS | G------CYWS | WIRQPPGK GLEWIG | EINH------SGRTSYNPS LKS | RVTISADTSKNQFSLKLSSV TAADTAVYYCAR | DYGG------------MDV | WGQGT TVTVS S |
| iPS:4 35025 | 21-225_89E10 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35029 | 21-225_89A11 | VH4/4-34/D4/4-17/RF2/J H6 | QVQLQPW-GAGLLKPSETLSL TCAVYG-GSFS | G------YYWS | WIRQPPGK GLEWIG | EINH------SGSTNYNPS LKS | RVTISVDTSKNQFSLKLSSV TAADTAVYYCAR | DYGG------------LDV | WGQGT TVTVS S |
| iPS:4 35039 | 21-225_90G4 | VH4/4-34/D4/4-17/RF2/J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |

Figure 51 (Continued)

| | | | | | | | | |
|---|---|---|---|---|---|---|---|---|
| iPS:4 35041 | 21-225_90A5 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35043 | 21-225_90G5 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35055 | 21-225_90F10 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35073 | 21-225_91B2 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35075 | 21-225_91B3 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35077 | 21-225_91F3 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35079 | 21-225_91B4 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35089 | 21-225_91E9 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35097 | 21-225_92B1 | VH4|4-34|D4|4-17|RF2|J H6 | QVQLQQW-GAGLLKPSETLSL TCAVHG-GSFS | G------SYWS | WIRQPPGK GLEWIG | EINY------RGSTNYNPS LKS | RVAISVDTSKNQFSLNLTSV TAADTAVYYCAR | DYGG------------------ | ------LDV | WGQGT TVTVS S |
| iPS:4 35111 | 21-225_92D6 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35115 | 21-225_77C5 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |
| iPS:4 35171 | 21-225_93C2 | VH4|4-34|D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------------ | ------MDV | WGQGT TVTVS S |

Figure 51 (Continued)

| | | | | | | | | |
|---|---|---|---|---|---|---|---|---|
| iPS:4 35177 | 21-225_93E4 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35195 | 21-225_94D3 | VH4J4-34D4J4-17JRF2J H6 | QVQLQQG-GAGPLKPSETLSL TCAVYG-GSFS | G------CYWS | WIRQPPGK GLEWIG | EINY------SGRTNYNPS LKS | RVTISVDTSKNQFSLKLSSV TAADTAVYYCAR | DYGG------------MDV | WGQGT TVTVS S |
| iPS:4 35217 | 21-225_94F12 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35219 | 21-225_95D2 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35235 | 21-225_95F9 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35237 | 21-225_95G9 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35239 | 21-225_95H10 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35273 | 21-225_97A2 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 35281 | 21-225_97E5 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 37324 | 21-225_75C2 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 37328 | 21-225_75D3 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |
| iPS:4 37332 | 21-225_75F3 | VH4J4-34D4J4-17JRF2J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG------------MDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 37344 | 21-225_75G12 | VH4|4-34/D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG----------MDV | WGQGT TVTVS S |
| iPS:4 37350 | 21-225_74A3 | VH4|4-34/D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG----------MDV | WGQGT TVTVS S |
| iPS:4 37369 | 21-225_74D6 | VH4|4-34/D4|4-17|RF2|J H6 | QVQLQQW-GAGLLKPSETLSL TCAVHG-GSFS | G------CYWS | WIRQPPGK GLEWIG | EINH------SGSTNYNPS LKS | RVTISVDTSKNQFSLKLSSV TAADTAVYYCAR | DYGG----------MDV | WGQGT TVTVS S |
| | Germline VH3|3-33/D4|4-17|RF2|J H6 | | | | | | | | |
| iPS:4 68814 | 21-225_223D11 | VH3|3-33/D4|4-17|RF2|J H6 | QVQLVES-GGGVVQPGRSLRL SCAASG-FTFS | N------YGMD | WVRQAPGK GLEWVA | VIWYD------GSNDYYADS VKG | RFTISRDNSKNTLFLQMNSL RAEDTAVYYCAR | DRGIGY---------NDMDV | WGQGT TVTVS S |
| iPS:4 34621 | 21-225_74D1 | VH3|3-33/D4|4-17|RF2|J H6 | QVQLVES-GGGVVQPGRSLRL SCAASG-FTFS | S------YGMH | WVRQAPGK GLEWVA | VIWYD------GINKNYADS VKG | RFTISRDNSKNTLYLQMNSL RAEDTAMYYCAR | DEGFGEFD---YYNYGMDV | WGQGT TVTVS S |
| iPS:4 34947 | 21-225_87B7 | VH3|3-33/D4|4-17|RF2|J H6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DFGVGY---------YGMDV | WGQGT TVTVS S |
| iPS:4 35819 | 21-225_190C11 | VH3|3-33/D4|4-17|RF2|J H6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DQGVGY---------DGLDV | WGQGT TVTVS S |
| iPS:4 35825 | 21-225_190G11 | VH3|3-33/D4|4-17|RF2|J H6 | QVQLVES-GGGVVQPGRSLRL SCAASG-FTFS | I------YGMH | WVRQAPGK GLEWVA | VIWYD------GSNKNYADS VKG | RFTISRDNSKNTLYLQMNSL RAEDTAVYYCAR | DQGVGY---------DGLDV | WGQGT TVTVS S |
| iPS:4 35837 | 21-225_198G3 | VH3|3-33/D4|4-17|RF2|J H6 | QVQLVES-GGGVVQPGRSLRL SCAASG-FTFS | T------YGMH | WVRQAPGK GLEWVA | VIWYD------GSNEHYADS VKG | RFTISRDNSKNTLCLQMNSL RAEDTAVYYCAR | DQGVGY---------DGLDV | WGQGT TVTVS S |
| iPS:4 35845 | 21-225_191G1 | VH3|3-33/D4|4-17|RF2|J H6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DRGVGY---------YGLDV | WGQGT TVTVS S |
| iPS:4 35859 | 21-225_190E6 | VH3|3-33/D4|4-17|RF2|J H6 | QVQLVES-GGGVVQPGRSLRL SCAASG-FTFS | S------YGMH | WVRQAPGK GLEWVA | VIWYD------GSNKNYADS VKG | RFTISRDNSKNTLYLQMNSL RAEDTAVYYCAR | DQGVGY---------DGLDV | WGQGT TVTVS S |

Figure 51 (Continued)

| | | | | | | | | |
|---|---|---|---|---|---|---|---|---|
| iPS:4 35873 | 21-225_190G4 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNTLYLQMNSL RAEDTAMYYCAR | DQGVGY---------DGLDV | WGQGT SVTVS S |
| iPS:4 35933 | 21-225_190F8 | VH3J3-33ID4J4-17IRF2IJ H6 | QVQLVES-GGGVVQPGRSLRLSCAASG-FTFS | T------YGMH | WVRQAPGK GLEWVA | VIWYD----GSNKNYADS VKG | RFTISRDNSKNTLYLQMNSL RAEDTAVYYCAR | DQGVGY---------DGLDV | WGQGT TVTVS S |
| iPS:4 35941 | 21-225_191E8 | VH3J3-33ID4J4-17IRF2IJ H6 | QVQLVES-GGGVVQPGRSLRLSCAASG-FTFS | N------YGMH | WVQAPGK GLEWVA | IIWFD----GSNQYYADS VKG | RFTISRDNSKNTLYLQLNSL RAEDTAMYYCAR | AHGVYY---------YAMDV | WGQGT TVTVS S |
| iPS:4 35945 | 21-225_191A10 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNTLYLQMNSL RAEDTAMYYCAR | DQGVGY---------DGLDV | WGQGT SVTVS S |
| iPS:4 35947 | 21-225_191E10 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNTLYLQMNSL RAEDTAMYYCAR | DQGVGY---------DGLDV | WGQGT SVTVS S |
| iPS:4 35957 | 21-225_191G12 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNTLYLQMNSL RAEDTAVYYCAR | DQGVGY---------DGLDV | WGQGT SVTVS S |
| iPS:4 35963 | 21-225_192D2 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNMLYLQMNSL RAEDTAVYYCAR | DRGVGY---------YGMDV | WGQGT TVTVS S |
| iPS:4 35971 | 21-225_192D3 | VH3J3-33ID4J4-17IRF2IJ H6 | QVQLVES-GGGVVQPGRSLRLSCAASG-FTFS | S------YGMH | WVRQAPGK GLEWVA | VIWYD----GSNEHYADS VKG | RFTISRDNSKNTLYLQMNSL RAEDTAVYYCAR | DRGVGY---------YGLDV | WGQGT TVTVS S |
| iPS:4 35979 | 21-225_192H4 | VH3J3-33ID4J4-17IRF2IJ H6 | QVQLVES-GGGVVQPGRSLRLSCAASG-FTFS | S------YGMH | WVRQAPGK GLEWVA | VLWYD----GTNKNYADS VKG | RFTISRDNSKNTLYLQMNSL RAEDTAVYYCAR | DQGVGY---------YGMDV | WGQGT TVTVS S |
| iPS:4 35987 | 21-225_192G6 | VH3J3-33ID4J4-17IRF2IJ H6 | QVQLVES-GGGVVQPGRSLRLSCAASG-FTFS | S------YGMH | WVRQAPGK GLEWVA | VIWYD----GSNEHYADS VKG | RFTISRDNSKNTLYLQMNSL RAEDTAVYYCAR | DQGVGY---------DGLDV | WGQGT TVTVS S |
| iPS:4 35993 | 21-225_192C8 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RPMISRDNSKNTLYLQMNSL RAEDTAVYYCAR | DRGVGY---------YGMDV | WGQGT TVTVS S |
| iPS:4 35997 | 21-225_192G8 | VH3J3-33ID4J4-17IRF2IJ H6 | QVQLVES-GGGVVQPGRSLRLSCAASG-FTFS | S------YGMH | WVRQAPGK GLEWVA | VIWYD----GSNKNYADS VKG | RFTISRDNSKNTLYLQMNSL RAEDTAVYYCAR | DQGVGY---------DGLDV | WGQGT TVTVS S |

Figure 51 (Continued)

| | | | | | | | | |
|---|---|---|---|---|---|---|---|---|
| iPS:4 36005 | 21-225_192H10 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAMYYCAR | DQGVGY--------DGLDV | WGQGT SVTVS S |
| iPS:4 36031 | 21-225_193C7 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAMYYCAR | DQGVGY--------DGLDV | WGQGT SVTVS S |
| iPS:4 36045 | 21-225_193A10 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRGVGY--------YGLDV | WGQGT TVTVS S |
| iPS:4 36076 | 21-225_194H11 | VH3J3-33|D4J4-17|RF2J H6 | QVQLVES-GGGVVQPGRSLRL SCAASG-FTFS | S------YGMH | WVRQAPGK GLEWVA | VIWYD----GSNEHYADS VKG | RFTISRDNSKNTLSLQMNSL RAEDTAVYYCAR | DRGVGY--------YGLDV | WGQGT TVTVS S |
| iPS:4 36086 | 21-225_191G10 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------DGLDV | WGQGT TVTVS S |
| iPS:4 36090 | 21-225_195A9 | VH3J3-33|D4J4-17|RF2J H6 | QVQLVES-GGGVVQPGRSLRL SCAASG-FTFS | S------YGMH | WVRQAPGK GLQWVA | VIWYD----GSNEHYADS VKG | RFTISRDNSKNTLYLQMNSL RAEDTAVYYCAR | DRGVGY--------YGLDV | WGQGT TVTVS S |
| iPS:4 36112 | 21-225_196C7 | VH3J3-33|D4J4-17|RF2J H6 | QVQLVES-GGGVVQPGRSLRL SCAASG-FTFS | S------YGMH | WVRQAPGK GLEWVA | VIWYD----GSNKHYADS VKG | RFTISRDNSKNTLYLQMNSL RAEDTAVYYCAR | DRGVGY--------YGLDV | WGQGT TVTVS S |
| iPS:4 36138 | 21-225_197F2 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------DGLDV | WGQGT SVTVS S |
| iPS:4 36152 | 21-225_197B6 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNMLYLQMNSL RAEDTAMYYCAR | DQGVGY--------DGLDV | WGQGT TVTVS S |
| iPS:4 36173 | 21-225_197G12 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAMYYCAR | DQGVGY--------DGLDV | WGQGT TVTVS S |
| iPS:4 36189 | 21-225_198B6 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------YGMDV | WGQGT TVTVS S |
| iPS:4 36201 | 21-225_199C5 | VH3J3-33|D4J4-17|RF2J H6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DQGVGY--------YGMDV | WGQGT TVTVS S |

Figure 51 (Continued)

| | | | | | | | | |
|---|---|---|---|---|---|---|---|---|
| iPS:4 36203 | 21-225_199A6 | VH3\|3-33\|D4\|4-17\|RF2\|J H6 | QVQLVES-GGGVVQPGRSLRL SCAASG-FTFS | N-----YGMH | WVRQAPGK GLEWVA | IIWFD----GSNQYYADS VKG | RFTISRDNSKNTLYLQLNSL RAEDTAVYYCAR | AHGVYY-------YAMDV | WGQGT TVTVS S |
| iPS:4 36282 | 21-225_204G6 | VH3\|3-33\|D4\|4-17\|RF2\|J H6 | QVQLVES-GGGVVQPGRSLRL SCTASG-FTFS | S-----YGMH | WVRQAPGK GLEWVA | VIWYD----GSNKNYADS VKG | RFTISRDNSKNTLYLQMNSL RAEDTAVYYCAR | DRGVGY-------DGMDV | WGQGT TVTVS S |
| iPS:4 36296 | 21-225_205F5 | VH3\|3-33\|D4\|4-17\|RF2\|J H6 | QVQLVES-GGGVVQPGRSLRL SCAASG-FTFS | R-----YGMH | WVRQAPGK GLEWVA | VIWYD----GSNENYVDS VKG | RFTISRDTSKKRMLFLQMNSL RTDDTAVYYCAR | DMGIGY-------YGMDV | WGQGT TVTVS S |
| iPS:4 36324 | 21-225_207G6 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNKNYAES VKG | RFTISRDNSKNTLYLQMNSL RAEDTAVYYCAR | DAGIGY-------YGIDV | WGQGT TVTVS S |
| iPS:4 36364 | 21-225_211A11 | VH3\|3-33\|D4\|4-17\|RF2\|J H6 | QVQLVGS-GGGVVQPGRSLRL SCAASG-FTFS | S-----YGMH | WVRQAPGK GLEWVA | VLWFD----GSNRNYVDS VKG | RFTISRDNSKNTLYLQMNSL RAEDTAVYYCAR | DRGVGY-------YGTDV | WGQGT TVTVS S |
| iPS:4 36372 | 21-225_211A8 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNEHYADS VKG | RFTISRDNSKKTLYLQMNSL RAEDTAVYYCAR | DHGVGY-------YGMDV | WGQGT TVTVS S |
| iPS:4 36376 | 21-225_212E6 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNKNYVDS VKG | RFTISRDNSKNTLYLQMNSL RAEDTAVYYCAR | DYGVGY-------YGTDV | WGQGT TVTVS S |
| iPS:4 36378 | 21-225_212D7 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNKNYADS VKG | RFTISRDNSKNTLSLQMNSL RAEDTAVYYCAR | DYGVGY-------YGIDV | WGQGT TVTVS S |
| iPS:4 36380 | 21-225_212H9 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNEKYADS VKG | RFTISRDNSKKTLYLQMNSL RAEDTAVYYCAR | DHGVGY-------YGMDV | WGQGT TVTVS S |
| iPS:4 36384 | 21-225_212F10 | VH3\|3-33\|D4\|4-17\|RF2\|J H6 | QVQLVES-GGGVVQPGRSLRL SCAASG-FTFS | R-----YGMH | WVRQAPGK GLEWVA | VIWYD----GSNKHYADS VKG | RFTISRDNSKNTLYLQMNSL RGEDTAVYYCAR | DRGVGY-------NGMDV | WGQGT TVTVS S |
| iPS:4 36390 | 21-225_213D2 | VH3\|3-33\|D4\|4-17\|RF2\|J H6 | QVQLVES-GGGVVQPGRSLRL SCAASG-FTFS | S-----YGMH | WVRQAPGK GLEWVA | VIWYD----GSNKHYADS VKG | RFTISRDNSKNTLSLQMNSL RAEDTAVYYCAR | DYGVGY-------YGIDV | WGQGT TVTVS S |
| iPS:4 36394 | 21-225_213C4 | VH3\|3-33\|D4\|4-17\|RF2\|J H6 | QVQLVES-GGGVVQPGRSLRL SCATSG-FTFS | S-----YGMH | WVRQAPGK GLEWVA | VIWYD----GSNKHYADS VKG | RFTISRDNSKNTLYLQMNSL RAEDTAVYYCAR | DYGVGY-------DGMDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36398 | 21-225_213B8 | VH3|3-33/D4|4-17|RF2|J H6 | QVQLVES-GGGVVQPGRSLRLSCAASG-FTFS | S-----YGMH | WVRQAPGK GLEWVA | VIWYD----GSNKHYADS VKG | RFTISRDNSKNTLYLQMNSL RAEDTAVYYCAR | DYGVGY--------YGTDV | WGQGT TVTVS S |
| iPS:4 36404 | 21-225_214C3 | VH3|3-33/D4|4-17|RF2|J H6 | QVQLVES-GGGVVQPGRSLRLSCAASG-FTFS | S-----YGMH | WVRQAPGK GLEWVA | VIWYD----GSNKNYGDS VKG | RFTISRDNSKNTLYLQMNSL RAEDTAVYYCAR | DRGVGY--------DGMDV | WGQGT TVTVS S |
| iPS:4 36410 | 21-225_212E10 | VH3|3-33/D4|4-17|RF2|J H6 | QVQLVES-GGGVVQPGRSLRLSCAASG-FTFS | S-----YGMH | WVRQAPGK GLEWVA | VIWYD----GSNKNYADS VKG | RFTISRDNSKNTLSLQMNSL RAEDTAVYYCAR | DYGVGY--------YGTDV | WGQGT TVTVS S |
| iPS:4 36420 | 21-225_215B5 | VH3|3-33/D4|4-17|RF2|J H6 | QVQLVES-GGGVVQPGRSLRLSCAASG-FTFS | S-----YGMH | WVRQAPGK GLEWVA | VIWYD----GSNKNYADS VKG | RFTISRDNSKNTLYLQMNSL RAEDTAVYYCAR | DYGVGY--------YGTDV | WGQGT TVTVS S |
| iPS:4 36422 | 21-225_215D6 | VH3|3-33/D4|4-17|RF2|J H6 | QVQLVES-GGGVVQPGRSLRLSCAASG-FTFS | S-----YGMH | WVRQAPGK GLEWVA | VIWYD----GSNKNYADS VKG | RFTISRDNSKNTLYLQMNSL RAEDTAVYYCAR | DCGVGY--------YGTDV | WGQGT TVTVS S |
| iPS:4 36430 | 21-225_215A12 | VH3|3-33/D4|4-17|RF2|J H6 | QVQLVES-GGGVVQPGRSLRLSCAASG-LIFS | S-----YGMH | WVRQAPGK GLEWVA | VIWYD----GSNEHYADS VKG | RFTISRDNSKNTLYLQMNSL RAEDTAVYYCAR | DRGVGY--------YGMDV | WGQGT TVTVS S |
| iPS:4 36452 | 21-225_217G5 | VH3|3-33/D4|4-17|RF2|J H6 | QVQLVES-GGGVVQPGRSLRLSCAASG-FTFS | S-----NGMH | WVRQAPGK GLEWVA | VIWYD----GSNKNYADS VKG | RFTISRDNSKNTLYLQMNSL RAEDTAVYYCAR | DYGVGY--------YGLDV | WGQGT TVTVS S |
| iPS:4 36464 | 21-225_219H1 | VH3|3-33/D4|4-17|RF2|J H6 | QVQLVES-GGGVVQPGRSLRLSCAASG-FTFS | R-----YGMH | WVRQAPGK GLEWVA | VIWYD----GSNKNYADS VKG | RFTISRDNSKNTLYLQMNSL RGEDTAVYYCAR | DRGVGY--------NGMDV | WGQGT TVTVS S |
| iPS:4 51120 | 21-225_197D3 | VH3|3-33/D4|4-17|RF2|J H6 | QVQLVES-GGGVVQPGRSLRLSCAASG-FTFS | S-----HGMH | WVRQAPGK GLEWVA | VIWYD----GSNEHYADS VKG | RFTISRDNSKNTLYLQMNSL RAEDTAVYYCAR | DQGVGY--------YGMDV | WGQGT TVTVS S |
| | Germline VH3|3-33/D4|4-17|RF2|H4 | QVQLVES-GGGVVQPGRSLRLSCAASG-FTFS | S-----YGMH | WVRQAPGK GLEWVA | IIWYD----GSNKYYADS VKG | RFTISRDNSKNTLYLQMNSL RAEDTAVYYCAR | DYGGY--------YFDY | WGQGT LVTVS S |
| iPS:4 68822 | 21-225_147E10 | VH3|3-33/D4|4-17|RF2|J H4 | QVQLVES-GGGVVQPGRSLRLSCAASG-FTFS | N-----YGLH | WVRQAPGK GLEWVA | IIWYD----GSNKYADS VKG | RFTISRDNSKNTLYLQMNSL RAEDTAVYYCAR | DHYDFW--------SGHFDY | WGQGT LVTVS S |
| iPS:4 33965 | 21-225_46F2 | VH3|3-33/D4|4-17|RF2|J H4 | QVQLVES-GGGVVQPGRSLRLSCAASG-FTFS | S-----YGMH | WVRQAPGK GLEWVA | IIWYD----GSNKYVDS VKG | RFTISRDNSKNTLYLQMNSL RAEDTAVYYCAR | DRYDFW--------SGYFDY | WGQGT LVTVS S |

Figure 51 (Continued)

| | | | | | | | | |
|---|---|---|---|---|---|---|---|---|
| iPS:4 34255 | 21-225_62E6 | VH3/3-33/D4/4-17/RF2/JH4 | QVQLVES-GGGVVQPGRSLRLSCAASG-FTFS | S-----YGMH | WVRQAPGK GLEWVA | AIWYD----GSNKYYGDS VKG | RVTISRDNSKNSLHLQMNSL RAEDTAVYYCAR | DQGIVG--------ATWFDY | WGQGT LVTVS S |
| iPS:4 34269 | 21-225_57H3 | VH3/3-33/D4/4-17/RF2/JH4 | QVQLVES-GGGVVQPGRSLRLSCAASG-FTFS | S-----YGMH | WVRQAPGK GLEWVA | AIWYD----GSNKYYADS VKG | RFTISRDNSKNTLYLQMNSL RAEDTAVYYCAR | DYGIVG--------ATYFDY | WGQGT LVTVS S |
| iPS:4 34345 | 21-225_64H9 | VH3/3-33/D4/4-17/RF2/JH4 | QVQLVES-GGGVVQPGRSLRLSCAASG-FTFS | T-----YGMH | WVQAPGK GLEWVA | IIWYD----GSNKYYADS VKG | RFTISRDNSKNTLYLQMNSL RAEDTAVYYCAR | DTYDFW--------SGYLGY | WGQGT LVTVS S |
| iPS:4 34363 | 21-225_65A6 | VH3/3-33/D4/4-17/RF2/JH4 | QVQLVES-GGGVVQPGRSLRLSCAASG-FTFS | N-----YGMH | WVRQAPGK GLEWVA | VIWYD----GSNKYYGDS VKG | RFTISRDNSKNTLYLQMNSL RAEDTAVYYCAR | DQGIVG--------ATWFDY | WGQGT LVTVS S |
| iPS:4 34393 | 21-225_67C3 | VH3/3-33/D4/4-17/RF2/JH4 | QVQLVES-GGGVVQPGRSLRLSCAASG-FTFS | S-----YGMH | WVRQAPGK GLEWVA | AIWYD----GSNKYYADS VKG | RVTISRDNSKNSLHLQMNSL RAEDTAVYYCAR | DQGIVG--------ATWFDY | WGQGT LVTVS S |
| iPS:4 34425 | 21-225_70A5 | VH3/3-33/D4/4-17/RF2/JH4 | QVQLVES-GGGVVQPGRSLRLSCAASG-FTFS | S-----YGMH | WVRQAPGK GLEWVA | VIWYD----GSNKYYGDS VKG | RFTISRDNSKNSLYLQMNSL SAEDTAVYYCAR | DQGIVG--------ATWFDY | WGQGT LVTVS S |
| iPS:4 35341 | 21-225_148B2 | VH3/3-33/D4/4-17/RF2/JH4 | QVQLVES-GGGVVQPGRSLRLSCAASG-FTFS | S-----YGMH | WVRQAPGK GLEWVA | IIWYD----GSNKYYADS VKG | RFTISRDNSKNTLYLQMNSL SAEDTAVYYCAR | DHFDFW--------SGHFDY | WGQGT LVTVS S |
| iPS:4 35357 | 21-225_148G10 | VH3/3-33/D4/4-17/RF2/JH4 | QVQLVES-GGGVVQPGRSLRLSCAASG-FTFS | S-----YGMH | WVRQAPGK GLEWVA | IIWYD----GSYKYYADS VKG | RFTISRDNSKNTLYLQMNSL RAEDTAVYYCAR | DRYDFW--------SGHFDY | WGQGT LVTVS S |
| iPS:4 35365 | 21-225_149F1 | VH3/3-33/D4/4-17/RF2/JH4 | QVQLVES-GGGVVQPGRSLRLSCAASG-FTFS | S-----YGMH | WVRQAPGK GLEWVA | IIWYD----GSNKYYADS VKG | RFTISRDNSKNTLYLQMNSL SAEDTAVYYCAR | DHFDFW--------SGHFDY | WGQGT LVTVS S |
| iPS:4 35413 | 21-225_150B11 | VH3/3-33/D4/4-17/RF2/JH4 | QVQLMES-GGGVVQPGRSLRLSCAASG-FTFS | S-----YGMH | WVRQAPGK GLEWVA | IIWYD----GSYKYYADS VKG | RFTISRDNSKNTLYLQMNSL RAEDTAVYYCAR | DRYDFW--------SGHFDY | WGQGT LVTVS S |
| iPS:4 35423 | 21-225_151G5 | VH3/3-33/D4/4-17/RF2/JH4 | QVQLVES-GGGVVQPGRSLRLSCAASG-FTFS | S-----YGMH | WVRQAPGK GLEWVA | IIWYD----GSNKYYADS VKG | RFTISRDNSKNTLYLQMNSL RAEDTAVYYCAR | DRYDFW--------SGHFDY | WGQGT LVTVS S |
| iPS:4 35429 | 21-225_151A10 | VH3/3-33/D4/4-17/RF2/JH4 | QVQLVES-GGGVVQPGRSLRLSCAASG-FTFS | N-----YGMH | WVRQAPGK GLEWLA | IIWYD----GSNKYYADS VKG | RFTISRDNSKNTLYLQMNSL RAEDTAVYYCAR | DHYDFW--------SGHFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35489 | 21-225_155A5 | VH3|3-33|D4|4-17|RF2|JH4 | QVQLVES-GGDVVQPGRSLRLSCAASG-FTFS | S------YGMH | WVRQAPGKGLEWVA | IIWYD----GSSKYYADSVKG | RFTISRDNSKNTLYLHMNSLRAEDTAVYYCAR | DRYDFW------SGHFDY | WGQGTLVTVSS |
| iPS:4 35683 | 21-225_170A1 | VH3|3-33|D4|4-17|RF2|JH4 | QVQLVES-GGGVVQPGRSLRLSCAASG-FTFS | S------YGMH | WVRQAPGKGLEWVA | IIWYD----GSYKYYADSVKG | RFTISRDNSKNTLYLQMNSLRAEDTAVYYCAR | DAHDFW------SGYFDS | WGQGTLVTVSS |
| iPS:4 35755 | 21-225_176H4 | VH3|3-33|D4|4-17|RF2|JH4 | QVQLVES-GGGVVQPGRSLRLSCAASG-FTFS | S------YGMH | WVRQAPGKGLEWVA | IIWYD----GSYKYYADSVKG | RFTISRDNSKNTLYLQMSSLRAEDTAVYYCAR | DAHDFW------SGYFAY | WGQGALVTVSS |
| iPS:4 35795 | 21-225_181C2 | VH3|3-33|D4|4-17|RF2|JH4 | QVQLVES-GGGVVQPGRSLRLSCVASG-FTFS | S------YGMH | WVRQAPGKGLEWVT | IIWYD----GSYKYYADSVKG | RFTISRDNSKNTLYLQMNSLRAEDTAVYYCAR | DHYDFW------SGHFDF | WGQGTLVTVSS |
| iPS:4 35807 | 21-225_181C10 | VH3|3-33|D4|4-17|RF2|JH4 | QVQLVES-GGGVVQPGRSLRLSCAASG-FTFS | S------YGMH | WVRQAPGKGLEWMA | IIWYD----GSYKYYADSVKG | RFTISRDNSKNTLYLQMNSLRAEDTAVYYCAR | DHYDFW------SGHFDY | WGQGTLVTVSS |
| iPS:4 35887 | 21-225_186F7 | VH3|3-33|D4|4-17|RF2|JH4 | QVQLVES-GGGVVQPGRSLRLSCAASG-FTFS | T------YGMH | WVRQAPGKGLEWVA | IIWYD----GSYKYYADSVKG | RFTISRDNSKNTLYLQMNSLRAEDTAVYYCAR | DHYDFW------SGHFDY | WGQGTLVTVSS |
| iPS:4 35901 | 21-225_189G2 | VH3|3-33|D4|4-17|RF2|JH4 | QVQLVES-GGGVVQPGRSLRLSCAASG-FTFS | N------YGMH | WVRQAPGKGLEWVA | IIWYD----GSYKYYADSVKG | RFTISRDNSKNTLYLQMNSLRAEDTAVYYCAR | DRFDFW------SGYSDY | WGQGTLVTVSS |
| iPS:4 36594 | 21-225_226A5 | VH3|3-33|D4|4-17|RF2|JH4 | QVQLVES-GGGVVQPGRSLRLSCAASG-FTFS | N------YGMH | WVRQAPGKGLEWVA | IIWYD----GTNKYYTDSVKG | RFTISRDNSKNTLYLQMNSLRAEDTAVYYCAR | EGHDFW------SGFFCY | WGQGTLVTVSS |
| iPS:3 92814 | 21-225_22A1 | VH3|3-33|D4|4-17|RF2|JH4 | QVQLVES-GGGVVQPGRSLRLSCAASG-FTFS | S------YGMH | WVRQAPGKGLEWVA | VMWYD----GSNKYYADSVKG | RFTISRDNSKNTLYLQMNSLRAEDTAVYYCAR | DGGFL------EWLDY | WGQGTLVTVSS |
| iPS:3 93036 | 21-225_28G3 | VH3|3-33|D4|4-17|RF2|JH4 | QVQLVES-GGGVVQPGRSLRLSCAASG-FTFS | T------YGMH | WVRQAPGKGLEWVA | VIWYD----GSNKYYADSVKG | RFTISRDNSKNTLYLQMNSLRAEDTAVYYCAR | DRYDFW------SGYFDY | WGQGTLVTVSS |
| Germline | VH3|3-33|D7|7-27|RF1|JH4 | | | | | | | | |
| iPS:4 68824 | 21-225_73G6 | VH3|3-33|D7|7-27|RF1|JH4 | QVQLVES-GGGVVQPGRSLRLSCAASG-FTFS | S------YGMH | WVRQAPGKGLEWVA | VIWYD----VSNKYYGDSVKG | RFTISRDNSKNTLYLQMNSLRAEDTAVYYCAR | EVGM-------TSDY | WGQGTLVTVSS |

Figure 51 (Continued)

| | | | | | | | | | |
|---|---|---|---|---|---|---|---|---|---|
| iPS:4 34169 | 21-225_50C4 | VH3/3-33/D7/7-27/RF1/J H4 | QVQLVES-GGGVVQPGRSLRL SCAASG-FTFS | D------YGMH | WVRQAPGK GLEWVA | VIWYE----ETNKYYADS VKG | RFTISRDNSKNTLYLQMNSL RGEDTAVYYCAR | EVGF--------LNDY | WGQGT LVTVS S |
| iPS:4 35045 | 21-225_90H5 | VH3/3-33/D7/7-27/RF1/J H4 | QVQLVES-GGGVVQPGRSLRL SCAASG-FTFS | D------YGMH | WVRQSPGK GLEWVA | VIWYE----GSNTYYADS VKG | RFTISRDNSKNTLYLQMNSL RAEDTAVYYCVR | EMGW--------LDDY | WGQGT LVTVS S |
| iPS:4 35367 | 21-225_149G1 | VH3/3-33/D7/7-27/RF1/J H4 | QVQLVES-GGGVVQPGRSLRL SCAASG-FTFS | D------YGMH | WVRQAPGK GLEWVA | VIWYE----GSNKYYADS VKG | RFTISRDNSKRMLYLQMNSL RAEDTAVYYCAR | EIGF--------SEDY | WGQGT LVTVS S |
| iPS:4 35397 | 21-225_149F12 | VH3/3-33/D7/7-27/RF1/J H4 | QVQLVES-GGGVVQPGRSLRL SCAASG-FTFS | D------YGMH | WVRQAPGK GLEWVA | VIWYE----ENNKYYADS VKG | RFTISRDNSKNTLFLQMNSL RAEDTAVYYCAR | EIGF--------SEDY | WGQGT LVTVS S |
| iPS:4 35407 | 21-225_150E7 | VH3/3-33/D7/7-27/RF1/J H4 | QVQLVES-GGGVVQPGRSLRL SCAASG-FTFS | D------YGMH | WVRQAPGK GLEWVA | VIWFD----ENNKYYADS VKG | RFTISRDNSKNTLFLQMNSL RAEDTAVYYCAR | EIGF--------SEDY | WGQGT LVTVS S |
| iPS:4 35609 | 21-225_161F7 | VH3/3-33/D7/7-27/RF1/J H4 | QVQLVES-GGGVVQPGRSLRL SCAASG-FTFS | D------FGLH | WVRQAPGQ GLEWVA | VIWFD----GSNKYYADS VKG | RFTIFRDNSKNTLYLQMNSL RAEDTAVYYCAR | EIGW--------LSDY | WGQGT LVTVS S |
| iPS:4 35613 | 21-225_161D11 | VH3/3-33/D7/7-27/RF1/J H4 | QVQLVES-GGGVVQPGRSLRL SCAASG-FTFS | D------FGLH | WVRQAPGQ GLEWVA | VIWYE----GSNKYYADS VKG | RFTIFRDNSKNTLYLQMNSL RAEDTAVYYCAR | EIGW--------LSDY | WGQGT LVTVS S |
| iPS:4 35791 | 21-225_180H7 | VH3/3-33/D7/7-27/RF1/J H4 | QVQLVES-GGGVVQPGRSLRL SCVASG-FTFS | D------YGMH | WVRQAPGK GLEWVA | VIWYD----ENNKHYADS AKG | RFTISRDNSKNTLYLQMNSL RVEDTAVYYCAR | EVGW--------SDDY | WGQGT LVTVS S |
| iPS:4 35805 | 21-225_181A8 | VH3/3-33/D7/7-27/RF1/J H4 | QVQLVES-GGGVVQPGRSLRL SCAASG-FTFS | D------YGMH | WVRQAPGK GLEWVA | VIWYD----ENNKWKADS AKG | RFTISRDNSKNTLXLQMNSL RAEDTAVYYCAR | EVGW--------SDDY | WGQGT LVTVS S |
| iPS:4 35879 | 21-225_184H10 | VH3/3-33/D7/7-27/RF1/J H4 | QVQLVES-GGGVVQPGRSLRL SCAASG-FTFS | D------YGMH | WVRQAPGK GLEWVA | VIWYD----ETNKHYGDS VKG | RFTISRDNSKDTLYLQMNSL RAEDTAVYYCAR | EVGW--------HDDY | WGQGT LVTVS S |
| iPS:4 35881 | 21-225_184D11 | VH3/3-33/D7/7-27/RF1/J H4 | QVQLVES-GGGVVQPGRSLRL SCAASG-FTFS | D------YGMH | WVRQAPGK GLEWVA | VIWYD----ETNKHYGDS VKG | RFTISRDNSKDTLYLQMNSL RAEDTAVYYCAR | EVGW--------HDDY | WGQGT LVTVS S |
| iPS:4 36350 | 21-225_210E4 | VH3/3-33/D7/7-27/RF1/J H4 | QVQLVES-GGGVVQPGRSLRL SCAASG-FTLI | N------YGMH | WVRQAPGK GLEWVA | VIWYD----ENNKYVDS VKG | RFTISRDDSKNTLYLQMNSL RAEDSAVYYCAR | EIGF--------LSDY | WGQGT LVTVS S |

Figure 51 (Continued)

| | | | | | | | | | | |
|---|---|---|---|---|---|---|---|---|---|---|
| iPS:4 36576 | 21-225_225B6 | VH3/3-33/D7/7-27/RF1/JH4 | QVQLVES-GGGVVQPGRSLRLSCAASG-FTFS | D------YGMH | WVRQAPGK GLEWVA | VIWYD----ENNKYYADS VKG | RFTISRDNSKNTLYLQMNSL RAEDTAVYYCAR | EVGF--------TEDY | WGQGT LVTVS S |
| iPS:4 36578 | 21-225_225D6 | VH3/3-33/D7/7-27/RF1/JH4 | QVQLVES-GGGVVQPGRSLRLSCAASG-FTFS | N------YGMH | WVRQAPGK GLEWVA | VIWYD----ENNKYYADS VKG | RFTISRDNSQNTLYLQMTSL RAEDTAVYYCAR | EVGF--------TEDY | WGQGT LVTVS S |
| iPS:4 36582 | 21-225_225F8 | VH3/3-33/D7/7-27/RF1/JH4 | QVQLVES-GGGVVQPGRSLRLSCAASG-FTFS | S------YGMH | WVRQAPGK GLEWVA | VIWYD----ENNKYYVDS VKG | RFTISRDNSKNTLYLQMNSL RAEDTAVYYCAR | EVGF--------TEDY | WGQGT LVTVS S |
| iPS:4 36608 | 21-225_226A9 | VH3/3-33/D7/7-27/RF1/JH4 | QVQLVES-GGGVVQPGRSLRLSCAASG-FTFS | N------YGMH | WVRQAPGK GLEWVA | VIWYE----ESNKYYTDS VKG | RFTISRDNSKNTLFLQMNSL RAEDTAVYYCAR | EVGF--------TEDY | WGQGT LVTVS S |
| iPS:4 36630 | 21-225_227G3 | VH3/3-33/D7/7-27/RF1/JH4 | QVQLVES-GGGVVQPGRSLRLSCAASG-FTFS | S------YGMH | WVRQAPGK GLEWVA | VIWYV----GSNQYYADS VKG | RFTISRDNSKNTLYLQMSSL RAEDTAVYYCAR | EVGF--------TEDY | WGQGT LVTVS S |
| iPS:4 36634 | 21-225_227H5 | VH3/3-33/D7/7-27/RF1/JH4 | QVQLVES-GGGVVQPGRSLRLSCAASG-FTFS | N------YGMH | WVRQAPGK GLEWVA | VIWYE----ESNKYYADS VKG | RFTISRDNSKNTLYLQMNSL RAEDTAVYYCAR | EVGF--------TEDY | WGQGT LVTVS S |
| iPS:4 36650 | 21-225_227C12 | VH3/3-33/D7/7-27/RF1/JH4 | QVQLVES-GGGVVQPGRSLRLSCAASG-FTFS | N------YGMH | WVRQAPGK GLEWVA | VIWYI----GSMQYYADS VKG | RFTISRDNSKNTLYLQMSSL RAEDTAVYYCAR | EVGF--------TEDY | WGQGT LVTVS S |
| iPS:4 37280 | 21-225_203C10 | VH3/3-33/D7/7-27/RF1/JH4 | QVQLVES-GGGVVQPGRSLRLSCAASG-FTFS | D------YGMH | WVRQAPGK GLEWVA | VIWYD----GGNTHYDS VKG | RFTISRDNSKNTLYLQMNSL RAEDTAVYYCAR | EVGW--------LDDY | WGQGT LVTVS S |
| iPS:3 92740 | 21-225_18H12 | VH3/3-33/D7/7-27/RF1/JH4 | QVQLVES-GGGVVQPGRSLRLSCAASG-FTFS | D------YGMH | WVRQAPGK GLEWMA | VIWYD----VTNKYYADS VKG | RFTISRDNSKNTLYLQMNSL RAEDTAVYYCAR | EVGW--------YEDY | WGQGT LVTVS S |
| iPS:3 92780 | 21-225_22B7 | VH3/3-33/D7/7-27/RF1/JH4 | QVQLVES-GGGVVQPGRSLRLSCAASG-FTFS | S------YGMH | WVRQAPGK GLEWVA | VIWYE----ENNQYYADS VKG | RFTISRDNSKNTLYLQMNSL RAEDTAVYYCAR | EVGF--------RSDY | WGQGT LVTVS S |
| iPS:3 92812 | 21-225_26A9 | VH3/3-33/D7/7-27/RF1/JH4 | QVQLVES-GGGVVQPGRSLRLSCAASG-FTFS | S------YGMH | WVRQAPGK GLEWVA | VIWYD----VTNKYYTGS VKG | RFTISRDNSKNTLYLQMNSL RAEDTAVYYCAR | EIGW--------LDDY | WGQGT LVTVS S |
| iPS:3 92940 | 21-225_29D9 | VH3/3-33/D7/7-27/RF1/JH4 | QVQLVES-GGGVVQPGRSLKLSCSASG-FTFS | D------YGIH | WVRQAPGK GLEWVA | VIWYD----ESNNYYADS VKG | RFTISRDNSKNTLYLQMNSL RAEDTAVYYCAR | EIGW--------LDDY | WGQGT QVTVS S |

Figure 51 (Continued)

| | | | | | | | | | |
|---|---|---|---|---|---|---|---|---|---|
| iPS:3 92948 | 21-225_25G5 | VH3/3-33/D7/7-27/RF1/JH4 | QVQLVES-GGGVVQPGRSLRLSCAASG-FTFS | D------YGIH | WVRQAPGK GLEWVA | VIWYD----GNNKYYADS VKG | RFTISRDNSKNTLYLQMNNL RAEDTAVYYCAR | EIGW--------LDDY | WGQGT LVTVS S |
| iPS:3 92978 | 21-225_28B8 | VH3/3-33/D7/7-27/RF1/JH4 | QVQLVES-GGGVVQPGRSLRLSCAASG-FTFS | D------YGMH | WVRQAPGK GLEWVT | VIWYD----ANNKYYADS VKG | RFTISRDNFKNTVYLQMNSL RAEDTAVYYCAR | EIGW--------LDDY | WGQGT LVTVS S |
| iPS:3 92998 | 21-225_28A9 | VH3/3-33/D7/7-27/RF1/JH4 | QVQLVES-GGGVVQPGRSLRLSCAASG-FTFS | S------YGIH | WVRQAPGK GLEWVA | VIWFD----GSNKYYADS VKG | RFTISRDNSKNTLFLQMNSL RVEDTAVYYCAR | EIGW--------LDDY | WGQGT LVTVS S |
| iPS:3 93038 | 21-225_29D8 | VH3/3-33/D7/7-27/RF1/JH4 | QVQLVES-GGGVVQPGRSLRLSCAASG-FTFR | D------YGIH | WVRQAPGK GLEWVA | VIWFD----GTNKYYADS VKG | RFTISRDNSKNTLYLQMNSL RAEDTAVYYCGR | EIGW--------LDDY | WGQGT LVTVS S |
| iPS:3 93056 | 21-225_30F3 | VH3/3-33/D7/7-27/RF1/JH4 | QVQLVES-GGGVVQPGRSLRLSCAASG-FTFS | S------YGMH | WVRQAPGK GLEWVA | VIWYD----VSNKYYADS VKG | RFTISRDNSKNTLYLQMNSL RAEDTAVYYCAR | EMGW--------YDDY | WGQGT LVTVS S |
| iPS:3 93874 | 21-225_33B1 | VH3/3-33/D7/7-27/RF1/JH4 | QVQLVES-GGGVVQPGRSLRLSCAASG-FTFS | D------YGMH | WVRQAPAK GLEWVA | VIWYD----RNNKYYADS VKG | RFTISRDNSKNTLYLQMNSL RAEDTAVYYCAR | EMGW--------YDDY | WGQGT LVTVS S |
| iPS:3 93822 | 21-225_15B11 | VH3/3-33/D7/7-27/RF1/JH4 | QVQLVES-GGGVVQPGRSLRLSCAASG-FTFS | N------YGMH | WVRQAPGK GLEWVA | VIWYE----ESNKYYTDS VKG | RFTISRDNSKNTLYLQMNSL RPEDTAVYYCAR | EVGF--------TEDY | WGQGT LVTVS S |
| iPS:3 93856 | 21-225_14C2 | VH3/3-33/D7/7-27/RF1/JH4 | QVQLVES-GGGVVQPGRSLRLSCAASG-FTFS | D------YGMH | WVRQAPGK GLEWVA | VIWYD----ESNKYYEDS VKG | RFTISRDNSKNTLYLQMKSL RAEDTGVYYCAR | EVGF--------RSDY | WGQGT LVTVS S |
| iPS:3 93874 | 21-225_4C8 | VH3/3-33/D7/7-27/RF1/JH4 | QVQLVES-GGGVVQPGRSLRLSCAASG-FTFS | N------YGMH | WVRQAPGK GLEWVA | VIWYE----ENNQYYADS VKG | RFTISRDNSKNTLYLQMNSL TAEDTAVYYSPR | EMGW--------LSDY | WGQGT LVTVS S |
| iPS:3 93984 | 21-225_4F12 | VH3/3-33/D7/7-27/RF1/JH4 | QVQLVES-GGGVVQPGRSLRLSCAASG-FTFS | S------YGMH | WVRQAPGK GLEWVA | VIWYD----VTNKKYADS VKG | RFTISRDNSKNTLYLQMNSL TPENTGGYENQR | EKGG--------LFDY | WGQGT LVTVS S |
| iPS:3 94020 | 21-225_15H10 | VH3/3-33/D7/7-27/RF1/JH4 | QVQLVES-GGGVVQPGRSLRLSCAASG-FTFS | N------YGMH | WVRQAPGK GLEWVA | VIWYD----ESNKYYEDS VKG | RFTISRDNSKNTLYLQMNCVR RAEDTAVYYCAR | EVGF--------LSDY | WGQGI LVTVS S |
| iPS:3 94095 | 21-225_16H4 | VH3/3-33/D7/7-27/RF1/JH4 | QVQLVES-GGGVVQPGRSLRLSCAASG-FTFS | N------YGMH | WVRQAPGK GLEWVA | VIWYD----VSNKYYADS VKG | RFTISRDNSKNMLYLQMNSL RAEDTAVYYCAR | EMGW--------TDDC | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1|1-08|D5|5-24|RF3|JH6 | | QVQLVQS-GAEVKKPGASVKV SCKASG-YTFT | S------YDIN | WVRQATGQ GLEWMG | WMNPK----RGNTYAQK FQG | RVTMTRDTSISTAYMELSSL RSEDTAVYYCAR | GDYNYY------AIYMDV | WGQGT LVTVS S |
| iPS:4 68818 21-225_190C8 | VH1|1-08|D5|5-24|RF3|JH6 | QVQLVQS-GAEVKKPGASVKV SCKASG-YTFT | S------YDIN | WVRQATGQ GLEWMG | WMNPK----RGNTGYAQK FQG | RVTMTRDTSISTAYMELSSL RSEDTAVYYCAR | GDPYNWN------SYAMDV | WGQGA TVTVS S |
| iPS:4 36023 21-225_193A5 | VH1|1-08|D5|5-24|RF3|JH6 | QVQLVQS-GAEVKKPGASVKV SCKASG-YTFT | S------YDIN | WVRQATGQ GLEWMG | WMNPK----RGNTGYAQK FQG | RVTMTRDTSISTAYMELSSL RSEDTAVYYCAR | GDPYNWN------SYAMDV | WGQGA TVTVS S |
| iPS:4 36132 21-225_196C12 | VH1|1-08|D5|5-24|RF3|JH6 | QVQLVQS-GAEVKKPGASVKV SCKASG-YTFT | S------YDIN | WVRQATGQ GLEWMG | WMNPK----RGNTGYAQK FQG | RVTMTRDTSISTAYMELSSL RSEDTAVYYCAR | GDPYNWN------SYAMDV | WGQGA TVTVS S |
| | Germline | H_FR1 | H_CDR1 | H_FR2 | H_CDR2 | H_FR3 | H_CDR3 | H_FR4 |
| VH3|3-33/D2|2-8|RF3|JH5 | | QVQLVES-GGGVVQPGRSLRL SCAASG-FTFS | S------YGMH | WVRQAPGK GLEWVA | VIWYD----GSNKYYADS VKG | RFTISRDNSKNTLYLQMNSL RAEDTAVYYCAR | DIYMMYY------AIWMFDP | WGQGT LVTVS S |
| iPS:4 68828 21-225_162A10 | VH3|3-33/D2|2-8|RF3|JH5 | QVQLVES-GGGVVQPGRSLRL SCAASG-FTFS | S------CGMH | WVRQAPGK GLEWVA | AIWYD----GSNKYYADS VKG | RFTISRDNSKNTLFLQMNSL RAEDTAVYYCAR | DKNIMG------DTWFDF | WGQGT LVTVS S |
| | Germline | H_FR1 | H_CDR1 | H_FR2 | H_CDR2 | H_FR3 | H_CDR3 | H_FR4 |
| VH1|1-02|D5|5-18|RF3|JH4 | | QVQLVQS-GAEVKKPGASVKV SCKASG-YTFT | G------YYMH | WVRQAPGQ GLEWMG | WINPN----SGGTNYAQK FQG | RVTMTRDTSISTAYMELSRL RSEDTAVYYCAR | GNSYG------YYFDY | WGQGT LVTVS S |
| iPS:4 68830 21-225_191G11 | VH1|1-02|D5|5-18|RF3|JH4 | QVQLVQS-GAEVKKPGASVKV SCKASG-YTFT | G------YYMH | WVRQAPGQ GLEWMG | WINPN----SGGTNYAQK FQG | RVTLRDTSINTAYMELSWL RSGDTAVYYCAR | GKNYG------SYFDY | WGQGT LVTVS S |
| iPS:4 36896 21-225_67F10 | VH1|1-02|D5|5-18|RF3|JH4 | QVQLVQS-GAEVKKPGASVKV SCKASG-YTFT | G------YYMH | WVRQAPGQ GLEWMG | WINPN----SGGTNYGQK FQG | RVTMTRDTSISTAYMELSRL RSDDTAVYYCAR | TYFYGSGS------YNGFDY | WGQGT LVTVS S |
| iPS:3 93218 21-225_14G3 | VH1|1-02|D5|5-18|RF3|JH4 | QVQLVQS-GAEVKKPGASVKV SCKASG-YTFT | G------YYMY | WVRQAPGQ GLEWMG | WINPN----SGGTNYAQK FQG | RVTMTRDTSISTAYMELSRL RSDDTAVYYCAR | SYFYGSGS------YNEFDY | WGQGT LVTVS S |
| iPS:3 93565 21-225_34B11 | VH1|1-02|D5|5-18|RF3|JH4 | QVKLVQS-GAEVKKPGASVKV SCKASG-YTFT | G------YYMH | WVRQAPGQ GLEWMG | WINPN----SGGTNYAQK FQG | RVTMTRDTSISTAYMELSRL RSDDTAVYYCAR | VYFYGSGS------YNEFDY | WGQGT LVTVS S |
| iPS:3 98470 21-225_14B7 | VH1|1-02|D5|5-18|RF3|JH4 | QVQLVQS-GAEVKKPGASVKV SCKASG-YTFT | G------YYMH | WVRQAPGQ GLEWMG | WINPN----SGGTNVVQK FQG | RVTMTRDTSISTACMELSRL KSDDTAVYFCAR | SFFYGSGS------YNEFDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-30.3D1l1-1lRF1JH6 | | QVQLVES-GGGVVQPGRSLRLSCAASG-FTFS | YAMH | WVRQAPGKGLEWVA | VISYDGGYKNYADSVKG | RFTISRDNSKNTLYLQMNSLRAEDTAVYYCAR | GTHGYY-------YYYGMDV | WGQGTTVTVSS |
| iPS:4 68836 | 21-225_198E3 | VH3J3-30.3D1l1-1lRF1JH6 | QVQLVES-GGGVVQPGRSLRLSCAASG-FTFS | S-----YGMH | WVRQAPGKGLEWVA | VISYD----GGYKNYADSVKG | RFTISRDNSKNTLYLQMNSLRAEDTAVYYCAR | GTHGYY-------YGVDV | WGQGTTVTVSS |
| iPS:4 35831 | 21-225_190C12 | VH3J3-30.3D1l1-1lRF1JH6 | QVQLVES-GGAVVQPGRSLRLSCAASG-FTFS | S-----YGMH | WVRQAPGKGLEWVA | VISYD----GGYKNYVDSVKG | RFTISRDNSKNTLYLQMNSLRAEDTAVYYCAR | GTHGYY-------YGVDV | WGQGTTVTVSS |
| iPS:4 35857 | 21-225_191A4 | VH3J3-30.3D1l1-1lRF1JH6 | QVQLVES-GGGVVQPGRSLRLSCAASG-FTFS | S-----YGMH | WVRQAPGKGLEWVA | VISYD----GGYKNYADSVKG | RFTISRDNSKNTLYLQMNSLRAEDTAVYYCAR | GTHGYY-------YGVDV | WGQGTTVTVSS |
| iPS:4 35907 | 21-225_190G3 | VH3J3-30.3D1l1-1lRF1JH6 | QVQLVES-GGGVVQPGRSLRLSCAASG-FTFS | S-----YGMH | WVRQAPGKGLEWVA | VISYD----GGYKNYVDSVKG | RFTISRDNSKNTLYLQMNSLRAEDTAVYYCAR | GTHGYY-------YGVDV | WGQGTTVTVSS |
| iPS:4 35919 | 21-225_190H5 | VH3J3-30.3D1l1-1lRF1JH6 | QVQLVES-GGGVVQPGRSLRLSCAASG-FTFS | S-----YGMH | WVRQAPGKGLEWVA | VISYD----GGYKNYADSVKG | RFTISRDNSKNTLYLQMNSLRAEDTAVYYCAR | GTHGYY-------YGVDV | WGQGTTVTVSS |
| iPS:4 35989 | 21-225_192F7 | VH3J3-30.3D1l1-1lRF1JH6 | QVQLVES-GGGVVQPGRSLRLSCAASG-FTFS | S-----YGMH | WVRQAPGKGLEWVT | VISYD----GGYKNYADSVKG | RFTISRDNSKNTLYLQMNSLRAEDTAVYYCAR | GTHGYY-------YGVDV | WGQGTTVTVSS |
| iPS:4 36222 | 21-225_200C9 | VH3J3-30.3D1l1-1lRF1JH6 | QVQLVES-GGGVVQPGRSLRLSCAASG-FTFS | S-----YGMH | WVRQAPGKGLEWVA | VISYD----GGYKNYIDSVKG | RFTISRDNSKNTLYLQMNSLRAEDTAVYYCAR | GTHGYY-------YGVDV | WGQGTTVTVSS |
| | Germline | H_FR1 | H_CDR1 | H_FR2 | H_CDR2 | H_FR3 | H_CDR3 | H_FR4 |
| VH4J4-30.1D5l5-24lRF3JH6 | | QVQLQES-GPGLVKPSQTLSLTCTVSG-GSIS | SG-GYYWS | WIRQHPGKGLEWIG | YIYY----SGSTYNPSLKS | RVTLSVDTSKNQFSLKLSSVTAADTAVYYCAR | RGGYNWN-------YYGMDV | WGQGTTVTVSS |
| iPS:4 68840 | 21-225_200H9 | VH4J4-30.1D5l5-24lRF3JH6 | QVQLQES-GPGLVKPSQTLSLTCTVSG-GSMR | SG---GDYWS | WIRQHPGKGLEWFG | YIYY----SGSTYNPSLKS | RVTLSVDTSKNQFSLKLSSVTAADTAVYYCAR | MDYSNY-------YGMDV | WGQGTSVTVSS |
| iPS:4 36096 | 21-225_195E10 | VH4J4-30.1D5l5-24lRF3JH6 | QVQLQES-GFGLVKPSQTLSLTCTVSG-GSIS | SG---GYYWS | WIRQHPGKGLEWIG | YIYY----SGSTYNPSLKS | RVTISVDTSKNQFSLKLSSVAAADTAVYYCAR | GGYNWN-------HGMDV | WGQGTTVTVSS |
| iPS:4 36120 | 21-225_196C10 | VH4J4-30.1D5l5-24lRF3JH6 | QVQLQES-GPGLVKPSQTLSLTCTVSG-GSMR | SG---GDYWS | WIRQHPGKGLEWFG | FIYY----SGSTYNPSLKS | RVTLSVDTSKNQFSLKLSSVTAADTAVYYCAR | MDYSNY-------YYGMDV | WGQGTTVTVSS |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36216 | 21-225_200B7 | VH4-30.1\|D5\|5-24\|RF3/JH6 | QVQLQES-GPGLVKPSQTLSL TCTVSG-GSIS | SG----GYYWS | WIRQHPGK GLEWIG | YIFY----SGSTNYNPS LRS | RVTISVDTSKNQFSLKLSSV TAADTAVYYCAR | AGYNWN------NGMDV | WGQGT TVTVS S |
| | Germline | VH3\|3-21\|D6\|6-6\|RF2\|JH4 | EVQLVES-GGGLVKPGGSLRL SCAASG-FTFS | S-----YMN | WVRQAPGK GLEWVS | SISGS---SSYIYYADS VKG | RFTISRDNAKNSLYLQMNSL RAEDTAVYYCAR | STAAR | WGQGT LVTVS S |
| iPS:4 68844 | 21-225_48E10 | VH3\|3-21\|D6\|6-6\|RF2\|JH4 | EVQLVES-GGGLVKPGGSLRL SCAASG-FTFS | S-----YNMN | WVRQAPGK GLEWVS | SISGS---SSYIYYADS VKG | RFTISRDNAKNSLYLQMNSL RAEDTAVYYCAR | SL--------DL | WGQGT LVTVS S |
| iPS:4 35537 | 21-225_157H12 | VH3\|3-21\|D6\|6-6\|RF2\|JH4 | EVQLVES-GGGLVKPGGSLRL SCAASG-FTFS | S-----YSMN | WVRQAPGK GLEWVS | SISGS---GSYIYYADS VKG | RFTISRDNAKTSLYLQVNGL RAEDTAVYYCAR | SKF-------DS | WGQGT LVTVS S |
| iPS:4 35539 | 21-225_158G1 | VH3\|3-21\|D6\|6-6\|RF2\|JH4 | EVQLVES-GGGLVKPGGSLRL SCAASG-FTFS | S-----YGMN | WVRQAPGK GLEWIS | SISGS---SSYIYYADS VKG | RFTISRDNAKNSLYLQMNSL RAEDTAVYYCAI | SSG-------WS | WGQGT LVTVS S |
| iPS:4 35583 | 21-225_160F2 | VH3\|3-21\|D6\|6-6\|RF2\|JH4 | EVQLVES-GGGLVKPGGSLRL SCAASG-FTFS | S-----YGMN | WVRQAPGK GLEWIS | SISGS---SSYIYYADS VKG | RFTISRDNAKNSLYLQMNSL RAEDTAVYYCAR | SSG-------WS | WGQGT LVTVS S |
| | Germline | VH3\|3-21\|D11-1\|RF2\|JH5 | EVQLVES-GGGLVKPGGSLRL SCAASG-FTFS | S-----YSMN | WVRQAPGK GLEWVS | SISSS---SSYIYYADS VKG | RFTISRDNAKNSLYLQMNSL RAEDTAVYYCAR | VNS | WGQGT LVTVS S |
| iPS:4 68846 | 21-225_53B10 | VH3\|3-21\|D11-1\|RF2\|JH5 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | VNS-------FDS | WGQGT LVTVS S |
| iPS:4 34251 | 21-225_62G3 | VH3\|3-21\|D11-1\|RF2\|JH5 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | VNS-------FDS | WGQGT LVTVS S |
| iPS:4 34407 | 21-225_68G8 | VH3\|3-21\|D11-1\|RF2\|JH5 | EVQLVES-GGGLVKPGGSLRL SCAASG-FTFS | S-----YSMN | WVRQAPGK GLEWVS | SISGS---SSYIYYADS VMG | RFTISRDNAKNSLYLQMNSL RAEDTAVYYCAR | VNS-------FDS | WGQGT LVTVS S |
| iPS:4 35575 | 21-225_159H11 | VH3\|3-21\|D11-1\|RF2\|JH5 | EVQLVES-GGGLVKPGGSLRL SCAASG-FTFS | S-----YTMN | WVRQAPGK GLEWVS | SISGS---SSYIYYADS VKG | RFTISRDNAKNSLYLQMNSL RAEDTAVYYCAR | VSW-------ADC | WGQGT LVTVS S |
| | Germline | VH3\|3-23\|D11-1\|RF2\|JH4 | | | H_FR2 | H_CDR2 | H_FR3 | H_CDR3 | H_FR4 |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 68848 | 21-225_54B1 | VH3J3-23JD1J1-1JRF2/JH4 | EVQLLES-GGGLVQPGGSLRL SCAASG-FTFS | S------YAMS | WVRQAPGK GLEWVS | VLSGS---GGSTFYADS VKG | RFTISRENSKNTLYLQMSSL RAEDTAVYYCAR | RGREYSG--------YDYFDY | WGQGT LVTVS S |
| iPS:4 33993 | 21-225_47G7 | VH3J3-23JD1J1-1JRF2/JH4 | EVQLLDS-GGGLVQPGGSLRL SCAASG-FTFS | S------YAMS | WVRQAPGK GLEWVS | AISGR---GGNTFYAES VRG | RFTISRDNSKNTLYLQMNSL RAEDTAVYYCAK | IIREQ----------WAFDY | WGQGT LVTVS S |
| iPS:4 34007 | 21-225_48D7 | VH3J3-23JD1J1-1JRF2/JH4 | EVQLLES-GGGLVQPGGSLRL SCAASG-FTFR | N------SAMN | WVRQAPGK GLEWVS | AISGS---GGTTFYADS VKG | RFTISRDNSKNTLYLQINSL RAEDTAVYYCAK | CGREQ-----------WLDY | WGQGT LVTVS S |
| iPS:4 34115 | 21-225_53E4 | VH3J3-23JD1J1-1JRF2/JH4 | EVQLLES-GGGLVQPGGSLRL SCAASG-FTFS | S------YVMS | WVRQAPGK GLEWVS | GISGS---GGRTYYADS VKG | RFNISRDNSKNTLYLQMNSL RAEDTAVYYCAR | VAL-------------FDY | WGQGT LVTVS S |
| iPS:4 35679 | 21-225_169D10 | VH3J3-23JD1J1-1JRF2/JH4 | EVQLLES-GGGLVQSGGSLRL SCAASG-FTFS | S------YVMS | WVRQAPGK GLEWVS | AISGS---GSRIYYADS VKG | RFTISRDNSRNTLYLQMNSL RAEDTALYYCAR | VAF-------------FDY | WGQGT LVTVS S |
| iPS:4 35685 | 21-225_170E1 | VH3J3-23JD1J1-1JRF2/JH4 | EVQLLES-GGGLVQPGGSLRL SCAASG-FTFS | S------YVMS | WVRQAPGK GLEWVS | AISGR---GNRIYYADS VKG | RFTISRDNSRNTLYLQMNSL RAEDTAVYYCAR | VAF-------------FDY | WGQGT LVTVS S |
| iPS:4 36632 | 21-225_227E4 | VH3J3-23JD1J1-1JRF2/JH4 | EGQLLES-GGGLVQPGGSLRL SCTASG-FTFS | T------FAMT | WVRQAPGR GLEWVS | VISGR---GGSSFYADS VKG | RFTISRDNTRNTLYLQMNSL RAEDTAVYYCAK | DQLW------------FDY | WGQGT LVTVS S |
| | Germline VH4J4-39JD4J4-11JRF2/JH5 | | | | | | | |
| iPS:4 68856 | 21-225_77C9 | VH4J4-39JD4J4-11JRF2/JH5 | QLQLQES-GPGLVTPSEILSL TCTVSG-GSIS | RS-----SYYWG | WIRQPPGK GLEWIG | SIYY------SGSAYSNPS LKS | RVTISVDTSKNQFSLKLSSV TAADTALFYCAR | LDSNW-----------GLDY | WGQGT LVTVS S |
| iPS:4 34489 | 21-225_74E4 | VH4J4-39JD4J4-11JRF2/JH5 | QLQLQES-GPGLVKPSEILSL ICTVSG-GSIS | SS-----NYYWG | WIRQPPGK GLEWIG | SIYY------SGYTSYNPS LKS | RVTISVDSSKNHFSLRLSSV TAADTAVYYCAR | LDSNW-----------GLDY | WGQGT LVTVS S |
| iPS:4 35251 | 21-225_96A3 | VH4J4-39JD4J4-11JRF2/JH5 | QLQLQES-GPGLVKPSEILSL ICTVSG-GSIS | SS-----NYYWG | WIRQPPGK GLEWIG | SIYY------SGYTSYNPS LKS | RVTISVDSSKNHFSLRLSSV TAADTAVYYCAR | LDSNW-----------GLDY | WGQGT LVTVS S |
| iPS:4 37346 | 21-225_75H7 | VH4J4-39JD4J4-11JRF2/JH5 | QLQLQES-GPGLVTPSEILSL TCTVSG-GSIS | RS-----SYYWG | WIRQPPGK GLEWIG | SIYY------SGSAYSNPS LKS | RVTISVDTSKNQFSLKLSSV TAADTALFYCAR | LDSNW-----------GLDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93886 | 21-225_2G9 | VH4|4-39|D4|4-11|RF2|JH5 | QLQLQES-GPGLVKPSETLSL TCTVSG-GSIR | PN-----YYWG | WIRQPPGK GLEWIG | SIYY------SGSTSYNPS LNS | RVTISVDTSKNQFSLKLNSV TAADTAVYYCAR | LSSNW----------DFDN | WGQGT LVTVS S |
| iPS:3 93928 | 21-225_4E10 | VH4|4-39|D4|4-11|RF2|JH5 | QLQLQES-GPGLVKPSETLSL TCTVSG-GSIS | RS-----SYYWG | WIRQPPGK GLEWIG | SVYY------SGATSYNPS LKS | RVTISVDTSKNQFSLKLNSV TAADTALYYCVR | LSSNW----------DFDY | WGQGT LFTVS S |
| | Germline | VH1|1-02|D6|6-6|RF1|JH6 | | | | | | | |
| iPS:4 68862 | 21-225_178H8 | VH1|1-02|D6|6-6|RF1|JH6 | QVQLVQS-GAEVRTPGASVKV SCKASG-YIFT | D-------YYMH | WVRQAPGQ GLEWMG | WINFN------RGGTNYAQK FQG | RVTMTRDTSISTAYMELSRL RSDDTAVYYCAR | EEDRSGWY------YYYGMDV | WGQGT TVTVS S |
| iPS:4 51112 | 21-225_53D10 | VH1|1-02|D6|6-6|RF1|JH6 | QVQLVQS-GAEVRTPGASVKV SCKASG-YIFT | G-------YYIH | WVRQAPGQ GLEWMG | WINPN------SGGTNYAQK FQG | RVTMTRDTSISTAYMELIRL RSDDTAVYYCAR | ENESLATRP------FYDYYGMDV | WGQGT TVTVS S |
| | Germline | VH2|2-05|D6|6-6|RF2|JH4 | | | | | H_FR3 | H_CDR3 | H_FR4 |
| iPS:4 68864 | 21-225_60D6 | VH2|2-05|D6|6-6|RF2|JH4 | QITLKES-GPTLVKPTQTLTL TCTFSG-FSLS | TS-----GVGVG | WIRQPPGK ALEWLA | LIYW------KDDERYSPS LKS | RLITKDTSKNQVVLTMTNM DPVDTATYYCAH | AVAV----------SFDY | WGQGT LVTVS S |
| iPS:4 36850 | 21-225_57D9 | VH2|2-05|D6|6-6|RF2|JH4 | QITLKES-GPMLVKPTQTLTL TCTFSG-FSLS | TS-----GVGVG | WIRQPPGK ALEWLA | LIYW------NDDKRYSPS LKS | RLITIEDTSKNQVVLTMTNM DPVDTATYYCAH | AVAV----------SFDY | WGQGT LVTVS S |
| iPS:4 36914 | 21-225_76B4 | VH2|2-05|D6|6-6|RF2|JH4 | QITLKES-GPTLVKPTQTLTL TCTFSG-FSLS | TG-----GVGVG | WIRQPPGK ALEWLA | LIYW------DDDKRYSPS LKS | RLITKDTPKNQVVLTMTNM DPVDTATYYCAH | LIAV----------AFDY | WGQGT LVTVS S |
| iPS:4 36918 | 21-225_77A2 | VH2|2-05|D6|6-6|RF2|JH4 | QITLKES-GPSLVKPTQTLTL TCTFSG-FSLS | TS-----GVGVG | WIRQPPGK ALEWLV | FIYW------DDDKRYSPS LKS | RLITKDTSKNQVVLTMTNM DPVDTATYYCAH | LIAV----------AFDY | WGQGT LVTVS S |
| iPS:4 36934 | 21-225_96B5 | VH2|2-05|D6|6-6|RF2|JH4 | QITLKES-GPTLVKPTQTLTL TCTFSG-FSLS | TG-----GVGVG | WIRQPPGK ALEWLA | LIYW------DDDKRYSPS LKS | RLITKDTPKNQVVLTMTNM DPVDTATYYCAH | LIAV----------ACDY | WGQGT LVTVS S |
| iPS:4 37334 | 21-225_75F11 | VH2|2-05|D6|6-6|RF2|JH4 | QITLKES-GPTLVKPTQTLTL TCTFSG-FSLS | TG-----GVGVG | WIRQPPGK ALEWLA | LIYW------DDDKRYSPS LKS | RLITKDTPKNQVVLTMTNM DPVDTATYYCAH | LIAV----------AFDY | WGQGT LVTVS S |

Figure 51 (Continued)

| | | VH2|2-05/D6|6-6|RF2/JH4 | QITLKES-GPTLVKPTQTLTL TCTFSG-FSLS | TG----GVGVG | MIRQPPGK ALEWLA | LIYW------DDDKRYSPS LKS | RLIITKDTPKNQVLTMTNM DPVDTATYYCAR | LIAV-----------AFDY | WGQGT LVTVS S |
|---|---|---|---|---|---|---|---|---|---|
| iPS:4 37377 | 21-225_74G9 | VH2|2-05/D6|6-6|RF2/JH4 | QITLKES-GPTLVKPTQTLTL TCTFSG-FSLS | TG----GVGVG | MIRQPPGK ALEWLV | FIYW------SDDKRYSPS LKS | RLSITKDTSKNQVLTMTNM DPVDTATYYCAR | IAAV-----------AFDY | WGQGT LVTVS S |
| iPS:3 92583 | 21-225_10B10 | VH2|2-05/D6|6-6|RF2/JH4 | QITLKES-GLITLMKPTQTLTL TCTFSG-FSLS | TG----GVGVG | WIRQPPGK ALEWLA | LIYW------HDDKRYSPS LRS | RLIITKDTSKNQVLTMTNM DPVDTATYYCAR | IVAV-----------AFDY | WGQGT LVTVS S |
| iPS:3 93184 | 21-225_15H11 | VH2|2-05/D6|6-6|RF2/JH4 | QITLKES-GPTLVKPTQTLTL TCTFSG-FSLS | TG----GVGVG | WIRQPPGK ALEWLA | LIYW------HDDKRYSPS LKS | RLAITKDTSKNQVLTMTNM DPVDTATYYCAR | LIAV-----------AFDY | WGQGT LVTVS S |
| iPS:3 93212 | 21-225_30H6 | VH2|2-05/D6|6-6|RF2/JH4 | QITLKES-GPSLVKPTQTLTL TCTFSG-FSLS | TS----GVGVG | WIRQPPGK ALEWLA | LIYW------DDDKRYSPS LKS | RLTITKDTSKNQVLTMTNM DPVDTATYSCAR | IIAV-----------AFDY | WGQGT LVTVS S |
| iPS:3 93222 | 21-225_17F5 | VH2|2-05/D6|6-6|RF2/JH4 | QITLKES-GPTLVKPTQTLTL TCTFSG-FSLN | TG----GVGVG | WIRQPPGK ALEWLA | LIYW------NDDERKYSPS LKS | RLTITKDTSKNQVLTMTNM DPLDTASYYCAR | LIAV-----------SFDY | WGQGA LVTVS S |
| iPS:3 93224 | 21-225_31C2 | | | | | | | | |
| | Germline | | H_FR1 | H_CDR1 | H_FR2 | H_CDR2 | H_FR3 | H_CDR3 | H_FR4 |
| | VH1|1-02/D6|6-19|RF2/JH6 | | QVQLVQS-GAEVKKPGASVKV SCKASG-YTFT | | WVRQAPGQ GLEWMG | | RVTMTRDTSISTAYMELSRL RSDDTAVYYCAR | | WGQGT TVTVS S |
| iPS:4 68866 | 21-225_190C1 | VH1|1-02/D6|6-19|RF2/JH6 | QVQLVQS-GAEVKKPGASVKV SCKASG-YTFT | G------YYMH | WVRQAPGQ GLEWMG | WINPY-----SGGTNYAQK FQG | RVTMTRDTSISTAYMELSRL RSDDTAVYYCAR | DRAVAGNY-------FYYGMDV | WGQGT TVTVS S |
| iPS:4 36972 | 21-225_190C7 | VH1|1-02/D6|6-19|RF2/JH6 | QVQLVQS-GAEVKKPGASVKV SCKASG-YTFT | G------YYMH | WVRQAPGQ GLEWMG | WINPN-----SGGTNYAQK FQG | RVTMTRDTSISTAYMELSRL RSDDTAVYYCAR | DRAVAGNY-------FYYGMDV | WGQGT TVTVS S |
| iPS:4 37020 | 21-225_193F11 | VH1|1-02/D6|6-19|RF2/JH6 | QVQLVQS-GAEVKKPGASVKV SCKASG-YTFT | G------YYMH | WVRQAPGQ GLEWMG | WINPY-----SGGTNYAQK FQG | RVTMTRDTSISTAYMELSRL RSDDTAVYYCAR | DRAVAGNY-------FYYGMDV | WGQGT TVTVS S |
| iPS:4 37036 | 21-225_195H9 | VH1|1-02/D6|6-19|RF2/JH6 | QVQLVQS-GAEVKKPGASVKV SCKASG-YTFT | G------YYMH | WVRQAPGQ GLEWMG | WINPY-----SGGTNYAQK FQD | RVTMTRDTSITTAYMELSRL RSDDTAVYYCAR | DRAVAGNY-------FYYGMDV | WGQGT TVTVS S |
| iPS:4 37042 | 21-225_197E8 | VH1|1-02/D6|6-19|RF2/JH6 | QVQLLQS-GAEVRKPGASVRV SCKASG-YTFT | G------YYIH | WVRQAPGQ GLEWMG | WINPN-----SGGTNYAQR FQG | RVTMTRDTSISTAYMELSRL RSDDTAVYYCAR | EIAVAGNY-------FYYGMGV | WGQGT TVAVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-39D1|1-1|RF2JH4 | | QLQLQES | SS----SYWG | WIRQPPGK GLEWIG | NIYY----SGSTYHNPS LKS | RVTISVDTSKNQFSLKLTSV TAADTAVFYCAR | HDLLM-------SLDF | WGQGT LVTVS S |
| iPS:4 68868 | 21-225_74A1 | VH4/4-39/D1|1-1|RF2JH4 | QLQLQES-GPGLVKPSETLSL TCTVSG-GSIS | GS---SYWG | WIRQPPGK GLEWIG | NIYY----SGSTYHNPS LKS | RVTISVDTSKNQFSLKLTSV TAADTAVFYCAR | HDLLM-------SLDF | WGQGT LVTVS S |
| VH1|1-02D3|3-22|RF2JH5 | Germline | | YMH | WVRQAPGQ GLEWMG | WINPN----SGGTNYAQK FQG | RVTMTRDTSISTAYMELSRL RSDDTAVYYCAR | YYYGSST-------YHNEFDP | WGQGT LVTVS S |
| iPS:4 72742 | 21-225_30D9_LC2 | VH1|1-02/D3|3-22|RF2/JH5 | QVKLVQS-GAEVEKPGASVKV SCKASG-YTFT | G-----YYLH | WVRQAPGQ GLEWMG | WINPN----SGGTNYAQK FQG | RVTMTRDTSISTAYMELSRL RSDDTAVYYCAR | VYYYGSGS-------YNEFDN | WGQGT LVTVS S |
| iPS:4 72741 | 21-225_30D9_LC1 | VH1|1-02/D3|3-22|RF2/JH5 | QVKLVQS-GAEVKKPGASVKV SCKASG-YTFT | G-----YYLH | WVRQAPGQ GLEWMG | WINPN----SGGTNYAQK FQG | RVTMTRDTSISTAYMELSRL RSDDTAVYYCAR | VYYYGSGS-------YYNEFDN | WGQGT LVTVS S |
| iPS:4 37040 | 21-225_196E7 | VH1|1-02/D3|3-22|RF2/JH5 | QVQLVQS-GAEVKKPGASVKV SCKVSG-YTFT | G------YNMH | WVRQAPGQ GLEWMG | WINPN----SGGTNYAHK FQG | RVTMTRDTSISTAYMELSRL RSDDTAVYYCAR | DYYDTSG-------EGWFDP | WGQGT LVTVS S |
| iPS:4 37050 | 21-225_197C11 | VH1|1-02/D3|3-22|RF2/JH5 | QVQLVQS-GAEVKKPGASVKV SCKVSG-YTFS | G------YNMH | WVRQAPGQ GLEWMG | WINPN----SGGTNYAHK FQG | RVTMTRDTSISTAYMELSRL RSDDTAVYYCAR | DYYDSSG-------EGWFDP | WGQGT LVTVS S |
| iPS:3 93214 | 21-225_33A1 | VH1|1-02/D3|3-22|RF2/JH5 | QVQLVQS-GAEVKKPGASVKV SCKASG-YTFS | G------YYMH | WVRQAPGQ GLEWMG | WINPN----NGGTHYAQK FQD | RVTMTRDTSIRIASMELSRL RSDDTAVFYCAR | GYYYAGSS-------YYNDLDP | WGQGT LVTVS S |
| VH1|1-02D3|3-22|RF2JH4 | Germline | | YMH | WVRQAPGQ GLEWMG | WINPN----SGGTNYAQK FQG | RVTMTRDTSISTAYMELSRL RSDDTAVYYCAR | YYYGSST-------YYNFFDY | WGQGT LVTVS S |
| iPS:4 72743 | 21-225_68G6 | VH1|1-02/D3|3-22|RF2/JH4 | QVQLVQF-GGEVKKPGSSVKV SCKASG-YTFT | G-----YMH | WVRQAPGQ GLEWMG | SIYRN----SGGTNYAQK FQG | RVTMTRDKSISTAYMEKSRL RSDDTAVYYCAR | APYYGSGT-------YYNEFDY | WGQGT LVTVS S |
| iPS:4 36902 | 21-225_69B11 | VH1|1-02/D3|3-22|RF2/JH4 | QVQLVQS-GAEVKKPGASVRV SCKASG-YTFT | G------YYMH | WVRQAPGQ GLEWMG | WINPN----SGGTNYGQK FQD | RVTMTRDISTAFMELSRL RSDDTAAYYCAR | TYYYGSGS-------YYNGFDY | WGQGT LVTVS S |
| iPS:4 36904 | 21-225_71D4 | VH1|1-02/D3|3-22|RF2/JH4 | QVQLVQS-GAEVKKPGASVKV SCKASG-YTFT | G------YCMH | WVRQAPGQ GLEWMG | WINPN----SGGTNYAQK FQV | RVTMTRDISVSTVYMDLSRL RSDDTAVYYCAR | AYYYGSGT-------YYNEFDY | WGQGS LVTVS S |

Figure 51 (Continued)

| | | | | | | | | | |
|---|---|---|---|---|---|---|---|---|---|
| iPS:4 36906 | 21-225_72B4 | VH1J1-02/D3/3-22/RF2/J H4 | QVQLVQS-GAEVKKPGASVKV SCKASG-YTFT | G-----YYMH | WVRQAPGQ GLEWMG | WINPN---SGGTNYGQK FQG | RVTMTRDTSISTAYMELSRL RSDDTAVYYCAR | TYYYGSGS------YYNGFDY | WGQGT LVTVS S |
| iPS:4 37034 | 21-225_195E9 | VH1J1-02/D3/3-22/RF2/J H4 | QVQVVQS-GAEVKKPGASVKV SCKASG-YTFT | G-----YYMH | WVRQAPGQ GLEWMG | WINPN---SGATNYAQK FQG | RVTMTRDTSISTAYMELNRL RSDDTAVYCAR | AYYYGSGT------YYNEFDY | WGQGT LVTVS S |
| iPS:3 92598 | 21-225_18E10 | VH1J1-02/D3/3-22/RF2/J H4 | QVQLVQS-GAEVKKPGASVKV SCKASG-YTFT | G-----YYMH | WVRQAPGQ GLEWMG | WINPN---SGGTNYAQK FQG | RVTMTRDTSINTAYMELSRL RSDDTAVYCAR | SYYYGSGS------YYNEFDY | WGQGT LVTVS S |
| iPS:3 93182 | 21-225_4B3 | VH1J1-02/D3/3-22/RF2/J H4 | QVQLVQS-GAEVKKPGASVKV SCKASG-YTFT | G-----YYMH | WVRQAPGQ GLEWMG | WINPN---SGGTNSAQK FQG | RVTMTRDTSISTAYMELSRL RSDDTAVYCAR | SYYYGSGS------YYNEFDY | WGQGT LVTVS S |
| iPS:3 93200 | 21-225_35E1 | VH1J1-02/D3/3-22/RF2/J H4 | QVKLVQS-GAEVKKPGASVKV SCKASG-YTFT | G-----YYMH | WVRQAPGQ GLEWMG | WINPK---SGGTNYAQK FQG | RVTMTRDTSTVYMEPSRL RSDDTAVYCAR | VYHGSGS------YYNEFDY | WGQGT LVTVS S |
| iPS:3 93206 | 21-225_13F6 | VH1J1-02/D3/3-22/RF2/J H4 | QVQLVQS-GAEVKKPGASVKV SCKASG-YTFT | G-----YYMH | WVRQAPGQ GLEWMG | WINPN---SGGANYAQK FQG | RVTMTRDTSISTAYMELFCAR RSDDTAVYFCAR | SFYYGSGT------YYNEFDY | WGQGT LVTVS S |
| iPS:3 93208 | 21-225_16F3 | VH1J1-02/D3/3-22/RF2/J H4 | QVQLVQS-GAEVKKPGASVKV SCKASG-YTFT | G-----HYMH | WVRQAPGQ GLEWMG | WINPN---SGGTNYAQK FQG | RVTMTRDTSISTAYMELSRL RSDDTAVYCAR | SYYYGSGT------YYNEFDY | WGQGT LVTVS S |
| iPS:3 93210 | 21-225_17D3 | VH1J1-02/D3/3-22/RF2/J H4 | QVQLVQS-GAEVKKPGASVKV SCKASG-YTFT | G-----YYMH | WVRQAPGQ GLEWMG | WINPN---SGGTNYAQK FQG | RVTMTRDTSISTAYMELSRL RSDDTAVYCAR | ANYYGSGS------YYNDFDY | WGQGT LVTVS S |
| iPS:3 93226 | 21-225_33E6 | VH1J1-02/D3/3-22/RF2/J H4 | QVQLVQS-GAEVKKPGASVKV SCKASG-YTFT | G-----YYIH | WVRQAPGQ GLEWMG | WINPN---SGGTDYAQK FQG | RVTMTRDTSISTAYMELSRL RSDDTAVYCAR | VYYYGSGS------YYNEFDY | WGQGT LVTVS S |
| iPS:3 93230 | 21-225_9G9 | VH1J1-02/D3/3-22/RF2/J H4 | QVQLVQS-GAEVKKPGASVKV SCKASG-YTFT | D-----YYIH | WVRQAPGQ GLEWMG | WINPN---SGGTNNAQK FQG | RVTMTRDTSISTAYMELSRL RSDDTAVYCAR | SYYYGSGT------YYNEFDY | WGQGT LVTVS S |
| iPS:3 98490 | 21-225_21D12 | VH1J1-02/D3/3-22/RF2/J H4 | QVQLVQS-GAEVKKPGASVKV SCKASG-YTFT | G-----YYMH | WVRQAPGQ GLEWMG | WINPN---SGGTNNAQK FQG | RVTMTRDTSISTAYMELSRL RSDDTAVYSCAR | SYYYGSGT------YYNEFDY | WGQGT LVTVS S |
| iPS:4 23018 | 21-225_31D12_L C2 | VH1J1-02/D3/3-22/RF2/J H4 | QVKLVQS-GAEVKKPGASVKV SCKASG-YTFT | G-----YYMH | WVRQAPGQ GLEWMG | WINPN---SGGTNVQK FQG | RVTMTRDTSISTAYMELSRL RSDDTAVYCAR | VYYYGSGS------YYNEFDY | WGQGT LVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:3 23019 | 21-225_31D12_L C1 | VH1I1-02/D3/3-22/RF2/J H4 | QVKLVQS-GAEVKKPGASVKV SCKASG-YIFT | G------YYMH | WVRQAPGQ GLEWMG | WINPN---SGGTNYVQK FQG | RVTMTRDTSISTAYMELSRL RSEDTAVYYCAR | VYYYGSGS------YNEEFDY | WGQGT LVTVS S |
| | VH3J3-33/D7/7-27/RF2/JH4 | | QVQLVES-GGGVVQPGRSLRL SCAASG-FTFS | ------YGMH | WVRQAPGK GLEWVA | VIWYD---ESNKYYADS VKG | RFTISRDNSKNTLYLQMNSL RAEDTAVYYCAR | ELGF------TDY | WGQGT LVTVS S |
| iPS:4 92920 | 21-225_29G4 | VH3J3-33/D7/7-27/RF2/J H4 | QVQLVES-GGGVVQPGRSLRL TCAASG-FTFS | D------YGIH | WVRQAPGK GLEWVA | VIWYD---ESNKYYADS MKG | RFTISRDNSKNTLYLQMNSL RAEDTAVYYCAR | ELGM------TGDY | WGQGT LVTVS S |
| iPS:4 33899 | 21-225_43C3 | VH3J3-33/D7/7-27/RF2/J H4 | QVQLVES-GGGVVQPGRSLRL SCAASG-FTFS | S------YGIH | WVRQAPGK GLEWVA | VIWYD---ENNKYYADS VKG | RFTISRDNSKNTLYLQMNSL RAEDTAVYYCAR | ELGF------SNDY | WGQGT LVTVS S |
| iPS:4 33921 | 21-225_44C3 | VH3J3-33/D7/7-27/RF2/J H4 | QVQLVES-GGGVVQPGRSLRL SCAASG-FTFS | S------YGMH | WVRQAPGK GLEWVA | VIWYD---GSNKYYADS VKG | RFTISRDNSKNTLYLQMSSL RAEDTAVYYCVR | ELGF------STDY | WGQGT LVTVS S |
| iPS:4 33933 | 21-225_44C8 | VH3J3-33/D7/7-27/RF2/J H4 | QVQLVES-GGGVVQPGRSLRL SCAASG-FTFN | N------YGMH | WVRQAPGK GLEWVA | VIWFE---GSNKYYADS VKG | RFTISRDNSKNTLYLQMNSL RAEDTAVYYCVR | ELGF------LSDY | WGQGT LVTVS S |
| iPS:4 33969 | 21-225_46F3 | VH3J3-33/D7/7-27/RF2/J H4 | QVQLVES-GGGVVQPGRSLRL SCAASG-FTFS | D------YGMH | WVRQAPGK GLEWVA | VIWYD---GSNKYYADS VKG | RFTISRDNSKNTLYLVQMNSL RAEDTAVYYCAR | ELGF------SNDY | WGQGT LVTVS S |
| iPS:4 33975 | 21-225_46C6 | VH3J3-33/D7/7-27/RF2/J H4 | QVQLVES-GGGVVQPGRSLRL SCAASG-FTFS | S------YGIH | WVRQAPGK GLEWVA | VIWFE---ENNKYYADS VKG | RFTISRDNSKNTLYLVQMNSL RAEDTAVYYCVR | ELGF------SNDY | WGQGT LVTVS S |
| iPS:4 33977 | 21-225_46D8 | VH3J3-33/D7/7-27/RF2/J H4 | QVQLVES-GGGVVQPGRSLRL SCAASG-FTFS | D------YGIH | WVRQAPGK GLEWVA | VIWFE---GSNKYYADS VKG | RFTISRDNSKNTLYLQMNSL RAEDTAVYYCAR | ELGF------SNDY | WGQGT LVTVS S |
| iPS:4 33983 | 21-225_47A1 | VH3J3-33/D7/7-27/RF2/J H4 | QVQLVES-GGGVVQPGRSLRL SCAASG-FTFS | D------YGMH | WVRQAPGK GLEWVA | VIWYD---DYNKKYADS VKG | RFTISRDNAKNTLYLQVNSL RVEDTAVYYCAI | ELGM------LFDY | WGQGT LVTVS S |
| iPS:4 33997 | 21-225_48C1 | VH3J3-33/D7/7-27/RF2/J H4 | QVQLVES-GGGVVQPGRSLRL SCAASG-FTFS | S------YGMH | WVRQAPGK GLEWVA | VVWYD---EINKKYADS VKG | RVTISRDNSKNTLYLQMNSL RAEDTAMYYCAR | ELGW------EADY | WGQGT LVTVS S |
| iPS:4 34009 | 21-225_48A9 | VH3J3-33/D7/7-27/RF2/J H4 | QVQLVES-GGGVVQPGRSLRL SCAASG-FTFS | S------YGMH | WVRQAPGK GLEWVA | VIWYE---ENKKYYADS VKG | RFTISRDNSKNTLFLQMNSL RAEDTAMYFCAR | ELAW------YEDY | WGQGT LVTVS S |

Figure 51 (Continued)

| | | | | | | | | | |
|---|---|---|---|---|---|---|---|---|---|
| iPS:4 34013 | 21-225_48D12 | VH3 3-33/D7/7-27/RF2/JH4 | QVQLVES-GGGVVQPGRSLRLSCAASG-FTFS | D------YGMH | WVRQAPGKGLEWVA | VIWYD----VSNKYYVDSVKG | RFTISRDNSKNTLYLQMNSLRAEDTAVYYCAR | ELGM--------RSDY | WGQGTLVTVSS |
| iPS:4 34019 | 21-225_49A1 | VH3 3-33/D7/7-27/RF2/JH4 | QVQLVES-GGGVVQPGRSLRLSCAASG-FTFS | D------YGMH | WVRQAPGKGLEWVA | VIWYD----EDNKYYVDSVKG | RFTISRDNSKNTLYLQMNSLRAEDTAVYYCAR | ELGF--------LSDY | WGQGTLVTVSS |
| iPS:4 34029 | 21-225_49C6 | VH3 3-33/D7/7-27/RF2/JH4 | QVQLVES-GGGVVQPGRSLRLSCAASG-FTFS | N------YGMH | WVRQAPGKGLEWVA | VIWYD----VSNKKYVDSVKG | RFTISRDNSKNTLYLQMSSLRAEDTAVYYCAR | DLGM--------IEDY | WGQGTLVTVSS |
| iPS:4 34057 | 21-225_51E4 | VH3 3-33/D7/7-27/RF2/JH4 | QVQLVES-GGGVVQPGRSLRLSCAASG-FTFS | S------YGMH | WVRQAPGKGLEWVA | VIWYD----ESNKYYADSVKG | RFTISRDNSKNTLYLQMNSLRAEDTAVYYCAR | ELGF--------LSDY | WGQGTLVTVSS |
| iPS:4 34071 | 21-225_51F9 | VH3 3-33/D7/7-27/RF2/JH4 | QVQLVES-GGGVVQPGRSLRLSCAASG-FTFS | D------YGMH | WVRQAPGKGLEWVA | VIWFD----GNNKYYADSVKG | RFTISRDNSKNTLYLQMNSLSAEDTAVYYCAR | ELGF--------LSDY | WGQGTLVTVSS |
| iPS:4 34075 | 21-225_51B11 | VH3 3-33/D7/7-27/RF2/JH4 | QVQLVES-GGGVVQPGRSLRLSCAASG-FTFS | D------YGMH | WVRQAPGKGLEWVA | VIWFG----GNNKYYADSVKG | RFTISRDNSKNTLYLQMNSLSAEDTAVYYCAR | ELGF--------LSDY | WGQGTLVTVSS |
| iPS:4 34077 | 21-225_51F11 | VH3 3-33/D7/7-27/RF2/JH4 | QVQLVES-GGGVVQPGRSLRLSCAASG-FTFS | N------FGMH | WVRQAPGKGLEWVA | VIWYE----ESNKYYADSVKG | RFTISRDNSKNTLYLQMNSLRAEDTAVYYCAR | ELGF--------LSDF | WGQGTLVTVSS |
| iPS:4 34081 | 21-225_52B2 | VH3 3-33/D7/7-27/RF2/JH4 | QVQLVES-GGGVVQPGRSLRLSCAASG-FTFS | N------YGMH | WVRQAPGKGLEWVA | VTWFD----GSNQRYADSVKG | RFTISRDISKNTLYLQMNSLSAEDTAVYYCAR | DLGM--------IEDF | WGQGTLVTVSS |
| iPS:4 34091 | 21-225_52B9 | VH3 3-33/D7/7-27/RF2/JH4 | QVQLVES-GGGVVQPGRSLRLSCAASG-FTFS | D------YGMH | WVRQAPGKGLEWVA | VIWFD----GNNKYYADSVKG | RFTISRDNSKNTLYLQMNSLSAEDTAVYYCAR | ELGF--------LSDY | WGQGTLVTVSS |
| iPS:4 34105 | 21-225_53D2 | VH3 3-33/D7/7-27/RF2/JH4 | QVQLVES-GGGVVQPGRSLRLSCAASG-FTFS | N------YGMH | WVRQAPGKGLEWVT | VVWDD----GSNKYYADSVKG | RFTISRDNSKNTLYLQMNSLRAEDTAVYYCAR | GLGF--------TGDY | WGQGALVTVSS |
| iPS:4 34119 | 21-225_53E6 | VH3 3-33/D7/7-27/RF2/JH4 | QVQLVES-GGGVVQPGRSLRLSCTISG-FTFS | D------YGIH | WVRQAPGKGLEWVA | VIWYD----ESNKYYADSVKG | RPAISRDNSKNTLYLQMNSLRAEDTAVYYCVR | ELGM--------TSDY | WGQGTLVTVSS |
| iPS:4 34129 | 21-225_53B12 | VH3 3-33/D7/7-27/RF2/JH4 | QVQLVES-GGGVVQPGRSLRLSCAASG-FTFS | N------FGMH | WVRQAPGKGLEWVA | VVWYD----GNNRYYADSVKG | RFTISRDNSKNTLYLQMHSLRAEDTAVYYCAR | ELGF--------LSDF | WGQGTLVTVSS |

Figure 51 (Continued)

| | | | | | | | | | |
|---|---|---|---|---|---|---|---|---|---|
| iPS:4 34131 | 21-225_54D3 | VH3-33/D7/7-27/RF2/JH4 | QVQLVES-GGGVVQPGRSLRLSCAASG-FTFS | N------YGMH | WVRQAPGK GLEWVA | VIWFD---GNNNYADS VKG | RFTISRDNSKNTLYLQMNSL RAEDTAVYYCAR | ELGF--------LSDY | WGQGT LVTVS S |
| iPS:4 34141 | 21-225_54C6 | VH3-33/D7/7-27/RF2/JH4 | QVQLVES-GGGVVQPGRSLRLSCTTSG-FTFS | D------YGIH | WVRQAPGK GLEWVA | VIWYD---ENNKYYADS VKG | RFAISRDNSKNTLYLQMNSL RAEDTAVYYCVR | ELGM--------TSDY | WGQGT LVTVS S |
| iPS:4 34143 | 21-225_54G7 | VH3-33/D7/7-27/RF2/JH4 | QVQLVES-GGGVVQPGRSLRLSCAASG-FTFS | N------YGMH | WVRQAPGK GLEWVA | VIWYE---ESNKYYGDS VKG | RPTISRDNSKNTLYLQMNSL RAEDTAVYYCAR | ELGF--------LSDY | WGQGT LVTVS S |
| iPS:4 34155 | 21-225_55B3 | VH3-33/D7/7-27/RF2/JH4 | QVQLVES-GGGVVQPGRSLRLSCAASG-FTFS | S------YGMH | WVRQAPGK GLEWVA | VIWFD---GNNKYEDS VKG | RFTISRDNSKNTLYLQMNSL RAEDTAVYYCVR | ELGF--------LSDY | WGQGT LVTVS S |
| iPS:4 34199 | 21-225_59F11 | VH3-33/D7/7-27/RF2/JH4 | QVQLVES-GGGVVQPGRSLRLSCAASG-FTFS | N------YGMH | WVRQAPGK GLEWVA | VIWYD---ESNKHYADS VKG | RFTISRDSKTTLYLQMSSL RAEDTAVYYCSR | ELGM--------NGDY | WGQGT LVTVS S |
| iPS:4 34207 | 21-225_60A3 | VH3-33/D7/7-27/RF2/JH4 | QVQLVES-GGGVVQPGRSLRLSCAASG-FTFS | S------YGMH | WVRQAPGK GLEWVA | VIWYE---ESNKYYADS VKG | RFTISRDNSKNTLYLQMNSL RAEDTAVYYCAR | ELGM--------TGDY | WGQGT LVTVS S |
| iPS:4 34253 | 21-225_62E4 | VH3-33/D7/7-27/RF2/JH4 | QVQLVES-GGGVVQPGRSLRLSCAASG-FTFS | D------YGMH | WVRQAPGK GLEWVA | VIWYD---RSNKYYADS VKG | RFTISRDNSKNTLYLQMNSL RVEDTAVYYCAR | ELGM--------SSDY | WGQGT LVTVS S |
| iPS:4 34271 | 21-225_57A4 | VH3-33/D7/7-27/RF2/JH4 | QVQLVES-GGGVVQPGRSLRLSCVASG-FTFS | D------YGMH | WVRQAPGK GLEWVA | VIWYA---GSNKYYVDS VKG | RPTISRDNSKNTLYLQMNSL RAEDTAVYYCAR | ELGM--------RSDY | WGQGT LVTVS S |
| iPS:4 34293 | 21-225_58F5 | VH3-33/D7/7-27/RF2/JH4 | QVQLVES-GGGVVQPGRSLRLSCVASG-FTFS | D------YGMH | WVRQAPGK GLEWVA | VIWYA---GSNKYHVDS VKG | RFTISRDNSKNTLYLQMNSL RAEDTAVYYCAR | ELGM--------RSDY | WGQGT LVTVS S |
| iPS:4 34337 | 21-225_64E1 | VH3-33/D7/7-27/RF2/JH4 | QVQLVES-GGGVVQPGRSLRLSCAASG-FTFS | S------YGMH | WVRQAPGK GLEWVA | VIWFE---ETNKYYGDS VKG | RFTISRDNSKNTLYLQMNSL RAEDTAVYYCAR | ELGM--------SSDY | WGQGT LVTVS S |
| iPS:4 34357 | 21-225_65C1 | VH3-33/D7/7-27/RF2/JH4 | QVQLVES-GGGVVQPGRSLRLSCAASG-FTFS | D------YGMH | WVRQAPGK GLEWVA | VIWFE---GSNKYYVDS VKG | RPTISRDNSKNTLYLQMNSL RAEDTAVYYCAR | ELGF--------SSDY | WGQGT LVTVS S |
| iPS:4 34375 | 21-225_66C7 | VH3-33/D7/7-27/RF2/JH4 | QVQLVES-GGGVVQPGRSLRLSCVASG-FTFS | D------YGMH | WVRQAPGK GLEWVA | VIWFE---GSHKYYTDS VKG | RFTISRDNSKNTLYLQMNSL RAEDTAVYYCAR | ELGF--------SSDY | WGQGT LVTVS S |

Figure 51 (Continued)

| | | | | | | | | |
|---|---|---|---|---|---|---|---|---|
| iPS:4 34411 | 21-225_68F11 | VH3)3-33D7)7-27)RF2)JH4 | QVQLVES-GGGVVQPGRSLRLSCAASG-FTFS | D------YGMH | WVRQAPGKGLEWVA | VIWYD----VSNKYYADSVKG | RFTISRDNSKNTLYLQMNSLRAEDTAVYYCVR | ELGW--------------TSDC | WGQGTLVTVSS |
| iPS:4 34441 | 21-225_71A2 | VH3)3-33D7)7-27)RF2)JH4 | QVQLVES-GGGVVQPGRSLRLSCATSG-FTFS | D------YGMH | WVRQAPGKGLEWVA | VIWYD----ESNKYYADSVKG | RFTISRDNSKNTLYLQMNSLRAEDTAVYYCAR | ELGW-------------QDDY | WGQGTLVTVSS |
| iPS:4 34447 | 21-225_71B6 | VH3)3-33D7)7-27)RF2)JH4 | QVQLVES-GGGVVQPGRSLRLSCAASG-FTFS | N------YGMH | WVQAPGKGLEWVA | VIWYD----RTNKYYADSVKG | RFTISRDNSKNTLHLQMNSLRAEDTAVYYCAR | ELGM-------------LSDY | WGQGTLVTVSS |
| iPS:4 34453 | 21-225_71B11 | VH3)3-33D7)7-27)RF2)JH4 | QVQLVES-GGGVVQPGRSLRLSCAASG-FTFS | D------YGMH | WVRQAPGKGLEWVA | VIWYD----RNNKYYGDSVKG | RFTISRDNSKNTLYLQMNSLRAEDTAVYYCAR | ELGM-------------LSDY | WGQGTLVTVSS |
| iPS:4 34457 | 21-225_72G12 | VH3)3-33D7)7-27)RF2)JH4 | QVQLVES-GGGVVQPGRSLRLSCAASG-FTFS | S------YGMH | WVRQAPETGLEWVA | VIWFD----ESNKYYADSVKG | RFTISRDNSKNTLYLQMNSLRAEDTAVYYCAR | ELGF-------------SSDY | WGQGTLVTVSS |
| iPS:4 35311 | 21-225_146H9 | VH3)3-33D7)7-27)RF2)JH4 | QVQLVES-GGGVVQPGRSLRLSCAASG-FSFS | S------YGMH | WVRQAPGKGLEWVA | VIWFD----ESNKHYGDSVKG | RFTISRDNSKNTLYLQMNSLRAEDTAVYYCAR | ELGF-------------LSDY | WGQGTLVTVSS |
| iPS:4 35511 | 21-225_157C3 | VH3)3-33D7)7-27)RF2)JH4 | QVQLVES-GGGVVQPGRSLRLSCAASG-FTFS | T------YGMH | WVRQAPGKGLEWVA | VIWYD----VNNKYYADSVKG | RFTISRDNSKNTLYLQMNSLRAEDTAVYYCAR | ELGF-------------LSDY | WGQGTLVTVSS |
| iPS:4 35533 | 21-225_157H8 | VH3)3-33D7)7-27)RF2)JH4 | QVQLVES-GGGVVQPGRSLRLSCAASG-FTFS | S------YGMH | WVRQAPGKGLEWVA | VIWYD----VNNKYYADSVKG | RFTISRDNSKNTLYLQMNSLRAEDTAVYYCAR | ELGF-------------LSDY | WGQGTLVTVSS |
| iPS:4 35551 | 21-225_158H6 | VH3)3-33D7)7-27)RF2)JH4 | QVQLVES-GGGVVQPGRSLRLSCAASG-FTFS | S------YGMH | WVRQAPGKGLEWVA | VIWYD----VTNKYYADSVKG | RFTISRDNSKNTLYLQMNSLRDEDTAVYYCVR | ELGW-------------AEDY | WGQGTLVTVSS |
| iPS:4 35569 | 21-225_159C5 | VH3)3-33D7)7-27)RF2)JH4 | QVQLVES-GGGVVQPGRSLRLSCAVSG-FTFS | S------YGIH | WVRQAPGKGLEWVA | VVWYD----VNNKYYADSVKG | RFTISRDNSKNTLYLQMNSLRAEDTAVYYCAR | ELGF-------------LSDY | WGQGTLVTVSS |
| iPS:4 36268 | 21-225_203B9 | VH3)3-33D7)7-27)RF2)JH4 | QVQLVES-GGGVVQPGRSLRLSCAASG-FTLS | S------FGMH | WVRQAPGKGLEWVA | VIWYD----VNNKYYADSVKG | RFTISRDNSKNTLYLQMNSLRPEDTAVYYCAR | ELGF-------------LSDY | WGQGILVTVSS |
| iPS:4 36328 | 21-225_207F12 | VH3)3-33D7)7-27)RF2)JH4 | QVQLVES-GGGVVQPGRSLRLSCAASG-FTFS | N------YGMH | WVRQAPGKGLEWVA | VIWYD----RNNKYYGDSVKG | RFTISRDNSKNTLYLQMNSLRAEDTAVYYCAR | ELGF-------------LFDY | WGQGTLVTVSS |

Figure 51 (Continued)

| | | | | | | | | |
|---|---|---|---|---|---|---|---|---|
| iPS:4 36556 | 21-225_224D10 | VH3/3-33/D7/7-27/RF2/JH4 | QVQLVES-GGGLVQPGKSLRLSCAASG-FTFS | S------YGMH | WVRQAPGK GLEWVA | VIWYE---GSNKYYVDS VKG | RFTISRDNSKSTLYLQMNSL RAEDTAVYYCVR | ELGF--------QSDY | WGQGT PVTVS S |
| iPS:3 92618 | 21-225_16F10 | VH3/3-33/D7/7-27/RF2/JH4 | QVQLVES-GGGVVQPGRSLRLSCAASG-FTFS | D------YGMH | WVRQAPGK GLEWVA | VIWYD---GNNKYYVDS VKG | RFTISRDNSKNTLYLQMNSL RAEDTAVYYCAR | ELAW--------YEDY | WGQGT LVTVS S |
| iPS:3 92626 | 21-225_18A5 | VH3/3-33/D7/7-27/RF2/JH4 | QVQLVES-GGGVVQPGRSLRLSYTASG-FTFS | D------YGMH | WVRQAPGK GLEWVA | VIWFD---GSNKYYADS VKG | RFTISRDNSKNTLYLQMNSL RAEDTAVYYCAR | DLGW--------TEEY | WGQGT LVTVS S |
| iPS:3 92630 | 21-225_20E5 | VH3/3-33/D7/7-27/RF2/JH4 | QVQLVES-GGGVVQPGRSLRLSCAASG-FTFS | D------YGMH | WVRQAPGK GLEWVA | VIWYE---ENNQYYADS VKG | RFTISRDNSKNTLYLQMNSL RAEDTAVYYCAR | ELGF--------RSDY | WGQGT LVTVS S |
| iPS:3 92640 | 21-225_18A1 | VH3/3-33/D7/7-27/RF2/JH4 | QVQLVES-GGGVVQPGRSLRLSCAVSG-FTFS | S------YGMH | WVRQAPGK GLEWVA | VIWYE---ENNKYYVDS VKG | RFTISRDNSKSTLYLQMNSL RAEDTAVYYCVR | ELGF--------QSDY | WGQGT PVTVS S |
| iPS:3 92644 | 21-225_19E1 | VH3/3-33/D7/7-27/RF2/JH4 | QVQLVES-GGGVVQPGRSLRLSCAASG-FTFS | N------YGMH | WVRQAPGK GLEWVA | VIWYE---ENNQYYADS VKG | RFTISRDNSKNTLYLQMNSL RAEDTAVYYCAR | ELGF--------RSDY | WGQGT LVTVS S |
| iPS:3 92654 | 21-225_17A10 | VH3/3-33/D7/7-27/RF2/JH4 | QVQLVES-GGGVVQPGRSLRLSCAASG-FTFS | N------YGMH | WVRQAPAK GLEWVA | VIWYE---ENNQYYADS VKG | RFTISRDNSKNTLYLQMNSL RAEDTAVYYCAR | ELGF--------RSDY | WGQGT LVTVS S |
| iPS:3 92658 | 21-225_18E8 | VH3/3-33/D7/7-27/RF2/JH4 | QVQLVES-GGGVVQPGRSLRLSCAASG-FTFS | N------YGMH | WVRQAPGK GLEWVA | VIWYE---ENNQYYADS VKG | RFTVSRDNSKNTLFLQMNSL RAEDTAVYYCAR | ELGF--------RSDY | WGQGT LVTVS S |
| iPS:3 92666 | 21-225_16F11 | VH3/3-33/D7/7-27/RF2/JH4 | QVQLVES-GGGVVQPGRSLRLSCAASG-FTFS | S------YGMH | WVRQAPGK GLEWVA | VIWYE---ENNKYYVDS VKG | RFTISRDNSKSTLYLQMNSL RAEDTAVYYCAR | ELGF--------QSDY | WGQGT PVTVS S |
| iPS:3 92674 | 21-225_18C2 | VH3/3-33/D7/7-27/RF2/JH4 | QVQLVES-GGGVVQPGRSLRLSCAASG-FTFS | D------YGMH | WVRQAPGK GLEWMA | VIWYD---VTNKYYADS VKG | RFTISRDNSKNTLYLQMNSL RAEDTAVYYCAR | ELGW--------YEDY | WGQGT LVTVS S |
| iPS:3 92680 | 21-225_20A7 | VH3/3-33/D7/7-27/RF2/JH4 | QVQLVES-GGGVVQPGRSLRLSCAASG-FTFS | N------YGMH | WVRQAPGK GLEWVA | VIWYE---ENNQYYADS VKG | RFTISRDNSKNTLYLQMNSL SAEDTAVYYCAR | ELGF--------RSDY | WGQGT LVTVS S |
| iPS:3 92686 | 21-225_17C7 | VH3/3-33/D7/7-27/RF2/JH4 | QVQLVES-GGGVVQPGRSLRLSCAASG-FTFS | D------YGMH | WVRQAPGK GLEWVA | VIWFD---GSNKYYADS VKG | RFTISRDNSKNTLYLQMNSL RAEGTAIYYCAR | DLGW--------TEEY | WGQGT LVTVS S |

Figure 51 (Continued)

| | | | | | | | | | |
|---|---|---|---|---|---|---|---|---|---|
| iPS:3 92690 | 21-225_18F2 | VH3/3-33/D7/7-27/RF2/JH4 | QVQLVES-GGGVVQPGRSLRLSCAASG-FTFS | D------YGMH | WVRQAPGK GLEWVA | VIWFD----GSNKYYVDS VKG | RFTISRDNSKNTLYLQMNSL RVEDTAVYYCAR | DLGW--------------TEEY | WGQGT LVTVS S |
| iPS:3 92716 | 21-225_17B5 | VH3/3-33/D7/7-27/RF2/JH4 | QVQLVES-GGGVVQPGRSLRLSCAASG-FTFS | D------YGMH | WVRQAPGK GLEWVA | VIWYD----ESNKHYIDS VKG | RFTISRDNSKNTLYLQMNSL RAEDTAVYYCVR | ELGF--------------RFDY | WGQGT LVTVS S |
| iPS:3 92732 | 21-225_17E5 | VH3/3-33/D7/7-27/RF2/JH4 | QVQLVES-GGGVVQPGRSLRLSCAASG-FTFS | D------YGMH | WVRQAPGK GLEWVA | LIWYD----VTNKYYGDS VKG | RFTISRDNSQNTLYLQLNSL RAEDTAVYYCAR | ELGW--------------YEDY | WGQGT LVTVS S |
| iPS:3 92744 | 21-225_20D5 | VH3/3-33/D7/7-27/RF2/JH4 | QVQLVES-GGGVVQPGRSLRLSCAASG-FTFS | S------YGMH | WVRQAPGK GLEWVA | VIWYE----ENNQYYADS VKG | RFTISRDNSKNTLYLQMNSL RADDTAVYYCAR | ELGF--------------RSDY | WGQGT LVTVS S |
| iPS:3 92758 | 21-225_21G11 | VH3/3-33/D7/7-27/RF2/JH4 | QVQLVES-GGGVVQPGRSLRLSCAASG-FTFS | D------YGMH | WVRQAPGK GLEWMA | VIWYD----VTNEYYADS VKG | RFTISRDNSKNTLYLQMNSL RAEDTAVYYCAR | ELGW--------------YEDY | WGQGT LVTVS S |
| iPS:3 92772 | 21-225_20E12 | VH3/3-33/D7/7-27/RF2/JH4 | QVQLVES-GGGVVQPGRSLRLSCAASG-FTFS | S------YGMH | WVRQAPGK GLEWVA | VMWYD----ESNKHYADS VKG | RFTISRDNSKNTLYLQMNSL RAEDTAVYYCAR | ELGF--------------RFDY | WGQGT LVTVS S |
| iPS:3 92790 | 21-225_20D10 | VH3/3-33/D7/7-27/RF2/JH4 | QVQLVES-GGGVVQPGRSLRLSCAASG-FTFS | D------YGMH | WVRQAPGK GLEWVA | VIWFD----GSNKYYVDS VKG | RFTISRDDSKNTLYLQMNSL RAEDTAVYYCAR | DLGW--------------TEEY | WGQGT LVTVS S |
| iPS:3 92796 | 21-225_22A4 | VH3/3-33/D7/7-27/RF2/JH4 | QVQLVES-GGGVVQPGRSLRLSCAASG-FTFS | D------YGIH | WVRQAPGK GLEWVA | VIWYD----GSNKYYADS VKG | RITISRDNSKNTLYLQMNSL RAEDTAVYYCAR | DLGW--------------TEEY | WGQGT LVTVS S |
| iPS:3 92810 | 21-225_20H12 | VH3/3-33/D7/7-27/RF2/JH4 | QVQLVES-GGGVVQPGSLRLSCAASG-FTFS | N------YGMH | WVRQAPGK GLEWVA | VIWYD----ENNKYYVDS VKG | RFTISRDNSKNTLYLQMNSL RAEDTAVYYCAR | ELGW--------------RSDY | WGQGT LVTVS S |
| iPS:3 92832 | 21-225_21H8 | VH3/3-33/D7/7-27/RF2/JH4 | QVQLVES-GGGVVQPGRSLRLSCAASG-FTFS | D------YGMH | WVRQAPGK GLEWVA | VIWYD----GSNKYYADS VKG | RFTISRDNSKNTLYLQMNSL RAEDTAVYYCAR | DLGW--------------TEEY | WGQGT LVTVS S |
| iPS:3 92854 | 21-225_21E5 | VH3/3-33/D7/7-27/RF2/JH4 | QVQLVES-GGGVVQPGRSLRLSCAASG-FTFS | D------YGMH | WVRQAPGK GLEWVA | VIWYD----ESNKYYADS VKG | RPTISRDNSKNTLYLQMNSL RAEDTAMYYCTR | ELGF--------------RSDY | WGQGT LVTVS S |
| iPS:3 92860 | 21-225_22H8 | VH3/3-33/D7/7-27/RF2/JH4 | QVQLVES-GGGVVQPGRSLRLSCAASG-FTFS | S------YGMH | WVRQAPGK GLEWVA | VIWYD----GNNKYYADS VKG | RFTISRDNSKNTLYLQMNSL RAEDTAVYYCAR | ELAW--------------YEDY | WGQGT LVTVS S |

Figure 51 (Continued)

| | | | | | | | | | |
|---|---|---|---|---|---|---|---|---|---|
| iPS:3 92866 | 21-225_23H11 | VH3J3-33[D7]7-27[RF2]J H4 | QEQLVES-GGGVVQPGRSLRL SCAASG-FTFS | S------YGMH | WVRQAPGK GLEWVA | VIWYD---ENNKYYVDS VKG | RFTISRDNSKNTLYLQMNSL RAEDTAVYYCAR | ELGF--------RSDY | WGQGT LVTVS S |
| iPS:3 92876 | 21-225_21F7 | VH3J3-33[D7]7-27[RF2]J H4 | QVQLVES-GGGVVQPGRSLRL SCAASG-FTFS | D------YGMH | WVRQAPGK GLEWVA | VIWFD---GNNKYYVDS VKG | RFTISRDNSKNTLYLQMNSL RAEDTAVYYCAR | DLGW--------TEEY | WGQGT LVTVS S |
| iPS:3 92880 | 21-225_22F9 | VH3J3-33[D7]7-27[RF2]J H4 | QVQMVES-GGGVVQPGRSLRL SCAASG-FTFS | S------YGMH | WVRQAPGK GLEWVA | VIWYE---ENNKDYVDS VKG | RFTISRDNSKSTLYLQMNSL RAEDTAVYYCVR | ELGF--------QSDY | WGQGT PVTVS S |
| iPS:3 92894 | 21-225_21G2 | VH3J3-33[D7]7-27[RF2]J H4 | QVQLVES-GGGVVQPGRSLRL SCAASG-FTFS | D------YGMH | WVRQAPGK GLEWMA | VIWYD---VTNKYYADS VKG | RFTISRDNSKNTLYLEMNSL RAEDTAVYYCAR | ELGW--------YEDY | WGQGT LVTVS S |
| iPS:3 92900 | 21-225_22F2 | VH3J3-33[D7]7-27[RF2]J H4 | QVQLVES-GGGVVQPGRSLRL SCAASG-FTFS | D------YGMH | WVRQAPGK GLEWVA | VIWYE---GSNKYYVDS VRG | RFTISRDNSKSTLYLQMNSL RAEDTAVYYCVR | ELGF--------QSDY | WGQGT PVTVS S |
| iPS:3 92908 | 21-225_23F12 | VH3J3-33[D7]7-27[RF2]J H4 | QVQLVES-GGGVVQPGRSLRL SCVASG-FTFS | S------YGMH | WVRQAPGK GLEWVA | VIWYD---ETNKYYADS VKG | RFTISRDNSKNTLYLQMNSL RAEDTAIYYCAR | ELAW--------YEDY | WGQGS LVTVS S |
| iPS:3 92918 | 21-225_28F5 | VH3J3-33[D7]7-27[RF2]J H4 | QVQLVES-GGGVVQPGRSLRL SCAASG-FTFS | S------YGMH | WVRQAPGK GLEWVA | VIWYD---ENNKYYVDS VKG | RFTISRDNSKNTLYLQMNSL RAEDTAVYYCAR | ELGW--------YDDY | WGQGT LVTVS S |
| iPS:3 92934 | 21-225_27D5 | VH3J3-33[D7]7-27[RF2]J H4 | QVQLVES-GGGVVQPGRSLRL SCAASG-FTFS | S------YGMH | WVRQAPGK GLEWVA | VIWYD---ESNKYYGDS VKG | RFTISRDNSKNMLYLQMNSL RGEDTALYYCAR | ELGF--------LSDY | WGQGT LVTVS S |
| iPS:3 92958 | 21-225_28C7 | VH3J3-33[D7]7-27[RF2]J H4 | QVQLVES-GGGVVQPGRSLRL SCAASG-FTFS | S------YGMH | WVRQAPGK GLEWVA | VIWYD---ESNKYYADS VKG | RFTISRDNSKNTLYLQMNSL RAEDTAVYYCAR | ELGW--------YDDY | WGQGT LVTVS S |
| iPS:3 92968 | 21-225_25B6 | VH3J3-33[D7]7-27[RF2]J H4 | QVQLVES-GGGVVQPGRSLRV SCIASG-PTLR | N------YGMH | WVRQAPGK GLEWVA | VIWYE---ESNKYTES VKG | RFTISRDNSKNTLYLQMNSL RAEDTAVYYCAR | ELGF--------LSDY | WGQGT LVTVS S |
| iPS:3 92972 | 21-225_26A2 | VH3J3-33[D7]7-27[RF2]J H4 | QVQLVES-GGGVVQPGRSLRL SCIASG-FTFS | S------YGMH | WVRQAPGK GLEWVA | VIWYE---GSNKYYVDS VKG | RFTISRDNSKNTLYLQMNSL RAEDTAVYYCAR | ELGW--------YDDY | WGQGT LVTVS S |
| iPS:3 92980 | 21-225_29H6 | VH3J3-33[D7]7-27[RF2]J H4 | QVQLVES-GGGVVQPGRSLRL SCAASG-FTFS | D------YGMH | WVRQAPGK GLEWVT | VIWYN---ENNKYYADS VKG | RFTISRDNSKNTLYLQMNSL RAEDTAVYYCAR | ELGM--------TGDS | WGQGT LVTVS S |

Figure 51 (Continued)

| | | | | | | | | | | |
|---|---|---|---|---|---|---|---|---|---|---|
| iPS:3 92988 | 21-225_25E6 | VH3)3-33/D7\|7-27\|RF2/J H4 | QVQLVES-GGGVVQPGRSLRL SCAASG-FTFS | D------YGMH | WVRQAPGK GLEWVA | VIWYD---ENNKYADS VKG | RFTISRDNSKNTLYLQMNSL RAEDTALYYCAT | ELGM----------- | --------TGDS | WGQGT LVTVS S |
| iPS:3 92990 | 21-225_25H10 | VH3\|3-33/D7\|7-27\|RF2/J H4 | QVQLVES-GGGVVQPGRSLRL SCAASG-FTFS | D------YGMH | WVRQAPGK GLEWVA | VIWYD---ESNKYYADS MKG | RFTISRDNSKNTLYLQMNSL RAEDTAVYYCAR | ELGM----------- | --------TGDY | WGQGT LVTVS S |
| iPS:3 93000 | 21-225_29D7 | VH3\|3-33/D7\|7-27\|RF2/J H4 | QVQLVES-GGGVVQPGRSLRL SCAASG-FTFS | S------YGMH | WVRQAPGK GLEWVA | VIWYD---ESNKYYGDS VKG | RFTISRDNSKNTLYLQMNSL RGEDTALYYCAR | ELGF----------- | --------LSDY | WGQGT LVTVS S |
| iPS:3 93018 | 21-225_29B8 | VH3\|3-33/D7\|7-27\|RF2/J H4 | QVQLVES-GGGVVQPGRSLRL SCAASG-FTFS | D------YGMH | WVRQAPGK GLEWVA | VIWYD---ENNKYADS VKG | RFTISRDNSKNTLYLQMNSL RAEDTAVYYCAR | ELGM----------- | --------TGDS | WGQGT LVTVS S |
| iPS:3 93030 | 21-225_25H11 | VH3\|3-33/D7\|7-27\|RF2/J H4 | QVQLVES-GGGVVQPGRSLRL SCAASG-FTFS | D------YGMH | WVRQAPGK GLEWVA | VIWYD---ENNKYYADS VKG | RFTISRDNSKNTLYLQMNSL RAEDTAVYYCAR | ELGM----------- | --------TGDS | WGQGT LVTVS S |
| iPS:3 93034 | 21-225_27F2 | VH3\|3-33/D7\|7-27\|RF2/J H4 | QEQLVES-GGGVVQPGRSLRL SCAASG-FTFS | D------YGMH | WVRQAPGK GLEWVA | VIWYD---ENNKYVDS VRG | RFTISRDNSKNTLYLQMNSL RAEDTAVYYCAR | ELGM----------- | --------TGDS | WGQGT LVTVS S |
| iPS:3 93048 | 21-225_27C3 | VH3\|3-33/D7\|7-27\|RF2/J H4 | QVQLVES-GGGVVQPGRSLRL SCAASG-FTFS | D------YGMH | WVRQAPGK GLEWVA | VIWYD---ENNKYADS VKG | RFTISRDNSKNTLYLQMNSL RAEDTAVYYCAR | ELGM----------- | --------TGDS | WGQGT LVTVS S |
| iPS:3 93054 | 21-225_29G8 | VH3\|3-33/D7\|7-27\|RF2/J H4 | QVQLVES-GGGVVQPGRSLRL SCAASG-FTFS | D------YGMH | WVRQAPGK GLEWVA | VIWYD---ETNKYADS VKG | RFTISRDNSKNTLYLQMNSL RAEDTAVYYCAR | ELGM----------- | --------TSDY | WGQGT LVTVS S |
| iPS:3 93812 | 21-225_6A11 | VH3\|3-33/D7\|7-27\|RF2/J H4 | QVQLVES-GGGVVQPGRSLRL SCAASG-FTFS | D------YGMH | WVRQAPGK GLEWVA | VIWFD---GSNKYADS VKG | RFTISRDNSKNTLYLQMNSL RAEDTAVYDCAR | DLGW----------- | --------TEEY | WGQGT LVTVS S |
| iPS:3 93818 | 21-225_6G12 | VH3\|3-33/D7\|7-27\|RF2/J H4 | QVQLVES-GGGVVQPGRSLRL SCAASG-FTFS | D------YGMH | WVRQAPGK GLEWVA | VIWYE---RSNNYADS VKG | RFTISRDNSKNTLYLQMNSL RAEDTAVYYCAR | ELGF----------- | --------RSDY | WGQGT LVTVS S |
| iPS:3 93820 | 21-225_8H7 | VH3\|3-33/D7\|7-27\|RF2/J H4 | QVQLVES-GGGVVQPGRSLRL SCPASG-FTFS | D------FGMH | WVRQAPGK GLEWVA | VIWYD---ENNQYADS VKG | RFTISRDNSKNTLYLQMNSL RAEDTAVYYCAR | ELGF----------- | --------RSDY | WGQGT LVTVS S |
| iPS:3 93826 | 21-225_10G5 | VH3\|3-33/D7\|7-27\|RF2/J H4 | QVQLVES-GGGVVQPGRSLRL SCAASG-FTFS | N------YGMH | WVRQAPGK GLEWVA | VIWYE---ENNQYADS VKG | RFTISRDNSKNTLYLQMNSL RAEDTAVYYCTR | ELGF----------- | --------RSDY | WGQGT LVTVS S |

Figure 51 (Continued)

| | | | | | | | | |
|---|---|---|---|---|---|---|---|---|
| iPS:3 93828 | 21-225_10H12 | VH3/3-33/D7/7-27/RF2/J H4 | QVQLVES-GGGVVQPGRSLRL SCAASG-FTFS | D------YGMH | WVRQAPGK GLEWVA | VIWYE---DNNQYYADS VKG | RFTISRDNSKNTLYLQMNSL RAEDTAVYYCAR | ELGF--------RSDY | WGQGT LVTVS S |
| iPS:3 93830 | 21-225_12A1 | VH3/3-33/D7/7-27/RF2/J H4 | QVQLVES-GGGVVQPGRSLRL SCAASG-FTFS | S------YGMH | WVRQAPGK GLEWVA | VIWYE---ENMQYYADS VKG | RFTISRDNSKNTLYLQMNSL RAEDTAVYYCAR | ELGF--------RSDY | WGQGT LVTVS S |
| iPS:3 93838 | 21-225_6G2 | VH3/3-33/D7/7-27/RF2/J H4 | LVQLVES-GGGVVQPGKSLRL SCAASG-FTFS | D------YGIH | WVRQAPGK GLEWVA | VIWFD---GSNKYYADS VKG | RFTISSDNSKNTLYLQMNSL RAEDTAVYYCAR | DLGW--------TEEY | WGQGT LVTVS S |
| iPS:3 93854 | 21-225_7H11 | VH3/3-33/D7/7-27/RF2/J H4 | QVQLVES-GGGVVQPGRSLRL SCSASG-FTFS | D------YGMH | WVRQAPGK GLEWVA | VIWYD---ENNKYYADS VKG | RFTISRDNSKNTLYLQMNSL RAEDTAVYYCAR | ELGF--------RSDY | WGQGT LVTVS S |
| iPS:3 93866 | 21-225_14E3 | VH3/3-33/D7/7-27/RF2/J H4 | QVQLVES-GGGVVQPGRSLRL SCAASG-FTFS | D------FGMH | WVRQAPGK GLEWVA | VIWYE---ENNQYYADS VKG | RFTISRDNSKNTVYLQMNSL RAEDTAFYYCAR | ELGF--------RSDY | WGQGT LVTVS S |
| iPS:3 93876 | 21-225_9A1 | VH3/3-33/D7/7-27/RF2/J H4 | QVQVVES-GGGVVQPGRSLRL SCAASG-FTFS | D------YGMH | WVRQAPGK GLEWVA | VIWFD---GSNKYYADS VKG | RFTISRDNSKNTLYLQMNSL RAEDTAVYYCAR | DLGW--------TEEY | WGQGT LVTVS S |
| iPS:3 93882 | 21-225_15E3 | VH3/3-33/D7/7-27/RF2/J H4 | QVQLVES-GGGVVQPGRSLRL SCAASG-FTFS | S------YGMH | WVRQAPGK GLEWVA | VIWYE---ENNKHYADS VKG | RFTISRDNSKNTLYLQMNSL RAEDTAVYYCAR | ELGF--------LSDY | WGQGT LVTVS S |
| iPS:3 93884 | 21-225_16F4 | VH3/3-33/D7/7-27/RF2/J H4 | QVQLVES-GGGVVQPGRSLRL SCAASG-FTFS | N------YGMH | WVRQAPGK GLEWVA | VIWYE---GSNQYYGDS VKG | RFTISRDNSKNTVYLQMHSL RAEDTAVYYCAR | ELGF--------LSDY | WGQGT PVTVS S |
| iPS:3 93912 | 21-225_16F6 | VH3/3-33/D7/7-27/RF2/J H4 | QVQLVES-GGGVVQPGRSLRL SCAASG-FTFS | N------YGMH | RVKQAPGK GLEWVA | VIWYE---GSNQYYGDS VKG | RFTISRDNSKNTVYLQMNSL RAEDTAVYYCAR | ELGF--------LSDY | WGQGT LVTVS S |
| iPS:3 93922 | 21-225_2B2 | VH3/3-33/D7/7-27/RF2/J H4 | QVQLVES-GGGVVQPGRSLRL SCAASG-FTFS | S------YGMH | WVRQAPGK GLEWVA | VIWYE---ENNKYVDS VKG | RFTISRDNSKSTLYLQMNSL RAEDTAVYYCVR | ELGF--------QSDY | WGQGT PVTVS S |
| iPS:3 93934 | 21-225_13E6 | VH3/3-33/D7/7-27/RF2/J H4 | QVQLVES-GGGVVQPGRSLRL SCAASG-FTFS | N------YGMH | WVRQAPGK GLEWVA | VIWYD---ENNKYYDS VKG | RPTISRDNSKNTLYLQMNSL RAEDTAVYYCAR | ELGF--------RSDY | WGQGT LVTVS S |
| iPS:3 93948 | 21-225_16A5 | VH3/3-33/D7/7-27/RF2/J H4 | QVQLVES-GGGVVQPGRSLRL SCAASG-FTFS | D------YGMH | WVRQAPGK GLEWVA | VIWFD---GSNKYVDS VKG | RFTISRDNSKNTLYLQMSSL RAEDTAVYYCAR | DLGW--------TEEY | WGQGT LVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS.3 93960 | 21-225_7G2 | VH3\|3-33\|D7\|7-27\|RF2\|JH4 | QVQLVES-GGGVVQPGRSLRLSCAASG-FTFS | D------YGMH | WVRQAPGKGLEWMA | VIWYD----VTNKYYADSVKG | RFTISRDNSKNTLYLQLNSLRAEDTAVYYCAR | ELGW----------YEDY | WGQGTLVTVSS |
| iPS.3 93974 | 21-225_7C4 | VH3\|3-33\|D7\|7-27\|RF2\|JH4 | QVQLVES-GGGVVQPGKSLRLSCAASG-FTFS | N------YGMH | WVRQAPGKGLEWVA | VIWYE----ENNQYYADSVKG | RFTISRDNSKNTLYLQMNSLRAEDTAVYYCAR | ELGF----------RSDY | WGQGTLVTVSS |
| iPS.3 93976 | 21-225_7E9 | VH3\|3-33\|D7\|7-27\|RF2\|JH4 | QVQLVES-GGGVVQPGRSLRLSCAASG-FTFS | D------YGMH | WVRQAPGKGLEWVA | VIWYD----ENNKYYVDSVKG | RFTISRDNSKNTLYLQMNSLRAEDTAVYYCAR | ELGF----------RSDY | WGQGTLVTVSS |
| iPS.3 93994 | 21-225_8C9 | VH3\|3-33\|D7\|7-27\|RF2\|JH4 | QVQLVES-GGGVVQPGRSLRLSCAASG-FTFS | S------YGMH | WVRQAPGKGLEWVA | VIWYD----ENNKYYVDSVKG | RFTISRDNSKNTLYLQMNSLRAEDTAVYYCAR | ELGF----------RSDY | WGQGTLVTVSS |
| iPS.3 93998 | 21-225_12B12 | VH3\|3-33\|D7\|7-27\|RF2\|JH4 | QVQLVES-GGGVVQPGRSLRLSCAASG-FTFS | D------YGMH | WVRQAPGKGLEWMA | VIWYD----VTNKYYADSVKG | RFTISRDNSKNTLYLQMNSLRAEDTAVYYCAR | ELGW----------YEDY | WGQGTLVTVSS |
| iPS.3 94024 | 21-225_16B7 | VH3\|3-33\|D7\|7-27\|RF2\|JH4 | QVQLVES-GGGVVQPGRSLRLSCAASG-FTFS | S------YGMH | WVRQAPGKGLEWVA | VIWYE----ENNQYYADSVKG | RFTISRDNSKNTLYLQMNSLRAEDTAVYYCAR | ELGF----------LSDY | WGQGTLVTVSS |
| iPS.3 94059 | 21-225_9E8 | VH3\|3-33\|D7\|7-27\|RF2\|JH4 | QVQLVES-GGGVVQPGRSLRLSCAASG-FTFS | S------YGMH | WVRQAPGKGLEWVA | VIWYE----ENNQYYADSVKG | RFTISRDNSKNTLYLQMNSLRAEDTAVYYCAR | ELGF----------RSDY | WGQGTLVTVSS |
| iPS.3 94067 | 21-225_12F2 | VH3\|3-33\|D7\|7-27\|RF2\|JH4 | QVQLVES-GGGVVQPGRSLRLSCAASG-FTFS | D------YGMH | WVRQAPGKGLEWVA | VIWFD----GNNKYYVDSVKG | RFTISRDNSKNTLFLQMNSLRAEDTAVYYCVR | ELAW----------SEDY | WGQGTLVTVSS |
| iPS.3 94089 | 21-225_12E6 | VH3\|3-33\|D7\|7-27\|RF2\|JH4 | QVQLVES-GGGVVQPGRSLRLSCAASG-FTFS | D------YGMH | WVRQAPGKGLEWVA | VIWYE----ESNKYYADSVKG | RFTISRDDSKNTLYLQMNSLRAEDTAVYYCAR | ELAW----------YEDY | WGQGTLVTVSS |
| iPS.3 94097 | 21-225_16G7 | VH3\|3-33\|D7\|7-27\|RF2\|JH4 | QVQLVES-GGGVVQPGRSLRLSCAASG-FTFT | D------YGMH | WVRQAPGKGLEWVT | VIWYD----ENNEYYADSVKG | RFTISRANSKNTLYLQMNSLRAEDTAVYICVR | ELAW----------YEDY | WGQGTLVTVSS |
| iPS.4 02219 | 21-225_1C12 | VH3\|3-33\|D7\|7-27\|RF2\|JH4 | QVQLVES-GGGVVQPGRSLRLSCAASG-FTFS | N------YGMH | WVRQAPGKGLEWVA | VIWYD----ENNKYYVDSVKG | RFTISRDNSKNTLYLQMNSLRAEDTAVYYCAR | ELGF----------RSDY | WGQGTLVTVSS |
| VH3\|3-33\|D4\|4-11\|RF2\|JH4 | | | QVQLVESGGGVVQPGRSLRLSCAASGFTFS | YGMH | WVRQAPGKGLEWVS | SVIYADS | RFTISRDNSKNTLYLQMNSLRAEDTAVYYCAR | YEDY | WGQGT LVTVS S |

Figure 51 (Continued)

| | | | | | | | | |
|---|---|---|---|---|---|---|---|---|
| iPS:4 33895 | 21-225_43E1 | VH3/3-21/D4/4-11/RF2/JH4 | EVQLVES-GGGLVKPGGSLRL SCAASG-FTFS | S------YSMN | WVRQAPGK GLEWVS | AISGN---STYIYYADS LKG | RFTISRDNAKNSLFLQLNSL RAEDTAVYYCAR | DRG-----------SE | WGQGT LVTVS S |
| iPS:4 34103 | 21-225_53G1 | VH3/3-21/D4/4-11/RF2/JH4 | EVQLVES-GGGLVKPGESLRL SCAASG-FTFS | S------YSMN | WVRQAPGK GLEWVS | SISGS---SSYIYYADS VKG | RFTISRDNAKNSLYLQMNSL RAEDTAVYYCAR | DRG-----------ST | WGQGT LVTVS S |
| iPS:4 34179 | 21-225_56F1 | VH3/3-21/D4/4-11/RF2/JH4 | EVQLVES-GGGLVKFGGSLRL SCAASG-FTFS | S------YSMN | WVQAPGK GLEWVS | SISSS---STYIYYGDS VKG | RFTISRDNAKNSLYLQMNSL RAEDTAVYYCAR | DRG-----------SS | WGQGT LVTVS S |
| iPS:4 34263 | 21-225_56H7 | VH3/3-21/D4/4-11/RF2/JH4 | EVQLVES-GGGLVKPGGSLRL SCAASG-FIFS | S------YSMN | WVRQAPGK GLEWVS | SISSS---STYIYYGDS VKG | RFTISRDNAKNSLYLQMNSL RAEDTAVYYCAR | DRG-----------SS | WGQGT LVTVS S |
| iPS:4 35521 | 21-225_157H4 | VH3/3-21/D4/4-11/RF2/JH4 | EVQLVES-GGGLVKPGGSLRL SCAASG-FTFS | S------YSMN | WVRQAPGK GLEWVS | SISSS---STYIYYADS VKG | RFTMSRDNAKNSLYLQMNSL RAEDTAVYYCAR | DRG-----------SI | WGQGT LVTVS S |
| iPS:4 35527 | 21-225_157G7 | VH3/3-21/D4/4-11/RF2/JH4 | EVQLVES-GGGLVKPGGSLRF SCAASG-FIFS | S------YSMN | WVRQAPGK GLEWVS | SISGS---STYIYYADS VKG | RFTISRDNAKNSLYLQMNSL RAEDTAVYYCAR | DRG-----------SS | WGQGT LVTVS S |
| iPS:4 35529 | 21-225_157H7 | VH3/3-21/D4/4-11/RF2/JH4 | EVQLVES-GGGLVKPGGSLRL SCAASG-FIFS | S------YSMN | WVRQAPGK GLEWVS | CISGS---SSYIYYADS VKG | RFTISRDNAKNSLYLQMNSL RAEDTAVYYCVR | DRG-----------GY | WGQGT LVTVS S |
| iPS:4 35547 | 21-225_158F5 | VH3/3-21/D4/4-11/RF2/JH4 | EVQLVES-GGGLVKPGGSLRF SCAASG-FTFS | S------YSMN | WVRQAPGK GLEWVS | SISGS---STYIYYADS VKG | RFTISRDNAKNSLYLQMNSL RAEDTAVYYCAR | DRG-----------SS | WGQGT LVTVS S |
| iPS:4 35549 | 21-225_158H5 | VH3/3-21/D4/4-11/RF2/JH4 | EVQLVES-GGGLVKPGGSLRL SCAASG-FTFS | S------YSMN | WVRQAPGK GLEWVS | SISGS---STYIYYADS VKG | RFTISRDNAKNSLHLQMNSL RAEDTAVYYCAR | DRG-----------SS | WGQGT LVTVS S |
| iPS:4 35553 | 21-225_158G8 | VH3/3-21/D4/4-11/RF2/JH4 | EVQLVES-GGGLVTPGGSLRL SCAASG-FTFS | S------YTMN | WVRQAPGK GLEWVS | LISGS---SSYIYYADS VKG | RFTISRDNAKNSLYLQMNSL RAEDTAVYYCAR | DRG-----------SL | WGQGT LVTVS S |
| iPS:4 35581 | 21-225_160H1 | VH3/3-21/D4/4-11/RF2/JH4 | EVQLVES-GGGLVKPGGSLRL SCAASG-FTFS | S------YRMN | WVRQAPGK GLEWVS | SISSS---TGYMYYADS VKG | RPTISRDNAKNSLYVFCAR RAEDTAVYFCAR | DK-----------DY | WGQGT LVTVS S |
| iPS:4 35593 | 21-225_160F4 | VH3/3-21/D4/4-11/RF2/JH4 | EVQLVES-GGGLVKPGGSLRF SCAASG-FIFS | S------YSMN | WVRQAPGK GLEWVS | SISGS---STYIYYADS VKG | RFTISRDNAKNSLYLQMNSL RAEDTAVYYCAR | DRG-----------SS | WGQGT LVTVS S |

Figure 51 (Continued)

| | | | | | | | | |
|---|---|---|---|---|---|---|---|---|
| iPS:4 35617 | 21-225_162F2 | VH3/3-21/D4/4-11/RF2/JH4 | EVQLVES-GGGLVKPGGSLRF SCAASG-FTFS | S-----YSMN | WVRQAPGK GLEWVS | SISGS---STYIYYADS VKG | RFTISRDNAKNSLYLQMNSL RAEDTAVYYCAR | DRG------------- | ----------SS | WGQGT LVTVS S |
| iPS:4 35621 | 21-225_162H3 | VH3/3-21/D4/4-11/RF2/JH4 | EVQLVES-GGGLVKPGGSLRF SCAASG-FTFS | S-----YSMN | RVRQAPGK GLEWVS | SISGS---STYIYYADS VKG | RFTISRDNAKNSLYLQMNSL RAEDTAVYYCAR | DRG------------- | ----------SS | WGQGT LVTVS S |
| iPS:4 35641 | 21-225_163F9 | VH3/3-21/D4/4-11/RF2/JH4 | EVQLVES-GGGLVQPGGSLRL SCAASG-FTFS | S-----YSMN | WVRQAPGK GLEWVS | SISGS---STYIYYADS VKG | RFTISRDNAKNSLYLQMNSL RAEDTAVYYCAR | DRG------------- | ----------SL | WGQGT LVTVS S |
| iPS:4 35719 | 21-225_171A11 | VH3/3-21/D4/4-11/RF2/JH4 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | DRG------------- | ----------SS | WGQGT LVTVS S |
| iPS:4 36856 | 21-225_58C5 | VH3/3-21/D4/4-11/RF2/JH4 | EVQLVES-GGGLVKPGGSLRL SCAASG-FTFN | S-----FSLN | WVRQAPGK GLEWIS | SISSS---SSYLVYPDS VKG | RFTISRDSAKNSLYLQMNSL RAEDTAVYYCAR | TYSG------------ | ----------SFDY | WGQGT LVTVS S |
| iPS:4 48904 | 21-225_65C12 | VH3/3-21/D4/4-11/RF2/JH4 | EVQLVES-GGGLVKPGGSLRL SCAASG-FTFR | S-----FSLN | WVRQAPGK GLEWVS | SISSS---SSYIYYADS VKG | RFTISRDNAKNSLYLQMNSL RAEDTAVYYCAR | DAY------------- | ----------SHY | WGQGT LVTVS S |
| iPS:4 72730 | 21-225_14B1_LC1 | VH3/3-21/D4/4-11/RF2/JH4 | EVQLVES-GGGLVKPGGSLRL SCAASG-FTFS | S-----YTMN | WVRQAPGK GLEWVS | SISGS---SSYLYPDS VKG | RFTISRDNAKNSLYLQMNSL RAEDTAVYYCAR | DRG------------- | ----------SS | WGQGT LVTVS S |
| iPS:4 72731 | 21-225_14B1_LC2 | VH3/3-21/D4/4-11/RF2/JH4 | EVQLVES-GGGLVKPGGSLRL SCAASG-FTFS | S-----YTMN | WVRQAPGK GLEWVS | SISGS---SSYLYPDS VKG | RFTISRDNAKNSLYLQMNSL RAEDTAVYYCAR | DRG------------- | ----------SS | WGQGT LVTVS S |
| iPS:3 92726 | 21-225_20B5 | VH3/3-21/D4/4-11/RF2/JH4 | EVQLVEA-GGGLVKPGGSLRL SCAASG-FTFT | S-----YGLN | WVRQAPGK GLEWVS | SISGS---GSHIYYADS VKG | RFTISRDNAKNSLYLQLNSL RAEDTAVYYCAR | DRG------------- | ----------SY | WGQGT LVTVS S |
| iPS:3 92734 | 21-225_17D8 | VH3/3-21/D4/4-11/RF2/JH4 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | DRG------------- | ----------SG | WGQGT LVTVS S |
| iPS:3 92768 | 21-225_20B8 | VH3/3-21/D4/4-11/RF2/JH4 | EVQLVES-GGGLVKPGGSLRL SCAASG-FTFS | S-----YSMN | WVRQAPGK GLEWVS | SISGS---GSHISYADS VKG | RFTISRDNAKNSLYLQMNSL RAEDTAVYYCAR | DRG------------- | ----------SG | WGQGT LVTVS S |
| iPS:3 92778 | 21-225_22H3 | VH3/3-21/D4/4-11/RF2/JH4 | AVQLVES-GGGLVKPGGSLRL SCAASG-FTFS | S-----YSMN | WVRQAPGK GLEWVS | SISSS---SSYIYYADS VKG | RFTISRDNAKNSLYLQMNSL RAEDTAVFYCAR | DRG------------- | ----------SL | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92788 | 21-225_20C8 | VH3J3-21/D4J4-11/RF2/JH4 | EVQLVES-GGGLVKPGGSLRL SCAASG-FTFS | S------YSMN | WVRQAPGK GLEWVS | SISGS----SSYIYYADS VKA | RFTISRDNAKNSLYLQMNSL RAEDTAVYYCAR | DRG-----------SL | WGQGT LVTVS S |
| iPS:3 92792 | 21-225_20G12 | VH3J3-21/D4J4-11/RF2/JH4 | EVQLVES-GGGLVKPGGSLRL SCAASG-FTFS | S------YSMN | WVRQAPGK GLEWVS | SISGS----SSYIYYADS LKG | RFTISRDNAKNSLYLQMNSL RAEDTAVYYCAR | DRG-----------SY | WGQGT LVTVS S |
| iPS:3 92844 | 21-225_23E11 | VH3J3-21/D4J4-11/RF2/JH4 | EVQLVES-GGGLVKPGGSLRL SCAASG-FTFS | S------YTMN | WVRQAPGK GLEWVS | SISGS----SSYIWYVDS VKG | RFTISRDNAKNSLYLQMNSL RAEDTAVYYCAR | DRG-----------SL | WGQGT LVTVS S |
| iPS:3 92848 | 21-225_20F9 | VH3J3-21/D4J4-11/RF2/JH4 | EVQLVES-GGGLVKPGGSLRL SCAASG-FTFS | S------YSMN | WVRQAPGK GLEWVS | SISSS----SSYIYYADS VKG | RFTISRDNAKNSLYLQMNSL RAEDTAVYYCAR | DRG-----------SC | WGQGT LVTIS S |
| iPS:3 92850 | 21-225_20H10 | VH3J3-21/D4J4-11/RF2/JH4 | EVQLVES-GGGLVKPGGSLRL SCAASG-FTFS | T------YSMN | WVRQAPGK GLEWVS | SISSS----SSYIYYADS VKG | RFTISRDNAKNSLYLQMNSL RAEDTAVYYCAR | DRG-----------SL | WGQGT LVTVS S |
| iPS:3 93006 | 21-225_31G9 | VH3J3-21/D4J4-11/RF2/JH4 | EVQLVES-GGGLVKPGGSLRL SCAASG-FTFS | S------YSMN | WVRQAPGK GLEWVS | SISGS----SSYIYYADS VKG | RFTISRDNAKNSLYLQMNSL RAEDTAVYYCAR | DRG-----------SS | WGQGT LVTVS S |
| iPS:3 93022 | 21-225_30H11 | VH3J3-21/D4J4-11/RF2/JH4 | EVQLVES-GGGLVKPGGSLRL SCAASG-FTFS | S------YSMN | WVRQAPGK GLQWVS | SISGS----SSYIYYADS VKG | RFTISRDNAKNSLYLQMNSL RAEDTAIFYCAR | DRG-----------SL | WGQGT LVTVS S |
| iPS:3 93130 | 21-225_33C2 | VH3J3-21/D4J4-11/RF2/JH4 | EVQLVES-GGGLVKPGGSLRL SCAASG-FTFS | S------YTMN | WVRQAPGK GLDWVS | SISGS----SSYIYYADS VKG | RFTISRDNAKNSLFLQMNSL RAEDTAVYYCAR | DRG-----------GT | WGQGT LVTVS S |
| iPS:3 93906 | 21-225_13D3 | VH3J3-21/D4J4-11/RF2/JH4 | EVQLVES-GGGLVKPGGSLRL SCAASG-FTFS | S------YTMN | WVRQAPGK GLEWVS | SISGS----SSYIYYADS VKG | RFTISRDNAKNSLYLQMNSL RAEDTAVYYCAR | DRG-----------SG | WGQGT LVTVS S |
| iPS:3 93982 | 21-225_6C12 | VH3J3-21/D4J4-11/RF2/JH4 | EVQLVES-GGGLVKPGGSLRL SCAASG-FTFS | S------YSMN | WVRQAPGK GLEWVS | SISSS----SSYIYYADS VKG | RFTISRDNAKNSLYLQMNSL RAEDTAVYYCAR | DRG-----------SL | WGQGT LVTVS S |
| iPS:3 98478 | 21-225_17C10 | VH3J3-21/D4J4-11/RF2/JH4 | EVQLVES-GGGLVKPGGSLRL SCAASG-FTFS | S------YSMN | WVRQAPGK GLEWVS | SISSS----SSYMYYADS VKG | RFTISRDNAKNSLYLQMNSL RAEDTALYYCAR | DRG-----------SS | WGQGT LVTVS S |
| VH3J3-23/D6J6-6/RF1/JH4 | | Germline | EVQLVES-GGGLVKPGGSLRL SCAASG-FTFS | S-----YAMS | WVRQAPGK GLEWVS | AISGS----GGSTYYADS VKG | RFTISRDNSKNTLYLQMNSL RAEDTAVYYCAK | SFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33897 | 21-225_43C2 | VH3j3-23/D6j6-6jRF1/JH4 | EVQLLES-GGGLVQPGGSLRL SCAASG-FTFS | S-----YAMS | WVRQAPGK GLEWVS | AISGR---GVNTFDADS VKG | RFTISRDNSKNTLYLQMNSL RAEDTAVYYCAK | ERSGS--------YFDY | WGQGT LVTVS S |
| iPS:4 33903 | 21-225_43H4 | VH3j3-23/D6j6-6jRF1/JH4 | EVQLLES-GGGLVQPGGSLRL SCAASG-FTFS | S-----YAMS | WVRQAPGK GLEWVS | AISGR---GINTFDADS VKG | RFTISRDNSKRNTLYLQMNSL RAEDTAVYYCAK | ERSGS--------YFDY | WGQGT LVTVS S |
| iPS:4 33911 | 21-225_43E8 | VH3j3-23/D6j6-6jRF1/JH4 | EVQLLES-GGGLVQPGGSLRL SCAASG-FTFS | S-----YAMS | WVRQAPGK GLEWVS | AISGR---GINTFDADS VKG | RFTISRDNSKRNTLYLQMNSL RAEDTAVYYCAK | ERSGS--------YFDY | WGQGT LVTVS S |
| iPS:4 33941 | 21-225_44D10 | VH3j3-23/D6j6-6jRF1/JH4 | EVQLLES-GGGLVQPGGSLRL SCAASG-FTFS | S-----YAMS | WVRQAPGK GLEWVS | AISGR---GVNTFDADS VKG | RFTISRDNSKNTLYLQMNSL RAEDTAVYYCAK | ERSGS--------YFDY | WGQGT LVTVS S |
| iPS:4 33957 | 21-225_45F8 | VH3j3-23/D6j6-6jRF1/JH4 | EVQLLES-GGGLVQPGGSLRL SCAASG-FTFS | S-----YAMS | WVRQAPGK GLEWVS | AISGR---GVNTFDADS VKG | RFTISRDNSKNTLYLQMNSL RAEDTAVYYCAK | ERSGS--------YFDY | WGQGT LVTVS S |
| iPS:4 33973 | 21-225_46A6 | VH3j3-23/D6j6-6jRF1/JH4 | EVQLLES-GGGLVQPGGSLRL SCAASG-FTFS | S-----YAMS | WVRQAPGK GLEWVS | AISGR---GINTFDADS VKG | RFTISRDNSKNTLYLQMNSL RAEDTAVYYCAK | ERSGS--------YFDY | WGQGT LVTVS S |
| iPS:4 35715 | 21-225_171A8 | VH3j3-23/D6j6-6jRF1/JH4 | EVQLLES-GGGLVQPGGSLRL SCAASG-PTFR | S-----SAMS | WVRQAPGK GLEWVS | VISGS---GGSIFYTDS VKG | RFTISRDNSKNTLYLQMNSL RAEDTAVYYCAK | SNSSG--------WFDY | WGQGT LVTVS S |
| iPS:4 35739 | 21-225_174G7 | VH3j3-23/D6j6-6jRF1/JH4 | EVQLLES-GGGLVQPGGSLRL SCAASG-FTFR | S-----SAMS | WVRQAPGK GLEWVS | VISGS---GGSIFYTDS VKG | RFTVSRDNSKNTLYLQMNSL RAEDTAVYYCAK | SNSSG--------WFDY | WGQGT LVTVS S |
| iPS:4 35749 | 21-225_175C10 | VH3j3-23/D6j6-6jRF1/JH4 | EVQLLES-GGGLVQPGGSLRL SCAASG-FTFS | S-----YAMS | WVRQAPGK GLEWVS | SISGR---GGSTFYADS VKG | RFTISRDNSKNTLYLQMNSL RAEDTAVYYCAK | SNSSG--------WFDY | WGQGT LVTVS S |
| | Germline | VH3j3-21jD7j7-27jRF1jJH4 | EVQLLES-GGGLVQPGGSLRL SCAASG-FTFS | S-----YAMS | WVRQAPGK GLEWVS | SISGS---SSYIYADS VKG | RFTISRDNSKNTLYLQMNSL RAEDTAVYYCAR | TGY----------FDY | WGQGT LVTVS S |
| iPS:4 33901 | 21-225_43A4 | VH3j3-21/D7j7-27jRF1/JH4 | EVQLVES-GGGLVKPGGSLRL SCAASG-FTFS | S-----YTMN | WVRQVPGK GLEWVS | SISGS---STYIYADS VKG | RFTISRDDAQNSLYLQMNSL RGEDTAVYYCAR | VTS----------FDY | WGQGA LVTVS S |
| iPS:4 33961 | 21-225_45D9 | VH3j3-21/D7j7-27jRF1/JH4 | EVQLVES-GGGLVKPGGSLRL SCAASG-FTFS | S-----YTMN | WVRQVPGK GLEWVS | SISGS---STYIYADS VKG | RFTISRDDAQNSLYLQMNSL RGEDTAVYYCAR | VTS----------FDY | WGQGA LVTVS S |

Figure 51 (Continued)

| | | | | | | | | |
|---|---|---|---|---|---|---|---|---|
| iPS:4 34135 | 21-225_54H3 | VH3\|3-21\|D7\|7-27\|RF1/J H4 | EVQLVES-GGGLVKPGGSLRL SCAASG-FTFS | S------YSMI | WVRQAPGK GLEWVS | SISGT----SSYIYYADS VKG | RFTISRDNAKNSLYLQMNSL RAEDTAVYYCAG | MTT---------VI | WGQGT LVTVS S |
| iPS:4 34331 | 21-225_63H8 | VH3\|3-21\|D7\|7-27\|RF1/J H4 | EVQLVES-GGGLVKPGGSLRL SCAASG-FTFS | S------YNMN | WVRQAPGK GLEWVS | SISGS----STYMNYTDS VKG | RFTISRDNAKNSLYLQMNSL RAEDTAVYYCAR | LRN---------FDY | WGQGT LVTVS S |
| iPS:4 35421 | 21-225_151F1 | VH3\|3-21\|D7\|7-27\|RF1/J H4 | EVQLVES-GGGLVKPGGSLRL SCAASG-YTFR | S------FSMN | WVRQAPGK GLEWVS | SISSS----SYIYYADS VKG | RFTISRDNAKNSLYLQMNSL RAEDTAVYYCAR | DIP---------LVY | WGQGT LVTVS S |
| iPS:4 35653 | 21-225_166H12 | VH3\|3-21\|D7\|7-27\|RF1/J H4 | EVQLVES-GGALVKPGGSLRL SCAASG-FTFS | S------YSMS | WVRQAPGK GLGWVS | SISGS----SSYSYYADS VKG | RFTISRDNAKNSLYLQMNSL RAEDTAVYYCAR | LTG---------FDY | WGQGT LVTVS S |
| iPS:4 36648 | 21-225_227F11 | VH3\|3-21\|D7\|7-27\|RF1/J H4 | EVQLVES-GGGLVKPGGSLRL SCAASG-FTFS | T------YSMN | WVRQAPGK GLEWVS | SISSS----INYMYYADS VKG | RFTISRDNAKNSLYLQMNSL RAEDTAVYYCAR | LG-----------VY | WGQGT LVTVS S |
| iPS:3 92952 | 21-225_26G1 | VH3\|3-21\|D7\|7-27\|RF1/J H4 | EVQLVES-GGGLVKPGGSLRL SCAVSG-FTFS | S------YGMN | WVRQAPGK GLEWVS | SISGS----SSYIYYADS VKG | RFTISRDNAKNSLYLQMNSL RAEDTAVYYCAR | LTT---------FDF | WGQGT LVTVS S |
| iPS:3 93082 | 21-225_34C11 | VH3\|3-21\|D7\|7-27\|RF1/J H4 | EVQLVES-GGGLVKPGGSLRL SCAASG-FTFS | S------YTMS | WVRQAPGK GLEWVS | SISGS----SNYIYYADS VKG | RFTISRDNAKNSLYLQMNSL RAEDSAVYYCAR | LTG---------FDY | WGQGT LVTVS S |
| iPS:3 94061 | 21-225_12D2 | VH3\|3-21\|D7\|7-27\|RF1/J H4 | EVQLVES-GGGLVKPGGSLRL SCAASG-FTFS | S------YSMN | WVRQAPGK GLEWVS | SISGS----SSYIYYADS VKG | RFTISRDNAKNSLYLQMNSL RAEDTAVYYCAR | LG-----------DY | WGQGT LVAVS S |
| iPS:3 94071 | 21-225_10C7 | VH3\|3-21\|D7\|7-27\|RF1/J H4 | EVQLVES-GGGLVKPGGSLRL SCAASG-FTFS | S------YNMN | WVRQAPGK GLEWVS | SISGS----NNYIYYADS VKG | RFTISRDNAKNSLYLQMNSL RAEDSAVYYCAR | LG-----------VY | WGQGT LVTVS S |
| iPS:3 98532 | 21-225_33B7 | VH3\|3-21\|D7\|7-27\|RF1/J H4 | EVQLVES-GGGLVKPGGSLRL SCAASG-FTFS | S------YSMN | WVRQAPGK GLEWVS | SISGS----SSYIYYADS VKG | RFTISRDNAKNSLYLQMNSL RAEDTAVYYCAR | LNG---------FDY | WGQGT LVTVS S |
| iPS:4 02225 | 21-225_2B1 | VH3\|3-21\|D7\|7-27\|RF1/J H4 | EVQLVES-GGGLVKPGGSLRL SCAASG-FTFS | S------YSMN | WVRQAPGK GLEWVS | SISSS----SSYIYYADS VKG | RFTISRDNAKNSLYLQMNSL RAEDTAVYYCAR | LG-----------NY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 04090 | 21-225_8D8 VH3/3-21/D7/7-27/RF1/JH4 | EVQLVES-GGGLVKPGGSLRL SCAASG-FTFS | S-----YSMN | WVRQAPGK GLEWVS | SISSS---SSYIYYADS VKG | RFTISRDNAKNSLYLQMNSL RAEDTAVYYCAR | LG----------NY | WGQGT LVTVS S |
| | VH3/3-11/D4/4-11/RF2/JH4 Germline | EVQLVES-GGGLVKPGGSLRL SCAASG-FTFS | -------YYMN | WVRQAPGK GLEWVS | YISSS---GSTIYYADS VKG | RFTISRDNAKNSLYLQMNSL RAEDTAVYYCAR | DY-----------YFDY | WGQGT LVTVS S |
| iPS:4 33905 | 21-225_43E5 VH3/3-11/D4/4-11/RF2/JH4 | QVQLVES-GGGLVKPGGSLRL SCAASG-FTFS | D-------YYMI | WIRQAPGK GLEWVS | YISSS---GITKYYADS MKG | RFTISRDNAKNSLYLQMNSL RAEDTAVYYCAA | DT----------IY | WGQGT LVTVS S |
| iPS:4 33913 | 21-225_43H8 VH3/3-11/D4/4-11/RF2/JH4 | QVQLVES-GGGLVKPGGSLRL SCAASG-FTFS | D-------YYMN | WIRQAPGK GLEWVS | YISSS---GRTIFYYADS LKG | RFTISRDNAKNSLYLQMNSL RAEDTAVYYCAA | DT----------IY | WGQGT LVTVS S |
| iPS:4 33949 | 21-225_45H2 VH3/3-11/D4/4-11/RF2/JH4 | QVQLVES-GGGLVKPGGSLRL SCAASG-FTFS | D-------YYMN | WIRQAPGK GLEWVS | YISSS---GITKYYADS VKG | RFTISRDNAKNSLYLQMNSL RAEDTAVYYCAA | DT----------IY | WGQGT LVTVS S |
| iPS:4 33981 | 21-225_46E9 VH3/3-11/D4/4-11/RF2/JH4 | QVQLVES-GGGLVKPGGSLRL SCAASG-FTFS | D-------YYMN | WIRQAPGK GLEWVS | YINSN---GFTIYYADS VKG | RFTISRDNAKNSLYLQMNSL RAEDTAVYYCAA | DT----------IY | WGQGT LVTVS S |
| iPS:4 33995 | 21-225_47H7 VH3/3-11/D4/4-11/RF2/JH4 | QVQLVES-GGGLVKPGGSLRL SCAASG-FTFS | D-------YYMN | WIRQAPGK GLEWVS | YINSN---GFTKYYADS VKG | RFTISRDNAKNSLYLQMNSL RAEDTAVYYCAA | DT----------VY | WGQGT LVTVS S |
| iPS:4 34039 | 21-225_43B1 VH3/3-11/D4/4-11/RF2/JH4 | QVQLVES-GGGLVKPGGSLRL SCAASG-FTFS | D-------YYMN | WIRQAPGK GLEWVS | YISSS---GSTIYYADS VKG | RFTISRDNAKNSLYLQMNSL RAEDTAVYYCAA | DM----------IY | WGQGT RVTVS S |
| iPS:4 34275 | 21-225_57F4 VH3/3-11/D4/4-11/RF2/JH4 | QVQLVES-GGGLVKPGGSLRL SCAASG-FTFS | D-------YYMN | WIRQAPGK GLEWVS | YISSS---GSTIYYADS VKG | RFTISRDNAKNSLYLQMNSL RAEDTAVYYCAR | DM----------IT | WGQGT LVTVS S |
| | VH3/3-23/D7/7-27/RF1/JH3 Germline | EVQLLES-GGGLVQPGGSLRL SCAASG-FTFS | ----------YAMS | WVRQAPGK GLEWVS | AISGS---GSNTYYADS VKG | RFTISRDNSKNTLYLQMNSL RAEDTAVYYCAK | TGS------------AFDI | WGQGT MVTVS S |
| iPS:4 33915 | 21-225_43H9 VH3/3-23/D7/7-27/RF1/JH3 | EVQLLES-GGGLVQPGGSLRL SCAASG-FTFS | S-------YAMS | WVRQAPGM GLEWVS | AISGS---GSNTYYADS VKG | RFTISRDNSKNTLYLHMNSL RAEDTAVYFCAK | RTPSD-----------VFDI | WGQGT MVTVS S |
| iPS:4 33925 | 21-225_44F3 VH3/3-23/D7/7-27/RF1/JH3 | EVHLLES-GGGLVQPGGSLRL SCAASG-FTFS | S-------YAMS | WVRQAPGK GLEWVS | ILSGG---GKTTYYADS VKG | RFTISRDNSKNTLFLQMNSL RAEDTAVYYCAK | RTPSD-----------AFDI | WGQGT MVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33953 | 21-225_45H4 | VH3|3-23/D7|7-27|RF1|J H3 | EVQLLES-GGGLVQPGGSLRL SCAASG-FTFS | S-----YAMS | WVRQAPGM GLEWVS | AISGS---GSNTYYADS VKG | RFTISRDNSKNTLYLHMNSL RAEDTAVYFCAK | RTPSD---------VFDI | WGQGT MVTVS S |
| iPS:4 33959 | 21-225_45C9 | VH3|3-23/D7|7-27|RF1|J H3 | EVQLLES-GGGLVQPGGSLRL SCAASG-FTFN | S-----YAMS | WVRQAPGK GLEWVS | VISGR---GGTTFYADS VKG | RFTISRDNSKNTLYLQMNSL RAEDTAVYYCAK | RTPSD---------AFDI | WGQGT MVTVS S |
| iPS:4 35379 | 21-225_149B6 | VH3|3-23/D7|7-27|RF1|J H3 | EVQLLES-GGGLVQPGGSLRL SCAASG-FTFS | S-----YAMS | WVRQAPGK GLEWVS | VISGS---GGTTFYADS VKG | RFTISRDNSKNTLFLQMNSL RAEDTAVYYCAK | RTPED---------VFDI | WGQGT MVTVS S |
| iPS:4 35787 | 21-225_180A3 | VH3|3-23/D7|7-27|RF1|J H3 | EVQLLES-GGGLEQPGGSLRL SCAASG-FTFS | S-----FAMN | WVRQAPGK GLEWVS | VISGR---GGNTFYADS VKG | RFTISRDNSKNTLFLQMNSL RAEDTAVYFCAK | RTGDD---------VFDV | WGQGT MVTVS S |
| iPS:4 35809 | 21-225_182H5 | VH3|3-23/D7|7-27|RF1|J H3 | EVQLLES-GGGLVQPGGSLRL SCAASG-FTFS | S-----YAMS | WVRQAPGK GLEWVS | VISGR---GGTTFYADS VKG | RFTISRDNSKNTLYLQMNSL RAEDTAVYYCAK | RTGDD---------VFDI | WGQGT MVTVS S |
| iPS:4 35889 | 21-225_186A11 | VH3|3-23/D7|7-27|RF1|J H3 | EVQLLES-GGGLVQPGGSLRL SCAASG-FTFS | S-----YAMS | WVRQAPGK GLEWVS | VISGR---GGTTFYADS VKG | RFTISRDNSKNTLYLQMNSL RAEDTAVYYCAK | RTGDD---------VFDI | WGQGT MVTVS S |
| | VH4|4-59|D6|6-13|RF2|JH4 | Germline | | | | | | | |
| iPS:4 33931 | 21-225_44F6 | VH4|4-59/D6|6-13|RF2|J H4 | QVHLQES-GPGLVKPSETLSL TCTVSG-GSIS | S-----YYWS | WIRQPPGK GLEWIG | YIYY-----SGNTNYNPS LKS | RVTISVDTSKNQFSLKLSSV TAADTAVYYCVR | GVAI---------KNY | WGQGT LVTVS S |
| | VH3|3-23|D4|4-17|RF2|JH6 | Germline | | | | | | | |
| iPS:4 33943 | 21-225_44E10 | VH3|3-23|D4|4-17|RF2|J H6 | EVQLLES-GGGLVQSGGSLRL SCAASG-FTFS | S-----YAMN | WVRQAPGK GLEWVS | GVVGS---GGRTFYADS VKG | RFTISRDNSKNTLYLQMNSL RAEDTAVYYCAK | DRGQWL---------LGGMDV | WGQGT TVTVS S |
| iPS:4 33989 | 21-225_47C7 | VH3|3-23|D4|4-17|RF2|J H6 | EVQLLES-GGGLVQPGGSLRL SCAASG-FTFS | N-----YAMS | WVRQAPGK GLEWVS | GISGS---GSRTFYADS VKG | RFTISRDNSKNTLYLQMNSL RAEDTAVYYCAK | DRGQWL---------IGGMDV | WGQGT TVTVS S |
| iPS:4 34133 | 21-225_54G3 | VH3|3-23|D4|4-17|RF2|J H6 | EVQLLES-GGGLVQPGGSLRL SCAASG-FTFS | T-----YAMS | WVRQAPGK GLEWVS | AISGS---GVNTFYADS VKG | RFTISRDNSKNTLFLQMNSL RAEDTAVYYCAK | LGKDYY---------YYGMDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34221 | 21-225_60A11 | VH3/3-23/D4/4-17/RF2/JH6 | EVQLLES-GGGLVQPGGSLRL SCAASG-FTFS | N-----YAMT | WVRQAPGK GLEWVS | AISGS---GGNTYYADS VTG | RVTISRDNSKNTLYLQMNSL RAEDTAVYYCAK | LGKDYH------YYGMDV | WGQGT TVTVS S |
| iPS:4 34257 | 21-225_62F7 | VH3/3-23/D4/4-17/RF2/JH6 | EVQLLES-GGGLVQPGGSLRL SCAASG-FTFS | S-----YVMS | WVRQAPGK GLEWVS | GISGS---GAKTYYADS VKG | RFTISRDNSKNTLYLQMNSL RAEDTAVYYCAE | LGIDYY------YGMDV | WGQGT TVTVS S |
| iPS:4 34283 | 21-225_57F8 | VH3/3-23/D4/4-17/RF2/JH6 | EVQLLES-GGGLVQPGGSLRL SCVVSG-FTFS | N-----YAMS | WVRQAPGK GLEWVS | ASSGS---GGNTYYADS VTG | RVTISRDNSKNTLYLQMNSL RAEDTAVYYCAK | LGKDYH------YYGMDV | WGQGT TVTVS S |
| iPS:4 34385 | 21-225_66C10 | VH3/3-23/D4/4-17/RF2/JH6 | EVQLLES-GGGLVQPGGSLRL SCAASG-FTFS | S-----YVMS | WVRQAPGK GLEWVS | GISGS---GARTYYADS VKG | RFTISRDNSKNTLYLQMNSL RAEDTAVYYCAE | LGIDYY------YGMDV | WGQGT TVTVS S |
| iPS:4 35717 | 21-225_171A9 | VH3/3-23/D4/4-17/RF2/JH6 | EVQLLES-GGGLAQPGGSLRL SCAASG-FTFS | S-----YAMT | WVRQAPGK GLEWVS | AISGS---GGNTFNADS VKG | RFTISRDNSKNTLYLQMNSL RAEDTAVYYCAK | LGIDYY------YYGMDV | WGQGT TVTVS S |
| iPS:4 36528 | 21-225_224B1 | VH3/3-23/D4/4-17/RF2/JH6 | EVQVLES-GGGLVQPGGSLRL SCAASG-FTFS | S-----YAMS | WVRQAPGK GLEWVS | YISSS---SSTIYADS VKG | RFTISRDNSKNTLYLHMNSL RAEDTAVYYCAG | EGGYYY------YYGVDV | WGQGT TVTVS S |
| iPS:3 93810 | 21-225_5AA | VH3/3-23/D4/4-17/RF2/JH6 | EVQVLES-GGGLVQPGGSLRL SCAASG-LIFS | S-----SAMS | WVRQAPGK GLEWVS | AISGR---GGNIFYTDS VKG | RFTISRDNSKNTLYLQMNSL RAEDTAVYYCAK | LGKDYY------YYGMDV | WGQGT TVTVS S |
| | Germline | | H_FR1 | H_CDR1 | H_FR2 | H_CDR2 | H_FR3 | H_CDR3 | H_FR4 |
| | VH3/3-48/D5/5-24/RF3/JH6 | | EVQLVES-GGGLVQPGGSLRL SCAASG-FTFS | | WVRQAPGK GLEWVS | SSIKYADS VKG | | | |
| iPS:4 33945 | 21-225_44C12 | VH3/3-48/D5/5-24/RF3/JH6 | EVQLVES-GGGLVQPGGSLRL SCAASG-FTFS | S-----YSVN | WVRQAPGK GLEWVS | YISSS---SSTIYADS VKG | RFTISRDNAKNSLYLQMNSL RQEDTAVYYCAR | SGYSYAY------YYYGMDV | WGQGT TVTVS S |
| | Germline | | H_FR1 | H_CDR1 | H_FR2 | H_CDR2 | H_FR3 | H_CDR3 | H_FR4 |
| | VH3/3-33/D6/6-13/RF2/JH4 | | QVHLAES-GGGVVQPGRSLRL SCEASG-FTLS | | WVRQPPGK GLEWVA | | | | |
| iPS:4 33947 | 21-225_44E12 | VH3/3-33/D6/6-13/RF2/JH4 | QVHLAES-GGGVVQPGRSLRL SCEASG-FTLS | S-----DDTH | WVRQPPGK GLEWVA | VIWFD---EYNKYYADS VKG | RFTISRDNSKNTLYLQMNSL RAEDAAVYYCAR | DLIAAA------GTGDY | WGQGT LVTVS S |
| iPS:4 33963 | 21-225_46B1 | VH3/3-33/D6/6-13/RF2/JH4 | QVHLAES-GGGVVQPGRSLRL SCEASG-FTLS | S-----DDSH | WVRQPPGK GLEWVA | VIWFD---EYTKYYADS VKG | RFTISRDNSKNTLYLQMNRL RAEDAAVYYCAR | DLIAAT------GTGDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 33987 | 21-225_47A5 | VH3J3-33/D6j6-13/RF2/JH4 | QVQLVES-GGGVVQPGRSLRL SCAASG-FTFS | D------DDTH | WVRQAPGK GLEWVA | VIWFD----GSNKYYADS VKG | RFTISRDNSKNTLYLQMNSL SAEDTAVYYCAR | DLIAAA------------GTVDY | WGQGT LVTVS S |
| iPS:4 36258 | 21-225_202F12 | VH3J3-33/D6j6-13/RF2/JH4 | QVQLVES-GGGVVQPGRSLRL SCEASG-FTFS | Y------YGMH | WVRQAPGK GLEWVA | IIWYD----GSNKFYADS VKG | RFTISRDSSKNTLYLQMNSL RAEDTAVYYCAS | NIAAAA------------PYFDY | WGQGT LVTVS S |
| iPS:3 92646 | 21-225_20G2 | VH3J3-33/D6j6-13/RF2/JH4 | QVQLVES-GGGVVQPGRSLRL SCAASG-FTLS | S------DDMH | WVRQEPGK GLEWVA | VIWFD----GSNKYYADS VKG | RFIMSRDNSKNTLYLQMNSL RAGDTAVYYCAR | DLIAAA------------GTVDY | WGQGT LVTVS S |
| iPS:3 92750 | 21-225_20A10 | VH3J3-33/D6j6-13/RF2/JH4 | QVQLVES-GGGVVQPGRSLRL SCAASG-FTLS | S------DDMH | WVRQAPGK GLEWVA | VIWFD----GSNKYYADS VKG | RFIISRDNSKNTLYLQMNSL RAEDTAMYYCAR | DLIAAA------------GTVDY | WGQGT LVTVS S |
| | Germline VH3J3-23/D6j6-19/RF2/JH3 | | EVQLLES-GGGLVQPGGSLRL SCAASG-FTFS | S | WVRQAPGK GLEWVS | AISGS----GGSTFYADS VKG | RFTISRDNSKNTLYLQMNSL RAEDTAVYYCAR | DAFDI | WGQGT MVTVS S |
| iPS:4 33999 | 21-225_48D1 | VH3J3-23/D6j6-19/RF2/JH3 | EVQLLES-GGGLVQPGGSLRL SCAASR-FTFS | S------YAMS | WVRQAPGK GLEWVS | VISGR----GGSTFYADS VKG | RFTISRDNSKNTLYLQMNSL RAEDTAVYYCAR | RIAVAG------------NEAFDI | WGQGT MVTVS S |
| iPS:4 34003 | 21-225_48C3 | VH3J3-23/D6j6-19/RF2/JH3 | EVQLLES-GGGLVQPGGSLRL SCAASR-FTFS | S------YAMS | WVRQAPGK GLEWVS | VISGR----GGSTFYADS VKG | RFTISRDNSKNTLYLQMNSL RAEDTAVYYCAR | RIAVAG------------NEAFDI | WGQGT MVTVS S |
| iPS:4 34037 | 21-225_49G12 | VH3J3-23/D6j6-19/RF2/JH3 | EVQLLES-GGGLVQPGGSLRL SCTASG-FTFS | S------YAMS | WVRQAPGK GLEWVS | VISGS----GGTFYADS VKG | RLTISRDNSKNTLYLQMNSL RAEDTAVYYCAR | RIAVAG------------NDAFDI | WGQGT MVTVS S |
| iPS:4 34041 | 21-225_50H8 | VH3J3-23/D6j6-19/RF2/JH3 | EVQLLES-GGGLVQPGGSLRL SCAASR-FTFS | S------YAMS | WVRQAPGK GLEWVS | VISGR----GGSTFYADS VKG | RFTISRDNSKNTLYLQMNSL RAEDTAVYYCAR | RIAVAG------------NEAFDI | WGQGT MVTVS S |
| iPS:4 34045 | 21-225_50H10 | VH3J3-23/D6j6-19/RF2/JH3 | EGQLLES-GGGLVQPGGSLRL SCAASR-FTFS | S------YAMS | WVRQAPGK GLEWVS | VISGR----GGSTFYADS VKG | RFTISRDNSKNTLYLQMNSL RAEDTAVYYCAR | RIAVAG------------NEAFDI | WGQGT MVTVS S |
| iPS:4 34073 | 21-225_51H10 | VH3J3-23/D6j6-19/RF2/JH3 | EVQLLES-GGGLVQPGGSLRL SCTASG-FTFS | S------YAMS | WVRQAPGK GLEWVS | VISGS----GGTFYADS VKG | RLTISRDNSKNTLYLQMNSL RAEDTAVYYCAR | RIAVAG------------NDAFDI | WGQGT MVTVS S |
| iPS:4 36212 | 21-225_200G1 | VH3J3-23/D6j6-19/RF2/JH3 | EVQLLES-GGGLVQPGGSLRL SCAASG-FTFS | S------YAMS | WVRQAPGK GLEWVS | AISGR----GGNTFYADS VRG | RFTISRDNSKNTLYLQMNSL RAEDTAVYYCAR | RIAVDG------------YDAFDV | WGQGT MVTVS S |

Figure 51 (Continued)

| | | | | | | | | |
|---|---|---|---|---|---|---|---|---|
| iPS:3 92652 | 21-225_17C6 | VH3/3-23\|D6\|6-19\|RF2/J H3 | EVQLLES-GGGLVQPGGSLRL SCAASE-FTFS | S-----YAMN | WVRQAPGK GLEWVS | VISGR---- GGNTFYADS VKG | RFTISRDNSKNTLFLQMNSL RAEDTAVYYCAS | RLAVAG---------- ---------SEAFDI | WGQGT MVTVS S |
| iPS:3 92668 | 21-225_17B4 | VH3/3-23\|D6\|6-19\|RF2/J H3 | EVQLLES- GGGLVQPGGSLRL SCAASE-FTFS | S-----YAMN | WVRQAPGK GLEWVS | VISGR---- GGNTFYADS VKG | RFTISRDNSKNTLYLQMNSL RAEDTAVYYCAS | RLAVAG---------- ---------SEAFDI | WGQGT MVTVS S |
| iPS:3 92696 | 21-225_20A4 | VH3/3-23\|D6\|6-19\|RF2/J H3 | EVQLLES- GGGLVQPGGSLRL SCAASE-FTFS | S-----YAMT | WVRQGPGM GLEWVS | VISGS---- GGYTYNADS VKG | RFTISRDNSKNTLYLQMNSL RVEDTAVYYCAS | RIAVAG---------- ---------SEAFDI | WGQGT MVTVS S |
| iPS:3 92702 | 21-225_17F7 | VH3/3-23\|D6\|6-19\|RF2/J H3 | EVQLLES- GGGLVQPGGSLRL SCAASG-FTFS | S-----YAMN | WVRQAPGK GLEWVS | IISGR---- GGNAFYADS VKG | RFTISRDNSKNTLYLQMNSL RAEDTAVYYCAS | RLAVAG---------- ---------SEAFDI | WGQGT MVTVS S |
| iPS:3 92704 | 21-225_17F11 | VH3/3-23\|D6\|6-19\|RF2/J H3 | EAQLLES- GGGLVQPGGSLRL SCAASE-FTFS | S-----YAMS | WVRQAPGK GLEWVS | VISGR---- GGNTYSADS VKG | RFTISRDNSKNTLYLQMNSL RAEDTAVYYCAS | RLAVAG---------- ---------SEAFDI | WGQGT MVTVS S |
| iPS:3 92720 | 21-225_17A12 | VH3/3-23\|D6\|6-19\|RF2/J H3 | EVQLLES- GGGLVQPGGSLRL SCAASE-FTFS | S-----YAMS | WVRQDPGK GLEWVS | IISGR---- GGNTFYADS VKG | RFTISRDNSKNTLYLQMNSL RAEDTAVYYCAS | RIAVAG---------- ---------SEAFDI | WGQGT MVTVS S |
| iPS:3 92722 | 21-225_18E12 | VH3/3-23\|D6\|6-19\|RF2/J H3 | EVQLLES- GGGLVQPGGSLRL SCAASE-FTFS | S-----YAMS | WVRQAPGT GLEWVS | IISGR---- GGNTFYADS VKG | RFTISRDNSKNTLYLQMNSL RAEDTAVYYCAS | RLAVAG---------- ---------SEAFDI | WGQGT MVTVS S |
| iPS:3 92760 | 21-225_22G3 | VH3/3-23\|D6\|6-19\|RF2/J H3 | EVQLLES- GGGLVQPGGSLRL SCAASE-FTFS | S-----YAMN | WVRQAPGK GLEWVS | VISGR---- GVNTFYADS VKG | RFTISRDNSKNTLYLQMNSL RAEDTAVYYCAS | RLAVAG---------- ---------SEAFDI | WGQGT MVTVS S |
| iPS:3 92764 | 21-225_22G10 | VH3/3-23\|D6\|6-19\|RF2/J H3 | EVQLLES- GGGLVQPGGSLRL SCAASE-FTFS | S-----YAMN | WVRQAPGK GLEWVS | VISGS---- GGNTFYADS VKG | RFTISRDNSKNTLFLHMNSL RAEDTAVYYCAS | RMAVAG---------- ---------SEAFDI | WGQGT MVTVS S |
| iPS:3 92812 | 21-225_21F4 | VH3/3-23\|D6\|6-19\|RF2/J H3 | EVQLLES- GGGLVQPGGSLRL SCAASE-FTFS | S-----YAMN | WVRQAPGK GLEWVS | VISGR---- GGNTFYADS VKG | RFTISRDNSKNTLYLQMNSL RAEDTAVYYCAS | RLAVAG---------- ---------SEAFDI | WGQGT MVTVS S |
| iPS:3 92816 | 21-225_22E4 | VH3/3-23\|D6\|6-19\|RF2/J H3 | EVQLLES- GGGLVQPGGSLRL SCAASE-FTFS | S-----YAMS | WVRQAPGK GLEWIS | IISGR---- GINTFYADS VKG | RFTISRVNSKNTLYLQMNSL RAEDTAVYYCAS | RIAVAG---------- ---------SEACDI | WGQGT MVTVS S |
| iPS:3 92852 | 21-225_21A2 | VH3/3-23\|D6\|6-19\|RF2/J H3 | EVQLLES- GGGLVQPGGSLRL SCAASK-FTFS | S-----YAMN | WVRQAPGK GLEWIS | IISGR---- GGNTFYADS VKG | RFTISRDNSKNTLYLQMNSL RAEDTAVYYCAS | RLAVAG---------- ---------SEAFDI | WGQGT MVTVS S |

Figure 51 (Continued)

| | | | | | | | | | |
|---|---|---|---|---|---|---|---|---|---|
| iPS:3 92878 | 21-225_22C5 | VH3/3-23|D6|6-19|RF2|JH3 | EVQLLES-GGGLVQVGGSLRLSCAASG-FTFS | S-----YAMS | WVRQAPGM GLEWVS | IISGS---GGYTYYADSVKG | RFTISRDNSKNTLYLQMNSL RAEDTAVYYCAS | RIAVAG-------SEAFDI | WGQGT MVTVS S |
| iPS:3 92902 | 21-225_22D5 | VH3/3-23|D6|6-19|RF2|JH3 | EVQLLES-GGGLVQPGGSLRLSCAASE-FTFS | S-----YAMS | WVRQAPGK GLEWVS | VISGR---GGNTFYADSVKG | RFTISRDNSKNTLYLQMNSL RAEDTAVYYCAS | RIAVAG-------SEAFDI | WGQGT MVTVS S |
| iPS:3 93824 | 21-225_10F12 | VH3/3-23|D6|6-19|RF2|JH3 | EVQLLES-GGGLVQPGGSLRLSCAASE-FTFS | S-----YAMS | WVRQAPGK GLEWVS | IISGR---GGNTFYADSVKG | RFTISRDNSKNTLYLQMNSL RAEDTAVYYCAS | RVAVAG-------SEAFAI | WGQGT MVTVS S |
| iPS:3 93848 | 21-225_4H2 | VH3/3-23|D6|6-19|RF2|JH3 | EVQLLES-GGGLVQPGGSLRLSCAASG-FTFS | G-----YAMN | WVRQAPGM GLEWVS | VISRS---GGYTYYADSVKG | RFTISRDNSKNTLYLQMNSL RAEDTAVYYCAS | RLAVAG-------SEAFDI | WGQGT MVTVS S |
| iPS:3 93862 | 21-225_5G2 | VH3/3-23|D6|6-19|RF2|JH3 | EVQLLES-GGGLVQPGGSLRLSCAASE-FTFS | S-----YAMS | WVRQAPGK GLEWVS | VISGR---GVNTFYADSVKG | RFTISRDNSKNTLYLQMNSL RAEDTAVYYCAS | RIAVAG-------SEAFDI | WGQGT MVTVS S |
| iPS:3 93888 | 21-225_3E3 | VH3/3-23|D6|6-19|RF2|JH3 | EVQLLES-GGTLVQPGGSLRLSCVASE-FTFS | S-----YVMS | WVRQAPGM GLEWVS | IISGR---GGNTFYADSVKG | RFTISRDNSKNTLYLQMNSL RAEDTALYYCAS | RLAVAG-------SEAFDI | WGQGT MVTVS S |
| iPS:3 93898 | 21-225_5F7 | VH3/3-23|D6|6-19|RF2|JH3 | EVQLLES-GGGLVQPGGSLRLSCAASE-FTFS | S-----YAMS | WVRQAPGK GLEWVS | IISGR---GGNTFYADSVKG | RFTISRDNSKNTLYLQMNSL RAEDTAVYYCAS | RIAVAG-------SEAFAI | WGQGT MVTVS S |
| iPS:3 93980 | 21-225_6D3 | VH3/3-23|D6|6-19|RF2|JH3 | EVQLLES-GGGLVQPGGSLRLSCAASE-FTFS | S-----YAMN | WVRQAPGK GLEWVS | VISGR---GGNTFYADSVKG | RFTISRDNSKNTLYLQMNSL RAEDTAVYYCAS | RLAVAG-------SEAFDI | WGQGT MVTVS S |
| iPS:3 94014 | 21-225_8G6 | VH3/3-23|D6|6-19|RF2|JH3 | EVQLLES-GGGLVQPGGSLRLSCAASE-FTFS | S-----YVMN | WVRQAPGK GLEWVS | VISRS---GGYTYYADSVKG | RFTISRDNSKNTLYLQMNSL RAEDTAVYYCAS | RLAVAG-------SEAFDI | WGQGT MVSVS S |
| iPS:3 94022 | 21-225_16H6 | VH3/3-23|D6|6-19|RF2|JH3 | EVQLLES-GGGLVQPGGSLRLSCAASE-FTFS | S-----YAMN | WVRQAPGM GLEWVS | VISRS---GGYTYYADSVKG | RFTISRDNSKNTLYLQMNSL RAEDTAVYYCAS | RLAVAG-------SEAFDI | WGQGT MVTVS S |
| iPS:3 94043 | 21-225_3B1 | VH3/3-23|D6|6-19|RF2|JH3 | EVQLLES-GGGLVQPGGSLRLSCAASE-FTFS | S-----YAMN | WVRQAPGK GLEWVS | VISGR---GINTFYADSVKG | RFTISRDNSKNTLYLQMNSL RAEDTAVYYCAS | RLAVAG-------SEAFDI | WGQGT MVTVS S |
| iPS:3 94077 | 21-225_8E12 | VH3/3-23|D6|6-19|RF2|JH3 | EVQLLES-GGGLVQPGGSLRLSCAASE-FTFS | S-----YAMS | WVRQAPGK GLEWVS | IISGR---GGNTFYADSVKG | RFTISRDNSKNTLYLQMNSL RAEDTAVYYCAS | RMAVAG-------SEAFDI | WGQGT MVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 94087 | 21-225_11A5 | VH3j3-23jD6j6-19jRF2/JH3 | EVQLLES-GGGLVQPGGSLRL SCAASE-FTFS | S------YAMS | WVRQAPGK GLEWIS | VISGR----GVNTYYADS VKG | RFTISRDNSKNTLYLQMNSL RAEDTAVYYCAS | RIAVAG----------SEAFDI | WGQGT MVTVS S |
| | VH3j3-11jD6j6-6jRF2/JH3 | Germline | QVQLVES-GGGLVKPGGSLRL SCAASG-FTFS | D------YFMT | WIRQAPGQ GLEWVS | TISSS----GSTIYADS VKG | RFTISRDNAKNSLYLQMNSL RAEDTAVYYCAR | SIAAR----------GAFDI | WGQGT MVTVS S |
| | | H_FR1 | H_CDR1 | H_FR2 | H_CDR2 | H_FR3 | H_CDR3 | H_FR4 |
| iPS:4 34011 | 21-225_48B10 | VH3j3-11jD6j6-6jRF2/JH 3 | QVQLVES-GGGLVKPGGSLRL SCAASG-FTFS | D------YFMT | WIRQAPGQ GLEWVS | YISSA----GGAIYYADS VKG | RFTISRDNAKNSLYLQMNSL RAEDTAVYYCAI | AVAAP----------GVFDI | WGQGT MVTVS S |
| | VH3j3-11jD6j6-6jRF2/JH4 | Germline | QVQLVES-GGGLVKPGGSLRL SCAASG-FTFS | D------YFMT | WIRQAPGQ GLEWVS | TISSS----GSTIYADS VKG | RFTISRDNAKNSLFLQMNSL RAEDTAVYYCAR | SIAAR----------YFDY | WGQGT LVTVS S |
| | | H_FR1 | H_CDR1 | H_FR2 | H_CDR2 | H_FR3 | H_CDR3 | H_FR4 |
| iPS:4 34015 | 21-225_48F12 | VH3j3-11jD6j6-6jRF2/JH 4 | QVQLVES-GGGLVKPGGSLRL SCAASG-FTFS | D------YFMT | WIRQAPGQ GLEWVS | YISSA----GGAIYYADS VKG | RFTISRDNAKNSLFLQMNSL RAEDTAVYYCAI | AVAAP----------GAFDI | WGQGT LVTVS S |
| iPS:4 34017 | 21-225_48G12 | VH3j3-11jD6j6-6jRF2/JH 4 | QVQLVES-GGGLVKPGGSLRL SCAASG-FTFS | D------YFMT | WIRQAPGQ GLEWVS | YISSA----GGAIYYADS VKG | RFTISRDNAKNSLFLQMNSL RAEDTAVYYCAI | AVAAP----------GAFDI | WGQGT LVTVS S |
| | VH3j3-23jD6j6-13jRF2/JH4 | Germline | EVQLLES-GGGLVQPGGSLRL SCAASG-FTFS | S------YAMS | WVRQAPGK GLEWVS | AISGS----GGSTYYADS VKG | RFTISRDNSKNTLYLQMNSL RAEDTAVYYCAK | GIAAR----------YFDY | WGQGT LVTVS S |
| | | H_FR1 | H_CDR1 | H_FR2 | H_CDR2 | H_FR3 | H_CDR3 | H_FR4 |
| iPS:4 34023 | 21-225_49F1 | VH3j3-23jD6j6-13jRF2/JH4 | EVQLLES-GGGLVQPGGSLRL SCAASG-FTFS | S------YAMS | WVRQAPGK GLEWVS | VISGS----GGSTYYADS VKG | RFTISRDNSKSTLYLQMNSL RAEDTAVYYCAS | AIAAAG----------AHYFDY | WGQGT LVTVS S |
| iPS:4 36246 | 21-225_201G6 | VH3j3-23jD6j6-13jRF2/JH4 | EVQLLES-GGGLVQPGGSLRL SCAASG-FTFS | S------YAMS | WVRQAPGK GLEWVS | TISGS----GVRTYYADS VKG | RFTISRDNSKNTLFLQMNSL RAEDTAVYYCAK | GGARSSG----------WFHFDY | WGQGT LVTVS S |
| iPS:4 36254 | 21-225_202C12 | VH3j3-23jD6j6-13jRF2/JH4 | EVQLLES-GGGLVQPGGSLRL SCVASG-FTFS | S------YAMS | WVRQAPGK GLEWVS | TISGS----GVRTYYADS VKG | RSTISRDNSKNTLFLQMNSL RAEDTAVYYCAK | GGARSSG----------WFHFDY | WGQGT LVTVS S |
| iPS:4 36304 | 21-225_201F3 | VH3j3-23jD6j6-13jRF2/JH4 | EVQLLES-GGGLVQPGGSQRL SCAASG-FTFS | S------YAMS | WVRQAPGK GLEWVS | TISGS----GVRTYYADS VKG | RFTISRDNSNNTLFLQMNSL RAEDTAVYYCAK | GGARSSG----------WFHFDY | WGQGT LVTVS S |
| iPS:4 36334 | 21-225_208G3 | VH3j3-23jD6j6-13jRF2/JH4 | EVQLLES-GGGLVQPGGSLRL SCAASG-FTFS | S------YAMS | WVRQAPGK GLEWVS | TISGS----GVRTYYADS VKG | RSTISRDNSKNTLFLQMNSL RAEDKAVYYCAK | GGARSSG----------WFHFDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-23|D6|6-19|RF2|JH5 | | EVQLLES-GGGLVQPGGSLRL SCAASG-FTFS | YAMS | WVRQAPGK GLEWVS | AISGS---GGSTYYADS VKG | RFTISRDNSKNTLYLQMNSL RAEDTAVYYCAK | GIAVAG------NSWFDP | WGQGT LVTVS S |
| iPS:4 34027 | 21-225_49H5 | VH3/3-23|D6|6-19|RF2|JH5 | EVQLLES-GGGLVQPGGSLRL SCAASG-FTFS | S-----YAMT | WVRQTPGK GLEWVS | AISGS---GGNSFYADS VKG | RFTISRDNSENTFYLQMNSL RAEDTAVYYCAK | ARAVAG------SHWFDP | WGQGT LVTVS S |
| iPS:4 34061 | 21-225_51C7 | VH3/3-23|D6|6-19|RF2|JH5 | EVQLLES-GGGLVQPGGSLRL SCAASG-FTIS | N-----YAMT | WVRQTPCK GLEWVS | VISAS---GGNSFYADS VKG | RFTISRDNSENTFYLQMNSL RAEDTAVYYCAK | ARAVAG------SHWFDP | WGQGT LVTVS S |
| iPS:4 34167 | 21-225_50F3 | VH3/3-23|D6|6-19|RF2|JH5 | EVQLLES-GGGLVQPGGSLRL SCAASG-FTFR | T-----YAMI | WVRQAPGK GLEWVS | AISGS---GVNSFYADS VKG | RFTISRDNSENTLYLQMNSL RAEDTAVYYCAK | ARAVAG------SHWFDP | WGQGT LVTVS S |
| iPS:4 34455 | 21-225_72F5 | VH3/3-23|D6|6-19|RF2|JH5 | EVQLLES-GGGLVQPGGSLRL SCAASG-FTFS | S-----YAMI | WVRQAPGK GLEWVS | TISGS---GGYTYADS VKG | RFTISRDNSKNTLYLQMNSL RAEDTAVYYCAK | RIAVTG------TEWYDP | WGQGT LVTVS S |
| iPS:4 37232 | 21-225_63E1 | VH3/3-23|D6|6-19|RF2|JH5 | EVQMLES-GGGLGQSGGSLRL SCTASG-FTFI | T-----SAMS | WVRQAPGK GLEWVS | AISGS---GANTFYADS VKG | RPTVTRDNSKNTLYLQMNSL TAEDTAVYYCVK | VIAVAG------GHFFDP | WGQGT LVTVS S |
| | Germline | H_FR1 | H_CDR1 | H_FR2 | H_CDR2 | H_FR3 | H_CDR3 | H_FR4 |
| VH3/3-21|D1|1-1|RF2|JH4 | | EVQLVES-GGGLVKPGGSLRL SCAASG-FTFS | YSMN | WVRQAPGK GLEWVS | SISGS---SSYIYYADS VKG | RFTISRDNAKNSLYLQMNSL RAEDTAVYYCAR | VDER------FDY | WGQGT LVTVS S |
| iPS:4 34043 | 21-225_50G10 | VH3/3-21|D1|1-1|RF2|JH4 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | VAT------FDY | WGQGT LVTVS S |
| iPS:4 34085 | 21-225_52E3 | VH3/3-21|D1|1-1|RF2|JH4 | EVQLVES-GGGLVKPGGSLRL SCAASG-FTFS | S-----YKMN | WVRQAPGK GLEWVS | SISSG---NSSIYYADS VKG | RFTISRDNAENSLYLQMNSL RAEDTAVYYCAR | VSIS------NDY | WGQGT LVTVS S |
| iPS:4 34101 | 21-225_52H12 | VH3/3-21|D1|1-1|RF2|JH4 | EVQLVES-GGGLVKPGGSLRL SCAASG-FTFS | S-----YSMN | WVRQAPGK GLEWVS | SISGS---STYIYYADS VKG | RFTISRDNAKNSLYLQVNSL RAEDTAVYYCAR | VNS------FDY | WGQGT LVTVS S |
| iPS:4 34187 | 21-225_56A5 | VH3/3-21|D1|1-1|RF2|JH4 | EVQLVES-GGGLVKPGGSLRL SCAASG-FTFS | S-----YSMN | WVRQAPGK GLEWVS | SISGS---SSYIYYADS VKG | RFTISRDNAKNSLYLQMNSL RAEDTAVYYCAR | VAT------FDY | WGQGT LVTVS S |
| iPS:4 34265 | 21-225_57B2 | VH3/3-21|D1|1-1|RF2|JH4 | EVQLVES-GGGLVKPGGSLRL SCAASG-FTFS | S-----YSMN | WVRQAPGK GLEWVS | SISGS---SSYINYTDS VKG | RFTISRDNAKNSLYLQMNSL RAEDTAVYYCAR | VAG------FDY | WGQGT LVTVS S |

Figure 51 (Continued)

| | | | | | | | | | |
|---|---|---|---|---|---|---|---|---|---|
| iPS:4 34439 | 21-225_70E12 | VH3/3-21/D1/1-1/RF2/JH4 | EVQLVES-GGGLVKPGGSLRL SCAASG-FTFS | S-----YSMN | WVRQAPGK GLEWVS | SISGN----STYIYTDS VKG | RFTISRDNAKNSLYLQMDSL TAEDTAVYYCAR | VAA--------- | ----FDC | WGQGT LVTVS S |
| iPS:4 35515 | 21-225_157E4 | VH3/3-21/D1/1-1/RF2/JH4 | EVQLVES-GGGLVKPGGSLRL SCAASG-FTFS | S-----YTMN | WVRQAPGK GLEWVS | SISGS----SSYIYYADS VKG | RFTISRDNAKNSLYLQMNSL RAEDTAVYYCAR | VAT--------- | ----FDY | WGQGT LVTVS S |
| iPS:4 35535 | 21-225_157H10 | VH3/3-21/D1/1-1/RF2/JH4 | EVQLVES-GGGLVKPGGSLRL SCAASG-FTFS | S-----YTMN | WVRQAPGK GLEWVS | SISGS----SSYINYADS VKG | RFTISRDNAKNSLYLQMNSL RAEDTAVYYCAR | VAH--------- | ----FDY | WGQGT LVTVS S |
| iPS:4 37224 | 21-225_56H1 | VH3/3-21/D1/1-1/RF2/JH4 | EVQLVES-GGGLVKPGGSLRL SCAASG-FTFS | N-----YRMN | WVRQGPGK GLEWIS | SISGS----STDIYYADS VKG | RFTISRDNAKNSLYLQMNSL RAEDTAVYYCAR | VAS--------- | ----FDY | WGQGT LVTVS S |
| iPS:3 92620 | 21-225_17H5 | VH3/3-21/D1/1-1/RF2/JH4 | EVQLVES-GGGLVKPGGSLRL SCAASG-FTFS | S-----YSMN | WVRQAPGK GLEWVS | SISSS----STYIYYADS VKG | RFTISRDNAKNSLYLQMNSL RAEDTAVYYCAR | VAS--------- | ----FDY | WGQGT LVTVS S |
| iPS:3 92632 | 21-225_16A11 | VH3/3-21/D1/1-1/RF2/JH4 | EVQLVES-GGGLVKPGGSLRL SCAASG-FTFS | S-----YSMN | WVRQAPGK GLEWVS | SISGS----SSLIYYADS VKG | RFTISRDNAKNSLYLQMNSL RAEDTAVYYCAR | VAA--------- | ----FDY | WGQGT LVTVS S |
| iPS:3 92746 | 21-225_20H7 | VH3/3-21/D1/1-1/RF2/JH4 | EVHLVES-GGGLVKPGGSLRL SCAASG-FTFS | S-----YSMN | WVRQAPGK GLEWVS | SISGS----SSFIYYADS VKG | RFTISRDNAKNSLYLQMNSL RAEDTAVYYCAR | VAA--------- | ----LDY | WGQGT LVTVS S |
| iPS:3 92782 | 21-225_22B12 | VH3/3-21/D1/1-1/RF2/JH4 | EVQLVES-GGGLVKPGGSLRL SCAASG-FTFS | S-----YSMN | WVRQAPGK GLEWVS | SISGS----SSYIYYADS VKG | RFTISRDNAKNSLYLQMNSL RAEDTAVYYCAR | VAA--------- | ----LDS | WGQGT LVTVS S |
| iPS:3 92916 | 21-225_27C5 | VH3/3-21/D1/1-1/RF2/JH4 | EVQLVES-GGGLVKPGGSLRL SCAASG-FTFS | S-----YSMN | WVRQAPGK GLEWVS | STSGS----DSYIYYADS VKG | RFTISRDNAKNSLYLQMNSL RAEDTAVYYCAR | VAS--------- | ----FDC | WGQGT LVTVS S |
| iPS:3 92976 | 21-225_27H12 | VH3/3-21/D1/1-1/RF2/JH4 | EVQLVES-GGGLVKPGGSLRL SCAASG-FTFS | S-----YSLN | WVRQAPGK GLEWVS | SISGS----SSNIYYTDS VKG | RFTISRDNAKNSLFLQMNSL RAEDTAVYYCAR | VAS--------- | ----FDY | WGQGT LVTVS S |
| iPS:3 93120 | 21-225_35H8 | VH3/3-21/D1/1-1/RF2/JH4 | EVQLVES-GGGLVKPGGSLRL SCAASG-FTFS | S-----YSMN | WVRQAPGK GLEWVS | SISGT----GSFIYYADS VKG | RFTISRDNAKKSVYLQMNSL RAEDTAVYYCAR | VSG--------- | ----FDY | WGQGT LVTVS S |
| iPS:3 93836 | 21-225_15A2 | VH3/3-21/D1/1-1/RF2/JH4 | EVQLVES-GGGLVKPGGSLRL SCAASG-FTFS | S-----YTMN | WVRQAPGK GLEWVS | SISGS----GSYIYYADS VKG | RFTISRDNAKNSLYLQMNAL RAEDTAVYYCAR | VAS--------- | ----FDY | WGQGT LVTVS S |

Figure 51 (Continued)

| | | | | | | | | | |
|---|---|---|---|---|---|---|---|---|---|
| iPS:3 93894 | 21-225_5E11 | VH3/3-21/D1/1-1/RF2/JH4 | EVQLVES-GGGLVKPGGSLRLSCAASG-FTFS | S-----YSMN | WVRQAPGKGLEWVS | SISGS---STYIYYADSVKG | RFTISRDNAKNSLYLQMNSLRAEDTAVYYCAR | VAS----------- | ----FDY | WGQGTLVTVSS |
| iPS:3 93896 | 21-225_2A4 | VH3/3-21/D1/1-1/RF2/JH4 | EVQLVES-GGGLVKPGGSLRLSCAASG-FTFS | S-----YSMN | WVRQAPGKGLEWVS | SISGS---STYIYYADSVKG | RIAISRDNAKNSLYLQMNSLRAEDTAVYYCAR | VAS----------- | ----FDY | WGQGTLVTVSS |
| iPS:3 93914 | 21-225_16B8 | VH3/3-21/D1/1-1/RF2/JH4 | EVQLVES-GGGLVKPGGSLRLSCAASG-FTFS | S-----YSMN | WVRQAPGKGLEWIS | SISGS---STYIYYADSVKG | RFTISRDNAKNSLYLQMNSLRAEDTAVYYCAR | VAS----------- | ----FDY | WGQGTLVTVSS |
| iPS:3 93944 | 21-225_14D6 | VH3/3-21/D1/1-1/RF2/JH4 | EVQLVES-GGGLVKPGGSLRLSCAASG-FTFS | S-----YTMN | WVRQAPGKGLEWVS | SISGS---GSYIYYADSVKG | RFTMSRDNAKNSLYLQMNSLRAEDTAVYYCAR | VAA----------- | ----FDS | WGQGTLVSVSS |
| iPS:3 93952 | 21-225_1F1 | VH3/3-21/D1/1-1/RF2/JH4 | EVQLVES-GGGLVKPGGSLRLSCAASG-FTFS | S-----YNMN | WVRQAPGKGLEWIS | SISSS---SSYIYYADSVKG | RFTISRDNAKNSLYLQMNSLRAEDTAVYYCAR | VNL----------- | ----FDY | WGQGTLVTVSS |
| iPS:3 94033 | 21-225_5F4 | VH3/3-21/D1/1-1/RF2/JH4 | EVQLVES-GGGLVKPGGSLRLSCVASG-FTFS | S-----YSMN | WVRQAPGKGLEWVS | SISGS---STYIYYADSVKG | RFTISRDNAKNSLFLQMNSLRAEDTAVYYCAR | VNN----------- | ----FDY | WGQGTLVTVSS |
| iPS:3 94069 | 21-225_16H1 | VH3/3-21/D1/1-1/RF2/JH4 | EVQLVES-GGGLVKPGGSLRLSCAASG-FTFS | S-----YSMN | WVRQAPGKGLEWVS | SISGS---STYIYYADSVKG | RFTISRDNAKNSLYLQMNSLRAEDTAVYYCAR | VAA----------- | ----FDY | WGQGTLVTVSS |
| iPS:3 94482 | 21-225_17H6 | VH3/3-21/D1/1-1/RF2/JH4 | EVQLVES-GGGLVKPGGSLRLSCAASG-FTFS | S-----YSMN | WVRQAPGRGLEWVS | SISGS---SSYIYYADSVKG | RFTIFRDNAKNSLYLQMNSLRAEDTAVYYCAR | VAS----------- | ----FDY | WGQGTLVTVSS |
| iPS:3 98492 | 21-225_21F12 | VH3/3-21/D1/1-1/RF2/JH4 | EVQLVES-GGGLVKPGGSLRLSCAASG-FTFS | S-----YRMN | WVKQAPGKGLEWVS | SINSN---SSYIYYADSVKG | RFTISRDNAKNSLYLQMNSLRAEDTAVYYCAR | VAS----------- | ----FDY | WGQGTLVTVSS |
| iPS:3 98500 | 21-225_23A11 | VH3/3-21/D1/1-1/RF2/JH4 | EVQLVES-GGGLVKPGGSLRLSCAASG-FTFS | S-----YRMN | WIRQAPGKGLEWVS | SISGS---STYIYYADSVKG | RIAISRDNAKNSLYLQMNSLRAEDTAVYYCAR | VAS----------- | ----FDY | WGQGTLVTVSS |
| iPS:3 98526 | 21-225_32B3 | VH3/3-21/D1/1-1/RF2/JH4 | EVQLVES-GGGLVKPGGSLRLSCAASG-FTFS | S-----YSMN | WVRQAPGKGLEWVS | SISGS---STYIYYADSVKG | RFTISRDNAKNSLYLQMNSLRAEDTAVYYCAR | VAG----------- | ----FDY | WGQGTLVTVSS |
| iPS:4 02221 | 21-225_2C12 | VH3/3-21/D1/1-1/RF2/JH4 | EVQLVES-GGGLVKPGGSLRLSCAASG-FTFS | S-----YSMN | WVRQAPGKGLEWVS | SISGS---SSYMYYADSVKG | RFTISRDNAKDSLYLQMNSLRAEDTAVYYCAR | VNL----------- | ----FDY | WGQGTLVTVSS |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1/1-02/D2/2-15/RF2/JH6 | | EVQLVQS-GAEVKKPGASVKV SCKASG-YTFT | G------YYMH | WVRQAPGQ GLEWMG | WINP------ SGGTNAQK FQG | RVTMTRDTSISTAYMELSRL RSEDTAVYYCAR | GYYDRSSYG------ -YYYYGMDV | WGQGT TVTVS S |
| iPS:4 34047 | 21-225_50A12 | VH1/1-02/D2/2-15/RF2/JH6 | QVQLVQS-GAEVKKPGASVKV SCKASG-YTFT | G------HYIN | WVRQAPGQ GPEWMA | WVNPN------ SGGTNSAQK FQG | RVTMTRDTSISTVYMELSRL RSDDTAVYYCAR | GGQLGGFN------ -YYYGMDV | WGQGT TVTVS S |
| iPS:4 34067 | 21-225_51H8 | VH1/1-02/D2/2-15/RF2/JH6 | QVQLVQS-GAEVKKPGASVKV SCKASG-YTFT | G------HYMN | WVRQAPGQ GLEWMG | WVNPN------ SGGSNSAQQ FQG | RVTMTRDTSISTVYMELSRL SSDDTAVYYCAR | GGQLGGFN------ -FYYGMDV | WGQGT TVTVS S |
| iPS:4 34197 | 21-225_56C7 | VH1/1-02/D2/2-15/RF2/JH6 | QVQLVQS-GAEVKKPGASVKV SCKASG-YTFT | G------HYIN | WVRQAPGQ GLEWMA | WVNPN------ SGGTNSAQK FQG | RVTMTRDTSISTVYMELSRL RSDDTAVYYCAR | GGQLGGFN------ -YYYGMDV | WGQGT TVTVS S |
| | Germline | H_FR1 | H_CDR1 | H_FR2 | H_CDR2 | H_FR3 | H_CDR3 | H_FR4 |
| VH3/3-21/D2/2-15/RF2/JH6 | | EVQLVES-GGGLVKPGGSLRL SCAASG-FTFS | S------YSMN | WVRQAPGK GLEWVS | SISSS------ SSTIYYADS VKG | RFTISRDNAAKNSLYLQMNSL RAEDTAVYYCAR | DRSVVTALL------ -YYYGMDV | WGQGT TVTVS S |
| iPS:4 34049 | 21-225_50B12 | VH3/3-21/D2/2-15/RF2/JH6 | EVQLVES-GGGLVKPGGSLRL SCAASG-FTFS | S------HSMN | WVRQAPGK GLEWVS | SISSS------ SNYIYYADS VKG | RFTISRDYAKNSLYLQMNSL RAEDTAVYYCAK | DRSIVAGP------ -WDYGMDV | WGQGT TVTVS S |
| | Germline | H_FR1 | H_CDR1 | H_FR2 | H_CDR2 | H_FR3 | H_CDR3 | H_FR4 |
| VH3/3-23/D1/1-20/RF1/JH3 | | EVQLLES-GGGLVQPGGSLRL SCAASG-FTFS | S------YAMS | WVRQAPGK GLEWVS | AISGS------ GSSTYYADS VKG | RFTISRDNSKNTLYLQMNSL RAEDTAVYYCAK | GITGT------ -DAFDI | WGQGT TVTVS S |
| iPS:4 34055 | 21-225_51B4 | VH3/3-23/D1/1-20/RF1/JH3 | EVQLLES-GGGLVQPGGSLSL SCAASG-FTFR | S------YVMS | WVRQAPGK GLEWVS | AISGR------ GSNTFYTDS VKG | RFTISRDNSKNTLYLQMNSL RAEDTAVYYCAK | GITGSH------ -GAFDI | WGQGT MVTVS S |
| | Germline | H_FR1 | H_CDR1 | H_FR2 | H_CDR2 | H_FR3 | H_CDR3 | H_FR4 |
| VH3/3-23/D7/7-27/RF1/JH4 | | EVQLLES-GGGLVQPGGSLRL SCAASG-FTFS | S------YAMS | WVRQAPGK GLEWVS | AISGS------ GSSTYYADS VKG | RFTISRDNSKNTLYLQMNSL RAEDTAVYYCAK | LTGT------ -FDY | WGQGT LVTVS S |
| iPS:4 34059 | 21-225_51C5 | VH3/3-23/D7/7-27/RF1/JH4 | EVQLLES-GGGLVQPGGSLRL SCAASG-FTFS | S------YVMS | WVRQTPGK GLEWVS | TMSGS------ GGRTYYADS VNG | RFTVSRDNSKNTLYLQMSSL RAEDTAVYYCAR | VTA------ -FDY | WGQGT LVTVS S |
| iPS:4 34213 | 21-225_60A4 | VH3/3-23/D7/7-27/RF1/JH4 | EVQLLES-GGGLVQPGGSLRL SCAASG-FTFS | S------YVMS | WVRQAPGK GLEWVS | SISGS------ GGWTNYADS VKG | RFTTSRDNSKNTLYLQMNSL RAEDTAVYYCAR | LTG------ -FDY | WGQGT LVTVS S |
| iPS:4 34215 | 21-225_60F7 | VH3/3-23/D7/7-27/RF1/JH4 | EVQLLES-GGGLVQPGGSLRL SCAASG-FTFS | S------YVMS | WVRQAPGK GLEWVS | GISGS------ GNRTYYADS VKG | RFTISRDNSKNTLYLQMNSL RAEDSAVYYCGS | LG------ -ID | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34241 | 21-225_61E6 | VH3J3-23JD7J7-27JRF1JH4 | EVQLLES-GGGLVQPGGSLRL SCAASG-FTFR | S-----YAMS | WVRQAPGK GLEWVS | AISGS----GVNTFYADS VKG | RFTISRDNSKNTLYLQMNSL RAEDTAVYYCAK | LELG--------------IFDY | WGQGT LVTVS S |
| iPS:4 34281 | 21-225_57B8 | VH3J3-23JD7J7-27JRF1JH4 | EVQLLES-GGGLVQPGGSLRL SCAASG-FTFR | S-----YAMS | WVRQAPGK GLEWVS | AISGS----GGNTFYADS VKG | RFTISRDNSKNTLYLQMNSL RAEDTAVYYCAK | LELG--------------IFDY | WGQGT LVTVS S |
| iPS:4 34301 | 21-225_58F11 | VH3J3-23JD7J7-27JRF1JH4 | EVQLLES-GGGLVQPGGSLRL SCAASG-FTFS | S-----YAMS | WVRQAPGK GLEWVS | AISGS----GGNTFYADS VKG | RFTISRYNSKNTLYLQMNSL RAEDTAVYYCAK | FFGMVG-----------AGFFDY | WGQGT LVTVS S |
| iPS:4 35523 | 21-225_157G5 | VH3J3-23JD7J7-27JRF1JH4 | EVQLLES-GGGLVQPGGSLRL SCAASG-FTFS | S-----YVMS | WVRQAPGK GLDWVS | AMSGS----GGRTYYADS VKG | RFTISRDNSKNTLYLQMNSL RAEDTAVYYCAK | YTW---------------NGY | WGQGT LVTVS S |
| iPS:4 35659 | 21-225_167D12 | VH3J3-23JD7J7-27JRF1JH4 | EVQLLES-GGGLVQPGGSLRL SCAASG-FTFS | S-----YVMS | WVRQAPGK GLEWVS | AMSGS----GGRTYYADS VKG | RFTISRDNSKNTLYLQMNSL RAEDTAVYYCAK | YTW---------------NGY | WGQGT LVTVS S |
| iPS:4 35765 | 21-225_177D3 | VH3J3-23JD7J7-27JRF1JH4 | EVQLLES-GGGLVQPGGSLRL SCAASG-FTFS | S-----YVMN | WVRQAPGK GLEWVS | GMSGS----GGRTYYADS VKD | RFTISRDNSKNTLSLQMNSL RAEDTAVYYCAK | VTF---------------FDY | WGQGT LVTVS S |
| iPS:4 37216 | 21-225_51D5 | VH3J3-23JD7J7-27JRF1JH4 | EVQLLES-GGGLVQPGGSLRL SCAASG-FTFS | S-----YVMS | WVRQTPGK GLEWVS | TMSGS----GGRTYYADS VNG | RFTVSRDNSKNTLYLQMSSL RAEDTAVYYCAK | VTA---------------FDY | WGQGT LVTVS S |
| | Germline | | H_FR1 | H_CDR1 | H_FR2 | H_CDR2 | H_FR3 | H_CDR3 | H_FR4 |
| VH3J3-21JD5J5-24JRF2JH4 | | | | | | | | | |
| iPS:4 34063 | 21-225_51G7 | VH3J3-21JD5J5-24JRF2JH4 | EVQLVES-GGGLVKPGGSLRL SCAASG-FTFS | S-----YSMN | WVRQAPGK GLEWVS | SISSS----SSYIYYADS VKG | RFTISRDNAKNSLYLQMNSL RAEDTAVYYCAR | ARL---------------DY | WGQGT LVTVS S |
| | Germline | | H_FR1 | H_CDR1 | H_FR2 | H_CDR2 | H_FR3 | H_CDR3 | H_FR4 |
| VH3J3-23JD7J7-27JRF3JH4 | | | | | | | | | |
| iPS:4 34083 | 21-225_52H2 | VH3J3-23JD7J7-27JRF1JH4 | EVQLLES-GGGLVQPGGSLRL SCAASG-FTFS | R-----NAMS | WVRQAPGM GLEWVS | AISGR----GGNTFYADS VKG | RFTVSRDNSKNTLFLQMSSL RAEDTAVYYCAK | NGREQ-------------WLDY | WGQGT LVTVS S |
| | Germline | | H_FR1 | H_CDR1 | H_FR2 | H_CDR2 | H_FR3 | H_CDR3 | H_FR4 |
| VH3J3-30.3JD6J6-6JRF2JH6 | | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34087 | 21-225_52F6 | VH3/3-30.3/D6/6-6/RF2/JH6 | QVQLVES-GGGVVQPGRSLRL SCAASG-FTFS | S-----YGMH | WVRQAPGK GLEWVA | IISYG----GSNKYYADS VKG | RFTISRDNSKNTLYLQMNSL RAEDTAVYYCAR | RSAARP------GYGMDV | WGQGT TVTVS S |
| iPS:4 34111 | 21-225_53H2 | VH3/3-30.3/D6/6-6/RF2/JH6 | QVQLVES-GGGVVQPGRSLRL SCAASG-FTFS | S-----YGMH | WVRQAPGK GPEWVA | VISYG----GSNKYYADS VKG | RFTISRDNSRNTLYLQMNSL RAEDTAVYYCAR | RGAARP------GYGMDV | WGQGT TVTVS S |
| iPS:4 34121 | 21-225_53F6 | VH3/3-30.3/D6/6-6/RF2/JH6 | QVQLVES-GGGVVQPGRSLRL SCAASG-FTFS | S-----YGMH | WVRQAPGK GLEWVA | VISYG----GSNKYYADS VKG | RFTISRDNSKNTLYLQMTSL RAEDTAVYYCAR | RRAARP------GYGMDV | WGQGT TVTVS S |
| iPS:4 34163 | 21-225_50H1 | VH3/3-30.3/D6/6-6/RF2/JH6 | QVQLVES-GGGVVQPGRSLRL SCAASG-FTFS | S-----YGMH | WVRQAPGK GLEWVS | IISYG----GSNKYYADS VKG | RFTISRDNSKNTLYLQMTSL RAEDTAVYYCAR | RRAARP------GYGMDV | WGQGT TVTVS S |
| iPS:3 94035 | 21-225_5G9 | VH3/3-30.3/D6/6-6/RF2/JH6 | QVQLVES-GGGVVQPGRSLRL SCAASG-FTFS | N-----YGMH | WVRQAPGK GLEWVA | IISYA----GSNKYYADS VKG | RFTISRDNSKNTLYLQMNSL RAEDTAVYYCVR | RITARL------YYGMDV | WGQGT TVTVS S |
| | Germline | | | H_CDR1 | H_FR2 | H_CDR2 | H_FR3 | H_CDR3 | H_FR4 |
| | VH3/3-33/D2/2-8/RF1/JH4 | | | | | | | | |
| iPS:4 34095 | 21-225_52F10 | VH3/3-33/D2/2-8/RF1/JH4 | QVQLVES-GGGVVQPGRSLRL SCAASG-FTFS | F-----YGMH | WVRQAPGK GLEWVS | VIWDD----GSNKYYADS VKG | RFTISRDNSKNTLFLQMSL RAEDTAVYYCAR | DSLYSS------SWLFDY | WGQGT LVTVS S |
| | Germline | | H_FR1 | H_CDR1 | H_FR2 | H_CDR2 | H_FR3 | H_CDR3 | H_FR4 |
| | VH3/3-23/D4/4-23/RF3/JH4 | | | | | | | | |
| iPS:4 34107 | 21-225_53E2 | VH3/3-23/D4/4-23/RF3/JH4 | EVQLLES-GGGLIQPGGSLRL SCAASG-FTFR | S-----YAMS | WVRQAPGK GLEWVS | AISGS----GGNTFYADS VKG | RFTISRDNSKNTLYLQMNTL RAEDTAVYYCAK | KVVDTA------MALDY | WGQGT LVTVS S |
| iPS:4 34181 | 21-225_56B2 | VH3/3-23/D4/4-23/RF3/JH4 | EVQLLES-GGGLIQPGGSLRL SCAASG-FTFR | S-----YAMS | WVRQAPGK GLEWVS | AISGS----GGNTFYADS VKG | RFTISRDNSKNTLYLQMNTL RAEDTAVYYCAK | KVVDTA------MALDY | WGQGT LVTVS S |
| | Germline | | H_FR1 | H_CDR1 | H_FR2 | H_CDR2 | H_FR3 | H_CDR3 | H_FR4 |
| | VH3/3-23/D1/1-26/RF1/JH3 | | | | | | | | |
| iPS:4 34117 | 21-225_53C6 | VH3/3-23/D1/1-26/RF1/JH3 | EVQLLES-GGGLVQPGGSLRL SCAASG-FTFS | S-----YAMN | WVRQAPGK GLEWVS | AISGS----GGATYYADS VKG | RFTISRDNSKNTLYLQMNSL RAEDTAVYYCAK | PLVGAH------DAFEI | WGQGT MVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92984 | 21-225_30E11 | VH3\|3-23\|D1\|1-26\|RF1\|JH3 | EVQLLES-GGDMVQPGGSLRLSCAASG-FTFS | I-----YAMS | WVRQAPGK GLEWVS | VISGS----GGSSFYADS VKG | RFTISRDNSKNTLYLQMNSL RAEDTAVYYCTK | DRVKAH--------DGFDI | WGQGT MVTVS S |
| iPS:3 93114 | 21-225_33G12 | VH3\|3-23\|D1\|1-26\|RF1\|JH3 | EVQLLES-GGDMVQPGGSLRLSCAASG-FTFS | S-----YAMS | WVRQAPGK GLEWVS | VISGS----GGSSFYADS VKG | RFTISRDNSKNTLYLQMNSL RAEDTAVYYCAK | DRVRAH--------DGFDI | WGQGT MVTVS S |
| | Germline | VH3\|3-33\|D5\|5-24\|RF2\|JH4 | EVQLLES-GGGLVQPGGSLRLSCAASG-FTFS | S-----YGMH | WVRQAPGK GLEWVS | AISGS----GSSTFYADS VKG | RFTISRDNSKNTLYLQMNSL RAEDTAVYYCAR | KNLC-----------LFFDY | WGQGT LVTVS S |
| iPS:4 34127 | 21-225_53H8 | VH3\|3-33\|D5\|5-24\|RF2\|JH4 | QVQLVES-GGGVVQPGRSLRLSCAASG-FTFS | S-----YGMH | WVRQAPGK GLEWVA | VIWYD----GSNKYYADS VKG | RFTISRDNSKNTLYLQMNSL RAEDTAVYYCAR | ARIG-----------YFDS | WGQGT LVTVS S |
| | Germline | VH3\|3-23\|D4\|4-17\|RF2\|JH4 | EVQLLES-GGGLVQPGGSLRLSCAASG-FTFS | S-----YAMS | WVRQAPGK GLEWVS | AISGS----GSSTFYADS VKG | RFTISRDNSKNTLYLQMNSL RAEDTAVYYCAK | DYGDY----------YFDY | WGQGT LVTVS S |
| iPS:4 34147 | 21-225_55E1 | VH3\|3-23\|D4\|4-17\|RF2\|JH4 | EVQLLES-GGGLVQPGGSLRLSCAASG-FTFS | S-----YAMS | WVRQAPGK GLEWVS | AISGR----GSSTFYADS VKG | RFTISRDNSKNTLYLQMNSL RAEDTAVYYCAK | DHGIVG---------TIYFDY | WGQGT LVTVS S |
| iPS:4 35303 | 21-225_146A6 | VH3\|3-23\|D4\|4-17\|RF2\|JH4 | EVQLLES-GGGLVQPGGSLRLSCAASG-FTFN | S-----YAMN | WVRQAPGK GLEWVS | AISGS----GGNTFYADS VKG | RFTISRDNSKNTLYLQMNSL RAEDTAVYYCAK | KDNDYVW--------GSPYFDY | WGQGT LVTVS S |
| iPS:4 35335 | 21-225_147D10 | VH3\|3-23\|D4\|4-17\|RF2\|JH4 | EVQLLES-GGGLVQPGGSLRLSCAASG-FTFS | S-----YAMS | WVRQAPGK GLEWVS | AISGR----GGNTFYADS VKG | RFTISRDNSKNTLYLQMNSL RAEDTAVYYCAK | KDYDYVW--------GSPYFDY | WGQGT LVTVS S |
| iPS:4 35339 | 21-225_147D12 | VH3\|3-23\|D4\|4-17\|RF2\|JH4 | EVQLLES-GGGLVQSGGSLRLSCAASG-FTFS | S-----YAMS | WVRQAPGK GLEWVS | AISGR----GGNTFYADS VKG | RFTISRDNSKNTLYLQMNSL RAEDTAVYYCAK | KDYDYVW--------GSPYFDY | WGQGT LVTVS S |
| iPS:4 35343 | 21-225_148E2 | VH3\|3-23\|D4\|4-17\|RF2\|JH4 | EVQLLES-GGGLVQPGGSLRLSCAASG-FTFS | S-----YAMS | WVRQAPGK GLEWVS | AISGR----GGNTFYADS VKG | RFTISRDNSKNTLYLQMNSL RAEDTAVYYCAK | KDYDYVW--------GSPYFDY | WGQGT LVTVS S |
| iPS:4 35381 | 21-225_149C6 | VH3\|3-23\|D4\|4-17\|RF2\|JH4 | EVQLLES-GGGLVQPGGSLRLSCAASG-FTFS | S-----YAMS | WVRQAPGK GLEWVS | AISGR----GGNTFYADS VKG | RFTISRDNSKNTLYLHMNSL RAEDTAVYYCAK | KDYDYVW--------GSPYFDY | WGQGT LVTVS S |
| iPS:4 35391 | 21-225_149F8 | VH3\|3-23\|D4\|4-17\|RF2\|JH4 | EVQLLES-GGGLVQPGGSLRLSCAASG-FTFS | S-----YAMS | WVRQAPGK GLEWVS | AISGR----GGNTFYADS VKG | RFTISRDNSKNTLYLQMNSL RAEDTAVYYCAK | KDYDYVW--------GSPYFDY | WGQGT LVTVS S |

Figure 51 (Continued)

| ID | V(D)J | H_FR1 | H_CDR1 | H_FR2 | H_CDR2 | H_FR3 | H_CDR3 | H_FR4 |
|---|---|---|---|---|---|---|---|---|
| iPS:4 35395 | 21-225_149D11 | VH3|3-23|D4|4-17|RF2|JH4 | EVQLLES-GGGLVQPGGSLRLSCAASG-FTFS | S------YAMS | WVRQAPGKGLEWVS | AISGR---GGNTFYADSVKG | RFTISRDNSKNTLYRQMNSLRAEDTAVYYCAK | KDYDYVW-------GSPYFDY | WGQGTLVTVSS |
| iPS:4 35403 | 21-225_150C5 | VH3|3-23|D4|4-17|RF2|JH4 | EVQLLES-GGGLVQPGGSLRLSCAASG-FTFS | S------YAMS | WVRQAPGKGLEWVS | AISGS---GGNTFYADSVKG | RFTISRDNSKNTLYLQMNSLRAEDTAVYYCAK | KDYDYVW-------GSPYFDY | WGQGTLVTVSS |
| iPS:4 35447 | 21-225_152H7 | VH3|3-23|D4|4-17|RF2|JH4 | EVQLLES-GGGLVQPGGSLRLSCAASG-FTFN | S------YAMN | WVRQAPGKGLEWVS | AISGS---GGNTFYADSVKG | RFTISRDNSKNTLYLQMNSLRAEDTAVYYCAK | KDNDYVW-------GSPYFDY | WGQGTLVTVSS |
| iPS:4 35453 | 21-225_152G10 | VH3|3-23|D4|4-17|RF2|JH4 | EVQLLES-GGGLVQPGGSLRLSCAASG-FTFS | S------YAMS | WVRQAPGKGLEWVS | AISGR---GGNTFYADSVKG | RFTISRDNSKNTLYLQMNSLRAEDTAVYYCAK | KDYDYVW-------GSPYFDY | WGQGTLVTVSS |
| iPS:4 35483 | 21-225_155A4 | VH3|3-23|D4|4-17|RF2|JH4 | EVQLLES-GGGLVQPGGSLRLSCAASG-FTFS | S------YAMS | WVRQAPGKGLEWVS | AISGS---GGNTFYADSVKG | RFTISRDNSKNTLYLQMNSLRAEDTAVYYCAK | KDYDYVW-------GSPYFDY | WGQGTLVTVSS |
| iPS:4 35485 | 21-225_155B4 | VH3|3-23|D4|4-17|RF2|JH4 | EVQLLES-GGGLVQPGGSLRLSCAASG-FTFS | S------YAMS | WVRQAPGKGLEWVS | AISGS---GGNTFYADSVKG | RFTISRDNSKNTLYLQMNSLRAEDTAVYYCAK | KDYDYVW-------GSPYFDY | WGQGTLVTVSS |
| iPS:4 35777 | 21-225_178F7 | VH3|3-23|D4|4-17|RF2|JH4 | EVQLLES-GGGLVQTGGSLRLSCAASG-FTFS | S------YAMT | WVRQAPGKGLEWVS | VISGS---GGNTFYADSVKG | RFTISRDNSKNTLYLQMNSLRAEDTAVYYCAR | RYGD----------YFDY | WGQGTLVTVSS |
| iPS:4 35783 | 21-225_179G1 | VH3|3-23|D4|4-17|RF2|JH4 | EVHLLES-GGGLVQPGGSLRLSCAASG-FTFS | S------YAMT | WVRQAPGKGLEWVS | VISGF---GGNTFYADSVKG | RFTISRDNSKNTLYLQMNSLRAEDTAVYYCAR | RYGD----------YFDY | WGQGTLVTVSS |
| iPS:4 35833 | 21-225_190D12 | VH3|3-23|D4|4-17|RF2|JH4 | EVQLLES-GGGLVQPGGSLRLSCAASG-FTFS | S------YAMS | WVRQAPGKGLEWDS | AIIGN---GGRTYYADSVKG | RFTISRDNSKNTLYLQMNSLRAEDTAVYYCAK | DMGRYS--------YGFFDY | WGQGTLVTVSS |
| iPS:4 36156 | 21-225_197C8 | VH3|3-23|D4|4-17|RF2|JH4 | EVQLLES-GGGLVQPGGSLRLSCAASG-FTFS | S------SAMT | WVRQAPGKGLEWVS | AIIGN---GGRAYADSVKG | RFTISRDNSKNTLYLQMNSLRTEDTAVYYCAK | DRGYSRIA------VAGTFDY | WGQGTLVTVSS |
| Germline | VH3|3-21|D1|1-1|RF1|JH4 | | | | | | | |
| iPS:4 34157 | 21-225_55D4 | VH3|3-21|D1|1-1|RF1|JH4 | EVQLVES-GGGLVKPGGSLRLSCAASG-FTFN | S------YRMN | WVRQAPGKGLEWVS | SISSS---SNHIDYADSVKG | RFTISRDNAKNSLYLQMNSLRAEDTALYYCAR | GT------------DY | WGQGTLVSVSS |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34243 | 21-225_62C1 | VH3J3-21JD1J1-1JRF1JH4 | EVQLVES-GGGLVKPGGSLRL SCAASG-FTFS | S-----YSMN | WVRQAPGK GLEWVS | SISSS---SSYIYYADS VKG | RFTISRDNAKKSLYLQMNSL RAEDTAVYYCAI | FG----------VD | WGQGT LVTVS S |
| iPS:4 35505 | 21-225_157C1 | VH3J3-21JD1J1-1JRF1JH4 | EVQLVES-GGGLVKPGGSLRL SCAASG-FTFS | S-----YRMN | WVRQAPGK GLEWVS | SMSNS---SSSIYYADS VKG | RFTISRDNAKNSLYLQMNSL RAEDTAVYYCAR | QAA----------QDY | WGQGT LVTVS S |
| iPS:3 92966 | 21-225_32G3 | VH3J3-21JD1J1-1JRF1JH4 | EVQLVES-GGGLVKPGGSLRL SCAASG-FTFS | S-----YSMN | WVRQAPGK GLEWVS | SISGS---SSYIYYADS VKG | RFTISRDNAKNSLYLQINSL RAEDTAVYYCAR | GNIA----------RDY | WGQGT LVTVS S |
| | Germline | | H_FR1 | H_CDR1 | H_FR2 | H_CDR2 | H_FR3 | H_CDR3 | H_FR4 |
| VH3J3-33JD7J7-27JRF3J4JH4 | | QVQLVES-GGGVVQPGRSLRL SCAASG-FTFS | | | | | | |
| iPS:4 34159 | 21-225_55B8 | VH3J3-33JD7J7-27JRF3J JH4 | QVQLVES-GGGVVQPGRSLRL SCAASG-FTFS | D-----YGMH | WVRQAPGK GLEWVA | VIWYD---ENNKYYADS VKG | RFTISRDNSKNTLYLQMNSL RAEDTAVYYCTR | EWF----------DY | WGQGT LVTVS S |
| iPS:3 93026 | 21-225_32B6 | VH3J3-33JD7J7-27JRF3J JH4 | QVQLVES-GGGVVQPGRSLRL SCAASG-FTFS | D-----YGMH | WVRQAPDK GLEWVA | VIWYD---ENTKYYADS VKG | RFTISRDNSKNTLYLQMNSL RAEDTAVYYCAR | EWG----------DY | WGQGT LVTVS S |
| | Germline | | H_FR1 | H_CDR1 | H_FR2 | H_CDR2 | H_FR3 | H_CDR3 | H_FR4 |
| VH3J3-33JD6J6-6JRF3JH4 | | | | | | | | |
| iPS:4 34165 | 21-225_50F2 | VH3J3-33JD6J6-6JRF3JH4 | QVQLVES-GGGVVQPGRSLRL SCAASA-FTFS | S-----YGMH | WVRQTPGK GLEWVA | VIWHD---GSNKYYADS VKG | RFTISRDNSKNTLYLQMNSL RAEDTAVYYCAR | DEQLG----------TFDY | WGQGT LVTVS S |
| iPS:4 34191 | 21-225_56B6 | VH3J3-33JD6J6-6JRF3JH4 | QVQLVES-GGGVVQPGRSLRL SCAASG-FTFS | S-----YGMH | WVRQAPGK GLEWVA | VIWHD---GSNKYVDS VKG | RFTISRDNSKNTLYLQMNSL RAEDTAVYYCAR | DEQLG----------TFDY | WGQGT LVTVS S |
| | Germline | | H_FR1 | H_CDR1 | H_FR2 | H_CDR2 | H_FR3 | H_CDR3 | H_FR4 |
| VH1J1-46JD4J4-17JRF2JH6 | | | | | | | | |
| iPS:4 34171 | 21-225_50G4 | VH1J1-46JD4J4-17JRF2J H6 | QVQLVQS-GAEVKEPGASVKV SCKASG-YITFT | S-----YYIH | WVRQAPGQ GLEWMG | VINPS---NGRTSYAQR FQG | RVTMTRDTSTVYMELSSL RSEDTAVYYCAR | DRGDGYY----------FYYGMDV | WGQGT LVTVS S |
| | Germline | | H_FR1 | H_CDR1 | H_FR2 | H_CDR2 | H_FR3 | H_CDR3 | H_FR4 |
| VH3J3-30.3JD4J4-17JRF2JH3 | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34175 | 21-225_55A11 | VH3-30.3/D4/4-17/RF2/JH3 | QVQLVES-GGGVVQPGRSLRL SCAASG-FTFS | S-----YGMH | WVRQTPGK GLEWVA | VISYV----GSTKYYADS VRG | RFTISRDNSKNTLYLQMNSL RIEDTAVYYCAR | GRGRYSDY------GHDAFDI | WGQGT MVTVS S |
| | VH1/1-02/D1/1-1/RF1/JH2 | Germline | | | | | | | |
| iPS:4 34193 | 21-225_56C6 | VH1/1-02/D1/1-1/RF1/JH2 | QVQLVQS-GAEVKKPGASVKV SCKASG-YTFT | D-----YHMH | WVRQAPGQ GLEWMG | WINPN----RGGTNYVQK FQG | RVAMTNDISISTAYMELSGL RSDDTAVYYCAR | DGTS------SFDY | WGRGI LVTVS S |
| | VH1/1-02/D5/5-24/RF1/JH4 | Germline | | | | | | | |
| iPS:4 34195 | 21-225_56F6 | VH1/1-02/D5/5-24/RF1/JH4 | QVQLVQS-GAEVKKPGASVKV SCKASG-FTFT | D-----YYMH | WVRQAPGK GLEWMG | WINPN----SGGTNYAQR FQG | RVTMTRDTSISTAYMELSRL RSDDTAVYYCTR | EGATRP----TGFDY | WGQGT LVTVS S |
| | VH3/3-33/D1/1-1/RF2/JH4 | Germline | | | | | | | |
| iPS:4 34203 | 21-225_60E2 | VH3/3-33/D1/1-1/RF2/JH4 | QVQLVES-GGGVVQPGRSLRL SCAASG-FTFN | D-----YGMH | WVRQAPGK GLEWVA | IIWYD----ENNKYYADS VKG | RFTISRDNSKNTLYLQMSSL RAEDTAVYYCAR | DVLD------PFDY | WGQGT LVTVS S |
| iPS:4 34229 | 21-225_61H1 | VH3/3-33/D1/1-1/RF2/JH4 | QVQLVES-GGGVVQPGRSLRL SCAASG-FTFN | G-----YGMH | WVRQAPGK GLEWVA | IIWYD----ESNKYYADS VKG | RFTISRDNSKNTLYLQMSSL RAEDTAVYYCAR | DVLD------PFDY | WGQGT LVTVS S |
| | VH1/1-02/D5/5-18/RF3/JH6 | Germline | | | | | | | |
| iPS:4 34209 | 21-225_60C3 | VH1/1-02/D5/5-18/RF3/JH6 | QVQLVQS-GAEVKKPGASVKV SCKASG-YSFT | G-----HYIH | WVRQAPGQ GLEYMG | WINPN----SGGTNYVQK FQG | RVTMTRDTSISTAYMELSRL RSDDTAIYYCSR | GGLLGATN------YYYYGMDV | WGQGT TVTVS S |
| iPS:4 34315 | 21-225_59G7 | VH1/1-02/D5/5-18/RF3/JH6 | QVQLVQS-GAEVKKPGASVKV SCKASG-YSFT | G-----HYIH | WVRQAPGQ GLEYMG | WINPN----SGGTNYVQK FQG | RVTMTRDTSISTAYMELSRL RSDDTAIYYCSR | GGLLGATN------YYYYGMDV | WGQGT TVTVI S |
| iPS:4 34319 | 21-225_59B9 | VH1/1-02/D5/5-18/RF3/JH6 | QVQLVQS-GPEVKKPGASVKV SCKASG-YIFT | G-----NYIH | WVRQAPGQ GLEYMG | WINPN----SGGTNYVQK FQG | RVTMTRDTSISTANMELISL RSDDTAVYYCSR | GGLLGATY------YYYYGMDV | WGQGT TVTVS S |

Figure 51 (Continued)

| | | FR1 | CDR1 | FR2 | CDR2 | FR3 | CDR3 | FR4 |
|---|---|---|---|---|---|---|---|---|
| iPS:4 43003 | 21-225_43F11_LC2 | VH1|1-02|D5|5-18|RF3|JH6 | QVQLVQS-GAEVKKPGASVKV SCKASG-YTFT | G-----YYIH | WVRQAPGQ GLEWMG | WINPN---SGGTNYAQK FQG | GVTMTRLTSINTAYMDLSRL RSDDTAVYYCAR | GGNYFY------NHVMDV | WGQGT PVTVS S |
| iPS:4 43005 | 21-225_43F11_LC1 | VH1|1-02|D5|5-18|RF3|JH6 | QVQLVQS-GAEVKKPGASVKV SCKASG-YTFT | G-----YYIH | WVRQAPGQ GLEWMG | WINPN---SGGTNYAQK FQG | GVTMTRLTSINTAYMDLSRL RSDDTAVYYCAR | GGNYFY------NHVMDV | WGQGT PVTVS S |
| | Germline | | H_FR1 | H_CDR1 | H_FR2 | H_CDR2 | H_FR3 | H_CDR3 | H_FR4 |
| | VH4|4-30.4|D5|5-12|RF3|JH4 | | | | | | | | |
| iPS:4 34217 | 21-225_60E8 | VH4|4-30.4|D5|5-12|RF3|JH4 | QVQLQES-GPGLVRPSATLSL TCTVSG-GSIS | RS----SYYWG | WIRQPPGK GLEWIG | SIYY-----SGSASYNPS LKS | RVTISVDTSEMQFSLRLSSV TAADTAVYYCAR | LDSGW-------SFDY | WGQGT LVTVS S |
| | Germline | | H_FR1 | H_CDR1 | H_FR2 | H_CDR2 | H_FR3 | H_CDR3 | H_FR4 |
| | VH3|3-23|D3|3-22|RF3|JH4 | | | | | | | | |
| iPS:4 34219 | 21-225_60E9 | VH3|3-23|D3|3-22|RF3|JH4 | EVQLLES-GGGLVQPGGSLRL SCAASG-FTFS | S-----YAMS | WVRQAPGK GLEWVS | AISGS---GGNTFYADS VKG | RFTISRDNSKNTLFLQMNSL RAEDTAVYYCAK | FFGIVG------AGYFDY | WGQGT LVTVS S |
| iPS:4 34289 | 21-225_57H12 | VH3|3-23|D3|3-22|RF3|JH4 | EVQLLES-GGGLVQPGGSLRL SCAASG-LTFS | S-----YAMS | WVRQDPGK GLEWVS | AISGS---GGNTFYGDS VKG | RFTISRDNSKTLYLQMNSL RAEDTAVYYCAK | FFGIVG------AGYFDY | WGQGT LVTVS S |
| iPS:4 34297 | 21-225_58A10 | VH3|3-23|D3|3-22|RF3|JH4 | EVQLLES-GGGLVQPGGSLRL SCAASG-FTFR | S-----YAMS | WVRQAPGK GLEWVS | AISGS---GGNTFYADS VKG | RFTISRDNSKNTLFLQMNSL RAEDTAVYYCAK | FFGIVG------AGYFDY | WGQGT LVTVS S |
| iPS:3 92996 | 21-225_28B1 | VH3|3-23|D3|3-22|RF3|JH4 | EVQLLES-GGGLVQPGGSLRL SCAASG-FTFS | S-----YAMS | WVRQAPGK GLEWVS | AISGS---GGNTFYADS VKG | RFTISRDNSKNTLYLQMNSL RAEDTAVYYCAK | LGRIAVT-----GPYFDY | WGQGT LVTVS S |
| | Germline | | H_FR1 | H_CDR1 | H_FR2 | H_CDR2 | H_FR3 | H_CDR3 | H_FR4 |
| | VH4|4-59|D4|4-11|RF3|JH4 | | | | | | | | |
| iPS:4 34225 | 21-225_60E12 | VH4|4-59|D4|4-11|RF3|JH4 | QVQLQES-GPGLVKPSEILSL TCTVSG-GSIS | S-----YFWS | WIRQPAGK GLEWIG | RIYI-----RGSTNYNPS LKS | RVTMSVDTSKNQFSLKLSSV TAADTAVYYCAR | EGKTGG------VSYFDY | WGQGT LVTVS S |
| iPS:4 34227 | 21-225_61A1 | VH4|4-59|D4|4-11|RF3|JH4 | QVQLQES-GPGLVKPSEILSL TCTVSG-GSIS | S-----HFWS | WIRQPAGK GLEWIG | RIYI-----RGSTNYNPS LKS | RVTMSVDTSKNQFSLKLSSV TAADTAVYYCAR | EGKTGG------VSYFDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34267 | 21-225_57F2 | VH4/4-59/D4/4-11|RF3/JH4 | QVQLQES-GPGLVKPSETLSL TCTVSG-GSIS | S-----YYWS | WIRQPAGK GLEWIG | RIYT----RGSTNYNPS LKS | RVTMSIDTSKNQFSLKLSSV TAADTAVYYCAR | EGNTGG-------VSYFDY | WGQGT LVTVS S |
| | Germline | VH3|3-23|D5|5-18|RF3/JH3 | EVQLLES-GGGLVQPGGSLRL SCAASG-FTFS | ---YAMS | WVRQAPGK GLEWVS | AISIG----GSTYYDS VKG | RFTISRDNSKNTLYLQMNSL RAEDTAVYYCAR | RGSTYYA-------DAFDI | WGQGT MVTVS S |
| iPS:4 34239 | 21-225_58F1 | VH3|3-23|D5|5-18|RF3/JH3 | EVQLLES-GGGLVQPGGSLRL SCAASG-FTFS | S-----YAMS | WVRQAPGK GLEWVS | AISIG----GGNTYYADS VKG | RFTISRDNSKNTLYLQMNSL RAEDTAVYYCAR | RGVYGD-------FDAFDI | WGQGT MVTVS S |
| iPS:4 34309 | 21-225_59B5 | VH3|3-23|D5|5-18|RF3/JH3 | EVQLLES-GGGLVQPGGSLRL SCAASG-FTFS | S-----YAMN | WVRQAPGK GLEWVS | AISGS----GGNTFYADS VKG | RFTISRDNSKNTLYLQMNSL RAEDTAVYYCAR | RGVYGD-------YEAFDI | WGQGT MVTVS S |
| | Germline | VH3|3-33/D5|5-18|RF1/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | VDTAM-------VYFDY | WGQGT LVTVS S |
| iPS:4 34245 | 21-225_62H1 | VH3|3-33/D5|5-18|RF1/JH4 | QVQLVES-GGGVVQPGRSLRL SCAASG-FTFS | S-----YGMH | WVRQAPGK GLEWMA | IIWYD----GSNKYYADS VKG | RFTISRDNSKNTLYLQINSL RAEDTAVYYCAR | EDPRT-------SCSDY | WGQGT LVTVS S |
| iPS:4 34323 | 21-225_62H8 | VH3|3-33/D5|5-18|RF1/JH4 | QVQLVES-GGGVVQPGRSLRL SCAASG-FTFS | T-----YGMH | WVRQAPGK GLKWVA | VIWHD----GSDKYYVDS VKG | RFTISRDNSKNTLYLQMNSL RAEDTAVYYCAR | EDPRT-------SCSDY | WGQGT LVTVS S |
| iPS:4 34379 | 21-225_66A9 | VH3|3-33/D5|5-18|RF1/JH4 | QVQLVES-GGGVVQPGRSLRL SCAASG-FTFS | S-----YGMH | WVRQAPGK GLEWVA | VIWHD----GSDKYYADS VKG | RFTISRDNSKNTLYLQMNSL RAEDTAVYYCAR | EDPRT-------SCSDY | WGQGT LVTVS S |
| | Germline | VH3|3-33/D1|1-1|RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | VYFDY | WGQGT LVTVS S |
| iPS:4 34247 | 21-225_62D2 | VH3|3-33/D1|1-1|RF3/JH4 | QYYLVES-GGGVVQPGRSLRL SCAASG-FTFS | S-----YGMH | WVRQAPGK GLEWVA | VIWYD----GSNKYSADS VKG | RFTISRDNSKNTLDLQMNSL RAEDTAVYYCAR | DNGNW-------NYLDY | WGQGT LVTVS S |
| iPS:4 36838 | 21-225_52H4 | VH3|3-33/D1|1-1|RF3/JH4 | QVQLVES-GGGVVQPGRSLRL SCAASG-FTFS | H-----FGMH | WVRQAPGK GLKWVA | VIWYD----GSNKYSADS VKG | RFTISRDNSKNTLYLQMNSL RAEDTAVYYCAR | GDWNY-------EGFDY | WGQGT LVTVS S |
| iPS:4 36948 | 21-225_183F5 | VH3|3-33/D1|1-1|RF3/JH4 | QVQLVES-GGGVVQPGRSLRL SCAASG-FTFS | S-----YGML | WVRQAPGK GLEWVT | VIWYD----GSGKYYADS VKG | RFTISRDNSKNTLYLQMNSL RAEDTAVYYCAR | ENFW-------SGDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-39/D5/5-12/RF3/JH4 | | QLQLQES GPGLVKPSETLSL TCIVSG-GSIS | RS---SYYWG | WIRQPPGK GLEWIG | SIYY SGSTYNPS LKS | RVTISVDTSKNQFSLKLSSV TAADTAVYYCAR | GYSGW------YYFDY | WGQGT LVTVS S |
| iPS:4 34249 | 21-225_62E2 | VH4/4-39/D5/5-12/RF3/JH4 | QLQLQES- GPGLVKPSETLSL TCIVSG-GSIS | RS---SYYWG | WIRQPPGK GLEWIG | SIYY SGIASYNPS LKS | RVTISVDTSKNQFSLKLNSV TATDTAVYYCAR | LSSGW------SFDY | WGQGT LVTVS S |
| iPS:4 34353 | 21-225_64B12 | VH4/4-39/D5/5-12/RF3/JH4 | QLQLQES- GPGLVKPSETLSL TCTVSG-VSIS | RS---SYYWG | WIRQPPGK GLEWIG | SIYY---- SGSTSYNPS LKS | RVTISVDISKNQFSLKLSSV TAADTAVYYCAR | LDSGW------SFDY | WGQGT LVTVS S |
| iPS:3 94073 | 21-225_15C9 | VH4/4-39/D5/5-12/RF3/JH4 | QLQLQES- GPGLVKPSETLSL TCTVSG-GSIS | RS---SYYWG | WIRQPPGK GLEWIG | NIYY---- SGSTYNNPS LKS | RVTISVDTSKNQFSLKLSSV TAADTAVYYCAR | QGSGW------EVDY | WGQGT LVTVS S |
| VH1/1-02/D7/7-27/RF1/JH4 | Germline | QVQLVQS GAEVKKPGASVKV SCKASG-YIFT | G------YYMH | WVRQAPGQ GLEWMG | WINPN---- SGGTNAQK FQG | RVTMTRDTSISTAYMELSRL RSDDTAVYYCAR | GTCY------FDY | WGQGT LVTVS S |
| iPS:4 34259 | 21-225_62G7 | VH1/1-02/D7/7-27/RF1/JH4 | QVQLVQS- GAEVKKPGASVKV SCKASG-YIFT | G------YYMH | WVRQAPGQ GLEWMG | WIKPK---- SGGTNQAQK FQG | RVTMTRDTSISTAYMELSSL RSDDTAVYYCAR | APGIAAAG------TWGYFDY | WGQGT LVTVS S |
| iPS:4 34347 | 21-225_64H10 | VH1/1-02/D7/7-27/RF1/JH4 | QVQLVQS- GAEVKKPGASVKV SCKASG-YIFT | G------YYMH | WVRQAPGQ GLEWMG | WIKPN---- SGGTNQAQK FQG | RVTMTRDTSISTAYMELSGL RSDDTAVYYCAR | APGTAATG------TWGYFDY | WGQGT LVTVS S |
| iPS:4 34359 | 21-225_65G3 | VH1/1-02/D7/7-27/RF1/JH4 | QVQLVQS- GAEVKKPGASVKV SCKASG-YIFT | G------YYIH | WVRQAPGQ GLEWMG | WINPN---- SGGTNSAQK FQG | RVTMTRDTSISTAYMELSKL RSDDTAVYYCAR | APGKAAAG------TWGYFDY | WGQGT LVTVS S |
| iPS:4 34369 | 21-225_66B1 | VH1/1-02/D7/7-27/RF1/JH4 | QVQLVQS- GAEVKKPGASVKV SCKASG-YIFT | G------YYMH | WVRQAPGQ GLEWMG | WIKPN---- SGGTNNAQK FQG | RVTMTRDTSISTAYMELSRL RSDDTAVYYCAR | APGTAAAG------TWGYFDY | WGQGT LVTVS S |
| iPS:4 34373 | 21-225_66A7 | VH1/1-02/D7/7-27/RF1/JH4 | QVQLVQS- GAEVKKPGASVKV SCKASG-YIFT | G------YYMH | WVRQAPGQ GLEWMG | WIKPN---- SGGTNQAQK FQG | RVTMTRDTSISTAYMELSRL RSDDTAVYYCAR | APGTVAAG------TWGYFDY | WGQGT LVTVS S |
| iPS:4 34397 | 21-225_67H4 | VH1/1-02/D7/7-27/RF1/JH4 | QVQLVQS- GAEVKKPGASVKV SCKASG-YIFT | G------YYMH | WVRQAPGQ GLEWMG | WIKPN---- SGGTNQAQK FQG | RVTMTRDTSISTAYMELSGL RSDDTAVYYCAR | APGTAATG------TWGYFDY | WGQGT LVTVS S |
| iPS:4 34427 | 21-225_70D6 | VH1/1-02/D7/7-27/RF1/JH4 | QVQLVQS- GAEVKKPGASVKV SCKASG-YIFT | G------YYMH | WVRQAPGQ GLEWMG | WINPK---- SGGTNSAQK FQG | RVSMTRDISIGTAYMELRGL RSDDTAEYYCAR | APGKAAAG------TWGFFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34435 | 21-225_70G9 | VH1\|1-02/D7\|7-27\|RF1/J H4 | QVQLVQS-GAEVKKPGASVKV SCKASG-YTFT | G------YYMH | WVRQAPGQ GLEWMG | WIKPN---SGGTNQAQK FQG | RVTMTRDTSISTAYMELSSL RSDDTAVYYCAR | APGIAAAG------------TWGYFDY | WGQGT LVTVS S |
| iPS:4 34437 | 21-225_70A12 | VH1\|1-02/D7\|7-27\|RF1/J H4 | QVQLVQS-GAEVKKPGASVKV SCKASG-YTFT | G------YYMH | WVRQAPGQ GLEWMG | WIKPN---SGGTNQAQK FQG | RVTMTRDTSISTAYMELSGL RSDDTAVYYCAR | APGTAATG------------TWGYFDY | WGQGT LVTVS S |
| iPS:4 34451 | 21-225_71B7 | VH1\|1-02/D7\|7-27\|RF1/J H4 | QVQLVQS-GAEVKKPGASVKV SCKASG-YTFT | G------YYMH | WVRQAPGQ GLEWMG | WINPN---SGGTNSAQK FQG | RVTMTRDTSIGTAYMELSGL RSDDTAVYYCAR | APGKAAAG------------TWGFFDY | WGQGT LVTVS S |
| iPS:4 34459 | 21-225_71A7 | VH1\|1-02/D7\|7-27\|RF1/J H4 | QVQLVQS-GAEVKKPGASVKV SCKASG-YTFT | G------YYMH | WVRQAPGQ GLEWMG | WINPK---SGGTNVVQK FQG | RVTMTRDTSISTAYMELSSL RSDDTAVYYCAR | APGTAPAG------------SWGYFDY | WGQGT LVTVS S |
| iPS:4 34461 | 21-225_73A3 | VH1\|1-02/D7\|7-27\|RF1/J H4 | QVQLVQS-GAEVKKPGASVKV SCKASG-YTFT | G------YYMH | WVRQAPGQ GLDWMG | WINPK---SGGTNAVQK FQG | RVAMTRDTSISTAYMELSSL RSDDTAVYYCAR | APGTAAAG------------SWGCFDY | WGQGT LVTVS S |
| | Germline | VH3\|3-23D4\|4-11\|RF3/JH4 | EVQLLES-GGGLVQPGGSLRL SCAASG-FTFS | S------YAMS | WVRQAPGK GLEWVS | AISGS---GGSTYYADS VKG | FTISRDNSKNTLYLQMNSL RAEDTAVYYCAK | YYT | WGQGT LVTVS S |
| iPS:4 34261 | 21-225_56F7 | VH3\|3-23D4\|4-11\|RF3/J H4 | EVQLLES-GGGLVQPGGSLRL SCAASG-FTFS | S------YVLN | WVRQAPGK GLEWVS | AMSGS---GGRTYYADS VKG | RFTISRDNSKNTLYLQMNSL RAEDTAVYFCAM | TTH------------FDY | WGQGT LVTVS S |
| iPS:4 35461 | 21-225_153A1 | VH3\|3-23D4\|4-11\|RF3/J H4 | EVQLLES-GGGLVQPGGSLRL SCAASG-FSFS | S------YVMS | WVRQGPGK GLEWVS | AISGS---GDRTYYADS VKG | RFTISRDNSKNTLYLQMNSL RAEDTAVYYCAR | TAT------------KDY | WGQGT LVTVS S |
| iPS:4 35509 | 21-225_157H1 | VH3\|3-23D4\|4-11\|RF3/J H4 | EVQLLES-GGGLVQPGGSLRL SCAASG-FTFS | S------YAMR | WIRQAPGK GLQWVS | DISGS---GGTTYYADS VKG | RFTISRDDSNTTLYLQMNSL RAEDTAVYYCAR | TY------------L | WGQGT LVTVS S |
| iPS:4 35747 | 21-225_175C4 | VH3\|3-23D4\|4-11\|RF3/J H4 | EVQLLES-GGGLVQPGGSLRL SCAASA-FTFS | S------YVMS | WVRQAPGK GLEWVS | AISGS---GDRTYYADS VKG | RFTISRDNSKNTLYLQMNSL RAEDTAVYYCAR | TAG------------FDY | WGQGT LVTVS S |
| iPS:3 92784 | 21-225_23C7 | VH3\|3-23D4\|4-11\|RF3/J H4 | EVQLLES-GGGLVQPGGSLRL SCAASG-FTFS | S------YVMS | WVRQAPGK GLEWVS | AMSGS---GGSTYYVDS VKG | RFTISRDNSKNTLYLQMNSL RAEDTAVYYCAR | TGV------------FDY | WGQGT LVIVS S |
| iPS:3 92802 | 21-225_23E7 | VH3\|3-23D4\|4-11\|RF3/J H4 | EVQLLES-GGGLVQPGGSLRL SCTASG-FTFS | S------YAMN | WVRQAPGK GLEWVS | AISGS---GGFTYYADS VKG | RFTISRDNSKNTLYLQMNSL RAEDTAVYYCAR | TSG------------FDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92962 | 21-225_30A1 | VH3｜3-23｜D4｜4-11｜RF3｜JH4 | EVQLLES-GGGLVQPGGSLRL SCAASG-FTFS | S------YVMN | WVRQAPGK GLEWVS | AISGS---GGSTYYADS VKG | RFTISRNNSKNTLYLQMNSL RAEDTAVYYCAR | TGV----------FDY | WGQGT LVTVS S |
| iPS:3 93090 | 21-225_33A5 | VH3｜3-23｜D4｜4-11｜RF3｜JH4 | EVQLLES-GGGLVQPGGSLRL SCAASG-FTFS | S------YVIN | WVRQAPGK GLEWVS | AISGS---GVSTYYADS VKG | RFTISRDNSKNTLYLQMNSL RAEDTAVYYCAR | TSL----------FDY | WGQGT LVTVS S |
| | Germline | VH3｜3-23｜D11｜1｜RF3｜JH4 | EVQLLES-GGGLVQPGGSLRL SCAASG-FTFS | S------YAMS | WVRQAPGK GLEWVS | AISGS---GGSTYYADS VKG | RFTISRDNSKNTLYLQMNSL RAEDTAVYYCAK | RWND----------FDY | WGQGT LVTVS S |
| | | H_FR1 | H_CDR1 | H_FR2 | H_CDR2 | H_FR3 | H_CDR3 | H_FR4 |
| iPS:4 34273 | 21-225_57E4 | VH3｜3-23｜D1｜1-1｜RF3｜JH4 | EVQLLES-GGGLVQPGGSLRL SCAASG-FTFS | S------YAMS | WVRQAPGK GLEWVS | VISGS---GGSTFYADS VKG | RFTISRDNSKTTLYLQMNSL RAEDTAVYYCAK | RDWND----------VFDY | WGQGT LVTVS S |
| | Germline | VH3｜3-23｜D3｜3-3｜RF3｜JH4 | EVQLLES-GGGLVQPGGSLRL SCAASG-FTFS | S------YAMS | WVRQAPGK GLEWVS | AISGS---GGSTYYADS VKG | RFTISRDNSKNTLYLQMNSL RAEDTAVYYCAK | LLDYPT----------VFDY | WGQGT LVTVS S |
| iPS:4 34279 | 21-225_57F7 | VH3｜3-23｜D3｜3-3｜RF3｜JH4 | EVQLLES-GGGLVQPGGSLRL SCAASG-FTFS | S------YAMS | WVRQAPGK GLEWVS | VISGS---GGNTFYADS VKG | RFTISRDNSKNTLYLQMNSL RAEDTAVYYCAK | FFGVVG----------VGCFDY | WGQGT LVTVS S |
| iPS:4 37228 | 21-225_60C11 | VH3｜3-23｜D3｜3-3｜RF3｜JH4 | EVQLLES-GGGLVQPGGSLRL SCAASG-PPFS | S------YAMS | WVRQAPGK GLEWVS | AISGS---GGNTFYADS VKG | RFTISRDNSKNTLYLQMNSL RAEDTAVYYCAK | FFGVVG----------VGCFDY | WGQGT LVTVS S |
| | Germline | VH3｜3-23｜D3｜3-22｜RF3｜JH1 | EVQLLES-GGGLVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAK | TTHIYYT----------TAEYFQH | WGQGT LVTVS S |
| iPS:4 34291 | 21-225_58A4 | VH3｜3-23｜D3｜3-22｜RF3｜JH1 | EVQLLES-GGGLVQPGGSLRL SCAASG-LTFS | S------YAMS | WVRQDPGK GLEWVS | AISGS---GGNTFYGDS VKG | RFTISRDNSKKTLYLQMNSL RAEDTAVYYCAK | FFGIVG----------AGFFDS | WGQGT LVTVS S |
| | Germline | VH3｜3-33｜D2｜2-15｜RF3｜JH4 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | DIYYYA----------ATYFDY | WGQGT LVTVS S |
| iPS:4 34299 | 21-225_58D11 | VH3｜3-33｜D2｜2-15｜RF3｜JH4 | QVQLVES-GGGVVQPGRSLRL SCAASG-FTFS | D------YDIH | WVRQSPGK GLEWVA | VIWYD---GSKKYYADS VKG | RFTISRDNSKNTLYLQMNSL RAEDTALYYCAR | DRVT----------FDY | WGQGT LVTVS S |
| iPS:4 34871 | 21-225_85H1 | VH3｜3-33｜D2｜2-15｜RF3｜JH4 | QVQLVES-GGGVVQPGRSLRL SCAASG-FTFS | S------YGIH | WVRQAPGK GLEWVA | VIWYD---GSNKYYADS VKG | RFTISRDNSKNTLYLQMNSL RAEDTAVYYCAR | DPFIVG----------ATYFDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35109 | 21-225_92H5 | VH3-33/D2/2-15/RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | DPFIVG--------ATYFDY | WGQGT LVTVS S |
| iPS:4 36434 | 21-225_216B10 | VH3-33/D2/2-15/RF3/JH4 | QVQLVES-GGGVVQPGRSLRL SCAASG-FTFS | S-----YGMH | WVRQAPGK GLEWVA | AIWYD----GSNKYYADS VKG | RFTISRDNSKTLYLQMNSL RAEDTAVYYCAR | DPNIVG--------ATWFDY | WGQGT LVTVS S |
| VH1-02/D4/4-17/RF2/JH4 | Germline | | | H_CDR1 | H_FR2 | H_CDR2 | H_FR3 | H_CDR3 | H_FR4 |
| iPS:4 34307 | 21-225_59B2 | VH1-02/D4/4-17/RF2/J H4 | QVQLVQS-GAEVKKPGASVKV SCKASG-YTFA | G-----YYIH | WVRQAPGQ GLEWLG | WINFN----SGGTNYAQK FQG | RVTMTRDTSISTAYMELSRL REDDTAVYYCAR | DPGP----------FDY | WGQGT LVTVS S |
| VH3-33/D3/3-22/RF3/JH6 | Germline | | | H_CDR1 | H_FR2 | H_CDR2 | H_FR3 | H_CDR3 | H_FR4 |
| iPS:4 34311 | 21-225_59H5 | VH3-33/D3/3-22/RF3/J H6 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | ERGIAVG-------YYGMDV | WGQGT TVTVS S |
| VH4-39/D1/1-26/RF3/JH4 | Germline | | | H_CDR1 | H_FR2 | H_CDR2 | H_FR3 | H_CDR3 | H_FR4 |
| iPS:4 34313 | 21-225_59E6 | VH4-39/D1/1-26/RF3/J H4 | QLQLQES-GPGLVKPSETLSL TCTVSG-GSIS | RS----SYYWG | WIRQPPGK GLEWIG | NIYY------SGSTYYNPS LKS | RVIISVDTSKNQFSLKLSSV TAADTALYYCAR | HSSSW---------SLDY | WGQGT LVTVS S |
| iPS:4 34413 | 21-225_68D12 | VH4-39/D1/1-26/RF3/J H4 | QLQLQES-GPGLVKPSETLSL TCTVSG-GSIS | RS----SYYWG | WIRQPPGK GLEWIG | NIYY------SGSTYYIPS LKS | RVIISVDTSKNQFSLKLSSV TAADTAVYYCAR | HSTSW---------SIDY | WGQGT LVTVS S |
| iPS:3 92628 | 21-225_20C2 | VH4-39/D1/1-26/RF3/J H4 | QLQLQES-GPGLVKPSETLSL TCTVSG-GSIS | RS----SYYWG | WIRQPPGK GLEWIG | NIYY------SGTAYCNSS LKS | RVIISVDTSKNQFSLKLSSV TAIDTAVYYCAR | HSSSW---------SLDN | WGQGT LVTVS S |
| iPS:3 92642 | 21-225_18C6 | VH4-39/D1/1-26/RF3/J H4 | QLQLQES-GPGLVKPSETLSL TCTVSG-GSIS | RS----SYYWG | WIRQPPGK GLEWIG | NIYY------SGTYYNPS LKS | RVIISVDTSKNQFSLKLSSV TAADTALYYCAR | HSSSW---------SLDD | WGQGT LVTVS S |
| iPS:3 92706 | 21-225_18A3 | VH4-39/D1/1-26/RF3/J H4 | QLQLQES-GPGLVKPSETLSL TCTVSG-GSIS | RS----SYYWG | WIRQPPGK GLEWIG | NIYY------SGYTYYTPS LKS | RVIISVDTSKNQFSLKLSSV TAADTAVYYCAR | HSTSW---------SLDY | WGQGT LVTVS S |

Figure 51 (Continued)

| | | | | | | | | | |
|---|---|---|---|---|---|---|---|---|---|
| iPS:3 92800 | 21-225_22D12 | VH4/4-39/D1/1-26/RF3/J H4 | QLQLQES-GPGLVKPSETLSL TCTVSG-GSIS | RS----SYYWG | WIRQPPGK GLEWIG | NIYY----SGTTSYNPS LKS | RVTISVDTSKNQFSLKLSSV TAADTAVFYCAR | LSSSW------- | --------SVDY | WGQGT LVTVS S |
| iPS:3 92820 | 21-225_23D1 | VH4/4-39/D1/1-26/RF3/J H4 | QLQLQES-GPGLVKPSETLSL TCTVSG-GSIS | RS----SYYWG | WIRQPPGK GLEWIG | SIYY----SGSAQYNPS LKS | RVTISVDTSKNQFSLTLSSV TAADTALYYCAR | LSSSW------- | --------SFDY | WGQGT LVTVS S |
| iPS:3 92824 | 21-225_24E5 | VH4/4-39/D1/1-26/RF3/J H4 | QLQLQES-GPGLVKPSETLSL TCTVSG-GAIS | RS----SYYWG | WIRQPPGK GLEWIG | SIYY----SGSANYNPS LKS | RVTISVDTSKNQFSLKLSSV TAADTAVYYCAR | LSSSW------- | --------SIDN | WGQGT LVTVS S |
| iPS:3 92834 | 21-225_22C1 | VH4/4-39/D1/1-26/RF3/J H4 | QLQLQES-GPGLVKPSETLSL TCTVSG-GSIN | RS----SYYWG | WIRQPPGK GLEWIG | NIYY----SGSAYYNSS LKS | RVTISVDTSTNQFSLKLSSV TAADTAVYYCAR | HSGSW------- | --------SLDY | WGQGT LVTVS S |
| iPS:3 92870 | 21-225_20G9 | VH4/4-39/D1/1-26/RF3/J H4 | QLQLQES-GPGLVKPSETLSL TCTVSG-GSIS | RS----SYYWG | WIRQPPGK GLEWIG | SIYY----SGSASYNPS LKS | RVTISVDTSRNQFSLKLSSV TAADTAVYYCAR | LSSSW------- | --------SFDY | WGQGT LVTVS S |
| iPS:3 92896 | 21-225_21G7 | VH4/4-39/D1/1-26/RF3/J H4 | QLQLQES-GPGLVKPSETLSL TCTVSG-GSIS | RS----SYYWG | WIRQPPGK GQEWIG | NIYY----SGYSYNPS LKS | RVTISVDTSKNQFSLKLSSV TAADTAVYYCAR | HSTSW------- | --------SLDY | WGQGT LVTVS S |
| iPS:3 92904 | 21-225_22G9 | VH4/4-39/D1/1-26/RF3/J H4 | QLQLQES-GPGLVKPSETLSL TCTVSG-GSIS | GS----NYYWG | WIRQPPGK ELEWIG | NIYY----SGSTYNPS LKS | RVTISVDTSRNQFSLKLRSV TABDTAVYYCAR | HSSSW------- | --------SLDY | WGQGT LVTVS S |
| iPS:3 93094 | 21-225_34C4 | VH4/4-39/D1/1-26/RF3/J H4 | QLQLQES-GPGLVKPSETLSL TCTVSG-GSIS | RS----SYYWG | WIRQSPGK GLEWIG | SIYY----SGSTAYNPS LKS | RVNISVDTSKNQVSLKLSSV IAADTAVYYCAR | LSSSW------- | --------SFDY | WGQGT LVTVS S |
| iPS:3 93806 | 21-225_6A6 | VH4/4-39/D1/1-26/RF3/J H4 | QLQLQES-GPGLVKPSETLSL TCTVSG-GSIS | RS----SYYWG | WIKQPPGK GLEWIG | NIYY----SGIPYYNPS LKS | RVTISVDTSKNQFSLKLNSV TAADTAVYYCAR | HSSSW------- | --------SLDY | WGQGT LVTVS S |
| iPS:3 93814 | 21-225_7F4 | VH4/4-39/D1/1-26/RF3/J H4 | QLQLQES-GPGLVKPSETLSL TCTVSG-GSIS | RS----SYYWG | WIRQPPGK GLEWIG | NIYY----SGATYNPS LKS | RVTISVDTSTNQFSLKLNSV TAADTAVYYCAR | HSGSW------- | --------SLDY | WGQGT LVTVS S |
| iPS:3 93816 | 21-225_6D4 | VH4/4-39/D1/1-26/RF3/J H4 | QLQLQES-GPGLVKPSETLSL TCTVSG-GSIS | RS----SYYWG | WIRQPPGK GLEWIG | SIYY----SGSAYYIPS LKS | RVTISVATSKNQFSLNLTSV TAADTAVYYCAR | HSSSW------- | --------SLDC | WGQGT LVTVS S |
| iPS:3 93880 | 21-225_15A1 | VH4/4-39/D1/1-26/RF3/J H4 | QLHLQES-GPGLVKPSETLSL TCTVSG-GSIS | RS----SYYWG | WIRQPPGK GLEWIG | SIYY----SGSAQYNPS LKS | RVTISVDITRMQFSLTLSSV TAADTAVYYCAR | LSSSW------- | --------SFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 94002 | 21-225_15G7 | VH4/4-39/D1/1-26/RF3/JH4 | QLQLQES-GPGLVKPSETLSL TCTVSG-GSIS | RS----SSYWG | WIRQPPGK GLEWIG | SIYY----SGYTYTPS LKS | RVTISVDTSKNQFSLRLSSV TAADTASYYCAR | LSSSW----------SFDF | WGQGT LVTVS S |
| iPS:3 94053 | 21-225_11F10 | VH4/4-39/D1/1-26/RF3/JH4 | QLHLQES-GPGLVKPSETLSL TCTVSG-ASIS | RS----SYYWG | WIRQPPGK GLEWIG | SIYY----SGSAQYNPS LKS | RVTISVDTSKNQFSLTLSSV TAADTAVYYCAR | LSSSW----------SFDY | WGQGT LVTVS S |
| iPS:3 94057 | 21-225_15H1 | VH4/4-39/D1/1-26/RF3/JH4 | QLQLQES-GPGLVKPSETLSL TCTVSG-GSIS | RS----SYYWG | WIRQPPGK GLEWIG | NIYY----SGYPYNPS LKS | RVTISVDTSKNQFSLKLSSV TAADTAVYYCAR | HSTSW----------SLDY | WGQGT LVTVS S |
| iPS:3 94063 | 21-225_16A1 | VH4/4-39/D1/1-26/RF3/JH4 | QLQLQES-GPGLVKPSETLSL ICTVSG-GSID | RS----SYYWG | WIRQPPGK GLEWIG | SIYY----SGSAYHNPS LKS | RGTISVDTSKNQFSLKLSSV TAADTAAYYCAR | LSSSW----------SFDY | WGQGT LVTVS S |
| iPS:3 94075 | 21-225_8D12 | VH4/4-39/D1/1-26/RF3/JH4 | QLQLQES-GPGLVKFSETLSL TCTVSG-GSIS | RS----SYYWG | WIRQPPGK GLEWIG | NIYY----SGYPYNPS LKS | RVTISIDTSKNQFSLKLSSV TAADTAVYYCAR | HSTSW----------SLDY | WGQGT LVTVS S |
| | Germline | | H_FR1 | H_CDR1 | H_FR2 | H_CDR2 | H_FR3 | H_CDR3 | H_FR4 |
| | VH3/3-48/D7/7-27/RF3/JH4 | | EVQLVES-GGGLVQPGGSLRL SCAASG-FTFS | S-----YSMH | WVRQAPGK GLEWVS | YISSS----SSTIYADS VKG | RFTISRDNAKNSLYLQMNSL RAEDTAVYYCAR | NPDY | WGQGT LVTVS S |
| iPS:4 34317 | 21-225_59E8 | VH3/3-48/D7/7-27/RF3/JH4 | EVQLVES-GGGLVQPGGSLRL SCAASG-FTFS | S-----YSMN | WVRQAPGK GLGWVS | YISSS----SGTIYYADS VKG | RFTISRDNAKNSLYLQMNSL RDEDTAVYYCAR | EWGMAV----------AGPFDY | WGQGT LVTVS S |
| | Germline | | H_FR1 | H_CDR1 | H_FR2 | H_CDR2 | H_FR3 | H_CDR3 | H_FR4 |
| | VH3/3-33/D1/1-26/RF3/JH4 | | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYYCAR | YSSY----------FDY | WGQGT LVTVS S |
| iPS:4 34327 | 21-225_63G6 | VH3/3-33/D1/1-26/RF3/JH4 | QVQLVES-GGGVVQPGRSLRL SCAASG-FTFS | S-----YGMH | WVRQAPGK GLEWVT | VIWYD----GSNKYYADS VKG | RFTISRDNSKNTLYLQMNSL RAEDTAVYYCAR | DSLSGI----------AAAFDY | WGQGT LVTVS S |
| iPS:4 37084 | 21-225_206B5 | VH3/3-33/D1/1-26/RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYNCAR | EGGSY----------HLDY | WGQGT LVTVS S |
| iPS:4 37088 | 21-225_209H10 | VH3/3-33/D1/1-26/RF3/JH4 | QVQLVES-GGGVVQPGRSLRL SCAASG-FTFS | S-----YGMH | WVRQAPGK GLEWVA | VIWYD----GSNKYYADS VKG | RFTISRDNSKNTLYLQMNSL RAEDTAVYNCAR | EGGSY----------HLDY | WGQGT LVTVS S |
| iPS:3 92684 | 21-225_17F4 | VH3/3-33/D1/1-26/RF3/JH4 | QVQLVES-GGGVVQPGRSLRL SCAASG-FTFS | N-----YGMN | WVRQAPGK GLEWVA | VIWYD----GNNKHYADS VKG | RFTISRDNSKNTLYLQMNSL RAEDTAVYYCAS | SGSY----------FFDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1|1-02|D6|6-19|RF2|JH4 | | QVQLVQS- GAEVKKPGASVKV SCKASG-YTFT | G-----YYMH | WVRQAPGQ GLEWMG | WINPN--- SGGTNFAQK FQG | RVTMTRDASINTAYMELRSL ISDDTAVYYCAR | APGVAAAG------SWGYFDY | WGQGT LVTVS S |
| iPS:4 34333 | 21-225_63C9 | | | | | | | |
| | Germline | | | | | | | |
| iPS:4 34335 | 21-225_63C10 | VH3|3-33|D4|4-11|RF2|J H4 | QVQLVES- GGGVVQPGRSLRL SCAASG-FTFS | S-----YGMH | WVRQAPGK GLDWVA | VIWYD--- GSNKYYADS VKG | RFTISRDNSKNTLYLQMNSL RAEDTAVYYCAR | DDPRS------------SAGDY | WGQGT LVTVS S |
| iPS:4 34429 | 21-225_70H6 | VH3|3-33|D4|4-11|RF2|J H4 | QVQLVES- GGGVVQPGRSLRL SCAASG-FTFS | S-----YGMH | WVRQTPGK GLDWVA | VIWHD--- GSNKYYADS VKG | RFTISRDNSKNTLYLQMNSL RAEDTAVYYCAR | DDPRS------------SAGDY | WGQGT LVTVS S |
| iPS:4 34569 | 21-225_77H5 | VH3|3-33|D4|4-11|RF2|J H4 | QVQLVES- GGGVVQPGRSLRL SCAASG-FTFS | N-----YGMH | WVRQAPGK GLEWVA | VIWYD--- GRNKYYADS VKG | RFTISRDNSKNTLYLQMNSL RAEDTALYYCAR | DRSILG------------ATFFDY | WGQGT LVTVS S |
| iPS:4 34629 | 21-225_74C3 | VH3|3-33|D4|4-11|RF2|J H4 | QVQLVES- GGGVVQPGRSLRL SCAASG-FTFS | S-----FGMH | WARQAPGK GLEWVA | AIWYD--- GSNKYCADS VKG | RFTISRDNSKNTLYLQMNSL RAEDSAVYYCAR | DRSILG------------AAFFDY | WGQGT LVTVS S |
| iPS:4 35793 | 21-225_180F8 | VH3|3-33|D4|4-11|RF2|J H4 | QVQLVES- GGGVVQPGRSLRL SCAASG-FTFS | S-----YGMH | WVRQAPGK GLEWVS | VIWYD--- GSDKYYEDS VKG | RFTISRDNSKNTLYLQMNSL RAEDTAVYYCAR | DHPRW------------SYGDY | WGQGT LVTVS S |
| iPS:4 36382 | 21-225_212C10 | VH3|3-33|D4|4-11|RF2|J H4 | QVQLVES- GGGVVQPGRSLRL SCAASG-FTFS | S-----YGMH | WVRQAPGK GLEWVT | AIWYD--- GSHRYYTDS VKG | RFTISRDNSKNTLYLQMNSL RAEDTAVYYCAR | DRSIVG------------ATYFDY | WGQGT LVTVS S |
| iPS:3 92660 | 21-225_19B3 | VH3|3-33|D4|4-11|RF2|J H4 | QVQLVES- GGGVVQPGRSLRL SCAASG-FTFS | S-----YDMH | WVRQAPGK GLEWVA | VIWYD--- GSDKYYADS VKG | RFTISRDNSKNTLFLQMNSL RAEDTAVYYCAR | DRAYS------------SSSDY | WGQGT LVTVS S |
| iPS:3 93904 | 21-225_8H11 | VH3|3-33|D4|4-11|RF2|J H4 | QVQLVES- GGGVVQPGRSLRL SCAASG-FTFS | T-----YNMH | WVRQAPGK GLEWVA | VIWYD--- GSDRYSADS VKG | RFTISRDNSKNTLYLQMNSL RAEDTAVYYCAR | DRAYS------------SSSDF | WGQGT LVTVS S |
| | Germline | H_FR1 | H_CDR1 | H_FR2 | H_CDR2 | H_FR3 | H_CDR3 | H_FR4 |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34341 | 21-225_64F7 | VH4/4-59/D4/4-11/RF2/JH4 | QVQLQES-GPGLVKPSETLSL TCTVSG-GSIS | S------YFWS | WIRQPAGK GLEWIG | RIYT----SGISNYNPS LKS | RVTMSVDTSKNQFSLKLSSV TAADTAVYYCAR | FSSG----------FFDY | WGQGT LVTVS S |
| | VH3/3-33/D7/7-27/RF2/JH1 | Germline | | | | | | | |
| iPS:4 34351 | 21-225_64A12 | VH3/3-33/D7/7-27/RF2/JH1 | QVQLVES-GGGVVQPGRSLRL SCAASG-FTFS | S------YGMH | WVRQAPGK GLEWVA | VIWYD----ESNKYYVDS VKG | RFTISRDNSKNTLYLQMNSL RAEDTAVYYCAR | ELGF----------LSDH | WGQGT LVTVS S |
| iPS:3 92700 | 21-225_16E12 | VH3/3-33/D7/7-27/RF2/JH1 | QVQLVES-GGGLVQPGRSLRL SCAASG-FTFS | M------YGMH | WVRQAPGK GLEWVA | VIWYE----GSNKYYVDS VRG | RFTISRDNSKSTLYLQMNSL RAEDTAVYYCVR | ELGF----------QSDH | WGQGT PVTVS S |
| iPS:3 92710 | 21-225_19A10 | VH3/3-33/D7/7-27/RF2/JH1 | QVQLVES-GGGVVQPGRSLRL SCAASG-FTFS | S------YGMH | WVRQAPGK GLEWVA | VIWYD----ESNKYYADS VKG | RFTISRDNSKNTLYLQMNSL RAEDTAVYYCAR | ELAW----------YEDS | WGQGT LVTVS S |
| iPS:3 94093 | 21-225_9D12 | VH3/3-33/D7/7-27/RF2/JH1 | QVQLVES-GGGVVQPGRSLRL SCAASG-FTFS | D------YGMH | WVRQAPGK GLEWVA | VIWYD----GNNNYYADS VKG | RFTISRDNSKNTLYLQMNSL RAEDTAVYYCAR | ELAW----------YEDF | WGQGT LVTVS S |
| | VH3/3-23/D3/3-22/RF2/JH3 | Germline | | | | | | | |
| iPS:4 34355 | 21-225_64G12 | VH3/3-23/D3/3-22/RF2/JH3 | EVQLLES-GGGLVQPGGSLRL SCAASG-FTFS | S------NAMS | WVRQAPGK GLEWVS | VISGS----GGSTYYADS VKG | RFTISRDNSKNTLYLQMNSL RAEDTALYYCAK | RNYDD---------AFDI | WGQGT MVTVS S |
| | VH3/3-21/D4/4-11/RF3/JH4 | Germline | | | | | | | |
| iPS:4 34367 | 21-225_65H11 | VH3/3-21/D4/4-11/RF3/JH4 | EVQLVES-GGGLVKPGGSLRL SCAASG-FTFS | S------YRMN | WVRQAPGK GLEWVS | SISSS----NSSIYYADS VKG | RFTISRDNAKNSLYLQMNSL RAEDTAVYYCTS | TS------------GS | WGQGT LVTVS S |
| iPS:4 37220 | 21-225_55H6 | VH3/3-21/D4/4-11/RF3/JH4 | EVHLVES-GGGLVKPGGSLRL SCAASG-FTFS | S------YSMN | WVRQAPGK GLEWVS | SISGS----STYIYYADS VKG | RFTISRDNAKNSLYLQMNSL RAEDTAVYYCAR | TGV-----------FDY | WGQGT LVTVS S |
| iPS:4 02237 | 21-225_23D11 | VH3/3-21/D4/4-11/RF3/JH4 | EVQLVES-GGGLVKPGGSLRL SCAASG-FTFS | S------YNIN | WVRQAPGK GLEWVS | SISGN----SGYIYYADS VKG | RFTISRDNAKNSLYLQMNSL RAEDTAVYYCAR | TNL-----------FDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3|3-21|D4|4-11|RF3|JH3 | | EVQLVES- GGGLVKPGGSLRL SCAASG-FTFS | S------YSMN | WVRQAPGK GLEWVS | SISSS--- SSYIYYADS VKG | RFTISRDNAKNSLYLQMNSL RAEDTAVYFCAR | TVTD | WGQGT MTVS S |
| iPS:4 34383 | 21-225_66F9 | VH3|3-21|D4|4-11|RF3|JH3 | EVQLVES- GGGLVKPGGSLRL SCAASG-FTFS | S------YSMN | WVRQAPGK GLEWVS | SISGT--- SSYIYYADS VKG | RFTISRDNAKNSLYLQMNGL RAEDTAVYFCAR | TNA------FDI | WGQGT MVTVS S |
| iPS:4 34449 | 21-225_71H6 | VH3|3-21|D4|4-11|RF3|JH3 | EVQLVES- GGGLVKPGGSLRL SCAASG-FTFS | S------YSMN | WVRQAPGK GLEWVS | SISGT--- SSYIYYADS VKG | RFTISRDNAKNSLYLQMNGL RAEDTAVYFCAK | TNA------FDI | WGQGT MVTVS S |
| | Germline | H_FR1 | H_CDR1 | H_FR2 | H_CDR2 | H_FR3 | H_CDR3 | H_FR4 |
| VH3|3-33|D6|6-6|RF2|JH4 | | QVQLVES- GGGLVKPGGSLRL SCAASG-FTFS | Y-------YGMH | WVRQAPGK GLEWVA | VILYD--- GSKKYYADS VKG | RFTISRDNSKNTLYLQMNSL RAEDTAVYYCAR | SIASK------YFDY | WGQGT LVTVS S |
| iPS:4 34399 | 21-225_67B7 | VH3|3-33|D6|6-6|RF2|JH4 | QVQLVES- GGGLVKPGGSLRL SCAASG-FTFS | N-------YGMH | WVRQAPGK GLEWVA | VILYD--- GSKKYYADS VKG | RFTISRDNSKNTLYLQMNSL RAEDTAVYYCAR | SIPE------FDY | WGQGT LVTVS S |
| iPS:4 34463 | 21-225_73A6 | VH3|3-33|D6|6-6|RF2|JH4 | QVQLVES- GGGLVKPGGSLRL SCAASG-FTFS | Y-------YGMH | WVRQAPGK GLEWVA | VILYD--- GSKKYYAAS VKG | RFTISRDNAKNSLYLQMNSL RAEDTAVYYCAR | SIPD------FDY | WGQGT LVTVS S |
| | Germline | H_FR1 | H_CDR1 | H_FR2 | H_CDR2 | H_FR3 | H_CDR3 | H_FR4 |
| VH3|3-21|D1|1-26|RF3|JH4 | | EVQLVES- GGGLVKPGGSLRL SCAASG-FTFS | S------YSMN | WVRQAPGK GLEWVS | SISSS--- SSYIYYADS VKG | RFTISRDNAKNSLYLQMNSL RAEDTAVYYCAR | SGGY | WGQGT LVTVS S |
| iPS:4 34405 | 21-225_68E6 | VH3|3-21|D1|1-26|RF3|JH4 | EVQLVES- GGGLVKPGGSLRL SCAASG-FTFS | S------FGMN | WVRQAPGK GLEWVS | YISRS--- SSHIYYADS VKG | RFTISRDNAKNSLYLQMNSL RAEDTAVYYCAR | SSGS------PFDY | WGQGT LVTVS S |
| iPS:4 35595 | 21-225_160H4 | VH3|3-21|D1|1-26|RF3|JH4 | EVQLVES- GGGLVKPGGSLRL SCAASG-FTLS | S------YRMN | WVRQAPGK GLEWVS | SISGS--- SSYIDYADS VKG | RFTISRDNAKNSLYLQMNSL RAEDTAVYYCAR | KSW------FDY | WGQGT LVTVS S |
| iPS:4 35635 | 21-225_163F1 | VH3|3-21|D1|1-26|RF3|JH4 | EVQLVDS- GGGLVKPGGSLRL SCAASG-FTFS | S------YSMN | WVRQAPGK GLEWVS | SISGS--- GSYIYYADS VKG | RFTISRDNAKNSLYLQMNSL SADDTAVYYCTL | YSS------SHY | WGQGT LVTVS S |
| | Germline | H_FR1 | H_CDR1 | H_FR2 | H_CDR2 | H_FR3 | H_CDR3 | H_FR4 |
| VH3|3-30.3|D2|2-15|RF3|JH4 | | EVQLVES- GGGLVKPGGSLRL SCAASG-FTFS | S-------YAMH | WVRQAPGK GLEWVA | VISYD--- GSNKYYADS VKG | RFTISRDNSKNTLYLQMNSL RAEDTAVYYCAR | DIVYYA------ALFDY | WGQGT LVTVS S |
| iPS:4 34417 | 21-225_69C8 | VH3|3-30.3|D2|2-15|RF3|JH4 | QVQLVES- GGGLVKPGGSLRL SCAASG-FTFS | N-------YAMH | WVRQAPGK GLEWVA | VIWYD--- GSDKYYADS VKG | RFTISRDNSKNTLYLQMISL RAEDTAVYYCAR | DIPSN------SAGDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-33|D3J3-10|RF1|JH4 | | | | | | | | |
| iPS:4 34433 | 21-225_70E8 | VH3J3-33|D3J3-10|RF1|JH4 | QVQLVES-GGGVVQPGRSLRL SCAASG-FTFS | S-----YGML | WVRQAPGK GLEWVA | IIWYD---ESNKYYADS VKG | RFTISRDNSKNTLYLQMNSL RAEDTAVYYCAR | DLLD--------PRDY | WGQGT LVTVS S |
| VH3J3-23|D6J6-13|RF1|JH4 | Germline | | | | | | | |
| iPS:4 34467 | 21-225_73H8 | VH3J3-23|D6J6-13|RF1|JH4 | EVQLLES-GGGWVQSGGSLRL SCAASG-FTFS | S-----NAMS | WVRQAPGK GLEWVS | DISRS---GGTFYADS VKG | RFTISRDNSKNTLYLQMNSL RAEDTAVYYCAR | WDSSSWI--------DVTPFDY | WGQGT LVTVS S |
| VH4J4-34|D4J4-17|RF2|JH4 | Germline | | | | | | | |
| iPS:4 34471 | 21-225_75G3 | VH4J4-34|D4J4-17|RF2|JH4 | QVQLQQW-GAGLLKPSETLSL TCAVYG-GSLS | G-----SYWS | WIRQPPGK GLEWIG | EINL----SGSTNYNPS LKS | RVTISVDTSKSQFSLTLRSV TAADTAVYYCAR | DYGG-----------LDY | WGQGT LVTVS S |
| iPS:4 34517 | 21-225_76A7 | VH4J4-34|D4J4-17|RF2|JH4 | QVQLQQW-GAGLLKPSETLSL TCAVYG-GSFS | G-----CYWS | WIRQPPGK GLEWIG | EINH----SGRTNYNPS LKS | RVTISVDISENQFSLKLSSV TAADTAVYYCAR | DYGG-----------LDY | WGQGA LVTVS S |
| iPS:4 34519 | 21-225_74C7 | VH4J4-34|D4J4-17|RF2|JH4 | QVQLQQW-GAGLLKPSETLSL TCAVYG-GSLS | G-----SYWS | WIRQPPGK GLEWIG | EINL----SGSTNYNPS LKS | RVTISVDTSKSQFSLTLRSV TAADTAVYYCAR | DYGG-----------LDY | WGQGT LVTVS S |
| iPS:4 34571 | 21-225_74D2 | VH4J4-34|D4J4-17|RF2|JH4 | QVQLQQW-GAGLLKPSETLSL TCAVYG-GSFS | G-----CYWS | WIRQPPGK GLEWIG | EINH----SGRTNYNPS LKS | RVTISVDTSENQFSLKLSSV TAADTAVYYCAR | DYGG-----------LDY | WGQGT LVTVS S |
| iPS:4 34637 | 21-225_78E7 | VH4J4-34|D4J4-17|RF2|JH4 | QVQLQQW-GAGLLKPSETLSL TCAVYG-GSLS | G-----SYWS | WIRQPPGK GLEWIG | EINL----SGSTNYNPS LKS | RVTISVDTSKSQFSLTLRSV TAADTAVYYCAR | DYGG-----------LDY | WGQGT LVTVS S |
| iPS:4 34717 | 21-225_80A6 | VH4J4-34|D4J4-17|RF2|JH4 | QVQLQQW-GAGLLKPSETLSL TCAVYG-GSFS | G-----CYWS | WIRQPPGK GLEWIG | EINH----SGRTNYNPS LKS | RVTISVDTSEKQFSLKLSSV TAADTAVYYCAR | DYGG-----------LDY | WGQGT LVTVS S |
| iPS:4 34735 | 21-225_80B10 | VH4J4-34|D4J4-17|RF2|JH4 | QVQLQQW-GAGLLKPSETLSL TCAVYG-GSFS | G-----CYWS | WIRQPPGK GLEWIG | EINH----SGSTNYNPS LKS | RVTISVDISKNQFSLKLSSV TAADTAVYYCAR | DYGG-----------LDY | WGQGT LVTVS S |

Figure 51 (Continued)

| | | | | | | | | |
|---|---|---|---|---|---|---|---|---|
| iPS:4 34835 | 21-225_83B6 | VH4J4-34/D4J4-17/RF2/JH4 | QVQLQQW-GAGLLKPSETLSLTCAVYG-GSFS | G------CYWS | WIRQPPGK GLEWIG | EINH----SGRTNYNPS LKS | RVTISVDTSENQFSLKLSSV TAADTAVYYCAR | DYGG------------LDY | WGQGT LVTVS S |
| iPS:4 34849 | 21-225_83C10 | VH4J4-34/D4J4-17/RF2/JH4 | QVQLQQW-GAGLLKPSETLSLTCAVYG-GSFS | G------YYWS | WIRQPPGK GLEWIG | EINH----SGSTNFNPS LKS | RVTISVDTSKNQFSLKLSSV TAADTAVFYCAR | DYGG------------LDY | WGQGT LVTVS S |
| iPS:4 34891 | 21-225_85G6 | VH4J4-34/D4J4-17/RF2/JH4 | QVQLQQW-GAGLLKPSETLSLTCAVYG-GSFS | D------CYWS | WIRQPPGK GLEWIG | EINH----SGRTNYNPS LKS | RVTISVDTSENKFSLKLSSV TAADTAVYYCAR | DYGG------------LDY | WGQGT LVTVS S |
| iPS:4 35183 | 21-225_93E9 | VH4J4-34/D4J4-17/RF2/JH4 | QVQLQQW-GAGLLKPSETLSLTCAVYG-GSFS | G------CYWS | WIRQPPGK GLEWIG | EINH----SGRTNYNPS LKS | RVTISVDTSKNQFSLKLSSV TAADTAVYYCAR | DYGG------------LDY | WGQGT LVTVS S |
| iPS:4 35331 | 21-225_147G8 | VH4J4-34/D4J4-17/RF2/JH4 | QVQLQQW-GAGLLKPSETLSLTCAVFG-GSFS | A------YYWS | WIRQPPGK GLEWIG | EINH----SGSTNYKPS LKS | RVTISVDTSKNQFSLKLSSV TAADTAVYYCAR | DYGV------------FDY | WGQGT LVTVS S |
| iPS:4 35995 | 21-225_192F8 | VH4J4-34/D4J4-17/RF2/JH4 | QVQLQQW-GAGLLKPSETLSLTCAVYG-GSFS | G------CYWS | WIRQPPGK GLEWIG | EINQ----SGRSNYNPS LKS | RVTISVDTSTNQFSLKLRSV TAADTAVYYCAR | DYGV------------FDY | WGQGT LVTVS S |
| iPS:4 36027 | 21-225_193E6 | VH4J4-34/D4J4-17/RF2/JH4 | QVQLQQW-GAGLLKPSETLSLTCAVYG-GSFS | G------PYWS | WIRQPPGK GLEWIG | ESNH----SGRTNYNPS LKS | RVTISVDTSKNQFSLRLSSV TAADTAVYYCAR | DYGG------------LDY | WGQGT LVTVS S |
| iPS:4 36080 | 21-225_195B1 | VH4J4-34/D4J4-17/RF2/JH4 | QVQLQQW-GAGLLKPSETLSLTCAVSG-GSFR | Y------YFWS | WIRQSPGK GLEWFG | EINH----SGRTNYNPS LKS | RVTISVDTSKNQFSLKLRSV TAADTAVYYCAR | DYGA------------FDI | WGQGT LVTVS S |
| iPS:4 36232 | 21-225_201E1 | VH4J4-34/D4J4-17/RF2/JH4 | QVQLQQW-GAGLLKPSETLSLTCAVYG-GSFS | P------YYWS | WIRQPPGK GLEWIG | EVNH----SGSTNYNPS LKS | RVTISVDTSKNQFSLKLSSV TAADTAVYYCAR | DYGG------------LDY | WGQGA LVTVS S |
| iPS:4 36238 | 21-225_201B2 | VH4J4-34/D4J4-17/RF2/JH4 | QVQLQQW-GAGLLKPSETLSLTCAVFD-GSFS | V------YYWT | WIRQPPGK GLEWIG | EINH----SGSTNYNPS LKS | RVTISVDTSKNQFSLKLSSV TAADTAVYYCAR | DYGV------------FDY | WGQGT LVTVS S |
| iPS:4 36256 | 21-225_202D9 | VH4J4-34/D4J4-17/RF2/JH4 | QVQLQQW-GAGLLKPSETLSLTCAVYG-GSIS | P------YYWS | WIRQPPGK GLEWIG | EINH----SGRTNYNPS LKS | RVTISVDTSKNQFSLKLSSV TAADTAVYYCAR | DYGG------------LDY | WGQGT LVTVS S |
| iPS:4 36302 | 21-225_205G7 | VH4J4-34/D4J4-17/RF2/JH4 | QVQLQQW-GAGLLKPSETLSLTCAVYG-GSFS | V------YYWS | WIRQPPGK GLEWIG | ESNQ----SGRTYNPS LKS | RVTISVDTSKNQFSLNLISV TAADTAVYYCAR | DYGV------------FDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36310 | 21-225_202D11 | VH4/4-34/D4/4-17/RF2/JH4 | QVQLQQR-GAGLLKPSETLSL TCAAYG-GSFS | G------PYWS | WIRQPPGK GLEWIG | EINH------ SGSTNYNPS LKS | RVTISVDTSKNQFSLKLSSV TAADTAVYYCAR | DYGV---------LDY | WGQGT LVTVS S |
| iPS:4 36336 | 21-225_208B5 | VH4/4-34/D4/4-17/RF2/JH4 | QVQLQQW-GAGLLKPSETLSL TCAVFG-GSIS | V------YYWT | WIRQPPGK GLEWIG | EINH------ SGSTNYNPS LKS | RVTISVDTSKNQFSLKLSSV TAADTAVYYCAR | DYGV---------FDY | WGQGT LVTVS S |
| iPS:4 36340 | 21-225_208A9 | VH4/4-34/D4/4-17/RF2/JH4 | QVQLQQW-GAGLLKPSETLSL TCAVYG-GSFS | V------SYWS | WIRQPPGK GLEWIG | EINH------ SGRANYNPS LKS | RVTISIDTSKNQFSLKLSSV TAADTAVYYCAR | DYGV---------LDY | WGQGT LVTVS S |
| iPS:4 37340 | 21-225_75G9 | VH4/4-34/D4/4-17/RF2/JH4 | QVQLQQW-GAGLLKPSETLSL TCAVYG-GSFS | G------CYWS | WIRQPPGK GLEWIG | EINH------ SGRTNYNPS LKS | RVTISVDISENQFSLKLSSV TAADTAVYYCAR | DYGG---------LDY | WGQGT LVTVS S |
| iPS:4 51122 | 21-225_200A1 | VH4/4-34/D4/4-17/RF2/JH4 | QVQLQQW-GAGLLKPSETLSL TCAVYG-GSFS | V------YYWS | WIRQPPGK GLEWIG | EINH------ SGSTNYNPS LKS | RVTISLDTSKNQFSLKLSSV TAADTAVYYCAR | DYGV---------FDY | WGQGT LVTVS S |
| Germline | VH3/3-33/D2/2-15/RF3/JH1 | | | | | | | |
| iPS:4 34485 | 21-225_76D2 | VH3/3-33/D2/2-15/RF3/JH1 | QVQLVES-GGGVVQPGRSLRL SCAASG-FTFS | S------YGMH | WVRQAPGK GLEWVA | VIWYD----- GSNKYYADS VKG | RFTISRDNSKNTLFLQMNSL RAEDTAVYYCAS | DRNIVG---------ATYFES | WGQGT LVTVS S |
| iPS:4 34537 | 21-225_74E11 | VH3/3-33/D2/2-15/RF3/JH1 | QVQLVES-GGGVVQPGRSLRL SCAASG-FTFS | S------YGMH | WVRQAPGK GLEWVA | VIWYD----- GSNKYYADS VKG | RFTISRDNSKNTLFLQMNSL RAEDTAVYYCAS | DRNIVG---------ATYFES | WGQGT LVTVS S |
| iPS:4 34673 | 21-225_74E3 | VH3/3-33/D2/2-15/RF3/JH1 | QVQLVES-GGGVVQPGRSLRL SCTASG-FTFS | S------YGMH | WVRQAPGK GLEWVA | VIWYD----- GSNKYYADS VKG | RFTISRDNSKNTLFLQMNSL RAEDTAVYYCAS | DRNIVG---------ATYFES | WGQGT LVTVS S |
| iPS:4 35221 | 21-225_95G2 | VH3/3-33/D2/2-15/RF3/JH1 | QVQLVES-GGGVVQPGRSLRL SCTASG-FTFS | S------YGMH | WVRQAPGK GLEWVA | VIWYD----- GSNKYYADS VKG | RFTISRDNSKNTLFLQMNSL RAEDTAVYYCAS | DRNIVG---------ATYFES | WGQGT LVTVS S |
| Germline | VH4/4-39/D7/7-27/RF1/JH5 | | | | | | | |
| iPS:4 34503 | 21-225_74D7 | VH4/4-39/D7/7-27/RF1/JH5 | QLQLQES-GPGLVKPSETLSL TCSVSG-GSIF | RS---SYYWG | WIRQPPGK GLEWIG | GIYY------ SGSTSNPS LKS | RVTISVDISENQFSLKLSSV TAADTAVYYCAR | LRPNW---------DFDY | WGQGT LVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH3-15/D1I1-1/RF2/JH4 | | EVQLVES-GGGLVKPGGSLRL SCAASG-FTFS | N------AWMN | WVRQAPGK GLEWVG | RIKSKT-DGGTTDYAA PVKG | RFTISRDDSKNTLYLQMNSL KTEDTAVYYCTT | VGPT | WGQGT LVTVS S |
| iPS:4 34531 | 21-225_76C9 | VH3-15/D1I1-1/RF2/JH4 | EVQLVES-GGGLVKPGGSLRL SCAASG-FSFS | N------AWMN | WVRQAPGK GLEWVG | RIKNKA-DGGTTDFAA PVKG | RFTISRDDSKHTLYLQMNSL KTEDTAVYYCTT | VGPT------TDY | WGQGT LVTVS S |
| iPS:4 34633 | 21-225_74G8 | VH3-15/D1I1-1/RF2/JH4 | EVQLVES-GGGLVKPGGSLRL SCAASG-FTFS | N------AWMN | WVRQAPGK GLEWVG | RIKNKA-DGGTTDYAA PVKG | RFTISRDDSKNTLYLQMNSL KTEDTAVYYCTT | VGAT------TDY | WGQGT LVTVS S |
| iPS:4 34671 | 21-225_74F4 | VH3-15/D1I1-1/RF2/JH4 | EVQLVES-GGGLVKPGGSLRL SCAASG-FTFS | N------AWMN | WVRQAPGK GLEWVG | RIKNKI-DGGTTDYAA PVKG | RFTISRDDSKNTLYLQMNSL KTEDTAVYYCTT | VGAT------TDY | WGQGT LVTVS S |
| iPS:4 37383 | 21-225_74H8 | VH3-15/D1I1-1/RF2/JH4 | EVHLVES-GGGLVKPGGSLRL SCAASG-FTFS | N------AWMN | WVRQAPGK GLEWVG | RIKSKT-DGGTTDYAA PVKG | RFTISRDDSKNTLYLQMNSL KTEDTAVYYCTT | VGAT------TDY | WGQGT LVTVS S |
| | Germline | | H_FR1 | H_CDR1 | H_FR2 | H_CDR2 | H_FR3 | H_CDR3 | H_FR4 |
| | VH3-33/D5/5-18/RF3/JH4 | | QVQLVES-GGGVVQPGRSLRL SCAASG-FTFS | S------YGMH | WVRQAPGK GLEWVA | VIWYD-GSNKNYADS VKG | RFTISRDNSKNTLFLQMNSL RAEDTAVYYCAR | DGSYGY | WGQGT LVTVS S |
| iPS:4 34535 | 21-225_74C8 | VH3-33/D5/5-18/RF3/JH4 | QVQLVES-GGGVVQPGRSLRL SCAASG-FTFS | S------YGMH | WVRQAPGK GLEWVA | VIWYD-GSNKNYADS VKG | RFTISRDNSKNTLYLQMNSL RAEDTAVYYCAR | DGSYGY------DGLDY | WGQGT LVTVS S |
| iPS:4 34573 | 21-225_77E6 | VH3-33/D5/5-18/RF3/JH4 | QVQLVES-GGGVVQPGRSLRL SCAASG-FTFS | S------YGMH | WVRQAPGK GLEWVA | VIWYD-GSNQNYADS VKG | RFTISRDNSKNTLFLQMNSL RAEDTAVYYCAR | DGSYGY------DGLDY | WGQGT LVTVS S |
| iPS:4 34615 | 21-225_76C5 | VH3-33/D5/5-18/RF3/JH4 | QVQLVES-GGGVVQPGRSLRL SCAASG-FTFS | S------YGMH | WVRQAPGK GLEWVA | VIWYD-GSNKNYADS VKG | RFTISRDNSKNTLYLQMNSL RAEDTAVYYCAR | DGSYGY------DGLDY | WGQGT LVTVS S |
| iPS:4 34669 | 21-225_79F4 | VH3-33/D5/5-18/RF3/JH4 | QVQLVES-GGGVVQPGRSLRL SCAASG-FTFS | N------YGMH | WVRQAPGK GLEWVA | VIWYD-GSNQNYADS VKG | RFTISRDNSKNTLFLQMNSL RAEDTAVYYCAR | DGSYGY------DGLDY | WGQGT LVTVS S |
| iPS:4 34737 | 21-225_74G6 | VH3-33/D5/5-18/RF3/JH4 | QVQLVES-GGGVVQPGRSLRL SCAASG-FTFS | S------YGMH | WVRQAPGK GLEWVA | VIWYD-GSNKNYADS VKG | RFTISRDNSKNTLYLQMNSL RAEDTAVYYCAR | DGSYGY------DGLDY | WGQGT LVTVS S |
| iPS:4 34741 | 21-225_80C11 | VH3-33/D5/5-18/RF3/JH4 | QVQLVES-GGGVVQPGRSLRL SCAASG-FTFS | S------YGMH | WVRQAPGK GLEWVA | VIWYD-GSNKNYADS VKG | RFTISRDNSKNTLSLQMNSL RAEDTAVYYCAR | DGSYGY------DGLDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 34867 | 21-225_79A12 | VH3/3-33/D5/5-18/RF3/JH4 | QVQLVES-GGGVVQPGRSLRLSCAASG-FTFS | S------YGMH | WVRQAPGK GLEWVA | VIWYD---GSNKNYADS VKG | RFTISRDNSKNTLYLQMNSL RAEDTAVYYCAR | DGSYGY------DGLDY | WGQGT LVAVS S |
| | Germline | VH4/4-34D3/3-10/RF2/JH6 | QVQLQQW-GAGLLKPSETLSL TCAVYG-GSFT | | WIRQPPGK GLEWIG | EINH----SGDTNYNPS LKS | | | WGQGT TVTVS S |
| iPS:4 34539 | 21-225_74A2 | VH4/4-34/D3/3-10/RF2/JH6 | QVQLQQW-GAGLLKPSETLSL TCAVYG-GSFT | D------YYWS | WIRQPPGK GLEWIG | EINH----SGDTNYNPS LKS | RVTISVDTSKNQFSLKLSSV TAADTAVYYCAR | EFPYSGSY------LYYYGMDV | WGQGT TVTVS S |
| iPS:4 37248 | 21-225_97H3 | VH4/4-34/D3/3-10/RF2/JH6 | QVQVQQW-GAGLLKPSETLSL TCAVYG-GSFT | D------YYWS | WIRQPPGK GLEWIG | EINH----SGDTNYNPS LKS | RVTISVDTSKNQFSLKLSSV TAADTAVYYCAR | EFPYSGSY------LYYYGMDV | WGQGT TVTVS S |
| iPS:4 37320 | 21-225_75A1 | VH4/4-34/D3/3-10/RF2/JH6 | QVQVQQW-GAGLLKHSETLSL TCAVYG-GSFT | D------YYWS | WIRQPPGK GLEWIG | EINH----SGDTNYNPS LKS | RVTISVDTSKNQFSLKLSSV TAADTAVYYCAR | EFPYSGSY------LYYYGMDV | WGQGT TVTVS S |
| | Germline | VH3/3-13D3/3-9/RF1/JH6 | EVQLVES-GGGLVQPGGSLRL SCAASG-FTFS | | WVRQATGK GLEWVS | AIGT-----AGDTYPGS VKG | | | WGQGT TVTVS S |
| iPS:4 34563 | 21-225_75D8 | VH3/3-13/D3/3-9/RF1/JH6 | EVQLVES-GGGLVQPGGSLRL SCAASG-FTFS | N------YDMH | WVRQATGK GLEWVS | AIGT-----AGDTYPGS VKG | RFTISRENAKNSLYLQMNSL RAGDTAVYYCAR | VLDYGDSLG------YYYYGMDV | WGQGT TVTVS S |
| iPS:4 35009 | 21-225_89G4 | VH3/3-13/D3/3-9/RF1/JH6 | EVQLVES-GGGLVQPGGSLRL SCAASG-FTFS | S------YDMH | WVRQATGK GLEWVS | AIGT-----AGDTYPGS VKG | RFTISRENAKNSLYLQMNSL RAGDTAVYFCAR | ALDYGDSLG------YYYYGMDV | WGQGT TVTVS S |
| iPS:4 35059 | 21-225_90C11 | VH3/3-13/D3/3-9/RF1/JH6 | EVQLVES-GGGLVQPGGSLRL SCAASG-FTFS | N------YDMH | WVRQATGK GLEWVS | AIGT-----AGDTYPGS VKG | RFTISRENAKNSLYLQMNSL RAGDTAVYYCAR | VLDYGDSLG------YYYYGMDV | WGQGT TVTVS S |
| iPS:4 35103 | 21-225_92B2 | VH3/3-13/D3/3-9/RF1/JH6 | EVQLVES-GGGLVQPGGSLRL SCAASG-FTFS | N------YDMH | WVRQATGK GLEWVS | AIGT-----AGDTYPGS VKG | RFTISRENAKNSLYLQMNSL RAGDTAVYFCAR | ALDYGDSLG------YYYYGMDV | WGQGT TVTVS S |
| iPS:4 37371 | 21-225_74D8 | VH3/3-13/D3/3-9/RF1/JH6 | EVQLVES-GGGLVQPGGSLRL SCAASG-FTFS | N------YDMH | WVRQATGK GLEWVS | AIGT-----AGDTYPGS VKG | RFTISRENAKNSLYLQMNSL RAGDTAVYYCAR | VLDYGDSLG------YYYYGMDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 34711 | 21-225_80H3 | VH1|1-08|D1|1-26|RF3|J H4 | QVQLVQS-GAEVKKPGASVKV SCKASG-YTLT | N-----YDIN | WVRQATGQ GLEWMG | WMNPN----SGNTGYAQK FQG | RVTMTRNTSISTAYMELSSL RSEDTAVYYCGS | TSGWN------FFDY | WGQGT LVTVS S |
| iPS:4 34901 | 21-225_85H9 | VH1|1-08|D1|1-26|RF3|J H4 | QVQLVQS-GAEVKKPGASVKV SCKASG-YTLT | N-----YDIN | WVRQATGQ GLEWMG | WMNPN----SGNTGYAQK FQG | RVTMTRNTSISTAYMELSSL RSEDTAVYYRGS | TSGWN------FFDY | WGQGT LVTVS S |
| iPS:4 35167 | 21-225_92F12 | VH1|1-08|D1|1-26|RF3|J H4 | QVQLVQS-GAEVKKPGASVKV SCKASG-YTLT | N-----YDIN | WVRQATGQ GLEWMG | WMNPN----SGNTGYAQK FQG | RVTMTRNTSISTAYMELSSL RSEDTAVYYRGS | TSGGK------FFDY | WGQGT LVTVS S |
| iPS:4 35215 | 21-225_94E12 | VH1|1-08|D1|1-26|RF3|J H4 | QVQLVQS-GAEVKKPGASVKV SCKASG-YTLT | N-----YDIN | WVRQATGQ GLEWMG | WMNFN----SGNTGYAQK FQG | RVTMTRNTSISTAYMELSSL RSEDTAVYYRGS | TSGWK------FFDY | WGQGT LVTVS S |
| iPS:4 37356 | 21-225_74B1 | VH1|1-08|D1|1-26|RF3|J H4 | QVQLVQS-GAEVKKPGASVKV SCKASG-YTLT | N-----YDIN | WVRQATGQ GLEWMG | WMNPN----SGNTGYAQK FQG | RVTMTRNTSISTAYMELSSL RSEDTAVYYCGS | TSGWN------FFDY | WGQGT LVTVS S |
| VH1|1-08|D1|1-1|RF1|JH6 | | Germline | | | | | | | |
| | | | H_FR1 | H_CDR1 | H_FR2 | H_CDR2 | H_FR3 | H_CDR3 | H_FR4 |
| iPS:4 34815 | 21-225_74A11 | VH1|1-08|D1|1-1|RF1|JH 6 | QVQLVQS-GAEVKKPGASVKV SCKASG-YIFT | S-----YDIN | WVRQATGQ GLEWMG | WMNPN----SGNTGYAQK FQG | RVTMTWNTSKSTAYMELSSL RSEDTAVYYCAR | GFYDILTGS-------GYYVMDV | WGQGT TVTVS S |
| iPS:4 35253 | 21-225_96A4 | VH1|1-08|D1|1-1|RF1|JH 6 | QVQLVQS-GAEVKKPGASVKV SCKASG-YIFT | S-----YDIN | WVRQATGH GLEWMG | WMNPN----SRNTGYAQK FQG | RVTMTWNTSKSTAYMELSSL RSEDTAVYYCAR | GFYDILTGS-------GYYVMDV | WGQGT TVTVS S |
| VH1|1-08|D3|3-22|RF2|JH6 | | Germline | | | | | | | |
| | | | H_FR1 | H_CDR1 | H_FR2 | H_CDR2 | H_FR3 | H_CDR3 | H_FR4 |
| iPS:4 34977 | 21-225_88A5 | VH1|1-08|D3|3-22|RF2|J H6 | QVQLVQS-GAEVKKPGASVKV SCKASG-YIFT | S-----YDIN | WVRQATGQ GLEWMG | WMNPN----SGNTGYAQK FQG | RVTMTWNTSIRTAYMELSSL RSEDTAVYYCAR | GFYDFLTGYS------PTYYYDMDV | WGQGT TVTVS S |
| iPS:4 35259 | 21-225_96C6 | VH1|1-08|D3|3-22|RF2|J H6 | QVQLVQS-GAEVKKPGASVKV SCKASG-YIFT | S-----YDIN | WVRQATGQ GLEWMG | WMNPN----SGNTGYAQK FQG | RVTMTWNTSISTAYMELSSL RSEDTAVYYCAR | GGYDVLPGN-------NYYYDMDV | WGQGT TVTVS S |
| VH3|3-33|D2|2-15|RF3|JH3 | | Germline | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35291 | 21-225_146E1 | VH3/3-33/D2/2-15/RF3/JH3 | QVQLVES-GGGVVQPGRSLRLSCEASG-ITFS | S------YGMH | WVRQAPGK GLEWVA | IIWYD-----GSNRYYADSVKG | RFTISRDNSKNTLFLQMNSL RAEDTAVYYCAR | DRLVGAT-------ADAFDI | WGQGT MVTVS S |
| iPS:4 36360 | 21-225_210H11 | VH3/3-33/D2/2-15/RF3/JH3 | QVQLVES-GGGVVQPGRSLRLSCAASG-FTFS | S------HGMH | WVRQAPGK GLEWVA | VTWYD-----GSDKYYADSVKG | RFTISRDNSKNTLYLQMNSL RAEDTAVYYCAR | DRLVGAT-------TDAFDI | WGQGT MVTVS S |
| iPS:4 36370 | 21-225_211A6 | VH3/3-33/D2/2-15/RF3/JH3 | QVQLVES-GGGVVQPGRSLRLSCAASG-FTFS | S------YGMH | WVRQAPGK GLEWVA | VIWYD-----GSNKNYADSVKG | RFTISRDNSKNTLYLQMNSL RAEDTAVYYCAR | DRTVGY--------DGFDI | WGQGT MVTVS S |
| iPS:4 36392 | 21-225_213B3 | VH3/3-33/D2/2-15/RF3/JH3 | QVQLVES-GGGVVQPGRSLRLSCAASG-FTFS | S------YGMH | WVRQAPGK GLEWVA | VIWYD-----GSNKNYADSVKG | RFTISRDNSKNTLYLQMNSL RAEDTAVYYCAR | DRTVGY--------DGFDI | WGQGT MVTVS S |
| iPS:4 36406 | 21-225_214E4 | VH3/3-33/D2/2-15/RF3/JH3 | QVQLVES-GGGVVQPGRSLRLSCAASG-FTFS | S------YGMH | WVRQAPGK GLEWVA | VIWYD-----GSNENYADSVKG | RITISRDNSKNTLYLQMNSL RAEDTAVYYCAR | DRTVGY--------DGCDI | WGQGA MVTVS S |
| iPS:4 37326 | 21-225_75C10 | VH3/3-33/D2/2-15/RF3/JH3 | QVQLVES-GGGVVQPGRSLRLSCAASG-FTFS | S------YGMH | WVRQAPGK GLEWVA | VIWYD-----GSRKYYADSVKG | RFTISRDNSKNTLYLQMNSL RAEDTAVYYCAR | DRLVGAT-------VDAFDI | WGQGT MVTVS S |
| | Germline VH4/4-39/D7/7-27/RF1/JH4 | QLQLQES-GPGLVKPSETLSL TCTVSG-GSIS | RS----SYYWG | WIRQPPGK GLEWIG | SIYY------SGSTSYNPS LKS | RVTISVDTSKNQFSLKLSSV TAADTAVYYCAR | LGT--------FDY | WGQGT LVTVS S |
| iPS:4 35293 | 21-225_146F1 | VH4/4-39/D7/7-27/RF1/JH4 | QLQLQES-GPGLVKPSETLSL TCTVSG-GSIS | RS----SYYWG | WIRQPPGK GLEWIG | SIYY------SGSTSYNPS LKS | RVTISVDTSKNQFSLKLSSV TAADTAVYYCAR | LDLLW---------SFDY | WGQGT LVTVS S |
| iPS:4 35361 | 21-225_148E11 | VH4/4-39/D7/7-27/RF1/JH4 | QLQLQES-GPGLVKPSETLSL TCTVSG-VSIS | RS----SYYWG | WIRQPPGK GLEWIG | SIYY------SGSTSYNPS LKS | RVTISVDTSKNQFSLKLSSV TAADTAVFYCAR | LDPQW---------SFDY | WGQGT LVTVS S |
| iPS:4 35449 | 21-225_152H9 | VH4/4-39/D7/7-27/RF1/JH4 | QLQLQES-GPGLVKPSETLSL TCTVSG-GSIS | RS----SYYWG | WIRQPPGK GLEWIG | SIYY------SGSASYNPS LKS | RVTISVDTSKNQFSLKLSSV TAADTAVFYCAR | LDLQW---------SFDF | WGQGT LVTVS S |
| iPS:4 35499 | 21-225_156G1 | VH4/4-39/D7/7-27/RF1/JH4 | QLQLQES-GPGLVKPSETLSL TCTVSG-GSIS | RS----SYYWG | WIRQPPGK GLEWIG | SIYY------SGSASYNPS LKS | RVTISVDTSKNQFSLKLSSV TAADTAVFYCAR | LDLQW---------SFDF | WGQGT LVTVS S |
| iPS:4 35587 | 21-225_160H3 | VH4/4-39/D7/7-27/RF1/JH4 | QLQLQES-GPGLVKPSETLSL TCTVSG-GSIS | RS----SYYWG | WIRQPPGK GLEWIG | SIYY------SGSTSYNPS LES | RVTISVDTSKNQFSLKLSSV TAADTAVFYCAR | LSQRW---------DFDY | WGQGT LVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:4 03868 | 21-225_19D11 | VH4/4-39/D7/7-27/RF1/J H4 | QLQLQES-GPGLVKPSETLSL TCTVSG-GSIS | RS----SYYWG | WIRQPPGK GLDWIG | SIYY----SGSANYNPS LKS | RVTISVDTSKNQFSLKLSSV TAADAAVYYCAR | LDRGW--------SFDY | WGQGT LVTVS S |
| | VH3|3-23|D4|4-17|RF2|JH5 | | EVQLLES-GGGLVQPGGSLRL SCAASG-FTFS | ----YAMS | WVRQAPGK GLEWVS | AISGS----GGNTFYADS VKG | RFTISRDNSKNTLYLQMNSL RAEDTAVYYCAK | NDWFDP | WGQGT LVTVS S |
| iPS:4 35295 | 21-225_146H1 | VH3|3-23/D4|4-17|RF2/J H5 | EVQLLES-GGGLVQPGGSLRL SCAASG-FTFS | S-----YAMS | WVRQAPGK GLEWVS | AISGR----GGNTFYADS VKG | RFTISRDNSKNTLYLQMNSL RAEDTAVYYCAK | RVTDYGG--------NDWFDP | WGQGT LVTVS S |
| iPS:4 35307 | 21-225_146E9 | VH3|3-23/D4|4-17|RF2/J H5 | EVQLLES-GGGLVQPGGSLRL SCAASG-FTFS | S-----YAMS | WVRQAPGK GLEWVS | AISGR----GGNTFYADS VKG | RFTISRDNSKKTLYLQMNSL RAEDTAVYYCAK | RVTDYGG--------NDWFDP | WGQGT LVTVS S |
| iPS:4 35347 | 21-225_148C4 | VH3|3-23/D4|4-17|RF2/J H5 | EVQLLES-GGGLVQPGGSLRL SCAASG-FTFS | S-----YAMN | WVRQAPGK GLEWVS | AISGS----GGNTFYADS VKG | RFTISRDNSKNTLYLQMNSL RAEDTAVYYCAK | RVTDYGG--------NDWFDP | WGQGT LVTVS S |
| iPS:4 35355 | 21-225_148H9 | VH3|3-23/D4|4-17|RF2/J H5 | EVQLLES-GGGLVQPGGSLRL SCAASG-FTFS | S-----YAMS | WVRQAPGK GLEWVS | AISGR----GGNTFYADS VKG | RFTISRDNSKNTLYLQMNSL RAEDTAVYYCAK | RVTDYGG--------NDWFDP | WGQGT LVTVS S |
| iPS:4 35371 | 21-225_149A3 | VH3|3-23/D4|4-17|RF2/J H5 | EVQLLES-GGGLVQPGGSLRL SCAASG-FTFS | N-----YAMT | WVRQAPGK GLEWVS | AISGR----GGNTFYADS VKG | RFTISRDNSKNTLYLQMNSL RAEDTAVYYCTK | RVTDYGG--------NDWFDP | WGQGT LVTVS S |
| iPS:4 35415 | 21-225_150C11 | VH3|3-23/D4|4-17|RF2/J H5 | EVQLLES-GGGLVQPGGSLRL SCAASG-FTFS | S-----YAMN | WVRQAPGK GLEWVS | AISGS----GGNTFYADS VKG | RFTISRDNSKNTLNLQMSSL RAEDTAVYYCAK | RVTDYGG--------NDWFDP | WGQGT LVTVS S |
| iPS:4 35419 | 21-225_150C12 | VH3|3-23/D4|4-17|RF2/J H5 | EVQLLES-GGGLVQPGGSLRL SCAASG-FTFS | S-----YAMS | WVRQAPGK GLEWVS | AISGS----GGNTFYADS VKG | RFTISRDNSKNTLYLQMNSL RAEDTAVYYCAK | RVTDYGG--------NDWFDP | WGQGT LVTVS S |
| iPS:4 35425 | 21-225_151B12 | VH3|3-23/D4|4-17|RF2/J H5 | EVQLLES-GGGLVQPGGSLRL SCAASG-FTFS | S-----YAMN | WVRHAPGK GLEWVS | AISGS----GKNTFYADS VKG | RFTISRDNSKNTLYLQMNSL RAEDTAVYYCAK | RVTDYGG--------NDWFDP | WGQGT LVTVS S |
| iPS:4 35431 | 21-225_152D2 | VH3|3-23/D4|4-17|RF2/J H5 | EVQLLES-GGGLVQPGGSLRL SCAASG-FTFS | S-----YAMS | WVRQAPGK GLEWVS | AISGR----GGNTFYADS VKG | RFTISRDNSKKTLYLQMNSL RAEDTAVYYCAK | RVTDYGG--------NDWFDP | WGQGT LVTVS S |
| iPS:4 35439 | 21-225_152G4 | VH3|3-23/D4|4-17|RF2/J H5 | EVQLLES-GGGLVQPGGSLRL SCAASG-FTFS | S-----YAMS | WVRQAPGK GLEWVS | AISGR----GGNTFYADS VKG | RFTISRDNSKNTLYLQMNSL RAEDTAVYYCAK | RVTDYGG--------NDWFDP | WGQGT LVTVS S |

Figure 51 (Continued)

| ID | V/D/J | H_FR1 | H_CDR1 | H_FR2 | H_CDR2 | H_FR3 | H_CDR3 | H_FR4 |
|---|---|---|---|---|---|---|---|---|
| iPS:4 35455 | 21-225_152B11 | VH3/3-23/D4/4-17/RF2/JH5 | EVQLLES-GGGLVQPGGSLRLSCAASG-FTFS | S-------YAMN | WVRQAPGK GLEWVS | AISGR----GGNTFYADS VKG | RFTISRDNSKNTLYLQMNSL RAEDTAVYYCAK | RVTDYGG-------NDWFDP | WGQGT LVTVS S |
| iPS:4 35487 | 21-225_155C4 | VH3/3-23/D4/4-17/RF2/JH5 | EVQLLES-GGGLVQPGGSLRLSCAASG-FTFS | S-------YAMS | WVRQAPGK GLEWVS | AISGR----GGNTFYADS VKG | RFTISRDNSKNTLYLQMNSL RAEDTAVYYCAK | RVTDYGG-------NDWFDP | WGQGT LVTVS S |
| iPS:4 35503 | 21-225_156E4 | VH3/3-23/D4/4-17/RF2/JH5 | EVQLLES-GGGLVQPGGSLRLSCAASG-FTFS | S-------YAMS | WVRQAPGK GLEWVS | AISGR----GGNTFYADS VKG | RFTISRDNSKNTLYLQMNSL RAEDTAVYYCAK | RVTDYGG-------NDWFDP | WGQGT LVTVS S |
| | Germline | | H_FR1 | H_CDR1 | H_FR2 | H_CDR2 | H_FR3 | H_CDR3 | H_FR4 |
| VH3/3-30/D4/3-22/RF3/JH3 | | | | | | | | | |
| iPS:4 35297 | 21-225_146B3 | VH3/3-30/D33-22/RF3/JH6 | QVQLVES-GGGVVQPGRSLRLSCAASG-FTFS | S-------YGMH | WVRQAPGK GLEWVA | VIWYD----GSYKYYADS VKG | RFTISRDNSKNTLDLQMNSL RAEDTAVYYCVK | MGIEVAVD------YYYGMDV | WGQGT TVTVS S |
| | Germline | | H_FR1 | H_CDR1 | H_FR2 | H_CDR2 | H_FR3 | H_CDR3 | H_FR4 |
| VH4/4-30.1/D1/1-1/RF1/JH3 | | | | | | | | | |
| iPS:4 35301 | 21-225_146G4 | VH4/4-30.1/D1/1-1/RF1/JH3 | QVQLQES-GPGLVKPSQTLSLNCTVSG-GSIS | NS-----GYYWS | WIRQHPGK GLEWIG | YSYY----SGSTYNFS LKS | RITISVDTSNMQFSLKLTSV TAADTAVYYCAR | GKYNWN------HAFDI | WGQGT MVTVS S |
| | Germline | | H_FR1 | H_CDR1 | H_FR2 | H_CDR2 | H_FR3 | H_CDR3 | H_FR4 |
| VH3/3-21/D6/6-13/RF1/JH4 | | | | | | | | | |
| iPS:4 35313 | 21-225_146G11 | VH3/3-21/D6/6-13/RF1/JH4 | EVQLVES-GGGLVKPGGSLRLSCAASG-FTFS | S-------YSMN | WVRQAPGK GLEWVS | SISGS----GSYIYYADS VKG | RFTISRDNAKNSLYLQMNSL RAEDTAVYYCAR | GSSSS-------GFDY | WGQGT LVTVS S |
| iPS:3 93808 | 21-225_1A2 | VH3/3-21/D6/6-13/RF1/JH4 | EVQLVES-GGGLVKPGGSLRLSCAASG-FTFS | S-------YTMN | WVRQAPGK GLEWVS | SISGS----GSYIYYADS VKG | RFTISRGMAKNSLYLQMNSL RAEDTAVYYCAR | GSSSS-------GFDY | WGQGT LVTVS S |
| iPS:3 93958 | 21-225_5H2 | VH3/3-21/D6/6-13/RF1/JH4 | EVQLVES-GGGLVKPGGSLRLSCAASG-FTFS | S-------YTMN | WVRQAPGK GLEWVS | SISGS----SSYIYADS VKG | RFTISRANAKNSLYLQMNSL RAEDTAVYYCAR | GSSSS-------GFDY | WGQGT LVTVS S |
| | Germline | | H_FR1 | H_CDR1 | H_FR2 | H_CDR2 | H_FR3 | H_CDR3 | H_FR4 |
| VH4/4-30.4/D5-18/RF2/JH6 | | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35317 | 21-225_147D2 VH4/4-30.4/D5/5-18/RF3/J H6 | QVLLQES-GPGLVKPSQTLSL TCAVSG-GPIS | SG----DYYWN | WIRQRPGK GLEWIG | FIYY----TGSTYYNPS LKS | RVSISEDTSENQFSLNLSSV TAADTAVYYCAR | GGAYYS-------YYGMDV | WGQGT TVTVS S |
| | VH4/4-30.1/D5/5-24/RF3/JH3 | Germline | | | | | | |
| iPS:4 35319 | 21-225_147E3 VH4/4-30.1/D5/5-24/RF3/J H3 | QVQLQES-GPGLVKPSQTLSL TCTVSG-GSIT | NS----GYYYS | WIRQHPGK GLEWIG | YIYY-----SGGTYYNPS LKS | RITISVDTSNNQFSLKLSSV TAADTAVYYCAR | GGYNWN-------HAFDF | WGQGT MVTVS S |
| iPS:4 35383 | 21-225_149D7 VH4/4-30.1/D5/5-24/RF3/J H3 | QVQLQES-GPGLVKPSQTLSL NCTVSG-GSIS | NS----GYYWS | WIRQHPGK GLEWIG | YSYY-----SGGTYYNPS LKS | RITISVDTSNNQFSLKLSSV TAADTAVYYCAR | GGYNWN-------HAFDI | WGQGT MVTVS S |
| iPS:4 35443 | 21-225_152E7 VH4/4-30.1/D5/5-24/RF3/J H3 | QVQLQES-GPGLVKPSQTLSL NCTVSG-GSIS | NS----GYYWS | WIRQHPGK GLEWIG | YSYY-----SGGTYYNPS LKS | RITISVDTSNNQFSLNLSSV TAADTAVYYCAR | GGYNWN-------HAFDI | WGQGT MVTVS S |
| iPS:4 35465 | 21-225_153A6 VH4/4-30.1/D5/5-24/RF3/J H3 | QVQLQES-GPGLVKPSQTLSL NCTVSG-GSIS | NS----GYYWS | WIRQHPGK GLEWIG | YSYY-----SGGTYYNPS LKS | RITISVDTSNNQFSLNLSSV TAADTAVYYCAR | GGYNWN-------HAFDI | WGQGT MVTVS S |
| iPS:4 42568 | 21-225_149D8 VH4/4-30.1/D5/5-24/RF3/J H3 | QVQLQES-GPGLVKPSQTLSL NCTVSG-GSIS | NS----GYYWS | WIRQHPGK GLEWIG | YSYY-----SGGTYYNPS LKS | RITISVDTSNNQFSLKLSSV TAADTAVYYCAR | GGYNWN-------HAFDI | WGQGT MVTVS S |
| | VH3/3-48/D4/4-11/RF2/JH4 | Germline | | | | | | |
| iPS:4 35333 | 21-225_147E9 VH3/3-48/D4/4-11/RF2/J H4 | EVQLVES-GGGLVQPGGSLRL SCAASG-FTFS | S-----YSMN | WVRQAPGK GLEWVS | SISGR----NTTIYYADS VKG | RFTISRDNAKNSLYLQMNSL RCEDTAVYYCAR | DRG--------------SC | WGQGT LVTVS S |
| iPS:4 35637 | 21-225_163E2 VH3/3-48/D4/4-11/RF2/J H4 | EVQLVES-GGGLVQPGGSLRL SCAASG-FTFS | S-----YSMN | WVRQAPGR GLEWVS | STSGS----STYIYYADS VKG | RFTISRDNARNLVYLQMNSL RPEDTAVYYCAR | DRG--------------SL | WGQGT LVTVS S |
| | VH1/1-02/D2/2-15/RF3/JH4 | Germline | | | | | | |
| iPS:4 35351 | 21-225_148B6 VH1/1-02/D2/2-15/RF3/J H4 | QVQLVQS-GAEVKKPGASVKV SCKASG-YTFT | G------YYMH | WVRQAPGQ GLEWMG | WIHPN----NGGINYAQT FQG | RVTMTRDTSISTVYMELSRL RSDDTAVYYCAR | DFVVVP-------AAPFDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-30.1D5J5-12|RF3|JH6 | | QVQLQES-GPGLVKPSQTLSL TCTVSG-GSIS | SG----GYYWS | WIRQHPGK GLEWIG | YIYY----SGSTYNPS LKS | RVTISVDTSKDQFSLRLSSV TAADTAVYYCAR | GYSGYYY----YYGMDV | WGQGT TVTVS S |
| iPS:4-35363 21-225_148F12 | VH4-30.1/D5J5-12|RF3|JH6 | QVQLQES-GPGLVKPSQTLSL TCTVSG-GSIS | NG----GYYWN | WIRQHPGK GLEWIG | YIYY----SGSTYNPS LKS | QITISVDTSKDQFSLRLSSV TAADTAVYYCAR | YSTYDY----YYGMDV | WGQGT TVTVS S |
| iPS:4-35377 21-225_149G5 | VH4-30.1/D5J5-12|RF3|JH6 | QVQLQES-GRGLVKPSQTLSL TCTVSG-GSIS | NG----GYYWN | WIRQHPGK GLEWIG | YIYY----SGSTYNPS LKS | RVTISVDTSKDQFSLRLSSV TAADTAVYYCAR | YSTYDY----YYGMDV | WGQGT TVTVS S |
| VH3J3-48/D6J6-6|RF2|JH4 | Germline | EVQLVES-GGGLVQPGGSLRL SCAASG-FTFS | S----YSMT | WVRQAPGK GLDWVS | VISRS----SSTIYYADS VKG | RFSISRDNAKNSLYLQMNSL RDEDTAVYYCAR | SAFS----YFDY | WGQGT LVTVS S |
| iPS:4-35409 21-225_150G8 | VH3J3-48/D6J6-6|RF2|JH4 | EVQLVES-GGGLVQPGGSLRL SCAASG-FTFS | T----YSMT | WVRQAPGK GLDWVS | VISRS----SSTIYYADS VKG | RFSISRDNAKNSLYLQMNSL RDEDTAVYYCAR | SAFS----PFDY | WGQGT LVTVS S |
| VH3J3-30.3D5J5-18|RF2|JH5 | Germline | QVQLVES-GGGVVQPGRSLRL SCAASG-FTFS | S----YAMH | WVRQAPGK GLEWVS | VISYD----GSNKYYADS VKG | RFTISRDNSKNTLYLQMNSL RAEDTAVYYCAR | NRRDP | WGQGT LVTVS S |
| iPS:4-35427 21-225_151C9 | VH3J3-30.3D5J5-18|RF2|JH5 | QVQLVES-GGGVVQPGRSLRL SCAASG-FTFS | S----YGMH | WVRQAPGK GLEWVA | VISYD----GSNKYYADS VKG | RFTISRDNSKNTLYLQMNSL RAEDTAVYYCAR | GVLLWFGE----LEDDWFDP | WGQGT LVTVS S |
| VH3J3-33D3J3-22|RF2|JH4 | Germline | QVQLVES-GGGVVQPGRSLRL SCAASG-FTFS | S----YGMH | WVRQAPGK GLEWVS | IIWYD----GSYKYYADS VKG | RFTISRDNSKNTLYLQMNSL RAEDTAVYYCAR | VYYDSS----YYYFDY | WGQGT LVTVS S |
| iPS:4-35441 21-225_152F6 | VH3J3-33D3J3-22|RF2|JH4 | QVQLVES-GGGVVQPGRSLRL SCAASG-FTFS | S----YGMH | WVRQAPGK GLEWVA | IIWYD----GSYKYYADS VKG | RFTISRDNSKNTLYLQMNSL RAEDTAVYYCAR | EGYDFW----SGYLGY | WGQGT LVTVS S |
| iPS:4-35457 21-225_152C11 | VH3J3-33D3J3-22|RF2|JH4 | QVQLVES-GGGVVQPGRSLRL SCAASG-PTFR | N----YGMH | WVRQAPGK GLEWVA | IIWYD----GSNKYYADS VKG | RFTISRDNSKNTLYLQMNSL RAEDTAVYYCAR | EAYDFW----SGYFDY | WGQGT LVTVS S |
| iPS:4-35463 21-225_153D2 | VH3J3-33D3J3-22|RF2|JH4 | QVQLVES-GGGVVQPGRSLRL SCAASG-FTFS | S----YGMH | WVRQAPGK GLEWVA | IIWYD----GSYKYYADS VKG | RFTISRDNSKNTVYLQMNSL RAEDTAVYYCAR | EGYDFW----SGYLGY | WGQGT LVTVS S |
| iPS:4-35531 21-225_157G8 | VH3J3-33D3J3-22|RF2|JH4 | QVQLVES-GGGVVQPGRSLRL SCAASG-FTFS | N----YGMH | WVRQAPGK GLEWVA | IIWYD----GSYKYYADS VKG | RFTVSRDNSKNTLYLQMNSL RAEDTAVYYCAR | EGYDFW----SGFFDS | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35577 | 21-225_160B1 | VH3/3-33/D3/3-22/RF2/JH4 | QVQLVES-GGGVVQPGRSLRLSCAASG-FTFS | S------YGMH | WVRQAPGK GLEWVA | VIWYD---GSYKYYADS VKG | RFTISRDNSKNTLYLQMNSL RAEDTAVYYCAR | EAYDFW------SGYYDY | WGQGT LVTVS S |
| iPS:4 35723 | 21-225_172B7 | VH3/3-33/D3/3-22/RF2/JH4 | QVQLVES-GGGVVQPGRSLRLSCAASG-FTFS | N------YGMH | WVRQAPGK GLEWVA | IIWYD---GSNKYYVDS VKG | RFTISRDNSKNTLYLQMNSL RAEDTAVYYCAR | EAYDFW------SGYWDY | WGQGT LVTVS S |
| iPS:4 35731 | 21-225_173A11 | VH3/3-33/D3/3-22/RF2/JH4 | QVQLVES-GGGVVQPGRSLRLSCAASG-FTFS | S------YGMH | WVRQAPGK GLEWVA | IIWYD---GSNKYYADS VKG | RFTISRDNSKNTLYLQMNSL RAEDTAVYYCAR | EAYDFW------SGFFDS | WGQGT LVTVS S |
| iPS:4 35781 | 21-225_178G10 | VH3/3-33/D3/3-22/RF2/JH4 | QVQLVES-GGGVVQPGRSLRLSCAASG-FTFS | T------YGMH | WVRQAPGK GLEWVA | VIWYD---GSNKYYADS VKG | RFTISRDNFKNTLYLQMNSL RAEDTAVYYCAR | ERYDFW------SGHFDY | WGQGT LVTVS S |
| iPS:4 35899 | 21-225_188G11 | VH3/3-33/D3/3-22/RF2/JH4 | QVQLVES-GGGVVQPGRSLRLSCAASG-FTFS | S------YGMH | WVRQAPGK GLEWVT | IIWYD---GSYKYYADS VKG | RFTISRDNSKNTLFLQMNSL RAEDTAVYYCAR | ERYDFW------SGHFDY | WGQGT LVTVS S |
| iPS:4 36602 | 21-225_226E7 | VH3/3-33/D3/3-22/RF2/JH4 | QVQLVES-GGGVVQPGRSLRLSCAASG-FTFS | T------YGMH | WVRQAPGK GLEWVS | AISGR---GGNTFYADS VKG | RFTISRDNFKNTLYLQMHSL RADDTAVYYCAR | ENYDFW------SGYYGY | WGQGT LVTVS S |
| iPS:3 92930 | 21-225_25H9 | VH3/3-33/D3/3-22/RF2/JH4 | QVQLVES-GGGVVQPGRSLRLSCAASG-FPFN | N------YGMH | WVRQAPGK GLEWVS | IIWYD---GSYKYYADS VKG | RFTISRDNSKNTLYLQMNSL RAEDTAVYYCAR | EGYDFW------SGFFDS | WGQGT LVTVS S |
| VH3/3-23/D1/1-26/RF2/JH4 | Germline | | | H_CDR1 | H_FR2 | H_CDR2 | H_FR3 | H_CDR3 | H_FR4 |
| iPS:4 35479 | 21-225_154E9 | VH3/3-23/D1/1-26/RF2/JH4 | EVKLLES-GGGLVQPGGSLRLSCAASG-FTFS | S------YAMS | WVRQAPGK GLEWVS | AISGR---GGNTFYADS VKG | RFTISRDNSKNTLFLQMNSL RAEDTAVYYCAK | RGFRFLE-----WLGGFDY | WGQGT LVTVS S |
| VH3/3-23/D5/5-18/RF3/JH4 | Germline | | | H_CDR1 | H_FR2 | H_CDR2 | H_FR3 | H_CDR3 | H_FR4 |
| iPS:4 35497 | 21-225_155H9 | VH3/3-23/D5/5-18/RF3/JH4 | EVQLLES-GGGLVQPGGSLRLSCAASG-FTFS | S------YAMN | WVRQAPGK GLEWVS | TISGR---GLGTFYADS VKG | RPTISRDNSKNTLYLQLNSL RAEDTAVYYCAK | DHDYGDY-----NIYFDY | WGQGT LVTVS S |
| VH3/3-23/D6/6-19/RF1/JH3 | Germline | | | H_CDR1 | H_FR2 | H_CDR2 | H_FR3 | H_CDR3 | H_FR4 |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35513 | 21-225_157F3 | VH3|3-23|D6|6-19|RF1|JH3 | EVQLLES-GGGLVQPGGSLRL SCAASE-FTFS | T-----YAMS | WVRQAPGK GLEWVS | VISGS---GGSTYYADS VKG | RFTISRDNSKNTLYLQMNSL RAEDTAVYYCAR | RSSGWY------EDALDI | WGQGT MVTVS S |
| iPS:3 92766 | 21-225_23H4 | VH3|3-23|D6|6-19|RF1|JH3 | EVQLLES-GGGLVQPGGSLRL SCAASG-FTFS | S-----YAMN | WVRQAPGK GLEWVS | VISGS---GGTTYYADS VKG | RFTISRDNSKNTLYLQMNSL RAEDTAVYYCAK | RNSSGW------HDVFDI | WGQGT KVTVS S |
| iPS:3 92808 | 21-225_20F8 | VH3|3-23|D6|6-19|RF1|JH3 | EVQLLES-GGGLVQPGGSLRL SCAASG-FTFR | S-----YAMS | WIRQAPGR GLEWSS | VISGS---GGSTYYADS VKG | RFTISRDNSKNTLYLQMSSL RAEDTAVYYCAK | RYNSGW------HDVFDI | WGQGT MVTVS S |
| | Germline | | H_FR1 | H_CDR1 | H_FR2 | H_CDR2 | H_FR3 | H_CDR3 | H_FR4 |
| | VH4|4-39|D2|2-21|RF3|JH4 | | QLHLQES-GPGLVKPSETLSL TCTVSG-GSIS | SG-----SYYWG | WIRQPPGK GLEWIG | SIYY---SGSTYYNPS LKS | RVTISVDTSKNQFSLNLSSV TAADTAVYYCAR | HKVAG------PFDY | WGQGT LVTVS S |
| iPS:4 35525 | 21-225_157E7 | VH4|4-39|D2|2-21|RF3|JH4 | | | | | | | |
| | Germline | | H_FR1 | H_CDR1 | H_FR2 | H_CDR2 | H_FR3 | H_CDR3 | H_FR4 |
| | VH3|3-33|D3|3-10|RF2|JH6 | | | | | | | | |
| iPS:4 35543 | 21-225_158D4 | VH3|3-33|D3|3-10|RF2|JH6 | QVQLVES-GGGVVQPGRSLRL SCAASG-FTFS | D-----YVMH | WVRQAPGK GLEWVS | VIWYD---GSNKYYADS VKG | RFTISRDNSKNTLYLQMNSL RAEDTAVYYCAR | EPYTSGW------YDYGMDV | WGQGT TVTVS S |
| iPS:4 35571 | 21-225_159C8 | VH3|3-33|D3|3-10|RF2|JH6 | QVQLVES-GGGVVQPGRSLRL SCAASG-FTFS | D-----YVMQ | WVRQAPGK GLEWVA | VIWYD---GSNKYYADS VKG | RFTISRDNSKNTLYLQMNSL RAEDTAVYYCAR | EPYNSGW------YDYGMDV | WGQGT TVTVS S |
| iPS:4 35591 | 21-225_160C4 | VH3|3-33|D3|3-10|RF2|JH6 | QVQLVES-GGGVVQPGRSLRL SCAASG-FTFS | D-----YVMQ | WVRQAPGK GLEWVA | VIWYD---GSNKYYADS VKG | RFTISRDNSKNTLYLQMNSL RAEDTAVYYCAR | EPYNSGW------YDYGMDV | WGQGT TVTVS S |
| iPS:4 35615 | 21-225_161G12 | VH3|3-33|D3|3-10|RF2|JH6 | QVQLVES-GGGVVQPGRSLRL SCAASG-FTFS | D-----YVMQ | WVRQAPGK GLEWVA | VIWYD---GSNKYYADS VKG | RFTISRDNSKNTLYLQMNSL RAEDTAVYYCAR | EPYNSGW------YDYGMDV | WGQGT TVTVS S |
| iPS:4 36604 | 21-225_226F7 | VH3|3-33|D3|3-10|RF2|JH6 | QVQLVES-GGGVVQPGRSLRL SCAASG-FTFS | S-----YGMH | WVRQAPGK GLEWVA | IIWYD---GSNKYYADS VKG | RFTISRDNSKNTLYLQMNSL RAEDTAVYYCAR | ERYNSGW------YDYGLDV | WGQGT TVTVS S |
| iPS:4 51114 | 21-225_159A3 | VH3|3-33|D3|3-10|RF2|JH6 | QVQLVES-GGGVVQPGRSLRL SCAASG-FTFS | D-----YVMQ | WVRQAPGK GLEWVA | VIWYD---GSNKYYADS VKG | RFTISRDISKNTLYLQMNSL RAEDTAVYYCAR | EPYNSGW------YDYGMDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 21-72732 | 21-225_2B10_LC1 | VH3/3-33/D3/3-10/RF2/JH6 | QVQLVES-GGGVVQPGRSLRL SCAASG-FTFS | S-----YVMH | WVRQAPGK GLEWVA | VIWYD---GSNKYYADS VKV | RFTVSRDNSKNTLSLQMNSL RAEDTAVYYCAR | ERYTSGW-------YDYGMDV | WGQGT TVTVS S |
| iPS:4 21-72733 | 21-225_2B10_LC2 | VH3/3-33/D3/3-10/RF2/JH6 | QVQLVES-GGGVVQPGRSLRL SCAASG-FTFS | S-----YVMH | WVRQAPGK GLEWVA | VIWYD---GSNKYYADS VKV | RFTVSRDNSKNTLSLQMNSL RAEDTAVYYCAR | ERYTSGW-------YDYGMDV | WGQGT TVTVS S |
| iPS:3 92872 | 21-225_20B11 | VH3/3-33/D3/3-10/RF2/JH6 | QVQLVES-GGGVVQPGRSLRL SCAASG-FTFS | S-----YVMH | WVQAPGK GLEWVA | VIWYD---GSNKYYADS VKV | RFTVSRDNSKNTLSLQMNSL RAEDTAVYYCAR | ERYTSGW-------YDYGMDV | WGQGT TVTVS S |
| iPS:3 93966 | 21-225_7F8 | VH3/3-33/D3/3-10/RF2/JH6 | QVQLVES-GGGVVQPGRSLRL SCAASG-FTFS | S-----CVMH | WVRQAPGK GLEWVA | VIWYD---GSNKYYADS VKG | RFTISRDNSNNTLYLQMNSL RAEDTAVYYCAR | ERYTSGW-------HDYGMDV | WGQGT TVTVS S |
| | Germline VH3/3-23/D1/1-1/RF1/JH6 | H_FR1 | H_CDR1 | H_FR2 | H_CDR2 | H_FR3 | H_CDR3 | H_FR4 |
| iPS:4 35559 | 21-225_158H12 | VH3/3-23/D1/1-1/RF1/JH6 | EVQLVES-GGGLVQPGGSLRL SCAASG-FTFS | S-----YVMS | WVRQAPGK GLEWVS | AISGS---GGRTDYADS VKG | RFTISRDNSKNTLYLQMNSL RAEDTAVYYCAR | GGW-----------NHD | WGQGT TVTVS S |
| | Germline VH3/3-21/D1/1-1/RF1/JH6 | H_FR1 | H_CDR1 | H_FR2 | H_CDR2 | H_FR3 | H_CDR3 | H_FR4 |
| iPS:4 35561 | 21-225_159F1 | VH3/3-21/D1/1-1/RF1/JH6 | EVQLVES-GGGLVKPGGSLRL SCAASG-FTFS | S-----YRMN | WVRQAPGK GLEWVS | SISGS---GNYIDYADS VKG | RFTISRDNAKNSLYLQMNSL RAEDTAVYYCAR | GW------------DV | WGQGT TVTVS S |
| | Germline VH1/1-08/D1/1-1/RF1/JH4 | H_FR1 | H_CDR1 | H_FR2 | H_CDR2 | H_FR3 | H_CDR3 | H_FR4 |
| iPS:4 35563 | 21-225_159H2 | VH1/1-08/D1/1-1/RF1/JH4 | QVQLVQS-GAEVKKPGASVKV SCKASG-YTFT | S-----YDIN | WVRQATGQ GLEWMG | WMNPN---SGNTGYVQK FQG | RVTMTRNTSISTAYMELSSL RSEDTAVYYCAR | KKT-----------GDY | WGQGT LVTVS S |
| iPS:3 92718 | 21-225_17B8 | VH1/1-08/D1/1-1/RF1/JH4 | QVQLVQS-GAEVKKPGASVKV SCKASG-YTFT | S-----YAIN | WVRQAPGK GLEWMG | WMNPN---TGNTGYAQK FQG | RVTMTRNTSISTAYMELSSL RSEDTAVYFCTR | KAG-----------FDY | WGQGT LVTVS S |
| iPS:3 93064 | 21-225_33A9 | VH1/1-08/D1/1-1/RF1/JH4 | QVQLVQS-GAEVKKPGASVKV SCKASG-YTFT | S-----YDIN | WVRQATGQ GLEWMG | WMNPN---SGNTGYAQK FQG | RVTMTRNTSISTAVYYCAR GSEDTAVYYCAR | KKA-----------NDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93148 | 21-225_35E5 | VH1|1-08/D1|1-1|RF1/JH4 | QVQLVQS-GAEVKKPGASVKV SCKASG-YTFT | S------YDIN | WVRQATGQ GLEWMG | WMNPN---SGNTGYAQK FQG | RVTMTRNTSISTAYMELSSL RSEDTAVYYCAR | KKS---------NDY | WGQGT LVTVS S |
| iPS:3 98530 | 21-225_32G4 | VH1|1-08/D1|1-1|RF1/JH4 | QVQLVQS-GAEVKKPGASVKV SCKASG-YTFT | S------YDIN | WVRQATGQ GLEWMG | WMNPN---SGNTGYAQK FQG | RVTMTRNTSISTAYMELSSL RSEDTAVYYCAR | KKA---------NDY | WGQGT LVTVS S |
| | Germline VH3|3-30.3/D1|1-26|RF3/JH6 | | | | | | | |
| iPS:4 35565 | 21-225_159C4 | VH3|3-30.3/D1|1-26|RF3/JH6 | QVQLVES-GGGVVQPGRSLRL SCAASG-FTFS | N------YGMH | WVRQAPGK GLEWVA | VISYS----GNNRYYADS VKG | RFTISRDNSKNTLYLQLNSL RAEDMAVYYCAR | RSSWG-------GYGMDV | WGHGI TVTVS S |
| iPS:3 93892 | 21-225_6G7 | VH3|3-30.3/D1|1-26|RF3/JH6 | QVQLVES-GGGVVQPGRSLRL SCAASG-FTFS | S------YGMH | WVRQTPGK GLEWVA | IISYV----GKNKYYADS VKG | RFTISRDNSKNTLYLQMNSL RAEDTAVYYCAR | RGNSYG------GYGMDV | WGQGT TVTVS S |
| | Germline VH3|3-23/D2|2-21|RF3/JH4 | | | | | | | |
| iPS:4 35579 | 21-225_160G1 | VH3|3-23/D2|2-21|RF3/JH4 | EVQLLES-GGGLVQPGGSLRL SCAASG-FTFS | S------YVMS | WVRQAPGK GLEWVS | AMSGS----GGHTYYADS VKG | RFTISRDNSKNTLYLQMNSL RAEDTAVYYCAR | HG----------YS | WGQGT LVTVS S |
| iPS:4 35585 | 21-225_160G3 | VH3|3-23/D2|2-21|RF3/JH4 | EVQLLES-GGGLVQPGGSLRL SCAASG-FTFS | S------YVMS | WVRQTPGK GLEWVS | AMSGS----GGHTYYADS VKG | RFTISRDNSKNTLYLQMNSL RAEDTAIYYCVK | HG----------YS | WGQGT TVTVS S |
| | Germline VH4|4-39/D1|1-1|RF3/JH5 | | | | | | | |
| iPS:4 35599 | 21-225_160B10 | VH4|4-39/D1|1-1|RF3/JH5 | QLQLQES-GPGLVRPSETLSL TCTVSG-GSIS | RS----SYYWG | WIRQYPGR GLEWIG | NIYY-----SGSAYIPS LKS | RVTISVDTSKNQFSLKLNSV TAADTAVYYCVR | HDPNW-------GVDY | WGQGT LVTVS S |
| | Germline VH3|3-33/D1|1-1|RF2/JH6 | | | | | | | |
| iPS:4 35601 | 21-225_160G10 | VH3|3-33/D1|1-1|RF2/JH6 | QVQLVES-GGGVVQPGRSLRL SCAASG-FTFS | S------FGMH | WVRQAPGK GLEWVA | VIWYD----GSYKYYADS VKG | RFTISRDNSKNTLYLQMNSL RAEDTAVYYCAR | VGIEVAGD----YYFGMEV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 21-225_167E2 35655 | VH3|3-33|D1|1-1|RF2|JH6 | QVQLVES-GGGVVQPGRSLRL SCAASG-FTFS | S-----FGMH | WVRQAPGK GLEWVA | VIWYD---- GTYKYYADS VKG | RFTISRDNSKNTLYLQMNSL RAEDTAVYYCAR | VGIEVAGD------ ------YYYGMEV | WGQGT TVTVS S |
| iPS:4 21-225_167H10 35657 | VH3|3-33|D1|1-1|RF2|JH6 | QVQLVES-GGGVVQPGRSQRL SCAASG-FTFS | S-----FGMH | WVRQAPGK GLEWVA | VIWYD---- GSYKYHADS VKG | RFTISRDNSKNTLYLQMNSL RAEDTAVYYCAR | VGIEVAGD------ ------YYYGMEV | WGQGT TVTVS S |
| | Germline | H_FR1 | H_CDR1 | H_FR2 | H_CDR2 | H_FR3 | H_CDR3 | H_FR4 |
| VH3|3-53|D7|7-27|RF3|JH4 | | | | | | | | |
| iPS:4 21-225_161A4 35605 | VH3|3-53|D7|7-27|RF3|JH4 | EVQLVES-GGGLIQPGGSLRL SCAASG-FTVS | S-----NYMS | WVRQAPGK GLEWVS | VIYT---- GGSTYNADS VKG | RFTISRDNSKNTLYLQMNSL RAEDTAVYCAR | NWGMA---- --------GPFDY | WGQGI LVTVS S |
| | Germline | H_FR1 | H_CDR1 | H_FR2 | H_CDR2 | H_FR3 | H_CDR3 | H_FR4 |
| VH3|3-30.3|D6|6-6|RF1|JH6 | | | | | | | | |
| iPS:4 21-225_161G4 35607 | VH3|3-30.3|D6|6-6|RF1|JH6 | QVQLVES-GGGVVQPGRSLRL SCAASG-FTFS | S-----YGMH | WVRQAPGK GLEWVA | VISYG---- GSNKYHADS VKG | RFTISRDNSKNTLYLQMNSL RAEDTAVYYCVR | RSSSSG------ ------GYGMDV | WGQGT TVTVS S |
| iPS:4 21-225_30E2 93020 | VH3|3-30.3|D6|6-6|RF1|JH6 | QVQLVES-GGGVVQPGRSLRL SCAASG-FTFS | S-----YGMH | WVRQAPGK GLEWVA | VISYG---- GSNKYAVS VKG | RFNISRDNSKNTLYLQMNSL RAEDTAVYYCAR | RGYSSG------ ------GYGMDV | WGQGT TVTVS S |
| iPS:3 21-225_33H3 93062 | VH3|3-30.3|D6|6-6|RF1|JH6 | QVQLVES-GGGVVQPGRSLRL SCAASG-FTFS | S-----YGMH | WVRRAPGK GLEWVA | IISYG---- GSNNFYADS VKG | RFTISRDNSKNTLYLQMNSL RAEDTAVYYCAR | RGYSSG------ ------GYGMDV | WGQGT TVTVS S |
| iPS:3 21-225_35E3 93138 | VH3|3-30.3|D6|6-6|RF1|JH6 | QVQLVES-GGGVVQPGRSLRL SCAASG-FTFS | S-----YGMH | WVRQAPGK GLEWVA | VISYG---- GSNKYADS VKG | RFTISRDNSKNTLYLQMNSL RAEDTAVYYCAR | RGYSSG------ ------GYGMDV | WGQGT TVTVS S |
| | Germline | H_FR1 | H_CDR1 | H_FR2 | H_CDR2 | H_FR3 | H_CDR3 | H_FR4 |
| VH3|3-30.3|D6|6-13|RF2|JH6 | | | | | | | | |
| iPS:4 21-35611 225_161F10 | VH3|3-30.3|D6|6-13|RF2|JH6 | QVQLVES-GGGVVQFGRSLRL SCAASG-FTFS | S-----YGMH | WVRQAPGK GLEWVA | IISYS---- GRNDFYADS VKG | RFTISRDNSKNTLYLQMNSL RAEDTAVYYCAR | RIAAAG---- --------HYGMDV | WGQGT TVTVS S |
| VH3|3-33|D6|6-18|RF1|JH6 | Germline | H_FR1 | H_CDR1 | H_FR2 | H_CDR2 | H_FR3 | H_CDR3 | H_FR4 |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35629 | 21-225_162H6 | VH3J3-33|D5|5-18|RF1|JH6 | QVQLVES-GGGVVQPGRSLRL SCAASG-FTFN | N------YGMH | WVRQAPGK GLEWVA | VIWYD----GSNKYYADS VKG | RFTISRDNSKNTLYLQMNSL RAEDTAVYYCAR | KGIAAVGD--------YYYGMDV | WGQGT TVTVS S |
| | | Germline | | | | | | | |
| iPS:4 35639 | 21-225_163G6 | VH3J3-21|D7|7-27|RF1|JH6 | EVQLVES-GGGLVKPGGSLRL SCAASG-FTFS | S------YSMS | WVRQAPGK GLEWVS | SISGS---SAYIYYADS VKG | RFTISRDNAKNSLYLQMNSL RAEDTAVYYCAR | LSG-----------MDV | WGQGT TVTVS S |
| | | Germline | | | | | | | |
| iPS:4 35643 | 21-225_163G10 | VH3J3-21|D5|5-24|RF2|JH6 | EVQLVES-GGGLVKPGGSLRL SCAASG-FTFS | S------YSMN | WVRQAPGK GLEWVS | SISGS---STYIYYADS VKG | RFTISRDNARNSLYLQMNSL RAEDTAVYYCAR | ARM-------------DV | WGQGT TVTVS S |
| | | Germline | | | | | | | |
| iPS:4 35663 | 21-225_169B1 | VH3J3-33|D3|3-9|RF2|JH4 | QVQLVES-GGGVVQPGRSLRL SCAASG-FTFS | S------YGMH | WVRQAPGK GLEWVA | VIWYD----GSNKYYADS VRG | RFTISRDNSKNTLYLQMNSL RAEDTAVYYCAR | DPLRGYN----------DFVMDY | WGQGT LVTVS S |
| iPS:4 35669 | 21-225_169F9 | VH3J3-33|D3|3-9|RF2|JH4 | QVQLVES-GGGVVQPGRSLRL SCAASG-FTFS | T------YGMH | WVRQAPGK GLEWVS | IIWYD----GTNKYYADS VKG | RFTISRDNSKNTLQLQNSL RAEDTAVYYCAR | DPLRGYN----------DPVMDY | WGQGT LVTVS S |
| iPS:4 35693 | 21-225_170G4 | VH3J3-33|D3|3-9|RF2|JH4 | QVQLVES-GGGVVQPGRSLRL SCTASG-FTFS | T------YGMH | WVRQAPGK GLEWVS | IIWYD----GTNKYYADS VKG | RFTISRDNSKNTLFLQINSL RAEDTAMYYCAR | DPLRGYN----------DFVMDY | WGQGT LVTVS S |
| iPS:4 35695 | 21-225_170D5 | VH3J3-33|D3|3-9|RF2|JH4 | QVQLVES-GGGVVQPGRSLRL SCAASG-FTFS | S------YGMH | WVRQAPGK GLEWVA | IIWYD----GTNKYYADS VKG | RFTISRDNSKNTLYLQINSL RAEDTAVYYCAR | DPLRGYN----------DFVMDY | WGQGT LVTVS S |
| iPS:4 35697 | 21-225_170G5 | VH3J3-33|D3|3-9|RF2|JH4 | QVQLVES-GGGVVQPGRSLRL SCAASG-FTFS | T------YGMH | WVRQAPGK GLEWVT | IIWYD----GTNKYYADS VKG | RFTISRDNSKSTLYLQMNSL RAEDTAVYFCAR | DPLRGYN----------DFVMDY | WGQGT LVTVS S |
| iPS:4 35703 | 21-225_170D11 | VH3J3-33|D3|3-9|RF2|JH4 | QVQLVES-GGGVVQPGRSLRL SCVASG-FTFS | S------YGMH | WVRQAPGK GLEWVA | IIWYD----GTNKYYADS VKG | RFTISRDNSKNTLYLQINSL RAEDTAVYYCAR | DPLRGYN----------DFVMDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35705 | 21-225_171C3 | VH3/3-33/D3/3-9/RF2/JH4 | QVQLVES-GGGVVQPGGSLRLSCAASG-FTFS | T------YGMH | WVRQAPGK GLEWVT | IIWYD----GTNKYYADS VKG | RFTISRDNSKNTLYLQMNSL RAEDTAVYYCAR | DPLRGYN------DPVMDY | WGQGT LVTVS S |
| iPS:4 35709 | 21-225_171A4 | VH3/3-33/D3/3-9/RF2/JH4 | QVQLVES-GGGVVQPGGSLRLSCAASG-FTFS | T------YGMH | WVRQAPGK GLEWVA | IIWYD----GSNKYYADS VKG | RFTISRDNSKNTLYLQMNSL RAEDTAVYYCAR | DPLRGYN------DPVMDY | WGQGT LVTVS S |
| iPS:4 35721 | 21-225_172B3 | VH3/3-33/D3/3-9/RF2/JH4 | QVQLVES-GGGVVQPGRSLRLSCAASG-FTFS | T------YGMH | WVRQAPGK GLEWVA | VIWYD----GSNKYYADS VKG | RFTISRDNSKNTLYLQMNSL RAEDTAVYYCAR | DPLRGYN------DPVMDY | WGQGT LVTVS S |
| iPS:4 35725 | 21-225_172G8 | VH3/3-33/D3/3-9/RF2/JH4 | QVQMVES-GGGVVQPGRSLRLSCAASG-FTFS | T------YGMH | WVRQAPGK GLEWMA | IIWYD----GTNKYYADS VKG | RFTISRDNSKNTLYLQLNSL RAEDTAVYYCAR | DPLRGYN------DPVMDY | WGQGT LVTVS S |
| iPS:4 35735 | 21-225_173H12 | VH3/3-33/D3/3-9/RF2/JH4 | QVQLVES-GGGVVQPGRSLRLSCAASG-FTFS | S------YGMH | WVRQAPGK GLEWVA | IIWYD----GTNKYYADS VKG | RFTISRDNSKNTLYLQLNSL RAEDTAVYYCAR | DPLRGYN------DPVMDY | WGQGT LVTVS S |
| iPS:4 35743 | 21-225_175G1 | VH3/3-33/D3/3-9/RF2/JH4 | QVQLVES-GGGVVQPGGSLRLSCAASG-FTFS | T------YGMH | WVRQAPGK GLEWMA | VIWYD----GTNKYYADS VKG | RFTISRDNSKNTLYLQMNSL RAEDTAVYYCAR | DPLRGYN------DPVMDY | WGQGT LVTVS S |
| iPS:4 35761 | 21-225_176B11 | VH3/3-33/D3/3-9/RF2/JH4 | QVQLVES-GGGVVQPGRSLRLSCAASG-FTFS | T------YGMH | WVRQAPGK GLEWVS | IIWYD----GTNKYYADS VKG | RFTISRDNSKNTLFLQLNSL RAEDTAVYYCAR | DPLRGYN------DPVLDY | WGQGT LVTVS S |
| iPS:4 35779 | 21-225_178B10 | VH3/3-33/D3/3-9/RF2/JH4 | EVQLVES-GGGVVQPGRSLRLSCVASG-FTSS | T------YGMH | WVRQAPGK GLEWMA | IIWYD----GTNKYYADS VKG | RFTISRDNSKNTLYLQLNSL RAEDTAVYYCAR | DPLRGYN------DPVMDY | WGQGT LVTVS S |
| | Germline | VH3/3-48/D2/2-15/RF3/JH6 | EVQLVES-GGGLVQPGGSLRLSCAASG-FTFS | S------HSMN | WVRQAPGK GLEWVS | YISSS----SSTIYYADS VKG | RFTISRDNAKNSLYLQMNSL RAEDTAVYYCAR | DITVVRA------YYYMDV | WGQGT TVTVS S |
| iPS:4 35667 | 21-225_169E3 | VH3/3-48/D2/2-15/RF3/JH6 | EVQLVES-GGGLVQPGGSLRLSCAASG-FTFS | G------HSMN | WVRQAPGK GLEWVA | YISLS----GSTIKYADS VKG | RFTISRDNARDSLYLQMNSL RDEDTAVYYCAR | RGITVVR------NEDGLDV | WGQGT TVTVS S |
| iPS:4 35673 | 21-225_169E6 | VH3/3-48/D2/2-15/RF3/JH6 | EVQLVES-GGGLVQPGGSLRLSCAASG-FTFS | G------HSMN | WVRQAPGK GLEWVA | YISIS----SSTIKYADS VKG | RFTISRDNARDSLYLQMNSL RDEDTAVYYCAR | RGITVVR------NEDGLDV | WGQGT TVTVS S |
| iPS:4 35759 | 21-225_176E6 | VH3/3-48/D2/2-15/RF3/JH6 | EVQLVES-GGGLVQPGGSLRLSCAASG-FTFS | G------HSMN | WVRQAPGK GLEWVA | YISIS----GSTIKYADS VKG | RFTISRDNAKDSLYLQMNSL RDEDTAVYYCAR | RGITVVR------NEDGLDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-59/D3/3-9/RF1/JH6 | | QVQLQES- GPGLVKPSETLSL | S-----YYWS | WIRQPPGK GLEWIG | RIYT----- SGSTNYNPS LKS | RVTMSVDTSKNQFSLKLSSV TAADTAVYFCAR | VGRYYPDLL----RYYYGMDV | WGQGT TVTVS S |
| iPS:4 35675 | 21-225_169D7 | VH4-59/D3/3-9/RF1/JH6 | QVQLQES- GPGLVKPSETLSL TCTVSG-GSIS | S-----YYWT | WIRQPAGK GLEWIG | RIYT----- SGSTNYNPS LKS | RVTMSVDTSKNQFSLKLSSV TAADTAVYFCAR | VGRYY--------YGMDV | WGQGT TVTVS S |
| iPS:4 35687 | 21-225_170H1 | VH4-59/D3/3-9/RF1/JH6 | QVQLQES- GPGLVKPSETLSL TCTVSG-GSIS | S-----YYWS | WIRQPAGK GLEWIG | RIYT----- SGSTNYNPS LKS | RVTMSVDTSKNQFSLKLSSV TAADTAVYFCAR | VGRYY--------YGMDV | WGQGT TVTVS S |
| | Germline | H_FR1 | H_CDR1 | H_FR2 | H_CDR2 | H_FR3 | H_CDR3 | H_FR4 |
| VH3/3-23/D4/4-23/RF2/JH4 | | EVQLLES- GGGLVQPGGSLRL SCAASG-FTFS | S-----YAMS | WVRQAPGK GLEWVS | AISGR----- GGTTYYADS VRG | RFTISRDNSKNTLFLQMNSL RAEDTAVYYCAR | DYGEN-------SYFDY | WGQGT LVTVS S |
| iPS:4 35711 | 21-225_171G4 | VH3/3-23/D4/4-23/RF2/JH4 | EVQLLES- GGDLVQPGGSLRL SCAASG-FTFS | S-----CAMT | WVRQAPGK GLEWVS | AISGR----- GGTTFYADS VRG | RFTISRDNSKNTLFLQMNSL RAEDTAVYYCAR | DLIGGA------TYFDY | WGQGT LVTVS S |
| iPS:4 35875 | 21-225_190B9 | VH3/3-23/D4/4-23/RF2/JH4 | EVQLLES- GGGLVQPGGSLRL SCAASG-FTFS | T-----YAMS | WVRQAPGK GLEWVS | AISRS----- GGNTHYADS VKG | RFTISRDNSKNTLYLQMNSL RAEDTAVYSCAK | DGFGGS------SYFDY | WGQGT LVTVS S |
| iPS:4 35909 | 21-225_190H3 | VH3/3-23/D4/4-23/RF2/JH4 | EVQLLES- GGGLVQPGGSLRL SCAASG-FTFS | S-----YAMS | WVRQAPGK GLEWVS | AISGR----- GGNTYYADS VKG | RFTISRDNSKNTLYLQMNSL RAEDTAVYSCAK | DGFGGS------SYFDY | WGQGT LVTVS S |
| iPS:4 36013 | 21-225_193F2 | VH3/3-23/D4/4-23/RF2/JH4 | EVQLLES- GGGLVQPGGSLRL SCAASG-FTFS | T-----FAMS | WVRQAPGK GLEWVS | AISRS----- GGNTHYADS VKG | RFTISRDNSKNTLYLQMNSL RAEDTAVYSCAK | DGFGGS------SYFDY | WGQGT LVTVS S |
| iPS:4 36100 | 21-225_195G12 | VH3/3-23/D4/4-23/RF2/JH4 | EVQLLES- GGGLVQPGGSLRL SCAASG-FTFS | T-----YAMS | WVRQAPGK GLEWVS | AISRS----- GGNTHYADS VKG | RFTISRDNSKNTLYLQMNSL RAEDTAVYSCAK | DGFGGS------SYFDY | WGQGT LVTVS S |
| | Germline | H_FR1 | H_CDR1 | H_FR2 | H_CDR2 | H_FR3 | H_CDR3 | H_FR4 |
| VH3/3-30.3/D1/1-7/RF2/JH6 | | EVQLVES- GGGLVQPGRSLRL SCAASG-FTFS | S-----YAMS | WVRQAPGK GLEWVA | VISYD----- GSNKYYADS VKG | RFTISRDNSKNTLYLQMNSL RAEDTAVYYCAR | V*LELE------SYGMDV | WGQGT TVTVS S |
| iPS:4 35713 | 21-225_171D7 | VH3/3-30.3/D1/1-7/RF2/JH6 | QVQLVES- RGGVVQPGRSLRL SCAASG-FTFS | S-----YGMH | WVRQAPGK GLEWVA | VISYD----- GNNRHYADS VQG | RFTISRDNSKNTLSLQMNSL GAEDTAVYYCAR | DRHRLD------YYALDV | WGQGT TVTVS S |
| | Germline | H_FR1 | H_CDR1 | H_FR2 | H_CDR2 | H_FR3 | H_CDR3 | H_FR4 |
| VH3/3-23/D5/5-24/RF3/JH3 | | EVQLLES- GGGLVQPGGSLRL SCAASG-FTFS | S-----YAMS | WVRQAPGK GLEWVS | AISGS----- GGSTYYADS VKG | RFTISRDNSKNTLYLQMNSL RAEDTAVYYCAK | EDGINY------DAFDI | WGQGT MVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35729 | 21-225_173E7 | VH3/3-23|D5|5-24|RF3/JH3 | EVQLLES-GGGSVQPGGSLRL SCAASG-FTFS | S-----YAMS | WVRQAPGK GLEWVS | FISGS----GGNTYYADS VKG | RFTISRDNSKNTLYLQMNSL QAEDTAVYYCTK | RDTYNG--------WDAFDI | WGQGT MVTVS S |
| iPS:4 35753 | 21-225_175G10 | VH3/3-23|D5|5-24|RF3/JH3 | EVQLLES-GGGLVQPGGSLRL SCAASG-FTFS | S-----YAMS | WVRQTPGK GLEWVS | IISGS----GGNTYYADS VKG | RFTISRDNSKNTLYLQMNSL RAEDTAVYYCAK | RDTWNG--------WDAFDI | WGQGT MVTVS L |
| iPS:3 93024 | 21-225_31H9 | VH3/3-23|D5|5-24|RF3/JH3 | EVQLLES-GGGLVQPGGSLRL SCAASG-FTFS | S-----CAMN | WVRQAPGK GLEWVS | AISGS----GGSSFYADS VKG | RFTISRDNSKNTLYLQMNSL RAEDTAVYYCAK | RTPYD---------VFDI | WGQGT MVTVS S |
| iPS:3 98474 | 21-225_17B10 | VH3/3-23|D5|5-24|RF3/JH3 | EVQLLES-GGGLVQPGGSLRL SCAASG-FTFR | S-----YAMS | WVRQAPGK GLEWVS | VISGS----GGNTYYADS VKG | RFTISRDNSKNTLYLQMDSL RAEDTAVYYCAK | RGIPEA--------DAFDI | WGQGT MVTVS S |
| | Germline | H_FR1 | H_CDR1 | H_FR2 | H_CDR2 | H_FR3 | H_CDR3 | H_FR4 |
| | VH1|1-02|D2|11-1|RF1/JH3 | QVQVVQS-GAEVKKPGASVKV SCKASG-YTFT | | WVRQAPGQ GLEWMG | WINPN----SGGTNCAQR FQG | RVTMTRDTSTSTAYMELSRL RSEDTAVYYCAR | SSSG---------DAFDI | WGQGT MVTVS S |
| iPS:4 35745 | 21-225_175G3 | VH1|1-02|D1|1-1|RF1/JH3 | QVQVVQS-GAEVKKPGASVKV SCKASG-YIFT | G-----YFMH | WVRQAPGQ GLEWMG | WIKPK----SGGTNCAQK FQG | RVTMTRDISITTAYMELSRL RSDDTAVYYCVR | GGTTVTT-------WGVFDY | WGQGT MVTVS S |
| iPS:4 37270 | 21-225_178H4 | VH1|1-02|D1|1-1|RF1/JH3 | QVQLVQS-GAEVKKPGASVKV SCKASG-YIFT | G-----YFMH | WVRQAPGQ GLEWMG | WIKPK----SGGTNCAQK FQG | RVTMTRDISITTAYMELSRL RSDDTAVYYCVR | GGTTVTT-------WGVFDY | WGQGT MVTVS S |
| | Germline | H_FR1 | H_CDR1 | H_FR2 | H_CDR2 | H_FR3 | H_CDR3 | H_FR4 |
| | VH3|3-23|D3|3-22|RF2/JH4 | EVQLLES-GGGLVQPGGSRRL SCAASG-FTFS | S-----YGMH | WVRQAPGK GLEWVA | VISGS----GSNKYYADS VKG | RFTISRDNSKNTLYLQMNSL RAEDTAVYYCAK | SSSG---------YYYFDY | WGQGT LVTVS S |
| iPS:4 35769 | 21-225_177B6 | VH3|3-23|D3|3-22|RF2/JH4 | EVQLLES-GGGLVQPGGSRRL SCAASG-FTFS | S-----YAMS | WVRQAPGK GLEWVS | VISGS----GSNTYYVDS VKG | RFTISRDNSKNTLNLQMNSL RAEBDSAVYYCTK | GYYDSSG-------YYYPFGP | WGQGT LVTVS S |
| | Germline | H_FR1 | H_CDR1 | H_FR2 | H_CDR2 | H_FR3 | H_CDR3 | H_FR4 |
| | VH3|3-33|D3|3-22|RF2/JH1 | EVQLVES-GGGVVQPGRSLRL SCAASG-FTFS | S-----YGMH | WVRQAPGK GLEWVA | VISYD----GSNKYYADS VKG | RFTISRDNSKNTLYLQMNSL RAEDTAVYYCAK | YYAEYFDH | WGQGT LVTVS S |
| iPS:4 35771 | 21-225_177B11 | VH3/3-33|D3|3-22|RF2/JH1 | QVQLVES-GGGVVQPGRSLRL TCAASG-FTFS | S-----YGMH | WVRQAPGK GLEWVA | IIWYD----GSYKYTDS VKG | RFTISRDNSKNTLYLQMNSL RAEDTAVYYCAR | ETYDFW--------SGYFVF | WGQGT LVTVS S |
| | Germline VH3|3-23|D5|5-24|RF3/JH4 | EVQLLES-GGGLVQPGGSLRL SCAASG-FTFS | S-----YAMS | WVRQAPGK GLEWVS | FISGS----GGSTYYADS VKG | RFTISRDNSKNTLYLQMNSL RAEDTAVYYCAR | YYFDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35775 | 21-225_178A5 | VH3|3-23|D5|5-24|RF3|JH4 | EVHLLES-GGGLVQTGGSLRL SCAASG-FTFS | S------YAMT | WVRQAPGK GLEWVS | VISGS---GGNTFYADS VKG | RFTISRDNSKNTLYLQMNSL RAEDTAVYYCAR | RDGD-------------YFDY | WGQGT LVTVS S |
| iPS:4 37214 | 21-225_48B12 | VH3|3-23|D5|5-24|RF3|JH4 | EVQLLES-GGGLVQPGGSLRL SCAASG-FTFS | S------YAMN | WVRQAPGK GLEWVS | AISGR---GGNTFYADS VKG | RFTISRDNSKNTLYLQMNSL RAEDTAVYYCAK | RETYNWN-------YEGFDY | WGQGT LVTVS S |
| iPS:3 93028 | 21-225_25D7 | VH3|3-23|D5|5-24|RF3|JH4 | EVQLLES-GGGLVQPGGSLRL SCAASG-FTFS | S------YAMS | WVRQTPGQ GLEWVS | AISGR---GGTTFYADS VKG | RFTISRDMSKNTLYLQMNSL RAEDTAVYYCAK | DGYGGN---------SFFDY | WGQGT LVTVS S |
| | Germline | | H_FR1 | H_CDR1 | H_FR2 | H_CDR2 | H_FR3 | H_CDR3 | H_FR4 |
| | VH3|3-33|D4|4-11|RF3|JH6 | | EVQLVES-GGGLVQPGRSLRL SCAASG-FTFS | S------YGMH | WVRQAPGK GLEWVA | VIWYD---GSNKYADS VKG | RFTISRDNSKNLYLQMNSL RAEDTAVYYCAR | LVTVS------VYGMDV | WGQGT TVTVS S |
| iPS:4 35789 | 21-225_180C4 | VH3|3-33|D4|4-11|RF3|JH6 | QVQLVES-GGGLVQPGRSLRL SCAASG-FTFS | A------YGMH | WVRQAPGK GLEWVT | IIWYD---GSYKYADS VKG | RFAISRDNSKNTLYLQMNSL RAEDTAVYYCAR | TGVDPRD-------YYNGMDV | WGQGT TVTVS S |
| | Germline | | H_FR1 | H_CDR1 | H_FR2 | H_CDR2 | H_FR3 | H_CDR3 | H_FR4 |
| | VH3|3-23|D2|2-8|RF1|JH3 | | EVQLLES-GGGLVQPGGSLRL SCAASG-FTFS | S------YAMS | WVRQAPGK GLEWVS | AISGS---GGTTYADS VKG | RFTISRDMSKNTLYLQMNSL RAEDTAVYYCAR | RILYNM-------LDAFDI | WGQGT MVTVS S |
| iPS:4 35799 | 21-225_181G3 | VH3|3-23|D2|2-8|RF1|JH3 | EVQLLES-GGGLVQPGGSLRL SCAASG-FTFS | S------YAMS | WVRQAPGK GLEWVS | VISGS---GGNTFYGDS VKG | RFTISRDNSKNTLYLQMNSL RAEDTAVYYCAR | RETYDNG---------SDAFDI | WGQGT MVTVS S |
| | Germline | | H_FR1 | H_CDR1 | H_FR2 | H_CDR2 | H_FR3 | H_CDR3 | H_FR4 |
| | VH3|3-30.3|D5|5-18|RF2|JH6 | | EVQLVES-GGGLVQPGRSLRL SCAASG-FTFS | S------YAMH | WVRQAPGK GLEWVA | VISYD---GSNKYADS VKG | RFTISRDNSKNTLYLQMNSL RAEDTAVYYCAR | WQMFL-------VYYGMDV | WGQGT TVTVS S |
| iPS:4 35811 | 21-225_183H6 | VH3|3-30.3|D5|5-18|RF2|JH6 | QVQLVES-GGGLVQPGRSLRL SCAASG-FTFS | S------YGMH | WVRQAPGK GLEWVA | IISYA---GSTKFYADS VKG | RFTISRDNSKNTLYLQMNSL RAEDTAVYYCVR | REPQWLV---------EGYGMDV | WGQGT TVTVS S |
| iPS:4 36754 | 21-225_155G3 | VH3|3-30.3|D5|5-18|RF2|JH6 | QVQLVES-GGGVVQPGRSLRL SCAASG-FTFS | S------YGMH | WVRQAPGK GLEWVA | VISYD---GSNKYADS VKG | RFTISRDMSKNTLYLQMNSL RAEDTAVYYCAR | DTERWLP---------VSYGMDV | WGQGT TVTVS S |
| iPS:4 48908 | 21-225_50G9 | VH3|3-30.3|D5|5-18|RF2|JH6 | QVQLVES-GGGVVQPGRSLRL SCTASG-FTFS | S------YGMH | WVRQAPGK GLEWVA | VISQD---GIIRYADS VKG | RFTISRDNSKNTLYLQMNSL RAEDTAVYYCAR | DVKQWLV---------RTYGMDV | WGQGT TVTVS S |
| | Germline | | H_FR1 | H_CDR1 | H_FR2 | H_CDR2 | H_FR3 | H_CDR3 | H_FR4 |
| | VH3|3-30.3|D6|6-19|RF1|JH5 | | QVQLVES-GGGVVQPGRSLRL SCAASG-FTFS | S------YAMH | WVRQAPGK GLEWVA | VISYD---GSNKYADS VKG | RFTISRDNSKNTLYLQMNSL RAEDTAVYYCAR | GYSSGW-------NWFDP | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35813 | 21-225_183A12 | VH3J3-30.3/D6|6-19|RF1/J H5 | QVQLVES-GGGVVQPGRSLRL SCAASG-FTFS | S-----YGMH | WVRQAPGK GLEWVA | VISSA----GSNKYYADS VKG | RFTISRDNGKNTLYLQMNSL RAEDTAVYYCAR | RYSSGW------DWFDP | WGQGT LVTVS S |
| | | Germline VH3J3-21|D3J3-10|RF3/J H4 | QVQLVES-GGGLVKPGGSLRL SCAASG-FTFS | S-----YSMN | WVRQAPGK GLEWVS | SISSG----SGYIHYADS VKG | RFTISRDNAKNSLYLQMNSL RAEDTAVYYCAR | TYRSGY------LVTEV | WGQGT LVTVS S |
| iPS:4 35815 | 21-225_190G10 | VH3J3-21|D3J3-10|RF3/J H4 | EVQLVES-GGGLVKPGGSLRL SCAASG-FTFR | D-----YSMN | WVRQAPGK GLEWVS | SISSG----SGYIHYADS VKG | RFTISRDNAKNSLYLQMNSL RAEDTAVYYCAR | ATMA--------LDY | WGQGA LVTVS S |
| iPS:4 35865 | 21-225_191A5 | VH3J3-21|D3J3-10|RF3/J H4 | EIQVVES-GGGLVKPGGSLRL SCAASG-FTFR | D-----YSMN | WVRQAPGK GLEWVS | SISSG----SGYIYYADS VKG | RFTISRDNAKNSLYLQMNSL RAEDTAVYYCAR | ATMA--------LDY | WGQGT LVTVS S |
| iPS:4 36047 | 21-225_193B10 | VH3J3-21|D3J3-10|RF3/J H4 | EVQLVES-GGGLVKPGGSLRL SCAASG-FTFR | D-----YSMN | WVRQAPGK GLEWVS | SISSA----GGYIYYADS LKG | RFTISRDNAKNSLYLQMNSL RAEDTAVYYCAR | ATMA--------LDY | WGQGT LVTVS S |
| iPS:4 36122 | 21-225_196G10 | VH3J3-21|D3J3-10|RF3/J H4 | EVQLVES-GGGLVKPGGSLRL SCAASG-FTFR | D-----YSMN | WVRQAPGK GLEWVS | SISSG----SGYIHYADS VKG | RFTISRDNGKNSLYLQMNSL RAEDTAVYYCAR | ATMA--------LDY | WGQGT LVTVS S |
| | | H_FR1 | H_CDR1 | H_FR2 | H_CDR2 | H_FR3 | H_CDR3 | H_FR4 |
| | Germline VH4|4-59|D4|4-17|RF2|J H6 | QVQLQES-GPGLVKPSETLSL TCTVSG-GSIN | S-----YYWS | WIRQPPGK GLEWIG | YIYY----SGSTNYNPS LKS | RVTISVDTSKNQFSLKLSSV TAADTAVYYCAR | DYGYY------YYGMDV | WGQGT LVTVS S |
| iPS:4 35817 | 21-225_190B11 | VH4|4-59|D4|4-17|RF2|J H6 | QVQLQES-GPGLVKPSETLSL TCTVSG-GSIN | N-----YYWS | WIRQPAGK GLEWIG | RIYT----SGSTNYNPS LKS | RVTMSVDTSKNQFSLKLSSV TAADTAVHYCAR | DRGYYG------YYGMDV | WGQGT TVTVS S |
| iPS:4 35917 | 21-225_190D5 | VH4|4-59|D4|4-17|RF2|J H6 | QVQLQES-GPGLVKPSETLSL TCTVSG-GSIN | N-----YYWS | WIRQPAGK GLEWIG | RIYA----SGSTNYNPS LKS | RVTMSVDTSKNQFSLKLSSV TAADTAVYYCAR | DRGYYG------YYGMDV | WGQGA TVTIS S |
| iPS:4 36056 | 21-225_194C3 | VH4|4-59|D4|4-17|RF2|J H6 | QVQLQES-GPGLVKPSETLSL TCTVSG-GSIN | N-----YYWS | WIRQPAGK GLEWIG | RIYA----SGSTNYNPS LKS | RVTMSIDTSKNQFSLKLSSV TAADTAVHYCAR | DRGYYG------YYGMDV | WGQGT TVTIS S |
| iPS:4 36220 | 21-225_200F8 | VH4|4-59|D4|4-17|RF2|J H6 | QVQLQES-GPGLVKPSETLSL TCTVSG-GSIN | N-----YYWS | WIRQPAGK GLEWIG | RIYT----SGSTNYNPS LKS | RVTMSVDTSKNQFSLKLSSV TAADTAVYYCAR | DRGYYG------YYGMDV | WGQGT TVTVS S |
| | | H_FR1 | H_CDR1 | H_FR2 | H_CDR2 | H_FR3 | H_CDR3 | H_FR4 |
| | Germline | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35821 | 21-225_190E11 | VH3/3-30/D4/4-17/RF2/JH6 | QVQLVES-GGGVVQPGRSRL SCTASG-FTFS | N-----YGMH | WVRQAPGK GLEWVA | IIWFD----GSNRYYADS VKG | RFTISRDNSKNTLYLQMNSL RAEDTAVYYCAK | AGGVYY------YVMDV | WGQGT TVTVS S |
| | VH3/3-23/D5/5-12/RF3/JH5 | Germline | EVQLLES-GGGLVQPGGSLRL SCAASG-FTFS | ---------YAMS | WVRQAPGK GLEWVS | AISGS----SGSTYYADS VKG | RFTISRDNSKNTLYLQMNSL RAEDTAVYYCAK | GYYYDS------SGWFDP | WGQGT LVTVS S |
| iPS:4 35823 | 21-225_190F11 | VH3/3-23/D5/5-12/RF3/JH5 | EVQLLDS-GGGLGQPGGSLRL SCAASG-FTFD | S-----YAMN | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35867 | 21-225_191E5 | VH3/3-23/D5/5-12/RF3/JH5 | EVQLLDS-GGGLGQPGGSLRL SCAASG-FTFD | S-----YAMN | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35929 | 21-225_190D9 | VH3/3-23/D5/5-12/RF3/JH5 | EVQLLDS-GGGLGQPGGSLRL SCAASG-FTFD | S-----YAMS | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| iPS:4 35935 | 21-225_190H8 | VH3/3-23/D5/5-12/RF3/JH5 | GVQLLDS-GGGLGQPGGSLRL SCAASG-FTFD | S-----YAMS | WVRQAPGK GLEWVS | TISGT----GRRTYYADS VKG | RFTISRDNSKNTLYLQMNSL RAEDTAVYYCAK | EEDYYDS------SGPGFDP | WGQGT LVTVS S |
| | VH4/4-39/D3/3-9/RF1/JH4 | Germline | QLQLQES-GPGLVKPSETLSL TCTVSG-GSIR | S-----SYYWS | WIRQPPGK GLEWIG | SIYY----SGSTYYNPS LKS | RVTISVDTSKNQFSLKLSSV TAADTAVYYCAR | VRYYYY------YFDY | WGQGT LVTVS S |
| iPS:4 35827 | 21-225_190H11 | VH4/4-39/D3/3-9/RF1/JH4 | QLQLQES-GPGLVKPSETLSL TCTVSG-GSIR | S-----YHWS | WIRQPAGK GLEWIG | LIYT----SRSTYNPS LKS | RVTLSVDTSKNQFSLKLSSV TAADTAVYYCAR | LRYNWN------FPYFDY | WGQGT LVTVS S |
| iPS:4 35853 | 21-225_191E3 | VH4/4-39/D3/3-9/RF1/JH4 | QLQLQES-GPGLVKPSETLSL TCTVSG-GSIR | S-----YHWS | WIRQPAGK GLEWIG | LIYT----SRSTNNPS LKS | RVTMSVDTSKNQFSLKLNSV TAADTAVYYCAR | LRYNWN------FPYFDY | WGQGT LVTVS S |
| iPS:4 35871 | 21-225_191E6 | VH4/4-39/D3/3-9/RF1/JH4 | QLQLQES-GPGLVKPSETLSL TCTVSG-GSIR | S-----YHWS | WIRQPAGK GLEWIG | LIYT----SRSTNNPS LKS | RVTMSVDTSKNQFSLKLNSV TAADTAVYYCAR | LRYNWN------FPYFDF | WGQGT LVTVS S |
| iPS:4 35927 | 21-225_190E7 | VH4/4-39/D3/3-9/RF1/JH4 | QLQLQES-GPGLVKPSETLSL TCTVSG-GSIR | S-----YHWS | WIRQPAGK GLEWIG | HIYT----SRSTNNPS LKS | RVTISVDTSKNQFSLKLSSV TAIDTAVYYCAR | LRYNWN------FPYFDY | WGQGT LVTVS S |
| iPS:4 35999 | 21-225_192F9 | VH4/4-39/D3/3-9/RF1/JH4 | QLQLQES-GPGLVKPSETLSL TCTVSG-GSIR | S-----YHWS | WIRQPAGK GLEWIG | LIYT----SRSTNNPS LKS | RVTMSVDTSKNQFSLKLNSV TAADTAVYYCAR | LRYNWN------FPYFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36060 | 21-225_194F4 | VH4|4-39|D3|3-9|RF1|JH4 | QLQLQES-GPGLVKPSETLSL TCTVSG-GSIS | S-----YHWS | WIRQPAGK GLEWIG | LIYT---- SRSTNYNPS LKS | RVTMSVDRBKSQFSLKLSSV TAADTAVYYCAR | LRYNWN------ ------FPYFDY | WGQGT LVTVS S |
| iPS:4 36193 | 21-225_198A10 | VH4|4-39|D3|3-9|RF1|JH4 | QLQLQES-GPGLVKPSETLSL TCTVSG-GSIR | S-----YHWS | WIRQPAGK GLEWIG | HIYT---- SRSTNYNPS LKS | RVTISVDTSKNQFSLKLSSV TATDTAVYYCAR | LRYNWN------ ------FPYFDY | WGQGT LVTVS S |
| | Germline | | H_FR1 | H_CDR1 | H_FR2 | H_CDR2 | H_FR3 | H_CDR3 | H_FR4 |
| | VH4|4-30.1|D5|5-24|RF3|JH2 | | QLQLQES-GPGLVKPSQTLSL TCTVSG-GSIS | SG---GYYWS | WIRQHPGK GLEWIG | YIYY---- SGSTYYNPS LKS | RVTISVDTSKNQFFLKLNSV TAADTAVYYCAR | | |
| iPS:4 35829 | 21-225_190B12 | VH4|4-30.1|D5|5-24|RF3|JH2 | QVQLQES-GPGLVKPSQTLSL TCTVSG-GSIS | SG---GYYWN | WIRQHPGK GLEWIG | YIYY---- SGSTYYNPS LKS | RVTISVDTSKNQFFLKLNSV TAADTAVYYCAR | SGYNWD------ ------AGVDP | WGRGI LVTVS S |
| | Germline | | H_FR1 | H_CDR1 | H_FR2 | H_CDR2 | H_FR3 | H_CDR3 | H_FR4 |
| | VH3|3-33|D4|4-11|RF2|JH6 | | QVQLVES-GGGVVQPGRSLRL SCAASG-FTFS | | | | | | |
| iPS:4 35835 | 21-225_190F12 | VH3|3-33|D4|4-11|RF2|JH6 | QVQLVES-GGGVVQPGRSLRL SCAASG-FTFR | N-----YGMH | WVRQAPGK GLEWVA | VIWFD---- GSNDYADS VKG | RFTISRDNSKNTLSLQMNSL RAEDTAVYYCAR | DRSVGY------ ------DGLDV | WGQGT TVTVS S |
| iPS:4 35861 | 21-225_190A5 | VH3|3-33|D4|4-11|RF2|JH6 | QVQLVES-GGGVVQPGRSLRL SCAASG-FTFS | S-----YGMH | WVRQAPGK GLEWVA | VIWYD---- GSNKNYADS VKG | RFTISRDNSKNTLYLQMNSL RAEDTAVYYCAR | DFSVGY------ ------DGMDV | WGQGT TVTVS S |
| iPS:4 35937 | 21-225_190H9 | VH3|3-33|D4|4-11|RF2|JH6 | QVQLVES-GGGVVQPGRSLRL SCAASG-FTFR | N-----YGMH | WVRQAPGK GLEWVA | VIWYD---- GSNDYADS VKG | RFTISRDNSKNTLSLQMNSL RAEDTAVYYCAR | DRSVGY------ ------DGLDV | WGQGT TVTVS S |
| iPS:4 35977 | 21-225_192E4 | VH3|3-33|D4|4-11|RF2|JH6 | QVQLVES-GGGVVQPGRSLRL SCAASG-FTFS | S-----YGMH | WVRQAPGK GLKWVA | VIWFD---- GSNKNYADS VKG | RFTISRDNSKNTLYLQMNSL RAEDTAVYYCAR | DRSVGY------ ------DGMDV | WGQGT TVTVS S |
| iPS:4 36001 | 21-225_192C10 | VH3|3-33|D4|4-11|RF2|JH6 | QVQLVES-GGGVVQPGRSLRL SCAASG-FTFR | N-----YGMH | WVRQAPGK GLEWVA | VIWYD---- GSNDYADS VKG | RFTISRDNSKNTLSLQMNSL RAEDTAVYYCAR | DRSVGY------ ------DGLDV | WGQGT TVTVS S |
| iPS:4 36066 | 21-225_194B7 | VH3|3-33|D4|4-11|RF2|JH6 | QVQLVES-GGGVVQPGRSLRL SCAASG-FTFS | S-----YGMH | WVRQAPGK GLEWVA | VIWYD---- GSNKNYADS VKG | RFTISRDNSKNTLYLQMNSL RAEDTAVYYCAR | DRSKGY------ ------DGMDV | WGQGT TVTVS S |
| iPS:4 36078 | 21-225_194H12 | VH3|3-33|D4|4-11|RF2|JH6 | QVQLVES-GGGVVQPGRSLRL SCAASG-FTFR | N-----YGMH | WVRQAPGK GLEWVA | VIWFD---- GSNDYADS VKG | RFTISRDNSKNTLSLQMNSL RAEDTAVYYCAR | DRSVGY------ ------DGLDV | WGQGT TVTVS S |

Figure 51 (Continued)

| | | | | | | | | |
|---|---|---|---|---|---|---|---|---|
| iPS:4 36140 | 21-225_197G3 | VH3/3-33/D4/4-11/RF2/JH6 | QVQLVES-GGGVVQPGRSLRLSCVASG-FTFS | S-----HGMH | WVRQAPGKGLEWVA | VIWYD----GSNKNYADSVKG | RFTISRDNSKNTLYLQMNSLRAEDTAVYYCAR | DPSVGY-------DGMDV | WGQGTTVTVSS |
| iPS:4 36167 | 21-225_197E11 | VH3/3-33/D4/4-11/RF2/JH6 | QVQLVES-GGGVVQPGRSLRLSCAASG-FTFR | N-----YGMH | WVRQAPGKGLEWVA | VIWFD----GSNDYYADSVKG | RFTISRDNSKNTLSLQMNSLRAEDTAVYYCAR | DRSVGY-------DGLDV | WGQGTTVTVSS |
| iPS:4 36292 | 21-225_205H3 | VH3/3-33/D4/4-11/RF2/JH6 | QVQLVES-GGGVVQPGRSLRLSCAASG-FTFS | S-----YGMH | WVRQAPGKGLEWVA | VIWYD----GSNKYYADSVKG | RFTISRDNSKNTLYLQMNSLRAEDTAVYYCAR | DRSVGY-------DGIDV | WGQGTTVTVSS |
| iPS:4 36802 | 21-225_171E12 | VH3/3-33/D4/4-11/RF2/JH6 | QVQLVES-GGGVVQPGRSLRLSCAASG-FTFS | S-----YGMH | WVRQAPGKGLEWVA | VIWND----GSNKYNGDSVKG | RFTISRDNSKNTLYLQMNSLRAEDTAVYYCAR | DRTYYSGSGSF---PYYYYGMDV | WGQGTTVTVSS |
| iPS:4 36816 | 21-225_179H5 | VH3/3-33/D4/4-11/RF2/JH6 | QVQLVES-GGGVVQPGRSLRLSCAASG-FTFS | S-----YGMH | WVRQAPGKGLEWVA | VIWHD----GSNEYYADSVKG | RFTISRDNSKNTLYLQMNSLRAEDTAVYYCAR | DIRNYY-------YGLDV | WGQGTTVTVSS |
| iPS:4 36960 | 21-225_198D2 | VH3/3-33/D4/4-11/RF2/JH6 | QVQLVES-GGGVVQPGRSLRLSCAASG-FTFS | S-----YGMH | WVRQAPGKGLEWVA | VIIYD----GSYKYYADSVKG | RFTISRDNSKNTLYLQMNSLRAEDTAVYYCAR | TYSG---------GMDV | WGQGTTVTVSS |
| iPS:4 36974 | 21-225_190H7 | VH3/3-33/D4/4-11/RF2/JH6 | QVQLVES-GGGVVQPGRSLRLSCAASG-PNFR | S-----YGMH | WVRQAPGKGLEWVA | VIIYD----GSYKYYADSVKG | RFTISRDNSKNTLYLQMNSLRAEDTAVYYCAR | TYSG---------GMDV | WGQGTTVTVSS |
| iPS:4 36982 | 21-225_190D10 | VH3/3-33/D4/4-11/RF2/JH6 | QVQLVES-GGGVVQPGRSLRLSCAASG-FTFR | S-----YGMH | WVRQAPGKGLEWVA | VIIYD----GSYKYYADSVKG | RFTISRDNSKNTLYLQMNSLRAEDTAVYYCAR | TYSG---------GMDV | WGQGTTVTVSS |
| iPS:4 37274 | 21-225_196D4 | VH3/3-33/D4/4-11/RF2/JH6 | QVQLVES-GGGVVQPGRSLRLSCAASG-FTFS | S-----YGMH | WVRQAPGKGLEWVA | VIWYD----GSNRNYADSVKG | RFTISRDNSKNTLYLQMNSLRVEDTAVYYCAR | DRSKGY-------DGMDV | WGQGTTVTVSS |
| iPS:3 92664 | 21-225_20F6 | VH3/3-33/D4/4-11/RF2/JH6 | QVQLVES-GGGVVQPGRSLRLSCAASG-FTFS | S-----YGMH | WVRQAPGKGLEWGA | VIWHD----GSNKYYADSVKG | RFTISRDNAKNTLYLQMNSLRAEDTAVYYCAR | DLSMG--------GMDV | WGQGTTVTVSS |
| iPS:3 92738 | 21-225_18G4 | VH3/3-33/D4/4-11/RF2/JH6 | QVQLVES-GGGVVQPGRSLRLSCAASG-FTFS | S-----YGMH | WVRQAPGKGLEWGA | IIWYD----GSNKYYADSVKG | RFTISRDNSKNTLYLQMNSLRAEDTAVYYCAR | DLSMG--------GMDV | WGQGTTVTVSS |
| iPS:3 92798 | 21-225_22C7 | VH3/3-33/D4/4-11/RF2/JH6 | QVQLVES-GGGVVQPGRSLRLSCAASG-FTFS | S-----YGMH | WVRQAPGKGLEWGA | VIWHD----GSNKYYADSVKG | RFTISRDNAKNTLYLQMNSLRAEDTAVYYCAR | DLSMG--------GMDV | WGQGTTVTVSS |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92956 | 21-225_27A11 | VH3J3-33/D4J4-11/RF2/JH6 | QVQLVES-GGGVVQPGRSLRLSCAASG-FTFS | S------YGMH | WVRQAPGK GLEWVA | VIWYD----GSNKYADS VKG | RFTISRDNSKNTLYLQMNSL RAEDTAVYHCAR | DSSPY--------GMDV | WGQGT TVTVS S |
| iPS:3 92994 | 21-225_26G11 | VH3J3-33/D4J4-11/RF2/JH6 | QVQLVES-GGGVVQPGRSLRLSCAASG-FTFS | S------YGMH | WVRQAPGK GLEWVA | VIWYD----GSNKYADS VKG | RFTISRDNSKNTLYLQMNSL RAEDTAVYYCAR | RYSNSW------SGGMDV | WGQGT TVTVS S |
| iPS:3 93014 | 21-225_26D12 | VH3J3-33/D4J4-11/RF2/JH6 | QVQLVES-GGGVVQPGRSLRLSCAASG-FTFS | S------YGMH | WVRQAPGK GLEWVA | VIWYD----GSNEYYADS VKG | RFTISRDNSKNTLYLQMNSL RAADTAVYYCAR | DSSPY--------GMDV | WGQGT TVTVS S |
| iPS:3 93152 | 21-225_25B3 | VH3J3-33/D4J4-11/RF2/JH6 | QVQLVES-GGGVVQPGRSLRLSCAASG-FTFS | S------YGMH | WVRQAPGK GLEWVA | VIWYD----GSNKYADS VKG | RFTISRDNSKNTLYLQMNSL RAEDTAVYYCAR | DSSPY--------GMDV | WGQGT TVTVS S |
| iPS:3 93840 | 21-225_3F8 | VH3J3-33/D4J4-11/RF2/JH6 | QVQLVES-CGGVVQPGRSLRLSCAASG-FTFS | S------YGMH | WVRQAPGK GLEWVA | VIWYD----GSNKYADS VKG | RFTISRDNARNTLYLQMNSL RAEDTAVYYCAR | DLSMG--------GMDV | WGQGT TVTVS S |
| iPS:3 93930 | 21-225_7E11 | VH3J3-33/D4J4-11/RF2/JH6 | QVQLVES-GGGVVQPGRSLRLSCAASG-FTFS | S------FGMH | WVRQAPGK GLEWVA | IIWHD----GSNKYADS VKG | RFTISRDNSNTLYLQMNSL RAEDTAVYYCAR | DLSMG--------GMDV | WGQGT TVTVS S |
| iPS:3 93964 | 21-225_6G1 | VH3J3-33/D4J4-11/RF2/JH6 | QVQLVES-GGGVVQPGRSLRLSCAASG-FTFS | S------YGMH | WVRQAPGK GLEWVA | IIWYD----GSNKYADS VKG | RFTISRDNSKNTLYLQMNSL RAEDTAVYYCAR | DLSMG--------GMDV | WGQGT TVTVS S |
| iPS:3 94012 | 21-225_15A3 | VH3J3-33/D4J4-11/RF2/JH6 | QVQLVES-GGGVVQPGRSLRLSCAASG-FTFS | S------YGIH | WVRQAPGK GLEWVA | VIWHD----GSNKYADS VKG | RFTISRDNSKNTLYLQMNSL RAEDTAMYYCAR | DLSMG--------GMDV | WGQGT TVTVS S |
| iPS:3 94016 | 21-225_13D4 | VH3J3-33/D4J4-11/RF2/JH6 | QVQLVES-GGGVVQPGRSLRLSCAASG-FTFS | S------YGMH | WVRQAPGK GLEWVA | VIWHD----GSNKYADS VKG | RFTISRDNSKNTILNLQMNSL RAEDTAVYYCAR | DLSMG--------GMDV | WGQGT TVTVS S |
| iPS:3 94083 | 21-225_16E6 | VH3J3-33/D4J4-11/RF2/JH6 | QVQLVES-GGGVVQPGRSLRLSCAASG-FTFS | S------YGMH | WVRQAPGK GLEWVA | VIWHD----GSNKYVDS VKG | RFTISRDNSKNTLNLQMNSL RAEDTAVYYCAR | DLSMG--------GMDV | WGQGT TVTVS S |
| VH4J4-59/D3J3-9/RF1/JH4 | | Germline | QVQLQES-GPGLVKPSETLSL TCTVSG-GSIS | S------YHWS | WIRQPAGK GLEWIG | HIYT----SGSTKYNPS LKS | RVTMSVDTSKNQFSLKLSSV TAADTAVYCAR | | |
| iPS:4 35339 | 21-225_191B1 | VH4J4-59/D3J3-9/RF1/JH4 | QVQLQES-GPGLVKPSETLSL TCTVSG-GSIS | S------YHWS | WIRQPAGK GLEWIG | HIYT----SGSTKYNPS LKS | RVTMSVDTSKNQFSLKLSSV TAADTAVYYCAR | LRYNWN------FFFFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36158 | 21-225_197G8 | VH4/4-59/D3/3-9/RF1/JH4 | QVHLQES-GPGLVKPSETLSL TCTVSG-GSIS | A------YSWS | WIRQPAGK GLEWIG | RLSP----GGSTNFNPS LKS | RVTMSVDTSKNQFSLRLSSV TAADTAVYYCAR | LRYNWN------FPYFDY | WGQGA LVTVS S |
| | | Germline | QVQLQES-GPGLVKPSQTLSL TCTVSG-GSIS | SG---GYYWS | WIRQHPGK GLEWIG | YIFY----SGSTYYNPS LKS | RVTISVDTSKNQFSLKLSSV TAADTAVYYCAR | YYYDSSGXY------YYYYGMDV | WGQGT TVTVS S |
| | | VH4/4-30.1/D3/3-22/RF2/JH6 | | | | | | | |
| iPS:4 35843 | 21-225_191F1 | VH4/4-30.1/D3/3-22/RF2/JH6 | QVQLQES-GPGLVKPSQTLSL TCTVSG-GSIS | SG---GYYWN | WIRQHPGK GLEWIG | YIFY----SGSTYYNPS LKS | RVTISVDTSKNQFSLKLSSV TAADTAVYYCAR | GDYDGSGSY------HYYYGMDV | WGQGT TVTVS S |
| iPS:4 35847 | 21-225_191A3 | VH4/4-30.1/D3/3-22/RF2/JH6 | QVQLQES-GPGLVKPSQTLSL TCTVSG-GSIS | SG---DYYWN | WIRQHPGK GLEWIG | YIFY----SGSTYYNPS LKS | RVTISVDTSKNQFSLKLSSV TAADTAVYYCAR | GDYDGSGSY------HYYYGMDV | WGQGT TVTVS S |
| iPS:4 35851 | 21-225_191D3 | VH4/4-30.1/D3/3-22/RF2/JH6 | QVQLKES-GPGLVKPSQTLSL TCTVSG-GSIS | SG---DYYWN | WIRQHPGK GLEWIG | YIFY----SGSTYYNPS LKS | RVTISVDTSKNQFSLKLSSV TAADTAVYYCAR | GDYDGSGSY------HYYYGMDV | WGQGT TVTVS S |
| iPS:4 35905 | 21-225_190A3 | VH4/4-30.1/D3/3-22/RF2/JH6 | QVQLQES-GPGLVKPSQTLSL TCTVSG-GSIS | SG---GYYWN | WIRQHPGK GLEWIG | FIFY----SGSTYYNPS LKS | RVTISVDTSKNQFSLKLSSV TAADTAVYYCAR | GDYDGSGSY------HYYYGMDV | WGQGT TVTVS S |
| iPS:4 35911 | 21-225_190B4 | VH4/4-30.1/D3/3-22/RF2/JH6 | QVQLQES-GPGLVKPSQTLSL TCTVSG-GSIS | SG---DYYWN | WIRQHPGK GLEWIG | YIFY----SGSTYYNPS LKS | RIIISVDTSKNQFSLKLSSV TAADTAVYYCAR | GDYDGSGSY------HYYYGMDV | WGQGT TVTVS S |
| iPS:4 35913 | 21-225_190A7 | VH4/4-30.1/D3/3-22/RF2/JH6 | QVQLQES-GPGLVNPSQTLSL TCTVSG-GSIS | SG---VYYWS | WIRQHPGK GLEWIG | NIYY----SGSTYYNPS LKS | RVTISVDTSKNQFSLKLSSV TAADTAVYYCAR | GDYDGSGSY------HYYGLDV | WGQGT TVTVS S |
| iPS:4 35939 | 21-225_191H7 | VH4/4-30.1/D3/3-22/RF2/JH6 | QVQLQES-GPGLVKPSQTLSL TCTVSG-GSIS | SG---DYYWN | WIRQHPGK GLEWIG | YIFY----SGSTYYNPS LKS | RVTISVDTSKNQFSLKLSSV TVADTAVYYCAR | GDYDGSGSY------HYYYGMDV | WGQGT TVTVS S |
| iPS:4 35967 | 21-225_192B3 | VH4/4-30.1/D3/3-22/RF2/JH6 | QVQLQES-GPGLVKPSQTLSL TCTVSG-GSIS | SG---DYYWN | WIRQRPGK GLEWIG | FIFY----SGSTYYNPS LKS | RVTISVDTSKNQFSLKLSSV TAADTAVYYCAR | GDYDGSGSY------HHYYGMDV | WGQGT TVTVS S |
| iPS:4 35973 | 21-225_192H3 | VH4/4-30.1/D3/3-22/RF2/JH6 | QVQLQES-GPGLVKPSQTLSL TCTVSG-GSIS | SV---SYYWS | WIRQHPGK GLEWIG | NLYY----SGSTYYNPS LRS | RATISVDTSKNQFSLKLSSV TAADTAVYYCTR | GDYDGSGSY------HYYHGMDV | WGQGT TVTVS S |
| iPS:4 36007 | 21-225_192G12 | VH4/4-30.1/D3/3-22/RF2/JH6 | QVQLQES-GPGLVKPSQTLSL TCTVSG-GSIS | SG---VYHWS | WIRQHPGK GLEWIG | NIHY----SGSTYNNPS LKS | RVTISVDTSKNQFSLKLSSV TAADTAVYYCAR | GDYDGSGSY------HYYYGMDV | WGQGT TVTVS S |

Figure 51 (Continued)

| | | | | | | | | | |
|---|---|---|---|---|---|---|---|---|---|
| iPS:4 36009 | 21-225_193A1 | VH4/4-30.1/D3/3-22/RF2/J H6 | QVQLQES-GPGLVKPSQTLSL TCTVSG-GSIS | SG----VYYWS | WIRQHPGK GLEWIG | NIYY----SGSTYNNPS LKS | RLTISADTSKNQFSLKLSSV TAADTAVYYCAR | GDYDGSGSY-------HYYGMDV | WGQGT TVTVS S |
| iPS:4 36011 | 21-225_193B1 | VH4/4-30.1/D3/3-22/RF2/J H6 | QVQLQES-GPGLVKPSQTLSL TCTVSG-GSIS | SG----VYYWS | WIRQHPGK GLEWIG | NIYY----SGSTYNNPS LKS | RVTISVDTSKNQFSLKLSSV TAADTAVYYCAR | GDYDGGSY--------HYYGMDV | WGQGT TVTVS S |
| iPS:4 36017 | 21-225_193F3 | VH4/4-30.1/D3/3-22/RF2/J H6 | QVQLQES-GPGLVKPSQTLSL TCTVSG-GSIN | SG----DYYWN | WIRQHPGK GLEWIG | YIFY----SGSTYYNPS LKS | RVTISVDTSKNQFSLKLSSV TAADTAVYYCAR | GDYDGSGSY-------HYYYGMDV | WGQGT TVTVS S |
| iPS:4 36029 | 21-225_193H6 | VH4/4-30.1/D3/3-22/RF2/J H6 | QVQLQES-GPGLVKPSQTLSL TCTVSG-GSIN | SG----DYYWN | WIRQHPGK GLEWIG | YIFY----SGSTYYNPS LKS | RVTISVDTSKNQFSLKLSSV TAADTAVYYCAR | GDYDGSGSY-------HYYYGMDV | WGQGT TVTVS S |
| iPS:4 36035 | 21-225_193C8 | VH4/4-30.1/D3/3-22/RF2/J H6 | QVQLQES-GPGLVKPSQTLSL TCTVSG-GSIN | SG----DYYWN | WIRQHPGK GLEWIG | YIFY----SGSTYYNPS LKS | RVSISVDTSKNQFSLKLSSV TAADTAVYYCAR | GDYDGSGSY-------HYYYGMDV | WGQGT TVTVS S |
| iPS:4 36037 | 21-225_193D8 | VH4/4-30.1/D3/3-22/RF2/J H6 | QVQLQES-GPGLVKPSQTLSL TCTVSG-GSIN | SG----GYYWN | WIRQHPGK GLEWIG | FIFY----SGSTYYNPS LKS | RVTISVDTSKNQFSLKLNSV TAADTAVYYCAR | GDYDGSGSY-------HPYYGLDV | WGHGT TVTVS S |
| iPS:4 36041 | 21-225_193G8 | VH4/4-30.1/D3/3-22/RF2/J H6 | QVQLQEK-GPGLVKPSQTLSL TCTVSG-GSVS | SG----VYYWS | WIRQHPGK GLEWIG | NIYY----SGSTYNNPS LKS | RVTISVDTSKNQFSLKLSSV TAADTAVYYCAR | GDYDGSGSY-------HYYGMDV | WGQGT TVTVS S |
| iPS:4 36062 | 21-225_194E5 | VH4/4-30.1/D3/3-22/RF2/J H6 | QVQLQES-GPGLVKPSQTLSL TCTVSG-GSIS | SG----DYYWN | WIRHHPGK GLEWIG | YIFY----SGSTYYNPS LKS | RVTISIDTSKNQFSLKLSSV IAADTAVYYCAR | GDYDGSGSY-------HYYYGMDV | WGQGT TVTVS S |
| iPS:4 36064 | 21-225_194E6 | VH4/4-30.1/D3/3-22/RF2/J H6 | QVQLQES-GPGLVKPSQTLSL TCTVSG-GSIN | SG----DYYWN | WIKQHPGK GLEWIG | FIFY----SGSTYYNPS LKS | RVTISIDTSKNQFSLKLSSV NVADTAVYYCAR | GDYDGSGSY-------HYYYGMDV | WGQGT TVTVS S |
| iPS:4 36134 | 21-225_196H12 | VH4/4-30.1/D3/3-22/RF2/J H6 | QVQLQES-GPGLVKPSQTLSL TCTVSG-GSIN | SG----DYYWN | WIRQHPGK GLEWIG | NIYY----SGSTYNNPS LKS | RITISVDTSKNQFSLKLSSV TAADTAVYYCAR | GDYDGSGSY-------HYYGMDV | WGQGT TVTVS S |
| iPS:4 36146 | 21-225_197F4 | VH4/4-30.1/D3/3-22/RF2/J H6 | QVQLQES-GPGLVKPSQTLSL TCTVSG-GSIS | SG----DYYWN | WIRQHPGK GLEWIG | YIFY----SGSTYYNPS LKS | RITISVDTSKNQFSLKLSSV TAADTAVYYCAR | GDYDGSGSY-------HYYGLDV | WGQGT TVTVS S |
| iPS:4 36177 | 21-225_198B1 | VH4/4-30.1/D3/3-22/RF2/J H6 | QVQLKES-GPGLVKPSQTLSL TCTVSG-GSIN | SG----DYYWN | WFRQHPGK GLEWIG | YIFH----SGSTYYNPS LKS | RVTVSVDTSKNQFSLKLSSV TAADTAVYYCAR | GDYDGSGSY-------HYYGMDV | WGRGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36179 | 21-225_198E1 VH4|4-30.1|D3|3-22|RF2|J H6 | QVQLQES-GPGLVKPSQTLSL TCTVSG-GSIN | SG----GYYWN | WIRQHPGK GLEWIG | YIFY---- SGSTYNPS LKS | RLSISVDTSKKQFSLKLSSV TAADTAVYYCAR | GDYDGGSY------HYYYGMDV | WGQGT TVTVS S |
| iPS:4 36197 | 21-225_199C2 VH4|4-30.1|D3|3-22|RF2|J H6 | QVQLQES-GPGLVKPSQTLSL TCTVSG-GSIS | SG----DYYWN | WLRQHPEK GLEWIG | YIFY---- SGSTYNPS LKS | RVTISVDTSMTQFSLKLITSV TAADTAVYYCAR | GDYDGGSY------HYYYGMDV | WGQGT TVTVS S |
| iPS:4 36207 | 21-225_199C7 VH4|4-30.1|D3|3-22|RF2|J H6 | QVQLQES-GPGLVKPSQTLSL TCTVSG-GSIN | SG----GYYWN | WIRQHPGK GLEWIG | FIFY---- SGSTYNPS LKS | RVSISVDTSKNQFSLKLSSV TAADTAVYYCAR | GDYDGGSY------HYYYGMDV | WGQGT TVTVS S |
| iPS:4 36226 | 21-225_200F10 VH4|4-30.1|D3|3-22|RF2|J H6 | QVQLQES-GPGLVKPSQTLSL TCTVSG-GSIS | SG----DYYWN | WLRQHPEK GLEWIG | YIFY---- SGSTYNPS LKS | RLTISVDTSMTQFSLKLITSV TAADTAVYYCAR | GDYDGGSY------HYYYGMDV | WGQGT TVTVS S |
| | Germline VH4|4-30.4|D3|3-22|RF2|J H6 | QVQLQES-GPGLVKPSQTLSL TCTVSG-GSIS | SG----DYYWN | WIRQHPGK GLEWIG | YIFY---- SGSTYNPS LKS | RLTISVDTSKNQFSLKLSSV TAADTAVYYCAR | GDYDGGSY------HYYYGMDV | WGQGT TVTVS S |
| iPS:4 35849 | 21-225_191C3 VH4|4-30.4|D3|3-22|RF2|J H6 | QVQLQES-GPGLVKPSQTLSL TCTVSG-GSIS | SG----DYYWN | WIRQLPGK GLEWIG | YIFY---- SGSTYNPS LKS | RLMSVDTSKNQFSLKLNSV TAADTAVYYCAR | GDYDGGSY------HFYYGMDV | WGQGT TVTVS S |
| iPS:4 36015 | 21-225_193D3 VH4|4-30.4|D3|3-22|RF2|J H6 | QVQLQES-GPGLVKPSQTLSL TCTVSG-GSIS | SG----DYYWN | WIRQLPGK GLEWIG | YIFY---- SGSTYNPS LKS | RLTISVDTSKNQFSLKLSSV TAADTAVYYCTR | GDYDGGSY------HFYYGMDV | WGQGT TVTVS S |
| iPS:4 36049 | 21-225_193B12 VH4|4-30.4|D3|3-22|RF2|J H6 | QVQLQES-GPGLVKPSQTLSL TCTVSG-GSIS | SA----DYYWN | WIRQLPGK GLEWIG | YIFY---- SGSTYNPS LKS | RLTISVDTSKNQFSLKLSSV TAADTAVYYCAR | GDYDGGSY------HFYYGMDV | WGQGT TVTVS S |
| iPS:4 36088 | 21-225_195C8 VH4|4-30.4|D3|3-22|RF2|J H6 | QVQLQES-GPGLVKPSQTLSL TCTVSG-GSIS | SG----DYYWN | WIRQLPGK GLEWIG | YIFY---- SGSTYNPS LKS | RLTISVDTSKNQFSLKLSSV TAADTAVYYCAR | GDYDGGSY------HFYYGMDV | WGQGT TVTVS S |
| iPS:4 36195 | 21-225_198G10 VH4|4-30.4|D3|3-22|RF2|J H6 | QVQLQES-GPGLVKPSQTLSL TCTVSG-GSIS | SG----DYYWN | WIRQLPGK GLEWIG | YIFY---- SGSTYNPS LKS | RLTISVDTSKNQFSLKLSSV TAADTAVYYCAR | GDYDGGSY------HFYYGMDV | WGQGT TVTVS S |
| | Germline VH4|4-30.1|D5|5-24|RF3|JH5 | QVQLQES-GPGLVKPSQTLSL TCTVSG-GSIS | SG----GYYWS | WIRQHPGK GLEWIG | YIYY---- SGSTYNPS LKS | RVTISVDTSKNQFSLKLSSV TAADTAVYYCAR | --NWFDP | WGQGT LVTVS S |
| iPS:4 35863 | 21-225_191H4 VH4|4-30.1|D5|5-24|RF3|J H5 | QVQLQES-GPGLVKPSQTLSL TCTVSG-GSIS | SG----GYYWN | WIRQHPGK GLEWIG | YIFY---- SGSTYNPS LKS | RLTISIDFSKNQFSLKLITSV TAADTAVYYCGR | SGYNWD------NGVDP | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 35943 | 21-225_191C9 | VH4/4-30.1/D5/5-24/RF3/JH5 | QVQLQES-GPGLVKPSQTLSL TCTVSG-GSIS | SG----GYYWN | WIRQHPGK GLEWIG | YIYY----SGSTYYNPS LKS | RVTISVDTSKNQFSLKLNSV TAADTAVYYCAR | SGYNWD----------AGVDP | WGQGT LVTVS S |
| iPS:4 36094 | 21-225_195B10 | VH4/4-30.1/D5/5-24/RF3/JH5 | QVQLQES-GPGLVKPSQTLSL TCTVSG-GSIS | NS----GYYWS | WIRQHPGK GLEWIG | YMYY----SGSTYYNPS LKS | RVTISVDTSKNQFYLKLSAV TAADTAVYYCAR | GGYNWN----------NGFDC | WGQGT LVTVS S |
| | Germline | | H_FR1 | H_CDR1 | H_FR2 | H_CDR2 | H_FR3 | H_CDR3 | H_FR4 |
| VH3/3-33/D2/2-15/RF3/JH6 | | | | | | | | | |
| iPS:4 35869 | 21-225_190B1 | VH3/3-33/D2/2-15/RF3/JH6 | QVQLVES-GGGVVQPGRSLRL SCATSG-FTFS | S------YGMH | WVRQAPGK GLEWVA | VIWYD----GSNKNYADS VKG | RFTISRDNSKNTLYLQMNSL RAEDTAVYYCAR | DRTVGY----------SGMDV | WGQGT TVTVS S |
| iPS:4 36260 | 21-225_203H1 | VH3/3-33/D2/2-15/RF3/JH6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRTVGY----------NGMDV | WGQGT TVTVS S |
| iPS:4 36490 | 21-225_221F6 | VH3/3-33/D2/2-15/RF3/JH6 | QVQLVES-GGGVVQPGRSLRL SCAASG-FTFS | S------NGMH | WVRQAPGK GLEWVA | VIWYD----GSNENYADS VKG | RFTISRDNSKNTLYLQMNSL RAEDTAVYYCAR | DRTVGY----------NGMDV | WGQGT TVTVS S |
| iPS:4 36502 | 21-225_222A11 | VH3/3-33/D2/2-15/RF3/JH6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRDVGY----------NGMDV | WGQGT TVTVS S |
| iPS:4 36514 | 21-225_222D10 | VH3/3-33/D2/2-15/RF3/JH6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRDVGY----------NGMDV | WGQGT TVTVS S |
| iPS:4 36522 | 21-225_223H10 | VH3/3-33/D2/2-15/RF3/JH6 | QVQLVES-GGGVVQPGRSLRL SCAASG-FTFS | S------YGMH | WVRQAPGK GLEWVA | VIWYD----GSNKNYADS VKG | RFTISRDNSKNTLYLQMNSL RAEDTAVYYCAR | DRDVGY----------NGMDV | WGQGT TVTVS S |
| | Germline | | H_FR1 | H_CDR1 | H_FR2 | H_CDR2 | H_FR3 | H_CDR3 | H_FR4 |
| VH3/3-21/D11-1/RF1/JH5 | | | | | | | | | |
| iPS:4 35883 | 21-225_185A1 | VH3/3-21/D11-1/RF1/JH5 | EVQLVES-GGGLVKPGGSLRL SCAASG-FTFN | S------YSMN | WVRQAPGK GLEWVS | SISSS----GSYIYYADS VKG | RFTISRDNAKNSLYLQMHSL RAEDTAVYYCAR | SNL----------FDC | WGQGT PVTVS S |
| | Germline | | H_FR1 | H_CDR1 | H_FR2 | H_CDR2 | H_FR3 | H_CDR3 | H_FR4 |
| VH3/3-23/D11-1/RF1/JH3 | | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 35895 | 21-225_188E8 | VH3/3-23/D1(1-1)RF1/JH3 | EVQLLES-GGGLVQPGGSLRL SCAASG-FTFS | S------SAMN | WVRQAPGK GLEWVS | VISGS----GGYTYYADS VKG | RFTISRDNSKNTLYLQMNSL RAEDTAVYFCAK | RNTED-------AFDI | WGQGT MVTVS S |
| | | Germline | | | | | | | |
| | VH3/3-11/D7/7-27/RF3/JH4 | | QVQLVES-GGGLVKPGGSLRL SCAASG-FTFS | YYMS | WVRQAPGK GLEWVS | YISSS----GSTVFYADS VKG | RFTISRDNSKNTLYLQMNSL RAEDTAVYYCAR | EWVGY | WGQGT LVTVS S |
| iPS:4 35903 | 21-225_190E2 | VH3/3-11/D7/7-27/RF3/JH4 | QVQLVES-GGGLVKPGGSLRL SCAASG-FTFS | D------YYMS | WIRQAPGK GLEWLS | YISSS----GTTVFYADS VKG | RFTISRDNAKNSLYLQMNSL RAEDTAVYYCAR | EWVG-------ADY | WGQGT LVTVS S |
| iPS:4 35923 | 21-225_190H6 | VH3/3-11/D7/7-27/RF3/JH4 | QVQLVES-GGGLVKPGGSLRL SCAASG-FTFS | D------YYMS | WIRQAPGK GLEWLS | YISSS----GTTVFYADS VKG | RFTISRDNAKNSLYLQMNSL RAEDTAVYYCAR | EWVG-------ADY | WGQGT LVTVS S |
| iPS:4 35953 | 21-225_191B12 | VH3/3-11/D7/7-27/RF3/JH4 | QVQLVES-GGGLVKPGGSLRL SCAASG-FTFS | D------YYMS | WIRQAPGK GLEWLS | YISSS----GTTVFYADS VKG | RFTISRDNAKNSLYLQMNSL RAEDTAVYYCAR | EWVG-------ADY | WGQGT LVTVS S |
| iPS:4 36098 | 21-225_195G11 | VH3/3-11/D7/7-27/RF3/JH4 | QVQLVES-GGGLVKPGGSLRL SCAASG-FTFS | D------YYMS | WIRQAPGK GLEWLS | YISSS----GTTVFYADS VKG | RFTISRDNAKNSLYLQMNSL RAEDTAVYYCAR | EWVG-------ADY | WGQGT LVTVS S |
| iPS:4 36102 | 21-225_196B1 | VH3/3-11/D7/7-27/RF3/JH4 | QVQLVES-GGGLVKPGGSLRL SCAASG-FTFS | D------YYMS | WIRQAPGK GLEWLS | YISSS----GITMYADS VKG | RFTISRDNAKNSLYLQMNSL RAEDTAVYYCAR | EWVG-------ADY | WGQGT LVTVS S |
| iPS:4 36104 | 21-225_196C1 | VH3/3-11/D7/7-27/RF3/JH4 | QVQLVES-GGGLVKPGGSLRL SCAASG-FTFS | D------YYMS | WIRQAPGK GLEWLS | YISSS----GTTVFYADS VKG | RFTISRDNAKNSLYLQMNSL RAEDTAVYYCAR | EWVG-------ADY | WGQGT LVTVS S |
| | | Germline | | | | | | | |
| | VH3/3-23/D6/6-19/RF2/JH4 | | EVQLLES-GGGLVQPGGSLRL SCAASG-FTFS | YAMS | WVRQAPGK GLEWVS | AISGS----GGSTYYADS VKG | RFTISRDNSKNTLYLQMNSL RAEDTAVYYCAK | GYFDY | WGQGT LVTVS S |
| iPS:4 35965 | 21-225_192H2 | VH3/3-23/D6/6-19/RF2/JH4 | EVQLLES-GGDLIQPGGSLRL SCAASG-FTFS | S------SAMS | WVRQAPGK GLEWVS | AISGS----GGNTFYADS VKG | RFTISRDNSKNTLYLQMNSL RAEDTAVYYCAK | LIAVVG------SHYFDY | WGQGT LVTVS S |
| iPS:4 36160 | 21-225_197C9 | VH3/3-23/D6/6-19/RF2/JH4 | EVQLLES-GGGLAQPGGSLRL SCAASG-FTFR | S------YAMS | WVRQAPGK GLEWVS | VISGR----GGNTYYADS VKG | RFTISRDNSKNTLYLQMNSL RAEDTAVYYCAK | GIAVAG------SHYFDY | WGQGT LVTVS S |
| iPS:3 92954 | 21-225_26A10 | VH3/3-23/D6/6-19/RF2/JH4 | EVQLLES-GGGLVQPGGSLRL SCAASG-FTFS | S------YAMS | WVRQAPGK GLEWVS | VISGS----GVNTFYADS VKG | RFTISRDNSKNTLYLLMNSL RAEDTAVYYCAK | KIAVAG------THYFDY | WGQGT LVTVS S |
| | | | H_FR1 | H_CDR1 | H_FR2 | H_CDR2 | H_FR3 | H_CDR3 | H_FR4 |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4(4-30.1/D5/5-24)RF3/JH4 | | QVQLQES-GPGLVKPSQTLSL TCTVSG-GSIS | SG----GYYWS | WIRQHPGK GLEWIG | YIYY SGSTYYNPS LKS | RVTISVDTSKNQFSLKLSSV TAADTAVYYCAR | RGYYN----------YYFDY | WGQGT LVTVS S |
| iPS:4 35983 | 21-225_192E5 | VH4/4-30.1/D5/5-24)RF3/JH4 | QVQLQES-GPGLVKPSQTLSL TCTVSG-DSIN | NG----GYYWS | WIRQHPGK GLEWIG | YIFY SGSTYYNPS LKS | RVTISVDTSKNQFSLKLNSV TAADTAVYFCAR | AGYNWD----------NGFDY | WGQGT LVTVS S |
| iPS:4 36043 | 21-225_193G9 | VH4/4-30.1/D5/5-24)RF3/JH4 | QVQLQES-GPGLVKPSQTLSL TCTVSG-DSIN | NG----GYYWS | WIRQHPGK GLEWIG | YIFY SGSTYYNPS LKS | RVTISVDTSKNQFSLKLNSV TAADTAVYFCAR | AGYNWD----------NGFDY | WGQGT LVTVS S |
| iPS:4 36084 | 21-225_195F2 | VH4/4-30.1/D5/5-24)RF3/JH4 | QVQLQES-GPGLVKPSQTLSL TCTVSG-DSIS | SG----GYYWS | WIRQHPGK GLEWIG | YSYY SGSTYYNPS LKS | RVTISVDMSKNQFSLKLSSV TDADTAVYYCAR | GGYYMN----------NGFDY | WGQGA LVTVS S |
| iPS:4 37138 | 21-225_214D8 | VH4/4-30.1/D5/5-24)RF3/JH4 | QVQLQES-GPGLVKPSQTLSL TCTVSG-GSIS | TA----FYYWS | WIRQHPGK GLEWIG | YIYF SGSTYYNPS LKS | RVTISVDTSKNQFSLNLSSV TAADTAVYYCAR | ARGYHY----------SIFDY | WGQGT LVTVS S |
| VH3(3-23/D3/3-16)RF1/JH3 | Germline | EVQLLES-GGGLVQPGGSLRL SCAASG-FTFS | S----YAMS | WVRQAPGK GLEWVS | AISGS GGSTYYADS VKG | RFTISRDNSKNTLYLQMNSL RAEDTAVYYCAR | VL*LRLGEL----------SLDAFDI | WGQGT MVTVS S |
| iPS:4 36003 | 21-225_192G10 | VH3/3-23/D3/3-16)RF1/JH3 | EVQLLES-GGGLVQPGGSLRL SCAASG-FTFS | S----YAMS | WVRQAPGK GLEWVS | AISGS GGSTYYADS VKG | RFTISRDNSKNTLYLQMNSL RAEDTAVYYCAR | RLALDG----------YDAFDI | WGQGT MVTVS S |
| VH3(3-23/D7/7-27)RF2/JH4 | Germline | | | | | | | |
| iPS:4 36019 | 21-225_193C4 | VH3/3-23/D7/7-27)RF2/JH4 | EVQLLES-GGGLAQPGGSLRL SCAASG-FTFS | S----YAMN | WVRQAPGK GLEWVS | AIIGN GGRTYYADS VKG | RFSISRDNSKNTLFLQMNSL RAEDTAVYYCAK | DLGRYS----------YGFFDY | WGQGT LVTVS S |
| VH4(4-30.1/D11/1-1)RF1/JH6 | Germline | QVQLQES-GPGLVKPSQTLSL TCTVSG-GSIS | SG----GYYWS | WIRQHPGK GLEWIG | YIYY SGSTYYNPS LKS | RVTISVDTSKNQFSLKLSSV AAADTAVYYCAR | GYYCDDV----------FDY | WGQGT TVTVS S |
| iPS:4 36025 | 21-225_193B5 | VH4/4-30.1/D11/1-1)RF1/JH6 | QVQLQES-GPGLVKPSQTLSL TCTVSG-GSIS | SG----GYYWS | WIRQHPGK GLEWIG | YIYY SGSTYYNPS LKS | RVTISVDTSKNQFSLKLSSV AAADTAVYYCAR | GEYNWN----------HGMDV | WGQGT TVTVS S |
| VH4(4-34/D4/4-11)RF2/JH4 | Germline | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36033 | 21-225_193E7 | VH4|4-34|D4|4-11|RF2|JH4 | QVQLQQW-GAGLLKPSETLSL TCAVYG-GSFS | G------YFWT | WIRQPPGK GLEWIG | EINH---- SGSTNYNPS LKS | RVTISVDTSKNQFSLKLSSV TAADTAVYYCAR | DYG--------------ADY | WGQGT LVAVS A |
| iPS:4 36199 | 21-225_199E3 | VH4|4-34|D4|4-11|RF2|JH4 | QVQLQQW-GAGLLKPSETLSL TCAVYG-GSFS | G------YFWT | WIRQPPGK GLEWIG | EINH---- SGSTNYNPS LKS | RVTISVDTSKNQFSLKLSSV TAADTAVYYCAR | DYG--------------ADY | WGQGT LVAVS A |
| iPS:4 36228 | 21-225_200F12 | VH4|4-34|D4|4-11|RF2|JH4 | QVQLQQW-GAGLLKPSETLSL TCAVYG-GSFS | G------YFWT | WIRQPPGK GLEWIG | EISH---- SGSTNYNPS LKS | RVTISVDTSKNQFSLKLSSV TAADTAVYYCAR | DYG--------------ADY | WGQGT LVTVS S |
| iPS:4 36230 | 21-225_201A1 | VH4|4-34|D4|4-11|RF2|JH4 | QVQLQQW-GAGLLKPSETLSL TCAVYG-GSFS | G------YFWT | WIRQPPGK GLEWIG | EISH---- SGRTNYNPS LKS | RVTISGDTSKNQFSLKLSSV TAADTAVYYCAR | DYG--------------ADY | WGQGT LVTVS S |
| iPS:4 36242 | 21-225_201A10 | VH4|4-34|D4|4-11|RF2|JH4 | QVQLQQW-GAGLLKPSETLSL TCAVYG-GSFS | G------YFWT | WIRQPPGK GLEWIG | EISH---- SGSTNYNPS LKS | RVTISVDTSKNQFSLKVNSV TAADTAVYYCAR | DYG--------------ADY | WGQGT LVTVS S |
| iPS:4 36286 | 21-225_204H8 | VH4|4-34|D4|4-11|RF2|JH4 | QVQLQQW-GAGLLKPSETLFL TCAVYG-GSFS | G------YFWT | WVRQPPGK GLEWIG | EISH---- SGSTNYNPS LKS | RVTISVDKSKNQFSLKVSSV TAADTAVYYCAR | DYG--------------ADY | WGQGT LVTVS S |
| iPS:4 36308 | 21-225_205H8 | VH4|4-34|D4|4-11|RF2|JH4 | QVQLQQW-GAGLLKPSETLSL TCAVYG-GSFS | G------YFWS | WIRQPPGK GLEWIG | EISH---- SGRTNYNPS LKS | RVTISVDTSKNQFSLKVSSV TAADTAVYYCAR | DYG--------------ADY | WGQGT LVTVS S |
| VH3|3-30.3D|1|1-1|RF1|JH4 | Germline | | | | | | | |
| iPS:4 36051 | 21-225_193G12 | VH3|3-30.3D|1|1-1|RF1|JH4 | QVQLVES-GGGVVQPGRSLRL SCAASG-FTFS | S------YAMH | WVRQAPGK GLEWVA | VIWYD-- GTNKYYGDS VKG | RFTISRDNSKNTLNLQMNSL RAEDTAVYYCAR | DFIITG-----------ATYFDY | WGQGT LVTVS S |
| VH3|3-33D|7|7-27|RF3|JH6 | Germline | | | | | | | |
| iPS:4 36054 | 21-225_194C1 | VH3|3-33D|7|7-27|RF3|JH6 | QVQLVES-GGGVVQPGRSLRL SCAASG-FTFS | S------YGMH | WVRQAPGK GLEWVA | VIWYD-- GSNEHYADS VKG | RFTISRDNSKNTLYLQMNSL RAEDTAVYYCAR | NRGVGY-----------YGLDV | WGQGT TVTVS S |
| VH1|1-42D|5|5-18|RF3|JH1 | Germline | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36058 | 21-225_194A4 | VH1|1-02|D5|5-18|RF3|JH1 | QVQLVQS-GTEVKKPGASLKV SCKASG-YTFT | V------YYLN | WVRQAPGQ GLEWMG | WINPN---SGGTNYAQK FQG | RVTMTRDTSISTAYMELSRL RSDDTAVYYCAR | GYDI----------LTG | WGQGT LVTVS S |
| | VH1|1-02|D5|5-26|RF3|JH6 Germline | | QVQLVQS-GAEVKKPGASVKV SCKASG-YTFT | V------YMH | WVRQAPGQ GLEWMG | WINPN---SGGTNYAQK FQG | RVTMTRDTSISTAYMELSRL RSDDTAVYYCAR | YYGMDV | WGQGT TVTVS S |
| iPS:4 36068 | 21-225_194F7 | VH1|1-02|D1|1-26|RF3|JH6 | QVQLVQS-GAEVKKPGASVKV SCKASG-YTFT | D------YYIH | WVRQAPGQ GLEWMG | WINPN---NGGTNYAQK FQG | RVTMTRDISTAYMELSRL RSDDTAVYYCAR | EPLGYYGSG----SYGAYGMDV | WGQGT TVTVS S |
| | VH4|4-34|D4|4-17|RF2|JH3 Germline | | QVQLQES-GPGLLKPSETLSL TCTVSG-GSTS | G------YYWS | WIRQPPGK GLEWIG | EINH------SGSTNYNPS LKS | RVTISVDTSKNQFSLKLSSV TAADTAVYYCAR | DAFDI | WGQGT MVTVS S |
| iPS:4 36072 | 21-225_194C10 | VH4|4-34|D4|4-17|RF2|JH3 | QVQLQQW-GAGLLKPSETLSL TCAVSG-GSFR | Y------YYWS | WIRQPPGK GLEWFG | EINH------SGSTNYNPS LKS | RVTISIDTSKNQFSLKLRSV TAADTAVYYCAR | DYGA----------FDI | WGQGT MVTVS S |
| iPS:4 36506 | 21-225_222C7 | VH4|4-34|D4|4-17|RF2|JH3 | QVQLQQW-GAGLLKPSETLSL TCAVYG-GSFS | G------RYWS | WIRQPPGK GLEWIG | EINH------SGSANYNPS LKS | RVTISVDTSKNQFSLKLSSV TAADTAVYYCAR | DYGA----------LDF | WGQGT MVTVS S |
| | VH3|3-33|D5|5-24|RF2|JH6 Germline | | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | YYGMDV | WGQGT TVTVS S |
| iPS:4 36092 | 21-225_195B9 | VH3|3-33|D5|5-24|RF2|JH6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCAR | EWLQFRY-------YYGMDV | WGQGT TVTVS S |
| iPS:4 36164 | 21-225_197G10 | VH3|3-33|D5|5-24|RF2|JH6 | QVQLVES-GGGVVQPGRSLRL SCVASG-FTFS | S------YGMH | WVRQAPGK GLEWVA | VTWYD---GSNKYYADS VKG | RFTISRDNSKNTLFLQMSSL RAEDTAVYYCAR | EWLQFRY-------YYGIDV | WGQGT TVTVS S |
| iPS:4 36191 | 21-225_198B9 | VH3|3-33|D5|5-24|RF2|JH6 | QVQLVES-GGGVVQPGRSLRL SCAASG-FTFS | N------YGMH | WVRQAPGK GLEWVA | IIWFD---GSNKYYVDS VKG | RFTISRDNSKNTLFLQMSSL RAEDTAVYYCAR | EWLQFRY-------YYGMDV | WGQGT TVTVS S |
| iPS:4 36205 | 21-225_199A7 | VH3|3-33|D5|5-24|RF2|JH6 | QVQLVES-GGGVVQPGRSLRL SCAASG-FTFS | N------YGMH | WVRQAPGK GLEWVA | IIWFD---GSNKYYADS VKG | RFTISRDNSKNTLFLQMSSL RAEDTAVYYCAR | EWLQFRY-------YYGMDV | WGQGT TVTVS S |
| iPS:4 36214 | 21-225_200F6 | VH3|3-33|D5|5-24|RF2|JH6 | QVQLVES-GGGVVQPGRSLRL SCAASG-FTFS | S------YGMH | WVRQAPGK GLEWVA | VIWYD---GSNKYYADS VKG | RFTISRDNSKNTLYLQMNSL RAEDTAVYYCTR | EWLQFRY-------YYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3 3-33 D6 6-19 RF3 JH6 | | | S | WVRQAPGK GLEWVA | VILND | RFTISRDNSKNTLYLQMNSL RAEDTAVYYCAR | | WGQGT TVTVS S |
| iPS:4 36106 | 21-225_196F2 | VH3 3-33 D6 6-19 RF3 JH6 | QVQLVES-GGGVVQPGRSLRL SCAASG-FTFS | S------FGMH | WVRQAPGK GLEWVA | VILND---GSNKKCADS VKG | RCTISRDNSKNTLYLQMNSL RAEDTAVYYCAR | GQQWLV---------NGVDV | WGQGT TVTVS S |
| VH3 3-23 D6 6 RF3 JH6 | | Germline | | H_FR1 | H_CDR1 | H_FR2 | H_CDR2 | H_FR3 | H_CDR3 | H_FR4 |
| iPS:4 36110 | 21-225_196F4 | VH3 3-23 D6 6-6 RF3 JH 6 | EVQLLES-GGGLVQPGGSLRF SCAASG-FTFS | S------CAMT | WVRQAPGK GLEWVS | AISGS---GGSTYIADS VKG | RFTISRDNSKNTLYLQMNSL RAEDTAVYYCAR | VGGLIGSY---------YYYGMDV | WGQGT TVTVS S |
| VH1 1-08/D2 2-21 RF1 JH5 | | Germline | | | | | | | | |
| iPS:4 36114 | 21-225_196G8 | VH1 1-08 D2 2-21 RF1 JH5 | QVQLVQS-GAEVKKPGASVKV SCKASG-YTFT | N------YDIN | WMRQATGQ GLEWMG | WMHLN---SGNTGYAPK FQG | RVTMTRDTSISTAFMELSSL RSEDTAVYYCAY | SGGWY----------VFDP | WGQGT LVTVS S |
| iPS:4 36218 | 21-225_200G7 | VH1 1-08 D2 2-21 RF1 JH5 | QVQLVQS-GAEVKKPGASVKV SCKASG-YTFT | N------YDIN | WMRQATGQ GLEWMG | WMHLN---SGNTGYAPK FQG | RVTMTRDTSISTAFMELSSL RSEDTAVYYCAY | SGGWY----------VFDP | WGQGT LVTVS S |
| VH1 1-02/D3 3-10 RF3 JH6 | | Germline | | | | | | | | |
| iPS:4 36116 | 21-225_196B9 | VH1 1-02 D3 3-10 RF3 JH6 | QVQLVQS-GAEVKKPGASMKV SCKASG-YTFT | G------YYMH | WVRQAPGK GLEWMG | WINFN---SGGTNFAQK FRG | RVTMTRDTSISTAYMELSRL SSEDTAVYYCAR | GGVRGVPN--------YYYVMDV | WGQGT TVTVS S |
| VH4 4-30.1/D5 5-18 RF3 JH6 | | Germline | | | | | | | | |
| iPS:4 36181 | 21-225_198C2 | VH4 4-30.1 D5 5-18 RF3 J H6 | QVQLQES-GPGLVKPSQTLSL TCTVSG-GSIS | SG------GYYWS | WIRQHPGK GLEWIG | NIYY---SGSTYYNPS LKS | RVTISVDTSKNQFSLKLSSV TAADTAVYYCAR | GDYYGSGSY-------HNYYGLDV | WGQGT TVTVS S |
| iPS:4 36210 | 21-225_199G11 | VH4 4-30.1 D5 5-18 RF3 JH6 | QVQLQES-GPGLVKPSQTLSL TCTVSG-GSIS | SG------GYYWS | WIRQHPGK GLEWIG | NIYY---SGSTYYNPS LKS | RVTISVDTSKNQFSLKLSSV TAADTAVYYCAR | GDYYGSGSY-------HNYYGLDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1|1-18|D3|3-3|RF2|JH6 | | QVQLVQS | S | WVRQAPGQ GLEWMG | WISAY NGNTKYAQK LQG | RVTMTDTSISTAYMELRSL RSDDTAVYYCAR | YDFWSGYYY YYYGMDV | WGQGT TVTVS S |
| iPS:4 36234 | 21-225_51E3 | VH1|1-18|D3|3-3|RF2|JH 6 | QVQLVQS-GAEVKKPGASVKV SCKASG-YTFN | S------YGIS | WVRLAPGQ GLEWMG | WISAY--NGNTKNAQR FQG | RVTMTTDTSTSTAYMELRSL RSDDTAVYYCAR | HDFWSGY------YKGMDV | WGQGT TVTVS S |
| iPS:4 36830 | 21-225_51F4 | VH1|1-18|D3|3-3|RF2|JH 6 | QVQLVQS-GAEVKKPGASVKV SCKASG-YTFN | S------YGIS | WVRQAPGQ GLEWMG | WISAY--NGNTKYAQK LQG | RVTMTTDTSTSTAYMELRSL RSDDTAVYYCAR | HDFWSGY------YKGMDV | WGQGT TVTVS S |
| iPS:4 36834 | 21-225_52F1 | VH1|1-18|D3|3-3|RF2|JH 6 | QVQLVQS-GAEVKKPGASVKV SCKASG-YTFN | S------YGVS | WVRQAPGQ GLEWMG | WISAY--NGNRKYAQK LQG | RVSMTTDTSTSTAYMELRSL RSDDTAVYYCAR | HDFWSGY------YKGMDV | WGQGT TVTVS S |
| iPS:4 36842 | 21-225_54E9 | VH1|1-18|D3|3-3|RF2|JH 6 | QVQLVQS-GAEVKKPGASVKV SCKASG-YTFN | S------YGIS | WVRQAPGQ GLEWMG | WISAY--NGNTKNAQK LQG | RVTMTTDTSTSTAYMELRSL RSDDTAVYYCAR | HDFWSGY------YKGMDV | WGQGT TVTVS S |
| iPS:4 36844 | 21-225_56G1 | VH1|1-18|D3|3-3|RF2|JH 6 | QVQLVQS-GAEVKKPGASVKV SCKASG-YTFN | S------YGIS | WVRQAPGQ GLEWMG | WISAY--NGNTKYAQR FQG | RVTMTTDTSTSTAYMELRSL RSDDTAVYYCAR | HDFWSGY------YKGMDV | WGQGT TVTVS S |
| iPS:4 36846 | 21-225_56E3 | VH1|1-18|D3|3-3|RF2|JH 6 | QVQLVQS-GAEVKKPGASVKV SCKASG-YTFN | S------YGFS | NVRQAPGQ GLEWMG | WISAY--NGNTKZAQK LQG | RVTMTTDTSTSTAYMELRSL RADDDTAVYYCAR | HDFWSGY------YKGMDV | WGQGT TVTVS S |
| iPS:4 51104 | 21-225_49C5 | VH1|1-18|D3|3-3|RF2|JH 6 | QVQLVQS-GAEVKKPGASVKV SCKASG-YTFN | S------YGIS | WVRLAPGQ GFEWMG | WISAY--NGNTKYAQK LQG | RVTMTTDTSTSTAYMELRSL RSDDTAVYYCAR | HDFWSGI------YKGMDV | WGQGT TVTVS S |
| iPS:4 51106 | 21-225_49D10 | VH1|1-18|D3|3-3|RF2|JH 6 | QVQLVQS-GAEVKKPGASVKV SCKASG-YTFN | S------YGIS | WVRQAPGQ GLEWMG | WISAY--NGNTKPAQK LQG | RVTMTTDTSTSTAYMELRSL RSDDTAVYYCAR | HDFWSGY------YKGMDV | WGQGT TVTVS S |
| iPS:4 51108 | 21-225_53E8 | VH1|1-18|D3|3-3|RF2|JH 6 | QVQLVQS-GAEVKKPGASVKV SCKASG-YTFN | S------YGIS | WVRQAPGQ GLEWMG | WISAY--NGNTKPAQK LQG | RVTMTTDTSTSTAYMELRSL RSDDTAVYYCAR | HDFWSGY------YKGMDV | WGQGT TVTVS S |
| | Germline | H_FR1 | H_CDR1 | H_FR2 | H_CDR2 | H_FR3 | H_CDR3 | H_FR4 |
| VH6|6-01|D3|3-9|RF1|JH6 | | QVQLQQS GPGLVKPSQTLSL | SN-SAAWN | WIRQSPSR GLEWLG | RIYYR-SKWYNYYEV SVRS | RITINPDISKNQFSLQLNSV TPEDTAVYFCAR | YRYY---YYYGMDV | WGQGT TVTVS S |
| iPS:4 36236 | 21-225_201F7 | VH6|6-01|D3|3-9|RF1|JH 6 | QVQLQQS-GPGLVKPSQTLSL TCAISG-DSVS | SN---SAAWN | WIRQSPSR GLEWLG | RIYYR-SKWYNYYEV SVRS | RITINPDISKNQFSLQLNSV TPEDTAVYFCAR | DQRYY------GMDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36250 | 21-225_201A4 | VH6|6-01|D3|3-9|RF1|JH6 | QVQLQQS-GPGLVKPSQTLSL TCAISG-DSVS | SN----SAAWN | WIRQSPSR GLEWLG | RTYYR----SKWYNYYEV SVRS | RITINPDTSKNQFSLQLNSV TPEDTAVYFCAR | DQRYY-------GMDV | WGQGT TVTVS S |
| iPS:4 36252 | 21-225_202A8 | VH6|6-01|D3|3-9|RF1|JH6 | QVQLQQS-GPGLVKPSQTLSL TCAISG-DSVS | SN----SAAWN | WIRQSPSR GLEWLG | RTYYR----SKWYNEYAV SVRS | RITINPDTSKNQFSLQLNSV TPEDTALYCTR | DQRYY-------GMDV | WGQGT PVTVS S |
| iPS:4 36278 | 21-225_201F2 | VH6|6-01|D3|3-9|RF1|JH6 | QVQLQQS-GPGLVKPSQTLSL TCAISG-DSVS | SN----SAAWN | WIRQSPSR GLEWLG | RTYYR----SKWYNYYEV SVRS | RVTINPDTSKNQFSLQLNSV TPEDTAVYFCAR | DQRYY-------GMDV | WGQGT TVTVS S |
| iPS:4 36294 | 21-225_205G4 | VH6|6-01|D3|3-9|RF1|JH6 | QVQLQQS-GPGLVKPSQTLSL TCAISG-DSVS | SN----SAAWN | WIRQSPSR GLEWLG | RTYYR----SKWYNYYEV SVRS | RITINPDTSKNQFSLQLNSV TPEDTAVYFCAR | DQRYY-------GMDV | WGQGT TVTVS S |
| iPS:4 36356 | 21-225_210H10 | VH6|6-01|D3|3-9|RF1|JH6 | QVQLQQS-GPGLVKPSQTLSL TCAISG-DSVS | SN----SAAWN | WIRQSPSR GLEWLG | RTYYR----SKWYNYYPV SVRS | RITINPDTSKNQFSLLLNSV TPEDTAVYCAR | DQRYY-------GMDV | WGQGT TVTVS S |
| VH1|1-02|D4|4-23|RF2|JH4 | | Germline | QVQLVQS-GAEVKKPGASVKV SCKASG-YTFT | G-------YYMH | WVRQAPGQ GLEWMG | WINPN----SGGTNYAQK FQG | RVTMTRDTSTAYMELSRL RSDDTAVYYCAR | GYYCN | WGQGT LVTVS S |
| iPS:4 36240 | 21-225_201E8 | VH1|1-02|D4|4-23|RF2|JH4 | QVQLVQS-GAEVKKPGASVKV SCKASG-YTFT | G-------YYMH | WVRQAPGQ GLEWMG | WIDFN----SGGTNYPQK FQG | RVTMRDTSISTAYMELSRL RSDDTAVYYCAK | DQGYNW------NSFDY | WGQGT LVTVS S |
| iPS:4 36314 | 21-225_206G4 | VH1|1-02|D4|4-23|RF2|JH4 | QVQLVQS-GAEVKKPGASVKV SCKASG-YTFT | G-------YYIH | WVRQAPGQ GLEWMG | WIDPN----SGGTNYAQK FQG | RVTMRDTSISTAYMELSRL RSDDTAVYYCAR | DQGYNW------NSFDY | WGQGT LVTVS S |
| VH1|1-02|D5|5-18|RF3|JH5 | | Germline | QVQLVQS-GAEVKKPGASVKV SCKASG-YTFT | G-------YYMH | WVRQAPGQ GLEWMA | WINPN----SGGTNYAQK FQG | RVTMTRDTSTAYMELSRL RSDDTAVYYCAR | GYSYGY | WGQGT LVTVS S |
| iPS:4 36244 | 21-225_201H10 | VH1|1-02|D5|5-18|RF3|JH5 | QVQLVQS-GAEVKKPGASVKV SCKASG-YTFT | G-------YYIH | WVRQAPGQ GLEWMA | WINPN----SGGTNYAQK FQG | RVTMTRDTSTTTYMELSRL RSDDTAVYYCAR | GYSYGY-------NWFDP | WGQGT LVTVS S |
| iPS:4 36262 | 21-225_203E3 | VH1|1-02|D5|5-18|RF3|JH5 | QVQLVQS-GAEVKKPGASVKV SCKASG-YTFT | G-------YYIH | WVRQAPGQ GLEWMA | WINPN----SGGTNYAQK FQG | RVTMTRDTSTTAYMELSRL RSDDTAVYYCAR | GYSYGY-------NWFDP | WGQGT LVTVS S |
| iPS:4 36276 | 21-225_204H4 | VH1|1-02|D5|5-18|RF3|JH5 | QVQLVQS-GAEVKKPGASVKV SCKASG-YTFT | G-------YYIH | WVRQAPGQ GLEWMA | WINPN----SGGTNYAQK FQG | RVTMTRDTSISTAYMELSRL RSDDTAVYYCAR | GYSYGY-------NWFDP | WGQGT LVTVS S |

Figure 51 (Continued)

| | | | | | | | | | |
|---|---|---|---|---|---|---|---|---|---|
| iPS:4 36312 | 21-225_206A4 | VH1\|1-02\|D5\|5-18\|RF3\|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY--------NWFDP | WGQGTLVTVSS |
| iPS:4 36316 | 21-225_206A5 | VH1\|1-02\|D5\|5-18\|RF3\|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY--------NWFDP | WGQGTLVTVSS |
| iPS:4 36338 | 21-225_208E8 | VH1\|1-02\|D5\|5-18\|RF3\|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY--------NWFDP | WGQGTLVTVSS |
| iPS:4 36344 | 21-225_208B11 | VH1\|1-02\|D5\|5-18\|RF3\|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY--------NWFDP | WGQGTLVTVSS |
| iPS:4 36358 | 21-225_210D11 | VH1\|1-02\|D5\|5-18\|RF3\|JH5 | QVQLVQS-GAEVKKPGASVKVSCKASG-YTFT | G------YYIH | WVRQAPGQGLEWMA | WINPN----SGGTNYAQKFQG | RVTMTRDTSITTAYMELSRLRSDDTAVYYCAR | GYSYGY--------NWFDP | WGQGTLVTVSS |
| iPS:4 36408 | 21-225_214H8 | VH1\|1-02\|D5\|5-18\|RF3\|JH5 | QVQLVQS-GAEVKKPGASVKVSCKASG-YTFT | G------HYIH | WVRQAPGQGLEWMG | WINSN----SGGTNYAQKFQG | RVTMTRDTSITTAYMELSRLRSDDTAVYYCAR | DGRYSYG-------YDWFDP | WGQGTLVTVSS |
| iPS:4 36424 | 21-225_215H6 | VH1\|1-02\|D5\|5-18\|RF3\|JH5 | QVQLVQS-GAEVKKPGASVKVSCKASG-YTFT | G------HYIH | WVRQAPGQGLEWMG | WINSN----SGGTNYAEKFQG | RVTMTRDTSITTAYMELSRLRSDDTAVYYCAR | DGRYSYG-------HDWFDP | WGQGTLVTVSS |
| iPS:4 37092 | 21-225_210B12 | VH1\|1-02\|D5\|5-18\|RF3\|JH5 | QVQLVQS-GAEVKKPGASVKISCKASG-FTFT | D------YYMN | WVRQAPGQGLEWMG | WINPN----SGGTNYAQKFQG | RVTMTRDTSISTAYMELSRLRSDDTAVYYCAR | GYDS----------FAP | WGQGTLVTVSS |
| iPS:4 37134 | 21-225_213A7 | VH1\|1-02\|D5\|5-18\|RF3\|JH5 | QVQLVQS-GAEVKKPGASVKISCKASG-FTFT | D------YYMN | WVRQAPGQGLEWMG | WINPK----NGGTNYAQKFQD | RVTMTRDTSLGRAYMELSRLRSDDTAVYYCAR | GYDS----------FAP | WGQGTLVTVSS |
| iPS:4 37194 | 21-225_226B2 | VH1\|1-02\|D5\|5-18\|RF3\|JH5 | QVQLVQS-GAEVKKPGASVKVSCKASG-YTFT | G------YFMH | WVRQAPGQGLEWMG | WINPN----SGDTNYAQKFQG | RVTMTRDTSLNTAYMELSRLRSDDTAVYYCAR | GIYYGSGS------YFNELDS | WGQGTLVTVSS |
| iPS:4 37196 | 21-225_226B7 | VH1\|1-02\|D5\|5-18\|RF3\|JH5 | QVQLVQS-GAEVKKPGASVKVSCKASG-YTFT | G------YYMH | WVRQAPGQGLEWMG | WINPN----SGGTNYAQKFQG | RVTMTRDTSISTAHMELSRLRSDDTAVYYCAR | GYYGSGS-------YYNWPDS | WGQGTLVTVSS |
| iPS:4 37200 | 21-225_226A10 | VH1\|1-02\|D5\|5-18\|RF3\|JH5 | QVQLVQS-GAEVKKPGASVKVSCKASG-YTFT | G------YPMH | WVRQAPGQGLEWMG | WINPN----SGGTNYAQKFQG | RVTMTRDTSLSTAYMELSRLRSDDTAIYYCAR | GIYYGSGS------YFNELDS | WGQGTLVTVSS |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 93168 | 21-225_32B11 | VH1]1-02/D5|5-18|RF3/JH5 | QVQLVQS-GAEVKKPGASVKVSCKASG-YTFT | G------YYMH | WVRQAPGQGLEWMG | WINPN---SDGTNYAQKFQG | RVTMTRDTSISTAYMELNRLRSEDTAVYYCAR | GFYYGSGS-------YYNDLDP | WGQGTLVTVSS |
| iPS:3 93178 | 21-225_34D7 | VH1]1-02/D5|5-18|RF3/JH5 | QVQLVQS-GAEVKKPGASVKVSCKASG-YTFT | G------YYMH | WVRQAPGQGLEWMG | WINPN---SGGTNYAQKFQG | RVTMTRDTSISTAYMELSRLRSDDTAVYYCAR | GYYYGSGS-------YYNDLDP | WGQGTLVTVSS |
| iPS:3 98480 | 21-225_17G4 | VH1]1-02/D5|5-18|RF3/JH5 | QVQLVQS-GAEVKKPGASVKVSCKTSG-YTFT | D------YYMH | WVRQAPGQGLEWMG | WINPN---SGGTNYEQKFQG | RVTMTRDTSISTAYMELSRLRSDDTAVYYCAS | GYSYGY---------NWFDP | WGQGTLVTVSS |
| iPS:3 98486 | 21-225_19A1 | VH1]1-02/D5|5-18|RF3/JH5 | QVQLVQS-GAEVKKPGASVKVSCKASG-YTFT | G------YYMH | WVRQAPGQGLEWMG | WINPN---SGGTNYAQKFQG | RVTMTRDTSISTAYMELSRLRSEDTAVYYCAR | GYSYGY---------NWFDP | WGQGTLVTVSS |
| | Germline VH1|1-08/D5|6-13|RF1/JH6 | | QVQLVQS-GAEVKKPGASVKVSCKASG-YTFT | S------YDIN | WVRQAPGQGLEWMG | WMNPN---SGGTNYAQKFQG | RVTMTRDTSISTAYMELSSLRSEDTAVYYCAR | CYSSGSYYYYYGMDV | WGQGTTVTVSS |
| iPS:4 36248 | 21-225_202A3 | VH1]1-08/D6|6-13|RF1/JH6 | QVQLEQS-GAEVKKPGASVKVSCKASG-YTFT | S------YDIN | WVRQATGQGLEWLG | WMNPK---RGNTGYAQKFQG | RVTMTRNTSISTAHMELSSLRSEDTAVYYCAR | GRYSREDY-------YYYYDMDV | WGQGTTVTVSS |
| | Germline | | | | | | | H_CDR3 | H_FR4 |
| iPS:4 36270 | 21-225_203F10 | VH3]3-11/D4|4-17|RF2/JH6 | QVQLVES-GGGLVKPGGSLRLSCAASG-FTFS | D------YYMS | WIRQAPGKGLEWVL | YISGS---GTTTYYADSVKG | RFTISRDNAKNSLYLQMNSLRAEDTAVYYCAR | DRGG-----------LDV | WGQGTTVTVSS |
| iPS:4 36280 | 21-225_204D6 | VH3]3-23/D11-20|RF1/JH6 | EVQVLES-GGGLVQPGGSLRLSCAASG-FTFS | T------YAMS | WVRQAPGKGLEWVS | AISGS---GGSTYYADSVKG | RFTISRDNSKNTLYLQMDSLRAEDTAVYYCAR | GISGTGSY-------YYYGVDV | WGQGTTVTVSS |
| | Germline VH3|3-33/D7|7-27|RF2/JH6 | | | | | | | H_CDR3 | H_FR4 |
| iPS:4 36284 | 21-225_204G8 | VH3]3-33/D7|7-27|RF2/JH6 | QVQLVES-GGDVVQPGRSLRLSCAASG-FTFS | S------YGMH | WGRQAPGKGLEWVA | VIWYD---GSNENYVASVKG | RFTIFRDNSKNTLYLQMNSLRAEDTAVYYCAR | DLGIGY---------YGMDV | WGQGTTVTVSS |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36968 | 21-225_190B10 | VH3-33/D7/7-27/RF2/JH6 | QVQLVES-GGGVVQPGRSLRLSCVASG-FTFS | S------YGMH | WVRQAPGKGLEWVA | VIWND---GSKKYHVDSVKG | RFTISRDNSKNTLYLQMNSLRAEDTALYYCAR | DLDKRNPPY------YYYYGMDV | WGQGTTVTVSS |
| iPS:4 37006 | 21-225_192G2 | VH3-33/D7/7-27/RF2/JH6 | QVQLVES-GGGVVQPGRSLRLSCAASG-FTFS | S------YGMH | WVRQAPGKGLEWVT | VIWND---GSNKYYADSVKG | RFTISRDNSKNTLYLQMNSLRAEDTALYYCAR | DLDKRNPPY------YYYYGMDV | WGQGTTVTVSS |
| iPS:4 37024 | 21-225_194F11 | VH3-33/D7/7-27/RF2/JH6 | QVQLVES-GGGVVQPGRSLRLSCAASG-FTFS | S------YGMH | WVRQAPGKGLEWVA | VIWND---GSKKYHVDSVKG | RFTISRDNSKNTLYLQMNSLRAEDTALYYCAR | DLDKRNPPY------YYYYGMDV | WGQGTTVTVSS |
| iPS:4 37028 | 21-225_194G12 | VH3-33/D7/7-27/RF2/JH6 | QVQLVES-GGGVVQPGRSLRLSCAASG-FTFS | S------YGMH | WVRQAPGKGLEWVT | VIWND---GSNKYYADSVKG | RFTISRDNSKNTLYLQMNSLRAEDTALYYCAR | DLDKRNPPY------YYYYGMDV | WGQGTTVTVSS |
| | Germline | | H_FR1 | H_CDR1 | H_FR2 | H_CDR2 | H_FR3 | H_CDR3 | H_FR4 |
| iPS:4 36290 | 21-225_205G3 | VH4-34/D6/6-19/RF3/JH3 | QVQLQQW-GAGLLKPSEILSLTCAVFG-GSFS | G------HYWS | WIEQPPGKGLEWIG | EMYH---FGNTNINPSLKS | RVTMSVDTSKKQFSLKLSSVTAADTAVYYCAR | VGQWL---------AFDI | WGQGTMVTVSS |
| | Germline | | H_FR1 | H_CDR1 | H_FR2 | H_CDR2 | H_FR3 | H_CDR3 | H_FR4 |
| iPS:4 36306 | 21-225_201H4 | VH3-30.3/D4/4-17/RF2/JH1 | QVQLVES-GGGVVQPGRSLRLSCAASG-FTFS | S------YAMH | WVRQAPGKGLEWVA | AIWYD---GSNKYNADSVKG | RFTISRDNSKNTLYMQMNSLRAEDTAVYYCAR | DVGIVG---------ATYFDC | WGPGTLVTVSS |
| | Germline | | H_FR1 | H_CDR1 | H_FR2 | H_CDR2 | H_FR3 | H_CDR3 | H_FR4 |
| iPS:4 36362 | 21-225_210C12 | VH1-18/D1/1-18/RF1/JH6 | QVQLVQS-GAEVKKPGASVKVSCKASG-YTFT | N------NGIS | WVRQAPGQGLEWMG | WINAY---NGHTNYAQKFQG | RVTMTTDTSTSTAYMELRSLRSDDTAVYYCAR | DPTVIHY---------YYYGMDV | WGQGTTVTVSS |
| iPS:4 36374 | 21-225_211C10 | VH1-18/D1/1-18/RF1/JH6 | QVQLVQS-GAEVKKPGASVKVSCKASG-YTFT | R------HGIS | WVRLAPGQGLEWMG | WISAY---NGLTNYAQKFQG | RVTMTTDTSTSTGVMELRSLRSDDTAVYYCAR | DPTVIHY---------YYYGMDV | WGQGTTVTVSS |
| | Germline | | H_FR1 | H_CDR1 | H_FR2 | H_CDR2 | H_FR3 | H_CDR3 | H_FR4 |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:4 36366 | 21-225_211A3 | VH3|3-33/D5|5-18|RF3/J H6 | QVQLVES-GGGVVQPGRSLRL SCAVSG-ITFS | S------YGMH | WARQAPGK GLEWVA | VIWYD----GSNKNYEDS VKG | RFTISRDNSKNTLYLQMNSL RAEDTAVYYCAR | DGSYGY-------DGMDV | WGQGT TVTVS S |
| iPS:4 36388 | 21-225_212H11 | VH3|3-33/D5|5-18|RF3/J H6 | QVQLVES-GGGVVQPGRSLRL SCAVSG-ITFS | S------YGMH | WARQAPGK GLEWVA | VIWYD----GSNKNYEDS VKG | RFTISRDNSKNTLYLQMNSL RAEDTAVYYCAR | DGSYGY-------DGMDV | WGQGT TVTVS S |
| iPS:4 36396 | 21-225_213E5 | VH3|3-33/D5|5-18|RF3/J H6 | QVQLVES-GGGVVQPGRSLRL SCAVSG-ITFS | S------YGMH | WARQAPGK GLEWVA | VIWYD----GSNKNYEDS VKG | RFTISRDNSKNTLYLQMNSL RAEDTAVYYCAR | DGSYGY-------DGMDV | WGQGT TVTVS S |
| iPS:4 36454 | 21-225_217B10 | VH3|3-33/D5|5-18|RF3/J H6 | QVQLVES-GGGVVQPGRSLRL SCAVSG-ITFS | S------YGMH | WARQAPGK GLEWVA | VIWYD----GSNKNYEDS VKG | RFTISRDNSKNTLYLQMNSL RAEDTAVYYCAR | DGSYGY-------DGMDV | WGQGT TVTVS S |
| iPS:4 36668 | 21-225_147B9 | VH3|3-33/D5|5-18|RF3/J H6 | QVQLVES-GGGVVQPGRSLRL SCAASG-FTFS | S------YGMH | WVRQAPGK GLEWVA | VIWYD----GSNKYADS VKG | RFTISRDNSKNTLYLQMNSL RAEDTAVYYCAR | DRDYGDPPY-------YYYYGMDV | WGQGT TVTVS S |
| iPS:4 36688 | 21-225_148C8 | VH3|3-33/D5|5-18|RF3/J H6 | QVQLVES-GGGVVQPGRSLRL SCAASG-FTFS | S------YGMH | WVRQAPGK GLEWVA | VIWYD----GSNKYADS VKG | RFTISRDNSKNTLYLQMNSL RAEDTAVYYCAR | DRDYGDPPY-------YYYYGMDV | WGQGT TVTVS S |
| iPS:4 36706 | 21-225_149A11 | VH3|3-33/D5|5-18|RF3/J H6 | QVQLVES-GGGVVQPGRSLRL SCAASG-FTFS | S------YGMH | WVRQAPGK GLEWVA | VIWYD----GSNKYADS VKG | RFTISRDNSKNTLYLQMNSL RAEDTAVYYCAR | DRDYGDPPY-------YYYYGMDV | WGQGT TVTVS S |
| iPS:4 36760 | 21-225_155E10 | VH3|3-33/D5|5-18|RF3/J H6 | QVQLVES-GGGVVQPGRSLRL SCAASG-FTFS | S------YGMH | WVRQAPGK GLEWVA | VIWYD----GSNKYADS VKG | RFTISRDNSKNTLYLQMNSL RAEDTAVYYCAR | DRDYGDPPY-------YYYYGMDV | WGQGT TVTVS S |
| iPS:4 36966 | 21-225_190C3 | VH3|3-33/D5|5-18|RF3/J H6 | QVQLVES-GGGVVQPGRSLRL SCAASG-FTFS | S------YGMH | WVRQAPGK GLEWVA | VIWYD----GSNKYADS VKG | RFTISRDNSKNTLYLQMNSL RAEDTAVYYCAN | WYYYY-------YGMDV | WGQGT TVTVS S |
| iPS:4 36976 | 21-225_190D8 | VH3|3-33/D5|5-18|RF3/J H6 | QVQLVES-GGGVVQPGRSLRL SCAASG-FTFS | S------YGLH | WVRQAPGK GLEWVA | VIWYD----GSNKYADS VKG | RFTISRDNSKNTLYLQMNSL RAEDTAVYYCAN | WYYYY-------YGMDV | WGQGT TVTVS S |
| iPS:4 37168 | 21-225_218G4 | VH3|3-33/D5|5-18|RF3/J H6 | QVQLVES-GGGVVQPGRSLRL SCAASG-FTFS | S------YGLH | WVRQAPGK GLEWVA | VIWYD----GSNKYADS VKG | RFTISRDNSKNTLYLQMNSL RVEDTAVYYCAN | WYYYY-------YGMDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36368 | 21-225_211G3 VH3-33/D5-24/RF3/JH5 | QVQLVES-GGGVVQPGRSLRLSCAASG-FTFS | N-----YGMH | WVRQAPGK GLEWVA | VIWHD----GSNKYYADS VKG | RFTISRDNSKNTLYLQMNSL RAEDTAVYYCAR | LDYSNY----------GWFDP | WGQGT LVTVS S |
| iPS:4 36426 | 21-225_215C7 VH3-33/D5-24/RF3/JH5 | QVQLVES-GGGVVQPGRSLRLSCAASG-FTFS | Y-----YGMH | WVRQAPGK GLEWVA | VIWHD----GSNKYYADS VKG | RFTISRDNSKNTLYLQMNSL RAEDTAVYYCAR | LDYSNY----------GWFDP | WGQGT LVTVS S |
| iPS:4 36432 | 21-225_215H12 VH3-33/D5-24/RF3/JH5 | QVQLVES-GGGVVQPGRSLRLSCAASG-FTFS | N-----YGMH | WVRQAPGK GLEWVA | VIWHD----GSNKYYADS VKG | RFTISRDNSKNTLYLQMNSL RAEDTAVYYCAR | LDYSNY----------GWFDP | WGQGT LVTVS S |
| | Germline | | | | | | | |
| VH1-18/D4-11/RF2/JH6 | | | | | | | | |
| iPS:4 36402 | 21-225_213H12 VH1-18/D4-11/RF2/JH6 | QVQLVQS-GAEVKKPGASVKV SCKASG-FTFT | S-----YGIN | WVRQAPGQ GLEWMG | WISVH----NGNTDYAQK FQG | RVTMTDTSTSTAYMELRSL RSDTAVYYCAR | DYYY------------GMDV | WGQGT KVTVS S |
| iPS:4 36500 | 21-225_222H3 VH1-18/D4-11/RF2/JH6 | QVQLVQS-GAEVKKPGASVKV SCKASG-FTFT | S-----YGIN | WVRQAPGQ GLEWMG | WISVY----NGNTNYAQK LQG | RVTMTDTSTSTAYMELRSL RSDDTAVYYCAR | DYYY------------GFDV | WGQGT TVTVS S |
| iPS:4 36520 | 21-225_223G10 VH1-18/D4-11/RF2/JH6 | QVQLVQS-GAEVKKPGASVKV SCKASG-FTFT | S-----YGIN | WVRQAPGQ GLEWMG | WISVY----SGNTNYAQK LQG | RVTMTDTSTSTAYMELRSL RSDDTAVYYCAR | DYYY------------GMDV | WGQGT TVTVS S |
| | Germline | | | | | | | |
| VH3-48/D2-21/RF1/JH4 | | | | | | | | |
| iPS:4 36436 | 21-225_216F10 VH3-48/D2-21/RF1/JH4 | EVQLVES-GGGLVQPGGSLRL SCAASG-FSFR | S-----YSMN | WVRQAPGK GLEWVS | YITGS----SSTIYYADS VKG | RFTISRDNAKNSLYLQMNSL RDEDTAVYYCAR | SGLA-------------VEEY | WGQGT LVTVS S |
| | Germline | | | | | | | |
| VH3-48/D6-6/RF1/JH4 | | | | | | | | |
| iPS:4 36448 | 21-225_217A3 VH3-48/D6-6/RF1/JH4 | EVQLVES-GGGLVQPGGSLRL SCAASG-FTFS | S-----YNMN | WVRQAPGK GLEWVS | YISSS----RNIIYYADS VKG | RFTISRENAKNSLSLQMDSL RDEDTAVYYCAR | DGSYSSG----------WYWGFDY | WGQGT LVTVS S |
| | Germline | | | | | | | |
| VH4-39/D6-6/RF3/JH6 | | | | | | | | |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36472 | 21-225_220E1 | VH4/4-59/D6/6-19/RF3/J H6 | QVQLQES-GPGLVKPSETLSL TCTVSG-GSIS | T------YYWS | WIRQPPGK GLEWIG | YIYY------SGTTNYNPS LKS | RVTISVDTSKNQFSLKLSSV TAADTAVYYCAR | DQQWLVRGR------DNYYYGMDV | WGQGT TVTVS S |
| | Germline | VH3/3-23/D2/2-15/RF3/JH4 | EVQLLES-GGGLVQPGGSLRL SCAASG-FTFS | | WVRQAPGK GLEWVS | | | | |
| iPS:4 36504 | 21-225_222H4 | VH3/3-23/D2/2-15/RF3/J H4 | EVQLLES-GGGLVQPGGSLRL SCAASG-FTFS | N------FAMS | WVRQAPGK GLEWVS | SIVGS------GGRTYYADS VKG | RFTISRDNSKNTLYLQMNSL RAEDTAVYYCAK | DPYRVAV------AGAFDY | WGQGT LITVS S |
| iPS:4 36510 | 21-225_222H8 | VH3/3-23/D2/2-15/RF3/J H4 | EVQLLES-GGGLVQPGGSLRL SCAASG-FTFS | M------FAMS | WVRQAPGK GLEWVS | SIVGS------GGRTYYADS VKG | RFTISRDNSKNTLYLQMNSL RAEDTAVYYCAK | DPYRVAV------AGAFDY | WGQGT LITVS S |
| | Germline | VH3/3-23/D3/3-22/RF2/JH1 | | | | | | | |
| iPS:4 36526 | 21-225_224A1 | VH3/3-23/D3/3-22/RF2/J H1 | EVQVLES-GGGLVQPGGSLRL SCAASG-FTFS | S------YAMS | WVRQAPGK GLEWVS | AISGR------GGSTYYADA VKG | RFTISRDNSKNTLYLQMNSL RAEDTAVYYCAK | GSYDSSG------YYHYLDR | WGQGT LVTVS S |
| | Germline | VH1/1-02/D4/4-23/RF2/JH6 | | | | | | | |
| iPS:4 36536 | 21-225_224G1 | VH1/1-02/D4/4-23/RF2/J H6 | QVQLVQS-GAEVKKPGASVKV SCKASG-YTFT | G------YYIH | WVRQAPGQ GLEWMG | WINPY------SGDTNYAQK FQG | RVTMTRDTSISTAYMELSRL RFEDTAVFYCAR | DWGGYSS------YYYGMDV | WGQGT TVTVS S |
| iPS:4 36548 | 21-225_224A7 | VH1/1-02/D4/4-23/RF2/J H6 | QVQLVQS-GAEVKKPGASVKV SCKASG-YTFT | G------YYIH | WVRQAPGQ GLEWMG | WINPY------SGDTNYAQK FQG | RVTMTRDISISTAYMELSRL RFEDTAVFYCAR | DWGGYSS------YYYGMDV | WGQGT TVTVS S |
| iPS:4 36558 | 21-225_224C11 | VH1/1-02/D4/4-23/RF2/J H6 | QVQLVQS-GAEVKKPGASVKV SCKASG-YTFT | G------YYIH | WVRQAPGQ GLEWMG | WINPY------SGDTNYAQK FQG | RVTMTRDISISTAYMELRRL RFEDTAVFYCAR | DWGGYSS------YYFGMDV | WGQGT TVTVS S |
| iPS:4 36562 | 21-225_224H11 | VH1/1-02/D4/4-23/RF2/J H6 | QVQLVQS-GAEVKKPGASVKV SCKASG-YTFT | G------YYIH | WVRQTPGQ GLEWMG | WINPY------SGDTNYAQK FQG | RVTMTRDISISTAYMELRRL RFEDTAVFYCAR | DWGGYSS------YYYGMDV | WGQGT TVTVS S |
| iPS:4 36572 | 21-225_225G4 | VH1/1-02/D4/4-23/RF2/J H6 | QVQLVQS-GAEVKKPGASVKV SCKASG-YTFT | G------YYIH | WVRQAPGQ GLEWMG | WINPY------SGDTNYAQK FQG | RVTMTRDISISTAYMELRRL REEDTAVFYCAR | DWGGYSS------YYYGMDV | WGQGT TVTVS S |

Figure 51 (Continued)

| | | FR1 | CDR1 | FR2 | CDR2 | FR3 | CDR3 | FR4 |
|---|---|---|---|---|---|---|---|---|
| iPS:4 36606 | 21-225_226G8 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTKYAQKFQG | RVTMTRDTSISTAYMELSRLREDDTAVFYCAR | DWGGYSS--------YYYGMDV | WGQGTTVTVSS |
| iPS:4 36610 | 21-225_226F9 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTKYAQKFQG | RVTMTRATSISTAYMELSRLREDDTAVFYCAR | DWGGYSS--------YYYGMDV | WGQGTTVTVSS |
| iPS:4 36612 | 21-225_226H9 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTNSAQKFQG | RVTMTRDTSISTAYMELSRLREDDTAVFYCAR | DWGGYSS--------YYYGMDV | WGQGTTVTVSS |
| iPS:4 36614 | 21-225_226F10 VH1\|1-02\|D4\|4-23\|RF2\|JH6 | QVQLVQS-GGEVKKLRASVKVSCKASG-YTFT | G------YYIH | WVRQAPGQGLEWMG | WINPY----SGDTKYAQKFQG | RVTMTRDTSISTAYMELSRLRLDDTAVFYCAR | DWGGYSS--------YYYGMDV | WGQGTPVTVSS |
| iPS:4 36618 | 21-225_226E11 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELRRLREDDTAVYYCAR | DWGGYSS--------YYYGMDV | WGQGTTVTVSS |
| iPS:4 36624 | 21-225_226H12 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELSRLREDDTAVYYCAR | DWGGYSS--------YYYGMDV | WGQGTTVTVSS |
| iPS:4 36626 | 21-225_227C1 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTNYAQKFQG | RVTMTRDTSISTAYMELSRLREDDTAVYYCAR | DWGGYSS--------YYYGMDV | WGQGTTVTVSS |
| iPS:4 36628 | 21-225_227F2 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTKYAQKFQG | RVTMTRDTSVSTAYMELSRLREDDTAVFYCAR | DWGGYSS--------YYYGMDV | WGQGTTVTVSS |
| iPS:4 36640 | 21-225_227A8 VH1\|1-02\|D4\|4-23\|RF2\|JH6 | QVQLVQS-GAEVKKPGASVKVSCKASG-YTFT | G------YYIH | WVRQAPGQGLEWMG | WINPY----SGDTNYAQKFQG | RVTMTRDTSVSTAYMELSRLREDDTAVFYCAR | DWGGYSS--------YYYGMDV | WGQGTTVTVSS |
| | Germline | H_FR1 | H_CDR1 | H_FR2 | H_CDR2 | H_FR3 | H_CDR3 | H_FR4 |
| iPS:4 36538 | 21-225_224C3 VH4\|4-39\|D4\|4-17\|RF1\|JH4 | QLQLQES-GPGLVKSSETLSLTCTVSG-GSIS | RS----SYYWG | WIRQPPGKGLEWIG | MIYY----SGSTYNPSLKS | RVTISVDTSKNQFSLKLSSVTAADTAVYYCAR | QGRDW---------GVDY | GGQGTLVTVSS |
| | Germline | H_FR1 | H_CDR1 | H_FR2 | H_CDR2 | H_FR3 | H_CDR3 | H_FR4 |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS.4 36546 | 21-225_224D6 | VH3|3-23|D4|4-11|RF2|JH5 | EVQVLES-GGGLVQPGGSLRL SCAASG-STFS | S------DAMS | WVRQAPGK GLEWVS | AISGS---GDNTFYADS VKG | RFTISRDNSKNTLYLQMNSL RAEDTAVYYCAK | VYSAYD-------SHWFDP | WGQGT LVTVS S |
| | | Germline | | | | | | | |
| | VH1|1-46|D6|6-6|RF2|JH6 | | | | | | | | |
| iPS.4 36568 | 21-225_225B3 | VH1|1-46|D6|6-6|RF2|JH6 | QVQLVQS-GAEVKKPGASVKV SCKASG-YTFT | S------YYMH | WVRQAPGQ GLEWMG | IINPS---GGSTSYAQK FQG | RVTMTRDTSISTVYMELSSL RSADTAVYYCAR | DLAARSIY---YYFGMDV | WGQGA TVTVS S |
| | | Germline | | | | | | | |
| | VH4|4-30.1|D4|4-17|RF2|JH6 | | | | | | | | |
| iPS.4 36580 | 21-225_225E7 | VH4|4-30.1|D4|4-17|RF2|JH6 | QVQLQES-GPGLVKPSQTLSL TCTVSG-NSIS | SG---HYYWS | WIRQHPGK GLEWIG | FIYY---TGSTYNPS LKS | RVTISVDTSKNQFSLKLSSV TAADTAVYYCAR | EAGDYG---YYGMDV | WGQGT TVTVS S |
| iPS.4 36926 | 21-225_78D10 | VH4|4-30.1|D4|4-17|RF2|JH6 | QVQLQES-GPGLVKPSQTLSL TCTVSG-GSIS | SG---GYYWS | WIRQHPGK GLEWIG | YIYY---IGSVYNPS LKS | RVTISVDTSKNQFSLKLSSV TAADTAVYYCAR | DAPDF------GMDV | WGQGT TVTVS S |
| | | Germline | | | | | | | |
| | VH3|3-33|D4|4-17|RF2|JH1 | | | | | | | | |
| iPS.4 36592 | 21-225_226B1 | VH3|3-33|D4|4-17|RF2|JH1 | QVQLVES-GGGVVQPGRSLRL SCAASG-FTFS | T------YGMH | WVRQAPGK GLEWVA | IIWYD---GGYKYYADS VKG | RFTISRDNSKNTLFLQMNSL RAEDTAVYYCAR | DHYDFW-----SGYLTH | WGQGT LVTVS S |
| | | Germline | | | | | | | |
| | VH3|3-23|D7|7-27|RF1|JH6 | | | | | | | | |
| iPS.4 36652 | 21-225_146B11 | VH3|3-23|D7|7-27|RF1|JH6 | EVQLLES-GGGLVQPGGSLRL SCAASG-FTFS | S------YAMS | WVRQAPGK GLEWVS | VISGG---GSSTYYADS VKG | RFTISRDNSKNTLYLQMNSL RAEDTAVYYCAK | WRGNPT---DYGMDV | WGQGT TVTVS S |
| iPS.4 36654 | 21-225_146C11 | VH3|3-23|D7|7-27|RF1|JH6 | EVQLLES-GGGLVQPGGSLRL SCAASG-ITFS | S------YAMS | WVRQAPGK GLEWVS | VISGG---GSSTYYADS VKG | RFTISRDNSKNTLYLQMNSL RAEDTAVYYCAK | WRGNPT---DYGMDV | WGQGT TVTVS S |
| iPS.4 36658 | 21-225_146A2 | VH3|3-23|D7|7-27|RF1|JH6 | EVQLLES-GGGLVQPGGSLRL SCAASG-FTFS | S------YAMS | WVRQAPGK GLEWVS | VISGG---GSSTYYADS VKG | RFTISRDNSKNTLHLQMNSL RAEDTAVYYCAK | WRGNPT---DYGMDV | WGQGT TVTVS S |

Figure 51 (Continued)

| | | | | | | | | |
|---|---|---|---|---|---|---|---|---|
| iPS:4 36664 | 21-225_147E7 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36676 | 21-225_147E11 | VH3\|3-23\|D7\|7-27\|RF1\|J H6 | EVQLLES-GGGLVQPGGSLRL SCAASG-FTFS | N-----YVMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36678 | 21-225_147B12 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36686 | 21-225_148G6 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNMLHLQMNSL RAEDTAVYYCAK | WRGNPT------DYGMDV | WGQGT TVTVS S |
| iPS:4 36694 | 21-225_148G11 | VH3\|3-23\|D7\|7-27\|RF1\|J H6 | EVQLLES-GGGLVQPGGSLRL SCAASG-FTFS | S-----YPMS | WVRQAPGK GLEWVS | VISGG----GSSAYYADS VKG | RFTISRDNSKNTLYLQMNSL RAEDTAVYYCAK | WRGNPT------DYGMDV | WGQGT TVTVS S |
| iPS:4 36700 | 21-225_149C7 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36704 | 21-225_149C10 | VH3\|3-23\|D7\|7-27\|RF1\|J H6 | EVQLLES-GGGLVQPGGSLRL SCAASG-FTFS | S-----HAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36710 | 21-225_150F6 | VH3\|3-23\|D7\|7-27\|RF1\|J H6 | EVQLLES-GGGLVQPGGSLRF SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36714 | 21-225_150H11 | VH3\|3-23\|D7\|7-27\|RF1\|J H6 | EVQLLES-GGGLVQPGGSLRL SCAASG-FTFS | T-----YAMS | WVRQAPGK GLEWVS | IISGG----GSSTYYADS VKG | RFTISRDNSKNTLYLQMNSL RAEDTAVYYCAK | WRGNPT------DYGMDV | WGQGT TVTVS S |
| iPS:4 36718 | 21-225_151H5 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36722 | 21-225_151H7 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36724 | 21-225_151B9 | VH3\|3-23\|D7\|7-27\|RF1\|J H6 | EVQLLES-GGGLVQPGGSLRL SCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36728 | 21-225_152G6 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36730 | 21-225_152D7 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DSGMDV | WGQGT TVTVS S |
| iPS:4 36742 | 21-225_154C4 | VH3/3-23/D7/7-27/RF1/JH6 | EVQLLES-GGGLIQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36746 | 21-225_154E10 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36758 | 21-225_155C10 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 36338 | 21-225_146A3 | VH3/3-23/D7/7-27/RF1/JH6 | EVQLLES-GGGLVQPGGSLRLSCAASG-FTFS | S-----YAMS | WVRQAPGK GLEWVS | VISGG----GTTTYYADS VKG | RFTISRDNSKNTLYLQMNSL RAEDTAVYYCAK | WRGNPT------DYGMDV | WGQGT TVTVS S |
| iPS:4 37250 | 21-225_148C6 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 37252 | 21-225_148H11 | VH3/3-23/D7/7-27/RF1/JH6 | EVQLLES-GGGLVQPGGSLRLSCAASG-FTFS | S-----YAMS | WVRQAPGK GLEWVS | VISGG----GSSTYYADS VKG | RFTISRDNSKNTLYLQMNSL RAEDTAVYYCAK | WRGNPT------DYGMDV | WGQGT TVTVS S |
| iPS:4 37282 | 21-225_207C9 | VH3/3-23/D7/7-27/RF1/JH6 | EVQLLES-GGGLVQPGGSLRLSCAASG-FTFS | S-----YAMS | WVRQAPGK GLEWVS | AISGS----GGSTYYADS VKG | RFTISRDNSKNTLYLQMNSL RAEDTAVYYCAK | AGGTIGSY----YYNGMDV | WGQGT TVTVS S |
| Germline | | | H_FR1 | H_CDR1 | H_FR2 | H_CDR2 | H_FR3 | H_CDR3 | H_FR4 |
| | VH3/3-48/D4/4-11/RF2/JH6 | | | | | | | | |
| iPS:4 36660 | 21-225_146D8 | VH3/3-48/D4/4-11/RF2/JH6 | EVQLVES-GGGLVQPGGSLRLSCAASG-FTFS | N-----YNMN | WVRQAPGK GLEWVS | YISRS----SNTKYYVDS VKG | RFTISRDNAKNSLYLQMNSL RDEDTAVYYCAR | DRSGSYGY------FYYYGLDV | WGQGT TVTVS S |
| iPS:4 36682 | 21-225_146A8 | VH3/3-48/D4/4-11/RF2/JH6 | EVKLVES-GGGLVQPGESLRLSCVASG-FTFS | N-----YNMN | WVRQAPGK GLEWVS | YISRS----SNTKYYADS VRG | RFTISRDNAKNSLYLQMNSL RDEDTAVYYCAR | DRSGSYGY------FYYYGLDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36684 | 21-225_146B6 | VH3/3-48/D4/4-11|RF2/JH6 | EVQLVES-GGGLVQPGGSLRL SCAASG-FTFS | S------YNMN | WVRQAPGK GLEWVS | YISRS---SNTKHYADS VKG | RFTISRDNAKNSLYLQMDSL RQEDTAVYYCAR | DRSGSYGY------FYYYGLDV | WGQGI TVTVS S |
| iPS:4 36696 | 21-225_149A1 | VH3/3-48/D4/4-11|RF2/JH6 | EVQLVES-GGGLVQPGGSLRL SCAASG-FTFS | S------YNMN | WVRQAPGK GLEWVS | YISRS---SNTKHYADS VKG | RFTISRDNAKNSLYLQMNSL RQEDTAVYYCAR | DRSGSYGY------FYYYGLDV | WGQGT TVTVS S |
| iPS:4 36712 | 21-225_150F9 | VH3/3-48/D4/4-11|RF2/JH6 | EMQLVES-GGGLVQPGGSLRL SCAASG-FTFS | S------YNMN | WVRQVPGK GLEWVS | YISRS---SNTKHYADS VKG | RFTISRDNAKNSLYLQMNSL RQEDTAVYYCAR | DRSGSYGY------FYYYGLDV | WGQGT TVTVS S |
| iPS:4 36762 | 21-225_156H2 | VH3/3-48/D4/4-11|RF2/JH6 | EVQLVES-GGGLIQPGGSLRL SCAASG-FTFS | N------YNMN | WVRQAPGK GLEWVS | YISRS---SNTKYYADS VKG | RFTISRDNAKNSLYLQMNSL RQEDTAVYYCAR | DRSGSYGY------FYYYGMDV | WGQGT TVTVS S |
| iPS:4 36820 | 21-225_179D10 | VH3/3-48/D4/4-11|RF2/JH6 | EVQLVES-GGGLVQPGGSLRL SCAASG-FTFS | S------YSMN | WVRQAPGK GLEWVA | YISSS---GSTTYYADS VQG | RFTISRDNARNSLYLQMNSL RQEDTAVYRCAR | DSRKGF------YYGLDV | WGQGT TVTVS S |
| iPS:4 37262 | 21-225_170E4 | VH3/3-48/D4/4-11|RF2/JH6 | EVQLVES-GGGSVQPGGSLRL SCAASG-FTFS | S------YSMN | WVRQAPGK GLEWVS | YISSS---GSTKYYADS VEG | RFTISRDNAKNSLDLQMNSL RQEDTAVYRCAR | DSRKGF------YYGLDV | WGQGT TVTVS S |
| | Germline | | | | | | | | |
| iPS:4 36662 | 21-225_147D7 | VH1/1-08/D5/5-12|RF1/JH6 | QVQLVQS-GAEVKKPGASVKV SCKASG-YTFT | S------YDIN | WVRQATGQ GLEWMG | WMNPN---SGNTGYAQK FQG | RVTMTRNTSISTAYMELRSL RSEDTAVYYCAR | ADIVLVPAAI---PYNYFAMDV | WGQGT TVTVS S |
| | Germline | | | | | | | | |
| iPS:4 36666 | 21-225_147B8 | VH1/1-02/D3/3-3|RF2/JH6 | QVQLVQS-GAEVKKPGASVKV SCKASG-YTFT | D------YYLH | WVRQAPGQ GLEWMG | WINPN---SGDTNYAQK FQG | RVTMTRDTSISTAYMELSKL RSEDTAVYYCAR | DRDSGGSYP---YYYYGMDV | WGQGT TVTVS S |
| | Germline | | | | | | | | |
| iPS:4 36672 | 21-225_147F9 | VH3/3-33/D3/3-3|RF2/JH6 | QVQLVES-GGGVVQPGRSLRL SCAASG-FTFS | T------YGMH | WVRQAPGK GLEWVA | VIWYG---GSDKDYADS VKG | RFTISRDISKNTLYLQMNSL RAEDTAVYYCAR | DRDYCSGGTC------FYYYYGMDV | WGQGT TVTVS S |

Figure 51 (Continued)

| | | | | | | | | | |
|---|---|---|---|---|---|---|---|---|---|
| iPS:4 36674 | 21-225_147G9 | VH3/3-33/D3/3-3/RF2/JH6 | QVQLVES-GGGVVQPGRSLRL SCAASG-FTFS | T-----YGMH | WVRQAPGK GLEWVA | VIWYG---- GSDKDYADS VKG | RFTISRDISKNTLYLQMNSL RAEDTAVYYCAR | DRDYCSGSC--------- -----PYYYYYGMDV | WGQGT TVTVS S |
| iPS:4 36690 | 21-225_148A9 | VH3/3-33/D3/3-3/RF2/JH6 | QVQLVES-GGGVVQPGRSLRL SCAASG-FTFS | T-----YGMH | WVRQAPGK GLEWVA | VIWYG---- GSDKDYADS VKG | RFTISRDISKNTLYLQMNSL RAEDTAVYYCAR | DRDYCSGTC--------- -----PYYYYYGMDV | WGQGT TVTVS S |
| iPS:4 36708 | 21-225_150D3 | VH3/3-33/D3/3-3/RF2/JH6 | QVQLVES-GGGVVQPGRSLRL SCAASG-FTFS | T-----YGMH | WVRQAPGK GLEWVA | VIWYG---- GSNKDYADS VKG | RFTISRDISKNTLYLQMNSL RAEDTAVYYCAR | DRDYCSGGSC-------- -----PYYYYYGMDV | WGQGT TVTVS S |
| iPS:4 36716 | 21-225_151F3 | VH3/3-33/D3/3-3/RF2/JH6 | QVQLVES-GGGVVQPGRSLRL SCAASG-FTFS | T-----YGMH | WVRQAPGK GLEWVA | VIWYG---- GSNTDYADS VKG | RFTISRDISKNTLYLQMNSL RAEDTAVYYCAR | DRDYCSGSC--------- -----PYYYYYGMDV | WGQGT TVTVS S |
| iPS:4 36738 | 21-225_153D9 | VH3/3-33/D3/3-3/RF2/JH6 | QVQLVES-GGGVVQPGRSLRL SCAASG-FTFS | T-----YGMH | WVRQAPGK GLEWVA | VIWYG---- GSNKDYADS VKG | RFTISRDISKNTLYLQMNSL RAEDTAVYYCAR | DRDYCSGGSC-------- -----PYYYYYGMDV | WGQGT TVTVS S |
| iPS:4 36740 | 21-225_154C3 | VH3/3-33/D3/3-3/RF2/JH6 | QVQLVES-GGGVVQPGRSLRL SCAASG-FTFS | T-----YGMH | WVRQAPGK GLEWVA | VVWYG---- GNNKDYADS VKG | RFTISRDISKNTLYLQMNSL RAEDTAVYYCAR | DRDYCSGGSC-------- -----PYYYYYGMDV | WGQGT TVTVS S |
| iPS:4 36748 | 21-225_154D11 | VH3/3-33/D3/3-3/RF2/JH6 | QVQLVES-GGGVVQPGRSLRL SCAASG-FNVS | T-----YGMH | WVRQAPGK GLEWVA | VIWYG---- GSNKDYADS VKG | RFTISRDSSRNTLYLQMNSL RAEDTAVYYCAR | DRDYCSGSC--------- -----PYYYYYGMDV | WGQGT TVTVS S |
| iPS:4 36764 | 21-225_158E9 | VH3/3-33/D3/3-3/RF2/JH6 | QVQLVES-GGGVVQPGRSLRL SCAASG-FTFS | S-----YGMH | WVRQAPGK GLEWVA | VIWYG---- GSSKYYADS VKG | RFTISRDNSKNTLYLQMNSL RAEDTAVYYCAR | DRVFCSGTSC-------- -----PYYYYYGMDV | WGQGT TVTVS S |
| iPS:4 36774 | 21-225_161E10 | VH3/3-33/D3/3-3/RF2/JH6 | QVQLVES-GGGVVQPGRSLRL SCAASG-FTFS | S-----YGMH | WVRQAPGK GLEWVA | VIWYG---- GSNKYYVDS VKG | RFTISRDNSKNTLYLQMNSL RAEDTAVYYCAR | DRVFCSGTSC-------- -----PYYYYYGMDV | WGQGT TVTVS S |
| iPS:4 36916 | 21-225_74A9 | VH3/3-33/D3/3-3/RF2/JH6 | QVQLVES-GGGVVQPGRSLRL SCAASG-FTFS | S-----YGMH | WVRQAPGK GLEWVA | VIWYD---- GNNKSYADS VKG | RFTISRDISKNTLFLQMNSL RADDTAVYYCAR | DRDYCSGTSC-------- -----PYYYYYGMDV | WGQGT TVTVS S |
| iPS:4 36940 | 21-225_146B8 | VH3/3-33/D3/3-3/RF2/JH6 | QVQLVES-GGGVVQPGRSLRL SCAASG-FTFS | T-----YGMH | WVRQAPGK GLEWVA | VIWYD---- GNDKDFADS VTG | RFTISRDISKNTLYLQMNSL RAEDTAVYYCAR | DRDYCSGGSC-------- -----PYYYYYGMDV | WGQGT TVTVS S |
| iPS:4 37258 | 21-225_153F9 | VH3/3-33/D3/3-3/RF2/JH6 | QVHLVES-GGGVVQPGRSLRL SCAASG-FTIS | T-----YGMH | WVRQGPGK GLEWVA | VIWYG---- GSDTDYADS VRG | RFTISRDISKNTLYLQMNSL RAEDTAVYYCAR | DRDYCSGGNC-------- -----PYYYYYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-30.1/D7/7-27/RF3/JH5 | | QVQLQES-GPGLVKPGQTLSL TCTVSG-GSIS | SG----YYWS | WIRQHPGK GLEWIG | YIYY----SGSTYYNPS LKS | RVTISVDTSKNQFSLKLTSV TAADTAVYYCAR | NWGN-------YFDP | WGQGT LVTVS S |
| iPS:4-36680 | 21-225_147H12 | VH4-30.1/D7/7-27/RF3/JH5 | QVQLQES-GPGLVKPSQTLSL TCAVSG-GSIS | SG----YHWS | WIRQHPGK GLEWIG | YIYY----SGSTYYNPS LKS | RVTISVDTSKNQFSLKLTSV TAADTAVYYCAR | DWGGYDS------SGWFDP | WGQGT LVTVS S |
| iPS:4-36750 | 21-225_154G12 | VH4-30.1/D7/7-27/RF3/JH5 | QVQLQES-GPGLVNPSQTLSL TCGVSG-GSIS | SG----YYWS | WIRQHPGK GLEWIG | YIYY----SGSTYYNPS LKS | RVSISLDTPKNQFSLKLTSV TAADTAVYYCAR | DWGGYDS------SGWFDP | WGQGT LVTVS S |
| | Germline | H_FR1 | H_CDR1 | H_FR2 | H_CDR2 | H_FR3 | H_CDR3 | H_FR4 |
| VH3-07/D6/6-13/RF1/JH4 | | EVQLVES-GGGLVKPGGSLRL SCAASG-FTFS | S-----YGMS | WVRQAPGK GLEWVA | NIKQD---GSEKYYVDS VKG | RFTISRDNAKNSLYLQMNSL RAEDTAVYYCAR | GYSSSW---YFDY | WGQGT LVTVS S |
| iPS:4-36698 | 21-225_149B5 | VH3-07/D6/6-13/RF1/JH4 | EVQLVES-GGGLVQPGGSLRL SCAASG-FTFS | G-----YWMN | WVRQAPGK GLEWVS | NIKQD---GSEKYVDS VKG | RFTISRDNAKNSLYLQMNSL RAEDTAVYYCAR | GMXSSG---WYVFDY | WGQGT LVTVS S |
| | Germline | H_FR1 | H_CDR1 | H_FR2 | H_CDR2 | H_FR3 | H_CDR3 | H_FR4 |
| VH3-21/D6/6-19/RF2/JH5 | | EVQLVES-GGGLVKPGGSLRL SCAASG-FTFS | S-----YSMN | WVRQAPGK GLEWVS | SISSS---SSYIYYADS VKG | RFTISRDNAKNSLYLQMNSL RAEDTAVYYCAR | GTAVAG-------NWFDP | WGQGT LVTVS S |
| iPS:4-36702 | 21-225_149E8 | VH3-21/D6/6-19/RF2/JH5 | EVQLVES-GGGLVKPGGSLRL SCAASG-FTFS | S-----YSMN | WVRRAPGK GLEWVS | AISST---GSYIYYADS VKG | RFTISRDNAKNSLYLQMNSL RAEDTAVYYCAR | TAVAGI-------GWFDP | WGQGT LVTVS S |
| | Germline | H_FR1 | H_CDR1 | H_FR2 | H_CDR2 | H_FR3 | H_CDR3 | H_FR4 |
| VH5-51/D3/3-22/RF2/JH6 | | EVQLVQS-GAEVKKPGESLKI SCKGSG-YSFT | S-----YWIG | WVRQMPGK GLEWMG | IIYPG---DSDTRYSPS FQG | QVTISADKSISTAYLQWSSL KASDTAMYYCAR | YYYDSSGYYY---YYYYGMDV | WGQGT TVTVS S |
| iPS:4-36752 | 21-225_155H1 | VH5-51/D3/3-22/RF2/JH6 | EVQLVQS-GAEVKRPGESLKI SCKGSG-YSFT | S-----YWIG | WVRQMPGK GLEWMG | LIYPG---ASDIRYSPS FQG | QVTISADKSISTAYLQWSSL KASDTAMYYCAR | QAIASRGR---YYYYGMDV | WGQGT TVTVS S |
| | Germline | H_FR1 | H_CDR1 | H_FR2 | H_CDR2 | H_FR3 | H_CDR3 | H_FR4 |
| VH3-33/D6/6-19/RF1/JH4 | | QVQLVES-GGGVQPGRSLRL SCAASG-FTFS | S-----YGMH | WVRQAPGK GLEWVA | VIWYD---GSNKYYADS VKG | RFTISRDNSKNTLYLQMNSL RAEDTAVYYCAR | GYSSGW-------YFDY | WGQGT LVTVS S |
| iPS:4-36772 | 21-225_161H3 | VH3-33/D6/6-19/RF1/JH4 | QVQLVES-GGGVQPGRSLRL SCAASG-FTFS | S-----YGMH | WVRQAPGK GLEWVA | VIWYD---GSNKYYADS VKG | RFTISRDNSKNTLYLQMNSL RAEDTAVYYCAR | VGYSGG-------WYIFDY | WGQGT LVTVS S |
| | Germline | H_FR1 | H_CDR1 | H_FR2 | H_CDR2 | H_FR3 | H_CDR3 | H_FR4 |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| | VH4-30.1\|D2\|2-2\|RF2\|JH6 | QVQLQES-GGGLVKPSQTLSL TLTVSG-GSIS | SG----GYYWS | WIRQHPGK GLEWIG | SGSTYYNPS LKS | RVTISVDTSKNQFSLKLSSV TAADTAVYYCAR | GYYSSTRCYT-------YYYYGMDV | WGQGT TVTVS S |
| iPS:4 36776 | 21-225_161F12 | QVQLQES-GFGLVKPSQTLSL TCTVSG-GSIS | SG----GYYWS | WIRQHPGK GLEWIG | YIYY---- SGSPYYNPS LKS | RITISIDTSKNQFSLKLNSV TAADTAVYYCAR | SNCSSANCYT-------VGFYYYGLDV | WGRGT TVTVS S |
| iPS:4 36780 | 21-225_165H3 VH4-30.1\|D2\|2-2\|RF2\|JH6 | QVQLQES-GFGLVKPSQTLSL TCTVSG-GSIS | SG----GYYWS | WIRQHPGK GLEWIG | YIYY---- SGSPYYNPS LKS | RITISIDTSKNQFSLKLNSV TAADTAVYYCAR | SNCSSANCYT-------VGFYYYGMDV | WGQGT TVTVS S |
| | Germline | H_FR1 | H_CDR1 | H_FR2 | H_CDR2 | H_FR3 | H_CDR3 | H_FR4 |
| | VH3-33\|D5\|5-24\|RF3\|JH6 | EVQLVES-GGGVVQPGRSLRL SCAASG-FTFS | S------NGMH | WVRQAPGK GLEWVA | VIWYD--- GSNKYYADS VKG | RFTISRNDSKNTLYLQMNSL RAEDTAVYYCAR | RGANYYY-------YYYGMDV | WGQGT TVTVS S |
| iPS:4 36784 | 21-225_169C1 VH3-33\|D5\|5-24\|RF3\|JH6 | QVQLVES-GGGVVQPGRSLRL SCAASG-FTLS | S------NGMH | WVRQAPGK GLEWVA | VIWYD--- GSNKYYADS VKG | RFTISRDTSKNTLYLQMNSL RAEDTAVYYCAR | DQYNRNDGPP-------AYYYYGLDV | WGQGT TVTVS S |
| iPS:4 36786 | 21-225_169A6 VH3-33\|D5\|5-24\|RF3\|JH6 | QVQLVES-GGGVVQPGRSLRL SCAASG-FTLS | S------NGMH | WVRQAPGK GLEWVA | VIWYD--- GSNKYYADS VKG | RFTISRDNSKNTLSLQMNSL RAEDTAVYYCAR | DQYNRNDGPP-------AYYYYGMDV | WGQGT TVTVS S |
| iPS:4 36796 | 21-225_170A5 VH3-33\|D5\|5-24\|RF3\|JH6 | QVQLVES-GGGVVQPGRSLRL SCAASG-LIFS | N------CGMH | WVRQAPGK GLEWVA | IIWYD--- GSNKYYADS VKG | RFTISRDNSKNTLDLQMNSL RAEDTAVYYCAR | DQYNRNDGPP-------AYYYYGLDV | WGQGT TVTVS S |
| iPS:4 36812 | 21-225_175C6 VH3-33\|D5\|5-24\|RF3\|JH6 | QVQLVES-GGGVVQPGRSLRL SCAASG-LIFS | N------CGMH | WVRQAPGK GLEWVA | IIWYD--- GSNKYYADS VKG | RFTVSRDNSKNTLDLQMNSL RAEDTAVYYCAR | DQYNRNDGPP-------AYYYYGLDV | WGQGT TVTVS S |
| | Germline | H_FR1 | H_CDR1 | H_FR2 | H_CDR2 | H_FR3 | H_CDR3 | H_FR4 |
| | VH3-48\|D5\|5-18\|RF1\|JH6 | EVQLVES-GGGLVQPGGSLRL SCAASG-FTFS | S------YSMN | WVRQAPGK GLEWVS | YISXS--- SSTIYYADS VKG | RFTISRDNAKNSLYLQMNSL RDEDTAVYYCAR | VDTAMVY-------YYYGMDV | WGQGT TVTVS S |
| iPS:4 36788 | 21-225_169B7 VH3-48\|D5\|5-18\|RF1\|JH6 | EVQLVES-GGGLVQPGGSLRL SCAASG-FTFS | S------YSLN | WVRQAPGK GLEWVS | YIGSS--- GSIIFYADS VKG | RFTISRDNAKNSLYLQMNSL RDEDTAVYYCAR | GDTAGVT-------YYYGMDV | WGQGT TVTVS S |
| iPS:4 36798 | 21-225_171F5 VH3-48\|D5\|5-18\|RF1\|JH6 | EVQLVES-GGGLVQPGGSLRL SCAASG-FTFS | S------YSLN | WVRQAPGK GLEWVS | YIGSS--- GSIIFYADS VKG | RFTISRDNAKNSLYLQMNSL RDEDTAVYYCAR | GDTAGVT-------YYYGMDV | WGQGT TVTVS S |
| iPS:4 36864 | 21-225_58G11 VH3-48\|D5\|5-18\|RF1\|JH6 | EVQLVES-GGGLVQPGGSLRL SCAASG-FTFS | S------YSMN | WVRQAPGK GLEWIS | YISTS--- SSTIFYADS VKG | RFTISRDSAKNSLYLQMNSL RDEDTAVYYCAR | GDTAMVL-------YYYGMDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36866 | 21-225_59F2 | VH3J3-48|D5|5-18|RF1/JH6 | EVQLVES-GGGLVQPGGSLRLSCGASG-FTFS | S-----YSMN | WVRQAPGK GLEWVS | YISGS---SNIYYTDS VKG | RFTISRDNAKMNSLYLQMNSL RDEDTAVYYCAR | ADTPMVL------YFYGMDV | WGQGT TVTVS S |
| iPS:4 36872 | 21-225_60D2 | VH3J3-48|D5|5-18|RF1/JH6 | EVQLVES-GGGLVQPGGSLRLSCGASG-FTFS | S-----YSMN | WVRQAPGK GLEWVS | YISES---SNIYYTDS VKG | RFTISRDNAMNSLYLQMNSL RDEDTAVYYCAR | ADTPMVL------YFYGMDV | WGQGT TVTVS S |
| | Germline | VH3J3-33D5|5-24|RF1/JH6 | QVQLVQS-GGGVVQPGRSLRLSCAASG-FTFS | S-----YGMH | WVRQAPGK GLEWVA | VIWYD---GSNKYYADS VKG | RFTISRDNSKNTLYLQMNSL RAEDTAVYYCAR | YFYYGMDV | WGQGT TVTVS S |
| iPS:4 36790 | 21-225_169G11 | VH3J3-33D5|5-24|RF1/JH6 | QVQLVES-GGGVVQPGRSLRLSCAASG-FTFS | S-----YGMH | WVRQAPGK GLEWVA | IIWYD---GSNKYIADS VKG | RFTISRDNSKNTLYLQMNSL RAEDTGVYYCAR | EGATYYHGSGS---YYPATNYGMDV | WGQGT TVTVS S |
| | Germline | VH3J3-33D3|3-10|RF1/JH6 | QVQLVQS-GGGVVQPGRSLRLSCAASG-FTFS | S-----YGMH | WVRQAPGK GLEWVA | VIWYD---GSNKYYADS VKG | RFTISRDNSKNTLYLQMNSL RAEDTAVYYCAR | YFYYGMDV | WGQGT TVTVS S |
| iPS:4 36792 | 21-225_169D12 | VH3J3-33D3|3-10|RF1/JH6 | QVQLVES-GGGVVQPGRSLRLSCAASG-FTFS | S-----YGMH | WVRQAPGK GLEWVA | VIWYD---GSNKYIADS VKG | RFTISRDNSKNTLYLQMNSL RAEDTAVYYCAR | PLYDMGL------YDDMDV | WGQGT TVTVS S |
| | Germline | VH1|1-46|D7|7-27|RF3/JH4 | QVQLVQS-GAEVKKPGASVKVSCKASG-YTFT | T-----YYMY | WVRQAPGQ GLEWMG | IINPS---GGSTNYAQK FQG | RVTMTRDTSTSTAYMELSSL RSEDTAVYYCAR | RWGT | WGQGT LVTVS S |
| iPS:4 36800 | 21-225_171D12 | VH1|1-46|D7|7-27|RF3/JH4 | QVQLVQS-GAEVKKPGASVKVSCKASG-YTFN | S-----YYMY | WVRQAPGQ GLEWMG | IINPS---GGSTNYAQK FQG | RVTMTRDISTSTLYMELNSL RSEDTAVYYCAR | GWE------LNY | WGQGT LVTVS S |
| iPS:4 36804 | 21-225_172C3 | VH1|1-46|D7|7-27|RF3/JH4 | QVQLVQS-GAEVKKPGASVKVSCKASG-YTFR | S-----YYMY | WVRQAPGQ GLEWVG | TINPS---GGSTNYAQK FQG | RVTMTRDISTSTLYMELNSL RSEDTAVYYCAS | GWE------LNY | WGQGT LVTVS S |
| iPS:4 36806 | 21-225_172B12 | VH1|1-46|D7|7-27|RF3/JH4 | QVQLVQS-GAEVKKPGASVTVSCKASG-YTFR | S-----YYMY | WVRQAPGQ GLEWVG | TINPS---GGSTDYAQK FQG | RVTMTRDTSTSTLYMELNSL RSEDTAVYYCAS | GWE------LNY | WGQGT LVTVS S |
| | Germline | VH3J3-30.3D4|4-23|RF1/JH6 | QVQLVES-GGGVVQPGRSLRLSCAASG-FTFS | S-----YAMH | WVRQAPGK GLEWVA | VISYD---GSNKYYADS VKG | RFTISRDNSKNTLYLQMNSL RAEDTAVYYCAR | YFYYGMDV | WGQGT TVTVS S |
| iPS:4 36808 | 21-225_173F8 | VH3J3-30.3D4|4-23|RF1/JH6 | QVQLVES-GGGVVQPGRSLRLSCAASG-FTFS | S-----YGMH | WVRQAPGK GLEWVA | VISYD---GSPKYCADS VKG | RFTISRDNSKNTLFLQMNSL RAEDTAVYYCAR | DERQMLP------APYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH6|6-01|D6|6-6|RF2|JH6 | | QVQLQQS | SN---SAAWN | WIRQSPSR GLEWLG | RTYYR-SKWYNAYPV SMES | RITINPDTSKNQFSLQLNSV TPEDTAVYYCAR | STAAYY-----YYYGMDY | WGQGT TVTVS S |
| iPS:4 36810 | 21-225_175F4 | VH6|6-01|D6|6-6|RF2|JH6 | QVQLQQS-GPGLVKPSQTLSL TCAISG-DSVS | SN---SAAWN | WIRQSPSR GLEWLG | RTYYR-SKWYNAYPV SMES | RISINPDTSKNQFSLQLNSV TPEDTAVYYCAR | DKAAGRND-------FYYYGMDV | WGQGT TVTVS S |
| iPS:4 36814 | 21-225_178H10 | VH6|6-01|D6|6-6|RF2|JH6 | QVQLQQS-GPGLVKPSQTLSL TCAISG-DSVS | SN---SAAWN | WIRQSPSR GLEWLG | RTYYR-SKWYSAYPV SMES | RVSIMPDISKNQFSLQLNSV TPEDTAVYYCAR | DKAAGRND-------FYYYGMDV | WGQGT TVTVS S |
| | Germline | H_FR1 | H_CDR1 | H_FR2 | H_CDR2 | H_FR3 | H_CDR3 | H_FR4 |
| VH3|3-33|D1|1-1|RF3|JH6 | | QVQLVES-GGGVVQPGRSLRL SCAASG-FTFS | ----YGMH | WVRQAPGK GLEWVA | VIWYD---GSNKYYADS VKG | RFTISRDNSKNTLYLQMNSL RAEDTAVYYCAR | YYYGMDY | WGQGT TVTVS S |
| iPS:4 36818 | 21-225_179C7 | VH3|3-33|D1|1-1|RF3|JH6 | QAQLVES-GGGVVQPGRSLRL SCAASG-FTFS | N------SGMH | WVRQGFGK GLEWVA | IIYYD---GSYKYNADS VKG | RFTISRDNSKNTLYLQMNSL RAEDTAVYYCAR | DRHYDFHVP-----YYYYGMDV | WGQGT TVTVS S |
| iPS:4 37094 | 21-225_210D12 | VH3|3-33|D1|1-1|RF3|JH6 | QVQLVES-GGGVVQPGRSLRL SCAASG-FTFS | H------YGMH | WVRQAPGK GLEWVA | VIWYD---GSNKYYADS VKG | RFTISRDNSKNTLYLQMNSL RAEDTAVYYCAR | GDWNP---------EGLDV | WGQGT TVTVS S |
| iPS:4 37096 | 21-225_210E12 | VH3|3-33|D1|1-1|RF3|JH6 | QVHLVES-GGGVVQPGRSLRL SCAASG-FTFS | N------YGMH | WVRQAPGK GLEWVA | VIWYD---GSNKYYADS VKG | RFTISRDNSKNTLYLQMNSL RAEDTAVYYCAR | GDWNP---------EGMDV | WGQGT TVTVS S |
| iPS:4 37098 | 21-225_211C1 | VH3|3-33|D1|1-1|RF3|JH6 | QVQLVES-GGGVVQPGRSLRL SCAASG-FTFS | H------YGMH | WVRQAPGK GLEWVA | VIWYD---GSNKYYADS VKG | RFTISRDNSKNTLYLQMNTL RAEDTAIYYCAR | GDWNP---------EGLDV | WGQGT TVTVS S |
| iPS:4 37104 | 21-225_211G5 | VH3|3-33|D1|1-1|RF3|JH6 | QVQLVES-GGGVVQPGRSLRL SCAASG-FTFS | H------YGMH | WVRQAPGK GLEWVA | VIWYD---GSNKYYADS VKG | RFTISRDNSKNTLYLQMNSL RAEDTAVYYCAR | GDWNP---------EGLDV | WGQGT TVTVS S |
| iPS:4 37112 | 21-225_212C2 | VH3|3-33|D1|1-1|RF3|JH6 | QVQLVES-GGGVVQPGRSLRL SCAASG-FTFS | H------YGMH | WVRQAPGK GLEWVA | VIWYD---GSNKYYADS VKG | RFTISRDNSKNTLYLQMNSL RAEDTAVYYCAR | GDWNP---------EGMDV | WGQGT TVTVS S |
| iPS:4 37114 | 21-225_212A4 | VH3|3-33|D1|1-1|RF3|JH6 | QVQLVES-GGGVVQAGRSLRL SCAASG-FTFS | N------YGMH | WVRQAPGK GLEWVA | VIWYD---GSNKYYADS VKG | RFTISRDNSKNTLYLQMNSL RAEDTAVYYCAR | GDWNP---------EGMDV | WGQGT SVTVS S |
| iPS:4 37116 | 21-225_212F6 | VH3|3-33|D1|1-1|RF3|JH6 | QVQLVES-GGGVVQPGRSLRL SCAASG-FTFS | H------YGMH | WVRQAPGK GLEWVA | VIWYD---GSNKYYADS VKG | RFTISRDNSKNTLYLQMNSL RAEDTAVYYCAR | GDWNP---------EGLDV | WGQGT TVTVS S |

Figure 51 (Continued)

| | | | H_FR1 | H_CDR1 | H_FR2 | H_CDR2 | H_FR3 | H_CDR3 | | H_FR4 |
|---|---|---|---|---|---|---|---|---|---|---|
| iPS:4 37118 | 21-225_212G7 | VH3J3-33JD1J1-1JRF3/JH6 | QVQLVES-GGGVVQPGRSLRLSCAASG-FTFS | H------YGMH | WVRQAPGK GLEWVA | VIWYD----GSNKYADS VKG | RFTISRDNSTNTLYLQMNSL RAEDTAVYYCAR | GDWNP------ | ------EGLDV | WGQGT TVTVS S |
| iPS:4 37128 | 21-225_213G3 | VH3J3-33JD1J1-1JRF3/JH6 | QVQLVES-GGGVVQPGRSLRLSCAASG-FTFS | H------YGMH | WVRQAPGK GLEWVA | VIWYD----GSNKYADS VKG | RFTISRDNSKNTLHLQMNSL RAEDTAVYYCAR | GDWNP------ | ------EGMDV | SVTVS S |
| iPS:4 37130 | 21-225_213D5 | VH3J3-33JD1J1-1JRF3/JH6 | QVQLVES-GGGVVQPGRSLRLSCAASG-FTFS | H------YGMH | WVRQAPGK GLEWVA | VIWYD----GSNKYADS VKG | RFTISRDNSKNTLFLQMNSL RVEDTAVYYCAR | GDWNP------ | ------EGMDV | WGQGT TVTVS S |
| iPS:4 37146 | 21-225_215D3 | VH3J3-33JD1J1-1JRF3/JH6 | QTQLVES-GGGVVQPGRSLRLSCAASG-FTFS | H------YGMH | WVRQAPGK GLEWVA | VIWYD----GSNEYADS VKG | RFTISRDNSKNTLYLQMNSL RAEDTAVYYCAR | GDWNP------ | ------EGMDV | WGQGT TVTVS S |
| iPS:4 37150 | 21-225_216A3 | VH3J3-33JD1J1-1JRF3/JH6 | QVQLVES-GGGVVQPGRSLRLSCAASG-FTFS | H------YGMH | WVRQAPGK GLEWVA | VIWYD----GSNKYADS VKG | RFTISRDNSKNTLYLQMNSL RAEDTAVYYCAR | GDWNP------ | ------EGLDV | WGQGT TVTVS S |
| iPS:4 37162 | 21-225_217B2 | VH3J3-33JD1J1-1JRF3/JH6 | QVQLVES-GGGVVQPGRSLRLSCAASG-FTFS | N------YGMH | WVRQAPGK GLEWVA | VIWYD----GSNKYADS VKG | RFTISRDNSKNTLYLQMNSL RAEDTAVYYCAR | GDWNP------ | ------EGMDV | WGQGT TVTVS S |
| iPS:4 37172 | 21-225_219A7 | VH3J3-33JD1J1-1JRF3/JH6 | QVQLVES-GGGVVQPGRSLRLSCAASG-FTFS | H------YGMH | WVRQAPGK GLEWVA | VIWYD----GSNKYADS VKG | RFTISRDNSKNMLYLQMNSL RAEDTAVYYCAR | GDWNP------ | ------EGMDV | WGQGT TVTVS S |
| iPS:4 37182 | 21-225_221H2 | VH3J3-33JD1J1-1JRF3/JH6 | QVQLVES-GGGVVQPGRSLRLSCPASG-FTFS | H------YGMH | WVRQAPGK GLEWVA | VIWYD----GSNKYADS VKG | RFTISRDNSKNTLHLQMNSL RAEDTAVYYCAR | GDWNP------ | ------EGMDV | WGQGT TVTVS S |
| iPS:4 37184 | 21-225_221G4 | VH3J3-33JD1J1-1JRF3/JH6 | QVQLVES-GGGVVQPGRSLRLSCAASG-FTFS | H------YGMH | WVRQAPGK GLEWVA | VIWYD----GSDKYADS VKG | RFTISRDNSKNTLYLQMNSL RAEDTAVYYCAR | GDWNP------ | ------EGMDV | WGQGT SVTVS S |
| iPS:4 38664 | 21-225_216G1 | VH3J3-33JD1J1-1JRF3/JH6 | QVHLVES-GGGVVQPGRSLRLSCAASG-FTFS | N------YGMH | WVRQAPGK GLEWVA | VIWYD----GSNKYADS VKG | RFTISRDNSKNTLYLQMNSL RAEDTAVYYCAR | GDWNP------ | ------EGMDV | WGQGT TVTVS S |
| Germline | VH3J3-33/D1J1-1JRF1/JH4 | | QVQLVES-GGGVVQPGRSLRLSCAASG-FTFS | | WVRQAPGK GLEWVA | GSNKYADS | RFTISRDNSKNTLYLQMNSL RAEDTAVYYCAR | GTTGT | ------TTDY | WGQGT LVTVS S |
| iPS:4 36822 | 21-225_180D4 | VH3J3-33JD1J1-1JRF1/JH4 | QVQLVES-GGGVVQPGRSLRLSCAASG-FTFS | N------FGMH | WVRQAPGK GLEWVA | IIWYD----GSDKYADS VKG | RFTISRDNSKNTLYLQMNTL RAEDTAVYFCAR | GGPFFST---- | ------VIMYFDY | WGQGT LVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36828 | 21-225_181H1 | VH3/3-33/D1/1-1/RF1/JH4 | QVQLVES-GGGVVQPGRSLRL SCAASG-FTFS | N------YGMH | WVRQAPGK GLEWVA | IIWYD---GSDKYYADS VKG | RITISRDNSKNTLYLQMNTL RAEDTAVYFCAR | GGPPFST------VTMYFDY | WGQGT LVTVS S |
| iPS:4 36950 | 21-225_184G4 | VH3/3-33/D1/1-1/RF1/JH4 | QVQLVES-GGGVVQPGRSLRL SCAVSG-FTFS | S------YGMH | WVRQAPGK GLEWVA | IIWYD---GSNKYYADS VKG | RFTISRDNSKNTLYLQMNSL RAEDTAVYYCAR | GGPPFST------VTMYFDY | WGQGT LVTVS S |
| iPS:4 36952 | 21-225_185D2 | VH3/3-33/D1/1-1/RF1/JH4 | QVQLVES-GGGVVQPGRSLRL SCAASG-FTFS | N------YGMH | WVRQAPGK GLEWVA | IIWYD---GSDKYYADS VKG | RFTISRDNSKNTLYLQMNTL RAEDTAVYFCAR | GGPPFST------VTMYFDY | WGQGT LVTVS S |
| | Germline | | H_FR1 | H_CDR1 | H_FR2 | H_CDR2 | H_FR3 | H_CDR3 | H_FR4 |
| | VH2/2-05/D6/6-6/RF2/JH3 | | QITLKES-GPTLVKPTQTLTL TCTFSG-FSLS | TS---GVGVG | WIRQPPGK ALEWLG | FISW------NDDKRYSPS LKS | SLTITKDTSKNQVVLTMTNM DPVDTATYYCAR | KAAAV----------AFDI | WGQGT MVTVS S |
| iPS:4 36824 | 21-225_180C5 | VH2/2-05/D6/6-6/RF2/JH3 | QITLKES-GPTLVKPTQTLTL TCTFSG-FSLS | TS---GVGVG | WIRQPPGK ALEWLG | FISW------NDDKRYSPS LKS | SLTITKDTSKNQVVLTMTNM DPVDTATYYCAR | KAAAV----------AFDI | WGQGT MVTVS S |
| iPS:4 36956 | 21-225_186H6 | VH2/2-05/D6/6-6/RF2/JH3 | QITLKES-GPTLVKPTQTLTL TCTFSG-FSLS | TS---GVGVG | WIRQPPGK ALEWLG | FISW------NDDKRYSPS LKS | SLTITKDTSKNQVVLTMTNM DPVDTATYYCAR | KAAAV----------AFDI | WGQGT MVTVS S |
| | Germline | | H_FR1 | H_CDR1 | H_FR2 | H_CDR2 | H_FR3 | H_CDR3 | H_FR4 |
| | VH1/1-08/D5/5-18/RF3/JH6 | | QVQLVQS-GAEVKKPGASVKV SCKASG-YTFT | S------YDIN | WVRQATGQ GLEWMG | WMNPN---SGNTGYAQK FQG | RVTMTRNTSTAYMELSSL RSEDTAVYYCAR | GFYYYGSGSHV---PYHYYYGLDV | WGQGT TVTVS S |
| iPS:4 36826 | 21-225_180G5 | VH1/1-08/D5/5-18/RF3/JH6 | QVQLVQS-GAEVKKPGASVKV SCKASG-YTFT | S------YDIN | WVRQATGQ GLEWMG | WMNPN---SGNTGYAQK FQG | RVTMTRNTSTAYMELSSL RSEDTAVYYCAR | GFYYYGSGSHV---PYHYYYGLDV | WGQGT TVTVS S |
| | Germline | | H_FR1 | H_CDR1 | H_FR2 | H_CDR2 | H_FR3 | H_CDR3 | H_FR4 |
| | VH6/6-01/D5/5-24/RF3/JH2 | | QVQLQQS-GPGLVKPSQTLSL TCAISG-DSVS | SN---SAAWN | WIRQSPSR GLEWLG | RTIYR---SKWYNDYAV SVKS | RITFNPDTSKNQFSLRLNSV TPEDTAVYYCAR | DRYNWNY------FYWYFDL | WGRGT LVTVS S |
| iPS:4 36832 | 21-225_51D8 | VH6/6-01/D5/5-24/RF3/JH2 | QVQLQQS-GPGLVKPSQTLSL TCAISG-DSVS | SN---SAAWN | WIRQSPSR GLEWLG | RTIYR---SKWYNDYAV SVKS | RITFNPDTSKNQFSLRLNSV TPEDTAVYYCAR | DRYNWNY------FYWYFDL | WGRGT LVTVS S |
| | Germline | | H_FR1 | H_CDR1 | H_FR2 | H_CDR2 | H_FR3 | H_CDR3 | H_FR4 |
| | VH1/1-02/D5/5-24/RF3/JH5 | | QVQLVQS-GAEVKKPGASVKV SCKASG-NIFT | G------YYMH | WVRQAPGQ GLEWMG | WIIFN---SGDTNYAQK FQG | RVTMTRDISISTAYMELSRL RSDDTAVYYCAR | EDIYNY--------FNWFDP | WGQGT LVTVS S |
| iPS:4 36840 | 21-225_53E9 | VH1/1-02/D5/5-24/RF3/JH5 | QVQLVQS-GAEVKKPGASVKV SCKASG-NIFT | G------YYMH | WVRQAPGQ GLEWMG | WIIFN---SGDTNYAQK FQG | RVTMTRDISISTAYMELSRL RSDDTAVYYCAR | DGYSSGW-------FNWFDP | WGQGT LVTVS S |

Figure 51 (Continued)

| | Germline | H_FR1 | H_CDR1 | H_FR2 | H_CDR2 | H_FR3 | H_CDR3 | | H_FR4 |
|---|---|---|---|---|---|---|---|---|---|
| VH2|2-05|D7|7-27|RF1|JH4 | | QITLKES-GPTLVKPTQILTL TCTFSG-FSLS | TS---GVGVG | WIRQPPGK ALEWLA | LIYW------LKS | RLTITEDTSKNQVLTMTNM DPVDTATYYCAH | VTGI | ---FDY | WGQGT LVTVS S |
| iPS:4 36848 | 21-225_57F1 | VH2|2-05|D7|7-27|RF1|JH4 | QITLKES-GPTLVKPTQILTL TCTFSG-FSLS | TS---GVGVG | WIRQPPGK ALEWLA | LIYW------HEDKRYSPS LKS | RLTITEDTSKNQVDLTMTNM APVDTATYYCAH | VTGI | ------AAPY | WGQGT LVTVS S |
| iPS:4 36852 | 21-225_57H11 | VH2|2-05|D7|7-27|RF1|JH4 | QITLKES-GPTLVKPTQILTL TCTFSG-FSLT | TS---GVGVG | WIRQPPGK ALEWLA | LIYW------HEDRRYSPS LKS | RLTITEDTSKNQVDLTMTNM APVDTATYYCAH | VTGI | ------AAPY | WGQGT LVTVS S |
| iPS:4 36870 | 21-225_60B1 | VH2|2-05|D7|7-27|RF1|JH4 | QITLKES-GPTLVKPTQILTL TCTFSG-FSLS | TS---GVGVG | WIRQPPGK ALEWLA | LIYW------HEDKRYSPS LKS | RLTITEDTSKNQVDLTMTNM APVDTATYYCAH | VTYI | ------AAPY | WGQGT LVTVS S |
| iPS:4 36876 | 21-225_61F5 | VH2|2-05|D7|7-27|RF1|JH4 | QITLKES-GPTLVKPTQILTL TCTFSG-FSLS | TS---GLGVG | WIRQPPGK ALEWLA | LIYS------HEDKRYSPS LKS | RLTITEDTSKNQVDLTMTNM APVDTATYYCAH | VTGI | ------AAPY | WGQGT LVTVS S |
| iPS:3 92593 | 21-225_3E10 | VH2|2-05|D7|7-27|RF1|JH4 | QITLKES-GPTLVKPTQILTL TCTFSG-FSLN | TG---GVGVG | WIRQPPGK ALEWLA | LIYW------NDDKRHSPS LKS | RLTITKDTSKNQVVLTMTHM APVDTATYYCAH | LIEV | ------AFDY | WGQGT LVTVS S |
| | Germline | H_FR1 | H_CDR1 | H_FR2 | H_CDR2 | H_FR3 | H_CDR3 | | H_FR4 |
| VH2|2-05|D6|6-6|RF2|JH1 | | | | | | | | | |
| iPS:4 36854 | 21-225_58C1 | VH2|2-05|D6|6-6|RF2|JH1 | QITLKES-GPTLVKPTQILTL TCTFSG-FSLS | TS---GVGVG | WIRQPPGK ALEWLA | LIYW------DDDKRYSPS LKS | RLTITEDTSKNQVVLTMTNM DPVDTATYYCAH | LIAV | ------AFDS | WGQGT LVTVS S |
| iPS:4 36874 | 21-225_60A12 | VH2|2-05|D6|6-6|RF2|JH1 | QITLKES-GPTLVKPTQILTL TCTFSG-FSLS | TS---GVGVG | WIRQPPGK ALEWLA | LIYW------DDDKRYSPS LKS | RLTITEDTSKNQVVLTMTNM DPVDTATYYCAH | LIAV | ------AFDS | WGQGT LVTVS S |
| iPS:4 36954 | 21-225_185G7 | VH2|2-05|D6|6-6|RF2|JH1 | QITLKES-GPTLVKPTQILTL TCTFSG-FSLT | TG---GVGVG | WIRQPPGK ALEWLA | LIYW------NDDERYSPS LKS | RLTITKDTSKNQVVLTMTNM DPVDTATYYCAH | IIAV | ------AFQH | WGQGT LVTVS S |
| iPS:3 93188 | 21-225_34B9 | VH2|2-05|D6|6-6|RF2|JH1 | QITLKES-GPTLVKPTQILTL TCTFSG-FSLS | TS---GVGVG | WIRQPPGK ALEWLA | LIYW------NDDKRYSPS LKS | RLTITKDTSKNQVVLTMTNM DPVDTATYYCAH | LIAV | ------TFDS | WGQGS LVTVS S |
| | Germline | H_FR1 | H_CDR1 | H_FR2 | H_CDR2 | H_FR3 | H_CDR3 | | H_FR4 |
| VH3|3-30.3|D3|3-10|RF2|JH6 | | | | | | | | | |

Figure 51 (Continued)

| | | | | H_CDR1 | H_FR2 | H_CDR2 | H_FR3 | H_CDR3 | H_FR4 |
|---|---|---|---|---|---|---|---|---|---|
| iPS:4 36858 | 21-225_58E7 | VH3/3-30.3/D3/3-10/RF2/JH6 | QVQLVES-GGGVVQPGRSLRL SCAASG-FTFS | F------YGMH | WVRQAPGK GLEWVA | VISYD---GSDRYYADS VKG | RFSISRDNSKNTLYLQMSSL RAEDTAMYYCAR | DDYGSSP------LYYGMDV | WGQGT TVTVS S |
| | VH3/3-07/D3/5-12/RF3/JH6 | Germline | | | | | | | |
| iPS:4 36860 | 21-225_58F7 | VH3/3-07/D5/5-12/RF3/JH6 | EVQLVES-GGGLVQPGGSLRL SCAASG-FTFS | S------FWMS | WVRQAPGK GLEWVA | HIKQD---GSEKYYVDS VKG | RFTISRDNAKNSLYLQMNSL RAEDTAVYYCAR | GDLPYSG------YYYGMDV | WGQGT TVTVS S |
| | VH3/3-30.3/D4/4-17/RF2/JH6 | Germline | | | | | | | |
| iPS:4 36862 | 21-225_58F8 | VH3/3-30.3/D4/4-17/RF2/JH6 | QVQLVES-GGGVVQPGRSLRL SCAASG-FTFS | S------YGMH | WVRQAPGK GLEWVA | VISYD---GSNKYYADS VKG | RFTISRDNSKNTLYLQMNSL RAEDTAVYYCAR | DEGRGYGGYER------GYYYYYGMDV | WGQGT TVTVS S |
| | VH3/3-33/D3/3-16/RF2/JH6 | Germline | | | | | | | |
| iPS:4 36868 | 21-225_59B11 | VH3/3-33/D3/3-16/RF2/JH6 | QVQLVES-GGGVVQPGRSLRL SCAASG-FTFS | S------YGVH | WVRQAPGK GLEWVA | AIWYD---GSNKYYADS VKG | RFTISRDNSKNTLYLQMNSL RAEDTAVYYCAR | DRDYCSSSC------PYYYYYGMDV | WGQGT TVTVS S |
| | VH2/2-05/D1/1-1/RF1/JH3 | Germline | | | | | | | |
| iPS:4 36878 | 21-225_62E3 | VH2/2-05/D1/1-1/RF1/JH3 | QITLKES-GPTLVKPTQTLTL TCTFSG-FSLS | TS-----GVGVG | WIRQPPGK ALEWLA | LINW------NDDKRYSPS LKS | RFTITRDTSKDQVVLTMTNM DPVDTATYYCAH | KATWV------AFDI | WGQGT MVTVS S |
| iPS:4 36880 | 21-225_62E8 | VH2/2-05/D1/1-1/RF1/JH3 | QITLKES-GPTLVKPTQTLTL TCTFSG-FSLS | TS-----GVGVG | WIRQPPGK ALEWLA | LINW------NDDKRYSPS LKS | RFTITRDTSKDQVVLTMTNM DPVDTATYYCAH | KATWV------AFDI | WGQGT MVTVS S |
| iPS:4 36882 | 21-225_62D10 | VH2/2-05/D1/1-1/RF1/JH3 | QITLKES-GPTLVKSTQTLTL TCTFSG-FSLS | TS-----GVGVG | WIRQPPGK ALEWLA | LINW------NDDKRYSPS LKS | RFTITRDTSKDQVVLTMTNM DPVDTATYYCAH | KATWV------AFDI | WGQGT MVTVS S |
| iPS:4 36884 | 21-225_62A12 | VH2/2-05/D1/1-1/RF1/JH3 | QITLKES-GPTLVKPTQTLTL TCTFSG-FSLS | TS-----GVGVG | WIRQPPGK ALEWLA | LINW------NDDKRYSPS LKS | RFTITRDTSKDQVVLTMTNM DPLDTATYYCAH | KITWV------AFDI | WGQGT MVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:4 36886 | 21-225_62B12 | VH2[2-05]D1[1-1]RF1/JH3 | QITLKES-GPTLVKPTQTLTL TCTFSG-FSLN | TS----GVGVG | WIRQPPGK ALEWLA | LINW----NDDKRYSPS LKS | RFTITRDTSKDQVVLTMTNM DPVDTATYYCAH | KATWV-------AFDI | WGQGT MVTVS S |
| iPS:4 36894 | 21-225_66G9 | VH2[2-05]D1[1-1]RF1/JH3 | QITLKES-GPTLVKPTQTLTL TCTFSG-FSLS | TS----GVGVG | WIRQPPGK ALEWLA | LINW----NDDKRFSPS LKS | RFTITRDTSKDQVVLTMTNM DPVDTATYYCAH | KATWV-------AFDI | WGQGT MVTVS S |
| iPS:4 36908 | 21-225_72D5 | VH2[2-05]D1[1-1]RF1/JH3 | QITLKES-GPTLVKPTQTLTL TCTFSG-FSLS | TS----GVGVG | WIRQPPGK ALEWLA | LINW----NDDKRYSPS LKS | RFTITRDTSKDQVVFTMTNM DPVDTGTYYCAH | KATWV-------AFDI | WGQGT MVTVS S |
| iPS:4 36912 | 21-225_73C4 | VH2[2-05]D1[1-1]RF1/JH3 | QITLKES-GPTLVKPTQTLTL TCTFSG-FSLS | TS----GVGVG | WIRQPPGK ALEWLA | LINW----NDDKRYSPS LKS | RFTITRDTSKDQVVLTMTNM DPVDTATYYCAH | KITWV-------AFDI | WGQGT MVTVS S |
| | Germline | | H_FR1 | H_CDR1 | H_FR2 | H_CDR2 | H_FR3 | H_CDR3 | H_FR4 |
| | VH3[3-48]D4[4-11]RF2/JH3 | | EVQLVES-GGGLVQPGGSLRL SCAASG-FTFS | DYSMN | WVRQAPGK GLEWVS | WISS---SSTIYYADS VKG | RFTISRDNAKNSLYLQMNSL RDEDTAVYYCAR | DAFDI | WGQGT MVTVS S |
| iPS:4 36888 | 21-225_63G7 | VH3[3-48]D4[4-11]RF2/JH3 | EVQLVES-GGGLVQPGGSLRL SCAASG-FTFS | S------YSMN | WVRQAPGK GLEWVS | YISSS---TSTIYYAAS VKG | RFTISRDNAKNSLYLQMNSL RDEDTAVYYCAR | DHRYIDSSG-----YSDAFDI | WGQGT MVTVS S |
| iPS:4 36890 | 21-225_63A10 | VH3[3-48]D4[4-11]RF2/JH3 | EVQLVES-GGGLVQPGGSLRL SCAASG-FTFS | S------YSMN | WVRQAPGK GLEWVS | YISSS---TSTIYYAAS VKG | RFTISRDNAKNSLYLQMNSL RDEDTAVYYCAR | DHRYIDSSG-----YSDAFDI | WGQGT MVTVS S |
| | Germline | | H_FR1 | H_CDR1 | H_FR2 | H_CDR2 | H_FR3 | H_CDR3 | H_FR4 |
| | VH1[1-02]D3[3-22]RF2/JH3 | | QVQLVQS-GAEVKKPGASVKV SCKASG-YTFT | YYMH | WVRQAPGQ GLEWMG | WINPN---SGGTNYAQK FQG | RVTMTRDTSISTAYMELSRL RSDDTAVYYCAR | YYDSSY | WGQGT MVTVS S |
| iPS:4 36892 | 21-225_85E9 | VH1[1-02]D3[3-22]RF2/JH3 | QVQLVQS-GAEVKKPGASVKV SCKASG-YTFT | G------YYMH | WVRQAPGQ GLEWMG | WINPN---SGGTNYAQK FQG | RVTMTRDTSISTAYMELSRL RSDDTAVYYCAR | AYYGSGS------YNEFDM | WGQGT MVTVS S |
| iPS:4 36900 | 21-225_69B9 | VH1[1-02]D3[3-22]RF2/JH3 | QVQMVQS-GDEVKKPGASVKV SCKASG-YTFT | G------YHMH | WVRQAPGQ GLEWMG | WINPN---SGGTNYAQK FQG | RVTMTRDTSISTAYMELSRM RSDDTAVYYCAR | AYYYGSGS-----YNESDM | WGQGT MVTVS S |
| | Germline | | H_FR1 | H_CDR1 | H_FR2 | H_CDR2 | H_FR3 | H_CDR3 | H_FR4 |
| | VH6[6-01]D4[4-17]RF2/JH6 | | QVQLQQS-GPGLVKPSQTLSL TCAISG-DSVS | SAAWN | WIRQSPSR GLEWLG | RTYYR---SKWYNDYAV SVQS | RITINPDISKNQFSLHLNSV TPEDTAVYFCAR | YYCGMDV | WGQGT TVTVS S |
| iPS:4 36898 | 21-225_68D8 | VH6[6-01]D4[4-17]RF2/JH6 | QVQLQQS-GPGLVKPSQTLSL TCAISG-DSVS | SN----SAAWN | WIRQSPSR GLEWLG | RTYYR---SECINDYAV SVQS | RITINPDISKNQFSLHLNSV TPEDTAVYFCAR | DRGHRG------FYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-33/D7/7-27/RF1/JH3 | | QVQLVES-GGGVVQPGRSLRL SCAASGFTFS | YGMH | WVRQAPGK GLEWVA | VIWYD-GSNKYYADS VKG | RFTISRDNSKNTLYLQMNSL RAEDTAVYYCAR | LTGD--------AFDI | WGQGT MVTVS S |
| iPS:4 36910 | 21-225_73G1 VH3/3-33/D7/7-27/RF1/JH3 | QVQLVES-GGGVVQPGRSLRL SCAGTG-FTFS | Y------YGMH | WVRQAPGK GLEWVA | VIIYD----GSNKYYADS VKG | RFTSSRDNSKNILYLQMNSL RAEDTAVYHCAR | ETGIW-------AFDI | WGQGT MVTVS L |
| | Germline | H_FR1 | H_CDR1 | H_FR2 | H_CDR2 | H_FR3 | H_CDR3 | H_FR4 |
| VH4/4-30.1/D2/2-15/RF3/JH4 | | QVQLQES-GPGLVKPSQTLSL TCTVSG-GSIS | SG------GYYWS | WIRQHPGK GLEWIG | YIYY-----SGSTYYNPS LKS | RVTISVDTSKNQFSLKLSSV TAADTAVYYCAR | DIVVVA------AFFDY | WGQGT LVTVS S |
| iPS:4 36920 | 21-225_74E5 VH4/4-30.1/D2/2-15/RF3/J H4 | QVQLQES-GPGLVKPSQTLSL TCTVSG-GSIR | SG------GYYWS | WIRQHPGK GLEWIG | YIYY-----SGSTYYNPS LRS | RASISVDTSKNQFSLKLSSV TAADTAVYYCAR | DSPVA-------GTDY | WGQGT LVTVS S |
| iPS:4 37012 | 21-225_192G7 VH4/4-30.1/D2/2-15/RF3/J H4 | QVQLQES-GPGLVKPSQTLSL TCTVSG-GSIS | SG------GYYWS | WIRQHPGK GLEWIG | YIYY-----RGSTYYNPS LKS | RVTISVDTSKNQFSLKLNSV TAADTAVYYCAR | DSPVT-------GFDY | WGQGT LVTVS S |
| | Germline | H_FR1 | H_CDR1 | H_FR2 | H_CDR2 | H_FR3 | H_CDR3 | H_FR4 |
| VH1/1-08/D5/5-12/RF3/JH6 | | QVQLVQS-GAEVKKPGASVKV SCKASG-YTFI | S------YDIN | WVRQATGQ GLEWMG | WMNPN----SGNTGYAQK FQG | RVTMTRNTSTAYMELSSL RSEDTAVYYCAR | GSGDYY------PYYYYGMDV | WGQGT TVTVS S |
| iPS:4 36942 | 21-225_146H8 VH1/1-08/D5/5-12/RF3/J H6 | QVQLVQS-GAEVKKPGASVKV SCKASG-YTFI | S------YDIN | WVRQATGQ GLEWMG | WMNPN----SGNTGYAQK FQG | RVTMTRNTSKSTAYMELSSL RSEDTAVYYCAR | GDYYYDSSGHQ-PYYYYGMDV | WGQGT TVTVS S |
| | Germline | H_FR1 | H_CDR1 | H_FR2 | H_CDR2 | H_FR3 | H_CDR3 | H_FR4 |
| VH2/2-05/D6/6-8/RF3/JH4 | | QITLKES-GPTLVKPTQTLTL TCTFSG-FSIS | TS------GVGVG | WIRQPPGK ALEWLA | LIYW-----DDEKRISPS LKS | RLTITKDTSKNQVVLTMTNM DFVDTATYYCAR | KSQLV-------YFDY | WGQGT LVTVS S |
| iPS:4 36944 | 21-225_182D12 VH2/2-05/D6/6-8/RF3/JH 4 | QITLKES-GPTLVKPTQTLTL TCTFSG-FSIS | TT------GVGVG | WIRQPPGK ALEWLG | ILFW-----NDDERYSPS LKS | RLTITKDTSKNQVVLTMTNM DFVDTATYYCAR | KSQLV-------YFDY | WGQGT LVTVS S |
| | Germline | H_FR1 | H_CDR1 | H_FR2 | H_CDR2 | H_FR3 | H_CDR3 | H_FR4 |
| VH4/4-30.1/D2/2-8/RF3/JH4 | | QVQLQES-GPGLVKPSQTLSL TCTVSG-GSIS | SG------GYYWS | WIRQHPGK GLEWIG | YIYY-----SGSTYYNPS LKS | RVTISVDTSKNQFSLKLSSV TAADTAVYYCAR | DIVLMY------AFFDY | WGQGT LVTVS S |
| iPS:4 36958 | 21-225_190D1 VH4/4-30.1/D2/2-8/RF3/JH 4 | QVQLQES-GPGLVKPSQTLSL TCTVSG-GSIS | SG------GYYWS | WIRQHPGK GLEWIG | YIYY-----SGSTYYNPS LKS | RVTISVDTSKNQFSLKLSSV TAADTAVYYCAR | DSPLR-------GFDY | WGQGT LVTVS S |
| | Germline | H_FR1 | H_CDR1 | H_FR2 | H_CDR2 | H_FR3 | H_CDR3 | H_FR4 |

Figure 51 (Continued)

| VH6|6-01|D4|4-17|RF2|JH4 | | | | | | | | | |
|---|---|---|---|---|---|---|---|---|---|
| | | | | | | | | | |
| | | QVQLQS-GPGLVKPSQTLSL | | | | | | | |
| | | TCAISG-DSVS | | WIRQSPSR | | | | | WGQGT |
| | | | SAT WN | GLEWLG | RTYYR--- | RITIN | DPGG | | LVTVS |
| | | | | | SKWYNDYAV | PDTSKNQFSLQLNSV | | LFDY | S |
| Germline | | | | | SVKS | TPEDTAVYYCAR | | | |
| iPS:4 36962 | 21-225_190H1 | VH6|6-01|D4|4-17|RF2|JH4 | QVQLQS-GPGLVKPSQTLSL TCDISG-DSVS | RK---SATWN | WIRQSPSR GLEWLG | RTYYR---SKWYNDYAV SVKS | RITINPDTSKNQFSLQLNSV TPEDTAVYYCAR | DPGG-------LFDY | WGQGT LVTVS S |
| iPS:4 36978 | 21-225_190G9 | VH6|6-01|D4|4-17|RF2|JH4 | QVQLQS-GPGLVKPSQTLSL TCAISG-DSVS | RK---SATWN | WIRQSPSR GLEWLG | RTYYR---SKWYNDYAV SVKS | RIIINPDTSKNQFSLQLNSV TPEDTAVYYCAR | DPGG-------LFDY | WGQGT LVTVS S |
| iPS:4 37070 | 21-225_201G11 | VH6|6-01|D4|4-17|RF2|JH4 | QVQLQS-GPGLVKPSQTLSL TCAISG-DSVS | RI---NFTWN | WIRQSPSR GLEWLG | RTYYR---SKWYHVYAV SVKS | RITIMPDTSKNQFSLQLNSV TPEDTAVYYCAR | DPGG-------LFDY | WGQGT LVTVS S |
| iPS:4 37076 | 21-225_203G6 | VH6|6-01|D4|4-17|RF2|JH4 | QVQLQS-GPGLVKPSQTLSL TCAISG-DSVS | RT---NFTWN | WIRQSPSR GLEWLG | RTYYR---SKWYHVYAL SVKS | RITITPDTSKNQFSLQLNSV TPEDTAVYYCAR | DPGG-------LFDY | WGQGT LVTVS S |
| | | H_FR1 | H_CDR1 | H_FR2 | H_CDR2 | H_FR3 | H_CDR3 | | H_FR4 |
| VH3|3-33|D1|1-7|RF3|JH6 | | | | | | | | | |
| Germline | | QVQLVES-GGGVVQPGRSLRL SCAASG-FTFS | YGMH | WVRQAPGK GLEWVA | VIWFD---GSNKYYADS VKG | RFTISRDNSKNTLYLQMNSL RAEDTAVYYCAR | DNWNYY-------YYYGMDV | | WGQGT TVTVS S |
| iPS:4 36964 | 21-225_190B3 | VH3|3-33|D1|1-7|RF3|JH6 | N------YGIH | WVRQAPGK GLEWVA | VIWFD---GDNKYYADS VKG | RFTISRDNSKNTLYLQMNSL RAEDTAVYYCAR | DNWNYGDH-------YYYFGMDV | | WGQGT TVTVS S |
| iPS:4 36970 | 21-225_190B8 | VH3|3-33|D1|1-7|RF3|JH6 | QVQLVES-GGGVVQPGRSLRL SCAASG-FTFN | S------YGMH | WVRQAPGK GLEWVA | VIWFD---GSNKYYTDS VKG | RFTISRDNSKNTLYLQMNSL RAEDTAVYYCAR | DNWNYGDY-------YYYYGMDV | | WGQGT TVTVS S |
| iPS:4 36980 | 21-225_190C10 | VH3|3-33|D1|1-7|RF3|JH6 | QVQLVES-GGGVVQPGRSLRL SCAASG-FTLS | N------YGMH | WVRQAPGK GLEWVA | VIWFG---GDNKYYADS VKG | RFTISRDNSKNTLYLQMNSL RAEDTAVYYCAR | DNWNYGDH-------YYYYGMDV | | WGQGT TVTVS S |
| iPS:4 36992 | 21-225_191B8 | VH3|3-33|D1|1-7|RF3|JH6 | QVQLVES-GGGVVQPGRSLRL SCAASG-FTLS | S------YGMH | WVRQAPGK GLEWVA | VIWFG---GSNKYYADS VRG | RFTISRDNSKNTLYLQMNSL RAEDTAVFYCAR | DNWNYGDH-------YYYYGMDV | | WGQGT TVTVS S |
| iPS:4 36994 | 21-225_191A9 | VH3|3-33|D1|1-7|RF3|JH6 | QVQLVES-GGGVVQPGRSLRL SCAASG-FTLS | N------YGMH | WVRQAPGK GLEWVA | VIWFG---GDNKYYADS VKG | RFTISRDNSKNTLYLQMNSL RAEDTAVYYCAR | DNWNYGDH-------YYYYGMDV | | WGQGT TVTVS S |
| | | H_FR1 | H_CDR1 | H_FR2 | H_CDR2 | H_FR3 | H_CDR3 | | H_FR4 |
| VH4|4-30.1|D4|4-11|RF2|JH6 | | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36984 | 21-225_190F10 | VH4|4-30.1|D4|4-11|RF2|JH6 | QVQLQES-GPGLVKPSQTLSL TCTVSG-GSIR | SG----GDYWS | WIRQHPGE GLEWIG | YIYY---- SGITYNPS LKS | RVTISVDTSKNQFSLKLSSV TAADTAVYYCAR | DSSSR-------GMDV | WGQGT TVTVS S |
| iPS:4 36988 | 21-225_191A2 | VH4|4-30.1|D4|4-11|RF2|JH6 | QVQLQES-GPGVVKPSQTLSL TCTVSG-GSIR | SG----GDYWS | WIRQHPGE GLEWIG | YIYY---- SGITYNPS LKS | RVTISVDTSKNQFSLKLSSV TAADTAVYYCAR | DSSSR-------GMDV | WGQGT TVTVS S |
| iPS:4 37014 | 21-225_192H8 | VH4|4-30.1|D4|4-11|RF2|JH6 | QVQLQES-GPGLVKPSQTLSL TCTVSG-GSIS | SG----GDYWS | WIRQHPGK GLEWIG | YIYY---- SGPTYNPS LKS | RLTMSADTSKNQFSLKLSSV TAADTAVYYCAR | DSSLY-------GMDV | WGQGT TVTVS S |
| iPS:4 37022 | 21-225_194G5 | VH4|4-30.1|D4|4-11|RF2|JH6 | QVQLQES-GPGLVKPSQTLSL TCTVSG-GSIR | SG----GDYWS | WIRQHPGK GLEWIG | YIYY---- SGSTYNPS LKS | RVTISVDTSKNQFSLKLSSV TAADTAVYYCAR | DHSLY-------GMDV | WGQGT TVTVS S |
| iPS:4 37026 | 21-225_194D12 | VH4|4-30.1|D4|4-11|RF2|JH6 | QVQLQES-GPGLVKPSQTLSL TCTVSG-GSIR | SG----GDYWS | WIRQHPGE GLEWIG | YIYY---- SGSTYNPS LKS | RVTISVDTSKNQFSLKLSSV TAADTAVYYCAR | DGARM-------GMDV | WGQGT TVTVS S |
| iPS:4 37056 | 21-225_198B8 | VH4|4-30.1|D4|4-11|RF2|JH6 | QVQLQES-GPGLVKPSQTLSL TCTVSG-GSIR | SG----GDYWS | WIRQHPGE GLEWIG | YIYY---- SGITYNPS LKS | RVTISVDTSKNQFSLKLSSV TAADTAVYYCAR | DSSSR-------GMDV | WGQGT TVTVS S |
| iPS:4 37124 | 21-225_212H12 | VH4|4-30.1|D4|4-11|RF2|JH6 | QVQLQES-GPGLVKPSQTLSL TCTVSG-GSIR | SG----GDYWS | WIRQPPGK GLEWIG | YIYY---- SGSTYNPS LKS | RVTISVDTSKNQFSLKLSSV TAADTAVYYCAR | DSSSY-------GMDV | WGQGT TVTVS S |
| iPS:4 37136 | 21-225_214H3 | VH4|4-30.1|D4|4-11|RF2|JH6 | QVQLQES-GPGLVKPSQTLSL TCTVSG-GSIR | SG----GDYWS | WIRQPPGK GLEWIG | YIYY---- SGSTYNPS LKS | RVTISGDTSKNQFSLKLSSV TAADTAVYYCAR | DSSSY-------GMDV | WGQGT TVTVS S |
| | Germline | | H_FR1 | H_CDR1 | H_FR2 | H_CDR2 | H_FR3 | H_CDR3 | H_FR4 |
| VH4|4-59|D1|1-26|RF1|JH4 | | | QVQLQES-GPGLVKPSETLSL TCTVSG-GSIS | S-------YYWI | WIRQPPGK GLEWIG | YIYY---- SGSTYNPS LKS | RVTISVDTSKNQFSLKLSSV TAADTAVYYCAR | | |
| iPS:4 36986 | 21-225_191A1 | VH4|4-59|D1|1-26|RF1|JH4 | QVQLQES-GPGLVKPSETLSL TCTVSG-GSIS | S-------YYWI | WIRQPPGK GLEWIG | YIYY---- SGSTYNPS LKS | RVTISVDTSKNQFSLKLSSV TAADTAVYYCAR | KGVGT-------IHFDY | WGQGT LVTVS S |
| iPS:4 37064 | 21-225_200G8 | VH4|4-59|D1|1-26|RF1|JH4 | QVQLQES-GPGLVKPSETLSL TCTVSG-GSIS | S-------YYWS | WIRQPPGK GLEWIG | YIYY---- SGSTYNPS LKS | RVTISGDTSKNQFSLKLSSV TAADTAVYYCAR | KGVGT-------IHFDY | WGQGT LVTVS S |
| | Germline | | H_FR1 | H_CDR1 | H_FR2 | H_CDR2 | H_FR3 | H_CDR3 | H_FR4 |
| VH3|3-30|D6|6-6|RF1|JH4 | | | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 36996 | 21-225_191B9 | VH3/3-30/D6/6-6/RF1/JH4 | QVQLVES-GGGVVQPGRSLRL SCAASG-FTFS | F-----HGMH | WVRQAPGK GLEWVA | VIWYD----GSKKYYADS VKG | RFTISRDNSKNTLHLQMNSL RAEDTAVYYCAK | EGYSSGF------YRGFDN | WGQGT LVTVS S |
| iPS:4 37054 | 21-225_194G3 | VH3/3-30/D6/6-6/RF1/JH4 | QVQLVES-GGGVVQPGRSLRL SCAASG-FTFS | F-----HGMH | WVRQAPGK GLEWVA | VIWYD----GSKKYYADS VKG | RFTISRDNSKNTLHLQMNSL RAEDTAVYYCAK | EGFSSGF------YRGFDN | WGQGT LVTVS S |
| | Germline | VH3/3-33/D1/1-26/RF1/JH6 | QVQLVES-GGGVVQPGRSLRL SCAASG-FTFS | ------YGMH | WVRQAPGK GLEWVS | VIWYD----SGSNKYYADS VKG | RFTISRDNSKNTLYLQMNSL RAEDTAVYYCAR | YYYGMDV | WGQGT LVTVS S |
| iPS:4 37000 | 21-225_191G9 | VH3/3-33/D1/1-26/RF1/JH6 | QVQLVES-GGGVVQPGRSLRL SCAASG-FTFS | I-----YGMH | WVRQAPGK GLEWVT | LIWFD----GSNKYYADS VKG | RFTISRDNSKNTLYLQMNSL RAEDTAVYYCAR | DRVGGISPP----YYYYGMDV | WGQGT LVTVS S |
| iPS:3 93192 | 21-225_12B1 | VH3/3-33/D1/1-26/RF1/JH6 | QVQLVES-GGGVVQPGRSLRL SCAASG-FTFS | S-----YGMH | WVRQAPGK GLEWVA | VIWND----GSNKYYADS VKG | RFTISRDNSKNTLYLQMNSL RAEDTAVYYCAR | DRVAAAGTP----YYYYGMDV | WGQGT LVTVS S |
| | Germline | VH1/1-02/D3/3-10/RF2/JH5 | QVQLVQS-GAEVKKPGASVKV SCKVSG-YIFT | G-----YNMH | WVRQAPGQ GLEWMG | WINPN----SGGTNYAHK FQG | RVTMTRDTSTAYMELSRL RSDDTAVYYCAR | SLSTNIAGK | WGQGT LVTVS S |
| iPS:4 37002 | 21-225_191H9 | VH1/1-02/D3/3-10/RF2/JH5 | QVQLVQS-GAEVKKPGASVKV SCKVSG-YIFT | G-----YNMH | WVRQAPGQ GLEWMG | WINFN----SGGTNYAHK FQG | RVTMTRDTSTAYMELSRL RSDDTAVYYCAR | DFYDSGG------EGWFDP | WGQGT LVTVS S |
| | Germline | VH4/4-30.4/D2/2-8/RF3/JH6 | QVQLQES-GPGLVKPSQTLSL TCTVSG-GSIS | SG-----YYWS | WIRQPPGK GLEWIG | YIYY----TGSTYNPS LKS | RVTISVDTSKNQFSLKLSSV TAADTAVYYCAR | YYYGMDV | WGQGT LVTVS S |
| iPS:4 37008 | 21-225_192E3 | VH4/4-30.4/D2/2-8/RF3/JH6 | QVQLQES-GPGLVKPSQTLSL TCTVSG-GSIS | SG-----GYYWS | WIRQPPGK GLEWIG | YIYY----TGSTYNPS LKS | RVTISVDTSKNQFSLKLSSV TAADTAVYYCAR | DDPLY--------GMDV | WGQGT LVTVS S |
| iPS:4 37048 | 21-225_197B11 | VH4/4-30.4/D2/2-8/RF3/JH6 | QVQLQES-GPGLVKPSQTLSL TCTVSG-GSIS | SG-----GYYWS | WIRQPPGK GLEWIG | YIYY----TGSTYNPS LKS | RVTISVDTSKNQFSLKLSSV TAADTAVYYCAR | DDPLY--------GMDV | WGQGT LVTVS S |
| | Germline | VH4/4-59/D7/7-27/RF3/JH4 | QVQLQES-GPGLVKPSETLSL TCTVSG-GSIS | ------YYWS | WIRQPPGK GLEWIG | YIYY----SGSTNYNPS LKS | RVTISVDTSKNQFSLKLSSV TAADTAVYYCAR | FDY | WGQGT LVTVS S |
| iPS:4 37010 | 21-225_192G3 | VH4/4-59/D7/7-27/RF3/JH4 | QVQLQES-GPGLVKPSETLSL TCTVSG-GSIS | N-----YYWS | WIRQPAGK GLEWIG | RIYS----SGSTNYNPS LKS | RVTMSVDTSKNQFSLKLNSV TAADTAVYYCAK | GWE----------LNY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37016 | 21-225_193A6 | VH4/4-59/D7/7-27/RF3/JH4 | QVQLQES-GPGLVKPSETLSL TCTVSG-GSIS | S------YYWS | WIRQPPGK GLEWIG | YIYY---- SGSTNYNPS LKS | RVTISVDTSKNQFSLKLSSV TAADTAVYYCAG | GWE--------------LNY | WGQGT LVTVS S |
| | Germline | VH3/3-15/D4/4-17/RF2/JH4 | EVQLVES-GGGLVKPGGSLRL SCAASG-FTFS | | | | | | |
| iPS:4 37018 | 21-225_193H5 | VH3/3-15/D4/4-17/RF2/JH4 | EVQLVES-GGGLVMPGGSLSL SCAASG-FTFS | N------AYMT | WVRQAPGK GLEWVG | RIKSKT- DGGTDYAA PVKG | RFTISRDDSKNTLYLQMNSL KTEDTAVYYCTT | DPGG-----------IFDY | WGQGT LVTVS S |
| iPS:4 37144 | 21-225_215B3 | VH3/3-15/D4/4-17/RF2/JH4 | EVQLVES-GGGLVKPGGSLRL SCAASG-FTFS | N------AWMH | WVRQAPGK GLEWVG | RIKSKT- NGGTDYAA PVKG | RFTISRDGSKNTLYLQMNSL KTEDTAVYYCTT | DPGG-----------IFDY | WGQGT LVTVS S |
| | Germline | VH3/3-11/D3/3-9/RF1/JH4 | | | | | | | |
| iPS:4 37030 | 21-225_195E3 | VH3/3-11/D3/3-9/RF1/JH4 | QVQLVES-GGGLVKPGGSLRL SCAASG-FTFS | D------YYMS | WIRQAPGK GLEWVS | YITSS--- GNTIYADS VKG | RFTISRDNAKNSLYLQMNSL RAEDTAVYYCAR | DSRYF----------DWFDY | WGQGT LVTVS S |
| | Germline | VH4/4-59/D7/7-27/RF3/JH1 | | | | | | | |
| iPS:4 37032 | 21-225_195H6 | VH4/4-59/D7/7-27/RF3/JH1 | QVQLQES-GPGLVKPSETLSL TCTVSG-GSIS | N------YYWS | WIRQPPGK GLEWIG | RIYS---- SGSTNYNPS LKS | RVSMSVDTSKNQFSLKLSSV TAADTAVYYCTR | GWE--------------LNN | WGQGT LVTVS S |
| | Germline | VH4/4-59/D6/6-6/RF1/JH6 | | | | | | | |
| iPS:4 37044 | 21-225_197F9 | VH4/4-59/D6/6-6/RF1/JH6 | QVQLQES-GPGLVKPSETLSL TCTVSG-GSIS | I------YYWS | WIRQPAGK GLEWIG | YVYY---- SGSTTYNPS LKS | RVTISVDTSKNQFSLKLNSV TAADTAVYYCVR | ERGSSHRW-------GDYYGMDV | WGRGT TVTVS S |
| iPS:4 37060 | 21-225_199C3 | VH4/4-59/D6/6-6/RF1/JH6 | QVQLQES-GPGLVKPSETLSL TCTVSG-GSIR | I------YYWS | WIRQTPGK GLEWIG | YIYY---- SGSTTYNPS LKS | RVTISVDTSKNQFSLKLNSV TAADTAVYYCVR | ERGSSHRW-------GDYYGMDV | WGRGT TVTVS S |
| | Germline | VH3/3-30/D6/6-6/RF1/JH1 | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37058 | 21-225_199F3 | VH3J3-30/D6J6-6JRF1/JH1 | QVQLVES-GGGVVQPGRSLRL SCAASG-FTFS | F------YGMH | WVRQAPGK GLEWVA | VIWYD---GSSKYYADS VKG | RFTVSRDNBKNTLYLQMNSL RAEDTAVYYCAK | EGYSSGF------YRGFAN | WGQGT LVTVS S |
| | Germline | VH4J4-30.1D6J6-6JRF2/JH6 | QVQLQES-GPGLVKPSQTLSL TCTVSG-GSIS | ------GYWS | WIRQHPGK GLEWIG | YIYY------SGSTYYNPS LKS | RVTISVDTSKNQFSLKLSSV TAADTAVYYCAR | STAAVYY------VTCNDV | WGQGT TVTVS S |
| iPS:4 37062 | 21-225_200H1 | VH4J4-30.1D6J6-6JRF2/JH6 | QVQLQES-GPGLVKPSQTLSL TCTVSG-GSIS | SG----GDYWS | WIRQHPGK GLEWIG | YIYY------SGSTYYNPS LKS | RVTISVDTSKNQFSLKLNSV TAADTAVYYCAR | DGAAL-------GMDV | WGQGT TVTVS S |
| iPS:4 37066 | 21-225_200G9 | VH4J4-30.1D6J6-6JRF2/JH6 | QVQLQES-GPGLVKPSQTLSL TCTVSG-GSIS | SG----GDYWS | WIRQHPGK GLEWIG | YIYY------SGSTYYNPS LKS | RVTISVDTSKNQFSLKLNSV TAADTAVYYCAR | DGAAL-------GMDV | WGQGT TVTVS S |
| iPS:4 37068 | 21-225_200A11 | VH4J4-30.1D6J6-6JRF2/JH6 | QVQLQES-GPGLVKPSQTLSL TCTVSG-GSIS | SG----GDYWS | WIRQHPGK GLEWIG | YIYY------RGSTYYNPS LKS | RVTISVDTSKNQFSLKLSSV TAADTAVYYCAR | DAAAH-------GMDV | WGQGT TVTVS S |
| iPS:4 37140 | 21-225_214E12 | VH4J4-30.1D6J6-6JRF2/JH6 | QVQLQES-GPGLVKPSQTLSL TCTVSG-GSIS | SG----GDYWS | WIRQHPGK GLEWIG | YIYY------SGPTYYNPS LKS | RVTISVDTSKNQFSLKLSSV TAADTAVYYCAR | DGAAE-------GMDV | WGQGT TVTVS S |
| iPS:4 37158 | 21-225_216H11 | VH4J4-30.1D6J6-6JRF2/JH6 | QVQLQES-GPGLVKPSQTLSL TCTVSG-GSIS | SG----GDYWS | WIRQHPGK GLEWIG | YIYY------SGPTYYNPS LKS | RVTISVDTSKNQFSLKLSSV TAADTAVYYCAR | DGAAE-------GLDV | WGQGT TVTVS S |
| | | H_FR1 | H_CDR1 | H_FR2 | H_CDR2 | H_FR3 | H_CDR3 | H_FR4 |
| | Germline VH3J3-33/D1J1-26/RF3/JH3 | QVQLVES-GGGLVQPGGSLRL SCAASG-FTFS | ------YGMN | WVRQAPGS GLEWVS | IIWFD---SSIIYADS VKG | RFTISRDNSKNILYLQMNSL RAEDTAVYYCAR | YYSSSY------DAFDI | WGQGT MVTVS S |
| iPS:4 37074 | 21-225_203B2 | VH3J3-33/D1J1-26/RF3/JH3 | QVQLVES-GGGVVQPGRSLRL SCAASG-FTFS | N------YGMH | WVRQAPGK GLEWVA | IIWFD---GSNEYYADS VKG | RFTISRDNSMSTLYLQMNSL RAEDTAVYYCAR | ESGSY-------ALYI | WGQGT MVTVS S |
| iPS:4 37082 | 21-225_205E12 | VH3J3-33/D1J1-26/RF3/JH3 | QVQLVES-GGGVVQPGRSLRL SCAASG-FTFS | N------YGMH | WVRQAPGK GLEWVA | IIWFD---GSNEYYADS VKG | RFTISRDNSMSTLYLQMNSL RAEDTAVYYCAR | ESGSY-------ALYI | WGQGT MVTVS S |
| | | H_FR1 | H_CDR1 | H_FR2 | H_CDR2 | H_FR3 | H_CDR3 | H_FR4 |
| | Germline VH3J3-48/D4J4-17/RF2/JH4 | EVQLVES-GGGLVQPGGSLRL SCAASG-FTFR | ------YSMN | WVRQAPGK GLEWVL | YISSS---SSIKKYADS VKG | RFTISRDNAKNSLYLQMNSL RDEDTAVYYCVR | DYIDY------YFDY | WGQGT LVTVS S |
| iPS:4 37086 | 21-225_209A8 | VH3J3-48/D4J4-17/RF2/JH4 | EVQLVES-GGGLVQPGGSLRL SCAASG-FTFR | S------YSMN | WVRQAPGK GLEWVL | YISSS---SSIKKYADS VKG | RFTISRDNAKNSLYLQMNSL RDEDTAVYYCVR | DDGSY-------YFDY | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-30.1/D2/2-8/RF3/JH6 | Germline | QVQLQES-GPGLVKPSQTLSL TCTVSG-GSIS | SG---GYYWS | WIRQHPGK GLEWIG | YIYY------ SGSTYNPS LKS | RVTISVDTSKNQFSLKLSSV TAADTAVYYCAR | DIYYYYYAA------YYGMDV | WGQGT TVTVS S |
| iPS:4 37090 | 21-225_210F11 | VH4/4-30.1/D2/2-8/RF3/JH6 | QVQLQES-GPGLVKPSQTLSL TCTVSG-GSIS | SG---GSYWS | WIRQHPGK GLEWIG | YIYY------ IGTTYNPS LKS | RVTISVDTSINHFSLKLSSV TAADTAVYYCAR | DEFLT------------GMDV | WGQGT TVTVS S |
| iPS:4 37106 | 21-225_211H7 | VH4/4-30.1/D2/2-8/RF3/JH6 | QVQLQES-GPGLVKPSQTLSL TCTVSG-GSIS | SG---GYYWS | WIRQHPGK GLEWIG | YIYY------ VGSTYNPS LKS | RVTISVDTSKNQFSLKLSSV TAADTAVYYCAR | DGFLS------------GMDV | WGQGT TVTVS S |
| VH3/3-30.3/D4/4-17/RF2/JH5 | Germline | QVQLVES-GGGVVQPGRSLRL SCAASG-FTFS | S------YAMH | WVRQAPGK GLEWVA | VIWYD--- GSNKYYADS VKG | RFTISRDNSKNTLYLQMNSL RAEDTAVYYCAR | DYGDY-------------NWFDP | WGQGT LVTVS S |
| iPS:4 37100 | 21-225_211H2 | VH3/3-30.3/D4/4-17/RF2/JH5 | QVQLVES-GGGVVQPGRSLRL SCAASG-FTFS | S------YAMH | WVRQAPGK GLEWVA | VIWYD--- GSNKYYADS VKG | RFTIARDNSKNTLYLQMNSL RAEDTAVYYCAR | DPGSY-------------GFDP | WGQGT LVTVS S |
| VH3/3-33/D5/5-12/RF3/JH6 | Germline | QVQLVES-GGGVVQPGRSLRL SCAASG-FTFS | N------YGMH | WVRQAPGK GLEWVA | VIYYD--- GSNKYYADS VKG | RFTISRDNSKNTLYLQMNSL RAEDTAVYYCAR | GYSGYYY------YYGMDV | WGQGT TVTVS S |
| iPS:4 37102 | 21-225_211E5 | VH3/3-33/D5/5-12/RF3/JH6 | QVQLVES-GGGVVQPGRSLRL SCAASG-FTFR | N------YGMH | WVRQAPGK GLEWVS | IIWFD--- GSDQYYADS VKG | RFTISRDNSKNTLYLQMNSL RAEDTAVYYCAR | GLSVYY------------YGMGV | WGQGT TVTVS S |
| iPS:4 37164 | 21-225_217C6 | VH3/3-33/D5/5-12/RF3/JH6 | QVQLVES-GGGVVQPGRSLRL SCAASG-FTFS | N------YGMH | WVRQAPGK GLEWMA | IIWFD--- GSDEYYADS VKG | RFTISRDNSKNTMYLQMNSL RAEDTAVYYCAR | GLSVYY------------YGMDV | WGQGT TVTVS S |
| iPS:4 37166 | 21-225_217G11 | VH3/3-33/D5/5-12/RF3/JH6 | QVQLVES-GGGVVQPGRSLRL SCAASG-FTFR | N------YGMH | WVRQAPGK GLEWVS | IIWFD--- GSDQYYADS VKG | RFTISRDNSKNTLYLQMNSL RAEDTAVYYCAR | GLSVYY------------YGMDV | WGQGT TVTVS S |
| iPS:4 37170 | 21-225_218E5 | VH3/3-33/D5/5-12/RF3/JH6 | QVQLVES-GGGVVQPGRSLRL SCAASG-FTFS | N------YGMH | WVRQAPGK GLEWMA | IIWFD--- GSDEYYADS VKG | RFTISRDNSKNTLYLQMNSL RAEDTAVYYCAR | GLSVYY------------YGMDV | WGQGT TVTVS S |
| VH4/4-30.1/D6/6-19/RF2/JH6 | Germline | QVQLQES-GPGLVKPSQTLSL TCTVSG-GSIS | SG---GYYWS | WIRQHPGK GLEWIG | YIYY------ SGSTYNPS LKS | RVTISVDTSKNQFSLKLSSV TAADTAVYYCAR | GIAVAGYY------YYGMDV | WGQGT TVTVS S |

Figure 51 (Continued)

| ID | Clone | Germline | H_FR1 | H_CDR1 | H_FR2 | H_CDR2 | H_FR3 | H_CDR3 | H_FR4 |
|---|---|---|---|---|---|---|---|---|---|
| iPS:4 37108 | 21-225_211C9 | VH4\|4-30.1\|D6\|6-19\|RF2\|JH6 | QVQLQES-GPGLVKPSQTLSLTCTVSG-GSIR | SG----GDYWS | WIRQHPGKGLEWIG | YIYY----SGSTYYNPSLKS | RVTILLDTSKNQFSLKLSSVTVADTAVYYCAR | DSAVY--------NMDV | WGQGTTVTVSS |
| iPS:4 37110 | 21-225_211E9 | VH4\|4-30.1\|D6\|6-19\|RF2\|JH6 | QVQLQES-GPGLVKPSQTLSLTCTVSG-GSIS | SG----GDYWS | WIRQHPGKGLEWIG | YIYY----TGSNYYNPSLKS | RVTISVDTSKNQFSLNLISVTAADTAVYYCAR | DSAVY--------GMDV | WGQGTTVTVSS |
| iPS:4 37120 | 21-225_212A9 | VH4\|4-30.1\|D6\|6-19\|RF2\|JH6 | QVQLQES-GPGLVKPSQTLSLTCTVSG-GSIR | SG----GDYWS | WIRQHPGKGLEWIG | YMYY----SGSTYYNPSLKS | RVTISVDTSKNQFSLKLSSVTVADTAVYYCAR | DSAVY--------GMDV | WGQGTTVTVSS |
| iPS:4 37132 | 21-225_213F5 | VH4\|4-30.1\|D6\|6-19\|RF2\|JH6 | QVQLQES-GPGLVKPSQTLSLTCTVSG-GSIR | SG----GDYWS | WIRQHPGKGLEWIG | YIYY----SGSTYYNPSLKS | RVTISLDTSKNQFSLKLSSVTVADTAVYYCAR | DSAVY--------NMDV | WGQGTTVTVSS |
| iPS:4 37142 | 21-225_215A3 | VH4\|4-30.1\|D6\|6-19\|RF2\|JH6 | QVQLQES-GPGLVKPSQTLSLTCTVSG-GSIS | SG----GDYWS | WIRQHPGKGLEWIG | YIYY----TGSNYYNPSLKS | RVTISVDTSKNQFSLKVISVTAADTAVYYCAR | DSAVY--------GMDV | WGQGTTVTVSS |
| iPS:4 37148 | 21-225_215H3 | VH4\|4-30.1\|D6\|6-19\|RF2\|JH6 | QVQLQES-GPGLVKPSQTLSLTCTVSG-GSIR | SG----GDYWS | WIRQHPGKGLEWIG | YMYY----SGSTYYNPSLKS | RVTISVDTSKNQFSLKLSSVTVADTAVYYCAR | DSAVY--------GMDV | WGQGTTVTVSS |
| iPS:4 37154 | 21-225_216A7 | VH4\|4-30.1\|D6\|6-19\|RF2\|JH6 | QVQLQES-GPGLVKPSQTLSLTCTVSG-GSIR | SG----GDYWS | WIRQHPGKGLEWIG | YMYY----SGSTYYNPSLKS | RVTISVDTSKNQFSLKLSSVTVADTAVYYCAR | DSAVY--------GMDV | WGQGTTVTVSS |
| | Germline VH3\|3-30.3\|D7\|7-27\|RF2\|JH4 | | H_FR1 | H_CDR1 | H_FR2 | H_CDR2 | H_FR3 | H_CDR3 | H_FR4 |
| iPS:4 37160 | 225_216B12 | VH3\|3-30.3\|D7\|7-27\|RF2\|JH4 | QVQLVES-GGGVVQPGRSLRLSCAASG-FTFS | S-----YAMH | WVRQAPGKGLEWVA | VIWYD---GSNKYYADSVKG | RFTISRDNSKNTLYLQMNSLRAEDTAVYYCAR | DLGLG--------YFFDY | WGQGTLVTVSS |
| | Germline VH6\|6-01\|D2\|2-21\|RF2\|JH5 | | H_FR1 | H_CDR1 | H_FR2 | H_CDR2 | H_FR3 | H_CDR3 | H_FR4 |
| iPS:4 37186 | 21-225_224H2 | VH6\|6-01\|D2\|2-21\|RF2\|JH5 | QVQLQQS-GPGLVKPSQTLSLTCDISG-DSVS | SN----SAAWN | WIRQSPSRGLEWLG | RTYYR---SKWYNDYAVSVKS | RVTINPDTSKNQFSLQLNSVTPEDTAVYYCAR | EGGLGYCSST------SCYGGWPDF | WGQGTLVTVSS |
| | Germline VH1\|1-02\|D4\|4-17\|RF2\|JH6 | | H_FR1 | H_CDR1 | H_FR2 | H_CDR2 | H_FR3 | H_CDR3 | H_FR4 |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37188 | 21-225_224B11 | VH1)1-02/D4)4-17)RF2/JH6 | QVHLVQS-GAEVKKPGASVKV SCKASG-YTFT | G-----YYIH | WVRQAPGQ GLEWMG | WINPK---NGGTNYAQK FQG | RVTMTRDASISTTYMELSRL RSDDTAVYYCAR | GAFDYFI-------YAMDV | WGHGT TVTVS S |
| iPS:4 37198 | 21-225_226F8 | VH1)1-02/D4)4-17)RF2/JH6 | QVQLVQS-GAEVKKPGASVKV SCKASG-YTFT | G-----YYIH | WVRQAPGQ GLEWMG | WINPN---SGGTNYARK FQG | RVTMTRDTSISTAYMELSRL RSDDTAVYYCAR | GAFDYY-------YYALDV | WGQGT TVTVS S |
| iPS:4 37202 | 21-225_227D3 | VH1)1-02/D4)4-17)RF2/JH6 | QVQLVQS-GAEVKKPGASVKV SCKASG-YTFT | G-----YYMH | WVRQAPGQ GLERMG | WINPK---SGGTNFAQK FQG | RVTMTRDTSISTAYMELSRL RSDDTAVYYCAR | GAFDYFI-------YYGMDV | WGQGT TVTVS S |
| iPS:4 37208 | 21-225_227C10 | VH1)1-02/D4)4-17)RF2/JH6 | QVQLVQS-GAEVKKPGASVKV SCKASG-YTFT | G-----YYMH | WVRQAPGQ GLERMG | WINPK---SGGTNYAQK FQG | RVTMTRDTSISTAYMELSRL RSDDTAVYYCAR | GAFDYFI-------YYGMDV | WGQGT TVTVS S |
| | Germline VH3)3-33/D2)2-21)RF2/JH6 | | | | | | | |
| iPS:4 37192 | 21-225_225E9 | VH3)3-33/D2)2-21)RF2/JH6 | QVQLVES-GGGVVQPGRSLRL SCAASG-FTFS | S-----YGMH | WVRQAPGK GLEWVA | VMWYD---GGNKDYADS VKG | RFTISRDNSKNTLYLQMNSL RAEDTAVYYCAK | DREYCTSTSC----PIYYYYGMDV | WGQGT TVTVS S |
| | Germline VH3)3-23/D2)2-21)RF2/JH6 | | | | | | | |
| iPS:4 37204 | 21-225_227E5 | VH3)3-23/D2)2-21)RF2/JH6 | EVQLLES-GGGLVQPEGSLRL SCAASG-FTFS | S-----YAMS | WVRQAPGK GLEWVS | AISGS---GGSTYYADS VKG | RFTISRDNSKNTLCLQMNSL RAEDTAVYYCAK | EYCGGDCYSP---YYYYYGMDV | WGQGT TVTVS S |
| iPS:3 93196 | 21-225_16G8 | VH3)3-23/D2)2-21)RF2/JH6 | EVQLLES-GGGLVQPEGSLRL SCAASG-FTFS | S-----YAMS | WVRQAPGK GLEWVS | GISGS---GGSTYYADS VKG | RFTISRDNSKNTLCLHMNSL RAEDTAVYYCAK | EYCGGDCYSP---YYYYYGMDV | WGQGT TVTVS S |
| iPS:3 93202 | 21-225_6B4 | VH3)3-23/D2)2-21)RF2/JH6 | EVQLLES-GGGLVQPEGSLRL SCAASG-FTFS | S-----YAMS | WVRQAPGK GLEWVS | AISGS---GGSTYYADS VKG | RFTISRDNSKNTLCLQMNSL RAEDTAVYYCAK | EYCGGDCYSF---YYYYYGMDV | WGQGT TVTVS S |
| iPS:3 93345 | 21-225_5G7 | VH3)3-23/D2)2-21)RF2/JH6 | EVQLLES-GGGLVQPEGSLRL SCAASG-FTFS | S-----YAMS | WVRQAPGK GLEWVS | AISGS---GGSTYYADS VKG | RFTISRDNSKNTLCLQMNSL RAEDTAVYYCAK | EYCGGDCYSP---YYYYYGMDV | WGQGT TVTVS S |
| | Germline VH2)2-05/D6)6-13)RF3/JH4 | | | | | | | |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:4 37210 | 21-225_227E12 | VH2|2-05/D6|6-13|RF3/JH4 | QITLKES-GPTLVKPTQTLTL TCTFSG-FSLS | TS----GVGVG | WIRQPPGK ALECLS | LIYW----NDDKVSPS LKS | RLTITKYTSKNQVVLTMTNM DPVDTATYYCAH | RGQQL--------ALDY | WGQGT LVTVS S |
| iPS:3 92587 | 21-225_18G5 | VH2|2-05/D6|6-13|RF3/JH4 | QITLKES-GPTLVKPTQTLTL TCTFSG-FSLS | TS----GVGVG | WIRQPPGK ALECLS | LIYW----NDDKVSPS LKS | RLTITKYTSKNQVVLTMTNM DPVDTATYYCAH | RGQQL--------ALDY | WGQGT LVTVS S |
| iPS:3 98504 | 21-225_23D7 | VH2|2-05/D6|6-13|RF3/JH4 | QITLKES-GPTLVKPTQTLTL TCTFSG-FSLS | TS----GVGVG | WIRQPPGK ALECLS | LIYW----NNDKVSPS LKS | RLTITKYTSKNQVVLTMSNM DPVDTATYYCAH | RGQQL--------ALDY | WGQGT LVTVS S |
| | Germline | VH3|3-21/D4|4-11|RF2/JH6 | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | YYYGMDV | WGQGT TVTVS S |
| iPS:4 37226 | 21-225_57C2 | VH3|3-21/D4|4-11|RF2/JH6 | EVQLVES-GGGLVKPGGSLRL SCAASG-FTFS | S------FGMN | WVRQAPGK GLEWVS | SISSS---TGYINADS VKG | RFTISRDNAKNSLYLQMNSL RAEDTAVYYCAR | TYSG----------SLDV | WGQGT TVTVS S |
| | Germline | VH3|3-21/D5|5-18|RF3/JH5 | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | NWFDP | WGQGT LVTVS S |
| iPS:4 37230 | 21-225_62H10 | VH3|3-21/D5|5-18|RF3/JH5 | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | GGSR----------GFDP | WGQGT LVTVS S |
| iPS:4 48906 | 21-225_72G9 | VH3|3-21/D5|5-18|RF3/JH5 | EVQLVES-GGGLVKPGGSLRL SCAASG-FTFS | S------YSMN | WVRQAPGK GLEWVS | SISGS---SSYIYADS VKG | RFTISRDNAKNSLYLQMNSL RAEDTAVYYCAR | GGSR----------GFDP | WGQGT LVTVS S |
| | Germline | VH1|1-02/D1|1-26|RF1/JH4 | QVQLVQS-GAEVKKPGASVKV SCKASG-YTFT | G------YFMH | WVRQAPGQ GLEWMG | WIKPK--SGGTNCAQK FQG | RVTMTRDTSSTAYMELSRL TSDDTAVYYCAR | TYFDY | WGQGT LVTVS S |
| iPS:4 37260 | 21-225_170D1 | VH1|1-02/D1|1-26|RF1/JH4 | QVQLVQS-GAEVKKPGASVKV SCKASG-YTFT | G------YFMH | WVRQAPGQ GLEWMG | WIKPK--SGGTNCAQK FQG | RVTMTRDTSSTAYMELSRL TSDDTAVYYCAR | GGATVTT--------WGVFDY | WGQGT LVTVS S |
| | Germline | VH3|3-33/D2|2-21|RF2/JH6 | EVQLVES-GGGVVQPGRSLRL SCAASG-FTFS | S------YGMD | WVRQAPGK GLEWVA | VIWYD---GSNKYYADS VKG | RFTISRDNSKNTLYLQMNSL RAEDTAVYYCAR | YYYGMDV | WGQGT TVTVS S |
| iPS:4 37268 | 21-225_177D2 | VH3|3-33/D2|2-21|RF2/JH6 | QVQLVES-GGGVVQPGRSLRL SCAASG-FTFS | S------YGMD | WVRQAPGK GLEWVA | IIWFD---GSNKYYADS VKG | RFTISRDNSKNTLYLQMNSL RAEDTAVYYCAR | AYCGGDCYFP----HLHYYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-4_30.1/D4/4-17/RF2/JH4 | | QXQLQES-GPSLVKPSQTLSL TCTVSG-GSIS | SG----GYYWS | WIRQHPGK GLEWIG | YIYY----SGSTYNPS LKS | RVTISVDTSKMQFSLKLNSV TAADTAVYFCAR | DSPDY | WGQGT LVTVTSS |
| iPS:4 37294 | 21-225_216D5 | VH4-4-30.1D4/4-17/RF2/JH4 | QVQLQES-GPGLVKPSQTLSL TCTVSG-GSIS | SG----GYYWS | WIRQHPGK GLEWIG | YIYY----SGSTYYNPS LKS | RVTISVDTSKMQFSLKLNSV TAADTAVYFCAR | DSPDR---------GFDI | WGQGT LVTVS S |
| | Germline | H_FR1 | H_CDR1 | H_FR2 | H_CDR2 | H_FR3 | H_CDR3 | H_FR4 |
| VH3/3-30.3/D5/5-24/RF3/JH6 | | QVQLVES-GGGVVQPGRSLRL SCAASG-FTFS | YAMH | WVRQAPGK GLEWVS | VISID----GSNKYADS VKG | RFTISRDNSKNTLYLQMNSL RAEDTAVYYCVR | RDGSMDY | WGQGT TVTVS S |
| iPS:4 37302 | 21-225_225B11 | VH3/3-30.3/D5/5-24/RF3/JH6 | QVQLVES-GGGVVQPGRSLRL SCAASG-FTFS | S-----YGMH | WVRQAPGK GLEWVT | IISYS----GSNKYYADS VKG | RFTISRDNSKNTLYLQMNSL RAEDTAVYYCAR | RGYSYG----------GYGMDV | WGQGT TVTVS S |
| iPS:4 51102 | 21-225_45F6 | VH3/3-30.3/D5/5-24/RF3/JH6 | QVQLVES-GGGVVQPGRSLRL SCAASG-FTFS | Y-----YGLH | WVRQAPGK GLEWVA | VISYD----GSNKYYADS VKG | RFTISRDNSKNTLYLQMNNL RAEDTAVYYCAR | EDRYCSGTSC-------PYYYYGMDV | WGQGT TVTVS S |
| iPS:3 92868 | 21-225_24D6 | VH3/3-30.3/D5/5-24/RF3/JH6 | QVQLVES-GGGVVQPGRSLRL SCAASG-FTFS | S-----YGMH | WVRQAPGK GLEWVA | IISYA----GSNKYYADS VKG | RFTISRDNSKNTLYLQMNSL RAEDTAVYYCVR | RGYSYG----------GYGMDV | WGQGA TVTVS S |
| iPS:3 93910 | 21-225_15F10 | VH3/3-30.3/D5/5-24/RF3/JH6 | QVQLVES-GGGVVQPGRSLRL SCAASG-FTFS | S-----YGMH | WVRQAPGK GLEWVS | VISYG----GSNNYYADS VKG | RFTISRDNSKNTLYLQMNSL RAEDTAVYYCVR | RGYSYG----------GYGMDV | WGQGT TVTVS S |
| iPS:3 94000 | 21-225_11A2 | VH3/3-30.3/D5/5-24/RF3/JH6 | QVQLVES-GGGVVQPGRSLRL SCAASG-FTFS | S-----YGMH | WVRQAPGK GLEWVA | VISYD----GSNKDSADS VKG | RFTISRDNSKNTLYLQMNSL RAEDTAVYYCVR | RGYSYG----------GYGMDV | WGQGT TVTVS S |
| iPS:3 94004 | 21-225_13A1 | VH3/3-30.3/D5/5-24/RF3/JH6 | QVQLVES-GGGVVQPGRSLRL SCAASG-FTFS | S-----YGMH | WVRQAPGK GLEWVA | VISYA----GTNQYYADS VKG | RFTISRDNSKNTLYLQMNSL RAEDTAVYYCVR | RGYSYG----------GYGMDV | WGQGT TVTVS S |
| iPS:3 94006 | 21-225_15C2 | VH3/3-30.3/D5/5-24/RF3/JH6 | QVQLVES-GGGVVQPGRSLRL SCAASG-FTFS | S-----YGMH | WVRQAPGK GLEWVS | IISYG----GRNNHYADS VKG | RFTISRDNSKNTLYLQMNSL RAEDTAVYYCVR | RGYSYG----------GYGMDV | WGQGT TVTVS S |
| iPS:3 94029 | 21-225_1B12 | VH3/3-30.3/D5/5-24/RF3/JH6 | QVQLVES-GGGVVQPGRSLRL SCAASG-FTFS | S-----YGMH | WVRQAPGK GLEWVA | IISYA----GSNKSYADS VKG | RFTISRDNSKNMLYLQMNSL RAEDTAVYYCVR | RGYSYG----------GYGMDV | WGQGA TVTVS S |
| iPS:3 94047 | 21-225_5E6 | VH3/3-30.3/D5/5-24/RF3/JH6 | QVQLVES-GGGVVQPGRSLRL SCAASG-FTFS | S-----YGMH | WVRQAPGK GLEWVA | IISYS----GNNKYYADS VKG | RFTISRDNSKNTLYLQMNSL RVEDTAVYYCAR | RGYSYG----------GYGMDV | WGQGT TVTVS S |

Figure 51 (Continued)

| | | | | H_FR1 | H_CDR1 | H_FR2 | H_CDR2 | H_FR3 | H_CDR3 | H_FR4 |
|---|---|---|---|---|---|---|---|---|---|---|
| iPS:3 94881 | 21-225_16B3 | VH3J3-30.3\|D5\|5-24\|RF3/JH6 | | QVQLVES-GGGVVQPGRSLRL SCVASG-FTFS | S------YGMH | WVRQAPGK GLEWVA | VISYA---- GINRSYADS VKG | RFTISRDNSNTLYLQMNSL RAEDTAVYYCVR | RGYSYG-------GYGMDV | WGQGA TVTVS S |
| | | Germline | | H_FR1 | H_CDR1 | H_FR2 | H_CDR2 | H_FR3 | H_CDR3 | H_FR4 |
| | | VH4\|4-61\|D3\|3-9\|RF1\|JH4 | | | | | | | | |
| iPS:4 51118 | 21-225_191C8 | VH4\|4-61\|D3\|3-9\|RF1/JH 4 | | QVQLQES-GPGLVKPSETLSL TCTVSS-GSVS | SG-----GYYWS | WIRQPPGK GLEWIG | YIYY------ SGTTYNPS LKS | RVTISVDTSKNQFSLKLTSV TVADTAVYYCAR | DTFCFDG-------CGYFFDS | WGQGI LVTVS S |
| | | Germline | | H_FR1 | H_CDR1 | H_FR2 | H_CDR2 | H_FR3 | H_CDR3 | H_FR4 |
| | | VH2\|2-05\|D4\|4-11\|RF3\|JH4 | | | | | | | | |
| iPS:3 92573 | 21-225_15G2 | VH2\|2-05\|D4\|4-11\|RF3/J H4 | | QITLKES-GPTLVKPTQTLTL TCTFSG-FSLS | TS-----GVGVG | WIRQPPGK ALEWLA | LIYW------ NDDKRYSPS LKS | RLTITKDTSKNQVVLTMTWM DPVDTATYYCAD | TGVSC----------CYFHY | WGQGT LVTVS S |
| | | Germline | | H_FR1 | H_CDR1 | H_FR2 | H_CDR2 | H_FR3 | H_CDR3 | H_FR4 |
| | | VH1\|1-02\|D2\|2-2\|RF2\|JH6 | | | | | | | | |
| iPS:3 92585 | 21-225_14H11 | VH1\|1-02\|D2\|2-2\|RF2/JH 6 | | QVQLVQS-GAEVKKPGASVKV SCQGSG-YIFT | G------HYMC | WVRQAPGK GLEWMG | WINPN----- SGGTNYAQK FQG | RVTMTRDTSISTAYMELSRL RSDDTAVYYCAA | GYCSSSCYL-----QPGYYGMDV | WGQGI TVTVS S |
| iPS:3 93186 | 21-225_27D9 | VH1\|1-02\|D2\|2-2\|RF2/JH 6 | | QVQLVQS-GAEVKKPGASVKV SCKASG-YIFT | G------YYMH | WVRQAPGQ GLEWMG | WINPN----- SGGTNYAQK FQG | RVTMTRDTSISTAYMELNRL RSEDTAVYYCAR | ERCSTTSCYL----GITGYYGMDV | WGQGT TVTVS S |
| iPS:3 93234 | 21-225_26C10 | VH1\|1-02\|D2\|2-2\|RF2/JH 6 | | QVQLVQS-GAEVKKPGASVKV SCKASG-YIFT | G------YYVH | WVRQAPGK GLEWMG | WINPN----- SGGTNYAQK FQG | RVTMTRDTSISTAYMELSRL RSEDTAVYYCAR | ERCSTTSCYL----GITGYYGMDV | WGQGT TVTVS S |
| | | Germline | | H_FR1 | H_CDR1 | H_FR2 | H_CDR2 | H_FR3 | H_CDR3 | H_FR4 |
| | | VH3\|3-23\|D5\|5-12\|RF3\|JH6 | | | | | | | | |
| iPS:3 92596 | 21-225_12D8 | VH3\|3-23\|D5\|5-12\|RF3/J H6 | | EVQLLES-GGGLVQPGGSLRL SCAASG-FTFS | S------YVMS | WVRQAPGK GLEWVS | TISVG----- GGSTYYADS VKG | RFTISRDNSKTTLYLQMNSL RAEDTAVYYCAK | WGRGYSYE------YYYGMDV | WGQGT TVTVS S |
| iPS:3 92942 | 21-225_30E9 | VH3\|3-23\|D5\|5-12\|RF3/J H6 | | EVQVLES-GGGLVQPGGSLRL SCAASG-FTFS | S------CAMN | WVRQAPGK GLEWVS | AISGR----- GGSTFYADS VKG | RFTISRDNSKNTLYLQMNSL RAEDTAVYYCAK | GELLEDY-------YYYGMDV | WGQGT TVTVS S |

Figure 51 (Continued)

| | | | | | | | | |
|---|---|---|---|---|---|---|---|---|
| iPS:3 92944 | 21-225_31H5 | VH3J3-23D5|5-12|RF3/J H6 | EVQLLES-GGGLVQPGGSLRL SCAASG-FTFS | S------YAMS | WVRQAPGK GLEWVS | AISGR---GGSTFHADS VKG | RFTISRDNSKNTLYLQMNSL RAEDTAVYYCVK | GELLEDY------------YFYGMDV | WGQGT TVTVS S |
| iPS:3 92964 | 21-225_31A8 | VH3J3-23D5|5-12|RF3/J H6 | EVQLLES-GGGLVQPGGSLRL SCAASG-FTFS | S------YAMS | WVRQAPGK GLEWVS | AISGR---GGSTFHADS VKG | RFTISRDNSKNTLYLQMNSL RDEDTAVYYCVK | GELLEDY------------YFYGMDV | WGQGT TVTVS S |
| iPS:3 92982 | 21-225_30D1 | VH3J3-23D5|5-12|RF3/J H6 | EVQVLES-GGGLVQPGGSLRL SCAASG-FTFS | S------YAMS | WVRQAPGK GLEWVS | AISGR---GGSTFHADS VKG | RFTISRDNSKNTLYLQMNSL RAEDTAVYYCVK | GELLEDY------------YPYGLDV | WGQGT TVTVS S |
| iPS:3 92986 | 21-225_31B8 | VH3J3-23D5|5-12|RF3/J H6 | EVQLLES-GGGLVQPGGSLRL SCAASG-FTFS | S------YAMS | WVRQAPGK GLEWVS | AISGR---GGSTFHADS VKG | RFTISRDNSKNTLYLQINSL RADDTAVYYCVK | GELLEDY------------YFYGMDV | WGQGT TVTVS S |
| iPS:3 93004 | 21-225_30G11 | VH3J3-23D5|5-12|RF3/J H6 | EVQLLES-GGGLVQPGGSLRL SCAASG-FTFS | S------YAMS | WVRQAPGK GLEWVS | AISGR---GGSTTFHADS VKG | RFTISRDNSKTTLYLQMNSL RAEDTAVYYCVK | GELLEDY------------YFYGMDV | WGQGT TVTVS S |
| iPS:3 93040 | 21-225_30E3 | VH3J3-23D5|5-12|RF3/J H6 | EVQVLES-GGGLVQPGGSLRL SCAASG-FTFS | S------YAMN | WVRQAPGK GLEWVS | AISGR---GGSTFHADS EKG | RFTISRDNSKNTLYLQMNSL RAEDTALYYCAK | GELLEDY------------YYYGMDV | WGQGT TVTVS S |
| iPS:3 93058 | 21-225_31H3 | VH3J3-23D5|5-12|RF3/J H6 | EVQLLES-GGGLVQPGGSLRL SCAASG-FTFS | S------YAMN | WVRQAPGK GLEWVS | AISGR---GGNTFYADS VKG | RFTISRDNSRNTLYLQMNSL RAEDTAVYYCVK | GELLEDY------------YYYGMDV | WGQGT TVTVS S |
| iPS:3 93060 | 21-225_32G12 | VH3J3-23D5|5-12|RF3/J H6 | EVQLLES-GGGLVQPGGSLRL SCAASG-FTFN | S------YAMS | WVRQAPGK GLEWVS | SISGR---GGSTFHADS VKG | RFTISRDNSKNTLYLQMNSL RAEDTAVYYCVK | GELLEDY------------YFYGMDV | WGQGT TVTVS S |
| iPS:3 93068 | 21-225_34G9 | VH3J3-23D5|5-12|RF3/J H6 | EVQLVES-GGGLVQPGGSLRL SCAASG-FTFS | S------YAMN | WVRQAPGK GLEWVS | AISGR---GGSTFHADS VKG | RFTISRDNSKNTLYLQMNSL RAEDTAVYYCVK | GELLEDY------------YFYGMDV | WGQGT TVTVS S |
| iPS:3 93072 | 21-225_36C5 | VH3J3-23D5|5-12|RF3/J H6 | EVQLLES-GGGLVQSGGSLRL SCEASG-FTFS | S------YAMN | WVRQAPGK GLEWVS | AISRR---GGSTFYADS VKG | RFTISRDNSKNTLYLQMNSL RAEDTAVYFCAK | GELLEDY------------YFYGMDV | WGQGT TVTVS S |
| iPS:3 93076 | 21-225_33A4 | VH3J3-23D5|5-12|RF3/J H6 | EVQLLES-GGGLVQPGGSLRL SCAASG-FTFS | S------YAMN | WVRQVPGK GLEWVS | AISGR---GGSTFYADS VKG | RFTISRDNSKNTLYLQMNSL RAEDTAVYYCVK | GELLEDY------------SYYGIDV | WGQGT TVTVS S |
| iPS:3 93102 | 21-225_33F1 | VH3J3-23D5|5-12|RF3/J H6 | EVQLLES-GGGLLQPGGSLRL SCAASG-FTFS | S------YAMS | WVRQAPGK GLEWVS | SISGR---GGSTFHADS VKG | RFTISRDNSKNTLYLQMNSL RAEDTAVYYCVK | GELLEDY------------YFYGMDV | WGQGT TVTVS S |

Figure 51 (Continued)

| | | | | | | | | | |
|---|---|---|---|---|---|---|---|---|---|
| iPS:3 93104 | 21-225_33A7 | VH3/3-23/D5/5-12/RF3/JH6 | EVQLLES-GGGLVQPGGSLRLSCAASG-FTFS | S------CAMS | WVRQAPGK GLEWVS | AISGR---GGSTFHADS VKG | RFTISRDNSKNTLYLQMNSL RAEDTAVYYCVK | GELLEDY--------YFYGMDV | WGQGT TVTVS S |
| iPS:3 93106 | 21-225_34A6 | VH3/3-23/D5/5-12/RF3/JH6 | EVQLLES-GGGLVQPGGSLRLSCAASG-FTFN | N------YAMN | WVRQAPGK GLEWVS | AISRR---GGSTFYADS VKG | RFTISRDNSKNTLYLQMNSL RAEDTAVYYCAK | GELLEDY--------YYFAMDV | WGQGT TVTVS S |
| iPS:3 93110 | 21-225_35B7 | VH3/3-23/D5/5-12/RF3/JH6 | EVQLLES-GGGLVQPGGSLRLSCAASG-FTFS | S------YAMS | WVQAPGK GLEWVS | AISGR---GGSTFHADS VKG | RFTISRDNSKNTLYLQMNSL RAEDTAVYYCAK | GELLEDY--------YYYGMDV | WGQGA TVTVS S |
| iPS:3 93118 | 21-225_34H11 | VH3/3-23/D5/5-12/RF3/JH6 | EVQLLES-GGGLVQPGGSLRLSCAASG-FTFS | S------YAMN | WVKQAPGE GLEWVS | AISGR---GGSTFHADS VKG | RFTISRDNSKNTLFLQMNSL RAEDTAVYYCAK | GELLEDY--------YYYGMDV | WGQGT TVTVS S |
| iPS:3 93124 | 21-225_33G7 | VH3/3-23/D5/5-12/RF3/JH6 | EVQLLES-GGGLVQPGGSLRLSCAASG-FTFS | S------YAMS | WVRQAPGK GLEWVS | AISRR---GGSTFYADS MKG | QFTISRDNSKNTLYLQMNSL RAEDTAVYYCAK | GELLEDY--------SYYGMDV | WGQGT TVTVS S |
| iPS:3 93126 | 21-225_35D1 | VH3/3-23/D5/5-12/RF3/JH6 | EVQLLES-GGGLVQPGGSLRLSCAASG-FTFS | N------YAMS | WVRQAPGK GLEWVS | AISGR---GGSTFHADS VKG | RFTISRDNSKNTLYLQMNSL RAEDTAVYYCVK | GELLEDY--------YFYGMDV | WGQGA TVTVS S |
| iPS:3 93128 | 21-225_35F11 | VH3/3-23/D5/5-12/RF3/JH6 | EVQLLES-GGGLVQPGGSLRLSCAASG-FTFS | S------YAMS | WVRQAPGK GLEWVS | AISRR---GGSTFYADS VKG | RFTISRDNSKNTLYLQMNSL RAEDTAVYYCVK | GELLEDY--------YFYGMDV | WGQGT TVTVS S |
| iPS:3 93146 | 21-225_34G8 | VH3/3-23/D5/5-12/RF3/JH6 | EVQLLES-GGGLVQPGGSLRLSCAASG-FTFS | S------YAMS | WVRQAPGK GLEWVS | AISGR---GGSTFHADS VKG | RFTISRDNSKNTLYLQINSL RAEDTAVYYCVK | GELLEDY--------YFYGMDV | WGQGT TVTVS S |
| iPS:3 93150 | 21-225_36A5 | VH3/3-23/D5/5-12/RF3/JH6 | EVQLLES-GGGLVQPGGSLRLSCAASG-FTFN | N------YAMN | WVKQAPGK GLEWVS | AISRR---GGNTFYADS VKG | RFTISRDNSKNTLYLQMSSL RAEDTAVYYCAK | GELLEDY--------YYYAMDV | WGQGT TVTVS S |
| iPS:3 93180 | 21-225_4G12 | VH3/3-23/D5/5-12/RF3/JH6 | EVQLLES-GGGLVQPGGSLRLSCAASG-FTFS | S------YAMS | WVRQAPGK GLEWVS | TLSGR---GGSTYYADS VKG | RSTISRDNSKNTLYLQMNSL RAEDTAVYYCAK | WGRGYSYE-------YYYGMDV | WGQGT TVTVS S |
| iPS:3 93232 | 21-225_17F12 | VH3/3-23/D5/5-12/RF3/JH6 | EVQLLES-GGGLVQPGGSLRLSCAASG-FTFS | S------YAMS | WVRQAPGK GLEWVS | AISGG---GGSTYYADS VKG | RVTISRDNSKNTLYLQMNSL RAEDTAVYYCAK | WGRGYNYE-------YYYGMDV | WGQGT TVTVS S |
| iPS:3 98494 | 21-225_21H4 | VH3/3-23/D5/5-12/RF3/JH6 | EVQLLES-GGGLVQPGGSLRLSCAASG-FTFS | S------YAMS | WVRQAPGK GLEWVS | ALSGR---GGSTYYADS VKG | RFTISRDNSKNTLYLQMNSL RAEDTAVYYCAK | WGRGYSYE-------YYYGMDV | WGQGT TVTVS S |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 98508 | 21-225_24B1 | VH3/3-23/D5/5-12/RF3/J H6 | EVQLLES-GGGLVQPGGSLRL SCAASG-FTFS | S------YAMS | WVRQAPGK GLEWVS | AISGR----GGSTYYADS VKG | RFTISRDNSKNTLYLQMNSL RAEDTAVYYCAK | WGRGYSYE------------YYYGMDV | WGQGT TVTVS S |
| iPS:3 98528 | 21-225_32G1 | VH3/3-23/D5/5-12/RF3/J H6 | EVQLLES-GGGLAQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY------------YFYGMDV | WGQGT TVTVS S |
| iPS:3 98534 | 21-225_33B8 | VH3/3-23/D5/5-12/RF3/J H6 | EVQLLES-GGGLVQPGGSLRL SCAASG-FTFS | S------YAMS | WVRQAPGK GLEWVS | AISGR----GGSTFHADS VKG | RFTISRDNSKNTLYLQMNSL RAEDTAVYYCVK | GELLEDY------------YFYGMDV | WGQGT TVTVS S |
| iPS:3 98540 | 21-225_35A6 | VH3/3-23/D5/5-12/RF3/J H6 | EVQLLES-GGGLVQPGGSLRL SCAASG-FTFS | S------YAMS | WVRQAPGK GLEWVS | TISGR----GGSTFHADS VKG | RFTISRDNSKNTLYLQMNSL RAEDTAVYYCAK | GELLEDI------------YFYGMDV | WGQGT TVTVS S |
| Germline | | | H_FR1 | H_CDR1 | H_FR2 | H_CDR2 | H_FR3 | H_CDR3 | H_FR4 |
| VH4/4-39/D4/4-17/RF2/JH4 | | | QLQLQES-GPGLVKPSETLSL TCTVSG-GSIS | SS | WIRQPSG KGLEWIG | SIYY----SGSTYYNPS LKS | RVTISVDTSKNQFSLRLSSV TAADTAVYYCAR | YYDX | WGQGT LVTVS S |
| iPS:3 92622 | 21-225_17H8 | VH4/4-39/D4/4-17/RF2/J H4 | QLQLQES-GPGLVKPSETLSL TCTVSG-GSIS | RS---SYYWG | WIRQPPGK GLEWIG | NIYY----GGNTYYNPS LKS | RVTISVDTSKNQFSLKLSSV TAADTAVYYCAR | HGKDW------------GLDY | WGQGT LVTVS S |
| iPS:3 92638 | 21-225_17F9 | VH4/4-39/D4/4-17/RF2/J H4 | QLQLQES-GPGLVKPSETLSL TCTVSG-GSIS | RS---SYYWG | WIRQPPGK GLEWIG | NIYY----SGSAYNNPS LKS | RVTISVDTSKNQFSLNLNSV TAADTAVYSCAR | HGKDW------------GLDY | WGQGT LVTVS S |
| iPS:3 92656 | 21-225_1F2 | VH4/4-39/D4/4-17/RF2/J H4 | QLQLQES-GPGLVKPSETLSL TCTVSG-GSIS | RS---SYYWG | WIRQPPGK GLEWIG | NIYY----SGSAYNNPS LKG | RVTISVDTSKNQFSLKLNSV TAADTAVYYCGR | HGKDW------------GLDY | WGQGT LVTVS S |
| iPS:3 92794 | 21-225_21H3 | VH4/4-39/D4/4-17/RF2/J H4 | QLQLQES-GPGLVKPSETLSL TCTVSG-GSIS | RS---SYYWG | WIRQPPGK GLEWIG | NIYY----SGTTYNNPS LKS | RVTISVDTSKNHFSLKLSSV TAADTAVYYCGR | HGKDW------------GLDY | WGQGT LVTVS S |
| iPS:3 92822 | 21-225_23C8 | VH4/4-39/D4/4-17/RF2/J H4 | QLQLQES-GPGLVKPSETLSL TCTVSG-GSIS | RS---SYYWG | WIRQPPGK GLDWIG | NIYY----SGSTYDNPS VKS | RVTISVDTSKNQFSLKLSSV TAADTAVYYCAR | HGKDW------------GLDY | WGQGT LVTVS S |
| iPS:3 92838 | 21-225_22G8 | VH4/4-39/D4/4-17/RF2/J H4 | QLQLQES-GPGLVKPSETLSL TCTVSG-GSIN | RS---SYYWG | WIRQPPGK GLEWIG | NIYY----SGSTYYNPS VKS | RFTISVDTSKNQFSLKLSSV TAADTAVYYCAR | HGKDW------------GLDY | WGQGT LVTVS S |
| iPS:3 92858 | 21-225_22H4 | VH4/4-39/D4/4-17/RF2/J H4 | QLQLQES-GPGLVKPSETLSL TCTVSG-GSIS | RS---SYYWG | WIRQPPGK GLEWIG | NIYY----SGSTYHNPS LKS | RVTISVDTSMNQFSLKLISV TAADTAVYFCGR | HGKDW------------GLDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92882 | 21-225_23A3 | VH4|4-39/D4|4-17|RF2/J H4 | QLQLQES-GPGLVKPSETLSL TCTVSG-GSIS | RS---SYYWG | WIRQPPGQ GLEWIG | NIYY----SGSTYNNPS LKS | RVSISVDTSKNQFSLNLSSV TAADTAVYYCAR | HGKDW------------GLDF | WGQGT LVTVS S |
| iPS:3 93804 | 21-225_5H7 | VH4|4-39/D4|4-17|RF2/J H4 | QLQLQES-GPGLVKPSETLSL TCTVSG-GSIN | RS---SYYWG | WIRQPPGK GLEWIG | NIYY----SGTTYNPS LKS | RVTISVDTSKNQFSLNLSSV TAADTAVYYCAR | HGKDW------------GLDY | WGQGT LVTVS S |
| iPS:3 93832 | 21-225_14B2 | VH4|4-39/D4|4-17|RF2/J H4 | QLQLQES-GPGLVKPSETLSL TCTVSG-GSIN | RS---SYYWG | WIRQPPGK GLEWIG | NIYY----SGTTYNPS LKS | RVTISVDTSKNQFSLNLSSV TAADTAVYYCAR | HGKDW------------GLDY | WGQGA LVTVS S |
| iPS:3 94037 | 21-225_4F4 | VH4|4-39/D4|4-17|RF2/J H4 | QLQLQES-GPGLVKPSETLSL TCTVSG-GSIS | RS---SYYWG | WIRQPPGK GLEWIG | NIYY----SGSTYNPS LKS | RVTISVDTSKNQFSLKLSSV TAADTAVYYCGR | HGKDW------------GLDY | WGQGT LVTVS S |
| iPS:3 94045 | 21-225_4H4 | VH4|4-39/D4|4-17|RF2/J H4 | QLQLQES-GPGLVKPSETLSL TCTVSG-GSIS | RS---SYYWG | WIRQPPGM GLEWIG | NIYY----SGNTYNNPS LKS | RVTISVDTSKNQFSLKLNSV TAADTAVYYCGR | HGKDW------------GLDY | WGQGT LVIVS S |
| iPS:3 94079 | 21-225_11F5 | VH4|4-39/D4|4-17|RF2/J H4 | QLQLQES-GPGLVKPSETLSL TCTVSG-GSIS | RS---SYYWG | WIRQPPGK GLEWIG | NIYY----SGSTYNPS LKS | RVTISVDTSKNHFSLKLSSV TAADTAVYYCAR | HGKDW------------GLDN | WGQGT LVTVS S |
| VH3|3-21/D4|4-11|RF2/JH3 | Germline | EVQLVES-GGGLVKPGGSLRL SCAASG-FTFS | S------YTMN | WVRQAPGK GLEWVS | SISSS----SSYIYPAS VKG | RFTISRDNAKNSLYLQMNSL RAED TAVYYCAR | DRGTY-- | WGQGT MVTVS S |
| iPS:3 92624 | 21-225_17H12 | VH3|3-21/D4|4-11|RF2/J H3 | EVQLVES-GGGLVKPGGSLRL SCAASG-FTFS | S------YTMN | WVRQAPGK GLEWVS | SISGS----SSYIYYADS VKG | RFTISRDNAKNSLYLQMNSL RAEDTAVYYCAR | DRG---------------SI | WGQGT MVTVS S |
| iPS:3 93946 | 21-225_16A4 | VH3|3-21/D4|4-11|RF2/J H3 | EVQLVES-GGGLVKPGGSLRL SCAASG-FTFS | S------YSMN | WVRQAPGK GLEWVS | SISGS----STYKYYADS VKG | RFTISRDNAKNSLYLQMNSL RTEDTAVYYCAR | DRG---------------SY | WGQGT QVTVS S |
| iPS:3 94008 | 21-225_15H8 | VH3|3-21/D4|4-11|RF2/J H3 | EVQLVES-GGGLVKPGGSLRL SCAASG-FTFS | S------YVMN | WVRQAPGK GLEWVS | SISGS----STYIYCADS IKG | RFTISRDNAKNSLYLQMNSL RAEDTAVYYCAR | DRG---------------SI | WGQGT MVTVS S |
| VH6|6-01/D3|6-19|RF1/JH6 | Germline | QVQLQQS-GPGLVKPSQTLSL TCAISG-DSVS | RN---TAAWN | WIRQSPSR GLEWLG | RTIYR----SKWYNDPAV SVKS | RVTINPDISKNQPSLQLSSV TPEDIAVYYCAR | VSSGWY------YYYGMDV | WGQGT LVTVS S |
| iPS:3 92636 | 21-225_17A6 | VH6|6-01/D6|6-19|RF1/J H6 | QVQLQQS-GPGLVKPSQTLSL TCAISG-DSVS | RN---TAAWS | WIRQSPSR GLEWLG | RTIYR----SKWYNDYAV SVKS | RVTINPDISKNQFSLQLNSV TPEDTAVYYCAR | VSSGWSHH------YYYYGMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH6[6-01]D2[2-15]RF2/JH6 | | QVQLQQS GPGLVKPSQTLSL TCAISG-DSVS | SN--SAAWN | WIRQSPSR GLEWLG | RTYYR-- SKWYNDYAV SVKS | RITINPDTSKNQFSLQLNSV TEDPAVYYCAR | GYYGSHH-- -YYYGMDV | WGQGT TVTVS S |
| iPS:3 92648 21-225_16D11 | VH6[6-01/D2[2-15]RF2/J H6 | QVQLQQS GPGLVKPSQTLSL TCAISG-DSVS | RN---TAAWS | WIRQSPSR GLEWLG | RTYYR-- SKWYNDYAV SVKS | RITINPDTSKNQFSLQLNSV TEDPAVYYCAR | VNSGWSHH-- -YYYGMDV | WGQGT TVTVS S |
| VH3[3-11]D1[1-1]RF3/JH2 | Germline | EVQLVES- GGGLVKPGGSLRL SCAASG-FTFS | YYMS | WIRQAPGK GLEWVS | HISSS--- GSTIYYADS VKG | RFTISRDNAKNSLYLQMNSL RAEDTAVYYCAR | YRNR-- ---WFDL | WGQGT LVTVS S |
| iPS:3 92650 21-225_17A4 | VH3[3-11]D1[1-1]RF3/JH 2 | QVQLVES- GGGLVKPGGSLRL SCAASG-FTFS | D------YYMS | WIRQAPGK GLEWVS | HISSS--- GSTIYYADS VKG | RFTISRDNAKNSLYLQMNSL RAEDTAVYYCAR | YRNR-- ---GYFDL | WGRGT LVTVS S |
| iPS:3 92728 21-225_20F7 | VH3[3-11]D1[1-1]RF3/JH 2 | QVQLVES- GGGLVKPGGSLRL SCAASG-FTFS | D------YYMS | WIRQAPGK GLEWVS | HISSS--- GSTIYYADS VKG | RFTISRDNGENSLYLQMNSL RAEDTAVYYCAR | YRNR-- ---GYFDL | WGRGS LVTVS S |
| VH4[4-59]D1[1-26]RF3/JH4 | Germline | QVQLQES- GGGLVKPSETLSL TCTVSG-GSIS | YYMS | WIRQPPGK GLEWIG | YIYY--- SGSTYNPS LKS | RFTISVDTSRNQFSLKLSSV TAEDTAVYYCAR | YGSY-- ---YYFDY | WGQGT LVTVS S |
| iPS:3 92676 21-225_19F3 | VH4[4-59]D1[1-26]RF3/J H4 | QVQLQES- GPGLVKPSETLSL TCTVSG-GAIS | GS----SYYWG | WIRQPPGK QLEWIG | NIYY--- SGSTYNPS FKS | RVTISVDTSKNQFSLKLSSV TAEDTAVYYCAR | HSSSW-- ---SLDY | WGQGT LVTVS S |
| VH3[3-23]D6[6-13]RF2/JH2 | Germline | EVQLVES- GGGLVQPGGSLRL SCAASG-FTFS | YYMS | WVRQAPGK GLEWVS | VISGS--- GGSTYYADS VKG | RFTISRDNSKNTLYLQMNSL RAEDTAVYYCAR | GYAAA-- ---YYFDL | WGQGT LVTVS S |
| iPS:3 92678 21-225_20F3 | VH3[3-23]D6[6-13]RF2/J H2 | EVQLVES- GGGLVQPGGSLRL SCAASG-FTFS | S------YAMN | WVRQAPGK GLEWVS | VISGS--- GGSTYYADS VKG | RFTISRDNSKNTLYLQMNSL RAEDTAVYYCAR | RIAAAG-- ---TEYFDL | WGRGT LVTVS S |
| VH3[3-21]D5[5-24]RF3/JH4 | Germline | EVQLVES- GGGLVKPGGSLRL SCAASG-FTFS | YSMN | WVRQAPGK GLEWVS | SISSS--- SSTIYYADS VKG | RFTISRDNAKNSLYLQMNSL RAEDTAVYYCAR | EDGYN-- ---YYFDY | WGQGT LVTVS S |
| iPS:3 92682 21-225_16A12 | VH3[3-21]D5[5-24]RF3/J H4 | EVQLVES- GGGLVKPGGSLRL SCAASG-FTFS | S------YRMN | WFRQAPGK GLEWVS | SISGS--- STDIYYADS VKG | RFTISRDNAENSLYLQMNSL RAEDTAVYYCAR | RD-- ---------F | WGRGT LVTVS S |
| VH3[3-48]D7[7-27]RF1/JH4 | Germline | EVQLVES- GGGLVQPGGSLRL SCAASG-FTFS | YRMN | WVRQAPGK GLEWVS | YISSS--- SSTIYYADS VKG | RFTISRDNAKNSLYLQMNSL RAEDTAVYYCAR | LTGY-- ---FDY | WGQGT LVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 92692 | 21-225_18G10 | VH3J3-48jD7j7-27jRF1jJH4 | EVQLVES-GGGLVQPGGSLRL LCAASG-ITFS | T------YSMN | WVRQAPGK GLEWVS | YISRS----SSTIYYADS VKG | RFTISRDNAKNSLYLQMNSL RDEDTAVYYCAR | GGGS--------PFDY | WGQGT LVTVS S |
| iPS:3 92708 | 21-225_18D11 | VH3J3-48jD7j7-27jRF1jJH4 | EVQLVES-GGGLVQPGGSLRL SCAASG-FTFR | S------YSMN | WVRQAPGK GLEWLS | YISSS----SGTIYYADS VKG | RFTISRDNARNSLNLQMNSL RDEDTAVYYCAR | GGGS--------PFDY | WGQGT LVTVS S |
| iPS:3 93992 | 21-225_14H8 | VH3J3-48jD7j7-27jRF1jJH4 | EVQLVES-GGGLVQPGGSLRL SCAASG-FTFS | S------NSMN | WVRQAPGK GLEWVS | YISSS----SSTIYYADS VKG | RFTIARDNAKNSLYLQMNSL RDEDTAVYYCAR | GGGS--------PFDY | WGQGT LVTVS S |
| iPS:3 94055 | 21-225_9C8 | VH3J3-48jD7j7-27jRF1jJH4 | EVQLVES-GGGLVQPGGSLRL SCVVSG-FTFS | S------QSMN | WVRQAPGK GLEWVS | YISI-----SSTIYYADS VKG | RFTISRDNAKNSLYLQMNSL RDEDTAVYYCAR | GGGS--------PFDS | WGQGT LVTVS S |
| | Germline VH3J3-30.3jD4j4-11jRF2jJH4 | | H_FR1 | H_CDR1 | H_FR2 | H_CDR2 | H_FR3 | H_CDR3 | H_FR4 |
| iPS:3 92694 | 21-225_19A5 | VH3J3-30.3jD4j4-11jRF2jJH4 | QVQLVES-GGGLVQPGRSLRL SCAASG-FTFS | S------YAMH | WVRQAPGK GLEWVA | VIWFD----GSDKYYADS VKG | RFTISRDNSKNTLYLQMSSL RAEDTAVYYCAR | DRAYS-------SSSDY | WGQGT LVTVS S |
| | Germline VH3J3-23jD1j1-1jRF1jJH4 | | H_FR1 | H_CDR1 | H_FR2 | H_CDR2 | H_FR3 | H_CDR3 | H_FR4 |
| iPS:3 92714 | 21-225_16G12 | VH3J3-23jD1j1-1jRF1jJH4 | EVQLLES-GGGLVQPGGSLRL SCAASG-FSFS | S------YAMT | WVRQAPGK GLEWVS | TISGR----GGHTYYADS VRG | RFAISRDSSKNTLYLQMSSL RAEDTAVYYCAK | QD----------C | WGQGT LVTVS S |
| iPS:3 92890 | 21-225_20H9 | VH3J3-23jD1j1-1jRF1jJH4 | EVQLLES-GGGLVQPGGSLRL SCAASG-FTFS | S------YAMS | WVRQAPGK GLEWVS | AISGS----GGYTYYADS VKG | RFTISRDNSENTLYLQMSSL RAEDTAVYYCAK | GGS---------LFY | WGQGT LVTVS S |
| iPS:3 92892 | 21-225_20C11 | VH3J3-23jD1j1-1jRF1jJH4 | EVQLLES-GGGLVQPGGSLRL SCAASG-FSFS | S------YAMS | WVRQAPGK GLEWVS | TISGR----GGHTYYADS VKG | RFAISRDSSKNTLYLQMSSL RAEDTAVYYCAK | QD----------C | WGQGT LVTVS S |
| iPS:3 93968 | 21-225_5A5 | VH3J3-23jD1j1-1jRF1jJH4 | EVQLWES-GGGLVQPGGSLRL SCAASG-FTFS | S------YAMN | WVRQAPGK GLEWVS | AISGS----GGYTYYADS VKG | RFTISRDNSKNTLYLQMSSL RAEDTAVYYCAK | GGS---------LFY | WGQGT LVTVS S |
| | Germline VH3J3-23jD6j6-6jRF1jJH3 | | H_FR1 | H_CDR1 | H_FR2 | H_CDR2 | H_FR3 | H_CDR3 | H_FR4 |

Figure 51 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:3 92730 | 21-225_17A1 | VH3l3-23/D6j6-6|RF1/JH3 | EVQLLES-GGGLVQPGGSLRL SCAASG-FTFS | S-----YAMN | WVRQAPGK GLEWVS | VISGS---GSNTYYADS VKG | RFTISRDNSKNTLYLQMNSL RAEDTAVYYCAK | RYTSDW------HDAFDI | WGQGT MVTVS S |
| iPS:3 92736 | 21-225_17B12 | VH3l3-23/D6j6-6|RF1/JH3 | EVQLLES-GGGLVQPGGSLRL SCVASG-FTFS | S-----YAMN | WVRQAPGK GLEWVS | VISGS---GGSTYYADS VKG | RFTISRDNSKNTLYLQMNTL RAEDTAVYYCAK | RYTSDW------HDAFDI | WGQGT MVTVS S |
| iPS:3 92770 | 21-225_20C10 | VH3l3-23/D6j6-6|RF1/JH3 | EVQLLES-GGGLVQPGGSLRL SCAASG-FTFS | S-----YAMN | WVRQAPGK GLEWVS | VISGS---GGTYYADS VKG | RFTISRDNSKNTLYLQMNTL RAEDTAVYYCAK | RYTSDW------HDAFDI | WGQGT MVTVS S |
| iPS:3 93878 | 21-225_7G12 | VH3l3-23/D6j6-6|RF1/JH3 | EVQLLES-GGGLVQPGGSLRL SCAASG-FTFS | S-----YAMN | WVRQAPGK GLEWVS | VISGS---GGSTYYADS VKG | RFTISRDNSKNTLYLQMNTL RAEDTAVYYCAK | RYTSDW------HDAFDI | WGQGT MVTVS S |
| | Germline | | | | | | | | |
| | VH3l3-21/D7|7-27|RF3/JH5 | | | | | | | | |
| iPS:3 92748 | 21-225_20A8 | VH3l3-21/D7|7-27|RF3/JH5 | EVQLVES-GGGLVKPGGSLRL SCVASG-FTFS | S-----YSVN | WVRQAPGK GLEWVS | SISSS---SSFLYYADS VKG | RFTISRDNAKNSVYLQMNSL RAEDTAVYYCAR | NW--------DY | WGQGT LVTVS S |
| | Germline | | | | | | | | |
| | VH3l3-30.3D1|1-1|RF1/JH5 | | | | | | | | |
| iPS:3 92754 | 21-225_21D3 | VH3l3-30.3D1|1-1|RF1/JH | QVQLVES-GGGVVQPGRSLRL SCVASG-FTFS | S-----YGMH | WVRQAPGK GLEWVT | VISYD---GSNKYYADS VKG | RFTISRDNSKNTLYLQMNSL RAEDTAVYYCAR | GVWF--------GDL | WGQGT LVTVS S |
| iPS:3 92818 | 21-225_22D8 | VH3l3-30.3D1|1-1|RF1/JH5 | QVQLVES-GGGVVQPGRSLRL SCVASG-FTFR | S-----YGMH | WVRQAPGK GLEWVT | IISYD---GSNKYYADS VKG | RFTISRDNSKNTLYLQMNSL RAEDTAVYFCAR | GVWF--------GCF | WGQGT LVTVS S |
| | Germline | | | | | | | | |
| | VH3l3-23/D6j6-19|RF2/JH1 | | | | | | | | |
| iPS:3 92762 | 21-225_22G5 | VH3l3-23/D6j6-19|RF2/JH1 | EVQLLES-GGGLVQPGGSLRL SCAASG-FTFS | S-----YAMN | WVRQAPGM GLEWVS | VISRS---GGTYYADS VKG | RFTISRDNSKNTLYLQMNSL RAEDTAVYYCAS | RLAVAG------SEAFDI | WGQGT LVTVS S |
| iPS:3 94051 | 21-225_9E5 | VH3l3-23/D6j6-19|RF2/JH1 | EVQLLES-GGGLVQPGGSLRL SCAASG-FTFS | N-----YAMN | WVRQAPGM GLEWVS | AISGG---GGNTFYADS VKG | RFTISRDNSKNTLYLQMNGL RAEDTAVYYCAS | RIAVAG------SEAFAI | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-39/D1[1-26]RF3/JH1 | | QLQLQES-GPGLVKPSETLSL TCTVSG-GSIS | RS----SYYWG | WIRQPPGK GLEWIG | SIYY----SSSTYYNPS LKS | RVTISVDTSKNQFSLKLSSV TAADTAVYYCAS | LSSSW------AYTFDH | WGQGT LVTVS S |
| iPS:3 92774 | VH4/4-39/D1[1-26]RF3/JH1 | QLQLQES-GPGLVKPSETLSL TCTVSG-GSIS | RS----SYYWG | WIRQPPGK VLEWIG | SIYY----SGSTYYNPS LKS | RVTISVDTSKNQFSLKLSSV TAADTAEYYCAS | LSSSW------DFQH | WGQGT LVTVS S |
| 21-225_21F3 | | | | | | | | |
| iPS:3 93862 | VH4/4-39/D1[1-26]RF3/J H1 | QLQLQES-GPGLVKPSETLSL TCTVSG-GSIS | RS----SYYWG | WIRQPPGK GLEWIG | MIYY----SGSTYYIPS LKS | RVTISVDISKNQFSLKLSSV TAADTAVYYCAR | HSTSW------SLDH | WGQGT LVTVS S |
| 21-225_7H7 | | | | | | | | |
| iPS:3 94049 | VH4/4-39/D1[1-26]RF3/J H1 | QLQLQES-GPGLVKPSETLSL TCTVSG-GSIS | RS----SYYWG | WIRQPPGK GLEWIG | SIYY----SGSTYYNPS LKS | RVTISVDTSKNQFSLKLSSV TAADTAVYYCAS | LSSSW------DFQH | WGQGT LVTVS S |
| 21-225_13H5 | | | | | | | | |
| | Germline | EVQLVES-GGGLVKPGGSLRL SCAASG-FTFS | S------YSMN | WVRQAPGK GLEWVS | SISSS----SSTYYADS VKG | RFTISRDNAKNSLYLQMNSL RAEDTAVYYCAR | AVTTTD------ASTFDI | WGQGT LVTVS S |
| VH3/3-21/D2[2-21]RF2/JH4 | | | | | | | | |
| iPS:3 92776 | VH3/3-21/D2[2-21]RF2/J H4 | EVQLVES-GGGLVKPGGSLRL SCAASG-FTFN | S------YSMN | WVRQAPGK GLEWVS | SISGS----SSYIYYADS VKG | RFTISRDNAKNSLYLQMNSL RAEDTAVYYCAR | AAG------FDY | WGQGT LVTVS S |
| 21-225_21A12 | | | | | | | | |
| | Germline | QVQLVES-GGGLVQPGRSLRL SCAASG-FTFS | S------YGMH | WVRQAPGK GLEWVS | VIWYD----GSNKKYADS VKG | RFTISRDNSKNTLYLQMNSL RAEDTAVYYCAR | GRAYSGI------YYGHDV | WGQGT LVTVS S |
| VH3/3-33/D6[6-19]RF2/JH6 | | | | | | | | |
| iPS:3 92806 | VH3/3-33/D6[6-19]RF2/J H6 | QVQLVES-GGGLVQPGRSLRL SCGASG-FTFS | S------YGMH | WVRQAPGK GLEWVA | VIWYD----GSNKYYADS VKG | RFTISRDNSKNTLYLQMNSL RAEDTAVYYCAR | VAVAG------GMDV | WGQGT TVTVS S |
| 21-225_24H3 | | | | | | | | |
| | Germline | EVQLVES-GGGLVQPGGSLRL SCAASG-FTFS | S------YSMN | WVRQAPGK GLEWVS | YISSS----SSTIYYADS VKG | RFTISRDNAKNSLYLQMNSL RDEDTAVYYCAR | SLY------FDY | WGQGT LVTVS S |
| VH3/3-48/D7[7-27]RF2/JH4 | | | | | | | | |
| iPS:3 92825 | VH3/3-48/D7[7-27]RF2/J H4 | EVQLVES-GGGLVQPGGSLRL SCAASG-FTFS | S------YSMN | WVRQAPGK GLEWVS | YISSS----SSTIYYADS VKG | RFTISRDNAKNSLYLQMNSL RDEDTAVYYCAR | SLWS------PFDY | WGQGT LVTVS S |
| 21-225_20B9 | | | | | | | | |
| | Germline | QVQLQES-GPGLVKPSETLSL TCTVSG-GSIS | S------YYWS | WIRQPAGK GLEWIG | YIYY----SGSTNNPS LKS | RVTISVDTSKNQFSLKLSSV TAADTAVYYCAR | GTTYI------SWFDP | WGQGT LVTVS S |
| VH4/4-59/D1[1-1]RF1/JH5 | | | | | | | | |
| iPS:3 92830 | VH4/4-59/D1[1-1]RF1/JH 5 | QVQLQES-GPGLVKPSETLSL TCTVSG-GSIS | S------YFWS | WIRQPAGK GLEWIG | RIYT----SGIINNPS LKS | RVTMSVDISKNQFSLKLSSV TAADTAIYYCAR | GPTSG------WFDP | WGQGT LVTVS S |
| 21-225_21A5 | | | | | | | | |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3]3-23]D6[6-6]RF2]JH4 | | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAK | SSLR | WGQGT LVTVS S |
| iPS.3 92840 | 21-225_23G1 VH3]3-23]D6[6-6]RF2]JH4 | EVQLLES-GGGLVQPGGSLRL SCAASG-FTFS | S-----YAMS | WVRQAPGK GLEWVS | VISGS---GGTTYNTDS VKG | RFTISRDNSKNTLYLQMNSL RAEDTAVYYCAR | SSL------FDY | WGQGT LVTVS S |
| iPS.3 94018 | 21-225_15B1 VH3]3-23]D6[6-6]RF2]JH4 | EVQLLES-GGGLVQPGGSLRL SCATSG-FTFS | S-----YVMS | WVRQAPGK GLEWVS | GISGS---GGSTNNADS VKG | RFTISRDNSKNTLYLQVNSL RAEDTAVYYCAR | SSL------FDY | WGQGT LVTVS S |
| iPS.3 94026 | 21-225_16C7 VH3]3-23]D6[6-6]RF2]JH4 | EVQLLES-GGGLVQPGGSLRL SCAASG-FTFS | S-----YVMT | WVRQAPGK GLEWVS | TISGS---GGMTYYADS VKG | RFTISRDNSKNTLYLQMNSL RAEDTAEYYCAR | SSL------FDY | WGQGT LVTVS S |
| VH3]3-23]D6[6-6]RF2]JH5 | | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAK | STAWFDP | WGQGT LVTVS S |
| iPS.3 92842 | 21-225_23G8 VH3]3-23]D6[6-6]RF2]JH5 | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAV | SSG------WFA | WGQGT LVTVS S |
| VH3]3-23]D1[1-1]RF2]JH2 | | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAK | VDIRYWYFDL | WGRGT LVTVS S |
| iPS.3 92856 | 21-225_22A2 VH3]3-23]D1[1-1]RF2]JH2 | EVQLLES-GGGLVQPGGSLRL SCAASG-FTFS | S-----YAMS | WVRQAPGK GLEWVS | GISGS---GGNTPYADS VKG | RFTISRDISKNLLYLQMSSL RAEDTAVYYCAK | VVG------AVH | WGRGT LVTVS S |
| VH4]4-30.1]D5[5-18]RF1]JH6 | | QVQLQAS-GPGLVRPSQTLSL TCTVSD-GSIS | SG----GYYWS | WIRQHPGK GLEWIG | YIYY---SGSTYYNPS LKS | RVTISVDTSKNQFSLKLSSV TAADTAVYYCAR | DTAMYYYYGMDV | WGQGT TVTVS S |
| iPS.3 92864 | 21-225_23B9 VH4]4-30.1]D5[5-18]RF1]JH6 | QVQLQAS-GPGLVRPSQTLSL TCTVSD-GSIS | SG----GYYWS | WIRQHPGK GLEWIG | YIYY---SGSTYYNPS LKS | RVTISVDTSKNQFSLKLSSV TAADTAVYYCAR | EDGAFG---YYGMDV | WGQGT TVTVS S |
| VH3]3-23]D2[2-2]RF2]JH3 | | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAK | GYYYSTSYDAFDI | WGQGT MVTVS S |
| iPS.3 92874 | 21-225_21D2 VH3]3-23]D2[2-2]RF2]JH3 | EVKLLES-GGGLVQPGGSLRL SCAASG-FTFN | N-----YAMS | WVRQAPGK GLEWVS | VLSGS---GGSTFYADS VKG | RFTISRDNSKNTLYLQMSSL RAEDTAVYFCAR | YCSSARC---PYDAFDI | WGQGT MVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS:3 93940 | 21-225_16B2 | VH3|3-23|D2|2-2|RF2|JH3 | EVQLLES-GGGLVQPGGSLRL SCAASG-FTFS | S-----YAMT | WVRQAPGK GPEWVS | VISGS---GGSTYADS VKG | RFTISRDNSKNTLYLQMSSL RAEDTAVYFCAR | YCSSTRC------PYDAFDI | WGQGT MVTVS S |
| iPS:3 93956 | 21-225_4D7 | VH3|3-23|D2|2-2|RF2|JH3 | EVKLLES-GGGLVQPGGSLRL SCAASG-FTFS | S-----YAMS | WVRQAPGK GLEWVS | VLSGS---GGSTYADS VKG | RFTISRDNSKNTLYLQMSSL RAGDTAVYFCAR | YCSSARC------PYDAFDI | WGQGT MVTVS S |
| iPS:3 98476 | 21-225_17C1 | VH3|3-23|D2|2-2|RF2|JH3 | EVQLLES-GGGLEQPGGSLRL SCAASG-FTFS | S-----YAMS | WVRQAPGK GLEWVS | VISGS---GGTTFYADS VKG | RFTISRDNSKNTLYLQMSSL RAEDTAVYFCAR | YCSSTRC------PYDAFDI | WGQGT MVTVS S |
| | Germline VH3|3-15|D1|1-1|RF3|JH4 | | EVQLLES-GGGLVKPGGSLRL SCAASG-FTFS | -----AWMN | WVRQAPGK GLEWVS | RIKSKT-DGGTTDYAA KTEDTAVYYCTT | RFTISRDNAKNTLYLQMNSL | YVT------YFDY | WGQGT LVTVS S |
| iPS:3 92898 | 21-225_21H10 | VH3|3-15|D1|1-1|RF3|JH4 | EVQLVES-GGGLVKPGGSLRL SCAASG-FTFS | N-----AWMN | WVRQAPGK GLEWVG | RIKSKT-DGGTTDYAA KTEDTAVYYCTT | RFTISRDDSKNTLYLQMNSL | EGWN------TDY | WGQGT LVTVS S |
| iPS:3 93802 | 21-225_3D12 | VH3|3-15|D1|1-1|RF3|JH4 | EVQLVES-GGGLVKPGGSLRL SCAASG-VTFS | T-----AWMN | WVRQAPGK GLEWVG | RIKNKI-DGGTTDYVA PVKG | RFTISRDDSKNTLYLQMNSL KTEDTAVYYCTT | EGWN------TDY | WGQGT LVTVS S |
| | Germline VH3|3-48|D4|4-11|RF3|JH4 | | EVQLVES-GGGLVQPGGSLRL SCAASG-FTFS | S-----YSMN | WVRQAPGK GLEWVS | YISSS-SSTIYADS VKG | RFTISRDNAKNSLYLQMNSL AKEDTAVYYCAR | TVT------YFDY | WGQGT LVTVS S |
| iPS:3 92950 | 21-225_25C10 | VH3|3-48|D4|4-11|RF3|JH4 | EVQLVES-GGGLVQPGGSLRL SCAASG-FTFS | S-----YRMN | WVRQAPGK GLEWVS | SISSS---SSTIYADS VKG | RFTISRDNAKNSLYLQMNSL RDEDTAVYYCAR | TAG------FDY | WGQGT LVTVS S |
| | Germline VH3|3-23|D1|1-26|RF3|JH4 | | EVQLLES-GGGLVQPGGSLRL SCAASG-FTFS | S-----YAMS | WVRQAPGK GLEWVS | AISGS---GGSTYYADS VKG | RFTISRDNAKNTLYLQMNSL RAEDTAVYYCAK | YGSY------YFDY | WGQGT LVTVS S |
| iPS:3 93010 | 21-225_25E11 | VH3|3-23|D1|1-26|RF3|JH4 | EVQLVES-GGGLVQPGGSLRL SCAASG-FTFS | S-----YAMS | WVRQAPGK GLEWVS | VISGG---GGSTYYADS VKG | RFTISRDNSKNTLYLQMNSL RAEDTAVYYCAK | RGYSGYP------DLLYFDC | WGQGT LVTVS S |
| | Germline VH3|3-23|D3|3-3|RF3|JH3 | | EVQLLES-GGGLVQPGGSLRL SCAASG-FTFS | S-----YAMS | WVRQAPGK GLEWVS | AISGS---GGSTYYADS VKG | RFTISRDNSKNTLYLQMNSL RAEDTAVYYCAK | ITFGYY------IIDAFDI | WGQGT MVTVS S |
| iPS:3 93016 | 21-225_28F11 | VH3|3-23|D3|3-3|RF3|JH3 | EVQLVES-GGGLVQPGGSLRL SCAASG-FIFS | S-----YAMS | WVRQAPGK GLEWVS | VISGS---GGTTFYADS VKG | RFTISRDNSKNTLYLQMNSL RAEDTAVYYCAK | RTQFD------DFDI | WGQGT MVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3J3-33D3J3-22RF2JH6 | | QVQLVES- GGGVVQPGRSLRL SCAASG-FTFS | S---YGMH | WVRQAPGK GLEWVA | VIWYD- GSNKYYADS VKG | RFTISRDNSKNTLYLQMNSL RAEDTAVYYCAR | YYYSGYYY YYYGMDV | WGQGT TVTVS S |
| iPS:3 93032 | 21-225_26F8 | VH3J3-33/D3J3-22|RF2/J H6 | QVQLVES- GGGVVQPGRSLRL SCAASG-FTFS | G-----YGMH | WVRQAPGK GLEWVA | IIWYD- GSNKYYADS VKG | RFTISRDNSKNTLYLQMNSL RAEDTAVYYCAR | ERYDFW------SGCMDV | WGQGT TVTVS S |
| | Germline | | | | | | | |
| VH1J1-02D4J4-11RF2JH6 | | | | | | | | |
| iPS:3 93042 | 21-225_31F1 | VH1J1-02/D4J4-11|RF2/J H6 | QVQLVQS- GAEVKKPGASVKV SCKASG- YIFT | D------YYMH | WVRQAPGQ GLEWMG | WINPN--- SGGTNYAQK FQG | RVTMTRDTSIMTAYMELSRL RSDDTAVYYCAR | DSSNFSNW-------YDYYGMDV | WGQGT TVTVS S |
| iPS:3 93108 | 21-225_34G11 | VH1J1-02/D4J4-11|RF2/J H6 | QVQLVQS- GAEVKKPGASVKV SCKASG- YIFT | G------YYMH | WVRQAPGQ GLEWMG | WINPN--- SGGTNYAQK FQG | RVTMTRDTSISTAYMELSRL RSDDTAVYYCAR | DISNFSW-------YDYYAMDV | WGQGT TVTVS S |
| | Germline | | | | | | | |
| VH1J1-18D5J5-12RF3JH4 | | | | | | | | |
| iPS:3 93044 | 21-225_25B8 | VH1J1-18/D5J5-12|RF3/J H4 | QVQLVQS- GAEVKKPGASVKV SCKASG- YIFT | S------YGIS | WVRQAPGQ GLEWMG | WISAY--- NGNTTYAQK LRG | RVTMTDTSTAYMDLRSL RSDDTAVYYCAR | TAAGYS-------SSWFDY | WGQGT LVTVS S |
| iPS:3 93050 | 21-225_28C5 | VH1J1-18/D5J5-12|RF3/J H4 | QVQLVQS- GAEVKKPGASVKV SCKASD- YIFT | S------YGIS | WVRQAPGQ GLEWMG | WISAY--- NGNTTYAQK LRG | RVTMTDTSTAYMDLRSL RSDDTAVYYCAR | TAAGYS-------SSWFDY | WGQGT MVTVS S |
| | Germline | | | | | | | |
| VH3J3-33D3J6-6RF1JH3 | | | | | | | | |
| iPS:3 93046 | 21-225_25A12 | VH3J3-33/D3J6-6|RF1/JH 3 | QVQLVES- GGGVVQPGRSLRL SCAASG-FTFS | N-----CVMH | WVRQAPGK GLEWVA | VIWYD- GSNKYYADS VKG | RFTISRDNSKNTLYLQMNSL RAEDTAVYYCAR | EEYSSGW-------YDYGMDV | WGQGT MVTVS S |
| | Germline | | | | | | | |
| VH3J3-21D3J4-11RF3JH6 | | | | | | | | |
| iPS:3 93078 | 21-225_33H11 | VH3J3-21/D4J4-11|RF3/J H6 | EVQLVES- GGGLVKPGGSLRL SCAASG-FTFS | S------YSMN | WVRQAPGK GLEWVS | SISGS--- SSYIYYADS VKG | RFTISRDNARNSLYLQMSSL RAEDTAVYYCAR | TNG-------MDV | WGQGT TVTVS S |

Figure 51 (Continued)

| | | H_FR1 | H_CDR1 | H_FR2 | H_CDR2 | H_FR3 | H_CDR3 | H_FR4 |
|---|---|---|---|---|---|---|---|---|
| iPS.3 93142 | 21-225_33A3 | VH3／3-21／D4／4-11／RF3／JH6 | EVQLVES-GGGLVKPGGSLRL SCAASG-FTFS | S-----YGMN | WVRQAPGK GLEWVS | SISGS----STYIYYADS VKG | RFTISRDNAKKSLYLQMNSL RAEDTAVYYCAR | TNG---------MDV | WGQGT TVTVS S |
| | | Germline | EVQLVES-GGGLVQPGGSLRL SCAASG-FTFS | S-----YAMS | WVRQAPGK GLEWVS | AISGS----GGSTYYADS VKG | RFTISRDNSKNTLYLQMNSL RAEDTAVYYCAR | ------------YYYGMDV | WGQGT TVTVS S |
| iPS.3 93096 | 21-225_34D11 | VH3／3-23／D6／6-19／RF2／JH6 | EVQLSES-GGGLVQPGGSLRL SCAASG-FTFS | S-----YAMN | WVRQAPGK GLEWVS | AISGR----GGSTFHADS VKG | RFTISRDNSKNTLYLQMNSL RAEDTAVYYCVK | GELVEDY-----YFYGMDV | WGQGT TVTVS S |
| | | Germline | EVQLVES-GGGVQPGRSLRL SCAASG-FTFS | S-----YAMN | WVRQAPGK GLEWVA | VISYD----GSNKYYADS VKG | RFTISRDNSKNTLYLQMNSL RAEDTAVYYCAR | ------------DAFDI | WGQGT MVTVS S |
| iPS.3 93172 | 21-225_3B12 | VH3／3-30.3／D4／4-23／RF2／JH3 | QVHLVES-GGGVVQPGRSLRL SCAASG-FTFS | Y-----YGMH | WVRQAPGK GLEWVS | VISYD----GSNKYYADS VKG | RFTISRDNSKNTLHLQMNSL RAEDTAVYYCAR | DRRGGYG-----VPDAFDI | WGQGT MVTVS S |
| | | Germline | EVQLVES-GGGVVQPGRSLRL SCAASG-FTFS | S-----YAMH | WVRQAPGK GLEWVA | VISYD----GSNKYYADS VKG | RFTISRDNSKNTLYLQMNSL RAEDTAVYYCAR | ------------YYGMDV | WGQGT TVTVS S |
| iPS.3 93174 | 21-225_15D8 | VH3／3-30.3／D4／4-23／RF2／JH6 | QVQLVES-GGGLVQPGGSLRL SCAASG-FTFS | G-----YGMH | WVRQAPGK GLEWVS | VISYD----GSNKYYADS VKG | RFTISRDNSKNTLYLQMNSL RAEDTAVYYCAR | DRVYCSSTSCV---PYYDYGMDV | WGQGT TVTVS S |
| | | Germline | EVQLVES-GGGLVKPGGSLRL SCAASG-FTFS | N-----AMMS | WVRQAPGK GLEWVG | RIKSKT----DGGTTDYAA PVKG | RFTISRDDSKNTLYLQMNSL KTEDTAVYYCTT | ------------YYGMDV | WGQGT TVTVS S |
| iPS.3 93194 | 21-225_16D2 | VH3／3-15／D7／7-27／RF1／JH6 | EVQLVES-GGGLVKPGGSLRL SCAASG-FTFS | N-----AMMN | WVRQAPGK GLEWVG | RIKSKT----DGGTTDYAA PVKG | RFTISRDDSKNTLYLQMNSL KTEDTAVYYCTT | DTGPIAARLA---YYYYAMDV | WGQGT TVTVS S |
| iPS.3 98488 | 21-225_19F6 | VH3／3-15／D7／7-27／RF1／JH6 | EVQLVES-GGGLVKPGGSLRL SCAASG-FTFS | N-----AMMN | WVRQAPGK GLEWVG | RIKSKT----DGGTTDYAA PVKG | RFTISRDDSKNTLYLQMNSL KTEDTAVYYCTT | DTGPIAARLA---YYYYAMDV | WGHGT TVTVS S |
| iPS.3 98544 | 21-225_7C8 | VH3／3-15／D7／7-27／RF1／JH6 | EVQLVES-GGGLVKPGGSLRL SCAASG-FTFS | N-----ARMN | WVRLAPGK GLEWVG | RIKSKT----DGGTTDYAA PVKG | RFTISRDESENTLYLQMNSL KTEDTGVYYCST | DTGPIAARLA---YYYYAMDV | WGQGT TVTVS S |
| iPS.4 02231 | 21-225_6D9 | VH3／3-15／D7／7-27／RF1／JH6 | EVQLVES-GGGLVKPGGSLRL SCAASG-FTFS | N-----AMMN | WVRLAPGK GLEWVG | RIKSKT----DGGTTDYAA PVKG | RFTISRDDSENTLYLQMNSL KTEDTAVYYCSI | DTGPIAARLA---YYYYAMDV | WGQGT TVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-23/D4/4-11/RF2/JH4 | | EVQLLES | YAMS | WVRQAPGK GLEWVS | AISGS GGITYYADS VKG | RFTISRDNSKRTLYLQMNSL RAEDTAVYYCAR | DYSNY | WGQGT TLVT... |
| iPS:3 93870 | VH3/3-23/D4/4-11/RF2/JH4 | EVQLLES-GGGLVQPGGSLRL SCAASG-FTFS | S------YDMS | WVRQAPGK GLEWVS | TISGS---GGITYYADS VKG | RFTISRDNSKTLYLQMNSL RAEDTAVYYCAR | DRG-------SV | WGQGT LVTVS S |
| | | H_FR1 | H_CDR1 | H_FR2 | H_CDR2 | H_FR3 | H_CDR3 | H_FR4 |
| VH4/4-39/D4/4-17/RF2/JH1 | | QIQLQES GGGLVKPSETLSL TCTVSG-GSIS | SYYWG | WIRQPPGK GLEWIG | SIYY SGSTYNPS LKS | RVTISVDTSKNQFSLKLSSV TAADTAVYYCAR | ENSYH------EYFDH | WGQGT LVTVS S |
| iPS:3 93872 | VH4/4-39/D4/4-17/RF2/JH1 | QIQLQES-GPGLVKPSETLSL TCTVSG-GSIS | RS----SYYWG | WIRQPPGK GLEWIG | NIYY---SGSTYYNPS VKS | RVTISVDTSKNQFSLKLSTV TAADTAVYYCAR | HGKDW------GLED | WGQGT LVTVS S |
| | | H_FR1 | H_CDR1 | H_FR2 | H_CDR2 | H_FR3 | H_CDR3 | H_FR4 |
| VH4/4-59/D6/6-6/RF1/JH4 | Germline | QVQLQES GGGLVKPSETLSL TCTVSG-GSIS | YSWS | WIRQPPGK GLEWIG | YIYY SGSTYNPS LKS | RVTISVDTSKQFSLKLSSV TAADTAVYYCAR | EYSSS------SIFH | WGQGT LVTVS S |
| iPS:3 93890 | VH4/4-59/D6/6-6/RF1/JH4 | QVQLQES-GPGLVKPSETLSL TCSVSG-DSIS | S------YSWS | WIRQPAGK GLEWIG | RIYT---SGSTNYIPS LKS | RITMSVDTSKKQFSLKLSSV TAADTAVYYCAR | DLKSSG-----CLFFDY | WGQGT TVTVS S |
| | | H_FR1 | H_CDR1 | H_FR2 | H_CDR2 | H_FR3 | H_CDR3 | H_FR4 |
| VH3/3-33/D4/4-17/RF1/JH6 | Germline | EVQLVES GGGLVQPGRSLRL SCAASG-FTFS | YGMH | WVRQAPGK GLEWVA | VIYD--- SGSNTY ADS VKG | RFTISRDNSKNTLYLQMNSL RAEDTAVYYCAR | DLRMG------WYFDL | WGQGT TVTVS S |
| iPS:3 93926 | VH3/3-33/D4/4-17/RF1/JH6 | QVQLVES-GGGVVQPGRSLRL SCAASG-FTFS | S------YGMH | WVRQAPGK GLEWGA | VIWHD--GSNKYYADS VKG | RFTISRDNAKNTLYLQMNSL RAEDTAVYYCAR | DLRMG------GMDV | WGQGT TVTVS S |
| | | H_FR1 | H_CDR1 | H_FR2 | H_CDR2 | H_FR3 | H_CDR3 | H_FR4 |
| VH3/3-23/D6/6-6/RF2/JH2 | Germline | EVQLLES GGGLVQPGGSLRL SCAASG-FTFS | YAMS | WVRQAPGK GLEWVS | AISGS GGITYYADS VKG | RFTISRDNSKTLYLQMNSL RAEDTAVYYCAR | STAAT------WYFDL | WGQGT LVTVS S |
| iPS:3 93936 | VH3/3-23/D6/6-6/RF2/JH2 | EVQLLES-GGGLVQPGGSLRL SCAASG-FTFS | S------YAMN | WVRQAPGK GLEWVS | VISGR--GGSTYYADS VKG | RFTISRDNTLYLQMNSL RAEDTAVYYCAR | RIAAGM-----EYFDL | WGRGT LVTVS S |
| | | H_FR1 | H_CDR1 | H_FR2 | H_CDR2 | H_FR3 | H_CDR3 | H_FR4 |
| VH3/3-21/D1/1-1/RF3/JH4 | Germline | EVQLVES GGGLVKPGGSLRL SCAASG-FTFS | YSMN | WVRQAPGK GLEWVS | SISSS SSYIYADS VKG | RFTISRDNAKNSLYLQMNSL RAEDTAVYYCAR | YSMH------FDY | WGQGT LVTVS S |
| iPS:3 93988 | VH3/3-21/D1/1-1/RF3/JH4 | EVQLVES-GGGLVKPGGSLRL SCAASG-FTFS | S------YSMN | WVRQAPGK GLEWVS | SISSS--SSYIYADS VKG | RFTISRDNAKNSLYLQMNSL RIEDTAVYYCAR | ANL-------FDX | WGQGT LVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4-4-39/D6/6-6/RF1/JH4 | | | | | | | | |
| iPS:3 93990 21-225_11G7 | VH4/4-39/D6/6-6/RF1/JH4 | QLQLQES-GPGLVKPSETLSL TCTVSG-GFIS | RS---TYYWG | WIRQPPGK GLEWIG | SIYY---SGSTSYSPS LKS | RVTISVDTSKNQFSLKLSSV TAADTAVYYCAR | LNSSW-------SFDY | WGQGT LVTVS S |
| | Germline | | | | | H_FR3 | H_CDR3 | H_FR4 |
| VH3/3-30.3/D2/2-15/RF3/JH6 | | | | | | | | |
| iPS:3 94010 21-225_12G5 | VH3/3-30.3/D2/2-15/RF3/JH6 | QVQLVES-GGGVVQPGRSLRL SCAASG-FTFS | N------YGIY | WVRQAPGK GLEWVA | VISYD---GSNRYYADS VKG | RFTISRDNSKNTLYLQMNSL RAEDTAVYYCAR | DRGAVAAY-------YYYGIDV | WGQGT TVTVS S |
| | Germline | | | | H_CDR2 | H_FR3 | H_CDR3 | H_FR4 |
| VH1/1-08/D2/2-21/RF1/JH4 | | | | | | | | |
| iPS:3 94065 21-225_11E2 | VH1/1-08/D2/2-21/RF1/JH4 | QVQVVQS-GAEVKKPGASVKV SCKASG-YIFT | N------YDIN | WVRQATGQ GLEWMG | WMNTN---SGNTGYAQK FQG | RVTMTRNTSISTAYMDLSSL RSEDTAVYYCAY | SHGWF-------LFDY | WGQGT LVTVS S |
| iPS:3 98506 21-225_23G12 | VH1/1-08/D2/2-21/RF1/JH4 | QVQLLQS-GAEVKKPGASVKV SCKASG-YIFT | N------YDIN | WVRQATGQ GLEWMG | WMYFN---SGNTGYAQK FQG | RVTMTNTSISTAYMELSSL RSEDTAVYYCAI | SGGWY-------YFDY | WGQGT LVTVS S |
| iPS:3 98512 21-225_25E12 | VH1/1-08/D2/2-21/RF1/JH4 | QVQLVQS-GAEVKKPGASVKV SCKASG-YIFT | N------YDIN | WVRQATGQ GLEWMG | WMNPN---SGNTGYAQK FQG | RVTMTRNTSISTAYLELSSL RSEDTAVYYCAG | SNGWY-------YFDY | WGQGT LVTVS S |
| | Germline | H_FR1 | H_CDR1 | H_FR2 | H_CDR2 | H_FR3 | H_CDR3 | H_FR4 |
| VH3/3-33/D7/7-27/RF2/JH3 | | | | | | | | |
| iPS:3 94091 21-225_13H3 | VH3/3-33/D7/7-27/RF2/JH3 | QVQLVES-GGGLVQPGGSLRL SCAASG-FTFS | S------YGMH | WVRQAPGK GLEWVA | VIWYE---ESNKYYVDS VRG | RFTISRDNSKSTLYLQMNSL RAEDTAVYYCVR | ELGF-------QSDF | WGQGT PVTVS S |
| | Germline | | | | | H_FR3 | H_CDR3 | H_FR4 |
| VH3/3-23/D4/4-23/RF2/JH6 | | | | | | | | |
| iPS:3 98472 21-225_16E4 | VH3/3-23/D4/4-23/RF2/JH6 | EVQLLES-GGGLIQPGGSLRL SCAASG-FTFS | S------YVMS | WVRQAPGK GLEWVS | TISVG---GGITYYADS VKG | RFTISRDNSKNTLYLQMNSL RAEDTAVYYCAK | WGRGNSYE-------YYYGMDV | WGQGT TVTVS S |

Figure 51 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | VH2|2-05|D6|6-19|RF2|J H4 | Germline | QITLKES GPTLVKPTQTLTL TCTFSG-FSLS | TS---GVGVG | WIRQPPGK ALEWLA | LIYW---NDDKRYSPS LKS | RLTITKDTSKNQVVLTMTNM DPVDTATYYCAR | GTAVR------GFDY | WGQGT LVTVS S |
| iPS:3 98498 | 21-225_22E6 | VH2|2-05|D6|6-19|RF2|J H4 | QITLKES-GPTLVKPTQTLTL TCTFSG-FSLS | TG---GVGVG | WIRQPPGK ALEWLA | LIYW---NDDKRYSPS LKS | RLTITKDTSKNQVVLTMTNM DPVDTATYYCAR | TIAVR------GFDY | WGQGT LVTVS S |
| | VH1|1-08|D5|5-24|RF2|J H4 | Germline | QVQLVQS-GAEVKKPGASVKV SCKASG-YIFT | S------YDIS | WVRQAPGQ GLEWMG | WMNPN---SGNTGYAQK FQG | RVTMTRNTSISTAYMELSSL RSEDTAVYYCAR | KRA------STFDY | WGQGT LVTVS S |
| iPS:3 98536 | 21-225_33D12 | VH1|1-08|D5|5-24|RF2|J H4 | QVQLVQS-GAEVKKPGASVKV SCKASG-YIFT | S------YDIS | WVRLATGQ GLEWMG | WMNPN---SGNTGYAQK FQG | RVTMTRNTSISTAYMELSSL RSEDTAVYYCAR | KRA------NDY | WGQGT LVTVS S |
| | VH2|2-05|D6|6-6|RF1|JH4 | Germline | QITLKES-GPTLVKPTQTLTL TCTFSG-FSLS | TS---GVGVG | WIRQPPGK ALEWLA | LIYW---SDDKRYSPS LKS | RLTITKDTSKNQVVLTMTNM APVDTATYYCAR | EVRS------STFDY | WGQGT LVTVS S |
| iPS:3 98546 | 21-225_9H10 | VH2|2-05|D6|6-6|RF1|JH4 | QITLKES-GPTLVKPTQTLTL TCTFSG-FSLS | TS---GVGVG | WIRQPPGK ALEWLA | LIYW---SDDKRYSPS LKS | RLTITKDTSKNQVVLTMTNM APVDTATYYCAR | TGSSC------CYFDY | WGQGT TVTVS S |
| | VH3|3-21|D1|1-1|RF1|JH6 | Germline | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | VDLPYY------MDV | WGQGT LVTVS S |
| iPS:4 02229 | 21-225_16H9 | VH3|3-21|D1|1-1|RF2|JH6 | EVQLVES-GGGLVKPGGSLRL SCAASG-FTFS | S------YSMN | WVRQAPGK GLEWVS | SISGS---SSYIYADS VKG | RFTISRDNAKNSLYLQMNSL RAEDTAVYYCAR | VNG------MDV | WGQGT TVTVS S |
| | VH3|3-21|D4|4-11|RF3|JH5 | Germline | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | TTYDY------WFDP | WGQGT LVTVS S |
| iPS:4 02233 | 21-225_16D10 | VH3|3-21|D4|4-11|RF3|JH5 | EVQLVES-GGGLVKPGGSLRL SCAASG-FTFS | T------YNLN | WVRQAPGK GLEWVS | SISGG---AGHIYYADS VKG | RFTISRDNAKNSLYLQMNSL RAEDTAVYYCAR | TNG------FDF | WGQGT LVTVS S |
| | VH3|3-21|D1|1-1|RF1|JH3 | Germline | EVQLVES-GGGLVKPGGSLRL SCAASG-FTFS | S------YSMN | WVRQAPGK GLEWVS | SISSS---SSYIYADS VKG | RFTISRDNAKNSLYLQMNSL RAEDTAVYYCAR | GTTCT------DAFDI | WGQGT MVTVS S |
| iPS:4 02235 | 21-225_20F10 | VH3|3-21|D1|1-1|RF1|JH3 | EVQLVES-GGGLVKPGGSLRL SCAASG-FTFS | S------YSMN | WVRQAPGK GLEWVS | SIST---STFIYYADS VKG | RFTISRDNAKNSLYLQMNSL RAEDTAVYYCAR | KAG------LDI | WGQGT MVTVS S |

Figure 51 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH3J3-23D5J5-12RF1JH3 | EVQLLES GGGLVQPGGSLRL SCAASG-FTFS | S------YAMS | WVRQAPGK GLEWVS | AISGS---- GGSTYYADS VKG | RFTISRDNSKNTLYLQMNSL RAEDTAVYYCAK | YDFWSGY YYYGMDV | WGQGT MVTVS S |
| iPS:4 03870 | 21-225_23G4 | EVQLLES- GGGLVQPGGSLRL SCAASG-FTFS | S------YAMS | WVRQAPGK GLEWVS | VISGR---- GGSTYYADS VKG | REFTISRDNSKNTLYLQMNSL RAEDTAVYYCAK | RGIVGA------TEAFDI | WGQGT MVTVS S |
| | Germline | QVQLVQS- GAEVKKPGASVKV SCKASG-GTIS | SSY----SYWG | WIRQPPGK GLEWIG | SIYY---- SGSTYYNPS LKS | VRVTISVDTSKNQFSLKLSSV TAADTAVYYCAR | YFYDSSGY YYYGMDV | WGQGT TVTVS S |
| | VH4J4-39D4J4-11RF1JH4 | | | | | | | |
| iPS:4 03872 | 21-225_8F11 | QLQLQES- GPGLVQPSETLSL TCTVSG-VSIS | RT---SYYWG | WLRQPPGK GLEWIG | NIYY---- SGSAYRNPS LKS | RVTISVDTSKNQFSLKLSSV TAADTAVYYCGR | HGQDW---------GLDY | WGQGT LVTVS S |
| | Germline | QVQLVQS GAEVKKPGASVKV SCKASG-YTFT | S------YDIN | WVRQATGQ GLEWMG | WMNPN---- SGNTGYAQK FQG | RVTMTWNTSIRTAYMELSSL RSEDTAVYYCAR | YDILTGYP PYYYYGMDV | WGQGT LVTVS S |
| | VH1J1-08D3J3-9RF2JH6 | | | | | | | |
| iPS:4 37240 | 21-225_84H12 | QVQLVQS- GAEVKKPGASVKV SCKASG-YTFT | S------YDIN | WVRQATGQ GLEWMG | WLNPH---- SGNTGYAQK FQG | RITMTWNTSIRTAYMELSSL RSEDTAVYYCAR | GFYDILTGYS------PTYYYYDMDV | WGQGT TVTVS S |
| iPS:4 34577 | 21-225_75C11 | QVQLVQS- GAEVKKPGASVKV SCKASG-YTFT | S------YDIN | WVRQATGQ GLEWMG | WLNPH---- SGNTGYAQK FQG | RITMTWNTSIRTAYMELSSL RSEDTAVYYCAR | GFYDILTGYS------PTYYYYDMDV | WGQGT TVTVS S |
| iPS:4 34553 | 21-225_76H12 | QVQLVQS- GAEVKKPGASVKV SCKASG-YTFT | S------YDIN | WVRQATGQ GLEWMG | WLNPH---- SGNTGYAQK FQG | RITMTWNTSIRTAYMELSSL RSEDTAVYYCAR | GFYDILTGYS------PTYYYYDMDV | WGQGT TVTVS S |
| iPS:4 34927 | 21-225_86E5 | QVQLVQS- GAEVKKPGASVKV SCKASG-YTFT | S------YDIN | WVRQATGQ GLEWMG | WMNPN---- SGNTGYAQK FQG | RVTMTWNTSIRTAYMELSSL RSEDTAVYYCAR | GFYDILTGYS------PTYYYYDMDV | WGQGT TVTVS S |
| | VH3J3-23D6J6-19RF2JH4 | EVQLLES GGGLVQPGGSLRL SCAASG-FTFS | S------YAMS | WVRQAPGK GLEWVS | AISGS---- GGNTYYADS VKG | RFTISRDNSKNTLYLQMNSL RAEDTAVYYCAK | GIAVA --GAHYFDY | WGQGT LVTVS S |
| iPS:4 35477 | 21-225_154E8 | EVQLLES- GGGLVQPGGSLRL SCAASG-FTFS | S------YAMS | WVRQAPGK GLEWVS | AISGS---- GGNTYYADS VKG | RFTISRDNSKNTLYLQMNSL RAEDTAVYYCAI | HGIAVAGT------GAHYFDY | WGQGT LATVS S |
| iPS:4 35385 | 21-225_149G7 | EVQLLES- GGGLVQPGGSLRL SCAASG-FTFS | S------YAMS | WVRQAPGK GLEWVS | AISGS---- GGNTYYADS VKG | RFTISRDNSKNTLYLQMNSL RAEDTAVYYCAI | HGIAVAGT------GAHYFDY | WGQGT LATVS S |

Figure 52 - Table 5
Standard IgG Antibody Variable Region Consensus Protein Alignment
CDRs defined by Kabat
Alignment numbering defined by Amgen Reference (AHo)

| KAPPA_VARIABLE | Germline | K_FR1 | K_CDR1 | K_FR2 | K_CDR2 | K_FR3 | K_CDR3 | K_FR4 |
|---|---|---|---|---|---|---|---|---|
| VK4jB3jK3 | | DIVMTQSPDSLA VSLGERATINC | KSS--- QSVLYSSNRN YLA | WYQQKPGQ PPKLLIY | WASTRES | GVPDRFSGSGSG--- TDFTLTISSLQAEDVAV YYC | QQYYS ----SPYT | FGQGTK VDIK |
| iPS:42 6126 | 21-225_6G6 | VK4jB3jK3 | .........Y.... .HN | .......... | ....... | .............N............... ....F........... | .........D...... | ....H.. |
| iPS:41 2232 | 21-225_4A2 | VK4jB3jK3 | .........N.... .I.H. | .F....L... | .......... | ..............................P........... | .........N...V.. | ....G.. |
| iPS:45 1141 | 21-225_164B11 | VK4jB3jK3 | .........S.... .L.K. | .S........ .L..... | .......S.. | ..............................L........... | ..............I.P. | ....H.N ..T |
| iPS:42 3314 | 21-225_12F11 | VK4jB3jK3 | .........Y.... .H.. | .N..F..... | .......... | .............N................F........... | .........D...I.P. | ....... |
| iPS:43 5327 | 21-225_147G6 | VK4jB3jK3 | ........SN.... ..... | .......... | .......... | ..............................A........... | .........T...P.. | ....... |
| iPS:43 5345 | 21-225_148G3 | VK4jB3jK3 | .......H.Y.... .R.H. | .......... | .......A.. | ..............................L........... | ................ | ....... |
| iPS:43 5405 | 21-225_150B7 | VK4jB3jK3 | .......H.N.... ..... | .......... | .......D.. | .........T....................L........... | ................ | ....... |
| iPS:43 5433 | 21-225_152E3 | VK4jB3jK3 | .........Y..V. .H.. | .S..R..... | .......... | ........S..................................... | .........FN..... | ....... |
| iPS:43 5437 | 21-225_152F4 | VK4jB3jK3 | .........Y.... ..... | .......... | .......K.. | .........V..................................... | ................ | ....... |
| iPS:43 5649 | 21-225_165H2 | VK4jB3jK3 | .P.......T.... .H.. | .......... | .......... | .........V..VP..M.DD..........R................ | .........S...I.P. | ....N.. |
| iPS:43 5855 | 21-225_191G3 | VK4jB3jK3 | .........SY... .H.. | ......L... | .......... | ..............................F............ | ................ | ....... |
| iPS:43 5903 | 21-225_190E2 | VK4jB3jK3 | .........Y.... .FN. | .N........ | .......... | .............M.................................. | .........S...P.. | ....M.. |
| iPS:43 5915 | 21-225_190H4 | VK4jB3jK3 | AN.......Y.... .H.. | .R........ | .......... | ................................................... | .........C...L.. | ....... |
| iPS:43 5923 | 21-225_190H6 | VK4jB3jK3 | ...........T.. .FN. | .N........ | .......... | ..............................C................. | .........C...I.P. | ....... |
| iPS:43 5953 | 21-225_191B12 | VK4jB3jK3 | ...........D.. .FN. | .......... | .......... | .............N...........I........ | .........S...L.. | ....H.N ..R |
| iPS:43 6098 | 21-225_195G11 | VK4jB3jK3 | ...........D.. .FN. | .N........ | .......L.. | .............M........C............ | .........C...F.. | ....R.. |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 6102 | 21-225_196B1 | VK4\|B3/JK3 | ........F....... | .....I.F........ | ................ | ................ | ................ | ....S........... | ................ |
| iPS:43 6104 | 21-225_196C1 | VK4\|B3/JK3 | ................ | .........R...... | L.N............. | ................ | ................ | .........L...... | ................ |
| iPS:43 6156 | 21-225_197C8 | VK4\|B3/JK3 | .........P...... | ............FN.. | ................ | ................ | ..........M..C.. | ......C......... | ..........R..... |
| iPS:43 6270 | 21-225_203F10 | VK4\|B3/JK3 | ................ | ...........FFH.. | ................ | .....I.......... | ............S... | ....S.T.......I. | ..........N..... |
| iPS:43 6570 | 21-225_225F4 | VK4\|B3/JK3 | ................ | ................ | ................ | ................ | ..............T. | .......F.....L.. | .............T.. |
| iPS:43 6570 | 21-225_225F4 | VK4\|B3/JK3 | ................ | ................ | ................ | ................ | .......CV.P..... | H..HN........S.P | ...........H..E. |
| iPS:39 4065 | 21-225_11E2 | VK4\|B3/JK3 | ................ | ...N..R..S...H.. | ........R....... | ................ | ................ | .......F........ | ................ |
| Germline | VK4\|B3/JK3 | K_FR1 DIQMTQSPSSLS ASVGDRVTITC | K_CDR1 RAS-QGIS----NDLG | K_FR2 WYQQKPGK APKLLIY | K_CDR2 A---ASSLQS | K_FR3 GVPSRFSGSGSGT EFTLTISSLQPEDFAT YYC | K_CDR3 LQHNS------YPIT | K_FR4 FGPGTK LEIK |
| iPS:47 3253 | 21-225_7C3_LC1 | VK1\|A30/JK5 | ................ | .......S........ | ................ | ................ | ................ | ................ | ................ |
| iPS:47 3256 | 21-225_9F12_LC2 | VK1\|A30/JK5 | ................ | ................ | .....N.V........ | ................ | ......V......... | ..........YL.... | ................ |
| iPS:45 3449 | 21-225_208A2 | VK1\|A30/JK5 | ................ | .........T...... | .......Q........ | ..........L..... | ................ | ................ | ................ |
| iPS:43 4467 | 21-225_73H8 | VK1\|A30/JK5 | ................ | .........Y...... | ................ | ................ | ........R....D.. | .........Y...... | ................ |
| iPS:43 4467 | 21-225_73H8 | VK1\|A30/JK5 | ................ | .........R...... | ................ | ................ | ................ | ............P... | ................ |
| iPS:43 5045 | 21-225_90H5 | VK1\|A30/JK5 | ................ | .........D...... | ....T........... | ................ | ..........S..... | I...........YP.. | ....V........... |
| iPS:43 5561 | 21-225_159F1 | VK1\|A30/JK5 | ................ | ................ | .....L..V....... | .....I.......... | ................ | ................ | ................ |
| iPS:43 6328 | 21-225_207F12 | VK1\|A30/JK5 | ................ | ........RV...... | .......A.D...... | ........D.N..... | ................ | .....H.......... | ................ |
| iPS:43 6354 | 21-225_210G10 | VK1\|A30/JK5 | ................ | ................ | .....I..F....... | ................ | ................ | ............F... | ................ |
| iPS:43 6354 | 21-225_210G10 | VK1\|A30/JK5 | ................ | ................ | .......Q........ | ................ | ........R....D.. | .........Y...... | ................ |
| iPS:39 3094 | 21-225_34C4 | VK1\|A30/JK5 | ................ | ................ | .....T..M....... | ....T........... | ................ | ....S.......P... | ................ |
| iPS:39 8484 | 21-225_18D4 | VK1\|A30/JK5 | ................ | ................ | ................ | ................ | ......V......... | ....H..N....YL.. | ................ |
| Germline | VK1\|L5\|JK3 | K_FR1 DIQMTQSPSSLS ASVGDRVTITC | K_CDR1 RAS-QGIS----SWLA | K_FR2 WYQQKPGK APKLLIY | K_CDR2 A---ASSLQS | K_FR3 GVPSRFSGSGSGT DFTLTISSLQPEDFAT YYC | K_CDR3 LQANS------FPFT | K_FR4 FGPGTK VDIK |

Figure 52 (Continued)

| ID | Num | Name | Germline | Seq1 | Seq2 | Seq3 | Seq4 |
|---|---|---|---|---|---|---|---|
| iPS:47 | 3254 | 21-225_7C3_LC2 | VK1IL5/JK3 | ..L....... | .......... | A......... | .......... |
| iPS:47 | 3255 | 21-225_9F12_LC1 | VK1IL5/JK3 | .......... | ..R....... | .......Q.. F...R. | .......... |
| iPS:42 | 6108 | 21-225_10G6 | VK1IL5/JK3 | .......... | ..K....... | .......... | ..G.L...I. |
| iPS:42 | 6110 | 21-225_12E9 | VK1IL5/JK3 | ..R....... | .......... | .......E.Y | A......... |
| iPS:45 | 3447 | 21-225_65F10 | VK1IL5/JK3 | .......... | .GG...T... | .......... | ..R....... |
| iPS:45 | 3451 | 21-225_52G11 | VK1IL5/JK3 | .......... | ..K....... | .......L.. I | R.R....... |
| iPS:45 | 3453 | 21-225_53F2 | VK1IL5/JK3 | .......... | ..K....N.L | .......... | A......... |
| iPS:43 | 3915 | 21-225_43H9 | VK1IL5/JK3 | .......... | ..D....K.. | .......D.. | .I........ |
| iPS:43 | 3925 | 21-225_44F3 | VK1IL5/JK3 | .......... | ..D....... | .......... | .......F.. |
| iPS:43 | 3953 | 21-225_45H4 | VK1IL5/JK3 | .......... | ..D....K.Y | .......D.. | .I........ I.F |
| iPS:43 | 3959 | 21-225_45C9 | VK1IL5/JK3 | .V........ | ..D....R.. | .......... | .......... |
| iPS:43 | 4023 | 21-225_49F1 | VK1IL5/JK3 | .......... | .RD.N..... | .......T.. E | .......... |
| iPS:43 | 4027 | 21-225_49H5 | VK1IL5/JK3 | .......... | ..G....F.. | .......V.. | .K........ |
| iPS:43 | 4035 | 21-225_49F10 | VK1IL5/JK3 | .......... | ..T....V.. | .......... | .......... |
| iPS:43 | 4061 | 21-225_51C7 | VK1IL5/JK3 | ..L....... | ..R....... | .......... | .......... |
| iPS:43 | 4065 | 21-225_51E9 | VK1IL5/JK3 | .......... | .DVN...F.. | .......T.. | .L........ |
| iPS:43 | 4069 | 21-225_50D4 | VK1IL5/JK3 | .......... | .NY....V.. | .......V..N | .......F.. |
| iPS:43 | 4079 | 21-225_52B1 | VK1IL5/JK3 | .TF...I... | ..R....... | .......... | ..R....... |
| iPS:43 | 4097 | 21-225_52H10 | VK1IL5/JK3 | .......... | .D.R..T... | .......... | A......... |
| iPS:43 | 4123 | 21-225_53F7 | VK1IL5/JK3 | ..S....... | .D.N...N.. | .......V..N | .....R.... |
| iPS:43 | 4145 | 21-225_55B1 | VK1IL5/JK3 | .......... | ..R....... | .......... | .......... I |

Figure 52 (Continued)

| | | | | | | | | | |
|---|---|---|---|---|---|---|---|---|---|
| iPS:43 4167 | 21-225_50F3 | VK1|L5/J K3 | . . . . . | . . . . . | D . . . . | . . . . . | F . . . . | . . . . . | . . T . . | . . . . . |
| iPS:43 4189 | 21-225_56E5 | VK1|L5/J K3 | . . . . . | . . . . . | . R . . . | . . . . . | . . . . . | . . N . . | . . . . . | . . . . . |
| iPS:43 4193 | 21-225_56C6 | VK1|L5/J K3 | . . . . . | . . . . . | . . K . . | . . . . . | . S . N . | . . . . . | I . . S . | . . . . . |
| iPS:43 4195 | 21-225_56F6 | VK1|L5/J K3 | . . Y . . | C . . . . | V . . D . | . . . . . | F . . . V | . . . . . | . . . . Y | . . . . . |
| iPS:43 4273 | 21-225_57E4 | VK1|L5/J K3 | . . . . . | . . S . . | . . K . . | . . . . . | . . F . . | . . . G . | . . . . . | . . . . . |
| iPS:43 4277 | 21-225_57A7 | VK1|L5/J K3 | . . . . . | . . . . . | . . N . . | . . . . . | . . . . . | . . . . . | . . . S . | . . G . . |
| iPS:43 4355 | 21-225_64G12 | VK1|L5/J K3 | . . . . . | . . . . . | . . R . . | . . . . . | . . N . . | . . N . . | . . . I . | . . . . . |
| iPS:43 4389 | 21-225_66F11 | VK1|L5/J K3 | . . . . . | . . . . . | . . N . T | . . . . . | . . . S . | . . . . . | . . . . . | . . L . . |
| iPS:43 4423 | 21-225_70D1 | VK1|L5/J K3 | . . . . . | C . . . . | . . T . . | . . . . . | . . . . . | . . . . . | . . . Y . | . . . . . |
| iPS:43 5291 | 21-225_146E1 | VK1|L5/J K3 | . . . . K | . . . . . | . . E . . | . . . . . | . . . . . | . . . . . | . V . . . | . . . . . |
| iPS:43 5303 | 21-225_146A6 | VK1|L5/J K3 | . . . . . | . . . . . | . . R . . | . . . . . | . . . . . | . . . . . | . . S . R | . . . . . |
| iPS:43 5335 | 21-225_147D10 | VK1|L5/J K3 | . . . . . | A . . . . | . . N . . | . . . . . | . . . . . | . . . G . | . . . S . | . TD . . . |
| iPS:43 5339 | 21-225_147D12 | VK1|L5/J K3 | . . . . . | A . . . . | . . N . T | . . . . . | . . . . E | . . . . . | . . . S . | . TD . . . |
| iPS:43 5343 | 21-225_148E2 | VK1|L5/J K3 | . . . . . | A . . . . | . . N . . | . . . . . | . . . . . | . . . . . | . . . S NE | . TD . . . |
| iPS:43 5379 | 21-225_149B6 | VK1|L5/J K3 | . . . . . | A . . . . | . . . . I | . . . . . | . . . R . | . . . . . | . . . S . | . G . . . |
| iPS:43 5381 | 21-225_149C6 | VK1|L5/J K3 | . . . . . | A . . . . | . . N . . | . . . . . | . . . . . | . . . G . | . . . S Y | . TD . . . |
| iPS:43 5391 | 21-225_149F8 | VK1|L5/J K3 | . . . . . | A . . . . | . . N . . | . . . . . | . . . . . | . . . . . | . . . S NE | . TD . . . |
| iPS:43 5395 | 21-225_149D11 | VK1|L5/J K3 | . . . . . | A . . . . | . . N . T | . . . . . | . . . . . | . . . . . | . . . S . I | . TD . . V |
| iPS:43 5403 | 21-225_150C5 | VK1|L5/J K3 | . . . . . | G . . . . | . . . . . | . . . . . | . . . . . | . . . G . | . . . . . | . TD . . V |
| iPS:43 5447 | 21-225_152H7 | VK1|L5/J K3 | . . . . . | A . . . . | . . D . . | . . . . . | . . . . . | . . . G . | . . . S T | . TD . . V |
| iPS:43 5453 | 21-225_152G10 | VK1|L5/J K3 | . . . . . | A . . . . | . . N . . | . . . . . | . . . S . | . . . . . | . . . S NE | . TD . . V |

Figure 52 (Continued)

| ID | Germline | | | | | | | | | | |
|---|---|---|---|---|---|---|---|---|---|---|---|
| iPS:43_5483 | 21-225_155A4 | VK1 L5/J K3 | . . . . . . . . . . | . . . . . . . . . . | . . . . H . . . . . | . . . . . . . . . . | . . . . . . . . . . | . . . . . . . . . . | H.TD . . . . . | . . . . . . . . . . | . . . . . . . . . . |
| iPS:43_5485 | 21-225_155B4 | VK1 L5/J K3 | . A . . . . . . . . | . . . N . . . . . . | . . . . . . . . . . | . . . . . G . . . . | . . . . S . . . . . | . . . . . . . . . . | H.TD . . . . . | . . . . . . . . . . | . . . . . . . . . . |
| iPS:43_5787 | 21-225_180A3 | VK1 L5/J K3 | . A . . . . . . . . | . . . D.T . . . . . | . . . . . . . . . . | . . . . . G . . . . | I . . . S . . . . . | . . . . . F H . . | . . . . . . . . . . | . . . . . . . . . . | . . . . . N . . . . |
| iPS:43_5809 | 21-225_182H5 | VK1 L5/J K3 | . Y . . . . . . . . | . . . D.T . . . . . | . . . . . . . . . . | . . . . . . . . . . | I . . T.V.D . . . | . . . . . . . . . . | . . . . . I . . . | . . . . . . . . . . | . . . . . H . . . . |
| iPS:43_5889 | 21-225_186A11 | VK1 L5/J K3 | . . . . . . . . . . | . . . D.T . . . . . | . . . . . . . . . . | . . . . . G . . . . | I . . T.V.D . . . | . . . . . . . . . . | . . . . . . . . . . | . . . . . . . . . . | . . . . . H . . . . |
| iPS:43_5965 | 21-225_192H2 | VK1 L5/J K3 | . . . . . . . . . . | . . . I . . . . . . | . . . . . . . . . . | . . . . . . . . . . | . . . . . . . . . . | . . . . . . . . . . | . . . . S . . . . | . . . . . V . . . . | . . . . . V . . . . |
| iPS:43_6106 | 21-225_196F2 | VK1 L5/J K3 | . . . . . . . . . . | . . . . . . . . . . | . . . . N . . . . . | . . . . . . . . . . | . . . . . . . . . . | . . . . R . . . . | . . . . T . . . . . | . . . . . . . . . . | . . . . . . . . . . |
| iPS:43_6360 | 21-225_210H11 | VK1 L5/J K3 | . . . . . . . . . . | . . . I . . . . . . | . . . . . . . . . . | . . . T.N . . . . | . . . . . . . . . . | . . . . . . . . . . | . . . . K . . . . . | . . . . . . . . . . | . . . . . . . . . . |
| iPS:43_6488 | 21-225_221A6 | VK1 L5/J K3 | . . . . . . . . . . | . V . . . . . . . . | . . . L.V . . . . | . . . T.N . . . . | . . . . . . . . . . | . . . . R . . . . | . . . . . . . . . . | . . . . . . . . . . | . . . . . . . . . . |
| iPS:43_6494 | 21-225_221F12 | VK1 L5/J K3 | . C . . . . . . . . | . . . . . . . . . . | . . . . . . . . . . | . . . T.N . . . . | . . . . . . . . . . | . . . . . . . . . . | . . . . D . . . . | . . . . . . . . . . | . . . . . R . . . . |
| iPS:43_6496 | 21-225_222E1 | VK1 L5/J K3 | . . . . . . . . . . | . . . R . . . . . . | . . . . . . . . . . | . . . T.N . . . . | . . . . V . . . . | . . V.R . . . . . | . . . . . . . . . . | . . . . . . . . . . | . . . . . R . . . . |
| iPS:43_6508 | 21-225_222F7 | VK1 L5/J K3 | . . . . . . . . . . | . . . A.N . . . . | . . . . . . . . . . | . . . T . . . . . . | . . . . T . . . . | . . . . . . . . . . | . . . . . . . . . . | . . . . . . . . . . | . . . . . . . . . . |
| iPS:43_6516 | 21-225_222C12 | VK1 L5/J K3 | . . . . . . . . . . | . D . . . . . . . . | . . . . . . . . . . | . . . . . F . . . | . . . . . . . . . . | . . . . . . . . . . | . . . . G . . . . | . . . . . . . . . . | . . . . . . . . . . |
| iPS:43_7234 | 21-225_64E2 | VK1 L5/J K3 | . . . . . . . . . . | . . . N . . . . . . | . . . . . . . . . . | . . . . . N . . . | . . I.S . . . . . | . . . . R . . . . | . . . . . . . . . . | . . . . . I . . . . | . . . . . . . . . . |
| iPS:39_2996 | 21-225_28B1 | VK1 L5/J K3 | . . . . . . . . . . | . . . N . . . . . . | . . . R . . . . . . | . . . D . . . . . . | . . . . T . . . . | . . . . . . . . . . | . . . . . . . . . . | . . . . . . . . . . | . . . . . . . . . . |
| iPS:39_3010 | 21-225_25E11 | VK1 L5/J K3 | . . . . . . . . . . | . . . . . . . . . . | . . . . . . . . . . | . . . . T . . . . . | . I.F . . . . . . | . . . . C . . . . | . . . . . . . . . . | . . . . . . . . . . | . . . . . . . . . . |
| iPS:39_3016 | 21-225_28F11 | VK1 L5/J K3 | . T . . . S . . . . | . . . K . . . . . . | . . . . . . . . . . | . . . . . . . . . . | . . . . T . . . . | . . . . . S . . . . | . . . . . . . . . . | . . . . . L . . . . | . . . . . . . . . . |
| iPS:39_3024 | 21-225_31H9 | VK1 L5/J K3 | . . . . . . . . . . | . . . K . . . . . . | . . . P . . . . . . | . . . . . . . . . . | . . . . . . . . . . | . . . . I . . . . | . . . . . . . . . . | . . . . . . . . . . | . . . . . Q . . . . |
| iPS:39_3080 | 21-225_34F3 | VK1 L5/J K3 | . . . . . . . . . . | . . . R . . . . . . | . . . E . . . . . . | . . . . R . . . . | . . . . I . . . . | . . . . . . . . . . | . . . . . . . . . . | . . . . . . . . . . | . . . . . . . . . . |
| iPS:39_3084 | 21-225_35C6 | VK1 L5/J K3 | | | | | | | | | |
| iPS:39_3086 | 21-225_36H5 | VK1 L5/J K3 | | | | | | | | | |

Figure 52 (Continued)

[Figure: Table continued from previous page showing antibody sequence alignments with columns for sample IDs, germline designations (VK1|L5/JK3, VK4|B3/JK1), and sequence positions across K_FR1, K_CDR1, K_FR2, K_CDR2, K_FR3, K_CDR3, and K_FR4 regions. The germline VK1|L5/JK1 reference sequence shown is DIVMTQSPDSLA / VSLGERATINC / KSS / QSVLYSSNNKN / YLA / WYQQKPGQ / ASTRES / GVPDRFSGSGS / TDFTLTISSLQAEDVAV / YYC and for VK4|B3/JK1 germline. Most cells contain dots indicating identity with germline; scattered single-letter substitutions are shown.]

| | | | | | | | | | |
|---|---|---|---|---|---|---|---|---|---|
| iPS:43 4707 | 21-225_80D3 | VK4{B3/J K1 | . . . . . . . . . . | . . . . . C . . . . | . . . . . . . . . . | . . . . . T . . . . | . . . . . . . . . . | . . . . . . . . . . | . H . NE . . . . GK | V . V . . . . . . . |
| iPS:43 4711 | 21-225_80H3 | VK4{B3/J K1 | . . . . . . . . . . | . . . . . . . . . . | . . . . N . . . . . | . . . HR . . . . . | . . . . . . . . . . | . . . . . . . . . . | . . . . . . . . P . | . . . . . T . . . . |
| iPS:43 4731 | 21-225_80E9 | VK4{B3/J K1 | . . . . . . . . . . | . . . . . T . . . . | . . . . Y . . . . . | . . . . . T . . . . | . . . . . . . . . . | . . . . . . . . . . | . . . N . . . . . . | . . V . . . . . . . |
| iPS:43 4761 | 21-225_81E5 | VK4{B3/J K1 | . . . . . . . . . . | . . . . . C . . . . | . . . . N . . . . . | . . . . . F . . . . | . . . . . . . . . . | . . . . . . . . . . | . . . . . . . S . L | . . . . . . . . . . |
| iPS:43 4771 | 21-225_81F9 | VK4{B3/J K1 | . . . . . . . . . . | . . . . . C . . . . | . . . . Y . . . . . | . . . . . R . . . N | . . . . . . A . . . | . . . . . . . . . . | . H . ND . . . . GK | . . Q . . . T . . . |
| iPS:43 4827 | 21-225_83F3 | VK4{B3/J K1 | . . . . . . . . . . | . . . . . C . . . . | . . . . N . . . . . | . . . . . T . . . . | . . . . . . . . . . | . . . . . . . . R . | . H . ND . . . . . . | . V . IM . . . . . . |
| iPS:43 4829 | 21-225_83G3 | VK4{B3/J K1 | . . . . . . . . . . | . . . . . C . . . . | . . . . N . . . . . | . . . . . T . . . . | . . . . . . . . . . | . . . . . . . . . . | . H . N . . . . . K | . V . I . . T . . . |
| iPS:43 4841 | 21-225_83G7 | VK4{B3/J K1 | . . . . . . . . . . | . . . . . I . . . . | . . . . Y . . T . H | . . . . . V . . . . | . . . . . . . . . . | . . . . . . . . . . | . . F . . . . . . . | . V . . . . . . . . |
| iPS:43 4863 | 21-225_84G7 | VK4{B3/J K1 | . . . . . . . . . . | . . . . . P . . . . | . . . . Y . . T . H | . . . . . V . . . . | . . . . . . . . . . | . . . . . . . . . . | . . F . . . . . S . P | . . . . . . . . . . |
| iPS:43 4877 | 21-225_85H2 | VK4{B3/J K1 | . . . . . SM . . . . | . . . . . I . . . . | . . . . K . . . H . | . . . . . . . . . . | . . . . . . . . . . | . . . . . . . . . . | . . . R . . . . . . | . . . . . . . . . . |
| iPS:43 4901 | 21-225_85H9 | VK4{B3/J K1 | . . . . . . . . . . | . . . . . . . . . . | . . . . Y . . HR . | . . . . . . . . . . | . . . . . . . A . . | . . . . . . . . . . | . . . . . . . S . L | . . . . . . . . . . |
| iPS:43 4935 | 21-225_86E9 | VK4{B3/J K1 | . . . . . . . . . . | . . . . C . P . . . | . . . . Y . . HR . | . . . . . N . . . . | . . . . . . . . . . | . . . . . . . . . . | . H . . . . . . . . | . . . . . T . . . . |
| iPS:43 4965 | 21-225_88A1 | VK4{B3/J K1 | . N . . . . A . . . | . . . . . . . . . . | . . . . N . . . H . | . . . . . . . . . . | . . . . . . . . . . | . . . . . . . . . . | . . L . . . . . . . | . . . . . . . . . . |
| iPS:43 4971 | 21-225_88G2 | VK4{B3/J K1 | . . . . . . . . . . | . . . . . I . P . . | . . . . Y . . HN . | . . . . . V . . . . | . . . . . . . . . . | . . . . . . . . . . | . . . N . . . . . . | . V . . . . . . . . |
| iPS:43 4973 | 21-225_88B4 | VK4{B3/J K1 | . . . . . . . . . . | . . . . V . . . . . | . . . . N . . . . . | . . . . . . . . . . | . . . . . . . . . . | . . . . . . . . . . | . . . . . . . S . P | . . . . . . . . . . |
| iPS:43 4997 | 21-225_88C10 | VK4{B3/J K1 | . . . . . . . . . . | . . . . . . . . . . | . . . . W . . . H . | . . . . . H . . . . | . . . . . . . . . . | . . . . . . G . N . | . . . R . . . . A . P | . . . . . . . . . . |
| iPS:43 5051 | 21-225_90D9 | VK4{B3/J K1 | . . . . . . . . . . | . . . . . . . . . . | . . . . . T . H . . | . . . . . . . F . K | . . . . . . . . . . | . . . . . . . . . . | . . . . . . . . . . | . . . . . . . . . . |
| iPS:43 5053 | 21-225_75F9 | VK4{B3/J K1 | . . . . . . . . . . | . . . . . I . . . . | . . . . Y . . H . . | . . . . . V . . . T | . . . . . . . . . . | . . . . . . . . . . | . . L . . . . . S . L | . . . . . . . . . . |
| iPS:43 5071 | 21-225_91F1 | VK4{B3/J K1 | . . . . . . . . . . | . . . . . . . . . . | . . . . N . . HN . | . . . . . . . . . . | . . . . . . . . . . | . . . . . . . . . . | . H . N . . . . . . | . V . . . . . . . . |
| iPS:43 5087 | 21-225_91G8 | VK4{B3/J K1 | . . . . . . . . . . | . . . . . . . . . . | . . . . . . . . . . | . . . . . . . . . . | . . . . . . . . . . | . . . . . . . . . . | . . . T . . . . . . | . . . . . . . . . . |
| iPS:43 5113 | 21-225_92E6 | VK4{B3/J K1 | . A . . . . . . . . | . . . . . . . . . . | . . . NI . S . . T | . . . . . I . . . . | . . . . . . . . . . | . . . . . F . . . . | . . F . . . . . V . P | . . . . . . . . . . |

Figure 52 (Continued)

| | | | | | | | | |
|---|---|---|---|---|---|---|---|---|
| iPS:43 5167 | 21-225_92F12 | VK4{B3/J K1 | | | .HR | | | |
| iPS:43 5203 | 21-225_75A7 | VK4{B3/J K1 | .T. | .Y. | .H. | ..V. | | .P. |
| iPS:43 5209 | 21-225_75A10 | VK4{B3/J K1 | N..A | .Y. | .HN | .T | | S.P. |
| iPS:43 5211 | 21-225_94E11 | VK4{B3/J K1 | | .Y..T | .F. | ..L. | .F | .F. .T |
| iPS:43 5215 | 21-225_94E12 | VK4{B3/J K1 | .T. | .Y. | | .R. .N | | .H. S.L. .Q. |
| iPS:43 5227 | 21-225_95G4 | VK4{B3/J K1 | .C. | .Y. | .FR | .R. | .A. | .P. |
| iPS:43 5245 | 21-225_95E12 | VK4{B3/J K1 | | .A. | .H. | .HN | .V..A.Y. | .H. S.L. .Q. |
| iPS:43 5249 | 21-225_96E2 | VK4{B3/J K1 | .S. | | .F | .N.F | | .R. CS |
| iPS:43 5255 | 21-225_96D5 | VK4{B3/J K1 | | .K. | .H. | ..W | .A. | S.P. |
| iPS:43 5257 | 21-225_96H5 | VK4{B3/J K1 | | .Y. | .NI.S. .T | .N | | CS |
| iPS:43 5267 | 21-225_96D10 | VK4{B3/J K1 | .C. | .SH. | .T | .I. | .S.M. .F | V.P. |
| iPS:43 5279 | 21-225_97H4 | VK4{B3/J K1 | | .N | .H. | .T | .F | H.ND .K. .T |
| iPS:43 5321 | 21-225_147E4 | VK4{B3/J K1 | | .Y. | .H. | .L.R | .R | .S. |
| iPS:43 5353 | 21-225_148F8 | VK4{B3/J K1 | .L. | .A.H. | .A.H. | | .I | I.P. |
| iPS:43 5369 | 21-225_149A2 | VK4{B3/J K1 | | .Y. | | .K. | | |
| iPS:43 5373 | 21-225_149E3 | VK4{B3/J K1 | | .P..N. | .HN | .LR | | CS |
| iPS:43 5375 | 21-225_149H4 | VK4{B3/J K1 | .S. | .H..F. | .T..HN | .R.S. | .H | .P. |
| iPS:43 5481 | 21-225_154A11 | VK4{B3/J K1 | | R..Y. | .DN | | | Y.P. |
| iPS:43 5557 | 21-225_158B12 | VK4{B3/J K1 | .P. | .Y. | .N.H. | .R. | .E. .F. | S.R. |
| iPS:43 5627 | 21-225_162F6 | VK4{B3/J K1 | | .N.T | .N.T | .R. | .E. | .P. |
| iPS:43 5701 | 21-225_170F6 | VK4{B3/J K1 | .A. | .Y. | .H. | .V..H | .N. .V | .K. |

Figure 52 (Continued)

| ID | Name | Framework | | | | | | | | | | | |
|---|---|---|---|---|---|---|---|---|---|---|---|---|---|
| iPS:43 5737 | 21-225_174G5 | VK4(B3)J K1 | . . . . . . . . . . | . . . . . . . . . . | . . A . . . . . . . | . . . . . . . . . . | . . . Y . . . . . H | . . . . . . H . . . | . . . . . S . . . . | . . . . . . . . . . | . . . . . . . . . . | . . . . . . . . . . | . . R . . . . . . . | . . . . . . . . . . |
| iPS:43 5751 | 21-225_175D10 | VK4(B3)J K1 | . . . . . . . . . . | . . . . . . . . . . | . . . . . . . . . . | . . . . . . . . . . | . . . N . . . . . T | . . . . N . . . . . | . . . . . . . . . . | . . . . . . . . . . | . . . . . . . . . . | . . . . . . . . . . | . . . . . . . . . . | . . . . . . . . . . |
| iPS:43 5773 | 21-225_177B12 | VK4(B3)J K1 | . . . . . . . . . . | . . . . . . V . . . | . . . . . . . . . . | . . . . . . . . . . | . . . N . . . . . T | . . . . . . . . . . | . . . . . . . . . . | . . . . . . . . . . | . . . . . . . . . . | . . . . . . . . . . | . . . . . . . . S.P | . . . . . . . . . . |
| iPS:43 5801 | 21-225_181E5 | VK4(B3)J K1 | . . . . . . . . . . | . . . . . . . . . . | . . . . . . . . . . | . . . . . . . . . . | . . . Y . . . . . H | . . . . . . . . . . | . . . . . . . . . . | . . . . . . . . . . | . . . . . . . . . . | . . . . . . . H . FI | . . . . . . . . . . | . . . . . . . . . . |
| iPS:43 5841 | 21-225_191D8 | VK4(B3)J K1 | . . . M . . . . . . | . . . . . . I . S . | . . . . . . . . . . | . . . R . . . . . . | . . . Y . . . . . . | . . . . . . . . . . | . . . . . . . . . . | . . . . . . . . . . | . . . . . . . . . . | . . . . . . . . . . | . . . . . . . . P . | . . . . . . . L . . |
| iPS:43 5925 | 21-225_190D7 | VK4(B3)J K1 | . . . . . . . . . . | . . . . . . . . . . | . . . . . . . . . . | . . . . . . . . . . | . . . Y . . . . . S | . . . . . . . . . . | . . . . . . . . K . | . . . . . . . . . . | . . . . . . . . . . | . . . . . . . R . . | . . . . . . . . . . | . . . . . . . . . . |
| iPS:43 6021 | 21-225_193G4 | VK4(B3)J K1 | . . . . . . . . . . | . . . . . . . . . . | . . . . . . . . . . | . . . . . . . . . . | . . . Y . . . . . V | . . . . . . . . . . | . . . . . . . . K . | . . . . . . . . D . | . . . . . . . . . . | . . . . . . . I . . | . . . . . . . . P . | . . . . . . . . . . |
| iPS:43 6114 | 21-225_196G8 | VK4(B3)J K1 | . . . . . . . T . . | . . . . . . V . . . | . . . . . . . . . . | . . . . . . . . . . | . . . Y . . . . . T | . . . . . . H . . . | . . . . . . . . . . | . . . . . . . . D . | . . . . . . . . . . | . . . . . . . . . . | . . . . . . . . . . | . . . . . . . . . . |
| iPS:43 6150 | 21-225_197H4 | VK4(B3)J K1 | . . . M . . . . . . | . . . . S . T . . . | . . . R . . . . . . | . . . . . . . . . . | . . . Y . . . . . H | . . . . . . A . H . | . . . . . . . . . . | . . . . . . . . A . | . . . . . . . . P . | . . . . . . . . N . | . . . . . . . . . . | . . . . . . . . L . |
| iPS:43 6154 | 21-225_197C6 | VK4(B3)J K1 | . . . M . . . . . . | . . . . . . I . S . | . . . F . . . Y . . | . . . R . . . . . . | . . . Y . . . . . . | . . . . . . . N . . | . . . . . . H . . . | . . . . . . . . . . | . . . . . . . . . . | . . . . . . . . . . | . . . . . . . . P . | . . . . . . . . L . |
| iPS:43 6218 | 21-225_200G7 | VK4(B3)J K1 | . . . A . . . . . . | . . . . . . . . PT . | . . . . . . . VK . . | . . . . . . . . . . | . . . N . . . . . . | . . . . . . . . . . | . . . . . . . . . . | . . . . . . . . A . | . . . . . . . . . . | . . . . . . . . N . | . . . . . . . . P . | . . . . . . . . . . |
| iPS:43 6272 | 21-225_201F5 | VK4(B3)J K1 | . . . . . . . . . . | . . . . . . E . . . | . . . . . . . . . . | . . . . . . . . V . | . . . . . . . . . . | . . . . . . . . . . | . . . . . . . . . . | . . . . . . . . . . | . . . . . . . . . . | . . . . . . . . . . | . . . . . . . . P . | . . . . . . . . . . |
| iPS:43 6400 | 21-225_213H7 | VK4(B3)J K1 | . . . . . . . . . . | . . . . . . . . . . | . . . . . . . . . . | . . . . . . N . DI | . . . . . . . . . . | . F . . . . N . . . | . . . . . . . . . . | . . . . . . . . . . | . . . . . . . . T . | . . . . . . . . . . | . . . . . . . . P . | . . . . . . . . . . |
| iPS:43 6402 | 21-225_213H12 | VK4(B3)J K1 | . . . . . . . T . . | . . . . . . . . . . | . . . R . . . . . . | . . . . . . S . G . | . . . . . . . . . . | . . . . . . . V . . | . . . . . . . . . . | . . . . . . . . . . | . . . . . . . . H . | . . . . . . . . . . | . . I . . . . . P . | . . . . . . . . . . |
| iPS:43 6500 | 21-225_222H3 | VK4(B3)J K1 | . . . K . . . . . . | . . . . . . . . . . | . . . . . . . . . . | . . . . . . N . . KT | . . . . . . . . . . | . . . . . . . . . . | . . . . . . . . . . | . . . . . . . . . . | . . . . . . . . . . | . . . . . . . H . . | . . . . . . . . I . | . . . . . . . . . . |
| iPS:43 6520 | 21-225_223G10 | VK4(B3)J K1 | . . . . . . . . . . | . . . . . . . . . . | . . . . HR . . . . . | . . . . I . L . . . | . . . . . . . . . . | . . . . . . Q . . . | . . . . . . . . . . | . . . . . . . . . . | . . . . . . . . . . | . . . . . . . S . . | . . . . . . . . . . | . . . . . . . . N . |
| iPS:43 6544 | 21-225_224H5 | VK4(B3)J K1 | . . . . . . . . . . | . . . . . . . . . . | . . . . . . . . . . | . . . . F . T . . . | . . . . . . . . . . | . . . . . . H . . . | . . . . . . . . . . | . . . . . . . . N . | . . . . . . . . . . | . . . . . . . S . I | . . . . . . . . . . | . . . . . . . . . . |
| iPS:43 6550 | 21-225_224D8 | VK4(B3)J K1 | . . . . . . . . . . | . . . . . . A . . . | . . . N . . . . . . | . . . . . . . . . . | . . . . . . . . . . | . . . . . . . . . . | . . . . . . . . . . | . . . . . S . . K . | . . . . . . . . . . | . . . . . . . . . . | . . . . . . . . . . | . . . . . . . . . . |
| iPS:43 6574 | 21-225_225F5 | VK4(B3)J K1 | . . . . . . . . . . | . . . . . . . . . . | . . . Y . . . . . . | . . . . . . . . . . | . . . . . . . . . . | . . . . . . . . . . | . . . . . . . . . . | . . . . . . . . . . | . . . . . . . . . . | . . . . . . . F . . | . . . . . . . . P . | . . . . . . . . . . |
| iPS:43 6586 | 21-225_225F11 | VK4(B3)J K1 | . . . . . . . . . . | . . . . . . . . . . | . . . Y . . . . . . | . . . . . . . . . . | . . . . . . R . . . | . . . . . . . . . . | . . . . . . . . . . | . . . . . . . F . . | . . . . . . . . . . | . . . . . . . T . . | . . . . . . . . S.P | . . . . . . . . . . |
| iPS:43 6600 | 21-225_226F6 | VK4(B3)J K1 | . . . . . . . . . . | . . . . . . . . . . | . . . Y . . . . . . | . . . . I . . . . . | . . . . . . . . . . | . . . . . . . . . . | . . . . . . . . . . | . . . . . . . . P . | . . . . . . . . . . | . . . . . . . T . . | . . . . . . . . P . | . . . . . . . . N . |

| VK1|A30/JK2 | | K_FR1 ASVGDRVTITC | K_CDR1 RAS QSIS SYLN | K_FR2 WYQQKPG KAPKLLIY | K_CDR2 AAS SLQS | K_FR3 GVPSRFSGSGSGTDFTLTISSLQPEDFATYYC | K_CDR3 QQSYS TPLT | K_FR4 FGQGTK LEIK |
|---|---|---|---|---|---|---|---|---|
| iPS:42 6114 | 21-225_28H2 | VK1|A30/ JK2 | .........I.... | ............ | ............ | ............ | ............................. | ....Y......... | ............ |
| iPS:42 6116 | 21-225_29E2 | VK1|A30/ JK2 | ............ | ......A..... | ......R..... | ............ | ............................. | ...YN........RS | ............ |
| iPS:43 4231 | 21-225_61F2 | VK1|A30/ JK2 | .......V.... | ...D........ | .E.......... | ............ | ..I.......................... | ....Y.........RS | ............ |
| iPS:43 5401 | 21-225_150E2 | VK1|A30/ JK2 | ...........S | ......G..... | ....T....... | ............ | ............................. | ....Y........F.S | ............ |
| iPS:43 5445 | 21-225_152F7 | VK1|A30/ JK2 | ............ | ............ | ............ | ............ | ............A................ | ...YN........F.S | ............ |
| iPS:43 5763 | 21-225_176H12 | VK1|A30/ JK2 | ............ | ............ | ...N........ | ............ | .....................G........ | ....Y.........RS | ............ |
| iPS:43 5767 | 21-225_177B4 | VK1|A30/ JK2 | ........I... | ......A..... | ......R..... | ............ | ............................. | ....Y........F.RS | ............ |
| iPS:39 2974 | 21-225_26A11 | VK1|A30/ JK2 | ............ | ............ | ......R..... | ............ | ..I........................... | ...YN.........RS | ..........R. |
| iPS:39 3046 | 21-225_25A12 | VK1|A30/ JK2 | .......V.... | ...D........ | ............ | ............ | ..I........................... | ...YN.........RS | ............ |
| Germline | | | K_FR1 ASVGDRVTITC | K_CDR1 QSIS SYLN | K_FR2 WYQQKPG KAPKLLIY | K_CDR2 AAS SLQS | K_FR3 GVPSRFSGSG SGTDFTLTISSLQPEDFATYYC | K_CDR3 QQSYS TPLT | K_FR4 FGQGTK VEIK |

| VK1|O12/JK4 | | | | | | | | | |
|---|---|---|---|---|---|---|---|---|
| iPS:42 6118 | 21-225_7A10 | VK1|O12/ JK4 | ............ | ...N.Y...... | ....V....... | ...R.S...... | ...S...N.....S................ | ............P. | ..........R. |
| iPS:42 6124 | 21-225_32D6 | VK1|O12/ JK4 | T........... | ...N.I...... | ....M....... | ....T....... | ...........A.................. | ............Y. | ............ |
| iPS:45 1135 | 21-225_64A11 | VK1|O12/ JK4 | ......F..... | ...R.V...... | ..TL..S..... | .V.......... | ...................F........... | ............F. | ..........A. |
| iPS:43 4011 | 21-225_48B10 | VK1|O12/ JK4 | ............ | .....R....R. | ..KT........ | ...R........ | ...........V.R................ | ...D........... | ............ |
| iPS:43 4015 | 21-225_48F12 | VK1|O12/ JK4 | ............ | .....K...... | ..KT........ | ............ | ............V................. | ...T........N.. | ...FT....... |
| iPS:43 4017 | 21-225_48G12 | VK1|O12/ JK4 | ............ | .....K...... | ..KT........ | ............ | ...........V..N................ | ...T........N.. | .......E....T |
| iPS:43 4165 | 21-225_50F2 | VK1|O12/ JK4 | ............ | .....K...... | ............ | .V.......... | ...........V..N................ | ...T........N.. | .......E....T |
| iPS:43 4191 | 21-225_56B6 | VK1|O12/ JK4 | V........... | ...R....R... | ......F..... | ...R.F...... | .....D......................... | ............P. | ............T |
| iPS:43 4247 | 21-225_62D2 | VK1|O12/ JK4 | ............ | .......I.... | ............ | ...T........ | ............................... | ...T........P. | ............ |

Figure 52 (Continued)

| | | | | | | | | | |
|---|---|---|---|---|---|---|---|---|---|
| iPS:43 4335 | 21- 225_63C10 | VK1|O12/ JK4 | . . . . . T . . . | . . . . . . . . . | . . . . . . . . . | . . . . F . . . | . . . . . . . . . | . . . T . . . . P . | . . . . . . . . . |
| iPS:43 4341 | 21-225_64F7 | VK1|O12/ JK4 | . . . . . . . . . | . F . . . H . N K . | . . . F . . . . . | . . . G . . . . . | . . . . A . . . . | . . N . . . ISF . | . . . . L . . . . |
| iPS:43 5295 | 21- 225_146H1 | VK1|O12/ JK4 | . . . . . . . . . | . . . . . D . . . | . . . V . . . . . | . T . . T . . . . | . . . . . . . . . | . . . . . . STP . | . . . . . . . . . |
| iPS:43 5307 | 21- 225_146E9 | VK1|O12/ JK4 | . . . . . . . . . | . . . . . D . . . | . . . L . V . . . | . T . . T . . . . | . . . . F . . . . | . . . . . . STP . | . . . . . . . . . |
| iPS:43 5347 | 21- 225_148C4 | VK1|O12/ JK4 | . . . . . . . . . | . . . I . . . N . | . . . . . V . . . | . T . . . . . . . | . . . T . . . . . | . . . . . . STP . | . . . . E . . . . |
| iPS:43 5355 | 21- 225_148H9 | VK1|O12/ JK4 | . . . . . . . . . | . . . . . N . . . | . . . . . V . . . | . I . . . . . . . | . . . . . . . . . | . . . . . . STP . | . . . . . . . . . |
| iPS:43 5371 | 21- 225_149A3 | VK1|O12/ JK4 | . . . . . . . . . | . . . . . . . . . | . . . VM . . . . | . T . . . . . . . | . . N . . . . . . | . . . . . . SIP . | . . . S . . . . . |
| iPS:43 5415 | 21- 225_150C11 | VK1|O12/ JK4 | . . . . . . . . . | . . . . . . . . . | . . . . . V . . . | . T . . . . . . . | . . . . . . . . . | . . . . . . SIY . | . . . . . . . . . |
| iPS:43 5419 | 21- 225_150C12 | VK1|O12/ JK4 | . . . . . . . . . | . . . . . NF . . | . . . . . V . . . | . T . . T . . . . | . . . . F . . . . | . . . . . . STP . | . . . . R . . . . |
| iPS:43 5425 | 21- 225_151B12 | VK1|O12/ JK4 | . . . . L . . . . | . . . L . D . . . | . . . L . V . . . | . T . . T . . . E | . . . . . . . . . | . . . . . . STP . | . . . . . . . . . |
| iPS:43 5431 | 21- 225_152D2 | VK1|O12/ JK4 | . . . . . . . . . | . . . . . D . . . | . . . . . V . . . | . T . . T . . . . | . . . . F . . . . | . . . . . . STP . | . . . . . . . . . |
| iPS:43 5439 | 21- 225_152G4 | VK1|O12/ JK4 | . . . . . . . . . | . . . . . D . . . | . . . . . V . . . | . T . . T . . . . | . . . . F . . . . | . . . . . . STP . | . . . . . . . . . |
| iPS:43 5455 | 21- 225_152B11 | VK1|O12/ JK4 | . . . . . . . . . | . . . . . . . . . | . . . . V . F . . | . T . . . . . . . | . . . . F . . . . | . . . . . . STP . | . . . R . . . . . |
| iPS:43 5487 | 21- 225_155C4 | VK1|O12/ JK4 | . . . . . . . . . | . . . . . . . . . | . . . . . V . . . | . T . . . . . . . | . . . . . . . . . | . . . . . . STP . | . . . . . . . . . |
| iPS:43 5503 | 21- 225_156E4 | VK1|O12/ JK4 | . . . . . . . . . | . . . . . . . . . | . . . . . V . . . | . T . . . . . . . | . . . . . . . . . | . . . . . . SAP . | . . . . . . . . . |

Figure 52 (Continued)

| | | | | | | | | | | |
|---|---|---|---|---|---|---|---|---|---|---|
| iPS:43 5563 | 21-225_159H2 | VK1|O12/JK4 | ...L. | . | .K. | .E. | .T.N. | .T. | .V. | .L.V. | . |
| iPS:43 6110 | 21-225_196F4 | VK1|O12/JK4 | .F..I. | . | .R.H. | . | .T....G | . | . | .G..S. | .MR |
| iPS:43 6244 | 21-225_201H10 | VK1|O12/JK4 | . | .P. | HN.N. | ...S. | . | .F. | . | .F. | .MR |
| iPS:43 6262 | 21-225_203E3 | VK1|O12/JK4 | . | .P..R | HN.N. | ...S. | . | .F. | . | .F. | .MR |
| iPS:43 6276 | 21-225_204H4 | VK1|O12/JK4 | .F...L. | .P..R | HN.N. | ...S. | . | .F. | . | .F. | . |
| iPS:43 6280 | 21-225_204D6 | VK1|O12/JK4 | ...S. | . | .R.VH. | .V. | .G..... | . | .V. | .S. | .Q |
| iPS:43 6312 | 21-225_206A4 | VK1|O12/JK4 | .F. | .P..R | HN.N. | ...S..C | . | .F. | . | .F. | .MR |
| iPS:43 6316 | 21-225_206A5 | VK1|O12/JK4 | . | .P..R | HN.N. | ...S..C | . | .F. | . | .F. | .MR |
| iPS:43 6338 | 21-225_208E8 | VK1|O12/JK4 | .F. | .P..R | HN.N. | ...S. | . | .F. | . | .F. | .MR |
| iPS:43 6344 | 21-225_208B11 | VK1|O12/JK4 | . | .P..R | HN.N. | ...S. | . | .F. | . | .E. | .MR |
| iPS:43 6358 | 21-225_210D11 | VK1|O12/JK4 | . | . | .RF. | . | .T..... | .F..A.V | . | .I. | . |
| iPS:43 7282 | 21-225_207C9 | VK1|O12/JK4 | ..N | . | .N. | .H. | . | . | .HT | .S. | . |
| iPS:39 2636 | 21-225_17A6 | VK1|O12/JK4 | . | . | ..T. | .H. | . | . | .H. | .S. | . |
| iPS:39 2648 | 21-225_16D11 | VK1|O12/JK4 | . | . | ..T. | . | .T..... | . | .T. | .P. | . |
| iPS:39 2664 | 21-225_20F6 | VK1|O12/JK4 | . | . | ...I. | .V.H | .T..... | . | . | . | . |
| iPS:39 2738 | 21-225_18G4 | VK1|O12/JK4 | .H. | . | ...I. | .V. | .T..... | .G. | .T. | .P. | . |
| iPS:39 2798 | 21-225_22C7 | VK1|O12/JK4 | . | . | .N.I. | .E..H | .I..... | . | . | .T. | . |
| iPS:39 2922 | 21-225_30G4 | VK1|O12/JK4 | .T | .P | .N.F. | .H. | .T....G | . | . | .L. | . |
| iPS:39 3002 | 21-225_30G1 | VK1|O12/JK4 | . | . | .N.Y. | .D. | . | .I.M. | . | .P.Y. | . |
| iPS:39 3042 | 21-225_31F1 | VK1|O12/JK4 | . | . | .R. | . | ......F | . | .I. | . | ..T.R |
| iPS:39 3066 | 21-225_34D3 | VK1|O12/JK4 | . | . | .N.Y. | .D. | .H. | . | . | . | . |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| Germline | VK1|O12/ JK4 | | | | | | | |
| iPS:39 3082 | 21-225_34C11 | ....T...... | .....N.R. | D..Q... | ..E.G...T | ..........F....... | ....TC... | ...... |
| iPS:39 3092 | 21-225_33C12 | T.......... | .....NF... | ........ | ........ | ............K..... | ...... | ...... |
| iPS:39 3100 | 21-225_36B8 | ..T......... | .......I.. | ........ | .....V... | ..........N........ | ...... | ...Y.. |
| iPS:39 3108 | 21-225_34G11 | ............ | ....N.N... | ........ | ......G.. | ................. | ...T.I.. | ...Y.. |
| iPS:39 3122 | 21-225_33B2 | ...T...K.... | ........R. | ........ | ......V.. | ............T...... | ...... | ...... |
| iPS:39 3134 | 21-225_34C2 | .....TF..... | .....R.I.. | .F...... | ......V.. | ...V............Y. | ...... | ...Y.M |
| iPS:39 3136 | 21-225_34D8 | ....T....... | .......I.. | ........ | ......V.. | .................. | ...... | ...... |
| iPS:39 3840 | 21-225_3F8 | ......F..... | .......L.. | ..R....R.T | ....RT..... | ................V | ...T... | ...... |
| iPS:39 3844 | 21-225_3G7 | ............ | ......R... | QV..H..  | ...T...... | ................. | ...... | ....R.N |
| iPS:39 3852 | 21-225_12A10 | .V.......... | ....N.Y... | GR..R..  | ......V... | ...V.............A | ....... | ...P.A |
| iPS:39 3900 | 21-225_10E12 | ...A........ | ....N.Y... | M....... | ......S.. | ..........N....G.. | ....N... | ...P.D |
| iPS:39 3920 | 21-225_1H12 | ............ | ....N.Y... | .V..H... | ....RT.... | ................. | ...... | ...P..E |
| iPS:39 3926 | 21-225_4G4 | ......A..... | ...A...T.I. | ..E..R.. | ....RT.... | ........D........ | ...... | ...P... |
| iPS:39 3930 | 21-225_7E11 | ......A..... | ....N.I... | ......H. | ........ | ..........S...... | ...... | ...P... |
| iPS:39 3932 | 21-225_10F5 | ............ | .....R....N.Y... | .F...... | ...T...... | ........D........ | ....I... | ...P... |
| iPS:39 3964 | 21-225_6G1 | ............ | ...T.N.I.. | ..E..RT. | ...T...... | ................G | ...T... | ...P... |
| iPS:39 4012 | 21-225_15A3 | ............ | ........I. | ..V..... | .....N.T. | ................. | ...... | ...P... |
| iPS:39 4016 | 21-225_13D4 | ...L........ | .......I.. | ..L..... | ...T...... | ................. | ...T... | ....L. |
| iPS:39 4083 | 21-225_16E6 | ............ | ........F. | .F...... | ....C..... | ................. | ...PH. | ...... |
| iPS:39 4480 | 21-225_17G4 | ..A......... | ....N....N.. | .F...... | ...T...... | ................E | ...NF... | ...F..I |
| iPS:39 4486 | 21-225_19A1 | ............ | .....HT.T. | ..F....N | ...T.N..... | .F...............I | ...N... | ...F... |

Figure 52 (Continued)

| VK2/A18/JK4 | | DIWMTFGQGT KVEIK | KSSQSLLHSD GKTYLY | NYLQRPGQ SPQLLIY | EVSNRFS | GVPDRFSGSG SGTDFTLKIS RVEAEDVGVY YC | MQSIH LPT | FGGGTK VEIK |
|---|---|---|---|---|---|---|---|---|
| iPS:45 1139 | 21-225_71A6 | VK2/A18/JK4 | .......... | ....R. | .......... | .......... | .S........ .......... ..... | .SKQ....Y. | ......F... |
| iPS:43 3937 | 21-225_44B10 | VK2/A18/JK4 | H......... | .......... | E.R....... | P......... | .......... .......... ..... | .S........ | .......... |
| iPS:43 3979 | 21-225_46B9 | VK2/A18/JK4 | .......... | .......... | .H........ | P......... | .......... .........M .I.H.. | HS.Q....Y. | ....Q..... |
| iPS:43 4201 | 21-225_59A12 | VK2/A18/JK4 | .......... | .Q.G...... | E......... | P....V.... | .......... .........V ....Y | .STQ...... | .......... |
| iPS:43 4205 | 21-225_60G2 | VK2/A18/JK4 | ....S..... | .......... | E......... | P......... | .......... .......... ..N.I | .S.Q....Y. | .......... |
| iPS:43 4223 | 21-225_60C12 | VK2/A18/JK4 | .......... | .......... | E......... | P......... | .......... .......... ....N | .S.K....Y. | .......... |
| iPS:43 4233 | 21-225_61B3 | VK2/A18/JK4 | .......... | .......... | E......... | P.F....... | .......... .......... .I. | .S.Q...... | .......... |
| iPS:43 4303 | 21-225_58H11 | VK2/A18/JK4 | .......... | .......... | E......... | P....V.... | .......... .......... ....Y | .S.Q...... | .......... |
| iPS:43 5349 | 21-225_148F5 | VK2/A18/JK4 | F......... | .......... | E......... | P......... | .......... .........F ..Y.V | .S.Q...... | .......... |
| iPS:43 5359 | 21-225_148H10 | VK2/A18/JK4 | .......... | .......... | E......... | P......... | .......... .......... ..Y.V | .S.Q...... | .......... |
| iPS:43 5417 | 21-225_150D11 | VK2/A18/JK4 | .......... | .......... | E......... | P......... | .......... .......... ....Y | .Q........ | .......... |
| iPS:43 5469 | 21-225_153G9 | VK2/A18/JK4 | .......... | .......... | E......... | P......... | ........D. .......... ....N | .N.K....Y. | .......... |
| iPS:43 5733 | 21-225_173C11 | VK2/A18/JK4 | .......... | .......... | E......... | P......... | .......... .......... ....H | .S.-...QL. | .......... |
| iPS:43 5785 | 21-225_179C2 | VK2/A18/JK4 | .......... | .......... | .......... | P......... | .......... .......... ..... | .S.-...... | .......... |
| iPS:39 2618 | 21-225_16F10 | VK2/A18/JK4 | .I........ | H.N....... | .......... | P......... | .E........ .......V... ....Y | F.S.Q...QV | .......... |
| iPS:39 2860 | 21-225_22H8 | VK2/A18/JK4 | .......... | .......... | .......... | P......... | ....A..... .......A.I ....H | .S.Q...... | .......... |
| iPS:39 2888 | 21-225_25A2 | VK2/A18/JK4 | .N........ | F......... | .......... | P......... | ..A.L..... .......... ..I.N | .S.Q......S | .......... |
| iPS:39 2938 | 21-225_29H4 | VK2/A18/JK4 | .......... | .......... | E......... | P......... | .L........ .......... ..... | .STQ....F. | .......... |
| iPS:39 2994 | 21-225_26G11 | VK2/A18/JK4 | F......... | .T....G... | .......... | P.H....... | .......... .......I... ....N | .S.Q...H.F | ......R... |

Figure 52 (Continued)

| | | | K_FR1 | | | K_CDR1 | | K_FR2 | | K_CDR2 | K_FR3 | | | K_CDR3 | | K_FR4 |
|---|---|---|---|---|---|---|---|---|---|---|---|---|---|---|---|---|
| iPS:39 3012 | 21-225_26G7 | VK2|A18/ JK4 | .L.... | .... | E... | ...... | .... | P.F.... | .... | ...H.L | ...... | .... | ...... | ...S.Q | .... | ...... |
| iPS:39 3144 | 21-225_34D2 | VK2|A18/ JK4 | ...... | .... | .... | ...... | .... | .P..... | .... | ...N.. | ...... | .... | ...... | ..SK-- | .... | ...R.. |
| | | Germline | K_FR1 | | | K_CDR1 | | K_FR2 | | K_CDR2 | K_FR3 | | | K_CDR3 | | K_FR4 |
| | VK1|L1/JK3 | | DIQMTQSPSS LSASVGDRVTITC | | | RASQSIS NYLA | | WYQQKPGKAPKLLIY | | AASSLQS | GVPSRFSGSGSGTDFTLTISSLQPEDFATYYC | | | QQSYS TPPT | QLPP | FGQGTKVDIK |
| iPS:45 1143 | 21-225_66H11 | VK1|L1/ K3 | ...F.. | .... | .... | ...... | .... | ...... | P... | G..... | ..K... | F... | ...... | ...SC. | .... | ...H.. |
| iPS:46 8814 | 21-225_223D11 | VK1|L1/ K3 | ...... | .... | .... | ...... | .... | ...... | .... | FN..H. | ..K... | R... | N..... | ...SG. | .... | ...T.. |
| iPS:43 3901 | 21-225_43A4 | VK1|L1/ K3 | ...... | .... | .... | ......N | .... | ...N.. | .... | ...T.. | ....A. | .... | ...... | ...Y.. | .... | ...... |
| iPS:43 3961 | 21-225_45D9 | VK1|L1/ K3 | ...... | .... | .... | ......N | .... | ...N.. | .... | ...... | ....A. | .... | ...... | .H.Y.. | .... | ...... |
| iPS:43 4059 | 21-225_51C5 | VK1|L1/ K3 | ...... | .... | .... | ...... | .... | ...... | .... | ...E.. | ..Q... | .... | I..... | ...Y.. | .... | ...R.. |
| iPS:43 4085 | 21-225_52E3 | VK1|L1/ K3 | ...... | .... | .... | ...... | .... | ...N.. | .... | ...... | ..K... | .... | ...... | ...H.. | ..F. | ...... |
| iPS:43 4115 | 21-225_53E4 | VK1|L1/ K3 | ...... | .... | .... | ...V.. | .... | ...S.. | .... | ...... | ...... | .... | ...... | ...... | ..L. | ...R.. |
| iPS:43 4213 | 21-225_60A4 | VK1|L1/ K3 | ...... | .... | .... | V.K.V. | .... | V..... | .... | ...... | ..K... | .... | ...... | ...K.. | .... | ...... |
| iPS:43 4215 | 21-225_60F7 | VK1|L1/ K3 | ...... | .... | .... | ......T | .... | ...... | .... | ...T.T | ...... | .... | S..... | L.FH.. | .... | M..... |
| iPS:43 4261 | 21-225_56F7 | VK1|L1/ K3 | ..L... | .... | .... | ...... | .... | ...... | .... | ...... | ..K... | .... | ...... | H..... | F.K. | ...R..T |
| iPS:43 4331 | 21-225_63H8 | VK1|L1/ K3 | ...... | .... | .... | ...... | .... | ..H... | .... | ...... | ...... | .... | ...... | ...H.. | .... | ...R.. |
| iPS:43 4361 | 21-225_65D5 | VK1|L1/ K3 | ...... | .... | .... | ..D.N. | .... | ...R.. | .... | ...... | ..Q..A | ..S. | ...... | PL.K.. | .... | ...... |
| iPS:43 4405 | 21-225_68E6 | VK1|L1/ K3 | ...... | .... | .... | ...Y.. | .... | ...... | .... | ..R.V. | ...... | .... | ...... | ....D. | ..L. | ...R.. |
| iPS:43 5259 | 21-225_96C6 | VK1|L1/ K3 | ...... | .... | .... | ...... | .... | ...... | .... | ...... | ..K... | .... | I..... | H...D. | .... | ...... |
| iPS:43 5351 | 21-225_148B6 | VK1|L1/ K3 | ...S.. | .... | .... | ..K... | .... | ......F | .... | ...... | ..N... | .... | ...... | ...... | .... | ...... |
| iPS:43 5461 | 21-225_153A1 | VK1|L1/ K3 | ...... | .... | .... | ...V.. | .... | ...S.. | .... | ...... | ..K... | .... | ...... | ...H.. | ..F. | ...... |
| iPS:43 5509 | 21-225_157H1 | VK1|L1/ K3 | ...... | .... | .... | ..D..V | .... | ...R.. | .... | ...R.. | ..K... | .... | ...... | ...H.. | .... | ...F.. |

Figure 52 (Continued)

| | | | | | | | | |
|---|---|---|---|---|---|---|---|---|
| iPS:43 5515 | 21-225_157E4 | VK1|L1/J K3 | . | . | . | . | . Q | . | . |
| iPS:43 5523 | 21-225_157G5 | VK1|L1/J K3 | . F | . N | . R | . | . N | . | . |
| iPS:43 5535 | 21-225_157H10 | VK1|L1/J K3 | . | . T | . E | . | . Q | . | . |
| iPS:43 5559 | 21-225_158H12 | VK1|L1/J K3 | . | . N | . | . T | . K | . H | . |
| iPS:43 5575 | 21-225_159H11 | VK1|L1/J K3 | . | . K . V | . | . N | . S | . | . |
| iPS:43 5579 | 21-225_160G1 | VK1|L1/J K3 | . | . D . N | . | . T | . K | . H | . R |
| iPS:43 5585 | 21-225_160G3 | VK1|L1/J K3 | . | . D . N | . T | . S | . K | . H | . |
| iPS:43 5635 | 21-225_163F1 | VK1|L1/J K3 | . | . D | . R | . S | . K | . | . |
| iPS:43 5659 | 21-225_167D12 | VK1|L1/J K3 | . | . N | . | . | . K . A | . | . AQ |
| iPS:43 5679 | 21-225_169D10 | VK1|L1/J K3 | . | . D | . E | . | . K . F | . H | . |
| iPS:43 5685 | 21-225_170E1 | VK1|L1/J K3 | . E | . | . | . | . K | . H | . |
| iPS:43 5747 | 21-225_175C4 | VK1|L1/J K3 | . | . G | . | . G | . F . K | . Y | . |
| iPS:43 5765 | 21-225_177D3 | VK1|L1/J K3 | . S | . T | . | . I . T | . S . F | . G | . |
| iPS:43 5797 | 21-225_181G2 | VK1|L1/J K3 | . I . E | . | . | . | . K . D | . R.DT | . |
| iPS:43 5835 | 21-225_190F12 | VK1|L1/J K3 | . | . K | . | . | . K | . SN | . V |
| iPS:43 5861 | 21-225_190A5 | VK1|L1/J K3 | . | . H | . H | . V | . K . E | . LN | . V |
| iPS:43 5869 | 21-225_190B1 | VK1|L1/J K3 | . R | . R | . | . | . . G | . G | . R |
| iPS:43 5877 | 21-225_184E7 | VK1|L1/J K3 | . I . E | . | . I . T | . | . S . F . V.R | . G | . H |
| iPS:43 5883 | 21-225_185A1 | VK1|L1/J K3 | . | . | . | . T . V | . I . A | . | . |
| iPS:43 5885 | 21-225_185E10 | VK1|L1/J K3 | . I . E | . | . I . T | . | . S . F | . G | . |
| iPS:43 5891 | 21-225_188H5 | VK1|L1/J K3 | . I . E | . | . L . T | . | . S . F | . R . H | . |

Figure 52 (Continued)

| | | | | | | | | | |
|---|---|---|---|---|---|---|---|---|---|
| iPS:43 5897 | 21-225_188B9 | VK1|L1/J K3 | .I.E | . | . | .L....T | . | S.....F | . |
| iPS:43 5937 | 21-225_190H9 | VK1|L1/J K3 | . | . | .G | . | . | K...D | . |
| iPS:43 5961 | 21-225_192A2 | VK1|L1/J K3 | . | .N...N | . | . | . | . | . |
| iPS:43 5977 | 21-225_192E4 | VK1|L1/J K3 | . | . | .G | V.. | . | . | . |
| iPS:43 6001 | 21-225_192C10 | VK1|L1/J K3 | . | . | .G | V.. | . | K...D | R.DT |
| iPS:43 6039 | 21-225_193F8 | VK1|L1/J K3 | .I | . | .V..H | .R | . | K...A | . |
| iPS:43 6078 | 21-225_194H12 | VK1|L1/J K3 | . | .R | .G..H | . | . | K...D | R.DT |
| iPS:43 6140 | 21-225_197G3 | VK1|L1/J K3 | . | . | .G..H | . | . | K...R | .SN...V |
| iPS:43 6167 | 21-225_197E11 | VK1|L1/J K3 | . | . | .N..K.S | . | V. | S | . |
| iPS:43 6370 | 21-225_211A6 | VK1|L1/J K3 | .S | . | .G | . | .L | K...R..D..G | R.DT |
| iPS:43 6392 | 21-225_213B3 | VK1|L1/J K3 | . | . | .K | . | . | K...D | K.DT |
| iPS:43 6404 | 21-225_214C3 | VK1|L1/J K3 | . | . | .G | .S | .VL | K | . |
| iPS:43 6406 | 21-225_214E4 | VK1|L1/J K3 | . | . | .N | . | . | K...T | MT |
| iPS:43 7216 | 21-225_51D5 | VK1|L1/J K3 | .F | . | . | .E | .R | .I..Q | .LT..I |
| iPS:43 7224 | 21-225_56H1 | VK1|L1/J K3 | . | . | . | .Q.MS | .G | K | .Y |
| iPS:43 2620 | 21-225_17H5 | VK1|L1/J K3 | . | . | . | .N | . | K | .QN |
| iPS:39 2692 | 21-225_18G10 | VK1|L1/J K3 | . | . | .D..Y | .R | V. | K.G..F | L...H |
| iPS:39 2708 | 21-225_18D11 | VK1|L1/J K3 | . | .F | .Y | . | V. | K...F | .T..T |
| iPS:39 2714 | 21-225_16G12 | VK1|L1/J K3 | . | . | .D | . | . | K.R..S | .H..F |
| iPS:39 2746 | 21-225_20H7 | VK1|L1/J K3 | . | . | .N..V | . | . | N | .Y |
| iPS:39 2782 | 21-225_22B12 | VK1|L1/J K3 | . | . | .D | .H | G..R | K...L | .H |

Figure 52 (Continued)

| | | | | | | | | |
|---|---|---|---|---|---|---|---|---|
| iPS:39 2784 | 21-225_23C7 | VK1[L1/J K3 | | .G. | | | K | | |
| iPS:39 2802 | 21-225_23E7 | VK1[L1/J K3 | | .I. | .T. | | K | .FY | .N |
| iPS:39 2826 | 21-225_20B9 | VK1[L1/J K3 | | | .V | | K | .T | |
| iPS:39 2840 | 21-225_23G1 | VK1[L1/J K3 | | | | | Q | .F | |
| iPS:39 2842 | 21-225_23G8 | VK1[L1/J K3 | | .R. | | | Q | | |
| iPS:39 2880 | 21-225_20H9 | VK1[L1/J K3 | | .D. | .S | | N | | .I |
| iPS:39 2892 | 21-225_20C11 | VK1[L1/J K3 | | | .S | .R. | K | .H | |
| iPS:39 2950 | 21-225_25C10 | VK1[L1/J K3 | | .D. | | .T. | K.R | .F | |
| iPS:39 2952 | 21-225_26G1 | VK1[L1/J K3 | | | | | F.K | | .V |
| iPS:39 2962 | 21-225_30A1 | VK1[L1/J K3 | | .A. | .N | .G. | N | .H | |
| iPS:39 2976 | 21-225_27H12 | VK1[L1/J K3 | | | .S | | K | .N | |
| iPS:39 3090 | 21-225_33A5 | VK1[L1/J K3 | | .D. | .S | .G. | K | | |
| iPS:39 3120 | 21-225_35H8 | VK1[L1/J K3 | | .H.V | .F | | K | .H | .Y |
| iPS:39 3836 | 21-225_15A2 | VK1[L1/J K3 | .FI. | .A. | .F | .G | K | .F. | |
| iPS:39 3870 | 21-225_7B1 | VK1[L1/J K3 | .V | | .N | | PP. | .N | .N.N |
| iPS:39 3894 | 21-225_5E11 | VK1[L1/J K3 | | | .N | .V | Q | .Y | .F. |
| iPS:39 3896 | 21-225_2A4 | VK1[L1/J K3 | | | .R. | .T | I | | .Q |
| iPS:39 3914 | 21-225_16B8 | VK1[L1/J K3 | | .N. | .L.N | .V | K | .H | .F. |
| iPS:39 3968 | 21-225_5A5 | VK1[L1/J K3 | | | .S | | K | .H.H | |
| iPS:39 3992 | 21-225_14H8 | VK1[L1/J K3 | | .Y. | | .V. | K | | .V |
| iPS:39 4018 | 21-225_15B1 | VK1[L1/J K3 | | | .S | | N | .H | .N |

Figure 52 (Continued)

| | | Germline | K_FR1 | K_CDR1 | K_FR2 | K_CDR2 | K_FR3 | K_CDR3 | K_FR4 |
|---|---|---|---|---|---|---|---|---|---|
| iPS:39 4026 | 21-225_16C7 | VK1|L1/J K3 | | | | | K | | |
| iPS:39 4055 | 21-225_9C8 | VK1|L1/J K3 | | ...Y.. | ...S | ...V.. | ...K.. | ...D | |
| iPS:39 8482 | 21-225_17H6 | VK1|L1/J K3 | | RD. | | ...T.. | ...K...I | ...H | ...Q |
| iPS:39 8492 | 21-225_21F12 | VK1|L1/J K3 | | ...R. | | ...S | ...K.. | | |
| iPS:39 8500 | 21-225_23A11 | VK1|L1/J K3 | | F. | | ...S | ...K.. | ...F. | |
| iPS:39 8526 | 21-225_32B3 | VK1|L1/J K3 | T. | ..D.. | .R. | | ...T.. | | ...L |
| iPS:40 2235 | 21-225_20F10 | VK1|L1/J K3 | .I.. | .N.. | .R. | ...T.. | | ...F. | |
| | | | .L.. | | | | | ...F. | ...N |
| VK3jA27jJK1 | | Germline | EIVLTQSPGTLSLSPGERATLSC | RAS QSVSS SYLA | WYQQKPG QAPRLLIY | GASSRAT | GIPDRFSGSGSG TDFTLTISRLEPEDFAV YYC | QQYGSS SPWT | FGQGTK VEIK |
| iPS:46 8810 | 21-225_74D5 | VK3jA27/ JK1 | | .N.. | .R. | | .I. | .E | |
| iPS:46 8834 | 21-225_94G10 | VK3jA27/ JK1 | | .N.. | .R. | | .I. | .E | |
| iPS:46 8838 | 21-225_80E12 | VK3jA27/ JK1 | .C. | .N.. | .R..D. | | .I. | .E | |
| iPS:46 8820 | 21-225_76E10 | VK3jA27/ JK1 | .V. | .N...G | .R. | | .I. | .E | |
| iPS:46 3931 | 21-225_44F6 | VK3jA27/ JK1 | | | | | | | |
| iPS:43 4307 | 21-225_59B2 | VK3jA27/ JK1 | | W...Y.. | .F..S | | | .T | |
| iPS:43 4471 | 21-225_75G3 | VK3jA27/ JK1 | | .F.. | | | .F. | .ER | |
| iPS:43 4473 | 21-225_76D1 | VK3jA27/ JK1 | | .R..N.D.. | | | .F. | .E | |
| iPS:43 4495 | 21-225_74B2 | VK3jA27/ JK1 | | .NIY.. | .E.. | | ...V.. | .E | |
| iPS:43 4497 | 21-225_76A4 | VK3jA27/ JK1 | | .NIY.. | | | ...C. | .E | |
| iPS:43 4501 | 21-225_76G4 | VK3jA27/ JK1 | Y | ...Y.. | | | A...V.. | HSDN | |
| iPS:43 4507 | 21-225_74C5 | VK3jA27/ JK1 | | .N.. | | ...F.. | A.... | HSDN | |
| | | | | | | | NI. | .E | |

Figure 52 (Continued)

| | | | | | | | | | |
|---|---|---|---|---|---|---|---|---|---|
| iPS:43 4517 | 21-225_76A7 | VK3|A27/ JK1 | .A.. | | ....P..D.. | ..R. | | | .E. |
| iPS:43 4519 | 21-225_74C7 | VK3|A27/ JK1 | | | T...PN.D.. | | | | ..ER. |
| iPS:43 4523 | 21-225_75C3 | VK3|A27/ JK1 | ..Q. | | .R... | | | .F | .H.D. |
| iPS:43 4531 | 21-225_76C9 | VK3|A27/ JK1 | | | ...S | | | | --- |
| iPS:43 4533 | 21-225_85F7 | VK3|A27/ JK1 | .P. | | .NIY.. | | | | .E. |
| iPS:43 4547 | 21-225_74H5 | VK3|A27/ JK1 | | | .N... | .R. | | | .E. |
| iPS:43 4559 | 21-225_74D11 | VK3|A27/ JK1 | | | .N... | | | | ...RSR. |
| iPS:43 4561 | 21-225_77G1 | VK3|A27/ JK1 | ...Y | | ...Y.. | | A | | .H.DN. |
| iPS:43 4565 | 21-225_75B10 | VK3|A27/ JK1 | | | ...Y.. | | A | .C | .H.DN. |
| iPS:43 4571 | 21-225_74D2 | VK3|A27/ JK1 | | | .P..N.. | | | .F | .ED. |
| iPS:43 4579 | 21-225_77F7 | VK3|A27/ JK1 | ...Y | | ...N... | | .N | .F | .E. |
| iPS:43 4581 | 21-225_74B12 | VK3|A27/ JK1 | | | ...Y.. | ..L. | A | V.H..C | .H.DN. |
| iPS:43 4585 | 21-225_75A12 | VK3|A27/ JK1 | | | .R... | ..K..F | .S | A | .H.D. |
| iPS:43 4595 | 21-225_77A10 | VK3|A27/ JK1 | | | .R..H.. | | | | .H.D. |
| iPS:43 4611 | 21-225_77C12 | VK3|A27/ JK1 | | | .R..D.. | ..R. | .S | | .E. |
| iPS:43 4633 | 21-225_74G8 | VK3|A27/ JK1 | | | ..F. | | ...T | ..G | --- |
| iPS:43 4637 | 21-225_78E7 | VK3|A27/ JK1 | | | .A... | | | .F | ..ER. |
| iPS:43 4657 | 21-225_79G1 | VK3|A27/ JK1 | | | .N... | ...A. | .S | | ..NSR. |
| iPS:43 4663 | 21-225_79F3 | VK3|A27/ JK1 | ...Y | | ...Y.. | ...A. | .S | A | .H.DN. |
| iPS:43 4671 | 21-225_74F4 | VK3|A27/ JK1 | ...Y | .S. | .IF.. | | A | | ..SR. |

Figure 52 (Continued)

| | | | | | | | | | |
|---|---|---|---|---|---|---|---|---|---|
| iPS:43 4687 | 21-225_75A5 | VK3|A27/ JK1 | . . . . . . . . . . | . Y . . . . . . . . | . . . . . . . . . . | . . . . . . . . . . | . A . . . . . . . . | . H . DN . . . . . . | . . . . . . . . . . |
| iPS:43 4691 | 21-225_75G7 | VK3|A27/ JK1 | . . . . . . . . . . | . . . . . . . . . . | . R . . . D . . . . | . . . . . . . . . . | . . . . . . . . . . | . . E . . . . . . . | . . . . . . . . . . |
| iPS:43 4693 | 21-225_79F11 | VK3|A27/ JK1 | . . . . . . . . . . | . Y . . . . . . . . | . . . . . . . . . . | . . . . . . . . . . | . A . . . . . . . . | . HSDN . . . . . . | . . . . . . . . . . |
| iPS:43 4699 | 21-225_79G12 | VK3|A27/ JK1 | . . . . . . . . . . | . RY . . . . . . . | . . . . . . . . . . | . . . . . . . . . . | . A . . . . . C . . | . HSDN . . . . . . | . . . . . . . . . . |
| iPS:43 4701 | 21-225_80A1 | VK3|A27/ JK1 | . . . . . . . . . . | . Y . . . . . . . . | . . . . . . . . . . | . . . S . . . . . . | . A . . . V . C . . | . HSDN . . . . . . | . . . . . . . . . . |
| iPS:43 4703 | 21-225_80C1 | VK3|A27/ JK1 | . . . . . . . . . . | . Y . . . . . . . . | . . . . . . . . . . | . . . S . . . . . . | . A . . . V . C . . | . HSDN . . . . . . | . . . . . . . . . . |
| iPS:43 4709 | 21-225_80E3 | VK3|A27/ JK1 | . . . S . . . . . . | . Y . . . . . . . . | . . . . . . . . . . | . . . S . . . . . . | . A . . . V . C . . | . E . . . . . . . . | . . . . . . . . . . |
| iPS:43 4715 | 21-225_80D5 | VK3|A27/ JK1 | . L . . . K . V . . | . . . . . . . . . . | . NIY . . . . . . . | . . . . . . . . . . | . . . . . T . . . . | . E . . . . . . . . | . . . . . . . . . . |
| iPS:43 4717 | 21-225_80A6 | VK3|A27/ JK1 | . . . . . IP . . . | . . . . . . . . . . | . . . G . . . D . . | . . . P . . . . . . | . . . . . . . . . . | . E . . . . . . . . | . . . . . . . . . . |
| iPS:43 4725 | 21-225_80H7 | VK3|A27/ JK1 | . . . . . N . . . . | . . . . . . . . . . | . . . . . IN . . . | . . . . . . . . . . | . . . . . . . F . . | . E . . . . . . . . | . . . . . . . . . . |
| iPS:43 4735 | 21-225_80B10 | VK3|A27/ JK1 | . . . . . . . . . . | . Y . . . . . . . . | . . . D . . . . . . | . . . P . . . . . . | . . . . . . . . . . | . E . . . . . . . . | . . . . . . . . . . |
| iPS:43 4743 | 21-225_74A4 | VK3|A27/ JK1 | . . . . . . . . . . | . . . . . . . . . . | . . . . . . . . . . | . . . S . . . . . . | . A . . . . . C . . | . HSDN . . . . . . | . . . . . . . . . . |
| iPS:43 4751 | 21-225_80H12 | VK3|A27/ JK1 | . . . S . . . . . . | . Y . . . . . . . . | . . . . . . . . . . | . . . S . . . . . . | . A . . . V . C . . | . HSDN . . . . . . | . . . . . . . . . . |
| iPS:43 4759 | 21-225_81C5 | VK3|A27/ JK1 | . . . . . . . . . . | . . . . . . . . . . | . . . . . . . . . . | . . . S . . . . . . | . . . . . . . C . . | . HSDN . . . . . . | . . . . . . . . . . |
| iPS:43 4773 | 21-225_75D9 | VK3|A27/ JK1 | . . . . . . . . . . | . . . . . . . . . . | . . . R . . . . . . | . . . . . . . . . . | . . . . . . . . . . | . E . . . . . . . . | . . . . . . . . . . |
| iPS:43 4777 | 21-225_81C11 | VK3|A27/ JK1 | . . . V . . . . . . | . RY . . . . . . . | . Y . . . . . . . . | . . . . . . . . . . | . L . . . . . C . . | . HSDN . . . . . . | . . . . . . . . . . |
| iPS:43 4809 | 21-225_74F5 | VK3|A27/ JK1 | . . . . . . . . . . | . Y . . . . . . . . | . . . . . . . . . . | . . . S . . . . . . | . A . . . V . C . . | . HSDN . . . . . . | . . . . . . . . . . |
| iPS:43 4821 | 21-225_83G1 | VK3|A27/ JK1 | . . . . . . . . . . | . . . . . . . . . . | . . . . . . . . . . | . . . S . . . . . . | . VL . . . . . . . | . HSDN . . . . . . | . . . . . . . . . . |
| iPS:43 4835 | 21-225_83B6 | VK3|A27/ JK1 | . . . . . . . . . . | . . . . . . . . . . | . . . G . . . D . . | . . . TP . . . . . | . A . . . . . . . . | . E . . . . . . . . | . . . . . . . . . . |
| iPS:43 4839 | 21-225_83B7 | VK3|A27/ JK1 | . . . SV . . . . . | . RY . . . . . . . | . . . . . . . . . . | . . . S . . . . . . | . A . . . V . C . . | . HSDN . . . . . . | . . . . . . . . . . |
| iPS:43 4849 | 21-225_83C10 | VK3|A27/ JK1 | . . . . . . . . . . | . . . . . . . . . . | . . . N . . . P . H | . . . . . . . . . . | . I . . . . . . . . | . E . . . . . . . . | . . . . . . . . . . |

Figure 52 (Continued)

| | | | | | | | | | | |
|---|---|---|---|---|---|---|---|---|---|---|
| iPS:43 4869 | 21-225_84E12 | VK3JA27/ JK1 | . | . | .IN. | . | . | . | D..F | ..E |
| iPS:43 4879 | 21-225_85A3 | VK3JA27/ JK1 | . | F | ..N | .A. | .S | . | . | .H.DN |
| iPS:43 4881 | 21-225_85B4 | VK3JA27/ JK1 | . | F | .Y. | . | . | A | . | .H.DN |
| iPS:43 4887 | 21-225_85D6 | VK3JA27/ JK1 | .Q | F | .Y. | . | . | A | . | .H.D. |
| iPS:43 4891 | 21-225_85G6 | VK3JA27/ JK1 | .A | . | .R. | . | A.P | . | . | ..E |
| iPS:43 4895 | 21-225_74H7 | VK3JA27/ JK1 | .L | . | .P.D | . | . | . | V | ..E |
| iPS:43 4899 | 21-225_85B9 | VK3JA27/ JK1 | . | F | .NIY. | . | . | . | .C | ..E |
| iPS:43 4907 | 21-225_85G10 | VK3JA27/ JK1 | . | S | ..N | .R. | . | I I | . | . |
| iPS:43 4913 | 21-225_86C1 | VK3JA27/ JK1 | . | Y | .W. | .A. | . | . | . | ..E |
| iPS:43 4921 | 21-225_86E4 | VK3JA27/ JK1 | . | RY | ..G | . | . | A. | .F | .H.DN |
| iPS:43 4939 | 21-225_86C11 | VK3JA27/ JK1 | . | Y | .Y. | . | .S | A. | .C | .HSDN |
| iPS:43 4943 | 21-225_87H1 | VK3JA27/ JK1 | . | Y | ..D | . | . | L. | .C | . |
| iPS:43 4945 | 21-225_87E5 | VK3JA27/ JK1 | .F | Y | ..N | . | A.T | A. | .C | ..E |
| iPS:43 4955 | 21-225_87C9 | VK3JA27/ JK1 | .V | RY | .Y. | . | .S | A. | .S | .HSDN |
| iPS:43 4961 | 21-225_87A12 | VK3JA27/ JK1 | . | I | .Y. | . | .S | V.V.C | .HSDN |
| iPS:43 4969 | 21-225_88H1 | VK3JA27/ JK1 | . | RY | .Y. | . | .S | V.V.C | .HSDN |
| iPS:43 4981 | 21-225_88E7 | VK3JA27/ JK1 | . | Y | .Y. | . | . | V.V.C | .HSDN |
| iPS:43 4983 | 21-225_88F7 | VK3JA27/ JK1 | . | . | .Y. | . | .S | A.V.C | .HSDN |
| iPS:43 4995 | 21-225_88G9 | VK3JA27/ JK1 | . | RY | .Y. | . | .S | A. .C | .HSDN |
| iPS:43 4999 | 21-225_75A8 | VK3JA27/ JK1 | . | Y | .Y. | . | .S | A.V.C | .HSDN |
| iPS:43 5013 | 21-225_89D5 | VK3JA27/ JK1 | .S | Y | .Y. | . | .S | A. | . | .H.DN |

Figure 52 (Continued)

| ID | Clone | V/J | | | | | | | | | |
|---|---|---|---|---|---|---|---|---|---|---|---|
| iPS:43 5015 | 21-225_89H5 | VK3|A27/JK1 | . | . | N. | . | . | N.I..V. | . | E...V. | . |
| iPS:43 5025 | 21-225_89E10 | VK3|A27/JK1 | Y | .S | . | . | .S | V. | A...V | HSDN | . |
| iPS:43 5029 | 21-225_89A11 | VK3|A27/JK1 | . | . | NF. | D. | .A.T | . | . | .EI | . |
| iPS:43 5039 | 21-225_90G4 | VK3|A27/JK1 | Y | . | . | Y | .S | V...V..C | HSDN | . | . |
| iPS:43 5041 | 21-225_90A5 | VK3|A27/JK1 | Y | . | . | Y | . | A. | V.H | H.DN | . |
| iPS:43 5043 | 21-225_90G5 | VK3|A27/JK1 | Y | . | . | Y | .I | A. | V.H | H.DN | . |
| iPS:43 5055 | 21-225_90F10 | VK3|A27/JK1 | Y | . | . | Y | .S | A. | V.H | HSDN | . |
| iPS:43 5073 | 21-225_91B2 | VK3|A27/JK1 | Y | . | . | Y | .A..S | A. | V...C | H.DN | . |
| iPS:43 5075 | 21-225_91B3 | VK3|A27/JK1 | Y | . | . | Y | .S | A. | V.H.C | H.DN | . |
| iPS:43 5077 | 21-225_91F3 | VK3|A27/JK1 | Y | . | . | Y | .A..S | A. | V...C | HSDN | . |
| iPS:43 5079 | 21-225_91B4 | VK3|A27/JK1 | Y | . | . | Y | .I..S | A. | V...C | H.DN | . |
| iPS:43 5089 | 21-225_91E9 | VK3|A27/JK1 | Y | . | . | Y | . | A. | V.H.C | HSDN | . |
| iPS:43 5097 | 21-225_92B1 | VK3|A27/JK1 | Y | . | .N. | G. | .R. | D. | ...C | .E. | . |
| iPS:43 5111 | 21-225_92D6 | VK3|A27/JK1 | Y | . | . | Y | .S | V. | ...C | HSDN | . |
| iPS:43 5115 | 21-225_77C5 | VK3|A27/JK1 | Y | . | . | Y | .S | A. | . | H.D | . |
| iPS:43 5171 | 21-225_93C2 | VK3|A27/JK1 | Y | . | . | Y | .T..P | . | . | . | . |
| iPS:43 5177 | 21-225_93E4 | VK3|A27/JK1 | Y | . | . | Y | . | . | H.C | H.DN | . |
| iPS:43 5183 | 21-225_93E9 | VK3|A27/JK1 | .Q | . | . | D. | . | A. | V. | .E. | . |
| iPS:43 5195 | 21-225_94D3 | VK3|A27/JK1 | Y | . | .R. | . | . | . | . | H.D | . |
| iPS:43 5217 | 21-225_94F12 | VK3|A27/JK1 | F | . | . | Y | .S | A. | . | H.DN | .NQ |
| iPS:43 5219 | 21-225_95D2 | VK3|A27/JK1 | Y | . | . | Y | . | A. | ...C | H.DN | . |

Figure 52 (Continued)

| | | | | | | | | | |
|---|---|---|---|---|---|---|---|---|---|
| iPS:43 5235 | 21-225_95F9 | VK3JA27/ JK1 | . . . . . . . . . . . . . . . Y . . . | . . . . . . . . . . . . . . . . . . . . | . . . . . . . . . . . . . . . . . . . . | . . . . . . . . . . . . . . A . . . . . | . . . . . . . . . H.DN | . . . . . . . . . . . . . . . . . . . . |
| iPS:43 5237 | 21-225_95G9 | VK3JA27/ JK1 | . . . . . . . S . . . . . . . Y . . . | . . . . . . . . . . . . . . . . . . . . | . . . . . . . . . . . . . . . . . . . . | . . A . . . . . V . H . C . . . . . . | . . . . . . . . . H.DN | . . . . . . . . . . . . . . . . . . . . |
| iPS:43 5239 | 21-225_95H10 | VK3JA27/ JK1 | . . . . . . . S . . . . . I . Y . . . | . . . . . . . . . . . . . . . . . . . . | . . . . . . . . . . . . . . . . . . . . | . . . . . . . . . . . . . . . . . . . | . . . . . . . . . H.DN | . . . . . . . . . . . . . . . . . . . . |
| iPS:43 5273 | 21-225_97A2 | VK3JA27/ JK1 | . . . . . . . S . . . . . . . Y . . . | . . . . . . . . . . . . . . . . . . . . | . . . . . . . . . . . . . . . . . . . . | . . A . . . . . . . . . C . . . . . . | . . . . . . . . . HSDN | . . . . . . . . . . . . . . . . . . . . |
| iPS:43 5281 | 21-225_97E5 | VK3JA27/ JK1 | . . . . . . . . . . . . . . . Y . . . | . . . . . . . . . . . . . . . . . . . . | . . . . . . . . . . . . . . . . . . . . | . . A . . . . . V . . . C . . . . . . | . . . . . . . . . HSDN | . . . . . . . . . . . . . . . . . . . . |
| iPS:43 5331 | 21-225_147G8 | VK3JA27/ JK1 | . . . . . . Q . . . . . . . . . . . . | . . . . . . . . . . . . . . . . RIF. . | . . . . . . . I . . . . . . . . . . . | . . . . . . . . . I . T . . . . . . . | . . . . . . . . . D . . . | . . . . . . . . . . . . . . . . . . N . |
| iPS:43 5815 | 21-225_190G10 | VK3JA27/ JK1 | . . . . . . . . . . . . . . . . . . . | . . . . . . . . . . . . . . . . . P . . | . . . . . . . . . . . . . . . . . . . | . . . . . . . . . . . . . . . . . . . | . . . . . . . . . . . SP . | . . . . . . . . . . . . . . . . . . . . |
| iPS:43 5843 | 21-225_191F1 | VK3JA27/ JK1 | . . . . . . . . . . . . . . . . . . . | . . . . . . . . . . . . . . . . . RF. . | . . . . . . . . . . . . . I . L . . . | . . . . . . . . . N . . . . . . . . . | . . . . . . . . . . . . . | . . . . . . . . . . . . . . . . . . . V |
| iPS:43 5847 | 21-225_191A3 | VK3JA27/ JK1 | . . . . . . . . . . . . . A . . . . . | . . . . . . . . . . . . . . . . . NF. . | . . . . . . . . . . . . . . . . . . . | . . . . . . . . . N . . . . . . . . . | . . . . . . . . . R . . . | . . . . . . . . . . . . . . . . . . . V |
| iPS:43 5849 | 21-225_191C3 | VK3JA27/ JK1 | . . . . . . . . . . . . . . . . . . . | . . . . . . . . . . . . . . . . . IR. . | . . . . . . . . . . . . . . . . . . . | . . . . . . . . . . . . . . . . . . . | . . . . . . . . . N . . . | . . . . . . . . . . . . . . . . . . . . |
| iPS:43 5851 | 21-225_191D3 | VK3JA27/ JK1 | . . . . . . . . . . . . . . . . . . . | . . . . . . . . . . . . . . . . . IR. . | . . . . . . . . . . . . . . . F . . . | . . . . . . . . . . . . . . . . . . . | . . . . . . . . . N . . . | . . . . . . . . . . . . . . . . . . . . |
| iPS:43 5865 | 21-225_191A5 | VK3JA27/ JK1 | . . . . . . . S . . . . . . . . . . . | . . . . . . . . . . . . . . G . . . IRT. | . . . . . . . . . . . . . Q . . . . . | . . . . . . . . . . . . . . . . . . . | . . . . . . . . . . . . A | . . . . . . . . . . . . . . . . . . . . |
| iPS:43 5905 | 21-225_190A3 | VK3JA27/ JK1 | . . . . . . . . . . . . . . . . . . . | . . . . . . . . . . . . . . . . . NF. . | . . . . . . . . . . . . . . . . . . . | . . . . . . . . . N . . . . . . . . . | . . . . . . . . . G . . . | . . . . . . . . . . . . . . . . . . . V |
| iPS:43 5911 | 21-225_190B4 | VK3JA27/ JK1 | . . . . . . . M . . . . . . . . . . . | . . . . . . . . . . . . . . . . . RF. . | . . . . . . . . . . . . . . . . . . . | . . . . . . . . . V . . . . . . . . . | . . . . . . . . . . . SP . | . . . . . . . . . . . . . . . . . . . . |
| iPS:43 5913 | 21-225_190A7 | VK3JA27/ JK1 | . . . . . . . . . . . . . . . . . . . | . . . . . . . . . . . . . . . . . NIR. | . . . . . . . H . . . . . . . YR . . | . . . . . . . . . N . . . . . . . . . | . . . . . . . . . N . . A | . . . . . . . . . . . . . . . . . . . . |
| iPS:43 5939 | 21-225_191H7 | VK3JA27/ JK1 | . . . . . . . S . . . . . . . . . . . | . . . . . . . . . . . . . . . . . IR. . | . . . . . . . . . . . . . . . . R . . | . . . . . . . . . . . . . . . . . . . | . . . . . . . . . G . . . | . . . . . . . . . . . . . . . . . . . . |
| iPS:43 5967 | 21-225_192B3 | VK3JA27/ JK1 | . . . . . . . . . . . . . . . . . . . | . . . . . . . . . . . . . . G . . . IRT. | . . . . . . . Q . . . . . . . . . . . | . . . . . . . . . . . . . . . . . . . | . . . . . . . . . N . . . | . . . . . . . . . . . . . . . . . . . . |
| iPS:43 5973 | 21-225_192H3 | VK3JA27/ JK1 | . . . . . . . . . . . . . . . . . . . | . . . . . . . . . . . . . . . . . DF. . | . . . . . . . . . . . . . . . . R . . | . . . . . . . . . . . . . . . P . . . | . . . . . . . . . N . . . | . . . . . . . . . . . . . . . . . . . . |
| iPS:43 5995 | 21-225_192F8 | VK3JA27/ JK1 | . . . . . . . . . . . . . . . . . . . | . . . . . . . . . . . . . . . . . NF. . | . . . . . . . . . . . . . I . . . . . | . . . . . . . . . . . . . . . . . F . | . . . . . . . . . N . . . | . . . . . . . . . . . . . . . . . . N . |
| iPS:43 6007 | 21-225_192G12 | VK3JA27/ JK1 | . . . . . . . . . . . . . . . . . . . | . . . . . . . . . . . . . . . . . DF. . | . . . . . . . L . . . . . . . V R . . | . . . . . . . . . . . . . . . . . . . | . . . . . . . . . I . . . | . . . . . . . . . . . . . . . . . . . . |
| iPS:43 6009 | 21-225_193A1 | VK3JA27/ JK1 | . . . . . . . . . . . . . . . . . . . | . . . . . . . . . . . . . . . . . NF. . | . . . . . . . H . . . . . . . . R . . | . . . . . . . . . A . . . . . . . . . | . . . . . . . . . E . . . | . . . . . . . . . . . . . . . . . . . . |

Figure 52 (Continued)

| | | | | | | | | | |
|---|---|---|---|---|---|---|---|---|---|
| iPS:43 6011 | 21-225_193B1 | VK3JA27/ JK1 | . . . . . . . . . . | . . . D . . . . . . | . . . . . R . . . | . H . . . . . . . . | . . . . . . . . . . | . . . . . . . . . . | . . . . . . . . . . | . . . . . . . . . . |
| iPS:43 6015 | 21-225_193D3 | VK3JA27/ JK1 | . . . . . . . . . . | . . . . . . . . . . | . . . NF . . . IR . . | . . . . . . . . . . | . . . . R . . . . . | . . N . . F . . . . | . . . N . . . . . . | . . . . . . . . . . |
| iPS:43 6017 | 21-225_193F3 | VK3JA27/ JK1 | . . . . . . . . . . | . . . . . . . . F . | . . . . F . . . . . | . . . . . . . . . . | . . . . N . . . . . | . . . . . . . . . . | . . . . . A . . . . | . . . . N . . . . . |
| iPS:43 6027 | 21-225_193E6 | VK3JA27/ JK1 | . . . . . . . . . . | . . . A . . . . . . | . . G . . . IRT . . . DF.V | . . . Q . . . . . . | . F.E. . . . . . . | . . . . . . . . . . | . . . . . . . . . . | . . . . . . . . . . |
| iPS:43 6029 | 21-225_193H6 | VK3JA27/ JK1 | . . . . . . . . . . | . . . S . . . . . . | . . G . . . . R . . | . . . . . . . . . . | . . . . G . . . . . | . . . . . . . . . . | . . . . E . . . . . | . . . . . . . . . . |
| iPS:43 6035 | 21-225_193C8 | VK3JA27/ JK1 | . . . . . . . . . . | . . . S . . . . . F | . . . . . . . IRT . . | . . . Q . . . . . . | . . . . . . . . . . | . . . . N . . F . . | . . . . N . . . . . | . . . . . A . . . . |
| iPS:43 6037 | 21-225_193D8 | VK3JA27/ JK1 | . . . . . . . . . . | . . . K . . . . . F | . . . . . F . . . . | . . . . . . . . . . | . . . . N . . . . . | . . . . . . . . . . | . . . . N . . . . . | . . . . . . . . I . |
| iPS:43 6041 | 21-225_193G8 | VK3JA27/ JK1 | . . . . . . . . . . | . . . . . . . . . . | . . . . . . . IRT . . | . H . . . . . . . . | . . . . . R . . . . | . . . . . . . L . . | . . . . N . . . . . | . . . . . . . . V . |
| iPS:43 6047 | 21-225_193B10 | VK3JA27/ JK1 | . . . . . . . . . . | . . . . . . . . . . | . . . . . . . . RT . . | . . . . . . . . . . | . . . . . R . . . . | . . . . . . . . . . | . . . . . . . . . . | . . . . . . . . . . |
| iPS:43 6049 | 21-225_193B12 | VK3JA27/ JK1 | . . . . . . . . . . | . . . . . . . . . . | . . . . . P . . . . | . . . V . . . . . . | . . D . . . . . . . | . . . . . . . . . . | . . . . . . . . . . | . . . . . . SP . . . |
| iPS:43 6062 | 21-225_194E5 | VK3JA27/ JK1 | . . . . . . . . . . | . . . S . . . . . . | . . G . . . IRT . . . | . . . . . . . . . . | . . . . . . . . . . | . . . . . K . . . . | . . . . N . . . . . | . . . . . A . . . . |
| iPS:43 6064 | 21-225_194E6 | VK3JA27/ JK1 | . . . . . . . . . . | . . . . . . . . . . | . . . . . . . IR . . . | . . . . . . . . . . | . . . . . . . . . . | . . . . . V . . . . | . . . . N . . . . . | . . . . . . . . . . |
| iPS:43 6072 | 21-225_194C10 | VK3JA27/ JK1 | . . . . . . . . . . | . . . . . . . . . . | . . . . . P . . N . . | . T . . . F . . . . | . . . . N . . . . . | . . . . . A . . A . | . . . . N . . . . . | . . . . . . . . . . |
| iPS:43 6080 | 21-225_195B1 | VK3JA27/ JK1 | . . . . . . . . . . | . . . S . . . . . . | . . . . . P . . N . . | . T . . . . . . . . | . . . . . V . . R . | . . . . . A . . A . | . . . . E . . . . . | . . . . . . . . . . |
| iPS:43 6088 | 21-225_195C8 | VK3JA27/ JK1 | . . . . . . . . L . | . . . . . . . . . . | . . . . . G . . . . | . . . . . . . . . . | . . . . . . . . . . | . . . . . . . . F . | . . . . E . . . . . | . . . . . . . . . . |
| iPS:43 6122 | 21-225_196G10 | VK3JA27/ JK1 | . . . . . . . . . . | . . . . . . . . . F | . . . . . P . . . N | . . . . . . . . . . | . . . . . F . . . . | . . . . . . . . . . | . . . . N . . . . . | . . . . . . SP . . . |
| iPS:43 6134 | 21-225_196H12 | VK3JA27/ JK1 | . . . . . . . . . . | . . . G . . . . . . | . . . . . . . R . . | . H . . . . . . . . | . . . YR . . . . . . | . . . . . . . . . . | . . . . N . . . . . | . . . . . A . . . . |
| iPS:43 6146 | 21-225_197F4 | VK3JA27/ JK1 | . . . . . . . . . . | . . . . . . . . . . | . . . . NF . . . . . | . . . L . . . . . . | . . . . . . . . . . | . . . . . . . . . . | . . . . . . . . . . | . . . . . . . . . . |
| iPS:43 6177 | 21-225_198B1 | VK3JA27/ JK1 | . . . . . . . . . . | . . . S . . . . . . | . . G . . . IRT . . . | . . . Q . . . . . . | . . . . . . . . . . | . . . . . . . . . . | . . . . N . . . . . | . . . . . . . . . . |
| iPS:43 6179 | 21-225_198E1 | VK3JA27/ JK1 | . . . . . . . . . . | . . . . . . . . . . | . . . . NF . . . . . | . . . . . . . . . . | . . . . . . . . . F | . . . . . . . . F . | . . . . N . . . . . | . . . . . . . . L . |
| iPS:43 6181 | 21-225_198C2 | VK3JA27/ JK1 | . . . . . . . . . . | . . V . . . . . . L | . YSE . S . . . . R . . | . . . . C . . . . . | . . . . F . . . S | . . . . . . . . . . | . . . . . . . . . . | . . . . L.HA. . . . |

Figure 52 (Continued)

| | | | | | | | | |
|---|---|---|---|---|---|---|---|---|
| iPS:43 6195 | 21-225_198G10 | VK3JA27/ JK1 | ........ | ...... | .IR.. | ...... | ...... | .N.. | ...... |
| iPS:43 6197 | 21-225_199C2 | VK3JA27/ JK1 | ........ | ...... | .IR.. | .F... | .N... | .N.. | ..A. |
| iPS:43 6207 | 21-225_199C7 | VK3JA27/ JK1 | ........ | ...... | .IRT. | .F... | ...... | ...... | ..A. |
| iPS:43 6210 | 21-225_199G11 | VK3JA27/ JK1 | ..V... | ...... | .NF.. | ...... | .N... | .N.. | ...... |
| iPS:43 6226 | 21-225_200F10 | VK3JA27/ JK1 | ........ | ...... | ..R.. | .F... | ...... | ...... | ...... |
| iPS:43 6232 | 21-225_201E1 | VK3JA27/ JK1 | ........ | ...D.. | .NIR. | ...... | ...... | ...... | ..A. |
| iPS:43 6238 | 21-225_201B2 | VK3JA27/ JK1 | ........ | ...... | .F... | .P.IN. | .N... | H.ET | ...... |
| iPS:43 6256 | 21-225_202D9 | VK3JA27/ JK1 | ........ | ...... | ..GF.. | ..R.. | ..MFH. | ..EN. | ...... |
| iPS:43 6302 | 21-225_205G7 | VK3JA27/ JK1 | ........ | ...D.. | ..N... | ..V.. | ..F... | ..ET. | ...... |
| iPS:43 6310 | 21-225_202D11 | VK3JA27/ JK1 | ........ | ...... | ..N... | S..... | ..H... | ..E.. | ...... |
| iPS:43 6336 | 21-225_208B5 | VK3JA27/ JK1 | ........ | ...... | ..G... | ..F... | .N.... | H.EN. | ...... |
| iPS:43 6340 | 21-225_208A9 | VK3JA27/ JK1 | ........ | ...... | ..N... | ..IN.R.. | ...... | H.H.. | ...... |
| iPS:43 6472 | 21-225_220E1 | VK3JA27/ JK1 | ........ | ...... | ..N... | ..V... | ...... | ..EN. | ...... |
| iPS:43 6506 | 21-225_222C7 | VK3JA27/ JK1 | ........ | ...... | ..I.R. | .N.V... | ...... | ..F... | ...... |
| iPS:43 6580 | 21-225_225E7 | VK3JA27/ JK1 | ........ | ...... | ..H.V. | ..L... | ..T... | ...... | ...... |
| iPS:43 7324 | 21-225_75C2 | VK3JA27/ JK1 | ........ | .RY.. | ..N... | ...... | ...RS. | ..ED. | ..R.. |
| iPS:43 7328 | 21-225_75D3 | VK3JA27/ JK1 | ........ | ..Y... | ..Y... | ...... | ..A... | ..G... | ...... |
| iPS:43 7332 | 21-225_75F3 | VK3JA27/ JK1 | ........ | ..Y... | ..Y... | ..I... | ..S... | ..TI.. | ...... |
| iPS:43 7340 | 21-225_75G9 | VK3JA27/ JK1 | ..A.... | ..Y... | ..Y... | ...... | A.....C | ..T... | ...... |
| iPS:43 7344 | 21-225_75G12 | VK3JA27/ JK1 | ........ | ...... | .P.D.. | .P... | A..V.H.C | H.DN. | ...... |
| iPS:43 7350 | 21-225_74A3 | VK3JA27/ JK1 | ........ | ..Y... | ..Y... | S..... | A....H | ..E.. | ...... |
| | | | | | | | A..V..C | H.DN. | ...... |
| | | | | | | | A..... | HSDN. | ...... |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 7369 | 21-225_74D6 | VK3|A27/ JK1 | .................... | .........Y... | ............ | ........ | ...........A........C...... | H.DN..... | ....... |
| iPS:43 7383 | 21-225_74H8 | VK3|A27/ JK1 | .................... | .........F... | ............ | ........ | ............................ | .......SR. | ....... |
| iPS:45 1122 | 21-225_200A1 | VK3|A27/ JK1 | ..........I......... | ....N....N... | ......R..... | ........ | .....C.L..........C......... | ....EI.... | ...S.. |
| iPS:39 2864 | 21-225_23B9 | VK3|A27/ JK1 | .........Y.......... | .....N.Y..... | ....S....T.. | ........ | ............................ | ......R... | ....... |
| Germline | | VK1|A30/JK4 | DIQMTQSPSS LSASVGDRVTITC | RAS QGI NNG | WYQQKPG KAPKLLIY | AASSLQS | GVPSRFSGSGS GTDFTLTISSLQPEDFAT YYC | QQYNS YPLT | FGGGTK VEIK |
| iPS:46 8812 | 21-225_48H4 | VK1|A30/ JK4 | .........F.......... | ...RD........ | ............ | ........ | ............................ | ........ | ....... |
| iPS:46 8824 | 21-225_73G6 | VK1|A30/ JK4 | .................... | ............. | ............ | ........ | ............................ | ...Y.... | ....... |
| iPS:46 8818 | 21-225_190C8 | VK1|A30/ JK4 | .................... | ............. | ............ | ........ | ................E........... | ....D... | ....... |
| iPS:46 8840 | 21-225_200H9 | VK1|A30/ JK4 | .................... | ............. | ............ | ........ | .....I...................... | ........ | ....... |
| iPS:46 8868 | 21-225_74A1 | VK1|A30/ JK4 | .................... | ...T......... | ............ | ........ | ............................ | ....D... | ....A. |
| iPS:39 2920 | 21-225_29G4 | VK1|A30/ JK4 | .................... | ............. | ............ | ........ | ............................ | ........ | ....T. |
| iPS:43 3899 | 21-225_43C3 | VK1|A30/ JK4 | .................... | ............. | ............ | ......G. | ...........G................ | ....S... | ..G.T |
| iPS:43 3921 | 21-225_44C3 | VK1|A30/ JK4 | .................... | ............. | ............ | ........ | ............................ | ........ | ....... |
| iPS:43 3947 | 21-225_44E12 | VK1|A30/ JK4 | .................... | ............. | ............ | ........ | ............................ | ........ | ....... |
| iPS:43 3963 | 21-225_46B1 | VK1|A30/ JK4 | .................... | ............. | ............ | ........ | .....S...................... | ........ | ....... |
| iPS:43 3969 | 21-225_46F3 | VK1|A30/ JK4 | .................... | .....K....... | ............ | ........ | ............................ | ........ | ....T. |
| iPS:43 3975 | 21-225_46C6 | VK1|A30/ JK4 | .................... | ............. | ............ | ........ | .....S...................... | ...S.... | ....... |
| iPS:43 3977 | 21-225_46D8 | VK1|A30/ JK4 | .................... | .....K...D... | ............ | ........ | ............................ | ........ | ....... |
| iPS:43 3983 | 21-225_47A1 | VK1|A30/ JK4 | .................... | ............. | ............ | .....F.. | .....................R...... | ........ | ....... |
| iPS:43 3987 | 21-225_47A5 | VK1|A30/ JK4 | .................... | ............. | ............ | ........ | ............................ | ........ | ....... |

| ID | Clone | V/J | | | | | | | |
|---|---|---|---|---|---|---|---|---|---|
| iPS:43_4503 | 21-225_74D7 | VK1|A30/JK4 | . | . | . | . | . F | ...SN | . |
| iPS:43_5251 | 21-225_96A3 | VK1|A30/JK4 | . | . | . | . | . | ...SN | . |
| iPS:43_5293 | 21-225_146F1 | VK1|A30/JK4 | . | . | . T | . G . R | . H | ...ST | . |
| iPS:43_5311 | 21-225_146H9 | VK1|A30/JK4 | . | . | . | . . . G | . | . | . |
| iPS:43_5313 | 21-225_146G11 | VK1|A30/JK4 | . D . NF. | . | . | . . L . | . | . D . | . |
| iPS:43_5361 | 21-225_148E11 | VK1|A30/JK4 | . | . S | . | . T | . | . RM | . |
| iPS:43_5363 | 21-225_148F12 | VK1|A30/JK4 | . A . | . | . | . F . V . | . F | . | . I |
| iPS:43_5367 | 21-225_149G1 | VK1|A30/JK4 | . . A | . F | . | . | . | . | . |
| iPS:43_5377 | 21-225_149G5 | VK1|A30/JK4 | . A . | . | . N | . | . | . | . |
| iPS:43_5397 | 21-225_149F12 | VK1|A30/JK4 | . | . | . | . L . | . I | . | . |
| iPS:43_5407 | 21-225_150E7 | VK1|A30/JK4 | . I . F.F | . M . I . | . | . | . A | . | . |
| iPS:43_5449 | 21-225_152H9 | VK1|A30/JK4 | . | . | . R | . F | . T | . | . |
| iPS:43_5499 | 21-225_156G1 | VK1|A30/JK4 | . P . | . t | . | . F | . C . S | . V . | . Q . S . |
| iPS:43_5549 | 21-225_158H5 | VK1|A30/JK4 | . | . | . | . V . R . | . | ..SN | . |
| iPS:43_5587 | 21-225_160H3 | VK1|A30/JK4 | . | . G | . | . N | . | ..SN | . |
| iPS:43_5599 | 21-225_160B10 | VK1|A30/JK4 | . | . F | . | . | . | . S . | . |
| iPS:43_5663 | 21-225_169B1 | VK1|A30/JK4 | . | . E . | . E | . . G | . | . Y . | . |
| iPS:43_5669 | 21-225_169F9 | VK1|A30/JK4 | . | . H . | . | . | . | . Y | . |
| iPS:43_5693 | 21-225_170G4 | VK1|A30/JK4 | . | . H . | . N | . | . | . Y | . |
| iPS:43_5695 | 21-225_170D5 | VK1|A30/JK4 | . | . | . | . | . | . Y | . F . |
| iPS:43_5697 | 21-225_170G5 | VK1|A30/JK4 | . T . | . F . | . T | . | . | . Y | . |

Figure 52 (Continued)

| ID | V/J | | | | | | | | | | | |
|---|---|---|---|---|---|---|---|---|---|---|---|---|
| iPS:43_5703 | 21-225_170D11 | VK1(A30)/JK4 | . | . | . | . | . | . | . | . | Y. | . | ..R |
| iPS:43_5705 | 21-225_171C3 | VK1(A30)/JK4 | . | . | F. | T. | . | . | . | . | .Y. | .F. | . |
| iPS:43_5709 | 21-225_171A4 | VK1(A30)/JK4 | . | t. | . | . | . | . | . | . | .Y. | . | . |
| iPS:43_5721 | 21-225_172B3 | VK1(A30)/JK4 | . | . | . | . | . | . | . | . | .Y. | . | . |
| iPS:43_5725 | 21-225_172G8 | VK1(A30)/JK4 | . | .V. | .G. | .E. | . | .G. | . | . | .HY. | . | . |
| iPS:43_5735 | 21-225_173H12 | VK1(A30)/JK4 | . | . | . | T. | N. | . | . | . | .Y. | .F. | . |
| iPS:43_5743 | 21-225_175G1 | VK1(A30)/JK4 | . | t. | . | T. | . | .S. | . | . | .Y. | .F.N. | . |
| iPS:43_5761 | 21-225_176B11 | VK1(A30)/JK4 | . | . | F. | . | . | . | .L. | . | .Y. | . | . |
| iPS:43_5779 | 21-225_178B10 | VK1(A30)/JK4 | . | . | .H. | .N. | . | . | . | . | .RY. | .F. | . |
| iPS:43_6023 | 21-225_193A5 | VK1(A30)/JK4 | .F. | .I.S. | .Y.V. | . | . | .I.V.E. | .F. | . | .D. | .F.F. | . |
| iPS:43_6033 | 21-225_193E7 | VK1(A30)/JK4 | . | . | . | .S. | R. | . | . | . | KR. | . | . |
| iPS:43_6120 | 21-225_196C10 | VK1(A30)/JK4 | . | . | . | . | . | . | . | . | .Y. | . | . |
| iPS:43_6199 | 21-225_199E3 | VK1(A30)/JK4 | . | . | . | .S. | R. | . | . | . | KR. | . | . |
| iPS:43_6228 | 21-225_200F12 | VK1(A30)/JK4 | . | . | R.S. | .HT. | . | . | . | . | . | . | . |
| iPS:43_6230 | 21-225_201A1 | VK1(A30)/JK4 | .E. | . | .S. | .I.R. | . | . | . | . | .K. | . | . |
| iPS:43_6242 | 21-225_201A10 | VK1(A30)/JK4 | .S. | . | R.S. | .T.H. | . | . | . | . | .K. | . | . |
| iPS:43_6286 | 21-225_204H8 | VK1(A30)/JK4 | . | . | .S. | . | . | . | .R. | . | . | . | . |
| iPS:43_6308 | 21-225_205H8 | VK1(A30)/JK4 | . | . | .Q.L. | .S.F.R. | . | .V. | .S.A. | . | . | . | .T.K. |
| iPS:43_6526 | 21-225_224A1 | VK1(A30)/JK4 | . | . | . | . | . | . | . | . | . | . | .V. |
| iPS:43_6528 | 21-225_224B1 | VK1(A30)/JK4 | .D. | . | . | . | . | . | .H. | . | . | .P. | . |
| iPS:43_6538 | 21-225_224C3 | VK1(A30)/JK4 | . | . | .I. | . | . | . | . | . | . | . | . |

Figure 52 (Continued)

| ID | Germline | | | | | | | | |
|---|---|---|---|---|---|---|---|---|---|
| iPS:43 6656 | 21-225_22AD10 | VK1\|A30/ JK4 | .L. | .... | .... | .... | .... | .... | .... |
| iPS:43 7220 | 21-225_55H6 | VK1\|A30/ JK4 | .... | .... | .... | .... | .A. | RD. | ...F |
| iPS:43 7346 | 21-225_75H7 | VK1\|A30/ JK4 | .RY NS | .... | S.Q. | .D. | .GV | I..SN | .... |
| iPS:47 2730 | 21-225_14B1_L C1 | VK1\|A30/ JK4 | .Y. | .D. DN. | .... | T.Y. | .V. | YN | .... |
| iPS:39 2622 | 21-225_17H8 | VK1\|A30/ JK4 | .... | .... | .... | G.. | .... | .... | .... |
| iPS:39 2624 | 21-225_17H12 | VK1\|A30/ JK4 | .... | .D. | .A. N | D.. | .I. TG | .Y. | .MF. |
| iPS:39 2628 | 21-225_20C2 | VK1\|A30/ JK4 | .Q. | .... | .F. | .... | .... | .A. | .... |
| iPS:39 2630 | 21-225_20E5 | VK1\|A30/ JK4 | .... | .... | .... | .... | .... | .... | .E. |
| iPS:39 2638 | 21-225_17F9 | VK1\|A30/ JK4 | .... | .V. | .... | .V. | .... | .T. | .... |
| iPS:39 2640 | 21-225_18A1 | VK1\|A30/ JK4 | .... | .... | .... | .N. | .... | .... | ...F |
| iPS:39 2642 | 21-225_18C6 | VK1\|A30/ JK4 | .T. | .... | .... | .... | .... | .... | .... |
| iPS:39 2644 | 21-225_19E1 | VK1\|A30/ JK4 | .... | .... | .... | .N. | .... | .... | .... |
| iPS:39 2646 | 21-225_20G2 | VK1\|A30/ JK4 | .... | .... | .... | .F. | .S. | .... | .F. |
| iPS:39 2654 | 21-225_17A10 | VK1\|A30/ JK4 | .... | .... | .... | .... | .... | .... | .... |
| iPS:39 2656 | 21-225_1F2 | VK1\|A30/ JK4 | .R. | .... | .... | .V. | .I. | .... | .... |
| iPS:39 2658 | 21-225_18E8 | VK1\|A30/ JK4 | .A. | .... | .... | .V. | .... | .... | .... |
| iPS:39 2666 | 21-225_16F11 | VK1\|A30/ JK4 | .... | .... | .... | .... | .... | .... | .... |
| iPS:39 2676 | 21-225_19F3 | VK1\|A30/ JK4 | .... | .... | .... | .... | .... | .A. | .... |
| iPS:39 2680 | 21-225_20A7 | VK1\|A30/ JK4 | .... | .... | .... | .... | .S. | .... | .... |
| iPS:39 2700 | 21-225_16E12 | VK1\|A30/ JK4 | .... | .... | .... | .... | .... | .... | .... |
| iPS:39 2706 | 21-225_18A3 | VK1\|A30/ JK4 | .... | .... | .... | V.. | .N. | .S. | .... |

Figure 52 (Continued)

| | | | | | | | | | | | |
|---|---|---|---|---|---|---|---|---|---|---|---|
| iPS:39 2716 | 21-225_17B5 | VK1)A30/ JK4 | . . . . . | . . . . . | . . . . . | . . . . . | . . . . . | SF | . . . . . | . . . . . | . . . . . |
| iPS:39 2744 | 21-225_20D5 | VK1)A30/ JK4 | . . . . . | . . . . . | . . . . . | N | . . . . . | . . . . . | . . . . . | R | F |
| iPS:39 2750 | 21-225_20A10 | VK1)A30/ JK4 | . . . . . | . . . . . | Q | . . . . . | . . . . . | . . . . . | . . . . . | . . . . . | . . . . . |
| iPS:39 2772 | 21-225_20E12 | VK1)A30/ JK4 | . . . . . | . . . . . | F | . . . . . | . . . . . | . . . . . | . . . . . | . . . . . | F |
| iPS:39 2774 | 21-225_21F3 | VK1)A30/ JK4 | . . . . . | . . . . . | . . . . . | . . . . . | D | I | . . . . . | S | . . . . . |
| iPS:39 2780 | 21-225_22B7 | VK1)A30/ JK4 | . . . . . | . . . . . | . . . . . | T | . . . . . | . . . . . | . . . . . | T | . . . . . |
| iPS:39 2788 | 21-225_20C8 | VK1)A30/ JK4 | . . . . . | . . . . . | K..N | . . . . . | . . . . . | . . . . . | . . . . . | D | F |
| iPS:39 2794 | 21-225_21H3 | VK1)A30/ JK4 | . . . . . | . . . . . | . . . . . | . . . . . | A.L.I | . . . . . | . . . . . | . . . . . | T |
| iPS:39 2800 | 21-225_22D12 | VK1)A30/ JK4 | . . . . . | . . . . . | . . . . . | V.T | D | . . . . . | . . . . . | ST | . . . . . |
| iPS:39 2810 | 21-225_20H12 | VK1)A30/ JK4 | D | . . . . . | . . . . . | . . . . . | VI | V | . . . . . | . . . . . | . . . . . |
| iPS:39 2820 | 21-225_23D1 | VK1)A30/ JK4 | . . . . . | . . . . . | . . . . . | . . . . . | . . . . . | . . . . . | . . . . . | S | . . . . . |
| iPS:39 2822 | 21-225_23C8 | VK1)A30/ JK4 | R | D | R.G | . . . . . | . . . . . | . . . . . | . . . . . | . . . . . | . . . . . |
| iPS:39 2824 | 21-225_24E5 | VK1)A30/ JK4 | . . . . . | . . . . . | N | V | . . . . . | K | . . . . . | SN | . . . . . |
| iPS:39 2834 | 21-225_22C1 | VK1)A30/ JK4 | I | . . . . . | . . . . . | . . . . . | . . . . . | . . . . . | . . . . . | ST | . . . . . |
| iPS:39 2838 | 21-225_22G8 | VK1)A30/ JK4 | F | . . . . . | G.C | T | . . . . . | S | . . . . . | . . . . . | . . . . . |
| iPS:39 2850 | 21-225_20H10 | VK1)A30/ JK4 | . . . . . | K.N | . . . . . | . . . . . | . . . . . | . . . . . | . . . . . | . . . . . | . . . . . |
| iPS:39 2854 | 21-225_21E5 | VK1)A30/ JK4 | . . . . . | . . . . . | . . . . . | . . . . . | . . . . . | . . . . . | . . . . . | . . . . . | . . . . . |
| iPS:39 2858 | 21-225_22H4 | VK1)A30/ JK4 | . . . . . | . . . . . | . . . . . | V | L | . . . . . | . . . . . | . . . . . | . . . . . |
| iPS:39 2866 | 21-225_23H11 | VK1)A30/ JK4 | . . . . . | D | . . . . . | . . . . . | . . . . . | . . . . . | . . . . . | R | . . . . . |
| iPS:39 2870 | 21-225_20G9 | VK1)A30/ JK4 | . . . . . | . . . . . | . . . . . | . . . . . | . . . . . | . . . . . | . . . . . | ST | . . . . . |
| iPS:39 2880 | 21-225_22F9 | VK1)A30/ JK4 | . . . . . | . . . . . | . . . . . | . . . . . | . . . . . | . . . . . | . . . . . | . . . . . | . . . . . |

Figure 52 (Continued)

| ID | Clone | Germline | | | | | | |
|---|---|---|---|---|---|---|---|---|
| iPS:39 2882 | 21-225_23A3 | VK1|A30/JK4 | . | . | V. | . | . I F | . |
| iPS:39 2896 | 21-225_21G7 | VK1|A30/JK4 | V.. | .Q. | . | N. | S. | . |
| iPS:39 2900 | 21-225_22F2 | VK1|A30/JK4 | . | . | . | . | A. | . |
| iPS:39 2904 | 21-225_22G9 | VK1|A30/JK4 | . | . | . | . | T. | . |
| iPS:39 2942 | 21-225_30E9 | VK1|A30/JK4 | .D. | .R. | .G..F | . | I.II | .P. |
| iPS:39 2944 | 21-225_31H5 | VK1|A30/JK4 | F.SF | .S. | . | F.M.D.SN | . | . |
| iPS:39 2964 | 21-225_31A8 | VK1|A30/JK4 | . | .H.I | . | . | TI | .P. |
| iPS:39 2960 | 21-225_29H6 | VK1|A30/JK4 | . | .S..T | V. | . | . | . |
| iPS:39 2982 | 21-225_30D1 | VK1|A30/JK4 | .D. | .E. | . | . | TI | .P. |
| iPS:39 2986 | 21-225_31B8 | VK1|A30/JK4 | I.. | .S. | .G. | .T | II | .P. |
| iPS:39 2988 | 21-225_25E6 | VK1|A30/JK4 | . | .R. | . | .R.N | . | . |
| iPS:39 2990 | 21-225_25H10 | VK1|A30/JK4 | .R. | . | .F. | . | . | . |
| iPS:39 3004 | 21-225_30G11 | VK1|A30/JK4 | .S. | . | . | G.. | F. | . |
| iPS:39 3018 | 21-225_29B8 | VK1|A30/JK4 | . | . | . | .R. | . | . |
| iPS:39 3030 | 21-225_25H11 | VK1|A30/JK4 | .T. | . | .F. | . | . | . |
| iPS:39 3034 | 21-225_27F2 | VK1|A30/JK4 | .D. | .R. | .V. | . | TI | .P. |
| iPS:39 3040 | 21-225_30E3 | VK1|A30/JK4 | .S. | . | . | . | . | . |
| iPS:39 3048 | 21-225_27C3 | VK1|A30/JK4 | . | .L. | . | . | . | . |
| iPS:39 3054 | 21-225_29G8 | VK1|A30/JK4 | .D. | . | . | .N. | .R. | . |
| iPS:39 3056 | 21-225_30F3 | VK1|A30/JK4 | . | . | .T. | .D.S | . | .F. |
| iPS:39 3058 | 21-225_31H3 | VK1|A30/JK4 | .D. | .R..F | .F. | . | .T. | .P. |

Figure 52 (Continued)

| ID | V/J | | | | | | | | |
|---|---|---|---|---|---|---|---|---|---|
| iPS:39 3060 | 21-225_32G12 | VK1/A30/JK4 | . | . | . | . | . | .TI | . |
| iPS:39 3068 | 21-225_34G9 | VK1/A30/JK4 | . | .R.. | .D.. | . | . | ...P. | ...W |
| iPS:39 3072 | 21-225_36C5 | VK1/A30/JK4 | . | . | ..S. | . | T | .TI | . |
| iPS:39 3074 | 21-225_33B1 | VK1/A30/JK4 | . | . | ..S. | F | . | .H.PI | ...W |
| iPS:39 3076 | 21-225_33A4 | VK1/A30/JK4 | . | . | ..S. | . | T.V | ...P. | . |
| iPS:39 3076 | 21-225_33A4 | VK1/A30/JK4 | . | . | ..V. | .E.. | . | .Y.. | ..V. |
| iPS:39 3096 | 21-225_34D11 | VK1/A30/JK4 | . | R | .D.. | . | .A.I | .TI | . |
| iPS:39 3102 | 21-225_33F1 | VK1/A30/JK4 | . | . | ..S. | . | . | .TI | ..G. |
| iPS:39 3104 | 21-225_33A7 | VK1/A30/JK4 | . | . | ..S. | .F.. | VI | ...P. | . |
| iPS:39 3106 | 21-225_34A6 | VK1/A30/JK4 | . | V | .D.. | .E.. | .I | .TI | . |
| iPS:39 3110 | 21-225_35B7 | VK1/A30/JK4 | .I | . | ..S. | . | .V | ...P. | . |
| iPS:39 3118 | 21-225_34H11 | VK1/A30/JK4 | . | T | .D.. | . | .A | ...P. | . |
| iPS:39 3124 | 21-225_33G7 | VK1/A30/JK4 | . | . | . | . | . | .Y. | . |
| iPS:39 3126 | 21-225_35D1 | VK1/A30/JK4 | . | . | . | . | . | .TI | . |
| iPS:39 3128 | 21-225_35F11 | VK1/A30/JK4 | . | . | .D.. | . | . | .TV | . |
| iPS:39 3146 | 21-225_34G8 | VK1/A30/JK4 | . | . | ..S. | . | . | .TI | . |
| iPS:39 3150 | 21-225_36A5 | VK1/A30/JK4 | . | V.T.G | .D.. | .F.. | . | ...P. | ..I.T |
| iPS:39 3804 | 21-225_5H7 | VK1/A30/JK4 | . | . | .D.. | . | . | .H.PK | . |
| iPS:39 3806 | 21-225_6A6 | VK1/A30/JK4 | . | N | .D.. | . | . | ..S.. | . |
| iPS:39 3808 | 21-225_1A2 | VK1/A30/JK4 | . | . | .D.. | T | . | . | ..H. |
| iPS:39 3814 | 21-225_7F4 | VK1/A30/JK4 | . | . | .D.. | . | . | .SA | . |
| iPS:39 3816 | 21-225_6D4 | VK1/A30/JK4 | . | . | ..A. | . | . | ..S. | . |

Figure 52 (Continued)

| | | | | | | | | |
|---|---|---|---|---|---|---|---|---|
| iPS:39 3818 | 21-225_6G12 | VK1|A30/ JK4 | | | | | | |
| iPS:39 3820 | 21-225_8H7 | VK1|A30/ JK4 | | | | | F. | |
| iPS:39 3826 | 21-225_10G5 | VK1|A30/ JK4 | | T | | | | |
| iPS:39 3828 | 21-225_10H12 | VK1|A30/ JK4 | | | G | | | |
| iPS:39 3830 | 21-225_12A1 | VK1|A30/ JK4 | | | | | | |
| iPS:39 3832 | 21-225_14B2 | VK1|A30/ JK4 | A | V.T..G | Y | L | |
| iPS:39 3854 | 21-225_7H11 | VK1|A30/ JK4 | V..I | V.C.F | IM | | |
| iPS:39 3856 | 21-225_14C2 | VK1|A30/ JK4 | C..I...D | | V.R | V | .R |
| iPS:39 3866 | 21-225_14E3 | VK1|A30/ JK4 | | S | I..C | V.Y | F |
| iPS:39 3872 | 21-225_2A11 | VK1|A30/ JK4 | P...I..F.F | I | R..A.S..D | | M |
| iPS:39 3874 | 21-225_4C8 | VK1|A30/ JK4 | C | Q..S | V | | |
| iPS:39 3880 | 21-225_15A1 | VK1|A30/ JK4 | | | V | | |
| iPS:39 3882 | 21-225_15E3 | VK1|A30/ JK4 | | | R..S | HNS | I..T |
| iPS:39 3884 | 21-225_16F4 | VK1|A30/ JK4 | P | S..V | L.A | H | VK |
| iPS:39 3886 | 21-225_2G9 | VK1|A30/ JK4 | | Q..Q | I..V | I | E..Y |
| iPS:39 3922 | 21-225_2B2 | VK1|A30/ JK4 | F | Q | F | F | |
| iPS:39 3928 | 21-225_4E10 | VK1|A30/ JK4 | F | | L.H | DN | |
| iPS:39 3934 | 21-225_13E6 | VK1|A30/ JK4 | V | | L | V | |
| iPS:39 3958 | 21-225_5H2 | VK1|A30/ JK4 | T | S | | | A |
| iPS:39 3962 | 21-225_7H7 | VK1|A30/ JK4 | | ..T | S | F | |
| iPS:39 3974 | 21-225_7C4 | VK1|A30/ JK4 | F | H | | | V |

Figure 52 (Continued)

| ID | Clone | V/J | | | | | | | | |
|---|---|---|---|---|---|---|---|---|---|---|
| iPS:39 3976 | 21-225_7E9 | VK1|A30/ JK4 | . . . . . . F . . | . . . . . . . . . | . . . . . E . . T . | . . . . . . . . . | . . . . . . . . . | . . . . . . . . . | . . . . . . . . . |
| iPS:39 3982 | 21-225_6C12 | VK1|A30/ JK4 | . . . . . . . . . | . . . . . . S N . | . . . . . . . . . | . . . . . . . . . | . . . . . . D . . | . . . . . . F . . | . . . . . . . . . |
| iPS:39 3984 | 21-225_4F12 | VK1|A30/ JK4 | . . G . . . . . . | . . . . . . . . . | . . . . . . . E . | . . . . . G . . I | . . . . . . . . . | . . . . . . . . . | . . . . . . . . . |
| iPS:39 3990 | 21-225_11G7 | VK1|A30/ JK4 | . . . . . . . . . | . . . . . . . . . | . . . . . . . . . | . . . . . . . . . | . . . . . . S N . | . . . . . . A . . | . . . . . . M R . |
| iPS:39 3994 | 21-225_8C9 | VK1|A30/ JK4 | . . . . . . I . . | . . . A . . . . . | . . . . . . . . . | . . . . . . . . . | . . . . . . . . . | . . . . . . . . . | . . . . . . . . . |
| iPS:39 4002 | 21-225_15G7 | VK1|A30/ JK4 | . . . . . . . . . | . . . . . . . D . | . . . . . . . . . | . . . I . . T . . | . . . . . . . . . | . . . . . . . . . | . . . . . . . . . |
| iPS:39 4008 | 21-225_15H8 | VK1|A30/ JK4 | . . . . . . . . . | . . . . . . . . . | . . . . . . F . . | . . . . . . . F . | . . . . . . S N . | . . . . . . . . . | . . . . . . . R . |
| iPS:39 4020 | 21-225_15H10 | VK1|A30/ JK4 | . . . . . . . . . | . . . . . . . . . | . . . . . . . . . | . . . . . . . . S | . . . . . . . . . | . . . . . . . . . | . . . . . . . N . |
| iPS:39 4024 | 21-225_16B7 | VK1|A30/ JK4 | . . . . . . . . . | . . . . . . . . . | . . . . . . . . . | . . . . . . . . I | . . . . . . . . . | . . . . . . . . . | . . . . . F N . . |
| iPS:39 4037 | 21-225_4F4 | VK1|A30/ JK4 | . . . . . . . . . | . . . . . . . . . | . . . . . V T . . | . . . . . . . . I | . . . . . . . . . | . . . . . . . . . | . . . . . . . . . |
| iPS:39 4045 | 21-225_4H4 | VK1|A30/ JK4 | . . . . . . . . . | . . . . . . . . . | . . . . . . V . . | . . . . . . . . . | . . . . . . . . . | . . . . . . . . . | . . . . . . . . . |
| iPS:39 4049 | 21-225_13H5 | VK1|A30/ JK4 | . . . . . . . . . | . . . . . . . . . | . . . . . . . T . | . . . I . . . . . | . . . . . . . . . | . . . . . . . . . | . . . . . . . . . |
| iPS:39 4053 | 21-225_11F10 | VK1|A30/ JK4 | . . . . . . . . . | . . . . . . . . . | . . . . . . . . T | . . . . . V . N . | . . . . . . . . . | . . . . . . . . . | . . . . . . . . . |
| iPS:39 4057 | 21-225_15H1 | VK1|A30/ JK4 | . . . . . . . . . | . . . . . . . . . | . . . . . . . . . | . . . . . . . . . | . . . . . . . . . | . . . . . . . . . | . . . . . . . . . |
| iPS:39 4059 | 21-225_9E8 | VK1|A30/ JK4 | . . . . . . F . . | . . . . . . . . . | . . . . . . . . . | . . . . . . . . . | . . . . . . . . . | . . . . . . . . . | . . . . . . . . . |
| iPS:39 4063 | 21-225_16A1 | VK1|A30/ JK4 | . . . . . . . . . | . . . . . . . . . | . . . . . . . . . | . . . . . . . . . | . . . . . H . S N | . . . . . . . . . | . . . . . . . E . |
| iPS:39 4073 | 21-225_15C9 | VK1|A30/ JK4 | . . . . . . . . . | . . . . . . . . . | . . . . . . . . . | . . . . . V . N . | . . . . . . . T . | . . . . . . . . . | . . . . . . . . . |
| iPS:39 4075 | 21-225_8D12 | VK1|A30/ JK4 | . . . . . . . . . | . . . . . . . . . | . . . . . . . . . | . . . . . . . . . | . . . . . . . S . | . . . . . . . . . | . . . . . . . . . |
| iPS:39 4079 | 21-225_11F5 | VK1|A30/ JK4 | . . . . . . . . . | . . . . . . . . . | . . . . . . V . . | . . . . . . . . I | . . . . . . . . . | . . . . . . . . . | . . . . . . . . . |
| iPS:39 4091 | 21-225_13H3 | VK1|A30/ JK4 | . . . . . . . . . | . . . . . . . . . | . . . . . . . . . | . . . . . . . . . | . . . . . . . . . | . . . . . . . . . | . . . . . . . . . |
| iPS:39 8528 | 21-225_32G1 | VK1|A30/ JK4 | . . . . . . . . . | . . . . . . D M . S | . . . . . . . . . | . . . . . . . . . | . . . . . . T I . | . . . . . . S . P | . . . . . . . . . |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 8534 | 21-225_33B8 | VK1|A30/ JK4 | .........................| .....S.D........ | ........................ | ....... | ..........................................| ...TI........... | ........ |
| iPS:39 8540 | 21-225_35A6 | VK1|A30/ JK4 | .........................| .....S.D........ | ........................ | ...T... | ..........................................| ...TI.......P... | ........ |
| iPS:40 2219 | 21-225_1C12 | VK1|A30/ JK4 | .........................| ................ | ........................ | ....... | ..........................................| .........P...A.. | ....E... |
| iPS:40 3868 | 21-225_19D11 | VK1|A30/ JK4 | .........................| .....S.......... | ........................ | ....... | ..........................................| ...YY........... | ........ |
| iPS:40 3872 | 21-225_8F11 | VK1|A30/ JK4 | .........................| ................ | ....F........... | ...D..V | .......................I..................| ...YT........... | ........ |
| | Germline | K_FR1 | K_CDR1 | K_FR2 | K_CDR2 | K_FR3 | K_CDR3 | K_FR4 |
| VK2|A18|JK 5 | | DIVMTQTPLSLS VTPGQPASISC | RSS QSLLHSD GNTYLN | WYLQKPGQ SPQLLIY | LGSNRAS | GVPDRFSGSGSG TDFTLKISRVEAEDVGV YYC | MQGTH LPT | FGGGTK LEIK |
| iPS:46 8816 | 21-225_52G8 | VK2|A18/ JK5 | .........................| ......M......... | ........................ | ....... | ........M.................................| ...SMQ.......I.. | ........ |
| iPS:43 4021 | 21-225_49C1 | VK2|A18/ JK5 | .........................| ................ | ........................ | .K.L.. | ..........................................| ....S.Q......I.. | .L...... |
| iPS:43 4025 | 21-225_49G3 | VK2|A18/ JK5 | .........................| ......M......... | ....A..F..F..... | ...H... | ........M.................................| ...SMQ.......I.. | ........ |
| iPS:43 4031 | 21-225_49E7 | VK2|A18/ JK5 | .........................| .....IF......... | ........................ | .K.L.. | ........M.................................| ....S.Q......Y.. | ........ |
| iPS:43 4033 | 21-225_49F9 | VK2|A18/ JK5 | .........................| ...N......V.N... | ........................ | ...N.. | ..........................................| ....S.Q......Y.. | ........ |
| iPS:43 4093 | 21-225_52D10 | VK2|A18/ JK5 | ....VM...I............... | ................ | ........................ | ..N.V. | ..........................................| ....S.Q......Y.. | ........ |
| iPS:43 4151 | 21-225_55C2 | VK2|A18/ JK5 | ....VM...I............... | ......V......... | ........................ | ..N.V. | ....................R.....................| ....S.L......Y.. | ........ |
| iPS:43 4161 | 21-225_55F9 | VK2|A18/ JK5 | ..........S.............. | .....E.......... | ........................ | ...N.. | ....................R.....................| ...I.S.Q......... | ........ |
| iPS:46 5329 | 21-225_147A8 | VK2|A18/ JK5 | .........................| .....T.......... | ........................ | ....... | ..........................................| ....S.-.....QL.. | ........ |
| iPS:43 2924 | 21-225_32H2 | VK2|A18/ JK5 | .........................| ................ | ........................ | ..L.N. | .......................I.S................| ...L.S.Q......Y.. | ........ |
| | Germline | K_FR1 | K_CDR1 | K_FR2 | K_CDR2 | K_FR3 | K_CDR3 | K_FR4 |
| VK2|A18|JK 1 | | DIVMTQTPLSLS VTPGQPASISC | RSS QSLLHSD GNTYLN | WYLQKPGQ SPQLLIY | LGSNRAS | GVPDRFSGSGSG TDFTLKISRVEAEDVGV YYC | MQGTH LPWT | FGQGTK VEIK |
| iPS:46 8822 | 21-225_147E10 | VK2|A18/ JK1 | .........A..............| ..........R..... | ....P.H.......S. | .....N. | ..........................................| ....S.Q......V.. | ........ |
| iPS:43 3917 | 21-225_43E11 | VK2|A18/ JK1 | .........................| ......R......... | ....P........... | .....N. | ..........................................| ....S.Q......... | ........ |

Figure 52 (Continued)

| | | | | | | | | | | | | |
|---|---|---|---|---|---|---|---|---|---|---|---|---|
| iPS:43 3965 | 21-225_46F2 | VK2|A18/ JK1 | . . . . . . . . . | . . . . . . I . . | . . . . . . . . . | . . . . G . . . | . P . V . . . | . . . . N . . | . . . . L . . . | . . . . . . . . . | . . S . Q . . . | . . . . . . . . |
| iPS:43 3985 | 21-225_47C1 | VK2|A18/ JK1 | . . . . . . . . . | . . . . . . . . . | . . . T . E . . | . . . . . . . . | . . . P . . . | . . . . . . . | . . . . . . . . | . . . . . . . . . | . . S . Q . . . | . . . . . . . . |
| iPS:43 3991 | 21-225_47E7 | VK2|A18/ JK1 | . . . . . . . . . | . . . . . . . . . | . . . . R . . . | . . . . . . . . | . . . P . . . | . . . . N . . | . . . . . . . . | . . . . F . . . | . . S T Q . . . | . . A . . . . . |
| iPS:43 4345 | 21-225_64H9 | VK2|A18/ JK1 | . . . E . . . . . | . . . . . . . . . | . . . . . F . . | . . . . . . . . | . . . P . V . | . N . L C . . | . . A . S . . . | . . . . . . . . . | . . S . Q . V . | . . . . . . . . |
| iPS:43 5297 | 21-225_146B3 | VK2|A18/ JK1 | . . . . . . . . . | . . . . . . . . . | . . . . . . . . | . . . . G . . . | . . . P . . . | . . . . N . . | . . . . . . . . | . . . . L . H . | . . S . Q . . . | . . . . T . . . |
| iPS:43 5341 | 21-225_148B2 | VK2|A18/ JK1 | . . A . . . . . . | . . . . . . . . . | . . . . . F . . | . . . . G . . . | . . . P . . . | . . . . . . . | . . . . . . . . | . . . . . . . . . | . . S . Q . I . | . . . . . . . . |
| iPS:43 5357 | 21-225_148G10 | VK2|A18/ JK1 | . . . . . . . . . | . . . . . . . . . | . . . . . . . . | . . . . G . . . | . . . P . . . | . . . . H . . | . . . . . . . . | . . . . . . . . . | . . S . Q . . . | . . . . . . . . |
| iPS:43 5365 | 21-225_149F1 | VK2|A18/ JK1 | . . . . . . . . . | . . S . . F . Y . | . . . . . F . . | . . . . . . . . | . . . P . . . | . . . . N . . | . . . . . . . . | . . . . . . . . . | . . S . Q . I . | . . . . . . . . |
| iPS:43 5413 | 21-225_150B11 | VK2|A18/ JK1 | . . . . . . . . . | . . . . . . . . . | . . . . . . . . | . . . . V . G . | . . . P . . . | . . . . . . . | . . . . . . . . | . . . . . . . . . | . . S . Q . . . | . . . . . . . . |
| iPS:43 5423 | 21-225_151G5 | VK2|A18/ JK1 | . . . . . . . . . | . . . . . . . . . | . . . . . R . . | . . . . . . G . | . . . P . . L | . . . . N . . | . . . . . . . . | . . . . . . . . . | . . S . Q . V . | . . . . . . . . |
| iPS:43 5429 | 21-225_151A10 | VK2|A18/ JK1 | . . . . . . . . . | . . . . . . . . . | . . . . . . . . | . . . . G . . . | . . . P . . . | . . . . . . . | . . . . . . . . | . . . . . . . . . | . . S . Q . I . | . . . . . . . . |
| iPS:43 5441 | 21-225_152F6 | VK2|A18/ JK1 | . . . . . . . . . | . . . . . . . . . | . . . . . . . . | . . . R . G . . | . . . P . R . | . . . . N . . | . . . . N . . . | . . . . F . . . | . . S . Q . V . | . . . . . . . . |
| iPS:43 5457 | 21-225_152C11 | VK2|A18/ JK1 | . . . . . . . . . | . . . . . . . A . | . . . . . . . . | . . . . T . . . | . . . P . V . H | . I . K . T . | . . N . . . . | . . . . F . . . | . . S . Q . . . | . . . . . . . . |
| iPS:43 5463 | 21-225_153D2 | VK2|A18/ JK1 | . . . . . . . . . | . . . . . . . . . | . . . . . . . . | . . . R . G . . | . . . P . I . | . . . . N . . | . . . . N . . . | . . . . F F . . | . . S . Q . V . | . . . . . . . . |
| iPS:43 5489 | 21-225_155A5 | VK2|A18/ JK1 | . . . . . . . . . | . . . . . . . . . | . . . . T . . . | . . . . . . . . | . . . P . R . | . . . . K . T | . . N . . . . | . . . . F . . . | . . S . Q . I . | . . . . . . . . |
| iPS:43 5531 | 21-225_157G8 | VK2|A18/ JK1 | . . . . . . . . . | . . . . . . . . . | . . . . . . . . | . . . . G . . . | . . . P . V . H | . . . . N . . | . . . . . . . . | . . . . F . . . | . . S . Q . V . | . . . . . . . . |
| iPS:43 5577 | 21-225_160B1 | VK2|A18/ JK1 | . . . . . . . . . | . . . . . . . . . | . . . . . . . . | . . . . . . . . | . . . . . . . | . . I . K . . | . . S E . . . . | . . . . . . . . . | . . S . Q . V . | . . . . . . . . |
| iPS:43 5601 | 21-225_160G10 | VK2|A18/ JK1 | . . . . . . . . A | . . . . . . . . . | . . . . . F . . | . . . . . . . . | . . . P . V . | . . . . K . . | . . E . . . . | . . . . L . . . | . . S . Q . I . | . . . . V . . . |
| iPS:43 5629 | 21-225_162H6 | VK2|A18/ JK1 | . . . . . . . . . | . . . . . . . . . | . . . . . . . . | . . . . . . . . | . . . P . . . | . . . . K . . | . . . . . . . . | . . . . . . . . . | . . K S Q . . . | . . . . T . . . |
| iPS:43 5655 | 21-225_167E2 | VK2|A18/ JK1 | . . . . . . . . . | . . . . . . . . . | . . . . . . . . | . . . . G . . . | . . . P . H . | . . . . K . . | . . . . . . . . | . . . . L . H . | . . S . Q . . . | . . . . . . . . |
| iPS:43 5657 | 21-225_167H10 | VK2|A18/ JK1 | . . . . . . . . . | . . . . . . . . . | . . . . . . . . | . . . . G . . . | . . . P . H . | . . . . K . . | . . . . . . . . | . . . . L . H . | . . S . Q . . . | . . . . . . . . |

| | Germline | K_FR1 | K_CDR1 | K_FR2 | K_CDR2 | K_FR3 | K_CDR3 | K_FR4 |
|---|---|---|---|---|---|---|---|---|
| iPS:43 6536 | 21-225_224G1 | VK2|A18/ JK1 | ...G......... | ...F.S....P. | ..I.N... | .............. | ..STQ......R. | .............. |
| iPS:43 6548 | 21-225_224A7 | VK2|A18/ JK1 | .............. | .....F......P. | ..I.N... | .............. | ..STQ......R. | .............. |
| iPS:43 6558 | 21-225_224C11 | VK2|A18/ JK1 | ....F......... | .....F......P. | ..I.N... | ..............IF | ..STQ......R. | .............. |
| iPS:43 6562 | 21-225_224H11 | VK2|A18/ JK1 | .............. | .....F......P. | ..I.N... | ..............I. | ..STQ......R. | .............. |
| iPS:43 6572 | 21-225_225G4 | VK2|A18/ JK1 | .............. | .....F......P. | ..I.N... | ..............I. | ..STQ......R. | .............. |
| iPS:43 6592 | 21-225_226B1 | VK2|A18/ JK1 | .............. | ......G.....F.P.R | ..I..... | ..............I. | ..S.Q......I. | ............D. |
| iPS:43 6594 | 21-225_226A5 | VK2|A18/ JK1 | .............. | ......G.....F..P.N | ....N... | ..............I. | ..S.Q......I. | .............. |
| iPS:43 6602 | 21-225_226E7 | VK2|A18/ JK1 | .............. | ......G.....F..P.Q..I | ....N... | .............. | ..S.Q......V. | .............. |
| iPS:43 6606 | 21-225_226G8 | VK2|A18/ JK1 | .............. | .....F......P. | ..I.N... | .............. | ..STQ......R. | .............. |
| iPS:43 6610 | 21-225_226F9 | VK2|A18/ JK1 | .............. | .....F......P.R | ..I.N... | ..............I. | ..STQ......R. | .............. |
| iPS:43 6612 | 21-225_226H9 | VK2|A18/ JK1 | ...I.......... | .....F......P. | ..I.N... | ..............I. | ..STQ......R. | .............. |
| iPS:43 6614 | 21-225_226F10 | VK2|A18/ JK1 | .............. | .....F......P.H | ..I.N... | ..............I. | ..STQ......R. | .............. |
| iPS:43 6618 | 21-225_226E11 | VK2|A18/ JK1 | .............. | .....KT.....P.H | ..I.N... | ..............I. | ..STQ......R. | .............. |
| iPS:43 6624 | 21-225_226H12 | VK2|A18/ JK1 | .............. | .....F......P.P. | ..I.N... | ..............I. | ..STQ......R. | .............. |
| iPS:43 6626 | 21-225_227C1 | VK2|A18/ JK1 | .............. | .....F......P. | ..I.N... | ..............I. | ..STQ......R. | .............. |
| iPS:43 6628 | 21-225_227F2 | VK2|A18/ JK1 | .............. | .....F......P. | ..I.N... | ..............I. | ..STQ......R. | ...........R. |
| iPS:43 6640 | 21-225_227A8 | VK2|A18/ JK1 | .............. | .....F......P. | ..I.N... | .....L........I. | ..STQ......R. | .............. |
| iPS:39 2814 | 21-225_22A1 | VK2|A18/ JK1 | .............. | ...G.........P. | ....N... | ..............A. | ..TL.......... | .............. |
| iPS:39 2930 | 21-225_25H9 | VK2|A18/ JK1 | .............. | .............P. | ....N... | .............. | ..S.Q......I. | .............. |
| iPS:39 3032 | 21-225_26F8 | VK2|A18/ JK1 | .............. | ......G.....P. | ....N... | .....E........ | ..S.Q......R. | .............. |
| iPS:39 3036 | 21-225_28G3 | VK2|A18/ JK1 | ...E.......... | ......G.....P. | ....N... | .............. | ..S.Q......I. | .............. |

Figure 52 (Continued)

| VK1|A30|JK1 | VK1|A30|JK1 | DIQMTQSPSS LSASVGDRVTITC | RAS QGIR NDLG | IYAATRLQS ASRLQS | GVPSRFSGSG SGTEFTLTISSLQPEDFAT YYC | LQHNS YPWT | FGQGTK VEIK |
|---|---|---|---|---|---|---|---|
| iPS:46 8826 | 21-225_201C5 | VK1|A30|JK1 | | | | .........Y.... | .........F.R. |
| iPS:46 8842 | 21-225_50H4 | VK1|A30|JK1 | | ....H..... | | .........Y.... | ..........R. |
| iPS:46 8858 | 21-225_148C9 | VK1|A30|JK1 | | ....R..... ....D..... | | .........Y.... | ..........R. |
| iPS:46 8860 | 21-225_224E7 | VK1|A30|JK1 | | | .T....... | .........Y.... | ..........R. |
| iPS:43 3919 | 21-225_44B3 | VK1|A30|JK1 | | | | .L.YN.... | ..........R. |
| iPS:43 3923 | 21-225_44D3 | VK1|A30|JK1 | ......F... | ....D..... | | .........Y.... R..R... | ..........R. |
| iPS:43 3929 | 21-225_44D5 | VK1|A30|JK1 | | ....D..... ....K..... | | .........Y.... | ..........F. |
| iPS:43 3935 | 21-225_44F9 | VK1|A30|JK1 | .V........ | | T........ | .H.YN.... | ..........R. |
| iPS:43 3939 | 21-225_44C10 | VK1|A30|JK1 | ......F... | | | .........Y.... | ..........R. |
| iPS:43 3951 | 21-225_45B4 | VK1|A30|JK1 | ......F... | | | .........YN... | ..........R. |
| iPS:43 3955 | 21-225_45B8 | VK1|A30|JK1 | ......F... | ....D..... | | .........Y.... | ..........R. |
| iPS:43 3967 | 21-225_46C3 | VK1|A30|JK1 | | ....D..... | | .........Y.... R........ | ..........R. |
| iPS:43 3971 | 21-225_46D4 | VK1|A30|JK1 | | T...D..... ....K..... | V........ | .........Y.... | ..........F. |
| iPS:43 3997 | 21-225_48C1 | VK1|A30|JK1 | | T......... | R........ | .........F.... A........ | |
| iPS:43 4001 | 21-225_48F2 | VK1|A30|JK1 | | ....R..... ....D..... | P........ | .........QY... N..S.L... | |
| iPS:43 4009 | 21-225_48A9 | VK1|A30|JK1 | | | I........ | .........R.... .G...I... | |
| iPS:43 4047 | 21-225_50A12 | VK1|A30|JK1 | | | T........ .N....... | .........Y.... | |
| iPS:43 4067 | 21-225_51H8 | VK1|A30|JK1 | | ....D..... ....I..... | | .........Y.... ...G...H. | |
| iPS:43 4135 | 21-225_54H3 | VK1|A30|JK1 | | | | .........Y.... | |
| iPS:43 4197 | 21-225_56C7 | VK1|A30|JK1 | | | T....N... | .........Y.... | |

Figure 52 (Continued)

| | | | | | | | | | |
|---|---|---|---|---|---|---|---|---|---|
| iPS:43 4203 | 21-225_60E2 | VK1JA30/ JK1 | | | | | | | |
| iPS:43 4209 | 21-225_60C3 | VK1JA30/ JK1 | | | .K. | .S. | | | .L. |
| iPS:43 4229 | 21-225_61H1 | VK1JA30/ JK1 | | | .K. | .F. | | | |
| iPS:43 4241 | 21-225_61E6 | VK1JA30/ JK1 | .I. | | .G. | .E. | | | |
| iPS:43 4257 | 21-225_62F7 | VK1JA30/ JK1 | | | .A. | .P. | | .Y. | FP. S |
| iPS:43 4281 | 21-225_57B8 | VK1JA30/ JK1 | .I. | | .G. | .E. | | | YP. |
| iPS:43 4315 | 21-225_59G7 | VK1JA30/ JK1 | | | .D. | .H. | | | FP. |
| iPS:43 4319 | 21-225_59B9 | VK1JA30/ JK1 | | | | .S. | TR. | | |
| iPS:43 4339 | 21-225_64A4 | VK1JA30/ JK1 | | | | | .L. | .Y. | .R. |
| iPS:43 4343 | 21-225_64C8 | VK1JA30/ JK1 | .A. | | | .C. | | .HY. | .R. |
| iPS:43 4385 | 21-225_66C10 | VK1JA30/ JK1 | | | .A. | .P. | | .Y. | YP. S |
| iPS:43 4387 | 21-225_66D11 | VK1JA30/ JK1 | .F..Q | | | .H. .C | IS..M.R | IV. | .R. |
| iPS:43 4441 | 21-225_71A2 | VK1JA30/ JK1 | .R | | | .I. FR. i | | IH. | .R. |
| iPS:43 4469 | 21-225_73C9 | VK1JA30/ JK1 | | | | | | | |
| iPS:43 5197 | 21-225_94F3 | VK1JA30/ JK1 | | | .A. .D. | .Q..F | .C. | .Y. | .R. |
| iPS:43 5325 | 21-225_147H5 | VK1JA30/ JK1 | | | .R. .D. | | | .Y. | .R. .A. |
| iPS:43 5393 | 21-225_149D10 | VK1JA30/ JK1 | | | .R. | | | .Y. | .R. |
| iPS:43 5539 | 21-225_158G1 | VK1JA30/ JK1 | | | .D. | .T. .N. | .V. | .Y. | .R. |
| iPS:43 5543 | 21-225_158D4 | VK1JA30/ JK1 | | | .K. | | .F. | | |
| iPS:43 5571 | 21-225_159C8 | VK1JA30/ JK1 | | | .D. .K. | .N. | .F. | .H. | .R. |
| iPS:43 5573 | 21-225_159D8 | VK1JA30/ JK1 | | | .RD.G. | .S. | .F. | .Y. | .R. |

Figure 52 (Continued)

| ID | V/J | | | | | | | | | |
|---|---|---|---|---|---|---|---|---|---|---|
| iPS:43-5581 | 21-225_160H1 | VK1|A30/JK1 | . | . | . | . | . | . | . | . |
| iPS:43-5583 | 21-225_160F2 | VK1|A30/JK1 | . | . | . | . | . | T | F | . |
| iPS:43-5591 | 21-225_160C4 | VK1|A30/JK1 | . | . | N | . | V | . | . | . |
| iPS:43-5615 | 21-225_161G12 | VK1|A30/JK1 | R | K | . | . | F | Y | . | . |
| iPS:43-5675 | 21-225_169D7 | VK1|A30/JK1 | . | K | . | . | F | H | R | . |
| iPS:43-5681 | 21-225_169D11 | VK1|A30/JK1 | . | D | V | . | . | R | C | . |
| iPS:43-5687 | 21-225_170H1 | VK1|A30/JK1 | . | . | . | T | . | Y | R | . |
| iPS:43-5689 | 21-225_170F3 | VK1|A30/JK1 | Q | R | . | . | N | S | N | S |
| iPS:43-5741 | 21-225_174G10 | VK1|A30/JK1 | . | D | V | T | . | Y | R | . |
| iPS:43-5831 | 21-225_190C12 | VK1|A30/JK1 | . | K | H | T | L | H | R | . |
| iPS:43-5857 | 21-225_191A4 | VK1|A30/JK1 | R | K | H | T | L | . | . | . |
| iPS:43-5907 | 21-225_190G3 | VK1|A30/JK1 | . | K | H | T | L | . | . | . |
| iPS:43-5919 | 21-225_190H5 | VK1|A30/JK1 | . | K | H | T | L | . | . | . |
| iPS:43-5989 | 21-225_192F7 | VK1|A30/JK1 | . | K | H | . | L | . | . | . |
| iPS:43-6132 | 21-225_196C12 | VK1|A30/JK1 | L..I | T | S.N | . | I | . | . | Y |
| iPS:43-6222 | 21-225_200C9 | VK1|A30/JK1 | C | . | EL | . | L | E | D | R |
| iPS:43-6264 | 21-225_203F7 | VK1|A30/JK1 | RF | H | L | . | . | V.C..N | F.F | . |
| iPS:43-6274 | 21-225_203F7 | VK1|A30/JK1 | . | . | . | A.G | . | . | . | . |
| iPS:43-6332 | 21-225_204H3 | VK1|A30/JK1 | . | . | . | . | G | Y | R | . |
| iPS:43-6352 | 21-225_208B2 | VK1|A30/JK1 | . | H | . | . | G | Y | R | . |
| iPS:43-6386 | 21-225_210G5 | VK1|A30/JK1 | . | H | . | . | . | H.Y | R | . |
| iPS:43-6386 | 21-225_212B11 | VK1|A30/JK1 | P | . | . | . | I | L.Y | R | LQ |

Figure 52 (Continued)

| | | | | | | | | |
|---|---|---|---|---|---|---|---|---|
| iPS:43 6412 | 21- 225_214H9 | VK1|A30/ JK1 | .......... | .......... | .......... | .......... | ...Y..... | .......... |
| iPS:43 6414 | 21- 225_214G10 | VK1|A30/ JK1 | ....LC...PP | .......... | .......... | .L........ | ........R. | .......... |
| iPS:43 6416 | 21- 225_214G12 | VK1|A30/ JK1 | ........PP | .......... | I......... | VM.Y...... | ........R. | .......... |
| iPS:43 6418 | 21- 225_215E3 | VK1|A30/ JK1 | ........PP | .......... | .......... | VM........ | ........R. | .......... |
| iPS:43 6428 | 21- 225_215E11 | VK1|A30/ JK1 | .....C..PP | .......... | I......V.R | VM.Y...... | ........R. | .......... |
| iPS:43 6438 | 21- 225_216E8 | VK1|A30/ JK1 | .........P | .......G.. | H......... | .M.Y...... | ........R. | .......... |
| iPS:43 6440 | 21- 225_216H12 | VK1|A30/ JK1 | ....L...PP | .......... | I......... | VM........ | ........R. | .......... |
| iPS:43 6450 | 21- 225_217E5 | VK1|A30/ JK1 | .F......PP | .......C.. | H......... | VM........ | ........R. | .......... |
| iPS:43 6456 | 21- 225_217G10 | VK1|A30/ JK1 | .....C..PP | .......... | I......... | .M.Y...... | ........R. | .......... |
| iPS:43 6458 | 21- 225_217H12 | VK1|A30/ JK1 | ........PP | .......... | I......... | VM.Y...... | ........R. | .......... |
| iPS:43 6462 | 21- 225_218C4 | VK1|A30/ JK1 | .F......PP | .......C.. | I......V.R | VM........ | ........R. | .......... |
| iPS:43 6480 | 21- 225_220F8 | VK1|A30/ JK1 | .F...L..PP.R | .......... | I.......R. | VM........ | ........R. | .......... |
| iPS:43 6534 | 21- 225_224F1 | VK1|A30/ JK1 | A......... | .........T | I.......I. | ....Y..... | ........R. | .......... |
| iPS:43 6540 | 21- 225_224F3 | VK1|A30/ JK1 | .......... | ....E..... | .......... | ....YN.... | ........RA | .......... |
| iPS:43 6564 | 21- 225_225A1 | VK1|A30/ JK1 | .......... | ....D..I.. | .......... | ....Y..... | ........R. | .......... |
| iPS:43 6596 | 21- 225_226C6 | VK1|A30/ JK1 | .......... | ....D..... | .L....N... | ....YN...D | ........RA | ........Q. |
| iPS:43 6604 | 21- 225_226F7 | VK1|A30/ JK1 | .......... | .......G.. | I.......V. | .H.Y...... | ........R. | .......... |
| iPS:43 6620 | 21- 225_226H11 | VK1|A30/ JK1 | .......... | .......... | .......... | ....Y..... | ........R. | .......... |
| iPS:43 7262 | 21- 225_170E4 | VK1|A30/ JK1 | .......... | ....Y...V..G | .......... | .......... | ....YP.... | .......D.. |
| iPS:43 7280 | 21- 225_203C10 | VK1|A30/ JK1 | .......... | .......A..R | .......A.. | .......... | .......... | .......... |
| iPS:43 7286 | 21- 225_208F1 | VK1|A30/ JK1 | ....H..... | .......F.. | .......... | ....Y..... | ....F..R. | .......... |

| | | | | | | | | | | | |
|---|---|---|---|---|---|---|---|---|---|---|---|
| iPS:39 2908 | 21-225_23F12 | VK1A30/ JK1 | | | | | | | | | |
| iPS:39 2914 | 21-225_25D12 | VK1A30/ JK1 | | | T | | | | | Y | |
| iPS:39 2918 | 21-225_28F5 | VK1A30/ JK1 | | | | | | | T | F.R. | V. |
| iPS:39 2958 | 21-225_28C7 | VK1A30/ JK1 | | | | T | | | T | | |
| iPS:39 2972 | 21-225_26A2 | VK1A30/ JK1 | | S | | I | | | R | | |
| iPS:39 3026 | 21-225_32B6 | VK1A30/ JK1 | | | | T | F | | | | |
| iPS:39 3130 | 21-225_33C2 | VK1A30/ JK1 | | | | V | | H | | | |
| iPS:39 3812 | 21-225_6A11 | VK1A30/ JK1 | | | | | P | | | | |
| iPS:39 3838 | 21-225_6G2 | VK1A30/ JK1 | .R. F..Y | | Q | | NI | Y | L I | | .T |
| iPS:39 3864 | 21-225_4C5 | VK1A30/ JK1 | ..H.HL. | R. | R. | | | Y I | | L | |
| iPS:39 3868 | 21-225_9C11 | VK1A30/ JK1 | | ..G. | S.R V | N | | G | Y | R. | |
| iPS:39 3876 | 21-225_9A1 | VK1A30/ JK1 | .F | Y.N | L | T | N | I H | H.S. | T.L | .R. |
| iPS:39 3902 | 21-225_14E10 | VK1A30/ JK1 | | .R. | R.. | | I | Y | I | L | |
| iPS:39 3908 | 21-225_10E9 | VK1A30/ JK1 | F | D. | H..Q | .H | | TA. | Y | R. | |
| iPS:39 3916 | 21-225_2G4 | VK1A30/ JK1 | | S.. | T.F | | | | Y | | |
| iPS:39 3948 | 21-225_16A5 | VK1A30/ JK1 | | | T | | N | .L | Y | F.R. | .L |
| iPS:39 3960 | 21-225_7G2 | VK1A30/ JK1 | | .G. | C.. | | | N Y | | | V. |
| iPS:39 3966 | 21-225_7F8 | VK1A30/ JK1 | | | T | | P | V. | YT | R. | |
| iPS:39 3972 | 21-225_7C9 | VK1A30/ JK1 | .G | | | | | | LY | R. | .D. |
| iPS:39 3978 | 21-225_4C12 | VK1A30/ JK1 | | | T | H | | L | Y | F.R. | |
| iPS:39 3986 | 21-225_7G4 | VK1A30/ JK1 | | R... | | | | S | HQY. | R. | |

Figure 52 (Continued)

| | | Germline | K_FR1 | K_CDR1 | K_FR2 | K_CDR2 | K_FR3 | K_CDR3 | K_FR4 |
|---|---|---|---|---|---|---|---|---|---|
| iPS:39 3996 | 21-225_15C11 | VK1|A30/JK1 | | | | | | .L.Y | ..R.. |
| iPS:39 3998 | 21-225_12B12 | VK1|A30/JK1 | | | ..V.. | ..T.. | | ...R.. | ..L..V. |
| iPS:39 4041 | 21-225_5E5 | VK1|A30/JK1 | | | | | | ...Y.. | ..V.. |
| iPS:39 4067 | 21-225_12F2 | VK1|A30/JK1 | | | | | ..V.. | | |
| iPS:39 4089 | 21-225_12E6 | VK1|A30/JK1 | | .S.. | | | | | |
| iPS:39 4093 | 21-225_9D12 | VK1|A30/JK1 | | | | | | | |
| iPS:39 4095 | 21-225_16H4 | VK1|A30/JK1 | | | | ..T.. | | | |
| iPS:39 4097 | 21-225_16G7 | VK1|A30/JK1 | | | | | | | |
| | VK3|L2/JK2 | | EIVMTQSPATLS | RAS-QSVS--SYLA | WYQQKPG QAPRLLIY | -ASTRAT | GIPARFSGSGS GTDFTLTISSLQSEDFAV YYC | QQYNN-WPPT | FGQGTK LEIK |
| iPS:46 8828 | 21-225_162A10 | VK3|L2/JK2 | | ..T.N.. | ..S.. | | ..V....IN...R.. | ..D.. | ..F.. |
| iPS:43 4255 | 21-225_62E6 | VK3|L2/JK2 | | ..N.. | ..F.. | | ..N.. | ..D.. | .CS |
| iPS:43 4269 | 21-225_57H3 | VK3|L2/JK2 | | ..S.. | ..S.. | ..V.. | ..F..N..W.. | ..D.. | .CS |
| iPS:43 4363 | 21-225_65A6 | VK3|L2/JK2 | ..V.F.. | ..N.. | | | ..I | ..D.. | .CS |
| iPS:43 4393 | 21-225_67C3 | VK3|L2/JK2 | | ..N.. | ..S.. | ..I.. | ..N.. | ..D.. | .CS.LE. |
| iPS:43 4425 | 21-225_70A5 | VK3|L2/JK2 | | ..N.. | ..L..S.. | ..I.. | ..P..N.. | ..D.. | .CS |
| iPS:43 4485 | 21-225_76D2 | VK3|L2/JK2 | ..P.. | ..V..V.. | ..H.. | | ..V.....I | ..D.. | .CS |
| iPS:43 4537 | 21-225_74E11 | VK3|L2/JK2 | | ..L.V.. NS | ..L.. | | ..I | ..D.. | .CS |
| iPS:43 4569 | 21-225_77H5 | VK3|L2/JK2 | ..V.. | ..S.. NS | | | ..SF.. | ..D.. | .CS..S. ..Q |
| iPS:43 4629 | 21-225_74C3 | VK3|L2/JK2 | | ..S..A.. | | ..F..T.. | ..I | ..D.. | .CS |
| iPS:43 4673 | 21-225_74E3 | VK3|L2/JK2 | ..L.. | ..L.V.. NS | | | ..I | ..D.. | .CS..L.. |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| | Germline | EIVMTQSPATLS VSPGERATLSC | RAS QSVS SNLA | WYQQKPGQ APRLLIY | GASTRAT | GIPARFSGSGSG TEFTLTISSLQSEDFAV YYC | QQYNN WPLT | FGGGTK VEIK |
| iPS:43 5109 | 21-225_92H5 VK3jL2/J K2 | | ....D.I.. | | | V........ | E.D...... CS | ........ |
| iPS:43 5221 | 21-225_95G2 VK3jL2/J K2 | L....... | ....TY... | | | ....T..L. | ....D.... CS | ........ |
| iPS:43 6051 | 21-225_193G12 VK3jL2/J K2 | | ....M..V. ..NS | | | ........I | ......... CS | ........ |
| iPS:43 6236 | 21-225_201F7 VK3jL2/J K2 | | ........S | ..I..S | | .....A... | .FY...... LCS | .L. |
| iPS:43 6250 | 21-225_201A4 VK3jL2/J K2 | | ...NIK... ..N.. | .F | | | .FY...... LCS | .L. |
| iPS:43 6252 | 21-225_202A8 VK3jL2/J K2 | ..S..... | S..NIK... | .F | | | ......... LCS | ........ |
| iPS:43 6258 | 21-225_202F12 VK3jL2/J K2 | | ...RIN... ..N.. | N | | V........ | .Y....... LCS | ........ |
| iPS:43 6278 | 21-225_201F2 VK3jL2/J K2 | | .......L. ..N.. | .R | | | ....D.... WP.CS | ..R |
| iPS:43 6294 | 21-225_205G4 VK3jL2/J K2 | | ...NIK... | .F | | ....T.... | .FY...... LCS | .L. |
| iPS:43 6306 | 21-225_201H4 VK3jL2/J K2 | | .......N. | | | | .FY...... LCS | .L. |
| iPS:43 6356 | 21-225_210H10 VK3jL2/J K2 | | ........Y | .K | | | E.D...... CS | ..N |
| iPS:43 6382 | 21-225_212C10 VK3jL2/J K2 | | ........A ..S.. | | .T. | DV....F.S | .Y....... LCS | ........ |
| iPS:43 6434 | 21-225_216B10 VK3jL2/J K2 | | ........N. | .R. | | ....P..SD .....S | ....D.... CS | ........ |
| iPS:43 6434 | 21-225_216B10 VK3jL2/J K2 | E....... | ........N | | | ....S.... | ....D.... CS | ..R |
| iPS:39 2806 | 21-225_24H3 VK3jL2/J K2 | | | | F.I | | .......... WPMCS | ........ |
| | VK3jL2jJK4 | K_FR1 | K_CDR1 | K_FR2 | K_CDR2 | K_FR3 | K_CDR3 | K_FR4 |
| | | EIVMTQSPATLS VSPGERATLSC | RAS QSVS SNLA | WYQQKPGQ APRLLIY | GASTRAT | GIPARFSGSGSG TEFTLTISSLQSEDFAV YYC | QQYNN WPLT | FGGGTK VEIK |
| iPS:46 8830 | 21-225_191G11 VK3jL2/J K4 | ....N... | ....T.... ..ISV | .H. | ..A. | | ....Y.... | ........ |
| iPS:43 4147 | 21-225_55E1 VK3jL2/J K4 | | ........D | .L. | .D..A. | | ....Y.... | ........ |
| iPS:43 4621 | 21-225_74D1 VK3jL2/J K4 | | ........R | .F. | | ....F.... | .......WP | ........ |
| iPS:43 5821 | 21-225_190E11 VK3jL2/J K4 | | ....FR... ..I.. | | .I | ....Y.... | ....Y.... | ........ |
| iPS:43 5941 | 21-225_191E8 VK3jL2/J K4 | | ....P.F.. ..R.. | .R. | | ....S...E | | .I. |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 6203 | 21-225_199A6 | VK3|L2/JK4 | D......P...F | ..........R | F.......I | . | ........EC | . | . |
| iPS:43 7334 | 21-225_75F11 | VK3|L2/JK4 | ...........F | ..........R | . | . | .....Y..Y | ....T....WP | . |
| iPS:44 8904 | 21-225_65C12 | VK3|L2/JK4 | .F...G | .......I | . | . | ...S...NA..N | . | . |
| | Germline | | K_FR1 DIQMTQSPSSLS | K_CDR1 RAS-QGIR-NDLG | K_FR2 WYQQKPG KAPKLLI | K_CDR2 A--ASSLQS | K_FR3 GVPSRFSGSGSGS TDFTLTISSLQPEDFAT YYC | K_CDR3 LQHNS--YPPT | K_FR4 FGPGTK VDIK |
| iPS:46 8832 | 21-225_76H10 | VK1|A30/JK3 | .A | . | . | .G | . | .Y | . |
| iPS:46 8836 | 21-225_198E3 | VK1|A30/JK3 | . | . | . | . | ......F | .YR | . |
| iPS:46 8844 | 21-225_48E10 | VK1|A30/JK3 | . | .K | . | .T | ......V | .Y | . |
| iPS:46 8846 | 21-225_53B10 | VK1|A30/JK3 | .A | .S.D | . | .G | ......F | .Y | . |
| iPS:43 3895 | 21-225_43E1 | VK1|A30/JK3 | . | .Y | ...K....N | . | . | . | . |
| iPS:43 3905 | 21-225_43E5 | VK1|A30/JK3 | . | . | . | . | . | . | . |
| iPS:43 3913 | 21-225_43H8 | VK1|A30/JK3 | . | . | ...H | ...N | ......V....F | .T....F | . |
| iPS:43 3933 | 21-225_44C8 | VK1|A30/JK3 | . | . | . | . | ...S | . | . |
| iPS:43 3949 | 21-225_45H2 | VK1|A30/JK3 | . | . | ...K | ...N | ......V....F | .T....F | . |
| iPS:43 3981 | 21-225_46E9 | VK1|A30/JK3 | . | . | . | .G | ......V....F | .T....F | . |
| iPS:43 3995 | 21-225_47H7 | VK1|A30/JK3 | . | .T | . | . | ......V....F | .T....F | . |
| iPS:43 4039 | 21-225_43B1 | VK1|A30/JK3 | . | . | . | . | ......V....F | .T....F | . |
| iPS:43 4057 | 21-225_51E4 | VK1|A30/JK3 | . | . | ...Q | . | ............A | . | . |
| iPS:43 4071 | 21-225_51F9 | VK1|A30/JK3 | . | . | ...Q...R | ...R | ............D.S | . | . |
| iPS:43 4075 | 21-225_51B11 | VK1|A30/JK3 | .A | .T | . | . | . | . | . |
| iPS:43 4091 | 21-225_52B9 | VK1|A30/JK3 | .A | . | ......R | . | .L.......R | . | . |

Figure 52 (Continued)

| | | | | | | | | |
|---|---|---|---|---|---|---|---|---|
| iPS:43 4101 | 21-225_52H12 | VK1|A30/ JK3 | | | | | Y | |
| iPS:43 4103 | 21-225_53G1 | VK1|A30/ JK3 | | N | | S | D | |
| iPS:43 4129 | 21-225_53B12 | VK1|A30/ JK3 | | | P | | | |
| iPS:43 4131 | 21-225_54D3 | VK1|A30/ JK3 | | | | | | |
| iPS:43 4143 | 21-225_54G7 | VK1|A30/ JK3 | | | | | H.T | |
| iPS:43 4155 | 21-225_55B3 | VK1|A30/ JK3 | L | | | R | | |
| iPS:43 4169 | 21-225_50C4 | VK1|A30/ JK3 | | | I | S | | |
| iPS:43 4187 | 21-225_56A5 | VK1|A30/ JK3 | | D L | | | R | |
| iPS:43 4199 | 21-225_59F11 | VK1|A30/ JK3 | | | | | Y | R |
| iPS:43 4207 | 21-225_60A3 | VK1|A30/ JK3 | | | F T | | | F |
| iPS:43 4251 | 21-225_62G3 | VK1|A30/ JK3 | H | D N | | | | |
| iPS:43 4263 | 21-225_56H7 | VK1|A30/ JK3 | L | D | R P | | D | S |
| iPS:43 4265 | 21-225_57B2 | VK1|A30/ JK3 | V | A | L | | | |
| iPS:43 4271 | 21-225_57A4 | VK1|A30/ JK3 | | V | L | | | |
| iPS:43 4275 | 21-225_57F4 | VK1|A30/ JK3 | | | FL.T L | G | YG | |
| iPS:43 4293 | 21-225_58F5 | VK1|A30/ JK3 | | S.D | | H | F | E |
| iPS:43 4299 | 21-225_58D11 | VK1|A30/ JK3 | | | T T | A R | N | |
| iPS:43 4351 | 21-225_64A12 | VK1|A30/ JK3 | | D V | T | G | G | F |
| iPS:43 4383 | 21-225_66F9 | VK1|A30/ JK3 | | V | | | Y | |
| iPS:43 4399 | 21-225_67B7 | VK1|A30/ JK3 | | F | R | S | H | K |
| iPS:43 4407 | 21-225_68G8 | VK1|A30/ JK3 | | N | V | | Y | |

| ID | V/J | | | | | | | | | | |
|---|---|---|---|---|---|---|---|---|---|---|---|
| iPS:43 21-225_163E2 | VK1A30/JK3 | . | . | . | D. | . | . | . | . | . H. | . |
| iPS:43 21-225_163F9 | VK1A30/JK3 | . | . | . | D. | . | . | . | . | . D. | . |
| iPS:43 21-225_163G10 | VK1A30/JK3 | . | . | . | D. | . | P. | . | A. | .DY. | . |
| iPS:43 21-225_171A11 | VK1A30/JK3 | . | . | . | N. | . | P. | . | . | . | . |
| iPS:43 21-225_177B6 | VK1A30/JK3 | . | . | . | D.S. | . | P. | . | . | .DH. | . |
| iPS:43 21-225_180H7 | VK1A30/JK3 | . | . | . | . | . | . | N. | . | .L. | . |
| iPS:43 21-225_181A8 | VK1A30/JK3 | . | . | . | . | . | T. | . | S. | . | .F. |
| iPS:43 21-225_184H10 | VK1A30/JK3 | . | . | . | . | . | T. | . | .D. | . | .F. |
| iPS:43 21-225_184D11 | VK1A30/JK3 | . | . | L. | . | . | I. | . | S. | . | . |
| iPS:43 21-225_190D6 | VK1A30/JK3 | . | . | L. | K. | . | I. | . | . | . | . |
| iPS:43 21-225_192F6 | VK1A30/JK3 | . | . | L. | K. | . | . | . | P. | .Y. | . |
| iPS:43 21-225_194F10 | VK1A30/JK3 | . | . | . | K. | . | .D. | . | P. | .Y. | . |
| iPS:43 21-225_195B9 | VK1A30/JK3 | . | C. | . | . | . | G. | . | P. | .Y. | .F. |
| iPS:43 21-225_197G10 | VK1A30/JK3 | . | . | . | . | . | . | . | C. | .YR. | . |
| iPS:43 21-225_198B9 | VK1A30/JK3 | . | . | . | . | . | . | . | V. | .YR. | .F. |
| iPS:43 21-225_199A7 | VK1A30/JK3 | . | . | . | K. | . | . | . | V. | .YR. | .F. |
| iPS:43 21-225_200F6 | VK1A30/JK3 | . | . | . | D. | . | . | . | H. | .YR. | . |
| iPS:43 21-225_202A3 | S. | . | . | . | . | . | . | . | I. | .YR. | . |
| iPS:43 21-225_203B9 | VK1A30/JK3 | . | . | . | . | . | .R. | . | . | .HD. | . |
| iPS:43 21-225_210E4 | VK1A30/JK3 | . | . | . | . | . | R..V.N | . | H. | . | . |
| iPS:43 21-225_225B6 | VK1A30/JK3 | I. | . | . | M. | . | .T. | . | . | . | . |

Figure 52 (Continued)

| | | | | | | | |
|---|---|---|---|---|---|---|---|
| iPS:43 6578 | 21-225_225D6 | VK1JA30/ JK3 | . | . | . | . | . | . |
| iPS:43 6582 | 21-225_225F8 | VK1JA30/ JK3 | . | . | . | . | . | . |
| iPS:43 6608 | 21-225_226A9 | VK1JA30/ JK3 | . | . | LG | . | . | . |
| iPS:43 6630 | 21-225_227G3 | VK1JA30/ JK3 | . | D | . | . | . | . |
| iPS:43 6634 | 21-225_227H5 | VK1JA30/ JK3 | . | . | . | A | H | . |
| iPS:43 6650 | 21-225_227C12 | VK1JA30/ JK3 | S..S | D | RN | . | . | . |
| iPS:43 2632 | 21-225_16A11 | VK1JA30/ JK3 | . | H. | . | . | Y | . |
| iPS:39 2684 | 21-225_17F4 | VK1JA30/ JK3 | . | . | . | . | . | . |
| iPS:39 2732 | 21-225_17E5 | VK1JA30/ JK3 | . | . | T | . | . L | V |
| iPS:39 2778 | 21-225_22H3 | VK1JA30/ JK3 | . | D..N | P..T | F | D | . |
| iPS:39 2912 | 21-225_25A9 | VK1JA30/ JK3 | . | . | . | V | . | . |
| iPS:39 2934 | 21-225_27D5 | VK1JA30/ JK3 | . | . | . | . | . | . |
| iPS:39 2940 | 21-225_29D9 | VK1JA30/ JK3 | . | . | F | . | T | F. |
| iPS:39 2948 | 21-225_25G5 | VK1JA30/ JK3 | . | D | R | . | . | . |
| iPS:39 2968 | 21-225_25B6 | VK1JA30/ JK3 | . | . | H | . | . | . |
| iPS:39 2978 | 21-225_28B8 | VK1JA30/ JK3 | . | . | . | . | . | N |
| iPS:39 2998 | 21-225_28A9 | VK1JA30/ JK3 | . | . | N | . | R | . |
| iPS:39 3000 | 21-225_29D7 | VK1JA30/ JK3 | . | . | . | . | . | . |
| iPS:39 3006 | 21-225_31G9 | VK1JA30/ JK3 | T | . | P | . | D | . |
| iPS:39 3022 | 21-225_30H11 | VK1JA30/ JK3 | . | . | P | . | D.H | . |
| iPS:39 3038 | 21-225_29D8 | VK1JA30/ JK3 | V | . | T | . | . | T |

Figure 52 (Continued)

| | | Germline | K_FR1 | K_CDR1 | K_FR2 | K_CDR2 | K_FR3 | K_CDR3 | K_FR4 |
|---|---|---|---|---|---|---|---|---|---|
| iPS:39 3822 | 21-225_15B11 | VK1|A30/ JK3 | | | | | | | |
| iPS:39 3944 | 21-225_14D6 | VK1|A30/ JK3 | ....S... | ....D... ....H... | ....H... | | | ...Y... | ...N... |
| iPS:39 4033 | 21-225_5F4 | VK1|A30/ JK3 | | ....H... | | | ...V... | .Y.G... | |
| iPS:39 4069 | 21-225_16H1 | VK1|A30/ JK3 | | ...DI... | | ...N... | | ...YH... | ...V... |
| iPS:40 2229 | 21-225_16H9 | VK1|A30/ JK3 | | ...Y... | ...F... | ...G... | ...I... | ...YH...L. | |
| VK1|O12/JK1 | | Germline | DIQMTQSPSSLS ASVGDRVTITC | RAS-QSIS- -SYLN | WYQQKPGKA- APKLLIY | AASSLQS | GVPSRFSGSGSG--- TDFTLTISSLQPEDFAT YYC | QQSYS- TPWT | FGQGTK VEIK |
| iPS:46 8848 | 21-225_54B1 | VK1|O12/ JK1 | ...I... | ...N... | | | ...P... | ...R...TPL. | |
| iPS:43 4239 | 21-225_58F1 | VK1|O12/ JK1 | | ...T... ...NF... | ...F... | | ...I... | ...I... | |
| iPS:43 5513 | 21-225_157F3 | VK1|O12/ JK1 | | ...N... | ...L... | ...T... | | ...N...TPT. | |
| iPS:43 5729 | 21-225_173E7 | VK1|O12/ JK1 | ..CI..A..Y. | ...T... | | | ...V...F.. | ...R...TPQ. | |
| iPS:43 5753 | 21-225_175G10 | VK1|O12/ JK1 | ...I... | ...T.G. | ...R... | ...I... | ...G...F.. | ...R...TPQ. | |
| iPS:43 5799 | 21-225_181G3 | VK1|O12/ JK1 | | ...H... ...N... | ...A... | ...H... | | ...SP... | |
| iPS:43 5813 | 21-225_183A12 | VK1|O12/ JK1 | ...N... | ...RN... ...N... | ...N... | ...T...TLN. | | ...SP... | ...D.R |
| iPS:43 6003 | 21-225_192G10 | VK1|O12/ JK1 | | ...N... | | ...V... | ...S... | ...SP... | |
| iPS:43 6212 | 21-225_200G1 | VK1|O12/ JK1 | | ...N... | ...F... | ...E... | ...S... | ...SP... | ...F. |
| iPS:39 2730 | 21-225_17A1 | VK1|O12/ JK1 | | ...N.N... | .G.V.F. | ...T... | | ...T...TPT. | |
| iPS:39 2736 | 21-225_17B12 | VK1|O12/ JK1 | | ...N.N... | .G.V.L. | ...T... | | ...T.T...TPT. | |
| iPS:39 2766 | 21-225_23H4 | VK1|O12/ JK1 | ....S... | ...R... | ...R.S. ...C.. | | | ...T...SP... | |
| iPS:39 2770 | 21-225_20C10 | VK1|O12/ JK1 | ...H... ...K.S. | ...HH... | | ...T... | | ...T...TPT. | ...R |
| iPS:39 2808 | 21-225_20F8 | VK1|O12/ JK1 | | ...R... | ...E... | | ...I... | ...N...TPT. | |

Figure 52 (Continued)

| | | Germline | K_FR1 | K_CDR1 | K_FR2 | K_CDR2 | K_FR3 | K_CDR3 | K_FR4 |
|---|---|---|---|---|---|---|---|---|---|
| iPS:39 2954 | 21-225_26A10 | VK1|O12/ JK1 | .........I.. | ......N.N.. | ......V... | .......... | .......... | ........ | ........ |
| iPS:39 3878 | 21-225_7G12 | VK1|O12/ JK1 | ..........S. | ........N.. | ..G.V.L... | T......... | ......N... | .....T... | ....TPT. | ........ |
| iPS:39 8474 | 21-225_17B10 | VK1|O12/ JK1 | ............ | ...S....N.. | ......F... | .....H.... | .......... | ...G.N... | ....TPT. | .....N |
| | VK4|B3/JK2 | DIVMTQSPDSLA VSLGERATINC | RSS--- QSVLYSSNNRN YLA | WYQQKPGQSP KRLII | -ASTRES | GVPDRFSGSGS-- GTDFTLTISSLQAEDVAV YYC | QQYYS ----TPYT | FGQGTK LEIK |
| iPS:46 8850 | 21-225_63F4 | VK4|B3/ K2 | ............ | .........S. | .......... | .......... | ..........I.......... | .....T... | ........CS | .....N |
| iPS:46 8852 | 21-225_71F3 | VK4|B3/ K2 | ......A..... | .N..SN..... | .......... | .......... | ..........I.......... | .....T... | ........CS | ........ |
| iPS:46 8870 | 21-225_74A8 | VK4|B3/ K2 | ............ | .N......... | .......... | .......... | ..........N.......... | .......... | ........CS | ........ |
| iPS:43 4211 | 21-225_60F3 | VK4|B3/ K2 | T........... | ..SH....... | .......... | .......... | ..........I........ | ........ | .......I.CS | ........ |
| iPS:43 4235 | 21-225_61E3 | VK4|B3/ K2 | ............ | ..N.....HI. | ...Q...... | .....I.... | .......... | ........ | .......I.CS | .....N |
| iPS:43 4287 | 21-225_57F12 | VK4|B3/ K2 | ............ | ..Y........ | ...T....I.. | .......... | .........I. | ........ | .......I.CS | ........ |
| iPS:43 4305 | 21-225_59E1 | VK4|B3/ K2 | ............ | ..N........ | ...R...... | .....S.... | .......... | .....F... | .......N.CS | ........ |
| iPS:43 4443 | 21-225_71G3 | VK4|B3/ K2 | ......VA..... | ..N.....D.. | .......... | .......... | .......F.. | .....I... | .......I.CS | ........ |
| iPS:43 4483 | 21-225_74C12 | VK4|B3/ K2 | ............ | ..A........ | ....N..... | .......... | ..........D | ........ | ........CS | ........ |
| iPS:43 4613 | 21-225_77D12 | VK4|B3/ K2 | ......A..... | ..Y........ | .......... | ...L..F.... | .......... | .....T... | ........CS | ........ |
| iPS:43 4635 | 21-225_78E6 | VK4|B3/ K2 | ............ | ..SH....... | .......... | .......... | .......... | ........ | ........CS | ........ |
| iPS:43 4679 | 21-225_79G7 | VK4|B3/ K2 | ............ | ..SH....... | .......... | ......I..... | .S......M. | ........ | ........CS | ........ |
| iPS:43 4909 | 21-225_85C11 | VK4|B3/ K2 | ............ | ..SH.F..... | ....N..... | ....FI..... | ..EG......A. | .......... | ........CS | ........ |
| iPS:43 4959 | 21-225_87E10 | VK4|B3/ K2 | .....K...... | ..M........ | ...F...... | .....K.... | .S..G...... | .......... | .......S.CS | .......K. |
| iPS:43 5299 | 21-225_146D4 | VK4|B3/ K2 | ............ | ..N........ | ...V...... | .....I.... | .......... | .......... | ........CS | ........ |
| iPS:43 5305 | 21-225_146C9 | VK4|B3/ K2 | ............ | ..Y........ | ...V...... | .....K.... | .......... | .......... | ........CS | ........ |

| | | K_FR1 | K_CDR1 | K_FR2 | K_CDR2 | K_FR3 | K_CDR3 | K_FR4 |
|---|---|---|---|---|---|---|---|---|
| Germline | | DVVMTQSPLSLPVTLGQPASISC | RSSQSLVHSGNTYLN | WFQQRPGQSPRLLIY | KVSNRDS | GVPDRFSGSGSGTDFTLKISRVEAEDVGVYYC | MQGTH | FGGGTKVEIK |
| iPS:43 6644 | 21-225_227G9 | VK4|B3/JK2 | ......................... | ............... | .......H........... | ....... | ................................. | ..... | ........A..S |
| iPS:43 6646 | 21-225_227D11 | VK4|B3/JK2 | ............D............ | ......N........ | ................... | ....... | .I............................... | N.... | .......CS |
| iPS:43 7363 | 21-225_74C10 | VK4|B3/JK2 | ......................... | ......A........ | N.................. | ....... | ................................. | ..... | .......CS |
| iPS:45 1131 | 21-225_160A7 | VK4|B3/JK2 | .......L..........P...... | .H.N........SN | .........R..H...... | ....... | ................................Y | ..... | .......CS |
| iPS:39 3088 | 21-225_33D1 | VK4|B3/JK2 | ....................S.... | .I..........R. | .......R..F.......T | ....... | ..L....I........C............L... | ..... | ......S.CS |
| iPS:39 4085 | 21-225_8B11 | VK4|B3/JK2 | ......................... | ......N..N.... | ................... | ....... | ................................. | ..... | .......CS |
| iPS:39 8496 | 21-225_22D2 | VK4|B3/JK2 | ..................T...... | ......N........ | .................H. | ...K... | ................................F | ..... | .......CS |
| iPS:39 8512 | 21-225_25E12 | VK4|B3/JK2 | M......L..........F...... | ......Y........ | .........K......... | ....... | ................................Y | ..... | .......CS |
| iPS:39 8522 | 21-225_32A1 | VK4|B3/JK2 | ......................... | ......Y........ | ...........L....... | ....... | ..........T...................... | ..L.. | ......S.CS |
| iPS:39 8524 | 21-225_32A5 | VK4|B3/JK2 | ......................... | ............... | ...........L....... | ....... | ...A.................L.H......... | ..... | ......S.CS |
| iPS:39 8538 | 21-225_34H7 | VK4|B3/JK2 | ......................... | ......Y........ | ................... | ....... | ..........T....................L. | ..... | ......S.CS N |
| VK2|A17JK4 | | Germline | DVVMTQTPLSLPVTLGQPASISC | RSSQSLVYSDGNTYLN | WYLQKPGQSPQLLIY | KVSNRDS | GVPDRFSGSGSGTDFTLKISRVEAEDVGVYYC | MQGTH | FGGGTKVEIK WPLT |
| iPS:46 8854 | 21-225_72C4 | VK2|A17/JK4 | ......................... | ............... | ................... | E..KW.. | ................................N | ....F. | ................ |
| iPS:43 7250 | 21-225_148C6 | VK2|A17/JK4 | ......................... | ......G........ | ................... | ...W... | ................................. | ..... | ..........S..... |
| iPS:43 7252 | 21-225_148H11 | VK2|A17/JK4 | ......................... | ............... | ................... | ...W... | ................................. | ..... | ..........L..... |
| iPS:43 7254 | 21-225_149F2 | VK2|A17/JK4 | ......................... | ......S........ | ................... | ...W... | ......V.......................... | ..I.. | ................ |
| iPS:43 7256 | 21-225_150F11 | VK2|A17/JK4 | .......S..Y............. | ......S........ | .Y................. | ..WY... | ......V.......................... | ..I.. | ..........P..... |
| iPS:43 7268 | 21-225_177D2 | VK2|A17/JK4 | ....F.................... | ............... | ................... | ...W... | ................................. | ..... | ..........P..... |
| iPS:44 3005 | 21-225_43F11_LC1 | VK2|A17/JK4 | ..................S...... | ............... | ................... | ...W... | ................................. | ..... | ................ |
| iPS:39 8530 | 21-225_32G4 | VK2|A17/JK4 | ......................... | ............... | ................... | ....... | ................................. | ....I~ | ....HW.. |

| | | | | | | | | | |
|---|---|---|---|---|---|---|---|---|---|
| iPS:43 4037 | 21-225_49G12 | VK1|O12/ JK3 | . . . . | . . . . | S . . . | . . . . | . . . . | E . A | . . . . | . . . . |
| iPS:43 4041 | 21-225_50H8 | VK1|O12/ JK3 | . . N . | . T . M | . . . . | . . . . | . . . . | . . . . | . N . . | . I . . |
| iPS:43 4045 | 21-225_50H10 | VK1|O12/ JK3 | . . N . | . . I . | . . . . | . . . . | . . . . | . A . . | . N . . | . L . . |
| iPS:43 4049 | 21-225_50B12 | VK1|O12/ JK3 | . . . . | . . Y . | . . H . | . . . . | . . . . | . A . . | . . . S | . I . . |
| iPS:43 4073 | 21-225_51H10 | VK1|O12/ JK3 | . . . . | . . I . | . . R . | . . . . | . . . . | E . . T | . . . S | . A . . |
| iPS:43 4107 | 21-225_53E2 | VK1|O12/ JK3 | . . . . | . T . M | . . . . | . . . . | I . . . | E . A . | . . . . | . I . . |
| iPS:43 4181 | 21-225_56B2 | VK1|O12/ JK3 | . . . . | . . F . | . . H . | . V . . | . . . . | . . P . | . F . . | . . . . |
| iPS:43 4225 | 21-225_60E12 | VK1|O12/ JK3 | . . . . | . . F . | . N . F | . V . . | . . . . | . . . . | . . . S | . . I . F |
| iPS:43 4227 | 21-225_61A1 | VK1|O12/ JK3 | . . . . | . . F . | . N . F | . . . . | . . . . | . . . . | . . I . F | . . . . |
| iPS:43 4245 | 21-225_62H1 | VK1|O12/ JK3 | . Y . . | . N . F | . V . . | . V F . | . . . . | . . . P | . . . . | . . . . |
| iPS:43 4267 | 21-225_57F2 | VK1|O12/ JK3 | . . . . | . . F . | . . . . | . . . . | . . . . | . . . P | . N . . | . . . . |
| iPS:43 4323 | 21-225_62H8 | VK1|O12/ JK3 | . . . . | . . . . | . N . . | . . S . | I . . . | . L . N | . N . . | . I S . |
| iPS:43 4379 | 21-225_66A9 | VK1|O12/ JK3 | . . . . | . N . F | . . . . | . . . . | . . . . | . . . P | . N . . | . I S . R |
| iPS:43 4417 | 21-225_69C8 | VK1|O12/ JK3 | . . . P | . G . T Y | . F L . | . . H . | . . . . | . . . . | . . . . | . I S . |
| iPS:43 5545 | 21-225_158F4 | VK1|O12/ JK3 | . . F . | . . N . R | . . . . | . . . . | . . T . | . . . . | . . . . | . . V . F |
| iPS:43 5793 | 21-225_180F8 | VK1|O12/ JK3 | . . . . | . K . H | . . . . | . . . . | . . T . | . . . . | . . . . | . . . . |
| iPS:43 6504 | 21-225_222H4 | VK1|O12/ JK3 | . . G . | . T . L | . . . . | . G . . | . . . . | S . . . | . . . . | . I S . |
| iPS:43 6510 | 21-225_222H8 | VK1|O12/ JK3 | . . H . | . . N . | . . F . | . . V . | . . T . | S . VHRD . I | . Y . F | . . . R |
| iPS:43 7230 | 21-225_62H10 | VK1|O12/ JK3 | . . H . | . N . V | . . F . | . I . . | . . . . | S . VHRD . I | . Y . F | . . . R |
| iPS:44 8906 | 21-225_72G9 | VK1|O12/ JK3 | . . . . | . N . V | . . . . | . T . . | . . . . | . . . . | . H . . | . . F . |
| iPS:39 2652 | 21-225_17C6 | VK1|O12/ JK3 | . . . . | . . T . | . V . . S | . T . . | . . . . | . . F . | . R . . | . TPF . |

Figure 52 (Continued)

| | | | | | | | | | |
|---|---|---|---|---|---|---|---|---|---|
| iPS:39 2660 | 21-225_19B3 | VK1|O12/ JK3 | . . . . . . . . . . | . . . . . . . . . . | . . . . . . . . . . | . G . . N . I . . | . . . N . . . . . . | . . . . . V . . . . | N . . . . . . . . . | . . . . . . . . . . | . . . . . . . . . . |
| iPS:39 2668 | 21-225_17B4 | VK1|O12/ JK3 | . . . . . . . . . . | . . . . . . . . . . | . . . . . . . . . . | . . . . . N . . . . | . . . . . . . . . . | . G . . . . . . . T | . . . . . . . . . F | . . R . . . . TPF . | . . . . . . . . . . |
| iPS:39 2678 | 21-225_20F3 | VK1|O12/ JK3 | . . . . . . . . . . | . . . . . . . . . . | . . . . . . . . . . | . . . . . Y . . . . | . . . . . . . . . . | . . . . . . . . . . | . . . . . . . . . . | . . . . . . AP . . . | . . . . . . . . . . |
| iPS:39 2694 | 21-225_19A5 | VK1|O12/ JK3 | . P . . . . . . . . | . . . . . S . . . . | . . . . . N . I . . | . . . . . . . D . . | . V . . . N . . G . | . . . . . . . . . . | . . . . . . . . . . | . . . . . . . . . . | . . . . . . . . . . |
| iPS:39 2696 | 21-225_20A4 | VK1|O12/ JK3 | . . . . . A . . . . | . . . . . . . . . . | . . . . . . N . . . | . . . . . R . . . . | . . . . . . . . . . | . . R . . . . . . . | . . . . . . . . . F | . . R . . . TPL . . | . . . . . F . . . . |
| iPS:39 2702 | 21-225_17F7 | VK1|O12/ JK3 | . . . . . . . . . . | . . . . . . . . . . | . . . . . . T . . . | S . . . . . . . . . | . . . . . . . H . . | . . . . . . . . . . | . . . . . . . . . F | . . R . . . . TPF . | . . . . . . . . . . |
| iPS:39 2704 | 21-225_17F11 | VK1|O12/ JK3 | . I . . . . . . . . | . . . . . S . . . . | . . . . . . F . . . | . . . . . . . . . . | . . . . . . . . . T | . G . . . . . . . . | . . . . . . . . . . | . T . . . . TPL . A | . . . . . . . . . . |
| iPS:39 2720 | 21-225_17A12 | VK1|O12/ JK3 | . . . . . . . . . . | . . . . . . . . . . | . . . . . R T . M . | . . . . . H . . . . | . . . . . . . . . . | . . . . . . . . . . | . . . . . . . . . . | . . . . . . . . . . | . . . . . . . . . . |
| iPS:39 2722 | 21-225_18E12 | VK1|O12/ JK3 | . . . . . . . . . . | . . . . . . . . . . | . . . . . . N . . . | . . . . . . . . . . | . . . . . . . . . . | . N . . . . . . . . | . . . . . . . . . F | . N . . . . . TPL . | . . . . . . . . . . |
| iPS:39 2760 | 21-225_22G3 | VK1|O12/ JK3 | . . . . . . . . . . | . . . . . . . . . . | . . . . . . T . . . | . T . . . . . . . . | . . . . . . . . . . | . G . . . . . . . . | . . . . . . . . . . | . . R . . . . TPF . | . . . . . . . . . . |
| iPS:39 2762 | 21-225_22G5 | VK1|O12/ JK3 | . . . . . . . . . . | . . . . . . . . . . | . . . . . . . . . . | . . . . . Q . . . . | . . . . . . . . . N | . . R . . . . . . . | . . . . . . . . . F | . . F R . . . TPL . | . . . . . . . . . . |
| iPS:39 2764 | 21-225_22G10 | VK1|O12/ JK3 | . . . . . . . . . . | . . . . . . . F . . | . . . . . . . . . . | . . . . . R . . . . | . . . . . . . . . . | . . . . . . . . . . | . . . . . . . . . F | . F R . . . . TPL . | . . . . . . . F . . |
| iPS:39 2812 | 21-225_21F4 | VK1|O12/ JK3 | . . . . . . . . . . | . . . . . . N . G . | . . . . . . . . . . | . . . . . F . . . . | . . . . . . . . . . | . . . . . . . . . . | . . . . . . . . . . | . . R . . . . TPL . | . . . . . . . F . . |
| iPS:39 2816 | 21-225_22E4 | VK1|O12/ JK3 | . . . . C . . . . . | . . . . . N . . . . | . . . . . . . . . . | . . . . . . . . . . | . . . . . . . . . . | . . . . . . . . . . | . . . . . . . . . F F | . . R . . . . TPF . | . . . . . . . . . . |
| iPS:39 2830 | 21-225_21A5 | VK1|O12/ JK3 | . . . . . . . . . . | . . . . . . . . . . | . . . . . . T . . . | . H . . . . . . . . | . . . . . . . . . . | . . . . . . . . . . | . . . . . . . . . . | . . . . . . . TPL . | . . . . . . . . . . |
| iPS:39 2852 | 21-225_21A2 | VK1|O12/ JK3 | . . . . . A . . . . | . . . . . . . N . . | . . . . . . . . . . | . N . F . . . . . . | . . . . . . V . H . | . I . . . . . . . . | . . . . . . . . . F | . . R . . . . TPF . | . . . . . . . . . . |
| iPS:39 2878 | 21-225_22C5 | VK1|O12/ JK3 | . . . . . . . . . . | . . . . . . . . . . | . . . . . . . . . . | . . . . . H . . . . | . . . . . . . . . . | . I . . . . . . . . | . . R . . . . . . . | . . R . . . . IS . . | . . . . . F . . . . |
| iPS:39 2902 | 21-225_22D5 | VK1|O12/ JK3 | . . . . . . . . . . | . . . . . . N . . . | . . . . . . . . . . | . . . . . . . . . . | . . . . . . . . . . | . . . . . . . . . . | . . . . . . . . . F | . . R . . . . TPF . | . . . . . . . F . . |
| iPS:39 2984 | 21-225_30E11 | VK1|O12/ JK3 | . . . . . . . . . . | . . . . . . . . . . | . . . . . . . . . . | . . . . . . . Q T . | . . . . . . . . . . | . . . . . . . . . . | . . . . . . . . . F | . . R . . . . TPL . | . . . . . . . F . . |
| iPS:39 3114 | 21-225_33G12 | VK1|O12/ JK3 | . . . . . . . . . . | . . . . . . . . . . | . . . . . . . . . . | . . . . . F . . . . | . . . . . . . Q T . | . . . . . . . . . . | . . . . . . . . . . | . . R . . . . TPL . | . . . . . . . . . . |
| iPS:39 3824 | 21-225_10F12 | VK1|O12/ JK3 | . . . . . . . . . . | . . . . . . . . . . | . . . . . . N . . . | . . . . . . . . . . | . . . . . . . . . . | . . . . . . . . . . | . . . . . . . . . . | . N . . . . . TPF . | . . . . . . . F . . |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 3848 | 21-225_4H2 | VK1\|O12/ JK3 | .......L........ | .....I...N..... | .......V....... | ............. | ........GCV.R..........R....... | ...R....TPL. | ............ |
| iPS:39 3862 | 21-225_5G2 | VK1\|O12/ JK3 | ................ | ..............  | ............... | ............. | ........................ | ........TPL. | ............ |
| iPS:39 3888 | 21-225_3E3 | VK1\|O12/ JK3 | ............P.. | .....N.I....... | .R.V........... | ...G......... | .....N.R................ | ........TPL. | ............ |
| iPS:39 3890 | 21-225_4B1 | VK1\|O12/ JK3 | ............P.F | ........R...... | .H.V........... | ...G....T... | ........................ | ........TPL. | ............ |
| iPS:39 3898 | 21-225_5F7 | VK1\|O12/ JK3 | ............P.. | .......HT.R.... | ............... | ............. | ........IN.............N....... | ......IS... | ............ |
| iPS:39 3904 | 21-225_8H11 | VK1\|O12/ JK3 | ..F.........F.. | .........T..... | ............... | ............. | ........IN.............N....... | ........TPL. | ...V........ |
| iPS:39 3936 | 21-225_14A11 | VK1\|O12/ JK3 | ..I............. | .....N.I....... | .N.M..T..H.S... | ............. | ........................T....... | ......SP... | ...A........ |
| iPS:39 3980 | 21-225_6D3 | VK1\|O12/ JK3 | ................ | .....T.......... | ............F.. | .....N....... | ..........................R....... | ........TPF. | ............ |
| iPS:39 4014 | 21-225_8G6 | VK1\|O12/ JK3 | ................ | .....T.......... | ............F.. | ............. | ..........................R....... | ........TPF. | ............ |
| iPS:39 4022 | 21-225_16H6 | VK1\|O12/ JK3 | ................ | .......N........ | ............... | ............. | ..........................R....... | ........TPL. | ............ |
| iPS:39 4043 | 21-225_3B1 | VK1\|O12/ JK3 | ................ | ................ | ............... | ...T...N..... | ........................ | ........TPL. | ...F........ |
| iPS:39 4051 | 21-225_9E5 | VK1\|O12/ JK3 | ...........Q.. | .............A.. | ............... | ...G......... | ........................ | ........TPL.S | ............ |
| iPS:39 4077 | 21-225_8E12 | VK1\|O12/ JK3 | ................ | .......N........ | ............... | ............. | .............F..........R....... | ........TPF. | ............ |
| iPS:39 4087 | 21-225_11A5 | VK1\|O12/ JK3 | ................ | .......N.Y...... | ............... | ............. | ........................N....... | ........TPL. | ...N........ |
| Germline | VK2\|A18/JK 3 | K_FR1 DIVMTQTRLSLS VTPGQPASISC | K_CDR1 KSS QSLLHSD GKTYLY | K_FR2 WYLQKPGQ SPQLLIY | K_CDR2 EVS NRFS | K_FR3 GVPDRFSGSGSG TDFTLKISRVEAEDVGVY YC | K_CDR3 MQGTH LPFT | K_FR4 FGQGTK VDIK |
| iPS:43 4053 | 21-225_51E1 | VK2\|A18/ JK3 | .........M..... | .........E...... | ....P.R.F.F.... | .......N..... | ........................E....... | ......S.Q. | ............ |
| iPS:43 4137 | 21-225_54D4 | VK2\|A18/ JK3 | .........M..... | .........E...... | ....P.R.F.F.... | ............. | ........................E....I... | ......S.Q. | ............ |
| iPS:43 4149 | 21-225_55H1 | VK2\|A18/ JK3 | ................ | .........E...... | ....P...F.F.... | ...H......... | ........................F....... | ......S.Q. | ...F........ |
| iPS:43 5315 | 21-225_147B2 | VK2\|A18/ JK3 | ................ | .........E...... | ....P........... | ...H.V....... | ........V............... | ......STQ. | ...F.P...... |
| | | K_FR1 | K_CDR1 | K_FR2 | K_CDR2 | K_FR3 | K_CDR3 | K_FR4 |

Figure 52 (Continued)

| | | K_FR1 ALCMTQSPSSLS ASVGDRVTITC | K_CDR1 QAS QDIS NYLA | K_FR2 WYQQKPGK APKLLIY | K_CDR2 D ASNLET | K_FR3 GVPSRFSGSGS GTDFTLTISSLQPEDIAT YYC | K_CDR3 QQYDN LPIT | K_FR4 FGQGTK VEIK |
|---|---|---|---|---|---|---|---|---|
| VK1|O18|JK 3 | | | | | | | | |
| iPS:43 4055 | 21-225_51B4 | VK1|O18/ JK3 | ........F..... | ....R..T. | ................. | ................. | ......CVH........L..... | .........LPTT | ......T |
| | | Germline | K_FR1 | K_CDR1 | K_FR2 | K_CDR2 | K_FR3 | K_CDR3 | K_FR4 |
| VK1|O18|JK 4 | | | ALCMTQSPSSLS ASVGDRVTITC | QAS QDIS NYLN | WYQQKPGK APKLLIY | D ASNLET | GVPSRFSGSGS GTDFTLTISSLQPEDFAT YYC | QQYDN LPIT | FGGGTK VEIK |
| iPS:43 4087 | 21-225_52F6 | VK1|O18/ JK4 | ................ | ................ | ................ | ................ | ..............E..... | .........C..... | ........ |
| iPS:43 4111 | 21-225_53H2 | VK1|O18/ JK4 | ................ | ......H........ | .......Q....... | .......T.G...... | ......N.......S..... | .........H..... | ........ |
| iPS:43 4121 | 21-225_53F6 | VK1|O18/ JK4 | .......I....... | ......H........ | ................ | ................ | ...T................ | .........C..... | ........ |
| iPS:43 4163 | 21-225_50H1 | VK1|O18/ JK4 | .............P. | .......T....... | ................ | .........G...... | ................... | .........C..... | ........ |
| iPS:43 5611 | 21-225_161F10 | VK1|O18/ JK4 | ................ | ......D........ | ................ | ................ | .A................. | .........E..... | ........ |
| iPS:43 5811 | 21-225_183H6 | VK1|O18/ JK4 | ...........A... | .....H.S....... | ................ | ......W......... | .....G.....F........ | ................ | ........ |
| iPS:39 4035 | 21-225_5G9 | VK1|O18/ JK4 | ................ | .......Y....... | .........T..... | ................ | .A......A.......... | ................ | ......D. |
| | | Germline | K_FR1 | K_CDR1 | K_FR2 | K_CDR2 | K_FR3 | K_CDR3 | K_FR4 |
| VK1|L1|JK1 | | | DIQMTQSPSSLS ASVGDRVTITC | RAS QGIS SYLA | WYQQKPGK APKLLIY | A ASSLQS | GVPSRFSGSGS GTDFTLTISSLQPEDFAT YYC | QQYNS TPWT | FGQGTK VEIK |
| iPS:43 4095 | 21-225_52F10 | VK1|L1/J K1 | V............... | .......G....... | ................ | ................ | ................... | ................ | ........ |
| iPS:39 2848 | 21-225_20F9 | VK1|L1/J K1 | .......I........ | ................ | .........S...... | ................ | ......K............. | ..........P.... | ........ |
| iPS:39 3078 | 21-225_33H11 | VK1|L1/J K1 | ........F....... | W.....N........ | ........R....... | ................ | ......K............ | .........H..... | ........ |
| iPS:39 3142 | 21-225_33A3 | VK1|L1/J K1 | ................ | .....S......... | .........H...... | ................ | ...I..K............ | .........F..L.. | ........ |
| iPS:39 3946 | 21-225_16A4 | VK1|L1/J K1 | ................ | ......D........ | .........S...... | ................ | ......K.......A..... | .........F..P.. | ......N. |
| | | Germline | K_FR1 | K_CDR1 | K_FR2 | K_CDR2 | K_FR3 | K_CDR3 | K_FR4 |
| VK1|O12|JK 5 | | | DIQMTQSPSTL SASVGDRVTITT | RAS QSIS SWLA | WYQQKPGK APKLLIY | K ASSLES | GVPSRFSGSGS GTEFTLTISSLQPDDFAT YYC | QQYNS YPLT | FGGGTK VEIK |
| iPS:43 4117 | 21-225_53C6 | VK1|O12/ JK5 | ................ | .....YS..D..... | .....V..F....... | ................ | ...........E....F... | .........F..... | ........ |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 4317 | 21-225_59E8 | VK1|O12/ JK5 | | | | | | |
| iPS:43 4327 | 21-225_63G6 | VK1|O12/ JK5 | ....I.S. | ......F.. | ......V.... | ........ | ........F... | ....F....NS. | ........ |
| iPS:43 4455 | 21-225_72F5 | VK1|O12/ JK5 | ....I.P. | ........ | ........ | .D....... | ........ | ....G....I.. | ........Q |
| iPS:43 5525 | 21-225_157E7 | VK1|O12/ JK5 | ........ | ....N... | ........ | .T.T.T | .N...... | .T....... | .D.N |
| iPS:39 2754 | 21-225_21D3 | VK1|O12/ JK5 | ........ | ....F... | ........ | .I...... | ........ | ...STP.. | ........ |
| iPS:39 2818 | 21-225_22D8 | VK1|O12/ JK5 | ........ | ...G.S.. | .T...... | .....F.. | .T...... | .E......IRFA | ........ |
| iPS:39 3064 | 21-225_33A9 | VK1|O12/ JK5 | ........ | .T....NSM. | ........ | ..TY..E. | .F..N... | ...NR....E..S. | ........ |
| iPS:39 3148 | 21-225_35E5 | VK1|O12/ JK5 | ...I.... | ...R..S. | .Q..F.... | ...Y..E. | ........ | .T.G......S. | ........ |
| iPS:39 3802 | 21-225_3D12 | VK1|O12/ JK5 | ........ | ........ | .N.Q..... | ...A..G. | .......S | ...N......I.. | ........ |
| iPS:39 8536 | 21-225_33D12 | VK1|O12/ JK5 | ...V.... | ...R.... | .H...... | .....F.. | .W..I.M.G.Y | .H..N......L. | ........ |
| Germline VK3|A27/JK2 | | K_FR1 EIVLTQSPGTLSLSPGERATLSC | K_CDR1 RASQSVSSSYLA | K_FR2 WYQQKPGQAPRLLIY | K_CDR2 GASSRAT | K_FR3 GIPDRFSGSGSGTDFTLTISRLEPEDFAVYYC | K_CDR3 QQYGSSPYT | K_FR4 FGQGTKLEIK |
| iPS:43 4127 | 21-225_53H8 | VK3|A27/ JK2 | ...I.T.. | ....N..Y. | ........ | ...G.... | ........ | .FE.....SPMCS | .......N |
| iPS:43 6290 | 21-225_205G3 | VK3|A27/ JK2 | ........ | ....NL... | ........ | ....R... | .....K..F | ..........CS | ........ |
| iPS:43 6568 | 21-225_225B3 | VK3|A27/ JK2 | ........ | ......G. | .D...... | ........ | .N...... | .E......SLMCS | ........ |
| iPS:39 2898 | 21-225_21H10 | VK3|A27/ JK2 | ........ | ....F... | ........ | .T...... | ........ | .......SRS | ........ |
| iPS:39 3802 | 21-225_3D12 | VK3|A27/ JK2 | ........ | ........ | ........ | .T...... | ........ | .......SRS | ........ |
| Germline VK1|L1/JK4 | | K_FR1 DIQMTQSPSSLSASVGDRVTITC | K_CDR1 RASQGISNYLA | K_FR2 WYQQKPGKAPKLLIY | K_CDR2 AASTLQS | K_FR3 GVPSRFSGSGSGTDFTLTISSLQPEDFATYYC | K_CDR3 QQYNSYPLT | K_FR4 FGGGTKVEIK |
| iPS:43 4157 | 21-225_55D4 | VK1|L1/J K4 | ........F | ....D... | ........ | ........ | .....K..F | ...H.... | ......R |
| iPS:43 4175 | 21-225_55A11 | VK1|L1/J K4 | ........ | ....D.N. | ........ | ........ | .....K.. | .....F... | ......R |

Figure 52 (Continued)

| | | | | | | | | | | |
|---|---|---|---|---|---|---|---|---|---|---|
| iPS:43 4367 | 21-225_65H11 | VK1|L1/J K4 | . . . . . . . . | . . . . . . . . | . . . . . . . . | . . . . . . . . | . . . . . . . . | . K . . | . . . . . . . . | . . . . . . . . | . . . . . . . . |
| iPS:43 4429 | 21-225_70H6 | VK1|L1/J K4 | . . . L . . . . | T . . . . . . . | . . S . F . . . | . R . . . . . . | . T . . . . . . | . . I . | . . . . S . . . | . S Y . . . . . | . . . F . . . . |
| iPS:43 4535 | 21-225_74C8 | VK1|L1/J K4 | . . . . . . . . | . . . . . . . . | . . . . N . . . | . . V . . . . . | . . . . . . . . | . . . . | . . . . . . . . | . . . . . . . . | . . . . . . . . |
| iPS:43 4573 | 21-225_74C8 | VK1|L1/J K4 | . . . . . . . . | . . . . . . . . | . . . G . . . . | . . . . . . . . | T . N . . . . . | . A . K | . . . . Y . . . | . . S N . . . . | . . . I . . . . |
| iPS:43 4615 | 21-225_77E6 | VK1|L1/J K4 | . . . . . . . . | . . . . . . . . | . . . K . . . . | . . . . . . . . | . . . . G . . . | . A . K | . . . . . . . . | . . S N . . . . | . . . . . . . R |
| iPS:43 4669 | 21-225_76C5 | VK1|L1/J K4 | . . . . . . . . | . . . . . . . . | . . . . V . . . | . . . . . . . . | . . . . . . . . | . A . K | . . . . . . . . | . . S N . . . . | . . . . . . . N |
| iPS:43 4737 | 21-225_79F4 | VK1|L1/J K4 | . . . . . . . . | . . . . . . . . | . . . K . . . . | . . . . . . . . | . . . . G . . . | . A . K | . . . . Y . . . | . . S N . . . . | . . . . . . . R |
| iPS:43 4741 | 21-225_74G6 | VK1|L1/J K4 | . . . . . . . . | . . . . . . . . | . . . K . . . . | . . . . . . . . | . T . . . . . . | . A . K | . . . . . . . . | . . S N . . . . | . . . . . . . N |
| iPS:43 4867 | 21-225_80C11 | VK1|L1/J K4 | . . . . . . . . | . . . . . . . . | . . . R . . . . | R . . . . . . . | . T . . . . . . | . A . K | . . . . . . . . | . . S N . . . . | . . . . . . . . |
| iPS:43 5333 | 21-225_79A12 | VK1|L1/J K4 | . . . . . . . . | . . . . . . . . | . . . K . . . . | . . V . . . . . | . . . . . . . . | . . . K | . . . . . . . . | . . . N . . . . | . . . . . . . . |
| iPS:43 5409 | 21-225_147E9 | VK1|L1/J K4 | . I . I . L . . | . . . . . . . . | . . . D . N . . | . . . . . . . . | . . . . . . . . | . . . K | . . . . . . . . | . . . . . . . . | . . . . . . . . |
| iPS:43 5505 | 21-225_150G8 | VK1|L1/J K4 | . . . . . . . . | . . . . . . . . | . . . . H . . . | . . . . . . . . | . . . . V . . N | . . . K | . . . . . . . . | . . . . . . . . | . . . F . F . . |
| iPS:43 5595 | 21-225_157C1 | VK1|L1/J K4 | . . . . . . . . | . . . . . . . . | . . . . . . . . | . R . . . . . . | . . . . . . . . | . . . K | . . . . . . . . | . . . . . . . . | . . . . . . . . |
| iPS:43 5639 | 21-225_160H4 | VK1|L1/J K4 | . . . . . . . . | . . . . . . . . | . . . D . . . . | . . L . . . . . | . . . . . L . . | . . . K | . . . . . . . . | . . . . . . . . | . . . . . . . . |
| iPS:43 5653 | 21-225_163G6 | VK1|L1/J K4 | T . . . . . . . | . . . . . . . . | . . . H . . . . | . . . . . . . . | . . . . . L . . | . . . K | . . . . . . . . | . . . H . . . . | . . . . . . A . |
| iPS:43 5677 | 21-225_166H12 | VK1|L1/J K4 | . . . . . . . . | . . . . . . . . | . . . D . . . . | . . . . . . . . | . S . . . . . . | . . . K | . . . . . . . . | . . . . . . . . | . . . F . . T . |
| iPS:43 5699 | 21-225_169C10 | VK1|L1/J K4 | . . . . . . . . | . . . . . . . . | . . . D . . . . | . . . F . . . . | . S . . . . . . | N . . K | . . . . . . . . | . . S D . . . . | . . . . . . . . |
| iPS:43 5745 | 21-225_170D6 | VK1|L1/J K4 | . . . . A . . . | . . . . . . . . | . D . G . . . . | . . . . . . . . | . S . . . . . . | . . . K | . . . . . . . . | . . S D . . . . | . . . . . . . . |
| iPS:43 5819 | 21-225_175G3 | VK1|L1/J K4 | . . . . . . . . | . . . . . . . . | . . . D . . C . | . . L . . . . . | . K . . T . . . | . . . K | . . . . . . . . | . . S D . . . . | . . . . . . L . |
| iPS:43 5825 | 21-225_190C11 | VK1|L1/J K4 | . . . . . . . . | T . . . . . . . | . . . D . . . . | . . L . . . . . | . K . . . . . . | . . . K | . . . . . . . . | . . M T . . . . | . . . . . . . . |
| iPS:43 5837 | 21-225_190G11 | VK1|L1/J K4 | . . . . A . . . | T . . . . . . . | . . . G . . . . | . . L . . . . . | . . . . G . . . | . . . K | . . . . . . . . | . . M T . . . . | . . . . . . . . |
| iPS:43 5837 | 21-225_198G3 | VK1|L1/J K4 | . . . . . . . . | T . . . . . . . | . . . K . . . . | . . . . . . . . | . . . . . . . . | . . . K | . . . . . . . . | . . M T . . . . | . . . . . . . . |

Figure 52 (Continued)

| | | | | | | | |
|---|---|---|---|---|---|---|---|
| iPS:43 5845 | 21-225_191G1 | VK1|L1/J K4 | | | | .H.LT | |
| iPS:43 5859 | 21-225_190E6 | VK1|L1/J K4 | T...G. | ...K. | K. | ...MT | |
| iPS:43 5873 | 21-225_190G4 | VK1|L1/J K4 | ..D.G. ...R. | ...L. | K...N | ...ST | |
| iPS:43 5887 | 21-225_190F8 | VK1|L1/J K4 | T...G. | ...L. | K. | ...MT | |
| iPS:43 5933 | 21-225_191A10 | VK1|L1/J K4 | ...G. ...K. | | K...Y N.I | ...ST | |
| iPS:43 5945 | 21-225_191E10 | VK1|L1/J K4 | ...K. | | K. | ...ST | |
| iPS:43 5947 | 21-225_191G12 | VK1|L1/J K4 | T...G. | K. | K...N | ...IT | |
| iPS:43 5957 | 21-225_192D2 | VK1|L1/J K4 | ...I. | ...L. | K. | .H.VT...N | |
| iPS:43 5963 | 21-225_192D3 | VK1|L1/J K4 | | | K. | LH.LN | |
| iPS:43 5971 | 21-225_192H4 | VK1|L1/J K4 | ...D. | | K...R...G | LH.LN | ..R ..R |
| iPS:43 5979 | 21-225_192G6 | VK1|L1/J K4 | ...K. | ...L. | K. | ...MT | |
| iPS:43 5987 | 21-225_192C8 | VK1|L1/J K4 | T...G. | | K. | | |
| iPS:43 5993 | 21-225_192G8 | VK1|L1/J K4 | ...G. ...K. | ...L. | K. | ...IT | |
| iPS:43 5997 | 21-225_192H10 | VK1|L1/J K4 | T...G. | | K...Y | ...ST | |
| iPS:43 6005 | 21-225_193C7 | VK1|L1/J K4 | ...G. ...K. | | K...N | ...ST | |
| iPS:43 6031 | 21-225_193A10 | VK1|L1/J K4 | | | K. ..F. | .H.LT | |
| iPS:43 6045 | 21-225_194C1 | VK1|L1/J K4 | | | K. | LH.LT | |
| iPS:43 6054 | 21-225_194H11 | VK1|L1/J K4 | T...K. | ...L.V | K. | ...MT | |
| iPS:43 6076 | 21-225_191G10 | VK1|L1/J K4 | | | K. | .H.LT | |
| iPS:43 6086 | 21-225_195A9 | VK1|L1/J K4 | | | | | |
| iPS:43 6090 | 21-225_196C7 | VK1|L1/J K4 | ..N.A | | K. | .H.LT | |

| | | | | | | | | |
|---|---|---|---|---|---|---|---|---|
| iPS:43 6396 | 21-225_213E5 | VK1jL1/J K4 | .R.... | ....A.G.. | ....R.... | .......... | K........ | .......... | .H.SN..... | .......... |
| iPS:43 6398 | 21-225_213B8 | VK1jL1/J K4 | .......... | ....KH... | .......... | .......... | K........ | .......... | ...SN..... | .......... |
| iPS:43 6410 | 21-225_212E10 | VK1jL1/J K4 | .......... | ....H.... | .......... | .......... | K........ | .L....... | ...SN..... | .......... |
| iPS:43 6420 | 21-225_215B5 | VK1jL1/J K4 | .......... | ....H.... | .......... | .......... | K..NR.... | .......... | ...IN..... | .......... |
| iPS:43 6422 | 21-225_215D6 | VK1jL1/J K4 | .......... | ....H.... | .H........ | .......... | NN....V.. | .......... | ...VT..... | .......... |
| iPS:43 6430 | 21-225_215A12 | VK1jL1/J K4 | ..I....... | .T..D.G.. | .......... | .......... | K...R.... | .......... | ...VT..... | .......... |
| iPS:43 6452 | 21-225_217G5 | VK1jL1/J K4 | .L....... | ....G.... | .......... | .......... | K...R.... | ..S....... | ...VN..... | .......... |
| iPS:43 6454 | 21-225_217B10 | VK1jL1/J K4 | .R........ | ....A.G.. | .R........ | .......... | K...TR... | .......... | .HTSK.... | .LV....... |
| iPS:43 6464 | 21-225_219H1 | VK1jL1/J K4 | .....Q.... | ....KH... | .......... | .R........ | ....D.... | .......... | .S.VQ..... | ...T...... |
| iPS:43 6490 | 21-225_221F6 | VK1jL1/J K4 | .G........ | .......... | .......... | ..S....... | K...V.L.R | .......... | .H.SN..... | .......... |
| iPS:43 6502 | 21-225_222A11 | VK1jL1/J K4 | .......... | ....D.... | .......... | ...N...... | K...R.... | .......... | ...MT..... | ....R..... |
| iPS:43 6514 | 21-225_222D10 | VK1jL1/J K4 | .......... | .......... | .......... | ....N..... | K........ | .......... | .LY.LN.... | .......... |
| iPS:43 6522 | 21-225_223H10 | VK1jL1/J K4 | .......... | .......... | .......... | .......... | K........ | .......... | .LH.LN.... | .R........ |
| iPS:43 7258 | 21-225_153F9 | VK1jL1/J K4 | .......... | .......... | ..S....... | ....N..... | K........ | .......... | .LH.LN.... | .......... |
| iPS:43 7260 | 21-225_170D1 | VK1jL1/J K4 | .A........ | ....D.... | .......... | .......... | K........ | ...S...... | .......... | .......... |
| iPS:43 7264 | 21-225_171H12 | VK1jL1/J K4 | .......... | ....D.... | .......... | .......... | K........ | .......... | ...CD..F.. | .......... |
| iPS:43 7266 | 21-225_177A5 | VK1jL1/J K4 | .......... | ....D.... | .......... | ..S....... | K........ | .......... | ...SD..... | .......... |
| iPS:43 7270 | 21-225_178H4 | VK1jL1/J K4 | .......... | ....D.... | ..L....... | ..S....... | K........ | .......... | ...SD..... | .......... |
| iPS:43 8664 | 21-225_216G1 | VK1jL1/J K4 | ..E....... | ....S.... | .......... | .......... | .N........ | .......... | ...S...... | .......... |
| iPS:45 1120 | 21-225_197D3 | VK1jL1/J K4 | .......... | ....R.... | .......... | .......... | K........ | .......... | .LR.DT.... | .......... |
| iPS:39 2682 | 21-225_16A12 | VK1jL1/J K4 | .......... | ....A.N.. | ...S...... | .......... | K........ | .E........ | ....Y...... | .......... |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 2856 | 21-225_22A2 | VK1|L1/J K4 | ....... | ...D.... | ....V.... | ........ | ........K. | ........ | ........ |
| iPS:39 2966 | 21-225_32G3 | VK1|L1/J K4 | ......T. | ...A.... | ........ | ........ | ........K. | .....H.. | ........ |
| iPS:39 3952 | 21-225_1F1 | VK1|L1/J K4 | ........ | ....N... | ...S.... | ......T. | ......T.. | ........ | ....F... |
| iPS:39 3988 | 21-225_7F10 | VK1|L1/J K4 | .....A.. | ..D.R... | ...S.... | ...V.... | ........ | ........ | ........ |
| iPS:40 2233 | 21-225_16D10 | VK1|L1/J K4 | ........ | ...D.... | ........ | ...TP... | ........K. | ........ | ........ |
| iPS:40 2237 | 21-225_23D11 | VK1|L1/J K4 | ........ | ...A.... | ...R.S.. | ........ | ........K. | .....H.. | ...S.... |
| Germline | VK1|O18|JK5 | K_FR1: DIQMTQSPSS ASQSVSSYLA | K_CDR1: QAS QDI SNYLN | K_FR2: WYQQKPGK APKLLIY | K_CDR2: D AANRLET | K_FR3: GVPSRFSGSGSG TDFTLTISSLQPEDIAT YYC | K_CDR3: QQYDN LPIT | K_FR4: FGQGTK LEIK |
| iPS:43 4171 | 21-225_50G4 | VK1|O18/ JK5 | ......T. | ....T... | ........ | ........ | ........ | ........ | ........ |
| iPS:43 5565 | 21-225_159C4 | VK1|O18/ JK5 | ........ | ....F... | ........ | ........ | ........ | .....NL. | ........ |
| iPS:43 5607 | 21-225_161G4 | VK1|O18/ JK5 | ........ | ....D... | ........ | ........ | ........ | .....I.. | ........ |
| iPS:43 7302 | 21-225_225B11 | VK1|O18/ JK5 | ........ | ....Y... | ........ | ........ | ........ | ........ | ........ |
| iPS:39 2868 | 21-225_24D6 | VK1|O18/ JK5 | ........ | ....F... | ........ | ........ | .....A.. | ........ | ........ |
| iPS:39 3020 | 21-225_30E2 | VK1|O18/ JK5 | ........ | ....N... | ...L.... | ........ | ........ | ........ | ........ |
| iPS:39 3138 | 21-225_35E3 | VK1|O18/ JK5 | ........ | ....Y... | ........ | ....D... | ........ | .....E.. | ........ |
| iPS:39 3892 | 21-225_6G7 | VK1|O18/ JK5 | ......R. | ....F... | ...C.... | ........ | .......F. | ........ | ........ |
| iPS:39 3910 | 21-225_15F10 | VK1|O18/ JK5 | ........ | ..N.F.T. | ...L..S. | ....T... | .....V... | ........ | ........ |
| iPS:39 3912 | 21-225_16F6 | VK1|O18/ JK5 | ........ | ..N.F.T. | ...N..S. | ........ | .....V... | ........ | ....D.R. |
| iPS:39 4000 | 21-225_11A2 | VK1|O18/ JK5 | ........ | ....F... | ...N.... | ........ | .....V... | ........ | ........ |
| iPS:39 4004 | 21-225_13A1 | VK1|O18/ JK5 | ........ | ....N... | ........ | ...L.T.. | .....L... | .....E.. | ...D.... |
| iPS:39 4006 | 21-225_15C2 | VK1|O18/ JK5 | ........ | ....T... | ...N.... | ....G... | ........ | ........ | ...A.... |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:39 4029 | 21-225_1B12 | VK1|O18/ JK5 | | ....N.. | | | | ..E...... | |
| iPS:39 4047 | 21-225_5E6 | VK1|O18/ JK5 | | ....N.. ....C.. | | | | | |
| iPS:39 4081 | 21-225_16B3 | VK1|O18/ JK5 | | ....N.. | ....R.. | | | ...F...... | |
| | VK1L2/K3 Germline | K_FR1 DIVMTQSPATLS VSPGERATLSC | K_CDR1 RAS--QSVS ------SNLA | K_FR2 WYQQKPGQG APRLLIY | K_CDR2 -ASTRAT | K_FR3 GIPARFSGSGSG TDFTLTISSLQSEDFAV YYC | K_CDR3 QQYNN ------WPPT | K_FR4 FGPGTK VDIK |
| iPS:43 4219 | 21-225_60E9 | VK3|L2/ K3 | | ....R.. | | | | | ....I. |
| iPS:43 4279 | 21-225_57F7 | VK3|L2/ K3 | ....I... ....F... | ....S... | | | ....M........ | | |
| iPS:43 4289 | 21-225_57H12 | VK3|L2/ K3 | | ....D... | | ....A... | ........G... ............H.. | ....S... | |
| iPS:43 4291 | 21-225_58A4 | VK3|L2/ K3 | | ....D... | ....R.. | ....A... | | ....F... | ....N.. |
| iPS:43 4297 | 21-225_58A10 | VK3|L2/ K3 | ....C... | ....S... | | | | | |
| iPS:43 4301 | 21-225_58F11 | VK3|L2/ K3 | | ....D.V | | ....V.. | ........A...H.. | ....S... | |
| iPS:43 7228 | 21-225_60C11 | VK3|L2/ K3 | | ....ND.. | | | | | |
| | VK2|A19|JK5 Germline | K_FR1 DIVMTQSPLSL PVTPGEPASISC | K_CDR1 RSS--QSLLHSN GYNYLD | K_FR2 WYLQKPGQ SPQLLIY | K_CDR2 -LGSNRAS | K_FR3 GVPDRFSGSGSGT DFTLKISRVEAEDVGV YYC | K_CDR3 MQALQ ------TPIT | K_FR4 FGQGTR LEIK |
| iPS:43 4243 | 21-225_62C1 | VK2|A19/ JK5 | | | ....V.. | | ........G...F.. | ....L... | |
| iPS:43 6648 | 21-225_227F11 | VK2|A19/ JK5 | ....V... | ....W.. | | | | | |
| iPS:39 4061 | 21-225_12D2 | VK2|A19/ JK5 | | | ....V.. | | | ....L... | |
| iPS:39 4071 | 21-225_10C7 | VK2|A19/ JK5 | | ....K.. | ....V.. | | | ....L... | |
| | VK1|L5|JK4 Germline | K_FR1 DIQMTQSPSSVS ASVGDRVTITC | K_CDR1 RAS--QGIS ------SWLA | K_FR2 WYQQKPGK APKLLIY | K_CDR2 -ASSLQS | K_FR3 GVPSRFSGSGSGT DFTLTISSLQPEDFAT YYC | K_CDR3 QQANS ------FPIT | K_FR4 FGQGTK VEIK |
| iPS:43 4259 | 21-225_62G7 | VK1|L5/J K4 | ....F... | ....D... | ....N.. | | ....N... | ....T... | |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 4333 | 21-225_63C9 | VK1|L5/J K4 | .................. ................ | ........N.. ....... | ........ ........ | ............... ............... ... | ...........I.... | .A.. |
| iPS:43 4347 | 21-225_64H10 | VK1|L5/J K4 | .................. ................ | ...L....... ....... | ........ ........ | ............... ............... ... | ...........I.... | .... |
| iPS:43 4359 | 21-225_65G3 | VK1|L5/J K4 | .................. ................ | ........... ....... | ........ ........ | ............... ............... ... | .....G.....V.F.. | .... |
| iPS:43 4369 | 21-225_66B1 | VK1|L5/J K4 | .................. ................ | ...L....... ....... | ........ ........ | ............... ............... ... | ...........T.F.. | .... |
| iPS:43 4373 | 21-225_66A7 | VK1|L5/J K4 | ........K......... ....D........... | ........... ....... | ........ ........ | ............... ............... ... | ...........I.... | .... |
| iPS:43 4397 | 21-225_67H4 | VK1|L5/J K4 | .................. ................ | ....N..F... ....... | ........ ........ | ............... ............... ... | ...........T.... | .... |
| iPS:43 4427 | 21-225_70D6 | VK1|L5/J K4 | .................. ................ | ....N...... ....... | ........ ........ | ............N.. ............... ... | ...........T.... | .... |
| iPS:43 4435 | 21-225_70G9 | VK1|L5/J K4 | .................. ................ | ........... ....... | ........ ........ | ............... ............... ... | ...........I.... | .... |
| iPS:43 4437 | 21-225_70A12 | VK1|L5/J K4 | .................. ................ | ...L....... ....... | ........ ........ | .....V......... ............... ... | ...........T.... | .... |
| iPS:43 4451 | 21-225_71B7 | VK1|L5/J K4 | .................. ................ | ....N..E... ....... | .....G.. ........ | ............N.. ............... ... | ...........T.... | .... |
| iPS:43 4459 | 21-225_71A7 | VK1|L5/J K4 | .................. ................ | ........... ....... | ........ ........ | ............... ............... ... | ...........V.... | .... |
| iPS:43 4461 | 21-225_73A3 | VK1|L5/J K4 | .......I........L.Y ............... | ....R...... ....... | ........ ........ | ............... ............... ... | .....E.....V.... | .... |
| iPS:43 5479 | 21-225_154E9 | VK1|L5/J K4 | .......N...........Y ............... | ....V...... ....... | ........ ........ | .....V......... ............... ... | ...........G.... | ...L |
| iPS:43 7232 | 21-225_63E1 | VK1|L5/J K4 | .................. ................ | ........... ....... | ........ ........ | ............... ............... ... | ...........V.... | ...D |
| iPS:43 7326 | 21-225_75C10 | VK1|L5/J K4 | .......I........... ................ | ....F...... ....... | ........ ........ | ........L...... ............... ... | .........K...... | .... |

| | Germline | K_FR1 | K_CDR1 | K_FR2 | K_CDR2 | K_FR3 | K_CDR3 | K_FR4 |
|---|---|---|---|---|---|---|---|---|
| VK1|O12/JK2 | | DIQMTQSPSSLS ASVSDRVTITC | RAS QSIS SYLN | WYQQKPGK A PKLLIY | AASSLQS | GVPSRFSGSGSG TDFTLTISSLQPEDFAT YYC | QQSYS TPYT | FGQGTK LEIK |
| iPS:39 4309 | 21-225_59B5 | VK1|O12/JK2 | .................I. ................ | ........... ....... | ........ .G...... | ............... ............... ... | ...........TPMFS | .... |
| iPS:39 2874 | 21-225_21D2 | VK1|O12/JK2 | ..............F.... .........D...... | ........... ....... | ....R.D. ........ | ............... ............... ... | .......T.NI.LPERS | ..R. |
| iPS:39 3940 | 21-225_16B2 | VK1|O12/JK2 | GV................. ........G....... | ........... ....... | ........ .T...... | .....N........G ............... ... | .......T.NT.PPERS | .... |
| iPS:39 3956 | 21-225_4D7 | VK1|O12/JK2 | .................. .........D...... | ....F...... ....... | ....D... .TT..... | .....N......... ............... ... | .......T.NT.PPERS | .... |

| | | K_FR1 | K_CDR1 | K_FR2 | K_CDR2 | K_FR3 | K_CDR3 | K_FR4 |
|---|---|---|---|---|---|---|---|---|
| | | ....L....... | ...S..N | S....G. | ...G.. | I.......A....E...G | .QNYN... | |
| iPS:43_4457 | 21-225_72G12 | VK1|A20/JK4 | | | | | | |
| | Germline | ETVLTQSPGTLS LSPGERATLSC | RAS QSVSS SYLA | WYQQKPGQ APRLLIY | ASSRAT | GIPDRFSGSGSG TDFTLTISRLEPEDFAV YYC | QQYGS SPLT | FGGGTK VEIK |
| iPS:43_4479 | 21-225_76H1 | VK3|A27/JK4 | .FM........Y | .......V | | ...T.. | ........Y | C | T |
| iPS:43_4513 | 21-225_76A6 | VK3|A27/JK4 | W.........R. | | | ...T.. | ........Y | N | |
| iPS:43_4515 | 21-225_74A5 | VK3|A27/JK4 | .FM......... | .......V | | ...T.. | ........Y | C | T |
| iPS:43_4529 | 21-225_76B9 | VK3|A27/JK4 | .FM......... | .......V | | ...T.. | ........Y | C | T |
| iPS:43_4583 | 21-225_74B6 | VK3|A27/JK4 | W........C | .......V | | ...T.. | ........Y | N | |
| iPS:43_4587 | 21-225_74G3 | VK3|A27/JK4 | .FM......Y | .......V | | ...T.. | ........Y | C | T |
| iPS:43_4603 | 21-225_77D11 | VK3|A27/JK4 | W......I. | .......V | | ...T.. | ........Y | C | T |
| iPS:43_4705 | 21-225_80A2 | VK3|A27/JK4 | .FM......Y | .......V | | ...T.. | ........Y | C | T |
| iPS:43_4747 | 21-225_80C12 | VK3|A27/JK4 | .........Y | .......V | | ...T.. | ........Y | C | T |
| iPS:43_4793 | 21-225_82A5 | VK3|A27/JK4 | W........ | | | ...T.. | ........Y | N | |
| iPS:43_4797 | 21-225_82G5 | VK3|A27/JK4 | .FM......Y | ...E...V | | ...T.. | ........Y | C | T |
| iPS:43_4805 | 21-225_82D9 | VK3|A27/JK4 | .FM......S | ...E...V | | ...T.. | ........Y | C | T |
| iPS:43_4813 | 21-225_82C12 | VK3|A27/JK4 | W.......... | | | ...T.. | ........Y | N | |
| iPS:43_4825 | 21-225_83C2 | VK3|A27/JK4 | ........C | | | ...T.S | ........Y | C | T |
| iPS:43_4833 | 21-225_83C5 | VK3|A27/JK4 | .FM.......C | | | ...T.. | ........Y | C | T |
| iPS:43_4883 | 21-225_85B5 | VK3|A27/JK4 | .FM......... | S......V | | ...T.. | ........Y | C | T |
| iPS:43_4911 | 21-225_85D11 | VK3|A27/JK4 | .FM......T | S......V | | ...T.. | ........Y | N | |
| iPS:43_4957 | 21-225_87A10 | VK3|A27/JK4 | .F.......Y | .......V | | ...T.S | ........Y | N | |

| | | K_FR1 | K_CDR1 | K_FR2 | K_CDR2 | K_FR3 | K_CDR3 | K_FR4 |
|---|---|---|---|---|---|---|---|---|
| iPS:43 6246 | 21-225_201G6 | VK2|A19/ JK4 | ....... | ...R..H...N | ..... | ...... | ......... | ...QTP. | ... |
| iPS:43 6254 | 21-225_202C12 | VK2|A19/ JK4 | ....L.. | ...K..H...N | ..... | ...... | ......... | ...QTP. | ... |
| iPS:43 6304 | 21-225_201F3 | VK2|A19/ JK4 | ....... | ...R..H...N | ..... | ...... | ......... | ...QTP. | ... |
| iPS:43 6334 | 21-225_208G3 | VK2|A19/ JK4 | ....L.. | ...K..H...N | ..... | ...... | ......... | ...QTP. | ... |
| iPS:43 7248 | 21-225_97H3 | VK2|A19/ JK4 | ....I.. | ....H...... | ...R. | ...... | ....E.... | ...P...F. | ... |
| iPS:43 7320 | 21-225_75A1 | VK2|A19/ JK4 | ....... | ....H...... | ...R. | ...... | ....E.... | ...P...F. | ... |
| iPS:43 7371 | 21-225_74D8 | VK2|A19/ JK4 | ....... | ...S....V.. | ..... | ...... | ......S.. | ...H...P. | ... |
| iPS:39 2718 | 21-225_17B8 | VK2|A19/ JK4 | ....... | ...N.S..... | ..... | ....H. | ....D.L.. | ...V...TP. | ... |
| Germline | VK3|L2/JK1 | | K_FR1 EIVMTQSPAT LSVSPGERAT VSCRRASQSI SSNLA | K_CDR1 | K_FR2 WYQQKPGQ APRLLIY | K_CDR2 GASTRAT | K_FR3 GIPARFSGSG SGTEFTLTIS SLQSEDFAV YYC | K_CDR3 QQYNN WP | K_FR4 FGQGT KVEIK |
| iPS:43 4871 | 21-225_85H1 | VK3|L2/JK1 | ....... | ....D.I.... | ..... | ...... | ....V.... | ...E.D...CS | ... |
| iPS:43 5421 | 21-225_151F1 | VK3|L2/JK1 | .M..... | ....TY..... | ..... | ...... | ......... | ...D...WP. | ... |
| iPS:43 5497 | 21-225_155H9 | VK3|L2/JK1 | .....V. | ....IN..... | ..... | ...... | .........L | ...D...WP. | ... |
| iPS:43 5605 | 21-225_161A4 | VK3|L2/JK1 | ....S.. | ....I.I.... | ...R. | ...... | ....D.N.. | ...DD..WP. | ...T |
| iPS:45 1118 | 21-225_191C8 | VK3|L2/JK1 | ....... | ...S...N... | ...L. | ...I.. | ......F.. | ...NW..... | ... |
| iPS:39 2734 | 21-225_17D8 | VK3|L2/JK1 | ....... | ........... | ...E. | ...... | ......... | ...SFT..LR. | ... |
| iPS:39 2768 | 21-225_20B8 | VK3|L2/JK1 | ...S... | ........... | ..F.N | ...S.. | ......... | .........L. | ... |
| iPS:39 3044 | 21-225_25B8 | VK3|L2/JK1 | ...S... | ...R....... | ..F.N | ...S.. | ......... | ...C.L..... | ... |
| iPS:39 3050 | 21-225_28C5 | VK3|L2/JK1 | ....... | ...R....... | ..H.. | ...... | .........L | ...WP..P | ... |

Figure 52 (Continued)

| | | VK3\|L2/J K1 | | K_FR1 | K_CDR1 | K_FR2 | K_CDR2 | K_FR3 | K_CDR3 | K_FR4 |
|---|---|---|---|---|---|---|---|---|---|---|
| iPS:39 3906 | 21-225_13D3 | | Germline | DIQMTQSPSSLS ASVGDRVTITC | RAS QSIS NYLA | WFQQKPGK APKLLIY | AASSLQS | GVPSRFSGSGSG TDFTLTISSLQPEDFAT YYC | QQSYS TPIT | FGQGTK LEIK |
| | | | | ........T... | | ....F...N | | | ....HD | |
| VK1\|L1\|JK5 | | | | | | | | | | |
| iPS:43 4947 | 21-225_87B7 | VK1\|L1/J K5 | | ........S... | | | | | ....P. | |
| iPS:43 5427 | 21-225_151C9 | VK1\|L1/J K5 | | | | | | ....K...... | ....LL.LT | |
| iPS:43 5529 | 21-225_157H7 | VK1\|L1/J K5 | | | ....K... | | ...H | ....K...... | ....S...F ....L | |
| iPS:43 6066 | 21-225_194B7 | VK1\|L1/J K5 | | | | | ...D...R | ....K...... | ....H.KH | |
| iPS:43 7274 | 21-225_196D4 | VK1\|L1/J K5 | | | ....D... ....F... | | ...T...VS | ....K...... | ....S | |
| iPS:39 2748 | 21-225_20A8 | VK1\|L1/J K5 | | | ....K... | | ...G...R | ....K...... | ....H.LN ....L | |
| iPS:43 3062 | 21-225_33H3 | VK1\|L1/J K5 | | | ....N.. ....V | | | ....K...... | ....H.LN ....L | |
| iPS:43 8532 | 21-225_33B7 | VK1\|L1/J K5 | | | ....Q... ....D.. ....F.N | | ...D...... ...N.VT | ....F...... ....R | ....DN ....L | |
| iPS:40 2221 | 21-225_2C12 | VK1\|L1/J K5 | | | ....D... | | | ....K...... | ....H | |
| | | | | | | ...T...S | ...T | ....Q...... | ....Y ....L | |
| | | | | | | | ....S...T | ....K..P.V ....K...C | | |
| | | | | | | | | ....K......F | | |
| | | | | K_FR1 | K_CDR1 | K_FR2 | K_CDR2 | K_FR3 | K_CDR3 | K_FR4 |
| VK4\|B3\|JK5 | | | Germline | DIVMTQSPDSLA VSLGERATINC | KSS QSVLYSSNNKN YLA | WYQQKPGQ N PPKLLIY | WASTRES | GVPDRFSGSGSG TDFTLTISSLQAEDVAV YYC | QQYYS TPIT | FGQGTK LEIK |
| iPS:43 5665 | 21-225_169F2 | VK4\|B3/J K5 | | | | | | | | |
| iPS:43 5671 | 21-225_169H5 | VK4\|B3/J K5 | | ........I... | | | | | ......RAP. | |
| iPS:43 6554 | 21-225_224C10 | VK4\|B3/J K5 | | ......A..... | ...N... | | | | | |
| iPS:39 8510 | 21-225_25A3 | VK4\|B3/J K5 | | ..........T. | | | | | ......RAP. | |
| iPS:39 8516 | 21-225_26A9 | VK4\|B3/J K5 | | ..........T. | | | | ....I | ....I...N.CS | |
| | | | | | | | | | ...CS | |
| | | | | | | | | | ....S.CS | |
| | | | | K_FR1 | K_CDR1 | K_FR2 | K_CDR2 | K_FR3 | K_CDR3 | K_FR4 |

Figure 52 (Continued)

| | | | | K_FR1 | K_CDR1 | K_FR2 | K_CDR2 | K_FR3 | K_CDR3 | K_FR4 |
|---|---|---|---|---|---|---|---|---|---|---|
| VK2/A19/JK | | | | DIVMTQSPLSL PVTPGEPASIS | RSS QSLLHSNGYNYLD | WYLQKPGQ SPQLLIY | LGSNRAS | GVPDRFSGSGS GTDFTLKISRVEAEDVGVYYC | MQALQ TPWT | FGQGTK VEIK |
| iPS:43 5667 | 21-225_169E3 | VK2/A19/JK1 | | . . . . . . . . . . . . . . . . . . . . . . . | . . . . . K . . . . N . . . . . . . | . . . . . . . . . . . . . . . . | . . . . . . . | . . . . . . . . . . . . . . . . . . . . . . A . . . . . . . . . . . | . V . . . | . . . . . |
| iPS:43 5673 | 21-225_169E6 | VK2/A19/JK1 | | . . . . . . . . . . . . . . . . . . . . . . . | . . . . . K . . . . N . . . . . . . | . . . . . . . . . . . . . . . . | . . . . . . . | . . . . . . . . . . . . . . . . . . . . . . A . . . . . . . . . . . | . V . . . | . . . . . |
| iPS:43 5759 | 21-225_176E6 | VK2/A19/JK1 | | . . . . . . . . . . . . . . . . . . . . . . . | . . . . . K . . . . N . . . . . . . | . . . . . . . . . . . . . . . . | . . . . . . . | . . . . . . . . . . . . . . . . . . . . . . A . . . . . . . . . . . | . V . . . | . . . . . |
| Germline | | | K_FR1 | K_CDR1 | K_FR2 | K_CDR2 | K_FR3 | K_CDR3 | K_FR4 | |
| VK6/A26/JK4 | | | | EIVLTQSPDFQS VTPKEKVTIT | RAS QSIG SSLH | WYQQKPD QSPKLLIK | YASQSFS | GVPSRFSGSGSG TDFTLTINSLEAEDAAT YYC | HQSSS LPWT | FGQGTK VEIK |
| iPS:43 5817 | 21-225_190B11 | VK6/A26/JK1 | | . A . . . . . . . . . . . . . . . . . . . . . | . . . . N . . . . . . . . | . . . . . . . . . . . . . . . . | . . . S . . . | . . . . . . . . . . . . . . . . . . . . . . T . . . . . . . . . . . . | . Q . . . | . . . . . |
| iPS:43 5823 | 21-225_190F11 | VK6/A26/JK1 | | . . . . F . S . . . . . . . . . . . . . . . . | . . . . N . . . . . . . . | . . . . . . . . . . V . . . . . | . . . . . . . | . . . . . . . . . . . . . . . . . . . . . . . . . . . . . . . . . . | . . . . . | . . F . R . |
| iPS:43 5867 | 21-225_191E5 | VK6/A26/JK1 | | . . . . F . S . . . . . . . . . . . . . . . . | . . . . . . . . . . . . . | . . . . . . . . . . . . . . . . | . . . . . . . | . . . . . . . . . . . . . . . . . . . . . . T . . . . . . . . . . . . | . Q . . . | . . F . R . |
| iPS:43 5917 | 21-225_190D5 | VK6/A26/JK1 | | . A . . . . . . . . . . . . . . . . . . . . . | . . . . N . . . . . . . . | . . . . . . . . . . . . . . . . | . . . S . . . | . . . . . . . . . . . . . . . . . . . . . . T . . . . . . . . . . . . | . Q . . . | . . F . R . |
| iPS:43 5929 | 21-225_190D9 | VK6/A26/JK1 | | . . . . F . S . . . . . . . . . . . . . . . . | . . . . . . . . . . . . . | . . . . . . . . . . . . . . . . | . . . S . . . | . . . . . . . . . . . . . . . . . . . . . . T . . . . . . . . . . . . | . . . . . | . . F . R . |
| iPS:43 5935 | 21-225_190H8 | VK6/A26/JK1 | | . . . . . . . . . . . . . . . . . . . . . . . | . . . . N T . . . . . . . | . . . . . . . . . . . . . . . . | . . . S . . . | . . . . . . . . . . . . . . . . . . . . . . . . . . . . . . . . . . | . . . . . | . . . Q . |
| iPS:43 6056 | 21-225_194C3 | VK6/A26/JK1 | | . A . . . . . . . . . . . . . . . . . . . . . | . . . . N . . . . . . . . | . . . . . . . . . . . . . . . . | . . . S . . . | . . . . . . . . . . . . . . . . . . . . . . T . . . . . . . . . . . . | . Q . . . | . . . . . |
| iPS:43 6216 | 21-225_200B7 | VK6/A26/JK1 | | . . . . . . . K . . . . . . . . . . . . . . . | . . . . . . . . . . . . . | . . . . . . . . . . . . . . . . | . . . . . . . | . . . . . . . . . . . . . . . . . . . . . . . . . . . . . . G . . . | . . G . . | . . . . . |
| iPS:43 6220 | 21-225_200F8 | VK6/A26/JK1 | | . A . . . . . . . . . . . . . . . . . . . . . | . . . . N . . . . . . . . | . . . . . . . . . . . . . . . . | . . . . . . . | . . . . . . . . . . . . . . . . . . . . . . T . . . . . . . . . . . . | . Q . . . | . . . R . |
| iPS:43 6448 | 21-225_217A3 | VK6/A26/JK1 | | . . . . . . . . . . . . . . . . . . . . . . . | . . . . . . . . . . . . . | . . . . . . . . . . . . . . . . | . . . . . . . | . . . . . . . . . . . . . . . . . . . . . . . . . . . . . . . . . . | . . . . . | . . . . . |
| Germline | | | K_FR1 | K_CDR1 | K_FR2 | K_CDR2 | K_FR3 | K_CDR3 | K_FR4 | |
| VK6/A26/JK4 | | | | EIVLTQSPDFQS VTPKEKVTIT | RAS QSIG SSLH | WYQQKPD QSPKLLIK | YASQSFS | GVPSRFSGSGSG TDFTLTINSLEAEDAAT YYC | HQSSS LPLT | FGGGTK VEIK |
| iPS:43 5829 | 21-225_190B12 | VK6/A26/JK4 | | . . . . . . . . . . . . . . . . . . . . . . . | . . . . . . . . . . . . . | . . . . . . . . . . . . . . . . | . . . . . . . | . . . . . . . . . . . . . . . . . . . . . . D . . . . . . . . . . . . | . . TR . | . . . . . |
| iPS:43 5863 | 21-225_191H4 | VK6/A26/JK4 | | . . . . . . . . . . . . . . . . . . . . . . . | . . . . N . . . . . . . . | . . . . . . . . . . . . . . . . | . . . L . . . | . . . . . . . . . . . . . . . . . . . . . . . A . . . . . . . . . . . | . . TGR | . . . . . |
| iPS:43 5943 | 21-225_191C9 | VK6/A26/JK4 | | . . . . . . . . . . . . . . . . . . . . . . . | . . . . . . . . . . . . . | . . . . . . . . . . . . . . . . | . . . . . . . | . . . . . . . . . . . . . . . . . . . . . . D . . . . . . . . . . . . | . . TR . | . . . . . |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| iPS:43 5983 | 21-225_192E5 | VK6|A26/JK4 | ........................ | ........ | ........... | ........ | ........................... | ........ | ........ |
| iPS:43 6043 | 21-225_193G9 | VK6|A26/JK4 | ........................ | ....R... | .....R..... | ........ | ........................... | ...R.... | ........ |
| iPS:43 6084 | 21-225_195F2 | VK6|A26/JK4 | ........................ | ........ | .....L..... | ........ | ........................... | ...RT... | ........ |
| iPS:43 6094 | 21-225_195B10 | VK6|A26/JK4 | ........................ | ........ | ........... | ........ | A....S..................... | ...GR... | ........ |
| iPS:43 6240 | 21-225_201E8 | VK6|A26/JK4 | ........................ | ....A... | ........... | ...N.... | ........................... | ...R.... | ...R.... |
| iPS:43 6314 | 21-225_206G4 | VK6|A26/JK4 | ........................ | ....R... | ........... | ...V.... | ........................... | ...R.... | ........ |
| | Germline | | DIVMTQSPDSLAVSLGERATINC | RAS-QGIS-SYLA | WYQQKPGQ-PPKLLIY-AASTLQS | GVPSRFSGSGS-GTDFTLTISSLQAEDVAVYYC | QKYNS--APLT | FGPGTK-VDIK | K_FR4 |
| | VK1|A20/JK3 | | ........................ | ........ | ........... | ........ | ........................... | ........ | ........ |
| iPS:43 5833 | 21-225_190D12 | VK1|A20/JK3 | ........................ | ........ | ........... | ...V.... | ........................... | ........ | ........ |
| iPS:43 6019 | 21-225_193C4 | VK1|A20/JK3 | ........................ | ...P..I. | .....N..... | ........ | ........................... | ........ | ........ |
| iPS:39 4010 | 21-225_12G5 | VK1|A20/JK3 | ......P................. | ....D... | ........... | ...YI... | A.......................... | ....D... | ........ |
| | Germline | | K_FR1 | K_CDR1 | K_FR2 | K_CDR2 | K_FR3 | K_CDR3 | K_FR4 |
| | VK6|A26/JK3 | | EIVLTQSPGTLSLSPGERATLSC | RAS-QSIS-SSLH | WYQQKPGQ-APRLLIK-ASQSFS | GVPSRFSGSGS-GTDFTLTISRLEPEDFAVYYC | HQSSS--LPLT | FGQGTK-LEIK | K_FR4 |
| iPS:43 6025 | 21-225_193B5 | VK6|A26/JK3 | ........................ | ........ | ........... | ........ | ........................... | ........ | ........ |
| iPS:43 6096 | 21-225_195E10 | VK6|A26/JK3 | ........................ | ....R... | ........... | ........ | ........................... | ...R.... | ....S... |
| iPS:43 6408 | 21-225_214H8 | VK6|A26/JK3 | ........................ | ....V... | .....Q..... | ........ | .....S..................... | ...R.... | ........ |
| iPS:43 6424 | 21-225_215H6 | VK6|A26/JK3 | ........................ | ....V... | .....Q..L.. | ...L.... | ...................I....... | ...R.... | ....S... |
| | Germline | | K_FR1 | K_CDR1 | K_FR2 | K_CDR2 | K_FR3 | K_CDR3 | K_FR4 |
| | VK1|L5/JK2 | | DIQMTQSPSSVSASVGDRVTITC | RAS-QGIS-SWLA | WYQQKPGQ-APKLLIY-AASSLQS | GVPSRFSGSGS-GTDFTLTISSLQPEDFATYYC | QQANS--FPLT | FGGGTK-VEIK | K_FR4 |
| iPS:43 6082 | 21-225_195D9 | VK1|L5/JK2 | ........................ | ........ | ........... | ...LG... | ........................... | ...R.... | ....CS.. |
| iPS:43 6118 | 21-225_196A10 | VK1|L5/JK2 | ......Y.Y.........S..... | ....R... | .....A.F... | ...LG... | .....S..................... | ...RD... | .L.CS... |
| | Germline | | K_FR1 | K_CDR1 | K_FR2 | K_CDR2 | K_FR3 | K_CDR3 | K_FR4 |

Figure 52 (Continued)

| | | K_FR1 | K_CDR1 | K_FR2 | K_CDR2 | K_FR3 | K_CDR3 | K_FR4 |
|---|---|---|---|---|---|---|---|---|
| VK2lA19/JK2 | | DIVMTQSPLSLP VTPGEPASISC | RSS QSLLHSN GYNYLD | WYLQKPGQSP QRLLIY | LGS NRAS | GVPDRFSGSGS GTDFTLKISRVEAEDVGV YYC | MQALQ TPYT | FGQGTK LEIK |
| iPS:43 6362 | 21-225_210C12 | VK2|A19/ JK2 | ......... | ...H.F.... | ........Y | ...V... | ............ | ......... | ......... |
| iPS:43 6374 | 21-225_211C10 | VK2|A19/ JK2 | ......... | ........... | .......L.. | ....... | ............ | L... TPMCS | ......... |
| | Germline | K_FR1 | K_CDR1 | K_FR2 | K_CDR2 | K_FR3 | K_CDR3 | K_FR4 |
| VK2|A17/JK1 | | DVVMTQSPLSLP VTLGQPASISC | RSS QSLVHSD GNTYLN | FQQRPGQ SPRRLII | K VSNRDS | GVPDRFSGSGS GTDFTLKISRVEAEDVGV YYC | MQGTH MENT | FGQGTK VEIK |
| iPS:43 7226 | 21-225_57C2 | VK2|A17/ JK1 | ......... | ........... | .....E.... | ....W.. | ....N....A. | ...V..R. | ......... |
| | Germline | K_FR1 | K_CDR1 | K_FR2 | K_CDR2 | K_FR3 | K_CDR3 | K_FR4 |
| VK1|A20/JK5 | | DIQMTQSPSSLS ASVGDRVTITC | RAS QGIS NYLA | WFQQKPGKA PKLLIY | A ASTLQS | GVPSRFSGSG SGTDFTLTISSLQPEDFAT YYC | QQYNS APYT | FGQGTK LEIK |
| iPS:39 2726 | 21-225_20B5 | VK1|A20/ JK5 | ......... | ....N...... | ....I..... | ....... | ............ | .......AP. | ......... |
| iPS:39 2792 | 21-225_20G12 | VK1|A20/ JK5 | ......... | ........... | ....V..... | ...T... | ....V....... | .......AP. | ......... |
| iPS:39 8478 | 21-225_17C10 | VK1|A20/ JK5 | .......Q. | ........... | ........... | ....R.. | ........D... | .....AP.L. | ......... |
| | Germline | K_FR1 | K_CDR1 | K_FR2 | K_CDR2 | K_FR3 | K_CDR3 | K_FR4 |
| VK1|L1/JK2 | | DIQMTQSPSSLS ASVGDRVTITC | RAS QGIS NDLG | WFQQKPGKA PKLLIY | A ASSLQS | GVPSRFSGSG SGTDFTLTISSLQPEDFAT YYC | LQHNS YPYT | FGQGTK VDIK |
| iPS:43 2776 | 21-225_21A12 | VK1|L1/J K2 | ......... | ...K....... | ........... | ....... | ....K....... | ........FR | ......... |
| | Germline | K_FR1 | K_CDR1 | K_FR2 | K_CDR2 | K_FR3 | K_CDR3 | K_FR4 |
| VK1|A30/JK3 | | DIQMTQSPSSLS ASVGDRVTITC | RAS QGIS NYLA | WFQQKPGKA PKLLIY | A ASSLQS | GVPSRFSGSG SGTDFTLTISSLQPEDFAT YYC | LQHNS YPFT | FGPGTK VDIK |
| iPS:43 7240 | 21-225_84H12 | VK1|A30/ JK3 | ....YQ. | ........... | ........F.. | ....... | ............ | ..D...... | ......... |
| iPS:43 4577 | 21-225_75C11 | VK1|A30/ JK3 | ......... | ........... | ........F.. | ....... | ............ | ..D...... | ......... |
| iPS:43 4553 | 21-225_76H12 | VK1|A30/ JK3 | ......... | ........... | ........F.. | ....... | ............ | ..D...... | ......... |
| iPS:43 4927 | 21-225_86E5 | VK1|A30/ JK3 | ......... | ........... | ........... | ...R... | .......H.... | ..D...... | .......E. |
| | Germline | K_FR1 | K_CDR1 | K_FR2 | K_CDR2 | K_FR3 | K_CDR3 | K_FR4 |

Figure 52 (Continued)

| VK1|L5|JK1 | | DIQMTQSPSSVS ASVGDRVTITC | RAS QGIS ---SWLA | WYQQKPGKA PKLLIY | -AASSLQS | GVPSRFSGSGSGG TDFTLTISSLQPEDFAT YYC | QQANS ----------FPWT | FGQGTK VEIK |
|---|---|---|---|---|---|---|---|---|
| iPS:43 5477 | 21- 225_154E8 | VK1|L5|J K1 | .I.......... ............ | ....F....... | ....T... | -------- | ............ ................ ... | ............ ........... | ..FN |
| iPS:43 5385 | 21- 225_149G7 | VK1|L5|J K1 | ............ ............ | ....F....... | .F...... | -------- | ............ ................ ... | ............ ........... | ..N. |
| LAMBDA_VARIABL E | | | | | | | | | |
| | | Germline | L_FR1 | L_CDR1 | L_FR2 | L_CDR2 | L_FR3 | L_CDR3 | L_FR4 |
| | | | SSELTQP PSVSVSPGQTAS ITC | SGD KLGD KYAC | WYQQKPGQ SPVLVI | YQDSKRPS | GIPERFSGSNSGN MATLTISGTQAMDEAD YYC | QAWDS --------STAVV | FGGGTK LTVL |
| iPS:45 3445 | 21- 225_148E10 | VL3|3r/JL 2 | ............ ............ | .V...N. | ........ | ........ | ............ ................ ... | .......... ........ | ........ |
| iPS:47 2742 | 21- 225_30D9_L C2 | VL3|3r/JL 2 | ............ ............ | ........... | .AA..R.H .I. | ........ | ............ ................ ... | .R........ .N.Y..... | ........ |
| iPS:47 2743 | 21-225_68G6 | VL3|3r/JL 2 | .V.......... ............ | ..VY........ | ...F.... | ........ | .D.......... ................ ... | .N........ ---STA... | ........ |
| iPS:43 6652 | 21- 225_146B11 | VL3|3r/JL 2 | ............ ............ | ..TY........ | ....A... | ........ | ............ ..........A..F. ... | .......... ---STA... | ........ |
| iPS:43 6654 | 21- 225_146C11 | VL3|3r/JL 2 | ............ ............ | ...S........ | ...F.... | ...R.... | .I.......... ................ ... | .N........ .--ST.... | ........ |
| iPS:43 6658 | 21- 225_146A2 | VL3|3r/JL 2 | ............ ............ | ...S........ | ........ | ...R.... | .I.......... ................ ... | .......... .--ST.... | ........ |
| iPS:43 6664 | 21- 225_147E7 | VL3|3r/JL 2 | ............ ............ | ...S........ | ........ | ........ | .I.......... ................ ... | .......... .--ST.... | ........ |
| iPS:43 6666 | 21- 225_147B8 | VL3|3r/JL 2 | ............ ............ | ..V......... | ...E.... | ........ | .I......L.V. ................ ... | .G........ .--ST.... | ........ |
| iPS:43 6668 | 21- 225_147B9 | VL3|3r/JL 2 | ............ ............ | ..VS........ | ........ | ........ | ............ ................ ... | .L........ .N....... | ........ |
| iPS:43 6670 | 21- 225_147D9 | VL3|3r/JL 2 | ............ ............ | ..V......... | ...R.... | ...R.... | ............ ..........F.... ... | .......... ........ | ........ |
| iPS:43 6672 | 21- 225_147F9 | VL3|3r/JL 2 | ............ ............ | .E..N....... | ...R.... | ........ | ............ ................ ... | .R........ .N.Y..... | ........ |
| iPS:43 6674 | 21- 225_147G9 | VL3|3r/JL 2 | ............ ............ | ...S........ | ........ | ...R.... | ............ ................ ... | .H........ .--ST.... | ........ |
| iPS:43 6676 | 21- 225_147E11 | VL3|3r/JL 2 | ............ ............ | ............ | ........ | ........ | .I.......... ................ ... | .H........ .--ST.... | ........ |
| iPS:43 6678 | 21- 225_147B12 | VL3|3r/JL 2 | ............ ............ | ............ | ........ | ........ | .I.......... ...........A... ... | .......... .--ST.... | ........ |
| iPS:43 6686 | 21- 225_148G6 | VL3|3r/JL 2 | ............ ............ | ...S........ | ........ | ........ | .I.......... ................ ... | .......... .--ST.... | ........ |

Figure 52 (Continued)

| | | | | | | | | | |
|---|---|---|---|---|---|---|---|---|---|
| iPS:43 6688 | 21-225_148C8 | VL3J3r/JL2 | | .VS | .I. | .R. | .T. | | .L. |
| iPS:43 6690 | 21-225_148A9 | VL3J3r/JL2 | | .N..V | | | | | .H..-ST. |
| iPS:43 6694 | 21-225_148G11 | VL3J3r/JL2 | | F.S | | | | .I | ..-ST. |
| iPS:43 6698 | 21-225_149B5 | VL3J3r/JL2 | | Y..Y.V | .F | | | | ..-ST. |
| iPS:43 6700 | 21-225_149C7 | VL3J3r/JL2 | | .N...S | | NNQ. | | .K.I | .F. |
| iPS:43 6704 | 21-225_149C10 | VL3J3r/JL2 | | .S | | .N. | .S | .G.I | .H.-ST. |
| iPS:43 6706 | 21-225_149A11 | VL3J3r/JL2 | | .N..VS | | .R. | | .I | .-ST. |
| iPS:43 6708 | 21-225_150D3 | VL3J3r/JL2 | | .E..N. | | .N. | | .S | .L...-ST. |
| iPS:43 6710 | 21-225_150F6 | VL3J3r/JL2 | | .S | .C | | | .I | .C.-ST. |
| iPS:43 6714 | 21-225_150H11 | VL3J3r/JL2 | | .S | | | | .I | .F.-ST. |
| iPS:43 6716 | 21-225_151F3 | VL3J3r/JL2 | | .V | | .R. | | | .H.-ST. |
| iPS:43 6718 | 21-225_151H5 | VL3J3r/JL2 | .A | .S | | | | .I | .-ST. |
| iPS:43 6722 | 21-225_151H7 | VL3J3r/JL2 | .D | .S | | | | .I | .-ST. |
| iPS:43 6724 | 21-225_151B9 | VL3J3r/JL2 | .A | .S | | | | .I | .-ST. |
| iPS:43 6728 | 21-225_152G6 | VL3J3r/JL2 | | .S | | | | .I | .-ST. |
| iPS:43 6730 | 21-225_152D7 | VL3J3r/JL2 | | .N..S | | | .T | .I.L. | .N..-ST. |
| iPS:43 6736 | 21-225_153E8 | VL3J3r/JL2 | | .S...N..V | .R. | .N. | | .I..G. | .Y.I.-ST. |
| iPS:43 6738 | 21-225_153D9 | VL3J3r/JL2 | | | | .R. | | | .H.-ST..V |
| iPS:43 6740 | 21-225_154C3 | VL3J3r/JL2 | | .V | | .R. | | | .H.-ST. |
| iPS:43 6742 | 21-225_154C4 | VL3J3r/JL2 | .R | .V | | | | .I | .-ST. |
| iPS:43 6744 | 21-225_154F4 | VL3J3r/JL2 | | .N..V | .E | .K. | | .G | .N.-STL. |

Figure 52 (Continued)

| | | | | | | | | |
|---|---|---|---|---|---|---|---|---|
| iPS:43 6746 | 21- 225_154E10 | VL3j3r/jL 2 | . | . | . | . | . N . | . -ST . | . |
| iPS:43 6748 | 21- 225_154D11 | VL3j3r/jL 2 | . | . | . | . K . | I . H . | . -SI . | . |
| iPS:43 6756 | 21- 225_146A10 | VL3j3r/jL 2 | . | . | . F . | . R . | . | . -ST . | . V . |
| iPS:43 6758 | 21- 225_155C10 | VL3j3r/jL 2 | . | . V . | . | . | I . | . -ST . | . |
| iPS:43 6760 | 21- 225_155E10 | VL3j3r/jL 2 | . | . VS | . | . R . | . | . -ST . | . |
| iPS:43 6764 | 21- 225_158E9 | VL3j3r/jL 2 | . D . | . | . | . | L . | . F . | . |
| iPS:43 6766 | 21- 225_158D10 | VL3j3r/jL 2 | . T . | . V . | . | . | . T . N . | . N . SF . L | . |
| iPS:43 6768 | 21- 225_159H8 | VL3j3r/jL 2 | . | . V . | . | . R . | . L . | . GN . SF . | . |
| iPS:43 6770 | 21- 225_160B12 | VL3j3r/jL 2 | . D . | . S . | . | . | . L . | . GN . SF | . |
| iPS:43 6772 | 21- 225_161H3 | VL3j3r/jL 2 | . | . R . V . | . | . | . L . | . GN . SF . | . |
| iPS:43 6774 | 21- 225_161E10 | VL3j3r/jL 2 | . FD . | . V . | . F . | . N . | . | . VN . N . | . |
| iPS:43 6776 | 21- 225_161F12 | VL3j3r/jL 2 | . | . V . | . | . T . | . I . | . T . N . SFAL | . |
| iPS:43 6780 | 21- 225_165H3 | VL3j3r/jL 2 | . | . | . | . | . L . | . . TL . | . |
| iPS:43 6782 | 21- 225_166G11 | VL3j3r/jL 2 | . | . VH | . | . | . L . | . . TL . | . |
| iPS:43 6784 | 21- 225_169C1 | VL3j3r/jL 2 | . | . V . | . L . | K . I . | . | . N . -STA . | . |
| iPS:43 6786 | 21- 225_169A6 | VL3j3r/jL 2 | . | . V . | . R . | . I . | . | . T . -NT.I | . |
| iPS:43 6788 | 21- 225_169B7 | VL3j3r/jL 2 | A.D . | . G . | . | . Y . | . | . T . -NT.L | . |
| iPS:43 6790 | 21- 225_169G11 | VL3j3r/jL 2 | . | . S . | . R . | . | . | . K . -NT . | . |
| iPS:43 6794 | 21- 225_170F1 | VL3j3r/jL 2 | . | . | . | . | . A . | . N . -STA . | . |
| iPS:43 6796 | 21- 225_170A5 | VL3j3r/jL 2 | . D . | . G . | . I . | . Y . | . | . N . -NTA . | . |
| iPS:43 6798 | 21- 225_171F5 | VL3j3r/jL 2 | A.D . | . S . | . | . R . | . | . K . -NT . -STM | . R . |

Figure 52 (Continued)

| | | | | | | | | | |
|---|---|---|---|---|---|---|---|---|---|
| iPS:43 6802 | 21-225_171E12 | VL3lr/JL2 | | | | | | I..........Y....... | |
| iPS:43 6808 | 21-225_173F8 | VL3lr/JL2 | | ....N.. | ..R..S | ....R.. | | .........-FT...... | ...R |
| iPS:43 6812 | 21-225_175C6 | VL3lr/JL2 | .D.... | ....V.. | | | ..N......-STM...... | |
| iPS:43 6818 | 21-225_179C7 | VL3lr/JL2 | | ....V.. | ..I... | ...Y... | | | |
| iPS:43 6822 | 21-225_180D4 | VL3lr/JL2 | .T.... | ....R.. | ..R... | E..R... | ....R.. | ..N............... | |
| iPS:43 6824 | 21-225_180C5 | VL3lr/JL2 | | ....E.. | | ....R.. | ...G... | .........-RK...... | |
| iPS:43 6826 | 21-225_180G5 | VL3lr/JL2 | .Y.... | ....VS. | | ....R.. | | ..I......-STA...... | |
| iPS:43 6828 | 21-225_181H1 | VL3lr/JL2 | .T.... | | | E..R... | S.....P. | .........-IA....... | |
| iPS:43 6836 | 21-225_52H1 | VL3lr/JL2 | .F..S | ....VS. | | ....R.. | | ..N......-RK...... | |
| iPS:43 6848 | 21-225_57F1 | VL3lr/JL2 | .A... | ....E.. | | ....R.. | | .........-ST....... | |
| iPS:43 6850 | 21-225_57D9 | VL3lr/JL2 | .....E.....F. | ..E... | ....R.. | | .........-ST....... | |
| iPS:43 6852 | 21-225_57H11 | VL3lr/JL2 | .A.... | ..E... | | ....R.. | | .........-ST....... | |
| iPS:43 6854 | 21-225_58C1 | VL3lr/JL2 | | ....N.. | | ....R.. | | .........-SSTA...... | |
| iPS:43 6858 | 21-225_58E7 | VL3lr/JL2 | .N.... | ....T.. | ..K... | ..N... | ....F... | ..NN.....-YT....... | ..A |
| iPS:43 6860 | 21-225_58F7 | VL3lr/JL2 | .S.... | | | ....R.. | | .........-ST....... | |
| iPS:43 6862 | 21-225_58F8 | VL3lr/JL2 | | | | | | .........-ST....... | |
| iPS:43 6864 | 21-225_58G11 | VL3lr/JL2 | | ....S.. | | ....M.. | | ..NN.....-NI.M..... | |
| iPS:43 6866 | 21-225_59F2 | VL3lr/JL2 | | ....S.. | ..R... | ..N... | | ..N......-NT....... | |
| iPS:43 6868 | 21-225_59B11 | VL3lr/JL2 | | | | ....R.. | ...L... | .........Y.......... | |
| iPS:43 6870 | 21-225_60B1 | VL3lr/JL2 | .A.... | | | | | .........-ST....... | |
| iPS:43 6872 | 21-225_60D2 | VL3lr/JL2 | | ....S.. | ..R... | ..N... | .....T... | ..N......-NT....... | |

Figure 52 (Continued)

| | | | | | | | | | | | |
|---|---|---|---|---|---|---|---|---|---|---|---|
| iPS:43 6874 | 21-225_60A12 | VL3}3r/J}L 2 | | .N | | | .I | | | ...-SSTA | |
| iPS:43 6876 | 21-225_61F5 | VL3}3r/J}L 2 | .N | .E | | .R | | | | -ST. | |
| iPS:43 6878 | 21-225_62E3 | VL3}3r/J}L 2 | .D | .N | .V | .R | | | | -STA. | |
| iPS:43 6880 | 21-225_62E8 | VL3}3r/J}L 2 | .D | R.N S | .V | .R | | | | -STA. | |
| iPS:43 6882 | 21-225_62D10 | VL3}3r/J}L 2 | .D | .N | .V | .R | | | | -STA. | |
| iPS:43 6884 | 21-225_62A12 | VL3}3r/J}L 2 | .D | .N | .V | .R | | | | -STA. | |
| iPS:43 6886 | 21-225_62B12 | VL3}3r/J}L 2 | .D | .N I | .V | .R | | | .N | -ST. | |
| iPS:43 6892 | 21-225_65E9 | VL3}3r/J}L 2 | .D | .N DY | | .R | | | .I | -NTA. | |
| iPS:43 6894 | 21-225_66G9 | VL3}3r/J}L 2 | .D T | .N | .V | .R | | | .N | -ST. | R |
| iPS:43 6896 | 21-225_67F10 | VL3}3r/J}L 2 | | .Y W | .F | E.R | | | | -ST. | |
| iPS:43 6898 | 21-225_68D8 | VL3}3r/J}L 2 | | .N DY | | .R | | | .N | -ST. | |
| iPS:43 6900 | 21-225_69B9 | VL3}3r/J}L 2 | | .W | .R | E.R | | | .N | -ST. | |
| iPS:43 6902 | 21-225_69B11 | VL3}3r/J}L 2 | .A | .Y | .V | .R | | | .N | -ST. | |
| iPS:43 6904 | 21-225_71D4 | VL3}3r/J}L 2 | | .W | .V | .R | | | .VN | -ST. | |
| iPS:43 6906 | 21-225_72B4 | VL3}3r/J}L 2 | | .N | .V | .R | | | .N | -ST. | |
| iPS:43 6908 | 21-225_72D5 | VL3}3r/J}L 2 | .D | .N | .V | .R | | | | -STA. | |
| iPS:43 6912 | 21-225_73C4 | VL3}3r/J}L 2 | .D | .N | | .M | | | | -STA. | |
| iPS:43 6914 | 21-225_76B4 | VL3}3r/J}L 2 | P. N.T | R.T F. | | | | | | .-SST. | |
| iPS:43 6916 | 21-225_74A9 | VL3}3r/J}L 2 | | .N V | | .NR | | | | -SP.I | |
| iPS:43 6918 | 21-225_77A2 | VL3}3r/J}L 2 | | .R | | .R | | | | -STA. | |

Figure 52 (Continued)

| | | | | | | | |
|---|---|---|---|---|---|---|---|
| iPS:43 6922 | 21-225_78E9 | VL3j3rJ3L 2 | .E. | .N. .VS | .NR. | . | -SP.I | . |
| iPS:43 6924 | 21-225_74B3 | VL3j3rJ3L 2 | . | . | . | . | -T. | . |
| iPS:43 6928 | 21-225_79E7 | VL3j3rJ3L 2 | . | .N. .VS | .NR. | .S. | -SP.I | . |
| iPS:43 6932 | 21-225_92A4 | VL3j3rJ3L 2 | .N | .N. .V | . | . | -SP.I | . |
| iPS:43 6934 | 21-225_96B5 | VL3j3rJ3L 2 | P.N.T. | .R.T. .F. | . | .S. | . | . |
| iPS:43 6936 | 21-225_97E6 | VL3j3rJ3L 2 | . | .N. .VS | .NR. | . | .P.I | . |
| iPS:43 6938 | 21- 225_146A3 | VL3j3rJ3L 2 | .V. | .AM. | .N. .R. | .I. | -SST. | . |
| iPS:43 6940 | 21- 225_146B8 | VL3j3rJ3L 2 | .M. | .V. | .R. | . | -ST. | . |
| iPS:43 6942 | 21- 225_146H8 | VL3j3rJ3L 2 | . | .V. | .K. | .V. | -ST. | . |
| iPS:43 6944 | 21- 225_182D12 | VL3j3rJ3L 2 | . | .E. | .R. .S. | . | -RT. | . |
| iPS:43 6946 | 21- 225_183F4 | VL3j3rJ3L 2 | .T. | . | .K. | . | -RTA. | . |
| iPS:43 6952 | 21- 225_185D2 | VL3j3rJ3L 2 | . | . | .E.R. | .D. | . | . |
| iPS:43 6954 | 21- 225_185G7 | VL3j3rJ3L 2 | . | . | .R. | . | -RK. | . |
| iPS:43 6956 | 21- 225_186H6 | VL3j3rJ3L 2 | . | .H. .FV. | .R. | . | -SST. | . |
| iPS:43 6962 | 21- 225_190H1 | VL3j3rJ3L 2 | . | .M.E. | . | .K. | -STA. | . |
| iPS:43 6978 | 21- 225_190G9 | VL3j3rJ3L 2 | . | .RF.Y | . | . | -ST. | .R. |
| iPS:43 7018 | 21- 225_193H5 | VL3j3rJ3L 2 | .S. | .RF.Y | .N. | . | -STA. | . |
| iPS:43 7030 | 21- 225_195E3 | VL3j3rJ3L 2 | . | .RF. | .E. | .S. | -VT. | . |
| iPS:43 7034 | 21- 225_195E9 | VL3j3rJ3L 2 | . | .RSV.Y | .R. | .G. | -GI. | .I. |
| iPS:43 7070 | 21- 225_201G11 | VL3j3rJ3L 2 | . | .N. .RF. | . | . | -ST. | . |

Figure 52 (Continued)

| ID | Name | Region | | | | | | | | |
|---|---|---|---|---|---|---|---|---|---|---|
| iPS:43 7076 | 21-225_20G6 | VL3|3r/JL2 | ..... | ..RF.. | ..... | ..... | ..... | ..... | ..-ST. | ..... |
| iPS:43 7144 | 21-225_215B3 | VL3|3r/JL2 | ..... | ..... | ..... | ..... | ..... | ..... | ..-ST. | ..... |
| iPS:43 7186 | 21-225_224H2 | VL3|3r/JL2 | ..... | ..F.. | .N.V. TY | ..... | ..... | ..... | ..... | ..... |
| iPS:43 7192 | 21-225_225E9 | VL3|3r/JL2 | ...D. | ..... | .N.N. | ..... | ..... | ..... | ..-ST. | ..... |
| iPS:43 7194 | 21-225_226B2 | VL3|3r/JL2 | ..... | ..R.. | ...M. | ..... | ..... | ..... | ..R.. | ..... |
| iPS:43 7200 | 21-225_226A10 | VL3|3r/JL2 | ..... | ..T.G. | ...R. | ..R.. | ..... | ..N.. | ..-G.A. | ..... |
| iPS:43 7204 | 21-225_227E5 | VL3|3r/JL2 | ..... | ..T.G. W | ..... | ..R.. | ..... | ..N.. | ..-G.A. | ..... |
| iPS:43 7210 | 21-225_227E12 | VL3|3r/JL2 | ...S. | ..E. W | ..... | ..R.. | ..K.. | ..VN. | ..-NTMI | ..... |
| iPS:44 8908 | 21-225_50G9 | VL3|3r/JL2 | ..... | ..V.. | ..... | ..... | ..... | ..N.. | ..-SN. | ..... |
| iPS:45 1102 | 21-225_45F6 | VL3|3r/JL2 | ..... | ..... | ..... | ..NR. | ..R.E. | ..RN.. | ..-RRG. | ..R.. |
| iPS:45 1110 | 21-225_74C9 | VL3|3r/JL2 | ..E.. | ..S.N. VS | ..... | ..... | ..S.. | ..N.. | ..-RTM. | ..... |
| iPS:45 1112 | 21-225_53D10 | VL3|3r/JL2 | ..... | ..N.. | ..R.. | ..R.. | ..... | ..... | ..... | ..... |
| iPS:47 2731 | 21-225_14B1_L C2 | VL3|3r/JL2 | ..F.. | ..Y.. | ..... | ..R.. | ..... | ..... | ..-P.I | ..... |
| iPS:39 2583 | 21-225_10B10 | VL3|3r/JL2 | ..... | ..N. W | ..... | ..R.. | ..... | ..... | ..-ST. | ..... |
| iPS:39 2585 | 21-225_14H11 | VL3|3r/JL2 | ..T.. | ..E.. V | ..... | ..T.. | ..T.. | ..-.. | ..... | ..... |
| iPS:39 2587 | 21-225_18G5 | VL3|3r/JL2 | ..... | ..E.V. | ..... | ..... | ..... | ..... | ..-SSTI | ..... |
| iPS:39 2589 | 21-225_27H2 | VL3|3r/JL2 | ..... | ..S.. | ..... | ..G.. | ..L.. | ..N.. | ..-SN. | ..... |
| iPS:39 2598 | 21-225_18E10 | VL3|3r/JL2 | ..... | ..R.. W | ..... | ..R.. | ..... | ..... | ..Y.. | ..... |
| iPS:39 3166 | 21-225_27G6 | VL3|3r/JL2 | ..... | ..Y.. | ..... | ..R.. | ..... | ..N.. | ..-SI. | ..... |
| iPS:39 3168 | 21-225_32B11 | VL3|3r/JL2 | ..... | ..E.. | ..S.. | ..... | ..K.. | ..N.. | ..SY. | ..... |
| iPS:39 3172 | 21-225_3B12 | VL3|3r/JL2 | ..S.. | ..E.. | ..... | ..R.. | ..... | ..VN. | ..-NTMI | ..... |

Figure 52 (Continued)

| ID | Name | Chain | | | | | | | |
|---|---|---|---|---|---|---|---|---|---|
| iPS:39 3176 | 21-225_27E7 | VL3j3r/jL 2 | . . . . . | . . . . . N . . . | . . . . . E . . . | . . . . . | . . . . . | . . . . . | . . . . . -ST. |
| iPS:39 3178 | 21-225_34D7 | VL3j3r/jL 2 | . . . . . | . . . . . E. . .Y | . . . . . L . . . | . . . . . | . . . . . T. | . . . . . N . . . | . . . . . -T. |
| iPS:39 3182 | 21-225_4B3 | VL3j3r/jL 2 | . . . . . R. .V. | . . . . . | . . . . . | . . . . . R. | . . . . . | . . . . . N . . . | . . . . . -NT.I |
| iPS:39 3184 | 21-225_15H11 | VL3j3r/jL 2 | . . . . . | . . . . . E. . . | . . . . . | . . . . . | . . . . . | . . . . . | . . . . . -STA. |
| iPS:39 3186 | 21-225_27D9 | VL3j3r/jL 2 | . . . . . M. | . . . . . .Y | . . . . . F. . . | . . . . . | . . . . . I . . . | . . . . . V- . . . | . . . . . --NNT. |
| iPS:39 3188 | 21-225_34B9 | VL3j3r/jL 2 | . . . . . A. | . . . . . .VS | . . . . . E . . . | . . . . . | . . . . . | . . . . . - . . . | . . . . . |
| iPS:39 3192 | 21-225_12B1 | VL3j3r/jL 2 | . . . . . R. .V. | . . . . . | . . . . . | . . . . . R. | . . . . . | . . . . . | . . . . . -SST. |
| iPS:39 3194 | 21-225_16D2 | VL3j3r/jL 2 | . . . . . | . . . . . | . . . . . | . . . . . | . . . . . | . . . . . N . . . | . . . . . -NT.I |
| iPS:39 3196 | 21-225_16G8 | VL3j3r/jL 2 | . . . . . S. . . | . . . . . E. . . | . . . . . | . . . . . | . . . . . K . . . | . . . . . VN . . . | . . . . . -NTMI |
| iPS:39 3198 | 21-225_28A11 | VL3j3r/jL 2 | . . . . . | . . . . . | . . . . . | . . . . . R. | . . . . . | . . . . . | . . . . . Y . . . |
| iPS:39 3200 | 21-225_35E1 | VL3j3r/jL 2 | . . . . . | . . . . . .Y | . . . . . E. . . | . . . . . | . . . . . | . . . . . N . . . | . . . . . -STA. |
| iPS:39 3202 | 21-225_6B4 | VL3j3r/jL 2 | . . . . . R. .V. | . . . . . | . . . . . F. . . | . . . . . R. | . . . . . | . . . . . N . . . | . . . . . -NT.I |
| iPS:39 3206 | 21-225_13F6 | VL3j3r/jL 2 | . . . . . | . . . . . | . . . . . I . . . | . . . . . R. | . . . . . | . . . . . GN . . . | . . . . . |
| iPS:39 3210 | 21-225_17D3 | VL3j3r/jL 2 | . . . . . S. . . | . . . . . .VY | . . . . . V. . . | . . . . . R. | . . . . . | . . . . . | . . . . . -ITA. R. |
| iPS:39 3212 | 21-225_30H6 | VL3j3r/jL 2 | . . . . . | . . . . . .N | . . . . . | . . . . . | . . . . . | . . . . . | . . . . . -SST. |
| iPS:39 3214 | 21-225_33A1 | VL3j3r/jL 2 | . . . . . | . . . . . FVY | . . . . . | . . . . . | . . . . . | . . . . . | . . . . . T. |
| iPS:39 3218 | 21-225_14G3 | VL3j3r/jL 2 | . . . . . | . . . . . .V | . . . . . | . . . . . R. | . . . . . | . . . . . GN . . . | . . . . . |
| iPS:39 3222 | 21-225_17F5 | VL3j3r/jL 2 | . . . . . | . . . . . E. . . | . . . . . | . . . . . | . . . . . | . . . . . | . . . . . -SST. |
| iPS:39 3224 | 21-225_31C2 | VL3j3r/jL 2 | . . . . . | . . . . . .N | . . . . . | . . . . . | . . . . . | . . . . . | . . . . . -SST. |

Figure 52 (Continued)

| | | L_FR1 | L_CDR1 | L_FR2 | L_CDR2 | L_FR3 | L_CDR3 | L_FR4 |
|---|---|---|---|---|---|---|---|---|
| | Germline | QSVLTQP AVSGSPGQSIT ISC | TGTS SDVGGY NYVS | WYQQHPGK APKLMIY | EVSNRPS | GVSNRFSGSKSGG NTASLTISGLQAEDEAD YYC | SSYTSS STLVV | FGGGTK LTVL |
| iPS:46 8862 | 21-225_178H8 | VL2l2a2/ JL3b | ..S........ | ........F... | V..F.... | | ........P.... | ......YT... | |
| iPS:39 3226 | 21-225_33E6 | VL3l3r/JL 2 | | Y | F.. | R | | N | -STA |
| iPS:39 3234 | 21-225_26C10 | VL3l3r/JL 2 | ...V...M | V | I | | | V- | -NNT |
| iPS:39 3345 | 21-225_5G7 | VL3l3r/JL 2 | | N | F | | | | -ST |
| iPS:39 3565 | 21-225_34B11 | VL3l3r/JL 2 | | W | | R | | N | -STA |
| iPS:39 3950 | 21-225_3H10 | VL3l3r/JL 2 | ...S | E | V | M | K | VN | -NTMI |
| iPS:39 8470 | 21-225_14B7 | VL3l3r/JL 2 | ...R | N | | R | | NN | -ST |
| iPS:39 8472 | 21-225_16E4 | VL3l3r/JL 2 | P | Y | S | R | | | |
| iPS:39 8488 | 21-225_19F6 | VL3l3r/JL 2 | | VY | | | A | N | -ST |
| iPS:39 8490 | 21-225_21D12 | VL3l3r/JL 2 | V | | | | T | | -NT |
| iPS:39 8498 | 21-225_22E6 | VL3l3r/JL 2 | | N | | R | | N | -ST |
| iPS:39 8504 | 21-225_23D7 | VL3l3r/JL 2 | | E | Y | R | | | -STA |
| iPS:39 8546 | 21-225_9H10 | VL3l3r/JL 2 | | V | V | F | T | N | -STA |
| iPS:40 2225 | 21-225_2B1 | VL3l3r/JL 2 | | E | | R | | N | -SN |
| iPS:40 2231 | 21-225_6D9 | VL3l3r/JL 2 | V | | | K | | N | Y |
| iPS:40 4090 | 21-225_8D8 | VL3l3r/JL 2 | | E | V | R | I | N | -NT |
| iPS:42 3018 | 21-225_31D12_LC2 | VL3l3r/JL 2 | | Y | F..I | R | | -SST | -STA |
| | | | | | | | | | -STA |

| | | L_FR1 | L_CDR1 | L_FR2 | L_CDR2 | L_FR3 | L_CDR3 | L_FR4 |
|---|---|---|---|---|---|---|---|---|
| iPS:43 21-225_219A7 | VL2(2a2/JL3b | ........... | ........... | ........... | ........... | ........... | C....R-- | ........... |
| iPS:43 21-225_221H2 | VL2(2a2/JL3b | ...........L | .........S | ........... | ..R. | ........... | N...R--...IT.. | ........... |
| iPS:43 21-225_221G4 | VL2(2a2/JL3b | ........... | ........... | ........... | ..R. | ........... | ...IT.. | ........... |
| iPS:43 21-225_7184 | VL2(2a2/JL3b | ........... | ........... | ........... | ..R. | ........... | N...R--...IT.. | ........... |
| | Germline | L_FR1 DSVLTQP-PSASGTPGQRVTISC | L_CDR1 SGSS SNIGS NTYN | L_FR2 WYQQLPGT APKLLIY | L_CDR2 NNQRPS | L_FR3 GVPDRFSGSKSG TSASLAISGLQSEDEAD YYC | L_CDR3 AAWDDS LNGVV | L_FR4 FGGGT KLTVL |
| VL1(1c/JL2 | | | | | | | | |
| iPS:46 21-225_60D6 8864 | VL1(1c/JL2 | ........... | ........... | ........... | ........... | ........... | ........... | V........... |
| iPS:43 21-225_146D8 6660 | VL1(1c/JL2 | .........T | ....Y....D | ........... | ........... | ........... | .SLNGP | ........... |
| iPS:43 21-225_147H12 6680 | VL1(1c/JL2 | ........... | ...YA. | ........... | ........... | ........... | ........... | ........... |
| iPS:43 21-225_146A8 6682 | VL1(1c/JL2 | ........... | ...SI. | ..R. | ........... | ........... | E....P. | ........... |
| iPS:43 21-225_146B6 6684 | VL1(1c/JL2 | ........... | ....A. | ........... | ..D. | ........... | ........... | ........... |
| iPS:43 21-225_149A1 6696 | VL1(1c/JL2 | ........... | ....A. | ........... | ........... | ........... | ........... | ........... |
| iPS:43 21-225_150F9 6712 | VL1(1c/JL2 | ........... | ....A. | ........... | ..S. | .....F. | ........... | ........... |
| iPS:43 21-225_154G12 6750 | VL1(1c/JL2 | ........... | ...A.S | ..N. | ..DH. | ........... | K.P. | ........... |
| iPS:43 21-225_156H2 6762 | VL1(1c/JL2 | ........... | ........... | ........... | ..S. | ......L | ........... | ........... |
| iPS:43 21-225_197F9 7044 | VL1(1c/JL2 | ...........V | ........... | ........... | ........... | ........... | ........... | V........... |
| iPS:43 21-225_199C3 7060 | VL1(1c/JL2 | ........... | ........... | ........... | ..I. | ........... | M.P. | ........... |
| iPS:39 21-225_4G12 3180 | VL1(1c/JL2 | .......NM. | ..TN-Y | ........... | ..I. | ........... | ....P.LNGH. | ........R. |
| iPS:39 21-225_9G9 3230 | VL1(1c/JL2 | .......NM. | ......Y | ........... | ........... | ........... | LNGH. | ........R. |
| | Germline | L_FR1 | L_CDR1 | L_FR2 | L_CDR2 | L_FR3 | L_CDR3 | L_FR4 |

[Complex sequence alignment table showing antibody light chain variable region sequences with columns for L_FR1, L_CDR1, L_FR2, L_CDR2, L_FR3, L_CDR3, and L_FR4 across multiple clones including iPS:43 21-225_152G5, 152B12, 153A8, 155G3, 225A9, 149E8, 155H1, 179D10, 224B11, 226F8, 227D3, 227C10, and iPS:44 21-225_43F11_LC2]

| | | | L_FR1 | L_CDR1 | L_FR2 | L_CDR2 | L_FR3 | L_CDR3 | L_FR4 |
|---|---|---|---|---|---|---|---|---|---|
| iPS:43 6832 | 21-225_51D8 | VL1j1e/JL1 | | | FE. | | | | |
| | VL3j1r/JL7 | Germline | SYELTQP PSVSVSPGQTAS ITC | SGD KLGD RYAC | WYQQKPGQ SPVLVIY | QDSKRPS | GIPERFSGSNSG NTATLTISGTQAMDEAD YYC | QAWDS | FGGGTQ LTVL |
| iPS:43 6840 | 21-225_53E9 | VL3j3r/JL7 | ... | ...T... | ... | ...N... | ... | ...T... | ...-ST. |
| iPS:43 6950 | 21-225_184G4 | VL3j3r/JL7 | ... | ...F... | ... | ...R... | ...E... | ...R... | ...-RTV. |
| | VL1j1bjL2 | Germline | QSVLTQP PSVSAAPGQKVT ISC | SGSS-SNIGN- NYVS | WYQQLPG- APKLLIY | D--- NNKRPS | GIPDRFSGSKSG- TSATLGITGLQTGDEAD YYC | GTWDSS | FGGGTK LTVL |
| iPS:43 6856 | 21-225_58C5 | VL1j1b/JL2 | ... | ... | ... | ... | ... | ...I... | ...VG. |
| iPS:43 6960 | 21-225_198D2 | VL1j1b/JL2 | ... | ...S... | ...V... | ... | ... | ...R... | ...NVG. |
| iPS:43 6966 | 21-225_190C3 | VL1j1b/JL2 | ... | ... | ...L... | ...S... | ...G... | ... | ...T... |
| iPS:43 6968 | 21-225_190B10 | VL1j1b/JL2 | ... | ... | ...H... | ... | ... | ... | ...G. |
| iPS:43 6974 | 21-225_190H7 | VL1j1b/JL2 | ... | ...S... | ...V... | ... | ... | ...GR. | ...NVG. |
| iPS:43 6976 | 21-225_190D8 | VL1j1b/JL2 | ... | ... | ... | ...SS... | ...E... | ... | ...T... |
| iPS:43 6982 | 21-225_190D10 | VL1j1b/JL2 | ...R... | ...S... | V..V... | ... | ... | ...R... | ...NVG. |
| iPS:43 6986 | 21-225_191A1 | VL1j1b/JL2 | ... | ...L... | ...F... | ...Y... | ...V... | ... | ...NTG. |
| iPS:43 7006 | 21-225_192G2 | VL1j1b/JL2 | ... | ...F... | ... | ... | ...R... | ... | ...G. |
| iPS:43 7024 | 21-225_194F11 | VL1j1b/JL2 | ... | ... | ... | ... | ... | ... | ...G. |
| iPS:43 7028 | 21-225_194G12 | VL1j1b/JL2 | ... | ... | ...F... | ... | ...R...E... | ... | ...VG. |
| iPS:43 7042 | 21-225_197E8 | VL1j1b/JL2 | ... | ...K...L. | ... | ... | ...K...L. | ...I..R. | ...VM. |
| iPS:43 7064 | 21-225_200G8 | VL1j1b/JL2 | ...R... | ...F... | ...F... | ...Y... | ...V... | ... | ...NTG. |
| iPS:43 7086 | 21-225_209A8 | VL1j1b/JL2 | ... | ...FL. | ... | ... | ... | ... | ...G. |

Figure 52 (Continued)

[Figure showing sequence alignment table of antibody variable light chain sequences - content too detailed to transcribe as table]

Figure 52 (Continued)

| ID | Region | | | | | | | | | |
|---|---|---|---|---|---|---|---|---|---|---|
| iPS:43 21-7022 225_194G5 | VL7[7a]J L2 | . . . . . | . . . . . | . . . . . | . . . . . | . . . . . | . . . . . | . . . . . | . I . . . | . . . . . LM |
| iPS:43 21-7026 225_194D12 | VL7[7a]J L2 | . . . . . | . . N . . | . . . . . | . T . . . | . . . . . | . . . . . | S . . . . | . I . . . | . . . . . LA |
| iPS:43 21-7040 225_196E7 | VL7[7a]J L2 | . . . . . | SF.S | . L . . . | . . . . . | . . R . . | . . . . . | . . . . . | . IF . . | . . . VH.I |
| iPS:43 21-7048 225_197B11 | VL7[7a]J L2 | . . . . . | . F . . . | . . . . . | . . T . . | . N . . . | D . . . . | . . . . . | . . . . . | . . . . . L . |
| iPS:43 21-7050 225_197C11 | VL7[7a]J L2 | . . . . . | VL. . SF . | . A . . . | . . T . . | . N . . . | D . . . . | . . . . . | . IF . . | . . . VH.I |
| iPS:43 21-7056 225_198B8 | VL7[7a]J L2 | . . . . . | . S . . . | . . . . . | . . . . . | . . . . . | . . . . . | . . . . . | M.S | . . . . . M. |
| iPS:43 21-7062 225_200H1 | VL7[7a]J L2 | . . . . . | . . N . . | . . . . . | . . . . . | . H . . . | . . . . . | D . . . F | . I . . . | . . . . . L . |
| iPS:43 21-7066 225_200G9 | VL7[7a]J L2 | . . . . . | . . N . . | . . . . . | . . L . . | . H . . . | . A . . . | . . . . . | . I . . . | . . . . . L . |
| iPS:43 21-7068 225_200A11 | VL7[7a]J L2 | . . . . . | . . N . S | . . . . . | . . . . . | . . D . . | . . . . . | . . . . . | . . . . . | . . . HLA |
| iPS:43 21-7090 225_210F11 | VL7[7a]J L2 | . . . . . | . . . . . | . . . . . | . . V . . | . N . . . | . D . . . | . . . . . | . . . . . | . . . . . L . |
| iPS:43 21-7106 225_211H7 | VL7[7a]J L2 | . . . . . | . F . N . | . . . . . | . . V . . | . R . . . | . . . . . | . . . . . | . . . . . | . . . . . L . |
| iPS:43 21-7108 225_211C9 | VL7[7a]J L2 | . . . . . | . F . N.S | . . . . . | . . . . . | . . . . . | . . . . . | . . . . . | . . . . . | . . . . . LA |
| iPS:43 21-7110 225_211E9 | VL7[7a]J L2 | . . . . . | G . . . . | . . . . . | . . . . . | . . . . . | . D . . . | . . . . . | . . . . . | . . . . . LA |
| iPS:43 21-7120 225_212A9 | VL7[7a]J L2 | . . . . . | . . . F . | . . . . . | . . P . . | . N . . . | . . TF . | D . . . . | . . . . . | . . . . . . G |
| iPS:43 21-7124 225_212H12 | VL7[7a]J L2 | . . . . . | . . . . . | . . . . . | . . . . . | . . . . . | . . . . . | D D . . . | . . . . . | . . . . . H . |
| iPS:43 21-7132 225_213F5 | VL7[7a]J L2 | . . . . . | G . . S . | . . . . . | T . P . . | . . . . . | . . . . . | . . . . T | . . F . . | . . . . . LA |
| iPS:43 21-7136 225_214H3 | VL7[7a]J L2 | . . . . . | . . . F . | . . . . . | . . . . . | . N . . . | D . . . . | . . . . . | . . . . . | . . . . . H . |
| iPS:43 21-7140 225_214E12 | VL7[7a]J L2 | . . . . . | . . . . . | . . . . . | . . . . . | . . . . . | D . . . . | . . . . . | . . CD . | . . . . . L . |
| iPS:43 21-7142 225_215A3 | VL7[7a]J L2 | . . . . . | . E . . . | . . . . . | . . . . . | . . . . . | . T . . . | . . . . . | . . . . . | . . . . . . A . |
| iPS:43 21-7148 225_215H3 | VL7[7a]J L2 | . . . . . | . . N . S | . . . . . | . . . . . | . N . . . | CG . . . | D D . . . | . . . . . | . . . . . LA |
| iPS:43 21-7154 225_216A7 | VL7[7a]J L2 | . . . . . | . . . . . | . . . . . | . . . . . | . N . . . | C . . . . | D D . . . | . . . . . | . . . . . . G |

| | | | L_FR1 | L_CDR1 | L_FR2 | L_CDR2 | L_FR3 | L_CDR3 | L_FR4 |
|---|---|---|---|---|---|---|---|---|---|
| iPS:43 7160 | 21-225_216B12 | VL3j3j/JL2 | . . . . . . . . | . . D . . . . . RR . | . . . . . . . . | . . . . . . . . | . . . . . . . . | . . . . . . . . STG . | . . . . . . . . |
| iPS:39 2593 | 21-225_3E10 | VL3j3j/JL2 | . . . . . . H . . . . . . TA . M . . . | . . . . . . . . R . . . . . . . A . | . . . . . . . . D . | . . . . . . . . | . . . . . . . . | . . . . . . . . S . . . . . . . . DH . | . . . . . . . . |
| iPS:39 3204 | 21-225_8C12 | VL3j3j/JL2 | . . . . . . H . . . . . . TA . M . . . | . . . . . . . . A . | . . . . . . . . D . | . . . . . . . . | . . . . . . . . | . . . . . . . . S . . . . . . . . DH . | . . . . . . . . |
| | Germline | | L_FR1 QSALTQP ASVSGSPGQSIT ISC | L_CDR1 TGTS SDVGGY NYVS | L_FR2 WYQQHPG KAPKLMIY | L_CDR2 E VSNRPS | L_FR3 GVSNRFSGSKSG NTASLTISGLQAEDEAD YYC | L_CDR3 SSYTSS STLVV | L_FR4 FGTGT KVTVL |
| iPS:43 7092 | 21-225_210B12 | VL2j2a2/JL2 | . . . . . . . . | . . . . . . . . | . . . . . . . F . | . . . . . . . . R . | . . . . . . . . | . . . . . . . . RTL . | . . . . . . . . |
| iPS:43 7134 | 21-225_213A7 | VL2j2a2/JL2 | . . . . . . . . | . . . . . . . . | . . . . . . . F . | . . . . . . . . R . | . . . . . . . . | . . . . . . . . RTL . | . . . . . . . . |
| iPS:47 2733 | 21-225_2B10_L C2 | VL2j2a2/JL2 | . . . . . . . . | . . . . . . . F . | . . . . . . . . D . | . . . . . . . . | . . . . . . . . | . . . . . . . . TGT . | . . . . . . . . T . |
| iPS:39 2573 | 21-225_15G2 | VL2j2a2/JL2 | . . . . . . . . | . . . . . . . . | . . . . . . . . | . . . . . . . . | . . . . . . . . | . . . T . . . . . . TST . | . . . . . . . . |
| iPS:39 3232 | 21-225_17F12 | VL2j2a2/JL2 | . . . . . . . . | . . . . . A . S . | . . . . . . . . | . . . . . . . . | . . . . . . . . | . . . . . . . . IT . | . . . . . . . . |
| iPS:39 8494 | 21-225_21H4 | VL2j2a2/JL2 | . . . . . . . . | . . . . . . . S . | . . . . . . . D . | . . . . . . . . | . . . . . . . . | . . . . . . . . R— . . . . . . . . ST . | . . . . . . . . |
| | Germline | | L_FR1 SYELMQP PSVSVSPGQTAR ITC | L_CDR1 SGD ALPK QYAY | L_FR2 WYQQKPGQ APVLVIY | L_CDR2 K DSERPS | L_FR3 GIPERFSGSSSG TVTLTISGVQAEDEAD YYC | L_CDR3 QSADSS GTYVV | L_FR4 FGTGT KVTVL |
| iPS:43 7102 | 21-225_211E5 | VL3j3m/JL1 | . . . . . . . T . | . . . . . . . . | . . . . . . . . | . . . . . . . . | . . . . . . . R . . . . . . . . V . | . . . . . . . . LVY . — | . . . . . . . . L . . . M |
| iPS:43 7164 | 21-225_217C6 | VL3j3m/JL1 | . . . . . . . T . | . . . . . . . . | . . . . . . . . | . . . . . . . A . | . . . . . . . R . . . . . . . . R . | . . . . . . . . SDT . LIV . — | . . . . . . . . |
| iPS:43 7166 | 21-225_217G11 | VL3j3m/JL1 | . . . . . . . T . | . . . . . . . . | . . . . . . . . | . . . . . . . . | . . . . . . . R . . . . . . . . V . | . . . . . . . . SDT . LVY . — | . . . . . . . . |
| iPS:43 7170 | 21-225_218E5 | VL3j3m/JL1 | . . . . . . . T . | . . R . . . V . . . | . . . . . . . . | . . . . . . . . | . . . . . . . R . | . . . . . . . . SDT . LVV . — . . . . . . . . SDT . | . . . . . . . . |

Figure 52 (Continued)

| | | L_FR1 | L_CDR1 | L_FR2 | L_CDR2 | L_FR3 | L_CDR3 | L_FR4 |
|---|---|---|---|---|---|---|---|---|
| iPS:43 7196 | 21-225_226B7 | VL3|3m/J L1 | .F.T............ | .....R.............H.V........ | ........N............ | ............. | ...SGT. | ......... |
| | VL4|4c/JL2 | Germline | TPVLTQP-PSASASLGASVK LTC | TLSS_FHSTY____TIE | WYQQRPGR_VRS SPQLIMK | DGSHSRGD | GIPDRFMGSSSG ADKYLTFSNLQSDDEAE YYC | FFSRTTD ____GQVGWV | FGGGTK LTVL |
| iPS:39 2596 | 21-225_12D8 | VL4|4c/J L2 | | | | | ..........D........... | | |
| iPS:39 3174 | 21-225_15D8 | VL4|4c/J L2 | | | | | ........I..........E........ | | |
| iPS:39 8544 | 21-225_7C8 | VL4|4c/J L2 | | | | | ......................G..........D | ......P. | |
| | VL3|3h/JL2 | Germline | SYVLTQP-PSSVSVAPGKTAR ITC | GGN_NIGS_____KSVH | WYQQKPGQ APVLVIY | DSDRPS | GIPERFSGSNSG NTATLTISRVEAGDEAD YYC | QVWDSS | FGGGTK LTVL |
| iPS:39 3208 | 21-225_16F3 | VL3|3h/J L2 | .....Q........ | | .....V....... | ...D.......T | | ......SDPYV | |

HEAVY_VARIABLE

| | | H_FR1 | H_CDR1 | H_FR2 | H_CDR2 | H_FR3 | H_CDR3 | H_FR4 |
|---|---|---|---|---|---|---|---|---|
| | VH1|1-08|D6|6-19|RF1|JH4 | Germline | QVQLVQS-GAEVKKPGASVK VSCKASG-FTFT | S------YDIN | WVRQATGQ GLEWMG | WMNPN------ SGNTGYAQ KFQG | RVTMTRNTSISTAYMEL SSLRSEDTAVYYCAR | GYSSGW-- --------TYFDY | WGQGTL VTVSS |
| iPS:42 6126 | 21-225_6G6 | VH1|1-08|D6|6-19|RF1|J H4 | ........R............... | ....N............. | .....P............. | .............H............K | ........A...V..... | SSGWY-- .....L | |
| iPS:41 2232 | 21-225_4A2 | VH1|1-08|D6|6-19|RF1|J H4 | ........T.............. | ....N............. | | .............H.......... | ...................S | SSGWY-- ...-- | |
| iPS:42 6112 | 21-225_12F12 | VH1|1-08|D6|6-19|RF1|J H4 | ........L.............. | ....N............. | | .............Y.......... | ..........M........ | SSGWY-- ...-..F | |
| iPS:45 1141 | 21-225_164B11 | VH1|1-08|D6|6-19|RF1|J H4 | ........................ | ....N............. | | .............T.......... | ......M........SY. | SSGWY-- ...-M... | |
| iPS:46 8850 | 21-225_63F4 | VH1|1-08|D6|6-19|RF1|J H4 | ........................ | ....N.......V..... | | .............H........R. | ..........L..V....Y | SSGWY-- ..-V.. | |

Figure 52 (Continued)

| | | | | | | | | |
|---|---|---|---|---|---|---|---|---|
| iPS:46 8852 | 21-225_71F3 | VH1{1-08/D6{6-19}RF1/J H4 | .................. | N........V. | ................. | ...H.............. | .................Y | SSGWY-- .-V..S | ..... |
| iPS:46 8854 | 21-225_72C4 | VH1{1-08/D6{6-19}RF1/J H4 | .................. | N............ | .........V....... | ...H.............. | ....N........SH | SSGWY-- .-L.. | ..... |
| iPS:46 8870 | 21-225_74A8 | VH1{1-08/D6{6-19}RF1/J H4 | .................. | N............ | .........S....... | ...H.............. | ........S.......Y | SSGWY-- .-K.. | ...S. |
| iPS:42 3314 | 21-225_12F11 | VH1{1-08/D6{6-19}RF1/J H4 | .................. | N............ | .......P......... | ...H..........K | .................. | SSGWY-- ..... | ..... |
| iPS:43 3909 | 21-225_43D8 | VH1{1-08/D6{6-19}RF1/J H4 | .................. | N............ | .................. | ...H.............. | ..........A..V. ...L | SSGWT-- .-L.. | ....A |
| iPS:43 4177 | 21-225_56A1 | VH1{1-08/D6{6-19}RF1/J H4 | .................. | N............ | ...L.............. | ...H.............. | ....T.........H | SSGWY-- ..... | ..... |
| iPS:43 4211 | 21-225_60F3 | VH1{1-08/D6{6-19}RF1/J H4 | .................. | N............ | .................. | ...H.............. | .................Y | SSGWY-- .-V.. | ..... |
| iPS:43 4235 | 21-225_61E3 | VH1{1-08/D6{6-19}RF1/J H4 | ....L............. | N............ | .................. | ...T.............. | .....K........Y | SSGWY-- .-F.. | ..... |
| iPS:43 4237 | 21-225_61B5 | VH1{1-08/D6{6-19}RF1/J H4 | .................. | N............ | .................. | ...H...S......... | .................Y | SSGWY-- .-R.. | ..... |
| iPS:43 4295 | 21-225_58B9 | VH1{1-08/D6{6-19}RF1/J H4 | .................. | N............ | .................. | .......S.......... | .................Y | SSGWY-- ..... | ..... |
| iPS:43 4305 | 21-225_59E1 | VH1{1-08/D6{6-19}RF1/J H4 | .................. | N............ | .................. | ...T.............. | ....T............F | SSGWY-- .-F.. | ..... |
| iPS:43 4321 | 21-225_59F10 | VH1{1-08/D6{6-19}RF1/J H4 | .................. | .............. | .................. | .................. | ..............N.V | SSGWY-- ..... | ..... |

Figure 52 (Continued)

| | | | | | | | | |
|---|---|---|---|---|---|---|---|---|
| iPS:43 4431 | 21-225_70E7 | VH1\|1-08/D6\|6-19\|RF1/J H4 | . . . . . . . . . | N . . . . . . . . | . . . . . . . . . | . . . . H . . . . | . . . . . . . . . | SSGWY- . -V . . . | . . . . . |
| iPS:43 4443 | 21-225_71G3 | VH1\|1-08/D6\|6-19\|RF1/J H4 | . . . . . . . . . | N . . . . . . . . | . . . . . . . . . | . . . . H . . . . . . . . S . . . . | . . . . D . V . . . . . . Y . . . | SSGWY- . . . . . | . . . . . |
| iPS:43 4475 | 21-225_74F9 | VH1\|1-08/D6\|6-19\|RF1/J H4 | . . . . . . . . . | N . . . . . . . . | . . . . . . . . . | . . . . . C . . . | . . . . . . . S . | SSGWN- . -F . . . | . . . . . |
| iPS:43 4477 | 21-225_74A6 | VH1\|1-08/D6\|6-19\|RF1/J H4 | . . . . . . . . . | N . . . . . . . . | . . . . . . . . . | . . . . H . . . . . . . . R . . . . | . . W . . . . . . . . . . . . S . | SSGWY- . . . . . | . . . . . |
| iPS:43 4487 | 21-225_76G2 | VH1\|1-08/D6\|6-19\|RF1/J H4 | . . . . . . . . . | N . . . . . . . . | . . . . . . . . . | . . . . . . . . . | . . . . . . . G . | SSGWY- . -M . . . | . . . . . |
| iPS:43 4511 | 21-225_74B11 | VH1\|1-08/D6\|6-19\|RF1/J H4 | . . R . . . . . . | N . . . . . . . . | . . . . . . . . . | . . . . H . . . . | . . . . . . . Y . | SSGWY- . . . . . | . . . . . |
| iPS:43 4549 | 21-225_76E11 | VH1\|1-08/D6\|6-19\|RF1/J H4 | . . . . . . . . . | N . . . . . . . . | . . . . . . . . . | . . . . . . . . . | . L . . F . . . Y | SSGWY- . . . . . | . . . . . |
| iPS:43 4551 | 21-225_75C4 | VH1\|1-08/D6\|6-19\|RF1/J H4 | . . . . . . . . . | N . . . . . . . . | . . . . . . . . . | . . . . H . . . . | . . . . . . . S . | SSGWY- . . . . . | . . . . . |
| iPS:43 4635 | 21-225_78E6 | VH1\|1-08/D6\|6-19\|RF1/J H4 | . . . . . . . . . | N . . . . . . . . | . . . . S . . . . | . . . . . . . . . | . . . S . . . Y . | SSGWY- . -K . . . | . S . . . |
| iPS:43 4649 | 21-225_78E11 | VH1\|1-08/D6\|6-19\|RF1/J H4 | . . . . . . . . . | N . V . . . . . . | . . . . . . . . . | . . . . H . . C . | . . . . R . . S . | SSGWN- . -F . . . | . . . . . |
| iPS:43 4665 | 21-225_74G4 | VH1\|1-08/D6\|6-19\|RF1/J H4 | . . . . . . . . . | N . . . . . . . . | . . . . S . . . . | . . . . H . . . . | . . . S . . . . . | SSGWY- . -H . . . | . . . . . |
| iPS:43 4679 | 21-225_79G7 | VH1\|1-08/D6\|6-19\|RF1/J H4 | . . . . . . . . . | N . . . . . . . . | . . . . . . . . . | . . . . H . . . . | . . . S . . . Y . | SSGWY- . -K . . . | . S . . . |

Figure 52 (Continued)

| | | | | | | | | |
|---|---|---|---|---|---|---|---|---|
| iPS:43 4685 | 21-225_79E9 | VH1\|1-08/D6\|6-19\|RF1/J H4 | . . . . . . . . . . . . | . . . . . N . . . . . | . . . . . . . . . . . . . . . . . H . . | . . . . . . . . . . . . . . . . . . | SSGWY- . . . . . . . . . . . . | . . . . . . . . . . . . |
| iPS:43 4697 | 21-225_79F12 | VH1\|1-08/D6\|6-19\|RF1/J H4 | . . . . . . . . . . . . | . . . . . N . . . . . | . . . . . . . . . . . . . . . . . . | . . . . . . . . . . . . . . . . . S | SSGWY- . . . . . . . -F . . | . . . . . . . . . L . . |
| iPS:43 4729 | 21-225_80B12 | VH1\|1-08/D6\|6-19\|RF1/J H4 | . . . . . . . . . . T . | . . . . . N . . . . . | . . . . . . . . . . . . . . . . . . V | . . . . . . . . . . . . . . . . . Y | SSGWY- . . . . . . . -I . . | . . . . . . . . . . . . |
| iPS:43 4851 | 21-225_75A6 | VH1\|1-08/D6\|6-19\|RF1/J H4 | . . . . . . . . . . . . | . . . . . N . . . . . | . . . . . . . S . . . . . . . . . . | . . . . . . . . . . . . . . . . . Y | SSGWY- . . . . . . . -I . . | . . . . . . . . . . . . |
| iPS:43 4909 | 21-225_85C11 | VH1\|1-08/D6\|6-19\|RF1/J H4 | . . . . . . . . . . . . | . . . . . N . . . . . | . . . . . . . . . . . . . . . . . H . . | . . . . . . . . . . S . . . . . . Y | SSGWY- . . . . . . . -K . . | . . . . . . . . . S . . |
| iPS:43 4959 | 21-225_87E10 | VH1\|1-08/D6\|6-19\|RF1/J H4 | . . . . . . . . . . . . | . . . . . N . . . . . | . . . . . . . . . . . . . . . . . . | . . . . . . . . . . . . . . . . . Y | SSGWY- . . . . . . . -F . . | . . . . . . . . . . . . |
| iPS:43 4965 | 21-225_88A1 | VH1\|1-08/D6\|6-19\|RF1/J H4 | . . . . . . . . . . . . | . . . . . N . . . . . | . . . . . . . . . . . . . . . . . . | . . . . . . . . . . . . . . . . . Y | SSGWY- . . . . . . . . . . | . . . . . . . . . . . . |
| iPS:43 4973 | 21-225_88B4 | VH1\|1-08/D6\|6-19\|RF1/J H4 | . . . . . . . . . . . . | . . . . . N . . . . . | . . . . . . . . . . . . . . . . . D . . | . . . S . . . . . . . T . . . . . SY | SSGWY- . . . . . . . . . . | . . . . . . . . . . . . |
| iPS:43 4997 | 21-225_88C10 | VH1\|1-08/D6\|6-19\|RF1/J H4 | . . . . . . . . . R . . . . S | . . . . . N . . . . . | . . . . . . . . . . . . . . . . . T . . | . . . . . . . . . . . . . . . . . S | SSGWY- . . . . . . . . . . | . . . . . L . . . . . . |
| iPS:43 5053 | 21-225_75F9 | VH1\|1-08/D6\|6-19\|RF1/J H4 | . . . . . . . . . . . . | . . . . . N . . . . . | . . . . . . . . . . . . . . . . . H . . | . . . . . . . . . . . . . . . . . Y | SSGWY- . . . . . . . -I . . | . . . . . . . . . . . . |
| iPS:43 5113 | 21-225_92E6 | VH1\|1-08/D6\|6-19\|RF1/J H4 | . . . . . . . . . R . . | . . . . . N . . . . . | . . . . . . . . . . . . . . . . . H . . | . . . . . . . . . . M . . . . . . H | SSGWY- . . . . . . . -F . . | . . . . . . . . . . . . |
| iPS:43 5209 | 21-225_75A10 | VH1\|1-08/D6\|6-19\|RF1/J H4 | . . . . . . . . . . . . | . . . . . N . . . . . | . . . . . . . . . . . . . . . . . . | . . . . . . . . . . . . . . . . . Y | SSGWY- . . . . . . . -I . . | . . . . . . . . . . . . |

Figure 52 (Continued)

| | | | | | | | | |
|---|---|---|---|---|---|---|---|---|
| iPS:43 5257 | 21-225_96H5 | VH1|1-08/D6|6-19|RF1/J H4 | | N... | .S... | ...H... | ...S.....Y | SSGWY-.-K... | S... |
| iPS:43 5267 | 21-225_96D10 | VH1|1-08/D6|6-19|RF1/J H4 | ....R | N... | | ...H... | ..M......... | SSGWY-.-F... | |
| iPS:43 5299 | 21-225_146D4 | VH1|1-08/D6|6-19|RF1/J H4 | | N... | | VH... | .........G | SSGWY-...... | |
| iPS:43 5305 | 21-225_146C9 | VH1|1-08/D6|6-19|RF1/J H4 | | N... | | ...H... | ..W......A..Y | SSGWY-.-S... | |
| iPS:43 5309 | 21-225_146F9 | VH1|1-08/D6|6-19|RF1/J H4 | | N... | | ...H... | .........S | SSGWY-.-F... | |
| iPS:43 5321 | 21-225_147E4 | VH1|1-08/D6|6-19|RF1/J H4 | | N... | | ...... | .........S | SSGWY-...... | |
| iPS:43 5323 | 21-225_147D5 | VH1|1-08/D6|6-19|RF1/J H4 | | N... | | VH... | ...G......G | SSGWY-...... | |
| iPS:43 5345 | 21-225_148G3 | VH1|1-08/D6|6-19|RF1/J H4 | | N... | .S... | ...H... ...N... | .........S | SSGWY-.-F... | |
| iPS:43 5353 | 21-225_148F8 | VH1|1-08/D6|6-19|RF1/J H4 | | N... | | ...... | .........G | SSGWY-...... | |
| iPS:43 5369 | 21-225_149A2 | VH1|1-08/D6|6-19|RF1/J H4 | | N... | | VH... | ...T......Y | SSGWY-.-W... | |
| iPS:43 5373 | 21-225_149E3 | VH1|1-08/D6|6-19|RF1/J H4 | | N... | | ...H... | ...T.V...TF | SSGWY-...... | |
| iPS:43 5375 | 21-225_149H4 | VH1|1-08/D6|6-19|RF1/J H4 | | N... | | ...H...D | | SSGWY-...... | |

Figure 52 (Continued)

| | | | | | | | | |
|---|---|---|---|---|---|---|---|---|
| iPS:43 5399 | 21-225_150D2 | VH1J1-08/D6J6-19JRF1/JH4 | . . . | . . . | N . . . | . H . . . | . . . Y | SSGWY- . . . . |
| iPS:43 5405 | 21-225_150B7 | VH1J1-08/D6J6-19JRF1/JH4 | . . . T . . . FP . . | . . . | N . . . | . H . . . | . . . L . . . S | SSGWY- . -F . . . |
| iPS:43 5433 | 21-225_152E3 | VH1J1-08/D6J6-19JRF1/JH4 | . . . | . . . | N . . . | . H . . . | . . . S | SSGWY- . -F . . . |
| iPS:43 5435 | 21-225_152H3 | VH1J1-08/D6J6-19JRF1/JH4 | . . . P . . | . . . | N . . . | . H . . . | . . . -W . | SSGWY- . -W . . |
| iPS:43 5459 | 21-225_152E12 | VH1J1-08/D6J6-19JRF1/JH4 | . . . | . . . | N . . . | . H . . . | . . . Y | SSGWY- . . . . |
| iPS:43 5471 | 21-225_153F11 | VH1J1-08/D6J6-19JRF1/JH4 | . . E . . | . . . | N . . . | . H . . . | . N . . Y | SSGWY- . -F . . N |
| iPS:43 5475 | 21-225_154H6 | VH1J1-08/D6J6-19JRF1/JH4 | . . . | . . . | N . . . | . . . | . . . Y | SSGWY- . -I . . |
| iPS:43 5481 | 21-225_154A11 | VH1J1-08/D6J6-19JRF1/JH4 | . . . | . . . | N . . . | . H . S . R . | . . . Y | SSGWY- . . . . |
| iPS:43 5491 | 21-225_155E5 | VH1J1-08/D6J6-19JRF1/JH4 | . . . | . . . | N . . . | . . . | . . . S | SSGWY- . . . . |
| iPS:43 5495 | 21-225_155B6 | VH1J1-08/D6J6-19JRF1/JH4 | . . . | . . . | N . . . | . . . | . . . F | SSGWY- . . . . |
| iPS:43 5501 | 21-225_156H1 | VH1J1-08/D6J6-19JRF1/JH4 | . . . | . . . | N . . . | . VH . . | . . . Y | SSGWY- . . . . |
| iPS:43 5557 | 21-225_158B12 | VH1J1-08/D6J6-19JRF1/JH4 | . R . . | . . . | N . . . | . H . . | . . F . . . Y | SSGWY- . -R . . . |

Figure 52 (Continued)

| | | | | | | | | | |
|---|---|---|---|---|---|---|---|---|---|
| iPS:43_5589 | 21-225_160AA4 | VH1J1-08/D6J6-19JRF1/JH4 | ......T.. | N....... | ........ | .P...H.. | ....P... | ........ | ....Y... | SSGWY-..-I... |
| iPS:43_5623 | 21-225_162D5 | VH1J1-08/D6J6-19JRF1/JH4 | ......S.. | N....... | ........ | ......H.. | ....S... | ......D.. | ........ | SSGWY-..-F... |
| iPS:43_5627 | 21-225_162F6 | VH1J1-08/D6J6-19JRF1/JH4 | .......R. | N....... | ........ | ........ | F....... | ....F.F. | ....Y... | SSGWY-........ |
| iPS:43_5649 | 21-225_165H2 | VH1J1-08/D6J6-19JRF1/JH4 | ........ | H....... | ....V... | ....HK.. | ........ | ........ | ....Y... | SSGWY-..-R... |
| iPS:43_5727 | 21-225_172E11 | VH1J1-08/D6J6-19JRF1/JH4 | ....M... | N......L | ........ | ....H... | ........ | ....N.D. | ....Y... | SSGWY-..-M... |
| iPS:43_5751 | 21-225_175D10 | VH1J1-08/D6J6-19JRF1/JH4 | ........ | N....... | ........ | ....H... | ........ | ........ | ....Y... | SSGWY-..-R... |
| iPS:43_5773 | 21-225_177B12 | VH1J1-08/D6J6-19JRF1/JH4 | ........ | N....... | ........ | ....H... | ........ | ....V... | ....Y... | SSGWY-....F.. |
| iPS:43_5801 | 21-225_181E5 | VH1J1-08/D6J6-19JRF1/JH4 | ........ | N....... | ........ | ........ | ........ | ........ | ....Y... | SSGWY-........ |
| iPS:43_5841 | 21-225_191D8 | VH1J1-08/D6J6-19JRF1/JH4 | ........ | N....... | ........ | ....H... | ........ | ........ | ....S... | SSGWY-..-I... |
| iPS:43_5855 | 21-225_191G3 | VH1J1-08/D6J6-19JRF1/JH4 | ........ | N....... | ........ | ....R... | ........ | ........ | ....H... | SSGWY-........ |
| iPS:43_5915 | 21-225_190H4 | VH1J1-08/D6J6-19JRF1/JH4 | ....N... | N....... | ........ | ........ | ........ | ........ | ....H... | SSGWY-..-I... |
| iPS:43_5925 | 21-225_190D7 | VH1J1-08/D6J6-19JRF1/JH4 | ........ | N....... | ........ | ........ | ........ | ........ | ....S... | SSGWY-....F.. |

Figure 52 (Continued)

| | | | | | | | |
|---|---|---|---|---|---|---|---|
| iPS:43_6021 | 21-225_193G4 | VH1j1-08/D6j6-19jRF1/JH4 | ...... | N..... | ...... | ......N..... | SSGWY-...-F... |
| iPS:43_6150 | 21-225_197H4 | VH1j1-08/D6j6-19jRF1/JH4 | ...... | N..... | ......H..... | ......R......S | SSGWY-...... |
| iPS:43_6154 | 21-225_197C6 | VH1j1-08/D6j6-19jRF1/JH4 | ......A..... | N..... | ......H..... | ......H..... | SSGWY-...... |
| iPS:43_6272 | 21-225_201F5 | VH1j1-08/D6j6-19jRF1/JH4 | ...... | N..... | ......H..... | ......H..... | SSGWY-...... |
| iPS:43_6550 | 21-225_224D8 | VH1j1-08/D6j6-19jRF1/JH4 | .....S | N..... | .....LY..... | ......Y..... | SSGWY-...... |
| iPS:43_6554 | 21-225_224C10 | VH1j1-08/D6j6-19jRF1/JH4 | ...... | N..... | ......H..... | ......Y..... | SSGWY-...-K... |
| iPS:43_6560 | 21-225_224F11 | VH1j1-08/D6j6-19jRF1/JH4 | ...... | N..... | ......R...... | ......Y..... | SSGWY-...-K... |
| iPS:43_6574 | 21-225_225F5 | VH1j1-08/D6j6-19jRF1/JH4 | ......R...H | N..... | ......H..F.. | ......N......Y | SSGWY-...-R... |
| iPS:43_6584 | 21-225_225S9 | VH1j1-08/D6j6-19jRF1/JH4 | ......R..... | N..... | ......R. | ......Y..... | SSGWT-...-L... |
| iPS:43_6586 | 21-225_225F11 | VH1j1-08/D6j6-19jRF1/JH4 | ......T | N..... | ......H..... | ......N......Y | SSGWY-...... |
| iPS:43_6588 | 21-225_225F12 | VH1j1-08/D6j6-19jRF1/JH4 | ...... | H..... | ......H..... | ......A......Y | SSGWY-...-R... |
| iPS:43_6590 | 21-225_225H12 | VH1j1-08/D6j6-19jRF1/JH4 | ...... | N..... | ......H..... | ......Y..... | SSGWY-...-K... |

Figure 52 (Continued)

| | | | | | | | |
|---|---|---|---|---|---|---|---|
| iPS:43 6598 | 21-225_226D6 | VH1|1-08/D6|6-19|RF1/JH4 | . . . . . . . . . . . . | N . . . . . . . | . . . . . . . . . . . . | . . . . . . . H . . . . . . . | . . . . . . . . . . . . | SSGWY-.-K... | . . . . . . . . . . . . |
| iPS:43 6600 | 21-225_226F6 | VH1|1-08/D6|6-19|RF1/JH4 | . . . . . . . . . . . . | N . . . . . . . | . . . . . . . . . . . . | . . . . . . . H . . . . . . . | . . . . . . . N . . . Y . . . | SSGWY-.-R... | . . . . . . . . . . . . |
| iPS:43 6616 | 21-225_226D11 | VH1|1-08/D6|6-19|RF1/JH4 | . . . . . . . S . . . . . . . | N . . . . . . . | . . . . . . . . . . . . | . . . . . . . H . . . . . . . | . . . . . . . . . . . Y . . . | SSGWY-. . . . | . . . . . . . . . . . . |
| iPS:43 6622 | 21-225_226A12 | VH1|1-08/D6|6-19|RF1/JH4 | . . . . . . . . . . . R . . . | N . . . . . . . | . . . . . . . . . . . . | . . . . . . . H . . . . . . . | . . . . . . . . . . . Y . . . | SSGWY-. . . . | . . . . . . . . . . . . |
| iPS:43 6636 | 21-225_227E6 | VH1|1-08/D6|6-19|RF1/JH4 | . . . . . . . T . . . . . . . | N . . . . . . . | . . . . . . . . . . . . | . . . . . . . H . . . . . . . | . . . . . . . . . . . Y . . . | SSGWY-.-K... | . . . . . . . . . . . . |
| iPS:43 6638 | 21-225_227C7 | VH1|1-08/D6|6-19|RF1/JH4 | . . . . . . . . H . . . . . . | N . . . . . . . | . . . . . . . . . . . . | . . . . . . . H . . . . . . . | . . . . . . . . . . . Y . . . | SSGWY-.-R... | . . . . . . . . . . . . |
| iPS:43 6646 | 21-225_227D11 | VH1|1-08/D6|6-19|RF1/JH4 | . . . . . F . . P . . . . . . | N . . . . . . . | . . . . . . . . . . . . | . . . . . . . H . . . . . . . | . . . . . . . . . . . Y . . . | SSGWY-. . . . | . . . . . . . . . . . . |
| iPS:44 6086 | 21-225_94D8 | VH1|1-08/D6|6-19|RF1/JH4 | . . . . . . . . . . . R . . . | N . . . . . . . | . . . V . . . | . . . . . . . . V . . . . . . | . . . . . . . . . . . Y . . . | SSGWY-.-I... | . . . . . . . . . . . . |
| iPS:45 1116 | 21-225_164A4 | VH1|1-08/D6|6-19|RF1/JH4 | . . . . . . . . . . . . . . . | N . . . . . . . | . . . . . . . . . . . . | . . . . . . . H . . . . . . . | . . . M . . . . . . S . . . | SSGWY-.-F... | . . . . . . . . . . . . |
| iPS:45 1124 | 21-225_74F6 | VH1|1-08/D6|6-19|RF1/JH4 | . . . . . . . . . . . . . . . | N . . . . . . . | . . . . . . . . . . . . | . . . . . . . H . . . . . . . | . . . T . . . . . . H . . . | SSGWY-.-F... | . . . . . . . . . . . . |
| iPS:45 1127 | 21-225_164A7 | VH1|1-08/D6|6-19|RF1/JH4 | . . . . . . . . . . . . . . . | N . . . . . . . | . . . . . . . . . . . . | . . . . . . . H . . . . . . . | . . . . . . . . . . S . . . | SSGWY-.-L... | . . . . . . . . . . . . |
| iPS:45 1131 | 21-225_160A7 | VH1|1-08/D6|6-19|RF1/JH4 | . . . . . . . . . . . . . . . | N . . . . . . . | . . . . . . . . . . . . | . . . . . . . H.H . . . . . . | . . . N . . . . . . H . . . | SSGWY-. . . . | . . . . . . . . . . . . |

Figure 52 (Continued)

| | | | | | | | |
|---|---|---|---|---|---|---|---|
| iPS:39 2786 | 21-225_24E1 | VH1j1-08/D6j6-19jRF1/J H4 | .................... | ................H... | ................... | SSGWE--................ | ........ |
| iPS:39 2886 | 21-225_23A12 | VH1j1-08/D6j6-19jRF1/J H4 | ..............P... | N............... | .......R............ | ................... | SSGWY--.-V.. ........ |
| iPS:39 2928 | 21-225_25A4 | VH1j1-08/D6j6-19jRF1/J H4 | ...L......R...... | N............... | ................H... | ............T...... | SSGWY--...... ........ |
| iPS:39 2936 | 21-225_28B6 | VH1j1-08/D6j6-19jRF1/J H4 | ...L......R...... | N............... | ................Y... | ............G...... | SSGWY--...... ........ |
| iPS:39 2960 | 21-225_29E6 | VH1j1-08/D6j6-19jRF1/J H4 | ...L......R...... | N............... | ...........H.D...... | ................S... | SSGWY--...... ........ |
| iPS:39 2992 | 21-225_26C4 | VH1j1-08/D6j6-19jRF1/J H4 | .................... | N............... | .........S......H...R. | ................S... | SSGWY--...... ........ |
| iPS:39 3088 | 21-225_33D1 | VH1j1-08/D6j6-19jRF1/J H4 | .................... | N............... | ................... | N...............S... | SSGWY--...... ........ |
| iPS:39 3144 | 21-225_34D2 | VH1j1-08/D6j6-19jRF1/J H4 | .................... | N............... | .........V......F...R. | ................S... | SSGWY--.-F.. ........ |
| iPS:39 3368 | 21-225_29H8 | VH1j1-08/D6j6-19jRF1/J H4 | ..............Q... | N............... | ...........LH...T..F...R. | ................L...S... | SSGWY--.-F.. ........ |
| iPS:39 3942 | 21-225_11E5 | VH1j1-08/D6j6-19jRF1/J H4 | ..............P... | N............... | .........A.......H...R. | ................A...S... | SSGWE--...... ........ |
| iPS:39 4085 | 21-225_8B11 | VH1j1-08/D6j6-19jRF1/J H4 | .................... | N............... | ................H... | ............T...... | SSGWE--.-V.. ........ |
| iPS:39 8496 | 21-225_22D2 | VH1j1-08/D6j6-19jRF1/J H4 | ................I. | N............... | ...........H.D...... | ............R...Y... | SSGWY--...... ........ |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 8522 | 21-225_32A1 | VH1|1-08/D6|6-19|RF1/JH4 | . . . . . . . . . . . . . . . . . . . . . . . . . . . . . | N . . . . . . . . . . . | . . . . . . . . . . . . . . . | . . . . . . . . . . . . | . . . . . . . . . . . . . . . . . . . . . . . . . S | SSGWY- -F. . . | . . . . . . . . . . |
| iPS:39 8524 | 21-225_32A5 | VH1|1-08/D6|6-19|RF1/JH4 | . . . . . . . . . . . . . . . . . . . . . . . . . . . . . | N . . . . . . . . . . . | . . . . . . . . . . . . . . . | . . . . . H . . . F . . . . . . . R . . | . . . . . . . . . . . . . . . . . . . . . . . . SS | SSGWY- -F. . . | . . . . . . . . . . |
| iPS:39 8538 | 21-225_34H7 | VH1|1-08/D6|6-19|RF1/JH4 | . . . . . . . . . . . . . . . . . . . . . . . . . . . . . | N . . . . . . . . . . . | . . . . . . . . . . . . . . . | . . . . . . . . . . . . | . N . . . . . . . . . . . . . . . . . . . . . . . S | SSGWY- -F. . . | . . . . . . . . . . |
| VH1|1-02/D1|1-1|RF1/JH4 | Germline | QVQLVQS GAEVKKPGASVK VSCKASG YTFT | G. . . . . . YYMH | WVRQAPGQ GLEWMG | WINPN SGGTNYAQ KFQG | RVTMTRDTSISTAYMEL SRLRSDDTAVYYCAR | ISTGT YFDY | WGQGTL VTVSS |
| iPS:47 3253 | 21-225_7C3_LC1 | VH1|1-02/D1|1-1|RF1/JH4 | . . . . . . . . . . . . . . . . . . . . . . . . . . . . N | D . . . . . . . L | . . . . . . . . . . . . . . . | . . . . . H . . . . . . . . . . . | . . . . . . . . . . . . . . . . . . . . . . . . . S | DG.S- . . .S. . . | . . . . . . . . . . |
| iPS:47 3254 | 21-225_7C3_LC2 | VH1|1-02/D1|1-1|RF1/JH4 | . . . . . . . . . . . . . . . . . . . . . . . . . . . . N | D . . . . . . . L | . . . . . . . . . . . . . . . | . . . . . . . . . . . . . . . | . . . . . . . . . . . . . . . S . . . . . . . . . S | DG.S- . . .S. . . | . . . . . . . . . . |
| iPS:47 3255 | 21-225_9F12_L C1 | VH1|1-02/D1|1-1|RF1/JH4 | . . . . . . . . . . . . . . . . . . . . . . . . . . . . A | D . . . . . . . L | . . . . . . . . . . . . . . . | . . . . . H . . . F . . . . . . . | . . . . . . . . . . . . S . . . . . F . . . . . . L | DG.S- . . .S. . . | . . . . . . . . . . |
| iPS:47 3256 | 21-225_9F12_L C2 | VH1|1-02/D1|1-1|RF1/JH4 | . . . . . . . . . . . . . . . . . . . . . . . . . . . . A | D . . . . . . . L | . . . . . . . . . . . . . . . | . . . . . H . . . F . . . . . . . | . . . . . . . . . . . . S . . . . . F . . . . . . L | DG.S- . . .S. . . | . . . . . . . . . . |
| iPS:42 6108 | 21-225_10G6 | VH1|1-02/D1|1-1|RF1/JH4 | . . . . . . . . . . . . . . . . . . . . . . . . . . . . . | A . . . . . . . H | . . . . . . . . . . . . . . . | . . . . NN . . . . . . . . . . . | . . . . . . . . . . . . . . . . . . . . . . . . . G. | DV.S- . . .S. . . | . . . . . . . . . . |
| iPS:42 6110 | 21-225_12E9 | VH1|1-02/D1|1-1|RF1/JH4 | . . . . . . . . . . . . . . . . . . . . . . . . . . . . . | D . . . . . . . L | . . . . . . . . . . . . . . . | . . . . . VH . . . . . . . . D | . . . . . . . . . . . . S . . . . . . . . . . . I.S | DG.S- . . .S. . . | . . . . . . . . . . |
| iPS:45 3451 | 21-225_52G11 | VH1|1-02/D1|1-1|RF1/JH4 | . . . . . . . . . . . . . . . . . . . . . . . . . . . . . | . . . . . . . . . . . | . . . . . . . . . . . . . . . | . . . . . RN . . . . . . . . . . | . . . . . . . . . . . . . . . . . . . . . . . . . F. | DG.S- . . .S. . . | . . . . . . . . . . |

Figure 52 (Continued)

| | | | | | | | | |
|---|---|---|---|---|---|---|---|---|
| iPS:45 3453 | 21-225_53F2 | VH1│1-02/D1│1-1│RF1/JH4 | . . . . . . . . . . . . . | . . . L . . | . . . . . . . . . | RM . . . N . . . | . . . K . . . | DG.S- . . . S . . . |
| iPS:43 4035 | 21-225_49F10 | VH1│1-02/D1│1-1│RF1/JH4 | . . . . . . . . . . . . . | . . . H . . | . . . . . . . . . | NNA . . N . . . | . . . L . . . | DG.S- . . . S . . F |
| iPS:43 4065 | 21-225_50D4 | VH1│1-02/D1│1-1│RF1/JH4 | . . . . . . . . . . . . . | . . . H . . | . . . . . . . . . | NNA . . S . . . | . . . L . . . | DG.S- . . . S . . F |
| iPS:43 4069 | 21-225_51E9 | VH1│1-02/D1│1-1│RF1/JH4 | . . . . . . . . . R . . | . . . HI . | . . . . . . . . . | TN . Q . . . | . . . . . . . | DG.S- . . . S . . . |
| iPS:43 4079 | 21-225_52B1 | VH1│1-02/D1│1-1│RF1/JH4 | . . . . . . . . . . . . Q | . . . H.Q | . . . . . . . . . | . . A . N . . | . . . LD . . | DG.S- . . . S . . . |
| iPS:43 4097 | 21-225_52H10 | VH1│1-02/D1│1-1│RF1/JH4 | . . . . . . . . . . . . . | . . . H.Q | . . . . . . . . . | . . N . . Q . | N . T . . . . | DG.S- . . . S . . . |
| iPS:43 4123 | 21-225_53F7 | VH1│1-02/D1│1-1│RF1/JH4 | . . . . . . . . . R . . | . . . H . . | . . . . . . . . . | NN . . . . . | . . . R . . . | DG.S- . . . S . . . |
| iPS:43 4189 | 21-225_56E5 | VH1│1-02/D1│1-1│RF1/JH4 | . . . . . . . . . R . . | . . . H . . | . . . . . . . . . | NNA . . . . . | . . . N . . . | DG.S- . . . S . . . |
| iPS:43 5677 | 21-225_169C10 | VH1│1-02/D1│1-1│RF1/JH4 | . . . . . . . . . . . . . | . . . F . . | . . . V . . . | . . K.K . . . S . . | . . . N . . . | .G.TVAT. . . . . . WGV. . . . |
| iPS:43 5699 | 21-225_170D6 | VH1│1-02/D1│1-1│RF1/JH4 | . . . . . . . . . . . . . | . . . FI . | . . . V . . . | . . K . . . . S . . R . . . | . . . . . . . | .G.TVAT. . . . . . WGV. . . . |
| iPS:43 5797 | 21-225_181G2 | VH1│1-02/D1│1-1│RF1/JH4 | . . . . T . . . . . . | . . . N . . | S . . . . . . | . . N . S . T . . . . | . . . . . . . | KF---- . . . ---GD |
| iPS:43 5877 | 21-225_184E7 | VH1│1-02/D1│1-1│RF1/JH4 | . . . . T . . . . . . | . . . N . . | S . . . . . . | . . N . S . T . . . . | . . . . . . . | KF---- . . . ---GD |

Figure 52 (Continued)

| | | | | | | | | |
|---|---|---|---|---|---|---|---|---|
| iPS:43 5885 | 21-225_185E10 | VH1\|1-02/D1\|1-1\|RF1/JH4 | ....T........R | S........N.. | ........V...... | ....N.S.T....... | ............... | KF----....-GD |
| iPS:43 5891 | 21-225_188H5 | VH1\|1-02/D1\|1-1\|RF1/JH4 | ....I........R | S........N.. | ........V...... | ........S.T.... | .....I......... | KF----....-GD |
| iPS:43 5897 | 21-225_188B9 | VH1\|1-02/D1\|1-1\|RF1/JH4 | ....I........R | S........N.. | ........V...... | ........S.T.... | ............... | KF----....-GD |
| iPS:43 6400 | 21-225_213H7 | VH1\|1-02/D1\|1-1\|RF1/JH4 | ............... | ........H... | ............... | ....K.....D.... | ............... | EKP.S....YK. |
| iPS:43 6488 | 21-225_221A6 | VH1\|1-02/D1\|1-1\|RF1/JH4 | ....T........... | ............ | ............... | ....H.......... | ....L....D..... | DG.S-......... |
| iPS:43 6496 | 21-225_222E1 | VH1\|1-02/D1\|1-1\|RF1/JH4 | ....T........... | ............ | ............... | ....H.......... | ....L....D..... | DG.S-......S... |
| iPS:43 6508 | 21-225_222F7 | VH1\|1-02/D1\|1-1\|RF1/JH4 | ....T........... | ............ | ............... | ....H.......... | ....L....D..... | DG.S-......S... |
| iPS:43 6516 | 21-225_222C12 | VH1\|1-02/D1\|1-1\|RF1/JH4 | ............... | ............ | ............... | ....H.......... | ....L....D..... | DG.S-......S... |
| iPS:43 7264 | 21-225_171H12 | VH1\|1-02/D1\|1-1\|RF1/JH4 | ............R.. | ....F....... | ............... | .K.K...S....R.. | ............N.. | G.TVAT......WGV. |
| iPS:43 7266 | 21-225_177A5 | VH1\|1-02/D1\|1-1\|RF1/JH4 | ............R.. | ....F....... | ............... | .K.K...S....R.. | ...........NW.. | G.TVAT......WGV. |
| iPS:39 3080 | 21-225_34F3 | VH1\|1-02/D1\|1-1\|RF1/JH4 | ............... | ....H....... | ............... | ............... | ............N.. | DG.S-......... |
| iPS:39 3084 | 21-225_35C6 | VH1\|1-02/D1\|1-1\|RF1/JH4 | ....T.......... | ....D....... | ........D...... | .S.K....N...... | ............N.. | DG..-......S... |

| VH3/3-33/D6/6/RF1/JH6 | | CQLKS SGGYCDSSSLR SCAAGCFT2 | S KCMH | NYGIRQT ICLEWVA | GSNKY.YNYD GSNKYYAD SVKG | FTISRDENT.YIQM NSLRAEDTAVYYCAR | RYSSSSYY YYGMDY | WGQGTT VTVSS |
|---|---|---|---|---|---|---|---|---|
| iPS:42 6114 | 21-225_28H2 | VH3/3-33/D6/6/RF1/JH6 | N......V. | | | ......V | .EY.GW— ........D. | |
| iPS:42 6116 | 21-225_29E2 | VH3/3-33/D6/6/RF1/JH6 | N......CV. | | | I | .EY.GW— ........D. | |
| iPS:46 8812 | 21-225_48H4 | VH3/3-33/D6/6/RF1/JH6 | D.....SL. | | .T | | .NY.GW— ........G. | |
| iPS:46 8816 | 21-225_52G8 | VH3/3-33/D6/6/RF1/JH6 | | | | .L. | R...W— SG... | |
| iPS:46 8826 | 21-225_201C5 | VH3/3-33/D6/6/RF1/JH6 | D......V. | | .V | R | .RY.GL— ........D. | |
| iPS:46 8842 | 21-225_50H4 | VH3/3-33/D6/6/RF1/JH6 | | | A. | .D | .LY.NW— | |
| iPS:46 8858 | 21-225_148C9 | VH3/3-33/D6/6/RF1/JH6 | D.....A. | | | .L. | .RY.GW— ........D. | |
| iPS:46 8860 | 21-225_224E7 | VH3/3-33/D6/6/RF1/JH6 | ........S. | | | | .QY..W— ...L. | .DF |
| iPS:43 3917 | 21-225_43E11 | VH3/3-33/D6/6/RF1/JH6 | D..... | | | .L. | R.VR.W— VG... | |
| iPS:43 3919 | 21-225_44B3 | VH3/3-33/D6/6/RF1/JH6 | D.....S.. | | | | .RY.GW— | ........D. |
| iPS:43 3923 | 21-225_44D3 | VH3/3-33/D6/6/RF1/JH6 | .......V. | | | | .RY.GL— | ........D. |

Figure 52 (Continued)

| | | | | | | | | |
|---|---|---|---|---|---|---|---|---|
| iPS:43 3929 | 21-225_44D5 | VH3\|3-33/D6\|6-6\|RF1/JH6 | . | V. | . | . | . | VPY...W-.....D.... |
| iPS:43 3935 | 21-225_44F9 | VH3\|3-33/D6\|6-6\|RF1/JH6 | . | V. | . | . | . | .PY..W-.....D....G |
| iPS:43 3937 | 21-225_44B10 | VH3\|3-33/D6\|6-6\|RF1/JH6 | .V | . | . | . | . | .........W-........ |
| iPS:43 3939 | 21-225_44C10 | VH3\|3-33/D6\|6-6\|RF1/JH6 | . | D....CV | . | . | . | R....W-.....-..... VG.... |
| iPS:43 3951 | 21-225_45B4 | VH3\|3-33/D6\|6-6\|RF1/JH6 | . | D....CV | . | . | . | RY..GL-.....D.... |
| iPS:43 3955 | 21-225_45B8 | VH3\|3-33/D6\|6-6\|RF1/JH6 | . | ....V. | . | . | . | RY..GL-.....D.... |
| iPS:43 3967 | 21-225_46C3 | VH3\|3-33/D6\|6-6\|RF1/JH6 | . | ....V. | . | . | . | RY..GL-.....D.... |
| iPS:43 3971 | 21-225_46D4 | VH3\|3-33/D6\|6-6\|RF1/JH6 | . | . | . | . | . | VPY...W-.....D.... |
| iPS:43 3979 | 21-225_46B9 | VH3\|3-33/D6\|6-6\|RF1/JH6 | .S | D....... | .T | .R | .F | R....W-.....-..... MG.... |
| iPS:43 3985 | 21-225_47C1 | VH3\|3-33/D6\|6-6\|RF1/JH6 | . | .I | . | . | .D | R..R.W-.....D.... |
| iPS:43 3991 | 21-225_47E7 | VH3\|3-33/D6\|6-6\|RF1/JH6 | . | N....V. | . | . | . | R..R.W-.....-..... VG.... |
| iPS:43 4001 | 21-225_48F2 | VH3\|3-33/D6\|6-6\|RF1/JH6 | . | . | . | . | . | RY...W-.....D.... .L.. |

Figure 52 (Continued)

| | | | | | | |
|---|---|---|---|---|---|---|
| iPS:43 4021 | 21-225_49C1 | VH3\|3-33/D6\|6-6\|RF1/JH6 | ....T........ | ............ | ............ | R....W----<br>.SG.... |
| iPS:43 4025 | 21-225_49G3 | VH3\|3-33/D6\|6-6\|RF1/JH6 | ............ | ............ | ............ | R....W----<br>.SG.... |
| iPS:43 4031 | 21-225_49E7 | VH3\|3-33/D6\|6-6\|RF1/JH6 | ............ | ............ | ..L......... | R....W----<br>.SG.... |
| iPS:43 4033 | 21-225_49F9 | VH3\|3-33/D6\|6-6\|RF1/JH6 | ............ | ..L...R..... | ....P...H... | R....W----<br>.SG.... |
| iPS:43 4053 | 21-225_51E1 | VH3\|3-33/D6\|6-6\|RF1/JH6 | ............ | ....S....... | ............ | R....W----<br>.SG.... |
| iPS:43 4093 | 21-225_52D10 | VH3\|3-33/D6\|6-6\|RF1/JH6 | ............ | ..L......H.. | ............ | R....W----<br>.SG.... |
| iPS:43 4137 | 21-225_54D4 | VH3\|3-33/D6\|6-6\|RF1/JH6 | ............ | ............ | ............ | R....W----<br>.SG.... |
| iPS:43 4149 | 21-225_55H1 | VH3\|3-33/D6\|6-6\|RF1/JH6 | ............ | ..L......H.. | ............ | R....W----<br>.SG.... |
| iPS:43 4151 | 21-225_55C2 | VH3\|3-33/D6\|6-6\|RF1/JH6 | ............ | ............ | ............ | R....W----<br>.SG.... |
| iPS:43 4161 | 21-225_55F9 | VH3\|3-33/D6\|6-6\|RF1/JH6 | ............ | ....NG...... | ............ | R....W----<br>.SG.... |
| iPS:43 4201 | 21-225_59A12 | VH3\|3-33/D6\|6-6\|RF1/JH6 | ............ | ............ | ............ | R....W----<br>.DG.... |
| iPS:43 4205 | 21-225_60G2 | VH3\|3-33/D6\|6-6\|RF1/JH6 | ............ | ............ | ............ | R..R.W----<br>.TG.... |

Figure 52 (Continued)

| | | | | | | | |
|---|---|---|---|---|---|---|---|
| iPS:43 4223 | 21- 225_60C12 | VH3\|3- 33/D6\|6- 6\|RF1/JH 6 | . . . . . . . . . . . | . . . . . . . . . . . | . . . V . . . | . . . . . . . | R . . R . W --- . . . . . . . . . TG . . . . |
| iPS:43 4231 | 21-225_61F2 | VH3\|3- 33/D6\|6- 6\|RF1/JH 6 | . . . . . . . . . . . | . . . . . . . . . . . | . . . . . . . | . . . . . . . | . RY . . GW --- . . . . . . . . . . . . . D . |
| iPS:43 4233 | 21-225_61B3 | VH3\|3- 33/D6\|6- 6\|RF1/JH 6 | . . . . . . . . . . . | . . . . . . . . . . . | . . . . . . . | . . . . . . . | R . . R . W --- . . . . . . . . . AG . . . . |
| iPS:43 4303 | 21- 225_58H11 | VH3\|3- 33/D6\|6- 6\|RF1/JH 6 | . . . . . . . . . . . | . . . . . . . . . . . | . . . H . . . | . . . . . . . | R . . . W --- . . . . . . . . . DG . . . . |
| iPS:43 4339 | 21-225_64A4 | VH3\|3- 33/D6\|6- 6\|RF1/JH 6 | . . . . . . . . . . . | D . . . V . . . | . . . . M . . | . . . Q . . . | . RY . . W --- . . . . . . . . . . . . . . . |
| iPS:43 4343 | 21-225_64C8 | VH3\|3- 33/D6\|6- 6\|RF1/JH 6 | . . . . . . . G . . . | D . . . . V . . | . . . . . . . | . . . . . . . | . RY . . GW --- . . . . . . . . . . . . . D . |
| iPS:43 4387 | 21- 225_66D11 | VH3\|3- 33/D6\|6- 6\|RF1/JH 6 | . . . . . . . . . . . | N . . . . . V . | . . . . . . . | . . . S . . . . . . L . . . | MY . . NW --- . . . . . . . . . . L . . . . |
| iPS:43 4469 | 21-225_73C9 | VH3\|3- 33/D6\|6- 6\|RF1/JH 6 | . . . . . . . . . . . | N . . . . DI . | . . . . . . . | . . . . I . . . . . F . . . | . RY . . W --- . . . . . . . . . . . . . FD . |
| iPS:43 5197 | 21-225_94F3 | VH3\|3- 33/D6\|6- 6\|RF1/JH 6 | . . . . . . . . . . . | D . . . . . . . | . . . . . . . | . . . . . . . | . KY . . GW --- . . . . . . . . . . . . . D . |
| iPS:43 5315 | 21- 225_147B2 | VH3\|3- 33/D6\|6- 6\|RF1/JH 6 | . . . . . . . . . . . | . . . . . . . | . . . . . . . | . . L . . . . . . . S . . . | R . . . W --- . . . . . . . . . SG . . . . |
| iPS:43 5325 | 21- 225_147H5 | VH3\|3- 33/D6\|6- 6\|RF1/JH 6 | . . . A . . . . . . . | . . . . . . . | . . . . . . . | . . . . . . . | . RY . . GW --- . . . . . . . . . . L . . . D . |
| iPS:43 5329 | 21- 225_147A8 | VH3\|3- 33/D6\|6- 6\|RF1/JH 6 | . . . . . . . . . . . | . . . . . . . | . . . . . . . | . . . . . . . | R . . . W --- . . . . . . . . . TG . . . . |

Figure 52 (Continued)

| | | | | | | | | |
|---|---|---|---|---|---|---|---|---|
| iPS:43_5349 | 21-225_148F5 | VH3J3-33/D6J6-6JRF1/JH6 | . . . . . | . . . . . | . . . . . | . . . . . | R....W---SG.... | . . . . . |
| iPS:43_5359 | 21-225_148H10 | VH3J3-33/D6J6-6JRF1/JH6 | . . . . . | . . . . . | . . . . . | . . . . . | R....W---.SG.... | . . . . . |
| iPS:43_5393 | 21-225_149D10 | VH3J3-33/D6J6-6JRF1/JH6 | D....A. | ....V | ...G | L.... | .RY..GW-...D. | . . . . . |
| iPS:43_5401 | 21-225_150E2 | VH3J3-33/D6J6-6JRF1/JH6 | . . . . . | . . . . . | . . . . . | . . . . . | .EY...W-...G. | . . . . . |
| iPS:43_5417 | 21-225_150D11 | VH3J3-33/D6J6-6JRF1/JH6 | . . . . . | ...I | F.H. | S...T | RF....W--- | . . . . . |
| iPS:43_5445 | 21-225_152F7 | VH3J3-33/D6J6-6JRF1/JH6 | N.....V | . . . . . | . . . . . | . . . . . | .EY...W---SG.... | . . . . . |
| iPS:43_5469 | 21-225_153G9 | VH3J3-33/D6J6-6JRF1/JH6 | . . . . . | . . . C. | L.F. | .F.. I | R..R.W---AG.... | . . . . . |
| iPS:43_5573 | 21-225_159D8 | VH3J3-33/D6J6-6JRF1/JH6 | D.....V | . . . . . | . . . . . | . . . . L | .PY..GW---...D. | . . . . . |
| iPS:43_5681 | 21-225_169D11 | VH3J3-33/D6J6-6JRF1/JH6 | D.....V | . . . . . | ...E | . . . . . | .RY..GW-...D. | . . . . . A |
| iPS:43_5689 | 21-225_170F3 | VH3J3-33/D6J6-6JRF1/JH6 | ...S. | ...I | L.F. | . . . . . | .TY...W--- | . . . . . |
| iPS:43_5733 | 21-225_173C11 | VH3J3-33/D6J6-6JRF1/JH6 | . . . . . | . . . . . | . . . . . | S...H. | R....W---SG.... | . . . . . |
| iPS:43_5741 | 21-225_174G10 | VH3J3-33/D6J6-6JRF1/JH6 | D.....V | . . . . . | . . . . . | . . . . L | .RY..GW---...D. | . . . . . |

Figure 52 (Continued)

| ID | Name | V/D/J | | | | | | | |
|---|---|---|---|---|---|---|---|---|---|
| iPS:43 5763 | 21-225_176H12 | VH3\|3-33/D6\|6-6\|RF1/JH6 | ......... | D......V.. | ......... | ......... | ......... | KY..NW-......D. | ......... |
| iPS:43 5767 | 21-225_177B4 | VH3\|3-33/D6\|6-6\|RF1/JH6 | ......... | D......V.. | ......... | ......... | ......... | KY...W-......D. | ......... |
| iPS:43 5785 | 21-225_179C2 | VH3\|3-33/D6\|6-6\|RF1/JH6 | ......... | ......... | ......L.F | IV....... | ....F.... | R..G.W--.....L.. | ......... |
| iPS:43 5921 | 21-225_190D6 | VH3\|3-33/D6\|6-6\|RF1/JH6 | ......... | ....FI... | ...R..... | ......... | ......... | SG.... | ......... |
| iPS:43 5961 | 21-225_192A2 | VH3\|3-33/D6\|6-6\|RF1/JH6 | ......... | ......... | ...L..Y.. | ......... | ......... | EY..GW-......FG. | ......... |
| iPS:43 5985 | 21-225_192F6 | VH3\|3-33/D6\|6-6\|RF1/JH6 | ......... | ....FI... | ...R...V. | ......... | ......... | D.PY.G.A.....LD.F | ......... |
| iPS:43 6039 | 21-225_193F8 | VH3\|3-33/D6\|6-6\|RF1/JH6 | ......... | I......D. | ......Y.. | ......... | ......... | EY..GW-......FG. | ......... |
| iPS:43 6074 | 21-225_194F10 | VH3\|3-33/D6\|6-6\|RF1/JH6 | ......... | D......V.. | ...R...V. | ......... | ......... | D.PY.G.G.....LD. | ......... |
| iPS:43 6264 | 21-225_203F7 | ...G..T VH3\|3-33/D6\|6-6\|RF1/JH6 | ......... | D......V.. | ......... | ....V.... | ......E.. | EY..GW-......FG. | ......... |
| iPS:43 6274 | 21-225_204H3 | VH3\|3-33/D6\|6-6\|RF1/JH6 | ......... | ......... | ...N..... | ....R.... | ......... | RY..GL-......D. | ......... |
| iPS:43 6332 | 21-225_208B2 | VH3\|3-33/D6\|6-6\|RF1/JH6 | ......... | D.....CV.. | ...V..... | ....R.... | ......... | PY...W-.....L.. S.... | ......... |
| iPS:43 6352 | 21-225_210G5 | VH3\|3-33/D6\|6-6\|RF1/JH6 | ......... | D.....CV.. | ...V..... | ....R.... | ......... | RY..GL-......D......L.. | ......... |

Figure 52 (Continued)

| | | | | | | | |
|---|---|---|---|---|---|---|---|
| iPS:43_6386 | 21-225_212B11 | VH3\|3-33/D6\|6-6\|RF1/JH6 | ............ | D........V.. | ....T....... | ............ | ............ | RY..GW-.....D. |
| iPS:43_6412 | 21-225_214H9 | VH3\|3-33/D6\|6-6\|RF1/JH6 | ............ | ........V.. | ............ | ........F... | ............ | RYT.W-......D. |
| iPS:43_6414 | 21-225_214G10 | VH3\|3-33/D6\|6-6\|RF1/JH6 | ............ | D........V.. | ....T....... | ............ | ............ | RY..GW-.....D. |
| iPS:43_6416 | 21-225_214G12 | VH3\|3-33/D6\|6-6\|RF1/JH6 | ............ | D........V.. | ............ | ............ | ............ | RY..GW-.....D. |
| iPS:43_6418 | 21-225_215E3 | VH3\|3-33/D6\|6-6\|RF1/JH6 | ............ | D.......VI. | ....T....... | ........V... | ............ | RY..GW-.....D. |
| iPS:43_6428 | 21-225_215E11 | VH3\|3-33/D6\|6-6\|RF1/JH6 | ............ | D........V.. | ....T....... | ............ | ............ | RY..GW-.....D. |
| iPS:43_6438 | 21-225_216E8 | VH3\|3-33/D6\|6-6\|RF1/JH6 | ............ | D........V.. | ....T....... | ............ | ............ | RY..GW-.....D. |
| iPS:43_6440 | 21-225_216H12 | VH3\|3-33/D6\|6-6\|RF1/JH6 | ............ | D........V.. | ....T....... | ............ | ............ | RY..GW-.....D. |
| iPS:43_6450 | 21-225_217E5 | VH3\|3-33/D6\|6-6\|RF1/JH6 | ............ | D........V.. | ....T....... | ............ | ............ | RY..GW-.....D. |
| iPS:43_6456 | 21-225_217G10 | VH3\|3-33/D6\|6-6\|RF1/JH6 | ............ | D........V.. | ....T....... | ............ | ............ | RY..GW-.....D. |
| iPS:43_6458 | 21-225_217H12 | VH3\|3-33/D6\|6-6\|RF1/JH6 | ............ | D........V.. | ....T....... | ............ | ............ | RY..GW-.....D. |
| iPS:43_6462 | 21-225_218C4 | VH3\|3-33/D6\|6-6\|RF1/JH6 | ............ | D........V.. | ....T....... | ............ | ............ | RY..GW-.....D. |

Figure 52 (Continued)

| | | | | | | | |
|---|---|---|---|---|---|---|---|
| iPS:43 6480 | 21-225_220F8 | VH3\|3-33/D6\|6-6\|RF1/JH6 | . . . | D......V... | . . . | . . . | RY...GW-... |
| iPS:43 6534 | 21-225_224F1 | VH3\|3-33/D6\|6-6\|RF1/JH6 | . . . | ......I... | T | . . . | RY...NW-... |
| iPS:43 6540 | 21-225_224F3 | VH3\|3-33/D6\|6-6\|RF1/JH6 | ...S | . . . | . . . | . . . | RY...W-...D |
| iPS:43 6564 | 21-225_225A1 | VH3\|3-33/D6\|6-6\|RF1/JH6 | . . . | D......VI. | . . . | . . . | RY...GW-...D |
| iPS:43 6596 | 21-225_226C6 | VH3\|3-33/D6\|6-6\|RF1/JH6 | . . . | D........ | . . . | T | RY...W-...D |
| iPS:43 6620 | 21-225_226H11 | VH3\|3-33/D6\|6-6\|RF1/JH6 | . . . | N.....C... | . . . | . . . | LY...W-...D L........ |
| iPS:43 6744 | 21-225_154F4 | VH3\|3-33/D6\|6-6\|RF1/JH6 | . . . | . . . | . . . | . . . | D.YC.GTSC....PYY.......D |
| iPS:43 6946 | 21-225_183F4 | VH3\|3-33/D6\|6-6\|RF1/JH6 | R. | D......V.. | V. | R | RTYC.GTYC...PYY....LG |
| iPS:43 7286 | 21-225_208F1 | VH3\|3-33/D6\|6-6\|RF1/JH6 | . . . | D......V.. | V. | R | RY...GL-...D |
| iPS:43 7290 | 21-225_210G6 | VH3\|3-33/D6\|6-6\|RF1/JH6 | . . . | N.....CV.. | . . . | . . . | RY...GL-...D |
| iPS:39 2634 | 21-225_17H3 | VH3\|3-33/D6\|6-6\|RF1/JH6 | . . . | N.....VI. | . . . | S | KY...W-...D |
| iPS:39 2742 | 21-225_20B2 | VH3\|3-33/D6\|6-6\|RF1/JH6 | . . . | . . . | . . . | . . . | KY...W-...D |

Figure 52 (Continued)

| | | | | | | | |
|---|---|---|---|---|---|---|---|
| iPS:39 2836 | 21-225_22F4 | VH3\|3-33/D6\|6-6\|RF1/JH6 | ............ | D............V... | ............ | ............ | KY...W-.........D. |
| iPS:39 2846 | 21-225_24B6 | VH3\|3-33/D6\|6-6\|RF1/JH6 | ...P........I... | N......V......... | ............ | ............ | EY..GW-.........D. |
| iPS:39 2884 | 21-225_23A10 | VH3\|3-33/D6\|6-6\|RF1/JH6 | ............ | ............ | ............ | ............ | RY..GW-........HD. |
| iPS:39 2888 | 21-225_25A2 | VH3\|3-33/D6\|6-6\|RF1/JH6 | ............ | ............ | ............ | ............ | R....W---.....SG... |
| iPS:39 2914 | 21-225_25D12 | VH3\|3-33/D6\|6-6\|RF1/JH6 | ............ | ......D...... | ............ | ............ | RY...W-.........D. |
| iPS:39 2924 | 21-225_32H2 | VH3\|3-33/D6\|6-6\|RF1/JH6 | ............ | ............ | ............ | .....G..N... | R....W---.....TG... |
| iPS:39 2938 | 21-225_29H4 | VH3\|3-33/D6\|6-6\|RF1/JH6 | ............ | .......I..... | ............ | ............ | R....W---.....SG... |
| iPS:39 2974 | 21-225_26A11 | VH3\|3-33/D6\|6-6\|RF1/JH6 | ............ | N.....CV..... | ............ | ......N..... | R....W-.........D. |
| iPS:39 3012 | 21-225_26G7 | VH3\|3-33/D6\|6-6\|RF1/JH6 | ............ | ............ | ............ | ............ | EY..GW-.......... |
| iPS:39 3176 | 21-225_27E7 | VH3\|3-33/D6\|6-6\|RF1/JH6 | ............ | ............ | ............ | ............ | D.YC.STSC........PYY... |
| iPS:39 3864 | 21-225_4C5 | VH3\|3-33/D6\|6-6\|RF1/JH6 | ............ | VL........... | ............ | ............ | KYT..W-.......... |
| iPS:39 3902 | 21-225_14E10 | VH3\|3-33/D6\|6-6\|RF1/JH6 | ............ | D............ | ............ | ............ | KY...W-.........D. |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| Germline | VH3]3-33/D2]2-8]RF3/JH4 | QVQLVES GGGVVQPGRSLR LSCAASG-FTFS | S ...VGMH | WVRQAPGK GLEWVA | VIWYD GSNKYYAL SVKG | RFTISRDNSKNTLYLQM NSLRAEDTAVYYCAR | DILLWY ----AIYFDY | WGQGT LVTVSS |
| iPS:39 3908 | 21-225_10E9 | VH3]3-33/D6]6-6]RF1/JH 6 | N......VI. | | | | KY...W- | .D. | |
| iPS:39 3916 | 21-225_2G4 | VH3]3-33/D6]6-6]RF1/JH 6 | .........V... | | | | KY...W- | .D. | .H. |
| iPS:39 3950 | 21-225_3H10 | VH3]3-33/D6]6-6]RF1/JH 6 | .........V... | | | | RY..GW- L.. | .D. | |
| iPS:39 3972 | 21-225_7C9 | VH3]3-33/D6]6-6]RF1/JH 6 | N......V... | | | | KY...W- | .D. | |
| iPS:39 3978 | 21-225_4C12 | VH3]3-33/D6]6-6]RF1/JH 6 | .........V... | | | | KY...W- | .D. | .H. |
| iPS:39 3986 | 21-225_7G4 | VH3]3-33/D6]6-6]RF1/JH 6 | ......N | | | .T. | KY..NW- | .D. | |
| iPS:39 3996 | 21-225_15C11 | VH3]3-33/D6]6-6]RF1/JH 6 | D......V... | | | | KY...W- L.. | .D. | |
| iPS:39 4041 | 21-225_5E5 | VH3]3-33/D6]6-6]RF1/JH 6 | N......V... | | | | VY..GW- | .D. | |
| iPS:42 6118 | 21-225_7A10 | VH3]3-33/D2]2-8]RF3/JH 4 | ..........N.. | | .M. | | .H. | .ER.G--- ---I | |
| iPS:39 3844 | 21-225_3G7 | VH3]3-33/D2]2-8]RF3/JH 4 | ..........N.. | N | | .H. V | V | .ER.G--- ---I | |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3852 | 21-225_12A10 | VH3|3-33/D2|2-8|RF3/JH4 | ............ | ............ | ............ | ...H...T... E....... | ............ .ER.G--- ..I.... | ............ |
| iPS:39 3868 | 21-225_9C11 | VH3|3-33/D2|2-8|RF3/JH4 | ............ | ............ | ............ | ...H....... ET...... | ........S... .ER.G--- ..I.... | ............ |
| iPS:39 3900 | 21-225_10E12 | VH3|3-33/D2|2-8|RF3/JH4 | ......N..... | ............ | ...V........ | ...H...V... | ........S... ....C....... .ER.G--- ..I.... | ............ |
| iPS:39 3920 | 21-225_1H12 | VH3|3-33/D2|2-8|RF3/JH4 | ...S........ ..N......... | ............ | ............ | I..H...V... | ............ .ER.G--- ..I.... | ............ |
| iPS:39 3932 | 21-225_10F5 | VH3|3-33/D2|2-8|RF3/JH4 | ..N......... | ............ | ...S........ | I..H...V... | ............ .ER.G--- ..I.... | ............ |
| Germline | | H_FR1 CVQLVES GGGYVQPGRSLR LSCAASG FTFS | H_CDR1 S----YSMH | H_FR2 WVRQAPGK GLEWVA | H_CDR2 VIWYD GSNKYYAD SVKG | H_FR3 RFTISRDNSKNTLYLQM NSLRAEDTAVYYCAR | H_CDR3 EVYSS-----SYFDY | H_FR4 WGQGTL VTVSS |
| VH3|3-33/D6|6-6|RF1/JH4 | | | | | | | | |
| iPS:42 6124 | 21-225_32D6 | VH3|3-33/D6|6-6|RF1/JH4 | ............ | ............ | ....T....... | ...H...A... | ............ | N...........Y.... | ............ |
| iPS:39 2922 | 21-225_30G4 | VH3|3-33/D6|6-6|RF1/JH4 | ............ | ............ | .R.......... | ...TD..V... | ..........S. | N...........Y.... | ............ |
| iPS:39 3002 | 21-225_30G1 | VH3|3-33/D6|6-6|RF1/JH4 | ............ | ....Y....... | ............ | ...H...V... | ............ | N...........Y.... | ............ |
| iPS:39 3066 | 21-225_34D3 | VH3|3-33/D6|6-6|RF1/JH4 | ............ | ....Y....... | ............ | ...H...V... | ............ | N...........F.... | ............ |
| iPS:39 3092 | 21-225_33C12 | VH3|3-33/D6|6-6|RF1/JH4 | ............ | ....H....... | ............ | ............ | ............ | N...........Y.... | ............ |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3100 | 21-225_36B8 | VH3\|3-33/D6\|6-6\|RF1/JH4 | ........N........... | ................ | .........H...... | ................ | ................ | N....Y... | ........ |
| iPS:39 3122 | 21-225_33B2 | VH3\|3-33/D6\|6-6\|RF1/JH4 | ........N........... | ................ | .........H...... | ................ | ................ | N....Y... | ........ |
| iPS:39 3134 | 21-225_34C2 | VH3\|3-33/D6\|6-6\|RF1/JH4 | ........N......V... | ................ | .........L...... | ................ | ................ | N....Y... | ........ |
| iPS:39 3136 | 21-225_34D8 | VH3\|3-33/D6\|6-6\|RF1/JH4 | ........N........... | ................ | ................ | ................ | ................ | N....Y... | ........ |
| Germline | VH3\|3-30.3/D6\|6-19\|RF2/JH6 | H_FR1 QVQLVES-GGVVQPGRSLR LSCAASG-FTFS | H_CDR1 S------YAMH | H_FR2 WVRQAPGK VGLEWVA | H_CDR2 VISYD-GSNKYYAD SVKG | H_FR3 RFTISRDNSKNTLYLQM NSLRAEDTAVYYCAR | H_CDR3 GLAVAGYY -----YYYGMDV | H_FR4 WGQGTT VTVSS |
| iPS:45 1135 | 21-225_64A11 | VH3\|3-30.3/D6\|6-19\|RF2/JH6 | ................G... | ................ | ................ | ........V....... | ........T....... | RG....P--- | ........ |
| Germline | VH1\|1-08/D6\|6-19\|RF1/JH5 | H_FR1 QVQLVQS-GAEVKKPGASVK VSCKASG-YTFT | H_CDR1 S------YDIN | H_FR2 WVRQATGQ GLEWMG | H_CDR2 WMNPN-SGNTGYAQ KFQG | H_FR3 RVTMTRTSTSTAYMEL SSLRSEDTAVYYCAR | H_CDR3 GISSGW- -----WWFDP | H_FR4 WGQGTL VTVSS |
| iPS:45 1137 | 21-225_74A7 | VH1\|1-08/D6\|6-19\|RF1/JH5 | ........N........... | ................ | ................ | ................ | ........T...H... | SSGWN- | ........ |
| iPS:43 4285 | 21-225_57A11 | VH1\|1-08/D6\|6-19\|RF1/JH5 | ........N........... | ................ | ................ | ........V....... | ........D...... | SSGWN- | ........ |
| iPS:43 4287 | 21-225_57F12 | VH1\|1-08/D6\|6-19\|RF1/JH5 | ........N........... | ................ | ................ | ................ | ................I | SSGWY- ---R... | ........ |
| iPS:43 4479 | 21-225_76H1 | VH1\|1-08/D6\|6-19\|RF1/JH5 | ........N........... | ................ | .........VP. | .........H...... | ................I | SSGWY- | ........ |

Figure 52 (Continued)

| | | | | | | | |
|---|---|---|---|---|---|---|---|
| iPS:43 4481 | 21-225_74B10 | VH1j1-08/D6j6-19jRF1/J H5 | . . . . . . . . . | N . . . . . . . | . . . . H . . . . . F . | . . . . . . . . . | SSGWY- . . . . . | . . . . . |
| iPS:43 4483 | 21-225_74C12 | VH1j1-08/D6j6-19jRF1/J H5 | . . . . . . . . . | N . . . . . . . | . . . . . . . . . | . . . . . V . . . | SSGWY- . . . . . | . . . . . |
| iPS:43 4493 | 21-225_76F3 | VH1j1-08/D6j6-19jRF1/J H5 | . . . . . . . . . | N . . . . . . . | . . . . . . . . . | . T . . . H . V . | SSGWN- . . . . . | . . . . . |
| iPS:43 4509 | 21-225_76F5 | VH1j1-08/D6j6-19jRF1/J H5 | . . . . . . . . . | N . . . . . . . | . . . . . . . . . | . . . . . S . . . | SSGWY- . . . . . | . . . . . |
| iPS:43 4513 | 21-225_76A6 | VH1j1-08/D6j6-19jRF1/J H5 | . . . . . . . . . | N . . . . . . . | . . . . . H . . . N . | . . . . . I . . . | SSGWY- . . . . . | . . . L . |
| iPS:43 4515 | 21-225_74A5 | VH1j1-08/D6j6-19jRF1/J H5 | . . . . . . . . . | N . . . . . . . | . VP . . . H . . . | . . . . . I . . . | SSGWY- . . . . . | . . . . . |
| iPS:43 4525 | 21-225_76E8 | VH1j1-08/D6j6-19jRF1/J H5 | . . . P . . . . . | N . . . . . . . | . . . . . . . . . | . . . . . V . . . | SSGWH- . . . . . | . . . A . |
| iPS:43 4529 | 21-225_76B9 | VH1j1-08/D6j6-19jRF1/J H5 | . . . . . . . . . | N . . . . . . . | . VP . . . H . . . | . . . . . I . . . | SSGWY- . . . . . | . . . . . |
| iPS:43 4575 | 21-225_77C7 | VH1j1-08/D6j6-19jRF1/J H5 | . . . P . . . . . | N . . . . . . . | . . . . . . . . . N . | . . . . . V . . . | SSGWH- . . . . . | . . . A . |
| iPS:43 4583 | 21-225_74B6 | VH1j1-08/D6j6-19jRF1/J H5 | . . . . . . . . . | N . . . . . . . | . . . . . H . . . | . . . . . I . . . | SSGWY- . . . . . | . . . L . |
| iPS:43 4587 | 21-225_74G3 | VH1j1-08/D6j6-19jRF1/J H5 | . . . . . . . . . | N . . . . . . . | . . . . . H . . . | . . . . . I . . . | SSGWY- . . . . . | . . . . . |
| iPS:43 4597 | 21-225_77C10 | VH1j1-08/D6j6-19jRF1/J H5 | . . . . . . . . . | N . . . . . . . | . . . . . H . . . | . . . . . I . . . | SSGWY- . . . . . | . . . . . |

Figure 52 (Continued)

| | | | | | | | | | |
|---|---|---|---|---|---|---|---|---|---|
| iPS:43 4603 | 21-225_77D11 | VH1\|1-08/D6\|6-19\|RF1/JH5 | . . . . . . . . . | N . . . . . . . . | . . . . . . . . . | . VP . . . . . . . . . H . . . | . . . . . . . . . . . . . . . . | . . . . . . . . N . . . . . . . . . . | SSGWY-- . . . . . . . . . . . | . . . . . . . . . . . . . |
| iPS:43 4613 | 21-225_77D12 | VH1\|1-08/D6\|6-19\|RF1/JH5 | . . . . . . . . . | N . . . . . . . . | . . . . . . . . . | . . . . . . . . . . . . . . . . | . . . . . . . . . . L . . . . . . . | . . . . . . . . . . . . . . . . . . . . . . I . . | SSGWY-- . . . . . . . . . . . | . . . . . . . . . . . . . |
| iPS:43 4617 | 21-225_74B8 | VH1\|1-08/D6\|6-19\|RF1/JH5 | . . . . . . . . . | N . . . . . . . . | . . . . . . . . . | . . . . . . . . . H . . . | . . . . . . . . . . . . . . . . | . . . . . . . . . . . . . . . . . V | SSGWY-- . . . . . . . . . . . | . . . . . . . . . . . . . |
| iPS:43 4619 | 21-225_78C1 | VH1\|1-08/D6\|6-19\|RF1/JH5 | . . . . . . . . . | N . . . . . . . . | . . . . . . . . . | . . . . . . . . . H . . . | . . . . . . . . . . . . . . . . | . . . . . . . . . . . . . . . . . I | SSGWY-- . . . . . . . . . . . | . . . . . . . . . . . . . |
| iPS:43 4639 | 21-225_74B7 | VH1\|1-08/D6\|6-19\|RF1/JH5 | . . . . . . . P | N . . . . . . . . | . . . . . . . . . | . . . . . . . . . . . . . . . . | . . . . . . . . . . . . . . . . | . . . . . . . . . . . . T . H . . . . . V | SSGWH-- . . . . . . . . . . . | . . A . . . . . . . . . . |
| iPS:43 4653 | 21-225_74B5 | VH1\|1-08/D6\|6-19\|RF1/JH5 | . . . . . . . . . | N . . . . . . . . | . . . . . . . . . | . . . . . . . . . . . . . . . . | . . . . . . . . . . . . . . . . | . . . . . . . . . . . . . . . . . V | SSGWN-- . . . . . . . . . . . | . . . . . . . . . . . . . |
| iPS:43 4655 | 21-225_78H12 | VH1\|1-08/D6\|6-19\|RF1/JH5 | . . . . . . F . . | N . . . . . . . . | . . . . . . . . . | . VP . . . . . . . . . F . . . | . . . . . . . . . . . . . . . . | . . . . . . . . . . . . T . H . . . . . V | SSGWH-- . . . . . . . . . . . | . . A . . . . . . . . . . |
| iPS:43 4675 | 21-225_79G6 | VH1\|1-08/D6\|6-19\|RF1/JH5 | . . . . . . . . . | N . . . . . . . . | . . . . . . . . . | . . . . . . . . . . . . . . . . | . . . . . . . . . . . . . . . . | . . . . . . . . . . . . . . . . . V | SSGWN-- . . . . . . . . . . . | . . . . . . . . . . . . . |
| iPS:43 4689 | 21-225_79G10 | VH1\|1-08/D6\|6-19\|RF1/JH5 | . . . . . . . . . | N . . . . . . . . | . . . . . . . . . | . VP . . . . . . . . . H . . . | . . . . . . . . . . . . . . . . | . . . . . . . . . . . . . . . . . I | SSGWY-- . . . . . . . . . . . | . . . . . . . . . . . . . |
| iPS:43 4705 | 21-225_80A2 | VH1\|1-08/D6\|6-19\|RF1/JH5 | . . . . . . . . . | N . . . . . . . . | . . . . . . . . . | . . . . . . . . . H . . . | . . . . . . . . . . . . . . . . | . . . . . . . . . . . . . . . . . I | SSGWY-- . . . . . . . . . . . | . . . . . . . . . . . . . |
| iPS:43 4707 | 21-225_80D3 | VH1\|1-08/D6\|6-19\|RF1/JH5 | . . . . . . . . . | N . . . . . . . . | . . . . . . . . . | . . . . . . . . . H . . . | . . . . . . . . . . . . . . . . | . . . . . . . . . . . . . . . . . V | SSGWY-- . . . . . . . . . . . | . . . . . . . . . . . . . |
| iPS:43 4731 | 21-225_80E9 | VH1\|1-08/D6\|6-19\|RF1/JH5 | . . . . . . . . . | N . . . . . . . . | . . . . . . . . . | . . . . . . . . . H . . . | . . . . . . . . . . . . . . . . | . . . . . . . . . . . . . . . . . I | SSGWY-- . . . . . . . . . . . | . . . . . . . . . . . . . |

Figure 52 (Continued)

| | | | | | | | | | |
|---|---|---|---|---|---|---|---|---|---|
| iPS:43 4747 | 21-225_80C12 | VH1j1-08/D6j6-19jRF1/J H5 | . . . . . . . . . . . . | N . . . . . . | . . . . . . . . . | . . . . . . . H . . | . . . . . . . . . N . | . . . . . . . | SSGWY- . . . . . . . . . . . . . | . . . L |
| iPS:43 4761 | 21-225_81E5 | VH1j1-08/D6j6-19jRF1/J H5 | . . . . . . . . . . . . | N . . . . . . | . . . . . . . . . | . . . . . . . . . . | . . . T . . H . . V | . . . . . . . | SSGWN- . . . . . . . . . . . . . | . . . . |
| iPS:43 4771 | 21-225_81F9 | VH1j1-08/D6j6-19jRF1/J H5 | . . . . . . . . . . . . | N . . . . . . | . . . . . . . . . | . . . . . . . H . . | . . . . . . . . . I | . . . . . . . | SSGWY- . . . . . . . . . . . . . | . . . . |
| iPS:43 4793 | 21-225_82A5 | VH1j1-08/D6j6-19jRF1/J H5 | . . . . . . . . . . . . | N . . . . . . | . . . . . . . . . | . . . . . . . H . . N | . . . . . . . . . I | . . . . . . . | SSGWY- . . . . . . . . . . . . . | . . . L |
| iPS:43 4797 | 21-225_82G5 | VH1j1-08/D6j6-19jRF1/J H5 | . . . . . . . . . . . . | N . . . . . . | . . . . . . VP . | . . . . . . . H . . | . . . . . . . . . I | . . . . . . . | SSGWY- . . . . . . . . . . . . . | . . . . |
| iPS:43 4805 | 21-225_82D9 | VH1j1-08/D6j6-19jRF1/J H5 | . . . . . . . . . . . . | N . . . . . . | . . . . . . VP . | . . . . . . . H . . | . . . . . . . . . N . | . . . . . . . | SSGWY- . . . . . . . . . . . . . | . . . L |
| iPS:43 4813 | 21-225_82C12 | VH1j1-08/D6j6-19jRF1/J H5 | . . . . . . . . . . . . | N . . . . . . | . . . . . . VP . | . . . . . . . H . . | . . . . . . . . . I | . . . . . . . | SSGWY- . . . . . . . . . . . . . | . . . . |
| iPS:43 4825 | 21-225_83C2 | VH1j1-08/D6j6-19jRF1/J H5 | . . . . . . . . . . . . | N . . . . . . | . . . . . . VP . | . . . . . . . H . . | . . . . . . . . . I | . . . . . . . | SSGWY- . . . . . . . . . . . . . | . . . . |
| iPS:43 4827 | 21-225_83F3 | VH1j1-08/D6j6-19jRF1/J H5 | . . . . . . . . . . . . | N . . . . . . | . . . . . . VP . | . . . . . . . H . . | . . . . . . . . . I | . . . . . . . | SSGWY- . . . . . . . . . . . . . | . . . . |
| iPS:43 4829 | 21-225_83G3 | VH1j1-08/D6j6-19jRF1/J H5 | . . . . . . . . . . . . | N . . . . . . | . . . . . . . . . | . . . . . . . H . . | . . . . . . . . . I | . . . . . . . | SSGWY- . . . . . . . . . . . . . | . . . . |
| iPS:43 4833 | 21-225_83C5 | VH1j1-08/D6j6-19jRF1/J H5 | . . . . . . . . . . . . | N . . . . . . | . . . . . . . . . | . . . . . . . H . . | . . . . . . . . . . | . . . . . . . | SSGWY- . . . . . . . . . . . . . | . . . . |
| iPS:43 4841 | 21-225_83G7 | VH1j1-08/D6j6-19jRF1/J H5 | . . . . . . . . . . P | N . . . . . . | . . . . . . . . . | . . . . . . . . . . | . . . . . . . . . V | . . . . . . . | SSGWH- . . . . . . . . . . . . . | . . . A |

Figure 52 (Continued)

| | | | | | | | | |
|---|---|---|---|---|---|---|---|---|
| iPS:43 4863 | 21-225_84G7 | VH1\|1-08/D6\|6-19\|RF1/J H5 | .........P.. | N........... | ............ | ............D | ............ | SSGWH- | ....A. |
| iPS:43 4877 | 21-225_85H2 | VH1\|1-08/D6\|6-19\|RF1/J H5 | ............ | N........... | ............ | ............ | ..L.........V | SSGWY- | ...... |
| iPS:43 4883 | 21-225_85B5 | VH1\|1-08/D6\|6-19\|RF1/J H5 | ............ | ............ | .VP......... | ............H | ............I | SSGWY- | ...... |
| iPS:43 4911 | 21-225_85D11 | VH1\|1-08/D6\|6-19\|RF1/J H5 | ............ | N........... | .VP......... | ............H | ............I | SSGWY- | ...... |
| iPS:43 4935 | 21-225_86E9 | VH1\|1-08/D6\|6-19\|RF1/J H5 | ............ | N........... | ............ | ............H | ...S.T...H..V | SSGWS- | ...... |
| iPS:43 4957 | 21-225_87A10 | VH1\|1-08/D6\|6-19\|RF1/J H5 | ............ | N........... | ............ | ..N.........H | ............I | SSGWY- | ....L. |
| iPS:43 4971 | 21-225_88G2 | VH1\|1-08/D6\|6-19\|RF1/J H5 | ............ | N........... | ............ | ............ | ............V | SSGWY- | ...... |
| iPS:43 5051 | 21-225_90D9 | VH1\|1-08/D6\|6-19\|RF1/J H5 | .........P.. | N........... | ............ | ............H | ............I | SSGWH- | ....A. |
| iPS:43 5071 | 21-225_91F1 | VH1\|1-08/D6\|6-19\|RF1/J H5 | ............ | N........... | ............ | ............H | ............I | SSGWY- | ...... |
| iPS:43 5087 | 21-225_91G8 | VH1\|1-08/D6\|6-19\|RF1/J H5 | ............ | N........... | ............ | ............ | ............V | SSGWY- | ...... |
| iPS:43 5203 | 21-225_75A7 | VH1\|1-08/D6\|6-19\|RF1/J H5 | .........P.. | N........... | ............ | ............D | ...T......H..V | SSGWH- | ....A. |
| iPS:43 5211 | 21-225_94E11 | VH1\|1-08/D6\|6-19\|RF1/J H5 | ............ | ............ | ............ | ............ | ............V | SSGWK- | ...... |

Figure 52 (Continued)

| ID | Gene | | | | | | | |
|---|---|---|---|---|---|---|---|---|
| iPS:43 5227 | 21-225_95G4 | VH1|1-08/D6|6-19|RF1/J H5 | | N........... | ............ T...H... | ............V | SSGWN- | ........... |
| iPS:43 5245 | 21-225_95E12 | VH1|1-08/D6|6-19|RF1/J H5 | | N........... | ............ | ............ | SSGWY- | ........... |
| iPS:43 5247 | 21-225_96G1 | VH1|1-08/D6|6-19|RF1/J H5 | | N........... | ......H..... N........... | ............I | SSGWY- | ........L.. |
| iPS:43 5249 | 21-225_96E2 | VH1|1-08/D6|6-19|RF1/J H5 | | N........... | ......H..... | ............I | SSGWY- | ........... |
| iPS:43 5255 | 21-225_96D5 | VH1|1-08/D6|6-19|RF1/J H5 | | N........... | ......L..... ......S.T.H... | ............V | SSGWS- | ........... |
| iPS:43 5279 | 21-225_97H4 | VH1|1-08/D6|6-19|RF1/J H5 | | N........... | ......H..... | ............I | SSGWY- | ........... |
| iPS:43 5327 | 21-225_147G6 | VH1|1-08/D6|6-19|RF1/J H5 | | N........... | ............ | ............Y | SSGWY- | ........... |
| iPS:43 5437 | 21-225_152F4 | VH1|1-08/D6|6-19|RF1/J H5 | | N........... | ......D..... ......D..... | ............Y | SSGWY- | ........... |
| iPS:43 5701 | 21-225_170F6 | VH1|1-08/D6|6-19|RF1/J H5 | | N........... | ......H..... ......H..... | ............ | SSGWY- | ........... |
| iPS:43 5737 | 21-225_174G5 | VH1|1-08/D6|6-19|RF1/J H5 | | N........... | ......H..... | ............S | SSGWN- | ........... |
| iPS:43 6544 | 21-225_224H5 | VH1|1-08/D6|6-19|RF1/J H5 | | N........... | ......H..... ......S..... ......L..... N........... | ............V .S | SSGWY- | ........... |
| iPS:43 6570 | 21-225_225F4 | VH1|1-08/D6|6-19|RF1/J H5 | | N........... | | .S | SSGWY- | ........... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6644 | 21-225_227G9 | VH1|1-08/D6|6-19|RF1/J H5 | ........N........ ..............R | .........R...Y.. | ........... | ............L.. | SSGWY-..- | ..... |
| iPS:43 7322 | 21-225_75B1 | VH1|1-08/D6|6-19|RF1/J H5 | ................. | ........N........ | ...VP.. | ........H..... | ............I.. | SSGWY-..- | ..... |
| iPS:43 7361 | 21-225_74C1 | VH1|1-08/D6|6-19|RF1/J H5 | ................. | ........N........ | | ........D..... | ............V.. | SSGWY-..- | ..... |
| iPS:43 7363 | 21-225_74C10 | VH1|1-08/D6|6-19|RF1/J H5 | ................. | ........N........ | | ........F..I.. | ............I.. | SSGWY-..- | ..... |
| iPS:43 7379 | 21-225_74H2 | VH1|1-08/D6|6-19|RF1/J H5 | ........F........ | ........N........ | | ........H..F.. | ............V.. | SSGWH-..- | ..... |
| iPS:44 6094 | 21-225_77E1 | VH1|1-08/D6|6-19|RF1/J H5 | ........F........ ..............P | ........N........ | | ........H..F.. | ............V.. | SSGWY-..- | ....A. |
| iPS:45 1129 | 21-225_94D2 | VH1|1-08/D6|6-19|RF1/J H5 | ................. | ........N........ | | ........H..... | ............V.. | SSGWY-..- | ..... |
| iPS:45 1133 | 21-225_95H4 | VH1|1-08/D6|6-19|RF1/J H5 | ..............I.. | ........N........ | | ........H..... | ......T..H...V.. ........W | SSGWN-..- | ..... |
| iPS:39 8510 | 21-225_25A3 | VH1|1-08/D6|6-19|RF1/J H5 | ................. | ........N........ | | ........H..... | ............N.. ........W......S | SSGWY-..- | ..... |
| iPS:39 8516 | 21-225_26A9 | VH1|1-08/D6|6-19|RF1/J H5 | ................. | ........N........ | | ........H..C.. | ............S ........W.M | SSGWY-..- | ..... |
| Germline VH3|3-30.3|D5|5-18|RF3|JH4 | | EVQLVES- GGGVVQPGRSLR LSCAASG-FTFS | S------YAMH | WVRQAPGK GLEWVA | VISID---- GSNKYYAD SVKG | RFTISRDNSKNTLYLQM NSLRAEDTAVYYCAR | GYSYG------- GYFDY | WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:45_1139 | VH3j3-30.3/D5j5-18jRF3/J18jRF2jH4 | .......... | N......G... | .......... | ......E... | .......... | DHR.V..... RGG.... | .......... |
| VH1j1-18jD6j6-19jRF2jH5 | Germline | DVQLVQS GAEVKKPGASVK VSCKASG-YTFT | S YGIS | WVRQAPGQ GLEWMG | WISAY NGNTNYAQ KLQG | RVTMTTDTSTSTAYMEL RSLRSDDTAVYYCAR | GLAVAG NWFDP | WGQGTL VTVSS |
| iPS:45_1143 | VH1j1-18jD6j6-19jRF2jH5 | ..........A | T......... | .......... | .......... | .......... | .E....... | .......... |
| iPS:43_4361 | VH1j1-18jD6j6-19jRF2jH5 | ..........P | .......... | .......... | S......... | ......F... | .-V...... | .......... |
| VH3j3-33jD4j4-23jRF2jH6 | Germline | QVQLVES GGGYVQPGRSLR LSCAASG-FTFS | S YGMH | WVRQAPGK GLEWVA | VIWYD GSNKYYAD SVKG | RFTISRDNSKNTLYLQM NSLRAEDTAVYYCAR | DYGNSYY YYGMDV | WGQGTT VTVSS |
| iPS:45_3445 | VH3j3-33jD4j4-23jRF2jH6 | .......... | .......... | .......... | ...F...V..D | .......... | RVEG.GTP.....Y..... | .......... |
| iPS:43_6082 | VH3j3-33jD4j4-23jRF2jH6 | .......... | H......V.. | .......... | ...T...... | .......... | WF.EGN--.......... | .......... |
| iPS:43_6118 | VH3j3-33jD4j4-23jRF2jH6 | .......... | H......V.. | .......... | ...T...... | .......... | WF.EGN--.......... | .......... |
| iPS:43_6670 | VH3j3-33jD4j4-23jRF2jH6 | .......... | .......... | .......... | D..F......D | .......... | RVEG.GTP.....Y..... | .......... |
| iPS:43_6720 | VH3j3-33jD4j4-23jRF2jH6 | .......... | D......... | .......... | ...L...... | .......... | DRSC.RTSC...PYY....L | I.... |
| iPS:43_6726 | VH3j3-33jD4j4-23jRF2jH6 | .......... | D......... | .......... | ...L...... | .......... | DRSC.RTSC...PYY....L | I.... |

Figure 52 (Continued)

| | | | | | | | | |
|---|---|---|---|---|---|---|---|---|
| iPS:43 6732 | 21-225_152B12 | VH3\|3-33\|D4\|4-23\|RF2\|J H6 | ....V....... | ........D... | ............ | ............ | ............ | DRSC.STSC..... ..PYY....L.. |
| iPS:43 6734 | 21-225_153A8 | VH3\|3-33\|D4\|4-23\|RF2\|J H6 | ....M....... | ........D... | ....L....... | ............ | ............ | DRSC.RTSC..... ..PYY....L..I |
| iPS:43 6736 | 21-225_153E8 | VH3\|3-33\|D4\|4-23\|RF2\|J H6 | ....L....... | ....N....... | ....F...V... | ............ | ............ | RVEG.GTP...... ......Y..... |
| iPS:43 6756 | 21-225_146A10 | VH3\|3-33\|D4\|4-23\|RF2\|J H6 | ....E....... | ........G... | ..MT........ | ............ | ............ | RVFC.STSCL.... ...SYY...... |
| iPS:43 6766 | 21-225_158D10 | VH3\|3-33\|D4\|4-23\|RF2\|J H6 | ............ | ............ | ....L.R..... | ............ | ............ | RVSC.STSC..... ...PYY...... |
| iPS:43 6768 | 21-225_159H8 | VH3\|3-33\|D4\|4-23\|RF2\|J H6 | ............ | ........T... | ............ | ............ | ............ | RVSC.STSC..... ...PYY...... |
| iPS:43 6770 | 21-225_160B12 | VH3\|3-33\|D4\|4-23\|RF2\|J H6 | ............ | ............ | ............ | ............ | ............ | RVSC.STSC..... ...PYY...... |
| iPS:43 6782 | 21-225_166G11 | VH3\|3-33\|D4\|4-23\|RF2\|J H6 | ....N....... | ....N...G... | ............ | ....T....F.. | ............ | DRYC.SPTCH.... ..PYY....L.. |
| iPS:43 6794 | 21-225_170F1 | VH3\|3-33\|D4\|4-23\|RF2\|J H6 | ............ | ........G... | ....I....... | ............ | ............ | RVYC.STSCH.... ..PYY....A.. |
| iPS:43 6836 | 21-225_52H1 | VH3\|3-33\|D4\|4-23\|RF2\|J H6 | ............ | ............ | ....N....... | ............ | ............ | RVYC.SSSCS.... ...YYY...... |
| iPS:43 6922 | 21-225_78E9 | VH3\|3-33\|D4\|4-23\|RF2\|J H6 | ............ | ............ | ....N.S..... | ............I | ............ | RDYC.STSC..... ..PYY....... |
| iPS:43 6924 | 21-225_74B3 | VH3\|3-33\|D4\|4-23\|RF2\|J H6 | ............ | ........K... | ....F...D... | ............ | ............ | RDYC.STSC..... ..PYY....... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | VH3\|3-33\|D4\|4-23\|RF2\|J H6 | | | | | | |
| iPS:43 6928 | 21-225_79E7 | ......... | ......... | ......... | ...N..S. | ......... I ...... | .RDYC.STSC ...PYY..... | ..... |
| iPS:43 6932 | 21-225_92A4 | ......... | ......... | ......... | ...N..S. | .....Y..I ...... | .RDYC.STSC ...PYY..... | ..... |
| iPS:43 6936 | 21-225_97E6 | ......... | ......... | ......... | ...N..S. | ......... I ...... | .RDYC.STSC ...PYY..... | ..... |
| iPS:43 7190 | 21-225_225A9 | ....G.... | ......T.. | ....L.... | ......... | ......... I..Q... | .NHYC.STSCS ...PYY..F... | ..... |
| iPS:43 7254 | 21-225_149F2 | ....G.A.. | ......R.. | ......... | ....F.EN. | .....V..R ...... | .RVEG.GTP ......Y..... | ..... |
| iPS:43 7256 | 21-225_150F11 | ....G.A.. | ......R.. | ......... | ....F.EN. | .....V..R ...... | .RVEG.GTP ......Y..... | ..... |
| iPS:45 1110 | 21-225_74C9 | ......... | ......... | ......... | ...N..S. | ......... I ...... | .RDYC.STSC ...PYY..... | ..... |
| iPS:39 2589 | 21-225_27H2 | ......... | ....G.... | ......... | ......... | ......... ...F... | .RVYC.STSCS ...PYY..... | ..... |
| iPS:39 3166 | 21-225_27G6 | ......... | ....G.... | ......L.. | ...I..K..N | ......... ...... | .RVYC.STSCS ...PYY..... | ..... |
| iPS:39 3198 | 21-225_28A11 | ......... | ....G.... | ......... | ....L.....N..T. | ......... ...... | .RVSC.STSCS ...PYY..... | ..... |
| iPS:39 3204 | 21-225_8C12 | .........G | ......... | ......... | ....L...... | ......... ...... | .RVSC.SSSCY ...PYY..... | ..... |

| | Germline | H_FR1 | H_CDR1 | H_FR2 | H_CDR2 | H_FR3 | H_CDR3 | H_FR4 |
|---|---|---|---|---|---|---|---|---|
| iPS:43 5665 | VH4|4-59/D7|7-27|RF1/JH4 | ........... | ........... | ...A.. | ..R.DT.. | ...M.I....S.I.. | EG.VGA........TY... | .......... |
| iPS:43 5671 | VH4|4-59/D7|7-27|RF1/JH4 | ........... | ........... | ...A.. | ..R.DT.. | ...M......S.I.. | EG.VGA........TY... | .......... |
| iPS:43 6354 | VH4|4-59/D7|7-27|RF1/JH4 | ........N..R | ........... | ...A.. | ..R.T... | .I.M........... | GF.D.........W... | .......... |
| VH4|4-34|D4|4-17|RF2|JH6 | Germline | QVQLQEW GALLKPSETLS LTCAVYG GSFS | G........ YYWS | WIRQPPGK GLEWIG CLEWIG | EINH SGSTNYNP SLKS | RVTISVDTSKNQFSLKL SSVTAADTAVYYCAR | DYGDIII YYGMDV | WGQGTT VTVSS |
| iPS:46 8810 | VH4|4-34|D4|4-17|RF2|JH5 | ....N....P.. | ...........C..... | ...... | ..Y....R..F.. | ............... | ...G.............. | .......... |
| iPS:46 8832 | VH4|4-34|D4|4-17|RF2|JH6 | ....N....P.. | ...........C..... | ...... | ..Y....R..F.. | ............... | ...G.............. | .......... |
| iPS:46 8834 | VH4|4-34|D4|4-17|RF2|JH6 | ....N....P.. | ...........C..... | .G..R.. | ..Y....R..F.. | ............... | ...G.............. | .......... |
| iPS:46 8838 | VH4|4-34|D4|4-17|RF2|JH6 | ....N....P.. | ...........S..... | ...... | ..Y....R..F.. | ............... | ...G.............. | .......... |
| iPS:46 8820 | VH4|4-34|D4|4-17|RF2|JH6 | ....N....P.. | ...........C..... | ...... | .....R.... | ............... | ...G.............. | .......... |
| iPS:43 4473 | VH4|4-34|D4|4-17|RF2|JH6 | ......S.P.. | ...........P..... | ...... | ........ | ...T........... | ...G.............. | .......... |
| iPS:43 4495 | VH4|4-34|D4|4-17|RF2|JH6 | ........... | ........... | ...... | ..T... | ...T.....S..... | ---L.............. | .......... |

| | | | | | | | | | |
|---|---|---|---|---|---|---|---|---|---|
| iPS:43_4595 | 21-225_77A10 | VH4|4-34|D4|4-17|RF2|JH6 | ......G....P.. | ..........H.... | ...C... | ........ | ........ | ..G----- | ........ |
| iPS:43_4611 | 21-225_77C12 | VH4|4-34|D4|4-17|RF2|JH6 | ..........A.... | ........ | ...S... | ...S...Y..R. | ......N. | ..G----- | ........ |
| iPS:43_4657 | 21-225_79G1 | VH4|4-34|D4|4-17|RF2|JH6 | ..........H.... | ........ | ...C... | ...S...Y..R. | ........ | ..G----- | ........ |
| iPS:43_4663 | 21-225_79F3 | VH4|4-34|D4|4-17|RF2|JH6 | ..........H.... | ........ | ...C... | ........ | ........ | ..G----- | ........ |
| iPS:43_4687 | 21-225_75A5 | VH4|4-34|D4|4-17|RF2|JH6 | ..........H.... | ........ | ...C... | ........ | ........ | ..G----- | ........ |
| iPS:43_4691 | 21-225_75G7 | VH4|4-34|D4|4-17|RF2|JH6 | ......T...H.... | ..........A.... | ...S... | ...S...Y..R. | ......N. | ..G----- | ........ |
| iPS:43_4693 | 21-225_79F11 | VH4|4-34|D4|4-17|RF2|JH6 | ..........H.... | ........ | ...C... | ........ | ........ | ..G----- | ........ |
| iPS:43_4699 | 21-225_79G12 | VH4|4-34|D4|4-17|RF2|JH6 | ..........H.... | ........ | ...C... | ........ | ........ | ..G----- | ........ |
| iPS:43_4701 | 21-225_80A1 | VH4|4-34|D4|4-17|RF2|JH6 | ..........H.... | ........ | ...C... | ........ | ........ | ..G----- | ........ |
| iPS:43_4703 | 21-225_80C1 | VH4|4-34|D4|4-17|RF2|JH6 | ..........H.... | ........ | ...C... | ........ | ........ | ..G----- | ........ |
| iPS:43_4709 | 21-225_80E3 | VH4|4-34|D4|4-17|RF2|JH6 | ..........H.... | ........ | ...C... | ........ | ........ | ..G----- | ........ |
| iPS:43_4715 | 21-225_80D5 | VH4|4-34|D4|4-17|RF2|JH6 | ..........P.... | ..........P.... | ...P... | ........ | ..T.....M... | ..G----- | --L... |

Figure 52 (Continued)

| | | | | | | |
|---|---|---|---|---|---|---|
| iPS:43 4725 | 21-225_80H7 | VH4|4-34/D4|4-17|RF2/J H6 | ........ | .S... | .......Q. .R... | .......G---- |
| iPS:43 4743 | 21-225_74A4 | VH4|4-34/D4|4-17|RF2/J H6 | ...V | .C... | | .......G---- --I.. |
| iPS:43 4751 | 21-225_80H12 | VH4|4-34/D4|4-17|RF2/J H6 | .H... | .C... | | .......G---- |
| iPS:43 4759 | 21-225_81C5 | VH4|4-34/D4|4-17|RF2/J H6 | .H... | .C... | | .......G---- |
| iPS:43 4773 | 21-225_75D9 | VH4|4-34/D4|4-17|RF2/J H6 | ........ | .P... | .......Y. .R... | .......G---- |
| iPS:43 4777 | 21-225_81C11 | VH4|4-34/D4|4-17|RF2/J H6 | .H... | .C... | | .......G---- |
| iPS:43 4809 | 21-225_74F5 | VH4|4-34/D4|4-17|RF2/J H6 | .H... | .C... | ...N. | .......G---- |
| iPS:43 4821 | 21-225_83G1 | VH4|4-34/D4|4-17|RF2/J H6 | ........ | .C... | | .......G---- |
| iPS:43 4839 | 21-225_83B7 | VH4|4-34/D4|4-17|RF2/J H6 | .H... | .C... | | .......G---- |
| iPS:43 4869 | 21-225_84E12 | VH4|4-34/D4|4-17|RF2/J H6 | ........ | .S... | .......Q. .R... | .......G---- |
| iPS:43 4879 | 21-225_85A3 | VH4|4-34/D4|4-17|RF2/J H6 | .H... | .C... | | .......G---- --I.. |
| iPS:43 4881 | 21-225_85B4 | VH4|4-34/D4|4-17|RF2/J H6 | .H... | .C... | | .......G---- |

Figure 52 (Continued)

| | | | | | | | |
|---|---|---|---|---|---|---|---|
| iPS:43 4887 | 21-225_85D6 | VH4|4-34|D4|4-17|RF2|JH6 | | ...G....P | ...C... | ....Y...R | | ...G----- |
| iPS:43 4895 | 21-225_74H7 | VH4|4-34|D4|4-17|RF2|JH6 | | | ...P | | ....H | ...G----- ---L.. |
| iPS:43 4899 | 21-225_85B9 | VH4|4-34|D4|4-17|RF2|JH6 | | ..N..P.. | ...C... | ...R..F. | | ...G----- |
| iPS:43 4907 | 21-225_85G10 | VH4|4-34|D4|4-17|RF2|JH6 | | ...R.... | ...C... | ....I... | | ...G----- ---L.. |
| iPS:43 4913 | 21-225_86C1 | VH4|4-34|D4|4-17|RF2|JH6 | | ....H | ...C... | | | ...G----- |
| iPS:43 4921 | 21-225_86E4 | VH4|4-34|D4|4-17|RF2|JH6 | | ....H | ...C... | | | ...G----- |
| iPS:43 4939 | 21-225_86C11 | VH4|4-34|D4|4-17|RF2|JH6 | | ....H | ...C... | ....R | | ...G----- |
| iPS:43 4943 | 21-225_87H1 | VH4|4-34|D4|4-17|RF2|JH6 | | ...P.... | ...C... | | ....D | ...G----- |
| iPS:43 4945 | 21-225_87E5 | VH4|4-34|D4|4-17|RF2|JH6 | | ....H | ...C... | | | ...G----- ---L.. |
| iPS:43 4955 | 21-225_87C9 | VH4|4-34|D4|4-17|RF2|JH6 | | ....H | ...C... | | | ...G----- |
| iPS:43 4961 | 21-225_87A12 | VH4|4-34|D4|4-17|RF2|JH6 | | ....H | ...C... | | | ...G----- |
| iPS:43 4969 | 21-225_88H1 | VH4|4-34|D4|4-17|RF2|JH6 | | ....H | ...C... | | | ...G----- |

Figure 52 (Continued)

| | | | | | | |
|---|---|---|---|---|---|---|
| iPS:43 4981 | 21-225_88E7 | VH4\|4-34\|D4\|4-17\|RF2\|JH6 | .H | .C | | | .G |
| iPS:43 4983 | 21-225_88F7 | VH4\|4-34\|D4\|4-17\|RF2\|JH6 | .H | .C | | | .G |
| iPS:43 4995 | 21-225_88G9 | VH4\|4-34\|D4\|4-17\|RF2\|JH6 | .H | .C | | | .G |
| iPS:43 4999 | 21-225_75A8 | VH4\|4-34\|D4\|4-17\|RF2\|JH6 | .H | .C | | | .G |
| iPS:43 5013 | 21-225_89D5 | VH4\|4-34\|D4\|4-17\|RF2\|JH6 | .H | .C | | | .G |
| iPS:43 5015 | 21-225_89H5 | VH4\|4-34\|D4\|4-17\|RF2\|JH6 | .H | .C | Y..F | A | .G |
| iPS:43 5025 | 21-225_89E10 | VH4\|4-34\|D4\|4-17\|RF2\|JH6 | .H | .C | | | .G...L |
| iPS:43 5029 | 21-225_89A11 | VH4\|4-34\|D4\|4-17\|RF2\|JH6 | .P .H | .C | R.S | | .G |
| iPS:43 5039 | 21-225_90G4 | VH4\|4-34\|D4\|4-17\|RF2\|JH6 | .H | .C | | | .G |
| iPS:43 5041 | 21-225_90A5 | VH4\|4-34\|D4\|4-17\|RF2\|JH6 | .H | .C | | | .G |
| iPS:43 5043 | 21-225_90G5 | VH4\|4-34\|D4\|4-17\|RF2\|JH6 | .H | .C | | | .G |
| iPS:43 5055 | 21-225_90F10 | VH4\|4-34\|D4\|4-17\|RF2\|JH6 | .H | .C | | | .G |

| ID | Gene | | | | | |
|---|---|---|---|---|---|---|
| iPS:43 5219 | 21-225_95D2 | VH4\|4-34\|D4\|4-17\|RF2\|JH6 | . . . . . . | . . C . . . | . . . . . . | . . . . . . |
| iPS:43 5235 | 21-225_95F9 | VH4\|4-34\|D4\|4-17\|RF2\|JH6 | . . H . . . | . . C . . . | . . . . . . | . G . . . . |
| iPS:43 5237 | 21-225_95G9 | VH4\|4-34\|D4\|4-17\|RF2\|JH6 | . . . . . . | . . C . . . | . . . . . . | . G . . . . |
| iPS:43 5239 | 21-225_95H10 | VH4\|4-34\|D4\|4-17\|RF2\|JH6 | . . H . . . | . . C . . . | . . . . . . | . G . . . . |
| iPS:43 5273 | 21-225_97A2 | VH4\|4-34\|D4\|4-17\|RF2\|JH6 | . . H . . . | . . C . . . | . . . . . . | . G . . . . |
| iPS:43 5281 | 21-225_97E5 | VH4\|4-34\|D4\|4-17\|RF2\|JH6 | . . H . . . | . . C . . . | . . . . . . | . G . . . . |
| iPS:43 7324 | 21-225_75C2 | VH4\|4-34\|D4\|4-17\|RF2\|JH6 | . . H . . . | . . C . . . | . . . . . . | . G . . . . |
| iPS:43 7328 | 21-225_75D3 | VH4\|4-34\|D4\|4-17\|RF2\|JH6 | . . H . . . | . . C . . . | . . . . . . | . G . . . . |
| iPS:43 7332 | 21-225_75F3 | VH4\|4-34\|D4\|4-17\|RF2\|JH6 | . . H . . . | . . C . . . | . . . . . . | . G . . . . |
| iPS:43 7344 | 21-225_75G12 | VH4\|4-34\|D4\|4-17\|RF2\|JH6 | . . H . . . | . . C . . . | . . . . . . | . G . . . . |
| iPS:43 7350 | 21-225_74A3 | VH4\|4-34\|D4\|4-17\|RF2\|JH6 | . . H . . . | . . C . . . | . . . . . . | . G . . . . |
| iPS:43 7369 | 21-225_74D6 | VH4\|4-34\|D4\|4-17\|RF2\|JH6 | . . H . . . | . . C . . . | . . . . . . | . G . . . . |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3}3-33{D}4-17{RF2}JH6 | | QVQLVES GGGVVQPGRSLR LSCAASG-FTFS | S....YGMH | WVRQAPGK GLEWVA | VIWYD GSNKYYAD SVKG | RFTISRDNSKNTLYLQM NSLRAEDTAVYYCAR | EVQDYY—-YYYGMDV | WGQGTT VTVSS |
| iPS:46 8814 | VH3}3-33{D}4-17{RF2}JH6 | | N........ | | ....D | ................F.... | .R.IG.-............ND... | ................ |
| iPS:43 4621 | VH3}3-33{D}4-17{RF2}JH6 | | | | | ......M............... | E.FGEEFD.-........Y.N... | ................ |
| iPS:43 4947 | VH3}3-33{D}4-17{RF2}JH6 | | | | ....H | ................ | F.VG.-............ | ................ |
| iPS:43 5819 | VH3}3-33{D}4-17{RF2}JH6 | | | | ....N | ................ | .Q.VG.-........D.L... | ................ |
| iPS:43 5825 | VH3}3-33{D}4-17{RF2}JH6 | | I........ | | ....N | ................ | .Q.VG.-........D.L... | ................ |
| iPS:43 5837 | VH3}3-33{D}4-17{RF2}JH6 | ........K....... | T........ | | T.N | ............C......... | .Q.VG.-........D.L... | ................ |
| iPS:43 5845 | VH3}3-33{D}4-17{RF2}JH6 | | | | EH | ................ | .R.VG.-..........L... | ................ |
| iPS:43 5859 | VH3}3-33{D}4-17{RF2}JH6 | | | | ....N | ................ | .Q.VG.-........D.L... | ................ |
| iPS:43 5873 | VH3}3-33{D}4-17{RF2}JH6 | | | | ....N | ......M............... | .Q.VG.-........D.L... | ..........S..... |
| iPS:43 5933 | VH3}3-33{D}4-17{RF2}JH6 | | T........ | | ....N | ................ | .Q.VG.-........D.L... | ................ |

Figure 52 (Continued)

| | | | N | | I.F | | L | AH.V.- | |
|---|---|---|---|---|---|---|---|---|---|
| iPS:43 5941 | 21-225_191E8 | VH3\|3-33\|D4\|4-17\|RF2/J H6 | | | .Q | | | .A... | |
| iPS:43 5945 | 21-225_191A10 | VH3\|3-33\|D4\|4-17\|RF2/J H6 | | | .N | M.. | | .Q.VG.- D.L.. | S |
| iPS:43 5947 | 21-225_191E10 | VH3\|3-33\|D4\|4-17\|RF2/J H6 | | | .N | M.. | | .Q.VG.- D.L.. | S |
| iPS:43 5957 | 21-225_191G12 | VH3\|3-33\|D4\|4-17\|RF2/J H6 | | | .N | | | .Q.VG.- | |
| iPS:43 5963 | 21-225_192D2 | VH3\|3-33\|D4\|4-17\|RF2/J H6 | | | .N | M.. E.. | | .R.VG.- | |
| iPS:43 5971 | 21-225_192D3 | VH3\|3-33\|D4\|4-17\|RF2/J H6 | | | EH. | | | R.VG.- .L.. | |
| iPS:43 5979 | 21-225_192H4 | VH3\|3-33\|D4\|4-17\|RF2/J H6 | | | .N | | | .Q.VG.- | |
| iPS:43 5987 | 21-225_192G6 | VH3\|3-33\|D4\|4-17\|RF2/J H6 | | | .L. T.N | M.. | | .Q.VG.- D.L.. | |
| iPS:43 5993 | 21-225_192C8 | VH3\|3-33\|D4\|4-17\|RF2/J H6 | | | EH. | | | R.VG.- | |
| iPS:43 5997 | 21-225_192G8 | VH3\|3-33\|D4\|4-17\|RF2/J H6 | | | .N | | | .Q.VG.- | |
| iPS:43 6005 | 21-225_192H10 | VH3\|3-33\|D4\|4-17\|RF2/J H6 | | | .N | M.. | | .Q.VG.- D.L.. | S |
| iPS:43 6031 | 21-225_193C7 | VH3\|3-33\|D4\|4-17\|RF2/J H6 | | | .N | M.. | | .Q.VG.- D.L.. | S |

Figure 52 (Continued)

| | | | | | | |
|---|---|---|---|---|---|---|
| iPS:43_6045 | 21-225_193A10 | VH3|3-33|D4|4-17|RF2/J H6 | . . . . . . . . . . . . | . . . . . . . . . . . . | EH. . . . . . . . . . . | . . . . . . . . . . . . | R.VG.-------- . . . . . . . . . . . |
| iPS:43_6076 | 21-225_194H11 | VH3|3-33|D4|4-17|RF2/J H6 | . . . . . . . . . . . . | . . . . . . . . . . . . | .EH. . . . . . . . . . | S. . . . . . . . . . . | R.VG.-------- ..L. . . . . . . . . |
| iPS:43_6086 | 21-225_191G10 | VH3|3-33|D4|4-17|RF2/J H6 | . . . . . . . . . . . . | . . . . . . . . . . . . | .N. . . . . . . . . . | . . . . . . . . . . . . | .Q.VG.-------- D.L.. . . . . . . . |
| iPS:43_6090 | 21-225_195A9 | VH3|3-33|D4|4-17|RF2/J H6 | . . . . . . . . . . . . | ..Q. . . . . . . . . | EH. . . . . . . . . . | . . . . . . . . . . . . | R.VG.-------- ..L. . . . . . . . |
| iPS:43_6112 | 21-225_196C7 | VH3|3-33|D4|4-17|RF2/J H6 | . . . . . . . . . . . . | . . . . . . . . . . . . | EH. . . . . . . . . . | . . . . . . . . . . . . | R.VG.-------- ..L. . . . . . . . |
| iPS:43_6138 | 21-225_197F2 | VH3|3-33|D4|4-17|RF2/J H6 | . . . . . . . . . . . . | . . . . . . . . . . . . | .N. . . . . . . . . . | . . . . . . . . . . . . | .Q.VG.-------- D.L.. . . . . . . . |
| iPS:43_6152 | 21-225_197B6 | VH3|3-33|D4|4-17|RF2/J H6 | . . . . . . . . . . . . | . . . . . . . . . . . . | .N. . . . . . . . . . | M. . . . . . . . . . S | .Q.VG.-------- . . . . . . . . . . . |
| iPS:43_6173 | 21-225_197G12 | VH3|3-33|D4|4-17|RF2/J H6 | . . . . . . . . . . . . | . . . . . . . . . . . . | .H. . . . . . . . . . | M. . . . . . . . . . | .Q.VG.-------- D.L.. . . . . . . . |
| iPS:43_6189 | 21-225_198B6 | VH3|3-33|D4|4-17|RF2/J H6 | . . . . . . . . . . . . | . . . . . . . . . . . . | .N. . . . . . . . . . | . . . . . . . . . . . . | .Q.VG.-------- D.L.. . . . . . . . |
| iPS:43_6201 | 21-225_199C5 | VH3|3-33|D4|4-17|RF2/J H6 | N. . . . . . . . . . . | . . . . . . . . . . . . | . . . . . . . . . . . . | . . . . . . . . . . . . | .Q.VG.-------- . . . . . . . . . . . |
| iPS:43_6203 | 21-225_199A6 | VH3|3-33|D4|4-17|RF2/J H6 | . . . . . . . . . . . . | I.F. ..Q. . . . . . . | . . . . . . . . . . . . | L. . . . . . . . . . | AH.V.-------- .A. . . . . . . . . |
| iPS:43_6282 | 21-225_204G6 | VH3|3-33|D4|4-17|RF2/J H6 | T. . . . . . . . . . . | .N. . . . . . . . . . | . . . . . . . . . . . . | . . . . . . . . . . . . | R.VG.-------- .D. . . . . . . . . |

Figure 52 (Continued)

| | | | | | | | |
|---|---|---|---|---|---|---|---|
| iPS:43_6296 | 21-225_205F5 | VH3\|3-33\|D4\|4-17\|RF2/J H6 | | R..... | ..EN.V. | ..T..KM.F... | M.IG.- |
| iPS:43_6324 | 21-225_207G6 | VH3\|3-33\|D4\|4-17\|RF2/J H6 | | | ..N..E | ..TD..... | A.IG.- ..I. |
| iPS:43_6364 | 21-225_211A11 | VH3\|3-33\|D4\|4-17\|RF2/J H6 | ...G.... | | L.F. RN. | | R.VG.- ..T.. |
| iPS:43_6372 | 21-225_211A8 | VH3\|3-33\|D4\|4-17\|RF2/J H6 | | | .EH. | ..K...... | H.VG.- |
| iPS:43_6376 | 21-225_212E6 | VH3\|3-33\|D4\|4-17\|RF2/J H6 | | | ..N.V. | | VG.- ..T.. |
| iPS:43_6378 | 21-225_212D7 | VH3\|3-33\|D4\|4-17\|RF2/J H6 | | | ..N. | ......S..... | VG.- ..T.. |
| iPS:43_6380 | 21-225_212F10 | VH3\|3-33\|D4\|4-17\|RF2/J H6 | | | .EH. | ..K...... | H.VG.- |
| iPS:43_6384 | 21-225_212H9 | VH3\|3-33\|D4\|4-17\|RF2/J H6 | | R..... | ..H. | ....G..... | R.VG.- N..... |
| iPS:43_6390 | 21-225_213D2 | VH3\|3-33\|D4\|4-17\|RF2/J H6 | ...T.... | | ..N. | ......S..... | VG.- ..T.. |
| iPS:43_6394 | 21-225_213C4 | VH3\|3-33\|D4\|4-17\|RF2/J H6 | | | ..H. | | VG.- D... |
| iPS:43_6398 | 21-225_213B8 | VH3\|3-33\|D4\|4-17\|RF2/J H6 | | | ..H. | | VG.- ..T.. |
| iPS:43_6404 | 21-225_214C3 | VH3\|3-33\|D4\|4-17\|RF2/J H6 | ......E | | ..N.G | | R.VG.- D.... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | EVQLVES-GGGVVQPGRSLR LSCAASG-FTFS | S------YGMH | WVRQAPGK GLEWVA | VIWYD GSNKYYAD SVKG | RFTISRDNSKNTLYLQM NSLRAEDTAVYYCAR | DYGDY---------YFDY | WGQGTL VTVSS |
| | VH3}3-33/D4}4-17/RF2/JH4 | | | | | | | |
| iPS:43 6410 | 21-225_212E10 | VH3}3-33/D4}4-17/RF2/JH6 | . . . . . . . . . . . . . . . . . . . . . . | . . . . . . . . . . . | . . . . . . . . . . . . . . . . . | . . . . . . . . . . . . . S . . . . . . . . . . . . . . . . . . . . . | . . . VG . - . . . . . . . . . . . . | . . . . . . . . |
| iPS:43 6420 | 21-225_215B5 | VH3}3-33/D4}4-17/RF2/JH6 | . . . . . . . . . . . . . . . . . . . . . . | . . . . . . . . . . . | . . . . . . . . . . . . . . . . . | . . . N . . . . . . . . . . . S . . . . . . . . . . . . . . . . . . . . . | . . . VG . - . . . T . . . . . . . . . | . . . . . . . . |
| iPS:43 6422 | 21-225_215D6 | VH3}3-33/D4}4-17/RF2/JH6 | . . . . . . . . . . . . . . . . . . . . . . | . . . . . . . . . . . | . . . . . . . . . . . . . . . . . | . . . N . . . . . . . . . . . . . . . . . . . . . . . . . . . . . . . . . | . . C . VG . - . . . T . . . . . . . | . . . . . . . . |
| iPS:43 6430 | 21-225_215A12 | VH3}3-33/D4}4-17/RF2/JH6 | . . . . . . . . . . . . . . . . L . . . . | . . . N . . . . . . . | . . . . . . . . . . . . . . . . . | . . . EH . . . . . . . . . . . . . . . . . . . . . . . . . . . . . . . . | . . R . VG . - . . . . . . . . . . . | . . . . . . . . |
| iPS:43 6452 | 21-225_217G5 | VH3}3-33/D4}4-17/RF2/JH6 | . . . . . . . . . . . . . . . . . . . . . . | R . . . . . . . . . . | . . . . . . . . . . . . . . . . . | . . . N . . . . . . . . . . . . . . . . . . . . . . . . . . . . . . . . . | . . . VG . - . . . L . . . . . . . | . . . . . . . . |
| iPS:43 6464 | 21-225_219H1 | VH3}3-33/D4}4-17/RF2/JH6 | . . . . . . . . . . . . . . . . . . . . . . | . . . H . . . . . . . | . . . . . . . . . . . . . . . . . | . . . H . . . . . . . . . . . . . . . . . . G . . . . . . . . . . . . . | . . R . VG . - . . N . . . . . . . | . . . . . . . . |
| iPS:45 1120 | 21-225_197D3 | VH3}3-33/D4}4-17/RF2/JH6 | . . . . . I . . . . . . . . . . . . . . . . | . . . . . . . . . . . | . . . . . . . . . . . . . . . . . | . . . EH . . . . . . . . . . . . . . . . . . . . . . . . . . . . . . . . | . . Q . VG . - . . . . . . . . . . . | . . . . . . . . |
| | VH3}3-33/D4}4-17/RF2/JH4 | EVQLVES-GGGVVQPGRSLR LSCAASG-FTFS | S------YGMH | WVRQAPGK GLEWVA | VIWYD GSNKYYAD SVKG | RFTISRDNSKNTLYLQM NSLRAEDTAVYYCAR | DYGDY---------YFDY | WGQGTL VTVSS |
| iPS:46 8822 | 21-225_147E10 | VH3}3-33/D4}4-17/RF2/JH4 | . . . . . . . . . . . . . . . K . . . . . | N . . . . . . . L . . | . . . . . . . . . . . . . . . . . | I . . . . . . . . . . . . . . . . . . . . . . . . . . . . . . . . . . . . | . HY . FW . . . . . . SGH . . . | . . . . . . . . |
| iPS:43 3965 | 21-225_46F2 | VH3}3-33/D4}4-17/RF2/JH4 | . . . . . . . . . . . . . . . . . . . . . . | . . . . . . . . . . . | . . . . . . . . . . . . . . . . . | I . . . . . . . . . . . . . . V . . . . . . . . . . . . . . . . . . . . . | . RY . FW . . . . . . SG . . . . | . . . . . . . . |
| iPS:43 4255 | 21-225_62E6 | VH3}3-33/D4}4-17/RF2/JH4 | . . . . . . . . . . . . . . . . . . . . . . | . . . . . . . . . . . | . . . . . . . . . . . . . . . . . | A . . . . . . G . . . . . . . V . . . . . . . . . . . . . . S . H . . . | . Q . IVG . - . . . . . ATW . | . . . . . . . . |

Figure 52 (Continued)

| | | | | | | | |
|---|---|---|---|---|---|---|---|
| iPS:43 4269 | 21-225_57H3 | VH3\|3-33\|D4\|4-17\|RF2\|J H4 | ................ | ................A....... | ................ | ...IVG.........AI.... | ........ |
| iPS:43 4345 | 21-225_64H9 | VH3\|3-33\|D4\|4-17\|RF2\|J H4 | ........T....... | ................I....... | ................ | TY.FW.........SG.LG. | ........ |
| iPS:43 4363 | 21-225_65A6 | VH3\|3-33\|D4\|4-17\|RF2\|J H4 | ........N....... | ................G....... | ................ | Q.IVG.........ATW... | ........ |
| iPS:43 4393 | 21-225_67C3 | VH3\|3-33\|D4\|4-17\|RF2\|J H4 | ................ | ................A....G... | ........V......S.H.. | Q.IVG.........ATW... | ........ |
| iPS:43 4425 | 21-225_70A5 | VH3\|3-33\|D4\|4-17\|RF2\|J H4 | ................ | ................ | ........S....... | Q.IVG.........ATW... | ........ |
| iPS:43 5341 | 21-225_148B2 | VH3\|3-33\|D4\|4-17\|RF2\|J H4 | ................ | ................I..Y.... | ........S....... | HF.FW.........SGH... | ........ |
| iPS:43 5357 | 21-225_148G10 | VH3\|3-33\|D4\|4-17\|RF2\|J H4 | ................ | ................I....... | ................ | RY.FW.........SGH... | ........ |
| iPS:43 5365 | 21-225_149F1 | VH3\|3-33\|D4\|4-17\|RF2\|J H4 | ................ | ................I..Y.... | ........S....... | HF.FW.........SGH... | ........ |
| iPS:43 5413 | 21-225_150B11 | VH3\|3-33\|D4\|4-17\|RF2\|J H4 | ......M....I.... | ................I....... | ................ | RY.FW.........SGH... | ........ |
| iPS:43 5423 | 21-225_151G5 | VH3\|3-33\|D4\|4-17\|RF2\|J H4 | ................ | ........L.......I....... | ................ | HY.FW.........SGH... | ........ |
| iPS:43 5429 | 21-225_151A10 | VH3\|3-33\|D4\|4-17\|RF2\|J H4 | ................ | ................I....... | ................ | RY.FW.........SGH... | ........ |
| iPS:43 5489 | 21-225_155A5 | VH3\|3-33\|D4\|4-17\|RF2\|J H4 | ............D... | ................I..S.... | ........H....... | RY.FW.........SGH... | ........ |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 5683 | VH3\|3-33\|D4\|4-17\|RF2/JH4 | .................... | .................... | .................... | .I...Y..... | .................... | AH.FW......SG...S | .................... |
| iPS:43 5755 | VH3\|3-33\|D4\|4-17\|RF2/JH4 | .................... | .................... | .................... | .I...Y..... | ..........S........ | AH.FW......SG..A. | .............A. |
| iPS:43 5795 | VH3\|3-33\|D4\|4-17\|RF2/JH4 | ..........V......... | .................T.. | ..........T......... | .I...Y..... | .................... | HY.FW......SGH..F | .................... |
| iPS:43 5807 | VH3\|3-33\|D4\|4-17\|RF2/JH4 | .................... | .................... | ............M....... | .I...Y..... | .................... | HY.FW......SGH... | .................... |
| iPS:43 5887 | VH3\|3-33\|D4\|4-17\|RF2/JH4 | .................... | .......T............ | .................... | .I...Y..... | .................... | HY.FW......SGH... | .................... |
| iPS:43 5901 | VH3\|3-33\|D4\|4-17\|RF2/JH4 | .................... | .......N............ | .................... | .I...Y..... | .................... | RF.FW......SG..S. | .................... |
| iPS:43 6594 | VH3\|3-33\|D4\|4-17\|RF2/JH4 | .................... | .......N............ | .................... | .I...T..T.. | .................... | EGH.FW......SGF.C. | .................... |
| iPS:43 2814 | VH3\|3-33\|D4\|4-17\|RF2/JH4 | .................... | .................... | .................... | ....M....... | .................... | .G.FL......EWL... | .................... |
| iPS:39 3036 | VH3\|3-33\|D4\|4-17\|RF2/JH4 | .................I.. | .......t............ | .................... | .................... | .................... | RY.FW......SG.... | .................... |
| VH3\|3-33\|D7\|7-27\|RF1\|JH4 | Germline | QVQLVESGGGVVQPGRSLRLSCAASG-FTFS | -YGMH | WVRQAPGK-GLEWVA-GLNWVA | VIWID-GSNKYYAD-SVKG | RFTISRDNSNTLYLQMNSLRAEDDTAVYYCAR | LIGY-------PDY | WGQGTLVTVSS |
| iPS:46 8824 | VH3\|3-33\|D7\|7-27\|RF1/JH4 | .................... | .................... | .................... | ...V...G... | .................... | EV.M......TS... | .................... |

Figure 52 (Continued)

| | | | | | | | | |
|---|---|---|---|---|---|---|---|---|
| iPS:43 4169 | 21-225_50C4 | VH3\|3-33/D7\|7-27\|RF1/J H4 | D........ | ........ E... ET.. | D........ | ........ G.. | EV.F..... ....LN.. | ....I... |
| iPS:43 5045 | 21-225_90H5 | VH3\|3-33/D7\|7-27\|RF1/J H4 | ........ | ........ S. | D........ ........ E... ...T.... | ........ V.. | EM.W..... ....LD.. | ........ |
| iPS:43 5367 | 21-225_149G1 | VH3\|3-33/D7\|7-27\|RF1/J H4 | ........ | ........ | D........ ........ E... ........ | ........ M.. | EI.F..... ....SE.. | ........ |
| iPS:43 5397 | 21-225_149F12 | VH3\|3-33/D7\|7-27\|RF1/J H4 | ........ | ........ | D........ EN.. .... E... ........ | ........ F.. | EI.F..... ....SE.. | ........ |
| iPS:43 5407 | 21-225_150E7 | VH3\|3-33/D7\|7-27\|RF1/J H4 | ........ | ........ | D........ EN.. .... E... ........ | ........ F.. | EI.F..... ....SE.. | ........ |
| iPS:43 5609 | 21-225_161F7 | VH3\|3-33/D7\|7-27\|RF1/J H4 | D...F.L.. | ........ Q. | ........ F... ........ | ........ | EI.W..... ....LS.. | ........ |
| iPS:43 5613 | 21-225_161D11 | VH3\|3-33/D7\|7-27\|RF1/J H4 | D...F.L.. | ........ Q. | ........ F... ........ | ........ | EI.W..... ....LS.. | ........ |
| iPS:43 5791 | 21-225_180H7 | VH3\|3-33/D7\|7-27\|RF1/J H4 | ........ | ........ | D........ EN..H... .A...... | ........ V.. | EV.W..... ....SD.. | ........ |
| iPS:43 5805 | 21-225_181A8 | VH3\|3-33/D7\|7-27\|RF1/J H4 | ........ V. | ........ | D........ EN..H... .A...... | ........ | EV.W..... ....SD.. | ....I... |
| iPS:43 5879 | 21-225_184H10 | VH3\|3-33/D7\|7-27\|RF1/J H4 | ........ | ........ | D........ ET..H.G. ........ | ........ D.. | EV.W..... ....HD.. | ........ |
| iPS:43 5881 | 21-225_184D11 | VH3\|3-33/D7\|7-27\|RF1/J H4 | ........ | ........ | D........ ET..H.G. ........ | ........ D.. S. | EV.W..... ....HD.. | ........ |
| iPS:43 6350 | 21-225_210E4 | VH3\|3-33/D7\|7-27\|RF1/J H4 | ........ LI | ........ | N........ EN....V. ........ | ........ D.. | E..F..... ....LS.. | ........ |

Figure 52 (Continued)

| | | | | | | | |
|---|---|---|---|---|---|---|---|
| iPS:43 6576 | 21-225_225B6 | VH3\|3-33\|D7\|7-27\|RF1\|J H4 | ..R........ | ............ | D.......... | EN....... | ........... | EV.F......TE... | ........... |
| iPS:43 6578 | 21-225_225D6 | VH3\|3-33\|D7\|7-27\|RF1\|J H4 | ........... | ............ | N.......... | EN....... .I.... | ........Q.. | EV.F......TE... | ........... |
| iPS:43 6582 | 21-225_225F8 | VH3\|3-33\|D7\|7-27\|RF1\|J H4 | ........... | ............ | ........... | EN...V.... | ........... | EV.F......TE... | ........... |
| iPS:43 6608 | 21-225_226A9 | VH3\|3-33\|D7\|7-27\|RF1\|J H4 | ........... | ............ | N.......... | .E...T.... | .........F. | EV.F......TE... | ........... |
| iPS:43 6630 | 21-225_227G3 | VH3\|3-33\|D7\|7-27\|RF1\|J H4 | ........... | ............ | ........... | ....V..... .....Q.... | ........... | EV.F......TE... | ........... |
| iPS:43 6634 | 21-225_227H5 | VH3\|3-33\|D7\|7-27\|RF1\|J H4 | ........... | ........D... | N.......... | ...E...... | .......M... .S.... | EV.F......TE... | ........... |
| iPS:43 6650 | 21-225_227C12 | VH3\|3-33\|D7\|7-27\|RF1\|J H4 | .......K... | ............ | D.......... | ....E..... ....I..Q.. | ........... | EV.F......TE... | ........... |
| iPS:43 6634 | 21-225_203C10 | VH3\|3-33\|D7\|7-27\|RF1\|J H4 | ........... | ............ | D.......... | .G.TH.T... | ........... | EV.W......LD... | ........... |
| iPS:43 7280 | 21-225_18H12 | VH3\|3-33\|D7\|7-27\|RF1\|J H4 | ........... | .......M.... | ........... | .VT....... | ........... | EV.W......YE... | ........... |
| iPS:39 2740 | 21-225_22B7 | VH3\|3-33\|D7\|7-27\|RF1\|J H4 | ........... | ............ | ........... | EN.Q...E.. | ........... | EV.F......RS... | ........... |
| iPS:39 2780 | 21-225_25A9 | VH3\|3-33\|D7\|7-27\|RF1\|J H4 | ........... | ............ | ........... | .VT....TG | ........... | EI.W......LD... | ........... |
| iPS:39 2912 | 21-225_29D9 | VH3\|3-33\|D7\|7-27\|RF1\|J H4 | ......K..S. | ............ | D.......I.. | .E..N..... | ........... | EI.W......LD... | ........Q.. |

Figure 52 (Continued)

| | | | | | | | | |
|---|---|---|---|---|---|---|---|---|
| iPS:39 2948 | 21-225_25G5 | VH3\|3-33\|D7\|7-27\|RF1\|J H4 | ... | D...... | ...:..N... | ..:........ | EI.W......LD... | ...:... |
| iPS:39 2978 | 21-225_28B8 | VH3\|3-33\|D7\|7-27\|RF1\|J H4 | ... | ......T. | ...AN..... | ....F...V.. | EI.W......LD... | ...:... |
| iPS:39 2998 | 21-225_28A9 | VH3\|3-33\|D7\|7-27\|RF1\|J H4 | ... | D...I... | ...:...F.. | ..V....F... | EI.W......LD... | ...:... |
| iPS:39 3038 | 21-225_29D8 | VH3\|3-33\|D7\|7-27\|RF1\|J H4 | ...:..R | D...I... | ...:...T.. | ..:....G... | EI.W......LD... | ...:... |
| iPS:39 3056 | 21-225_30F3 | VH3\|3-33\|D7\|7-27\|RF1\|J H4 | ... | ...:... | ...:..V... | ..:........ | EM.W......YD... | ...:... |
| iPS:39 3074 | 21-225_33B1 | VH3\|3-33\|D7\|7-27\|RF1\|J H4 | ... | ..A...... | ...RN..... | ..:........ | EM.W......YD... | ...:... |
| iPS:39 3822 | 21-225_15B11 | VH3\|3-33\|D7\|7-27\|RF1\|J H4 | ... | ...:... | ...E...T.. | ..P........ | EV.F......TE... | ...:... |
| iPS:39 3856 | 21-225_14C2 | VH3\|3-33\|D7\|7-27\|RF1\|J H4 | ... | N...... | ...:..E... | ..K.....G.. | EV.F......RS... | ...:... |
| iPS:39 3874 | 21-225_4C8 | VH3\|3-33\|D7\|7-27\|RF1\|J H4 | ... | D...... | ...EN.Q... | ..:.....SP. | EM.F......LS... | ...:... |
| iPS:39 3984 | 21-225_4F12 | VH3\|3-33\|D7\|7-27\|RF1\|J H4 | ... | ...:... | ...VT..K.. | ..T.IP.N.GG.ENQ. | EK.G......L.... | ...:... |
| iPS:39 4020 | 21-225_15H10 | VH3\|3-33\|D7\|7-27\|RF1\|J H4 | ... | N...... | ...:..E... | ..:.....V.. | EV.F......LS... | .I.:... |
| iPS:39 4095 | 21-225_16H4 | VH3\|3-33\|D7\|7-27\|RF1\|J H4 | ... | N...... | ...:..V... | ..:..M..... | EM.W......TD.C | ...:... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH1\|1-08/D5\|5-24\|RF3\|JH6 | | QVQLVQS GAEVKKPGASVK VSCKASG.YTFT | S....YDIN | WVRQATGQ GLEWMG | WMNPN SGNTGYAQ KFQG | RVTMTRDTSISTAYMEL SSLRSEDTAVYYCAR | RGIMVYY YYGMDV | WGQGTT VTVSS |
| iPS:46 8818 | 21-225_190C8 | VH1\|1-08/D5\|5-24\|RF3\|JH6 | .......... | ........ ...... | .K.... ....... .... | ........... D....... ......... | G.P..WN- S.A...... | .......A. ........ |
| iPS:43 6023 | 21-225_193A5 | VH1\|1-08/D5\|5-24\|RF3\|JH6 | .......... ......I | .......... | ........ ...... | .K.... R...... .... | ........... D....... ......... | G.P..WN- S.A...... | .......A. ........ |
| iPS:43 6132 | 21-225_196C12 | VH1\|1-08/D5\|5-24\|RF3\|JH6 | .......... ......I | .......... | ........ ...... | .K.... R...... .... | ........... D....... ......... | G.P..WN- S.A...... | .......A. ........ |
| VH3\|3-33/D2\|2-8\|RF3\|JH5 | | QVQLVES GGGVVQPGRSLR LSCAASG.FTFS | S....YGMH | WVRQAPGK GLEWVA | VIWYD- GSNKYYAD SVKG | RFTISRDNSKNTLYLQM NSLRAEDTAVYYCAR | DTVLMYY ------ AINWFDP | WGQGTL VTVSS |
| iPS:46 8828 | 21-225_162A10 | VH3-33\|D2\|2-8\|RF3\|JH 5 | .......... .......C | .......... | ........ ...... | A..... ...... .... | .................. F......... ......... | ...KNI.G- DT...F | ........ ........ |
| VH1\|1-02/D5\|5-18\|RF3\|JH4 | | QVQLVQS GAEVKKPGASVK VSCKASG.YTFT | S....YYMH | WVRQAPGQ GLEWMG | WINPN SGGTNYAQ KFQG | RVTMTRDTSISTAYMEL SRLRSDDTAVYYCAR | GYSVG YYFDY | WGQGTL VTVSS |
| iPS:46 8830 | 21-225_191G11 | VH1\|1-02/D5\|5-18\|RF3\|JH 4 | .......... | .......... | ........ ...... | F..... ...... .... | .L.......... W........ N........ | KN....S... | ........ ........ |
| iPS:43 6896 | 21-225_67F10 | VH1\|1-02/D5\|5-18\|RF3\|JH 4 | .......... | .......... | ........ ...... | G..... ...... .... | .................. ........ ........ | T.F..SGS. ...YYNG... | ........ ........ |
| iPS:39 3218 | 21-225_14G3 | VH1\|1-02/D5\|5-18\|RF3\|JH 4 | .......... | ........Y | ........ ...... | ...... ...... .... | .................. ........ ........ | S.F..SGS. ...YYNE... | ........ ........ |
| iPS:39 3565 | 21-225_34B11 | VH1\|1-02/D5\|5-18\|RF3\|JH 4 | ...K...... ........ | .......... | ........ ...... | ...... ...... .... | .................. ........ ........ | V.F..SGS. ...YYNE... | ........ ........ |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39_8470 | VH1|1-02/D5|5-18|RF3/JH4 | . . . . . . . . . . | . . . . . . . . . . | . . . . . . . . . . | . . . . . . V . | . . . . . . . C . . . . . . . F . . . . . . . . | SFF . . . SGS . . . . . . . . . . . . . . . YYNE . . . . | . . . . . . . . |
| | Germline | H_FR1 | H_CDR1 | H_FR2 | H_CDR2 | H_FR3 | H_CDR3 | H_FR4 |
| | VH3|3-30.3/D1|1-1|RF1/JH6 | QVQLVES-GGGVVQPGRSLR LSCAASG FTFS | S . . . . . YAMH | WVRQAPGK GLEWVA | VISYD GSNKYYAD SVKG | RFTISRDNSKNTLYLQM NSLRAEDTAVYYCAR | GTYGYYY . . . YYYGMDV | WGQGTT VTVSS |
| iPS:46_8836 | VH3|3-30.3/D1|1-1|RF1/JH6 | . . . . . . . . . . | . . . . . . G . . | . . . . . . . . . | . GY . N . . . | . . . . . . . . . . . . . . . . . . . . . . . . . | . H . Y . - . . . . . . . . . . . . . . . V . . | . . . . . . . . |
| iPS:43_5831 | VH3|3-30.3/D1|1-1|RF1/JH6 | . . . . . . . . . A . | . . . . . . G . . | . . . . . . . . . | . GY . N . V . . | . . . . . . . . . . . . . . . . . . . . . . . . . | . H . Y . - . . . . . . . . . . . . . . . V . . | . . . . . . . . |
| iPS:43_5857 | VH3|3-30.3/D1|1-1|RF1/JH6 | . . . . . . . . . . | . . . . . . G . . | . . . . . . . . . | . GY . N . . . | . . . . . . . . . . . . . . . . . . . . . . . . . | . H . Y . - . . . . . . . . . . . . . . . V . . | . . . . . . . . |
| iPS:43_5907 | VH3|3-30.3/D1|1-1|RF1/JH6 | . . . . . . . . . . | . . . . . . G . . | . . . . . . . . . | . GY . N . V . . | . . . . . . . . . . . . . . . . . . . . . . . . . | . H . Y . - . . . . . . . . . . . . . . . V . . | . . . . . . . . |
| iPS:43_5919 | VH3|3-30.3/D1|1-1|RF1/JH6 | . . . . . . . . . . | . . . . . . G . . | . . . . . . . . . | . GY . N . . . | . . . . . . . . . . . . . . . . . . . . . . . . . | . H . Y . - . . . . . . . . . . . . . . . V . . | . . . . . . . . |
| iPS:43_5989 | VH3|3-30.3/D1|1-1|RF1/JH6 | . . . . . . . . . . | . . . . . . G . . | . . . . . I . . . | . GY . N . . . | . . . . . . . . . . . . . . . . . . . . . . . . . | . H . Y . - . . . . . . . . . . . . . . . V . . | . . . . . . . . |
| iPS:43_6222 | VH3|3-30.3/D1|1-1|RF1/JH6 | . . . . . . . . . . | . . . . . . G . . | . . . . . . . . . | . GY . N . I . . | . . . . . . . . . . . . . . . . . . . . . F . . | . H . Y . - . . . . . . . . . . . . . . . V . . | . . . . . . . . |
| | Germline | H_FR1 | H_CDR1 | H_FR2 | H_CDR2 | H_FR3 | H_CDR3 | H_FR4 |
| | VH4|4-30.1/D5|5-24|RF3/JH6 | QVQLQES GPGLVRPSQTLS LTCTVSG GSIS | SS . . . GYYGS | WIRQHPGK GLEWIG | SGSTYYNP SLKS | RVTISVDTSKNQFSLRL RSVTAADTAVYYCAR | HGYYYY . . . . . . . . . . . . YYYGMDV | WGQGTT VTVSS |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH3-21/D6|6-6|RF2/JH4 | EVOLVES GGGLVKPGGSLR LSCAASG-FTFS | S YSMN | WVRQAPGK GLEWVS | SISSS SSIYYAD SVKG | RFTISRDNAKNSLYLQM NSLRAEDTAVYYCAR | STAAP TFDY | WGQGTL VTVSS |
| iPS:46 21-225_8844 | VH3-21/D6|6-6|RF2/JH4 | ......W............ | ........ | ........ | ....G........... | ............................ | ..L.........L | ........ |
| iPS:43 21-225_48E10 | VH3-21/D6|6-6|RF2/JH4 | .................... | ........ | ....I... | ....G.N.......... | .................T........V | ..KF.........S | ........ |
| iPS:43 21-225_157H12 | VH3-21/D6|6-6|RF2/JH4 | .................... | ...G.... | ........ | ....G........... | ............................ | ..SG.........WS | ........ |
| iPS:43 21-225_158G1 | VH3-21/D6|6-6|RF2/JH4 | .................... | ...G.... | ....I... | ....G........... | ...........I................ | ..SG.........WS | ........ |
| iPS:43 21-225_160F2 | | | | | | | | |
| | Germline | H_FR1 | H_CDR1 | H_FR2 | H_CDR2 | H_FR3 | H_CDR3 | H_FR4 |
| | VH3-21/D1|1-1|RF2/JH5 | EVOLVES GGGLVKPGGSLR LSCAASG-FTFS | | | | RFTISRDNAKNSLYLQM NSLRAEDTAVYYCAR | VQLER MWFDP | WGQGTL VTVSS |

| | | H_FR1 | | H_CDR1 | H_FR2 | H_CDR2 | H_FR3 | H_CDR3 | H_FR4 |
|---|---|---|---|---|---|---|---|---|---|
| iPS:46 225_200H9 | VH4|4-30.1/D5|5-24|RF3/JH6 | ................I... | ......D.. | .......F. | ........ | ........ | .......L.. | M.YS....S | ........ |
| iPS:43 225_195E10 | VH4|4-30.1/D5|5-24|RF3/JH6 | ...........MR | ........ | ........ | ........ | ........ | ....A..... | GGYNWN---.....H | ........ |
| iPS:43 225_196C10 | VH4|4-30.1/D5|5-24|RF3/JH6 | .................... | ......D.. | .......F. | ........ | ....F.N. | .......L.. | M.YS.... | ........ |
| iPS:43 225_200B7 | VH4|4-30.1/D5|5-24|RF3/JH6 | ...........MR | ........ | ........ | ........ | .....R. | ........... | AGYNWN---.....N | ........ |

Figure 52 (Continued)

| | | H_FR1 EVQLLES GGGLVQPGGSLR LSCAASG-FTFS | H_CDR1 YAMS | H_FR2 WVRQAPGK GLEWVS | H_CDR2 AISGS GGSTYYAD SVKG | H_FR3 RFTISRDNSKNTLYLQM NSLRAEDTAVYYCAR | H_CDR3 VGIER......YFDY | H_FR4 WGQGT LVTVSS |
|---|---|---|---|---|---|---|---|---|
| iPS:46_8846 | 21-225_53B10 | VH3|3-21/D1|1-1|RF2/JH 5 | .................. | .................. | .....G...V........ | .................. | .NS----............ | .......... |
| iPS:43_4251 | 21-225_62G3 | VH3|3-21/D1|1-1|RF2/JH 5 | .................. | .................. | .................. | .................. | .NS----.....S...... | .......... |
| iPS:43_4407 | 21-225_68G8 | VH3|3-21/D1|1-1|RF2/JH 5 | .................. | .................. | .....G............ | .................. | .NS----.....S...... | .......... |
| iPS:43_5575 | 21-225_159H11 | VH3|3-21/D1|1-1|RF2/JH 5 | .................. | .........T........ | .....G....M....... | .................. | .SW----...A.C...... | .......... |
| Germline | VH3|3-23/D1|1-1|RF2/JH4 | EVQLLES GGGLVQPGGSLR LSCAASG-FTFS | YAMS | WVRQAPGK GLEWVS | AISGS GGSTYYAD SVKG | RFTISRDNSKNTLYLQM NSLRAEDTAVYYCAR | VGIER......YFDY | WGQGT LVTVSS |
| iPS:46_8848 | 21-225_54B1 | VH3|3-23/D1|1-1|RF2/JH 4 | .................. | .................. | ....VL.F.........E | ..........R....... | RGR.YSG...YD....... | .......... |
| iPS:43_3993 | 21-225_47G7 | VH3|3-23/D1|1-1|RF2/JH 4 | .............D.... | .................. | .....N.F.E........ | .S................ | IIR.Q.....WA....... | .......... |
| iPS:43_4007 | 21-225_48D7 | VH3|3-23/D1|1-1|RF2/JH 4 | .................. | N.....S..N........ | .....T.F.......R.. | .................I | CGR.Q.....WL....... | .......... |
| iPS:43_4115 | 21-225_53E4 | VH3|3-23/D1|1-1|RF2/JH 4 | ..............R... | ........V......... | .....G....R....... | ..........N....... | .A.-----........... | .......... |
| iPS:43_5679 | 21-225_169D10 | VH3|3-23/D1|1-1|RF2/JH 4 | .............S.... | ........V......... | .....SRI.......... | ..........L....R.. | .AF----............ | .......... |
| iPS:43_5685 | 21-225_170E1 | VH3|3-23/D1|1-1|RF2/JH 4 | .................. | ........V......... | .....NRI.......... | ..........L....R.. | .AF----............ | .......... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6632 | 21-225_227E4 | VH3|3-23|D1|1-11|RF2/JH4 | .G........T......F..T | T......RV...R....SF | ....T | ....D..W- | |
| | Germline | VH4|4-39|D4|4-11|RF2/JH5 | H_FR1 QVQLQES------GPGLVKPSETLS LTCTVSG-GSIS | H_CDR1 SS--SYWG | H_FR2 WIRQPPGK GLEWIG | H_CDR2 SIY--- SGSTYYNP SLKS | H_FR3 RVTISVDTSKNQFSLKL SSVTAADTAVYYCAR | H_CDR3 LYSYY------NWFDP | H_FR4 WGQG TLVTVSS |
| iPS:46 8856 | 21-225_77C9 | VH4|4-39|D4|4-11|RF2/JH5 | ........T........ | .R...... | ........ | ....A.S. | ........LF... | LD..W.....-GL.Y | .... |
| iPS:43 4489 | 21-225_74E4 | VH4|4-39|D4|4-11|RF2/JH5 | ...........I.... | .N...... | ........ | ....Y.S. | ....S...H...R. | LD..W.....-GL.Y | .... |
| iPS:43 5251 | 21-225_96A3 | VH4|4-39|D4|4-11|RF2/JH5 | ...........I.... | .N...... | ........ | ....Y.S. | ....S...H...R. | LD..W.....-GL.Y | .... |
| iPS:43 7346 | 21-225_75H7 | VH4|4-39|D4|4-11|RF2/JH5 | ........T....... | .R...... | ........ | ....A.S. | ........LF... | LD..W.....-GL.Y | .... |
| iPS:39 3886 | 21-225_2G9 | VH4|4-39|D4|4-11|RF2/JH5 | ................ | PN...... | ........ | ....S...N. | N............. | LS..W.....-D..N | .... |
| iPS:39 3928 | 21-225_4E10 | VH4|4-39|D4|4-11|RF2/JH5 | ...........R.... | .R...... | ........ | ..V...A.S. | N......L..V. | LS..W.....-D..Y | F. |
| | | H_FR1 | H_CDR1 | H_FR2 | H_CDR2 | H_FR3 | H_CDR3 | H_FR4 |
| | Germline | VH1|1-02|D6|6-6|RF1/JH6 | H_FR1 QVQLVQS------GAEVKKPGASVK VSCKASG-YTFT | H_CDR1 G------YYMH | H_FR2 WVRQAPGQ GLEWMG | H_CDR2 WINPN--- SGGTNYAQ KFQG | H_FR3 RVTMTRDTSISTAYMEL SRLRSDDTAVYYCAR | H_CDR3 EIQSSSYY------YYYGMDV | H_FR4 WGQG TTVTVSS |
| iPS:46 8862 | 21-225_178H8 | VH1|1-02|D6|6-6|RF1/JH6 | RT........ | .D...... | ........ | ....R..... | ........... | .EDR.GW....... | .... |
| iPS:45 1112 | 21-225_53D10 | VH1|1-02|D6|6-6|RF1/JH6 | ........I... | ........I | ........ | ........ | I.......... | .NE.LATRP....FYD. | .... |

Figure 52 (Continued)

| VH2 12-05/D6/6-6/RF2/JH4 | | GTLRES GFTLKTCIII TSTSGC PFIS | SVGVG | WIRQPPG KGLEMLA | SVGYG DGRYSP SLKS | RLTLEDDSAGLTV TMRPEDTATYYCAR | SLARF ---YFDY | WGQGTL VTVSS |
|---|---|---|---|---|---|---|---|---|
| iPS:46 8864 | 21-225_60D6 | VH2 12-05/D6/6-6/RF2/JH4 | ........ | ........ | ........ | ........ | AV.V-....... | ........ |
| iPS:43 6850 | 21-225_57D9 | VH2 12-05/D6/6-6/RF2/JH4 | ....M... | ........ | K.E..... | ........ | ...S.... | ........ |
| iPS:43 6914 | 21-225_76B4 | VH2 12-05/D6/6-6/RF2/JH4 | ........ | .G...... | ........ | E....... | AV.V-....... | ........ |
| iPS:43 6918 | 21-225_77A2 | VH2 12-05/D6/6-6/RF2/JH4 | ....S... | ........ | ...D.... | ........ | ...S.... | ........ |
| iPS:43 6934 | 21-225_96B5 | VH2 12-05/D6/6-6/RF2/JH4 | ........ | ........ | .V...... | ........ | L..V-....... | ........ |
| iPS:43 7334 | 21-225_75F11 | VH2 12-05/D6/6-6/RF2/JH4 | ........ | .G...... | F....... | ........ | ...A.... | ........ |
| iPS:43 7377 | 21-225_74G9 | VH2 12-05/D6/6-6/RF2/JH4 | ........ | ........ | ...D.... | P....... | L..V-....... | ........ |
| iPS:39 2583 | 21-225_10B10 | VH2 12-05/D6/6-6/RF2/JH4 | ........ | .G...... | ...D.... | ........ | ...AC... | ........ |
| iPS:39 3184 | 21-225_15H11 | VH2 12-05/D6/6-6/RF2/JH4 | ........ | .G...... | ...D.... | P....... | L..V-....... | ........ |
| iPS:39 3212 | 21-225_30H6 | VH2 12-05/D6/6-6/RF2/JH4 | ....L... | .G...... | F.S..... | P....... | ...A.... | ........ |
| iPS:39 3222 | 21-225_17F5 | VH2 12-05/D6/6-6/RF2/JH4 | ....M... | .G...... | ..R..... | S....R.. | L..V-....... | ........ |

(Additional rows for IA.V-, IV.V-, IL.V-, I..V- entries as shown.)

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 3224 | 21-225_31C2 | VH2|2-05/D6|6-19|RF2|JH4 | .G........ | ........... | ........... | ......E..... | .....L..S..... | L...V- ...S... | ....A. |
| | Germline | | H_FR1 QVQLVQS GAEVKKPGASVK VSCKASG-YTFT | H_CDR1 G----YMH | H_FR2 WVRQAPGQ GLEWMG | H_CDR2 WINPN SGGTNYAQ KFQG | H_FR3 RVTMTRDTSISTAYMEL SRLRSDDTAVYYCAR | H_CDR3 GIAVAGTT-------YYYGMDV | H_FR4 WGQGTT VTVSS |
| iPS:46 8866 | 21-225_190C1 | VH1|1-02/D6|6-19|RF2|JH6 | ........... | ........... | ........... | .........Y........... | ........... | DR......N.........F. | ........... |
| iPS:43 6972 | 21-225_190C7 | VH1|1-02/D6|6-19|RF2|JH6 | ........... | ........... | ........... | ........... | ........... | DR......N.........F. | ........... |
| iPS:43 7020 | 21-225_193F11 | VH1|1-02/D6|6-19|RF2|JH6 | ........... | ........... | ........... | .........Y........... | ........... | DR......N.........F. | ........... |
| iPS:43 7036 | 21-225_195H9 | VH1|1-02/D6|6-19|RF2|JH6 | ........... | ........... | ........... | .........Y.....D..... | .....T..... | DR......N.........F. | ........... |
| iPS:43 7042 | 21-225_197E8 | VH1|1-02/D6|6-19|RF2|JH6 | R....L.R.. | .........I | ........... | R........... | .....F..... | E......N.........F...G. | ....A. |
| | Germline | | H_FR1 QVQLVQS GAEVKKPGSSVK VSCKASG-GTFSS | H_CDR1 SS--SIWG | H_FR2 WVRQAPGK GLEWMG | H_CDR2 SIII SGGTTNP SLKS | H_FR3 RVTISVDTSKNQFSLKL SSVTAADTAVYYCAR | H_CDR3 VGLER-------YFDY | H_FR4 WGQGTL VTVSS |
| iPS:46 8868 | 21-225_74A1 | VH4|4-39/D1|1-1|RF2|JH4 | G.......... | ........... | ........... | ......N......H....... | .........T...........F. | HD.LW.........SL.F | .....I. |
| | Germline | | H_FR1 QVQLVQS GAEVKKPGASVK VSCKASG-YTFT | H_CDR1 G----YMH | H_FR2 WVRQAPGQ GLEWMG | H_CDR2 WINPN SGGTNYAQ KFQG | H_FR3 RVTMTRDTSISTAYMEL SRLRSDDTAVYYCAR | H_CDR3 YYYDSSGY-------YYRWFDP | H_FR4 WGQGTL VTVSS |
| iPS:47 2742 | 21-225_30D9_L C2 | VH1|1-02/D3|3-22|RF2|JH5 | ..K..E..... | .......L... | ........... | ........... | ........... | V...YG...S......E..N | ........... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:47 2741 | 21-225_30D9_L C1 | VH1|1-02|D3|3-22|RF2|J H5 | ..K........... .E........... ............ | ......L... | ........... ........... ........ | ........... ........... ... | ........... ........... ........... ........... | V.YG...S. ...E..N | ........... ........... |
| iPS:43 7040 | 21-225_196E7 | VH1|1-02|D3|3-22|RF2|J H5 | ........... ..S........ .V.......... | ........N.. | ........... ........... ........ | .........H ........... ... | ........... ........... ........... ........... | D...T.- ...EG... | ........... ........... |
| iPS:43 7050 | 21-225_197C11 | VH1|1-02|D3|3-22|RF2|J H5 | ........... ..S........ .V.......... | ........N.. | ........... ........... ........ | .........H ........... ... | ........... ........... ........... ........... | D....- ...EG... | ........... ........... |
| iPS:39 3214 | 21-225_33A1 | VH1|1-02|D3|3-22|RF2|J H5 | ........... ........... ........... | ........... | ........... ........... ........ | .......N.H. ........... ... | ........R.S. ........F.. ........... ........... | G.YA..S. .....DL.. | ........... ........... |
| Germline | VH1|1-02|D3|3-22|RF2|JH4 | QVQLVQS GAEVKKPGASVK VSCKASG-YTFT | YYMH | WVRQAPGQ GLEWMG SGGINYAQ KFQG | MINPN | RVTMTRDTS ISTAYMEL SRLRSDDTAVYYCAR | YYYDSSG ----YYYYFDY | WGQGT LVTVSS |
| iPS:47 2743 | 21-225_68G6 | VH1|1-02|D3|3-22|RF2|J H4 | ........... ........F..G ........... | ........... | ........... ........... ........ | .....S.YR.. ........... ... | ........... ........... ...I....... ........K.. | AF.YG..T. ......NE.. | ........... ........... |
| iPS:43 6902 | 21-225_69B11 | VH1|1-02|D3|3-22|RF2|J H4 | ........... ........... ........R... | ........... | ........... ........... ........ | ........... ........G.. .D. | ........... ........... ........... ......A.F.. | T..YG..S. ......NG.. | ........... ........... |
| iPS:43 6904 | 21-225_71D4 | VH1|1-02|D3|3-22|RF2|J H4 | ........... ........... ........... | ......C.... | ........... ........... ........ | ........... ........... ..V | ........... ........... ........... ....V..V..D. | A..YG..T. .....HNE.. | ........... ........... |
| iPS:43 6906 | 21-225_72B4 | VH1|1-02|D3|3-22|RF2|J H4 | ........... ........... ........... | ........... | ........... ........... ........ | ........... ........G.. ... | ........... ........... ........... ........... | T..YG..S. ......NG.. | ........... ........... |
| iPS:43 7034 | 21-225_195E9 | VH1|1-02|D3|3-22|RF2|J H4 | ........... ........... .V......... | ........... | ........... ........... ........ | .........A. ........... ... | ........... ........N.. ........... ........... | A..YG..T. ......NE.. | .......S.. ........... |
| iPS:39 2598 | 21-225_18E10 | VH1|1-02|D3|3-22|RF2|J H4 | ........... ........... ........... | ........... | ........... ........... ........ | ........... ........... ... | ........... ........... ........... ......S.N.. | S..YG..S. ......NE.. | ........... ........... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS-39 3182 | VH|1-02|D3|3-22|RF2|J H4 | | | | ..S | | S...YG..S......NE.... | |
| iPS-39 3200 | VH|1-02|D3|3-22|RF2|J H4 | ..K........ | | | ..K | ........V.....P | V...HG..S......NE.... | |
| iPS-39 3206 | VH|1-02|D3|3-22|RF2|J H4 | | | | ..A | ...........F | SF.YG..T......NE.... | |
| iPS-39 3208 | VH|1-02|D3|3-22|RF2|J H4 | | H... | | | | S...YG..T......NE.... | |
| iPS-39 3210 | VH|1-02|D3|3-22|RF2|J H4 | | | | | | AN.YG..S......ND.... | |
| iPS-39 3226 | VH|1-02|D3|3-22|RF2|J H4 | ..K........ | I... | | ..D | | V...YG..S......NE.... | |
| iPS-39 3230 | VH|1-02|D3|3-22|RF2|J H4 | | I... | | | ........S | S...YG..T......NE.... | |
| iPS-39 8490 | VH|1-02|D3|3-22|RF2|J H4 | | D.......... | | ..N | | S...YG..T......NE.... | |
| iPS-42 3018 | VH|1-02|D3|3-22|RF2|J H4 | ..K........ | | | ..V | | V...YG..S......NE.... | |
| iPS-42 3019 | VH|1-02|D3|3-22|RF2|J H4 | ..K........ | | | ..V | | V...YG..S......NE.... | |
| VH3|3-33|D7|7-27|RF2|JH4 | Germline | EVQLVES-GGGVVQPGRSLR LSCAASG-FTFS | S------YGMH | WVRQAPGK GLEWVA | VIWYD--GSNKYYAD SVKG | RFTISRDNSKNTLYLQM NSLRAEDTAVYYCAR | --------EGY ----------FDY | WGQGTL VTVSS |

Figure 52 (Continued)

| | | | | | | | |
|---|---|---|---|---|---|---|---|
| iPS:39 2920 | 21-225_29G4 | VH3\|3-33\|D7\|7-27\|RF2\|J H4 | D......I. | .T.. | .......... | .......... | E..M.....TG. |
| iPS:43 3899 | 21-225_43C3 | VH3\|3-33\|D7\|7-27\|RF2\|J H4 | .......... | .......... | EN........ M. | .......... | E..F.....SN. |
| iPS:43 3921 | 21-225_44C3 | VH3\|3-33\|D7\|7-27\|RF2\|J H4 | .......I. | .......... | .......... | .S........V. | E..F.....ST. |
| iPS:43 3933 | 21-225_44C8 | VH3\|3-33\|D7\|7-27\|RF2\|J H4 | N......... | ....N..... | FE........ | .........V. | E..F.....LS. |
| iPS:43 3969 | 21-225_46F3 | VH3\|3-33\|D7\|7-27\|RF2\|J H4 | D......I. | .......... | ..E....... | .........V. | E..F.....SN. |
| iPS:43 3975 | 21-225_46C6 | VH3\|3-33\|D7\|7-27\|RF2\|J H4 | D......I. | .......... | FE........ | .........V. | E..F.....SN. |
| iPS:43 3977 | 21-225_46D8 | VH3\|3-33\|D7\|7-27\|RF2\|J H4 | D......... | .......... | EN........ | .........V. | E..F.....SN. |
| iPS:43 3983 | 21-225_47A1 | VH3\|3-33\|D7\|7-27\|RF2\|J H4 | .......... | .......... | ..FE...... | .........V. | E..F.....SN. |
| iPS:43 3997 | 21-225_48C1 | VH3\|3-33\|D7\|7-27\|RF2\|J H4 | .......... | .......... | DY....K... | .A.......V..T | E..M.....L.. |
| iPS:43 4009 | 21-225_48A9 | VH3\|3-33\|D7\|7-27\|RF2\|J H4 | .......... | .......... | ..V....... EI....K... | ..........M. | E..W.....EA. |
| iPS:43 4013 | 21-225_48D12 | VH3\|3-33\|D7\|7-27\|RF2\|J H4 | .......... | .R........ | ENK..E.... | .........M.F | E..AW....YE. |
| iPS:43 4013 | 21-225_48D12 extra | VH3\|3-33\|D7\|7-27\|RF2\|J H4 | D......... | .......... | ...V..V... | .......... | E..M.....RS. |
| iPS:43 4019 | 21-225_49A1 | VH3\|3-33\|D7\|7-27\|RF2\|J H4 | D......... | .......... | ED....V... | .......... | E..F.....LS. |

Figure 52 (Continued)

| | | | | | | | | |
|---|---|---|---|---|---|---|---|---|
| iPS:43 4029 | 21-225_49C6 | VH3\|3-33/D7\|7-27\|RF2/J H4 | . . . . | N . . . . . | . . . . | . . . . | . . . V . . . K . V . . . . F | . . . . S . . . . . . . . | D . . M . . . . . I E . . . |
| iPS:43 4057 | 21-225_51E4 | VH3\|3-33/D7\|7-27\|RF2/J H4 | . . . . | . . . . . | . . . . | . . . . E . . . . . . . . F | . . . . . . . . . . . . | E . . F . . . . . L S . . . |
| iPS:43 4071 | 21-225_51F9 | VH3\|3-33/D7\|7-27\|RF2/J H4 | . . . . | D . . . . . | . . . . | . . . . . . . . N . . . F | . . . . . . . . . . . . | E . . F . . . . . L S . . . |
| iPS:43 4075 | 21-225_51B11 | VH3\|3-33/D7\|7-27\|RF2/J H4 | . . . . | D . . . . . | . . . . | . . . . . . . . N . . . F G | . . . S . . . . . . . . | E . . F . . . . . L S . . . |
| iPS:43 4077 | 21-225_51F11 | VH3\|3-33/D7\|7-27\|RF2/J H4 | . . . . | N . . . F . | . . . . | . . . . E . . . . . . . . | . . . S . . . . . . . . | E . . F . . . . . L S . F . |
| iPS:43 4081 | 21-225_52B2 | VH3\|3-33/D7\|7-27\|RF2/J H4 | . . . . | N . . . . . | . . . . | . . . . T . F . . . Q R . . | . . . I S . . . . . . . | D . . M . . . . . I E . F . |
| iPS:43 4091 | 21-225_52B9 | VH3\|3-33/D7\|7-27\|RF2/J H4 | . . . . | D . . . . . | . . . . | . . . . . . . . N . . . F | . . . S . . . . . . . . | E . . F . . . . . L S . F . |
| iPS:43 4105 | 21-225_53D2 | VH3\|3-33/D7\|7-27\|RF2/J H4 | . . . T | D . . . I . | . . . T | . . . . V . D . . . . . . | . . . A . . . . . . T . | G . . F . . . . . T G . . . |
| iPS:43 4119 | 21-225_53E6 | VH3\|3-33/D7\|7-27\|RF2/J H4 | . . . . | . . . . . . | . . . . | . . . . E . . . G . . . . | . . . . . . . . . . V . | E . . M . . . . . T S . . A |
| iPS:43 4129 | 21-225_53B12 | VH3\|3-33/D7\|7-27\|RF2/J H4 | . . . . | N . . . F . | . . . . | . . . . V . . . N . R . . | . . . H . . . . . . . . | E . . F . . . . . L S . F . |
| iPS:43 4131 | 21-225_54D3 | VH3\|3-33/D7\|7-27\|RF2/J H4 | . . . . | . . . . . . | . . . . | . . . . T . F . . . N . N | . . . . . . . . . . . . | E . . F . . . . . L S . . . |
| iPS:43 4141 | 21-225_54C6 | VH3\|3-33/D7\|7-27\|RF2/J H4 | . . . T | D . . . I . | . . . D | . . . . . . . . E N . . . | . . . A . . . . . . V . | E . . M . . . . . T S . . . |

Figure 52 (Continued)

| | | | | | | | | | |
|---|---|---|---|---|---|---|---|---|---|
| iPS:43 4143 | 21-225_54G7 | VH3\|3-33/D7\|7-27\|RF2/J H4 | . . . | . . . | N . . . | . . . | E . . G | . . . | E . F . . . . LS . |
| iPS:43 4155 | 21-225_55B3 | VH3\|3-33/D7\|7-27\|RF2/J H4 | . . . | . . . | . . . | . . . | . F . . N . . . E | . . V | E . F . . . . LS . |
| iPS:43 4199 | 21-225_59F11 | VH3\|3-33/D7\|7-27\|RF2/J H4 | . . . | . . . | N . . . | . . . | E . H . . . | . . T . S | E . M . . . . NG . |
| iPS:43 4287 | 21-225_60A3 | VH3\|3-33/D7\|7-27\|RF2/J H4 | . . . | . . . | . . . | . . . | . E . . | S . . | E . M . . . . TG . |
| iPS:43 4253 | 21-225_62E4 | VH3\|3-33/D7\|7-27\|RF2/J H4 | . . . | . . . | D . . . | . . . | . R . . | . . V . . H | E . F . . . . SS . |
| iPS:43 4271 | 21-225_57A4 | VH3\|3-33/D7\|7-27\|RF2/J H4 | . . V | . . . | D . . . | . . . | . A . . V | . . . | E . M . . . . RS . |
| iPS:43 4293 | 21-225_58F5 | VH3\|3-33/D7\|7-27\|RF2/J H4 | . . V | . . . | D . . . | . . . | . A . . HV | . . . | E . M . . . . RS . |
| iPS:43 4337 | 21-225_64E1 | VH3\|3-33/D7\|7-27\|RF2/J H4 | . . V | . . . | D . . . | . . . | . ET . F . . . G | . . . | E . F . . . . SS . |
| iPS:43 4357 | 21-225_65C1 | VH3\|3-33/D7\|7-27\|RF2/J H4 | . . V | . . . | D . . . | . . . | . FE . H . . T | . . . | E . M . . . . SS . |
| iPS:43 4375 | 21-225_66C7 | VH3\|3-33/D7\|7-27\|RF2/J H4 | . . V | . . . | D . . . | . . . | . FE . . H . . . T | . . . | E . F . . . . SS . |
| iPS:43 4411 | 21-225_68F11 | VH3\|3-33/D7\|7-27\|RF2/J H4 | . . . | . . . | . . . | . . . | . V . . | . . V | E . M . . . . TS . C |
| iPS:43 4441 | 21-225_71A2 | VH3\|3-33/D7\|7-27\|RF2/J H4 | . T . | . . . | D . . . | . . . | . E . . | . . . | E . W . . . . QD . |

Figure 52 (Continued)

| | | | | | | | | |
|---|---|---|---|---|---|---|---|---|
| iPS:43 4447 | 21-225_71B6 | VH3\|3-33\|D7\|7-27\|RF2\|J H4 | . . . . . | N . . . . | . . . . . | RT . . . . | . . H . . | E . M . . . . LS . . |
| iPS:43 4453 | 21-225_71B11 | VH3\|3-33\|D7\|7-27\|RF2\|J H4 | . . . . . | D . . . . | . . . . . | RN . . . G | . . . . . | E . M . . . . LS . . |
| iPS:43 4457 | 21-225_72G12 | VH3\|3-33\|D7\|7-27\|RF2\|J H4 | . . . . . | . . . . . | DT . . . . E . . . F . | . . . . . | . . . . . | E . F . . . . SS . . |
| iPS:43 5311 | 21-225_146H9 | VH3\|3-33\|D7\|7-27\|RF2\|J H4 | . . . S . | . . . . . | . . . . . | E . . F . . . H . G | . . . . . | E . F . . . . LS . . |
| iPS:43 5511 | 21-225_157C3 | VH3\|3-33\|D7\|7-27\|RF2\|J H4 | . . . . . | T . . . . | . . . . . | VN . . . . | . . . . . | E . F . . . . LS . . |
| iPS:43 5533 | 21-225_157H8 | VH3\|3-33\|D7\|7-27\|RF2\|J H4 | . . V . . | . . . . . | I . . . . F . . . . | VT . . . . | . . D . . V | E . W . . . . AE . . |
| iPS:43 5551 | 21-225_158H6 | VH3\|3-33\|D7\|7-27\|RF2\|J H4 | . . . . . | . . . . . | . . . . . | V . . . . VN . . . . | . . P . . | E . F . . . . LS . . |
| iPS:43 5569 | 21-225_159C5 | VH3\|3-33\|D7\|7-27\|RF2\|J H4 | . . L . . | . . . . . | . . . . . | VN . . . . | . . . . . | E . F . . . . LS . . I |
| iPS:43 6268 | 21-225_203B9 | VH3\|3-33\|D7\|7-27\|RF2\|J H4 | . . . L . | N . . . . | . . . . . | RN . . . G | . . . . . | E . F . . . . L . . |
| iPS:43 6328 | 21-225_207F12 | VH3\|3-33\|D7\|7-27\|RF2\|J H4 | . . K . . | . . . . . | . . . . . | E . V . . . . R . | . . S . V | E . F . . . . QS . . P |
| iPS:43 6556 | 21-225_224D10 | VH3\|3-33\|D7\|7-27\|RF2\|J H4 | . . . . . | . . . . . | . . . . . | . . . V . N . . . . | . . . . V | E . AW . . . . YE . . |
| iPS:39 2618 | 21-225_16F10 | VH3\|3-33\|D7\|7-27\|RF2\|J H4 | . . . . . | D . . . . | . . . . . | . . . V . N . . . . | . . . . . | E . AW . . . . YE . . |

Figure 52 (Continued)

| | | | | | | | | | |
|---|---|---|---|---|---|---|---|---|---|
| iPS:39 2626 | 21-225_18A5 | VH3\|3-33/D7\|7-27\|RF2/J H4 | . . . | D . . . | . . . | . F . . | . . . | D . W . . . . TEE . | . . . |
| iPS:39 2630 | 21-225_20E5 | VH3\|3-33/D7\|7-27\|RF2/J H4 | . . . | . . . | . . . | EN.Q. E . | . . . | E . F . . . . RS . | . . . |
| iPS:39 2640 | 21-225_18A1 | VH3\|3-33/D7\|7-27\|RF2/J H4 | V . . | . . . | . . . | EN . . . E . V . | . S . . . V | E . F . . . . QS . | . P . |
| iPS:39 2644 | 21-225_19E1 | VH3\|3-33/D7\|7-27\|RF2/J H4 | . . . | N . . . | . . . | EN.Q. E . | . . . | E . F . . . . RS . | . . . |
| iPS:39 2654 | 21-225_17A10 | VH3\|3-33/D7\|7-27\|RF2/J H4 | . . . | N . . . | . A . | EN.Q. E . | . V . | E . F . . . . RS . | . . . |
| iPS:39 2658 | 21-225_18E8 | VH3\|3-33/D7\|7-27\|RF2/J H4 | . . . | . . . | . . . | EN.Q. E . V . | . F . . . . | E . F . . . . QS . | . P . |
| iPS:39 2666 | 21-225_16F11 | VH3\|3-33/D7\|7-27\|RF2/J H4 | . M . | D . . . | . M . | . . . E . | . S . . . V | E . F . . . . RS . | . . . |
| iPS:39 2674 | 21-225_18C2 | VH3\|3-33/D7\|7-27\|RF2/J H4 | . V . | N . . . | . . . | EN.Q. E . | . . . | E . F . . . . QS . | . . . |
| iPS:39 2680 | 21-225_20A7 | VH3\|3-33/D7\|7-27\|RF2/J H4 | . . . | D . . . | . . . | VT . . . E . | . I . . . | E . W . . . . YE . | . . . |
| iPS:39 2686 | 21-225_17C7 | VH3\|3-33/D7\|7-27\|RF2/J H4 | . K . | D . . . | . . . | EN.Q. F . | . G . . . | D . W . . . . TEE . | . . . |
| iPS:39 2690 | 21-225_18F2 | VH3\|3-33/D7\|7-27\|RF2/J H4 | . . . | D . . . | . . . | . . . F . V . | . V . . . V | D . W . . . . TEE . | . . . |
| iPS:39 2716 | 21-225_17B5 | VH3\|3-33/D7\|7-27\|RF2/J H4 | . . . | D . . . | . . . | E . . H.I . | . V . | E . F . . . . R . . | . . . |

Figure 52 (Continued)

| | | | | | | | |
|---|---|---|---|---|---|---|---|
| iPS:39 2732 | 21-225_17E5 | VH3\|3-33\|D7\|7-27\|RF2\|J H4 | ... | D... | ... | L...VT...G. | ...Q...L | L..W......YE... |
| iPS:39 2744 | 21-225_20D5 | VH3\|3-33\|D7\|7-27\|RF2\|J H4 | ... | ... | ... | ..EN.Q... | ...D... | E..F......RS... |
| iPS:39 2758 | 21-225_21G11 | VH3\|3-33\|D7\|7-27\|RF2\|J H4 | ... | D... | ...M. | ..VT.E... | ... | E..W......YE... |
| iPS:39 2772 | 21-225_20E12 | VH3\|3-33\|D7\|7-27\|RF2\|J H4 | ... | ... | ... | M...E..H... | ...R... | E..F......R... |
| iPS:39 2790 | 21-225_20D10 | VH3\|3-33\|D7\|7-27\|RF2\|J H4 | ... | D... | ... | ..F...V. | ...D... | D..W......TEE. |
| iPS:39 2796 | 21-225_22A4 | VH3\|3-33\|D7\|7-27\|RF2\|J H4 | ... | D... | ..I | ..F... | I... | D..W......TEE. |
| iPS:39 2810 | 21-225_20H12 | VH3\|3-33\|D7\|7-27\|RF2\|J H4 | ... | N... | ... | ..EN....V. | ... | E..F......RS... |
| iPS:39 2832 | 21-225_21H8 | VH3\|3-33\|D7\|7-27\|RF2\|J H4 | ... | D...S | ... | ..F... | ... | D..W......TEE. |
| iPS:39 2854 | 21-225_21E5 | VH3\|3-33\|D7\|7-27\|RF2\|J H4 | ... | D... | ... | ..E... | M...T | E..F......RS... |
| iPS:39 2860 | 21-225_22H8 | VH3\|3-33\|D7\|7-27\|RF2\|J H4 | ... | ... | ... | ..N... | ... | E.AW......YE... |
| iPS:39 2866 | 21-225_23H11 | VH3\|3-33\|D7\|7-27\|RF2\|J H4 | ... | E... | ... | ..EN....V. | ... | E..F......RS... |
| iPS:39 2876 | 21-225_21F7 | VH3\|3-33\|D7\|7-27\|RF2\|J H4 | ... | D... | ... | ..F..N...V. | ... | D..W......TEE. |

Figure 52 (Continued)

| | | | | | | | |
|---|---|---|---|---|---|---|---|
| iPS:39 2880 | 21-225_22F9 | VH3|3-33/D7|7-27|RF2/J H4 | .M.......... | ..... | ...... | ....E. ....EN.D.V. | ...S......V | E..F.....QS. | .....P...... |
| iPS:39 2894 | 21-225_21G2 | VH3|3-33/D7|7-27|RF2/J H4 | ............ | ..... | ....M. | .....VT..... | ............ | E..W.....YE. | ............ |
| iPS:39 2900 | 21-225_22F2 | VH3|3-33/D7|7-27|RF2/J H4 | ............ | ...D. | ...... | ....E...V.. ..R. | ...S......V | E..F.....QS. | .....P...... |
| iPS:39 2908 | 21-225_23F12 | VH3|3-33/D7|7-27|RF2/J H4 | .........V.. | ...D. | ...... | ....ET...... | ........I... | E.AW.....YE. | ............ |
| iPS:39 2918 | 21-225_28F5 | VH3|3-33/D7|7-27|RF2/J H4 | ............ | ..... | ...... | ....EN...... | ...........M ....G..L. | E..W.....YD. | ...S........ |
| iPS:39 2934 | 21-225_27D5 | VH3|3-33/D7|7-27|RF2/J H4 | ............ | ..... | ...... | ....E....G.. | ............ | E..F.....LS. | ............ |
| iPS:39 2958 | 21-225_28C7 | VH3|3-33/D7|7-27|RF2/J H4 | .....V..T .LR | ..N.. | ...... | ....E.....TE | ............ | E..F.....YD. | ............ |
| iPS:39 2968 | 21-225_25B6 | VH3|3-33/D7|7-27|RF2/J H4 | ............ | ..... | ...... | ....E....V.. | ............ | E..F.....LS. | ............ |
| iPS:39 2972 | 21-225_26A2 | VH3|3-33/D7|7-27|RF2/J H4 | ............ | ..... | ...T.. | ....EN..N... | ............ | E..W.....YD. | ............ |
| iPS:39 2980 | 21-225_29H6 | VH3|3-33/D7|7-27|RF2/J H4 | ............ | ...D. | ...... | ....EN...... | ........L..T | E..F.....LS. | ............ |
| iPS:39 2988 | 21-225_25E6 | VH3|3-33/D7|7-27|RF2/J H4 | ............ | ...D. | ...... | ....EN...... | ............ | E..M.....TG.S | ............ |
| iPS:39 2990 | 21-225_25H10 | VH3|3-33/D7|7-27|RF2/J H4 | ............ | ...D. | ...... | ....E....... ..M. | ............ | E..M.....TG.S | ............ |

Figure 52 (Continued)

| | | | | | | | | |
|---|---|---|---|---|---|---|---|---|
| iPS:39 3000 | 21-225_29D7 | VH3\|3-33/D7\|7-27\|RF2/J H4 | . . . | . . . | . . . | . . . G. | . . . G . . . L . . . | E . . F . . . . . LS . . | . . . |
| iPS:39 3018 | 21-225_29B8 | VH3\|3-33/D7\|7-27\|RF2/J H4 | . . . | D . . . | . . . | EN . . . | . . . | E . M . . . . . TG . S | . . . |
| iPS:39 3030 | 21-225_25H11 | VH3\|3-33/D7\|7-27\|RF2/J H4 | . . . | D . . . | . . . | EN . E . . . | . . . | E . M . . . . . TG . S | . . . |
| iPS:39 3034 | 21-225_27F2 | VH3\|3-33/D7\|7-27\|RF2/J H4 | . E . . . . I . | D . . . | . . . | EN . . . V . . . R . | . . . | E . M . . . . . TG . S | . . . |
| iPS:39 3048 | 21-225_27C3 | VH3\|3-33/D7\|7-27\|RF2/J H4 | . . . | D . . . | . . . | EN . S . . . | . . . | E . M . . . . . TG . S | . . . |
| iPS:39 3054 | 21-225_29G8 | VH3\|3-33/D7\|7-27\|RF2/J H4 | . . . | D . . . | . . . | ET . . . | . . . | E . M . . . . . TS . . | . . . |
| iPS:39 3812 | 21-225_6A11 | VH3\|3-33/D7\|7-27\|RF2/J H4 | . . . | D . . . | . . F . . . | . . F . . . | . . . D . . . | D . W . . . . . TEE . | . . . |
| iPS:39 3818 | 21-225_6G12 | VH3\|3-33/D7\|7-27\|RF2/J H4 | . . . | D . . . | . . . | R . . N . . . | . . . | E . F . . . . . RS . . | . . . |
| iPS:39 3820 | 21-225_8H7 | VH3\|3-33/D7\|7-27\|RF2/J H4 | . . . P . . . | D . . . | . . . | EN . Q . . . | . . . T . . . | E . F . . . . . RS . . | . . . |
| iPS:39 3826 | 21-225_10G5 | VH3\|3-33/D7\|7-27\|RF2/J H4 | . . . | N . . . | . . . | EN . Q . . . | . . . | E . F . . . . . RS . . | . . . |
| iPS:39 3828 | 21-225_10H12 | VH3\|3-33/D7\|7-27\|RF2/J H4 | . . . | D . . . | . . . | DN . Q . . . | . . . | E . F . . . . . RS . . | . . . |
| iPS:39 3830 | 21-225_12A1 | VH3\|3-33/D7\|7-27\|RF2/J H4 | . . . | . . . | . . . | EN . Q . . . | . . . | E . F . . . . . RS . . | . . . |

Figure 52 (Continued)

| | | L......D...I. | .......... | .F........ | .......... | D..W....TEE. | .......... | .......... |
|---|---|---|---|---|---|---|---|---|
| iPS:39 3838 | 21-225_6G2 | VH3\|3-33/D7\|7-27\|RF2/J H4 | | | S.......... | | | |
| iPS:39 3854 | 21-225_7H11 | VH3\|3-33/D7\|7-27\|RF2/J H4 | ....K...S | D......... | EN........ | .......... | E..F....RS. | .......... |
| iPS:39 3866 | 21-225_14E3 | VH3\|3-33/D7\|7-27\|RF2/J H4 | .......... | D......F. | E........ | .....F.... | E..F....RS. | .......... |
| iPS:39 3876 | 21-225_9A1 | VH3\|3-33/D7\|7-27\|RF2/J H4 | ....V..... | D......... | .F........ | .......... | D..W....TEE. | ......P... |
| iPS:39 3882 | 21-225_15E3 | VH3\|3-33/D7\|7-27\|RF2/J H4 | ....T..... | .......... | EN..E..H.. | .......... | E..F....LS. | .......... |
| iPS:39 3884 | 21-225_16F4 | VH3\|3-33/D7\|7-27\|RF2/J H4 | .......... | .......... | ...E..G..R | ...H....V. | E..F....LS. | .......... |
| iPS:39 3912 | 21-225_16F6 | VH3\|3-33/D7\|7-27\|RF2/J H4 | .......... | N........ | ...Q..G.. | ...H..S..V. | E..F....LS. | ......P... |
| iPS:39 3922 | 21-225_2B2 | VH3\|3-33/D7\|7-27\|RF2/J H4 | .......... | N........ | EN..E..V.. | .......... | E..F....QS. | .......... |
| iPS:39 3934 | 21-225_13E6 | VH3\|3-33/D7\|7-27\|RF2/J H4 | .......... | .......... | .......I. | ...S...... | E..F....RS. | .......... |
| iPS:39 3948 | 21-225_16A5 | VH3\|3-33/D7\|7-27\|RF2/J H4 | .......... | D......... | .F..M..V.. | .......... | D..W....TEE. | .......... |
| iPS:39 3960 | 21-225_7G2 | VH3\|3-33/D7\|7-27\|RF2/J H4 | .......... | D......... | .VT.E..... | .......L. | E..W....YE. | .......... |
| iPS:39 3974 | 21-225_7C4 | VH3\|3-33/D7\|7-27\|RF2/J H4 | ....K..... | N........ | EN..Q..... | .......... | E..F....RS. | .......... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3976 | 21-225_7E9 | VH3\|3-33/D7\|7-27\|RF2/JH4 | .......... ...... | ......... | ........ | EN...V. | .......... .......... | E.F....RS... | .... |
| iPS:39 3994 | 21-225_8C9 | VH3\|3-33/D7\|7-27\|RF2/JH4 | .......... ...... | ......... | ........ | EN...V. | .......... .......... | E.F....RS... | .... |
| iPS:39 3998 | 21-225_12B12 | VH3\|3-33/D7\|7-27\|RF2/JH4 | .......... ...... | D........ | ....M... | ......VT. | .......... .......... | E.W....YE... | .... |
| iPS:39 4024 | 21-225_16B7 | VH3\|3-33/D7\|7-27\|RF2/JH4 | .......... ...... | D........ | ........ | ...E.... | .......... .......... | E.F....LS... | .... |
| iPS:39 4059 | 21-225_9E8 | VH3\|3-33/D7\|7-27\|RF2/JH4 | .......... ...E.. | ......... | ........ | EN.Q.... | .......... .......... | E.F....RS... | .... |
| iPS:39 4067 | 21-225_12F2 | VH3\|3-33/D7\|7-27\|RF2/JH4 | .......... ...... | D........ | ........ | ..F.N...V. | .......F. ......V.. | E.AW...SE... | .... |
| iPS:39 4089 | 21-225_12E6 | VH3\|3-33/D7\|7-27\|RF2/JH4 | .......... ...... | D........ | ....T... | E....... | .......... ....D..... | E.AW...YE... | .... |
| iPS:39 4097 | 21-225_16G7 | VH3\|3-33/D7\|7-27\|RF2/JH4 | .......... ...... | D........ | ........ | EN.E.... | .......... ....A..... | E.AW...YE... | .... |
| iPS:40 2219 | 21-225_1C12 | VH3\|3-33/D7\|7-27\|RF2/JH4 | .......... ...T.. | N........ | ........ | EN...V. | .......... .......... | E.F....RS... | .... |
| Germline | | VH3\|3-21\|D4\|4-11\|RF2\|JH4 | EVQLVES GGGLVKPGGSLR LSCAASG-FTFS | S----ISN | WVRQAPGK GLEWVS | SSSS---- SSTIYYAD SVKG | RFTISRDNAKNSLYLQM NSLRAEDTAVYYCAR | DYSNY ----TFDY | WGQGTL VTVSS |
| iPS:43 3895 | 21-225_43E1 | VH3\|3-21\|D4\|4-11\|RF2/JH4 | .......... ...... | ......... | ........ | A..GN... ..T..... ..L..... | .......F.L .......... | .RG-- ...--SE | .... |

Figure 52 (Continued)

| | | | | | | | |
|---|---|---|---|---|---|---|---|
| iPS:43 4103 | 21-225_53G1 | VH3\|3-21\|D4\|4-11\|RF2/JH4 | . . . . | . . . . | . . . . | . . . . G | RG--- |
| iPS:43 4179 | 21-225_56F1 | VH3\|3-21\|D4\|4-11\|RF2/JH4 | . . E . | . . . . | . . . . | T . . G | . . -SI |
| iPS:43 4263 | 21-225_56H7 | VH3\|3-21\|D4\|4-11\|RF2/JH4 | . F . . | . . . . | . . . . | T . . G | RG--- |
| iPS:43 5521 | 21-225_157H4 | VH3\|3-21\|D4\|4-11\|RF2/JH4 | . S . . | . . . . | . . . . | . T . . | . . -SS |
| iPS:43 5527 | 21-225_157G7 | VH3\|3-21\|D4\|4-11\|RF2/JH4 | . . F . | . . . . | . . . . | . T . . | RG--- |
| iPS:43 5529 | 21-225_157H7 | VH3\|3-21\|D4\|4-11\|RF2/JH4 | . . F . | . . . . | . M . . | . . . G | . . -SI |
| iPS:43 5547 | 21-225_158F5 | VH3\|3-21\|D4\|4-11\|RF2/JH4 | . . F . | . T . . | . . . V | C . G . | RG--- |
| iPS:43 5549 | 21-225_158H5 | VH3\|3-21\|D4\|4-11\|RF2/JH4 | . . . . | . R . . | . . . . | . T . . | . . -G. |
| iPS:43 5553 | 21-225_158G8 | VH3\|3-21\|D4\|4-11\|RF2/JH4 | . . . . | . . . . | . . H . | . . . G | RG--- |
| iPS:43 5581 | 21-225_160H1 | VH3\|3-21\|D4\|4-11\|RF2/JH4 | . . T . | . . . . | . . . . | L . G . | RG--- |
| iPS:43 5593 | 21-225_160F4 | VH3\|3-21\|D4\|4-11\|RF2/JH4 | . . . . | . . . . | . F . . | TG.M. . | . . -SL |
| iPS:43 5617 | 21-225_162F2 | VH3\|3-21\|D4\|4-11\|RF2/JH4 | . . F . | . . . . | . . . . | . . . G | K---- |
| | | | | | | . T . . | . . -SS |
| | | | | | | | RG--- |
| | | | | | | | . . -SS |

Figure 52 (Continued)

| | | | | | | | |
|---|---|---|---|---|---|---|---|
| iPS:43 5621 | 21-225_162H3 | VH3\|3-21\|D4\|4-11\|RF2/JH4 | . . . . . . . . . . . . | . . . . . . . . . . . . | R . . . . . . . . G . . . T . . | . . . . . . . . . . . . | RG------.....SS |
| iPS:43 5641 | 21-225_163F9 | VH3\|3-21\|D4\|4-11\|RF2/JH4 | . . . Q . . . F . . . . | . . . . . . . . . . . . | . . . . . . . . G . . . T . . | . . . . . . . . . . . . | RG------.....SL |
| iPS:43 5719 | 21-225_171A11 | VH3\|3-21\|D4\|4-11\|RF2/JH4 | . . . . . . . . . . . . | . . . . . . . . . . . . | . . . . . . . . G . . . . . . | . . . . . . . . . . . . | RG------.....SS |
| iPS:43 6856 | 21-225_58C5 | VH3\|3-21\|D4\|4-11\|RF2/JH4 | . . . . . . . . . . N . | . . . . . . . . . . . . | . . . . . . I . Y L . . . . . | . . . . . . S . . . . . | T..G----.S... |
| iPS:44 8904 | 21-225_65C12 | VH3\|3-21\|D4\|4-11\|RF2/JH4 | . . . . . . . . . . R . | F L . . . . . . . . . . | . . . . . . . . . . . . . . . | . . . . . . . . . . . . | AY-------SH. |
| iPS:47 2730 | 21-225_14B1_LC1 | VH3\|3-21\|D4\|4-11\|RF2/JH4 | . . . . . . . . . . . . | . . . . . . . T . . . . | . . . . . . . . G . P . L . . | . . . . . . . . . . . . | RG------.....SS |
| iPS:47 2731 | 21-225_14B1_LC2 | VH3\|3-21\|D4\|4-11\|RF2/JH4 | . . . . . . . . . . . . | . . . . . . . T . . . . | . . . . . . . . G . P . L . . | . . . . . . . . . . . . | RG------.....SS |
| iPS:39 2726 | 21-225_20B5 | VH3\|3-21\|D4\|4-11\|RF2/JH4 | . . . A . . . . T . . . | . . . . . . . . . . . . | . . . . . . . . G . . . . . . | . . . . . . L . . . . . | RG------.S. |
| iPS:39 2734 | 21-225_17D8 | VH3\|3-21\|D4\|4-11\|RF2/JH4 | . . . . . . . . . . . . | . . . . . . G L . . . . | . . . . . . . . G . H . S . . | . . . . . . . . . . . . | RG------.....SG |
| iPS:39 2768 | 21-225_20B8 | VH3\|3-21\|D4\|4-11\|RF2/JH4 | . . . . . . . . . . . . | . . . . . . . . . . . . | . . . . . . . . G . H . . . . | . . . . . . . . . . . . | RG------.....SG |
| iPS:39 2778 | 21-225_22H3 | VH3\|3-21\|D4\|4-11\|RF2/JH4 | . . . A . . . . . . . . | . . . . . . . . . . . . | . . . . . . . . . . . . . . . | . . . . . . F . . . . . | RG------.....SL |
| iPS:39 2788 | 21-225_20C8 | VH3\|3-21\|D4\|4-11\|RF2/JH4 | . . . . . . . . . . . . | . . . . . . . . . . . . | . . . . . . . . G . . . A . . | . . . . . . . . . . . . | RG------.....SL |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39_2792 | VH3j3-21/D4j4-11jRF2/JH4 | .................... | .................... | .................... | .G.... | .................... | .RG----...-S. | .... |
| iPS:39_2844 | VH3j3-21/D4j4-11jRF2/JH4 | .................... | ........T........... | .................... | .G.... .L... .W.V | .................... | .RG----...-SL | .... |
| iPS:39_2848 | VH3j3-21/D4j4-11jRF2/JH4 | .................... | .................... | .................... | .................... | .................... | .RG----...-SC | ..I. |
| iPS:39_2850 | VH3j3-21/D4j4-11jRF2/JH4 | .................... | .........T.......... | .................... | .................... | ..........I......... | .RG----...-SL | .... |
| iPS:39_3006 | VH3j3-21/D4j4-11jRF2/JH4 | .................... | .................... | .................... | .................... | .................... | .RG----...-SS | .... |
| iPS:39_3022 | VH3j3-21/D4j4-11jRF2/JH4 | .................... | .................... | .................... | .G.... | .................... | .RG----...-SL | .... |
| iPS:39_3130 | VH3j3-21/D4j4-11jRF2/JH4 | .................... | ........T........... | ....Q............... | .G.... | ...........IF.....F. | .RG----...-GT | .... |
| iPS:39_3906 | VH3j3-21/D4j4-11jRF2/JH4 | .................... | ........T........... | ....D............... | .G.... | .................... | .RG----...-SG | .... |
| iPS:39_3982 | VH3j3-21/D4j4-11jRF2/JH4 | .................... | .................... | .................... | .................... | .................... | .RG----...-SL | .... |
| iPS:39_8478 | VH3j3-21/D4j4-11jRF2/JH4 | .................... | .................... | .................... | .G.... .M... | ...................L | .RG----...-SS | .... |
| VH3j3-23/D6j6-6jRF1jJH4 | | EVQLLES- GGGLVQPGGSLR LSCAASG-FTFS | S------- YAMS | WVRQAPGK GLEWVS | AISGS------ SVKG GGSIYYAD | RFTISRDNSKNTLYLQM NSLRAEDTAVYYCAK | NGGTL EYSSSS-------SYFDY | WGQGTL VTVSS |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43_3897 | VH3}3-23/D6{6-6|RF1/JH4 | ........ | ........ | ........ | ..R. VN.FD.. | ........ | R.G..... | ........ |
| iPS:43_3903 | VH3}3-23/D6{6-6|RF1/JH4 | ........ | ........ | ........ | ..R. IN.FD.. | ........ | R.G..... | ........ |
| iPS:43_3911 | VH3}3-23/D6{6-6|RF1/JH4 | ........ | ........ | ........ | ..R. IN.FD.. | ........ | R.G..... | ........ |
| iPS:43_3941 | VH3}3-23/D6{6-6|RF1/JH4 | ........ | ........ | ........ | ..R. VN.FD.. | ........ | R.G..... | ........ |
| iPS:43_3957 | VH3}3-23/D6{6-6|RF1/JH4 | ........ | ........ | ........ | ..R. VN.FD.. | ........ | R.G..... | ........ |
| iPS:43_3973 | VH3}3-23/D6{6-6|RF1/JH4 | ........ | ........ | ........ | ..R. IN.FD.. | ........ | R.G..... | ........ |
| iPS:43_5715 | VH3}3-23/D6{6-6|RF1/JH4 | ........ | ....S... | ........ | V... F.T.. | ........ | SN..G... —W | ........ |
| iPS:43_5739 | VH3}3-23/D6{6-6|RF1/JH4 | .....R.. | ....S... | ........ | V... F.T.. | ........ | SN..G... —W | ........ |
| iPS:43_5749 | VH3}3-23/D6{6-6|RF1/JH4 | .....R.. | ........ | ........ | S...R... F... | ...V... | SN..G... —W | ........ |
| VH3}3-21|D7|7-27|RF1|JH4 | Germline | EVQLVES GGGLVRPGGSLR LSCAASG-FTFS | S....YSMN | WVRQAPGK GLEWVS | SSSSS SSYIYAD SVKG | RFTISRDNAKNSLYLQM NSLRAEDTAVYYCAR | .......FDY | WGQGT VTVSS |
| iPS:43_3901 | VH3}3-21|D7|7-27|RF1|JH4 | ........ | ....T... | ...V... | ...G....T... | ....D.Q....G........ | V.S-.... | .....A |

Figure 52 (Continued)

| | | | | | | | | |
|---|---|---|---|---|---|---|---|---|
| iPS:43 3961 | 21-225_45D9 | VH3\|3-21\|D7\|7-27\|RF1\|J H4 | ....... | ....T.. | .....V... | .....G.. | .....D.Q......... | V.S-....A... |
| iPS:43 4135 | 21-225_54H3 | VH3\|3-21\|D7\|7-27\|RF1\|J H4 | ....... | .....I.. | ......... | ...T..GT. | ...........G..... | M.T-....-VI |
| iPS:43 4331 | 21-225_63H8 | VH3\|3-21\|D7\|7-27\|RF1\|J H4 | ....... | .....N.. | ......... | ..T.MN.T. | ................. | RN-....... |
| iPS:43 5421 | 21-225_151F1 | VH3\|3-21\|D7\|7-27\|RF1\|J H4 | ...Y..R | .....F.. | ......... | .....Y... | ................. | D.P-...LV. |
| iPS:43 5653 | 21-225_166H12 | VH3\|3-21\|D7\|7-27\|RF1\|J H4 | ....A.. | ....S... | .G....... | .....G..S | ................. | ........... |
| iPS:43 6648 | 21-225_227F11 | VH3\|3-21\|D7\|7-27\|RF1\|J H4 | ...V... | ..T..... | ......... | .IN.M.... | ......S.......... | G-......-V. |
| iPS:39 2952 | 21-225_26G1 | VH3\|3-21\|D7\|7-27\|RF1\|J H4 | ....... | ....G... | ......... | .....G... | ................. | ..T-.....F. |
| iPS:39 3082 | 21-225_34C11 | VH3\|3-21\|D7\|7-27\|RF1\|J H4 | ....... | ...T.S.. | ......... | .....N... | ................. | ........... |
| iPS:39 4061 | 21-225_12D2 | VH3\|3-21\|D7\|7-27\|RF1\|J H4 | ....... | ........ | ......... | ....NN... | ......S.......... | G-.......A. |
| iPS:39 4071 | 21-225_10C7 | VH3\|3-21\|D7\|7-27\|RF1\|J H4 | ....... | ....N... | ......... | .....G... | ................. | G-......-V. |
| iPS:39 8532 | 21-225_33B7 | VH3\|3-21\|D7\|7-27\|RF1\|J H4 | ....... | ........ | ......... | ......... | ................. | N.-....... |
| iPS:40 2225 | 21-225_2B1 | VH3\|3-21\|D7\|7-27\|RF1\|J H4 | ....... | ........ | ......... | ......... | ................. | G-.....-N. |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:40 4090 | 21-225_8D8 | VH3\|3-21\|D7\|7-27\|RF1\|JH4 | ........ | ..... | ........ | ........ | ........ | .G-----N. | ........ |
| | Germline | VH3\|3-11\|D4\|4-11\|RF2\|JH4 | QVQLVES GGGLVKPGGSLR LSCAASG-FTFS | ----YMS | WIRQAPGK GLEWVS | YISSS GSTYYAD SVKG | RFTISRDNAKNSLY LQMNSLRAEDTAVYYCAR | ----DYSNY YFDY | WGQGTL VTVSS |
| iPS:43 3905 | 21-225_43E5 | VH3\|3-11\|D4\|4-11\|RF2\|JH4 | ........ | ...I | ........ | I.K.M.. | ........A | T-----I | ........ |
| iPS:43 3913 | 21-225_43H8 | VH3\|3-11\|D4\|4-11\|RF2\|JH4 | ........ | ...N | ........ | R.F.L.. | ........A | T-----I | ........ |
| iPS:43 3949 | 21-225_45H2 | VH3\|3-11\|D4\|4-11\|RF2\|JH4 | ........ | ...N | ........ | I.K... | ........A | T-----I | ........ |
| iPS:43 3981 | 21-225_46E9 | VH3\|3-11\|D4\|4-11\|RF2\|JH4 | ........ | ...I | ........ | N.N.F.. | ........A | T-----I | ........ |
| iPS:43 3995 | 21-225_47H7 | VH3\|3-11\|D4\|4-11\|RF2\|JH4 | ........ | ...N | ........ | N.N.F.K.. | ........A | T-----I | ........ |
| iPS:43 4039 | 21-225_43B1 | VH3\|3-11\|D4\|4-11\|RF2\|JH4 | ........ | ...N | ........ | N.N.F... | ........A | T-----V | ........ |
| iPS:43 4275 | 21-225_57F4 | VH3\|3-11\|D4\|4-11\|RF2\|JH4 | .......I | ........ | ........ | ........ | ........ | M-----IT | ......R. |
| | Germline | VH3\|3-23\|D7\|7-27\|RF1\|JH3 | EVQLLES GGGLVQPGGSLR LSCAASG-FTFS | S---YAMS | WVRQAPGK GLEWVS | AISGS GGSTYYAD SVKG | RFTISRDNSKNTLY LQMNSLRAEDTAVYYCAK | ----LTGD AFDI | WGQGTM VTVSS |
| iPS:43 3915 | 21-225_43H9 | VH3\|3-23\|D7\|7-27\|RF1\|JH3 | ........ | ........ | ......M | SN.F... | ......F....H. | R.PSD......V | ........ |

Figure 52 (Continued)

| | Germline | H_FR1 | H_CDR1 | H_FR2 | H_CDR2 | H_FR3 | | | H_CDR3 | H_FR4 |
|---|---|---|---|---|---|---|---|---|---|---|
| iPS:43 3925 | VH3|3-23|D7|7-27|RF1|JH3 | ........H................ | ........ | ........ | IL..G... KT.... | ........ | F..... | ........ | R.PSD... | ........ |
| iPS:43 3953 | VH3|3-23|D7|7-27|RF1|JH3 | ........ | ........ | ........ | ........M ........ SM.F... | ........ | ....H. F...... | ........ | R.PSD... ......V | ........ |
| iPS:43 3959 | VH3|3-23|D7|7-27|RF1|JH3 | ............N........ | ........ | ........ | .....V.. ...T... | ........ | ........ | ........ | R.PSD... ......V | ........ |
| iPS:43 5379 | VH3|3-23|D7|7-27|RF1|JH3 | ........ | ........ | ........ | .....V.. ....F.. | ........ | ....F. ........ | ........ | R.PED... ......V | ........ |
| iPS:43 5787 | VH3|3-23|D7|7-27|RF1|JH3 | ........E...... | ...F..N. | ........ | .....V.. ...N.F. | ........ | ....F. ........ | ........ | R.....D. ......V | ........ |
| iPS:43 5809 | VH3|3-23|D7|7-27|RF1|JH3 | ........ | ........ | ........ | .....V.. ...T.E. | ........ | ........ | ........ | R.....D. ......V | ........ |
| iPS:43 5889 | VH3|3-23|D7|7-27|RF1|JH3 | ........ | ........ | ........ | .....V.. ...T.E. | ........ | ........ | ........ | R.....D. ......V | ........ |
| VH4|4-59|D6|6-13|RF2|JH4 | Germline | H_FR1 QVQLQES.G PGLVKPSETLS LTCTVSG.GSIS | H_CDR1 S..YYWS | H_FR2 WIRQPPGK GLEWIG | H_CDR2 YIYY SGSTNYNP SLKS | H_FR3 RVTISVDTSKNQFSLKL SSVTAADTAVYYCAR | | | H_CDR3 GTAAA------GFFDY | H_FR4 WGQGTL VTVSS |
| iPS:43 3931 | VH4|4-59|D6|6-13|RF2|JH4 | ......H.. ............ .............. | ........ | ........ | .....N.. ........ .... | ........ ........I. | ........ | ........ | V.I-........ .....KN. | ........I ...... |
| VH3|3-23|D4|4-17|RF2|JH6 | Germline | H_FR1 EVQLLES.G GGLVQPGGSLR LSCAASG.FTFS | H_CDR1 S..YAMS | H_FR2 WVRQAPGK GLEWVS | H_CDR2 AISGS GGSTYYAD SVKG | H_FR3 RFTISRDNSKNTLYLQM NSLRAEDTAVYYCAK | | | H_CDR3 DYGDYY------YYGMDV | H_FR4 WGQGTT VTVSS |
| iPS:43 3943 | VH3|3-23|D4|4-17|RF2|JH6 | .....S.. ........ ............ | ........ | ........ | ....N... GVV...R. | ........I | ........ | ........ | R.QWL-....LG.... | ........ |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 3989 | 21-225_47C7 | VH3\|3-23\|D4\|4-17\|RF2/J H6 | N....... | ........ | G...... .SR. | ........ | R.QWL- .IG.... | ........ |
| iPS:43 4133 | 21-225_54G3 | VH3\|3-23\|D4\|4-17\|RF2/J H6 | T....... | ........ | ...F... | ........ | LGK..... | ........ |
| iPS:43 4221 | 21-225_60A11 | VH3\|3-23\|D4\|4-17\|RF2/J H6 | N....T.. | ........ | VN.F... | ........ | LGK..H- | ........ |
| iPS:43 4257 | 21-225_62F7 | VH3\|3-23\|D4\|4-17\|RF2/J H6 | .....V.. | ........ | ..N.F... ...T. | ....E.. | LGI..... | ........ |
| iPS:43 4283 | 21-225_57F8 | VH3\|3-23\|D4\|4-17\|RF2/J H6 | N....... .V.. | ........ | G...... .AK.... | ....V.. | LGK..H- | ........ |
| iPS:43 4385 | 21-225_66C10 | VH3\|3-23\|D4\|4-17\|RF2/J H6 | ........ | ........ | ..S.... ..N.F.. ....T. | ....V.. | LGI..... | ........ |
| iPS:43 5717 | 21-225_171A9 | VH3\|3-23\|D4\|4-17\|RF2/J H6 | ......T. | ........ | G...... .AR.... | ....E.. | LGI..... | ........ |
| iPS:43 6528 | 21-225_224B1 | VH3\|3-23\|D4\|4-17\|RF2/J H6 | ...V.... | ........ | ..N.FN. | ....H.. ....G.. | EG.Y..- ...V... | ........ |
| iPS:39 3810 | 21-225_5A4 | VH3\|3-23\|D4\|4-17\|RF2/J H6 | ...V.... ....L... | ..S..... | ..R.... ..N.F.T | ........ | LGK..... | ........ |
| | Germline | H_FR1 | H_CDR1 | H_FR2 | H_CDR2 | H_FR3 | H_CDR3 | H_FR4 |
| VH3\|3-48\|D5\|5-24\|RF3\|JH6 | | EVQLVES- GGGLVQPGGSLR LSCAASG-FTFS | S...-YSMN | WVRQAPGK GLEWVS | YISSS- SSTIYAD SVKG | RF TISRDNAKNSLYLQM NSLRAEDTAVYYCAR | RGGYNYY- -YYYGMDV | WGQGT VTVSS |
| iPS:43 3945 | 21-225_44C12 | VH3\|3-48\|D5\|5-24\|RF3/J H6 | ........ | .....V.. | ........ | ........ | SGYSYA | ........ |

Figure 52 (Continued)

| | | OCLVES<br>GGGVVQPGRSLR<br>LSCAASG-FTFS | S----YGMH | WVRQAPG-KGKGD<br>GLEWVA | VIWYD<br>GSNKYYAD<br>SVKG | RFTISRDNSKNTLYLQM<br>NSLRAEDTAVYYCAR | GIAVAG-------GYFDY | WGQGTL<br>VTVSS |
|---|---|---|---|---|---|---|---|---|
| iPS:43 3947 | 21-225_44E12 | VH3J3-33\|D6\|6-13\|RF2\|JH4 | ..H.A.........E | .....DDT | .........P... | EY......F... | ....................A.......... | DLI..A........TG... | .......... |
| iPS:43 3963 | 21-225_46B1 | VH3J3-33\|D6\|6-13\|RF2\|JH4 | ..H.A.........E<br>............L | .....DDS | .........P... | EYT.....F... | ................................ | DLI..T........TG... | .......... |
| iPS:43 3987 | 21-225_47A5 | VH3J3-33\|D6\|6-13\|RF2\|JH4 | ................ | D....DDT | ............. | ........F... | ..N...A......................... | DLI..A........TV... | .......... |
| iPS:43 6258 | 21-225_202F12 | VH3J3-33\|D6\|6-13\|RF2\|JH4 | ...............E | Y....... | ............. | I.......F... | ......S......................S.. | N....A........P.... | .......... |
| iPS:39 2646 | 21-225_20G2 | VH3J3-33\|D6\|6-13\|RF2\|JH4 | ................ | .....DD. | .........E... | ........F... | ..IM.............G.............. | DLI..A........TV... | .......... |
| iPS:39 2750 | 21-225_20A10 | VH3J3-33\|D6\|6-13\|RF2\|JH4 | ............L | .....DD. | ............. | ........F... | ..I..............M.............. | DLI..A........TV... | .......... |
| Germline | | H_FR1 | H_CDR1 | H_FR2 | H_CDR2 | H_FR3 | H_CDR3 | H_FR4 |
| | | EVLLES-<br>GGGLVQPGGSLR<br>LSCAASG-FTFS | S----YAMS | WVRQAPGK-KGLE<br>GLEWVS | AISGS--<br>GGSTYYAD<br>SVKG | RFTISRDNSKNTLYLQM<br>NSLRAEDTAVYYCAK | GLAVAG-------DAFDI | WGQGTM<br>VTVSS |
| iPS:43 3999 | 21-225_48D1 | VH3J3-23\|D6\|6-19\|RF2\|JH3 | .....R........ | ........ | ............. | V....R... F... | .............................R.. | R............NE.... | .......... |
| iPS:43 4003 | 21-225_48C3 | VH3J3-23\|D6\|6-19\|RF2\|JH3 | .....R........ | ........ | ............. | V....R... F... | .............................R.. | R............NE.... | .......... |
| iPS:43 4037 | 21-225_49G12 | VH3J3-23\|D6\|6-19\|RF2\|JH3 | .....T........ | ........ | ............. | V....T.F... | .....L.......................R.. | R............N..... | .......... |
| iPS:43 4041 | 21-225_50H8 | VH3J3-23\|D6\|6-19\|RF2\|JH3 | .....R........ | ........ | ............. | V....T.F... | .............................R.. | R............NE.... | .......... |

Figure 52 (Continued)

| | | | | | | | | |
|---|---|---|---|---|---|---|---|---|
| iPS:43 4045 | 21-225_50H10 | VH3\|3-23\|D6\|6-19\|RF2\|J H3 | .G........ | ........ | ........ | V...R. .F... | ........ | R......NE... |
| iPS:43 4073 | 21-225_51H10 | VH3\|3-23\|D6\|6-19\|RF2\|J H3 | ..R... | ........ | ........ | V... .I.F | ...L.... ........ | ...R R......N... |
| iPS:43 6212 | 21-225_20QG1 | VH3\|3-23\|D6\|6-19\|RF2\|J H3 | ........ | ........ | ........ | ........ | ........ | R..D ......Y...V |
| iPS:39 2652 | 21-225_17C6 | VH3\|3-23\|D6\|6-19\|RF2\|J H3 | ........ | ...N.... | ........ | ...R. .N.F. ..R. | ...F. ....S | RL......SE... |
| iPS:39 2668 | 21-225_17B4 | VH3\|3-23\|D6\|6-19\|RF2\|J H3 | ...E.... | ...N.... | ........ | V...R. .N.F. | .....S | RL......SE... |
| iPS:39 2696 | 21-225_20A4 | VH3\|3-23\|D6\|6-19\|RF2\|J H3 | ........ | ...T.... | .G..MV.. | ...R. ..Y.N. | .....S | R......SE... |
| iPS:39 2702 | 21-225_17F7 | VH3\|3-23\|D6\|6-19\|RF2\|J H3 | ...E.... | ...N.... | ........ | I...R. .N.F. | .V.....S | RL......SE... |
| iPS:39 2704 | 21-225_17F11 | VH3\|3-23\|D6\|6-19\|RF2\|J H3 | .A...... | ........ | ...D.... | V...R. .N..S | .....S | R......SE..H. |
| iPS:39 2720 | 21-225_17A12 | VH3\|3-23\|D6\|6-19\|RF2\|J H3 | ..I..E.. | ........ | ........ | I...R. .NAF. | .....S | RL......SE... |
| iPS:39 2722 | 21-225_18E12 | VH3\|3-23\|D6\|6-19\|RF2\|J H3 | ...E.... | ...N.... | ...T.... | I...R. .N.F. | .....S | RL......SE... |
| iPS:39 2760 | 21-225_22G3 | VH3\|3-23\|D6\|6-19\|RF2\|J H3 | ...E.... | ........ | ........ | I...R. VN.F. | .....S | RL......SE... |
| iPS:39 2764 | 21-225_22G10 | VH3\|3-23\|D6\|6-19\|RF2\|J H3 | ..D...T | ...N.... | ........ | V... .N.F. | .F.H. ....S | RM......SE... |

Figure 52 (Continued)

| | | | | | | | | |
|---|---|---|---|---|---|---|---|---|
| iPS:39 2812 | 21-225_21F4 | VH3\|3-23\|D6\|6-19\|RF2/J H3 | . . . . . . . . . . | . . . . N . . . | . . . . . . . . | . . . V . . R . . . N . F . . . | . . . . . . . . . | RL . . . . . . SE . C . | . . . . . . |
| iPS:39 2816 | 21-225_22E4 | VH3\|3-23\|D6\|6-19\|RF2/J H3 | . . . E . . . | . . . . . . . . | . . . . . . . . | . . . I . . R . . . . . . . | . . . . . S . | R . . . . . . SE . . . | . . . . . . |
| iPS:39 2852 | 21-225_21A2 | VH3\|3-23\|D6\|6-19\|RF2/J H3 | . . . E . . . | . . . . N . . . | . . . I . . . . | . . . I . . R . . . TN . F . | . . . . . S . | RL . . . . . . SE . . . | . . . . . . |
| iPS:39 2878 | 21-225_22C5 | VH3\|3-23\|D6\|6-19\|RF2/J H3 | . . . K . . . | . . . . . . . . | . . . . . . . . | . . . I . . R . . . N . F . . . | . . . . . S . | R . . . . . . SE . . . | . . . . . . |
| iPS:39 2902 | 21-225_22D5 | VH3\|3-23\|D6\|6-19\|RF2/J H3 | . . . V . . . | . . . . . . . . | . M . . . . I . | . . . . . . Y . . . . . . . | . . . . . S . | R . . . . . . SE . . . | . . . . . . |
| iPS:39 3824 | 21-225_10F12 | VH3\|3-23\|D6\|6-19\|RF2/J H3 | . . . E . . . | . . . . . . . . | . . . . . . . . | . . . V . . R . . . N . F . . . | . . . . . S . | R . . . . . . SE . . . | . . . . . . |
| iPS:39 3846 | 21-225_4H2 | VH3\|3-23\|D6\|6-19\|RF2/J H3 | . . . . . . . . | G . . . . . . . | . . . . . . . . | . M V . . R . . . . . . Y . . | . . . . . S . | RV . . . . . . SE . . . | . . . . . . |
| iPS:39 3862 | 21-225_5G2 | VH3\|3-23\|D6\|6-19\|RF2/J H3 | . . . E . . . | . . . . . . . . | . . . . . . . . | . . . I . . R . . . N . F . . . | . . . . . S . | RL . . . . . . SE . . . | . . . . . . |
| iPS:39 3888 | 21-225_3E3 | VH3\|3-23\|D6\|6-19\|RF2/J H3 | . . . T . . . | . . . V . . . . | . . . . . . . . | . . . V . . R . . . VN . F . . | . . . . . S . | R . . . . . . SE . . . | . . . . . . |
| iPS:39 3898 | 21-225_5F7 | VH3\|3-23\|D6\|6-19\|RF2/J H3 | . . . E . . . | . . . . . . . . | . . . . . . . . | . . . I . . R . . . N . F . . . | . . . . L . S . | RL . . . . . . SE . A . | . . . . . . |
| iPS:39 3980 | 21-225_6D3 | VH3\|3-23\|D6\|6-19\|RF2/J H3 | . . . E . . . | . . . . N . . . | . . . . . . . . | . . . I . . R . . . N . F . . . | . . . F . S . | RL . . . . . . SE . . . | . . . . . . |
| iPS:39 4014 | 21-225_8G6 | VH3\|3-23\|D6\|6-19\|RF2/J H3 | . . . E . . . | . . V . N . . . | . . . . . . . . | . . . V . . R . . . N . F . . . | . . . . . S . | RL . . . . . . SE . . . | . . S . . . |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 4022 | 21-225_16H6 | VH3|3-23|D6|6-19|RF2|J H3 | ......... | ......N...... | .....M.V..R.. .........Y... | .............. | .............. | RL.......SE.... | .......... |
| iPS:39 4043 | 21-225_3B1 | VH3|3-23|D6|6-19|RF2|J H3 | ......E.. | ......N...... | .....V...R.. ......IN.F... | ......S....... | .............. | RL.......SE.... | .......... |
| iPS:39 4077 | 21-225_8E12 | VH3|3-23|D6|6-19|RF2|J H3 | ......E.. | .............. | .....I...R.. ......N.F.... | ......S....... | .............. | RM.......SE.... | .......... |
| iPS:39 4087 | 21-225_11A5 | VH3|3-23|D6|6-19|RF2|J H3 | ...D..E.. | ......I....... | .....V...R.. ......VN.F... | ......S....... | .............. | R........SE.... | .......... |
| | Germline VH3|3-11|D6|6-6|RF2|JH3 | H_FR1 QVQLVES GGGLVKPGGSLR LSCAASG-FTFS | H_CDR1 YKMS | H_FR2 WVRQAPGK VISSS GLEWVS | H_CDR2 GSTIVYAD SVKG | H_FR3 RFTISRDNAKNSLYLQM NSLRAEDTAVYYCAR | H_CDR3 STARR ........DAFDI | H_FR4 WGQGTL VTVSS |
| iPS:43 4011 | 21-225_48B10 | VH3|3-11|D6|6-6|RF2|JH 3 | ......... | .....F.T.. | ......Q... GA....A.. | ......I....... | .............. | AV..P.....GV.... | .......... |
| | Germline VH3|3-11|D6|6-6|RF2|JH4 | H_FR1 QVQLVES GGGLVKPGGSLR LSCAASG-FTFS | H_CDR1 YVMS | H_FR2 WVRQAPGK VISSS GLEWVS | H_CDR2 GSTIYYAD SVKG | H_FR3 RFTISRDNAKNSLYLQM NSLRAEDTAVYYCAR | H_CDR3 STARR ........YFDY | H_FR4 WGQGTL VTVSS |
| iPS:43 4015 | 21-225_48F12 | VH3|3-11|D6|6-6|RF2|JH 4 | ......... | .....F.T.. | ......Q... GA....A.. | ......F....I. | .............. | AV..P.....GA..I. | .......... |
| iPS:43 4017 | 21-225_48G12 | VH3|3-11|D6|6-6|RF2|JH 4 | ......... | .....F.T.. | ......Q... GA....A.. | ......F....I. | .............. | AV..P.....GA..I. | .......... |
| | Germline VH3|3-23|D6|6-13|RF2|JH4 | H_FR1 EVQLVES GGGLVQPGGSLR LSCAASG-FTFS | H_CDR1 SYAMS | H_FR2 WVRQAPGK GLEWVS | H_CDR2 AISGS GSTIYYAD SVKG | H_FR3 RFTISRDNSKNTLYLQM NSLRAEDTAVYYCAK | H_CDR3 GIARA ........GIRDI | H_FR4 WGQGTL VTVSS |
| iPS:43 4023 | 21-225_49F1 | VH3|3-23|D6|6-13|RF2|J H4 | ......... | .............. | ...D...... V...F..... | ......S....... | .............. | A....G....AH.... | .......... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 6246 | VH3|3-23|D6|6-13|RF2|JH4 | ..........................V | ............ | ............ | ............ | .........T....F...... | .G.RSSG.....WFH... | ............ |
| iPS:43 6254 | VH3|3-23|D6|6-13|RF2|JH4 | ............ | ............ | ............ | ....S....VR.. | .........T....F...... | .G.RSSG.....WFH... | ............ |
| iPS:43 6304 | VH3|3-23|D6|6-13|RF2|JH4 | ...........Q | ............ | ............ | ....VR.. | ......N..F...... | .G.RSSG.....WFH... | ............ |
| iPS:43 6334 | VH3|3-23|D6|6-13|RF2|JH4 | ............ | ............ | ............ | ....VR.. | ....S.......K...... | .G.RSSG.....WFH... | ............ |
| | Germline | H_FR1 | H_CDR1 | H_FR2 | H_CDR2 | H_FR3 | H_CDR3 | H_FR4 |
| VH3|3-23|D6|6-19|RF2|JH5 | | EVQLLES-CGGLVQPGGSLR LSCAASG-FTFS | -TMS | MYRQAPGK SISGS-GLRWVS | GSSIYYAD SVKG | RFTISRDNSKNTLYLQM NSLRAEDTAVYYCAK | GIAVAG-------NWFDP | WGQGTL VTVSS |
| iPS:43 4027 | VH3|3-23|D6|6-19|RF2|JH5 | ............ | ......I | ............ | ...NSF.. | ......E....... | AR.......SH...... | ............ |
| iPS:43 4061 | VH3|3-23|D6|6-19|RF2|JH5 | ..........I. | ...N........ | ............ | V.A..NSF.. | ......E.F....... | AR.......SH...... | ............ |
| iPS:43 4167 | VH3|3-23|D6|6-19|RF2|JH5 | ...........R | ...T........ | ............ | ...VNSF.. | ......E.F....... | AR.......SH...... | ............ |
| iPS:43 4455 | VH3|3-23|D6|6-19|RF2|JH5 | ............ | ............ | ............ | ...T..Y..S.. | ...........R...... | R......T....TE.Y.. | ............ |
| iPS:43 7232 | VH3|3-23|D6|6-19|RF2|JH5 | ...M........G.S......T | ...T........S | ............ | ...AM.F.. | ...VT........T...... | V...........GHF... | ............ |
| | Germline | H_FR1 | H_CDR1 | H_FR2 | H_CDR2 | H_FR3 | H_CDR3 | H_FR4 |
| VH3|3-21|D1|1-21|RF2|JH4 | | EVQLVES-GGGLVKPGGSLR LSCAASG-FTFS | S----YSMN | WVRQAPGK GLEWVS | SISSS-SSYIYYAD SVKG | RFTISRDNAKNSLYLQM NSLRAEDTAVYYCAR | VDLER-------YFDY | WGQGTL VTVSS |

Figure 52 (Continued)

| | | | | | | | |
|---|---|---|---|---|---|---|---|
| iPS:43 4043 | 21-225_50G10 | VH3\|3-21/D1\|1-1\|RF2/JH4 | | .G... | | | AT--- |
| iPS:43 4085 | 21-225_52E3 | VH3\|3-21/D1\|1-1\|RF2/JH4 | K.. | ...G N.S | E | | SS--- ...-N. |
| iPS:43 4101 | 21-225_52H12 | VH3\|3-21/D1\|1-1\|RF2/JH4 | | .G... T | V | | NS--- |
| iPS:43 4187 | 21-225_56A5 | VH3\|3-21/D1\|1-1\|RF2/JH4 | | .G... | | | AT--- |
| iPS:43 4265 | 21-225_57B2 | VH3\|3-21/D1\|1-1\|RF2/JH4 | | .G.. N.T | | | AG--- |
| iPS:43 4439 | 21-225_70E12 | VH3\|3-21/D1\|1-1\|RF2/JH4 | T | .GN.. T..T | D.T | | AA--- ...C |
| iPS:43 5515 | 21-225_157E4 | VH3\|3-21/D1\|1-1\|RF2/JH4 | T | .G... | K. | | AT--- |
| iPS:43 5535 | 21-225_157H10 | VH3\|3-21/D1\|1-1\|RF2/JH4 | N..R. | .G.. TD | | | AH--- |
| iPS:43 7224 | 21-225_56H1 | VH3\|3-21/D1\|1-1\|RF2/JH4 | | .G.. T | | G.. I | AS--- |
| iPS:39 2620 | 21-225_17H5 | VH3\|3-21/D1\|1-1\|RF2/JH4 | | .G.. L | | | AS--- |
| iPS:39 2632 | 21-225_16A11 | VH3\|3-21/D1\|1-1\|RF2/JH4 | | .G.. F | | | AA--- |
| iPS:39 2746 | 21-225_20H7 | VH3\|3-21/D1\|1-1\|RF2/JH4 | H | | | | AA--- ...-L. |

Figure 52 (Continued)

| | | | | | | | |
|---|---|---|---|---|---|---|---|
| iPS:39 2782 | 21-225_22B12 | VH3\|3-21\|D1\|1-1\|RF2/JH4 | | | | AA--- ---L.S | |
| iPS:39 2916 | 21-225_27C5 | VH3\|3-21\|D1\|1-1\|RF2/JH4 | | ..T D... | | AS--- ....C | |
| iPS:39 2976 | 21-225_27H12 | VH3\|3-21\|D1\|1-1\|RF2/JH4 | L.. | | ..F | AS--- | |
| iPS:39 3120 | 21-225_35H8 | VH3\|3-21\|D1\|1-1\|RF2/JH4 | | ..G .N..T | K.V | .SG--- | |
| iPS:39 3836 | 21-225_15A2 | VH3\|3-21\|D1\|1-1\|RF2/JH4 | T.. | .GT G.F | ...A | AS--- | |
| iPS:39 3894 | 21-225_5E11 | VH3\|3-21\|D1\|1-1\|RF2/JH4 | | ..G G.. | | AS--- | |
| iPS:39 3896 | 21-225_2A4 | VH3\|3-21\|D1\|1-1\|RF2/JH4 | ..I | ..G ..T | ..F | AS--- | |
| iPS:39 3914 | 21-225_16B8 | VH3\|3-21\|D1\|1-1\|RF2/JH4 | | ..G ..T | .IA. | AS--- | |
| iPS:39 3944 | 21-225_14D6 | VH3\|3-21\|D1\|1-1\|RF2/JH4 | T.. N.. | ..G ..G. | ...M | AA--- .....S | ...S |
| iPS:39 3952 | 21-225_1F1 | VH3\|3-21\|D1\|1-1\|RF2/JH4 | ..V | ..G | | N..--- | |
| iPS:39 4033 | 21-225_5F4 | VH3\|3-21\|D1\|1-1\|RF2/JH4 | | ..G ..T | ..F | NN--- | |
| iPS:39 4069 | 21-225_16H1 | VH3\|3-21\|D1\|1-1\|RF2/JH4 | | ..G ..T | | AA--- | |

| | | Germline | H_FR1 | H_CDR1 | H_FR2 | H_CDR2 | H_FR3 | H_CDR3 | H_FR4 |
|---|---|---|---|---|---|---|---|---|---|
| iPS:43 4055 | 21-225_51B4 | VH3J3-23\|D1\|1-20\|RF1/JH3 | .........S........R | ................ | ................ | .....R....SN.F.T | ................ | ...SH.......G | ................ |
| | VH3J3-23\|D7\|7-27\|RF1/JH4 | Germline | EVQLLES GGGLVQPGGSLR LSCAASG-FTFS | S-------YAMS | WVRQAPGK GLEWVS | AISGS GSTIYAD SVKG | RFTISRDNSKNTLYLQM NSLRAEDTAVYYCAR | LIVY ------FDY | WGQGTL VTVSS |
| iPS:43 4059 | 21-225_51C5 | VH3J3-23\|D7\|7-27\|RF1/JH4 | ................ | V........ | ......T......... | TM.....R....N | S..........V........ | V.A-........ | ................ |
| iPS:43 4213 | 21-225_60A4 | VH3J3-23\|D7\|7-27\|RF1/JH4 | ................ | V........ | ................ | S...W.N........ | .........T.......... | ...-........ | ................ |
| iPS:43 4215 | 21-225_60F7 | VH3J3-23\|D7\|7-27\|RF1/JH4 | ................ | V........ | ................ | G...NR........ | .........S....GS | .G---........ | ................ |
| iPS:43 4241 | 21-225_61E6 | VH3J3-23\|D7\|7-27\|RF1/JH4 | ................ | ................ | ................ | T....VN.F....... | ................ | ELG........I | ................ |
| iPS:43 4281 | 21-225_57B8 | VH3J3-23\|D7\|7-27\|RF1/JH4 | .........R | ................ | ................ | ....N.F........ | ................ | ELG.........-ID | ................ |
| iPS:43 4301 | 21-225_58F11 | VH3J3-23\|D7\|7-27\|RF1/JH4 | ................ | ................ | ................ | ................ | ........Y........... | FF.MVG......AGF | ................ |
| iPS:43 5523 | 21-225_157G5 | VH3J3-23\|D7\|7-27\|RF1/JH4 | ................ | V........ | .....D........ | M.....R........ | ................ | Y.W-.......NG. | ................ |
| iPS:43 5659 | 21-225_167D12 | VH3J3-23\|D7\|7-27\|RF1/JH4 | ................ | V........ | ................ | M.....R........ | ................ | Y.W-.......NG. | ................ |
| iPS:43 5765 | 21-225_177D3 | VH3J3-23\|D7\|7-27\|RF1/JH4 | ................ | V.N...... | ................ | GM.....R.....D | .............S.....R | V.F-........ | ................ |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 7216 | 21-225_51D5 | VH3\|3-23\|D7\|7-27\|RF1/J H4 | ........ | .....V... | ........ T.... | ...TM.... ..R..... ...N.. | ...V..... S....... | V.A-..... | ........ |
| | VH3\|3-21\|D5\|5-24\|RF2\|JH4 | Germline | H_FR1 EVQLVES GGGLVQPGGSLR LSCAASG FTFS | H_CDR1 ------YSMN | H_FR2 WVRQAPGK GLEWVS | H_CDR2 SISSS SSTIYYAD SVKG | H_FR3 RFTISRDNAKNSLYLQM NSLRAEDTAVYYCAR | H_CDR3 ------PWLG --------LFDI | H_FR4 WGQGTL VTVSS |
| iPS:43 4063 | 21-225_51G7 | VH3\|3-21\|D5\|5-24\|RF2\|J H4 | ........ | ........ | ........ | ........ | ........ | A.L---- | ........ |
| | VH3\|3-23\|D7\|7-27\|RF3\|JH4 | Germline | H_FR1 EVQLVES GGGLVQPGGSLR LSCAASG FTFS | H_CDR1 ------YAMS | H_FR2 WVRQAPGK GLEWVS | H_CDR2 AISGS GSTIYAD SVKG | H_FR3 RFTISRDNSKNTLYLQM NSLRAEDTAVYYCAR | H_CDR3 ------NWGY -------FDI | H_FR4 WGQGTL VTVSS |
| iPS:43 4083 | 21-225_52H2 | VH3\|3-23\|D7\|7-27\|RF3\|J H4 | ........ | R...N... | ........ | ...M..R. ...N.F. | ...V..... F...... | .GREQ....WL. | ........ |
| | VH3\|3-30.3\|D6\|6-6\|RF2\|JH6 | Germline | H_FR1 QVQLVES GGGVVQPGRSLR LSCAASG FTFS | H_CDR1 ------SYAMH | H_FR2 WVRQAPGK GLEWVA | H_CDR2 VISYD GSNKYYAD SVKG | H_FR3 RFTISRDNSKNTLYLQM NSLRAEDTAVYYCAR | H_CDR3 ------STAEYY --YYYGMDV | H_FR4 WGQGTT VTVSS |
| iPS:43 4087 | 21-225_52F6 | VH3\|3-30.3\|D6\|6-6\|RF2\|JH 6 | ........ | ....G... | ........ | ....I..G. | ........D... | RS...P-.. .....G.. | ........ |
| iPS:43 4111 | 21-225_53H2 | VH3\|3-30.3\|D6\|6-6\|RF2\|JH 6 | ........ | ....G... | ...P..... | ........H.. | ........ | RG...P-.. .....G.. | ........ |
| iPS:43 4121 | 21-225_53F6 | VH3\|3-30.3\|D6\|6-6\|RF2\|JH 6 | ........ | ....G... | ........ | ....G.. ......D. | ........T... | RR...P-.. .....G.. | ........ |
| iPS:43 4163 | 21-225_50H1 | VH3\|3-30.3\|D6\|6-6\|RF2\|JH 6 | ........ | ....G... | ....S..... | ....I..G. ......D. | ........T.. | RR...P-.. .....G.. | ....I... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 4035 | 21-225_5G9 | VH3\|3-30.3/D6\|6-6\|RF2/JH6 | N.......G... | | I....A. | | R.T..L-- | |
| | | Germline | EVQLLES-GGGVVQPGRSLR LSCAASG-FTFS | S----YGMH | WVRQAPGK GLEWVA | VIWYD-GSNKYYAD SVKG | RFTISRDNSKNTLYLQM NSLRAEDTAVYYCAR | RILLY*WC -----MLIYFDY | WGQGTL VTVSS |
| iPS:43 4095 | 21-225_52F10 | VH3\|3-33/D2\|2-8\|RF1/JH4 | F............ | | .....D. | .......M............... | DS...SS- SWL.... | |
| | | Germline | EVQLLES-GGGLVQPGGSLR LSCAASG-FTFS | S----YAMS | WVRQAPGK GLEWVS | AISGS-GGSTYYAD SVKG | RFTISRDNSKNTLYLQM NSLRAEDTAVYYCAK | TTVVI-----YFDY | WGQGTL VTVSS |
| iPS:43 4107 | 21-225_53E2 | VH3\|3-23/D4\|4-23\|RF3/JH4 | I............R | | .....N.F. | ............T...D............ | KV.D.A.....MAL.. | |
| iPS:43 4181 | 21-225_56B2 | VH3\|3-23/D4\|4-23\|RF3/JH4 | I............R | | .....N.F. | ............T...D............ | KV.D.A.....MAL.. | |
| | | Germline | EVQLLES-GGGLVQPGGSLR LSCAASG-FTFS | S----YAMS | WVRQAPGK GLEWVS | AISGS-GGSTYYAD SVKG | RFTISRDNSKNTLYLQM NSLRAEDTAVYYCAK | DAFDI | WGQGTM VTVSS |
| iPS:43 4117 | 21-225_53C6 | VH3\|3-23/D1\|1-26\|RF1/JH3 | ..........N.. | | .....A. | | PL...H....E | |
| iPS:39 2984 | 21-225_30E11 | VH3\|3-23/D1\|1-26\|RF1/JH3 | ......DM..... | I........ | | V....SF. | ............T............ | DR.K.H........G | |
| iPS:39 3114 | 21-225_33G12 | VH3\|3-23/D1\|1-26\|RF1/JH3 | ......DM..... | | | V....SF. | | DR.R.H........G | |
| | | Germline | QVQLVES-GGGLVQPGGSLR LSCAASG-FTFS | S----YGMH | WVRQAPGK GLEWVA | VIWYD-GSNKYYAD SVKG | RFTISRDNSKNTLYLQM NSLRAEDTAVYYCAR | *RWLQ-----LYFDY | WGQGTL VTVSS |

Figure 52 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:43_4127 | 21-225_53H8 | VH3|3-33/D5|5-24|RF2/JH4 | | | | | | A.IG-<br>...S | |
| | VH3|3-23|D4|4-17|RF2|JH4 | Germline | EVQLLES<br>GGGLVQPGGSLR<br>LSCAASG-FTFS | S------<br>YAMS | WVRQAPGK<br>GLEWVS | AISGS<br>GGSTYYAD<br>SVKG | RFTISRDNSKNTLYLQM<br>NSLRAEDTAVYYCAR | DYGDY<br>------VFDY | WGQGT<br>LVTVSS |
| iPS:43_4147 | 21-225_55E1 | VH3|3-23|D4|4-17|RF2|JH4 | | | | .S..F. | .F. | H.IVG.<br>....TI. | |
| iPS:43_5303 | 21-225_146A6 | VH3|3-23|D4|4-17|RF2|JH4 | ...N | N | | ..N.F. | | KDN.VW.<br>....GSP. | |
| iPS:43_5335 | 21-225_147D10 | VH3|3-23|D4|4-17|RF2|JH4 | | | | ..N.F. | | KDY.VW.<br>....GSP. | |
| iPS:43_5339 | 21-225_147D12 | VH3|3-23|D4|4-17|RF2|JH4 | .S.. | | | ..R.<br>..N.F. | | KDY.VW.<br>....GSP. | |
| iPS:43_5343 | 21-225_148E2 | VH3|3-23|D4|4-17|RF2|JH4 | | | | ..R.<br>..N.F. | | KDY.VW.<br>....GSP. | |
| iPS:43_5381 | 21-225_149C6 | VH3|3-23|D4|4-17|RF2|JH4 | | | | ..R.<br>..N.F. | H. | KDY.VW.<br>....GSP. | |
| iPS:43_5391 | 21-225_149F8 | VH3|3-23|D4|4-17|RF2|JH4 | | | | ..R.<br>..N.F. | | KDY.VW.<br>....GSP. | |
| iPS:43_5395 | 21-225_149D11 | VH3|3-23|D4|4-17|RF2|JH4 | | | | ..R.<br>..N.F. | R. | KDY.VW.<br>....GSP. | |
| iPS:43_5403 | 21-225_150C5 | VH3|3-23|D4|4-17|RF2|JH4 | | | | ..N.F. | | KDY.VW.<br>....GSP. | |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| Germline | H_FR1 | EVQLLES GGGLVKPGGSLR LSCAASG-FTFS | S...VSMN | WVRQAPGK GLEWVS | SISSS SSIYYAL SVKG | RFTISRDNAKNSLYLQM NSLRAEDTAVYYCAR | CTIGT....YFDY | WGQGT LVTVSS |
| iPS:43 5447 | 21- 225_152H7 | VH3|3- 23|D4|4- 17|RF2|J H4 | . . . . . . . . . . . . . . . . . . . . . . . . . . . . . . . . . | . . . . . . . . . . . N | . . . . . . . . . . . . . . . . | . . . . . . . . . . N.F. . . | . . . . . . . . . . . . . . . . . . . . . . . . . | KDN..VW... ....GSP... | . . . . . . . . . . |
| iPS:43 5453 | 21- 225_152G10 | VH3|3- 23|D4|4- 17|RF2|J H4 | . . . . . . . . . . . . . . . . . . . . . . . . . . . . . . . . . | . . . . . . . . . . . . | . . . . . . . . . . . . . . . . | . . . . . . . . . . .R. . N.F. . . | . . . . . . . . . . . . . . . . . . . . . . . . . | KDY..VW... ....GSP... | . . . . . . . . . . |
| iPS:43 5483 | 21- 225_155A4 | VH3|3- 23|D4|4- 17|RF2|J H4 | . . . . . . . . . . . . . . . . . . . . . . . . . . . . . . . . . | . . . . . . . . . . . N | . . . . . . . . . . . . . . . . | . . . . . . . . . . N.F. . . | . . . . . . . . . . . . . . . . . . . . . . . . . | KDY..VW... ....GSP... | . . . . . . . . . . |
| iPS:43 5485 | 21- 225_155B4 | VH3|3- 23|D4|4- 17|RF2|J H4 | . . . . . . . . . . . . . . . . . . . . . . . . . . . . . . . . . | . . . . . . . . . . . . | . . . . . . . . . . . . . . . . | . . . . . . . . . . N.F. . . | . . . . . . . . . . . . . . . . . . . . . . . . . | KDY..VW... ....GSP... | . . . . . . . . . . |
| iPS:43 5777 | 21- 225_178F7 | VH3|3- 23|D4|4- 17|RF2|J H4 | . . . . . H . . . . T . . . . . . . . . . . . . . . . . . . . . | . . . . . . . . . . . . | . . . . . . . . . . . . . . . . | V . . . . . . . . N.F. . . | . . . . . . . . . . . . . . . . . . R . . . . . . | R . . - - - . . . . . . . | . . . . . . . . . . |
| iPS:43 5783 | 21- 225_179G1 | VH3|3- 23|D4|4- 17|RF2|J H4 | . . . . . H . . . . T . . . . . . . . . . . . . . . . . . . . . | . . . . . . . . . . . . | . . . . . . . . . . . . . . . . | V . . F. . . . . N.F. . . | . . . . . . . . . . . . . . . . . . R . . . . . . | R . . - - - . . . . . . . | . . . . . . . . . . |
| iPS:43 5833 | 21- 225_190D12 | VH3|3- 23|D4|4- 17|RF2|J H4 | . . . . . . . . . . . . . . . . . . . . . . . . . . . . . . . . . | . . . . . . . . . . . . | . . . . . . . D . . . . . . . . | . . . . . . . . . . I.N. . . . R . | . . . . . . . . . . . . . . . . . . . . . . . . . | M.R.S..... ...YGF... | . . . . . . . . . . |
| iPS:43 6156 | 21- 225_197C8 | VH3|3- 23|D4|4- 17|RF2|J H4 | . . . . . . . . . . . . . . . . . . . . . . . . . . . . . . . . . | . . . . . S . T . . . . | . . . . . . . . . . . . . . . . | . . . . . . . . . . I.N. . . . RA . . | . . . . . . . . . . . . . . . . . T . . . . . . . | R.YSRIA... ...VAGT... | . . . . . . . . . . |
| VH3|3- 21|D1|1- 1|RF1|JH4 | | EVQLLES GGGLVKPGGSLR LSCAASG-FTFS | S...VSMN | WVRQAPGK GLEWVS | SISSS SSIYYAL SVKG | RFTISRDNAKNSLYLQM NSLRAEDTAVYYCAR | CTIGT....YFDY | WGQGT LVTVSS |
| iPS:43 4157 | 21-225_55D4 | VH3|3- 21|D1|1- 1|RF1|JH 4 | . . . . . . . . . . . . . . . . . . . . . . . . . . . . . . . . N | . . . . . R . . . . . . | . . . . . . . . . . . . . . . . | . . . . . . . . . . NH.D. . . | . . . . . . . . . . . . . . . . . . L . . . . . . | - - - - - - . . . . . . . | . . . S . . . . . . |
| iPS:43 4243 | 21-225_62C1 | VH3|3- 21|D1|1- 1|RF1|JH 4 | . . . . . . . . . . . . . . . . . . . . . . . . . . . . . . . . . | . . . . . . . . . . . . | . . . . . . . . . . . . . . . . | . . . . . . . . . . . . . . . . | . . . . . . . . . . . . . . . . . . I . . . . . . | FG-----... ...-VD... | . . . . . . . . . . |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5505 | 21-225_157C1 | VH3|3-21/D1|1-1|RF1/JH4 | | ......R... | ...... | .M.N. .....S | | QAA--- ...-Q- | |
| iPS:39 2966 | 21-225_32G3 | VH3|3-21/D1|1-1|RF1/JH4 | | | | .........I | | .NIA- ..-R- | |
| | Germline | H_FR1 QVQLVES-GGGVVQPGRSLR LSCAASG-FTFS | H_CDR1 S----YSMH | H_FR2 WVRQAPGK GLEWVA | H_CDR2 VIWYD--GSNKYYAD SVKG | H_FR3 RFTISRDNSKNTLYLQM NSLRAEDTAVYYCAR | H_CDR3 NWGY-----------FDY | H_FR4 WGQGTL VTVSS |
| iPS:43 4159 | 21-225_55B8 | VH3|3-33/D7|7-27|RF3/JH4 | D...... | | EN..... | ......T | E.F--- | |
| iPS:39 3026 | 21-225_32B6 | VH3|3-33/D7|7-27|RF3/JH4 | D...... | | ENT.... | | E.---- | |
| | Germline | H_FR1 QVQLVES-GGGVVQPGRSLR LSCAASG-FTFS | H_CDR1 S----YSMH | H_FR2 WVRQAPGK GLEWVA | H_CDR2 VIWYD--GSNKYYAD SVKG | H_FR3 RFTISRDNSKNTLYLQM NSLRAEDTAVYYCAR | H_CDR3 V*QLV-----------YFDY | H_FR4 WGQGTL VTVSS |
| iPS:43 4165 | 21-225_50F2 | VH3|3-33/D6|6-6|RF3/JH4 | ..A... | | ......T | | DE.G.........T | |
| iPS:43 4191 | 21-225_56B6 | VH3|3-33/D6|6-6|RF3/JH4 | | | ......H | ......V | DE.G.........T | |
| | Germline | H_FR1 QVQLVQS-GAEVKRPGASVK VSCKASG-YTFT | H_CDR1 S----YAMH | H_FR2 WVRQAPGQ GLEWMG | H_CDR2 IINPS--GGSTSYAQ KFQG | H_FR3 RVTMTRDTSTSTVYMEL SSLRSEDTAVYYCAR | H_CDR3 DYGIYYY---------YYYGMDV | H_FR4 WGQGTT VTVSS |
| iPS:43 4171 | 21-225_50G4 | VH1|1-46/D4|4-17|RF2/JH6 | ..E... | | .V.N.R. | | ..R.G......F | |
| | Germline | H_FR1 QVQLVES-GGGVVQPGRSLR LSCAASG-FTFS | H_CDR1 S----YAMH | H_FR2 WVRQAPGK GLEWVA | H_CDR2 VISYD--GSNKYYAD SVKG | H_FR3 RFTISRDNSKNTLYLQM NSLRAEDTAVYYCAR | H_CDR3 DYGIY----------DAFDI | H_FR4 WGQGTM VTVSS |

(VH3|3-33/D7|7-27|RF3/JH4; VH3|3-33/D6|6-6|RF3/JH4; VH1|1-46/D4|4-17|RF2/JH6; VH3|3-30/D4|4-17|RF2/JH3 — germline identifiers)

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43-4175 | 21-225_55A11 | VH3\|3-30.3\|D4\|4-17\|RF2/JH3 | ..........G... | .....T.....V | .....T.. ..R. | | GR.R.SDY. .....GH... | |
| | Germline | QVQLVQS- GAEVKKPGASVK VSCKASG-YTFT | G------YYMH | WVRQAPGQ GLEWMG | WINPN- SGGTNYAQ KFQG | RVTMTRDTSISTAYMEL SRLRSDDTAVYYCAR | GTTGTV- ---------WYFDL | WGQGTL VTVSS |
| iPS:43-4193 | 21-225_56C6 | VH1\|1-02\|D1\|1-1\|RF1/JH2 | | D........H... | | R......V. | .A..N...... .G......... | DG.S-- --S..Y | |
| | Germline | QVQLVQS- GAEVKKPGASVK VSCKASG-YTFT | G------YYMH | WVRQAPGQ GLEWMG | WINPN- SGGTNYAQ KFQG | RVTMTRDTSISTAYMEL SRLRSDDTAVYYCAR | VEMAT- ---------TYFDY | WGQGTL VTVSS |
| iPS:43-4195 | 21-225_56F6 | VH1\|1-02\|D5\|5-24\|RF1/JH4 | ..........F... | D............ | | R............ | .............T..... | EGATRP ......TG.. | |
| | Germline | QVQLVQS- GGSVQPGRSLR LSCAASG-FTFS | S------YGMH | WVRQAPGK GLKWVA | VIWYD- GSNKYYAD SVKG | RFTISRDNSKNTLYLQM NSLRAEDTAVYYCAR | VDLEP- ----------YFDY | WGQGTL VTVSS |
| iPS:43-4203 | 21-225_60E2 | VH3\|3-33\|D1\|1-1\|RF2/JH4 | ...........N.. | D............ | ...Y...... | I......... EN............ | ......S............ | DV.D-- ...P... | |
| iPS:43-4229 | 21-225_61H1 | VH3\|3-33\|D1\|1-1\|RF2/JH4 | ...........N.. | D............ | ...Y...... | I.......... E............ | ...................  | DV.D-- ...P... | |
| | Germline | QVQLVQS- GAEVKKPGASVK VSCKASG-YTFT | G------YYMH | WVRQAPGQ GLEWMG | WINPN- SGGTNYAQ KFQG | RVTMTRDTSISTAYMEL SRLRSDDTAVYYCAR | GYSYGYYY -----YYGMDV | WGQGTT VTVSS |
| iPS:43-4209 | 21-225_60C3 | VH1\|1-02\|D5\|5-18\|RF3/JH6 | ..........S... | ..........H.I | ...Y...... | .........V... | I.......S.......... | .GLL.ATN ......Y.. | |
| iPS:43-4315 | 21-225_59G7 | VH1\|1-02\|D5\|5-18\|RF3/JH6 | ..........S... | ..........H.I | | .........V... | I.......S.......... | .GLL.ATN ......Y.. | ....T. |

| | | H_FR1 | H_CDR1 | H_FR2 | H_CDR2 | H_FR3 | H_CDR3 | H_FR4 |
|---|---|---|---|---|---|---|---|---|
| iPS:43 4225 | 21-225_60E12 | VH4\|4-59\|D4\|4-11\|RF3\|JH4 | ......... | ...F... | ........A.. | ....R..T... | ........M..... | EGK.GG..........VS.... | |
| iPS:43 4227 | 21-225_61A1 | VH4\|4-59\|D4\|4-11\|RF3\|JH4 | ......... | ...HF. | ........A.. | ....R..I... | ........M..... | EGK.GG..........VS.... | |
| iPS:43 4267 | 21-225_57F2 | VH4\|4-59\|D4\|4-11\|RF3\|JH4 | ......... | ........ | ........A.. | ....R..T... | ........M.I... | EGK.GG..........VS.... | |
| Germline | | H_FR1 EVQLVESG GGGLVQPGGSLR LSCAASG-FTFS | H_CDR1 SYAMS | H_FR2 WVRQAPGK GLEWVS | H_CDR2 AISGS GSTYYAD SVKG | H_FR3 RFTISRDNSKNTLYLQM NSLRAEDTAVYYCAR | H_CDR3 GYSYGY----------DAFDI | H_FR4 WGQGTM VTVSS |
| iPS:43 4239 | 21-225_58F1 | VH3\|3-23\|D5\|5-18\|RF3\|JH3 | ......... | ........ | ............ | ....TG...... | ............... | RGV.D.........F......... | |
| iPS:43 4309 | 21-225_59B5 | VH3\|3-23\|D5\|5-18\|RF3\|JH3 | ......... | ....N... | ............ | ...N.F...... | ............... | RGV.D.........YE........ | |
| Germline | | H_FR1 QVQLVESG GGGVVQPGRSLR LSCAASG-FTFS | H_CDR1 SYGMH | H_FR2 WVRQAPGK GLEWVA | H_CDR2 VIWYD GSNKYYAD SVKG | H_FR3 RFTISRDNSKNTLYLQM NSLRAEDTAVYYCAR | H_CDR3 VDTAM----------VFFDY | H_FR4 WGQGTL VTVSS |
| iPS:43 4245 | 21-225_62H1 | VH3\|3-33\|D5\|5-18\|RF1\|JH4 | ......... | ........ | ......M..... | .....QI..... | .............L... | E.PRT.......SCS...... | |
| iPS:43 4323 | 21-225_62H8 | VH3\|3-33\|D5\|5-18\|RF1\|JH4 | ......... | ...T... | ............ | ....H.D..V.. | ............... | E.PRT.......SCS...... | |
| iPS:43 4379 | 21-225_66A9 | VH3\|3-33\|D5\|5-18\|RF1\|JH4 | ......... | ........ | ............ | ....H.D..... | ............... | E.PRT.......SCS...... | |
| Germline | | H_FR1 QVQLVESG GGGVVQPGRSLR LSCAASG-FTFS | H_CDR1 SYGMH | H_FR2 WVRQAPGK GLEWVA | H_CDR2 VIWYD GSNKYYAD SVKG | H_FR3 RFTISRDNSKNTLYLQM NSLRAEDTAVYYCAR | H_CDR3 VHWND----------VFDY | H_FR4 WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 4247 | 21-225_62D2 | VH3/3-33/D1|1-1|RF3/JH4 | ...Y............. | ................. | ................. | .......S......... | ................. | D.G.W....N.L. | ................. |
| iPS:43 6838 | 21-225_52H4 | VH3/3-33/D1|1-1|RF3/JH4 | ................. | H......F......... | ......K.......... | ................. | ................. | GD.Y....EG... | ................. |
| iPS:43 6948 | 21-225_183F5 | VH3/3-33/D1|1-1|RF3/JH4 | ................. | ............L.... | ................. | .......G......... | ................. | E.FW-....SG... | ................. |
| | Germline | VH4|4-39|D5|5-12|RF3/JH4 | H_FR1 QVQLQES GAEVKKPGASVK VSCKASG-YTFT | H_CDR1 SS SYYWG | H_FR2 WIRQPPGK GLEWIG | H_CDR2 SIYY SGSTYYNP SLKS | H_FR3 RVTISVDTSKNQFSLKL SSVTAADTAVYYCAR | H_CDR3 CVSGYD---------YFDY | H_FR4 WGQGTL VTVSS |
| iPS:43 4249 | 21-225_62E2 | VH4|4-39|D5|5-12|RF3/JH4 | .......I......... | R................ | ................. | ..IAS............ | N....T........... | LS..W---...-S... | ................. |
| iPS:43 4353 | 21-225_64B12 | VH4|4-39|D5|5-12|RF3/JH4 | ............V.... | R................ | ................. | ......S.......... | ................. | LD..W---...-S... | ................. |
| iPS:39 4073 | 21-225_15C9 | VH4|4-39|D5|5-12|RF3/JH4 | ................. | R................ | ................. | N.....N........... | .....G........... | QG..W----.-EV... | ................. |
| | Germline | VH1|1-02|D7|7-27|RF1/JH4 | H_FR1 QVQLVQS GAEVKKPGASVK VSCKASG-YTFT | H_CDR1 G YYMH | H_FR2 WVRQAPGQ GLEWMG | H_CDR2 WINPN SGGTNYAQ KFQG | H_FR3 RVTMTRDTSISTAYMEL SRLRSDDTAVYYCAR | H_CDR3 ICY------FDY | H_FR4 WGQGTL VTVSS |
| iPS:43 4259 | 21-225_62G7 | VH1|1-02|D7|7-27|RF1/JH4 | ................. | ................. | ................. | ..K.K.Q.......... | ................. | AP.IAAAG.....TWGY. | ................. |
| iPS:43 4347 | 21-225_64H10 | VH1|1-02|D7|7-27|RF1/JH4 | ................. | ................. | ................. | ..K...Q.......... | ................. | AP.TAATG.....TWGY. | ................. |
| iPS:43 4359 | 21-225_65G3 | VH1|1-02|D7|7-27|RF1/JH4 | ................. | ........I........ | ................. | .......S......... | ................. | AP.KAAAG.....TWGY. | ................. |

Figure 52 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| | | | EVQLLES GGGLVQPGGSLR LSCAASG FTFS | S YAMS VLN | WVRQAPGK GLEWVS | AISGS GGSTYYAD SVKG | RFTISRDNSKNTLYLQM NSLRAEDTAVYYCAK | AP. TAAAG.......TFDY | WGQGT VTVSS |
| iPS:43 4369 | 21-225_66B1 | VH1}1-02/D7|7-27|RF1/J H4 | | | | ...N | ...A | AP.TAAAG.......TWGY | |
| iPS:43 4373 | 21-225_66A7 | VH1}1-02/D7|7-27|RF1/J H4 | | | | ...K...Q | ...G | AP.TVAAG.......TWGY | |
| iPS:43 4397 | 21-225_67H4 | VH1}1-02/D7|7-27|RF1/J H4 | | | | ...K...Q | ..G | AP.TAATG.......TWGY | |
| iPS:43 4427 | 21-225_70D6 | VH1}1-02/D7|7-27|RF1/J H4 | ..I | | | ...K...S | ..S...G...E | AP.KAAAG.......TWGF | |
| iPS:43 4435 | 21-225_70G9 | VH1}1-02/D7|7-27|RF1/J H4 | | | | ...K...Q | ..RG...S | AP.IAAAG.......TWGY | |
| iPS:43 4437 | 21-225_70A12 | VH1}1-02/D7|7-27|RF1/J H4 | | | | ...K...Q | ..G | AP.TAATG.......TWGY | |
| iPS:43 4451 | 21-225_71B7 | VH1}1-02/D7|7-27|RF1/J H4 | ..I | | | ...S | ..G | AP.KAAAG.......TWGF | |
| iPS:43 4459 | 21-225_71A7 | VH1}1-02/D7|7-27|RF1/J H4 | | | | ...K...V | ..S | AP.TAPAG.......SWGY | |
| iPS:43 4461 | 21-225_73A3 | VH1}1-02/D7|7-27|RF1/J H4 | | | ..D | ...HV | ..A...S | AP.TAAAG.......SWGC | |
| VH3}3-23/D4|4-11|RF3/J H4 | | | | | | M...R | | ..H— | |
| iPS:43 4261 | 21-225_56F7 | VH3}3-23/D4|4-11|RF3/J H4 | | | | | F..M | | |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5461 | 21-225_153A1 | VH3\|3-23\|D4\|4-11\|RF3/JH4 | ........... | V... | ...G.... | ........... | .R...... | .AT-...... | ........ |
| iPS:43 5509 | 21-225_157H1 | VH3\|3-23\|D4\|4-11\|RF3/JH4 | ......S.. | .R | .I..... Q.. | ........... | ........... | ...-K.... | ........ |
| iPS:43 5747 | 21-225_175C4 | VH3\|3-23\|D4\|4-11\|RF3/JH4 | ....A..... | V... | ....D..T.. | ....DR..... | ....D.NT..R | .Y-...... ..L | ........ |
| iPS:39 2784 | 21-225_23C7 | VH3\|3-23\|D4\|4-11\|RF3/JH4 | ........... | V... | ........... | ....DR..... | ........R | .AG-...... | ........ |
| iPS:39 2802 | 21-225_23E7 | VH3\|3-23\|D4\|4-11\|RF3/JH4 | .........T | ..... | ........... | ....M....V | ........R | .G.-...... | ....I... |
| iPS:39 2962 | 21-225_30A1 | VH3\|3-23\|D4\|4-11\|RF3/JH4 | ........... | V.N | ........... | ....F...... | ....R....R | .SG-...... | ........ |
| iPS:39 3090 | 21-225_33A5 | VH3\|3-23\|D4\|4-11\|RF3/JH4 | ........... | VIN | ........... | ....V...... | ......N..R | .G.-...... | ........ |
| VH3\|3-23\|D1\|1-11\|RF3\|JH4 | Germline | | EVQLLES GGGLVQPGGSLR LSCAASG-FTFS | S----YAMS | WVRQAPGK GLEWVS | AISGS GGSTYYAD SVKG | RFTISRDNSKNTLYLQM NSLRAEDTAVYYCAK | VWWD-------YFDV | WGQGTL VTVSS |
| iPS:43 4273 | 21-225_57E4 | VH3\|3-23\|D1\|1-1\|RF3\|JH4 | ........... | ........... | ........... | ....V...... ....F...... | ........T | RD........V | ........ |
| VH3\|3-23\|D3\|3-3\|RF3\|JH4 | Germline | | EVQLLES GGGLVQPGGSLR LSCAASG-FTFS | S----YAMS | WVRQAPGK GLEWVS | AISGS GGSTYYAD SVKG | RFTISRDNSKNTLYLQM NSLRAEDTAVYYCAK | TIFGVV-------YFDY | WGQGTL VTVSS |
| iPS:43 4279 | 21-225_57F7 | VH3\|3-23\|D3\|3-3\|RF3\|JH4 | ........... | ........... | ........... | ....N.F.... | ........... | FFGVVG-...V GC... | ........ |

| | Germline | H_FR1 | H_CDR1 | H_FR2 | H_CDR2 | H_FR3 | H_CDR3 | H_FR4 |
|---|---|---|---|---|---|---|---|---|
| iPS:43_4311 | VH3-33/D3-22/RF3/JH5 | QVQLQES GPGLVKPSETLS LTCTVSG_GSIS | SS...SYYWG | WIRQPPGK GLEWIG | SIYY...SGSTYYNP SLKS | RVTISVDTSKNQFSLKL SSVTAADTAVYYCAR | ERG.A.G--- | WGQGT LVTVSS |
| iPS:43_4313 | VH4-39/D1-26/RF3/JH4 | . . . . . . . . . . . . . . . . . . . . . . . . . | R . . . . . . | . . . . . . . . . . . . . . | N . . . . . . . . . . . . | . . . . . . . . . . . . . . . . . . . . . . . . . . . . . . . . . . . . | H.S.W. . . . . . -SL. . | . . . . . . . . . . . |
| iPS:43_4413 | VH4-39/D1-26/RF3/JH4 | . . . . . . . . . . . . . . . . . . . . . . . . . | R . . . . . . | . . . . . . . . . . . . . . | N . . . . . . . . . . . I. . | . . . . . . . . . . . . . T . . . . . . . . . . . . . . . . . . . . . . . | H.T.W. . . . . . -SI. . | . . . . . . . . . . . |
| iPS:39_2628 | VH4-39/D1-26/RF3/JH4 | . . . . . . . . . . . . . . . . . . . . . . . . . | R . . . . . . | . . . . . . . . . . . . . . | N . . . . . . TA.C.S | . . . . . . . I . . . . . . . . . T . . . . . . . . . . . . . . . . . . . | H.S.W. . . . . . -SL.N | . . . . . . . . . . . |
| iPS:39_2642 | VH4-39/D1-26/RF3/JH4 | . . . . . . . . . . . . . . . . . . . . . . . . . | R . . . . . . | . . . . . . . . . . . . . . | N . . . . . . . . Y . . T | . . . . . . . I . . . . . . . . . . . . . . . . . . . . . . . . . . . . . | H.T.W. . . . . . -SI. . | . . . . . . . . . . . |
| iPS:39_2706 | VH4-39/D1-26/RF3/JH4 | . . . . . . . . . . . . . . . F . . . . . . . . . | R . . . . . . | . . . . . . . . . . . . . . | N . . . . . . . . Y . . T | . . . . . . . . . . . . . . . . . . . . . . R . . . . . . . . . . . . . . | H.S.W. . . . . . -SL.D | . . . . . . . . . . . |
| iPS:39_2800 | VH4-39/D1-26/RF3/JH4 | . . . . . . . . . . . . . . . . . . . . . . . . . | R . . . . . . | . . . . . . . . . . . . . . | N . . . . . . . . T.S. . | . . . . . . . . . . . . . . . . . . . . . . F . . . . . . . . . . . . . . | H.T.W. . . . . . -SL. . | . . . . . . . . . . . |
| iPS:39_2820 | VH4-39/D1-26/RF3/JH4 | . . . . . . . . . . . . . . . . . . . . . . . . . | R . . . . . . | . . . . . . . . . . . . . . | . . . . . . . . . . . AQ. . . | . . . . . . . . . . . . . . . . . . . . . . L . . . . . . . . . . . . . . | L.S.W. . . . . . -SV. . | . . . . . . . . . . . |
| iPS:39_2824 | VH4-39/D1-26/RF3/JH4 | . . . . . . . . . . . . . . . . A . . . . . . . . | R . . . . . . | . . . . . . . . . . . . . . | . . . . . . . . . . . AN. . . | . . . . . . . . . . . . . . . . . . . . . . . . . . . . . . T . . . . . . | L.S.W. . . . . . -S. . . | . . . . . . . . . . . |
| iPS:39_2834 | VH4-39/D1-26/RF3/JH4 | . . . . . . . . . . . . . . . . . . . . N . . . . | R . . . . . . | . . . . . . . . . . . . . . | N . . . . . . . . A . . . S | . . . . . . . . . . . . . . . . . . . . . . T . . . . . . . . . . . . . . | H. . .W. . . . . -SL. . | . . . . . . . . . . . |

Figure 52 (Continued)

| | | | | | | | |
|---|---|---|---|---|---|---|---|
| iPS:39 2870 | 21-225_20G9 | VH4|4-39/D1|1-26|RF3/J H4 | ......... | R......... | ....AS. | R......... | L.S.W.....-S... |
| iPS:39 2896 | 21-225_21G7 | VH4|4-39/D1|1-26|RF3/J H4 | ....F.... | R......... | ...Q.N..YS. | .......A.. | H.T.W.....-SL.. |
| iPS:39 2904 | 21-225_22G9 | VH4|4-39/D1|1-26|RF3/J H4 | .......A. | G...N..... | ....E..... | ......... | H.S.W.....-SL.. |
| iPS:39 3094 | 21-225_34C4 | VH4|4-39/D1|1-26|RF3/J H4 | ......... | R......... | .S....A... | R...E....V | L.S.W.....-S... |
| iPS:39 3806 | 21-225_6A6 | VH4|4-39/D1|1-26|RF3/J H4 | ......... | R......... | ...N..IP.. | .N........ | H.S.W.....-SL.. |
| iPS:39 3814 | 21-225_7F4 | VH4|4-39/D1|1-26|RF3/J H4 | ......... | R....S.... | ...N...A.. | ...T...... | H..W.....-SL... |
| iPS:39 3816 | 21-225_6D4 | VH4|4-39/D1|1-26|RF3/J H4 | ......H.. | R......... | ...N...A.I | ....A...N. | H.S.W.....-SL.C |
| iPS:39 3880 | 21-225_15A1 | VH4|4-39/D1|1-26|RF3/J H4 | ......... | R....S.... | ....AQ.... | ...T...T.. | L.S.W.....-S... |
| iPS:39 4002 | 21-225_15G7 | VH4|4-39/D1|1-26|RF3/J H4 | ......H.. | R......... | ....Y..T.. | ...S....R. | L.S.W.....-S..F |
| iPS:39 4053 | 21-225_11F10 | VH4|4-39/D1|1-26|RF3/J H4 | ....F.... | R......... | ....AQ.... | .......T.. | L.S.W.....-S... |
| iPS:39 4057 | 21-225_15H1 | VH4|4-39/D1|1-26|RF3/J H4 | ......... | R......... | ...N..YP.. | .G....A... | H.T.W.....-SL.. |
| iPS:39 4063 | 21-225_16A1 | VH4|4-39/D1|1-26|RF3/J H4 | .....I..D | R......... | ....A.H... | ......... | L.S.W.....-S... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 4075 | VH4|4-39/D1|1-26|RF3/JH4 | ........F........ | R........ | ........ | ....N..... ..YP | ........I......... | H.T.W.....-SL.. | ........ |
| | Germline | H_FR1 | H_CDR1 | H_FR2 | H_CDR2 | H_FR3 | H_CDR3 | H_FR4 |
| | VH3|3-48/D7|7-27|RF3/JH4 | EVQLVES GGGLVQPGGSLR LSCAASG.FTFS | S....YSMN | WVRQAPGK GLEWVS | SSISSS SSTIYYAD SVKG | RFTISRDNAKNSLYLQM NSLRAEDTAVYYCAR | KWGY -------TDY | WGQGTL VTVSS |
| iPS:43 4317 | VH3|3-48/D7|7-27|RF3/JH4 | ........ | ........ | ....G...... | ........G....... | ........ | E..MAV.. .....AGP... | ........ |
| | Germline | H_FR1 | H_CDR1 | H_FR2 | H_CDR2 | H_FR3 | H_CDR3 | H_FR4 |
| | VH3|3-33/D1|1-26|RF3/JH4 | EVQLVES GGGVVQPGRSLR LSCAASG.FTFS | S....YSMH | WVRQAPGK GLEWVA | VIWYD GSNKYYAD SVKG | RFTISRDNSKNTLYLQM NSLRAEDTAVYYCAR | YSGSY -----YYDY | WGQGTL VTVSS |
| iPS:43 4327 | VH3|3-33/D1|1-26|RF3/JH4 | ........ | ........ | ........T...... | ........ | ........ | D.L.GI... .....AAA... | ........ |
| iPS:43 7084 | VH3|3-33/D1|1-26|RF3/JH4 | ........ | ........ | ........ | ........ | ....N....... | EG....... ......-HL... | ........I |
| iPS:43 7088 | VH3|3-33/D1|1-26|RF3/JH4 | ........ | ........ | ........ | ........ | ....N....... | EG....... ......-HL... | ........I |
| iPS:39 2684 | VH3|3-33/D1|1-26|RF3/JH4 | ........ | ........ | ........ | ....N..H... | ........ | SGSY- .....S ....-F... | ........ |
| | Germline | H_FR1 | H_CDR1 | H_FR2 | H_CDR2 | H_FR3 | H_CDR3 | H_FR4 |
| | VH1|1-02/D6|6-19|RF2/JH4 | QVQLVQS GAEVKKPGASVK VSCKASG.YTFT | S....YGMH | WVRQAPGQ GLEWMG | WINPN SGGTNYAQ KFQG | RVTMTRDTSISTAYMEL SRLRSDDTAVYYCAR | GLAVA ......GYFDY | WGQGTL VTVSS |
| iPS:43 4333 | VH1|1-02/D6|6-19|RF2/JH4 | ........ | ........ | ........ | ........F.... | ....A..N....... | APG..AAG. .....SW..... | ........ |
| | Germline | H_FR1 | H_CDR1 | H_FR2 | H_CDR2 | H_FR3 | H_CDR3 | H_FR4 |
| | VH3|3-33/D4|4-11|RF2/JH4 | QVQLVES GGGVVQPGRSLR LSCAASG.FTFS | S....YGMH | WVRQAPGK GLEWVA | VIWYD GSNKYYAD SVKG | RFTISRDNSKNTLYLQM NSLRAEDTAVYYCAR | DVSNY ......YFDY | WGQGTL VTVSS |

| | Germline | H_FR1 | H_CDR1 | H_FR2 | H_CDR2 | H_FR3 | H_CDR3 | H_FR4 |
|---|---|---|---|---|---|---|---|---|
| iPS:43 21-225_64A12 | VH3\|3-33\|D7\|7-27\|RF2\|JH1 | ................................. | ................. | ................. | E.....V ......... | ................................. | E..F- ...LSD. | ................. |
| iPS:39 21-225_16E12 | VH3\|3-33\|D7\|7-27\|RF2\|JH1 | ..............L.. | ....N............ | ................. | .....E....V ..R.. | .............S... | E..F- ...QSD. | ...........P..... |
| iPS:39 21-225_19A10 | VH3\|3-33\|D7\|7-27\|RF2\|JH1 | ................. | ................. | ................. | .....E........... | ................. | E.AW- ....EDS | ................. |
| iPS:39 21-225_9D12 | VH3\|3-33\|D7\|7-27\|RF2\|JH1 | ................. | ....D............ | ................. | ...N.N........... | ................. | E.AW- ....EDF | ................. |
| Germline VH3\|3-23\|D3\|3-22\|RF2\|JH3 | | EVQLLES GGGLVQPGGSLR LSCAASG-FTFS | S------YAMS | WVRQAPGK GLEWVS | AISGS GGSTYYAD SVKG | RFTISRDNSKNTLYLQM NSLRAEDTAVYYCAR | VYTDSSGY VYDAFDI | WGQGTLV TVTSS |
| iPS:43 21-225_64G12 | VH3\|3-23\|D3\|3-22\|RF2\|JH3 | ................. | ................N | ................. | ........V........ | ...............L. | RN..D---- | ................. |
| Germline VH3\|3-21\|D4\|4-11\|RF3\|JH4 | | EVQLLES GGGLVKPGGSLR LSCAASG-FTFS | S------YSMN | WVRQAPGK GLEWVS | SISSS SSYIYYAD SVKG | RFTISRDNAKNSLYLQM NSLRAEDTAVYYCAR | TTVT- ----AFDY | WGQGTL VTVSS |
| iPS:43 21-225_65H11 | VH3\|3-21\|D4\|4-11\|RF3\|JH4 | ................. | .....R........... | ................. | ...N.S........... | ..........T...... | S---- ......... | ................. |
| iPS:43 21-225_55H6 | VH3\|3-21\|D4\|4-11\|RF3\|JH4 | ......H.......... | ................. | ................. | .....G........... | ...............TS | G.--- ---GS | ................. |
| iPS:40 21-225_23D11 | VH3\|3-21\|D4\|4-11\|RF3\|JH4 | ................. | ........NI....... | ................. | ...GN.... ...G... | ................. | NL--- ......... | ................. |
| | Germline VH3\|3-21\|D4\|4-11\|RF3\|JH3 | H_FR1 | H_CDR1 | H_FR2 | H_CDR2 | H_FR3 | H_CDR3 TTVTD-------AFDI | H_FR4 WGQGTLV TVTSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 4383 | VH3/3-21/D4/4-11/JRF3/JH3 | | | | ..GT. | ..G. | .NA--- | |
| iPS:43 4449 | VH3/3-21/D4/4-11/JRF3/JH3 | | | | ..GT. | ..G.....F..K | .NA--- | |
| Germline | | H_FR1 | H_CDR1 | H_FR2 | H_CDR2 | H_FR3 | H_CDR3 | H_FR4 |
| VH3/3-33/D6/6-6/RF2/JH4 | | EVQLVES GGGLVQPGGSLR LSCAASG-FTFS | S...YSMH | WVRQAPGK GLEWVA | VISYD GSNKYYAD SVKG | RFTISRDNSKNTLYLQMNSLRAEDTAVYYCAR | ...SIAAR -----YFDY | WGQGTL VTVSS |
| iPS:43 4399 | VH3/3-33/D6/6-6/RF2/JH4 | | N........ | | L. | | .PE- | |
| iPS:43 4463 | VH3/3-33/D6/6-6/RF2/JH4 | | Y........ | | L....K....A | | .PD- | |
| Germline | | H_FR1 | H_CDR1 | H_FR2 | H_CDR2 | H_FR3 | H_CDR3 | H_FR4 |
| VH3/3-21/D1/1-26/RF3/JH4 | | EVQLVES GGGLVKPGGSLR LSCAASG-FTFS | S...YSMN | WVRQAPGK GLEWVS | SISSS SSYIYAD SVKG | RFTISRDNAKNSLYLQMNSLRAEDTAVYYCAR | ....YFDY | WGQGTL VTVSS |
| iPS:43 4405 | VH3/3-21/D1/1-26/RF3/JH4 | | .....FG. | | Y..R. | | .S...-P | |
| iPS:43 5595 | VH3/3-21/D1/1-26/RF3/JH4 | | S........ | | .....H. | | K..W--- | |
| iPS:43 5635 | VH3/3-21/D1/1-26/RF3/JH4 | | .....R. | | ...G..D | ...T..... | .S----- | |
| iPS:43 225_163F1 | VH3/3-21/D1/1-26/RF3/JH4 | | .....D | | ...G | ...S.D......TL | ---SH | |
| Germline | | H_FR1 | H_CDR1 | H_FR2 | H_CDR2 | H_FR3 | H_CDR3 | H_FR4 |
| VH3/3-30.3/D2/2-15/RF2/JH4 | | EVQLVES GGGLVQPGGSLR LSCAASG-FTFS | S...YAMH | WVRQAPGK GLEWVS | VISYD GSNKYYAD SVKG | RFTISRDNSKNTLYLQMNSLRAEDTAVYYCAR | DIYYYA ----AYFDY | WGQGTL VTVSS |
| iPS:43 4417 | VH3/3-30.3/D2/2-15/RF3/JH4 | | N........ | | ...W..D | ........I. | .PSN--- SAG.. | |
| | | H_FR1 | H_CDR1 | H_FR2 | H_CDR2 | H_FR3 | H_CDR3 | H_FR4 |

Figure 52 (Continued)

| | | QVQLVES<br>GGGLVQPGRSLR<br>LSCAASG-FTFS | S...YGMH | WVRQAPGK<br>GLEWVA | VIWYD<br>GSNKYYA<br>DSVKG | RFTISRDNSKNTLYLQM<br>NSLRAEDTAVYYCAR | VLLWFSE<br>------LL-YFDY | WGQGT<br>LVTVSS |
|---|---|---|---|---|---|---|---|---|
| | VH3\|3-<br>33\|D3\|3-<br>10\|RF1\|J<br>H4 | H_FR1 | H_CDR1 | H_FR2 | H_CDR2 | H_FR3 | H_CDR3 | H_FR4 |
| iPS:43<br>4433 | 21-225_70E8 | | | | I...<br>E.... | | D..D----<br>-PR... | |
| | | Germline | | | | | | |
| | | EVQLLES<br>GGGLVQPGGSLR<br>LSCAASG-FTFS | S...YAMS | WVRQAPGK<br>GLEWVS | AISGS<br>GGSTYYAD<br>SVKG | RFTISRDNSKNTLYLQM<br>NSLRAEDTAVYYCAK | GYSSSW<br>-YFDY.... | WGQGT<br>LVTVSS |
| | VH3\|3-<br>23\|D6\|6-<br>13\|RF1\|J<br>H4 | H_FR1 | H_CDR1 | H_FR2 | H_CDR2 | H_FR3 | H_CDR3 | H_FR4 |
| iPS:43<br>4467 | 21-225_73H8 | ...S..... | ....N... | | D..R....<br>..T.F.. | | WD...Y..<br>.....DVTP.... | |
| | | Germline | | | | | | |
| | | QVQLQQW<br>GAGLLKPSETLS<br>LTCAVYG-GSFS | G...YYWS | WIRQPPGK<br>GLEWIG | YIYH<br>SGSTNYNP<br>SLKS | RVTISVDTSKNQFSLKL<br>SSVTAADTAVYYCAR | DYRDY<br>-YFDY | WGQGT<br>LVTVSS |
| | VH4\|4-<br>34\|D4\|4-<br>17\|RF2\|J<br>H4 | H_FR1 | H_CDR1 | H_FR2 | H_CDR2 | H_FR3 | H_CDR3 | H_FR4 |
| iPS:43<br>4471 | 21-225_75G3 | .......L. | ....S... | | ....L... | ....S...T..... | ...G-<br>..-L... | |
| iPS:43<br>4517 | 21-225_76A7 | | ....C... | | ....R... | ....E......... | ...G-<br>..-L... | ....A. |
| iPS:43<br>4519 | 21-225_74C7 | .......L. | ....S... | | ....L... | ....S...T..... | ...G-<br>..-L... | |
| iPS:43<br>4571 | 21-225_74D2 | | ....C... | | ....R... | ....E......... | ...G-<br>..-L... | |
| iPS:43<br>4637 | 21-225_78E7 | .......L. | ....S... | | ....L... | ....S...T..... | ...G-<br>..-L... | |
| iPS:43<br>4717 | 21-225_80A6 | | ....C... | | ....R... | ....EK........ | ...G-<br>..-L... | |
| iPS:43<br>4735 | 21-<br>225_80B10 | | ....C... | | | | ...G-<br>..-L... | |

Figure 52 (Continued)

| | | | | | | | | |
|---|---|---|---|---|---|---|---|---|
| iPS:43 4835 | 21-225_83B6 | VH4|4-34|D4|4-17|RF2|J H4 | ......... | .C... | ..... ..... | .R... | E..... | .G- ..... -L... |
| iPS:43 4849 | 21-225_83C10 | VH4|4-34|D4|4-17|RF2|J H4 | ........T | ..... | ..... ..... | ..... ..F.. | F..... | .G- ..... -L... |
| iPS:43 4891 | 21-225_85G6 | VH4|4-34|D4|4-17|RF2|J H4 | ......... | D..C... | ..... ..... | .R... | E..... | .G- ..... -L... |
| iPS:43 5183 | 21-225_93E9 | VH4|4-34|D4|4-17|RF2|J H4 | ......G | A..... | ..... ..... | .R... | E.K... | .G- ..... -L... |
| iPS:43 5331 | 21-225_147G8 | VH4|4-34|D4|4-17|RF2|J H4 | ......... | ..C... | ..... ..... | .K... ..Q.. | ..... | .V- ..... ..... |
| iPS:43 5995 | 21-225_192F8 | VH4|4-34|D4|4-17|RF2|J H4 | ......... | ..P... | ..... ..... | .RS. R.... | T..... | .V- ..... ..... |
| iPS:43 6027 | 21-225_193E6 | VH4|4-34|D4|4-17|RF2|J H4 | .....F. | Y...... | ..S.. ..F.. | .S... .R... | ..R... | .G- ..... -L... |
| iPS:43 6080 | 21-225_195B1 | VH4|4-34|D4|4-17|RF2|J H4 | ......R | P...... | ..... ..... | .R... | R..... | .A- ..... -L... |
| iPS:43 6232 | 21-225_201E1 | VH4|4-34|D4|4-17|RF2|J H4 | ....FD.. | V...T | ..... ..... | .V... | ..... | ..... ...I |
| iPS:43 6238 | 21-225_201B2 | VH4|4-34|D4|4-17|RF2|J H4 | ...F... | P..... | ..... ..... | ..... | ..... | .G- ..... -L... |
| iPS:43 6256 | 21-225_202D9 | VH4|4-34|D4|4-17|RF2|J H4 | ...D... | V-.... | ..... ..... | ..... | ..... | .V- ..... ..... |
| iPS:43 6302 | 21-225_205G7 | VH4|4-34|D4|4-17|RF2|J H4 | ......... | ..... | ..... ..... | S.Q. .R.T. | ..I... N..... | .V- ..... ..... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| Germline | VH4|4-34|D4|4-17|RF2|JH4 | QVQLQES-SGGVVQPGRSLR LSCAASG-FTFS | S----YGMH | MVRQAPGK GLEWVA | VIWYD-GSNKYYAD SVKG | RFTISRDNSKNTLYLQM NSLRAEDTAVYYCAR | DIVVVVAA-----TAEYFQH | WGQGTL VTVSS |
| iPS:43 6310 | 21-225_202D11 | ..........A......... R....... P.... | ................ | ............................. | ......................... | .............................................................. | ..V-..........-L... | ..................... |
| iPS:43 6336 | 21-225_208B5 | .............F....I. | V........T | ...................... | .......................... | .............................................................. | ..V-..........-L... | ..................... |
| iPS:43 6340 | 21-225_208A9 | ....................P | V........S | ....................... | ........RA.... | ..........I................................................ | ..V-..........-L... | ..................... |
| iPS:43 7340 | 21-225_75G9 | ..................... | .......C | ...................... | ........R.... | ..................E....................................... | ..G-..........-L... | ..................... |
| iPS:45 1122 | 21-225_200A1 | ..................... | V........ | ...................... | .......................... | ..................L........................................ | ..V-..........-L... | ..................... |
| Germline | VH3|3-33|D2|2-15|RF3|JH1 | QVQLQES-GPGLVKPSETLS LTCTVSG-GSIS | SS----SYWG | WIRQPPGK GLEWIG | SIYY-SGSTYYNP SLKS | EVTISVDTSKNQFSLKL TGM | DIGM----------MEDP | WGQGTL VTVSS |
| iPS:43 4485 | 21-225_76D2 | ..................... | ................ | ............................. | .......................... | .............................................F......S | .RNI.G-------T..ES | ..................... |
| iPS:43 4537 | 21-225_74E11 | ..................... | ................ | ............................. | .......................... | .............................................F......S | .RNI.G-------T..ES | ..................... |
| iPS:43 4673 | 21-225_74E3 | ..................T | ................ | ............................. | .......................... | .............................................F......S | .RNI.G-------T..ES | ..................... |
| iPS:45 5221 | 21-225_95G2 | ..................T | ................ | ............................. | .......................... | .............................................F......S | .RNI.G-------T..ES | ..................... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS.43 4503 | 21-225_74D7 | VH4|4-39/D7|7-27|RF1/JH5 | ......R.......S ...............F | | | .........G.........E | RP.W......D..Y | |
| | Germline VH3|3-15|D1|1-1|RF2|JH4 | EVQLVESG GGLVKPGGSLR LSCAASGFTFS | ......AMS | WVRQAPGK GLEWVG | RIKSKT DGGTTYA AEVKG | RFTISRDDSKNTLYLQM NSLKTEDTAVYYCTT | YFDY | WGQGTL VTVSS |
| iPS.43 4531 | 21-225_76C9 | VH3|3-15|D1|1-1|RF2|JH4 | .............S.. | | | .........N.A. ...........F | .........H. | .GPT-- | |
| iPS.43 4633 | 21-225_74G8 | VH3|3-15|D1|1-1|RF2|JH4 | | ........N | | .........N.A. | | .GAT- ...-T. | |
| iPS.43 4671 | 21-225_74F4 | VH3|3-15|D1|1-1|RF2|JH4 | | ........N | | .........N.I. | | .GAT- ...-T. | |
| iPS.43 7383 | 21-225_74H8 | VH3|3-15|D1|1-1|RF2|JH4 | .......H...... | ........N | | | | .GAT- ...-T. | |
| | Germline VH3|3-33|D5|5-18|RF3|JH4 | EVQLVESG GGVVQPGRSLR LSCAASGFTFS | ......S YGMH | WVRQAPGK GLEWVA | VIWYD GSNKYYAD SVKG | RFTISRDNSKNTLYLQM NSLRAEDTAVYYCAR | GYSYG YYPDY | WGQGTL VTVSS |
| iPS.43 4535 | 21-225_74C8 | VH3|3-33|D5|5-18|RF3|JH4 | | | | .........N | | DG...Y......DGL. | |
| iPS.43 4573 | 21-225_77E6 | VH3|3-33|D5|5-18|RF3|JH4 | .............S.. | | | .........QN | .........F | DG...Y......DGL. | |
| iPS.43 4615 | 21-225_76C5 | VH3|3-33|D5|5-18|RF3|JH4 | | | | .........N | | DG...Y......DGL. | |
| iPS.43 4669 | 21-225_79F4 | VH3|3-33|D5|5-18|RF3|JH4 | .......N..... .............S.. | | | .........QN | .........F | DG...Y......DGL. | |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 4737 | VH3|3-33/D5|5-18|RF3/JH4 | ..................... | .......... | ............... | ........N... | ..................................... | DG...Y......DGL... | .... |
| iPS:43 4741 | VH3|3-33/D5|5-18|RF3/JH4 | ..................... | .......... | ............... | ........N... | ..................................S.. | DG...Y......DGL... | .... |
| iPS:43 4867 | VH3|3-33/D5|5-18|RF3/JH4 | ..................... | .......... | ............... | ........N... | ..................................... | DG...Y......DGL... | ..A. |
| VH4|4-34|D3|3-10|RF2/JH6 | Germline | EVQLVESG GGLVQPGGSLR LSCAASG FTFS | S YWS | WVRQAPGK GLEWIS | YIWS SGSTNYNP SLKS | RFTISRDNSKNTLYLQM NSLRAEDTAVYYCAR | VYYGSSSYN YYYYGMDV | WGQGTT VTVSS |
| iPS:43 4539 | VH4|4-34/D3|3-10|RF2/JH6 | .....V................ | D......... | ............... | .....D...... | ..................................... | EFPY...........--- | .... |
| iPS:43 7248 | VH4|4-34/D3|3-10|RF2/JH6 | .....V........T....... | D......... | ............... | .....D...... | ..................................... | EFPY..L........--- | .... |
| iPS:43 7320 | VH4|4-34/D3|3-10|RF2/JH6 | .....V...H....T....... | D......... | ............... | .....D...... | ..................................... | EFPY..L........--- | .... |
| VH3|3-13|D3|3-9|RF1/JH6 | Germline | EVQLVESG GGLVQPGGSLR LSCAASG FTFS | S YDMH | WVRQATGK GLEWVS | AIGT AGDTYYPG SVKG | RFTISRENAKNSLYLQM NSLRAGDTAVYYCAR | VLYYEDLL YYYYGMDV | WGQGTT VTVSS |
| iPS:43 4563 | VH3|3-13/D3|3-9|RF1/JH6 | ..................... | N......... | ............... | ............ | ..................................... | ..D.G.S.G-------- | .... |
| iPS:43 5009 | VH3|3-13/D3|3-9|RF1/JH6 | ..................... | .......... | ............... | ............ | .............................F....... | A.D.G.S.G-------- | .... |
| iPS:43 5059 | VH3|3-13/D3|3-9|RF1/JH6 | ..................... | N......... | ............... | ............ | ..................................... | ..D.G.S.G-------- | .... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5103 | 21-225_92B2 | VH3|3-13/D3|3-9|RF1/JH6 | | N...... | | F........ | A.D.G.S.G- | .... |
| iPS:43 7371 | 21-225_74D8 | VH3|3-13/D3|3-9|RF1/JH6 | | N...... | | .......... | D.G.S.G- | .... |
| Germline | VH1|1-08/D1|1-26|RF3/JH4 | H_FR1 QVQLVQS GAEVKKPGASVK VSCKASG.YTFT | H_CDR1 S......YDIN | H_FR2 WVRQATGQ.WMEM.GLEWMG | H_CDR2 WMNP...SGNGYAQ KFQG | H_FR3 RVTMTRNTSISTAYMEL SSLRSEDTAVYYCAR | H_CDR3 YSSSY........YFDY | H_FR4 WGQGTL VTVSS |
| iPS:43 4711 | 21-225_80H3 | VH1|1-08/D1|1-26|RF3/JH4 | ........L. | N...... | | ...GS...... | T..WN......F.... | .... |
| iPS:43 4901 | 21-225_85H9 | VH1|1-08/D1|1-26|RF3/JH4 | ........L. | N...... | | ...RGS...... | T..WN......F.... | .... |
| iPS:43 5167 | 21-225_92F12 | VH1|1-08/D1|1-26|RF3/JH4 | ........L. | N...... | | ...RGS...... | T..GK......F.... | .... |
| iPS:43 5215 | 21-225_94E12 | VH1|1-08/D1|1-26|RF3/JH4 | ........L. | N...... | | ...RGS...... | T..WK......F.... | .... |
| iPS:43 7356 | 21-225_74B1 | VH1|1-08/D1|1-26|RF3/JH4 | ........L. | N...... | | ...GS...... | T..WN......F.... | .... |
| Germline | VH1|1-08/D1|1-11|RF1/JH6 | H_FR1 QVQLVQS GAEVKKPGASVK VSCKASG.YTFT | H_CDR1 S......YDIN | H_FR2 WVRQATGQ.WMEM.GLEWMG | H_CDR2 WMNP...SGNGYAQ KFQG | H_FR3 RVTMTRNTSISTAYMEL SSLRSEDTAVYYCAR | H_CDR3 FYD.LTGS........ ..YYGMDV | H_FR4 WGQGTT VTVSS |
| iPS:43 4815 | 21-225_74A11 | VH1|1-08/D1|1-11|RF1/JH6 | | | | W..........K.... | .FYD.LTGS....... ....G...V.... | .... |
| iPS:43 5253 | 21-225_96A4 | VH1|1-08/D1|1-11|RF1/JH6 | | ......H | | W..........K.... | .FYD.LTGS....... ....G...V.... | .... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH1\|1-08\|D3\|3-22\|RF2\|JH6 | QVQLVQS GGGVKKPGASVK VSCKASG-YTFT | S---YDIN | WVRQATG QGLEWMG | WMNPN SGNTGYAQ KFQG | RVTMTRNTSISTAYMEL SSLRSEDTAVYYCAR | YYYDSSGYYY YYYYGMDV | WGQGTT VTVSS |
| iPS:43 4977 | 21-225_88A5 | VH1\|1-08\|D3\|3-22\|RF2\|JH6 | | | | ........W......R.... | GF..FLTG.S..... ......PT....D.... | ....... |
| iPS:43 5259 | 21-225_96C6 | VH1\|1-08\|D3\|3-22\|RF2\|JH6 | | | ...........R.. | ........W........... | GG..VLPGN- ....N....D....... | ....... |
| | Germline | H_FR1 | H_CDR1 | H_FR2 | H_CDR2 | H_FR3 | H_CDR3 | H_FR4 |
| | VH3\|3-33\|D2\|2-15\|RF3\|JH3 | EVQLVES GGGVVQPGRSLR LSCAASG-FTFS | S---YGMH | WVRQAPG KGLEWVA | VIWYD GSNKYYAD SVKG | RFTISRDNSKNTLYLQM NSLRAEDTAVYYCAR | DIVVVA---ADAFDI | WGQGTM VTVSS |
| iPS:43 5291 | 21-225_146E1 | VH3\|3-33\|D2\|2-15\|RF3\|JH3 | .......I.... | | | ..I................ ..........F......... | .RL.GAT.......-A... | ....... |
| iPS:43 6360 | 21-225_210H11 | VH3\|3-33\|D2\|2-15\|RF3\|JH3 | | .H.... | | ..T.....D........... | .RL.GAT.....-..... | ....... |
| iPS:43 6370 | 21-225_211A6 | VH3\|3-33\|D2\|2-15\|RF3\|JH3 | | | ..N. | .................F.. | .RT.GY-..G......... | ....... |
| iPS:43 6392 | 21-225_213B3 | VH3\|3-33\|D2\|2-15\|RF3\|JH3 | | | ..N. | | .RT.GY-..G......... | ....... |
| iPS:43 6406 | 21-225_214E4 | VH3\|3-33\|D2\|2-15\|RF3\|JH3 | | | .EN. | ......I............. | .RT.GY-..GC........ | .A.... |
| iPS:43 7326 | 21-225_75C10 | VH3\|3-33\|D2\|2-15\|RF3\|JH3 | | | ...D. | | .RL.GAT......-V.... | ....... |
| | Germline | H_FR1 | H_CDR1 | H_FR2 | H_CDR2 | H_FR3 | H_CDR3 | H_FR4 |
| | VH4\|4-39\|D7\|7-27\|RF1\|JH4 | QLQLQES GPGLVKPSETLS LTCTVSG-GSIS | SS---SYYWG | WIRQPPGK GLEWIG | SIYY SGSTYYNP SLKS | RVTISIDTSKNQFSLRL SSVTAADTAVYYCAR | EIGY-FDY | WGQGTL VTVSS |
| iPS:43 5293 | 21-225_146F1 | VH4\|4-39\|D7\|7-27\|RF1\|JH4 | ...........R.... | | ....S.. | | DLLW.......S..... | ....... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5361 | VH4|4-39/D7|7-27|RF1/JH4 | ....... | R........ | ........ | ......S.. | ........F....... | .DPQW........ | ....I.. |
| iPS:43 5449 | VH4|4-39/D7|7-27|RF1/JH4 | ......V. | R........ | ........ | ....AS... | ........F....... | .DLQW......S..F | ....... |
| iPS:43 5499 | VH4|4-39/D7|7-27|RF1/JH4 | ....... | R........ | ........ | ....AS... | ........F....... | .DLQW......S..F | ....... |
| iPS:43 5587 | VH4|4-39/D7|7-27|RF1/JH4 | ....... | R........ | ........ | ...S.E... | ........F....... | .SQRW........D.. | ....... |
| iPS:40 3868 | VH4|4-39/D7|7-27|RF1/JH4 | ....... | R........ | ...D.... | ...AN.... | ........A....... | .DRGW........S.. | ....... |
| Germline VH3|3-23/D4|4-17|RF2/JH5 | H_FR1 EVQLLES GGGLVQPGGSLR LSCAASG FTFS | H_CDR1 ....YAMS | H_FR2 WVRQAPGK GLEWVS | H_CDR2 AISGS GGSTYYAD SVKG | H_FR3 RFTISRDNSKNTLYLQM NSLRAEDTAVYYCAR | H_CDR3 DYGDY NWFDP | H_FR4 WGQGTL VTVSS |
| iPS:43 5295 | VH3|3-23/D4|4-17|RF2/JH5 | ....... | ........ | ........ | ....R...N.F.. | ....... | RVT..GG......ND.. | ....... |
| iPS:43 5307 | VH3|3-23/D4|4-17|RF2/JH5 | ....... | ........ | ........ | ....R...N.F.. | ........K....... | RVT..GG......ND.. | ....... |
| iPS:43 5347 | VH3|3-23/D4|4-17|RF2/JH5 | ....... | ....N... | ........ | ....R...N.F.. | ....... | RVT..GG......ND.. | ....... |
| iPS:43 5355 | VH3|3-23/D4|4-17|RF2/JH5 | ....... | ........ | ........ | ....R...N.F.. | ....... | RVT..GG......ND.. | ....... |
| iPS:43 5371 | VH3|3-23/D4|4-17|RF2/JH5 | ....... | ....T... | ........ | ....R...N.F.. | ........T....... | RVT..GG......ND.. | ....... |

Figure 52 (Continued)

[Figure showing antibody sequence alignment table - content not transcribed in detail due to complexity]

| | | H_FR1 | H_CDR1 | H_FR2 | H_CDR2 | H_FR3 | H_CDR3 | H_FR4 |
|---|---|---|---|---|---|---|---|---|
| iPS:43 5443 | 21-225_152E7 | VH4\|4-30.1\|D5\|5-24\|RF3/JH3 | ..........................N..... | NS........ | .......................... | ..........S...... | ........I.......N...... | GGYNWN..........H.... | ........... |
| iPS:43 5465 | 21-225_153A6 | VH4\|4-30.1\|D5\|5-24\|RF3/JH3 | ..........................N..... | NS........ | .......................... | ..........S...... | ........I.......N...... | GGYNWN..........H.... | ........... |
| iPS:44 2568 | 21-225_149D8 | VH4\|4-30.1\|D5\|5-24\|RF3/JH3 | ..........................N..... | NS........ | .......................... | ..........S...... | ........I.......N...... | GGYNWN..........H.... | ........... |
| VH3\|3-48\|D4\|4-11\|RF2\|JH4 | Germline | EVQLVES GGGLVQPGGSLR LSCAASG-FTFS | SYSMN | WVRQAPG KGLEWVS | SISSSSSYIYYAD SVKG | RFTISRDNAKNSLYLQ MNSLRAEDTAVYYCAR | DYSNY-------VFDY | WGQGTL VTVSS |
| iPS:43 5333 | 21-225_147E9 | VH3\|3-48\|D4\|4-11\|RF2\|JH4 | .......................... | .......... | .......................... | ..S..GR..... NT.. | .........................S........ | RG--------SC | ........... |
| iPS:43 5637 | 21-225_163E2 | VH3\|3-48\|D4\|4-11\|RF2\|JH4 | .......................... | .......... | .......................... | ST.G..... .TY.. | .........LV........ .P........ | RG--------SL | ........... |
| VH1\|1-02\|D2\|2-15\|RF3\|JH4 | Germline | QVQLVQS GAEVKKPGASVK VSCKASG-YTFT | G----YYMH | WVRQAPGQ GLEWMG | WINPN SGGTNYAQ KFQG | RVTMTRDTSISTAYMEL SRLRSDDTAVYYCAR | DIVVVVA------ATYFDI | WGQGTL VTVSS |
| iPS:43 5351 | 21-225_148B6 | VH1\|1-02\|D2\|2-15\|RF3\|JH4 | .......................... | .......... | .......................... | .....H... N..... T.... | .........V........ | ....P...P-- AP.... | ........... |
| VH4\|4-30.1\|D5\|5-12\|RF3\|JH6 | Germline | QVQLQES GPGLVKPSQTLS LTCTVSG-GSIS | SG----SYYWS | WIRQHPG KGLEWIG | YIYY SGSTYYNP SLKS | RVTISVDTSKNQFSLKL SSVTAADTAVYYCAR | GYSGYDYY-------YYYYGMDV | WGQGTT VTVSS |
| iPS:43 5363 | 21-225_148F12 | VH4\|4-30.1\|D5\|5-12\|RF3\|JH6 | ........N................... | .......... | .......................... | ..........  | ........QI........ ....D.....R. | YSTYDY-- .......... | ........... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_5377 | 21-225_149G5 | VH4/4-30.1/D5/5-12/RF3/JH6 | | N......... | ....N | | ....D....R. | YSTYDY--- | ... |
| | | Germline | EVQLVES...GGGLVQPGGSLR LSCAASGFTFS | S.....YSMN | WVROAPGKGLEWVS | SISSSSSYIYYAD SVKG | RFTISRDNAKNSLYLQM NSLRAEDTAVYYCAR | SIAAR------- -----------YFDY | WGQGTL VTVSS |
| iPS:43_5409 | 21-225_150G8 | VH3/3-48/D6/6-6/RF2/JH4 | | T......T | ...D. | ...R. | ........S......L. | .AFS-------- ---------P. | ... |
| | | Germline | QVQLVES...GGGVVQPGRSLR LSCAASGFTFS | S.....YAMH | WVRQAPGKGLEWVA | VISYD GSNKYYAD SVKG | RFTISRDNSKNTLYLQM NSLRAEDTAVYYCAR | VIQLNL---------- -----RWPDP | WGQGTL VTVSS |
| iPS:43_5427 | 21-225_151C9 | VH3/3-30.3/D5/5-18/RF2/JH5 | | ......G.. | | | | GVL..FGE......... .LEDD | ... |
| | | Germline | QVQLVES...GGGVVQPGRSLR LSCAASGFTFS | S.....YGMH | WVRQAPGKGLEWVA | VIWYD GSNKYYAD SVKG | RFTISRDNSKNTLYLQM NSLRAEDTAVYYCAR | IVYDSG---------- --------YYFDY | WGQGTL VTVSS |
| iPS:43_5441 | 21-225_152F6 | VH3/3-33/D3/3-22/RF2/JH4 | | | | .I.... .Y. | | EG..FW- SG.LG. | ... |
| iPS:43_5457 | 21-225_152C11 | VH3/3-33/D3/3-22/RF2/JH4 | | N........ | | .I.... .Y. | | EA..FW- SG.... | I. |
| iPS:43_5463 | 21-225_153D2 | VH3/3-33/D3/3-22/RF2/JH4 | | | | .I.... .Y. | ....V........... | EG..FW- SG.LG. | ... |
| iPS:43_5531 | 21-225_157G8 | VH3/3-33/D3/3-22/RF2/JH4 | | | | .I.... .Y. | ....V........... | EG..FW- SGF..S | ... |
| iPS:43_5577 | 21-225_160B1 | VH3/3-33/D3/3-22/RF2/JH4 | | | | ...... .Y. | | EA..FW- SG.Y... | ... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5723 | 21-225_172B7 | VH3|3-33|D3|3-22|RF2|JH4 | . . . . . . . . . . . . . . . . . . . . | N . . . . . . . . . . . . . | . . . . . . . I . . . . . . . . . . V . . . . | . . . . . . . . . . . . . . . . . . . . . . . . . . | EA..FW-...SG.W.. | . . . . . . . . . . . . . . |
| iPS:43 5731 | 21-225_173A11 | VH3|3-33|D3|3-22|RF2|JH4 | . . . . . . . . . . . . . . . . . . . . | . . . . . . . . . . . . . | . . . . . . . I . . . . . . . . . . . . . . . | . . . . . . . . . . . . . . . . . . . . . . . . . . | EA..FW-...SGF..S | . . . . . . . . . . . . . . |
| iPS:43 5781 | 21-225_178G10 | VH3|3-33|D3|3-22|RF2|JH4 | . . . . . . . . . . . . . . . . . . . . | T . . . . . . . . . . . . | . . . . . . . . . . . . . . . . . . . . . . . | . . . . . . . . . . . . . . . . . F . . . . . . . | ER..FW-...SGH... | . . . . . . . . . . . . . . |
| iPS:43 5899 | 21-225_188G11 | VH3|3-33|D3|3-22|RF2|JH4 | . . . . . . . . . . . . . . . . . . . . | . . . . . . . . . . . . . | . . . . . . . I . . . . T . . . . . Y . . . . | . . . . . . . . . . . . . . . . . . . . . . . . . . | ER..FW-...SGH... | . . . . . . . . . . . . . . |
| iPS:43 6602 | 21-225_226E7 | VH3|3-33|D3|3-22|RF2|JH4 | . . . . . . . . . . . . . . . . . . . . | T . . . . . . . . . . . . | . . . . . . . I . . . . . . . . . . . . . . . | . . . . . . . . H . . D . . . . . F . . . . . . . | EN..FW-...SG.YG. | . . . . . . . . . . . . . . |
| iPS:39 2930 | 21-225_25H9 | VH3|3-33|D3|3-22|RF2|JH4 | . . . . . . . . . P.N | N . . . . . . . . . . . . | . . . . . . . I . . . . S . . . . . Y . . . . | . . . . . . . . . . . . . . . . . . . . . . . . . . | EG..FW-...SGF..S | . . . . . . . . . . . . . . |
| | Germline | H_FR1 EVQLLES-GGGLVQPGGSLR LSCAASG-FTFS | H_CDR1 ......YAMS | H_FR2 WVRQAPGK GLEWVS | H_CDR2 AISGS-GGSTYYAD SVKG | H_FR3 RFTISRDNSKNTLYLQM NSLRAEDTAVYYCAK | H_CDR3 V*WEI-......LIFDX | H_FR4 WGQGTL VTVSS |
| iPS:43 5479 | 21-225_154E9 | VH3|3-23|D1|1-26|RF2|JH4 | ...K................ | . . . . . . . . . . . . . | . . . . . . . . . . R . . N . F . . . . . . . | . . . . . . . . . . . . . . . . . F . . . . . . . | RGFRFLE-......WLGG.... | . . . . . . . . . . . . . . |
| | Germline | H_FR1 EVQLLES-GGGLVQPGGSLR LSCAASG-FTFS | H_CDR1 ......YAMS | H_FR2 WVRQAPGK GLEWVS | H_CDR2 AISGS-GGSTYYAD SVKG | H_FR3 RFTISRDNSKNTLYLQM NSLRAEDTAVYYCAK | H_CDR3 GYSYG-......YIFDY | H_FR4 WGQGTL VTVSS |
| iPS:43 5497 | 21-225_155H9 | VH3|3-23|D5|5-18|RF3|JH4 | . . . . . . . . . . . . . . . . . . . . | . . . . . . . . . . . . . | . . . . . . . . . . T . R . . . . . LG. . . . | . . . . . . . . . . . . . . . . . L . . . . . . . | DHD..DY-......NI..... | . . . . . . . . . . . . . . |
| | Germline | H_FR1 EVQLLES-GGGLVQPGGSLR LSCAASG-FTFS | H_CDR1 ......YAMS | H_FR2 WVRQAPGK GLEWVS | H_CDR2 AISGS-GGSTYYAD SVKG | H_FR3 RFTISRDNSKNTLYLQM NSLRAEDTAVYYCAK | H_CDR3 GYSSGW-......YDAFDI | H_FR4 WGQGTM VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5513 | 21-225_157F3 | VH3|3-23|D6|6-19|RF1|JH3 | ......................T......... | ................. | .....V........... | ................................... | RS.GWY....... | ................ |
| iPS:39 2766 | 21-225_23H4 | VH3|3-23|D6|6-19|RF1|JH3 | ...........E............. | ................. | ................. | ................... | ..........E..L.. | ................K |
| iPS:39 2808 | 21-225_20F8 | VH3|3-23|D6|6-19|RF1|JH3 | .......................R | ................N | ....I.........V...S.. | .....V....T..F... | ................... | RN...........H.V.... | ................. |
| Germline | VH4|4-39|D2|2-21|RF3|JH4 | QVQLQES GGGLVKPSETLS LTCTVSG GSIS | SS...SYWG | WIRQPPGK GLEWIG | SIYY SGSTYYNP SLKS | RVTISVDTSKNQFSLKL SSVTAADTAVYYCAR | HVVVT ------- AIYFDY | WGQGTL VTVSS |
| iPS:43 5525 | 21-225_157E7 | VH4|4-39|D2|2-21|RF3|JH4 | ..........H.............. | .G............... | ................. | ................... | .......................N...... | ....K.AG- .......P... | ................ |
| Germline | VH3|3-33|D3|3-10|RF2|JH6 | QVQLVES GGGVVQPGRSLR LSCAASG FTFS | S......YGMH | WVRQAPGK GLEWVA | VIWYD GSNKYYAD SVKG | RFTISRDNSKNTLYLQM NSLRAEDTAVYYCAR | YYYYGMDV | WGQGTT VTVSS |
| iPS:43 5543 | 21-225_158D4 | VH3|3-33|D3|3-10|RF2|JH6 | ................. | D.......V.. | ................. | ................... | ................. | EP.T...W---- ..D............ | ................ |
| iPS:43 5571 | 21-225_159C8 | VH3|3-33|D3|3-10|RF2|JH6 | ................. | D.......V.Q | ................. | ................... | ................. | EP.N...W---- ..D............ | ................ |
| iPS:43 5591 | 21-225_160C4 | VH3|3-33|D3|3-10|RF2|JH6 | ................. | D.......V.Q | .........S....... | ................... | ................. | EP.N...W---- ..D............ | ................ |
| iPS:43 5615 | 21-225_161G12 | VH3|3-33|D3|3-10|RF2|JH6 | ................. | D.......V.Q | ................. | ................... | ................. | EP.N...W---- ..D............ | ................ |
| iPS:43 6604 | 21-225_226F7 | VH3|3-33|D3|3-10|RF2|JH6 | ................. | ................. | .......I......... | ................... | ................. | ER.N...W---- ..D..L.. | ................ |

| | | Germline | H_FR1 | H_CDR1 | H_FR2 | H_CDR2 | H_FR3 | H_CDR3 | H_FR4 |
|---|---|---|---|---|---|---|---|---|---|
| iPS:43 5599 | 21-225_160B10 | VH4 4-39/D1 1-1/RF3/JH5 | R................ | ........ | ........Y.... | N...N...A.HI. | N................ | HDP.W........-GV.Y | ........ |
| | VH3 3-33/D1 1-1/RF2/JH6 | Germline | EVQLVES GGGVVQPGRSLR LSCAASG FTFS | S VGMH | WVRQAPGK GLEWVA | VIWYD GSNKYYAD SVKG | RFTISRDNSKNTLYLQM NSLRAEDTAVYYCAR | VQLPFYY YYYGMDV | WGQGTT VTVSS |
| iPS:43 5601 | 21-225_160G10 | VH3 3-33/D1 1-1/RF2/JH6 | ................ | ......F. | ........ | ....Y........ | ................ | .GI.VAGD........F..E. | ........ |
| iPS:43 5655 | 21-225_167E2 | VH3 3-33/D1 1-1/RF2/JH6 | ................ | ......F. | ........ | ....TY....... | ................ | .GI.VAGD.........E. | ........ |
| iPS:43 5657 | 21-225_167H10 | VH3 3-33/D1 1-1/RF2/JH6 | ........Q....... | ......F. | ........ | ....Y..H..... | ................ | .GI.VAGD.........E. | ........ |
| | VH3 3-53/D7 7-27/RF3/JH4 | Germline | EVQLVES GGGLIQPGGSLR LSCAASG FTVS | S NYMS | WVRQAPGK GLEWVS | VIYS GGSTYYAD SVKG | RFTISRDNSKNTLYLQM NSLRAEDTAVYYCAR | NWGY FDY | WGQGTT VTVSS |
| iPS:43 5605 | 21-225_161A4 | VH3 3-53/D7 7-27/RF3/JH4 | ......S......... | ........ | ........ | ....T....N... | ................ | .MA......GP. | ........ |
| | VH3 3-30.3/D6 6/RF1/JH6 | Germline | QVQLVES GGGVVQPGRSLR LSCAASG FTFS | S YAMH | WVRQAPGK GLEWVA | VISYD GSNKYYAD SVKG | RFTISRDNSKNTLYLQM NSLRAEDTAVYYCAR | EYSSSSYY YYYGMDV | WGQGTT VTVSS |
| iPS:43 5607 | 21-225_161G4 | VH3 3-30.3/D6 6/RF1/JH6 | ................ | ......G. | ........ | ....G....H... | ............V... | RS......G--- | ........ |
| iPS:39 3020 | 21-225_30E2 | VH3 3-30.3/D6 6/RF1/JH6 | ................ | ......G. | ........ | ....G....F.V. | ....N.........V... | RGY......G--- | ........ |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39_3062 | 21-225_33H3 | VH3\|3-30.3/D6\|6-6\|RF1/JH6 | ..........G... | ........S | ........R.... | ....I..G... ....NF... | | RGY..G--- ....G.... | ..... ..... |
| iPS:39_3138 | 21-225_35E3 | VH3\|3-30.3/D6\|6-6\|RF1/JH6 | ..........G... | ........ | ......... | ........G... ......V.. | | RGY..G--- ....G.... | ..... ..... |
| | Germline | H_FR1 EVQLVES...GGGVVQPGRSLR LSCAASG.FTFS | H_CDR1 ....YAMH | H_FR2 WVRQAPGK GLEWVA | H_CDR2 VIWYD. GSNKYYAD SVKG | H_FR3 RFTISRDNSKNTLYLQM NSLRAEDTAVYYCAR | H_CDR3 ETAASGY ...YYYGMDV | H_FR4 WGQGTT VTVSS |
| iPS:43_5611 | 21-225_161F10 | VH3\|3-30.3/D6\|6-13\|RF2/JH6 | ......... | ......... | ......... | ...I..S ...R.DF.. | | ....R..... ....H..... | ..... ..... |
| | Germline | H_FR1 EVQLVES...GGGVVQPGRSLR LSCAASG.FTFS | H_CDR1 ....YGMH | H_FR2 WVRQAPGK GLEWVS | H_CDR2 VIWYD. GSNKYYAD SVKG | H_FR3 RFTISRDNSKNTLYLQM NSLRAEDTAVYYCAR | H_CDR3 VDIAMVY ...YYYGMDV | H_FR4 WGQGTT VTVSS |
| iPS:43_5629 | 21-225_162H6 | VH3\|3-33/D5\|5-18\|RF1/JH6 | ..........N | ..........N | ......... | ......... | | KGI.A.GD ......... | ..... ..... |
| | Germline | H_FR1 EVQLVES...GGGVKPGGSLR LSCAASG.FTFS | H_CDR1 ....YSMN | H_FR2 WVRQAPGK GLEWVS | H_CDR2 SISSS. SSYIYYAD SVKG | H_FR3 RFTISRDNAKNSLYLQM NSLRAEDTAVYYCAR | H_CDR3 LIGYYY ...YYGMDV | H_FR4 WGQGTT VTVSS |
| iPS:43_5639 | 21-225_163G6 | VH3\|3-21/D7\|7-27\|RF1/J H6 | ......... | ........S | ......... | ........G... ......A... | | ....S..... ......... | ..... ..... |
| | Germline | H_FR1 EVQLVES...GGGVKPGGSLR LSCAASG.FTFS | H_CDR1 ....YSMN | H_FR2 WVRQAPGK GLEWVS | H_CDR2 SISSS. SSYIYYAD SVKG | H_FR3 RFTISRDNAKNSLYLQM NSLRAEDTAVYYCAR | H_CDR3 RMLQLYY ...YYGMDV | H_FR4 WGQGTT VTVSS |
| iPS:43_5643 | 21-225_163G10 | VH3\|3-21/D5\|5-24\|RF2/J H6 | ......... | ......... | ......... | ........G... ......T... | | ....A.M.... ......... | ..... ..... |

Figure 52 (Continued)

| VH3/3-33/D3/3-9/RF2/JH4 | | CVQLVES GGGVQPGRSLR LSCAASGFTFS | S | YGMH | WVRQAPGK GLEWVA | VIWYDG SNKYYAD SVKG | RFTISRDNSKNT LYLQMNSLRAEDTAVYYCAR | | YFDY WGQGTL VTVSS |
|---|---|---|---|---|---|---|---|---|---|
| iPS:43_5663 | 21-225_169B1 | VH3/3-33/D3/3-9/RF2/JH4 | ... | ... | ... | ... | ... | DPLRGYN...-DPVM.. | ... |
| iPS:43_5669 | 21-225_169F9 | VH3/3-33/D3/3-9/RF2/JH4 | ... | T... | ..S | I...T. | ...L | DPLRGYN...-DPVM.. | ... |
| iPS:43_5693 | 21-225_170G4 | VH3/3-33/D3/3-9/RF2/JH4 | ....T | T... | ..S | I...T. | ..F.L M | DPLRGYN...-DPVM.. | ... |
| iPS:43_5695 | 21-225_170D5 | VH3/3-33/D3/3-9/RF2/JH4 | ... | ... | ... | I...T. | ...L | DPLRGYN...-DPVM.. | ... |
| iPS:43_5697 | 21-225_170G5 | VH3/3-33/D3/3-9/RF2/JH4 | ..G... | T... | ..T | I...T. | ..S..F | DPLRGYN...-DPVM.. | ... |
| iPS:43_5703 | 21-225_170D11 | VH3/3-33/D3/3-9/RF2/JH4 | ...V | T... | ... | I...T. | ... | DPLRGYN...-DPVM.. | ... |
| iPS:43_5705 | 21-225_171C3 | VH3/3-33/D3/3-9/RF2/JH4 | ..G... | T... | ..T | I...T. | ...L | DPLRGYN...-DPVM.. | ... |
| iPS:43_5709 | 21-225_171A4 | VH3/3-33/D3/3-9/RF2/JH4 | ...P. | T... | ... | I...T. | ... | DPLRGYN...-DPVM.. | ... |
| iPS:43_5721 | 21-225_172B3 | VH3/3-33/D3/3-9/RF2/JH4 | ..M... | I... | ..M | I...T. | ... | DPLRGYN...-DPVM.. | ... |
| iPS:43_5725 | 21-225_172G8 | VH3/3-33/D3/3-9/RF2/JH4 | ... | ... | ... | ... | ... | DPLRGYN...-DPVM.. | ... |
| iPS:43_5735 | 21-225_173H12 | VH3/3-33/D3/3-9/RF2/JH4 | ... | ... | ... | I...T. | ...L | DPLRGYN...-DPVM.. | ... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:43 21-225_175G1 | VH3\|3-33/D3\|3-9\|RF2/JH4 | .........G............... | ..T....... | .................. | .............. | ............................ | ...V. | DPLRGYN.......-DPVM. | .............. |
| iPS:43 21-225_176B11 | VH3\|3-33/D3\|3-9\|RF2/JH4 | .......................... | ..T....... | ..........S....... | ..I...T....... | ............................ | F..L | DPLRGYN.......-DPVL. | .............. |
| iPS:43 21-225_178B10 | VH3\|3-33/D3\|3-9\|RF2/JH4 | ..................S....... | ..T....V.. | .........M........ | ..I...T....... | ............................ | ...L | DPLRGYN.......-DPVM. | .............. |
| VH3\|3-48/D2\|2-15\|RF3/JH6 | Germline | EVQLLES GGGLVQPGGSLR LSCAASG-FTFS | SYSMN | WVRQAPGK GLEWVS | YISSS SSTIYAD SVKG | RFTISRDNAKNSLYLQM NSLRDEDTAVYYCAR | DIVVVAAT YYYYYGMDV | WGQGTT VTVSS |
| iPS:43 21-225_169E3 | VH3\|3-48/D2\|2-15\|RF3/JH6 | ................G......... | ........H. | ..........A....... | .....G..L..K.. | ....................RD...... | RGIT..R--- NED.L.. | .............. |
| iPS:43 21-225_169E6 | VH3\|3-48/D2\|2-15\|RF3/JH6 | .......................... | ........H. | ..........A....... | .....G....I.K.. | ....................RD...... | RGIT..R--- NED.L.. | .............. |
| iPS:43 21-225_176E6 | VH3\|3-48/D2\|2-15\|RF3/JH6 | .......................... | ........H. | ..........A....... | .....G....I.K.. | ....I...............RD...... | RGIT..R--- NED.L.. | .............. |
| VH4\|4-59/D3\|3-9\|RF1/JH6 | Germline | H_FR1 | H_CDR1 | H_FR2 | H_CDR2 | H_FR3 | H_CDR3 | H_FR4 |
| iPS:43 21-225_169D7 | VH4\|4-59/D3\|3-9\|RF1/JH6 | .......................... | .......... | .........T........ | ...A.....R..T.. | ............M............... | .G..Y------ -YYYYGMDV | .............. |
| iPS:43 21-225_170H1 | VH4\|4-59/D3\|3-9\|RF1/JH6 | .......................... | .......... | ..........A....... | ...A.....R..T.. | ............M.......F..K.... | .G..Y------ | .............. |
| VH3\|3-23/D4\|4-23\|RF2/JH4 | Germline | EVQLLES GGGLVQPGGSLR LSCAASG-FTFS | SYAMS | WVRQAPGK GLEWVS | AISGSG GGSTYYAD SVKG | RFTISRDNSKNTLYLQM NSLRAEDTAVYYCAK | DYGGN-------- SYFDY | WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5711 | 21-225_171G4 | VH3|3-23|D4|4-23|RF2|JH4 | ........D. | ....C..T | ........ | ....R. T.F ..R. | ........F. | LI.GA. ...T.... | ........ |
| iPS:43 5875 | 21-225_190B9 | VH3|3-23|D4|4-23|RF2|JH4 | ........ | T....... | ........ | ....R. N.H. | ........S | .GF.GS.. | ........ |
| iPS:43 5909 | 21-225_190H3 | VH3|3-23|D4|4-23|RF2|JH4 | ........ | ........ | ........ | ....R. ...N.. | ........S | .GF.GS.. | ........ |
| iPS:43 6013 | 21-225_193F2 | VH3|3-23|D4|4-23|RF2|JH4 | ........R | T....F.. | ........ | ....R. N.H. | ........S | .GF.GS.. | ........ |
| iPS:43 6100 | 21-225_195G12 | VH3|3-23|D4|4-23|RF2|JH4 | ........ | T....... | ........ | ....R. N.H. | ........S | .GF.GS.. | ........ |
| Germline | VH3|3-30.3|D1|1-7|RF2|JH6 | H_FR1 EVQLVES-GGGLVQPGGSLR LSCAASG-FTFS | H_CDR1 S------YAMH | H_FR2 WVRQAPGK GLEWVA | H_CDR2 VISID--GSNKYYAD SVKG | H_FR3 RFTISRDNSKNTLYLQM NSLRAEDTAVYYCAR | H_CDR3 VYMELYY-----YYYGMDV | H_FR4 WGQGTT VTVSS |
| iPS:43 5713 | 21-225_171D7 | VH3|3-30.3|D1|1-7|RF2|JH6 | ........ | ....G... | ........ | ...N.RH.. ...Q. | ........S... ....G... | DRHR.D-- ....AL... | ........ |
| Germline | VH3|3-23|D5|5-24|RF3|JH3 | H_FR1 EVQLLES-GGGLVQPGGSLR LSCAASG-FTFS | H_CDR1 S------YAMS | H_FR2 WVRQAPGK GLEWVS | H_CDR2 ATSGS GGSTYYAD SVKG | H_FR3 RFTISRDNSKNTLYLQM NSLRAEDTAVYYCAR | H_CDR3 RDGNY-------DAPDI | H_FR4 WGQGTM VTVSS |
| iPS:43 5729 | 21-225_173E7 | VH3|3-23|D5|5-24|RF3|JH3 | ....S... | ........ | ........ | ....F... ........ | ........ ...Q... | ...T.G. ........ | ........ |
| iPS:43 5753 | 21-225_175G10 | VH3|3-23|D5|5-24|RF3|JH3 | ........ | ........ | ........ | T........ ...I.N.. | ........ ...T... | ...W.... IW.G.... | ........ |
| iPS:39 3024 | 21-225_31H9 | VH3|3-23|D5|5-24|RF3|JH3 | ........ | ....C..N | ........ | ........ .SF..... | ........ ........ | .TP.D--- ...-V.... | ........L |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| iPS:39 8474 | VH1|1-02|D1|1-1|RF1|JH3 21-225_17B10 | VH3|3-23|D5|5-24|RF3|J H3 | | | | V...... | .GIPEA...... | |
| | Germline | EVQLVES GGGLVQPGGSLR LSCAASG-FTFS | G----YYMH | WVRQAPGK GLEWVG | WINPN SGGTNYAQ KFQG | RVTMTRDTS ISTAYMEL SRLRSEDTAVYYCAR | GTTGT ----------DAFDI | WGQGTL VTVSS |
| iPS:43 5745 | VH1|1-02|D1|1-1|RF1|JH3 21-225_175G3 | ......V.............. | ........F | | .K..K..C R... | .......................T... | .G.TVTT ...........WGV..Y | ...... |
| iPS:43 7270 | VH1|1-02|D1|1-1|RF1|JH3 21-225_178H4 | ........................... | ........F | | .K..K..C | ................V............ | .G.TVTT ...........WGV..Y | ...... |
| | Germline | H_FR1 | H_CDR1 | H_FR2 | H_CDR2 | H_FR3 | H_CDR3 | H_FR4 |
| iPS:43 5769 | VH3|3-23|D3|3-22|RF2|JH4 21-225_177B6 | EVQLVES GGGLVQPGGSLR LSCAASG-FTFS | S-----YAMS | WVRQAPGK GLEWVS | AISGS GGSTYYAD SVKG | RFTISRDNSKNTLYLQM NSLRAEDTAVYYCAR | YYYDSGY -----------YYAFYFDY | WGQGTL VTVSS |
| | | ........R....E | | | V........ SN...V.... | .................N.... | G......................P..F | ...... |
| iPS:43 5771 | VH3|3-23|D3|3-22|RF2|JH1 21-225_177B11 | ..........T....... | | | .......I.... .......Y..T | .........S............T..... | ET...FW--- SG..VF | ...... |
| | Germline | H_FR1 | H_CDR1 | H_FR2 | H_CDR2 | H_FR3 | H_CDR3 | H_FR4 |
| iPS:43 5775 | VH3|3-23|D5|5-24|RF3|JH4 21-225_178A5 | ......H................... | .......T | | ..........V ..........N..F... | ...........................R... | RDGYN --------YYFDY | WGQGTL VTVSS |
| | | | | | | | D- | |
| iPS:43 7214 | VH3|3-23|D5|5-24|RF3|JH4 21-225_48B12 | ........................... | .......N | | ..........R ..........N..F... | | ET..WN---- ..........YEG... | ...... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS.39 3028 | VH3/3-33/D4/4-23/D5/5-24/RF3/JH4 | | | | ....T..Q... ....... ..R.. ...T.F.... | | DGYGGN.......... ......SF | |
| | Germline | QVQLVES GGGVVQPGRSLR LSCAASG-FTFS | ...YGMH | MVRQAPGK GLEWVA | VISYD GSNKYYAD SVKG | RFTISRDNSKNTLYLQM NSLRAEDTAVYYCAR | TVTYYY ———YGMDV | WGQGTT VTVSS |
| iPS.43 5789 | VH3/3-33/D4/4-11/RF3/JH6 | | ...S.... | | ...I..... ........Y.. | ................A. ............... | .G.DPWD. ....Y.N.... | |
| | Germline | EVQLLES GGGLVQPGGSLR LSCAASG-FTFS | ...YAMS | MVRQAPGK GLEWVS | AISGS GGSTYYAD SVKG | RFTISRDNSKNTLYLQM NSLRAEDTAVYYCAK | RILVVCM ———LYDAFDI | WGQGTM VTVSS |
| iPS.43 5799 | VH3/3-23/D2/2-8/RF1/JH3 | | | | ...V....... ...N.F.G.. | ...........I...... ............... | .ET.D.G- ......S... | |
| | Germline | QVQLVES GGGVVQPGRSLR LSCAASG-FTFS | ...YAMH | MVRQAPGK GLEWVA | VISYD GSNKYYAD SVKG | RFTISRDNSKNTLYLQM NSLRAEDTAVYYCAR | WGDMYY ———YYGMDV | WGQGTT VTVSS |
| iPS.43 5811 | VH3/3-30.3/D5/5-18/RF2/JH6 | | ......G... | | ...I..A... ....T.F.... | ...............V.. | RPPQ.V-- ..........EG. | |
| iPS.43 6754 | VH3/3-30.3/D5/5-18/RF2/JH6 | | ......G... | | | | DTER..P- ...........S. | |
| iPS.44 8908 | VH3/3-30.3/D5/5-18/RF2/JH6 | | ......G... | | ...Q....... ....IIR.... | | DVKQ.V-- ..........RT. | |
| | Germline | VH3/3-30.3/D6/6-19/RF1/JH5 | ...S | MVRQAPGK GLEWVA | VISYD GSNKYYAD SVKG | RFTISRDNSKNTLYLQM NSLRAEDTAVYYCAR | CYSSCW ———ZNWFDP | WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_5813 | VH3l3-21|D3|3-30.3/D6|6-19|RF1/JH5 Germline | EVOLVES-GGGLVKPGGSLR LSCAASG-FTFS | S-----YNMN | WVRQAPGK CEWVS | ....SA.. SSITYAD SVKG | RFTISRDNAKNSLYLQM NSLRAEDTAVYYCAR | R....... ......D-- TLVRGV-- -----IIYFDY | WGQGT LVTVSS |
| iPS:43_5815 | VH3l3-21|D3|3-10|RF3/JH4 | ........G... | ........... | ........... | .G..G.... | ........... | A..A---- | ...... |
| iPS:43_5865 | VH3l3-21|D3|3-10|RF3/JH4 | ..I.V...... ........R | D.......... | ........... | .G..H.... | ........... | ....L--- | ....A. |
| iPS:43_6047 | VH3l3-21|D3|3-10|RF3/JH4 | ........... ........R | D.......... | ........... | .G....... | ........... | A..A---- | ...... |
| iPS:43_6122 | VH3l3-21|D3|3-10|RF3/JH4 | ........... ........R | D.......... | ........... | .GG..A... .L.. | ........... | A..A---- ....L--- | ...... |
| iPS:43_6220 | VH3l3-21|D3|3-10|RF3/JH4 | ........... ........R | D.......... | ........... | .G..H.... | ........... | A..A---- ....L--- | ...... |
| | | H_FR1 | H_CDR1 | H_FR2 | H_CDR2 | H_FR3 | H_CDR3 | H_FR4 |
| iPS:43_5817 | VH4l4-59/D4|4-17|RF2/JH6 Germline | CHOICES GPGLVKPSETLS LTCTVSG-GSIS | S------YYWS | WIRQPPG KGLEWIG | YIYY SGSTNYNP SLKS | RVTISVDTSKNQFSLKL SSVTAADTAVYYCAR | DYGDYY- YYGMDV | WGQGT LVTVSS |
| iPS:43_5817 | VH4l4-59/D4|4-17|RF2/JH6 | ........... ........N | N.......... | ....A... | ..R..T.. ....... | ........M......... | R.Y.G--- ...... | ....... |
| iPS:43_5917 | VH4l4-59/D4|4-17|RF2/JH6 | ........... ........N | N.......... | ....A... | ..R..A.. ....... | ...M.I........H... | R.Y.G--- ...... | ....I.. |
| iPS:43_6056 | VH4l4-59/D4|4-17|RF2/JH6 | ........... ........N | N.......... | ....A... | ..R..A.. ....... | ...M.I........H... | R.Y.G--- ...... | ....I.. |
| iPS:43_6220 | VH4l4-59/D4|4-17|RF2/JH6 | ........... ........N | N.......... | ....A... | ..R..T.. ....... | ........M......... | R.Y.G--- ...... | ....... |

Figure 52 (Continued)

| | | QVQLVES GGGLVQPGRSLR LSCAASG-FTFS | SYGMH | WVRQAPGK GLEWVA | VISYD GSNKYYA DSVKG | RFTISRDNSKNTLYLQM NSLRAEDTAVYYCAK | DYSDIYY ----YYYGMDV | WGQGTT VTVSS |
|---|---|---|---|---|---|---|---|---|
| | | H_FR1 | H_CDR1 | H_FR2 | H_CDR2 | H_FR3 | H_CDR3 | H_FR4 |
| VH3\|3-30\|D4\|4-17\|RF2\|JH6 | | | | | | | | |
| iPS:43 5821 | 21-225_190E11 | VH3\|3-30\|D4\|4-17\|RF2\|JH6 | .........N..... | ............... | I..WF........... | ..........N..... | AQ.V...------- | ...... |
| | Germline | | | | | | V........ | |
| | | H_FR1 | H_CDR1 | H_FR2 | H_CDR2 | H_FR3 | H_CDR3 | H_FR4 |
| VH3\|3-23\|D5\|5-12\|RF3\|JH5 | | QVQLLES GGGLVQPGGSLR LSCAASG-FTFS | SYAMS | WVRQAPGK GLEWVS | AISGS GGSTYYAD SVKG | RFTISRDNSKNTLYLQM NSLRAEDTAVYYCAK | GYSGYD YYGFDP | WGQGTL VTVSS |
| iPS:43 5823 | 21-225_190F11 | G.....D......... | | | T..T... .RR..... | | EEDY..S......... ....SGPG | |
| iPS:43 5867 | 21-225_191E5 | G.....D......... | | | T..T... .RR..... | | EEDY..S......... ....SGPG | |
| iPS:43 5929 | 21-225_190D9 | G.....D......... | | | T..T... .RR..... | | EEDY..S......... ....SGPG | |
| iPS:43 5935 | 21-225_190H8 | G.....D......... | G......... | | T..T... .RR..... | | EEDY..S......... ....SGPG | |
| | Germline | H_FR1 | H_CDR1 | H_FR2 | H_CDR2 | H_FR3 | H_CDR3 | H_FR4 |
| VH4\|4-39\|D3\|3-9\|RF1\|JH4 | | QVQLQES GPGLVKPSETLS LTCTVSG-GSIS | SS--SYYWG | WIRQPPG KGLEWIG | SIY YSGSTYYNP SLKS | RVTISVDTSKNQFSLKL SSVTAADTAVYYCAR | VLRVFDM ------LL-YFDY | WGQGTL VTVSS |
| iPS:43 5827 | 21-225_190H11 | VH4\|4-39\|D3\|3-9\|RF1\|JH4 | .....---.H.S | .A... | .L..T... .R..I.. | .L............. | LRYNWN----- FP..... | ...... |
| iPS:43 5853 | 21-225_191E3 | VH4\|4-39\|D3\|3-9\|RF1\|JH4 | .....---.H.S | .A... | .L..T... .R..N.. | .M............. N..... | LRYNWN----- FP..... | ...... |
| iPS:43 5871 | 21-225_191E6 | VH4\|4-39\|D3\|3-9\|RF1\|JH4 | ........... | ..... | .L..T... .R..N.. | .M............. | LRYNWN----- FP....F | ...... |
| iPS:43 5927 | 21-225_190E7 | VH4\|4-39\|D3\|3-9\|RF1\|JH4 | .....---.H.S | .A... | .H..T... .R..N.. | ....T.......... | LRYNWN----- FP..... | ...... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43-5999 | VH4/4-39/D3/3-9|RF1/JH4 | ..........R | ----.H.S | | A..L.T. | ...N......M..... | LRYNWN-...FP... | ........ |
| iPS:43-6060 | VH4/4-39/D3/3-9|RF1/JH4 | ............ | ----.H.S | | A..L.T..R.N | .........M..R..S | LRYNWN-...FP... | ........ |
| iPS:43-6193 | VH4/4-39/D3/3-9|RF1/JH4 | ............ | ----.H.S | | A..H.T..R.N | ................T | LRYNWN-...FP... | ........ |
| VH4/4-30.1/D5/5-24|RF3/JH2 Germline | | H_FR1 QVQLQES-GPGLVKPSQTLS LTCTVSG_GSIS | H_CDR1 SG---GYYWS | H_FR2 WIRQHPGK GLEWIG | H_CDR2 YIYY-SGSTYYNP SLKS | H_FR3 RVTISVDTSKNQFSLKL RSSVTAADTAVYYCAR | H_CDR3 RDGNY-----------YYYFDL | H_FR4 WGRGTL VTVSS |
| iPS:43-5829 | VH4/4-30.1/D5/5-24|RF3/JH2 | ............ | N........ | | | ........N......F | SGYNWD---AGV.P | ........ |
| VH3/3-33/D4/4-11|RF2/JH6 Germline | | H_FR1 QVQLVES-GGGVVQPGRSLR LSCAASG_FTFS | H_CDR1 S----YGMH | H_FR2 WVRQAPGK GLEWVA | H_CDR2 VIWYD-GSNKYYAD SVKG | H_FR3 RFTISRDNSKNTLYLQM NSLRAEDTAVYYCAR | H_CDR3 DLNYY-----------YYYGMDV | H_FR4 WGQGTT VTVSS |
| iPS:43-5835 | VH3/3-33/D4/4-11|RF2/JH6 | ............ | N........ | | ....F...D | ................S | .R.VG.- | ........ |
| iPS:43-5861 | VH3/3-33/D4/4-11|RF2/JH6 | .....G...... | | | ....F...D | | F.VG.-...D | ........ |
| iPS:43-5937 | VH3/3-33/D4/4-11|RF2/JH6 | ............ | N........ | | ....F...N | ................S | .R.VG.-...D.L. | ........ |
| iPS:43-5977 | VH3/3-33/D4/4-11|RF2/JH6 | ............ | | | ....F...D | | .R.VG.-...D | ........ |
| iPS:43-6001 | VH3/3-33/D4/4-11|RF2/JH6 | S........R | N........ | ..K..... | ....N.V..R. | ................S | .R.VG.-...D.L.. | ........ |

Figure 52 (Continued)

| | | | | | | | | |
|---|---|---|---|---|---|---|---|---|
| iPS:43 6066 | 21-225_194B7 | VH3\|3-33\|D4\|4-11\|RF2/JH6 | ..... | ..... | ..... | ..... | ..... | R.KG.- |
| iPS:43 6078 | 21-225_194H12 | VH3\|3-33\|D4\|4-11\|RF2/JH6 | N..... .R | ..... | ..... | ..F ..D | S..... | ..... D.L.. |
| iPS:43 6140 | 21-225_197G3 | VH3\|3-33\|D4\|4-11\|RF2/JH6 | ..V | H..... | ..... | ..N | ..... | P.VG.- D..... |
| iPS:43 6167 | 21-225_197E11 | VH3\|3-33\|D4\|4-11\|RF2/JH6 | N..... .R | ..... | ..... | ..F ..D | S..... | R.VG.- D.L.. |
| iPS:43 6292 | 21-225_205H3 | VH3\|3-33\|D4\|4-11\|RF2/JH6 | ..... | ..... | ..... | ..... | ..... | R.VG.- |
| iPS:43 6802 | 21-225_171E12 | VH3\|3-33\|D4\|4-11\|RF2/JH6 | ..... | ..... | ..G | ..N ...NG. | ..... | RTY.SGSGSP .PYY...... |
| iPS:43 6816 | 21-225_179H5 | VH3\|3-33\|D4\|4-11\|RF2/JH6 | ..... | ..... | ..... | ..E | ..... | IR..... ..L... |
| iPS:43 6960 | 21-225_198D2 | VH3\|3-33\|D4\|4-11\|RF2/JH6 | N.R | ..... | ..... | ..I ..Y | ..... | T..G---- |
| iPS:43 6974 | 21-225_190H7 | VH3\|3-33\|D4\|4-11\|RF2/JH6 | ..R | ..... | ..... | ..I ..Y | ..... | T..G---- |
| iPS:43 6982 | 21-225_190D10 | VH3\|3-33\|D4\|4-11\|RF2/JH6 | ..R | ..... | ..... | ..I ..Y | ..... | T..G---- |
| iPS:43 7274 | 21-225_196D4 | VH3\|3-33\|D4\|4-11\|RF2/JH6 | ..V | ..... | ..... | ..RN | ..V... | R.KG.- D..... |
| iPS:39 2664 | 21-225_20F6 | VH3\|3-33\|D4\|4-11\|RF2/JH6 | ..V | ..... | ..... | ..H | ..A... | L.MG---- |

Figure 52 (Continued)

| | | | | | | | |
|---|---|---|---|---|---|---|---|
| iPS:39_2738 | 21-225_18G4 | VH3\|3-33\|D4\|4-11\|RF2/J H6 | | | | | L.MG---- |
| iPS:39_2798 | 21-225_22C7 | VH3\|3-33\|D4\|4-11\|RF2/J H6 | | ...G | H... | A... | L.MG---- |
| iPS:39_2956 | 21-225_27A11 | VH3\|3-33\|D4\|4-11\|RF2/J H6 | | | | H... | S.P.--- |
| iPS:39_2994 | 21-225_26G11 | VH3\|3-33\|D4\|4-11\|RF2/J H6 | | | E... | A... | R...SW- SG.... |
| iPS:39_3014 | 21-225_26D12 | VH3\|3-33\|D4\|4-11\|RF2/J H6 | | | | | S.P.--- |
| iPS:39_3152 | 21-225_25B3 | VH3\|3-33\|D4\|4-11\|RF2/J H6 | | ...G | H... | A... | S.P.--- |
| iPS:39_3840 | 21-225_3F8 | VH3\|3-33\|D4\|4-11\|RF2/J H6 | F | I.H... | ...S | | L.MG---- |
| iPS:39_3930 | 21-225_7E11 | VH3\|3-33\|D4\|4-11\|RF2/J H6 | I | I... | N... | | L.MG---- |
| iPS:39_3964 | 21-225_6G1 | VH3\|3-33\|D4\|4-11\|RF2/J H6 | | | | M... | L.MG---- |
| iPS:39_4012 | 21-225_15A3 | VH3\|3-33\|D4\|4-11\|RF2/J H6 | | H... | | | L.MG---- |
| iPS:39_4016 | 21-225_13D4 | VH3\|3-33\|D4\|4-11\|RF2/J H6 | | R... | | | L.MG---- |
| iPS:39_4083 | 21-225_16E6 | VH3\|3-33\|D4\|4-11\|RF2/J H6 | | H...V | | N... | L.MG---- |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-59/D3/3-9|RF1/JH4 | | QVQLQES GPGLVKPSETLS LTCTVSG-GSIS | S....YYWS | WIRQFFGK GLEWIG | SGSTNYNP SLKS | RVTISVDTSKNFSLKL SSVTAADTAVYYCAR | VLRYFDW ----LL*VFDY | WGQGTL VTVSS |
| iPS:43 5839 | VH4/4-59/D3/3-9|RF1/JH4 | | ....H. | .....A. | ..H..T. .....K. | ........M......... | LRYNWN- FPF... | ........ |
| iPS:43 6158 | VH4/4-59/D3/3-9|RF1/JH4 | ..H..... | .....A..... | .....A. | RLSP... G....F. | ........M.........R. | LRYNWN- FP.. | .....A. |
| VH4/4-30.1/D3/3-22|RF2/JH6 | | QVQLQES- GPGLVKPSQTLS LTCTVSG-GSIS | SG-TQIYWS | WIRQHPGK GLEWIG | YIYI SGSTYYNP SLKS | RVTISVDTSKNQFSLKL SSVTAADTAVYYCAR | YYYDSSGYYY ----YYYYYGMDV | WGQGTT VTVSS |
| iPS:43 5843 | VH4/4-30.1/D3/3-22|RF2/JH6 | .......N. | .........N | | .........F......... | | GD..G...S.- H....... | ........ |
| iPS:43 5847 | VH4/4-30.1/D3/3-22|RF2/JH6 | | .........D..N | | .........F......... | | GD..G...S.- H....... | ........ |
| iPS:43 5851 | VH4/4-30.1/D3/3-22|RF2/JH6 | .......K. | .........D..N | ....D.. | .........F......... | | GD..G...S.- H....... | ........ |
| iPS:43 5905 | VH4/4-30.1/D3/3-22|RF2/JH6 | .......N. | .........D..N | | F.F.......... | .............N......... | GD..G...S.- H....... | ........ |
| iPS:43 5911 | VH4/4-30.1/D3/3-22|RF2/JH6 | | | | .........F......... | | GD..G...S.- H....... | ........ |
| iPS:43 5913 | VH4/4-30.1/D3/3-22|RF2/JH6 | .......N. | .........V | | .N....N.... | .II............... | GD..G...S.- H...L... | ........ |

Figure 52 (Continued)

| | | | | | | | |
|---|---|---|---|---|---|---|---|
| iPS:43 5939 | 21-225_191H7 | VH4\|4-30.1/D3\|3-22\|RF2/JH6 | | ..D..N | | | GD..G..S.- .......... H....... |
| iPS:43 5967 | 21-225_192B3 | VH4\|4-30.1/D3\|3-22\|RF2/JH6 | ....N | ..D..N | F | | GD..G..S.- .......... HH...... |
| iPS:43 5973 | 21-225_192H3 | VH4\|4-30.1/D3\|3-22\|RF2/JH6 | | V..S.... | F.F | | GD..G..S.- .......... H..H.... |
| iPS:43 6007 | 21-225_192G12 | VH4\|4-30.1/D3\|3-22\|RF2/JH6 | | V.H.... | .R | .A...... ......V. ...T.... | GD..G..S.- .......... H....... |
| iPS:43 6009 | 21-225_193A1 | VH4\|4-30.1/D3\|3-22\|RF2/JH6 | | V...... | NL.... ..R..... N.H.... | | GD..G..S.- .......... H....... |
| iPS:43 6011 | 21-225_193B1 | VH4\|4-30.1/D3\|3-22\|RF2/JH6 | | V...... | N.....N | .L.A.... | GD..G..S.- .......... H....... |
| iPS:43 6017 | 21-225_193F3 | VH4\|4-30.1/D3\|3-22\|RF2/JH6 | | ..D..N | N.....N | | GD..G..S.- .......... H....... |
| iPS:43 6029 | 21-225_193H6 | VH4\|4-30.1/D3\|3-22\|RF2/JH6 | ....N | ..D..N | F | | GD..G..S.- .......... H....... |
| iPS:43 6035 | 21-225_193C8 | VH4\|4-30.1/D3\|3-22\|RF2/JH6 | ....N | ..D..N | F | | GD..G..S.- .......... H....... |

Figure 52 (Continued)

| | | | | | | | | | |
|---|---|---|---|---|---|---|---|---|---|
| iPS:43-6037 | 21-225_193D8 | VH4|4-30.1/D3|3-22|RF2/JH6 | . . . . . . . . . . . . | . . . . . N . . . | . . . . . . . . . . . | . . . F . F . . . | . . . S . . . . . | . . . . . . . . . . . | GD..G..S.- .H.......... |
| iPS:43-6041 | 21-225_193G8 | VH4|4-30.1/D3|3-22|RF2/JH6 | . . . K . . . . . V . | . . . . . . . . . . . | . . . . . . . . . . . | . . . . . N . . . | . . . N . . . . . | . . . . . . . . . . . | GD..G..S.- HF...L...... |
| iPS:43-6062 | 21-225_194E5 | VH4|4-30.1/D3|3-22|RF2/JH6 | . . . . . N . . . . . | . . . . . . . . . . . | . . . H . . . . . . | . . . . F . . . . | . . . . . . . . . | . . . . . . . . . . . | GD..G..S.- .H.......... |
| iPS:43-6064 | 21-225_194E6 | VH4|4-30.1/D3|3-22|RF2/JH6 | . . . . D . N . . . . | . . . D . . N . . . | . . . . . . . . . . | . . . F . F . . . | . . . I . NV . . . | . . . . . . . . . . . | GD..G..S.- .H.......... |
| iPS:43-6134 | 21-225_196H12 | VH4|4-30.1/D3|3-22|RF2/JH6 | . . . . . N . . . . . | . . . V . . . . . . | . . . . . . . . . . | . . . N . . N . . | . . . II . . . . . | . . . . . . . . . . . | GD..G..S.- .H....L..... |
| iPS:43-6146 | 21-225_197F4 | VH4|4-30.1/D3|3-22|RF2/JH6 | . . . . . . . . . . . | . . . D . . N . . . | . . . F . . . . . . | . . . . F . . . . | . . . I . . . . . | . . . . . . . . . . . | GD..G..S.- .H....L..... |
| iPS:43-6177 | 21-225_198B1 | VH4|4-30.1/D3|3-22|RF2/JH6 | . . . K . . . . . . . | . . . D . . N . . . | . . . . . . . . . . | . . . FH . . . . . | . . . LS . . . . . | . . . . . . . . . . . | GD..G..S.- .H.......... |
| iPS:43-6179 | 21-225_198E1 | VH4|4-30.1/D3|3-22|RF2/JH6 | . . . . . N . . . . . | . . . . . . . . . . | . . . L . . E . . . | . . . F . F . . . | . . . . . . . . . | . . . . . . . . . . . | GD..G..S.- .H.......... R.... |
| iPS:43-6197 | 21-225_199C2 | VH4|4-30.1/D3|3-22|RF2/JH6 | . . . . . . . . . . . | . . . D . . N . . . | . . . . . . . . . . | . . . . F . . . . | . . . . . . MT . . . T | . . . . . . . . . . . | GD..G..S.- .H.......... |

| Germline | | H_FR1 | H_CDR1 | H_FR2 | H_CDR2 | H_FR3 | H_CDR3 | H_FR4 |
|---|---|---|---|---|---|---|---|---|
| iPS:43_5863 | VH4\|4-30.1/D5\|5-24\|RF3/JH5 | ......... | .......N...... | ............ | ......F...... | ....L...I...... G. | SGYNWD....GV... | ........ |
| iPS:43_5943 | VH4\|4-30.1/D5\|5-24\|RF3/JH5 | ......... | .......N...... | ....D....... | .............. | ....T........... | SGYNWD....AGV.. .R. | ........ |
| iPS:43_6094 | VH4\|4-30.1/D5\|5-24\|RF3/JH5 | ...NS.... | ............... | ............ | ......M...... | ....A......Y...K | GGYNWN....G..C | ........ |
| VH3\|3-33/D2\|2-15\|RF3/JH6 | Germline | H_FR1 EVOLVES CGGLVPPGSSLR LSCAASG_FTFS | H_CDR1 S_____SGH | H_FR2 WVRQAPGK GLEWVS | H_CDR2 YISSS SSYITYAD SVKG | H_FR3 RFTISRDNSKNTLYLQM NSLRAEDTAVYYCAR | H_CDR3 DIVVYYAIT VTTTGNDV | H_FR4 WGQGTL VTVSS |
| iPS:43_5869 | VH3\|3-33/D2\|2-15\|RF3/JH6 | ....T.... | ............... | ............ | ......H...... | .............. S. | .RT.GY---- | ........ |
| iPS:43_6260 | VH3\|3-33/D2\|2-15\|RF3/JH6 | ......... | ............... | ............ | ......N...... | .............. N... | .RT.GY---- | ........ |
| iPS:43_6490 | VH3\|3-33/D2\|2-15\|RF3/JH6 | ......... | .......N...... | ............ | ...EN........ | .............. N... | .RT.GY---- | ........ |
| iPS:43_6502 | VH3\|3-33/D2\|2-15\|RF3/JH6 | ......... | ............... | ............ | ......N...... | .............. | .RD.GY---- | ........ |
| iPS:43_6514 | VH3\|3-33/D2\|2-15\|RF3/JH6 | ......... | ............... | ............ | ......N...... | ......H....... N... | .RD.GY---- | ........ |
| iPS:43_6522 | VH3\|3-33/D2\|2-15\|RF3/JH6 | ......... | ............... | ............ | ......N...... | .............. N... | .RD.GY---- | ........ |
| VH3\|3-21/D\|11-1\|RF3/JH5 | Germline | H_FR1 | H_CDR1 | H_FR2 | H_CDR2 | H_FR3 RFTISRDNAKNSLYLQM NSLRAEDTAVYYCAR | H_CDR3 YVVD_____NMFDP | H_FR4 WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 5883 | VH3|3-21|D1|1-1|RF3|JH5 | ..................N | ........ | ........ | ......G. | ........H........ | S.L--- ........C | ........P ........ |
| | Germline | EVQLLES GGGLVQPGGSLR LSCAASG-FTFS | S----YAMS | WVRQAPGK GLEWVS | AISGS GGSTYYAD SVKG | RFTISRDNSKNTLYLQM NSLRAEDTAVYYCAR | ----GTTGT -----DAFDI | WGQGTM VTVSS |
| iPS:43 5895 | VH3|3-23|D1|1-1|RF1|JH3 | ........ | S..N | ........ | ..Y..... | ........F........ | RN.DD... --- | ........ ........ |
| | Germline | EVQLVES GGGLVKPGGSLR LSCAASG-FTFS | D----YMS | WIRQAPGK GLEWVS | YISS GSTIYAD SVKG | RFTISRDNAKNSLYLQM NSLRAEDTAVYYCAR | ----NWGY -----FDI | WGQGIL VTVSS |
| iPS:43 5903 | VH3|3-11|D7|7-27|RF3|JH4 | ........ | ........ | ....L... | .T.VF... | ........ | E.VG....A... | ........ |
| iPS:43 5923 | VH3|3-11|D7|7-27|RF3|JH4 | ........ | ........ | ....L... | .T.VF... | ........ | E.VG....A... | ........ |
| iPS:43 5953 | VH3|3-11|D7|7-27|RF3|JH4 | ........ | ........ | ....L... | .T.VF... | ........ | E.VG....A... | ........ |
| iPS:43 6098 | VH3|3-11|D7|7-27|RF3|JH4 | ........ | ........ | ....L... | .T.VF... | ........ | E.VG....A... | ........ |
| iPS:43 6102 | VH3|3-11|D7|7-27|RF3|JH4 | ........ | ........ | ....I... | .I.M.... | ........ | E.VG....A... | ........ |
| iPS:43 6104 | VH3|3-11|D7|7-27|RF3|JH4 | ........ | ........ | ....L... | .T.VF... | ........ | E.VG....A... | ........ |
| | Germline | EVQLLES GGGLVQPGGSLR LSCAASG-FTFS | S----YAMS | WVRQAPGK GLEWVS | AISGS GGSTYYAD SVKG | RFTISRDNSKNTLYLQM NSLRAEDTAVYYCAK | GIAVA------GXFDY | WGQGTL VTVSS |
| iPS:43 | VH3|3-23|D6|6-19|RF2|JH4 | | | | | | | |

| | | H_FR1 | H_CDR1 | H_FR2 | H_CDR2 | H_FR3 | H_CDR3 | H_FR4 |
|---|---|---|---|---|---|---|---|---|
| | VH3\|3-23\|D7\|7-27\|RF2\|JH4 | EVQLLES GGGLVQPGGSLR LSCAASGFTFS | S YAMS | WVRQAPGKGLEWVS | AISGS GGSTYYAD SVKG | RFTISRDNSKNTLYLQM NSLRAEDTAVYYCAR | \*LGY -----FDY | WGQGTL VTVSS |
| iPS:43 6019 | 21-225_193C4 | VH3\|3-23\|D7\|7-27\|RF2\|JH4 | ..A......... | ..........N | ............... | ..I.N......... .....R........ ...... | .........S........ .............F..... | D..RYS..........YGF | ........ ..... |
| | Germline | H_FR1 | H_CDR1 | H_FR2 | H_CDR2 | H_FR3 | H_CDR3 | H_FR4 |
| | VH4\|4-30.1\|D1\|1-1\|RF1\|JH6 | QVQLQES GPGLVKPSQTLS LTCTVSGGSIS | SGG-GYWS | WIRQHPGK GLEWIG | YIYY SGSTYYNP SLKS | RVTISVDTSKNQFSLKL SSVTAADTAVYYCAR | GIIGTII -----YYGMDV | WGQGTT VTVSS |
| iPS:43 6025 | 21-225_193B5 | VH4\|4-30.1\|D1\|1-1\|RF1\|JH6 | ........... | ........... | ........... | ........... | ........A........ ................. | -EYNWN- ...H..... | ........ ..... |
| | Germline | H_FR1 | H_CDR1 | H_FR2 | H_CDR2 | H_FR3 | H_CDR3 | H_FR4 |
| | VH4\|4-34\|D4\|4-11\|RF2\|JH4 | QVQLQQW GAGLLKPSETLS LTCAVYG-GSFS | G----YYWS | WIRQPPGK GLEWIG | EINH SGSTNYNP SLKS | RVTISVDTSKNQFSLKL SSVTAADTAVYYCAR | DYSRY -----YFDY | WGQGTL VTVSS |
| iPS:43 6033 | 21-225_193E7 | VH4\|4-34\|D4\|4-11\|RF2\|JH4 | ........... | ......F.T | ............ | ............ | ................. ................. | ..G--- ..-A... | ..A..A ..... |
| iPS:43 6199 | 21-225_199E3 | VH4\|4-34\|D4\|4-11\|RF2\|JH4 | ........... | ......F.T | ............ | ............ | ................. ................. | ..G--- ..-A... | ..A..A ..... |
| iPS:43 6228 | 21-225_200F12 | VH4\|4-34\|D4\|4-11\|RF2\|JH4 | ........... | ......F.T | ............ | ......S..... | ................V ................. | ..G--- ...-A... | ........ ..... |
| iPS:43 6230 | 21-225_201A1 | VH4\|4-34\|D4\|4-11\|RF2\|JH4 | ........... | ......F.T | ............ | ......S..... ......R..... | ........G........ ................. | ..G--- ...-A... | ........ ..... |
| iPS:43 6242 | 21-225_201A10 | VH4\|4-34\|D4\|4-11\|RF2\|JH4 | ...T....... | ......F.T | .....V...... | ......S..... ......S..... | ........N........ ................. | ..G--- ...-A... | ........ ..... |
| iPS:43 6286 | 21-225_204H8 | VH4\|4-34\|D4\|4-11\|RF2\|JH4 | ......F.... | ............ | ............ | ............ | ................. .........K....... | ..G--- ...-A... | ........ ..... |

| | | H_FR1 | H_CDR1 | H_FR2 | H_CDR2 | H_FR3 | H_CDR3 | H_FR4 |
|---|---|---|---|---|---|---|---|---|
| iPS:43_6506 | VH4|4-34|D4|4-17|RF2/J H3 | QVQLQES GGGVVQPGRSLR LSCAASG-FTFS | ........R.... S ........YGMH | WVRQAPGK GLEWVA | .....A.... ..... | ............ ............ | ...A- ---L.F | ............ |
| | 21-225_222C7 | | | | | | | |
| VH3|3-33|D5|5-24|RF2/J|H6 | Germline | QVQLVES GGGVVQPGRSLR LSCAASG-FTFS | S YGMH | WVRQAPGK GLEWVA | VIWYD GSNKYYAD SVKG | RFTISRDNSKNTLYLQM NSLRAEDTAVYYCAR | EWLQFR- -YYYGMDV | WGQGTT VTVSS |
| iPS:43_6092 | VH3|3-33|D5|5-24|RF2/J H6 | ............ ............ | ............ | ............ | ............ | ............ | EWLQFR.- ............ | ............ |
| iPS:43_6164 | VH3|3-33|D5|5-24|RF2/J H6 | ............ .....V...... | ............ | ............ | .T.......... | ............ | EWLQFR.- ........I... | ............ |
| iPS:43_6191 | VH3|3-33|D5|5-24|RF2/J H6 | ............ ............ | N........... | ............ | ...I..F..... .........V.. | .......F.... ............ | EWLQFR.- ............ | ............ |
| iPS:43_6205 | VH3|3-33|D5|5-24|RF2/J H6 | ............ ............ | N........... | ............ | ...I..F..... ............ | .......S.... ............ | EWLQFR.- ............ | ............ |
| iPS:43_6214 | VH3|3-33|D5|5-24|RF2/J H6 | ............ ............ | ............ | ............ | ............ | .......T.... ............ | EWLQFR.- ............ | ............ |
| | | H_FR1 | H_CDR1 | H_FR2 | H_CDR2 | H_FR3 | H_CDR3 | H_FR4 |
| VH3|3-33|D6|6-19|RF3/JH6 | Germline | QVQLVES GGGLVQPGGSLR LSCAASG-FTFS | S YAMS | WVRQAPGK GLEWVS | AISGS GGSTYYAD SVKG | RFTISRDNSKNTLYLQM NSLRAEDTAVYYCAK | **V*QIVYY -YYYGMDV | WGQGTT VTVSS** |
| iPS:43_6106 | VH3|3-33|D6|6-19|RF3/J H6 | ............ ............ | ............F | ............ | ...LN....... ......KC.... | ....C....... ............ | GQ...-- ............ | ............ |
| | | H_FR1 | H_CDR1 | H_FR2 | H_CDR2 | H_FR3 | H_CDR3 | H_FR4 |
| VH3|3-23|D6|6-6|RF3/JH6 | Germline | EVQLLES GGGLVQPGGSLR LSCAASG-FTFS | S YAMS | WVRQAPGK GLEWVS | AISGS GGSTYYAD SVKG | RFTISRDNSKNTLYLQM NSLRAEDTAVYYCAK | **V*QIVYY -YYYGMDV | WGQGTT VTVSS** |
| iPS:43_6110 | VH3|3-23|D6|6-6|RF3/JH 6 | ............ .....F...... | .....C..T | ............ | ............ | ............ | .GG.TGSY ............ | ............ |
| iPS:43_6196F4 | | | | | | | N.V.. | |
| | | H_FR1 | H_CDR1 | H_FR2 | H_CDR2 | H_FR3 | H_CDR3 | H_FR4 |

| | Germline | H_FR1 | H_CDR1 | H_FR2 | H_CDR2 | H_FR3 | H_CDR3 | H_FR4 |
|---|---|---|---|---|---|---|---|---|
| iPS:43 6834 | VH1|1-18/D3|3-3|RF2/JH6 | ......... | ........V. | .......... | ......RK. | .................... | HDFWSGY---- ...... | ........ |
| iPS:43 6842 | VH1|1-18/D3|3-3|RF2/JH6 | .......N | .......... | .L........ | .....KN. | .................... | HDFWSGY---- ..K... | ........ |
| iPS:43 6844 | VH1|1-18/D3|3-3|RF2/JH6 | .......N | .......... | .......... | ......K.. ..F. | .................... | HDFWSGY---- ..K... | ........ |
| iPS:43 6846 | VH1|1-18/D3|3-3|RF2/JH6 | .......N | .......F. | .......... | ......KE. ..F. | ..........A......... ............... S | HDFWSGY---- ..K... | ........ |
| iPS:45 1104 | VH1|1-18/D3|3-3|RF2/JH6 | .......N | .......... | .......... | ......K.. | .................... | HDFWSGY---- ..K... | ........ |
| iPS:45 1106 | VH1|1-18/D3|3-3|RF2/JH6 | .......N | .......... | .L........ .F........ | .....KN. | .................... | HDFWSGY---- ..K... | ........ |
| iPS:45 1108 | VH1|1-18/D3|3-3|RF2/JH6 | .......N | .......... | .......... | ......KF. | .................... | HDFWSGY---- ..K... | ........ |
| VH6|6-01/D3|3-9|RF1/JH6 | | EVQLQQS--- GPGLVKPSQTLS LTCAISG-DSVS | SN---SAAWN | WIRQSPSR GLEWLG | RTYYR- SKWYNDYA VSVKS | RITINPDTSKNQFSLQL NSVTPEDTAVYYCAR | **YERYFDWLL*- ---YYYYYGMDV | WGQGT VTVSS** |
| iPS:43 6236 | VH6|6-01/D3|3-9|RF1/JH6 | .......... | .......... | .......... | ....Y.E. ...R. | ...................F | DQ..Y------ ........ | ........ |
| iPS:43 6250 | VH6|6-01/D3|3-9|RF1/JH6 | .......... | .......... | .......... | ....Y.E. | ...................F | DQ..Y------ ........ | ........ |
| iPS:43 6252 | VH6|6-01/D3|3-9|RF1/JH6 | .......... | .......... | .......... | .....E. ...R. | ..........L..T...... | DQ..Y------ ........ | ...P.... |

| | | | | | | | | |
|---|---|---|---|---|---|---|---|---|
| iPS:43 6316 | 21-225_206A5 | VH1|1-02/D5|5-18|RF3/J H5 | ..........I............ | ..........A............ | ....................... | ....................T.. | ....................... | ....................... |
| iPS:43 6338 | 21-225_208E8 | VH1|1-02/D5|5-18|RF3/J H5 | ..........I............ | ..........A............ | ....................... | ....................T.. | ....................... | ....................... |
| iPS:43 6344 | 21-225_208B11 | VH1|1-02/D5|5-18|RF3/J H5 | ..........I............ | ..........A............ | ....................... | ....................T.. | ....................... | ....................... |
| iPS:43 6358 | 21-225_210D11 | VH1|1-02/D5|5-18|RF3/J H5 | ........H.I............ | ..........A............ | ........S.............. | ....................T.. | ....................... | ....................... |
| iPS:43 6408 | 21-225_214H8 | VH1|1-02/D5|5-18|RF3/J H5 | ........H.I............ | ....................... | ........S....E......... | ....................K.. | ....................... | DGR.S.G............. ......YD........ |
| iPS:43 6424 | 21-225_215H6 | VH1|1-02/D5|5-18|RF3/J H5 | .......D......N........ | ....................... | ....................... | ....................... | ....................... | DGR.S.G............. ......HD........ |
| iPS:43 7092 | 21-225_210B12 | VH1|1-02/D5|5-18|RF3/J H5 | .......D.......I..R.... | ....................... | .................K..... | ....................... | ....................... | ..DS---........... ...---.A......... |
| iPS:43 7134 | 21-225_213A7 | VH1|1-02/D5|5-18|RF3/J H5 | .........F....N........ | ....................... | ................N...... | ................L.R.K.. | ....................... | ..DS---........... ...---.A......... |
| iPS:43 7194 | 21-225_226B2 | VH1|1-02/D5|5-18|RF3/J H5 | .........F....F........ | ....................... | ..................D..... | ....................LN. | ....................... | TY..SGS............ ....YF.EL.S........ |
| iPS:43 7196 | 21-225_226B7 | VH1|1-02/D5|5-18|RF3/J H5 | ..............F........ | ....................... | ..................D..... | ...............H....I.. | ....................... | Y..SGS............ ....YY......S........ |
| iPS:43 7200 | 21-225_226A10 | VH1|1-02/D5|5-18|RF3/J H5 | ....................... | ....................... | ..................D..... | ................L...I.. | ....................... | TY..SGS............ ....YF.EL.S........ |
| iPS:39 3168 | 21-225_32B11 | VH1|1-02/D5|5-18|RF3/J H5 | ....................... | ....................... | ..................D..... | ....................... | ..................N.... | FY..SGS............ ....YY.DL......... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 3178 | 21-225_34D7 | VH1\|1-02\|D5\|5-18\|RF3\|JH5 | ........................ | ........ | ........ | ........................ | Y...SGS........ | ........ |
| iPS:39 8480 | 21-225_17G4 | VH1\|1-02\|D5\|5-18\|RF3\|JH5 | ......D.............T.. | ........ | ........E. | ........ | ....YY.DL.. | ........ |
| iPS:39 8486 | 21-225_19A1 | VH1\|1-02\|D5\|5-18\|RF3\|JH5 | ........................ | ........ | ........ | ........S | ........................ | ........ |
| | Germline | H_FR1 | H_CDR1 | H_FR2 | H_CDR2 | H_FR3 | H_CDR3 | H_FR4 |
| VH1\|1-08\|D6\|6-13\|RF1\|JH6 | | QVQLVQS-GAEVKKPGASVK VSCKASG-YTFT | S------YDIN | WVRQAPGQG LEWMG | WMHPN-- SGNTGYAQ KFQG | RVTMTRDTS ISTAYMEL SSLRSEDTAVYYCAR | GYSSSWYY------ ---YYYGMDV | WGQGTT VTVSS |
| iPS:43 6248 | 21-225_202A3 | VH1\|1-08\|D6\|6-13\|RF1\|JH6 | ............E.. | ........ | ......L. | ..K.......... | ............... | ..RY.RED.....D... | ........ |
| | Germline | H_FR1 | H_CDR1 | H_FR2 | H_CDR2 | H_FR3 | H_CDR3 | H_FR4 |
| VH3\|3-11\|D4\|4-17\|RF2\|JH6 | | QVQLVES-GGGVQPGGSLR LSCAASG-FTFS | D------YAMS | WVRQAPGK GLEWVS | AISGS-- GGSTYYAD SVKG | RFTISRDNSKNTLYLQM NSLRAEDTAVYYCAK | DYGDYYY------ ---YYYGMDV | WGQGTT VTVSS |
| iPS:43 6270 | 21-225_203F10 | VH3\|3-11\|D4\|4-17\|RF2\|JH6 | ........ | ........ | ........L | ...G.......... | ........ | .R.G------- --L.. | ........ |
| | Germline | H_FR1 | H_CDR1 | H_FR2 | H_CDR2 | H_FR3 | H_CDR3 | H_FR4 |
| VH3\|3-23\|D1\|1-20\|RF2\|JH6 | | EVQLLES-GGGVQPGRSLR LSCAASG-FTFS | S------YAMS | WVRQAPGK GLEWVS | AISGS-- GGSTYYAD SVKG | RFTISRDNSKNTLYLQM NSLRAEDTAVYYCAK | GITGTYY------ ---YYYGMDV | WGQGTT VTVSS |
| iPS:43 6280 | 21-225_204D6 | VH3\|3-23\|D1\|1-20\|RF2\|JH6 | ............V.. | ......T. | ........ | ...TT......... | ...D.......... | .....S.GSY......V... | ........ |
| | Germline | H_FR1 | H_CDR1 | H_FR2 | H_CDR2 | H_FR3 | H_CDR3 | H_FR4 |
| VH3\|3-33\|D7\|7-27\|RF2\|JH6 | | QVQLVES-GGGVQPGRSLR LSCAASG-FTFS | S------YGMH | WVRQAPGK GLEWVA | VIWYD-- GSNKYYAD SVKG | RFTISRDNSKNTLYLQM *GYYY--- ---YYYGMDV | WGQGTT VTVSS |
| iPS:43 6284 | 21-225_204G8 | VH3\|3-33\|D7\|7-27\|RF2\|JH6 | ...........D... | ........ | ...G..... | ....EN.VA........ | ........E............ | ....D..IG....... | ........ |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6968 | 21- 225_190B10 | VH3|3- 33|D7|7- 27|RF2|J H6 | ........V........ | ........ | ........ | ....N... ..K..HV. ........ | ................. .........L....... | D.DKRNFPY....... ...YY........... | ........ ........ |
| iPS:43 7006 | 21- 225_192G2 | VH3|3- 33|D7|7- 27|RF2|J H6 | ................ | ........ | .......T | ....N... ........ ........ | ................. .........L....... | D.DKRNFPY....... ...YY........... | ........ ........ |
| iPS:43 7024 | 21- 225_194F11 | VH3|3- 33|D7|7- 27|RF2|J H6 | ................ | ........ | ........ | ....N... ..K..HV. ........ | ................. .........L....... | D.DKRNFPY....... ...YY........... | ........ ........ |
| iPS:43 7028 | 21- 225_194G12 | VH3|3- 33|D7|7- 27|RF2|J H6 | ................ | ........ | .......T | ....N... ........ ........ | ................. .........L....... | D.DKRNFPY....... ...YY........... | ........ ........ |
| Germline VH4|4- 34|D6|6- 19|RF3|J H3 | | H_FR1 QVQLQQW GPGLLKPSETLS LTCAVYG.GSFS | H_CDR1 .YWS | H_FR2 WIRQPPGK GLEWIG | H_CDR2 EINH SGSTNYNP SLKS | H_FR3 RVTISVDTSKNQFSLKL SSVTAADTAVYYCAR | H_CDR3 VKQWLV......... .........DAPDI. | H_FR4 WGQGTL VTVSS |
| iPS:43 6290 | 21- 225_205G3 | ............H... ...F............ | ........ | ........ | .MY..... F..N.... ........ | .............M.K. ................. | ....G........... ................. | ........ ........ |
| Germline VH3|3- 30.3|D4|4 - 17|RF2|J H1 | | H_FR1 QVQLVES GGGVVQPGGSLR LSCAASG.FTFS | H_CDR1 .YAMH | H_FR2 WVRQAPGK GLEWVA | H_CDR2 VISYD GSNKYYAD SVKG | H_FR3 RFTISRDNSKNTLYLQM NSLRAEDTAVYYCAR | H_CDR3 DYGYA............ .........EYFQH.. | H_FR4 WGQGTL VTVSS |
| iPS:43 6306 | 21- 225_201H4 | ................ ................ | ........ | ........ | A.W..... ........N ........ | .............M... ................. | V.TVG........... ...........AT.DC | ........ ......P. |
| Germline VH1|1- 18|D1|1- 1|RF1|J H6 | | H_FR1 QVQLVQS GAEVKKPGASVK VSCKASG.YTFT | H_CDR1 .SYGIS | H_FR2 WVRQAPGQ GLEWMG | H_CDR2 WISAY NGNTNYAQ KLQG | H_FR3 RVTMTTDTSISTAYMEL RSLRSEDTAVYYCAR | H_CDR3 GIGYP............ .........YYSMDV. | H_FR4 WGQGTT VTVSS |
| iPS:43 6362 | 21- 225_210C12 | .......T........ ................ | N.....N. | ........ | ....N... ........H ........ | ................. .........G....... | DP.V.H.......... ................. | ........ ........ |
| iPS:43 6374 | 21- 225_211C10 | ................ ................ | R.....H. | ........ | ........ .....L.. .....F.. | ................. ................. | DP.V.H.......... ................. | ........ ........ |

Figure 52 (Continued)

| VH3/3-33/D5/5-18/RF3/JH6 | | LVQLVES GGGVQPGRSLR LSCAASG FTFS | YGMH | WVRQAPGK GLEWVA | VIWYD GSNKYYAD SVKG | RFTISRDNSKN TLYLQMNSLRAEDTAVYYCAR | | | WGQGTVTVSS |
|---|---|---|---|---|---|---|---|---|---|
| iPS:43 6366 | 21-225_211A3 | VH3/3-33/D5/5-18/RF3/JH6 | V...I... | | .A. | | | DG... | ... |
| iPS:43 6388 | 21-225_212H11 | VH3/3-33/D5/5-18/RF3/JH6 | V...I... | | .A. | ..N.E. | | D... | ... |
| iPS:43 6396 | 21-225_213E5 | VH3/3-33/D5/5-18/RF3/JH6 | V...I... | | .A. | ..N.E. | | DG... | ... |
| iPS:43 6454 | 21-225_217B10 | VH3/3-33/D5/5-18/RF3/JH6 | V...I... | | .A. | ..N.E. | | D... | ... |
| iPS:43 6668 | 21-225_147B9 | VH3/3-33/D5/5-18/RF3/JH6 | | | | | | DG... | ... |
| iPS:43 6688 | 21-225_148C8 | VH3/3-33/D5/5-18/RF3/JH6 | | | | | | D... | ... |
| iPS:43 6706 | 21-225_149A11 | VH3/3-33/D5/5-18/RF3/JH6 | | | | | | DRD.DPPY.Y... | ... |
| iPS:43 6760 | 21-225_155E10 | VH3/3-33/D5/5-18/RF3/JH6 | | | | | | DRD.DPPY.Y... | ... |
| iPS:43 6966 | 21-225_190C3 | VH3/3-33/D5/5-18/RF3/JH6 | ...D..E | ..L. | | | | DRD.DPPY.Y... | ... |
| iPS:43 6976 | 21-225_190D8 | VH3/3-33/D5/5-18/RF3/JH6 | | ..L. | | | ..N | W.Y.Y--- | ... |
| iPS:43 7168 | 21-225_218G4 | VH3/3-33/D5/5-18/RF3/JH6 | | | | | ..N...V | W.Y.Y--- | ... |
|  |  |  |  |  |  |  | ..N | W.Y.Y--- | ... |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH3/3-33/D5/5-24/RF3/JH5 | | QVQLVES GGGVQPGRSLR LSCAASG FTFS | S....YGMH | WVRQAPGK GLEWVA | VIWYD GSNKYYAD SVKG | RFTISRDNSKNTLYLQM NSLRAEDTAVYYCAR | RDGYNY-----NWFDP | WGQGTL VTVSS |
| iPS:43-6368 | 21-225_211G3 | VH3/3-33/D5/5-24/RF3/JH5 | N.... | ........ | ....H..... | ........ | L.YS....G.... | ........ |
| iPS:43-6426 | 21-225_215C7 | VH3/3-33/D5/5-24/RF3/JH5 | Y.... | ........ | ....H..... | ........ | L.YS....G.... | ........ |
| iPS:43-6432 | 21-225_215H12 | VH3/3-33/D5/5-24/RF3/JH5 | N.... | ........ | ....H..... | ........ | L.YS....G.... | ........ |
| | Germline | H_FR1 | H_CDR1 | H_FR2 | H_CDR2 | H_FR3 | H_CDR3 | H_FR4 |
| VH1/1-18/D4/4-11/RF2/JH6 | | QVQLVQS GAEVKKPGASVK VSCKASG YTFT | S....YGIS | WVRQAPGQ GLEWMG | WISAY NGNTNYAQ KLQG | RVTMTTDTSTSTAIYMEL RSLRSDDTAVYYCAR | DISNYYY-----YYYGMDV | WGQGTT VTVSS.K |
| iPS:43-6402 | 21-225_213H12 | VH1/1-18/D4/4-11/RF2/JH6 | ....N... | .F.... | ........ | ....D..... | ........ | YY-----...... |
| iPS:43-6500 | 21-225_222H3 | VH1/1-18/D4/4-11/RF2/JH6 | ....N... | .F.... | ........ | ....V..... | ........ | YY-----...-.F. |
| iPS:43-6520 | 21-225_223G10 | VH1/1-18/D4/4-11/RF2/JH6 | ....N... | .F.... | ........ | .S..V..... | ........ | YY-----...... |
| | Germline | H_FR1 | H_CDR1 | H_FR2 | H_CDR2 | H_FR3 | H_CDR3 | H_FR4 |
| VH3/3-48/D2/2-21/RF1/JH4 | | EVQLVES GGGLVQPGGSLR LSCAASG FTFS | S....YSMN | WVRQAPGK GLEWVS | YISSS SSTIYYAD SVKG | RFTISRDNAKNSLYLQM NSLRDEDTAVYYCAR | SILWW*L-----LYFFDY | WGQGTL VTVSS |
| iPS:43-6436 | 21-225_216F10 | VH3/3-48/D2/2-21/RF1/H4 | .....S.R | ........ | ........ | ...TG..... | ........ | .G.A-----..-VE. |
| VH3/3-48/D6/6-6/RF1/JH4 | Germline | H_FR1 EVQLVES GGGLVQPGGSLR LSCAASG FTFS | H_CDR1 S....YSMN | H_FR2 WVRQAPGK GLEWVS | H_CDR2 YISSS SSTIYYAD SVKG | H_FR3 RFTISRDNAKNSLYLQM NSLRDEDTAVYYCAR | H_CDR3 EYSSS-----SYFDY | H_FR4 WGQGTL VTVSS |

| | | | | | | | | | |
|---|---|---|---|---|---|---|---|---|---|
| iPS:43 6558 | 21- 225_224C11 | VH1\|1- 02\|D4\|4- 23\|RF2\|J H6 | . . . . . . . . . . . . . . . | . . . I . . . . . . . . . . . | . . . . . . . . . . . . . . . | . . . Y . . . . . . . . . . . | . . R . F . . . . . . . . . . | . . . W . . Y . S . . . . . F . . . . . |
| iPS:43 6562 | 21- 225_224H11 | VH1\|1- 02\|D4\|4- 23\|RF2\|J H6 | . . . . . . . . . . . . . . . | . . . I . . . T . . . . . . . | . . . . . . . . . . . . . . . | . . . Y . D . . . . . . . . . | . . R . F . . . . . . . . . . | . . . W . . Y . S . . . . . F . . . . . |
| iPS:43 6572 | 21- 225_225G4 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . R . F . . . . . . . . . . | . . . W . . Y . S . . . . . F . . . . . |
| iPS:43 6606 | 21- 225_226G8 | VH1\|1- 02\|D4\|4- 23\|RF2\|J H6 | . . . . . . . . . . . . . . . | . . . I . . . . . . . . . . . | . . . . . . . . . . . . . . . | . . . Y D . K . . . . . . . . | . . . . F . . . . . . . . . . | . . . W . . Y . S . . . . . F . . . . . |
| iPS:43 6610 | 21- 225_226F9 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . . A F . . . . . . . . . . | . . . W . . Y . S . . . . . F . . . . . |
| iPS:43 6612 | 21- 225_226H9 | VH1\|1- 02\|D4\|4- 23\|RF2\|J H6 | . . . . . . . . . . . . . . . | . . . I . . . . . . . . . . . | . . . . . . . . . . . . . . . | . . . Y D . S . . . . . . . . | . . . L F . . . . . . . . . . | . . . W . . Y . S . . . . . F . . . . . |
| iPS:43 6614 | 21- 225_226F10 | VH1\|1- 02\|D4\|4- 23\|RF2\|J H6 | . . G . . . . L R . . . . . . | . . . I . . . . . . . . . . . | . . . . . . . . . . . . . . . | . . . Y . D . . . . . . . . . | . . . . F . . . . . . . V . . | . . . W . . Y . S . . . . . F . . . . P |
| iPS:43 6618 | 21- 225_226E11 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . . . F . . . . . . . . . . | . . . W . . Y . S . . . . . F . . . . . |
| iPS:43 6624 | 21- 225_226H12 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . R . F . . . . . . . . . . | . . . W . . Y . S . . . . . F . . . . . |
| iPS:43 6626 | 21- 225_227C1 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . . . F . . . . . . . . . . | . . . W . . Y . S . . . . . F . . . . . |
| iPS:43 6628 | 21- 225_227F2 | VH1\|1- 02\|D4\|4- 23\|RF2\|J H6 | . . H . . . . . . . . . . . . | . . . I . . . . . . . . . . . | . . . . . . . . . . . . . . . | . . . Y D . K . . . . . . . . | . . . . F . . . . . . . . . . | . . . W . . Y . S . . . . . F . . . . . |
| iPS:43 6640 | 21- 225_227A8 | VH1\|1- 02\|D4\|4- 23\|RF2\|J H6 | . . . . . . . . . . . . . . . | . . . I . . . . . . . . . . . | . . . . . . . . . . . . . . . | . . . Y . D . . . . . . . . . | . . . . F . . . . . . . V . . | . . . W . . Y . S . . . . . F . . . . . |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4|4-39|D4|4-17|RF1|JH4 | | QIQLQES GPGLVKPSETLS LICTVSG-GSIS | SS..SYWG | WIRQHPGK GLEWIG | SIYY..SGSTYYNP SLKS | RVTISVDTSKNQFSLKL SSVTAADTAVYYCAR | *IR*...........YFDY | WGQGTL VTVSS |
| iPS:43 6638 | 21-225_224C3 | ......S.............. | R...... | ........ | ........N...... | ................ | QG.DW........GV.. | G...... |
| VH3|3-23|D4|4-11|RF2|JH5 | | EVQLLES GGGLVQPGGSLR LSCAASG-FTFS | ...SYAMS | WVRQAPGK GLEWVS | AISGS..GGSTYYAD SVKG | FTISRDNSKNTLYLQM NSLRAEDTAVYYCAR | ...........NWFDP | WGQGTL VTVSS |
| iPS:43 6546 | 21-225_224D6 | ......V.............S.... | ........D | ........ | ......DN.F..... | ................ | V.A.D..........SH.... | ...... |
| VH1|1-46|D6|6-6|RF2|JH6 | | QVQLVQS GAEVKKPGASV KVSCKASG-YTF | ...SYAMH | WVRQAPGQ GLEWMG | LINPS..GGSTSYAQ KFQG | RVTMTRDTSISTAYMEL SSLRSEDTAVYYCAR | SIAARYY.....YYYGMDV | WGQGTT VTVSS |
| iPS:43 6568 | 21-225_225B3 | .................................. | ........ | ........ | ........ | ..........A...... | DL...S.Y...........F... | .......A |
| VH4|4-30.1|D4|4-17|RF2|JH6 | | QVQLQES GPGLVKPSQTLS LTCTVSG-GSIS | SS..GYYWS | WIRQPPGK GLEWIG | YIYY..SGSTYYNP SLKS | RVTISVDTSKNQFSLKL SSVTAADTAVYYCAR | DYGDVYY.....YYYGMDV | WGQGTT VTVSS |
| iPS:43 6580 | 21-225_225E7 | ......N.............. | .......H | ........ | .....F...... | ................ | EA...G-................ | ...... |
| iPS:43 6926 | 21-225_78D10 | .................................. | ........ | ........ | ......I...V. | ................ | AP.F-................. | ...... |
| VH3|3-33|D4|4-17|RF2|JH1 | | QVQLVES GGGVVQPGRSLR LSCAASG-FTFS | ...SYGMH | WVRQAPGK GLEWVA | VIWYD..GSNKYYAD SVKG | RFTISRDNSKNTLYLQM NSLRAEDTAVYYCAR | DYGNYA........EYFQH | WGQGTT VTVSS |
| iPS:43 6592 | 21-225_226B1 | ......T.............. | ........ | ........ | ......I...GY. | ................F | .HY.FW.......SG.LT. | ...... |

Figure 52 (Continued)

| | Germline | H_FR1 EVOLVES GGSIVQPGGSLR LSCAASG-FTFS | H_CDR1 S...YAMS | H_FR2 WVRQAPGK GLEWVS | H_CDR2 AISS GGSITYAD SVKG | H_FR3 RFTISRDNSKNTLYLQM NSLRAEDTAVYYCAR | H_CDR3 IGYYY..........YYGMDV | H_FR4 WGQGT VTVSS |
|---|---|---|---|---|---|---|---|---|
| VH3|3-23|D7|7-27|RF1|JH6 | | | | | | | | |
| iPS:43 6652 | 21-225_146B11 | VH3|3-23|D7|7-27|RF1|JH6 | . . . . . . . . . . | . . . . . . . | V . . . G . . . . S . . | . . . . . . . . . . . . . . . . . . . . . . . . . . . . . . . . . . . | WR . NPT . . . . . D . | . . . . . |
| iPS:43 6654 | 21-225_146C11 | . . . . . . . . . I . . . | . . . . . . . . . . | . . . . . . . | V . . . G . . . . S . . | . . . . . . . . . . . . . . . . . . . . . . . . . . . . . . . . . . . | WR . NPT . . . . . D . | . . . . . |
| iPS:43 6658 | 21-225_146A2 | VH3|3-23|D7|7-27|RF1|JH6 | . . . . . . . . . . | . . . . . . . | V . . . G . . . . S . . | . . . . . . . . . . . . . . . . . . H . . . . . . . . . . . . . . . . | WR . NPT . . . . . D . | . . . . . |
| iPS:43 6664 | 21-225_147E7 | VH3|3-23|D7|7-27|RF1|JH6 | . . . . . . . . . . | . . . . . . . | V . . . G . . . . S . . | . . . . L . . . . . . . . . . . . . . . F . . . . . . . . . . . . . . | WR . NPT . . . . . D . | . . . . . |
| iPS:43 6676 | 21-225_147E11 | VH3|3-23|D7|7-27|RF1|JH6 | N . . . . . . V . . . | . . . . . . . | V . . . G . . . . S . . | . . . . . . . . . . . . . . . . . . . . . . . . . . . . . . . . . . . | WR . NPT . . . . . D . | . . . . . |
| iPS:43 6678 | 21-225_147B12 | VH3|3-23|D7|7-27|RF1|JH6 | . . . . . . . . . . | . . . . . . . | V . . . G . . . . S . . | . . . . . . . . . . . . . . . . . . . . . . . . . . . . . . . . . . . | WR . NPT . . . . . D . | . . . . . |
| iPS:43 6686 | 21-225_148G6 | VH3|3-23|D7|7-27|RF1|JH6 | . . . . . . P . . . | . . . . . . . | V . . . G . . . . S . . | . . . . . . . . . . . . . . . . . . M . H . . . . . . . . . . . . . . | WR . NPT . . . . . D . | . . . . . |
| iPS:43 6694 | 21-225_148G11 | . . . . . . . . . . | . . . . . . . H . . . | . . . . . . . | V . . . G . . . . S . A . . | . . . . . . . . . . . . . . . . . . . . . . . . . . . . . . . . . . . | WR . NPT . . . . . D . | . . . . . |
| iPS:43 6700 | 21-225_149C7 | VH3|3-23|D7|7-27|RF1|JH6 | . . . . . . . . . . | . . . . . . . | V . . . G . . . . S . . | . . . . . . . . . . . . . . . . . . . . . . . . . . . . . . . . . . . | WR . NPT . . . . . D . | . . . . . |
| iPS:43 6704 | 21-225_149C10 | . . . . . F . . . | . . . . . . . . . . | . . . . . . . | V . . . G . . . . S . . | . . . . . . . . . . . . . . . . . . . . . . . . . . . . . . . . . . . | WR . NPT . . . . . D . | . . . . . |

Figure 52 (Continued)

| | | | | | | |
|---|---|---|---|---|---|---|
| iPS:43 6710 | 21- 225_150F6 | VH3\|3- 23\|D7\|7- 27\|RF1/J H6 | ... | V...G .S | ... | WR.NPT ......D |
| iPS:43 6714 | 21- 225_150H11 | VH3\|3- 23\|D7\|7- 27\|RF1/J H6 | ...T | I...G .S | ... | WR.NPT ......D |
| iPS:43 6718 | 21- 225_151H5 | VH3\|3- 23\|D7\|7- 27\|RF1/J H6 | ... | V...G .S | ... | WR.NPT ......D |
| iPS:43 6722 | 21- 225_151H7 | VH3\|3- 23\|D7\|7- 27\|RF1/J H6 | ... | V...G .S | ... | WR.NPT ......D |
| iPS:43 6724 | 21- 225_151B9 | VH3\|3- 23\|D7\|7- 27\|RF1/J H6 | ... | V...G .S | ... | WR.NPT ......D |
| iPS:43 6728 | 21- 225_152G6 | VH3\|3- 23\|D7\|7- 27\|RF1/J H6 | ... | V...G .S | ... | WR.NPT ......DS |
| iPS:43 6730 | 21- 225_152D7 | VH3\|3- 23\|D7\|7- 27\|RF1/J H6 | ... | V...G .S | ... | WR.NPT ......D |
| iPS:43 6742 | 21- 225_154C4 | VH3\|3- 23\|D7\|7- 27\|RF1/J H6 | ...H | V...G .S | ... | WR.NPT ......D |
| iPS:43 6746 | 21- 225_154E10 | VH3\|3- 23\|D7\|7- 27\|RF1/J H6 | ... | V...G .S | ... | WR.NPT ......D |
| iPS:43 6758 | 21- 225_155C10 | VH3\|3- 23\|D7\|7- 27\|RF1/J H6 | ... | V...G .S | ... | WR.NPT ......D |
| iPS:43 6938 | 21- 225_146A3 | VH3\|3- 23\|D7\|7- 27\|RF1/J H6 | ... | V...G .TT | ... | WR.NPT ......D |
| iPS:43 7250 | 21- 225_148C6 | VH3\|3- 23\|D7\|7- 27\|RF1/J H6 | ... | V...G .S | ... | WR.NPT ......D |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43-7252 | 21-225_148H11 | VH3J3-23JD7J7-27JRF1/JH6 | | | V..G .S | | WR.NPT .D | |
| iPS:43-7282 | 21-225_207C9 | VH3J3-23JD7J7-27JRF1/JH6 | | | | | AG.TTGSY Y.N | |
| | Germline | | H_FR1 | H_CDR1 | H_FR2 | H_CDR2 | H_FR3 | H_CDR3 | H_FR4 |
| VH3J3-48JD4J4-11JRF2/JH6 | | EVQLVES GGGLVQPGGSLR LSCAASG-FTFS | SYSM | WVRQAPGK GLEWVS | SSIYYAD SVKG | RFTISRDNAKNSLYLQM NSLRDEDTAVYYCAR | --TTGMDV | WGQGT TVTVSS |
| iPS:43-6660 | 21-225_146D8 | VH3J3-48JD4J4-11JRF2/JH6 | | N. | | R. N.K..V | | R.GS.GY ....F....L | |
| iPS:43-6682 | 21-225_146A8 | VH3J3-48JD4J4-11JRF2/JH6 | ..K. E....V | N. | | R. N.K. R. | | R.GS.GY ....F....L | |
| iPS:43-6684 | 21-225_146B6 | VH3J3-48JD4J4-11JRF2/JH6 | | N. | | R. N.KH | D | R.GS.GY ....F....L | |
| iPS:43-6696 | 21-225_149A1 | VH3J3-48JD4J4-11JRF2/JH6 | M. | N. | V | R. N.KH | | R.GS.GY ....F....L | |
| iPS:43-6712 | 21-225_150F9 | VH3J3-48JD4J4-11JRF2/JH6 | | N. | | R. N.K. | | R.GS.GY ....F | |
| iPS:43-6762 | 21-225_156H2 | VH3J3-48JD4J4-11JRF2/JH6 | I. | | A | G..T. ..Q. | R. | SRKGF- ....L. | I. |
| iPS:43-6820 | 21-225_179D10 | VH3J3-48JD4J4-11JRF2/JH6 | | | | | D. R. | | |
| iPS:43-7262 | 21-225_170E4 | VH3J3-48JD4J4-11JRF2/JH6 | ...S | | | G..K. ..E. | | .SRKGF- ....L. | |
| | Germline | | H_FR1 | H_CDR1 | H_FR2 | H_CDR2 | H_FR3 | H_CDR3 | H_FR4 |

Figure 52 (Continued)

| | | QVQLVQS GAEVKKPGASVK VSCKASG-YTFT | S YDIN | WVRQATG QGLEWMG | WMNPN SGNTGYAQ KFQG | RVTMTRNTSISTAYMEL SSLRSEDTAVYYCAR | VDIVATTY -YYYGMDV | WGQGTT VTVSS |
|---|---|---|---|---|---|---|---|---|
| | | H_FR1 | H_CDR1 | H_FR2 | H_CDR2 | H_FR3 | H_CDR3 | H_FR4 |
| VH1|1-08|D5|5-12|RF1|JH6 | VH1|1-08|D5|5-12|RF1|JH6 Germline | | | | | | | |
| iPS:43 6662 21-225_147D7 | | .................. | ........ | ............ | ............ | R................... | A....LVPAAI ..PYN..FA... | ........... |
| VH1|1-02|D3|3-3|RF2/JH6 | VH1|1-02|D3|3-3|RF2/JH6 Germline | QVQLVQS GAEVKKPGASVK VSCKASG-YTFT | S YDIN | WVRQATG QGLEWMG | WMNPN SGNTGYAQ KFQG | RVTMTRNTSISTAYMEL SSLRSEDTAVYYCAR | YYYYGMDV | WGQGTT VTVSS |
| iPS:43 6666 21-225_147B8 | VH1|1-02/D3|3-3|RF2/JH6 | .................. | D.......L | ............ | ......D....... | ................... | DR.SG..S.P. | ........... |
| VH3|3-33|D3|3-3|RF2/JH6 | VH3|3-33|D3|3-3|RF2/JH6 Germline | QVQLVES GGGVVQPGRSLR LSCAASG-FTFS | S YGMH | WVRQAPGK GLEWVA | VIWYD GSNKYYAD SVKG | RFTISRDNSKNTLYLQM NSLRAEDTAVYYCAR | YYFDWSGYYT YYYYGMDV | WGQGTT VTVSS |
| | | H_FR1 | H_CDR1 | H_FR2 | H_CDR2 | H_FR3 | H_CDR3 | H_FR4 |
| iPS:43 6672 21-225_147F9 | VH3|3-33|D3|3-3|RF2/JH6 | .................. | T........ | ............ | ....G. ...D.. | .....I............. | DR.YC..GTC ...P....... | ........... |
| iPS:43 6674 21-225_147G9 | VH3|3-33|D3|3-3|RF2/JH6 | .................. | T........ | ............ | ....G. .D.D.. | .....I............. | DR.YC..GSC ...P....... | ........... |
| iPS:43 6690 21-225_148A9 | VH3|3-33|D3|3-3|RF2/JH6 | .................. | T........ | ............ | ....G. ...D.. | .....I............. | DR.YC..GTC ...P....... | ........... |
| iPS:43 6708 21-225_150D3 | VH3|3-33|D3|3-3|RF2/JH6 | .................. | T........ | ............ | ....G. ...D.. | .....I............. | DR.YC..GTC ...P....... | ........... |
| iPS:43 6716 21-225_151F3 | VH3|3-33|D3|3-3|RF2/JH6 | .................. | T........ | ............ | ....G. ..TD.. | .....I............. | DR.YC..TSC ...P....... | ........... |
| iPS:43 6738 21-225_153D9 | VH3|3-33|D3|3-3|RF2/JH6 | ..........V....... | T........ | ............ | ....G. ...D.. | .....I............. | DR.YC..GSC ...P....... | ........... |
| iPS:43 6740 21-225_154C3 | VH3|3-33|D3|3-3|RF2/JH6 | ...............T.. | T........ | ............ | V..G. ..N.D.. | .....I............. | DR.YC..GSC ...P....... | ........... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43_6748 | 21-225_154D11 | VH3|3-33|D3|3-3|RF2/JH6 | . . . . . . . . . . . . . . . . . . . . . . . . . NV. | T. . . . . . . . . . . | . . . . . . . . . . . . . . . . . | . . . G. . . . . . . . . . . . . . . D. . . . . | . . . . . . . . . . . . . . . . . . . . . . . . . S. . . | DR.YC..GSC. . . . . . . . . . . . . . . . . . . . . . . . . . P. . . . | . . . . . . . . . . . . . . . . . . . . . . |
| iPS:43_6764 | 21-225_158E9 | VH3|3-33|D3|3-3|RF2/JH6 | . . . . . . . . . . . . . . . . . . . | . . . . . . . . . . . | . . . . . . . . . . . . . . . . . | . . . . . . . . . . . . . . . . . . . . . . . . . S. . . | . . . . . . . . . . . . . . . . . . . . . . . . . . . . . | DRV.C..TSC. . . . . . . . . . . . . . . . . . . . . . . . . . P. . . . | . . . . . . . . . . . . . . . . . . . . . . |
| iPS:43_6774 | 21-225_161E10 | VH3|3-33|D3|3-3|RF2/JH6 | . . . . . . . . . . . . . . . . . . . | . . . . . . . . . . . | . . . . . . . . . . . . . . . . . | . . . . . . . . . . . . . . . . . . . . . . . . . V. . . | . . . . . . . . . . . . . . . . . . . . . . . . . . . . . | DRV.C..TSC. . . . . . . . . . . . . . . . . . . . . . . . . . P. . . . | . . . . . . . . . . . . . . . . . . . . . . |
| iPS:43_6916 | 21-225_74A9 | VH3|3-33|D3|3-3|RF2/JH6 | . . . . . . . . . . . . . . . . . . . | . . . . . . . . . . . | . . . . . . . . . . . . . . . . . | . . . . . . . . . . . . . . . . . . . . . . . N.S. . . | . . . . . . . . . . . . . . . . . . . . . . . . . I.F. . | DR.YC..TSC. . . . . . . . . . . . . . . . . . . . . . . . . . P. . . . | . . . . . . . . . . . . . . . . . . . . . . |
| iPS:43_6940 | 21-225_146B8 | VH3|3-33|D3|3-3|RF2/JH6 | . . . . . . . . . . . . . . . . . . . | T. . . . . . . . . . | . . . . . . . . . . . . . . . . . | . . . . . . . . . . . . . . . . . V.G. . . ND.DF. . .T. . | . . . . . . . . . . . . . . . . . . . . . . . . . I. . . | DR.YC..GSC. . . . . . . . . . . . . . . . . . . . . . . . . . P. . . . | . . . . . . . . . . . . . . . . . . . . . . |
| iPS:43_7258 | 21-225_153F9 | VH3|3-33|D3|3-3|RF2/JH6 | . . . H. . . . . . . . . . . . . . I | T. . . . . . . . . . | . . . . . . . . . . . G. . . . . . | . . . . . . . . . . . . . . . . . . . . . G. DTD. . .R. | . . . . . . . . . . . . . . . . . . . . . . . . . I. . . | DR.YC..GNC. . . . . . . . . . . . . . . . . . . . . . . . . . P. . . . | . . . . . . . . . . . . . . . . . . . . . . |
| | Germline | H_FR1 | H_CDR1 | H_FR2 | H_CDR2 | H_FR3 | H_CDR3 | H_FR4 |
| VH4|4-30.1|D7|7-27|RF3/JH5 | | EVQLVES-GPGLVKPSQTLS LTCTVSG-GSIS | SG----SYWS | WIRQHPG KGLEWIG | YIYY--- SGSTYYNP SLKS | RVTISVDTSKNQFSLK LSSVTAADTAVYYCAR | NWGN------WFDP | WGQGT LVTSS |
| iPS:43_6680 | 21-225_147H12 | VH4|4-30.1|D7|7-27|RF3/JH5 | . . . . N. . . . . . . . . . . . . . . . . . . . . . . | . . . . . Y.H. . .A | . . . . . . . . . . . . . . . . . | . . . . . . . . . . . . . . . . . | . . . . . . . . . . . . . . . . . T. . . . . . . . . . . | D..GYDS. . . . . . . . . . . . . . . . . . SG. . . . | . . . . . . . . . . . . . . . . . . . . . . |
| iPS:43_6750 | 21-225_154G12 | VH4|4-30.1|D7|7-27|RF3/JH5 | . . . . N. . . . . . . . . . . . . . G | . . . . . Y. . . . | . . . . . . . . . . . . . . . . . | . . . . . . . . . . . . . . . . . | . . . . . S.L.P. . . . . . . . . . T. . . . . . . . . . . | D..GYDS. . . . . . . . . . . . . . . . . . SG. . . . | . . . . . . . . . . . . . . . . . . . . . . |
| | Germline | H_FR1 | H_CDR1 | H_FR2 | H_CDR2 | H_FR3 | H_CDR3 | H_FR4 |
| VH3|3-07|D6|6-13|RF1|JH4 | | EVQLVES- GGGLVQPGGSLR LSCAASG-FTFS | S-----YWMS | WVRQAPG KGLEWVA | NIKQD--- GSEKYYVD SVKG | RFTISRDNAKNSLYLQ MNSLRAEDTAVYYCAR | SISSSW------- YFDY | WGQGT LVTSS |
| iPS:43_6698 | 21-225_149B5 | VH3|3-07|D6|6-13|RF1|JH4 | . . . . . . . . . . . . . . . . . . . | G. . . . . . . . . N | . . . . . . . . . . . . . . . . . | . . . . . . . . . . . . . . . . . | . . . . . . . . . . . . . . . . . . . . . . . . . . . . . | .MY.G. . . . . . . . . . . . . . . . W.V. . . . | . . . . . . . . . . . . . . . . . . . . . . |

| | | H_FR1 | H_CDR1 | H_FR2 | H_CDR2 | H_FR3 | H_CDR3 | H_FR4 |
|---|---|---|---|---|---|---|---|---|
| iPS:43_6786 | 21-225_169A6 | VH3|3-33/D5|5-24/RF3/JH6 | ................................ | ........N... | ............. | ............ | ................................ | DQYNRNDGPP..AYY.... | ........ |
| iPS:43_6796 | 21-225_170A5 | VH3|3-33/D5|5-24/RF3/JH6 | ....................L....... | ..........N......C... | ....I........ | ............ | ................................ | DQYNRNDGPP..AYY...L. | ........ |
| iPS:43_6812 | 21-225_175C6 | VH3|3-33/D5|5-24/RF3/JH6 | ....................L....... | ..........N......C... | ....I........ | ............ | .............V.................. | DQYNRNDGPP..AYY...L. | ........ |
| Germline | VH3|3-48/D5|5-18/RF1/JH6 | EVQLVES GGGLVQPGGSLR LSCAASG FTFS | S----ISND YGMH | WVRQAPGK GLEWVS | SSIIYYAD SVKG | RFTISRDNAKNSLYLQM NSLRAEDTAVYYCAR | VDIAVYY------YYGMDV | WGQGTT VTVSS |
| iPS:43_6788 | 21-225_169B7 | VH3|3-48/D5|5-18/RF1/JH6 | ............................L. | ............. | ............. | ..G......... G.I.F. | ................................ | G...G.T-............ | ........ |
| iPS:43_6798 | 21-225_171F5 | VH3|3-48/D5|5-18/RF1/JH6 | ............................L. | ............. | ............. | ..G......... G.I.F. | ................................ | G...G.T-............ | ........ |
| iPS:43_6864 | 21-225_58G11 | VH3|3-48/D5|5-18/RF1/JH6 | ....................G........ | ............. | .....I....... | ..T......... ..F......... | ................S............... | G...L-.............. | ........ |
| iPS:43_6866 | 21-225_59F2 | VH3|3-48/D5|5-18/RF1/JH6 | ............................. | ............. | ............. | ..G......... NI....T....... | ................................ | A..P..L-............F. | ........ |
| iPS:43_6872 | 21-225_60D2 | VH3|3-48/D5|5-18/RF1/JH6 | ....................G........ | ............. | ............. | ..E......... NI....T....... | ..............M................. | A..P..L-............F. | ........ |
| Germline | VH3|3-33/D5|5-24/RF1/JH6 | EVQLVES GGGVVQPGRSLR LSCAASG FTFS | S----YGMH | WVRQAPGK GLEWVA | GSNKYYAD SVKG | RFTISRDNSKNTLYLQM NSLRAEDTAVYYCAR | VENATYY------YYGMDV | WGQGTT VTVSS |
| iPS:43_6790 | 21-225_169G11 | VH3|3-33/D5|5-24/RF1/JH6 | ............................. | ............. | ............. | ..I......... | ............G................... | EGATYYHGSGS .YYPATN. | ........ |
| | | H_FR1 | H_CDR1 | H_FR2 | H_CDR2 | H_FR3 | H_CDR3 | H_FR4 |

Figure 52 (Continued)

| | | H_FR1 | H_CDR1 | H_FR2 | H_CDR2 | H_FR3 | H_CDR3 | |
|---|---|---|---|---|---|---|---|---|
| VH3｜3-33｜D3｜3-10｜RF1｜JH6 | | QVQLVES GGGVVQPGRSLR LSCAASG-FTFS | S YMH | WVRQAPGK GLEWVA | VISYD GSNKYYAD SVKG | RFTISRDNSKNTLYLQM NSLRAEDTAVYYCAR | VLLMFGELL* YYYYGMDV | WGQGTT VTVSS |
| iPS:43 6792 | 21-225_169D12 | . . . . . . . . . . . . . . . . . . . . . . . . . . . . . . . . | . . . . . | . . . . . . . . . . . . . . . . | . . . . . . . . . . . . . . . . . . . . . S | . . . . . . . . . . . . . . . . . . . . . . . . . . . | P.YDM.L—— . . . . . . D . . . . | . . . . . . . . . . |
| | Germline | H_FR1 | H_CDR1 | H_FR2 | H_CDR2 | H_FR3 | H_CDR3 | |
| VH1｜1-46｜D7｜7-27｜RF3｜JH4 | | QVQLVQS GAEVKKPGASVK VSCKASG-YTFT | S YYMH | WVRQAPGQ GLEWMG | IINPS GGSTSYAQ KFQG | RVTMTRDTSTSTVYMEL SSLRSEDTAVYYCAR | NNGY ——————FDY | WGQGTT VTVSS |
| iPS:43 6800 | 21-225_171D12 | . . . . . . . . . . . . . . . . . . . . . . . . . . . . . N . | . . . . Y | . . . . . . . . . . . . . . . . | . . . . . . . . . . . . N . . . . . | . . . . . . . . . . . . . . . . . . . . L . . . S | . . . . . . . . . . . . . . LN. | . . . . . . . . . . |
| iPS:43 6804 | 21-225_172C3 | . . . . . . . . . . . . . . . . . . . . . . . . . . . . . R . | . . . . Y | . . . . . . V . . . . . . . . . | T . . . . . . . . . . N . . . . . | . . . . . . . . . . . . . . . . . . . . L . . . S | G.E- . . . . . . . . . LN. | . . . . . . . . . . |
| iPS:43 6806 | 21-225_172B12 | . . . . . . . . . . . . . . . . . . . . . . . . T . . . . R . | . . . . Y | . . . . . . V . . . . . . . . . | T . . . . . . . . . . D . . . . . | . . . . . . . . . . . . . . . . . . . . L . . . S | G.E- . . . . . . . . . LN. | . . . . . . . . . . |
| | Germline | H_FR1 | H_CDR1 | H_FR2 | H_CDR2 | H_FR3 | H_CDR3 | |
| VH3｜3-30.3｜D4｜4-23｜RF1｜JH6 | | QVQLVES GGGVVQPGRSLR LSCAASG-FTFS | S YAMH | WVRQAPGK GLEWVA | VISYD GSNKYYAD SVKG | RFTISRDNSKNTLYLQM NSLRAEDTAVYYCAR | *LRW*LYY YYYGMDV | WGQGTT VTVSS |
| iPS:43 6808 | 21-225_173F8 | . . . . . . . . . . . . . . . . . . . . . . . . . . . . . . . | . . . . G | . . . . . . . . . . . . . . . . | . . . . . . . . . . P . C . . . . | . . . . . . . . . . . . . . . . . . . . . F . . . | DE.QW.P- . . . . . . . . AP. | . . . . . . . . . . |
| | Germline | H_FR1 | H_CDR1 | H_FR2 | H_CDR2 | H_FR3 | H_CDR3 | |
| VH6｜6-01｜D5｜5-6｜RF2｜JH6 | | QVQLQQS GPGLVKPSQTLS LTCAISG-DSVS | SN SAAWN | WIRQSPSR GLEWLG | RTYYR SKWYNDYA VSVKS | RITINPDTSKNQFSLQ LNSVTPEDTAVYYCAR | STAAPYY YYYGMDV | WGQGTT VTVSS |
| iPS:43 6810 | 21-225_175F4 | . . . . . . . . . . . . . . . . . . . . . . . . . . . . . . . | . . . . . | . . . . . . . . . . . . . . . . | . . . . . . . . . A.P. . . . . ME. | . . . . . . . . . . . . . . . . . . . S . . . . . | DK..GRND . . . . . . F . . | . . . . . . . . . . |
| iPS:43 6814 | 21-225_178H10 | . . . . . . . . . . . . . . . . . . . . . . . . . . . . . . . | . . . . . | . . . . . . . . . . . . . . . . | . . . . . . . . SA.P. . . . . ME. | . . . . . . . . . . . . . . . . . . VS . . . . . | DK..GRND . . . . . . F . . | . . . . . . . . . . |
| | Germline | H_FR1 | H_CDR1 | H_FR2 | H_CDR2 | H_FR3 | H_CDR3 | |

Figure 52 (Continued)

| VH3/3-33/D1/1-1/RF3/JH6 | | LVQLVES GGGVVQPGRSLR LSCAASGFTFS | S....YGMH | WVRQAPGKG LEWVA | VIWYD GSNKYYAD SVKG | RFTISRDNSKN TLYLQMNSLRAEDTAVYYCAR | VRKDGYYY ....YYGMDV | WGQGTT VTVSS |
|---|---|---|---|---|---|---|---|---|
| iPS:43 6818 | 21-225_179C7 | VH3/3-33/D1/1-1/RF3/JH6 | .A.......... | N......S.. | ....G.... | I.Y.. Y..N. | ............ ............ | DRHY.FHVP ...YY.... | ........ ..... |
| iPS:43 7094 | 21-225_210D12 | VH3/3-33/D1/1-1/RF3/JH6 | ............ | ........... | ........... | ........... | ............ ............ | GD..P--- ......... | ........ ..... |
| iPS:43 7096 | 21-225_210E12 | VH3/3-33/D1/1-1/RF3/JH6 | ...H........ | N.......... | ........... | ........... | ............ ............ | GD..P--- E.L...... | ........ ..... |
| iPS:43 7098 | 21-225_211C1 | VH3/3-33/D1/1-1/RF3/JH6 | ............ | H.......... | ........... | ........... | ............ ............ | GD..P--- ....E.... | ...H.... ..... |
| iPS:43 7104 | 21-225_211G5 | VH3/3-33/D1/1-1/RF3/JH6 | ............ | H.......... | ........... | ........... | .T.......... ............ | GD..P--- E.L...... | ........ ..... |
| iPS:43 7112 | 21-225_212C2 | VH3/3-33/D1/1-1/RF3/JH6 | ............ | N.......... | ........... | ........... | ............ ............ | GD..P--- ....E.... | ........ ..... |
| iPS:43 7114 | 21-225_212A4 | VH3/3-33/D1/1-1/RF3/JH6 | .H.A........ | H.......... | ........... | ........... | ............ ............ | GD..P--- E.L...... | ...S.... ..... |
| iPS:43 7116 | 21-225_212F6 | VH3/3-33/D1/1-1/RF3/JH6 | ............ | H.......... | ........... | ........... | ............ ............ | GD..P--- ....E.... | ........ ..I.. |
| iPS:43 7118 | 21-225_212G7 | VH3/3-33/D1/1-1/RF3/JH6 | ............ | H.......... | ........... | ....C...... | ............ ...T........ | GD..P--- E........ | ........ ..... |
| iPS:43 7128 | 21-225_213G3 | VH3/3-33/D1/1-1/RF3/JH6 | ............ | H.......... | ........... | ........... | ...H........ ............ | GD..P--- E.L...... | ...S.... ..... |
| iPS:43 7130 | 21-225_213D5 | VH3/3-33/D1/1-1/RF3/JH6 | ............ | H.......... | ........... | ........... | ...F........ .....V...... | GD..P--- ....E.... | ........ ..... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | EVQLVES-<br>GGGVVQPGRSLR<br>LSCAASG-FTFS | S------YGMH | WVRQAPGK<br>GLEWVA | VIWYD<br>GSNKYYAD<br>SVKG | RFTISRDNSKNTLYLQM<br>NSLRAEDTAVYYCAR | GTGT------<br>------YFDY | WGQGTL<br>VTVSS |
| iPS:43<br>21-7146 | VH3J3-<br>33/D1|1-<br>1|RF3/JH6 | .......T.........<br>..................<br>............. | H......... | ........<br>....... | .....E<br>.........<br>.... | .................<br>................. | GD..P---<br>.......<br>E.... | ......<br>..... |
| iPS:43<br>21-7150 | VH3J3-<br>33/D1|1-<br>1|RF3/JH6 | ..................<br>..................<br>............. | H......... | ........<br>....... | .......<br>.........<br>.... | .................<br>................. | GD..P---<br>.......<br>E.L.. | ......<br>..... |
| iPS:43<br>21-7162 | VH3J3-<br>33/D1|1-<br>1|RF3/JH6 | ..H...............<br>..................<br>............. | N......... | ........<br>....... | .......<br>.........<br>.... | .................<br>................. | GD..P---<br>.......<br>E.... | ...I..<br>..... |
| iPS:43<br>21-7172 | VH3J3-<br>33/D1|1-<br>1|RF3/JH6 | ..........P.......<br>..................<br>............. | H......... | ........<br>....... | .......<br>.........<br>.... | .........M.......<br>................. | GD..P---<br>.......<br>E.... | ......<br>..... |
| iPS:43<br>21-7182 | VH3J3-<br>33/D1|1-<br>1|RF3/JH6 | ..................<br>..................<br>............. | H......... | ........<br>....... | .......<br>.........<br>.... | .........H.......<br>................. | GD..P---<br>.......<br>E.... | ......<br>..... |
| iPS:43<br>21-7184 | VH3J3-<br>33/D1|1-<br>1|RF3/JH6 | ..................<br>..................<br>............. | .......... | ........<br>....... | .......<br>.........<br>.... | .........H.......<br>................. | GD..P---<br>.......<br>E.... | ...S..<br>..... |
| iPS:43<br>21-8664 | VH3J3-<br>33/D1|1-<br>1|RF3/JH6 | ..H...............<br>..................<br>............. | N......... | ........<br>....... | .......<br>.........<br>.... | .................<br>................. | GD..P---<br>.......<br>E.... | ...I..<br>..... |
| VH3J3-<br>33/D1|1-<br>1|RF1/JH4 | | | | | | | | |
| iPS:43<br>21-6822 | VH3J3-<br>33/D1|1-<br>1|RF1/JH4 | ..................<br>..................<br>............. | N......F. | ........<br>....... | .....I<br>......D.<br>.... | .........T.......<br>................. | .GPPFST.<br>.......<br>....F... | ......<br>..... |
| iPS:43<br>21-6828 | VH3J3-<br>33/D1|1-<br>1|RF1/JH4 | ..................<br>..................<br>............. | N......... | ........<br>....... | .....I<br>......D.<br>.... | .........I.......<br>.........T....... | .GPPFST.<br>.......<br>....F... | ......<br>..... |
| iPS:43<br>21-6950 | VH3J3-<br>33/D1|1-<br>1|RF1/JH4 | ..H...............<br>.........V........<br>............. | .......... | ........<br>....... | .....I<br>.........<br>.... | .................<br>................. | .GPPFST.<br>.......<br>....VTM. | ......<br>..... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 6952 | VH3/3-33/D1/1-1/RF1/JH4 21-225_185D2 | | | | | I | GPPFST.<br>....VTM..... | |
| | Germline | QITLKES-GPTLVKPIQLT LTCTFSG-FSLS | TS.-GVGVG | WIRQPPGK ALEWLA | LIIW-NDDKRYSP SLKS | RLTIIKDTSKNQVVLTM TNMDPVDTATYYCAH | SIAAA---------DFFDI | WGQGTM VTVSS |
| iPS:43 6824 | VH2/2-05/D6/6-6/RF2/JH3 21-225_180C5 | | | | F.S.....<br>....G | ....I...S...... | KA.V... | |
| iPS:43 6956 | VH2/2-05/D6/6-6/RF2/JH3 21-225_186H6 | | | | F.S.....<br>....G | ......S...... F.... | KA.V... | |
| | | H_FR1 | H_CDR1 | H_FR2 | H_CDR2 | H_FR3 | H_CDR3 | H_FR4 |
| | Germline | QVQLVQS GAEVKKPGASVK VSCKASG-VIFT | YDIN | WVRQATGQ GLEWMG | WMNPN SGNTGYAQ KFQG | RVTMTRNTSISTAYMEL SSLRSEDTAVYYCAR | GYSYGYY-----YYGMDV | WGQGTT VTVSS |
| iPS:43 6826 | VH1/1-08/D5/5-18/RF3/JH6 21-225_180G5 | | | | | | .FY.YGSGSHV<br>..PYH....L... | |
| | | H_FR1 | H_CDR1 | H_FR2 | H_CDR2 | H_FR3 | H_CDR3 | H_FR4 |
| | Germline | QVQLVQS GAEVKKPGSSVK VSCKASG-GTFS | SYAMH | WVRQAPGQ GLEWMG | RIIP--ILGIANYAQ KFQG | RVTITADKSISTAYMEL SRLRSDDTAVYYCAR | RDGYNY-----YYFDL | WGQGTL VTVSS |
| iPS:43 6832 | VH6/6-01/D5/5-24/RF3/JH2 21-225_51D8 | | | | | F....R.. | DRYNWNY<br>..P... | |
| | | H_FR1 | H_CDR1 | H_FR2 | H_CDR2 | H_FR3 | H_CDR3 | H_FR4 |
| | Germline | QVQLVQS GAEVKKPGASVK VSCKASG-YTFT | GYYMH | WVRQAPGQ GLEWMG | WINPN-SGGTNYAQ KFQG | RVTMTRDTSISTAYMEL SRLRSDDTAVYYCAR | RDGYNY-----NWFDP | WGQGTL VTVSS |
| iPS:43 6840 | VH1/1-02/D5/5-24/RF3/JH5 21-225_53E9 | | | | ....I.....D..... | | DGYSSGW.<br>.....F.. | |
| | | H_FR1 | H_CDR1 | H_FR2 | H_CDR2 | H_FR3 | H_CDR3 | H_FR4 |
| iPS:43 | VH2/2-05/D7/7-27/RF1/JH4 | Germline | QITLKES-GPTLVKPIQLT LTCTFSG-FSLS | TS.-GVGVG | WIRQPPGK ALEWLA | LTIW-NDDKRYSP SLKS | RLTIIKDTSKNQVVLTM TNMDPVDTATYYCAH | LTSY------------FDY | WGQGTL VTVSS |

| | | H_FR1 | H_CDR1 | H_FR2 | H_CDR2 | H_FR3 | H_CDR3 | H_FR4 |
|---|---|---|---|---|---|---|---|---|
| VH4/4-30.1/D2/2-8/RF3/JH4 | | QVQLQES GPGLVKPSQTLS LTCTVSG GSIS | SG GYWS | WIRQPPG KGLEWIG | YI SGSTYYNP SLKS | RVTISVDTSKNQFSLKL DIVLAVT SSVTAADTAVYYCAR | AITDY | WGQGTL VTVSS |
| | Germline | | | | | | | |
| iPS:43-6958 | 21-225_190D1 | | | | | | SP.R--.-G... | |
| VH6/6-01/D4/4-17/RF2/JH4 | | QVQLQQS GPGLVKPSQTLS LTCAISG DSVS | SN SAAWN | WIRQSPSR GLEWLG | RTYYR SKWYNDYA VSVKS | RITINPDTSKNQFSLQL NSVTPEDTAVYYCAR | DYGDY VFDY | WGQGTL VTVSS |
| | Germline | | | | | | | |
| iPS:43-6962 | 21-225_190H1 | ........D | RK......T... | | ...K | | P.G--.L.... | |
| iPS:43-6978 | 21-225_190G9 | | RK......T... | | | ...I | P.G--.L.... | |
| iPS:43-7070 | 21-225_201G11 | | RI...NPT... | | ...HV. | | P.G--.L.... | |
| iPS:43-7076 | 21-225_203G6 | | RT...NPT... | | ...HV.L | ...T | P.G--.L.... | |
| VH3/3-33/D1/1-7/RF3/JH6 | | QVQLVES GGGVVQPGRSLR LSCAASG FTFS | S YGMH | WVRQAPGK GLEWVA | VIWYD GSNKYYAD SVKG | RFTISRDNSKNTLYLQM NSLRAEDTAVYYCAR | YYYYYYY YYYGMDV | WGQGTT VTVSS |
| | Germline | | | | | | | |
| iPS:43-6964 | 21-225_190B3 | ......N | N......I... | | ...F .D... | | D....GDH .....Y..F | |
| iPS:43-6970 | 21-225_190B8 | | | | ...F ...T | | D....GDY .....Y.... | |
| iPS:43-6980 | 21-225_190C10 | .......L.. | N........ | | ...FG .D...R. | ...F... | D....GDH .....Y.... | |

Figure 52 (Continued)

| | | Germline | H_FR1 | H_CDR1 | H_FR2 | H_CDR2 | H_FR3 | H_CDR3 | H_FR4 |
|---|---|---|---|---|---|---|---|---|---|
| iPS:43 6992 | 21-225_191B8 | VH3/3-33/D1|1-7|RF3/JH6 | ........... ........L. | .......... | ............ ........... | .......F.. ....... | .................... ................. | D...GDH.... ....Y....... | .... ..... |
| iPS:43 6994 | 21-225_191A9 | VH3/3-33/D1|1-7|RF3/JH6 | ........N.. ........L. | .......... | ............ ........... | ......FG.. ...D... | .................... .........F....... | D...GDH.... ....Y....... | .... ..... |
| | | Germline | H_FR1 | H_CDR1 | H_FR2 | H_CDR2 | H_FR3 | H_CDR3 | H_FR4 |
| VH4|4-30.1|D4|4-,11|RF2|JH6 | | | QVQLQES GPGLVKPSQTLS LTCTVSG-GSIS | SG..GYYWS | WIRQHPGK EKEWIG | YIYY SGSTYYNP SLKS | RVTISVDTSKNQFSLKL SSVTAADTAVYYCAR | DYSNYYY---------YYGMDV | WGQGTT VTVSS |
| iPS:43 6984 | 21-225_190F10 | VH4|4-30.1|D4|4-,11|RF2|JH6 | ...........R | .......... | ............ ........... | ......E... ....... | .................... ................. | .S.SR----------....... | .... ..... |
| iPS:43 6988 | 21-225_191A2 | VH4|4-30.1|D4|4-,11|RF2|JH6 | ...........R | .....D.... | ............ ........... | ......E... ...I... | .................... ................. | .S.SR----------....... | .... ..... |
| iPS:43 7014 | 21-225_192H8 | VH4|4-30.1|D4|4-,11|RF2|JH6 | ........V.. | .....D.... | ............ ........... | ....... ...I... | .................... ................. | .S.L.----------....... | .... ..... |
| iPS:43 7022 | 21-225_194G5 | VH4|4-30.1|D4|4-,11|RF2|JH6 | ........I.. | .....D.... | ............ ........... | ......E... ....P.. | .L.M.A.............. ................. | .H.L.----------....... | .... ..... |
| iPS:43 7026 | 21-225_194D12 | VH4|4-30.1|D4|4-,11|RF2|JH6 | ........... | .....D.... | ............ ........... | ....... ....... | .................... ................. | .GARH----------....... | .... ..... |
| iPS:43 7056 | 21-225_198B8 | VH4|4-30.1|D4|4-,11|RF2|JH6 | ...........R | .....D.... | ............ ........... | ......E... ...I... | .................... ................. | .S.SR----------....... | .... ..... |
| iPS:43 7124 | 21-225_212H12 | VH4|4-30.1|D4|4-,11|RF2|JH6 | ...........R | .....D.... | ............ ........... | ....... ....... | .................... .........G....... | .S.S.----------....... | .... ..... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | QVQLQES.. GPGLVKPSETLS LTCTVSG.GSIS | S....YYWS | WIRQPPGK GLEWIG | YIYY.. SGSTNYNP SLKS | RVTISVDTSKNQFSLKL SSVTAADTAVYYCAR | GTVGA ........TYFDY | WGQGTL VTVSS |
| iPS:43-7136 | 21-225_214H3 | VH4|4-30.1/D4|4-11|RF2/J H6 | .........D.... | | | ...............G........ | .S.S.--- | |
| VH4|4-59/D1|1-26|RF1/JH4 | | | | | | | | |
| iPS:43-6986 | 21-225_191A1 | VH4|4-59/D1|1-26|RF1/J H4 | .........I | | .........K....... | | KG..T........IH.... | |
| iPS:43-7064 | 21-225_200G8 | VH4|4-59/D1|1-26|RF1/J H4 | | | .........K....... | | KG..T........IH.... | |
| | Germline | QVQLVES.. GGGTVQPGRSLR LSCAASG.FTFS | S....YGMH | WVRQAPGK GLEWVA | VISYD.. GSNKYYAD SVKG | RFTISRDNSKNTLYLQM NSLRAEDTAVYYCAR | EISSS .........SYFDY | WGQGTL VTVSS |
| VH3|3-30/D6|6-6|RF1/JH4 | | | | | | | | |
| iPS:43-6996 | 21-225_191B9 | VH3|3-30/D6|6-6|RF1/J H4 | F....H... | | W....K....... | ..........H......... | GY..GF........YRG..N | |
| iPS:43-7054 | 21-225_194G3 | VH3|3-30/D6|6-6|RF1/J H4 | F....H... | | W....K....... | ..........H......... | GF..GF........YRG..N | |
| | Germline | QVQLVES.. GGGTVQPGRSLR LSCAASG.FTFS | S....YGMH | WVRQAPGK GLEWVA | VIWY.. GSNKYYAD SVKG | RFTISRDNSKNTLYLQM NSLRAEDTAVYYCAR | GIVGATY .........VYYGMDV | WGQGTT VTVSS |
| VH3|3-33/D1|1-26|RF1/JH6 | | | | | | | | |
| iPS:43-7000 | 21-225_191G9 | VH3|3-33/D1|1-26|RF1/J H6 | .........T | | L..F...... | | DR.G.SPP .......YY........ | |
| iPS:39-3192 | 21-225_12B1 | VH3|3-33/D1|1-26|RF1/J H6 | | | .........N....... | | DR.A.AGTP.......Y........ | |
| | Germline | QVQLVQS.. GAEVKKPGASVK VSCKASG.YTFT | G....YYMH | WVRQAPGQ GLEWMG | WINPN.. SGGTNYAQ KFQG | RVTMTRDTSISTAYMEL SRLRSDDTAVYYCAR | VIYGSGSY .........YNRWFDP | WGQGTL VTVSS |
| VH1|1-02/D3|3-10|RF2/JH5 | | | | | | | | |

| | Germline | H_FR1 | H_CDR1 | H_FR2 | H_CDR2 | H_FR3 | H_CDR3 | H_FR4 |
|---|---|---|---|---|---|---|---|---|
| iPS:43 21-7068 225_200A11 | VH4|4-30.1/D6|6-6|RF2/JH6 | . . . . . . . . . . . . . . . . . . . . . . . | . . . . . . . D . . . | . . . . . . . . . . . . . | . . . . . . . . . . . . R . . . . | . . . . . . . . . . . . . . . . . . . . . . . . | DA..H--- . . . | . . . . . . . . |
| iPS:43 21-7140 225_214E12 | VH4|4-30.1/D6|6-6|RF2/JH6 | . . . . . . . . . . . . . . . . . . . . . . . | . . . . . . . D . . . | . . . . . . . . . . . . . | . . . . . . . . . . . . P . . . . | . . . . . . . . . . . . . . . . . . . . . . . . | DG..E--- . . . | . . . . . . . . |
| iPS:43 21-7158 225_216H11 | VH4|4-30.1/D6|6-6|RF2/JH6 | . . . . . . . . . . . . . . . . . . . . . . . | . . . . . . . D . . . | . . . . . . . . . . . . . | . . . . . . . . . . . . P . . . . | . . . . . . . . . . . . . . . . . . . . . . . . | DG..E--- --.L. . . . | . . . . . . . . |
| VH3|3-33|D1|1-26|RF3/JH3 Germline | | H_FR1 QVQLVES GGGLVQPGGSLR LSCAASG-FTFS | H_CDR1 ----SYAMH | H_FR2 WVRQAPGK GLEWVA | H_CDR2 VISY- DGSNKYYAD SVKG | H_FR3 RFTISRDNSKNTLYLQM NSLRAEDTAVYYCAR | H_CDR3 VSGSYY -----GAFDI | H_FR4 WGQGTL VTVSS |
| iPS:43 21-7074 225_203B2 | VH3|3-33/D1|1-26|RF3/JH3 | . . . . . . . . . . . . . . . . . . . . . . . | N . . . . . . . . . . | . . . . . . . . . . . . . | . . . I . F . . . . E . . . | . . . . . . . . . . MS . . . . . . . . . . . . . . | E . . . . . . . . . . . | . . . . . . . . |
| iPS:43 21-7082 225_205E12 | VH3|3-33/D1|1-26|RF3/JH3 | . . . . . . . . . . . . . . . . . . . . . . . | N . . . . . . . . . . | . . . . . . . . . . . . . | . . . I . F . . . . E . . . | . . . . . . . . . . MS . . . . . . . . . . . . . . | E . . . . --.LY. | . . . . . . . . |
| VH3|3-48|D4|4-17|RF2|JH4 Germline | | H_FR1 EVQLVES GGGLVQPGGSLR LSCAASG-FTFS | H_CDR1 ----SSMN | H_FR2 WVRQAPGK GLEWVS | H_CDR2 SISS- SSSYIYYAD SVKG | H_FR3 RFTISRDNAKNSLYLQM NSLRAEDEDAVYYCAR | H_CDR3 DYGDY ------YFDI | H_FR4 WGQGTL VTVSS |
| iPS:43 21-7086 225_209A8 | VH3|3-48|D4|4-17|RF2/JH4 | . . . . . . . . . . . . . . . . R . . . . . . | . . . . . . S . . . . | . . . . . . . . L . . . . | . . . . IKK . . . . . . . . | . . . . . . . . . . . V . . . . . . . . . . . . . | . . . . D.S . . . . . . . | . . . . . . . . |
| VH4|4-30.1/D2|2-8|RF3/JH6 Germline | | H_FR1 QVQLQES GPGLVKPSQTLS LTCTVSG-GSIS | H_CDR1 SG--SYWS | H_FR2 WIRQHPGK GLEWIG | H_CDR2 YIYY- SGSTYYNP SLKS | H_FR3 RVTISVDTSKNQFSLRL SSVTAADTAVYYCAR | H_CDR3 DIVLMVYAI ----YYYYGMDV | H_FR4 WGQGTT VTVSS |
| iPS:43 21-7090 225_210F11 | VH4|4-30.1/D2|2-8|RF3/JH6 | . . . . . . . . . . . . . . . . . . . . . . . | . . . . . . S . . . . | . . . . . . . . . . . . . | . . . IT . . . . . . . . . | . . . . . . . . . . . T.H . . . . . . . . . . . | EP.T--- . . . . | . . . . . . . . |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:43 7106 | VH4\|4-30.1/D2\|2-8\|RF3/JH6 | 225_211H7 | | | .T..... | ..V.... | .GP.S---- | ..... |
| VH3\|3-30.3/D4\|4-17\|RF2/JH5 | Germline | QVQLVES GGGVVQPGRSLR LSCAASG FTFS | S------ YAMH | WVRQAPGK GLEWVA | VISYD------ GSNKYYAD SVKG | RFTISRDNSKNTLYLQM NSLRAEDTAVYYCAR | DIGDY------ NWFDP | WGQGTL VTVSS |
| iPS:43 7100 | VH3\|3-30.3/D4\|4-17\|RF2/JH5 | 225_211H2 | | | ....W.. | ........A....... | .P.S....G...... | ..... |
| VH3\|3-33/D5\|5-12\|RF3/JH6 | Germline | QVQLVES GGGVVQPGRSLR LSCAASG FTFS | S------ VYMH | WVRQAPGK GLEWVA | VIWYD------ GSNKYYAD SVKG | RFTISRDNSKNTLYLQM NSLRAEDTAVYYCAR | YYSCYDYY------ YYYGMDV | WGQGTT VTVSS |
| iPS:43 7102 | VH3\|3-33/D5\|5-12\|RF3/JH6 | 225_211E5 | ........ | N....... | ....S.. | I..F......DQ... | ........... | .L.V.Y--- | ..... |
| iPS:43 7164 | VH3\|3-33/D5\|5-12\|RF3/JH6 | 225_217C6 | .......R | N....... | ....M.. | I..F......DE... | ...........M... | ...G..... | ..... |
| iPS:43 7166 | VH3\|3-33/D5\|5-12\|RF3/JH6 | 225_217G11 | ........ | N....... | ....S.. | I..F......DQ... | ........... | .L.V.Y--- | ..... |
| iPS:43 7170 | VH3\|3-33/D5\|5-12\|RF3/JH6 | 225_218E5 | .......R | N....... | ....M.. | I..F......DE... | ........... | .L.V.Y--- | ..... |
| VH4\|4-30.1/D6\|6-19\|RF2/JH6 | Germline | QVQLQES GPGLVKPSQTLS LTCTVSG GSIS | SG------ GYWS | WIRQHPGK GLEWIG | YIYY------ SGSTYYNP SLKS | RVTISVDTSKNQFSLKL SSVTAADTAVYYCAR | SIAVAGYY------ YYYGMDV | WGQGTT VTVSS |
| iPS:43 7108 | VH4\|4-30.1/D6\|6-19\|RF2/JH6 | 225_211C9 | | ......D. | | | .LL.......V.... | .DS..Y---N.... | ..... |

| | Germline | H_FR1 | H_CDR1 | H_FR2 | H_CDR2 | H_FR3 | H_CDR3 | H_FR4 |
|---|---|---|---|---|---|---|---|---|
| VH1\|1-02\|D4\|4-17\|RF2\|JH6 | | QVQLVQS GAEVKKPGASVK VSCKASG YTFT | G YYMH | WVRQAPGQ GLEWMG | WINPN SGGTNYAQ KFQG | RVTMTRDTSISTAYMEL SRLRSDDTAVYYCAR | DYGDIYY YYYYGMDV | WGQGTT VTVSS |
| iPS:43 7188 21-225_224B11 | VH1\|1-02\|D4\|4-17\|RF2\|JH6 | ......H......... | ......... | ......... | ...K.. N........ | ......A....T..... | GAF...F...A... | ......H......... |
| iPS:43 7198 21-225_226F8 | VH1\|1-02\|D4\|4-17\|RF2\|JH6 | ......... | ......I. | ...R.... | ...K..F.......... | ................. | GAF...F...AL.. | ......... |
| iPS:43 7202 21-225_227D3 | VH1\|1-02\|D4\|4-17\|RF2\|JH6 | ......... | ......... | ...R.... | ...K............ | ................. | GAF...F....... | ......... |
| iPS:43 7208 21-225_227C10 | VH1\|1-02\|D4\|4-17\|RF2\|JH6 | ......... | ......... | ......... | ................. | ................. | GAF...F....... | ......... |
| VH3\|3-33\|D2\|2-21\|RF2\|JH6 | | QVQLVES GGGLVQPGRSLR LSCAASG FTFS | S YGMH | WVRQAPGK GLEWVA | VIWYD GSNKYYAD SVKG | RFTISRDNSKNTLYLQM NSLRAEDTAVYYCAR | CYCSSTSCYT YYYYGMDV | WGQGTT VTVSS |
| iPS:43 7192 21-225_225E9 | VH3\|3-33\|D2\|2-21\|RF2\|JH6 | ............E... ............I.. | ......... | ......... | ..M....G.D.... | ................. | DREYC.TSC........P....... | ......... |
| VH3\|3-23\|D2\|2-21\|RF2\|JH6 | | EVQLLES GGGLVQPGGSLR LSCAASG FTFS | S YAMS | WVRQAPGK GLEWVS | AISGS GGSTYYAD SVKG | RFTISRDNSRNTLYLQM NSLRAEDTAVYCAR | SYCGGDCYS YYYYGMDV | WGQGTT VTVSS |
| iPS:43 7204 21-225_227E5 | VH3\|3-23\|D2\|2-21\|RF2\|JH6 | ......E.. | ......... | ......... | ......... | ........C........ | E........P....... | ......... |
| iPS:39 3196 21-225_16G8 | VH3\|3-23\|D2\|2-21\|RF2\|JH6 | ......E.. | ......... | ......... | ....G.... | ........C.H...... | E........P....... | ......... |
| iPS:39 3202 21-225_6B4 | VH3\|3-23\|D2\|2-21\|RF2\|JH6 | ......E.. | ......... | ......... | ......S.. | ........C........ | E........P....... | ......... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | QVTLKES<br>GPTLVKPTQT<br>LTLTCTFSG | TS----GVGVG | WIRQPPGK<br>ALEWLA | LIYW<br>NDEKRYSP<br>SLKS | RLTIKDTSKNQVVLTM<br>TNMDPVDTATYYCAH | V*QL<br>------VYFDY | WGQGTL<br>VTVSS |
| iPS:39 3345 | 21-225_5G7 | VH3|3-<br>23|D2|2-<br>21|RF2|J<br>H6 | ........E..... | ........... | ........ | ........ | ................................<br>................................ | ....E.........P.<br>................ | ...... |
| | VH2|2-<br>05|D6|6-<br>13|RF3|JH4 | | | | | | | |
| iPS:43 7210 | 21-225_227E12 | VH2|2-<br>05|D6|6-<br>13|RF3|J<br>H4 | ............... | ............ | ...C.S.. | .......V....<br>.... | ..........Y.................... | RG..........-AL. | ...... |
| iPS:39 2587 | 21-225_18G5 | VH2|2-<br>05|D6|6-<br>13|RF3|J<br>H4 | ............... | ............ | ...C.S.. | .......V....<br>.... | ..........Y.................... | RG..........-AL. | ...... |
| iPS:39 8504 | 21-225_23D7 | VH2|2-<br>05|D6|6-<br>13|RF3|J<br>H4 | ............... | ............ | ...C.S.. | ....N.V.....<br>.... | ..........Y...S................ | RG..........-AL. | ...... |
| | Germline | EVQLVES-<br>GGGLVKPGGSLR<br>LSCAASG-FTFS | S------YSMN | WVRQAPGK<br>GLEWVS | SISSS-----<br>SSYIYYAD<br>SVKG | RFTISRDNAKNSLYLQM<br>NSLRAEDTAVYYCAR | DYSNYY-------------<br>YYYGMDV | WGQGTL<br>VTVSS |
| VH3|3-<br>21|D4|4-<br>11|RF2|JH6 | | | | | | | | |
| iPS:43 7226 | 21-225_57C2 | VH3|3-<br>21|D4|4-<br>11|RF2|J<br>H6 | ..........FG.. | ............ | ........ | ....TG...N..<br>.... | ................................ | T..G------------<br>---SL.------------ | ...... |
| | Germline | EVQLVES-<br>GGGLVKPGGSLR<br>LSCAASG-FTFS | S------YSMN | WVRQAPGK<br>GLEWVS | SISSS-----<br>SSYIYYAD<br>SVKG | RFTISRDNAKNSLYLQM<br>NSLRAEDTAVYYCAR | GYSYGY------------<br>---RWFDP--------- | WGQGTL<br>VTVSS |
| VH3|3-<br>21|D5|5-<br>18|RF2|JH5 | | | | | | | | |
| iPS:43 7230 | 21-225_62B10 | VH3|3-<br>21|D5|5-<br>18|RF3|J<br>H5 | ............... | ............ | ........ | .......G....<br>.... | ................................ | .G.R-------------<br>---G-------------- | ...... |
| iPS:44 8906 | 21-225_72G9 | VH3|3-<br>21|D5|5-<br>18|RF3|J<br>H5 | ............... | ............ | ........ | ............<br>.... | ..................F............. | .G.R-------------<br>---G-------------- | ...... |
| | Germline | QVQLVQS-<br>GAEVKKPGASVK<br>VSCKASG-YTFT | S------YYMH | WVRQAPGQ<br>GLEWMG | WINPN-----<br>SGGTNYAQ<br>KFQG | RVTMTRDTSISTAYMEL<br>SRLRSDDTAVYYCAR | GIVGA---------<br>---TYFDY--------- | WGQGTL<br>VTVSS |
| VH1|1-<br>02|D1|1-<br>26|RF1|JH4 | | | | | | | | |

| | | H_FR1 | H_CDR1 | H_FR2 | H_CDR2 | H_FR3 | H_CDR3 | H_FR4 |
|---|---|---|---|---|---|---|---|---|
| iPS:39 4000 | 21-225_11A2 | VH3|3-30.3|D5|5-24|RF3/J H6 | .......... .......... | ......G... | .....G... ....DS | ........I... ........... | .GYSYG---- ...G..... | ......... |
| iPS:39 4004 | 21-225_13A1 | VH3|3-30.3|D5|5-24|RF3/J H6 | .......... .......... | ......G... | .....A... T.Q..... | ..........V ........... | .GYSYG---- ...G..... | ......... |
| iPS:39 4006 | 21-225_15C2 | VH3|3-30.3|D5|5-24|RF3/J H6 | .......... ........S. | ......G... | I...G R.NH. | ..........V ........... | .GYSYG---- ...G..... | ......... |
| iPS:39 4029 | 21-225_1B12 | VH3|3-30.3|D5|5-24|RF3/J H6 | .......... .......... | ......G... | ...A... ...S... | ........M. ..........V | .GYSYG---- ...G..... | ...A. |
| iPS:39 4047 | 21-225_5E6 | VH3|3-30.3|D5|5-24|RF3/J H6 | .......... .......... | ......G... | I...V ...N... | ..........V ........... | .GYSYG---- ...G..... | ......... |
| iPS:39 4081 | 21-225_16B3 | VH3|3-30.3|D5|5-24|RF3/J H6 | .......... ........V. | ......G... | ...A... I..S... | ........N. ..........V | .GYSYG---- ...G..... | ...A. |
| | Germline | H_FR1 QVQLQES GPGLVRPSETLS LTCTVSG GSVS | H_CDR1 SG---SYWG | H_FR2 WIRQPPGK GLEWIG | H_CDR2 SIYYTG SGSTNNP SLKS | H_FR3 RVTISVDTSKNQFSLKL SSVTAADTAVYYCAR | H_CDR3 VLPFDY LI*YFDY | H_FR4 WGQGT LVTVSS |
| iPS:45 1118 | VH4|4-61|D3|3-9|RF1/JH4 | .......... ..........S | .......G.. | ........... | ....T.I... ........... | .............T..V. ..................D | DTFC..G.. ........CGYF..S | ......... |
| | 21-225_191C8 | Germline | H_FR1 QITLKES GPTLVKPTQTLT LTCTFSG FSLS | H_CDR1 TS---GVGVG | H_FR2 WIRQPPGK ALEWLA | H_CDR2 LIYW NDNKRYSP SLKS | H_FR3 RLTITKDTSKNQVVLTM TNMDPVDTATYYCAH | H_CDR3 YYYY ----SFDY | H_FR4 WGQGT LVTVSS |
| iPS:39 2573 | VH2|2-05|D4|4-11|RF3/JH4 | 21-225_15G2 | VH2|2-05|D4|4-11|RF3/J H4 | .......... .......... | ........... | ........... | ........... | .G.SC.......... .......C..H | ......... |

Figure 52 (Continued)

| | | | | H_CDR1 | H_FR2 | H_CDR2 | H_FR3 | H_CDR3 | H_FR4 |
|---|---|---|---|---|---|---|---|---|---|
| | VH1\|1-02\|D2\|2-2\|RF2\|JH6 | QVQLVQS GAEVKKPGASVK VSCKASG-YTFT | G------YMH | WVRQAPG QGLEWMG | WINPN-SGGTNYAQ KFQG | RVTMTRDTSISTAYMEL SRLRSDDTAVYYCAR | GYCSSTSCYY-------YYYYGMDV | WGQGTT VTVSS |
| iPS:39 2585 | 21-225_14H11 | VH1\|1-02\|D2\|2-2\|RF2\|JH6 | ........Q...... .G............... | .....H.C | ........ ........ | ........K. .... | .................. .................A | ...S...L..... .QPG....... | ............ ..... |
| iPS:39 3186 | 21-225_27D9 | VH1\|1-02\|D2\|2-2\|RF2\|JH6 | ................ ................ | ........ | ........ ........ | ........ .... | ..N............... .................. | ER.T...L..... ..GITG...... | ............ ..... |
| iPS:39 3234 | 21-225_26C10 | VH1\|1-02\|D2\|2-2\|RF2\|JH6 | ................ ................ | .....V. | ........ ........ | ........ .... | .................. .................. | ER.T...L..... ..GITG...... | ............ ..... |
| Germline | | | | H_CDR1 | H_FR2 | H_CDR2 | H_FR3 | H_CDR3 | H_FR4 |
| | VH3\|3-23\|D5\|5-12\|RF3\|JH6 | EVQLLES GGGLVQPGGSLR LSCAASG-FTFS | S------YAMS | WVRQAPK KGLEWVS | AISGS GGSTYYAD SVKG | RFTISRDNSKNTLYLQM NSLRAEDTAVYYCAR | VSSGYYYY-------YYYYGMDV | WGQGTT VTVSS |
| iPS:39 2596 | 21-225_12D8 | VH3\|3-23\|D5\|5-12\|RF3\|JH6 | ................ ................ | .....V. | ........ ........ | .T..VG. .... ..... | ..........T....... .................. | WGR..S.E..... ............ | ............ ..... |
| iPS:39 2942 | 21-225_30E9 | VH3\|3-23\|D5\|5-12\|RF3\|JH6 | .V.............. ................ | .....C.N | ........ ........ | ........R. .F.. ..... | .................. .................. | .ELLE...-..... ............ | ............ ..... |
| iPS:39 2944 | 21-225_31H5 | VH3\|3-23\|D5\|5-12\|RF3\|JH6 | ................ ................ | ........ | ........ ........ | ........R. .IFH. ..... | .................. .........V........ | .ELLE...-..... ............ | ............ ..... |
| iPS:39 2964 | 21-225_31A8 | VH3\|3-23\|D5\|5-12\|RF3\|JH6 | ................ ................ | ........ | ........ ........ | ........R. .FH. ..... | ........D......... .........V........ | .ELLE...-..... ...F........ | ............ ..... |
| iPS:39 2982 | 21-225_30D1 | VH3\|3-23\|D5\|5-12\|RF3\|JH6 | .V.............. ................ | ........ | ........ ........ | ........R. .FH. ..... | .................. .........V........ | .ELLE...-..... ...F........ | ............ ..... |
| iPS:39 2986 | 21-225_31B8 | VH3\|3-23\|D5\|5-12\|RF3\|JH6 | ................ ................ | ........ | ........ ........ | ........R. .FH. ..... | ........D......... ........L.V........ | .ELLE...-..... ...F.L...... | ............ ..... |
| iPS:39 3004 | 21-225_30G11 | VH3\|3-23\|D5\|5-12\|RF3\|JH6 | ................ ................ | ........ | ........ ........ | ........R. .FN. ..... | ..........T....... .........V........ | .ELLE...-..... ...F........ | ............ ..... |

Figure 52 (Continued)

| | | | | | | | | | |
|---|---|---|---|---|---|---|---|---|---|
| iPS:39 3040 | 21-225_30E3 | VH3\|3-23\|D5\|5-12\|RF3\|J H6 | ....V... | ....N | .... | ..R. ..F. .E.. | .... | ELLE... | .... |
| iPS:39 3058 | 21-225_31H3 | VH3\|3-23\|D5\|5-12\|RF3\|J H6 | ....V... | ..N | .... | ..R. .N.F. | .... | ELLE... | .... |
| iPS:39 3060 | 21-225_32G12 | VH3\|3-23\|D5\|5-12\|RF3\|J H6 | ....L... ....N | .... | .... | ..R. ..FH. | ..R. ..V. | ELLE... ...F. | .... |
| iPS:39 3068 | 21-225_34G9 | VH3\|3-23\|D5\|5-12\|RF3\|J H6 | ....V... | .... | .... | S...R. ..FH. | ..V. | ELLE... ...F. | .... |
| iPS:39 3072 | 21-225_36C5 | VH3\|3-23\|D5\|5-12\|RF3\|J H6 | ....V... | ..N | ....V | ..R. ..FH. | ..V. | ELLE... ...F. | .... |
| iPS:39 3076 | 21-225_33A4 | VH3\|3-23\|D5\|5-12\|RF3\|J H6 | ...S..E ...I. | ..N | .... | ..RR. ..F. | ...F. | ELLE... ...S...I. | .... |
| iPS:39 3102 | 21-225_33F1 | VH3\|3-23\|D5\|5-12\|RF3\|J H6 | ....L... | ..C... | .... | S...R. ..FH. | ..V. | ELLE... ...F. | .... |
| iPS:39 3104 | 21-225_33A7 | VH3\|3-23\|D5\|5-12\|RF3\|J H6 | .... | N.... | .... | ..RR. ..F. | ..V. | ELLE... ...F. | .... |
| iPS:39 3106 | 21-225_34A6 | VH3\|3-23\|D5\|5-12\|RF3\|J H6 | ....N | .... | .... | ..R. ..FH. | ..V. | ELLE... ..FA. | .... |
| iPS:39 3110 | 21-225_35B7 | VH3\|3-23\|D5\|5-12\|RF3\|J H6 | ....A... | .... | .... | ..R. ..F. | ...F. | ELLE... | ...A... |
| iPS:39 3118 | 21-225_34H11 | VH3\|3-23\|D5\|5-12\|RF3\|J H6 | .... | ..N | ...E.. | ..RR. ..F. | ....Q... | ELLE... ...F. | .... |
| iPS:39 3124 | 21-225_33G7 | VH3\|3-23\|D5\|5-12\|RF3\|J H6 | .... | ..N | .... | ..RR. ..F. | .... | ELLE... ....S | .... |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | Germline | VH3|3-23|D5|5-12|RF3|JH6 | | | | | | |
| iPS:39 3126 | 21-225_35D1 | | | | ...R... ..FH. | ....N....V. | .ELLE... ....F.... | ...A. |
| iPS:39 3128 | 21-225_35F11 | | | | ...R... ..FH. | .........V. | .ELLE... ....F.... | |
| iPS:39 3146 | 21-225_34G8 | | | | ...R... ..FH. M.. | ..........T | .ELLE... ....F.... | |
| iPS:39 3150 | 21-225_36A5 | | | | ..RR... .N.F. | ............ | .ELLE... ....A.... | |
| iPS:39 3180 | 21-225_4G12 | | N.... | | TL..R.. | .S.. S | WGR..S.E... | |
| iPS:39 3232 | 21-225_17F12 | | | | ...G... | .V.. | WGR..N.E... | |
| iPS:39 8494 | 21-225_21H4 | | | | ...L..R. | | WGR..S.E... | |
| iPS:39 8508 | 21-225_24B1 | | | | ...R... | | WGR..S.E... | |
| iPS:39 8528 | 21-225_32G1 | ....A... | | | ...R... ..FH. | ..........V. | .ELLE... ....F.... | |
| iPS:39 8534 | 21-225_33B8 | | | | ...R... ..FH. | ..........V. | .ELLE... ....F.... | |
| iPS:39 8540 | 21-225_35A6 | | | | ..T..R.. ..FH. | ..........V. | .ELLE... ....F.... | |

Figure 52 (Continued)

| VH4/4-39/D4/4-17/RF2/JH4 | | CLQRES GPGLVKPSETLS LTCTVSG-GSIS | SS SYYWG | WIRQPPGK GLEWIG SIYYSG STYYNP SLKS | RVTISVDTSKNQFSLKL SSVTAADTAVYYCAR | PYKLSYDYTKNSSIKI DYGY | WGQGI VTVSS |
|---|---|---|---|---|---|---|---|
| iPS:39 2622 | 21-225_17H8 | VH4/4-39/D4/4-17/RF2/JH4 | ....... | R...... | .R.N..... G.N...... SLKS | ................. ................. | HGK.W.......... ..........GL. | .......... VTVSS |
| iPS:39 2638 | 21-225_17F9 | VH4/4-39/D4/4-17/RF2/JH4 | ....... | R...... | ....N............ ................. | ............N.... ..S....S......... | HGK.W.......... ..........GL. | .......... ...... |
| iPS:39 2656 | 21-225_1F2 | VH4/4-39/D4/4-17/RF2/JH4 | ....... | R...... | ....N...A.N...... ...........G..... | ............N.... ................G | HGK.W.......... ..........GL. | .......... ...... |
| iPS:39 2794 | 21-225_21H3 | VH4/4-39/D4/4-17/RF2/JH4 | ....... | R...... | ....N....D....... ................. | ................. ................G | HGK.W.......... ..........GL. | .......... ...... |
| iPS:39 2822 | 21-225_23C8 | VH4/4-39/D4/4-17/RF2/JH4 | ....... | R...... | ..D.N....T.N..... .........V....... | ................. ...H............G | HGK.W.......... ..........GL. | .......... ...... |
| iPS:39 2838 | 21-225_22G8 | VH4/4-39/D4/4-17/RF2/JH4 | ...N... | R...... | ....N....H....... ................. | .......F......... ................. | HGK.W.......... ..........GL. | .......... ...... |
| iPS:39 2858 | 21-225_22H4 | VH4/4-39/D4/4-17/RF2/JH4 | ....... | R...... | ....N............ ................. | .......T......... ...M........F.G.. | HGK.W.......... ..........GL. | .......... ...... |
| iPS:39 2882 | 21-225_23A3 | VH4/4-39/D4/4-17/RF2/JH4 | ...N... | R...... | ...QN............ ................. | ............S.... ................G | HGK.W.......... ..........GL. | .......... ...... |
| iPS:39 3804 | 21-225_5H7 | VH4/4-39/D4/4-17/RF2/JH4 | ....... | R...... | ....N....T....... ................. | ................. ...........S..N. | HGK.W.......... ..........GL.F | .......... ...... |
| iPS:39 3832 | 21-225_14B2 | VH4/4-39/D4/4-17/RF2/JH4 | ....... | R...... | ....N....T....... ................. | ................. ...........S..N. | HGK.W.......... ..........GL. | ......A... ...... |
| iPS:39 4037 | 21-225_4F4 | VH4/4-39/D4/4-17/RF2/JH4 | ...R... | R...... | ....N....D....... ................. | ................. ................G | HGK.W.......... ..........GL. | .......... ...... |

| | | H_FR1 | H_CDR1 | H_FR2 | H_CDR2 | H_FR3 | H_CDR3 | H_FR4 |
|---|---|---|---|---|---|---|---|---|
| iPS:39 3992 | 21-225_14H8 | VH3/3-48|D7|7-27|RF1/JH4 | ........... | ........N... | ........... | ........... | .....A......................... | GG.S......P... | ........... |
| iPS:39 4055 | 21-225_9C8 | VH3/3-48|D7|7-27|RF1/JH4 | ..........V | ........Q... | ........I- | ........... | ............................... | GG.S......P..S | ........... |
| | Germline | H_FR1 | H_CDR1 | H_FR2 | H_CDR2 | H_FR3 | H_CDR3 | H_FR4 |
| | VH3/3-30.3|D4|4-11|RF2/JH4 | EVQLVES GGGLVQPGRSLR LSCAASG-FTFS | YAMH | WVRQAPGK GLEWVA | GSNKYYAD SVKG | RFTISRDNSKNTVYLQM NSLRAEDTAVYYCAR | VFDY | WGQGTL VTVSS |
| iPS:39 2694 | 21-225_19A5 | VH3/3-30.3|D4|4-11|RF2/JH4 | ........... | ........... | ........... | WF......... ...D....... | ........... | RAYS....SSS. | ........... |
| | Germline | H_FR1 | H_CDR1 | H_FR2 | H_CDR2 | H_FR3 | H_CDR3 | H_FR4 |
| | VH3/3-23|D1|1-11|RF1/JH4 | EVQLLES GGGLVQPGGSLR LSCAASG-FTFS | S.....YAMS | WVRQAPGK GLEWVS | AISGS GGSTYYAD SVKG | RFTISRDNSKNTLYLQM NSLRAEDTAVYYCAK | GTTGT | WGQGTL VTVSS |
| iPS:39 2714 | 21-225_16G12 | VH3/3-23|D1|1-11|RF1/JH4 | ........... | .........T. | ........... | ..T..R. .H...... .R.... | .....A......S.................. | QD----C | ........... |
| iPS:39 2880 | 21-225_20H9 | VH3/3-23|D1|1-11|RF1/JH4 | ........S.. | ........... | ........... | .....Y..... | ....E........................... | .GS---LF. | ........... |
| iPS:39 2892 | 21-225_20C11 | VH3/3-23|D1|1-11|RF1/JH4 | ........S.. | ........... | ........... | ..T..R. .H...... | .....A......S.................. | QD----C | ........... |
| iPS:39 3968 | 21-225_5A5 | VH3/3-23|D1|1-11|RF1/JH4 | .......W... | ........N.. | ........... | .....Y..... | ...............S................ | .GS---LF. | ........... |
| | Germline | H_FR1 | H_CDR1 | H_FR2 | H_CDR2 | H_FR3 | H_CDR3 | H_FR4 |
| | VH3/3-23|D6|6-6|RF1|JH3 | | | | | RFTISRDNSKNTLYLQM NSLRAEDTAVYYCAR | EYCSSS-----DAFDI | WGQGTM VTVSS |
| iPS:39 2730 | 21-225_17A1 | VH3/3-23|D6|6-6|RF1|JH3 | ........... | .........N.. | ........... | V........... .SN........ | ............................... | R.T.DW....H..... | ........... |

Figure 52 (Continued)

[Figure showing antibody sequence alignment table with columns H_FR1, H_CDR1, H_FR2, H_CDR2, H_FR3, H_CDR3, H_FR4 for multiple clones including iPS-39 2736 (21-225_17B12), iPS-39 2770 (21-225_20C10), iPS-39 3878 (21-225_7G12), VH3|3-21|D7|7-27|RF3|JH5 Germline, iPS-39 2748 (21-225_20A8), VH3|3-30.3|D1|1-1|RF1/JH5 Germline, iPS-39 2754 (21-225_21D3), iPS-39 2818 (21-225_22D8), VH3|3-23|D6|6-19|RF2|JH1 Germline, iPS-39 2762 (21-225_22G5), iPS-39 4051 (21-225_9E5).]

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| VH4/4-39/D1|1-26|RF3/JH1 | | QVQLQES GPGLVKPSETLS LTCTVSG-GSIS | SS SYYWG | WIRQPPGK GLEWIG | SIYY SGSTYYNP SLKS | RVTISVDTSKNQFSLKL SSVTAADTAVYYCAR | ACGCDC ABVTQH | WGQGTL VTVSS |
| iPS:39 2774 21-225_21F3 | VH4|4-39|D1|1-26|RF3/JH1 | ....A.......... | R.. | ................ | ................ | .................. | L.S.W-- .......ABVTQH | ........ |
| iPS:39 3962 21-225_7H7 | VH4|4-39|D1|1-26|RF3/JH1 | ................ | R.. | V...... | N....I. | .............E..S | H.T.W-- ......--SLD. | ........ |
| iPS:39 4049 21-225_13H5 | VH4|4-39|D1|1-26|RF3/JH1 | ....A.......... | R.. | ................ | ................ | ................S | L.S.W-- ......---D.. | ........ |
| VH3|3-21|D2|2-21|RF2/JH4 | | EVQLVES GGGLVQPGGSLR LSCAASG-FTFS | S YSMN | WVRQAPGK GLEWVS SISS | SSTYYAD SVKG | RFTISRDNAKNSLYLQM NSLRAEDTAVYYCAR | SSYFDY | WGQGTL VTVSS |
| iPS:39 2776 21-225_21A12 | VH3|3-21|D2|2-21|RF2/JH4 | ..............N. | ...... | ................ | .....G. | ................L | .AG--- .....YSYFDY | ........ |
| VH3|3-33|D6|6-19|RF2/JH6 | | QVQLVES GGGLVQPGGSLR LSCAASG-FTFS | S YGMH | WVRQAPGK GLEWVA | VIWY DGSNKYYAD SVKG | RFTISRDNSKNTLYLQM NSLRAEDTAVYYCAR | GIAYAGYY YYGMDV | WGQGTT VTVSS |
| iPS:39 2806 21-225_24H3 | VH3|3-33|D6|6-19|RF2/JH6 | ...............G | ...... | ................ | ................ | .................. | VAVAG-- ........ | ........ |
| VH3|3-48|D7|7-27|RF2/JH4 | | EVQLVES GGGLVQPGGSLR LSCAASG-FTFS | S YSMN | WVRQAPGK GLEWVS | SISS SSTYIYAD SVKG | RFTISRDNAKNSLYLQM NSLRAEDTAVYYCAR | VLGY FDY | WGQGTL VTVSS |
| iPS:39 2826 21-225_20B9 | VH3|3-48|D7|7-27|RF2/JH4 | ................ | ...... | ................ | ................ | .................. | S.WS.. ......P. | ........ |
| VH4|4-59|D1|1-1|RF1|JH5 | | QVQLQES GPGLVKPSETLS LTCTVSG-GSIS | S YYWS | WIRQPPGK GLEWIG | YIYY SGSTNYNP SLKS | RVTISVDTSKNQFSLKL SSVTAADTAVYYCAR | GTTGT ---NWFDP | WGQGTL VTVSS |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| iPS:39 2830 | 21-225_21A5 | VH4|4-59/D1|1-1|RF1/JH5 | ........F.. | .......... | ....A..R..T...I..... | ...M........... | ...P.SG....... | ......... |
| | Germline | VH3|3-23|D6|6-6|RF2/JH4 | EVQLLES GGGLVQPGGSLR LSCAASG-FTFS | YAMS | WVRQAPGK AISGS GLEWVS GGSTYYAD SVKG | RFTISRDNSKNTLYLQM NSLRAEDTAVYYCAK | SIAAR YFDI | WGQGTL VTVSS |
| iPS:39 2840 | 21-225_23G1 | VH3|3-23|D6|6-6|RF2/JH4 | .......... | ....R.... | .........T..NT. | ..............R. | .SL--- ..... | ......... |
| iPS:39 4018 | 21-225_15B1 | VH3|3-23|D6|6-6|RF2/JH4 | ......T... | ....V.... | .........G..NN.. | ..............V.R. | .SL--- ..... | ......... |
| iPS:39 4026 | 21-225_16C7 | VH3|3-23|D6|6-6|RF2/JH4 | ......V.T. | .......... | .........T..W.. | ..............E..R. | .SL--- ..... | ......... |
| | Germline | VH3|3-23|D6|6-6|RF2/JH5 | EVQLLES GGGLVQPGGSLR LSCAASG-FTFS | YAMS | WVRQAPGK AISGS GLEWVS GGSTYYAD SVKG | RFTISRDNSKNTLYLQM NSLRAEDTAVYYCAK | SIAAR NWFDP | WGQGTL VTVSS |
| iPS:39 2842 | 21-225_23G8 | VH3|3-23|D6|6-6|RF2/JH5 | .......... | .......... | .......... | ..............V. | .SG--- ...WFA | ......... |
| | Germline | VH3|3-23|D1|1-1|RF2/JH2 | EVQLLES GGGLVQPGGSLR LSCAASG-FTFS | YAMS | WVRQAPGK AISGS GLEWVS GGSTYYAD SVKG | RFTISRDNSKNTLYLQM NSLRAEDTAVYYCAR | VILEY WYFDL | WGQGTL VTVSS |
| iPS:39 2856 | 21-225_22A2 | VH3|3-23|D1|1-1|RF2/JH2 | .......... | .......... | .........G..N.P.. | ...........I.... | VG--- ...--AVH | ......... |
| | Germline | VH4|4-30.1|D5|5-18|RF1/JH6 | QVQLQES GPGLVKPSQTLS LTCTVSG-GSIS | SG GYYWS | WIRQHPGK GLEWIG SGSTYYNP SLKS | RVTISVDTSKNQFSLKL SSVTAADTAVYYCAR | VDTAWYY YYGMDV | WGQGTT VTVSS |
| iPS:39 2864 | 21-225_23B9 | VH4|4-30.1|D5|5-18|RF1/JH6 | ......A... ......D... | .......... | .......... | .......... | E.G.FG--- ..... | ......... |
| | | H_FR1 | H_CDR1 | H_FR2 | H_CDR2 | H_FR3 | H_CDR3 | H_FR4 |

| | | H_FR1 | H_CDR1 | H_FR2 | H_CDR2 | H_FR3 | H_CDR3 | H_FR4 |
|---|---|---|---|---|---|---|---|---|
| iPS:39 3010 | 21-225_25E11 | VH3J3-23/D3|1-26|RF3|JH4 | | | V....G | | RGY.GYE......DLL....C | |
| | Germline | EVQLLES GGGLVQPGGSLR LSCAASG FTFS | S....YAMS | WVRQAPGK GLEWVS | AISGS GGSTYYAD SVKG | RFTISRDNSKNTLYLQM NSLRAEDTAVYYCAK | LIIFGVY --------IIDAFDI | WGQGT VTVSS |
| iPS:39 3016 | 21-225_28F11 | VH3J3-23/D3|3-3|RF3|JH 3 | | | VT | T.F. | | R.Q.D--- -D... | |
| | Germline | | H_CDR1 | H_FR2 | H_CDR2 | H_FR3 | H_CDR3 | H_FR4 |
| | | EVQLVES GGGVVQPGRSLR LSCAASG FTFS | S.......YGMH | WVRQAPGK GLEWVA | VIWYD GSNKYYAD SVKG | RFTISRDNSKNTLYLQM NSLRAEDTAVYYCAR | YYYDSSGIYY ---YYYYGMDV | WGQGT VTVSS |
| iPS:39 3032 | 21-225_26F8 | VH3J3-33/D3|3-22|RF2|JH6 | G.......... | | I | | ER..FW------ SGC.... | |
| | Germline | | H_CDR1 | H_FR2 | H_CDR2 | H_FR3 | H_CDR3 | H_FR4 |
| | | CVQLVQS GAEVKKPGASVK VSCKASG VTFT | G......YIMH | WVRQAPGQ GLEWMG | WINPN SGGTNYAQ KFQG | RVTMTRDTSTSTAYMEL SSLRSEDTAVYYCAR | DHSNYII ------YYYGMDV | WGQGT VTVSS |
| iPS:39 3042 | 21-225_31F1 | VH1|1-02/D4|4-11|RF2|JH6 | D.......... | | | M. | S..FSNW... YD... | |
| iPS:39 3108 | 21-225_34G11 | VH1|1-02/D4|4-11|RF2|JH6 | | | | | D. | I..FSSW... YD..A. | |
| | Germline | | H_CDR1 | H_FR2 | H_CDR2 | H_FR3 | H_CDR3 | H_FR4 |
| | | CVQLVQS GAEVKKPGASVK VSCKASG VTFT | S......YGIS | WVRQAPGQ GLEWMG | WISAY NGNTNYAQ KLQG | RVTMTTSTSTAYMEL SSLRSEDTAVYYCAR | SYSSYD ------VYFDY | WGQGT VTVSS |
| iPS:39 3044 | 21-225_25B8 | VH1|1-18/D5|5-12|RF3|JH4 | | | T. .R. | | D. | TAA..S..... ......SSW... | |
| iPS:39 3050 | 21-225_28C5 | VH1|1-18/D5|5-12|RF3|JH4 | ......D... | | T. .R. | | D. | TAA..S..... ......SSW... | |
| | | H_FR1 | H_CDR1 | H_FR2 | H_CDR2 | H_FR3 | H_CDR3 | H_FR4 |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | VH3|3-33|D6|6-8|RF1|JH3 | QVQLVES GGGVVQPGRSLR LSCAASG-FTFS | YGMH | WVRQAPGK GLEWVA | VISYDG SNKYYAD SVKG | RFTISRDNSKNTLYLQM NSLRAEDTAVYYCAR | EYSSSS------DAFDI | WGQGTM VTVSS |
| iPS:39 3046 | 21-225_25A12 | VH3|3-33|D6|6-8|RF1|JH3 | N......CV. | EY..GW....YDYGM.V | | | | | |
| | | Germline | H_FR1 | H_CDR1 | H_FR2 | H_CDR2 | H_FR3 | H_CDR3 | H_FR4 |
| | VH3|3-21|D4|4-11|RF3|JH6 | EVQLVES GGGLVKPGGSLR LSCAASG-FTFS | SYSMN | WVRQAPGK GLEWVS | SISSS SSYIYYAD SVKG | RFTISRDNAKNSLYLQM NSLRAEDTAVYYCAR | TTTTTT-------VYGMDV | WGQGTT VTVSS |
| iPS:39 3078 | 21-225_33H11 | VH3|3-21|D4|4-11|RF3|JH6 | | | S | G | S. | NG------ | |
| iPS:39 3142 | 21-225_33A3 | VH3|3-21|D4|4-11|RF3|JH6 | | G | | G...T | | NG------ | |
| | | Germline | H_FR1 | H_CDR1 | H_FR2 | H_CDR2 | H_FR3 | H_CDR3 | H_FR4 |
| | VH3|3-23|D6|6-19|RF2|JH6 | EVQLVES GGGLVQPGGSLR LSCAASG-FTFS | YAMS | WVRQAPGK GLEWVS | AISGS GSSTYYAD SVKG | RFTISRDNSKNTLYLQM NSLRAEDTAVYYCAR | GLAYAGY-------YYGMDV | WGQGTT VTVSS |
| iPS:39 3096 | 21-225_34D11 | VH3|3-23|D6|6-19|RF2|JH6 | S. | N | | R..FH. | V | EL.ED.-.......F. | |
| | | Germline | H_FR1 | H_CDR1 | H_FR2 | H_CDR2 | H_FR3 | H_CDR3 | H_FR4 |
| | VH3|3-30.3|D4|4-23|RF2|JH3 | QVQLVES GGGVVQPGRSLR LSCAASG-FTFS | SYAMH | WVRQAPGK GLEWVA | VISYD GSNKYYAD SVKG | RFTISRDNSKNTLYLQM NSLRAEDTAVYYCAR | DYGCTNS-------DAFDI | WGQGTM VTVSS |
| iPS:39 3172 | 21-225_3B12 | VH3|3-30.3|D4|4-23|RF2|JH3 | ..H | Y......G | S | | H. | RR.GYG.......VP... | |
| | | Germline | H_FR1 | H_CDR1 | H_FR2 | H_CDR2 | H_FR3 | H_CDR3 | H_FR4 |
| | VH3|3-30.3|D4|4-23|RF2|JH6 | QVQLVES GGGVVQPGRSLR LSCAASG-FTFS | SYAMH | WVRQAPGK GLEWVA | VISYD GSNKYYAD SVKG | RFTISRDNSKNTLYLQM NSLRAEDTAVYYCAR | DYGGNSYY-------YYGMDV | WGQGTT VTVSS |
| iPS:39 3174 | 21-225_15D8 | VH3|3-30.3|D4|4-23|RF2|JH6 | ..T | ......G. | | | | RVYC.STSCV.......PYYD... | |

Figure 52 (Continued)

| | | H_FR1<br>EVQLVES-<br>GGGLVQPGGSLR<br>LSCAASG-FTFS | H_CDR1<br>S------AMS | H_FR2<br>WVRQAPGK<br>GLEWVS | H_CDR2<br>AISGS-<br>GGSTYYA<br>DSVKG | H_FR3<br>RFTISRDNSKNTLYLQM<br>NSLRAEDTAVYYCTT | H_CDR3<br>LTGYY-----<br>YYEMDV | H_FR4<br>WGQGTT<br>VTVSS |
|---|---|---|---|---|---|---|---|---|
| | VH3\|3-<br>15\|D7\|7-<br>27\|RF1\|J<br>H6 | | | | | | | |
| iPS:39<br>3194 | 21-225_16D2 | VH3\|3-<br>15\|D7\|7-<br>27\|RF1\|J<br>H6 | ........N | ........ | ........ | ................H<br>................. | D..PIAARLA<br>...YYY..A... | ........ |
| iPS:39<br>8488 | 21-225_19F6 | VH3\|3-<br>15\|D7\|7-<br>27\|RF1\|J<br>H6 | ........N | ........ | ........ | ................. | D..PIAARLA<br>...YYY..A... | ........H<br>........ |
| iPS:39<br>8544 | 21-225_7C8 | VH3\|3-<br>15\|D7\|7-<br>27\|RF1\|J<br>H6 | .......R.N | ......L. | ........ | .............E.E....<br>.............G.....S | D..PIAARLA<br>...YYY..A... | ........ |
| iPS:40<br>2231 | 21-225_6D9 | VH3\|3-<br>15\|D7\|7-<br>27\|RF1\|J<br>H6 | ........N | ......L. | ........ | .................E...<br>................S | D..PIAARLA<br>...YYY..A... | ........ |
| | | Germline H_FR1 | H_CDR1 | H_FR2 | H_CDR2 | H_FR3 | H_CDR3 | H_FR4 |
| | VH3\|3-<br>23\|D4\|4-<br>11\|RF2\|J<br>H4 | EVQLVES-<br>GGGLVQPGGSLR<br>LSCAASG-FTFS | S------YAMS | WVRQAPGK<br>GLEWVS | AISGS-<br>GGSTYYA<br>DSVKG | RFTISRDNSKNTLYLQM<br>NSLRAEDTAVYYCAK | DYSNY------<br>-----YFDY | WGQGTL<br>VTVSS |
| iPS:39<br>3870 | 21-225_7B1 | VH3\|3-<br>23\|D4\|4-<br>11\|RF2\|J<br>H4 | ........D | ........ | ...T...<br>....I.. | ..............K....<br>..........F..R | .RG---<br>....-SV | ........ |
| | | Germline H_FR1 | H_CDR1 | H_FR2 | H_CDR2 | H_FR3 | H_CDR3 | H_FR4 |
| | VH4\|4-<br>39\|D4\|4-<br>17\|RF2\|J<br>H1 | QVQLQES-<br>GPGLVKPSETLS<br>LTCTVSG-GSIS | SS---SYYWG | WIRQPPGK<br>GLEWIG | SIYY----<br>SGSTYYNP<br>SLKS | RVTISVDTSKNQFSLKL<br>SSVTAADTAVYYCAR | DYGDYA------<br>-----EYFCH | WGQGTL<br>VTVSS |
| iPS:39<br>3872 | 21-225_2A11 | VH4\|4-<br>39\|D4\|4-<br>17\|RF2\|J<br>H1 | ........ | ......A. | ...N....<br>....V.. | ................T... | HGK.W--<br>....-GLED | ........ |
| | | Germline H_FR1 | H_CDR1 | H_FR2 | H_CDR2 | H_FR3 | H_CDR3 | H_FR4 |
| | VH4\|4-<br>59\|D6\|6-<br>6\|RF1\|JH4 | QVQLQES-<br>GPGLVKPSETLS<br>LTCTVSG-GSIS | S----YYWS | WIRQPPGK<br>GLEWIG | YIYY----<br>SGSTNINP<br>SLKS | RVTISVDTSKNQFSLKL<br>SSVTAADTAVYYCAR | EYSSY------<br>-----SIFDY | WGQGTL<br>VTVSS |
| iPS:39<br>3890 | 21-225_4B1 | VH4\|4-<br>59\|D6\|6-<br>6\|RF1\|JH<br>4 | ........S | ........ | ......R.T<br>.......I. | .I.M..........K.... | DLK.......G<br>.......CLF | ........ |
| | | Germline | H_CDR1 | H_FR2 | H_CDR2 | H_FR3 | H_CDR3 | H_FR4 |

Figure 52 (Continued)

| | | H_FR1 | H_CDR1 | H_FR2 | H_CDR2 | H_FR3 | H_CDR3 | H_FR4 |
|---|---|---|---|---|---|---|---|---|
| | VH3|3-33|D4|4-17|RF1|JH6 | QVQLVES GGGVQPGRSLR LSCAASG FTFS | YGMH | WVRQAPGK GLEWVA | VIWYD GSNKYYA SVKG | RFTISRDNSKNTLYLQM NSLRAEDTAVYYCAR | *LR*YYY* ----YYYGMDV | WGQGTT VTVSS |
| iPS:39 3926 | 21-225_4G4 | ........ | S....... | ......G. | ....H.. | ...............A.. | D..MG-- | ........ |
| | | H_FR1 | H_CDR1 | H_FR2 | H_CDR2 | H_FR3 | H_CDR3 | H_FR4 |
| | VH3|3-23|D6|6-6|RF2|JH2 | EVQLVES- GGGLVQPGGSLR LSCAASG-FTFS | YAMS | WVRQAPGK-GLEWVS | AISGS-GGSTYYAD SVKG | RFTISRDNSKNTLYLQM NSLRAEDTAVYYCAR | SIAARY- ---WYFDL | WGRGTL VTVSS |
| iPS:39 3936 | 21-225_14A11 | ........ | ......N | ........ | ...V...R.. | ........ | R...GM. ........E. | ........ |
| | | H_FR1 | H_CDR1 | H_FR2 | H_CDR2 | H_FR3 | H_CDR3 | H_FR4 |
| | VH3|3-21|D1|1-1|RF3|JH4 | EVQLVES- GGGLVKPGGSLR LSCAASG-FTFS | YSMN | WVRQAPGK GLEWVS | SISSS- SSIIYYAD SVKG | RFTISRDNAKNSLYLQM NSLRAEDTAVYYCAR | YNWD---- ----YFDY | WGQGTL VTVSS |
| iPS:39 3988 | 21-225_7F10 | ........ | R....T.. | ........ | ........ | ........I........ | A..L-- | ........ |
| | | H_FR1 | H_CDR1 | H_FR2 | H_CDR2 | H_FR3 | H_CDR3 | H_FR4 |
| | VH4|4-39|D6|6-6|RF1|JH4 | QVQLQES GPGLVKPSETLS LTCTVSG-GSIS | SS---SYYWG | WIRQPPGK GLEWIG | SIYY- SGSTNYN SLKS | RVTISVDTSKNQFSLKL SSVTAADTAVYYCAR | EYSSS--- ----SIYDI | WGQGTL VTVSS |
| iPS:39 3990 | 21-225_11G7 | ........ | ........ | ........ | ....S.S. | ........ | LN..W--- ........-S. | ........ |
| | | H_FR1 | H_CDR1 | H_FR2 | H_CDR2 | H_FR3 | H_CDR3 | H_FR4 |
| | VH3|3-30.3|D2|2-15|RF3|JH6 | QVQLVES GGGVVQPGRSLR LSCAASG-FTFS | YAMH | WVRQAPGK GLEWVA | VISYD GSNKYYA SVKG | RFTISRDNSKNTLYLQM NSLRAEDTAVYYCAR | DIVYYAAT ----YYYGMDV | WGQGTI VTVSS |
| iPS:39 4010 | 21-225_12G5 | ........F.. | N.......GIY | ........ | ........ | ........ | RGA.A.Y- ........I... | ........ |
| | | H_FR1 | H_CDR1 | H_FR2 | H_CDR2 | H_FR3 | H_CDR3 | H_FR4 |
| | VH1|1-08|D2|2-21|RF1|JH4 | QVQLVQS GAEVKKPGASVK VSCKASG-VTFT | S---YDIN | WVRQATGQ GLEWMG | WMNPN SGNTGYAQ KFQG | RVTMTRNTSISTAYMEL SSLRSEDTAVYYCAR | STIVW*I ---LFYFDY | WGQGTL VTVSS |

| | | H_FR1 QLQLQES GGGLVQPGGSLR LSCAASG-FTFS | H_CDR1 SS-----SYIWG | H_FR2 WIRQPPGK GLEWIG | H_CDR2 SIYY SGSTYYN SLKS | H_FR3 RVTISVDTSKNQFSLKL \*LQ\*L SSVTAADTAVYYCAR | H_CDR3 | H_FR4 WGQGTM VTVSS |
|---|---|---|---|---|---|---|---|---|
| iPS:39 8546 | VH2\|2-05\|D6\|6-6\|RF1\|JH4 21-225_9H10 | ........ ........ ........ | ........ | ........ | S....... .. | ........A..... | TG..C..... ........C..... | ........ |
| | | Germline | H_FR1 | H_CDR1 | H_FR2 | H_CDR2 | H_FR3 | H_CDR3 | H_FR4 |
| | VH2\|2-05\|D6\|6-6\|RF1\|JH4 | EVQLVES GGGLVQPGGSLR LSCAASG-FTFS | S------YSMN | WVRQAPGK GLEWVS | SISSS SSIYYAD SVKG | RFTISRDNAKNSLYLQM NSLRAEDTAVYYCAR | WGQGTT VTVSS | |
| iPS:40 2229 | VH3\|3-21\|D1\|1-1\|RF2\|JH 6 21-225_16H9 | ........ ........ ........ | ........ | ........ | ........ ........ .... | ........ ........ | ....WQIEYY ....YYYGMDV | MGQGTT VTVSS |
| | | Germline | H_FR1 | H_CDR1 | H_FR2 | H_CDR2 | H_FR3 | H_CDR3 | H_FR4 |
| | VH3\|3-21\|D4\|4-11\|RF2\|JH5 | EVQLVES GGGLVQPGGSLR LSCAASG-FTFS | S------YSMN | WVRQAPGK GLEWVS | SISSS SSIYYAD SVKG | RFTISRDNAKNSLYLQM NSLRAEDTAVYYCAR | WFDP | MGQGTL VTVSS |
| iPS:40 2233 | VH3\|3-21\|D4\|4-11\|RF3\|JH5 21-225_20F10 | ........ ........ ........ | T.....NL. | ........ | ..GG...S ........ | ........ | NG-------- .....F | ........ |
| | | Germline | H_FR1 | H_CDR1 | H_FR2 | H_CDR2 | H_FR3 | H_CDR3 | H_FR4 |
| | VH3\|3-21\|D1\|1-1\|RF1\|JH3 | EVQLVES GGGLVQPGGSLR LSCAASG-FTFS | S------YAMS | WVRQAPGK GLEWVS | AISGS GGSTYYAD SVKG | RFTISRDNSKNTLYLQM NSLRAEDTAVYYCAR | GTYGT DAFDI | WGQGTM VTVSS |
| iPS:40 2235 | VH3\|3-23\|D5\|5-12\|RF1\|JH3 | ........ ........ ........ | ........ | ........ | T--..... ..TF. | ........ ........ | KAG----- .....L... | ........ |
| | | Germline | H_FR1 | H_CDR1 | H_FR2 | H_CDR2 | H_FR3 | H_CDR3 | H_FR4 |
| | VH3\|3-23\|D5\|5-12\|RF1\|JH3 | EVQLVES GGGLVQPGGSLR LSCAASG-FTFS | S------YAMS | WVRQAPGK GLEWVS | AISGS GGSTYYAD SVKG | RFTISRDNSKNTLYLQM NSLRAEDTAVYYCAR | VDIVAT IDAFDI | WGQGTM VTVSS |
| iPS:40 3870 | VH3\|3-23\|D5\|5-12\|RF1\|JH3 21-225_23G4 | ........ ........ ........ | ........ | ........ | ....V.... ........R | ........ | RG..GA..... ........TE... | ........ |
| | | Germline | H_FR1 | H_CDR1 | H_FR2 | H_CDR2 | H_FR3 | H_CDR3 | H_FR4 |
| | VH4\|4-39\|D4\|4-11\|RF1\|JH4 | QLQLQES GPGLVKPSETLS LTCTVSG-GSIS | SS----SYIWG | WIRQPPGK GLEWIG | SIYY SGSTYYN SLKS | RVTISVDTSKNQFSLKL \*LQ\*L SSVTAADTAVYYCAR | VFDY | WGQGTL VTVSS |

Figure 52 (Continued)

| | Germline | H_FR1 | H_CDR1 | H_FR2 | H_CDR2 | H_FR3 | H_CDR3 | H_FR4 |
|---|---|---|---|---|---|---|---|---|
| | VH1|1-08/D3|3-19|RF2/JH6 | EVQLVQS-GAEVKKPGASVK VSCKASG-YTFT | S------YDIN | WVRQATGQ GLEWMG | WMNPN-SGNTGYAQ KFQG | RVTMTRNTSTSTAYMEL SSLRSEDTAVYYCAR | YYDILTGYIN-------YYYYYGMDV | WGQGTT VTVSS |
| iPS:40 3872 | VH4|4-39/D4|4-11|RF1/JH4 | ....Q....V.. | RT....... | ......L.... | ......N.A.N.... | .............G..... | HG.DW......GL... | .......... |
| iPS:43 7240 | VH1|1-08/D3|3-19|RF2/JH6 | ................. | .......... | ............ | ....L.H..... | ..I..W....R..... | GF..........S--..PT.....D. | .......... |
| iPS:43 4577 | VH1|1-08/D3|3-19|RF2/JH6 | ................. | .......... | ............ | ....L.H..... | ..I..W....R..... | GF..........S--..PT.....D. | .......... |
| iPS:43 4553 | VH1|1-08/D3|3-19|RF2/JH6 | ................. | .......... | ............ | ....L.H..... | ..I..W....R..... | GF..........S--..PT.....D. | .......... |
| iPS:43 4927 | VH1|1-08/D3|3-19|RF2/JH6 | ................. | .......... | ............ | ............ | .....W....R..... | GF..........S--..PT.....D. | .......... |
| | Germline | H_FR1 | H_CDR1 | H_FR2 | H_CDR2 | H_FR3 | H_CDR3 | H_FR4 |
| | VH3|3-23/D6|6-19|RF2/JH4 | EVQLLES-GGGLVQPGGSLR LSCAASG-FTFS | S------YAMS | WVRQAPGK GLEWVS | AISGS-GGSTYYAD SVKG | RFTISRDNSKNTLYLQM NSLRAEDTAVYYCAK | -GTAVA---------GFFDY | WGQGTL VTVSS |
| iPS:43 5477 | VH3|3-23/D6|6-19|RF2/JH4 | ................. | .......... | ............ | ......R..... | ..................I | H.....GT.........GAH.... | A... |
| iPS:43 5385 | VH3|3-23/D6|6-19|RF2/JH4 | ................. | .......... | ............ | ....N.F..... | ..................I | H.....GT.........GAH.... | A... |

Figure 53 (Table 6)
Standard IgG Antibody Variable Region Protein Alignment
CDRs defined by Kabat
Alignment numbering defined by Amgen Reference (AHo)

| KAPPA_VARIABLE | Germline | K_FR1 | K_CDR1 | K_FR2 | K_CDR2 | K_FR3 | K_CDR3 | K_FR4 |
|---|---|---|---|---|---|---|---|---|
| VK4|B3/J K1 | | DIVMTQSPDSLAVSLG ERATINC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.39 2928 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.42 4419 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.44 1468 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.44 1475 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.44 1482 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.44 1489 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |
| iPS.44 1496 | VK4|B3/J K1 | DIVMTQSPDSLAVSLG ERATIKC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.44 1505 | VK4|B3/J K1 | DIVMTQSPDSLAVSLG ERATIKC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.44 1512 | VK4|B3/J K1 | DIVMTQSPDSLAVSLG ERATIKC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.44 1519 | VK4|B3/J K1 | DIVMTQSPDSLAVSLG ERATIKC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.44 1554 | VK4|B3/J K1 | DIVMTQFPDSLAVSLG ERATIKC | KSS QSVLYSSHNNNY LA | WYQQKPGQPPK LLLY | W ASTRES | GVPDRFSGSGSG TEFTLTISSLQAEDVAVY YC | QQYYS TPPT | FGQGTK VEIK |
| iPS.44 1595 | VK4|B3/J K1 | DIVMTQSPDSLAVSLG ERATINC | KSS QSVLYSSHNNNY LA | WYQQKPGQPPK LLLY | W ASTRES | GVPDRFSGSGSG TEFTLTISSLEAEDVAVY YC | QQYYS TPPT | FGQGTK VEIK |

Figure 53 (Continued)

| | | K_FR1 | K_CDR1 | K_FR2 | K_CDR2 | K_FR3 | K_CDR3 | K_FR4 |
|---|---|---|---|---|---|---|---|---|
| iPS:44 1604 | VK4|B3/J K1 | DIVMTQSPDSLAVSLG ERATINC | KSS--- QSVLYSSHNNNY LA | WYQQKPGQPPK LLIY | W-------- ASTRES | GVPDRFSGSGSG--- TEFTLTISSLQAEDVAVY YC | QQYYS----------TPPT | FGQGTK VEIK |
| iPS:44 1613 | VK4|B3/J K1 | DIVMTQSPDSLAVSLG ERATINC | KSS--- QSVLYSSHNNNY LA | WYQQKPGQPPK LLIY | W-------- ASTRES | GVPDRFSGSGSG--- TEFTLTISSLQAEDVAVY YC | QQYYS----------TPPT | FGQGTK VEIK |
| iPS:44 3006 | VK4|B3/J K1 | DIVMTQFPDSLAVSLG ERATIKC | KSS--- QSVLYSSHNNNY LA | WYQQKPGQPPK LLIY | W-------- ASTRES | GVPDRFSGSGSG--- TEFTLTISSLQAEDVAVY YC | QQYYS----------TPPT | FGQGTK VEIK |
| iPS:44 1962 | VK4|B3/J K1 | DIVMTQSPDSLAVSLG ERATINC | KSS--- QSILHSSNNNY LA | WFQQKPGQPPK LLIY | W-------- ASTRES | GVPDRFSGSGSG--- TDFTLTISSLQPEDVAVY YC | QQYYS----------TPVT | FGQGTK VEIK |
| iPS:44 1999 | VK4|B3/J K1 | DIVMTQSPDSLAVSLG ERATINC | KSS--- QSILHSSNNWNY LA | WFQQKPGQPPK LLIY | W-------- ASTRES | GVPDRFSGSGSG--- TDFTLTISSLQPEDVAVY YC | QQYYS----------TPVT | FGQGTK VEIK |
| iPS:44 2006 | VK4|B3/J K1 | DIVMTQSPDSLAVSLG ERATINC | KSS--- QSILHSSNNNY LA | WFQQKPGQPPK LLIY | W-------- ASTRES | GVPDRFSGSGSG--- TDFTLTISSLQPEDVAVY YC | QQYYS----------TPVT | FGQGTK VEIK |
| iPS:44 2020 | VK4|B3/J K1 | DIVMTQSPDSLAVSLG ERATINC | KSS--- QSILHSSNNNY LA | WFQQKPGQPPK LLIY | W-------- ASTRES | GVPDRFSGSGSG--- TDFTLTISSLQPEDVAVY YC | QQYYN----------TPVT | FGPGTK VEIK |
| Germline VK1|L5/J K3 | | DIQMTQSPSSVSASVG DRVTITC | RAS---QGIS ----RWLA | WYQQKPGKAPK LLIY | G-------- ASSLQS | GVPSRFSGSGSG--- TDFTLTISSLQPEDFAIY YC | QQANS----------FPFT | FGPGTK VDIK |
| iPS:39 3954 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2050 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2059 004 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2065 005 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2071 006 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2078 007 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- IDFTLTISSLQPEDFAIY YC | QQANS----------FPFT | FGPGTK VDIK |
| iPS:44 2085 008 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- TDFTLTISSLQPEDFAIY YC | QQANS----------FPFT | FGPGTK VDIK |
| iPS:44 225_4H6. 009 | VK1|L5/J K3 | DIQMTQSPSSVSASVG DRVTITC | RAS---QGIS ----RWLA | WYQQKPGKAPK LLIY | G-------- ASSLQS | GVPSRFSGSGSG--- TDFTLTISSLQPEDFAIY YC | QQANS----------FPFT | FGPGTK VDIK |

Figure 53 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:44 2089 | 21-225_4H6. 010 | VK1|L5/J K3 | DIQMTQSPSSVSASVG DRVTITC | RAS---QGIS------RWLA | WYQQKPGKAPK LLIY | G------ ASSLQS | GVPSRFSGSGSG--- TDFTLTISSLQPEDFAIY YC | QQANS----------------FPFT | FGQGTK VDIK |
| iPS:44 2093 | 21-225_4H6. 011 | VK1|L5/J K3 | DIQMTQSPSSVSASVG DRVTITC | RAS---QGIS------RWLA | WYQQKPGKAPK LLIY | G------ ASSLQS | GVPSRFSGSGSG--- TDFTLTISSLQPEDFATY YC | QQANS----------------FPFT | FGPGTK VDIK |
| iPS:44 3016 | 21-225_4H6. 014 | VK1|L5/J K3 | DIQMTQSPSSVSASVG DRVTITC | RAS---QGIS------RWLA | WYQQKPGKAPK LLIY | G------ ASSLQS | GVPSRFSGSGSG--- TDFTLTISSLQPEDFATY YC | QQANS----------------FPFT | FGPGTK VDIK |
| Germline | VK4|B3J K3 | | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYS----------------TPFT | FGPGTK VDIK |
| iPS:41 2232 | 21-225_4A2 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:42 2894 | 21-225_4A2. 001 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:44 1841 | 21-225_4A2. 001.001 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYS-----------------TPVT | FGPGTK VGIK |
| iPS:44 1847 | 21-225_4A2. 001.002 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------APVT | FGPGTK VGIK |
| iPS:44 1853 | 21-225_4A2. 001.003 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:44 1859 | 21-225_4A2. 001.004 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYQ-----------------TPVT | FGPGTK VGIK |
| iPS:44 1866 | 21-225_4A2. 001.005 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:44 1873 | 21-225_4A2. 001.006 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:44 1880 | 21-225_4A2. 001.007 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYS-----------------TPVT | FGPGTK VGIK |
| iPS:44 1884 | 21-225_4A2. 001.008 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------TPVT | FGPGTK VGIK |
| iPS:44 1888 | 21-225_4A2. 001.009 | VK4|B3/J K3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYN-----------------APVT | FGPGTK VGIK |

Figure 53 (Continued)

| | | K_FR1 | K_CDR1 | K_FR2 | K_CDR2 | K_FR3 | K_CDR3 | K_FR4 |
|---|---|---|---|---|---|---|---|---|
| iPS:44 1892 | VK4\|B3/JK3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYQ--------- ---------TPVT | FGPGTK VGIK |
| iPS:44 1896 | VK4\|B3/JK3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYQ--------- ---------TPVT | FGPGTK VGIK |
| iPS:44 1900 | VK4\|B3/JK3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYQ--------- ---------TPVT | FGPGTK VGIK |
| iPS:44 1955 | VK4\|B3/JK3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYS--------- ---------TPVT | FGPGTK VGIK |
| iPS:44 1971 | VK4\|B3/JK3 | DIVMTQSPDSLAVSLG ERATINC | KSS--- QSILHSSNNNNY LA | WFQQKPGQPPK LLIY | W------ ASTRES | GVPDRFSGSGSG--- TDFTLTISSLQPEDVAVY YC | QQYYS--------- ---------TPVT | FGPGTK VGIK |
| Germline VK1\|A30/JK1 | | DIQMTQSPSSLSASVG DRVTITC | RAS---QGIS ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:39 4041 | VK1\|A30/JK1 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2115 | VK1\|A30/JK1 21-225_5E5.003 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2122 | VK1\|A30/JK1 21-225_5E5.004 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2129 | VK1\|A30/JK1 21-225_5E5.005 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2136 | VK1\|A30/JK1 21-225_5E5.006 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2171 | VK1\|A30/JK1 21-225_5E5.011 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2178 | VK1\|A30/JK1 21-225_5E5.012 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2199 | VK1\|A30/JK1 21-225_5E5.015 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |
| iPS:44 2206 | VK1\|A30/JK1 21-225_5E5.016 | DIQMTQSPSSLSASVG DRVTITC | RAS---QGIR ----NDLG | WYQQKPGKAPK RLIY | A------ ASSLQS | GVPSRFSGSGSG--- TEFTLTISSLQPEDFATY YC | LQHYS--------- ---------YPRT | FGQGTK VEVK |

Figure 53 (Continued)

| | | | | | | | | | |
|---|---|---|---|---|---|---|---|---|---|
| iPS:44 2213 | 21-225_5E5.017 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| iPS:44 2220 | 21-225_5E5.018 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| iPS:44 2227 | 21-225_5E5.019 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| iPS:44 2255 | 21-225_5E5.023 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| iPS:44 2262 | 21-225_5E5.024 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| iPS:44 2269 | 21-225_5E5.025 | VK1\|A30/JK1 | DIQMTQSPSSLSASVG DRVTITC | RAS---QGIR----NDLG | WYQQKPGKAPK RLIY | A-------ASSLQS | GVPSRFSGSGSG---TEFTLTISSLQPEDFATYYC | LQHYS----------YPRT | FGQGTK VEVK |
| Germline | | | K_FR1 | K_CDR1 | K_FR2 | K_CDR2 | K_FR3 | K_CDR3 | K_FR4 |
| | VK1\|O12/JK4 | | DIQMTQSPSSLSASVG DRVTITC | RAS---QSIS----SYLN | WYQQKPGKAPK LLIY | T-------ASSLQS | GVPSRFSGSGSG---TDFTLTISSLQPEDFATYYC | QQTYS----------TPLT | FGGGTK VEIK |
| iPS:39 3930 | 21-225_7E11.001 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---TDFTLTISSLQPEDFAIYYC | QQTYS----------TPLT | FGGGTK VEIK |
| iPS:42 4460 | 21-225_7E11.001 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---IDFTLTISSLQPEDFAIYYC | QQTYS----------TPLT | FGGGTK VEIK |
| iPS:44 2311 | 21-225_7E11.001.001 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---IDFTLTISSLQPEDFAIYYC | QQTYS----------TPLT | FGGGTK VEIK |
| iPS:44 2317 | 21-225_7E11.001.002 | VK1\|O12/JK4 | DIQMTQSPSSLSASVG DRVTIAC | RAS---QNII---SYLN | WYQQKPGKAPK LLIY | T-------ASSLQS | GVPSRFSGSGSG---IDFTLTISSLQPEDFAIYYC | QQTYS----------TPLT | FGGGTK VEIK |
| iPS:44 2323 | 21-225_7E11.001.003 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---IDFTLTISSLQPEDFAIYYC | QQTYS----------TPLT | FGGGTK VEIK |
| iPS:44 2330 | 21-225_7E11.001.004 | VK1\|O12/JK4 | DIQMTQSPSSLSASVG DRVTIAC | RAS---QNII---SYLN | WYQQKPGKAPK FLIY | T-------ASSLQS | GVPSRFSGSGSG---IDFTLTISSLQPEDFAIYYC | QQTYS----------TPLT | FGGGTK VEIK |
| iPS:44 2337 | 21-225_7E11.001.005 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---TDFTLTISSLQPEDFAIYYC | QQTYS----------TPLT | FGGGTK VEIK |
| iPS:44 2344 | 21-225_7E11.001.006 | VK1\|O12/JK4 | DIQMTQSPSSLSASVG DRVTIAC | RAS---QNII----SYLN | WYQQKPGKAPK FLIY | T-------ASSLQS | GVPSRFSGSGSG---TDFTLTISSLQPEDFAIYYC | QQTYS----------TPLT | FGGGTK VEIK |

Figure 53 (Continued)

| | | | | | | | | | |
|---|---|---|---|---|---|---|---|---|---|
| iPS:44 2351 | 21-225_7E11 .001.007 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2358 | 21-225_7E11 .001.008 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2365 | 21-225_7E11 .001.009 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2372 | 21-225_7E11 .001.010 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2379 | 21-225_7E11 .001.011 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2386 | 21-225_7E11 .001.012 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2390 | 21-225_7E11 .001.013 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2394 | 21-225_7E11 .001.014 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2398 | 21-225_7E11 .001.015 | VK1\|O12/ JK4 | DIQMTQSPSSLSASVG DRVTIAC | RAS--QNII----SYLN | WYQQKPGKAPK LLIY | T------ASSLQS | GVPSRFSGSGSG--TDFTLTISSLQPEDFAIY YC | QQTYS-------------TPLT | FGGGTK VEIK |
| iPS:44 2402 | 21-225_7E11 .001.016 | VK1\|O12/ JK4 | DIQMTQSPSSLSASVG DRVTIAC | RAS--QNII----SYLN | WYQQKPGKAPK LLIY | T------ASSLQS | GVPSRFSGSGSG--TDFTLTISSLQPEDFAIY YC | QQTYS-------------TPLT | FGGGTK VEIK |
| iPS:44 2406 | 21-225_7E11 .001.017 | VK1\|O12/ JK4 | DIQMTQSPSSLSASVG DRVTIAC | RAS--QNII----SYLN | WYQQKPGKAPK LLIY | T------ASSLQS | GVPSRFSGSGSG--TDFTLTISSLQPEDFAIY YC | QQTYS-------------TPLT | FGGGTK VEIK |
| iPS:44 2410 | 21-225_7E11 .001.018 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2417 | 21-225_7E11 .001.019 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2431 | 21-225_7E11 .001.021 | VK1\|O12/ JK4 | DIQMTQSPSSLSASVG DRVTIAC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |
| iPS:44 2438 | 21-225_7E11 .001.022 | VK1\|O12/ JK4 | DIQMTQSPSSLSASVG DRVTIIC | RAS--QNII----SYLN | WYQQKPGKAPK FLIY | T------ASSLQS | GVPSRFSGSGSG--TDFTLTISSLQPEDFAIY YC | QQTYS-------------TPLT | FGGGTK VEIK |

Figure 53 (Continued)

| | | DIQMTQSPSSLSASVG DRVTIAC | RAS--QNII-----SYLN | WCQKPGKAPK FLIY | T------ASSLQS | GVPSRFSGSGSG-TDFTLTISSLQPEDFAIY YC | QQIYS----------TPLT | FGGGTK VEIK |
|---|---|---|---|---|---|---|---|---|
| iPS:44 3027 | 21-225_7E11 .001_023 | VK1|O12/ JK4 | | | | | | |
| HEAVY_VARIABLE | | H_FR1 | H_CDR1 | H_FR2 | H_CDR2 | H_FR3 | H_CDR3 | H_FR4 |
| | Germline | | | | | | | |
| | VH1|1-08/D6|6-19|RF1/J H4 | QVQLVQS-GAEVKKPGASVKVSCK ASG-YTFT | S------YDIN | WVRQATGQGLE WMG | WMNPN-----SGNTGYAQK FQG | RVTMTRNTSISTAYMELS SLRSEDTAVYYCAR | SSGNY----------YFDY | WGQGTL VTVSS |
| iPS:39 2928 | 21-225_25A4 .001 | VH1|1-08/D6|6-19|RF1/J H4 | QVLLVQS-GAEVKRPGASVKVSCK ASG-YTFT | N------YDIN | WVRQATGQGLE WMG | WMYPN-----SGNTGYAQK FQG | RVTMTRNTSISTAYMELS SLRSEDTAVYYCAS | SSGNY----------YFDY | WGQGTL VTVSS |
| iPS:42 4419 | 21-225_25A4 .001_002 | VH1|1-08/D6|6-19|RF1/J H4 | QVLLVQS-GAEVKRPGASVKVSCK ASG-YTFT | N------YDIN | WVRQATGQGLE WMG | WMYPN-----SGNTGYAQK FQG | RVTMTRDTSISTAYMELS SLRSEDTAVYYCAS | SSGNY----------YFDY | WGQGTL VTVSS |
| iPS:44 1468 | 21-225_25A4 .001_001 | VH1|1-08/D6|6-19|RF1/J H4 | QVLLVQS-GAEVKRPGASVKVSCK ASG-YTFT | N------YDIN | WVRQATGQGLE WMG | WMYPN-----SGSTGYAQK FQG | RVTMTRDTSISTAYMELS SLRSEDTAVYYCAS | SSGNY----------YFDY | WGQGTL VTVSS |
| iPS:44 1475 | 21-225_25A4 .001_003 | VH1|1-08/D6|6-19|RF1/J H4 | QVLLVQS-GAEVKRPGASVKVSCK ASG-YTFT | N------YDIN | WVRQATGQGLE WMG | WMYPN-----SGNAGYAQK FQG | RVTMTRDTSISTAYMELS SLRSEDTAVYYCAS | SSGNY----------YFDY | WGQGTL VTVSS |
| iPS:44 1482 | 21-225_25A4 .001_004 | VH1|1-08/D6|6-19|RF1/J H4 | QVLLVQS-GAEVKRPGASVKVSCK ASG-YTFT | N------YDIN | WVRQATGQGLE WMG | WMYPN-----SGNVGYAQK FQG | RVTMTRDTSISTAYMELS SLRSEDTAVYYCAS | SSGNY----------YFDY | WGQGTL VTVSS |
| iPS:44 1489 | 21-225_25A4 .001_005 | VH1|1-08/D6|6-19|RF1/J H4 | QVLLVQS-GAEVKRPGASVKVSCK ASG-YTFT | N------YDIN | WVRQATGQGLE WMG | WMYPN-----SGQTGYAQK FQG | RVTMTRDTSISTAYMELS SLRSEDTAVYYCAS | SSGNY----------YFDY | WGQGTL VTVSS |
| iPS:44 1496 | 21-225_25A4 .001_006 | VH1|1-08/D6|6-19|RF1/J H4 | QVQLVQS-GAEVKRPGASVKVSCK ASG-YTFT | N------YDIN | WVRQATGQGLE WMG | WMYPN-----SGSTGYAQK FQG | RVTMTRDTSISTAYMELS SLRSEDTAVYYCAS | SSGNY----------YFDY | WGQGTL VTVSS |
| iPS:44 1505 | 21-225_25A4 .001_007 | VH1|1-08/D6|6-19|RF1/J H4 | QVLLVQS-GAEVKRPGASVKVSCK ASG-YTFT | N------YDIN | WVRQATGQGLE WMG | WMYPN-----SGNAGYAQK FQG | RVTMTRDTSISTAYMELS SLRSEDTAVYYCAS | SSGNY----------YFDY | WGQGTL VTVSS |
| iPS:44 1512 | 21-225_25A4 .001_008 | VH1|1-08/D6|6-19|RF1/J H4 | QVQLVQS-GAEVKRPGASVKVSCK ASG-YTFT | N------YDIN | WVRQATGQGLE WMG | WMYPN-----SGNVGYAQK FQG | RVTMTRDTSISTAYMELS SLRSEDTAVYYCAS | SSGNY----------YFDY | WGQGTL VTVSS |

Figure 53 (Continued)

| | | | | | | | | | |
|---|---|---|---|---|---|---|---|---|---|
| iPS:44 1519 | 21-225_25A4 .001.008 | VH1|1-08/D6|6-19|RF1/J H4 | QVQLVQS-GAEVKRPGASVKVSCK ASG-YTFT | N------YDIN | WVRQATGQGLE WMG | WMYPN----SGQTGYAQK FQG | RVTMTRDTSISTAYMELS SLRSEDTAVYYCAS | SSGWY--------YFDY | WGQGTL VTVSS |
| iPS:44 1554 | 21-225_25A4 .001.013 | VH1|1-08/D6|6-19|RF1/J H4 | QVLLVQS-GAEVKRPGASVKVSCK ASG-YTFT | N------YDIN | WVRQATGQGLE WMG | WMYPN----SGSTGYAQK FQG | RVTMTRDTSISTAYMELS SLRSEDTAVYYCAS | SSGWY--------YFDY | WGQGTL VTVSS |
| iPS:44 1595 | 21-225_25A4 .001.019 | VH1|1-08/D6|6-19|RF1/J H4 | QVQLVQS-GAEVKRPGASVKVSCK ASG-YTFT | N------YDIN | WVRQAPGQGLE WMG | WMYPN----SGSTGYAQK FQG | RVTMTRDTSISTAYMELS SLRSEDTAVYYCAS | SSGWY--------YFDY | WGQGTL VTVSS |
| iPS:44 1604 | 21-225_25A4 .001.020 | VH1|1-08/D6|6-19|RF1/J H4 | QVLLVQS-GAEVKRPGASVKVSCK ASG-YTFT | N------YDIN | WVRQAPGQGLE WMG | WMYPN----SGQTGYAQK FQG | RVTMTRDTSISTAYMELS SLRSEDTAVYYCAS | SSGWY--------YFDY | WGQGTL VTVSS |
| iPS:44 1613 | 21-225_25A4 .001.021 | VH1|1-08/D6|6-19|RF1/J H4 | QVQLVQS-GAEVKRPGASVKVSCK ASG-YTFT | N------YDIN | WVRQATGQGLE WMG | WMYPN----SGNAGYAQK FQG | RVTMTRDTSISTAYMELS SLRSEDTAVYYCAS | SSGWY--------YFDY | WGQGTL VTVSS |
| iPS:44 3006 | 21-225_25A4 .001.029 | VH1|1-08/D6|6-19|RF1/J H4 | QVLLVQS-GAEVKRPGASVKVSCK ASG-YTFT | N------YDIN | WVRQATGQGLE WMG | WMYPN----SGQTGYAQK FQG | RVTMTRDTSISTAYMELS SLRSEDTAVYYCAS | SSGWY--------YFDY | WGQGTL VTVSS |
| iPS:41 2232 | 21-225_4A2. 001 | VH1|1-08/D6|6-19|RF1/J H4 | QVQLVQS-GTEVKKPGASVKVSCK ASG-YTFT | N------YDIN | WVRQATGQGLE WMG | WMHPN----SGNTGYAQK FQG | RVTLTRNTSISTAYMELS SLRSEDTAVYYCAS | SSGWY--------YFDY | WGQGTL VTVSS |
| iPS:42 2894 | 21-225_4A2. 001 | VH1|1-08/D6|6-19|RF1/J H4 | QVQLVQS-GTEVKKPGASVKVSCK ASG-YTFT | N------YDIN | WVRQATGQGLE WMG | WMHPN----SGNTGYAQK FQG | RVTLIRDTSISTAYMELS SLRSEDTAVYYCAS | SSGWY--------YFDY | WGQGTL VTVSS |
| iPS:44 1841 | 21-225_4A2. 001.001 | VH1|1-08/D6|6-19|RF1/J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY--------YFDY | WGQGTL VTVSS |
| iPS:44 1847 | 21-225_4A2. 001.002 | VH1|1-08/D6|6-19|RF1/J H4 | QVQLVQS-GTEVKKPGASVKVSCK ASG-YTFT | N------YDIN | WVRQATGQGLE WMG | WMHPN----SGNTGYAQK FQG | RVTLIRDTSISTAYMELS SLRSEDTAVYYCAS | SSGWY--------YFDY | WGQGTL VTVSS |
| iPS:44 1853 | 21-225_4A2. 001.003 | VH1|1-08/D6|6-19|RF1/J H4 | QVQLVQS-GTEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY--------YFDY | WGQGTL VTVSS |
| iPS:44 1859 | 21-225_4A2. 001.004 | VH1|1-08/D6|6-19|RF1/J H4 | QVQLVQS-GTEVKKPGASVKVSCK ASG-YTFT | N------YDIN | WVRQATGQGLE WMG | WMHPN----SGNAGYAQK FQG | RVTLTRDTSISTAYMELS SLRSEDTAVYYCAS | SSGWY--------YFDY | WGQGTL VTVSS |

Figure 53 (Continued)

| | | | | | | | | | |
|---|---|---|---|---|---|---|---|---|---|
| iPS:44 1866 | 21-225_4A2. 001.005 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGSTGYAQK FQG | RVTLTRDTSISTAYMELS SLRSEDTAVYYCAS | SSGWY---------YFDY | WGQGTL VTVSS |
| iPS:44 1873 | 21-225_4A2. 001.006 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGQTGYAQK FQG | RVTLTRDTSISTAYMELS SLRSEDTAVYYCAS | SSGWY---------YFDY | WGQGTL VTVSS |
| iPS:44 1880 | 21-225_4A2. 001.007 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGSTGYAQK FQG | RVTLTRDTSISTAYMELS SLRSEDTAVYYCAS | SSGWY---------YFDY | WGQGTL VTVSS |
| iPS:44 1884 | 21-225_4A2. 001.008 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGNAGYAQK FQG | RVTLTRDTSISTAYMELS SLRSEDTAVYYCAS | SSGWY---------YFDY | WGQGTL VTVSS |
| iPS:44 1888 | 21-225_4A2. 001.009 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGQTGYAQK FQG | RVTLTRDTSISTAYMELS SLRSEDTAVYYCAS | SSGWY---------YFDY | WGQGTL VTVSS |
| iPS:44 1892 | 21-225_4A2. 001.010 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGNAGYAQK FQG | RVTLTRDTSISTAYMELS SLRSEDTAVYYCAS | SSGWY---------YFDY | WGQGTL VTVSS |
| iPS:44 1896 | 21-225_4A2. 001.011 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGQTGYAQK FQG | RVTLTRDTSISTAYMELS SLRSEDTAVYYCAS | SSGWY---------YFDY | WGQGTL VTVSS |
| iPS:44 1900 | 21-225_4A2. 001.012 | VH1\|1-08/D6\|6-19\|RF1/J H4 | QVQLVQS-GTEVKKPGASVKVSCK ASG-YTFT | N------YDIN | WVRQATGQGLE WMG | WMHPN----SGSTGYAQK FQG | RVTLTRDTSISTAYMELS SLRSEDTAVYYCAS | SSGWY---------YFDY | WGQGTL VTVSS |
| iPS:44 1955 | 21-225_4A2. 001.022 | VH1\|1-08/D6\|6-19\|RF1/J H4 | QVQLVQS-GAEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY---------YFDY | WGQGTL VTVSS |
| iPS:44 1962 | 21-225_4A2. 001.023 | VH1\|1-08/D6\|6-19\|RF1/J H4 | QVQLVQS-GAEVKKPGASVKVSCK ASG-YTFT | N------YDIN | WVRQATGQGLE WMG | WMHPN----SGNTGYAQK FQG | RVTLTRDTSISTAYMELS SLRSEDTAVYYCAS | SSGWY---------YFDY | WGQGTL VTVSS |
| iPS:44 1971 | 21-225_4A2. 001.024 | VH1\|1-08/D6\|6-19\|RF1/J H4 | QVQLVQS-GAEVKKPGASVKVSCK ASG-YTFT | N------YDIN | WVRQATGQGLE WMG | WMHPN----SGQIGYAQK FQG | RVTLTRDTSISTAYMELS SLRSEDTAVYYCAS | SSGWY---------YFDY | WGQGTL VTVSS |
| iPS:44 1999 | 21-225_4A2. 001.028 | VH1\|1-08/D6\|6-19\|RF1/J H4 | QVQLVQS-GAEVKKPGASVKVSCK ASG-YTFT | N------YDIN | WVRQAPGQGLE WMG | WMHPN----SGQTGYAQK FQG | RVTLTRDTSISTAYMELS SLRSEDTAVYYCAS | SSGWY---------YFDY | WGQGTL VTVSS |

Figure 53 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:44 2006 | 21-225_4A2. 001.029 | VH1\|1-08/D6\|6-19\|RF1/JH4 | QVQLVQS-GAEVKKPGASVKVSCK ASG-YTFT | N------YDIN | WVRQAPGQGLE WMG | WMHPN------SGGTGYAQK FQG | RVTLTRDTSISTAYMELS SLRSEDTAVYYCAS | SSGWY----------YFDY | WGQGTL VTVSS |
| iPS:44 2020 | 21-225_4A2. 001.031 | VH1\|1-08/D6\|6-19\|RF1/JH4 | QVQLVQS-GGEVKKPGASVKVSCK ASG-YTFT | N------YDIN | WVRQAEGQGLE WMG | WMHPN------SGNEGYAQK FQG | RVTLTRDTSISTAYMELS SLRSEDTAVYYCAS | SSGWY----------YFDY | WGQGTL VTVSS |
| | Germline | VH1\|1-02\|D1\|1-1\|RF1\|JH4 | QVQLVQS-GAEVKKPGASVKVSCK ASG-YTFT | D------YYMH | WVRQAPGQGLE WMG | WIHPN------SGGTNYAQK FQG | RVTMTRDTSISTAYMELS SLRSDDTAVYYCAR | GGTS----------YFDY | WGQGTL VTVSS |
| iPS:39 3954 | 21-225_4H6 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMGLS SLRSDDTAVYYCAR | DGTS----------SFDY | WGQGTL VTVSS |
| iPS:44 2050 | 21-225_4H6. 004 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS----------SFDY | WGQGTL VTVSS |
| iPS:44 2059 | 21-225_4H6. 005 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS----------SFDY | WGQGTL VTVSS |
| iPS:44 2065 | 21-225_4H6. 006 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DGTS----------SFDY | WGQGTL VTVSS |
| iPS:44 2071 | 21-225_4H6. 007 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DATS----------SFDY | WGQGTL VTVSS |
| iPS:44 2078 | 21-225_4H6. 008 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | SGTS----------SFDY | WGQGTL VTVSS |
| iPS:44 2085 | 21-225_4H6. 009 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | SGTS----------SFDY | WGQGTL VTVSS |
| iPS:44 2089 | 21-225_4H6. 010 | VH1\|1-02\|D1\|1-1\|RF1/JH4 | QVQLVQS-GAEVKKPGASVKVSCK ASG-YTFT | D------YYLH | WVRQAPGQGLE WMG | WIHPN------SGGTNYAQK FQG | RVTMTRDTSISTAYMELS SLRSDDTAVYYCAR | DATS----------SFDY | WGQGTL VTVSS |

Figure 53 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:44 2093 | 21-225_4H6. 011 | VH1\|1-02/D1\|1-1\|RF1/JH4 | QVQLVQS-GAEVKKPGASVKVSCK ASG-YTFT | D------YYLH | WVRQAPGQGLE WMG | WIHPN----SGGTNYAQK FQG | RVTMTRDTSISTAYMELS SLRSDDTAVYYCAR | DATS-------------SFDY | WGQGTL VTVSS |
| iPS:44 3016 | 21-225_4H6. 014 | VH1\|1-02/D1\|1-1\|RF1/JH4 | QVQLVQS-GAEVKKPGASVKVSCK ASG-YTFT | D------YYLH | WVRQAPGQGLE WMG | WIHPN----SGGTNYAQK FQG | RVTMTRDTSISTAYMGLS SLRSDDTAVYYCAR | DATS-------------SFDY | WGQGTL VTVSS |
| | Germline | VH3\|3-33/D6\|6-6\|RF1/JH6 | QVQLVES-GGGVVQPGRSLRLSCA ASG-FTFS | S-----YVMH | WVRQAPGKGLE WVA | VIWYD----GSNKYYADS VKG | RFTISRDNSKNTLYLQMN SLRAEDTAVYYCTR | EVYSSGY-------YYGMDV | WGQGTT VTVSS |
| | | | H_FR1 | H_CDR1 | H_FR2 | H_CDR2 | H_FR3 | H_CDR3 | H_FR4 |
| iPS:39 4041 | 21-225_5E5. | VH3\|3-33/D6\|6-6\|RF1/JH6 | QVQLVES-GGGVVQPGRSLRLSCA ASG-FTFS | N------YVMH | WVRQAPGKGLE WVA | VIWYD----GSNKYYADS VKG | RFTISRDNSKNTLYLQMN SLRAEDTAVYYCTR | EVYSSGW-------YDYGMDV | WGQGTT VTVSS |
| iPS:44 2115 | 21-225_5E5. 003 | VH3\|3-33/D6\|6-6\|RF1/JH6 | QVQLVES-GGGVVQPGRSLRLSCA ASG-FTFS | N------YVMH | WVRQAPGKGLE WVA | VIWYD----ASNKYYADS VKG | RFTISRDNSKNTLYLQMN SLRAEDTAVYYCTR | EVYSSGW-------YDYGMDV | WGQGTT VTVSS |
| iPS:44 2122 | 21-225_5E5. 004 | VH3\|3-33/D6\|6-6\|RF1/JH6 | QVQLVES-GGGVVQPGRSLRLSCA ASG-FTFS | N------YVMH | WVRQAPGKGLE WVA | VIWYD----GSNKYYAES VKG | RFTISRDNSKNTLYLQMN SLRAEDTAVYYCTR | EVYSSGW-------YDYGMDV | WGQGTT VTVSS |
| iPS:44 2129 | 21-225_5E5. 005 | VH3\|3-33/D6\|6-6\|RF1/JH6 | QVQLVES-GGGVVQPGRSLRLSCA ASG-FTFS | N------YVMH | WVRQAPGKGLE WVA | VIWYD----GSNKYYAGS VKG | RFTISRDNSKNTLYLQMN SLRAEDTAVYYCTR | EVYSSGW-------YDYGMDV | WGQGTT VTVSS |
| iPS:44 2136 | 21-225_5E5. 006 | VH3\|3-33/D6\|6-6\|RF1/JH6 | QVQLVES-GGGVVQPGRSLRLSCA ASG-FTFS | N------YVMH | WVRQAPGKGLE WVA | VIWYD----GSNKYYADA VKG | RFTISRDNSKNTLYLQMN SLRAEDTAVYYCTR | EVYSSGW-------YDYGMDV | WGQGTT VTVSS |
| iPS:44 2171 | 21-225_5E5. 011 | VH3\|3-33/D6\|6-6\|RF1/JH6 | QVQLVES-GGGVVQPGRSLRLSCA ASG-FTFS | N------YVMH | WVRQAPGKGLE WVA | VIWYD----GSNKYYAES VKG | RFTISRDNSKNTLYLQMN SLRAEDTAVYYCTR | EVYSSGW-------YDYGMDV | WGQGTT VTVSS |
| iPS:44 2178 | 21-225_5E5. 012 | VH3\|3-33/D6\|6-6\|RF1/JH6 | QVQLVES-GGGVVQPGRSLRLSCA ASG-FTFS | N------YVMH | WVRQAPGKGLE WVA | VIWYD----ASNKYYADA VKG | RFTISRDNSKNTLYLQMN SLRAEDTAVYYCTR | EVYSSGW-------YDYGMDV | WGQGTT VTVSS |
| iPS:44 2199 | 21-225_5E5. 015 | VH3\|3-33/D6\|6-6\|RF1/JH6 | QVQLVES-GGGVVQPGRSLRLSCA ASG-FTFS | N------YVMH | WVRQAPGKGLE WVA | VIWYD----ASNKYYADS VKG | RFTISRDNSKNTLYLQMN SLRAEDTAVYYCTR | EVYSSGY-------YDYGMDV | WGQGTT VTVSS |

Figure 53 (Continued)

| | | H_FR1 | H_CDR1 | H_FR2 | H_CDR2 | H_FR3 | H_CDR3 | H_FR4 |
|---|---|---|---|---|---|---|---|---|
| iPS:44 2206 | 21-225_5E5.016 | VH3J3-33/D6|6-6|RF1/JH6 | QVQLVES-GGGVVQPGRSLRLSCA ASG-FTFS | N------YVMH | WVRQAPGKGLE WVA | VIWYD-----ASNKYYADS VKG | RFTISRDNSKNTLYLQMN SLRAEDTAVYYCTR | EVYSSGF-------YDYGMDV | WGQGTT VTVSS |
| iPS:44 2213 | 21-225_5E5.017 | VH3J3-33/D6|6-6|RF1/JH6 | QVQLVES-GGGVVQPGRSLRLSCA ASG-FTFS | N------YVMH | WVRQAPGKGLE WVA | VIWYD-----GSNKYYAES VKG | RFTISRDNSKNTLYLQMN SLRAEDTAVYYCTR | EVYSSGY-------YDYGMDV | WGQGTT VTVSS |
| iPS:44 2220 | 21-225_5E5.018 | VH3J3-33/D6|6-6|RF1/JH6 | QVQLVES-GGGVVQPGRSLRLSCA ASG-FTFS | N------YVMH | WVRQAPGKGLE WVA | VIWYD-----GSNKYYADS VKG | RFTISRDNSKNTLYLQMN SLRAEDTAVYYCTR | EVYSSGY-------YDYGMDV | WGQGTT VTVSS |
| iPS:44 2227 | 21-225_5E5.019 | VH3J3-33/D6|6-6|RF1/JH6 | QVQLVES-GGGVVQPGRSLRLSCA ASG-FTFS | N------YVMH | WVRQAPGKGLE WVA | VIWYD-----GSNKYYADS VKG | RFTISRDNSKNTLYLQMN SLRAEDTAVYYCTR | EVYSSGF-------YDYGMDV | WGQGTT VTVSS |
| iPS:44 2255 | 21-225_5E5.023 | VH3J3-33/D6|6-6|RF1/JH6 | QVQLVES-GGGVVQPGRSLRLSCA ASG-FTFS | N------YVMH | WVRQAPGKGLE WVA | VIWYD-----ASNKYYAES VKG | RFTISRDNSKNTLYLQMN SLRAEDTAVYYCTR | EVYSSGY-------YDYGMDV | WGQGTT VTVSS |
| iPS:44 2262 | 21-225_5E5.024 | VH3J3-33/D6|6-6|RF1/JH6 | QVQLVES-GGGVVQPGRSLRLSCA ASG-FTFS | N------YVMH | WVRQAPGKGLE WVA | VIWYD-----ASNKYYADA VKG | RFTISRDNSKNTLYLQMN SLRAEDTAVYYCTR | EVYSSGY-------YDYGMDV | WGQGTT VTVSS |
| VH3J3-07/D6|6-6|RF1/JH6 | Germline | EVQLVES-GGGVVQPGGSLRLSCA ASG-FTFS | S------YVMH | WVRQAPGKGLE WVA | VIWYD-----GSNKYYADS VKG | RFTISRDNAKNTLYLQMN SLRAEDTAVYYCAR | EVYSSYY-------YYGMDV | WGQGTT VTVSS |
| iPS:44 2269 | 21-225_5E5.025 | VH3J3-07/D6|6-6|RF1/JH6 | EVQLVES-GGGVVQPGGSLRLSCA ASG-FTFS | N------YVMH | WVRQAPGKGLE WVA | VIWYD-----GSNKYYAES VKG | RFTISRDNAKNTLYLQMN SLRAEDTAVYYCTR | EVYSSGW-------YDYGMDV | WGQGTT VTVSS |
| VH3J3-33/D4|4-11|RF2/JH6 | Germline | QVQLVES-GGGVVQPGRSLRLSCA ASG-FTFS | S------FGMH | WVRQAPGKGLE WVA | IIWHD-----GSNKYYADS VKG | RFTISRDNSNNTLYLQMN SLRAEDTAVYYCAR | DLSYYY-------YYGMDV | WGQGTT VTVSS |
| iPS:39 3930 | 21-225_7E11.001 | VH3J3-33/D4|4-11|RF2/JH6 | QVQLVES-GGGVVQPGRSLRLSCA ASG-FTFS | S------FGMH | WVRQAPGKGLE WVA | IIWHD-----GSNKYYADS VKG | RFTISRDNSNNTLYLQMS SLRAEDTAVYYCAR | DLSMG-------GMDV | WGQGTT VTVSS |
| iPS:42 4460 | 21-225_7E11.001 | VH3J3-33/D4|4-11|RF2/JH6 | QVQLVES-GGGVVQPGRSLRLSCA ASG-FTFS | S------FGMH | WVRQAPGKGLE WVA | IIWHD-----GSNKYYADS VKG | RFTISRDNSKNTLYLQMS SLRAEDTAVYYCAR | DLSMG-------GMDV | WGQGTT VTVSS |

Figure 53 (Continued)

| | | | | | | | | |
|---|---|---|---|---|---|---|---|---|
| iPS:44 2311 | 21- 225_7E11 .001.001 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- GSNKYYADS VKG | RFTISRDNSKNTLYLQMS SLRAEDTAVYYCAR | DLSMG--------- -------GMDV | WGQGTT VTVSS |
| iPS:44 2317 | 21- 225_7E11 .001.002 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- GSNKYYADS VKG | RFTISRDNSKNTLYLQMS SLRAEDTAVYYCAR | DLSMG--------- -------GMDV | WGQGTT VTVSS |
| iPS:44 2323 | 21- 225_7E11 .001.003 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHS---- GSNKYYADS VKG | RFTISRDNSKNTLYLQMS SLRAEDTAVYYCAR | DLSMG--------- -------GMDV | WGQGTT VTVSS |
| iPS:44 2330 | 21- 225_7E11 .001.004 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- GSNKYYADS VKG | RFTISRDNSKNTLYLQMS SLRAEDTAVYYCAR | DLSMG--------- -------GMDV | WGQGTT VTVSS |
| iPS:44 2337 | 21- 225_7E11 .001.005 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- ASNKYYADS VKG | RFTISRDNSKNTLYLQMS SLRAEDTAVYYCAR | DLSMG--------- -------GMDV | WGQGTT VTVSS |
| iPS:44 2344 | 21- 225_7E11 .001.006 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- GSNKYYAES VKG | RFTISRDNSKNTLYLQMS SLRAEDTAVYYCAR | DLSMG--------- -------GMDV | WGQGTT VTVSS |
| iPS:44 2351 | 21- 225_7E11 .001.007 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHD---- GSNKYYADA VKG | RFTISRDNSKNTLYLQMS SLRAEDTAVYYCAR | DLSMG--------- -------GMDV | WGQGTT VTVSS |
| iPS:44 2358 | 21- 225_7E11 .001.008 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHE---- GSNKYYADA VKG | RFTISRDNSKNTLYLQMS SLRAEDTAVYYCAR | DLSMG--------- -------GMDV | WGQGTT VTVSS |
| iPS:44 2365 | 21- 225_7E11 .001.009 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHE---- GSNKYYAES VKG | RFTISRDNSKNTLYLQMS SLRAEDTAVYYCAR | DLSMG--------- -------GMDV | WGQGTT VTVSS |
| iPS:44 2372 | 21- 225_7E11 .001.010 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHS---- GSNKYYAES VKG | RFTISRDNSKNTLYLQMS SLRAEDTAVYYCAR | DLSMG--------- -------GMDV | WGQGTT VTVSS |
| iPS:44 2379 | 21- 225_7E11 .001.011 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHS---- GSNKYYADA VKG | RFTISRDNSKNTLYLQMS SLRAEDTAVYYCAR | DLSMG--------- -------GMDV | WGQGTT VTVSS |
| iPS:44 2386 | 21- 225_7E11 .001.012 | VH3\|3- 33\|D4\|4- 11\|RF2\|J H6 | QVQLVES- GGGVVQPGRSLRLSCA ASG-FTFS | S------FGMH | WVRQAPGKGLE WVA | IIWHS---- GSNKYYADS VKG | RFTISRDNSKNTLYLQMS SLRAEDTAVYYCAR | DLSMG--------- -------GMDV | WGQGTT VTVSS |

Figure 53 (Continued)

| | | | H_FR1 | H_CDR1 | H_FR2 | H_CDR2 | H_FR3 | H_CDR3 | H_FR4 |
|---|---|---|---|---|---|---|---|---|---|
| iPS:44 2390 | 21-225_7E11 .001_013 | VH3|3-33/D4|4-11|RF2|J H6 | QVQLVES-GGGVVQPGRSLRLSCA ASG-FTFS | S------FGMH | WVRQAPGKGLE WVA | IIWHD---GSNKYYAES VKG | RFTISRDNSKNTLYLQMS SLRAEDTAVYYCAR | DLSMG------GMDV | WGQGTT VTVSS |
| iPS:44 2394 | 21-225_7E11 .001_014 | VH3|3-33/D4|4-11|RF2|J H6 | QVQLVES-GGGVVQPGRSLRLSCA ASG-FTFS | S------FGMH | WVRQAPGKGLE WVA | IIWHS---GSNKYYAES VKG | RFTISRDNSKNTLYLQMS SLRAEDTAVYYCAR | DLSMG------GMDV | WGQGTT VTVSS |
| iPS:44 2398 | 21-225_7E11 .001_015 | VH3|3-33/D4|4-11|RF2|J H6 | QVQLVES-GGGVVQPGRSLRLSCA ASG-FTFS | S------FGMH | WVRQAPGKGLE WVA | IIWHS---GSNKYYADS VKG | RFTISRDNSKNTLYLQMS SLRAEDTAVYYCAR | DLSMG------GMDV | WGQGTT VTVSS |
| iPS:44 2402 | 21-225_7E11 .001_016 | VH3|3-33/D4|4-11|RF2|J H6 | QVQLVES-GGGVVQPGRSLRLSCA ASG-FTFS | S------FGMH | WVRQAPGKGLE WVA | IIWHE---GSNKYYAES VKG | RFTISRDNSKNTLYLQMS SLRAEDTAVYYCAR | DLSMG------GMDV | WGQGTT VTVSS |
| iPS:44 2406 | 21-225_7E11 .001_017 | VH3|3-33/D4|4-11|RF2|J H6 | QVQLVES-GGGVVQPGRSLRLSCA ASG-FTFS | S------FGMH | WVRQAPGKGLE WVA | IIWHE---GSNKYYADA VKG | RFTISRDNSKNTLYLQMS SLRAEDTAVYYCAR | DLSMG------GMDV | WGQGTT VTVSS |
| iPS:44 2410 | 21-225_7E11 .001_018 | VH3|3-33/D4|4-11|RF2|J H6 | QVQLVES-GGGVVQPGRSLRLSCA ASG-FTFS | S------FGMH | WVRQAPGKGLE WVA | IIWHS---ASNKYYAES VKG | RFTISRDNSKNTLYLQMS SLRAEDTAVYYCAR | DLSMG------GMDV | WGQGTT VTVSS |
| iPS:44 3027 | 21-225_7E11 .001_023 | VH3|3-33/D4|4-11|RF2|J H6 | QVQLVES-GGGVVQPGRSLRLSCA ASG-FTFS | S------FGMH | WVRQAPGKGLE WVA | IIWHD---ASNKYYADA VKG | RFTISRDNSKNTLYLQMS SLRAEDTAVYYCAR | DLSMG------GMDV | WGQGTT VTVSS |
| | Germline | | H_FR1 | H_CDR1 | H_FR2 | H_CDR2 | H_FR3 | H_CDR3 | H_FR4 |
| | VH3|3-07/D4|4-11|RF2|J H6 | | EVQLVES-GGGVVQPGGSLRLSCA ASG-FTFS | S------YGMS | WVRQAPGKGLE WVA | NIKQ---GSNKYYVDS VKG | RFTISRDNAKNTLYLQMN SLRAEDTAVYYCAR | DYSNYYY------DYYGMDV | WGQGTT VTVSS |
| iPS:44 2417 | 21-225_7E11 .001_019 | VH3|3-07/D4|4-11|RF2|J H6 | EVQLVES-GGGVVQPGGSLRLSCA ASG-FTFS | S------FGMH | WVRQAPGKGLE WVA | IIWHD---GSNKYYAES VKG | RFTISRDNAKNTLYLQMS SLRAEDTAVYYCAR | DLSMG------GMDV | WGQGTT VTVSS |
| iPS:44 2431 | 21-225_7E11 .001_021 | VH3|3-07/D4|4-11|RF2|J H6 | EVQLVES-GGGVVQPGGSLRLSCA ASG-FTFS | S------FGMH | WVRQAPGKGLE WVA | IIWHS---GSNKYYAES VKG | RFTISRDNAKNTLYLQMS SLRAEDTAVYYCAR | DLSMG------GMDV | WGQGTT VTVSS |
| iPS:44 2438 | 21-225_7E11 .001_022 | VH3|3-07/D4|4-11|RF2|J H6 | EVQLVES-GGGVVQPGGSLRLSCA ASG-FTFS | S------FGMH | WVRQAPGKGLE WVA | IIWHE---GSNKYYAES VKG | RFTISRDNAKNTLYLQMS SLRAEDTAVYYCAR | DLSMG------GMDV | WGQGTT VTVSS |

Figure 54 (Table 7)
Standard IgG Antibody Variable Region Consensus Protein Alignment
CDRs defined by Kabat
Alignment numbering defined by Amgen Reference (AHo)

| KAPPA_VARIABLE | Germline | K_FR1 | K_CDR1 | K_FR2 | K_CDR2 | K_FR3 | K_CDR3 | K_FR4 |
|---|---|---|---|---|---|---|---|---|
| VK4|B3/J K1 | | DIVM..QSPDSLAVSLGERATINC | KSS..QSVLYSSNNKNYLA | WYQQKPGQPPK..LLIY | WASTRES | GVPDRFSGSGSGTDFTLTISSLQAEDVAVYYC | QQYYS...TPYT | FGQGTKVEIK |
| iPS:39 2928 | 21-225_25A 4 | VK4|B3/J K1 | | | | | | |
| iPS:42 4419 | 21-225_25A 4.001 | VK4|B3/J K1 | ....F........K. | ....N........ | ....L..... | | .........E.......... | .........P.... | |
| iPS:44 1468 | 21-225_25A 4.001.001 | VK4|B3/J K1 | ....F........K. | ....N........ | ....L..... | | .........E.......E.. | .........P.... | |
| iPS:44 1475 | 21-225_25A 4.001.002 | VK4|B3/J K1 | ....F........K. | ....N........ | ....L..... | | ..................E.. | .........P.... | |
| iPS:44 1482 | 21-225_25A 4.001.003 | VK4|B3/J K1 | ....F........K. | ....N........ | ....L..... | | .........E.......E.. | .........P.... | |
| iPS:44 1489 | 21-225_25A 4.001.004 | VK4|B3/J K1 | ....F........K. | ....N........ | ....L..... | | .........E.......E.. | .........P.... | |
| iPS:44 1496 | 21-225_25A 4.001.005 | VK4|B3/J K1 | .............K. | ....N........ | ....L..... | | .........E.......E.. | .........P.... | |
| iPS:44 1505 | 21-225_25A 4.001.006 | VK4|B3/J K1 | .............K. | ....N........ | ....L..... | | .................E.. | .........P.... | |
| iPS:44 1512 | 21-225_25A 4.001.007 | VK4|B3/J K1 | .............K. | ....N........ | ....L..... | | .................E.. | .........P.... | |
| iPS:44 1519 | 21-225_25A 4.001.008 | VK4|B3/J K1 | .............K. | ....N........ | ....L..... | | .................E.. | .........P.... | |
| iPS:44 1554 | 21-225_25A 4.001.013 | VK4|B3/J K1 | ....F........K. | ....N........ | ....L..... | | .........E.......E.. | .........P.... | |
| iPS:44 1595 | 21-225_25A 4.001.019 | VK4|B3/J K1 | .............. | ....N........ | ....L..... | | .................E.. | .........P.... | |

Figure 54 (Continued)

| | | K_FR1 | K_CDR1 | K_FR2 | K_CDR2 | K_FR3 | K_CDR3 | K_FR4 |
|---|---|---|---|---|---|---|---|---|
| Germline | VK1|L5/J K3 | DIQMTQSPSSLSA SVGDRVTITC | RAS-QSIS -SYLA | WYQQKPGKAPK LLIY | AASLQS | GVPSRFSGSGS GTDFTLTISSLQPEDFAT YYC | QQANS FPT | FGQGTKV EIK |
| iPS:44 1604 | 21- 225_25A 4.001.020 | VK4|B3/J K1 | ......................... | ...N.... | ...........L.. | .......... | ............................... | .P.... | .... |
| iPS:44 1613 | 21- 225_25A 4.001.021 | VK4|B3/J K1 | ......................... | ...N.... | ...........L.. | .......... | ............................... | .P.... | .... |
| iPS:44 3006 | 21- 225_25A 4.001.029 | VK4|B3/J K1 | .......F................. | ...N.K.. | ...........L.. | .......... | ............................E.. | .P.... | .... |
| iPS:44 1962 | 21- 225_4A2. 001.023 | VK4|B3/J K1 | ......................... | ...N.I.H... | .F.........L.. | .......... | .......P.................... | .....V. | .... |
| iPS:44 1999 | 21- 225_4A2. 001.028 | VK4|B3/J K1 | ......................... | ...N.I.H... | .F.........L.. | .......... | .......P.................... | .....V. | .... |
| iPS:44 2006 | 21- 225_4A2. 001.029 | VK4|B3/J K1 | ......................... | ...N.I.H... | .F.........L.. | .......... | .......P.................... | .....V. | .... |
| iPS:44 2020 | 21- 225_4A2. 001.031 | VK4|B3/J K1 | ......................... | ...N.I.H... | .F.........L.. | .......... | ............................. | .N.... | .P.... |
| iPS:39 3954 | 21- 225_4H6 004 | VK1|L5/J K3 | ......................... | .R...... | .............. | .G........ | ............I................. | ....... | .... |
| iPS:44 2050 | 21- 225_4H6. 005 | VK1|L5/J K3 | ......................... | .R...... | .............. | .G........ | ............I................. | ....... | .... |
| iPS:44 2059 | 21- 225_4H6. 006 | VK1|L5/J K3 | ......................... | .R...... | .............. | .G........ | ............I................. | ....... | .Q.... |
| iPS:44 2065 | 21- 225_4H6. 007 | VK1|L5/J K3 | ......................... | .R...... | .............. | .G........ | ............I................. | ....... | .... |
| iPS:44 2071 | 21- 225_4H6. 008 | VK1|L5/J K3 | ......................... | .R...... | .............. | .G........ | ............I................. | ....... | .Q.... |
| iPS:44 2078 | 21- 225_4H6. 008 | VK1|L5/J K3 | ......................... | .R...... | .............. | .G........ | ............................. | ....... | .... |
| iPS:44 2085 | 21- 225_4H6. 009 | VK1|L5/J K3 | ......................... | .R...... | .............. | .G........ | ............I................. | ....... | .Q.... |

Figure 54 (Continued)

| | | | K_FR1 | K_CDR1 | K_FR2 | K_CDR2 | K_FR3 | K_CDR3 | K_FR4 |
|---|---|---|---|---|---|---|---|---|---|
| iPS:44 2089 | 21-225_4H6. 010 | VK1\|L5\|JK3 | .......... | ..R... | .......... | .......... | .......... | .........I..... | ........Q........ |
| iPS:44 2093 | 21-225_4H6. 011 | VK1\|L5\|JK3 | .......... | ..R... | .......... | G........ | .......... | ............... | ........Q........ |
| iPS:44 3016 | 21-225_4H6. 014 | VK1\|L5\|JK3 | .......... | ..R... | .......... | G........ | .......... | ............... | ................. |
| Germline | VK4\|B3\|JK3 | | DIVMTQSPDSLAVSLGERATINC | KSSQSVLYSSNNKNYLA | WYQQKPGQPPKLLIY | WASTRES | GVPDRFSGSGSGTDFTLTISSLQAEDVAVYYC | QQYYS-----TPPT | FGQGTKVEIK |
| iPS:41 2232 | 21-225_4A2. 001 | VK4\|B3\|JK3 | .......... | .N... | .F.. .L | .......... | ...........P...... | ....N....V... | ............G... |
| iPS:42 2894 | 21-225_4A2. 001.001 | VK4\|B3\|JK3 | .......... | .N...I.H... | .F.. .L | .......... | ...........P...... | ....N....V... | ............G... |
| iPS:44 1841 | 21-225_4A2. 001.002 | VK4\|B3\|JK3 | .......... | .N...I.H... | .F.. .L | .......... | ...........P...... | ....N....V... | ............G... |
| iPS:44 1847 | 21-225_4A2. 001.003 | VK4\|B3\|JK3 | .......... | .N...I.H... | .F.. .L | .......... | ...........P...... | ....N...A.V... | ............G... |
| iPS:44 1853 | 21-225_4A2. 001.004 | VK4\|B3\|JK3 | .......... | .N...I.H... | .F.. .L | .......... | ...........P...... | ....Q....V... | ............G... |
| iPS:44 1859 | 21-225_4A2. 001.005 | VK4\|B3\|JK3 | .......... | .N...I.H... | .F.. .L | .......... | ...........P...... | ....N....V... | ............G... |
| iPS:44 1866 | 21-225_4A2. 001.006 | VK4\|B3\|JK3 | .......... | .N...I.H... | .F.. .L | .......... | ...........P...... | .........V... | ............G... |
| iPS:44 1873 | 21-225_4A2. 001.007 | VK4\|B3\|JK3 | .......... | .N...I.H... | .F.. .L | .......... | ...........P...... | ....N....V... | ............G... |
| iPS:44 1880 | 21-225_4A2. 001.008 | VK4\|B3\|JK3 | .......... | .N...I.H... | .F.. .L | .......... | ...........P...... | .........V... | ............G... |
| iPS:44 1884 | 21-225_4A2. 001.009 | VK4\|B3\|JK3 | .......... | .N...I.H... | .F.. .L | .......... | ...........P...... | ....N...A.V... | ............G... |
| iPS:44 1888 | | | | | | | | | |

Figure 54 (Continued)

| | | K_FR1 | K_CDR1 | K_FR2 | K_CDR2 | K_FR3 | K_CDR3 | K_FR4 |
|---|---|---|---|---|---|---|---|---|
| iPS:44 1892 | VK4|B3/J K3 | | ....... | .F..... .L. | | | ....Q...... | .G.. |
| iPS:44 1896 | VK4|B3/J K3 | | .N..I.H.. | .F..... .L. | | | ....Q.....V. | .G.. |
| iPS:44 1900 | VK4|B3/J K3 | | .N..I.H.. | .F..... .L. | | | ....Q.....V. | .G.. |
| iPS:44 1955 | VK4|B3/J K3 | | .N..I.H.. | .F..... .L. | | .P........ | ....Q.....V. | .G.. |
| iPS:44 1971 | VK4|B3/J K3 | | .N..I.H.. | .F..... .L. | | .P........ | ..........V. | .G.. |
| Germline VK1|A30/ JK1 | | DIQMTQSPSSLSA SVGDRVTITC | RAS QDIS NDLN | WYQQKPGKAPKL LIY | AASSL QS | GVPSRFSGSGS GTDFTLTISSLQPEDFAT YYC | QQNS YPWT | FGQGTKV EIK |
| iPS:39 4041 | VK1|A30/ JK1 | | | | | | ....Y.....R. | ...V. |
| iPS:44 2115 | VK1|A30/ JK1 | | | | | | ....Y.....R. | ...V. |
| iPS:44 2122 | VK1|A30/ JK1 | | | | | | ....Y.....R. | ...V. |
| iPS:44 2129 | VK1|A30/ JK1 | | | | | | ....Y.....R. | ...V. |
| iPS:44 2136 | VK1|A30/ JK1 | | | | | | ....Y.....R. | ...V. |
| iPS:44 2171 | VK1|A30/ JK1 | | | | | | ....Y.....R. | ...V. |
| iPS:44 2178 | VK1|A30/ JK1 | | | | | | ....Y.....R. | ...V. |
| iPS:44 2199 | VK1|A30/ JK1 | | | | | | ....Y.....R. | ...V. |
| iPS:44 2206 | VK1|A30/ JK1 | | | | | | ....Y.....R. | ...V. |

Figure 54 (Continued)

| | | K_FR1 | K_CDR1 | K_FR2 | K_CDR2 | K_FR3 | K_CDR3 | K_FR4 |
|---|---|---|---|---|---|---|---|---|
| iPS:44 2213 | 21- 225_5E5. 017 | VK1|A30/ JK1 | | | | | | Y | R | V |
| iPS:44 2220 | 21- 225_5E5. 018 | VK1|A30/ JK1 | | | | | | Y | R | V |
| iPS:44 2227 | 21- 225_5E5. 019 | VK1|A30/ JK1 | | | | | | Y | R | V |
| iPS:44 2255 | 21- 225_5E5. 023 | VK1|A30/ JK1 | | | | | | Y | R | V |
| iPS:44 2262 | 21- 225_5E5. 024 | VK1|A30/ JK1 | | | | | | Y | R | V |
| iPS:44 2269 | 21- 225_5E5. 025 | VK1|A30/ JK1 | | | | | | Y | R | V |
| | Germline | K_FR1 | K_CDR1 | K_FR2 | K_CDR2 | K_FR3 | K_CDR3 | K_FR4 |
| | VK1|O12/ JK4 | DIQMTQSPSSLSA SVGDRVTITC | RAS_QSIS SYLN | WYQQKPGKAPK LLIY | AASSLQS | GVPSRFSGSGS GTDFTLTISSLQPEDFATY YC | QQSYSTP | FGQGTK VEIK |
| iPS:39 3930 | 21- 225_7E1 1 | VK1|O12/ JK4 | A | N.I | F | T | I | T | |
| iPS:42 4460 | 21- 225_7E1 1.001 | VK1|O12/ JK4 | A | N.I | F | T | I | T | |
| iPS:44 2311 | 21- 225_7E1 1.001.001 | VK1|O12/ JK4 | A | N.I | F | T | I | T | |
| iPS:44 2317 | 21- 225_7E1 1.001.002 | VK1|O12/ JK4 | A | N.I | F | T | I | T | |
| iPS:44 2323 | 21- 225_7E1 1.001.003 | VK1|O12/ JK4 | A | N.I | F | T | I | T | |
| iPS:44 2330 | 21- 225_7E1 1.001.004 | VK1|O12/ JK4 | A | N.I | F | T | I | T | |
| iPS:44 2337 | 21- 225_7E1 1.001.005 | VK1|O12/ JK4 | A | N.I | F | T | I | T | |
| iPS:44 2344 | 21- 225_7E1 1.001.006 | VK1|O12/ JK4 | A | N.I | F | T | I | T | |

Figure 54 (Continued)

| | | | | | | | | |
|---|---|---|---|---|---|---|---|---|
| iPS:44-2351 | 21-225_7E1 1.001.007 | VK1\|O12/JK4 | . . . | . . . | . . . | . . . | . . . | . . . |
| iPS:44-2358 | 21-225_7E1 1.001.008 | VK1\|O12/JK4 | . . . A . | . . . F . | . . . F . | . . . | . . . T . | . . . |
| iPS:44-2365 | 21-225_7E1 1.001.009 | VK1\|O12/JK4 | . . . A . | . . . F . | . . . F . | . . . I . | . . . T . | . . . |
| iPS:44-2372 | 21-225_7E1 1.001.010 | VK1\|O12/JK4 | . . . A . | . . . F . | . . . F . | . . . I . | . . . T . | . . . |
| iPS:44-2379 | 21-225_7E1 1.001.011 | VK1\|O12/JK4 | . . . A . | . . . F . | . . . F . | . . . I . | . . . T . | . . . |
| iPS:44-2386 | 21-225_7E1 1.001.012 | VK1\|O12/JK4 | . . . | . . N . I . | . . . F . | . . . I . | . . . T . | . . . |
| iPS:44-2390 | 21-225_7E1 1.001.013 | VK1\|O12/JK4 | . . . | . . N . I . | . . . F . | . . . I . | . . . T . | . . . |
| iPS:44-2394 | 21-225_7E1 1.001.014 | VK1\|O12/JK4 | . . . | . . N . I . | . . . F . | . . . I . | . . . T . | . . . |
| iPS:44-2398 | 21-225_7E1 1.001.015 | VK1\|O12/JK4 | . . . | . . N . I . | . . . F . | . . . I . | . . . T . | . . . |
| iPS:44-2402 | 21-225_7E1 1.001.016 | VK1\|O12/JK4 | . . . | . . N . I . | . . . | . . . I . | . . . T . | . . . |
| iPS:44-2406 | 21-225_7E1 1.001.017 | VK1\|O12/JK4 | . . . | . . N . I . | . . . F . | . . . I . | . . . T . | . . . |
| iPS:44-2410 | 21-225_7E1 1.001.018 | VK1\|O12/JK4 | . . . | . . N . I . | . . . F . | . . . I . | . . . T . | . . . |
| iPS:44-2417 | 21-225_7E1 1.001.019 | VK1\|O12/JK4 | . . . A . | . . . F . | . . . F . | . . . I . | . . . T . | . . . |
| iPS:44-2431 | 21-225_7E1 1.001.021 | VK1\|O12/JK4 | . . . A . | . . . F . | . . . F . | . . . I . | . . . T . | . . . |
| iPS:44-2438 | 21-225_7E1 1.001.022 | VK1\|O12/JK4 | . . . | . . . F . | . . . F . | . . . I . | . . . T . | . . . |

Figure 54 (Continued)

| | iPS:44 3027 | 21-225_7E1 1.001.023 | VK1O12/JK4 | ......... | .........A. | ........M.I...... | .......F...... | ......T...... | .........I...... | .........T... | | |
|---|---|---|---|---|---|---|---|---|---|---|---|---|

| HEAVY_VARIABLE | | | Germline | H_FR1 | H_CDR1 | H_FR2 | H_CDR2 | H_FR3 | H_CDR3 | H_FR4 |
|---|---|---|---|---|---|---|---|---|---|---|
| | VH1|1-08/D6|6-19|RF1/JH4 | | | QVQLVQS GAEVKKPGASVKV SCKASG-YTFT | S-------YIH | WVRQAPGQGLE WMG | SGNTGYAQKF QG | RVTFTRDTSIDTA SLESTGYMELSR | CSSGWY-----YFDY | WGQGTLV TVSS |
| iPS:39 2928 | 21-225_25A 4 | VH1|1-08/D6|6-19|RF1/JH4 | | .L. .......... R.............. | M.......... | | ..Y.... | | SSGWY- | .... |
| iPS:42 4419 | 21-225_25A 4.001 | VH1|1-08/D6|6-19|RF1/JH4 | | .L. .......... R.............. | N.......... | | ..Y.... | | SSGWY- S | .... |
| iPS:44 1468 | 21-225_25A 4.001.001 | VH1|1-08/D6|6-19|RF1/JH4 | | .L. .......... R.............. | N.......... | | ..Y.... S | ....D...... | SSGWY- S | .... |
| iPS:44 1475 | 21-225_25A 4.001.002 | VH1|1-08/D6|6-19|RF1/JH4 | | .L. .......... R.............. | N.......... | | ..Y.... A | ....D...... | SSGWY- S | .... |
| iPS:44 1482 | 21-225_25A 4.001.003 | VH1|1-08/D6|6-19|RF1/JH4 | | .L. .......... R.............. | N.......... | | ..Y.... V | ....D...... | SSGWY- S | .... |
| iPS:44 1489 | 21-225_25A 4.001.004 | VH1|1-08/D6|6-19|RF1/JH4 | | .L. .......... R.............. | N.......... | | ..Y.... Q | ....D...... | SSGWY- S | .... |
| iPS:44 1496 | 21-225_25A 4.001.005 | VH1|1-08/D6|6-19|RF1/JH4 | | .L. .......... R.............. | N.......... | | ..Y.... S | ....D...... | SSGWY- S | .... |
| iPS:44 1505 | 21-225_25A 4.001.006 | VH1|1-08/D6|6-19|RF1/JH4 | | .L. .......... R.............. | N.......... | | ..Y.... A | ....D...... | SSGWY- S | .... |
| iPS:44 1512 | 21-225_25A 4.001.007 | VH1|1-08/D6|6-19|RF1/JH4 | | .L. .......... R.............. | N.......... | | ..Y.... V | ....D...... | SSGWY- S | .... |

Figure 54 (Continued)

| | | | | | | | | |
|---|---|---|---|---|---|---|---|---|
| iPS:44-1519 | 21-225_25A 4.001.008 | VH1|1-08|D6|6-19|RF1/J H4 | | | | Y...... | .D........ S | SSGWY-...... |
| iPS:44-1554 | 21-225_25A 4.001.013 | VH1|1-08|D6|6-19|RF1/J H4 | .L. R. | | N...... | .Y...... Q. | .D........ S | SSGWY-...... |
| iPS:44-1595 | 21-225_25A 4.001.019 | VH1|1-08|D6|6-19|RF1/J H4 | R. | | N...... | .Y...... S. P...... | .D........ S | SSGWY-...... |
| iPS:44-1604 | 21-225_25A 4.001.020 | VH1|1-08|D6|6-19|RF1/J H4 | .L. R. | | N...... | .Y...... S. P...... | .D........ S | SSGWY-...... |
| iPS:44-1613 | 21-225_25A 4.001.021 | VH1|1-08|D6|6-19|RF1/J H4 | R. | | N...... | .Y...... Q. | .D........ S | SSGWY-...... |
| iPS:44-3006 | 21-225_25A 4.001.029 | VH1|1-08|D6|6-19|RF1/J H4 | .L. R. | | N...... | .Y...... A. | .D........ S | SSGWY-...... |
| iPS:41-2232 | 21-225_4A2 | VH1|1-08|D6|6-19|RF1/J H4 | | | N...... | .Y...... Q. | .L.D........ S | SSGWY-...... |
| iPS:42-2894 | 21-225_4A2 001 | VH1|1-08|D6|6-19|RF1/J H4 | T. | | | .H...... | .L.D........ S | SSGWY-...... |
| iPS:44-1841 | 21-225_4A2 001.001 | VH1|1-08|D6|6-19|RF1/J H4 | T. | | | .H...... | .L.D........ S | SSGWY-...... |
| iPS:44-1847 | 21-225_4A2 001.002 | VH1|1-08|D6|6-19|RF1/J H4 | T. | | | .H...... | .L.D........ S | SSGWY-...... |
| iPS:44-1853 | 21-225_4A2 001.003 | VH1|1-08|D6|6-19|RF1/J H4 | T. | | | .H...... | .L.D........ S | SSGWY-...... |
| iPS:44-1859 | 21-225_4A2 001.004 | VH1|1-08|D6|6-19|RF1/J H4 | T. | | N...... | .H...... A. | .L.D........ S | SSGWY-...... |

Figure 54 (Continued)

| | | | | | | | | | |
|---|---|---|---|---|---|---|---|---|---|
| iPS:44 1866 | VH1|1-08|D6|6-19|RF1/J H4 | 21-225_4A2. 001.005 | .....T........ | N........... | ............... | .H....... | ....L..D....... | ........S | SSGWY- | ... |
| iPS:44 1873 | VH1|1-08|D6|6-19|RF1/J H4 | 21-225_4A2. 001.006 | .....T........ | ........... | ............... | .H....... S | ....L..D....... | ........S | SSGWY- | ... |
| iPS:44 1880 | VH1|1-08|D6|6-19|RF1/J H4 | 21-225_4A2. 001.007 | .....T........ | N........... | ............... | .H....... Q | ....L..D....... | ........S | SSGWY- | ... |
| iPS:44 1884 | VH1|1-08|D6|6-19|RF1/J H4 | 21-225_4A2. 001.008 | .....T........ | N........... | ............... | .H....... Q | ....L..D....... | ........S | SSGWY- | ... |
| iPS:44 1888 | VH1|1-08|D6|6-19|RF1/J H4 | 21-225_4A2. 001.009 | .....T........ | N........... | ............... | .H....... A | ....L..D....... | ........S | SSGWY- | ... |
| iPS:44 1892 | VH1|1-08|D6|6-19|RF1/J H4 | 21-225_4A2. 001.010 | .....T........ | N........... | ............... | .H....... Q | ....L..D....... | ........S | SSGWY- | ... |
| iPS:44 1896 | VH1|1-08|D6|6-19|RF1/J H4 | 21-225_4A2. 001.011 | .....T........ | N........... | ............... | .H....... A | ....L..D....... | ........S | SSGWY- | ... |
| iPS:44 1900 | VH1|1-08|D6|6-19|RF1/J H4 | 21-225_4A2. 001.012 | .....T........ | N........... | ............... | .H....... Q | ....L..D....... | ........S | SSGWY- | ... |
| iPS:44 1955 | VH1|1-08|D6|6-19|RF1/J H4 | 21-225_4A2. 001.022 | ............ | ........... | ......P....... | .H....... S | ....L..D....... | ........S | SSGWY- | ... |
| iPS:44 1962 | VH1|1-08|D6|6-19|RF1/J H4 | 21-225_4A2. 001.023 | ............ | N........... | ......P....... | .H....... O | ....L..D....... | ........S | SSGWY- | ... |
| iPS:44 1971 | VH1|1-08|D6|6-19|RF1/J H4 | 21-225_4A2. 001.024 | ............ | N........... | ............... | .H....... O | ....L..D....... | ........S | SSGWY- | ... |
| iPS:44 1999 | VH1|1-08|D6|6-19|RF1/J H4 | 21-225_4A2. 001.028 | ............ | ........... | ............... | .H....... Q | ....L..D....... | ........S | SSGWY- | ... |

Figure 54 (Continued)

| | | H FR1 | H CDR1 | H FR2 | H CDR2 | H FR3 | H CDR3 | H FR4 |
|---|---|---|---|---|---|---|---|---|
| iPS:44 2006 | VH1|1-08|D6|6-19|RF1/J H4 | .................................... | N....... | ......F.......... | .....H........ | ........L..D................ | SSGWY-..... | ........... |
| iPS:44 2020 | VH1|1-08|D6|6-19|RF1/J H4 | ...........G........................ | N....... | ......E.......... | .....H.....S.. | ........L..D................ | SSGWY-..... | ........... |
| | Germline | H FR1 QVQLVQS-GAEVKKPGASVKV SCKASG-YTFT | H CDR1 G-------YMH | H FR2 WVRQAPGQGLEWMG WMG | H CDR2 WINPNSGGTNYAQK FQG | H FR3 RVTMTRDTSISTAYMEL SRLRSDDTAVYYCAR | H CDR3 GTTGT -------YFDY | H FR4 WGQGTLV TVSS |
| iPS:39 3954 | VH1|1-02|D1|1-1|RF1|JH 4 | .................................... | D.......L | .................. | .....H........ | ...............S............ | DG.S-..... | .....S..... |
| iPS:44 2050 | VH1|1-02|D1|1-1|RF1|JH 4 | .................................... | D.......L | .................. | .....H........ | ...............S............ | DG.S-..... | .....S..... |
| iPS:44 2059 | VH1|1-02|D1|1-1|RF1|JH 4 | .................................... | D.......L | .................. | .....H........ | ...............S............ | DG.S-..... | .....S..... |
| iPS:44 2065 | VH1|1-02|D1|1-1|RF1|JH 4 | .................................... | D.......L | .................. | .....H........ | ...............S............ | DG.S-..... | .....S..... |
| iPS:44 2071 | VH1|1-02|D1|1-1|RF1|JH 4 | .................................... | D.......L | .................. | .....H........ | ...............S............ | DA.S-..... | .....S..... |
| iPS:44 2078 | VH1|1-02|D1|1-1|RF1|JH 4 | .................................... | D.......L | .................. | .....H........ | ...............S............ | SG.S-..... | .....S..... |
| iPS:44 2085 | VH1|1-02|D1|1-1|RF1|JH 4 | .................................... | D.......L | .................. | .....H........ | ...............S............ | SG.S-..... | .....S..... |
| iPS:44 2089 | VH1|1-02|D1|1-1|RF1|JH 4 | .................................... | D.......L | .................. | .....H........ | ...............S............ | DA.S-..... | .....S..... |

Figure 54 (Continued)

| | | H FR1 | H CDR1 | H FR2 | H CDR2 | H FR3 | H CDR3 | H FR4 |
|---|---|---|---|---|---|---|---|---|
| iPS:44 2093 | 21- 225_4H6. 011 | VH1|1- 02|D1|1- 1|RF1|JH 4 | | D...... | | ....H....... | | ........S... | DA.S- | |
| iPS:44 3016 | 21- 225_4H6. 014 | VH1|1- 02|D1|1- 1|RF1|JH 4 | | D...... | | ....H....... | | ........S... | DA.S- ...S | |
| | Germline | VH3|3- 33|D6|6- 6|RF1|JH 6 | QVQLVES- GGGVQPGGSLR LSCAASGFTFS | S------DMH | WVRQAPGKGLE WVA | SGNTAEDSV- IHYD- KG | RFTISRDNSKNTLYLQM NSLRAEDTAVYYCAR | EYSSSSYY- YYGMDV | WGQGTTV TVSS |
| iPS:39 4041 | 21- 225_5E5 | VH3|3- 33|D6|6- 6|RF1|JH 6 | | N......V... | | ............ | | ........T... | .VY..GW- ...... | |
| iPS:44 2115 | 21- 225_5E5. 003 | VH3|3- 33|D6|6- 6|RF1|JH 6 | | N......V... | | ..........A. | | ........T... | .VY..GW- ........D. | |
| iPS:44 2122 | 21- 225_5E5. 004 | VH3|3- 33|D6|6- 6|RF1|JH 6 | | N......V... | | .....E...... | | ........T... | .VY..GW- ........D. | |
| iPS:44 2129 | 21- 225_5E5. 005 | VH3|3- 33|D6|6- 6|RF1|JH 6 | | N......V... | | .....G....A. | | ........T... | .VY..GW- ........D. | |
| iPS:44 2136 | 21- 225_5E5. 006 | VH3|3- 33|D6|6- 6|RF1|JH 6 | | N......V... | | ..........A. | | ........T... | .VY..GW- ........D. | |
| iPS:44 2171 | 21- 225_5E5. 011 | VH3|3- 33|D6|6- 6|RF1|JH 6 | | N......V... | | .....E....A. | | ........T... | .VY..GW- ........D. | |
| iPS:44 2178 | 21- 225_5E5. 012 | VH3|3- 33|D6|6- 6|RF1|JH 6 | | N......V... | | ..........A. | | ........T... | .VY..GW- ........D. | |
| iPS:44 2199 | 21- 225_5E5. 015 | VH3|3- 33|D6|6- 6|RF1|JH 6 | | N......V... | | ..........A. | | ........T... | .VY..G.- ........D. | |

Figure 54 (Continued)

| | | H_FR1 | H_CDR1 | H_FR2 | H_CDR2 | H_FR3 | H_CDR3 | H_FR4 |
|---|---|---|---|---|---|---|---|---|
| iPS.44-2206 | 21-225_5E5.016 | VH3]3-33/D6[6-6]RF1/JH6 | ........... | N......V.. | ........... | ......A... | ........T... | VY..GF- ..........D. | ....... |
| iPS.44-2213 | 21-225_5E5.017 | VH3]3-33/D6[6-6]RF1/JH6 | ........... | N......V.. | ........... | ......E... | ........T... | VY..G..- ..........D. | ....... |
| iPS.44-2220 | 21-225_5E5.018 | VH3]3-33/D6[6-6]RF1/JH6 | ........... | N......V.. | ........... | ........... | ........T... | VY..GF- ..........D. | ....... |
| iPS.44-2227 | 21-225_5E5.019 | VH3]3-33/D6[6-6]RF1/JH6 | ........... | N......V.. | ........... | ........... | ........T... | VY..G..- ..........D. | ....... |
| iPS.44-2255 | 21-225_5E5.023 | VH3]3-33/D6[6-6]RF1/JH6 | ........... | N......V.. | ........... | ......A... ......E... | ........T... | VY..G..- ..........D. | ....... |
| iPS.44-2262 | 21-225_5E5.024 | VH3]3-33/D6[6-6]RF1/JH6 | ........... | N......V.. | ........... | ......A... | ........T... | VY..G..- ..........D. | ....... |
| Germline | VH3]3-07/D6[6-6]RF1/JH6 | H_FR1 EVQLVES-GGGVQPGRSLR LSCAASG-FTFS | H_CDR1 S......YGMH | H_FR2 WVRQAPGKGLE WVA | H_CDR2 GSFKYYVDSV KG | H_FR3 RFTISRDNAKNSLYLQM NSLRAEDTAVYYCAR | H_CDR3 DYSGSYY YYYGMDV | H_FR4 WGQGTTV TVSS |
| iPS.44-2269 | 21-225_5E5.025 | VH3]3-07/D6[6-6]RF1/JH6 | ........V.. | N......V.H | ........... | V..WY... N...AE... | ..........T... | VY..GW- ..........D. | ....... |
| Germline | VH3]3-33/D4[4-11]RF2/JH6 | H_FR1 EVQLVES-GGGVQPGRSLR LSCAASG-FTFS | H_CDR1 S......YGMH | H_FR2 WVRQAPGKGLE WVA | H_CDR2 GSMRYADSV KG | H_FR3 RFTISRDNSKNTLYLQM NSLRAEDTAVYYCAR | H_CDR3 DYSNYYY YYYGMDV | H_FR4 WGQGTTV TVSS |
| iPS.39-3930 | 21-225_7E1.1 | VH3]3-33/D4[4-11]RF2/JH6 | ........... | ........F.. | ........... | I..H...... | ........N... .......S.. | L..MG-- | ....... |
| iPS.42-4460 | 21-225_7E1.1.001 | VH3]3-33/D4[4-11]RF2/JH6 | ........... | ........F.. | ........... | I..H...... | .......S.. | L..MG-- | ....... |

Figure 54 (Continued)

| | | | | | | | |
|---|---|---|---|---|---|---|---|
| iPS:44-2311 | VH3\|3-33\|D4\|4-11\|RF2\|JH6 | | F... | | I..H..... | ...S... | .L..MG--- |
| iPS:44-2317 | VH3\|3-33\|D4\|4-11\|RF2\|JH6 | | F... | | I..H..... | ...S... | .L..MG--- |
| iPS:44-2323 | VH3\|3-33\|D4\|4-11\|RF2\|JH6 | | F... | | I..HS.... | ...S... | .L..MG--- |
| iPS:44-2330 | VH3\|3-33\|D4\|4-11\|RF2\|JH6 | | F... | | I..HE.... | ...S... | .L..MG--- |
| iPS:44-2337 | VH3\|3-33\|D4\|4-11\|RF2\|JH6 | | F... | | I..H...A. | ...S... | .L..MG--- |
| iPS:44-2344 | VH3\|3-33\|D4\|4-11\|RF2\|JH6 | | F... | | I..H..E.. | ...S... | .L..MG--- |
| iPS:44-2351 | VH3\|3-33\|D4\|4-11\|RF2\|JH6 | | F... | | I..H...A. | ...S... | .L..MG--- |
| iPS:44-2358 | VH3\|3-33\|D4\|4-11\|RF2\|JH6 | | F... | | I..HE..A. | ...S... | .L..MG--- |
| iPS:44-2365 | VH3\|3-33\|D4\|4-11\|RF2\|JH6 | | F... | | I..HE..E. | ...S... | .L..MG--- |
| iPS:44-2372 | VH3\|3-33\|D4\|4-11\|RF2\|JH6 | | F... | | I..HS..E. | ...S... | .L..MG--- |
| iPS:44-2379 | VH3\|3-33\|D4\|4-11\|RF2\|JH6 | | F... | | I..HS..A. | ...S... | .L..MG--- |
| iPS:44-2386 | VH3\|3-33\|D4\|4-11\|RF2\|JH6 | | F... | | I..HS.... | ...S... | .L..MG--- |

Figure 54 (Continued)

| | | H_FR1 | H_CDR1 | H_FR2 | H_CDR2 | H_FR3 | H_CDR3 | H_FR4 |
|---|---|---|---|---|---|---|---|---|
| Germline | VH3j3-07|D4|4-11|RF2/J H6 | EVQLVES GGGLVQPGGSLRL SCAASG-FTFS | YWMS | WVRQAPGKGLE WVA | NIKQDGSEKYYVDSV KG | RFTISRDNAKNSLYLQM NSLRAEDTAVYYCAR | DSNYY------YYYGMDV | WGQGTTV TVSS |
| iPS:44 2390 | 21-225_7E1 1.001.013 | VH3j3-33|D4|4-11|RF2/J H6 | ........... ................... ............ | ...F. | ................... ... | I..H....... .....E..... | ..................S .................... .T | .L.MG--- ---...... | ................ .... |
| iPS:44 2394 | 21-225_7E1 1.001.014 | VH3j3-33|D4|4-11|RF2/J H6 | ........... ................... ............ | ...F. | ................... ... | I..HS...... .....E..... | ..................S .................... .T | .L.MG--- ---...... | ................ .... |
| iPS:44 2398 | 21-225_7E1 1.001.015 | VH3j3-33|D4|4-11|RF2/J H6 | ........... ................... ............ | ...F. | ................... ... | I..HS...... .....E..... | ..................S .................... .T | .L.MG--- ---...... | ................ .... |
| iPS:44 2402 | 21-225_7E1 1.001.016 | VH3j3-33|D4|4-11|RF2/J H6 | ........... ................... ............ | ...F. | ................... ... | I..HS...... .....E..... | ..................S .................... .T | .L.MG--- ---...... | ................ .... |
| iPS:44 2406 | 21-225_7E1 1.001.017 | VH3j3-33|D4|4-11|RF2/J H6 | ........... ................... ............ | ...F. | ................... ... | I..HE...A.. .....E..... | ..................S .................... .T | .L.MG--- ---...... | ................ .... |
| iPS:44 2410 | 21-225_7E1 1.001.018 | VH3j3-33|D4|4-11|RF2/J H6 | ........... ................... ............ | ...F. | ................... ... | I..H....A.. .....E..... | ..................S .................... .T | .L.MG--- ---...... | ................ .... |
| iPS:44 3027 | 21-225_7E1 1.001.023 | VH3j3-33|D4|4-11|RF2/J H6 | ........... ................... ............ | ...F. | ................... ... | I..H....A.. .....E..... | ..................S .................... .T | .L.MG--- ---...... | ................ .... |
| iPS:44 2417 | 21-225_7E1 1.001.019 | VH3j3-07|D4|4-11|RF2/J H6 | ........V.. ................... ............ | ...FG.H | ................... ... | I..WH...... N....AE..... | ..................S .................... .T | .L.MG--- ---...... | ................ .... |
| iPS:44 2431 | 21-225_7E1 1.001.021 | VH3j3-07|D4|4-11|RF2/J H6 | ........V.. ................... ............ | ...FG.H | ................... ... | I..WHS..... N....AE..... | ..................S .................... .T | .L.MG--- ---...... | ................ .... |
| iPS:44 2438 | 21-225_7E1 1.001.022 | VH3j3-07|D4|4-11|RF2/J H6 | ........V.. ................... ............ | ...FG.H | ................... ... | I..WHE..... N....AE..... | ..................S .................... .T | .L.MG--- ---...... | ................ .... |

FIGURE 55

Table 19A

VARIABLE HEAVY CHAIN CONSENSUS SEQUENCES

| NAME (ORIGINAL AND PATENT) | Patent SEQ ID NO: | SEQUENCE |
|---|---|---|
| VH-Consensus 1 (Table 21) (generated from 13 heavy chain sequences) | SEQ ID NO: 50352 | QVQLVQSGAEVKKPGASVKVSCKASGYTFTDYYMH WVRQAPGQGLEWMGWINPNGGGTNYAQKFQGRVT MTRDTSISTAYMELSRLRSDDTAVYYYCARDGTGSFD YWGQGTLVTVSS |
| VH-Consensus 2 (Table 22) (generated from 11 heavy chain sequences) | SEQ ID NO: 50353 | QVQLVQSGAEVKKPGASVKVSCKASGYTFTGYYMH WVRQAPGQGLEWMGWINPNSGGTNYAQKFQGRVT MTRDTSISTAYMELSRLRSDDTAVYYCARSYYYGSG SYYNEFDYWGQGTLVTVSS |
| VH-Consensus 3 (Table 23) (generated from 15 heavy chain sequences) | SEQ ID NO: 50354 | QVQLVQSGAEVKKPGASVKVSCKASGYTFTNYDIN WVRQATGQGLEWMGWMHPNSGNTGYAQKFQGRV TMTFRNTSISTAYMELSSLRSEDTAVYYCASSSGWYY FDYWGQGTLVTVSS |
| VH-Consensus 4 (Table 24) (generated from 23 heavy chain sequences) | SEQ ID NO: 50355 | EVQLVESGGGLVKPGGSLRLSCAASGFTFSSYSMNW VRQAPGKGLEWVSSISGSSSYIYYADSVKGRFTISRD NAKNSLYLQMNSLRAEDTAVYYCARVASFDYWGQ GTLVTVSS |
| VH-Consensus 5 | SEQ ID NO: 50356 | EVQLVESGGGLVKPGGSLRLSCAASGFTFSSYSMNW VRQAPGKGLEWVSSISGSSSYIYYADSVKGRFTISRD NAKNSLYLQMNSLRAEDTAVYYCARDRGSLWGQQ TLVTVSS |
| VH-Consensus 6 (Table 26) (generated from 11 heavy chain sequences) | SEQ ID NO: 50357 | EVQLLESGGGLVQPGGSLRLSCAASGFTFSSYYMNW VRQAPGKGLEWVSAISGSGGSTYYADSVKGRFTISR DNSKNTLYLQMNSLRAEDTAVYYCARTIGVFDYWG QGTLVTVSS |
| VH-Consensus 7 (Table 27) (generated from 30 heavy chain sequences) | SEQ ID NO: 50358 | EVQLLESGGGLVQPGGSLRLSCAASGFTFSSYAMSW VRQAPGKGLEWVSAISGRGGSTFHADSVKGRFTISR DNSKNTLYLQMNSLRAEDTAVYYCVKGELLEDYYP YGMDVWGQGTTVTVSS |
| VH-Consensus 8 (Table 28) (generated from 25 heavy chain sequences) | SEQ ID NO: 50359 | EVQLLESGGGLVQPGGSLRLSCAASEFTFSSYAMYW VRQAPGKGLEWVSVISGRGGNITYADSVKGRFTISR DNSKNTLYLQMNSLRAEDTAVYYCASRLAVAGSEA EDIWGQGTMVTVSS |
| VH-Consensus 9 (Table 29) (generated from 14 heavy chain sequences) | SEQ ID NO: 50360 | QVQLVESGGGVVQPGRSLRLSCAASGFTFSSYGMH WVRQAPGKGLEWVAVIWYDGSNKYYADSVKGRFT ISRDNSKNTLYLQMNSLRAEDTAVYYCARDLSMGG MDVWGQGTTVTVSS |

FIGURE 55 (Continued)

| | SEQ ID NO: | |
|---|---|---|
| VH-Consensus 10 (Table 30) (generated from 22 heavy chain sequences) | SEQ ID NO: 50361 | QVQLVESGGGVVQPGRSLRLSCAASGFTFSSYVMH WVRQAPGKGLEWVAVIWYDGSNKYYADSVKGRFT ISRDNSKNTLYLQMNSLRAEDTAVYYCAREKYSSS WYDYGMDVWGQGTTVTVSS |
| VH-Consensus 11 (Table 31) (generated from 16 heavy chain sequences) | SEQ ID NO: 50362 | QVQLVESGGGVVQPGRSLRLSCAASGFTFSDYGMH WVRQAPGKGLEWVAVIWYDESNKYYADSVKGRFTI SRDNSKNTLYLQMNSLRAEDTAVYYCAREHGWLDD YWGQGTLVTVSS |
| VH-Consensus 12 (Table 32) (generated from 71 heavy chain sequences) | SEQ ID NO: 50363 | QVQLVESGGGVVQPGRSLRLSCAASGFTFSDYGMH WVRQAPGKGLEWVAVIWYDENNKYYADSVKGRFT ISRDNSKNTLYLQMNSLRAEDTAVYYCARELGFRSD YWGQGTLVTVSS |
| VH-Consensus 13 (Table 33) (generated from 21 heavy chain sequences) | SEQ ID NO: 50364 | QLQLQESGPGLVKPSETLSLTCTVSGGSISRSSYYWG WIRQPPGKGLEWIGNIYYSGSTYYNPSLKSRVTISVD TSKNQFSLKLSSVTAADTAVYYCARHSSSWSLDYW GQGTLVTVSS |
| VH-Consensus 14 (Table 34) (generated from 13 heavy chain sequences) | SEQ ID NO: 50365 | QLQLQESGPGLVKPSETLSLTCTVSGGSISRSSYYWG WIRQPPGKGLEWIGNIYYSGSTYYNPSLKSRVTISVD TSKNQFSLKLSSVTAADTAVYYCGRHGKDWGLDY WGQGTLVTVSS |
| VH-Consensus 15 (Table 49) (generated from 149 heavy chain sequences) | SEQ ID NO: 50266 | QVQLVQS-GAEVKKPGASVKVSCKASG-YTFTN--- YDINWVRQATGQGLEWMGWMHPN--- SGNTGYAQKFQGRVTMTRNTSISTAYMELSSLRSED TAVYYCASSSGWY--- YFDYWGQGTLVTVSS |
| VH-Consensus 16 (Table 50) (generated from 128 heavy chain sequences) | SEQ ID NO: 50267 | QVQLVES-GGGVVQPGRSLRLSCAASG-FTFSS--- YVMHWVRQAPGKGLEWVAVIWYD--- GSNKYYADSVKGRFTISRDNSKNTLYLQMNSLRAED TAVYYCARERYSSGW--- YDYGMDVWGQGTTVTVSS |
| VH-Consensus 17 (Table 51) (generated from 117 heavy chain sequences) | SEQ ID NO: 50268 | QVQLVES-GGGVVQPGRSLRLSCAASG-FTFSD--- YGMHWVRQAPGKGLEWVAVIWYD--- ENNKYYADSVKGRFTISRDNSKNTLYLQMNSLRAE DTAVYYCARELGF--- SDYWGQGTLVTVSS |
| VH-Consensus 18 (Table 52) (generated from 91 heavy chain sequences) | SEQ ID NO: 50269 | QVQLQQW-GAGLLKPSETLSLTCAVHG-GSFSG--- CYWSWIRQPPGKGLEWIGEINH--- SGSTNYNPSLKSRVTISVDTSKNQFSLKLSSVTAADT AVYYCARDYGG--- MDVWGQGTTVTVSS |

FIGURE 55
(Continued)

| | SEQ ID NO: | |
|---|---|---|
| VH-Consensus 19 (Table 53) (generated from 74 heavy chain sequences) | SEQ ID NO: 50270 | QVQLVQS-GAEVKKPGASVKVSCKASG-YTFTN--- YDINWVRQATGQGLEWMGWMHPN--- SGNTGYAQKFQGRVTMTRNTSISTAYMELSSLRSED TAVYYCAHSSGWY--- WFDFWGQGTLVTVSS |
| VH-Consensus 20 (Table 54) (generated from 53 heavy chain sequences) | SEQ ID NO: 50271 | QVQLVES-GGGVVQPGRSLRLSCAASG-FTFSS--- YGMHWVRQAPGKGLEWVAVIWYD--- GSNKYYADSVKGRFTISRDNSKNTLYLQMNSLRAED TAVYYCARDQGYGY--- YGLDYWGQGTTVTVSS |
| VH-Consensus 21 (Table 55) (generated from 52 heavy chain sequences) | SEQ ID NO: 50272 | QVQLVQS-GAEVKKPGASVKVSCKASG-YTFTG--- YYMHWVRQAPGQGLEWMGWINPN--- SGGTNYAQKFQGRVTMTRDTSISTAYMELSRLRSDD TAVYYCARDGTS--- SFDYWGQGTLVTVSS |
| VH-Consensus 22 (Table 56) (generated from 49 heavy chain sequences) | SEQ ID NO: 50273 | QVQLVES-GGGVVQPGRSLRLSCAASG-FTFSS--- YGMHWVRQAPGKGLEWVAVIWHD--- GSNKYYADSVKGRFTISRDNSKNTLYLQMNSLRAED TAVYYCARDLSMG--- GMDYWGQGTTVTVSS |
| VH-Consensus 23 (Table 57) (generated from 37 heavy chain sequences) | SEQ ID NO: 50274 | QVQLVES-GGGVVQPGRSLRLSCAASG-FTFSD--- YGMHWVRQAPGKGLEWVAVIWYD--- ESNKYYADSVKGRFTISRDNSKNTLYLQMNSLRAED TAVYYCAREVGW--- LDDYWGQGTLVTVSS |
| VH-Consensus 24 (Table 58) (generated from 35 heavy chain sequences) | SEQ ID NO: 50275 | EVQLVES-GGGLVKPGGSLRLSCAASG-FTFSS--- YSMNWVRQAPGKGLEWVSSISGS--- SSYIYYADSVKGRFTISRDNAKNSLYLQMNSLRAED TAVYYCARDRG--- SSWGQGTLVTVSS |
| VH-Consensus 25 (Table 59) (generated from 32 heavy chain sequences) | SEQ ID NO: 50276 | EVQLLES-GGGLVQPGGSLRLSCAASE-FTFSS--- YAMSWVRQAPGKGLEWVSVISGR--- GGNTFYADSVKGRFTISRDNSKNTLYLQMNSLRAED TAVYYCASRIAVAG--- SEAFEIWGQGTMVTVSS |
| VH-Consensus 26 (Table 60) (generated from 30 heavy chain sequences) | SEQ ID NO: 50277 | EVQLLES-GGGLVQPGGSLRLSCAASG-FTFSS--- YAMSWVRQAPGKGLEWVSAISGR--- GGSTEHADSVKGRFTISRDNSKNTLYLQMNSLRAED TAVYYCVKGELLEDY--- YFYGMDVWGQGTTVTVSS |
| VH-Consensus 27 (Table 61) (generated | SEQ ID NO: 50278 | QVQLVES-GGGVVQPGRSLRLSCAASG-FTFSS--- YGMHWVRQAPGKGLEWVAVIWYD--- |

FIGURE 55
(Continued)

| | | |
|---|---|---|
| from 29 heavy chain sequences) | | GSNKYYADSVKGRFTISRDNSKNTLYLQMNSLRAED TAVYYCARDRVYCSSTSC PYYYYYGMDYWGQGTTVTVSS |
| VH-Consensus 28 (Table 62) (generated from 28 heavy chain sequences) | SEQ ID NO: 50279 | EVQLVES-GGGLVKPGGSLRLSCAASG-FTFSS-- YSMNWVRQAPGKGLEWVSSISGS--- SSYIYYADSVKGRFTISRDNAKNSLYLQMNSLRAED TAVYYCARVAS-- EDYWGQGTLVTVSS |
| VH-Consensus 29 (Table 63) (generated from 26 heavy chain sequences) | SEQ ID NO: 50280 | QVQLQES-GPGLVKPSQTLSLTCTVSG-GSISSG--- DYYWNWIRQHPGKGLEWIGYIEY--- SGSTYYNPSLKSRVTISVDTSKNQFSLKLSSVTAADT AVYYCARGDYDGSGY-- HYYYGMDYWGQGTTVTVSS |
| VH-Consensus 30 (Table 64) (generated from 24 heavy chain sequences) | SEQ ID NO: 50281 | EVQLLES-GGGLVQPGGSLRLSCAASG-FTFSS-- YAMSWVRQAPCKGLEWVSYISGG--- GSSTYYADSVKGRFTISRDNSKNTLYLQMNSLRAED TAVYYCAKWRGNPT-- DYGMDYWGQGTLVTVSS |
| VH-Consensus 31 (Table 65) (generated from 24 heavy chain sequences) | SEQ ID NO: 50282 | QVQLVES-GGGVVQPGRSLRLSCAASG-FTFSS-- YGMHWVRQAPGKGLEWVAHWYD--- GSNKYYADSVKGRFTISRDNSKNTLYLQMNSLRAED TAVYYCARDHYDFW-- SGHFDYWGQGTLVTVSS |
| VH-Consensus 32 (Table 66) (generated from 24 heavy chain sequences) | SEQ ID NO: 50283 | QVQLQQW-GAGLLKPSETLSLTCAVYG-GSFSG-- YYWSWIRQPPGKGLEWTGEINH--- SGRTNYNPSLKSRVTISVDTSKNQFSLKLSSVTAADT AVYYCARDYGG-- LDYWGQGTLVTVSS |
| VH-Consensus 33 (Table 67) (generated from 22 heavy chain sequences) | SEQ ID NO: 50284 | QLQLQES-GPGLVKPSETLSLTCTVSG-GSISRS-- SYYWGWIRQPPGKGLEWGNIYY--- SGSTYYNPSLKSRVTISVDTSKNQFSLKLSSVTAADT AVYYCARHSSSW-- SLDYWGQGTLVTVSS |
| VH-Consensus 34 (Table 68) (generated from 19 heavy chain sequences) | SEQ ID NO: 50285 | QVQLVQS-GAEVKKPGASVKVSCKASG-YTFTG-- YTIHWVRQAPGQGLEWMGWINPN--- SGGTNYAQKFQGRVTMTRDTSISTAYMELSRLRSDD TAVYYCARQYSYGY-- NWFDPWGQGTLVTVSS |
| VH-Consensus 35 (Table 69) (generated from 18 heavy chain sequences) | SEQ ID NO: 50286 | QVQLVES-GGGVVQPGRSLRLSCAASG-FTFSH-- YGMHWVRQAPGKGLEWVAVIWYD--- GSNKYYADSVKGRFTISRDNSKNTLYLQMNSLRAED |

FIGURE 55
(Continued)

| | | |
|---|---|---|
| | | TAVYYCARGDWNP-EGMDVWGQGTTVTVSS |
| VH-Consensus 36 (Table 70) (generated from 17 heavy chain sequences) | SEQ ID NO: 50287 | EVQLLES-GGGLVQPGGSLRLSCAASG-FTFSS-YAMSWVRQAPGKGLEWVSAISGS-GGNTFYADSVKGRFTISRDNSKNTLYLQMNSLRAED TAVYYCAKKDYDYVW-GSPYFDYWGQGTLVTVSS |
| VH-Consensus 37 (Table 71) (generated from 16 heavy chain sequences) | SEQ ID NO: 50288 | QVQLVQS-GAEVKKPGASVKVSCKASG-YTFTG-YYMHWVRQAPGQGLEWMGWINPN-SGGTNYAQKFQGRVTMTRDTSISTAYMELSRLRSDD TAVYYCARSYYYGSGS-YYNFFDYWGQGTLVTVSS |
| VH-Consensus 38 (Table 72) (generated from 14 heavy chain sequences) | SEQ ID NO: 50289 | QVQLVQS-GAEVKKPGASVKVSCKASG-YTFTG-YYIHWVRQAPGQGLEWMGWINPY-SGDTNYAQKFQGRVTMTRDTSISTAYMELSRLRFDD TAVFFYCARDMGGYSS-YYYGMDYWGQGTTVTVSS |
| VH-Consensus 39 (Table 73) (generated from 14 heavy chain sequences) | SEQ ID NO: 50290 | EVQLVES-GGGLVKPGGSLRLSCAASG-FTFSS-YSMNWVRQAPGKGLEWVSSISGS-SSYIYYADSVKGRFTISRDNAKNSLYLQMNSLRAED TAVYYCARLT-FDYWGQGTLVTVSS |
| VH-Consensus 40 (Table 74) (generated from 14 heavy chain sequences) | SEQ ID NO: 50291 | QVQLVES-GGGVVQPGRSLRLSCAASG-FTFST-YGMHWVRQAPGKGLEWVAHWYD-GTNKYYADSVKGRFTISRDNSSKNTLYLQLNSLRAED TAVYYCARDPLRGYN-DPYMDYWGQGTLVTVSS |
| VH-Consensus 41 (Table 75) (generated from 13 heavy chain sequences) | SEQ ID NO: 50292 | EVQLLES-GGGLVQPGGSLRLSCAASGR-YAMSWVRQAPGKGLEWVSAISGR-GGNTFYADSVKGRFTISRDNSKNTLYLQMNSLRAED TAVYYCAKRVTDYGG-NDWFDPWGQGTLVTVSS |
| VH-Consensus 42 (Table 76) (generated from 13 heavy chain sequences) | SEQ ID NO: 50293 | QVQLVES-GGGVVQPGRSLRLSCAASG-FTFST-YGMHWVRQAPGKGLEWVAYIWYG-GSNKDYADSVKGRFTISRDISKNTLYLQMNSLRAED TAVYYCARDRDYCSGSGSC-PYYYYGMDYWGQGTTVTVSS |
| VH-Consensus 43 (Table 77) (generated from 13 heavy chain sequences) | SEQ ID NO: 50294 | QLQLQES-GPGLVKPSETLSLTCTVSG-GSISRS-SYYWGWIRQPPGKGLEWIGNHYY-SGSTYYNPSLKSRVTISVDTSKNQFSLKLSSVTAADT AVTYCGRHGKDW-GLDYWGQGTLVTVSS |

FIGURE 55
(Continued)

| | SEQ ID NO: | |
|---|---|---|
| VH-Consensus 44 (Table 78) (generated from 12 heavy chain sequences) | SEQ ID NO: 50295 | QVQLVQS-GAEVKKPGASVKVSCKASG-YTFTG----YYMHWVRQAPGQGLEWMGWIKPN----SGGTNQAQKFQGRVTMTRDTSISTAYMELSGLRSDDTAVYYCARAPGTAAAG----TWGYFDYWGQGTLVTVSS |
| VH-Consensus 45 (Table 79) (generated from 12 heavy chain sequences) | SEQ ID NO: 50296 | QITLKES-GPTLVKPTQTLTLTCTFSG-FSLSTG----GVGVGWIRQPPGKALEWLALIYW----DDDKRYSPSLKSRLTITKDTSKNQVVLTMTNMDPVDTATYYCAHLIAV----AFDYWGQGTLVTVSS |
| VH-Consensus 46 (Table 80) (generated from 11 heavy chain sequences) | SEQ ID NO: 50297 | QVQLVES-GGGVVQPGRSLRLSCAASG-FTFSS----YGMHWVRQAPGKGLEWVAHWYD----GSYKYYADSVKGRFTISRDNSKNTLYLQMNSLRAEDTAVYYCAREAYDFW----SGYFDYWGQGTLVTVSS |
| VH-Consensus 47 (Table 81) (generated from 11 heavy chain sequences) | SEQ ID NO: 50298 | QVQLVES-GGGVVQPGRSLRLSCAASG-FTFSS----YGMHWVRQAPGKGLEWVAYIWYD----GSNKYYADSVKGRFTISRDNSKNTLYLQMNSLRAEDTAVYYCARDRDYGD----YGMDVWGQGTTVTVSS |
| VH-Consensus 48 (Table 82) (generated from 10 heavy chain sequences) | SEQ ID NO: 50299 | EVQLLES-GGGLVQPGGSLRLSCAASG-FTFSS----YAMSWVRQAPGKGLEWVSAHSGS----GGNTPYADSVKGRFTISRDNSKNTLYLQMNSLRAEDTAVYYCAKLGKDYY----YYGMDYWGQGTTVTVSS |
| VH-Consensus 49 (Table 83) (generated from 10 heavy chain sequences) | SEQ ID NO: 50300 | EVQLLES-GGGLVQPGGSLRLSCAASG-FTFSS----YYMSWVRQAPGKGLEWVSAMSGS----GGRTYYADSVKGRFTISRDNSKNTLYLQMNSLRAEDTAVYYCAKLTA----FDYWGQGTLVTVSS |
| VH-Consensus 50 (Table 84) (generated from 10 heavy chain sequences) | SEQ ID NO: 50301 | QVQLVES-GGGVVQPGRSLRLSCAASG-FTFSS----YGMHWVRQAPGKGLEWVAHSYA----GSNKYYADSVKGRFTISRDNSKNTLYLQMNSLRAEDTAVYYCVRRGYSYG----GYGMDVWGQGTTVTVSS |
| VH-Consensus 51 (Table 85) (generated from 10 heavy chain sequences) | SEQ ID NO: 50302 | QVQLVES-GGGVVQPGRSLRLSCAASG-FTFSD----YYMHWVRQAPGKGLEWVAVIWYD----GSNKYYADSVKGRFTISRDNSKNTLYLQMNSLRAEDTAVYYCAREPYISW----YDYGMDVWGQGTTVTVSS |

FIGURE 55
(Continued)

| | SEQ ID NO | Sequence |
|---|---|---|
| VH-Consensus 52 (Table 86) (generated from 9 heavy chain sequences) | SEQ ID NO: 50303 | QVQLVQS-GAEVKKPGASVKVSCKASG-YTFNS--- YGMSWVRQAPGQGLEWMGWISAY--- NGNTKYAQKLQGRVTMTTDTSTSTAYMELRSLRSD DTAVYYCARHDFWSGY--- YKGMDYWGKGTTVTVSS |
| VH-Consensus 53 (Table 87) (generated from 9 heavy chain sequences) | SEQ ID NO: 50304 | EVQLLES-GGGLVQPGGSLRLSCAASG-FTFSS--- YAMSWVRQAPGKGLEWVSAISGR---GG NTFDADSVKGRFTISRDNSKNTLYLQMNSLRAEDTA VYYCAKERSGS--- YFDYWGQGTLVTVSS |
| VH-Consensus 54 (Table 88) (generated from 9 heavy chain sequences) | SEQ ID NO: 50305 | QVQLVES-GGGVVQPGRSLRLSCAASG-FTFSN--- YGMHWVRQAPGKGLEWVAYIWHD--- GSNKYYADSVKGRFTISRDNSKNTLYLQMNSLRAED TAVYYCARENSSS--- YYFDYWGQGTLVTVSS |
| VH-Consensus 55 (Table 89) (generated from 8 heavy chain sequences) | SEQ ID NO: 50306 | QITLKES-GPTLVKPTQTLTLTCTFSG-FSLSTS--- GVGVGWIRQPPGKALEWLALINW--- NDDKRYSPSLKSRFTLTRDTSKDQVVLTMTNMDPVD TATYYCAHKATWY--- AFDIWGQGTMVTVSS |
| VH-Consensus 56 (Table 90) (generated from 8 heavy chain sequences) | SEQ ID NO: 50307 | EVQLLES-GGGLVQPGGSLRLSCAASG-FTFSS--- YYMNWVRQAPGKGLEWVSAISGS--- GGRTYYADSVKGRFTISRDNSKNTLYLQMNSLRAED TAVYYCARTAT--- FDYWGQGTLVTVSS |
| VH-Consensus 57 (Table 91) (generated from 8 heavy chain sequences) | SEQ ID NO: 50308 | EVQLLES-GGGLVQPGGSLRLSCAASG-FTFSS--- YAMSWVRQAPGKGLEWVSYISGR--- GGTTEYADSVKGRFTISRDNSKNTLYLQMNSLRAED TAVYYCAKRTPSD--- VFDIWGQGTMVTVSS |
| VH-Consensus 58 (Table 92) (generated from 8 heavy chain sequences) | SEQ ID NO: 50309 | QVQLVES-GGGVVQPGRSLRLSCAASG-FTFSS--- YGMHWVRQAPGKGLEWVAYIWYD--- GSMKYYADSVKGRFTISRDNSKNTLYLQMNSLRAED TAVYYCARDRPRS---SAF DYWGQGTLVTVSS |
| VH-Consensus 59 (Table 93) (generated from 8 heavy chain sequences) | SEQ ID NO: 50310 | EVQLVES-GGGLVQPGGSLRLSCAASG-FTFSS--- YNMNWVRQAPGKGLEWVSYISRS--- SNTKYYADSVKGRFTISRDNAKNSLYLQMNSLRDED TAVYYCARDRSGSYGY--- FYYGLDVWGQGTTVTVSS |
| VH-Consensus 60 (Table 94) (generated | SEQ ID NO: 50311 | QVQLQES-GPGLVKPSQTLSLTCTVSG-GSIRSG--- GDYWSWIRQHPGKGLEWIGYIYY--- |

FIGURE 55
(Continued)

| from 8 heavy chain sequences) | SGSTYYNPSLKSRVTISVDTSKNQFSLKLSSVTAADT AVYYCARDSSSY............................................. GMDVWGQGTTVTVSS |

FIGURE 55
(Continued)

Table 19B

VARIABLE HEAVY CDR CONSENSUS SEQUENCES 1

| NAME (ORIGINAL AND PATENT) | Patent SEQ ID NO: | CDR | Sequence |
|---|---|---|---|
| VH-CONSENSUS-1 TABLE 21 | 50381 | VH1 | DYYMH |
| | 50382 | VH2 | WINPNNGGTNYAQKFQG |
| | 50383 | VH3 | DGTGSFDY |
| VH-CONSENSUS-2 TABLE 22 | 50384 | VH1 | GYYMH |
| | 50385 | VH2 | WINPNSGGTNYAQKFQG |
| | 50386 | VH3 | SYYYGSGSYYNEFDY |
| VH-CONSENSUS-3 TABLE 23 | 50387 | VH1 | NYDIN |
| | 50388 | VH2 | WMHPNSGMTGYAQKFQG |
| | 50389 | VH3 | SSGWYYFDY |
| VH-CONSENSUS-4 TABLE 24 | 50390 | VH1 | SYSMN |
| | 50391 | VH2 | SISGSSSYIYYADSVKG |
| | 50392 | VH3 | VASFDY |
| VH-CONSENSUS-5 TABLE 25 | 50393 | VH1 | SYSMN |
| | 50394 | VH2 | SISGSSSYIYYADSVKG |
| | 50395 | VH3 | DRGSL |
| VH-CONSENSUS-6 TABLE 26 | 50396 | VH1 | SYVMN |
| | 50397 | VH2 | AISGSGGSTYYADSVKG |
| | 50398 | VH3 | TGVFDY |
| VH-CONSENSUS-7 TABLE 27 | 50399 | VH1 | SYAMS |
| | 50400 | VH2 | AISGRGGSTFHADSVKG |
| | 50401 | VH3 | GELLEPYYFYGMDV |
| VH-CONSENSUS-8 TABLE 28 | 50402 | VH1 | SYAMX |
| | 50403 | VH2 | VESGRGGNTFYADSVKG |
| | 50404 | VH3 | RLAVAGSEAFDI |
| VH-CONSENSUS-9 TABLE 29 | 50405 | VH1 | SYGMH |
| | 50406 | VH2 | VIWXDGSNKYYADSVKG |
| | 50407 | VH3 | DLSMGGMDV |
| VH-CONSENSUS-10 TABLE 30 | 50408 | VH1 | SYVMH |
| | 50409 | VH2 | VIWYDGSMKYYADSVKG |
| | 50410 | VH3 | EKYSSSWYDYGMDV |
| VH-CONSENSUS-11 TABLE 31 | 50411 | VH1 | DYGMH |
| | 50412 | VH2 | VIWYDESNKYYADSVKG |
| | 50413 | VH3 | EIGWLFDY |

FIGURE 55
(Continued)

| | | | |
|---|---|---|---|
| VH-CONSENSUS-12 TABLE 32 | 50414 | VH1 | DYGMH |
| | 50415 | VH2 | VIWYDENNKYYADSVKG |
| | 50416 | VH3 | ELGFRSDY |
| VH-CONSENSUS-13 TABLE 33 | 50417 | VH1 | RSSYYWG |
| | 50418 | VH2 | NIYYSGSTYYNPSLKS |
| | 50419 | VH3 | HSSSWSLDY |
| VH-CONSENSUS-14 TABLE 34 | 50420 | VH1 | RSSYYWG |
| | 50421 | VH2 | NIYYSGSTYYNPSLKS |
| | 50422 | VH3 | HGKDWGLDY |
| VH-CONSENSUS-15 TABLE 49 | 50468 | VH1 | NYDIN |
| | 50469 | VH2 | WMHPNSGNTGYAQKFQG |
| | 50470 | VH3 | SSGWYFDY |
| VH-CONSENSUS-16 TABLE 50 | 50471 | VH1 | SYYMH |
| | 50472 | VH2 | VIWYDGSNKYYADSVKG |
| | 50473 | VH3 | ERYSSGWYDYGMDV |
| VH-CONSENSUS-17 TABLE 51 | 50474 | VH1 | DYGMH |
| | 50475 | VH2 | VIWYDENNKYYADSVKG |
| | 50476 | VH3 | ELGFSDY |
| VH-CONSENSUS-18 TABLE 52 | 50477 | VH1 | GCYWS |
| | 50478 | VH2 | EINHSGSTNYNPSLKS |
| | 50479 | VH3 | DYGGMDV |
| VH-CONSENSUS-19 TABLE 53 | 50480 | VH1 | NYDIN |
| | 50481 | VH2 | WMHPNSGNTGYAQKFQG |
| | 50482 | VH3 | SSGWYWFDP |
| VH-CONSENSUS-20 TABLE 54 | 50483 | VH1 | SYGMH |
| | 50484 | VH2 | VIWYDGSNKYYADSVKG |
| | 50485 | VH3 | DQGVGYYGLDV |
| VH-CONSENSUS-21 TABLE 55 | 50486 | VH1 | GYYMH |
| | 50487 | VH2 | WINPNSGGTNYAQKFQG |
| | 50488 | VH3 | DGTSSFDY |
| VH-CONSENSUS-22 TABLE 56 | 50489 | VH1 | SYGMH |
| | 50490 | VH2 | VIWHDGSNKYYADSVKG |
| | 50491 | VH3 | DLSMGGMDV |
| VH-CONSENSUS-23 TABLE 57 | 50492 | VH1 | DYGMH |
| | 50493 | VH2 | VIWYDESNKYYADSVKG |
| | 50494 | VH3 | EVGWLDDY |

FIGURE 55
(Continued)

| | | | |
|---|---|---|---|
| VH-CONSENSUS-24 TABLE 58 | 50495 | VH1 | SYSMN |
| | 50496 | VH2 | SISGSSSYIYYADSVKG |
| | 50497 | VH3 | DRGSS |
| VH-CONSENSUS-25 TABLE 59 | 50498 | VH1 | SYAMS |
| | 50499 | VH2 | VISGRGGNTFYADSVKG |
| | 50500 | VH3 | RIAVAGSEAFDI |
| VH-CONSENSUS-26 TABLE 60 | 50501 | VH1 | SYAMS |
| | 50502 | VH2 | AISGRGGSTFHADSVKG |
| | 50503 | VH3 | GELLEDYYFYGMDV |
| VH-CONSENSUS-27 TABLE 61 | 50504 | VH1 | SYGMH |
| | 50505 | VH2 | VIWYDGSNKYYADSVKG |
| | 50506 | VH3 | DRVYCSSTSCPYYYYGMDV |
| VH-CONSENSUS-28 TABLE 62 | 50507 | VH1 | SYSMN |
| | 50508 | VH2 | SISGSSSYIYYADSVKG |
| | 50509 | VH3 | VASFDY |
| VH-CONSENSUS-29 TABLE 63 | 50510 | VH1 | SGDYYWN |
| | 50511 | VH2 | YIFYSGSTYYNPSLKS |
| | 50512 | VH3 | GDYDGSGSYHYYYGMDV |
| VH-CONSENSUS-30 TABLE 64 | 50513 | VH1 | SYAMS |
| | 50514 | VH2 | VISGGGSTYYADSVKG |
| | 50515 | VH3 | WKGNPTDYGMD |
| VH-CONSENSUS-31 TABLE 65 | 50516 | VH1 | SYGMH |
| | 50517 | VH2 | IIWYDGSNKYYADSVKG |
| | 50518 | VH3 | DHYDFWSGRFDY |
| VH-CONSENSUS-32 TABLE 66 | 50519 | VH1 | GYYWS |
| | 50520 | VH2 | EIHSGRTNYNPSLKS |
| | 50521 | VH3 | DYGGLDY |
| VH-CONSENSUS-33 TABLE 67 | 50522 | VH1 | RSSYYWG |
| | 50523 | VH2 | NIYYSGSTYYNPSLKS |
| | 50524 | VH3 | HSSSWSLDY |
| VH-CONSENSUS-34 TABLE 68 | 50525 | VH1 | GYYIH |
| | 50526 | VH2 | WINPNSGGTNYAQKFQG |
| | 50527 | VH3 | GVSYGYNWFDP |
| VH-CONSENSUS-35 TABLE 69 | 50528 | VH1 | HYGMH |
| | 50529 | VH2 | VIWYDGSNKYYADSVKG |
| | 50530 | VH3 | GDWNPEGMDV |

FIGURE 55
(Continued)

| | | | |
|---|---|---|---|
| VH-CONSENSUS-36 TABLE 70 | 50531 | VH1 | SYAMS |
| | 50532 | VH2 | AISGSGGNTFYADSVKG |
| | 50533 | VH3 | KDYDYVWGSPYFDY |
| VH-CONSENSUS-37 TABLE 71 | 50534 | VH1 | GYYMH |
| | 50535 | VH2 | WINPNSGGTNYAQKFQG |
| | 50536 | VH3 | SYYYGSGSYYMEFDY |
| VH-CONSENSUS-38 TABLE 72 | 50537 | VH1 | GYYIH |
| | 50538 | VH2 | WINPYSGDTNYAQKFQG |
| | 50539 | VH3 | DWGGYSSYYYGMDV |
| VH-CONSENSUS-39 TABLE 73 | 50540 | VH1 | SYSMN |
| | 50541 | VH2 | SISGSSSYIYYADSVKG |
| | 50542 | VH3 | LTFDY |
| VH-CONSENSUS-40 TABLE 74 | 50543 | VH1 | TYGMH |
| | 50544 | VH2 | IIWYDGTNKYYADSVKG |
| | 50545 | VH3 | DPLRGYNDPVMDY |
| VH-CONSENSUS-41 TABLE 75 | 50546 | VH1 | SYAMS |
| | 50547 | VH2 | AISGRGGNTFYADSVKG |
| | 50548 | VH3 | RVTDYGGNDWFDP |
| VH-CONSENSUS-42 TABLE 76 | 50549 | VH1 | TYGMH |
| | 50550 | VH2 | VIWYGGSMKDYADSVKG |
| | 50551 | VH3 | DRDYCSGGSCPYYYYGMDV |
| VH-CONSENSUS-43 TABLE 77 | 50552 | VH1 | RSSYYWG |
| | 50553 | VH2 | NIYYSGSTYYNPSLKS |
| | 50554 | VH3 | HGKDWGLDY |
| VH-CONSENSUS-44 TABLE 78 | 50555 | VH1 | GVYMH |
| | 50556 | VH2 | WIKPNSGGTNQAQKFQG |
| | 50557 | VH3 | APGTAAAGTWGYFDY |
| VH-CONSENSUS-45 TABLE 79 | 50558 | VH1 | TGGVGVG |
| | 50559 | VH2 | LIYWDDDKRYSPSLKS |
| | 50560 | VH3 | LIAYAPDY |
| VH-CONSENSUS-46 TABLE 80 | 50561 | VH1 | SYGMH |
| | 50562 | VH2 | IIWYDGSYKYYADSVKG |
| | 50563 | VH3 | EAYDFWSGYFDY |
| VH-CONSENSUS-47 TABLE 81 | 50564 | VH1 | SYGMH |
| | 50565 | VH2 | VIWYDGSMKYYADSVKG |
| | 50566 | VH3 | DRDYGDYGMDV |

FIGURE 55
(Continued)

| | | | |
|---|---|---|---|
| VH-CONSENSUS-48 TABLE 82 | 50567 | VH1 | SYAMS |
| | 50568 | VH2 | AISGSGGNTFYADSVKG |
| | 50569 | VH3 | LGKDYYYYGMDV |
| VH-CONSENSUS-49 TABLE 83 | 50570 | VH1 | SYVMS |
| | 50571 | VH2 | AMSGSGGRTYYADSVKG |
| | 50572 | VH3 | LTAFDY |
| VH-CONSENSUS-50 TABLE 84 | 50573 | VH1 | SYGMH |
| | 50574 | VH2 | RSYAGSNKYYADSVKG |
| | 50575 | VH3 | RGYSYGGYGMDV |
| VH-CONSENSUS-51 TABLE 85 | 50576 | VH1 | DYVMH |
| | 50577 | VH2 | VIWYDGSNKYYADSVKG |
| | 50578 | VH3 | EPYTSGWYDYGMDV |
| VH-CONSENSUS-52 TABLE 86 | 50579 | VH1 | SYGIS |
| | 50580 | VH2 | WISAYNGNTKYAQKLQG |
| | 50581 | VH3 | HDFWSGYYKGMDV |
| VH-CONSENSUS-53 TABLE 87 | 50582 | VH1 | SYAMS |
| | 50583 | VH2 | AISGRGG NTFDADSVKG |
| | 50584 | VH3 | ERSGSYFDY |
| VH-CONSENSUS-54 TABLE 88 | 50585 | VH1 | NYGMH |
| | 50586 | VH2 | VIWHDGSNKYYADSVKG |
| | 50587 | VH3 | ENSSSYYFDY |
| VH-CONSENSUS-55 TABLE 89 | 50588 | VH1 | TSGVGVG |
| | 50589 | VH2 | LINWNDDKRYSPSLKS |
| | 50590 | VH3 | KATWVAFDI |
| VH-CONSENSUS-56 TABLE 90 | 50591 | VH1 | SYVMN |
| | 50592 | VH2 | AISGSGGRTYYADSVKG |
| | 50593 | VH3 | TATFDY |
| VH-CONSENSUS-57 TABLE 91 | 50594 | VH1 | SYAMS |
| | 50595 | VH2 | VISGRGGTTFYADSVKG |
| | 50596 | VH3 | KRTPSDVFDI |
| VH-CONSENSUS-58 TABLE 92 | 50597 | VH1 | SYGMH |
| | 50598 | VH2 | VIWYDGSNKYYADSVKG |
| | 50599 | VH3 | DRPSSAFDY |
| VH-CONSENSUS-59 TABLE 93 | 50600 | VH1 | SYMMN |
| | 50601 | VH2 | YISRSSNTKYYADSVKG |
| | 50602 | VH3 | DRSGSYGYFYYGLDV |
| VH-CONSENSUS-60 | 50603 | VH1 | SGGDYWS |

FIGURE 55
(Continued)

| TABLE 94 | | | |
|---|---|---|---|
| | 50604 | VH2 | YIYYSGSTYYNPSLKS |
| | 50605 | VH3 | DSSSYGMDV |

FIGURE 55
(Continued)

Table 19C

VARIABLE HEAVY CDR CONSENSUS SEQUENCES II

| NAME (ORIGINAL AND PATENT) | Patent SEQ ID NO: | CDR | Sequence |
|---|---|---|---|
| VH-CONSENSUS-15 TABLE 49 | SEQ ID NO: 50001 | VH1 | X1 Tyr Asp X2 Asn, wherein X1 = N or H or a conservative substitution thereof, X2 = I or V or L or a conservative substitution thereof. |
| | SEQ ID NO: 50002 | VH2 | X1 X2 X3 Pro X4 Ser X5 X6 X7 X8 X9 X10 X11 X12 Phe X13 X14 wherein X1 = W or R or a conservative substitution thereof, X2 = M or V or L or a conservative substitution thereof, X3 = H or N or Y or T or a conservative substitution thereof, X4 = N or D or H or a conservative substitution thereof, X5 = G or H or a conservative substitution thereof, X6 = N or S or Q or A or D or K or T or a conservative substitution thereof, X7 = T or A or V or E or a conservative substitution thereof, X8 = G or D or a conservative substitution thereof, X9 = Y or F or C or a conservative substitution thereof, X10 = A or P or a conservative substitution thereof, X11 = Q or K or a conservative substitution thereof, X12 = K or R or N or a conservative substitution thereof, X13 = Q or R or a conservative substitution thereof, X14 = G or V or a conservative substitution thereof. |
| | SEQ ID NO: 50003 | VH3 | Ser Ser Gly Trp X1 X2 Phe Asp X3, wherein X1 = Y or E or N or T or a conservative substitution thereof, X2 = Y or F or K or I or R or Y or L or M or W or H or S or a conservative substitution thereof, X3 = Y or F or S or N or a conservative substitution thereof. |
| VH-CONSENSUS-16 TABLE 50 | SEQ ID NO: 50004 | VH1 | X1 X2 X3 X4 X5, wherein X1 = S or D or N or I or a conservative substitution thereof, X2 = Y or C or F or D or S or a conservative substitution thereof, X3 = Y or G or i or L or a conservative substitution thereof, X4 = M or I or L or a conservative substitution thereof, X5 = H or D or a conservative substitution thereof. |
| | SEQ ID NO: 50005 | VH2 | X1 Ile X2 Tyr Asp X3 X4 X5 Lys X6 X7 X8 X9 X10 X11 Lys Gly, wherein X1 = V or L or A or a conservative substitution thereof, X2 = W or F or a conservative substitution thereof, X3 = G or A or a conservative substitution thereof, X4 = S or R or N or a conservative substitution thereof, X5 = N or Y or G or S or a conservative substitution thereof, X6 = Y or H or a conservative substitution thereof, X7 = Y or H or N or a conservative substitution thereof, X8 = A or V or E or G or T or a conservative substitution thereof, X9 = D or E or G or a conservative substitution thereof, X10 = S or A or a conservative substitution thereof, X11 = V or M or a conservative substitution thereof. |

FIGURE 55
(Continued)

| | SEQ ID NO: 50006 | VH3 | X1 X2 X3 X4 X5 X6 X7 X8 X9 X10 X11 X12 X13 X14 X15 X16 Gly X17 X18 Val, wherein X1 = E or R or V or a conservative substitution thereof, X2 = R or Y or K or Y or E or P or D or L or F or M or N or Q or T or a conservative substitution thereof, X3 = Y or S or T or V or a conservative substitution thereof, X4 = S or R or Y or P or T or G or a conservative substitution thereof, X5 = S or C or Y or a conservative substitution thereof, X6 = G or W or S or N or a conservative substitution thereof, X7 = W or Absent or L or Y or G or F or S or a conservative substitution thereof, X8 = Absent or Y or a conservative substitution thereof, X9 = Absent or A or G or T or a conservative substitution thereof, X10 = Absent or C or a conservative substitution thereof, X11 = Absent or P or a conservative substitution thereof, X12 = Absent or Y or L or a conservative substitution thereof, X13 = Absent or Y or D or a conservative substitution thereof, X14 = Y or Absent or F or H or a conservative substitution thereof, X15 = D or S or G or T or V or Y or A or F or M or a conservative substitution thereof, X16 = Y or G or F or a conservative substitution thereof, X17 = M or L or a conservative substitution thereof, X18 = D or G or a conservative substitution thereof. |
|---|---|---|---|
| VH-CONSENSUS-17 TABLE 51 | SEQ ID NO: 50007 | VH1 | X1 X2 Gly X3 His, wherein X1 = D or S or N or T or a conservative substitution thereof, X2 = Y or F or a conservative substitution thereof, X3 = M or I or a conservative substitution thereof. |
| | SEQ ID NO: 50008 | VH2 | X1 X2 Trp X3 X4 X5 X6 X7 X8 X9 X10 X11 X12 Ser X13 X14 Gly, wherein X1 = V or L or a conservative substitution thereof, X2 = I or V or T or M or a conservative substitution thereof, X3 = Y or F or D or a conservative substitution thereof, X4 = D or E or A or G or N or a conservative substitution thereof, X5 = E or G or V or R or D or a conservative substitution thereof, X6 = N or S or T or D or I or Y or a conservative substitution thereof, X7 = N or H or K or a conservative substitution thereof, X8 = K or Q or E or N or R or a conservative substitution thereof, X9 = Y or H or K or D or R or S or a conservative substitution thereof, X10 = Y or H or a conservative substitution thereof, X11 = A or V or G or T or T or E or a conservative substitution thereof, X12 = D or E or a conservative substitution thereof, X13 = V or M or a conservative substitution thereof, X14 = K or R or a conservative substitution thereof. |
| | SEQ ID NO: 50009 | VH3 | X1 Leu X2 X3 X4 X5 X6 X7, wherein X1 = E or D or G or a conservative substitution thereof, X2 = G or A or a conservative substitution thereof, X3 = F or W or M or a conservative substitution thereof, X4 = L or R or T or Y or S or Q or I or A or E or N or a conservative substitution |

FIGURE 55
(Continued)

| | | | |
|---|---|---|---|
| VH-CONSENSUS-18 TABLE 52 | SEQ ID NO: 50010 | | thereof, X5 = S or E or G or D or F or N or A or T or a conservative substitution thereof, X6 = D or E or a conservative substitution thereof, X7 = Y or S or F or C or a conservative substitution thereof. |
| | SEQ ID NO: 50011 | VH1 | Gly X1 Tyr Trp Ser, wherein X1 = C or S or P or Y or a conservative substitution thereof. |
| | SEQ ID NO: 50012 | VH2 | Glu Ile Asn X1 X2 Gly X3 Thr X4 X5 Asn Pro Ser Leu X6 Ser, wherein X1 = H or Y or Q or a conservative substitution thereof, X2 = S or R or a conservative substitution thereof, X3 = S or R or C or I or a conservative substitution thereof, X4 = N or S or a conservative substitution thereof, X5 = Y or F or a conservative substitution thereof, X6 = K or T or a conservative substitution thereof. |
| | | VH3 | Asp Tyr Gly Gly X1 Asp Val, wherein X1 = M or L or a conservative substitution thereof. |
| VH-CONSENSUS-19 TABLE 53 | SEQ ID NO: 50013 | VH1 | Asn Tyr Asp Ile Asn. |
| | SEQ ID NO: 50014 | VH2 | Trp Met X1 Pro X2 X3 X4 X5 X6 Gly X7 Ala Gln Lys Phe Gln X8, wherein X1 = H or N or Y or a conservative substitution thereof, X2 = N or D or a conservative substitution thereof, X3 = S or N or a conservative substitution thereof, X4 = G or Y or a conservative substitution thereof, X5 = N or S or a conservative substitution thereof, X6 = T or I or a conservative substitution thereof, X7 = Y or F or C or a conservative substitution thereof, X8 = G or D or a conservative substitution thereof. |
| | SEQ ID NO: 50015 | VH3 | Ser Ser Gly Trp X1 X2 Phe Asp Pro, wherein X1 = Y or H or N or S or K or a conservative substitution thereof, X2 = W or R or a conservative substitution thereof. |
| VH-CONSENSUS-20 TABLE 54 | SEQ ID NO: 50016 | VH1 | X1 X2 Gly Met X3, wherein X1 = S or N or R or T or I or a conservative substitution thereof, X2 = Y or H or N or a conservative substitution thereof, X3 = H or D or a conservative substitution thereof. |
| | SEQ ID NO: 50017 | VH2 | X1 X2 Trp X3 Asp Gly X4 Asn X5 X6 X7 X8 X9 Ser Val Lys Gly, wherein X1 = V or I or a conservative substitution thereof, X2 = I or L or a conservative substitution thereof, X3 = Y or F or a conservative substitution thereof, X4 = S or T or a conservative substitution thereof, X5 = N or F or Q or D or R or a conservative substitution thereof, X6 = N or H or Y or a conservative substitution thereof, X7 = Y or H or a conservative substitution thereof, X8 = A or V or G |

FIGURE 55
(Continued)

| | | | |
|---|---|---|---|
| | SEQ ID NO: 50018 | VH3 | or a conservative substitution thereof, X9 = D or E or a conservative substitution thereof.  X1 X2 Gly X3 X4 X5 X6 X7 X8 X9 X10 X11 X12 X13 Asp Val, wherein X1 = D or A or a conservative substitution thereof, X2 = Q or R or Y or H or A or C or E or F or M or a conservative substitution thereof, X3 = V or I or F or a conservative substitution thereof, X4 = G or Y or a conservative substitution thereof, X5 = Y or E or a conservative substitution thereof, X6 = Absent or F or a conservative substitution thereof, X7 = Absent or D or a conservative substitution thereof, X8 = Absent or Y or a conservative substitution thereof, X9 = Absent or N or a conservative substitution thereof, X10 = Absent or N or a conservative substitution thereof, X11 = Y or D or N or a conservative substitution thereof, X12 = G or A or D or a conservative substitution thereof, X13 = L or M or T or I or a conservative substitution thereof. |
| VH-CONSENSUS-21 TABLE 55 | SEQ ID NO: 50019 | VH1 | X1 X2 X3 M4 X5, wherein X1 = G or D or S or A or a conservative substitution thereof, X2 = Y or D or a conservative substitution thereof, X3 = Y or H or N or F or a conservative substitution thereof, X4 = M or L or I or a conservative substitution thereof, X5 = H or Q or a conservative substitution thereof. |
| | SEQ ID NO: 50020 | VH2 | Trp X1 X2 Pro X3 X4 X5 X6 X7 X8 X9 X10 Gln X11 Phe Gln X12, wherein X1 = I or V or a conservative substitution thereof, X2 = N or H or K or S or a conservative substitution thereof, X3 = N or K or a conservative substitution thereof, X4 = S or N or R or T or a conservative substitution thereof, X5 = G or N or D or a conservative substitution thereof, X6 = G or A or a conservative substitution thereof, X7 = T or S or a conservative substitution thereof, X8 = N or H or Q or I or a conservative substitution thereof, X9 = Y or S or F or a conservative substitution thereof, X10 = A or T or a conservative substitution thereof, X11 = K or R or N or E or S or a conservative substitution thereof, X12 = G or D or a conservative substitution thereof. |
| | SEQ ID NO: 50021 | VH3 | X1 X2 X3 X4 X5 X6 X7 X8 X9 X10 X11 X12 X13, wherein X1 = D or K or G or S or E or a conservative substitution thereof, X2 = G or F or A or K or V or a conservative substitution thereof, X3 = T or Absent or P or a conservative substitution thereof, X4 = S or G or Absent or T or a conservative substitution thereof, X5 = Absent or V or S or a conservative substitution thereof, X6 = Absent or A or a conservative substitution thereof, X7 = Absent or T or a conservative substitution thereof, X8 = Absent or W or a conservative substitution thereof, X9 = Absent or G or a conservative substitution thereof, X10 = S or Absent or V or Y or a conservative substitution thereof, X11 = F or |

FIGURE 55
(Continued)

| | | | |
|---|---|---|---|
| VH-CONSENSUS-22 TABLE 56 | | | Absent or L or Y or a conservative substitution thereof, X12 = D or G or K or a conservative substitution thereof, X13 = Y or D or F or a conservative substitution thereof. |
| | SEQ ID NO: 50022 | VH1 | X1 X2 Gly X3 His, wherein X1 = S or N or a conservative substitution thereof, X2 = Y or F or H or a conservative substitution thereof, X3 = M or I or a conservative substitution thereof. |
| | SEQ ID NO: 50023 | VH2 | X1 Ile X2 X3 X4 X5 X6 X7 X8 X9 X10 X11 X12 X13 Val X14 Gly, wherein X1 = V or I or a conservative substitution thereof, X2 = W or I or a conservative substitution thereof, X3 = H or Y or F or N or a conservative substitution thereof, X4 = D or S or E or a conservative substitution thereof, X5 = G or A or a conservative substitution thereof, X6 = S or G or a conservative substitution thereof, X7 = N or Y or a conservative substitution thereof, X8 = K or D or E or R or a conservative substitution thereof, X9 = Y or N or a conservative substitution thereof, X10 = Y or N or a conservative substitution thereof, X11 = A or V or G or a conservative substitution thereof, X12 = D or E or a conservative substitution thereof, X13 = S or A or a conservative substitution thereof, X14 = K or R or a conservative substitution thereof. |
| | SEQ ID NO: 50024 | VH3 | X1 X2 X3 X4 X5 X6 X7 X8 X9 X10 X11 X12 X13 X14 X15 X16 X17 Gly X18 Asp Val, wherein X1 = D or T or R or a conservative substitution thereof, X2 = L or R or Y or S or F or I or P or a conservative substitution thereof, X3 = S or R or T or a conservative substitution thereof, X4 = M or V or G or P or K or N or V or a conservative substitution thereof, X5 = G or Y or Absent or S or a conservative substitution thereof, X6 = Absent or Y or S or W or a conservative substitution thereof, X7 = Absent or G or a conservative substitution thereof, X8 = Absent or S or a conservative substitution thereof, X9 = Absent or G or a conservative substitution thereof, X10 = Absent or S or a conservative substitution thereof, X11 = Absent or P or a conservative substitution thereof, X12 = Absent or P or a conservative substitution thereof, X13 = Absent or Y or a conservative substitution thereof, X14 = Absent or Y or a conservative substitution thereof, X15 = Absent or Y or a conservative substitution thereof, X16 = Absent or S or Y or a conservative substitution thereof, X17 = Absent or D or Y or G or a conservative substitution thereof, X18 = M or L or T or a conservative substitution thereof. |
| VH-CONSENSUS-23 TABLE 57 | SEQ ID NO: 50025 | VH1 | X1 X2 Gly X3 His, wherein X1 = D or N or S or a conservative substitution thereof, X2 = Y or P or a conservative substitution thereof, X3 = M or I or L or a conservative substitution thereof. |

FIGURE 55
(Continued)

| | | | |
|---|---|---|---|
| | SEQ ID NO: 50026 | VR2 | Val Ile Trp X1 X2 X3 X4 Asn X5 X6 Tyr X7 X8 Ser X9 Lys Gly, wherein X1 = Y or F or a conservative substitution thereof, X2 = D or E or I or V or a conservative substitution thereof, X3 = E or G or V or A or R or a conservative substitution thereof, X4 = S or N or T or G or a conservative substitution thereof, X5 = E or Q or T or N or a conservative substitution thereof, X6 = Y or H or K or a conservative substitution thereof, X7 = A or T or G or E or V or a conservative substitution thereof, X8 = D or G or a conservative substitution thereof, X9 = V or A or a conservative substitution thereof. |
| | SEQ ID NO: 50027 | VH3 | Gln X1 Gly X2 X3 X4 Asp X5, wherein X1 = V or I or M or K or T or a conservative substitution thereof, X2 = W or F or G or M or a conservative substitution thereof, X3 = L or T or S or Y or H or R or a conservative substitution thereof, X4 = D or E or S or F or N or a conservative substitution thereof, X5 = Y or C or a conservative substitution thereof. |
| VH-CONSENSUS-24 TABLE 58 | SEQ ID NO: 50028 | VH1 | X1 X2 X3 X4 Asn, wherein X1 = S or T or a conservative substitution thereof, X2 = Y or F or a conservative substitution thereof, X3 = S or T or G or R or a conservative substitution thereof, X4 = M or L or a conservative substitution thereof. |
| | SEQ ID NO: 50029 | VH2 | X1 Ile Ser X2 Ser X3 X4 X5 X6 X7 Tyr X8 Asp Ser X9 Lys X10, wherein X1 = S or A or C or L or a conservative substitution thereof, X2 = G or S or a conservative substitution thereof, X3 = S or G or T or a conservative substitution thereof, X4 = S or T or G or Y or a conservative substitution thereof, X5 = Y or H or a conservative substitution thereof, X6 = I or L or M or a conservative substitution thereof, X7 = Y or S or W or a conservative substitution thereof, X8 = A or G or P or V or a conservative substitution thereof, X9 = V or L or a conservative substitution thereof, X10 = G or A or a conservative substitution thereof. |
| | SEQ ID NO: 50030 | VH3 | X1 Arg X2 X3 X4 X5 X6 X7, wherein X1 = D or T or a conservative substitution thereof, X2 = G or Absent or S or Y or a conservative substitution thereof, X3 = Absent or G or a conservative substitution thereof, X4 = Absent or S or a conservative substitution thereof, X5 = Absent or F or S or a conservative substitution thereof, X6 = S or D or G or H or a conservative substitution thereof, X7 = S or L or Y or G or T or C or E or I or a conservative substitution thereof. |
| VH-CONSENSUS-25 TABLE 59 | SEQ ID NO: 50031 | VH1 | X1 Tyr X2 Met X3, wherein X1 = S or G or a conservative substitution thereof, X2 = A or V or a conservative substitution thereof, X3 = S or N or T or a conservative substitution thereof. |

FIGURE 55
(Continued)

| | SEQ ID NO: 50032 | VH2 | X1 Ile Ser X2 X3 Gly X4 X5 X6 X7 X8 Ala Asp Ser Val X9 Gly, wherein X1 = V or I or A or a conservative substitution thereof, X2 = G or R or a conservative substitution thereof, X3 = R or S or a conservative substitution thereof, X4 = G or V or I or T or a conservative substitution thereof, X5 = N or Y or S or T or a conservative substitution thereof, X6 = T or A or a conservative substitution thereof, X7 = F or Y or a conservative substitution thereof, X8 = Y or N or S or a conservative substitution thereof, X9 = K or R or a conservative substitution thereof. |
|---|---|---|---|
| | SEQ ID NO: 50033 | VH3 | Arg X1 Ala Val X2 Gly X3 X4 Ala X5 X6 X7, wherein X1 = I or L or M or V or a conservative substitution thereof, X2 = A or D or a conservative substitution thereof, X3 = S or N or Y or a conservative substitution thereof, X4 = E or D or a conservative substitution thereof, X5 = F or C or a conservative substitution thereof, X6 = D or A or H or a conservative substitution thereof, X7 = I or V or a conservative substitution thereof. |
| VH-CONSENSUS-26 TABLE 60 | SEQ ID NO: 50034 | VH1 | X1 X2 X3 Met X4, wherein X1 = S or N or a conservative substitution thereof, X2 = Y or C or a conservative substitution thereof, X3 = A or V or a conservative substitution thereof, X4 = S or N or a conservative substitution thereof. |
| | SEQ ID NO: 50035 | VH2 | X1 X2 Ser X3 X4 Gly Gly X5 X6 X7 X8 Ala Asp Ser X9 Lys Gly, wherein X1 = A or T or S or a conservative substitution thereof, X2 = I or L or a conservative substitution thereof, X3 = G or R or V or a conservative substitution thereof, X4 = R or G or a conservative substitution thereof, X5 = S or N or a conservative substitution thereof, X6 = T or I or a conservative substitution thereof, X7 = F or Y or a conservative substitution thereof, X8 = H or Y or N or a conservative substitution thereof, X9 = V or E or M or a conservative substitution thereof. |
| | SEQ ID NO: 50036 | VH3 | X1 X2 Leu X3 X4 Tyr X5 X6 X7 X8 X9 X10 Asp Val, wherein X1 = G or W or a conservative substitution thereof, X2 = E or G or a conservative substitution thereof, X3 = E or Y or a conservative substitution thereof, X4 = D or S or N or a conservative substitution thereof, X5 = Absent or E or a conservative substitution thereof, X6 = Y or S or a conservative substitution thereof, X7 = F or Y or a conservative substitution thereof, X8 = Y or F or a conservative substitution thereof, X9 = G or A or a conservative substitution thereof, X10 = M or I or L or a conservative substitution thereof. |

FIGURE 55
(Continued)

| | | | |
|---|---|---|---|
| VH-CONSENSUS-27 TABLE 61 | SEQ ID NO: 50037 | VH1 | X1 Tyr X2 X3 X4, wherein X1 = S or G or D or R or H or T or N or a conservative substitution thereof, X2 = G or V or a conservative substitution thereof, X3 = M or L or a conservative substitution thereof, X4 = H or N or a conservative substitution thereof. |
| | SEQ ID NO: 50038 | VH2 | X1 X2 X3 X4 Asp Gly X5 X6 X7 X8 X9 X10 Asp Ser Val Lys X11, wherein X1 = V or L or F or I or D or a conservative substitution thereof, X2 = I or F or a conservative substitution thereof, X3 = W or R or a conservative substitution thereof, X4 = Y or F or a conservative substitution thereof, X5 = S or N or T or a conservative substitution thereof, X6 = N or E or D or K or a conservative substitution thereof, X7 = K or N or T or a conservative substitution thereof, X8 = Y or S or D or N or a conservative substitution thereof, X9 = Y or N or a conservative substitution thereof, X10 = A or V or a conservative substitution thereof, X11 = G or D or a conservative substitution thereof. |
| | SEQ ID NO: 50039 | VH3 | Asp X1 X2 X3 X4 X5 X6 X7 X8 X9 X10 X11 X12 X13 X14 X15 Tyr X16 X17 Asp Val, wherein X1 = R or D or W or N or a conservative substitution thereof, X2 = V or D or R or F or H or a conservative substitution thereof, X3 = Y or S or E or G or F or a conservative substitution thereof, X4 = C or G or E or a conservative substitution thereof, X5 = S or G or a conservative substitution thereof, X6 = S or G or R or N or a conservative substitution thereof, X7 = T or Absent or S or P or a conservative substitution thereof, X8 = S or P or Absent or T or a conservative substitution thereof, X9 = C or Absent or T or a conservative substitution thereof, X10 = Absent or S or H or L or Y or a conservative substitution thereof, X11 = P or Absent or S or Y or a conservative substitution thereof, X12 = Y or Absent or a conservative substitution thereof, X13 = Y or Absent or a conservative substitution thereof, X14 = Y or Absent or a conservative substitution thereof, X15 = Y or F or a conservative substitution thereof, X16 = G or A or a conservative substitution thereof, X17 = M or L or a conservative substitution thereof. |
| VH-CONSENSUS-28 TABLE 62 | SEQ ID NO: 50040 | VH1 | X1 Tyr X2 X3 Asn, wherein X1 = S or N or a conservative substitution thereof, X2 = S or T or K or N or R or a conservative substitution thereof, X3 = M or L or a conservative substitution thereof. |
| | SEQ ID NO: 50041 | VH2 | Ser X1 Ser X2 X3 X4 X5 X6 X7 X8 Tyr X9 Asp Ser Val Lys Gly, wherein X1 = I or L or a conservative substitution thereof, X2 = G or S or a conservative substitution thereof, X3 = S or G or N or T or a conservative substitution thereof, X4 = S or G or D or N or a conservative substitution thereof, X5 = S or T or a conservative substitution thereof, X6 = Y or F or D or L or N or S or a |

FIGURE 55
(Continued)

| | | | |
|---|---|---|---|
| | SEQ ID NO: 50042 | VH3 | conservative substitution thereof, X7 = I or M or T or a conservative substitution thereof, X8 = Y or N or a conservative substitution thereof, X9 = A or T or a conservative substitution thereof. |
| | SEQ ID NO: 50042 | VH3 | Val X1 X2 X3 Asp X4, wherein X1 = A or N or S or a conservative substitution thereof, X2 = S or A or G or T or L or H or N or a conservative substitution thereof, X3 = F or L or M or a conservative substitution thereof, X4 = Y or C or S or a conservative substitution thereof. |
| VH-CONSENSUS-29 TABLE 63 | SEQ ID NO: 50230 | VH1 | Ser X1 X2 Tyr X3 Trp X4, wherein X1 = G or V or a conservative substitution thereof, X2 = D or V or G or S or a conservative substitution thereof, X3 = Y or H or a conservative substitution thereof, X4 = N or S or a conservative substitution thereof. |
| | SEQ ID NO: 50231 | VH2 | X1 X2 X3 X4 Ser Gly Ser Thr Tyr X5 Asn Pro Ser Leu X6 Ser, wherein X1 = Y or N or F or a conservative substitution thereof, X2 = I or L or a conservative substitution thereof, X3 = F or Y or H or a conservative substitution thereof, X4 = Y or H or a conservative substitution thereof, X5 = Y or N or a conservative substitution thereof, X6 = K or R or a conservative substitution thereof. |
| | SEQ ID NO: 50232 | VH3 | Gly Asp Tyr Asp Gly Ser Gly Ser Tyr His X1 Tyr X2 Gly X3 Asp Val, wherein X1 = Y or F or H or a conservative substitution thereof, X2 = Y or H or a conservative substitution thereof, X3 = M or L or a conservative substitution thereof. |
| VH-CONSENSUS-30 TABLE 64 | SEQ ID NO: 50043 | VH1 | X1 X2 X3 Met Ser, wherein X1 = S or N or T or a conservative substitution thereof, X2 = Y or H or a conservative substitution thereof, X3 = A or P or V or a conservative substitution thereof. |
| | SEQ ID NO: 50044 | VH2 | X1 Ile Ser Gly X2 Gly X3 X4 X5 Tyr Tyr Ala Asp Ser Val Lys Gly, wherein X1 = V or A or I or a conservative substitution thereof, X2 = G or S or a conservative substitution thereof, X3 = S or G or T or a conservative substitution thereof, X4 = S or T or A or a conservative substitution thereof, X5 = T or A or a conservative substitution thereof. |
| | SEQ ID NO: 50045 | VH3 | X1 X2 Gly X3 X4 X5 X6 X7 X8 X9 X10 Gly Met Asp, wherein X1 = W or A or a conservative substitution thereof, X2 = R or G or a conservative substitution thereof, X3 = N or T or a conservative substitution thereof, X4 = P or T or a conservative substitution thereof, X5 = T or G or a conservative substitution thereof, X6 = Absent or S or a conservative substitution thereof, X7 = Absent or Y or a conservative substitution thereof, X8 = Absent or Y or a conservative substitution thereof, X9 = D or Y or a conservative substitution thereof. |

FIGURE 55
(Continued)

| | | | |
|---|---|---|---|
| VH-CONSENSUS-31 TABLE 65 | SEQ ID NO: 50253 | VH1 | X1 Tyr Gly X2 His, wherein X1 = S or N or T or a conservative substitution thereof, X2 = M or L or a conservative substitution thereof; [prior row: conservative substitution thereof, X10 = Y or N or S or a conservative substitution thereof.] |
| | SEQ ID NO: 50254 | VH2 | X1 X2 Trp Tyr Asp Gly X3 X4 Lys Tyr X5 Asp Ser Val Lys Gly, wherein X1 = I or V or A or a conservative substitution thereof, X2 = I or M or a conservative substitution thereof, X3 = S or T or a conservative substitution thereof, X4 = N or Y or S or a conservative substitution thereof, X5 = A or G or T or V or a conservative substitution thereof. |
| | SEQ ID NO: 50255 | VH3 | X1 X2 X3 X4 X5 X6 X7 X8 X9 X10 X11 X12, wherein X1 = D or E or a conservative substitution thereof, X2 = H or R or Q or A or G or T or Y or a conservative substitution thereof, X3 = Y or G or F or H or a conservative substitution thereof, X4 = D or I or F or a conservative substitution thereof, X5 = F or V or L or a conservative substitution thereof, X6 = W or G or Absent or a conservative substitution thereof, X7 = S or A or Absent or a conservative substitution thereof, X8 = G or T or E or a conservative substitution thereof, X9 = H or Y or W or F or a conservative substitution thereof, X10 = F or L or S or a conservative substitution thereof, X11 = D or A or C or G or a conservative substitution thereof, X12 = Y or F or S or a conservative substitution thereof. |
| VH-CONSENSUS-32 TABLE 66 | SEQ ID NO: 50233 | VH1 | X1 X2 X3 Trp Ser () wherein X1 = G or V or P or A or D or Y or a conservative substitution thereof, X2 = Y or C or S or P or a conservative substitution thereof, X3 = Y or F or a conservative substitution thereof. |
| | SEQ ID NO: 50234 | VH2 | Glu X1 Asn X2 Ser Gly X3 X4 X5 X6 Asn Pro Ser Leu Lys Ser, wherein X1 = I or S or V or a conservative substitution thereof, X2 = H or I or Q or a conservative substitution thereof, X3 = R or S or a conservative substitution thereof, X4 = T or A or S or a conservative substitution thereof, X5 = N or T or a conservative substitution thereof, X6 = Y or F or a conservative substitution thereof. |
| | SEQ ID NO: 50235 | VH3 | Asp Tyr Gly Gly Leu Asp Tyr. |
| VH-CONSENSUS-33 TABLE 67 | SEQ ID NO: 50046 | VH1 | X1 Ser X2 X3 Tyr Trp Gly, wherein X1 = R or G or a conservative substitution thereof, X2 = S or N or a conservative substitution thereof, X3 = Y or S or a conservative substitution thereof. |
| | SEQ ID NO: 50047 | VH2 | X1 Ile Tyr Tyr Ser Gly X2 X3 X4 X5 X6 Pro Ser Leu Lys Ser, wherein X1 = N or S or a conservative substitution thereof, X2 = S or Y or A or T or I or a conservative |

FIGURE 55
(Continued)

| | | | |
|---|---|---|---|
| | SEQ ID NO: 50048 | VH3 | substitution thereof, X3 = T or A or P or S or a conservative substitution thereof, X4 = Y or Q or S or A or N or a conservative substitution thereof, X5 = Y or C or H or a conservative substitution thereof, X6 = N or I or T or a conservative substitution thereof. |
| VH-CONSENSUS-34 TABLE 68 | SEQ ID NO: 50049 | VH1 | X1 Ser X2 Ser Trp Ser X3 Asp X4, wherein X1 = H or L or a conservative substitution thereof, X2 = S or T or G or a conservative substitution thereof, X3 = L or F or I or V or a conservative substitution thereof, X4 = Y or N or C or D or F or a conservative substitution thereof. |
| | SEQ ID NO: 50050 | VH2 | X1 X2 X3 X4 X5, wherein X1 = G or D or a conservative substitution thereof, X2 = Y or H or a conservative substitution thereof, X3 = Y or F or a conservative substitution thereof, X4 = I or M or a conservative substitution thereof, X5 = H or N or a conservative substitution thereof. |
| | SEQ ID NO: 50051 | VH3 | Trp Ile Asn X1 X2 X3 X4 X5 Thr Asn Tyr X6 X7 Lys Phe Gln X8, wherein X1 = P or S or a conservative substitution thereof, X2 = N or K or a conservative substitution thereof, X3 = S or N or a conservative substitution thereof, X4 = G or D or a conservative substitution thereof, X5 = G or D or a conservative substitution thereof, X6 = A or E or a conservative substitution thereof, X7 = Q or E or a conservative substitution thereof, X8 = G or D or a conservative substitution thereof. |
| | SEQ ID NO: 50051 | VH3 | X1 X2 X3 X4 X5 X6 X7 X8 X9 X10 X11 X12 X13 X14 X15, wherein X1 = G or D or a conservative substitution thereof, X2 = Y or G or T or F or a conservative substitution thereof, X3 = S or Y or D or R or a conservative substitution thereof, X4 = Y or S or a conservative substitution thereof, X5 = G or Absent or S or a conservative substitution thereof, X6 = Y or S or Absent or a conservative substitution thereof, X7 = Absent or G or a conservative substitution thereof, X8 = Absent or S or a conservative substitution thereof, X9 = Absent or Y or a conservative substitution thereof, X10 = Absent or Y or F or H or a conservative substitution thereof, X11 = N or Absent or D or a conservative substitution thereof, X12 = W or Absent or D or E or a conservative substitution thereof, X13 = F or L or a conservative substitution thereof, X14 = D or A or a conservative substitution thereof, X15 = P or S or a conservative substitution thereof. |
| VH-CONSENSUS-35 TABLE 69 | SEQ ID NO: 50052 | VH1 | X1 X2 Gly Met His, wherein X1 = H or N or a conservative substitution thereof, X2 = Y or S or a conservative substitution thereof. |
| | SEQ ID NO: 50053 | VH2 | X1 Ile X2 Tyr Asp Gly Ser X3 X4 X5 Tyr Ala Asp Ser Val Lys Gly, wherein X1 = V or I or a conservative substitution thereof, X2 = W or Y or a conservative substitution thereof. |

FIGURE 55
(Continued)

| | | | |
|---|---|---|---|
| | SEQ ID NO: 50054 | VH3 | X3 = N or Y or a conservative substitution thereof, X4 = K or E or a conservative substitution thereof, X5 = Y or C or N or a conservative substitution thereof. |
| | | | X1 X2 X3 X4 X5 X6 X7 X8 X9 X10 X11 X12 X13 X14 Gly X15 Asp Val, wherein X1 = G or D or a conservative substitution thereof, X2 = D or R or a conservative substitution thereof, X3 = W or H or a conservative substitution thereof, X4 = N or Y or a conservative substitution thereof, X5 = P or D or a conservative substitution thereof, X6 = Absent or F or a conservative substitution thereof, X7 = Absent or H or a conservative substitution thereof, X8 = Absent or V or a conservative substitution thereof, X9 = Absent or P or a conservative substitution thereof, X10 = Absent or Y or a conservative substitution thereof, X11 = Absent or Y or a conservative substitution thereof, X12 = Absent or Y or a conservative substitution thereof, X13 = Absent or Y or a conservative substitution thereof, X14 = E or Y or a conservative substitution thereof, X15 = M or L or a conservative substitution thereof. |
| VH-CONSENSUS-36 TABLE 70 | SEQ ID NO: 50055 | VH1 | Ser X1 Ala Met X2, wherein X1 = Y or S or a conservative substitution thereof, X2 = S or T or N or a conservative substitution thereof. |
| | SEQ ID NO: 50056 | VH2 | X1 Ile X2 Gly X3 Gly X4 X5 X6 X7 Tyr Ala Asp Ser Val Lys Gly, wherein X1 = A or V or a conservative substitution thereof, X2 = S or I or a conservative substitution thereof, X3 = S or R or N or F or a conservative substitution thereof, X4 = G or S or a conservative substitution thereof, X5 = N or R or S or a conservative substitution thereof, X6 = T or A or a conservative substitution thereof, X7 = F or Y or a conservative substitution thereof. |
| | SEQ ID NO: 50057 | VH3 | X1 X2 X3 X4 X5 X6 X7 X8 X9 X10 X11 X12 Phe Asp Tyr, wherein X1 = K or D or R or a conservative substitution thereof, X2 = D or Y or H or M or R or a conservative substitution thereof, X3 = Y or G or N or a conservative substitution thereof, X4 = D or I or R or Y or a conservative substitution thereof, X5 = Y or Absent or S or V or a conservative substitution thereof, X6 = V or Absent or G or R or S or a conservative substitution thereof, X7 = W or Absent or I or a conservative substitution thereof, X8 = Absent or A or a conservative substitution thereof, X9 = G or Absent or V or a conservative substitution thereof, X10 = S or Absent or A or T or Y or a conservative substitution thereof, X11 = P or Absent or G or I or a conservative substitution thereof, X12 = Y or F or T or a conservative substitution thereof. |

FIGURE 55
(Continued)

| | | | |
|---|---|---|---|
| VH-CONSENSUS-37 TABLE 71 | SEQ ID NO: 50058 | VH1 | X1 X2 X3 X4 His, wherein X1 = G or D or a conservative substitution thereof, X2 = Y or H or a conservative substitution thereof, X3 = Y or C or a conservative substitution thereof, X4 = M or I or a conservative substitution thereof. |
| | SEQ ID NO: 50059 | VH2 | X1 Ile X2 X3 X4 Ser Gly X5 X6 X7 X8 X9 Gln Lys Phe Gln X10, wherein X1 = W or S or a conservative substitution thereof, X2 = N or Y or a conservative substitution thereof, X3 = F or R or a conservative substitution thereof, X4 = N or K or a conservative substitution thereof, X5 = G or A or a conservative substitution thereof, X6 = T or A or a conservative substitution thereof, X7 = N or D or a conservative substitution thereof, X8 = Y or N or S or a conservative substitution thereof, X9 = A or G or V or a conservative substitution thereof, X10 = Q or D or V or a conservative substitution thereof. |
| | SEQ ID NO: 50060 | VH3 | X1 X2 Tyr X3 Gly Ser Gly X4 Tyr X5 Asn X6 Phe Asp Tyr, wherein X1 = S or A or V or T or a conservative substitution thereof, X2 = Y or F or N or a conservative substitution thereof, X3 = Y or H or a conservative substitution thereof, X4 = S or T or a conservative substitution thereof, X5 = Y or H or a conservative substitution thereof, X6 = E or G or D or a conservative substitution thereof. |
| VH-CONSENSUS-38 TABLE 72 | SEQ ID NO: 50061 | VH1 | Gly Tyr Tyr X1 His, wherein X1 = I or T or a conservative substitution thereof. |
| | SEQ ID NO: 50062 | VH2 | Trp Ile Asn Pro Tyr Ser Gly X1 Thr X2 X3 Ala Gln Lys Phe Gln Gly, wherein X1 = D or G or a conservative substitution thereof, X2 = N or K or a conservative substitution thereof, X3 = Y or S or a conservative substitution thereof. |
| | SEQ ID NO: 50236 | VH3 | Asp Trp Gly Gly Tyr Ser Ser Tyr Tyr X1 Gly Met Asp Val, wherein X1 = Y or F or a conservative substitution thereof. |
| VH-CONSENSUS-39 TABLE 73 | SEQ ID NO: 50063 | VH1 | X1 X2 X3 Met X4, wherein X1 = S or T or a conservative substitution thereof, X2 = Y or F or a conservative substitution thereof, X3 = S or T or N or G or a conservative substitution thereof, X4 = N or S or I or a conservative substitution thereof. |
| | SEQ ID NO: 50064 | VH2 | Ser Ile Ser X1 X2 X3 X4 Tyr X5 X6 Tyr X7 Asp Ser Val Lys Gly, wherein X1 = G or S or a conservative substitution thereof, X2 = S or T or a conservative substitution thereof, X3 = S or I or N or a conservative substitution thereof, X4 = S or N or T or Y or a conservative substitution thereof, X5 |

FIGURE 55
(Continued)

| | | | |
|---|---|---|---|
| | SEQ ID NO: 50065 | VH3 | = I or M or S or a conservative substitution thereof, X6 = Y or N or a conservative substitution thereof, X7 = A or T or a conservative substitution thereof. Leu Thr Phe Asp Tyr. |
| VH-CONSENSUS-40 TABLE 74 | SEQ ID NO: 50066 | VH1 | X1 Tyr Gly Met His, wherein X1 = T or S or a conservative substitution thereof. |
| | SEQ ID NO: 50067 | VH2 | X1 Ile Trp Tyr Asp Gly X2 Asn Lys Tyr Tyr Ala Asp Ser Val X3 Gly, wherein X1 = I or V or a conservative substitution thereof, X2 = T or S or a conservative substitution thereof, X3 = K or R or a conservative substitution thereof. |
| | SEQ ID NO: 50068 | VH3 | Asp Pro Leu Arg Gly Tyr Asn Asp Pro Val X1 Asp Tyr, wherein X1 = M or L or a conservative substitution thereof. |
| VH-CONSENSUS-41 TABLE 75 | SEQ ID NO: 50069 | VH1 | X1 Tyr Ala Met X2, wherein X1 = S or N or a conservative substitution thereof, X2 = S or N or T or a conservative substitution thereof. |
| | SEQ ID NO: 50070 | VH2 | Ala Ile Ser Gly X1 Gly X2 Asn Thr Phe Tyr Ala Asp Ser Val Lys Gly, wherein X1 = R or S or a conservative substitution thereof, X2 = G or K or a conservative substitution thereof. |
| | SEQ ID NO: 50071 | VH3 | Arg Val Thr Asp Tyr Gly Asn Asp Trp Phe Asp Pro. |
| VH-CONSENSUS-42 TABLE 76 | SEQ ID NO: 50072 | VH1 | X1 Tyr Gly Met His, wherein X1 = T or S or a conservative substitution thereof. |
| | SEQ ID NO: 50073 | VH2 | Val X1 Trp Tyr X2 Gly X3 X4 X5 X6 X7 X8 Asp Ser Val X9 Gly, wherein X1 = I or V or a conservative substitution thereof, X2 = G or D or a conservative substitution thereof, X3 = S or N or a conservative substitution thereof, X4 = N or D or S or a conservative substitution thereof, X5 = K or T or a conservative substitution thereof, X6 = D or Y or S or a conservative substitution thereof, X7 = Y or F or a conservative substitution thereof, X8 = A or V or a conservative substitution thereof, X9 = K or R or T or a conservative substitution thereof. |
| | SEQ ID NO: 50074 | VH3 | Asp Arg X1 X2 Cys Ser Gly X3 X4 Cys Pro Tyr Tyr Tyr Tyr Gly Met Asp Val, wherein X1 = D or V or a conservative substitution thereof, X2 = Y or F or a conservative substitution thereof, X3 = G or T or a conservative substitution thereof, X4 = S or T or N or a conservative substitution thereof. |

FIGURE 55
(Continued)

| | | | |
|---|---|---|---|
| VH-CONSENSUS-43 TABLE 77 | SEQ ID NO: 50075 | VH1 | Arg Ser Ser Tyr Tyr Trp Gly |
| | SEQ ID NO: 50076 | VH2 | Asn Ile Tyr Tyr X1 Gly X2 X3 Tyr X4 Asn Pro Ser X5 Lys X6, wherein X1 = S or G or a conservative substitution thereof, X2 = S or T or N or a conservative substitution thereof, X3 = T or A or a conservative substitution thereof, X4 = Y or N or D or H or T or a conservative substitution thereof, X5 = L or V or a conservative substitution thereof, X6 = S or G or a conservative substitution thereof. |
| | SEQ ID NO: 50077 | VH3 | His Gly Lys Asp Trp Gly Leu Asp X1, wherein X1 = Y or F or N or a conservative substitution thereof. |
| VH-CONSENSUS-44 TABLE 78 | SEQ ID NO: 50078 | VH1 | Gly Tyr Tyr X1 His, wherein X1 = M or I or a conservative substitution thereof. |
| | SEQ ID NO: 50079 | VH2 | Trp Ile X1 Pro X2 Ser Gly Gly Thr Asn X3 X4 Gln Lys Phe Gln Gly, wherein X1 = K or N or a conservative substitution thereof, X2 = N or K or a conservative substitution thereof, X3 = Q or S or H or N or Y or a conservative substitution thereof, X4 = A or V or a conservative substitution thereof. |
| | SEQ ID NO: 50080 | VH3 | Ala Pro Gly X1 X2 X3 X4 Gly X5 Trp Gly X6 Phe Asp Tyr, wherein X1 = T or K or I or a conservative substitution thereof, X2 = A or V or a conservative substitution thereof, X3 = A or P or a conservative substitution thereof, X4 = A or T or a conservative substitution thereof, X5 = T or S or a conservative substitution thereof, X6 = Y or F or C or a conservative substitution thereof. |
| VH-CONSENSUS-45 TABLE 79 | SEQ ID NO: 50081 | VH1 | Thr X1 Gly Val Gly Val Gly, wherein X1 = G or S or a conservative substitution thereof. |
| | SEQ ID NO: 50082 | VH2 | X1 Ile Tyr Trp X2 Asp Asp X3 Arg Tyr Ser Pro Ser Leu X4 Ser, wherein X1 = L or F or a conservative substitution thereof, X2 = D or H or N or K or S or a conservative substitution thereof, X3 = K or E or a conservative substitution thereof, X4 = K or R or a conservative substitution thereof. |
| | SEQ ID NO: 50083 | VH3 | X1 X2 Ala Val X3 X4 Asp Tyr, wherein X1 = L or I or A or a conservative substitution thereof, X2 = L or V or A or a conservative substitution thereof, X3 = A or S or a conservative substitution thereof, X4 = F or C or a conservative substitution thereof. |
| VH-CONSENSUS-46 TABLE 80 | SEQ ID NO: 50084 | VH1 | X1 Tyr Gly Met His () wherein X1 = S or N or T or a conservative substitution thereof. |

FIGURE 55
(Continued)

| | SEQ ID NO: 50085 | VH2 | X1 Ile Trp Tyr Asp Gly Ser X2 Lys Tyr Tyr X3 Asp Ser Val Lys Gly, wherein X1 = I or V or a conservative substitution thereof, X2 = Y or N or a conservative substitution thereof, X3 = A or V or a conservative substitution thereof. |
|---|---|---|---|
| | SEQ ID NO: 50086 | VH3 | Glu X1 Tyr Asp Phe Trp Ser Gly X2 X3 X4 X5, wherein X1 = A or G or R or N or a conservative substitution thereof, X2 = Y or F or H or a conservative substitution thereof, X3 = F or L or Y or W or a conservative substitution thereof, X4 = D or G or a conservative substitution thereof, X5 = Y or S or a conservative substitution thereof. |
| VH-CONSENSUS-47 TABLE 81 | SEQ ID NO: 50087 | VH1 | Ser Tyr Gly X1 His, wherein X1 = M or L or a conservative substitution thereof. |
| | SEQ ID NO: 50088 | VH2 | Val Ile Trp Tyr Asp Gly Ser Asn Lys X1 Tyr X2 Asp Ser Val Lys Gly, wherein X1 = Y or N or a conservative substitution thereof, X2 = A or E or a conservative substitution thereof. |
| | SEQ ID NO: 50089 | VH3 | X1 X2 X3 Tyr X4 X5 X6 X7 X8 X9 X10 X11 X12 Gly Met Asp Val, wherein X1 = D or W or a conservative substitution thereof, X2 = R or G or Y or a conservative substitution thereof, X3 = D or S or Y or a conservative substitution thereof, X4 = G or Y or a conservative substitution thereof, X5 = D or Y or a conservative substitution thereof, X6 = Absent or P or a conservative substitution thereof, X7 = Absent or P or a conservative substitution thereof, X8 = Absent or Y or a conservative substitution thereof, X9 = Absent or Y or a conservative substitution thereof, X10 = Absent or Y or a conservative substitution thereof, X11 = Absent or Y or a conservative substitution thereof, X12 = Y or D or a conservative substitution thereof. |
| VH-CONSENSUS-48 TABLE 82 | | VH1 | X1 X2 X3 Met X4 (SEQ ID NO: 50090) wherein X1 = S or N or T or a conservative substitution thereof, X2 = Y or S or a conservative substitution thereof, X3 = A or V or a conservative substitution thereof, X4 = S or T or N or a conservative substitution thereof. |
| | | VH2 | X1 X2 X3 Gly X4 Gly X5 X6 Thr X7 X8 X9 Ser Val X10 Gly (SEQ ID NO: 50091) wherein X1 = A or G or a conservative substitution thereof, X2 = I or S or V or a conservative substitution thereof, X3 = S or V or a conservative substitution thereof, X4 = S or R or a conservative substitution thereof, X5 = G or A or S or V or a conservative substitution thereof, X6 = N or R or K or a conservative substitution thereof, X7 = F or Y or a conservative substitution thereof, X8 = Y or N or a |

FIGURE 55
(Continued)

| | | | |
|---|---|---|---|
| | | VH3 | conservative substitution thereof, X9 = A or T or a conservative substitution thereof, X10 = K or T or a conservative substitution thereof. |
| | | VH3 | X1 X2 X3 X4 X5 X6 X7 X8 Gly X9 Asp Val (SEQ ID NO: 50092) wherein X1 = L or D or E or a conservative substitution thereof, X2 = G or R or a conservative substitution thereof, X3 = K or G or L or a conservative substitution thereof, X4 = D or Q or Y or a conservative substitution thereof, X5 = Y or W or a conservative substitution thereof, X6 = Y or H or L or a conservative substitution thereof, X7 = Y or Absent or I or L or a conservative substitution thereof, X8 = Y or G or a conservative substitution thereof, X9 = M or V or a conservative substitution thereof. |
| VH-CONSENSUS-49 TABLE 83 | | VH1 | Ser Tyr X1 Met X2 (SEQ ID NO: 50093) wherein X1 = V or A or a conservative substitution thereof, X2 = S or N or a conservative substitution thereof. |
| | | VH2 | X1 X2 Ser Gly X3 X4 Tyr X5 Tyr Ala Asp Ser Val X6 X7 (SEQ ID NO: 50094) wherein X1 = A or G or T or S or a conservative substitution thereof, X2 = M or I or T or a conservative substitution thereof, X3 = G or N or V or a conservative substitution thereof, X4 = R or N or W or a conservative substitution thereof, X5 = Y or F or N or a conservative substitution thereof, X6 = K or N or a conservative substitution thereof, X7 = G or D or a conservative substitution thereof. |
| | | VH3 | X1 X2 X3 X4 X5 X6 X7 X8 X9 X10 X11 X12 (SEQ ID NO: 50095) wherein X1 = L or V or Y or F or a conservative substitution thereof, X2 = T or E or F or G or a conservative substitution thereof, X3 = A or G or L or W or Absent or F or a conservative substitution thereof, X4 = Absent or G or M or a conservative substitution thereof, X5 = Absent or V or a conservative substitution thereof, X6 = Absent or G or a conservative substitution thereof, X7 = Absent or A or a conservative substitution thereof, X8 = Absent or G or a conservative substitution thereof, X9 = Absent or I or F or a conservative substitution thereof, X10 = F or N or Absent or a conservative substitution thereof, X11 = D or G or I or a conservative substitution thereof, X12 = Y or D or a conservative substitution thereof. |
| VH-CONSENSUS-50 TABLE 84 | | VH1 | X1 Tyr Gly X2 His (SEQ ID NO: 50096) wherein X1 = S or Y or a conservative substitution thereof, X2 = M or L or a conservative substitution thereof. |
| | | VH2 | X1 Ile Ser Tyr X2 Gly X3 Asn X4 X5 X6 Ala Asp Ser Val Lys Gly (SEQ ID NO: 50097) wherein X1 = I or V or a conservative substitution thereof, X2 = A or G or D or S or V or a conservative substitution thereof, X3 = S or I or N or R or T or a conservative substitution thereof, X4 = K or N or |

FIGURE 55
(Continued)

| | | |
|---|---|---|
| | VH3 | or Q or a conservative substitution thereof, X5 = Y or S or D or H or a conservative substitution thereof, X6 = Y or S or a conservative substitution thereof. |
| VH-CONSENSUS-51 TABLE 85 | VH1 | X1 X2 X3 X4 X5 X6 X7 X8 X9 X10 X11 X12 X13 X14 X15 Tyr Gly Met Asp Val (SEQ ID NO: 50098) wherein X1 = R or E or a conservative substitution thereof, X2 = G or D or a conservative substitution thereof, X3 = Y or R or a conservative substitution thereof, X4 = S or Y or a conservative substitution thereof, X5 = Y or C or a conservative substitution thereof, X6 = G or S or a conservative substitution thereof, X7 = Absent or G or a conservative substitution thereof, X8 = Absent or T or a conservative substitution thereof, X9 = Absent or S or a conservative substitution thereof, X10 = Absent or C or a conservative substitution thereof, X11 = Absent or P or a conservative substitution thereof, X12 = Absent or Y or a conservative substitution thereof, X13 = Absent or Y or a conservative substitution thereof, X14 = Absent or Y or a conservative substitution thereof, X15 = G or Y or a conservative substitution thereof. |
| | VH1 | X1 X2 X3 Met X4 (SEQ ID NO: 50099) wherein X1 = D or S or a conservative substitution thereof, X2 = Y or G or a conservative substitution thereof, X3 = V or G or a conservative substitution thereof, X4 = H or Q or a conservative substitution thereof. |
| | VH2 | X1 Ile Trp Tyr Asp Gly Ser Asn Lys Tyr Tyr Ala Asp Ser Val Lys X2 (SEQ ID NO: 50100) wherein X1 = V or I or a conservative substitution thereof, X2 = G or V or a conservative substitution thereof. |
| | VH3 | Gln X1 Tyr X2 Ser Gly Trp X3 Asp Tyr Gly X4 Asp Val (SEQ ID NO: 50101) wherein X1 = P or R or a conservative substitution thereof, X2 = T or N or a conservative substitution thereof, X3 = Y or H or a conservative substitution thereof, X4 = M or L or a conservative substitution thereof. |
| VH-CONSENSUS-52 TABLE 86 | VH1 | Ser Tyr Gly X1 Ser (SEQ ID NO: 50102) wherein X4 = I or F or Y or a conservative substitution thereof. |
| | VH2 | Trp Ile Ser Ala Tyr Asn Gly Asn X1 Lys X2 Ala Gln X3 X4 Gln Gly (SEQ ID NO: 50103) wherein X1 = T or R or a conservative substitution thereof, X2 = Y or N or F or F or a conservative substitution thereof, X3 = K or R or a conservative substitution thereof, X4 = L or F or a conservative substitution thereof. |
| | VH3 | His Asp Phe Trp Ser Gly Tyr Tyr Lys Gly Met Asp Val (SEQ ID NO: 50227). |

FIGURE 55
(Continued)

| | | |
|---|---|---|
| VH-CONSENSUS-53 TABLE 87 | VH1 | X1 Ser X2 Ala Met Ser (SEQ ID NO: 50104) wherein X1 = S or R or a conservative substitution thereof, X2 = Y or S or a conservative substitution thereof. |
| | VH2 | X1 Ile Ser Gly X2 Gly X3 X4 Thr Phe X5 X6 Asp Ser Val Lys Gly (SEQ ID NO: 50105) wherein X1 = A or V or S or a conservative substitution thereof, X2 = R or S or a conservative substitution thereof, X3 = G or I or V or a conservative substitution thereof, X4 = N or S or a conservative substitution thereof, X5 = D or Y or a conservative substitution thereof, X6 = A or T or a conservative substitution thereof. |
| | VH3 | X1 X2 Ser X3 X4 X5 Phe Asp Tyr (SEQ ID NO: 50106) wherein X1 = E or S or a conservative substitution thereof, X2 = R or N or a conservative substitution thereof, X3 = G or S or a conservative substitution thereof, X4 = S or G or a conservative substitution thereof, X5 = Y or W or a conservative substitution thereof. |
| VH-CONSENSUS-54 TABLE 88 | VH1 | X1 Tyr X2 Met His (SEQ ID NO: 50107) wherein X1 = S or N or Y or H or a conservative substitution thereof, X2 = V or G or a conservative substitution thereof. |
| | VH2 | X1 Ile Trp X2 Asp Gly X3 X4 X5 Tyr Tyr X6 Asp Ser Val Lys Gly (SEQ ID NO: 50108) wherein X1 = V or L or a conservative substitution thereof, X2 = H or Y or a conservative substitution thereof, X3 = S or T or a conservative substitution thereof, X4 = N or D or a conservative substitution thereof, X5 = K or A or a conservative substitution thereof, X6 = A or V or G or a conservative substitution thereof. |
| | VH3 | Glu Asn Ser Ser X1 Tyr Phe Asp Tyr Trp Gly Gln Gly Thr Leu Val Thr Val Ser Ser (SEQ ID NO: 50109) wherein X1 = Y or F or a conservative substitution thereof. |
| VH-CONSENSUS-55 TABLE 89 | VH1 | Thr Ser Gly Val Gly Val Gly (SEQ ID NO: 50110). |
| | VH2 | Leu Ile Asn Trp Asn Asp Asp Lys Arg X1 Ser Pro Ser Leu Lys Ser (SEQ ID NO: 50111) wherein X1 = Y or F or a conservative substitution thereof. |
| | VH3 | Lys X1 Thr Trp Val Ala Phe Asp Ile (SEQ ID NO: 50112) wherein X1 = A or T or a conservative substitution thereof. |
| VH-CONSENSUS-56 TABLE 90 | VH1 | Ser Tyr X1 X2 X3 (SEQ ID NO: 50113) wherein X1 = V or A or a conservative substitution thereof, X2 = M or I or L or a conservative substitution thereof, X3 = N or S or R or a conservative substitution thereof. |
| | VH2 | X1 X2 Ser Gly Ser Gly X3 X4 Thr Tyr X5 Asp Ser Val Lys Gly (SEQ ID NO: 50114) wherein X1 = A or D or a conservative substitution thereof, X2 = I or M or a conservative substitution thereof, X3 = G or D or V or a conservative substitution thereof, X4 = R or S or F or T or a conservative substitution thereof. |

FIGURE 55
(Continued)

| | | |
|---|---|---|
| | VH3 | conservative substitution thereof, X5 = A or V or a conservative substitution thereof. |
| | | Thr X1 X2 X3 X4 X5 (SEQ ID NO: 50115) wherein X1 = A or G or S or T or Y or a conservative substitution thereof, X2 = T or V or Absent or H or L or G or a conservative substitution thereof, X3 = F or Absent or K or a conservative substitution thereof, X4 = D or Absent or a conservative substitution thereof, X5 = Y or L or a conservative substitution thereof. |
| VH-CONSENSUS-57 TABLE 91 | VH1 | Ser X1 Ala Met X2 (SEQ ID NO: 50116) wherein X1 = Y or F or a conservative substitution thereof, X2 = S or N or a conservative substitution thereof. |
| | VH2 | X1 X2 Ser Gly X3 Gly X4 X5 Thr Ala Asp Ser Val Lys Gly (SEQ ID NO: 50117) wherein X1 = V or A or I or a conservative substitution thereof, X2 = I or L or a conservative substitution thereof, X3 = R or S or G or a conservative substitution thereof, X4 = G or S or K or a conservative substitution thereof, X5 = T or N or S or a conservative substitution thereof, X6 = F or Y or a conservative substitution thereof. |
| | VH3 | Lys Arg Thr X1 X2 Asp X3 Phe Asp X4 (SEQ ID NO: 50118) wherein X1 = P or G or a conservative substitution thereof, X2 = S or D or E or a conservative substitution thereof, X3 = V or A or a conservative substitution thereof, X4 = I or V or a conservative substitution thereof. |
| VH-CONSENSUS-58 TABLE 92 | VH1 | X1 X2 X3 Met His (SEQ ID NO: 50237) wherein X1 = S or N or T or a conservative substitution thereof, X2 = Y or F or a conservative substitution thereof, X3 = G or D or N or a conservative substitution thereof. |
| | VH2 | X1 Ile Trp X2 Asp Gly X3 X4 X5 Tyr X6 X7 Asp Ser Val Lys Gly (SEQ ID NO: 50238) wherein X1 = V or A or a conservative substitution thereof, X2 = Y or H or a conservative substitution thereof, X3 = S or R or a conservative substitution thereof, X4 = N or D or H or a conservative substitution thereof, X5 = K or R or a conservative substitution thereof, X6 = Y or C or S or a conservative substitution thereof, X7 = A or E or T or a conservative substitution thereof. |
| | VH3 | Asp X1 X2 X3 X4 X5 X6 X7 X8 X9 Asp X10 (SEQ ID NO: 50239) wherein X1 = R or D or H or a conservative substitution thereof, X2 = P or S or A or a conservative substitution thereof, X3 = I or R or Y or a conservative substitution thereof, X4 = S or L or V or W or a conservative substitution thereof, X5 = Absent or G or a conservative substitution thereof, X6 = Absent or A or a conservative substitution thereof, X7 = S or T or A or a conservative substitution thereof, X8 = A or F or S or Y or a conservative substitution thereof, X9 = P or G or S or a conservative substitution thereof. |

FIGURE 55
(Continued)

| | | |
|---|---|---|
| VH-CONSENSUS-59 TABLE 93 | VH1 | X1 Tyr X2 Met Asn (SEQ ID NO: 50240) weherein X1 = S or N or a conservative substitution thereof, X2 = N or S or a conservative substitution thereof. ... conservative substitution thereof, X10 = Y or F or a conservative substitution thereof. |
| | VH2 | Tyr Ile Ser X1 Ser X2 X3 Thr X4 X5 Tyr X6 Asp Ser Val X7 Gly (SEQ ID NO: 50241) wherein X1 = S or G or a conservative substitution thereof, X2 = S or G or a conservative substitution thereof, X3 = N or S or a conservative substitution thereof, X4 = K or T or a conservative substitution thereof, X5 = Y or H or a conservative substitution thereof, X6 = A or V or a conservative substitution thereof, X7 = K or R or E or Q or a conservative substitution thereof. |
| | VH3 | Asp X1 X2 X3 X4 X5 X6 X7 X8 X9 Tyr Tyr Gly X10 Asp Val (SEQ ID NO: 50242) wherein X1 = R or S or a conservative substitution thereof, X2 = S or R or a conservative substitution thereof, X3 = G or K or a conservative substitution thereof, X4 = S or G or a conservative substitution thereof, X5 = Y or F or a conservative substitution thereof, X6 = G or Absent or a conservative substitution thereof, X7 = Y or Absent or a conservative substitution thereof, X8 = F or Absent or a conservative substitution thereof, X9 = Y or Absent or a conservative substitution thereof, X10 = L or M or a conservative substitution thereof. |
| VH-CONSENSUS-60 TABLE 94 | VH1 | Ser Gly Gly Asp Tyr Tyr Trp Ser (SEQ ID NO: 50119) |
| | VH2 | Tyr Ile Tyr Tyr Ser Gly X1 Thr Tyr Tyr Asn Pro Ser Leu Lys Ser (SEQ ID NO: 50120) wherein X1 = S or I or P or a conservative substitution thereof. |
| | VH3 | Asp X1 X2 X3 X4 Gly Met Asp Val (SEQ ID NO: 50121) wherein X1 = S or G or H or a conservative substitution thereof, X2 = S or A or a conservative substitution thereof, X3 = S or L or R or a conservative substitution thereof, X4 = Y or R or H or a conservative substitution thereof. |

FIGURE 55
(Continued)

Table 20A

VARIABLE LIGHT CDR CONSENSUS SEQUENCES I

| NAME (ORIGINAL AND PATENT) | Patent SEQ ID NO: | SEQUENCE |
|---|---|---|
| VL-Consensus-1 (Table 35) (generated from 13 light chain sequences) | SEQ ID NO: 50366 | DIQMTQSPSSVSASVGDRVTITCRASQGISRMLAWY QQKPGKAPKLLIYAASSLQSGVPSRFSGSGSGTDFTL TISSLQPEDFATYYCQQANSFPFIFGPGTKVDIKR |
| VL-Consensus-2 (Table 36) (generated from 11 light chain sequences) | SEQ ID NO: 50367 | SYELTQPPSVSVSPGQTASITCSGDKLGDKYAYWYQ QKPGQSPVLVIYQDRKRPSGIPERFSGSNSGNTATLTI SGTQAMDEADYYCQAWDNSTVVFGGGTKLTVLGG |
| VL-Consensus-3 (Table 37) (generated from 15 light chain sequences) | SEQ ID NO: 50368 | DIVMTQSPDSLAVSLGERATINCKSSQSVLYSSNNNN YLAWYQQKPGQPPKLLIYWASTRESGVPDRFSGSGS GTDFTLTISSLQAEDVAVYYCQQYYSTPFTFGQGTK VEIKR |
| VL-Consensus-4 (Table 38) (generated from 23 light chain sequences) | SEQ ID NO: 50369 | DIQMTQSPSSLSASVGDRVTITCRASQGISNYLAWFQ QKPGKAPKSLIYAASSLQSGVPSKFSGSGSGTDFTLTI SSLQPEDFATYYCQQYNSXPETFGPGTKVDIKR |
| VL-Consensus 5 (Table 39) (generated from 17 light chain sequences) | SEQ ID NO: 50370 | DIQMTQSPSSLSASVGDRVTITCRASQGIRNNLGWY QQKPGKAPKRLIYAASSLQSGVPSRFSGSGSGTEFTL TISSLQPEDFATYYCLQYNSYPLTFGQGTKVEIKR |
| VL-Consensus 6 (Table 40) (generated from 11 light chain sequences) | SEQ ID NO: 50371 | DIQMTQSPSSLSASVGDRVTITCRASQGISNYLAWFQ QKPGKAPKSLIYAASSLQSGVPSKFSGSGSGTDFTLTI SSLQPEDFATYYCQQYNSXPETFGPGTKVDIKR |
| VL-Consensus 7 (kappa) (Table 41) (generated from 26 light chain sequences) | SEQ ID NO: 50372 | DIQMTQSPSSLSASVGDRVTITCRASQDIRSDLGWYQ QKPGKAPKRLIYAASSLQSGVPSRFSGSGSGTEFTLTI SSLQPEDFATYYCLQHTYPLTFGGGTKVEIKR |
| VL-Consensus 7 (lambda) (Table 41) (generated from 26 light chain sequences) | SEQ ID NO: 50373 | QSXLTQPXSXSGSPGQSITISCTGTSSDVGXXNXSW YQQHPGKAPKLMIYEVSNRPSGVXXRFSGSKSGNTA SLTISGLQXEDEADYYCSSYTXSXTVYFGGGTKLFV LG |
| VL-Consensus-8 (Table 42) (generated from 25 light chain sequences) | SEQ ID NO: 50374 | DIQMTQSPSSLSASVGDRVTITCRASQSISSYLNWYQ QKPGKAPKLLIYAASSLQSGVPSRFSGSGSGTDFTLTI SSLQPEDFATYYCQQSYRTPLFTFGPGTKVDIKR |

FIGURE 55
(Continued)

| | | |
|---|---|---|
| VL-Consensus-9 (Table 43) (generated from 14 light chain sequences) | SEQ ID NO: 50375 | DIQMTQSPSSLSASVGDRVTITCRASQSHSYLNWYQ QKPGKAPKLLIYTASSLQSGVPSRFSGSGSGTDFTLTI SSLQPEDFATYYCQQTYSTPLTFGGGTKVEIKR |
| VL-Consensus-10 (Table 44) (generated from 22 light chain sequences) | SEQ ID NO: 50376 | DIQMTQSPSSLSASVGDRVTITCRASQGIRNDLGWY QQKPGKAPKRLIYAASSLQSGVPSRFSGSGSGTEFTL TISSLQPEDFATYYCLQHYSYPRTFGQGTKVEIKR |
| VL-Consensus-11 (Table 45) (generated from 16 light chain sequences) | SEQ ID NO: 50377 | DIQMTQSPSSLSASVGDRVTITCRASQGIRNDLGWY QQKPGKAPKRLIYAASSLQSGVPSRFSGSGSGTEFTL TISSLQPEDFATYYCLQHNSYPETFGXGTKVEIKR |
| VL-Consensus-12 (Table 46) (generated from 71 light chain sequences) | SEQ ID NO: 50378 | DIQMTQSPSSLSASVGDRVTITCRASQGIRNDLGWY QQKPGKAPKRLIYAASSLQSGVPSRFSGSGSGTEFTL TISSLQPEDFATYYCLQHNSYPLIFGGGTKVEIKR |
| VL-Consensus-13 (Table 47) (generated from 21 light chain sequences) | SEQ ID NO: 50379 | DIQMTQSPSSLSASVGDRVTITCRASQGIRNDLGWY QQKPGKAPKRLIYAASSLQSGVPSRFSGSGSGTEFTL TISSLQPEDFATYYCLQHSSYPLIFGGGTKVEIKR |
| VL-Consensus-14 (Table 48) (generated from 13 light chain sequences) | SEQ ID NO: 50380 | DIQMTQSPSSLSASVGDRVTITCRASQGIRNDLGWY QQKPGKAPKRLIYAASSLQSGVPSRFSGSGSGTEFTL TISSLQPEDFATYYCLQHSSYPLIFGGGTKVEIKR |
| VL-Consensus-15 (Table 95) (generated from 209 light chain sequences) | SEQ ID NO: 50312 | DIQMTQSPSSLSASVGDRVTITCRASQGIRDLGWYQ QKPGKAPKRLIYAASSLQSGVPSRFSGSGSGTEFTLTI SSLQPEDFATYYCLQHNSYPLIFGGGTKVEIKR |
| VL-Consensus-16 (Table 96) (generated from 174 light chain sequences) | SEQ ID NO: 50313 | SYELTQPPSVSVSPGQTASITCSGDKLLGDKYACWYQ QKPGQSPVLVIYQDRKRPSGIPERFSGSNSGNTATLTI SGTQAMDEADYYCQAWDSSTVLFGGGTKLTVLG |
| VL-Consensus-17 (Table 97) (generated from 162 light chain sequences) | SEQ ID NO: 50314 | EIVLTQSPGTLSLSPGERATLSCRASQSVYSSYLAWY QQKPGQAPRLLIYGASSRATGIPDRFSGSGSGTDFTL TISSRLEPEDFAVYYCQQYDNSPWITFGQGTKVEIKR |
| VL-Consensus-18 (Table 98) (generated from 147 light chain sequences) | SEQ ID NO: 50315 | DIQMTQSPSSLSASVGDRVTITCRASQGIRNDLGWY QQKPGKAPKRLIYAASSLQSGVPSRFSGSGSGTEFTL TISSLQPEDFATYYCLQHYSYPRTFGQGTKVEIKR |

FIGURE 55
(Continued)

| | | |
|---|---|---|
| VL-Consensus 19 (Table 99) (generated from 132 light chain sequences) | SEQ ID NO: 50316 | DIVMTQSPDSLAVSLGERATINCKSSQSVLHSSNNEN YLAWYQQKPGQPPKLLIYWASTRESGVPDRFSGSGS GTDFTLTISSLQAEDVAVYYCQQYYSTPFTFGQGTK VEIKR |
| VL-Consensus 20 (Table 100) (generated from 109 light chain sequences) | SEQ ID NO: 50317 | DIQMTQSPSSLSASVGDRVTITCRASQGIRNDLGWY QQKPGKAPKRLIYAASSLQSGVPSRFSGSGSGEFTLTI SSLQPEDFATYYCLQHNSYPFTFGPGTKVDIKR |
| VL-Consensus 21 (Table 101) (generated from 92 light chain sequences) | SEQ ID NO: 50318 | DIQMTQSPSSLSASVGDRVTITCRASQGISNYLAWFQ QKPGKAPKSLIYAASSLQSGVPSKFSGSGSGTDFTLTI SSLQPEDFATYYCQQYSYPLIFGGGTKVEIKR |
| VL-Consensus 22 (Table 102) (generated from 89 light chain sequences) | SEQ ID NO: 50319 | DIQMTQSPSSLSASVGDRVTITCRASQNISYLNWYQ QKPGKAPKLLIYTASSLQSGVPSRFSGSGSGTDFTLTI SSLQPEDFATYYCQQSYSTPLIFGGGTKVEIKR |
| VL-Consensus 23 (Table 103) (generated from 86 light chain sequences) | SEQ ID NO: 50320 | DIQMTQSPSSLSASVGDRVTITCRASQISNYLAWFQ QKPGKAPKSLIYAASSLQSGVPSKFSGSGSGTDFTLTI SSLQPEDFATYYCQQYNSYPFTFGPGTKVDIKR |
| VL-Consensus 24 (Table 104) (generated from 81 light chain sequences) | SEQ ID NO: 50321 | SYELTQPPSVSVSPGQTASITCSGDKLGDKYACWYQ QKPGQSPVLVIYQDRKRPSGIPERFSGSNSGNTATLTI SGTQAMDEADYYCQAWDSSTYPGGGTKLTVLG |
| VL-Consensus 25 (Table 105) (generated from 65 light chain sequences) | SEQ ID NO: 50322 | DIVMTQTPLSLSVTPGQPASISCKSSQSLLHGD-GKTYLYWYLQKPGQPPQLLIYEVSNRFSGVPDRFSG SGSGTDFTLKISRVEAEDVGVYYCMQSIQLPWTFGQ GTKVEIKR |
| VL-Consensus 26 (Table 106) (generated from 58 light chain sequences) | SEQ ID NO: 50323 | DIQMTQSPSSLSASVGDRVTITCRASQSISSYLNWYQ QKPGKAPKLLIYAASSLQSGVPSRFSGSGSGTDFTLTI SSLQPEDFATYYCQQSYSPPFTFGPGTKVDIKR |
| VL-Consensus 27 (Table 107) (generated from 47 light chain sequences) | SEQ ID NO: 50324 | DIVMTQSPDSLAVSLGERATINCKSSQSVLYSSNNNN YLAWYQQKPGQPPKLLIYWASTRESGVPDRFSGSGS GTDFTLTISSLQAEDVAVYYCQQYYSTRCSFGQGTK LEIKR |
| VL-Consensus 28 (Table 108) (generated from 42 light chain sequences) | SEQ ID NO: 50325 | DIQMTQSPSSVSASVGDRVTITCRASQGISNWLAWY QQKPGKAPKLLIYAASSLQSGVPSRFSGSGSGTDFTL TISSLQPEDFAIYYCQQAFPWTFGQGTKVEIKR |

FIGURE 55
(Continued)

| | | |
|---|---|---|
| VL-Consensus 29 (Table 109) (generated from 37 light chain sequences) | SEQ ID NO: 50326 | DIVMTQSPDSLAVSLGERATINCKSSQSVLHSSNNEN YLAWYQQKPGQPPKLLIYWASTRESGVPDRFSGSGS GTDFTLTISSLQAEDVAVYYCQQYYSTPYTFGPGTK VDIKR |
| VL-Consensus 30 (Table 110) (generated from 31 light chain sequences) | SEQ ID NO: 50327 | QTVVTQEPSLTVSPGGTVTLTCASSTGAVTSG-YYPNWFQQKPGQAPRALJYSTSNKHSWTPARFSGSL LGGKAALTLSGVQPEDEAEYYCLLYYGGAQLVFGG GTKLTVLG |
| VL-Consensus 31 (Table 111) (generated from 25 light chain sequences) | SEQ ID NO: 50328 | EIVMTQSPATLSVSPGERATLSCRASQSYNSNLAWY QQKPGQAPRLLIYGASTRATGIPARFSGSGSGTEFTL TISSLQSEDFAVYYCQQYNDWPCSFGQGTKLEJKR |
| VL-Consensus 32 (Table 112) (generated from 24 light chain sequences) | SEQ ID NO: 50329 | EFMLTQSPGTLSLSPGERATLSCRASQSVSSSYLVWY QQKPGQAPRLLIYGASTRATGIPDRFSGSGSGTDFTL TISSRLEPEYFAVYYCQQYGCSPLTPGGGTKVEITR |
| VL-Consensus 33 (Table 113) (generated from 21 light chain sequences) | SEQ ID NO: 50330 | DIVMTQTPLSLSVTPGQPASISCKSSQSLLHSEGKTYL YWYLQKPGQPPQLLIYEVSNRFSGVPDRFSGSGSGT DFTLKISRVEAEDVGVYYCMQSIQLPLTFGGGTKVEI KR |
| VL-Consensus 34 (Table 114) (generated from 18 light chain sequences) | SEQ ID NO: 50331 | QSALTQPASVSGSPGQSITISCIGTSSDVGGYNYVSW YQQHPGKAPKLMIYEVSNRPSGVSNRFSGSKSGNTA SLTTSGLQAEDEADYYCNSYTRSITWYFGGGTKLTV LG |
| VL-Consensus 35 (Table 115) (generated from 17 light chain sequences) | SEQ ID NO: 50332 | DIQMTQSPSSLSASVGDRVTITCRASQSISNYLNWYQ QKPGKAPKLLIYAASSLQSGVPSRFSGSGSGTDFTLTI SSLQPEDFATYYCQQSYSTPTWTFGQGTKVEIKR |
| VL-Consensus 36 (Table 116) (generated from 16 light chain sequences) | SEQ ID NO: 50333 | DIQMTQSPSSVSASVGDRVTITCRASQGISSWLAWY QQKPGKAPKLLIYAASSLQSGVPSRFSGSGSGTDFTL TISSLQPEDEFATYYCQQINSFPLTPGGGTKVEIKR |
| VL-Consensus 37 (Table 117) (generated from 16 light chain sequences) | SEQ ID NO: 50334 | DIQMTQSPSSLSASVGDRVTITCQASQDINNYLNWY QQKPGKAPKLLIYDASNLETGVPSRFSGSGSGTDFTF TISSLQPEDIATYYCQQYDELPITFGQGTRLEIKR |
| VL-Consensus 38 (Table 118) (generated from 16 light chain sequences) | SEQ ID NO: 50335 | QSVLTQPPSVSAAPGQKVTISCSGSSSNIGNNYVSWY QQLPGTAPKLLIYDNKRPSGIPDRFSGSKSGTSATL GHTGLQTGDEADYYCGTWDSSLSVGVFGGGTKLTV LG |

FIGURE 55
(Continued)

| | | |
|---|---|---|
| VL-Consensus 39 (Table 119) (generated from 14 light chain sequences) | SEQ ID NO: 50336 | DIVMTQSPLSLPVTPGEPASISCRSSQSLLRSNGTNYL DWYLQKPGQSPQLLIYLGSNRASGVPDRFSGSGSGT DFTLKISRVEAEDVGVYYCMQALHPPLTFGGGTKVE IKR |
| VL-Consensus 40 (Table 120) (generated from 13 light chain sequences) | SEQ ID NO: 50337 | QSVLTQPPSASGTPGQRVTISCSGSSSMGSNTYNWY QQLPGTAPKLLIYSNNQRPSGVPDRFSGSKSGTSASL AISGLQSEDEADYYCAAWDDSLNGVVFGGGTKLTV LG |
| VL-Consensus 41 (Table 121) (generated from 11 light chain sequences) | SEQ ID NO: 50338 | QSVLTQPPSASGTPGQRVTISCSGSSSMGSNIYIWYQ QLPGTAPKLLIYSNDQRPSGVPDRFSGSKSGTSASLAI SGLQSEDEADYYCAAWDDSLNGWVFGGGTTLTVL G |
| VL-Consensus 42 (Table 122) (generated from 10 light chain sequences) | SEQ ID NO: 50339 | DIQMTQSPSSLSASVGDRVTITCRASQGIRNDLGWY QQKPGKAPKRLIYAASSLQSGVPSRFSGSGSGTEFTL TISSLQPEDFATYYCLQHNSYPITFGQGTRLEIKR |
| VL-Consensus 43 (Table 123) (generated from 10 light chain sequences) | SEQ ID NO: 50340 | DIQMTQSPSSLSASVGDRVTITCRASQSISSYLNWYQ QKPGKAPKLLIYAASSLQSGVPSRFSGSGSGTDFTLTI SSLQPEDFATYYCQQSYSIPITFGQGTRLEIKR |
| VL-Consensus 44 (Table 124) (generated from 10 light chain sequences) | SEQ ID NO: 50341 | DIVMTQTPLSLSVTPGQPASISCKSSQSLLHSEGKTYL YWYLQKPGQPPQLLIYEVSNRFSGVPDRFSGSGSGT DFTLKISRVEAEDVGVYYCMQSIQLPITPGQGTRLEI KR |
| VL-Consensus 45 (Table 125) (generated from 10 light chain sequences) | SEQ ID NO: 50342 | EIVLTQSPGTLSLSPGERATLSCRASQSVISSYLAWYQ QKPGQAPRLLIFGVSSRATGIPDRFSGSGSGTDFTLTI SRLEPEDFAVYYCQQYGRSPFNFGPGTKVDIKR |
| VL-Consensus 46 (Table 126) (generated from 10 light chain sequences) | SEQ ID NO: 50343 | EIVMTQSPATLSVSPGERATLSCRASQSVSSNLAWY QQKPGQAPRLLIYGASTRATGIPARFSGSGSGTEFTL TISSLQSEDFAVYYCQQYNDWPWTFGQGTKVEIKR |
| VL-Consensus 47 (Table 127) (generated from 10 light chain sequences) | SEQ ID NO: 50344 | EIVLTQSPDFQSVTPKEKVTITCRASQSIGSSLHWYQ QKPDQSPKLLIKYASQSFSGVPSRFSGSGSGTDFTLTI NSLEAEDAATYYCHQSSSLPWTFGQGTKVEIKR |
| VL-Consensus 48 (Table 128) (generated from 9 light chain sequences) | SEQ ID NO: 50345 | DIQMTQSPSSLSASVGDRVTITCRASQGIRNDLGWY QQKPGKAPKRLIYAASSLQSGVPSRFSGSGSGTEFTL TISSLQPEDFATYYCLQHYSYPRSFGQGTKLEIKR |

FIGURE 55
(Continued)

| | | |
|---|---|---|
| VL-Consensus 49 (Table 129) (generated from 9 light chain sequences) | SEQ ID NO: 50346 | DIQMTQSPSSLSASVGDRVTITCRASQGISNYLAWFQ QKPGKAPKSLIYAASSLQSGVPSKFSGSGSGTDFTLTI SSLQPEDFATYYCQQYLSYPITFGQGTRLEIKR |
| VL-Consensus 50 (Table 130) (generated from 9 light chain sequences) | SEQ ID NO: 50347 | EIVLTQSPDFQSVTPKEKVTITCRASQSIGSSLHWYQ QKPDQSPKLLIKYASQSFSGVPSRFSGSGSGTDFTLTI NSLEAEDAATYYCHQSRRLPLTFGGGTKVEIKR |
| VL-Consensus 51 (Table 131) (generated from 9 light chain sequences) | SEQ ID NO: 50348 | SSELTQDPAVSVALGQTVRITCQGDSLRPYYASWYQ QKPGQAPVLVIYGKNNRPSGIPDRFSGSSSGNTASLTI TGAQAEDEADYYCNSRDSSGNHLVVFGGGTKLTVL G |
| VL-Consensus 52 (Table 132) (generated from 8 light chain sequences) | SEQ ID NO: 50349 | DVVMTQSPLSLPVTLGQPASISCRSSQSLVYSDGNTY LNWFQQRPGQSPRRLIYKVSNWDSGVPDRFSGSGSG TDFTLKISRVEAEDVGVYYCMQGIHWPLTFGGGTK VEIKR |
| VL-Consensus 53 (Table 133) (generated from 8 light chain sequences) | SEQ ID NO: 50350 | EIVMTQSPATLSVSPGERATLSCRASQSVSRNLAWY QQKPGQAPRLLIYGASTRATGIPARFSGSGSGTEFTL TISSLQSEDFAVYYCQQYNNWPLTFGGGTKVEIKR |
| VL-Consensus 54 (Table 134) (generated from 8 light chain sequences) | SEQ ID NO: 50351 | SYELTQPLSVSVALGQTARITCGGNNIGRKNVHWYQ QKPGQAPVLVIYRDSDRPSGIPERFSGSNSGNTATLTI SRAQAGDEADYYCQVWDSSTVVFGGGTKLTVLG |

FIGURE 55
(Continued)

Table 20B

VARIABLE LIGHT CDR CONSENSUS SEQUENCES

| Name (original and patent) | Patent SEQ ID NO. | CDR | Sequence |
|---|---|---|---|
| VL-Consensus-1 (Table 35) | 50423 | VL1 | RASQGISRWLA |
|  | 50424 | VL2 | AASSLQS |
|  | 50425 | VL3 | QQANSFPFT |
| VL-Consensus-2 (Table 36) | 50426 | VL1 | SGDKLGDKYAY |
|  | 50427 | VL2 | QDRKRPS |
|  | 50428 | VL3 | QAWDNSTVV |
| VL-Consensus-3 (Table 37) | 50429 | VL1 | KSSQSVLYSSNNNMYLA |
|  | 50430 | VL2 | WASTRES |
|  | 50431 | VL3 | QQYYSTPPT |
| VL-Consensus-4 (Table 38) | 50432 | VL1 | RASQGISNYLA |
|  | 50433 | VL2 | AASSLQS |
|  | 50434 | VL3 | QQYNSYPFT |
| VL-Consensus-5 (Table 39) | 50435 | VL1 | RASQGIRNNLG |
|  | 50436 | VL2 | AASSLQS |
|  | 50437 | VL3 | LQYNSYPFT |
| VL-Consensus-6 (Table 40) | 50438 | VL1 | RASQGISNYLA |
|  | 50439 | VL2 | AASSLQS |
|  | 50440 | VL3 | QQYNSYPFT |
| VL-Consensus-7κ (Table 41) | 50441 | VL1 | RASQDIRSDLG |
|  | 50442 | VL2 | AASSLQS |
|  | 50443 | VL3 | LQHTYPPT |
| VL-Consensus-7λ (Table 41) | 50444 | VL1 | TGTSSDVGXXNXVS |
|  | 50445 | VL2 | EVSNRPS |
|  | 50446 | VL3 | SSYTXSXTVV |
| VL-Consensus-8 (Table 42) | 50447 | VL1 | RASQSISSYLN |
|  | 50448 | VL2 | AASSLQS |
|  | 50449 | VL3 | QQSYRTPLFT |
| VL-Consensus-9 (Table 43) | 50450 | VL1 | RASQSHSYLN |
|  | 50451 | VL2 | TASSLQS |
|  | 50452 | VL3 | QQTYSTPLT |

FIGURE 55
(Continued)

| | | |
|---|---|---|
| VL-Consensus-10 (Table 44) | 50453 VL1 | RASQGIRNDLG |
| | 50454 VL2 | AASSLQS |
| | 50455 VL3 | LQHYSYPRT |
| VL-Consensus-11 (Table 45) | 50456 VL1 | RASQGIRNDLG |
| | 50457 VL2 | AASSLQS |
| | 50458 VL3 | LQHNSYPFT |
| VL-Consensus-12 (Table 46) | 50459 VL1 | RASQGIRNDLG |
| | 50460 VL2 | AASSLQS |
| | 50461 VL3 | LQHNSYPLT |
| VL-Consensus-13 (Table 47) | 50462 VL1 | RASQGIRNDLG |
| | 50463 VL2 | AASSLQS |
| | 50464 VL3 | LQHSSYPLT |
| VL-Consensus-14 (Table 48) | 50465 VL1 | RASQGIRNDLG |
| | 50466 VL2 | AASSVQS |
| | 50467 VL3 | LQHNSYPLT |
| VL-Consensus-15 (Table 95) | 50606 VL1 | RASQGIRNDLG |
| | 50607 VL2 | AASSLQS |
| | 50608 VL3 | LQHNSYPLT |
| VL-Consensus-16 (Table 96) | 50609 VL1 | SGDKLGDKYAC |
| | 50610 VL2 | AASSLQS |
| | 50611 VL3 | QAWDSSTVV |
| VL-Consensus-17 (Table 97) | 50612 VL1 | RASQSVYSSYLA |
| | 50613 VL2 | GASSRAT |
| | 50614 VL3 | QQYDNSPWT |
| VL-Consensus-18 (Table 98) | 50615 VL1 | RASQGIRNDLG |
| | 50616 VL2 | AASSLQS |
| | 50617 VL3 | LQHYSYPRT |
| VL-Consensus-19 (Table 99) | 50618 VL1 | KSSQSVLHSSNNNNYLA |
| | 50619 VL2 | WASTRES |
| | 50620 VL3 | QQYSTPPT |
| VL-Consensus-20 (Table 100) | 50621 VL1 | RASQGIRNDLG |
| | 50622 VL2 | AASSLQS |
| | 50623 VL3 | LQHNSYPFT |
| VL-Consensus-21 (Table 101) | 50624 VL1 | RASQGISNYLA |
| | 50625 VL2 | AASSLQS |
| | 50626 VL3 | QQYSTYPLT |

FIGURE 55
(Continued)

| | | | |
|---|---|---|---|
| VL-Consensus-22 (Table 102) | 50627 | VL1 | RASQNIISYLN |
| | 50628 | VL2 | TASSLQS |
| | 50629 | VL3 | QQSYSTPLT |
| VL-Consensus-23 (Table 103) | 50630 | VL1 | RASQGISNYLA |
| | 50631 | VL2 | AASSLQS |
| | 50632 | VL3 | QQYNSYPFT |
| VL-Consensus-24 (Table 104) | 50633 | VL1 | RASQGISRWLA |
| | 50634 | VL2 | AASSLQS |
| | 50635 | VL3 | QQANSFPFT |
| VL-Consensus-25 (Table 105) | 50636 | VL1 | KSSQSLLHGDGKTYLY |
| | 50637 | VL2 | EVSNRFS |
| | 50638 | VL3 | MQSIQLPWT |
| VL-Consensus-26 (Table 106) | 50639 | VL1 | RASQSISSYLN |
| | 50640 | VL2 | AASSLQS |
| | 50641 | VL3 | QQSYSPPFT |
| VL-Consensus-27 (Table 107) | 50642 | VL1 | KSSQSVLYSSNNNNYLA |
| | 50643 | VL2 | WASTRES |
| | 50644 | VL3 | QQYYSTPCS |
| VL-Consensus-28 (Table 108) | 50645 | VL1 | RASQGISWWLA |
| | 50646 | VL2 | AASSLQS |
| | 50647 | VL3 | QQANSFPWT |
| VL-Consensus-29 (Table 109) | 50648 | VL1 | KSSQSVLHSSNNNNYLA |
| | 50649 | VL2 | WASTRES |
| | 50650 | VL3 | QQYYSTPVT |
| VL-Consensus-30 (Table 110) | 50651 | VL1 | ASSTGAVTSGYYPN |
| | 50652 | VL2 | STSNKHS |
| | 50653 | VL3 | LLYYGGAQLV |
| VL-Consensus-31 (Table 111) | 50654 | VL1 | RASQSVNSRLA |
| | 50655 | VL2 | GASTRAT |
| | 50656 | VL3 | QQYNDWPCS |

FIGURE 55
(Continued)

| | | |
|---|---|---|
| VL-Consensus-32 (Table 112) | VL1 | RASQSVSSSYLV |
| | VL2 | GASTRAT |
| | VL3 | QQYGCSPLT |
| VL-Consensus-33 (Table 113) | VL1 | KSSQSLLHSEGKTYLY |
| | VL2 | EVSNRFS |
| | VL3 | MQSIQLPLT |
| VL-Consensus-34 (Table 114) | VL1 | TGTSSDVGGYNYVS |
| | VL2 | EVSNRPS |
| | VL3 | NSYTRSITWV |
| VL-Consensus-35 (Table 115) | VL1 | RASQSISNYLN |
| | VL2 | AASSLQS |
| | VL3 | QQSYSTPWT |
| VL-Consensus-36 (Table 116) | VL1 | RASQGISSWLA |
| | VL2 | AASSLQS |
| | VL3 | QQ NSFPLT |
| VL-Consensus-37 (Table 117) | VL1 | QASQDINYLN |
| | VL2 | DASNLET |
| | VL3 | QQYDNLPT |
| VL-Consensus-38 (Table 118) | VL1 | SGSSSNIGNNYVS |
| | VL2 | DNNKRP |
| | VL3 | GTWDSSLSVGV |
| VL-Consensus-39 (Table 119) | VL1 | RSSQSLLHSNGYNYLD |
| | VL2 | LGSNRAS |
| | VL3 | MQALPLT |
| VL-Consensus-40 (Table 120) | VL1 | SGSSSNIGSNTVN |
| | VL2 | SNNQRPS |
| | VL3 | AAWDDSLNGVV |
| VL-Consensus-41 (Table 121) | VL1 | SGSSSNIGSNIVT |
| | VL2 | SNDQRPS |
| | VL3 | AAWDDSLNGWV |

(Numbers column: 50657, 50658, 50659, 50660, 50661, 50662, 50663, 50664, 50665, 50666, 50667, 50668, 50669, 50670, 50671, 50672, 50673, 50674, 50675, 50676, 50677, 50678, 50679, 50680, 50681, 50682, 50683, 50684, 50685, 50686)

FIGURE 55
(Continued)

| | | | |
|---|---|---|---|
| VL-Consensus-42 (Table 122) | 50687 | VL1 | RASQGIRNDLG |
| | 50688 | VL2 | AASSLQS |
| | 50689 | VL3 | LQHNSYPIT |
| VL-Consensus-43 (Table 123) | 50690 | VL1 | RASQSISSYLN |
| | 50691 | VL2 | AASSLQS |
| | 50692 | VL3 | QQSYSIPIT |
| VL-Consensus-44 (Table 124) | 50693 | VL1 | KSSQSLLHSEGKTYLY |
| | 50694 | VL2 | EVSNRFS |
| | 50695 | VL3 | MQSIQ PIT |
| VL-Consensus-45 (Table 125) | 50696 | VL1 | RASQSVISSYLA |
| | 50697 | VL2 | GVSSRAT |
| | 50698 | VL3 | QQYGRSPFN |
| VL-Consensus-46 (Table 126) | 50699 | VL1 | RASQSVSSNLA |
| | 50700 | VL2 | GASTRAT |
| | 50701 | VL3 | QQYNDWPWT |
| VL-Consensus-47 (Table 127) | 50702 | VL1 | RASQSIGSSLH |
| | 50703 | VL2 | YASQSFS |
| | 50704 | VL3 | HQSSSLPWT |
| VL-Consensus-48 (Table 128) | 50705 | VL1 | RASQGIRNDLG |
| | 50706 | VL2 | AASSLQS |
| | 50707 | VL3 | LQHYSYPRS |
| VL-Consensus-49 (Table 129) | 50708 | VL1 | RASQGISNYLA |
| | 50709 | VL2 | AASSLQS |
| | 50710 | VL3 | QQYLSYPIT |
| VL-Consensus-50 (Table 130) | 50711 | VL1 | RASQSIGSSLH |
| | 50712 | VL2 | YASQSFS |
| | 50713 | VL3 | HQSKRLPLT |
| VL-Consensus-51 (Table 131) | 50714 | VL1 | QGDSLRPYYAS |
| | 50715 | VL2 | GKNNRPS |

FIGURE 55
(Continued)

| | | | |
|---|---|---|---|
| VL-Consensus-52 (Table 132) | 50716 | VL3 | NSRDSSGNHLVV |
| | 50717 | VL1 | RSSQSLVYSDGNTYLN |
| | 50718 | VL2 | KVSNWDS |
| | 50719 | VL3 | MQGTHWPLT |
| VL-Consensus-53 (Table 133) | 50720 | VL1 | RASQSVSRNLA |
| | 50721 | VL2 | GASTRAT |
| | 50722 | VL3 | QQYNNWPLT |
| VL-Consensus-54 (Table 134) | 50723 | VL1 | GGNNIGRKNVH |
| | 50724 | VL2 | RDSRPS |
| | 50725 | VL3 | QVWDSSTVV |

FIGURE 55
(Continued)

Table 26C

VARIABLE LIGHT CDR CONSENSUS SEQUENCES II

| NAME (ORIGINAL AND PATENT) | Patent SEQ ID NO: | SEQ ID NO: | CDR | Sequence |
|---|---|---|---|---|
| VL-CONSENSUS-15 TABLE 95 | | SEQ ID NO: 50122 | VL1 | X1 X2 Ser X3 X4 X5 X6 X7 X8 X9 X10, wherein X1 = R or L or a conservative substitution thereof, X2 = A or T or a conservative substitution thereof, X3 = Q or R or a conservative substitution thereof, X4 = G or D or A or V or a conservative substitution thereof, X5 = I or M or V or a conservative substitution thereof, X6 = R or E or K or N or S or a conservative substitution thereof, X7 = N or S or D or T or K or I or a conservative substitution thereof, X8 = D or N or A or a conservative substitution thereof, X9 = L or F or V or a conservative substitution thereof, X10 = G or D or N or a conservative substitution thereof. |
| | | SEQ ID NO: 50123 | VL2 | X1 X2 X3 X4 X5 X6 X7, wherein X1 = A or T or S or V or G or D or R or a conservative substitution thereof, X2 = A or T or V or E or a conservative substitution thereof, X3 = S or F or C or Y or a conservative substitution thereof, X4 = S or N or T or F or R or I or a conservative substitution thereof, X5 = L or V or F or S or a conservative substitution thereof, X6 = Q or H or E or a conservative substitution thereof, X7 = S or R or N or T or G or a conservative substitution thereof. |
| | | SEQ ID NO: 50124 | VL3 | X1 X2 X3 X4 X5 X6 X7 X8 X9, wherein X1 = L or V or I or a conservative substitution thereof, X2 = Q or H or a conservative substitution thereof, X3 = H or D or Y or N or R or a conservative substitution thereof, X4 = N or S or Y or T or D or K or A or I or E or H or P or R or a conservative substitution thereof, X5 = S or L or N or R or T or D or A or L or V or a conservative substitution thereof, X6 = Y or F or H or S or a conservative substitution thereof, X7 = P or A or M or a conservative substitution thereof, X8 = L or P or F or N or V or a conservative substitution thereof, X9 = T or K or I or a conservative substitution thereof. |
| VL-CONSENSUS-16 TABLE 96 | | SEQ ID NO: 50125 | VL1 | Ser Gly X1 X2 X3 Gly X4 X5 X6 X7 X8, wherein X1 = D or N or E or Y or S or a conservative substitution thereof, X2 = K or R or N or E or T or a conservative substitution thereof, X3 = L or M or S or a conservative substitution thereof, X4 = D or N or E or G or Y or T or H or V or a conservative substitution thereof, X5 = K or R or a conservative substitution thereof, X6 = Y or F or S or a conservative substitution thereof, X7 = A or V or T or D or S or a conservative substitution thereof, X8 = C or S or Y or W or H or a conservative substitution thereof. |

FIGURE 55
(Continued)

| | | | |
|---|---|---|---|
| | SEQ ID NO: 50126 | VL2 | X1 X2 X3 X4 Arg X5 X6, wherein X1 = Q or E or K or a conservative substitution thereof, X2 = D or N or a conservative substitution thereof, X3 = R or S or N or K or Y or M or T or G or J or a conservative substitution thereof, X4 = K or R or Q or a conservative substitution thereof, X5 = T or a conservative substitution thereof. |
| | SEQ ID NO: 50228 | VL3 | X1 X2 X3 X4 X5 X6 X7 X8 X9 X10, wherein X1 = Q or L or K or a conservative substitution thereof, X2 = A or T or a conservative substitution thereof, X3 = W or R or a conservative substitution thereof, X4 = D or H or Y or N or G or a conservative substitution thereof, X5 = S or N or Absent or I or R or K or T or a conservative substitution thereof, X6 = Absent or S or N or R or a conservative substitution thereof, X7 = S or T or N or R or G or F or I or V or Y or a conservative substitution thereof, X8 = T or S or Y or A or F or P or N or K or I or R or a conservative substitution thereof, X9 = V or A or T or M or L or G or a conservative substitution thereof, X10 = V or I or L or A or M. |
| VL-CONSENSUS-17 TABLE 97 | SEQ ID NO: 50127 | VL1 | X1 X2 X3 X4 X5 X6 X7 X8 X9 X10 Leu X11, wherein X1 = R or W or a conservative substitution thereof, X2 = A or T or a conservative substitution thereof, X3 = S or G or R or a conservative substitution thereof, X4 = Q or P or a conservative substitution thereof, X5 = S or N or I or R or a conservative substitution thereof, X6 = V or I or P or a conservative substitution thereof, X7 = Y or R or S or N or D or F or H or G or W or a conservative substitution thereof, X8 = S or T or N or G or L or R or a conservative substitution thereof, X9 = S or N or G or R or D or A or Y or a conservative substitution thereof, X10 = Y or F or H or a conservative substitution thereof, X11 = A or V or S or a conservative substitution thereof. |
| | SEQ ID NO: 50128 | VL2 | X1 X2 X3 X4 Arg X5 X6, wherein X1 = G or D or V or a conservative substitution thereof, X2 = A or T or P or V or a conservative substitution thereof, X3 = S or F or Y or A or T or a conservative substitution thereof, X4 = S or R or N or A or a conservative substitution thereof, X5 = A or S or T or a conservative substitution thereof, X6 = T or P or S or A or a conservative substitution thereof. |
| | SEQ ID NO: 50129 | VL3 | X1 X2 X3 X4 X5 X6 X7 X8 X9 X10, wherein X1 = Q or H or a conservative substitution thereof, X2 = Q or H or a conservative substitution thereof, X3 = Y or S or a conservative substitution thereof, X4 = D or E or G or H or a conservative substitution thereof, X5 = N or S or Absent or R or T or I or D or G or a conservative substitution thereof, X6 = Absent or S or a conservative substitution thereof, X7 = S or P or N or R or a conservative substitution thereof, X8 = P or S or V or a conservative substitution thereof. |

FIGURE 55
(Continued)

| | | | |
|---|---|---|---|
| VL-CONSENSUS-18 TABLE 98 | SEQ ID NO: 50130 | VL1 | Arg X1 X2 X3 X4 Ile X5 X6 X7 Leu X8, wherein X1 = A or T or a conservative substitution thereof, X2 = S or T or a conservative substitution thereof, X3 = Q or R or a conservative substitution thereof, X4 = G or D or A or N or V or a conservative substitution thereof, X5 = R or G or a conservative substitution thereof, X6 = N or K or D or H or S or G or T or a conservative substitution thereof, X7 = D or I or Y or a conservative substitution thereof, X8 = G or N or a conservative substitution thereof. |
| | SEQ ID NO: 50131 | VL2 | X1 X2 X3 X4 X5 X6 X7, wherein X1 = A or T or I or V or P or G or R or S or a conservative substitution thereof, X2 = A or T or S or a conservative substitution thereof, X3 = S or A or F or P or Y or a conservative substitution thereof, X4 = S or N or R or G or T or a conservative substitution thereof, X5 = L or C or F or S or a conservative substitution thereof, X6 = Q or H or E or a conservative substitution thereof, X7 = S or N or G or I or a conservative substitution thereof. |
| | SEQ ID NO: 50132 | VL3 | X1 X2 X3 X4 X5 X6 X7 X8 X9 Thr, wherein X1 = L or V or I or H or a conservative substitution thereof, X2 = Q or M or H or L or V or a conservative substitution thereof, X3 = H or Q or Y or L or S or a conservative substitution thereof, X4 = Y or N or H or S or T or a conservative substitution thereof, X5 = S or N or T or R or D or F or G or a conservative substitution thereof, X6 = Absent or Y or F or a conservative substitution thereof, X7 = Y or F or P or C or N or T or a conservative substitution thereof, X8 = P or L or a conservative substitution thereof, X9 = R or W or F or L or a conservative substitution thereof. |
| VL-CONSENSUS-19 TABLE 99 | SEQ ID NO: 50133 | VL1 | X1 X2 X3 Gln Ser X4 Leu X5 X6 X7 X8 X9 X10 X11 X12 X13 X14, wherein X1 = K or R or M or a conservative substitution thereof, X2 = S or G or R or a conservative substitution thereof, X3 = S or T or N or I or a conservative substitution thereof, X4 = V or I or A or a conservative substitution thereof, X5 = H or Y or F or S or K or D or L or M or a conservative substitution thereof, X6 = S or T or R or N or I or D or a conservative substitution thereof, X7 = S or F or P or a conservative substitution thereof, X8 = N or H or a conservative substitution thereof, X9 = N or K or S or D or H or a conservative substitution thereof, X10 = N or Y or K or R or A or F or W or a conservative substitution thereof, X11 = N or H or Y or a conservative substitution thereof, |

FIGURE 55
(Continued)

| | | | |
|---|---|---|---|
| | SEQ ID NO: 50229 | VL2 | conservative substitution thereof, X12 = Y or S or a conservative substitution thereof, X13 = L or F or a conservative substitution thereof, X14 = A or T or V or G or a conservative substitution thereof. |
| | | | Trp X1 X2 X3 X4 X5 X6, wherein X1 = A or T or S or a conservative substitution thereof, X2 = S or F or a conservative substitution thereof, X3 = T or I or K or S or a conservative substitution thereof, X4 = R or W or L or a conservative substitution thereof, X5 = E or K or A or D or R or a conservative substitution thereof, X6 = S or T or a conservative substitution thereof. |
| | SEQ ID NO: 50134 | VL3 | X1 X2 X3 X4 X5 X6 Pro X7 X8, wherein Y1 = Q or H or L or a conservative substitution thereof, X2 = Q or H or a conservative substitution thereof, X3 = Y or F or a conservative substitution thereof, X4 = Y or F or H or N or L or S or a conservative substitution thereof, X5 = S or N or R or D or I or T or C or E or K or a conservative substitution thereof, X6 = T or S or I or V or A or Y or a conservative substitution thereof, X7 = P or W or L or V or C or G or R or S or a conservative substitution thereof, X8 = T or K or S or a conservative substitution thereof. |
| VL-CONSENSUS-20 TABLE 100 | SEQ ID NO: 50135 | VL1 | Arg X1 Ser Gln X2 X3 X4 X5 X6 X7 X8, wherein X1 = A or T or a conservative substitution thereof, X2 = G or D or V or a conservative substitution thereof, X3 = I or M or a conservative substitution thereof, X4 = R or S or a conservative substitution thereof, X5 = N or K or S or D or T or D or a conservative substitution thereof, X6 = D or N or H or Y or V or A or I or L or a conservative substitution thereof, X7 = L or F or a conservative substitution thereof, X8 = G or D or a conservative substitution thereof. |
| | SEQ ID NO: 50136 | VL2 | X1 X2 X3 X4 X5 X6 X7, wherein X1 = A or P or T or G or L or R or V or a conservative substitution thereof, X2 = A or V or a conservative substitution thereof, X3 = S or F or T or a conservative substitution thereof, X4 = S or N or T or D or a conservative substitution thereof, X5 = L or V or a conservative substitution thereof, X6 = Q or L or a conservative substitution thereof, X7 = S or N or T or G or R or a conservative substitution thereof. |
| | SEQ ID NO: 50137 | VL3 | X1 X2 X3 X4 X5 X6 X7 X8 X9, wherein X1 = L or I or a conservative substitution thereof, X2 = Q or H or L or a conservative substitution thereof, X3 = H or Y or D or L or a conservative substitution thereof, X4 = N or Y or T or H or G or L or a conservative substitution thereof, X5 = S or R or D or T or G or N or a conservative substitution thereof, X6 = Y or F or H or a conservative substitution thereof, X7 = P or L or a |

FIGURE 55
(Continued)

| | | | |
|---|---|---|---|
| VL-CONSENSUS-21 TABLE 101 | SEQ ID NO: 50138 | VL1 | conservative substitution thereof, X8 = F or L or a conservative substitution thereof, X9 = T or K or a conservative substitution thereof. |
| | | | Arg X1 X2 Gln X3 Ile X4 X5 X6 Leu X7, wherein X1 = A or T or a conservative substitution thereof, X2 = S or N or a conservative substitution thereof, X3 = G or D or A or V or S or a conservative substitution thereof, X4 = S or G or N or R or A or F or a conservative substitution thereof, X5 = N or K or R or H or S or T or I or a conservative substitution thereof, X6 = Y or H or C or D or a conservative substitution thereof, X7 = A or D or V or I or N or a conservative substitution thereof. |
| | SEQ ID NO: 50139 | VL2 | X1 X2 X3 X4 Leu X5 X6, wherein X1 = A or K or S or T or V or D or G or a conservative substitution thereof, X2 = A or T or V or a conservative substitution thereof, X3 = S or P or a conservative substitution thereof, X4 = S or N or R or a conservative substitution thereof, X5 = Q or L or E or H or a conservative substitution thereof, X6 = S or G or N or T or a conservative substitution thereof. |
| | SEQ ID NO: 50140 | VL3 | X1 X2 X3 X4 X5 X6 Pro X7 X8, wherein X1 = Q or L or H or a conservative substitution thereof, X2 = Q or H or R or Y or a conservative substitution thereof, X3 = Y or S or C or T or a conservative substitution thereof, X4 = S or L or N or M or D or H or V or I or Y or a conservative substitution thereof, X5 = T or N or S or K or a conservative substitution thereof, X6 = Y or F or I or S or a conservative substitution thereof, X7 = L or V or F or N or a conservative substitution thereof, X8 = T or I or Q or S or a conservative substitution thereof. |
| VL-CONSENSUS-22 TABLE 102 | SEQ ID NO: 50141 | VL1 | Arg X1 X2 X3 X4 X5 X6 X7 X8 Leu X9, wherein X1 = A or T or a conservative substitution thereof, X2 = S or T or a conservative substitution thereof, X3 = Q or H or R or a conservative substitution thereof, X4 = N or S or R or T or I or a conservative substitution thereof, X5 = I or V or F or a conservative substitution thereof, X6 = I or S or N or Y or F or R or H or L or K or T or a conservative substitution thereof, X7 = S or N or D or R or K or T or a conservative substitution thereof, X8 = Y or F or N or a conservative substitution thereof, X9 = N or H or a conservative substitution thereof. |
| | SEQ ID NO: 50142 | VL2 | X1 X2 Ser X3 X4 X5 X6, wherein X1 = T or A or V or G or I or S or a conservative substitution thereof, X2 = A or T or V or a conservative substitution thereof, X3 = S or N or R or T or a conservative substitution thereof, X4 = L or F or S or a conservative substitution thereof, X5 = Q or H or F or P or a conservative substitution thereof, |

FIGURE 55
(Continued)

| | | | |
|---|---|---|---|
| | SEQ ID NO: 50143 | VL3 | X6 = S or G or T or N or R or a conservative substitution thereof. |
| | | | Gln X1 X2 X3 X4 X5 X6 X7 Thr, wherein X1 = Q or L or a conservative substitution thereof, X2 = S or T or N or P or a conservative substitution thereof, X3 = Y or H or C or D or F or N or a conservative substitution thereof, X4 = S or Absent or I or N or F or G or T or a conservative substitution thereof, X5 = T or S or P or F or N or I or L or a conservative substitution thereof, X6 = P or T or I or A or S or a conservative substitution thereof, X7 = L or P or Y or F or V or a conservative substitution thereof. |
| VL-CONSENSUS-23 TABLE 103 | SEQ ID NO: 50144 | VL1 | X1 X2 X3 X4 X5 X6 X7 X8 X9 Leu X10, wherein X1 = R or P or a conservative substitution thereof, X2 = A or T or a conservative substitution thereof, X3 = S or N or a conservative substitution thereof, X4 = Q or R or a conservative substitution thereof, X5 = G or D or V or A or a conservative substitution thereof, X6 = I or V or a conservative substitution thereof, X7 = S or N or G or R or T or K or a conservative substitution thereof, X8 = N or K or Y or H or I or T or a conservative substitution thereof, X9 = Y or H or a conservative substitution thereof, X10 = A or V or S or a conservative substitution thereof. |
| | SEQ ID NO: 50145 | VL2 | X1 X2 X3 X4 X5 X6 X7, wherein X1 = A or V or G or T or a conservative substitution thereof, X2 = A or S or V or a conservative substitution thereof, X3 = S or F or a conservative substitution thereof, X4 = S or G or N or T or a conservative substitution thereof, X5 = L or V or a conservative substitution thereof, X6 = Q or R or H or L or E or a conservative substitution thereof, X7 = S or G or T or a conservative substitution thereof. |
| | SEQ ID NO: 50146 | VL3 | X1 X2 X3 X4 X5 X6 Pro X7 X8, wherein X1 = Q or H or L or P or R or a conservative substitution thereof, X2 = Q or R or K or H or L or a conservative substitution thereof, X3 = Y or F or a conservative substitution thereof, X4 = N or H or D or Y or S or K or L or M or Q or a conservative substitution thereof, X5 = S or T or G or N or C or D or a conservative substitution thereof, X6 = Y or F or H or a conservative substitution thereof, X7 = F or V or L or I or a conservative substitution thereof, X8 = T or K or a conservative substitution thereof. |
| VL-CONSENSUS-24 TABLE 104 | SEQ ID NO: 50147 | VL1 | Arg X1 X2 X3 X4 X5 X6 X7 X8 X9 X10, wherein X1 = A or V or F or G or a conservative substitution thereof, X2 = S or G or a conservative substitution thereof, X3 = Q or R or a conservative substitution thereof, X4 = G or D or N or A or L or V or a |

FIGURE 55
(Continued)

| | | |
|---|---|---|
| | SEQ ID NO: 50148 | VL2 | X1 X2 X3 X4 X5 X6 X7, wherein X1 = A or G or T or D or V or a conservative substitution thereof, X2 = A or T or V or a conservative substitution thereof, X3 = S or Y or a conservative substitution thereof, X4 = S or R or N or T or G or I or a conservative substitution thereof, X5 = L or F or a conservative substitution thereof, X6 = Q or E or a conservative substitution thereof, X7 = S or G or N or D or a conservative substitution thereof. |
| | SEQ ID NO: 50149 | VL3 | X1 Gln X2 X3 X4 X5 Pro X6 Thr, wherein X1 = Q or H or a conservative substitution thereof, X2 = A or T or G or S or V or D or a conservative substitution thereof, X3 = N or D or K or S or a conservative substitution thereof, X4 = S or I or a conservative substitution thereof, X5 = F or L or V or a conservative substitution thereof, X6 = F or I or a conservative substitution thereof. |
| VL-CONSENSUS-25 TABLE 105 | SEQ ID NO: 50150 | VL1 | X1 Ser X2 X3 X4 Leu X5 X6 X7 X8 Gly X9 Thr X10 X11 X12, wherein X1 = K or M or R or T or a conservative substitution thereof, X2 = S or G or T or a conservative substitution thereof, X3 = Q or K or a conservative substitution thereof, X4 = S or R or N or T or a conservative substitution thereof, X5 = L or R or V or a conservative substitution thereof, X6 = H or Y or a conservative substitution thereof, X7 = G or S or a conservative substitution thereof, X8 = D or E or G or a conservative substitution thereof, X9 = K or R or a conservative substitution thereof, X10 = Y or F or a conservative substitution thereof, X11 = L or F or a conservative substitution thereof, X12 = Y or F or T or C or S or a conservative substitution thereof. |
| | SEQ ID NO: 50151 | VL2 | X1 X2 Ser X3 Arg X4 X5, wherein X1 = F or A or a conservative substitution thereof, X2 = V or I or L or T or a conservative substitution thereof, X3 = N or K or H or L or S or a conservative substitution thereof, X4 = F or L or T or a conservative substitution thereof, X5 = S or A or T or C or P or a conservative substitution thereof. |
| | SEQ ID NO: 50152 | VL3 | X1 Gln X2 X3 X4 X5 Pro X6 Thr, wherein X1 = M or K or a conservative substitution thereof, X2 = S or T or a conservative substitution thereof, X3 = I or T or F or L or a conservative substitution thereof, X4 = Q or H or L or a conservative substitution thereof, X5 = L or I or V or a conservative substitution thereof. |

FIGURE 55
(Continued)

| | | | |
|---|---|---|---|
| VL-CONSENSUS-26 TABLE 106 | | | F or a conservative substitution thereof, X6 = W or R or a conservative substitution thereof. |
| | SEQ ID NO: 50153 | VL1 | Arg X1 X2 X3 X4 X5 X6 X7 X8 X9 X10, wherein X1 = A or S or T or a conservative substitution thereof, X2 = S or G or I or a conservative substitution thereof, X3 = Q or H or R or a conservative substitution thereof, X4 = S or N or T or a conservative substitution thereof, X5 = I or F or a conservative substitution thereof, X6 = S or I or F or N or R or Y or T or A or G or L or a conservative substitution thereof, X7 = S or N or T or H or K or a conservative substitution thereof, X8 = Y or F or H or a conservative substitution thereof, X9 = L or V or a conservative substitution thereof, X10 = N or I or M or H or Y or a conservative substitution thereof. |
| | SEQ ID NO: 50154 | VL2 | X1 X2 Y3 X4 Leu X5 X6, wherein X1 = A or G or T or V or I or a conservative substitution thereof, X2 = A or T or V or S or a conservative substitution thereof, X3 = S or F or a conservative substitution thereof, X4 = S or N or T or V or a conservative substitution thereof, X5 = Q or H or a conservative substitution thereof, X6 = S or N or G or H or I or T or a conservative substitution thereof. |
| | SEQ ID NO: 50155 | VL3 | Gln Gln X1 X2 X3 X4 X5 X6 Phe X7, wherein X1 = S or T or Y or a conservative substitution thereof, X2 = Y or N or F or H or a conservative substitution thereof, X3 = S or R or N or F or I or a conservative substitution thereof, X4 = Absent or A or S or a conservative substitution thereof, X5 = P or T or I or F or A or L or V or a conservative substitution thereof, X6 = P or L or F or S or a conservative substitution thereof, X7 = T or A or S or a conservative substitution thereof. |
| VL-CONSENSUS-27 TABLE 107 | SEQ ID NO: 50156 | VL1 | X1 Ser X2 Gln X3 X4 Leu X5 X6 Ser X7 X8 X9 X10 X11 Leu X12, wherein X1 = K or R or T or a conservative substitution thereof, X2 = S or I or a conservative substitution thereof, X3 = S or N or a conservative substitution thereof, X4 = V or I or a conservative substitution thereof, X5 = Y or H or S or F or a conservative substitution thereof, X6 = S or N or I or R or H or a conservative substitution thereof, X7 = N or H or a conservative substitution thereof, X8 = N or S or D or a conservative substitution thereof, X9 = N or Y or K or H or A or M or Q or a conservative substitution thereof, X10 = N or K or a conservative substitution thereof, X11 = Y or F or a conservative substitution thereof, X12 = A or T or D or a conservative substitution thereof. |
| | SEQ ID NO: 50157 | VL2 | Trp X1 X2 X3 Arg X4 X5, wherein X1 = A or T or G or S or a conservative substitution thereof, X2 = S or F |

FIGURE 55
(Continued)

| | | | |
|---|---|---|---|
| | SEQ ID NO: 50158 | VL3 | or a conservative substitution thereof, X3 = T or I or a conservative substitution thereof, X4 = E or K or D or a conservative substitution thereof, X5 = S or F or a conservative substitution thereof. |
| | SEQ ID NO: 50159 | VL3 | X1 X2 X3 X4 X5 X6 X7 X8 X9, wherein X1 = Q or H or a conservative substitution thereof, X2 = Q or H or a conservative substitution thereof, X3 = Y or S or a conservative substitution thereof, X4 = Y or F or K or N or a conservative substitution thereof, X5 = S or T or I or Absent or N or a conservative substitution thereof, X6 = T or S or I or R or A or G or N or a conservative substitution thereof, X7 = P or S or a conservative substitution thereof, X8 = C or Y or G or L or P or a conservative substitution thereof, X9 = S or K or N or a conservative substitution thereof. |
| VL-CONSENSUS-28 TABLE 108 | SEQ ID NO: 50160 | VL1 | Arg Ala X1 Gln X2 X3 X4 X5 X6 Leu Ala, wherein X1 = S or N or a conservative substitution thereof, X2 = G or D or F or N or V or a conservative substitution thereof, X3 = I or L or V or a conservative substitution thereof, X4 = S or N or T or F or G or a conservative substitution thereof, X5 = N or S or D or T or R or a conservative substitution thereof, X6 = W or C or a conservative substitution thereof. |
| | SEQ ID NO: 50161 | VL2 | X1 X2 X3 X4 Leu Gln X5, wherein X1 = A or G or D or T or S or a conservative substitution thereof, X2 = A or V or P or T or a conservative substitution thereof, X3 = S or F or a conservative substitution thereof, X4 = S or N or a conservative substitution thereof, X5 = S or G or N or a conservative substitution thereof. |
| | SEQ ID NO: 50162 | VL3 | X1 Gln X2 X3 Ser X4 Pro X5 Thr, wherein X1 = Q or L or a conservative substitution thereof, X2 = A or T or S or G or V or Y or a conservative substitution thereof, X3 = N or D or H or Y or a conservative substitution thereof, X4 = F or L or a conservative substitution thereof, X5 = W or R or F or a conservative substitution thereof. |
| VL-CONSENSUS-29 TABLE 109 | SEQ ID NO: 50162 | VL1 | Lys Ser X1 Gln X2 X3 X4 X5 X6 Ser X7 X8 X9 X10 Tyr Leu X11, wherein X1 = S or N or a conservative substitution thereof, X2 = S or R or N or a conservative substitution thereof, X3 = V or I or L or a conservative substitution thereof, X4 = L or F or a conservative substitution thereof, X5 = H or F or Y or K or S or a conservative substitution thereof, X6 = S or N or H or a conservative substitution thereof, X7 = N or H or a conservative substitution thereof, X8 = N or S or a conservative substitution thereof, X9 = N or K or Y or H or a conservative substitution thereof, X10 = N or R |

FIGURE 55
(Continued)

| | | | |
|---|---|---|---|
| | SEQ ID NO: 50163 | VL2 | or S or a conservative substitution thereof, X11 = A or T or V or a conservative substitution thereof. |
| | | | Trp Ala Ser X1 X2 X3 Ser, wherein X1 = T or A or L or S or a conservative substitution thereof, X2 = R or L or a conservative substitution thereof, X3 = E or K or D or a conservative substitution thereof. |
| | SEQ ID NO: 50164 | VL3 | X1 Gln X2 X3 X4 X5 Pro X6 Thr, wherein X1 = Q or H or a conservative substitution thereof, X2 = Y or S or a conservative substitution thereof, X3 = Y or C or F or S or H or a conservative substitution thereof, X4 = S or N or Q or D or T or a conservative substitution thereof, X5 = T or L or I or A or F or S or a conservative substitution thereof, X6 = V or F or P or a conservative substitution thereof. |
| VL-CONSENSUS-30 TABLE 110 | SEQ ID NO: 50165 | VL1 | X1 X2 X3 Thr X4 X5 Val Thr Ser X6 X7 X8 Pro X9, wherein X1 = A or V or G or a conservative substitution thereof, X2 = S or F or L or a conservative substitution thereof, X3 = S or N or a conservative substitution thereof, X4 = G or E or a conservative substitution thereof, X5 = A or S or T or a conservative substitution thereof, X6 = G or A or a conservative substitution thereof, X7 = Y or S or N or F or a conservative substitution thereof, X8 = Y or F or a conservative substitution thereof, X9 = N or S or Q or a conservative substitution thereof. |
| | SEQ ID NO: 50166 | VL2 | X1 Thr X2 Asp X3 His Ser, wherein X1 = S or H or N or a conservative substitution thereof, X2 = S or N or D or I or T or a conservative substitution thereof, X3 = K or R or a conservative substitution thereof. |
| | SEQ ID NO: 50167 | VL3 | X1 X2 X3 X4 X5 Gly X6 X7 X8 X9, wherein X1 = L or M or a conservative substitution thereof, X2 = L or I or F or a conservative substitution thereof, X3 = Y or F or a conservative substitution thereof, X4 = Y or C or F or S or a conservative substitution thereof, X5 = G or D or a conservative substitution thereof, X6 = A or V or a conservative substitution thereof, X7 = Q or H or a conservative substitution thereof, X8 = L or V or M or a conservative substitution thereof, X9 = V or A or I or G or M or a conservative substitution thereof. |
| VL-CONSENSUS-31 TABLE 111 | SEQ ID NO: 50168 | VL1 | Arg X1 Ser X2 X3 X4 X5 X6 X7 Leu Ala, wherein X1 = A or S or a conservative substitution thereof, X2 = Q or L or M or V or a conservative substitution thereof, X3 = S or N or D or R or T or a conservative substitution thereof, X4 = V or I or a conservative substitution thereof, X5 = N or K or S or V or A or I or L or a conservative substitution thereof, X6 = S or N or T or a conservative substitution thereof, X7 = N or S or Y or a conservative substitution thereof. |

FIGURE 55
(Continued)

| | SEQ ID NO: 50169 | VL2 | X1 X2 Ser X3 Arg Ala Thr, wherein X1 = G or I or F or V or a conservative substitution thereof, X2 = A or T or a conservative substitution thereof, X3 = T or I or a conservative substitution thereof. |
|---|---|---|---|
| | SEQ ID NO: 50170 | VL3 | Gln X1 X2 X3 X4 X5 X6 X7 Cys Ser, wherein X1 = Q or E or a conservative substitution thereof, X2 = Y or F or a conservative substitution thereof, X3 = N or Y or D or a conservative substitution thereof, X4 = D or N or a conservative substitution thereof, X5 = Absent or W or a conservative substitution thereof, X6 = W or P or a conservative substitution thereof, X7 = P or L or M or a conservative substitution thereof. |
| VL-CONSENSUS-32 TABLE 112 | SEQ ID NO: 50171 | VL1 | Arg X1 Ser X2 X3 X4 X5 X6 X7 X8 Leu X9, wherein X1 = A or S or a conservative substitution thereof, X2 = Q or E or a conservative substitution thereof, X3 = S or R or a conservative substitution thereof, X4 = V or I or a conservative substitution thereof, X5 = S or T or a conservative substitution thereof, X6 = S or T or a conservative substitution thereof, X7 = S or N or a conservative substitution thereof, X8 = Y or A or a conservative substitution thereof, X9 = Y or S or a conservative substitution thereof. |
| | SEQ ID NO: 50172 | VL2 | Gly Ala Ser X1 Arg Ala X2, wherein X1 = T or S or a conservative substitution thereof, X2 = T or S or I or a conservative substitution thereof. |
| | SEQ ID NO: 50173 | VL3 | Gln Gln Tyr X1 X2 Ser X3 Leu Thr wherein X1 = G or V or a conservative substitution thereof, X2 = C or N or S or a conservative substitution thereof, X3 = P or L or a conservative substitution thereof. |
| VL-CONSENSUS-33 TABLE 113 | SEQ ID NO: 50174 | VL1 | Lys Ser Gln X1 Leu X2 X3 X4 X5 Gly X6 Thr X7 Leu X8, wherein X1 = S or T or a conservative substitution thereof, X2 = L or Q or a conservative substitution thereof, X3 = H or R or a conservative substitution thereof, X4 = S or G or a conservative substitution thereof, X5 = E or D or a conservative substitution thereof, X6 = K or R or a conservative substitution thereof, X7 = Y or H or F or a conservative substitution thereof, X8 = Y or N or a conservative substitution thereof. |
| | SEQ ID NO: 50175 | VL2 | Glu X1 Ser X2 Arg X3 Ser, wherein X1 = V or I or a conservative substitution thereof, X2 = N or Y or H or a conservative substitution thereof, X3 = F or I or V or L or a conservative substitution thereof. |
| | SEQ ID NO: 50176 | VL3 | X1 X2 X3 X4 X5 X6 X7 X8 X9, wherein X1 = M or F or a conservative substitution thereof, X2 = Q or H or a conservative substitution thereof, X3 = S or G or N or a conservative substitution thereof, X4 = I or K or T or a conservative substitution thereof, X5 = Q or Absent or |

FIGURE 55
(Continued)

| | | | |
|---|---|---|---|
| VL-CONSENSUS-34 TABLE 114 | SEQ ID NO: 50177 | VL1 | K or H or a conservative substitution thereof, X6 = L or Q or Y or F or H or a conservative substitution thereof, X7 = P or L or V or a conservative substitution thereof, X8 = L or F or P or a conservative substitution thereof, X9 = T or P or S or a conservative substitution thereof. |
| | SEQ ID NO: 50178 | VL2 | Thr Gly Thr Ser Asp X1 Gly X2 Tyr Asn X3 Val Ser, wherein X1 = V or I or a conservative substitution thereof, X2 = G or S or a conservative substitution thereof, X3 = Y or F or a conservative substitution thereof. |
| | SEQ ID NO: 50179 | VL3 | Gln Val X1 Asn Arg Pro Ser, wherein X1 = S or R or a conservative substitution thereof. |
| | | | X1 Ser Tyr X2 X3 X4 X5 Thr Trp Val, wherein X1 = N or G or C or S or a conservative substitution thereof, X2 = T or V or K or a conservative substitution thereof, X3 = R or S or K or a conservative substitution thereof, X4 = S or G or N or R or a conservative substitution thereof, X5 = I or S or Y or a conservative substitution thereof. |
| VL-CONSENSUS-35 TABLE 115 | SEQ ID NO: 50180 | VL1 | Arg X1 Ser X2 X3 Ile X4 X5 X6 Leu Asn, wherein X1 = A or S or a conservative substitution thereof, X2 = Q or H or R or a conservative substitution thereof, X3 = S or N or T or H or a conservative substitution thereof, X4 = S or N or G or T or a conservative substitution thereof, X5 = N or S or R or a conservative substitution thereof, X6 = Y or F or a conservative substitution thereof. |
| | SEQ ID NO: 50181 | VL2 | X1 X2 X3 X4 Leu X5 X6, wherein X1 = A or T or S or V or a conservative substitution thereof, X2 = A or T or F or V or a conservative substitution thereof, X3 = S or L or a conservative substitution thereof, X4 = S or N or a conservative substitution thereof, X5 = Q or H or a conservative substitution thereof, X6 = S or L or a conservative substitution thereof. |
| | SEQ ID NO: 50182 | VL3 | Gln Gln X1 Tyr X2 X3 X4 X5 Trp Thr, wherein X1 = S or G or F or a conservative substitution thereof, X2 = S or T or N or R or a conservative substitution thereof, X3 = T or S or Absent or a conservative substitution thereof, X4 = P or I or a conservative substitution thereof, X5 = T or P or Q or L or a conservative substitution thereof. |
| VL-CONSENSUS-36 TABLE 116 | SEQ ID NO: 50183 | VL1 | Arg Ala Ser Gln X1 Ile Ser X2 X3 Leu Ala, wherein X1 = G or D or a conservative substitution thereof, X2 = S or N or I or K or a conservative substitution thereof, X3 = W or Y or a conservative substitution thereof. |
| | SEQ ID NO: 50184 | VL2 | Ala Ala Ser Leu Gln X1, wherein X1 = S or G or a conservative substitution thereof. |

FIGURE 55
(Continued)

| | SEQ ID NO: 50185 | VL3 | Gln Gln X1 X2 Ser Phe Pro Leu Thr, wherein X1 = I or T or V or A or G or a conservative substitution thereof, X2 = N or K or a conservative substitution thereof. |
|---|---|---|---|
| VL-CONSENSUS-37 TABLE 117 | SEQ ID NO: 50186 | VL1 | Gln Ala X1 Gln X2 Ile X3 X4 X5 Leu Asn, wherein X1 = S or N or a conservative substitution thereof, X2 = D or Y or a conservative substitution thereof, X3 = N or S or T or F or Y or a conservative substitution thereof, X4 = N or D or a conservative substitution thereof, X5 = Y or F or a conservative substitution thereof. |
| | SEQ ID NO: 50187 | VL2 | Asp X1 Ser X2 Leu Glu Thr wherein X1 = A or G or a conservative substitution thereof, X2 = N or T or D or S or a conservative substitution thereof. |
| | SEQ ID NO: 50188 | VL3 | Gln Gln X1 X2 X3 X4 X5 Ile Thr, wherein X1 = Y or F or a conservative substitution thereof, X2 = D or E or a conservative substitution thereof, X3 = N or Absent or I or a conservative substitution thereof, X4 = L or N or V or a conservative substitution thereof, X5 = P or L or a conservative substitution thereof. |
| VL-CONSENSUS-38 TABLE 118 | SEQ ID NO: 50189 | VL1 | Ser Gly Ser Ser Asn X1 Gly X2 X3 X4 X5 Ser, wherein X1 = I or L or a conservative substitution thereof, X2 = N or S or a conservative substitution thereof, X3 = N or H or K or a conservative substitution thereof, X4 = Y or F or a conservative substitution thereof, X5 = V or L or a conservative substitution thereof. |
| | SEQ ID NO: 50190 | VL2 | Asp X1 X2 Lys Arg Pro Ser, wherein X1 = N or S or a conservative substitution thereof, X2 = N or Y or S or a conservative substitution thereof. |
| | SEQ ID NO: 50191 | VL3 | Gly X1 Trp Asp X2 X3 Leu X4 X5 X6 Val, wherein X1 = T or A or I or a conservative substitution thereof, X2 = S or G or I or R or a conservative substitution thereof, X3 = S or R or a conservative substitution thereof, X4 = S or N or a conservative substitution thereof, X5 = V or A or T or a conservative substitution thereof, X6 = G or V or M or a conservative substitution thereof. |
| VL-CONSENSUS-39 TABLE 119 | SEQ ID NO: 50243 | VL1 | Arg X1 Ser Gln Ser Leu X2 X3 X4 X5 X6 X7 Asn X8 Leu Asp, wherein X1 = S or Y or a conservative substitution thereof, X2 = L or V or a conservative substitution thereof, X3 = H or Y or a conservative substitution thereof, X4 = S or N or H or a conservative substitution thereof, X5 = N or S or a conservative substitution thereof, X6 = G or K or R or a conservative substitution thereof, X7 = Y or H or N or a conservative substitution thereof, X8 = Y or R or S or a conservative substitution thereof. |

FIGURE 55
(Continued)

| | | | |
|---|---|---|---|
| | SEQ ID NO: 50244 | VL2 | X1 Gly Ser X2 Arg Ala Ser, wherein X1 = L or V or a conservative substitution thereof, X2 = N or H or a conservative substitution thereof. |
| | SEQ ID NO: 50245 | VL3 | Met Gln X1 Leu X2 X3 X4 X5 X6 Thr, wherein X1 = A or P or T or V or a conservative substitution thereof, X2 = H or Q or Absent or T or a conservative substitution thereof, X3 = Absent or T or a conservative substitution thereof, X4 = P or Q or T or I or a conservative substitution thereof, X5 = P or T or a conservative substitution thereof, X6 = L or P or F or a conservative substitution thereof. |
| VL-CONSENSUS-40 TABLE 120 | SEQ ID NO: 50192 | VL1 | Ser Gly X1 X2 Ser X3 Ile Gly X4 X5 X6 X7 X8, wherein X1 = S or T or a conservative substitution thereof, X2 = S or N or a conservative substitution thereof, X3 = N or Y or a conservative substitution thereof, X4 = S or N or a conservative substitution thereof, X5 = N or Y or a conservative substitution thereof, X6 = T or A or S or a conservative substitution thereof, X7 = V or I or a conservative substitution thereof, X8 = N or D or S or a conservative substitution thereof. |
| | SEQ ID NO: 50193 | VL2 | X1 X2 X3 X4 Arg Pro Ser, wherein X1 = S or T or a conservative substitution thereof, X2 = N or S or a conservative substitution thereof, X3 = N or D or S or a conservative substitution thereof, X4 = Q or H or a conservative substitution thereof. |
| | SEQ ID NO: 50194 | VL3 | X1 Ala Trp Asp X2 X3 X4 X5 X6 X7 X8, wherein X1 = A or E or a conservative substitution thereof, X2 = S or Absent or a conservative substitution thereof, X3 = Absent or L or a conservative substitution thereof, X4 = L or N or M or S or a conservative substitution thereof, X5 = N or G or K or L or a conservative substitution thereof, X6 = G or H or N or a conservative substitution thereof, X7 = V or P or G or a conservative substitution thereof, X8 = V or P or a conservative substitution thereof. |
| VL-CONSENSUS-41 TABLE 121 | SEQ ID NO: 50195 | VL1 | Ser Gly Ser X1 Ser Asn Ile Gly X2 X3 X4 Val X5, wherein X1 = S or N or C or a conservative substitution thereof, X2 = S or N or H or a conservative substitution thereof, X3 = N or H or a conservative substitution thereof, X4 = I or T or a conservative substitution thereof, X5 = T or N or a conservative substitution thereof. |
| | SEQ ID NO: 50196 | VL2 | X1 Asn X2 Gln Arg Pro Ser, wherein X1 = S or Q or N or V or a conservative substitution thereof, X2 = D or K or N or Y or a conservative substitution thereof. |
| | SEQ ID NO: 50197 | VL3 | X1 X2 Trp Asp Ala Ser Leu X3 X4 Trp Val, wherein X1 = A or T or a conservative substitution thereof, X2 = |

FIGURE 55
(Continued)

| VL-CONSENSUS-42 TABLE 122 | SEQ ID NO: 50198 | VL1 | Arg X1 Ser Gln X2 X3 Arg X4 Asp Leu Gly, wherein X1 = A or T or a conservative substitution thereof, X2 = G or D or R or a conservative substitution thereof, X3 = I or V or a conservative substitution thereof, X4 = N or S or a conservative substitution thereof. |
|---|---|---|---|
| | SEQ ID NO: 50199 | VL2 | X1 Ala Ser X2 Leu X3 Ser, wherein X1 = A or D or I or T or a conservative substitution thereof, X2 = S or N or a conservative substitution thereof, X3 = Q or E or F or L or a conservative substitution thereof. |
| | SEQ ID NO: 50200 | VL3 | X1 X2 X3 X4 X5 X6 X7 Pro X8 Thr wherein, X1 = L or I or a conservative substitution thereof, X2 = Q or H or a conservative substitution thereof, X3 = H or Y or a conservative substitution thereof, X4 = N or H or S or a conservative substitution thereof, X5 = S or N or a conservative substitution thereof, X6 = Absent or Y or a conservative substitution thereof, X7 = Y or L or F or P or a conservative substitution thereof, X8 = I or P or L or a conservative substitution thereof. |
| VL-CONSENSUS-43 TABLE 123 | SEQ ID NO: 50201 | VL1 | Arg X1 Ser Gln X2 X3 X4 X5 Tyr X6 X7, wherein X1 = A or T or a conservative substitution thereof, X2 = S or N or Y or a conservative substitution thereof, X3 = I or S or F or a conservative substitution thereof, X4 = S or F or N or R or T or a conservative substitution thereof, X5 = S or D or G or R or a conservative substitution thereof, X6 = L or S or a conservative substitution thereof, X7 = N or S or a conservative substitution thereof. |
| | SEQ ID NO: 50202 | VL2 | X1 X2 X3 X4 X5 X6 X7, wherein X1 = A or D or G or S or a conservative substitution thereof, X2 = A or T or a conservative substitution thereof, X3 = S or Y or a conservative substitution thereof, X4 = S or T or a conservative substitution thereof, X5 = L or F or a conservative substitution thereof, X6 = Q or E or K or a conservative substitution thereof, X7 = S or T or a conservative substitution thereof. |
| | SEQ ID NO: 50203 | VL3 | X1 X2 X3 X4 X5 X6 X7 X8 X9, wherein X1 = Q or H or a conservative substitution thereof, X2 = Q or E or a conservative substitution thereof, X3 = T or a conservative substitution thereof, X4 = Y or F or a conservative substitution thereof, X5 = S or G or N or a conservative substitution thereof, X6 = I or T or L or N or S or a conservative substitution thereof, X7 = P or S or R or T or a conservative substitution thereof, X8 = I or F or P or a conservative substitution thereof, X9 = T or A or a conservative substitution thereof. |

FIGURE 55
(Continued)

| | SEQ ID NO | | |
|---|---|---|---|
| VL-CONSENSUS-44 TABLE 124 | SEQ ID NO: 50204 | VL1 | X1 X2 X3 Gln X4 X5 X6 His X7 X8 Gly X9 Thr Tyr Leu Tyr, wherein X1 = K or R or a conservative substitution thereof, X2 = S or T or a conservative substitution thereof, X3 = S or N or a conservative substitution thereof, X4 = S or I or a conservative substitution thereof, X5 = L or F or a conservative substitution thereof, X6 = L or V or a conservative substitution thereof, X7 = S or N or R or a conservative substitution thereof, X8 = E or D or a conservative substitution thereof, X9 = K or R or a conservative substitution thereof. |
| | SEQ ID NO: 50205 | VL2 | Glu X1 Ser X2 Arg X3 Ser, wherein X1 = V or L or a conservative substitution thereof, X2 = N or K or H or a conservative substitution thereof, X3 = F or L or V or a conservative substitution thereof. |
| | SEQ ID NO: 50246 | VL3 | X1 Gln Ser X2 X3 X4 X5 Ile X6, wherein X1 = M or I or L or a conservative substitution thereof, X2 = I or M or a conservative substitution thereof, X3 = Q or Absent or L or a conservative substitution thereof, X4 = L or Y or I or Q or a conservative substitution thereof, X5 = P or L or a conservative substitution thereof, X6 = T or I or a conservative substitution thereof. |
| VL-CONSENSUS-45 TABLE 125 | SEQ ID NO: 50206 | VL1 | Arg Ala Ser X1 X2 X3 X4 X5 X6 X7 Leu Ala, wherein X1 = Q or R or a conservative substitution thereof, X2 = S or G or N or a conservative substitution thereof, X3 = V or I or a conservative substitution thereof, X4 = I or S or G or a conservative substitution thereof, X5 = S or N or a conservative substitution thereof, X6 = S or I or N or a conservative substitution thereof, X7 = Y or F or a conservative substitution thereof. |
| | SEQ ID NO: 50207 | VL2 | Gly X1 Ser X2 X3 Ala Thr, wherein X1 = V or A or T or a conservative substitution thereof, X2 = S or N or T or a conservative substitution thereof, X3 = R or W or a conservative substitution thereof. |
| | SEQ ID NO: 50208 | VL3 | X1 X2 X3 X4 X5 Ser X6 X7 Asn, wherein X1 = Q or H or a conservative substitution thereof, X2 = Q or H or a conservative substitution thereof, X3 = Y or N or a conservative substitution thereof, X4 = G or D or a conservative substitution thereof, X5 = R or Absent or N or Y or a conservative substitution thereof, X6 = P or L or M or a conservative substitution thereof, X7 = N or T or a conservative substitution thereof. |
| VL-CONSENSUS-46 TABLE 126 | SEQ ID NO: 50209 | VL1 | Arg X1 Ser Gln X2 X3 X4 X5 X6 X7 Ala, wherein X1 = A or S or a conservative substitution thereof, X2 = S or D or T or a conservative substitution thereof, X3 = V or I or a conservative substitution thereof, X4 = S or N or I or a conservative substitution thereof, X5 = S or R or I or a conservative substitution thereof. |

FIGURE 55
(Continued)

| | | | |
|---|---|---|---|
| | SEQ ID NO: 50210 | VL2 | or L or T or a conservative substitution thereof, X6 = N or Y or a conservative substitution thereof, X7 = L or I or a conservative substitution thereof. |
| | SEQ ID NO: 50211 | VL3 | Gly Ala Ser Thr Arg Ala X1, wherein X1 = T or S or a conservative substitution thereof. |
| | | | Gln X1 X2 X3 X4 X5 X6 X7 X8 X9, wherein X1 = Q or E or a conservative substitution thereof, X2 = Y or S or a conservative substitution thereof, X3 = N or D or P or H or a conservative substitution thereof, X4 = D or N or Absent or T or a conservative substitution thereof, X5 = Absent or W or a conservative substitution thereof, X6 = W or P or C or N or a conservative substitution thereof, X7 = P or L or W or a conservative substitution thereof, X8 = W or L or C or P or R or a conservative substitution thereof, X9 = T or P or S or a conservative substitution thereof. |
| VL-CONSENSUS-47 TABLE 127 | SEQ ID NO: 50256 | VL1 | Arg Ala Ser Gln X1 Ile Gly X2 X3 Leu His, wherein X1 = S or N or a conservative substitution thereof, X2 = S or N or a conservative substitution thereof, X3 = S or N or T or a conservative substitution thereof. |
| | SEQ ID NO: 50257 | VL2 | X1 Ala Ser Gln Ser Phe Ser, wherein X1 = Y or S or a conservative substitution thereof. |
| | SEQ ID NO: 50258 | VL3 | X1 Gln Ser X2 Ser X3 Pro X4 Thr, wherein X1 = H or Q or a conservative substitution thereof, X2 = S or G or R or a conservative substitution thereof, X3 = L or F or a conservative substitution thereof, X4 = W or R or Q or a conservative substitution thereof. |
| VL-CONSENSUS-48 TABLE 128 | SEQ ID NO: 50247 | VL1 | Arg Ala Ser Gln X1 Ile X2 X3 Asp Leu Gly, wherein X1 = G or A or a conservative substitution thereof, X2 = R or G or a conservative substitution thereof, X3 = N or D or a conservative substitution thereof. |
| | SEQ ID NO: 50248 | VL2 | Ala X1 Ser Leu Gln Ser, wherein X1 = A or T or a conservative substitution thereof. |
| | SEQ ID NO: 50249 | VL3 | Leu Gln His X1 X2 X3 Pro X4 Ser, wherein X1 = Y or N or a conservative substitution thereof, X2 = S or N or a conservative substitution thereof, X3 = Y or F or a conservative substitution thereof, X4 = R or Y or a conservative substitution thereof. |
| VL-CONSENSUS-49 TABLE 129 | SEQ ID NO: 50212 | VL1 | X1 Ala Ser Gln X2 Ile X3 X4 X5 Leu X6, wherein X1 = R or Q or a conservative substitution thereof, X2 = G or D or a conservative substitution thereof, X3 = S or N or a conservative substitution thereof, X4 = N or K or a conservative substitution thereof, X5 = Y or F or a conservative substitution thereof, X6 = A or N or V or a conservative substitution thereof. |

FIGURE 55 (Continued)

| | | | |
|---|---|---|---|
| | SEQ ID NO: 50213 | VL2 | X1 Ala X2 X3 Leu X4 X5, wherein X1 = A or D or G or T or a conservative substitution thereof, X2 = S or T or a conservative substitution thereof, X3 = S or R or N or a conservative substitutions thereof, X4 = Q or H or L or V or a conservative substitution thereof, X5 = S or T or a conservative substitution thereof. |
| | SEQ ID NO: 50214 | VL3 | X1 X2 Tyr X3 X4 X5 Pro X6 Thr, wherein X1 = Q or H or L or a conservative substitution thereof, X2 = Q or H or L or a conservative substitution thereof, X3 = L or H or D or K or N or Y or a conservative substitution thereof, X4 = S or N or H or T or a conservative substitution thereof, X5 = Y or L or a conservative substitution thereof, X6 = I or L or a conservative substitution thereof. |
| VL-CONSENSUS-50 TABLE 130 | SEQ ID NO: 50215 | VL1 | X1 Ala X2 Gln Ser X3 Gly Ser Ser Leu His, wherein X1 = S or N or a conservative substitution thereof, X2 = S or N or a conservative substitutions thereof, X3 = S or R or a conservative substitution thereof. |
| | SEQ ID NO: 50216 | VL2 | Tyr Ala Ser Gln Ser X1 Ser, wherein X1 = F or L or a conservative substitution thereof. |
| | SEQ ID NO: 50217 | VL3 | His Gln X1 X2 X3 Leu Pro Leu Thr, wherein X1 = S or T or a conservative substitution thereof, X2 = R or G or S or a conservative substitution thereof, X3 = R or S or T or a conservative substitution thereof. |
| VL-CONSENSUS-51 TABLE 131 | SEQ ID NO: 50218 | VL1 | Gln Gly Asp X1 Leu Arg X2 Tyr Tyr X3 X4, wherein X1 = S or T or K, or a conservative substitution thereof, X2 = P or N or S or T or a conservative substitution thereof, X3 = A or V or a conservative substitution thereof, X4 = S or N or a conservative substitution thereof. |
| | SEQ ID NO: 50219 | VL2 | X1 Lys Asn X2 Arg Pro Ser, wherein X1 = G or A or T or a conservative substitution thereof, X2 = N or S or a conservative substitution thereof. |
| | SEQ ID NO: 50220 | VL3 | Asn Ser Arg Asp Ser X1 X2 X3 X4 X5 X6 X7, wherein X1 = S or C or a conservative substitution thereof, X2 = G or Absent or a conservative substitution thereof, X3 = N or G or a conservative substitution thereof, X4 = H or N or S or a conservative substitution thereof, X5 = L or H or a conservative substitution thereof, X6 = V or L or a conservative substitution thereof, X7 = V or L or a conservative substitution thereof. |
| VL-CONSENSUS-52 TABLE 132 | SEQ ID NO: 50221 | VL1 | Arg Ser X1 Gln Ser Leu Val Tyr Ser Asp Gly Asn Thr X2 Leu Asn, wherein X1 = S or G or a conservative substitution thereof, X2 = Y or S or a conservative substitution thereof. |
| | SEQ ID NO: 50222 | VL2 | X1 Val Ser X2 Trp Asp X3, wherein X1 = K or E or a conservative substitution thereof, X2 = N or K or a |

FIGURE 55
(Continued)

| | | | |
|---|---|---|---|
| | SEQ ID NO: 50223 | VL3 | conservative substitution thereof, X3 = S or Y or a conservative substitution thereof. |
| VL-CONSENSUS-53 TABLE 133 | SEQ ID NO: 50224 | VL1 | Met Gln Gly X1 X2 X3 X4 X5 Thr, wherein X1 = T or I or a conservative substitution thereof, X2 = H or Absent or a conservative substitution thereof, X3 = W or H or a conservative substitution thereof, X4 = P or L or S or W or a conservative substitution thereof, X5 = L or P or a conservative substitution thereof. |
| | SEQ ID NO: 50225 | VL2 | Arg X1 Ser Gln Ser X2 X3 X4 X5 X6 Ala, wherein X1 = A or P or T or a conservative substitution thereof, X2 = V or F or a conservative substitution thereof, X3 = S or R or W or a conservative substitution thereof, X4 = R or I or S or a conservative substitution thereof, X5 = N or D or S or a conservative substitution thereof, X6 = L or V or a conservative substitution thereof. |
| | SEQ ID NO: 50226 | VL3 | X1 Ala X2 X3 Arg Ala Thr, wherein X1 = G or D or a conservative substitution thereof, X2 = S or A or a conservative substitution thereof, X3 = T or I or A or a conservative substitution thereof. |
| VL-CONSENSUS-54 TABLE 134 | SEQ ID NO: 50250 | VL1 | Gln Gln Tyr X1 X2 X3 X4 Pro Leu Thr, wherein X1 = N or Y or a conservative substitution thereof, X2 = N or T or Y or a conservative substitution thereof, X3 = Absent or W or a conservative substitution thereof, X4 = W or P or a conservative substitution thereof. |
| | SEQ ID NO: 50251 | VL2 | Gly Gly X1 Asn Ile X2 X3 X4 X5 Val His, wherein X1 = N or D or a conservative substitution thereof, X2 = G or R or a conservative substitution thereof, X3 = R or S or a conservative substitution thereof, X4 = K or R or a conservative substitution thereof, X5 = N or A or a conservative substitution thereof. |
| | SEQ ID NO: 50252 | VL3 | X1 Asp X2 X3 Arg X4 Ser, wherein X1 = R or S or a conservative substitution thereof, X2 = S or R or a conservative substitution thereof, X3 = D or N or Y or a conservative substitution thereof, X4 = P or S or a conservative substitution thereof. |
| | | | Gln X1 Trp Asp Ser X2 X3 X4 X5 X6 Val, wherein X1 = V or D or a conservative substitution thereof, X2 = Absent or S or a conservative substitution thereof, X3 = Absent or S or a conservative substitution thereof, X4 = S or D or G or a conservative substitution thereof, X5 = T or H or a conservative substitution thereof, X6 = V or A or G or a conservative substitution thereof. |

Table 24

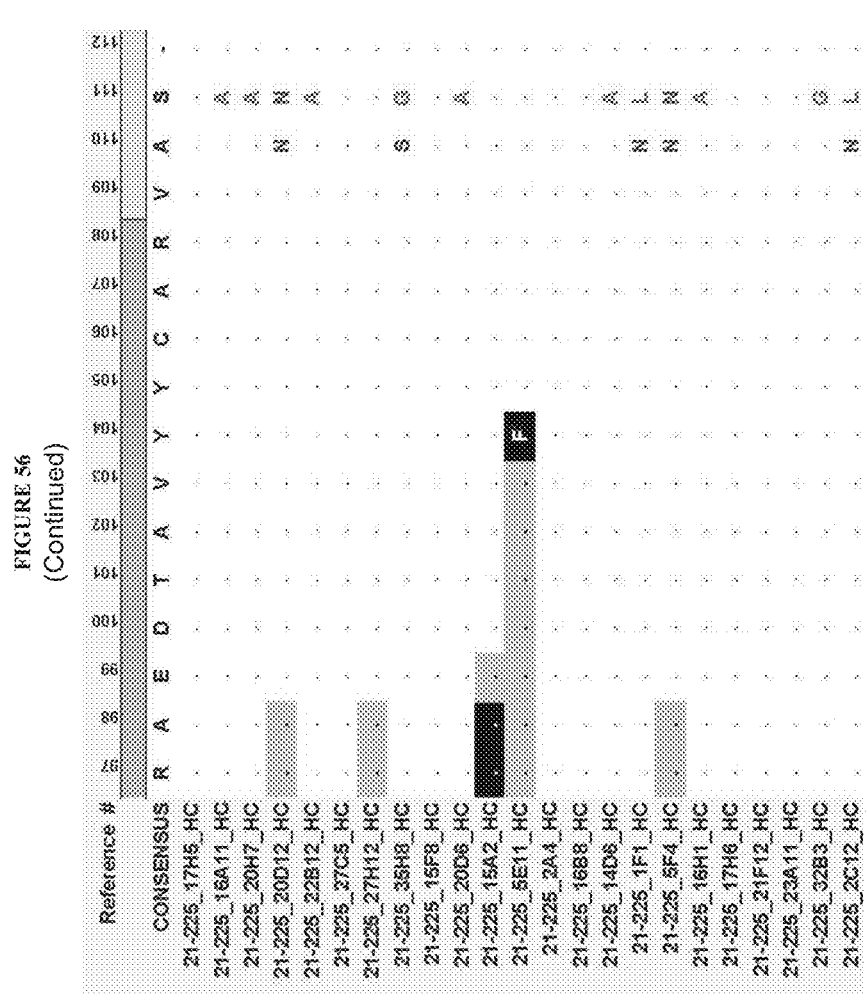

FIGURE 56
(Continued)

Table 25

| Reference # | 1 D | 2 I | 3 Q | 4 M | 5 T | 6 Q | 7 S | 8 P | 9 S | 10 S | 11 L | 12 S | 13 A | 14 S | 15 V | 16 G | 17 Q |
|---|---|---|---|---|---|---|---|---|---|---|---|---|---|---|---|---|---|
| CONSENSUS | D | I | Q | M | T | Q | S | P | S | S | L | S | A | S | V | G | Q |
| 21-225_2C12_LC | . | . | . | . | . | . | . | . | . | . | . | . | . | . | . | . | . |
| 21-225_17H5_LC | . | . | . | . | . | . | . | . | . | . | . | . | . | . | . | . | . |
| 21-225_16A11_LC | . | . | . | . | . | . | . | . | . | . | . | . | . | . | . | . | . |
| 21-225_20H7_LC | . | . | . | . | . | . | . | . | . | . | . | . | . | . | . | . | . |
| 21-225_20D12_LC | . | . | . | . | . | . | . | . | . | . | . | . | . | . | . | . | . |
| 21-225_22B12_LC | . | . | . | . | . | . | . | . | . | . | . | . | . | . | . | . | . |
| 21-225_27C5_LC | . | . | . | . | . | . | . | . | . | . | V | . | . | . | . | . | . |
| 21-225_27H12_LC | . | . | . | . | . | . | . | . | . | . | . | . | . | . | . | . | . |
| 21-225_35H8_LC | . | . | . | . | . | . | . | . | . | . | . | S | . | . | . | . | . |
| 21-225_15F8_LC | . | . | . | . | . | . | . | . | . | . | . | S | . | . | . | . | . |
| 21-225_20B6_LC | . | . | . | . | . | . | . | . | . | . | . | S | . | . | . | . | . |
| 21-225_15A2_LC | . | . | . | . | . | . | . | . | . | . | . | . | . | S | . | . | . |
| 21-225_5E11_LC | V | . | . | . | . | . | . | . | . | . | . | . | . | . | . | . | . |
| 21-225_2A4_LC | . | . | . | . | . | . | . | . | . | . | . | . | . | . | . | . | . |
| 21-225_16B8_LC | . | . | . | . | . | . | . | . | . | . | . | . | . | . | . | . | . |
| 21-225_14D6_LC | . | . | . | . | . | . | . | . | . | . | . | . | . | . | . | . | . |
| 21-225_1F1_LC | . | . | . | . | . | . | . | . | . | . | . | . | . | . | . | . | . |
| 21-225_5F3_LC | . | . | . | . | . | . | . | . | . | . | . | . | . | . | . | . | . |
| 21-225_16H1_LC | . | . | . | . | . | . | . | . | . | . | . | . | . | . | . | . | . |
| 21-225_17H6_LC | . | . | . | . | . | . | . | . | . | . | . | . | . | . | . | . | . |
| 21-225_21F12_LC | . | . | . | . | . | . | . | . | . | . | . | . | . | . | . | . | . |
| 21-225_23A11_LC | . | . | . | . | . | . | . | . | . | . | . | . | T | . | . | . | . |
| 21-225_32B3_LC | . | . | . | . | . | . | . | . | . | . | . | . | . | . | V | . | . |

Table 28

Table 30

| Reference # | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| | | | | | | | | | | | | | | | | KLRR1 | |
| CONSENSUS | Q | V | Q | L | V | E | S | - | G | G | G | V | V | Q | P | G | R |
| 21-225_17H3_HC | . | . | . | . | . | . | . | . | . | . | . | . | . | . | . | . | |
| 21-225_20B2_HC | . | . | . | . | . | . | . | . | . | . | . | . | . | . | . | . | |
| 21-225_22F4_HC | . | . | . | . | . | . | . | . | . | . | . | . | . | . | . | . | |
| 21-225_24B8_HC | . | . | . | . | . | . | . | . | . | . | . | . | . | . | . | . | |
| 21-225_33A10_HC | . | . | . | . | . | . | . | . | . | . | . | . | . | . | . | . | |
| 21-225_25A2_HC | . | . | . | . | . | . | . | . | . | . | . | . | . | . | . | . | |
| 21-225_25D12_HC | . | . | . | . | . | . | . | . | . | . | . | . | . | . | . | . | |
| 21-225_33H2_HC | . | . | . | . | . | . | . | . | . | . | . | . | . | . | . | . | |
| 21-225_29H4_HC | . | . | . | . | . | . | . | . | . | . | . | . | . | . | . | . | |
| 21-225_26A11_HC | . | . | . | . | . | . | . | . | . | . | . | . | . | . | . | . | |
| 21-225_36G7_HC | . | . | . | . | . | . | . | . | . | . | . | . | . | . | . | . | |
| 21-225_27E7_HC | . | . | . | . | . | . | . | . | . | . | . | . | . | . | . | . | |
| 21-225_4C5_HC | . | . | . | . | . | . | . | . | . | . | . | . | . | . | . | . | |
| 21-225_14E10_HC | . | . | . | . | . | . | . | . | . | . | . | . | . | . | . | . | |
| 21-225_10E9_HC | . | . | . | . | . | . | . | . | . | . | . | . | . | . | . | . | |
| 21-225_2G4_HC | . | . | . | . | . | . | . | . | . | . | . | . | . | . | . | . | |
| 21-225_3H10_HC | . | . | . | . | . | . | . | . | . | . | . | . | . | . | . | . | |
| 21-225_7C9_HC | . | . | . | . | . | . | . | . | . | . | . | . | . | . | . | . | |
| 21-225_4C12_HC | . | . | . | . | . | . | . | . | . | . | . | . | . | . | . | . | |
| 21-225_7G4_HC | . | . | . | . | . | . | . | . | . | . | . | . | . | . | . | . | |
| 21-225_15C11_HC | . | . | . | . | . | . | . | . | . | . | . | . | . | . | . | . | |
| 21-225_8E5_HC | . | . | . | . | . | . | . | . | . | . | . | . | . | . | . | . | |

| Reference # | 137 | 138 | 139 | 140 | 141 | 142 | 143 | 144 | 145 | 146 | 147 | 148 | 149 |
|---|---|---|---|---|---|---|---|---|---|---|---|---|---|
| Linear # | 101 | 102 | 103 | 104 | 105 | 106 | 107 | 108 | 109 | 110 | 111 | 112 | 113 |
| CONSENSUS | V | V | F | G | G | G | T | K | L | T | V | L | G |
| 21-225_18E10_LC | | | | | | | | | | | | | |
| 21-225_19D1_LC | | | | | | | | | | | | | |
| 21-225_4B3_LC | | | | | | | | | | | | | |
| 21-225_21D12_LC | | L | | | | | | | | | | | |
| 21-225_13F8_LC | A | | | | | | | R | | | | | |
| 21-225_31D12_LC | A | | | | | | | | | | | | |
| 21-225_33E6_LC | A | | | | | | | | | | | | |
| 21-225_35E1_LC | | | | | | | | | | | | | |
| 21-225_17D3_LC | A | | | | | | | | | | | | R |
| 21-225_16F3_LC | | | | | | | | | | | | | |
| 21-225_9G9_LC | | | | | | R | | | | | | | |

FIGURE 56
(Continued)

Table 37

FIGURE 56
(Continued)

Table 38

| Reference # | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| | | | | | | | | | | | | KLPR1 | | | | | |
| CONSENSUS | D | I | Q | M | T | Q | S | P | S | S | L | S | A | S | V | G | Q |
| 21-225_2C12_LC | . | . | . | . | . | . | . | . | . | . | . | . | . | . | . | . | . |
| 21-225_17H5_LC | . | . | . | . | . | . | . | . | . | . | . | . | . | . | . | . | . |
| 21-225_16A11_LC | . | . | . | . | . | . | . | . | . | . | . | . | . | . | . | . | . |
| 21-225_20H7_LC | . | . | . | . | . | . | . | . | . | . | . | . | . | . | . | . | . |
| 21-225_20D12_LC | . | . | . | . | . | . | . | . | . | . | . | . | . | . | . | . | . |
| 21-225_22B12_LC | . | . | . | . | . | . | . | . | . | . | . | . | . | . | . | . | . |
| 21-225_27C5_LC | . | . | . | . | . | . | . | . | . | . | . | . | . | . | . | . | . |
| 21-225_27H12_LC | . | . | . | . | . | . | . | . | . | . | V | . | . | . | . | . | . |
| 21-225_35H8_LC | . | . | . | . | . | . | . | . | . | . | . | . | . | . | . | . | . |
| 21-225_15F8_LC | . | . | . | . | . | . | . | . | . | . | . | A | . | . | . | . | . |
| 21-225_20B6_LC | . | . | . | . | . | . | . | . | . | . | . | A | . | . | . | . | . |
| 21-225_15A2_LC | . | . | . | . | . | . | . | . | . | . | . | A | . | . | . | . | . |
| 21-225_5E11_LC | V | . | . | . | . | . | . | . | . | . | . | . | . | A | . | . | . |
| 21-225_2A4_LC | . | . | . | . | . | . | . | . | . | . | . | . | . | . | . | . | . |
| 21-225_16B8_LC | . | . | . | . | . | . | . | . | . | . | . | . | . | . | . | . | . |
| 21-225_14D6_LC | . | . | . | . | . | . | . | . | . | . | . | . | . | . | . | . | . |
| 21-225_1F1_LC | . | . | . | . | . | . | . | . | . | . | . | . | . | . | . | . | . |
| 21-225_5F3_LC | . | . | . | . | . | . | . | . | . | . | . | . | . | . | . | . | . |
| 21-225_16H1_LC | . | . | . | . | . | . | . | . | . | . | . | . | . | . | . | . | . |
| 21-225_17H6_LC | . | . | . | . | . | . | . | . | . | . | . | . | . | . | . | . | . |
| 21-225_21F12_LC | . | . | . | . | . | . | . | . | . | . | . | . | . | . | . | . | . |
| 21-225_23A11_LC | . | . | . | . | . | . | . | . | . | . | . | . | T | . | . | . | . |
| 21-225_32B3_LC | . | . | . | . | . | . | . | . | . | . | . | . | . | . | . | . | . |

Table 42

| Reference # | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| CONSENSUS | D | I | Q | M | T | Q | S | P | S | S | L | S | A | S | V | G | D |
| 21-225_11A5_LC | . | . | . | . | . | . | . | . | . | . | . | . | . | . | . | . | . |
| 21-225_17C6_LC | . | . | . | . | . | . | . | . | . | . | . | . | . | . | . | . | . |
| 21-225_17B4_LC | . | . | . | . | . | . | . | . | . | . | . | . | . | . | . | . | . |
| 21-225_30A4_LC | . | . | . | . | . | . | . | . | < | . | . | . | . | . | . | . | . |
| 21-225_17F7_LC | . | . | . | . | . | . | . | . | . | . | . | . | . | . | . | . | . |
| 21-225_17F11_LC | . | . | . | . | . | . | . | . | . | . | . | . | . | . | . | . | . |
| 21-225_17A12_LC | . | . | . | . | . | . | . | . | . | . | . | . | . | . | . | . | . |
| 21-225_18E12_LC | . | . | . | . | . | . | . | . | . | . | . | . | . | . | . | . | . |
| 21-225_22G3_LC | . | . | . | . | . | . | . | . | . | . | . | . | . | . | . | . | . |
| 21-225_32G10_LC | . | . | . | . | . | . | . | . | . | . | . | . | . | . | . | . | . |
| 21-225_21F4_LC | . | . | . | . | . | . | . | . | < | . | . | . | . | . | . | . | . |
| 21-225_22E4_LC | . | . | . | . | . | . | . | . | . | . | . | . | . | . | . | . | . |
| 21-225_21A2_LC | . | . | . | . | . | . | . | . | . | . | . | . | . | . | . | . | . |
| 21-225_22C5_LC | . | . | . | . | . | . | . | . | . | . | . | . | . | . | . | . | . |
| 21-225_22D5_LC | . | . | . | . | . | . | . | . | . | . | . | . | . | . | . | . | . |
| 21-225_10F12_LC | . | . | . | . | . | . | J | . | . | . | . | . | . | . | . | . | . |
| 21-225_4H2_LC | . | . | . | . | . | . | . | . | . | . | & | . | . | . | . | . | . |
| 21-225_5G2_LC | . | . | . | . | . | . | . | . | . | . | & | . | . | . | . | . | . |
| 21-225_3E3_LC | . | . | . | . | . | . | . | . | . | . | & | . | . | . | . | . | . |
| 21-225_5F7_LC | . | . | . | . | . | . | . | . | . | . | . | . | . | . | . | . | . |
| 21-225_6D3_LC | . | . | . | . | . | . | . | . | . | . | . | . | . | . | . | . | . |
| 21-225_8G8_LC | . | . | . | . | . | . | . | . | . | . | . | . | . | . | . | . | . |
| 21-225_16H6_LC | . | . | . | . | . | . | . | . | . | . | . | . | . | . | . | . | . |
| 21-225_3B1_LC | . | . | . | . | . | . | . | . | . | . | . | . | . | . | . | . | . |
| 21-225_8E12_LC | . | . | . | . | . | . | . | . | . | . | . | . | . | . | . | . | . |

Table 43

Table 44

Table 45

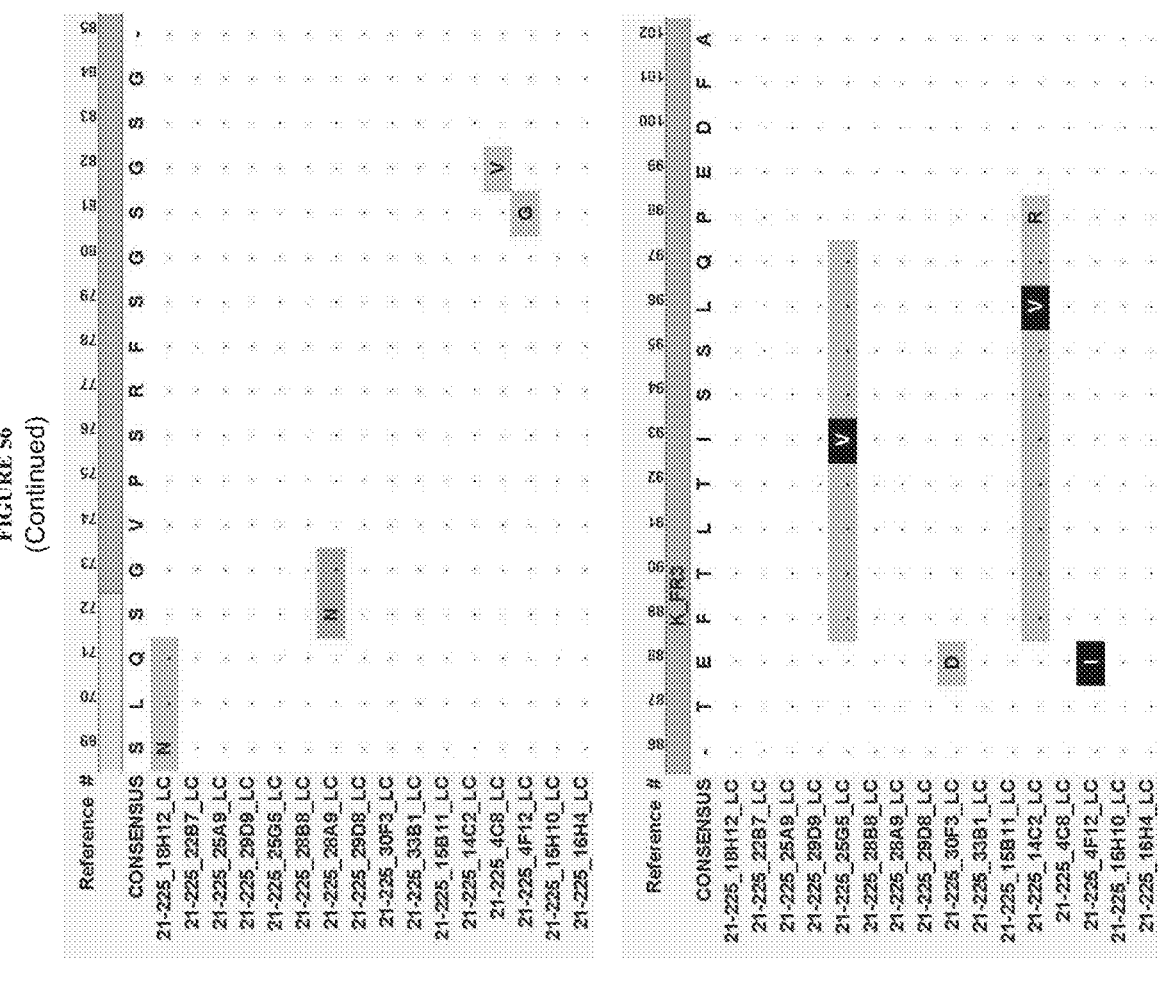

Table 47

| Reference # | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| CONSENSUS | D | I | Q | M | T | Q | S | P | S | S | L | S | A | S | V | G | D |
| 21-225_8D12_LC | . | . | . | . | . | . | . | . | . | . | . | . | . | . | . | . | . |
| 21-225_20C2_LC | . | . | . | . | . | . | . | . | . | . | . | . | . | . | . | Q | . |
| 21-225_18C6_LC | . | . | . | . | . | . | . | . | . | . | . | . | . | . | . | . | . |
| 21-225_18A3_LC | . | . | . | . | . | . | . | . | . | . | . | . | . | . | . | . | . |
| 21-225_22D12_LC | . | . | . | . | . | . | . | . | . | . | . | . | . | . | . | . | . |
| 21-225_23D1_LC | . | . | . | . | . | . | . | . | . | . | . | . | . | . | . | . | . |
| 21-225_24E5_LC | . | . | . | . | . | . | . | . | . | . | . | . | . | . | . | . | . |
| 21-225_22C1_LC | . | . | . | . | . | . | . | . | . | . | . | . | . | . | . | . | . |
| 21-225_20G9_LC | . | . | . | . | . | . | . | . | . | . | . | . | . | . | . | . | . |
| 21-225_21G7_LC | . | . | . | . | . | . | . | . | . | . | . | . | . | . | . | . | . |
| 21-225_22G9_LC | . | . | . | . | . | . | . | . | . | . | . | . | . | . | . | . | . |
| 21-225_34C4_LC | . | . | . | . | . | . | . | . | . | . | . | . | . | . | . | . | . |
| 21-225_2F7_LC | . | . | . | . | . | . | . | . | . | . | . | . | . | . | . | . | . |
| 21-225_3G4_LC | . | . | . | . | . | . | . | . | . | . | . | . | . | . | . | . | . |
| 21-225_7F4_LC | . | . | . | . | . | . | . | . | . | . | . | . | . | . | . | . | . |
| 21-225_8D4_LC | . | . | . | . | . | . | . | . | . | . | . | . | . | . | . | . | . |
| 21-225_15A1_LC | . | . | . | . | . | . | . | . | . | . | . | . | . | . | . | . | . |
| 21-225_15G7_LC | . | . | . | . | . | . | . | . | . | . | . | . | . | . | . | . | . |
| 21-225_11F10_LC | . | . | . | . | . | . | . | . | . | . | . | . | . | . | . | . | . |
| 21-225_15H1_LC | . | . | . | . | . | . | . | . | . | . | . | . | . | . | . | . | . |
| 21-225_18A1_LC | . | . | . | . | . | . | . | . | . | . | . | . | . | . | . | . | . |

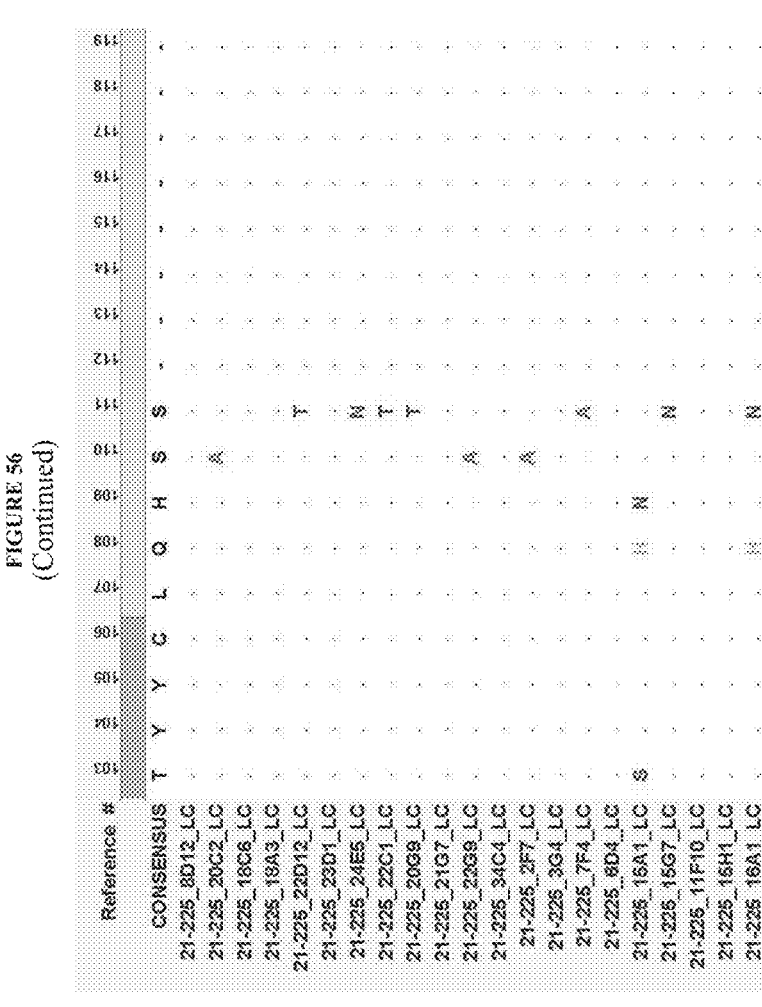

FIGURE 56
(Continued)

Table 48

| Reference # | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| | | | | | | K_FR1 | | | | | | | | | | | |
| CONSENSUS | D | I | Q | M | T | Q | S | P | S | S | L | S | A | S | V | G | D |
| 21-225_11F5_LC | . | . | . | . | . | . | . | . | . | . | . | . | . | . | . | . | . |
| 21-225_17H8_LC | . | . | . | . | . | . | . | . | . | . | . | . | . | . | . | . | . |
| 21-225_17F9_LC | . | . | . | . | . | . | . | . | . | . | . | . | . | . | . | . | . |
| 21-225_1F2_LC | . | . | . | . | . | . | . | . | . | . | . | . | . | . | . | . | . |
| 21-225_21H3_LC | . | . | . | . | . | . | . | . | . | . | . | . | . | . | . | . | . |
| 21-225_23C8_LC | . | . | . | . | . | . | . | . | . | . | . | . | . | . | . | . | . |
| 21-225_22G8_LC | . | . | . | . | . | . | . | . | . | . | . | . | . | . | . | . | . |
| 21-225_22H4_LC | . | . | . | . | . | . | . | . | . | . | . | . | . | . | . | . | . |
| 21-225_23A3_LC | . | . | . | . | . | . | . | . | . | . | . | . | . | . | . | . | . |
| 21-225_5H7_LC | . | . | . | . | . | . | . | . | . | . | . | . | . | . | . | . | . |
| 21-225_14B2_LC | . | . | . | . | . | . | . | . | . | . | . | . | . | . | . | . | . |
| 21-225_4F4_LC | . | . | . | . | . | . | . | . | . | . | . | . | . | . | . | . | . |
| 21-225_4H4_LC | . | . | . | . | . | . | . | . | . | . | . | . | . | . | . | . | . |

| Reference # | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|
| | | | | | | | | K_CDR1 | | | | | | | | | |
| CONSENSUS | R | V | T | I | T | C | R | A | S | Q | G | I | S | R | V | G | D |
| 21-225_11F5_LC | . | . | . | . | . | . | . | . | . | . | . | . | . | . | . | . | . |
| 21-225_17H8_LC | . | . | . | . | . | . | . | . | . | . | . | . | . | . | . | . | . |
| 21-225_17F9_LC | . | . | . | . | . | . | . | . | . | . | . | . | . | . | . | . | . |
| 21-225_1F2_LC | . | . | . | . | . | . | . | . | . | . | . | . | . | . | . | . | . |
| 21-225_21H3_LC | . | . | . | . | . | . | . | . | . | . | . | . | . | . | . | . | . |
| 21-225_23C8_LC | . | . | . | . | . | . | . | . | . | . | W | . | D | . | . | . | . |
| 21-225_22G8_LC | . | . | . | . | . | . | . | . | . | . | . | . | . | . | . | . | . |
| 21-225_22H4_LC | . | . | . | . | . | . | . | T | . | . | . | . | . | . | . | . | . |
| 21-225_23A3_LC | . | . | . | . | . | . | . | . | . | . | . | . | . | . | . | . | . |
| 21-225_5H7_LC | . | . | . | . | . | . | . | . | . | . | . | . | . | . | . | . | . |
| 21-225_14B2_LC | . | . | . | . | . | . | . | . | . | . | . | . | . | . | . | . | . |
| 21-225_4F4_LC | . | . | . | . | . | . | . | . | . | . | . | . | . | . | . | . | . |
| 21-225_4H4_LC | . | . | . | . | . | . | . | . | . | . | . | . | . | . | . | . | . |

FIGURE 57

Table 49: Consensus 15-VH1I1-08/D6i6-19iRF1/JH4 (SEQ ID NO: 50266):

QVQLVQS-GAEVKKPGASVKVSCKASG-YTFTN-----YDINWVRQATGQGLEWMGWMHPN---
SGNTGYAQKFQGRVTMTRNTSISTAYMELSSLRSEDTAVYYCASSSGWY............YFDYWGQGTLVTVSS wherein:

N at position 33 can be substituted with H

I at position 41 can be substituted with V or L

W at position 57 can be substituted with R

M at position 58 can be substituted with V or L

H at position 59 can be substituted with N, Y or T

N at position 61 can be substituted with D or H

G at position 66 can be substituted with H

N at position 67 can be substituted with S, Q, A, D, K or T

T at position 68 can be substituted with A, V or E

G at position 69 can be substituted with D

Y at position 70 can be substituted with F or C

A at position 71 can be substituted with P

Q at position 72 can be substituted with K

K at position 73 can be substituted with R or N

Q at position 75 can be substituted with R

G at position 76 can be substituted with V

Y at position 113 can be substituted with E, N or T

FIGURE 57
(Continued)

Y at position 135 can be substituted with F, K, I, R, V, L, M, W, H or S

Y at position 138 can be substituted with F, S or N

Xaa Tyr Asp Xaa Asn (SEQ ID NO: 50001)

Xaa Xaa Xaa Pro Xaa Ser Xaa Xaa Xaa Xaa Xaa Xaa Xaa Xaa Phe Xaa Xaa (SEQ ID NO: 50002)

Ser Ser Gly Trp Xaa Xaa Phe Asp Xaa (SEQ ID NO: 50003)

Asn Tyr Asp Ile Asn (SEQ ID NO: 50468)

Trp Met His Pro Asn Ser Gly Asn Thr Gly Tyr Ala Gln Lys Phe Gln Gly (SEQ ID NO: 50469)

Ser Ser Gly Trp Tyr Tyr Phe Asp Tyr (SEQ ID NO: 50470)

FIGURE 57
(Continued)

| Reference # | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| | | | | | | | | | | | | | | | | | | | | | | | | H_FR2 | |
| | | | | | | H_CDR1 | | | | | | | | | | | | | | | | | | | |
| CONSENSUS | S | G | . | Y | T | F | T | N | . | . | . | . | . | Y | D | I | N | W | V | R | Q | A | T | G | Q |
| 21-225_92E6_HC | . | . | . | . | . | . | . | . | . | . | . | . | . | . | . | . | . | . | . | . | . | . | . | . | . |
| 21-225_94D8_HC | . | . | . | . | . | . | . | . | . | . | . | . | . | . | . | . | . | . | . | . | . | . | . | . | . |
| 21-225_96D10_HC | . | . | . | . | . | . | . | . | . | . | . | . | . | . | . | . | . | . | . | . | . | . | . | . | . |
| 21-225_96H5_HC | . | . | . | . | . | . | . | . | . | . | . | . | . | . | . | . | . | . | . | . | . | . | S | . | . |

FIGURE 57
(Continued)

| Reference # | 76 | 77 | 78 | 79 | 80 | 81 | 82 | 83 | 84 | 85 | 86 | 87 | 88 | 89 | 90 | 91 | 92 | 93 | 94 | 95 | 96 | 97 | 98 | 99 | 100 |
|---|---|---|---|---|---|---|---|---|---|---|---|---|---|---|---|---|---|---|---|---|---|---|---|---|---|
| | | | | | | | | | | | | | | | | | H_FR3 | | | | | | | | |
| CONSENSUS | G | R | V | T | M | T | R | N | T | S | I | S | T | A | Y | M | E | L | S | S | L | R | S | E | D |
| 21-225_92E6_HC | . | . | V | . | . | . | . | . | . | . | . | . | . | . | . | . | . | . | . | . | . | . | . | . | . |
| 21-225_94D8_HC | V | . | . | . | . | . | . | . | . | . | I | . | . | . | . | . | . | V | . | . | . | . | . | . | . |
| 21-225_96D10_HC | . | . | . | . | . | . | . | . | . | . | I | . | . | . | . | . | . | . | . | . | . | . | . | . | . |
| 21-225_96H5_HC | . | . | . | . | . | . | . | . | . | . | . | . | . | . | . | . | . | . | . | . | . | . | . | . | . |

FIGURE 57
(Continued)

Table 50. Consensus 16- VH3|3-33/D6|6-6|RF1/JH6 (SEQ ID NO: 50267):

QVQLVES-GGGVVQPGRSLRLSCAASG-FTFSS-----YVMHWVRQAPGKGLEWVAVIWYD---
GSNKYYADSVKGRFTISRDNSKNTLYLQMNSLRAEDTAVYYCARERYSSGW----------YDYGMDVWGQGTTVTVSS wherein:

S at position 33 can be substituted with D, N or I

Y at position 39 can be substituted with C, F, D or S

V at position 40 can be substituted with G, I or L

M at position 41 can be substituted with I or L

H at position 42 can be substituted with D

V at position 57 can be substituted with L or A

W at position 59 can be substituted with F

G at position 65 can be substituted with A

S at position 66 can be substituted with R or N

N at position 67 can be substituted with Y, G or S

Y at position 69 can be substituted with H

Y at position 70 can be substituted with H or N

A at position 71 can be substituted with V, E, G or T

D at position 72 can be substituted with E or G

S at position 73 can be substituted with A

V at position 74 can be substituted with M

E at position 109 can be substituted with R or V

FIGURE 57
(Continued)

R at position 110 can be substituted with Y, K, V, E, P, D, L, F, M, N, Q or T

Y at position 111 can be substituted with S, T or V

S at position 112 can be substituted with R, Y, P, T or G

S at position 113 can be substituted with C or Y

G at position 114 can be substituted with W, S or N

W at position 115 can be substituted with null (-), L, Y, G, F or S null (-) at position 116 can be substituted with Y null (-) at position 117 can be substituted with A, G or T null (-) at position 118 can be substituted with C null (-) at position 129 can be substituted with P null (-) at position 130 can be substituted with Y or L null (-) at position 131 can be substituted with Y or D Y at position 132 can be substituted with null (-), F or H D at position 133 can be substituted with S, G, T, V, Y, A, F or M Y at position 134 can be substituted with G or F M at position 136 can be substituted with L D at position 137 can be substituted with G Xaa Xaa Xaa Xaa (SEQ ID NO: 50004)

Xaa Ile Xaa Tyr Asp Xaa Xaa Xaa Lys Xaa Xaa Xaa Xaa Xaa Xaa Lys Gly (SEQ ID NO: 50005)

FIGURE 57
(Continued)

Xaa Xaa Xaa Xaa Xaa Xaa Xaa Xaa Xaa Xaa Xaa Xaa Gly Xaa Xaa Xaa Val (SEQ ID NO: 50006)

Ser Tyr Val Met His (SEQ ID NO: 50471)

Val Ile Trp Tyr Asp Gly Ser Asn Lys Tyr Tyr Ala Asp Ser Val Lys Gly (SEQ ID NO: 50472)

Glu Arg Tyr Ser Ser Gly Trp Tyr Asp Tyr Gly Met Asp Val (SEQ ID NO: 50473)

FIGURE 57
(Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| | | | | | | | | | | | | | | | | H_FR1 | | | | | | | | | |
| CONSENSUS | Q | V | Q | L | V | E | S | · | G | G | V | V | Q | P | G | R | S | L | R | L | S | C | A | A |
| 21-225_5E5.024_HC | . | . | . | . | . | . | . | | . | . | . | . | . | . | . | . | . | . | . | . | . | . | . | . | . |
| 21-225_60C12_HC | . | . | . | . | . | . | . | | . | . | . | . | . | . | . | . | . | . | . | . | . | . | . | . | . |
| 21-225_60G2_HC | . | . | . | . | . | . | . | | . | . | . | . | . | . | . | . | . | . | . | . | . | . | . | . | . |
| 21-225_61B3_HC | . | . | . | . | . | . | . | | . | . | . | . | . | . | . | . | . | . | . | . | . | . | . | . | . |
| 21-225_61F2_HC | . | . | . | . | . | . | . | | . | . | . | . | . | . | . | . | . | . | . | . | . | . | . | . | . |
| 21-225_64A4_HC | . | . | . | . | . | . | . | | . | . | . | . | . | . | . | . | . | . | . | . | . | . | . | . | . |
| 21-225_64C8_HC | . | . | . | . | . | . | . | | . | . | . | . | . | . | . | . | . | . | . | . | . | . | . | . | . |
| 21-225_86D11_HC | . | . | . | . | . | . | . | | . | . | . | . | . | . | . | . | . | . | . | . | . | . | . | G | . |
| 21-225_73C9_HC | . | . | . | . | . | . | . | | . | . | . | . | . | . | . | . | . | . | . | . | . | . | . | . | . |
| 21-225_7C9_HC | . | . | . | . | . | . | . | | . | . | . | . | . | . | . | . | . | . | . | . | . | . | . | . | . |
| 21-225_7G4_HC | . | . | . | . | . | . | . | | . | . | . | . | . | . | . | . | . | . | . | . | . | . | . | . | . |
| 21-225_94F3_HC | . | . | . | . | . | . | . | | . | . | . | . | . | . | . | . | . | . | . | . | . | . | . | . | . |

FIGURE 57
(Continued)

| Reference # | 26 S | 27 G | 28 - | 29 F | 30 T | 31 F | 32 S | 33 S | 34 - | 35 - | 36 - | 37 - | 38 - | 39 Y | 40 V | 41 M | 42 H | 43 W | 44 V | 45 R | 46 Q | 47 A | 48 P | 49 G | 50 K |
|---|---|---|---|---|---|---|---|---|---|---|---|---|---|---|---|---|---|---|---|---|---|---|---|---|---|
| | | | | | | | | H_CDR1 | | | | | | | | | | H_FR2 | | | | | | | |
| CONSENSUS | S | G | - | F | T | F | S | S | - | - | - | - | - | Y | V | M | H | W | V | R | Q | A | P | G | K |
| 21-225_5E5.024_HC | | | | | | | | N | | | | | | | G | | | | | | | | | | |
| 21-225_60C12_HC | | | | | | | | | | | | | | | G | | | | | | | | | | |
| 21-225_60G2_HC | | | | | | | | | | | | | | | G | | | | | | | | | | |
| 21-225_61B3_HC | | | | | | | | D | | | | | | | G | | | | | | | | | | |
| 21-225_61F2_HC | | | | | | | | D | | | | | | | | | | | | | | | | | |
| 21-225_64A4_HC | | | | | | | | | | | | | | | G | | | | | | | | | | |
| 21-225_64C8_HC | | | | | | | | N | | | | | | | | | | | | | | | | | |
| 21-225_86D11_HC | | | | L | | | | N | | | | | | | | | | | | | | | | | |
| 21-225_73C9_HC | | | | | | | N | N | | | | | | | | | | | | | | | | | |
| 21-225_7C9_HC | | | | | | | | N | | | | | | | | | | | | | | | | | |
| 21-225_7G4_HC | | | | | | | | | | | | | | D | | | | | | | | | | | |
| 21-225_94F3_HC | | | | | | | | | | | | | | | I | | | | | | | | | | |

FIGURE 57
(Continued)

| Reference # | 51 | 52 | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 |
|---|---|---|---|---|---|---|---|---|---|---|---|---|---|---|---|---|---|---|---|---|---|---|---|---|---|
| | | | | | | | | | | | | | | | | | H_CDR2 | | | | | | | | | |
| CONSENSUS | G | L | E | W | V | A | V | I | W | Y | D | . | G | S | N | K | Y | Y | A | D | S | V | K |
| 21-225_10E9_HC | . | . | . | . | . | . | . | . | . | . | . | . | . | . | . | . | . | . | . | . | . | . | . | . | . |
| 21-225_147A8_HC | . | . | . | . | . | . | . | . | . | . | . | . | . | . | . | . | . | . | . | . | . | . | . | . | . |
| 21-225_147B2_HC | . | . | . | . | . | . | . | . | . | . | . | . | . | . | . | . | . | . | . | . | . | . | . | . | . |
| 21-225_147H5_HC | . | . | . | . | . | . | . | . | . | . | . | . | . | . | . | . | . | . | . | . | G | . | . | . | . |
| 21-225_148C9_HC | . | . | . | . | . | . | . | . | . | . | . | . | . | . | . | . | . | . | . | . | . | . | . | . | . |
| 21-225_148F5_HC | . | . | . | . | . | . | . | . | . | . | . | . | . | . | . | . | . | . | . | . | . | . | . | . | . |
| 21-225_148H10_HC | . | . | . | . | . | . | . | . | . | . | . | . | . | . | . | . | . | . | . | . | . | . | . | . | . |
| 21-225_149D10_HC | . | . | . | . | . | . | . | . | . | . | . | . | . | . | . | . | . | . | S | . | . | . | . | . | . |
| 21-225_14E10_HC | . | . | . | . | . | . | . | . | . | . | . | . | . | . | . | . | . | . | . | . | . | . | . | . | . |
| 21-225_150D11_HC | . | . | . | . | . | . | . | . | . | . | . | . | . | . | . | . | . | . | . | . | . | . | . | . | . |
| 21-225_150E2_HC | . | . | . | . | . | . | L | . | . | . | . | . | . | . | . | . | . | . | . | . | . | . | . | . | . |
| 21-225_152F7_HC | . | . | . | . | . | . | . | . | G | . | . | . | . | . | . | . | . | . | . | . | . | . | . | . | . |
| 21-225_153G9_HC | . | . | . | . | . | . | . | . | . | . | . | . | . | . | . | . | . | . | . | . | E | . | . | . | . |
| 21-225_154F4_HC | . | . | . | . | . | . | . | . | . | . | . | . | . | . | . | . | . | . | . | . | . | . | . | . | . |
| 21-225_159D8_HC | . | . | . | . | . | . | L | . | G | . | . | . | . | . | . | . | . | . | . | . | . | . | . | . | . |
| 21-225_15C11_HC | . | . | . | . | . | . | . | . | . | . | . | . | . | . | . | . | . | . | . | . | . | . | . | . | . |
| 21-225_169D11_HC | . | . | . | . | . | . | L | . | G | . | . | . | . | . | . | . | . | . | . | . | . | . | . | . | . |
| 21-225_170F3_HC | . | . | . | . | . | . | . | . | . | . | . | . | . | . | . | . | . | . | . | . | . | . | . | . | . |
| 21-225_173C11_HC | . | . | . | . | . | . | . | . | . | . | . | . | . | . | . | . | . | . | . | . | . | . | . | . | . |
| 21-225_174G10_HC | . | . | . | . | . | . | . | . | . | . | . | . | . | . | . | . | . | . | . | . | . | . | . | . | . |
| 21-225_176H12_HC | . | . | . | . | . | . | . | . | . | . | . | . | . | . | . | . | . | . | . | . | . | . | . | . | . |
| 21-225_177B4_HC | . | . | . | . | . | . | . | . | . | . | . | . | . | . | . | . | . | . | . | . | . | . | . | . | . |
| 21-225_179C2_HC | . | . | . | . | . | . | . | . | . | . | . | . | . | . | . | . | . | . | . | . | . | . | . | . | . |
| 21-225_17H3_HC | . | . | . | . | . | . | . | . | . | . | . | . | . | . | . | . | . | . | . | . | . | . | . | . | . |
| 21-225_183F4_HC | . | . | . | . | . | . | . | . | . | . | . | . | . | . | . | . | . | . | . | . | . | . | . | . | . |
| 21-225_180D6_HC | . | . | . | . | L | . | . | . | . | . | . | . | . | . | . | . | . | . | . | . | . | . | . | . | . |
| 21-225_192A2_HC | . | . | . | . | . | . | . | . | . | . | . | . | . | . | . | . | Y | . | . | . | . | . | . | . | . |
| 21-225_192F6_HC | . | . | . | . | . | . | . | . | . | . | . | . | . | . | . | . | . | . | . | . | Y | . | . | . | . |
| 21-225_193F8_HC | . | . | . | . | . | . | . | . | . | . | . | . | . | . | . | . | Y | . | . | . | . | . | . | . | . |

| Reference # | 51 | 52 | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 |
|---|---|---|---|---|---|---|---|---|---|---|---|---|---|---|---|---|---|---|---|---|---|---|---|---|---|
| | G | L | E | W | V | A | V | I | W | Y | D | - | - | - | G | S | N | K | Y | Y | A | D | S | V | K |
| | | | | | | | | | | | | | | | | H_CDR2 | | | | | | | | | |
| CONSENSUS | . | . | . | . | . | . | . | . | . | . | . | . | . | . | . | . | . | . | . | . | . | . | . | . | . |
| 21-225_5E5.024_HC | . | . | . | . | . | . | . | . | . | . | . | . | . | . | A | . | . | . | . | . | . | . | A | . | . |
| 21-225_60C12_HC | . | . | . | . | . | . | . | . | . | . | . | . | . | . | . | . | . | . | . | . | V | . | . | . | . |
| 21-225_60G2_HC | . | . | . | . | . | . | . | . | . | . | . | . | . | . | . | . | . | . | . | . | . | . | . | . | . |
| 21-225_61B3_HC | . | . | . | . | . | . | . | . | . | . | . | . | . | . | . | . | . | . | . | . | . | . | . | . | . |
| 21-225_61F2_HC | . | . | . | . | . | . | . | . | . | . | . | . | . | . | . | . | . | . | . | . | . | . | . | . | . |
| 21-225_64A4_HC | . | . | . | . | . | . | . | . | . | . | . | . | . | . | . | . | . | . | . | . | . | . | . | . | . |
| 21-225_64C8_HC | . | . | . | . | . | . | . | . | . | . | . | . | . | . | . | . | . | . | . | . | . | . | . | ▨ | . |
| 21-225_86D11_HC | . | . | . | . | . | . | . | . | . | . | . | . | . | . | . | . | . | . | . | . | . | . | . | . | . |
| 21-225_73C9_HC | . | . | . | . | . | . | . | . | . | . | . | . | . | . | . | . | . | . | . | . | . | . | . | . | . |
| 21-225_7C9_HC | . | . | . | . | . | . | . | . | . | . | . | . | . | . | . | . | . | . | . | . | . | . | . | . | . |
| 21-225_7G4_HC | . | . | . | . | . | . | . | . | . | . | . | . | . | . | . | . | . | . | . | . | . | . | . | . | . |
| 21-225_94F3_HC | . | . | . | . | . | . | . | . | . | . | . | . | . | . | . | . | . | . | . | . | . | . | . | . | . |

FIGURE 57 (Continued)

| Reference # | 76 | 77 | 78 | 79 | 80 | 81 | 82 | 83 | 84 | 85 | 86 | 87 | 88 | 89 | 90 | 91 | 92 | 93 | 94 | 95 | 96 | 97 | 98 | 99 | 100 |
|---|---|---|---|---|---|---|---|---|---|---|---|---|---|---|---|---|---|---|---|---|---|---|---|---|---|
| | | | | | | | | | | | | | | | | | H_FR3 | | | | | | | | |
| CONSENSUS | G | R | F | T | I | S | R | D | N | S | K | N | T | L | Y | L | Q | M | N | S | L | R | A | E | D |
| 21-225_5E5.024_HC | . | . | . | . | . | . | . | . | . | . | . | . | . | . | . | . | . | . | . | . | . | . | . | . | . |
| 21-225_60C12_HC | . | . | . | . | . | . | . | . | . | . | . | . | . | . | . | . | . | . | . | . | . | . | . | . | . |
| 21-225_60G2_HC | . | . | . | . | . | . | . | . | . | . | . | . | . | . | . | . | . | . | . | . | . | . | . | . | . |
| 21-225_61B3_HC | . | . | . | . | . | . | . | . | . | . | . | . | . | . | . | . | . | . | . | . | . | . | . | . | . |
| 21-225_61F2_HC | . | . | . | . | . | . | . | . | . | . | Q | . | . | . | . | . | . | . | . | . | . | . | . | . | . |
| 21-225_64A4_HC | . | . | . | . | . | . | . | . | . | . | . | . | . | . | S | . | . | . | . | . | . | . | . | . | . |
| 21-225_64C8_HC | . | . | . | . | . | . | . | . | . | . | . | . | . | . | . | . | . | . | . | . | . | . | . | . | . |
| 21-225_86D11_HC | . | . | . | . | . | . | . | . | . | . | . | . | . | . | . | . | . | . | . | . | . | . | . | . | . |
| 21-225_73C9_HC | . | . | . | . | . | . | . | . | . | . | . | . | . | . | . | . | . | . | . | . | . | . | . | . | . |
| 21-225_7C9_HC | . | . | . | . | . | . | . | . | . | . | . | . | . | . | . | . | . | . | T | . | . | . | . | . | . |
| 21-225_7G4_HC | . | . | . | . | . | . | . | . | . | . | . | . | . | . | . | . | . | . | . | . | . | . | . | . | . |
| 21-225_94F3_HC | . | . | . | . | . | . | . | . | . | . | . | . | . | . | . | . | . | . | . | . | . | . | . | . | . |

FIGURE 57
(Continued)

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | | | | | | H_CDR3 | | | | | | | | | | | |
| CONSENSUS | T | A | V | Y | Y | C | A | R | E | R | Y | S | S | G | W | | | | | | | | | | |
| 21-225_5E5.024_HC | . | . | . | . | . | . | . | . | . | Y | . | . | . | . | Y | . | . | . | . | . | . | . | . | . | . |
| 21-225_60C12_HC | . | . | . | . | . | . | . | . | K | Y | S | K | . | W | . | . | . | . | . | . | . | . | . | . | . |
| 21-225_60G2_HC | . | . | . | . | . | . | . | . | K | Y | S | K | . | W | . | . | . | . | . | . | . | . | . | . | . |
| 21-225_61B3_HC | . | . | . | . | . | . | . | . | K | Y | S | K | . | W | . | . | . | . | . | . | . | . | . | . | . |
| 21-225_61F2_HC | . | . | . | . | . | . | . | . | . | . | . | . | . | S | . | . | . | . | . | . | . | . | . | . | . |
| 21-225_64A4_HC | . | . | L | . | . | . | . | . | . | . | . | . | . | . | . | . | . | . | . | . | . | . | . | . | . |
| 21-225_64C8_HC | . | . | . | . | . | . | . | . | . | K | . | . | . | N | . | . | . | . | . | . | . | . | . | . | . |
| 21-225_86D11_HC | . | . | . | . | . | . | . | . | . | . | . | . | . | S | . | . | . | . | . | . | . | . | . | . | . |
| 21-225_73C9_HC | . | . | . | . | . | . | . | . | . | K | . | . | . | S | . | . | . | . | . | . | . | . | . | . | . |
| 21-225_7C9_HC | . | . | . | . | . | . | . | . | . | K | . | . | . | S | . | . | . | . | . | . | . | . | . | . | . |
| 21-225_7G4_HC | . | . | . | . | R | . | . | . | . | K | . | . | . | N | . | . | . | . | . | . | . | . | . | . | . |
| 21-225_94F3_HC | . | . | . | . | . | . | . | . | . | . | . | . | . | . | . | . | . | . | . | . | . | . | . | . | . |

FIGURE 57
(Continued)

Table 51. Consensus 17 - VH3|3-33/D7|7-27|RF2/JH4 (SEQ ID NO: 50268):

QVQLVES-GGGVVQPGRSLRLSCAASG-FTFSD-------YGMHWVRQAPGKGLEWVAVIWYD---
ENNKYYADSVKGRFTISRDNSKNTLYLQMNSLRAEDTAVYYCARELGF----------SDYWGQGTLVTVSS wherein:

D at position 33 can be substituted with S, N or T

Y at position 39 can be substituted with F

M at position 41 can be substituted with I

V at position 57 can be substituted with L

I at position 58 can be substituted with V, T or M

Y at position 60 can be substituted with F or D

D at position 61 can be substituted with E, A, G or N

E at position 65 can be substituted with G, V, R or D

N at position 66 can be substituted with S, T, D, I or Y

N at position 67 can be substituted with H or K

K at position 68 can be substituted with Q, E, N or R

Y at position 69 can be substituted with H, K, D, R or S

Y at position 70 can be substituted with H

A at position 71 can be substituted with V, G, T, I or E

D at position 72 can be substituted with E

V at position 74 can be substituted with M

K at position 75 can be substituted with R

FIGURE 57
(Continued)

E at position 109 can be substituted with D or G

G at position 111 can be substituted with A

F at position 112 can be substituted with W or M

L at position 135 can be substituted with R, T, Y, S, Q, I, A, E or N

S at position 136 can be substituted with E, G, D, F, N, A or T

D at position 137 can be substituted with E

Y at position 138 can be substituted with S, F or C

Xaa Xaa Gly Xaa His (SEQ ID NO: 50007)

Xaa Xaa Trp Xaa Xaa Xaa Xaa Xaa Xaa Xaa Xaa Ser Xaa Xaa Gly (SEQ ID NO: 50008)

Xaa Leu Xaa Xaa Xaa Xaa Xaa (SEQ ID NO: 50009)

Asp Tyr Gly Met His (SEQ ID NO: 50474)

Val Ile Trp Tyr Asp Glu Asn Asn Lys Tyr Tyr Ala Asp Ser Val Lys Gly (SEQ ID NO: 50475)

Glu Leu Gly Phe Ser Asp Tyr (SEQ ID NO: 50476)

Table 52. Consensus 18- VH4/4-34/D4|4-17/RF2/JH6 (SEQ ID NO: 50269):

QVQLQQW-GAGLLKPSETLSLTCAVHG-GSFSG------CYWSWIRQPPGKGLEWIGEINH------
SGSTNYNPSLKSRVTISVDTSKNQFSLKLSSVTAADTAVYYCARDYGG------------------MDVWGQGTTVTVSS wherein:

C at position 39 can be substituted with S, P or Y

H at position 60 can be substituted with Y or Q

S at position 65 can be substituted with R

S at position 67 can be substituted with R, C, or I

N at position 69 can be substituted with S

Y at position 70 can be substituted with F

K at position 75 can be substituted with T

M at position 136 can be substituted with L or I

Gly Xaa Tyr Trp Ser (SEQ ID NO: 50010)

Glu Ile Asn Xaa Xaa Gly Xaa Thr Xaa Xaa Asn Pro Ser Leu Xaa Ser (SEQ ID NO: 50011)

Asp Tyr Gly Gly Xaa Asp Val (SEQ ID NO: 50012)

Gly Cys Tyr Trp Ser (SEQ ID NO: 50477)

Glu Ile Asn His Ser Gly Ser Thr Asn Tyr Asn Pro Ser Leu Lys Ser (SEQ ID NO: 50478)

Asp Tyr Gly Gly Met Asp Val (SEQ ID NO: 50479)

FIGURE 57
(Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | V | Q | L | Q | Q | W | - | G | A | G | L | L | K | P | S | E | T | L | S | L | T | C | A | V | H |
| 21-225_95G9_HC | . | . | . | . | . | . | . | . | . | . | . | . | . | . | . | . | . | . | . | . | . | . | . | . | . | . |
| 21-225_95H10_HC | . | . | . | . | . | . | . | . | . | . | . | . | . | . | . | . | . | . | . | . | . | . | . | . | . | . |
| 21-225_97A2_HC | . | . | . | . | . | . | . | . | . | . | . | . | . | . | . | . | . | . | . | . | . | . | . | . | . | . |
| 21-225_97E5_HC | . | . | . | . | . | . | . | . | . | . | . | . | . | . | . | . | . | . | . | . | . | . | . | . | . | . |

FIGURE 57
(Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | | | | | | M | D | V | W | G | Q | G | T | T | V | T | V | S | S |
| 21-225_96G9_HC | . | . | x | x | . | . | . | . | . | . | . | . | . | . | . | . | . | . | . |
| 21-225_96H10_HC | . | . | x | x | . | . | . | . | . | . | . | . | . | . | . | . | . | . | . |
| 21-225_97A2_HC | . | . | . | . | . | . | . | . | . | . | . | . | . | . | . | . | . | . | . |
| 21-225_97E5_HC | . | . | . | . | . | . | . | . | . | . | . | . | . | . | . | . | . | . | . |

Table 53.  Consensus 19-VH1I1-08/D6i6-19|RF1/JH5 (SEQ ID NO: 50270):

QVQLVQS-GAEVKKPGASVKVSCKASG-YTFTN----YDINWVRQATGQGLEWMGWMHPN---SGNTGYAQKFQGRVTMTRNTSISTAYMELSSLRSEDTAVYYCAISSGWY------------WFDPWGQGTLVTVSS wherein:

H at position 59 can be substituted with N, or Y

N at position 61 can be substituted with D

S at position 65 can be substituted with N

G at position 66 can be substituted with V

N at position 67 can be substituted with S

T at position 68 can be substituted with I

Y at position 70 can be substituted with F, or C

G at position 76 can be substituted with D

Y at position 113 can be substituted with H, N, S, or K

FIGURE 57
(Continued)

W at position 135 can be substituted with R

Asn Tyr Asp Ile Asn (SEQ ID NO: 50013)

Trp Met Xaa Pro Xaa Xaa Xaa Xaa Gly Xaa Ala Gln Lys Phe Gln Xaa (SEQ ID NO: 50014)

Ser Ser Gly Trp Xaa Xaa Phe Asp Pro (SEQ ID NO: 50015)

Asn Tyr Asp Ile Asn (SEQ ID NO: 50480)

Trp Met His Pro Asn Ser Gly Asn Thr Gly Tyr Ala Gln Lys Phe Gln Gly (SEQ ID NO: 50481)

Ser Ser Gly Trp Tyr Trp Phe Asp Pro (SEQ ID NO: 50482)

FIGURE 57
(Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | | H_FR1 | | | | | | | | | |
| CONSENSUS | Q | V | Q | L | V | Q | S | - | G | A | E | V | K | K | P | G | A | S | V | K | V | S | C | K | A | S |
| 21-225_76E8_HC | . | . | . | . | . | . | . | . | . | . | . | . | . | . | . | . | . | . | . | . | . | . | . | . | . | . |
| 21-225_76F3_HC | . | . | . | . | . | . | . | . | . | . | . | . | . | . | . | . | . | . | . | . | . | . | . | . | . | . |
| 21-225_76F5_HC | . | . | . | . | . | . | . | . | . | . | . | . | . | . | . | . | . | . | . | . | . | . | . | . | . | . |
| 21-225_76H1_HC | . | . | . | . | . | . | . | . | . | . | . | . | . | . | . | . | . | . | . | . | . | . | . | . | . | . |
| 21-225_77C10_HC | . | . | . | . | . | . | . | . | . | . | . | . | . | . | . | . | . | . | . | . | . | . | . | . | . | . |
| 21-225_77C7_HC | . | . | . | . | . | . | . | . | . | . | . | . | . | . | . | . | . | . | . | . | . | . | . | . | . | . |
| 21-225_77D11_HC | . | . | . | . | . | . | . | . | . | . | . | . | . | . | . | . | . | . | . | . | . | . | . | . | . | . |
| 21-225_77D12_HC | . | . | . | . | . | . | . | . | . | . | . | . | . | . | . | . | . | . | . | . | . | . | . | . | . | . |
| 21-225_77E1_HC | . | . | . | . | . | . | . | . | . | . | . | . | . | . | . | . | . | . | . | . | . | . | . | . | . | . |
| 21-225_78C1_HC | . | . | . | . | . | . | . | . | . | . | . | . | . | . | . | . | . | . | . | . | . | . | . | . | . | . |
| 21-225_78H12_HC | . | . | . | . | . | . | . | . | . | . | . | . | . | . | . | . | . | . | . | . | . | . | . | . | . | . |
| 21-225_79G10_HC | . | . | . | . | . | . | . | . | . | . | . | . | . | . | . | . | . | . | . | . | . | . | . | . | . | . |
| 21-225_79G6_HC | . | . | . | . | . | . | . | . | . | . | . | . | . | . | . | . | . | . | . | . | . | . | . | . | . | . |
| 21-225_80A2_HC | . | . | . | . | . | . | . | . | . | . | . | . | . | . | . | . | . | . | . | . | . | . | . | . | . | . |
| 21-225_80C12_HC | . | . | . | . | . | . | . | . | . | . | . | . | . | . | . | . | . | . | . | . | . | . | . | . | . | . |
| 21-225_80D3_HC | . | . | . | . | . | . | . | . | . | . | . | . | . | . | . | . | . | . | . | . | . | . | . | . | . | . |
| 21-225_80E9_HC | . | . | . | . | . | . | . | . | . | . | . | . | . | . | . | . | . | . | . | . | . | . | . | . | . | . |
| 21-225_81E5_HC | . | . | . | . | . | . | . | . | . | . | . | . | . | . | . | . | . | . | . | . | . | . | . | . | . | . |
| 21-225_81F9_HC | . | . | . | . | . | . | . | . | . | . | . | . | . | . | . | . | . | . | . | . | . | . | . | . | . | . |
| 21-225_82A5_HC | . | . | . | . | . | . | . | . | . | . | . | . | . | . | . | . | . | . | . | . | . | . | . | . | . | . |
| 21-225_82C12_HC | . | . | . | . | . | . | . | . | . | . | . | . | . | . | . | . | . | . | . | . | . | . | . | . | . | . |
| 21-225_82D9_HC | . | . | . | . | . | . | . | . | . | . | . | . | . | . | . | . | . | . | . | . | . | . | . | . | . | . |
| 21-225_82G5_HC | . | . | . | . | . | . | . | . | . | . | . | . | . | . | . | . | . | . | . | . | . | . | . | . | . | . |
| 21-225_83C2_HC | . | . | . | . | . | . | . | . | . | . | . | . | . | . | . | . | . | . | . | . | . | . | . | . | . | . |
| 21-225_83C5_HC | . | . | . | . | . | . | . | . | . | . | . | . | . | . | . | . | . | . | . | . | . | . | . | . | . | . |
| 21-225_83F3_HC | . | . | . | . | . | . | . | . | . | . | . | . | . | . | . | . | . | . | . | . | . | . | . | . | . | . |
| 21-225_83G3_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | T | M | T | R | N | T | S | I | T | A | Y | M | E | L | S | S | L | R | S | E | D | T | A | V | Y | |
| | | | | | | | | | | | | | | H_FR3 | | | | | | | | | | | | |
| CONSENSUS | | | | | | | | | | | | | | | | | | | | | | | | | | |
| 21-225_147G6_HC | | | | | | | | | | | | | | | | | | | | | D | | | | | |
| 21-225_152F4_HC | | | | | N | | | | | | | | | | | | | | | | | | | | | |
| 21-225_170F6_HC | | | | | | | | | | | | | | | | | | | | | | | | | | |
| 21-225_174G5_HC | | | | | | | | | | | | | | | | | | | | | | | | | | |
| 21-225_224H5_HC | | | | W | W | | | | | V | N | | | | | N | | | | | | | | | | |
| 21-225_225F4_HC | | | | | D | | | | | | | | | | | | | | | | | | | | | |
| 21-225_227G9_HC | | | | | | W | | | | | | | | | | | | | | | | | | | | |
| 21-225_25A3_HC | | | | | | | | | | | | | | | | | | | | | | | | | | |
| 21-225_26A9_HC | | | | | | | | | | | | | | | | | | | | | | | | | | |
| 21-225_57A11_HC | | | | | | | | | | | | | | | | | | | | | | | | | | |
| 21-225_57F12_HC | | | | | | | | | | | | | | | | | | | | | | | | | | |
| 21-225_74A5_HC | | | | | | | | | | | | | | | | | | | | | | | | | | |
| 21-225_74A7_HC | | | | | | | T | | | | X | | | | | | | | | | | | | | | |
| 21-225_74B10_HC | | | | | | | T | | | | X | | | | | N | | | | | | | | | | |
| 21-225_74B5_HC | | | | | | | | | | | | | | | | | | | | | | | | | | |
| 21-225_74B6_HC | | | | | | | | | | | | | | | | | | | | | | | | | | |
| 21-225_74B7_HC | | | | | | | | | | | | | | | | | | | | | | | | | | |
| 21-225_74B8_HC | | L | | | | | | | | | | | | | | | | | | | | | | | | |
| 21-225_74C1_HC | | | | | | | | | | | | | | | | | | | | | | | | | | |
| 21-225_74C10_HC | | | | | | | | | | | | | | | | | | | | | | | | | | |
| 21-225_74C12_HC | | | | | | | | | | | | | | | | | | | | | | | | | | |
| 21-225_74G3_HC | | | | | | | | | | | | | | | | | | | | | | | | | | |
| 21-225_74H2_HC | | | | | | | | | | | | | | | | | | | | | | | | | | |
| 21-225_75A7_HC | | | | | | | | | | | | | | | | | | | | | | | | | | |
| 21-225_75B1_HC | | | | | | | | | | | | | | | | N | | | | | | | | | | |
| 21-225_76A6_HC | | | | | | | | | | | | | | | | | | | | | | | | | | |
| 21-225_76B9_HC | | | | | | | | | | | | | | | | | | | | | | | | | | |

FIGURE 57
(Continued)

Table 54. Consensus 20- VH3|3-33/D4|4-17|RF2/JH6 (SEQ ID NO: 50271):

QVQLVES-GGGVVQPGRSLRLSCAASG-FTFSS-----YGMHWVRQAPGKGLEWVAVIWYD---
GSNKNYADSVKGRFTISRDNSKNTLYLQMNSLRAEDTAVYYCARDQGVGY-----------YGLDVWGQGTTVTVSS wherein:

S at position 33 can be substituted with N, R, T or I

Y at position 39 can be substituted with H or N

H at position 42 can be substituted with D

V at position 57 can be substituted with I

I at position 58 can be substituted with L

Y at position 60 can be substituted with F

S at position 66 can be substituted with T

K at position 68 can be substituted with E, Q, D or R

N at position 69 can be substituted with H or Y

Y at position 70 can be substituted with H

A at position 71 can be substituted with V or G

D at position 72 can be substituted with E

D at position 109 can be substituted with A

Q at position 110 can be substituted with R, Y, H, A, C, E, F or M

V at position 112 can be substituted with I or F

G at position 113 can be substituted with Y

FIGURE 57
(Continued)

Y at position 114 can be substituted with E null (-) at position 115 can be substituted with F null (-) at position 116 can be substituted with D null (-) at position 131 can be substituted with Y null (-) at position 132 can be substituted with Y null (-) at position 133 can be substituted with N Y at position 134 can be substituted with D, or N G at position 135 can be substituted with A or D L at position 136 can be substituted with M, T or I Xaa Xaa Gly Met Xaa (SEQ ID NO: 50016)

Xaa Xaa Trp Xaa Asp Gly Xaa Asn Xaa Xaa Xaa Xaa Ser Val Xaa Xaa Xaa Xaa Asp Ser Val Lys Gly (SEQ ID NO: 50017)

Xaa Xaa Gly Xaa Xaa Xaa Xaa Xaa Xaa Xaa Xaa Xaa Xaa Asp Val (SEQ ID NO: 50018)

Ser Tyr Gly Met His (SEQ ID NO: 50483)

Val Ile Trp Tyr Asp Gly Ser Asn Lys Asn Tyr Ala Asp Ser Val Lys Gly (SEQ ID NO: 50484)

Asp Gln Gly Val Gly Tyr Tyr Gly Leu Asp Val (SEQ ID NO: 50485)

FIGURE 57
(Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | | H_FR2 | | |
| CONSENSUS | G | . | F | T | F | S | S | . | . | . | . | Y | G | M | H | W | V | R | Q | A | P | G | K | G | L |
| 21-225_199A8_HC | | | | | | | N | | | | | | | | | | | | | | | | | | | |
| 21-225_199C5_HC | | | | | | | | | | | | | | | | | | | | | | | | | | |
| 21-225_204G6_HC | | | | | | | | | | | | | | | | | | | | | | | | | | |
| 21-225_205F5_HC | | | | | | | | | | | | | | | | | | | | | | | | | | |
| 21-225_207G6_HC | | | | | | | | | | | | | | | | | | | | | | | | | | |
| 21-225_211A11_HC | | | | | | | | | | | | | | | | | | | | | | | | | | |
| 21-225_211A8_HC | | | | | | | | | | | | | | | | | | | | | | | | | | |
| 21-225_212D7_HC | | | | | | | | | | | | | | | | | | | | | | | | | | |
| 21-225_212E10_HC | | | | | | | | | | | | | | | | | | | | | | | | | | |
| 21-225_212E8_HC | | | | | | | | | | | | | | | | | | | | | | | | | | |
| 21-225_212F10_HC | | | | | | | | | | | | | | | | | | | | | | | | | | |
| 21-225_212H9_HC | | | | | | | | | | | | | | | | | | | | | | | | | | |
| 21-225_213B8_HC | | | | | | | | | | | | | | | | | | | | | | | | | | |
| 21-225_213C4_HC | | | | | | | | | | | | | | | | | | | | | | | | | | |
| 21-225_213D2_HC | | | | | | | | | | | | | | | | | | | | | | | | | | |
| 21-225_214C3_HC | | | | | L | | | | | | | | | | | | | | | | | | | | | |
| 21-225_215A12_HC | | | | | | | | | | | | | | | | | | | | | | | | | | |
| 21-225_215B5_HC | | | | | | | | | | | | | | | | | | | | | | | | | | |
| 21-225_215D6_HC | | | | | | | | | | | | | | | | | | | | | | | | | | |
| 21-225_217G5_HC | | | | | | | N | | | | | N | | | | | | | | | | | | | | |
| 21-225_219H1_HC | | | | | | | | | | | | | | | | Q | | | | | | | | | | |
| 21-225_223D11_HC | | | | | | | | | | | | | | | | | | | | | | | | | | |
| 21-225_74D1_HC | | | | | | | | | | | | | | | | | | | | | | | | | | |
| 21-225_87B7_HC | | | | | | | | | | | | | | | | | | | | | | | | | | |

Table 55. Consensus 21 - VH1I1-02/DI11-1IRF1/JH4 (SEQ ID NO: 50272):

QVQLVQS-GAEVKKPGASVKVSCKASG-YTFTG-----YYMHWVRQAPGQGLEWMGWINPN---SGGTNYAQKFQGRVTMTRDTSISTAYMELSRLRSDDTAVYYCARDGTS---------SFDYWGQGTLVTVSS wherein:

G at position 33 can be substituted with D, S or A

Y at position 39 can be substituted with D

Y at position 40 can be substituted with H, N or F

M at position 41 can be substituted with L or I

H at position 42 can be substituted with Q

I at position 58 can be substituted with V

N at position 59 can be substituted with H, K or S

N at position 61 can be substituted with K

S at position 65 can be substituted with N, R or T

G at position 66 can be substituted with N or D

G at position 67 can be substituted with A

T at position 68 can be substituted with S

N at position 69 can be substituted with H, Q or I

Y at position 70 can be substituted with S or F

A at position 71 can be substituted with T

K at position 73 can be substituted with R, N, E or S

G at position 76 can be substituted with D

FIGURE 57
(Continued)

D at position 109 can be substituted with K, G, S or E

G at position 110 can be substituted with F, A, K or V

T at position 111 can be substituted with null (-) or P

S at position 112 can be substituted with G, null (-), or T null (-) at position 113 can be substituted with V or S null (-) at position 114 can be substituted with A null (-) at position 115 can be substituted with T null (-) at position 133 can be substituted with W null (-) at position 134 can be substituted with G S at position 135 can be substituted with null (-), V or Y F at position 136 can be substituted with null (-), L or Y D at position 137 can be substituted with G or K Y at position 138 can be substituted with D or F Xaa Xaa Xaa Xaa (SEQ ID NO: 50019)

Trp Xaa Xaa Pro Xaa Xaa Xaa Xaa Xaa Xaa Xaa Gln Xaa Xaa Phe Gln Xaa (SEQ ID NO: 50020)

Xaa Xaa Xaa Xaa Xaa Xaa Xaa Xaa Xaa Xaa Xaa Xaa Xaa (SEQ ID NO: 50021)

Gly Tyr Tyr Met His (SEQ ID NO: 50486)

Trp Ile Asn Pro Asn Ser Gly Gly Thr Asn Tyr Ala Gln Lys Phe Gln Gly (SEQ ID NO: 50487)

Asp Gly Thr Ser Phe Asp Tyr (SEQ ID NO: 50488)

FIGURE 57
(Continued)

Table 56. Consensus 22 - VH3j3-33/D4j4-11RF2/JH6 (SEQ ID NO: 50273):

QVQLVES-GGGVVQPGRSLRLSCAASG-FTFSS-----YGMHWVRQAPGKGLEWVAVIWHD---
GSNKYYADSVKGRFTISRDNSKNTLYLQMNSLRAEDTAVYYCARDLSMG----------GMDVWGQGTTVTVSS wherein:

S at position 33 can be substituted with N

Y at position 39 can be substituted with F or H

M at position 41 can be substituted with I

V at position 57 can be substituted with I

W at position 59 can be substituted with I

H at position 60 can be substituted with Y, F or N

D at position 61 can be substituted with S or E

G at position 65 can be substituted with A

S at position 66 can be substituted with G

N at position 67 can be substituted with Y

K at position 68 can be substituted with D, E or R

Y at position 69 can be substituted with N

Y at position 70 can be substituted with N

A at position 71 can be substituted with V or G

D at position 72 can be substituted with E

S at position 73 can be substituted with A

K at position 75 can be substituted with R

FIGURE 57
(Continued)

D at position 109 can be substituted with T or R
L at position 110 can be substituted with R, Y, S, F, I or P S
S at position 111 can be substituted with R or T
M at position 112 can be substituted with V, G, P, K, N or Y
G at position 113 can be substituted with Y, null (-) or S
null (-) at position 114 can be substituted with Y, S or W
null (-) at position 115 can be substituted with G
null (-) at position 116 can be substituted with S
null (-) at position 117 can be substituted with G
null (-) at position 118 can be substituted with S
null (-) at position 119 can be substituted with P
null (-) at position 129 can be substituted with P
null (-) at position 130 can be substituted with Y
null (-) at position 131 can be substituted with Y
null (-) at position 132 can be substituted with Y
null (-) at position 133 can be substituted with S or Y
null (-) at position 134 can be substituted with D, Y or G
M at position 136 can be substituted with L or T
Xaa Xaa Gly Xaa His (SEQ ID NO: 50022)

FIGURE 57
(Continued)

Xaa Ile Xaa Xaa Xaa Xaa Xaa Xaa Xaa Xaa Val Xaa Gly (SEQ ID NO: 50023)

Xaa Xaa Xaa Xaa Xaa Xaa Xaa Xaa Xaa Xaa Xaa Xaa Gly Xaa Asp Val (SEQ ID NO: 50024)

Ser Tyr Gly Met His (SEQ ID NO: 50489)

Val Ile Trp His Asp Gly Ser Asn Lys Tyr Tyr Ala Asp Ser Val Lys Gly (SEQ ID NO: 50490)

Asp Leu Ser Met Gly Gly Met Asp Val (SEQ ID NO: 50491)

FIGURE 57
(Continued)

Table 57. Consensus 23- VH3:3-33/D7|7-27|RF1/JH4 (SEQ ID NO: 50274):
QVQLVES-GGGVVQPGRSLRLSCAASG-FTFSD----YGMHWVRQAPGKGLEWVAVIWYD-
ESNKYYADSVKGRFTISRDNSKNTLYLQMNSLRAEDTAVYYCAREVGW------------LDDYWGQGTLVTVSS wherein:

FIGURE 57
(Continued)

D at position 33 can be substituted with N or S
Y at position 39 can be substituted with F
M at position 41 can be substituted with I or L
Y at position 60 can be substituted with F
D at position 61 can be substituted with E, I or V
E at position 65 can be substituted with G, V, A or R
S at position 66 can be substituted with N, T or G
K at position 68 can be substituted with Q, T or N
Y at position 69 can be substituted with H or K
A at position 71 can be substituted with T, G, E or V D at position 72 can be substituted with G V at position 74 can be substituted with A V at position 110 can be substituted with I, M, K or T W at position 112 can be substituted with F, G or M L at position 135 can be substituted with T, S, Y, H or R D at position 136 can be substituted with E, S, F or N Y at position 138 can be substituted with C Xaa Xaa Gly Xaa His (SEQ ID NO: 50025)

Val Ile Trp Xaa Xaa Xaa Xaa Asn Xaa Xaa Tyr Xaa Xaa Ser Xaa Lys Gly (SEQ ID NO: 50026)

FIGURE 57
(Continued)

Glu Xaa Gly Xaa Xaa Xaa Asp Xaa (SEQ ID NO: 50027)

Asp Tyr Gly Met His (SEQ ID NO: 50492)

Val Ile Trp Tyr Asp Gly Ser Asn Lys Tyr Tyr Ala Asp Ser Val Lys Gly (SEQ ID NO: 50493)

Glu Val Gly Trp Leu Asp Asp Tyr (SEQ ID NO: 50494)

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_29D9_HC | . | . | . | . | . | . | . | . | . | . | . | . | . | . | . | . | . | . | . | . | . | . | . | . | . | . |
| 21-225_30F3_HC | . | . | . | . | . | . | . | . | . | . | . | . | . | . | . | . | . | . | . | . | . | . | . | . | . | . |
| 21-225_33B1_HC | . | . | . | . | . | . | . | . | . | . | . | . | . | . | . | . | . | . | . | . | . | . | . | . | . | . |
| 21-225_4C8_HC | . | . | . | . | . | . | . | . | . | . | . | . | . | . | . | . | . | . | T | . | . | . | . | . | . | . |
| 21-225_4F12_HC | . | . | . | . | . | . | . | . | . | . | . | . | . | . | . | . | . | . | T | P | . | N | . | . | . | . |
| 21-225_50C4_HC | . | . | . | . | . | . | . | . | . | . | . | . | . | . | . | . | . | . | . | G | . | . | . | G | G | . |
| 21-225_73G6_HC | . | . | . | . | . | . | . | . | . | . | . | . | . | . | . | . | . | . | . | . | . | . | . | . | . | . |
| 21-225_90H5_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | E | V | G | W | . | . | . | . | . | . | . | . | . | . | . | . | . | . | . | . | . | . |
| 21-225_29D9_HC | . | . | . | . | . | . | . | . | . | . | . | . | . | . | . | . | . | . | . | . | . | . | . | . | . | . |
| 21-225_30F3_HC | . | . | . | . | . | . | . | . | . | . | . | . | . | . | . | . | . | . | . | . | . | . | . | . | . | . |
| 21-225_33B1_HC | . | . | P | . | . | M | . | . | . | . | . | . | . | . | . | . | . | . | . | . | . | . | . | . | . | . |
| 21-225_4C8_HC | . | S | . | . | . | M | . | F | . | . | . | . | . | . | . | . | . | . | . | . | . | . | . | . | . | . |
| 21-225_4F12_HC | E | N | Q | . | . | K | . | Q | . | . | . | . | . | . | . | . | . | . | . | . | . | . | . | . | . | . |
| 21-225_50C4_HC | . | . | . | . | . | . | . | F | . | . | . | . | . | . | . | . | . | . | . | . | . | . | . | . | . | . |
| 21-225_73G6_HC | . | . | V | . | . | M | . | M | . | . | . | . | . | . | . | . | . | . | . | . | . | . | . | . | . | . |
| 21-225_90H5_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 H_FR4 L | 136 D | 137 D | 138 Y | 139 W | 140 G | 141 Q | 142 G | 143 T | 144 L | 145 V | 146 T | 147 V | 148 S | 149 S |
|---|---|---|---|---|---|---|---|---|---|---|---|---|---|---|---|---|---|---|---|
| CONSENSUS | | | | | L | D | D | Y | W | G | Q | G | T | L | V | T | V | S | S |
| 21-225_149F12_HC | | | | | S | E | | | | | | | | | | | | | |
| 21-225_149G1_HC | | | | | S | E | | | | | | | | | | | | | |
| 21-225_14C2_HC | | | | | R | S | | | | | | | | | | | | | |
| 21-225_150E7_HC | | | | | S | E | | | | | | | | | | | | | |
| 21-225_15B11_HC | | | | | T | S | | | | | | | | | | | | | |
| 21-225_15H10_HC | | | | | | S | | | | | | | | | | | | | |
| 21-225_161D11_HC | | | | | | S | | | | | | | | | | | | | |
| 21-225_161F7_HC | | | | | T | | | | | | | | | | | | | | |
| 21-225_16H4_HC | | | | | S | | | Q | | | | | | | | | | | |
| 21-225_180H7_HC | | | | | W | | | | | | | | | | | | | | |
| 21-225_181A8_HC | | | | | | E | | | | | | | | | | | | | |
| 21-225_184D11_HC | | | | | Y | | | | | | | | | | | | | | |
| 21-225_184H10_HC | | | | | | S | | | | | | | | | | | | | |
| 21-225_18H12_HC | | | | | T | E | | | | | | | | | | | | | |
| 21-225_203C10_HC | | | | | T | E | | | | | | | | | | | | | |
| 21-225_210E4_HC | | | | | T | E | | | | | | | | | | | | | |
| 21-225_225B6_HC | | | | | T | E | | | | | | | | | | | | | |
| 21-225_225D6_HC | | | | | T | E | | | | | | | | | | | | | |
| 21-225_225F8_HC | | | | | T | E | | | | | | | | | | | | | |
| 21-225_226A9_HC | | | | | R | S | | | | | | | | | | | | | |
| 21-225_227C12_HC | | | | | | | | | | | | | | | | | | | |
| 21-225_227G3_HC | | | | | | | | | | | | | | | | | | | |
| 21-225_227H5_HC | | | | | | | | | | | | | | | | | | | |
| 21-225_22B7_HC | | | | | | | | | | | | | | | | | | | |
| 21-225_25A9_HC | | | | | | | | | | | | | | | | | | | |
| 21-225_25G5_HC | | | | | | | | | | | | | | | | | | | |
| 21-225_28A9_HC | | | | | | | | | | | | | | | | | | | |
| 21-225_28B8_HC | | | | | | | | | | | | | | | | | | | |
| 21-225_29D8_HC | | | | | | | | | | | | | | | | | | | |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | - | - | - | - | L | D | D | Y | W | G | Q | G | T | L | V | T | V | S | S |
| 21-225_29D9_HC | . | . | . | . | . | . | . | . | . | . | . | . | . | Q | . | . | . | . | . |
| 21-225_30F3_HC | . | . | . | . | Y | . | . | . | . | . | . | . | . | . | . | . | . | . | . |
| 21-225_33B1_HC | . | . | . | . | Y | S | . | . | . | . | . | . | . | . | . | . | . | . | . |
| 21-225_4C8_HC | . | . | . | . | . | F | . | . | . | . | . | . | . | . | . | . | . | . | . |
| 21-225_4F12_HC | . | . | . | . | . | N | . | . | . | . | . | . | . | . | . | . | . | . | . |
| 21-225_50C4_HC | . | . | . | . | T | S | . | . | . | . | . | . | . | . | . | . | . | . | . |
| 21-225_73G6_HC | . | . | . | . | . | . | . | . | . | . | . | . | - | . | . | . | . | . | . |
| 21-225_90H5_HC | . | . | . | . | . | . | . | . | . | . | . | . | . | . | . | . | . | . | . |

FIGURE 57 (Continued)

Table 58. Consensus 24-VH3|3-21/D4|4-11|RF2/JH4 (SEQ ID NO: 50275)

EVQLVES-GGGLVKPGGSLRLSCAASG-FTFSS------YSMNWVRQAPGKGLEWVSSISGS---
SSYIYYADSVKGRFTISRDNAKNSLYLQMNSLRAEDTAVYYCARDRG................SSWGQGTLVTVSS wherein:

S at position 33 can be substituted with T

Y at position 39 can be substituted with F

S at position 40 can be substituted with T, G or R

M at position 41 can be substituted with L

S at position 57 can be substituted with A, C or L

G at position 60 can be substituted with S

S at position 65 can be substituted with G or T

S at position 66 can be substituted with T, G or Y

Y at position 67 can be substituted with H

I at position 68 can be substituted with L or M

Y at position 69 can be substituted with S or W

A at position 71 can be substituted with G, P or V

V at position 74 can be substituted with L

G at position 76 can be substituted with A

D at position 109 can be substituted with T

G at position 111 can be substituted with null (-), S or Y null (-) at position 112 can be substituted with G FIGURE 57 (Continued)

null (-) at position 135 can be substituted with S null (-) at position 136 can be substituted with F or S S at position 137 can be substituted with D, G or H S at position 138 can be substituted with L, Y, G, T, C, E or I Xaa Xaa Xaa Xaa Asn (SEQ ID NO: 50028)

Xaa Ile Ser Xaa Ser Xaa Xaa Xaa Xaa Tyr Xaa Asp Ser Xaa Lys Xaa (SEQ ID NO: 50029)

Xaa Arg Xaa Xaa Xaa Xaa Xaa Xaa (SEQ ID NO: 50030)

Ser Tyr Ser Met Asn (SEQ ID NO: 50495)

Ser Ile Ser Gly Ser Ser Tyr Ile Tyr Tyr Ala Asp Ser Val Lys Gly (SEQ ID NO: 50496)

Asp Arg Gly Ser Ser (SEQ ID NO: 50497)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | V | E | S | - | G | G | G | L | V | K | P | G | G | S | L | R | L | S | C | A | A | S |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | E | . | . | . | . | . | . | . | . | . | . | . |
| 21-225_56H7_HC | . | . | . | . | . | . | . | . | . | . | . | . | . | . | . | . | E | . | . | . | . | . | . | . | . | . |
| 21-225_58C5_HC | . | . | . | . | . | . | . | . | . | . | . | . | . | . | . | . | . | . | . | . | . | . | . | . | . | . |
| 21-225_65C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

FIGURE 57 (Continued)

| Reference # | | | | | | | H_CDR1 | | | | | | | | | | | | H_FR2 | | | | | | |
|---|---|---|---|---|---|---|---|---|---|---|---|---|---|---|---|---|---|---|---|---|---|---|---|---|---|---|
| | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
| CONSENSUS | G | - | F | T | F | S | S | - | - | - | - | - | Y | S | M | N | W | V | R | Q | A | P | G | K | G | L |
| 21-225_13D3_HC | . | . | . | . | . | . | . | . | . | . | . | . | . | T | . | . | . | . | . | . | . | . | . | . | . | . |
| 1-225_14B1_LC1_HC | . | . | . | . | . | . | . | . | . | . | . | . | . | T | . | . | . | . | . | . | . | . | . | . | . | . |
| 1-225_14B1_LC2_HC | . | . | . | . | . | . | . | . | . | . | . | . | . | T | . | . | . | . | . | . | . | . | . | . | . | . |
| 21-225_157G7_HC | . | . | . | . | . | . | . | . | . | . | . | . | . | . | . | . | . | . | . | . | . | . | . | . | . | . |
| 21-225_157H4_HC | . | . | . | . | . | . | . | . | . | . | . | . | . | T | . | . | . | . | . | . | . | . | . | . | . | . |
| 21-225_157H7_HC | . | . | . | . | . | . | . | . | . | . | . | . | . | . | . | . | . | . | . | . | . | . | . | . | . | . |
| 21-225_158F5_HC | . | . | . | . | . | . | . | . | . | . | . | . | . | . | . | . | R | . | . | . | . | . | . | . | . | . |
| 21-225_158G8_HC | . | . | . | . | . | . | . | . | . | . | . | . | . | . | . | . | . | . | . | . | . | . | . | . | . | . |
| 21-225_158H5_HC | . | . | . | . | . | . | . | . | . | . | . | . | . | . | . | . | . | . | . | . | . | . | . | . | . | . |
| 21-225_160F4_HC | . | . | . | . | . | . | . | . | . | . | . | . | . | . | . | . | . | . | . | . | . | . | . | . | . | . |
| 21-225_160H1_HC | . | . | . | . | . | . | . | . | . | . | . | . | . | . | . | . | . | . | . | . | . | . | . | . | . | . |
| 21-225_162F2_HC | . | . | . | . | . | . | . | . | . | . | . | . | . | . | . | . | . | . | . | . | . | . | . | . | . | . |
| 21-225_162H3_HC | . | . | . | . | . | S | . | . | . | . | . | . | . | G | . | . | . | . | . | . | . | . | . | . | . | . |
| 21-225_163F9_HC | . | . | . | . | . | . | . | . | . | . | . | . | . | . | . | . | . | . | . | . | . | . | . | . | . | . |
| 21-225_171A11_HC | . | . | . | . | . | . | . | . | . | . | . | . | . | . | . | . | . | . | . | . | . | . | . | . | . | . |
| 21-225_17C10_HC | . | . | . | . | . | T | . | . | . | . | . | . | . | G | L | . | . | . | . | . | . | . | . | . | . | . |
| 21-225_17D8_HC | . | . | . | . | . | . | . | . | . | . | . | . | . | . | . | . | . | . | . | . | . | . | . | . | . | . |
| 21-225_20B5_HC | . | . | . | . | . | . | . | . | . | . | . | . | . | . | . | . | . | . | . | . | . | . | . | . | . | . |
| 21-225_20B8_HC | . | . | . | . | . | . | . | . | . | . | . | . | . | . | . | . | . | . | . | . | . | . | . | . | . | . |
| 21-225_20C8_HC | . | . | . | . | . | . | T | . | . | . | . | . | . | . | . | . | . | . | . | . | . | . | . | . | . | . |
| 21-225_20F9_HC | . | . | . | . | . | . | . | . | . | . | . | . | . | . | . | . | . | . | . | . | . | . | . | . | . | . |
| 21-225_20G12_HC | . | . | . | . | . | . | . | . | . | . | . | . | . | T | . | . | . | . | . | . | . | . | . | . | . | . |
| 21-225_20H10_HC | . | . | . | . | . | . | . | . | . | . | . | . | . | . | . | . | . | . | . | . | . | . | . | . | . | . |
| 21-225_22H3_HC | . | . | . | . | . | . | . | . | . | . | . | . | . | . | . | . | . | . | . | . | . | . | . | . | . | . |
| 21-225_23E1_HC | . | . | . | . | . | . | . | . | . | . | . | . | . | T | . | . | . | . | . | . | . | . | . | . | . | . |
| 21-225_30H11_HC | . | . | . | . | . | . | . | . | . | . | . | . | . | . | . | . | . | . | . | . | . | . | . | . | . | . |
| 21-225_31G9_HC | . | . | . | . | . | . | . | . | . | . | . | . | . | T | . | . | . | . | . | . | . | . | . | . | . | . |
| 21-225_33C2_HC | . | . | . | . | . | . | . | . | . | . | . | . | . | . | . | . | . | . | . | . | . | . | . | . | . | . |
| 21-225_43E1_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | H_CDR1 | | | | | | | H_FR2 | | | | | | | | | | | |
| CONSENSUS_HC | G | - | F | T | F | S | S | - | - | - | - | - | Y | S | M | N | W | V | R | Q | A | P | G | K | G | L |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | S | . | . | . | . | . | . | . | . | . | . | . | . | . | . | . | . | . | . | . | . | . | . |
| 21-225_58C5_HC | . | . | . | . | . | N | . | . | . | . | . | . | . | . | . | . | . | . | . | . | . | . | . | . | . | . |
| 21-225_65C12_HC | . | . | . | . | . | . | . | . | . | . | . | . | R | . | L | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| CONSENSUS | E | W | V | S | S | I | S | G | S | S | . | . | S | S | Y | I | Y | Y | A | D | S | V | K | G | R | F |
| 1-225_13D3_HC | D | | | | | | | | | | | | | | | | | | | | | | | | | |
| 1-225_14B1_LC1_HC | | | | | | | | | | | | | | | | L | | | P | | | | | | | |
| 1-225_14B1_LC2_HC | | | | | | | | | | | | | | | | L | | | P | | | | | | | |
| 21-225_157G7_HC | | | | | | | | | | | | | | | | | | | | | | | | | | |
| 21-225_157H4_HC | | | | | C | | | G | | | | | | T | | | | | | | | | | | | |
| 21-225_157H7_HC | | | | | L | | | | | | | | | T | | | | | | | | | | | | |
| 21-225_158F5_HC | | | | | | | | | | | | | | T | | | | | | | | | | | | |
| 21-225_158G8_HC | | | | | | | | | | | | | | T | | | | | | | | | | | | |
| 21-225_158H5_HC | | | | | | | | G | | | | | | T | | S | | | | | | | | | | |
| 21-225_160F4_HC | | | | | | | | | | | | | | T | | | | | | | | | | | | |
| 21-225_160H1_HC | | | | | | | | | | | | | | Q | | | | | | | | | | | | |
| 21-225_162F2_HC | | | | | | | | | | | | | | T | | | | | | | | | | | | |
| 21-225_162H3_HC | | | | | | | | | | | | | | T | | | | | | | | | | | | |
| 21-225_163F9_HC | | | | | | | | | | | | | | | | | | | | | | | | | | |
| 21-225_171A11_HC | | | | | | | | | | | | | | | | | | | | | | | | | | |
| 21-225_17C10_HC | | | | | | | | | | | | | Q | | X | M | | | | | | | | | | |
| 21-225_17D8_HC | | | | | | | | | | | | | Q | | X | M | | | | | | | | | | |
| 21-225_20B5_HC | | | | | | | | | | | | | | | | | | | | | | | | | | |
| 21-225_20B8_HC | | | | | | | | | | | | | | | | | | | | | | | | | | |
| 21-225_20C8_HC | | | | | | | | S | | | | | | | | | S | | | | | | | A | | |
| 21-225_20F9_HC | | | | | | | | S | | | | | | | | | | | | | | L | | | | |
| 21-225_20G12_HC | | | | | | | | S | | | | | | | | | W | | V | | | | | | | |
| 21-225_20H10_HC | | | | | | | | S | | | | | | | | | | | | | | | | | | |
| 21-225_22H3_HC | | | | | | | | | | | | | | | | | | | | | | | | | | |
| 21-225_23E1_HC | | | | | | | | | | | | | | | | | | | | | | | | | | |
| 21-225_30H11_HC | | | | | | | | | N | | | | | | | | | | | | | | | | | |
| 21-225_31G9_HC | Q | | | | | | | | | | | | | | | | | | | | | | | | | |
| 21-225_33C2_HC | | | | | A | | | | | | | | | T | | | | | | | | | | | | |
| 21-225_43E1_HC | | | | | | | | | | | | | | T | | | | | | | | L | | | | |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | S | S | I | S | G | S | . | . | . | S | S | Y | Y | Y | Y | A | D | S | V | K | G | R | F |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | S | . | . | . | . | . | T | . | . | . | . | G | . | . | . | . | . | . | . |
| 21-225_56H7_HC | . | . | . | . | . | . | . | S | . | . | . | . | . | T | . | . | . | . | G | . | . | . | . | . | . | . |
| 21-225_58C5_HC | . | . | . | . | . | . | . | S | . | . | . | . | . | Y | . | L | . | . | . | . | . | . | . | . | . | . |
| 21-225_65C12_HC | . | . | . | . | . | . | . | S | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | A | K | N | S | L | Y | L | Q | M | N | S | L | R | A | E | D | T | A | V | Y |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | . | . | S | . | . | . | . | . | . | . | . | . | . | . | . | . | . | . | . | . | . | . | . |
| 21-225_58C5_HC | . | . | . | . | . | . | . | . | . | . | . | . | . | . | . | . | . | . | . | . | . | . | . | . | . | . |
| 21-225_65C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | D | R | G | | | | | | | | | | | | | | | | | | | |
| 21-225_13D3_HC | . | . | . | . | . | . | . | . | . | . | . | . | . | . | . | . | . | . | . | . | . | . | . | . | . | . |
| 1-225_14B1_LC1_HC | . | . | . | . | . | . | . | . | . | . | . | . | . | . | . | . | . | . | . | . | . | . | . | . | . | . |
| 1-225_14B1_LC2_HC | . | . | . | . | . | . | . | . | . | . | . | . | . | . | . | . | . | . | . | . | . | . | . | . | . | . |
| 21-225_15TG7_HC | . | . | . | . | . | . | . | . | . | . | . | . | . | . | . | . | . | . | . | . | . | . | . | . | . | . |
| 21-225_157H4_HC | . | . | V | . | . | . | . | . | . | . | . | . | . | . | . | . | . | . | . | . | . | . | . | . | . | . |
| 21-225_157H7_HC | . | . | . | . | . | . | . | . | . | . | . | . | . | . | . | . | . | . | . | . | . | . | . | . | . | . |
| 21-225_158F5_HC | . | . | . | . | . | . | . | . | . | . | . | . | . | . | . | . | . | . | . | . | . | . | . | . | . | . |
| 21-225_158G8_HC | . | . | . | . | . | . | . | . | . | . | . | . | . | . | . | . | . | . | . | . | . | . | . | . | . | . |
| 21-225_158H5_HC | . | . | . | . | . | . | . | . | . | . | . | . | . | . | . | . | . | . | . | . | . | . | . | . | . | . |
| 21-225_160F4_HC | . | . | . | . | . | . | . | . | . | . | . | . | . | . | . | . | . | . | . | . | . | . | . | . | . | . |
| 21-225_160H1_HC | F | . | . | . | . | . | . | . | . | . | . | . | . | . | . | . | . | . | . | . | . | . | . | . | . | . |
| 21-225_162F2_HC | . | . | . | . | . | K | . | . | . | . | . | . | . | . | . | . | . | . | . | . | . | . | . | . | . | . |
| 21-225_162H3_HC | . | . | . | . | . | . | . | . | . | . | . | . | . | . | . | . | . | . | . | . | . | . | . | . | . | . |
| 21-225_163F9_HC | . | . | . | . | . | . | . | . | . | . | . | . | . | . | . | . | . | . | . | . | . | . | . | . | . | . |
| 21-225_171A11_HC | . | . | . | . | . | . | . | . | . | . | . | . | . | . | . | . | . | . | . | . | . | . | . | . | . | . |
| 21-225_17C10_HC | . | . | . | . | . | . | . | . | . | . | . | . | . | . | . | . | . | . | . | . | . | . | . | . | . | . |
| 21-225_17D8_HC | . | . | . | . | . | . | . | . | . | . | . | . | . | . | . | . | . | . | . | . | . | . | . | . | . | . |
| 21-225_20B5_HC | . | . | . | . | . | . | . | . | . | . | . | . | . | . | . | . | . | . | . | . | . | . | . | . | . | . |
| 21-225_20B8_HC | . | . | . | . | . | . | . | . | . | . | . | . | . | . | . | . | . | . | . | . | . | . | . | . | . | . |
| 21-225_20C8_HC | . | . | . | . | . | . | . | . | . | . | . | . | . | . | . | . | . | . | . | . | . | . | . | . | . | . |
| 21-225_20F9_HC | . | . | . | . | . | . | . | . | . | . | . | . | . | . | . | . | . | . | . | . | . | . | . | . | . | . |
| 21-225_20G12_HC | . | . | . | . | . | . | . | . | . | . | . | . | . | . | . | . | . | . | . | . | . | . | . | . | . | . |
| 21-225_20H10_HC | . | . | . | . | . | . | . | . | . | . | . | . | . | . | . | . | . | . | . | . | . | . | . | . | . | . |
| 21-225_22H3_HC | . | . | . | . | . | . | . | . | . | . | . | . | . | . | . | . | . | . | . | . | . | . | . | . | . | . |
| 21-225_23E1_HC | . | . | . | . | . | . | . | . | . | . | . | . | . | . | . | . | . | . | . | . | . | . | . | . | . | . |
| 21-225_30H11_HC | . | . | . | . | . | . | . | . | . | . | . | . | . | . | . | . | . | . | . | . | . | . | . | . | . | . |
| 21-225_31G9_HC | . | . | . | . | . | . | . | . | . | . | . | . | . | . | . | . | . | . | . | . | . | . | . | . | . | . |
| 21-225_33C2_HC | . | . | . | . | . | . | . | . | . | . | . | . | . | . | . | . | . | . | . | . | . | . | . | . | . | . |
| 21-225_43E1_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | D | R | G | . | . | . | . | . | . | . | . | . | . | . | . | . | . | . | . | . | . | . |
| 21-225_53G1_HC | . | . | . | . | . | . | . | . | . | . | . | . | . | . | . | . | . | . | . | . | . | . | . | . | . | . |
| 21-225_56F1_HC | . | . | . | . | . | . | . | . | . | . | . | . | . | . | . | . | . | . | . | . | . | . | . | . | . | . |
| 21-225_56H7_HC | . | . | . | . | T | Y | S | . | . | . | . | . | . | . | . | . | . | . | . | . | . | . | . | . | . | . |
| 21-225_58C5_HC | . | . | . | . | . | A | Y | G | . | . | . | . | . | . | . | . | . | . | . | . | . | . | . | . | . | . |
| 21-225_65C12_HC | . | . | . | . | . | . | . | . | . | . | . | . | . | . | . | . | . | . | . | . | . | . | . | . | . | . |
| 21-225_6C12_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | - | - | - | - | - | - | S | S | W | G | Q | G | T | L | V | T | V | S | S |
| 21-225_53G1_HC | . | . | . | . | . | . | . | T | . | . | . | . | . | . | . | . | . | . | . |
| 21-225_56F1_HC | . | . | . | . | . | . | . | . | . | . | . | . | . | . | . | . | . | . | . |
| 21-225_56H7_HC | . | . | . | . | S | F | D | Y | . | . | . | . | . | . | . | . | . | . | . |
| 21-225_58C5_HC | . | . | . | . | . | S | E | Y | . | . | . | . | . | . | . | . | . | . | . |
| 21-225_65C12_HC | . | . | . | . | . | . | . | L | . | . | . | . | . | . | . | . | . | . | . |
| 21-225_6C12_HC | . | . | . | . | . | . | . | . | . | . | . | . | . | . | . | . | . | . | . |

FIGURE 57 (Continued)

Table 59. Consensus 25-VH3|3-23/D6i6-19|RF2/JH3 (SEQ ID NO: 50276)

EVQLLES-GGGLVQPGGSLRLSCAASE-FTFSS-----YAMSWVRQAPGKGLEWVSVISGR---
GGNTFYADSVKGRFTISRDNSKNTLYLQMNSLRAEDTAVYYCASRIAVAG..........SEAFDIWGQGTMVTVSS wherein:

S at position 33 can be substituted with G
A at position 40 can be substituted with V
S at position 42 can be substituted with N or T
V at position 57 can be substituted with I or A
G at position 60 can be substituted with R
R at position 61 can be substituted with S
G at position 66 can be substituted with V, I or T
N at position 67 can be substituted with Y, S or T
T at position 68 can be substituted with A
F at position 69 can be substituted with Y
Y at position 70 can be substituted with N or S
K at position 75 can be substituted with R
I at position 110 can be substituted with L, M or V
A at position 113 can be substituted with D
S at position 133 can be substituted with N or Y
E at position 134 can be substituted with D
F at position 136 can be substituted with C FIGURE 57 (Continued)

D at position 137 can be substituted with A or H

I at position 138 can be substituted with V

Xaa Tyr Xaa Met Xaa (SEQ ID NO: 50031)

Xaa Ile Ser Xaa Xaa Gly Xaa Xaa Xaa Xaa Ala Xaa Gly Xaa Xaa Ala Xaa Xaa Xaa (SEQ ID NO: 50032)

Arg Xaa Ala Val Xaa Gly Xaa Xaa Ala Xaa Xaa Xaa (SEQ ID NO: 50033)

Ser Tyr Ala Met Ser (SEQ ID NO: 50498)

Val Ile Ser Gly Arg Gly Gly Asn Thr Phe Tyr Ala Asp Ser Val Lys Gly (SEQ ID NO: 50499)

Arg Ile Ala Val Ala Gly Ser Glu Ala Phe Asp Ile (SEQ ID NO: 50500)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | L | E | S | - | G | G | G | L | V | Q | P | G | G | S | L | R | L | S | C | A | A | S |
| 21-225_6D3_HC | . | . | . | . | . | . | . | . | . | . | . | . | . | . | . | . | . | . | . | . | . | . | . | . | . | . |
| 21-225_8E12_HC | . | . | . | . | . | . | . | . | . | . | . | . | . | . | . | . | . | . | . | . | . | . | . | V | . | . |
| 21-225_8G8_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | H_FR2 | | | | | | | | | | |
| CONSENSUS | E | . | F | T | F | S | S | . | . | . | . | . | Y | A | M | S | W | V | R | Q | A | P | G | K | G | L |
| 21-225_6D3_HC | . | . | . | . | . | . | . | . | . | . | . | . | . | . | . | N | . | . | . | . | . | . | . | . | . | . |
| 21-225_8E12_HC | . | . | . | . | . | . | . | . | . | . | . | . | . | V | . | . | . | . | . | . | . | . | . | . | . | . |
| 21-225_8G6_HC | . | . | . | . | . | . | . | . | . | . | . | . | . | . | . | N | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | S | V | I | S | G | R | - | - | G | G | N | T | F | Y | A | D | S | V | K | G | R | F |
| 21-225_6D3_HC | . | . | . | . | . | . | . | . | . | . | . | . | . | . | . | . | . | . | . | . | . | . | . | . | . | . |
| 21-225_8E12_HC | . | . | . | . | — | . | . | . | . | . | . | . | . | . | . | . | . | . | . | . | . | . | . | . | . | . |
| 21-225_8G6_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_6D3_HC | . | . | . | . | . | . | . | . | . | . | . | . | . | . | . | . | . | . | . | . | . | . | . | . | . | . |
| 21-225_8E12_HC | . | . | . | . | . | . | . | . | . | . | . | . | . | . | . | . | . | . | . | . | . | . | . | . | . | . |
| 21-225_8G6_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | S | R | I | A | V | A | G | x | x | x | x | x | x | x | x | x | x | x | x | x | x | x | x |
| 21-225_6D3_HC | F | . | . | . | . | L | . | . | . | . | . | . | . | . | . | . | . | . | . | . | . | . | . | . | . | . |
| 21-225_8E12_HC | . | . | . | . | . | ▓ | . | . | . | . | . | . | . | . | . | . | . | . | . | . | . | . | . | . | . | . |
| 21-225_8G6_HC | . | . | . | . | . | L | . | . | . | . | . | . | . | . | . | . | . | . | . | . | . | . | . | . | . | . |

H_CDR3 (positions 115–130)

FIGURE 57 (Continued)

Table 60. Consensus 26-- VH3|3-23/D5|5-12|RF3/JH6 (SEQ ID NO: 50277):

EVQLLES-GGGLVQPGGSLRLSCAASG-FTFSS------YAMSWVRQAPGKGLEWVSAISGR---
GGSTFHADSVKGRFTISRDNSKNTLYLQMNSLRAEDTAVYYCVKGELLEDY--------------YFYGMDVWGQGTTVTVSS wherein:

S at position 33 can be substituted with N

Y at position 39 can be substituted with C

A at position 40 can be substituted with V

S at position 42 can be substituted with N

A at position 57 can be substituted with T or S

I at position 58 can be substituted with L

G at position 60 can be substituted with R or V

R at position 61 can be substituted with G

S at position 67 can be substituted with N

T at position 68 can be substituted with I

F at position 69 can be substituted with Y

H at position 70 can be substituted with Y or N

V at position 74 can be substituted with E or M

G at position 109 can be substituted with W

E at position 110 can be substituted with G

E at position 113 can be substituted with Y

D at position 114 can be substituted with S or N

FIGURE 57 (Continued)

null (-) at position 116 can be substituted with E

Y at position 132 can be substituted with S

F at position 133 can be substituted with Y

Y at position 134 can be substituted with F

G at position 135 can be substituted with A

M at position 136 can be substituted with I or L

Xaa Xaa Xaa Met Xaa (SEQ ID NO: 50034)

Xaa Xaa Ser Xaa Xaa Gly Gly Xaa Xaa Xaa Xaa Ala Asp Ser Xaa Lys Gly (SEQ ID NO: 50035)

Xaa Xaa Leu Xaa Xaa Tyr Xaa Xaa Xaa Xaa Xaa Xaa Asp Val (SEQ ID NO: 50036)

Ser Tyr Ala Met Ser (SEQ ID NO: 50501)

Ala Ile Ser Gly Arg Gly Gly Ser Thr Phe His Ala Asp Ser Val Lys Gly (SEQ ID NO: 50502)

Gly Glu Leu Leu Glu Asp Tyr Tyr Phe Tyr Gly Met Asp Val (SEQ ID NO: 50503)

Table 61. Consensus 27- VH3|3-33/D4|4-23|rF2/JH6 (SEQ ID NO: 50278):

QVQLVES-GGGVVQPGRSLRLSCAASG-FTFSS------YGMHWVRQAPGKGLEWVAVIWYD---GSNKYYADSVKGRFTISRDNSKNTLYLQMNSLRAEDTAVYYCARDRVYCSSTSC----------PYYYYYGMDVWGQGTTVTVSS wherein:

S in position 33 can be substituted with G, D, R, H, T or N

G in position 40 can be substituted with V

M in position 41 can be substituted with L

H in position 42 can be substituted with N

V in position 57 can be substituted with L, F, I or D

I in position 58 can be substituted with F

W in position 59 can be substituted with R

Y in position 60 can be substituted with F

S in position 66 can be substituted with N or T

N in position 67 can be substituted with E, D or K

K in position 68 can be substituted with N or T

Y in position 69 can be substituted with S, D or N

Y in position 70 can be substituted with N

A in position 71 can be substituted with V

G in position 76 can be substituted with D

R in position 110 can be substituted with D, W or N

V in position 111 can be substituted with D, R, F or H

FIGURE 57 (Continued)

Y in position 112 can be substituted with S, E, G or F
C in position 113 can be substituted with G or E
S in position 114 can be substituted with G
S in position 115 can be substituted with G, R or N
T in position 116 can be substituted with null (-), S or P
S in position 117 can be substituted with P, null (-) or T
C in position 118 can be substituted with null (-)
null (-) in position 119 can be substituted with S, H, L or Y
P in position 129 can be substituted with null (-), S or Y
Y in position 130 can be substituted with null (-)
Y in position 131 can be substituted with null (-)
Y in position 132 can be substituted with null (-)
Y in position 134 can be substituted with F
G in position 135 can be substituted with A
M in position 136 can be substituted with L
Xaa Tyr Xaa Xaa (SEQ ID NO: 50037)
Xaa Xaa Xaa Xaa Asp Gly Xaa Xaa Xaa Xaa Xaa Asp Ser Val Lys Xaa (SEQ ID NO: 50038)
Asp Xaa Xaa Xaa Xaa Xaa Xaa Xaa Xaa Xaa Xaa Xaa Tyr Xaa Xaa Asp Val (SEQ ID NO: 50039)
Ser Tyr Gly Met His (SEQ ID NO: 50504)

FIGURE 57 (Continued)

Val Ile Trp Tyr Asp Gly Ser Asn Lys Tyr Ala Asp Ser Val Lys Gly (SEQ ID NO: 50505)

Asp Arg Val Tyr Cys Ser Ser Thr Ser Cys Pro Tyr Tyr Tyr Tyr Tyr Gly Met Asp Val (SEQ ID NO: 50506)

Table 62. Consensus 28- VH3|3-21/D|I1-1|RF2/JH4 (SEQ ID NO: 50279):

EVQLVES-GGGLVKPGGSLRLSCAASG-FTFSS----YSMNWVRQAPGKGLEWVSSISGS---
SSYIYYADSVKGRFTISRDNAKNSLYLQMNSLRAEDTAVYYCARVAS------------FDYWGQGTLVTVSS wherein:

S at position 33 can be substituted with N

S at position 40 can be substituted with T, K, N or R

M at position 41 can be substituted with L

I at position 58 can be substituted with T

G at position 60 can be substituted with S

S at position 61 can be substituted with G, N or T

S at position 65 can be substituted with G, D or N

S at position 66 can be substituted with T

Y at position 67 can be substituted with F, D, L, N or S

I at position 68 can be substituted with M or T

Y at position 69 can be substituted with N

A at position 71 can be substituted with T

A at position 110 can be substituted with N or S

S at position 111 can be substituted with A, G, T, L, H or N

F at position 136 can be substituted with L or N

Y at position 138 can be substituted with C or S

Xaa Tyr Xaa Xaa Asn (SEQ ID NO: 50040)

FIGURE 57 (Continued)

Ser Xaa Ser Xaa Xaa Xaa Xaa Xaa Xaa Tyr Xaa Asp Ser Val Lys Gly (SEQ ID NO: 50041)

Val Xaa Xaa Xaa Asp Xaa (SEQ ID NO: 50042)

Ser Tyr Ser Met Asn (SEQ ID NO: 50507)

Ser Ile Ser Gly Ser Ser Ser Tyr Ile Tyr Tyr Ala Asp Ser Val Lys Gly (SEQ ID NO: 50508)

Val Ala Ser Phe Asp Tyr (SEQ ID NO: 50509)

| Reference # | 131 | 132 | 133 | 134 | 135 | 136 | 137 | 138 | 139 | 140 | 141 | 142 | 143 | 144 H_FR4 | 145 | 146 | 147 | 148 | 149 |
|---|---|---|---|---|---|---|---|---|---|---|---|---|---|---|---|---|---|---|---|
| CONSENSUS | . | . | . | . | . | F | D | Y | W | G | Q | G | T | L | V | T | V | S | S |
| 21-225_14D6_HC | | | | | | | | S | | | | | | | | S | | S | S |
| 21-225_157E4_HC | | | | | | | | | | | | | | | | | | | |
| 21-225_157H10_HC | | | | | | | | | | | | | | | | | | | |
| 21-225_15A2_HC | | | | | | | | | | | | | | | | | | | |
| 21-225_18A11_HC | | | | | | | | | | | | | | | | | | | |
| 21-225_16B8_HC | | | | | | | | | | | | | | | | | | | |
| 21-225_16H1_HC | | | | | | | | | | | | | | | | | | | |
| 21-225_17H5_HC | | | | | | | | | | | | | | | | | | | |
| 21-225_17H6_HC | | | | | | | | | | | | | | | | | | | |
| 21-225_1F1_HC | | | | | | | | | | | | | | | | | | | |
| 21-225_20H7_HC | | | | | | L | | | | | | | | | | | | | |
| 21-225_22B12_HC | | | | | | L | | S | | | | | | | | | | | |
| 21-225_23A11_HC | | | | | | | | G | | | | | | | | | | | |
| 21-225_27C5_HC | | | | | | | | | | | | | | | | | | | |
| 21-225_27H12_HC | | | | | | | | | | | | | | | | | | | |
| 21-225_2A4_HC | | | | | | | | | | | | | | | | | | | |
| 21-225_2C12_HC | | | | | | | | | | | | | | | | | | | |
| 21-225_32B3_HC | | | | | | | | | | | | | | | | | | | |
| 21-225_35H8_HC | | | | | | | | | | | | | | | | | | | |
| 21-225_50G10_HC | | | | | | N | | | | | | | | | | | | | |
| 21-225_52E3_HC | | | | | | | | | | | | | | | | | | | |
| 21-225_52H12_HC | | | | | | | | | | | | | | | | | | | |
| 21-225_56A5_HC | | | | | | | | | | | | | | | | | | | |
| 21-225_56H1_HC | | | | | | | | | | | | | | | | | | | |
| 21-225_57B2_HC | | | | | | | | | | | | | | | | | | | |
| 21-225_5E11_HC | | | | | | | | | | | | | | | | | | | |
| 21-225_5F4_HC | | | | | | | | C | | | | | | | | | | | |
| 21-225_70E12_HC | | | | | | | | | | | | | | | | | | | |

FIGURE 57 (Continued)

Table 63. Consensus 29-VH4i4-30.1/D3i3-22iRF2/JH6 (SEQ ID NO: 50280):

QVQLQES-GPGLVKPSQTLSLTCTVSG-GSISSG---DYYWNWIRQHPGKGLEWIGYIFY----
SGSTYYNPSLKSRVTISVDTSKNQFSLKLSSVTAADTAVYYCARGDYDGSGSY--------HYYYGMDVWGQGTTVTVSS wherein:

G at position 34 can be substituted with V

D at position 38 can be substituted with V, G or S

Y at position 40 can be substituted with H

N at position 42 can be substituted with S

Y at position 57 can be substituted with N or F

I at position 58 can be substituted with L

F at position 59 can be substituted with Y or H

Y at position 60 can be substituted with H

Y at position 70 can be substituted with N

K at position 75 can be substituted with R

Y at position 132 can be substituted with F or H

Y at position 134 can be substituted with H

M at position 136 can be substituted with L

Ser Xaa Tyr Xaa Trp Xaa (SEQ ID NO: 50230)

Xaa Xaa Xaa Ser Gly Ser Thr Tyr Xaa Asn Pro Ser Leu Xaa Ser (SEQ ID NO: 50231)

Gly Asp Tyr Asp Gly Ser Gly Ser Tyr His Xaa Tyr Xaa Gly Xaa Asp Val (SEQ ID NO: 50232)

Ser Gly Asp Tyr Tyr Trp Asn (SEQ ID NO: 50510)

Tyr Ile Phe Tyr Ser Gly Ser Thr Tyr Tyr Asn Pro Ser Leu Lys Ser (SEQ ID NO: 50511)

Gly Asp Tyr Asp Gly Ser Gly Ser Tyr His Tyr Tyr Tyr Gly Met Asp Val (SEQ ID NO: 50512)

Table 64. Consensus 30- VH3|3-23/D7|7-27|RF1/JH6 (SEQ ID NO: 50281):

EVQLLES-GGGLVQPGGSLRLSCAASG-FTFSS----YAMSWVRQAPGKGLEWVSVISGG----GSSTYYADSVKGRFTISRDNSKNTLYLQMNSLRAEDTAVYYCAKWRGNPT........DYGMDVWGQGTTVTVSS wherein:

S at position 33 can be substituted with N or T

Y at position 39 can be substituted with H

A at position 40 can be substituted with P or V

V at position 57 can be substituted with A or I

G at position 61 can be substituted with S

S at position 66 can be substituted with G or T

S at position 67 can be substituted with T

T at position 68 can be substituted with A

W at position 109 can be substituted with A

R at position 110 can be substituted with G

N at position 112 can be substituted with T

P at position 113 can be substituted with T

T at position 114 can be substituted with G null (-) at position 115 can be substituted with S null (-) at position 116 can be substituted with Y null (-) at position 132 can be substituted with Y D at position 133 can be substituted with Y FIGURE 57 (Continued)

Y at position 134 can be substituted with N or S

Xaa Xaa Xaa Met Ser (SEQ ID NO: 50043)

Xaa Ile Ser Gly Xaa Gly Xaa Xaa Xaa Tyr Tyr Ala Asp Ser Val Lys Gly (SEQ ID NO: 50044)

Xaa Xaa Gly Xaa Xaa Xaa Xaa Xaa Xaa Gly Met Asp (SEQ ID NO: 50045)

Ser Tyr Ala Met Ser (SEQ ID NO: 50513)

Val Ile Ser Gly Gly Gly Ser Thr Tyr Tyr Ala Asp Ser Val Lys Gly (SEQ ID NO: 50514)

Trp Arg Gly Asn Pro Thr Asp Tyr Gly Met Asp (SEQ ID NO: 50515)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | Y | C | A | K | W | R | G | N | P | T | | | | | | | | | H_CDR3 | | | | | | | |
| CONSENSUS | | | | | | | | | | | | | | | | | | | | | | | | | | |
| 21-225_146A2_HC | . | . | . | . | . | . | . | . | . | . | . | . | . | . | . | . | . | . | . | . | . | . | . | . | . | . |
| 21-225_146A3_HC | . | . | . | . | . | . | . | . | . | . | . | . | . | . | . | . | . | . | . | . | . | . | . | . | . | . |
| 21-225_146B11_HC | . | . | . | . | . | . | . | . | . | . | . | . | . | . | . | . | . | . | . | . | . | . | . | . | . | . |
| 21-225_146C11_HC | . | . | . | . | . | . | . | . | . | . | . | . | . | . | . | . | . | . | . | . | . | . | . | . | . | . |
| 21-225_147B12_HC | . | . | . | . | . | . | . | . | . | . | . | . | . | . | . | . | . | . | . | . | . | . | . | . | . | . |
| 21-225_147E11_HC | . | . | . | . | . | . | . | . | . | . | . | . | . | . | . | . | . | . | . | . | . | . | . | . | . | . |
| 21-225_147E7_HC | . | . | . | . | . | . | . | . | . | . | . | . | . | . | . | . | . | . | . | . | . | . | . | . | . | . |
| 21-225_148C6_HC | . | . | . | . | . | . | . | . | . | . | . | . | . | . | . | . | . | . | . | . | . | . | . | . | . | . |
| 21-225_148G11_HC | . | . | . | . | . | . | . | . | . | . | . | . | . | . | . | . | . | . | . | . | . | . | . | . | . | . |
| 21-225_148G6_HC | . | . | . | . | . | . | . | . | . | . | . | . | . | . | . | . | . | . | . | . | . | . | . | . | . | . |
| 21-225_148H11_HC | . | . | . | . | . | . | . | . | . | . | . | . | . | . | . | . | . | . | . | . | . | . | . | . | . | . |
| 21-225_149C10_HC | . | . | . | . | . | . | . | . | . | . | . | . | . | . | . | . | . | . | . | . | . | . | . | . | . | . |
| 21-225_149C7_HC | . | . | . | . | . | . | . | . | . | . | . | . | . | . | . | . | . | . | . | . | . | . | . | . | . | . |
| 21-225_150F6_HC | . | . | . | . | . | . | . | . | . | . | . | . | . | . | . | . | . | . | . | . | . | . | . | . | . | . |
| 21-225_150H11_HC | . | . | . | . | . | . | . | . | . | . | . | . | . | . | . | . | . | . | . | . | . | . | . | . | . | . |
| 21-225_151B9_HC | . | . | . | . | . | . | . | . | . | . | . | . | . | . | . | . | . | . | . | . | . | . | . | . | . | . |
| 21-225_151H5_HC | . | . | . | . | . | . | . | . | . | . | . | . | . | . | . | . | . | . | . | . | . | . | . | . | . | . |
| 21-225_151H7_HC | . | . | . | . | . | . | . | . | . | . | . | . | . | . | . | . | . | . | . | . | . | . | . | . | . | . |
| 21-225_152D7_HC | . | . | . | . | . | . | . | . | . | . | . | . | . | . | . | . | . | . | . | . | . | . | . | . | . | . |
| 21-225_152G6_HC | . | . | . | . | . | . | . | . | . | . | . | . | . | . | . | . | . | . | . | . | . | . | . | . | . | . |
| 21-225_154C4_HC | . | . | . | . | . | . | . | . | . | . | . | . | . | . | . | . | . | . | . | . | . | . | . | . | . | . |
| 21-225_154E10_HC | . | . | . | . | . | . | . | . | . | . | . | . | . | . | . | . | . | . | . | . | . | . | . | . | . | . |
| 21-225_155C10_HC | . | . | . | . | . | . | . | . | . | . | . | . | . | . | . | . | . | . | . | . | . | . | . | . | . | . |
| 21-225_207C9_HC | . | . | . | K | . | Q | . | T | T | Q | S | Y | . | . | . | . | . | . | . | . | . | . | . | . | . | . |

FIGURE 57 (Continued)

Table 65. Consensus 31-VH3j3-33/D4j4-17|RF2/JH4 (SEQ ID NO: 50282):

QVQLVES-GGGVVQPGRSLRLSCAASG-FTFSS----YGMHWVRQAPGKGLEWVAIIWYD---
GSNKYYADSVKGRFTISRDNSKNTLYLQMNSLRAEDTAVYYCARDHYDFW----------SGHFDYWGQGTLVTVSS wherein:

S at position 33 can be substituted with N or T

M at position 41 can be substituted with L

I at position 57 can be substituted with V or A

I at position 58 can be substituted with M

S at position 66 can be substituted with T

N at position 67 can be substituted with Y or S

A at position 71 can be substituted with G, T or V

D at position 109 can be substituted with E

H at position 110 can be substituted with R, Q, A, G, T or Y

Y at position 111 can be substituted with G, F or H

D at position 112 can be substituted with I or F

F at position 113 can be substituted with V or L

W at position 114 can be substituted with G or null (-)

S at position 133 can be substituted with A or null (-)

G at position 134 can be substituted with T or E

H at position 135 can be substituted with Y, W or F

F at position 136 can be substituted with L or S

FIGURE 57 (Continued)

D at position 137 can be substituted with A, C or G

Y at position 138 can be substituted with F or S

Xaa Tyr Gly Xaa His (SEQ ID NO: 50253)

Xaa Xaa Trp Tyr Asp Gly Xaa Xaa Lys Tyr Tyr Xaa Asp Ser Val Lys Gly (SEQ ID NO: 50254)

Xaa Xaa Xaa Xaa Xaa Xaa Xaa Xaa Xaa Xaa Xaa (SEQ ID NO: 50255)

Ser Tyr Gly Met His (SEQ ID NO: 50516)

Ile Ile Trp Tyr Asp Gly Ser Asn Lys Tyr Tyr Ala Asp Ser Val Lys Gly (SEQ ID NO: 50517)

Asp His Tyr Asp Phe Trp Ser Gly His Phe Asp Tyr (SEQ ID NO: 50518)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | H_CDR1 | | | | | | | | | | | | | H_FR2 | | | | | | | | | | |
| CONSENSUS | G | - | F | T | F | S | S | - | - | - | - | Y | G | - | M | H | W | V | R | Q | A | P | G | K | G | L |
| 21-225_147E10_HC | . | . | . | . | . | . | N | . | . | . | . | . | . | . | . | . | . | . | . | . | . | . | . | . | . | . |
| 21-225_148B2_HC | . | . | . | . | . | . | . | . | . | . | . | . | . | . | . | . | . | . | . | . | . | . | . | . | . | . |
| 21-225_148G10_HC | . | . | . | . | . | . | . | . | . | . | . | . | . | . | . | . | . | . | . | . | . | . | . | . | . | . |
| 21-225_149F1_HC | . | . | . | . | . | . | . | . | . | . | . | . | . | . | . | . | . | . | . | . | . | . | . | . | . | . |
| 21-225_150B11_HC | . | . | . | . | . | . | N | . | . | . | . | . | . | . | . | . | . | . | . | . | . | . | . | . | . | . |
| 21-225_151A10_HC | . | . | . | ~ | . | . | . | . | . | . | . | . | . | . | . | . | . | . | . | . | . | . | . | . | . | . |
| 21-225_151G5_HC | . | . | . | . | . | . | . | . | . | . | . | . | . | . | . | . | . | . | . | . | . | . | . | . | . | . |
| 21-225_155A5_HC | . | . | . | . | . | . | . | . | . | . | . | . | . | . | . | . | . | . | . | . | . | . | . | . | . | . |
| 21-225_170A1_HC | . | . | . | . | . | . | . | . | . | . | . | . | . | . | . | . | . | . | . | . | . | . | . | . | . | . |
| 21-225_176H4_HC | . | . | . | . | . | . | . | . | . | . | . | . | . | . | . | . | . | . | . | . | . | . | . | . | . | . |
| 21-225_181C10_HC | . | . | . | . | . | . | . | . | . | . | . | . | . | . | . | . | . | . | . | . | . | . | . | . | . | . |
| 21-225_181C2_HC | . | . | . | . | . | . | T | . | . | . | . | . | . | . | . | . | . | . | . | . | . | . | . | . | . | . |
| 21-225_186F7_HC | . | . | . | . | . | . | N | . | . | . | . | . | . | . | . | . | . | . | . | . | . | . | . | . | . | . |
| 21-225_189G2_HC | . | . | . | . | . | . | N | . | . | . | . | . | . | . | . | . | . | . | . | . | . | . | . | . | . | . |
| 21-225_226A6_HC | . | . | . | . | . | . | . | . | . | . | . | . | . | . | . | . | . | . | . | . | . | . | . | . | . | . |
| 21-225_22A1_HC | . | . | . | . | . | . | T | . | . | . | . | . | . | . | . | . | . | . | . | . | . | . | . | . | . | . |
| 21-225_28G3_HC | . | . | . | . | . | . | . | . | . | . | . | . | . | . | . | . | . | . | . | . | . | . | . | . | . | . |
| 21-225_46F2_HC | . | . | . | . | . | . | . | . | . | . | . | . | . | . | . | . | . | . | . | . | . | . | . | . | . | . |
| 21-225_57H3_HC | . | . | . | . | . | . | T | . | . | . | . | . | . | . | . | . | . | . | . | . | . | . | . | . | . | . |
| 21-225_62E6_HC | . | . | . | . | . | . | N | . | . | . | . | . | . | . | . | . | . | . | . | . | . | . | . | . | . | . |
| 21-225_64H9_HC | . | . | . | ~ | . | . | . | . | . | . | . | . | . | . | . | . | . | . | . | . | . | . | . | . | . | . |
| 21-225_65A6_HC | . | . | . | . | . | . | T | . | . | . | . | . | . | . | . | . | . | . | . | . | . | . | . | . | . | . |
| 21-225_67C3_HC | . | . | . | . | . | . | N | . | . | . | . | . | . | . | . | . | . | . | . | . | . | . | . | . | . | . |
| 21-225_70A5_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | S | G | H | F | D | Y | W | G | Q | G | T | L | V | T | V | S | S |
| 21-225_147E10_HC | . | . | . | . | . | . | . | . | . | . | . | . | . | . | . | . | . | . | . |
| 21-225_148B2_HC | . | . | . | . | . | . | . | . | . | . | . | . | . | . | . | . | . | . | . |
| 21-225_148G10_HC | . | . | . | . | . | . | . | . | . | . | . | . | . | . | . | . | . | . | . |
| 21-225_149F1_HC | . | . | . | . | . | . | . | . | . | . | . | . | . | . | . | . | . | . | . |
| 21-225_150B11_HC | . | . | . | . | . | . | . | . | . | . | . | . | . | . | . | . | . | . | . |
| 21-225_151A10_HC | . | . | . | . | . | . | . | . | . | . | . | . | . | . | . | . | . | . | . |
| 21-225_151G5_HC | . | . | . | . | . | . | . | . | . | . | . | . | . | . | . | . | . | . | . |
| 21-225_155A5_HC | . | . | . | . | Y | . | . | . | . | . | . | . | . | . | . | . | . | . | . |
| 21-225_170A1_HC | . | . | . | . | Y | . | A | S | . | . | . | . | A | . | . | . | . | . | . |
| 21-225_176H4_HC | . | . | . | . | . | . | . | . | . | . | . | . | . | . | . | . | . | . | . |
| 21-225_181C10_HC | . | . | . | . | . | . | . | . | . | . | . | . | . | . | . | . | . | . | . |
| 21-225_181C2_HC | . | . | . | . | Y | S | . | . | . | . | . | . | . | . | . | . | . | . | . |
| 21-225_186F7_HC | . | . | . | E | F | L | C | F | . | . | . | . | . | . | . | . | . | . | . |
| 21-225_189G2_HC | . | . | . | . | W | . | . | . | . | . | . | . | . | . | . | . | . | . | . |
| 21-225_226A5_HC | . | . | . | . | Y | . | . | . | . | . | . | . | . | . | . | . | . | . | . |
| 21-225_22A1_HC | . | . | A | T | Y | . | . | . | . | . | . | . | . | . | . | . | . | . | . |
| 21-225_28G3_HC | . | . | A | T | Y | . | . | . | . | . | . | . | . | . | . | . | . | . | . |
| 21-225_46F2_HC | . | . | . | . | . | . | . | . | . | . | . | . | . | . | . | . | . | . | . |
| 21-225_57H3_HC | . | . | A | T | W | L | G | L | . | . | . | . | . | . | . | . | . | . | . |
| 21-225_62E6_HC | . | . | . | . | Y | . | . | . | . | . | . | . | . | . | . | . | . | . | . |
| 21-225_64H9_HC | . | . | A | T | W | . | . | . | . | . | . | . | . | . | . | . | . | . | . |
| 21-225_65A6_HC | . | . | A | T | W | . | . | . | . | . | . | . | . | . | . | . | . | . | . |
| 21-225_67C3_HC | . | . | A | T | W | . | . | . | . | . | . | . | . | . | . | . | . | . | . |
| 21-225_70A5_HC | . | . | A | T | W | . | . | . | . | . | . | . | . | . | . | . | . | . | . |

FIGURE 57 (Continued)

Table 66. Consensus 32 - VH4|4-34/D4|4-17|RF2/JH4 (SEQ ID NO: 50283):

QVQLQQW-GAGLLKPSETLSLTCAVYG-GSFSG-------YYWSWIRQPPGKGLEWIGEINH-------
SGRTNYNPSLKSRVTISVDTSKNQFSLKLSSVTAADTAVYYCARDYGG--------------LDYWGQGTLVTVSS wherein:

G at position 33 can be substituted with V, P, A, D or Y

Y at position 39 can be substituted with C, S or P

Y at position 40 can be substituted with F

I at position 58 can be substituted with S or V

H at position 60 can be substituted with I or Q

R at position 67 can be substituted with S

T at position 68 can be substituted with A or S

N at position 69 can be substituted with T

Y at position 70 can be substituted with F

Xaa Xaa Xaa Trp Ser (SEQ ID NO: 50233)

Glu Xaa Asn Xaa Ser Gly Xaa Xaa Xaa Xaa Asn Pro Ser Leu Lys Ser (SEQ ID NO: 50234)

Asp Tyr Gly Gly Leu Asp Tyr (SEQ ID NO: 50235)

Gly Tyr Tyr Trp Ser (SEQ ID NO: 50519)

Glu Ile Asn His Ser Gly Arg Thr Asn Tyr Asn Pro Ser Leu Lys Ser (SEQ ID NO: 50520)

Asp Tyr Gly Gly Leu Asp Tyr (SEQ ID NO: 50521)

Table 67. Consensus 33-VH4|4-39/D|1-26|RF3/JH4 (SEQ ID NO: 50284):

QLQLQES-GPGLVKPSETLSLTCTVSG-GSISRS---SYYWGWIRQPPGKGLEWIGNIYY----SGSTYYNPSLKSRVTISVDTSKNQFSLKLSSVTAADTAVYYCARHSSSW--------SLDYWGQGTLVTVSS wherein:

R in position 33 can be substituted with G

S in position 38 can be substituted with N

Y in position 39 can be substituted with S

N in position 57 can be substituted with S

S in position 67 can be substituted with Y, A, T or I

T in position 68 can be substituted with A, P or S

Y in position 69 can be substituted with Q, S, A or N

Y in position 70 can be substituted with C or H

N in position 71 can be substituted with I or T

H in position 109 can be substituted with L

S in position 111 can be substituted with T or G

L in position 136 can be substituted with F, I or V

Y in position 138 can be substituted with N, C, D or F

Xaa Ser Xaa Xaa Tyr Trp Gly (SEQ ID NO: 50046)

Xaa Ile Tyr Tyr Ser Gly Xaa Xaa Xaa Xaa Xaa Pro Ser Leu Lys Ser (SEQ ID NO: 50047)

Xaa Ser Xaa Ser Trp Ser Xaa Asp Xaa (SEQ ID NO: 50048)

Arg Ser Ser Tyr Tyr Trp Gly (SEQ ID NO: 50522)

Asn Ile Tyr Tyr Ser Gly Ser Thr Tyr Tyr Asn Pro Ser Leu Lys Ser (SEQ ID NO: 50523)

His Ser Ser Trp Ser Leu Asp Tyr (SEQ ID NO: 50524)

| Reference # | 105 Y | 106 C | 107 A | 108 R | 109 H | 110 S | 111 S | 112 S | 113 W | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | R | H | S | S | S | W | | | | | | | | | | H_CDR3 | | | | | | | |
| 21-225_11F10_HC | . | . | . | . | L | . | . | . | . | . | . | . | . | . | . | . | . | . | . | . | . | . | . | . | . | . |
| 21-225_15A1_HC | . | . | . | . | L | . | T | . | . | . | . | . | . | . | . | . | . | . | . | . | . | . | . | . | . | . |
| 21-225_15G7_HC | . | . | . | . | L | . | T | . | . | . | . | . | . | . | . | . | . | . | . | . | . | . | . | . | . | . |
| 21-225_15H1_HC | . | . | . | . | . | . | . | . | . | . | . | . | . | . | . | . | . | . | . | . | . | . | . | . | . | . |
| 21-225_16A1_HC | . | . | . | . | L | . | T | . | . | . | . | . | . | . | . | . | . | . | . | . | . | . | . | . | . | . |
| 21-225_18A3_HC | . | . | . | . | . | . | . | . | . | . | . | . | . | . | . | . | . | . | . | . | . | . | . | . | . | . |
| 21-225_18C6_HC | . | . | . | . | . | . | TQ | . | . | . | . | . | . | . | . | . | . | . | . | . | . | . | . | . | . | . |
| 21-225_20C2_HC | . | . | . | . | L | . | . | . | . | . | . | . | . | . | . | . | . | . | . | . | . | . | . | . | . | . |
| 21-225_20G9_HC | . | . | . | . | L | . | . | . | . | . | . | . | . | . | . | . | . | . | . | . | . | . | . | . | . | . |
| 21-225_21G7_HC | . | . | . | . | L | . | . | . | . | . | . | . | . | . | . | . | . | . | . | . | . | . | . | . | . | . |
| 21-225_22C1_HC | . | . | . | . | . | . | . | . | . | . | . | . | . | . | . | . | . | . | . | . | . | . | . | . | . | . |
| 21-225_22D12_HC | . | . | . | . | . | . | . | . | . | . | . | . | . | . | . | . | . | . | . | . | . | . | . | . | . | . |
| 21-225_22G9_HC | . | . | . | . | . | . | . | . | . | . | . | . | . | . | . | . | . | . | . | . | . | . | . | . | . | . |
| 21-225_23D1_HC | . | . | . | . | . | . | . | . | . | . | . | . | . | . | . | . | . | . | . | . | . | . | . | . | . | . |
| 21-225_24E5_HC | . | . | . | . | . | . | . | . | . | . | . | . | . | . | . | . | . | . | . | . | . | . | . | . | . | . |
| 21-225_34C4_HC | . | . | . | . | . | . | . | . | . | . | . | . | . | . | . | . | . | . | . | . | . | . | . | . | . | . |
| 21-225_59E6_HC | . | . | . | . | . | . | . | . | . | . | . | . | . | . | . | . | . | . | . | . | . | . | . | . | . | . |
| 21-225_68D12_HC | . | . | . | . | . | . | T | . | . | . | . | . | . | . | . | . | . | . | . | . | . | . | . | . | . | . |
| 21-225_6A6_HC | . | . | . | . | . | . | . | . | . | . | . | . | . | . | . | . | . | . | . | . | . | . | . | . | . | . |
| 21-225_6D4_HC | . | . | . | . | . | . | Q | . | . | . | . | . | . | . | . | . | . | . | . | . | . | . | . | . | . | . |
| 21-225_7F4_HC | . | . | . | . | . | . | . | . | . | . | . | . | . | . | . | . | . | . | . | . | . | . | . | . | . | . |
| 21-225_8D12_HC | . | . | . | . | . | . | T | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | S | L | D | Y | W | G | Q | G | T | L | V | T | V | S | S |
| | | | | | | | | | | | | | H FR4 | | | | | | |
| CONSENSUS | . | . | . | . | . | . | . | . | . | . | . | . | . | . | . | . | . | . | . |
| 21-225_11F10_HC | . | . | . | . | . | F | . | . | . | . | . | . | . | . | . | . | . | . | . |
| 21-225_15A1_LHC | . | . | . | . | . | F | . | F | . | . | . | . | . | . | . | . | . | . | . |
| 21-225_15G7_HC | . | . | . | . | . | F | . | . | . | . | . | . | . | . | . | . | . | . | . |
| 21-225_15H1_HC | . | . | . | . | . | . | . | . | . | . | . | . | . | . | . | . | . | . | . |
| 21-225_16A1_HC | . | . | . | . | . | F | . | . | . | . | . | . | . | . | . | . | . | . | . |
| 21-225_18A3_HC | . | . | . | . | . | . | . | . | . | . | . | . | . | . | . | . | . | . | . |
| 21-225_18C6_HC | . | . | . | . | . | . | . | Q | . | . | . | . | . | . | . | . | . | . | . |
| 21-225_20C2_HC | . | . | . | . | . | . | . | N | . | . | . | . | . | . | . | . | . | . | . |
| 21-225_20G9_HC | . | . | . | . | . | R | . | . | . | . | . | . | . | . | . | . | . | . | . |
| 21-225_21G7_HC | . | . | . | . | . | V | . | . | . | . | . | . | . | . | . | . | . | . | . |
| 21-225_22C1_HC | . | . | . | . | . | F | . | . | . | . | . | . | . | . | . | . | . | . | . |
| 21-225_22D12_HC | . | . | . | . | . | I | . | . | . | . | . | . | . | . | . | . | . | . | . |
| 21-225_22G9_HC | . | . | . | . | . | F | . | N | . | . | . | . | . | . | . | . | . | . | . |
| 21-225_23D1_HC | . | . | . | . | . | . | . | . | . | . | . | . | . | . | . | . | . | . | . |
| 21-225_24E5_HC | . | . | . | . | . | . | . | . | . | . | . | . | . | . | . | . | . | . | . |
| 21-225_34C4_HC | . | . | . | . | . | . | . | . | . | . | . | . | . | . | . | . | . | . | . |
| 21-225_59E6_HC | . | . | . | . | . | . | . | C | . | . | . | . | . | . | . | . | . | . | . |
| 21-225_68D12_HC | . | . | . | . | . | . | . | . | . | . | . | . | . | . | . | . | . | . | . |
| 21-225_6A6_HC | . | . | . | . | . | . | . | . | . | . | . | . | . | . | . | . | . | . | . |
| 21-225_6D4_HC | . | . | . | . | . | . | . | . | . | . | . | . | . | . | . | . | . | . | . |
| 21-225_7F4_HC | . | . | . | . | . | . | . | . | . | . | . | . | . | . | . | . | . | . | . |
| 21-225_8D12_HC | . | . | . | . | . | . | . | . | . | . | . | . | . | . | . | . | . | . | . |

FIGURE 57 (Continued)

Table 68. Consensus 34-VH1|1-02/D5|5-18|RF3/JH5 (SEQ ID NO: 50285):

QVQLVQS-GAEVKKPGASVKVSCKASG-YTFTG-----YYIHWVRQAPGQGLEWMGWINPN-----SGGTNYAQKFQGRVTMTRDTSISTAYMELSRLRSDDTAVYYCARGYSYGY-----------NWFDPWGQGTLVTVSS wherein:

G in position 33 can be substituted with D

Y in position 39 can be substituted with H

Y in position 40 can be substituted with F

I in position 41 can be substituted with M

H in position 42 can be substituted with N

P in position 60 can be substituted with S

N in position 61 can be substituted with K

S in position 65 can be substituted with N

G in position 66 can be substituted with D

G in position 67 can be substituted with D

A in position 71 can be substituted with E

Q in position 72 can be substituted with E

G in position 76 can be substituted with D

G in position 109 can be substituted with D

Y in position 110 can be substituted with G, T or F

S in position 111 can be substituted with Y, D or R

Y in position 112 can be substituted with S

FIGURE 57 (Continued)

G in position 113 can be substituted with null (-) or S

Y in position 114 can be substituted with S or null (-)

null (-) in position 115 can be substituted with G null (-) in position 116 can be substituted with S null (-) in position 132 can be substituted with Y null (-) in position 133 can be substituted with Y, F or H N in position 134 can be substituted with null (-) or D W in position 135 can be substituted with null (-), D or E F in position 136 can be substituted with L D in position 137 can be substituted with A P in position 138 can be substituted with S Xaa Xaa Xaa Xaa (SEQ ID NO: 50049)

Trp Ile Asn Xaa Xaa Xaa Xaa Xaa Thr Asn Tyr Xaa Xaa Lys Phe Gln Xaa (SEQ ID NO: 50050)

Xaa Xaa Xaa Xaa Xaa Xaa Xaa Xaa Xaa Xaa Xaa Xaa Xaa Xaa Xaa (SEQ ID NO: 50051)

Gly Tyr Tyr Ile His (SEQ ID NO: 50525)

Trp Ile Asn Pro Asn Ser Gly Gly Thr Asn Tyr Ala Gln Lys Phe Gln Gly (SEQ ID NO: 50526)

Gly Tyr Ser Tyr Gly Tyr Asn Trp Phe Asp Pro (SEQ ID NO: 50527)

| Reference # | 51 | 52 | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 |
|---|---|---|---|---|---|---|---|---|---|---|---|---|---|---|---|---|---|---|---|---|---|---|---|---|---|
| | | | | | | | | | | | | | | | | H_CDR2 | | | | | | | | | |
| CONSENSUS | G | L | E | W | M | G | W | I | N | P | N | - | - | - | S | G | G | T | N | Y | A | Q | K | F | Q |
| 21-225_17G4_HC | . | . | . | . | . | . | . | . | . | . | . | . | . | . | . | . | . | . | . | . | E | . | . | . | . |
| 21-225_19A1_HC | . | . | . | . | . | . | . | . | . | . | . | . | . | . | . | . | . | . | . | . | . | . | . | . | . |
| 21-225_201H10_HC | . | . | . | . | . | A | . | . | . | . | . | . | . | . | . | . | . | . | . | . | . | . | . | . | . |
| 21-225_203E3_HC | . | . | . | . | . | A | . | . | . | . | . | . | . | . | . | . | . | . | . | . | . | . | . | . | . |
| 21-225_204H4_HC | . | . | . | . | . | A | . | . | . | . | . | . | . | . | . | . | . | . | . | . | . | . | . | . | . |
| 21-225_206A4_HC | . | . | . | . | . | A | . | . | . | . | . | . | . | . | . | . | . | . | . | . | . | . | . | . | . |
| 21-225_206A5_HC | . | . | . | . | . | A | . | . | . | . | . | . | . | . | . | . | . | . | . | . | . | . | . | . | . |
| 21-225_208B11_HC | . | . | . | . | . | A | . | . | . | . | . | . | . | . | . | . | . | . | . | . | . | . | . | . | . |
| 21-225_208E8_HC | . | . | . | . | . | . | . | . | . | . | . | . | . | . | . | . | . | . | . | . | . | . | . | . | . |
| 21-225_210B12_HC | . | . | . | . | . | V | . | . | . | . | . | . | . | . | . | . | . | . | . | . | . | . | . | . | . |
| 21-225_210D11_HC | . | . | . | . | . | A | . | . | . | S | X | . | . | . | N | . | . | . | . | . | . | . | . | . | . |
| 21-225_213A7_HC | . | . | . | . | . | . | . | . | . | S | . | . | . | . | . | . | . | . | . | . | . | . | . | . | . |
| 21-225_214H8_HC | . | . | . | . | . | . | . | . | . | . | . | . | . | . | . | . | . | . | . | . | . | . | . | . | . |
| 21-225_215H6_HC | . | . | . | . | . | . | . | . | . | . | . | . | . | . | . | . | . | . | . | . | . | . | . | . | . |
| 21-225_226A10_HC | . | . | . | . | . | . | . | . | . | . | . | . | . | . | . | . | D | . | . | . | . | . | . | . | . |
| 21-225_226B2_HC | . | . | . | . | . | . | . | . | . | . | . | . | . | . | . | . | D | . | . | . | . | E | . | . | . |
| 21-225_226B7_HC | . | . | . | . | . | . | . | . | . | . | . | . | . | . | . | D | . | . | . | . | . | . | . | . | . |
| 21-225_32B11_HC | . | . | . | . | . | . | . | . | . | . | . | . | . | . | . | . | . | . | . | . | . | . | . | . | . |
| 21-225_34D7_HC | . | . | . | . | . | . | . | . | . | . | . | . | . | . | . | . | . | . | . | . | . | . | . | . | . |

FIGURE 57 (Continued)

| Reference # | 76 | 77 | 78 | 79 | 80 | 81 | 82 | 83 | 84 | 85 | 86 | 87 | 88 | 89 | 90 | 91 | 92 | 93 | 94 | 95 | 96 | 97 | 98 | 99 | 100 |
|---|---|---|---|---|---|---|---|---|---|---|---|---|---|---|---|---|---|---|---|---|---|---|---|---|---|
| CONSENSUS | G | R | V | T | M | T | R | D | T | S | I | S | T | A | Y | M | E | L | S | R | L | R | S | D | D |
| 21-225_17G4_HC | . | . | . | . | . | . | . | . | . | . | . | . | . | . | . | . | . | . | . | . | . | . | . | . | . |
| 21-225_19A1_HC | . | . | . | . | . | . | . | . | . | . | . | . | . | T | . | . | . | . | . | . | . | . | . | . | . |
| 21-225_201H10_HC | . | . | . | . | . | . | . | . | . | . | . | T | . | . | . | . | . | . | . | . | . | . | . | . | . |
| 21-225_203E3_HC | . | . | . | . | . | . | . | . | . | . | . | T | . | . | . | . | . | . | . | . | . | . | . | . | . |
| 21-225_204H4_HC | . | . | . | . | . | . | . | . | . | . | . | T | . | . | . | . | . | . | . | . | . | . | . | . | . |
| 21-225_206A4_HC | . | . | . | . | . | . | . | . | . | . | . | T | . | . | . | . | . | . | . | . | . | . | . | . | . |
| 21-225_206A5_HC | . | . | . | . | . | . | . | . | . | . | . | . | . | . | . | . | . | . | . | . | . | . | . | . | . |
| 21-225_208B11_HC | . | . | . | . | . | . | . | . | . | . | . | T | . | . | . | . | . | . | . | . | . | . | . | . | . |
| 21-225_208E8_HC | . | . | . | . | . | . | . | . | . | . | L | . | K | . | . | . | . | . | . | . | . | . | . | . | . |
| 21-225_210B12_HC | . | . | . | . | . | . | . | . | . | . | . | . | . | . | . | . | . | . | . | . | . | . | . | . | . |
| 21-225_210D11_HC | . | . | . | . | . | . | . | . | . | . | . | . | . | . | . | . | . | . | . | . | . | . | . | . | . |
| 21-225_213A7_HC | . | . | . | . | . | . | . | . | . | . | L | N | . | . | . | . | . | . | . | . | . | . | . | . | . |
| 21-225_214H8_HC | . | . | . | . | . | . | . | . | . | . | L | . | . | . | . | . | . | . | . | . | . | . | . | . | . |
| 21-225_215H6_HC | . | . | . | . | . | . | . | . | . | . | L | . | . | . | . | . | . | . | . | . | . | . | . | . | . |
| 21-225_226A10_HC | . | . | . | . | . | . | . | . | . | . | . | . | . | . | . | . | . | . | . | . | . | . | . | . | . |
| 21-225_226B2_HC | . | . | . | . | . | . | . | . | . | . | . | . | . | . | X | . | . | . | N | . | . | . | . | . | . |
| 21-225_226B7_HC | D | . | . | . | . | . | . | . | . | . | . | . | . | . | . | . | . | . | . | . | . | . | . | . | . |
| 21-225_32B11_HC | . | . | . | . | . | . | . | . | . | . | . | . | . | . | . | . | . | . | . | . | . | . | . | . | . |
| 21-225_34D7_HC | . | . | . | . | . | . | . | . | . | . | . | . | . | . | . | . | . | . | . | . | . | . | . | . | . |

Table 69. Consensus 35- VH3|3-33/D1|1-1|RF3/JH6 (SEQ ID NO: 50286):

QVQLVES-GGGVVQPGRSLRLSCAASG-FTFSH------YGMHWVRQAPGKGLEWVAVIWYD---GSNKYYADSVKGRFTISRDNSKNTLYLQMNSLRAEDTAVYYCARGDWNP----------EGMDVWGQGTTVTVSS wherein:

H in position 33 can be substituted with N

Y in position 39 can be substituted with S

V in position 57 can be substituted with I

W in position 59 can be substituted with Y

N in position 67 can be substituted with Y

K in position 68 can be substituted with E

Y in position 70 can be substituted with C or N

G in position 109 can be substituted with D

D in position 110 can be substituted with R

W in position 111 can be substituted with H

N in position 112 can be substituted with Y

P in position 113 can be substituted with D null (-) in position 114 can be substituted with F null (-) in position 115 can be substituted with H null (-) in position 116 can be substituted with V null (-) in position 117 can be substituted with P FIGURE 57 (Continued)

null (-) in position 130 can be substituted with Y
null (-) in position 131 can be substituted with Y
null (-) in position 132 can be substituted with Y
null (-) in position 133 can be substituted with Y
E in position 134 can be substituted with Y
M in position 136 can be substituted with L
Xaa Xaa Gly Met His (SEQ ID NO: 50052)
Xaa Ile Xaa Tyr Asp Gly Ser Xaa Xaa Xaa Tyr Ala Asp Ser Val Lys Gly (SEQ ID NO: 50053)
Xaa Xaa Xaa Xaa Xaa Xaa Xaa Xaa Xaa Xaa Gly Xaa Xaa Asp Val (SEQ ID NO: 50054)
His Tyr Gly Met His (SEQ ID NO: 50528)
Val Ile Trp Tyr Asp Gly Ser Asn Lys Tyr Tyr Ala Asp Ser Val Lys Gly (SEQ ID NO: 50529)
Gly Asp Trp Asn Pro Glu Gly Met Asp Val (SEQ ID NO: 50530)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| CONSENSUS | Q | V | Q | L | V | E | S | - | G | G | G | V | V | Q | P | G | R | S | L | R | L | S | C | A | A |
| 21-225_179C7_HC | . | A | . | . | . | . | . | . | . | . | . | . | . | . | . | . | . | . | . | . | . | . | . | . | . |
| 21-225_210D12_HC | . | . | . | . | . | . | . | . | . | . | . | . | . | . | . | . | . | . | . | . | . | . | . | . | . |
| 21-225_210E12_HC | . | . | X | . | . | . | . | . | . | . | . | . | . | . | . | . | . | . | . | . | . | . | . | . | . |
| 21-225_211C1_HC | . | . | . | . | . | . | . | . | . | . | . | . | . | . | . | . | . | . | . | . | . | . | . | . | . |
| 21-225_211G5_HC | . | . | . | . | . | . | . | . | . | . | . | . | . | . | . | . | . | . | . | . | . | . | . | . | . |
| 21-225_212A4_HC | . | . | X | . | . | . | . | . | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | . | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | T | . | . | . | . | . | . | . | . | . | . | . | . | . | . | . | . | . | . | . | . | . | . | . |
| 21-225_216A3_HC | . | . | . | . | . | . | . | . | . | . | . | . | . | . | A | . | . | . | . | . | . | . | . | . | . |
| 21-225_216G1_HC | . | . | X | . | . | . | . | . | . | . | . | . | . | . | . | . | . | . | . | . | . | . | . | . | . |
| 21-225_217B2_HC | . | . | X | . | . | . | . | . | . | . | . | . | . | . | . | . | . | . | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | X | . |
| 21-225_221H2_HC | . | . | . | . | . | . | . | . | . | . | . | . | . | . | . | . | . | . | . | . | . | . | . | . | . |

| Reference # | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| | | | | | | H_CDR1 | | | | | | | | | | | | | H_FR2 | | | | | | |
| CONSENSUS | S | G | F | T | F | S | H | . | . | . | . | . | . | Y | G | M | H | W | V | R | Q | A | P | G | K |
| 21-225_179C7_HC | . | . | . | . | . | . | . | N | . | . | . | . | . | S | . | . | . | . | . | . | . | G | . | . | . |
| 21-225_210D12_HC | . | . | . | . | . | . | . | . | . | . | . | . | . | . | . | . | . | . | . | . | . | . | . | . | . |
| 21-225_210E12_HC | . | . | . | . | . | . | . | N | . | . | . | . | . | . | . | . | . | . | . | . | . | . | . | . | . |
| 21-225_211C1_HC | . | . | . | . | . | . | . | . | . | . | . | . | . | . | . | . | . | . | . | . | . | . | . | . | . |
| 21-225_211G5_HC | . | . | . | . | . | . | . | N | . | . | . | . | . | . | . | . | . | . | . | . | . | . | . | . | . |
| 21-225_212A4_HC | . | . | . | . | . | . | . | . | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | . | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | . | . | . | . | . | . | . | . | . | . | . | . | . | . | . | . | . | . | . | . | . | . | . | . |
| 21-225_216A3_HC | . | . | . | . | . | . | . | . | . | . | . | . | . | . | . | . | . | . | . | . | . | . | . | . | . |
| 21-225_216G1_HC | . | . | . | . | . | . | . | N | . | . | . | . | . | . | . | . | . | . | . | . | . | . | . | . | . |
| 21-225_217B2_HC | . | . | . | . | . | . | . | N | . | . | . | . | . | . | . | . | . | . | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | . | . |
| 21-225_221H2_HC | . | . | . | . | . | . | . | . | . | . | . | . | . | . | . | . | . | . | . | . | . | . | . | . | . |

FIGURE 57 (Continued)

| Reference # | 51 | 52 | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 |
|---|---|---|---|---|---|---|---|---|---|---|---|---|---|---|---|---|---|---|---|---|---|---|---|---|---|
| | | | | | | | | | | | | | | | | H_CDR2 | | | | | | | | | |
| CONSENSUS | G | L | E | W | V | A | V | I | W | Y | D | - | - | - | G | S | N | K | Y | Y | A | D | S | V | K |
| 21-225_179C7_HC | . | . | . | . | . | . | . | . | . | . | . | . | . | . | . | . | Y | . | . | . | . | . | . | . | . |
| 21-225_210D12_HC | . | . | . | . | . | . | . | . | . | . | . | . | . | . | . | . | . | . | . | . | . | . | . | . | . |
| 21-225_210E12_HC | . | . | . | . | . | . | . | . | . | . | . | . | . | . | . | . | . | . | . | . | . | . | . | . | . |
| 21-225_211C1_HC | . | . | . | . | . | . | . | . | . | . | . | . | . | . | . | . | . | . | . | . | . | . | . | . | . |
| 21-225_211G5_HC | . | . | . | . | . | . | . | . | . | . | . | . | . | . | . | . | . | . | . | . | . | . | . | . | . |
| 21-225_212A4_HC | . | . | . | . | . | . | . | . | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | Y | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | . | . | . | . | . | . | . | . | . | . | . | . | . | . | . | . | . | . | C | . | . | . | . | . |
| 21-225_216A3_HC | . | . | . | . | . | . | . | . | . | . | . | . | . | . | . | . | . | . | . | . | . | . | . | . | . |
| 21-225_216G1_HC | . | . | . | . | . | . | . | . | . | . | . | . | . | . | . | . | . | . | . | . | . | . | . | . | . |
| 21-225_217B2_HC | . | . | . | . | . | . | . | . | . | . | . | . | . | . | . | . | . | E | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | . | . |
| 21-225_221H2_HC | . | . | . | . | . | . | . | . | . | . | . | . | . | . | . | . | . | . | . | . | . | . | . | . | . |

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | | | | | | | | | | H_CDR3 | | | | | | | |
| CONSENSUS | T | A | V | Y | Y | C | A | R | G | D | W | N | P | F | S | V | A | . | . | . | . | . | . | . | . |
| 21-225_179C7_HC | . | . | . | . | . | . | . | . | . | . | . | . | . | . | . | . | . | . | . | . | . | . | . | . | . |
| 21-225_210D12_HC | . | . | . | . | . | . | . | . | . | . | . | . | . | . | . | . | . | . | . | . | . | . | . | . | . |
| 21-225_210E12_HC | . | . | . | . | . | . | . | . | . | . | . | . | . | . | . | . | . | . | . | . | . | . | . | . | . |
| 21-225_211C1_HC | . | . | - | . | . | . | . | . | . | . | . | . | . | . | . | . | . | . | . | . | . | . | . | . | . |
| 21-225_211G5_HC | . | . | . | . | . | . | . | . | . | . | . | . | . | . | . | . | . | . | . | . | . | . | . | . | . |
| 21-225_212A4_HC | . | . | . | . | . | . | . | . | . | . | . | . | . | . | . | . | . | . | . | . | . | . | . | . | . |
| 21-225_212C2_HC | . | . | . | . | . | . | . | . | . | . | . | . | . | . | . | . | . | . | . | . | . | . | . | . | . |
| 21-225_212F6_HC | . | . | . | . | . | . | . | . | . | . | . | . | . | . | . | . | . | . | . | . | . | . | . | . | . |
| 21-225_212G7_HC | . | . | . | . | . | . | . | . | . | . | . | . | . | . | . | . | . | . | . | . | . | . | . | . | . |
| 21-225_213D5_HC | . | . | . | . | . | . | . | . | . | . | . | . | . | . | . | . | . | . | . | . | . | . | . | . | . |
| 21-225_213G3_HC | . | . | . | . | . | . | . | . | . | . | . | . | . | . | . | . | . | . | . | . | . | . | . | . | . |
| 21-225_215D3_HC | . | . | . | . | . | . | . | . | . | . | . | . | . | . | . | . | . | . | . | . | . | . | . | . | . |
| 21-225_216A3_HC | . | . | . | . | . | . | . | . | . | . | . | . | . | . | . | . | . | . | . | . | . | . | . | . | . |
| 21-225_216G1_HC | . | . | . | . | . | . | . | . | . | . | . | . | . | . | . | . | . | . | . | . | . | . | . | . | . |
| 21-225_217B2_HC | . | . | . | . | . | . | . | . | . | . | . | . | . | . | . | . | . | . | . | . | . | . | . | . | . |
| 21-225_219A7_HC | . | . | . | . | . | . | . | . | . | . | . | . | . | . | . | . | . | . | . | . | . | . | . | . | . |
| 21-225_221G4_HC | . | . | . | . | . | . | . | . | . | . | . | . | . | . | . | . | . | . | . | . | . | . | . | . | . |
| 21-225_221H2_HC | . | . | . | . | . | . | . | . | . | . | . | . | . | . | . | . | . | . | . | . | . | . | . | . | . |

FIGURE 57
(Continued)

Table 70. Consensus 36- VH3|3-23/D4|4-17|RF2/JH4 (SEQ ID NO: 50287):

EVQLLES-GGGLVQPGGSLRLSCAASG-FTFSS----YAMSWVRQAPGKGLEWVSAISGS---
GGNTFYADSVKGRFTISRDNSKNTLYLQMNSLRAEDTAVYYCAKKDYDYW----------GSPYFDYWGQGTLVTVSS wherein:

Y in position 39 can be substituted with S

S in position 42 can be substituted with T or N

A in position 57 can be substituted with V

S in position 59 can be substituted with I

R in position 61 can be substituted with S, N or F

G in position 66 can be substituted with S

N in position 67 can be substituted with R or S

T in position 68 can be substituted with A

F in position 69 can be substituted with Y

K in position 109 can be substituted with D or R

D in position 110 can be substituted with Y, H, M or R

Y in position 111 can be substituted with G or N

D in position 112 can be substituted with I, R or Y

Y in position 113 can be substituted with null (-), S or V

V in position 114 can be substituted with null (-), G, R or S

W in position 115 can be substituted with null (-) or I null (-) in position 116 can be substituted with A FIGURE 57 (Continued)

G in position 132 can be substituted with null (-) or V

S in position 133 can be substituited with null (-), A, T or Y

P in position 134 can be substituted with null (-), G or I

Y in position 135 can be substituted with F or T

Ser Xaa Ala Met Xaa (SEQ ID NO: 50055)

Xaa Ile Xaa Gly Xaa Gly Xaa Xaa Xaa Xaa Tyr Ala Asp Ser Val Lys Gly (SEQ ID NO: 50056)

Xaa Xaa Xaa Xaa Xaa Xaa Xaa Xaa Xaa Xaa Xaa Xaa Phe Asp Tyr (SEQ ID NO: 50057)

Ser Tyr Ala Met Ser (SEQ ID NO: 50531)

Ala Ile Ser Gly Ser Gly Gly Asn Thr Phe Tyr Ala Asp Ser Val Lys Gly (SEQ ID NO: 50532)

Lys Asp Tyr Asp Tyr Val Trp Gly Ser Pro Tyr Phe Asp Tyr (SEQ ID NO: 50533)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| | | | | | | | | | | | | | | | | H_FR1 | | | | | | | | | |
| CONSENSUS | E | V | Q | L | L | E | S | - | G | G | G | L | V | Q | P | G | G | S | L | R | L | S | C | A | A |
| 21-225_146A6_HC | . | . | . | . | . | . | . | . | . | . | . | . | . | . | . | . | . | . | . | . | . | . | . | . | . |
| 21-225_147D10_HC | . | . | . | . | . | . | . | . | . | . | . | . | . | . | . | . | . | . | . | . | . | . | . | . | . |
| 21-225_147D12_HC | . | . | . | . | . | . | . | . | . | . | . | . | . | . | S | . | . | . | . | . | . | . | . | . | . |
| 21-225_148E2_HC | . | . | . | . | . | . | . | . | . | . | . | . | . | . | . | . | . | . | . | . | . | . | . | . | . |
| 21-225_149C6_HC | . | . | . | . | . | . | . | . | . | . | . | . | . | . | . | . | . | . | . | . | . | . | . | . | . |
| 21-225_149D11_HC | . | . | . | . | . | . | . | . | . | . | . | . | . | . | . | . | . | . | . | . | . | . | . | . | . |
| 21-225_149F8_HC | . | . | . | . | . | . | . | . | . | . | . | . | . | . | . | . | . | . | . | . | . | . | . | . | . |
| 21-225_150C5_HC | . | . | . | . | . | . | . | . | . | . | . | . | . | . | . | . | . | . | . | . | . | . | . | . | . |
| 21-225_152G10_HC | . | . | . | . | . | . | . | . | . | . | . | . | . | . | . | . | . | . | . | . | . | . | . | . | . |
| 21-225_152H7_HC | . | . | . | . | . | . | . | . | . | . | . | . | . | . | . | . | . | . | . | . | . | . | . | . | . |
| 21-225_155A4_HC | . | . | . | . | . | . | . | . | . | . | . | . | . | . | . | . | . | . | . | . | . | . | . | . | . |
| 21-225_155B4_HC | . | . | . | . | . | . | . | . | . | . | . | . | . | . | . | . | . | . | . | . | . | . | . | . | . |
| 21-225_178F7_HC | . | . | X | . | . | . | . | . | . | . | . | . | . | . | T | . | . | . | . | . | . | . | . | . | . |
| 21-225_179G1_HC | . | . | X | . | . | . | . | . | . | . | . | . | . | . | T | . | . | . | . | . | . | . | . | . | . |
| 21-225_190D12_HC | . | . | . | . | . | . | . | . | . | . | . | . | . | . | . | . | . | . | . | . | . | . | . | . | . |
| 21-225_197C8_HC | . | . | . | . | . | . | . | . | . | . | . | . | . | . | . | . | . | . | . | . | . | . | . | . | . |
| 21-225_55E1_HC | . | . | . | . | . | . | . | . | . | . | . | . | . | . | . | . | . | . | . | . | . | . | . | . | . |

FIGURE 57 (Continued)

| Reference # | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| | | | | | | | | | | H_CDR1 | | | | | | | | | | H_FR2 | | | | | |
| CONSENSUS | S | G | . | F | T | F | S | S | . | . | . | . | . | Y | A | M | S | W | V | R | Q | A | P | G | K |
| 21-225_146A6_HC | . | . | . | . | . | . | N | . | . | . | . | . | . | . | . | . | N | . | . | . | . | . | . | . | . |
| 21-225_147D10_HC | . | . | . | . | . | . | . | . | . | . | . | . | . | . | . | . | . | . | . | . | . | . | . | . | . |
| 21-225_147D12_HC | . | . | . | . | . | . | . | . | . | . | . | . | . | . | . | . | . | . | . | . | . | . | . | . | . |
| 21-225_148E2_HC | . | . | . | . | . | . | . | . | . | . | . | . | . | . | . | . | . | . | . | . | . | . | . | . | . |
| 21-225_149C6_HC | . | . | . | . | . | . | . | . | . | . | . | . | . | . | . | . | . | . | . | . | . | . | . | . | . |
| 21-225_149D11_HC | . | . | . | . | . | . | . | . | . | . | . | . | . | . | . | . | . | . | . | . | . | . | . | . | . |
| 21-225_149F8_HC | . | . | . | . | . | . | . | . | . | . | . | . | . | . | . | . | . | . | . | . | . | . | . | . | . |
| 21-225_150C5_HC | . | . | . | . | . | . | N | . | . | . | . | . | . | . | . | . | . | . | . | . | . | . | . | . | . |
| 21-225_152G10_HC | . | . | . | . | . | . | N | . | . | . | . | . | . | . | . | . | N | . | . | . | . | . | . | . | . |
| 21-225_152H7_HC | . | . | . | . | . | . | . | . | . | . | . | . | . | . | . | . | T | . | . | . | . | . | . | . | . |
| 21-225_155A4_HC | . | . | . | . | . | . | . | . | . | . | . | . | . | . | . | . | T | . | . | . | . | . | . | . | . |
| 21-225_155B4_HC | . | . | . | . | . | . | . | . | . | . | . | . | . | . | . | . | . | . | . | . | . | . | . | . | . |
| 21-225_179F7_HC | . | . | . | . | . | . | . | . | . | . | . | . | . | . | . | . | . | . | . | . | . | . | . | . | . |
| 21-225_179G1_HC | . | . | . | . | . | . | . | . | . | . | . | . | . | S | . | . | T | . | . | . | . | . | . | . | . |
| 21-225_190D12_HC | . | . | . | . | . | . | . | . | . | . | . | . | . | . | . | . | . | . | . | . | . | . | . | . | . |
| 21-225_197C8_HC | . | . | . | . | . | . | . | . | . | . | . | . | . | . | . | . | . | . | . | . | . | . | . | . | . |
| 21-225_55E1_HC | . | . | . | . | . | . | . | . | . | . | . | . | . | . | . | . | . | . | . | . | . | . | . | . | . |

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | H_CDR3 | | | | | | | | | | | | | | | | |
| CONSENSUS | T | A | V | Y | Y | C | A | K | K | D | Y | D | Y | V | W | | | | | | | | | | |
| 21-225_146A6_HC | | | | | | | | | | | | | | | | | | | | | | | | | |
| 21-225_147D10_HC | | | | | | | | | | | | | | | | | | | | | | | | | |
| 21-225_147D12_HC | | | | | | | | | | | | | | | | | | | | | | | | | |
| 21-225_148E2_HC | | | | | | | | | | | N | | | | | | | | | | | | | | |
| 21-225_149C6_HC | | | | | | | | | | | | | | | | | | | | | | | | | |
| 21-225_149D11_HC | | | | | | | | | | | | | | | | | | | | | | | | | |
| 21-225_149F8_HC | | | | | | | | | | | | | | | | | | | | | | | | | |
| 21-225_150C5_HC | | | | | | | | | | | | | | | | | | | | | | | | | |
| 21-225_152G10_HC | | | | | | | | | | | | | | | | | | | | | | | | | |
| 21-225_152H7_HC | | | | | | | | | | | N | | | | | | | | | | | | | | |
| 21-225_155A4_HC | | | | | | | | | | | | | | | | | | | | | | | | | |
| 21-225_155B4_HC | | | | | | | | | | | | | | | | | | | | | | | | | |
| 21-225_178F7_HC | | | | | | | | K | E | Y | G | | | | | | | | | | | | | | |
| 21-225_179G1_HC | | | | | | | | | E | Y | G | Y | S | S | | | | | | | | | | | |
| 21-225_190D12_HC | | | | | | | | | D | M | G | Y | S | E | I | | | | | | | | | | |
| 21-225_197C8_HC | | | | F | | | | | D | E | G | Y | S | E | | | | | | | | | | | |
| 21-225_55E1_HC | | | | | | | | | D | E | G | I | V | Q | I | A | | | | | | | | | |

Table 71. Consensus 37- VH1|1-02/D3|3-22|RF2/JH4 (SEQ ID NO: 50288):

QVQLVQS-GAEVKKPGASVKVSCKASG-YTFTG-----YYMHWVRQAPGQGLEWMGWINPN---SGGTNYAQKFQGRVTMTRDTSISTAYMELSRLRSDDTAVYYCARSYYYGSGS---------YYNEFDYWGQGTLVTVSS wherein:

G in position 33 can be substituted with D

Y in position 39 can be substituted with H

Y in position 40 can be substituted with C

M in position 41 can be substituted with I

W in position 57 can be substituted with S

N in position 59 can be substituted with Y

P in position 60 can be substituted with R

N in position 61 can be substituted with K

G in position 67 can be substituted with A

T in position 68 can be substituted with A

N in position 69 can be substituted with D

Y in position 70 can be substituted with N or S

A in position 71 can be substituted with G or V

G in position 76 can be substituted with D or V

S in position 109 can be substituted with A, V or T

Y in position 110 can be substituted with F or N

Y in position 112 can be substituted with H

FIGURE 57 (Continued)

S in position 116 can be substituted with T

Y in position 133 can be substituted with H

E in position 135 can be substituted with G or D

Xaa Xaa Xaa Xaa His (SEQ ID NO: 50058)

Xaa Ile Xaa Xaa Xaa Ser Gly Xaa Xaa Xaa Xaa Gln Lys Phe Gln Xaa (SEQ ID NO: 50059)

Xaa Xaa Tyr Xaa Gly Ser Gly Xaa Tyr Xaa Asn Xaa Phe Asp Tyr (SEQ ID NO: 50060)

Gly Tyr Tyr Met His (SEQ ID NO: 50534)

Trp Ile Asn Pro Asn Ser Gly Gly Thr Asn Tyr Ala Gln Lys Phe Gln Gly (SEQ ID NO: 50535)

Ser Tyr Tyr Tyr Gly Ser Gly Ser Tyr Tyr Asn Glu Phe Asp Tyr (SEQ ID NO: 50536)

Table 72. Consensus 38 – VH1|1-02/D4|4-23|RF2/JH6 (SEQ ID NO: 50289):

QVQLVQS-GAEVKKPGASVKVSCKASG-YTFTG-----YYIHWVRQAPGQGLEWMGWINPY---
SGDTNYAQKFQGRVTMTRDTSISTAYMELSRLRFDDTAVFYCARDWGGYSS----------YYYGMDVWGQGTTVTVSS wherein:

I in position 41 can be substituted with T

D in position 67 can be substituted with G

N in position 69 can be substituted with K

Y in position 70 can be substituted with S

Y in position 134 can be substituted with F

Gly Tyr Tyr Xaa His (SEQ ID NO: 50061)

Trp Ile Asn Pro Tyr Ser Gly Xaa Thr Xaa Xaa Ala Gln Lys Phe Gln Gly (SEQ ID NO: 50062)

Asp Trp Gly Gly Tyr Ser Ser Tyr Tyr Xaa Gly Met Asp Val (SEQ ID NO: 50236)

Gly Tyr Tyr Ile His (SEQ ID NO: 50537)

Trp Ile Asn Pro Tyr Ser Gly Asp Thr Asn Tyr Ala Gln Lys Phe Gln Gly (SEQ ID NO: 50538)

Asp Trp Gly Gly Tyr Ser Ser Tyr Tyr Tyr Gly Met Asp Val (SEQ ID NO: 50539)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | | | H_CDR1 | | | | | | | | | | | | H_FR2 | | | |
| CONSENSUS | G | . | Y | T | F | T | G | . | . | . | . | . | Y | Y | I | H | W | V | R | Q | A | P | G | Q | G | L |
| 21-225_224A7_HC | . | . | . | . | . | . | . | . | . | . | . | . | . | . | . | . | . | . | . | . | . | . | . | . | . | . |
| 21-225_224C11_HC | . | . | . | . | . | . | . | . | . | . | . | . | . | . | . | . | . | . | . | . | . | . | . | . | . | . |
| 21-225_224G1_HC | . | . | . | . | . | . | . | . | . | . | . | . | . | . | . | . | . | . | . | . | T | . | . | . | . | . |
| 21-225_224H11_HC | . | . | . | . | . | . | . | . | . | . | . | . | . | . | . | . | . | . | . | . | . | . | . | . | . | . |
| 21-225_225G4_HC | . | . | . | . | . | . | . | . | . | . | . | . | . | . | . | . | . | . | . | . | . | . | . | . | . | . |
| 21-225_226E11_HC | . | . | . | . | . | . | . | . | . | . | . | . | . | . | . | . | . | . | . | . | . | . | . | . | . | . |
| 21-225_226F10_HC | . | . | . | . | . | . | . | . | . | . | . | . | . | . | . | . | . | . | . | . | . | . | . | . | . | . |
| 21-225_226F9_HC | . | . | . | . | . | . | . | . | . | . | . | . | . | . | . | . | . | . | . | . | . | . | . | . | . | . |
| 21-225_226G8_HC | . | . | . | . | . | . | . | . | . | . | . | . | . | . | . | . | . | . | . | . | . | . | . | . | . | . |
| 21-225_226H12_HC | . | . | . | . | . | . | . | . | . | . | . | . | . | . | . | . | . | . | . | . | . | . | . | . | . | . |
| 21-225_226H9_HC | . | . | . | . | . | . | . | . | . | . | . | . | . | . | . | . | . | . | . | . | . | . | . | . | . | . |
| 21-225_227A8_HC | . | . | . | . | . | . | . | . | . | . | . | . | . | . | T | . | . | . | . | . | . | . | . | . | . | . |
| 21-225_227C1_HC | . | . | . | . | . | . | . | . | . | . | . | . | . | . | . | . | . | . | . | . | . | . | . | . | . | . |
| 21-225_227F2_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | - | Y | Y | Y | G | M | D | V | W | G | Q | G | T | T | V | T | V | S | S |
| 21-225_224A7_HC | | | | | | | | | | | | | | | | | | | |
| 21-225_224C11_HC | | | | A | | | | | | | | | | | | | | | |
| 21-225_224G1_HC | | | | | | | | | | | | | | | | | | | |
| 21-225_224H11_HC | | | | | | | | | | | | | | | | | | | |
| 21-225_225G4_HC | | | | | | | | | | | | | | | | | | | |
| 21-225_225E11_HC | | | | | | | | | | | | | | | | | | | |
| 21-225_226F10_HC | | | | | | | | | | | | | | A | | | | | |
| 21-225_226F9_HC | | | | | | | | | | | | | | | | | | | |
| 21-225_226G8_HC | | | | | | | | | | | | | | | | | | | |
| 21-225_226H12_HC | | | | | | | | | | | | | | | | | | | |
| 21-225_226H9_HC | | | | | | | | | | | | | | | | | | | |
| 21-225_227A8_HC | | | | | | | | | | | | | | | | | | | |
| 21-225_227C1_HC | | | | | | | | | | | | | | | | | | | |
| 21-225_227F2_HC | | | | | | | | | | | | | | | | | | | |

FIGURE 57 (Continued)

Table 73. Consensus 39 -- VH3[3-21/D7[7-27]RF1/JH4 (SEQ ID NO: 50290):

EVQLVES-GGGLVKPGGSLRLSCAASG-FTFSS------YSMNWVRQAPGKGLEWVSSISGS---
SSYIYYADSVKGRFTISRDNAKNSLYLQMNSLRAEDTAVYYCARLI-----------FDYWGQGTLVTVSS wherein:

S in position 33 can be substituted with T
Y in position 39 can be substituted with F
S in position 40 can be substituted with T, N or G
N in position 42 can be substituted with S or I
G in position 60 can be substituted with S
S in position 61 can be substituted with T
S in position 65 can be substituted with I or N
S in position 66 can be substituted with N, T or Y
I in position 68 can be substituted with M or S
Y in position 69 can be substituted with N
A in position 71 can be substituted with T
Xaa Xaa Xaa Met Xaa (SEQ ID NO: 50063)
Ser Ile Ser Xaa Xaa Xaa Xaa Tyr Xaa Xaa Tyr Xaa Asp Ser Val Lys Gly (SEQ ID NO: 50064)
Leu Thr Phe Asp Tyr (SEQ ID NO: 50065)
Ser Tyr Ser Met Asn (SEQ ID NO: 50540)
Ser Ile Ser Gly Ser Ser Ser Tyr Ile Tyr Tyr Ala Asp Ser Val Lys Gly (SEQ ID NO: 50541)
Leu Thr Phe Asp Tyr (SEQ ID NO: 50542)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | E | V | Q | L | V | E | S | - | G | G | G | L | V | K | P | G | G | S | L | R | L | S | C | A | A | S |
| 21-225_10C7_HC | . | . | . | . | . | . | . | . | . | . | . | . | . | . | . | . | . | . | . | . | . | . | . | . | . | . |
| 21-225_12D2_HC | . | . | . | . | . | . | . | . | . | . | . | . | . | . | . | . | . | . | . | . | . | . | . | . | . | . |
| 21-225_151F1_HC | . | . | . | . | . | . | . | . | . | . | . | . | . | . | . | . | . | . | . | . | . | . | . | . | . | . |
| 21-225_186H12_HC | . | . | . | . | . | . | . | . | . | . | A | . | . | . | . | . | . | . | . | . | . | . | . | . | . | . |
| 21-225_227F1_HC | . | . | . | . | . | . | . | . | . | . | . | . | . | . | . | . | . | . | . | . | . | . | . | . | V | . |
| 21-225_26G1_HC | . | . | . | . | . | . | . | . | . | . | . | . | . | . | . | . | . | . | . | . | . | . | . | . | . | . |
| 21-225_2B1_HC | . | . | . | . | . | . | . | . | . | . | . | . | . | . | . | . | . | . | . | . | . | . | . | . | . | . |
| 21-225_33B7_HC | . | . | . | . | . | . | . | . | . | . | . | . | . | . | . | . | . | . | . | . | . | . | . | . | . | . |
| 21-225_34C11_HC | . | . | . | . | . | . | . | . | . | . | . | . | . | . | . | . | . | . | . | . | . | . | . | . | . | . |
| 21-225_43A4_HC | . | . | . | . | . | . | . | . | . | . | . | . | . | . | . | . | . | . | . | . | . | . | . | . | . | . |
| 21-225_45D9_HC | . | . | . | . | . | . | . | . | . | . | . | . | . | . | . | . | . | . | . | . | . | . | . | . | . | . |
| 21-225_54H3_HC | . | . | . | . | . | . | . | . | . | . | . | . | . | . | . | . | . | . | . | . | . | . | . | . | . | . |
| 21-225_63H8_HC | . | . | . | . | . | . | . | . | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | | H_CDR1 | | | | | | | | | | | | H_FR2 | | | | | |
| CONSENSUS | G | . | F | T | F | S | S | . | . | . | . | . | Y | S | M | N | W | V | R | Q | A | P | G | K | G | L |
| 21-225_10C7_HC | . | . | . | . | . | . | . | . | . | . | . | . | . | . | . | . | . | . | . | . | . | . | . | . | . | . |
| 21-225_12D2_HC | . | . | Y | . | . | S | . | . | . | . | . | . | F | . | . | . | . | . | . | . | . | . | . | . | . | . |
| 21-225_151F1_HC | . | . | Y | . | . | . | . | . | . | . | . | . | . | . | . | . | . | . | . | . | . | . | . | . | . | . |
| 21-225_186H12_HC | . | . | . | . | . | . | . | . | . | . | . | . | . | . | . | . | . | . | . | . | . | . | . | . | . | . |
| 21-225_227F1_HC | . | . | . | . | . | . | T | . | . | . | . | . | . | . | . | . | . | . | . | . | . | . | . | . | . | . |
| 21-225_26G1_HC | . | . | . | . | . | . | . | . | . | . | . | . | . | G | . | . | . | . | . | . | . | . | . | . | . | . |
| 21-225_2B1_HC | . | . | . | . | . | . | . | . | . | . | . | . | . | . | . | . | . | . | . | . | . | . | . | . | . | . |
| 21-225_33B7_HC | . | . | . | . | . | . | . | . | . | . | . | . | . | . | . | S | . | . | . | . | . | . | . | . | . | . |
| 21-225_34C11_HC | . | . | . | . | . | . | . | . | . | . | . | . | . | . | . | . | . | . | . | . | . | . | . | . | . | . |
| 21-225_43A4_HC | . | . | . | . | . | . | . | . | . | . | . | . | . | N | . | S | . | . | . | . | V | . | . | . | . | . |
| 21-225_45D9_HC | . | . | . | . | . | . | . | . | . | . | . | . | . | T | . | . | . | . | . | . | V | . | . | . | . | . |
| 21-225_54H3_HC | . | . | . | . | . | . | . | . | . | . | . | . | . | T | . | . | . | . | . | . | . | . | . | . | . | . |
| 21-225_63H8_HC | . | . | . | . | . | . | . | . | . | . | . | . | . | N | . | I | . | . | . | . | . | . | . | . | . | . |
| 21-225_8D8_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | H_CDR3 | | | | | | | | |
| CONSENSUS | Y | C | A | R | L | T | . | . | . | . | . | . | . | . | . | . | . | . | . | . | . | . | . | . | . | . |
| 21-225_10C7_HC | . | . | . | . | . | G | . | . | . | . | . | . | . | . | . | . | . | . | . | . | . | . | . | . | . | . |
| 21-225_12D2_HC | . | . | . | . | Q | G | P | . | . | . | . | . | . | . | . | . | . | . | . | . | . | . | . | . | . | . |
| 21-225_151F1_HC | . | . | . | . | . | . | Q | . | . | . | . | . | . | . | . | . | . | . | . | . | . | . | . | . | . | . |
| 21-225_186H12_HC | . | . | . | . | . | . | . | . | . | . | . | . | . | . | . | . | . | . | . | . | . | . | . | . | . | . |
| 21-225_227F1_HC | . | . | . | . | . | G | T | . | . | . | . | . | . | . | . | . | . | . | . | . | . | . | . | . | . | . |
| 21-225_26G1_HC | . | . | . | . | . | G | G | . | . | . | . | . | . | . | . | . | . | . | . | . | . | . | . | . | . | . |
| 21-225_2B1_HC | . | . | . | . | . | N | G | . | . | . | . | . | . | . | . | . | . | . | . | . | . | . | . | . | . | . |
| 21-225_33B7_HC | . | . | . | . | V | . | S | . | . | . | . | . | . | . | . | . | . | . | . | . | . | . | . | . | . | . |
| 21-225_34C11_HC | . | . | . | . | V | . | S | . | . | . | . | . | . | . | . | . | . | . | . | . | . | . | . | . | . | . |
| 21-225_43A4_HC | . | . | . | G | M | . | T | . | . | . | . | . | . | . | . | . | . | . | . | . | . | . | . | . | . | . |
| 21-225_45D9_HC | . | . | . | . | . | . | N | . | . | . | . | . | . | . | . | . | . | . | . | . | . | . | . | . | . | . |
| 21-225_54H3_HC | . | . | . | . | . | A | . | . | . | . | . | . | . | . | . | . | . | . | . | . | . | . | . | . | . | . |
| 21-225_63H8_HC | . | . | . | . | . | G | . | . | . | . | . | . | . | . | . | . | . | . | . | . | . | . | . | . | . | . |
| 21-225_8D8_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 H_FR4 | 145 | 146 | 147 | 148 | 149 |
|---|---|---|---|---|---|---|---|---|---|---|---|---|---|---|---|---|---|---|---|
| CONSENSUS | . | . | . | . | . | F | D | Y | W | G | Q | G | T | L | V | T | V | S | S |
| 21-225_10C7_HC | . | . | . | . | . | . | V | . | . | . | . | . | . | . | . | A | . | . | . |
| 21-225_12D2_HC | . | . | . | . | . | . | . | . | . | . | . | . | . | . | . | . | . | . | . |
| 21-225_151F1_HC | . | . | . | . | . | L | V | . | . | . | . | . | . | . | . | . | . | . | . |
| 21-225_166H12_HC | . | . | . | . | . | . | . | . | . | . | . | . | . | . | . | . | . | . | . |
| 21-225_227F11_HC | . | . | . | . | . | . | V | . | . | . | . | . | . | . | . | . | . | . | . |
| 21-225_26G1_HC | . | . | . | . | . | . | N | . | . | . | . | . | . | . | . | . | . | . | . |
| 21-225_2B1_HC | . | . | . | . | . | . | . | . | . | . | . | . | . | . | . | . | . | . | . |
| 21-225_33B7_HC | . | . | . | . | . | . | . | . | . | . | . | . | . | . | . | . | . | . | . |
| 21-225_34C11_HC | . | . | . | . | . | . | . | . | . | . | . | . | . | . | . | . | . | . | . |
| 21-225_43A4_HC | . | . | . | . | . | . | . | F | . | . | . | . | A | . | . | . | . | . | . |
| 21-225_45D9_HC | . | . | . | . | . | . | V | - | . | . | . | . | A | . | . | . | . | . | . |
| 21-225_54H3_HC | . | . | . | . | . | . | . | . | . | . | . | . | . | . | . | . | . | . | . |
| 21-225_63H8_HC | . | . | . | . | . | . | V | . | . | . | . | . | . | . | . | . | . | . | . |
| 21-225_8D8_HC | . | . | . | . | . | . | N | . | . | . | . | . | . | . | . | . | . | . | . |

FIGURE 57 (Continued)

Table 74. Consensus 40 – VH3j3-33/D3j3-9jRF2/JH4 (SEQ ID NO: 50291):

QVQLVES-GGGVVQPGRSLRLSCAASG-FTFST----YGMHWVRQAPGKGLEWVAIIWYD--
GTNKYYADSVKGRFTISRDNSKNTLYLQLNSLRAEDTAVYYCARDPLRGYN----------DPVMDYWGQGTLVTVSS wherein:

T in position 33 can be substituted with S

I in position 57 can be substituted with V

T in position 66 can be substituted with S

K in position 75 can be substituted with R

M in position 136 can be substituted with L

Xaa Tyr Gly Met His (SEQ ID NO: 50066)

Xaa Ile Trp Tyr Asp Gly Xaa Asn Lys Tyr Tyr Ala Asp Ser Val Xaa Gly (SEQ ID NO: 50067)

Asp Pro Leu Arg Gly Tyr Asn Asp Pro Val Xaa Asp Tyr (SEQ ID NO: 50068)

Thr Tyr Gly Met His (SEQ ID NO: 50543)

Ile Ile Trp Tyr Asp Gly Thr Asn Lys Tyr Tyr Ala Asp Ser Val Lys Gly (SEQ ID NO: 50544)

Asp Pro Leu Arg Gly Tyr Asn Asp Pro Val Met Asp Tyr (SEQ ID NO: 50545)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | A | I | W | Y | D | - | - | - | G | T | N | K | Y | Y | A | D | S | V | K | G | R | F |
| 21-225_169B1_HC | | | | | | | | | | | | | | | | | | | | | | | | | | |
| 21-225_169F9_HC | | | | S | V | | | | | | | | | S | | | | | | | | | | | | |
| 21-225_170D11_HC | | | | | | | | | | | | | | | | | | | | | | | | | | |
| 21-225_170D5_HC | | | | S | | | | | | | | | | | | | | | | | | | | | | |
| 21-225_170G4_HC | | | | T | | | | | | | | | | | | | | | | | | | | | | |
| 21-225_170G5_HC | | | | | | | | | | | | | | | | | | | | | | | | | | |
| 21-225_171A4_HC | | | | T | | | | | | | | | | S | | | | | | | | | | | | |
| 21-225_171C3_HC | | | | | V | | | | | | | | | | | | | | | | | | | | | |
| 21-225_172B3_HC | | | V | | | | | | | | | | | S | | | | | | | | | | | | |
| 21-225_172G8_HC | | | | | | | | | | | | | | | | | | | | | | | | | | |
| 21-225_173H12_HC | | | | | V | | | | | | | | | | | | | | | | | | | | | |
| 21-225_175G1_HC | | | | S | | | | | | | | | | S | | | | | | | | | | | | |
| 21-225_176B11_HC | | | V | | | | | | | | | | | | | | | | | | | | | | | |
| 21-225_178B10_HC | | | | | | | | | | | | | | | | | | | | | | | | | | |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | | H_FR3 | | | | | | | | | | | |
| CONSENSUS | T | I | S | R | D | N | S | K | N | T | L | Y | L | Q | L | N | S | L | R | A | E | D | T | A | V | Y |
| 21-225_169B1_HC | . | . | . | . | . | . | . | . | . | . | . | . | . | . | ▩ | . | . | . | . | . | . | . | . | . | . | . |
| 21-225_169F9_HC | . | . | . | . | . | . | . | . | . | . | . | . | . | . | . | . | . | . | . | . | . | . | . | . | . | . |
| 21-225_170D11_HC | . | . | . | . | . | . | . | . | . | . | . | . | . | . | . | . | . | . | . | . | . | . | . | . | . | . |
| 21-225_170D5_HC | . | . | . | . | . | . | . | . | . | . | . | . | . | . | . | . | . | . | . | . | . | . | . | . | . | . |
| 21-225_170G4_HC | . | . | . | . | . | . | . | . | . | . | . | R | . | . | . | . | . | . | . | . | . | . | . | . | . | . |
| 21-225_170G5_HC | . | . | . | . | . | . | . | . | S | . | . | . | . | . | ▩ | . | . | . | . | . | . | . | . | . | . | . |
| 21-225_171A4_HC | . | . | . | . | . | . | . | . | . | . | . | . | . | . | ▩ | . | . | . | . | . | . | . | . | . | . | . |
| 21-225_171C3_HC | . | . | . | . | . | . | . | . | . | . | . | . | . | . | ▩ | . | . | . | . | . | . | . | . | . | ▩ | . |
| 21-225_172B3_HC | . | . | . | . | . | . | . | . | . | . | . | . | . | . | . | . | . | . | . | . | . | . | . | . | . | . |
| 21-225_172G8_HC | . | . | . | . | . | . | . | . | . | . | . | . | . | . | . | . | . | . | . | . | . | . | . | . | . | . |
| 21-225_173H12_HC | . | . | . | . | . | . | . | . | . | . | . | R | V | . | ▩ | . | . | . | . | . | . | . | . | . | . | . |
| 21-225_175G1_HC | . | . | . | . | . | . | . | . | . | . | . | . | . | . | . | . | . | . | . | . | . | . | . | . | . | . |
| 21-225_176B11_HC | . | . | . | . | . | . | . | . | . | . | . | . | . | . | . | . | . | . | . | . | . | . | . | . | . | . |
| 21-225_178B10_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | - | - | D | P | V | M | D | Y | W | G | Q | G | T | L | V | T | V | S | S |
| 21-225_169B1_HC | . | . | . | . | . | . | . | . | . | . | . | . | . | . | . | . | . | . | . |
| 21-225_169F9_HC | . | . | . | . | . | . | . | . | . | . | . | . | . | . | . | . | . | . | . |
| 21-225_170D11_HC | . | . | . | . | . | . | . | . | . | . | . | . | . | . | . | . | . | . | . |
| 21-225_170D5_HC | . | . | . | . | . | . | . | . | . | . | . | . | . | . | . | . | . | . | . |
| 21-225_170G4_HC | . | . | . | . | . | . | . | . | . | . | . | . | . | . | . | . | . | . | . |
| 21-225_170G5_HC | . | . | . | . | . | . | . | . | . | . | . | . | . | . | . | . | . | . | . |
| 21-225_171A4_HC | . | . | . | . | . | . | . | . | . | . | . | . | . | . | . | . | . | . | . |
| 21-225_171C3_HC | . | . | . | . | . | . | . | . | . | . | . | . | . | . | . | . | . | . | . |
| 21-225_172B3_HC | . | . | . | . | . | . | . | . | . | . | . | . | . | . | . | . | . | . | . |
| 21-225_172G8_HC | . | . | . | . | . | . | . | . | . | . | . | . | . | . | . | . | . | . | . |
| 21-225_173H12_HC | . | . | . | . | . | L | . | . | . | . | . | . | . | . | . | . | . | . | . |
| 21-225_175G1_HC | . | . | . | . | . | . | . | . | . | . | . | . | . | . | . | . | . | . | . |
| 21-225_176B11_HC | . | . | . | . | . | . | . | . | . | . | . | . | . | . | . | . | . | . | . |
| 21-225_178B10_HC | . | . | . | . | . | . | . | . | . | . | . | . | . | . | . | . | . | . | . |

FIGURE 57 (Continued)

Table 75. Consensus 41 – VH3|3-23/D4|4-17|RF2/JH5 (SEQ ID NO: 50292):

EVQLLES-GGGLVQPGGSLRLSCAASG-FTFSS-----YAMSWVRQAPGKGLEWVSAISGR---GGNTFYADSVKGRFTISRDNSKNTLYLQMNSLRAEDTAVYYCAKRVTDYGG-----------NDWFDPWGQGTLVTVSS wherein:

S in position 33 can be substituted with N

S in position 42 can be substituted with N or T

R in position 61 can be substituted with S

G in position 66 can be substituted with K

Xaa Tyr Ala Met Xaa (SEQ ID NO: 50069)

Ala Ile Ser Gly Xaa Asn Thr Phe Tyr Ala Asp Ser Val Lys Gly (SEQ ID NO: 50070)

Arg Val Thr Asp Tyr Gly Gly Asn Asp Trp Phe Asp Pro (SEQ ID NO: 50071)

Ser Tyr Ala Met Ser (SEQ ID NO: 50546)

Ala Ile Ser Gly Arg Gly Gly Asn Thr Phe Tyr Ala Asp Ser Val Lys Gly (SEQ ID NO: 50547)

Arg Val Thr Asp Tyr Gly Gly Asn Asp Trp Phe Asp Pro (SEQ ID NO: 50548)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | |
| CONSENSUS | E | W | V | S | A | I | S | G | R | - | - | - | G | G | N | T | F | Y | A | D | S | V | K | G | R | F |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . | . | . | . | . | . | . | . |
| 21-225_148C4_HC | . | . | . | . | . | . | . | . | S | . | . | . | . | . | . | . | . | . | . | . | . | . | . | . | . | . |
| 21-225_148H9_HC | . | . | . | . | . | . | . | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . | . | . | . | . | . | . | . |
| 21-225_150C11_HC | . | . | . | . | . | . | . | . | S | . | . | . | . | . | . | . | . | . | . | . | . | . | . | . | . | . |
| 21-225_150C12_HC | . | . | . | . | . | . | . | . | . | . | . | . | . | X | . | . | . | . | . | . | . | . | . | . | . | . |
| 21-225_151B12_HC | . | . | . | . | . | . | . | . | S | . | . | . | . | . | . | . | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_156E4_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | | H_CDR3 | | | | | | |
| CONSENSUS | Y | C | A | K | R | V | T | D | Y | G | G | . | . | . | . | . | . | . | . | . | . | . | . | . | . | . |
| 21-225_146E9_HC | . | . | . | . | . | . | . | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . | . | . | . | . | . | . | . |
| 21-225_148H9_HC | . | . | T | . | . | . | . | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . | . | . | . | . | . | . | . |
| 21-225_150C11_HC | . | . | . | . | . | . | . | . | . | . | . | . | . | . | . | . | . | . | . | . | . | . | . | . | . | . |
| 21-225_150C12_HC | . | . | . | . | . | . | . | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . | . | . | . | . | . | . | . |
| 21-225_158E4_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | N | D | W | F | D | P | W | G | Q | G | T | L | V | T | V | S | S |
| 21-225_146E9_HC | . | . | . | . | . | . | . | . | . | . | . | . | . | . | . | . | . | . | . |
| 21-225_146H1_HC | . | . | . | . | . | . | . | . | . | . | . | . | . | . | . | . | . | . | . |
| 21-225_148C4_HC | . | . | . | . | . | . | . | . | . | . | . | . | . | . | . | . | . | . | . |
| 21-225_148H9_HC | . | . | . | . | . | . | . | . | . | . | . | . | . | . | . | . | . | . | . |
| 21-225_149A3_HC | . | . | . | . | . | . | . | . | . | . | . | . | . | . | . | . | . | . | . |
| 21-225_150C11_HC | . | . | . | . | . | . | . | . | . | . | . | . | . | . | . | . | . | . | . |
| 21-225_150C12_HC | . | . | . | . | . | . | . | . | . | . | . | . | . | . | . | . | . | . | . |
| 21-225_151B12_HC | . | . | . | . | . | . | . | . | . | . | . | . | . | . | . | . | . | . | . |
| 21-225_152B11_HC | . | . | . | . | . | . | . | . | . | . | . | . | . | . | . | . | . | . | . |
| 21-225_152D2_HC | . | . | . | . | . | . | . | . | . | . | . | . | . | . | . | . | . | . | . |
| 21-225_152G4_HC | . | . | . | . | . | . | . | . | . | . | . | . | . | . | . | . | . | . | . |
| 21-225_155C4_HC | . | . | . | . | . | . | . | . | . | . | . | . | . | . | . | . | . | . | . |
| 21-225_158E4_HC | . | . | . | . | . | . | . | . | . | . | . | . | . | . | . | . | . | . | . |

FIGURE 57 (Continued)

Table 76. Consensus 42 – VH3|3-33/D3|3-3|RF2/JH6 (SEQ ID NO: 50293):

QVQLVES-GGGVVQPGRSLRLSCAASG-FTFST----YGMHWVRQAPGKGLEWVAVIWYG---GSNKDYADSVKGRFTISRDISKNTLYLQMNSLRAEDTAVYYCARDRDYCSGGSC------PYYYYYGMDVWGQGTTVTVSS wherein:

T in position 33 can be substituted with S

I in position 58 can be substituted with V

G in position 61 can be substituted with D

S in position 66 can be substituted with N

N in position 67 can be substituted with D or S

K in position 68 can be substituted with T

D in position 69 can be substituted with Y or S

Y in position 70 can be substituted with F

A in position 71 can be substituted with V

K in position 75 can be substituted with R or T

D in position 111 can be substituted with V

Y in position 112 can be substituted with F

G in position 116 can be substituted with T

S in position 117 can be substituted with T or N

Xaa Tyr Gly Met His (SEQ ID NO: 50072)

Val Xaa Trp Tyr Xaa Gly Xaa Xaa Xaa Xaa Xaa Xaa Asp Ser Val Xaa Gly (SEQ ID NO: 50073)

Asp Arg Xaa Xaa Cys Ser Gly Xaa Xaa Cys Pro Tyr Tyr Tyr Tyr Tyr Gly Met Asp Val (SEQ ID NO: 50074)

FIGURE 57 (Continued)

Thr Tyr Gly Met His (SEQ ID NO: 50549)

Val Ile Trp Tyr Gly Gly Ser Asn Lys Asp Tyr Ala Asp Ser Val Lys Gly (SEQ ID NO: 50550)

Asp Arg Asp Tyr Cys Ser Gly Gly Ser Cys Pro Tyr Tyr Tyr Tyr Tyr Gly Met Asp Val (SEQ ID NO: 50551)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | Q | V | Q | L | V | E | S | - | G | G | G | V | V | Q | P | G | R | S | L | R | L | S | C | A | A | S |
| | | | | | | | | | | | | | | | | | H_FR1 | | | | | | | | | |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | . | . | . | . | . | . | . | . | . | . | . | . | . | . | . | . | . | . | . | . | . | . |
| 21-225_150D3_HC | . | . | . | . | . | . | . | . | . | . | . | . | . | . | . | . | . | . | . | . | . | . | . | . | . | . |
| 21-225_151F3_HC | . | . | . | . | . | . | . | . | . | . | . | . | . | . | . | . | . | . | . | . | . | . | . | . | . | . |
| 21-225_153D9_HC | . | . | H | . | . | . | . | . | . | . | . | . | . | . | . | . | . | . | . | . | . | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | . | . | . | . | . | . | . | . | . | . | . | . | . | . | . | . | . | . | T | . | . |
| 21-225_154D11_HC | . | . | . | . | . | . | . | . | . | . | . | . | . | . | . | . | . | . | . | . | . | . | . | . | . | . |
| 21-225_158E9_HC | . | . | . | . | . | . | . | . | . | . | . | . | . | . | . | . | . | . | . | . | . | . | . | . | . | . |
| 21-225_161E10_HC | . | . | . | . | . | . | . | . | . | . | . | . | . | . | . | . | . | . | . | . | . | . | . | . | . | . |
| 21-225_74A9_HC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 H_CDR2 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| CONSENSUS | E | W | V | A | V | I | W | Y | G | - | - | - | G | S | N | K | D | Y | A | D | S | V | K | G | R | F |
| 21-225_146B8_HC | . | . | . | . | . | . | . | . | . | . | . | . | . | . | D | . | . | . | . | . | . | . | . | . | . | . |
| 21-225_147F9_HC | . | . | . | . | . | . | . | . | . | . | . | . | . | . | D | . | . | . | . | . | . | . | . | . | . | . |
| 21-225_147G9_HC | . | . | . | . | . | . | . | . | . | . | . | . | . | . | D | . | . | . | . | . | . | . | . | . | . | . |
| 21-225_148A9_HC | . | . | . | . | . | . | . | . | . | . | . | . | . | . | D | . | . | . | . | . | . | . | . | . | . | . |
| 21-225_150D3_HC | . | . | . | . | . | . | . | . | . | . | . | . | . | . | . | . | . | . | . | . | . | . | . | . | . | . |
| 21-225_151F3_HC | . | . | . | . | . | . | . | . | . | . | . | . | . | . | . | T | . | . | . | . | . | . | . | . | . | . |
| 21-225_153D9_HC | . | . | . | . | . | Y | . | . | . | . | . | . | . | N | . | T | . | . | . | . | . | . | . | . | . | . |
| 21-225_153F9_HC | . | . | . | . | . | . | . | . | . | . | . | . | . | . | D | . | . | . | . | . | . | . | . | . | . | . |
| 21-225_154C3_HC | . | . | . | . | . | . | . | . | D | . | . | . | . | . | . | . | . | . | . | . | . | . | . | . | . | . |
| 21-225_154D11_HC | . | . | . | . | . | . | . | . | D | . | . | . | . | . | S | . | Y | . | . | . | . | . | T | . | . | . |
| 21-225_158E9_HC | . | . | . | . | . | . | . | . | D | . | . | . | . | N | . | . | Y | . | . | . | . | . | . | . | . | . |
| 21-225_161E10_HC | . | . | . | . | . | . | . | . | . | . | . | . | . | . | . | . | S | . | V | . | . | . | . | . | . | . |
| 21-225_74A9_HC | . | . | . | . | . | . | . | . | . | . | . | . | . | . | . | . | . | . | . | . | . | . | . | . | . | . |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | S | K | N | T | L | Y | L | Q | M | N | S | L | R | A | E | D | T | A | V | Y |
| 21-225_146B8_HC | . | . | . | . | . | . | . | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . | . | . | . | . | . | . | . |
| 21-225_147G9_HC | . | . | . | . | . | . | . | . | . | . | . | . | . | . | . | . | . | . | . | . | . | . | . | . | . | . |
| 21-225_148A9_HC | . | . | . | . | . | . | . | . | . | . | . | . | . | . | . | . | . | . | . | . | . | . | . | . | . | . |
| 21-225_150D3_HC | . | . | . | . | . | N | . | . | . | . | . | . | . | . | . | . | . | . | . | . | . | . | . | . | . | . |
| 21-225_151F3_HC | . | . | . | . | . | . | . | . | . | . | . | . | . | . | . | . | . | . | . | . | . | . | . | . | . | . |
| 21-225_153D9_HC | . | . | . | . | . | . | . | . | . | . | . | . | . | . | . | . | . | . | . | . | . | . | . | . | . | . |
| 21-225_153F9_HC | . | . | . | . | . | . | . | . | . | . | . | . | . | . | . | . | . | . | . | . | . | . | . | . | . | . |
| 21-225_154C3_HC | . | . | . | . | . | S | . | . | . | . | . | . | . | . | . | . | . | . | . | . | . | . | . | . | . | . |
| 21-225_154D11_HC | . | . | . | . | . | N | . | . | . | . | . | . | . | . | . | . | . | . | . | . | . | . | . | . | . | . |
| 21-225_158E9_HC | . | . | . | . | . | N | . | . | . | . | . | R | . | . | . | . | . | . | . | . | Q | . | . | . | . | . |
| 21-225_161E10_HC | . | . | . | . | . | . | . | . | . | . | . | . | . | . | . | . | . | . | . | . | . | . | . | . | . | . |
| 21-225_74A9_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | Y | Y | Y | Y | G | M | D | V | W | G | Q | G | T | T | V | T | V | S | S |
| 21-225_148B8_HC | . | . | . | . | . | . | . | . | . | . | . | . | . | . | . | . | . | . | . |
| 21-225_147F9_HC | . | . | . | . | . | . | . | . | . | . | . | . | . | . | . | . | . | . | . |
| 21-225_147G8_HC | . | . | . | . | . | . | . | . | . | . | . | . | . | . | . | . | . | . | . |
| 21-225_148A9_HC | . | . | . | . | . | . | . | . | . | . | . | . | . | . | . | . | . | . | . |
| 21-225_150D3_HC | . | . | . | . | . | . | . | . | . | . | . | . | . | . | . | . | . | . | . |
| 21-225_151F3_HC | . | . | . | . | . | . | . | . | . | . | . | . | . | . | . | . | . | . | . |
| 21-225_153D9_HC | . | . | . | . | . | . | . | . | . | . | . | . | . | . | . | . | . | . | . |
| 21-225_153F9_HC | . | . | . | . | . | . | . | . | . | . | . | . | . | . | . | . | . | . | . |
| 21-225_154C3_HC | . | . | . | . | . | . | . | . | . | . | . | . | . | . | . | . | . | . | . |
| 21-225_154D11_HC | . | . | . | . | . | . | . | . | . | . | . | . | . | . | . | . | . | . | . |
| 21-225_158E9_HC | . | . | . | . | . | . | . | . | . | . | . | . | . | . | . | . | . | . | . |
| 21-225_161E10_HC | . | . | . | . | . | . | . | . | . | . | . | . | . | . | . | . | . | . | . |
| 21-225_74A9_HC | . | . | . | . | . | . | . | . | . | . | . | . | . | . | . | . | . | . | . |

FIGURE 57 (Continued)

Table 77. Consensus 43 – VH4|4-39/D4|4-17|RF2/JH4 (SEQ ID NO: 50294):

QLQLQES-GPGLVKPSETLSLTCTVSG-GSISRS---SYYWGWIRQPPGKGLEWIGNIYY---
SGSTYYNPSLKSRVTISVDTSKNQFSLKLSSVTAADTAVYYCGRHGKDW------------GLDYWGQGTLVTVSS wherein:

S in position 65 can be substituted with G

S in position 67 can be substituted with T or N

T in position 68 can be substituted with A

Y in position 70 can be substituted with N, D, H or T

L in position 74 can be substituted with V

S in position 76 can be substituted with G

Y in position 138 can be substituted with F or N

Arg Ser Tyr Tyr Trp Gly (SEQ ID NO: 50075)

Asn Ile Tyr Tyr Xaa Gly Xaa Xaa Tyr Xaa Asn Pro Ser Xaa Lys Xaa (SEQ ID NO: 50076)

His Gly Lys Asp Trp Gly Leu Asp Xaa (SEQ ID NO: 50077)

Arg Ser Tyr Tyr Trp Gly (SEQ ID NO: 50552)

Asn Ile Tyr Tyr Ser Gly Ser Thr Tyr Tyr Asn Pro Ser Leu Lys Ser (SEQ ID NO: 50553)

His Gly Lys Asp Trp Gly Leu Asp Tyr (SEQ ID NO: 50554)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | L | Q | L | Q | E | S | G | P | G | L | V | K | P | S | E | T | L | S | L | T | C | T | V | S |
| 21-225_11F5_HC | . | . | . | . | . | . | . | . | . | . | . | . | . | . | . | . | . | . | . | . | . | . | . | . | . | . |
| 21-225_14B2_HC | . | . | . | . | . | . | . | . | . | . | . | . | . | . | . | . | . | . | . | . | . | . | . | . | . | . |
| 21-225_17F9_HC | . | . | . | . | . | . | . | . | . | . | . | . | . | . | . | . | . | . | . | . | . | . | . | . | . | . |
| 21-225_17H8_HC | . | . | . | . | . | . | . | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . | . | . | . | . | . | . | . |
| 21-225_21H3_HC | . | . | . | . | . | . | . | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . | . | . | . | . | . | . | . |
| 21-225_22H4_HC | . | . | . | . | . | . | . | . | . | . | . | . | . | . | . | . | . | . | . | . | . | . | . | . | . | . |
| 21-225_23A3_HC | . | . | . | . | . | . | . | . | . | . | . | . | . | . | . | . | . | . | . | . | . | . | . | . | . | . |
| 21-225_23C8_HC | . | . | . | . | . | . | . | . | . | . | . | . | . | X | . | . | . | . | . | . | . | . | . | . | . | . |
| 21-225_4F4_HC | . | . | . | . | . | . | . | . | . | . | . | . | . | . | . | . | . | . | . | . | . | . | . | . | . | . |
| 21-225_4H4_HC | . | . | . | . | . | . | . | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . | . | . | . | . | . | . | . |

FIGURE 57 (Continued)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | | H_CDR1 | | | | | | | | | | | | | | H_FR2 | | | |
| CONSENSUS | G | - | G | S | I | S | R | S | - | - | S | Y | Y | W | G | W | I | R | Q | P | P | G | K | G | L |
| 21-225_11F5_HC | . | . | . | . | . | . | . | . | . | . | . | . | . | . | . | . | . | . | . | . | . | . | . | . | . | . |
| 21-225_14B2_HC | . | . | . | . | . | N | . | . | . | . | . | . | . | . | . | . | . | . | . | . | . | . | . | . | . | . |
| 21-225_17F9_HC | . | . | . | . | . | . | . | . | . | . | . | . | . | . | . | . | . | . | . | . | . | . | . | . | . | . |
| 21-225_17H8_HC | . | . | . | . | . | . | . | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . | . | . | . | . | . | . | . |
| 21-225_21H3_HC | . | . | . | . | . | N | . | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . | . | . | . | . | Q | . | . |
| 21-225_22H4_HC | . | . | . | . | . | . | . | . | . | . | . | . | . | . | . | . | . | . | . | . | . | . | . | . | . | . |
| 21-225_23A3_HC | . | . | . | . | . | . | . | . | . | . | . | . | . | . | . | . | . | . | . | . | . | . | . | . | . | . |
| 21-225_23C8_HC | . | . | . | . | . | N | . | . | . | . | . | . | . | . | . | . | . | . | . | . | . | . | . | . | . | . |
| 21-225_4F4_HC | . | . | . | . | . | . | . | . | . | . | . | . | . | . | . | . | . | . | . | . | . | . | . | . | . | . |
| 21-225_4H4_HC | . | . | . | . | . | . | . | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | G | R | H | G | K | D | W | | | | | | | | | | | | | | | | | |
| 21-225_11F5_HC | S | . | A | . | . | . | . | . | . | . | . | . | . | . | . | . | . | . | . | . | . | . | . | . | . | . |
| 21-225_14B2_HC | S | . | A | . | . | . | . | . | . | . | . | . | . | . | . | . | . | . | . | . | . | . | . | . | . | . |
| 21-225_17F9_HC | . | . | A | . | . | . | . | . | . | . | . | . | . | . | . | . | . | . | . | . | . | . | . | . | . | . |
| 21-225_17H8_HC | . | . | . | . | . | . | . | . | . | . | . | . | . | . | . | . | . | . | . | . | . | . | . | . | . | . |
| 21-225_1F2_HC | . | . | A | . | . | . | . | . | . | . | . | . | . | . | . | . | . | . | . | . | . | . | . | . | . | . |
| 21-225_21H3_HC | . | . | . | . | . | . | . | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . | . | . | . | . | . | . | . |
| 21-225_22H4_HC | P | . | . | . | . | . | . | . | . | . | . | . | . | . | . | . | . | . | . | . | . | . | . | . | . | . |
| 21-225_23A3_HC | . | . | . | . | . | . | . | . | . | . | . | . | . | . | . | . | . | . | . | . | . | . | . | . | . | . |
| 21-225_23C8_HC | . | . | . | . | . | . | . | . | . | . | . | . | . | . | . | . | . | . | . | . | . | . | . | . | . | . |
| 21-225_4F4_HC | . | . | A | . | . | . | . | . | . | . | . | . | . | . | . | . | . | . | . | . | . | . | . | . | . | . |
| 21-225_4H4_HC | . | . | . | . | . | . | . | . | . | . | . | . | . | . | . | . | . | . | . | . | . | . | . | . | . | . |
| 21-225_5H7_HC | S | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | . | . | . | G | L | D | Y | W | G | Q | G | T | L | V | T | V | S | S |
| 21-225_11F5_HC | . | . | . | . | . | . | . | N | . | . | . | . | A | . | . | . | . | . | . |
| 21-225_14B2_HC | . | . | . | . | . | . | . | . | . | . | . | . | . | . | . | . | . | . | . |
| 21-225_17F9_HC | . | . | . | . | . | . | . | . | . | . | . | . | . | . | . | . | . | . | . |
| 21-225_17H8_HC | . | . | . | . | . | . | . | . | . | . | . | . | . | . | . | . | . | . | . |
| 21-225_1F2_HC | . | . | . | . | . | . | . | . | . | . | . | . | . | . | . | . | . | . | . |
| 21-225_21H3_HC | . | . | . | . | . | . | . | . | . | . | . | . | . | . | . | . | . | . | . |
| 21-225_22G8_HC | . | . | . | . | . | . | . | . | . | . | . | . | . | . | . | . | . | . | . |
| 21-225_22H4_HC | . | . | . | . | . | . | . | & | . | . | . | . | . | . | . | . | . | . | . |
| 21-225_23A3_HC | . | . | . | . | . | . | . | . | . | . | . | . | . | . | . | . | . | . | . |
| 21-225_23C8_HC | . | . | . | . | . | . | . | . | . | . | . | . | . | . | . | . | . | . | . |
| 21-225_4F4_HC | . | . | . | . | . | . | . | . | . | . | . | . | . | . | . | ∞ | . | . | . |
| 21-225_4H4_HC | . | . | . | . | . | . | . | . | . | . | . | . | . | . | . | . | . | . | . |
| 21-225_5H7_HC | . | . | . | . | . | . | . | . | . | . | . | . | . | . | . | . | . | . | . |

FIGURE 57 (Continued)

Table 78. Consensus 44 - VH[[1-02/D7[7-27]RF1/JH4 (SEQ ID NO: 50295):

QVQLVQS-GAEVKKPGASVKVSCKASG-YTFTG-----YYMHWVRQAPGQGLEWMGWIKPN----
SGGTNQAQKFQGRVTMTRDTSISTAYMELSGLRSDDTAVYYCARAPGTAAAG---------TWGYFDYWGQGTLVTVSS wherein:

M at position 41 can be substituted with I

K in position 59 can be substituted with N

N in position 61 can be substituted with K

Q in position 70 can be substituted with S, H, N or Y

A in position 71 can be substituted with V

T in position 112 can be substituted with K or I

A in position 113 can be substituted with V

A in position 114 can be substituted with P

A in position 115 can be substituted with T

T in position 132 can be substituted with S

Y in position 135 can be substituted with F or C

Gly Tyr Tyr Xaa His (SEQ ID NO: 50078)

Trp Ile Xaa Pro Xaa Ser Gly Gly Thr Asn Xaa Xaa Gln Lys Phe Gln Gly (SEQ ID NO: 50079)

Ala Pro Gly Xaa Xaa Xaa Gly Xaa Xaa Trp Gly Xaa Phe Asp Tyr (SEQ ID NO: 50080)

Gly Tyr Tyr Met His (SEQ ID NO: 50555)

Trp Ile Lys Pro Asn Ser Gly Gly Thr Asn Gln Ala Gln Lys Phe Gln Gly (SEQ ID NO: 50556)

Ala Pro Gly Thr Ala Ala Ala Gly Thr Trp Gly Tyr Phe Asp Tyr (SEQ ID NO: 50557)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | V | Q | L | V | Q | S | - | G | A | E | V | K | K | P | G | A | S | V | K | V | S | C | K | A | S |
| 21-225_62G7_HC | . | . | . | . | . | . | . | . | . | . | . | . | . | . | . | . | . | . | . | . | . | . | . | . | . | . |
| 21-225_64H10_HC | . | . | . | . | . | . | . | . | . | . | . | . | . | . | . | . | . | . | . | . | . | . | . | . | . | . |
| 21-225_65G3_HC | . | . | . | . | . | . | . | . | . | . | . | . | . | . | . | . | . | . | . | . | . | . | . | . | . | . |
| 21-225_66A7_HC | . | . | . | . | . | . | . | . | . | . | . | . | . | . | . | . | . | . | . | . | . | . | . | . | . | . |
| 21-225_66B1_HC | . | . | . | . | . | . | . | . | . | . | . | . | . | . | . | . | . | . | . | . | . | . | . | . | . | . |
| 21-225_67H4_HC | . | . | . | . | . | . | . | . | . | . | . | . | . | . | . | . | . | . | . | . | . | . | . | . | . | . |
| 21-225_70A12_HC | . | . | . | . | . | . | . | . | . | . | . | . | . | . | . | . | . | . | . | . | . | . | . | . | . | . |
| 21-225_70D6_HC | . | . | . | . | . | . | . | . | . | . | . | . | . | . | . | . | . | . | . | . | . | . | . | . | . | . |
| 21-225_70G9_HC | . | . | . | . | . | . | . | . | . | . | . | . | . | . | . | . | . | . | . | . | . | . | . | . | . | . |
| 21-225_71A7_HC | . | . | . | . | . | . | . | . | . | . | . | . | . | . | . | . | . | . | . | . | . | . | . | . | . | . |
| 21-225_71B7_HC | . | . | . | . | . | . | . | . | . | . | . | . | . | . | . | . | . | . | . | . | . | . | . | . | . | . |
| 21-225_73A3_HC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | E | W | M | G | W | I | S | P | N | * | * | * | S | G | G | T | N | Q | A | Q | K | F | Q | Q | R | V |
| | | | | | | | | | | | | | | H_CDR2 | | | | | | | | | | | | |
| CONSENSUS | E | W | M | G | W | I | S | P | N | . | . | . | S | G | G | T | N | Q | A | Q | K | F | Q | Q | R | V |
| 21-225_62G7_HC | . | . | . | . | . | . | K | . | K | . | . | . | . | . | . | . | . | . | . | . | . | . | . | . | . | . |
| 21-225_64H10_HC | . | . | . | . | . | . | K | . | . | . | . | . | . | . | . | . | . | S | . | . | . | . | . | . | . | . |
| 21-225_65G3_HC | . | . | . | . | . | . | N | . | . | . | . | . | . | . | . | . | . | . | . | . | . | . | . | . | . | . |
| 21-225_66A7_HC | . | . | . | . | . | . | K | . | . | . | . | . | . | . | . | . | . | N | . | . | . | . | . | . | . | . |
| 21-225_66B1_HC | . | . | . | . | . | . | N | . | . | . | . | . | . | . | . | . | . | . | . | . | . | . | . | . | . | . |
| 21-225_67H4_HC | . | . | . | . | . | . | K | . | K | . | . | . | . | . | . | . | . | . | . | . | . | . | . | . | . | . |
| 21-225_70A12_HC | . | . | . | . | . | . | N | . | . | . | . | . | . | . | . | . | . | S | . | . | . | . | . | . | . | . |
| 21-225_70D6_HC | . | . | . | . | . | . | N | . | K | . | . | . | . | . | . | . | . | Y | . | . | . | . | . | . | . | . |
| 21-225_70G9_HC | . | . | . | . | . | . | N | . | . | . | . | . | . | . | . | . | . | S | V | . | . | . | . | . | . | . |
| 21-225_71A7_HC | . | . | . | . | . | . | N | . | K | . | . | . | . | . | . | . | . | . | . | . | . | . | . | . | . | . |
| 21-225_71B7_HC | . | . | . | . | . | . | N | . | . | . | . | . | . | . | . | . | . | . | V | . | . | . | . | . | . | . |
| 21-225_73A3_HC | D | . | . | . | . | . | N | . | K | . | . | . | . | . | . | . | . | H | V | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | H_FR4 | | | | | | | |
| CONSENSUS | - | T | W | G | Y | F | D | Y | W | G | Q | G | T | L | V | T | V | S | S |
| 21-225_62G7_HC | . | . | . | . | . | . | . | . | . | . | . | . | . | . | . | . | . | . | . |
| 21-225_84H10_HC | . | . | . | . | . | . | . | . | . | . | . | . | . | . | . | . | . | . | . |
| 21-225_85G3_HC | . | . | . | . | . | . | . | . | . | . | . | . | . | . | . | . | . | . | . |
| 21-225_66A7_HC | . | . | . | . | . | . | . | . | . | . | . | . | . | . | . | . | . | . | . |
| 21-225_86B1_HC | . | . | . | . | . | . | . | . | . | . | . | . | . | . | . | . | . | . | . |
| 21-225_67H4_HC | . | . | . | . | . | . | . | . | . | . | . | . | . | . | . | . | . | . | . |
| 21-225_70A12_HC | . | . | . | . | . | . | . | . | . | . | . | . | . | . | . | . | . | . | . |
| 21-225_70D8_HC | . | . | . | . | F | . | . | . | . | . | . | . | . | . | . | . | . | . | . |
| 21-225_70G9_HC | . | S | . | . | . | . | . | . | . | . | . | . | . | . | . | . | . | . | . |
| 21-225_71A7_HC | . | . | . | . | F | . | . | . | . | . | . | . | . | . | . | . | . | . | . |
| 21-225_71B7_HC | . | S | . | . | . | . | . | . | . | . | . | . | . | . | . | . | . | . | . |
| 21-225_73A3_HC | . | . | . | . | C | . | . | . | . | . | . | . | . | . | . | . | . | . | . |

FIGURE 57 (Continued)

Table 79. Consensus 45 - VH2|2-05/D6|6-6|RF2/JH4 (SEQ ID NO: 50296):

QITLKES-GPTLVKPTQTLTLTCTFSG-FSLSTG---GVGVGWIRQPPGKALEWLALIYW----DDDKRYSPSLKSRLTITKDTSKNQVVLTMTNMDPVDTATYYCAHLIAV----------AFDYWGQGTLVTVSS wherein:

G in position 34 can be substituted with S

L in position 57 can be substituted with F

D in position 65 can be substituted with H, N, K or S

K in position 68 can be substituted with E

K in position 75 can be substituted with R

L in position 109 can be substituted with I or A

I in position 110 can be substituted with V or A

A in position 135 can be substituted with S

F in position 136 can be substituted with C

Thr Xaa Gly Val Gly Val Gly (SEQ ID NO: 50081)

Xaa Ile Tyr Trp Xaa Asp Xaa Arg Tyr Ser Pro Ser Leu Xaa Ser (SEQ ID NO: 50082)

Xaa Xaa Ala Val Xaa Xaa Asp Tyr (SEQ ID NO: 50083)

Thr Gly Gly Val Gly Val Gly (SEQ ID NO: 50558)

Leu Ile Tyr Trp Asp Asp Asp Lys Arg Tyr Ser Pro Ser Leu Lys Ser (SEQ ID NO: 50559)

Leu Ile Ala Val Ala Phe Asp Tyr (SEQ ID NO: 50560)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | A | H | L | I | A | V | | | | | | | | | | | H_CDR3 | | | | | | | |
| 21-225_10B10_HC | . | . | . | . | - | A | . | . | . | . | . | . | . | . | . | . | . | . | . | . | . | . | . | . | . | . |
| 21-225_16H11_HC | . | . | . | . | - | V | . | . | . | . | . | . | . | . | . | . | . | . | . | . | . | . | . | . | . | . |
| 21-225_17F5_HC | S | . | . | . | - | . | . | . | . | . | . | . | . | . | . | . | . | . | . | . | . | . | . | . | . | . |
| 21-225_30H6_HC | . | . | . | . | . | . | . | . | . | . | . | . | . | . | . | . | . | . | . | . | . | . | . | . | . | . |
| 21-225_31C2_HC | . | . | . | . | . | . | . | . | . | . | . | . | . | . | . | . | . | . | . | . | . | . | . | . | . | . |
| 21-225_57D9_HC | . | . | . | . | A | V | . | . | . | . | . | . | . | . | . | . | . | . | . | . | . | . | . | . | . | . |
| 21-225_60D6_HC | . | . | . | . | A | V | . | . | . | . | . | . | . | . | . | . | . | . | . | . | . | . | . | . | . | . |
| 21-225_74G9_HC | . | . | . | . | . | . | . | . | . | . | . | . | . | . | . | . | . | . | . | . | . | . | . | . | . | . |
| 21-225_76F11_HC | . | . | . | . | . | . | . | . | . | . | . | . | . | . | . | . | . | . | . | . | . | . | . | . | . | . |
| 21-225_76B4_HC | . | . | . | . | . | . | . | . | . | . | . | . | . | . | . | . | . | . | . | . | . | . | . | . | . | . |
| 21-225_77A2_HC | . | . | . | . | . | . | . | . | . | . | . | . | . | . | . | . | . | . | . | . | . | . | . | . | . | . |
| 21-225_98B5_HC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 A | 136 F | 137 D | 138 Y | 139 W | 140 G | 141 Q | 142 G | 143 T | 144 L | 145 V | 146 T | 147 V | 148 S | 149 S |
|---|---|---|---|---|---|---|---|---|---|---|---|---|---|---|---|---|---|---|---|
| CONSENSUS | | | | | | | | | | | | | | | | | | | |
| 21-225_10B10_HC | | | | | | | | | | | | | | | | | | | |
| 21-225_15H11_HC | | | | | | | | | | | | | | | | | | | |
| 21-225_17F5_HC | | | | | | | | | | | | | | | | | | | |
| 21-225_30H6_HC | | | | | | | | | | | | | | | | | | | |
| 21-225_31C2_HC | | | | | S | | | | | | | | | | | | | | |
| 21-225_57D9_HC | | | | | S | | | | | | | | A | | | | | | |
| 21-225_60D6_HC | | | | | S | | | | | | | | | | | | | | |
| 21-225_74G9_HC | | | | | | | | | | | | | | | | | | | |
| 21-225_75F11_HC | | | | | | | | | | | | | | | | | | | |
| 21-225_76B4_HC | | | | | | | | | | | | | | | | | | | |
| 21-225_77A2_HC | | | | | | | | | | | | | | | | | | | |
| 21-225_96B5_HC | | | | | | G | | | | | | | | | | | | | |

FIGURE 57 (Continued)

Table 80. Consensus 46 - VH3|3-33/D3|3-22|RF2/JH4 (SEQ ID NO: 50297):

QVQLVES-GGGVVQPGRSLRLSCAASG-FTFSS------YGMHWVRQAPGKGLEWVAIIWYD---
GSYKYYADSVKGRFTISRDNSKNTLYLQMNSLRAEDTAVYYCAREAYDFW--------SGYFDYWGQGTLVTVSS wherein:

S at position 33 can be substituted with N or T

I at position 57 can be substituted with V

Y at position 67 can be substituted with N

A at position 71 can be substituted with V

A at position 110 can be substituted with G, R, or N

Y at position 135 can be substituted with F or H

F at position 136 can be substituted with L, Y, or W

D at position 137 can be substituted with G

Y at position 138 can be substituted with S

Xaa Tyr Gly Met His (SEQ ID NO: 50084)

Xaa Ile Trp Tyr Asp Gly Ser Xaa Lys Tyr Tyr Xaa Asp Ser Val Lys Gly (SEQ ID NO: 50085)

Glu Xaa Tyr Asp Phe Trp Ser Gly Xaa Xaa Xaa Xaa (SEQ ID NO: 50086)

Ser Tyr Gly Met His (SEQ ID NO: 50561)

Ile Ile Trp Tyr Asp Gly Ser Tyr Lys Tyr Tyr Ala Asp Ser Val Lys Gly (SEQ ID NO: 50562)

Glu Ala Tyr Asp Phe Trp Ser Gly Tyr Phe Asp Tyr (SEQ ID NO: 50563)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | V | Q | L | V | E | S | - | G | G | G | V | V | Q | P | G | R | S | L | R | L | S | C | A | A | S |
| 21-225_152C11_HC | . | . | . | . | . | . | . | . | . | . | . | . | . | . | . | . | . | . | . | . | . | . | . | . | . | . |
| 21-225_152F6_HC | . | . | . | . | . | . | . | . | . | . | . | . | . | . | . | . | . | . | . | . | . | . | . | . | . | . |
| 21-225_153D2_HC | . | . | . | . | . | . | . | . | . | . | . | . | . | . | . | . | . | . | . | . | . | . | . | . | . | . |
| 21-225_157G8_HC | . | . | . | . | . | . | . | . | . | . | . | . | . | . | . | . | . | . | . | . | . | . | . | . | . | . |
| 21-225_160B1_HC | . | . | . | . | . | . | . | . | . | . | . | . | . | . | . | . | . | . | . | . | . | . | . | . | . | . |
| 21-225_172B7_HC | . | . | . | . | . | . | . | . | . | . | . | . | . | . | . | . | . | . | . | . | . | . | . | . | . | . |
| 21-225_173A11_HC | . | . | . | . | . | . | . | . | . | . | . | . | . | . | . | . | . | . | . | . | . | . | . | . | . | . |
| 21-225_178G10_HC | . | . | . | . | . | . | . | . | . | . | . | . | . | . | . | . | . | . | . | . | . | . | . | . | . | . |
| 21-225_188G11_HC | . | . | . | . | . | . | . | . | . | . | . | . | . | . | . | . | . | . | . | . | . | . | . | . | . | . |
| 21-225_226E7_HC | . | . | . | . | . | . | . | . | . | . | . | . | . | . | . | . | . | . | . | . | . | . | . | . | . | . |
| 21-225_25H9_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | | H_CDR1 | | | | | | | | | H_FR2 | | | | | | | | | | |
| CONSENSUS | G | - | F | T | F | S | S | - | - | - | - | Y | G | M | H | W | V | R | Q | A | P | G | K | G | L |
| 21-225_152C11_HC | . | . | . | . | . | S | N | . | . | . | . | . | . | . | . | . | . | . | . | . | . | . | . | . | . | . |
| 21-225_152F6_HC | . | . | . | . | . | . | . | . | . | . | . | . | . | . | . | . | . | . | . | . | . | . | . | . | . | . |
| 21-225_153D2_HC | . | . | . | . | . | . | N | . | . | . | . | . | . | . | . | . | . | . | . | . | . | . | . | . | . | . |
| 21-225_157G8_HC | . | . | . | . | . | . | . | . | . | . | . | . | . | . | . | . | . | . | . | . | . | . | . | . | . | . |
| 21-225_160B1_HC | . | . | . | . | . | . | N | . | . | . | . | . | . | . | . | . | . | . | . | . | . | . | . | . | . | . |
| 21-225_172B7_HC | . | . | . | . | . | . | . | . | . | . | . | . | . | . | . | . | . | . | . | . | . | . | . | . | . | . |
| 21-225_173A11_HC | . | . | . | . | . | . | T | . | . | . | . | . | . | . | . | . | . | . | . | . | . | . | . | . | . | . |
| 21-225_178G10_HC | . | . | . | . | . | . | . | . | . | . | . | . | . | . | . | . | . | . | . | . | . | . | . | . | . | . |
| 21-225_188G11_HC | . | . | . | P | . | . | T | . | . | . | . | . | . | . | . | . | . | . | . | . | . | . | . | . | . | . |
| 21-225_226E7_HC | . | . | . | . | . | . | N | . | . | . | . | . | . | . | . | . | . | . | . | . | . | . | . | . | . | . |
| 21-225_25H9_HC | . | . | . | . | . | N | . | . | . | . | . | . | . | . | . | . | . | . | . | . | . | . | . | . | . | . |

Table 81. Consensus 47 - VH3|3-33/D5|5-18|RF3/JH6 (SEQ ID NO: 50298):

QVQLVES-GGGVVQPGRSLRLSCAASG-FTFSS----YGMHWVRQAPGKGLEWVAVIWYD---GSNKYYADSVKGRFTISRDNSKNTLYLQMNSLRAEDTAVYYCARDRDYGD............YGMDVWGQGTTVTVSS wherein:

M at position 41 can be substituted with L

Y at position 69 can be substituted with N

A at position 71 can be substituted with E

D at position 109 can be substituted with W

R at position 110 can be substituted with R, G or Y

D at position 111 can be substituted with S or Y

G at position 113 can be substituted with Y

D at position 114 can be substituted with Y null (-) at position 115 can be substituted with P null (-) at position 116 can be substituted with P null (-) at position 117 can be substituted with Y null (-) at position 131 can be substituted with Y null (-) at position 132 can be substituted with Y null (-) at position 133 can be substituted with Y Y at position 134 can be substituted with D Ser Tyr Gly Xaa His (SEQ ID NO: 50087)

Val Ile Trp Tyr Asp Gly Ser Asn Lys Xaa Tyr Xaa Asp Ser Val Lys Gly (SEQ ID NO: 50088)

FIGURE 57 (Continued)

Xaa Xaa Xaa Tyr Xaa Xaa Xaa Xaa Xaa Xaa Xaa Gly Met Asp Val (SEQ ID NO: 50089)

Ser Tyr Gly Met His (SEQ ID NO: 50564)

Val Ile Trp Tyr Asp Gly Ser Asn Lys Tyr Tyr Ala Asp Ser Val Lys Gly (SEQ ID NO: 50565)

Asp Arg Asp Tyr Gly Asp Tyr Gly Met Asp Val (SEQ ID NO: 50566)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| CONSENSUS | E | W | V | A | V | I | W | Y | D | - | - | G | S | N | K | Y | Y | A | D | S | V | K | G | R | F |
| 21-225_147B9_HC | . | . | . | . | . | . | . | . | . | . | . | . | . | . | . | . | . | . | . | . | . | . | . | . | . | . |
| 21-225_148C8_HC | . | . | . | . | . | . | . | . | . | . | . | . | . | . | . | . | . | . | . | . | . | . | . | . | . | . |
| 21-225_149A11_HC | . | . | . | . | . | . | . | . | . | . | . | . | . | . | . | . | . | . | . | . | . | . | . | . | . | . |
| 21-225_155E10_HC | . | . | . | . | . | . | . | . | . | . | . | . | . | . | . | . | . | . | . | . | . | . | . | . | . | . |
| 21-225_190C3_HC | . | . | . | . | . | . | . | . | . | . | . | . | . | . | . | . | . | . | . | . | . | . | . | . | . | . |
| 21-225_190D8_HC | . | . | . | . | . | . | . | . | . | . | . | . | . | . | . | . | . | . | . | . | . | . | . | . | . | . |
| 21-225_211A3_HC | . | . | . | . | . | . | . | . | . | . | . | . | . | . | . | . | N | . | E | . | . | . | . | . | . | . |
| 21-225_212H11_HC | . | . | . | . | . | . | . | . | . | . | . | . | . | . | . | . | N | . | E | . | . | . | . | . | . | . |
| 21-225_213E5_HC | . | . | . | . | . | . | . | . | . | . | . | . | . | . | . | . | N | . | E | . | . | . | . | . | . | . |
| 21-225_217B10_HC | . | . | . | . | . | . | . | . | . | . | . | . | . | . | . | . | N | . | E | . | . | . | . | . | . | . |
| 21-225_218G4_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_147B9_HC | . | . | . | . | . | . | . | . | . | . | . | . | . | . | . | . | . | . | . | . | . | . | . | . | . | . |
| 21-225_148C8_HC | . | . | . | . | . | . | . | . | . | . | . | . | . | . | . | . | . | . | . | . | . | . | . | . | . | . |
| 21-225_149A11_HC | . | . | . | . | . | . | . | . | . | . | . | . | . | . | . | . | . | . | . | . | . | . | . | . | . | . |
| 21-225_155E10_HC | . | . | . | . | . | . | . | . | . | . | . | . | . | . | . | . | . | . | . | . | . | . | . | . | . | . |
| 21-225_190C3_HC | . | . | . | . | . | . | . | . | . | . | . | . | . | . | . | . | . | . | . | . | . | . | . | . | . | . |
| 21-225_190D8_HC | . | . | . | . | . | . | . | . | . | . | . | . | . | . | . | . | . | . | . | V | . | . | . | . | . | . |
| 21-225_211A3_HC | . | . | . | . | . | . | . | . | . | . | . | . | . | . | . | . | . | . | . | . | . | . | . | . | . | . |
| 21-225_212H11_HC | . | . | . | . | . | . | . | . | . | . | . | . | . | . | . | . | . | . | . | . | . | . | . | . | . | . |
| 21-225_213E5_HC | . | . | . | . | . | . | . | . | . | . | . | . | . | . | . | . | . | . | . | . | . | . | . | . | . | . |
| 21-225_217B10_HC | . | . | . | . | . | . | . | . | . | . | . | . | . | . | . | . | . | . | . | . | . | . | . | . | . | . |
| 21-225_218G4_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | H_CDR3 | | | | | | | |
| CONSENSUS | Y | C | A | R | D | | | Y | G | | | | | | | | | | | | | | | | | |
| 21-225_147B9_HC | . | . | . | . | . | R | D | . | . | D | P | P | Y | . | . | . | . | . | . | . | . | . | . | . | . | . |
| 21-225_148C8_HC | . | . | . | . | . | R | D | . | . | D | P | P | Y | . | . | . | . | . | . | . | . | . | . | . | . | . |
| 21-225_149A11_HC | . | . | . | . | . | R | D | . | . | D | P | P | Y | . | . | . | . | . | . | . | . | . | . | . | . | . |
| 21-225_155E10_HC | . | . | . | . | W | Y | Y | . | Y | D | . | . | . | . | . | . | . | . | . | . | . | . | . | . | . | . |
| 21-225_180C3_HC | . | . | . | . | W | Y | Y | . | Y | . | . | . | . | . | . | . | . | . | . | . | . | . | . | . | . | . |
| 21-225_190D8_HC | . | . | . | . | . | G | S | . | . | Y | . | . | . | . | . | . | . | . | . | . | . | . | . | . | . | . |
| 21-225_211A3_HC | . | . | . | . | . | G | S | . | . | Y | . | . | . | . | . | . | . | . | . | . | . | . | . | . | . | . |
| 21-225_212H11_HC | . | . | . | . | . | G | S | . | . | Y | . | . | . | . | . | . | . | . | . | . | . | . | . | . | . | . |
| 21-225_213E5_HC | . | . | . | N | W | Y | Y | . | Y | . | . | . | . | . | . | . | . | . | . | . | . | . | . | . | . | . |
| 21-225_217B10_HC | . | . | . | . | . | . | . | . | . | . | . | . | . | . | . | . | . | . | . | . | . | . | . | . | . | . |
| 21-225_218G4_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | . | Y | . | Y | G | M | D | V | W | G | Q | G | T | T | V | T | V | S | S |
| 21-225_147B9_HC | Y | Y | Y | . | . | . | . | . | . | . | . | . | . | . | . | . | . | . | . |
| 21-225_148C8_HC | Y | Y | Y | . | . | . | . | . | . | . | . | . | . | . | . | . | . | . | . |
| 21-225_149A11_HC | Y | Y | Y | . | . | . | . | . | . | . | . | . | . | . | . | . | . | . | . |
| 21-225_155E10_HC | Y | Y | Y | . | . | . | . | . | . | . | . | . | . | . | . | . | . | . | . |
| 21-225_180C3_HC | . | . | . | . | . | . | . | . | . | . | . | . | . | . | . | . | . | . | . |
| 21-225_190D8_HC | . | . | . | . | . | . | . | . | . | . | . | . | . | . | . | . | . | . | . |
| 21-225_211A3_HC | . | . | . | D | . | . | . | . | . | . | . | . | . | . | . | . | . | . | . |
| 21-225_212H11_HC | . | . | . | D | . | . | . | . | . | . | . | . | . | . | . | . | . | . | . |
| 21-225_213E5_HC | . | . | . | D | . | . | . | . | . | . | . | . | . | . | . | . | . | . | . |
| 21-225_217B10_HC | . | . | . | D | . | . | . | . | . | . | . | . | . | . | . | . | . | . | . |
| 21-225_218G4_HC | . | . | . | . | . | . | . | . | . | . | . | . | . | . | . | . | . | . | . |

FIGURE 57 (Continued)

Table 82. Consensus 48 - VH3|3-23/D4|4-17|RF2/JH6 (SEQ ID NO: 50299):

EVQLLES-GGGLVQPGGSLRLSCAASG-FTFSS-----YAMSWVRQAPGKGLEWVSAISGS-----GGNTFYADSVKGRFTISRDNSKNTLYLQMNSLRAEDTAVYYCAKLGKDYY..........YYGMDVWGQGTTVTVSS wherein:

S at position 33 can be substituted with N or T

Y at position 39 can be substituted with S

A at position 40 can be substituted with V

S at position 42 can be substituted with T or N

A at position 57 can be substituted with G

I at position 58 can be substituted with S or V

S at position 59 can be substituted with V

S at position 61 can be substituted with R

G at position 66 can be substituted with A, S or V

N at position 67 can be substituted with R or K

F at position 69 can be substituted with Y

Y at position 70 can be substituted with N

A at position 71 can be substituted with T

K at position 75 can be substituted with T

L at position 109 can be substituted with D or E

G at position 110 can be substituted with R

K at position 111 can be substituted with G or I

FIGURE 57 (Continued)

D at position 112 can be substituted with Q or Y

Y at position 113 can be substituted with W

Y at position 114 can be substituted with H or L

Y at position 133 can be substituted with null (-), I, or L

Y at position 134 can be substituted with G

M at position 136 can be substituted with V

Xaa Xaa Xaa Met Xaa (SEQ ID NO: 50090)

Xaa Xaa Xaa Gly Xaa Gly Xaa Xaa Thr Xaa Xaa Xaa Asp Ser Val Xaa Gly (SEQ ID NO: 50091)

Xaa Xaa Xaa Xaa Xaa Xaa Xaa Gly Xaa Asp Val (SEQ ID NO: 50092)

Ser Tyr Ala Met Ser (SEQ ID NO: 50567)

Ala Ile Ser Gly Ser Gly Gly Asn Thr Phe Tyr Ala Asp Ser Val Lys Gly (SEQ ID NO: 50568)

Leu Gly Lys Asp Tyr Tyr Tyr Tyr Gly Met Asp Val (SEQ ID NO: 50569)

Table 83. Consensus 49 - VH3|3-23/D7|7-27|RF1/JH4 (SEQ ID NO: 50300):

EVQLLES-GGGLVQPGGSLRLSCAASG-FTFSS-----YVMSWVRQAPGKGLEWVSAMSGS---
GGRTYYADSVKGRFTISRDNSKNTLYLQMNSLRAEDTAVYYCAKLTA---------------FDYWGQGTLVTVSS wherein:

V at position 40 can be substituted with A

S at position 42 can be substituted with N

A at position 57 can be substituted with G, T or S

M at position 58 can be substituted with I or T

G at position 66 can be substituted with N or V

R at position 67 can be substituted with N or W

Y at position 69 can be substituted with F or N

K at position 75 can be substituted with N

G at position 76 can be substituted with D

L at position 109 can be substituted with V, Y or F

T at position 110 can be substituted with E, F or G

A at position 111 can be substituted with G, L, W, null (-) or F null (-) at position 112 can be substituted with G or M null (-) at position 113 can be substituted with V null (-) at position 114 can be substituted with G null (-) at position 133 can be substituted with A null (-) at position 134 can be substituted with G FIGURE 57 (Continued)

null (-) at position 135 can be substituted with I or F

F at position 136 can be substituted with N or null (-)

D at position 137 can be substituted with G or I

Y at position 138 can be substituted with D

Ser Tyr Xaa Met Xaa (SEQ ID NO: 50093)

Xaa Xaa Ser Gly Ser Gly Xaa Xaa Thr Xaa Tyr Ala Asp Ser Val Xaa Xaa (SEQ ID NO: 50094)

Xaa Xaa Xaa Xaa Xaa Xaa Xaa Xaa Xaa Xaa Xaa (SEQ ID NO: 50095)

Ser Tyr Val Met Ser (SEQ ID NO: 50570)

Ala Met Ser Gly Ser Gly Arg Thr Tyr Tyr Ala Asp Ser Val Lys Gly (SEQ ID NO: 50571)

Leu Thr Ala Phe Asp Tyr (SEQ ID NO: 50572)

Table 84. Consensus 50 - VH3|3-30.3/D5|5-24|RF3/JH6 (SEQ ID NO: 50301):

QVQLVES-GGGVVQPGRSLRLSCAASG-FTFSS-----YGMHWVRQAPGKGLEWVAIISYA---
GSNKYYADSVKGRFTISRDNSKNTLYLQMNSLRAEDTAVYYCVRRGYSYG--------GYGMDVWGQGTTVTVSS wherein:

S at position 33 can be substituted with Y

M at position 41 can be substituted with L

I at position 57 can be substituted with V

A at position 61 can be substituted with G, D, S or V

S at position 66 can be substituted with I, N, R or T

K at position 68 can be substituted with N or Q

Y at position 69 can be substituted with S, D or H

Y at position 70 can be substituted with S

R at position 109 can be substituted with E

G at position 110 can be substituted with D

Y at position 111 can be substituted with R

S at position 112 can be substituted with Y

Y at position 113 can be substituted with C

G at position 114 can be substituted with S null (-) at position 115 can be substituted with G null (-) at position 116 can be substituted with T null (-) at position 117 can be substituted with S FIGURE 57 (Continued)

null (-) at position 118 can be substituted with C
null (-) at position 129 can be substituted with P
null (-) at position 130 can be substituted with Y
null (-) at position 131 can be substituted with Y
null (-) at position 132 can be substituted with Y
G at position 133 can be substituted with Y
Xaa Tyr Gly Xaa His (SEQ ID NO: 50096)
Xaa Ile Ser Tyr Xaa Gly Xaa Asn Xaa Xaa Xaa Ala Asp Ser Val Lys Gly (SEQ ID NO: 50097)
Xaa Xaa Xaa Xaa Xaa Xaa Xaa Xaa Xaa Xaa Xaa Xaa Tyr Gly Met Asp Val (SEQ ID NO: 50098)
Ser Tyr Gly Met His (SEQ ID NO: 50573)
Ile Ile Ser Tyr Ala Gly Ser Asn Lys Tyr Tyr Ala Asp Ser Val Lys Gly (SEQ ID NO: 50574)
Arg Gly Tyr Ser Tyr Gly Gly Tyr Gly Met Asp Val (SEQ ID NO: 50575)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| | | | | | | | | | | | | | | | | H_FR1 | | | | | | | | | |
| CONSENSUS | Q | V | Q | L | V | E | S | - | G | G | G | V | V | Q | P | G | R | S | L | R | L | S | C | A | A |
| 21-225_11A2_HC | . | . | . | . | . | . | . | . | . | . | . | . | . | . | . | . | . | . | . | . | . | . | . | . | . |
| 21-225_13A1_HC | . | . | . | . | . | . | . | . | . | . | . | . | . | . | . | . | . | . | . | . | . | . | . | . | . |
| 21-225_15C2_HC | . | . | . | . | . | . | . | . | . | . | . | . | . | . | . | . | . | . | . | . | . | . | . | . | . |
| 21-225_15F10_HC | . | . | . | . | . | . | . | . | . | . | . | . | . | . | . | . | . | . | . | . | . | . | . | V | . |
| 21-225_16B3_HC | . | . | . | . | . | . | . | . | . | . | . | . | . | . | . | . | . | . | . | . | . | . | . | . | . |
| 21-225_1B12_HC | . | . | . | . | . | . | . | . | . | . | . | . | . | . | . | . | . | . | . | . | . | . | . | . | . |
| 21-225_225B11_HC | . | . | . | . | . | . | . | . | . | . | . | . | . | . | . | . | . | . | . | . | . | . | . | . | . |
| 21-225_24D6_HC | . | . | . | . | . | . | . | . | . | . | . | . | . | . | . | . | . | . | . | . | . | . | . | . | . |
| 21-225_45F6_HC | . | . | . | . | . | . | . | . | . | . | . | . | . | . | . | . | . | . | . | . | . | . | . | . | . |
| 21-225_5E8_HC | . | . | . | . | . | . | . | . | . | . | . | . | . | . | . | . | . | . | . | . | . | . | . | . | . |

| Reference # | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 |
|---|---|---|---|---|---|---|---|---|---|---|---|---|---|---|---|---|---|---|---|---|---|---|---|---|---|
| | | | | | | | | H_CDR1 | | | | | | | | | | | | | | H_FR2 | | | |
| CONSENSUS | S | G | - | F | T | F | S | S | - | - | - | - | Y | G | M | H | W | V | R | Q | A | P | G | K | K |
| 21-225_11A2_HC | . | . | . | . | . | . | . | . | . | . | . | . | . | . | . | . | . | . | . | . | . | . | . | . | . |
| 21-225_13A1_HC | . | . | . | . | . | . | . | . | . | . | . | . | . | . | . | . | . | . | . | . | . | . | . | . | . |
| 21-225_15C2_HC | . | . | . | . | . | . | . | . | . | . | . | . | . | . | . | . | . | . | . | . | . | . | . | . | . |
| 21-225_15F10_HC | . | . | . | . | . | . | . | . | . | . | . | . | . | . | . | . | . | . | . | . | . | . | . | . | . |
| 21-225_16B3_HC | . | . | . | . | . | . | . | . | . | . | . | . | . | . | . | . | . | . | . | . | . | . | . | . | . |
| 21-225_1B12_HC | . | . | . | . | . | . | . | . | . | . | . | . | . | . | . | . | . | . | . | . | . | . | . | . | . |
| 21-225_225B11_HC | . | . | . | . | . | . | . | . | . | . | . | . | . | . | . | . | . | . | . | . | . | . | . | . | . |
| 21-225_24D6_HC | . | . | . | . | . | . | . | Y | . | . | . | . | . | . | . | . | . | . | . | . | . | . | . | . | . |
| 21-225_45F6_HC | . | . | . | . | . | . | . | . | . | . | . | . | . | . | . | L | . | . | . | . | . | V | . | . | . |
| 21-225_5E8_HC | . | . | . | . | . | . | . | . | . | . | . | . | . | . | . | . | . | . | . | . | . | . | . | . | . |

| Reference # | 101 | 102 | 103 | 104 | 105 | 106 | 107 | 108 | 109 | 110 | 111 | 112 | 113 | 114 | 115 | 116 | 117 | 118 | 119 | 120 | 121 | 122 | 123 | 124 | 125 |
|---|---|---|---|---|---|---|---|---|---|---|---|---|---|---|---|---|---|---|---|---|---|---|---|---|---|
| | | | | | | | | | | | | H_CDR3 | | | | | | | | | | | | | |
| CONSENSUS | T | A | V | Y | Y | C | V | R | R | G | Y | S | Y | G | . | . | . | . | . | . | . | . | . | . | . |
| 21-225_11A2_HC | . | . | . | . | . | . | . | . | . | . | . | . | . | . | . | . | . | . | . | . | . | . | . | . | . |
| 21-225_13A1_HC | . | . | . | . | . | . | . | . | . | . | . | . | . | . | . | . | . | . | . | . | . | . | . | . | . |
| 21-225_15C2_HC | . | . | . | . | . | . | . | . | . | . | . | . | . | . | . | . | . | . | . | . | . | . | . | . | . |
| 21-225_15F10_HC | . | . | . | R | . | . | A | . | . | . | . | . | . | . | . | . | . | . | . | . | . | . | . | . | . |
| 21-225_16B3_HC | . | . | . | . | . | . | . | . | . | . | . | Y | . | . | . | . | . | . | . | . | . | . | . | . | . |
| 21-225_1B12_HC | . | . | . | . | . | . | . | . | E | D | . | . | C | S | . | . | . | . | . | . | . | . | . | . | . |
| 21-225_22SB11_HC | . | . | . | . | . | . | A | . | . | . | . | . | . | . | Q | T | S | C | . | . | . | . | . | . | . |
| 21-225_24D6_HC | . | . | . | . | . | . | A | . | . | . | . | . | . | S | . | . | . | . | . | . | . | . | . | . | . |
| 21-225_45F8_HC | . | . | . | . | . | . | A | . | . | . | . | . | . | . | . | . | . | . | . | . | . | . | . | . | . |
| 21-225_5E8_HC | . | . | . | . | . | . | . | . | . | . | . | . | . | . | . | . | . | . | . | . | . | . | . | . | . |

| Reference # | 126 | 127 | 128 | 129 | 130 | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|---|---|---|---|---|
| | | | | | | | | | | | | | | | H_FR4 | | | | | | | | | |
| CONSENSUS | . | . | . | . | . | . | . | G | Y | G | M | D | V | W | G | Q | G | T | T | V | T | V | S | S |
| 21-225_11A2_HC | . | . | . | . | . | . | . | . | . | . | . | . | . | . | . | . | . | . | . | . | . | . | . | . |
| 21-225_13A1_HC | . | . | . | . | . | . | . | . | . | . | . | . | . | . | . | . | . | . | . | . | . | . | . | . |
| 21-225_15C2_HC | . | . | . | . | . | . | . | . | . | . | . | . | . | . | . | . | . | . | . | . | . | . | . | . |
| 21-225_15F10_HC | . | . | . | . | . | . | . | . | . | . | . | . | . | . | . | . | . | . | . | . | . | . | . | . |
| 21-225_16B3_HC | . | . | . | . | . | . | . | . | . | . | . | . | . | . | . | . | . | A | . | . | . | . | . | . |
| 21-225_1B12_HC | . | . | . | . | . | . | Y | . | . | . | . | . | . | . | . | . | . | A | . | . | . | . | . | . |
| 21-225_22SB11_HC | . | . | . | . | . | . | . | . | . | . | . | . | . | . | . | . | . | . | . | . | . | . | . | . |
| 21-225_24D6_HC | . | . | . | . | Y | Y | Y | . | . | . | . | . | . | . | . | . | . | . | . | . | . | . | . | . |
| 21-225_45F8_HC | . | . | . | R | . | Y | Y | Y | . | . | . | . | . | . | . | . | . | A | . | . | . | . | . | . |
| 21-225_5E8_HC | . | . | . | . | . | . | . | . | . | . | . | . | . | . | . | . | . | . | . | . | . | . | . | . |

FIGURE 57 (Continued)

Table 85. Consensus 51 - VH3j3-33/D|3-10|RF2/JH6 (SEQ ID NO: 50302):

QVQLVES-GGGVVQPGRSLRLSCAASG-FTFSD----YVMHWVRQAPGKGLEWVAVIWYD---
GSNKYYADSVKGRFTISRDNSKNTLYLQMNSLRAEDTAVYYCAREPYTSGW--------YDYGMDVWGQGTTVTVSS wherein:

D at position 33 can be substituted with S

Y at position 39 can be substituted with C

V at position 40 can be substituted with G

H at position 42 can be substituted with Q

V at position 57 can be substituted with I

G at position 76 can be substituted with V

P at position 110 can be substituted with R

T at position 112 can be substituted with N

Y at position 132 can be substituted with H

M at position 136 can be substituted with L

Xaa Xaa Xaa Met Xaa (SEQ ID NO: 50099)

Xaa Ile Trp Tyr Asp Gly Ser Asn Lys Tyr Tyr Ala Asp Ser Val Lys Xaa (SEQ ID NO: 50100)

Glu Xaa Tyr Xaa Ser Gly Trp Xaa Asp Tyr Gly Xaa Asp Val (SEQ ID NO: 50101)

Asp Tyr Val Met His (SEQ ID NO: 50576)

Val Ile Trp Tyr Asp Gly Ser Asn Lys Tyr Tyr Ala Asp Ser Val Lys Gly (SEQ ID NO: 50577)

Glu Pro Tyr Thr Ser Gly Trp Tyr Asp Tyr Gly Met Asp Val (SEQ ID NO: 50578)

| Reference # | 126 | 127 | 128 | 129 | 130 | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|---|---|---|---|---|
| | | | | | | | | | | | | | | | | | | | H_FR4 | | | | | Refe |
| CONSENSUS | - | - | - | - | - | - | Y | D | Y | G | M | D | V | W | G | Q | G | T | T | V | T | V | S | S |
| 21-225_158D4_HC | . | . | . | . | . | . | . | . | . | . | . | . | . | . | . | . | . | . | . | . | . | . | . | |
| 21-225_159A3_HC | . | . | . | . | . | . | . | . | . | . | . | . | . | . | . | . | . | . | . | . | . | . | . | |
| 21-225_159C8_HC | . | . | . | . | . | . | . | . | . | . | . | . | . | . | . | . | . | . | . | . | . | . | . | |
| 21-225_160C4_HC | . | . | . | . | . | . | . | . | . | . | . | . | . | . | . | . | . | . | . | . | . | . | . | |
| 21-225_161G12_HC | . | . | . | . | . | . | . | . | . | . | L | . | . | . | . | . | . | . | . | . | . | . | . | |
| 21-225_20B11_HC | . | . | . | . | . | . | . | . | . | . | . | . | . | . | . | . | . | . | . | . | . | . | . | |
| 21-225_226F7_HC | . | . | . | . | . | . | . | . | . | . | . | . | . | . | . | . | . | . | . | . | . | . | . | |
| 21-225_2B10_LC1_HC | . | . | . | . | . | . | . | . | . | . | . | . | . | . | . | . | . | . | . | . | . | . | . | |
| 21-225_2B10_LC2_HC | . | . | . | . | . | . | . | . | . | . | . | . | . | . | . | . | . | . | . | . | . | . | . | |
| 21-225_7F8_HC | . | . | . | . | . | . | X | . | . | . | . | . | . | . | . | . | . | . | . | . | . | . | . | |

| Reference # | rence # |
|---|---|
| CONSENSUS | |
| 21-225_158D4_HC | |
| 21-225_159A3_HC | |
| 21-225_159C8_HC | |
| 21-225_160C4_HC | |
| 21-225_161G12_HC | |
| 21-225_20B11_HC | |
| 21-225_226F7_HC | |
| 21-225_2B10_LC1_HC | |
| 21-225_2B10_LC2_HC | |
| 21-225_7F8_HC | |

FIGURE 57 (Continued)

Table 86. Consensus 52 - VH1|1-18/D3|3-3|RF2/JH6 (SEQ ID NO: 50303):

QVQLVQS-GAEVKKPGASVKVSCKASG-YTFNS-----YGISWVRQAPGQGLEWMGWISAY---NGNTKYAQKLQGRVTMTDTSTSTAYMELRSLRSDDTAVYYCARHDFWSGY---------YKGMDVWGQGTTVTVSS wherein:

I in position 41 can be substituted with F or V

T in position 68 can be substituted with R

Y in position 70 can be substituted with N, E or F

K in position 73 can be substituted with R

L in position 74 can be substituted with F

Ser Tyr Gly Xaa Ser (SEQ ID NO: 50102)

Trp Ile Ser Ala Tyr Asn Gly Asn Xaa Lys Xaa Ala Gln Xaa Xaa Gln Gly (SEQ ID NO: 50103)

His Asp Phe Trp Ser Gly Tyr Tyr Lys Gly Met Asp Val (SEQ ID NO: 50227)

Ser Tyr Gly Ile Ser (SEQ ID NO: 50579)

Trp Ile Ser Ala Tyr Asn Gly Asn Thr Lys Tyr Ala Gln Lys Leu Gln Gly (SEQ ID NO: 50580)

His Asp Phe Trp Ser Gly Tyr Tyr Lys Gly Met Asp Val (SEQ ID NO: 50581)

Table 87. Consensus 53 - VH3j3-23/D6j6-6jRF1/JH4 (SEQ ID NO: 50304):

EVQLLES-GGGLVQPGGSLRLSCAASG-FTFSS------YAMSWVRQAPGKGLEWVSAISGR---GG
NTFDADSVKGRFTISRDNSKNTLYLQMNSLRAEDTAVYYCAKERSGS----------YFDYWGQGTLVTVSS wherein:

Y at position 39 can be substituted with S

A at position 57 can be substituted with V or S

R at position 61 can be substituted with S

G at position 66 can be substituted with I or V

N at position 67 can be substituted with S

D at position 70 can be substituted with Y

A at position 71 can be substituted with T

E at position 109 can be substituted with S

R at position 110 can be substituted with N

G at position 112 can be substituted with S

S at position 113 can be substituted with G

Y at position 135 can be substituted with W

Xaa Xaa Ala Met Ser (SEQ ID NO: 50104)

Xaa Ile Ser Gly Xaa Xaa Gly Xaa Xaa Thr Phe Xaa Xaa Asp Ser Val Lys Gly (SEQ ID NO: 50105)

Xaa Xaa Ser Xaa Xaa Xaa Phe Asp Tyr (SEQ ID NO: 50106)

Ser Tyr Ala Met Ser (SEQ ID NO: 50582)

Ala Ile Ser Gly Arg Gly Gly Asn Thr Phe Asp Ala Asp Ser Val Lys Gly (SEQ ID NO: 50583)

FIGURE 57 (Continued)

Glu Arg Ser Gly Ser Tyr Phe Asp Tyr (SEQ ID NO: 50584)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | | H_FR1 | | | | | | | | | |
| CONSENSUS | E | V | Q | L | L | E | S | - | G | G | L | V | Q | P | G | G | S | S | L | R | L | S | C | A | A | S |
| 21-225_171A8_HC | . | . | . | . | . | . | . | . | . | . | . | . | . | . | . | . | . | . | . | . | . | . | . | . | . | . |
| 21-225_174G7_HC | . | . | . | . | . | . | . | . | . | . | . | . | . | . | . | . | . | . | . | . | . | . | . | . | . | . |
| 21-225_175C10_HC | . | . | . | . | . | . | . | . | . | . | . | . | . | . | . | . | . | . | . | . | . | . | . | . | . | . |
| 21-225_43C2_HC | . | . | . | . | . | . | . | . | . | . | . | . | . | . | . | . | . | . | . | . | . | . | . | . | . | . |
| 21-225_43E8_HC | . | . | . | . | . | . | . | . | . | . | . | . | . | . | . | . | . | . | . | . | . | . | . | . | . | . |
| 21-225_43H4_HC | . | . | . | . | . | . | . | . | . | . | . | . | . | . | . | . | . | . | . | . | . | . | . | . | . | . |
| 21-225_44D10_HC | . | . | . | . | . | . | . | . | . | . | . | . | . | . | . | . | . | . | . | . | . | . | . | . | . | . |
| 21-225_45F8_HC | . | . | . | . | . | . | . | . | . | . | . | . | . | . | . | . | . | . | . | . | . | . | . | . | . | . |
| 21-225_46A6_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | | | H_FR2 | | | | | | | | |
| CONSENSUS | G | . | F | T | F | S | S | . | . | . | . | Y | A | M | S | W | V | R | Q | A | P | G | K | G | L |
| 21-225_171A8_HC | . | . | . | . | . | . | . | . | . | . | . | S | . | . | . | . | . | . | . | . | . | . | . | . | . |
| 21-225_174G7_HC | . | . | . | . | . | . | . | . | . | . | . | S | . | . | . | . | . | . | . | . | . | . | . | . | . |
| 21-225_175C10_HC | . | . | . | . | . | . | . | . | . | . | . | . | . | . | . | . | . | . | . | . | . | . | . | . | . |
| 21-225_43C2_HC | . | . | . | . | . | . | . | . | . | . | . | . | . | . | . | . | . | . | . | . | . | . | . | . | . |
| 21-225_43E8_HC | . | . | . | . | . | . | . | . | . | . | . | . | . | . | . | . | . | . | . | . | . | . | . | . | . |
| 21-225_43H4_HC | . | . | . | . | . | . | . | . | . | . | . | . | . | . | . | . | . | . | . | . | . | . | . | . | . |
| 21-225_44D10_HC | . | . | . | . | . | . | . | . | . | . | . | . | . | . | . | . | . | . | . | . | . | . | . | . | . |
| 21-225_45F8_HC | . | . | . | . | . | . | . | . | . | . | . | . | . | . | . | . | . | . | . | . | . | . | . | . | . |
| 21-225_46A6_HC | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | H_CDR3 | | | | | | | | | | | | | | | | | |
| CONSENSUS | Y | C | A | K | E | R | S | G | S | | | | | | | | | | | | | | | | | |
| 21-225_171A8_HC | . | . | . | . | S | N | . | S | G | . | . | . | . | . | . | . | . | . | . | . | . | . | . | . | . | . |
| 21-225_174G7_HC | . | . | . | . | S | N | . | S | G | . | . | . | . | . | . | . | . | . | . | . | . | . | . | . | . | . |
| 21-225_175C10_HC | . | . | . | . | S | N | . | S | G | . | . | . | . | . | . | . | . | . | . | . | . | . | . | . | . | . |
| 21-225_43C2_HC | . | . | . | . | . | . | . | . | . | . | . | . | . | . | . | . | . | . | . | . | . | . | . | . | . | . |
| 21-225_43E8_HC | . | . | . | . | . | . | . | . | . | . | . | . | . | . | . | . | . | . | . | . | . | . | . | . | . | . |
| 21-225_43H4_HC | . | . | . | . | . | . | . | . | . | . | . | . | . | . | . | . | . | . | . | . | . | . | . | . | . | . |
| 21-225_44D10_HC | . | . | . | . | . | . | . | . | . | . | . | . | . | . | . | . | . | . | . | . | . | . | . | . | . | . |
| 21-225_45F8_HC | . | . | . | . | . | . | . | . | . | . | . | . | . | . | . | . | . | . | . | . | . | . | . | . | . | . |
| 21-225_46A6_HC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | H_FR4 | | | | | | | | | |
| CONSENSUS | . | . | . | . | Y | F | D | Y | W | G | Q | G | T | L | V | T | V | S | S |
| 21-225_171A8_HC | . | . | . | . | W | . | . | . | . | . | . | . | . | . | . | . | . | . | . |
| 21-225_174G7_HC | . | . | . | . | W | . | . | . | . | . | . | . | . | . | . | . | . | . | . |
| 21-225_175C10_HC | . | . | . | . | W | . | . | . | . | . | . | . | . | . | . | . | . | . | . |
| 21-225_43C2_HC | . | . | . | . | . | . | . | . | . | . | . | . | . | . | . | . | . | . | . |
| 21-225_43E8_HC | . | . | . | . | . | . | . | . | . | . | . | . | . | . | . | . | . | . | . |
| 21-225_43H4_HC | . | . | . | . | . | . | . | . | . | . | . | . | . | . | . | . | . | . | . |
| 21-225_44D10_HC | . | . | . | . | . | . | . | . | . | . | . | . | . | . | . | . | . | . | . |
| 21-225_45F8_HC | . | . | . | . | . | . | . | . | . | . | . | . | . | . | . | . | . | . | . |
| 21-225_46A6_HC | . | . | . | . | . | . | . | . | . | . | . | . | . | . | . | . | . | . | . |

FIGURE 57 (Continued)

Table 88. Consensus 54 - VH3|3-33/D6|6-6|RF1/JH4 (SEQ ID NO: 50305):

QVQLVES-GGGVVQPGRSLRLSCAASG-FTFSN------YGMHWVRQAPGKGLEWVAVIWHD---GSNKYYADSVKGRFTISRDNSKNTLYLQMNSLRAEDTAVYYCARENSSS------------YYFDYWGQGTLVTVSS wherein:

N in position 33 can be substituted with S, Y or H

G in position 40 can be substituted with V

V in position 57 can be substituted with L

H in position 60 can be substituted with Y

S in position 66 can be substituted with T

N in position 67 can be substituted with D

K in position 68 can be substituted with A

A in position 71 can be substituted with V or G

Y in position 134 can be substituted with F

Xaa Tyr Xaa Met His (SEQ ID NO: 50107)

Xaa Ile Trp Xaa Asp Gly Xaa Xaa Xaa Tyr Tyr Xaa Asp Ser Val Lys Gly (SEQ ID NO: 50108)

Glu Asn Ser Ser Xaa Tyr Phe Asp Tyr Trp Gly Gln Gly Thr Leu Val Thr Val Ser Ser (SEQ ID NO: 50109)

Asn Tyr Gly Met His (SEQ ID NO: 50585)

Val Ile Trp His Asp Gly Ser Asn Lys Tyr Tyr Ala Asp Ser Val Lys Gly (SEQ ID NO: 50586)

Glu Asn Ser Ser Tyr Tyr Phe Asp Tyr Trp Gly Gln Gly Thr Leu Val Thr Val Ser Ser (SEQ ID NO: 50587)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | V | Q | L | V | E | S | - | G | G | G | V | V | Q | P | G | R | S | L | R | L | S | C | A | A | S |
| 21-225_30G1_HC | . | . | . | . | . | . | . | . | . | . | . | . | . | . | . | . | . | . | . | . | . | . | . | . | . | . |
| 21-225_30G4_HC | . | . | . | . | . | . | . | . | . | . | . | . | . | . | . | . | . | . | . | . | . | . | . | . | . | . |
| 21-225_32D6_HC | . | . | . | . | . | . | . | . | . | . | . | . | . | . | . | . | . | . | . | . | . | . | . | . | . | . |
| 21-225_33B2_HC | . | . | . | . | . | . | . | . | . | . | . | . | . | . | . | . | . | . | . | . | . | . | . | . | . | . |
| 21-225_33C12_HC | . | . | . | . | . | . | . | . | . | . | . | . | . | . | . | . | . | . | . | . | . | . | . | . | . | . |
| 21-225_34C2_HC | . | . | . | . | . | . | . | . | . | . | . | . | . | . | . | . | . | . | . | . | . | . | . | . | . | . |
| 21-225_34D3_HC | . | . | . | . | . | . | . | . | . | . | . | . | . | . | . | . | . | . | . | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | H_CDR1 | | | | | | | | | | H_FR2 | | | | | | | | | | |
| CONSENSUS | G | - | F | T | F | S | N | - | - | - | - | - | Y | G | M | H | W | V | R | Q | A | P | G | K | G | L |
| 21-225_30G1_HC | . | . | . | . | . | . | Y | . | . | . | . | . | . | . | . | . | . | . | . | . | . | . | . | . | . | . |
| 21-225_30G4_HC | . | . | . | . | . | . | S | . | . | . | . | . | . | . | . | . | . | . | . | . | . | . | . | . | . | . |
| 21-225_32D6_HC | . | . | . | . | . | . | S | . | . | . | . | . | . | . | . | . | . | . | . | . | . | . | . | . | . | . |
| 21-225_33B2_HC | . | . | . | . | . | . | . | . | . | . | . | . | . | . | . | . | . | . | . | . | . | . | . | . | . | . |
| 21-225_33C12_HC | . | . | . | . | . | . | H | . | . | . | . | . | . | V | . | . | . | . | . | . | . | . | . | K | . | . |
| 21-225_34C2_HC | . | . | . | . | . | . | Y | . | . | . | . | . | . | . | . | . | . | . | . | . | . | . | . | . | . | . |
| 21-225_34D3_HC | . | . | . | . | . | . | . | . | . | . | . | . | . | . | . | . | . | . | . | . | . | . | . | . | . | . |
| 21-225_34D8_HC | . | . | . | . | . | . | . | . | . | . | . | . | . | . | . | . | . | . | . | . | . | . | . | . | . | . |
| 21-225_36B8_HC | . | . | . | . | . | . | . | . | . | . | . | . | . | . | . | . | . | . | . | . | . | . | . | . | . | . |

Table 89. Consensus 55 – VH2|2-05/D1|1-1|RF1/JH3 (SEQ ID NO: 50306):

QITLKES-GPTLVKPTQTLTLTCTFSG-FSLSTS---GVGVGWIRQPPGKALEWLALINW----
NDDKRYSPSLKSRFTITRDTSKDQVLTMTNMDPVDTATYYCAHKATWV----------AFDIWGQGTMVTVSS wherein:

Y in position 70 can be substituted with F

A in position 110 can be substituted with T

Thr Ser Gly Val Gly Val Gly (SEQ ID NO: 50110)

Leu Ile Asn Trp Asn Asp Asp Lys Arg Xaa Ser Pro Ser Leu Lys Ser (SEQ ID NO: 50111)

Lys Xaa Thr Trp Val Ala Phe Asp Ile (SEQ ID NO: 50112)

Thr Ser Gly Val Gly Val Gly (SEQ ID NO: 50588)

Leu Ile Asn Trp Asn Asp Asp Lys Arg Tyr Ser Pro Ser Leu Lys Ser (SEQ ID NO: 50589)

Lys Ala Thr Trp Val Ala Phe Asp Ile (SEQ ID NO: 50590)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | | | | | H_FR1 | | | | | | | | | | |
| CONSENSUS | Q | I | T | L | K | E | S | - | G | P | T | L | V | K | P | T | Q | T | L | T | L | T | C | T | F | S |
| 21-225_62A12_HC | . | . | . | . | . | . | . | . | . | . | . | . | . | . | . | . | . | . | . | . | . | . | . | . | . | . |
| 21-225_62B12_HC | . | . | . | . | . | . | . | . | . | . | . | . | . | . | S | . | . | . | . | . | . | . | . | . | . | . |
| 21-225_62D10_HC | . | . | . | . | . | . | . | . | . | . | . | . | . | . | . | . | . | . | . | . | . | . | . | . | . | . |
| 21-225_62E3_HC | . | . | . | . | . | . | . | . | . | . | . | . | . | . | . | . | . | . | . | . | . | . | . | . | . | . |
| 21-225_62E8_HC | . | . | . | . | . | . | . | . | . | . | . | . | . | . | . | . | . | . | . | . | . | . | . | . | . | . |
| 21-225_66G9_HC | . | . | . | . | . | . | . | . | . | . | . | . | . | . | . | . | . | . | . | . | . | . | . | . | . | . |
| 21-225_72D5_HC | . | . | . | . | . | . | . | . | . | . | . | . | . | . | . | . | . | . | . | . | . | . | . | . | . | . |
| 21-225_73C4_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | H_CDR1 | | | | | | | H_FR2 | | | | | | | | | | | | | | | |
| CONSENSUS | G | - | F | S | L | S | T | S | - | - | G | G | V | G | V | G | W | I | R | Q | P | P | G | K | A | L |
| 21-225_62A12_HC | . | . | . | . | . | . | . | . | . | . | . | . | . | . | . | . | . | . | . | . | . | . | . | . | . | . |
| 21-225_62B12_HC | . | . | . | . | . | . | . | . | . | . | . | . | . | . | . | . | . | . | . | . | . | . | . | . | . | . |
| 21-225_62D10_HC | . | . | . | . | . | N | . | . | . | . | . | . | . | . | . | . | . | . | . | . | . | . | . | . | . | . |
| 21-225_62E3_HC | . | . | . | . | . | . | . | . | . | . | . | . | . | . | . | . | . | . | . | . | . | . | . | . | . | . |
| 21-225_62E8_HC | . | . | . | . | . | . | . | . | . | . | . | . | . | . | . | . | . | . | . | . | . | . | . | . | . | . |
| 21-225_66G9_HC | . | . | . | . | . | . | . | . | . | . | . | . | . | . | . | . | . | . | . | . | . | . | . | . | . | . |
| 21-225_72D5_HC | . | . | . | . | . | . | . | . | . | . | . | . | . | . | . | . | . | . | . | . | . | . | . | . | . | . |
| 21-225_73C4_HC | . | . | . | . | . | . | . | . | . | . | . | . | . | . | . | . | . | . | . | . | . | . | . | . | . | . |

Table 90. Consensus 56 - VH3|3-23/D4|4-11|RF3/JH4 (SEQ ID NO: 50307):

EVQLLES-GGGLVQPGGSLRLSCAASG-FTFSS----YVMNWVRQAPGKGLEWVSAISGS---
GGRTYYADSVKGRFTISRDNSKNTLYLQMNSLRAEDTAVYYCARTAT............FDYWGQGTLVTVSS wherein:

V at position 40 can be substituted with A

M at position 41 can be substituted with I or L

N at position 42 can be substituted with S or R

A at position 57 can be substituted with D

I at position 58 can be substituted with M

G at position 66 can be substituted with D or V

R at position 67 can be substituted with S, F or T

A at position 71 can be substituted with V

A at position 110 can be substituted with G, S, T or Y

T at position 111 can be substituted with V, null (-), H, L or G

F at position 136 can be substituted with null (-) or K

D at position 137 can be substituted with null (-)

Y at position 138 can be substituted with L

Ser Tyr Xaa Xaa Xaa (SEQ ID NO: 50113)

Xaa Xaa Ser Gly Ser Gly Xaa Xaa Thr Tyr Tyr Xaa Asp Ser Val Lys Gly (SEQ ID NO: 50114)

Thr Xaa Xaa Xaa Xaa (SEQ ID NO: 50115)

Ser Tyr Val Met Asn (SEQ ID NO: 50591)

FIGURE 57 (Continued)

Ala Ile Ser Gly Ser Gly Gly Arg Thr Tyr Tyr Ala Asp Ser Val Lys Gly (SEQ ID NO: 50592)

Thr Ala Thr Phe Asp Tyr (SEQ ID NO: 50593)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
|  |  |  |  |  |  |  |  |  |  |  |  |  |  |  |  | H_FR1 |  |  |  |  |  |  |  |  |  |  |
| CONSENSUS | E | V | Q | L | L | E | S | - | G | G | G | L | V | Q | P | G | G | S | L | R | L | S | C | A | A | S |
| 21-225_153A1_HC | . | . | . | . | . | . | . | . | . | . | . | . | . | . | . | . | . | . | . | . | . | . | . | . | . | . |
| 21-225_157H1_HC | . | . | . | . | . | . | . | . | . | . | . | . | . | . | . | . | . | . | . | . | . | . | . | . | . | . |
| 21-225_175C4_HC | . | . | . | . | . | . | . | . | . | . | . | . | . | . | . | . | . | . | . | . | . | . | . | T | . | . |
| 21-225_23C7_HC | . | . | . | . | . | . | . | . | . | . | . | . | . | . | . | . | . | . | . | . | . | . | . | . | . | . |
| 21-225_23E7_HC | . | . | . | . | . | . | . | . | . | . | . | . | . | . | . | . | . | . | . | . | . | . | . | . | . | . |
| 21-225_30A1_HC | . | . | . | . | . | . | . | . | . | . | . | . | . | . | . | . | . | . | . | . | . | . | . | . | . | . |
| 21-225_33A5_HC | . | . | . | . | . | . | . | . | . | . | . | . | . | . | . | . | . | . | . | . | . | . | . | . | . | . |
| 21-225_56F7_HC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
|  |  |  |  |  | H_CDR1 |  |  |  |  |  |  |  |  |  |  | H_FR2 |  |  |  |  |  |  |  |  |  |  |
| CONSENSUS | G | - | F | T | F | S | S | - | - | - | - | Y | V | M | N | W | V | R | Q | A | P | G | K | G | L |
| 21-225_153A1_HC | . | . | . | . | . | . | . | . | . | . | . | . | . | . | S | . | . | . | . | . | . | . | . | . | . | . |
| 21-225_157H1_HC | . | . | . | S | . | . | . | . | . | . | . | . | . | . | . | . | . | . | . | Q | . | . | . | . | . | . |
| 21-225_175C4_HC | A | . | . | . | . | . | . | . | . | . | . | . | A | . | S | . | . | . | . | . | . | . | . | . | . | . |
| 21-225_23C7_HC | . | . | . | . | . | . | . | . | . | . | . | . | . | . | . | . | . | . | . | . | . | . | . | . | . | . |
| 21-225_23E7_HC | . | . | . | . | . | . | . | . | . | . | . | . | A | . | S | . | . | . | . | . | . | . | . | . | . | . |
| 21-225_30A1_HC | . | . | . | . | . | . | . | . | . | . | . | . | . | . | . | . | . | . | . | . | . | . | . | . | . | . |
| 21-225_33A5_HC | . | . | . | . | . | . | . | . | . | . | . | . | . | . | . | . | . | . | . | . | . | . | . | . | . | . |
| 21-225_56F7_HC | . | . | . | . | . | . | . | . | . | . | . | . | . | L | . | . | . | . | . | . | . | . | . | . | . | . |

FIGURE 57 (Continued)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | H_CDR2 | | | | | | | | | | | | |
| CONSENSUS | E | W | V | S | A | I | S | G | S | . | . | . | G | G | . | T | Y | Y | A | D | S | V | K | G | R | F |
| 21-225_153A1_HC | . | . | . | . | Q | . | . | . | . | . | . | . | . | D | . | . | . | . | . | . | . | . | . | . | . | . |
| 21-225_157H1_HC | . | . | . | . | D | . | . | . | . | . | . | . | . | . | T | . | . | . | . | . | . | . | . | . | . | . |
| 21-225_175C4_HC | . | . | . | . | . | . | . | . | . | . | . | . | . | Q | . | . | . | . | . | . | . | . | . | . | . | . |
| 21-225_23C7_HC | . | . | . | . | . | M | . | . | . | . | . | . | . | . | S | . | . | . | . | . | . | . | . | . | . | . |
| 21-225_23E7_HC | . | . | . | . | . | . | . | . | . | . | . | . | . | . | F | . | . | . | . | . | . | . | . | . | . | . |
| 21-225_30A1_HC | . | . | . | . | . | . | . | . | . | . | . | . | . | V | S | . | . | . | V | . | . | . | . | . | . | . |
| 21-225_33A5_HC | . | . | . | . | . | M | . | . | . | . | . | . | . | . | S | . | . | . | . | . | . | . | . | . | . | . |
| 21-225_56F7_HC | . | . | . | . | . | . | . | . | . | . | . | . | . | . | R | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | H_FR3 | | | | | | | | | | | | |
| CONSENSUS | T | I | S | R | D | N | S | K | N | T | L | Y | L | Q | M | N | S | L | R | A | E | D | T | A | V | Y |
| 21-225_153A1_HC | . | . | . | . | . | . | . | . | . | . | . | . | . | . | . | . | . | . | . | . | . | . | . | . | . | . |
| 21-225_157H1_HC | . | . | . | . | . | . | . | N | T | . | . | . | . | . | . | . | . | . | . | . | . | . | . | . | . | . |
| 21-225_175C4_HC | . | . | . | . | . | Q | . | . | . | . | . | . | . | . | . | . | . | . | . | . | . | . | . | . | . | . |
| 21-225_23C7_HC | . | . | . | . | . | . | . | . | . | . | . | . | . | . | . | . | . | . | . | . | . | . | . | . | . | . |
| 21-225_23E7_HC | . | . | . | . | N | . | . | . | . | . | . | . | . | . | . | . | . | . | . | . | . | . | . | . | . | . |
| 21-225_30A1_HC | . | . | . | . | . | . | . | . | . | . | . | . | . | . | . | . | . | . | . | . | . | . | . | . | . | . |
| 21-225_33A5_HC | . | . | . | . | . | . | . | . | . | . | . | . | . | . | . | . | . | . | . | . | . | . | . | . | . | . |
| 21-225_56F7_HC | . | . | . | . | . | . | . | . | . | . | . | . | . | . | . | . | . | . | . | . | . | . | . | . | . | . |

FIGURE 57 (Continued)

Table 91. Consensus 57 - VH3j3-23/D7|7-27|RF1/JH3 (SEQ ID NO: 50308):

EVQLLES-GGGLVQPGGSLRLSCAASG-FTFSS-----YAMSWVRQAPGKGLEWVSVISGR---
GGTTFYADSVKGRFTISRDNSKNTLYLQMNSLRAEDTAVYYCAKRTPSD............VFDIWGQGTMVTVSS wherein:

Y at position 39 can be substituted with F

S at position 42 can be substituted with N

V at position 57 can be substituted with A or I

I at position 58 can be substituted with L

R at position 61 can be substituted with S or G

G at position 66 can be substituted with S or K

T at position 67 can be substituted with N or S

F at position 69 can be substituted with Y

P at position 111 can be substituted with G

S at position 112 can be substituted with D or E

V at position 135 can be substituted with A

I at position 138 can be substituted with V

Ser Xaa Ala Met Xaa (SEQ ID NO: 50116)

Xaa Xaa Ser Gly Xaa Gly Xaa Xaa Thr Xaa Tyr Ala Asp Ser Val Lys Gly (SEQ ID NO: 50117)

Lys Arg Thr Xaa Xaa Asp Xaa Phe Asp Xaa (SEQ ID NO: 50118)

Ser Tyr Ala Met Ser (SEQ ID NO: 50594)

Val Ile Ser Gly Arg Gly Gly Thr Thr Phe Tyr Ala Asp Ser Val Lys Gly (SEQ ID NO: 50595)

FIGURE 57 (Continued)

Lys Arg Thr Pro Ser Asp Val Phe Asp Ile (SEQ ID NO: 50596)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | | H_CDR3 | | | | | | |
| CONSENSUS | Y | C | A | K | R | T | P | S | D | | | | | | | | | | | | | | | | | |
| 21-225_149B6_HC | F | . | . | . | . | . | . | . | . | . | . | . | . | . | . | . | . | . | . | . | . | . | . | . | . | . |
| 21-225_180A3_HC | . | . | . | . | . | . | Q | E | . | . | . | . | . | . | . | . | . | . | . | . | . | . | . | . | . | . |
| 21-225_182H5_HC | . | . | . | . | . | . | Q | D | . | . | . | . | . | . | . | . | . | . | . | . | . | . | . | . | . | . |
| 21-225_186A11_HC | F | . | . | . | . | . | Q | D | . | . | . | . | . | . | . | . | . | . | . | . | . | . | . | . | . | . |
| 21-225_43H9_HC | . | . | . | . | . | . | . | D | . | . | . | . | . | . | . | . | . | . | . | . | . | . | . | . | . | . |
| 21-225_44F3_HC | . | . | . | . | . | . | . | . | . | . | . | . | . | . | . | . | . | . | . | . | . | . | . | . | . | . |
| 21-225_45C9_HC | . | . | . | . | . | . | . | . | . | . | . | . | . | . | . | . | . | . | . | . | . | . | . | . | . | . |
| 21-225_45H4_HC | F | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | | | | | V | F | D | I | W | G | Q | G | T | M | V | T | V | S | S |
| 21-225_149B6_HC | . | . | . | . | . | . | . | V | . | . | . | . | . | . | . | . | . | . | . |
| 21-225_180A3_HC | . | . | . | . | . | . | . | . | . | . | . | . | . | . | . | . | . | . | . |
| 21-225_182H5_HC | . | . | . | . | . | . | . | . | . | . | . | . | . | . | . | . | . | . | . |
| 21-225_186A11_HC | . | . | . | . | . | . | . | . | . | . | . | . | . | . | . | . | . | . | . |
| 21-225_43H9_HC | . | . | . | . | A | . | . | . | . | . | . | . | . | . | . | . | . | . | . |
| 21-225_44F3_HC | . | . | . | . | A | . | . | . | . | . | . | . | . | . | . | . | . | . | . |
| 21-225_45C9_HC | . | . | . | . | . | . | . | . | . | . | . | . | . | . | . | . | . | . | . |
| 21-225_45H4_HC | . | . | . | . | . | . | . | . | . | . | . | . | . | . | . | . | . | . | . |

FIGURE 57 (Continued)

Table 92. Consensus 58 - VH3j3-33/D4J4-11|RF2/JH4 (SEQ ID NO: 50309):

QVQLVES-GGGVVQPGRSLRLSCAASG-FTFSS-----YGMHWVRQAPGKGLEWVAVIWYD----
GSNKYYADSVKGRFTISRDNSKNTLYLQMNSLRAEDTAVYYCARDRPRS----------SAFDYWGQGTLVTVSS wherein:

S at position 33 can be substituted with N or T

Y at position 39 can be substituted with F

G at position 40 can be substituted with D or N

V at position 57 can be substituted with A

Y at position 60 can be substituted with H

S at position 66 can be substituted with R

N at position 67 can be substituted with D or H

K at position 68 can be substituted with R

Y at position 70 can be substituted with C or S

A at position 71 can be substituted with E or T

R at position 110 can be substituted with D or H

P at position 111 can be substituted with S or A

I at position 112 can be substituted with R or Y

S at position 113 can be substituted with L, V or W

Null (-) at position 114 can be substituted with G

FIGURE 57 (Continued)

Null (-) at position 133 can be substituted with A

S at position 134 can be substituted with T or A

A at position 135 can be substituted with F, S or Y

F at position 136 can be substituted with G or S

Y at position 138 can be substituted with F

Xaa Xaa Xaa Met His (SEQ ID NO: 50237)

Xaa Ile Trp Xaa Asp Gly Xaa Xaa Xaa Tyr Xaa Xaa Asp Ser Val Lys Gly (SEQ ID NO: 50238)

Asp Xaa Xaa Xaa Xaa Xaa Xaa Xaa Xaa Xaa Asp Xaa (SEQ ID NO: 50239)

Ser Tyr Gly Met His (SEQ ID NO: 50597)

Val Ile Trp Tyr Asp Gly Ser Asn Lys Tyr Tyr Ala Asp Ser Val Lys Gly (SEQ ID NO: 50598)

Asp Arg Pro Arg Ser Ser Ala Phe Asp Tyr (SEQ ID NO: 50599)

Table 93. Consensus 59 - VH3|3-48/D4|4-11|RF2/JH6 (SEQ ID NO: 50310):

EVQLVES-GGGLVQPGGSLRLSCAASG-FTFSS----YNMNWVRQAPGKGLEWVSYISRS---
SNTKYYADSVKGRFTISRDNAKNSLYLQMNSLRDEDTAVYYCARDRSGSYGY---------FYYYGLDVWGQGTTVTVSS wherein:

S at position 33 can be substituted with N

N at position 40 can be substituted with S

R at position 60 can be substituted with S

S at position 65 can be substituted with G

N at position 66 can be substituted with S

K at position 68 can be substituted with T

Y at position 69 can be substituted with H

A at position 71 can be substituted with V

K at position 75 can be substituted with R, E or Q

R at position 110 can be substituted with S

S at position 111 can be substituted with R

G at position 112 can be substituted with K

S at position 113 can be substituted with G

Y at position 114 can be substituted with F

G at position 115 can be substituted with null (-)

Y at position 116 can be substituted with null (-)

FIGURE 57 (Continued)

F at position 131 can be substituted with null (-)

Y at position 132 can be substituted with null (-)

L at position 136 can be substituted with M

Xaa Tyr Xaa Met Asn (SEQ ID NO: 50240)

Tyr Ile Ser Xaa Ser Xaa Xaa Thr Xaa Xaa Tyr Xaa Asp Ser Val Xaa Gly (SEQ ID NO: 50241)

Asp Xaa Xaa Xaa Xaa Xaa Xaa Xaa Xaa Tyr Tyr Gly Xaa Asp Val (SEQ ID NO: 50242)

Ser Tyr Asn Met Asn (SEQ ID NO: 50600)

Tyr Ile Ser Arg Ser Ser Asn Thr Lys Tyr Tyr Ala Asp Ser Val Lys Gly (SEQ ID NO: 50601)

Asp Arg Ser Gly Ser Tyr Gly Tyr Phe Tyr Tyr Tyr Gly Leu Asp Val (SEQ ID NO: 50602)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | H_CDR2 | | | | | | | | | | | |
| CONSENSUS | E | W | V | S | Y | I | S | R | S | - | - | - | S | N | T | K | Y | Y | A | D | S | V | K | G | R | F |
| 21-225_146A8_HC | . | . | . | . | . | . | . | . | . | . | . | . | . | . | . | . | H | . | . | . | . | . | H | . | . | . |
| 21-225_146B6_HC | . | . | . | . | . | . | . | . | . | . | . | . | . | . | . | . | . | . | V | . | . | . | . | . | . | . |
| 21-225_146D8_HC | . | . | . | . | . | . | . | . | . | . | . | . | . | . | . | . | H | . | . | . | . | . | . | . | . | . |
| 21-225_149A1_HC | . | . | . | . | . | . | . | . | . | . | . | . | . | . | . | . | . | . | . | . | . | . | . | . | . | . |
| 21-225_150F9_HC | . | . | . | . | . | . | . | S | . | . | . | . | G | S | . | . | . | . | . | . | . | . | . | . | . | . |
| 21-225_156H2_HC | . | . | . | A | . | . | . | S | . | . | . | . | G | S | . | T | . | . | . | . | . | . | E | . | . | . |
| 21-225_170E4_HC | . | . | . | . | . | . | . | . | . | . | . | . | . | . | . | . | . | . | . | . | . | . | Q | . | . | . |
| 21-225_179D10_HC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | | | | H_FR3 | | | | | | | | | | | |
| CONSENSUS | T | I | S | R | D | N | A | K | N | S | L | Y | L | Q | M | N | S | L | R | D | E | D | T | A | V | Y |
| 21-225_146A8_HC | . | . | . | . | . | . | . | . | . | . | . | . | . | . | . | . | . | . | . | . | . | . | . | . | . | . |
| 21-225_146B6_HC | . | . | . | . | . | . | . | . | . | . | . | . | . | . | . | D | . | . | . | . | . | . | . | . | . | . |
| 21-225_146D8_HC | . | . | . | . | . | . | . | . | . | . | . | . | . | . | . | . | . | . | . | . | . | . | . | . | . | . |
| 21-225_149A1_HC | . | . | . | . | . | . | . | . | . | . | . | . | . | . | . | . | . | . | . | . | . | . | . | . | . | . |
| 21-225_150F9_HC | . | . | . | . | . | . | . | . | . | . | . | . | . | . | . | D | . | . | . | . | . | . | . | . | . | . |
| 21-225_156H2_HC | . | . | . | . | . | . | . | . | . | . | . | D | . | . | . | . | . | . | . | . | . | . | . | . | . | . |
| 21-225_170E4_HC | . | . | . | . | . | . | . | . | . | . | . | . | . | . | . | . | . | . | . | . | . | . | . | . | . | . |
| 21-225_179D10_HC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | H_CDR3 | | | | | | | | | | | | | | | | | | | | | | |
| CONSENSUS | Y | C | A | R | D | R | S | G | S | Y | G | Y | | | | | | | | | | | | | | |
| 21-225_148A8_HC | . | . | . | . | . | . | . | . | . | . | . | . | . | . | . | . | . | . | . | . | . | . | . | . | . | . |
| 21-225_146B6_HC | . | . | . | . | . | . | . | . | . | . | . | . | . | . | . | . | . | . | . | . | . | . | . | . | . | . |
| 21-225_146D8_HC | . | . | . | . | . | . | . | . | . | . | . | . | . | . | . | . | . | . | . | . | . | . | . | . | . | . |
| 21-225_149A1_HC | . | . | . | . | . | . | . | . | . | . | . | . | . | . | . | . | . | . | . | . | . | . | . | . | . | . |
| 21-225_150F9_HC | . | . | . | . | . | . | . | . | . | F | . | . | . | . | . | . | . | . | . | . | . | . | . | . | . | . |
| 21-225_156H2_HC | . | . | . | . | . | . | R | K | Q | F | . | Y | . | . | . | . | . | . | . | . | . | . | . | . | . | . |
| 21-225_170E4_HC | R | . | . | . | . | S | R | K | Q | . | . | . | . | . | . | . | . | . | . | . | . | . | . | . | . | . |
| 21-225_179D10_HC | R | . | . | . | . | S | R | K | Q | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | F | Y | Y | Y | G | L | D | V | W | G | Q | Q | G | T | T | V | T | V | S | S |
| 21-225_148A8_HC | . | . | . | . | . | . | . | . | . | . | . | . | . | . | . | . | . | . | . |
| 21-225_146B6_HC | . | . | . | . | . | . | . | . | . | . | . | . | . | . | . | . | . | . | . |
| 21-225_146D8_HC | . | . | . | . | . | . | . | . | . | . | . | . | . | . | . | . | . | . | . |
| 21-225_149A1_HC | . | . | . | . | . | . | . | . | . | . | . | . | . | . | . | . | . | . | . |
| 21-225_150F9_HC | . | . | . | . | . | M | . | . | . | . | . | . | . | . | . | . | . | . | . |
| 21-225_156H2_HC | . | . | . | . | . | . | . | . | . | . | . | . | . | . | . | . | . | . | . |
| 21-225_170E4_HC | , | , | . | . | . | . | . | . | . | . | . | . | . | . | . | . | . | . | . |
| 21-225_179D10_HC | , | , | . | . | . | . | . | . | . | . | . | . | . | . | . | . | . | . | . |

FIGURE 57 (Continued)

Table 94. Consensus 60 – VH4|4-30.1/D4|4-11|RF2/JH6 (SEQ ID NO: 50311):

QVQLQES-GPGLVKPSQTLSLTCTVSG-GSIRSG----GDYWSWIRQHPGKGLEWIGYIYY----SGSTYYNPSLKSRVTISVDTSKNQFSLKLSSVTAADTAVYYCARDSSSY--------------GMDVWGQGTTVTVSS wherein:

S at position 67 can be substituted with I or P

S at position 110 can be substituted with G or H

S at position 111 can be substituted with A

S at position 112 can be substituted with L or R

Y at position 113 can be substituted with R or H

Ser Gly Gly Asp Tyr Trp Ser (SEQ ID NO: 50119)

Tyr Ile Tyr Tyr Ser Gly Xaa Thr Tyr Tyr Asn Pro Ser Leu Lys Ser (SEQ ID NO: 50120)

Asp Xaa Xaa Xaa Xaa Gly Met Asp Val (SEQ ID NO: 50121)

Ser Gly Gly Asp Tyr Trp Ser (SEQ ID NO: 50603)

Tyr Ile Tyr Tyr Ser Gly Ser Thr Tyr Tyr Asn Pro Ser Leu Lys Ser (SEQ ID NO: 50604)

Asp Ser Ser Ser Tyr Gly Met Asp Val (SEQ ID NO: 50605)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | R | | | | | | | | | | | | | | | H_CDR3 | | | | | | | |
| CONSENSUS | Y | C | A | R | D | S | S | S | Y | | | | | | | | | | | | | | | | | |
| 21-225_190F10_HC | . | . | . | . | . | . | . | . | . | | | | | | | | | | | | | | | | | |
| 21-225_191A2_HC | . | . | . | . | . | . | . | L | K | | | | | | | | | | | | | | | | | |
| 21-225_192H8_HC | . | . | . | . | . | . | A | . | . | | | | | | | | | | | | | | | | | |
| 21-225_194D12_HC | . | . | . | . | . | G | . | G | H | | | | | | | | | | | | | | | | | |
| 21-225_194G5_HC | . | . | . | . | . | . | . | L | . | | | | | | | | | | | | | | | | | |
| 21-225_198B8_HC | . | . | . | . | . | . | . | . | . | | | | | | | | | | | | | | | | | |
| 21-225_212H12_HC | . | . | . | . | . | . | . | . | . | | | | | | | | | | | | | | | | | |
| 21-225_214H3_HC | . | . | . | . | . | . | . | . | . | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | H_FR4 | | | | | |
| CONSENSUS | | | | | G | M | D | V | W | G | Q | G | T | T | V | T | V | S | S |
| 21-225_190F10_HC | | | | | . | . | . | . | . | . | . | . | . | . | . | . | . | . | . |
| 21-225_191A2_HC | | | | | . | . | . | . | . | . | . | . | . | . | . | . | . | . | . |
| 21-225_192H8_HC | | | | | . | . | . | . | . | . | . | . | . | . | . | . | . | . | . |
| 21-225_194D12_HC | | | | | . | . | . | . | . | . | . | . | . | . | . | . | . | . | . |
| 21-225_194G5_HC | | | | | . | . | . | . | . | . | . | . | . | . | . | . | . | . | . |
| 21-225_198B8_HC | | | | | . | . | . | . | . | . | . | . | . | . | . | . | . | . | . |
| 21-225_212H12_HC | | | | | . | . | . | . | . | . | . | . | . | . | . | . | . | . | . |
| 21-225_214H3_HC | | | | | . | . | . | . | . | . | . | . | . | . | . | . | . | . | . |

FIGURE 57 (Continued)

Table 95. Consensus 15 - VK1jA30/JK4 (SEQ ID NO: 50312):

DIQMTQSPSSLSASVGDRVTITCRAS--QGIR------NDLGWYQQKPGKAPKRLIYA------ASSLQSGVPSRFSGSGSG--TEFTLTISSLQPEDFATYYCLQHNS................YPLTFGGGTKVEIKR wherein:

R at position 24 can be substituted with L

A at position 25 can be substituted with T

Q at position 29 can be substituted with R

G at position 30 can be substituted with D, A or V

I at position 31 can be substituted with M or V

R at position 32 can be substituted with E, K, N or S

N at position 39 can be substituted with S, D, T, K or I

D at position 40 can be substituted with N or A

L at position 41 can be substituted with F or V

G at position 42 can be substituted with D or N

A at position 58 can be substituted with T, S, V, G, D or R

A at position 67 can be substituted with T, V or E

S at position 68 can be substituted with F, C or Y

S at position 69 can be substituted with N, T, F, R or I

L at position 70 can be substituted with V, F or S

Q at position 71 can be substituted with H or E

S at position 72 can be substituted with R, N, T or G

FIGURE 57 (Continued)

L at position 107 can be substituted with V or I

Q at position 108 can be substituted with H

H at position 109 can be substituted with D, Y, N or R

N at position 110 can be substituted with S, Y, T, D, K, A, I, E, H, P or R

S at position 111 can be substituted with I, N, R, T, D, A, L or V

Y at position 135 can be substituted with F, H or S

P at position 136 can be substituted with A or M

L at position 137 can be substituted with P, F, N or V

T at position 138 can be substituted with K or I

Xaa Xaa Ser Xaa Xaa Xaa Xaa Xaa Xaa Xaa Xaa (SEQ ID NO: 50122)

Xaa Xaa Xaa Xaa Xaa Xaa Xaa Xaa (SEQ ID NO: 50123)

Xaa Xaa Xaa Xaa Xaa Xaa Xaa Xaa Xaa Xaa (SEQ ID NO: 50124)

Arg Ala Ser Gln Gly Ile Arg Asn Asp Leu Gly (SEQ ID NO: 50606)

Ala Ala Ser Ser Leu Gln Ser (SEQ ID NO: 50607)

Leu Gln His Asn Ser Tyr Pro Leu Thr (SEQ ID NO: 50608)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | D | I | Q | M | T | Q | S | P | S | S | L | S | A | S | V | G | D | R | V | T | I | T | C | R | A | S |
| | | | | | | | | | | | | K_FR1 | | | | | | | | | | | | | | |
| CONSENSUS | | | | | | | | | | | | | | | | | | | | | | | | | | |
| 21-225_18A1_LC | | | | | | | | | | | | | | | | | | | | | | | | | T | |
| 21-225_18A3_LC | | | | | | | | | | | | | | | | | | | | | | | | | | |
| 21-225_18C6_LC | | | | | | | | | | | | | | | | | | | | | | | | | | |
| 21-225_18E8_LC | | | | | | | | | | | | | | | | | | | | | | | | | | |
| 21-225_19DC8_LC | | | | | | | | | | | | | | | | | | | | | | | | | | |
| 21-225_193A5_LC | | | | | | | A | | | | | | | | | | | | | | | S | | | | |
| 21-225_193E7_LC | | | | | | | | | | | | | | | | | | | | | | | | | | |
| 21-225_196C10_LC | | | | | | | | | | | | | | | | G | | | | | | | | | | |
| 21-225_199E3_LC | | | | | | | | | | | | | | | | | | | | | | | | | | |
| 21-225_19D11_LC | | | | | | | | | | | | | | | | | | | | | | | | | | |
| 21-225_19E1_LC | | | | | | | | | | | | | | | | | | | | | | | | | | |
| 21-225_19F3_LC | | | | | | | | | | | | | | | | | | | | | | | | | | |
| 21-225_1A2_LC | | | | | | | | | | | | | | | | | | | | | | | | | | |
| 21-225_1C12_LC | | | | | | | | | | | | | | | | | | | | | | | | | | |
| 21-225_1F2_LC | | | | | | | | | | | | | | | | | | | | | | | | | | |
| 21-225_200F12_LC | | | | | | | | | | | | | | | | | | | | | | | | | | |
| 21-225_200H9_LC | | | | | | | | | | | | | | | | | | | | | | | | | | |
| 21-225_201A1_LC | | | | | | | | | | | | | | | | | | | | | | | | | | |
| 21-225_201A10_LC | | | | | | | | | | | | | | | | | | | | | | | | | | |
| 21-225_204H8_LC | | | | | | | | | | | | | | | | | | | | | | | | | | |
| 21-225_205H8_LC | | | | | | | | | | | | | | | | | | | | | | | | | | |
| 21-225_20A10_LC | | | | | | | | | | | | | | | | | | | | | | | | | | |
| 21-225_20A7_LC | | | | | | | | | | | | | | | | Q | | | | | | | | | | |
| 21-225_20C2_LC | | | | | | | | | | | | | | | | | | | | | | | | | | |
| 21-225_20C8_LC | | | | | | | | | | | | | | | | | | | | | | | | | | |
| 21-225_20D5_LC | | | | | | | | | | | | | | | | | | | | | | | | | | |
| 21-225_20E12_LC | | | | | | | | | | | | | | | | | | | | | | | | | | |
| 21-225_20E5_LC | | | | | | | | | | | | | | | | | | | | | | | | | | |
| 21-225_20G2_LC | | | | | | | | | | | | | | | | | | | | | | | | | | |

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | Q | M | T | Q | S | P | S | S | L | S | A | S | V | G | D | R | V | T | I | T | C | R | A | S |
| 21-225_8C9_LC | . | . | . | . | . | . | . | . | . | . | . | . | . | . | . | . | . | . | . | . | . | . | . | . | . | . |
| 21-225_8D12_LC | . | . | . | . | . | . | . | . | . | . | . | . | . | . | - | . | . | . | . | . | . | . | . | . | . | . |
| 21-225_8F11_LC | . | . | . | . | . | . | . | . | . | . | . | . | . | . | . | . | . | . | . | . | . | . | . | . | . | . |
| 21-225_8H7_LC | . | . | . | . | . | . | . | . | . | . | . | . | . | . | . | . | . | . | . | . | . | . | . | . | . | . |
| 21-225_96A3_LC | . | . | . | . | . | . | . | . | . | . | . | R | . | . | . | . | . | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | K_FR2 | | | | | |
| CONSENSUS | - | - | Q | G | I | R | - | - | - | - | - | - | N | D | L | G | W | Y | Q | Q | K | P | G | K | A | P |
| 21-225_8C9_LC | . | . | . | A | . | . | . | . | . | . | . | . | . | . | . | D | . | . | . | . | . | . | . | . | . | . |
| 21-225_8D12_LC | . | . | . | . | . | . | . | . | . | . | . | . | . | . | . | . | . | . | . | . | . | . | . | . | . | . |
| 21-225_8F11_LC | . | . | . | . | . | . | . | . | . | . | . | . | S | . | . | . | . | R | . | . | . | . | . | . | . | . |
| 21-225_8H7_LC | . | . | . | . | . | . | . | . | . | . | . | . | . | . | . | . | . | . | . | . | . | . | . | . | . | . |
| 21-225_96A3_LC | . | . | . | . | . | . | . | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | R | L | I | Y | A | . | . | . | . | . | . | . | . | A | S | S | L | Q | S | G | V | P | S | R | F |
| 21-225_8C9_LC | . | . | . | . | . | . | . | . | . | . | . | . | . | . | . | . | . | . | . | . | . | . | . | . | . | . |
| 21-225_8D12_LC | . | . | . | . | . | . | . | . | . | . | . | . | . | . | . | . | . | . | . | . | . | . | . | . | . | . |
| 21-225_8F11_LC | . | . | . | . | F | D | . | . | . | . | . | . | . | . | . | . | . | . | . | . | . | . | . | . | . | . |
| 21-225_8H7_LC | . | . | . | . | . | . | . | . | . | . | . | . | . | . | . | . | . | V | . | . | . | . | . | . | . | . |
| 21-225_96A3_LC | . | . | . | . | . | . | . | . | . | . | . | . | . | . | . | . | T | . | . | . | . | . | . | . | . | . |
| 21-225_9E8_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| CONSENSUS | S | G | S | G | S | G | - | - | T | E | F | K_FR3 | L | T | I | S | S | L | Q | P | E | D | F | A | T | Y |
| 21-225_8C9_LC | | | | | | | | | | | | | | | | | | | | | | | | | | |
| 21-225_8D12_LC | N | | | | | | | | | | | | | | | | | | | | | | | | | |
| 21-225_8F11_LC | | | | | | | | | | | | | | | | | | | | | | | | | | |
| 21-225_8H7_LC | | | | | | | | | | | | | | | | | | | | T | | | | | | |
| 21-225_96A3_LC | | | | | | | | | | | | | | | | | G | | | | | | | | | |
| 21-225_9E8_LC | | | | | | | | | | | | | | | | | | | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | L | Q | H | N | S | . | . | . | . | . | . | . | . | . | . | . | . | . | . | . | . | . | . | . |
| 21-225_10G5_LC | . | . | . | . | . | . | . | . | . | . | . | . | . | . | . | . | . | . | . | . | . | . | . | . | . | . |
| 21-225_10H12_LC | . | . | . | . | . | S | . | . | . | . | . | . | . | . | . | . | . | . | . | . | . | . | . | . | . | . |
| 21-225_11F10_LC | . | . | . | . | . | S | . | . | . | . | . | . | . | . | . | . | . | . | . | . | . | . | . | . | . | . |
| 21-225_11F5_LC | . | . | . | . | . | . | . | . | . | . | . | . | . | . | . | . | . | . | . | . | . | . | . | . | . | . |
| 21-225_11G7_LC | . | . | V | . | . | . | . | . | . | . | . | . | . | . | . | . | . | . | . | . | . | . | . | . | . | . |
| 21-225_12A1_LC | . | . | . | . | . | . | N | . | . | . | . | . | . | . | . | . | . | . | . | . | . | . | . | . | . | . |
| 21-225_13E6_LC | . | . | . | . | . | . | . | . | . | . | . | . | . | . | . | . | . | . | . | . | . | . | . | . | . | . |
| 21-225_13H3_LC | . | . | . | . | . | . | . | . | . | . | . | . | . | . | . | . | . | . | . | . | . | . | . | . | . | . |
| 21-225_13H5_LC | . | . | . | . | . | . | . | . | . | . | . | . | . | . | . | . | . | . | . | . | . | . | . | . | . | . |
| 21-225_14BF1_LC | . | . | . | . | . | S | T | . | . | . | . | . | . | . | . | . | . | . | . | . | . | . | . | . | . | . |
| 21-225_146G11_LC | . | . | . | . | . | Q | . | . | . | . | . | . | . | . | . | . | . | . | . | . | . | . | . | . | . | . |
| 21-225_146H9_LC | . | . | . | . | . | . | N | . | . | . | . | . | . | . | . | . | . | . | . | . | . | . | . | . | . | . |
| 21-225_148E11_LC | . | . | . | . | . | . | . | . | . | . | . | . | . | . | . | . | . | . | . | . | . | . | . | . | . | . |
| 21-225_148F12_LC | F | . | . | . | . | . | . | . | . | . | . | . | . | . | . | . | . | . | . | . | . | . | . | . | . | . |
| 21-225_149F12_LC | . | . | . | . | . | . | . | . | . | . | . | . | . | . | . | . | . | . | . | . | . | . | . | . | . | . |
| 21-225_149G1_LC | . | . | V | . | . | Y | . | . | . | . | . | . | . | . | . | . | . | . | . | . | . | . | . | . | . | . |
| 21-225_149G5_LC | . | . | V | . | . | Y | . | . | . | . | . | . | . | . | . | . | . | . | . | . | . | . | . | . | . | . |
| 21-225_14B1_LC1_LC | . | S | . | . | . | S | . | . | . | . | . | . | . | . | . | . | . | . | . | . | . | . | . | . | . | . |
| 21-225_14B2_LC | . | . | . | . | . | . | . | . | . | . | . | . | . | . | . | . | . | . | . | . | . | . | . | . | . | . |
| 21-225_14C2_LC | . | . | V | . | . | S | N | . | . | . | . | . | . | . | . | . | . | . | . | . | . | . | . | . | . | . |
| 21-225_14E3_LC | . | . | . | . | . | S | N | . | . | . | . | . | . | . | . | . | . | . | . | . | . | . | . | . | . | . |
| 21-225_150E7_LC | . | . | . | . | N | . | . | . | . | . | . | . | . | . | . | . | . | . | . | . | . | . | . | . | . | . |
| 21-225_152H8_LC | . | . | . | . | . | S | N | . | . | . | . | . | . | . | . | . | . | . | . | . | . | . | . | . | . | . |
| 21-225_156G1_LC | . | . | V | . | . | . | . | . | . | . | . | . | . | . | . | . | . | . | . | . | . | . | . | . | . | . |
| 21-225_158H5_LC | . | . | . | . | . | S | N | . | . | . | . | . | . | . | . | . | . | . | . | . | . | . | . | . | . | . |
| 21-225_15A1_LC | . | . | . | . | . | T | . | . | . | . | . | . | . | . | . | . | . | . | . | . | . | . | . | . | . | . |
| 21-225_15C9_LC | . | . | . | . | . | . | . | . | . | . | . | . | . | . | . | . | . | . | . | . | . | . | . | . | . | . |
| 21-225_15E3_LC | . | . | . | . | . | S | . | . | . | . | . | . | . | . | . | . | . | . | . | . | . | . | . | . | . | . |
| 21-225_15G7_LC | . | . | . | . | . | . | N | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | L | Q | H | N | S | | | | | | | | | | | | | | | | | | | |
| 21-225_15H1_LC | | | | | | S | | | | | | | | | | | | | | | | | | | | |
| 21-225_15H10_LC | | | | | | | | | | | | | | | | | | | | | | | | | | |
| 21-225_15H8_LC | | | | | | | | | | | | | | | | | | | | | | | | | | |
| 21-225_160B10_LC | | | | | | S | N | | | | | | | | | | | | | | | | | | | |
| 21-225_160H3_LC | | | | | | S | | | | | | | | | | | | | | | | | | | | |
| 21-225_169B1_LC | | | | | | Y | | | | | | | | | | | | | | | | | | | | |
| 21-225_169F9_LC | | | | | | Y | N | | | | | | | | | | | | | | | | | | | |
| 21-225_16A1_LC | | | | | | S | | | | | | | | | | | | | | | | | | | | |
| 21-225_16B7_LC | | | | | | | | | | | | | | | | | | | | | | | | | | |
| 21-225_16E12_LC | | | | | | | | | | | | | | | | | | | | | | | | | | |
| 21-225_16F11_LC | | | | | | | | | | | | | | | | | | | | | | | | | | |
| 21-225_16F4_LC | | | L | | | | | | | | | | | | | | | | | | | | | | | |
| 21-225_170D11_LC | | | | Q | | Y | | | | | | | | | | | | | | | | | | | | |
| 21-225_170D5_LC | | | | | | Y | | | | | | | | | | | | | | | | | | | | |
| 21-225_170G4_LC | | | | | | Y | | | | | | | | | | | | | | | | | | | | |
| 21-225_170G5_LC | | | | | | Y | | | | | | | | | | | | | | | | | | | | |
| 21-225_171A4_LC | | | | | | Y | | | | | | | | | | | | | | | | | | | | |
| 21-225_171C3_LC | | | | | | Y | | | | | | | | | | | | | | | | | | | | |
| 21-225_172B3_LC | | | | | | Y | | | | | | | | | | | | | | | | | | | | |
| 21-225_172G8_LC | | | | Q | | Y | | | | | | | | | | | | | | | | | | | | |
| 21-225_173H12_LC | | | | | | Y | | | | | | | | | | | | | | | | | | | | |
| 21-225_175G1_LC | | | | | | | | | | | | | | | | | | | | | | | | | | |
| 21-225_176B11_LC | | | | Q | | | | | | | | | | | | | | | | | | | | | | |
| 21-225_178B10_LC | | | | | | | | | | | | | | | | | | | | | | | | | | |
| 21-225_17A10_LC | | | | | | | | | | | | | | | | | | | | | | | | | | |
| 21-225_17B5_LC | | | | | | | | | | | | | | | | | | | | | | | | | | |
| 21-225_17F9_LC | | | | | | Y | T | | | | | | | | | | | | | | | | | | | |
| 21-225_17H12_LC | | | | | | | | | | | | | | | | | | | | | | | | | | |
| 21-225_17H8_LC | | | | | | Y | | | | | | | | | | | | | | | | | | | | |

FIGURE 57 (Continued)

| Reference # | 105 | 106 | 107 | 108 | 109 | 110 | 111 | 112-130 K_CDR3 |
|---|---|---|---|---|---|---|---|---|
| CONSENSUS | Y | C | L | Q | H | N | S | |
| 21-225_20G9_LC | | | | | | S | T | |
| 21-225_20H10_LC | | | | | | | | |
| 21-225_20H12_LC | | | | | | | | |
| 21-225_21E5_LC | | | | | | S | | |
| 21-225_21F3_LC | | | | | | S | | |
| 21-225_21G7_LC | | | | | | | | |
| 21-225_21H3_LC | | | | | | | | |
| 21-225_224A1_LC | | | | | | | | |
| 21-225_224B1_LC | | | | | | | | |
| 21-225_224C3_LC | | | | | | | T | |
| 21-225_224D10_LC | | | | | | S | T | |
| 21-225_22B7_LC | | | | | | S | T | |
| 21-225_22C1_LC | | | | | | | | |
| 21-225_22D12_LC | | | | | | A | | |
| 21-225_22F2_LC | | | | | | | | |
| 21-225_22F9_LC | | | | | | | | |
| 21-225_22G8_LC | | | | | | S | | |
| 21-225_22G9_LC | | | | | | S | | |
| 21-225_22H4_LC | | | | | | | | |
| 21-225_23A3_LC | | | | | | | | |
| 21-225_23C8_LC | | | | | | | | |
| 21-225_23D1_LC | | | | | | | | |
| 21-225_23H11_LC | | | | | | | N | |
| 21-225_24E5_LC | | | | | | | | |
| 21-225_25E6_LC | | | | | | | | |
| 21-225_25H10_LC | | | | | | | | |
| 21-225_25H11_LC | | | | | | | | |
| 21-225_27C3_LC | | | | | | | | |
| 21-225_27F2_LC | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | K_CDR3 | | | | | | | |
| CONSENSUS | Y | C | L | Q | H | N | S | . | . | . | . | . | . | . | . | . | . | . | . | . | . | . | . | . | . | . |
| 21-225_54C6_LC | F | . | . | . | . | . | . | . | . | . | . | . | . | . | . | . | . | . | . | . | . | . | . | . | . | . |
| 21-225_55B8_LC | . | . | . | . | Q | D | . | . | . | . | . | . | . | . | . | . | . | . | . | . | . | . | . | . | . | . |
| 21-225_56H8_LC | . | . | . | . | . | . | . | . | . | . | . | . | . | . | . | . | . | . | . | . | . | . | . | . | . | . |
| 21-225_56F1_LC | . | . | . | . | . | . | . | . | . | . | . | . | . | . | . | . | . | . | . | . | . | . | . | . | . | . |
| 21-225_59E6_LC | . | . | . | . | . | S | N | . | . | . | . | . | . | . | . | . | . | . | . | . | . | . | . | . | . | . |
| 21-225_5H2_LC | . | . | . | . | . | S | . | . | . | . | . | . | . | . | . | . | . | . | . | . | . | . | . | . | . | . |
| 21-225_5H7_LC | . | . | . | . | . | . | T | . | . | . | . | . | . | . | . | . | . | . | . | . | . | . | . | . | . | . |
| 21-225_60E8_LC | . | . | . | . | . | S | . | . | . | . | . | . | . | . | . | . | . | . | . | . | . | . | . | . | . | . |
| 21-225_62E2_LC | . | . | . | . | . | S | . | . | . | . | . | . | . | . | . | . | . | . | . | . | . | . | . | . | . | . |
| 21-225_62E4_LC | . | . | . | . | . | S | . | . | . | . | . | . | . | . | . | . | . | . | . | . | . | . | . | . | . | . |
| 21-225_84E1_LC | . | . | . | . | Q | . | . | . | . | . | . | . | . | . | . | . | . | . | . | . | . | . | . | . | . | . |
| 21-225_68D12_LC | . | . | . | . | . | . | . | . | . | . | . | . | . | . | . | . | . | . | . | . | . | . | . | . | . | . |
| 21-225_68F11_LC | . | . | . | . | . | D | N | . | . | . | . | . | . | . | . | . | . | . | . | . | . | . | . | . | . | . |
| 21-225_6A6_LC | . | . | . | . | . | S | N | . | . | . | . | . | . | . | . | . | . | . | . | . | . | . | . | . | . | . |
| 21-225_6C12_LC | . | . | . | . | . | S | N | . | . | . | . | . | . | . | . | . | . | . | . | . | . | . | . | . | . | . |
| 21-225_6D4_LC | F | . | . | . | . | . | . | . | . | . | . | . | . | . | . | . | . | . | . | . | . | . | . | . | . | . |
| 21-225_8G12_LC | . | . | . | . | . | . | . | . | . | . | . | . | . | . | . | . | . | . | . | . | . | . | . | . | . | . |
| 21-225_70E12_LC | . | . | . | . | . | . | . | . | . | . | . | . | . | . | . | . | . | . | . | . | . | . | . | . | . | . |
| 21-225_70E8_LC | . | . | . | . | . | . | . | . | . | . | . | . | . | . | . | . | . | . | . | . | . | . | . | . | . | . |
| 21-225_73G6_LC | . | . | L | . | . | S | A | . | . | . | . | . | . | . | . | . | . | . | . | . | . | . | . | . | . | . |
| 21-225_74A1_LC | . | . | . | . | . | S | L | . | . | . | . | . | . | . | . | . | . | . | . | . | . | . | . | . | . | . |
| 21-225_74D7_LC | . | . | . | . | . | . | . | . | . | . | . | . | . | . | . | . | . | . | . | . | . | . | . | . | . | . |
| 21-225_74E4_LC | F | . | . | . | . | . | . | . | . | . | . | . | . | . | . | . | . | . | . | . | . | . | . | . | . | . |
| 21-225_75H7_LC | . | . | . | . | . | . | . | . | . | . | . | . | . | . | . | . | . | . | . | . | . | . | . | . | . | . |
| 21-225_7C4_LC | . | . | . | . | . | . | . | . | . | . | . | . | . | . | . | . | . | . | . | . | . | . | . | . | . | . |
| 21-225_7E9_LC | . | . | . | . | . | S | . | . | . | . | . | . | . | . | . | . | . | . | . | . | . | . | . | . | . | . |
| 21-225_7F4_LC | . | . | . | . | . | . | . | . | . | . | . | . | . | . | . | . | . | . | . | . | . | . | . | . | . | . |
| 21-225_7H11_LC | . | . | . | . | . | . | . | . | . | . | . | . | . | . | . | . | . | . | . | . | . | . | . | . | . | . |
| 21-225_7H7_LC | . | . | . | . | . | S | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | K_CDR3 | | | | | | | | | | | | | | | | | | |
| CONSENSUS | Y | C | L | Q | H | N | S | . | . | . | . | . | . | . | . | . | . | . | . | . | . | . | . | . | . | . |
| 21-225_8C9_LC | . | . | . | . | . | . | . | . | . | . | . | . | . | . | . | . | . | . | . | . | . | . | . | . | . | . |
| 21-225_8D12_LC | . | . | . | . | . | S | . | . | . | . | . | . | . | . | . | . | . | . | . | . | . | . | . | . | . | . |
| 21-225_8F11_LC | . | . | . | . | . | Y | T | . | . | . | . | . | . | . | . | . | . | . | . | . | . | . | . | . | . | . |
| 21-225_8H7_LC | . | . | . | . | . | . | . | . | . | . | . | . | . | . | . | . | . | . | . | . | . | . | . | . | . | . |
| 21-225_96A3_LC | H | . | . | . | . | S | N | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 Y | 136 P | 137 L | 138 T | 139 F | 140 G | 141 G | 142 G | 143 T | 144 K | 145 V | 146 E | 147 I | 148 K | 149 R |
|---|---|---|---|---|---|---|---|---|---|---|---|---|---|---|---|---|---|---|---|
| CONSENSUS | , | , | , | , | Y | P | L | T | F | G | G | G | T | K | V | E | I | K | R |
| 21-225_10G5_LC | . | . | . | . | . | . | . | . | . | . | . | . | . | . | . | . | . | . | . |
| 21-225_10H12_LC | . | . | . | . | . | . | . | . | . | . | . | . | . | . | . | . | . | . | . |
| 21-225_11F10_LC | . | . | . | . | . | . | . | . | . | . | . | . | . | . | . | . | . | ※ | . |
| 21-225_11F5_LC | . | . | . | . | . | . | . | . | . | . | . | . | . | . | . | . | . | . | . |
| 21-225_11G7_LC | . | . | . | . | . | . | . | . | . | . | . | . | . | ※ | . | . | . | . | . |
| 21-225_12A1_LC | . | . | . | . | . | . | . | . | . | . | . | . | . | . | . | A | . | . | . |
| 21-225_13E6_LC | . | . | . | . | . | . | . | . | . | . | . | . | . | . | . | . | . | . | . |
| 21-225_13H3_LC | . | . | . | . | . | . | . | . | . | . | . | . | . | . | . | . | . | . | . |
| 21-225_13H5_LC | . | . | . | . | . | . | . | . | . | . | . | . | . | . | . | . | . | . | . |
| 21-225_146F1_LC | . | . | . | . | . | . | . | . | . | . | . | . | . | . | . | . | . | . | . |
| 21-225_146G11_LC | . | . | . | . | . | . | . | . | . | . | . | . | . | . | . | . | . | . | . |
| 21-225_146H9_LC | . | . | . | . | . | . | . | . | . | . | . | . | . | . | . | . | . | . | . |
| 21-225_148E11_LC | . | . | . | . | . | . | . | . | . | . | . | . | . | . | . | . | . | . | . |
| 21-225_148F12_LC | . | . | . | . | . | . | . | - | . | . | . | . | . | . | . | . | . | . | . |
| 21-225_149F12_LC | . | . | . | . | . | . | . | . | . | . | . | . | . | . | . | . | . | . | . |
| 21-225_149G1_LC | . | . | . | . | . | . | . | . | . | . | . | . | . | . | . | . | . | . | . |
| 21-225_149G5_LC | . | . | . | . | . | . | . | . | . | . | . | . | . | . | . | . | . | . | . |
| 21-225_14B1_LC1_LC | . | . | . | . | . | . | . | . | . | . | . | . | . | . | . | . | . | . | . |
| 21-225_14B2_LC | . | . | . | . | . | . | & | . | . | . | . | . | . | . | . | . | . | ※ | . |
| 21-225_14C2_LC | . | . | . | . | . | . | . | . | . | . | . | . | . | . | . | . | . | . | . |
| 21-225_14E3_LC | . | . | . | . | . | . | . | . | . | . | . | . | . | . | . | . | . | . | . |
| 21-225_150E7_LC | . | . | . | . | . | . | > | . | . | . | . | . | . | . | . | . | . | T | . |
| 21-225_152H9_LC | . | . | . | . | . | . | . | . | . | . | . | . | . | . | . | . | . | . | Q |
| 21-225_156G1_LC | . | . | . | . | . | . | . | . | . | . | . | . | . | . | . | . | . | . | . |
| 21-225_158H5_LC | . | . | . | . | . | . | . | ※ | . | . | . | . | . | ※ | . | . | . | Y | . |
| 21-225_15A1_LC | . | . | . | . | . | . | . | . | . | . | . | . | . | . | . | . | . | . | . |
| 21-225_15C9_LC | . | . | . | . | . | . | . | . | . | . | . | . | . | . | . | . | . | . | . |
| 21-225_15E3_LC | . | . | . | . | . | . | . | . | . | . | . | . | . | . | . | . | . | . | . |
| 21-225_15G7_LC | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 K, FR4 | 145 | 146 | 147 | 148 | 149 |
|---|---|---|---|---|---|---|---|---|---|---|---|---|---|---|---|---|---|---|---|
| CONSENSUS | - | - | - | - | Y | P | L | T | F | G | G | G | T | K | V | E | I | K | R |
| 21-225_8C9_LC | . | . | . | . | . | . | . | . | . | . | . | . | . | . | . | . | . | . | . |
| 21-225_8D12_LC | . | . | . | . | . | . | . | . | . | . | . | . | . | . | . | . | . | . | . |
| 21-225_8F11_LC | . | . | . | . | . | . | . | . | . | . | . | . | . | . | . | . | . | . | . |
| 21-225_8H7_LC | . | . | . | . | . | . | R | . | . | . | . | . | . | . | . | . | . | . | . |
| 21-225_96A3_LC | . | . | . | . | . | . | . | . | . | . | . | . | . | . | . | . | . | . | . |
| 21-225_9E8_LC | . | . | . | . | . | . | . | . | . | . | . | . | . | . | . | . | . | . | . |

Table 96. Consensus 16 - VL3jir/JL2 (SEQ ID NO: 50313):

SYELTQP-PSVSVSPGQTASITCSGD---KLGD---KYACWYQQKPGQSPVLVTYQ------DRKRPSGIPERFSGSNSG--
NTATLTISGTQAMDEADYYCQAWDS-------------STVVFGGGTKLTVLG wherein:

D at position 26 can be substituted with N, E, Y or S

K at position 30 can be substituted with R, N, E or T

L at position 31 can be substituted with M or S

D at position 33 can be substituted with N, E, G, Y, T, H or V

K at position 39 can be substituted with R

Y at position 40 can be substituted with F or S

A at position 41 can be substituted with V, T, D or S

C at position 42 can be substituted with S, Y, W or H

Q at position 58 can be substituted with E or K

D at position 67 can be substituted with N

R at position 68 can be substituted with S, N, K, Y, M, T, G or I

K at position 69 can be substituted with R or Q

P at position 71 can be substituted with S

S at position 72 can be substituted with L

Q at position 107 can be substituted with L or K

A at position 108 can be substituted with T

FIGURE 57 (Continued)

W at position 109 can be substituted with R

D at position 110 can be substituted with H, V, N or G

S at position 111 can be substituted with N, null (-), I, R, K or T null (-) at position 134 can be substituted with S, N or R S at position 135 can be substituted with T, N, R, G, F, I V or Y T at position 136 can be substituted with S, Y, A, F, P, N, K, I or R V at position 137 can be substituted with A, T, M L or G V at position 138 can be substituted with I, L, A or M Ser Gly Xaa Xaa Gly Xaa Xaa Xaa Xaa (SEQ ID NO: 50125)

Xaa Xaa Xaa Arg Xaa Xaa (SEQ ID NO: 50126)

Xaa Xaa Xaa Xaa Xaa Xaa Xaa Xaa Xaa Xaa Xaa (SEQ ID NO: 50228)

Ser Gly Asp Lys Leu Gly Asp Lys Tyr Ala Cys (SEQ ID NO: 50609)

Gln Asp Arg Lys Arg Pro Ser (SEQ ID NO: 50610)

Gln Ala Trp Asp Ser Ser Thr Val Val (SEQ ID NO: 50611)

| Reference # | 109 | 110 | 111 | 112 | 113 | 114 | 115 | 116 | 117 | 118 | 119 | 120 | 121 | 122 L_CDR3 | 123 | 124 | 125 | 126 | 127 | 128 | 129 | 130 | 131 | 132 | 133 | 134 | 135 |
|---|---|---|---|---|---|---|---|---|---|---|---|---|---|---|---|---|---|---|---|---|---|---|---|---|---|---|---|
| CONSENSUS | W | D | S | | | | | | | | | | | | | | | | | | | | | | | | S |
| 21-225_62B12_LC | | | | | | | | | | | | | | | | | | | | | | | | | | | |
| 21-225_62D10_LC | | | | | | | | | | | | | | | | | | | | | | | | | | | |
| 21-225_62E3_LC | | | | | | | | | | | | | | | | | | | | | | | | | | | |
| 21-225_62E8_LC | | | N | | | | | | | | | | | | | | | | | | | | | N | | | |
| 21-225_65E8_LC | | | - | | | | | | | | | | | | | | | | | | | | | | | | |
| 21-225_66G9_LC | | | N | | | | | | | | | | | | | | | | | | | | | | | | |
| 21-225_67F10_LC | | | N | | | | | | | | | | | | | | | | | | | | | N | | | |
| 21-225_68D8_LC | | | N | | | | | | | | | | | | | | | | | | | | | | | | |
| 21-225_68G6_LC | | | N | | | | | | | | | | | | | | | | | | | | | | | | |
| 21-225_69B11_LC | | | N | | | | | | | | | | | | | | | | | | | | | | | | |
| 21-225_69B9_LC | | | N | | | | | | | | | | | | | | | | | | | | | T | | | T |
| 21-225_6B4_LC | | | | | | | | | | | | | | | | | | | | | | | | | | | |
| 21-225_6D9_LC | | > | | | | | | | | | | | | | | | | | | | | | | | | | |
| 21-225_71D4_LC | | | N | | | | | | | | | | | | | | | | | | | | | T | | | T |
| 21-225_72B4_LC | | | N | | | | | | | | | | | | | | | | | | | | | | | | |
| 21-225_72D5_LC | | | | | | | | | | | | | | | | | | | | | | | | | | | |
| 21-225_73C4_LC | | | | | | | | | | | | | | | | | | | | | | | | | | | |
| 21-225_74A9_LC | | | | | | | | | | | | | | | | | | | | | | | | | | | |
| 21-225_74B3_LC | | | | | | | | | | | | | | | | | | | | | | | | | | | |
| 21-225_74C8_LC | | | | | | | | | | | | | | | | | | | | | | | | | | | |
| 21-225_76B4_LC | | | | | | | | | | | | | | | | | | | | | | | | | | | |
| 21-225_77A2_LC | | | | | | | | | | | | | | | | | | | | | | | | | | | |
| 21-225_78E9_LC | | | | | | | | | | | | | | | | | | | | | | | | | | | |
| 21-225_79E7_LC | | | | | | | | | | | | | | | | | | | | | | | | | | | |
| 21-225_8D8_LC | | | | | | | | | | | | | | | | | | | | | | | | | | | |
| 21-225_92A4_LC | | | | | | | | | | | | | | | | | | | | | | | | | | | |
| 21-225_96B5_LC | | | | | | | | | | | | | | | | | | | | | | | | | | | |
| 21-225_97E6_LC | | | | | | | | | | | | | | | | | | | | | | | | | | | |
| 21-225_9H10_LC | | | | | | | | | | | | | | | | | | | | | | | | | D | | |

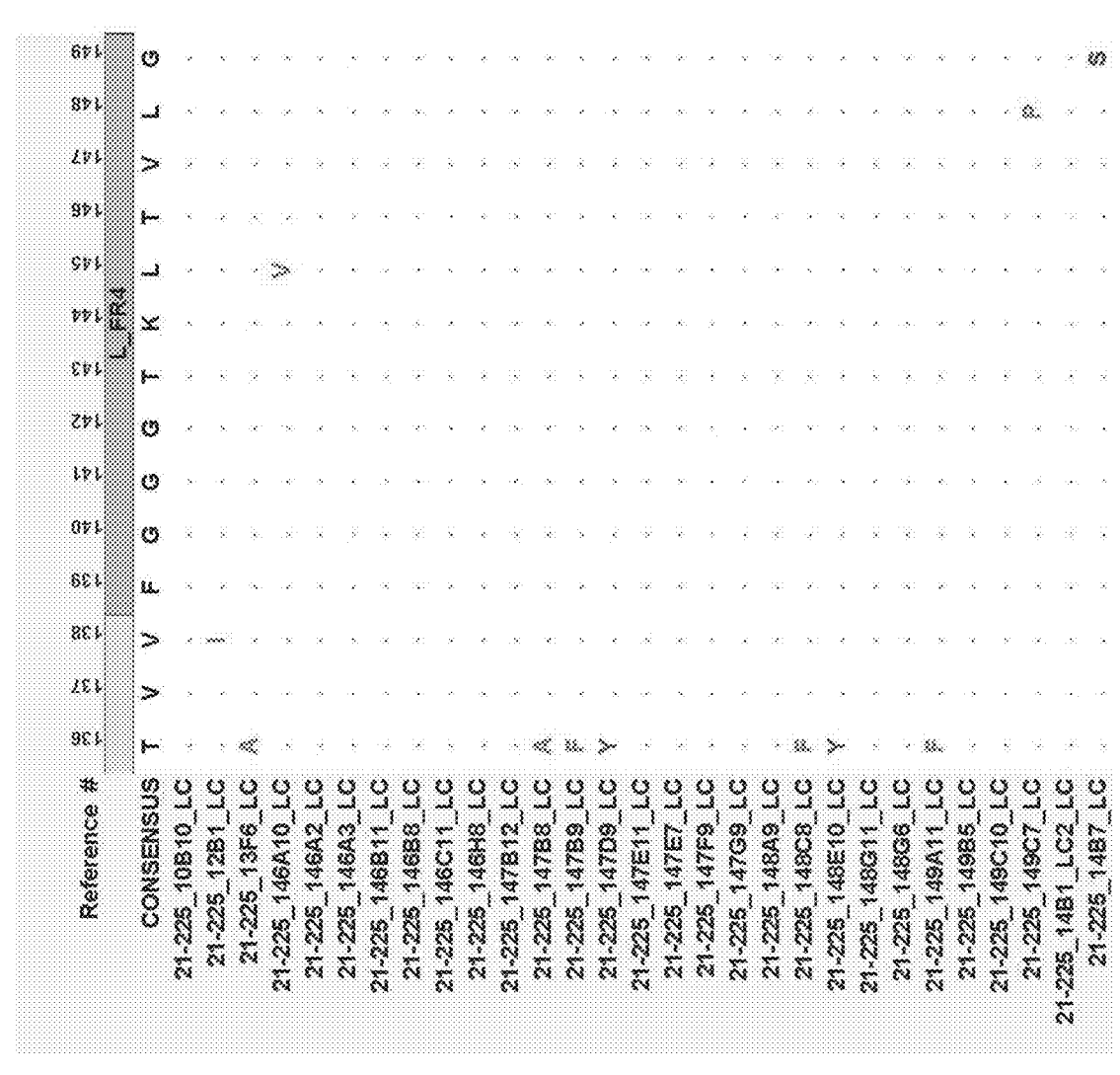

FIGURE 57 (Continued)

Table 97.  Consensus 17 - VK3|A27/JK1 (SEQ ID NO: 50314):

EIVLTQSPGTLSLSPGERATLSCRAS--QSVYS-----SYLAWYQQKPGQAPRLLIYG--------ASSRATGIPDRFSGSGSG--
TDFTLTISRLEPEDFAVYYCQQYDN................SPWTFGQGTKVEIKR wherein:

R at position 24 can be substituted with W

A at position 25 can be substituted with T

S at position 26 can be substituted with G or R

Q at position 29 can be substituted with P

S at position 30 can be substituted with N, I or R

V at position 31 can be substituted with I or F

Y at position 32 can be substituted with R, S, N, D, F, H, G or W

S at position 33 can be substituted with T, N, G, L or R

S at position 39 can be substituted with N, G, R, D, A or Y

Y at position 40 can be substituted with F or H

A at position 42 can be substituted with V or S

G at position 58 can be substituted with D or V

A at position 67 can be substituted with T, P or V

S at position 68 can be substituted with F, Y, A or T

S at position 69 can be substituted with R, N or A

A at position 71 can be substituted with S or T

T at position 72 can be substituted with P, S or A

FIGURE 57 (Continued)

Q at position 107 can be substituted with H

Q at position 108 can be substituted with H

Y at position 109 can be substituted with S

D at position 110 can be substituted with E, G or H

N at position 111 can be substituted with S, null (-), R, T, I, D or G null (-) at position 134 can be substituted with S S at position 135 can be substituted with P, N or R P at position 136 can be substituted with S or V W at position 137 can be substituted with R T at position 138 can be substituted with A Xaa Xaa Xaa Xaa Xaa Xaa Xaa Xaa Xaa Leu Xaa (SEQ ID NO: 50127)

Xaa Xaa Xaa Xaa Arg Xaa Xaa (SEQ ID NO: 50128)

Xaa Xaa Xaa Xaa Xaa Xaa Xaa Xaa Xaa Xaa (SEQ ID NO: 50129)

Arg Ala Ser Gln Ser Val Tyr Ser Ser Tyr Leu Ala (SEQ ID NO: 50612)

Gly Ala Ser Ser Arg Ala Thr (SEQ ID NO: 50613)

Gln Gln Tyr Asp Asn Ser Pro Trp Thr (SEQ ID NO: 50614)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | E | I | V | L | T | Q | S | P | G | T | L | S | L | S | P | G | E | R | A | T | L | S | C | R | A | S |
| 21-225_91B4_LC | . | . | . | . | . | . | . | . | . | . | . | Y | . | . | . | . | . | . | . | . | . | . | . | . | . | . |
| 21-225_91E9_LC | . | . | . | . | . | . | . | . | . | . | . | Y | . | . | . | . | . | . | . | . | . | . | . | . | . | . |
| 21-225_91F3_LC | . | . | . | . | . | . | . | . | . | . | . | Y | . | . | . | . | . | . | . | . | . | . | . | . | . | . |
| 21-225_92B1_LC | . | . | . | . | . | . | . | . | . | . | . | . | . | . | . | . | . | . | . | . | . | . | . | . | . | . |
| 21-225_92D6_LC | . | . | . | . | . | . | . | . | . | . | . | Y | . | . | . | . | . | . | . | . | . | . | . | . | . | . |
| 21-225_93C2_LC | . | . | . | . | . | . | . | . | . | . | . | Y | . | . | . | . | . | . | . | . | . | . | . | . | . | . |
| 21-225_93E4_LC | . | . | . | . | . | . | . | . | . | . | . | Y | . | . | . | . | . | . | . | . | . | . | . | . | . | . |
| 21-225_93E9_LC | . | . | . | . | . | . | . | . | . | . | . | . | . | . | . | . | . | . | . | . | . | . | . | . | . | . |
| 21-225_94D3_LC | . | . | . | . | . | . | . | . | . | . | . | . | . | . | Q | . | . | . | . | . | . | . | . | . | . | . |
| 21-225_94F12_LC | . | . | . | . | . | . | . | . | . | . | . | Y | . | . | . | . | . | . | . | . | . | . | . | . | . | . |
| 21-225_94G10_LC | . | . | . | . | . | . | . | . | . | . | . | Y | . | . | . | . | . | . | . | . | . | . | . | . | . | . |
| 21-225_95D2_LC | . | . | . | . | . | . | . | . | . | . | . | Y | . | . | . | . | . | . | . | . | . | . | . | . | . | . |
| 21-225_95F9_LC | . | . | . | . | S | . | . | . | . | — | . | Y | . | . | S | . | . | . | . | . | . | . | . | . | . | . |
| 21-225_95G9_LC | . | . | . | . | . | . | . | . | . | . | . | Y | . | . | S | . | . | . | . | . | . | . | . | . | . | . |
| 21-225_95H10_LC | . | . | . | . | . | . | . | . | . | . | . | Y | . | . | S | . | . | . | . | . | & | . | . | . | . | . |
| 21-225_97A2_LC | . | . | . | . | . | . | . | . | . | . | . | . | . | . | . | . | . | . | . | . | . | . | . | . | . | . |
| 21-225_97E5_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 87 | 88 | 89 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | R | L | I | Y | G | , | , | , | , | , | , | , | , | , | A | S | S | R | A | T | G | I | P | D | R | F |
| 21-225_91B4_LC | | | | | | | | | | | | | | | | | | | S | | | | | | | |
| 21-225_91E9_LC | | | | | | | | | | | | | | | | | | | | | | | | | | |
| 21-225_91F3_LC | | | | | | | | | | | | | | | | | | | S | | | | | | | |
| 21-225_92B1_LC | | | | | | | | | | | | | | | | | | | S | | D | | | | | |
| 21-225_92D8_LC | | | | | | | | | | | | | | | | | | | | | V | | | | | |
| 21-225_93C2_LC | | | | | | | | | | | | | | | | | | | S | | | | | | | |
| 21-225_93E4_LC | | | | | | | | | | | | | | | | | | | | P | | | | | | |
| 21-225_93E9_LC | | | | | | | | | | | | | | | | | | | S | | | | | | | |
| 21-225_94D3_LC | | | | | | | | | | | | | | | | | | | | | | | | | | |
| 21-225_94F12_LC | | | | | | | | | | | | | | | | | | | | | | | | | | |
| 21-225_94G10_LC | | | | | | | | | | | | | | | | | | | S | | | | | | | |
| 21-225_95D2_LC | | | | | | | | | | | | | | | | | | | S | | | | | | | |
| 21-225_95F9_LC | | | | | | | | | | | | | | | | | | | | | | | | | | |
| 21-225_95G9_LC | | | | | | | | | | | | | | | | | | | S | | | | | | | |
| 21-225_95H10_LC | | | | | | | | | | | | | | | | | | | | | | | | | | |
| 21-225_97A2_LC | | | | | | | | | | | | | | | | | | | S | | | | | | | |
| 21-225_97E5_LC | | | | | | | | | | | | | | | | | | | | | | | | | | |

| Reference # | 105 | 106 | 107 | 108 | 109 | 110 | 111 | 112-130 K_CDR3 |
|---|---|---|---|---|---|---|---|---|
| CONSENSUS | Y | C | Q | Q | Y | D | N | |
| 21-225_147G8_LC | | | | | | · | S | |
| 21-225_190A3_LC | | | | | | G | · | |
| 21-225_190A7_LC | | | | | | G | S | |
| 21-225_190B4_LC | | | | | | G | · | |
| 21-225_190G10_LC | | | | | | G | S | |
| 21-225_191A3_LC | | | | | | G | · | |
| 21-225_191A5_LC | | | | | | G | G | |
| 21-225_191C3_LC | | | | | | G | · | |
| 21-225_191D3_LC | | | | | | G | S | |
| 21-225_191F1_LC | | | | | | G | · | |
| 21-225_191H7_LC | R | | | | | G | S | |
| 21-225_192B3_LC | | | | | | E | · | |
| 21-225_192F8_LC | | | | | | G | S | |
| 21-225_192G12_LC | | | | | | G | · | |
| 21-225_192H3_LC | R | | | | | G | — | |
| 21-225_193A1_LC | | | | | | G | · | |
| 21-225_193B1_LC | | | | | | G | S | |
| 21-225_193B10_LC | | | | | | G | · | |
| 21-225_193B12_LC | | | | | | G | · | |
| 21-225_193C8_LC | | | | | | G | · | |
| 21-225_193D3_LC | | | | | | G | · | |
| 21-225_193D8_LC | | | | | | E | S | |
| 21-225_193E6_LC | | | | | | G | S | |
| 21-225_193F3_LC | | | | | | G | · | |
| 21-225_193G8_LC | R | | | | | G | · | |
| 21-225_193H6_LC | R | | | | | E | S | |
| 21-225_194C10_LC | | | | | | G | S | |
| 21-225_194E5_LC | | | | | | G | S | |
| 21-225_194E6_LC | | | | | | G | S | |

| Reference # | 131 | 132 | 133 | 134 | 135 S | 136 P | 137 W | 138 T | 139 F | 140 G | 141 Q | 142 G | 143 T | 144 K | 145 V | 146 E | 147 I | 148 K | 149 R |
|---|---|---|---|---|---|---|---|---|---|---|---|---|---|---|---|---|---|---|---|
| | | | | | | | | | | | | | | K_FR4 | | | | | |
| CONSENSUS | | | | | | | | | | | | | | | | | | | |
| 21-225_76A7_LC | | | | | | | | | | | | | | | | | | | |
| 21-225_76C9_LC | | | | | S | S | S | | | | | | | | | | | S | |
| 21-225_76D1_LC | | | | | | | | | | | | | | | | | | | |
| 21-225_76E10_LC | | | | | | | | | | | | | | | | | | | |
| 21-225_76G4_LC | | | | | | | | | | | | | | | | | | | |
| 21-225_77A10_LC | | | | | | | | | | | | | | | | | | | |
| 21-225_77C12_LC | | | | | | | | | | | | | | | | | | | |
| 21-225_77C5_LC | | | | | | | | | | | | | | | | | | | |
| 21-225_77F7_LC | | | | | | | | | | | | | | | | | | | |
| 21-225_77G1_LC | | | | | | | | | | | | | | | | | | | |
| 21-225_78E7_LC | | | | | | | | | | | | | | | | | | | |
| 21-225_79F11_LC | | | | | | | | | | | | | | | | | | | |
| 21-225_79F3_LC | | | | | | | | | | | | | | | | | | | |
| 21-225_79G1_LC | | | | | | | | | | | | | | | | | | | |
| 21-225_79G12_LC | | | | | | | | | | | | | | | | | | | |
| 21-225_80A1_LC | | | | | | | | | | | | | | | | | | | |
| 21-225_80A6_LC | | | | | | | | | | | | | | | | | | | |
| 21-225_80B10_LC | | | | | | | | | | | | | | | | | | | |
| 21-225_80C1_LC | | | | | | | | | | | | | | | | | | | |
| 21-225_80D5_LC | | | | | | | | | | | | | | | | | | | |
| 21-225_80E12_LC | | | | | | | | | | | | | | | | | | | |
| 21-225_80E3_LC | | | | | | | | | | | | | | | | | | | |
| 21-225_80H12_LC | | | | | | | | | | | | | | | | | | | |
| 21-225_80H7_LC | | | | | | | | | | | | | | | | | | | |
| 21-225_81C11_LC | | | | | | | | | | | | | | | | | | | |
| 21-225_81C5_LC | | | | | | | | | | | | | | | | | | | |
| 21-225_83B6_LC | | | | | | | | | | | | | | | | | | | |
| 21-225_83B7_LC | | | | | | | | | | | | | | | | | | | |
| 21-225_83C10_LC | | | | | | | | | | | | | | | | | | | |

FIGURE 57 (Continued)

| Reference # | 131 | 132 | 133 | 134 | 135 | 136 | 137 | 138 | 139 | 140 | 141 | 142 | 143 | 144 K_FR4 | 145 | 146 | 147 | 148 | 149 |
|---|---|---|---|---|---|---|---|---|---|---|---|---|---|---|---|---|---|---|---|
| CONSENSUS | , | , | , | , | S | P | W | T | F | G | Q | G | T | K | V | E | I | K | R |
| 21-225_91B4_LC | . | . | . | . | . | . | . | . | . | . | . | . | . | . | . | . | . | . | . |
| 21-225_91E9_LC | . | . | . | . | . | . | . | . | . | . | . | . | . | . | . | . | . | . | . |
| 21-225_91F3_LC | . | . | . | . | . | . | . | . | . | . | . | . | . | . | . | . | . | . | . |
| 21-225_92B1_LC | . | . | . | . | . | . | . | . | . | . | . | . | . | . | . | . | . | . | . |
| 21-225_92D6_LC | . | . | . | . | . | . | . | . | . | . | . | . | . | . | . | . | . | . | . |
| 21-225_93C2_LC | . | . | . | . | . | . | . | . | . | . | . | . | . | . | . | . | . | . | . |
| 21-225_93E4_LC | . | . | . | . | . | . | . | . | . | . | . | . | . | . | . | . | N | Q | N |
| 21-225_93E9_LC | . | . | . | . | . | . | . | . | . | . | . | . | . | . | . | . | . | . | . |
| 21-225_94D3_LC | . | . | . | . | . | . | . | . | . | . | . | . | . | . | . | . | . | . | . |
| 21-225_94F12_LC | . | . | . | . | . | . | . | . | . | . | . | . | . | . | . | . | . | . | . |
| 21-225_94G10_LC | . | . | . | . | . | . | . | . | . | . | . | . | . | . | . | . | . | . | . |
| 21-225_95D2_LC | . | . | . | . | . | . | . | . | . | . | . | . | . | . | . | . | . | . | . |
| 21-225_95F9_LC | . | . | . | . | . | . | . | . | . | . | . | . | . | . | . | . | . | . | . |
| 21-225_95G9_LC | . | . | . | . | . | . | . | . | . | . | . | . | . | . | . | . | . | . | . |
| 21-225_95H10_LC | . | . | . | . | . | . | . | . | . | . | . | . | . | . | . | . | . | . | . |
| 21-225_97A2_LC | . | . | . | . | . | . | . | . | . | . | . | . | . | . | . | . | . | . | . |
| 21-225_97E5_LC | . | . | . | . | . | . | . | . | . | . | . | . | . | . | . | . | . | . | . |

FIGURE 57 (Continued)

Table 98.  Consensus 18 - VK1|A30/JK1 (SEQ ID NO: 50315):

DIQMTQSPSSLSASVGDRVTITCRAS--QGIR------NDLGWYQQKPGKAPKRLIYA------ASSLQSGVPSRFSGSGSG--TEFTLTISSLQPEDFATYYCLQHYS................YPRTFGQGTKVEIKR wherein:

A at position 25 can be substituted with T

S at position 26 can be substituted with T

Q at position 29 can be substituted with R

G at position 30 can be substituted with D, A, N or V

R at position 32 can be substituted with G

N at position 39 can be substituted with K, D, H, S, G or T

D at position 40 can be substituted with I or Y

G at position 42 can be substituted with N

A at position 58 can be substituted with T, I, V, P, G, R or S

A at position 67 can be substituted with T or S

S at position 68 can be substituted with A, F, P or Y

S at position 69 can be substituted with N, R, G or T

L at position 70 can be substituted with C, F or S

Q at position 71 can be substituted with H or E

S at position 72 can be substituted with N, G or I

L at position 107 can be substituted with V, I or H

Q at position 108 can be substituted with M, H, L or V

FIGURE 57 (Continued)

H at position 109 can be substituted with Q, Y, L or S

Y at position 110 can be substituted with N, H, S or T

S at position 111 can be substituted with N, T, R, D, F or G null (-) at position 134 can be substituted with Y or F Y at position 135 can be substituted with F, P, C, N or T P at position 136 can be substituted with L R at position 137 can be substituted with W, F or L Arg Xaa Xaa Xaa Ile Xaa Xaa Xaa Leu Xaa (SEQ ID NO: 50130)

Xaa Xaa Xaa Xaa Xaa Xaa Xaa (SEQ ID NO: 50131)

Xaa Xaa Xaa Xaa Xaa Xaa Xaa Xaa Xaa Thr (SEQ ID NO: 50132)

Arg Ala Ser Gln Gly Ile Arg Asn Asp Leu Gly (SEQ ID NO: 50615)

Ala Ala Ser Ser Leu Gln Ser (SEQ ID NO: 50616)

Leu Gln His Tyr Ser Tyr Pro Arg Thr (SEQ ID NO: 50617)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | KLFR1 | | | | | | | | | | | | | | | |
| CONSENSUS | D | I | Q | M | T | Q | S | P | S | S | L | S | A | S | V | G | D | R | V | T | I | T | C | R | A | S |
| 21-225_9C11_LC | . | . | . | . | . | . | . | . | . | . | . | . | . | . | . | . | . | . | . | . | . | . | . | . | . | . |
| 21-225_9D12_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | R | L | I | Y | A | S | S | S | A | S | L | Q | S | G | V | P | S | R | F |
| 21-225_9C11_LC | . | L | . | . | . | V | . | . | . | . | . | . | . | . | . | . | . | . | . | . | . | . | . | . | . | . |
| 21-225_9D12_LC | . | . | . | . | . | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | K_FR3 | | | | | | | | | | | | | | | |
| CONSENSUS | S | G | S | G | S | G | . | . | T | E | F | T | L | T | I | S | S | L | Q | P | E | D | F | A | T | Y |
| 21-225_9C11_LC | . | . | . | . | . | . | . | . | . | . | . | . | . | . | . | N | . | . | . | . | . | . | . | . | — | . |
| 21-225_9D12_LC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | L | Q | H | Y | S | | | | | | | | | | | | | | | | | | | |
| 21-225_216E8_LC | | | | M | | N | | | | | | | | | | | | | | | | | | | | |
| 21-225_216H12_LC | | | Y | M | | N | | | | | | | | | | | | | | | | | | | | |
| 21-225_217E5_LC | | | Y | M | | N | | | | | | | | | | | | | | | | | | | | |
| 21-225_217G10_LC | | | | M | | | | | | | | | | | | | | | | | | | | | | |
| 21-225_217H12_LC | | | Y | M | | N | N | | | | | | | | | | | | | | | | | | | |
| 21-225_218C4_LC | | | | M | | N | N | | | | | | | | | | | | | | | | | | | |
| 21-225_21F7_LC | | | | | | N | | | | | | | | | | | | | | | | | | | | |
| 21-225_21G11_LC | | | | | | N | | | | | | | | | | | | | | | | | | | | |
| 21-225_21G2_LC | | | | | | | | | | | | | | | | | | | | | | | | | | |
| 21-225_21H8_LC | | | Y | M | | | N | | | | | | | | | | | | | | | | | | | |
| 21-225_220F8_LC | | | | | | | N | | | | | | | | | | | | | | | | | | | |
| 21-225_224E7_LC | | | | | | | | | | | | | | | | | | | | | | | | | | |
| 21-225_224F1_LC | | | | | | | | | | | | | | | | | | | | | | | | | | |
| 21-225_224F3_LC | | | | M | | | | | | | | | | | | | | | | | | | | | | |
| 21-225_225A1_LC | | | | | | N | | | | | | | | | | | | | | | | | | | | |
| 21-225_225C6_LC | | | | | | | | | | | | | | | | | | | | | | | | | | |
| 21-225_226F7_LC | | | | M | | | | | | | | | | | | | | | | | | | | | | |
| 21-225_226H11_LC | | | | | | N | N | | | | | | | | | | | | | | | | | | | |
| 21-225_22A4_LC | | | | | | | | | | | | | | | | | | | | | | | | | | |
| 21-225_22F4_LC | | | | | | | | | | | | | | | | | | | | | | | | | | |
| 21-225_23A10_LC | | | | | | | | | | | | | | | | | | | | | | | | | | |
| 21-225_23E11_LC | | | | | | | | | | | | | | | | | | | | | | | | | | |
| 21-225_23F12_LC | | | | | | | | | | | | | | | | | | | | | | | | | | |
| 21-225_24B6_LC | | | | | | | | | | | | | | | | | | | | | | | | | | |
| 21-225_25D12_LC | | | | | | | | | | | | | | | | | | | | | | | | | | |
| 21-225_26A2_LC | | | | | | N | T | | | | | | | | | | | | | | | | | | | |
| 21-225_26C7_LC | | | | | | N | T | | | | | | | | | | | | | | | | | | | |
| 21-225_28F5_LC | | | | | | N | T | | | | | | | | | | | | | | | | | | | |
| 21-225_2G4_LC | | | | | | | | | | | | | | | | | | | | | | | | | | |

| Reference # | 105 | 106 | 107 | 108 | 109 | 110 | 111 | 112-130 (K_CDR3) |
|---|---|---|---|---|---|---|---|---|
| CONSENSUS | Y | C | L | Q | H | Y | S | |
| 21-225_5E5.011_LC | | | | | | | | |
| 21-225_5E5.012_LC | | | | | | | | |
| 21-225_5E5.015_LC | | | | | | | | |
| 21-225_5E5.016_LC | | | | | | | | |
| 21-225_5E5.017_LC | | | | | | | | |
| 21-225_5E5.018_LC | | | | | | | | |
| 21-225_5E5.019_LC | | | | | | | | |
| 21-225_5E5.023_LC | | | | | | | | |
| 21-225_5E5.024_LC | | | | | | | | |
| 21-225_5E5.025_LC | | | | | | | | |
| 21-225_60C3_LC | | | | | Y | N | | |
| 21-225_60E2_LC | | | | | | N | | |
| 21-225_61E6_LC | | | | | | N | | |
| 21-225_61H1_LC | | | | | | N | | |
| 21-225_62F7_LC | | | | | | | | |
| 21-225_64A4_LC | | | | | Y | N | | |
| 21-225_64C8_LC | | | | | | N | | |
| 21-225_66C10_LC | | | | | | N | | |
| 21-225_66D11_LC | | | | | | N | | |
| 21-225_6A11_LC | | | | | | | | |
| 21-225_6G2_LC | | | | | | | | |
| 21-225_71A2_LC | | | | | L | | | |
| 21-225_73C9_LC | | | | | | | | |
| 21-225_7C9_LC | | | | | | | | |
| 21-225_7F8_LC | | | | | Q | N | T | |
| 21-225_7G2_LC | | | | | | | | |
| 21-225_7G4_LC | | | | | | | | |
| 21-225_94F3_LC | | | | | | N | | |
| 21-225_9A1_LC | | | | | | N | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | L | Q | H | Y | S | | | | | | | | | | | | K_CDR3 | | | | | | | |
| 21-225_9C11_LC | H | . | H | . | S | N | . | . | . | . | . | . | . | . | . | . | . | . | . | . | . | . | . | . | . | . |
| 21-225_9D12_LC | . | . | . | . | . | N | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | Y | P | R | T | F | G | Q | G | T | K | V | E | I | K | R |
| 21-225_9C11_LC | . | . | . | . | T | . | L | . | . | . | . | . | . | . | . | . | . | . | . |
| 21-225_9D12_LC | . | . | . | . | . | . | W | . | . | . | . | . | . | . | . | . | . | . | . |

FIGURE 57 (Continued)

Table 99. Consensus 19 - VK4|B3/JK1 (SEQ ID NO: 50316):

DIVMTQSPDSLAVSLGERATINCKSS--QSVLHSSNNNYLAWYQQKPGQPPKLLIYW-------ASTRESGVPDRFSGSGSG--TDFTLTISSLQAEDVAVYYCQQYYS--------TPPTFGQGTKVEIKR wherein:

K at position 24 can be substituted with R or M

S at position 26 can be substituted with G or R

S at position 30 can be substituted with T, N or I

V at position 31 can be substituted with I or A

H at position 33 can be substituted with Y, F, S, K, D, L or M

S at position 34 can be substituted with T, R, N, I or D

S at position 35 can be substituted with F or P

N at position 36 can be substituted with H

N at position 37 can be substituted with K, S, D or H

N at position 38 can be substituted with Y, K, H, R, A, F or W

N at position 39 can be substituted with H or Y

Y at position 40 can be substituted with S

L at position 41 can be substituted with F

A at position 42 can be substituted with T, V or G

A at position 67 can be substituted with T or S

S at position 68 can be substituted with F

T at position 69 can be substituted with I, K or S

FIGURE 57 (Continued)

R at position 70 can be substituted with W or L

E at position 71 can be substituted with K, A, D or R

S at position 72 can be substituted with T

Q at position 107 can be substituted with H or L

Q at position 108 can be substituted with H

Y at position 109 can be substituted with F

Y at position 110 can be substituted with F, H, N, L or S

S at position 111 can be substituted with N, R, D, I, T, C, E or K

T at position 135 can be substituted with S, I, V, A or Y

P at position 137 can be substituted with W, L, V, C, G, R or S

T at position 138 can be substituted with K or S

Xaa Xaa Xaa Gln Ser Xaa Leu Xaa Xaa Xaa Xaa Xaa Xaa Xaa Xaa Xaa Xaa (SEQ ID NO: 50133)

Trp Xaa Xaa Xaa Xaa Xaa Xaa (SEQ ID NO: 50229)

Xaa Xaa Xaa Xaa Xaa Xaa Pro Xaa Xaa (SEQ ID NO: 50134)

Lys Ser Ser Gln Ser Val Leu His Ser Ser Asn Asn Asn Asn Tyr Leu Ala (SEQ ID NO: 50618)

Trp Ala Ser Thr Arg Glu Ser (SEQ ID NO: 50619)

Gln Gln Tyr Tyr Ser Thr Pro Pro Thr (SEQ ID NO: 50620)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | D | I | V | M | T | Q | S | P | D | S | L | A | V | S | L | G | E | R | A | T | I | N | C | K | S | S |
| 21-225_90D9_LC | . | . | . | . | . | . | . | . | . | . | . | . | . | . | . | . | . | . | . | . | . | . | . | . | . | . |
| 21-225_91F1_LC | . | . | . | . | . | . | . | . | . | C | . | . | . | . | . | . | . | . | . | . | . | . | . | . | . | . |
| 21-225_91G8_LC | . | . | . | . | . | . | . | . | . | C | . | . | . | . | . | . | . | . | . | . | . | . | . | . | . | . |
| 21-225_92E6_LC | . | . | . | . | . | . | . | . | . | . | . | . | . | . | . | . | . | . | . | . | . | . | . | . | . | . |
| 21-225_92F12_LC | . | . | . | . | . | . | . | . | . | . | . | . | A | . | . | . | . | . | . | . | T | . | . | . | . | . |
| 21-225_94D2_LC | . | . | . | . | . | . | . | . | . | . | . | . | . | . | . | . | . | . | . | . | . | . | . | . | . | . |
| 21-225_94E11_LC | . | . | . | . | . | . | . | . | . | . | . | . | . | . | . | . | . | . | . | . | . | . | . | . | . | . |
| 21-225_94E12_LC | . | . | . | . | . | . | C | . | . | . | . | . | . | . | . | . | . | . | . | . | T | . | . | . | . | . |
| 21-225_95E12_LC | . | . | . | . | . | . | C | . | . | . | . | . | . | . | . | . | . | . | . | . | . | . | . | . | . | . |
| 21-225_95G4_LC | . | . | . | . | . | . | . | . | . | . | . | . | . | . | . | . | . | . | . | . | . | . | . | . | . | . |
| 21-225_95H4_LC | . | . | . | . | . | . | . | . | . | . | . | . | . | . | . | . | . | . | . | . | . | . | . | . | . | . |
| 21-225_96D10_LC | . | . | . | . | . | . | . | . | . | . | . | . | . | . | . | . | . | . | . | . | . | . | . | . | . | . |
| 21-225_96D5_LC | . | . | . | . | . | . | . | . | . | . | . | . | . | . | . | . | . | . | . | . | . | . | . | . | . | . |
| 21-225_96E2_LC | . | S | . | . | . | . | . | . | . | . | . | . | . | . | . | . | . | . | . | . | . | . | . | . | . | . |
| 21-225_98H5_LC | . | . | . | . | . | . | . | . | . | . | . | . | . | . | . | . | . | . | . | . | . | . | . | . | . | . |
| 21-225_97H4_LC | . | . | . | . | . | . | . | . | . | C | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | K_CDR3 | | | | | | | | | | | | | | | | | | | |
| CONSENSUS | Y | C | Q | Q | Y | Y | S | | | | | | | | | | | | | | | | | | | |
| 21-225_224D8_LC | | | | | | F | | | | | | | | | | | | | | | | | | | | |
| 21-225_224H5_LC | | | | | | | T | | | | | | | | | | | | | | | | | | | |
| 21-225_225F11_LC | F | | | | | | | | | | | | | | | | | | | | | | | | | |
| 21-225_225F5_LC | | | | | | | K | | | | | | | | | | | | | | | | | | | |
| 21-225_226A12_LC | F | | | | | | T | | | | | | | | | | | | | | | | | | | |
| 21-225_226D11_LC | | | | | E | S | Q | | | | | | | | | | | | | | | | | | | |
| 21-225_228F6_LC | F | | | | | | | | | | | | | | | | | | | | | | | | | |
| 21-225_227C7_LC | | | | | | | | | | | | | | | | | | | | | | | | | | |
| 21-225_23A12_LC | | | | | | | | | | | | | | | | | | | | | | | | | | |
| 21-225_23G12_LC | | | | | | | | | | | | | | | | | | | | | | | | | | |
| 21-225_24E1_LC | | | | | | | | | | | | | | | | | | | | | | | | | | |
| 21-225_25A4_LC | | | | | | | | | | | | | | | | | | | | | | | | | | |
| 21-225_25A4.001.001_LC | | | | | | | | | | | | | | | | | | | | | | | | | | |
| 21-225_25A4.001.002_LC | | | | | | | | | | | | | | | | | | | | | | | | | | |
| 21-225_25A4.001.003_LC | | | | | | | | | | | | | | | | | | | | | | | | | | |
| 21-225_25A4.001.004_LC | | | | | | | | | | | | | | | | | | | | | | | | | | |
| 21-225_25A4.001.005_LC | | | | | | | | | | | | | | | | | | | | | | | | | | |
| 21-225_25A4.001.006_LC | | | | | | | | | | | | | | | | | | | | | | | | | | |
| 21-225_25A4.001.007_LC | | | | | | | | | | | | | | | | | | | | | | | | | | |
| 21-225_25A4.001.008_LC | | | | | | | | | | | | | | | | | | | | | | | | | | |
| 21-225_25A4.001.013_LC | | | | | | | | | | | | | | | | | | | | | | | | | | |
| 21-225_25A4.001.019_LC | | | | | | | | | | | | | | | | | | | | | | | | | | |
| 21-225_25A4.001.020_LC | | | | | | | | | | | | | | | | | | | | | | | | | | |
| 21-225_25A4.001.021_LC | | | | | | | | | | | | | | | | | | | | | | | | | | |
| 21-225_25A4.001.029_LC | | | | | | | | | | | | | | | | | | | | | | | | | | |
| 21-225_28C4_LC | | | | | | | | | | | | | | | | | | | | | | | | | | |
| 21-225_29E6_LC | | | | | | | Q | | | | | | | | | | | | | | | | | | | |
| 21-225_29H8_LC | | | | | | | | | | | | | | | | | | | | | | | | | | |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | K_CDR3 | | | | | | | |
| CONSENSUS | Y | C | Q | Q | Y | Y | S | . | . | . | . | . | . | . | . | . | . | . | . | . | . | . | . | . | . | . |
| 21-225_90D9_LC | . | . | . | . | . | L | N | . | . | . | . | . | . | . | . | . | . | . | . | . | . | . | . | . | . | . |
| 21-225_91F1_LC | . | . | . | H | . | . | T | . | . | . | . | . | . | . | . | . | . | . | . | . | . | . | . | . | . | . |
| 21-225_91G8_LC | . | . | . | . | . | . | . | . | . | . | . | . | . | . | . | . | . | . | . | . | . | . | . | . | . | . |
| 21-225_92E6_LC | . | . | . | . | . | F | . | . | . | . | . | . | . | . | . | . | . | . | . | . | . | . | . | . | . | . |
| 21-225_92F12_LC | . | . | . | . | . | X | . | . | . | . | . | . | . | . | . | . | . | . | . | . | . | . | . | . | . | . |
| 21-225_94D2_LC | . | . | . | . | . | X | . | . | . | . | . | . | . | . | . | . | . | . | . | . | . | . | . | . | . | . |
| 21-225_94E11_LC | . | . | . | . | . | . | . | . | . | . | . | . | . | . | . | . | . | . | . | . | . | . | . | . | . | . |
| 21-225_94E12_LC | . | . | . | . | . | . | . | . | . | . | . | . | . | . | . | . | . | . | . | . | . | . | . | . | . | . |
| 21-225_95E12_LC | . | . | . | . | . | X | . | . | . | . | . | . | . | . | . | . | . | . | . | . | . | . | . | . | . | . |
| 21-225_95G4_LC | . | . | . | . | . | X | . | . | . | . | . | . | . | . | . | . | . | . | . | . | . | . | . | . | . | . |
| 21-225_95H4_LC | . | . | . | . | . | . | . | . | . | . | . | . | . | . | . | . | . | . | . | . | . | . | . | . | . | . |
| 21-225_96D10_LC | . | . | . | . | . | . | . | . | . | . | . | . | . | . | . | . | . | . | . | . | . | . | . | . | . | . |
| 21-225_96D5_LC | . | . | . | . | . | . | X | . | . | . | . | . | . | . | . | . | . | . | . | . | . | . | . | . | . | . |
| 21-225_96E2_LC | . | . | . | H | . | . | . | . | . | . | . | . | . | . | . | . | . | . | . | . | . | . | . | . | . | . |
| 21-225_98H5_LC | . | . | . | . | . | N | D | . | . | . | . | . | . | . | . | . | . | . | . | . | . | . | . | . | . | . |
| 21-225_97H4_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR3 | | | | | |
| CONSENSUS | . | . | . | . | T | P | P | T | F | G | Q | G | T | K | V | E | I | K | R |
| 21-225_90D9_LC | . | . | . | . | S | . | L | K | . | . | . | . | . | . | . | . | . | . | . |
| 21-225_91F1_LC | . | . | . | . | . | . | W | . | . | V | . | . | . | . | . | . | . | . | . |
| 21-225_91G8_LC | . | . | . | . | . | . | W | . | . | . | . | . | . | . | . | . | . | . | . |
| 21-225_92E6_LC | . | . | . | . | V | . | . | . | . | . | . | . | . | . | . | . | . | . | . |
| 21-225_92F12_LC | . | . | . | . | I | . | L | . | . | . | X | . | . | T | . | G | . | . | G |
| 21-225_94D2_LC | . | . | . | . | S | . | . | . | . | . | . | . | . | . | . | . | . | . | . |
| 21-225_94E11_LC | . | . | . | . | . | . | G | S | . | . | . | . | . | . | . | . | . | . | . |
| 21-225_94E12_LC | . | . | . | . | S | . | L | . | . | . | . | . | . | T | . | G | . | . | . |
| 21-225_95E12_LC | . | . | . | . | V | . | L | . | . | . | . | . | . | T | . | G | . | . | . |
| 21-225_95G4_LC | . | . | . | . | S | . | . | . | . | . | . | . | . | T | . | . | . | . | . |
| 21-225_95H4_LC | . | . | . | . | . | . | . | . | . | . | . | . | . | . | . | . | . | . | . |
| 21-225_96D10_LC | . | . | . | . | . | . | W | S | . | . | . | . | . | . | . | . | . | . | . |
| 21-225_96D5_LC | . | . | . | . | . | . | G | . | . | . | . | . | . | . | . | . | . | . | . |
| 21-225_96E2_LC | . | . | . | . | . | . | W | . | . | . | . | . | . | . | . | . | . | . | . |
| 21-225_96H5_LC | . | . | . | . | . | . | . | K | . | V | . | . | . | . | . | . | . | T | G |
| 21-225_97H4_LC | . | . | . | . | . | . | . | . | . | . | . | . | . | . | . | . | . | . | . |

FIGURE 57 (Continued)

Table 100. Consensus 20 - VK1IA30/JK3 (SEQ ID NO: 50317):

DIQMTQSPSSLSASVGDRVTITCRAS--QGIR------NDLGWYQQKPGKAPKRLIYA-------ASSLQSGVPSRFSGSGSG--TEFTLTISSLQPEDFATYYCLQHNS.........YPFTFGPGTKVDIKR wherein:

A at position 25 can be substituted with T

G at position 30 can be substituted with D or V

I at position 31 can be substituted with M

R at position 32 can be substituted with S

N at position 39 can be substituted with K, S, D or T

D at position 40 can be substituted with N, H, Y, V, A, I or L

L at position 41 can be substituted with F

G at position 42 can be substituted with D

A at position 58 can be substituted with P, T, G, I, R or V

A at position 67 can be substituted with V

S at position 68 can be substituted with F or T

S at position 69 can be substituted with N, T, R or D

L at position 70 can be substituted with V

Q at position 71 can be substituted with L

S at position 72 can be substituted with N, T, G or R

L at position 107 can be substituted with I

Q at position 108 can be substituted with H or L

FIGURE 57 (Continued)

H at position 109 can be substituted with Y, D or L

N at position 110 can be substituted with Y, T, H, G or I

S at position 111 can be substituted with R, D, T, G or N

Y at position 135 can be substituted with F or H

P at position 136 can be substituted with L

F at position 137 can be substituted with L

T at position 138 can be substituted with K

Arg Xaa Ser Gln Xaa Xaa Xaa Xaa Xaa Xaa Xaa (SEQ ID NO: 50135)

Xaa Xaa Xaa Xaa Xaa Xaa Xaa (SEQ ID NO: 50136)

Xaa Xaa Xaa Xaa Xaa Xaa Xaa Xaa Xaa (SEQ ID NO: 50137)

Arg Ala Ser Gln Gly Ile Arg Asn Asp Leu Gly (SEQ ID NO: 50621)

Ala Ala Ser Ser Leu Gln Ser (SEQ ID NO: 50622)

Leu Gln His Asn Ser Tyr Pro Phe Thr (SEQ ID NO: 50623)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | D | I | Q | M | T | Q | S | P | S | S | L | S | A | S | V | G | D | R | V | T | I | T | C | R | A | S |
| 21-225_58D11_LC | . | . | . | . | . | . | . | . | . | . | . | . | . | . | . | . | . | . | . | . | . | . | . | . | . | . |
| 21-225_58F5_LC | . | . | . | . | . | . | . | . | . | . | . | . | . | . | . | . | . | . | . | . | . | . | . | . | . | . |
| 21-225_59F11_LC | . | . | . | . | . | . | . | . | . | . | . | . | . | . | . | . | . | . | . | . | . | . | . | . | . | . |
| 21-225_5F4_LC | . | . | . | . | . | . | . | . | . | . | . | . | . | . | . | . | . | . | . | . | . | . | . | . | . | . |
| 21-225_60A3_LC | . | . | . | . | . | . | . | . | . | . | . | . | . | . | . | . | . | . | . | . | . | . | . | . | . | . |
| 21-225_62G3_LC | . | . | X | . | . | . | . | . | . | . | . | . | . | . | . | . | . | . | . | . | . | . | . | . | . | . |
| 21-225_64A12_LC | . | . | . | . | . | . | . | . | . | . | . | . | . | . | . | . | . | . | . | . | . | . | . | . | . | . |
| 21-225_66F9_LC | . | . | . | . | . | . | . | . | . | . | . | . | . | . | . | . | . | . | . | . | . | . | . | . | . | . |
| 21-225_67B7_LC | . | . | . | . | . | . | . | . | . | . | . | . | . | . | . | . | . | . | . | . | . | . | . | . | . | . |
| 21-225_68G8_LC | . | . | . | . | . | . | . | . | . | . | . | . | . | . | . | . | . | . | . | . | . | . | . | . | . | . |
| 21-225_71B11_LC | . | . | . | . | . | . | . | . | . | . | P | . | . | . | . | . | . | . | . | . | . | . | . | . | . | . |
| 21-225_71B6_LC | . | . | . | . | . | . | . | . | . | . | . | . | . | . | . | . | . | . | . | . | . | . | . | . | . | . |
| 21-225_71H6_LC | . | . | . | . | . | . | . | . | . | . | . | . | . | . | . | . | . | . | . | . | . | . | . | . | . | . |
| 21-225_73A6_LC | . | . | . | . | . | . | . | . | . | . | . | . | . | . | . | . | . | . | . | . | . | . | . | . | . | . |
| 21-225_74A11_LC | . | . | . | . | . | . | . | . | . | . | . | . | . | . | . | . | . | . | . | . | . | . | . | . | . | . |
| 21-225_75C11_LC | . | . | . | . | . | . | . | . | . | . | . | . | . | . | A | . | . | . | . | . | . | . | . | . | . | . |
| 21-225_76H10_LC | . | . | . | . | . | . | . | . | . | . | . | . | . | . | . | . | . | . | . | . | . | . | . | . | . | . |
| 21-225_76H12_LC | . | . | . | . | . | . | . | . | Y | Q | . | . | . | . | . | . | . | . | . | . | . | . | . | . | . | . |
| 21-225_84H12_LC | . | . | . | . | . | . | . | . | . | . | . | . | . | . | . | . | . | . | . | . | . | . | . | . | . | . |
| 21-225_88E5_LC | . | . | . | . | . | . | . | . | . | . | . | . | . | . | . | . | . | . | . | . | . | . | . | . | . | . |
| 21-225_88A5_LC | . | . | . | . | . | . | . | . | . | . | . | . | . | . | . | . | . | . | . | . | . | . | . | . | . | . |
| 21-225_96A4_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | R | L | I | Y | A | . | . | . | . | . | . | . | . | A | S | S | L | Q | S | G | V | P | S | R | F |
| 21-225_184H10_LC | . | . | . | . | . | - | . | . | . | . | . | . | . | . | . | . | . | . | . | . | . | . | . | . | . | . |
| 21-225_190D8_LC | . | . | . | . | . | . | . | . | . | . | . | . | . | . | . | . | . | . | . | . | . | . | . | . | . | . |
| 21-225_192F6_LC | . | . | . | . | . | . | . | . | . | . | . | . | . | . | . | . | . | . | . | . | . | . | . | . | . | . |
| 21-225_194F10_LC | . | . | . | . | . | . | . | . | . | . | . | . | . | . | . | . | . | . | . | . | . | . | . | . | . | . |
| 21-225_195B9_LC | . | . | . | . | . | . | . | . | . | . | . | . | . | . | . | . | D | . | . | . | . | . | . | . | . | . |
| 21-225_197D7_LC | . | . | . | . | . | Q | . | . | . | . | . | . | . | . | . | . | . | . | . | . | . | . | . | . | . | . |
| 21-225_197G10_LC | . | . | . | . | Q | . | . | . | . | . | . | . | . | . | . | . | . | . | . | . | . | . | . | . | . | . |
| 21-225_198B9_LC | . | . | . | . | . | . | . | . | . | . | . | . | . | . | . | . | . | . | . | N | . | . | . | . | . | . |
| 21-225_198E3_LC | . | . | . | . | . | R | . | . | . | . | . | . | . | . | . | . | R | V | . | . | . | . | . | . | . | . |
| 21-225_200F6_LC | . | . | . | . | . | . | . | . | . | . | . | . | . | . | . | T | . | . | . | . | . | . | . | . | . | . |
| 21-225_202A3_LC | . | . | . | . | . | . | . | . | . | . | . | . | . | . | . | . | . | . | . | . | . | . | . | . | . | . |
| 21-225_203B9_LC | . | . | . | . | . | . | . | . | . | . | . | . | . | . | . | . | . | . | . | O | . | . | . | . | . | . |
| 21-225_210E4_LC | . | . | . | . | . | . | . | . | . | . | . | . | . | . | . | . | . | . | L | . | . | . | . | . | . | . |
| 21-225_225B6_LC | . | . | . | . | . | R | . | . | . | . | . | . | . | . | . | . | . | . | . | . | . | . | . | . | . | . |
| 21-225_225D6_LC | . | . | . | . | . | R | . | . | . | . | . | . | . | . | . | . | . | . | . | . | . | . | . | . | . | . |
| 21-225_225F8_LC | . | . | . | . | . | . | . | . | . | . | . | . | . | . | . | . | . | . | . | T | . | . | . | . | . | . |
| 21-225_226A9_LC | . | . | . | . | . | . | . | . | . | . | . | . | . | . | . | . | . | . | . | . | . | . | . | . | . | . |
| 21-225_227C12_LC | . | . | . | . | . | . | . | . | . | . | . | . | . | . | . | . | . | . | . | . | . | . | . | . | . | . |
| 21-225_227G3_LC | . | . | . | . | . | . | . | . | . | . | . | . | . | . | . | . | . | . | . | N | . | . | . | . | . | . |
| 21-225_227H5_LC | . | . | . | . | . | . | . | . | . | . | . | . | . | . | . | . | . | . | . | . | . | . | . | . | . | . |
| 21-225_22H3_LC | . | . | . | . | . | . | . | . | . | . | . | . | . | . | . | . | . | . | . | . | . | . | . | . | . | . |
| 21-225_25A9_LC | . | . | . | . | . | . | . | . | . | . | . | . | . | . | . | . | . | . | . | . | . | . | . | . | . | . |
| 21-225_25B6_LC | . | . | . | . | . | . | . | . | . | . | . | . | . | . | . | . | . | . | . | . | . | . | . | . | . | . |
| 21-225_25G5_LC | . | . | . | . | . | . | . | . | . | . | . | . | . | . | . | . | . | . | . | . | . | . | . | . | . | . |
| 21-225_27D5_LC | . | . | . | . | . | . | . | . | . | . | . | . | . | . | . | . | . | . | . | . | . | . | . | . | . | . |
| 21-225_28A9_LC | . | . | . | . | . | . | . | . | . | . | . | . | . | . | . | . | . | . | . | . | . | . | . | . | . | . |
| 21-225_28B8_LC | . | . | . | . | . | . | . | . | . | . | . | . | . | . | . | . | . | . | . | . | . | . | . | . | . | . |
| 21-225_29D7_LC | . | . | . | . | . | . | . | . | . | . | . | . | . | . | . | . | . | . | . | . | . | . | . | . | . | . |
| 21-225_29D8_LC | . | . | . | . | . | T | . | . | . | . | . | . | . | . | . | . | . | . | . | . | . | . | . | . | . | . |

| Reference # | 105 | 106 | 107 | 108 | 109 | 110 | 111 | 112-130 (K_CDR3) |
|---|---|---|---|---|---|---|---|---|
| CONSENSUS | Y | C | L | Q | H | N | S | |
| 21-225_184H10_LC | . | . | . | . | . | . | . | |
| 21-225_190D8_LC | . | . | . | . | . | Y | . | |
| 21-225_192F6_LC | . | . | . | . | . | Y | . | |
| 21-225_194F10_LC | . | . | . | . | . | Y | . | |
| 21-225_195B9_LC | C | . | . | . | . | Y | R | |
| 21-225_197D7_LC | V | . | . | . | . | Y | R | |
| 21-225_197G10_LC | . | . | . | . | . | Y | R | |
| 21-225_198B9_LC | Y | . | . | . | . | Y | R | |
| 21-225_198E3_LC | V | . | . | . | . | Y | R | |
| 21-225_200F6_LC | . | . | . | . | . | Y | R | |
| 21-225_202A3_LC | . | . | . | . | . | Y | Q | |
| 21-225_203B9_LC | . | . | . | . | . | . | . | |
| 21-225_210E4_LC | . | . | . | . | . | . | T | |
| 21-225_225B6_LC | . | . | . | . | . | . | . | |
| 21-225_225D6_LC | C | . | . | . | . | . | . | |
| 21-225_225F8_LC | . | . | . | . | . | . | . | |
| 21-225_226A9_LC | . | . | . | . | . | . | . | |
| 21-225_227C12_LC | . | . | . | . | . | . | . | |
| 21-225_227G3_LC | . | . | . | . | Q | . | . | |
| 21-225_227H5_LC | F | . | . | . | . | . | . | |
| 21-225_22H3_LC | . | . | . | . | . | . | . | |
| 21-225_25A9_LC | . | . | . | . | . | . | . | |
| 21-225_25B6_LC | . | . | . | . | . | . | . | |
| 21-225_25G5_LC | . | . | . | . | . | . | . | |
| 21-225_27D5_LC | . | . | . | . | . | . | . | |
| 21-225_28A9_LC | . | . | . | . | . | . | R | |
| 21-225_28B8_LC | . | . | . | . | . | . | . | |
| 21-225_29D7_LC | . | . | . | . | . | . | . | |
| 21-225_29D8_LC | . | . | . | . | . | . | . | |

FIGURE 57 (Continued)

| Reference # | 105 Y | 106 C | 107 L | 108 Q | 109 H | 110 N | 111 S | 112 | 113 | 114 | 115 | 116 | 117 | 118 | 119 | 120 | 121 | 122 K_CDR3 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | L | Q | H | N | S | | | | | | | | | | | | | | | | | | | |
| 21-225_58D11_LC | . | . | . | . | . | . | N | . | . | . | . | . | . | . | . | . | . | . | . | . | . | . | . | . | . | . |
| 21-225_58F5_LC | . | . | . | . | . | . | . | . | . | . | . | . | . | . | . | . | . | . | . | . | . | . | . | . | . | . |
| 21-225_59F11_LC | . | . | . | . | Y | . | Q | . | . | . | . | . | . | . | . | . | . | . | . | . | . | . | . | . | . | . |
| 21-225_5F4_LC | . | . | . | . | Y | . | . | . | . | . | . | . | . | . | . | . | . | . | . | . | . | . | . | . | . | . |
| 21-225_60A3_LC | . | . | . | . | Y | . | Q | . | . | . | . | . | . | . | . | . | . | . | . | . | . | . | . | . | . | . |
| 21-225_62G3_LC | . | . | . | . | . | . | . | . | . | . | . | . | . | . | . | . | . | . | . | . | . | . | . | . | . | . |
| 21-225_64A12_LC | . | . | . | . | Y | . | . | . | . | . | . | . | . | . | . | . | . | . | . | . | . | . | . | . | . | . |
| 21-225_66F9_LC | . | . | . | . | . | . | T | . | . | . | . | . | . | . | . | . | . | . | . | . | . | . | . | . | . | . |
| 21-225_67B7_LC | . | . | . | H | . | . | . | . | . | . | . | . | . | . | . | . | . | . | . | . | . | . | . | . | . | . |
| 21-225_68G8_LC | . | . | . | . | . | . | D | . | . | . | . | . | . | . | . | . | . | . | . | . | . | . | . | . | . | . |
| 21-225_71B11_LC | . | . | . | . | Y | . | D | . | . | . | . | . | . | . | . | . | . | . | . | . | . | . | . | . | . | . |
| 21-225_71B6_LC | . | . | . | . | . | . | . | . | . | . | . | . | . | . | . | . | . | . | . | . | . | . | . | . | . | . |
| 21-225_71H6_LC | . | . | . | . | . | . | . | . | . | . | . | . | . | . | . | . | . | . | . | . | . | . | . | . | . | . |
| 21-225_73A6_LC | F | . | . | . | . | . | D | . | . | . | . | . | . | . | . | . | . | . | . | . | . | . | . | . | . | . |
| 21-225_74A11_LC | . | . | . | . | Y | . | D | . | . | . | . | . | . | . | . | . | . | . | . | . | . | . | . | . | . | . |
| 21-225_75C11_LC | . | . | . | . | . | . | . | . | . | . | . | . | . | . | . | . | . | . | . | . | . | . | . | . | . | . |
| 21-225_76H10_LC | . | . | . | . | . | . | Q | . | . | . | . | . | . | . | . | . | . | . | . | . | . | . | . | . | . | . |
| 21-225_76H12_LC | . | . | . | . | . | . | Q | . | . | . | . | . | . | . | . | . | . | . | . | . | . | . | . | . | . | . |
| 21-225_84H12_LC | . | . | . | . | . | . | Q | . | . | . | . | . | . | . | . | . | . | . | . | . | . | . | . | . | . | . |
| 21-225_88E5_LC | W | . | . | . | . | . | Q | . | . | . | . | . | . | . | . | . | . | . | . | . | . | . | . | . | . | . |
| 21-225_88A5_LC | . | . | . | . | . | . | Q | . | . | . | . | . | . | . | . | . | . | . | . | . | . | . | . | . | . | . |
| 21-225_96A4_LC | . | . | . | . | . | . | Q | . | . | . | . | . | . | . | . | . | . | . | . | . | . | . | . | . | . | . |

Table 101.  Consensus 21 - VKIiL1/JK4 (SEQ ID NO: 50318):

DIQMTQSPSSLSASVGDRVTITCRAS--QGIS-----NYLAWFQQKPGKAPKSLIYA--------ASSLQSGVPSKFSGSGSG--
TDFTLTISSLQPEDFATYCQQYST-------------YPLTFGGGTKVEIKR wherein:

A at position 25 can be substituted with T

S at position 26 can be substituted with N

G at position 30 can be substituted with D, A, V or S

S at position 32 can be substituted with G, N, R, A or F

N at position 39 can be substituted with K, R, H, S, T or I

Y at position 40 can be substituted with H, C or D

A at position 42 can be substituted with D, V, I or N

A at position 58 can be substituted with K, S, T, V, D or G

A at position 67 an be substituted with T or V

S at position 68 can be substituted with P

S at position 69 can be substituted with N or R

Q at position 71 can be substituted with L, E or H

S at position 72 can be substituted with G, N or T

Q at position 107 can be substituted with L or H

Q at position 108 can be substituted with H, R or Y

Y at position 109 can be substituted with S, C or T

S at position 110 can be substituted with L, N, M, D, H, V, I or Y

FIGURE 57 (Continued)

T at position 111 can be substituted with N, S or K

Y at position 135 can be substituted with F, I or S

L at position 137 can be substituted with V, F or N

T at position 138 can be substituted with I, Q or S

Arg Xaa Xaa Gln Xaa Ile Xaa Xaa Xaa Xaa Leu Xaa (SEQ ID NO: 50138)

Xaa Xaa Xaa Xaa Leu Xaa Leu Xaa Xaa (SEQ ID NO: 50139)

Xaa Xaa Xaa Xaa Xaa Xaa Pro Xaa Xaa (SEQ ID NO: 50140)

Arg Ala Ser Gln Gly Ile Ser Asn Tyr Leu Ala (SEQ ID NO: 50624)

Ala Ala Ser Ser Leu Gln Ser (SEQ ID NO: 50625)

Gln Gln Tyr Ser Thr Tyr Pro Leu Thr (SEQ ID NO: 50626)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | Q | M | T | Q | S | P | S | S | L | S | A | S | V | G | D | R | V | T | I | T | C | R | A | S |
| 21-225_77E6_LC | . | . | . | . | . | . | . | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . | . | . | . | . | . | . | . |
| 21-225_79F4_LC | . | . | . | . | . | . | . | . | . | A | . | . | . | . | . | . | . | . | . | . | . | . | . | . | . | . |
| 21-225_7F10_LC | . | . | . | . | . | . | . | . | . | . | . | . | . | . | . | . | . | . | . | . | . | . | . | . | . | . |
| 21-225_80C11_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | K_FR2 | | |
| CONSENSUS | - | - | Q | G | I | S | - | - | - | - | - | N | Y | L | A | W | F | Q | Q | K | P | G | K | A | P |
| 21-225_77E6_LC | . | . | . | . | . | . | . | . | . | . | . | . | . | . | . | . | . | . | . | . | . | . | . | . | . | . |
| 21-225_79A12_LC | . | . | . | V | . | . | . | . | . | . | . | K | . | . | . | . | . | . | . | . | . | . | . | . | . | . |
| 21-225_79F4_LC | . | . | . | D | . | R | . | . | . | . | . | K | . | . | . | . | . | . | . | . | . | . | . | . | . | . |
| 21-225_7F10_LC | . | . | . | . | . | G | . | . | . | . | . | . | . | . | . | . | . | . | . | . | . | . | . | . | . | . |
| 21-225_80C11_LC | . | . | . | . | . | . | . | . | . | . | . | K | . | . | . | . | . | . | . | . | . | . | R | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS | K | S | L | I | Y | A | . | . | . | . | . | . | . | . | A | S | S | L | Q | S | G | V | P | S | K | F |
| 21-225_77E6_LC | . | . | . | . | . | . | . | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . | . | . | A | . | . | . | . |
| 21-225_79F4_LC | . | . | . | . | S | V | . | . | . | . | . | . | . | . | . | . | . | . | . | G | . | A | . | . | . | . |
| 21-225_7F10_LC | . | . | . | . | . | T | . | . | . | . | . | . | . | . | . | . | . | . | . | G | . | A | . | . | R | . |
| 21-225_80C11_LC | . | . | . | . | . | . | . | . | . | . | . | . | . | . | . | . | . | . | . | . | . | A | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | K_FR3 | | | | | | | | | | | | | | | | |
| CONSENSUS | S | G | S | G | S | G | - | T | D | F | T | L | T | I | S | S | L | Q | P | E | D | F | A | T | Y |
| 21-225_77E6_LC | . | . | . | . | . | . | . | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . | . | . | . | . | . | . | . |
| 21-225_79F4_LC | . | . | . | . | . | . | . | . | . | . | . | . | . | . | . | . | . | . | . | . | . | . | . | . | . | . |
| 21-225_7F10_LC | . | . | . | . | . | . | . | . | . | . | . | . | . | . | . | . | . | . | . | . | . | . | . | . | . | . |
| 21-225_80C11_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112-130 K_CDR3 |
|---|---|---|---|---|---|---|---|---|
| CONSENSUS | Y | C | Q | Q | Y | S | T | |
| 21-225_147E9_LC | | | | | | N | S | |
| 21-225_150G8_LC | | | | | | N | N | |
| 21-225_153F9_LC | | | | | | N | S | |
| 21-225_157C1_LC | | | | | | N | S | |
| 21-225_160H4_LC | | | | | | N | S | |
| 21-225_163G6_LC | | | | | S | N | S | |
| 21-225_166H12_LC | | | | | | N | S | |
| 21-225_169C10_LC | | | | | | D | S | |
| 21-225_16A12_LC | | | | | | Y | S | |
| 21-225_16D10_LC | | | | | C | N | S | |
| 21-225_170D1_LC | | | | | S | D | S | |
| 21-225_170D6_LC | | | | | S | D | S | |
| 21-225_171H12_LC | | | | | S | D | S | |
| 21-225_175G3_LC | | | | | S | D | S | |
| 21-225_177A5_LC | | | | | | N | S | |
| 21-225_178H4_LC | | | | | | N | S | |
| 21-225_190C11_LC | | | | | | N | | |
| 21-225_190E10_LC | | | | | | N | | |
| 21-225_190E6_LC | | | | | | N | | |
| 21-225_190F8_LC | | | | | | N | | |
| 21-225_190G11_LC | | | | | | | | |
| 21-225_190G4_LC | | | | | | | | |
| 21-225_191A10_LC | | | | | | L | | |
| 21-225_191E10_LC | | | | | | N | | |
| 21-225_191G1_LC | | | | Q | | L | | |
| 21-225_191G10_LC | | | | | | L | | |
| 21-225_191G12_LC | | | | | | L | | |
| 21-225_192C8_LC | | | | Q | | L | | |
| 21-225_192D2_LC | | | | Q | | V | | |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Y | S | T | | | | | | | | | | | | | | | | | | | |
| 21-225_212E6_LC | . | . | . | . | . | V | N | | | | | | | | | | | | | | | | | | | |
| 21-225_212F10_LC | . | . | . | R | . | . | N | | | | | | | | | | | | | | | | | | | |
| 21-225_212H1_LC | . | . | . | R | . | . | . | | | | | | | | | | | | | | | | | | | |
| 21-225_212H9_LC | . | . | L | . | . | Q | N | | | | | | | | | | | | | | | | | | | |
| 21-225_213B8_LC | . | . | . | . | . | . | N | | | | | | | | | | | | | | | | | | | |
| 21-225_213C4_LC | . | . | . | . | . | . | N | | | | | | | | | | | | | | | | | | | |
| 21-225_213D2_LC | . | . | . | . | . | . | N | | | | | | | | | | | | | | | | | | | |
| 21-225_213E5_LC | . | . | . | R | . | . | . | | | | | | | | | | | | | | | | | | | |
| 21-225_215A12_LC | . | . | . | . | . | . | N | | | | | | | | | | | | | | | | | | | |
| 21-225_215B5_LC | . | . | . | . | . | Y | . | | | | | | | | | | | | | | | | | | | |
| 21-225_215D6_LC | . | . | . | . | . | I | . | | | | | | | | | | | | | | | | | | | |
| 21-225_215G1_LC | . | . | M | . | . | . | . | | | | | | | | | | | | | | | | | | | |
| 21-225_216G1_LC | . | . | . | . | . | V | . | | | | | | | | | | | | | | | | | | | |
| 21-225_217B10_LC | . | . | . | . | . | Q | N | | | | | | | | | | | | | | | | | | | |
| 21-225_217G5_LC | . | . | . | R | . | . | N | | | | | | | | | | | | | | | | | | | |
| 21-225_219H1_LC | . | . | . | . | T | . | . | | | | | | | | | | | | | | | | | | | |
| 21-225_221F6_LC | . | . | . | . | . | V | . | | | | | | | | | | | | | | | | | | | |
| 21-225_222A11_LC | . | . | L | K | . | E | K | | | | | | | | | | | | | | | | | | | |
| 21-225_222D10_LC | . | . | L | R | . | L | N | | | | | | | | | | | | | | | | | | | |
| 21-225_223H10_LC | . | . | L | R | . | L | N | | | | | | | | | | | | | | | | | | | |
| 21-225_22A2_LC | . | . | . | . | . | N | S | | | | | | | | | | | | | | | | | | | |
| 21-225_22D11_LC | . | . | . | . | . | S | S | | | | | | | | | | | | | | | | | | | |
| 21-225_23D11_LC | . | . | . | . | . | S | S | | | | | | | | | | | | | | | | | | | |
| 21-225_32G3_LC | . | . | . | . | . | S | S | | | | | | | | | | | | | | | | | | | |
| 21-225_56A11_LC | . | . | . | . | . | S | S | | | | | | | | | | | | | | | | | | | |
| 21-225_55D4_LC | . | . | . | Y | . | N | S | | | | | | | | | | | | | | | | | | | |
| 21-225_65H11_LC | . | . | . | . | S | Y | . | | | | | | | | | | | | | | | | | | | |
| 21-225_70H6_LC | . | . | . | . | . | . | N | | | | | | | | | | | | | | | | | | | |
| 21-225_74C8_LC | . | . | . | . | . | . | N | | | | | | | | | | | | | | | | | | | |
| 21-225_74G6_LC | . | . | . | . | . | . | N | | | | | | | | | | | | | | | | | | | |
| 21-225_76C5_LC | . | . | . | . | . | . | N | | | | | | | | | | | | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | Q | Q | Y | S | T | | | | | | | | | | | K_CDR3 | | | | | | | | |
| 21-225_77E6_LC | . | . | . | . | . | . | N | . | . | . | . | . | . | . | . | . | . | . | . | . | . | . | . | . | . | . |
| 21-225_79A12_LC | . | . | . | . | . | . | N | . | . | . | . | . | . | . | . | . | . | . | . | . | . | . | . | . | . | . |
| 21-225_79F4_LC | . | . | . | . | . | . | N | . | . | . | . | . | . | . | . | . | . | . | . | . | . | . | . | . | . | . |
| 21-225_7F10_LC | . | . | . | . | . | N | S | . | . | . | . | . | . | . | . | . | . | . | . | . | . | . | . | . | . | . |
| 21-225_80C11_LC | . | . | . | . | . | . | N | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K FR4 | | | | | |
| CONSENSUS | Y | . | . | . | Y | P | L | T | F | G | G | G | T | K | V | E | I | K | R |
| 21-225_147E9_LC | . | . | . | . | . | . | . | . | . | . | . | . | . | . | . | . | . | . | . |
| 21-225_150G8_LC | . | . | . | . | R | . | R | S | . | . | . | . | . | . | . | . | . | . | . |
| 21-225_153F9_LC | . | . | . | . | . | . | . | . | . | . | . | . | . | . | . | . | L | . | . |
| 21-225_157C1_LC | . | . | . | . | . | . | . | . | . | . | . | . | . | . | . | A | . | . | . |
| 21-225_180H4_LC | . | . | . | . | R | . | . | . | . | . | . | . | . | . | . | . | . | T | . |
| 21-225_163G6_LC | . | . | . | . | . | . | . | . | . | . | . | . | . | . | . | . | . | . | . |
| 21-225_168H12_LC | . | . | . | . | . | . | . | . | . | . | . | . | . | . | . | . | . | . | . |
| 21-225_169C10_LC | . | . | . | . | . | . | . | . | . | . | . | . | . | . | . | . | . | . | . |
| 21-225_16A12_LC | . | . | . | . | . | . | . | . | . | . | . | . | . | . | . | . | . | . | . |
| 21-225_18D10_LC | . | . | . | . | R | . | . | . | . | . | . | . | . | . | . | . | . | . | . |
| 21-225_170D1_LC | . | . | . | . | . | . | . | . | . | . | . | . | . | . | . | . | . | . | . |
| 21-225_170D6_LC | . | . | . | . | . | . | . | . | . | . | . | . | . | . | . | . | . | . | . |
| 21-225_171H12_LC | . | . | . | . | . | . | . | . | . | . | . | . | . | . | . | . | . | . | . |
| 21-225_175G3_LC | . | . | . | . | . | . | . | . | . | . | . | . | . | . | . | . | . | . | . |
| 21-225_177A5_LC | . | . | . | . | . | . | . | . | . | . | . | . | . | . | . | . | . | . | . |
| 21-225_178H4_LC | . | . | . | . | . | . | . | . | . | . | . | . | . | . | . | . | . | . | . |
| 21-225_190C11_LC | . | . | . | . | . | . | . | . | . | . | . | . | . | . | . | . | . | . | . |
| 21-225_190E10_LC | . | . | . | . | . | . | . | . | . | . | . | . | . | . | . | . | . | . | . |
| 21-225_190E6_LC | . | . | . | . | . | . | . | . | . | . | . | . | . | . | . | . | . | . | . |
| 21-225_190F8_LC | . | . | . | . | . | . | . | . | . | . | . | . | . | . | . | . | . | . | . |
| 21-225_190G11_LC | . | . | . | . | . | . | . | . | . | . | . | . | . | . | . | . | . | . | . |
| 21-225_190G4_LC | . | . | . | . | . | . | . | . | . | . | . | . | . | . | . | . | . | . | . |
| 21-225_191A10_LC | . | . | . | . | . | . | . | . | . | . | . | . | . | . | . | . | . | . | . |
| 21-225_191E10_LC | . | . | . | . | . | . | . | . | . | . | . | . | . | . | . | . | . | . | . |
| 21-225_191G1_LC | . | . | . | . | . | . | . | . | . | . | . | . | . | . | . | . | . | . | . |
| 21-225_191G10_LC | . | . | . | . | . | . | . | . | . | . | . | . | S | . | . | . | . | . | . |
| 21-225_191G12_LC | . | . | . | . | . | . | . | . | . | . | . | . | . | . | . | . | . | . | . |
| 21-225_192C8_LC | . | . | . | . | . | . | . | . | . | . | . | . | . | . | . | . | . | . | . |
| 21-225_192D2_LC | . | . | . | . | . | . | N | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | Y | P | L | T | F | G | G | G | T | K | V | E | I | K | R |
| 21-225_77E6_LC | . | . | . | . | . | . | . | . | . | . | . | . | . | . | . | . | . | . | . |
| 21-225_79A12_LC | . | . | . | . | . | . | . | . | . | . | . | . | . | . | . | . | . | . | . |
| 21-225_79F4_LC | . | . | . | . | . | . | . | . | . | . | . | . | . | . | . | . | . | . | . |
| 21-225_7F10_LC | . | . | . | . | . | . | . | . | . | . | . | . | . | . | . | . | . | . | . |
| 21-225_80C11_LC | . | . | . | . | . | . | . | . | . | . | . | . | . | . | . | . | . | N | . |

FIGURE 57 (Continued)

Table 102. Consensus 22 - VK1IO12/JK4 (SEQ ID NO: 50319):

DIQMTQSPSSLSASVGDRVTITCRAS--QNII-----SYLNWYQQKPGKAPKLLIYT------ASSLQSGVPSRFSGSGSG--TDFTLTISSLQPEDFATYYCQQSYS------------TPLTFGGGTKVEIKR wherein:

A at position 25 can be substituted with T
S at position 26 can be substituted with T
Q at position 29 can be substituted with H or R
N at position 30 can be substituted with S, R, T or I
I at position 31 can be substituted with V or F
I at position 32 can be substituted with S, N, Y, F, R, H, L, K or T
S at position 39 can be substituted with N, D, R, K or T
Y at position 40 can be substituted with F
N at position 42 an be substituted with H
T at position 58 can be substituted with A, V, G, I or S
A at position 67 can be substituted with T
S at position 69 can be substituted with N, R or T
L at position 70 can be substituted with F or S
Q at position 71 can be substituted with H, E or P
S at position 72 can be substituted with G, T, N or R
Q at position 108 can be substituted with L
S at position 109 can be substituted with T, N or P FIGURE 57 (Continued)

Y at position 110 can be substituted with H, C, D, F or N

S at position 111 can be substituted with null (-), I, N, F, G or T

T at position 135 can be substituted with S, P, F, N, I or L

P at position 136 can be substituted with T, I, A or S

L at position 137 can be substituted with P, Y, F or V

Arg Xaa Xaa Xaa Xaa Xaa Xaa Xaa Leu Xaa (SEQ ID NO: 50141)

Xaa Xaa Ser Xaa Xaa Xaa Xaa (SEQ ID NO: 50142)

Gln Xaa Xaa Xaa Xaa Xaa Xaa Xaa Xaa Thr (SEQ ID NO: 50143)

Arg Ala Ser Gln Asn Ile Ile Ser Tyr Leu Asn (SEQ ID NO: 50627)

Thr Ala Ser Ser Leu Gln Ser (SEQ ID NO: 50628)

Gln Gln Ser Tyr Ser Thr Pro Leu Thr (SEQ ID NO: 50629)

| Reference # | 105 | 106 | 107 | 108 | 109 | 110 | 111 | 112-130 (K_CDR3) |
|---|---|---|---|---|---|---|---|---|
| CONSENSUS | Y | C | Q | Q | S | Y | S | |
| 21-225_56B6_LC | . | . | . | . | T | . | . | |
| 21-225_62D2_LC | . | . | . | . | T | . | . | |
| 21-225_63C10_LC | . | . | . | . | . | . | . | |
| 21-225_64A11_LC | F | . | . | . | R | D | N | |
| 21-225_64F7_LC | . | . | . | . | . | . | . | |
| 21-225_6G1_LC | . | . | . | . | T | . | . | |
| 21-225_7A10_LC | . | . | . | . | T | . | . | |
| 21-225_7E11_LC | . | . | . | . | T | . | . | |
| 21-225_7E11.001_LC | . | . | . | . | T | . | . | |
| 21-225_7E11.001.001_LC | . | . | . | . | T | . | . | |
| 21-225_7E11.001.002_LC | . | . | . | . | T | . | . | |
| 21-225_7E11.001.003_LC | . | . | . | . | T | . | . | |
| 21-225_7E11.001.004_LC | . | . | . | . | T | . | . | |
| 21-225_7E11.001.005_LC | . | . | . | . | T | . | . | |
| 21-225_7E11.001.006_LC | . | . | . | . | T | . | . | |
| 21-225_7E11.001.007_LC | . | . | . | . | T | . | . | |
| 21-225_7E11.001.008_LC | . | . | . | . | T | . | . | |
| 21-225_7E11.001.009_LC | . | . | . | . | T | . | . | |
| 21-225_7E11.001.010_LC | . | . | . | . | T | . | . | |
| 21-225_7E11.001.011_LC | . | . | . | . | T | . | . | |
| 21-225_7E11.001.012_LC | . | . | . | . | T | . | . | |
| 21-225_7E11.001.013_LC | . | . | . | . | T | . | . | |
| 21-225_7E11.001.014_LC | . | . | . | . | T | . | . | |
| 21-225_7E11.001.015_LC | . | . | . | . | T | . | . | |
| 21-225_7E11.001.016_LC | . | . | . | . | T | . | . | |
| 21-225_7E11.001.017_LC | . | . | . | . | T | . | . | |
| 21-225_7E11.001.018_LC | . | . | . | . | T | . | . | |
| 21-225_7E11.001.019_LC | . | . | . | . | T | . | . | |
| 21-225_7E11.001.021_LC | . | . | . | . | T | . | . | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | , | , | , | , | T | P | L | T | F | G | G | G | T | K | V | E | I | K | R |
| 21-225_56B6_LC | . | . | . | . | A | . | . | . | . | . | . | . | . | . | . | . | . | . | . |
| 21-225_62D2_LC | . | . | . | . | A | . | . | . | . | . | . | . | . | . | . | . | . | . | . |
| 21-225_63C10_LC | . | . | . | . | A | . | . | . | . | . | . | . | . | . | . | . | . | . | . |
| 21-225_64A11_LC | . | . | . | . | A | . | . | . | . | . | . | . | . | . | . | . | . | . | . |
| 21-225_64F7_LC | . | . | . | . | - | S | R | . | . | . | . | . | . | . | . | . | L | . | . |
| 21-225_6G1_LC | . | . | . | . | A | . | . | . | . | . | . | . | . | . | . | . | . | . | . |
| 21-225_7A10_LC | . | . | . | . | A | . | . | . | . | . | . | . | . | . | . | . | . | . | . |
| 21-225_7E11_LC | . | . | . | . | . | . | . | . | . | . | . | . | . | . | . | . | . | . | . |
| 21-225_7E11.001_LC | . | . | . | . | . | . | . | . | . | . | . | . | . | . | . | . | . | . | . |
| 21-225_7E11.001.001_LC | . | . | . | . | . | . | . | . | . | . | . | . | . | . | . | . | . | . | . |
| 21-225_7E11.001.002_LC | . | . | . | . | . | . | . | . | . | . | . | . | . | . | . | . | . | . | . |
| 21-225_7E11.001.003_LC | . | . | . | . | . | . | . | . | . | . | . | . | . | . | . | . | . | . | . |
| 21-225_7E11.001.004_LC | . | . | . | . | . | . | . | . | . | . | . | . | . | . | . | . | . | . | . |
| 21-225_7E11.001.005_LC | . | . | . | . | . | . | . | . | . | . | . | . | . | . | . | . | . | . | . |
| 21-225_7E11.001.006_LC | . | . | . | . | . | . | . | . | . | . | . | . | . | . | . | . | . | . | . |
| 21-225_7E11.001.007_LC | . | . | . | . | . | . | . | . | . | . | . | . | . | . | . | . | . | . | . |
| 21-225_7E11.001.008_LC | . | . | . | . | . | . | . | . | . | . | . | . | . | . | . | . | . | . | . |
| 21-225_7E11.001.009_LC | . | . | . | . | . | . | . | . | . | . | . | . | . | . | . | . | . | . | . |
| 21-225_7E11.001.010_LC | . | . | . | . | . | . | . | . | . | . | . | . | . | . | . | . | . | . | . |
| 21-225_7E11.001.011_LC | . | . | . | . | . | . | . | . | . | . | . | . | . | . | . | . | . | . | . |
| 21-225_7E11.001.012_LC | . | . | . | . | . | . | . | . | . | . | . | . | . | . | . | . | . | . | . |
| 21-225_7E11.001.013_LC | . | . | . | . | . | . | . | . | . | . | . | . | . | . | . | . | . | . | . |
| 21-225_7E11.001.014_LC | . | . | . | . | . | . | . | . | . | . | . | . | . | . | . | . | . | . | . |
| 21-225_7E11.001.015_LC | . | . | . | . | . | . | . | . | . | . | . | . | . | . | . | . | . | . | . |
| 21-225_7E11.001.016_LC | . | . | . | . | . | . | . | . | . | . | . | . | . | . | . | . | . | . | . |
| 21-225_7E11.001.017_LC | . | . | . | . | . | . | . | . | . | . | . | . | . | . | . | . | . | . | . |
| 21-225_7E11.001.018_LC | . | . | . | . | . | . | . | . | . | . | . | . | . | . | . | . | . | . | . |
| 21-225_7E11.001.019_LC | . | . | . | . | . | . | . | . | . | . | . | . | . | . | . | . | . | . | . |
| 21-225_7E11.001.021_LC | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | - | - | - | - | T | P | L | T | F | G | G | G | T | K | V | E | I | K | R |
| 21-225_7E11.001.022_LC | | | | | | | | | | | | | | K_FR4 | | | | | |
| 21-225_7E11.001.023_LC | | | | | | | | | | | | | | | | | | | |

FIGURE 57 (Continued)

Table 103. Consensus 23 - VK1||L1/JK3 (SEQ ID NO: 50320):

DIQMTQSPSSLSASVGDRVTITCRAS--QGIS------NYLAWFQQKPGKAPKSLIYA-------ASSLQSGVPSKFSGSGSG--TDFTLTISSLQPEDFATYCQQYNS----------YPFTFGPGTKVDIKR wherein:

R at position 24 can be substituted with P

A at position 25 can be substituted with T

S at position 26 can be substituted with N

Q at position 29 can be substituted with R

G at position 30 can be substituted with D, V or A

I at position 31 can be substituted with V

S at position 32 can be substituted with N, G, R, T or K

N at position 39 can be substituted with K, Y, H, I or T

Y at position 40 can be substituted with H

A at position 42 can be substituted with V or S

A at position 58 can be substituted with V, G or T

A at position 67 can be substituted with S or V

S at position 68 can be substituted with F

S at position 69 can be substituted with G, N or T

L at position 70 can be substituted with V

Q at position 71 can be substituted with R, H, L or E

S at position 72 can be substituted with G or T

FIGURE 57 (Continued)

Q at position 107 can be substituted with H, L, P or R
Q at position 108 can be substituted with R, K, H or L
Y at position 109 can be substituted with F
N at position 110 can be substituted with H, D, Y, S, K, L, M or Q
S at position 111 can be substituted with T, G, N, C or D
Y at position 135 can be substituted with F or H
F at position 137 can be substituted with V, L or I
T at position 138 can be substituted with K
Xaa Xaa Xaa Xaa Xaa Xaa Xaa Xaa Xaa Leu Xaa (SEQ ID NO: 50144)

Xaa Xaa Xaa Xaa Xaa Xaa Xaa (SEQ ID NO: 50145)

Xaa Xaa Xaa Xaa Xaa Xaa Pro Xaa Xaa (SEQ ID NO: 50146)

Arg Ala Ser Gln Gly Ile Ser Asn Tyr Leu Ala (SEQ ID NO: 50630)

Ala Ala Ser Ser Leu Gln Ser (SEQ ID NO: 50631)

Gln Gln Tyr Asn Ser Tyr Pro Phe Thr (SEQ ID NO: 50632)

FIGURE 57 (Continued)

Table 104. Consensus 24 - VK1jL5/JK3 (SEQ ID NO: 50321):

DIQMTQSPSSVSASVGDRVTITCRAS—QGIS--------RWLAWYQQKPGKAPKLLIYA----------ASSLQSGVPSRFSGSGSG---
TDFTLTISSLQPEDFATYYCQQANS------------------FPFTFGPGTKVDIKR wherein:

A at position 25 can be substituted with V, E or G

S at position 26 can be substituted with G

Q at position 29 can be substituted with R

G at position 30 can be substituted with D, N, A, L or V

I at position 31 can be substituted with V or F

S at position 32 can be substituted with N, T, R or I

R at position 39 can be substituted with S, N, K, T, D, I or G

W at position 40 can be substituted with Y

L at position 41 can be substituted with I

A at position 42 can be substituted with T or V

A at position 58 can be substituted with G, T, D or V

A at position 67 can be substituted with T or V

S at position 68 can be substituted with Y

S at position 69 can be substituted with R, N, T, G or I

L at position 70 can be substituted with F

Q at position 71 can be substituted with E

FIGURE 57 (Continued)

S at position 72 can be substituted with G, N or D

Q at position 107 can be substituted with H

A at position 109 can be substituted with T, G, S, V or D

N at position 110 can be substituted with D, K or S

S at position 111 can be substituted with I

F at position 135 can be substituted with L, I or V

F at position 137 can be substituted with I

Arg Xaa Xaa Xaa Xaa Xaa Xaa Xaa Xaa Xaa Xaa (SEQ ID NO: 50147)

Xaa Xaa Xaa Xaa Xaa Xaa Xaa Xaa (SEQ ID NO: 50148)

Xaa Gln Xaa Xaa Xaa Xaa Pro Xaa Thr (SEQ ID NO: 50149)

Arg Ala Ser Gln Gly Ile Ser Arg Trp Leu Ala (SEQ ID NO: 50633)

Ala Ala Ser Ser Leu Gln Ser (SEQ ID NO: 50634)

Gln Gln Ala Asn Ser Phe Pro Phe Thr (SEQ ID NO: 50635)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | Q | M | T | Q | S | P | S | S | V | S | A | S | V | G | D | R | V | T | I | T | C | R | A | S |
| 21-225_4H6.014_LC | . | . | . | . | . | . | . | . | . | . | . | . | . | . | . | . | . | . | . | . | . | . | . | . | . | . |
| 21-225_50D4_LC | . | . | . | . | . | . | . | . | . | . | . | . | . | . | . | . | . | . | L | . | . | . | . | . | . | . |
| 21-225_50F3_LC | . | . | . | . | . | . | . | . | . | . | . | . | . | . | . | . | . | . | . | . | . | . | . | . | . | . |
| 21-225_51C7_LC | . | . | . | . | S | . | . | . | . | . | . | . | . | . | . | . | . | . | . | . | . | . | . | . | . | . |
| 21-225_51E9_LC | . | . | . | . | . | . | . | . | . | . | . | . | T | F | . | . | . | . | . | . | . | . | . | . | . | . |
| 21-225_52B1_LC | . | . | . | . | . | . | . | . | . | . | . | . | . | . | . | . | . | . | K | . | . | . | . | . | . | . |
| 21-225_52G11_LC | . | . | . | . | . | . | . | . | . | . | . | . | . | . | . | . | . | . | . | . | . | . | . | . | . | . |
| 21-225_52H10_LC | . | . | . | . | . | . | . | . | . | . | . | . | . | . | . | . | . | . | . | . | . | . | . | . | . | . |
| 21-225_53F2_LC | . | . | . | . | . | . | . | . | . | . | . | . | . | . | . | . | . | . | . | . | . | . | . | . | . | . |
| 21-225_53F7_LC | . | . | . | . | . | . | . | . | . | . | . | . | . | . | . | . | . | . | . | . | . | . | . | . | . | . |
| 21-225_55B1_LC | . | . | . | . | . | . | . | . | . | . | . | . | . | . | . | . | . | . | . | . | . | . | . | . | . | . |
| 21-225_56C6_LC | . | . | . | . | . | . | . | . | . | . | . | . | . | . | . | . | . | . | . | . | . | . | . | . | . | . |
| 21-225_56E5_LC | . | . | . | . | . | . | . | . | . | . | . | . | . | . | . | . | . | . | . | . | . | . | . | . | . | . |
| 21-225_56F6_LC | . | . | . | . | . | . | . | . | . | . | . | G | . | Y | . | . | . | . | . | . | . | . | . | . | . | . |
| 21-225_57A7_LC | . | . | . | . | . | . | . | . | . | . | . | . | . | . | . | . | . | . | . | S | . | . | . | . | . | . |
| 21-225_57E4_LC | . | . | . | . | . | . | . | . | . | . | . | . | . | . | . | . | . | . | . | . | . | . | . | . | V | . |
| 21-225_64E2_LC | . | . | . | . | . | . | . | . | . | . | . | . | . | . | . | . | . | . | . | . | . | . | . | . | . | . |
| 21-225_64G12_LC | . | . | . | . | . | . | . | . | . | . | . | . | . | . | . | . | . | . | . | . | . | . | . | . | . | . |
| 21-225_66F10_LC | . | . | . | . | . | . | . | . | . | . | . | G | . | . | . | . | . | . | . | . | . | . | . | . | G | G |
| 21-225_66F11_LC | . | . | . | . | . | . | . | . | . | . | . | . | . | . | . | . | . | . | . | . | . | . | . | . | E | . |
| 21-225_70D1_LC | . | . | . | . | . | . | . | . | . | . | . | . | . | . | . | . | . | . | . | . | . | . | . | . | . | . |
| 21-225_7C3_LC2 | . | . | . | . | . | . | . | . | . | . | . | . | . | . | . | . | . | . | . | . | . | . | . | . | . | . |
| 21-225_9F12_LC1 | . | . | . | . | . | . | . | . | . | . | . | . | . | . | L | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | K_FR4 | | | | | | |
| CONSENSUS | . | . | . | X | F | P | F | T | F | G | P | G | T | K | V | D | I | K | R |
| 21-225_4H6.014_LC | . | . | . | . | . | . | . | . | . | . | . | . | . | . | . | . | . | X | . |
| 21-225_50D4_LC | . | . | . | . | . | . | . | . | . | . | . | . | . | . | . | . | . | . | . |
| 21-225_50F3_LC | . | . | . | . | . | . | . | . | . | . | . | . | . | . | . | . | . | . | . |
| 21-225_51C7_LC | . | . | . | . | . | . | . | . | . | . | . | . | . | . | . | . | . | . | . |
| 21-225_51E9_LC | . | . | . | . | . | . | . | . | . | . | . | . | . | . | . | . | . | . | . |
| 21-225_52B1_LC | . | . | . | . | . | . | . | . | . | . | . | . | . | . | . | . | . | . | . |
| 21-225_52G11_LC | . | . | . | . | . | . | . | . | . | . | . | . | . | . | . | . | V | . | . |
| 21-225_52H10_LC | . | . | . | . | . | . | . | . | . | . | . | . | . | . | . | . | V | . | . |
| 21-225_53F2_LC | . | . | . | . | . | . | . | . | . | . | . | . | . | . | . | . | L | . | . |
| 21-225_53F7_LC | . | . | . | . | . | . | . | . | . | . | . | . | . | . | . | . | . | . | . |
| 21-225_55B1_LC | . | . | . | . | . | . | . | . | . | . | . | . | . | . | . | . | . | . | . |
| 21-225_56C6_LC | . | . | . | . | . | . | . | . | . | . | . | . | . | . | . | . | . | . | . |
| 21-225_56E5_LC | . | . | . | . | . | . | . | . | . | . | . | . | . | . | . | . | . | . | . |
| 21-225_56F6_LC | . | . | . | . | . | . | . | . | . | . | . | . | . | . | . | . | . | . | . |
| 21-225_57A7_LC | . | . | . | . | . | . | . | . | . | . | . | . | . | . | . | . | . | . | . |
| 21-225_57E4_LC | . | . | . | . | . | . | . | . | . | . | . | . | . | . | . | . | . | . | . |
| 21-225_64E2_LC | . | . | . | . | . | . | . | . | . | . | . | . | . | . | . | . | . | . | . |
| 21-225_64G12_LC | . | . | . | . | . | . | . | . | . | . | . | . | . | . | L | . | . | . | . |
| 21-225_65F10_LC | . | . | . | . | . | . | . | . | . | . | X | . | . | . | . | . | . | . | . |
| 21-225_66F11_LC | . | . | . | . | . | . | . | . | . | . | . | . | . | . | . | . | . | . | . |
| 21-225_70D1_LC | . | . | . | . | . | . | . | . | . | . | . | . | . | . | . | . | . | . | . |
| 21-225_7C3_LC2_LC | . | . | . | . | . | . | . | . | . | . | . | . | . | . | . | . | . | . | . |
| 21-225_9F12_LC1_LC | . | . | . | . | . | . | . | . | . | . | . | . | . | . | . | . | F | . | . |

FIGURE 57 (Continued)

Table 105.  Consensus 25 – VK2|A18/JK1 (SEQ ID NO: 50322):

DIVMTQTPLSLSVTPGQPASISCKSS--QSLLHGD-GKTYLYWYLQKPGQPPQLLIYE--------VSNRFSGVPDRFSGSGSG--TDFTLKISRVEAEDVGVYYCMQSIQ--------------LPWTFGQGTKVEIKR wherein:

K at position 24 can be substituted with M, R or T

S at position 26 can be substituted with G or T

Q at position 29 can be substituted with K

S at position 30 can be substituted with R, N or T

L at position 32 can be substituted with R or V

H at position 33 can be substituted with Y

G at position 34 can be substituted with S

D at position 35 can be substituted with E or G

K at position 38 can be substituted with R

Y at position 40 can be substituted with F

L at position 41 can be substituted with F

Y at position 42 can be substituted with F, T, C or S

E at position 58 can be substituted with A

V at position 67 can be substituted with I, L or T

N at position 69 can be substituted with K, H, I or S

F at position 71 can be substituted with L

S at position 72 can be substituted with A, T, C or P

FIGURE 57 (Continued)

M at position 107 can be substituted with K

S at position 109 can be substituted with T

I at position 110 can be substituted with T, F or L

Q at position 111 can be substituted with H

L at position 135 can be substituted with I, V or F

W at position 137 can be substituted with R

Xaa Ser Xaa Xaa Leu Xaa Xaa Xaa Gly Xaa Thr Xaa Xaa Xaa (SEQ ID NO: 50150)

Xaa Xaa Ser Xaa Arg Xaa Xaa (SEQ ID NO: 50151)

Xaa Gln Xaa Xaa Xaa Pro Xaa Thr (SEQ ID NO: 50152)

Lys Ser Ser Gln Ser Leu Leu His Gly Asp Gly Lys Thr Tyr Leu Tyr (SEQ ID NO: 50636)

Glu Val Ser Asn Arg Phe Ser (SEQ ID NO: 50637)

Met Gln Ser Ile Gln Leu Pro Trp Thr (SEQ ID NO: 50638)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | V | M | T | Q | T | P | L | S | L | S | V | T | P | G | Q | P | A | S | I | S | C | K | S | S |
| 21-225_26F8_LC | E | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | . | . | . | . | . | . | . | . | . | . | . | . | . | . | . | . | . | . | . | . | . | . | T | . | . |
| 21-225_46F2_LC | . | . | . | . | . | . | . | . | . | . | . | . | . | . | . | . | . | . | . | . | . | . | . | . | . | . |
| 21-225_47C1_LC | . | . | . | . | . | . | . | . | . | . | . | T | . | . | . | . | . | . | . | . | . | . | . | . | . | . |
| 21-225_47E7_LC | E | . | . | . | . | . | . | . | . | . | . | . | . | . | . | . | . | . | . | . | . | . | . | . | . | . |
| 21-225_64H9_LC | E | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | K_FR2 | | | |
| CONSENSUS | x | x | Q | S | L | L | H | G | D | - | G | K | T | Y | L | Y | W | Y | L | Q | K | P | G | Q | P | P |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | . | . | . | . | . | . | S | . | . | . | . | . | . | . | . | . | . | . | . | . | . | . | . | . | . |
| 21-225_46F2_LC | . | . | . | . | . | . | . | . | . | . | . | . | . | . | . | . | . | . | . | . | . | . | . | . | . | . |
| 21-225_47C1_LC | . | . | . | . | . | . | . | S | E | . | . | K | . | . | . | . | . | . | . | . | . | . | . | . | . | . |
| 21-225_47E7_LC | . | . | . | . | . | . | . | S | . | . | . | K | . | . | . | R | . | . | . | . | . | . | . | . | . | . |
| 21-225_64H9_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| CONSENSUS | Q | L | L | I | Y | E | . | . | . | . | . | . | . | . | V | S | N | R | F | S | G | V | P | D | R | F |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | V | . | . | . | . | . | . | . | . | . | . | . | . | . | . | . | . | . | . | . | . | . | . | . | . |
| 21-225_46F2_LC | . | . | . | . | . | . | . | . | . | . | . | . | . | . | . | . | . | . | . | . | . | . | . | E | . | . |
| 21-225_47C1_LC | . | . | . | . | . | . | . | . | . | . | . | . | . | . | . | . | S | . | . | . | . | . | . | . | . | . |
| 21-225_47E7_LC | . | V | . | . | . | . | . | . | . | . | . | . | . | . | . | . | . | . | . | . | . | . | . | . | . | . |
| 21-225_64H9_LC | . | . | . | . | . | . | . | . | . | . | . | . | . | . | . | . | . | . | L | C | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | | K_FR3 | | | | | | | | | | | | | | |
| CONSENSUS | S | G | S | G | S | G | - | T | D | F | T | L | K | I | S | R | V | E | A | E | D | V | G | V | Y |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | . | . | . | . | . | . | . | . | . | . | . | . | . | . | . | . | . | . | . | . | . | . | . | . | . |
| 21-225_46F2_LC | . | . | . | . | . | . | . | . | . | . | . | A | . | . | L | . | . | . | . | . | . | . | . | . | . | E |
| 21-225_47C1_LC | . | . | . | . | . | . | . | . | . | . | . | S | . | . | . | . | . | . | . | . | . | . | . | . | . | . |
| 21-225_47E7_LC | . | . | . | . | . | . | . | . | . | . | . | . | . | . | . | . | . | . | . | . | . | . | . | . | . | . |
| 21-225_64H9_LC | . | . | . | . | . | . | . | . | . | . | . | . | . | . | . | . | . | . | . | . | . | . | . | . | . | . |

FIGURE 57 (Continued)

| Reference # | 105 Y | 106 C | 107 M | 108 Q | 109 S | 110 I | 111 Q | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | | | | | | | | | | | | | | | | | | K_CDR3 | | | | | | | | |
| 21-225_189G2_LC | | | | | | | | | | | | | | | | | | | | | | | | | | |
| 21-225_190E7_LC | | | | | | | | | | | | | | | | | | | | | | | | | | |
| 21-225_190H11_LC | | | | | K | | | | | | | | | | | | | | | | | | | | | |
| 21-225_191B1_LC | | | | | | | | | | | | | | | | | | | | | | | | | | |
| 21-225_191E3_LC | | | | | | | | | | | | | | | | | | | | | | | | | | |
| 21-225_191E6_LC | | | | | | | | | | | | | | | | | | | | | | | | | | |
| 21-225_192F9_LC | | | | | | | | | | | | | | | | | | | | | | | | | | |
| 21-225_194F4_LC | S | | | | | | | | | | | | | | | | | | | | | | | | | |
| 21-225_197G8_LC | | | | | | | | | | | | | | | | | | | | | | | | | | |
| 21-225_198A10_LC | | | | | | T | | | | | | | | | | | | | | | | | | | | |
| 21-225_224A7_LC | | | | | | T | | | | | | | | | | | | | | | | | | | | |
| 21-225_224C11_LC | | | | | | T | | | | | | | | | | | | | | | | | | | | |
| 21-225_224G1_LC | | | | | | T | | | | | | | | | | | | | | | | | | | | |
| 21-225_224H11_LC | | | | | | | | | | | | | | | | | | | | | | | | | | |
| 21-225_225G4_LC | | | | | | T | | | | | | | | | | | | | | | | | | | | |
| 21-225_226A5_LC | | | | | | T | | | | | | | | | | | | | | | | | | | | |
| 21-225_226B1_LC | | | | | | T | | | | | | | | | | | | | | | | | | | | |
| 21-225_226E11_LC | | | | | | T | | | | | | | | | | | | | | | | | | | | |
| 21-225_226E7_LC | | | | | | T | | | | | | | | | | | | | | | | | | | | |
| 21-225_226F10_LC | | | | | | T | | | | | | | | | | | | | | | | | | | | |
| 21-225_226F9_LC | | | | | | T | | | | | | | | | | | | | | | | | | | | |
| 21-225_226G8_LC | | | | | | T | | | | | | | | | | | | | | | | | | | | |
| 21-225_226H12_LC | | | | | | T | | | | | | | | | | | | | | | | | | | | |
| 21-225_226H9_LC | | | | | | T | | | | | | | | | | | | | | | | | | | | |
| 21-225_227A8_LC | | | | | | T | | | | | | | | | | | | | | | | | | | | |
| 21-225_227C1_LC | | | | | T | L | | | | | | | | | | | | | | | | | | | | |
| 21-225_227F2_LC | | | | | | | K | | | | | | | | | | | | | | | | | | | |
| 21-225_22A1_LC | | | | | | | | | | | | | | | | | | | | | | | | | | |
| 21-225_25H9_LC | | | | | | | | | | | | | | | | | | | | | | | | | | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | M | Q | S | I | Q | | | | | | | | | | | | | | | | | | | |
| 21-225_26F8_LC | . | . | . | . | . | . | . | . | . | . | . | . | . | . | . | . | . | . | . | . | . | . | . | . | . | . |
| 21-225_28G3_LC | . | . | . | . | . | . | . | . | . | . | . | . | . | . | . | . | . | . | . | . | . | . | . | . | . | . |
| 21-225_43E11_LC | . | . | . | . | . | . | . | . | . | . | . | . | . | . | . | . | . | . | . | . | . | . | . | . | . | . |
| 21-225_46F2_LC | . | . | . | . | . | . | . | . | . | . | . | . | . | . | . | . | . | . | . | . | . | . | . | . | . | . |
| 21-225_47C1_LC | . | . | . | . | . | T | . | . | . | . | . | . | . | . | . | . | . | . | . | . | . | . | . | . | . | . |
| 21-225_47E7_LC | . | . | . | . | . | . | . | . | . | . | . | . | . | . | . | . | . | . | . | . | . | . | . | . | . | . |
| 21-225_64H9_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | L | P | W | T | F | G | Q | G | T | K | V | E | I | K | R |
| 21-225_26F8_LC | | | | | — | | | | | | | | | | | | | | |
| 21-225_28G3_LC | | | | | | | | | | | | | | | | | | | |
| 21-225_43E11_LC | | | | | | | | | | | | | | | | | | | |
| 21-225_46F2_LC | | | | | | | | | | | | | | | | | | | |
| 21-225_47C1_LC | | | | | | | | | | | | | | | A | | | | |
| 21-225_47E7_LC | | | | | V | | | | | | | | | | | | | T | |
| 21-225_64H9_LC | | | | | | | | | | | | | | | | | | | |

FIGURE 57 (Continued)

Table 106. Consensus 26 - VKIIO12/JK3 (SEQ ID NO: 50323):

DIQMTQSPSSLSASVGDRVTITCRAS--QSIS------SYLNWYQQKPGKAPKLLIYA-------ASSLQSGVPSRFSGSGSG--TDFTLTISSLQPEDFATYYCQQSYS-------------PPFTFGPGTKVDIKR wherein:

A at position 25 can be substituted with S or T

S at position 26 can be substituted with G or I

Q at position 29 can be substituted with H or R

S at position 30 can be substituted with N or T

I at position 31 can be substituted with F

S at position 32 can be substituted with I, F, N, R, Y, T, A, G or L

S at position 39 can be substituted with N, T, H or K

Y at position 40 can be substituted with F or H

L at position 41 can be substituted with V

N at position 42 can be substituted with I, M, H or Y

A at position 58 can be substituted with G, T, V or I

A at position 67 can be substituted with T, V or S

S at position 68 can be substituted with F

S at position 69 can be substituted with N, T or V

Q at position 71 can be substituted with H

S at position 72 can be substituted with N, G, H, I or T

S at position 109 can be substituted with T or Y

Y at position 110 can be substituted with N, F or H

FIGURE 57 (Continued)

S at position 111 can be substituted with R, N, F or I null (-) at position 134 can be substituted with A or S P at position 135 can be substituted with T, I, F, A, L or V P at position 136 can be substituted with L, F, or S T at position 138 can be substituted with A or S Arg Xaa Xaa Xaa Xaa Xaa Xaa Xaa Xaa Xaa (SEQ ID NO: 50153)

Xaa Xaa Xaa Xaa Leu Xaa Xaa (SEQ ID NO: 50154)

Gln Gln Xaa Xaa Xaa Xaa Xaa Xaa Phe Xaa (SEQ ID NO: 50155)

Arg Ala Ser Gln Ser Ile Ser Ser Tyr Leu Asn (SEQ ID NO: 50639)

Ala Ala Ser Ser Leu Gln Ser (SEQ ID NO: 50640)

Gln Gln Ser Tyr Ser Pro Pro Phe Thr (SEQ ID NO: 50641)

Table 107. Consensus 27 - VK4|B3/JK2 (SEQ ID NO: 50324):

DIVMTQSPDSLAVSLGERATINCKSS--QSVLYSSNNNYLAWYQQKPGQPPKLLIYW--------ASTRESGVPDRFSGSGSG--
TDFTLTISSLQAEDVAVYYCQQYYS--------------TPCSFGQGTKLEIKR wherein:

K at position 24 can be substituted with R or T

S at position 26 can be substituted with I

S at position 30 can be substituted with N

V at position 31 can be substituted with I

Y at position 33 can be substituted with H, S or F

S at position 34 can be substituted with N, I, R or H

N at position 36 can be substituted with H

N at position 37 can be substituted with S or D

N at position 38 can be substituted with Y, K, H, A, M or Q

N at position 39 can be substituted with K

Y at position 40 can be substituted with F

A at position 42 can be substituted with T or D

A at position 67 can be substituted with T, G or S

S at position 68 can be substituted with F

T at position 69 can be substituted with I

E at position 71 can be substituted with K or D

S at position 72 can be substituted with F

Q at position 107 can be substituted with H

FIGURE 57 (Continued)

Q at position 108 can be substituted with H

Y at position 109 can be substituted with S

Y at position 110 can be substituted with F, K, or N

S at position 111 can be substituted with T, I, null (-) or N

T at position 135 can be substituted with S, I, R, A, G or N

P at position 136 can be substituted with S

C at position 137 can be substituted with Y, G, L or P

S at position 138 can be substituted with K or N

Xaa Ser Xaa Gln Xaa Xaa Leu Xaa Xaa Ser Xaa Xaa Xaa Xaa Xaa Leu Xaa (SEQ ID NO: 50156)

Trp Xaa Xaa Xaa Arg Xaa Xaa (SEQ ID NO: 50157)

Xaa Xaa Xaa Xaa Xaa Xaa Xaa Xaa Xaa Xaa (SEQ ID NO: 50158)

Lys Ser Ser Gln Ser Val Leu Tyr Ser Ser Asn Asn Asn Tyr Leu Ala (SEQ ID NO: 50642)

Trp Ala Ser Thr Arg Glu Ser (SEQ ID NO: 50643)

Gln Gln Tyr Tyr Ser Thr Pro Cys Ser (SEQ ID NO: 50644)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | K_FR1 | | | | | | | | | | | | | | | |
| CONSENSUS | D | I | V | M | T | Q | S | P | D | S | L | A | V | S | L | G | E | R | A | T | I | N | C | K | S | S |
| 21-225_33D1_LC | . | . | . | . | . | . | . | . | . | . | . | S | . | . | . | . | . | . | . | . | . | . | . | . | . | - |
| 21-225_34H7_LC | . | . | . | . | . | . | . | . | . | . | . | . | . | . | . | . | . | . | . | . | . | . | . | . | . | . |
| 21-225_57F12_LC | . | . | . | . | . | . | . | . | . | . | . | T | . | . | . | . | . | . | . | . | . | . | . | . | . | . |
| 21-225_59E1_LC | . | . | . | . | . | . | . | . | . | . | . | . | . | . | . | . | . | . | . | . | . | . | . | . | . | . |
| 21-225_60F3_LC | . | . | . | . | . | . | . | . | . | . | . | . | . | . | . | . | . | . | . | . | . | . | . | . | . | . |
| 21-225_61E3_LC | . | . | . | . | . | . | . | . | . | . | . | . | . | . | . | . | A | . | . | . | . | . | . | . | . | . |
| 21-225_63F4_LC | . | . | . | . | . | . | . | . | . | . | . | . | . | . | . | . | . | . | . | . | . | . | . | . | . | . |
| 21-225_71F3_LC | . | . | . | . | . | . | . | . | . | . | . | . | . | . | . | . | . | . | V | A | . | . | . | . | . | . |
| 21-225_71G3_LC | . | . | . | . | . | . | . | . | . | . | . | . | . | . | . | . | A | . | . | . | . | . | . | . | . | . |
| 21-225_74A8_LC | . | . | . | . | . | . | . | . | . | . | . | . | . | . | . | . | . | . | . | . | . | . | . | . | . | . |
| 21-225_74C10_LC | . | . | . | . | . | . | . | . | . | . | . | . | . | . | . | . | . | . | . | . | . | . | . | . | . | . |
| 21-225_74C12_LC | . | . | . | . | . | . | . | . | . | . | . | . | . | . | . | . | . | . | . | . | . | . | . | . | . | . |
| 21-225_77D12_LC | . | . | . | . | . | . | . | . | . | . | . | . | . | . | . | . | . | . | . | . | . | . | . | . | . | . |
| 21-225_78E6_LC | . | . | . | . | . | . | . | . | . | . | . | . | . | . | . | . | . | . | . | . | . | . | . | . | . | . |
| 21-225_79G7_LC | . | . | . | . | . | . | . | . | . | . | . | . | . | . | . | . | . | . | . | . | . | . | . | K | . | . |
| 21-225_85C11_LC | . | . | . | . | . | . | . | . | . | . | . | . | . | . | . | . | . | . | . | . | . | . | . | . | . | . |
| 21-225_8TE10_LC | . | . | . | . | . | . | . | . | . | . | . | . | . | . | . | . | . | . | . | . | . | . | . | . | . | . |
| 21-225_88I1_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | T | P | C | S | F | G | Q | G | T | K | L | E | I | K | R |
| 21-225_146C9_LC | . | . | . | . | . | . | . | . | . | . | . | . | . | . | . | . | . | T | . |
| 21-225_146D4_LC | . | . | . | . | . | . | . | . | . | . | . | . | . | . | . | . | . | . | . |
| 21-225_148F9_LC | . | . | . | . | . | . | . | . | . | . | . | . | . | . | . | . | . | . | . |
| 21-225_147D5_LC | . | . | . | . | G | S | Y | N | . | . | . | . | . | . | . | . | . | . | . |
| 21-225_150D2_LC | . | . | . | . | S | . | R | . | . | . | . | . | . | . | R | . | . | . | . |
| 21-225_152D10_LC | . | . | . | . | S | S | . | . | . | . | . | . | . | . | . | . | . | . | . |
| 21-225_152E12_LC | . | . | . | . | . | . | L | . | . | . | . | . | . | . | . | . | . | . | . |
| 21-225_152H3_LC | . | . | . | . | . | . | . | . | . | . | . | . | . | . | . | . | . | . | . |
| 21-225_153B9_LC | . | . | . | . | . | . | . | . | . | . | . | . | . | . | . | . | . | . | . |
| 21-225_153F11_LC | . | . | . | . | . | . | . | . | . | . | . | . | . | . | . | . | . | . | . |
| 21-225_154H8_LC | . | . | . | . | S | . | . | . | . | . | . | . | . | . | . | . | . | . | . |
| 21-225_155B6_LC | . | . | . | . | . | . | . | . | . | . | . | . | . | . | . | . | . | . | . |
| 21-225_155E5_LC | . | . | . | . | . | . | . | . | . | . | . | . | . | . | . | . | . | . | . |
| 21-225_156H1_LC | . | . | . | . | . | . | . | . | . | . | . | . | . | . | . | . | . | . | . |
| 21-225_160A4_LC | . | . | . | . | . | . | Q | X | . | . | . | . | . | . | . | . | . | Q | Q |
| 21-225_160A7_LC | . | . | . | . | . | . | . | . | . | . | . | . | . | . | . | . | . | . | . |
| 21-225_172E11_LC | . | . | . | . | - | . | . | . | . | . | . | . | . | . | . | . | . | . | . |
| 21-225_224F11_LC | . | . | . | . | S | . | . | . | . | . | . | . | . | . | . | . | . | . | . |
| 21-225_225B9_LC | . | . | . | . | K | . | Y | . | . | . | . | . | . | . | . | . | . | . | . |
| 21-225_225F12_LC | . | . | . | . | . | . | . | . | . | . | . | . | . | . | . | . | . | . | . |
| 21-225_225H12_LC | . | . | . | . | . | . | . | . | . | . | . | . | . | . | . | . | . | . | . |
| 21-225_226D6_LC | . | . | . | . | S | . | . | . | . | . | . | . | . | N | . | . | . | . | . |
| 21-225_227D11_LC | . | . | . | . | S | . | . | . | . | . | . | . | . | Q | . | . | . | . | . |
| 21-225_227E6_LC | . | . | . | . | S | . | . | . | . | . | . | . | . | . | . | . | . | . | . |
| 21-225_227G9_LC | . | . | . | . | S | . | . | . | . | . | . | . | . | . | . | . | . | . | . |
| 21-225_22D2_LC | . | . | . | . | S | . | . | . | . | . | . | . | . | . | . | . | . | . | . |
| 21-225_25E12_LC | . | . | . | . | S | . | . | . | . | . | . | . | . | . | . | . | . | . | . |
| 21-225_32A1_LC | . | . | . | . | S | . | . | . | . | . | . | . | . | . | . | . | . | . | . |
| 21-225_32A5_LC | . | . | . | . | S | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | T | P | C | S | F | G | Q | G | T | K | L | E | I | K | R |
| 21-225_33D1_LC | . | . | . | . | S | . | . | . | . | . | . | . | . | . | . | . | . | . | . |
| 21-225_34H7_LC | . | . | . | . | S | . | . | . | . | . | . | . | . | . | . | . | . | . | . |
| 21-225_57F12_LC | . | . | . | . | N | . | . | . | . | . | . | . | . | . | . | . | . | . | . |
| 21-225_59E1_LC | . | . | . | . | I | . | . | . | . | . | . | . | . | . | . | . | . | . | . |
| 21-225_60F3_LC | . | . | . | . | I | . | . | . | . | . | . | . | . | . | . | . | . | . | . |
| 21-225_61E3_LC | . | . | . | . | . | . | . | . | . | . | . | . | . | . | . | . | . | . | . |
| 21-225_63F4_LC | . | . | . | . | . | . | . | . | . | . | . | . | . | . | . | . | . | N | . |
| 21-225_71F3_LC | . | . | . | . | . | . | . | . | . | . | . | . | . | . | . | . | . | N | . |
| 21-225_71G3_LC | . | . | . | . | . | . | . | . | . | . | . | . | . | . | . | . | . | . | . |
| 21-225_74A8_LC | . | . | . | . | . | . | . | . | . | . | . | . | . | . | . | . | . | . | . |
| 21-225_74C10_LC | . | . | . | . | . | . | . | . | . | . | . | . | . | . | . | . | . | . | . |
| 21-225_74C12_LC | . | . | . | . | . | . | . | . | . | . | . | . | . | . | . | . | . | . | . |
| 21-225_77D12_LC | . | . | . | . | . | . | . | . | . | . | . | . | . | . | . | . | . | . | . |
| 21-225_78E6_LC | . | . | . | . | . | . | . | . | . | . | . | . | . | . | . | . | . | . | . |
| 21-225_79G7_LC | . | . | . | . | S | . | . | . | . | . | . | . | . | . | . | . | . | . | . |
| 21-225_85C11_LC | . | . | . | . | . | . | . | . | . | . | . | . | . | . | . | . | . | . | . |
| 21-225_87E10_LC | . | . | . | . | . | . | . | . | . | . | . | . | . | . | . | X | . | . | . |
| 21-225_8B11_LC | . | . | . | . | . | . | . | . | . | . | . | . | . | . | . | . | . | . | . |

FIGURE 57 (Continued)

Table 108. Consensus 28 - VK1|L5/JK1 (SEQ ID NO: 50325):

DIQMTQSPSSVSASVGDRVTITCRAS--QGIS------NWLAWYQQKPGKAPKLLIYA------ASSLQSGVPSRFSGSGSG--TDFTLTISSLQPEDFATYYCQQANS------------FPWTFGQGTKVEIKR wherein:

S at position 26 can be substituted with N

G at position 30 can be substituted with D, F, N or V

I at position 31 can be substituted with L or V

S at position 32 can be substituted with N, T, I, F or G

N at position 39 can be substituted with S, D, T or R

W at position 40 can be substituted with C

A at position 58 can be substituted with G, D, T or S

A at position 67 can be substituted with V, P or T

S at position 68 can be substituted with F

S at position 69 can be substituted with N

S at position 72 can be substituted with G or N

Q at position 107 can be substituted with L

A at position 109 can be substituted with T, S, G, V or Y

N at position 110 can be substituted with D, H or Y

F at position 135 can be substituted with L

W at position 137 can be substituted with R or P

Arg Ala Gln Xaa Xaa Xaa Xaa Leu Ala (SEQ ID NO: 50159)

Xaa Xaa Xaa Xaa Leu Gln Xaa (SEQ ID NO: 50160)

Xaa Gln Xaa Xaa Ser Xaa Pro Xaa Thr (SEQ ID NO: 50161)

Arg Ala Ser Gln Gly Ile Ser Asn Trp Leu Ala (SEQ ID NO: 50645)

Ala Ala Ser Ser Leu Gln Ser (SEQ ID NO: 50646)

Gln Gln Ala Asn Ser Phe Pro Trp Thr (SEQ ID NO: 50647)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | K_FR3 | | | | | | | | | | | | | | | | |
| CONSENSUS | S | G | S | G | S | G | . | . | T | D | F | T | L | T | I | S | S | L | Q | P | E | D | F | A | T | Y |
| 21-225_43H4_LC | . | . | . | . | . | . | . | . | . | . | . | . | . | . | . | . | N | . | . | . | . | . | . | . | . | . |
| 21-225_44C12_LC | . | . | . | . | . | . | . | . | . | . | . | . | . | S | . | . | . | . | . | . | . | . | . | . | . | . |
| 21-225_44D10_LC | . | . | . | . | . | . | . | . | . | . | . | . | . | . | . | . | N | . | . | . | . | . | . | . | . | . |
| 21-225_45F8_LC | . | . | . | . | . | . | . | . | . | . | . | . | . | . | . | . | N | . | . | . | . | . | . | . | . | . |
| 21-225_46A6_LC | . | . | . | . | . | . | . | . | . | . | . | . | . | . | . | . | . | . | . | . | A | . | . | V | . | . |
| 21-225_47G7_LC | . | . | . | . | . | . | . | . | . | . | . | . | . | . | . | . | . | . | . | . | . | . | . | . | . | . |
| 21-225_48D7_LC | . | . | . | . | . | . | . | . | . | . | . | . | . | . | . | . | . | . | . | . | . | . | . | . | . | . |
| 21-225_51G7_LC | . | . | . | . | . | . | . | . | . | . | . | . | . | . | . | . | . | . | . | . | . | . | . | . | . | . |
| 21-225_52H2_LC | . | . | . | . | . | . | . | . | . | . | . | . | . | . | . | . | . | . | . | . | . | . | . | . | . | . |
| 21-225_54G3_LC | . | . | N | E | . | E | . | . | . | . | . | . | . | . | . | . | . | . | . | . | . | . | . | . | . | . |
| 21-225_57F8_LC | . | . | . | . | . | . | . | . | . | . | . | . | . | . | . | . | . | . | . | . | . | . | . | . | . | . |
| 21-225_5A4_LC | . | . | N | E | . | . | . | . | . | . | . | . | . | . | . | . | . | . | . | . | . | . | . | . | . | . |
| 21-225_60A11_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112-130 (K_CDR3) |
|---|---|---|---|---|---|---|---|---|
| CONSENSUS | Y | C | Q | Q | A | N | S | |
| 21-225_149G7_LC | . | . | . | . | . | . | . | |
| 21-225_154E8_LC | C | . | . | . | T | . | . | |
| 21-225_171A8_LC | . | . | . | . | T | . | . | |
| 21-225_171A9_LC | . | . | L | . | T | . | . | |
| 21-225_171G4_LC | . | . | . | . | T | . | . | |
| 21-225_174G7_LC | . | . | . | . | . | . | . | |
| 21-225_175C10_LC | C | . | . | . | . | . | . | |
| 21-225_178A5_LC | . | . | . | . | . | . | . | |
| 21-225_178F7_LC | . | . | . | . | . | . | . | |
| 21-225_179G1_LC | . | . | . | . | . | . | . | |
| 21-225_17A4_LC | . | . | . | . | . | . | . | |
| 21-225_188E8_LC | S | . | . | . | . | . | . | |
| 21-225_190B9_LC | S | . | . | . | . | . | . | |
| 21-225_190H3_LC | S | . | . | . | . | . | . | |
| 21-225_193F2_LC | . | . | . | . | . | . | . | |
| 21-225_194F7_LC | . | . | . | . | . | . | . | |
| 21-225_195G12_LC | . | . | . | . | Q | Q | . | |
| 21-225_196B9_LC | . | . | . | . | . | . | . | |
| 21-225_197C9_LC | . | . | . | . | . | . | . | |
| 21-225_20F7_LC | . | . | . | . | . | . | . | |
| 21-225_224D6_LC | C | . | . | . | S | Q | . | |
| 21-225_227E4_LC | . | . | . | . | . | . | . | |
| 21-225_25B3_LC | C | . | . | . | S | Y | . | |
| 21-225_25D7_LC | C | . | . | . | S | Q | . | |
| 21-225_26D12_LC | C | . | . | . | Y | Q | . | |
| 21-225_27A11_LC | . | . | . | . | T | Q | . | |
| 21-225_27C5_LC | . | . | . | . | . | . | . | |
| 21-225_43C2_LC | . | . | . | . | . | . | . | |
| 21-225_43E8_LC | . | . | . | . | T | . | . | |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | A | N | S | | | | | | | | | | | | | | | | | | | |
| 21-225_43H4_LC | . | . | . | . | T | . | . | . | . | . | . | . | . | . | . | . | . | . | . | . | . | . | . | . | . | . |
| 21-225_44C12_LC | . | . | . | . | S | . | . | . | . | . | . | . | . | . | . | . | . | . | . | . | . | . | . | . | . | . |
| 21-225_44D10_LC | . | . | . | . | T | . | . | . | . | . | . | . | . | . | . | . | . | . | . | . | . | . | . | . | . | . |
| 21-225_45F8_LC | . | . | . | . | T | . | . | . | . | . | . | . | . | . | . | . | . | . | . | . | . | . | . | . | . | . |
| 21-225_46A6_LC | C | . | . | . | T | . | . | . | . | . | . | . | . | . | . | . | . | . | . | . | . | . | . | . | . | . |
| 21-225_47G7_LC | C | . | . | . | V | . | . | . | . | . | . | . | . | . | . | . | . | . | . | . | . | . | . | . | . | . |
| 21-225_48D7_LC | . | . | . | . | . | . | . | . | . | . | . | . | . | . | . | . | . | . | . | . | . | . | . | . | . | . |
| 21-225_51G7_LC | C | . | . | . | T | . | . | . | . | . | . | . | . | . | . | . | . | . | . | . | . | . | . | . | . | . |
| 21-225_52H2_LC | . | . | . | . | . | . | . | . | . | . | . | . | . | . | . | . | . | . | . | . | . | . | . | . | . | . |
| 21-225_54G3_LC | . | . | . | . | . | . | . | . | . | . | . | . | . | . | . | . | . | . | . | . | . | . | . | . | . | . |
| 21-225_57F8_LC | . | . | . | . | . | . | . | . | . | . | . | . | . | . | . | . | . | . | . | . | . | . | . | . | . | . |
| 21-225_5A4_LC | . | . | . | . | . | . | . | . | . | . | . | . | . | . | . | . | . | . | . | . | . | . | . | . | . | . |
| 21-225_60A11_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | . | . | . | . | F | P | W | T | F | G | Q | G | T | K | V | E | I | K | R |
| 21-225_43H4_LC | . | . | . | . | . | . | . | . | . | . | . | . | . | . | . | . | . | . | . |
| 21-225_44C12_LC | . | . | . | . | . | . | . | . | . | . | . | . | . | . | . | . | . | . | . |
| 21-225_44D10_LC | . | . | . | . | . | . | . | . | . | . | . | . | . | . | . | . | . | . | . |
| 21-225_45F8_LC | . | . | . | . | . | . | . | . | . | . | . | . | . | . | . | . | . | . | . |
| 21-225_46A6_LC | . | . | . | . | . | . | . | . | . | . | . | . | . | . | . | . | . | . | . |
| 21-225_47G7_LC | . | . | . | . | . | . | . | . | . | . | . | . | . | . | . | . | . | . | . |
| 21-225_48D7_LC | . | . | . | . | . | . | . | . | . | . | . | . | . | . | . | . | . | . | . |
| 21-225_51G7_LC | . | . | . | . | . | . | . | . | . | . | . | . | . | . | . | . | . | . | . |
| 21-225_52H2_LC | . | . | . | . | . | . | . | . | . | . | X | . | . | . | . | . | V | . | . |
| 21-225_54G3_LC | . | . | . | . | . | . | . | . | . | . | . | . | . | . | . | . | . | . | . |
| 21-225_57F8_LC | . | . | . | . | . | . | . | . | . | . | . | . | . | . | . | . | . | . | . |
| 21-225_5A4_LC | . | . | . | . | . | . | . | . | . | . | . | . | . | . | . | . | . | . | . |
| 21-225_60A11_LC | . | . | . | . | . | . | . | . | . | . | . | . | . | . | . | . | . | . | . |

FIGURE 57 (Continued)

Table 109. Consensus 29 – VK4|B3/JK3 (SEQ ID NO: 50326):

DIVMTQSPDSLAVSLGERATINCKSS--QSVLHSSNNNYLAWYQQKPGQPPKLLIYW--------ASTRESGVPDRFSGSGSG--TDFTLTISSLQAEDVAVYYCQQYYS--------------TPVTFGPGTKVDIKR wherein:

S at position 26 can be substituted with N
S at position 30 can be substituted with R or N
V at position 31 can be substituted with I or L
L at position 32 can be substituted with F
H at position 33 can be substituted with F, Y, K or S
S at position 34 can be substituted with N or H
N at position 36 can be substituted with H
N at position 37 can be substituted with S
N at position 38 can be substituted with K, Y or H
N at position 39 can be substituted with R or S
A at position 42 can be substituted with T or V
T at position 69 can be substituted with A, I or S
R at position 70 can be substituted with L
E at position 71 can be substituted with K or D
Q at position 107 can be substituted with H
Y at position 109 can be substituted with S
Y at position 110 can be substituted with C, F, S or H
S at position 111 can be substituted with N, Q, D or T

FIGURE 57 (Continued)

T at position 135 can be substituted with L, I, A, F or S

V at position 137 can be substituted with F or P

Lys Ser Xaa Gln Xaa Xaa Xaa Xaa Xaa Ser Xaa Xaa Xaa Xaa Tyr Leu Xaa (SEQ ID NO: 50162)

Trp Ala Ser Xaa Xaa Xaa Ser (SEQ ID NO: 50163)

Xaa Gln Xaa Xaa Xaa Xaa Pro Xaa Thr (SEQ ID NO: 50164)

Lys Ser Ser Gln Ser Val Leu His Ser Ser Asn Asn Asn Asn Tyr Leu Ala (SEQ ID NO: 50648)

Trp Ala Ser Thr Arg Glu Ser (SEQ ID NO: 50649)

Gln Gln Tyr Tyr Ser Thr Pro Val Thr (SEQ ID NO: 50650)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | V | M | T | Q | S | P | D | S | L | A | V | S | L | G | E | R | A | T | I | N | C | K | S | S |
| 21-225_4A2.001.008_LC | . | . | . | . | . | . | . | . | . | . | . | . | . | . | . | . | . | . | . | . | . | . | . | . | . | . |
| 21-225_4A2.001.009_LC | . | . | . | . | . | . | . | . | . | . | . | . | . | . | . | . | . | . | . | . | . | . | . | . | . | . |
| 21-225_4A2.001.010_LC | . | . | . | . | . | . | . | . | . | . | . | . | . | . | . | . | . | . | . | . | . | . | . | . | . | . |
| 21-225_4A2.001.011_LC | . | . | . | . | . | . | . | . | . | . | . | . | . | . | . | . | . | . | . | . | . | . | . | . | . | . |
| 21-225_4A2.001.012_LC | . | . | . | . | . | . | . | . | . | . | . | . | . | . | . | . | . | . | . | . | . | . | . | . | . | . |
| 21-225_4A2.001.022_LC | . | . | . | . | . | . | . | . | . | . | . | . | . | . | . | . | . | . | . | . | . | . | . | . | . | . |
| 21-225_4A2.001.024_LC | . | . | . | . | . | . | . | . | . | . | . | . | . | . | . | . | . | . | . | . | . | . | . | . | . | . |
| 21-225_6G6_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | | K_FR2 | | |
| CONSENSUS | K | - | Q | S | V | L | H | S | S | N | N | N | N | Y | L | A | W | Y | Q | Q | K | P | G | Q | P | P |
| 21-225_4A2.001.008_LC | | | | | — | | | | | | | | | | | | | F | | | | | | | | |
| 21-225_4A2.001.009_LC | | | | | — | | | | | | | | | | | | | F | | | | | | | | |
| 21-225_4A2.001.010_LC | | | | | — | | | | | | | | | | | | | F | | | | | | | | |
| 21-225_4A2.001.011_LC | | | | | — | | | | | | | | | | | | | F | | | | | | | | |
| 21-225_4A2.001.012_LC | | | | | — | | | | | | | | | | | | | F | | | | | | | | |
| 21-225_4A2.001.022_LC | | | | | — | | | | | | | | | | | | | F | | | | | | | | |
| 21-225_4A2.001.024_LC | | | | | — | | | N | | | | Y | | | | | | | | | | | | | | |
| 21-225_6G6_LC | | | | | | | | | | | | | | | | | | | | | | | | | | |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | | |
| CONSENSUS_LC | K | L | L | I | Y | W | . | . | . | . | . | . | . | . | A | S | T | R | E | S | G | V | P | D | R | F |
| 21-225_4A2.001.008_LC | . | . | . | L | . | . | . | . | . | . | . | . | . | . | . | . | . | . | . | . | . | . | . | . | . | . |
| 21-225_4A2.001.009_LC | . | . | . | L | . | . | . | . | . | . | . | . | . | . | . | . | . | . | . | . | . | . | . | . | . | . |
| 21-225_4A2.001.010_LC | . | . | . | L | . | . | . | . | . | . | . | . | . | . | . | . | . | . | . | . | . | . | . | . | . | . |
| 21-225_4A2.001.011_LC | . | . | . | L | . | . | . | . | . | . | . | . | . | . | . | . | . | . | . | . | . | . | . | . | . | . |
| 21-225_4A2.001.012_LC | . | . | . | L | . | . | . | . | . | . | . | . | . | . | . | . | . | . | . | . | . | . | . | . | . | . |
| 21-225_4A2.001.022_LC | . | . | . | F | . | . | . | . | . | . | . | . | . | . | . | . | . | . | . | . | . | . | . | . | . | . |
| 21-225_4A2.001.024_LC | . | . | . | . | . | . | . | . | . | . | . | . | . | . | . | . | . | . | . | . | . | . | . | . | . | . |
| 21-225_6G6_LC | N | . | . | . | Q | . | . | . | . | . | . | . | . | . | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
|  |  |  |  |  |  |  |  |  |  | K_FR3 | | | | | | | | | | | | | | | |
| CONSENSUS | S | G | S | G | S | G | - | - | T | D | F | T | L | T | I | S | S | L | Q | A | E | D | V | A | V | Y |
| 21-225_4A2.001.008_LC | . | . | . | . | . | . | . | . | . | . | . | . | . | . | . | . | . | . | . | P | . | . | . | . | . | . |
| 21-225_4A2.001.009_LC | . | . | . | . | . | . | . | . | . | . | . | . | . | . | . | . | . | . | . | P | . | . | . | . | . | . |
| 21-225_4A2.001.010_LC | . | . | . | . | . | . | . | . | . | . | . | . | . | . | . | . | . | . | . | P | . | . | . | . | . | . |
| 21-225_4A2.001.011_LC | . | . | . | . | . | . | . | . | . | . | . | . | . | . | . | . | . | . | . | P | . | . | . | . | . | . |
| 21-225_4A2.001.012_LC | . | . | . | . | . | . | . | . | . | . | . | . | . | . | . | . | . | . | . | P | . | . | . | . | . | . |
| 21-225_4A2.001.022_LC | . | . | . | . | P | . | . | . | . | . | . | . | . | . | . | . | . | . | . | P | . | . | . | . | . | . |
| 21-225_4A2.001.024_LC | . | . | . | . | . | . | . | . | . | . | . | . | . | . | . | . | . | . | . | . | . | . | . | . | . | . |
| 21-225_6G6_LC | . | . | . | . | . | . | . | . | . | . | . | . | . | N | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Y | Y | S | | | | | | | | | | | | | | | | | | | |
| 21-225_4A2.001.008_LC | . | . | . | . | . | . | . | . | . | . | . | . | . | . | . | . | . | . | . | . | . | . | . | . | . | . |
| 21-225_4A2.001.009_LC | . | . | . | . | . | . | N | . | . | . | . | . | . | . | . | . | . | . | . | . | . | . | . | . | . | . |
| 21-225_4A2.001.010_LC | . | . | . | . | . | . | Q | . | . | . | . | . | . | . | . | . | . | . | . | . | . | . | . | . | . | . |
| 21-225_4A2.001.011_LC | . | . | . | . | . | . | Q | . | . | . | . | . | . | . | . | . | . | . | . | . | . | . | . | . | . | . |
| 21-225_4A2.001.012_LC | . | . | . | . | . | . | . | . | . | . | . | . | . | . | . | . | . | . | . | . | . | . | . | . | . | . |
| 21-225_4A2.001.022_LC | . | . | . | . | . | . | . | . | . | . | . | . | . | . | . | . | . | . | . | . | . | . | . | . | . | . |
| 21-225_4A2.001.024_LC | . | . | . | . | . | . | D | . | . | . | . | . | . | . | . | . | . | . | . | . | . | . | . | . | . | . |
| 21-225_6G6_LC | . | . | . | . | . | . | . | . | . | . | . | . | . | . | . | . | . | . | . | . | . | . | . | . | . | . |

Table 110. Consensus 30 - VL7j7a/JL2 (SEQ ID NO: 50327):

QTVVTQE-PSLTVSPGGTVTLTCASST-GAVTSG----YYPNWFQQKPGQAPRALIYS--------TSNKHSWTPARFSGSLLG--
GKAALTLSGVQPEDEAEYYCLLYYG--------------GAQLVFGGGTKLTVLG wherein:

A at position 24 can be substituted with V or G
S at position 25 can be substituted with F or L
S at position 26 can be substituted with N
G at position 29 can be substituted with E
A at position 30 can be substituted with S or T
G at position 34 can be substituted with A
Y at position 39 can be substituted with S, N or F
Y at position 40 can be substituted with F
N at position 42 can be substituted with S or Q
S at position 58 can be substituted with H or N
S at position 68 can be substituted with N, D, I or T
K at position 70 can be substituted with R
L at position 107 can be substituted with M
L at position 108 can be substituted with I or F
Y at position 109 can be substituted with F
Y at position 110 can be substituted with C, F or S
G at position 111 can be substituted with D
A at position 135 can be substituted with V FIGURE 57 (Continued)

Q at position 136 can be substituted with H

L at position 137 can be substituted with V or M

V at position 138 can be substituted with A, I, G or M

Xaa Xaa Xaa Thr Xaa Xaa Val Thr Ser Xaa Xaa Xaa Pro Xaa (SEQ ID NO: 50165)

Xaa Thr Xaa Asn Xaa His Ser (SEQ ID NO: 50166)

Xaa Xaa Xaa Xaa Gly Xaa Xaa Xaa Xaa Xaa (SEQ ID NO: 50167)

Ala Ser Ser Thr Gly Ala Val Thr Ser Gly Tyr Tyr Pro Asn (SEQ ID NO: 50651)

Ser Thr Ser Asn Lys His Ser (SEQ ID NO: 50652)

Leu Leu Tyr Tyr Gly Gly Ala Gln Leu Val (SEQ ID NO: 50653)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | LCDR2 | | | | | | | | | | | | | |
| CONSENSUS_LC | R | A | L | I | Y | S | . | . | . | . | . | . | . | . | T | S | N | K | H | S | W | T | P | A | R | F |
| 21-225_74E5_LC | . | . | . | . | . | . | . | . | . | . | . | . | . | . | . | . | . | . | . | . | . | . | . | . | . | . |
| 21-225_78D10_LC | . | . | . | . | . | . | . | . | . | . | . | . | . | . | . | D | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | L_FR3 | | | | | | | | | | | | | | | |
| CONSENSUS | S | G | S | L | L | G | - | - | G | K | A | A | L | T | L | S | G | V | Q | P | E | D | E | A | E | Y |
| 21-225_74E5_LC | . | . | . | . | . | . | . | . | . | . | . | . | . | . | . | . | D | . | . | . | . | . | . | . | . | . |
| 21-225_78D10_LC | . | . | . | . | . | . | . | . | . | . | . | . | . | . | . | . | . | . | . | . | . | . | . | . | . | . |

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | L_CDR3 | | | | | | | | |
| CONSENSUS | Y | C | L | L | Y | Y | G | . | . | . | . | . | . | . | . | . | . | . | . | . | . | . | . | . | . | . |
| 21-225_74E5_LC | . | . | . | . | . | . | . | . | . | . | . | . | . | . | . | . | . | . | . | . | . | . | . | . | . | . |
| 21-225_78D10_LC | . | . | . | . | . | . | . | . | . | . | . | . | . | . | . | . | . | . | . | . | . | . | . | . | . | . |

FIGURE 57 (Continued)

Table 111. Consensus 31 - VK3jL2/JK2 (SEQ ID NO: 50328):

EIVMTQSPATLSVSPGERATLSCRAS--QSVN------SNLAWYQQKPGQAPRLLIYG--------ASTRATGIPARFSGSGSG--
TEFTLTISSLQSEDFAVYYCQQYND----------------WPCSFGQGTKLEIKR wherein:

A at position 25 can be substituted with S

Q at position 29 can be substituted with L, M or V

S at position 30 can be substituted with N, D, R or T

V at position 31 can be substituted with I

N at position 32 can be substituted with K, S, V, A, I or L

S at position 39 can be substituted with N or T

N at position 40 can be substituted with S or Y

G at position 58 can be substituted with I, F or V

A at position 67 can be substituted with T

T at position 69 can be substituted with I

Q at position 108 can be substituted with E

Y at position 109 can be substituted with F

N at position 110 can be substituted with Y or D

D at position 111 can be substituted with N

Null (-) at position 134 can be substituted with W

W at position 135 can be substituted with P

P at position 136 can be substituted with L or M

FIGURE 57 (Continued)

Arg Xaa Ser Xaa Xaa Xaa Xaa Xaa Xaa Leu Ala (SEQ ID NO: 50168)

Xaa Xaa Ser Xaa Arg Ala Thr (SEQ ID NO: 50169)

Gln Xaa Xaa Xaa Xaa Xaa Xaa Xaa Cys Ser (SEQ ID NO: 50170)

Arg Ala Ser Gln Ser Val Asn Ser Asn Leu Ala (SEQ ID NO: 50654)

Gly Ala Ser Thr Arg Ala Thr (SEQ ID NO: 50655)

Gln Gln Tyr Asn Asp Trp Pro Cys Ser (SEQ ID NO: 50656)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | Q | Q | Y | N | D | | | | | | | | | | | K_CDR3 | | | | | | | | |
| 21-225_162A10_LC | F | | | | | | | | | | | | | | | | | | | | | | | | | |
| 21-225_193G12_LC | | | | | F | Y | N | | | | | | | | | | | | | | | | | | | |
| 21-225_201A4_LC | | | | | F | Y | N | | | | | | | | | | | | | | | | | | | |
| 21-225_201F2_LC | | | | | F | Y | N | | | | | | | | | | | | | | | | | | | |
| 21-225_201F7_LC | | | | E | | | | | | | | | | | | | | | | | | | | | | |
| 21-225_201H4_LC | | | | | | Y | N | | | | | | | | | | | | | | | | | | | |
| 21-225_202A8_LC | | | | | | D | N | | | | | | | | | | | | | | | | | | | |
| 21-225_202F12_LC | | | | | F | Y | N | | | | | | | | | | | | | | | | | | | |
| 21-225_205G4_LC | | | | | | Y | N | | | | | | | | | | | | | | | | | | | |
| 21-225_210H10_LC | S | | | | | | | | | | | | | | | | | | | | | | | | | |
| 21-225_212C10_LC | S | | | | | | N | | | | | | | | | | | | | | | | | | | |
| 21-225_216B10_LC | | | | | | | | | | | | | | | | | | | | | | | | | | |
| 21-225_24H3_LC | | | | | | | | | | | | | | | | | | | | | | | | | | |
| 21-225_57H3_LC | | | | | | | | | | | | | | | | | | | | | | | | | | |
| 21-225_62E6_LC | | | | | | | | | | | | | | | | | | | | | | | | | | |
| 21-225_65A6_LC | | | | | | | | | | | | | | | | | | | | | | | | | | |
| 21-225_67C3_LC | | | | | | | | | | | | | | | | | | | | | | | | | | |
| 21-225_70A5_LC | | | | | | | | | | | | | | | | | | | | | | | | | | |
| 21-225_74C3_LC | | | | | | | | | | | | | | | | | | | | | | | | | | |
| 21-225_74E3_LC | | | | | | | | | | | | | | | | | | | | | | | | | | |
| 21-225_74E11_LC | | | | | | | | | | | | | | | | | | | | | | | | | | |
| 21-225_76D2_LC | | | | | | | | | | | | | | | | | | | | | | | | | | |
| 21-225_77H5_LC | F | | | | | | | | | | | | | | | | | | | | | | | | | |
| 21-225_92H5_LC | | | | E | | | | | | | | | | | | | | | | | | | | | | |
| 21-225_95G2_LC | | | | | | | | | | | | | | | | | | | | | | | | | | |

Table 112. Consensus 32 – VK3|A27/JK4 (SEQ ID NO: 50329):

EFMLTQSPGTLSLSPGERATLSCRAS--QSVSS-----SYLVWYQQKPGQAPRLLIYG------ASTRATGIPDRFSGSGSG--
TDFTLTISRLEPEYFAVYYCQQYGC-----------------------SPLTFGGGTKVEITR wherein:

A at position 25 can be substituted with S
Q at position 29 can be substituted with E
S at position 30 can be substituted with R
V at position 31 can be substituted with I
S at position 32 can be substituted with T
S at position 33 can be substituted with T
S at position 39 can be substituted with N
Y at position 40 can be substituted with A
V at position 42 can be substituted with S
T at position 69 can be substituted with S
T at position 72 can be substituted with S or I
G at position 110 can be substituted with V
C at position 111 can be substituted with N or S
P at position 136 can be substituted with L Arg Xaa Ser Xaa Xaa Xaa Xaa Xaa Xaa Leu Xaa (SEQ ID NO: 50171)

Gly Ala Ser Xaa Arg Ala Xaa (SEQ ID NO:

Gln Gln Tyr Xaa Xaa Ser Xaa Leu Thr (SEQ ID NO: 50173)

Arg Ala Ser Gln Ser Val Ser Ser Ser Tyr Leu Val (SEQ ID NO: 50657)

Gly Ala Ser Thr Arg Ala Thr (SEQ ID NO: 50658)

Gln Gln Tyr Gly Cys Ser Pro Leu Thr (SEQ ID NO: 50659)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | K_FR2 | | | |
| CONSENSUS | . | . | Q | S | V | S | S | . | . | . | . | . | S | Y | L | V | W | Y | Q | Q | K | P | G | Q | A | P |
| 21-225_211G3_LC | | | | | | | | | | | | | | | | A | | | | | | | | | | |
| 21-225_215C7_LC | | | | | | T | T | | | | | | N | F | | A | | | | | | | | | | |
| 21-225_215H12_LC | | | | | | T | T | | | | | | | F | | A | | | | | | | | | | |
| 21-225_74A5_LC | | | | | | | | | | | | | | | | | | | | | | | | | | |
| 21-225_74B6_LC | | | | | | | | | | | | | | | | A | | | | | | | | | | |
| 21-225_74G3_LC | | | | | | | | | | | | | | | | | | | | | | | | | | |
| 21-225_74G9_LC | | | | | | | | | | | | | | | | | | | | | | | | | | |
| 21-225_75B1_LC | | | | | | | | | | | | | | | | | | | | | | | | | | |
| 21-225_76A6_LC | | | | | | | | | | | | | | | | A | | | | | | | | | | |
| 21-225_76B9_LC | | | | | | | | | | | | | | | | | | | | | | | | | | |
| 21-225_76H1_LC | | | | | | | | | | | | | | | | | | | | | | | | | | |
| 21-225_77D11_LC | | | | | | | | | | | | | | | | | | | | | | | | | | |
| 21-225_80A2_LC | | | | | | | | | | | | | | | | A | | | | | | | | | | |
| 21-225_80C12_LC | | | | | | | | | | | | | | | | A | | | | | | | | | | |
| 21-225_82A6_LC | | | | | | | | | | | | | | | | A | | | | | | | | | | |
| 21-225_82C12_LC | | | | | | | | | | | | | | | | | | | | | | | | | | |
| 21-225_82D9_LC | | | E | | | | | | | | | | | | | | | | | | | | | | | |
| 21-225_82G5_LC | | | | | | | | | | | | | | | | | | | | | | | | | | |
| 21-225_83C2_LC | | | E | | | | | | | | | | | | | | | | | | | | | | | |
| 21-225_83C5_LC | | | | | | | | | | | | | | | | | | | | | | | | | | |
| 21-225_85B5_LC | | | | | | | | | | | | | | | | | | | | | | | | | | |
| 21-225_85D11_LC | | | | | | | | | | | | | | | | | | | | | | | | | | |
| 21-225_87A10_LC | | | | | | | | | | | | | | | | A | | | | | | | | | A | |
| 21-225_96G1_LC | | | | | | | | | | | | | | | | A | | | | | | | | | | |

FIGURE 57 (Continued)

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | K_FR3 | | | | | | | | | | | | | | | | |
| CONSENSUS | S | G | S | G | G | . | . | T | D | F | T | L | T | I | S | R | L | E | P | E | D | F | A | V | Y | 
| 21-225_211G3_LC | . | . | . | . | . | . | . | . | . | . | . | . | . | . | . | . | . | . | . | . | . | D | . | . | . | . |
| 21-225_215C7_LC | . | . | . | . | . | . | . | . | . | . | . | . | . | . | . | . | . | . | . | S | . | D | . | . | . | . |
| 21-225_215H12_LC | . | . | . | . | . | . | . | . | . | . | . | . | . | . | . | . | . | . | . | . | . | D | . | . | . | . |
| 21-225_216H12_LC | . | . | . | . | . | . | . | . | . | . | . | . | . | . | . | . | . | . | . | . | . | . | . | . | . | . |
| 21-225_74A5_LC | . | . | . | . | . | . | . | . | . | . | . | . | . | . | . | . | . | . | . | . | . | . | . | . | . | . |
| 21-225_74B6_LC | . | . | . | . | . | . | . | . | . | . | . | . | . | . | . | . | . | . | . | . | . | . | . | . | . | . |
| 21-225_74G3_LC | . | . | . | . | . | . | . | . | . | . | . | . | . | . | . | . | . | . | . | . | . | . | . | . | . | . |
| 21-225_74G9_LC | . | . | . | . | . | . | . | . | . | . | . | . | . | . | . | . | . | . | . | . | . | . | . | . | . | . |
| 21-225_75B1_LC | . | . | . | . | . | . | . | . | . | . | . | . | . | . | . | . | . | . | . | . | . | . | . | . | . | . |
| 21-225_76A6_LC | . | . | . | . | . | . | . | . | . | . | . | . | . | . | . | . | . | . | . | . | . | . | . | . | . | . |
| 21-225_76B9_LC | . | . | . | . | . | . | . | . | . | . | . | . | . | . | . | . | . | . | . | . | . | . | . | . | . | . |
| 21-225_76H1_LC | . | . | . | . | . | . | . | . | . | . | . | . | . | . | . | . | . | . | . | . | . | . | . | . | . | . |
| 21-225_77D11_LC | . | . | . | . | . | . | . | . | . | . | . | . | . | . | . | . | . | . | . | . | . | . | . | . | . | . |
| 21-225_80A2_LC | . | . | . | . | . | . | . | . | . | . | . | . | . | . | . | . | . | . | . | . | . | . | . | . | . | . |
| 21-225_80C12_LC | . | . | . | . | . | . | . | . | . | . | . | . | . | . | . | . | . | . | . | . | . | . | . | . | . | . |
| 21-225_82A6_LC | . | . | . | . | . | . | . | . | . | . | . | . | . | . | . | . | . | . | . | . | . | . | . | . | . | . |
| 21-225_82C12_LC | . | . | . | . | . | . | . | . | . | . | . | . | . | . | . | . | . | . | . | . | . | . | . | . | . | . |
| 21-225_82D9_LC | . | . | . | . | . | . | . | . | . | . | . | . | . | . | . | . | . | . | . | . | . | . | . | . | . | . |
| 21-225_82G5_LC | . | . | . | . | . | . | . | . | . | . | . | . | . | . | . | . | . | . | . | . | . | . | . | . | . | . |
| 21-225_83C2_LC | . | . | . | . | . | . | . | . | . | . | . | . | . | . | . | . | . | . | . | . | . | . | . | . | . | . |
| 21-225_83C5_LC | . | . | . | . | . | . | . | . | . | . | . | . | . | . | . | . | . | . | . | . | . | . | . | . | . | . |
| 21-225_85B5_LC | . | . | . | . | . | . | . | . | . | . | . | . | . | . | . | . | . | . | . | . | . | . | . | . | . | . |
| 21-225_85D11_LC | . | . | . | . | . | . | . | . | . | . | . | . | . | . | . | . | . | . | . | . | . | . | . | . | . | . |
| 21-225_87A10_LC | . | . | . | . | . | . | . | . | . | . | . | . | . | . | . | . | . | . | . | . | . | . | . | . | . | . |
| 21-225_96G1_LC | . | . | . | . | . | . | . | . | . | . | . | . | . | . | . | . | . | . | . | . | . | . | . | . | . | . |

Table 113.  Consensus 33 - VK2|A18/JK4 (SEQ ID NO: 50330):

DIVMTQTPLSLSVTPGQPASISCKSS-QSLLHSE-GKTYLYWYLQKPGQPPQLLIYE------VSNRFSGVPDRFSGSGSG-TDFTLKISRVEAEDVGVYYCMQSIQ------------LPLTFGGGTKVEIKR wherein:

S at position 30 can be substituted with T

L at position 32 can be substituted with Q

H at position 33 can be substituted with R

S at position 34 can be substituted with G

E at position 35 can be substituted with D

K at position 38 can be substituted with R

Y at position 40 can be substituted with H or F

Y at position 42 can be substituted with N

V at position 67 can be substituted with I

N at position 69 can be substituted with Y or H

F at position 71 can be substituted with L, V or L

M at position 107 can be substituted with F

Q at position 108 can be substituted with H

S at position 109 can be substituted with G or N

I at position 110 can be substituted with K or T

Q at position 111 can be substituted with null (-), K or H

FIGURE 57 (Continued)

L at position 135 can be substituted with Q, Y, F or H

P at position 136 can be substituted with L or V

L at position 137 can be substituted with F or P

T at position 138 can be substituted with P or S

Lys Ser Ser Gln Xaa Leu Xaa Xaa Xaa Gly Xaa Thr Xaa Leu Xaa (SEQ ID NO: 50174)

Glu Xaa Ser Xaa Arg Xaa Ser (SEQ ID NO: 50175)

Xaa Xaa Xaa Xaa Xaa Xaa Xaa Xaa Xaa (SEQ ID NO: 50176)

Lys Ser Ser Gln Ser Leu Leu His Ser Glu Gly Lys Thr Tyr Leu Tyr (SEQ ID NO: 50660)

Glu Val Ser Asn Arg Phe Ser (SEQ ID NO: 50661)

Met Gln Ser Ile Gln Leu Pro Leu Thr (SEQ ID NO: 50662)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | K_FR2 | | | | | | |
| CONSENSUS | - | Q | S | L | L | H | S | E | - | G | K | T | Y | L | Y | W | Y | L | Q | K | P | G | Q | P | P |
| 21-225_148F5_LC | . | . | . | . | . | . | . | . | . | . | . | . | . | . | . | . | . | . | . | . | . | . | . | . | . | . |
| 21-225_148H10_LC | . | . | . | . | . | . | . | . | . | . | . | . | . | . | . | . | . | . | . | . | . | . | . | . | . | . |
| 21-225_150D11_LC | . | . | . | . | . | . | . | . | . | . | . | . | . | X | . | . | . | . | . | . | . | . | . | X | . | . |
| 21-225_153G9_LC | . | . | . | . | . | . | . | D | . | . | . | . | . | . | . | . | . | . | . | . | . | . | . | . | . | . |
| 21-225_16F10_LC | . | . | . | . | . | . | . | D | . | . | . | . | N | . | . | . | . | . | . | . | . | . | . | . | . | . |
| 21-225_173C11_LC | . | . | . | . | . | . | . | . | . | . | . | . | . | . | . | . | . | . | . | . | . | . | . | . | . | . |
| 21-225_179C2_LC | . | . | . | . | . | . | . | . | . | . | . | . | . | . | . | . | . | . | . | . | . | . | . | . | . | . |
| 21-225_22H8_LC | . | . | . | T | . | . | G | . | . | . | . | . | . | . | . | . | . | . | . | . | . | . | . | . | . | . |
| 21-225_25A2_LC | . | . | . | . | . | . | . | D | . | . | . | . | . | X | . | . | . | . | . | . | . | . | . | . | . | . |
| 21-225_28G11_LC | . | . | . | . | . | . | . | . | . | . | . | . | . | . | . | . | . | . | . | . | . | . | . | . | . | . |
| 21-225_26G7_LC | . | . | . | . | . | . | . | D | . | . | . | . | . | . | . | . | . | . | . | . | . | . | . | . | . | . |
| 21-225_29H4_LC | . | . | . | . | . | . | . | D | . | . | . | . | . | . | . | . | . | . | . | . | . | . | . | . | . | . |
| 21-225_34D2_LC | . | . | . | . | . | . | . | . | . | . | . | X | . | . | . | . | . | . | . | . | . | . | . | . | . | . |
| 21-225_44B10_LC | . | . | . | . | . | . | G | . | . | . | . | . | . | . | . | . | . | . | V | . | . | . | . | . | . | . |
| 21-225_46B9_LC | . | . | . | . | . | . | . | . | . | . | . | . | . | . | . | . | . | . | V | . | . | . | . | . | . | . |
| 21-225_58H11_LC | . | . | . | . | . | Q | . | . | . | . | . | . | . | . | . | . | . | . | . | . | . | . | . | . | . | . |
| 21-225_59A12_LC | . | . | . | . | . | . | . | . | . | . | . | . | . | . | . | . | . | . | . | . | . | . | . | . | . | . |
| 21-225_60C12_LC | . | . | . | . | . | . | . | . | . | . | . | . | . | . | . | . | . | . | . | . | . | . | . | . | . | . |
| 21-225_60G2_LC | . | . | . | . | . | . | . | . | . | . | . | . | . | . | . | . | . | . | . | . | . | . | . | . | . | . |
| 21-225_61B3_LC | . | . | . | . | . | X | . | . | . | . | . | . | . | . | . | . | . | . | . | . | . | . | . | . | . | . |
| 21-225_71A6_LC | . | . | . | . | . | . | . | D | . | . | . | . | . | X | . | . | . | . | . | . | . | . | . | . | . | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | K_FR3 | | | | | | | | | | | | | | | |
| CONSENSUS | S | G | S | G | S | G | - | - | T | D | F | T | L | K | I | S | R | V | E | A | E | D | V | G | V | Y |
| 21-225_148F5_LC | . | . | . | . | . | . | . | . | . | . | . | . | . | . | . | . | . | . | . | . | . | . | . | . | . | . |
| 21-225_148H10_LC | . | . | . | . | . | . | . | . | . | . | . | . | . | . | . | . | . | . | . | . | Q | . | . | . | . | . |
| 21-225_150D11_LC | . | . | . | . | . | . | . | . | . | . | . | . | . | . | . | . | . | . | . | . | . | . | . | . | . | . |
| 21-225_153G9_LC | . | . | . | . | . | . | . | . | . | V | . | . | . | E | . | . | . | . | . | . | A | . | . | . | . | . |
| 21-225_16F10_LC | . | . | . | . | . | . | . | . | . | . | . | . | . | . | . | . | . | . | . | . | . | . | . | . | . | . |
| 21-225_173C11_LC | . | . | . | . | . | . | . | . | . | . | . | . | . | . | . | . | . | . | . | . | . | . | . | . | . | . |
| 21-225_179C2_LC | . | . | . | . | . | . | . | . | . | . | . | . | . | . | . | . | . | . | . | . | . | . | . | . | . | . |
| 21-225_22H8_LC | . | . | . | . | . | . | . | . | . | . | . | . | . | . | . | . | . | . | . | . | . | . | . | . | . | . |
| 21-225_25A2_LC | . | . | . | . | . | . | . | . | . | . | . | . | . | . | . | . | . | . | . | . | . | . | . | . | . | . |
| 21-225_28G11_LC | . | . | . | . | . | . | . | . | . | . | . | . | . | . | . | . | . | . | . | . | . | . | . | . | . | . |
| 21-225_26G7_LC | . | . | . | . | . | . | . | . | . | . | . | . | . | . | . | . | . | . | . | . | . | . | . | . | . | . |
| 21-225_29H4_LC | . | . | . | . | . | . | . | . | . | . | . | . | . | . | . | . | . | S | . | . | . | . | . | . | . | . |
| 21-225_34D2_LC | . | . | . | . | . | . | . | . | . | . | . | . | . | . | . | . | . | . | . | . | . | . | . | . | . | . |
| 21-225_44B10_LC | . | . | . | . | . | . | . | . | . | . | . | . | . | . | . | . | . | . | . | V | . | . | . | . | . | . |
| 21-225_46B9_LC | . | . | . | . | . | . | . | . | . | . | . | . | . | . | . | . | . | . | . | . | . | . | . | . | . | . |
| 21-225_58H11_LC | . | . | . | . | . | . | . | . | . | . | . | . | . | . | . | . | . | . | . | . | . | . | . | . | . | . |
| 21-225_59A12_LC | . | . | . | . | . | . | . | . | . | . | . | . | . | . | . | . | . | . | . | . | . | . | . | . | . | . |
| 21-225_60C12_LC | . | . | . | . | . | . | . | . | . | . | . | . | . | . | . | . | . | . | . | . | . | . | . | . | . | . |
| 21-225_60G2_LC | . | . | . | . | . | . | . | . | . | . | . | . | . | . | . | . | . | . | . | . | . | . | . | . | . | . |
| 21-225_61B3_LC | . | . | . | . | . | . | . | . | . | . | . | . | . | . | . | . | . | . | . | . | . | . | . | . | . | . |
| 21-225_71A6_LC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 (K_FR4) | 145 | 146 | 147 | 148 | 149 |
|---|---|---|---|---|---|---|---|---|---|---|---|---|---|---|---|---|---|---|---|
| CONSENSUS | - | - | - | - | L | P | L | T | F | G | G | G | T | K | V | E | I | K | R |
| 21-225_148F5_LC | . | . | . | . | . | . | . | . | . | . | . | . | . | . | . | . | . | . | . |
| 21-225_148H10_LC | . | . | . | . | . | . | . | . | . | . | . | . | . | . | . | . | . | . | . |
| 21-225_150D11_LC | . | . | . | . | . | . | . | . | . | . | . | . | . | . | . | . | . | . | . |
| 21-225_153G9_LC | . | . | . | . | Y | . | . | . | . | . | . | . | . | . | . | . | . | . | . |
| 21-225_16F10_LC | . | . | . | . | Q | F | . | . | . | . | . | . | . | . | . | . | . | . | . |
| 21-225_173C11_LC | . | . | . | . | Q | V | . | . | . | . | . | . | . | . | . | . | . | . | . |
| 21-225_179C2_LC | . | . | . | . | F | . | . | . | . | . | . | . | . | . | . | . | . | N | . |
| 21-225_22H8_LC | . | . | . | . | . | . | . | . | . | . | . | . | . | . | . | . | . | . | . |
| 21-225_25A2_LC | . | . | . | . | . | . | R | P | . | . | . | . | . | . | . | . | . | . | . |
| 21-225_26G11_LC | . | . | . | . | . | . | R | P | . | . | . | . | . | E | . | . | . | R | . |
| 21-225_26G7_LC | . | . | . | . | . | L | . | . | . | . | . | . | . | . | . | . | . | . | . |
| 21-225_29H4_LC | . | . | . | . | Q | . | . | . | . | . | . | . | . | . | . | . | . | . | . |
| 21-225_34D2_LC | . | . | . | . | Y | . | . | . | . | . | . | . | . | . | . | . | . | . | . |
| 21-225_44B10_LC | . | . | . | . | . | . | . | . | . | . | . | . | . | . | . | . | . | Q | . |
| 21-225_46B9_LC | . | . | . | . | Y | . | . | . | . | . | . | . | . | . | . | . | . | . | . |
| 21-225_58H11_LC | . | . | . | . | . | . | . | . | . | . | . | . | . | . | . | . | . | . | . |
| 21-225_59A12_LC | . | . | . | . | . | . | . | . | . | . | . | . | . | . | . | . | . | . | . |
| 21-225_60C12_LC | . | . | . | . | . | . | . | . | . | . | . | . | . | . | . | . | . | . | . |
| 21-225_60G2_LC | . | . | . | . | . | . | . | . | . | . | . | . | . | . | . | . | . | . | . |
| 21-225_61B3_LC | . | . | . | . | . | . | . | . | . | . | . | . | . | . | . | . | L | . | . |
| 21-225_71A6_LC | . | . | . | . | . | . | . | . | . | . | . | . | . | . | . | . | . | . | . |

FIGURE 57 (Continued)

Table 114. Consensus 34 - VL2j2a2/JL3b (SEQ ID NO: 50331):

QSALTQP-ASVSGSPGQSITISCTGTS-SDVGGY-----NYVSWYQQHPGK-APKLMIYE--------VSNRPSGVSNRFSGSKSG--NTASLTISGLQAEDEADYYCNSYTR----------------SITWVFGGGTKLTVLG wherein:

V at position 31 can be substituted with I

G at position 33 can be substituted with S

Y at position 40 can be substituted with F

S at position 68 can be substituted with R

N at position 107 can be substituted with G, C or S

T at position 110 can be substituted with V or K

R at position 111 can be substituted with S or K

S at position 134 can be substituted with G, N or R

I at position 135 can be substituted with S or Y

Thr Gly Thr Ser Ser Asp Xaa Gly Xaa Tyr Asn Xaa Val Ser (SEQ ID NO: 50177)

Glu Val Xaa Asn Arg Pro Ser (SEQ ID NO: 50178)

Xaa Ser Tyr Xaa Xaa Xaa Xaa Thr Trp Val (SEQ ID NO: 50179)

Thr Gly Thr Ser Ser Asp Val Gly Gly Tyr Asn Tyr Val Ser (SEQ ID NO: 50663)

Glu Val Ser Asn Arg Pro Ser (SEQ ID NO: 50664)

Asn Ser Tyr Thr Arg Ser Ile Thr Trp Val (SEQ ID NO: 50665)

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | L_CDR1 | | | | | | | | | | | L_FR2 | | | | | | | | | |
| CONSENSUS | S | - | S | D | V | G | G | Y | - | - | - | N | Y | V | S | W | Y | Q | Q | H | P | G | K | A | P |
| 21-225_178H8_LC | . | . | . | . | . | . | . | . | . | . | . | . | . | . | . | . | . | . | . | . | . | . | . | . | . | . |
| 21-225_210D12_LC | . | . | . | . | . | . | . | . | . | . | . | . | . | . | . | . | . | . | . | . | . | . | . | . | . | . |
| 21-225_210E12_LC | . | . | . | . | . | . | . | . | . | . | . | . | . | . | . | . | . | . | . | . | Y | . | Y | . | . | . |
| 21-225_211C1_LC | . | . | . | . | . | . | . | . | . | . | . | . | . | . | . | . | . | . | . | . | . | . | . | . | . | . |
| 21-225_211G5_LC | . | . | . | . | . | . | . | . | . | . | . | . | . | . | . | . | . | . | . | . | . | . | . | . | . | . |
| 21-225_212A4_LC | . | . | . | . | . | . | . | . | . | . | . | . | . | . | . | . | . | . | . | . | . | . | . | . | . | . |
| 21-225_212C2_LC | . | . | . | . | . | . | S | . | . | . | . | . | . | . | . | . | . | . | . | . | . | . | . | . | . | . |
| 21-225_212F6_LC | . | . | . | . | . | . | . | . | . | . | . | . | . | . | . | . | . | . | . | . | . | . | . | . | . | . |
| 21-225_212G7_LC | . | . | . | . | . | . | . | . | . | . | . | . | . | . | . | . | . | . | . | . | . | . | . | . | . | . |
| 21-225_213D5_LC | . | . | . | . | . | . | . | . | . | . | . | . | . | . | . | . | . | . | . | . | . | . | . | . | . | . |
| 21-225_213G3_LC | . | . | . | . | . | . | . | . | . | . | . | . | . | . | . | . | . | . | . | . | . | . | . | . | . | . |
| 21-225_216D3_LC | . | . | . | . | . | . | . | . | . | . | . | . | . | . | . | . | . | . | . | . | Y | . | . | . | . | . |
| 21-225_216A3_LC | . | . | . | . | . | . | . | . | . | . | . | . | . | . | . | . | . | . | . | . | . | . | . | . | . | . |
| 21-225_217B2_LC | . | . | . | . | . | . | . | . | . | . | . | . | . | . | . | . | . | . | . | . | . | . | . | . | . | . |
| 21-225_219A7_LC | . | . | . | . | . | . | . | . | . | . | . | . | . | . | . | . | . | . | . | . | . | . | . | . | . | . |
| 21-225_221G4_LC | . | . | . | . | . | . | . | . | . | . | . | . | . | . | . | . | . | . | . | . | . | . | . | . | . | . |
| 21-225_221H2_LC | . | . | . | . | . | . | . | . | . | . | . | . | . | . | . | . | . | . | . | . | . | . | . | . | . | . |
| 21-225_S2H4_LC | . | . | . | . | . | . | . | . | . | . | . | . | . | . | . | . | . | . | . | . | . | . | . | . | T | . |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | | LFR3 | | | | | | | | | | | | | | | |
| CONSENSUS | S | G | S | K | S | G | - | - | N | T | A | S | L | T | I | S | G | L | Q | A | E | D | E | A | D | Y |
| 21-225_178H8_LC | . | . | . | . | . | . | . | . | . | . | . | . | . | . | . | . | . | . | . | . | . | . | . | . | . | . |
| 21-225_210D12_LC | . | . | . | . | . | . | . | . | . | . | . | . | . | . | . | . | . | . | . | . | . | . | . | . | . | . |
| 21-225_210E12_LC | . | . | . | . | . | . | . | . | . | . | . | . | . | . | . | . | . | . | . | . | . | . | . | . | . | . |
| 21-225_211C1_LC | . | . | . | . | . | . | . | . | . | . | . | . | . | . | . | . | . | . | . | . | . | . | . | . | . | . |
| 21-225_211G5_LC | . | . | . | . | . | . | . | . | . | . | . | . | . | . | . | . | . | . | . | . | . | . | . | . | . | . |
| 21-225_212A4_LC | . | . | . | . | . | . | . | . | . | . | . | . | . | . | . | . | . | . | . | . | . | . | . | . | . | . |
| 21-225_212C2_LC | . | . | . | . | . | . | . | . | . | . | . | . | . | . | . | . | . | . | . | . | . | . | . | . | . | . |
| 21-225_212F6_LC | . | . | . | . | . | . | . | . | . | . | . | . | . | . | . | . | . | . | . | . | . | . | . | . | . | . |
| 21-225_212G7_LC | . | . | . | . | . | . | . | . | . | . | . | . | . | . | . | . | . | . | . | . | . | . | . | . | . | . |
| 21-225_213D5_LC | . | . | . | . | . | . | . | . | . | X | . | . | . | . | . | . | . | . | . | . | . | . | . | . | . | . |
| 21-225_213G3_LC | . | . | . | . | . | . | . | . | . | . | . | . | . | . | . | . | . | . | . | . | . | . | . | . | . | . |
| 21-225_215D3_LC | . | . | . | . | . | . | . | . | . | . | . | . | . | . | . | . | . | . | . | . | . | . | . | . | . | . |
| 21-225_216A3_LC | . | . | . | . | . | . | . | . | . | . | . | . | . | . | . | . | . | . | . | . | . | . | . | . | . | . |
| 21-225_217B2_LC | . | . | . | . | . | . | . | . | . | . | . | . | . | . | . | . | . | . | . | . | . | . | . | . | . | . |
| 21-225_219A7_LC | . | . | . | . | . | . | . | . | . | . | . | . | . | . | . | . | . | . | . | . | . | . | . | . | . | . |
| 21-225_221G4_LC | . | . | . | . | . | . | . | . | . | . | . | . | . | . | . | . | . | . | . | . | . | . | . | . | . | . |
| 21-225_221H2_LC | . | . | . | . | . | . | . | . | . | . | . | . | . | . | . | . | . | . | . | . | . | . | . | . | . | . |
| 21-225_52H4_LC | . | . | . | . | . | . | . | . | . | . | . | . | . | . | . | . | . | . | . | . | . | . | . | . | . | . |

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| CONSENSUS | Y | C | N | S | Y | T | R | . | . | . | . | . | . | . | . | . | . | L_CDR3 | . | . | . | . | . | . | . | . |
| 21-225_178H8_LC | . | . | S | . | . | . | S | . | . | . | . | . | . | . | . | . | . | . | . | . | . | . | . | . | . | . |
| 21-225_210D12_LC | . | . | . | . | . | . | S | . | . | . | . | . | . | . | . | . | . | . | . | . | . | . | . | . | . | . |
| 21-225_210E12_LC | . | . | G | . | . | W | . | . | . | . | . | . | . | . | . | . | . | . | . | . | . | . | . | . | . | . |
| 21-225_211C1_LC | . | . | . | . | . | . | S | . | . | . | . | . | . | . | . | . | . | . | . | . | . | . | . | . | . | . |
| 21-225_211G5_LC | . | . | G | . | . | W | . | . | . | . | . | . | . | . | . | . | . | . | . | . | . | . | . | . | . | . |
| 21-225_212A4_LC | . | . | S | . | . | . | S | . | . | . | . | . | . | . | . | . | . | . | . | . | . | . | . | . | . | . |
| 21-225_212C2_LC | . | . | . | . | . | . | S | . | . | . | . | . | . | . | . | . | . | . | . | . | . | . | . | . | . | . |
| 21-225_212F6_LC | . | . | G | . | . | . | . | . | . | . | . | . | . | . | . | . | . | . | . | . | . | . | . | . | . | . |
| 21-225_212G7_LC | . | . | . | . | . | . | . | . | . | . | . | . | . | . | . | . | . | . | . | . | . | . | . | . | . | . |
| 21-225_213D5_LC | . | . | . | . | . | . | . | . | . | . | . | . | . | . | . | . | . | . | . | . | . | . | . | . | . | . |
| 21-225_213G3_LC | . | . | . | . | . | K | S | . | . | . | . | . | . | . | . | . | . | . | . | . | . | . | . | . | . | . |
| 21-225_215D3_LC | . | . | G | . | . | W | . | . | . | . | . | . | . | . | . | . | . | . | . | . | . | . | . | . | . | . |
| 21-225_216A3_LC | . | . | G | . | . | . | . | . | . | . | . | . | . | . | . | . | . | . | . | . | . | . | . | . | . | . |
| 21-225_217B2_LC | . | . | . | . | . | . | . | . | . | . | . | . | . | . | . | . | . | . | . | . | . | . | . | . | . | . |
| 21-225_219A7_LC | . | . | . | . | . | . | . | . | . | . | . | . | . | . | . | . | . | . | . | . | . | . | . | . | . | . |
| 21-225_221G4_LC | . | . | . | . | . | . | S | . | . | . | . | . | . | . | . | . | . | . | . | . | . | . | . | . | . | . |
| 21-225_221H2_LC | . | . | . | . | . | . | . | . | . | . | . | . | . | . | . | . | . | . | . | . | . | . | . | . | . | . |
| 21-225_52H4_LC | . | . | . | . | . | . | S | . | . | . | . | . | . | . | . | . | . | . | . | . | . | . | . | . | . | . |

Table 115. Consensus 35 - VK1iO12/JK1 (SEQ ID NO: 50332):

DIQMTQSPSSLSASVGDRVTITCRAS--QSIS-----NYLNWYQQKPGKAPKLLIYA-------ASSLQSGVPSRFSGSGSG--
TDFTLTISSLQPEDFATYYCQQSYS---------------TPTWTFGQGTKVEIKR wherein:

A at position 25 can be substituted with S

Q at position 29 can be substituted with H or R

S at position 30 can be substituted with N, T or H

S at position 32 can be substituted with N, G or T

N at position 39 can be substituted with S or R

Y at position 40 can be substituted with F

A at position 58 can be substituted with T, S or V

A at position 67 can be substituted with T, E or V

S at position 68 can be substituted with L

S at position 69 can be substituted with N

Q at position 71 can be substituted with H

S at position 72 can be substituted with I

S at position 109 can be substituted with G or T

S at position 111 can be substituted with T, N or R

T at position 134 can be substituted with S or null (-)

P at position 135 can be substituted with I

T at position 136 can be substituted with P, Q or L

FIGURE 57 (Continued)

Arg Xaa Ser Xaa Xaa Ile Xaa Xaa Xaa Xaa Leu Asn (SEQ ID NO: 50180)

Xaa Xaa Xaa Xaa Leu Xaa Xaa (SEQ ID NO: 50181)

Gln Gln Xaa Tyr Xaa Xaa Xaa Xaa Xaa Trp Thr (SEQ ID NO: 50182)

Arg Ala Ser Gln Ser Ile Ser Asn Tyr Leu Asn (SEQ ID NO: 50666)

Ala Ala Ser Ser Leu Gln Ser (SEQ ID NO: 50667)

Gln Gln Ser Tyr Ser Thr Pro Thr Trp Thr (SEQ ID NO: 50668)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | S | Y | S | | | | | | | | | | | | | | | | | | | |
| 21-225_157F3_LC | . | . | . | . | . | . | N | . | . | . | . | . | . | . | . | . | . | . | . | . | . | . | . | . | . | . |
| 21-225_173E7_LC | F | . | . | . | . | . | K | . | . | . | . | . | . | . | . | . | . | . | . | . | . | . | . | . | . | . |
| 21-225_175G10_LC | F | . | . | . | . | . | K | . | . | . | . | . | . | . | . | . | . | . | . | . | . | . | . | . | . | . |
| 21-225_17A1_LC | . | . | . | . | . | . | T | . | . | . | . | . | . | . | . | . | . | . | . | . | . | . | . | . | . | . |
| 21-225_17B10_LC | . | . | . | . | . | . | N | . | . | . | . | . | . | . | . | . | . | . | . | . | . | . | . | . | . | . |
| 21-225_17B12_LC | . | . | . | . | G | . | T | . | . | . | . | . | . | . | . | . | . | . | . | . | . | . | . | . | . | . |
| 21-225_181G3_LC | . | . | . | . | T | . | . | . | . | . | . | . | . | . | . | . | . | . | . | . | . | . | . | . | . | . |
| 21-225_183A12_LC | . | . | . | . | . | . | . | . | . | . | . | . | . | . | . | . | . | . | . | . | . | . | . | . | . | . |
| 21-225_192G10_LC | S | . | . | . | . | . | . | . | . | . | . | . | . | . | . | . | . | . | . | . | . | . | . | . | . | . |
| 21-225_200G1_LC | S | . | . | . | . | . | T | . | . | . | . | . | . | . | . | . | . | . | . | . | . | . | . | . | . | . |
| 21-225_20C10_LC | . | . | . | . | . | . | N | . | . | . | . | . | . | . | . | . | . | . | . | . | . | . | . | . | . | . |
| 21-225_20F8_LC | . | . | . | . | . | . | . | . | . | . | . | . | . | . | . | . | . | . | . | . | . | . | . | . | . | . |
| 21-225_23H4_LC | . | . | . | . | . | . | T | . | . | . | . | . | . | . | . | . | . | . | . | . | . | . | . | . | . | . |
| 21-225_26A10_LC | . | . | . | . | . | . | N | . | . | . | . | . | . | . | . | . | . | . | . | . | . | . | . | . | . | . |
| 21-226_54B1_LC | . | . | . | . | . | . | . | . | . | . | . | . | . | . | . | . | . | . | . | . | . | . | . | . | . | . |
| 21-226_58F1_LC | . | . | . | . | . | . | E | . | . | . | . | . | . | . | . | . | . | . | . | . | . | . | . | . | . | . |
| 21-225_7G12_LC | . | . | . | . | . | . | T | . | . | . | . | . | . | . | . | . | . | . | . | . | . | . | . | . | . | . |

Table 116. Consensus 36 - VK1iL5/JK4 (SEQ ID NO: 50333):

DIQMTQSPSSVSASVGDRVTITCRAS--QGIS------SWLAWYQQKPGKAPKLLIYA------ASSLQSGVPSRFSGSGSG--
TDFTLTISSLQPEDFATYYCQQINS...............FPLTFGGGTKVEIKR wherein:

G at position 30 can be substituted with D

S at position 39 can be substituted with N, I or K

W at position 40 can be substituted with Y

S at position 72 can be substituted with G

I at position 109 can be substituted with T, V, A or G

N at position 110 can be substituted with K

Arg Ala Ser Gln Xaa Ile Ser Xaa Xaa Leu Ala (SEQ ID NO: 50183)

Ala Ala Ser Leu Gln Xaa (SEQ ID NO: 50184)

Gln Gln Xaa Xaa Ser Phe Pro Leu Thr (SEQ ID NO: 50185)

Arg Ala Ser Gln Gly Ile Ser Ser Trp Leu Ala (SEQ ID NO: 50669)

Ala Ala Ser Leu Gln Ser (SEQ ID NO: 50670)

Gln Gln Ile Asn Ser Phe Pro Leu Thr (SEQ ID NO: 50671)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | | N | S | | | | | | | | | | | | | | | | | | | |
| 21-225_154E8_LC | . | . | . | . | Q | . | . | . | . | . | . | . | . | . | . | . | . | . | . | . | . | . | . | . | . | . |
| 21-225_62G7_LC | . | . | . | . | T | . | . | . | . | . | . | . | . | . | . | . | . | . | . | . | . | . | . | . | . | . |
| 21-225_63C9_LC | F | . | . | . | - | . | . | . | . | . | . | . | . | . | . | . | . | . | . | . | . | . | . | . | . | . |
| 21-225_63E1_LC | . | . | . | . | A | . | . | . | . | . | . | . | . | . | . | . | . | . | . | . | . | . | . | . | . | . |
| 21-225_64H10_LC | . | . | . | . | - | . | . | . | . | . | . | . | . | . | . | . | . | . | . | . | . | . | . | . | . | . |
| 21-225_65G3_LC | . | . | . | . | V | . | . | . | . | . | . | . | . | . | . | . | . | . | . | . | . | . | . | . | . | . |
| 21-225_66A7_LC | . | . | . | . | - | . | . | . | . | . | . | . | . | . | . | . | . | . | . | . | . | . | . | . | . | . |
| 21-225_66B1_LC | . | . | . | . | T | . | . | . | . | . | . | . | . | . | . | . | . | . | . | . | . | . | . | . | . | . |
| 21-225_67H4_LC | . | . | . | . | - | . | . | . | . | . | . | . | . | . | . | . | . | . | . | . | . | . | . | . | . | . |
| 21-225_70A12_LC | . | . | . | . | - | . | . | . | . | . | . | . | . | . | . | . | . | . | . | . | . | . | . | . | . | . |
| 21-225_70D6_LC | . | . | . | . | T | . | . | . | . | . | . | . | . | . | . | . | . | . | . | . | . | . | . | . | . | . |
| 21-225_70G9_LC | . | . | . | . | T | . | . | . | . | . | . | . | . | . | . | . | . | . | . | . | . | . | . | . | . | . |
| 21-225_71A7_LC | . | . | . | . | V | . | . | . | . | . | . | . | . | . | . | . | . | . | . | . | . | . | . | . | . | . |
| 21-225_71B7_LC | . | . | . | . | T | . | . | . | . | . | . | . | . | . | . | . | . | . | . | . | . | . | . | . | . | . |
| 21-225_73A3_LC | . | . | . | . | V | . | . | . | . | . | . | . | . | . | . | . | . | . | . | . | . | . | . | . | . | . |
| 21-225_75C10_LC | . | . | . | . | A | X | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K FR4 | | | | | |
| CONSENSUS | - | - | - | - | F | P | L | T | F | G | G | G | T | K | V | E | I | K | R |
| 21-225_154E9_LC | . | . | . | . | . | . | . | . | . | . | . | . | . | . | . | D | . | . | . |
| 21-225_62G7_LC | . | . | . | . | . | . | . | . | . | . | . | . | . | . | . | A | . | . | . |
| 21-225_63C9_LC | . | . | . | . | . | . | . | . | . | . | . | . | . | . | . | . | . | . | . |
| 21-225_63E1_LC | . | . | . | . | . | . | . | . | . | . | . | . | . | . | . | . | . | . | . |
| 21-225_64H10_LC | . | . | . | . | . | . | . | . | . | . | . | . | . | . | . | . | . | . | . |
| 21-225_65G3_LC | . | . | . | . | . | . | . | . | . | . | . | . | . | . | . | . | . | . | . |
| 21-225_66A7_LC | . | . | . | . | . | . | . | . | . | . | . | . | . | . | . | . | . | . | . |
| 21-225_66B1_LC | . | . | . | . | . | . | . | . | . | . | . | . | . | . | . | . | . | . | . |
| 21-225_67H4_LC | . | . | . | . | . | . | . | . | . | . | . | . | . | . | . | . | . | . | . |
| 21-225_70A12_LC | . | . | . | . | . | . | . | . | . | . | . | . | . | . | . | . | . | . | . |
| 21-225_70D6_LC | . | . | . | . | . | . | . | . | . | . | . | . | . | . | . | . | . | . | . |
| 21-225_70G9_LC | . | . | . | . | . | . | . | . | . | . | . | . | . | . | . | . | . | . | . |
| 21-225_71A7_LC | . | . | . | . | . | . | . | . | . | . | . | . | . | . | . | . | L | . | . |
| 21-225_71B7_LC | . | . | . | . | . | . | . | . | . | . | . | . | . | . | . | . | . | . | . |
| 21-225_73A3_LC | . | . | . | . | . | . | . | . | . | . | . | . | . | . | . | . | . | . | . |
| 21-225_75C10_LC | . | . | . | . | . | . | . | . | . | . | . | . | . | . | . | . | . | . | . |

FIGURE 57 (Continued)

Table 117. Consensus 37 - VK1jO18/JK5 (SEQ ID NO: 50334):

DIQMTQSPSSLSASVGDRVTITCQAS--QDIN------NYLNWYQQKPGKAPKLLIYD--------ASNLETGVPSRFSGSGSG--
TDFTFTISSLQPEDIATYYCQQYDN--------------LPITFGQGTRLEIKR wherein:

S at position 26 can be substituted with N

D at position 30 can be substituted with Y

N at position 32 can be substituted with S, T, F or Y

N at position 39 can be substituted with D

Y at position 40 can be substituted with F

A at position 67 can be substituted with G

N at position 69 can be substituted with T, D or S

Y at position 109 can be substituted with F

D at position 110 can be substituted with E

N at position 111 can be substituted with null (-) or I

L at position 135 can be substituted with N or V

P at position 136 can be substituted with L

Gln Ala Xaa Gln Xaa Ile Xaa Xaa Xaa Leu Asn (SEQ ID NO: 50186)

Asp Xaa Ser Xaa Leu Glu Thr (SEQ ID NO: 50187)

Gln Gln Xaa Xaa Xaa Xaa Xaa Ile Thr (SEQ ID NO: 50188)

Gln Ala Ser Gln Asp Ile Asn Asn Tyr Leu Asn (SEQ ID NO: 50672)

Asp Ala Ser Asn Leu Glu Thr (SEQ ID NO: 50673)

FIGURE 57 (Continued)

Gln Gln Tyr Asp Asn Leu Pro Ile Thr (SEQ ID NO: 50674)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | | K_FR1 | | | | | | | | | | | | | | |
| CONSENSUS | D | I | Q | M | T | Q | S | P | S | S | L | S | A | S | V | G | D | R | V | T | I | T | C | Q | A | S |
| 21-225_11A2_LC | . | . | . | . | . | . | . | . | . | . | . | . | . | . | . | . | . | . | . | . | . | . | . | . | . | . |
| 21-225_13A1_LC | . | . | . | . | . | . | . | . | . | . | . | . | . | . | . | . | . | . | . | . | . | . | . | . | . | . |
| 21-225_15C4_LC | . | . | . | . | . | . | . | . | . | . | . | . | . | . | . | . | . | . | . | . | . | . | . | . | . | N |
| 21-225_15C2_LC | . | . | . | . | . | . | . | . | . | . | . | . | . | . | . | . | . | . | . | . | . | . | . | . | . | . |
| 21-225_15F10_LC | . | . | . | . | . | . | . | . | . | . | . | . | . | . | . | . | . | . | . | . | . | . | . | . | . | N |
| 21-225_16IG4_LC | . | . | . | . | . | . | . | . | . | . | . | . | . | . | . | . | . | . | . | . | . | . | . | . | . | . |
| 21-225_16B3_LC | . | . | . | . | . | . | . | . | . | . | . | . | . | . | . | . | . | . | . | . | . | . | . | . | . | . |
| 21-225_16F6_LC | . | . | . | . | . | . | . | . | . | . | . | . | . | . | . | . | . | . | . | . | . | . | . | . | . | . |
| 21-225_1B12_LC | . | . | . | . | . | . | . | . | . | . | . | . | . | . | . | . | . | . | . | . | . | . | . | . | . | . |
| 21-225_225B11_LC | . | . | . | . | . | . | . | . | . | . | . | . | . | . | . | . | . | . | . | . | . | . | . | . | . | . |
| 21-225_24D6_LC | . | . | . | . | . | . | . | . | . | . | . | . | . | . | . | . | . | . | . | . | . | . | . | . | . | . |
| 21-225_30E2_LC | . | . | . | . | . | . | . | . | T | . | . | . | . | . | . | . | . | . | . | . | . | . | . | . | . | . |
| 21-225_36E3_LC | . | . | . | . | . | . | . | . | . | . | . | . | . | . | . | . | . | . | . | . | . | . | . | . | . | . |
| 21-225_50G4_LC | . | . | . | . | . | . | . | . | . | . | . | . | . | . | . | . | . | . | . | . | . | . | . | . | . | . |
| 21-225_5E6_LC | . | . | . | . | . | . | . | . | . | . | . | . | . | . | . | . | . | . | . | . | . | . | . | . | . | . |
| 21-225_6G7_LC | . | . | . | . | . | . | . | . | . | . | . | . | . | . | . | . | . | . | . | . | . | . | . | . | . | . |

Table 118. Consensus 38 - VL1|1b/JL2 (SEQ ID NO: 50335):

QSVLTQP-PSVSAAPGQKVTISCSGSS-SNIGN------NYVSWYQQLPGTAPKLLIYD------NNKRPSGIPDRFSGSKSG-TSATLGITGLQTGDEADYYCGTWDSS------------LSVGVFGGGTKLTVLG wherein:

I at position 31 can be substituted with L

N at position 33 can be substituted with S

N at position 39 can be substituted with H or K

Y at position 40 can be substituted with F

V at position 41 can be substituted with L

N at position 67 can be substituted with S

N at position 68 can be substituted with Y or S

T at position 108 can be substituted with A or I

S at position 111 can be substituted with G, I or R

S at position 112 can be substituted with R

S at position 135 can be substituted with N

V at position 136 can be substituted with A or T

G at position 137 can be substituted with V or M

Ser Gly Ser Ser Asn Xaa Gly Xaa Xaa Xaa Xaa Ser (SEQ ID NO: 50189)

Asp Xaa Xaa Lys Arg Pro Ser (SEQ ID NO: 50190)

Gly Xaa Trp Asp Xaa Xaa Leu Xaa Xaa Xaa Val (SEQ ID NO: 50191)

Ser Gly Ser Ser Asn Ile Gly Asn Asn Tyr Val Ser (SEQ ID NO: 50675)

FIGURE 57 (Continued)

Asp Asn Asn Lys Arg Pro Ser (SEQ ID NO: 50676)

Gly Thr Trp Asp Ser Ser Leu Ser Val Gly Val (SEQ ID NO: 50677)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | Q | S | V | L | T | Q | P | - | P | S | V | S | A | A | P | G | Q | K | V | T | I | S | C | S | G | S |
| 21-225_190B10_LC | . | . | . | . | . | . | . | . | . | . | . | . | . | . | . | . | . | . | . | . | . | . | . | . | . | . |
| 21-225_190C3_LC | . | . | . | . | . | . | . | . | . | . | . | . | . | . | . | . | . | . | . | . | . | . | . | . | . | . |
| 21-225_190D10_LC | . | . | . | . | . | . | . | . | . | . | . | . | . | . | . | . | . | . | . | . | . | . | . | . | . | . |
| 21-225_190D8_LC | . | . | . | . | . | . | . | . | . | . | . | . | . | . | . | . | . | . | . | . | . | . | . | . | . | . |
| 21-225_190H7_LC | . | . | . | . | . | . | . | . | . | . | . | . | . | . | . | . | . | . | . | . | . | . | . | . | . | . |
| 21-225_191A1_LC | . | . | . | . | . | . | . | . | . | . | . | . | . | . | . | . | . | . | . | . | . | . | . | . | . | . |
| 21-225_192G2_LC | . | . | . | . | . | . | . | . | . | . | . | . | . | . | . | . | . | . | . | . | . | . | . | . | . | . |
| 21-225_194F11_LC | . | . | . | . | . | . | . | . | . | . | . | . | . | . | . | . | . | . | . | . | . | . | . | . | . | . |
| 21-225_194G12_LC | . | . | . | . | . | . | . | . | . | . | . | . | . | . | . | . | . | . | . | . | . | . | . | . | . | . |
| 21-225_197E8_LC | . | . | . | . | . | . | . | . | . | . | . | . | . | . | . | . | . | . | . | . | . | . | . | . | . | . |
| 21-225_198D2_LC | . | . | . | . | . | . | . | . | . | . | . | . | . | . | . | . | . | . | . | . | . | . | . | . | . | . |
| 21-225_200G8_LC | . | . | . | . | . | . | . | . | . | . | . | . | . | . | . | . | . | . | . | . | . | . | . | . | . | . |
| 21-225_209A8_LC | . | . | . | . | . | . | . | . | . | . | . | . | . | . | . | . | . | . | . | . | . | . | . | . | . | . |
| 21-225_214D8_LC | . | . | . | . | . | . | . | . | . | . | . | . | . | . | . | . | . | . | . | . | . | . | . | . | . | . |
| 21-225_218G4_LC | . | . | . | . | . | . | . | . | . | . | . | . | . | . | . | . | . | . | . | . | . | . | . | . | . | . |
| 21-225_58C5_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | L_FR4 | | | | | | | | | | | | | | | |
| CONSENSUS | . | . | . | L | S | V | G | V | F | G | G | G | T | K | L | T | V | L | G |
| 21-225_190B10_LC | . | . | . | . | . | A | . | . | . | . | . | . | . | . | . | . | . | . | . |
| 21-225_190C3_LC | . | . | . | . | N | T | V | . | . | . | . | . | . | . | . | . | . | . | . |
| 21-225_190D10_LC | . | . | . | . | . | T | . | . | . | . | . | . | . | . | . | . | . | . | . |
| 21-225_190D8_LC | . | . | . | . | N | T | V | . | . | . | . | . | . | . | . | . | . | . | . |
| 21-225_190H7_LC | . | . | . | . | N | T | . | . | . | . | . | . | . | . | . | . | . | . | . |
| 21-225_191A1_LC | . | . | . | . | N | A | . | . | . | . | . | . | . | . | . | . | . | . | . |
| 21-225_192G2_LC | . | . | . | . | . | A | . | . | . | . | . | . | . | . | . | . | . | . | . |
| 21-225_194F11_LC | . | . | . | . | . | . | . | . | . | . | . | . | . | . | . | . | . | . | . |
| 21-225_194G12_LC | . | . | . | . | N | T | M | . | . | . | . | . | . | . | . | . | . | . | . |
| 21-225_197E8_LC | . | . | . | . | N | A | . | . | . | . | . | . | . | . | . | . | . | . | . |
| 21-225_198D2_LC | . | . | . | . | . | . | . | . | . | . | . | . | . | . | . | . | . | . | . |
| 21-225_200G8_LC | . | . | . | . | . | T | V | . | . | . | . | . | . | . | . | . | . | . | . |
| 21-225_209A8_LC | . | . | . | . | . | A | V | . | . | . | . | . | S | . | . | . | . | . | S |
| 21-225_214D8_LC | . | . | . | . | . | A | . | . | . | . | . | . | . | . | . | . | . | . | . |
| 21-225_218G4_LC | . | . | . | . | N | T | . | . | . | . | . | . | . | . | . | . | . | . | . |
| 21-225_58C5_LC | . | . | . | . | . | . | . | . | . | . | . | . | . | . | . | . | . | . | . |

FIGURE 57 (Continued)

Table 119. Consensus 39 - VK2iA19/JK4 (SEQ ID NO: 50336):

DIVMTQSPLSLPVTPGEPASISCRSS--QSLLHSN-GYNYLDWYLQKPGQSPQLLIYL--------GSNRASGVPDRFSGSGSG--TDFTLKISRVEAEDVGVYYCMQALH--------------PPLTFGGGTKVEIKR wherein:

S at position 25 can be substituted with Y

L at position 32 can be substituted with V

H at position 33 can be substituted with Y

S at position 34 can be substituted with N or H

N at position 35 can be substituted with S

G at position 37 can be substituted with K or R

Y at position 38 can be substituted with H or N

Y at position 40 can be substituted with H or S

L at position 58 can be substituted with V

N at position 69 can be substituted with H

A at position 109 can be substituted with P, T or V

H at position 111 can be substituted with Q or null (-)

Null (-) at position 134 can be substituted with T

P at position 135 can be substituted with Q, T or I

P at position 136 can be substituted with T

L at position 137 can be substituted with P or F

Arg Xaa Ser Gln Ser Leu Xaa Xaa Xaa Xaa Xaa Asn Xaa Leu Asp (SEQ ID NO: 50243)

FIGURE 57 (Continued)

Xaa Gly Ser Xaa Arg Ala Ser (SEQ ID NO: 50244)

Met Gln Xaa Leu Xaa Xaa Xaa Xaa Xaa Thr (SEQ ID NO: 50245)

Arg Ser Ser Gln Ser Leu Leu His Ser Asn Gly Tyr Asn Tyr Leu Asp (SEQ ID NO: 50678)

Leu Gly Ser Asn Arg Ala Ser (SEQ ID NO: 50679)

Met Gln Ala Leu His Pro Pro Leu Thr (SEQ ID NO: 50680)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | KLFR1 | | | | | | | | | | | | | | | |
| CONSENSUS | D | I | V | M | T | Q | S | P | L | S | L | P | V | T | P | G | E | P | A | S | I | S | C | R | S | S |
| 21-225_171D7_LC | . | . | . | . | . | . | . | . | . | . | . | . | . | . | . | . | . | . | . | . | . | . | . | . | . | . |
| 21-225_17B8_LC | . | . | . | . | . | . | . | . | . | . | . | . | . | . | . | . | . | . | . | . | . | . | . | . | . | . |
| 21-225_201F3_LC | . | . | . | . | . | . | . | . | . | . | . | . | . | . | . | . | . | . | . | . | . | . | . | . | . | . |
| 21-225_201G6_LC | . | . | . | L | . | . | . | . | . | . | . | . | . | . | . | . | . | . | . | . | . | . | . | . | . | . |
| 21-225_202C12_LC | . | . | . | L | . | . | . | . | . | . | . | . | . | . | . | . | . | . | . | . | . | . | . | . | . | . |
| 21-225_208G3_LC | . | . | . | . | . | . | . | . | . | . | . | . | . | . | . | . | . | . | . | . | . | . | . | . | . | . |
| 21-225_74A2_LC | . | . | . | . | . | . | . | . | . | . | . | . | . | . | . | . | . | . | . | . | . | . | . | . | . | . |
| 21-225_74D8_LC | . | . | . | . | . | . | . | . | . | . | . | . | . | . | . | . | . | . | . | . | . | . | . | . | . | . |
| 21-225_75A1_LC | . | . | . | . | . | . | . | . | . | . | . | . | . | . | . | . | . | . | . | . | . | . | . | . | . | . |
| 21-225_75D8_LC | . | . | . | . | . | . | . | . | . | . | . | . | . | . | . | . | . | . | . | . | . | . | . | . | . | . |
| 21-225_89G4_LC | . | . | . | . | . | . | . | . | . | . | . | . | . | . | . | . | . | . | . | . | . | . | . | . | . | . |
| 21-225_90C11_LC | . | . | . | . | . | . | . | . | . | . | . | . | . | . | . | . | . | . | . | . | . | . | . | . | Y | . |
| 21-225_92B2_LC | . | . | . | . | . | . | . | . | . | . | . | . | . | . | . | . | . | . | . | . | . | . | . | . | . | . |
| 21-225_97H3_LC | . | . | . | . | . | . | . | . | . | . | . | . | . | . | . | . | . | . | . | . | . | . | . | . | . | . |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | K_FR4 | | | | | | | |
| CONSENSUS | . | . | . | . | . | P | L | T | F | G | G | G | T | K | V | E | I | K | R |
| 21-225_171D7_LC | . | . | . | . | T | . | . | . | . | . | . | . | . | . | . | . | . | . | . |
| 21-225_17B8_LC | . | . | . | T | P | . | . | . | . | . | . | . | . | . | . | . | . | . | . |
| 21-225_201F3_LC | . | . | . | . | Q | T | R | . | . | . | . | . | . | . | . | . | . | . | Q |
| 21-225_201G6_LC | . | . | . | . | Q | T | R | . | . | . | . | . | . | . | . | . | . | . | Q |
| 21-225_202C12_LC | . | . | . | . | Q | T | R | . | . | . | . | . | . | . | . | . | . | . | . |
| 21-225_208G3_LC | . | . | . | . | T | . | R | . | . | . | . | . | . | . | . | . | . | . | . |
| 21-225_74A2_LC | . | . | . | . | P | . | R | . | . | . | . | . | . | . | . | . | . | . | . |
| 21-225_74D8_LC | . | . | . | . | T | . | . | . | . | . | . | . | . | . | . | . | . | . | . |
| 21-225_75A1_LC | . | . | . | . | P | . | R | . | . | . | . | . | . | . | . | . | . | . | . |
| 21-225_75D8_LC | . | . | . | . | — | . | . | . | . | . | . | . | . | . | . | . | . | . | . |
| 21-225_89G4_LC | . | . | . | . | P | . | . | . | . | . | . | . | . | . | . | . | . | . | . |
| 21-225_90C11_LC | . | . | . | . | — | . | . | . | . | . | . | . | . | . | . | . | . | . | . |
| 21-225_92B2_LC | . | . | . | . | T | . | R | . | . | . | . | . | . | . | . | . | . | . | . |
| 21-225_97H3_LC | . | . | . | . | . | . | . | . | . | . | . | . | . | . | . | . | . | . | . |

FIGURE 57 (Continued)

Table 120.  Consensus 40 - VL1|1c/JL2 (SEQ ID NO: 50337):

QSVLTQP-PSASGTPGQRVTISCSGSS-SNIGS-----NTVNWYQQLPGTAPKLLIYS--------NNQRPSGVPDRFSGSKSG--TSASLAISGLQSEDEADYYCAAWDDS..............LNGVFGGGTKLTVLG wherein:

S at position 26 can be substituted with T

S at position 27 can be substituted with N

N at position 30 can be substituted with Y

S at position 33 can be substituted with N

N at position 39 can be substituted with Y

T at position 40 can be substituted with A or S

V at position 41 can be substituted with I

N at position 42 can be substituted with D or S

S at position 58 can be substituted with I

N at position 67 can be substituted with S

N at position 68 can be substituted with D or S

Q at position 69 can be substituted with H

A at position 107 can be substituted with E

S at position 112 can be substituted with null (-)

null (-) at position 133 can be substituted with L

L at position 134 can be substituted with N, M or S

N at position 135 can be substituted with G, K or L

FIGURE 57 (Continued)

G at position 136 can be substituted with H or N

V at position 137 can be substituted with P or G

V at position 138 can be substituted with P

Ser Gly Xaa Xaa Ser Xaa Ile Gly Xaa Xaa Xaa Xaa Xaa (SEQ ID NO: 50192)

Xaa Xaa Xaa Xaa Arg Pro Ser (SEQ ID NO: 50193)

Xaa Ala Trp Asp Asp Xaa Xaa Xaa Xaa Xaa Xaa Xaa (SEQ ID NO: 50194)

Ser Gly Ser Ser Ser Asn Ile Gly Ser Asn Thr Val Asn (SEQ ID NO: 50681)

Ser Asn Asn Gln Arg Pro Ser (SEQ ID NO: 50682)

Ala Ala Trp Asp Asp Ser Leu Asn Gly Val Val (SEQ ID NO: 50683)

FIGURE 57 (Continued)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| CONSENSUS | Q | S | V | L | T | Q | P | - | P | S | A | S | G | T | P | G | Q | R | V | T | I | S | C | S | G | S |
| 21-225_146A8_LC | . | . | . | . | . | . | . | . | . | . | . | . | . | . | . | . | . | . | . | . | . | . | . | . | . | . |
| 21-225_146B8_LC | . | . | . | . | . | . | . | . | . | . | T | . | . | . | . | . | . | . | . | . | . | . | . | . | . | . |
| 21-225_146D8_LC | . | . | . | . | . | . | . | . | . | . | . | . | . | . | . | . | . | . | . | . | . | . | . | . | . | . |
| 21-225_147H12_LC | . | . | . | V | . | . | . | . | . | . | . | . | . | . | . | . | . | . | . | . | . | . | . | . | . | . |
| 21-225_149A1_LC | . | . | . | . | . | . | . | . | . | . | . | . | . | . | . | . | . | . | . | . | . | . | . | . | . | . |
| 21-225_150F9_LC | . | . | . | . | . | . | . | . | . | . | . | . | . | . | . | . | . | . | . | . | . | . | . | . | . | . |
| 21-225_154G12_LC | . | . | . | . | . | . | . | . | . | . | . | . | . | . | . | . | . | . | . | . | . | . | . | . | . | . |
| 21-225_156H2_LC | . | . | . | . | . | . | . | . | . | . | . | . | . | . | . | . | . | . | . | . | . | . | . | . | . | . |
| 21-225_197F9_LC | . | . | . | . | . | . | . | . | . | . | . | . | . | . | . | . | . | . | . | . | . | . | . | . | . | . |
| 21-225_199C3_LC | . | . | . | . | . | . | . | . | . | . | . | . | . | . | . | . | . | . | . | . | . | . | . | . | . | . |
| 21-225_4G12_LC | . | . | . | . | . | . | . | . | . | . | . | . | . | . | . | . | . | . | . | N | M | . | . | . | . | T |
| 21-225_60D6_LC | . | . | . | . | . | . | . | . | . | . | . | . | . | . | . | . | . | . | . | . | . | . | . | . | . | . |
| 21-225_9G9_LC | . | . | . | . | . | . | . | . | . | . | . | . | . | . | . | . | . | . | . | N | M | . | . | . | . | T |

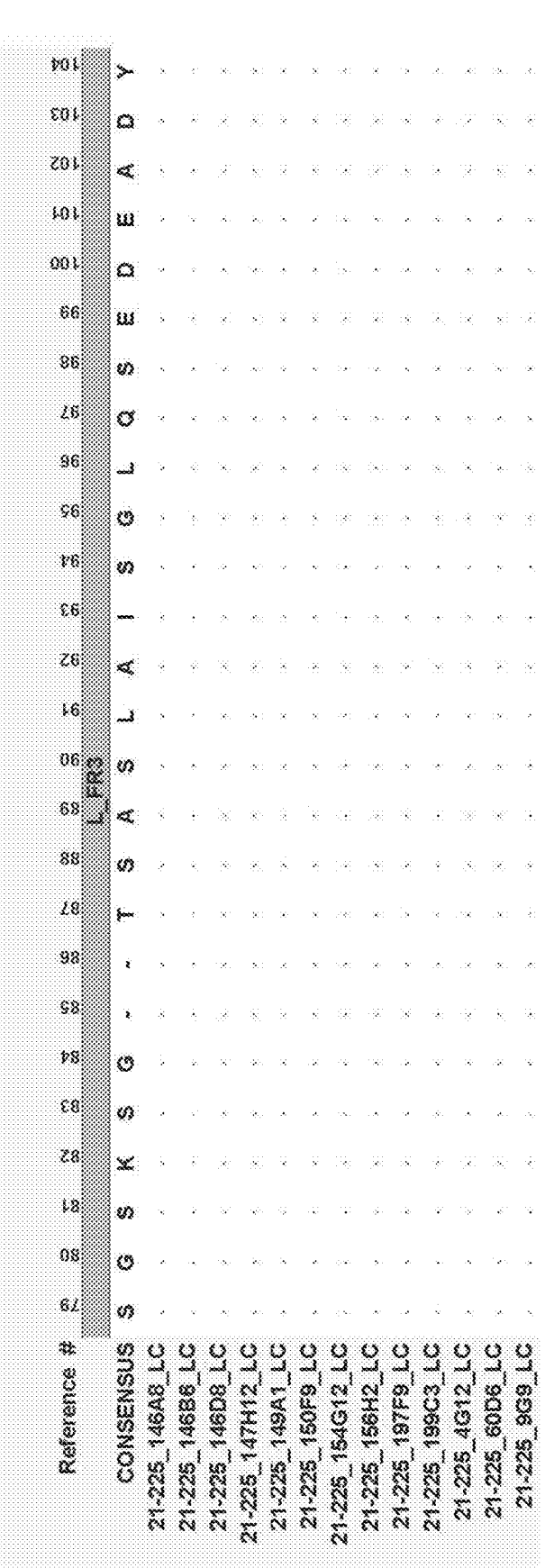

FIGURE 57 (Continued)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | L_CDR3 | | | | | | | | |
| CONSENSUS | Y | C | A | A | W | D | D | S | . | . | . | . | . | . | . | . | . | . | . | . | . | . | . | . | . | . |
| 21-225_146A8_LC | . | . | . | . | . | . | . | . | . | . | . | . | . | . | . | . | . | . | . | . | . | . | . | . | . | . |
| 21-225_146B8_LC | . | . | . | . | . | . | . | . | . | . | . | . | . | . | . | . | . | . | . | . | . | . | . | . | . | . |
| 21-225_146D8_LC | . | . | . | . | . | . | . | . | . | . | . | . | . | . | . | . | . | . | . | . | . | . | . | . | . | . |
| 21-225_147H12_LC | . | . | E | . | . | . | . | . | . | . | . | . | . | . | . | . | . | . | . | . | . | . | . | . | . | . |
| 21-225_149A1_LC | . | . | . | . | . | . | . | . | . | . | . | . | . | . | . | . | . | . | . | . | . | . | . | . | . | . |
| 21-225_150F9_LC | F | . | . | . | . | . | . | . | . | . | . | . | . | . | . | . | . | . | . | . | . | . | . | . | . | . |
| 21-225_154G12_LC | . | . | . | . | . | . | . | . | . | . | . | . | . | . | . | . | . | . | . | . | . | . | . | . | . | . |
| 21-225_156H2_LC | . | . | . | . | . | . | . | . | . | . | . | . | . | . | . | . | . | . | . | . | . | . | . | . | . | . |
| 21-225_197F9_LC | . | . | . | . | . | . | . | . | . | . | . | . | . | . | . | . | . | . | . | . | . | . | . | . | . | . |
| 21-225_199C3_LC | . | . | . | . | . | . | . | . | . | . | . | . | . | . | . | . | . | . | . | . | . | . | . | . | . | . |
| 21-225_4G12_LC | . | . | . | . | . | . | . | . | . | . | . | . | . | . | . | . | . | . | . | . | . | . | . | . | . | . |
| 21-225_60D6_LC | . | . | . | . | . | . | . | S | . | . | . | . | . | . | . | . | . | . | . | . | . | . | . | . | . | . |
| 21-225_9G8_LC | . | . | . | . | . | . | . | . | . | . | . | . | . | . | . | . | . | . | . | . | . | . | . | . | . | . |

FIGURE 57 (Continued)

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| CONSENSUS | . | . | . | L | N | G | V | V | F | G | G | G | T | K | L | T | V | L | G |
| 21-225_146A8_LC | . | . | . | . | . | . | . | . | . | . | . | . | . | . | . | . | . | . | . |
| 21-225_146B8_LC | . | . | . | . | . | . | . | . | . | . | . | . | . | . | . | . | . | . | S |
| 21-225_146D8_LC | . | . | . | . | . | . | P | . | . | . | . | . | . | . | . | . | . | . | . |
| 21-225_147H12_LC | . | . | . | S | K | . | . | . | . | . | . | . | . | . | . | . | . | . | . |
| 21-225_149A1_LC | . | . | . | . | . | . | P | . | . | . | . | . | . | . | . | . | . | . | S |
| 21-225_150F9_LC | . | . | . | . | . | . | P | . | . | . | . | . | . | . | . | . | . | . | S |
| 21-225_154G12_LC | . | . | . | . | . | . | P | . | . | . | . | . | . | . | . | . | . | . | . |
| 21-225_156H2_LC | . | . | . | . | . | . | . | . | . | . | . | . | . | . | . | . | . | . | . |
| 21-225_197F9_LC | . | . | L | N | G | N | Q | A | V | . | . | K | . | . | V | . | . | . | . |
| 21-225_199C3_LC | . | . | . | S | L | . | . | . | . | . | . | . | . | . | . | . | . | . | . |
| 21-225_4G12_LC | . | . | . | . | . | . | . | . | . | . | . | . | . | . | . | . | . | . | . |
| 21-225_60D6_LC | . | . | . | . | . | . | . | . | . | . | . | . | . | . | . | . | . | . | . |
| 21-225_9G9_LC | . | . | L | N | G | N | . | . | . | . | . | K | . | . | . | . | . | . | . |

FIGURE 57 (Continued)

Table 121. Consensus 41 - VL1l1c/JL3b (SEQ ID NO: 50338):

QSVLTQP-PSASGTPGQRVTISCSGSS-SNIGS------NIVTWYQQLPGTAPKLLIYS------NDQRPSGVPDRFSGSKSG--TSASLAISGLQSEDEADYYCAAWDDS--------LNGWFGGGTLTVLG wherein:

S at position 27 can be substituted with N or C

S at position 33 can be substituted with N

N at position 39 can be substituted with H

I at position 40 can be substituted with T

T at position 42 can be substituted with N

S at position 58 can be substituted with G, N or V

D at position 68 can be substituted with K, N or Y

A at position 107 can be substituted with T

A at position 108 can be substituted with T or V

N at position 135 can be substituted with I or S

G at position 136 can be substituted with D or V

Ser Gly Ser Xaa Ser Asn Ile Gly Xaa Xaa Xaa Val Xaa (SEQ ID NO: 50195)

Xaa Asn Xaa Gln Arg Pro Ser (SEQ ID NO: 50196)

Xaa Xaa Trp Asp Asp Ser Leu Xaa Xaa Trp Val (SEQ ID NO: 50197)

Ser Gly Ser Ser Ser Asn Ile Gly Ser Asn Ile Val Thr (SEQ ID NO: 50684)

Ser Asn Asp Gln Arg Pro Ser (SEQ ID NO: 50685)

Ala Ala Trp Asp Asp Ser Leu Asn Gly Trp Val (SEQ ID NO: 50686)

Table 122. Consensus 42 - VK1|A30/JK5 (SEQ ID NO: 50339):

DIQMTQSPSSLSASVGDRVTITCRAS--QGIR------NDLGWYQQKPGKAPKRLIYA--------ASSLQSGVPSRFSGSGSG--TEFTLTISSLQPEDFATYYCLQHNS----------------YPITFGQGTRLEIKR wherein:

A at position 25 can be substituted with T

G at position 30 can be substituted with D or R

I at position 31 can be substituted with V

N at position 39 can be substituted with S

A at position 58 can be substituted with D, I or T

S at position 69 can be substituted with N

Q at position 71 can be substituted with E, F or L

L at position 107 can be substituted with I

Q at position 108 can be substituted with H

H at position 109 can be substituted with Y

N a position 110 can be substituted with H or S

S at position 111 can be substituted with N null (-) at position 134 can be substituted with Y Y at position 135 can be substituted with L, F or P I at position 137 can be substituted with P or L Arg Xaa Ser Gln Xaa Xaa Arg Xaa Asp Leu Gly (SEQ ID NO: 50198)

Xaa Ala Ser Xaa Leu Xaa Ser (SEQ ID NO: 50199)

Xaa Xaa Xaa Xaa Xaa Xaa Pro Xaa Thr (SEQ ID NO: 50200)

Arg Ala Ser Gln Gly Ile Arg Asn Asp Leu Gly (SEQ ID NO: 50687)

Ala Ala Ser Ser Leu Gln Ser (SEQ ID NO: 50688)

Leu Gln His Asn Ser Tyr Pro Ile Thr (SEQ ID NO: 50689)

Table 123. Consensus 43 - VK1jO12/JK5 (SEQ ID NO: 50340):

FIGURE 57 (Continued)

DIQMTQSPSSLSASVGDRVTITCRAS--QSIS-------SYLNWYQQKPGKAPKLLIYA--------ASSLQSGVPSRFSGSGSG--TDFTLTISSLQPEDFATYCQQSYS--------------IPITFGQGTRLEIKR wherein:

A at position 25 can be substituted with T

S at position 30 can be substituted with N or Y

I at position 31 can be substituted with S or F

S at position 32 can be substituted with F, N, R or T

S at position 39 can be substituted with D, G or R

L at position 41 can be substituted with S

N at position 42 can be substituted with S

A at position 58 can be substituted with D, G or S

A at position 67 can be substituted with T

S at position 68 can be substituted with Y

S at position 69 can be substituted with T

L at position 70 can be substituted with F

Q at position 71 can be substituted with E or K

S at position 72 can be substituted with T

Q at position 107 can be substituted with H

Q at position 108 can be substituted with E

S at position 109 can be substituted with T

Y at position 110 can be substituted with F

FIGURE 57 (Continued)

S at position 111 can be substituted with G or N

I at position 135 can be substituted with T, L, N or S

P at position 136 can be substituted with S, R or T

I at position 137 can be substituted with F or P

T at position 138 can be substituted with A

Arg Xaa Ser Gln Xaa Xaa Xaa Xaa Tyr Xaa Xaa (SEQ ID NO: 50201)

Xaa Xaa Xaa Xaa Xaa Xaa Xaa Xaa (SEQ ID NO: 50202)

Xaa Xaa Xaa Xaa Xaa Xaa Xaa Xaa Xaa Xaa (SEQ ID NO: 50203)

Arg Ala Ser Gln Ser Ile Ser Ser Tyr Leu Asn (SEQ ID NO: 50690)

Ala Ala Ser Ser Leu Gln Ser (SEQ ID NO: 50691)

Gln Gln Ser Tyr Ser Ile Pro Ile Thr (SEQ ID NO: 50692)

Table 124. Consensus 44 - VK2|A18/JK5 (SEQ ID NO: 50341):

DIVMTQTPLSLSVTPGQPASISCKSS--QSLLHSE-GKTYLYWYLQKPGQPPQLLIYE------VSNRFSGVPDRFSGSGSG--TDFTLKISRVEAEDVGVYYCMQSIQ------LPITFGQGTRLEIKR wherein:

K at position 24 can be substituted with R

S at position 25 can be substituted with T

S at position 26 can be substituted with N

S at position 30 can be substituted with I

L at position 31 can be substituted with F

L at position 32 can be substituted with V

S at position 34 can be substituted with N or R

E at position 35 can be substituted with D

K at position 38 can be substituted with R

V at position 67 can be substituted with L

N at position 69 can be substituted with K or H

F at position 71 can be substituted with L or V

M at position 107 can be substituted with I or L

I at position 110 can be substituted with M

Q at position 111 can be substituted with null (-) or L

L at position 135 can be substituted with Y, I or Q

FIGURE 57 (Continued)

P at position 136 can be substituted with L

T at position 138 can be substituted with I

Xaa Xaa Xaa Gln Xaa Xaa His Xaa Xaa Gly Xaa Thr Tyr Leu Tyr (SEQ ID NO: 50204)

Glu Xaa Ser Xaa Arg Xaa Ser (SEQ ID NO: 50205)

Xaa Gln Ser Xaa Xaa Xaa Xaa Ile Xaa (SEQ ID NO: 50246)

Lys Ser Ser Gln Ser Leu Leu His Ser Glu Gly Lys Thr Tyr Leu Tyr (SEQ ID NO: 50693)

Glu Val Ser Asn Arg Phe Ser (SEQ ID NO: 50694)

Met Gln Ser Ile Gln Leu Pro Ile Thr (SEQ ID NO: 50695)

Table 125. Consensus 45 - VK3|A27/JK3 (SEQ ID NO: 50342):

EIVLTQSPGTLSLFPGERATLSCRAS--OSVIS------SYLAWYQQKPGQAPRLLIFG--------VSSRATGIPDRFSGSGSG--
TDFTLTISRLEPEDFAVYYCQQYGR------------------SPFNFGPGTKVDIKR wherein:

Q at position 29 can be substituted with R.

S at position 30 can be substituted with G or N

V at position 31 can be substituted with I

I at position 32 can be substituted with S or G

S at position 33 can be substituted with N

S at position 39 can be substituted with I or N

Y at position 40 can be substituted with F

V at position 67 can be substituted with A or T

S at position 69 can be substituted with N or T

R at position 70 can be substituted with W

Q at position 107 can be substituted with H

Q at position 108 can be substituted with H

Y at position 109 can be substituted with N

G at position 110 can be substituted with D

R at position 111 can be substituted with null (-), N or Y

P at position 136 can be substituted with L or M

FIGURE 57 (Continued)

N at position 138 can be substituted with T

Arg Ala Ser Xaa Xaa Xaa Xaa Xaa Xaa Xaa Leu Ala (SEQ ID NO: 50206)

Gly Xaa Ser Xaa Xaa Ala Thr (SEQ ID NO: 50207)

Xaa Xaa Xaa Xaa Ser Xaa Xaa Xaa Asn (SEQ ID NO: 50208)

Arg Ala Ser Gln Ser Val Ile Ser Ser Tyr Leu Ala (SEQ ID NO: 50696)

Gly Val Ser Ser Arg Ala Thr (SEQ ID NO: 50697)

Gln Gln Tyr Gly Arg Ser Pro Phe Asn (SEQ ID NO: 50698)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | | K_CDR3 | | | | | | | |
| CONSENSUS | Y | C | Q | Q | Y | G | R | | | | | | | | | | | | | | | | | | | |
| 21-225_146G4_LC | | | | | | | | | | | | | | | | | | | | | | | | | | |
| 21-225_147D2_LC | | | | | | | | | | | | | | | | | | | | | | | | | | |
| 21-225_147E3_LC | | | | | | | | | | | | | | | | | | | | | | | | | | |
| 21-225_149D7_LC | | | | | | | | | | | | | | | | | | | | | | | | | | |
| 21-225_149D8_LC | | | | | H | | | | | | | | | | | | | | | | | | | | | |
| 21-225_152E7_LC | | | | | N | D | Y | | | | | | | | | | | | | | | | | | | |
| 21-225_153A6_LC | | | | | | D | | | | | | | | | | | | | | | | | | | | |
| 21-225_194A4_LC | | | | | | | N | | | | | | | | | | | | | | | | | | | |
| 21-225_216F10_LC | | | R | | | | | | | | | | | | | | | | | | | | | | | |
| 21-225_59H5_LC | | | | | | | | | | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | K_FR4 | | | | | | | |
| CONSENSUS | | | | | S | P | F | N | F | G | P | G | T | K | V | D | I | K | R |
| 21-225_146G4_LC | | | | | | L | | T | | | | | | | | | | | |
| 21-225_147D2_LC | | | | | | | | | | | | | | | | | | | |
| 21-225_147E3_LC | | | | | | | | | | | | | | | | | | | |
| 21-225_149D7_LC | | | | | | | | | | | | | | | | | | | |
| 21-225_149D8_LC | | | | | | | | | | | | | | | | | | | |
| 21-225_152E7_LC | | | | | | | | | | | | | | | | | | | |
| 21-225_153A6_LC | | | | | | | | | | | | | | | | | | | |
| 21-225_194A4_LC | | | | | | M | | T | | | | | | | | | | | |
| 21-225_216F10_LC | | | | | | | | T | | | | | | | | | | | |
| 21-225_59H5_LC | | | | | | | | T | | | | | | | | | R | | |

FIGURE 57 (Continued)

Table 126. Consensus 46 - VK3jL2/JK1 (SEQ ID NO: 50343):

EIVMTQSPATLSVSPGERATLSCRAS--QSVS-----SNLAWYQQKPGQAPRLLIYG-------ASTRATGIPARFSGSGSG--
TEFTLTISSLQSEDFAVYYCQQYND-------------WPWTFGQGTKVEIKR wherein:

A at position 25 can be substituted with S

S at position 30 can be substituted with D or T

V at position 31 can be substituted with I

S at position 32 can be substituted with N, R or I

S at position 39 can be substituted with I or T

N at position 40 can be substituted with Y

L at position 41 can be substituted with I

T at position 72 can be substituted with S

Q at position 108 can be substituted with E

Y at position 109 can be substituted with S

N at position 110 can be substituted with D, F or H

D at position 111 can be substituted with N, null (-) or T null (-) at position 134 can be substituted with W W at position 135 can be substituted with P, C or N P at position 136 can be substituted with L or W W at position 137 can be substituted with L, C, P or R FIGURE 57 (Continued)

T at position 138 can be substituted with P or S

Arg Xaa Ser Gln Xaa Xaa Xaa Xaa Xaa Xaa Ala (SEQ ID NO: 50209)

Gly Ala Ser Thr Arg Ala Xaa (SEQ ID NO: 50210)

Gln Xaa Xaa Xaa Xaa Xaa Xaa Xaa Xaa Xaa Xaa (SEQ ID NO: 50211)

Arg Ala Ser Gln Ser Val Ser Ser Asn Leu Ala (SEQ ID NO: 50699)

Gly Ala Ser Thr Arg Ala Thr (SEQ ID NO: 50700)

Gln Gln Tyr Asn Asp Trp Pro Trp Thr (SEQ ID NO: 50701)

Table 127. Consensus 47 – VK6/A26/JK1 (SEQ ID NO: 50344):

EIVLTQSPDFQSVTPKEKVTITCRAS--QSIG-----SSLHWYQQKPDQSPKLLIKY------ASQSFSGVPSRFSGSGSG--
TDFTLTINSLEAEDAATYYCHQSSS-----------------LPWIFGQGTKVEIKR wherein:

S at position 30 can be substituted with N

S at position 39 can be substituted with N

S at position 40 can be substituted with N or T

Y at position 58 can be substituted with S

H at position 107 can be substituted with Q

S at position 110 can be substituted with G or R

L at position 135 can be substituted with F

W at position 137 can be substituted with R or Q

Arg Ala Ser Gln Xaa Ile Gly Xaa Xaa Leu His (SEQ ID NO: 50256)

Xaa Ala Ser Gln Ser Phe Ser (SEQ ID NO: 50257)

Xaa Gln Ser Xaa Ser Xaa Pro Xaa Thr (SEQ ID NO: 50258)

Arg Ala Ser Gln Ser Ile Gly Ser Ser Leu His (SEQ ID NO: 50702)

Tyr Ala Ser Gln Ser Phe Ser (SEQ ID NO: 50703)

His Gln Ser Ser Leu Pro Trp Thr (SEQ ID NO: 50704)

Table 128. Consensus 48 – VK1jA30/JK2 (SEQ ID NO: 50345):

DIQMTQSPSSLSASVGDRVTITCRAS--QGIR----NDLGWYQQKPGKAPKRLIYA------ASSLQSGVPSRFSGSGSG--
TEFTLTISSLQPEDFATYYCLQHYS-----------YPRSFGQGTKLEIKR wherein:

G at position 30 can be substituted with A

R at position 32 can be substituted with G

N at position 39 can be substituted with D

A at position 67 can be substituted with T

Y at position 110 can be substituted with N

S at position 111 can be substituted with N

Y at position 135 can be substituted with F

R at position 137 can be substituted with Y

Arg Ala Ser Gln Xaa Ile Xaa Xaa Asp Leu Gly (SEQ ID NO: 50247)

Ala Xaa Ser Leu Gln Ser (SEQ ID NO: 50248)

Leu Gln His Xaa Xaa Xaa Pro Xaa Ser (SEQ ID NO: 50249)

Arg Ala Ser Gln Gly Ile Arg Asn Asp Leu Gly (SEQ ID NO: 50705)

Ala Ala Ser Ser Leu Gln Ser (SEQ ID NO: 50706)

Leu Gln His Tyr Ser Tyr Pro Arg Ser (SEQ ID NO: 50707)

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | | | | | | | | | | | | | | | |
| | | | | | | | | | | | | | | K_CDR2 | | | | | | | | | | | |
| CONSENSUS | K | R | L | I | Y | A | . | . | . | . | . | . | . | . | A | S | S | L | Q | S | G | V | P | S | R | F |
| 21-225_150E2_LC | T | | | | | | | | | | | | | | | | | | | | | | | | | |
| 21-225_152F7_LC | | | | | | | | | | | | | | | T | | | | | | | | | | | |
| 21-225_176H12_LC | N | | | | | | | | | | | | | | | | | | | | | | | | | |
| 21-225_177B4_LC | | | | | | | | | | | | | | | | | | | | | | | | | | |
| 21-225_25A12_LC | | | | | | | | | | | | | | | | | | | | | | | | | | |
| 21-225_26A11_LC | | | | | | | | | | | | | | | | | | | | | | | | | | |
| 21-225_28H2_LC | | | | | | | | | | | | | | | | | | | | | | | | | | |
| 21-225_29E2_LC | | | | | | | | | | | | | | | | | | | | | | | | | | |
| 21-225_61F2_LC | E | | | | | | | | | | | | | | | | | | | | | | | | | |

| Reference # | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 |
|---|---|---|---|---|---|---|---|---|---|---|---|---|---|---|---|---|---|---|---|---|---|---|---|---|---|---|
| | | | | | | | | | | K_FR3 | | | | | | | | | | | | | | | | |
| CONSENSUS | S | G | S | G | S | G | . | . | T | E | F | T | L | T | I | S | S | L | Q | P | E | D | F | A | T | Y |
| 21-225_150E2_LC | | | | | | | | | | | | | | | | | | | | | | | | | | |
| 21-225_152F7_LC | | | | | | | | | | | | | | | | | | | | | | | | | | |
| 21-225_176H12_LC | | | | | | | | | | | | | | | | | | | | | | | | | | |
| 21-225_177B4_LC | | | | | | | | | | | | | | | | | | | | | | | | | | |
| 21-225_25A12_LC | | | | | | | | | | | | | | | | | | | | | A | | | | | |
| 21-225_26A11_LC | | | | | | | | | | | | | | | | | | | | | | | | | | |
| 21-225_28H2_LC | | | | | | | | | | | | | | | | | | | | | | | | | | |
| 21-225_29E2_LC | | | | | | | | | | | | | | | | | | | | | | | | | | |
| 21-225_61F2_LC | | | | | | | | | | | | | | | | | | | | | | | | | | |

Table 129. Consensus 49 - VK1|L1/JK5 (SEQ ID NO: 50346):

DIQMTQSPSSLSASVGDRVTITCRAS--QGIS--------NYLAWFQQKPGKAPKSLIYA--------ASSLQSGVPSKFSGSGSG--TDFTLTISSLQPEDFATYCQQYLS----------------YPITFGQGTRLEIKR wherein:

R at position 24 can be substituted with Q

G at position 30 can be substituted with D

S at position 32 can be substituted with N

N at position 39 can be substituted with K

Y at position 40 can be substituted with F

A at position 42 can be substituted with N or V

A at position 58 can be substituted with D, G, or T

S at position 68 can be substituted with T

S at position 69 can be substituted with R or N

Q at position 71 can be substituted with H, L, or V

S at position 72 can be substituted with T

Q at position 107 can be substituted with H or L

Q at position 108 can be substituted with H or L

L at position 110 can be substituted with H, D, K, N, or Y

S at position 111 can be substituted with N, H, or T

Y at position 135 can be substituted with L

FIGURE 57 (Continued)

I at position 137 can be substituted with L

Xaa Ala Ser Gln Xaa Ile Xaa Xaa Xaa Leu Xaa (SEQ ID NO: 50212)

Xaa Ala Xaa Xaa Leu Xaa Xaa (SEQ ID NO: 50213)

Xaa Xaa Tyr Xaa Xaa Xaa Pro Xaa Thr (SEQ ID NO: 50214)

Arg Ala Ser Gln Gly Ile Ser Asn Tyr Leu Ala (SEQ ID NO: 50708)

Ala Ala Ser Ser Leu Gln Ser (SEQ ID NO: 50709)

Gln Gln Tyr Leu Ser Tyr Pro Ile Thr (SEQ ID NO: 50710)

Table 130. Consensus 50 – VK6/A26/JK4 (SEQ ID NO: 50347):

EIVLTQSPDFQSVTPKEKVTITCRAS--QSIG------SSLHWYQQKPDQSPKLLIKY--------ASQSFSGVPSRFSGSGSG--TDFTLTINSLEAEDAATYYCHQSRR------------------LPLTFGGGTKVEIKR wherein:

S at position 26 can be substituted with N

S at position 30 can be substituted with N

S at position 39 can be substituted with R

F at position 71 can be substituted with L

S at position 109 can be substituted with T

R at position 110 can be substituted with G or S

R at position 111 can be substituted with S or T

Xaa Ala Xaa Gln Ser Xaa Gly Ser Ser Leu His (SEQ ID NO: 50215)

Tyr Ala Ser Gln Ser Xaa Ser (SEQ ID NO: 50216)

His Gln Xaa Xaa Xaa Leu Pro Leu Thr (SEQ ID NO: 50217)

Arg Ala Ser Gln Ser Ile Gly Ser Ser Leu His (SEQ ID NO: 50711)

Tyr Ala Ser Gln Ser Phe Ser (SEQ ID NO: 50712)

His Gln Ser Arg Arg Leu Pro Leu Thr (SEQ ID NO: 50713)

Table 131. Consensus 51 - VL3j3L/JL2 (SEQ ID NO: 50348):

SSELTQD-PAVSVALGQTVRITCQGD---SLRP------YYASWYQQKPGQAPVLVIYG--------KNNRPSGIPDRFSGSSSG--NTASLTITGAQAEDEADYYCNSRDSS------------GNHLVFGGGTKLTVLG wherein:

S at position 30 can be substituted with T or K

P at position 33 can be substituted with N, S, or T

A at position 41 can be substituted with V

S at position 42 can be substituted with N

G at position 58 can be substituted with A or T

N at position 69 can be substituted with S

S at position 112 can be substituted with C

G at position 133 can be substituted with null (-)

N at position 134 can be substituted with G

H at position 135 can be substituted with N or S

L at position 136 can be substituted with H

V at position 137 can be substituted with L

V at position 138 can be substituted with L

Gln Gly Asp Xaa Leu Arg Xaa Tyr Tyr Xaa Xaa (SEQ ID NO: 50218)

Xaa Lys Asn Xaa Arg Pro Ser (SEQ ID NO: 50219)

Asn Ser Arg Asp Ser Xaa Xaa Xaa Xaa Xaa Xaa Xaa (SEQ ID NO: 50220)

FIGURE 57 (Continued)

Gln Gly Asp Ser Leu Arg Pro Tyr Tyr Ala Ser (SEQ ID NO: 50714)

Gly Lys Asn Arg Pro Ser (SEQ ID NO: 50715)

Asn Ser Arg Asp Ser Ser Gly Asn His Leu Val Val (SEQ ID NO: 50716)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | L_FR1 | | | | | | | | | | | | | | | |
| CONSENSUS | S | S | E | L | T | Q | D | P | A | V | S | V | A | L | G | Q | T | V | R | I | T | C | Q | G | D |
| 21-225_171D12_LC | . | . | . | . | . | . | . | . | . | . | . | . | . | . | . | . | . | . | . | . | . | . | . | . | . | . |
| 21-225_172B12_LC | . | . | . | . | . | . | . | . | . | . | . | . | . | . | . | . | . | . | . | . | . | . | . | . | . | . |
| 21-225_172C3_LC | . | . | . | . | . | . | . | . | . | . | . | . | . | . | . | . | . | . | . | . | . | . | . | . | . | . |
| 21-225_190B3_LC | . | . | . | . | . | . | . | . | . | . | . | . | . | . | . | . | . | . | . | . | . | . | . | . | . | . |
| 21-225_190B8_LC | . | . | . | . | . | . | . | . | . | . | . | . | . | . | . | . | . | . | . | . | . | . | . | . | . | . |
| 21-225_180C10_LC | . | . | . | . | . | . | . | . | . | . | . | . | . | . | . | . | . | . | . | . | . | . | . | . | . | . |
| 21-225_191A9_LC | . | . | . | . | . | . | . | . | . | . | . | . | . | . | . | . | . | . | . | . | . | . | . | . | . | . |
| 21-225_191B8_LC | . | . | . | . | . | . | . | . | . | . | . | . | . | . | . | . | . | . | . | . | . | . | . | . | . | . |
| 21-225_193A6_LC | . | . | . | . | . | . | . | . | . | . | . | . | . | . | . | . | . | . | . | . | . | . | . | . | . | . |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | L_CDR1 | | | | | | | | | | | L_FR2 | | | | | | | | | |
| CONSENSUS | . | . | . | S | L | R | P | . | . | . | . | . | Y | Y | A | S | W | Y | Q | Q | K | P | G | Q | A | P |
| 21-225_171D12_LC | . | . | . | . | . | . | S | . | . | . | . | . | . | . | . | . | . | . | . | . | . | . | . | . | . | . |
| 21-225_172B12_LC | . | . | . | . | . | . | N | . | . | . | . | . | . | . | . | . | . | . | . | . | . | . | . | . | . | . |
| 21-225_172C3_LC | . | . | . | X | . | . | N | . | . | . | . | . | . | . | . | . | . | . | . | . | . | . | . | . | . | . |
| 21-225_190B3_LC | . | . | . | T | . | . | T | . | . | . | . | . | . | . | . | . | . | . | . | . | . | . | . | . | . | . |
| 21-225_190B8_LC | . | . | . | . | . | . | . | . | . | . | . | . | . | . | V | . | . | . | . | . | . | . | . | . | . | . |
| 21-225_180C10_LC | . | . | . | T | . | . | . | . | . | . | . | . | . | . | V | . | . | . | . | . | . | . | . | . | . | . |
| 21-225_191A9_LC | . | . | . | . | . | . | S | . | . | . | . | . | . | . | . | . | . | . | . | . | . | . | . | . | . | . |
| 21-225_191B8_LC | . | . | . | . | . | . | . | . | . | . | . | . | . | . | . | . | . | . | . | . | . | . | . | . | . | . |
| 21-225_193A6_LC | . | . | . | . | . | . | . | . | . | . | . | . | . | . | . | N | . | . | . | . | . | . | . | . | . | . |

Table 132. Consensus 52 - VK2iA17/JK4 (SEQ ID NO: 50349):

DVVMTQSPLSLPVTLGQPASISCRSS--QSLVYSD-GNTYLNWFQQRPGQSPRRLIYK------VSNWDSGVPDRFSGSGSG--
TDFTLKISRVEAEDVGVYYCMQGTH------------WPLTFGGGTKVEIKR wherein:

S at position 26 can be substituted with G

Y at position 40 can be substituted with S

K at position 58 can be substituted with E

N at position 69 can be substituted with K

S at position 72 can be substituted with Y

T at position 110 can be substituted with I

H at position 111 can be substituted with null (-)

W at position 135 can be substituted with H

P at position 136 can be substituted with L, S or W

L at position 137 can be substituted with P

Arg Ser Xaa Gln Ser Leu Val Tyr Ser Asp Gly Asn Thr Xaa Leu Asn (SEQ ID NO: 50221)

Xaa Val Ser Xaa Trp Asp Xaa (SEQ ID NO: 50222)

Met Gln Gly Xaa Xaa Xaa Xaa Xaa Thr (SEQ ID NO: 50223)

Arg Ser Ser Gln Ser Leu Val Tyr Ser Asp Gly Asn Thr Tyr Leu Asn (SEQ ID NO: 50717)

Lys Val Ser Asn Trp Asp Ser (SEQ ID NO: 50718)

Met Gln Gly Thr His Trp Pro Leu Thr (SEQ ID NO: 50719)

FIGURE 57 (Continued)

| Reference # | 1 D | 2 V | 3 V | 4 M | 5 T | 6 Q | 7 S | 8 P | 9 L | 10 S | 11 L | 12 P | 13 V | 14 T | 15 L | 16 G | 17 Q | 18 P | 19 A | 20 S | 21 I | 22 S | 23 C | 24 R | 25 S | 26 S |
|---|---|---|---|---|---|---|---|---|---|---|---|---|---|---|---|---|---|---|---|---|---|---|---|---|---|---|
| CONSENSUS | D | V | V | M | T | Q | S | P | L | S | L | P | V | T | L | G | Q | P | A | S | I | S | C | R | S | S |
| 21-225_148C6_LC | . | . | . | . | . | . | . | . | . | . | . | . | . | . | . | . | . | . | . | . | . | . | . | . | . | . |
| 21-225_148H11_LC | . | . | . | . | . | . | . | . | . | . | . | . | . | . | . | . | . | . | . | . | . | . | . | . | . | . |
| 21-225_149F2_LC | . | . | . | . | S | . | Y | . | . | . | . | . | . | . | . | . | . | . | . | . | . | . | . | . | . | . |
| 21-225_150F11_LC | . | . | . | . | . | . | . | . | . | . | . | . | . | . | P | . | . | . | . | . | . | . | . | . | . | . |
| 21-225_177D2_LC | . | . | . | . | . | . | . | . | . | . | . | S | . | . | . | . | . | . | . | . | . | . | . | . | . | . |
| 21-225_32G4_LC | . | . | . | . | . | . | . | . | . | . | . | . | . | . | . | . | . | . | . | . | . | . | . | . | . | . |
| 21-225_43F11_LC1_LC | . | . | . | . | . | . | . | . | . | . | . | . | . | . | . | . | . | . | . | . | . | . | . | . | . | . |
| 21-225_72C4_LC | . | . | . | . | . | . | . | . | . | . | . | . | . | . | . | . | . | . | . | . | . | . | . | . | . | G |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | | | | K_CDR1 | | | | | | | | | | | | | | | | | K_FR2 | | | |
| CONSENSUS | - | - | Q | S | L | V | Y | S | D | - | G | N | T | Y | L | N | W | F | Q | Q | R | P | G | Q | S | P |
| 21-225_148C6_LC | . | . | . | . | . | . | . | . | . | . | . | . | . | . | . | . | . | . | . | . | . | . | . | . | . | . |
| 21-225_148H11_LC | . | . | . | . | . | . | . | . | . | . | . | . | . | . | . | . | . | . | . | . | . | . | . | . | . | . |
| 21-225_149F2_LC | . | . | . | . | . | . | . | . | . | . | . | . | . | S | . | . | . | . | . | . | . | . | . | . | Y | . |
| 21-225_150F11_LC | . | . | . | . | . | . | . | . | . | . | . | . | . | S | . | . | . | . | . | . | . | . | . | . | . | . |
| 21-225_177D2_LC | . | . | . | . | . | . | . | . | . | . | . | . | . | . | . | . | . | . | . | . | . | . | . | . | . | . |
| 21-225_32G4_LC | . | . | . | . | . | . | . | . | . | . | . | . | . | . | . | . | . | . | . | . | . | . | . | . | . | . |
| 21-225_43F11_LC1_LC | . | . | . | . | . | . | . | . | . | . | . | . | . | . | . | . | . | . | . | . | . | . | . | . | . | . |
| 21-225_72C4_LC | . | . | . | . | . | . | . | . | . | . | . | . | . | . | . | . | . | . | . | . | . | . | . | . | . | . |

| Reference # | 53 | 54 | 55 | 56 | 57 | 58 | 59 | 60 | 61 | 62 | 63 | 64 | 65 | 66 | 67 | 68 | 69 | 70 | 71 | 72 | 73 | 74 | 75 | 76 | 77 | 78 |
|---|---|---|---|---|---|---|---|---|---|---|---|---|---|---|---|---|---|---|---|---|---|---|---|---|---|---|
| | | | | | | | | | | | | K_CDR2 | | | | | | | | | | | | | |
| CONSENSUS | R | R | L | I | Y | K | - | - | - | - | - | - | - | V | S | N | W | D | S | G | V | P | D | R | F |
| 21-225_148C6_LC | . | . | . | . | . | . | . | . | . | . | . | . | . | . | . | . | . | . | . | . | . | . | . | . | . | . |
| 21-225_148H11_LC | . | . | . | . | . | . | . | . | . | . | . | . | . | . | . | . | . | . | . | . | . | . | . | . | . | . |
| 21-225_149F2_LC | . | . | . | . | . | . | . | . | . | . | . | . | . | . | . | . | . | . | Y | . | . | . | . | Y | . | . |
| 21-225_150F11_LC | . | . | . | . | . | . | . | . | . | . | . | . | . | . | . | . | . | . | . | . | . | . | . | Y | . | . |
| 21-225_177D2_LC | . | . | . | . | . | . | . | . | . | . | . | . | . | . | . | . | . | . | . | . | . | . | . | . | . | . |
| 21-225_32G4_LC | . | . | . | . | . | . | . | . | . | . | . | . | . | . | . | . | K | . | . | . | . | . | . | . | . | . |
| 21-225_43F11_LC1_LC | . | . | . | . | . | . | . | . | . | . | . | . | . | . | . | . | . | . | . | . | . | . | . | . | . | . |
| 21-225_72C4_LC | . | . | . | . | . | E | . | . | . | . | . | . | . | . | . | . | . | . | . | . | . | . | . | . | . | . |

Table 133. Consensus 53 – VK3jL2/JK4 (SEQ ID NO: 50350):

EIVMTQSPATLSVSPGERATLSCRAS--QSVS------RNLAWYQQKPGQAPRLLIYG--------ASTRATGIPARFSGSGSG--TEFTLTISSLQSEDFAVYYCQQYNN-------------WPLTFGGGTKVEIKR wherein:

A at position 25 can be substituted with P or T

V at position 31 can be substituted with F

S at position 32 can be substituted with R or W

R at position 39 can be substituted with I or S

N at position 40 can be substituted with D or S

L at position 41 can be substituted with V

G at position 58 can be substituted with D

S at position 68 can be substituted with A

T at position 69 can be substituted with I or A

N at position 110 can be substituted with Y

N at position 111 can be substituted with T or Y null (-) at position 134 can be substituted with W W at position 135 can be substituted with P Arg Xaa Ser Gln Ser Xaa Xaa Xaa Xaa Xaa Ala (SEQ ID NO: 50224)

Xaa Ala Xaa Xaa Arg Ala Thr (SEQ ID NO: 50225)

Gln Gln Tyr Xaa Xaa Xaa Xaa Pro Leu Thr (SEQ ID NO: 50226)

Arg Ala Ser Gln Ser Val Ser Arg Asn Leu Ala (SEQ ID NO: 50720)

FIGURE 57 (Continued)

Gly Ala Ser Thr Arg Ala Thr (SEQ ID NO: 50721)
Gln Gln Tyr Asn Asn Trp Pro Leu Thr (SEQ ID NO: 50722)

| Reference # | 105 | 106 | 107 | 108 | 109 | 110 | 111 | 112 | 113 | 114 | 115 | 116 | 117 | 118 | 119 | 120 | 121 | 122 | 123 | 124 | 125 | 126 | 127 | 128 | 129 | 130 |
|---|---|---|---|---|---|---|---|---|---|---|---|---|---|---|---|---|---|---|---|---|---|---|---|---|---|---|
| | | | | | | | | | | | | | | | | | | K_CDR3 | | | | | | | | |
| CONSENSUS | Y | C | Q | Q | Y | N | N | | | | | | | | | | | | | | | | | | | |
| 21-225_190E11_LC | . | . | . | . | . | . | . | | | | | | | | | | | | | | | | | | | |
| 21-225_191E8_LC | . | . | . | . | . | . | . | | | | | | | | | | | | | | | | | | | |
| 21-225_191G11_LC | . | . | . | . | . | . | Y | | | | | | | | | | | | | | | | | | | |
| 21-225_199A6_LC | . | . | . | . | . | Y | . | | | | | | | | | | | | | | | | | | | |
| 21-225_55E1_LC | . | . | . | . | . | . | T | | | | | | | | | | | | | | | | | | | |
| 21-225_65C12_LC | . | . | . | . | . | . | . | | | | | | | | | | | | | | | | | | | |
| 21-225_74D1_LC | . | . | . | . | . | . | . | | | | | | | | | | | | | | | | | | | |
| 21-225_75F11_LC | . | . | . | . | . | . | . | | | | | | | | | | | | | | | | | | | |

| Reference # | 131 | 132 | 133 | 134 | 135 | 136 | 137 | 138 | 139 | 140 | 141 | 142 | 143 | 144 | 145 | 146 | 147 | 148 | 149 |
|---|---|---|---|---|---|---|---|---|---|---|---|---|---|---|---|---|---|---|---|
| | | | | | | | | | | | | | | K_FR4 | | | | | |
| CONSENSUS | | | | | W | P | L | T | F | G | G | G | T | K | V | E | I | K | R |
| 21-225_190E11_LC | | | | | . | . | . | . | . | . | . | . | . | . | . | . | . | . | . |
| 21-225_191E8_LC | | | | | . | . | . | . | . | . | . | . | . | . | . | . | . | . | . |
| 21-225_191G11_LC | | | | | . | . | . | . | . | . | . | . | . | . | . | . | . | . | . |
| 21-225_199A6_LC | | | | | . | . | . | . | . | . | . | . | W | . | . | . | . | . | . |
| 21-225_55E1_LC | | | | | . | . | . | . | . | . | . | . | . | . | . | . | . | . | . |
| 21-225_65C12_LC | | | | | . | . | . | . | . | . | . | . | . | . | . | . | . | . | . |
| 21-225_74D1_LC | | | | W | P | . | . | . | . | . | . | . | . | . | . | . | . | . | . |
| 21-225_75F11_LC | | | | W | P | . | . | . | . | . | . | . | . | . | . | . | . | . | . |

FIGURE 57 (Continued)

Table 134. Consensus 54 - VL3|3j/JL2 (SEQ ID NO: 50351):

SYELTQP-LSVSVALGQTARITCGGN---NIGR-----KNVHWYQQKPGQAPVLVIYR------DSDRPSGIPERFSGSNSG--
NTATLTISRAQAGDEADYYCQVWDS...............STVFGGGTKLTVLG wherein:

N at position 26 can be substituted with D
G at position 32 can be substituted with R
R at position 33 can be substituted with S
K at position 39 can be substituted with R
N at position 40 can be substituted with A
R at position 58 can be substituted with S
S at position 68 can be substituted with R
D at position 69 can be substituted with N or Y
P at position 71 can be substituted with S
V at position 108 can be substituted with D
null (-) at position 112 can be substituted with S
null (-) at position 134 can be substituted with S
S at position 135 can be substituted with D or G
T at position 136 can be substituted with H
V at position 137 can be substituted with A or G Gly Gly Asn Ile Xaa Xaa Xaa Xaa Val His (SEQ ID NO: 50250)

Xaa Asp Xaa Xaa Arg Xaa Ser (SEQ ID NO: 50251)

FIGURE 57 (Continued)

Gln Xaa Trp Asp Ser Xaa Xaa Xaa Xaa Xaa Val (SEQ ID NO: 50252)
Gly Gly Asn Asn Ile Gly Arg Lys Asn Val His (SEQ ID NO: 50723)
Arg Asp Ser Asp Arg Pro Ser (SEQ ID NO: 50724)
Gln Val Trp Asp Ser Ser Thr Val Val (SEQ ID NO: 50725)

| Reference # | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 |
|---|---|---|---|---|---|---|---|---|---|---|---|---|---|---|---|---|---|---|---|---|---|---|---|---|---|---|
| | | | | | | | | | | | L_FR1 | | | | | | | | | | | | | | | |
| CONSENSUS | S | Y | E | L | T | Q | P | · | L | S | V | S | V | A | L | G | Q | T | A | R | I | T | C | G | G | N |
| 21-225_203B2_LC | · | · | · | · | · | · | · | · | · | · | · | · | · | · | · | · | · | · | · | · | · | · | · | · | · | · |
| 21-225_205E12_LC | · | · | · | · | · | · | · | · | · | · | · | · | · | · | · | · | · | · | · | · | · | · | · | · | · | · |
| 21-225_206B5_LC | · | · | · | · | · | · | · | · | · | · | · | · | A | · | · | · | · | · | · | · | · | A | · | · | · | · |
| 21-225_209H10_LC | · | · | · | · | · | · | · | · | · | · | · | · | · | · | · | · | · | · | · | · | · | A | · | · | · | · |
| 21-225_211H2_LC | · | · | · | · | · | · | · | · | · | · | · | · | · | · | · | · | · | · | · | · | · | · | · | · | · | · |
| 21-225_216B12_LC | · | · | · | · | · | · | · | · | · | · | · | · | · | · | T | A | · | M | · | · | · | · | · | · | · | D |
| 21-225_3E10_LC | · | · | · | · | · | · | · | · | · | · | · | · | · | · | T | A | · | M | · | · | · | · | · | · | · | · |
| 21-225_8C12_LC | · | · | · | · | · | · | · | · | · | · | · | · | · | · | · | · | · | · | · | · | · | · | · | · | · | · |

| Reference # | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 |
|---|---|---|---|---|---|---|---|---|---|---|---|---|---|---|---|---|---|---|---|---|---|---|---|---|---|---|
| | | | L_CDR1 | | | | | | | | | | | | L_FR2 | | | | | | | | | | | |
| CONSENSUS | · | · | · | N | I | G | R | · | · | · | · | · | K | N | V | H | W | Y | Q | Q | K | P | G | Q | A | P |
| 21-225_203B2_LC | · | · | · | · | · | · | · | · | · | · | · | · | · | · | · | · | · | · | · | · | · | · | · | · | S | · |
| 21-225_205E12_LC | · | · | · | · | · | · | · | · | · | · | · | · | · | · | · | · | · | · | · | · | · | · | · | · | S | · |
| 21-225_206B5_LC | · | · | · | · | · | · | S | · | · | · | · | · | · | · | · | · | · | · | · | · | · | · | · | L | · | · |
| 21-225_209H10_LC | · | · | · | · | · | · | S | · | · | · | · | · | · | · | · | · | · | · | · | · | · | · | · | L | · | · |
| 21-225_211H2_LC | · | · | · | · | · | R | · | · | · | · | · | · | · | · | · | · | · | · | · | · | · | · | · | · | · | · |
| 21-225_216B12_LC | · | · | · | · | · | · | · | · | · | · | · | · | · | A | · | · | · | · | · | · | · | · | · | · | · | · |
| 21-225_3E10_LC | · | · | · | · | · | · | · | · | · | · | · | · | · | A | · | · | · | · | · | · | · | · | · | · | D | D |
| 21-225_8C12_LC | · | · | · | · | · | · | · | · | · | · | · | · | · | · | · | · | · | · | · | · | · | · | · | · | D | D |

Table 7.6. ASGR-1 residues identified as hits via Arg/Glu scanning mutagenesis:

++++  —

| mAb | Relative Epitope Profiling Bin | ASGR1 CBD Mutations That Reduced Antibody Binding Signal (3xIQR Cutoff) | | | | | | | | | | | | | | | | | |
|---|---|---|---|---|---|---|---|---|---|---|---|---|---|---|---|---|---|---|---|
| 4A2 | A | W195 | | | | | | | | | | | | | | | | | |
| 7E11 | A | W195 | | | | | | | | | | | | | | | | | |
| 56E5 | A | W195 | | | | | | | | | | | | | | | | | |
| 7G4 | A | W195 | R263 | | | | | | | | | | | | | | | | |
| 53F7 | A | W195 | K199 | E196 | | | | | | | | | | | | | | | |
| 10G6 | A | W195 | E196 | | | | | | | | | | | | | | | | |
| 26C4 | A | W195 | P207 | | | | | | | | | | | | | | | | |
| 6G6 | A | | | | | | | | | | | | | | | | | | |
| 29H8 | A | W195 | P207 | | | | | | | | | | | | | | | | |
| 25A4 | A | | | | | | | | | | | | | | | | | | |
| 32D6 | A | W195 | K199 | | | | | | | | | | | | | | | | |
| 198D2 | unknown | W195 | E196 | H204 | | | | | | | | | | | | | | | |
| 4B3 | A | H203 | H204 | | | | | | | | | | | | | | | | |
| 50G9 | A | H203 | H204 | | | | | | | | | | | | | | | | |
| 60D2 | A | H203 | H204 | | | | | | | | | | | | | | | | |
| 59F2 | A | H203 | H204 | | | | | | | | | | | | | | | | |
| 60E8 | A | H203 | H204 | P220 | G251 | | | | | | | | | | | | | | |
| 65E9 | A.1 | H203 | H204 | | | | | | | | | | | | | | | | |
| 5E5 | A | K199 | W195 | R263 | | | | | | | | | | | | | | | |
| 29E2 | A | K199 | R263 | | | | | | | | | | | | | | | | |
| 45B4 | A | K199 | R263 | | | | | | | | | | | | | | | | |
| 6G7 | B | L184 | | | | | | | | | | | | | | | | | |
| 72F5 | B.1 | L184 | | | | | | | | | | | | | | | | | |
| 22G5 | B | L184 | N265 | P220 | H215 | G251 | G248 | R183 | G246 | | | | | | | | | | |
| 48B12 | B | L184 | | | | | | | | | | | | | | | | | |
| 151B9 | B | L184 | | | | | | | | | | | | | | | | | |
| 52H2 | B | L184 | P238 | H247 | G251 | P220 | | | | | | | | | | | | | |
| 149D11 | B | R170 | L184 | S171 | | | | | | | | | | | | | | | |
| 175F4 | B | R183 | | | | | | | | | | | | | | | | | |
| 147E9 | C | Y245 | P241 | D242 | G251 | E253 | Y245 | | | | | | | | | | | | |
| 61A1 | C | Y245 | P241 | Y245 | D242 | E253 | G251 | | | | | | | | | | | | |
| 184E7 | C | Y245 | E253 | P241 | | | | | | | | | | | | | | | |
| 72G9 | C | Y245 | P241 | D242 | E253 | G251 | | | | | | | | | | | | | |
| 194A4 | C | D260 | | | | | | | | | | | | | | | | | |
| 60C12 | E | R237 | D260 | R263 | | | | | | | | | | | | | | | |
| 173C11 | E | R237 | D260 | T259 | R263 | | | | | | | | | | | | | | |
| 56E3 | E.1 | R237 | T259 | R263 | N265 | D260 | P241 | R170 | | | | | | | | | | | |
| 54E9 | E.1 | R237 | T259 | N265 | R263 | D260 | P241 | E239 | | | | | | | | | | | |
| 65D5 | E | D260 | R237 | R263 | T259 | | | | | | | | | | | | | | |
| 190F8 | L | R271 | R274 | G172 | P272 | V208 | | | | | | | | | | | | | |
| 198G3 | L | R271 | R274 | G172 | | | | | | | | | | | | | | | |
| 191G10 | L | R271 | G172 | R274 | | | | | | | | | | | | | | | |
| 202A3 | unknown | R271 | G172 | N209 | | | | | | | | | | | | | | | |
| 194C1 | L | R274 | R271 | P272 | G172 | V208 | R170 | | | | | | | | | | | | |
| 176H4 | R | R271 | P272 | N265 | G172 | P241 | L249 | H247 | D242 | | | | | | | | | | |
| 197G3 | L | R274 | R271 | R170 | G172 | D243 | G248 | D216 | P272 | S171 | Q270 | L249 | E196 | D260 | H215 | D225 | D228 | G251 | E280 | P207 | H204 |
| 191G1 | L | R274 | P238 | R271 | P272 | G172 | V208 | | | | | | | | | | | | |
| 213B3 | L | P238 | R271 | R274 | P272 | G172 | | | | | | | | | | | | | |
| 218G4 | O | R274 | P238 | G172 | R271 | | | | | | | | | | | | | | | |
| 75G3 | M | R274 | R170 | G172 | V208 | | | | | | | | | | | | | | | |
| 194C10 | T | R274 | R170 | G172 | V208 | | | | | | | | | | | | | | | |
| 85F7 | M.1 | R274 | R170 | V208 | G172 | | | | | | | | | | | | | | | |
| 199A7 | N | H215 | R170 | R183 | Q270 | | | | | | | | | | | | | | | |
| 146B6 | P | T259 | N265 | P241 | | | | | | | | | | | | | | | | |
| 193E7 | Q | R263 | P207 | | | | | | | | | | | | | | | | | |
| 65C12 | Q | | | | | | | | | | | | | | | | | | |

US 11,066,472 B2

METHODS OF TREATING CARDIOVASCULAR DISEASE WITH AN ANTI-ASGR ANTIBODY OR BINDING FRAGMENTS THEREOF

CROSS REFERENCE TO RELATED APPLICATIONS

This application claims priority to U.S. Provisional Patent Application No. 62/319,740, filed Apr. 7, 2016, U.S. Provisional Patent Application No. 62/259,553, filed Nov. 24, 2015, and U.S. Provisional Patent Application No. 62/234,546, filed Sep. 29, 2015, which are incorporated herein by reference in their entirety.

REFERENCE TO THE SEQUENCE LISTING AND TABLES IN ELECTRONIC FORMAT

This application contains a Sequence Listing which has been submitted electronically in ASCII format and is hereby incorporated by reference in its entirety. Said ASCII copy, created on Sep. 20, 2016, is named APMOL017ASEQUENCE.txt and is 14,773,579 bytes in size. The present application is being filed along with a collection of Tables in electronic format. The collection of Tables is provided as four files entitled TABLE10A.txt, TABLE10B.txt, TABLE10C.txt, and TABLE10D.txt, created and last saved on Sep. 26, 2016, which are 88,431, 356,111, 699,631, and 688,275 bytes in size respectively. The information in the electronic format of the collection of Tables is incorporated herein by reference in its entirety.

FIELD

The field of this invention relates to compositions and methods related to ASGR inhibitors, including but not limited to anti-ASGR, anti-ASGR-1, and/or anti-ASGR-2 antigen binding proteins.

BACKGROUND OF VARIOUS EMBODIMENTS

Cardiovascular disease involving the heart or blood vessels remains a leading cause of global mortality. Cardiovascular disease includes coronary artery disease (CAD) which can lead to angina and myocardial infarction (MI), stroke, hypertensive heart disease, rheumatic heart disease, and other disorders of the cardiovascular system. Medicines for treating cardiovascular disease, and in particular coronary artery disease, have been introduced over the years (e.g., the small molecule class of drugs called statins and the recently approved Repatha®, an antibody targeting PCSK9).

SUMMARY OF VARIOUS EMBODIMENTS

In some aspects, the invention provides an isolated antigen binding protein that binds to human ASGR and inhibits ASGR function. In one embodiment, the invention comprises an isolated antigen binding protein that binds to human ASGR and inhibits ASGR binding to ligand. In another embodiment, the invention comprises an isolated antigen binding protein that binds to human ASGR-1 and inhibits ASGR-1 binding to ligand and/or ASGR-1 interaction with ASGR-2. In another embodiment, the invention comprises an isolated antigen binding protein that binds to human ASGR-2 and inhibits ASGR-2 binding to ligand and/or ASGR-2 interaction with ASGR-1. In yet another embodiment, the invention comprises an isolated antigen binding protein that binds to human ASGR-1 and human ASGR-2, and inhibits ASGR-1 and/or ASGR-2 binding to ligand. In some embodiments, the isolated binding protein binds specifically to human ASGR, ASGR-1 and/or ASGR-2.

In some aspects, the invention provides an isolated antigen binding protein, wherein the isolated antigen binding protein binds to human ASGR-1 and comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises two VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and two VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2 and VH CDR3 having an amino acid sequence identical to or comprising 1, 2, or 3 amino acid residue substitutions, deletions or insertions in each CDR relative to the VH of any of the sequences set forth in Tables 3-7, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2, VH CDR3, VL CDR1, VL CDR2, and VL CDR3 having an amino acid sequence identical to any of the sequences set forth in Tables 3-7. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE A. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE A, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE A. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE B. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE B, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE B. In still some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE C. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE C, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE C. In further embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in Table 6. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in Table 6, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, VH CDR3, VL CDR1, VL CDR2, and VL CDR3 having an amino acid sequence identical to any of the sequences set forth in Table 6.

In some aspects, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7. In some aspects, the invention provides an isolated antigen binding protein, wherein the antigen binding protein specifically binds human ASGR-1 and comprises a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7, and a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having any of the VH domain amino acid sequences set forth in Tables 3-7, and a light chain variable domain having any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A, and a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having any of the VH domain amino acid sequences set forth in Table A, and a light chain variable domain having any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B, and a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having any of the VH domain amino acid sequences set forth in Table B, and a light chain variable domain having any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C, and a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having any of the VH domain amino acid sequences set forth in Table C, and a light chain variable domain having any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6, and a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having any of the VH domain amino acid sequences set forth in Table 6, and a light chain variable domain having any of the VL domain amino acid sequences set forth in Table 6.

In some aspects, the invention provides an isolated antigen binding protein, wherein the antigen binding protein binds human ASGR-1 and comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Table 19B or 19C, as depicted in FIG. 55. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A, as depicted in FIG. 55, and one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Table 19B or 19C, as depicted in FIG. 55, and one or more VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises one VH CDR1, VH CDR2 or VH CDR3 having an amino acid sequence identical no more than 18 amino acid residue substitutions, insertions or deletions in each CDR relative to the VH of any of the sequences set forth in Table19A, as depicted in FIG. 55, and one VL CDR1, VL CDR2 or VL CDR3 having an amino acid sequence identical to or comprising no more than 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises one VH CDR1, VH CDR2 or VH CDR3 having an amino acid sequence identical to or comprising a conservative substitution of any of the amino acid sequences set forth in Table 19B or 19C, as depicted in FIG. 55, and one VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises two VH CDR1, VH CDR2 or VH CDR3 having an amino acid sequence identical to or comprising up to 18 amino acid residue substitutions, insertions or deletions in each CDR relative to the VH of any of the sequences set forth in Table 19A, as depicted in FIG. 55, and two VL CDR1, VL CDR2 or VL CDR3 having an amino acid sequence identical to or comprising up to 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises two VH CDR1, VH CDR2 or VH CDR3 having an amino acid sequence identical to or comprising a conservative substitution of any of the amino acid sequences set forth in Table 19B or 19C, as depicted in FIG. 55, and two VL CDR1, VL CDR2 or VL CDR3 having an amino acid sequence identical to or comprising a conservative substitution of any of the amino acid sequences set forth in Tables 20B or 20C, as depicted in FIG. 55. In some embodiments, the isolated antigen binding protein comprises the VH CDR1, VH CDR2 and VH CDR3 having an amino acid sequence identical to or comprising up to 18 amino acid residue substitutions, insertions or deletions in each CDR relative to the VH of any of the sequences set forth in Table 19A, as depicted in FIG. 55, and the VL CDR1, VL CDR2 and VL CDR3 having an amino acid sequence identical to or comprising up to 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises the VH CDR1, VH CDR2 or VH CDR3 having an amino acid sequence identical to or comprising a conservative substitution of any of the amino acid sequences set forth in Table 19B or 19C, as depicted in FIG. 55, and the VL CDR1, VL CDR2 or VL CDR3 having an amino acid sequence identical to or comprising a conservative substitution of any of the amino acid sequences set forth in Table 20B or 20C, as depicted in FIG. 55.

In some aspects, the invention provides an isolated antigen binding protein, wherein the antigen binding protein specifically binds human ASGR-1 and comprises a heavy chain variable domain having at least 90% identity to any of the VH domain amino acid sequences set forth in Tables 19A, as depicted in FIG. 55 or in Tables 21-34 as depicted in FIG. 56 or in Tables 49-95 as depicted in FIG. 57. In some aspects, the invention provides an isolated antigen binding protein, wherein the antigen binding protein specifically binds human ASGR-1 and comprises a light chain variable domain having at least 90% identity to any of the VL domain amino acid sequences set forth in Table 20A, as depicted in FIG. 55, or in Tables 35-48, as depicted in FIG. 56 or in Tables 96-134 as depicted in FIG. 57. In some embodiments, the antigen binding protein comprises a heavy chain variable domain having at least 90% identity to any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having at least 90% identity to any of the VL domain amino acid sequences set forth in Table 20A as depicted in FIG. 55 or in Tables 35-48 as depicted in FIG. 56 or in Tables 96-134 as depicted in FIG. 57. In some embodiments, the antigen binding protein comprises a heavy chain variable domain having any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having any of the VL domain amino acid sequences set forth in Table 20A as depicted in FIG. 55 or in Tables 35-48 as depicted in FIG. 56 or in Tables 96-134 as depicted in FIG. 57.

In some aspects, the invention provides an antigen binding protein that specifically binds to human ASGR-1 at an epitope that is bound by any of the antigen binding proteins disclosed herein. In some embodiments, the invention provides an isolated antigen binding protein that specifically binds to human ASGR-1 at an epitope that is bound by at least one of the antigen binding proteins set forth in Tables 2-7. In some embodiments, the invention provides an isolated antigen binding protein that specifically binds to human ASGR-1 at an epitope that is bound by at least one of the antigen binding proteins set forth in Table A. In some embodiments, the invention provides an isolated antigen binding protein that specifically binds to human ASGR-1 at an epitope that is bound by at least one of the antigen binding proteins set forth in Table B. In some embodiments, the invention provides an isolated antigen binding protein that specifically binds to human ASGR-1 at an epitope that is bound by at least one of the antigen binding proteins set forth in Table C. In some embodiments, the invention provides an isolated antigen binding protein that specifically binds to human ASGR-1 at an epitope that is bound by at least one of the antigen binding proteins set forth in Table 6.

In some aspects, the invention provides an isolated antigen binding protein that competes for binding to human ASGR-1 with any of the antigen binding proteins disclosed herein. In some embodiments, the invention provides an isolated antigen binding protein that competes for binding with any of the antigen binding proteins set forth in Tables 2-7. In some embodiments, the invention provides an isolated antigen binding protein that competes for binding with any of the antigen binding proteins set forth in Table A. In some embodiments, the invention provides an isolated antigen binding protein that competes for binding with any of the antigen binding proteins set forth in Table B. In still some embodiments, the invention provides an isolated antigen binding protein that competes for binding with any of the antigen binding proteins set forth in Table C. In yet another embodiment, the invention provides an isolated antigen binding protein that competes for binding with any of the antigen binding proteins set forth in Table 6.

In some aspects, the invention provides an isolated antigen binding protein that binds to human ASGR-1 within the carbohydrate recognition domain ("CRD") (also known as the carbohydrate binding domain or "CBD") and inhibits human ASGR-1 binding to ligand. In some embodiments, the antigen binding protein binds to human ASGR-1 within residues 148-291, or 149-291, or 150-291, or 151-291, or 152-291, or 153-291, or 154-291, or 155-291 of SEQ ID NO:5. In some embodiments, the invention comprises an isolated antigen binding protein that binds to human ASGR-1 CBD within Helix α-1. In some embodiments, the invention comprises an isolated antigen binding protein that binds to human ASGR-1 within residues 174-186 of SEQ ID NO:5. In some embodiments, the invention comprises an isolated antigen binding protein that binds to human ASGR-1 CBD within Helix α-2. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 within residues 237-273 or residues 240-267 of SEQ ID NO:5. In some embodiments, the antigen binding protein binds to ASGR-1 having an amino acid sequence that is at least 90% identical to SEQ ID NO:5. In some embodiments, the antigen binding protein is an antibody.

In some aspects, the invention provides an isolated antigen binding protein or an antibody that binds to human ASGR-1 and inhibits human ASGR-1 function. In some embodiments, the isolated antigen binding protein or an antibody binds to human ASGR-1 and inhibits human ASGR-1 from binding to a ligand. In some embodiments, the antigen binding protein or antibody or a paratope in an antibody binds to human ASGR-1 at an epitope comprising at least one of the following amino acid residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, R264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, T260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, or R263 (SEQ ID NO:5). In some embodiments, the antigen binding protein or antibody or a paratope in an antibody binds to human ASGR1 at an epitope comprising at least one of the following amino acid residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, the antigen binding protein or antibody or a paratope in an antibody binds to human ASGR-1 at an epitope comprising at least one of the following amino acid residues: W167, S171, G172, K173, A174, A176, D177, N180, Y181, R183, L184, E185, D186, Q270, P272, or W275 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, or R274 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, or R263 (SEQ ID NO:5). In some embodiments, the antigen binding protein or paratope in an antibody binds to human ASGR-1 at an epitope comprising at least one of the following amino acid residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, or R263 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, or G252 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments, the antigen binding protein or antibody or a paratope in an antibody binds to human ASGR-1 at an epitope comprising at least one of the following amino acid residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5).

In some aspects, the invention provides an isolated antigen binding protein or an antibody or a paratope in an antibody that specifically binds to human ASGR-1 and inhibits human ASGR-1 function. In some embodiments, the isolated antigen binding protein or an antibody or a paratope in an antibody specifically binds to human ASGR-1 and inhibits human ASGR-1 from binding to a ligand. In some embodiments, the antigen binding protein or antibody or a paratope in an antibody specifically binds to human ASGR-1 within residues 148-291 of SEQ ID NO:5. In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5).

In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R237, Q240, D242, W244, E253, N265, D266, D267, N209, P238, E239, P241, D243, Y245, G246, H247, G252, C255, H257, T259, V268, R271, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R237, Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments when the antigen binding protein or antibody is bound to human ASGR-1, the antigen binding protein or antibody or a paratope in an antibody is positioned 5 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments when the antigen binding protein or a paratope in an antibody is bound to human ASGR-1, the antigen binding protein or antibody or a paratope in an antibody is positioned 5 angstroms or less from at least one of the following residues: R170, S171, G172, A174, H204, I205, G206, P207, V208, N209, H257, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, Q231, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, R274, V156, W158, V159, H161, W167, F168, S169, K173, (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments when the antigen binding protein or a paratope in an antibody is bound to human ASGR-1, the antigen binding protein or antibody or a paratope in an antibody is positioned 5 angstroms or less from at least one of the following residues of human ASGR-1 (SEQ ID NO:5): H161, E162, W195, E196, Q198, K199, F200, Q202, H203, H204, G232, F233, K234, N235, W236, R237, P238, D261, G262, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W167, S171, G172, K173, A174, A176, D177, N180, Y181, R183, L184, E185, D186, Q270, P272, or W275 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments when the antigen binding protein or antibody or a paratope in an antibody is bound to human ASGR-1, the antigen binding protein or or a paratope in an antibody is positioned 5 angstroms or less from at least one of the following residues: R170, W195, E196, K199, Q202, H203, H204, I205, G206, P207, V208, F233, K234, N235, W236, P238, D260, D261, G262, R263, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, S194, W195, E196, Q198, K199, F200, Q202, H203, F233, K234, N235, W236, R237, P238, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, T193, S194, W195, E196, K199, Q202, T231, G232, F233, K234, N235, P238, D261, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: T193, S194, W195, E196, P220, W221, G226, T227, D228, Y229, E230, T231, G232, F233, K234, N235, W236, R237, P238, E239, or G252 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N157, R170, S171, G172, Q202, H203, H204, I205, G206, P207, V208, N209, T210, D260, R271, P272, Y273 or R274 (SEQ ID NO:5).

In some aspects, the invention comprises an isolated antigen binding protein or antibody that specifically binds to human ASGR-1 and inhibits human ASGR-1 function. In some embodiments, the isolated antigen binding protein or antibody that specifically binds to human ASGR-1 inhibits binding of human ASGR-1 binding to a ligand. In some embodiments, the antigen binding protein or antibody specifically binds to human ASGR-1 at a location that overlaps with a location where a ligand binds to human ASGR-1. In some embodiments, the location where a ligand binds to ASGR-1 includes at least one amino acid residue selected from the group consisting of: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments, an isolated antigen binding protein or an antibody specifically binds to human ASGR-1 at a location that overlaps with a location that a ligand binds to ASGR-1. In some embodiments, the location that a ligand binds to human ASGR-1 includes at least one amino acid residue selected from the group consisting of: N209, R237, Q240, D242, W244, E253, H257, T259, N265, D266, D267, and Y273 (SEQ ID NO:5).

In some aspects, the invention comprises an isolated antigen binding protein that binds to human ASGR-1 and inhibits human ASGR, ASGR-1 and/or ASGR-2 function, wherein the antigen binding protein does not bind to a variant ASGR-1 protein, and wherein said variant ASGR-1 protein comprises a single mutation of a residue selected the group consisting of: R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, an isolated antigen binding protein or an antibody is contemplated. An antigen binding protein "does not bind" to a variant ASGR-1 protein when the measured reduction in antibody binding signal to a variant ASGR-1 protein (compared to that determined for binding to wild type ASGR-1) is statistically significant as measured by any number of methods known to one skilled in the art, such as the method described in Example 7E below. In some embodiments, the variant ASGR-1 protein comprises a single mutation of a residue at a position selected from the group consisting of: W195, E196, K199, H203, H204, P207, P220, G251, and R263 as shown in SEQ ID NO:5. In some embodiments, the single mutation is selected from the group consisting of H203, H204, P220, and G251. In some embodiments, the single mutation is selected from the group consisting of W195, E196 and K199. In some embodiments, the single mutation is selected from the group consisting of W195, E196 and H204. In some embodiments, the single mutation is selected from the group consisting W195, K199, and R263. In some embodiments, the single mutation is selected from the group consisting of W195 and E196. In some embodiments, the single mutation is selected from the group consisting of W195 and K199. In some embodiments, the single mutation is selected from the group consisting of W195 or P207. In some embodiments, the single mutation is selected from the group consisting of W195 and R263. In some embodiments, the single mutation is selected from the group consisting of H203 and H204. In some embodiments, the single mutation is selected from the group consisting of K199 and R263. In some embodiments, the single mutation is a mutation of residue W195. In some embodiments, the variant ASGR-1 protein comprises a single mutation of a residue selected the group consisting of: R170, S171, R183, L184, H215, P220, P238, G246, H247, G248, G251, and N265 as shown in SEQ ID NO:5. In some embodiments, the single mutation is selected from the group consisting of R183, L184, H215, P220, G246, G248, G251, and N265. In some embodiments, the single mutation is selected from the group consisting of L184, P220, P238, H247, and G251. In some embodiments, the single mutation is selected from the group consisting of R170, S171, and L184. In some embodiments, the single mutation is a mutation of residue R183. In some embodiments, the single mutation is a mutation of residue L184. In some embodiments, the variant ASGR-1 protein comprises a single mutation of a residue at a position selected from the group consisting of: P241, D242, D243, Y245, G251, E253 and D260 as shown in SEQ ID NO:5. In some embodiments, the single mutation is selected from the group consisting of P241, D243, Y245, G251, E253 and D260. In some embodiments, the single mutation is selected from the group consisting of P241, D243, and E253. In some embodiments, the single mutation is a mutation of residue D260. In some embodiments, the variant ASGR-1 protein comprises a single mutation of a residue at a position selected from the group consisting or comprising:_R170, R237, E239, P241, T259, D260, R263, and N265 as shown in SEQ ID NO:5. In some embodiments, the single mutation is selected from the group consisting of R237, D260 and R263. In some embodiments, the single mutation is selected from the group consisting of R237, T259, D260 and R263. In some embodiments, the single mutation is selected from the group consisting of R170, R237, P241, T259, D260, R263 and N265. In some embodiments, the single mutation is selected from the group consisting of R237, E239, P241, T259, D260, R263 and N265. In some embodiments, the variant ASGR-1 protein comprises a single mutation of a residue at a position selected from the group consisting or comprising: R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, H215, D216, D225, D228, D243, G248, L249, G251, D260, Q270, R271, P272, R274 and E280. In some embodiments, the single mutation is selected from the group consisting of G172, V208, R271, P272 and R274. In some embodiments, the single mutation is selected from the group consisting of G172, R271 and R274. In some embodiments, the single mutation is selected from the group consisting of G172, N209, and R271. In some embodiments, the single mutation is selected from the group consisting of R170, G172, V208, R271 and P272. In some embodiments, the single mutation is selected from the group consisting of G172, V208, P238, R271, P272 and R274. In some embodiments, the single mutation is selected from the group consisting of G172, P238, R271, P272 and R274. In some embodiments, the variant ASGR-1 protein comprises a single mutation of a residue at a position selected from the group consisting or comprising:_G172, P238, R271 and R274 as shown in SEQ ID NO:5. In some embodiments, the variant ASGR-1 protein comprises a single mutation of a residue at a position selected from the group consisting or comprising: R170, G172, V208 and R274 as shown in SEQ ID NO:5. In some embodiments, the variant ASGR-1 protein comprises a single mutation of a residue at a position selected from the group consisting or comprising: R170, R183, H215 and Q270 as shown in SEQ ID NO:5. In some embodiments, the variant ASGR-1 protein comprises a single mutation of a residue at a position selected from the group consisting or comprising: P241, T259, and N265 as shown in SEQ ID NO:5. In some embodiments, the variant ASGR-1 protein comprises a single mutation of a residue at a position selected from the group consisting or comprising: P207 and R263 as shown in SEQ ID NO:5. In some embodiments, the variant ASGR-1 protein comprises a single mutation of a residue at a position selected from the group consisting or comprising: G172, P241, D242, H247, L249, N265, R271 and P272 as shown in SEQ ID NO:5. In some embodiments, the antigen binding protein or antibody does not bind to two or more variant ASGR-1 proteins, wherein the variant ASGR-1 proteins comprise the single mutations of the group individually.

In some aspects, the invention comprises a vector comprising a nucleic acid molecule as described herein. In some embodiments, the invention comprises a host cell comprising a nucleic acid molecule as described herein.

In some aspects, the invention comprises a nucleic acid molecule encoding the antigen binding protein as described herein.

In some aspects, the invention comprises a pharmaceutical composition comprising at least one antigen binding protein described herein.

In some aspects, the invention provides a method of treating or preventing a cardiovascular disease comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In some aspects, the invention provides a method of decreasing the risk of acquiring coronary artery disease or having a myocardial infarction (MI) comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of coronary artery disease or MI is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In other aspects, the invention provides a method of reducing blood LDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, blood LDL cholesterol is reduced by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of blood LDL cholesterol in the patient.

In still other aspects, the invention provides a method of reducing non-HDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, non-HDL cholesterol is reduced by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of non-HDL cholesterol in the patient.

In some aspects, the invention provides a method of increasing alkaline phosphatase ("ALP") levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, ALP levels are increased at least about 40%, at least about 45%, at least about 50%, at least about 55%, at least about 60%, at least about 65%, at least about 70%, at least about 75%, at least about 80%, at least about 85%, or at least about 90% as compared to a predose ALP level in the patient. In some embodiments, ALP levels are increased at least about 1.25×, 1.5×, 2×, 2.5×, 3×, 3.5×, 4×, 4.5×, and 5× over pretreatment.

In some aspects, the invention provides a method of antagonizing ASGR, ASGR-1 and/or ASGR-2 in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein.

BRIEF DESCRIPTION OF THE FIGURES

FIG. 1A. ASGR-1 sequence alignments of human (SEQ ID NO: 32699), cynomolgus monkey (cyno) (SEQ ID NO: 32700), dog (SEQ ID NO: 32701), pig (SEQ ID NO: 32702), rat (SEQ ID NO: 32703) and mouse ASGR-1 (SEQ ID NO: 32704). The boxed areas denoting different regions of ASGR-1 (i.e., cytoplasmic, transmembrane, and the carbohydrate binding domain (CBD; also called the carbohydrate recognition domain, or CRD) are representative of the approximate amino acid locations of these regions; the human Y273 amino acid is boxed.

FIG. 1B. Human ASGR-1 sequence alignments (SEQ ID NOS 32705-32710, respectively, in order of appearance).

FIG. 2. ASGR-2 sequence alignments of human (SEQ ID NO: 32713), cyno (SEQ ID NO: 32714), dog (SEQ ID NO: 32716), pig (SEQ ID NO: 32715), rat (SEQ ID NO: 32712) and mouse ASGR-2 (SEQ ID NO: 32711). The boxed areas denoting different regions of ASGR-2 (i.e., cytoplasmic, transmembrane, and the carbohydrate binding domain (CBD; also called the carbohydrate recognition domain, or CRD) are representative of the approximate amino acid locations of these regions.

FIG. 5. (A) The del12 variant was typed in the indicated populations a total of 41,648 CAD cases and 247,374 controls. For each cohort, the square (diamond in the case of the combined estimate) indicates the estimated odds ratio and the line shows the 95% confidence interval. There was no evidence of heterogeneity across the eight study populations (Phet=0.96). (B) Kaplan-Meier curves for survival to first myocardial infarction in carriers and non-carriers of del12 in ASGR-1 stratified by sex. The proportion of individuals that have not had a myocardial infarction is shown on the y-axis and plotted against age on the x-axis. Males and females are represented separately and a distinction is made between del12 carriers and non-carriers in each case.

Figure 6:
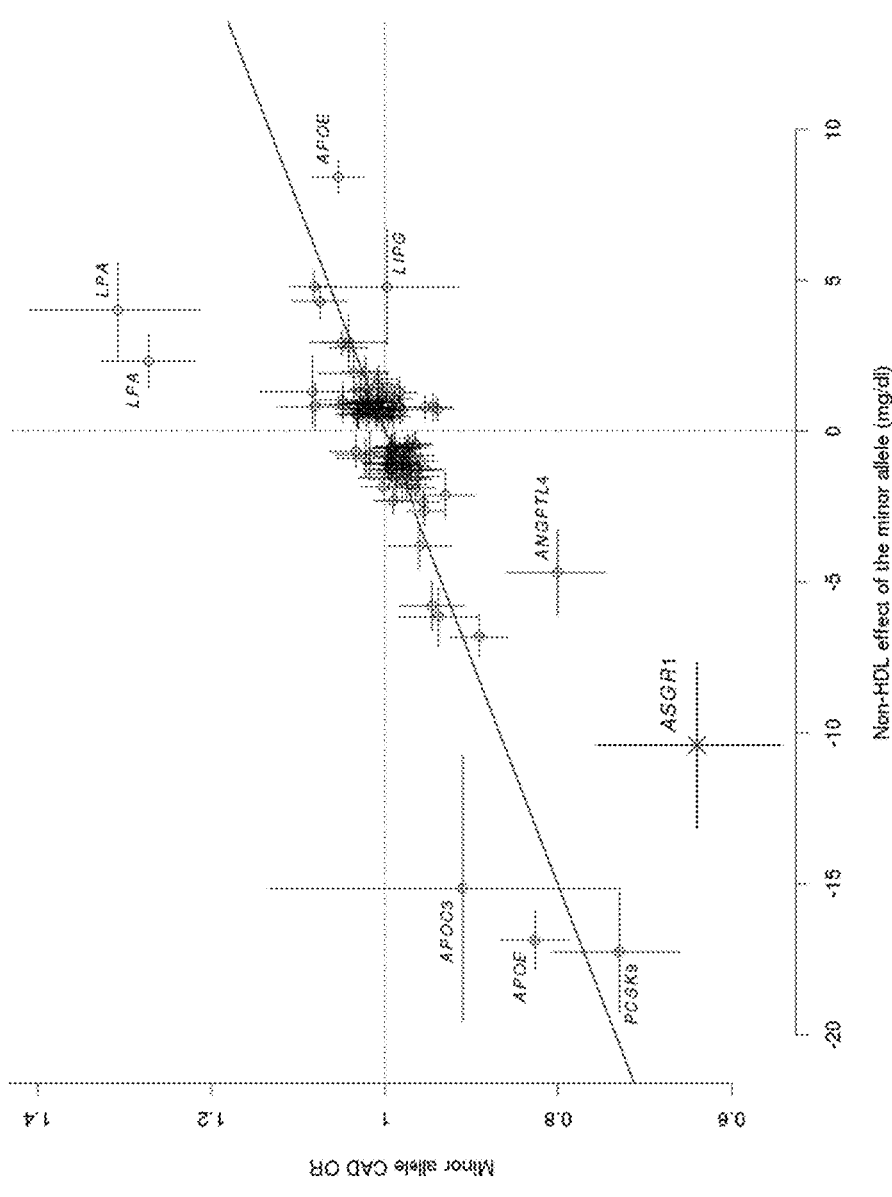

FIG. 6. Comparison of relationship between CAD and non-HDL cholesterol levels between previously identified sequence variants and del12 in ASGR-1. Based on the Icelandic population, the estimated odds ratio (OR) of the minor allele for coronary artery disease (CAD, 41,648 cases and 247,374 controls) as a function of the estimated effect of the minor allele on non-HDL cholesterol levels (N=119, 146). A full list of the sequence variants included is provided in Table 1.7. The error bars represent 95% confidence intervals. The del12 variant in ASGR-1 is shown. The line indicates the best linear regression fit through the origin.

Figure 7:
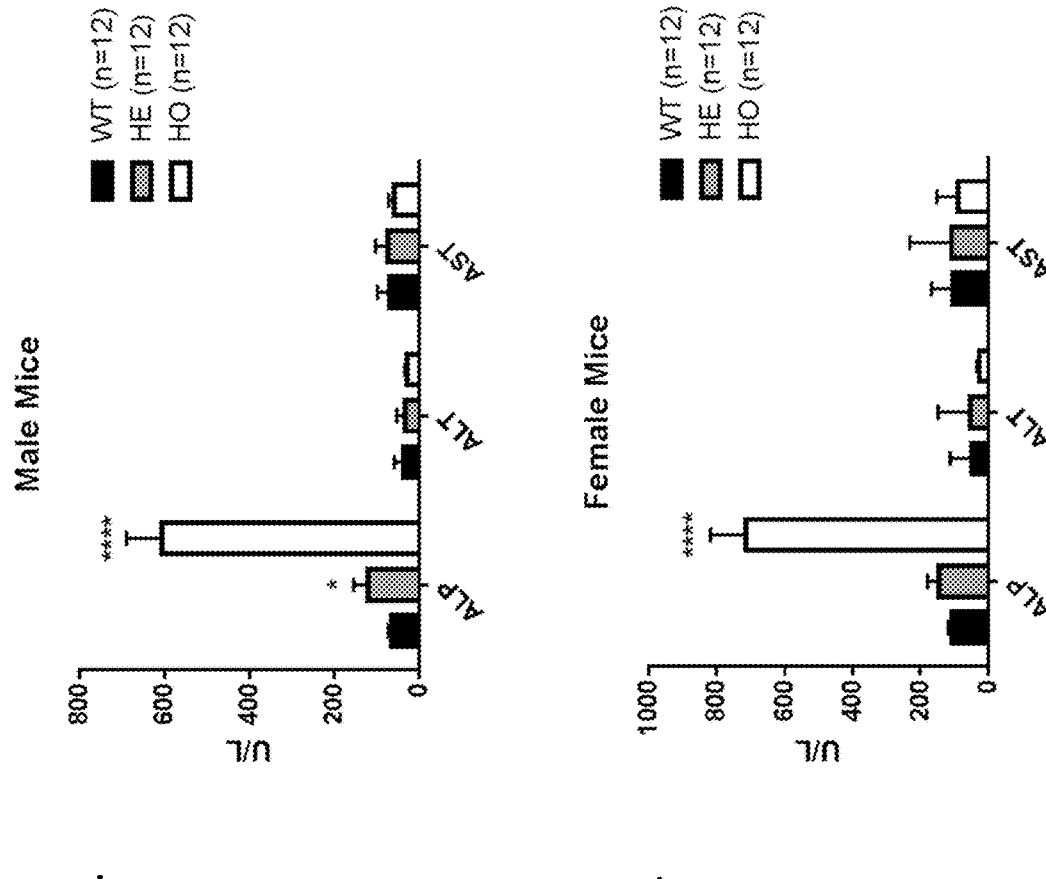

FIG. 7. Analysis of serum ALP, ALT, and AST from ASGR-1 knockout mice is provided. Panel A is data from the male mice studied and Panel B is data from the female mice.

FIG. 8. RNAi in vitro data in CHO cells transfected with hASGR-1 using construct 51662. Panel A is a western blot demonstrating reduction of expression of human ASGR-1. Panel B is a graphical representation of the relative reduction in expression of human ASGR-1. Panel C demonstrates that CHO cells receiving construct S1662 displays a dramatic reduction in internalization of ligand (β-GalNAc).

FIG. 9. RNAi in vitro data in CHO cells transfected with mASGR-1 using various constructs. Panel A is a western blot demonstrating reduction of expression of mouse ASGR-1. Panel B is a graphical representation of the relative reduction in expression of mouse ASGR-1. Panel C demonstrates that CHO cells receiving the various constructs display a dramatic reduction in internalization of ligand (β-GalNAc).

FIG. 10. RNAi in vitro data in HepG2 cells using construct S1662. Panel A is a western blot demonstrating reduction of expression of human ASGR-1. Panel B is a graphical representation of the relative reduction in expression of human ASGR-1.

FIG. 11. RNAi in vitro data in CHO cells transfected with hASGR-2 using various constructs. Panel A is a western blot demonstrating reduction of expression of human ASGR-2. Panel B is a graphical representation of the relative reduction in expression of human ASGR-2 by the various constructs.

FIG. 12. RNAi in vitro data in CHO cells transfected with mASGR-1 and mASGR-2 using various other constructs. Panel A is a western blot demonstrating reduction of expression of mouse ASGR-1 (anti-mouse ASGR-1 or anti-flag) or mouse ASGR-2 (anti-his). Panel B is a graphical representation of the relative reduction in expression of mouse ASGR-1 by the various constructs. Panel C is a graphical representation of the relative reduction in expression of mouse ASGR-2 by the various constructs.

FIG. 13. RNAi in vitro data in HepG2 cells using various constructs. Panel A is a western blot demonstrating reduction of expression of human ASGR-2. Panel B is a graphical representation of the relative reduction in expression of human ASGR-2 by the various constructs.

FIG. 14. RNAi in vivo data in in C57BL/6J mice using various constructs over the course of 7 days with three injections total, one injection at day 0, one injection at day 2 and one injection at day 4. Panel A is a graphical representation of quantitative per data showing the relative reduction in expression of mASGR-1 RNA in the liver. Panel B is a graphical representation of the relative reduction in expression of mASGR-2 RNA in the liver.

FIG. 15. RNAi in vivo data in in C57BL/6J mice using various constructs over the course of 7 days with three injections total, one injection at day 0, one injection at day 2, and one injection at day 4. Panel A is a western blot demonstrating reduction of expression of mouse ASGR-1 protein. Panel B is a graphical representation of the relative increase of serum ALP activity.

FIG. 16. RNAi in vivo data in C57BL/6J mice using various constructs over the course of 7 days with one injection at day 0. Panel A is a graphical representation of the relative reduction in expression of mASGR-2 in the liver. Panel B is a graphical representation of the relative reduction in expression of mASGR-1 in the liver.

Figure 17:
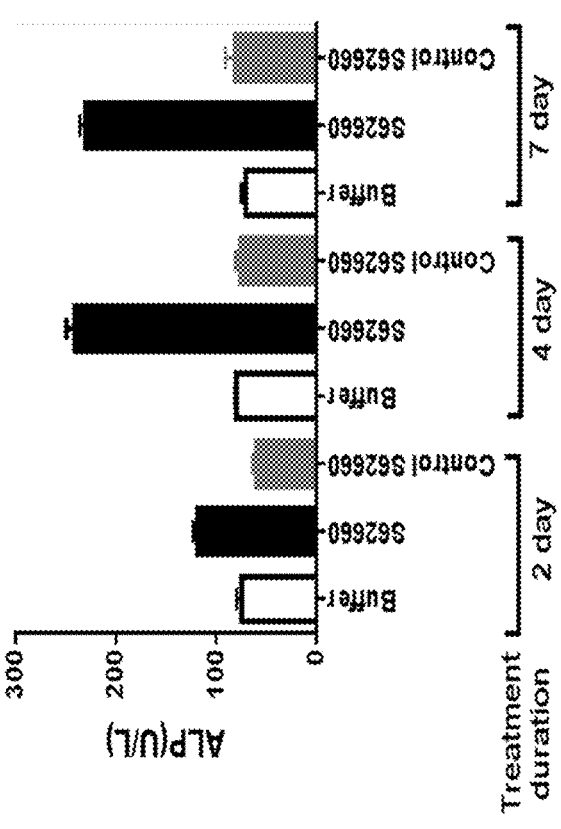

FIG. 17. RNAi in vivo data in C57BL/6J mice using various ASGR-2 constructs over the course of 7 days with one injection at day 0. The figure is a graphical representation of the relative increase in serum ALP activity.

FIG. 18. Panel A shows a computer representation of the crystal structure of the ASGR-1/lactose complex. Panel B is a computer representation of the observed electron density. Panel C is an enlarged view of the carbohydrate binding domain.

FIG. 19. Panel A shows a computer representation of the crystal structure of the ASGR-1/galactose complex. Panel B is a computer representation of the observed electron density. Panel C is an enlarged view of the carbohydrate binding domain.

Figure 20:
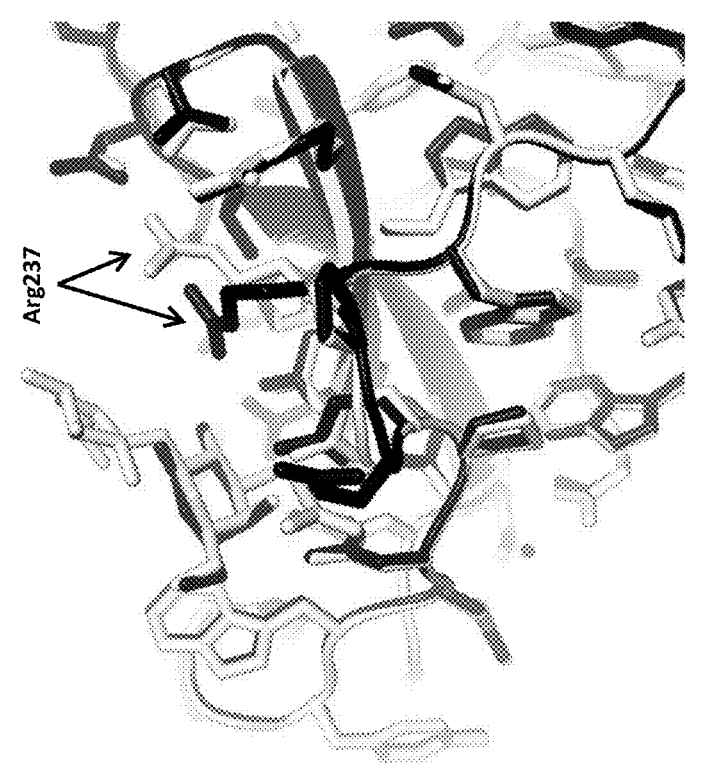

FIG. 20. A computer representation of the crystal structure of an enlarged view of the conformational difference of R237 between the ASGR-1/lactose (white) complex and ASGR-1/galactose (black) complex.

FIG. 21. Panel A shows a computer representation of the crystal structure of the ASGR-1/GalNAc complex. Panel B is a computer representation of the observed electron density. Panel C is an enlarged view of the carbohydrate binding domain.

FIG. 22. Panel A shows a depiction of the structure of the ASGR-1 CBD and the 5E5 Fab. Panel B is an enlarged view of the ASGR-1 CBD and 5E5 Fab that represents a disordered carbohydrate binding loop with a dashed line and highlights the indirect inhibition of ASGR-1 CBD and the ligand (GalNAc) binding. Panel B also incorporates a double-headed arrow which represents a 5 angstrom distance from tip to tip.

Figure 23:
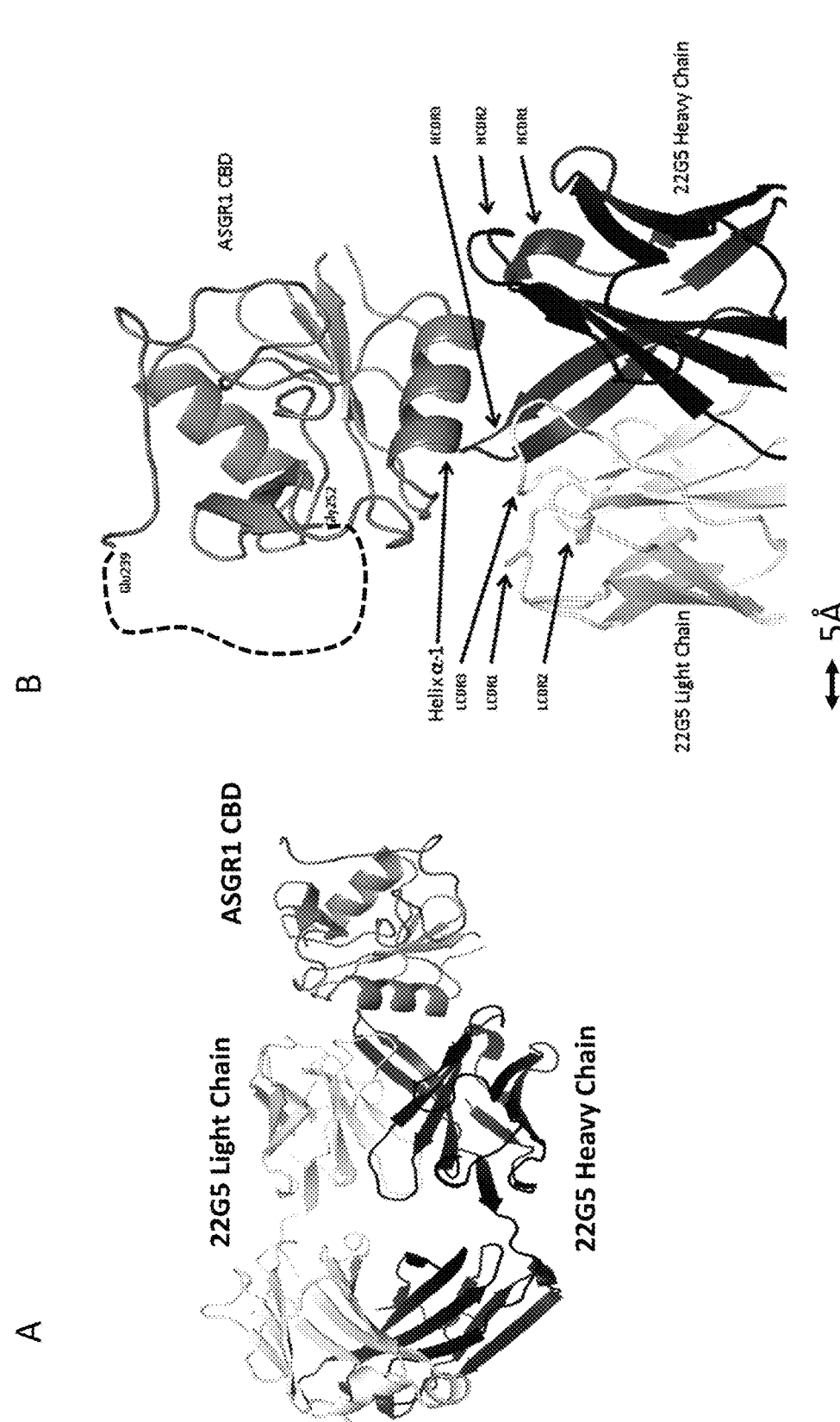

FIG. 23. Panel A shows a depiction of the structure of the ASGR-1 CB and the 22G5 Fab. Panel B is an enlarged view of the ASGR-1 CBD and 22G5 Fab that represents a disordered carbohydrate binding loop with a dashed line and highlights the indirect inhibition of ASGR-1 CBD and the ligand (GalNAc) binding. Panel B also incorporates a double-headed arrow which represents a 5 angstrom distance from tip to tip.

Figure 24:
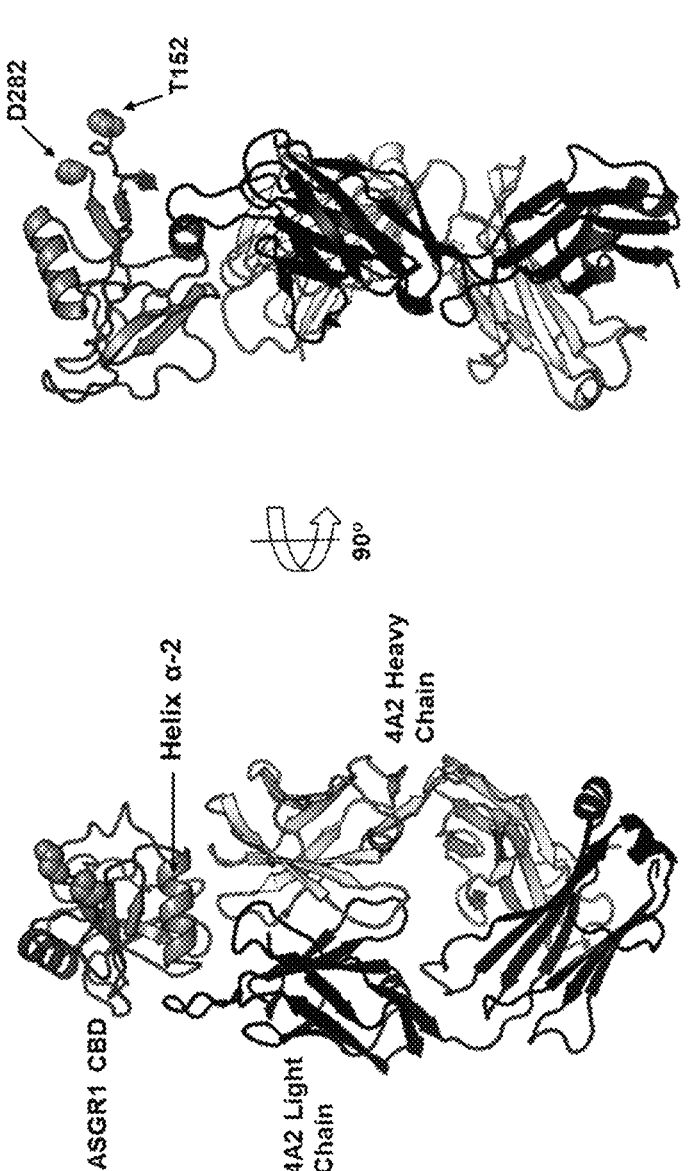

FIG. 24. A depiction of the structure of the ASGR-1 CBD and the 4A2 Fab.

Figure 25:
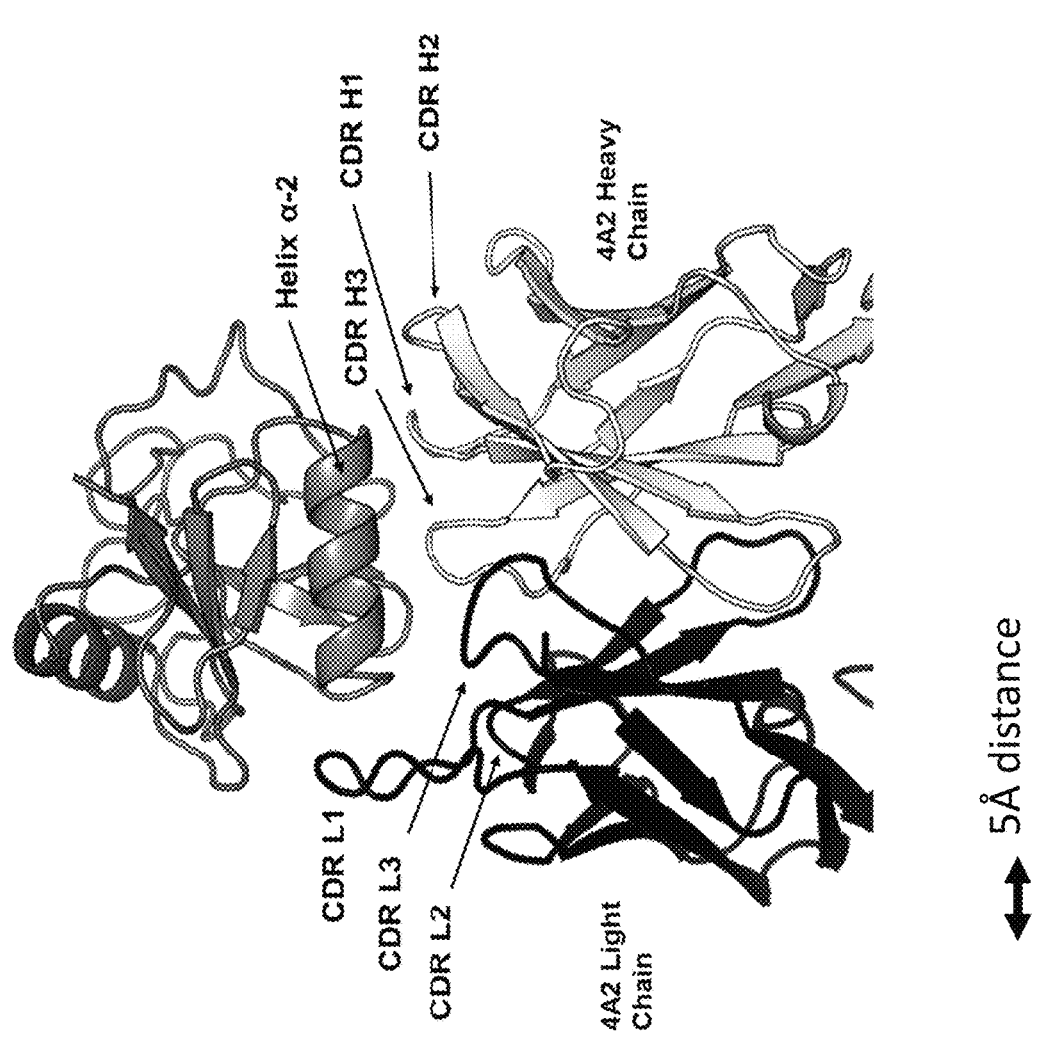

FIG. 25. An enlarged view of the structure of the ASGR-1 CBD and the 4A2 Fab that shows the CDRs of the 4A2 Fab that interact with ASGR-1 CBD Helix alpha-2 and highlights the indirect inhibition of ASGR-1 CBD and the ligand (GalNAc) binding. The figure incorporates a double-headed arrow which represents a 5 angstrom distance from tip to tip.

Figure 26:
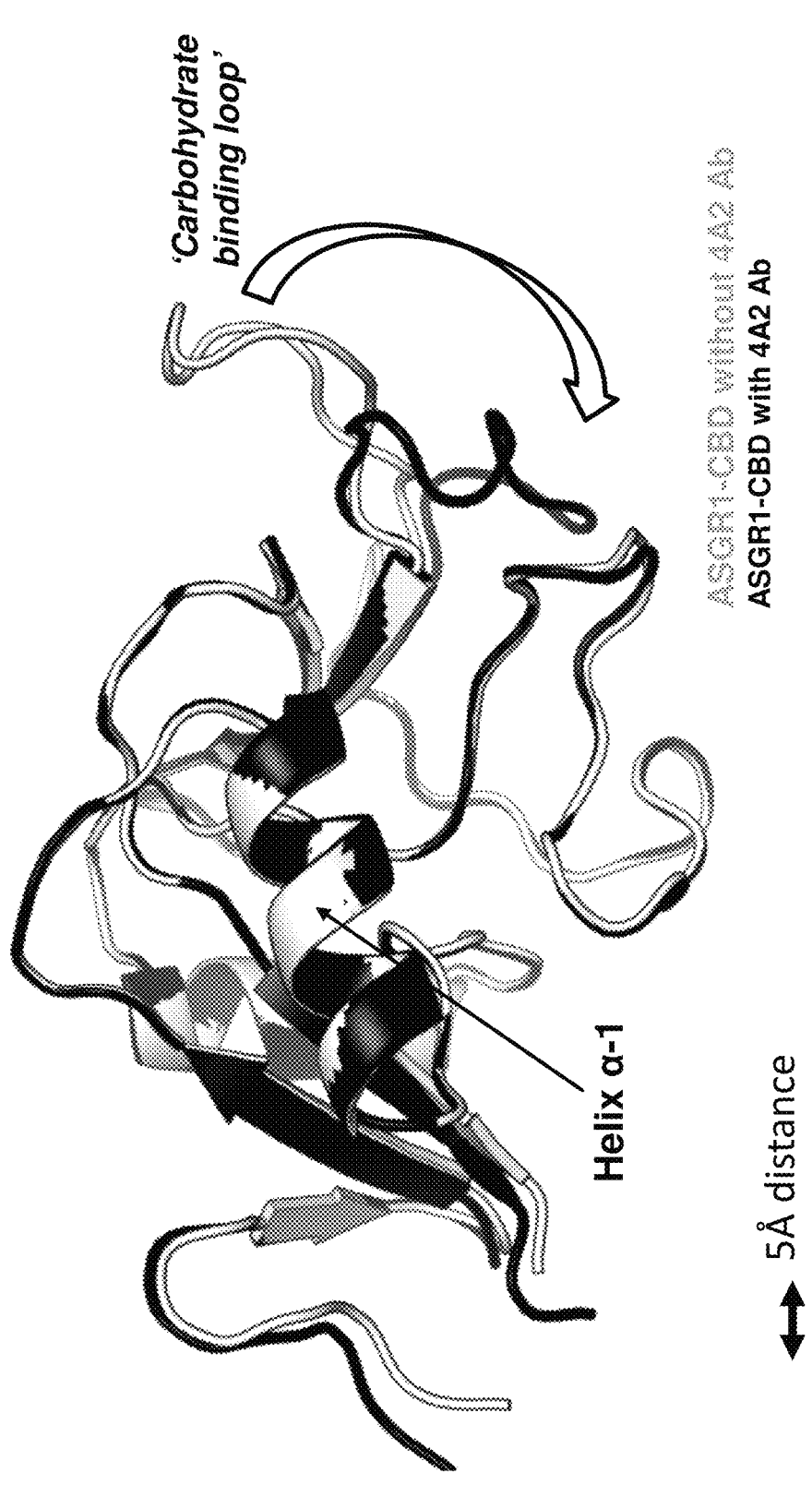

FIG. 26. An enlarged view of the structure of the ASGR-1 CBD and the carbohydrate binding loop with and without and the 4A2 Fab that includes a double-headed arrow which represents a 5 angstrom distance from tip to tip.

Figure 27:
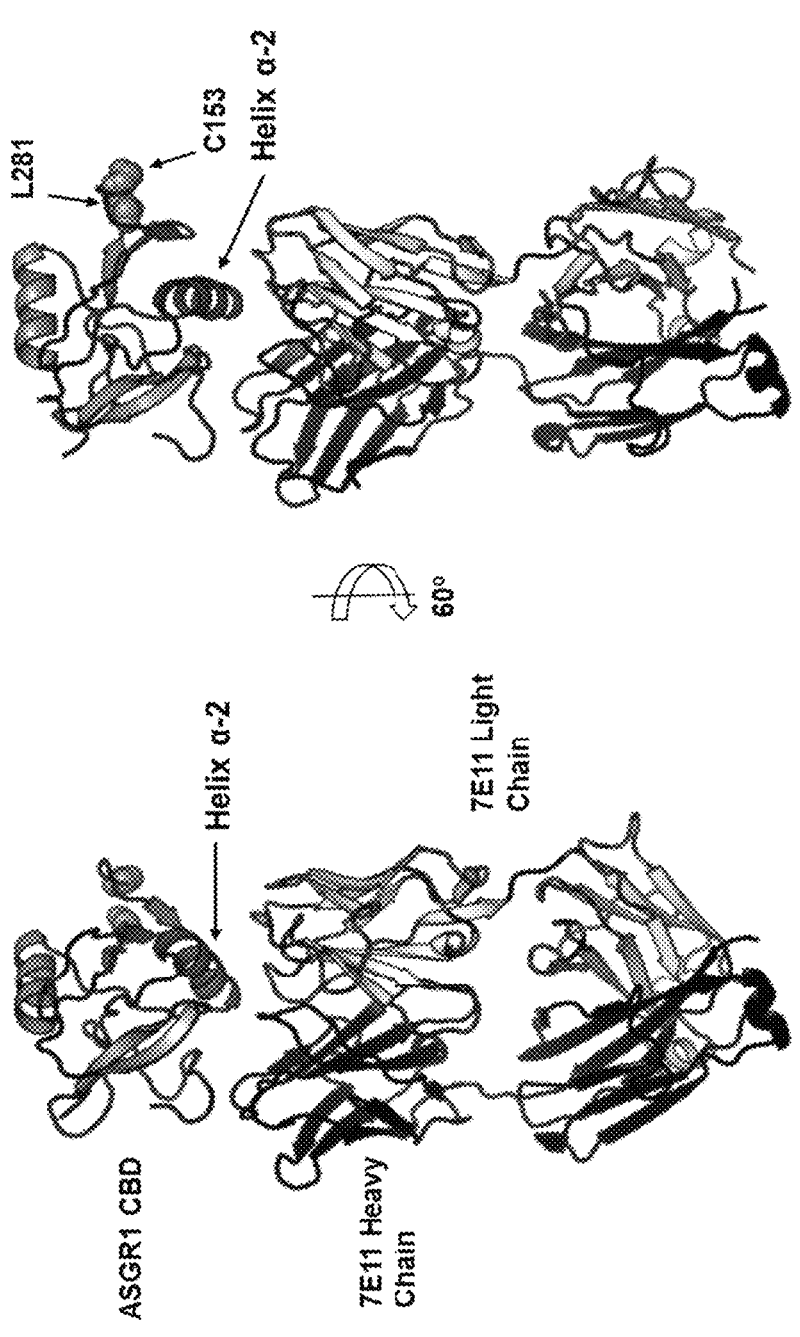

FIG. 27. A depiction of the structure of ASGR-1 CBD and the 7E11 Fab.

Figure 28:
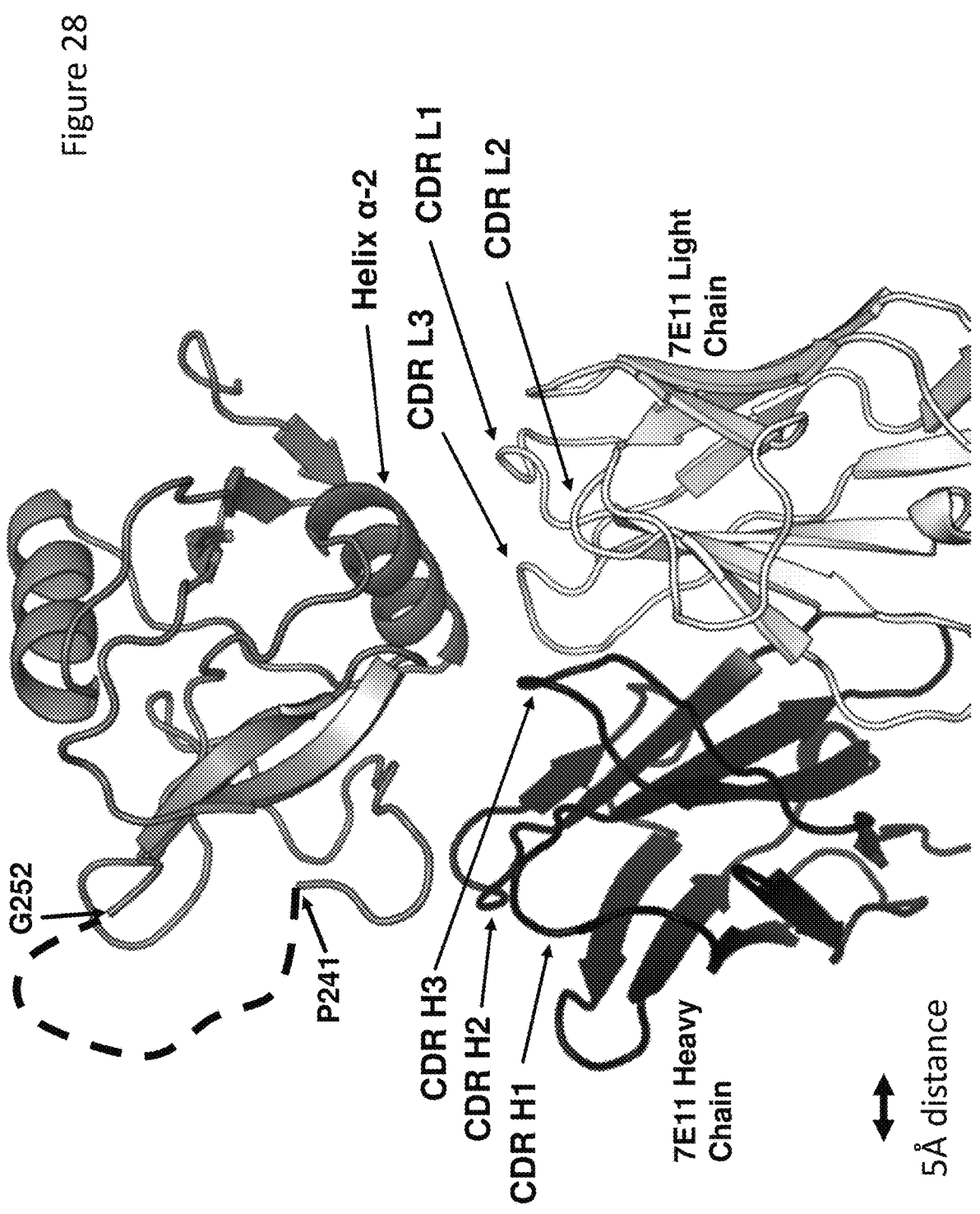

FIG. 28. An enlarged view of the structure of the ASGR-1 CBD and the 7E11 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

Figure 29:
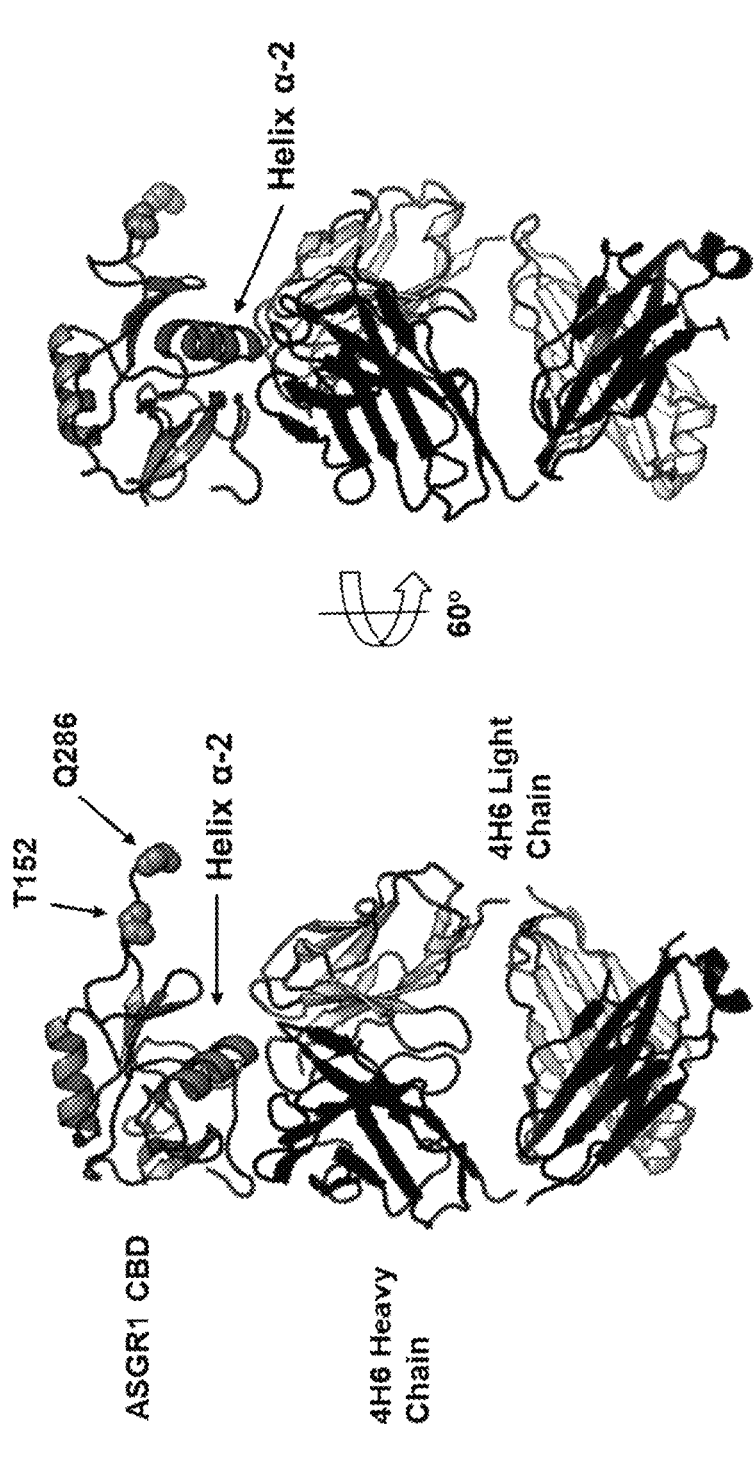

FIG. 29. A depiction of the structure of the ASGR-1 CBD and the 4H6 Fab.

Figure 30:
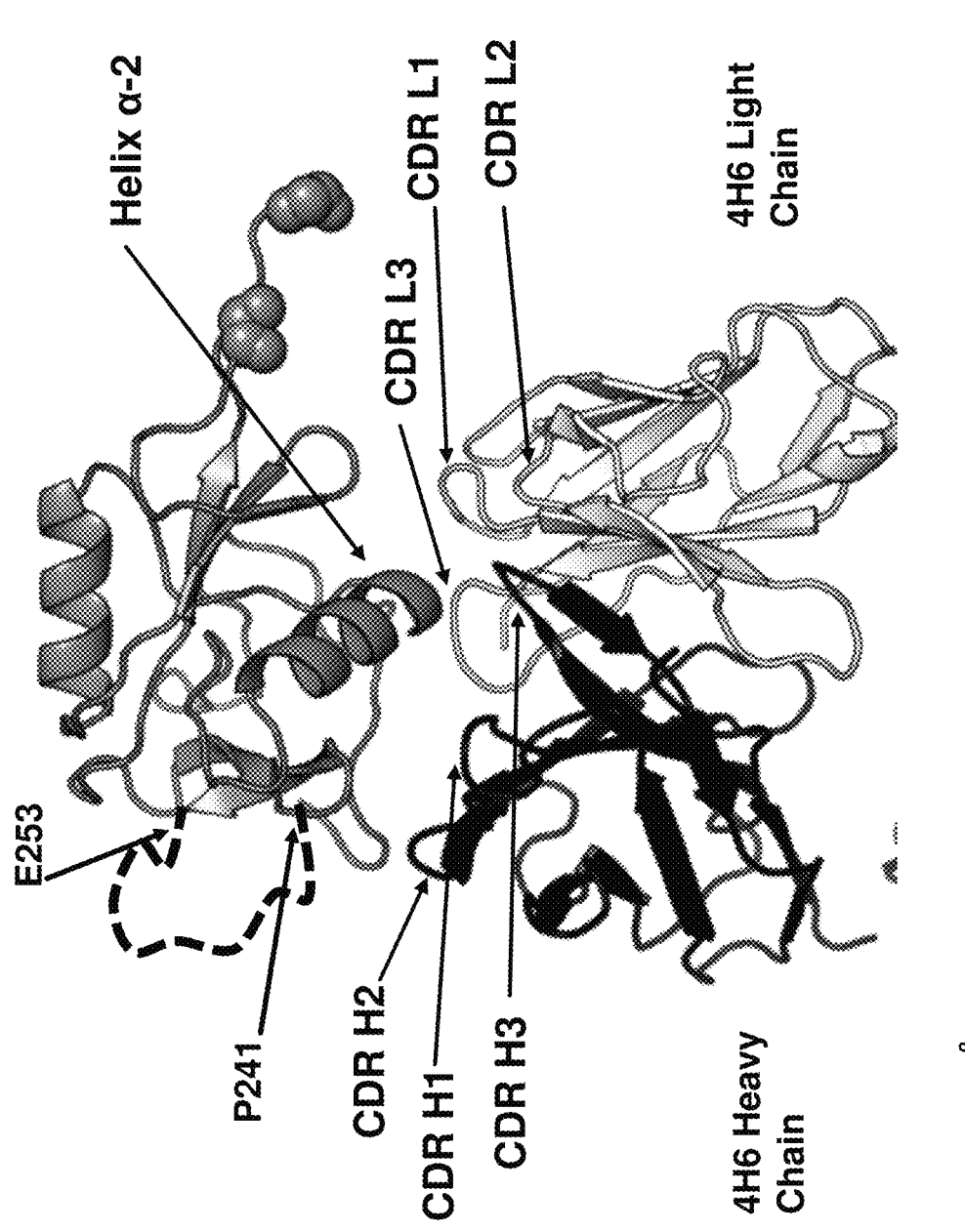

FIG. 30. An enlarged view of structure of the ASGR-1 CBD and the 4H6 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

Figure 31:
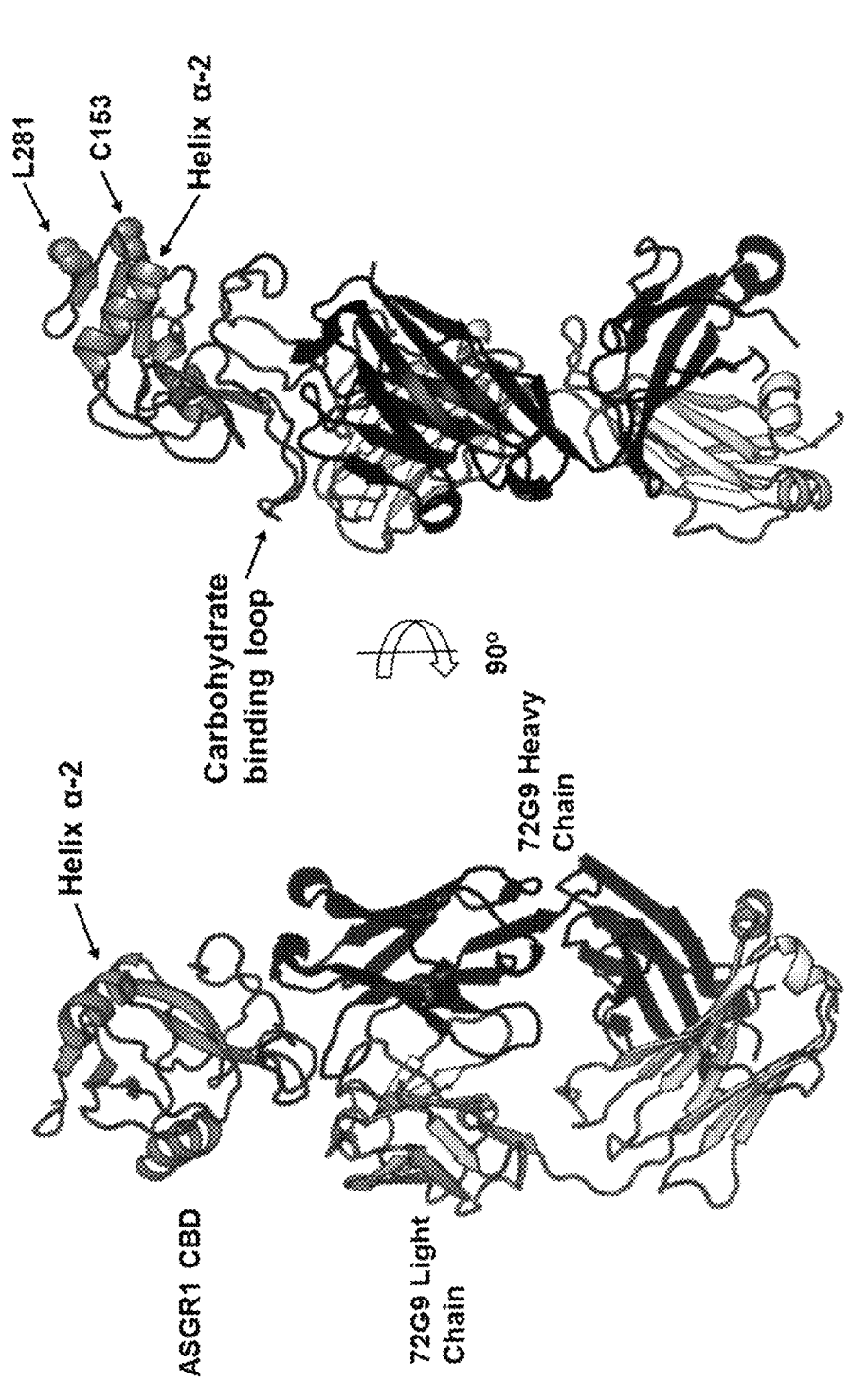

FIG. 31. A depiction of the structure of the ASGR-1 CBD and the 72G9 Fab.

Figure 32:
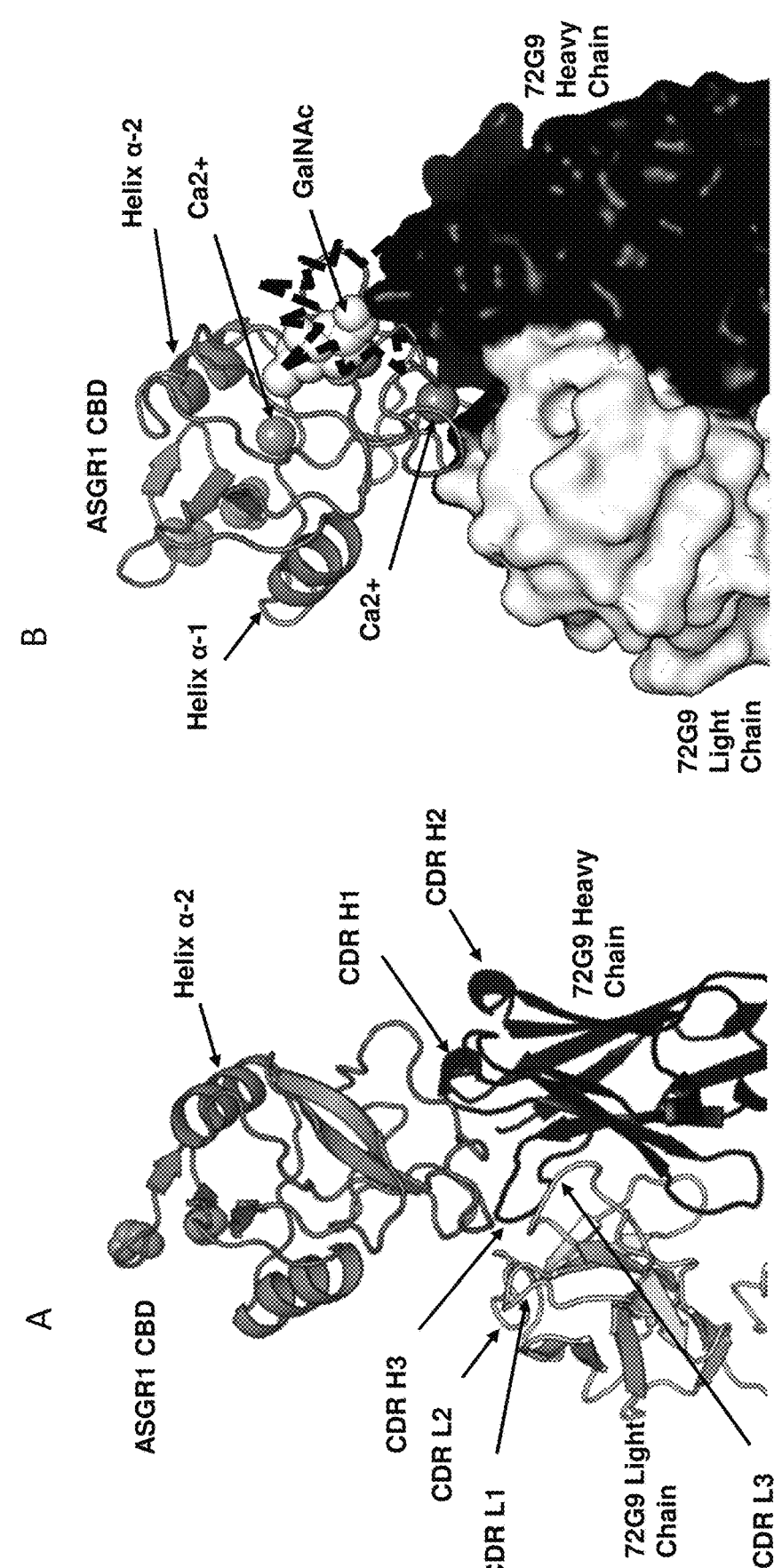

FIG. 32. Panel A is an enlarged view of the structure of ASGR-1 CBD and the 72G9 Fab; and Panel B is a depiction of the structure of ASGR-1 CBD and the 72G9 Fab that also overlays the structure of ASGR-1 CBD and the ligand and highlights the direct inhibition of ASGR-1 CBD and the ligand (GalNAc) binding.

Figure 33:
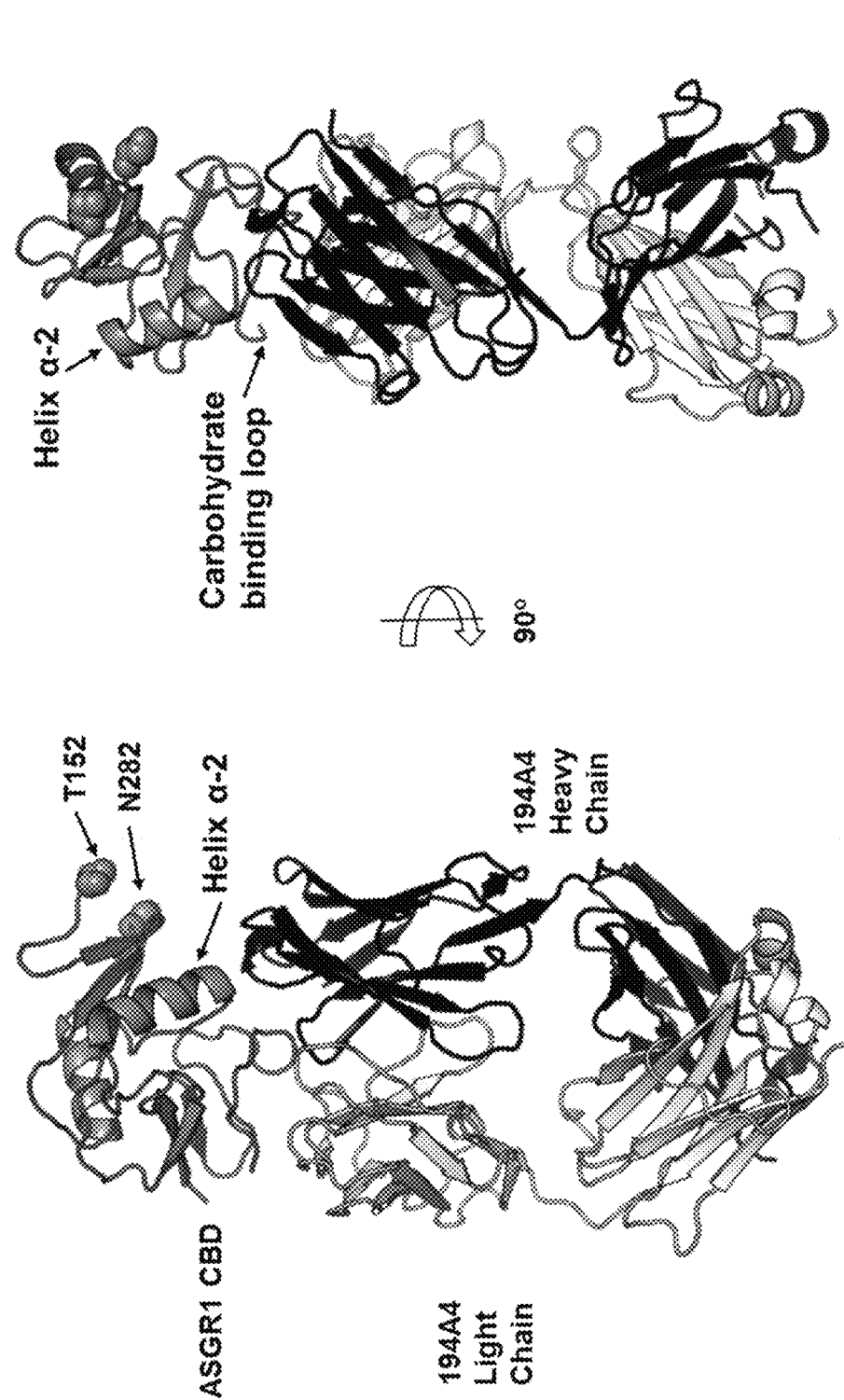

FIG. 33. A depiction of the structure of the ASGR-1 CBD and the 194A4 Fab.

Figure 34:
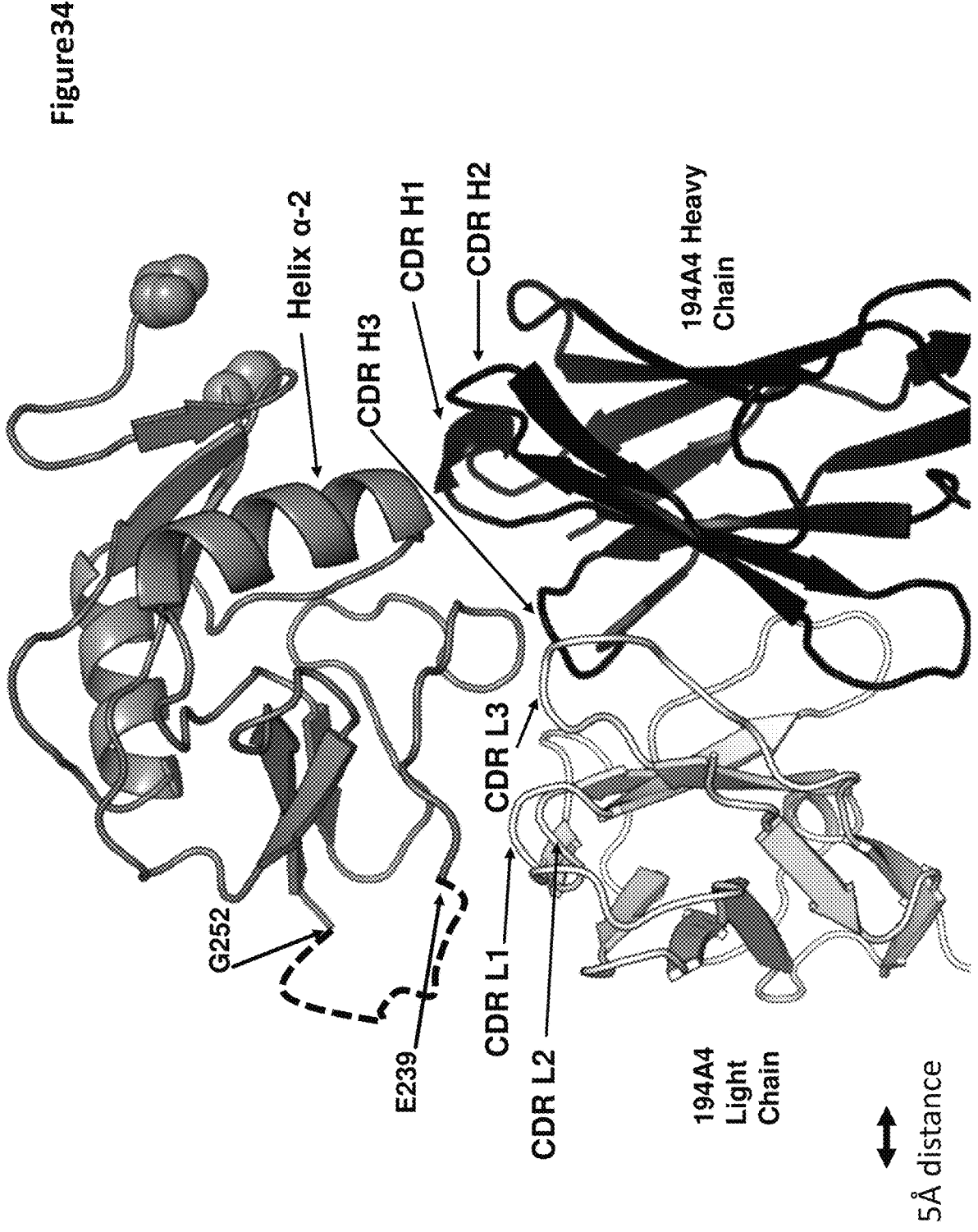

FIG. 34. An enlarged view of the structure of the ASGR-1 CBD and the 194A4 Fab. The figure represents a disordered carbohydrate binding loop with a dashed line and highlights the indirect inhibition of ASGR-1 CBD and the ligand (GalNAc) binding. The figure incorporates a double-headed arrow which represents a 5 angstrom distance from tip to tip.

FIG. 35. A depiction of the structure of the ASGR-1 CBD and the 54E9 Fab.

Figure 36:
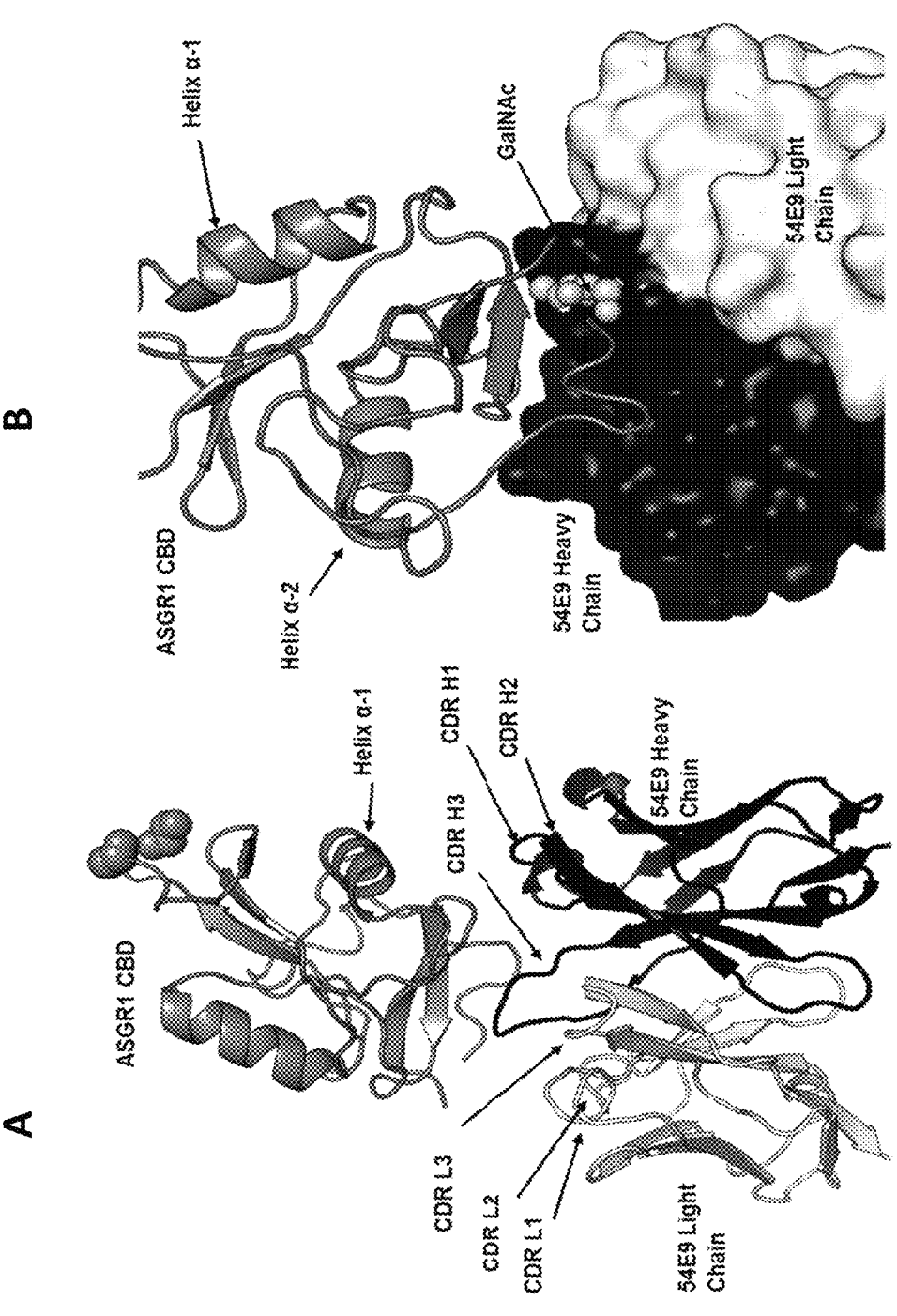

FIG. 36. Panel A is an enlarged view of the structure of the ASGR-1 CBD and the 54E9 Fab; and Panel B is a depiction of the structure of the ASGR-1 CBD and the 54E9 Fab that also overlays the structure of ASGR-1 CBD and the ligand and highlights the direct inhibition of ASGR-1 CBD and the ligand (GalNAc) binding.

FIG. 37. Panel A is a depiction of the structure of the ASGR-1 CBD and the 218G4 Fab; and Panel B is an enlarged view of the structure of the ASGR-1 CBD and the 218G4 Fab.

Figure 38:
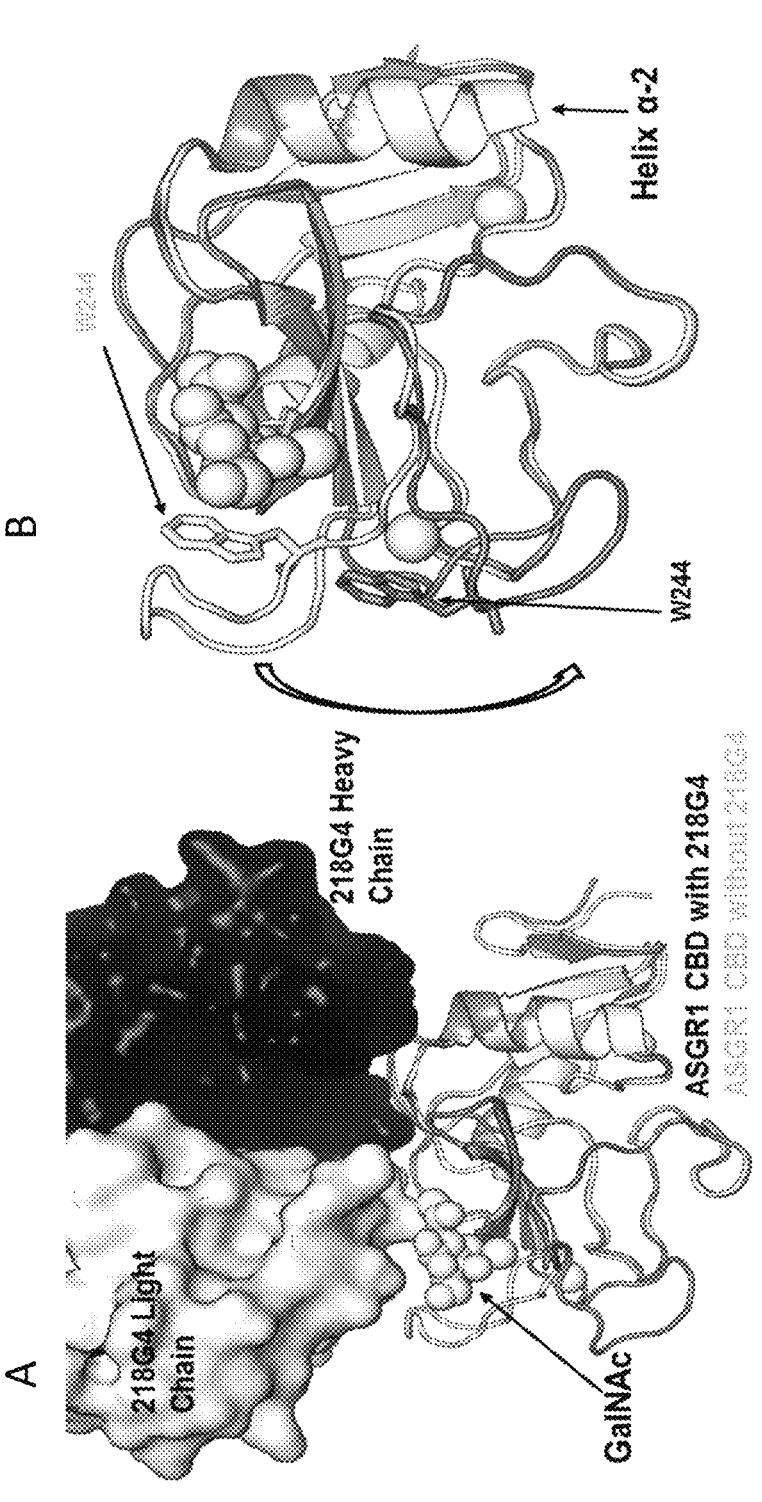

FIG. 38. Panels A and B are enlarged views of the structure of ASGR-1 CBD and the 218G4 Fab that also overlays the structure of ASGR-1 CBD and the ligand. These figures highlight the direct inhibition of ASGR-1 CBD and the ligand (GalNAc) binding when the 218G4 Fab is present.

Figure 39:
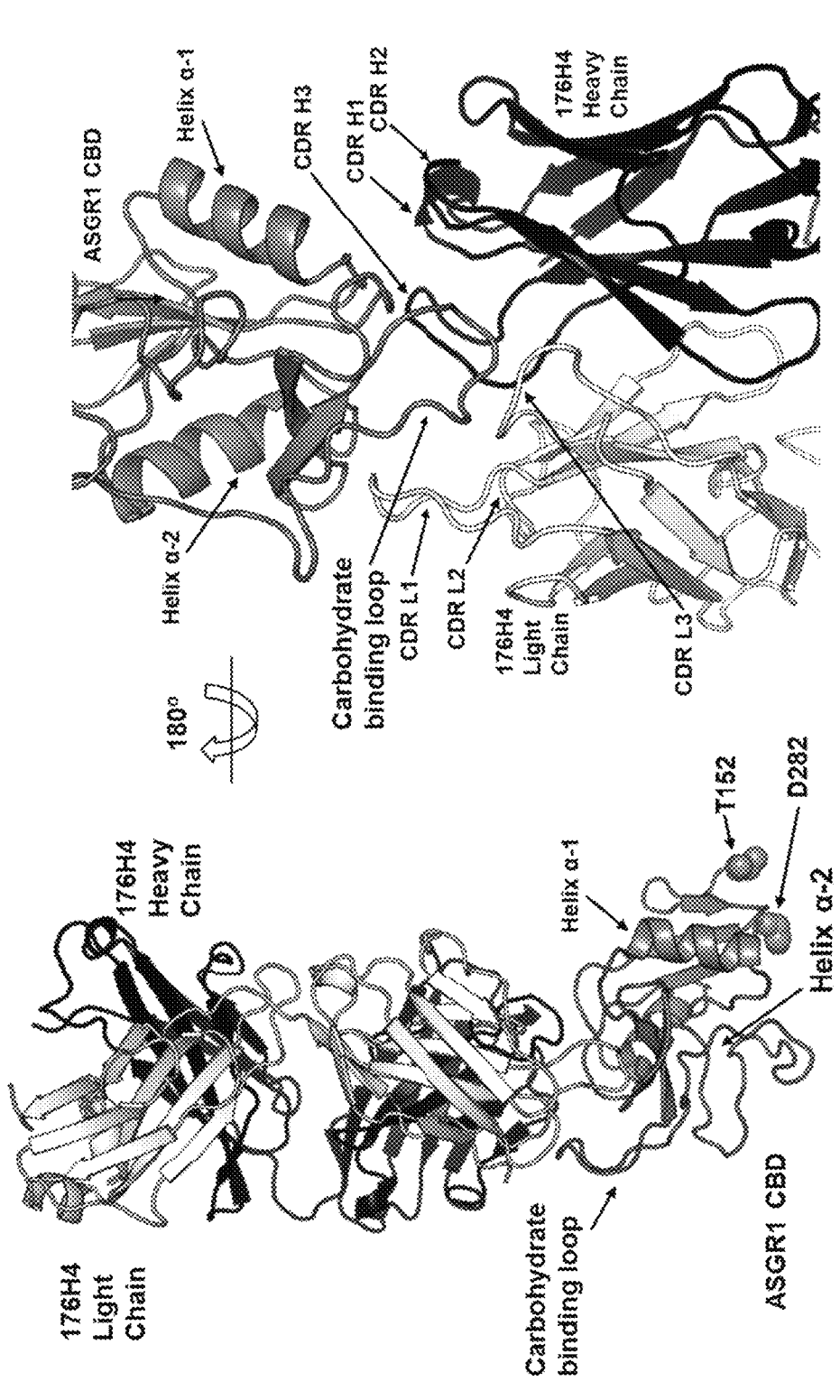

FIG. 39. A depiction of the structure of the ASGR-1 CBD and the 176H4 Fab.

Figure 40:
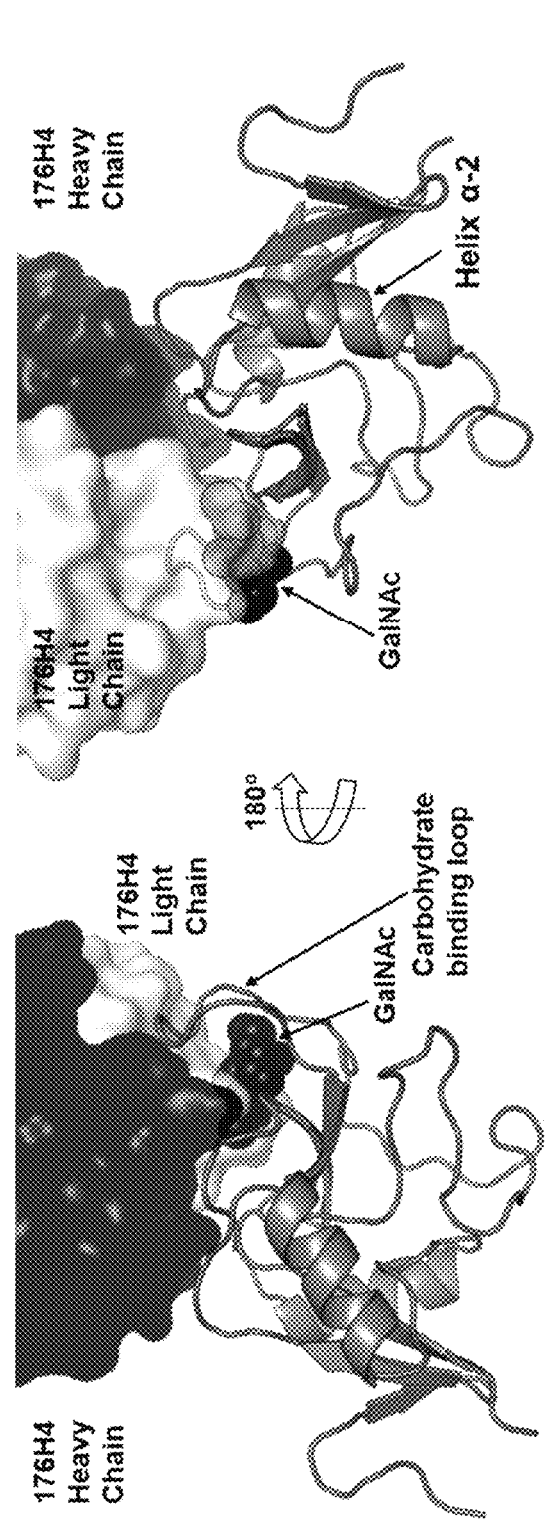

FIG. 40. An enlarged view of the structure of the ASGR-1 CBD and the 176H4 Fab that also overlays the structure of ASGR-1 CBD and the ligand. This figure highlight the direct inhibition of ASGR-1 CBD and the ligand (GalNAc) binding when the 176H4 Fab is present.

Figure 41:
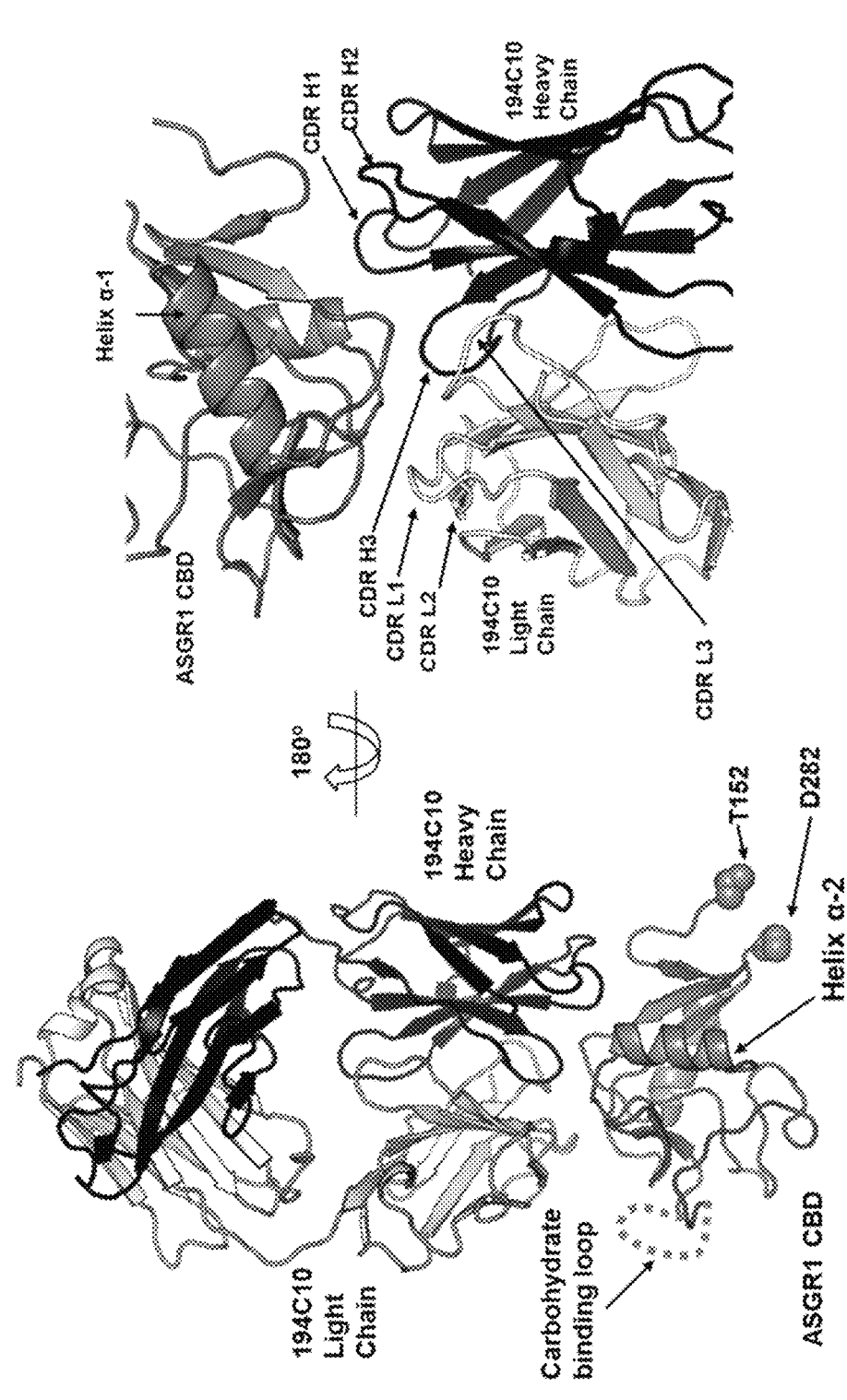

FIG. 41. A depiction of the structure of the ASGR-1 CBD and the 194C10 Fab. This figure depicts represents a disordered carbohydrate binding loop with a dashed line and highlights possible indirect inhibition of ASGR-1 CBD and the ligand (GalNAc) binding.

Figure 42:
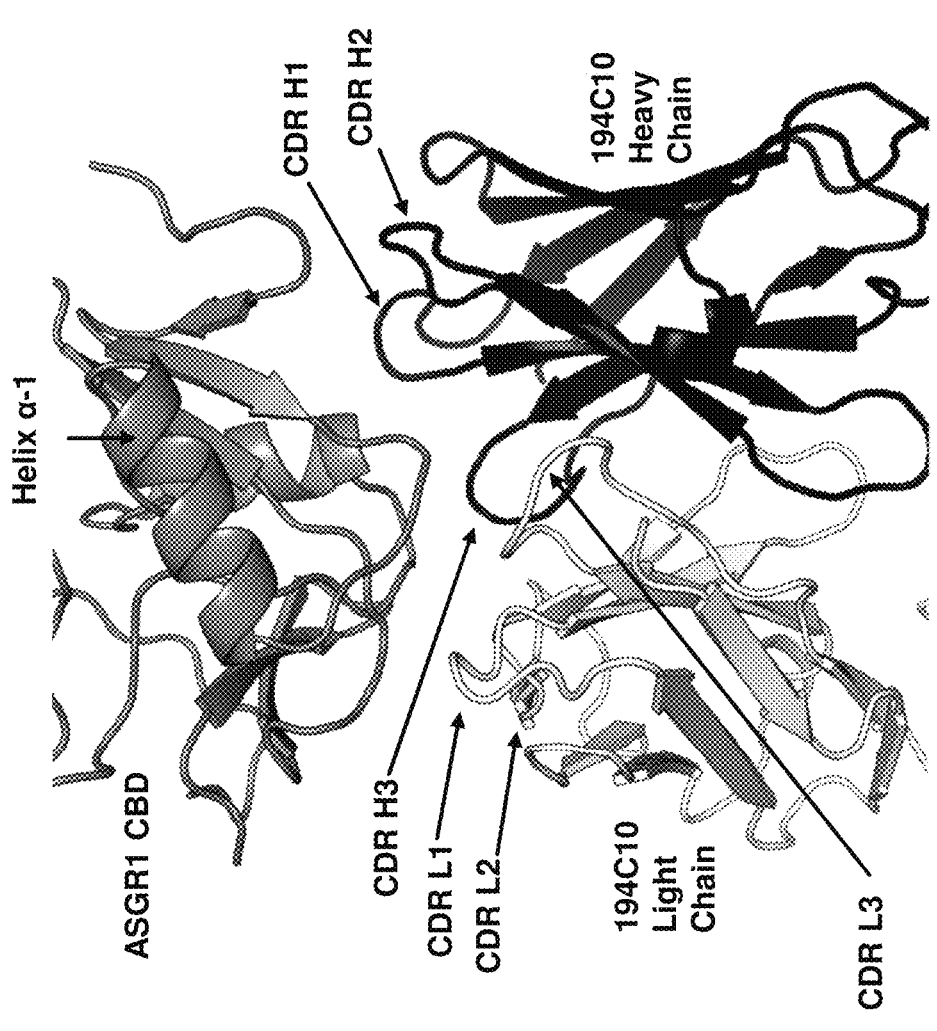

FIG. 42. An enlarged view of the structure of the ASGR-1 CBD and the 194C10 Fab. This figure shows the CDRs of the 194C10 that interact with the ASGR-1 CBD and highlights that there may be direct inhibition of the ASGR-1 CBD and the ligand (GalNAc) binding.

Figure 43:
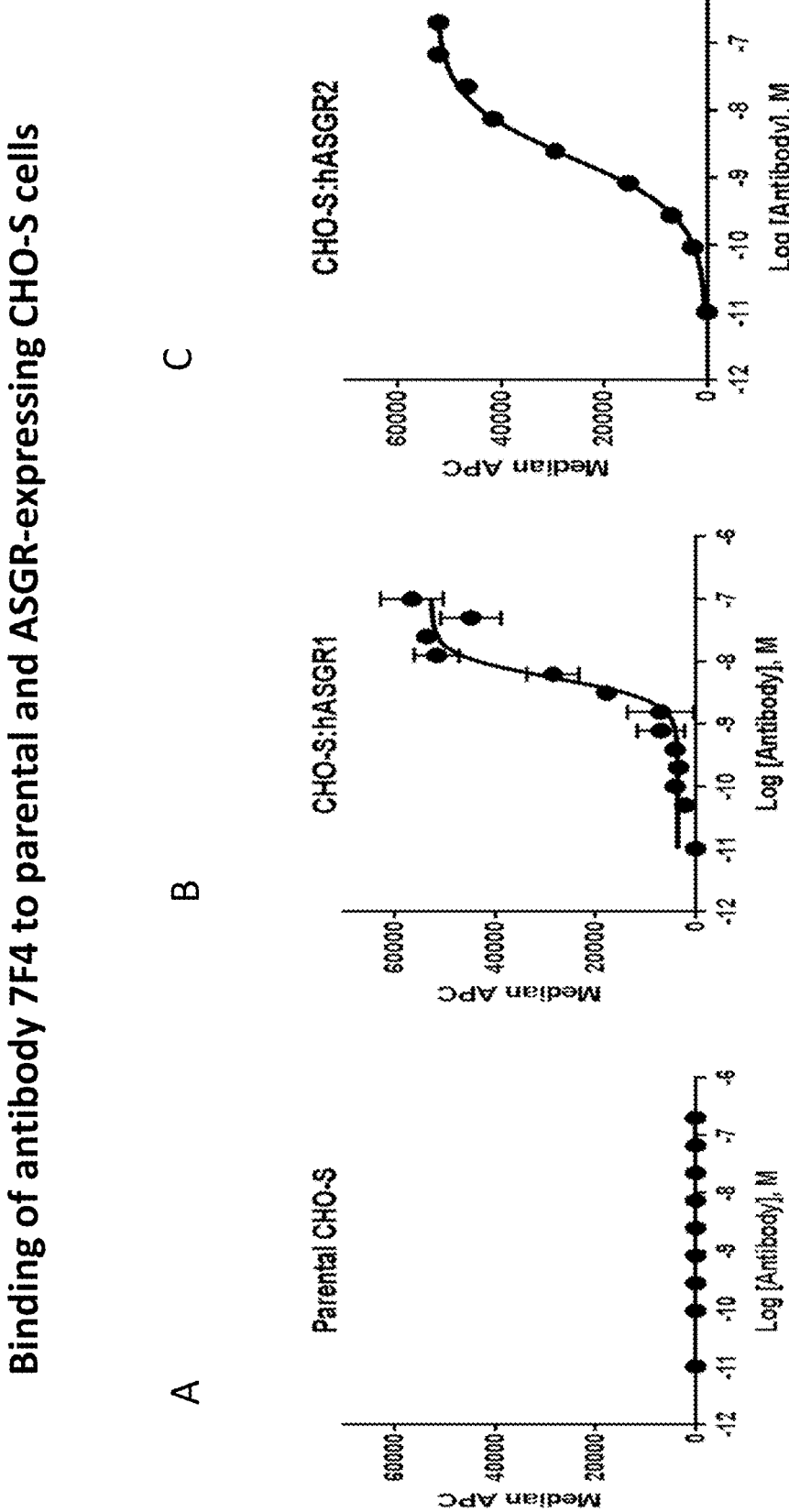

FIG. 43. Panels A-C are graphical representations showing antibody binding results from human ASGR-1 and human ASGR-2 expressing cells.

Figure 44:
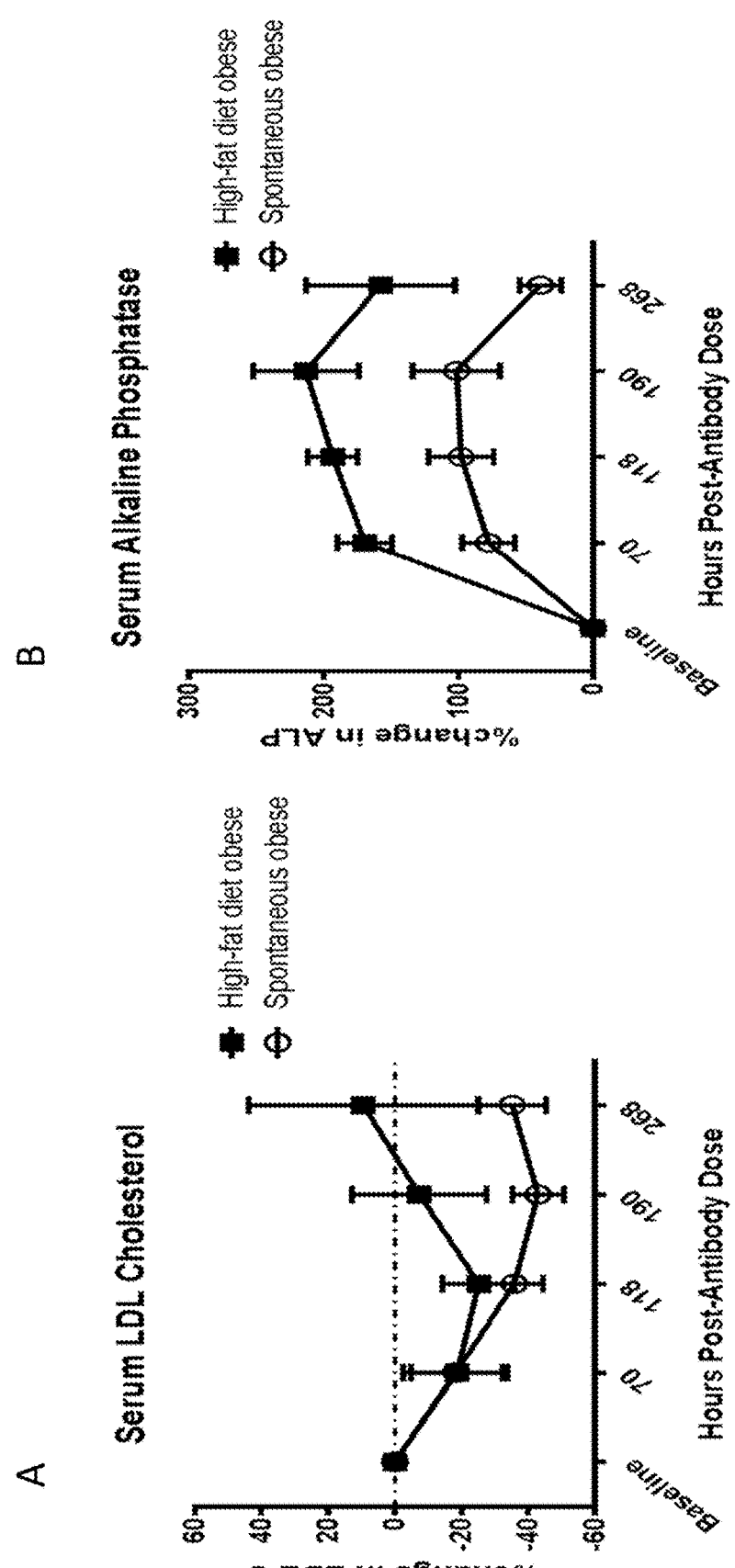

FIG. 44. Panel A is a graphical representation of the effect of ASGR-1 antibody, 4A2, on serum LDL cholesterol levels in obese cynomologus monkeys. Panel B is a graphical representation of the effect of ASGR-1 antibody, 4A2, on serum alkaline phosphatase levels in obese cynomologus monkeys. Data is expressed in the % change from baseline.

Figure 45:
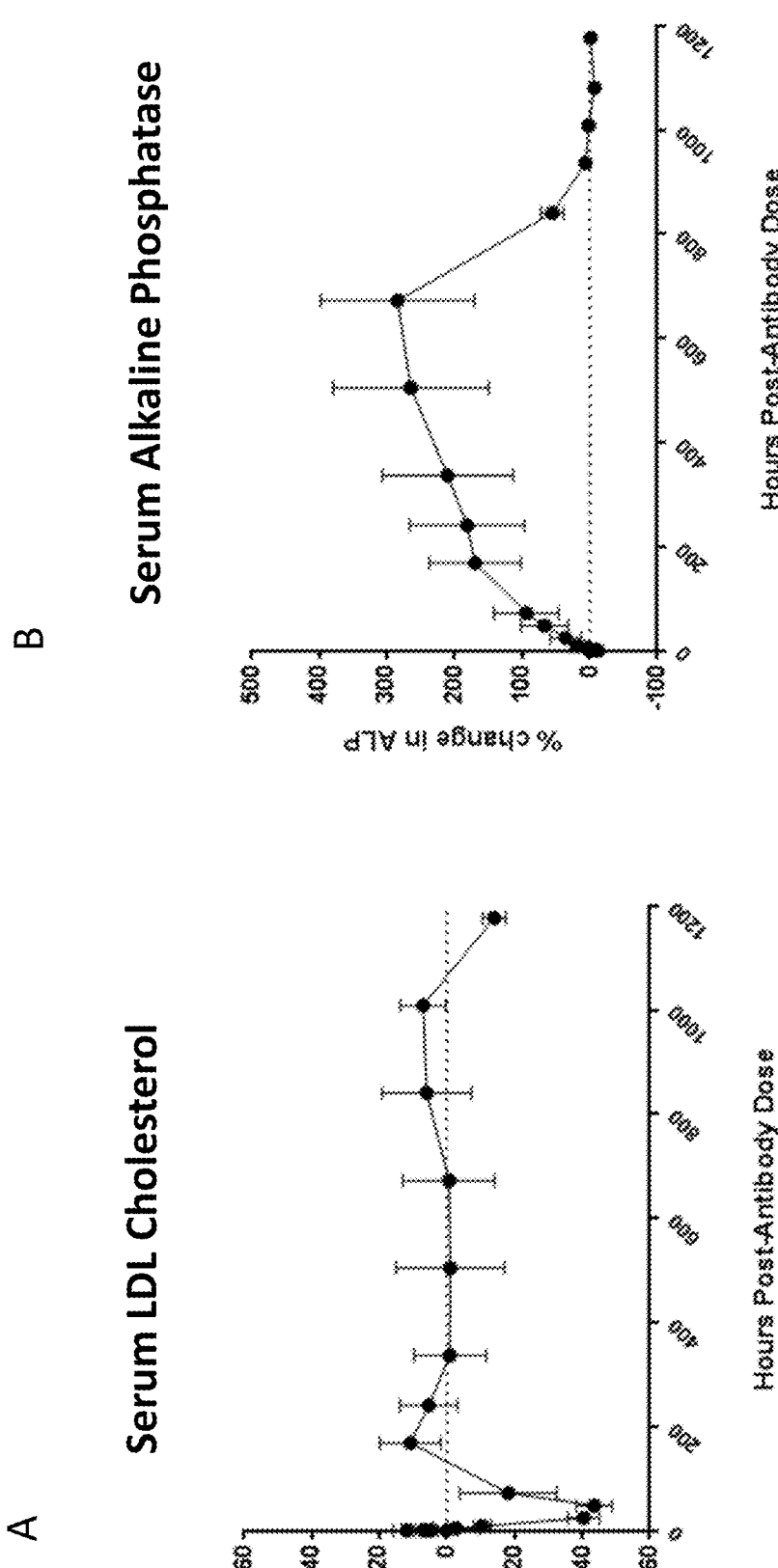

FIG. 45. Panel A is a graphical representation of the effect of ASGR-1 antibody, 4A2, on serum LDL cholesterol levels in normal cynomologus monkeys. Panel B is a graphical representation of the effect of ASGR-1 antibody, 4A2, on serum alkaline phosphatase levels in normal cynomologus monkeys. Data is expressed in the % change from baseline.

Figure 46:
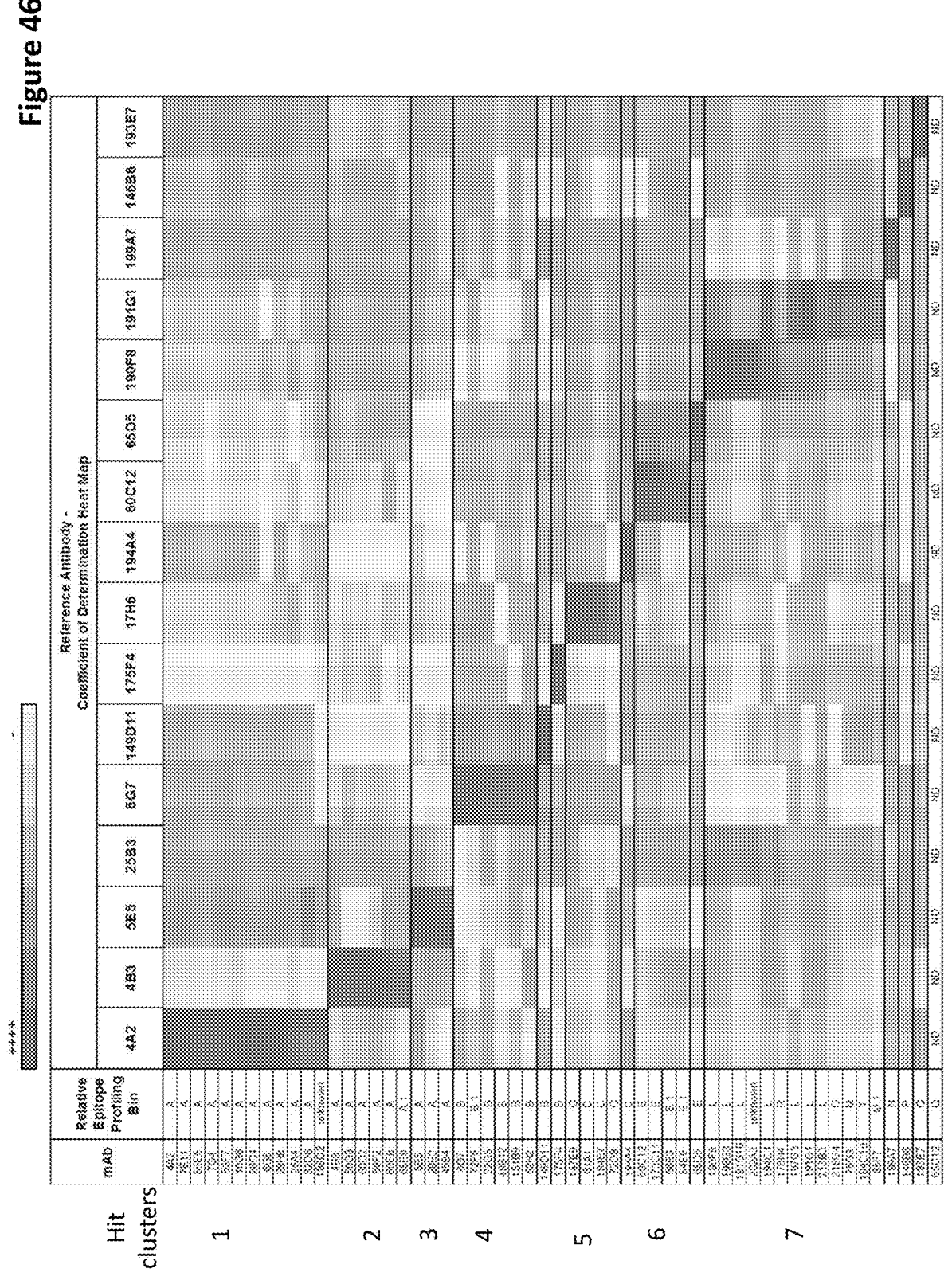

FIG. 46. A coefficient of determination heat map representing the coefficient of determination profiles of test ASGR-1 ligand blocking antibody-reference antibody combinations from an Arginine/Glutamic Acid scanning mutagenesis (Example 7E). Dark shading represents highly similar data, while light shading represents highly dissimilar data. The relative epitope profiling (antibody competition/binding) bin assignments are also indicated.

Figure 47:
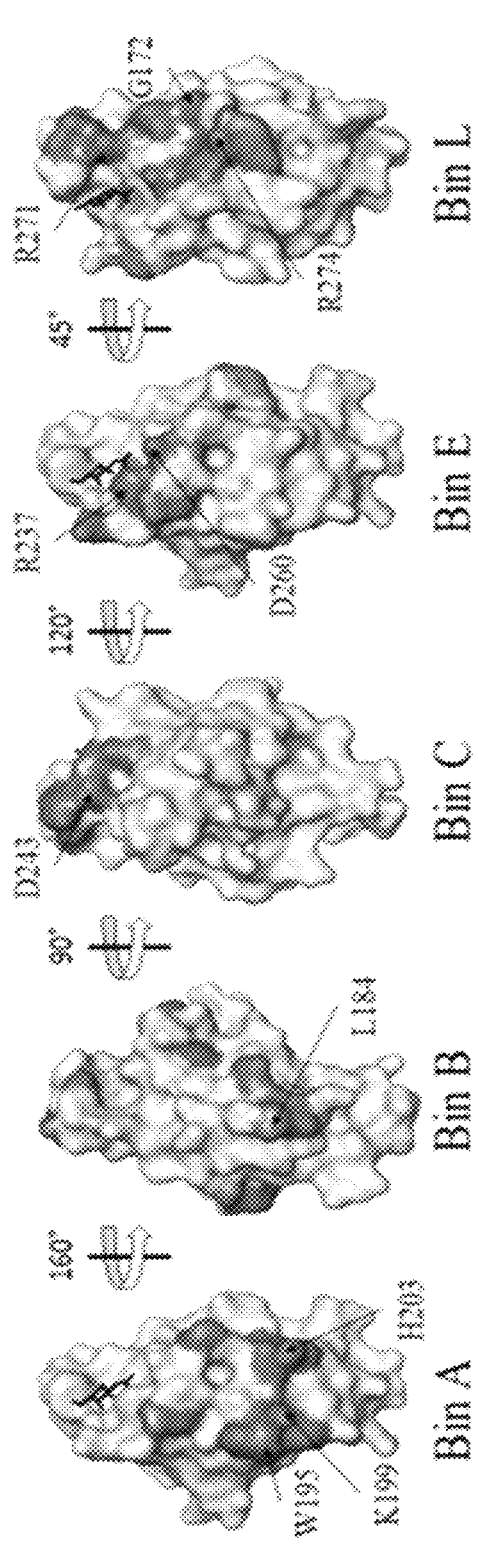

FIG. 47. A computer representation showing alternative views of the ASGR-1 CBD protein and the surface locations of amino acid residues identified as being important for antibody binding via Arginine/Glutamic Acid scanning mutagenesis (Example 7E). The relative epitope profiling (antibody competition/binding) bin assignments are also indicated. Ligand (GalNAc) is shown as a stick representation (black). The ASGR-1 CBD is shown as a surface representation (light grey). The positions of amino acids identified by Arg/Glu mutational scanning are indicated (dark grey surface). The relative positions of key amino acids in each bin are shown for reference only.

FIG. 48. A table presenting various protein sequences for human, mouse, rat, pig, dog and cynomolgus monkey ASGR, ASGR-1 and ASGR-2 (Table 1).

FIG. 49. Two tables presenting variable light and heavy chain CDR1, CDR2 and CDR3 amino acid sequences for certain antigen binding proteins of the present invention (Table 2A and Table 2B). Table 2A presents the Variable Light Chain CDR1, CDR2 and CDR3, while Table 2B presents the Variable Heavy Chain CDR1, CDR2, and CDR3. The CDR sequences in Tables 2A and 2B are wrapped due to space issues, and unless stated otherwise, should be understood to be a single amino acid sequence.

FIG. 50. A table presenting the amino acid sequences of the light and heavy chain variable domains for certain antigen binding proteins of the present invention are displayed in a table (Table 3). The amino acid sequences of the light and heavy chain variable domains in Table 3 are wrapped due to space issues, and unless stated otherwise, should be understood to be single amino acid sequences.

FIG. 51. A table presenting a protein alignment of light and heavy variable regions for certain antigen binding proteins of the present invention (Table 4). An asterisk "*" denotes a stop codon. Sequences containing a stop codon are represented as distinct sequences in the Sequence Listing, however, these sequences are related. Generally speaking, however, the amino acid sequences of the light and heavy chain variable domains in the protein alignment presented in Table 4 are wrapped due to space issues, and unless stated otherwise, like in the case of sequences with one or more stop codons, should be understood to be single amino acid sequences.

FIG. 52. A table presenting a consensus protein alignment of light and heavy variable regions for certain antigen binding proteins of the present invention (Table 5). An asterisk "*" denotes a stop codon. Sequences containing a stop codon are represented as distinct sequences in the Sequence Listing, however, these sequences are related. Generally speaking, however, the amino acid sequences of the light and heavy chain variable domains in the consensus protein alignment presented in Table 5 are wrapped due to space issues, and unless stated otherwise, like in the case of sequences with one or more stop codons, should be understood to be single amino acid sequences.

FIG. 53. A table presenting a protein alignment of light and heavy variable regions for certain optimized antigen binding proteins of the present invention (Table 6). The amino acid sequences of the light and heavy chain variable domains in the protein alignment presented in Table 6 are wrapped due to space issues, and unless stated otherwise, should be understood to be single amino acid sequences.

FIG. 54. A table presenting a consensus protein alignment of light and heavy variable regions for certain optimized antigen binding proteins of the present invention (Table 7). The amino acid sequences of the light and heavy chain variable domains in the consensus protein alignment presented in Table 7 are wrapped due to space issues, and unless stated otherwise, should be understood to be single amino acid sequences.

FIG. 55. A group of tables presenting the consensus sequences of various heavy and light chain variable regions (Tables 19A and 20A, respectively), as well as the consensus sequences of CDRs of various heavy and light chain variable regions (Tables 19B and C and Tables 20B and 20C, respectively) for certain antigen binding proteins of the present invention.

Figure 56:
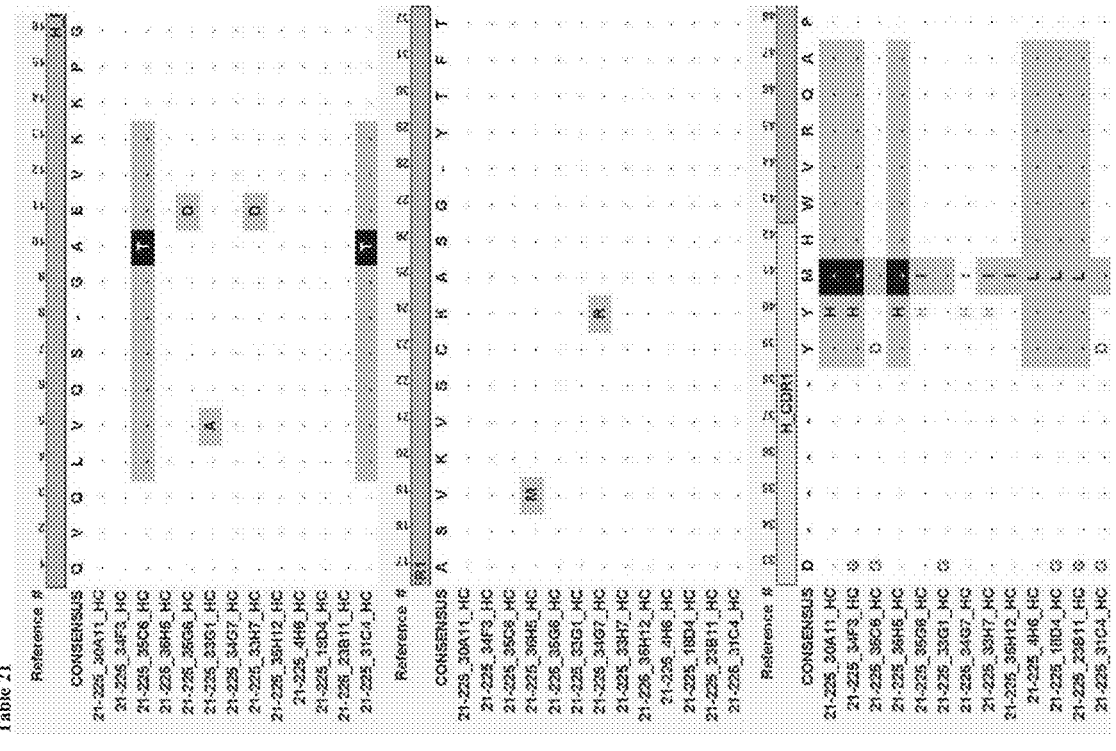
Figure 56:
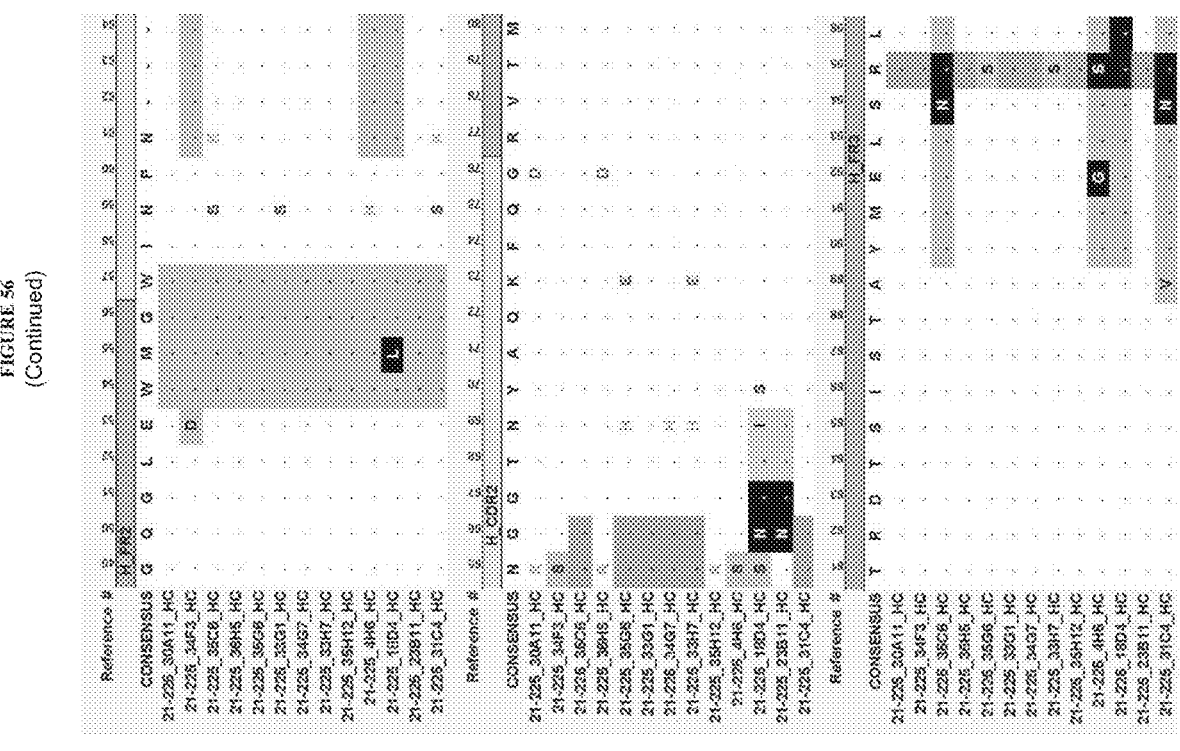
Figure 56:
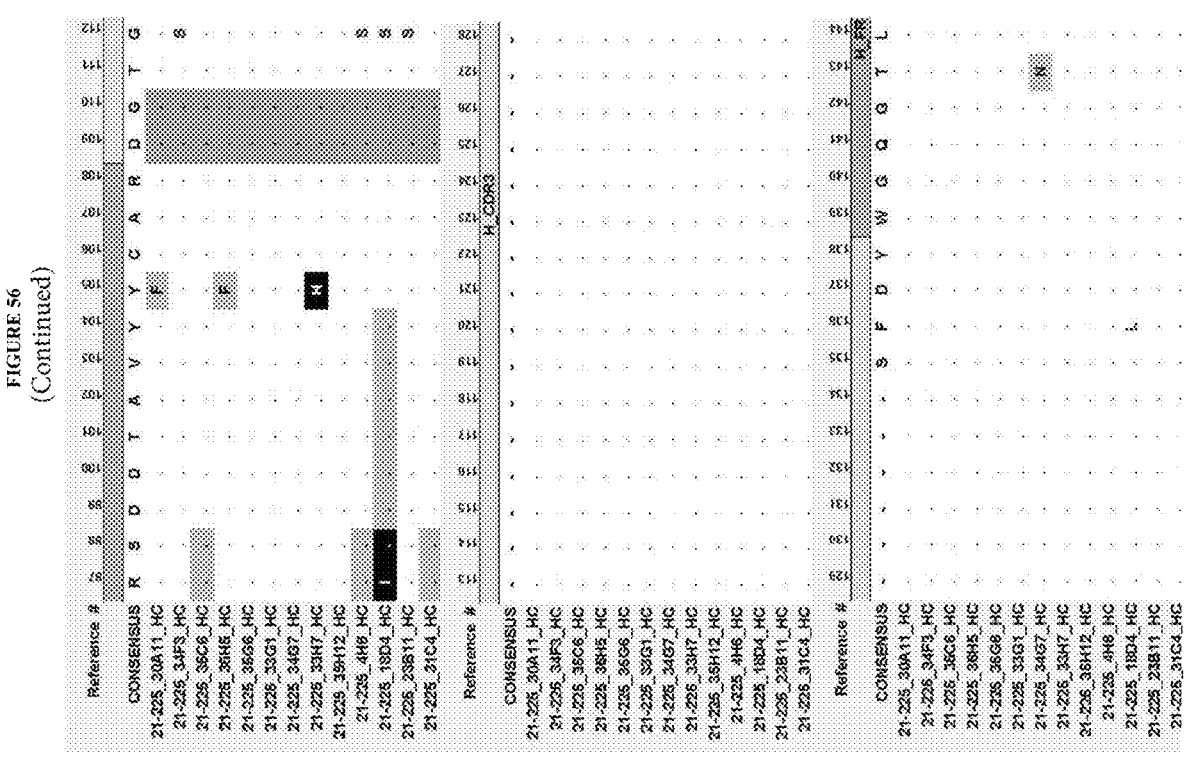
Figure 56:
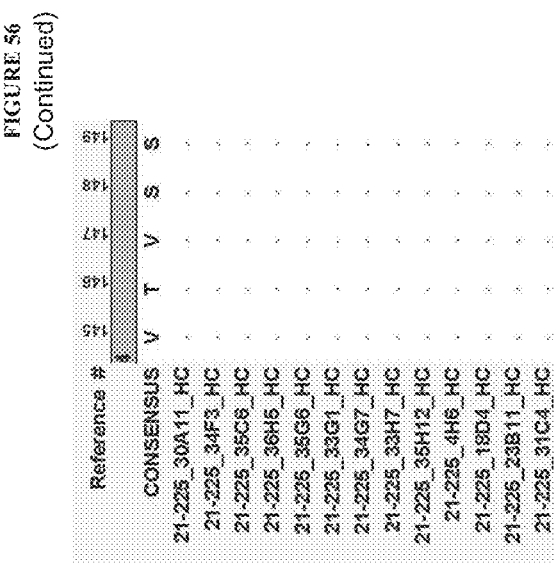
Figure 56:
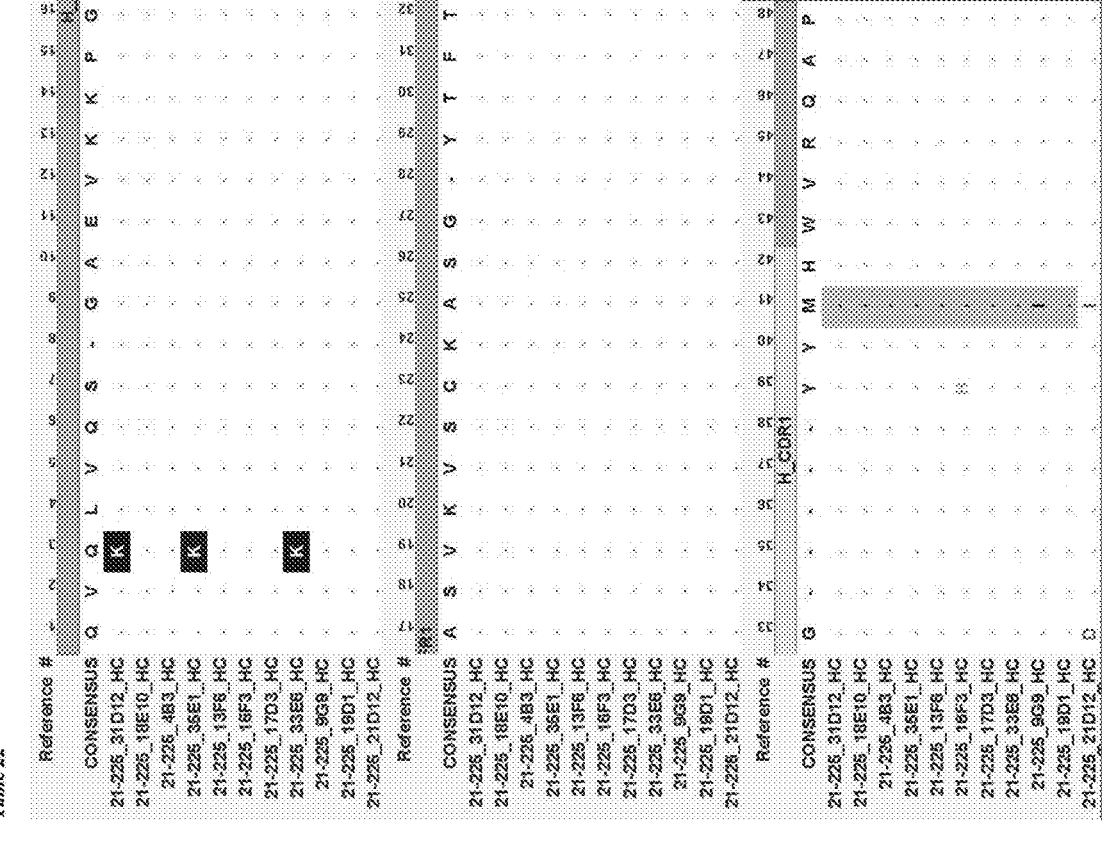
Figure 56:
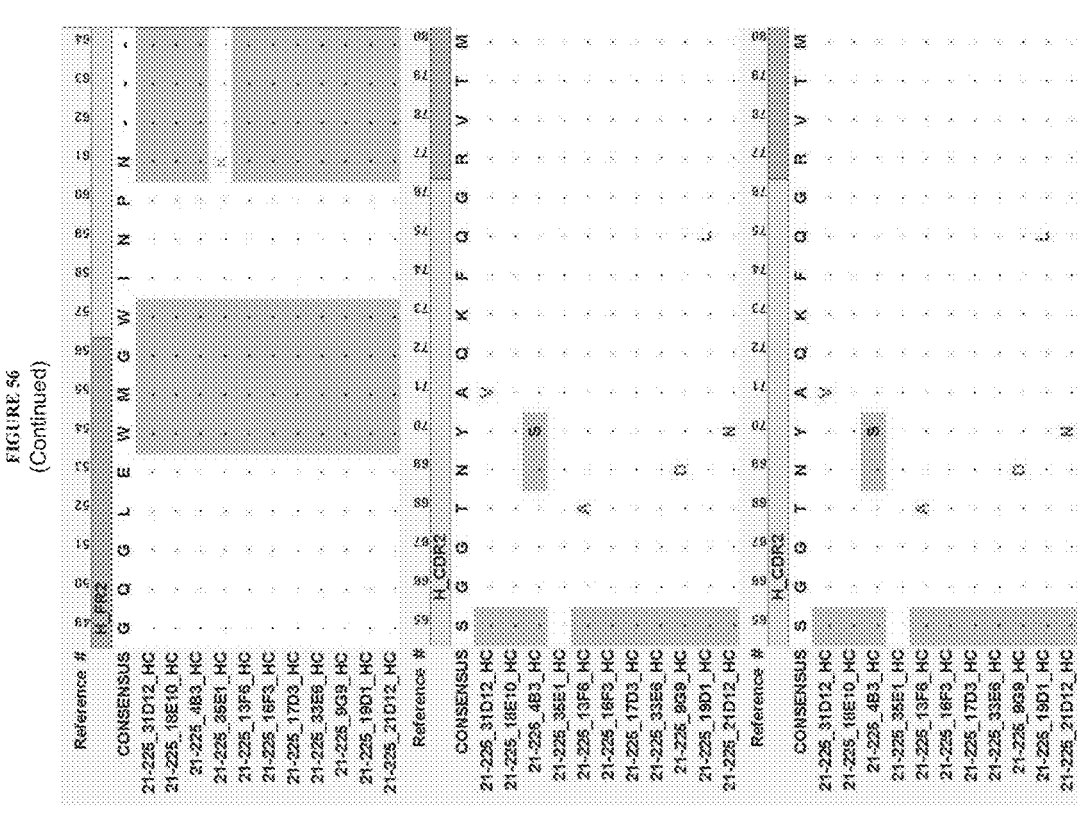
Figure 56:
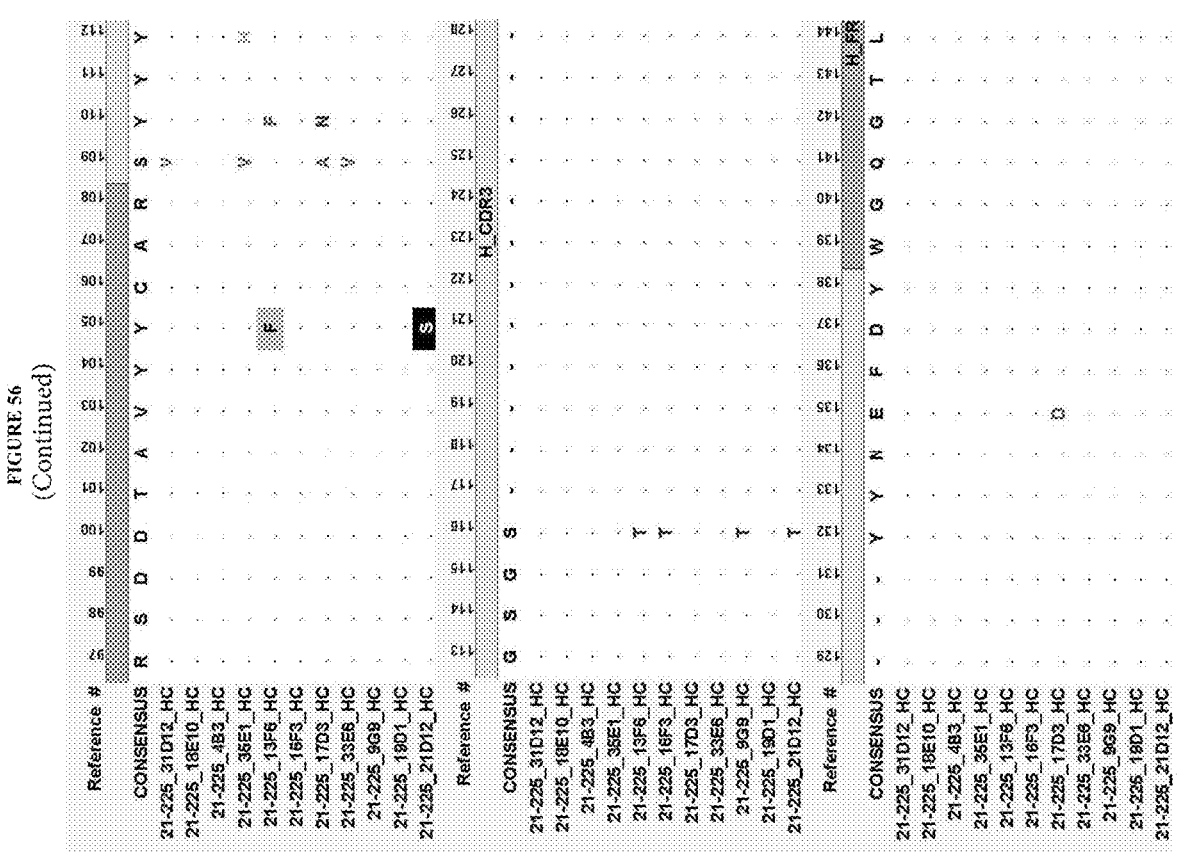
Figure 56:
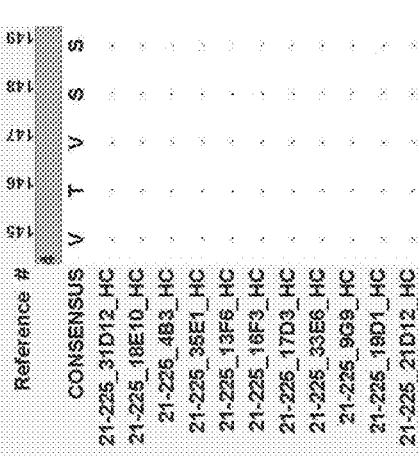
Figure 56:
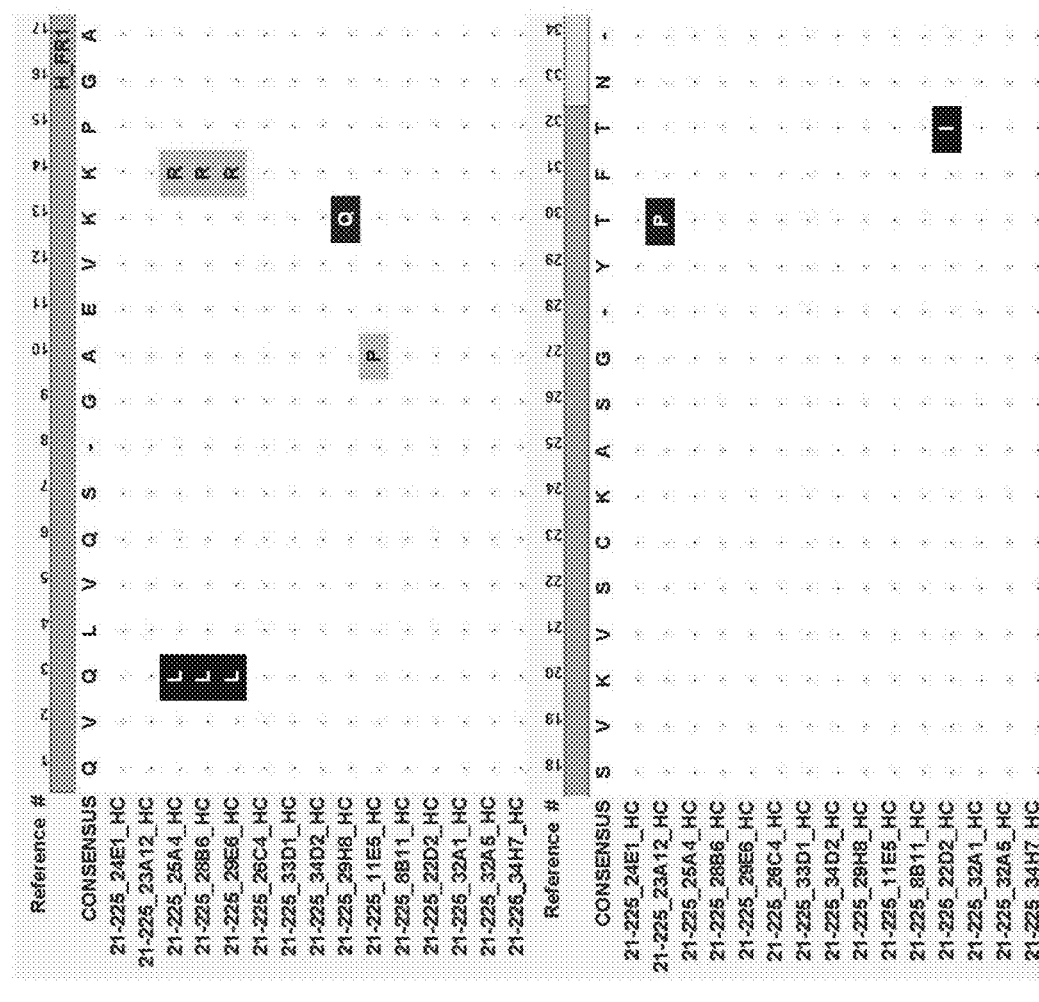
Figure 56:
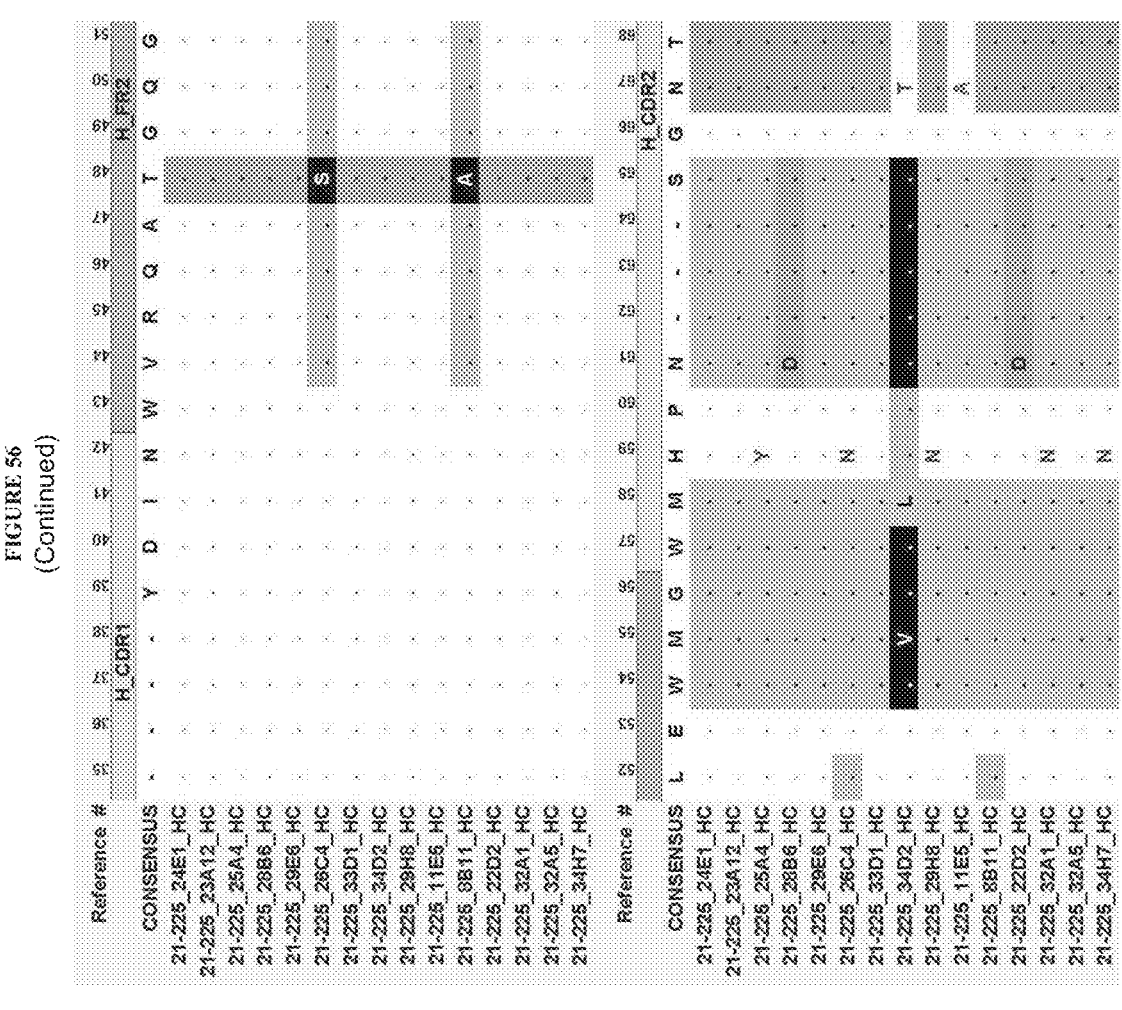
Figure 56:
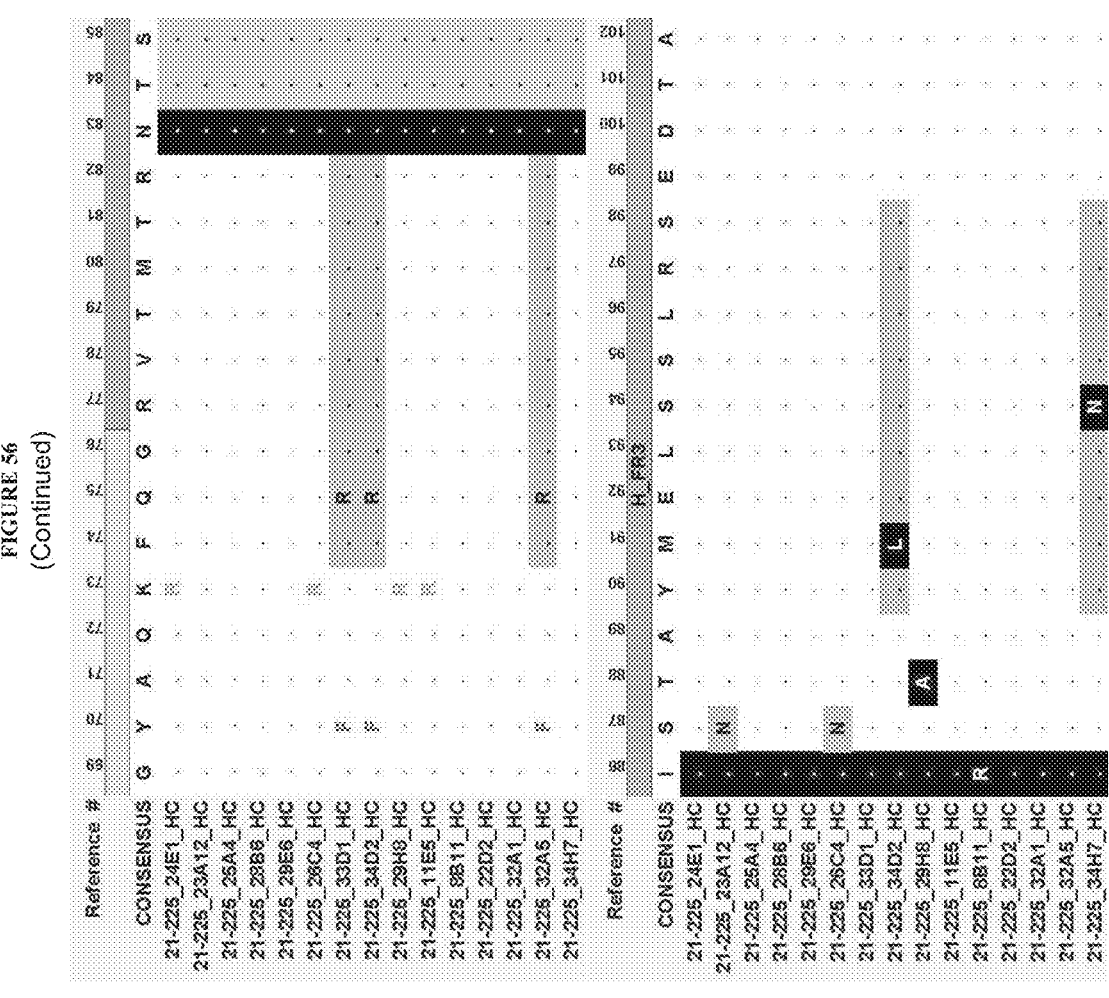
Figure 56:
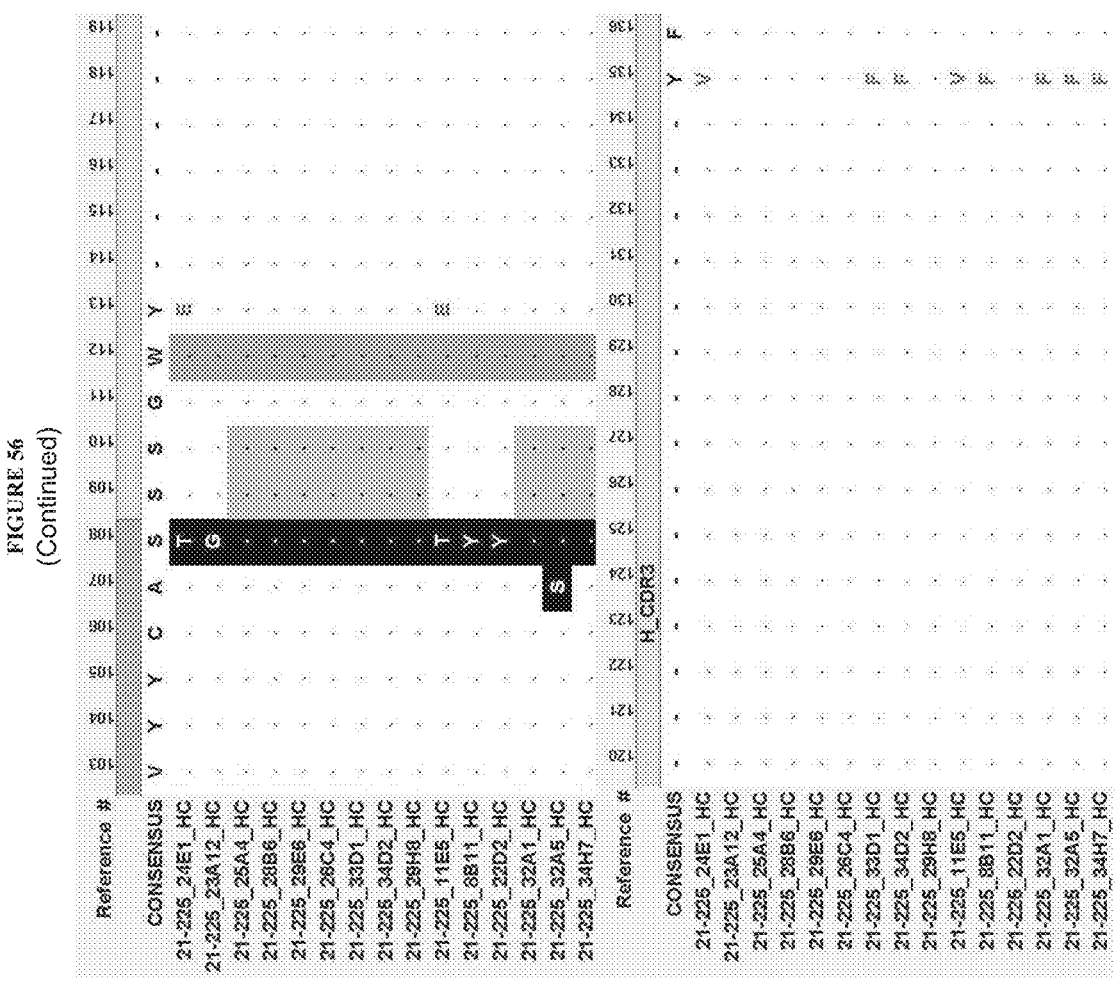
Figure 56:
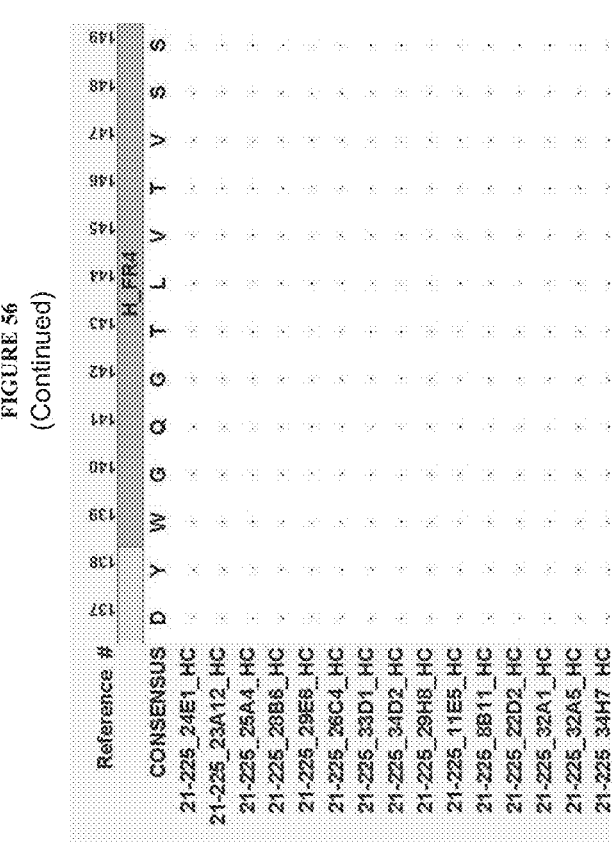
Figure 56:
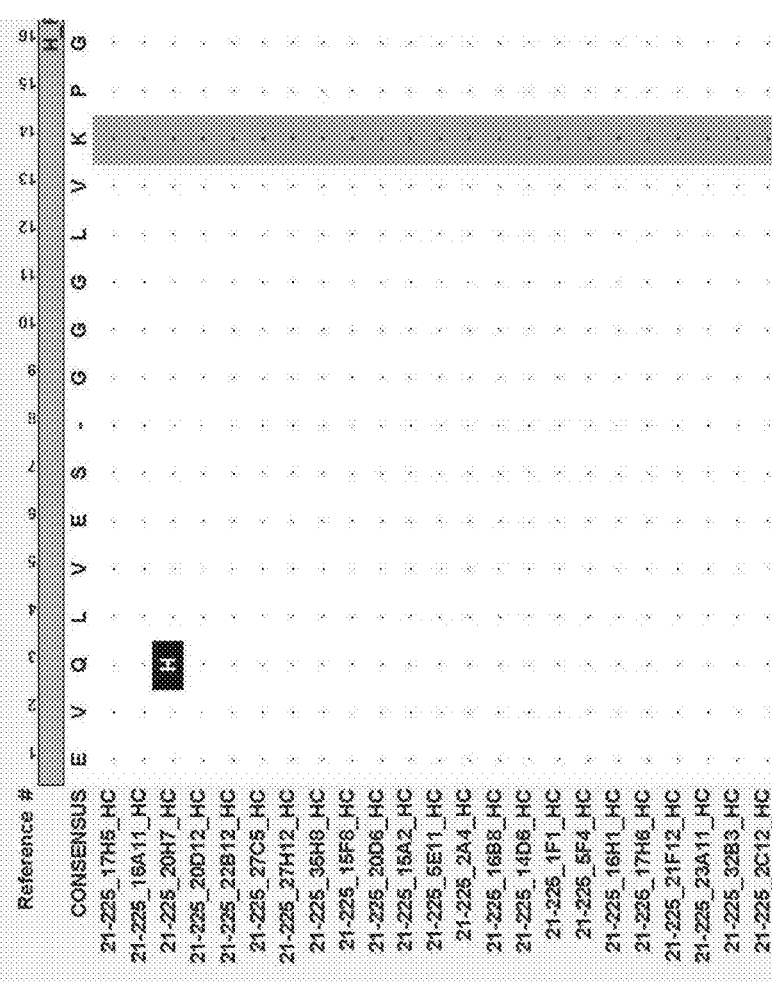
Figure 56:
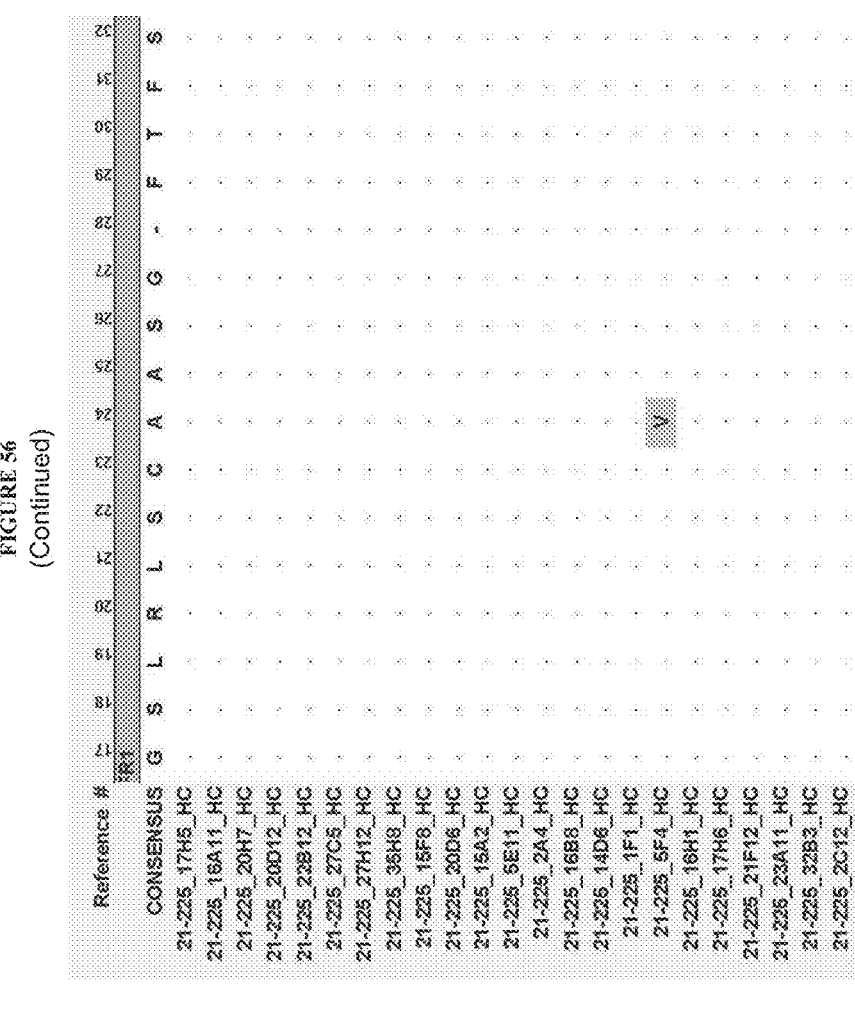
Figure 56:
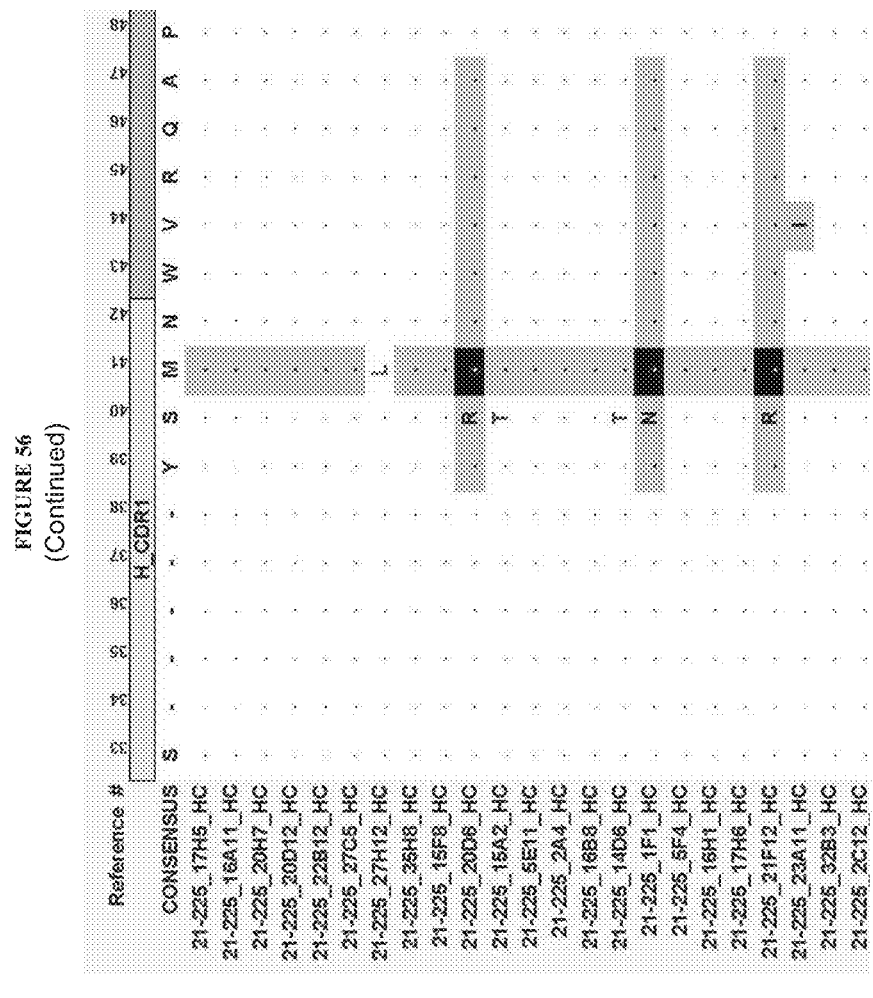
Figure 56:
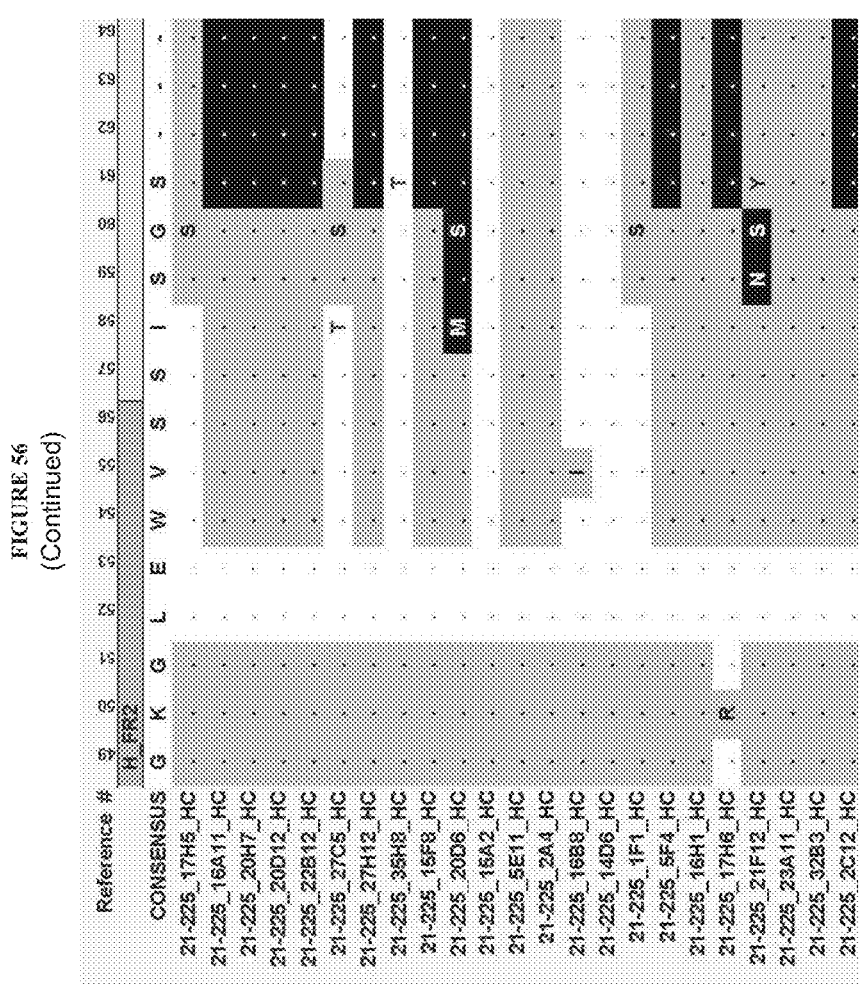
Figure 56:
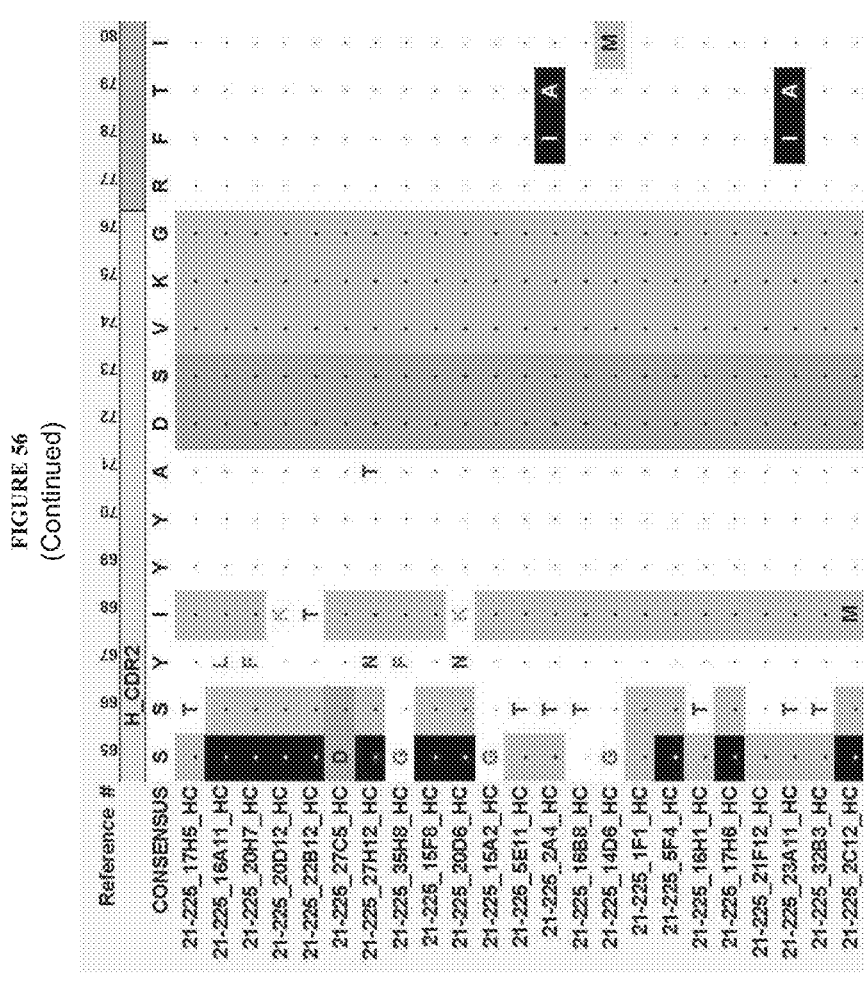
Figure 56:
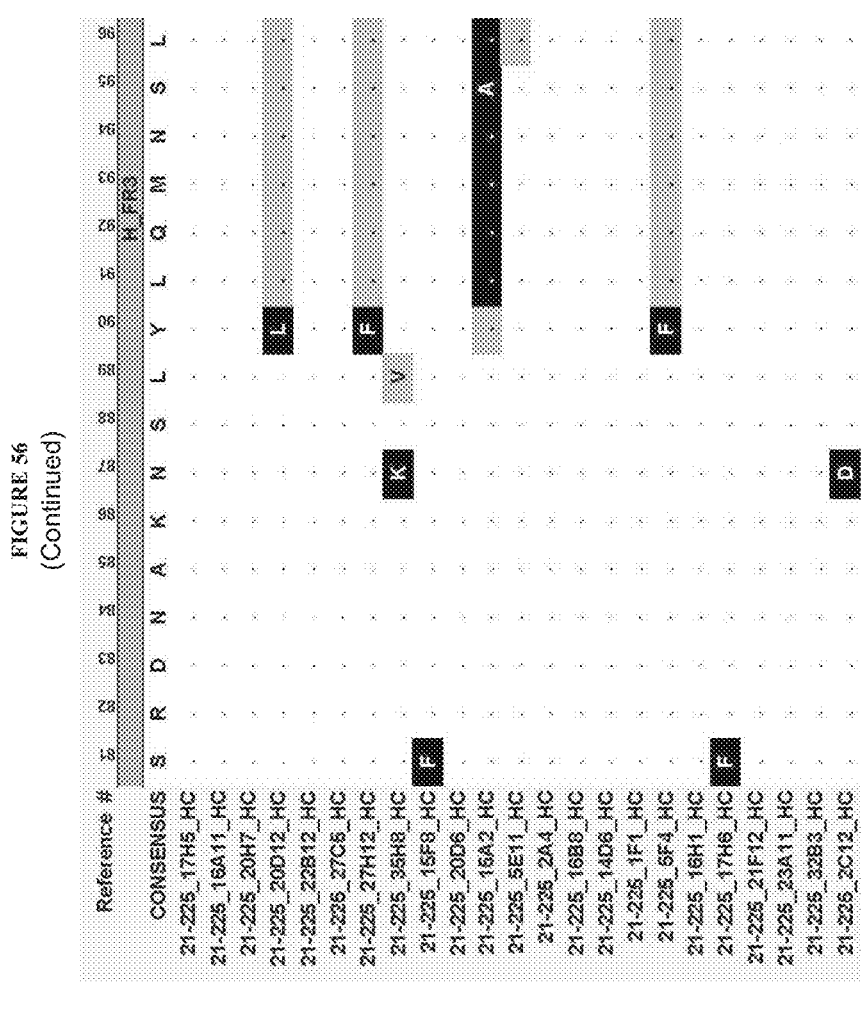
Figure 56:
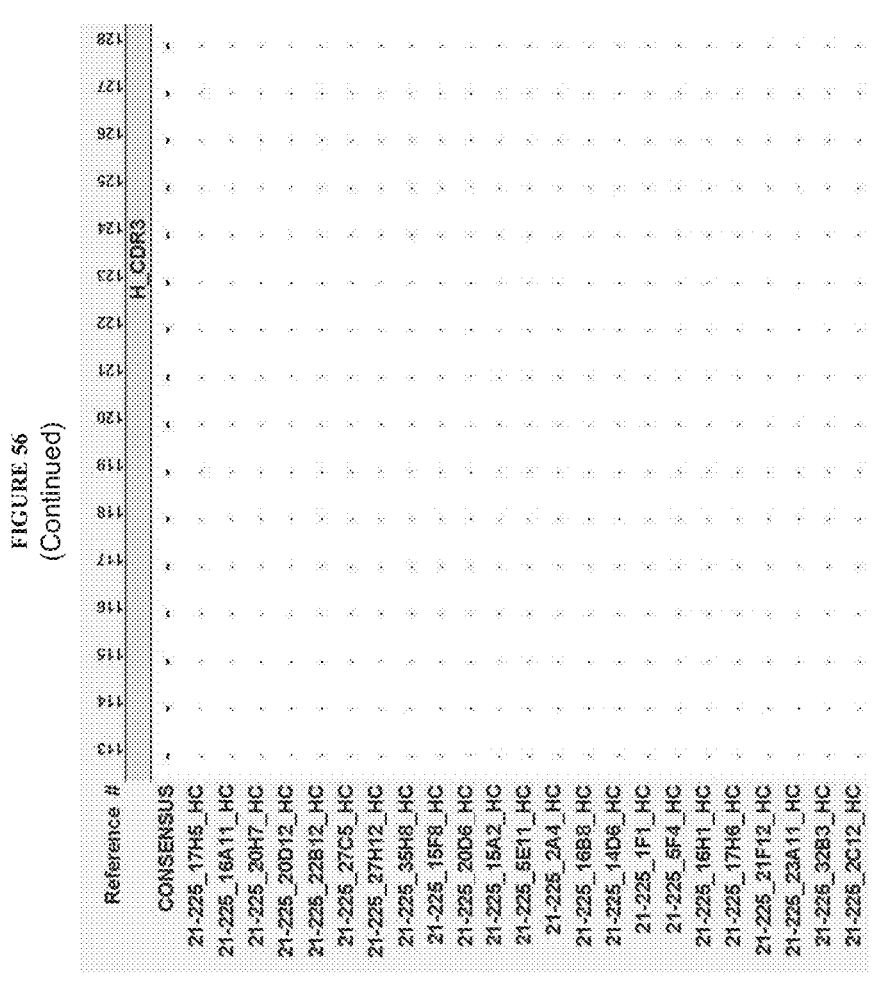
Figure 56:
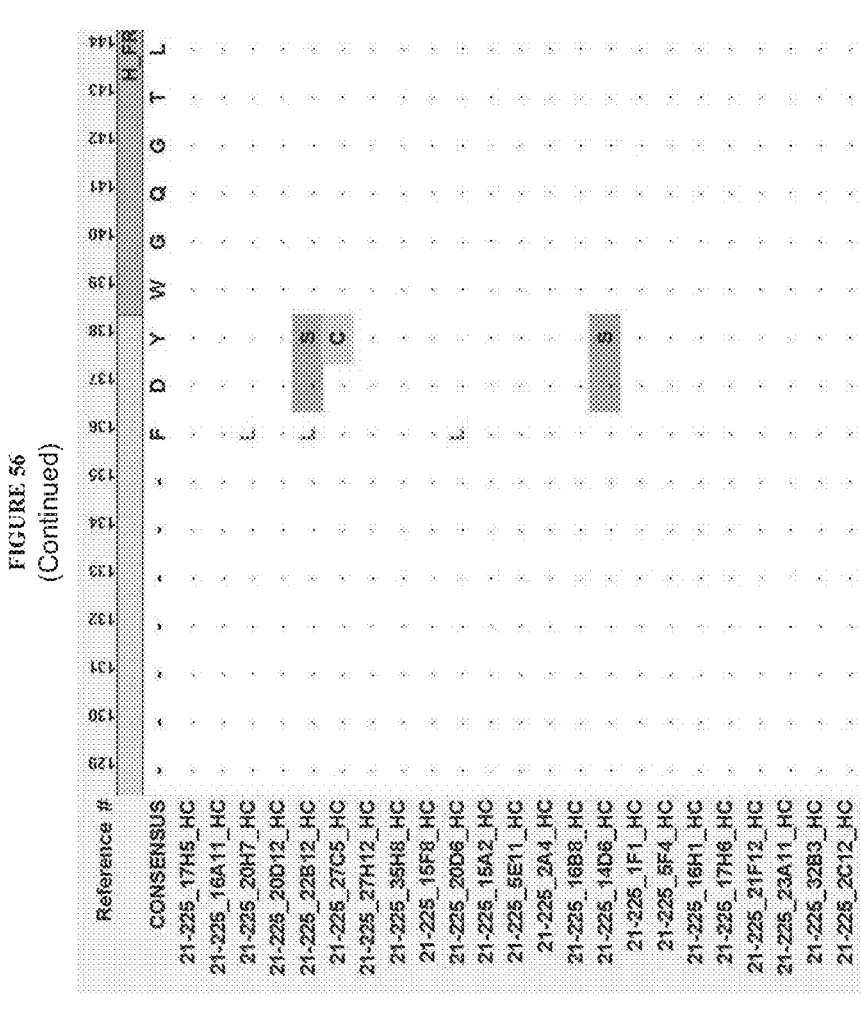
Figure 56:
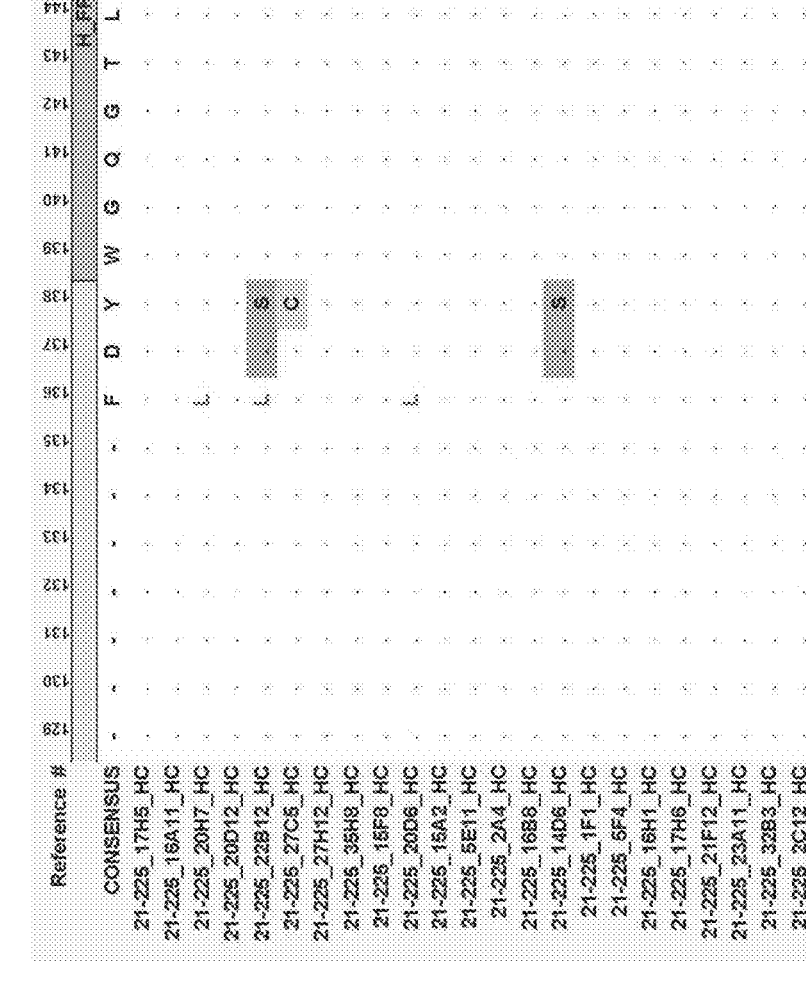
Figure 56:
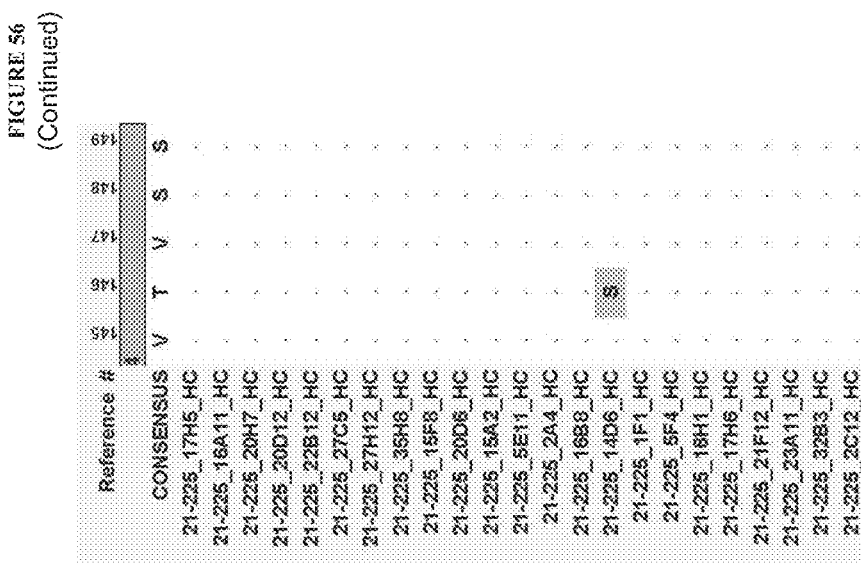
Figure 56:
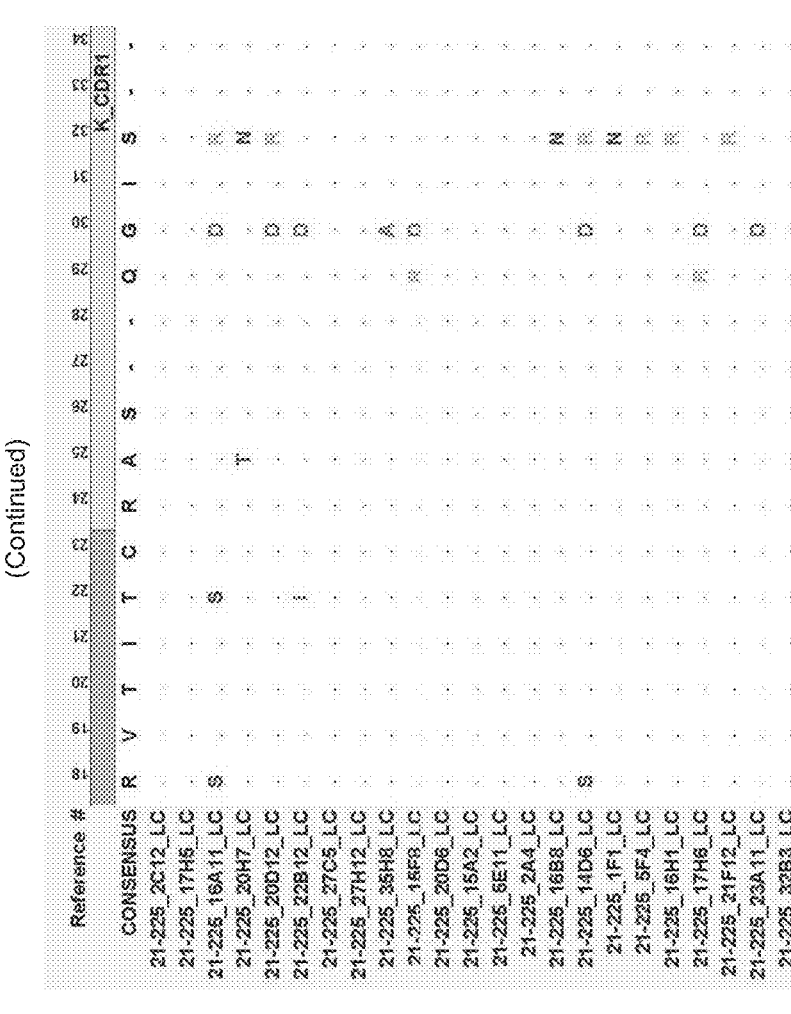
Figure 56:
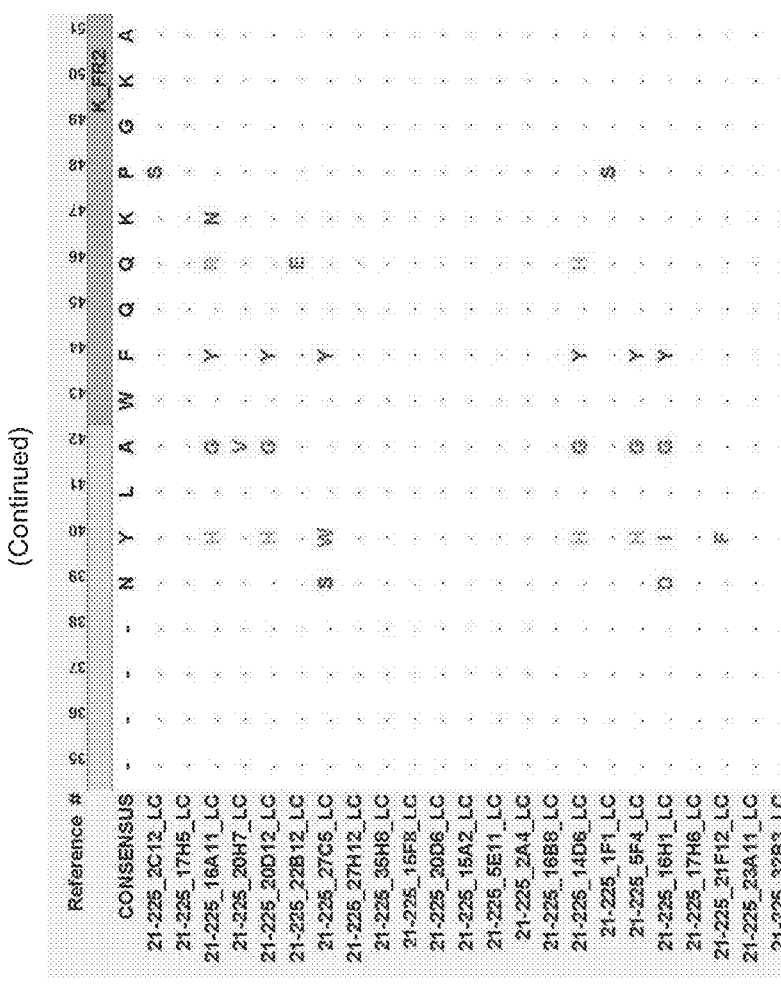
Figure 56:
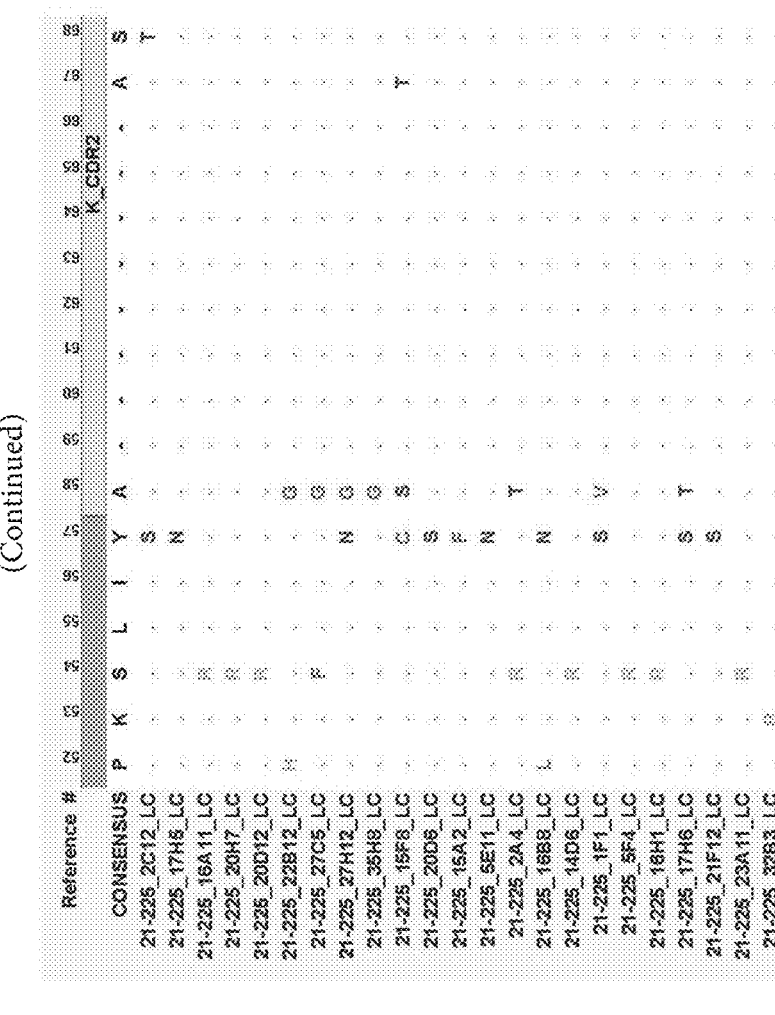
Figure 56:
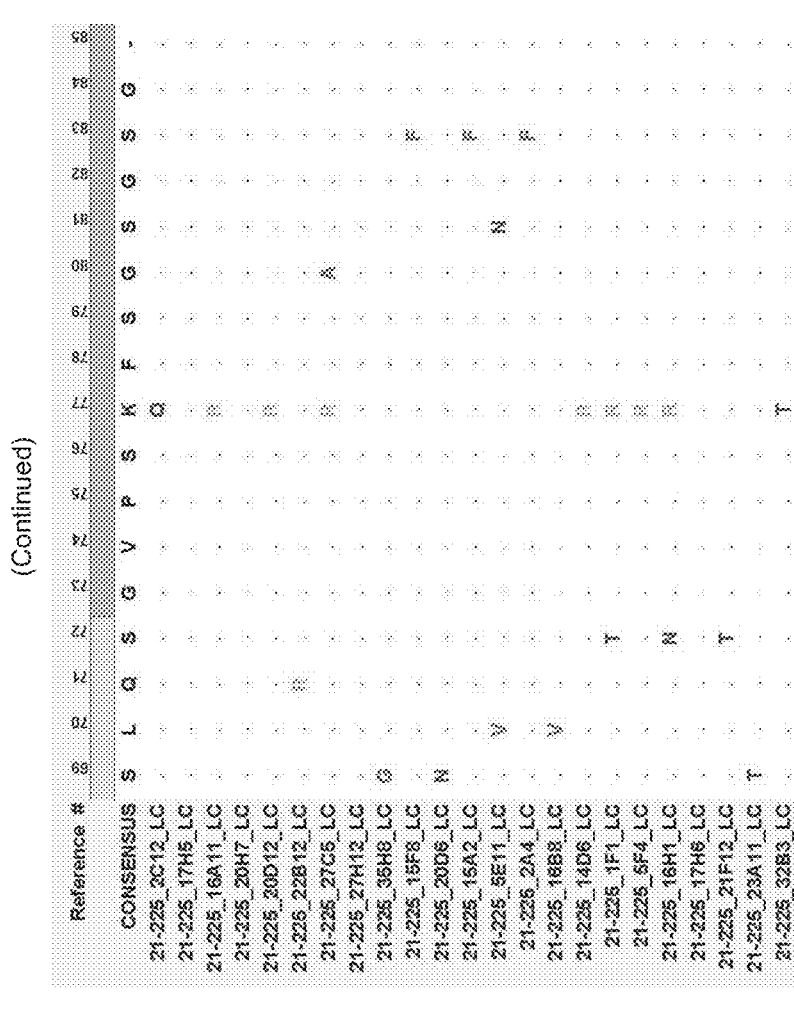
Figure 56:
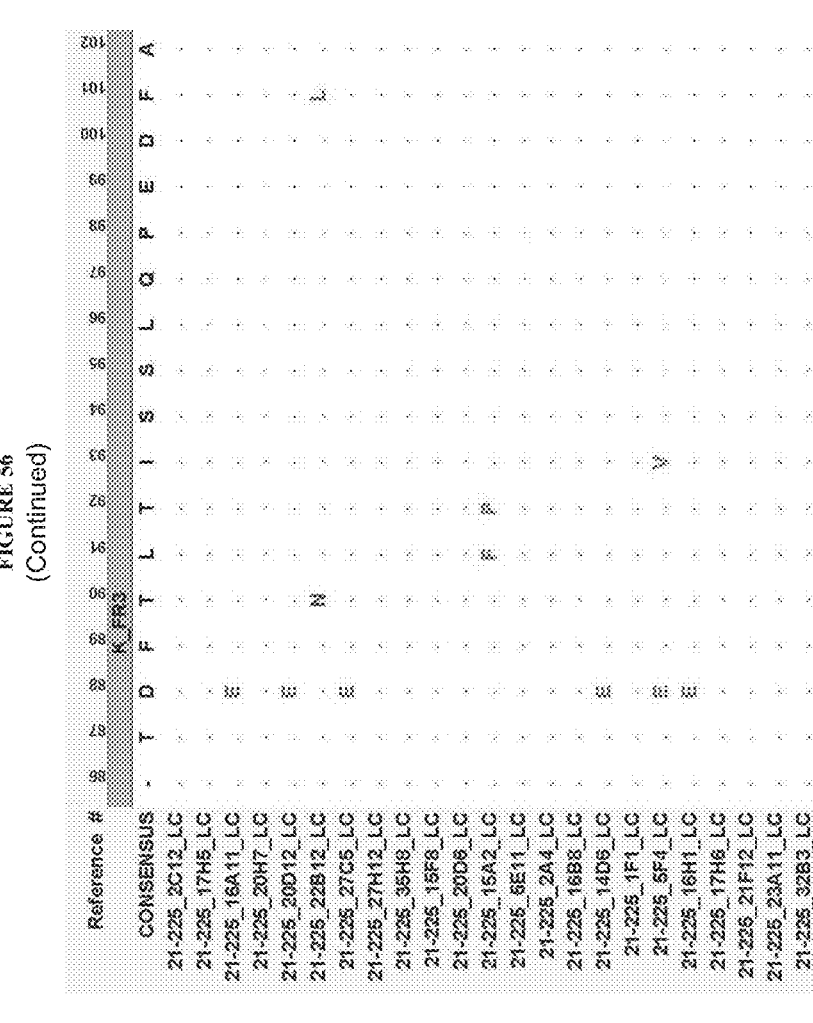
Figure 56:
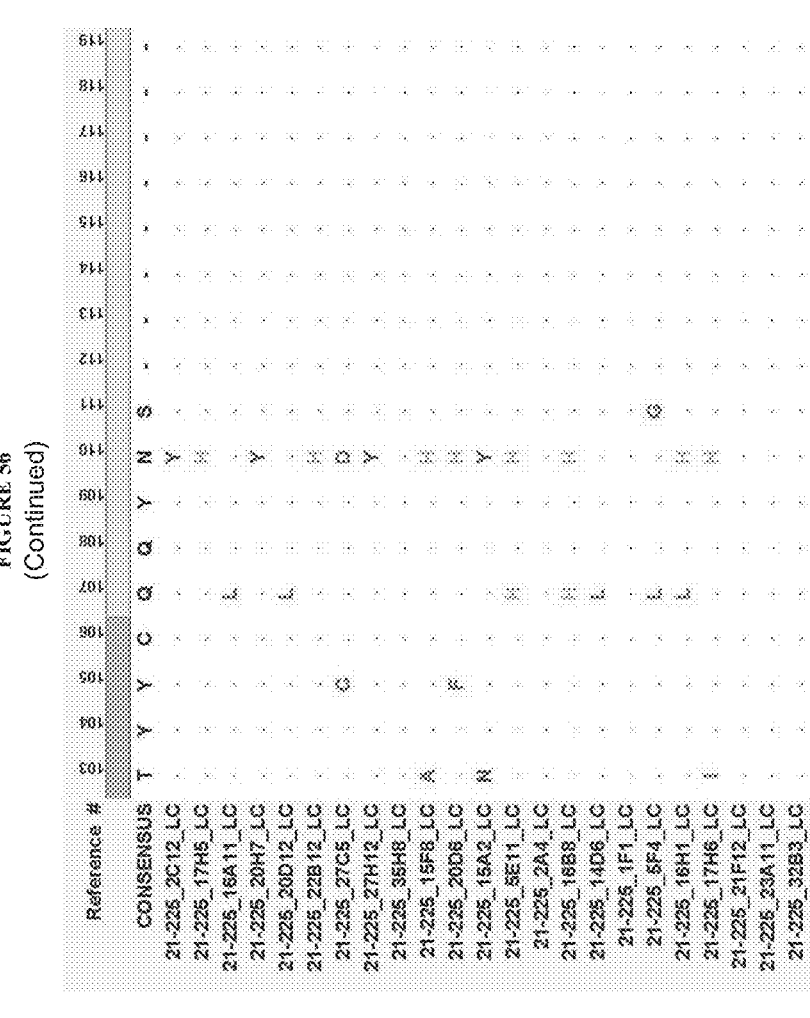
Figure 56:
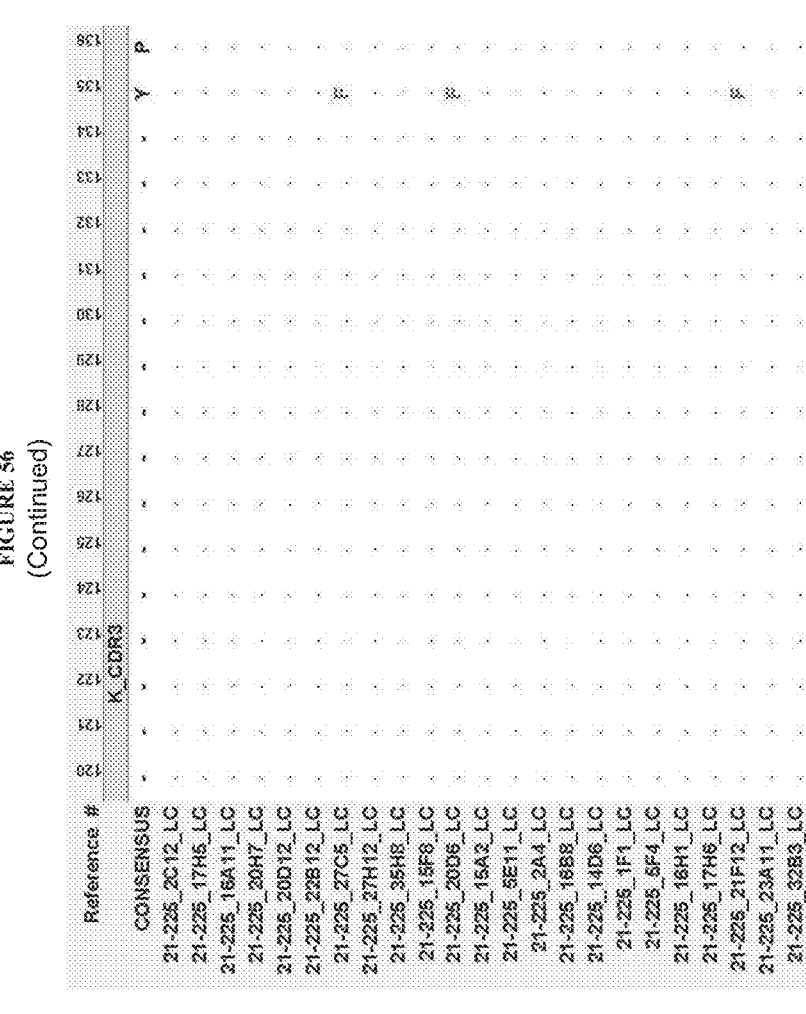
Figure 56:
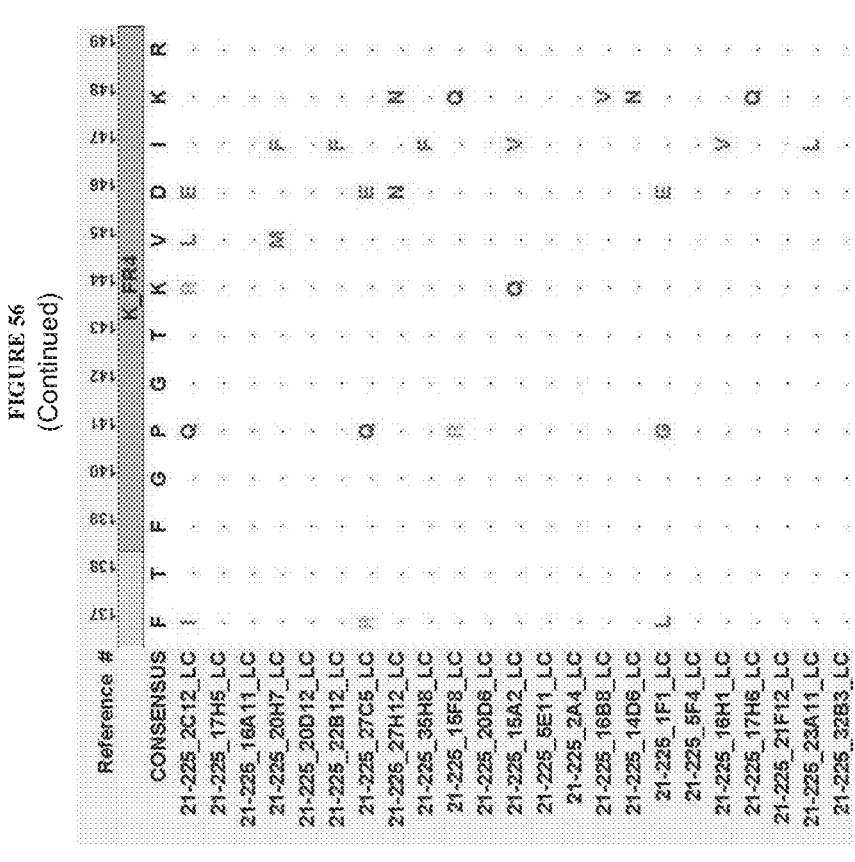
Figure 56:
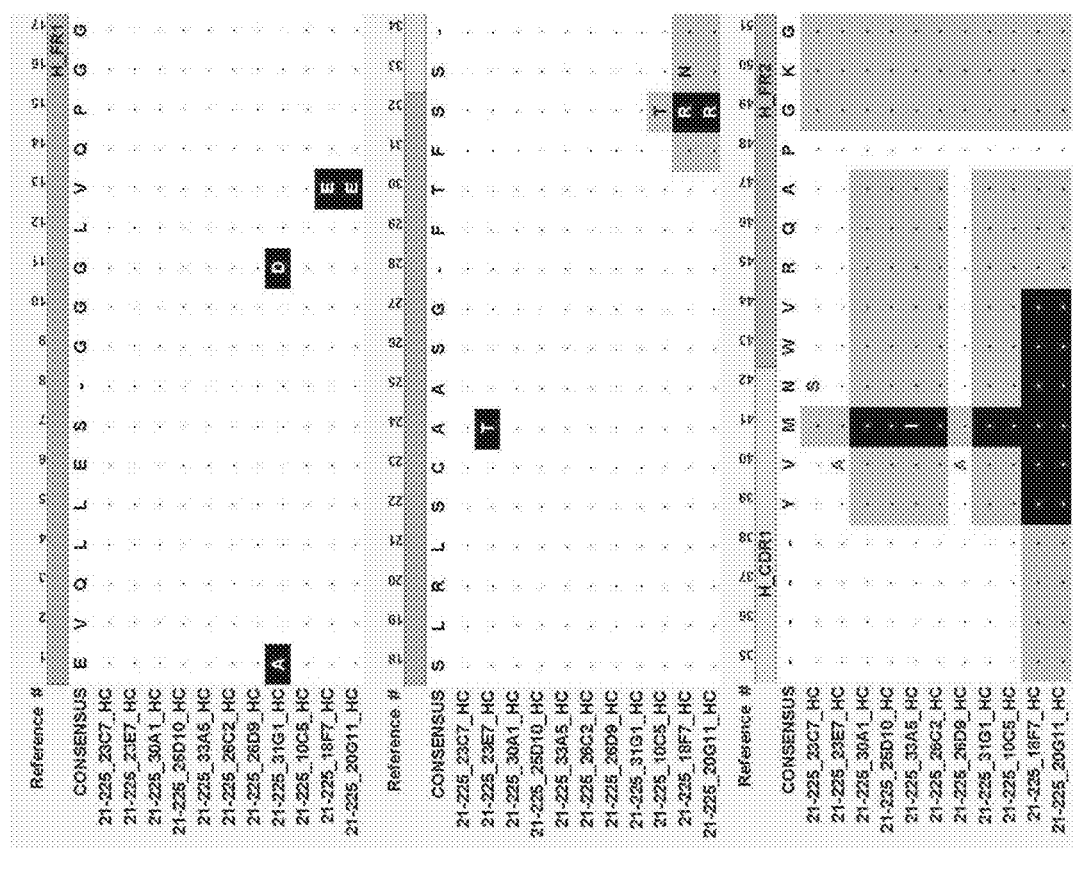
Figure 56:
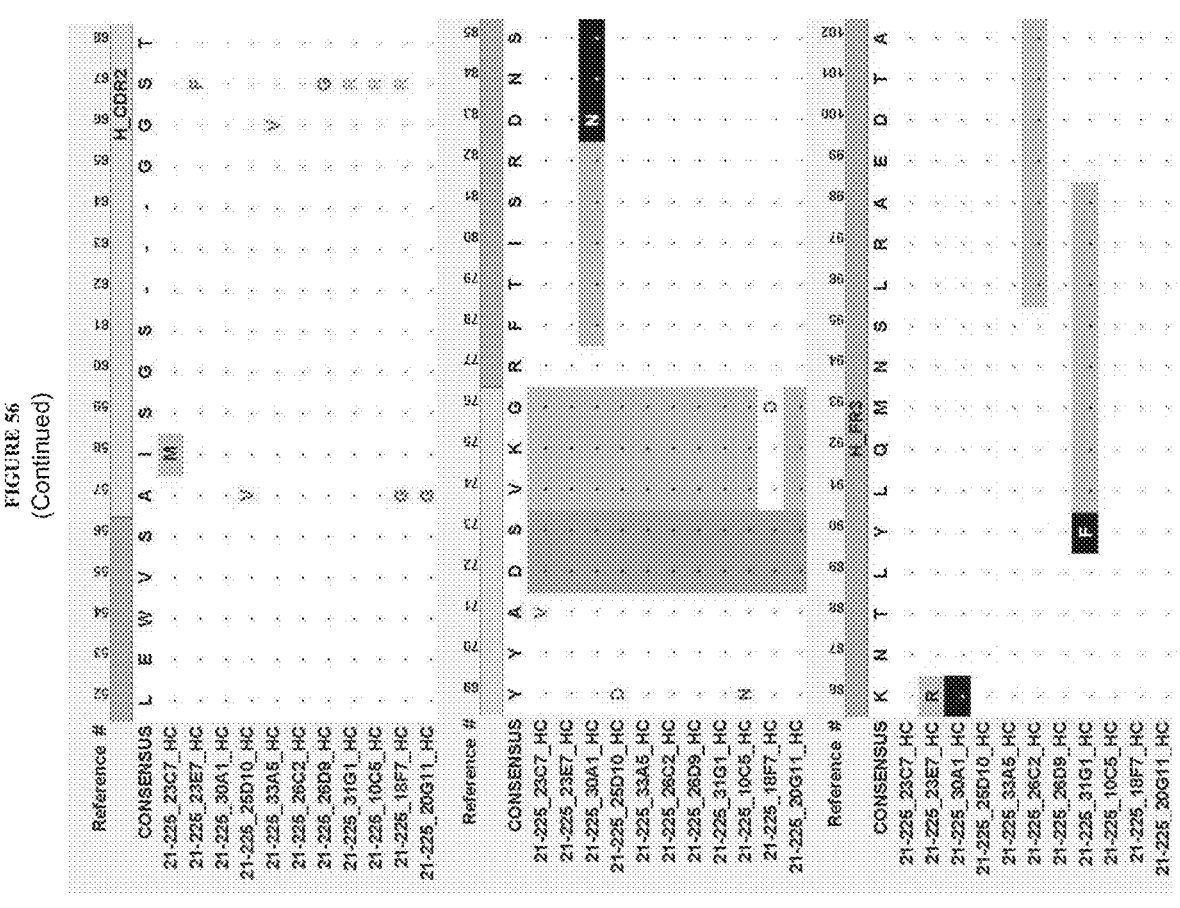
Figure 56:
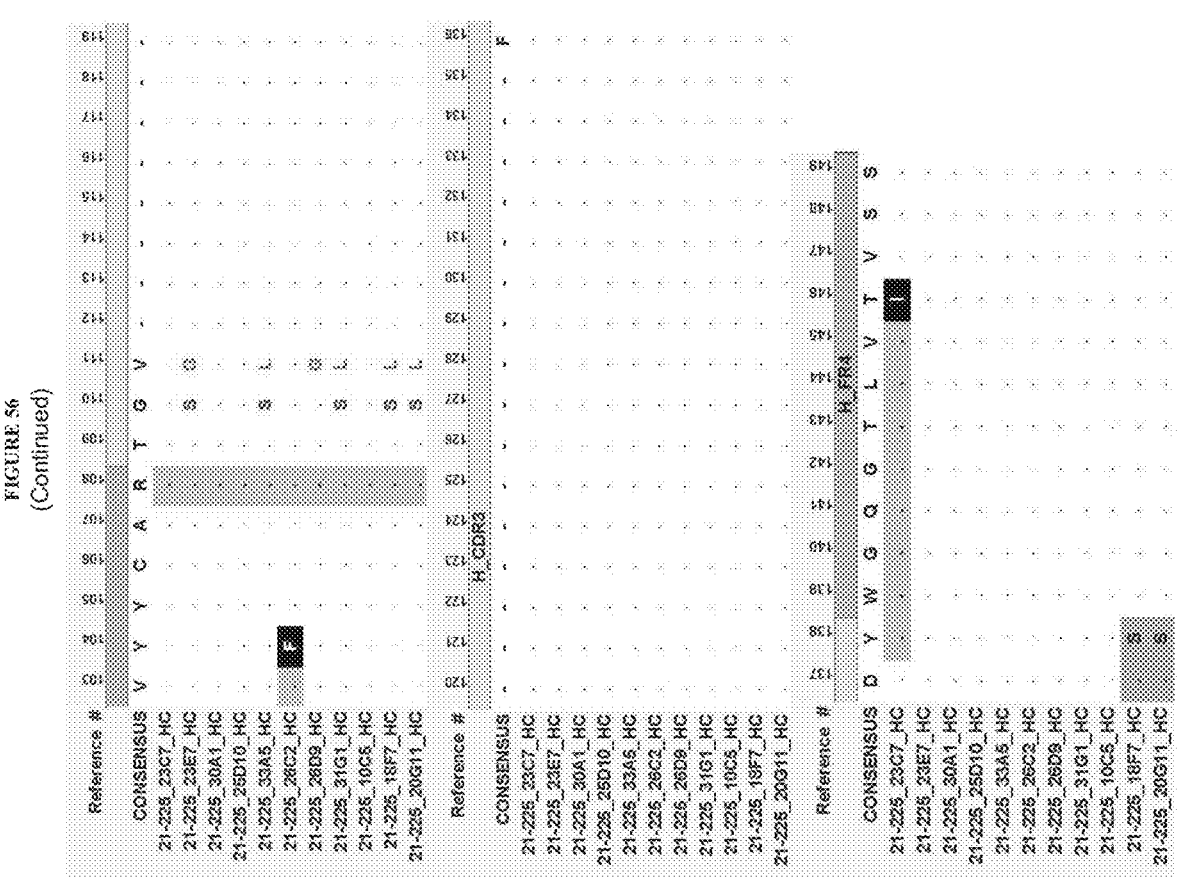
Figure 56:
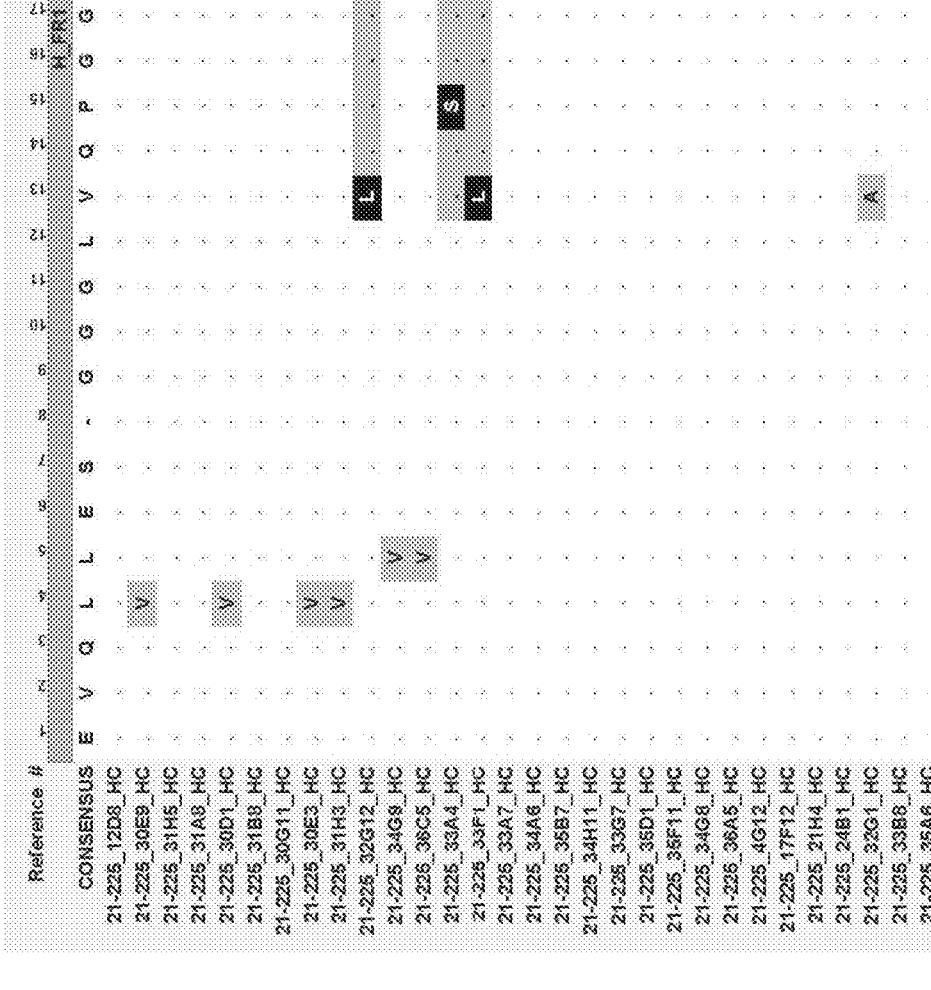
Figure 56:
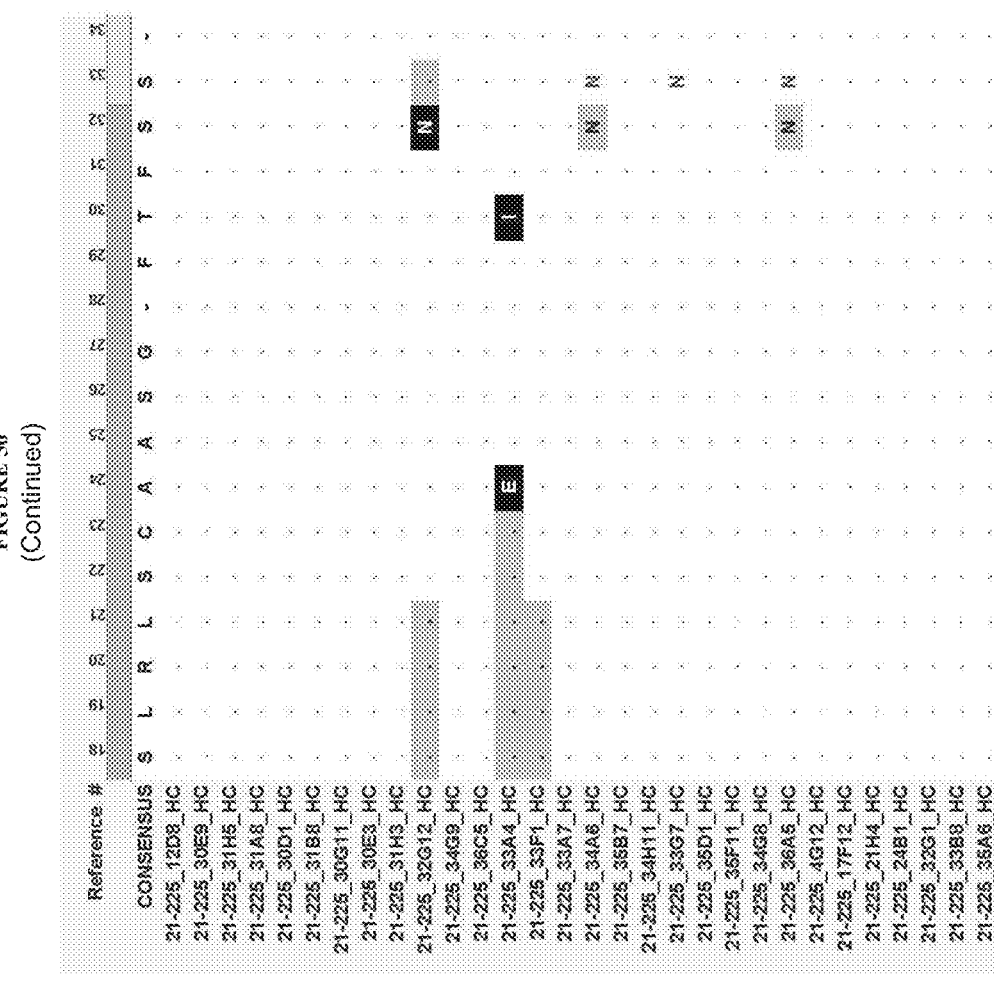
Figure 56:
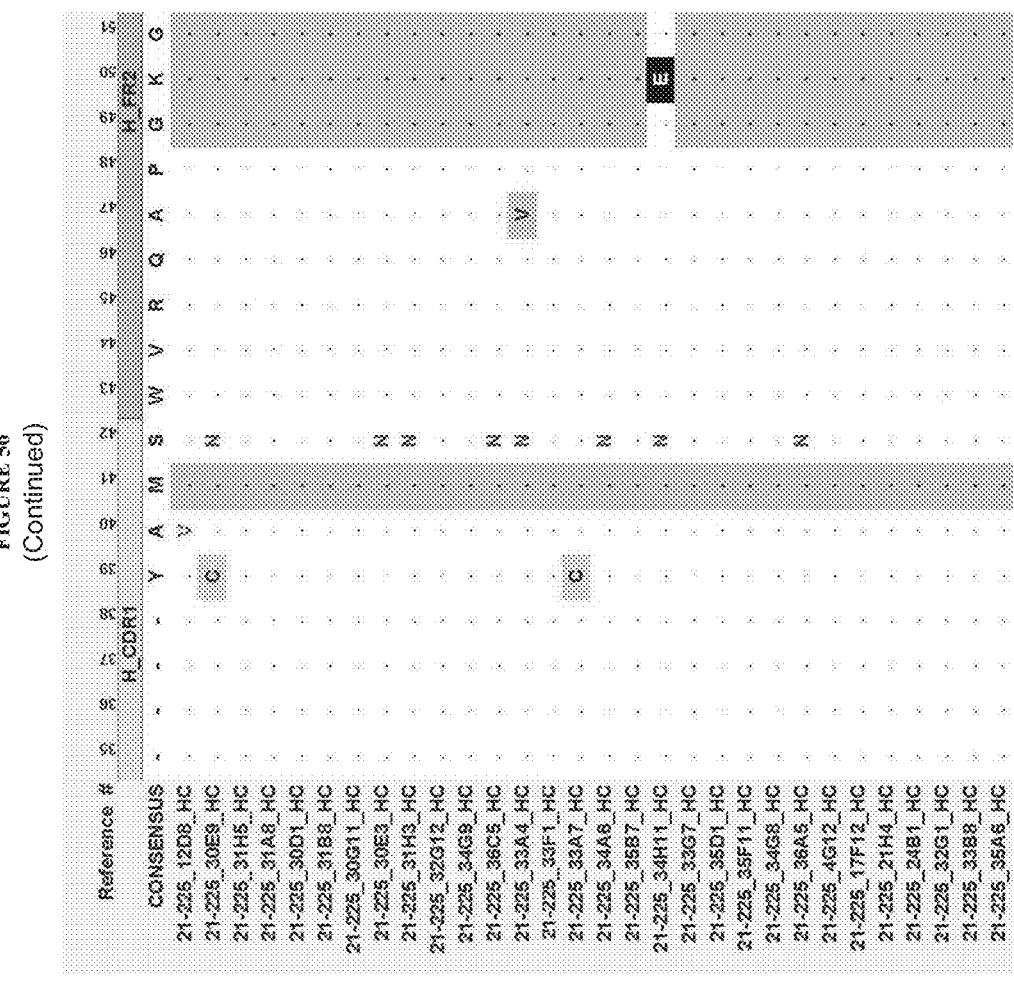
Figure 56:
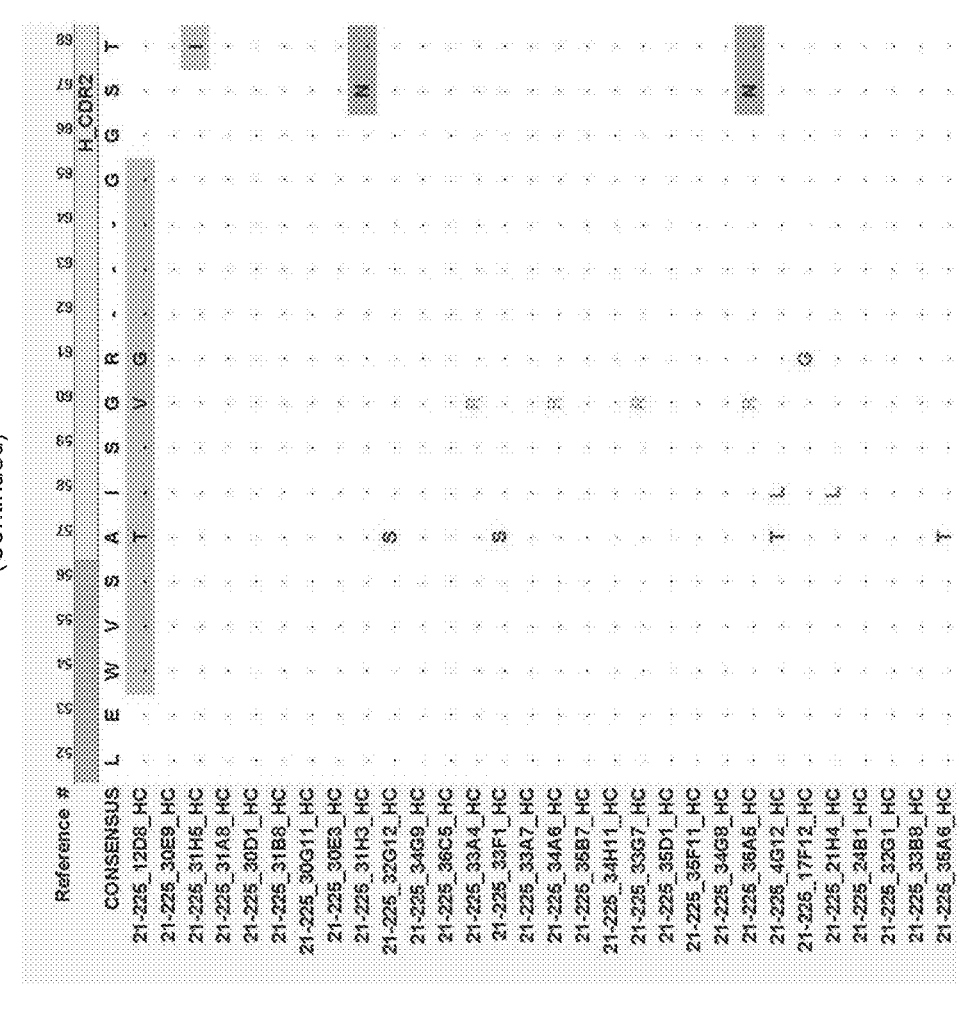
Figure 56:
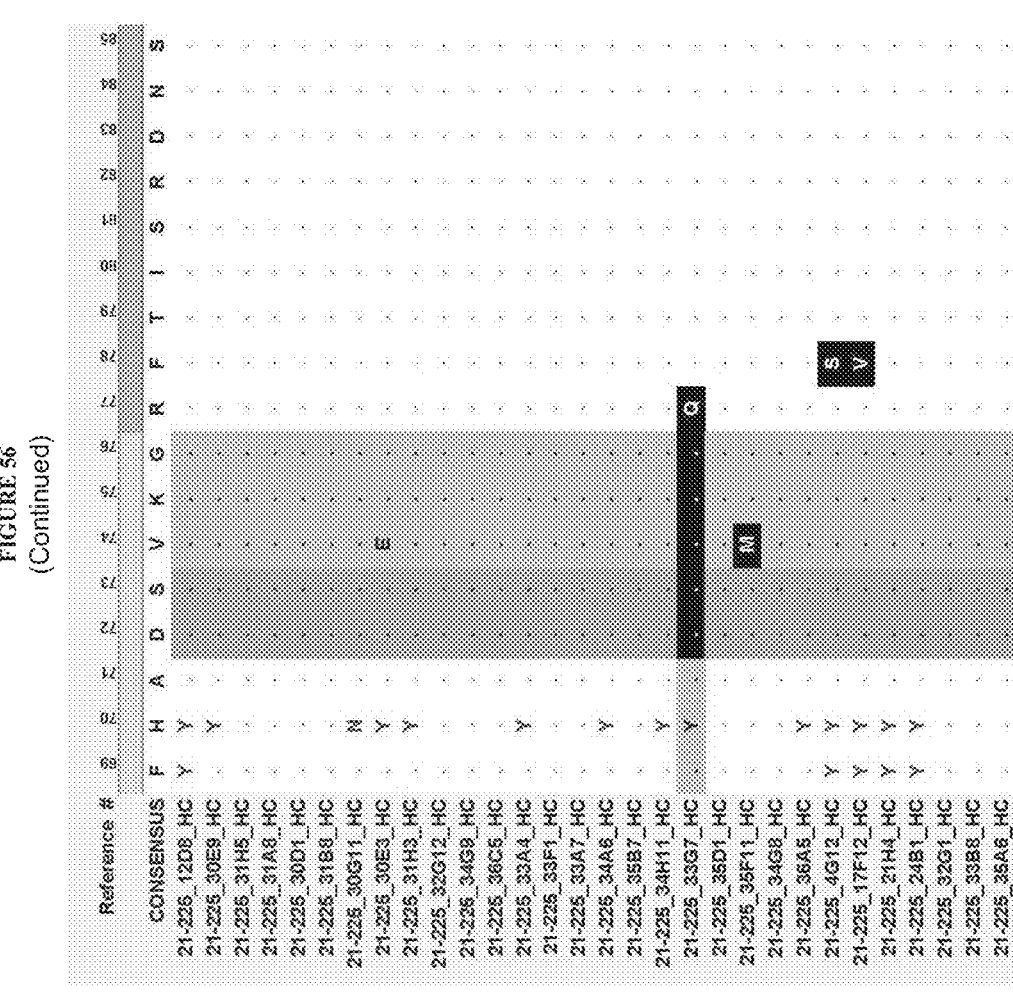
Figure 56:
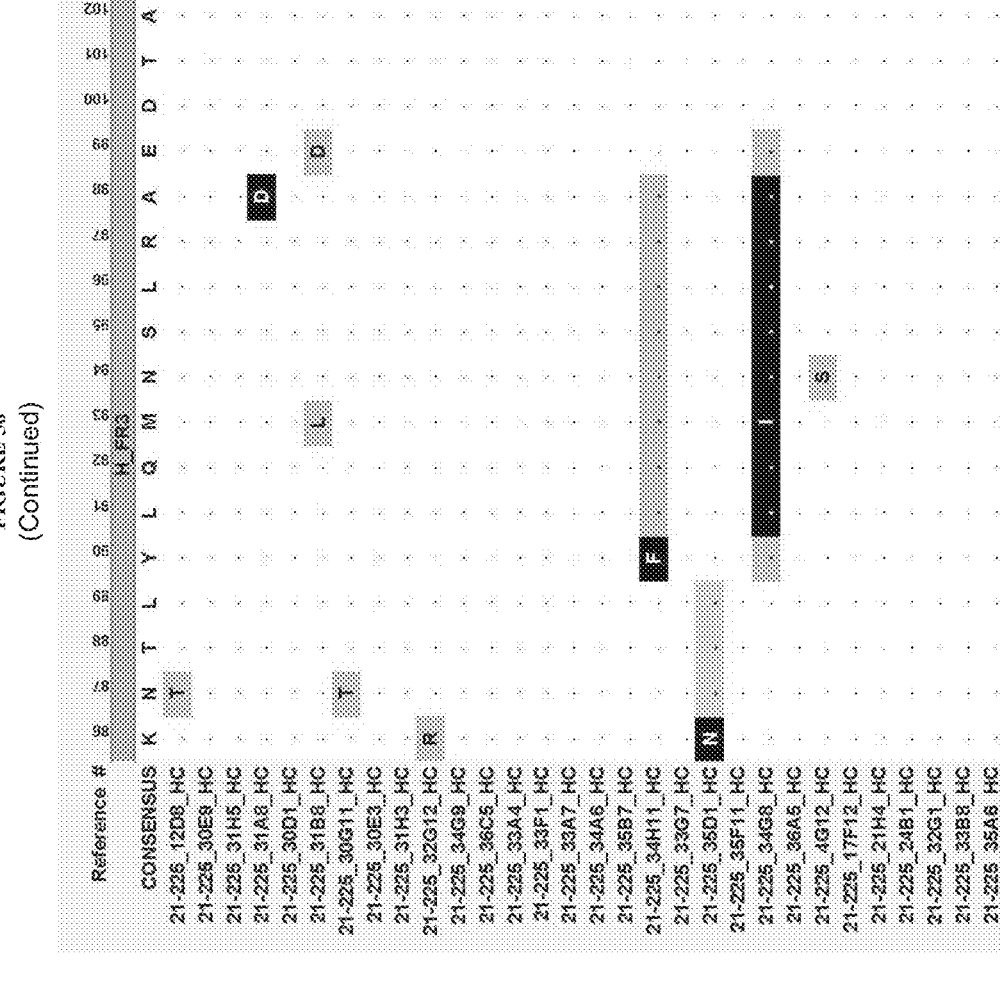
Figure 56:
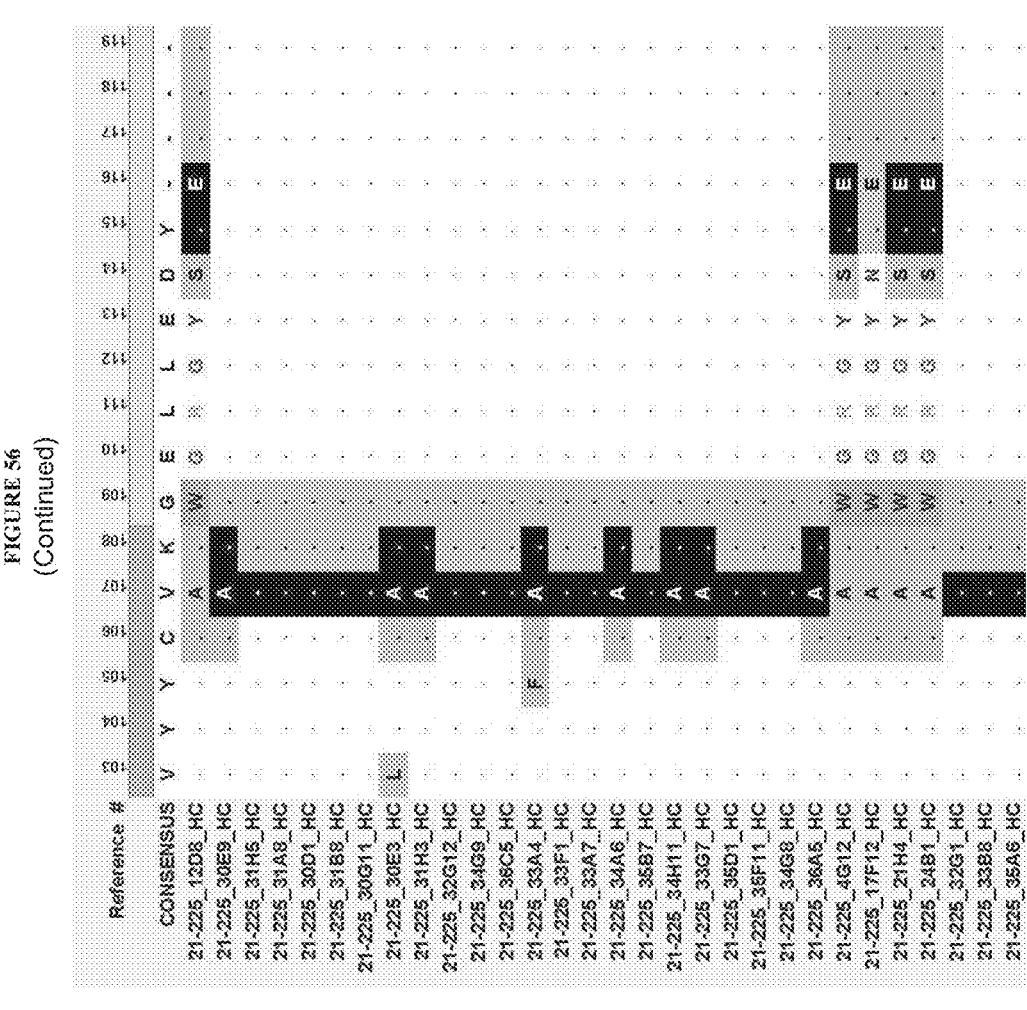
Figure 56:
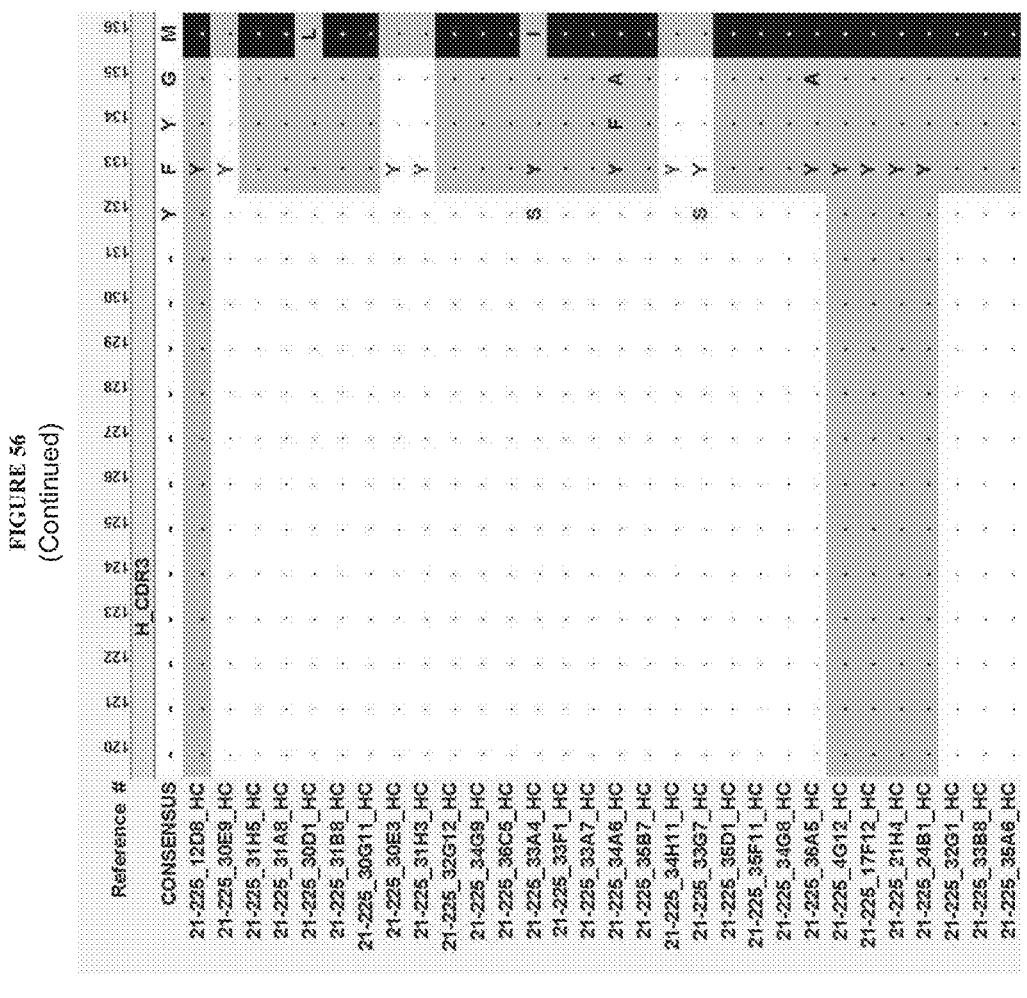
Figure 56:
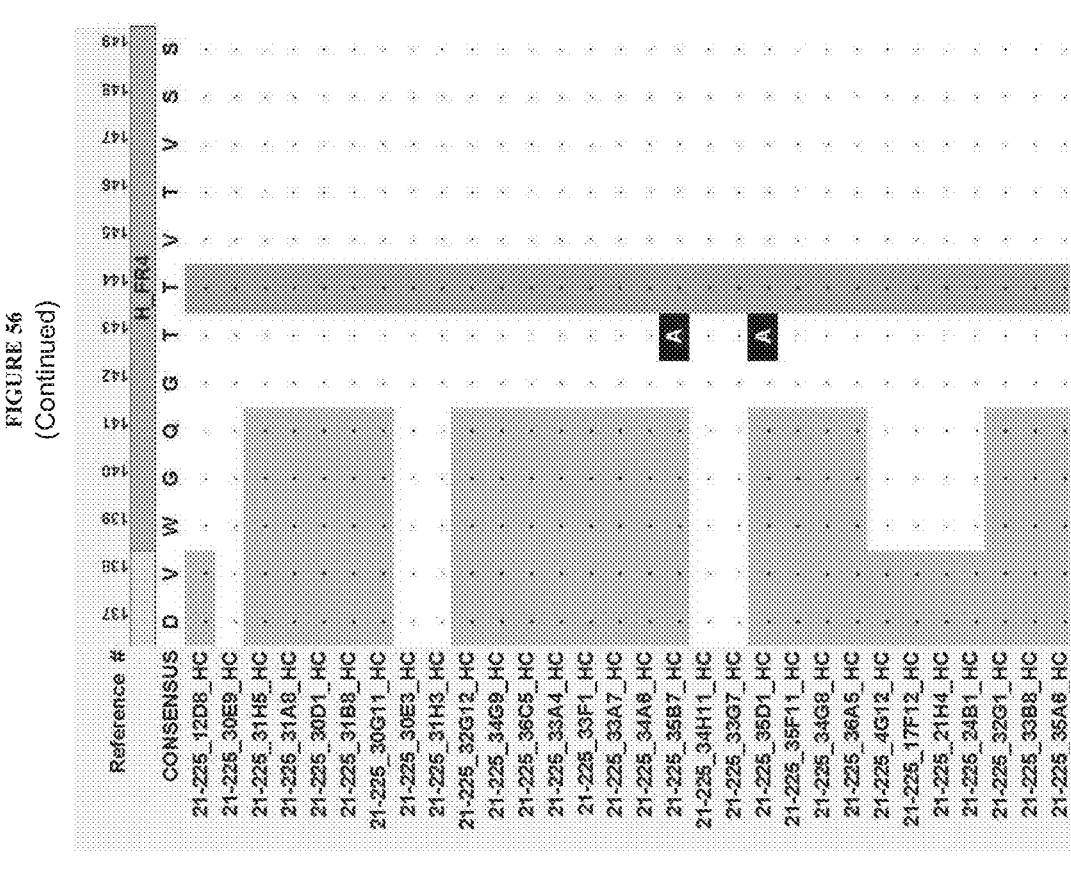
Figure 56:
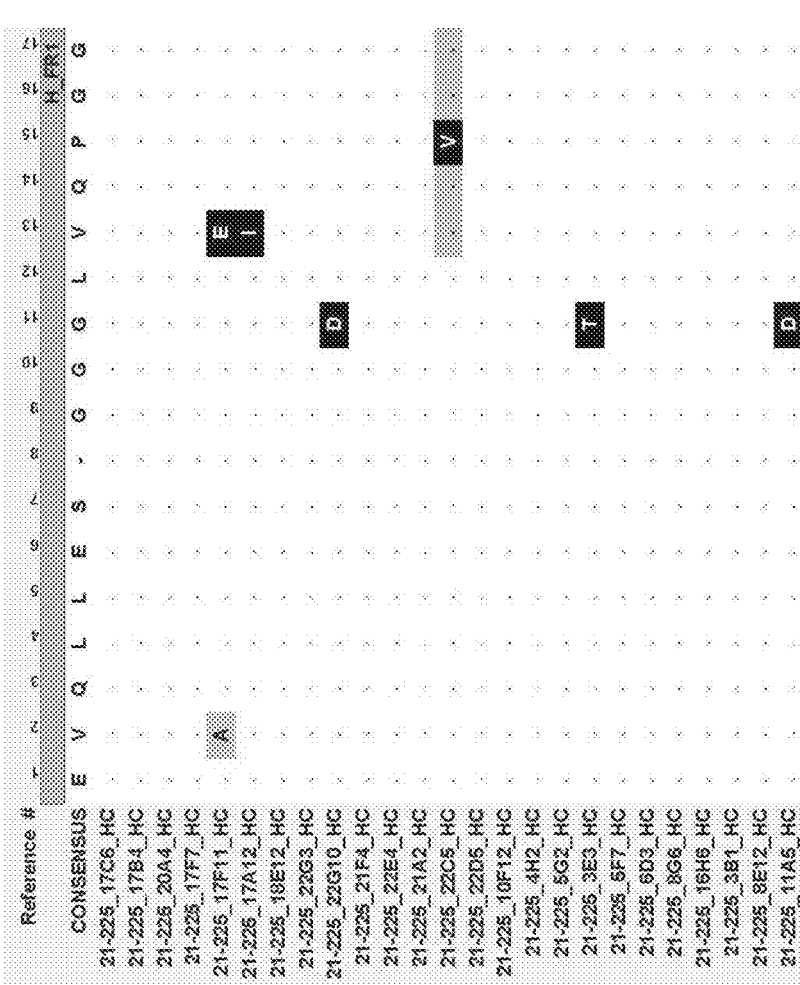
Figure 56:
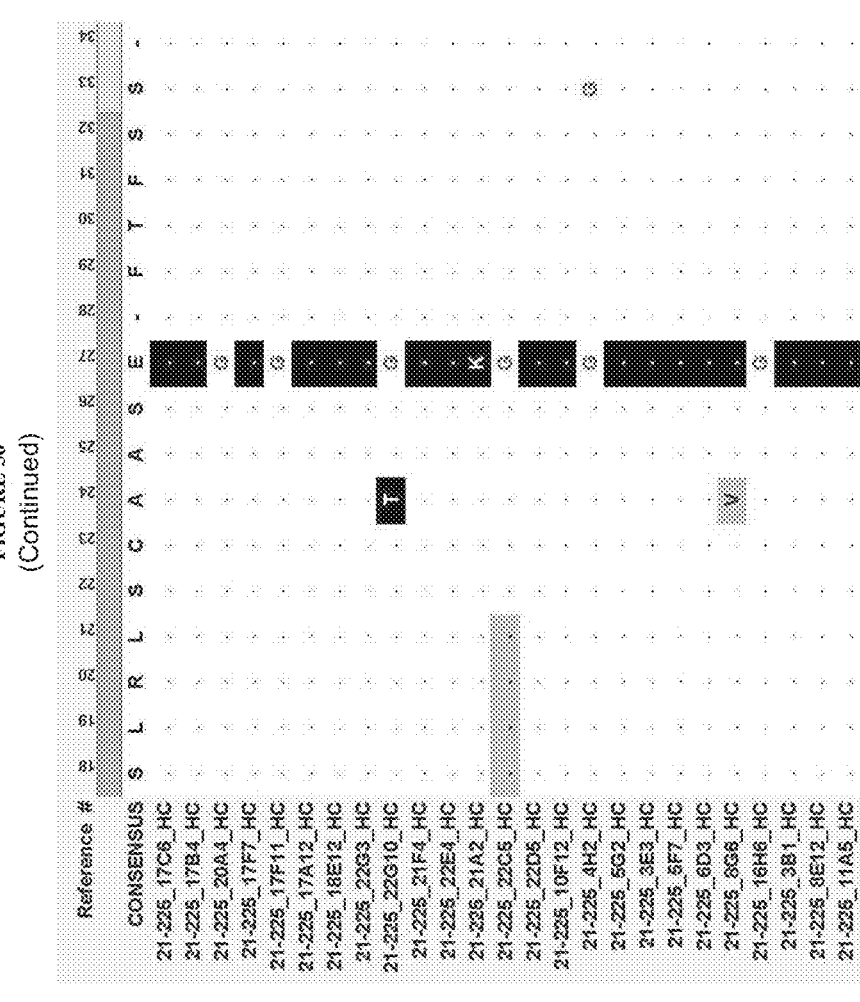
Figure 56:
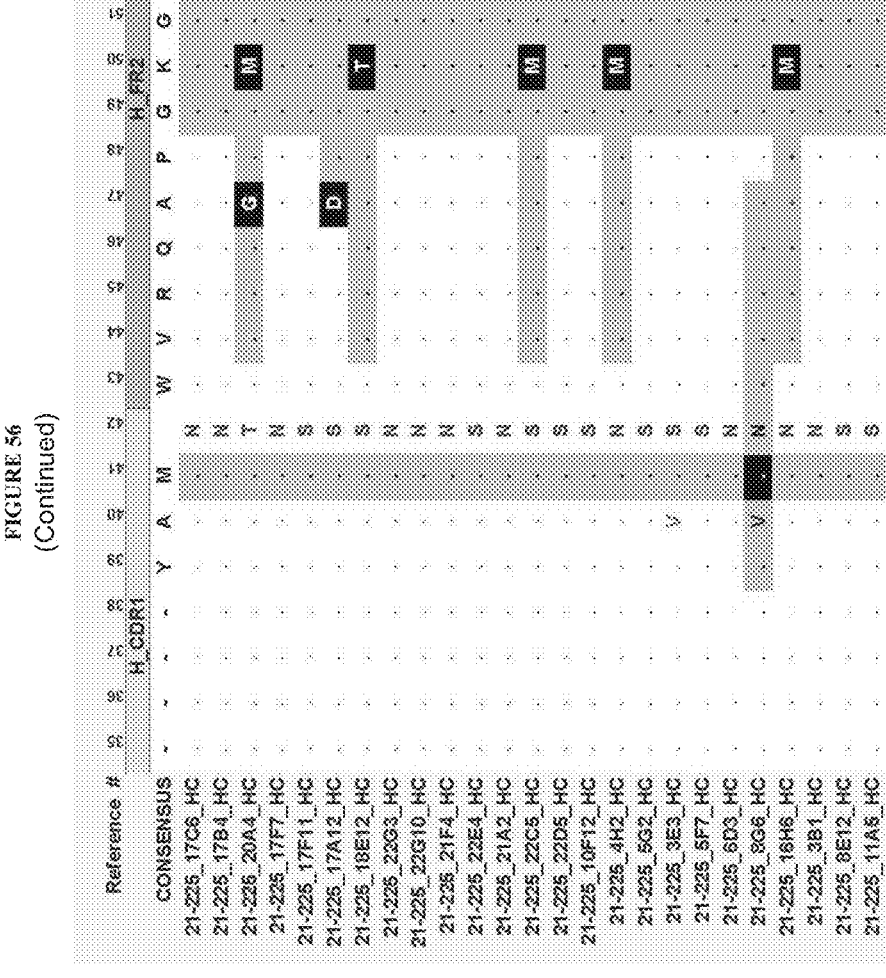
Figure 56:
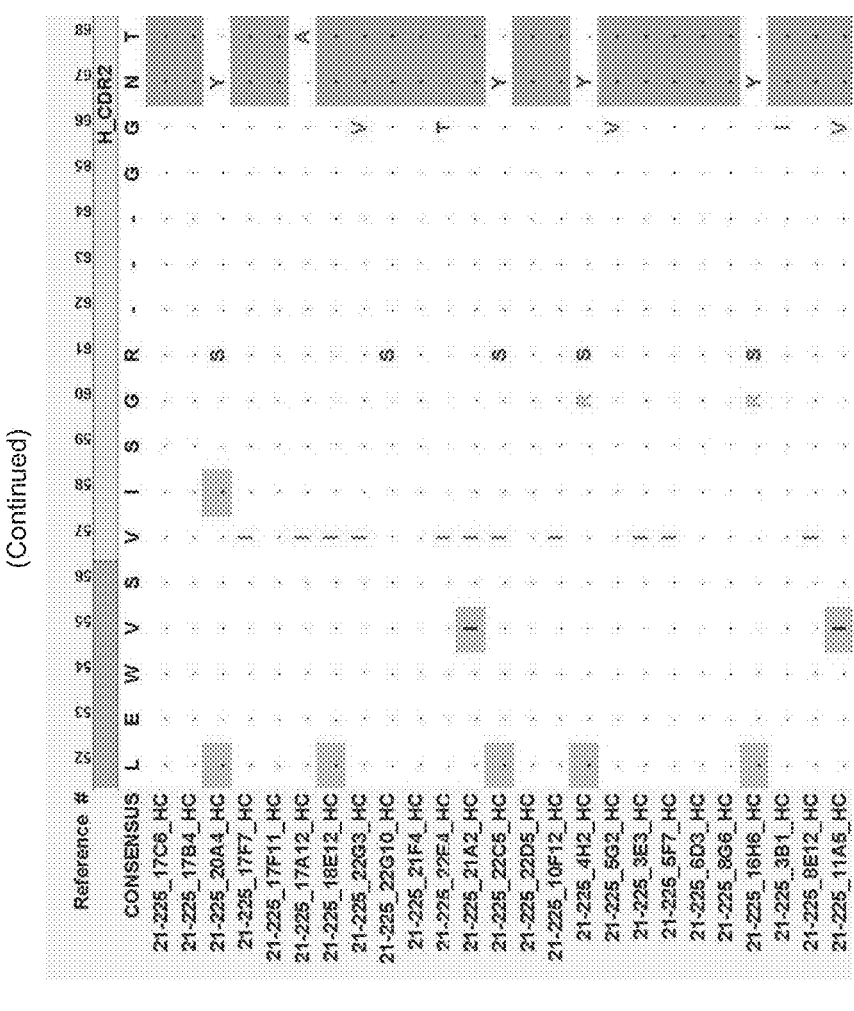
Figure 56:
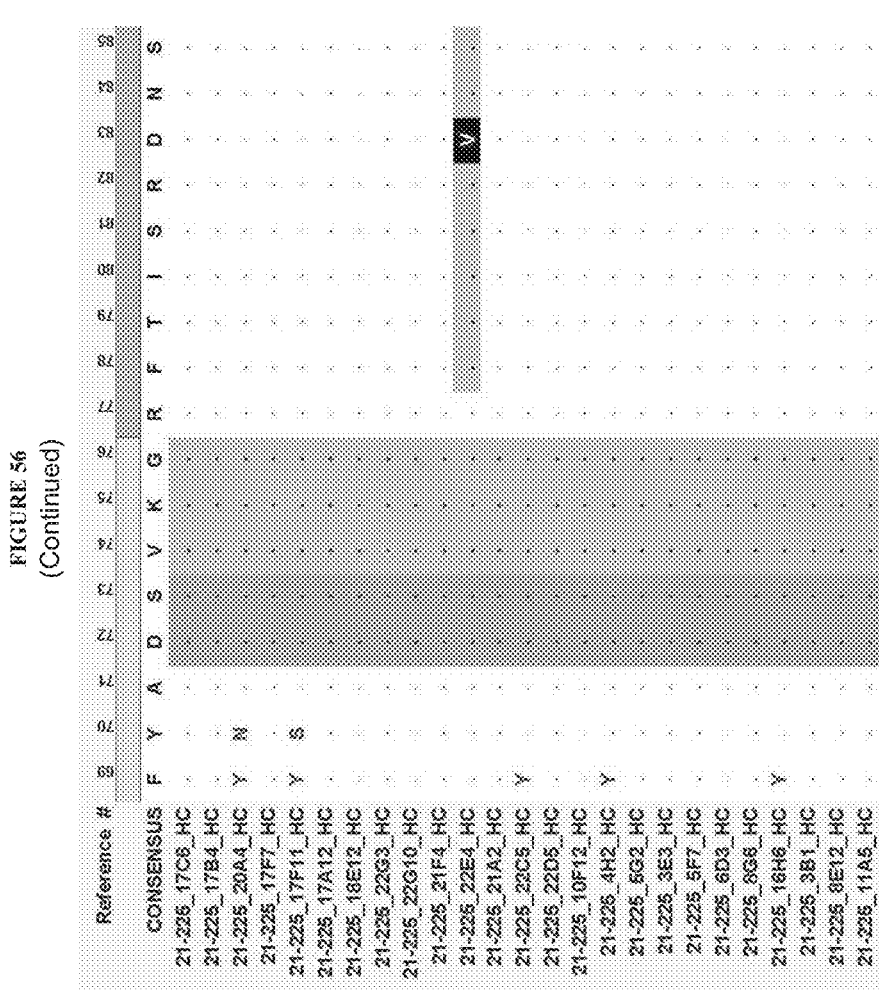
Figure 56:
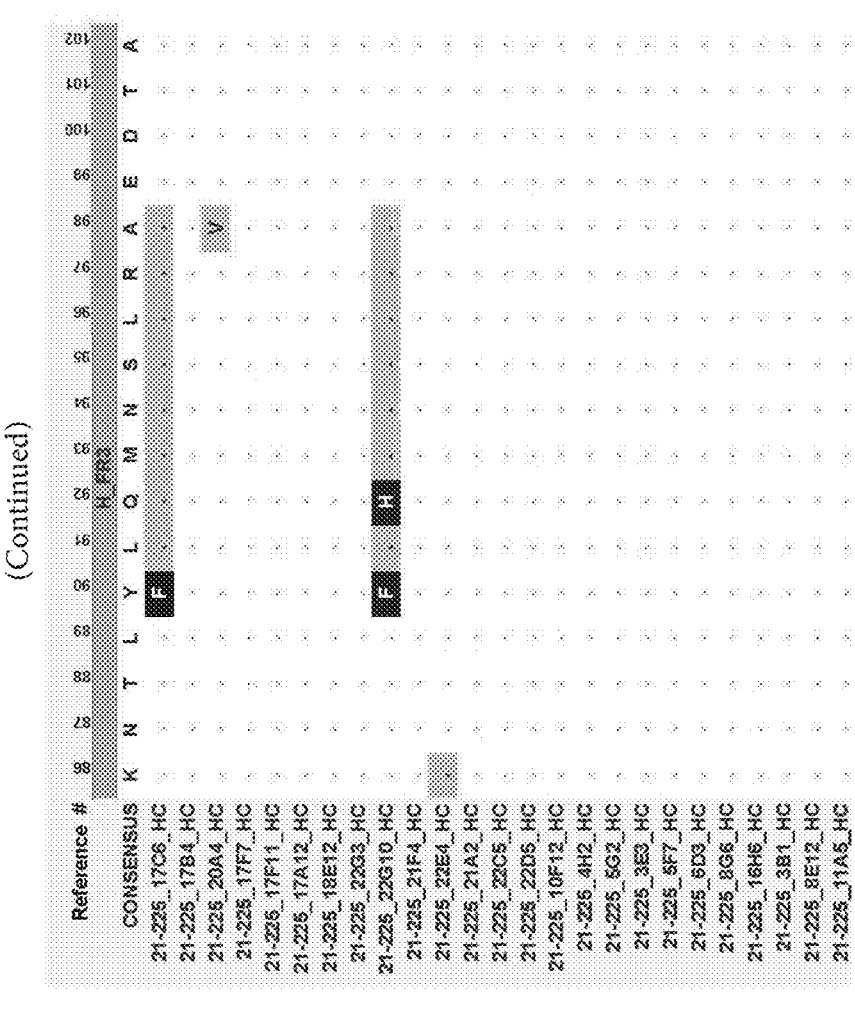
Figure 56:
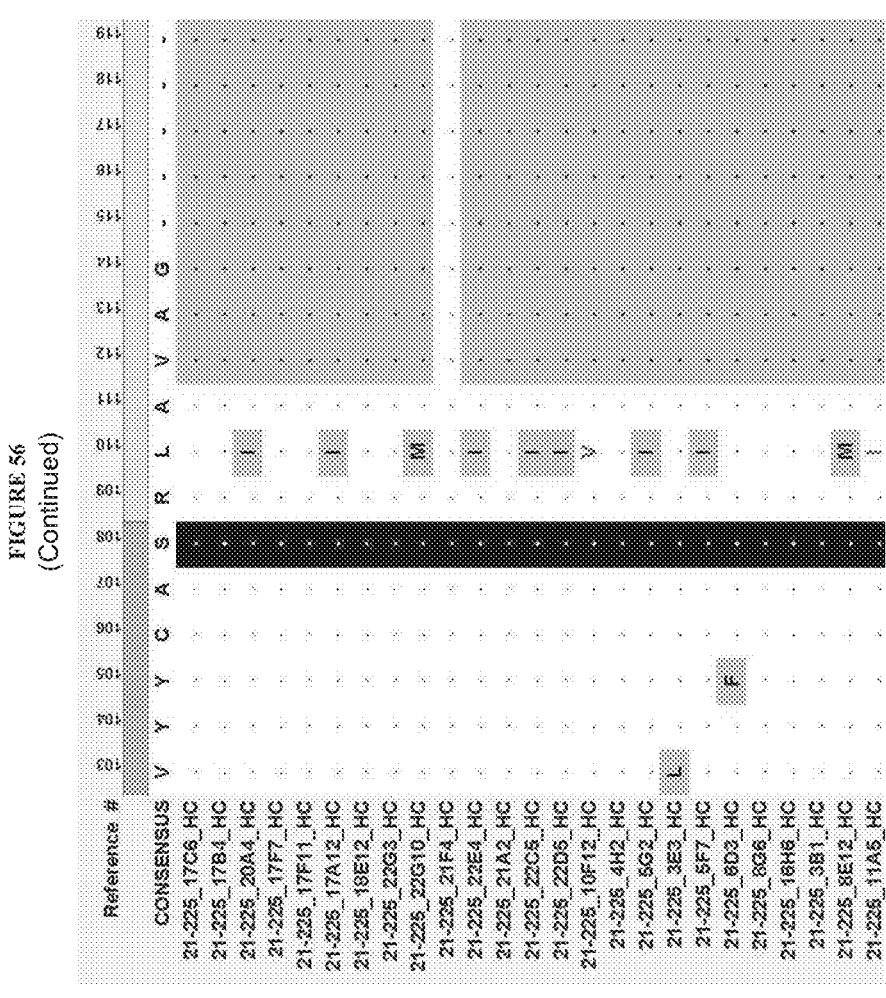
Figure 56:
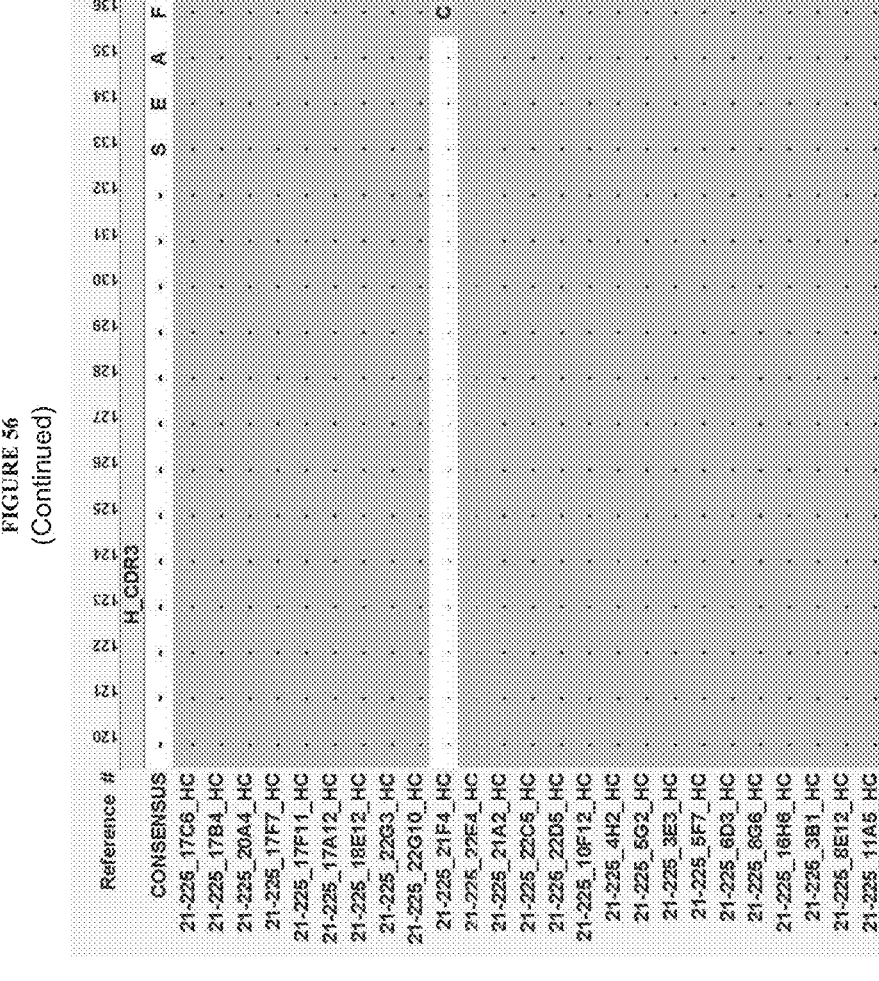
Figure 56:
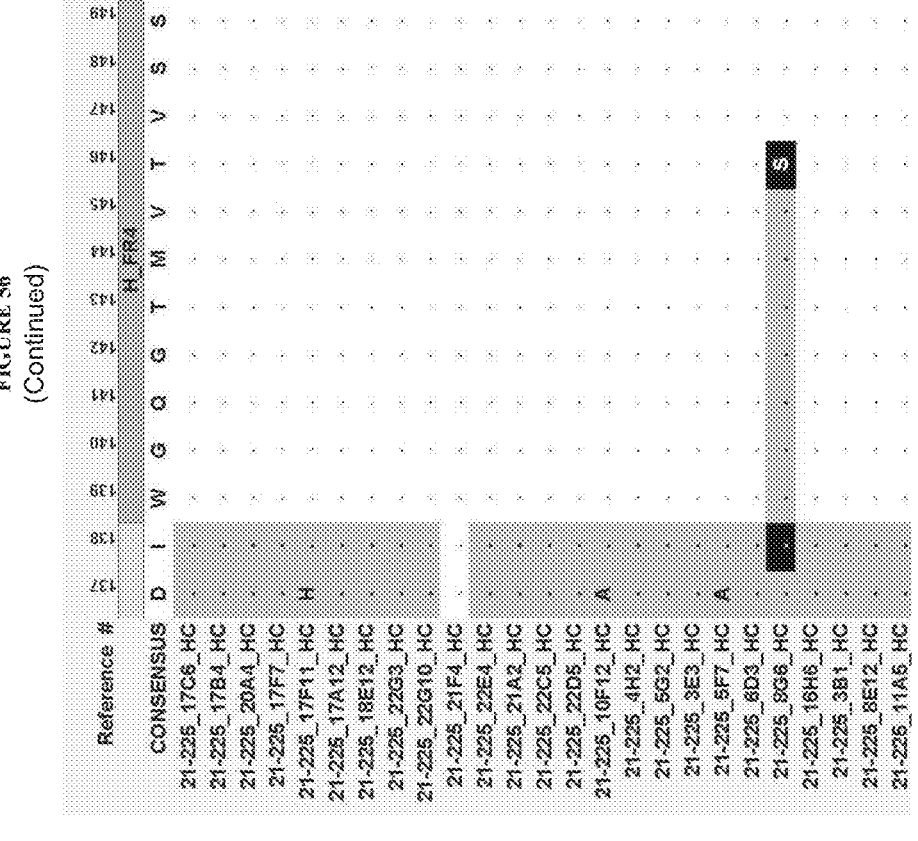
Figure 56:
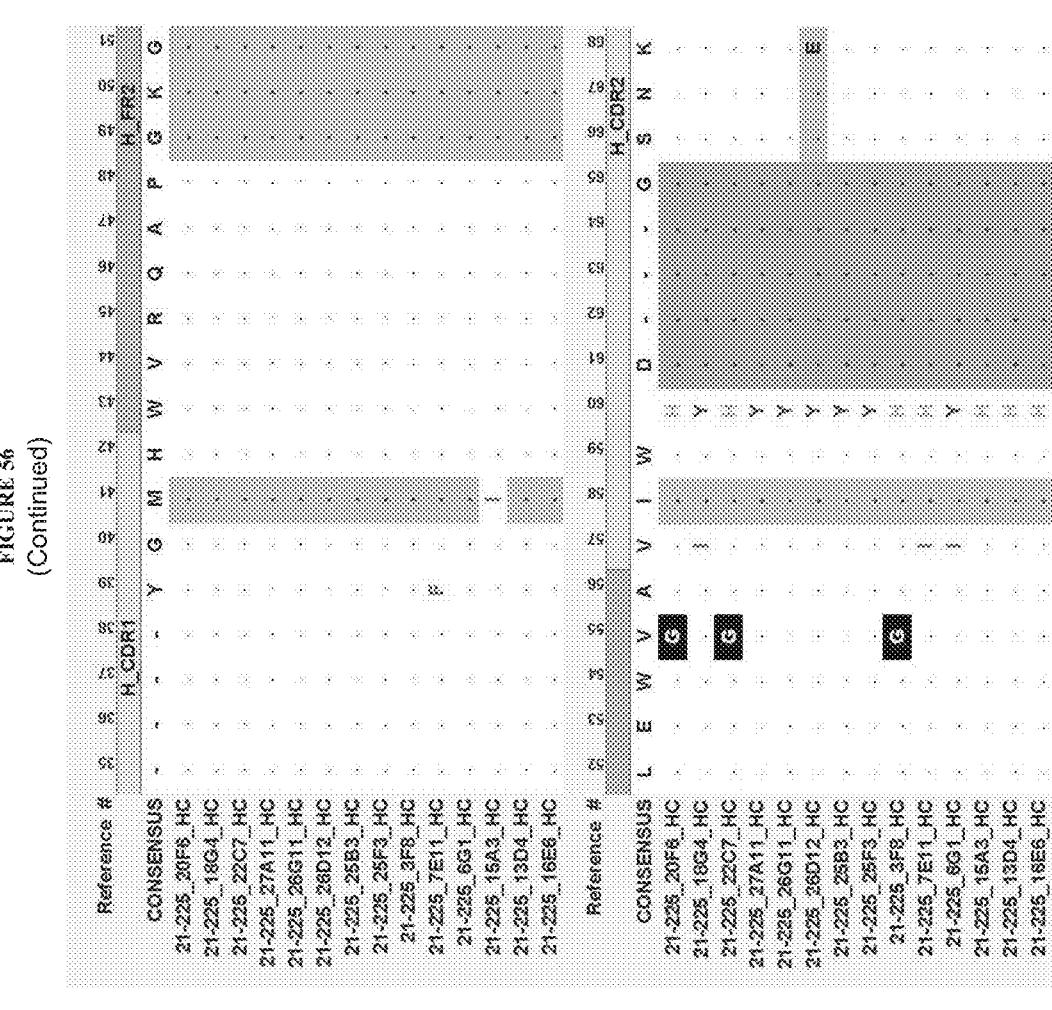
Figure 56:
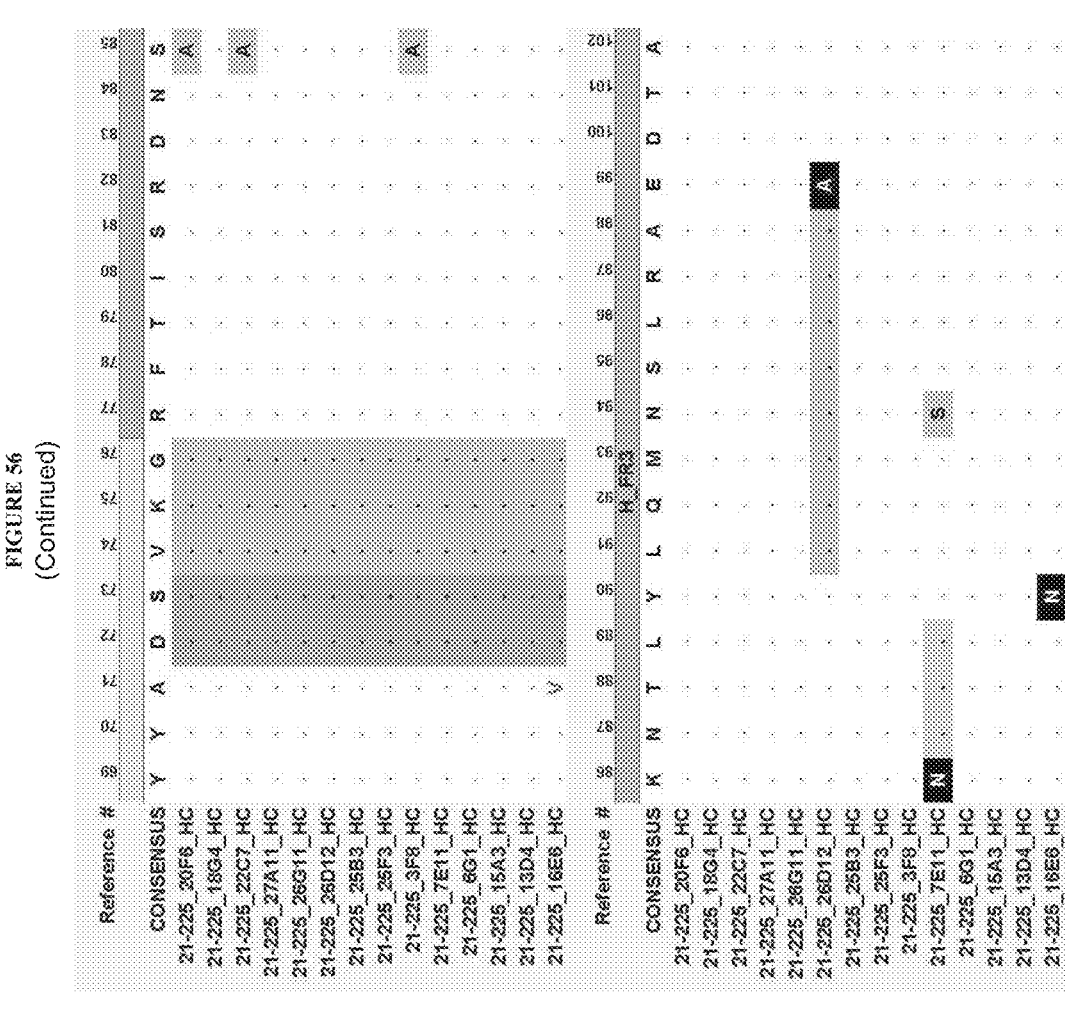
Figure 56:
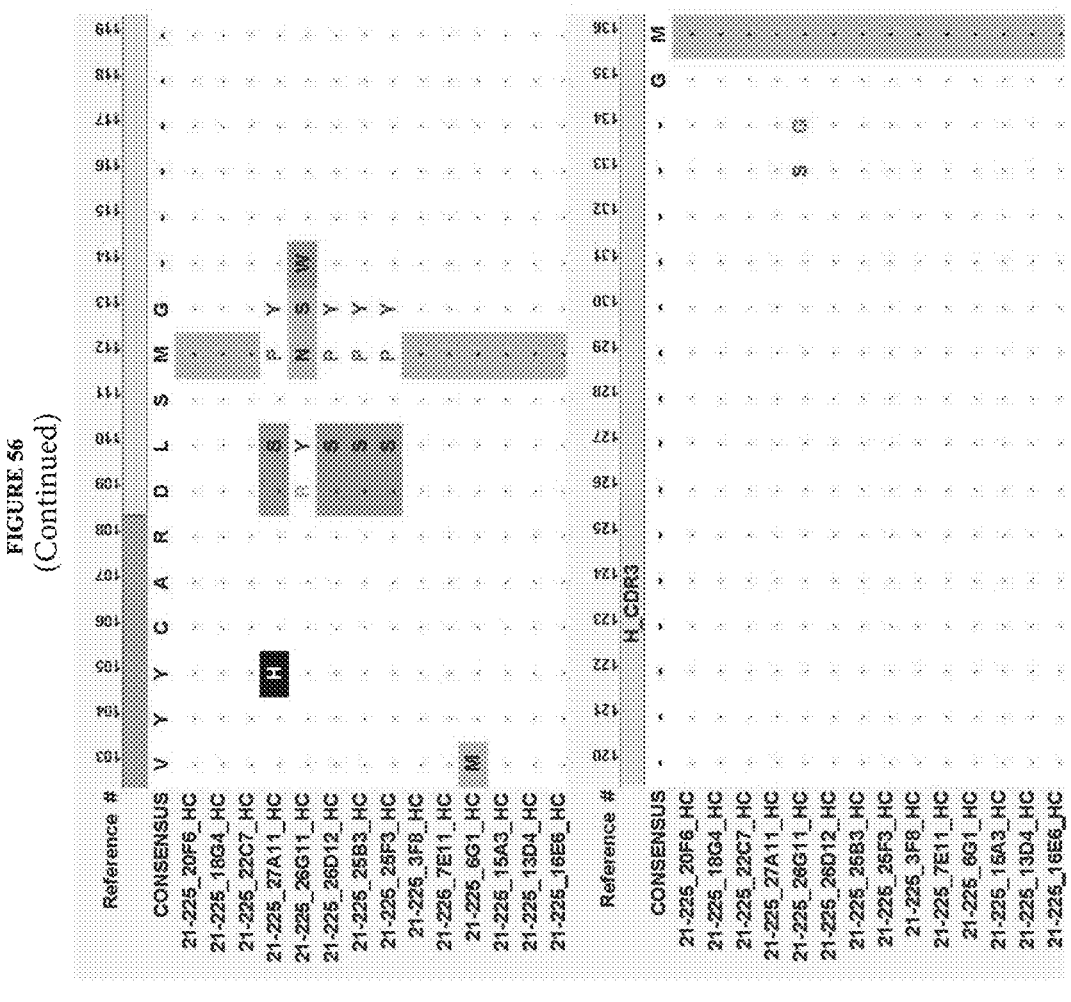
Figure 56:
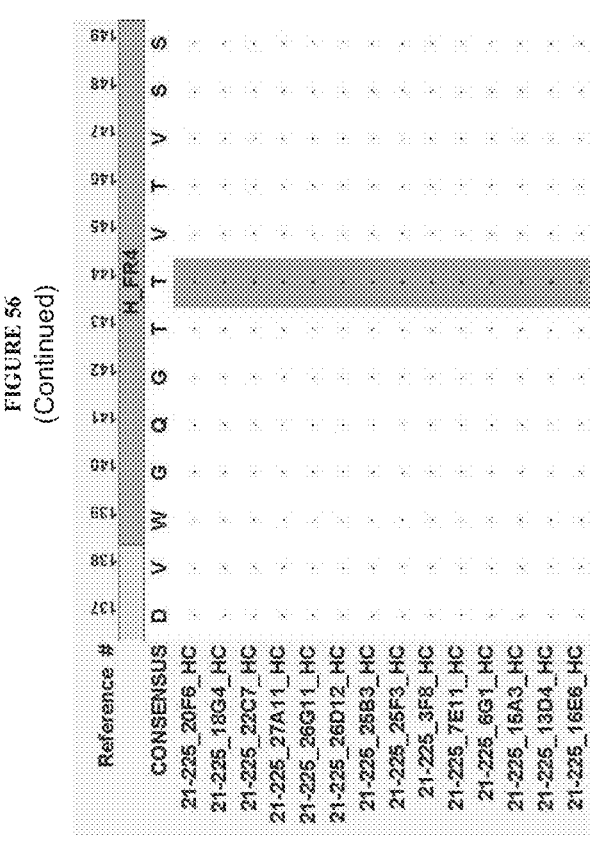
Figure 56:
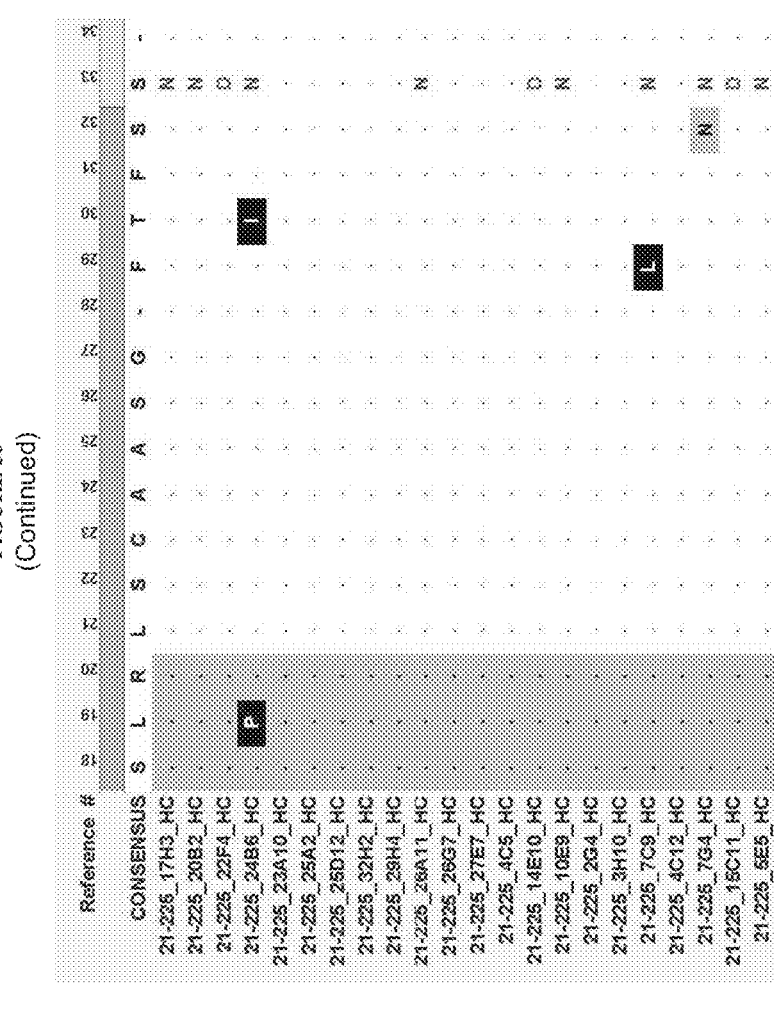
Figure 56:
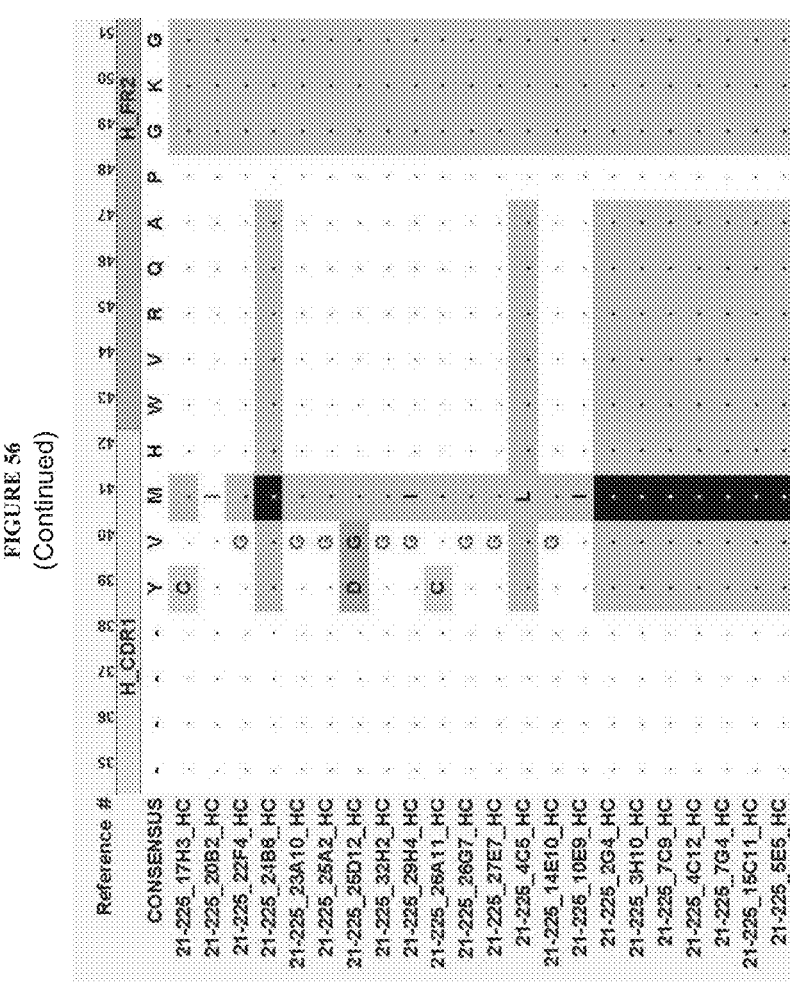
Figure 56:
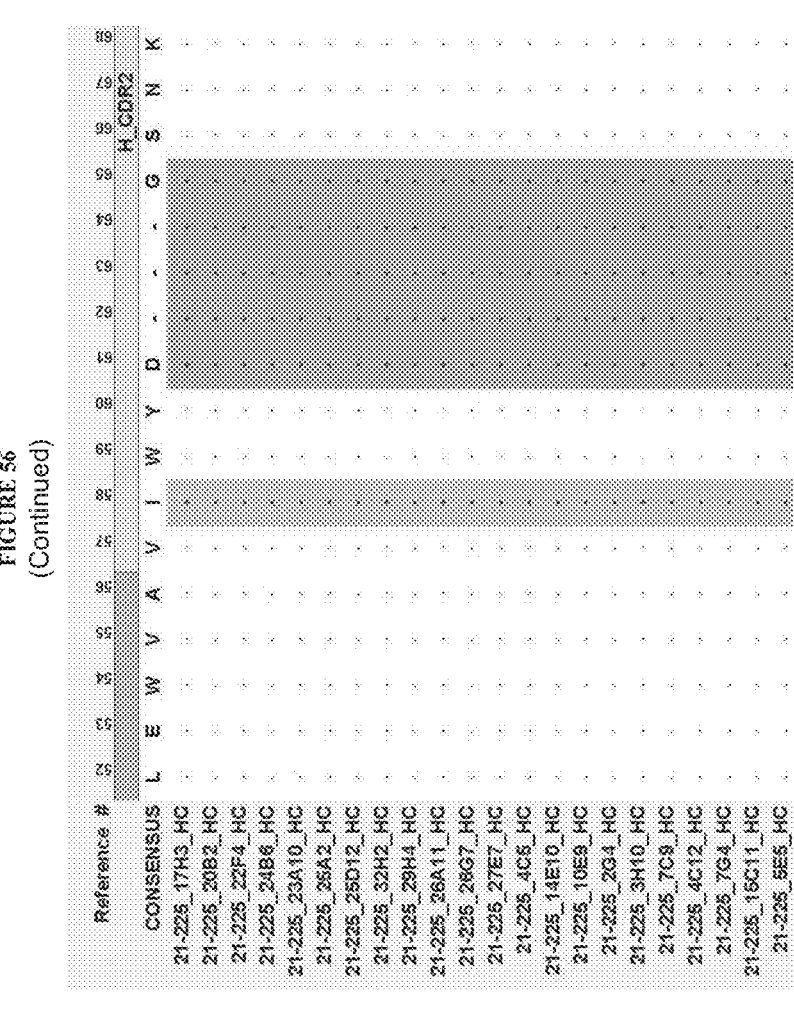
Figure 56:
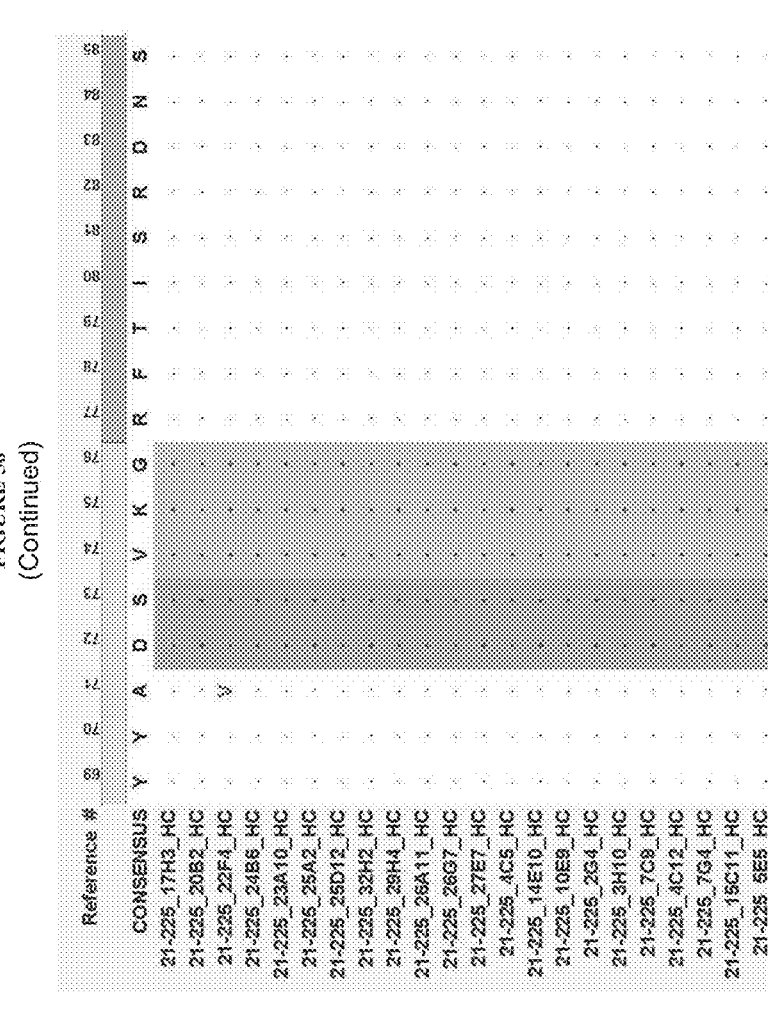
Figure 56:
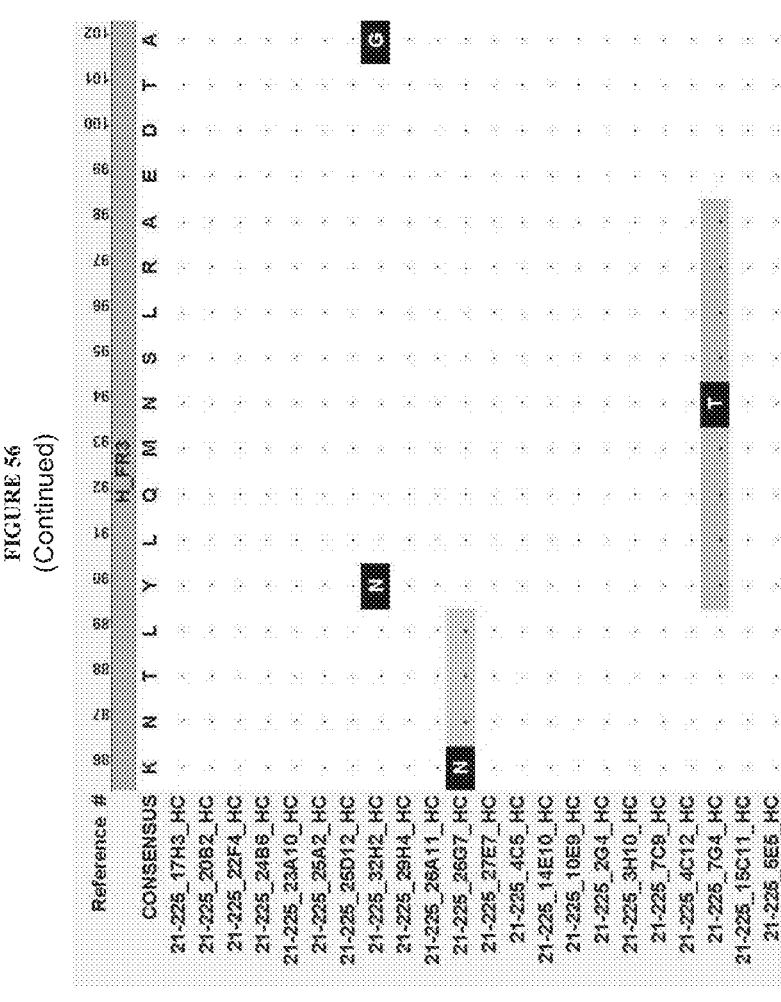
Figure 56:
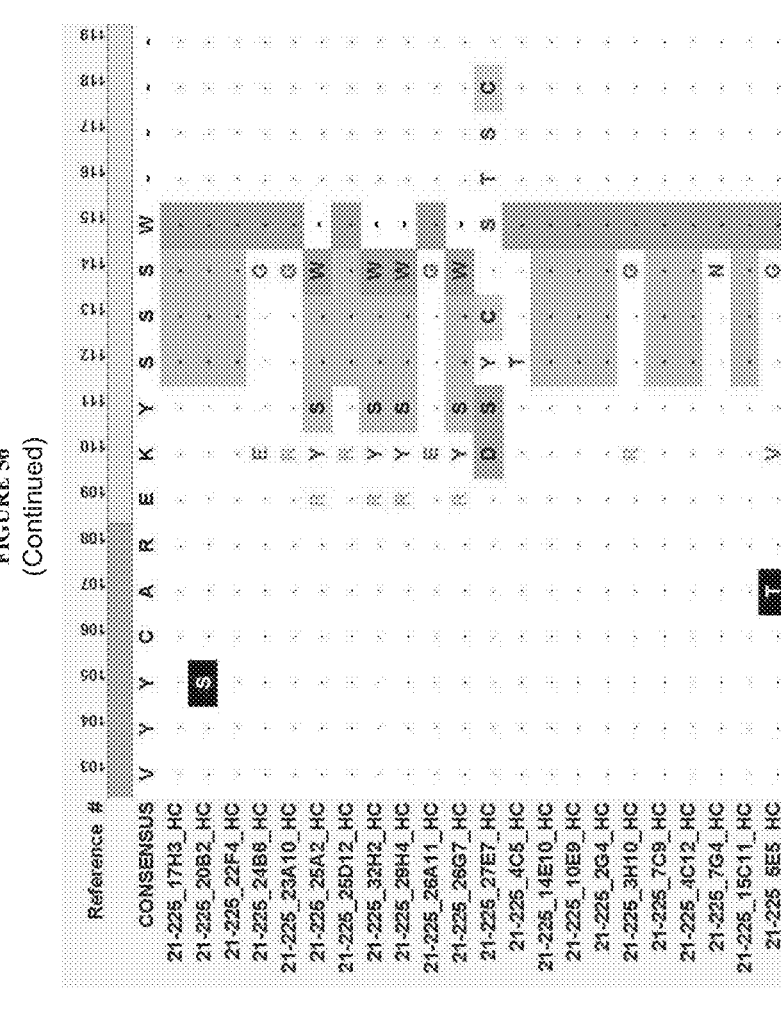
Figure 56:
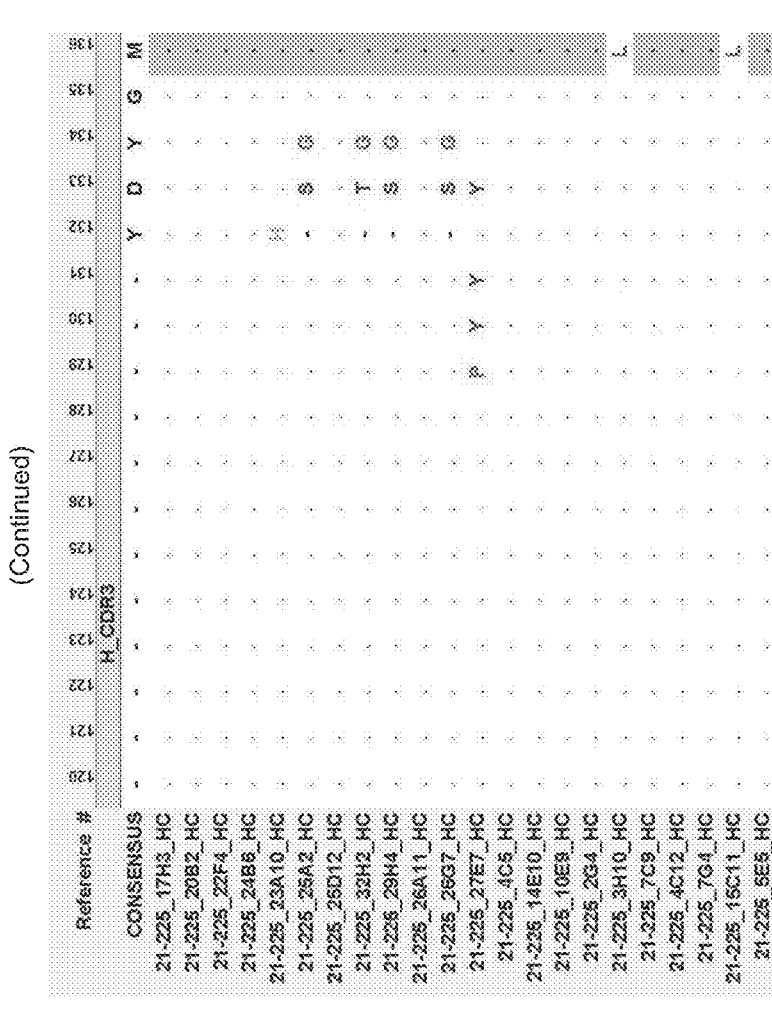
Figure 56:
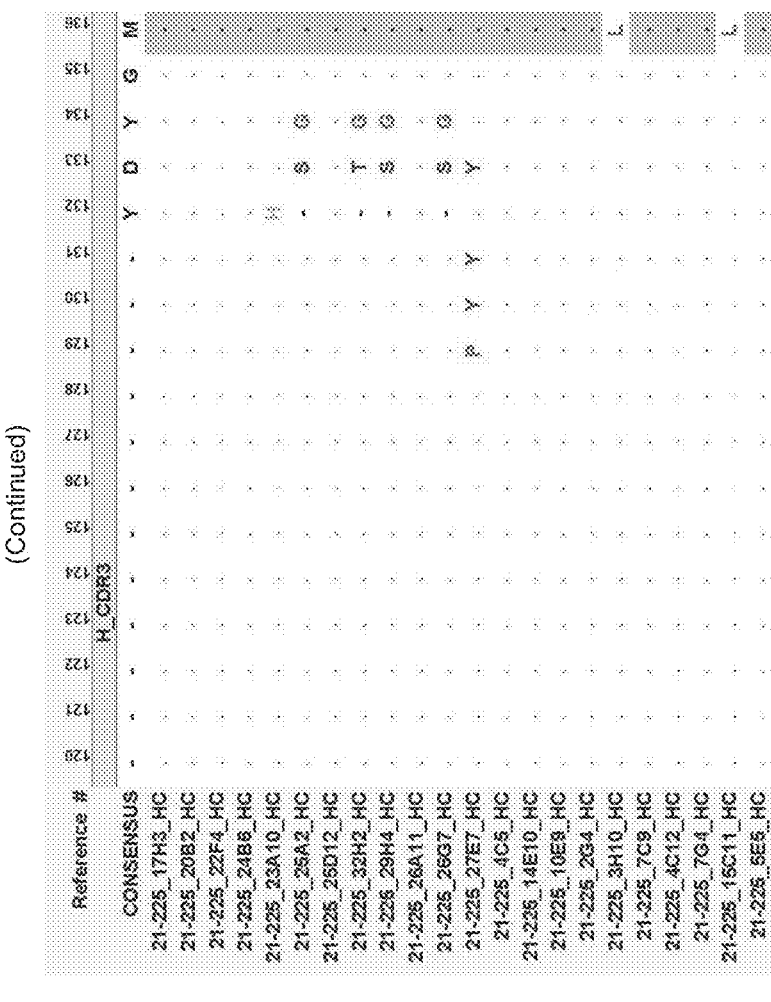
Figure 56:
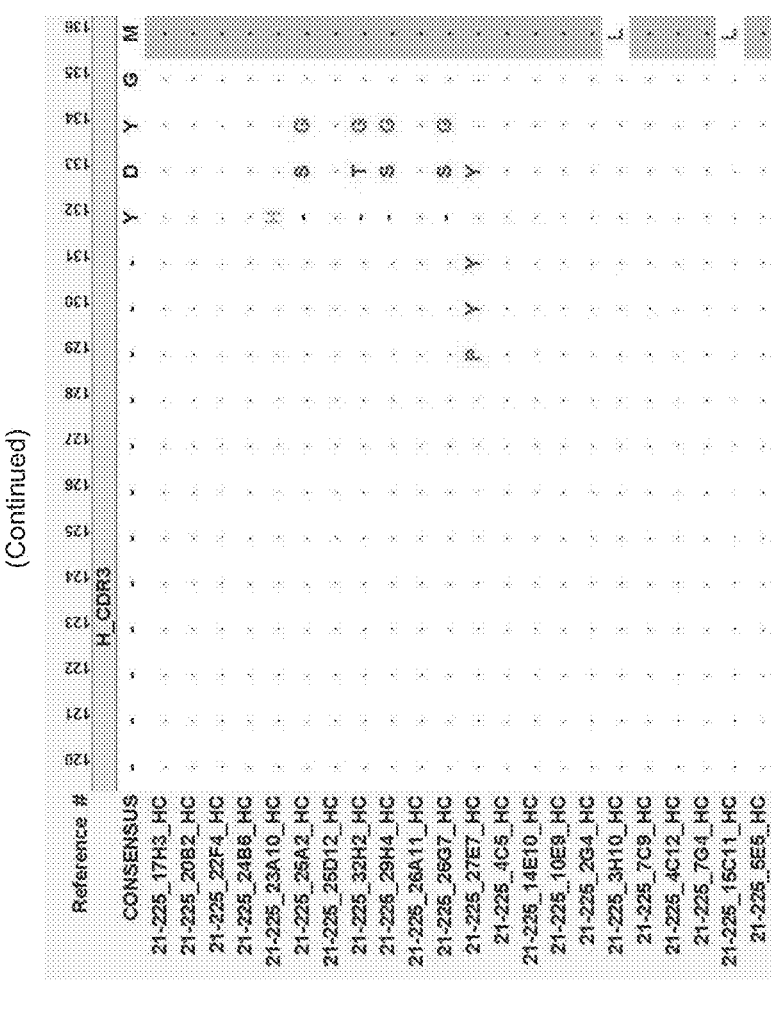
Figure 56:
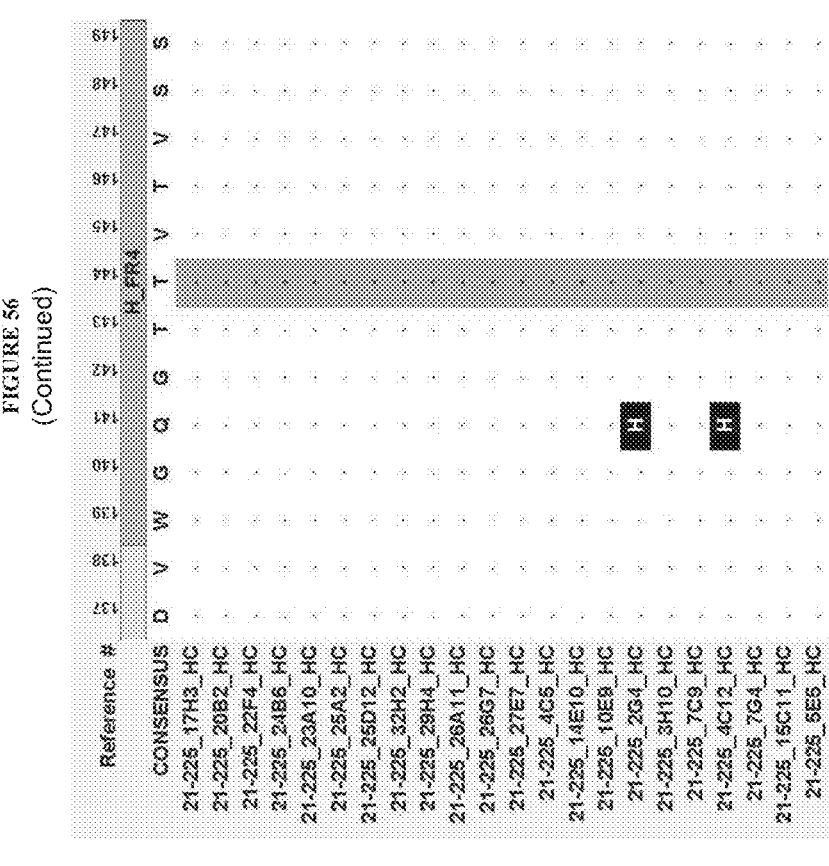
Figure 56:
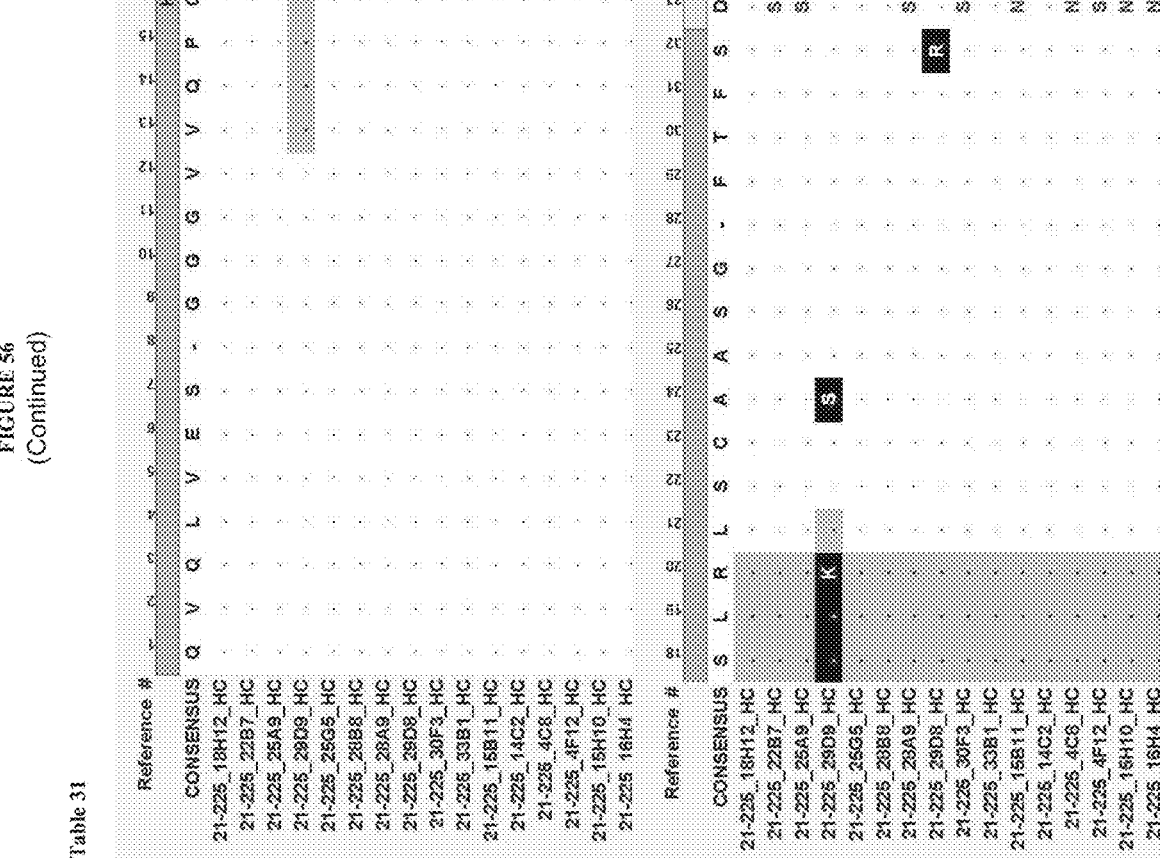
Figure 56:
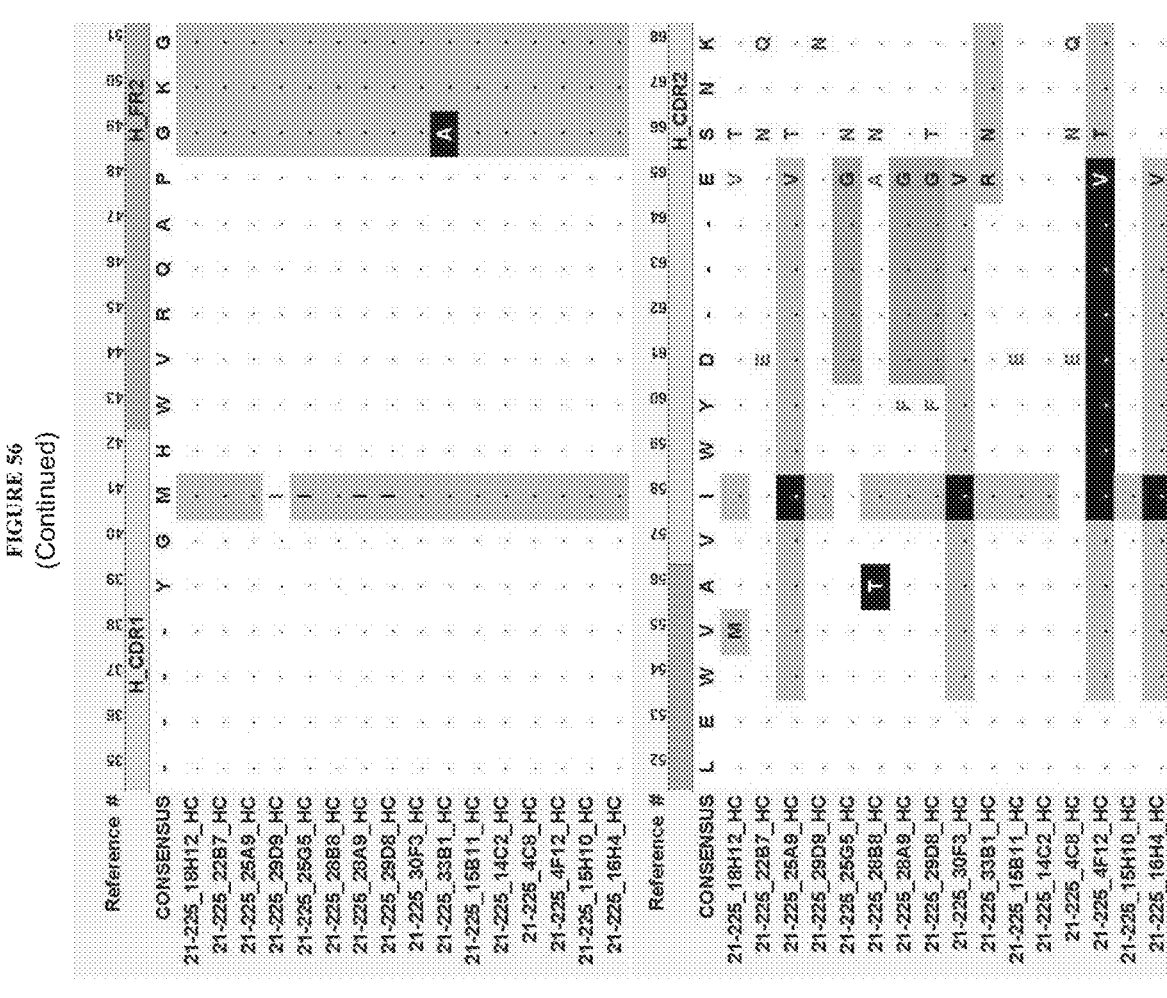
Figure 56:
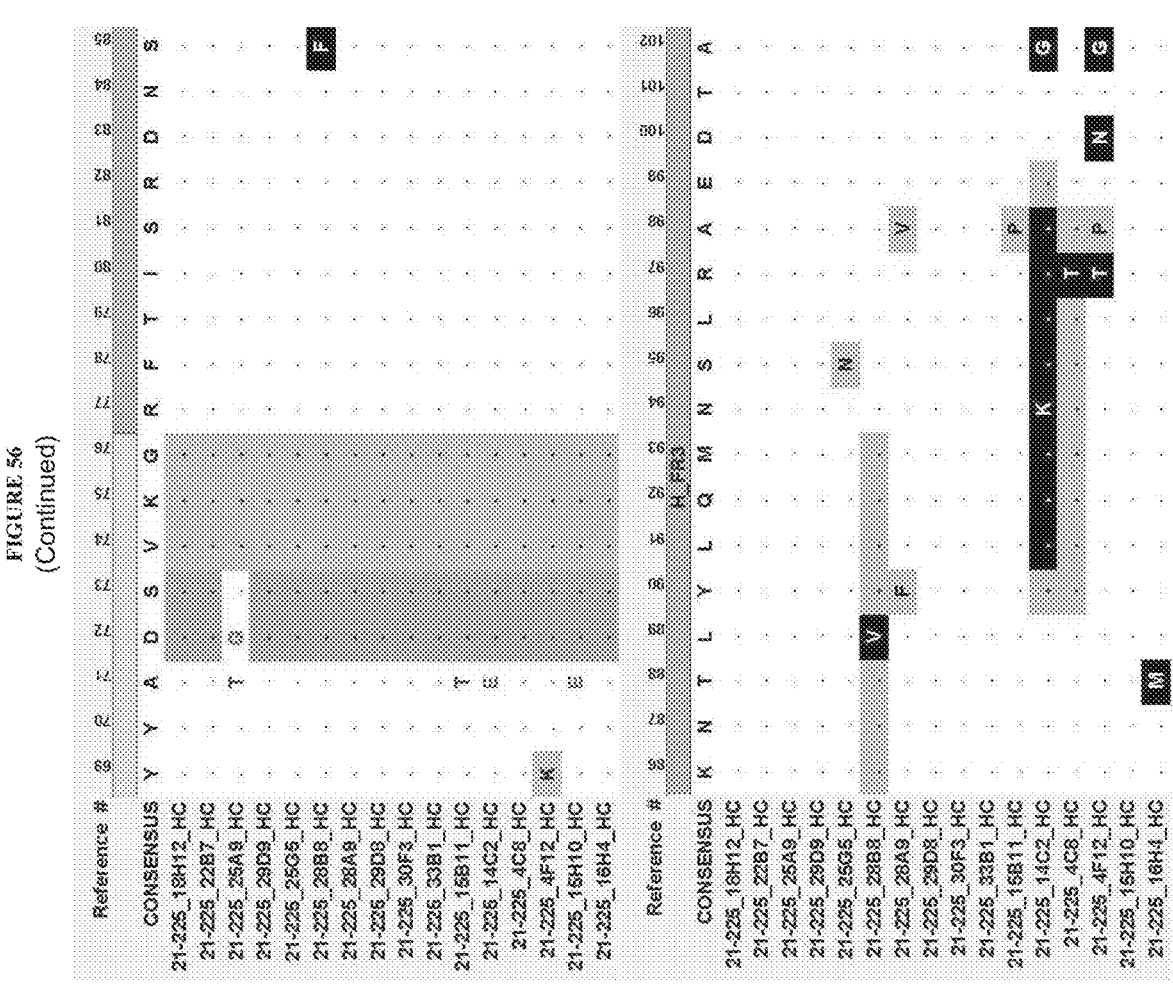
Figure 56:
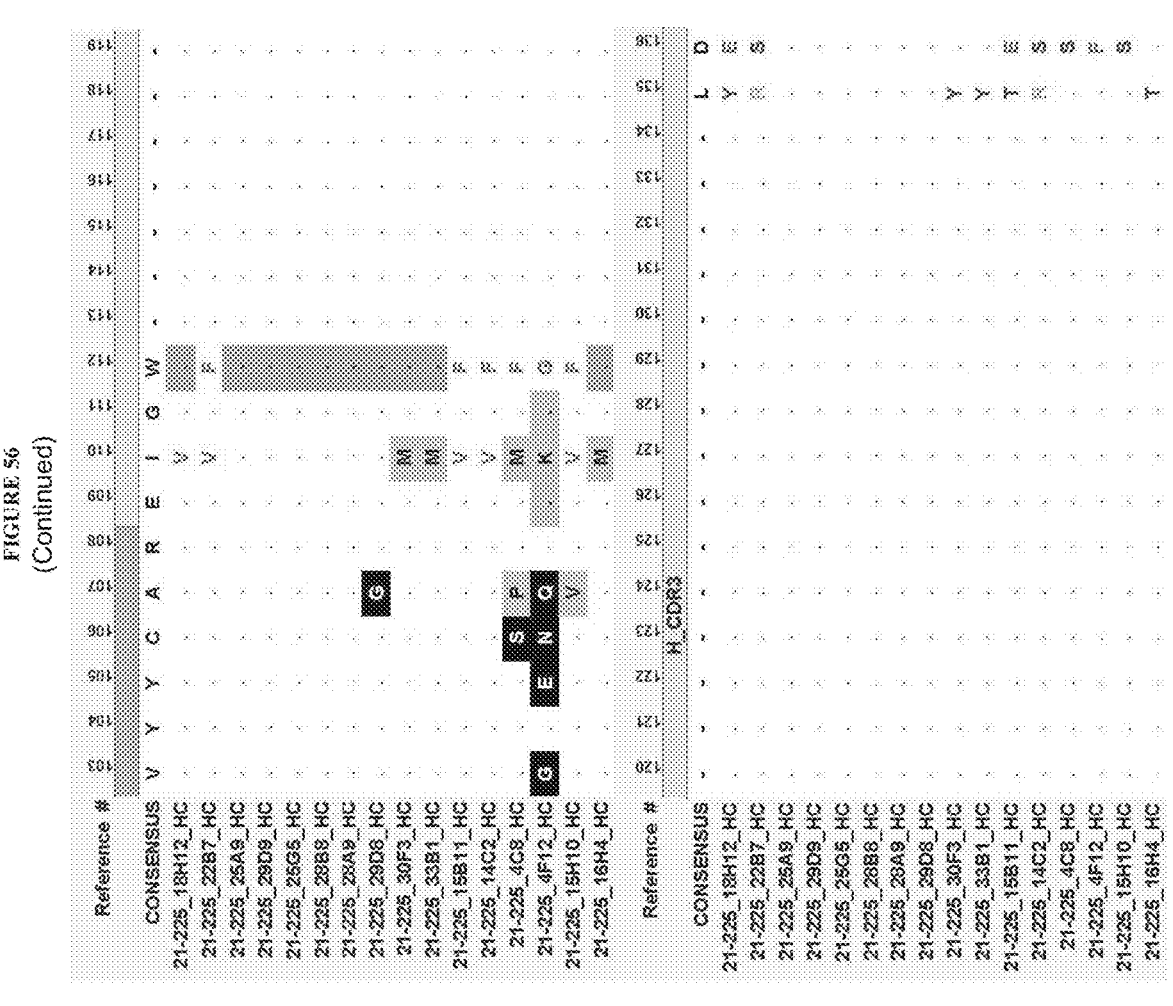
Figure 56:
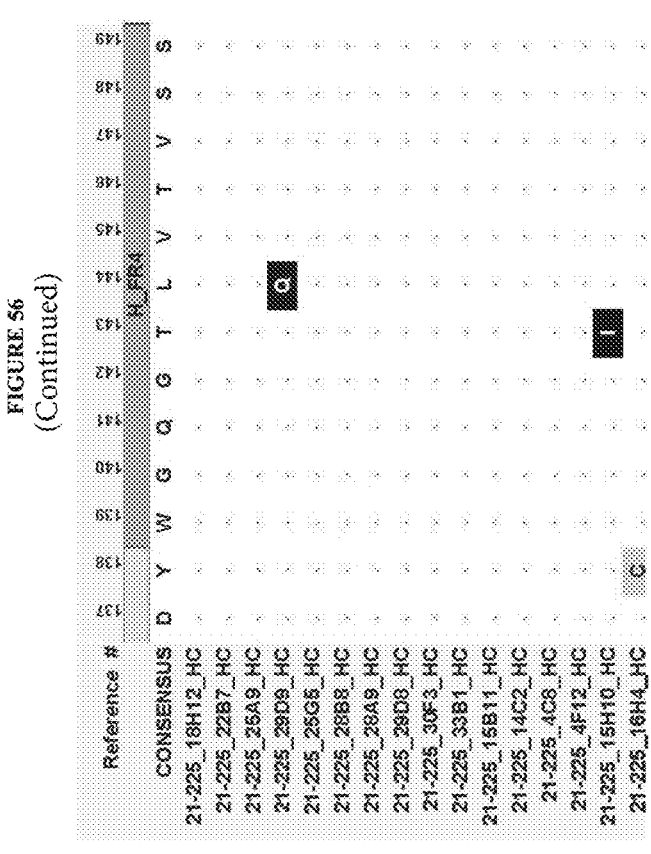
Figure 56:
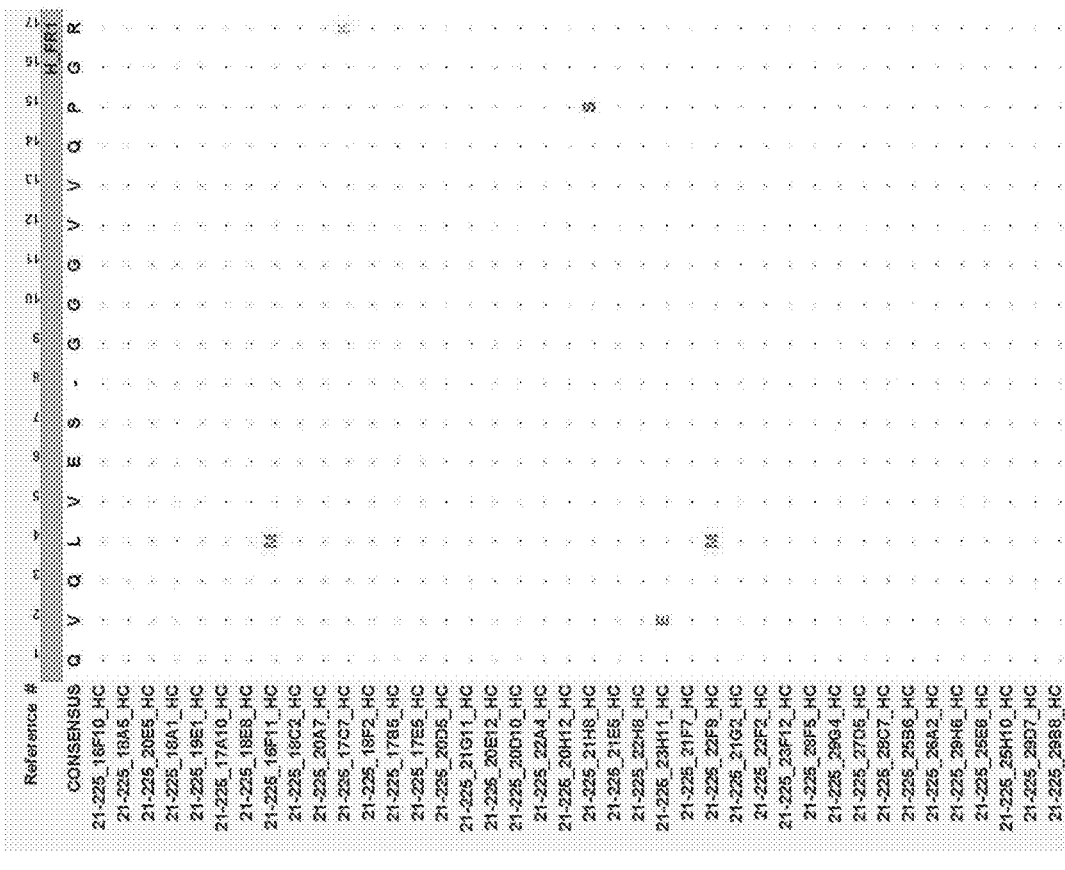
Figure 56:
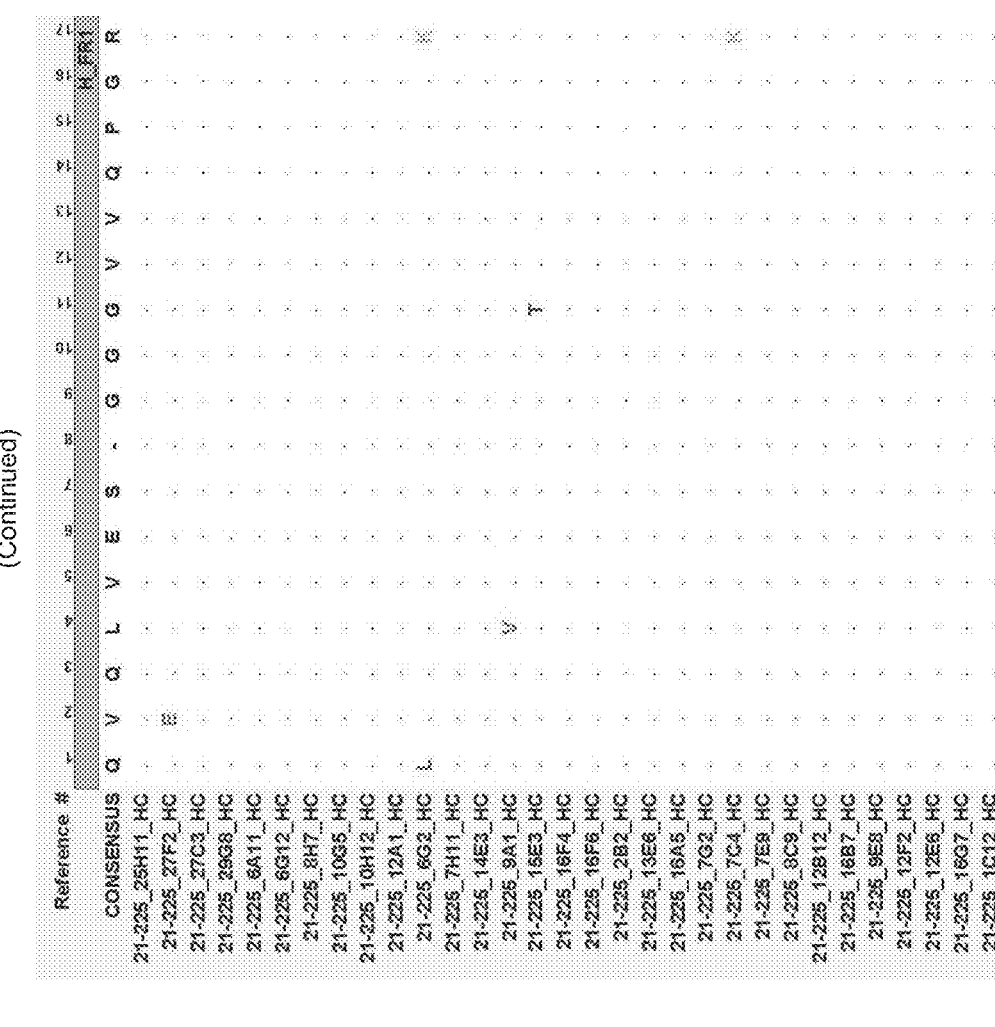
Figure 56:
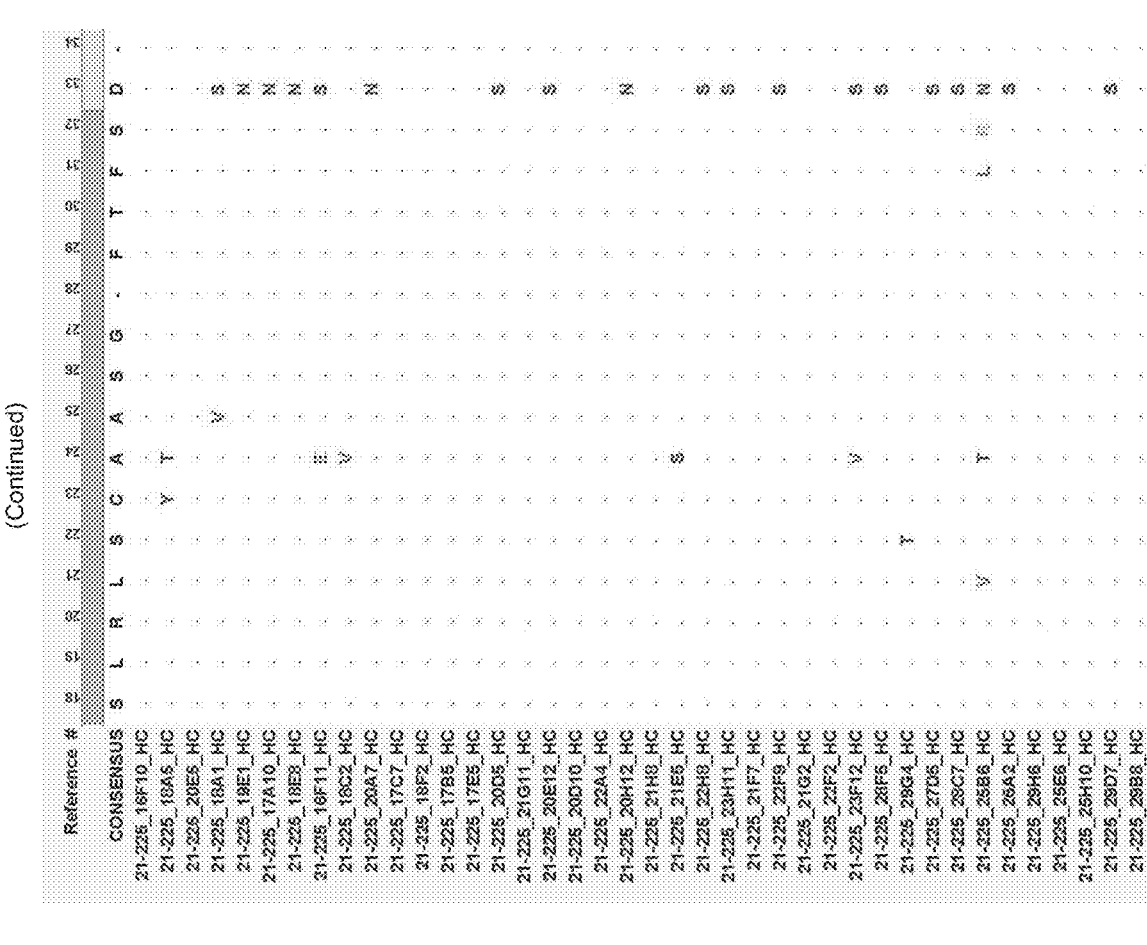
Figure 56:
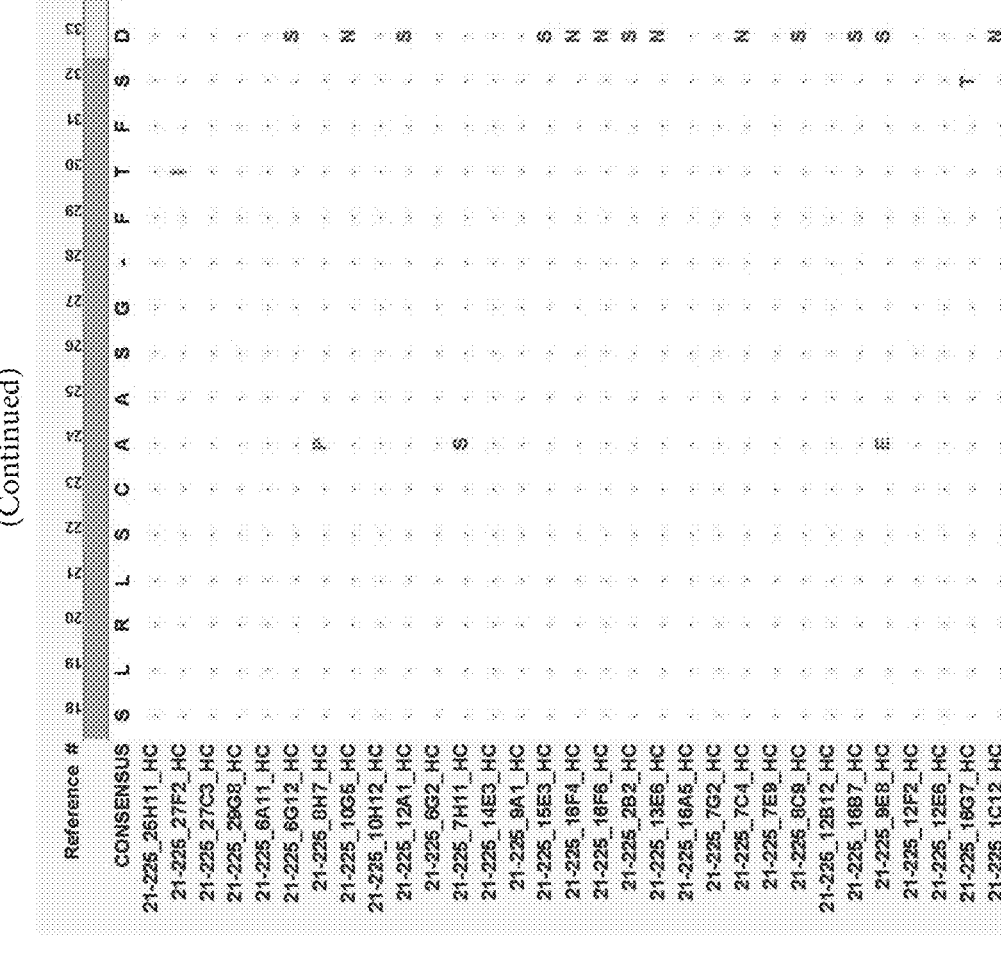
Figure 56:
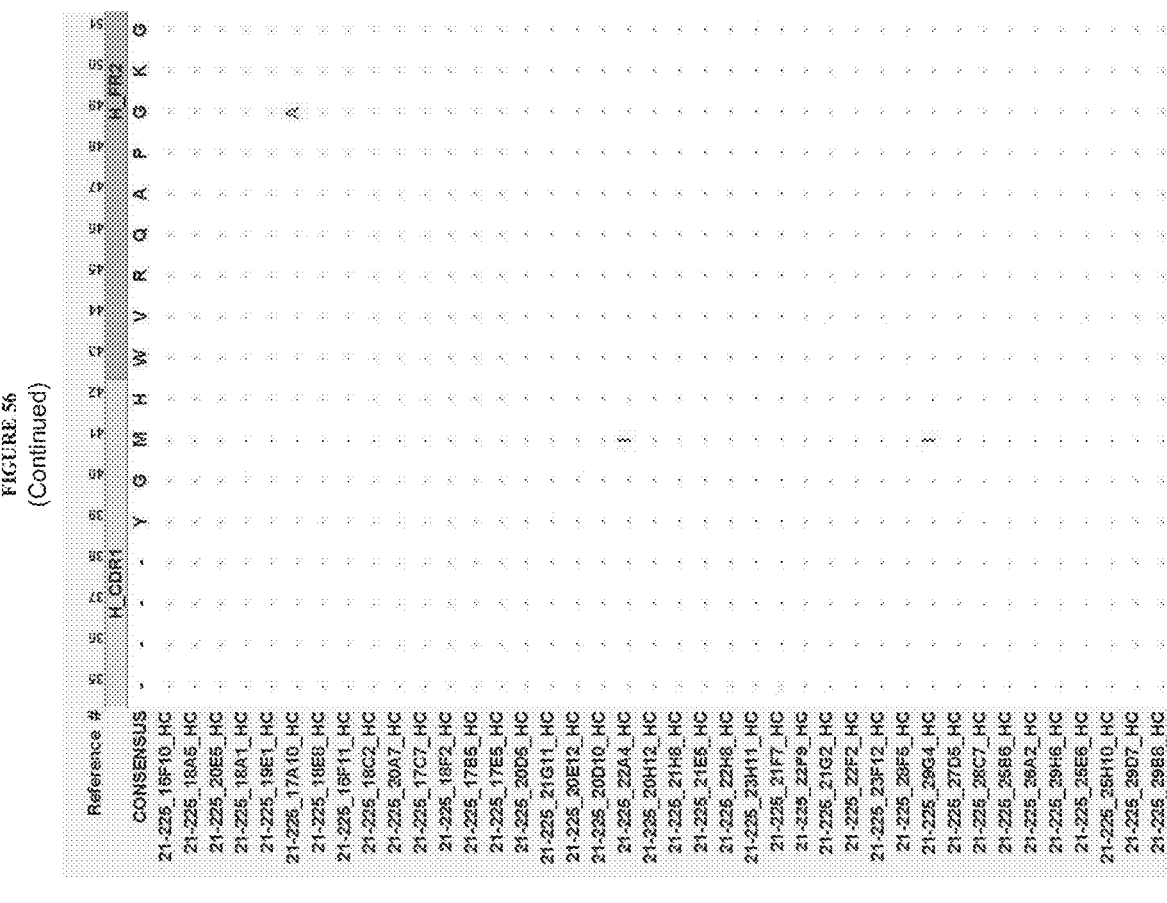
Figure 56:
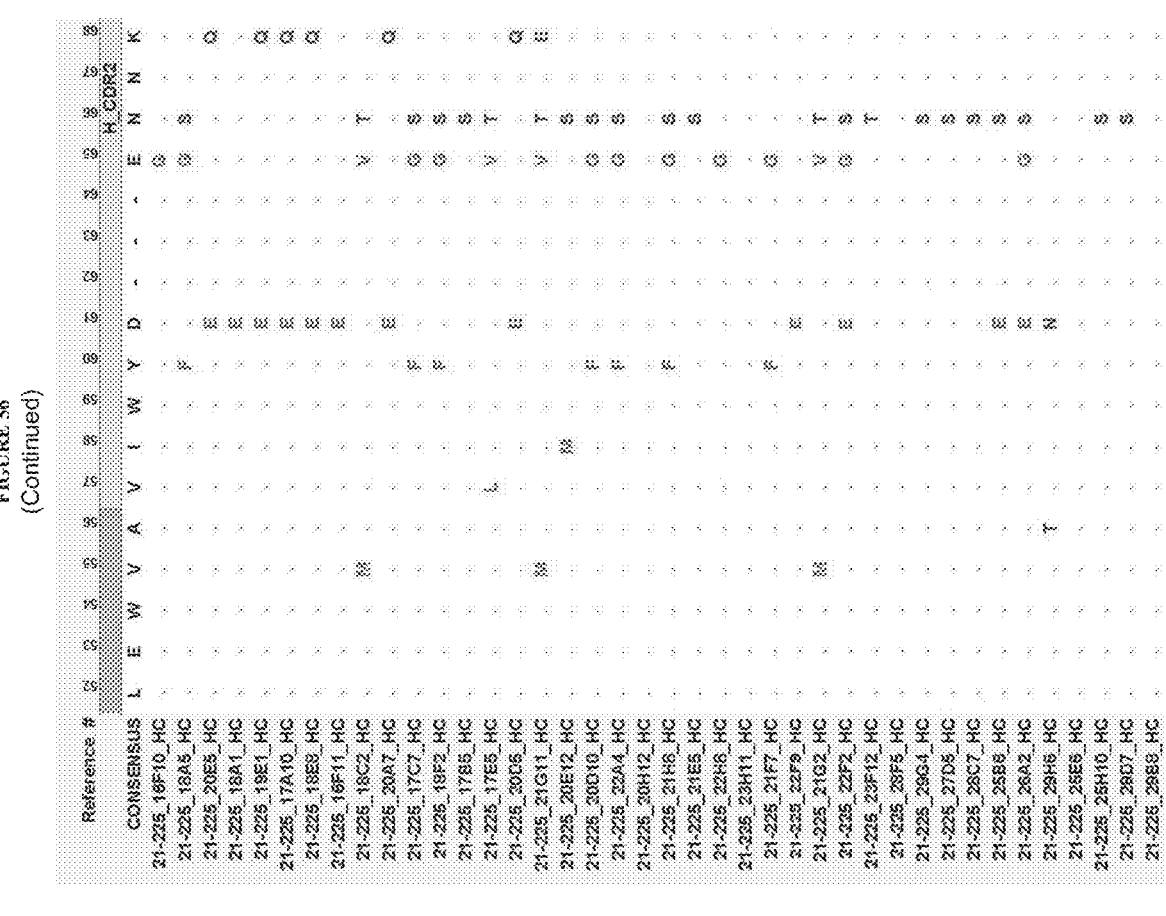
Figure 56:
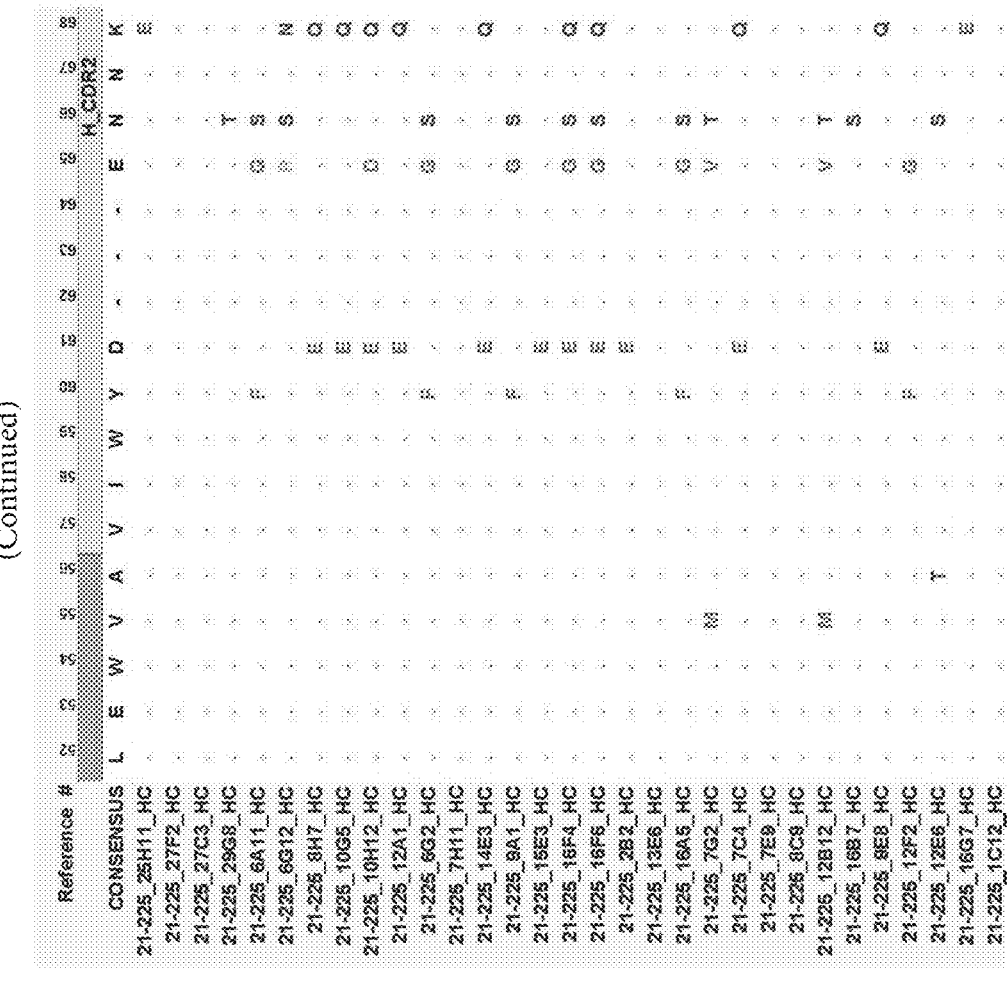
Figure 56:
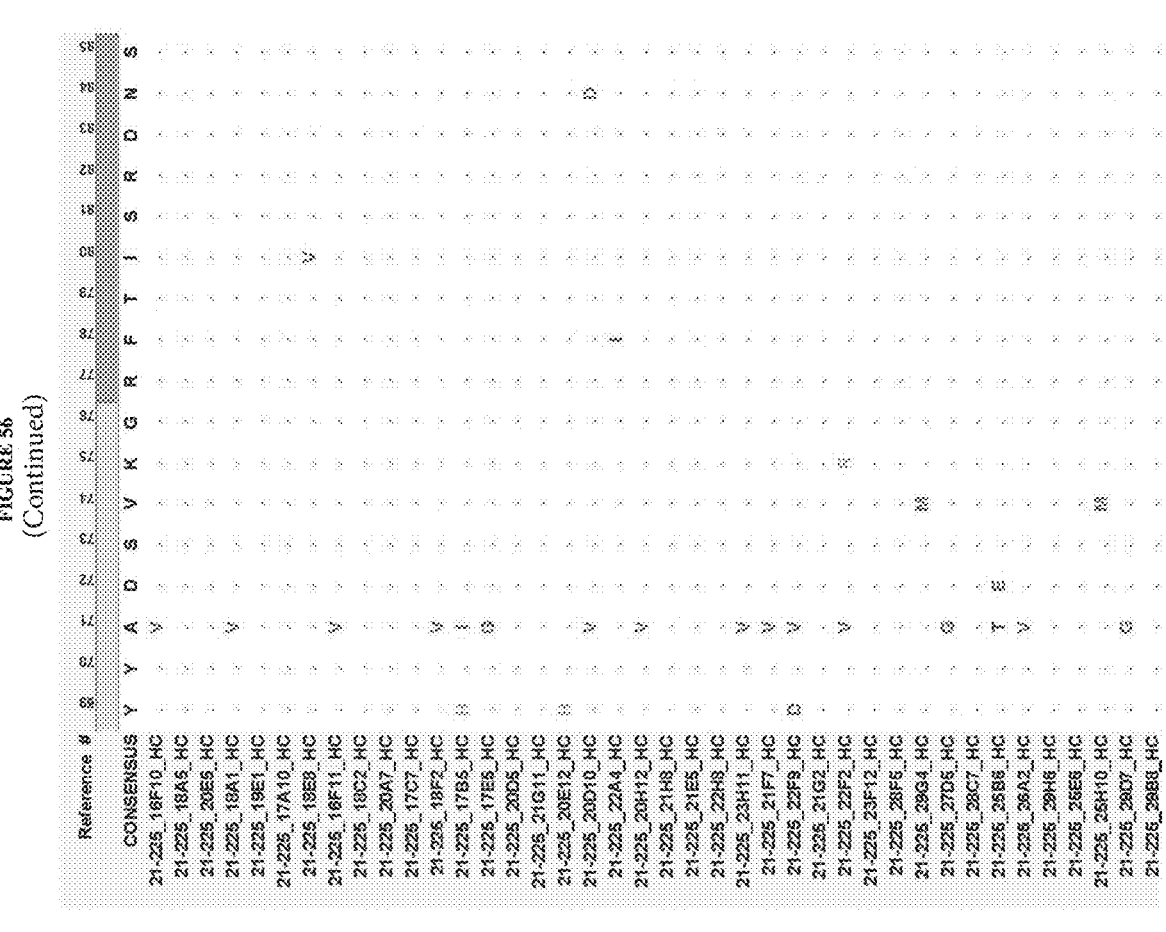
Figure 56:
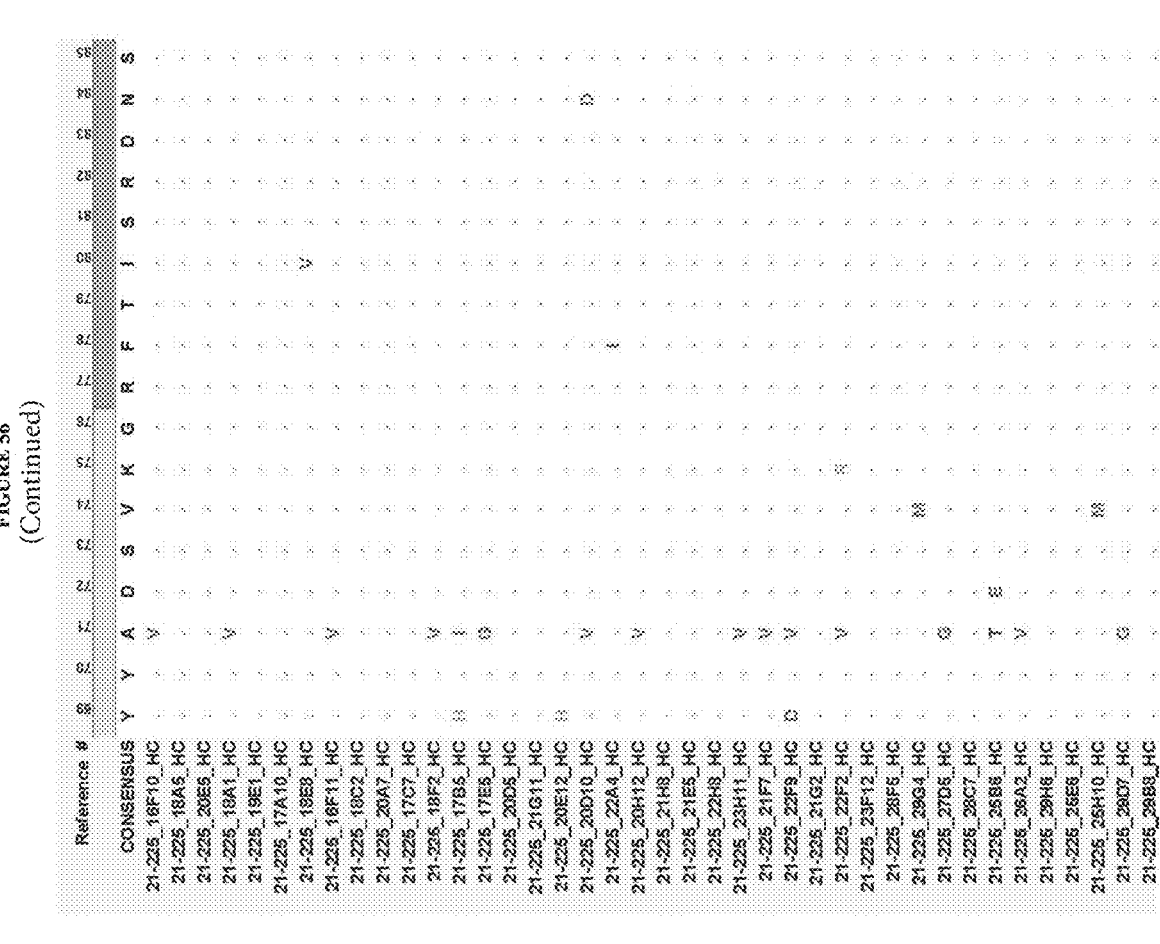
Figure 56:
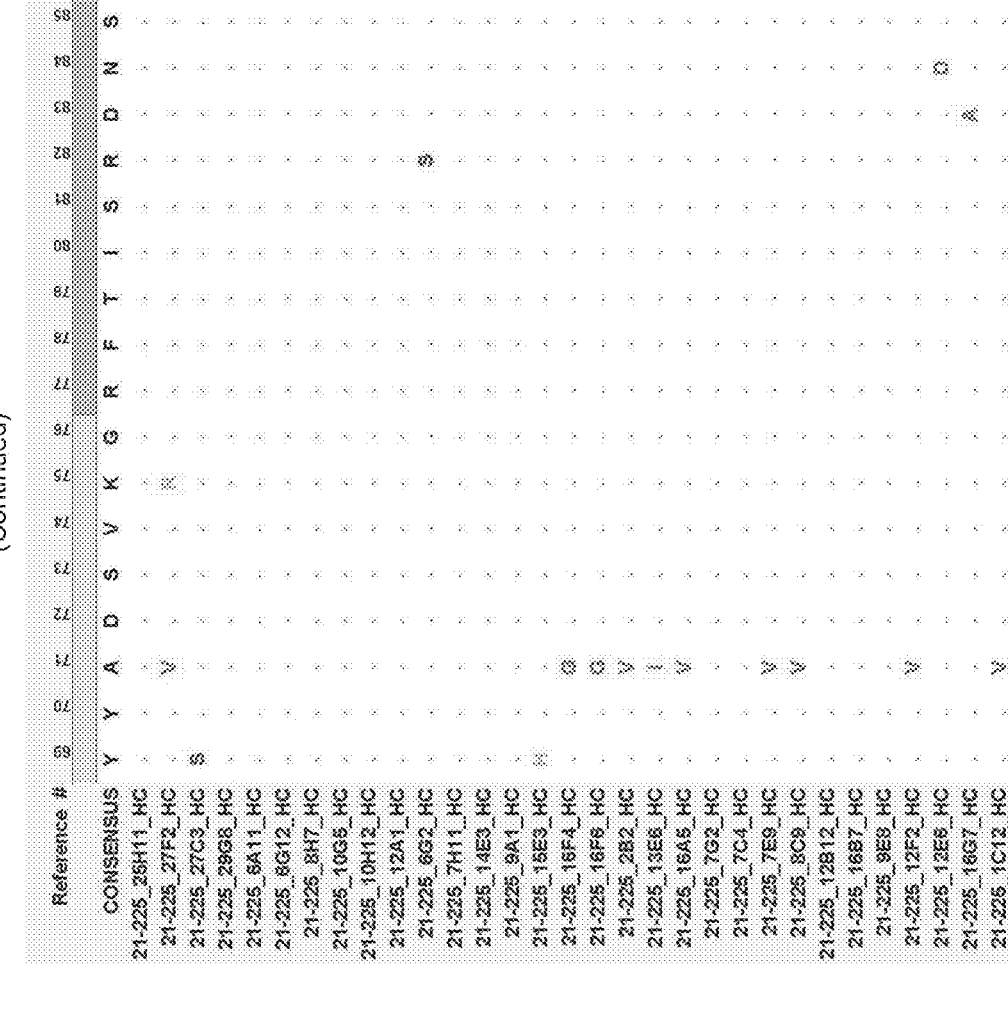
Figure 56:
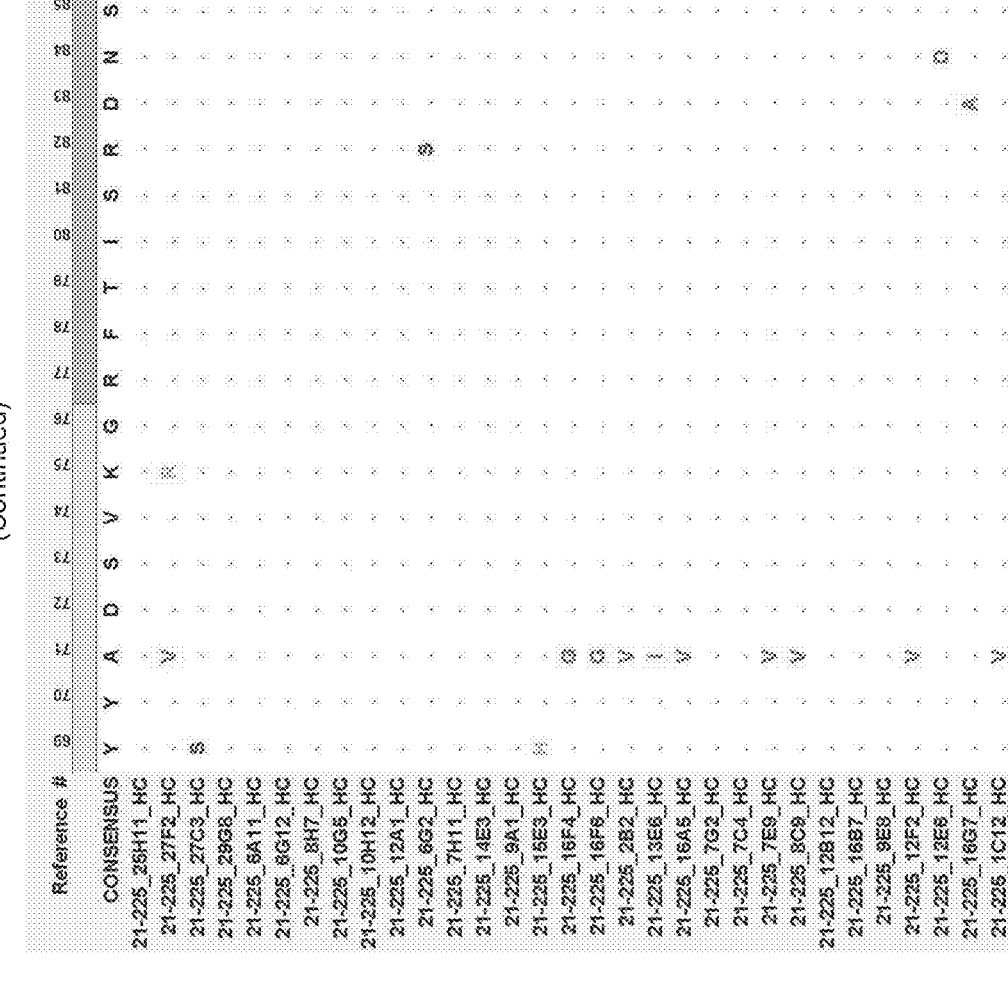
Figure 56:
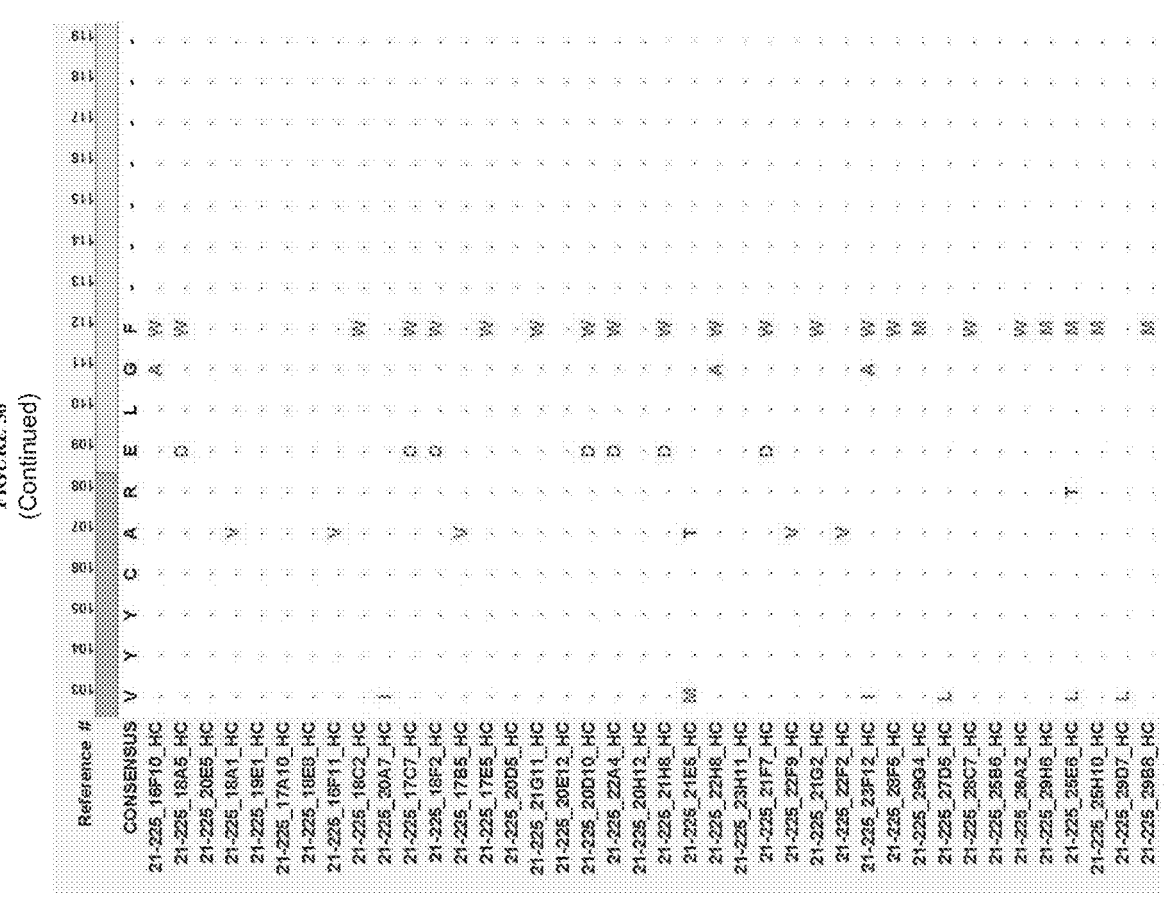
Figure 56:
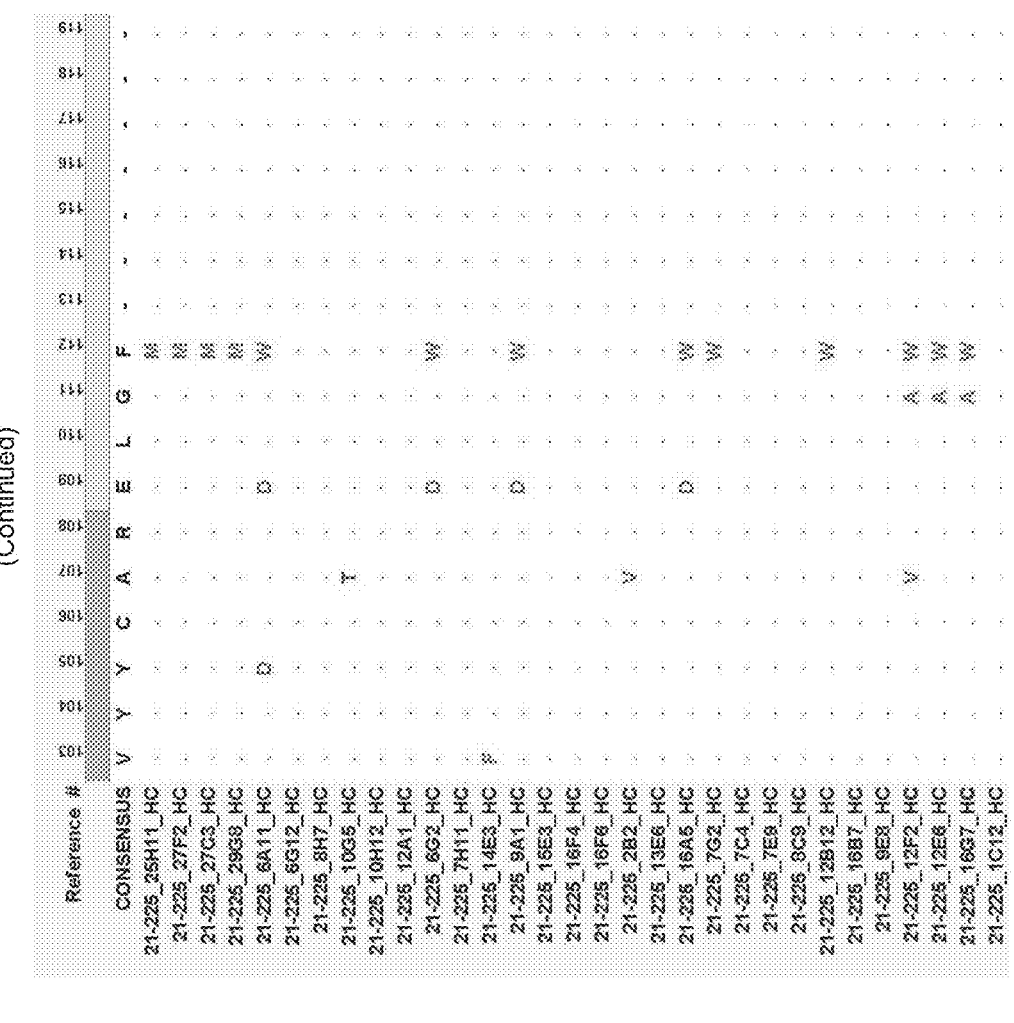
Figure 56:
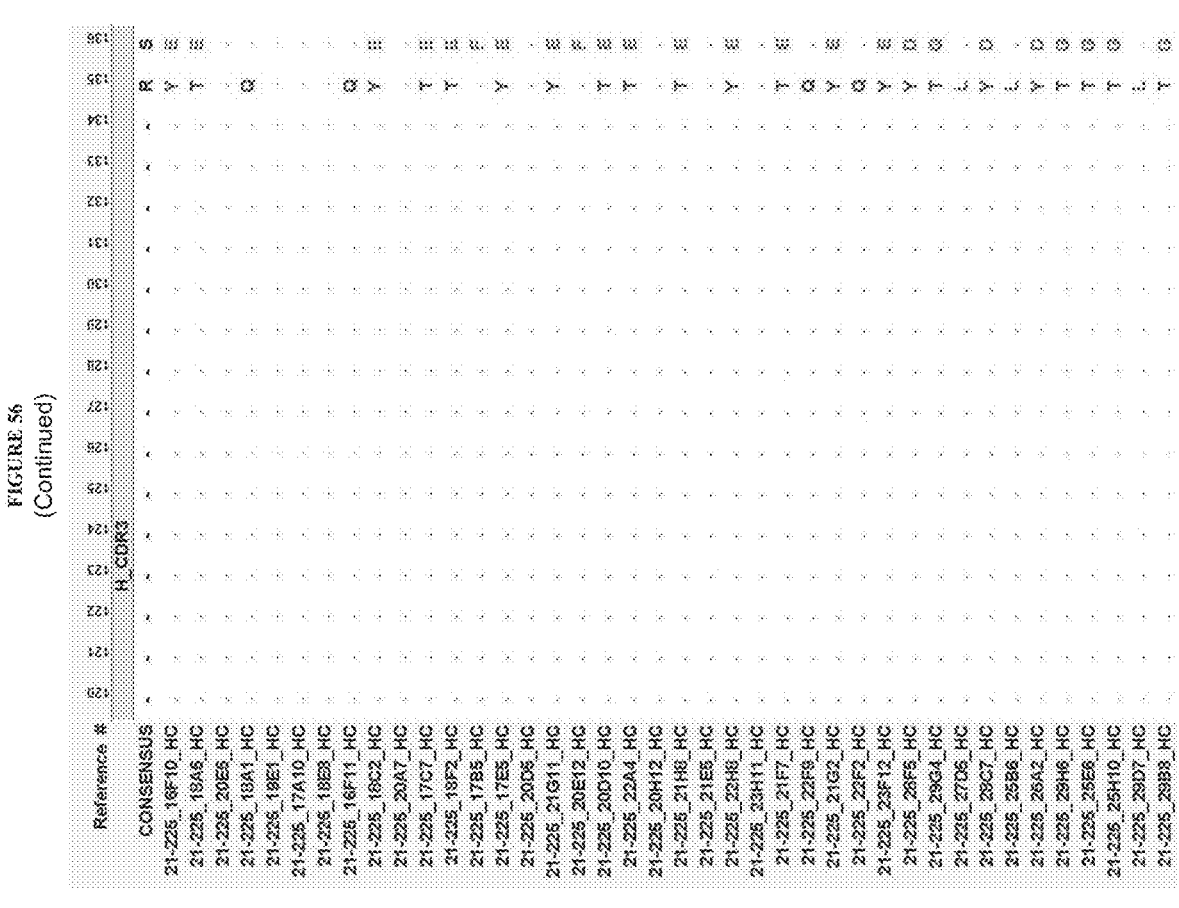
Figure 56:
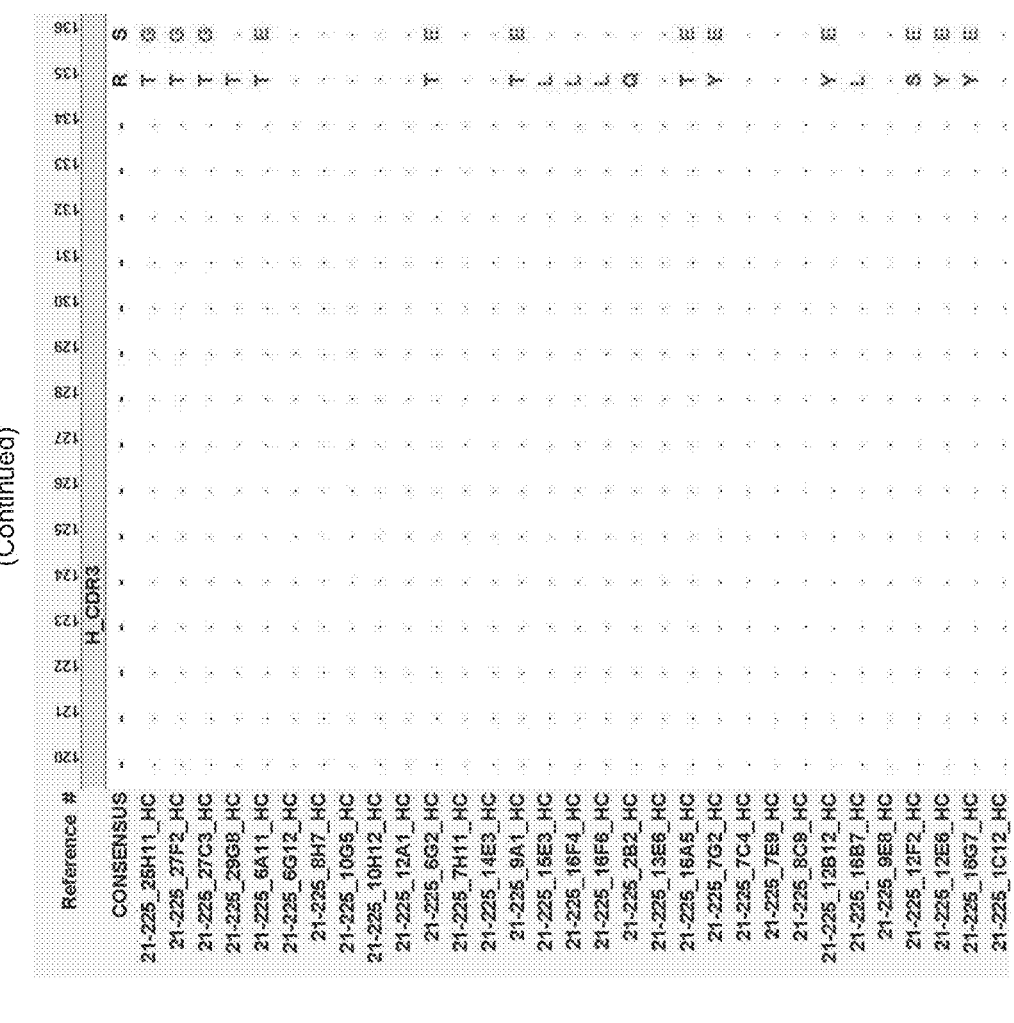
Figure 56:
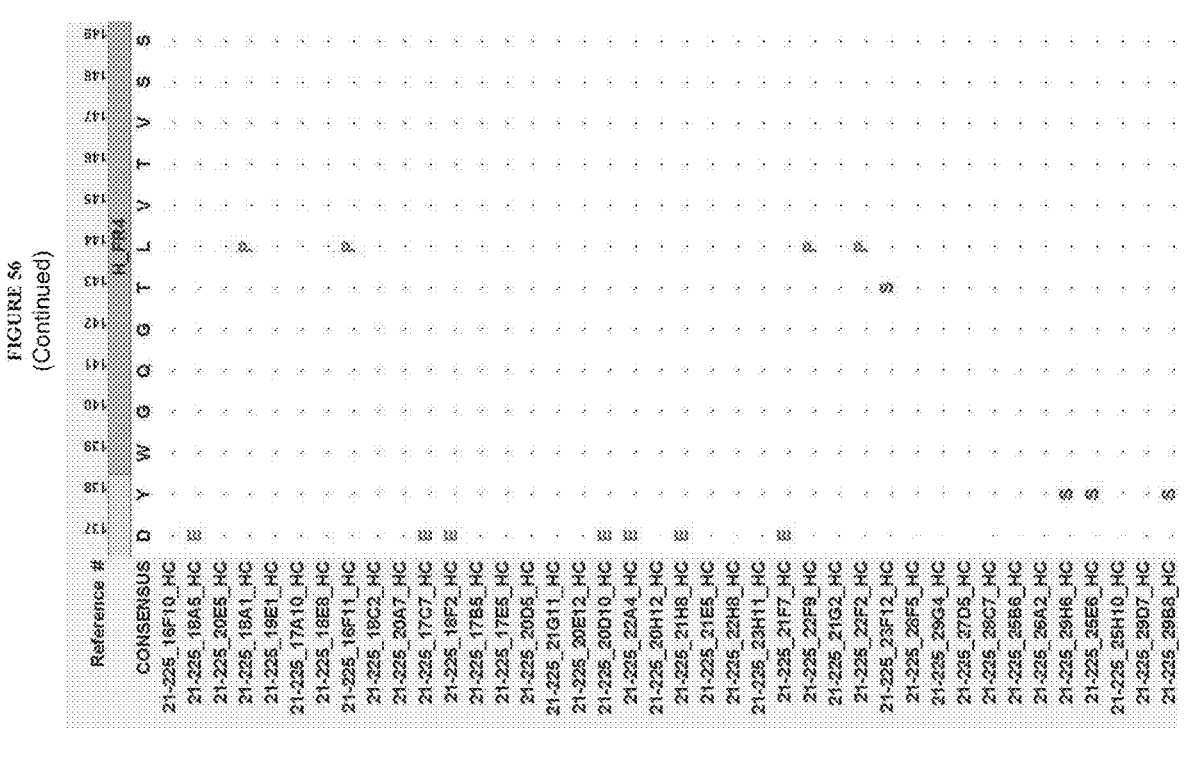
Figure 56:
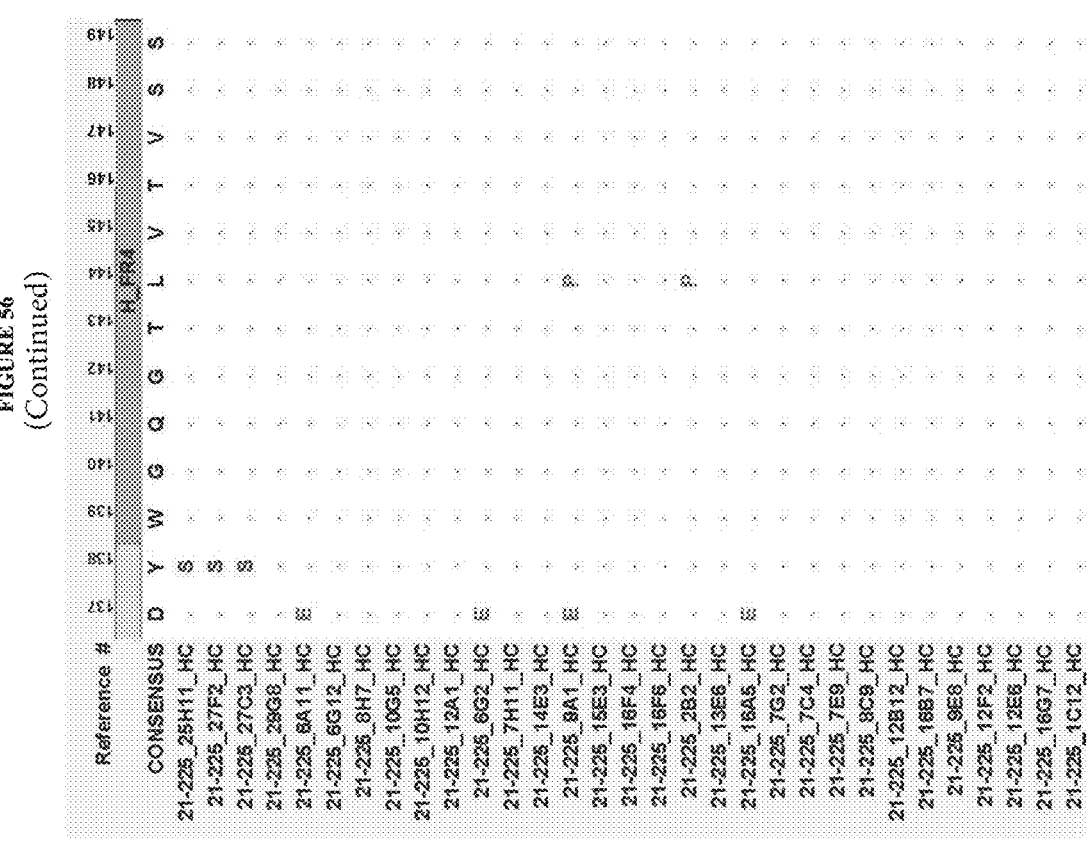
Figure 56:
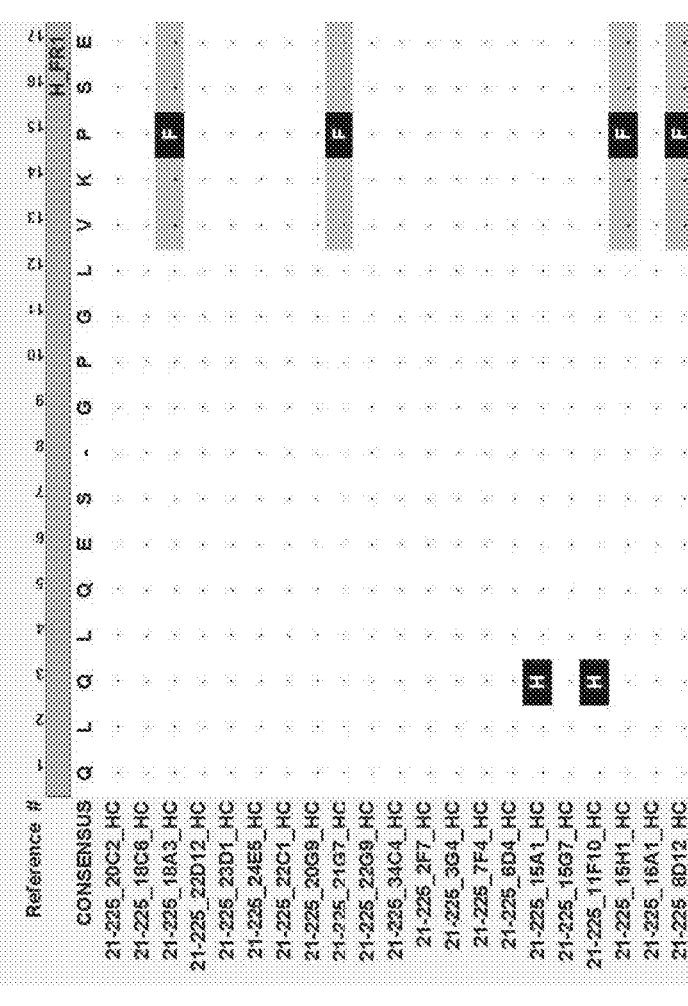
Figure 56:
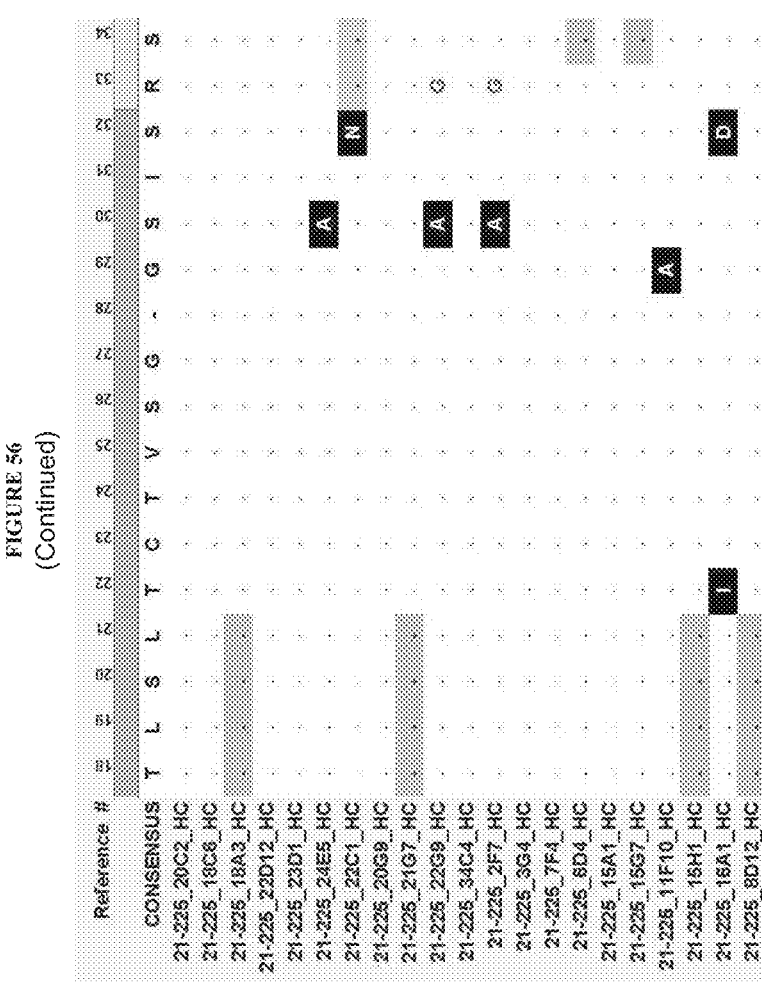
Figure 56:
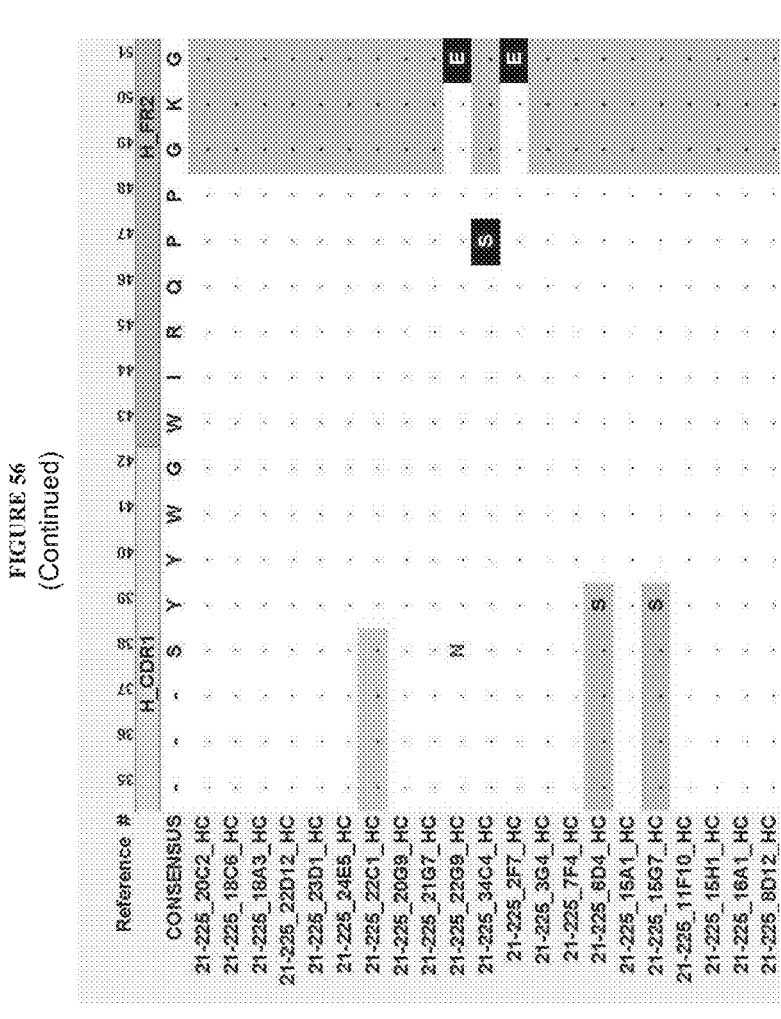
Figure 56:
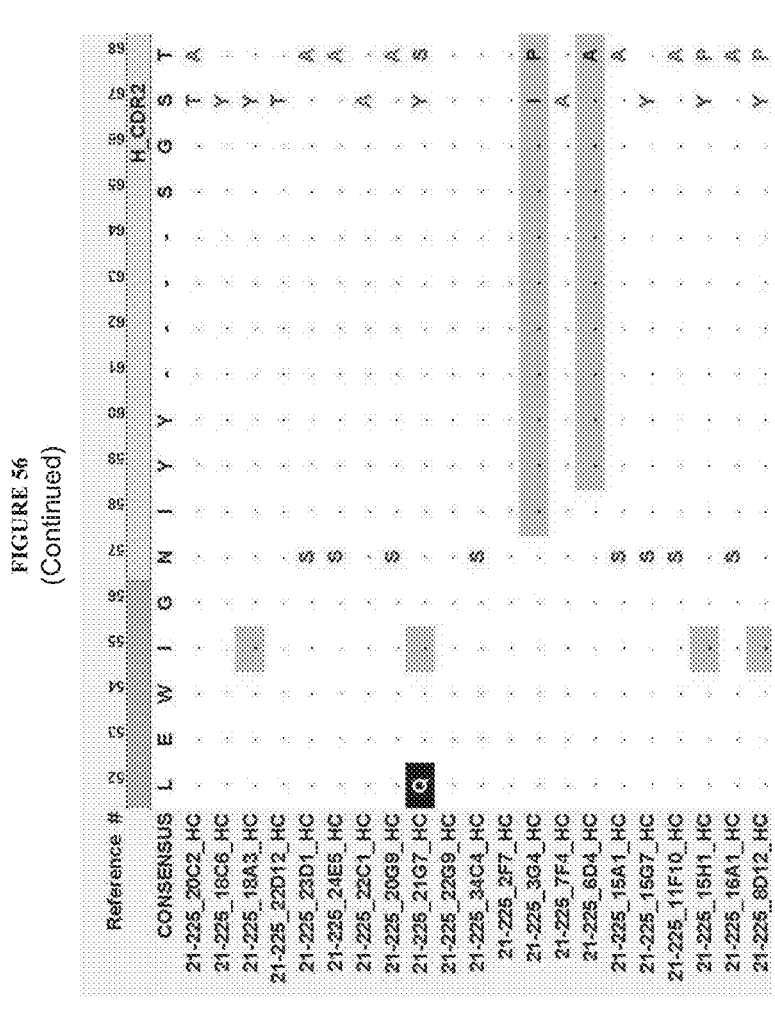
Figure 56:
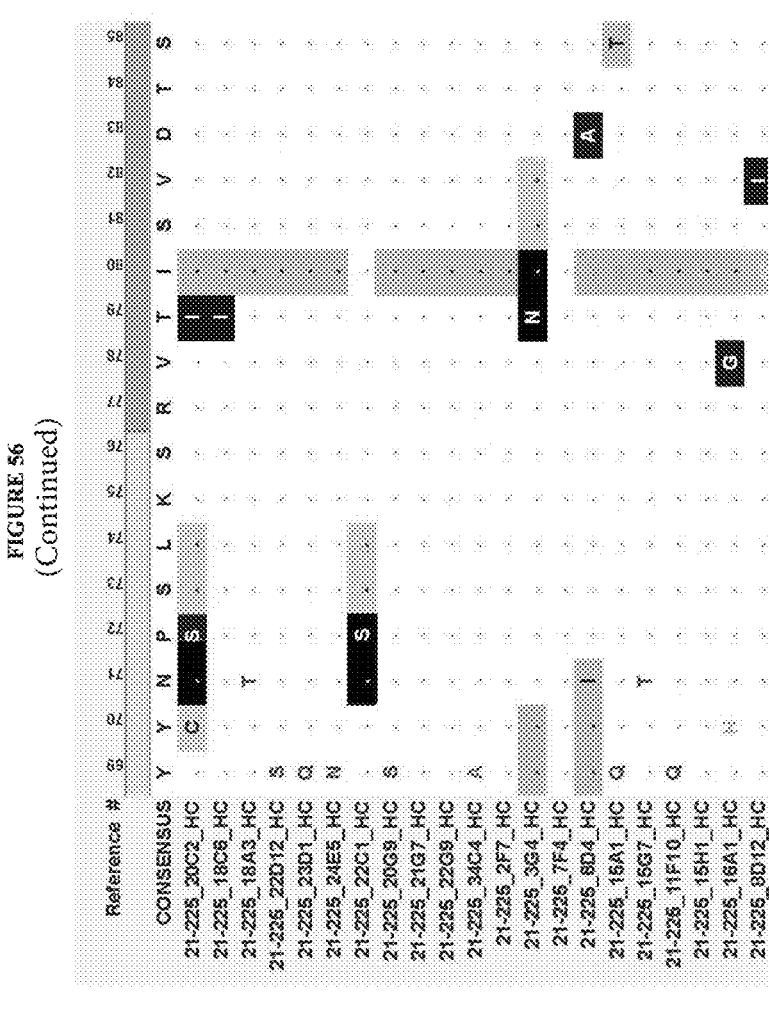
Figure 56:
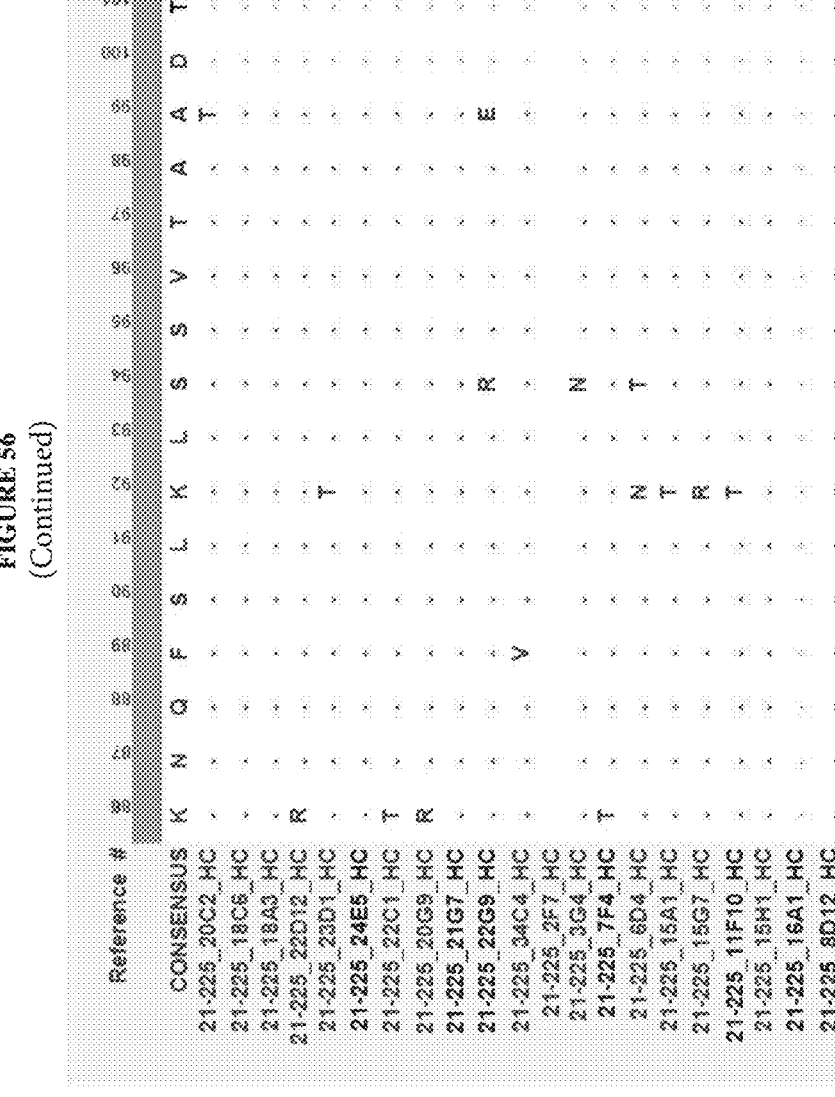
Figure 56:
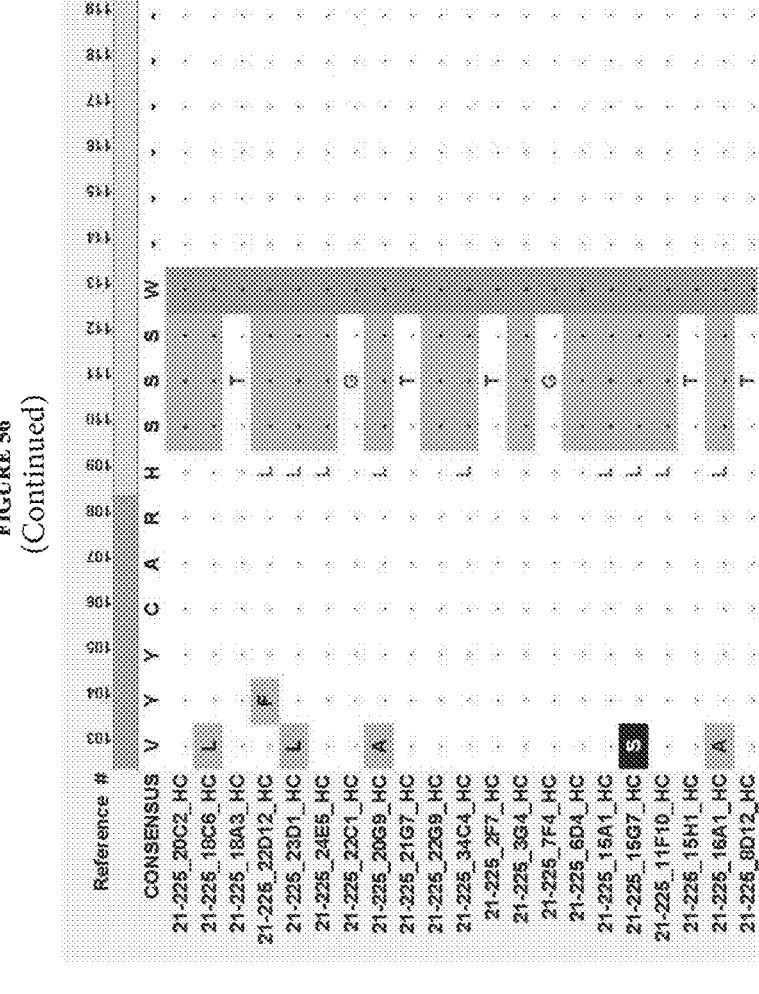
Figure 56:
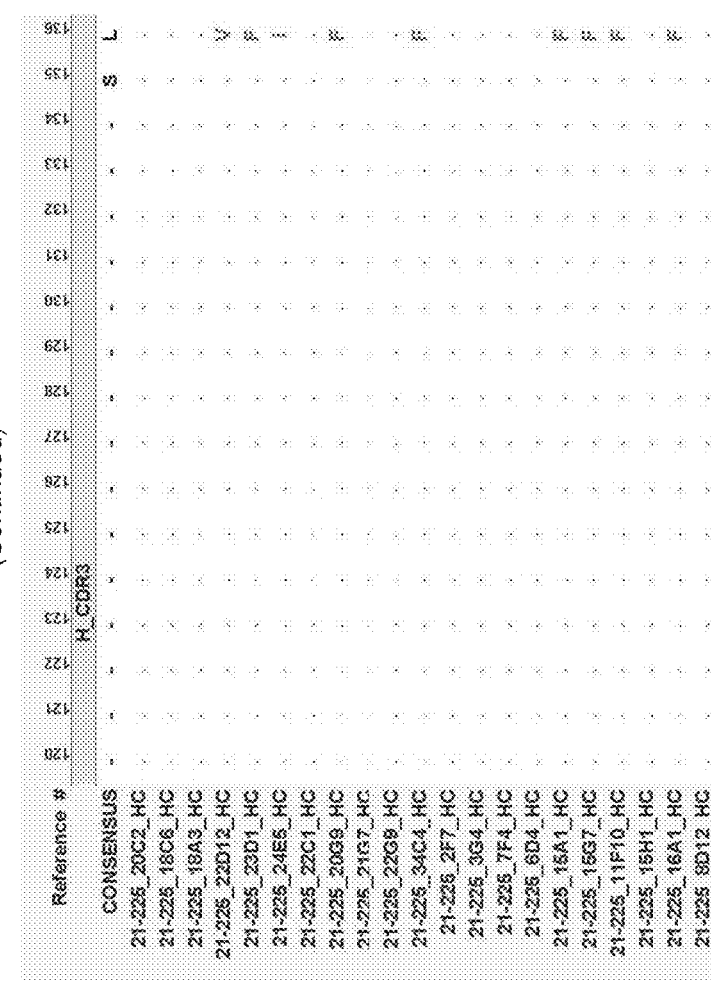
Figure 56:
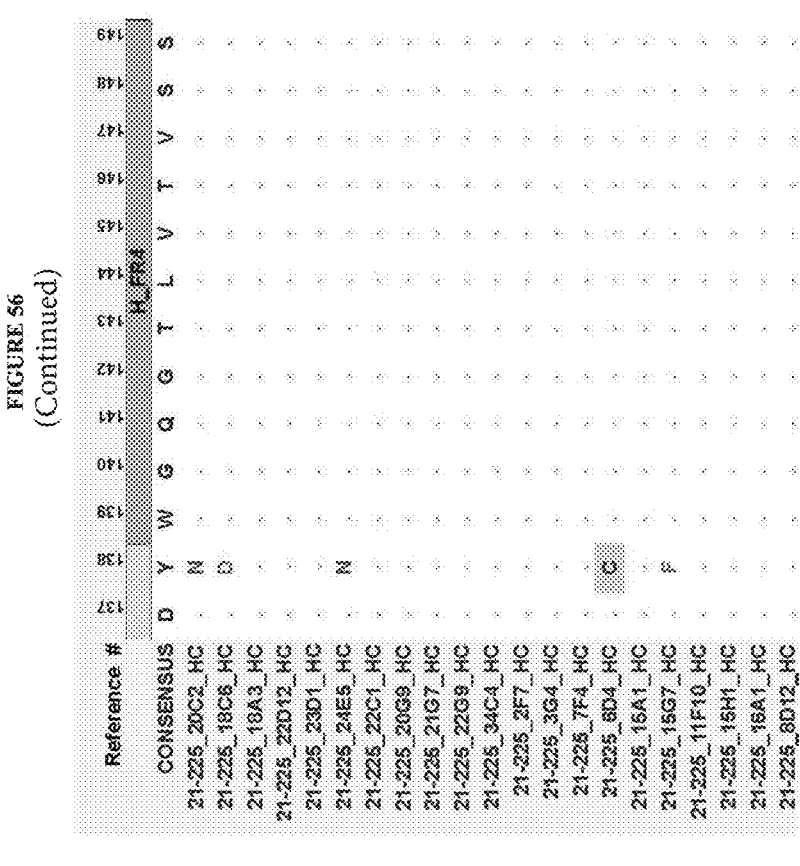
Figure 56:
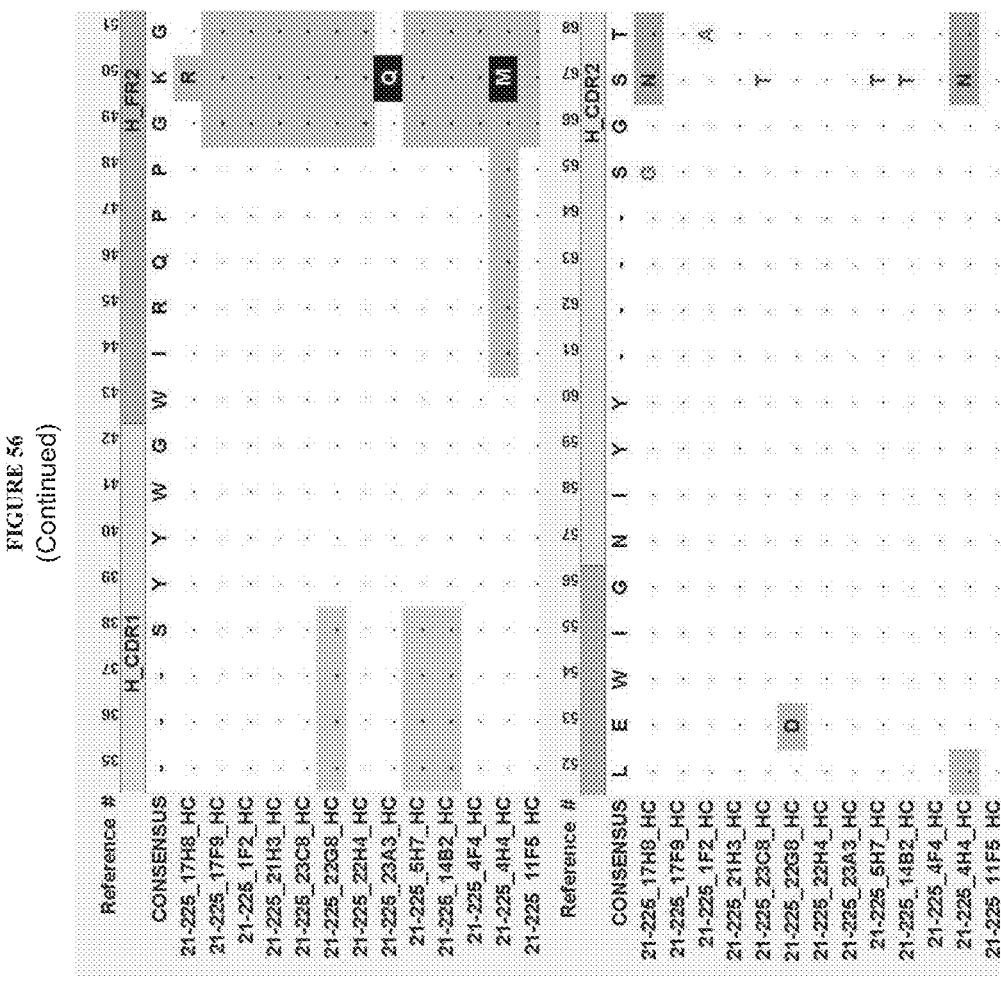
Figure 56:
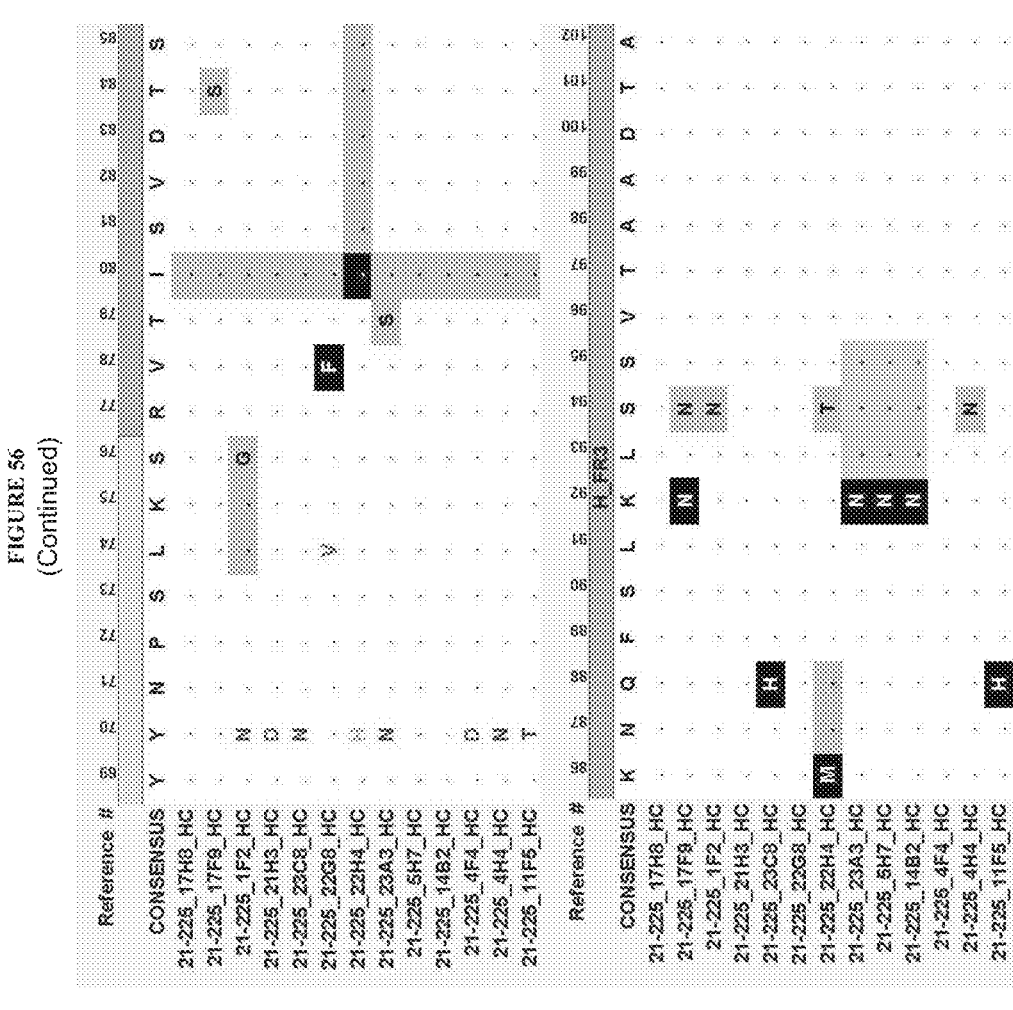
Figure 56:
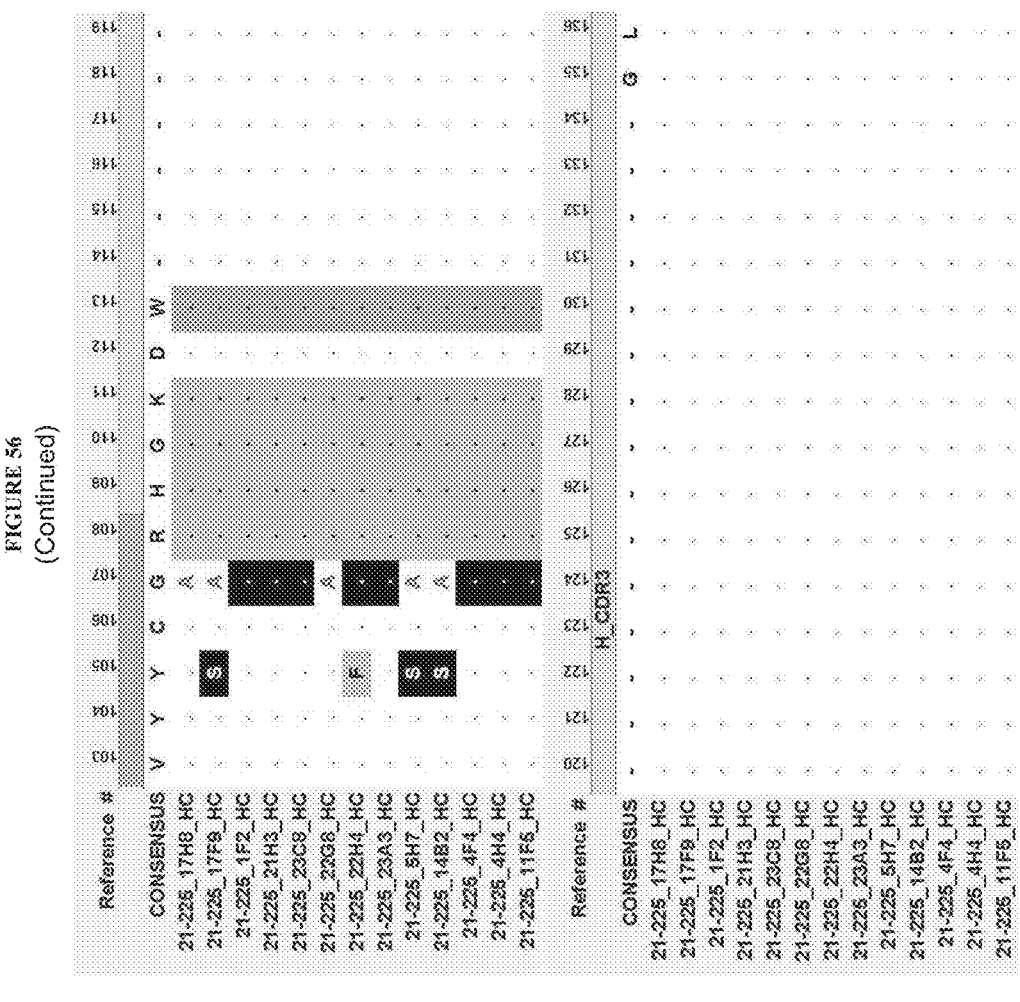
Figure 56:
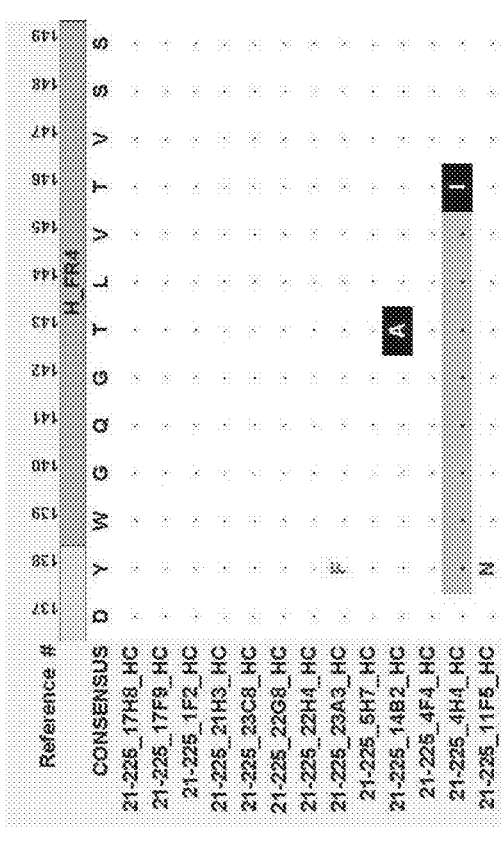
Figure 56:
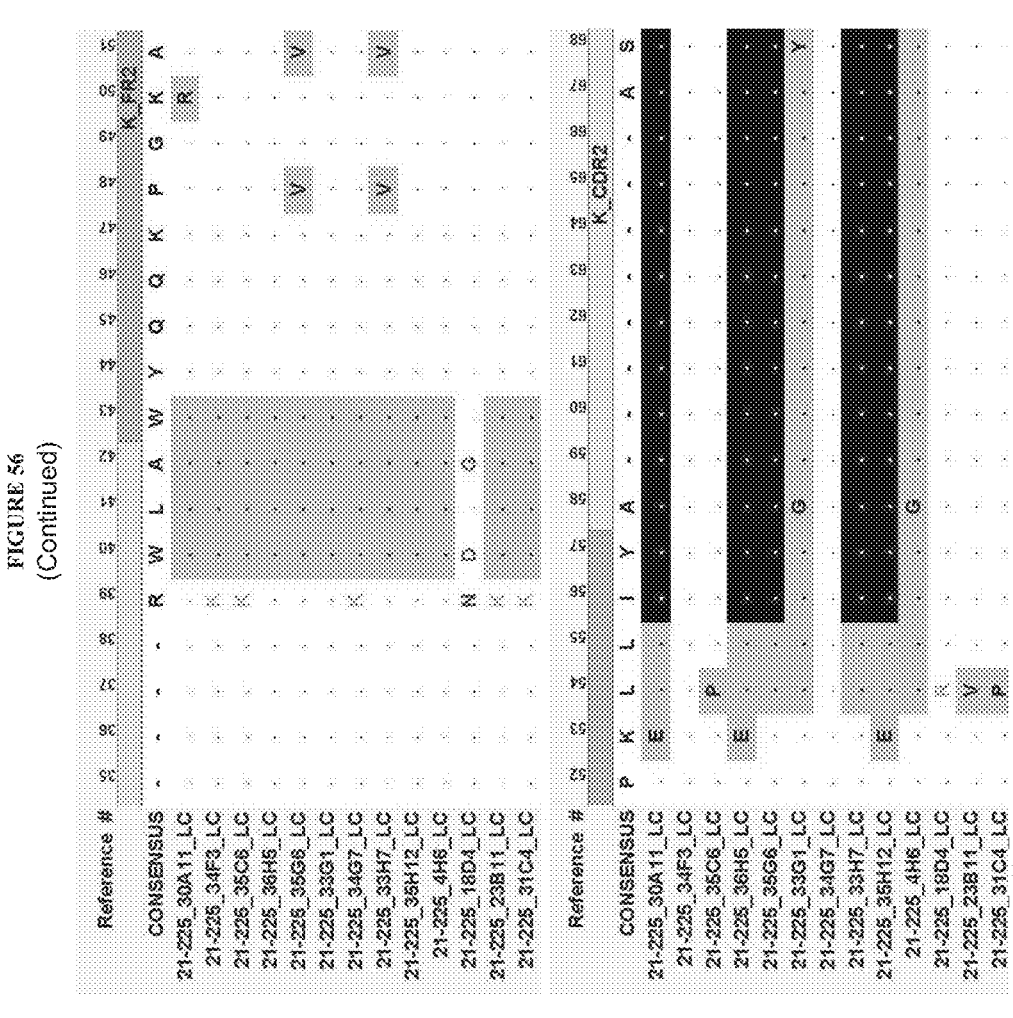
Figure 56:
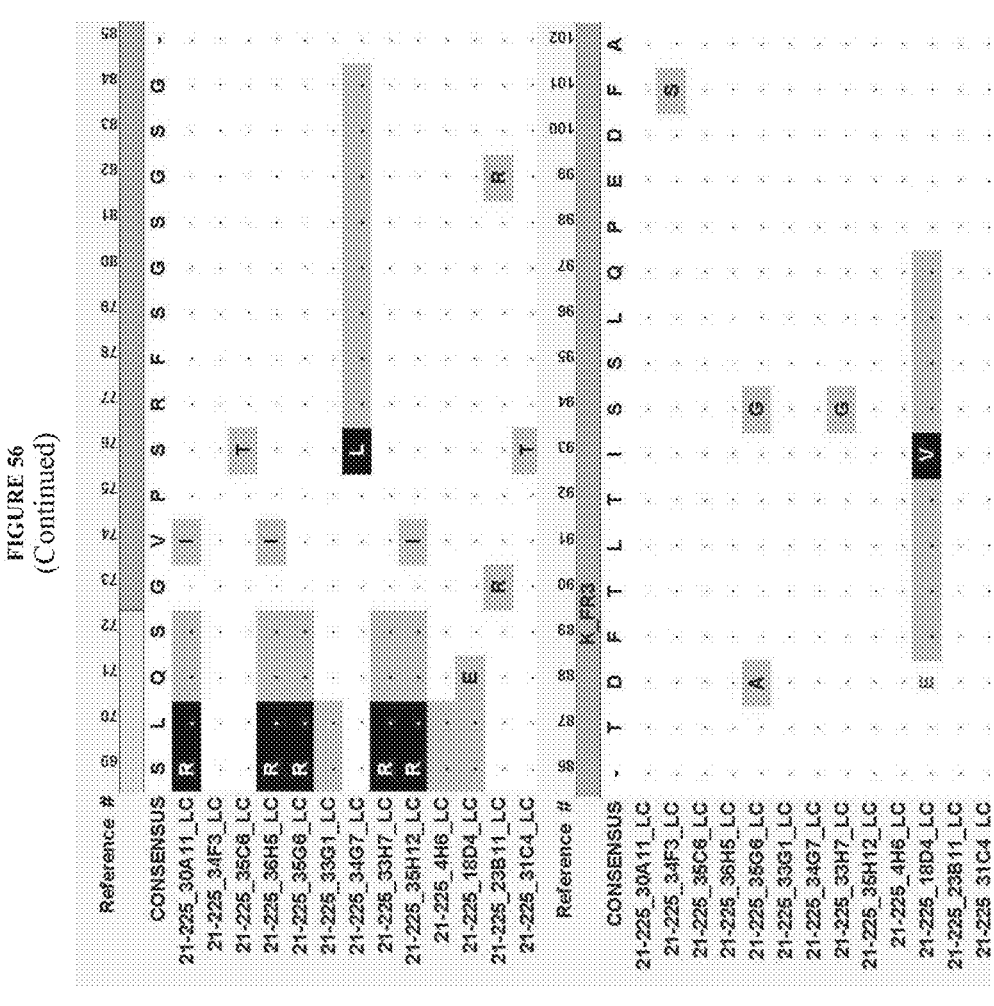
Figure 56:
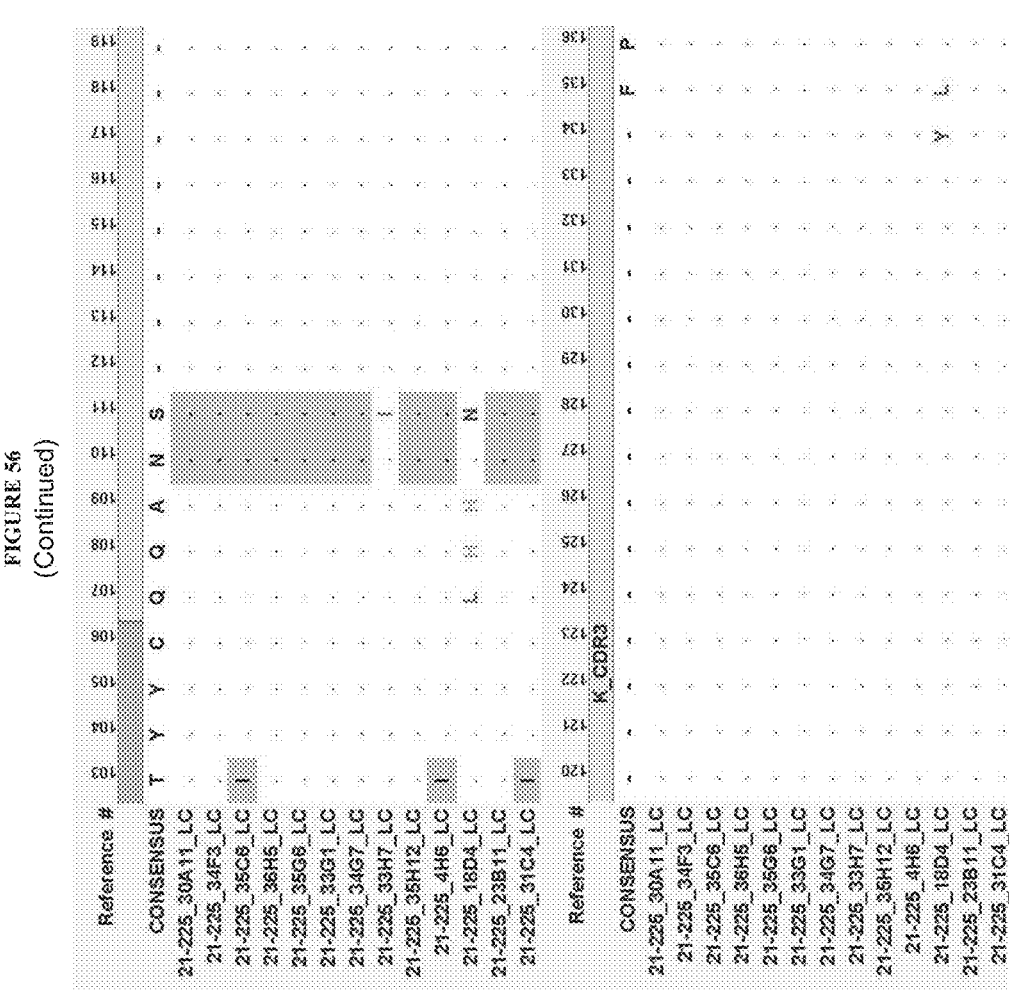
Figure 56:
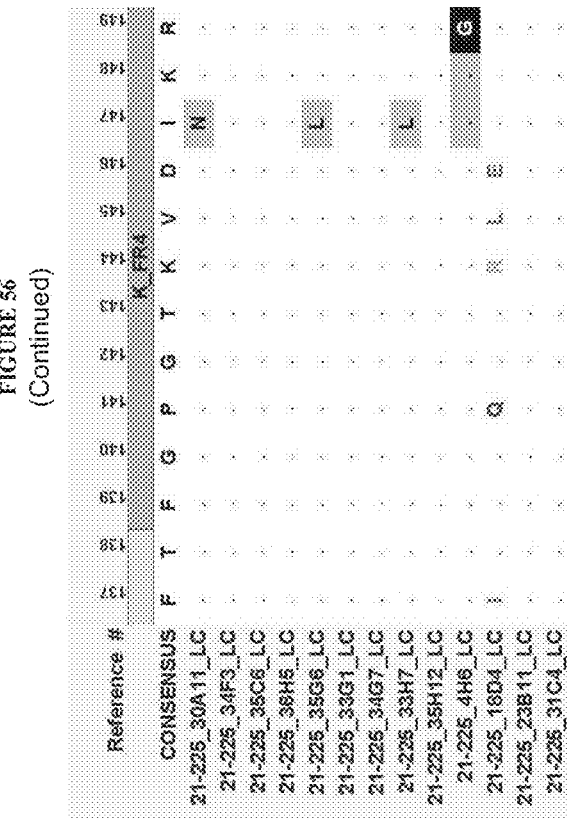
Figure 56:
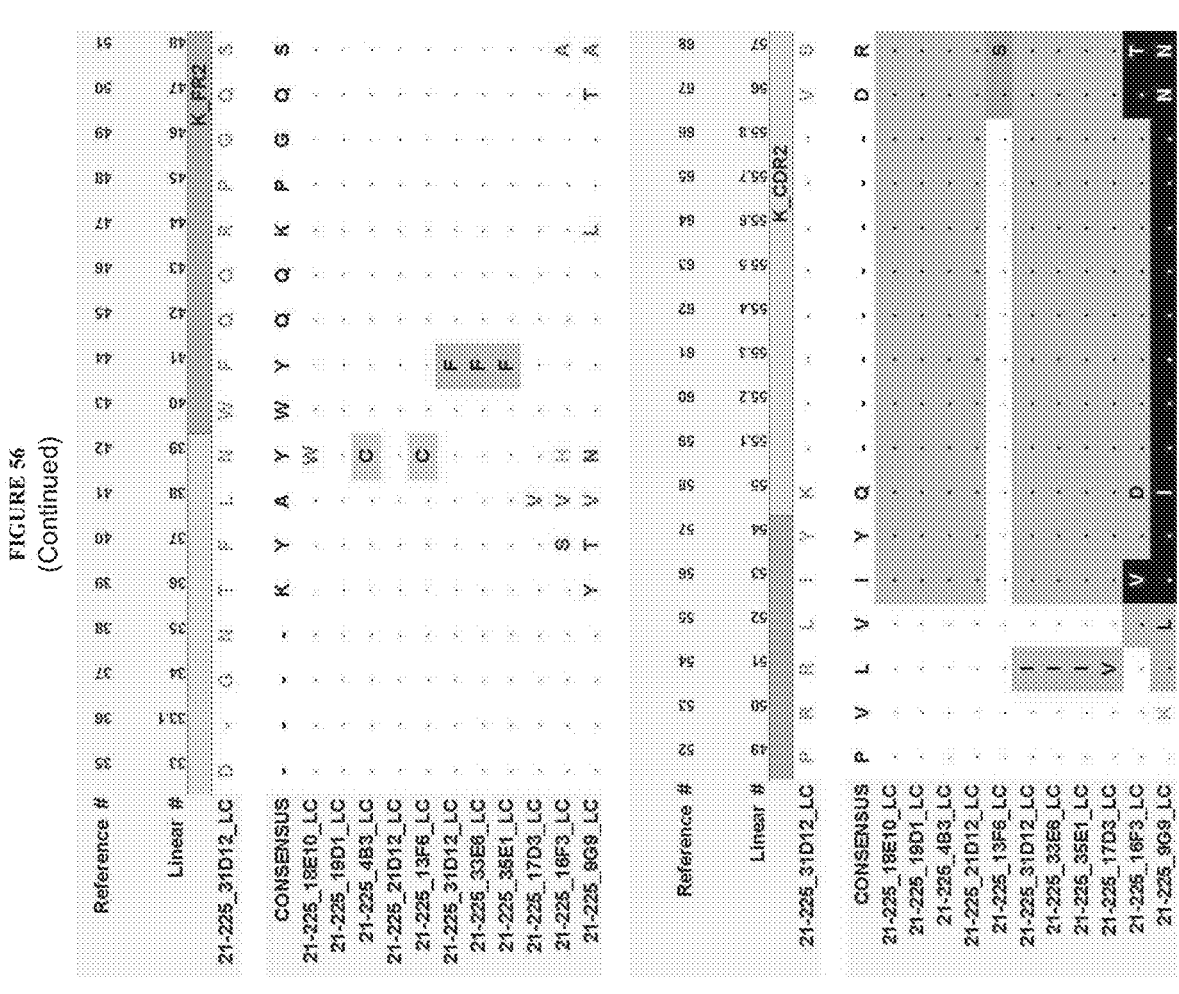
Figure 56:
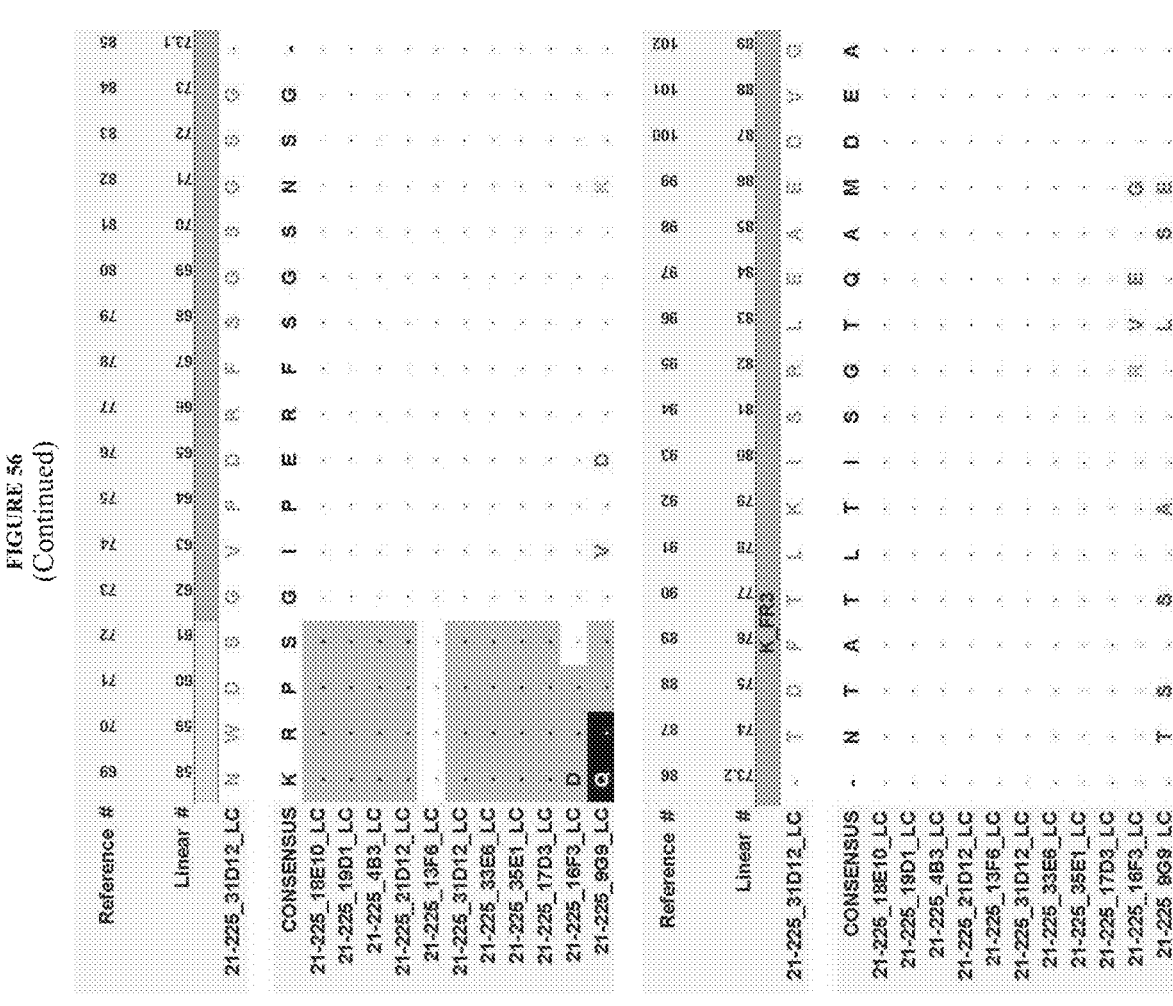
Figure 56:
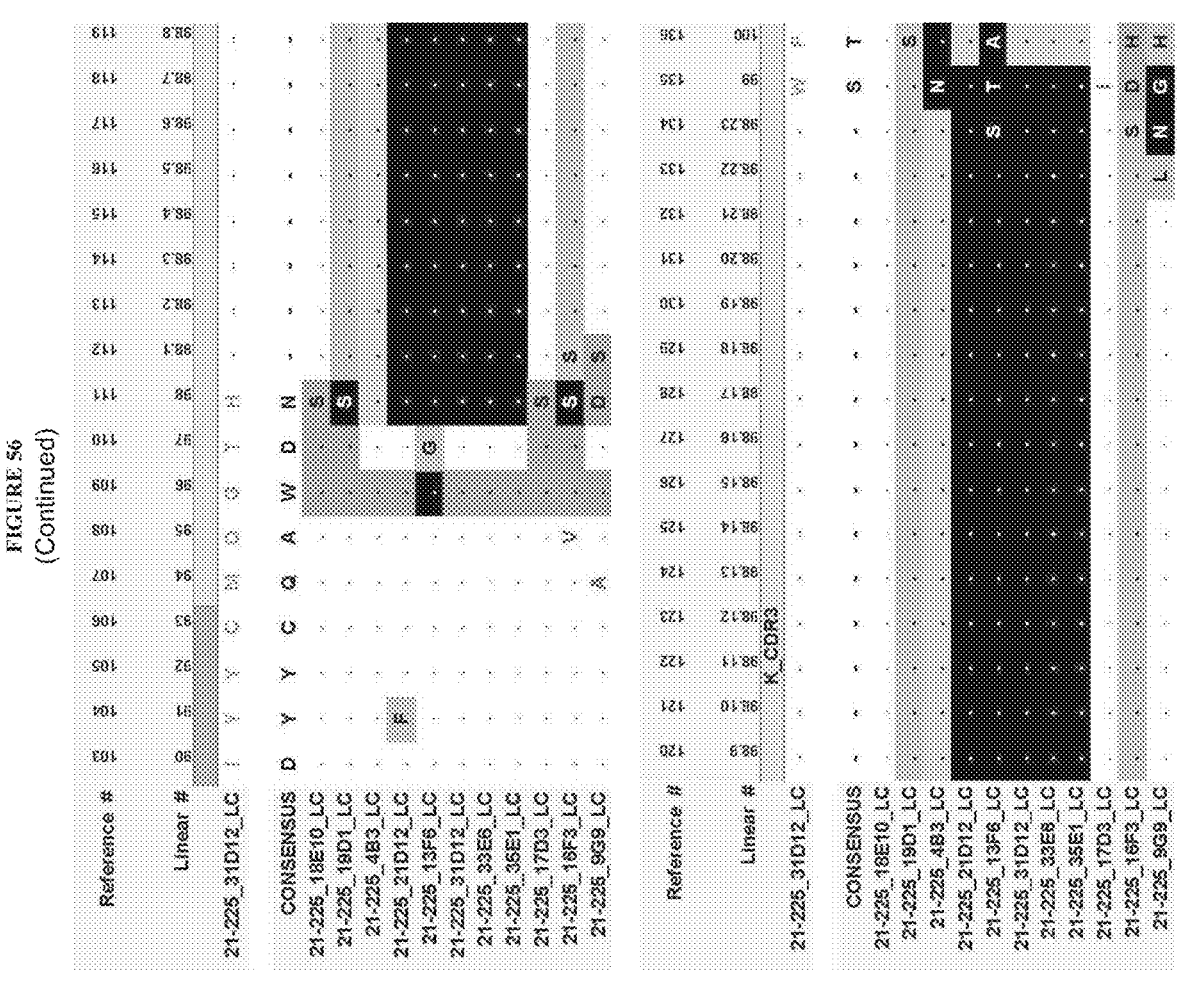
Figure 56:
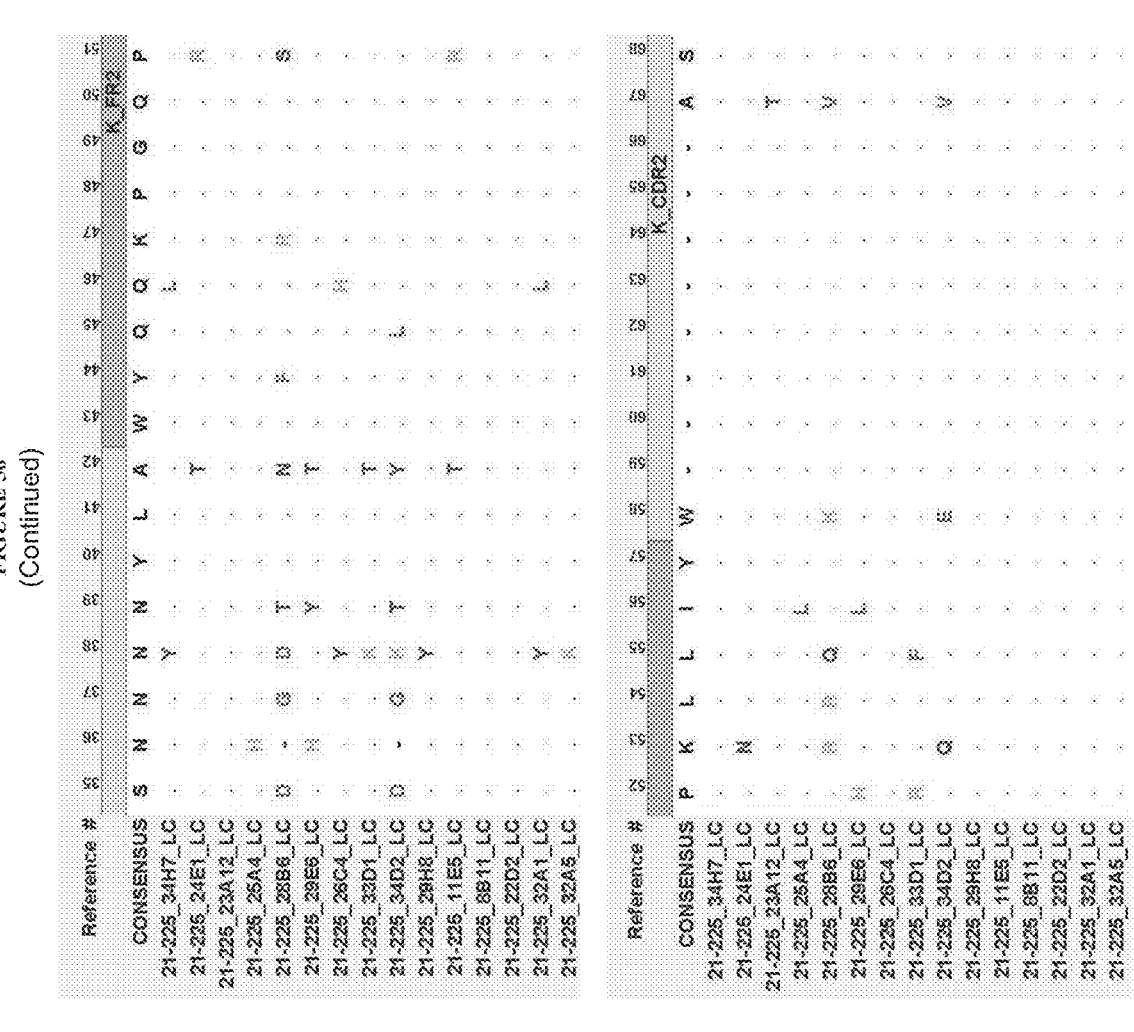
Figure 56:
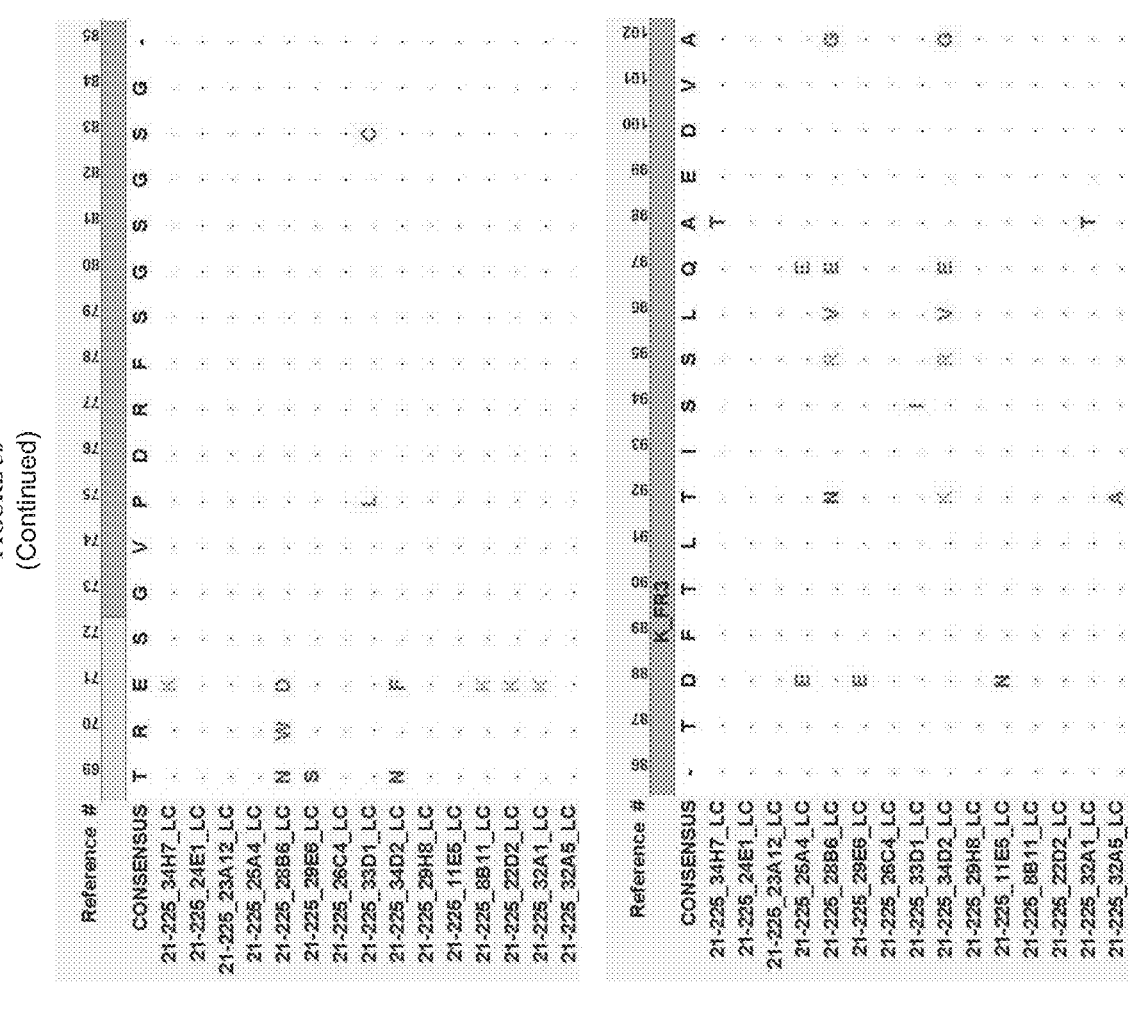
Figure 56:
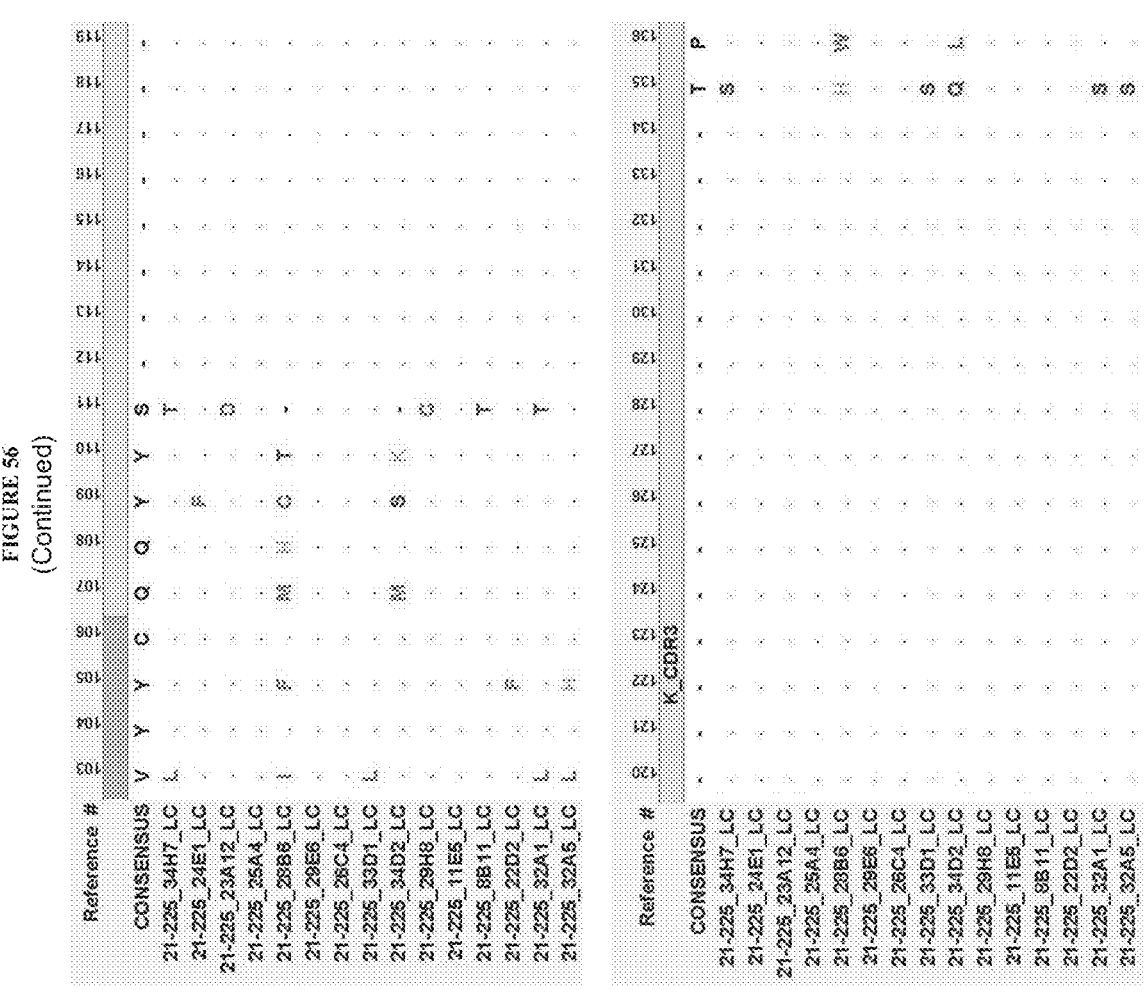
Figure 56:
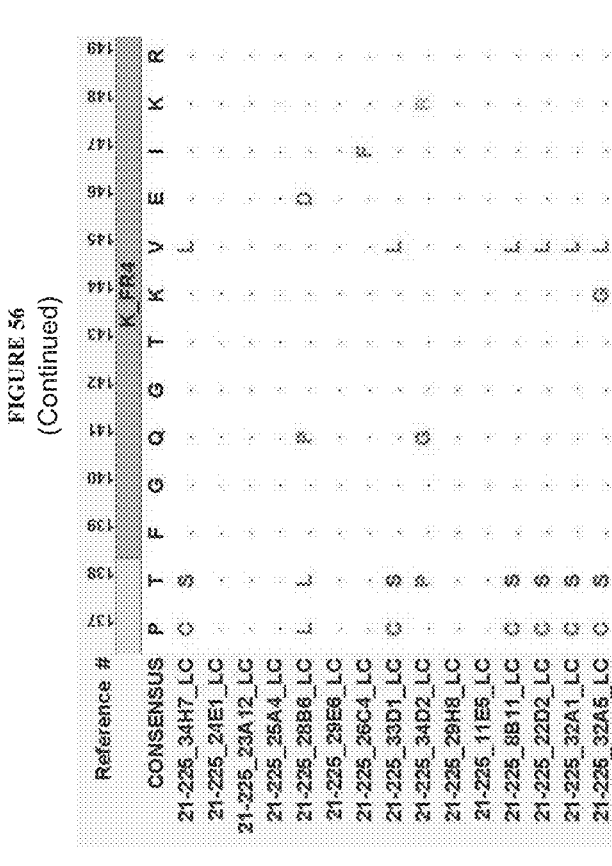
Figure 56:
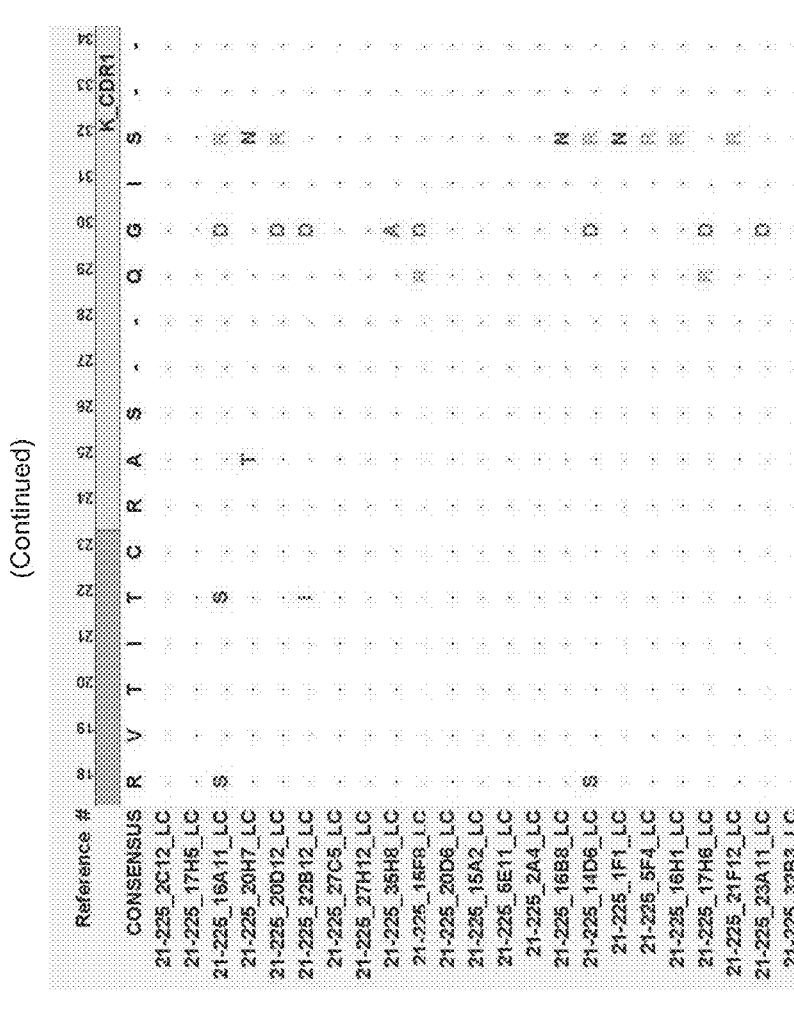
Figure 56:
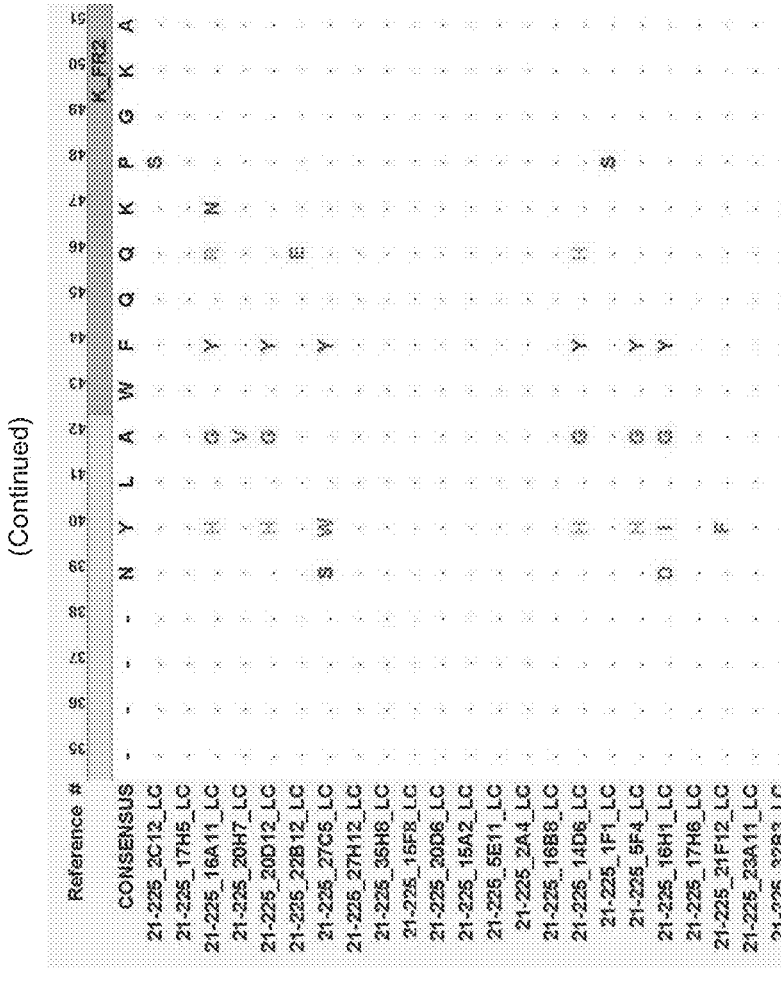
Figure 56:
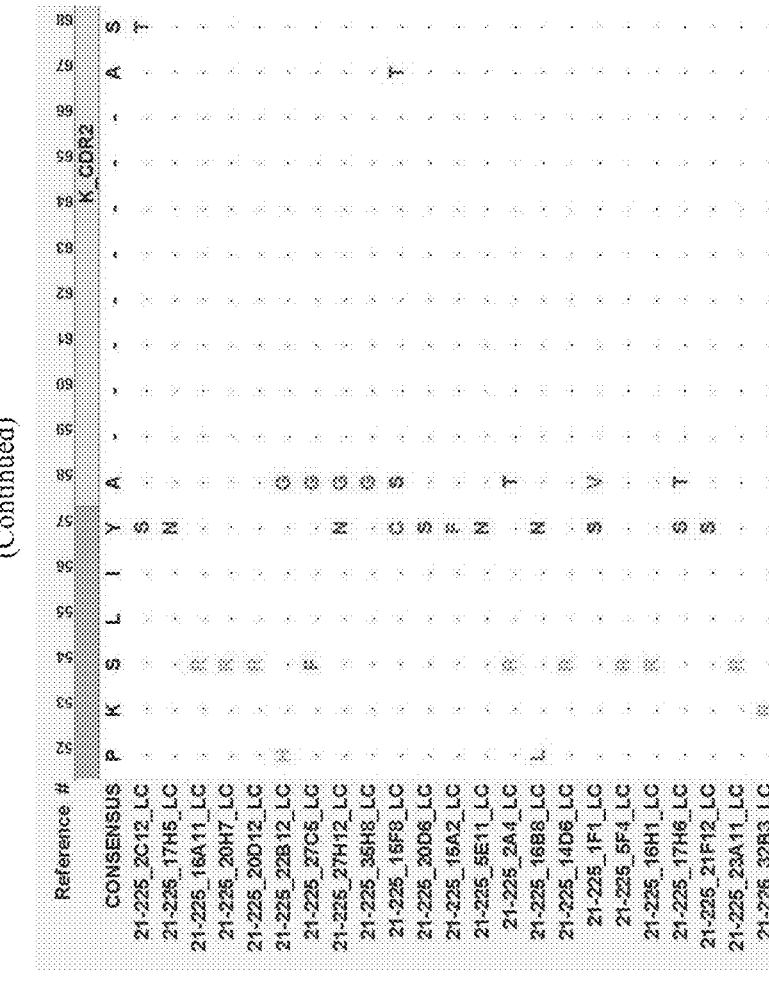
Figure 56:
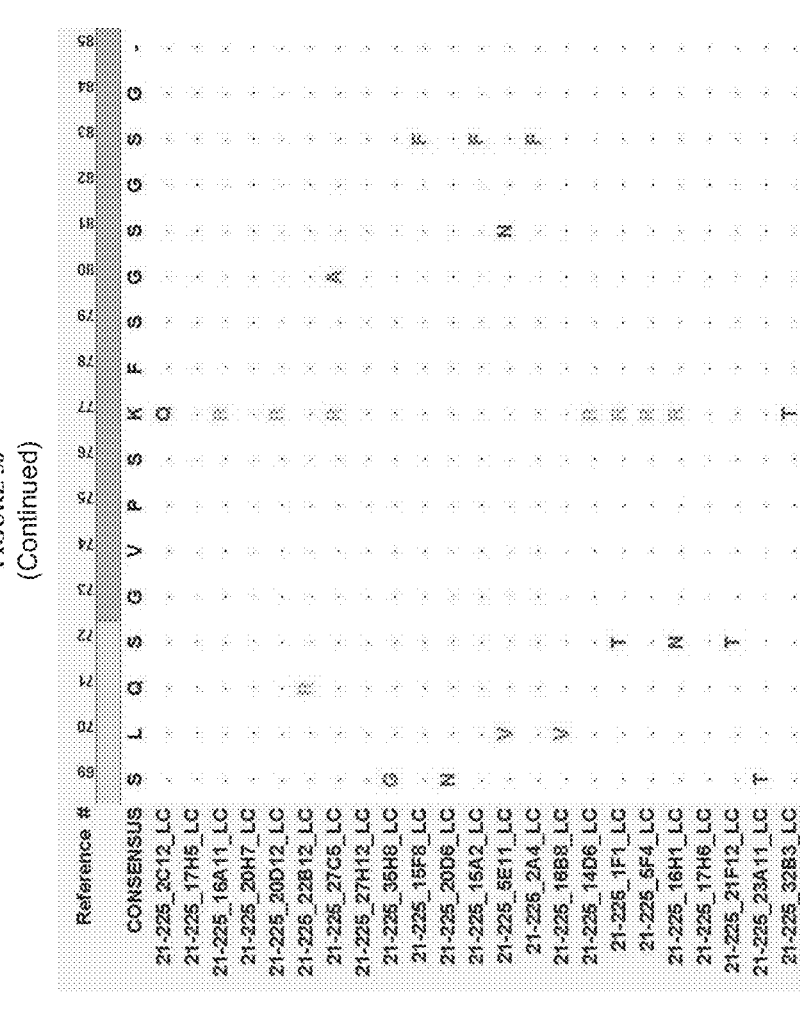
Figure 56:
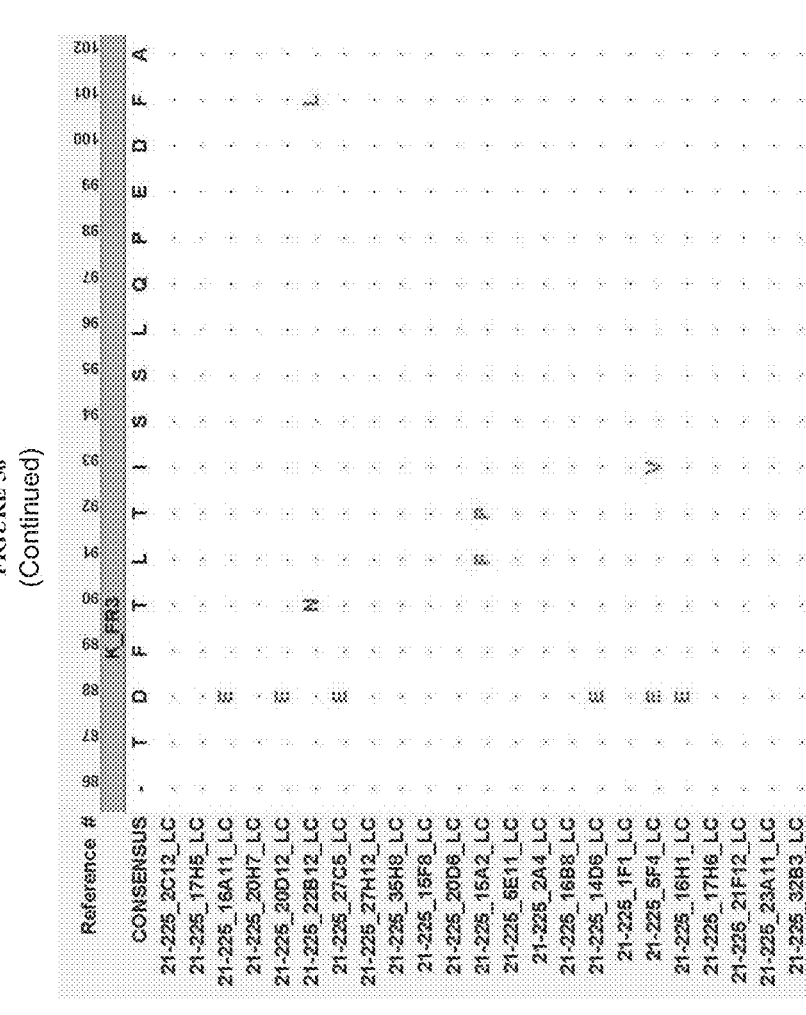
Figure 56:
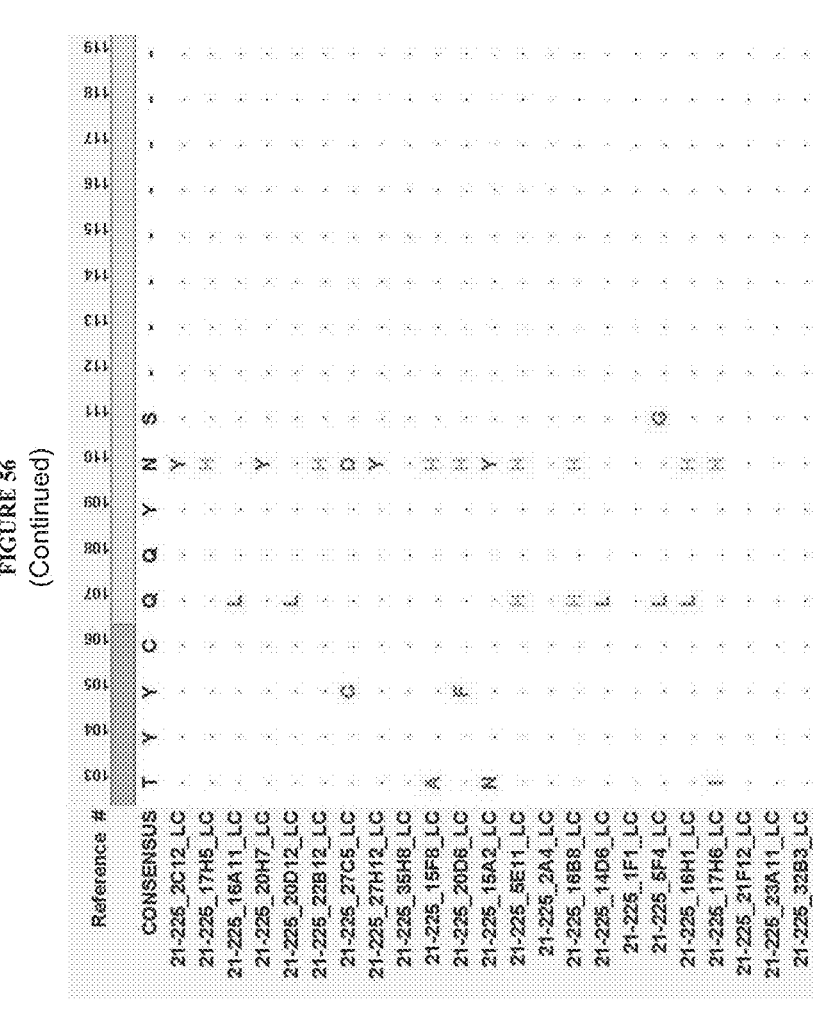
Figure 56:
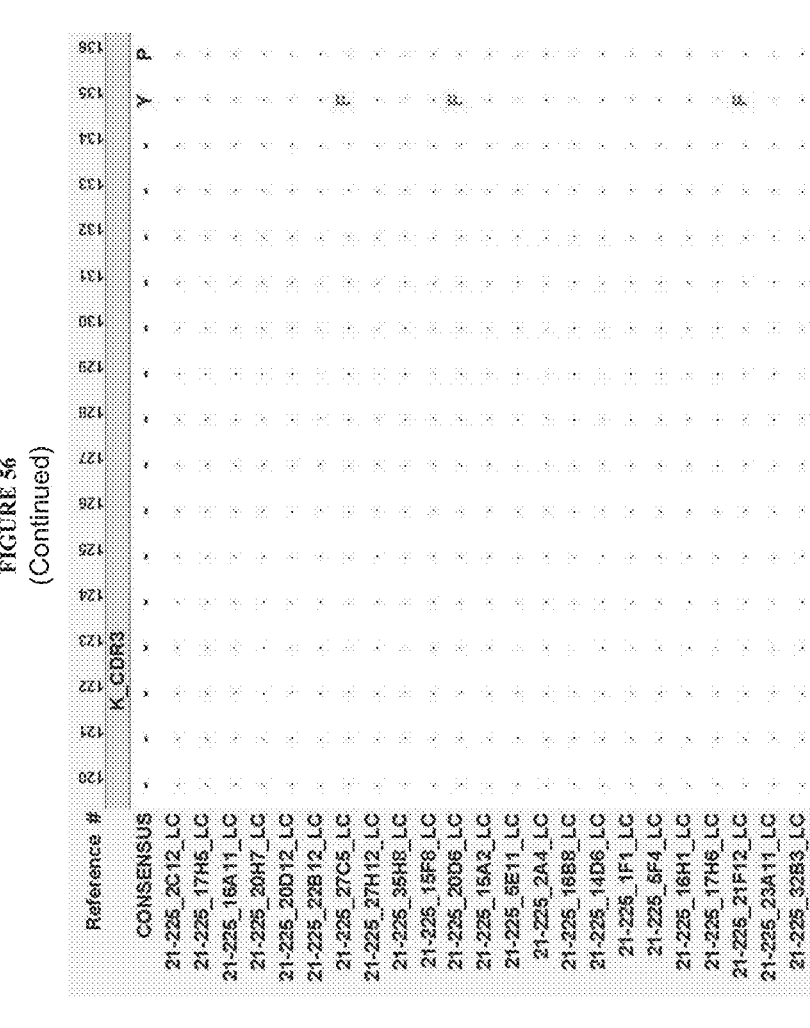
Figure 56:
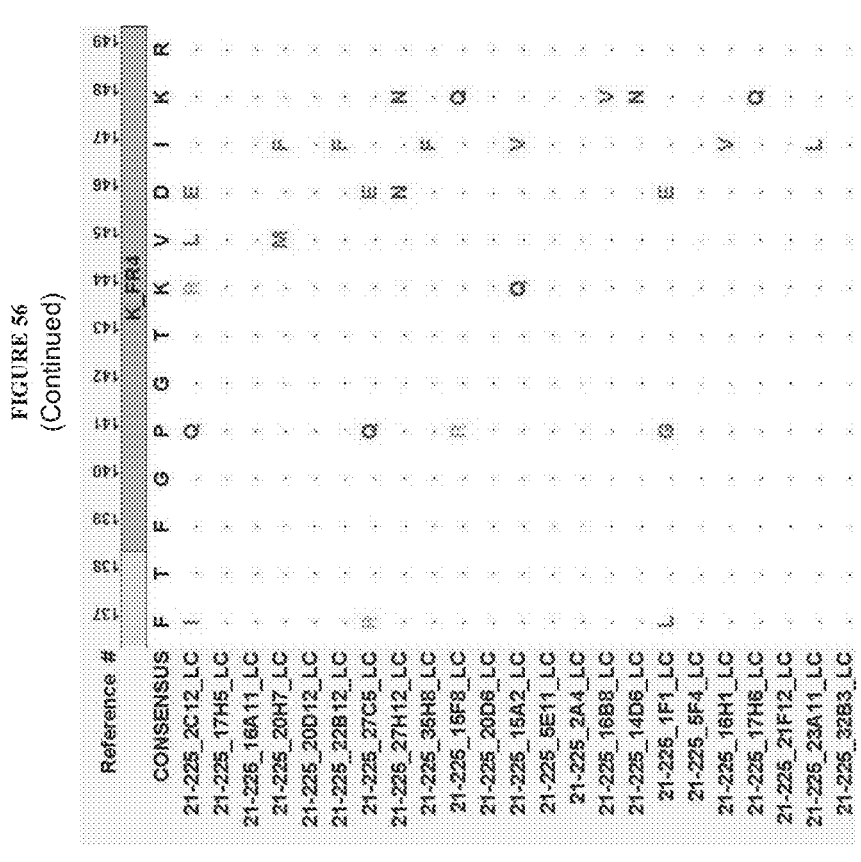
Figure 56:
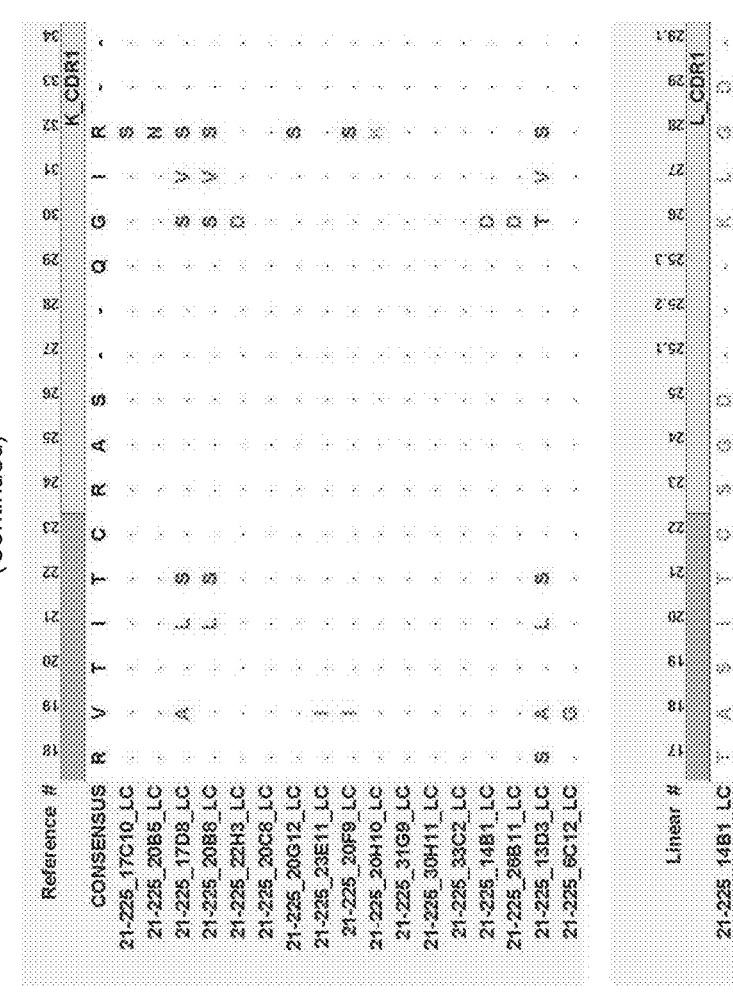
Figure 56:
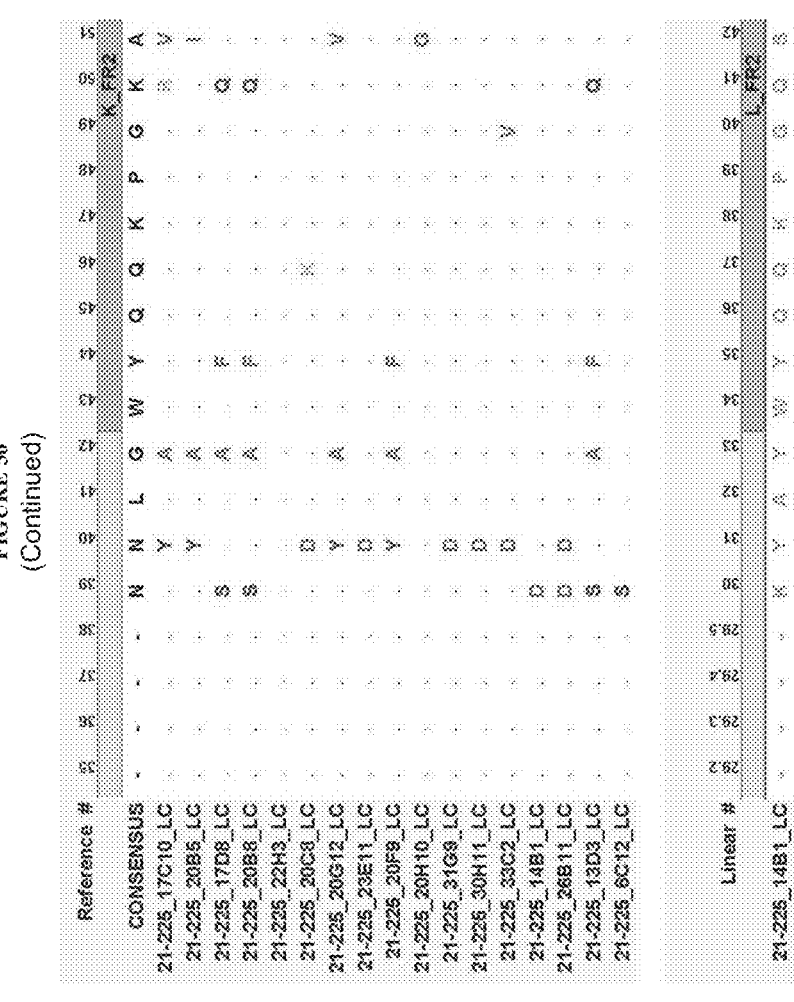
Figure 56:
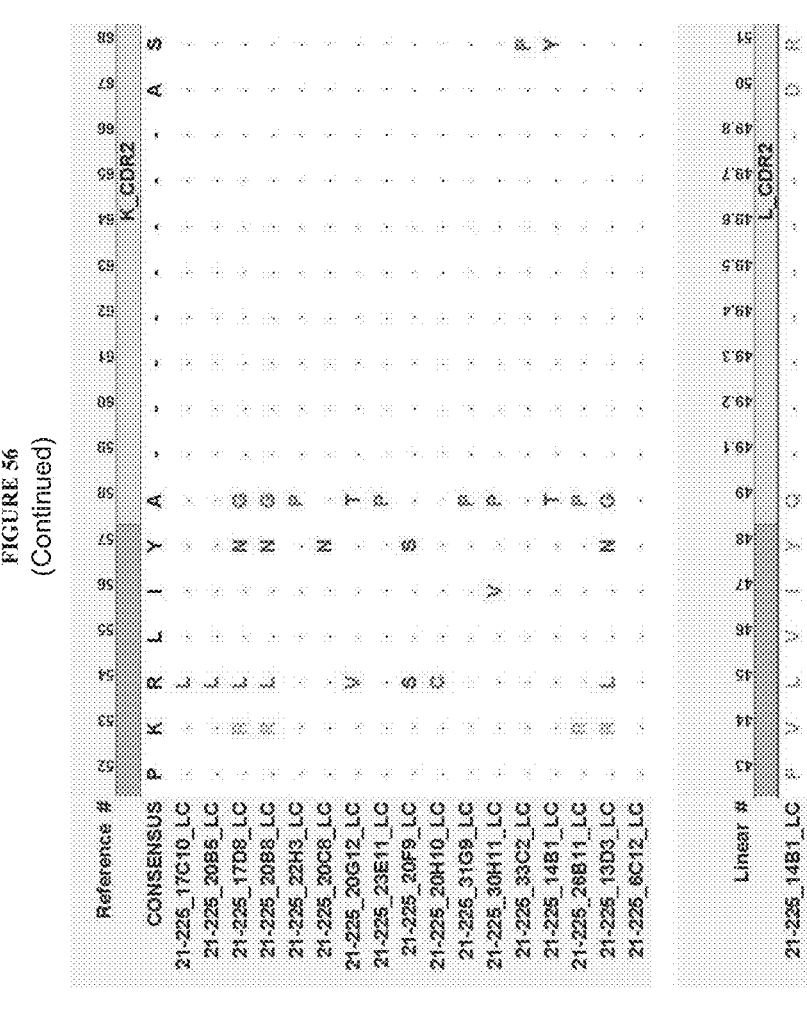
Figure 56:
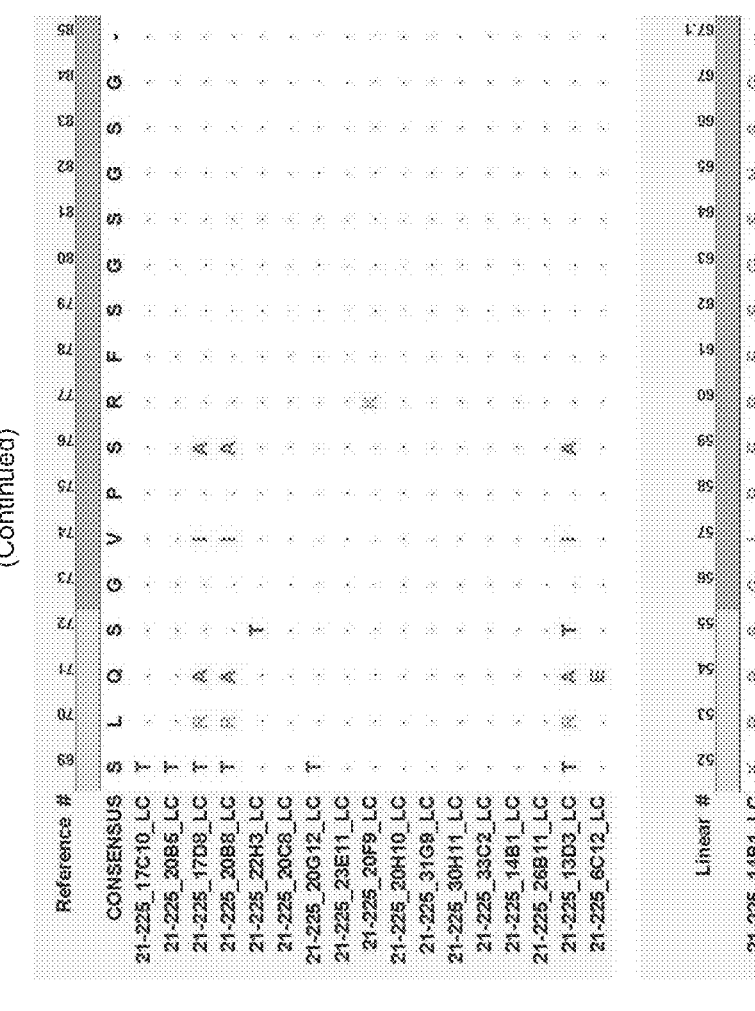
Figure 56:
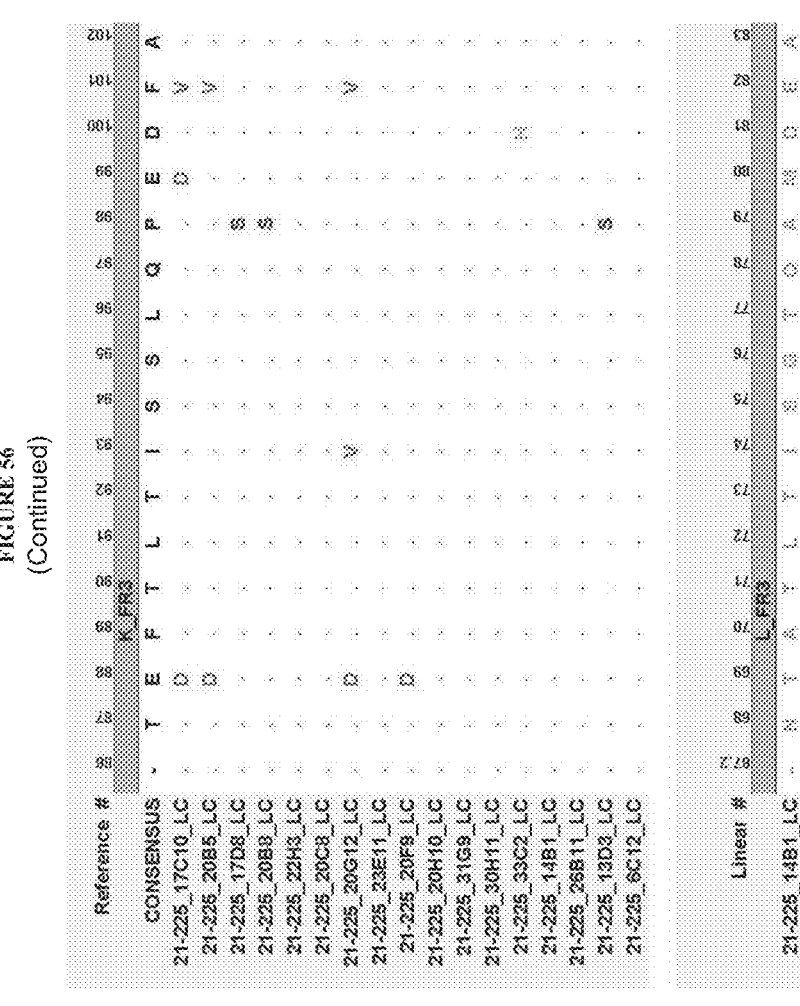
Figure 56:
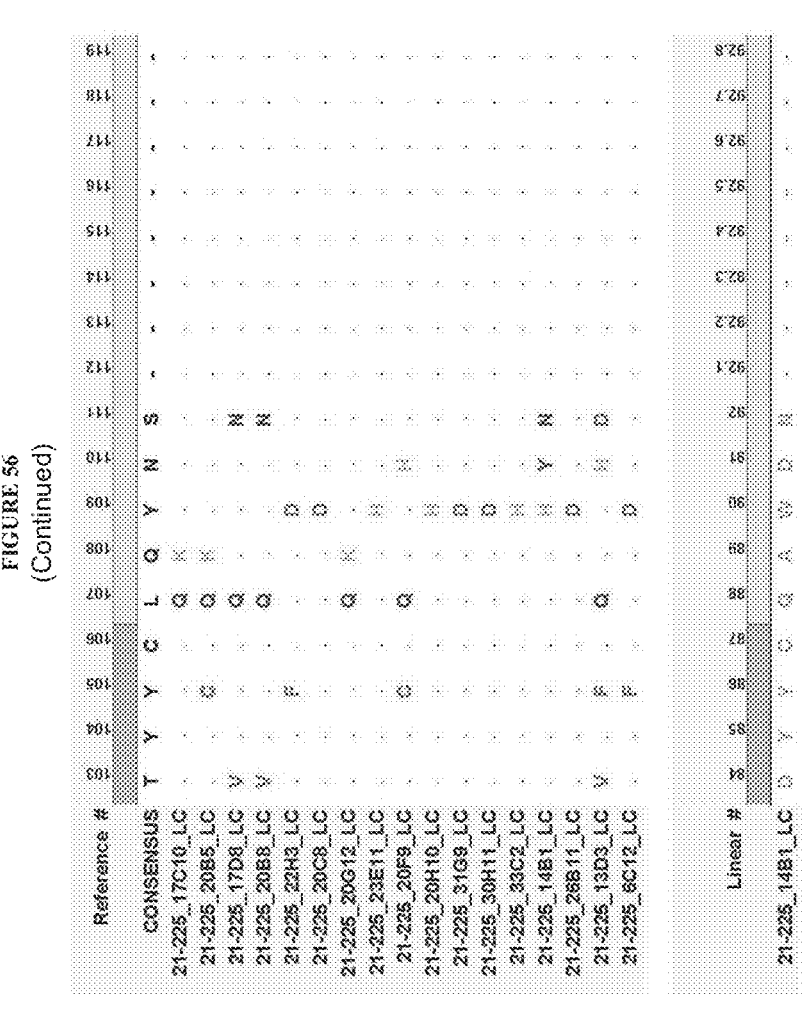
Figure 56:
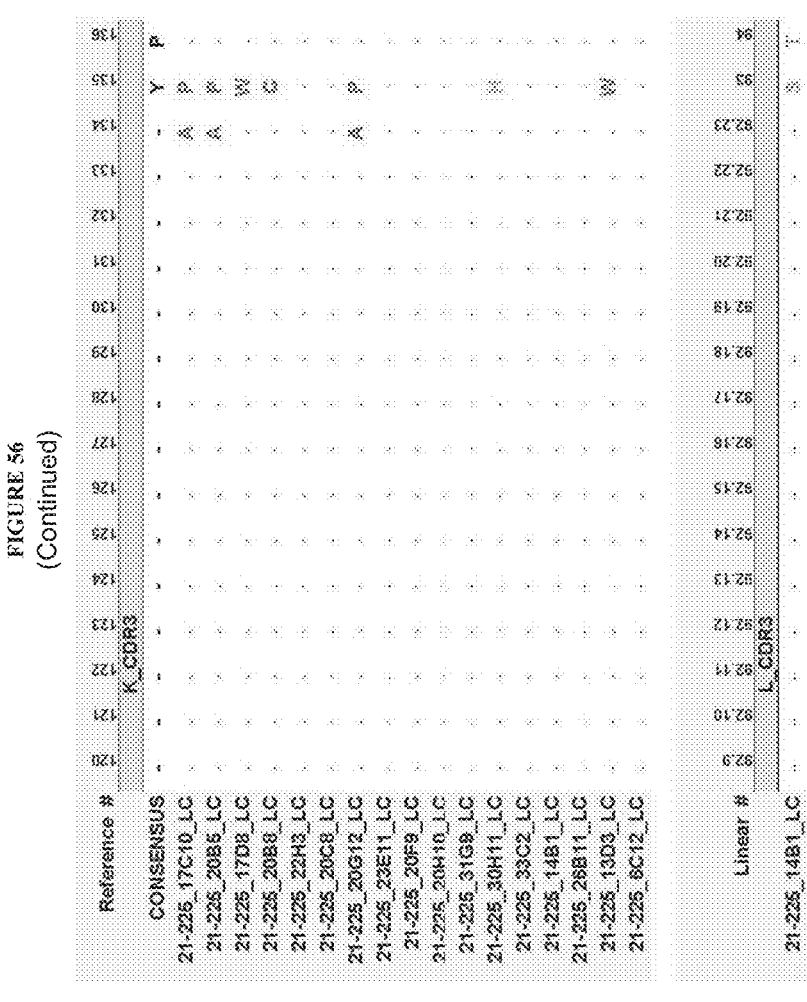
Figure 56:
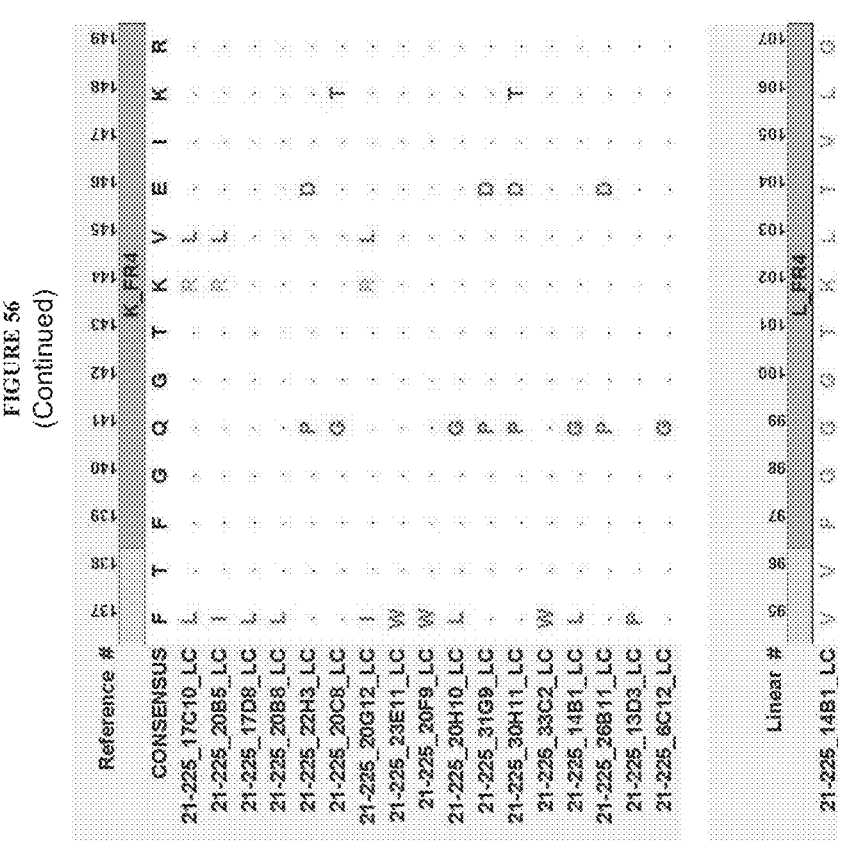
Figure 56:
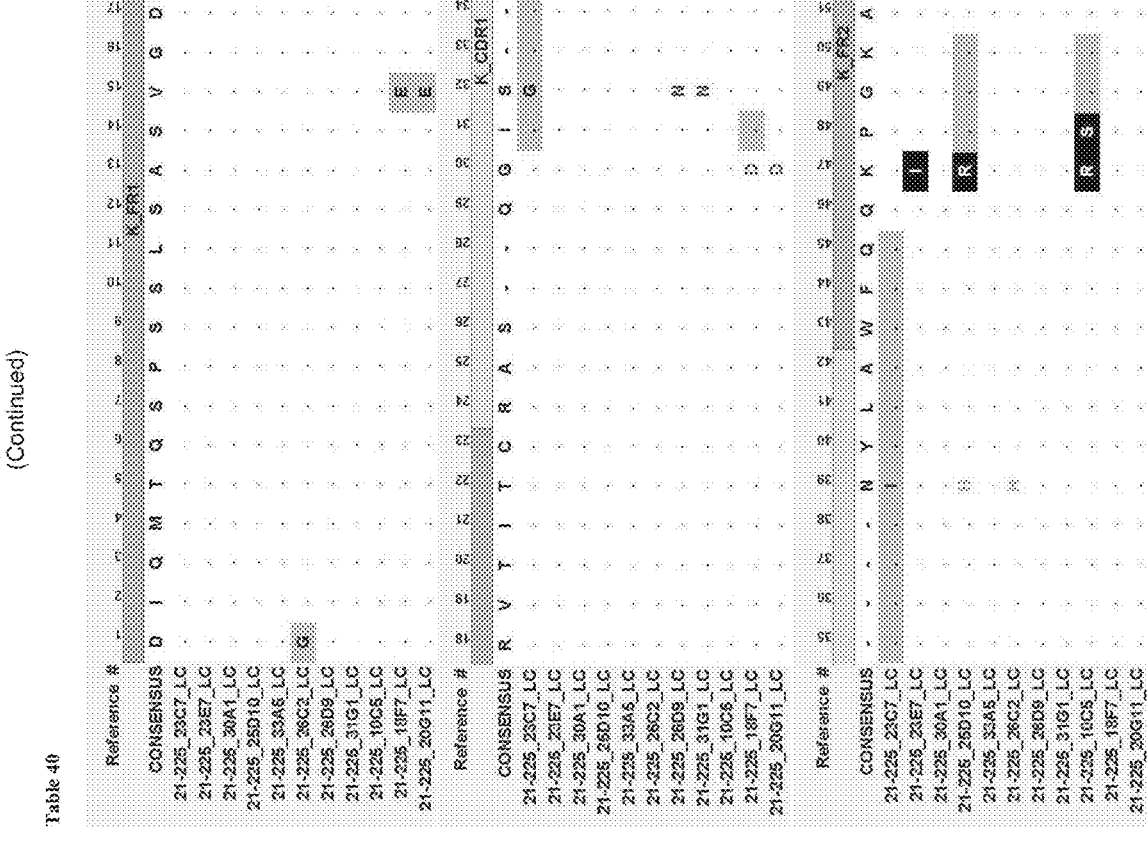
Figure 56:
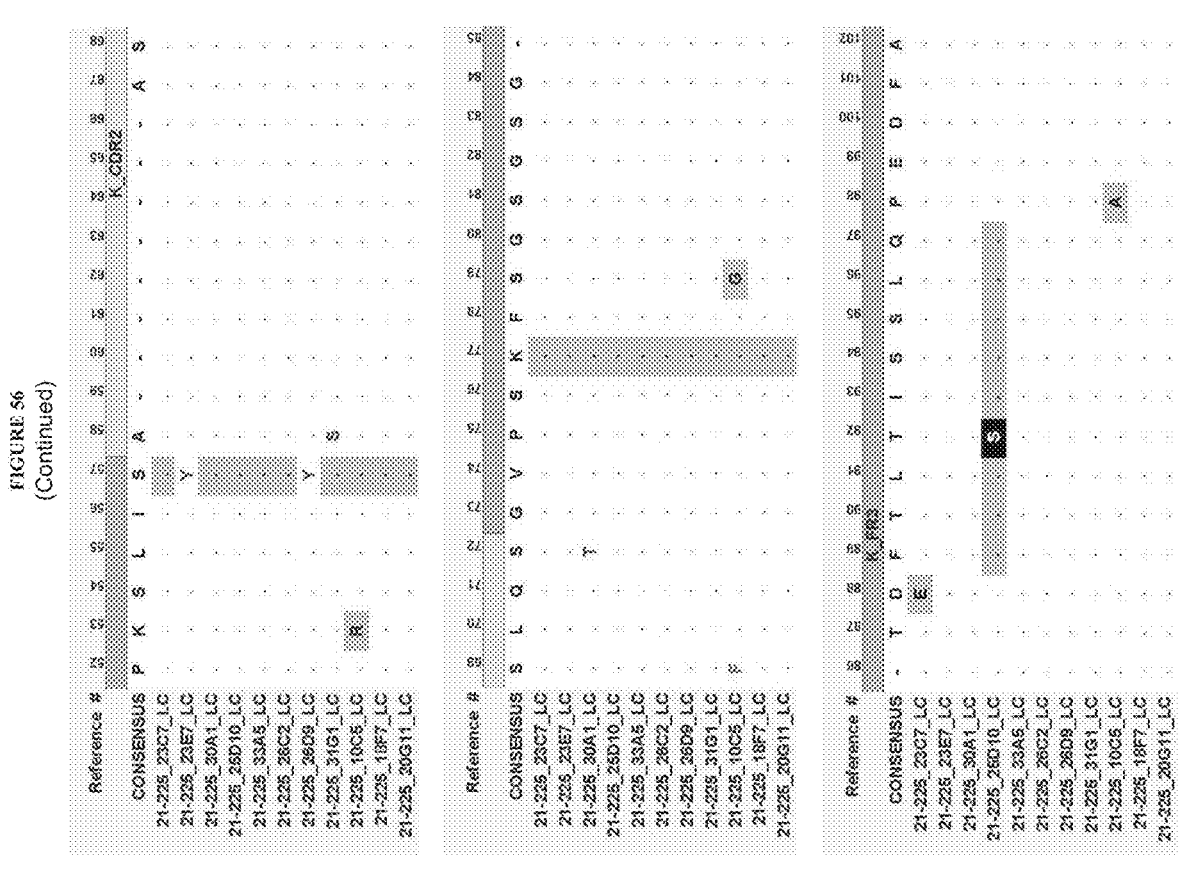
Figure 56:
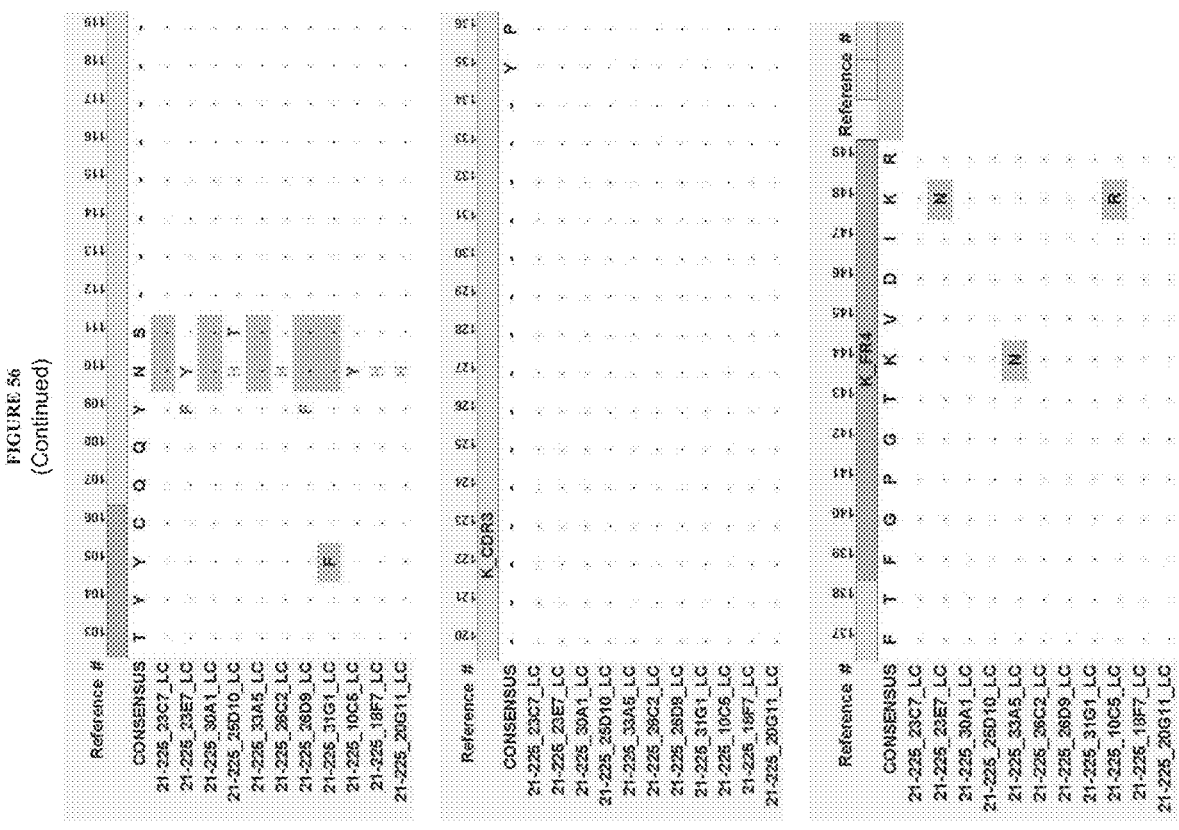
Figure 56:
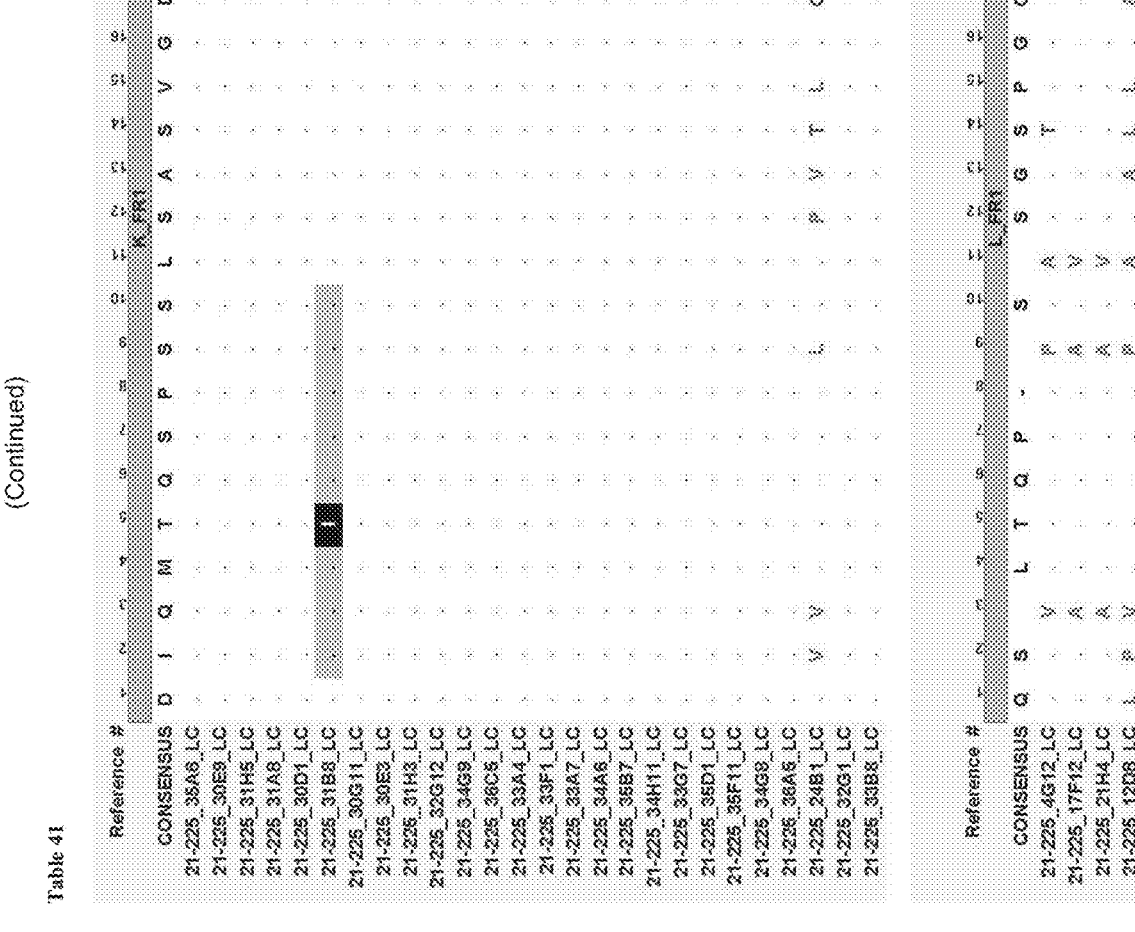
Figure 56:
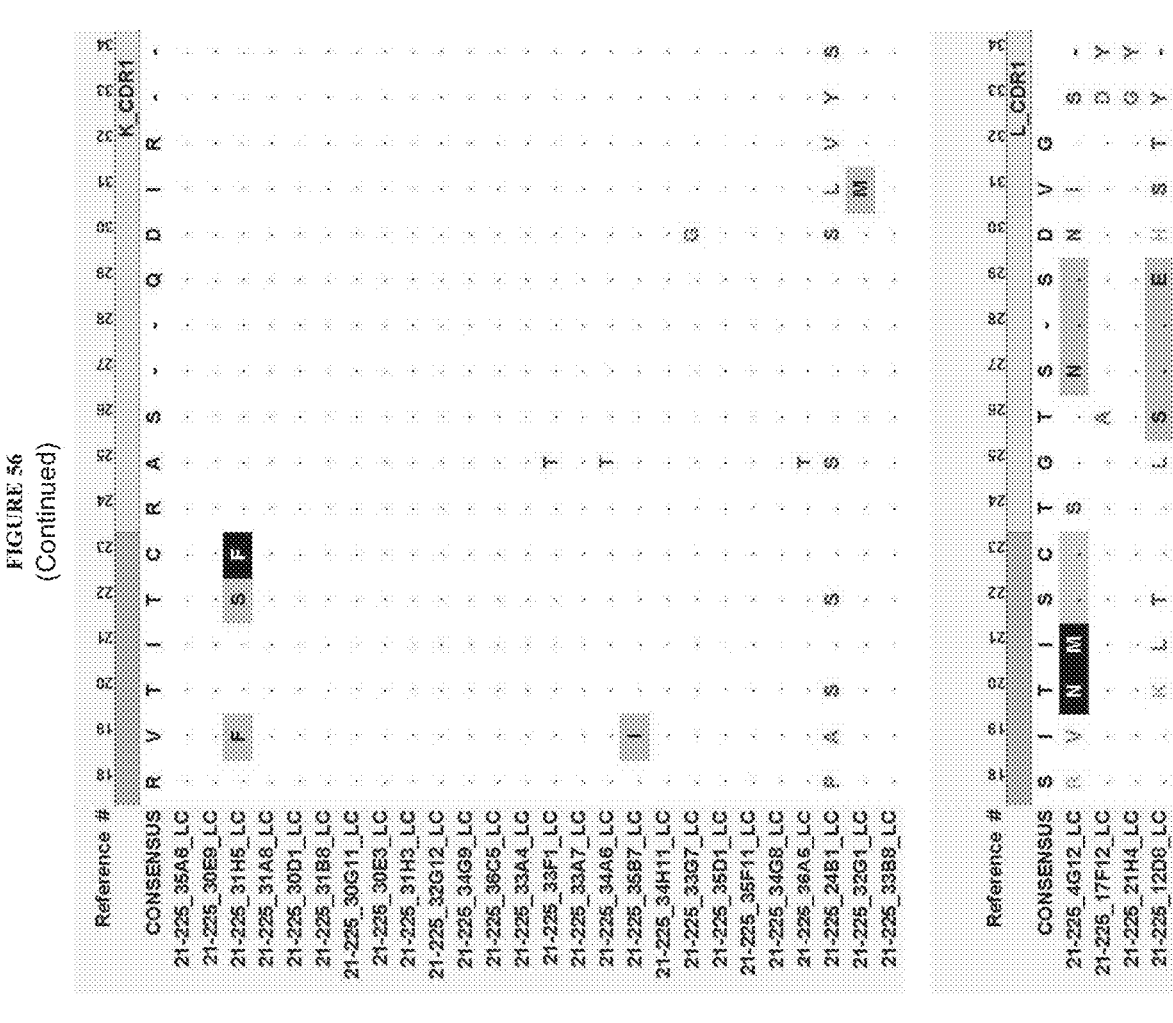
Figure 56:
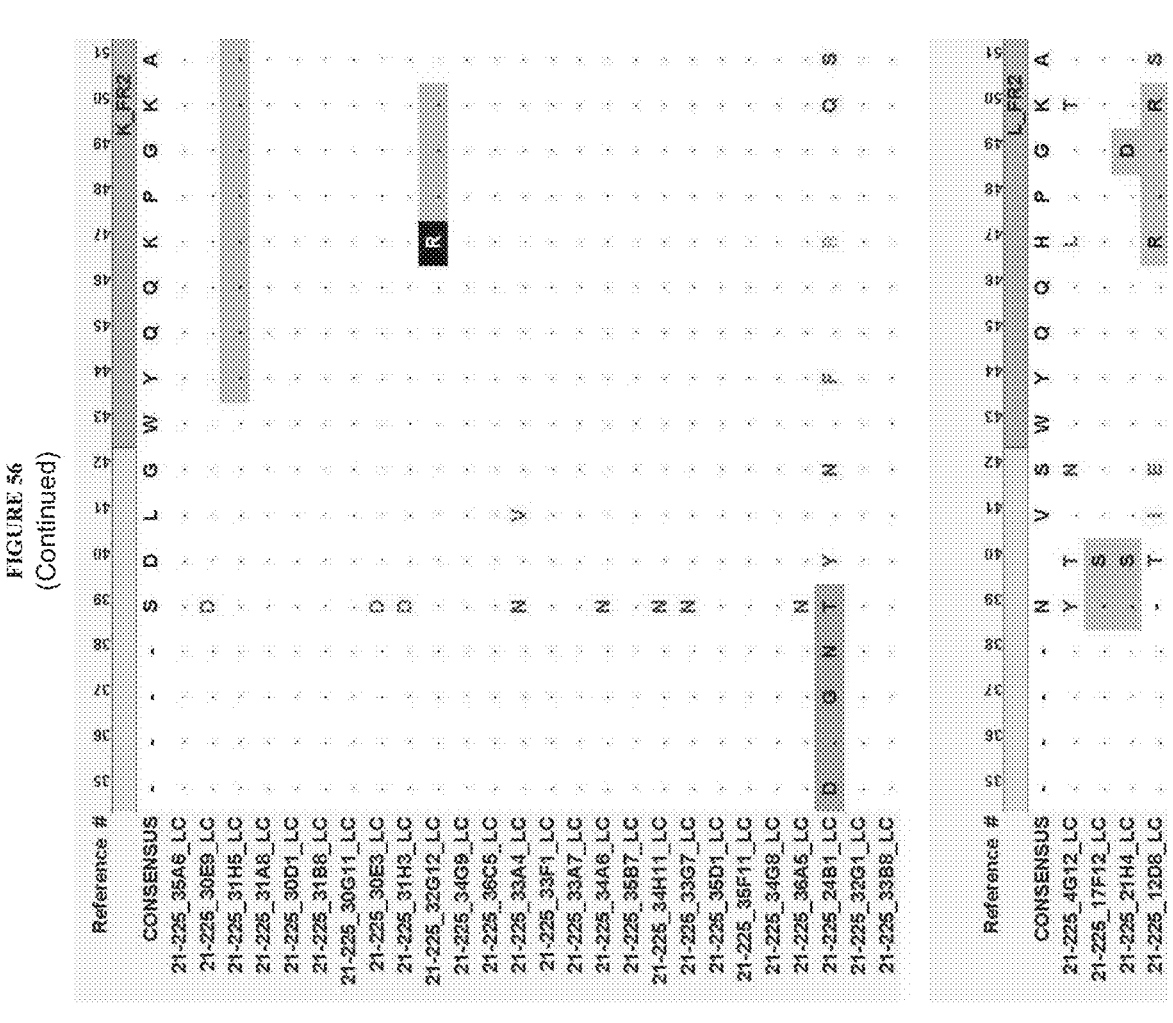
Figure 56:
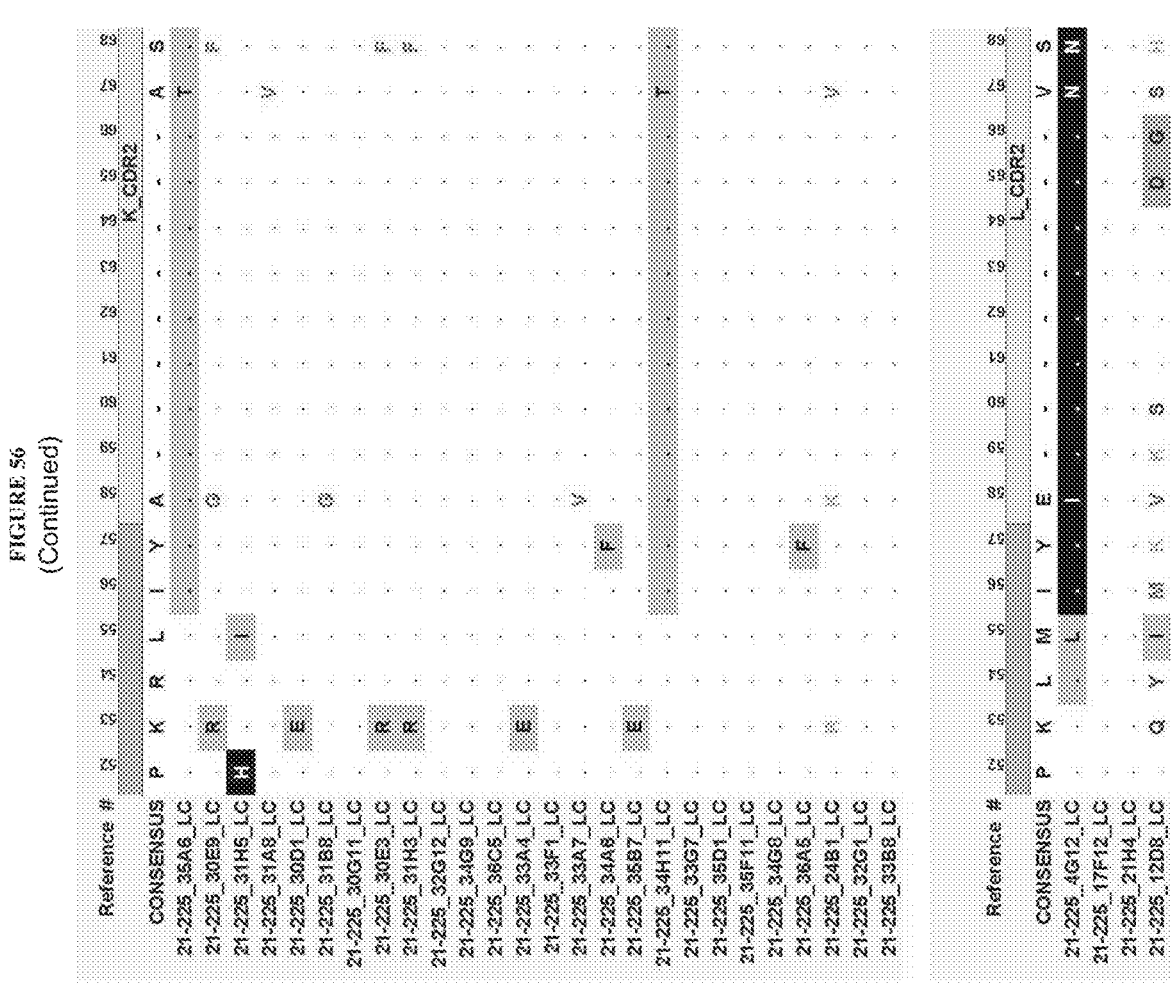
Figure 56:
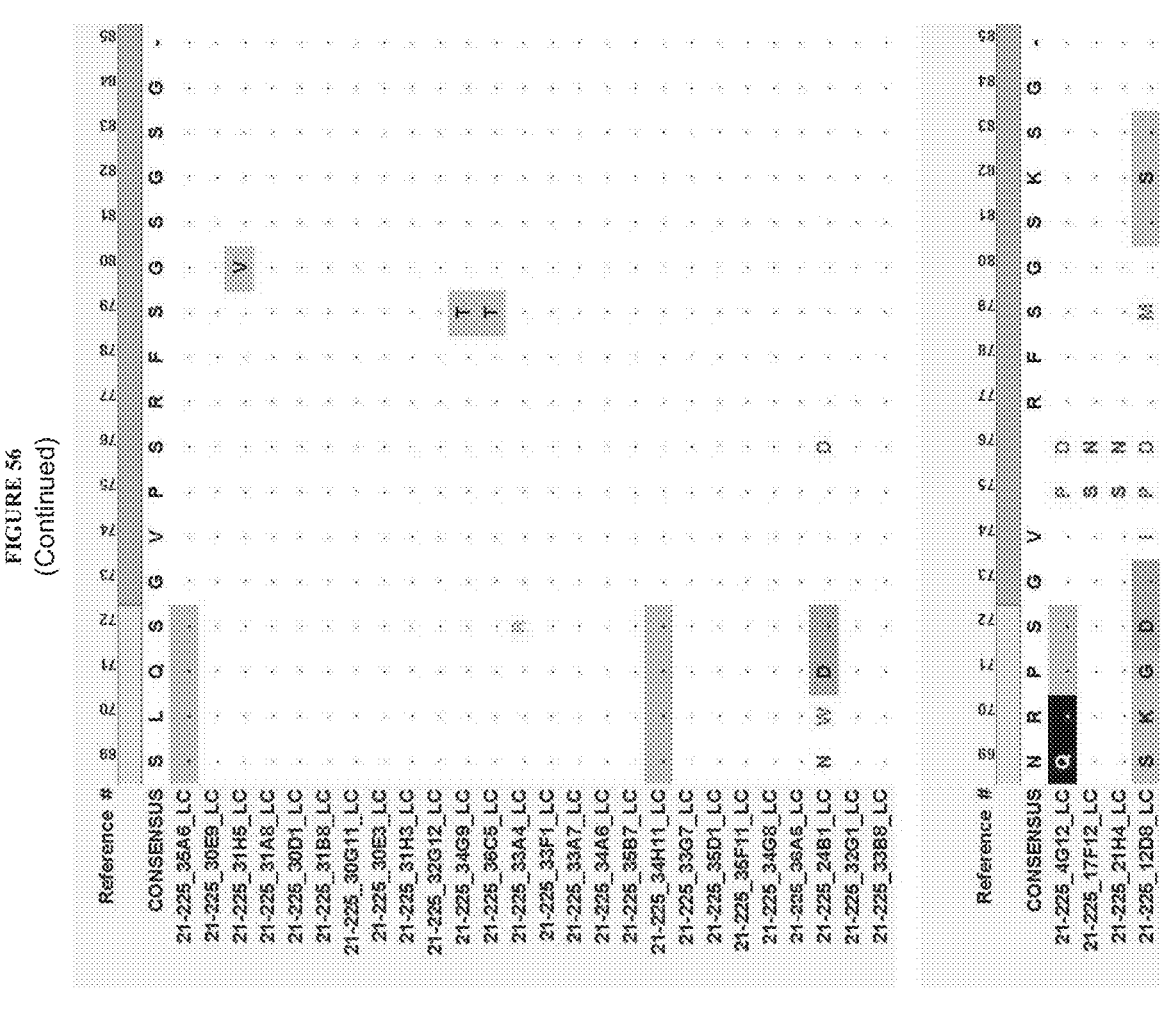
Figure 56:
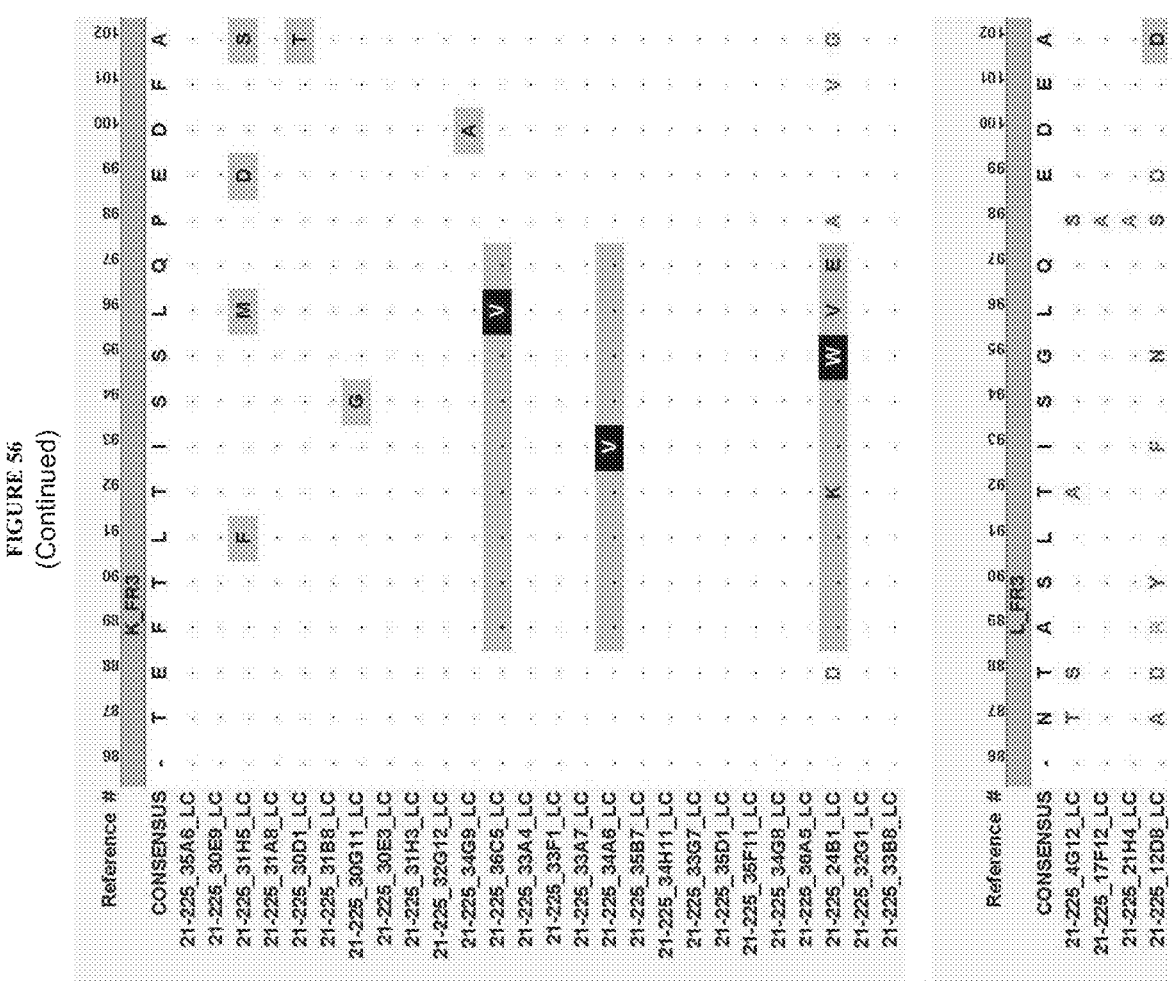
Figure 56:
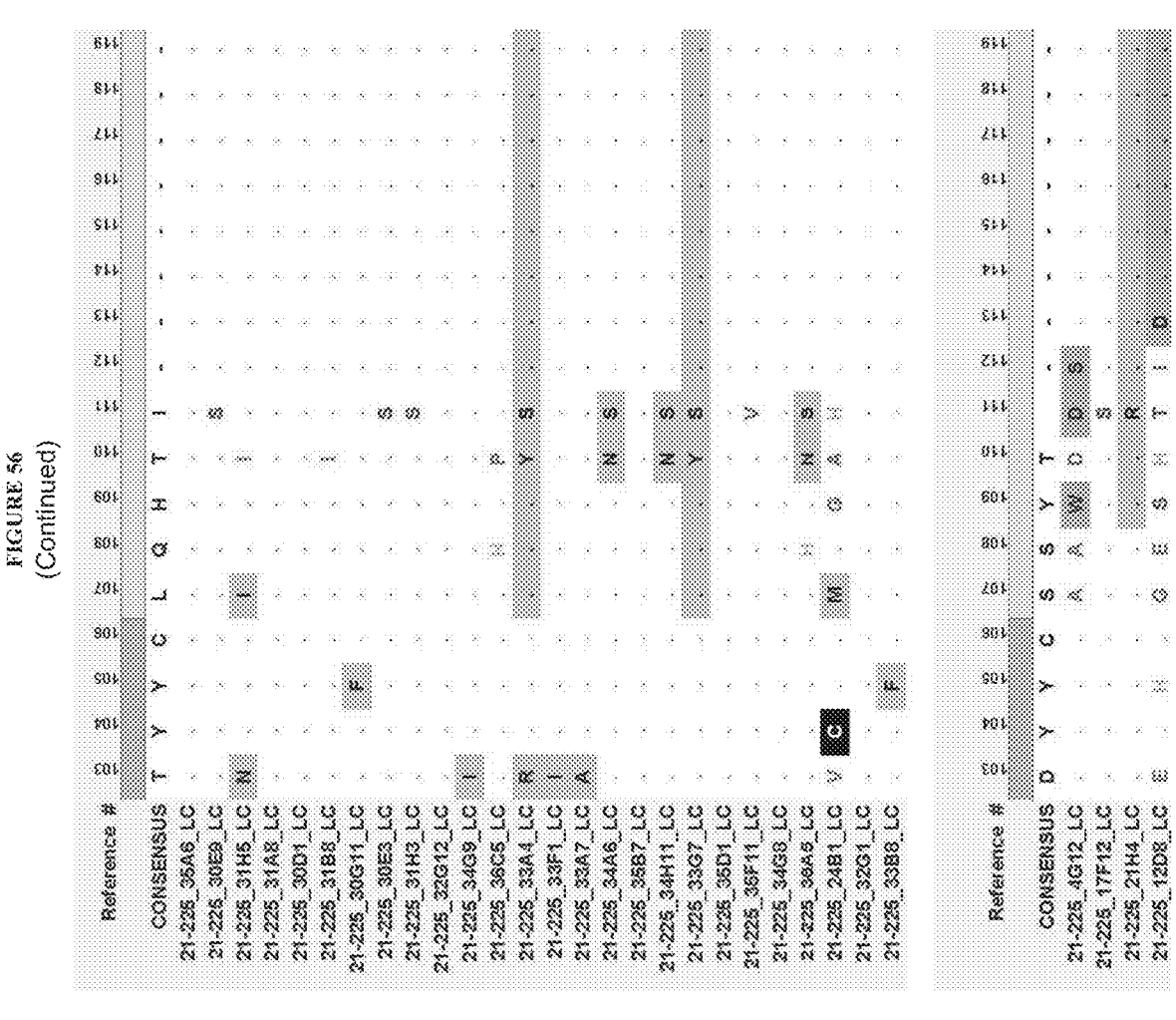
Figure 56:
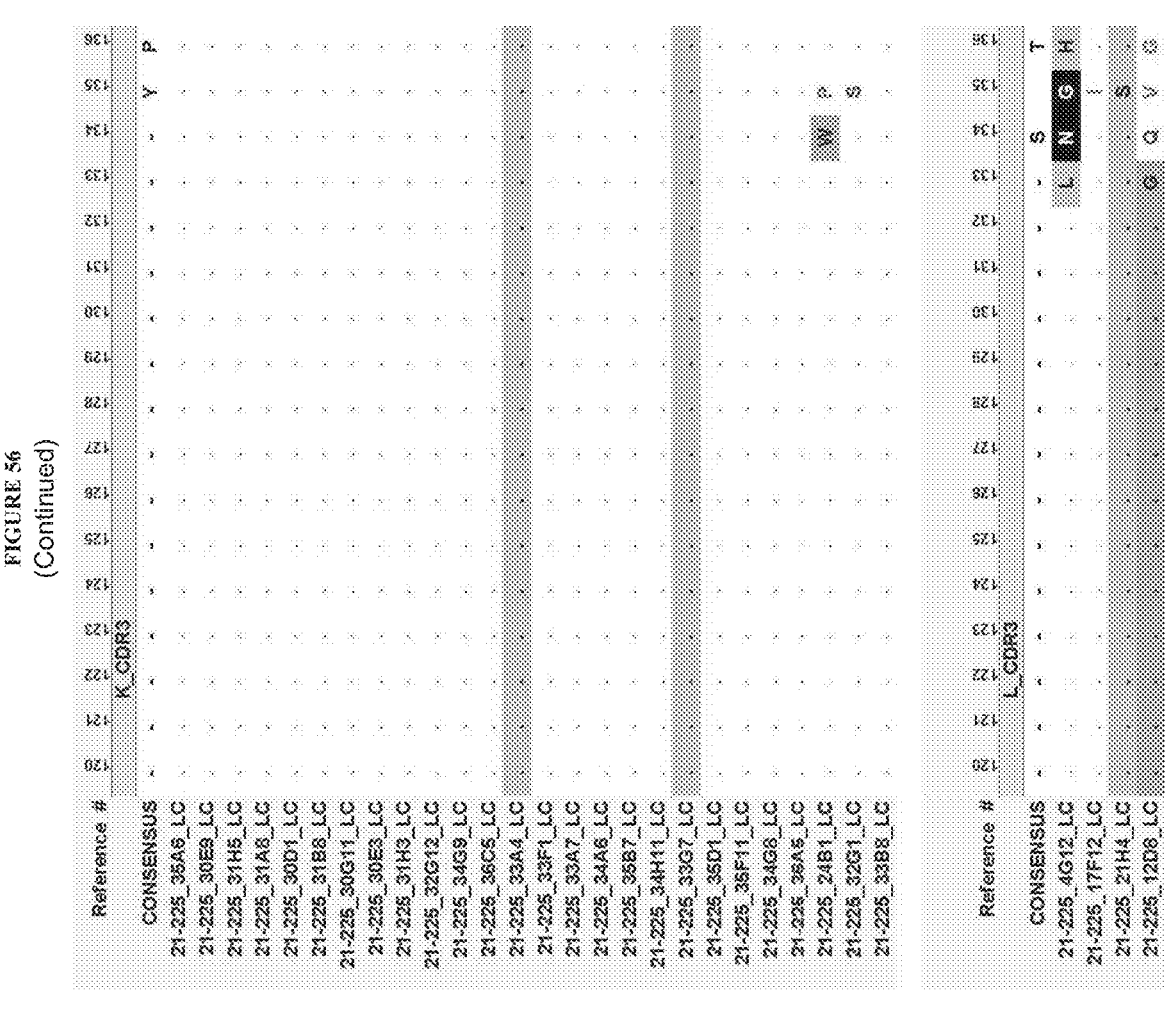
Figure 56:
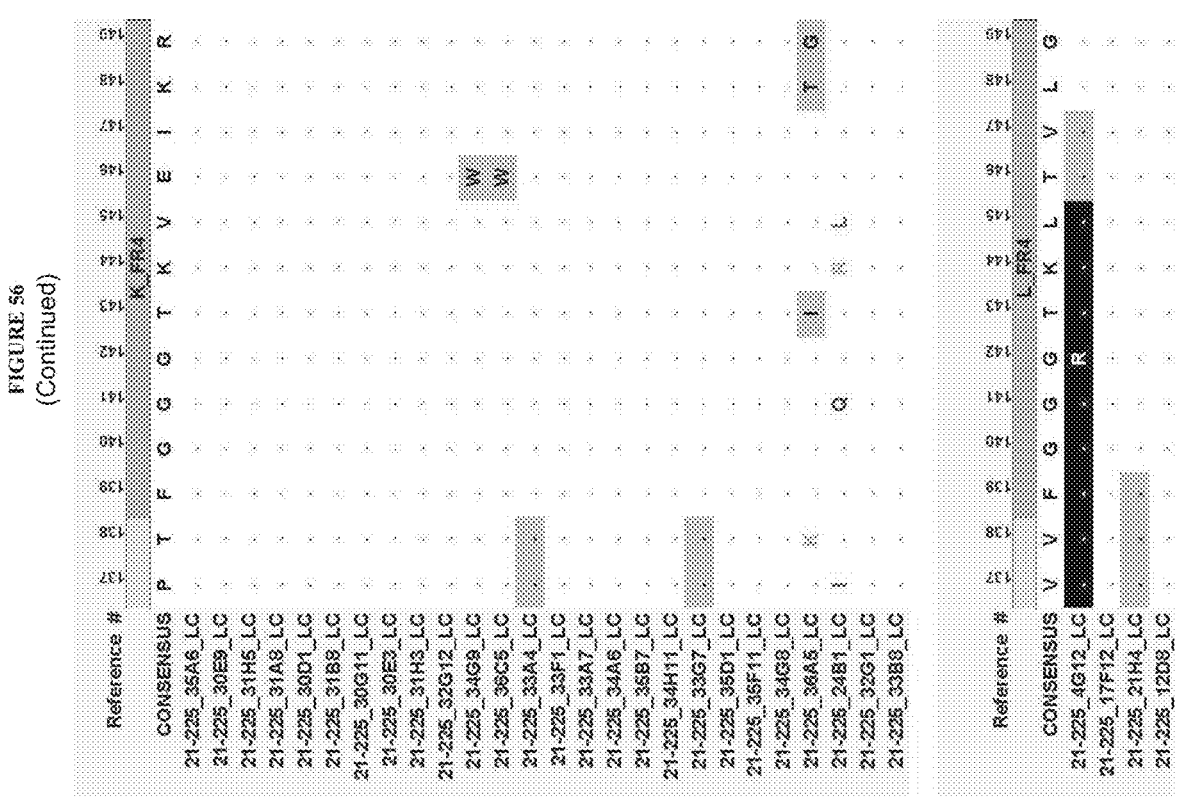
Figure 56:
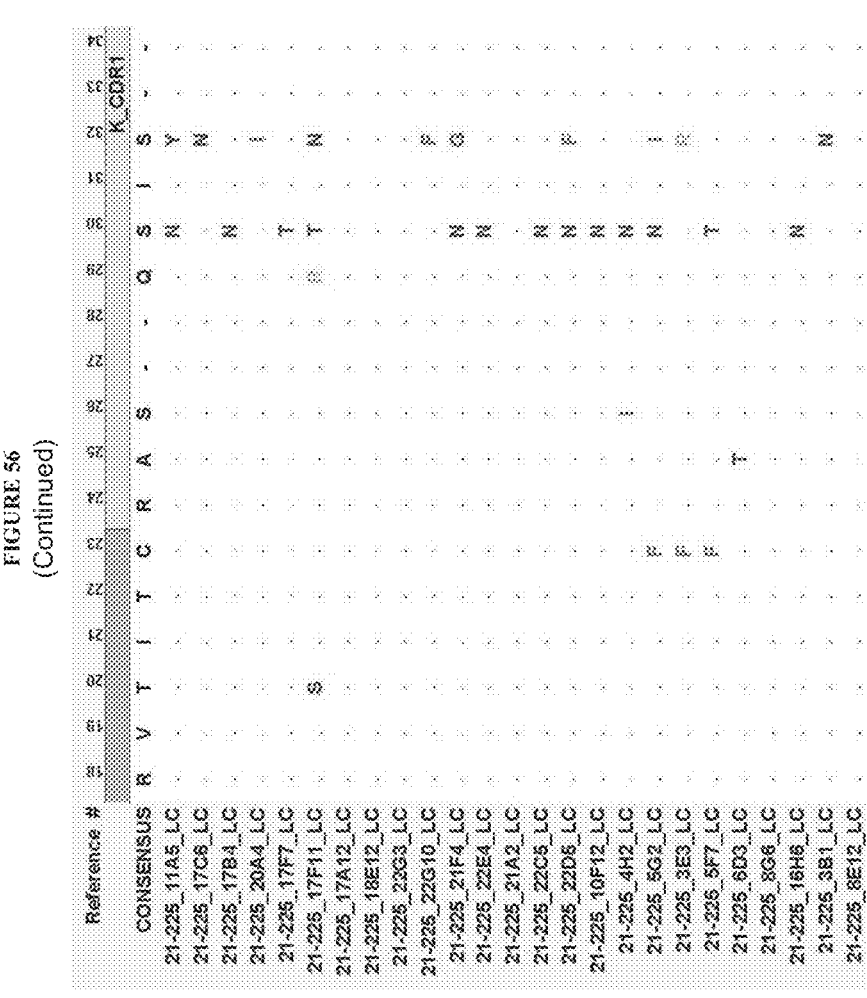
Figure 56:
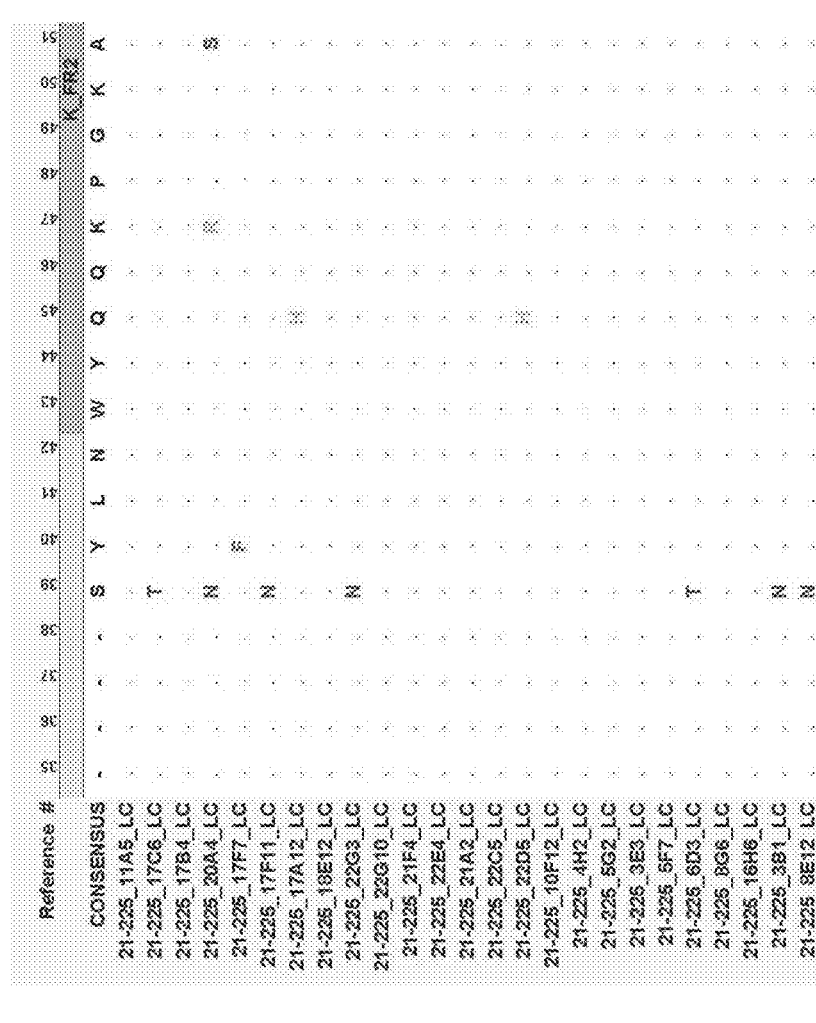
Figure 56:
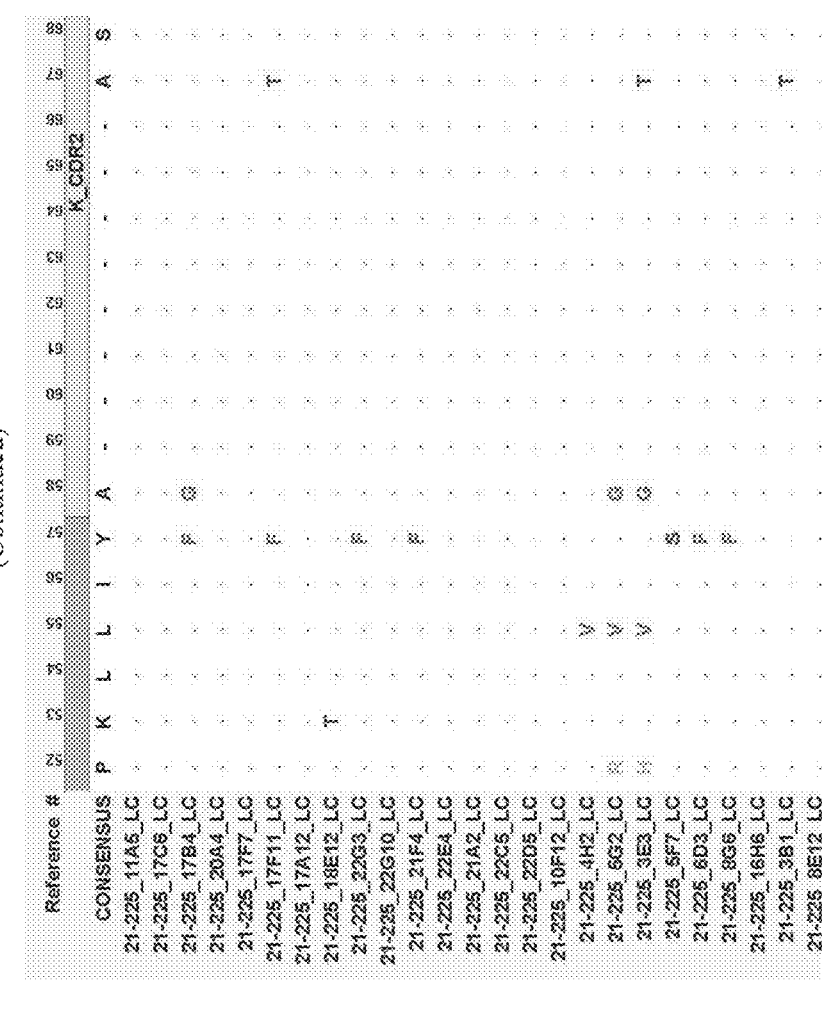
Figure 56:
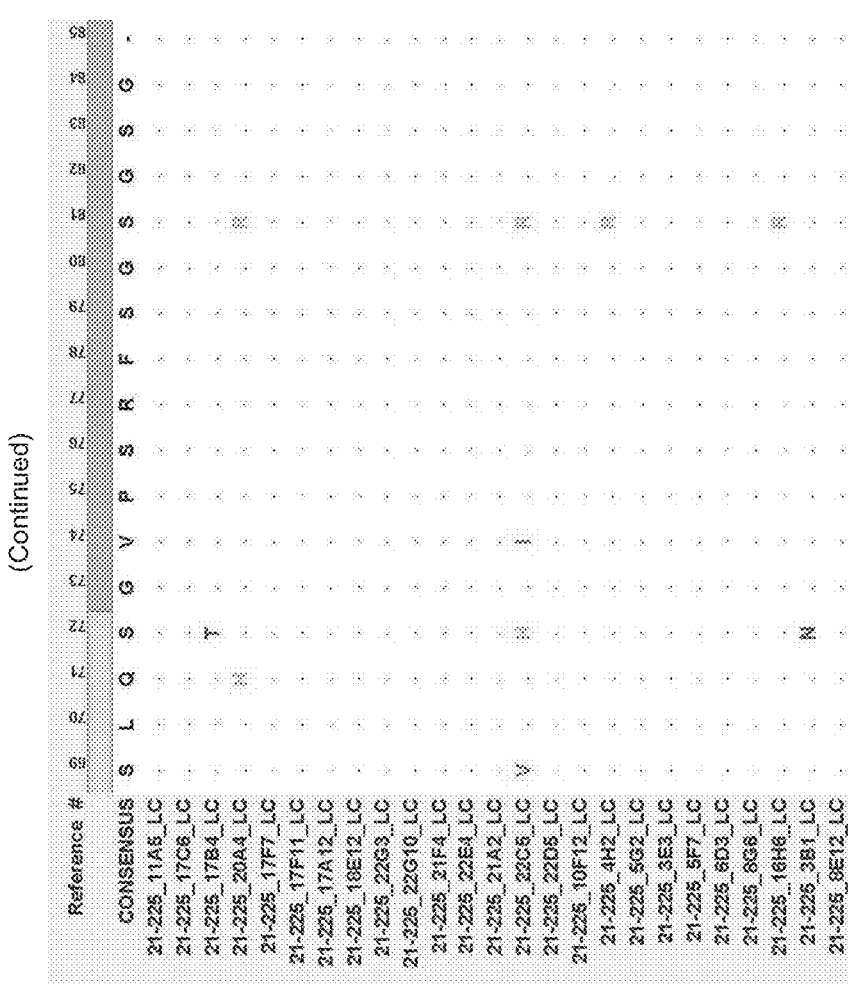
Figure 56:
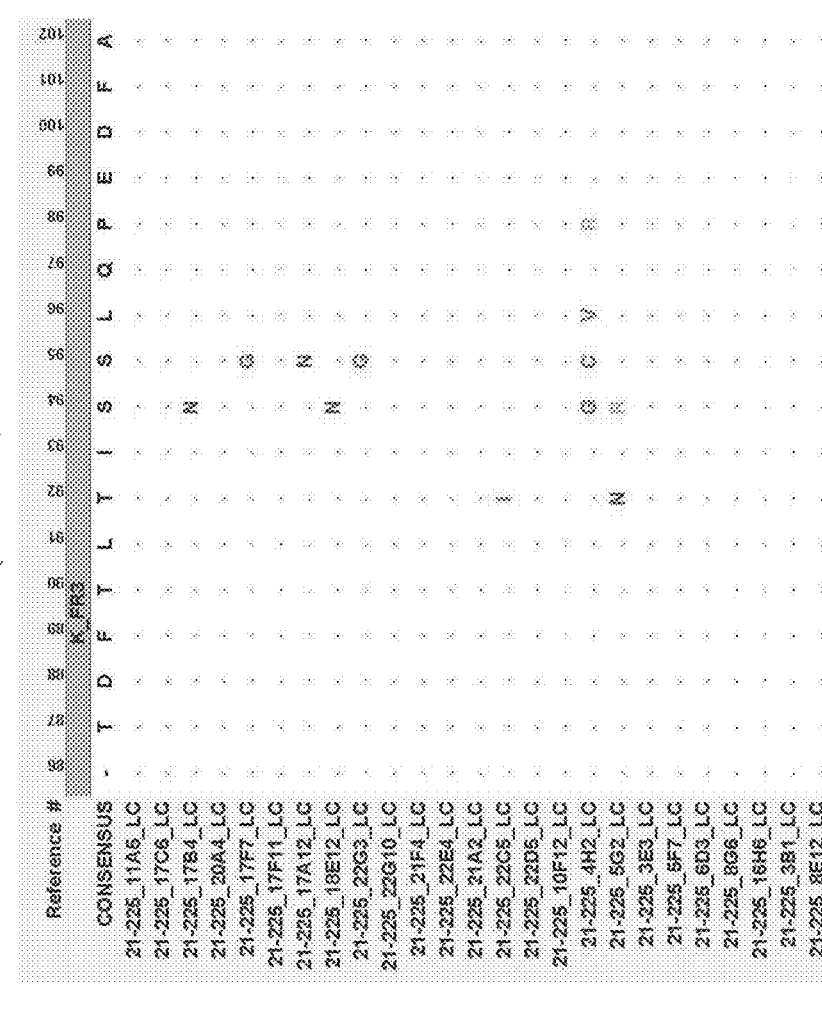
Figure 56:
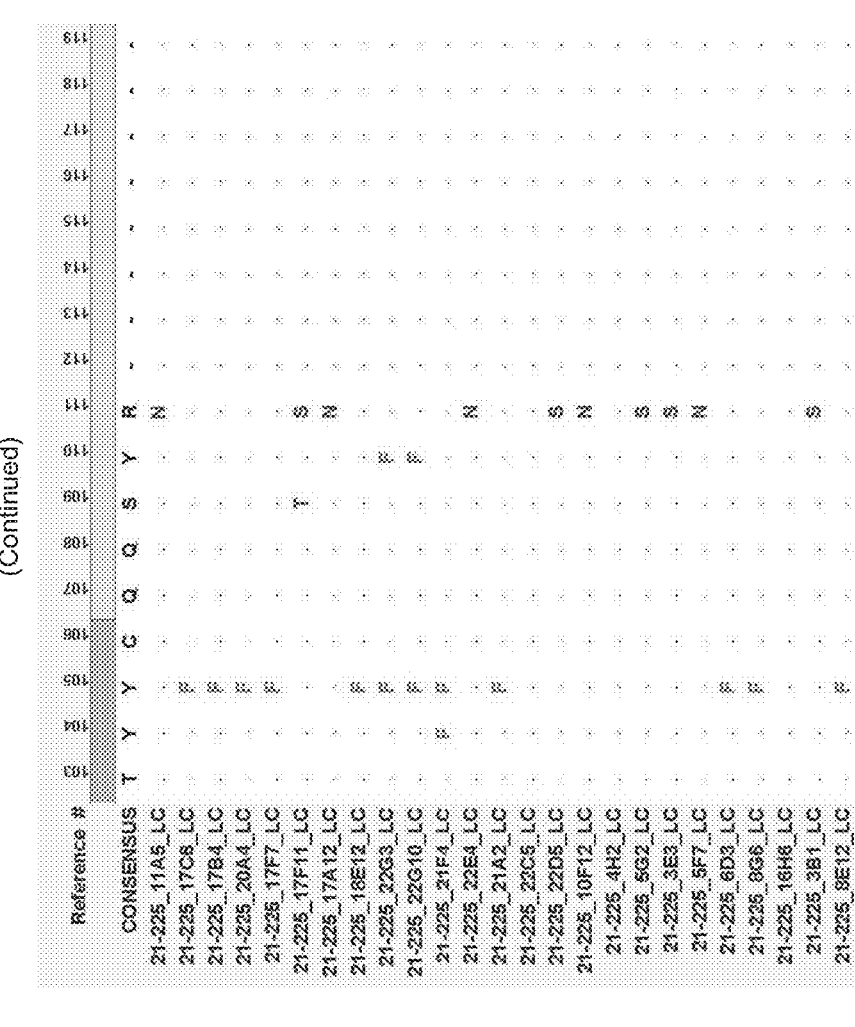
Figure 56:
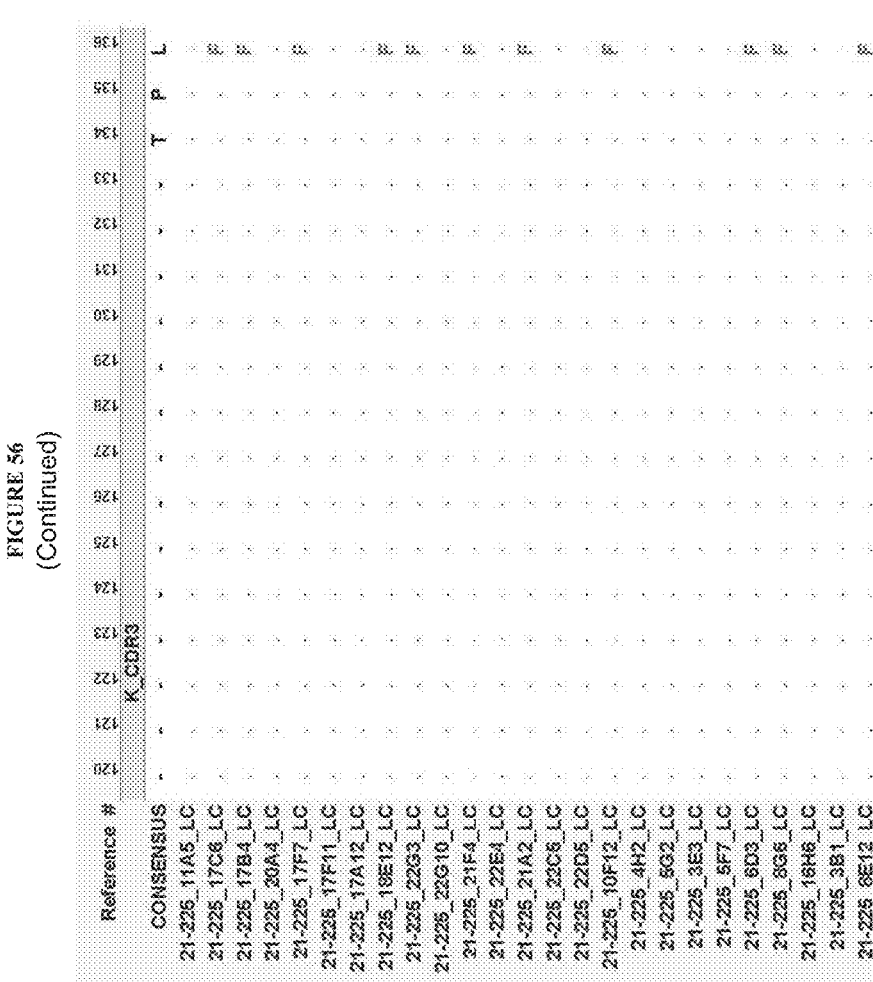
Figure 56:
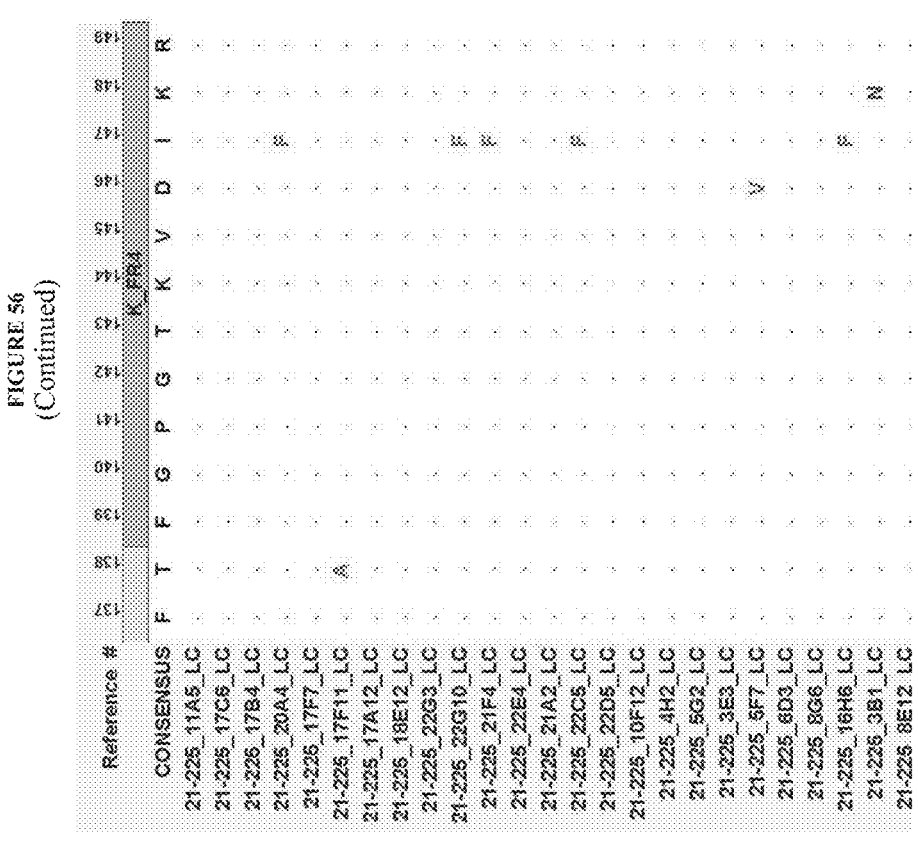
Figure 56:
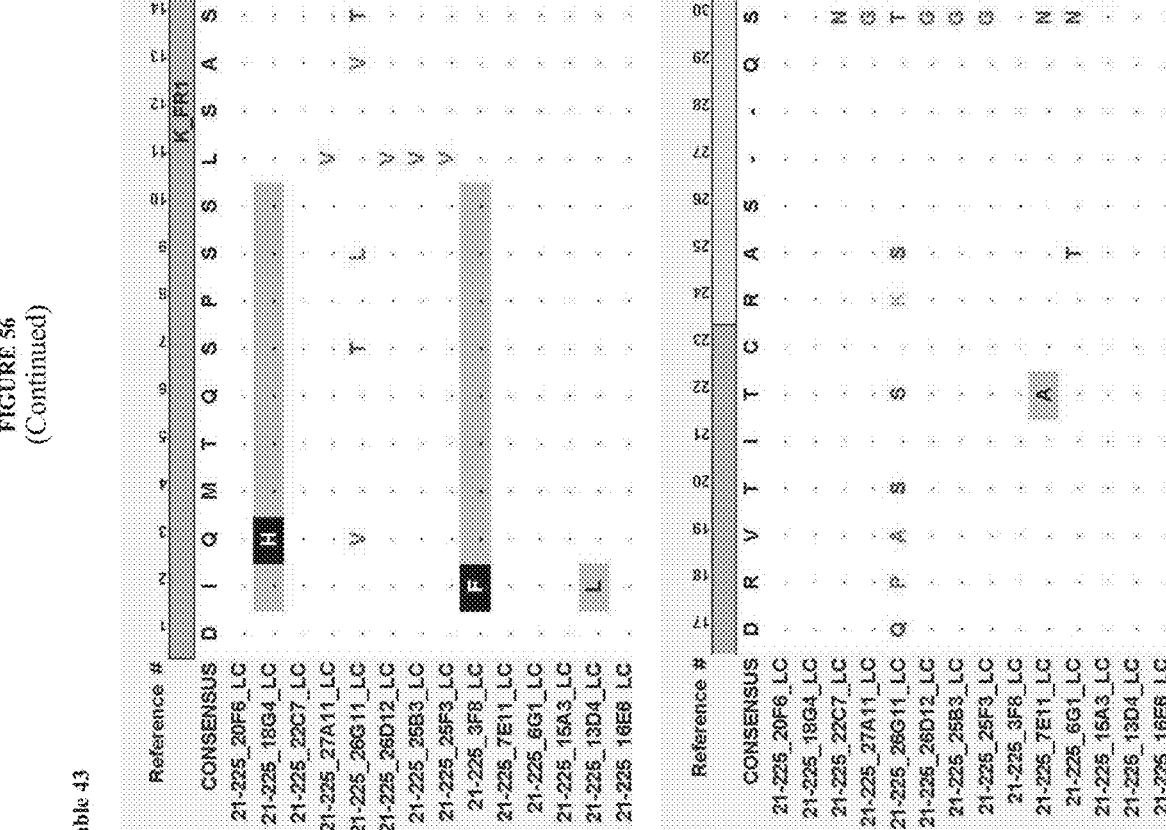
Figure 56:
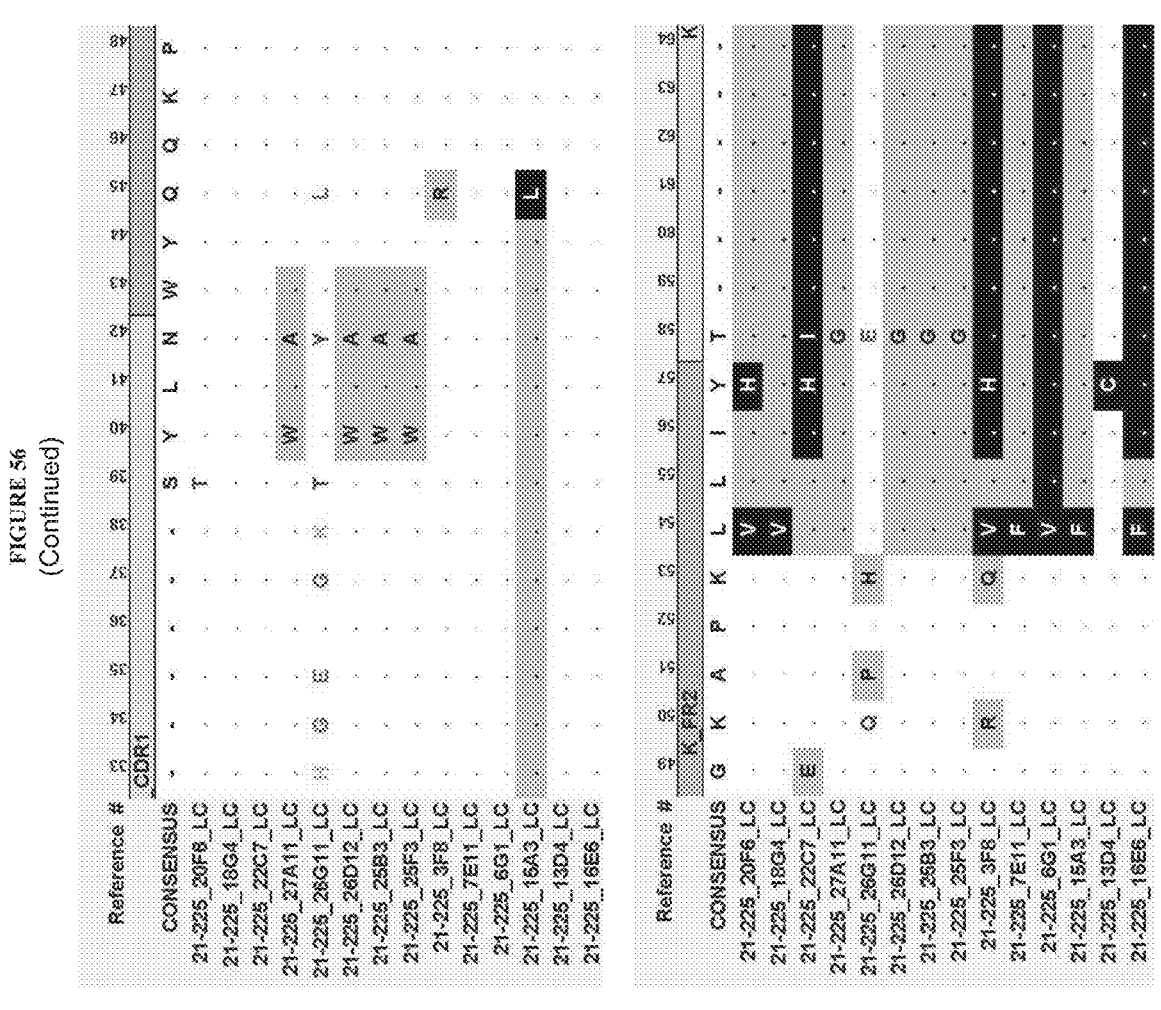
Figure 56:
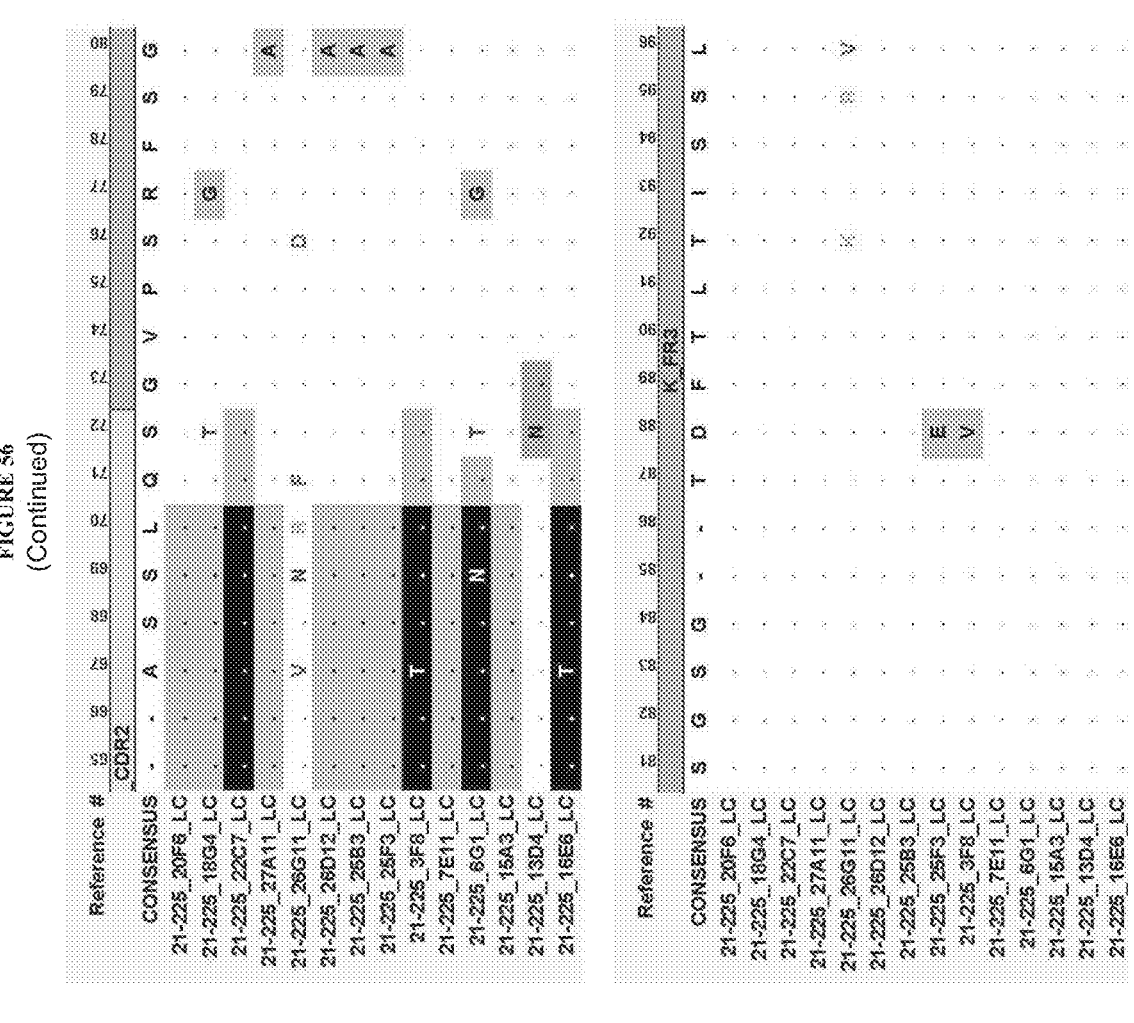
Figure 56:
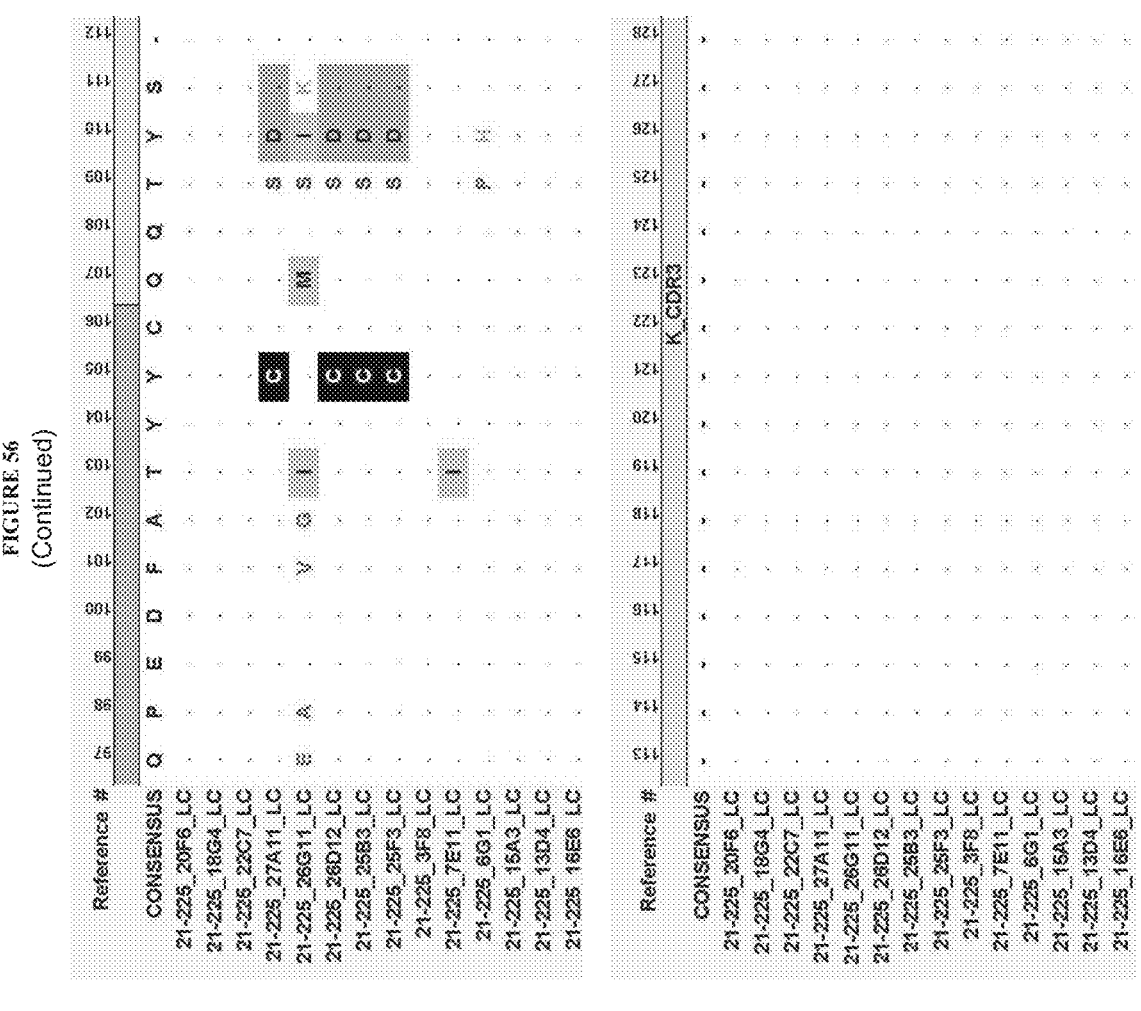
Figure 56:
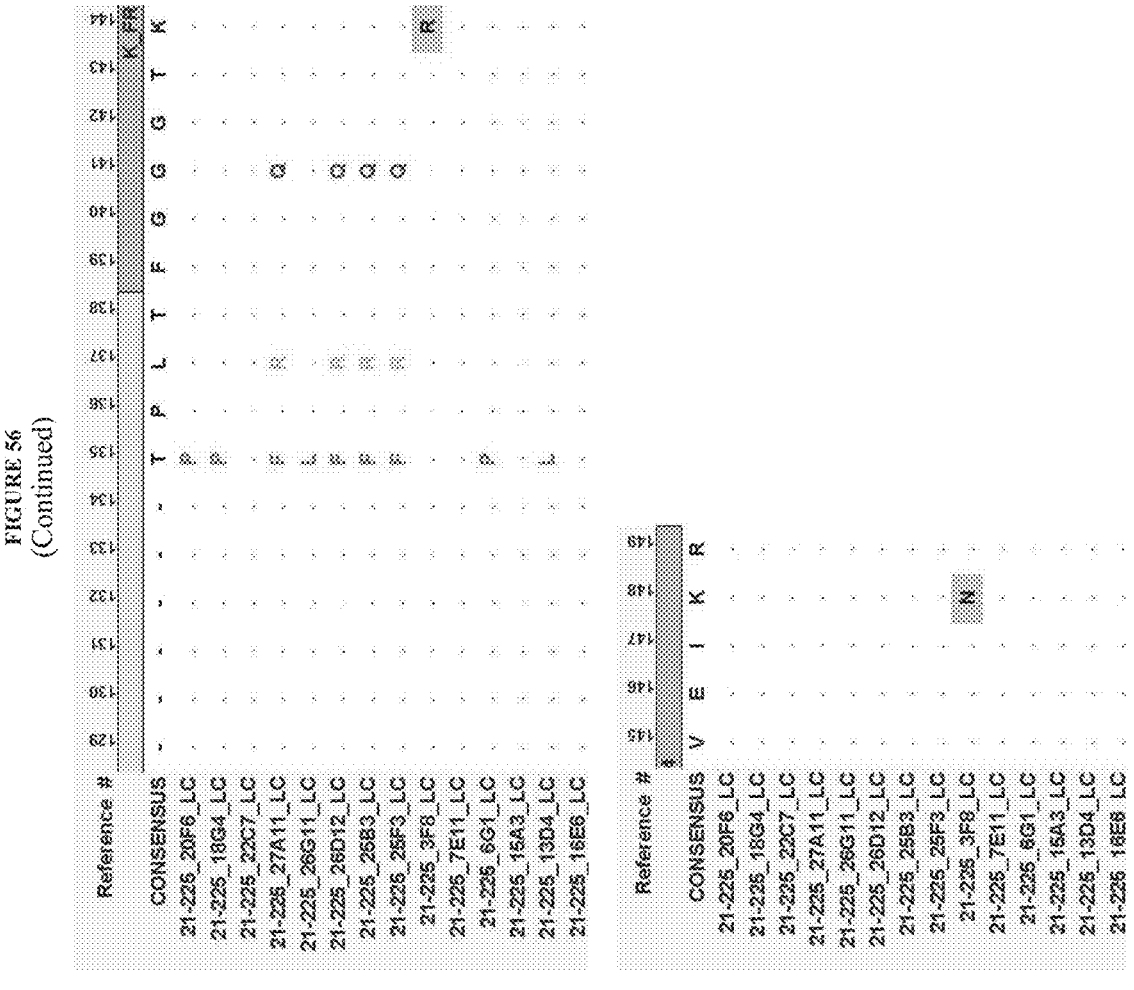
Figure 56:
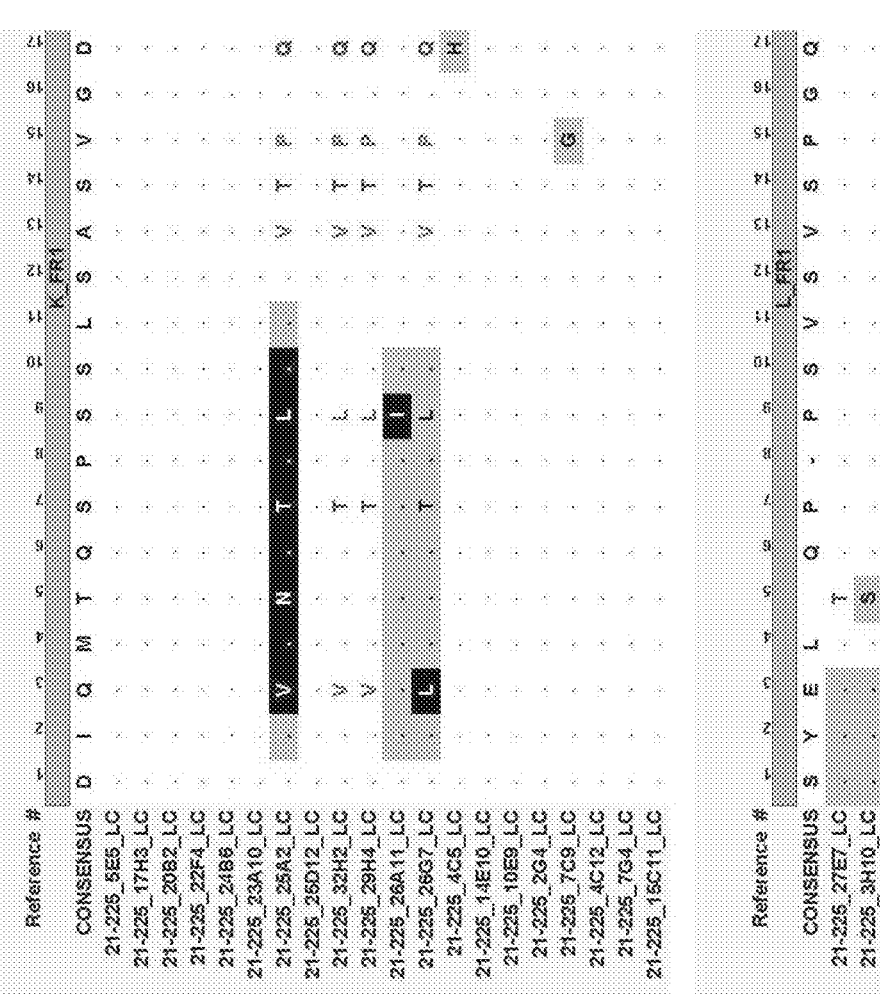
Figure 56:
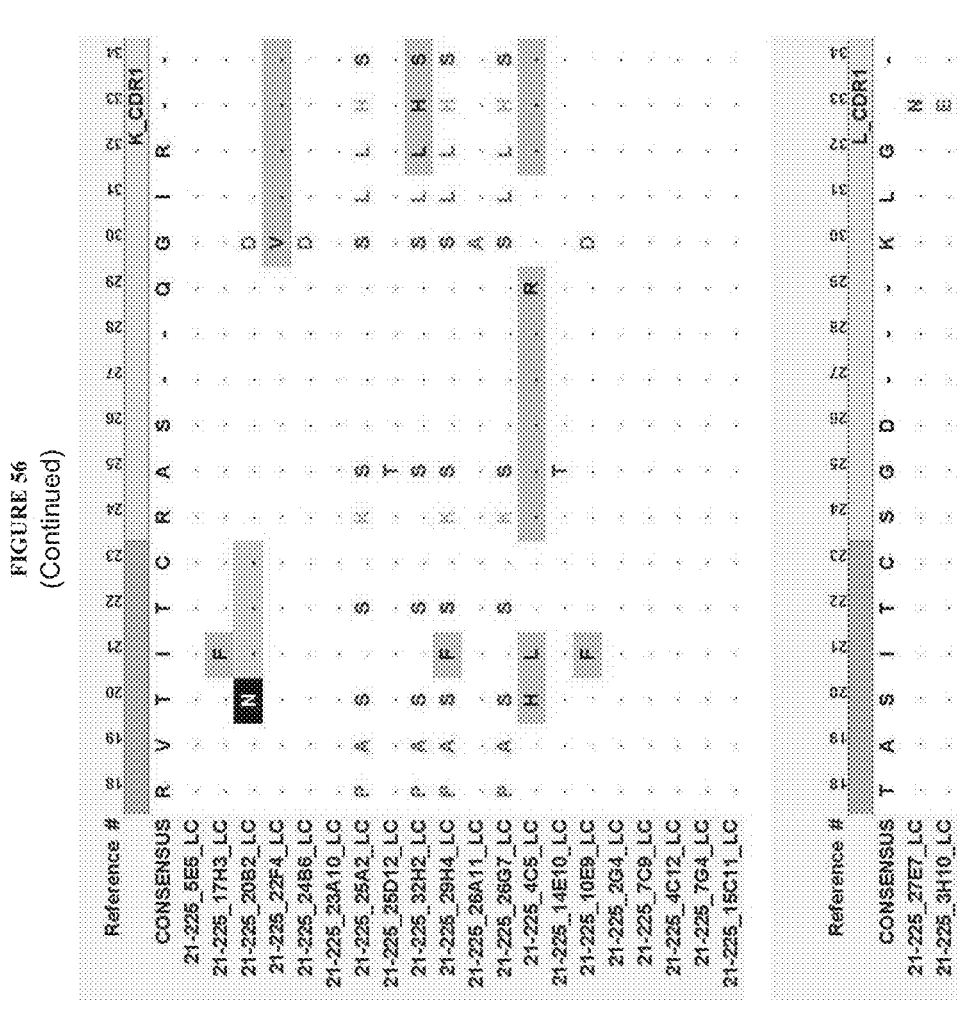
Figure 56:
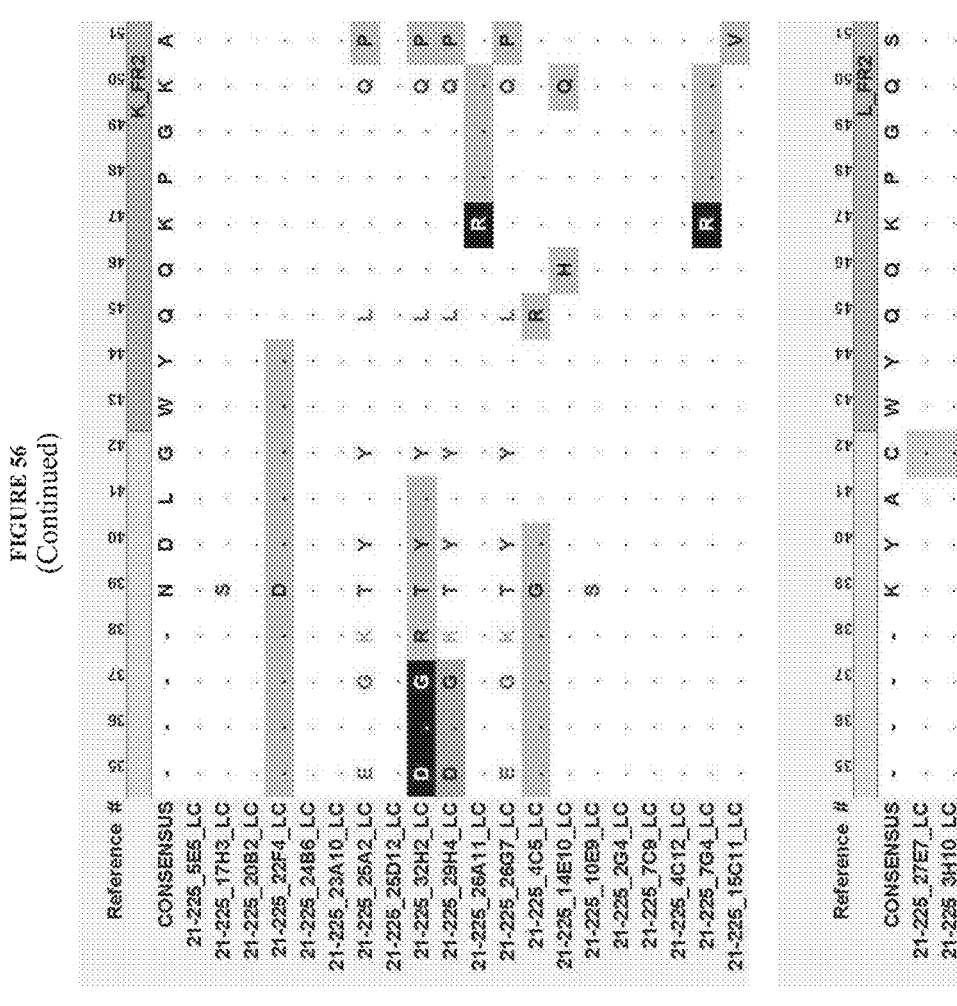
Figure 56:
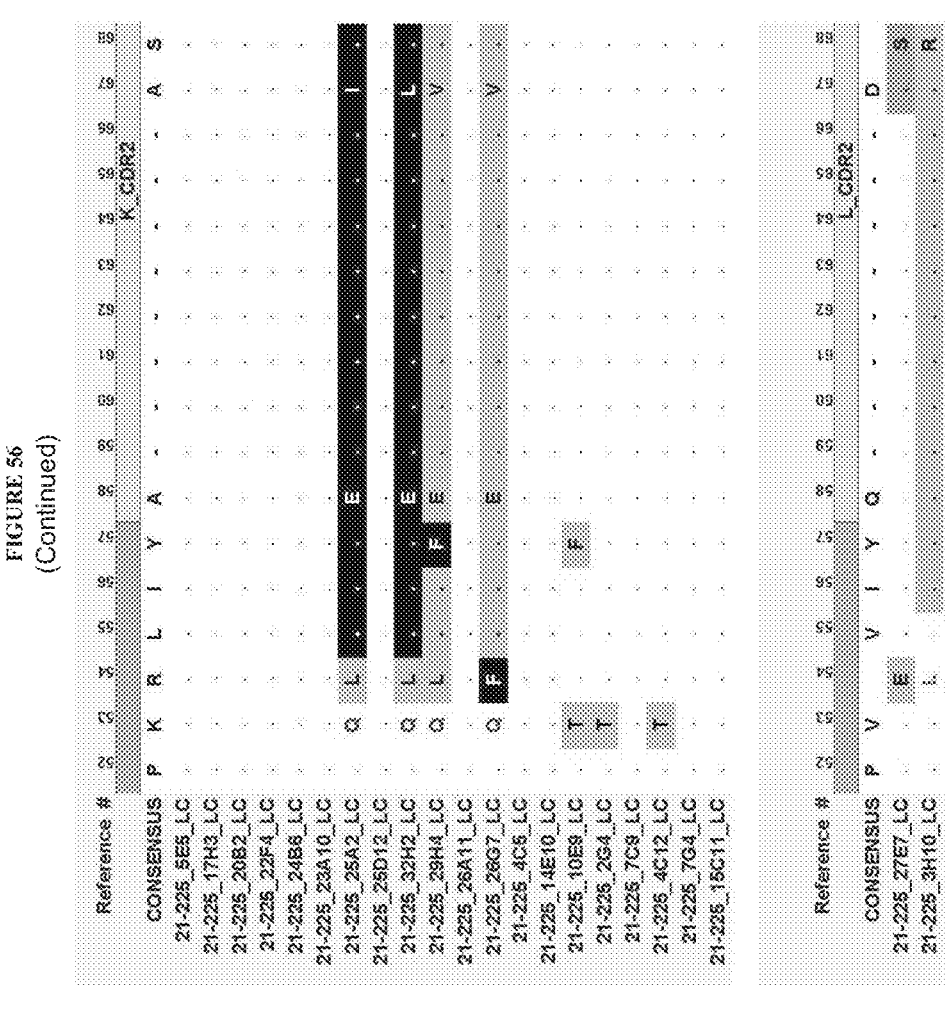
Figure 56:
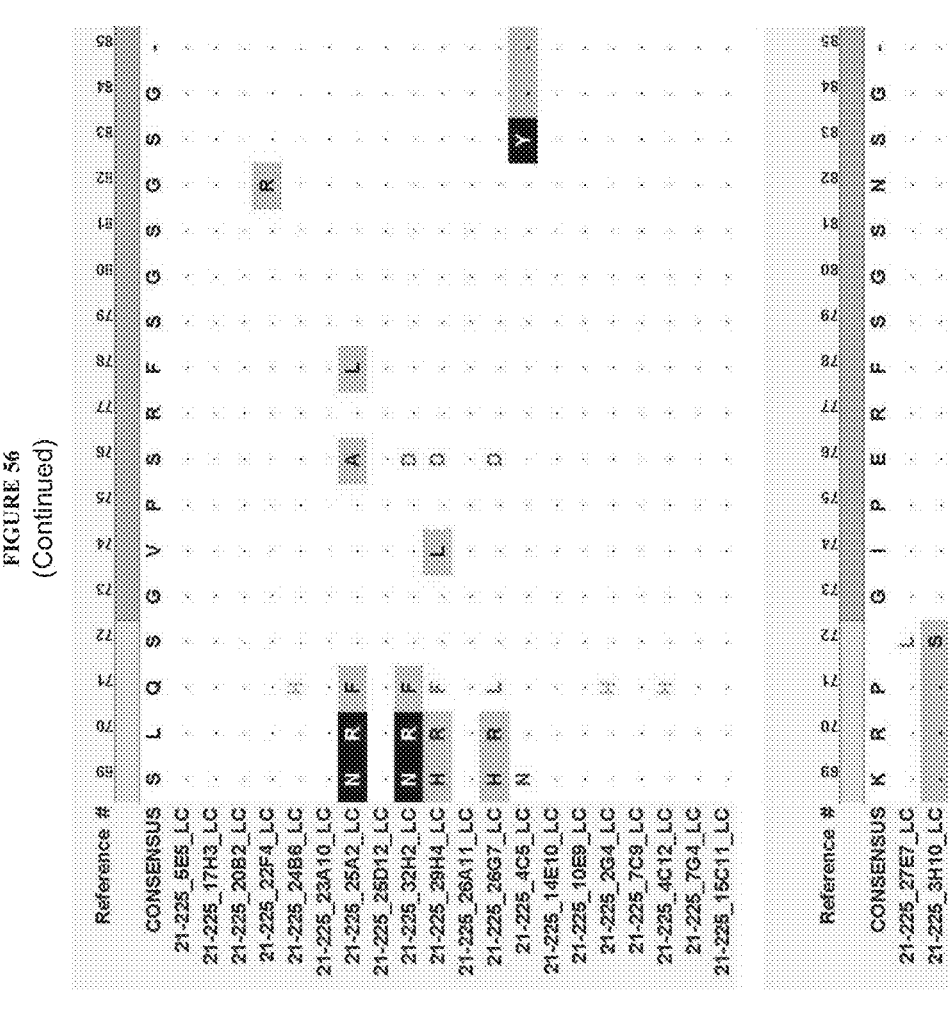
Figure 56:
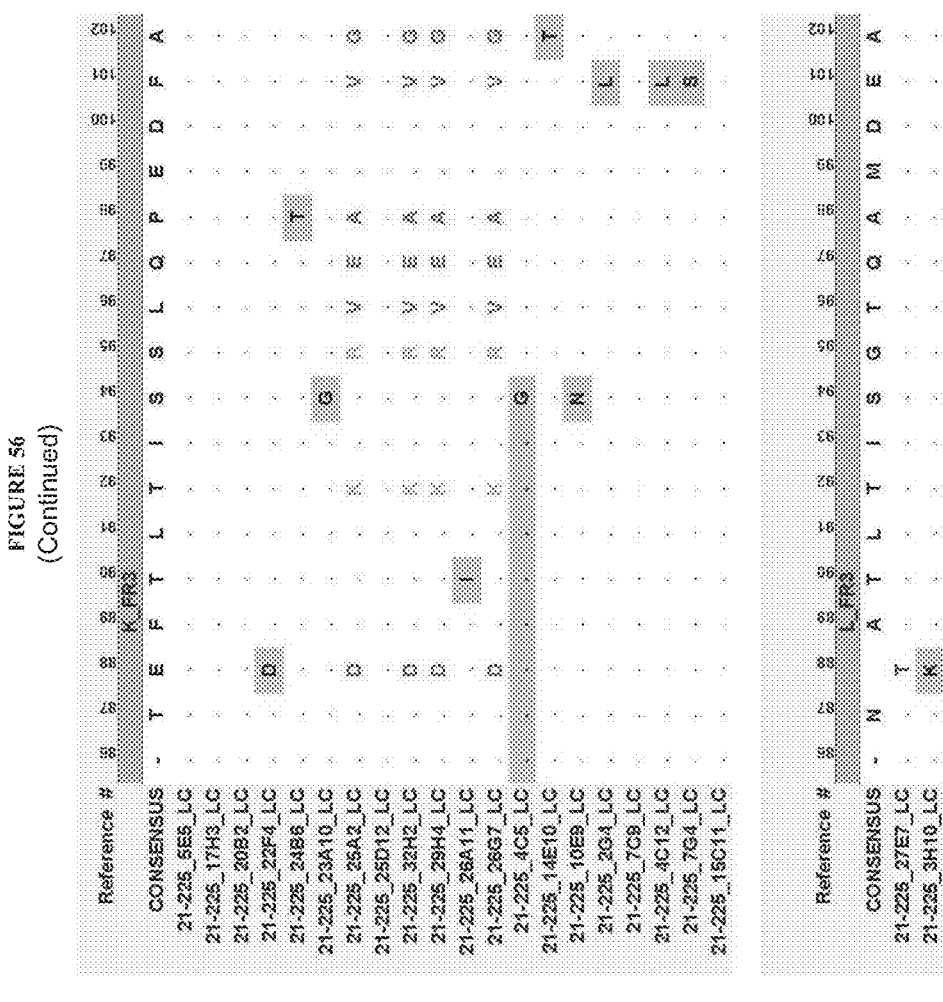
Figure 56:
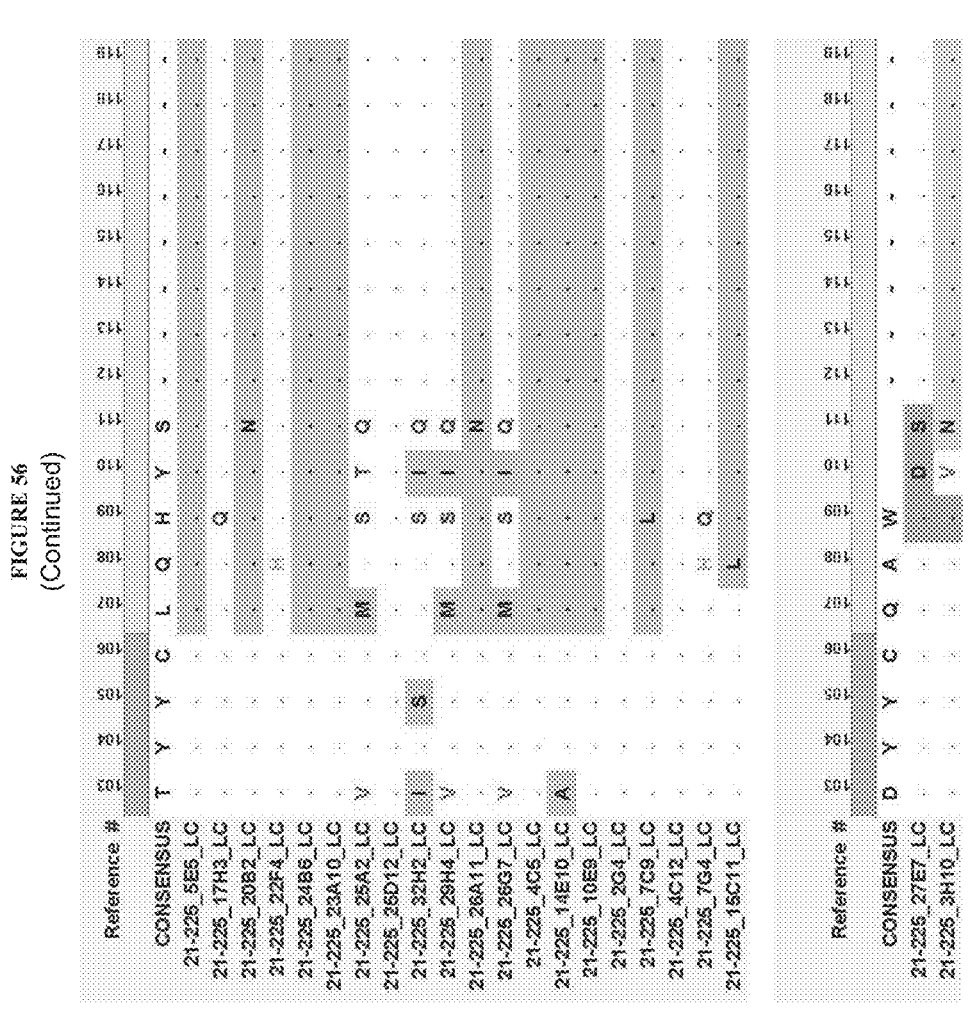
Figure 56:
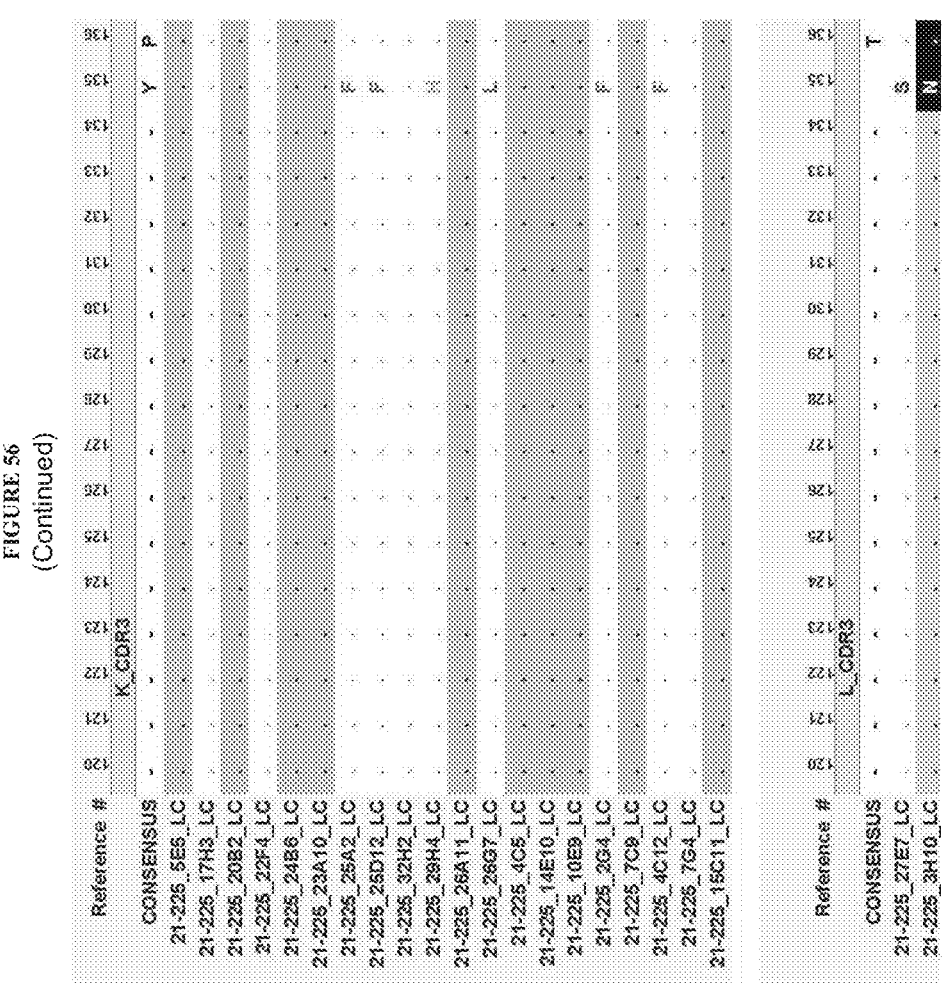
Figure 56:
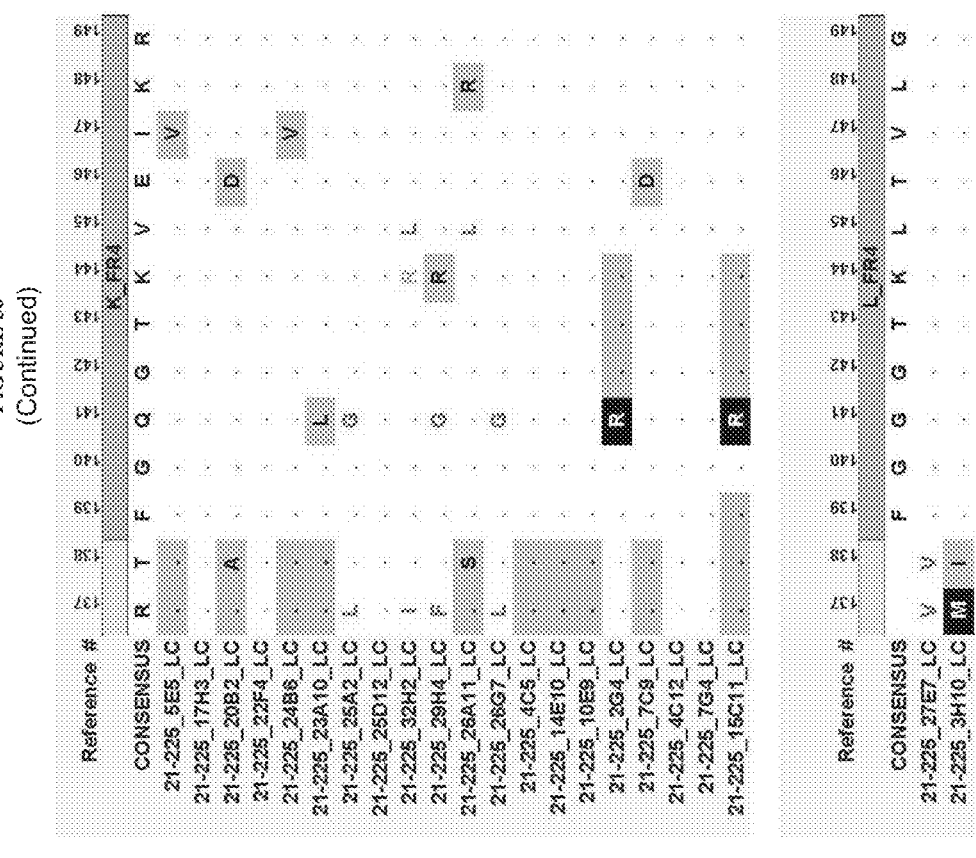
Figure 56:
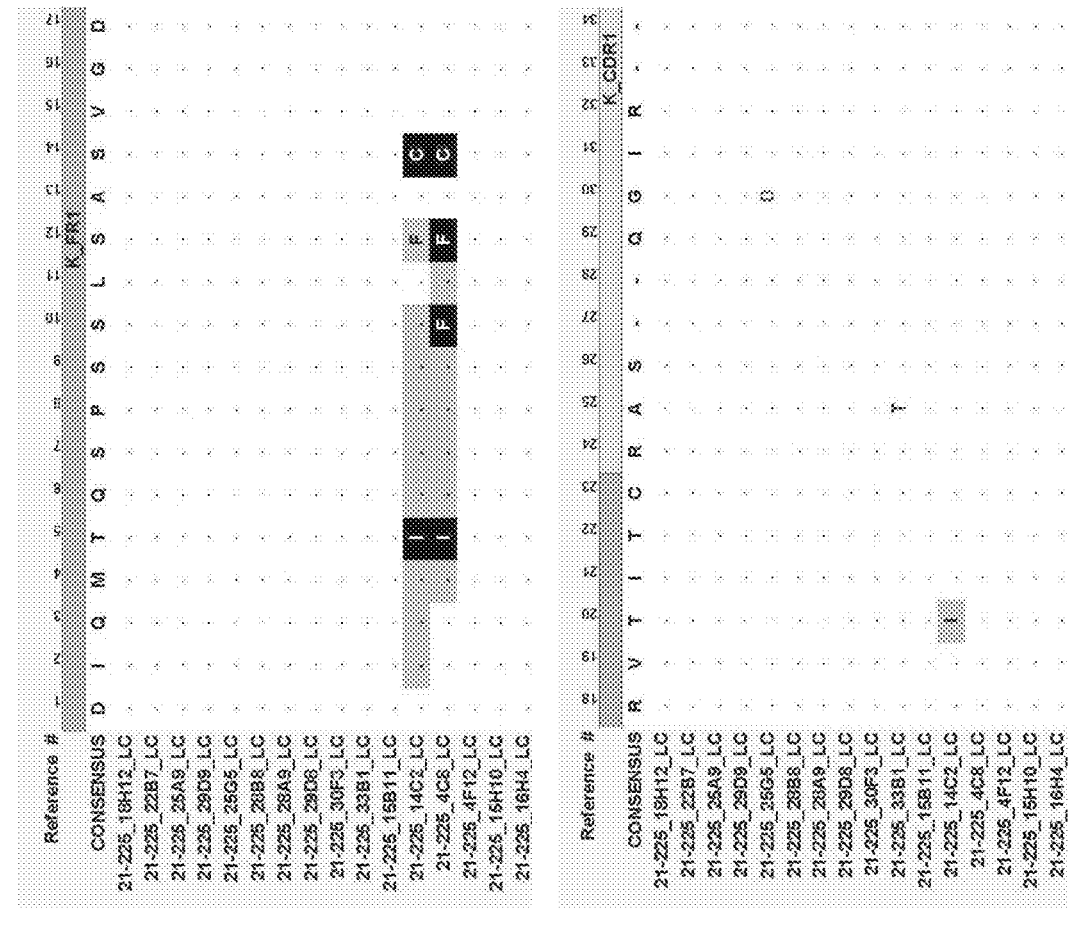
Figure 56:
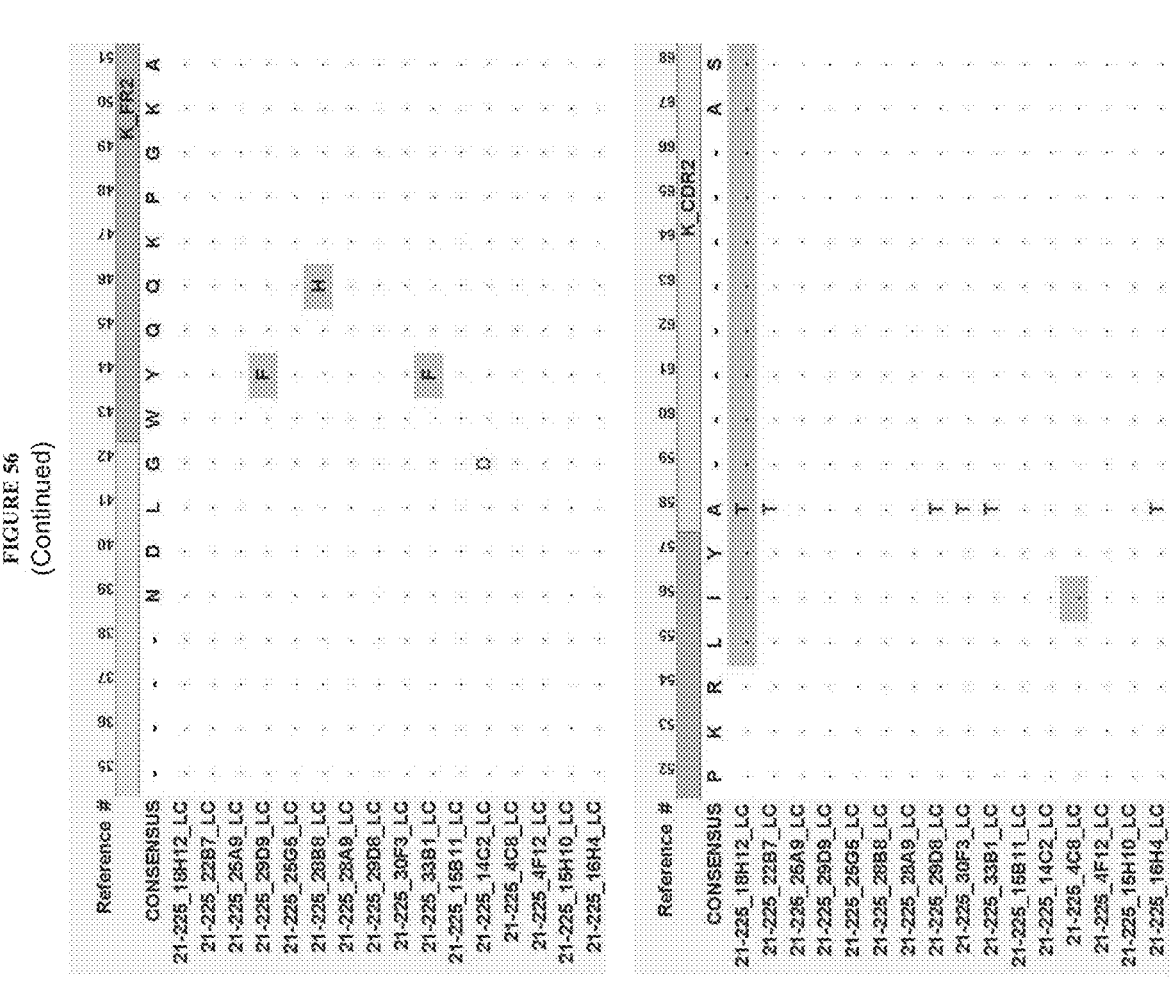
Figure 56:
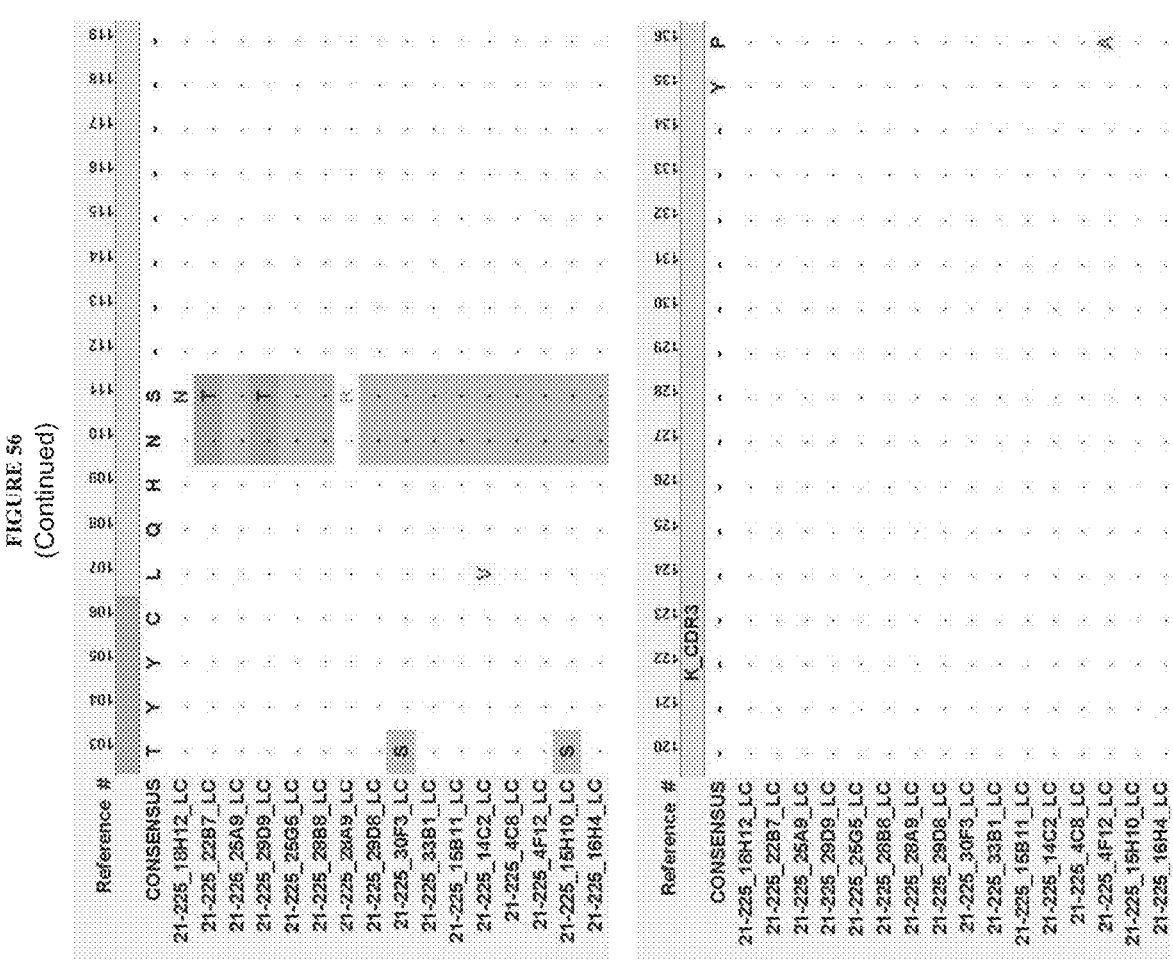
Figure 56:
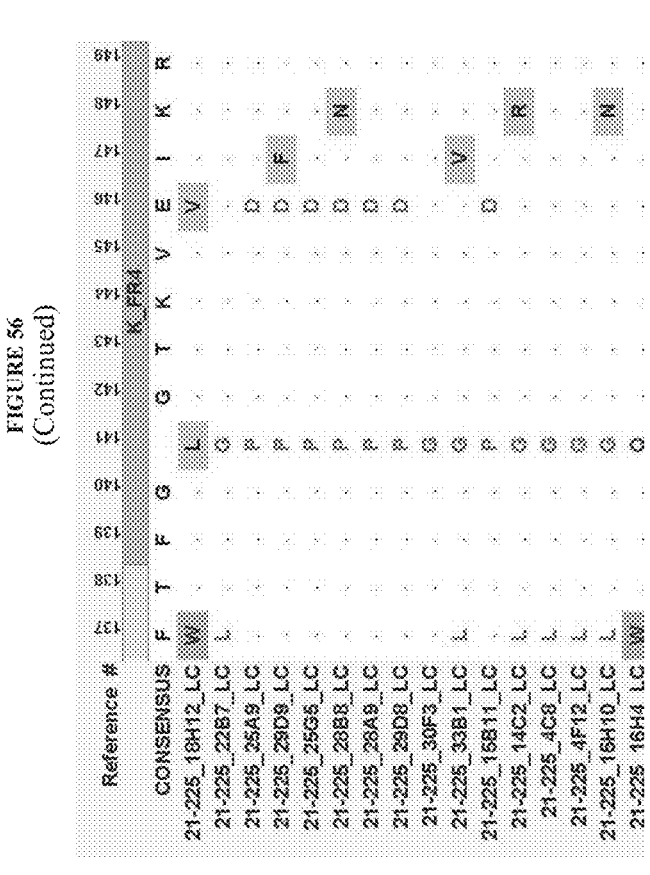
Figure 56:
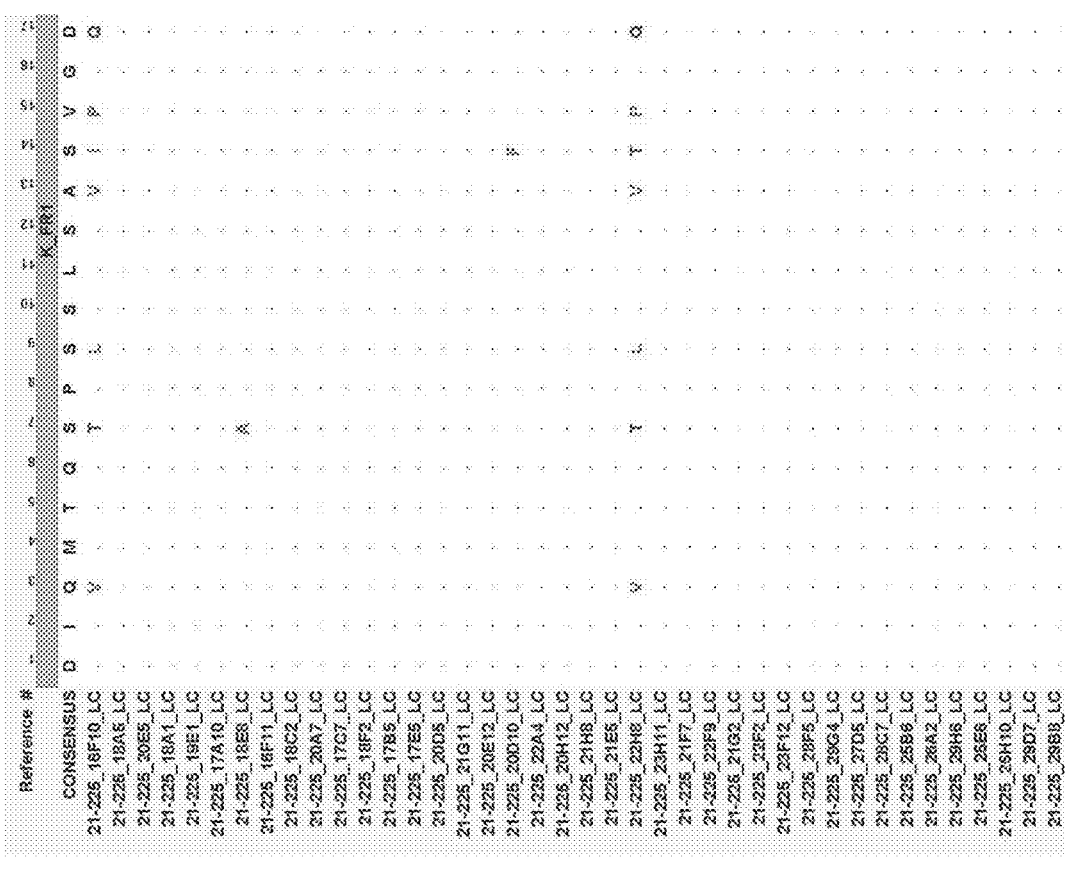
Figure 56:
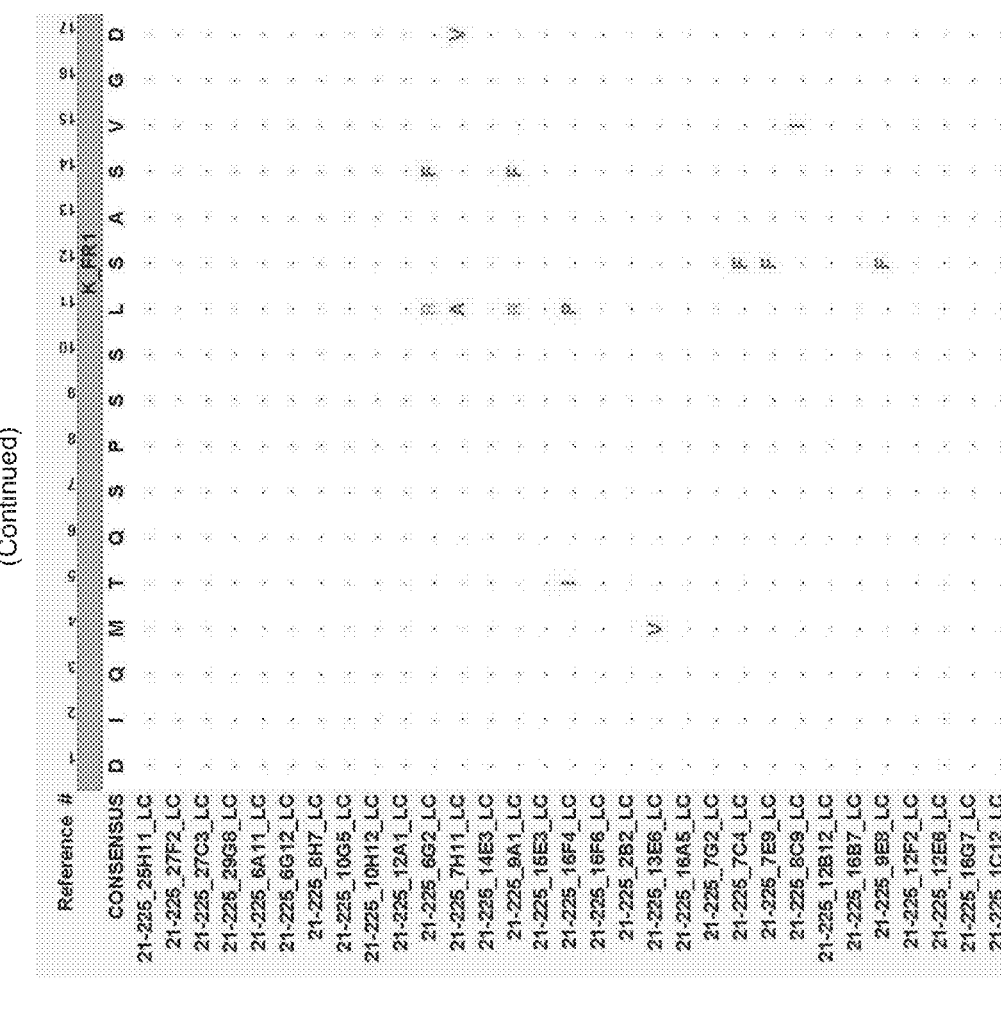
Figure 56:
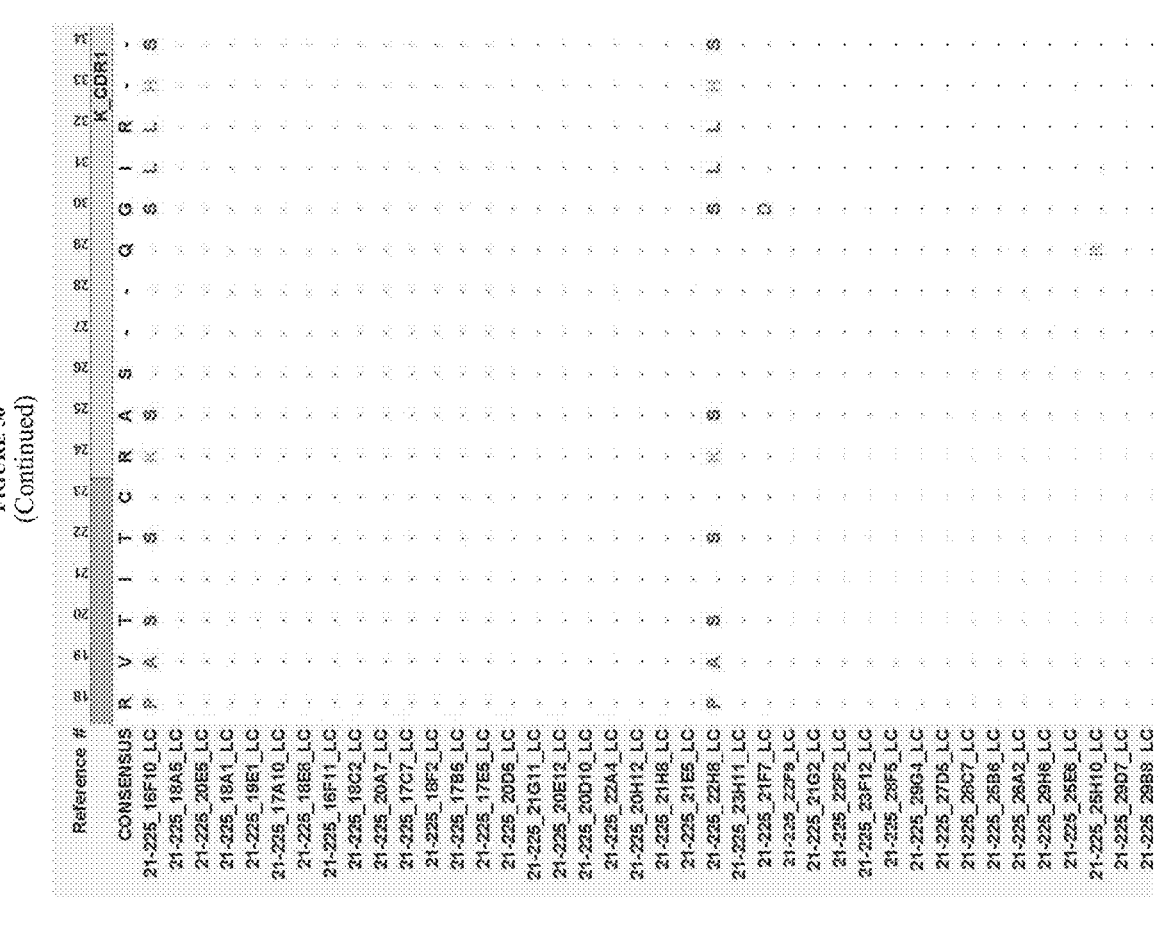
Figure 56:
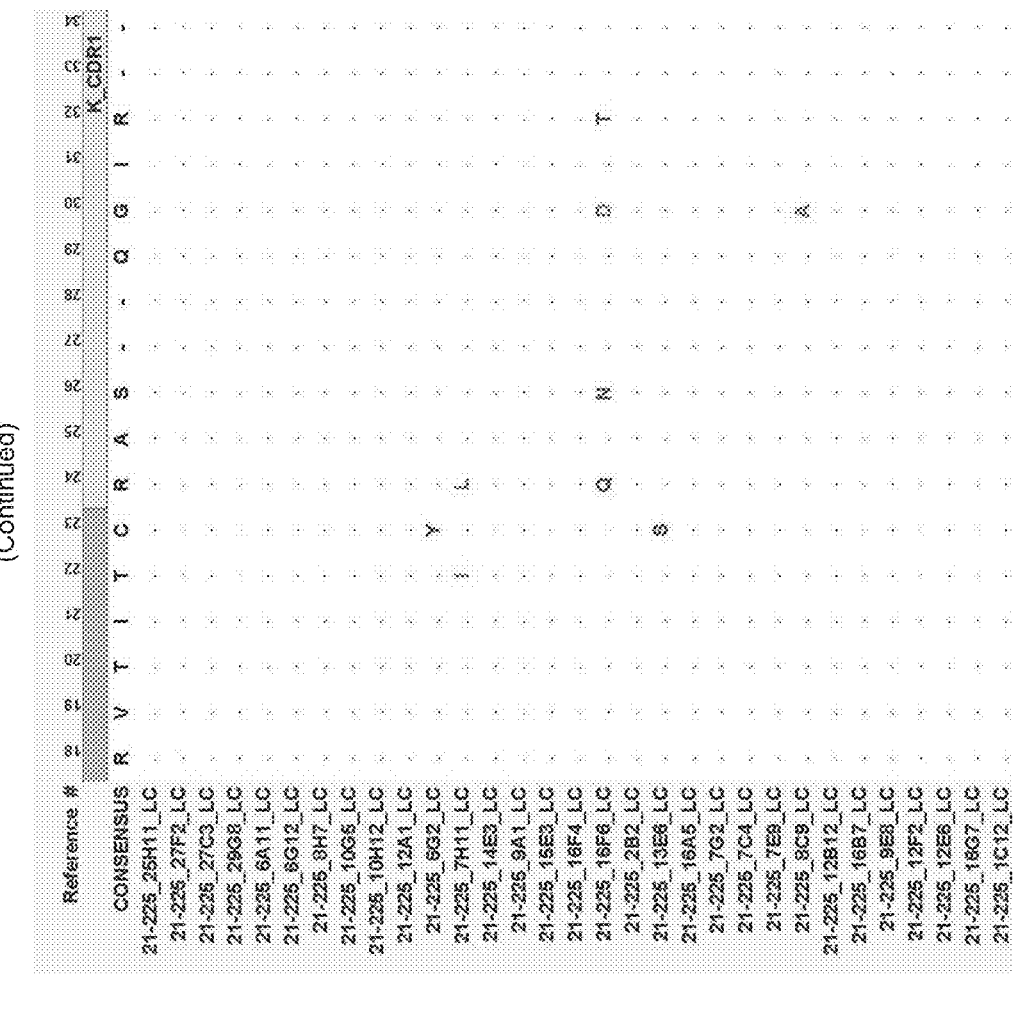
Figure 56:
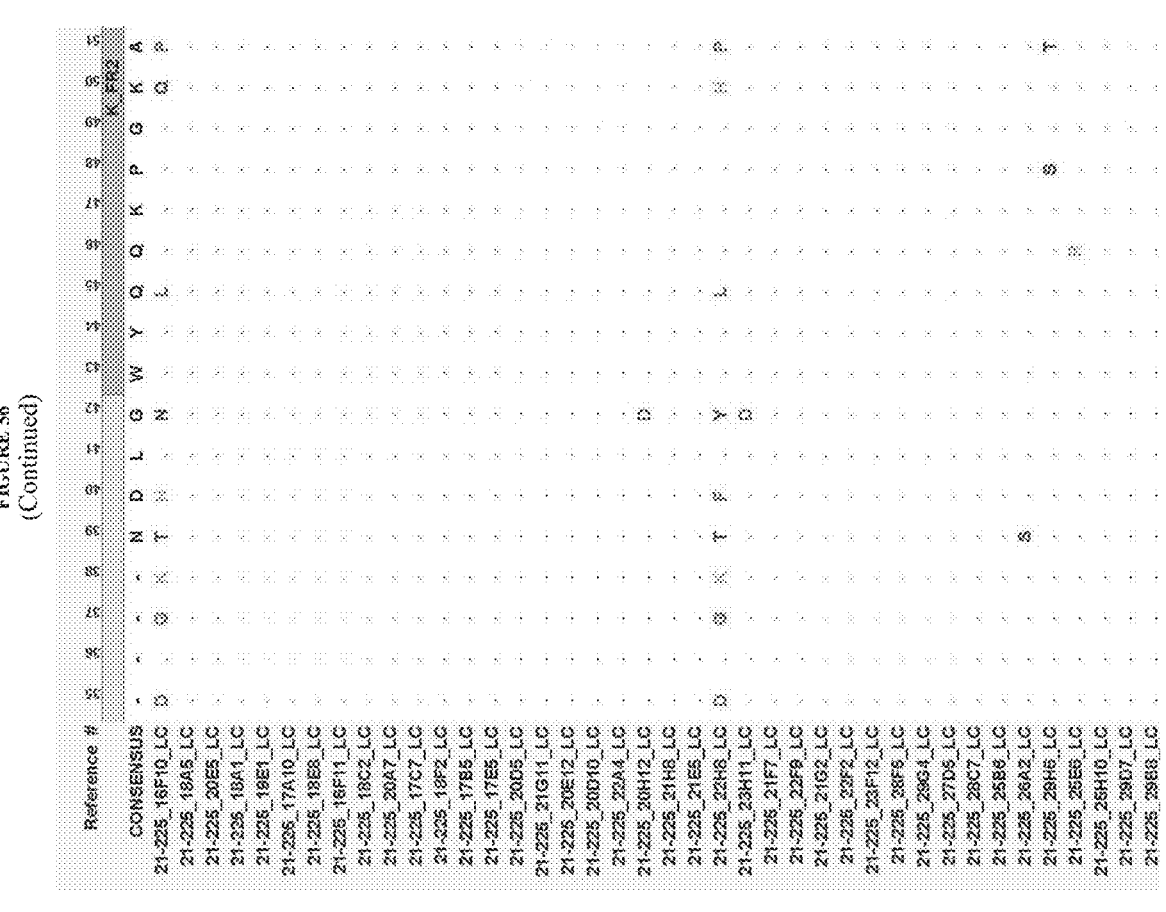
Figure 56:
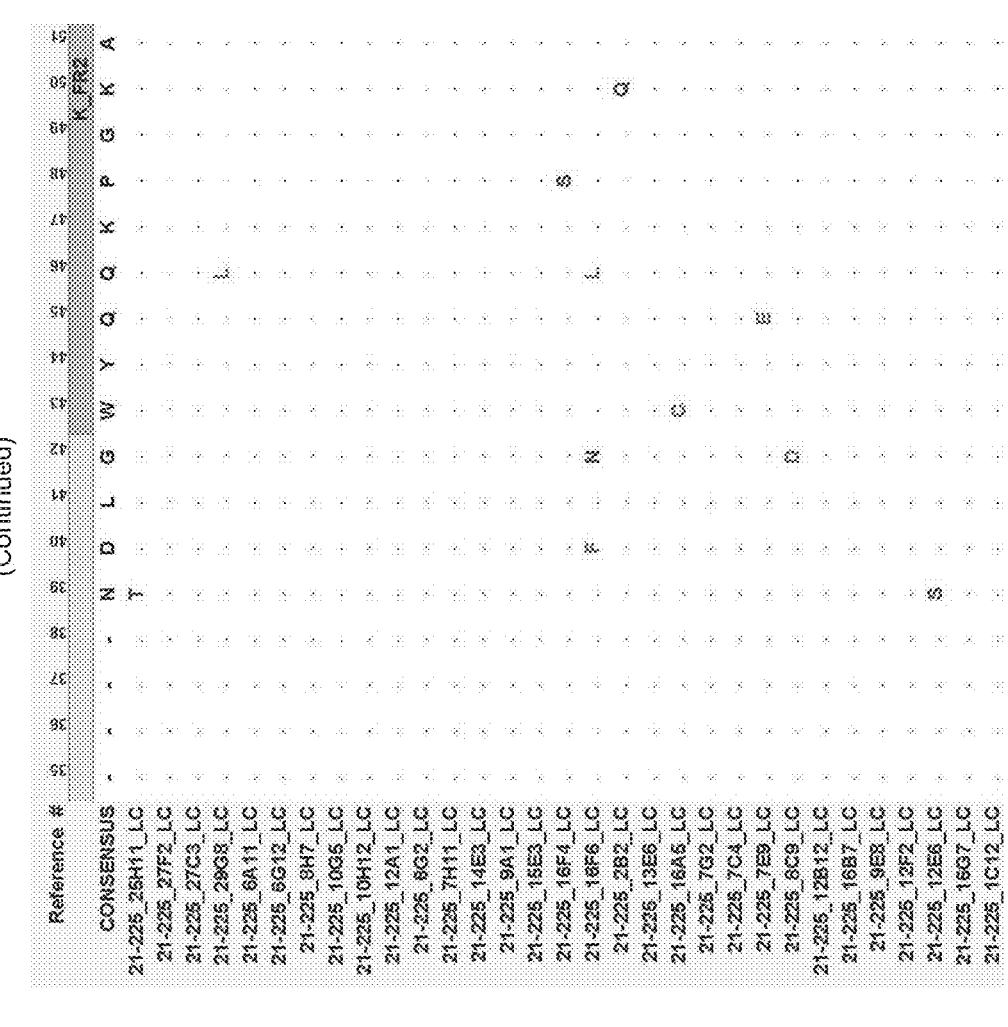
Figure 56:
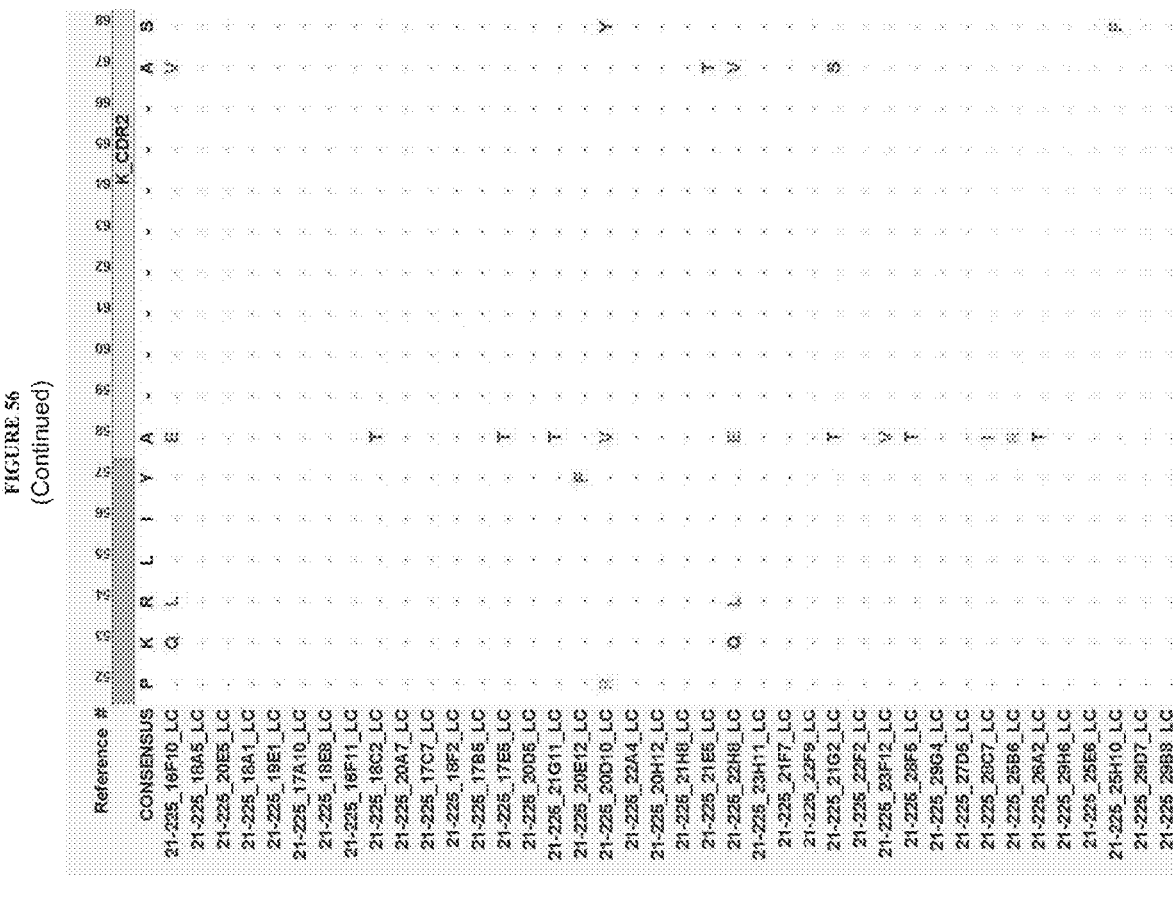
Figure 56:
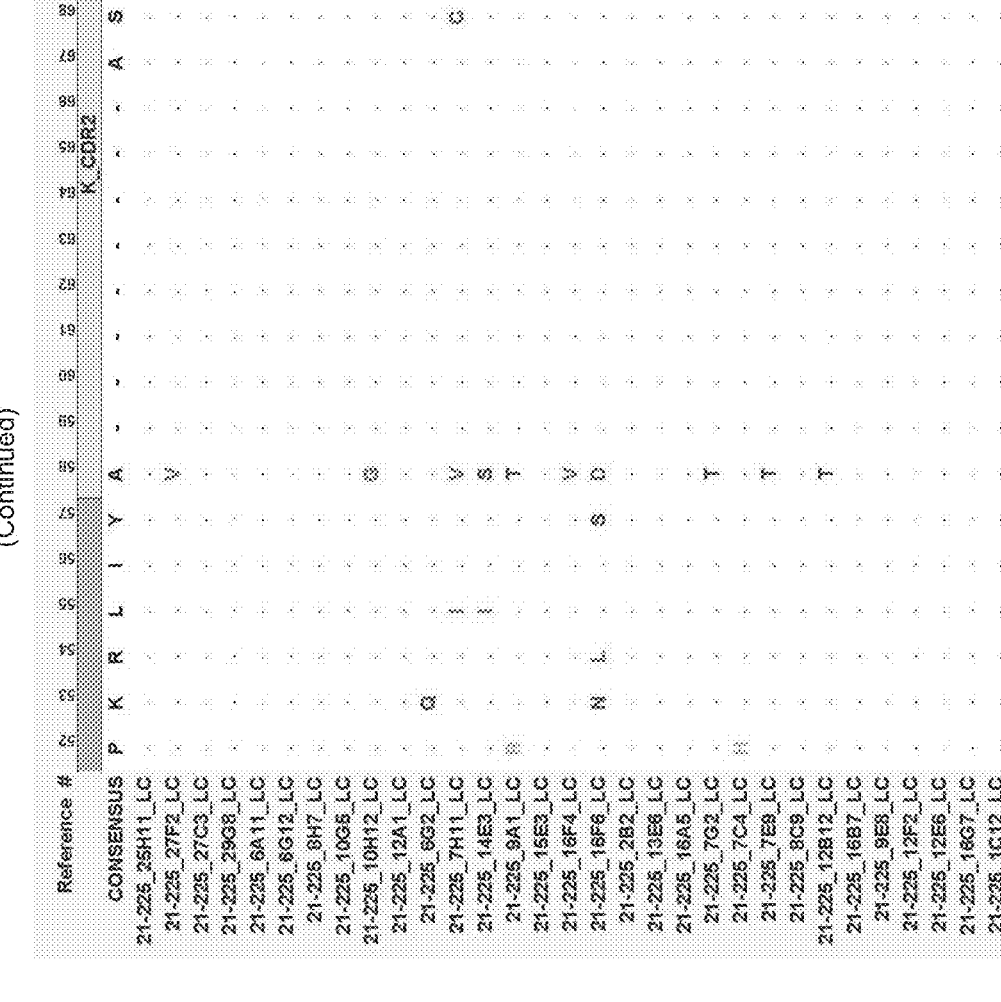
Figure 56:
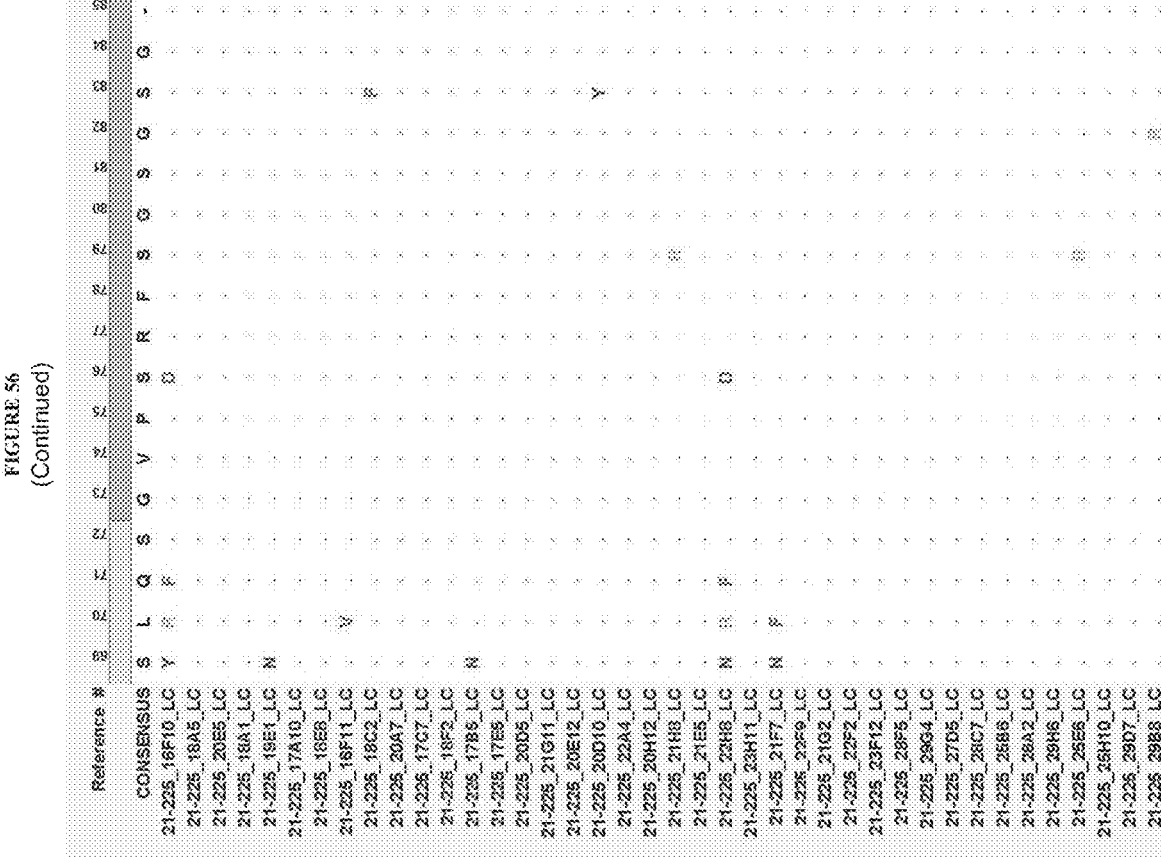
Figure 56:
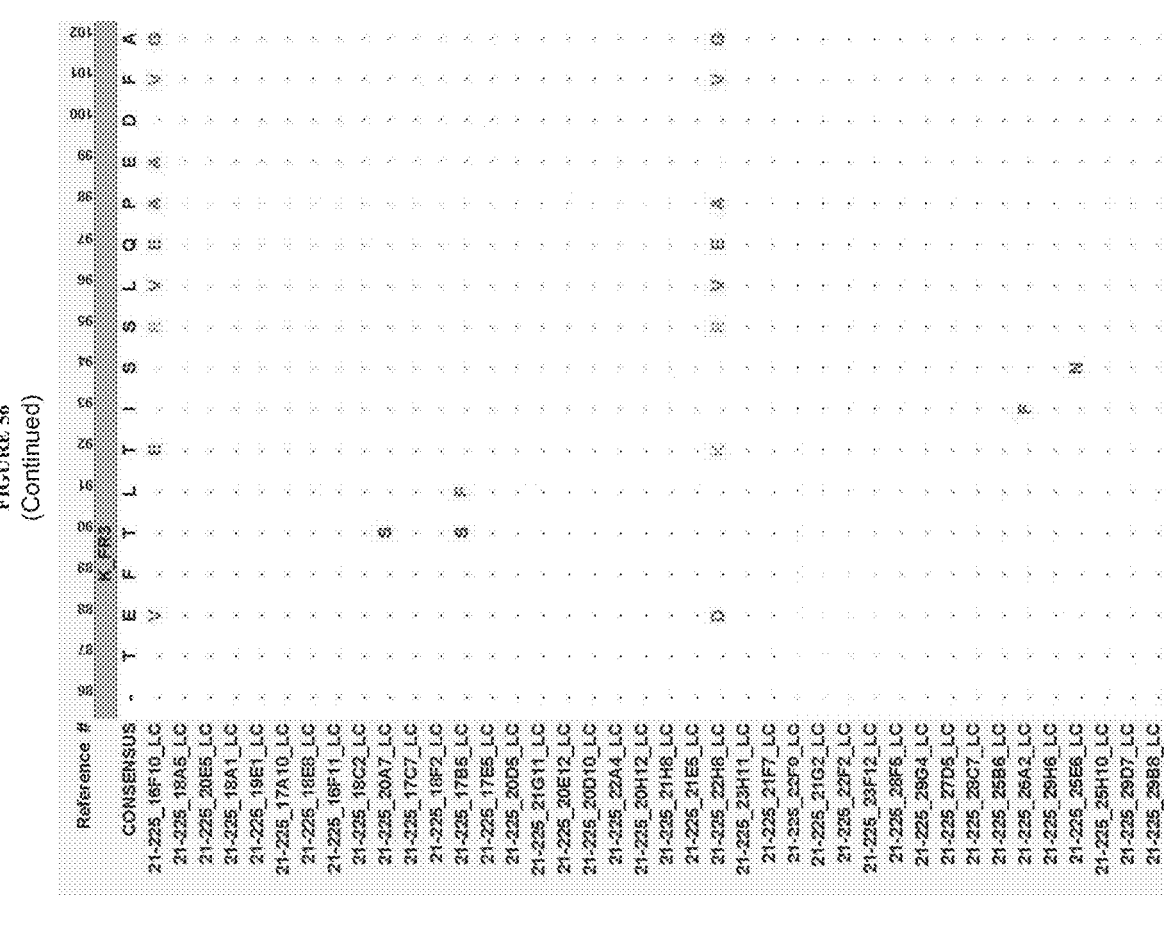
Figure 56:
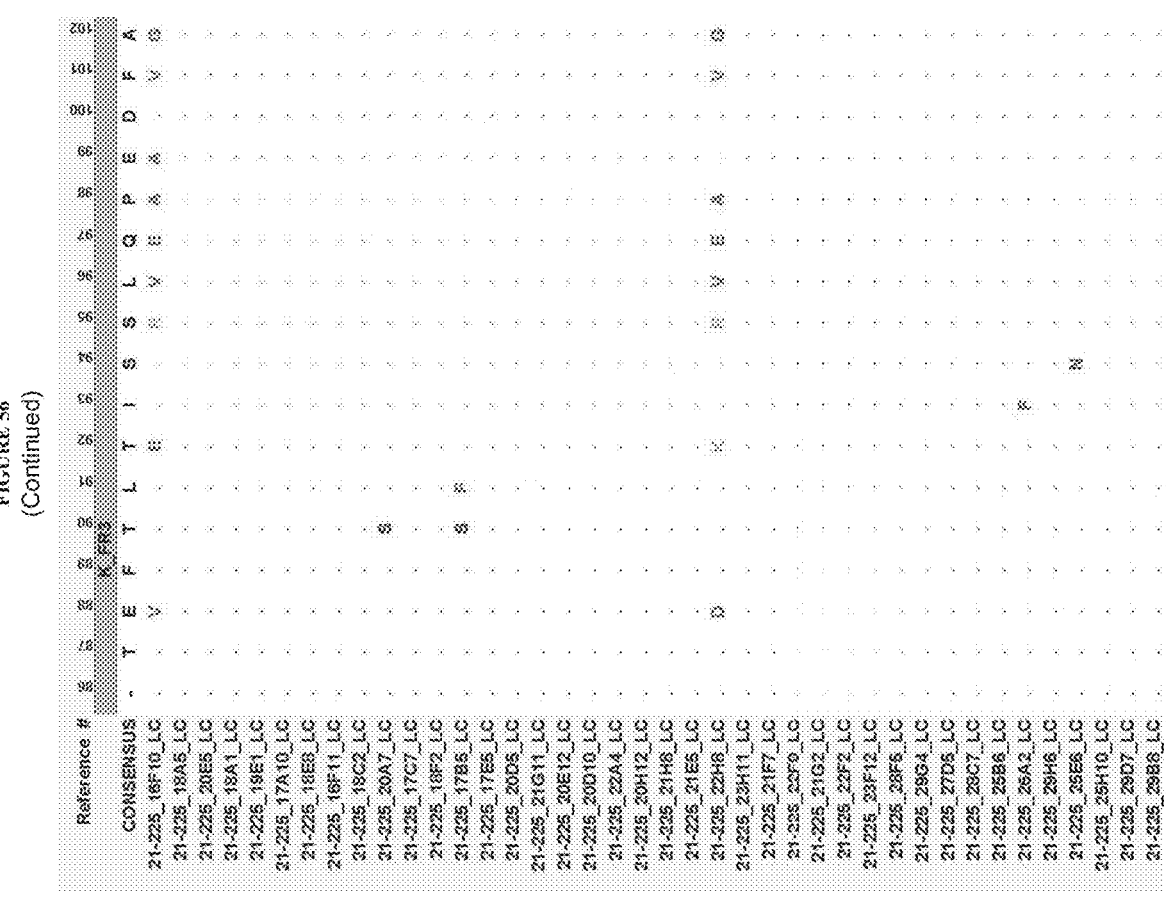
Figure 56:
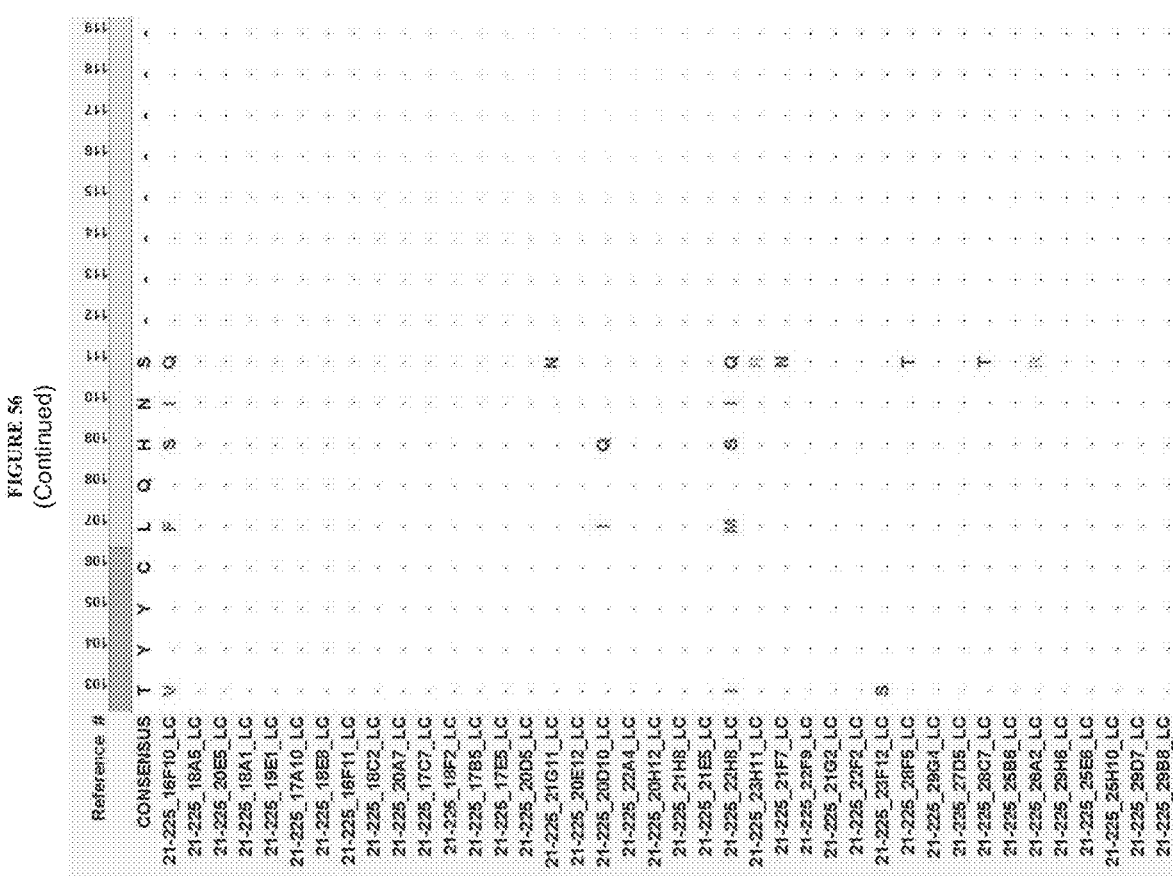
Figure 56:
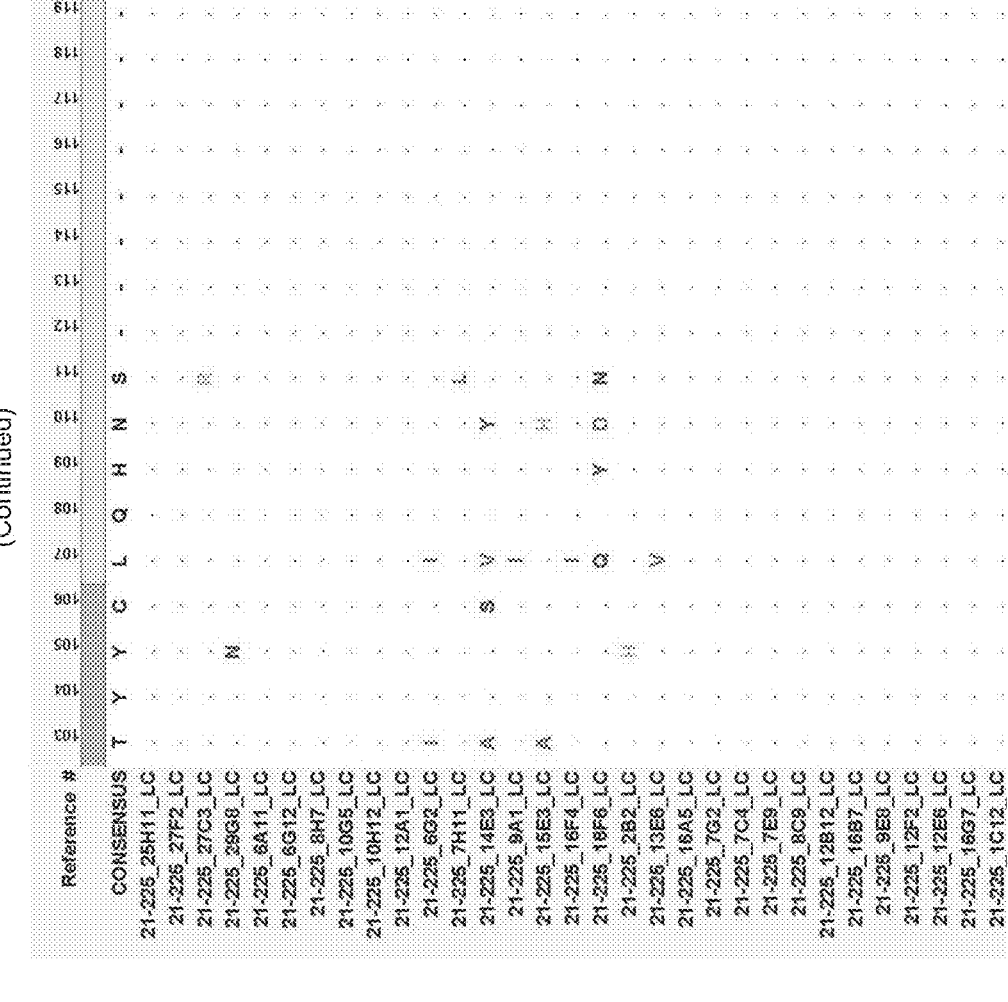
Figure 56:
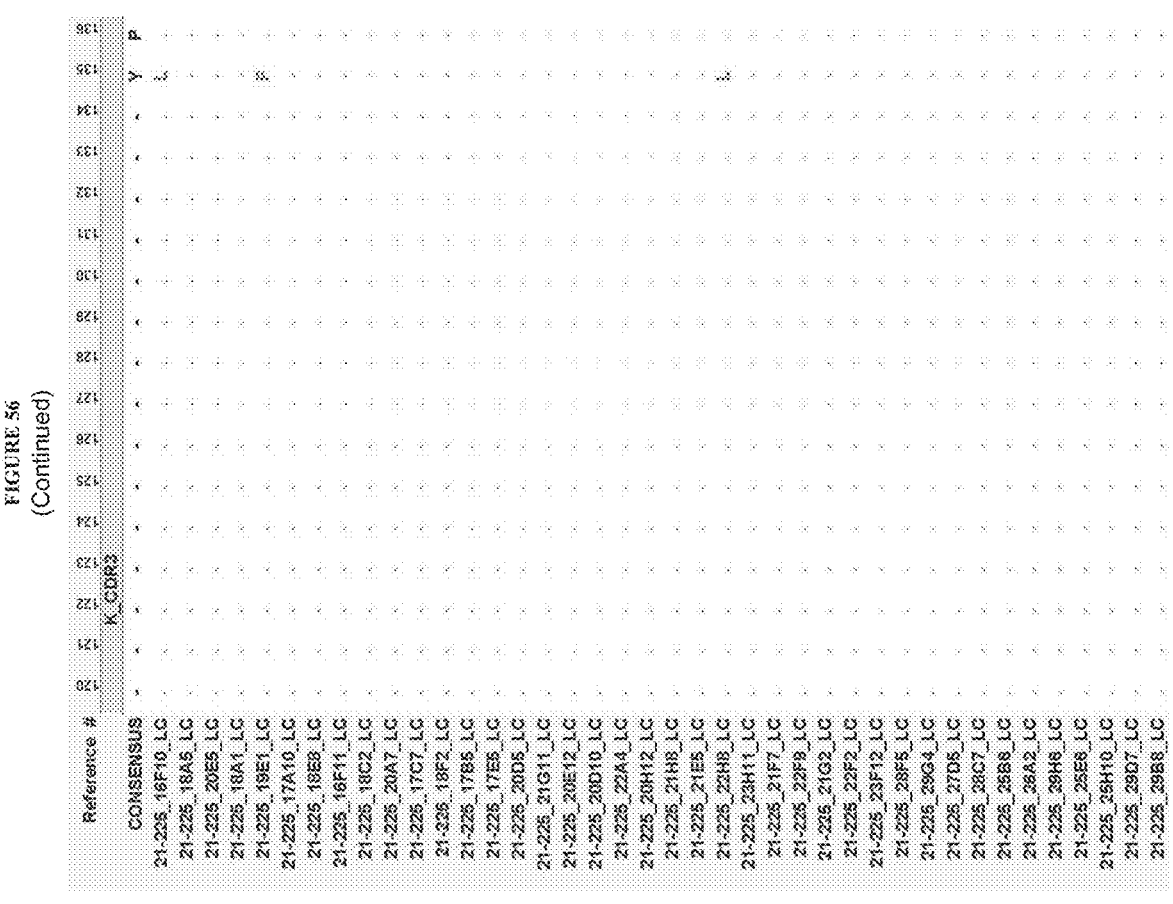
Figure 56:
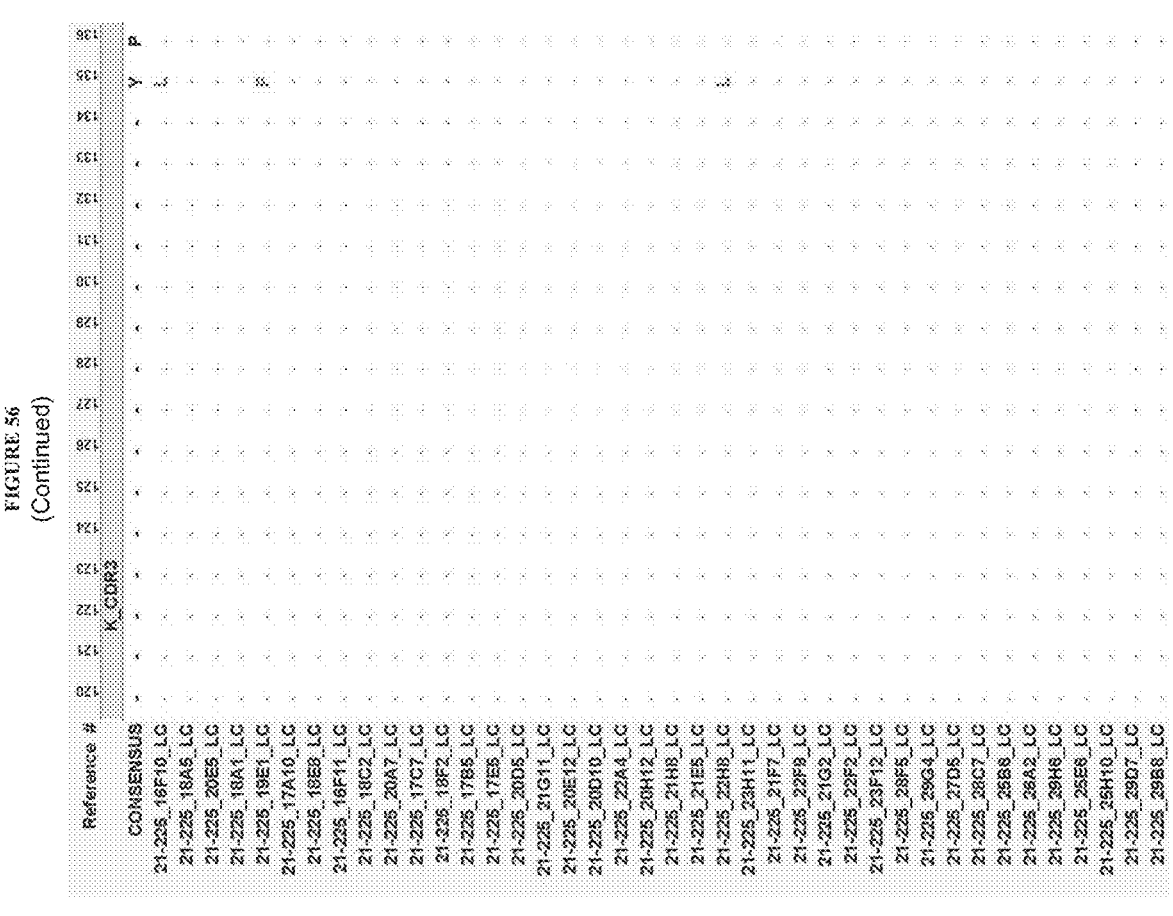
Figure 56:
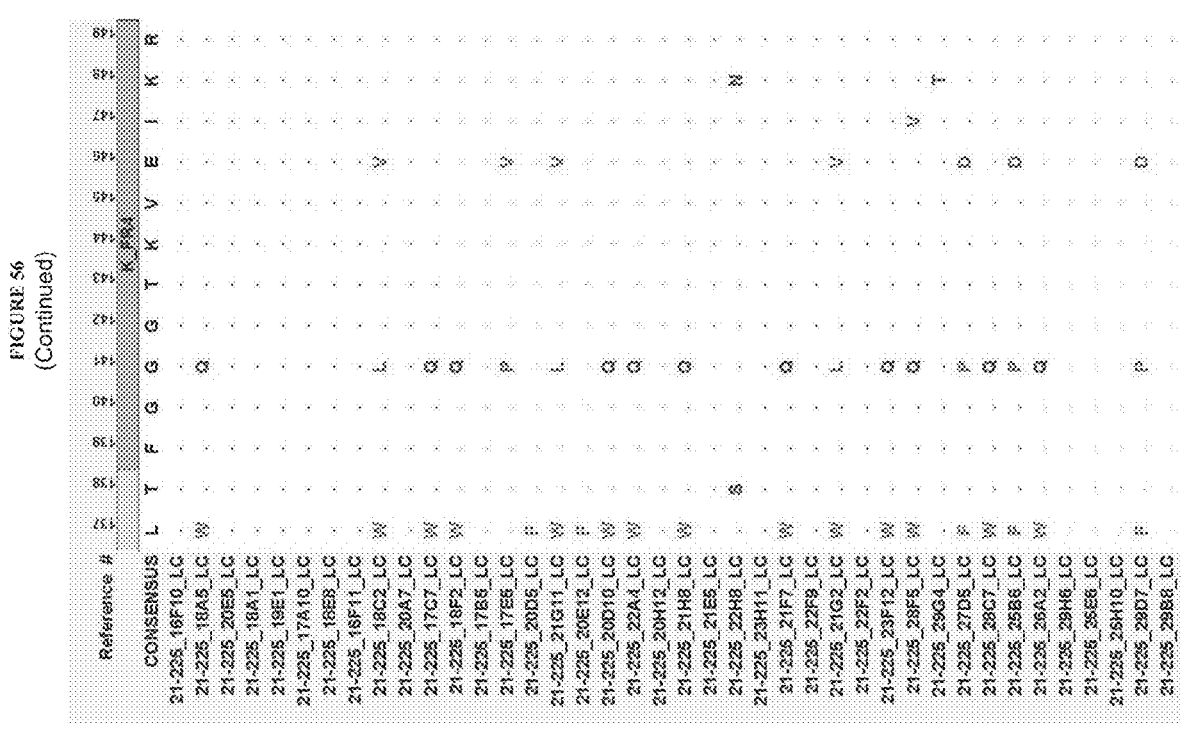
Figure 56:
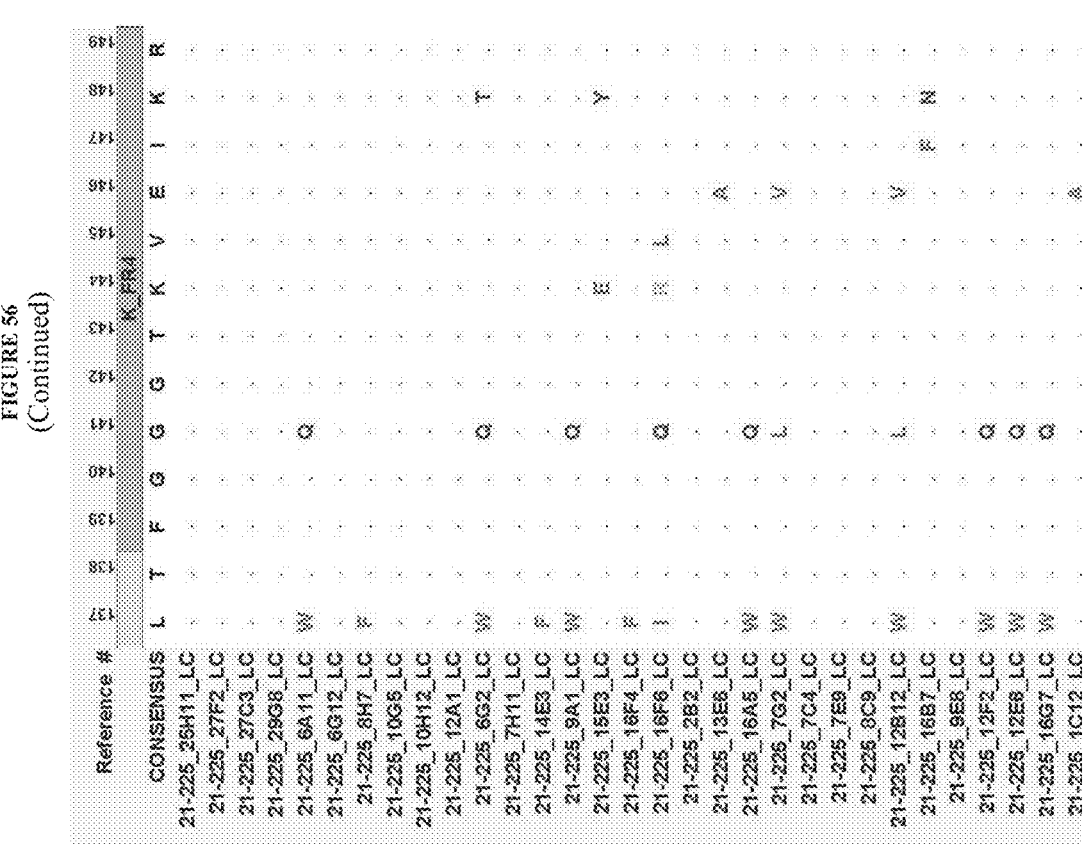
Figure 56:
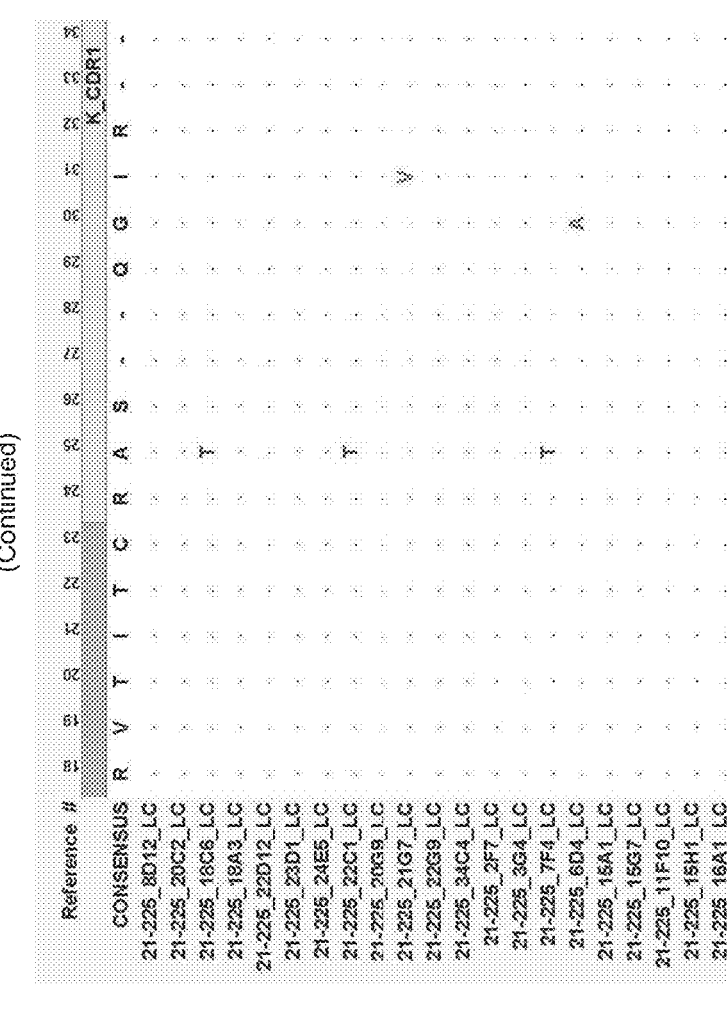
Figure 56:
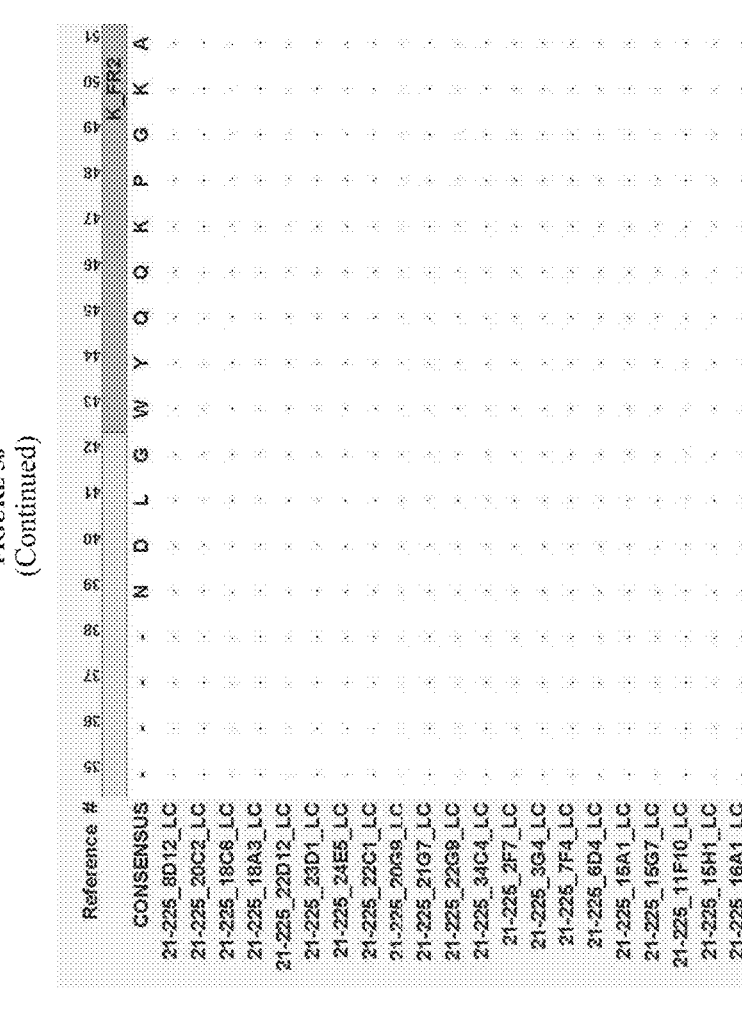
Figure 56:
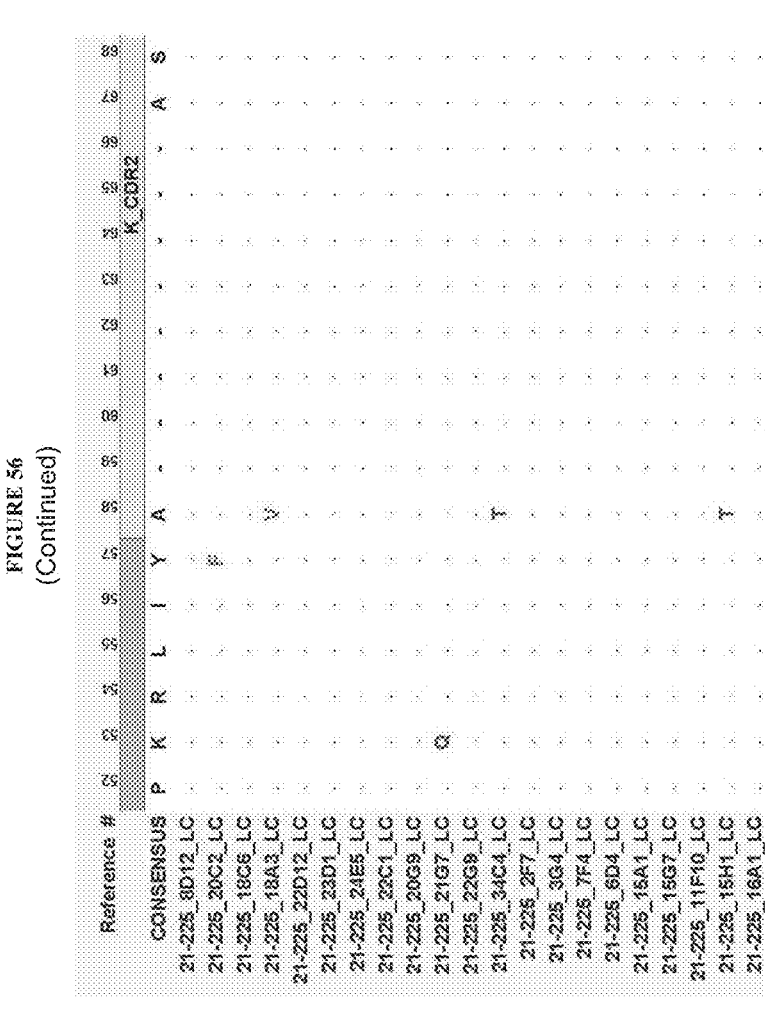
Figure 56:
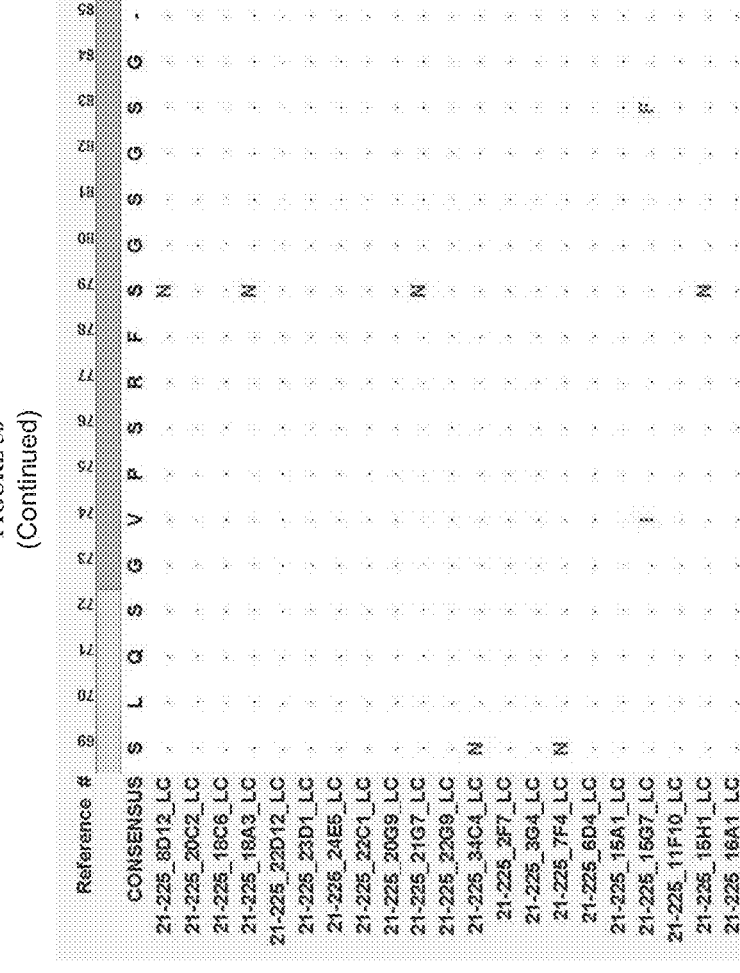
Figure 56:
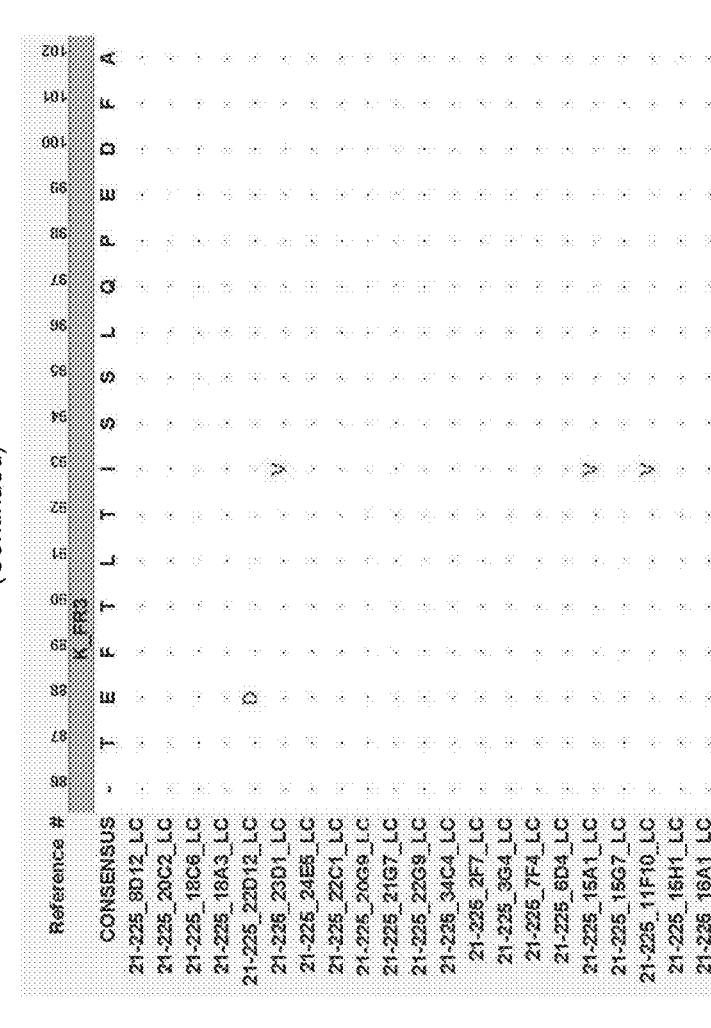
Figure 56:
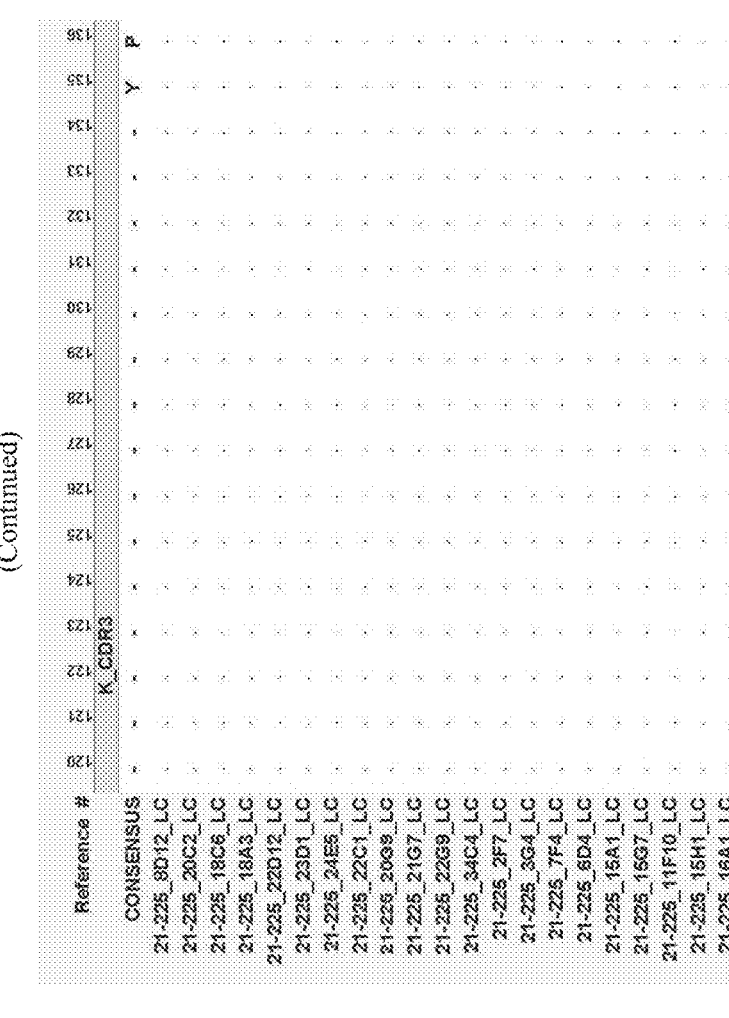
Figure 56:
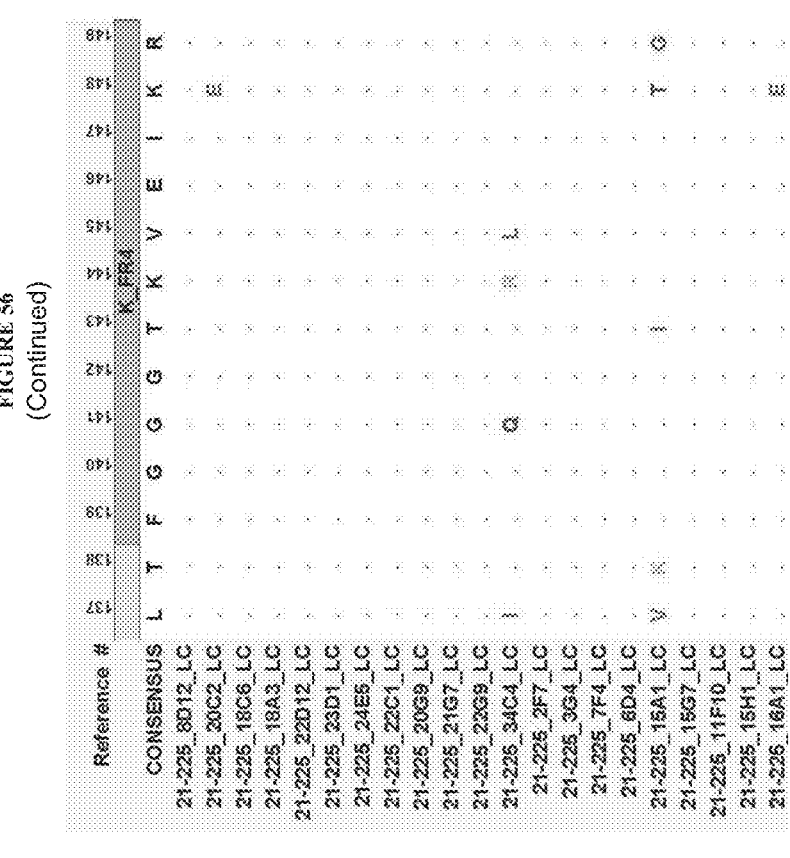
Figure 56:
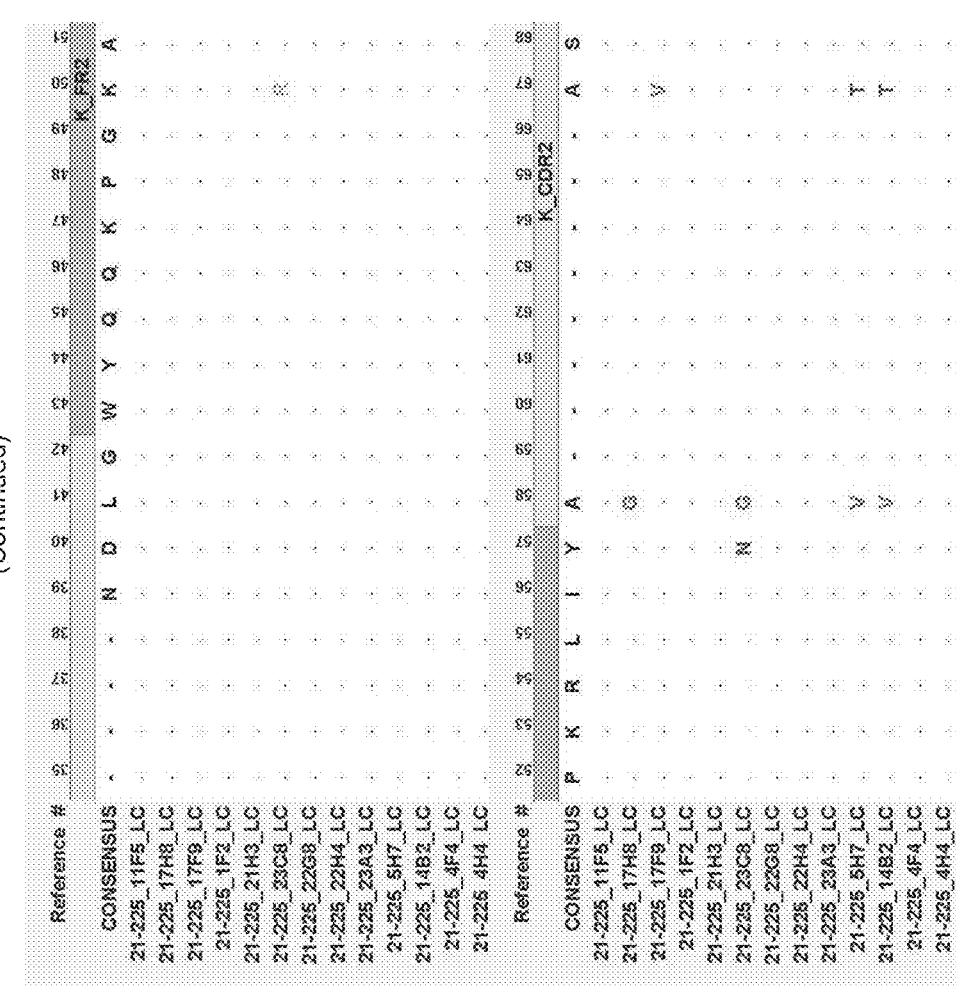
Figure 56:
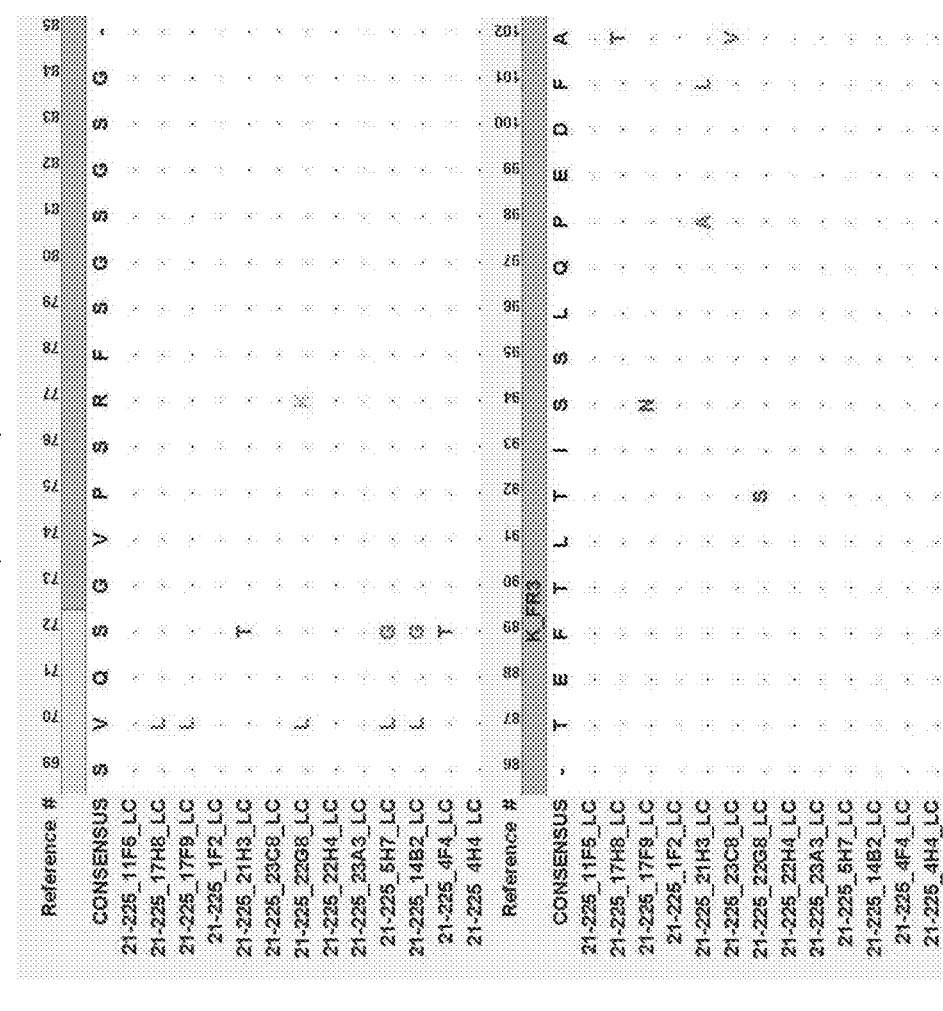
Figure 56:
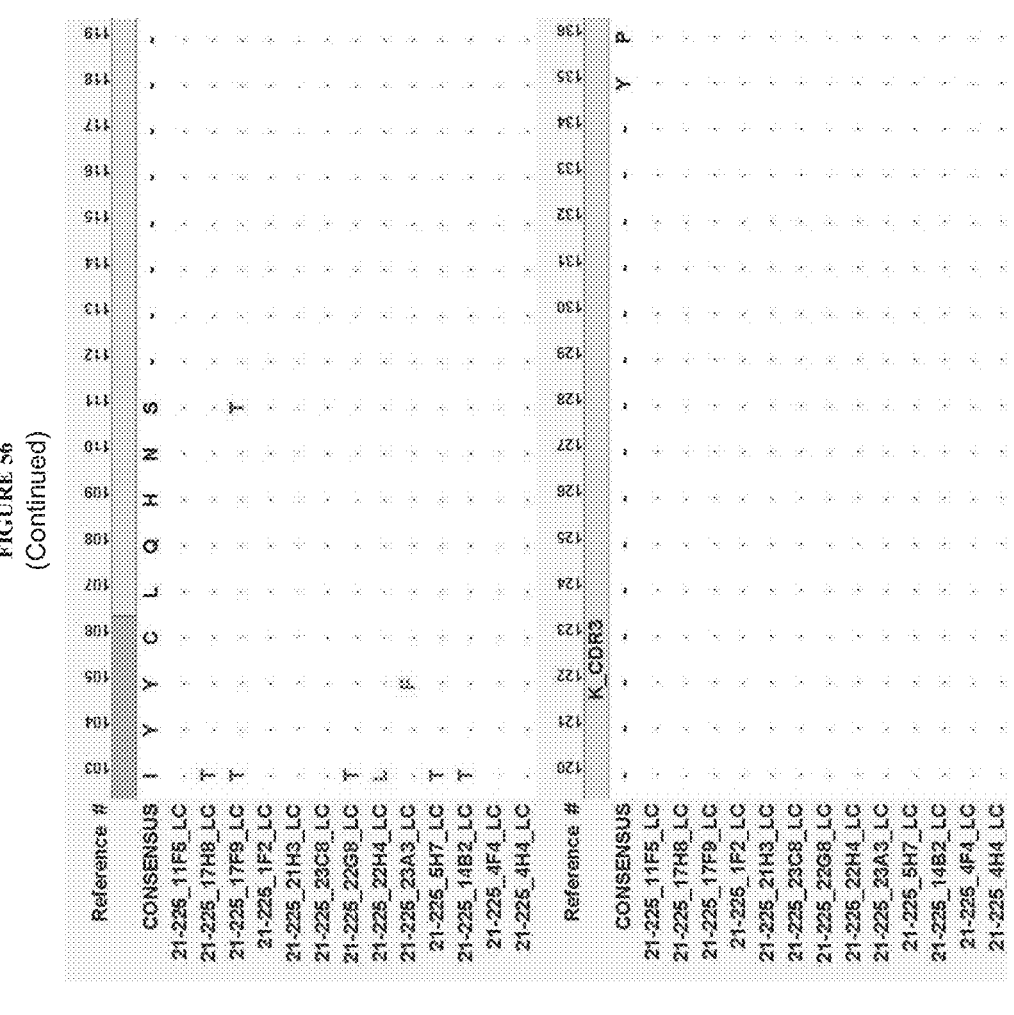
Figure 56:
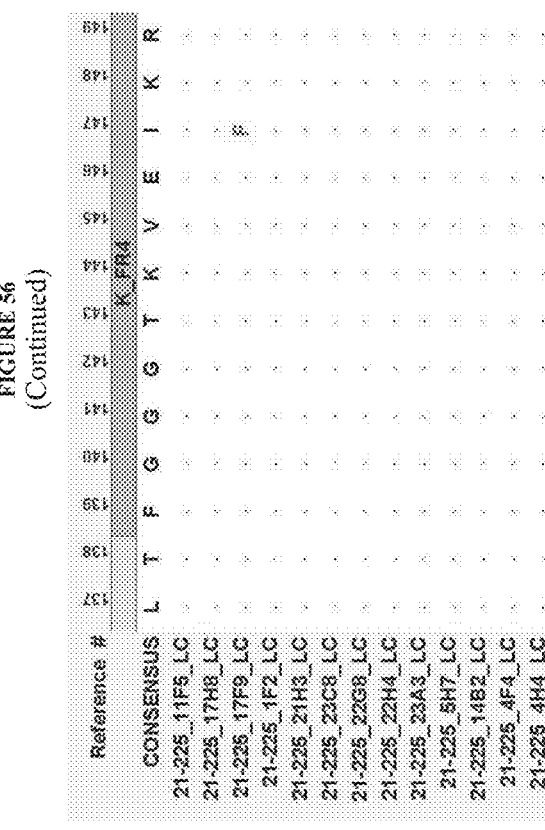

FIG. 56. A group of tables presenting the detailed consensus protein alignment of various light and heavy chain variable regions for certain antigen binding proteins of the present invention (Tables 21-48). The shading of amino acid residues in the consensus protein alignment presented in Tables 21-48 denote particular residues that one of ordinary skill in the art may wish to target for engineering.

Figure 57:
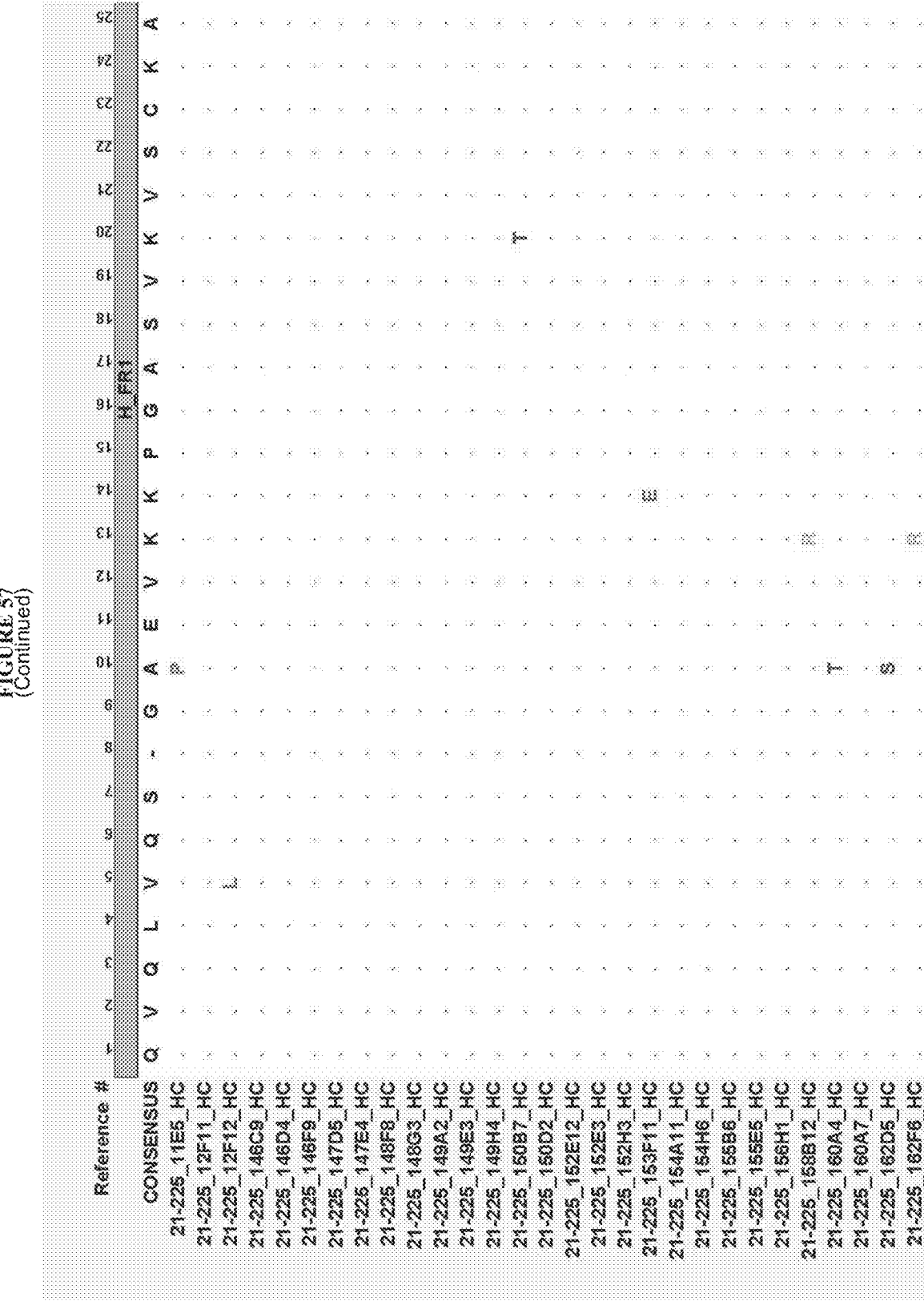
Figure 57:
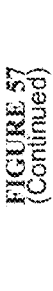
Figure 57:
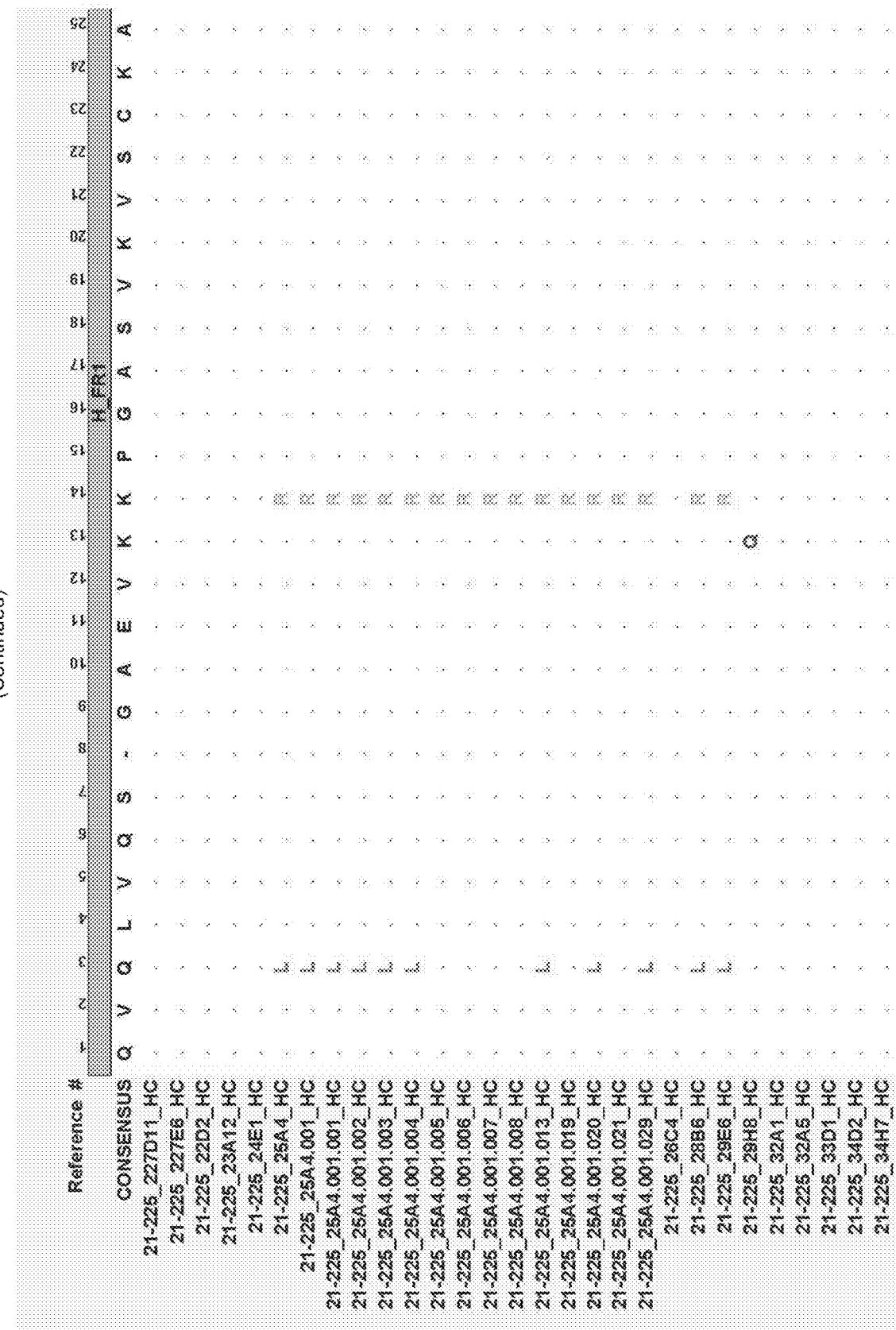
Figure 57:
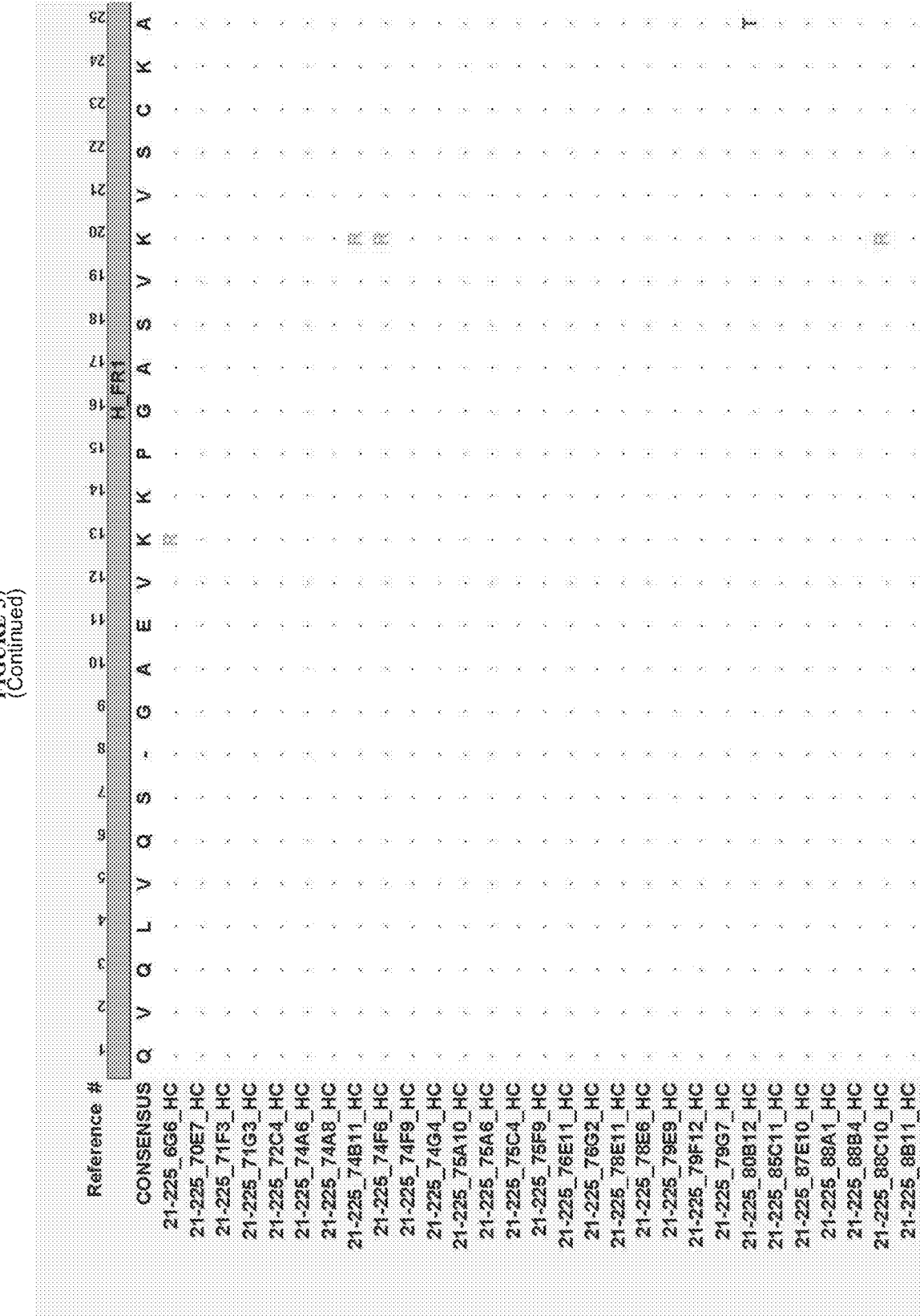
Figure 57:
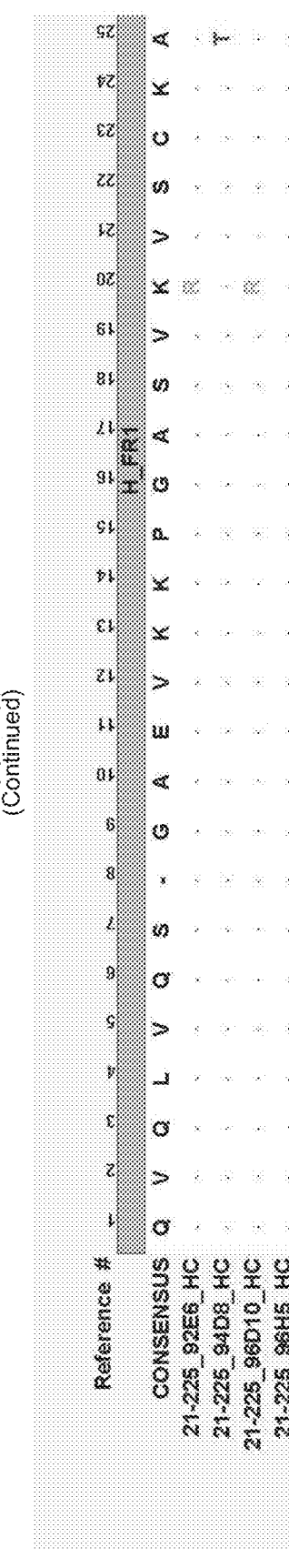
Figure 57:
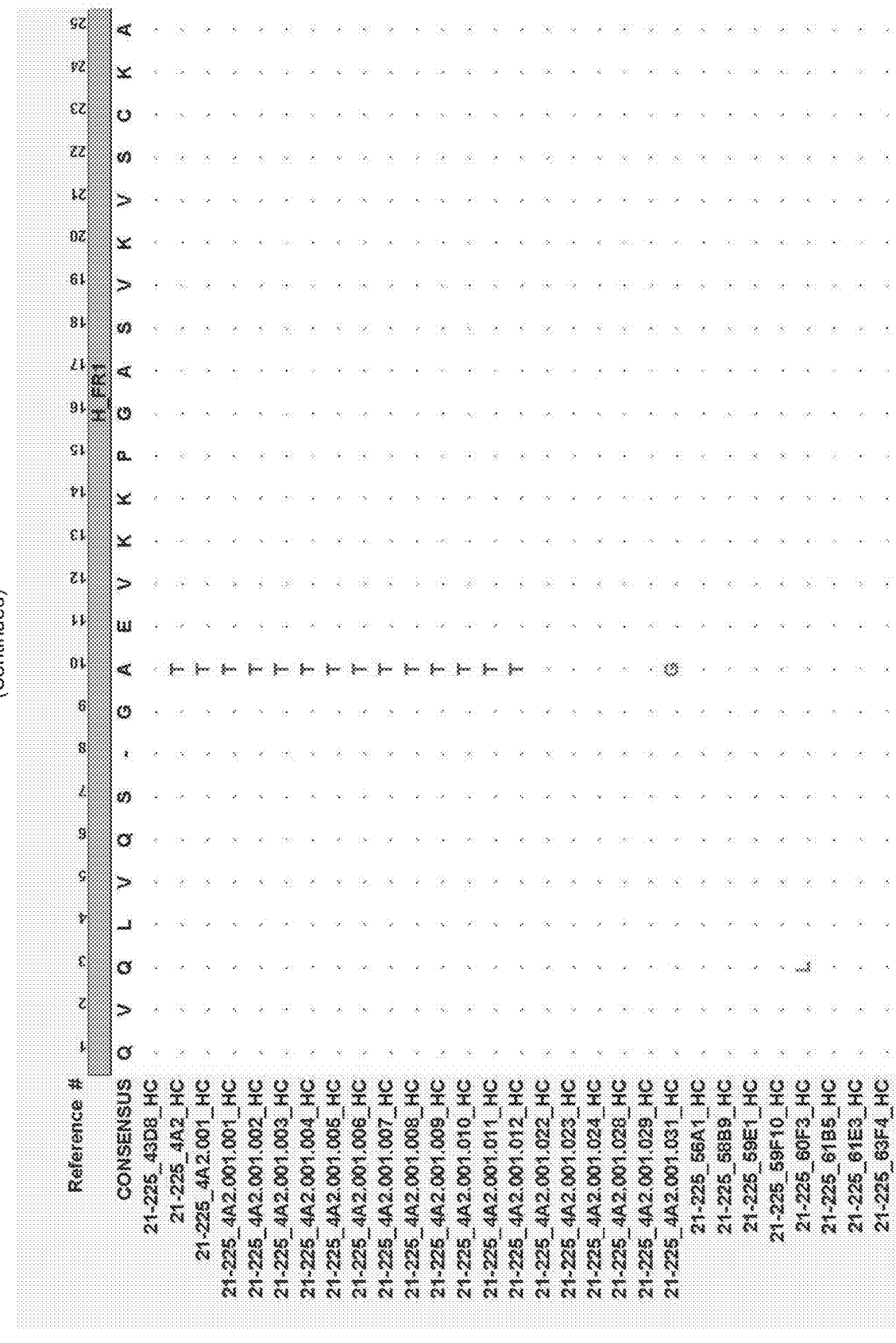
Figure 57:
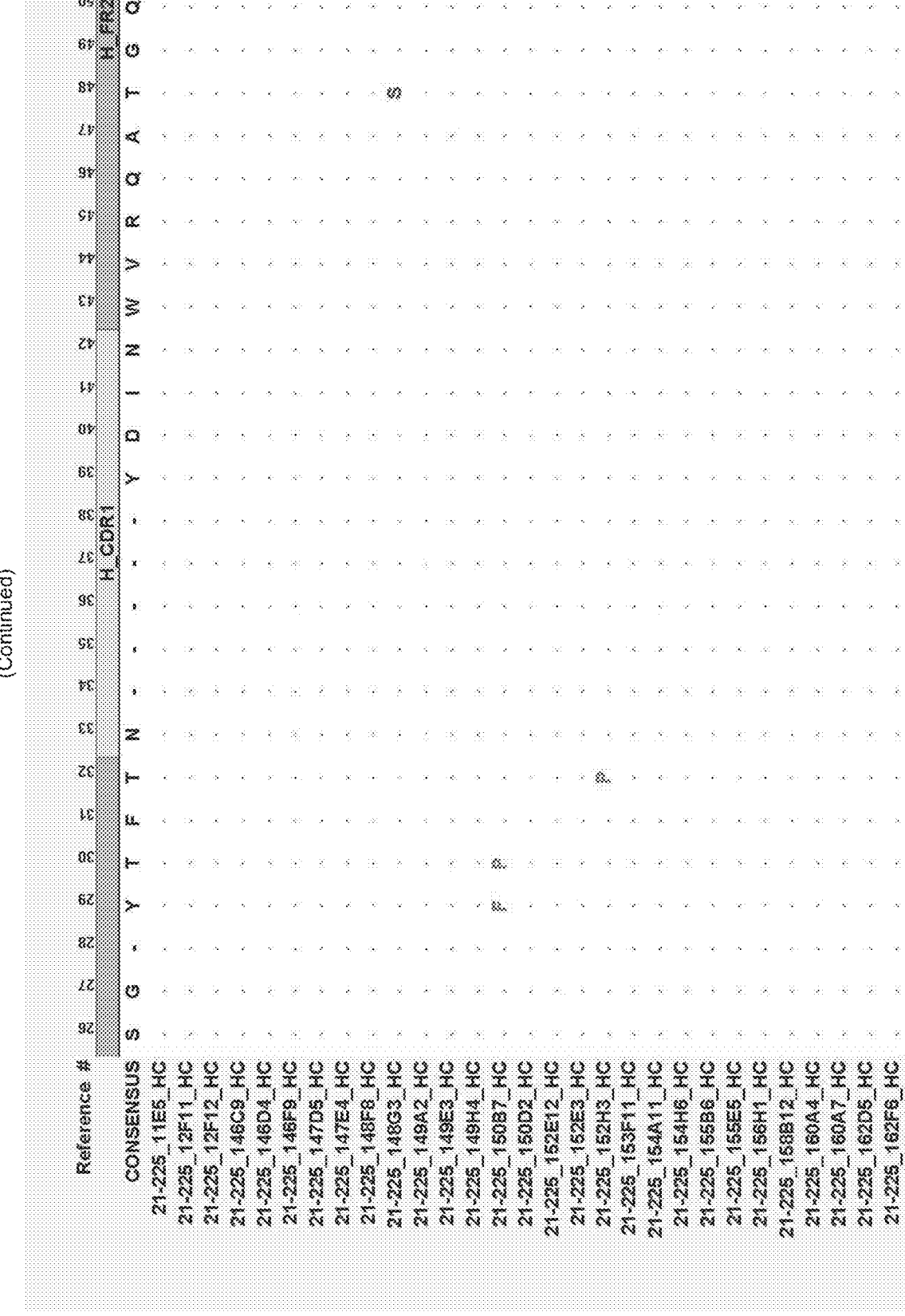
Figure 57:
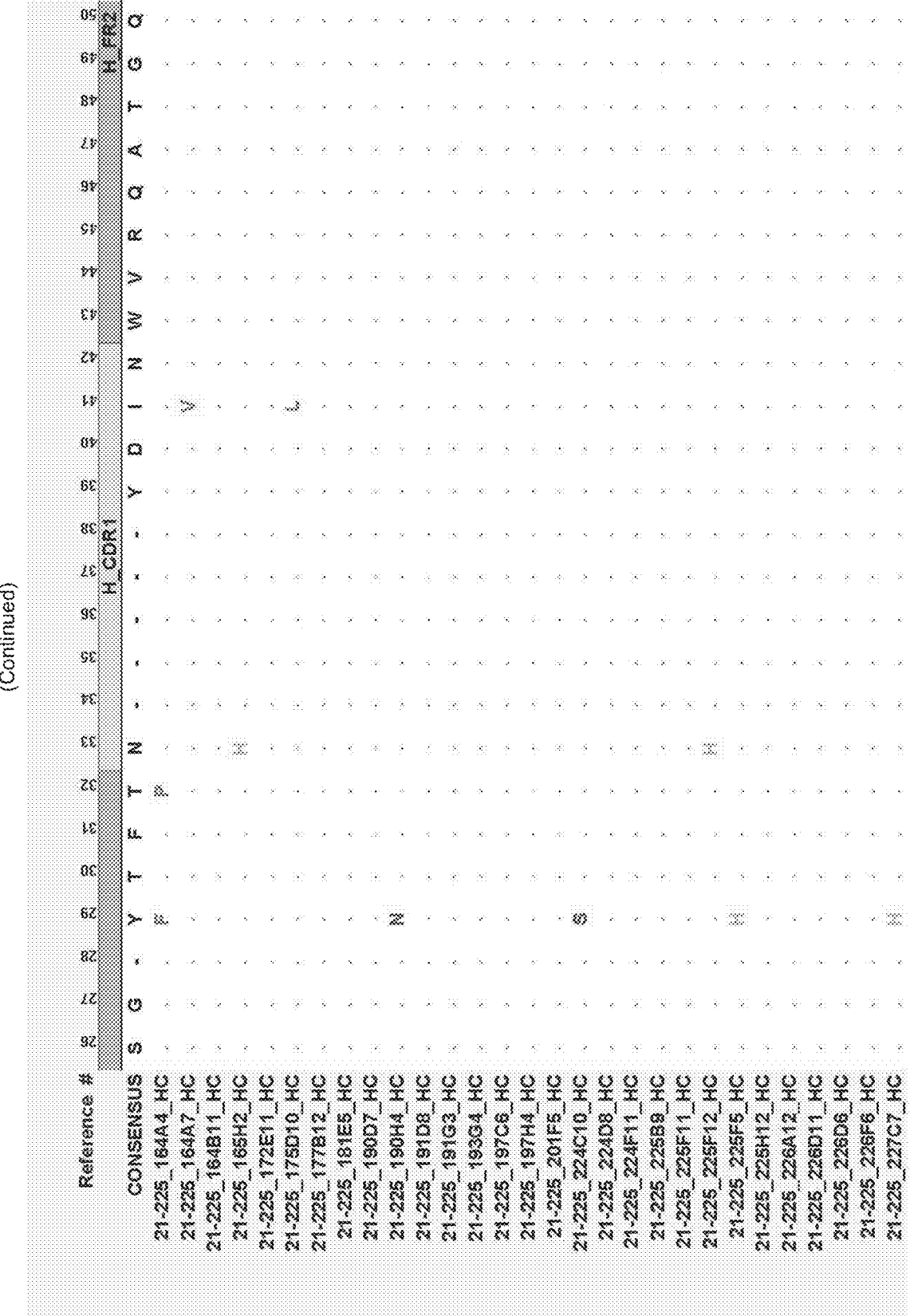
Figure 57:
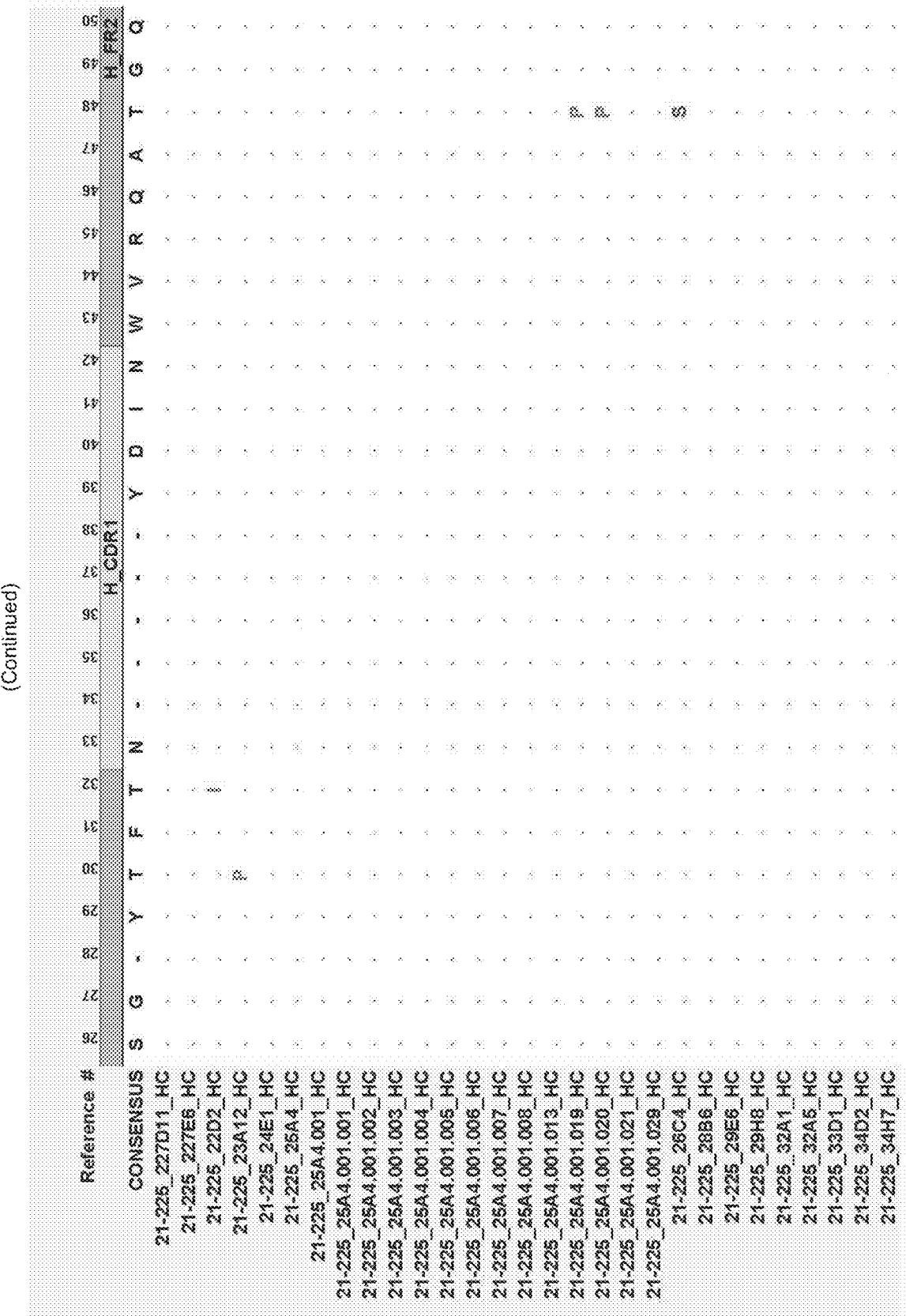
Figure 57:
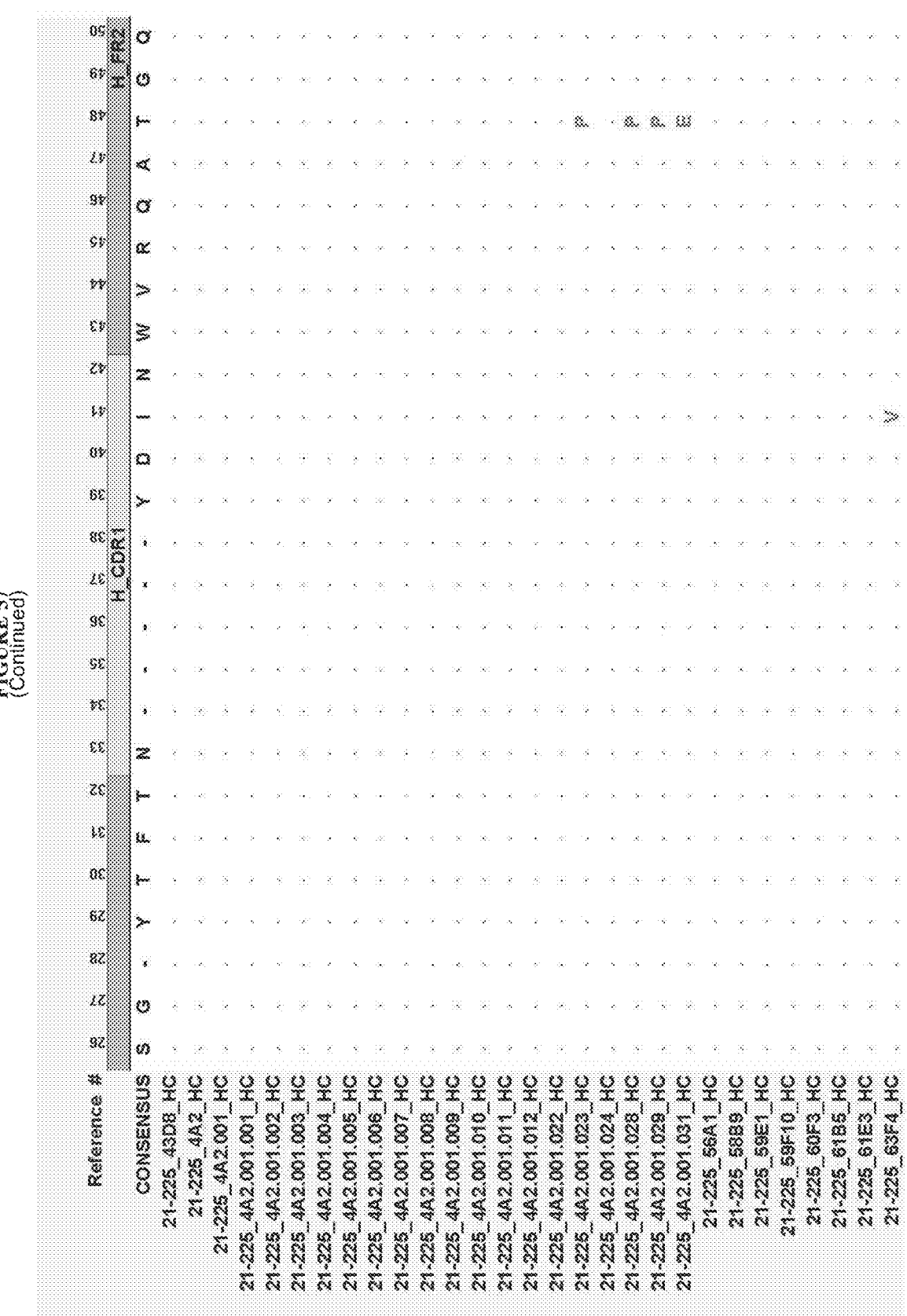
Figure 57:
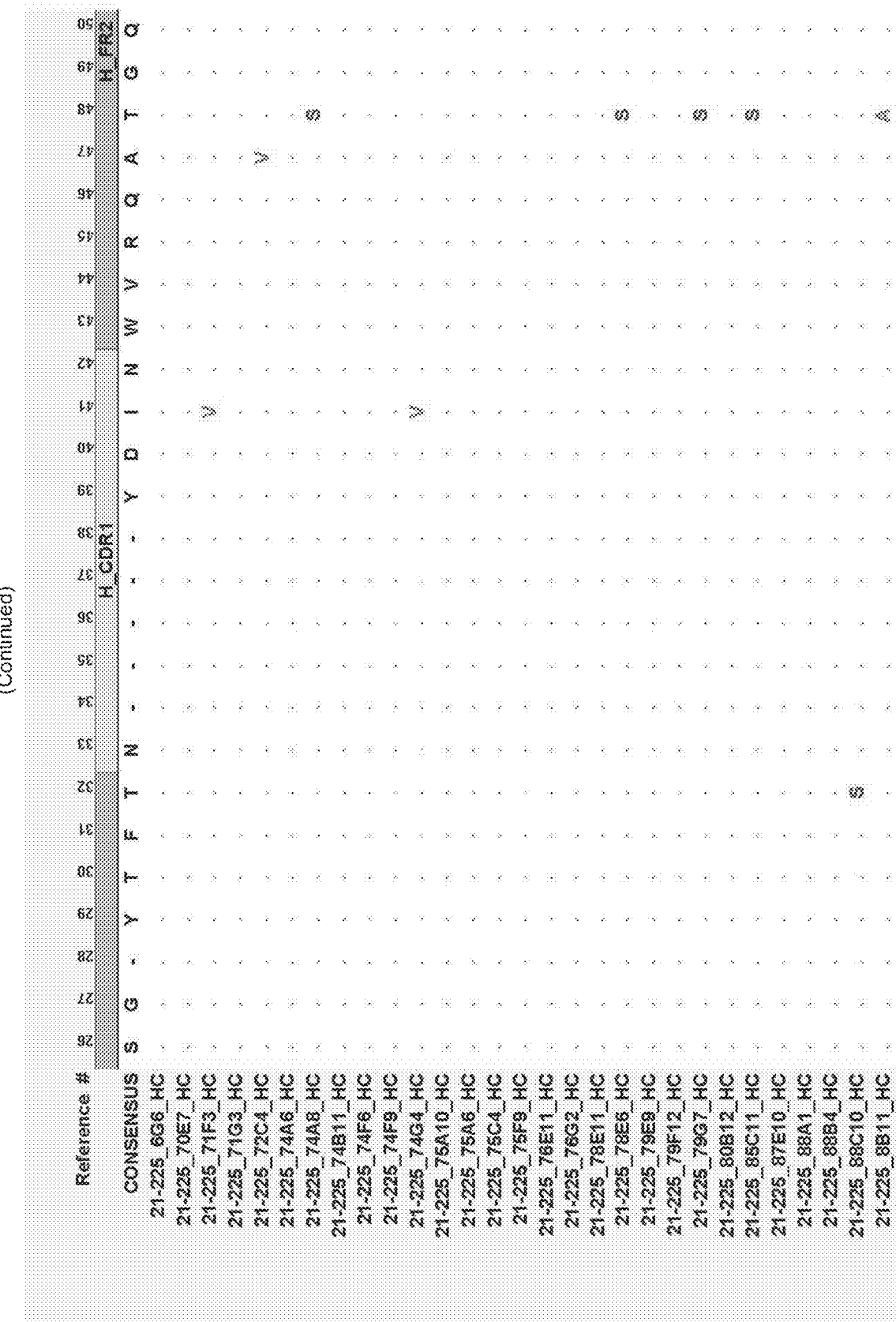
Figure 57:
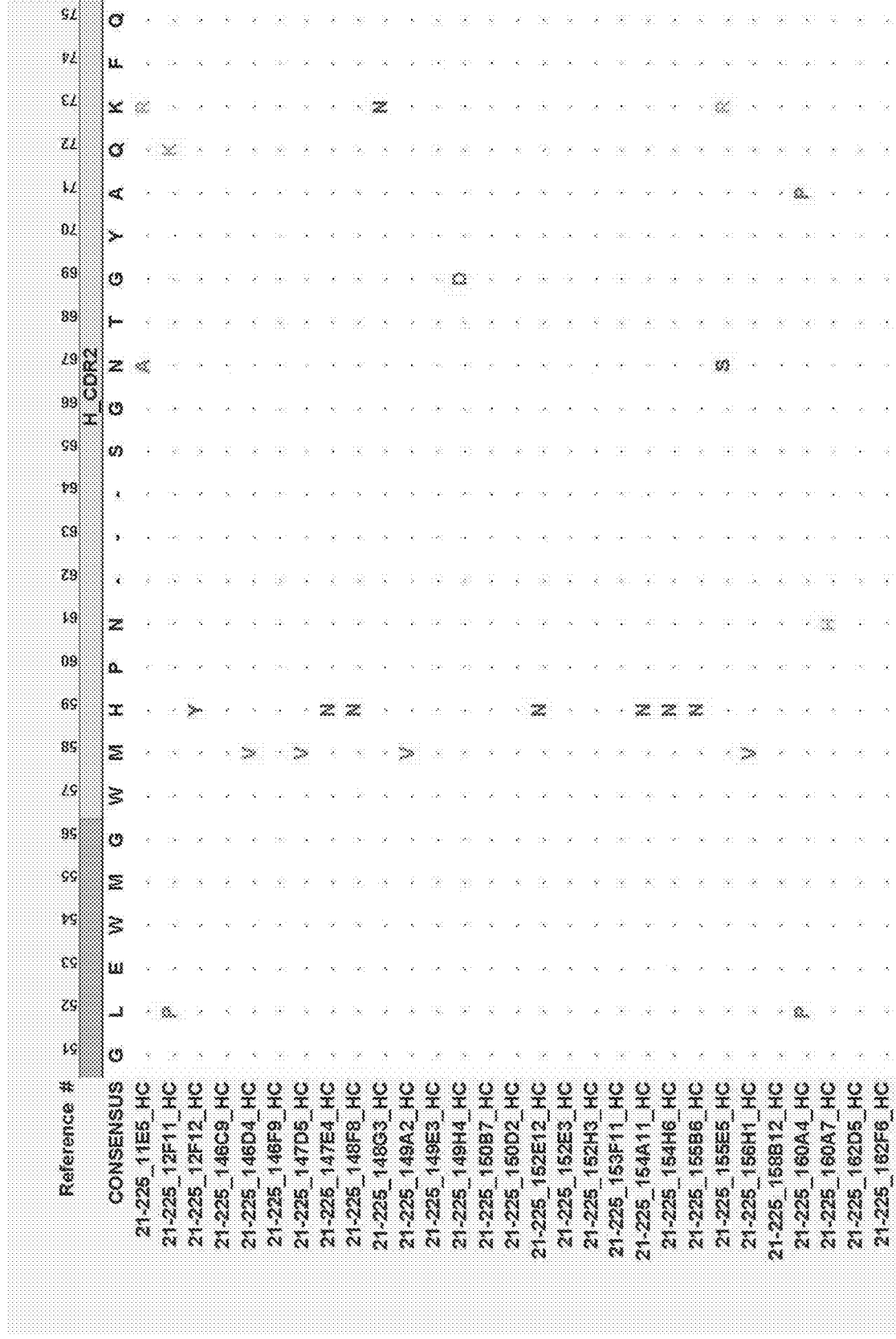
Figure 57:
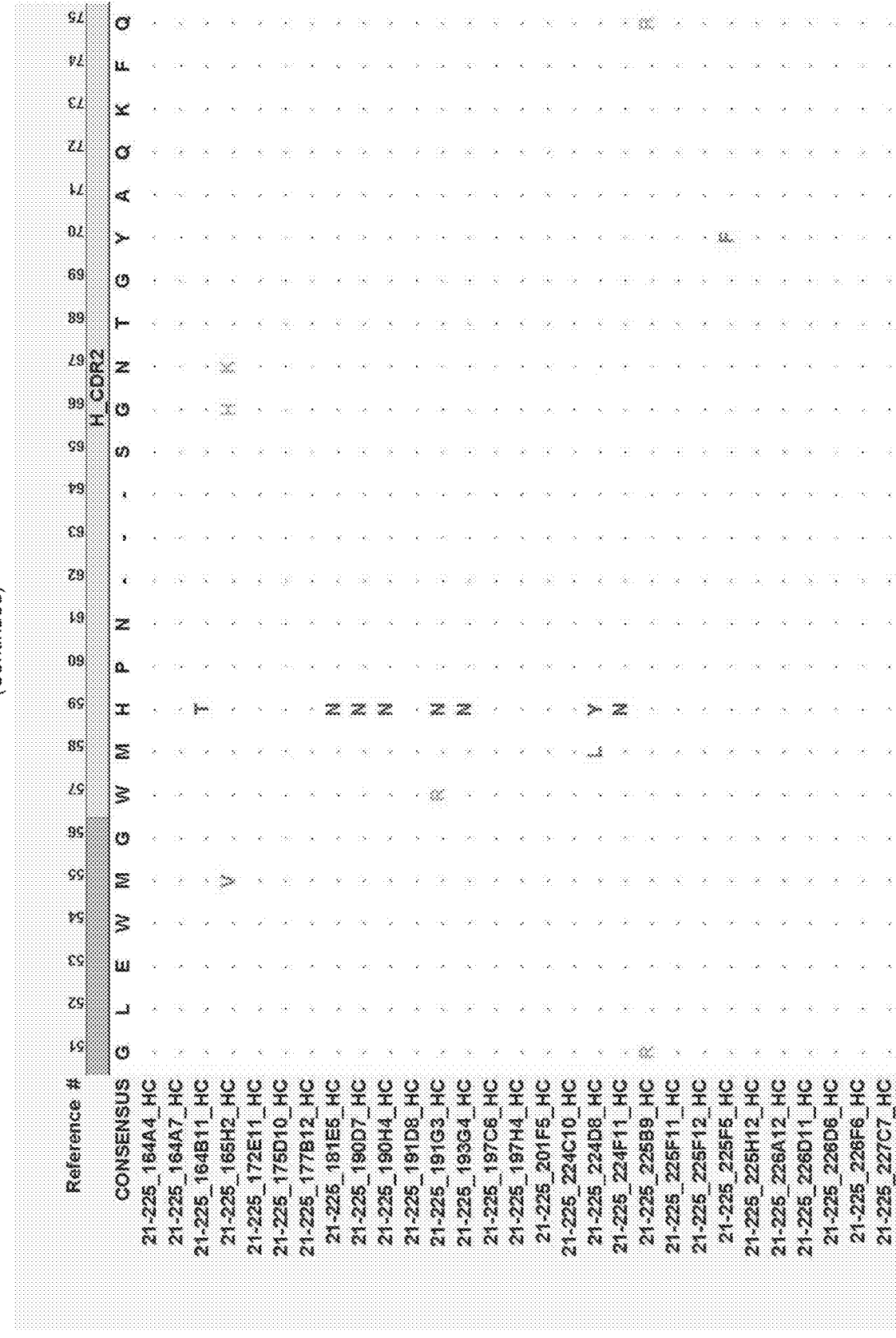
Figure 57:
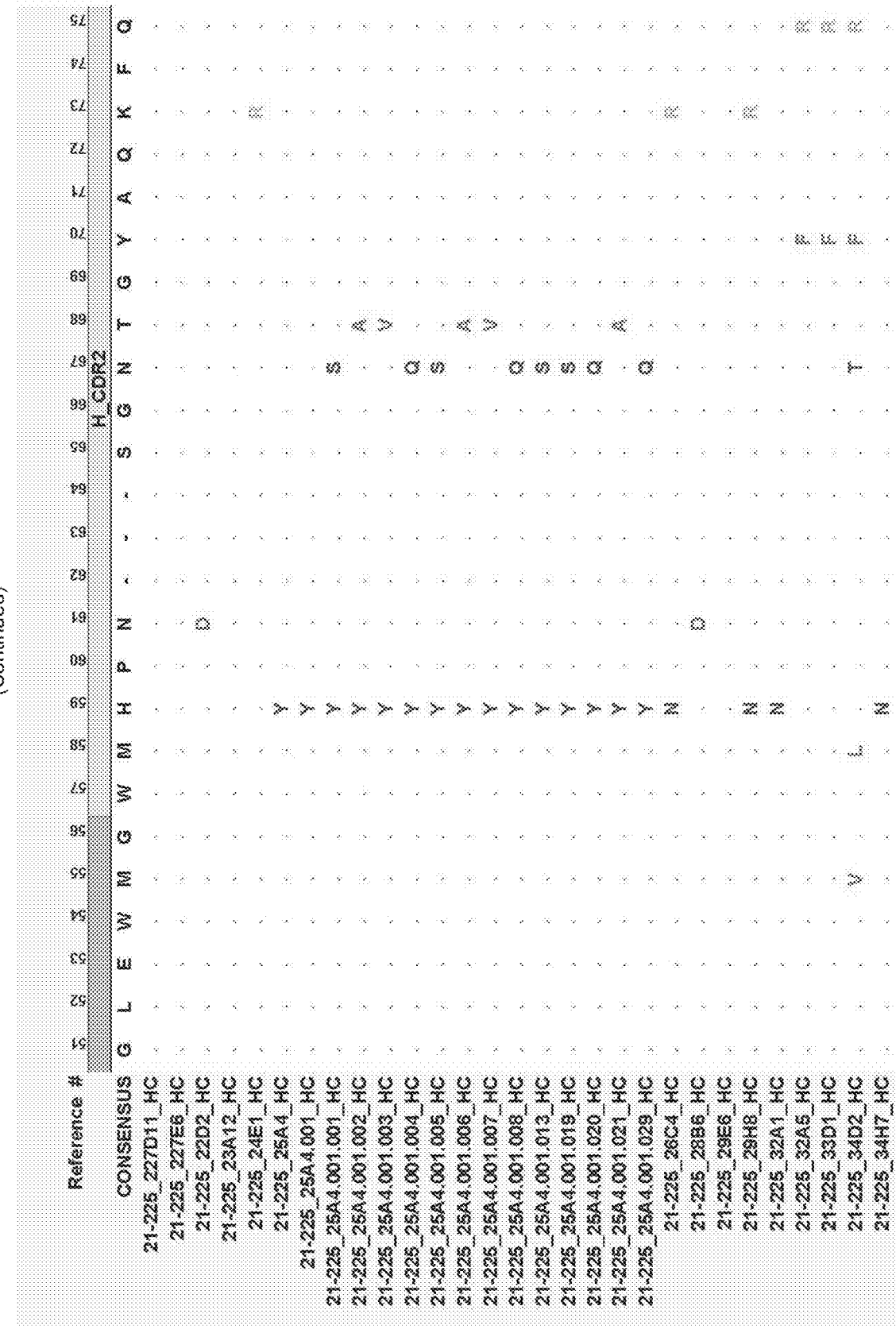
Figure 57:
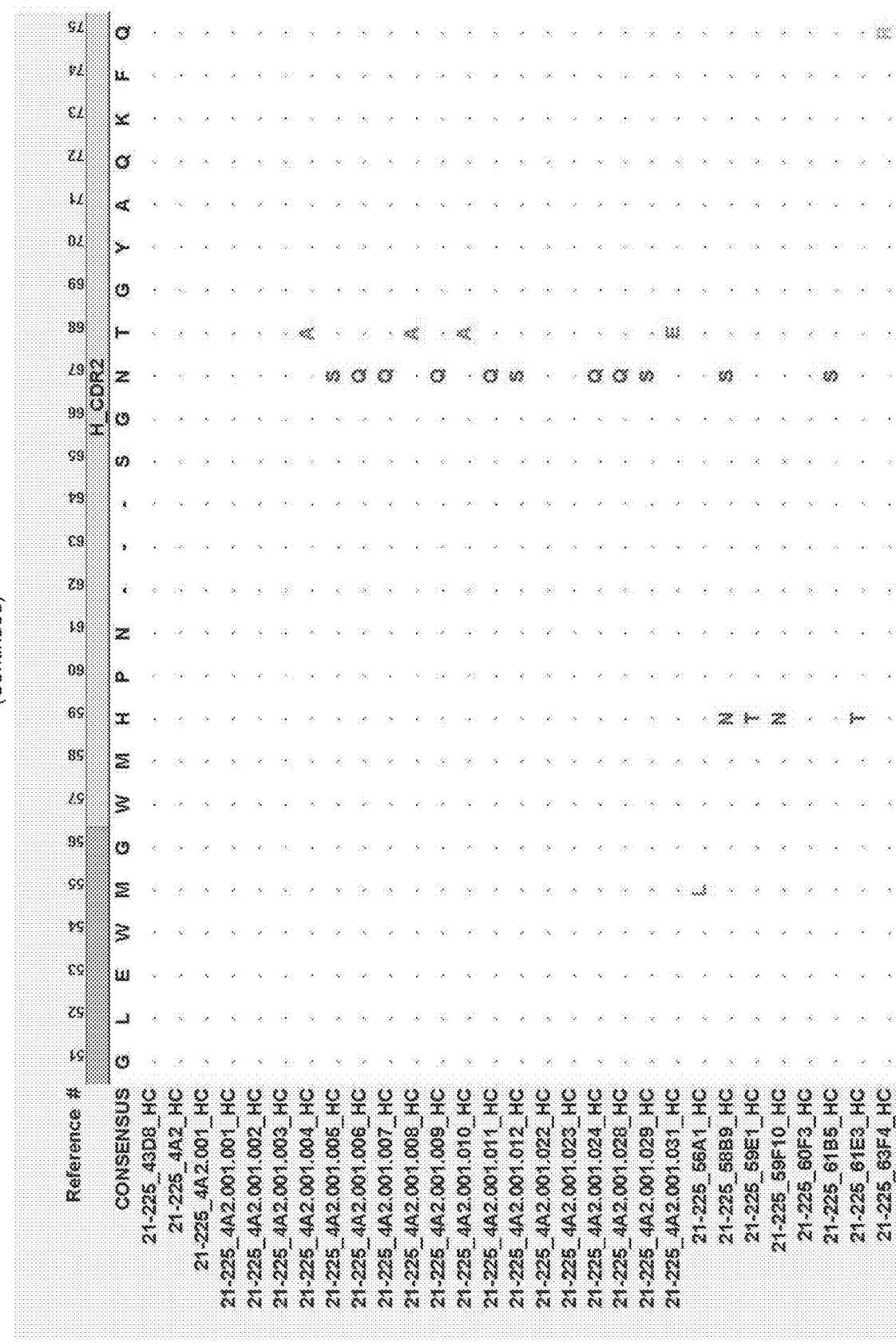
Figure 57:
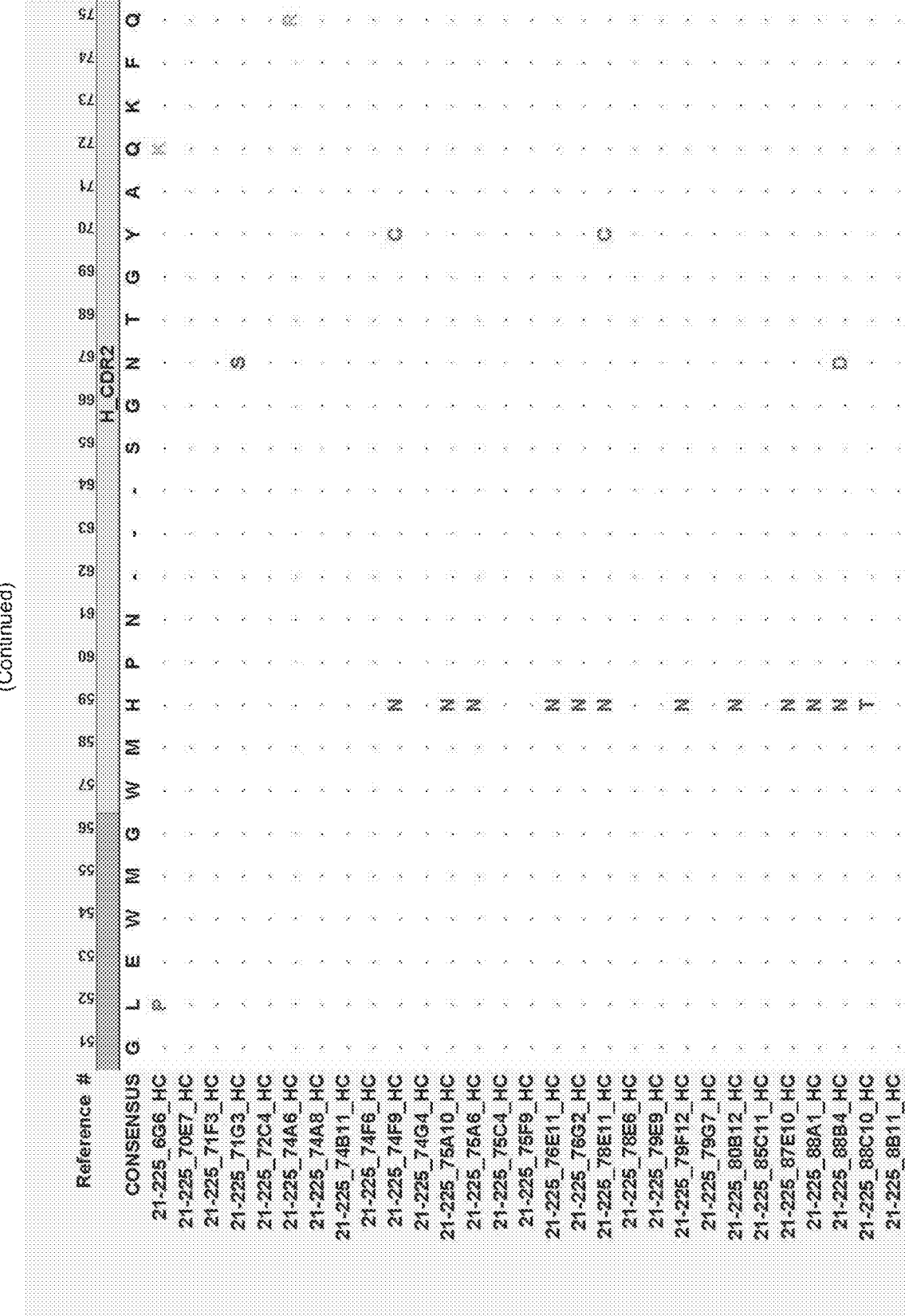
Figure 57:
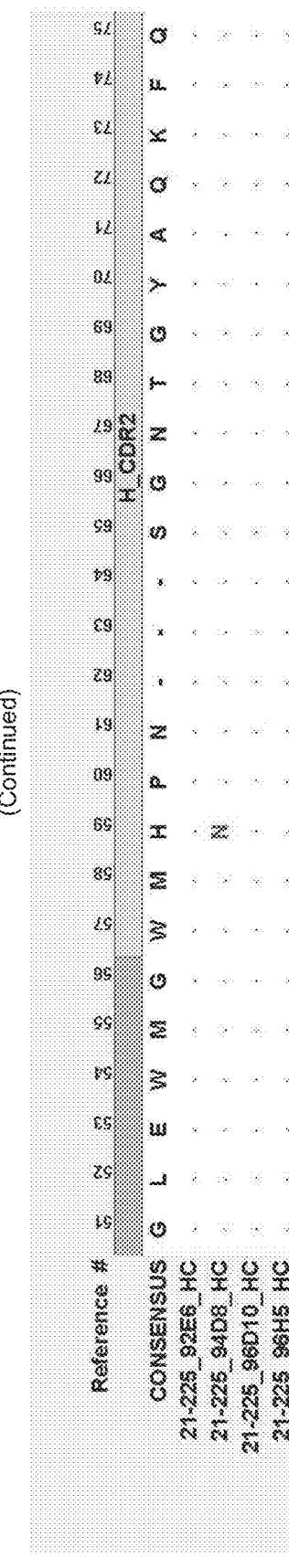
Figure 57:
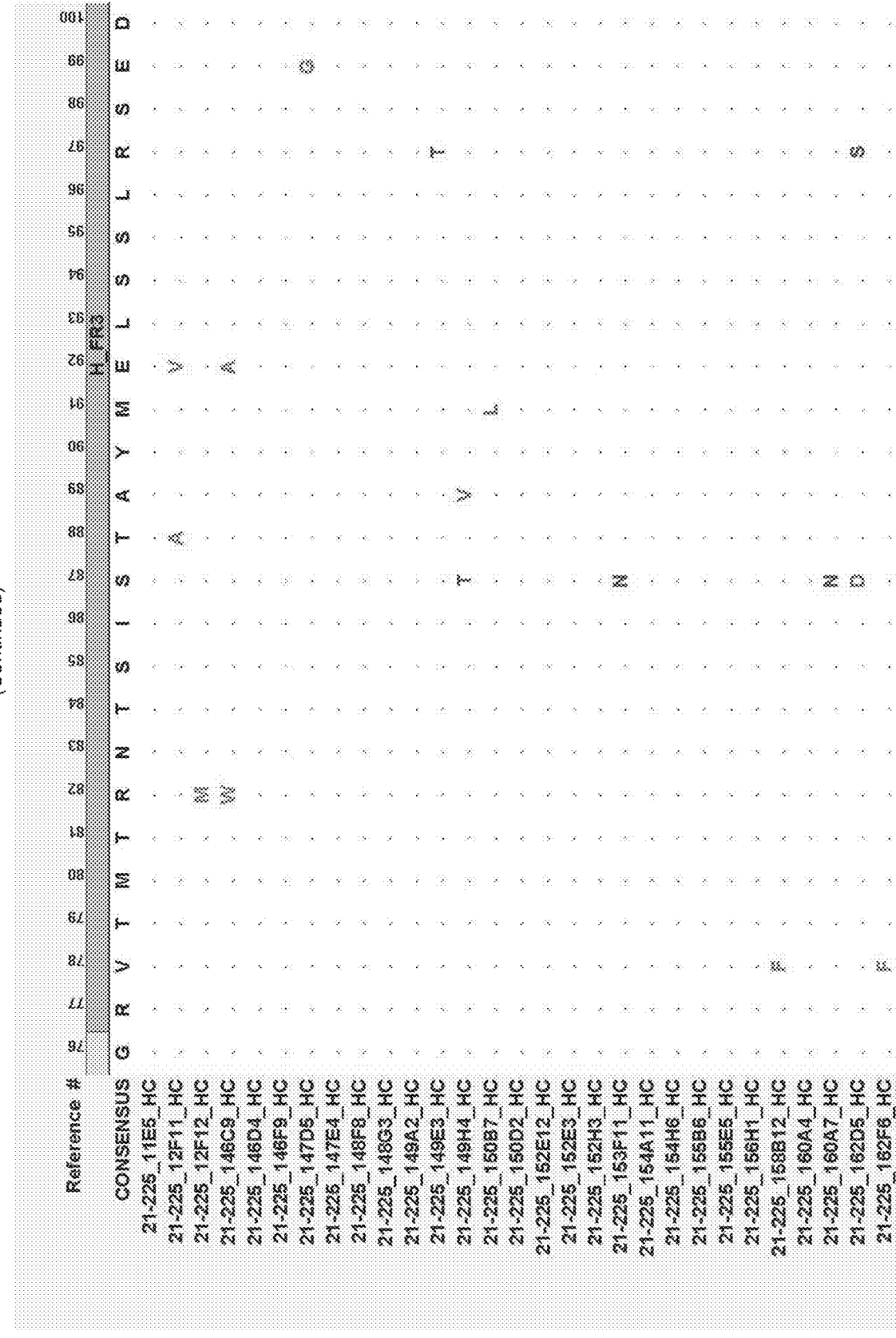
Figure 57:
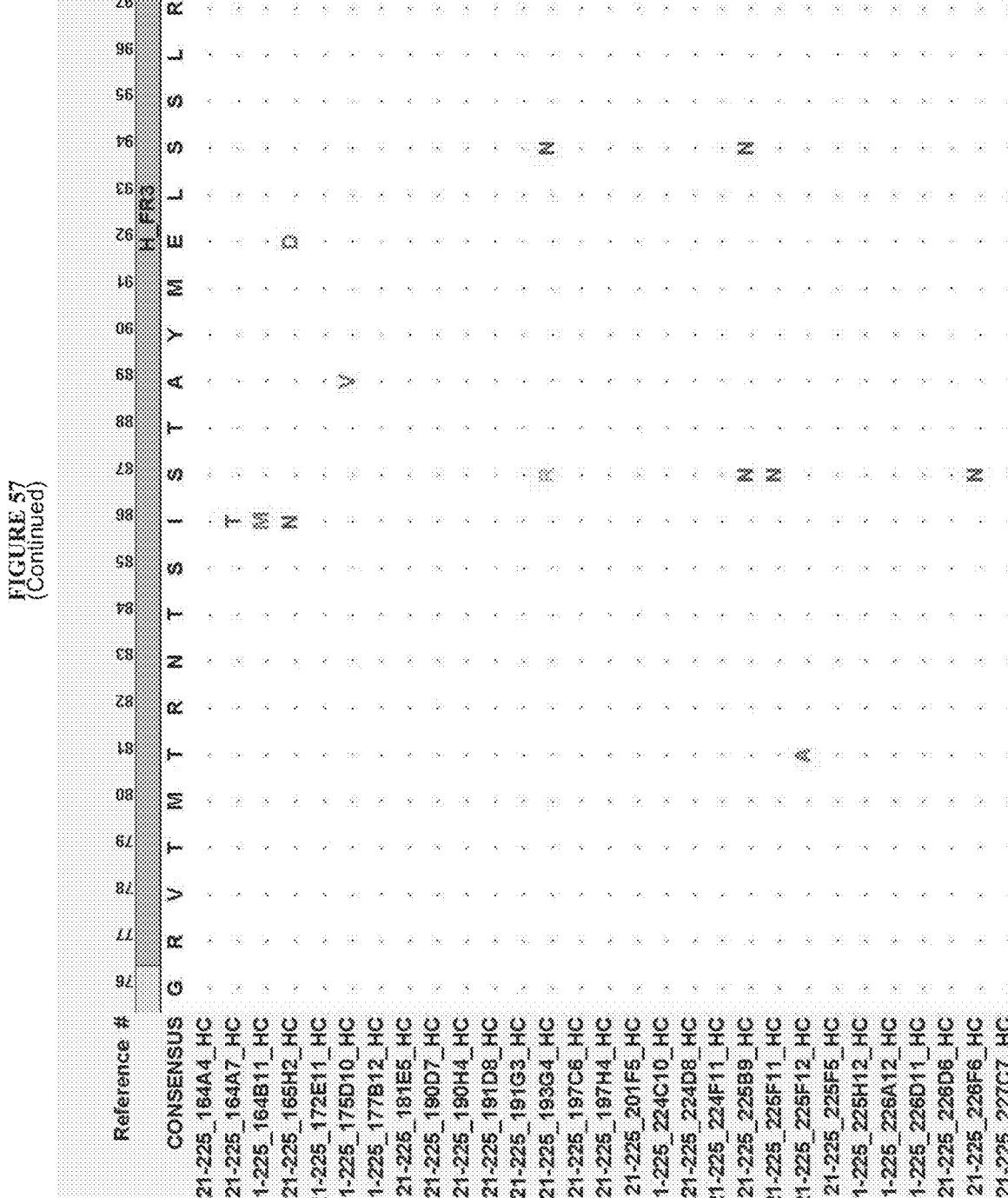
Figure 57:
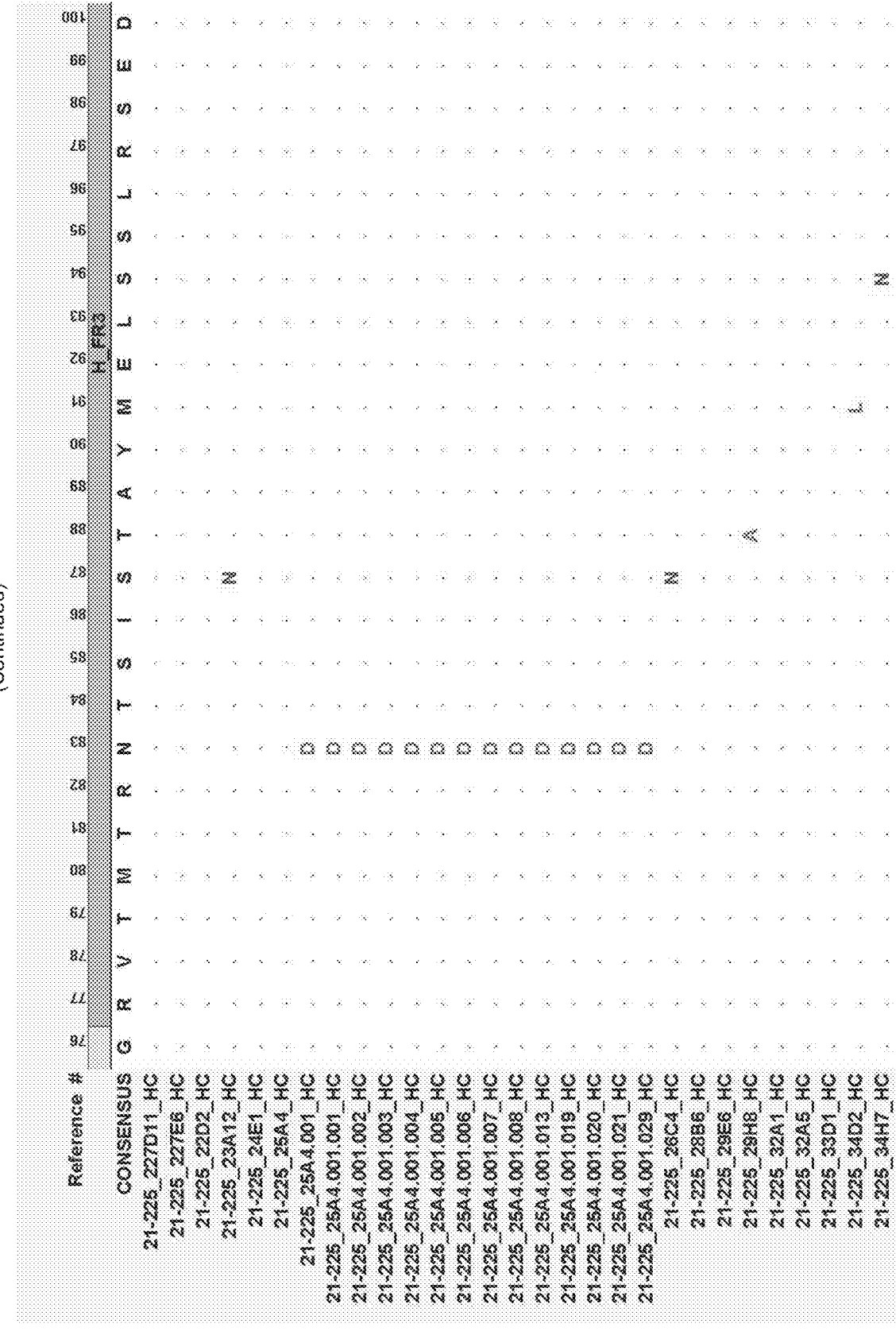
Figure 57:
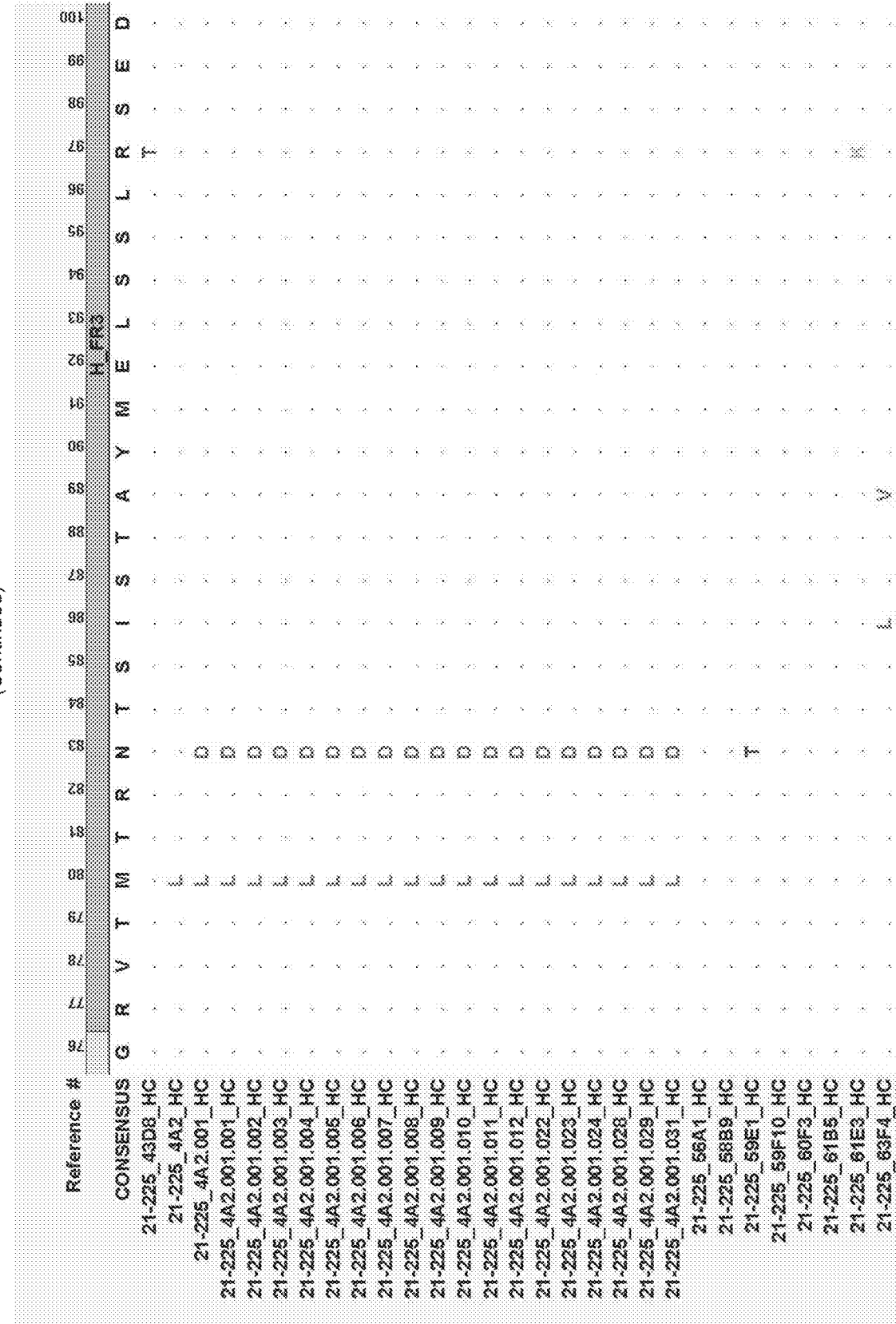
Figure 57:
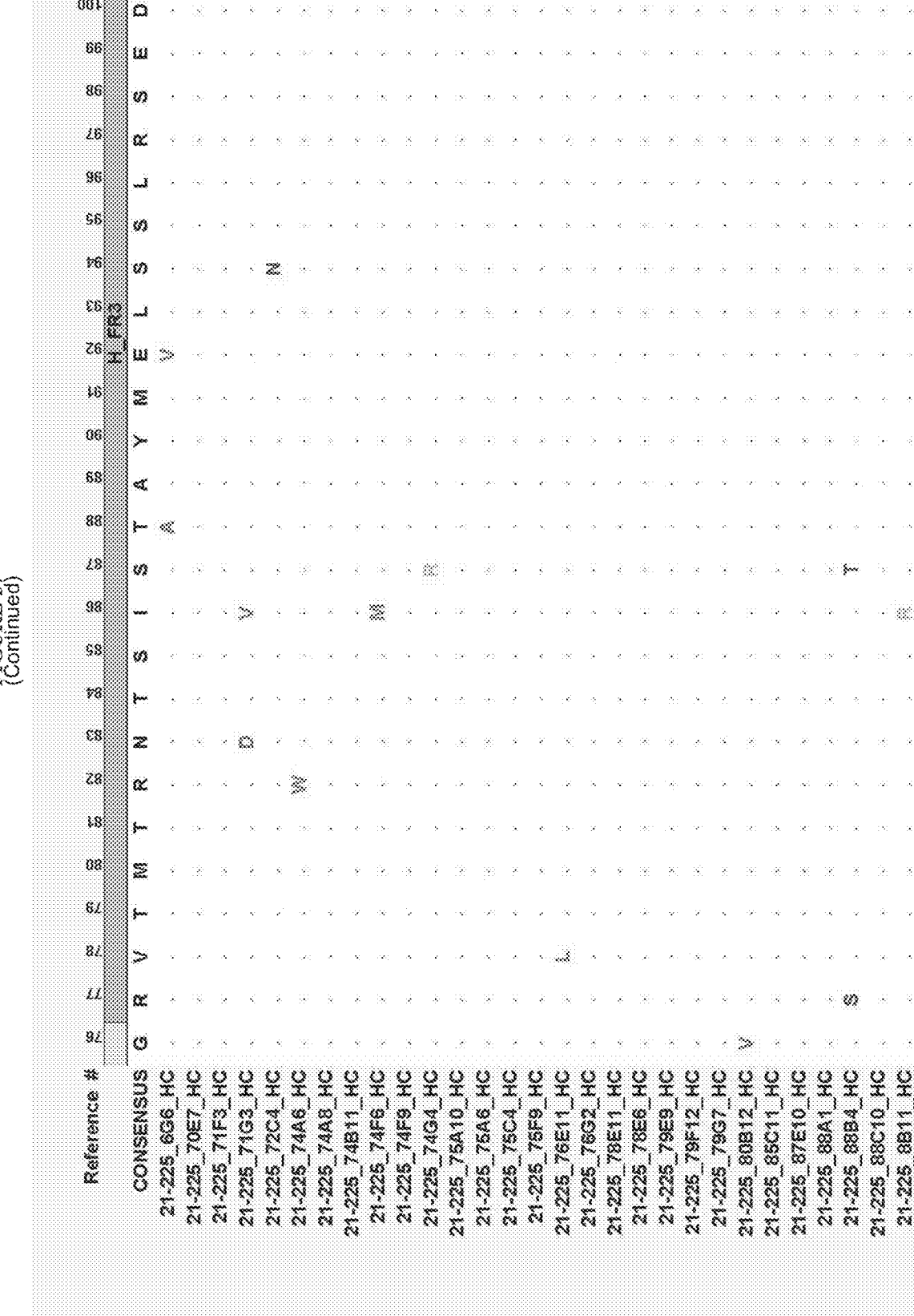
Figure 57:
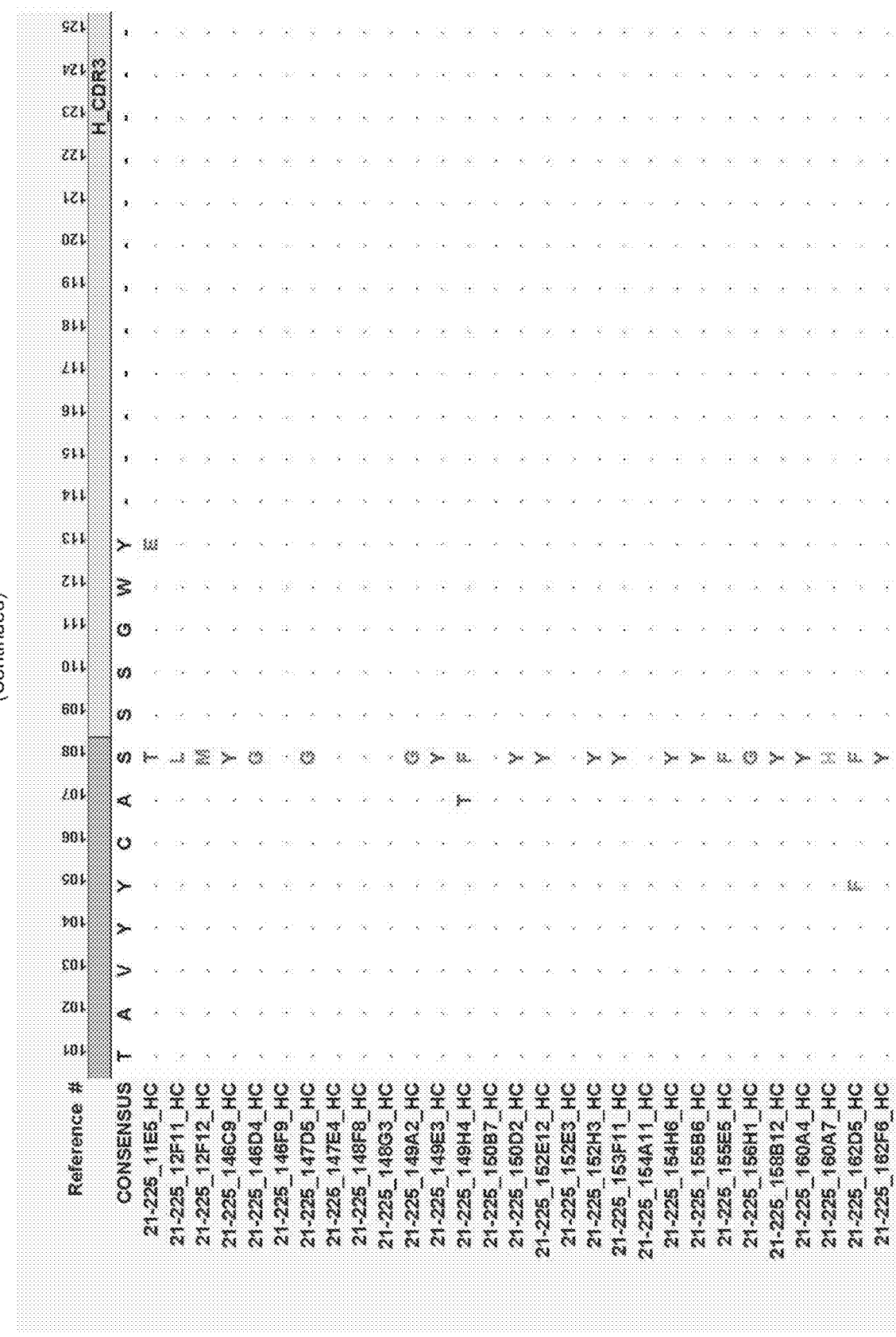
Figure 57:
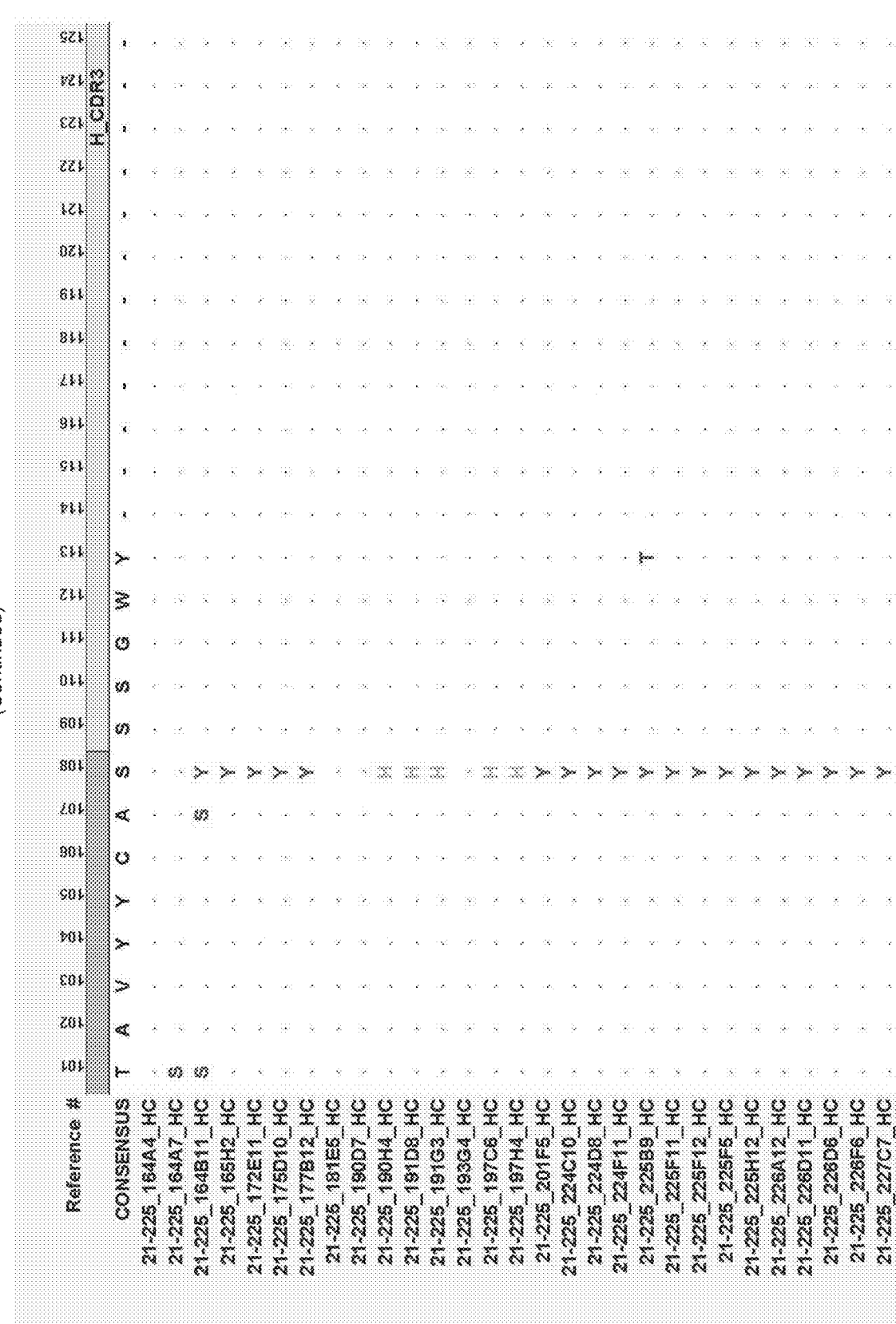
Figure 57:
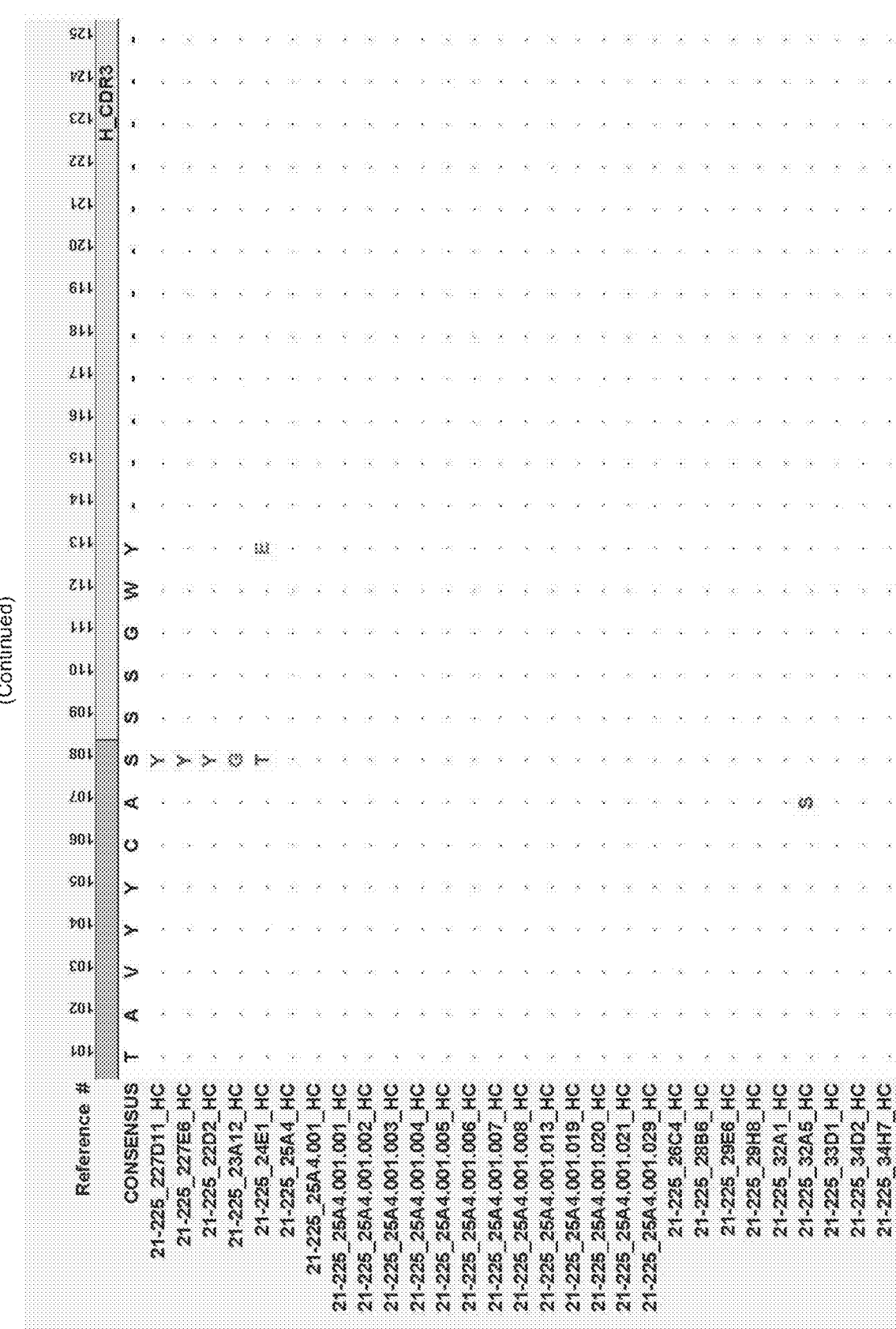
Figure 57:
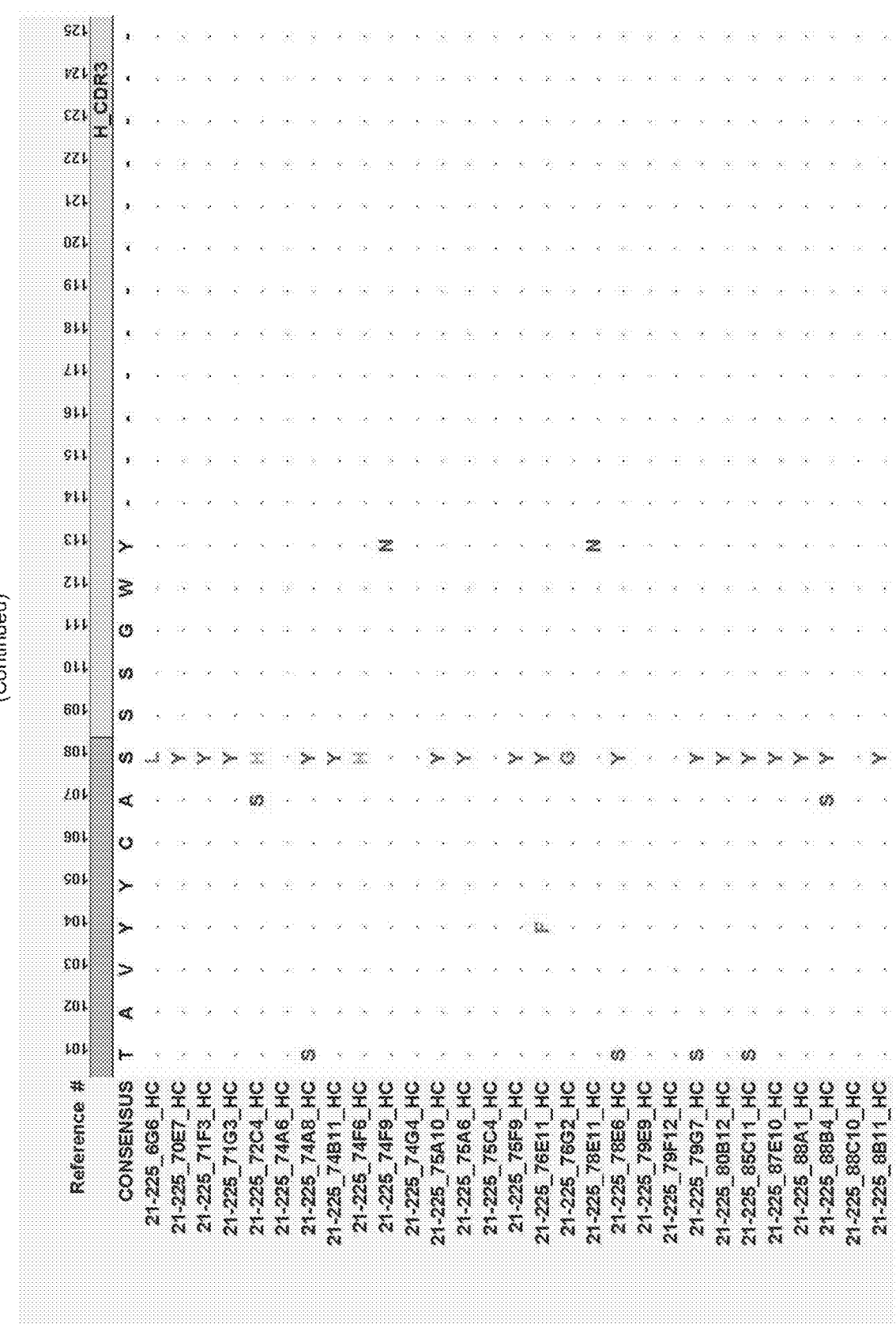
Figure 57:
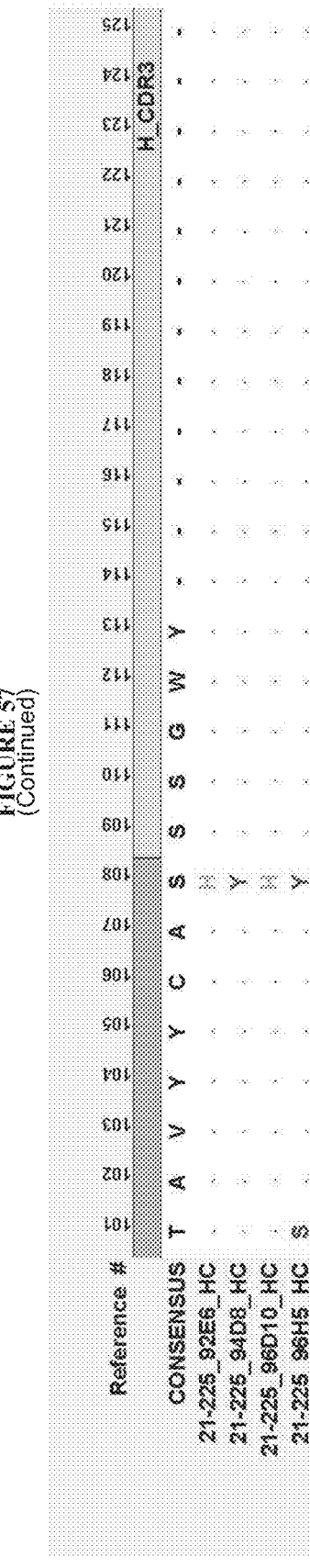
Figure 57:
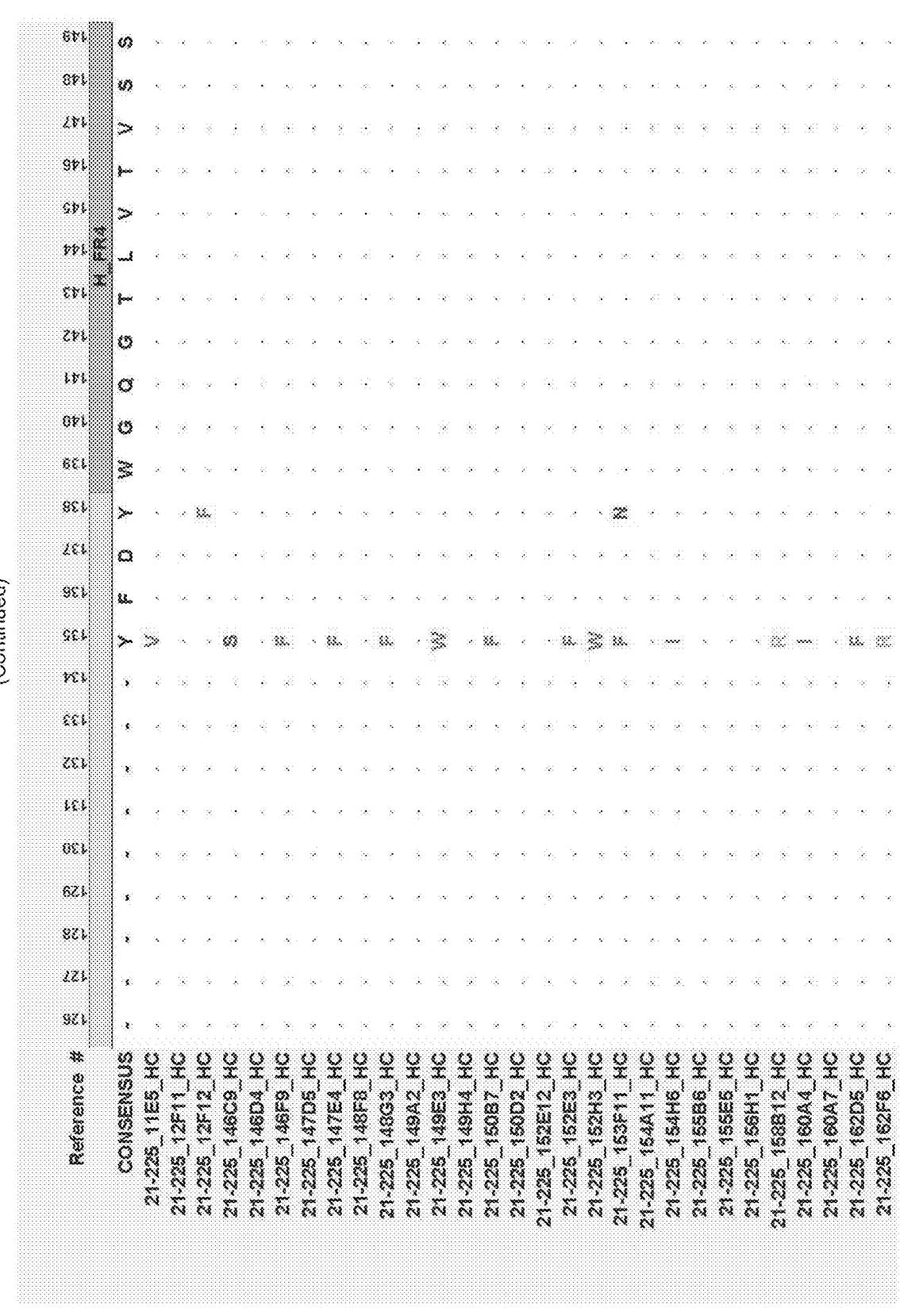
Figure 57:
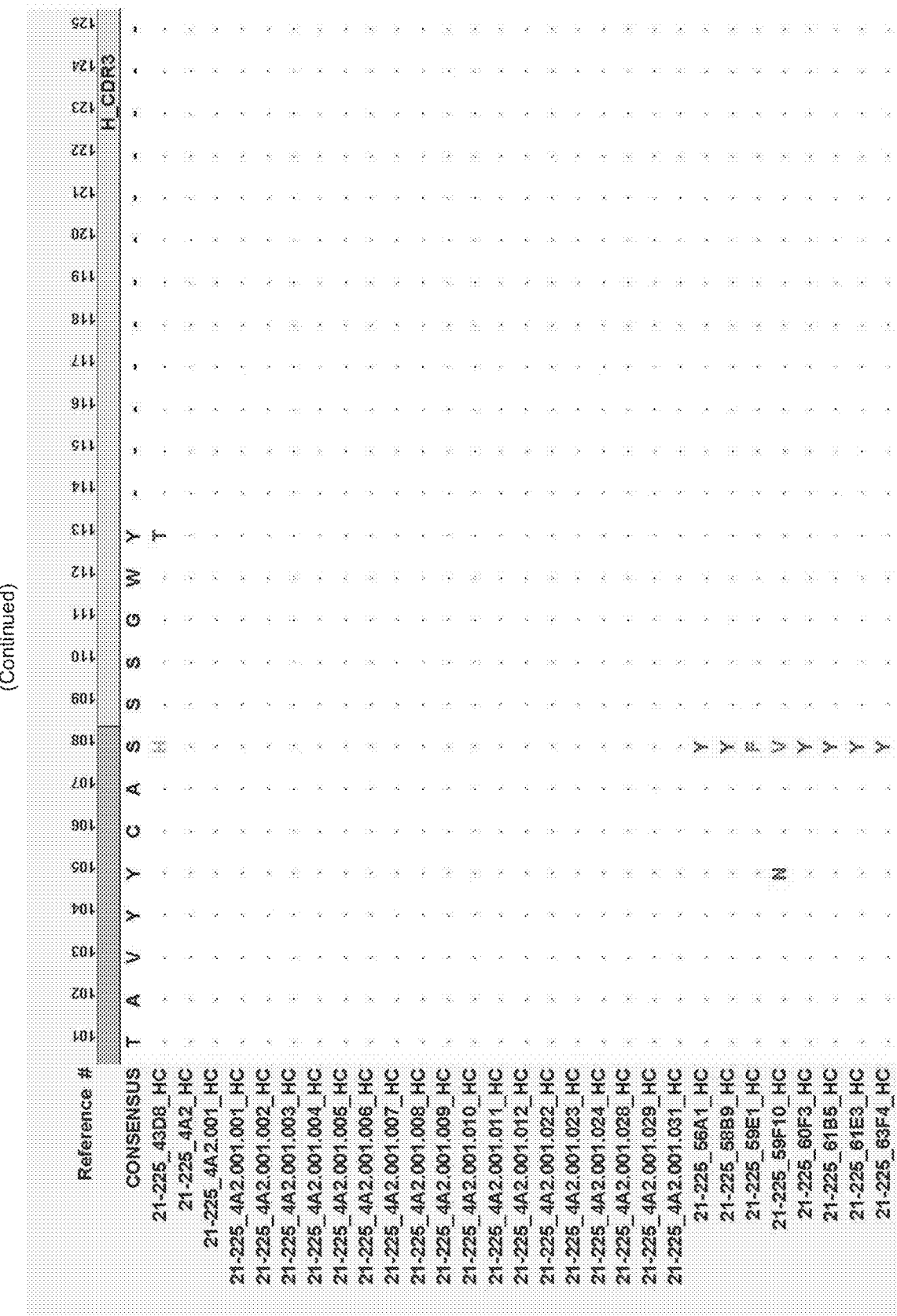
Figure 57:
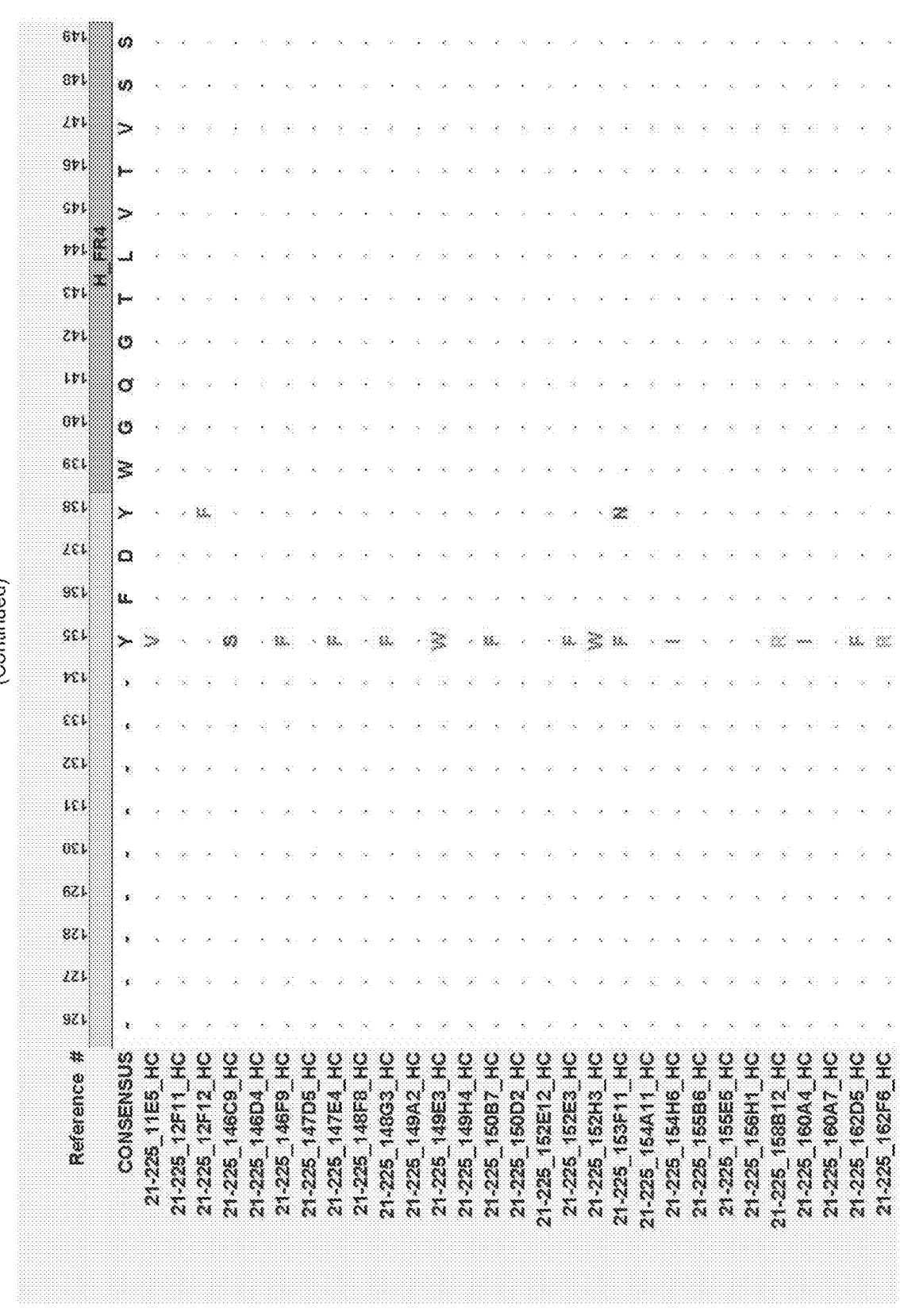
Figure 57:
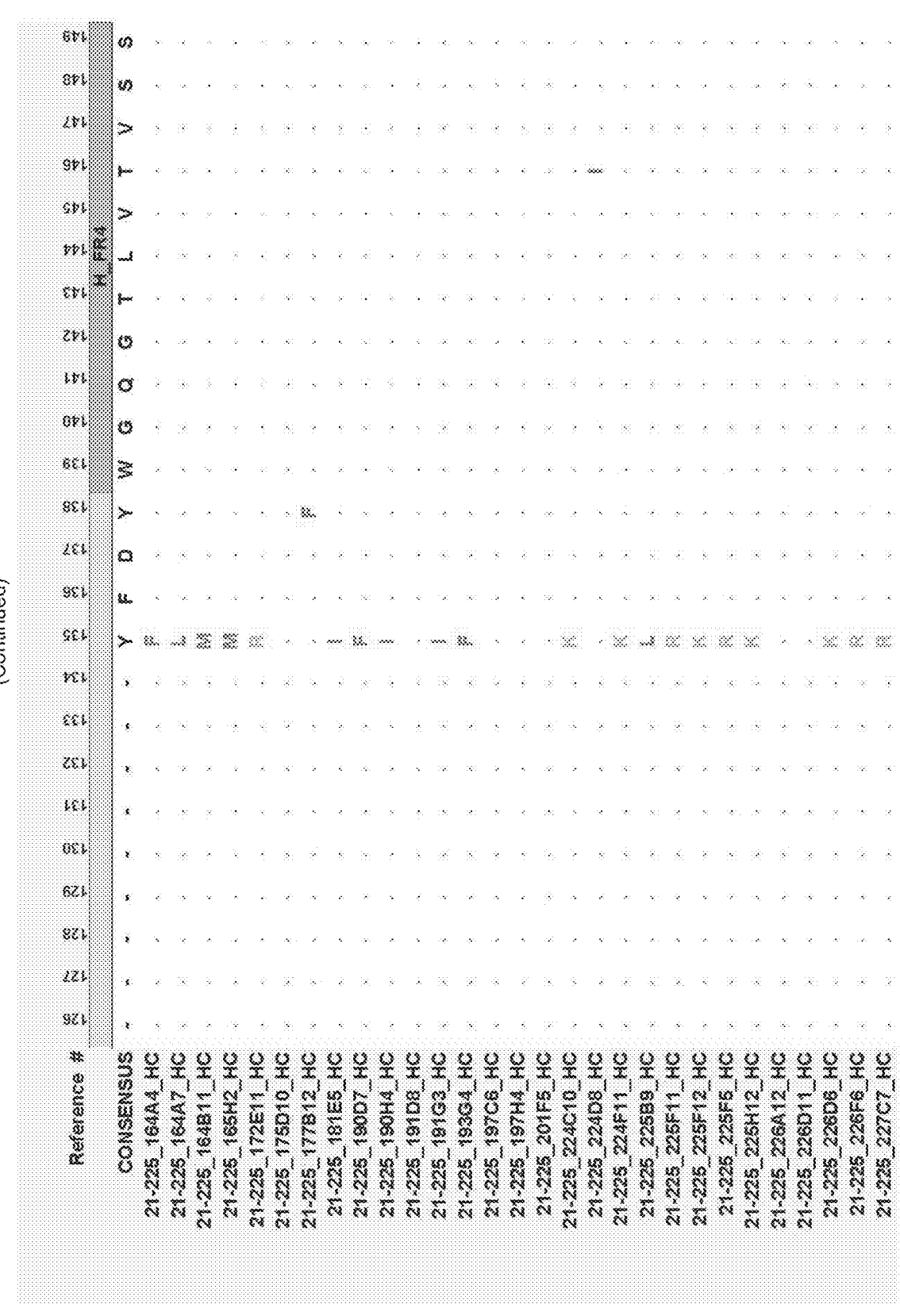
Figure 57:
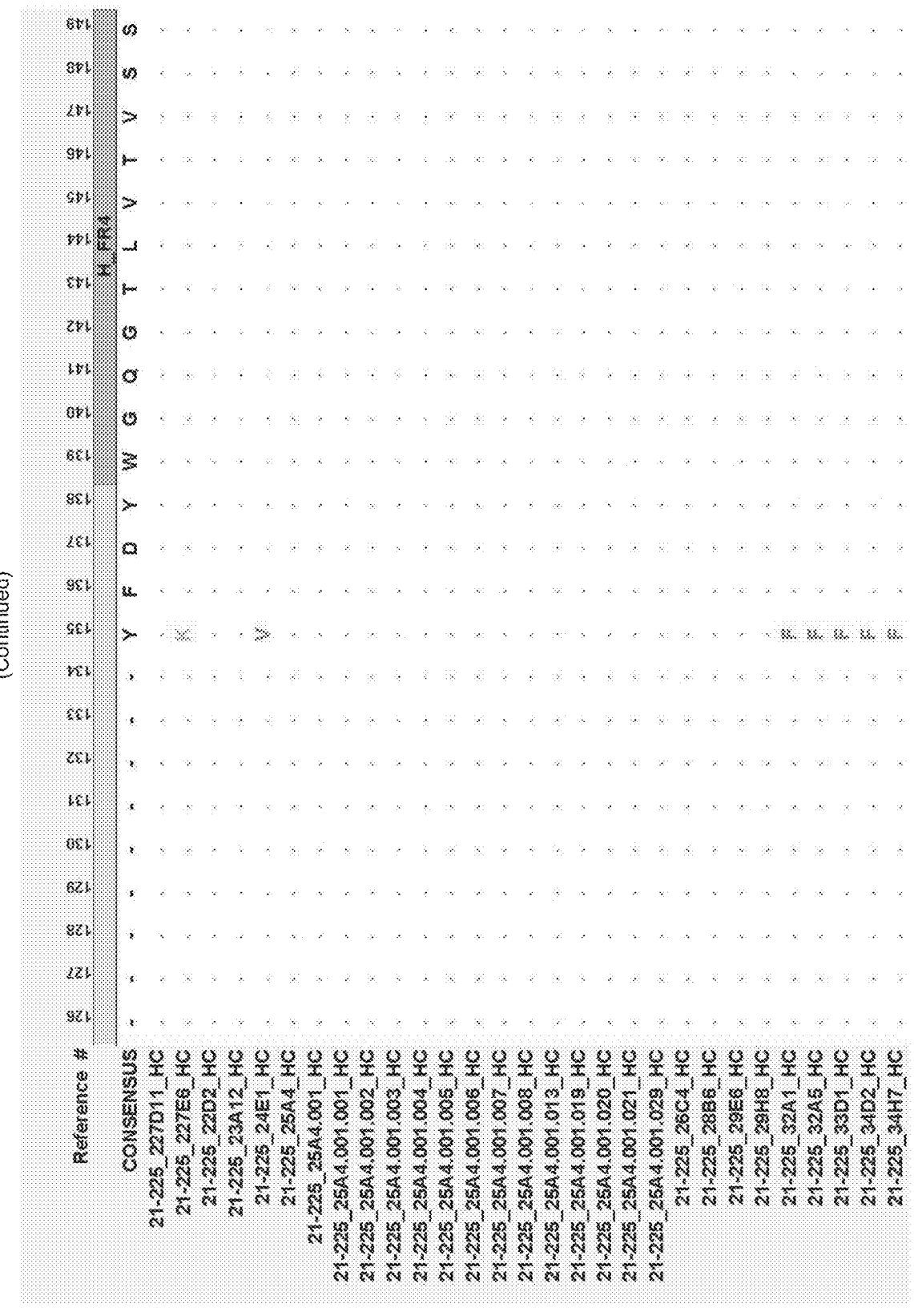
Figure 57:
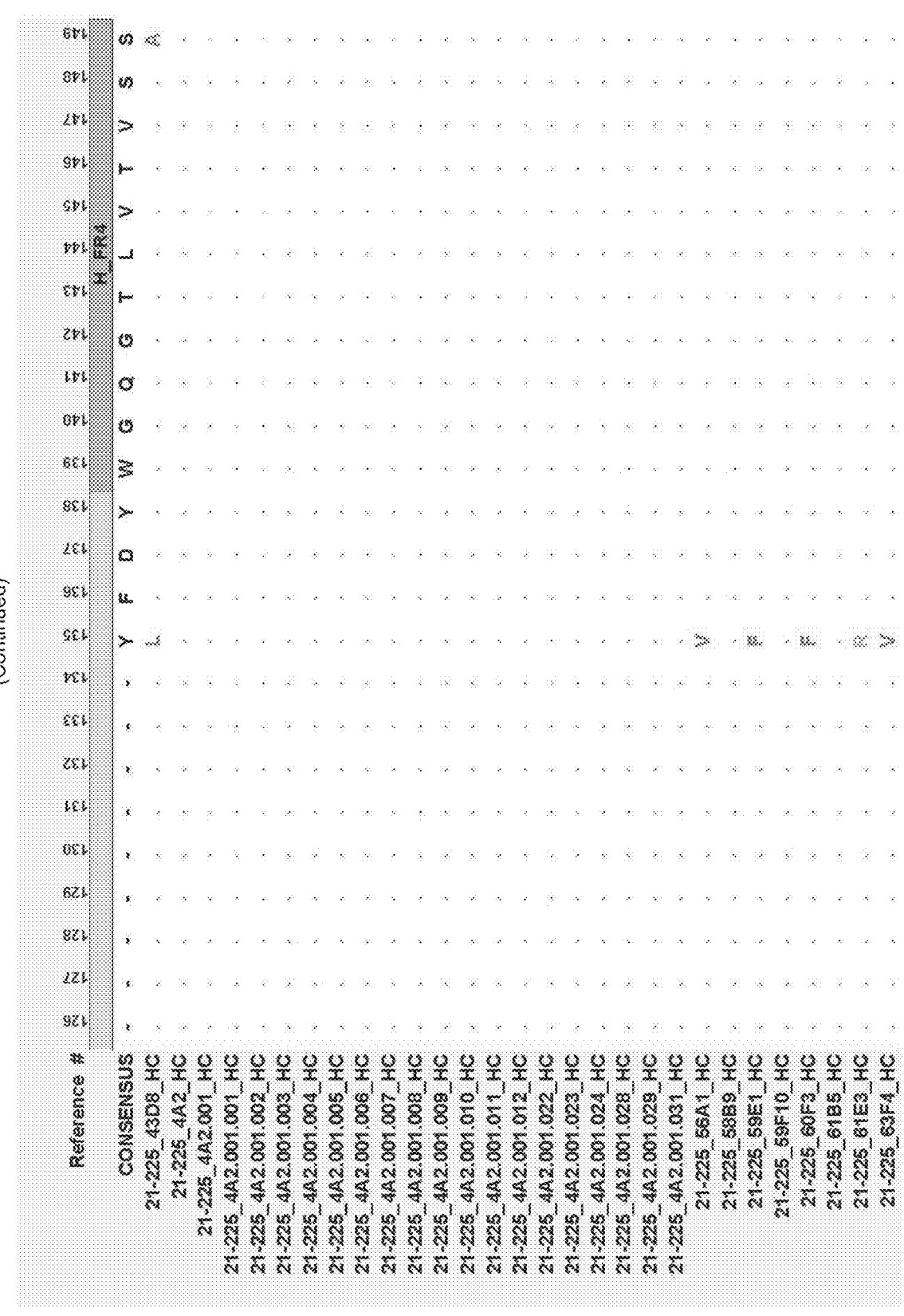
Figure 57:
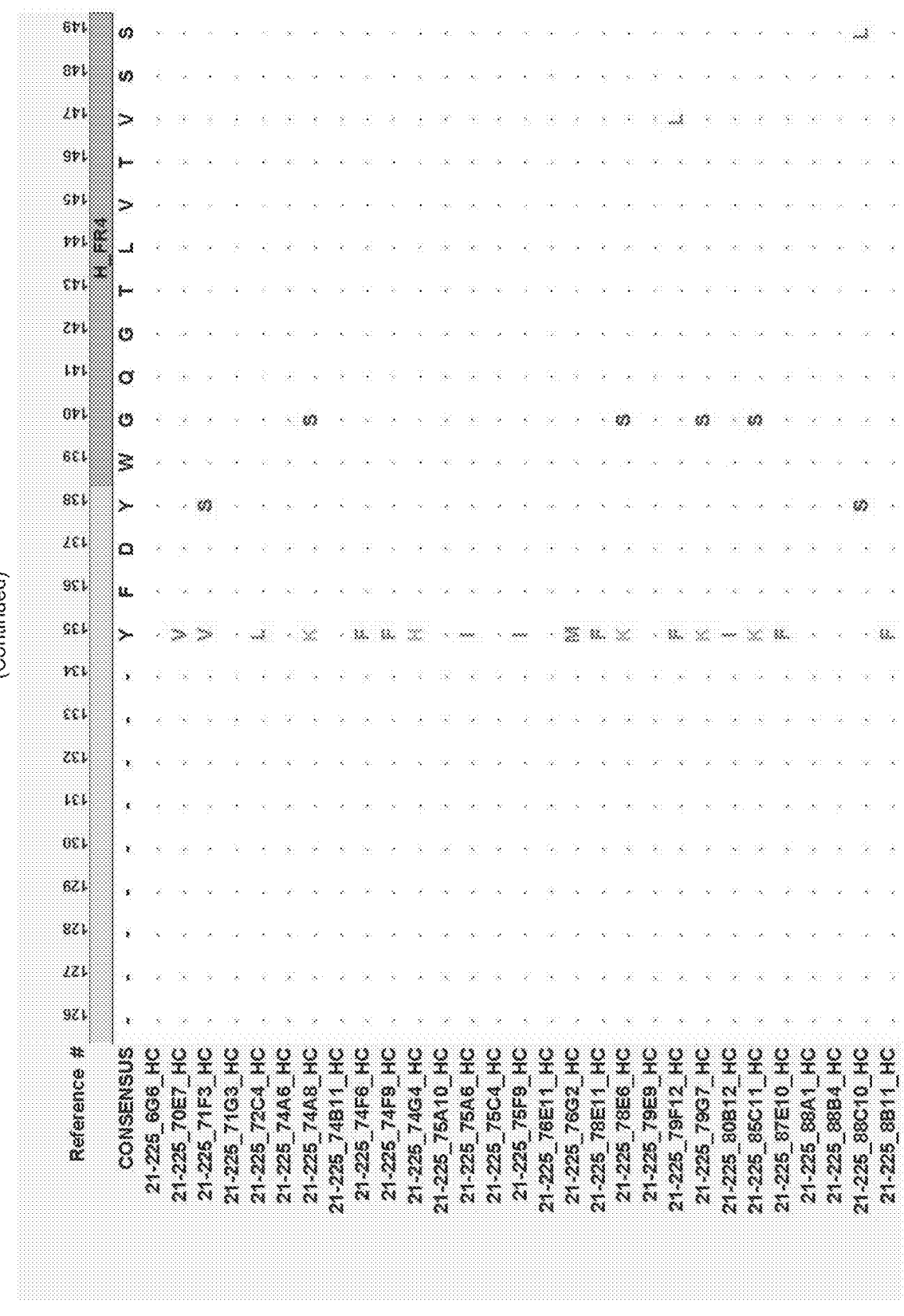
Figure 57:
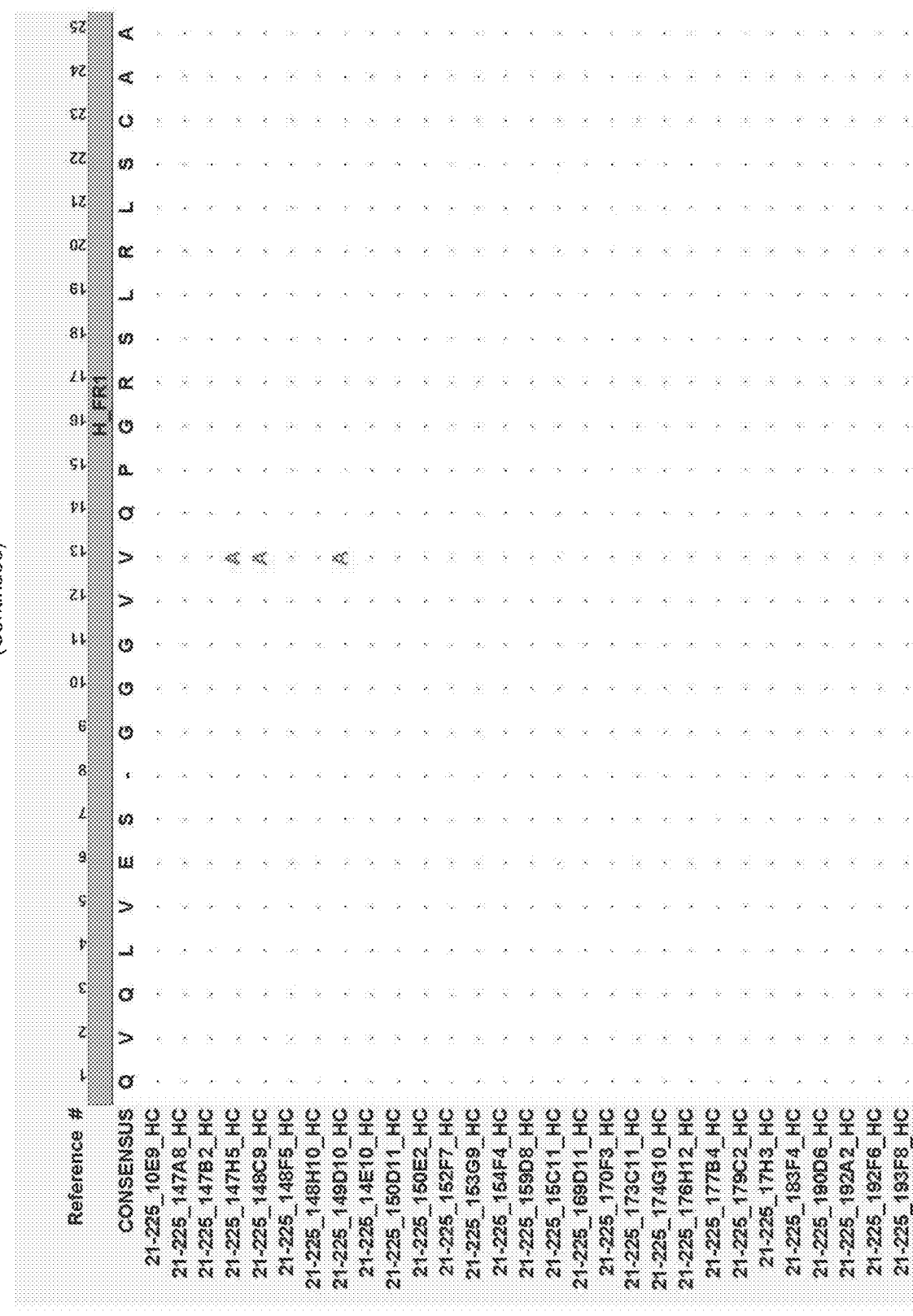
Figure 57:
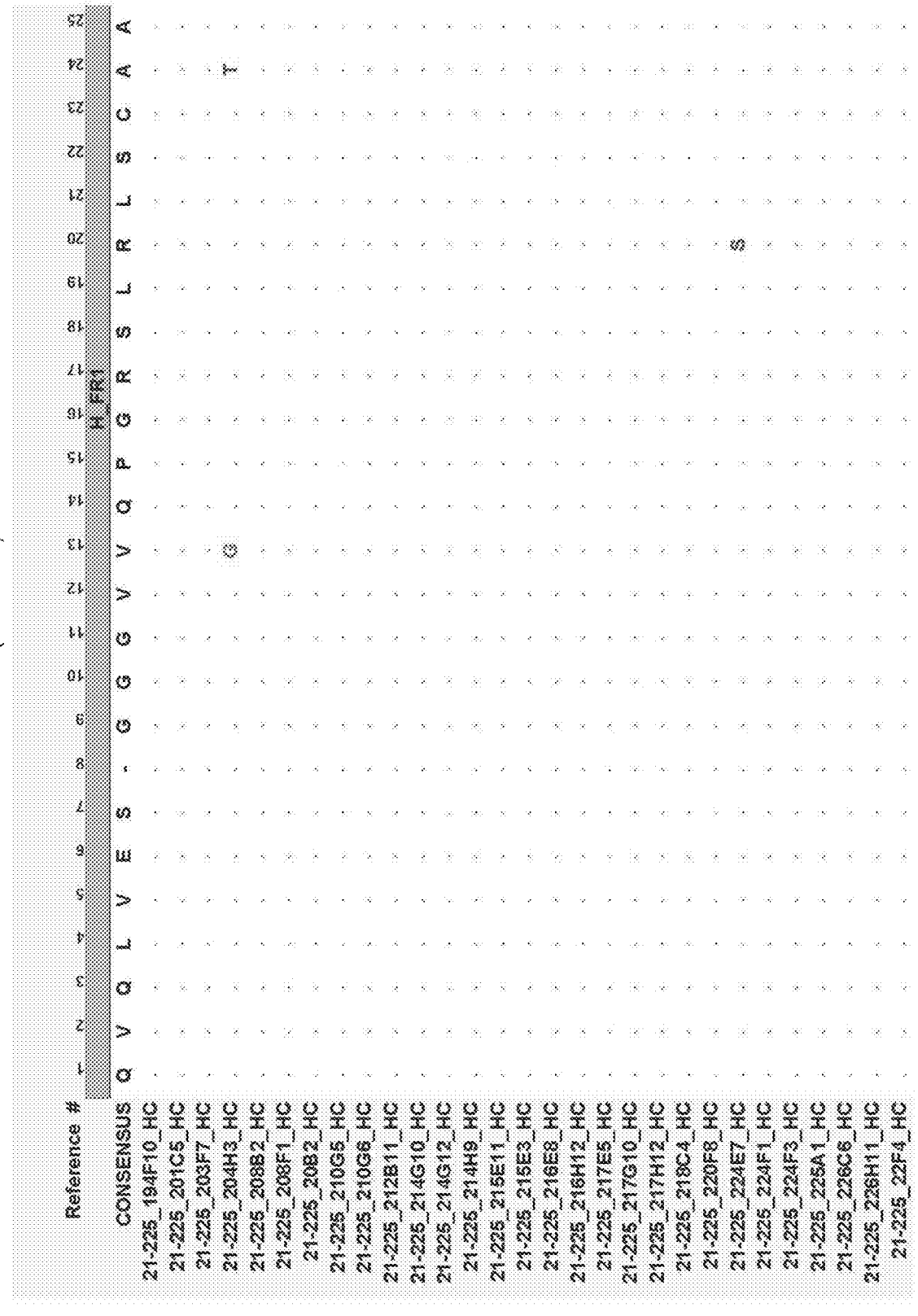
Figure 57:
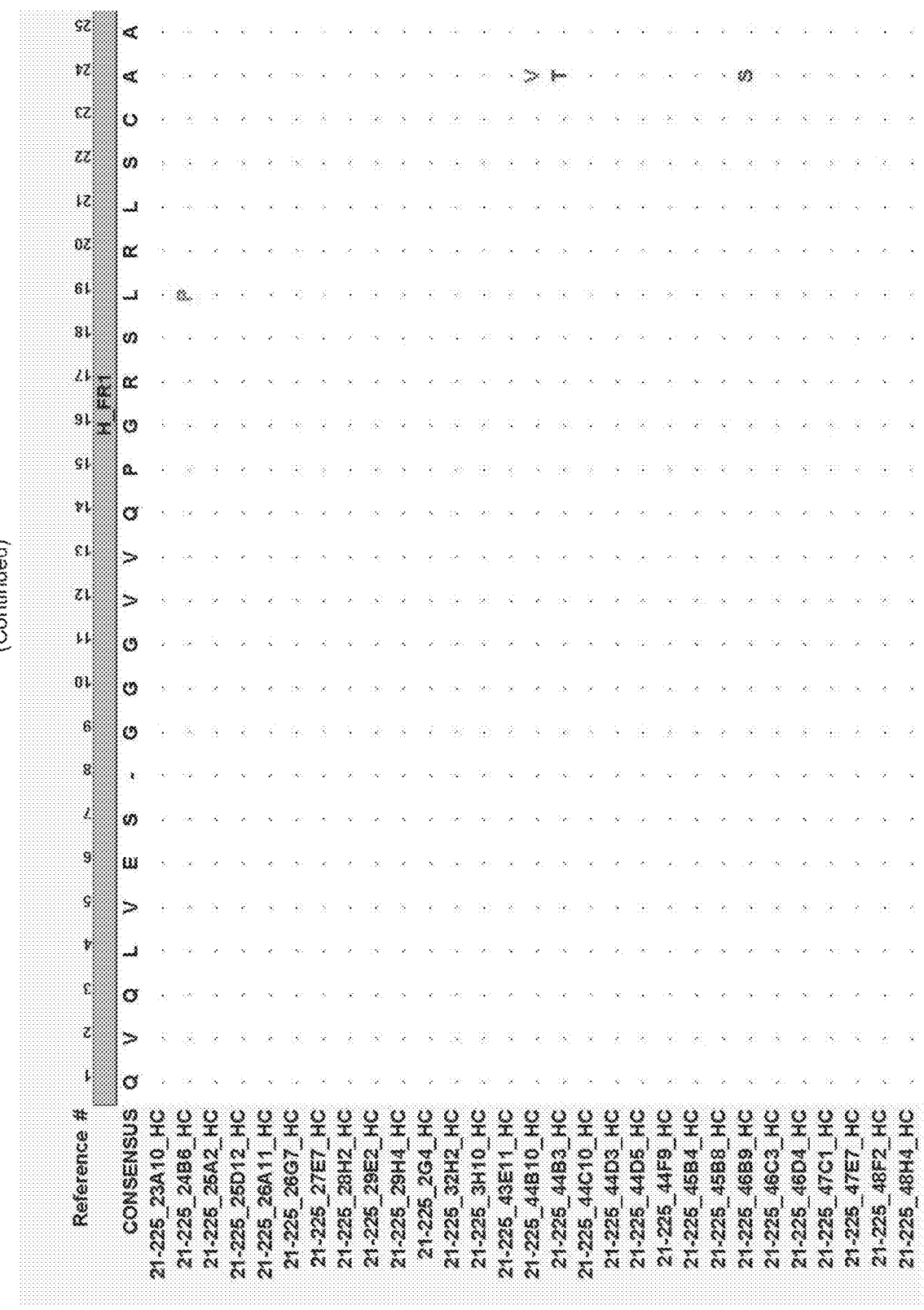
Figure 57:
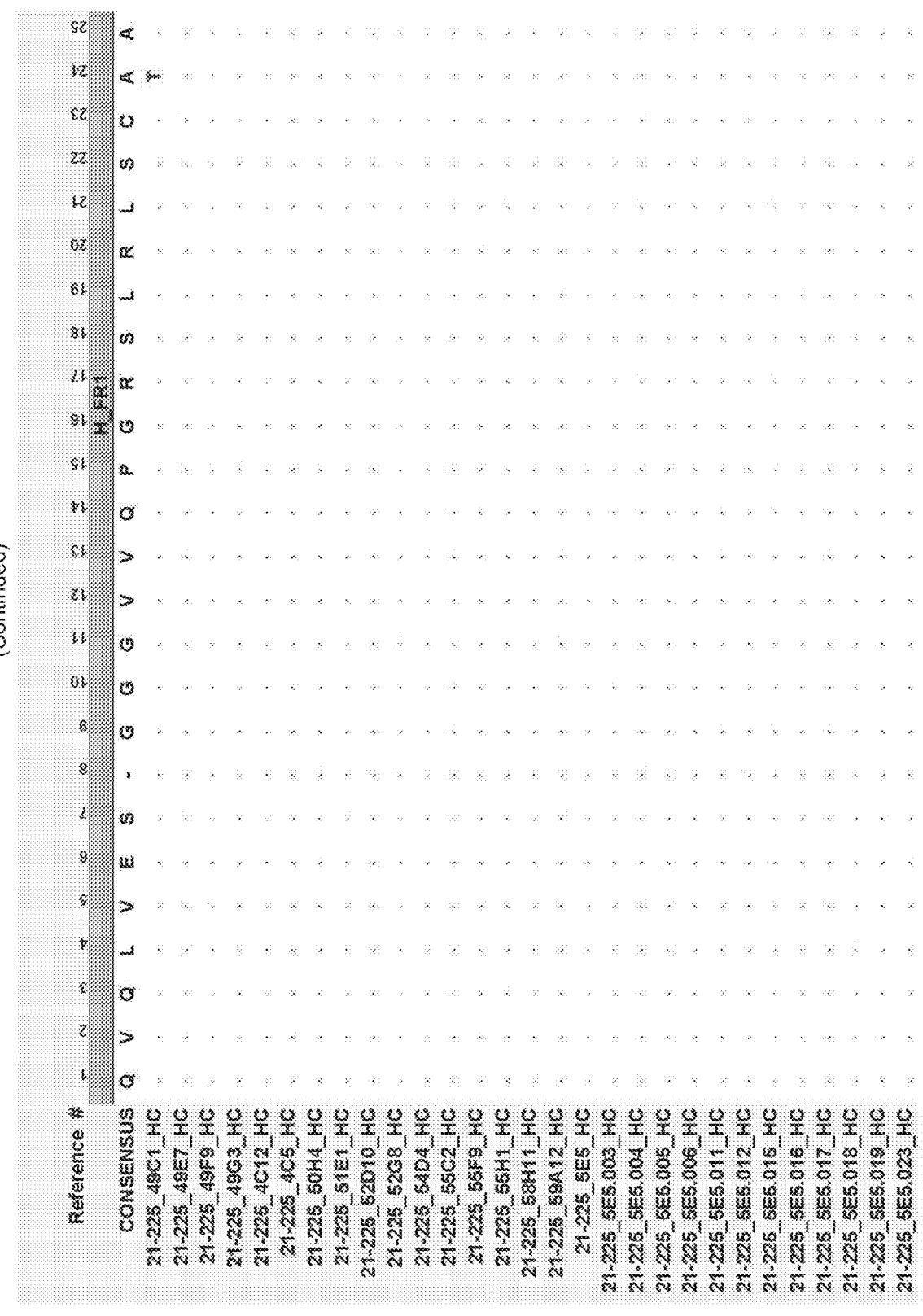
Figure 57:
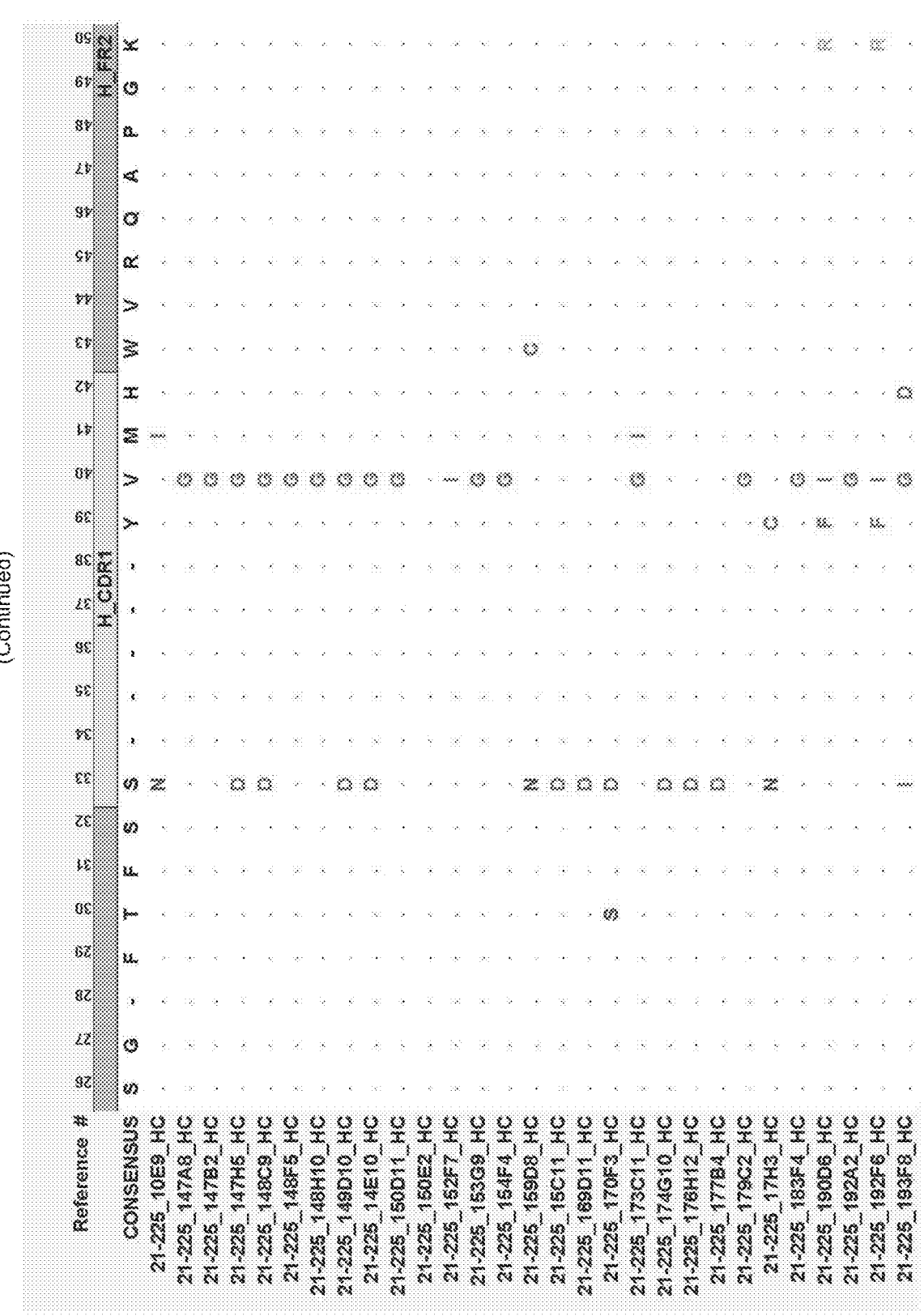
Figure 57:
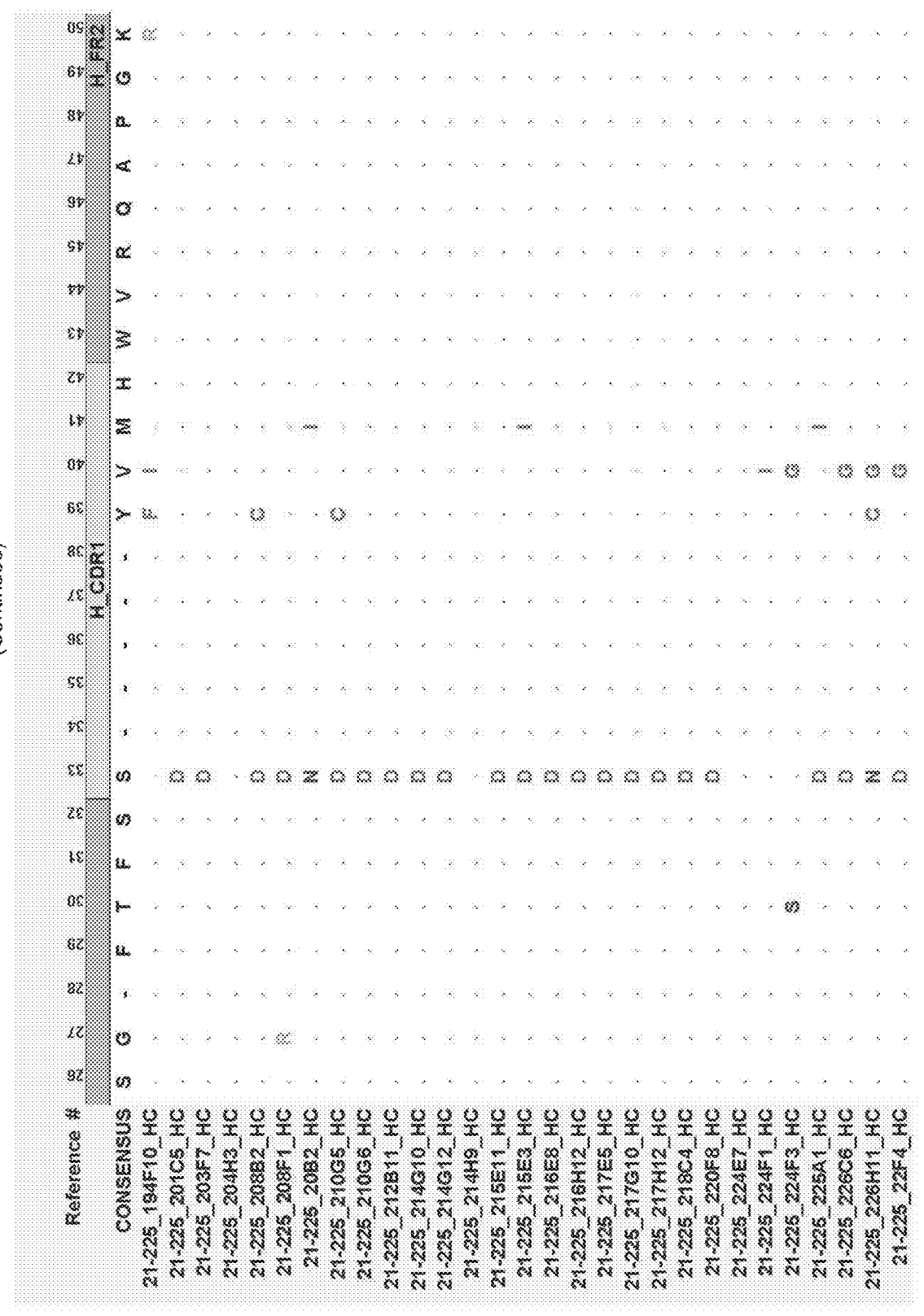
Figure 57:
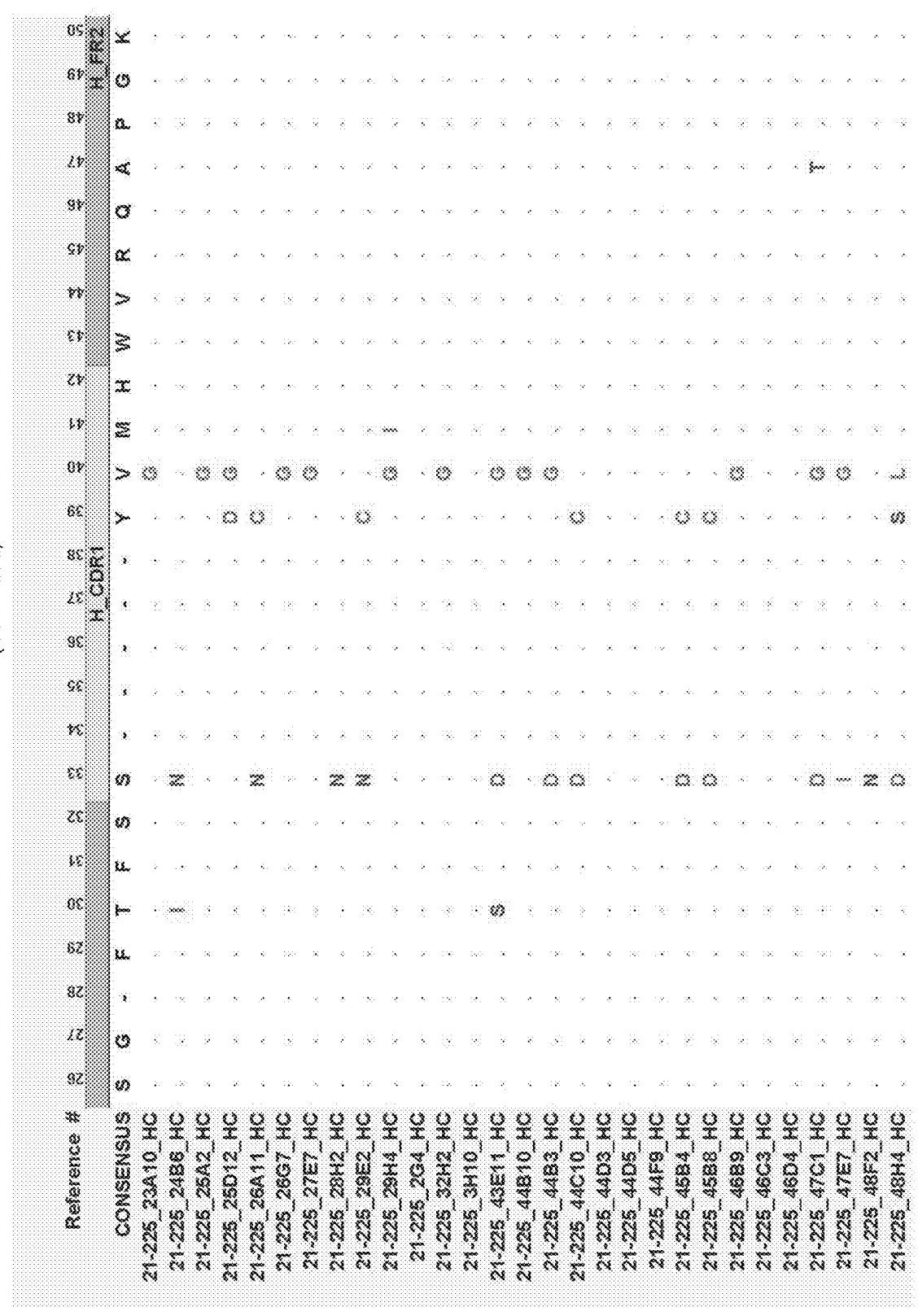
Figure 57:
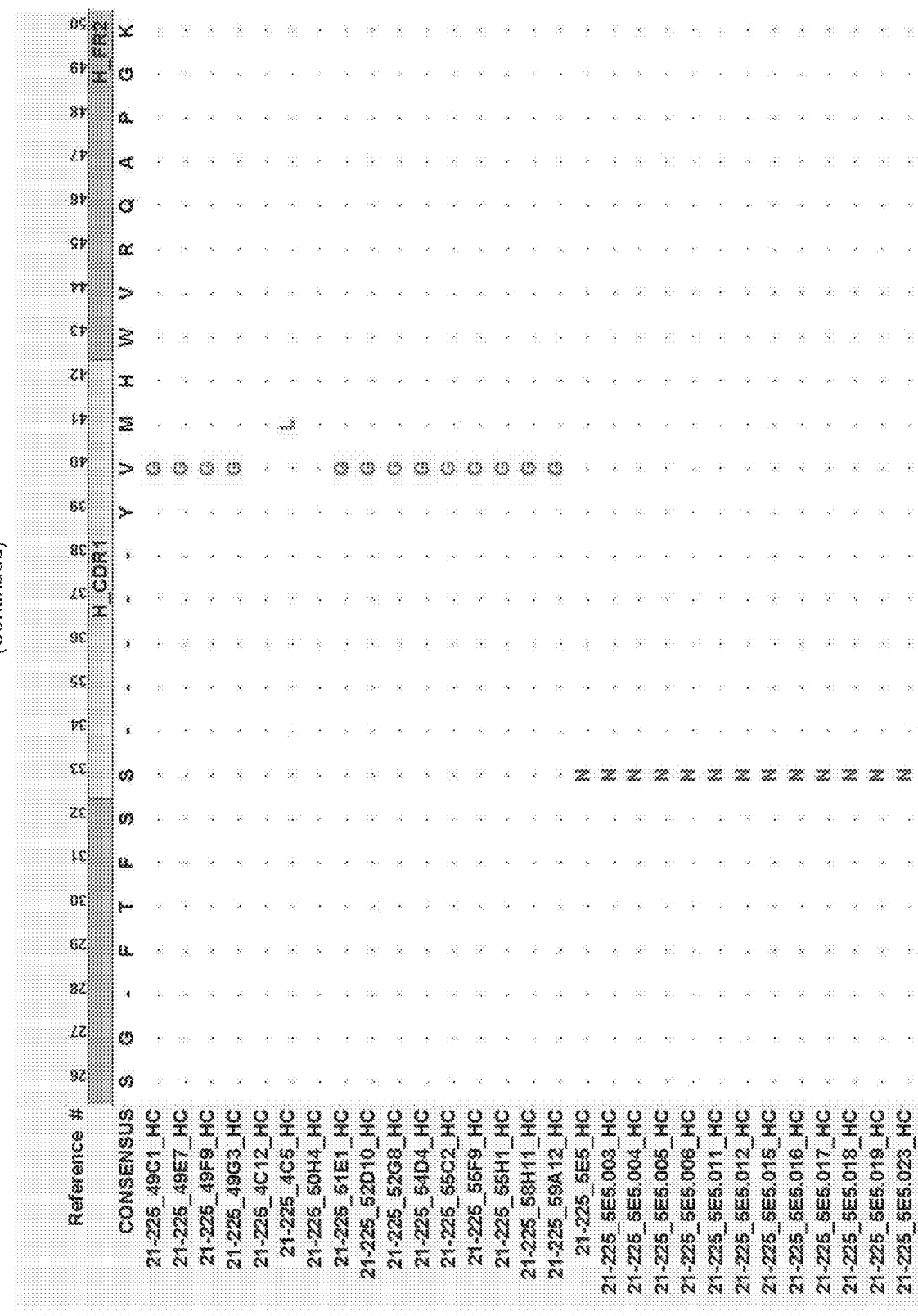
Figure 57:
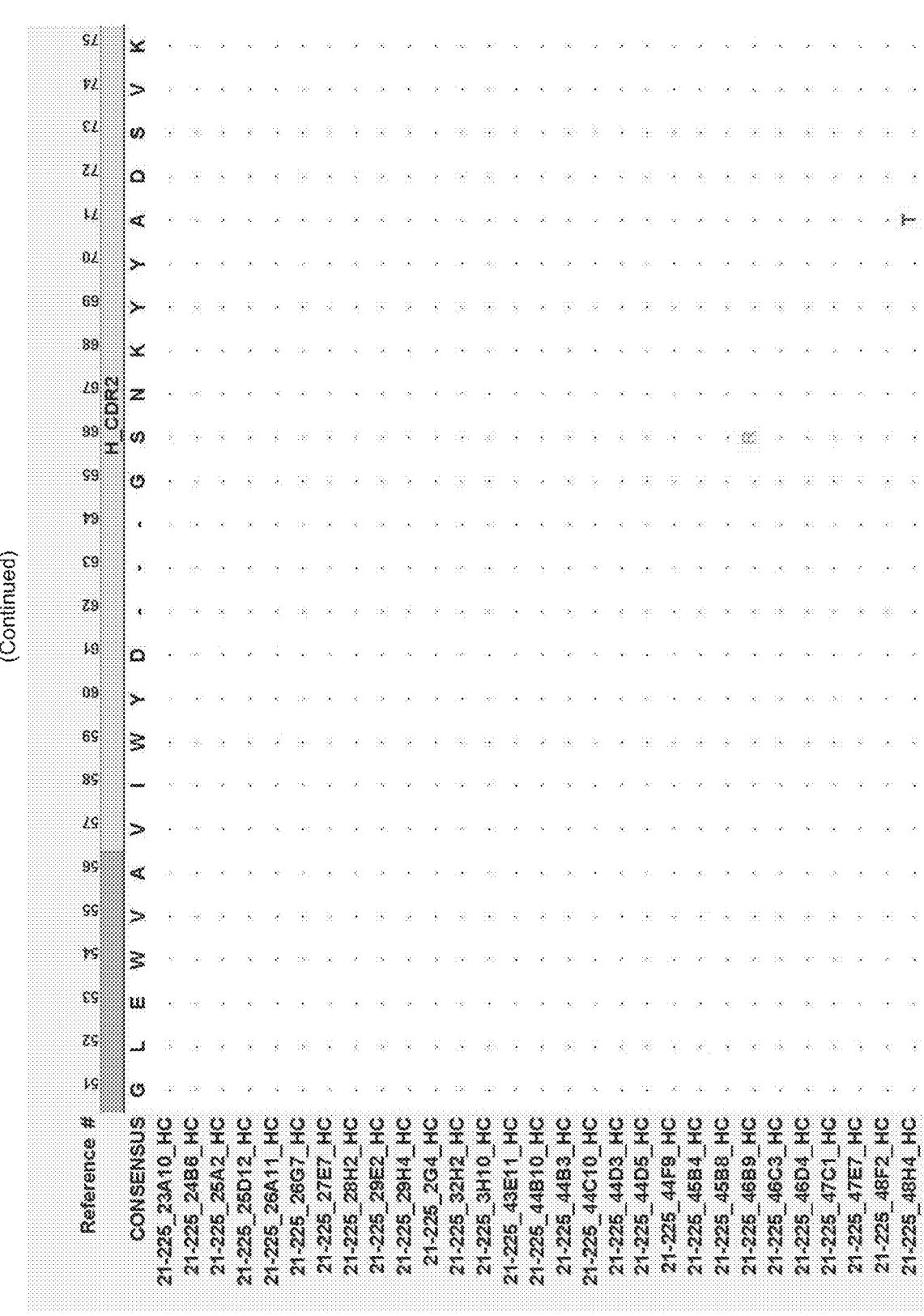
Figure 57:
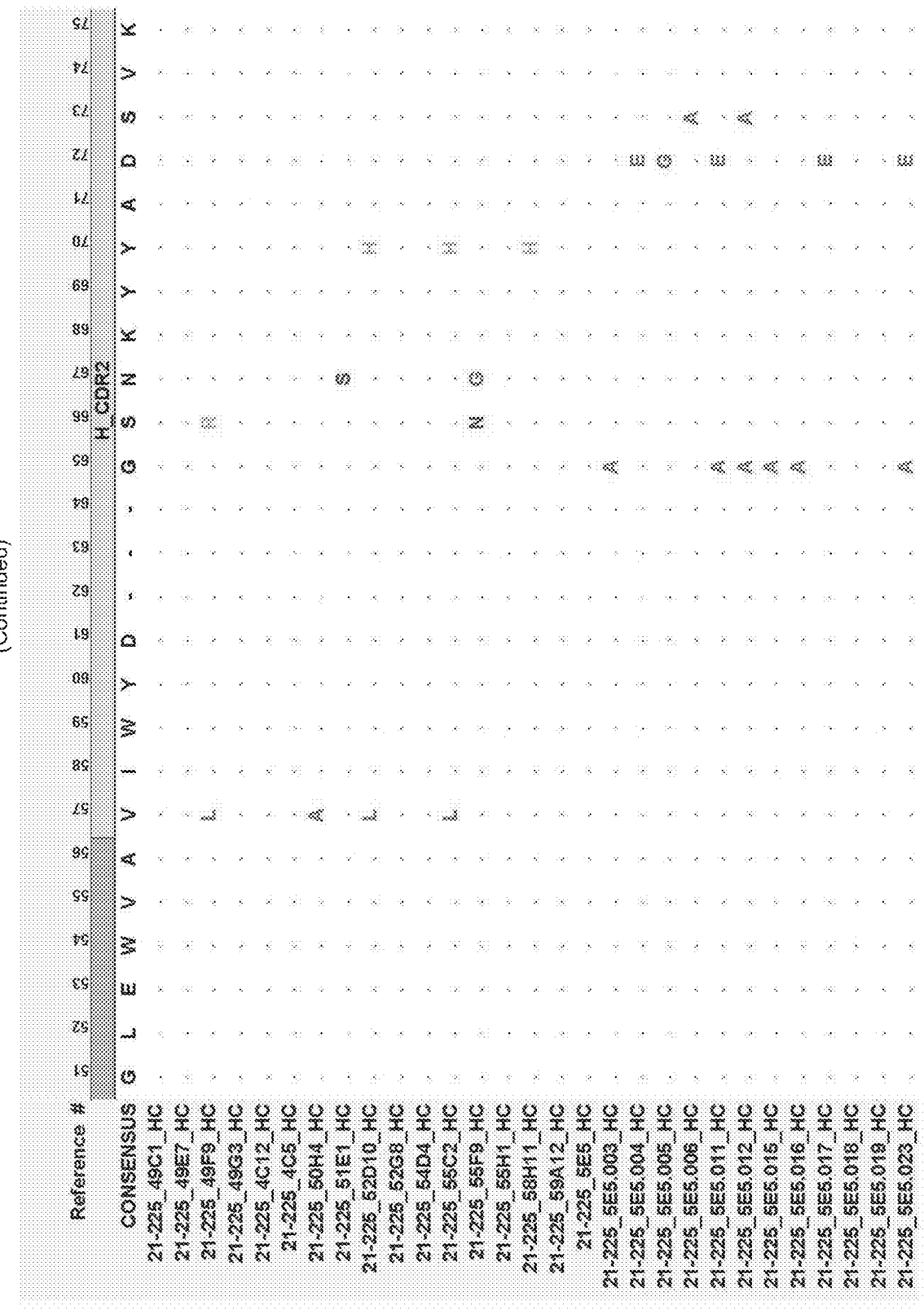
Figure 57:
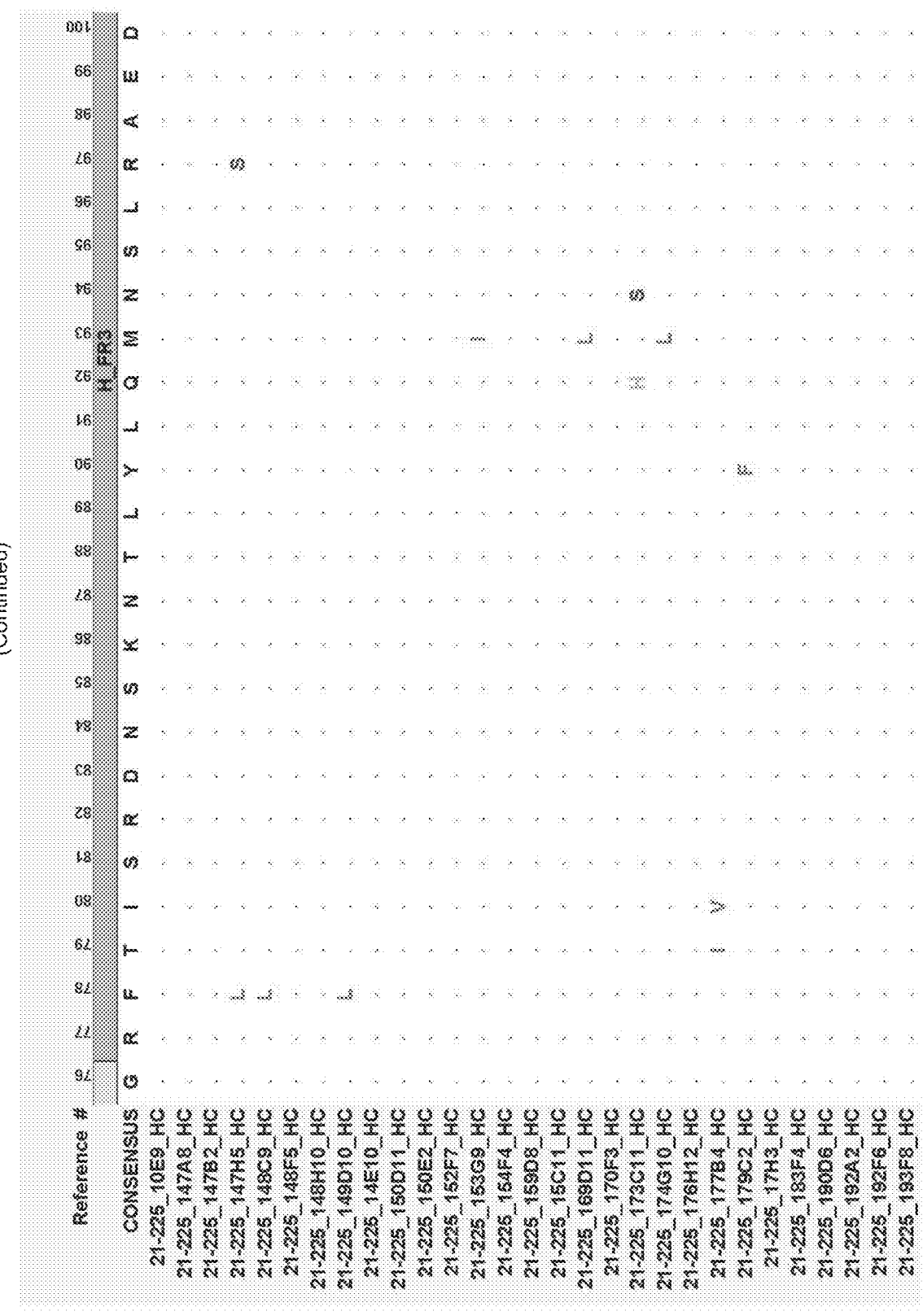
Figure 57:
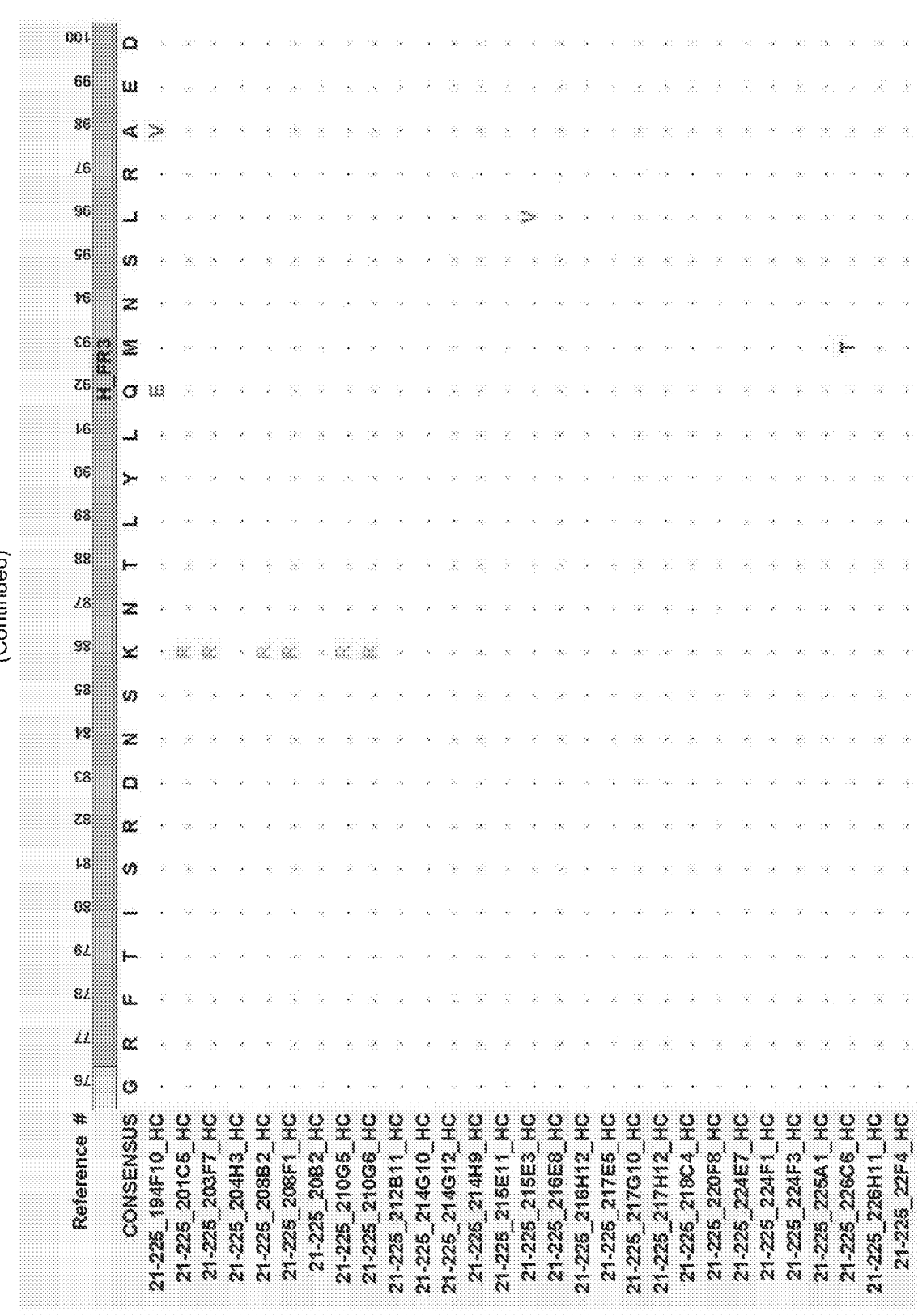
Figure 57:
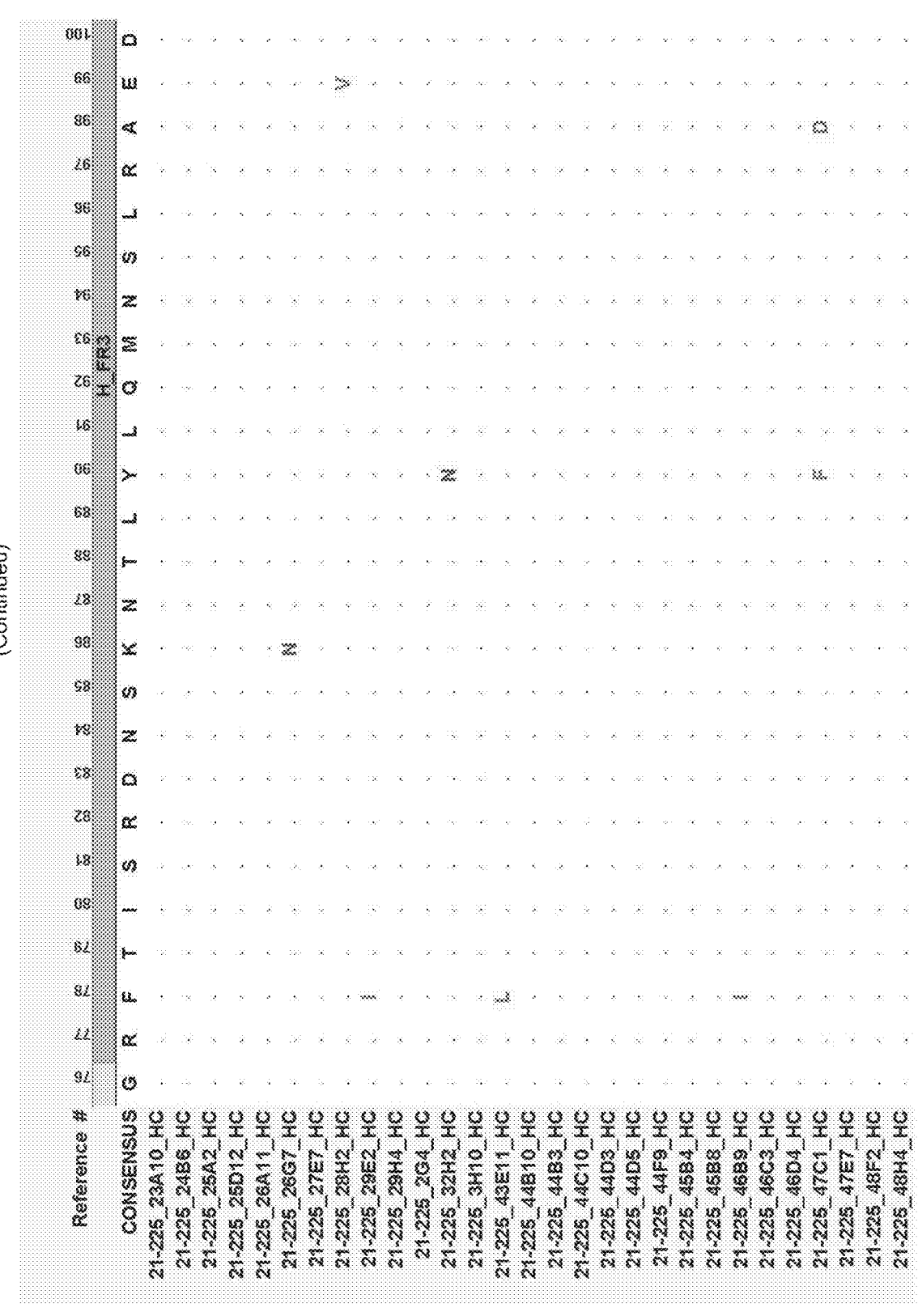
Figure 57:
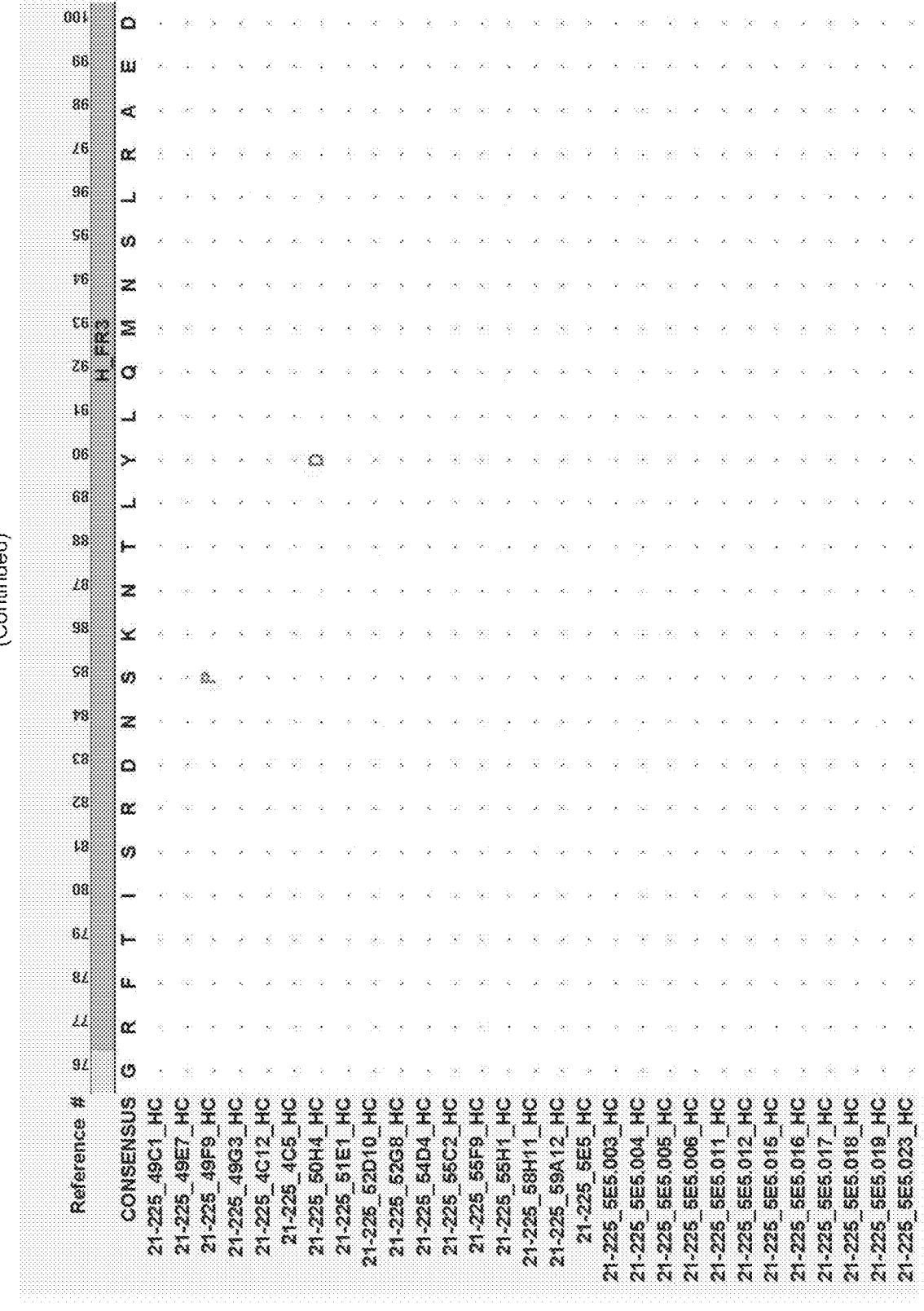
Figure 57:
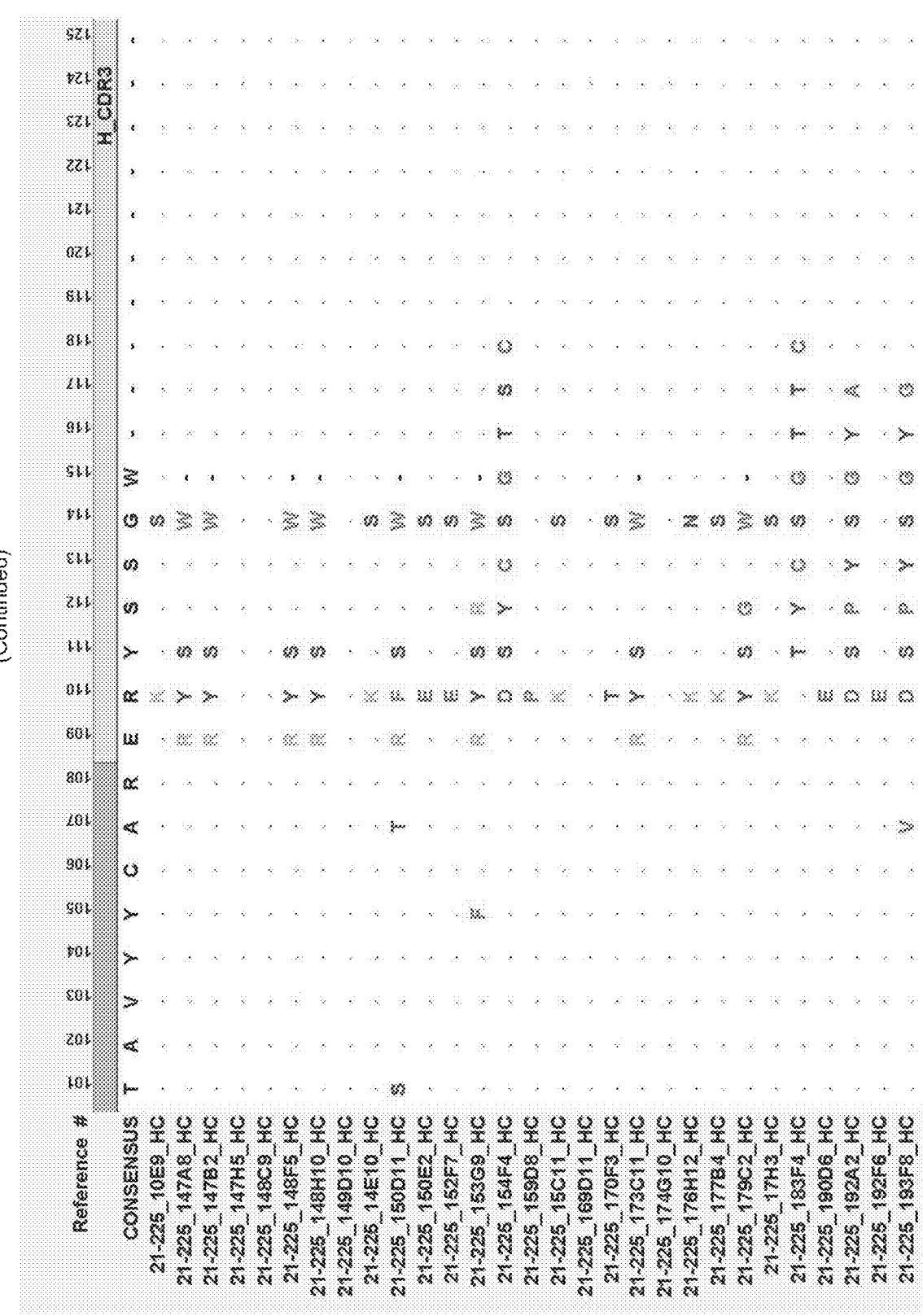
Figure 57:
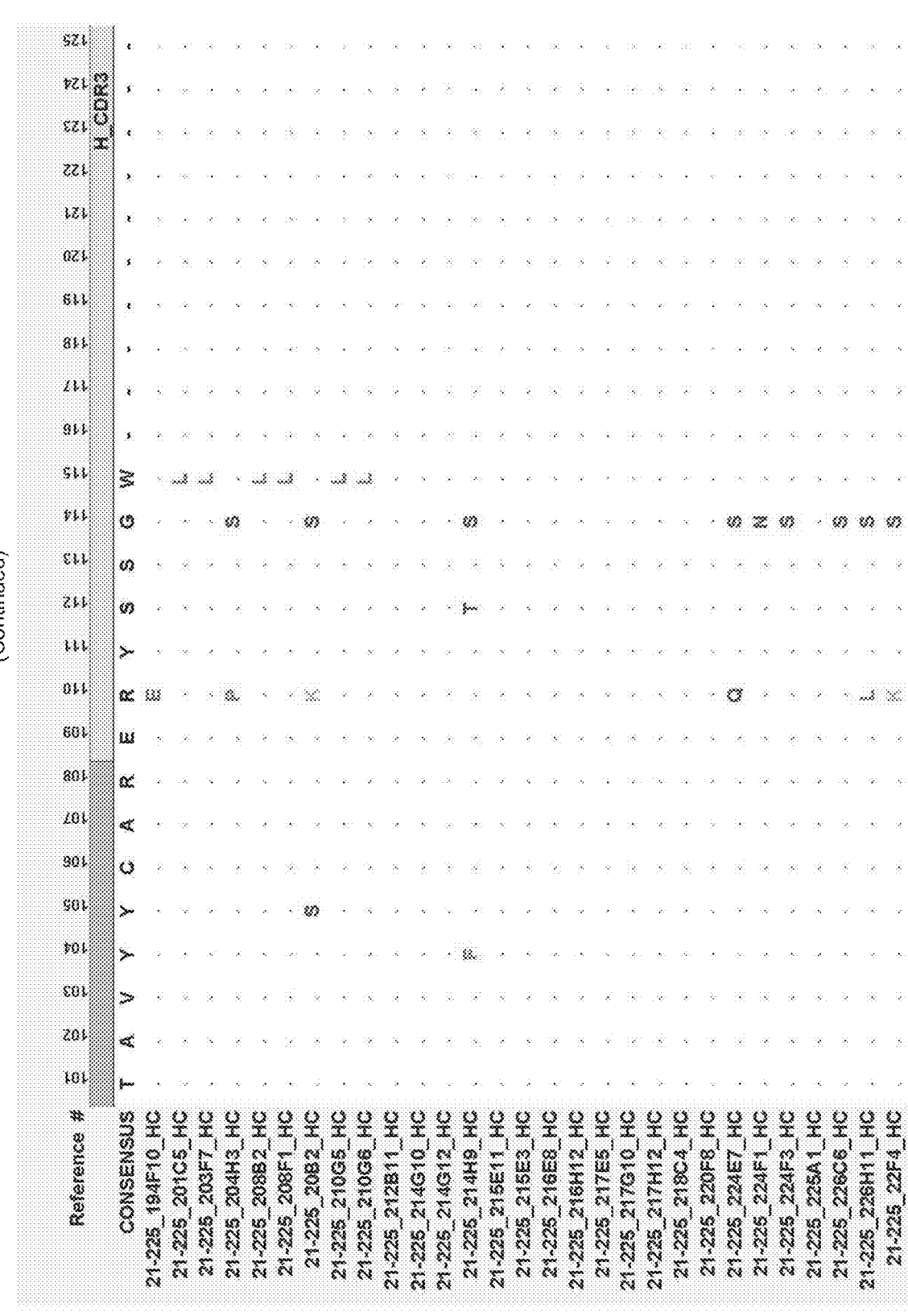
Figure 57:
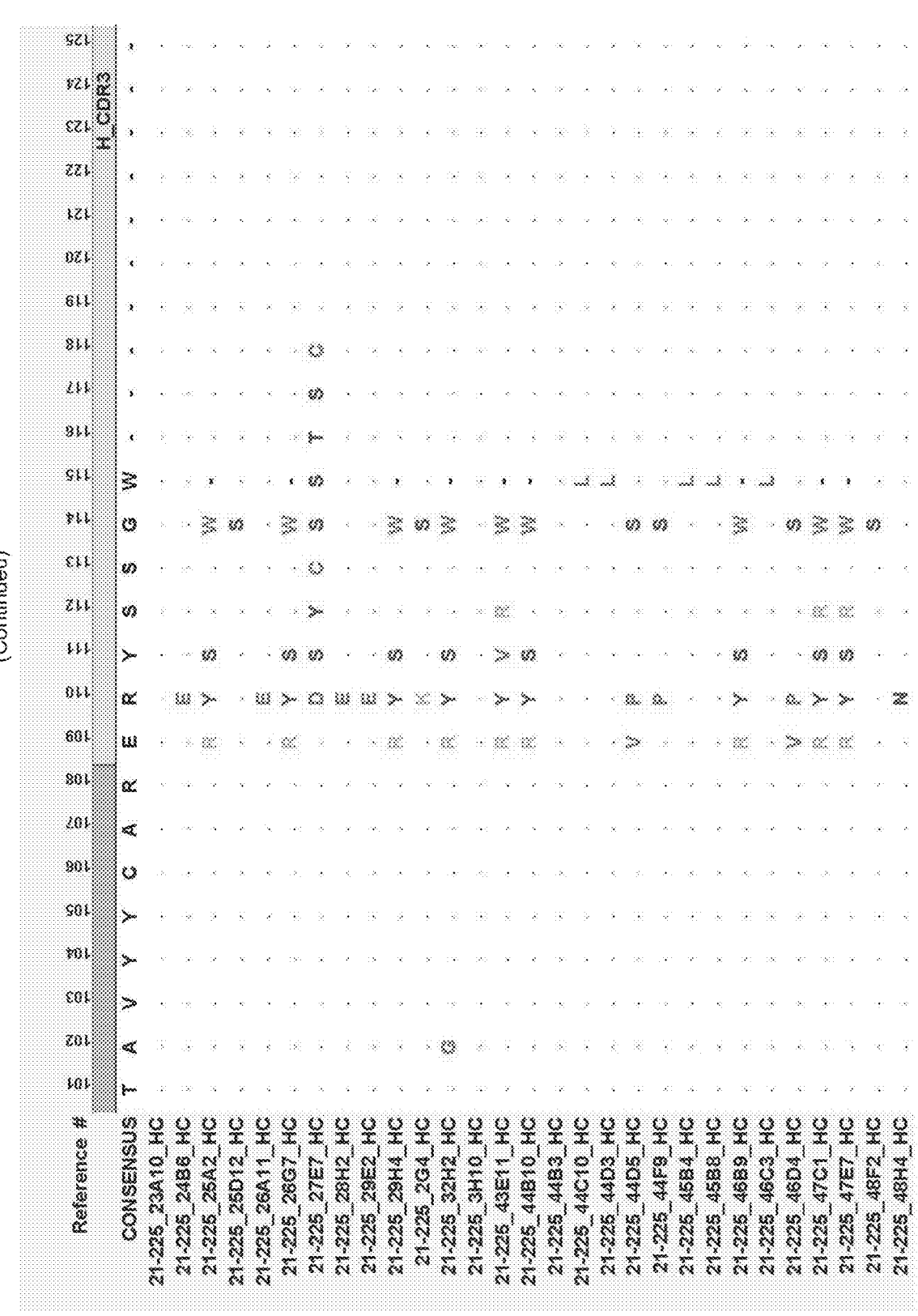
Figure 57:
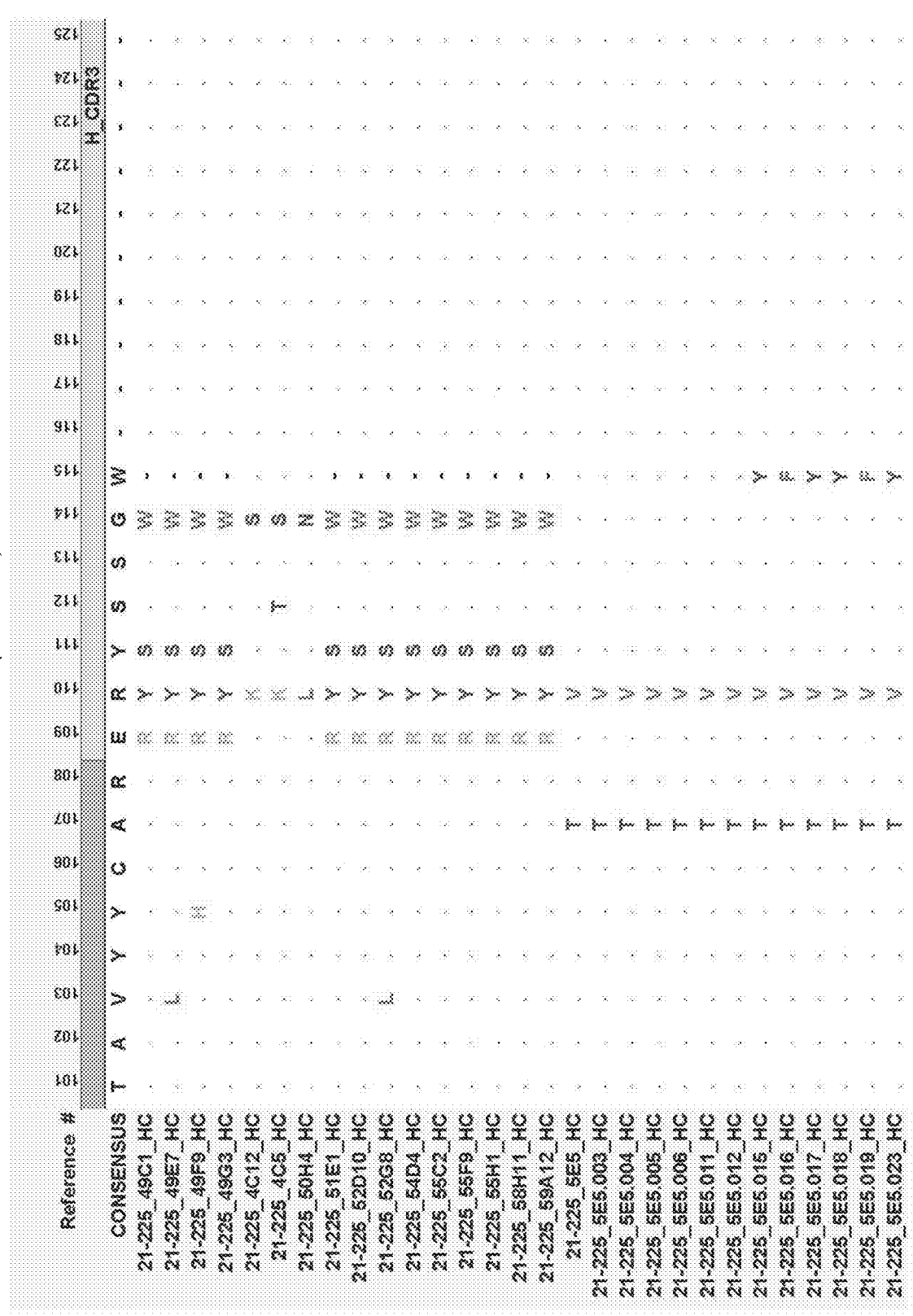
Figure 57:
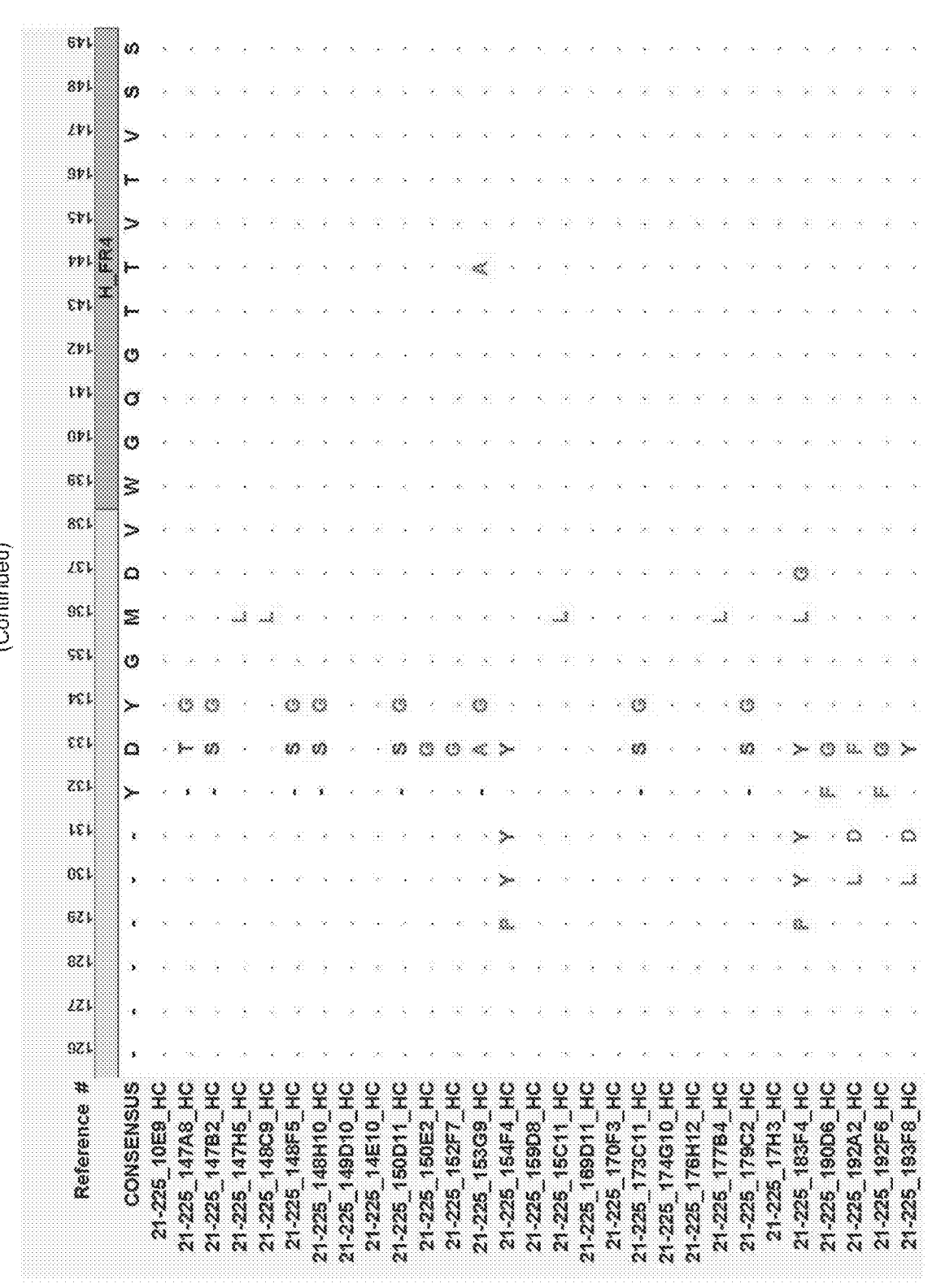
Figure 57:
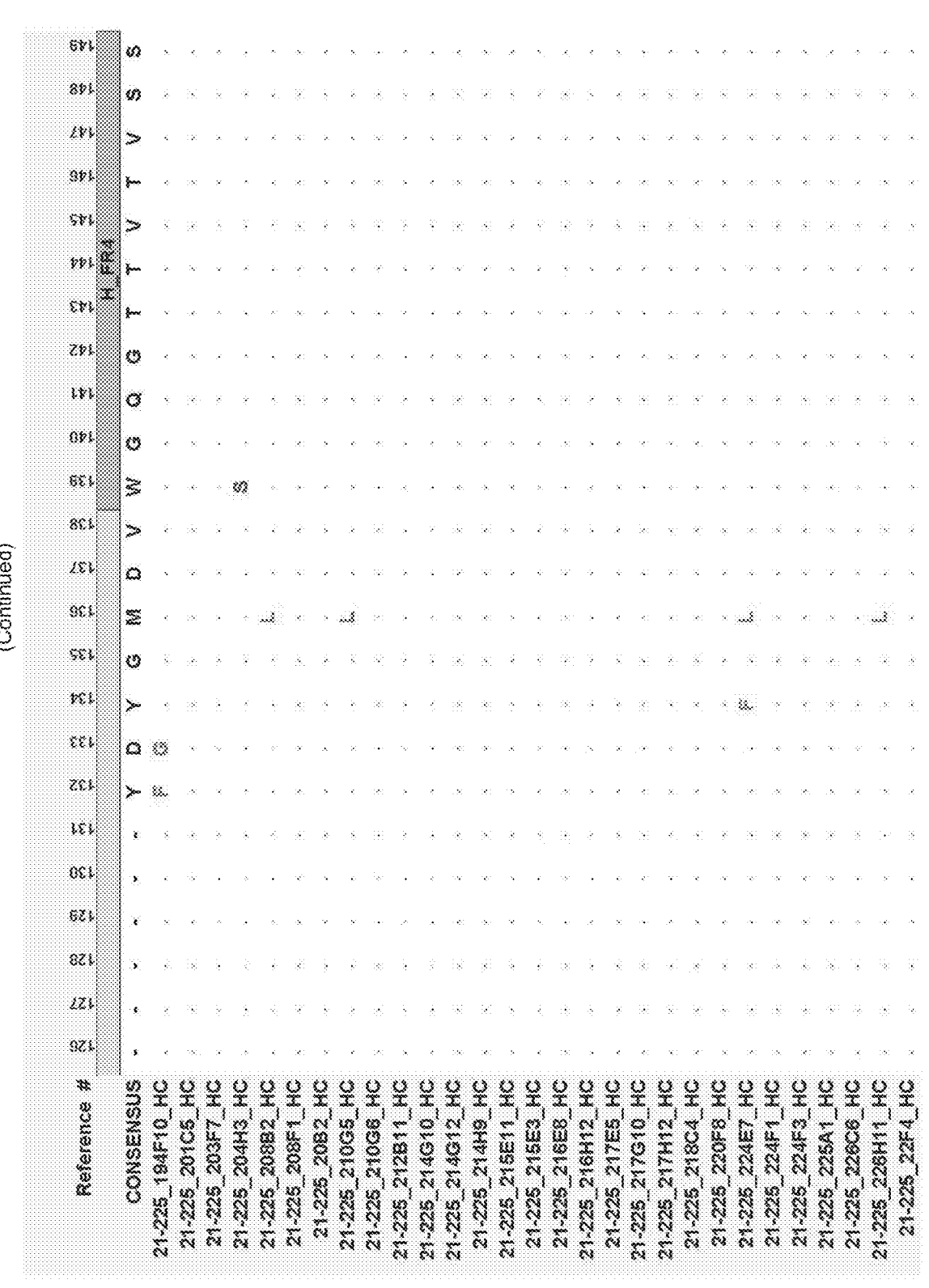
Figure 57:
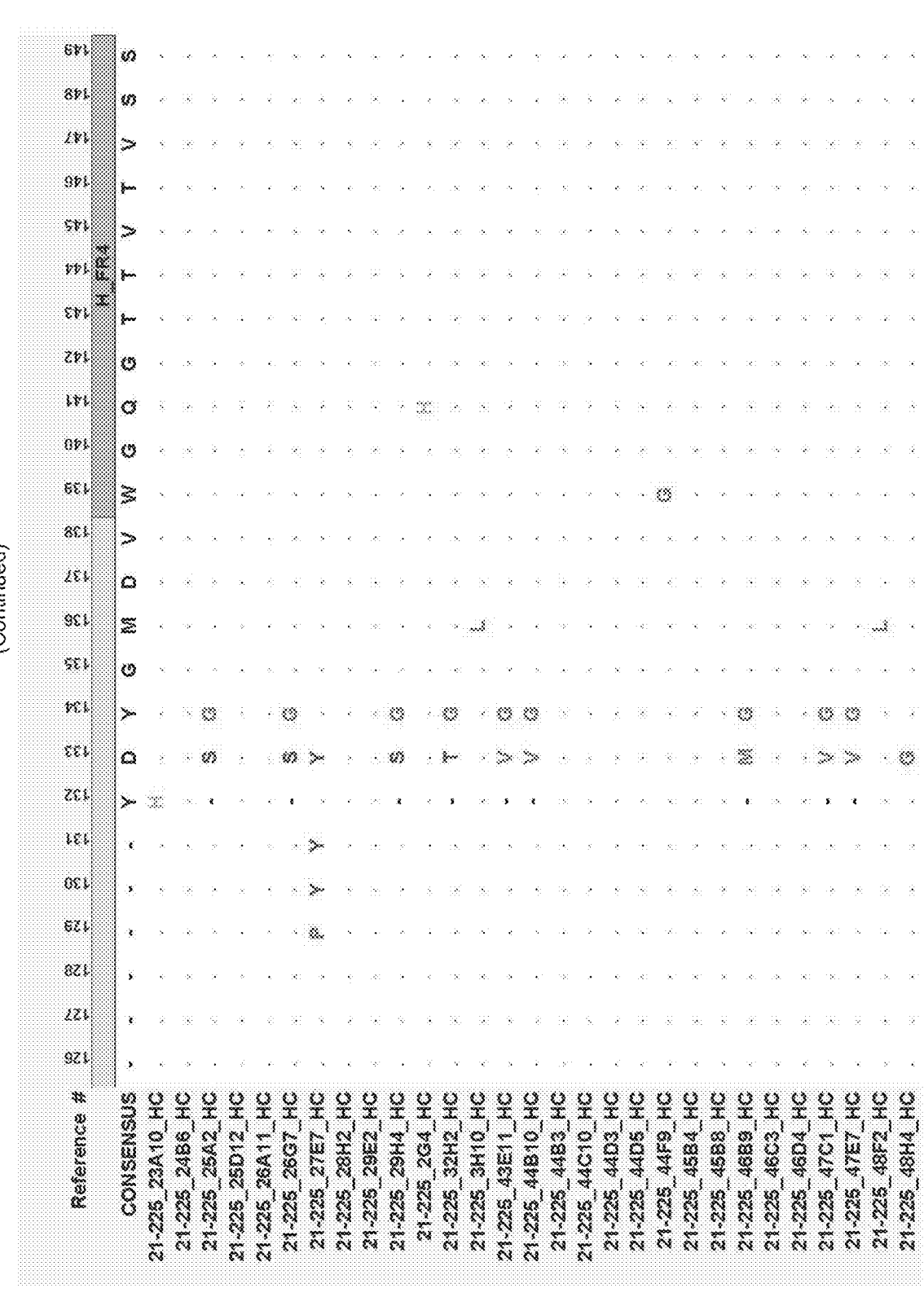
Figure 57:
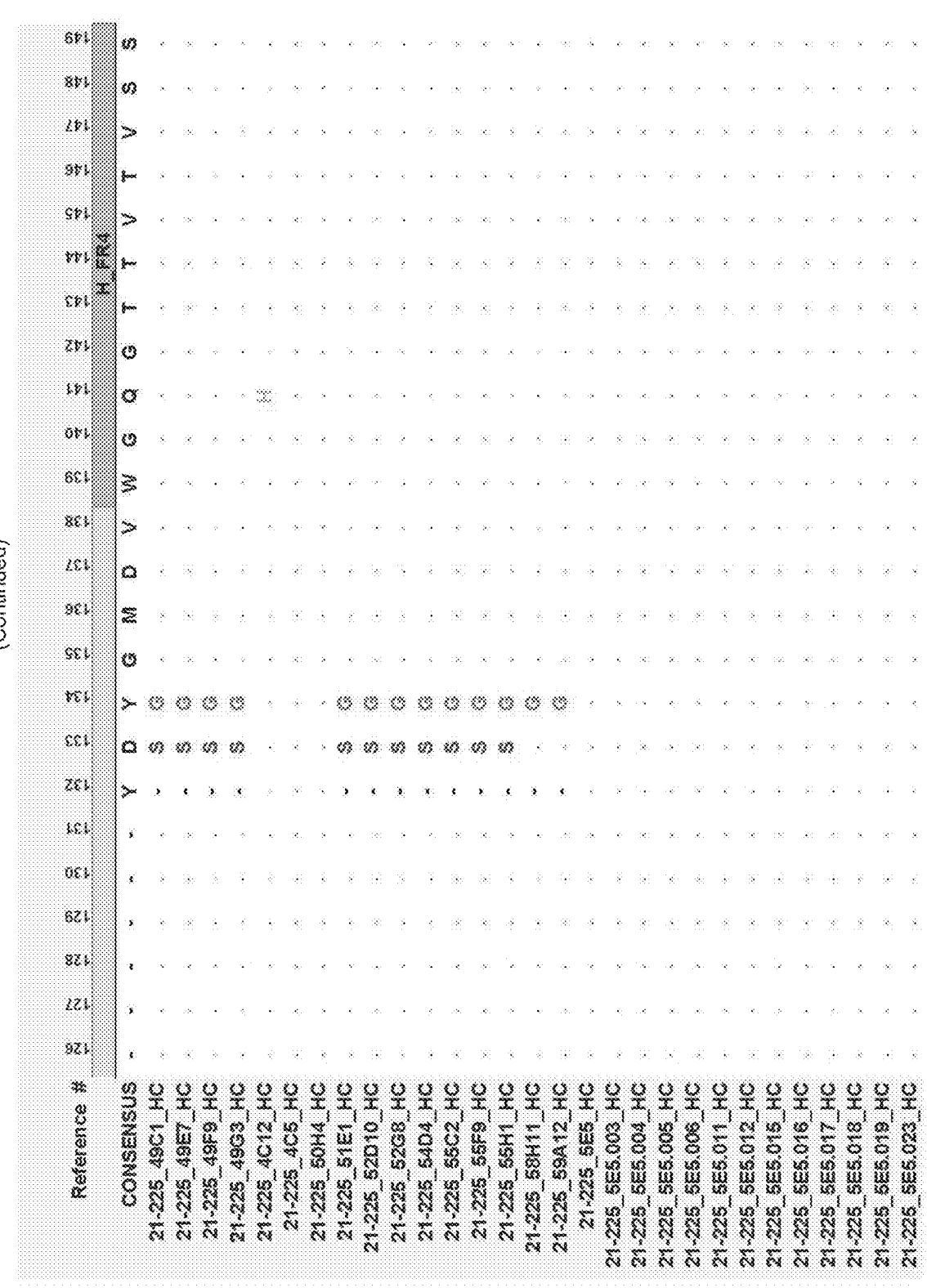
Figure 57:
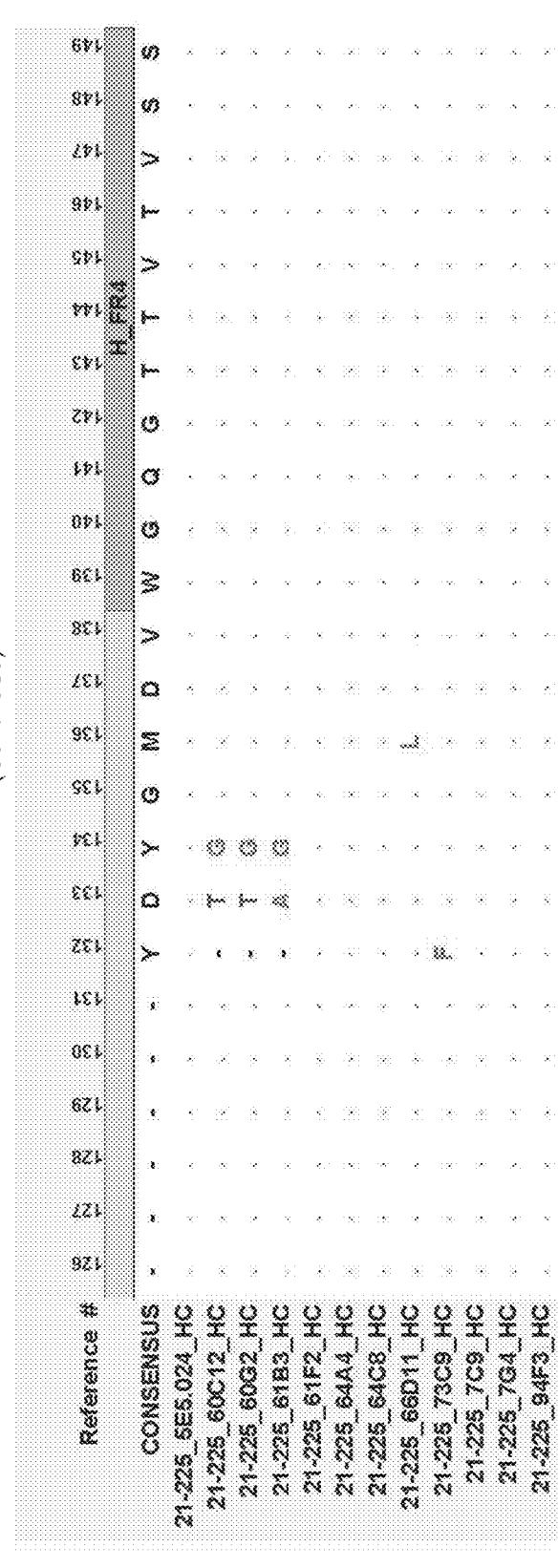
Figure 57:
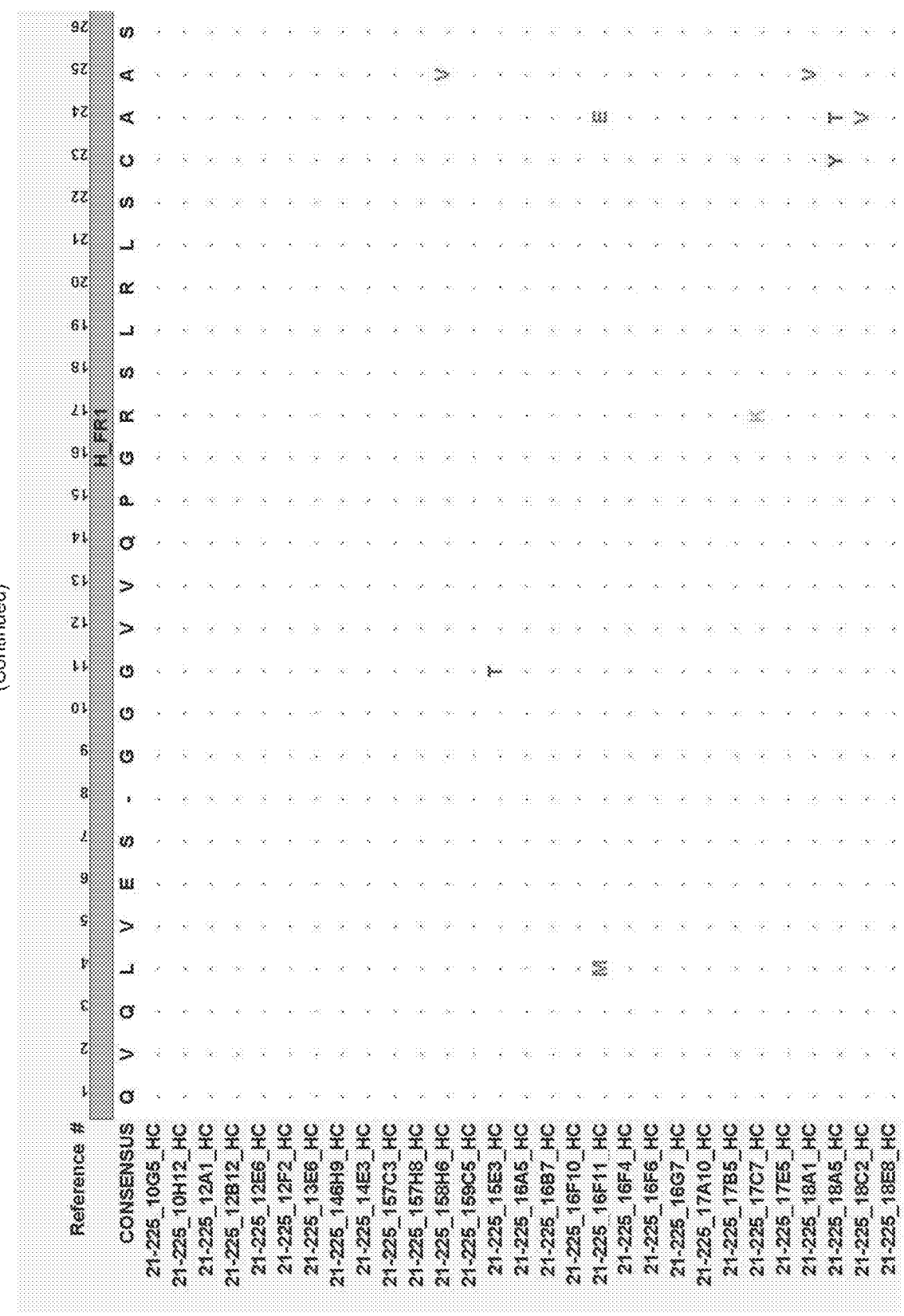
Figure 57:
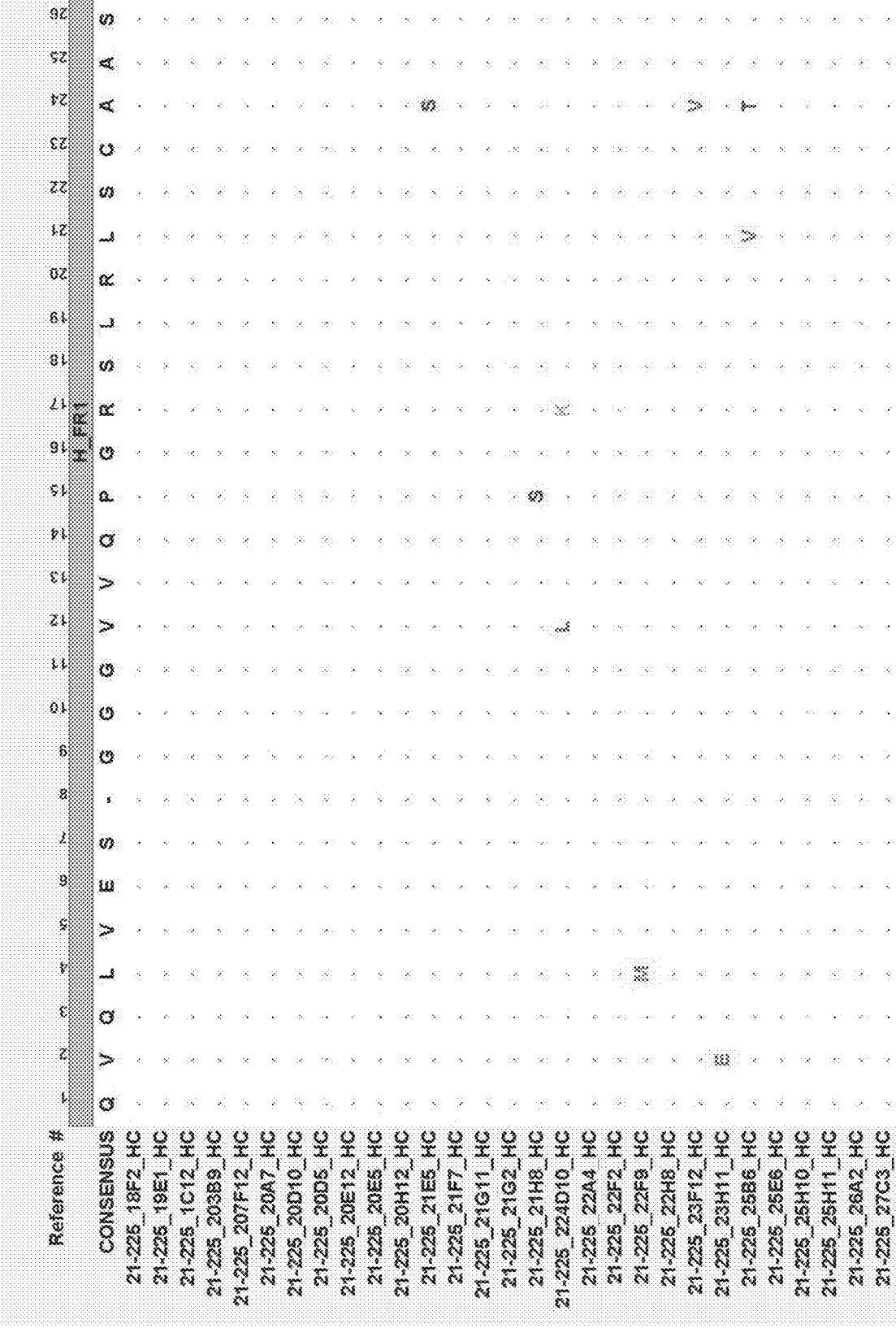
Figure 57:
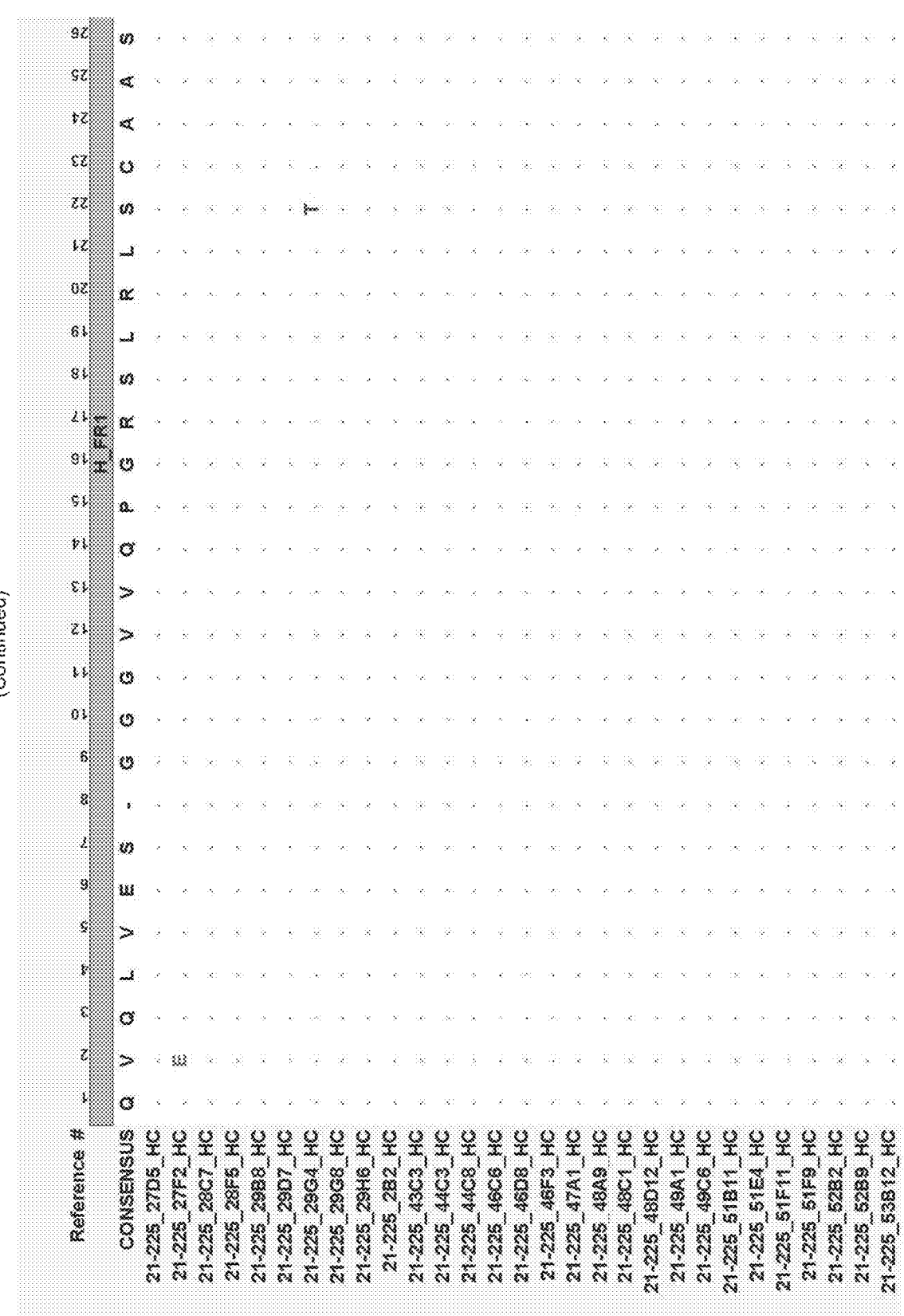
Figure 57:
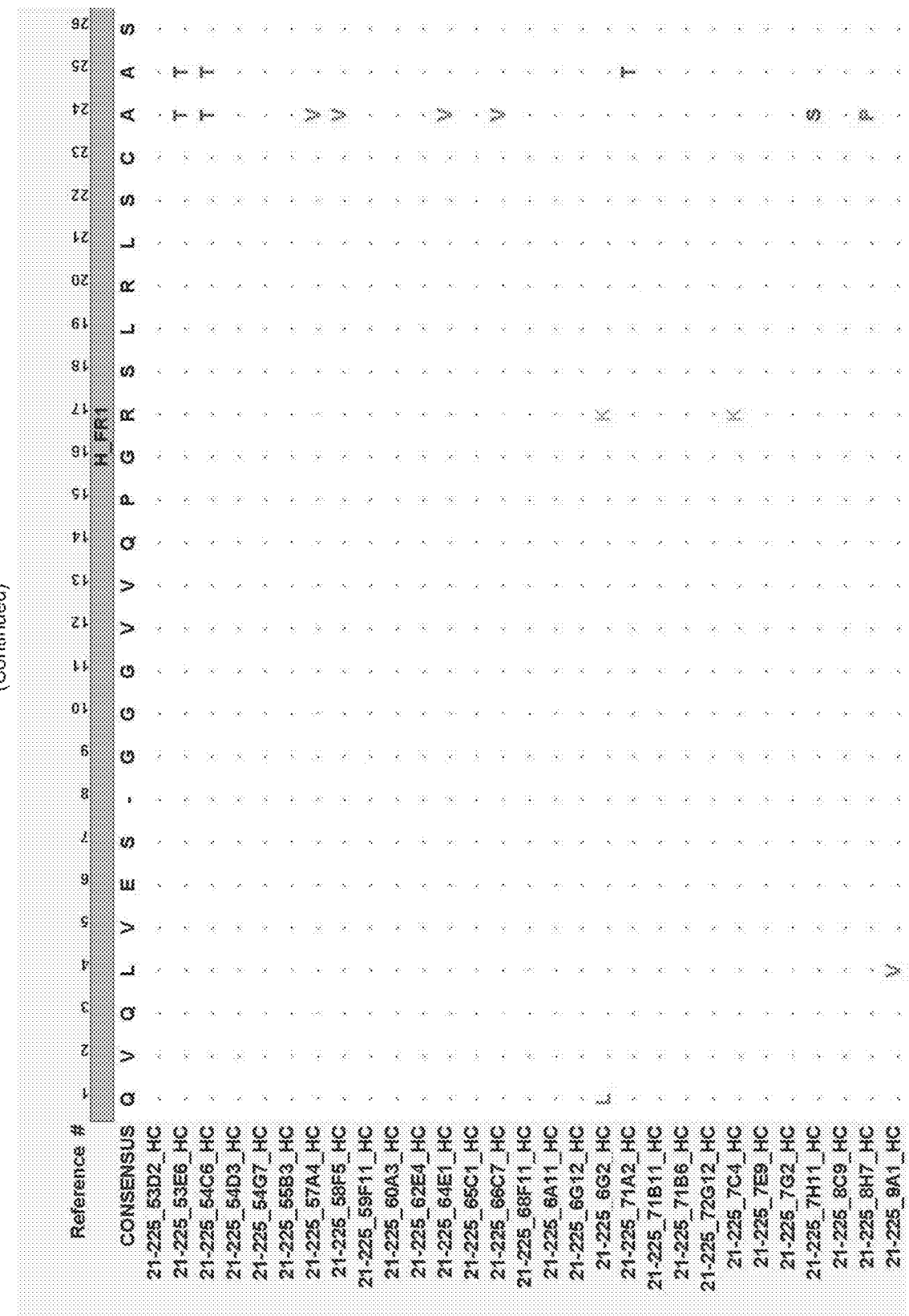
Figure 57:
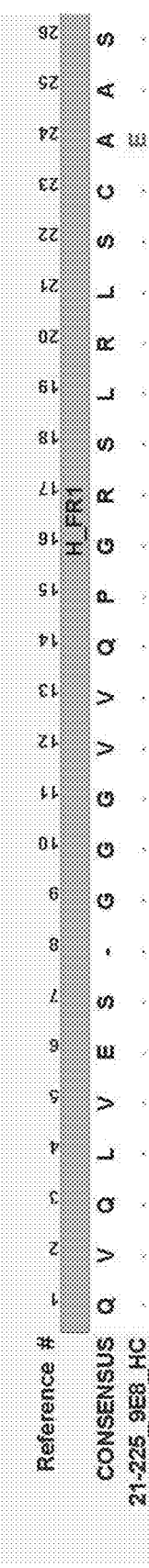
Figure 57:
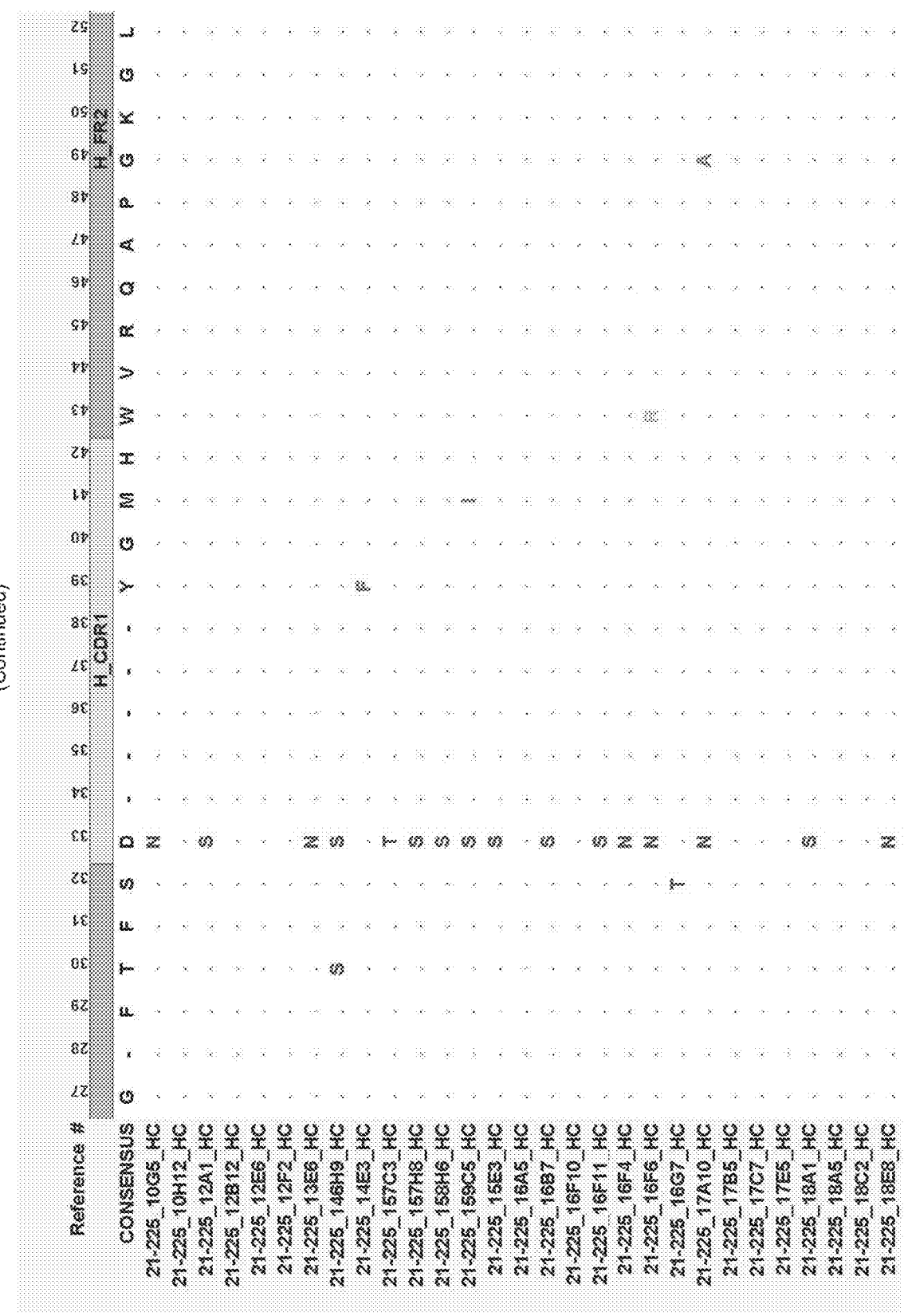
Figure 57:
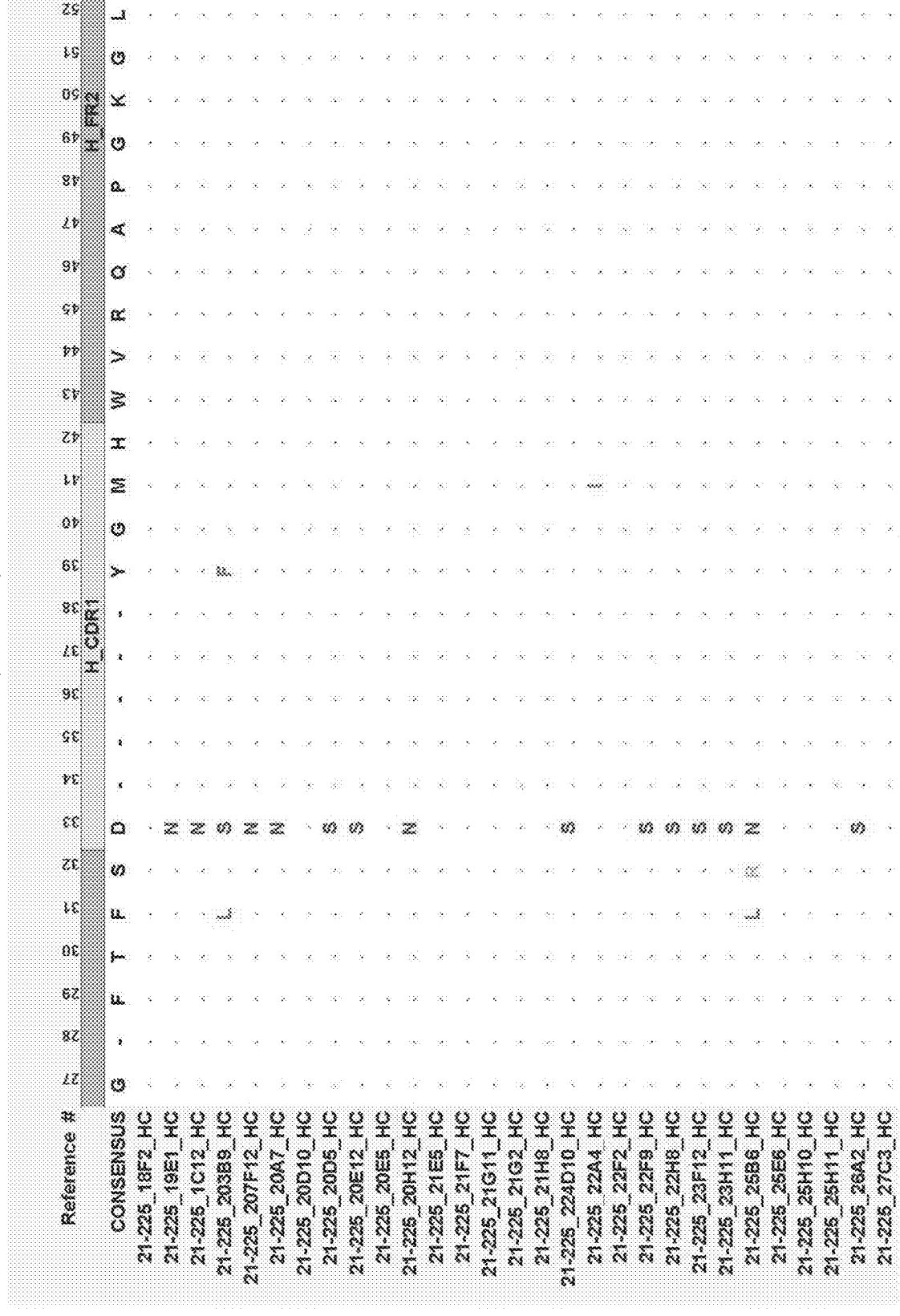
Figure 57:
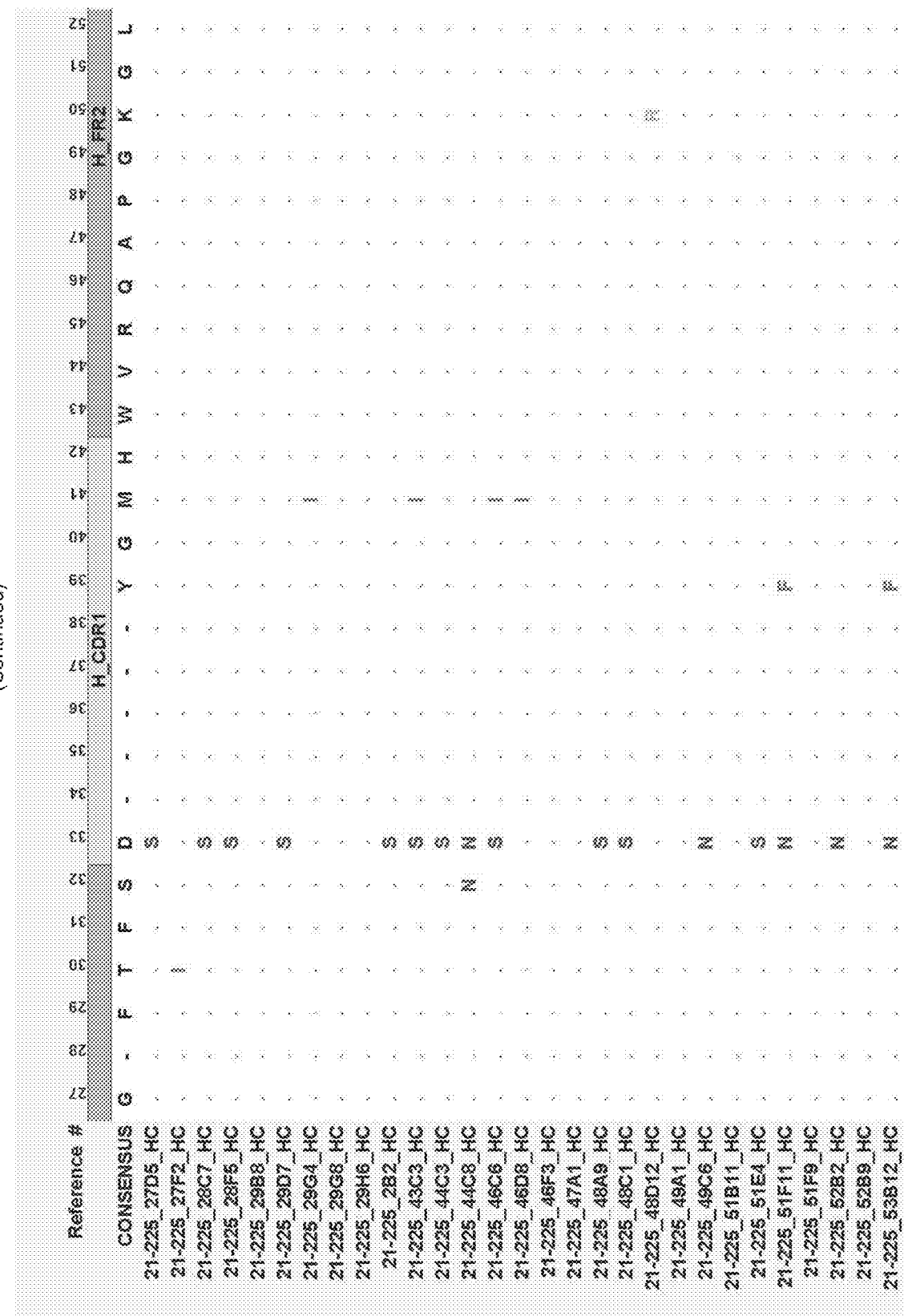
Figure 57:
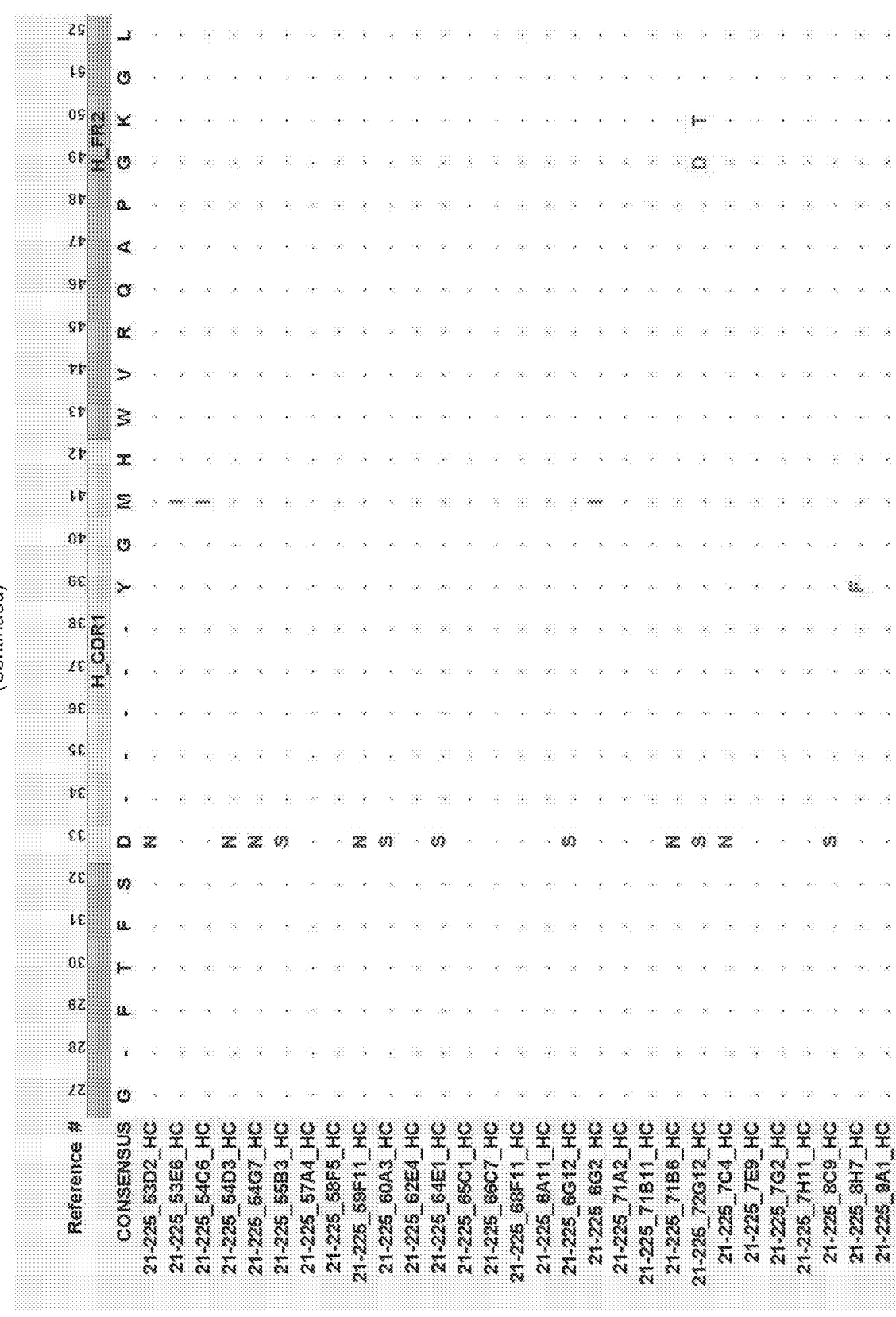
Figure 57:
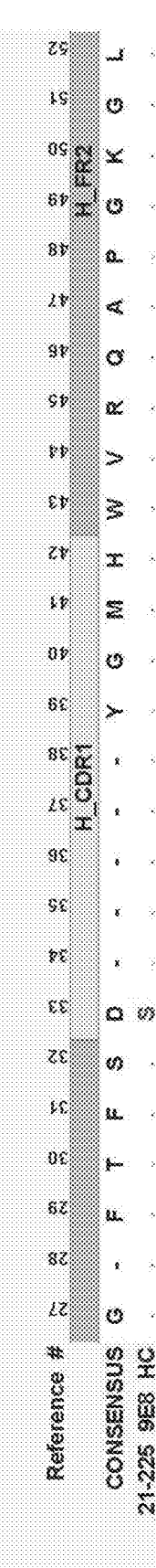
Figure 57:
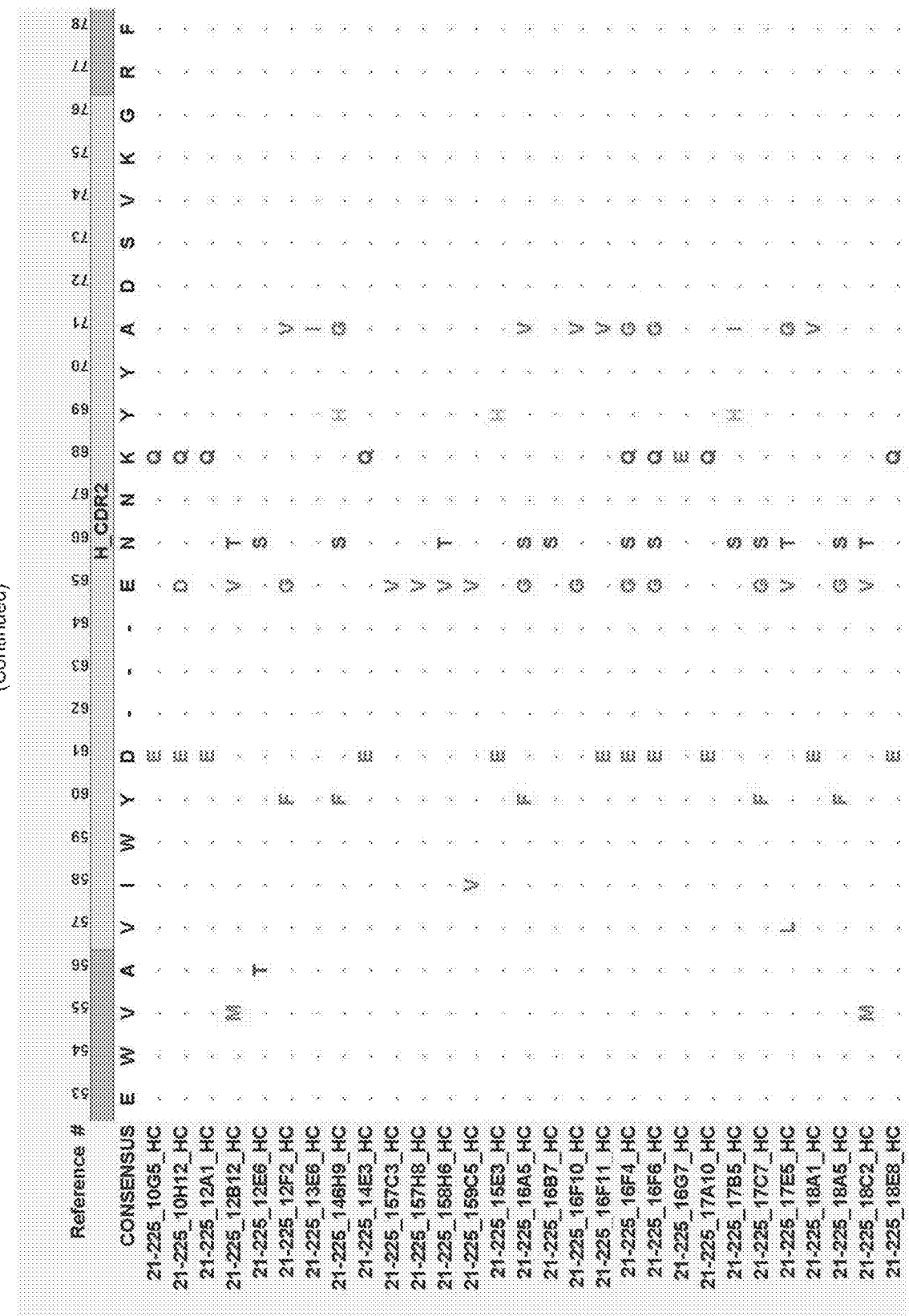
Figure 57:
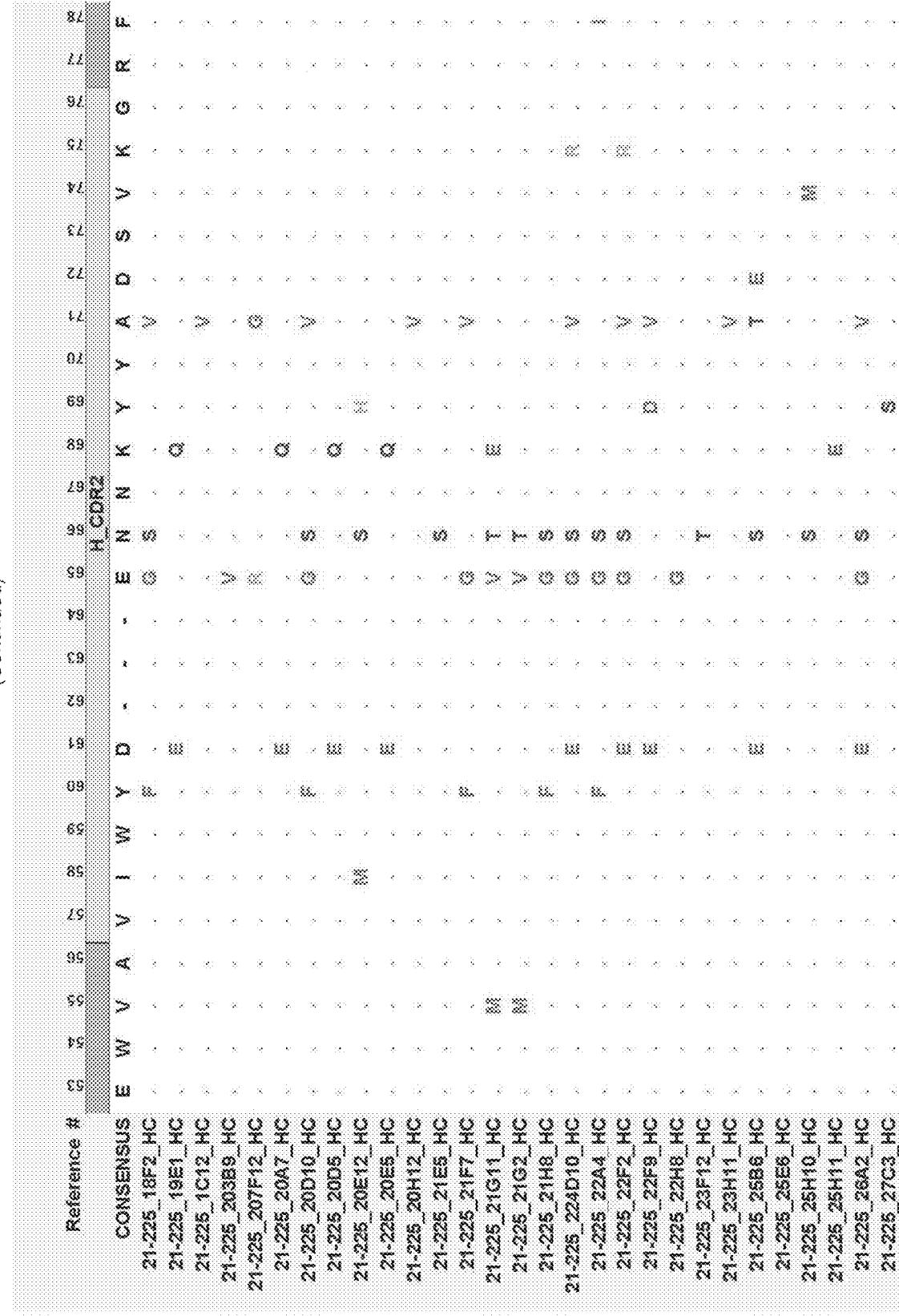
Figure 57:
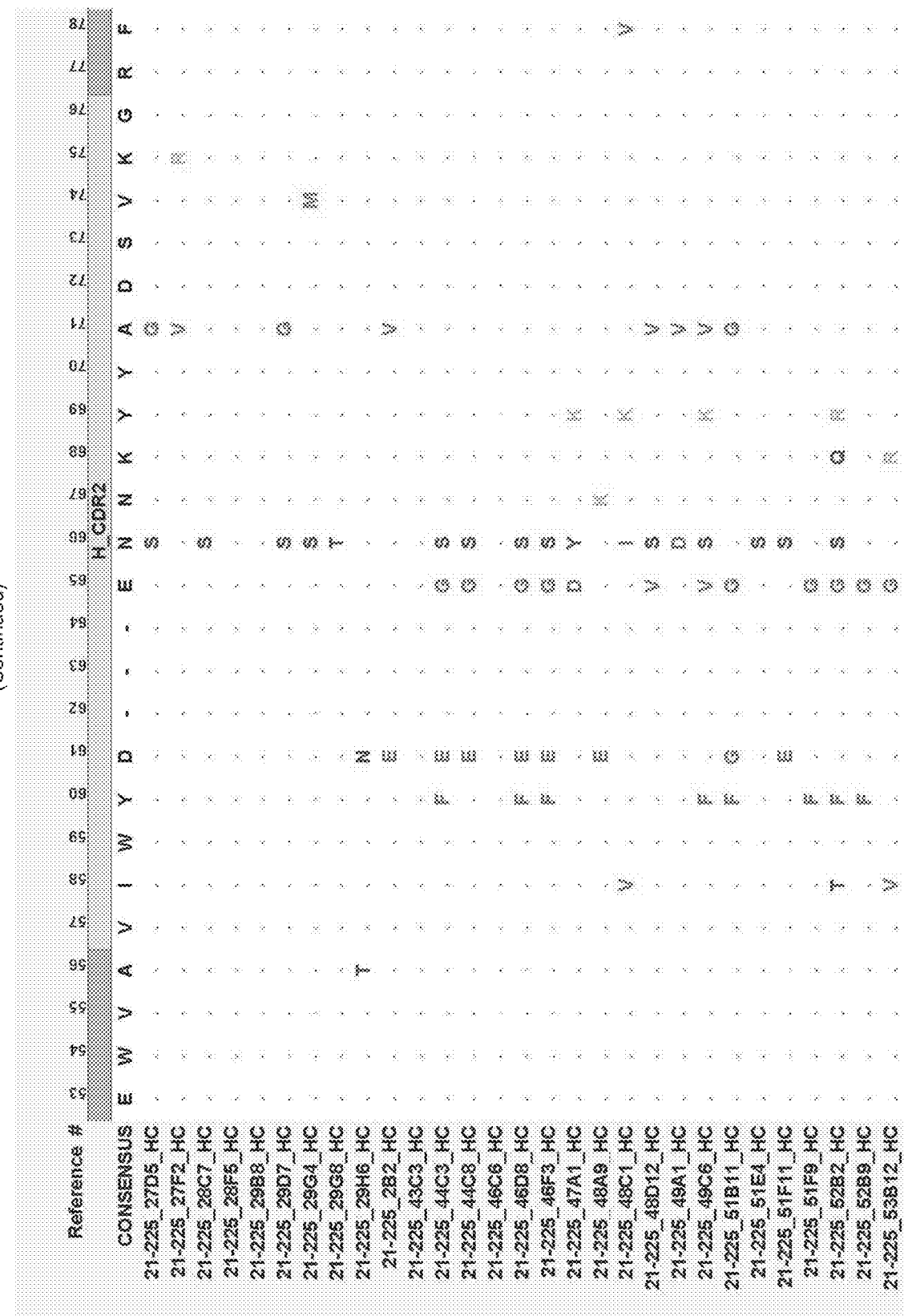
Figure 57:
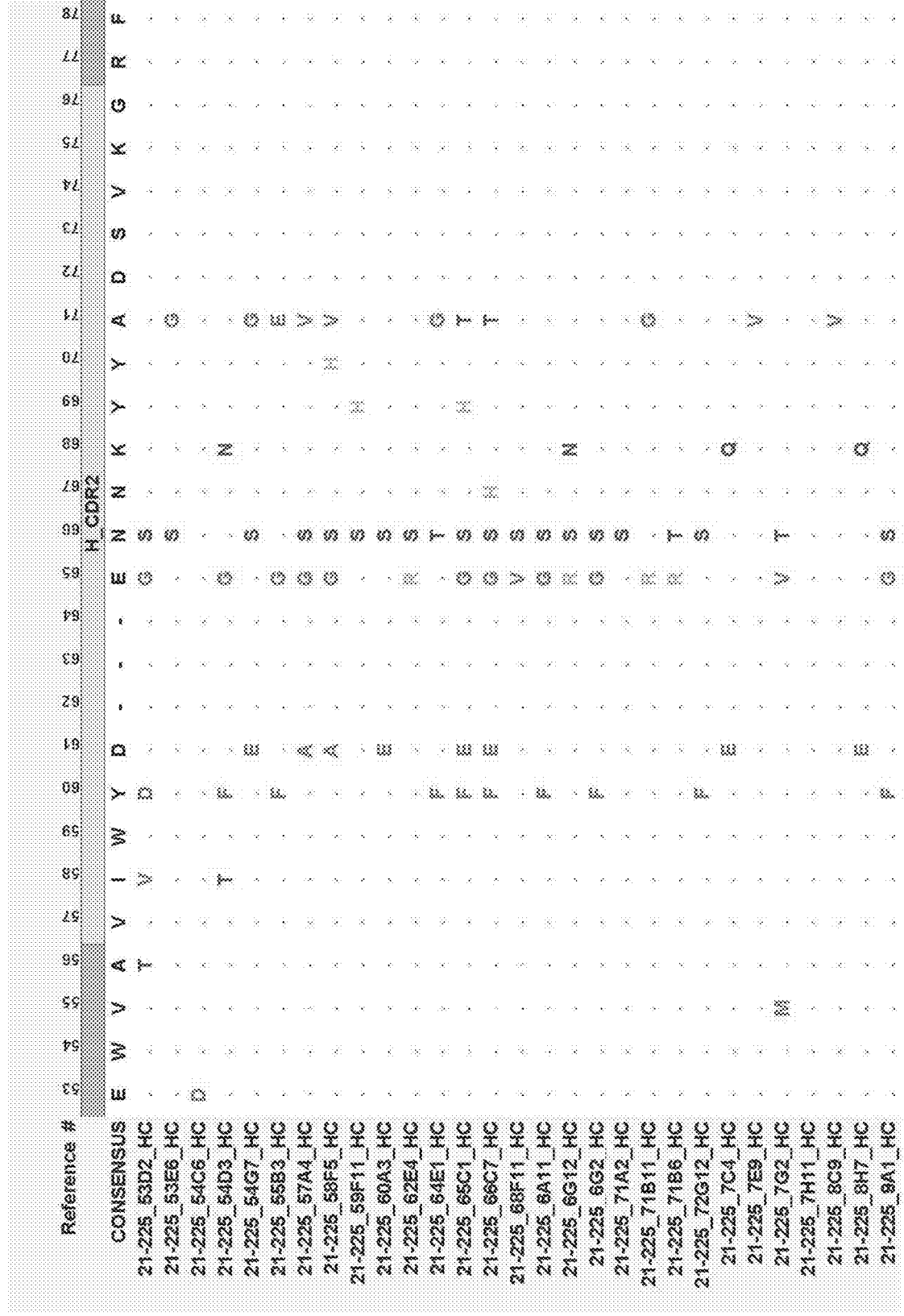
Figure 57:
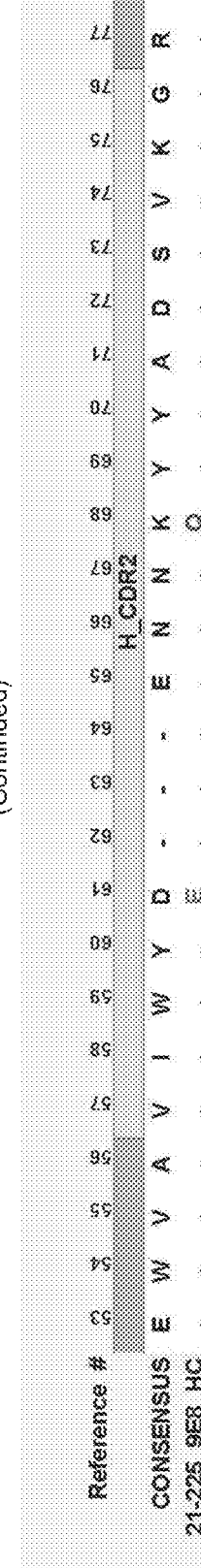
Figure 57:
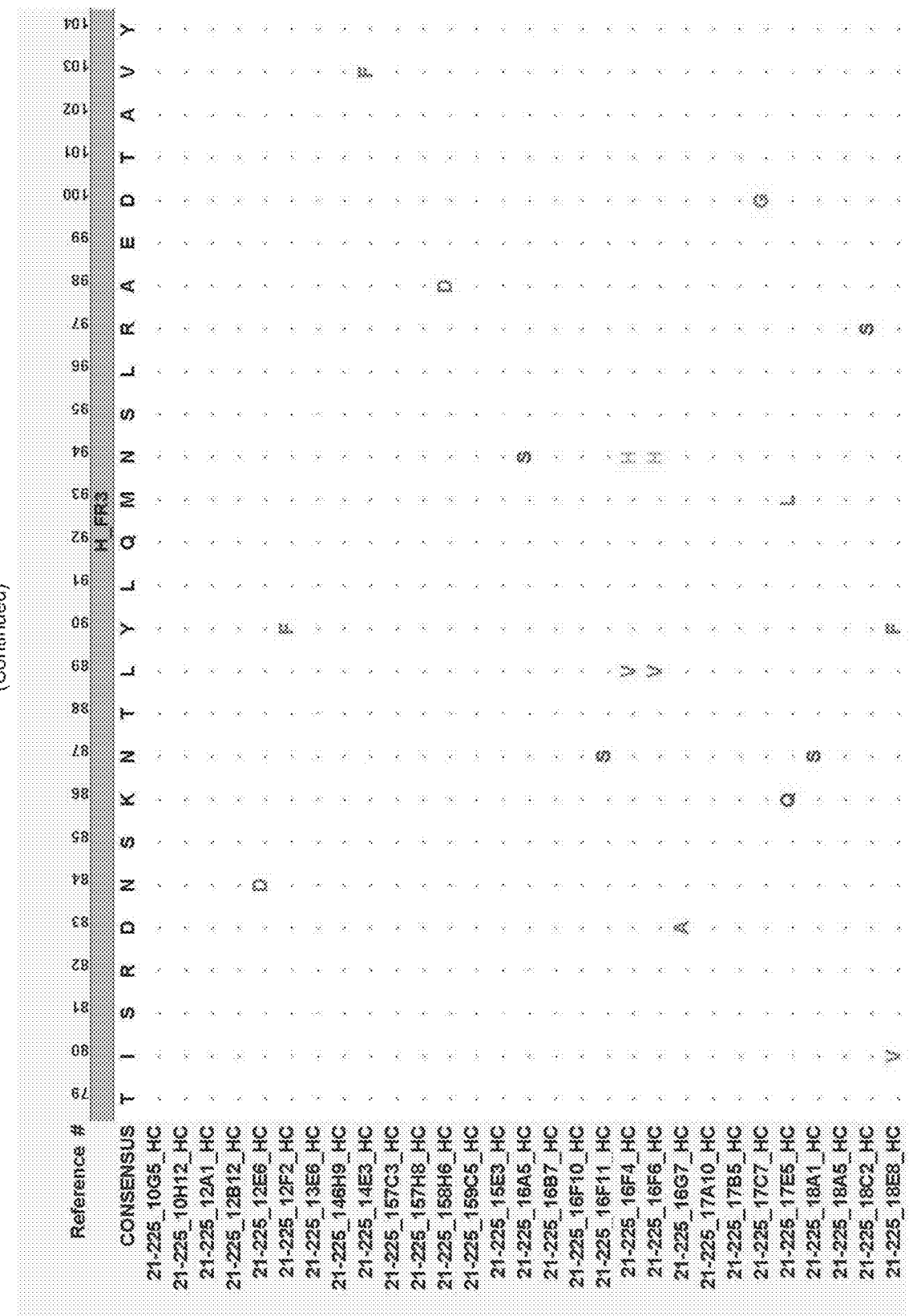
Figure 57:
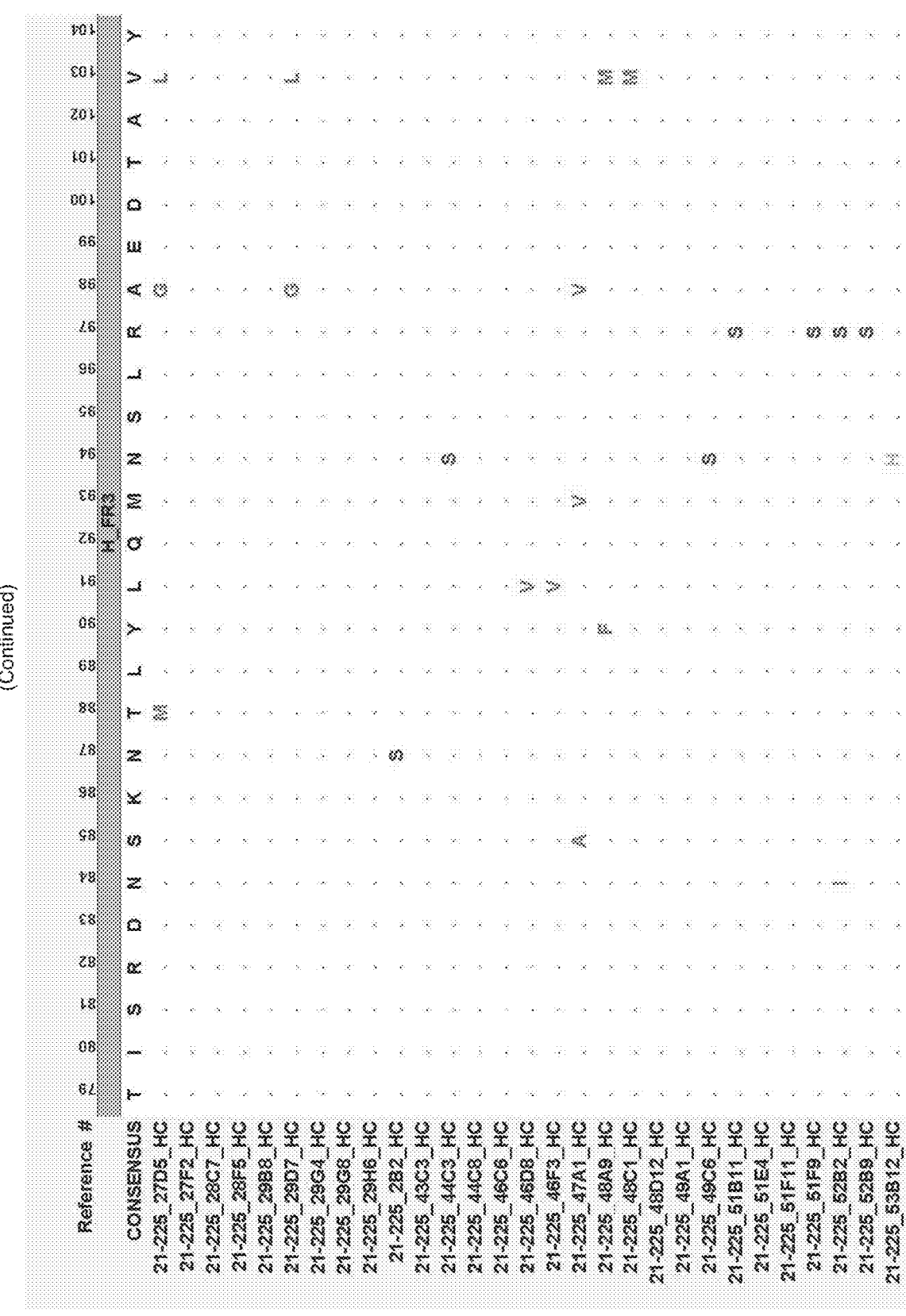
Figure 57:
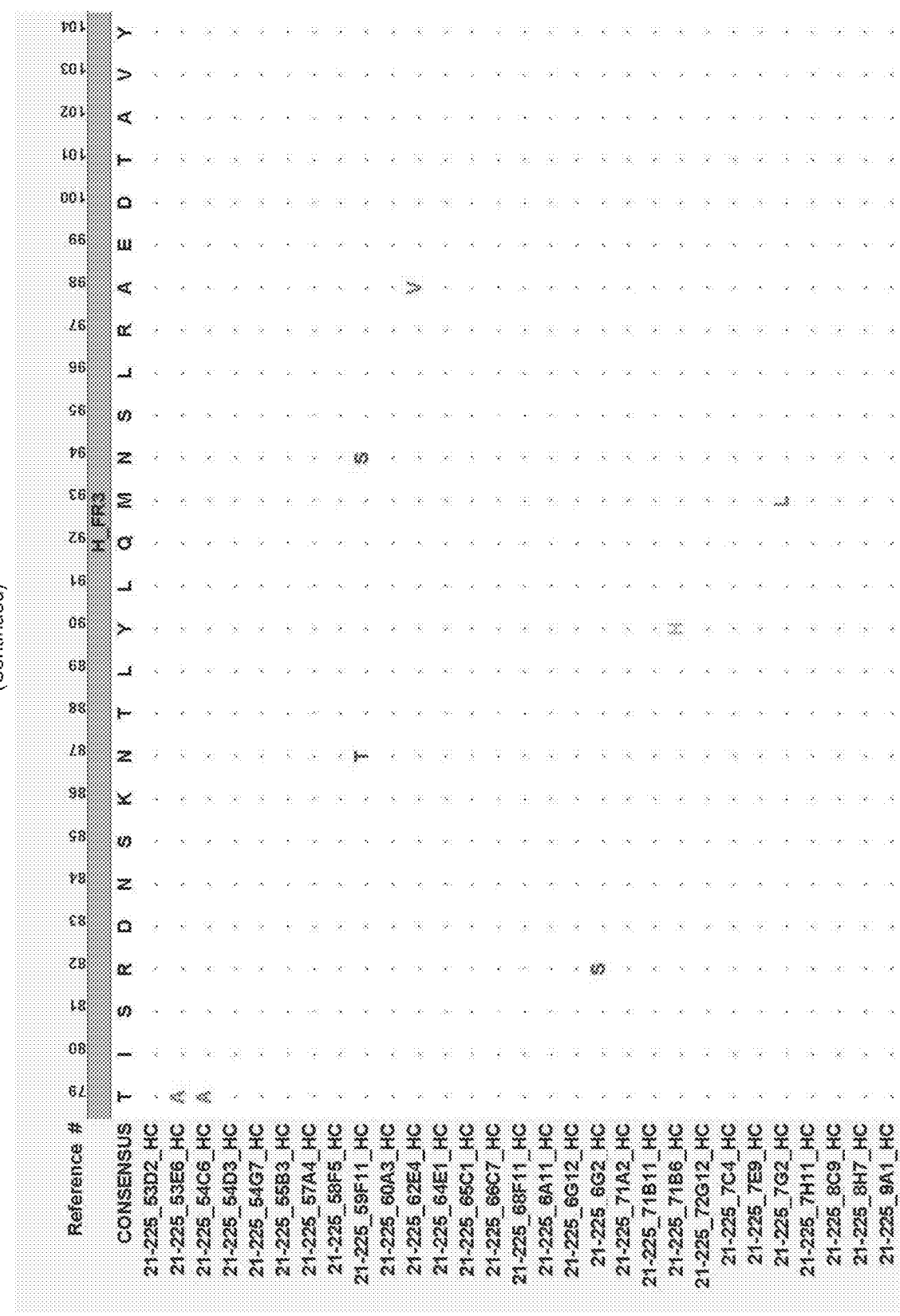
Figure 57:
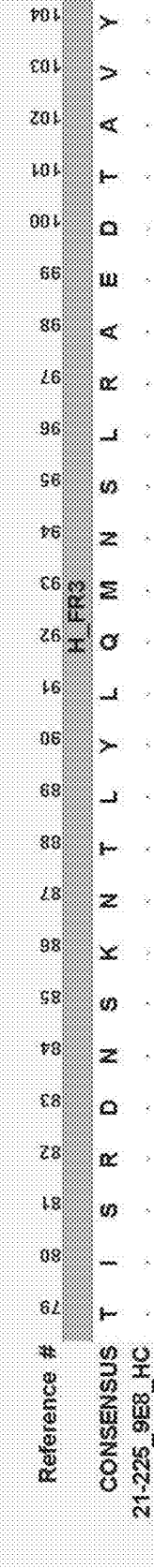
Figure 57:
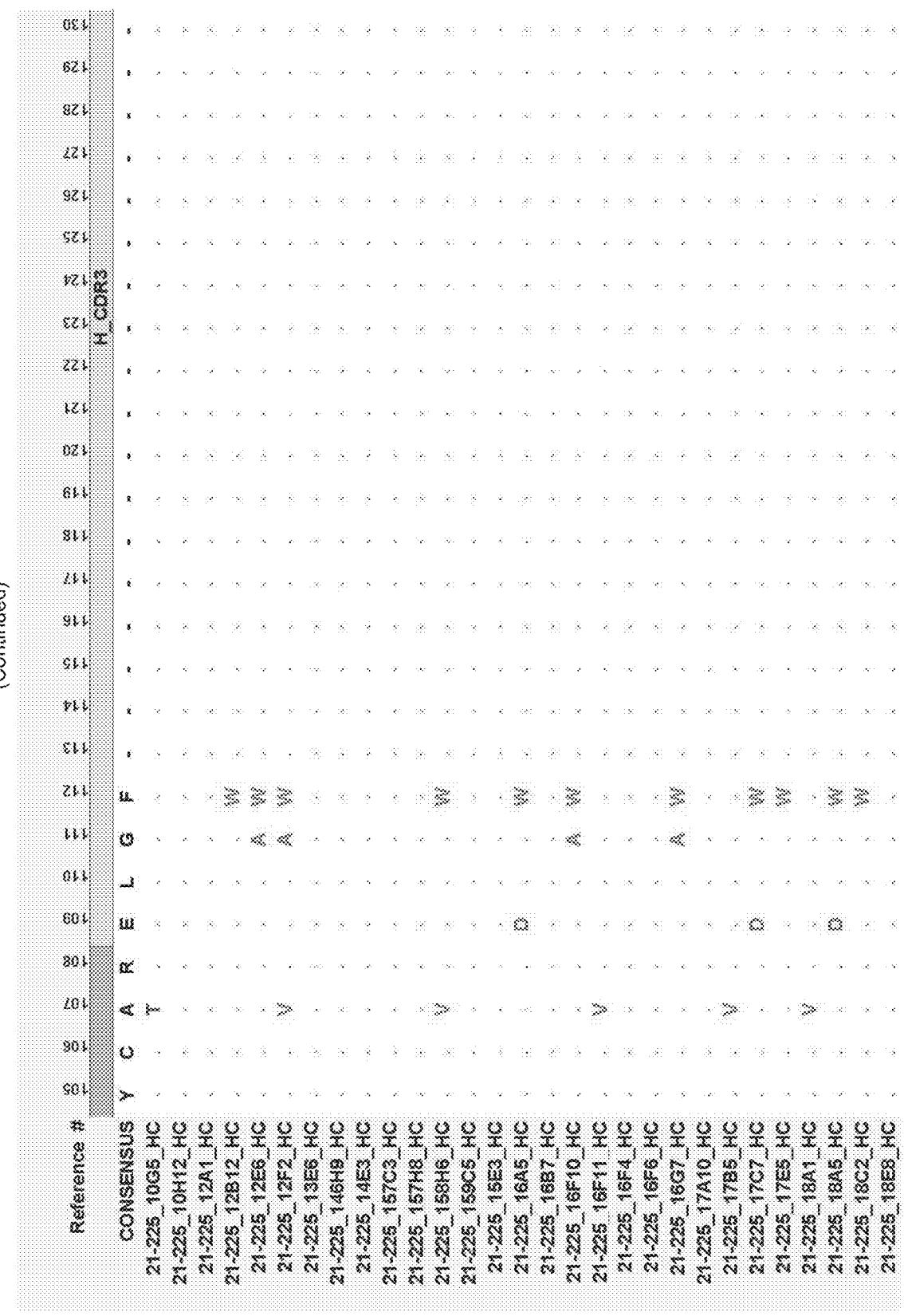
Figure 57:
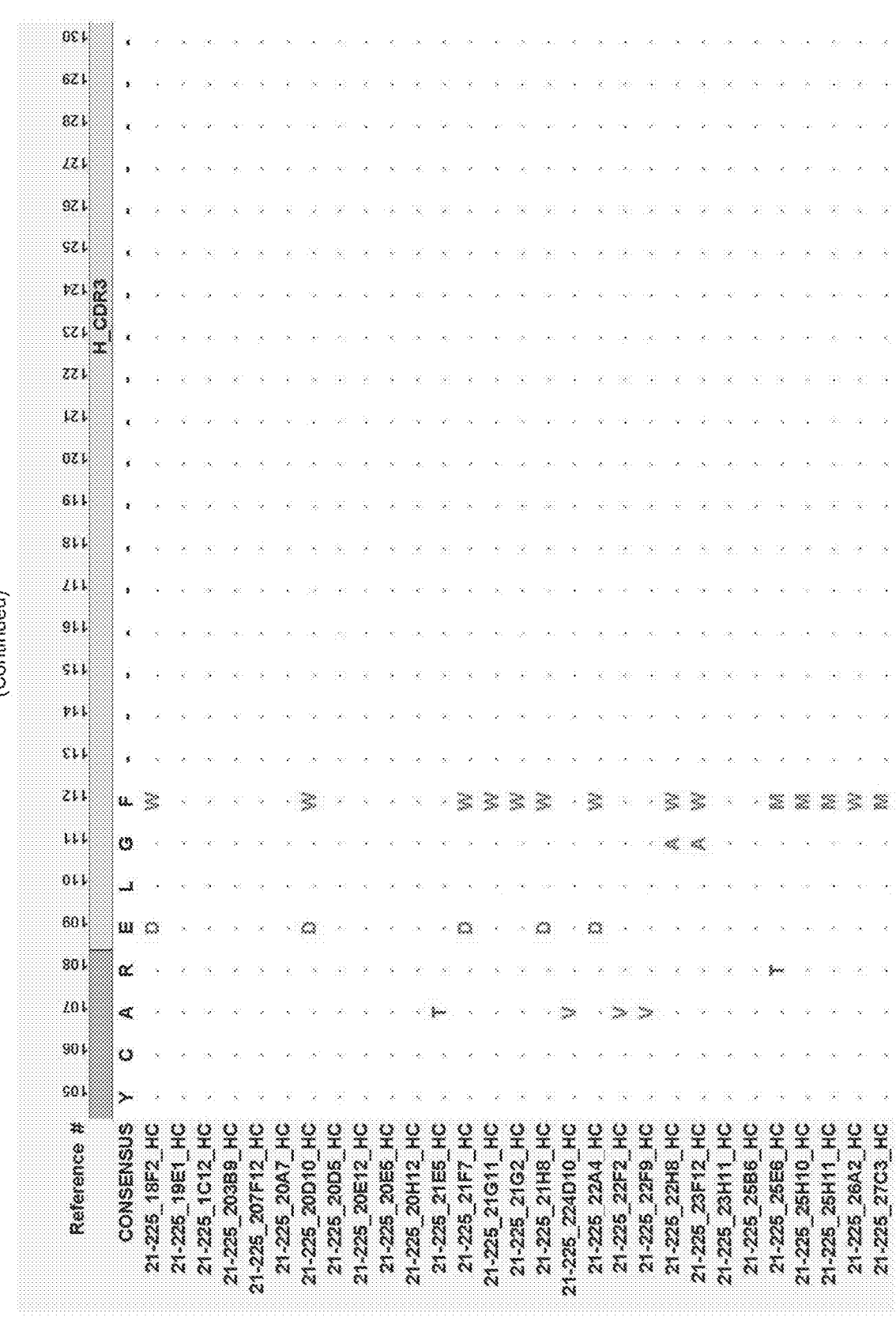
Figure 57:
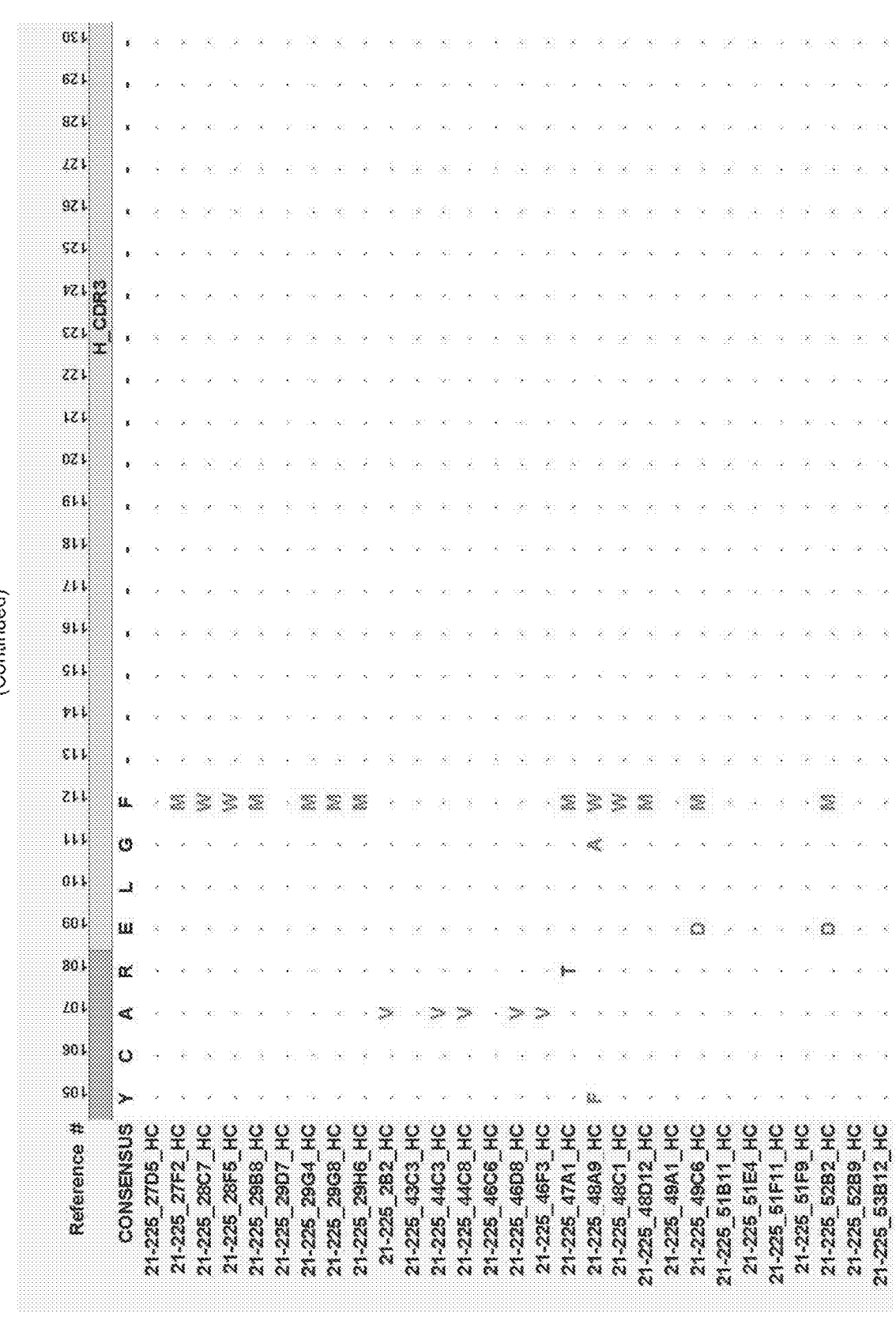
Figure 57:
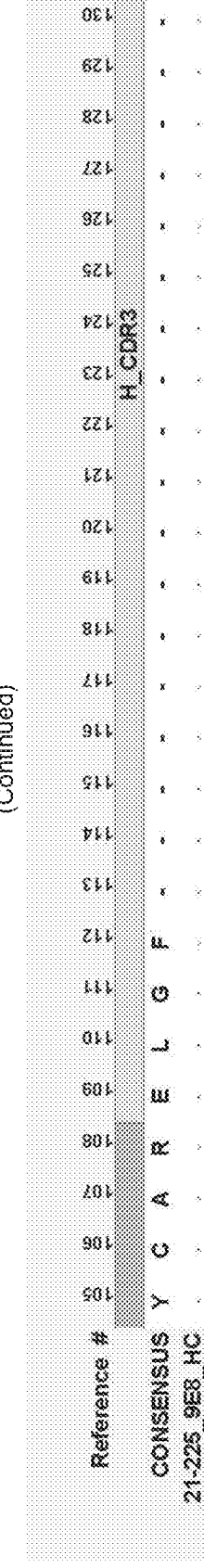
Figure 57:
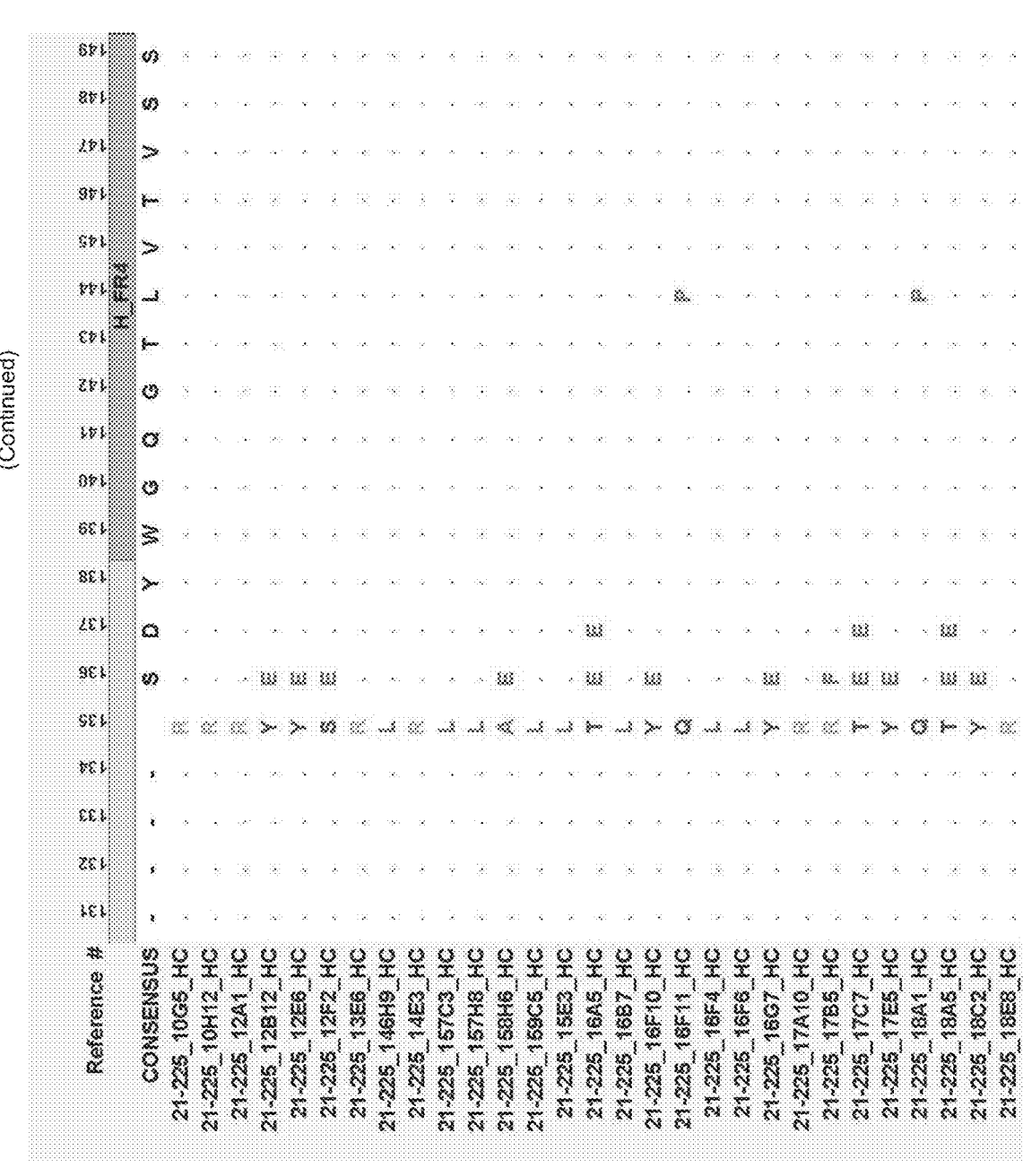
Figure 57:
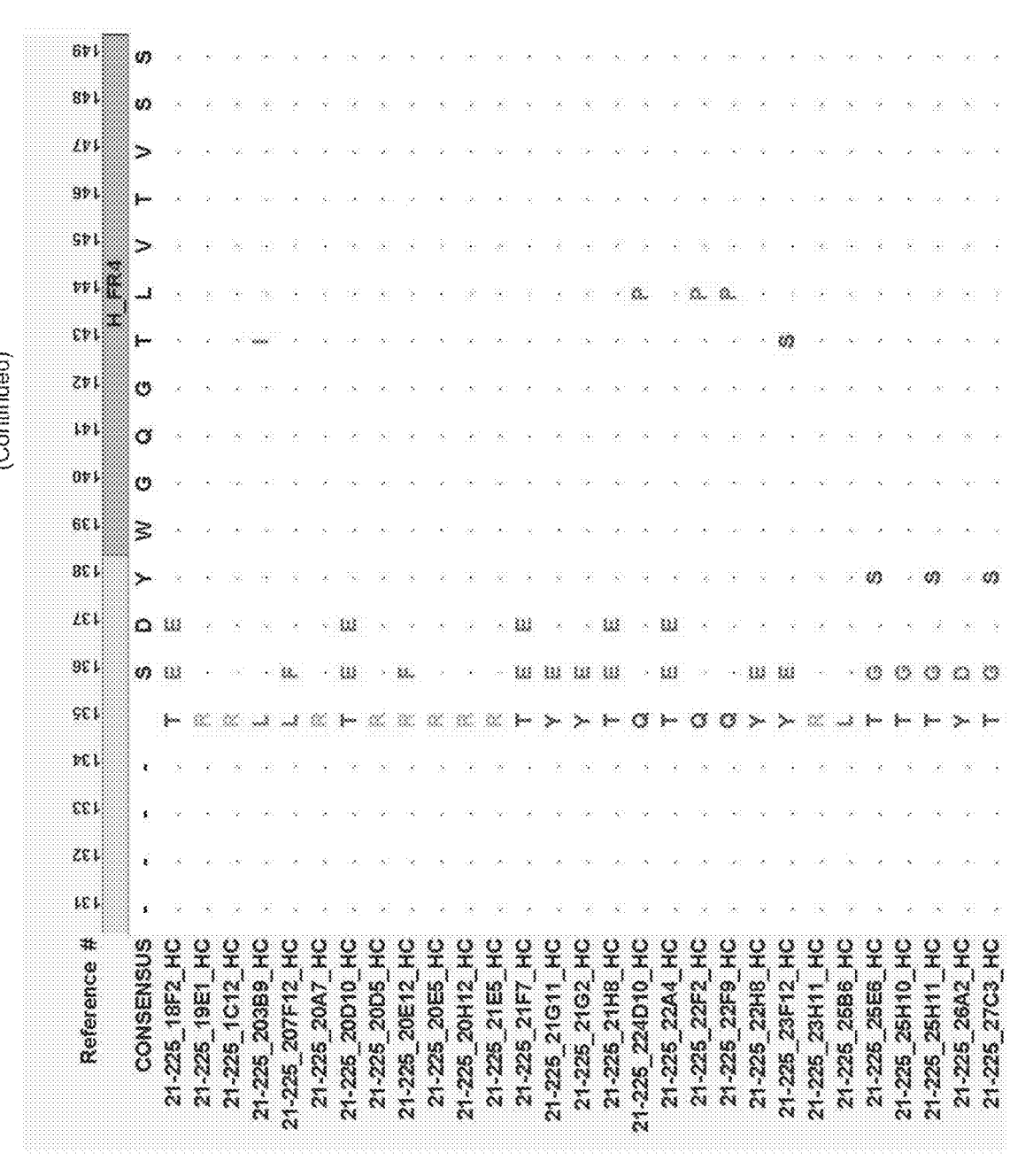
Figure 57:
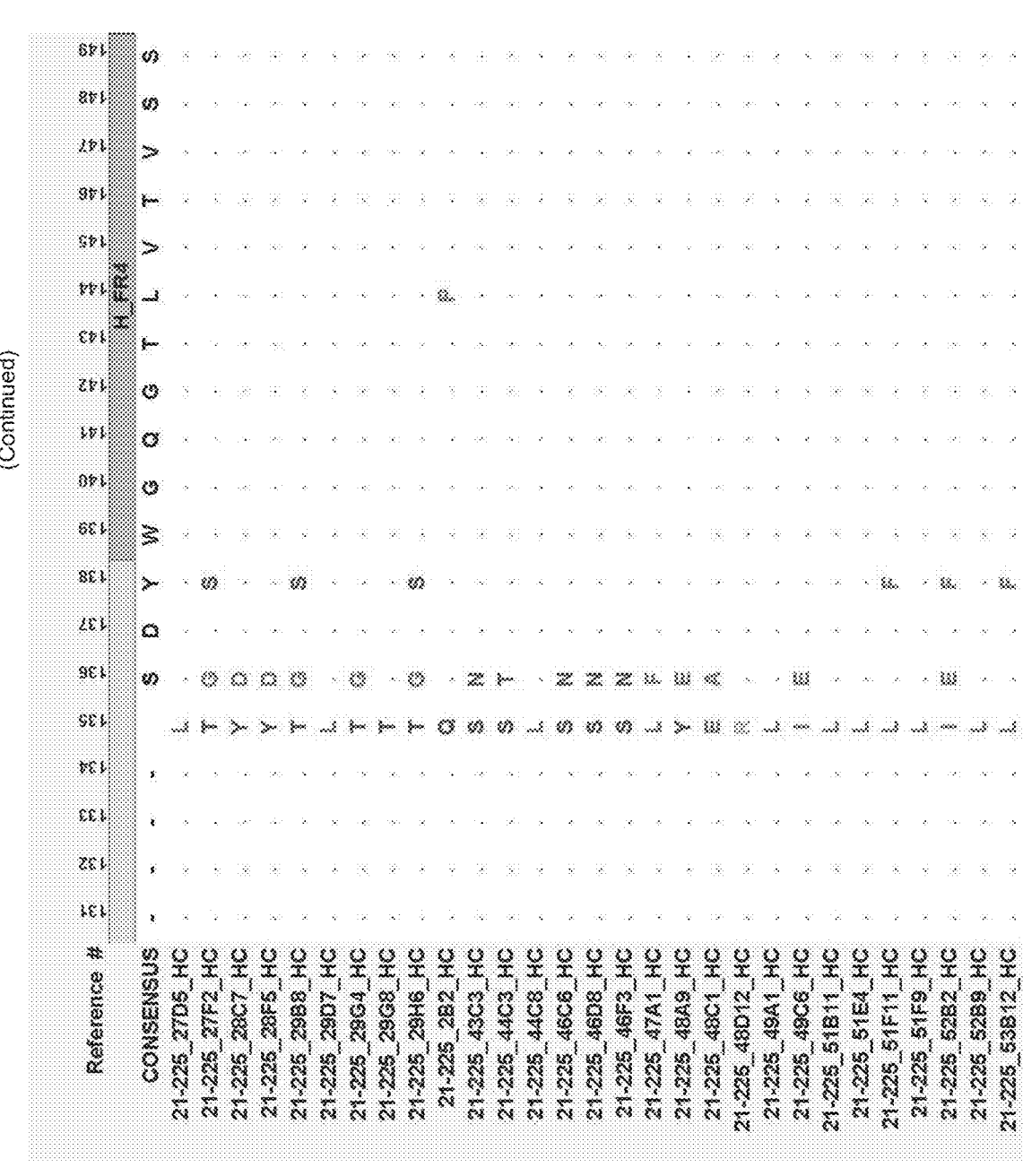
Figure 57:
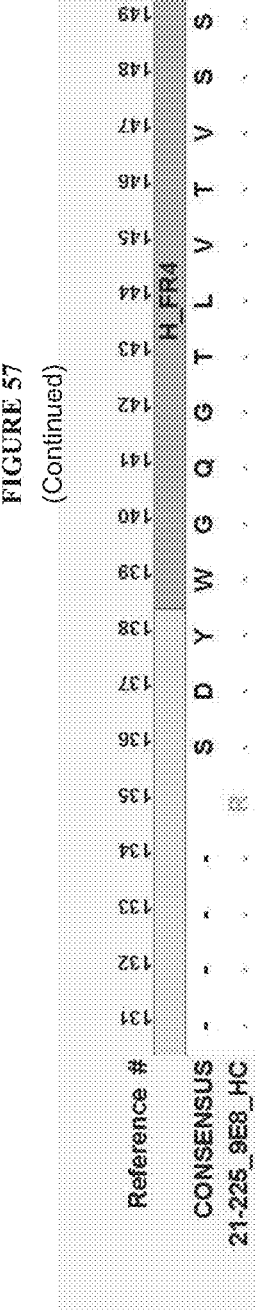
Figure 57:
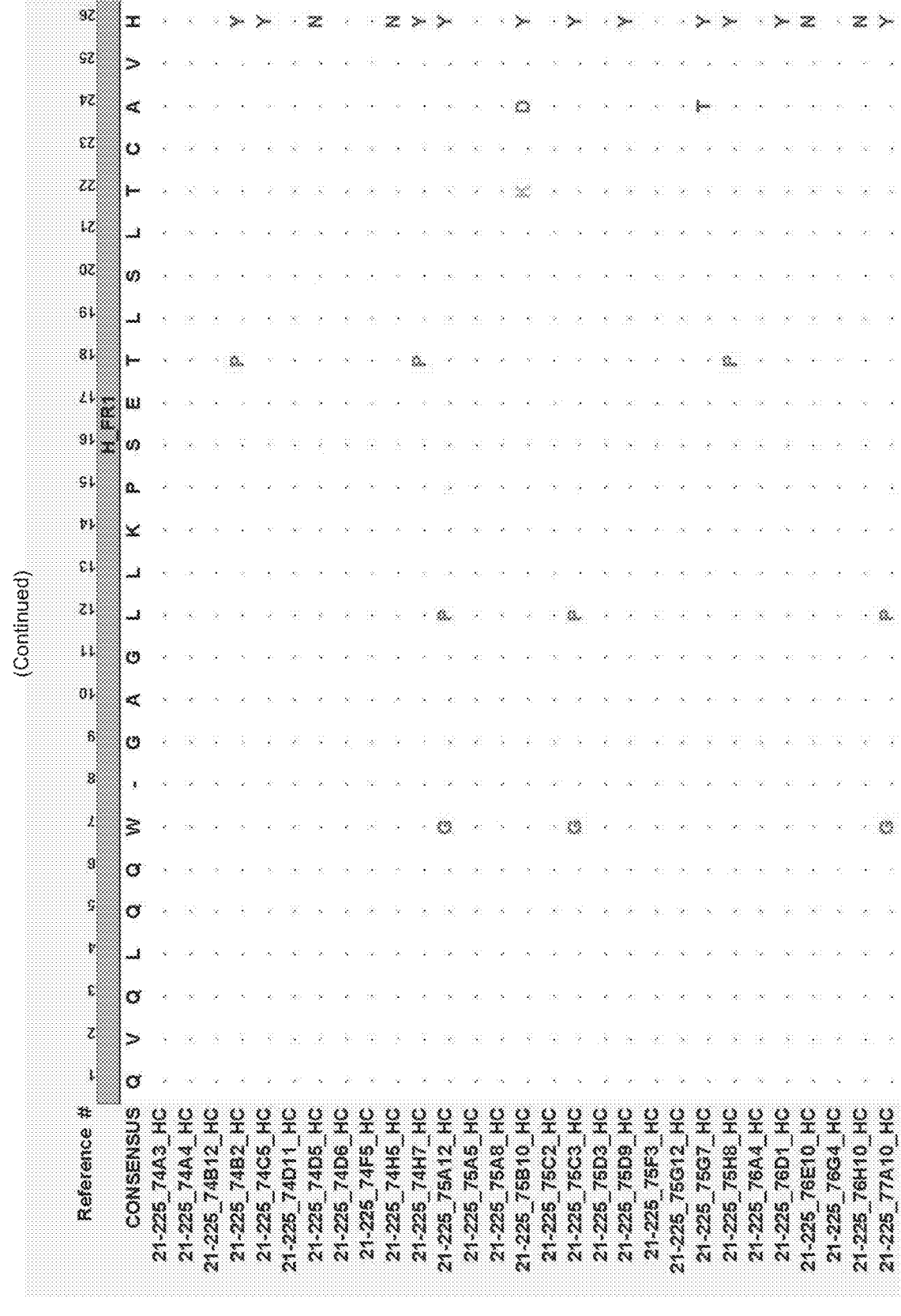
Figure 57:
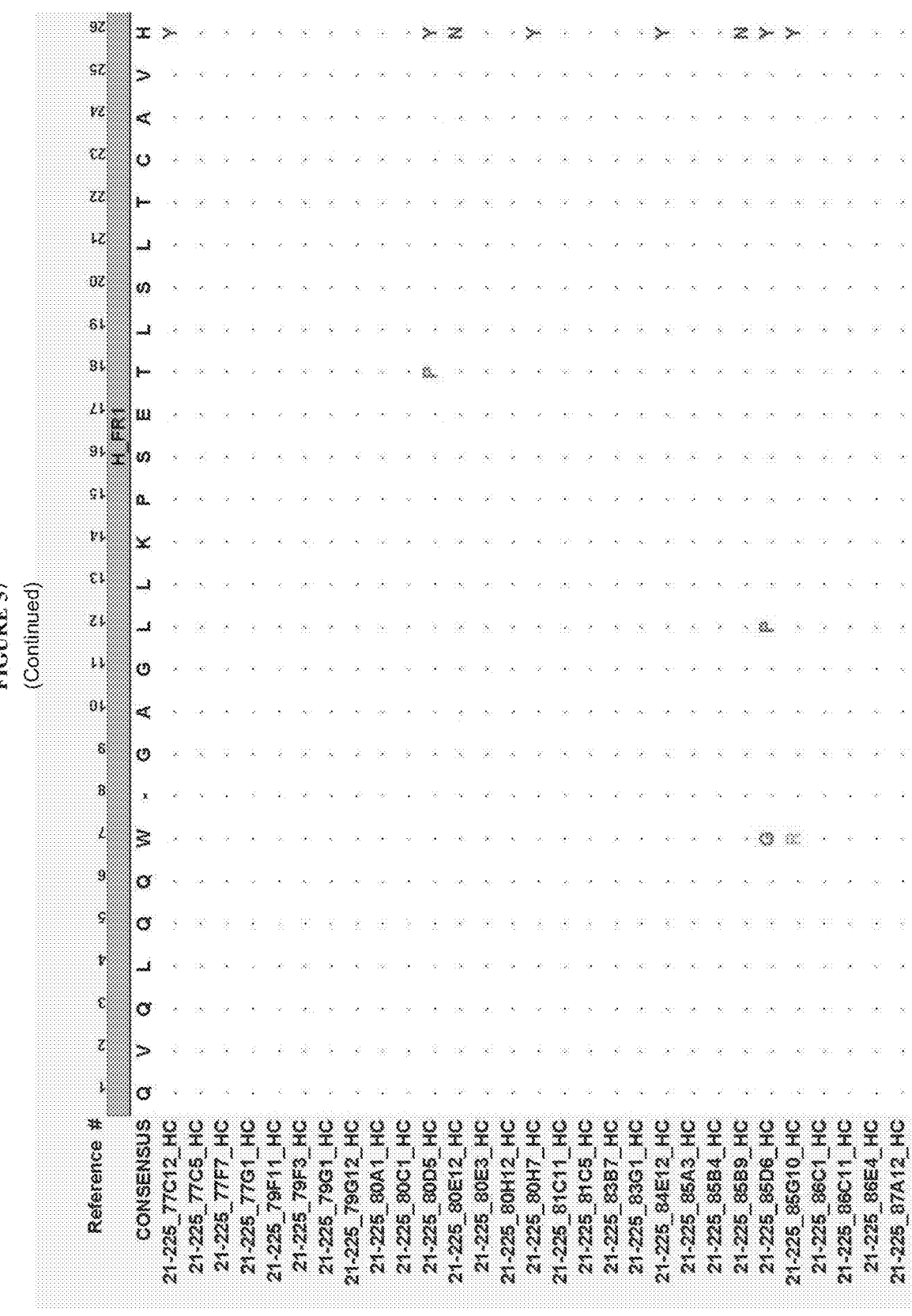
Figure 57:
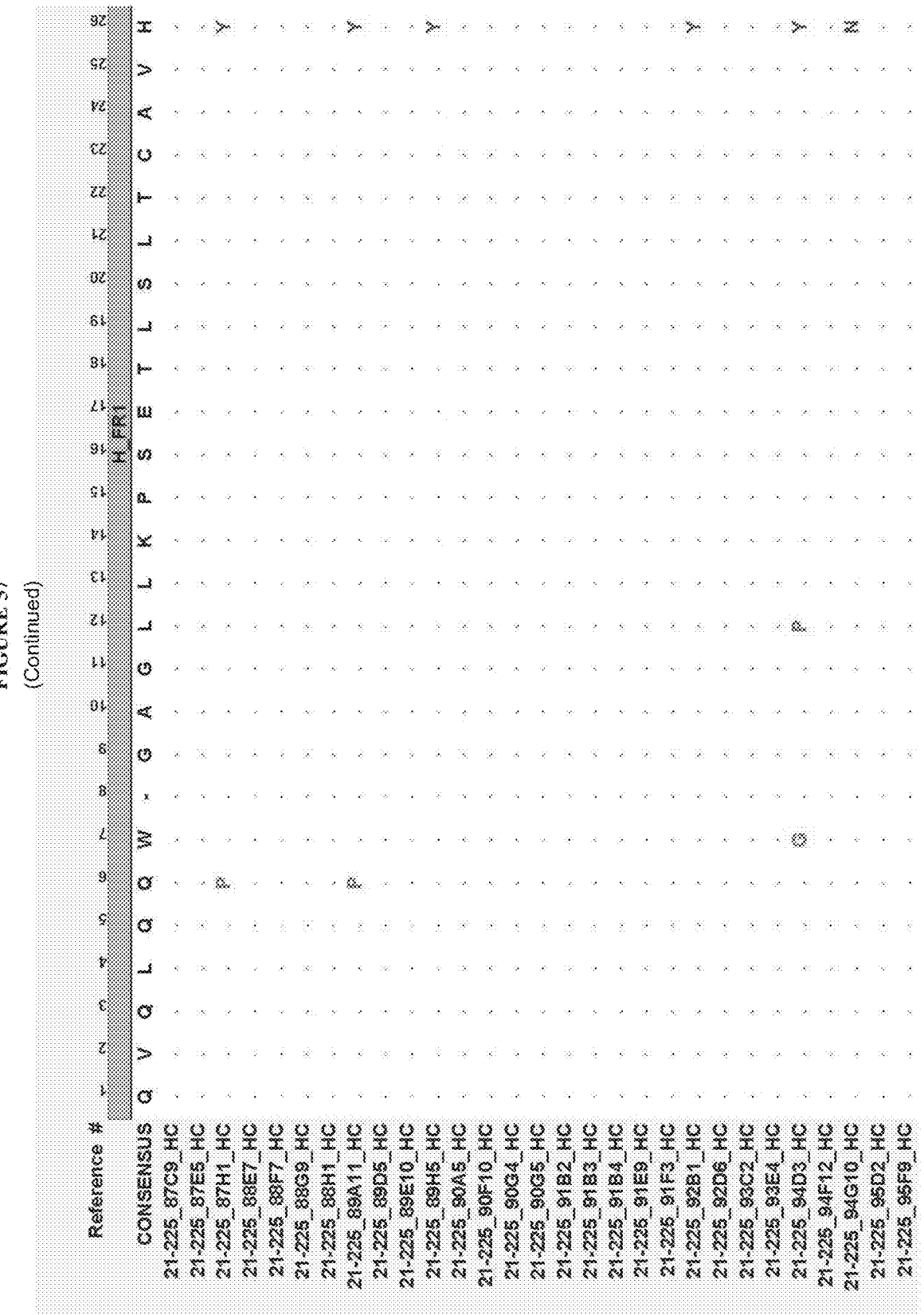
Figure 57:
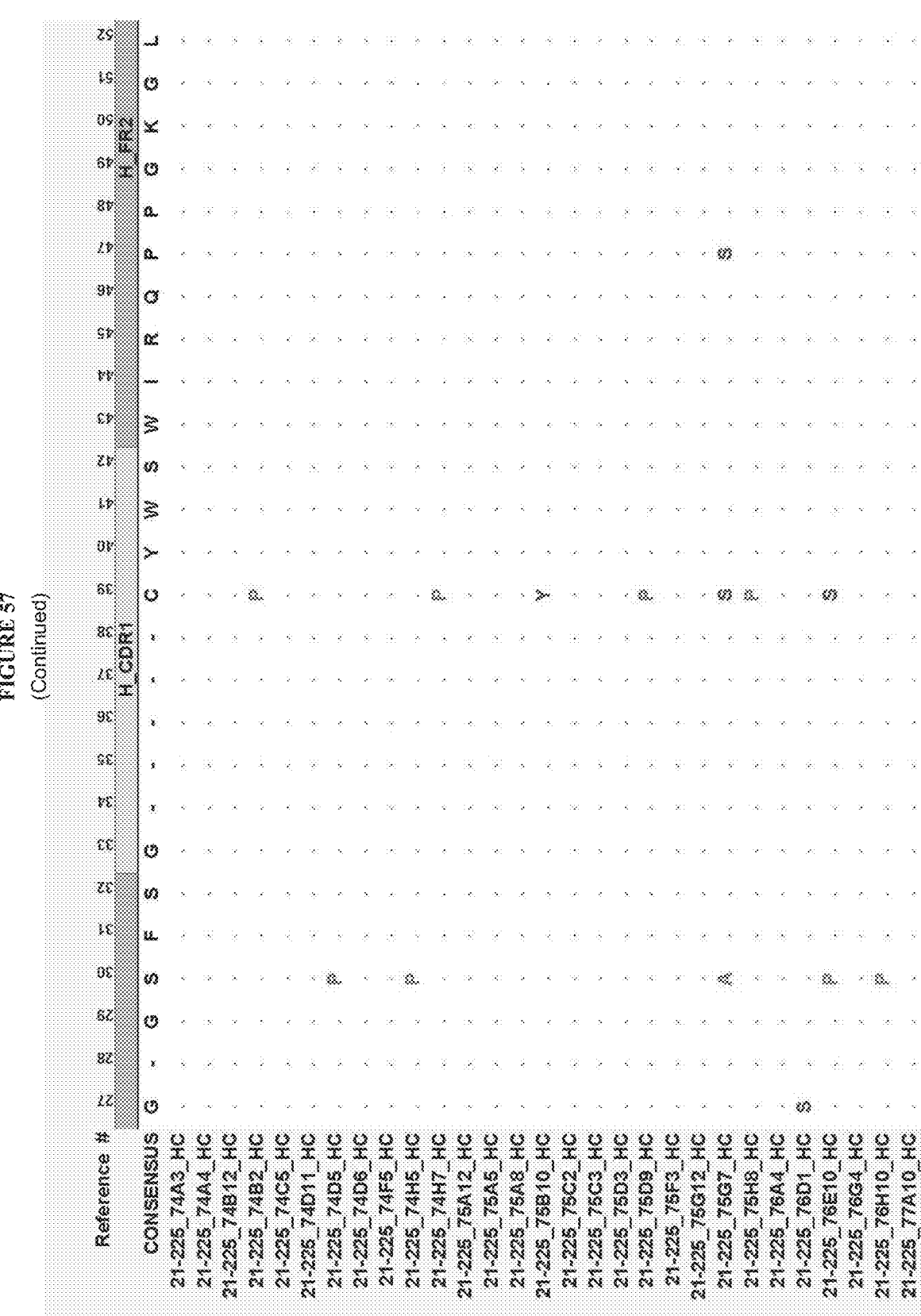
Figure 57:
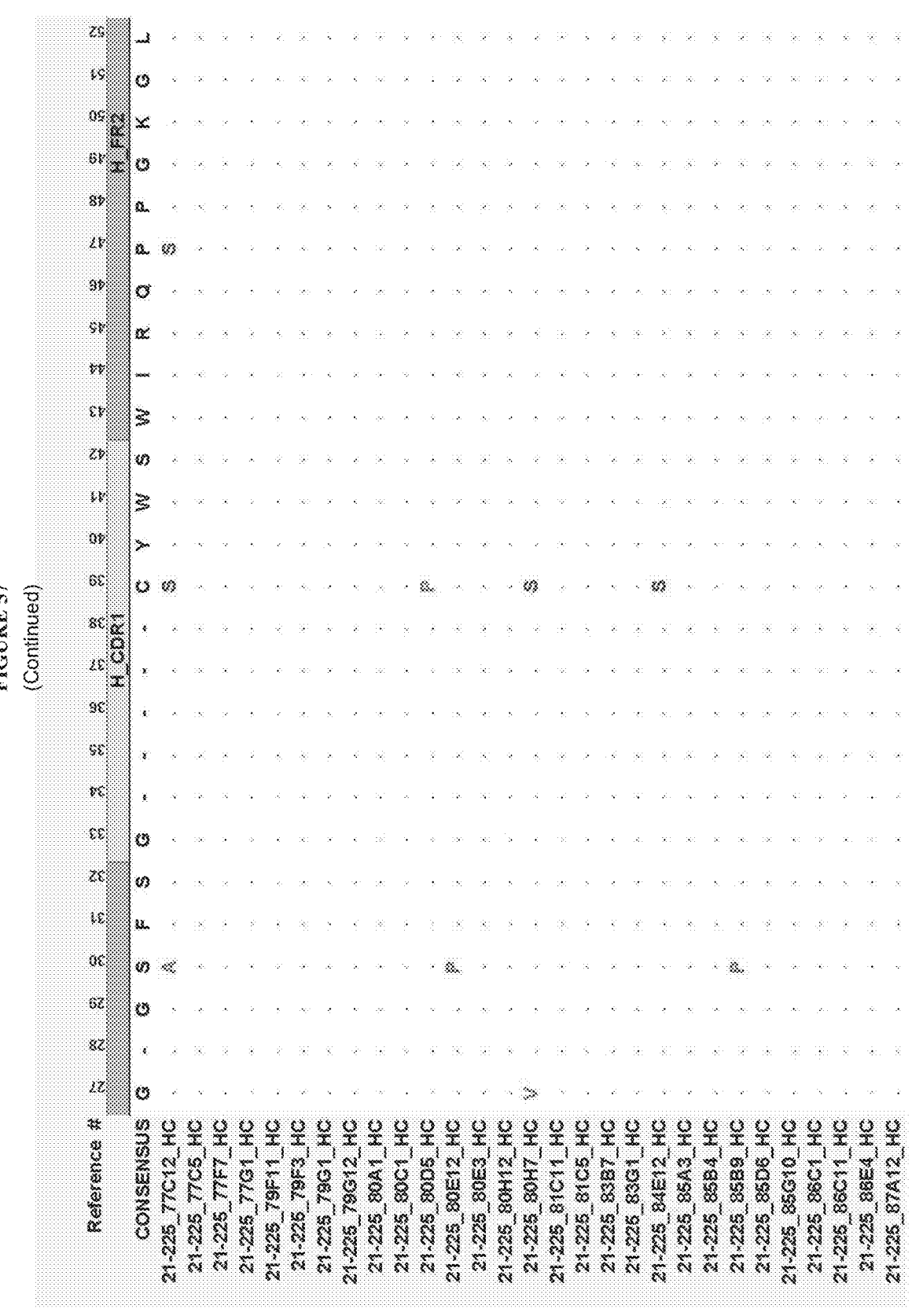
Figure 57:
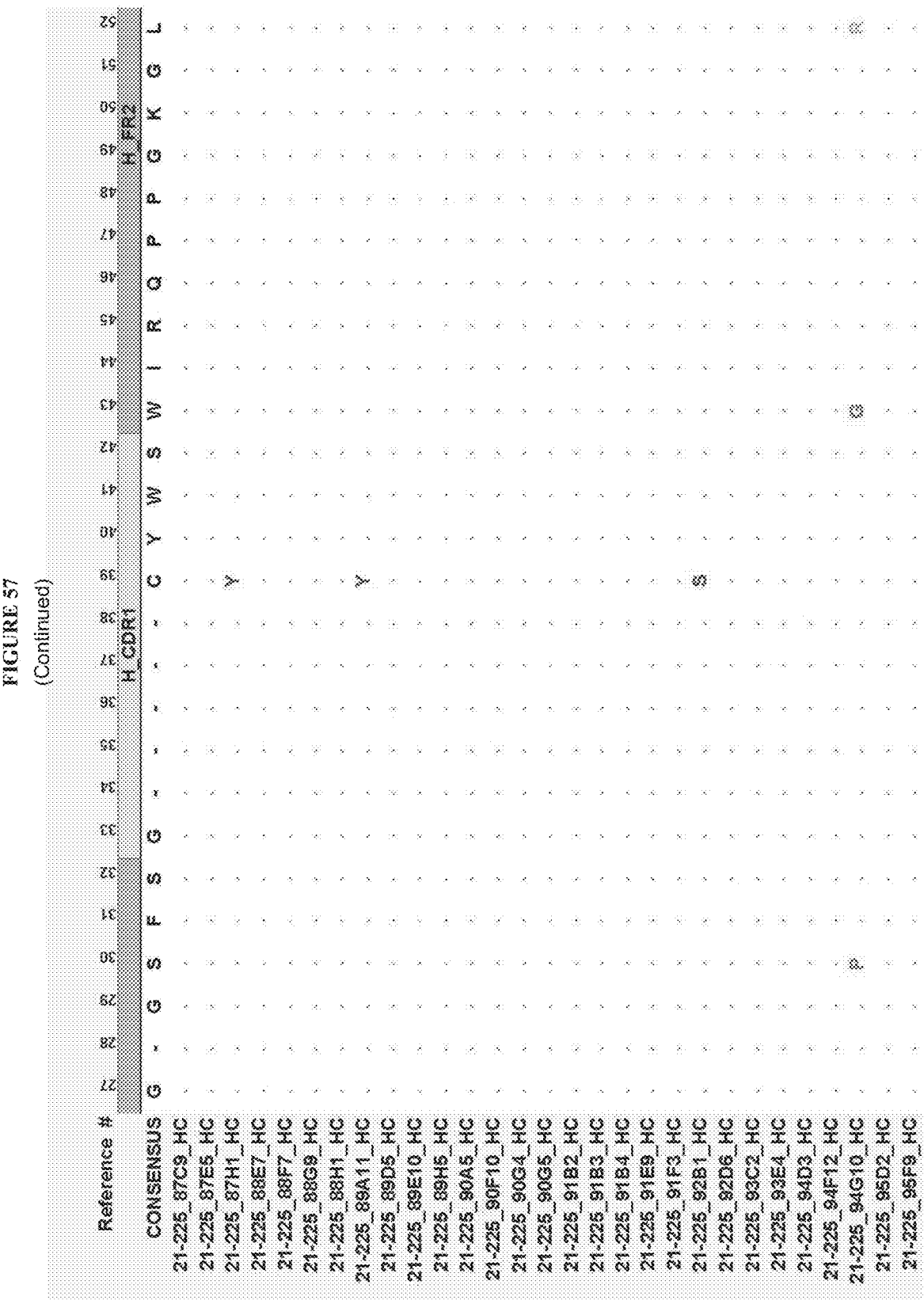
Figure 57:
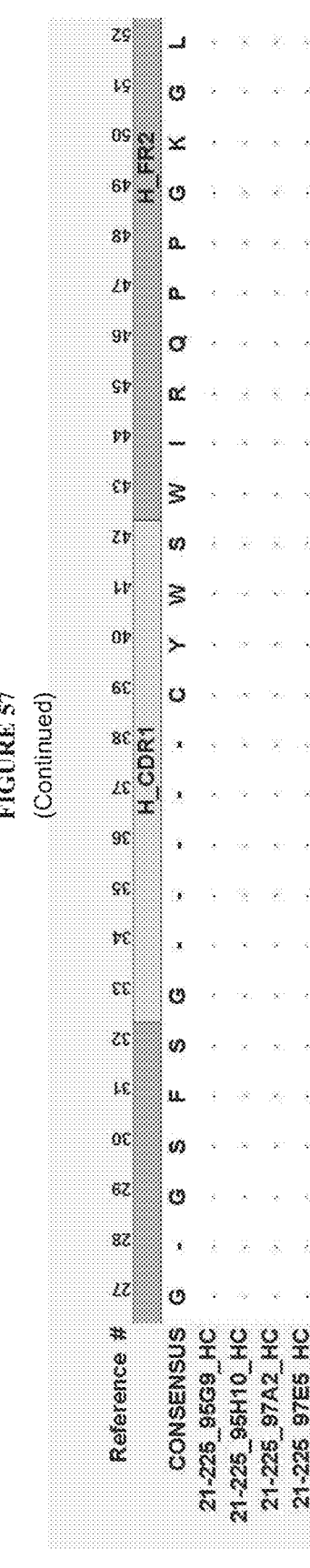
Figure 57:
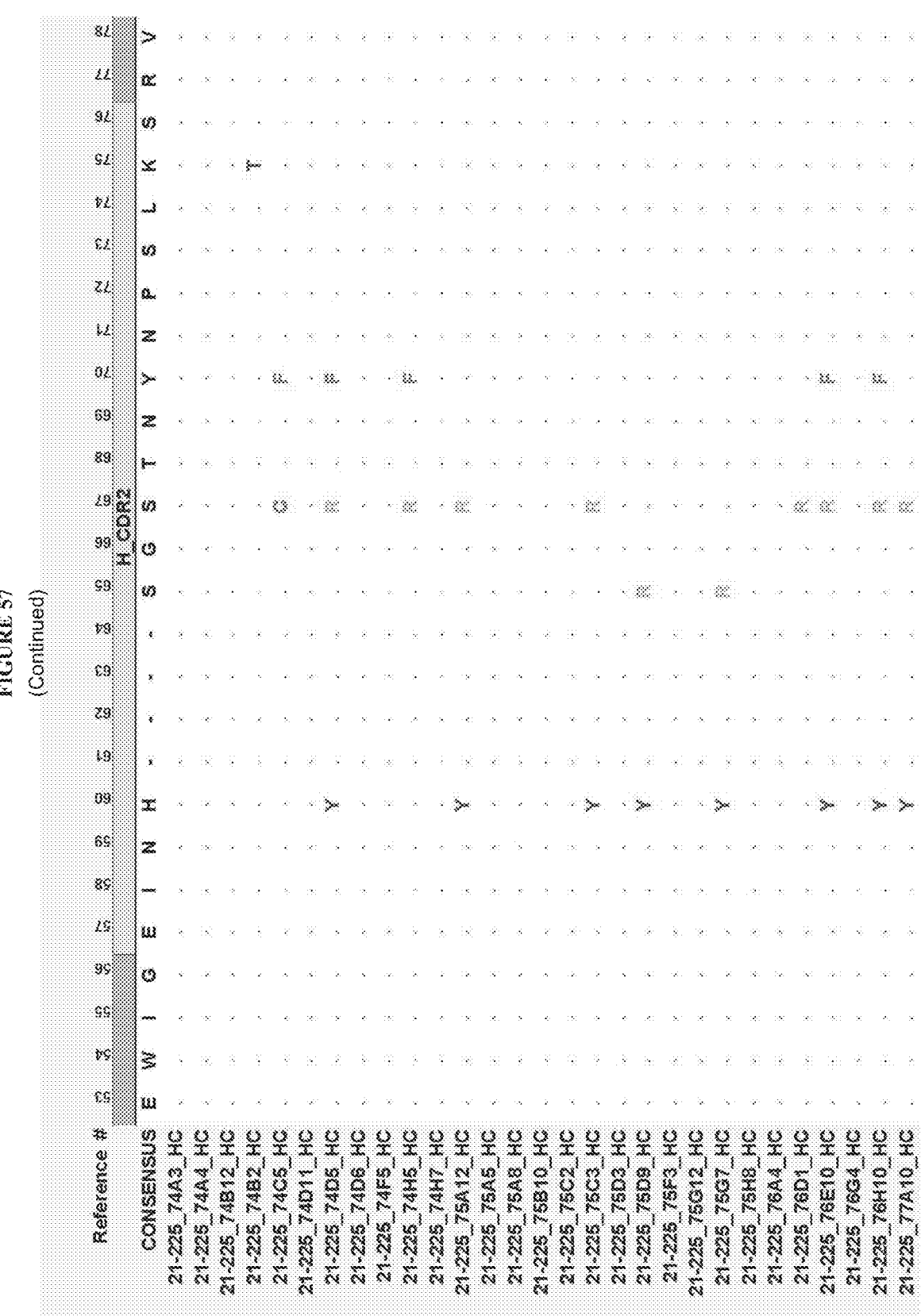
Figure 57:
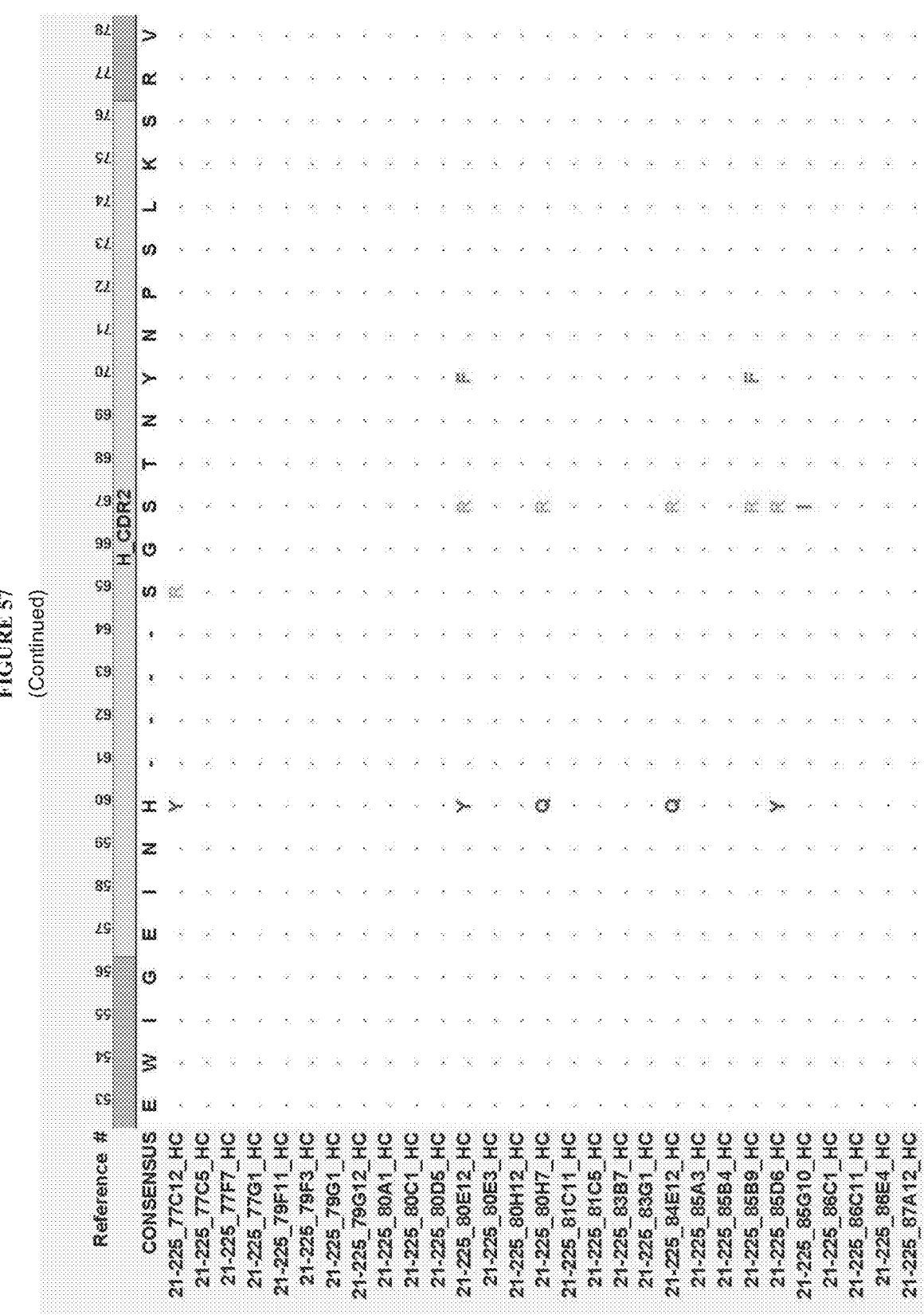
Figure 57:
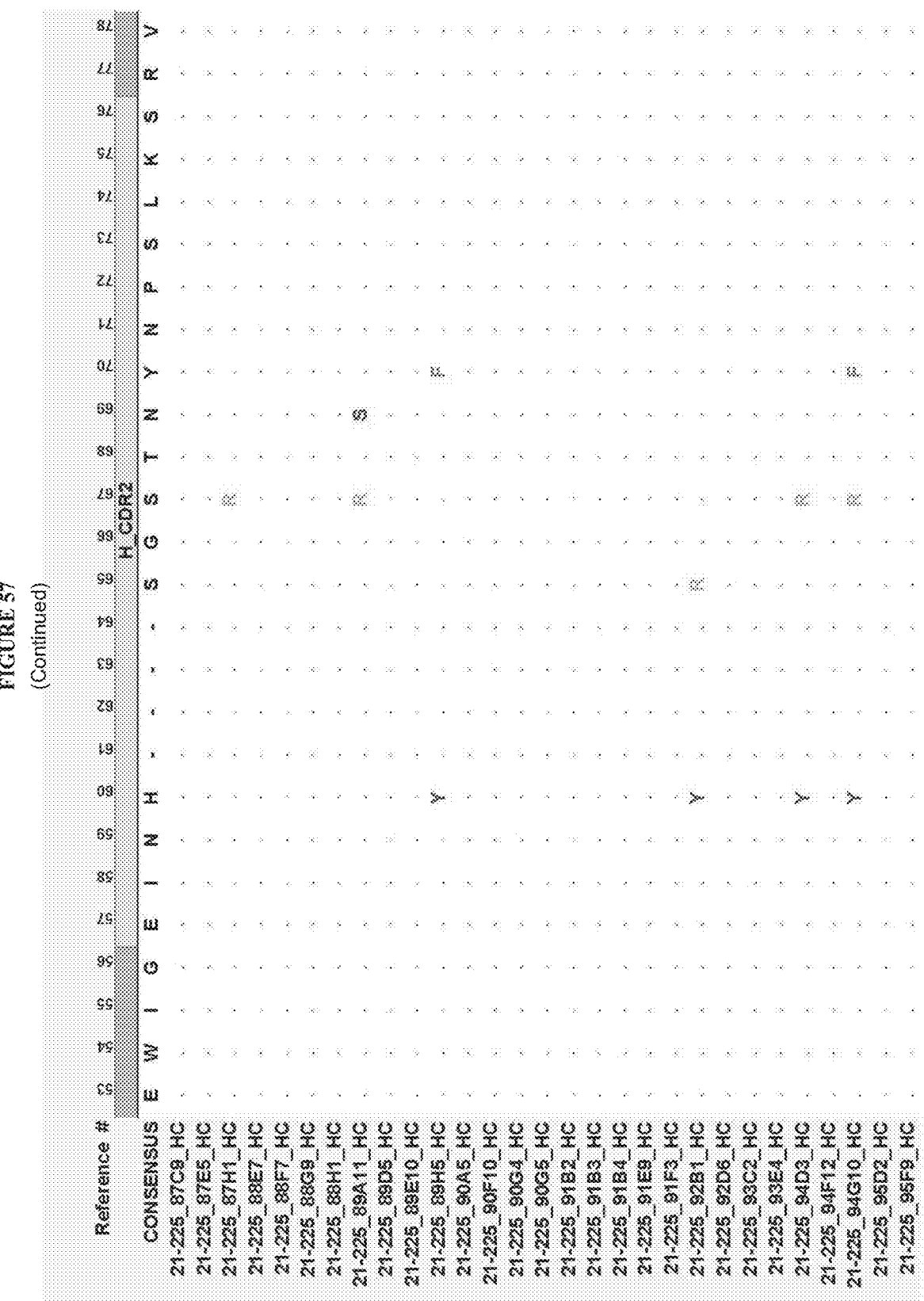
Figure 57:
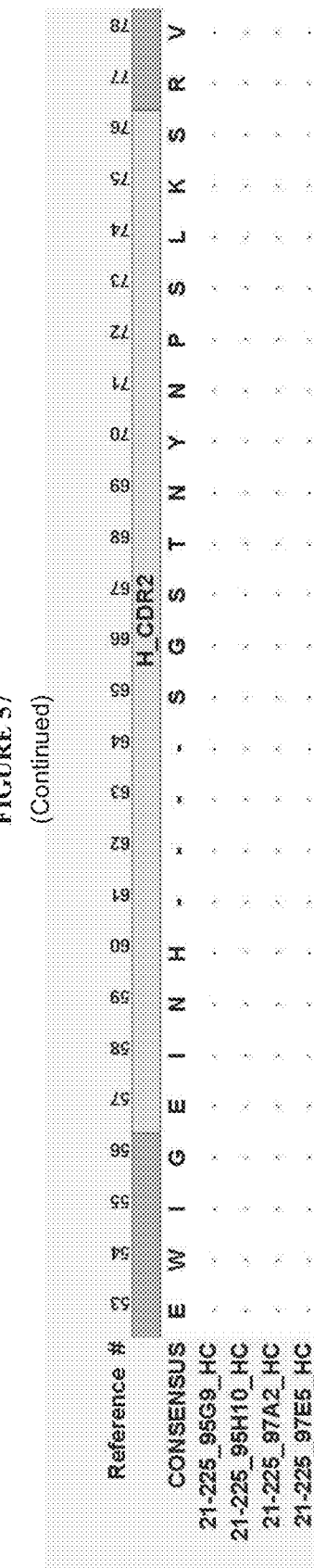
Figure 57:
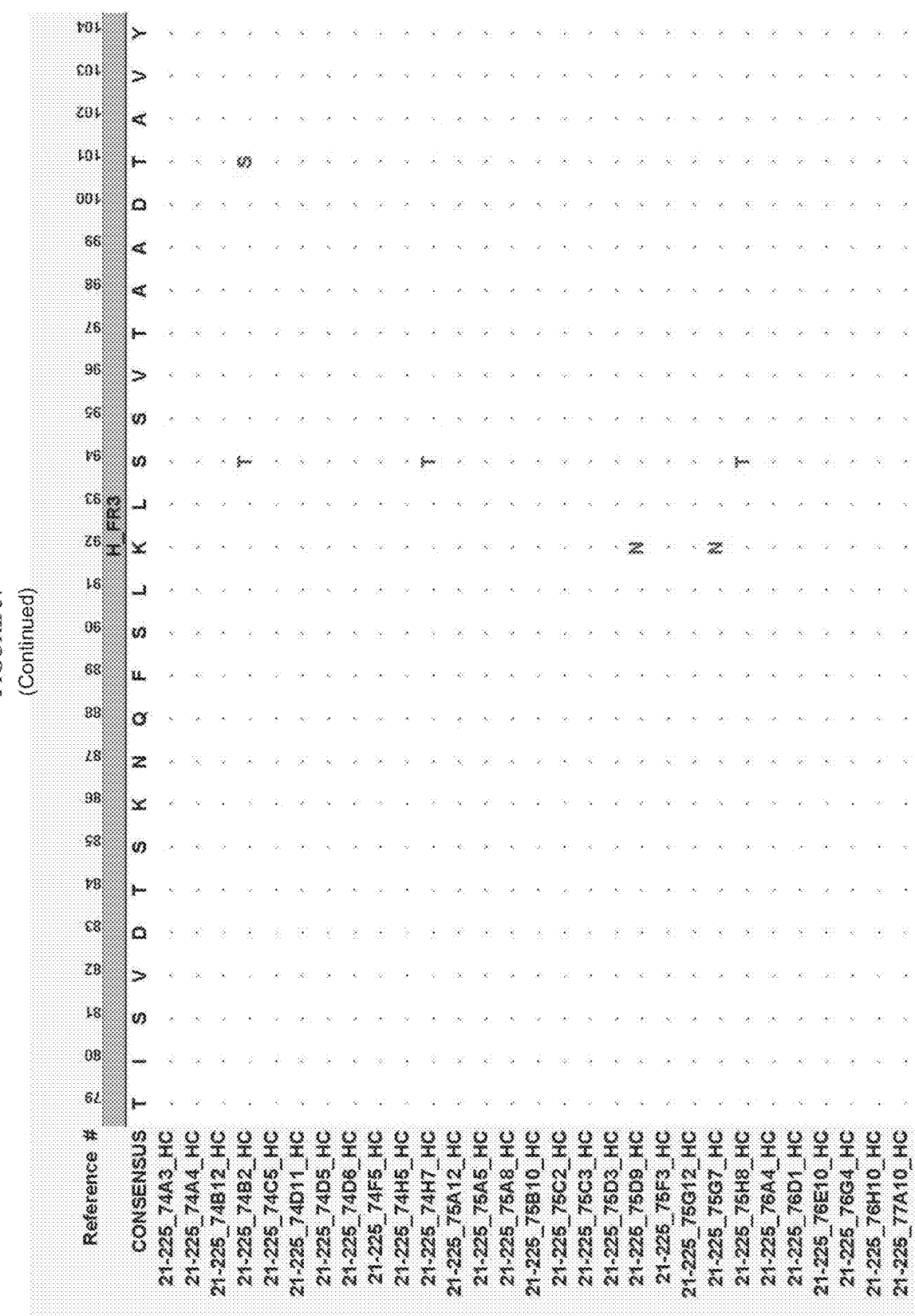
Figure 57:
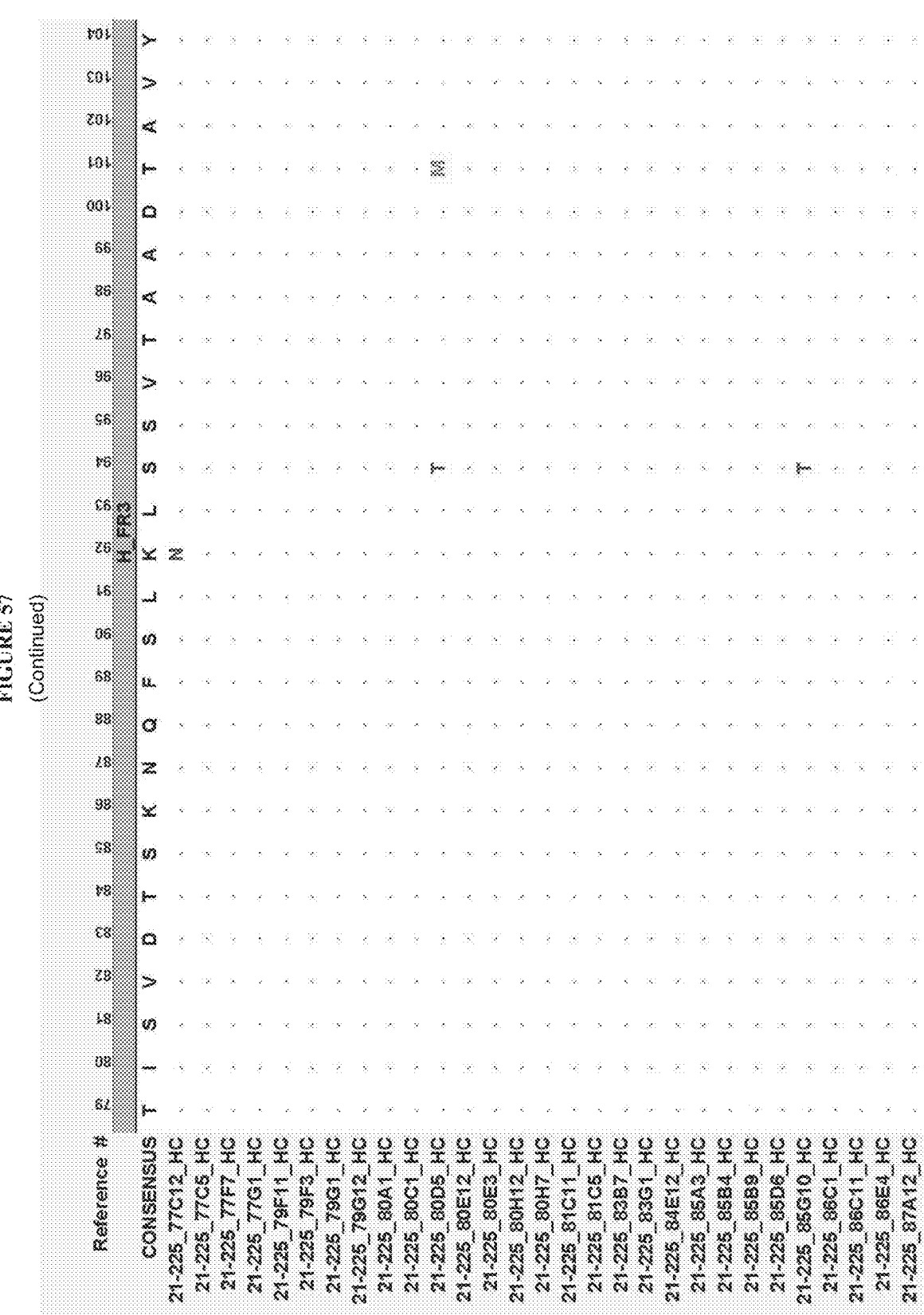
Figure 57:
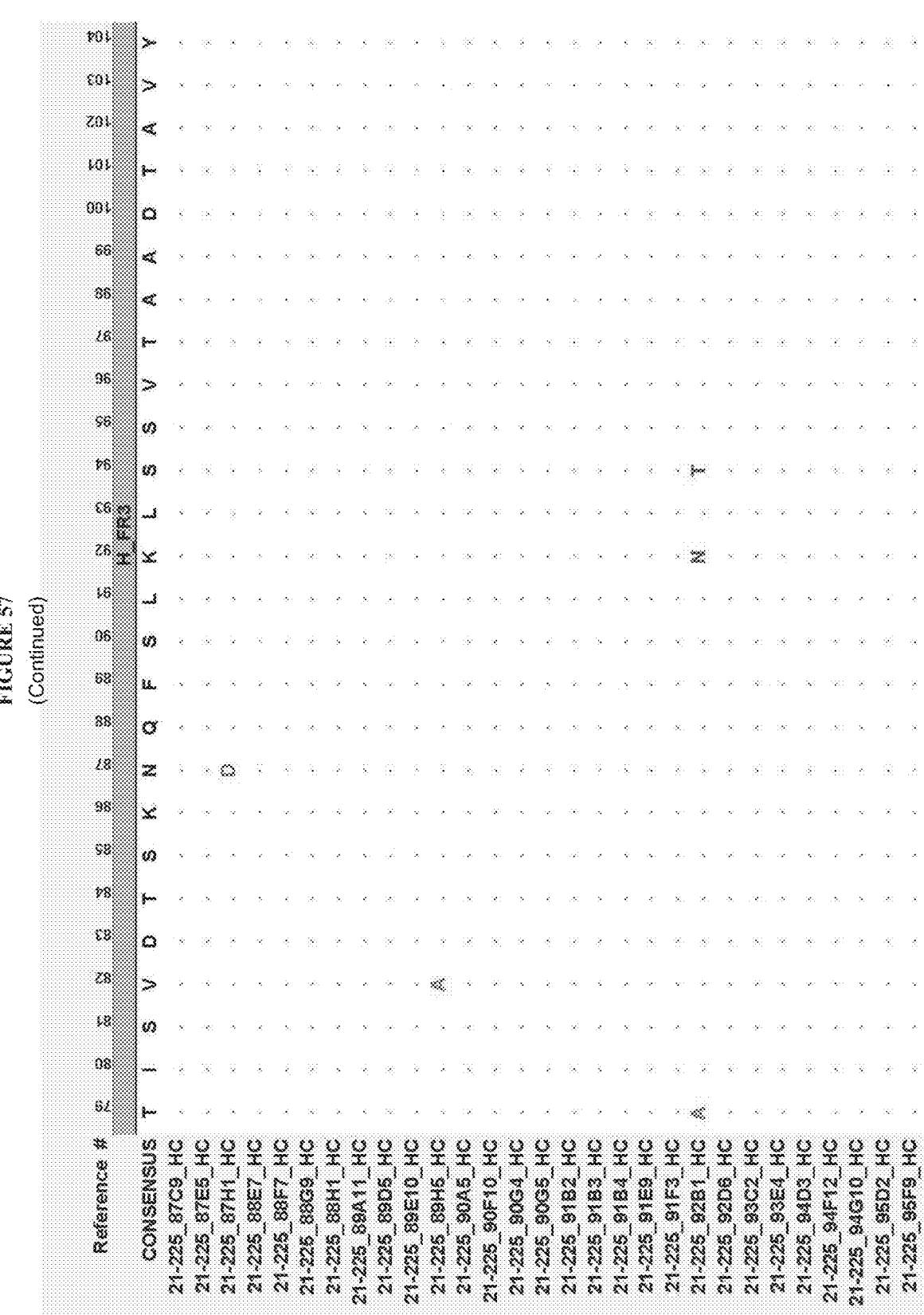
Figure 57:
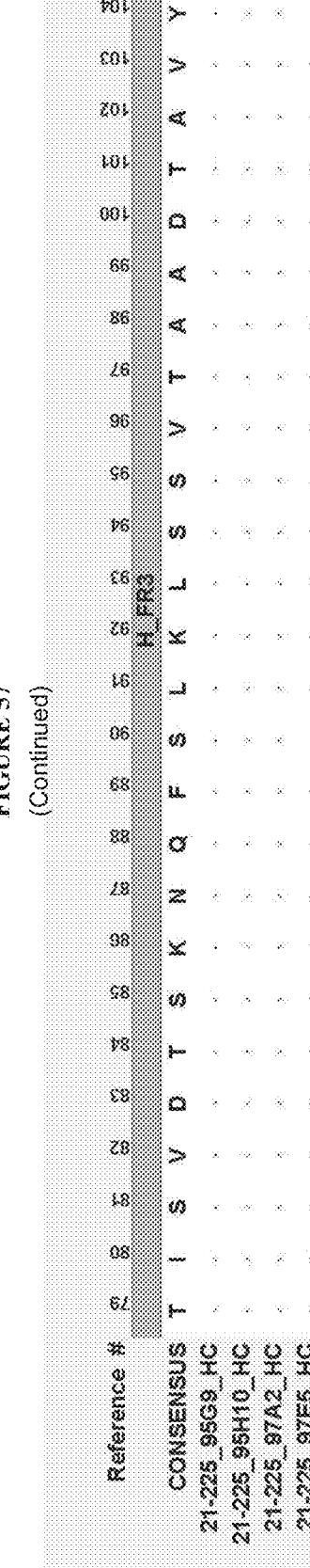
Figure 57:
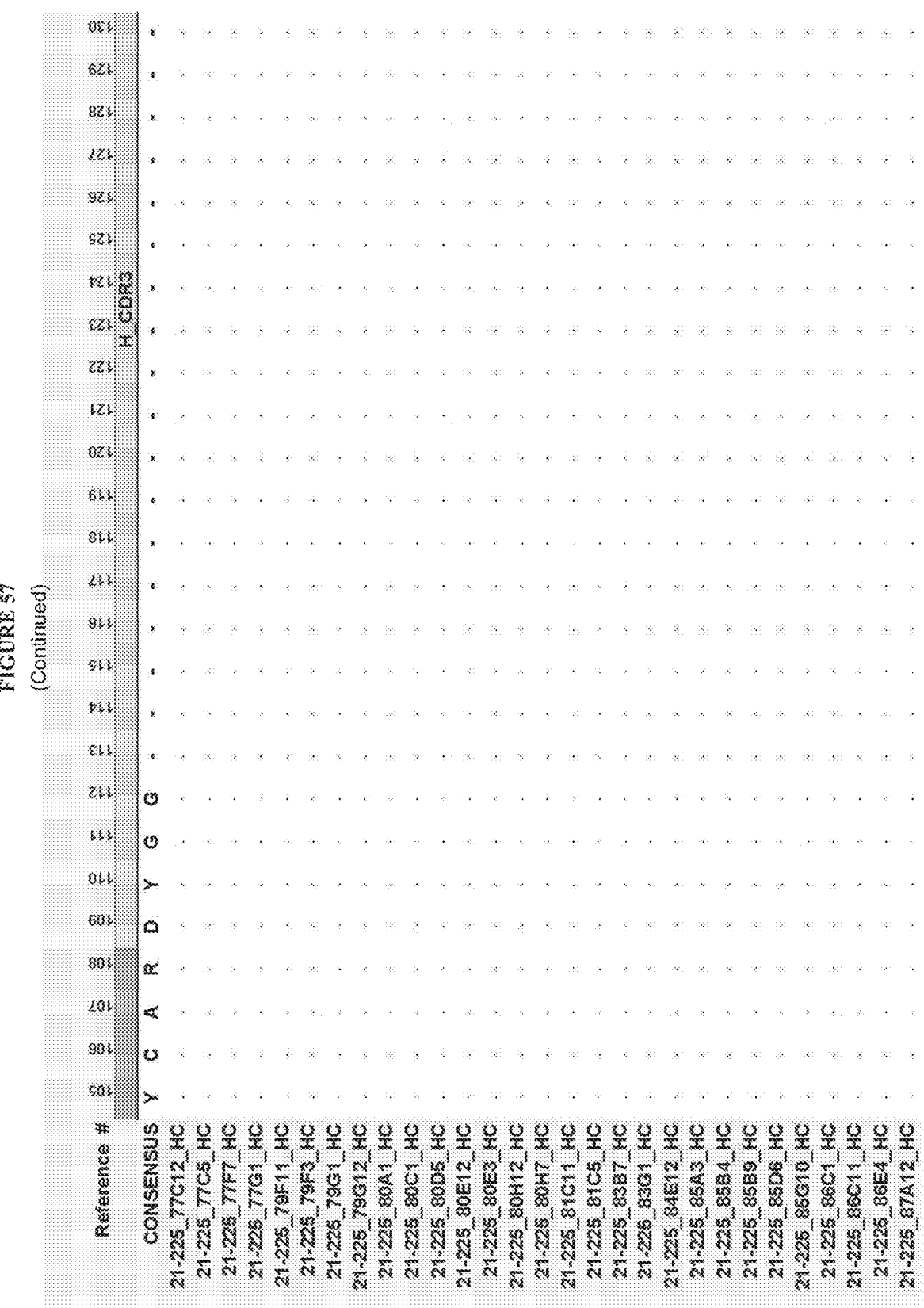
Figure 57:
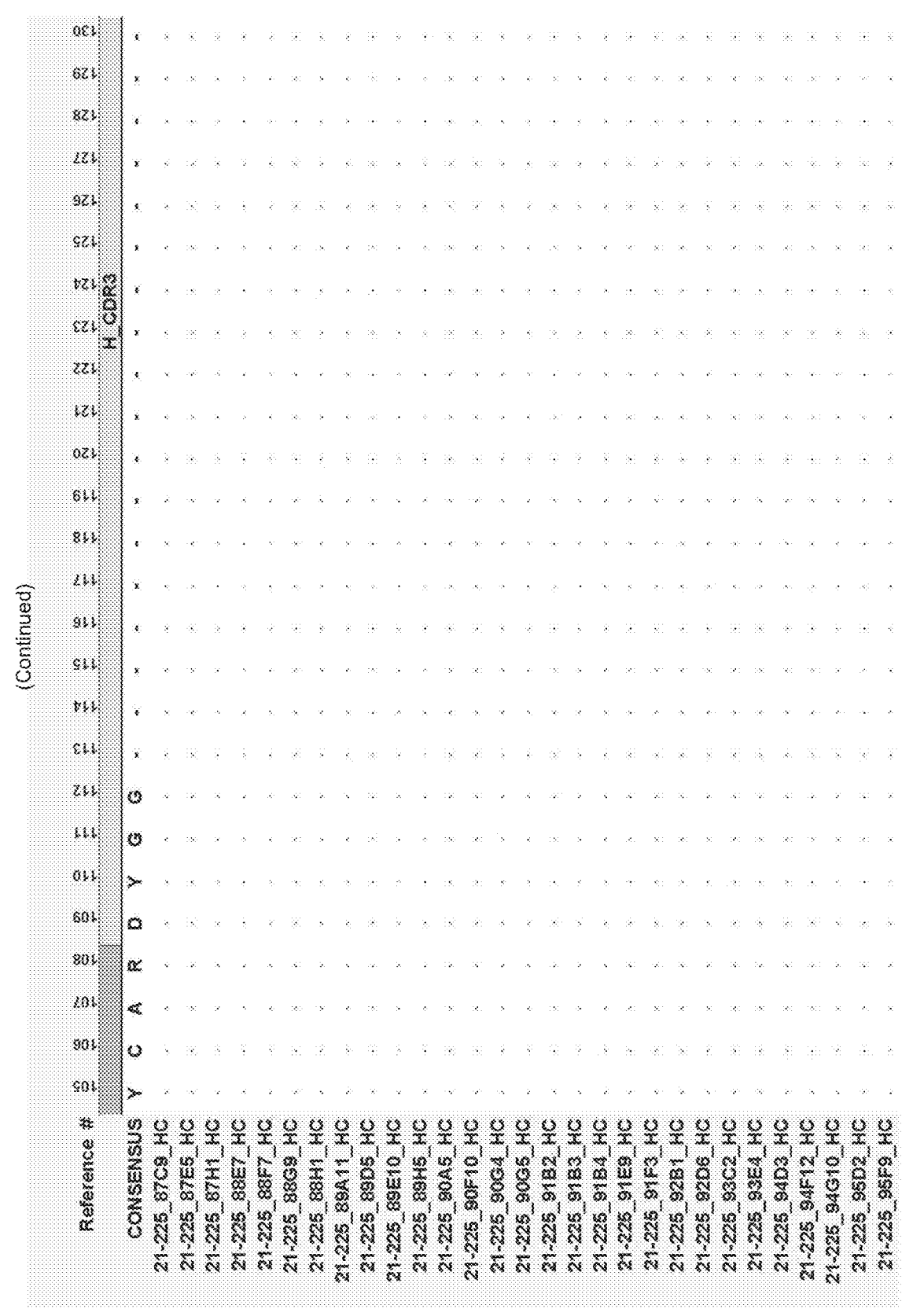
Figure 57:
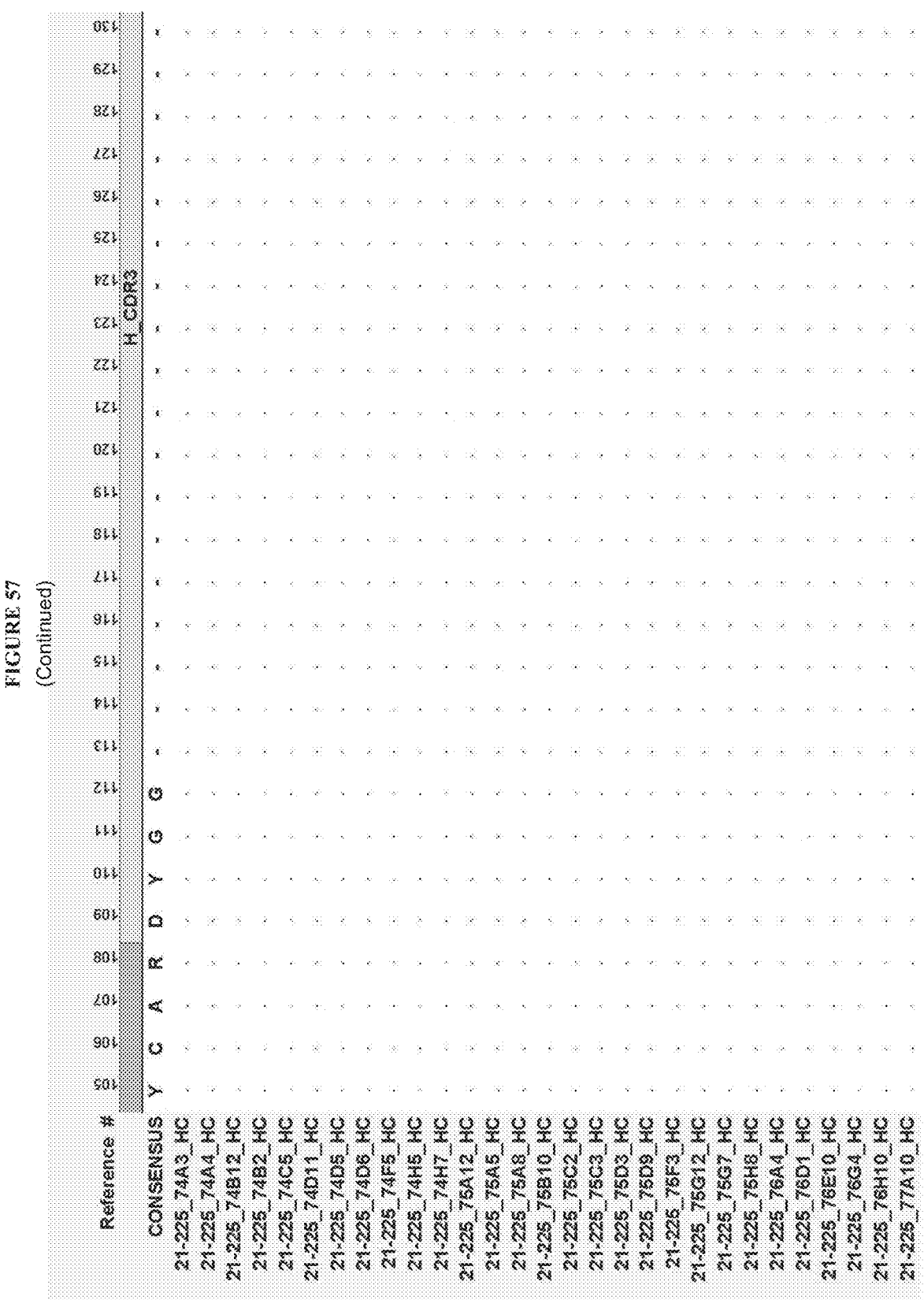
Figure 57:
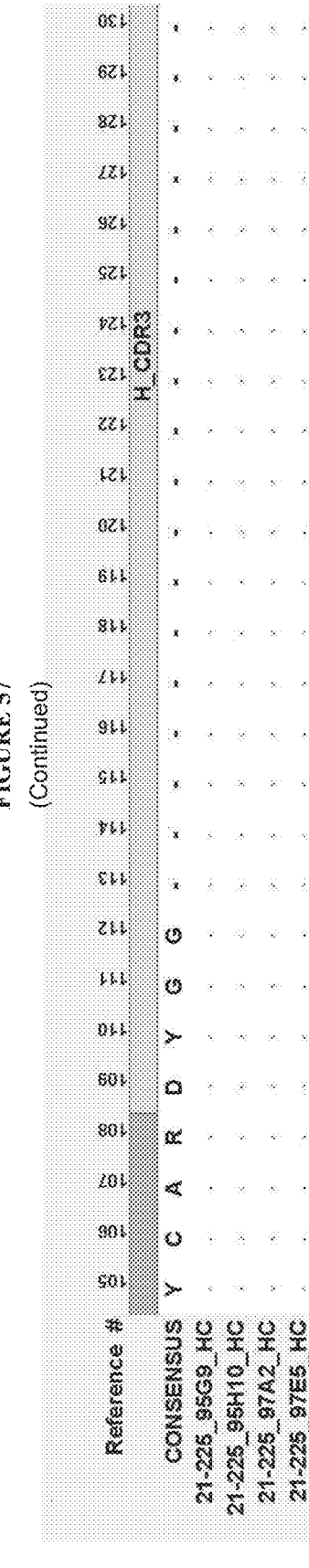
Figure 57:
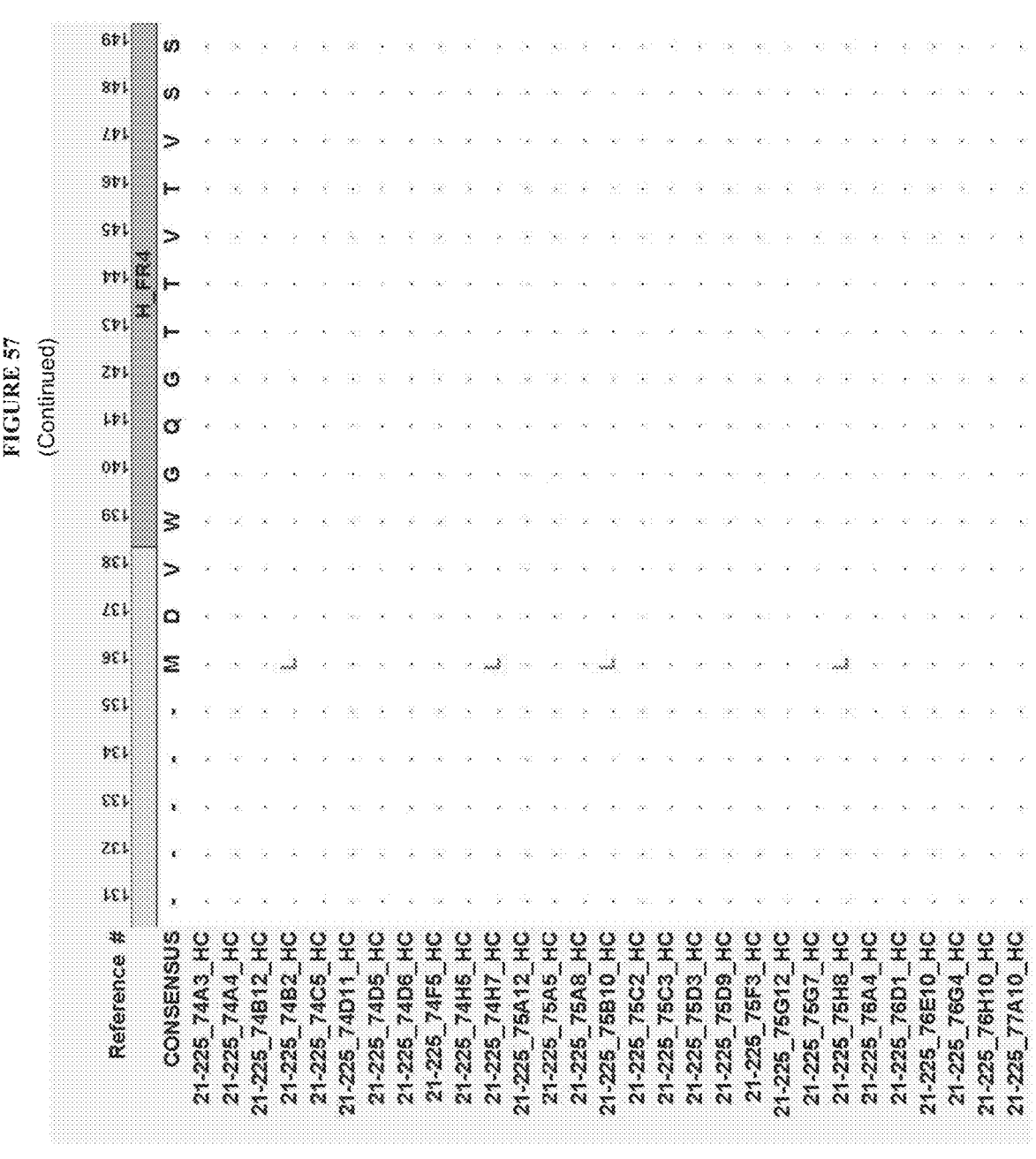
Figure 57:
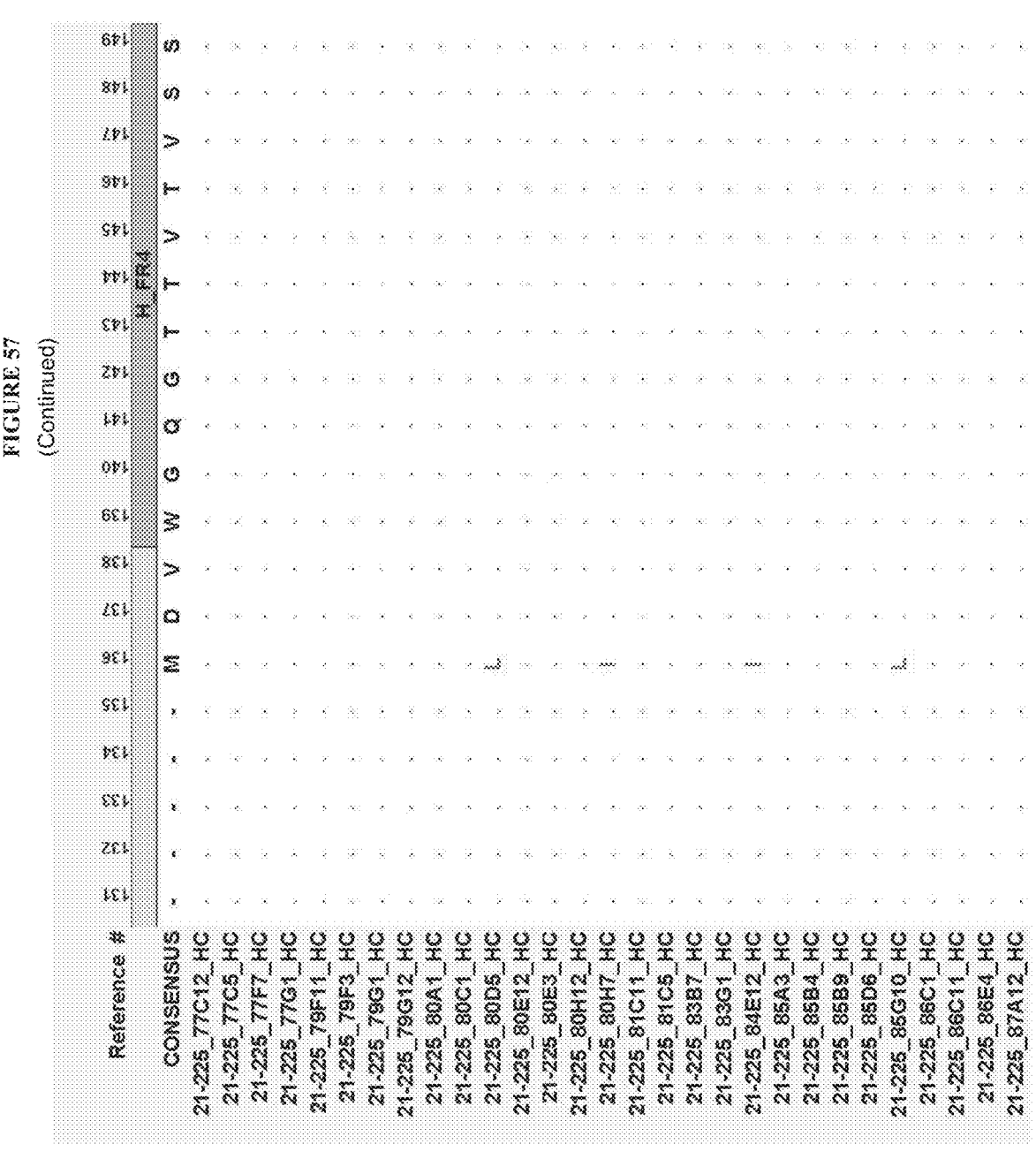
Figure 57:
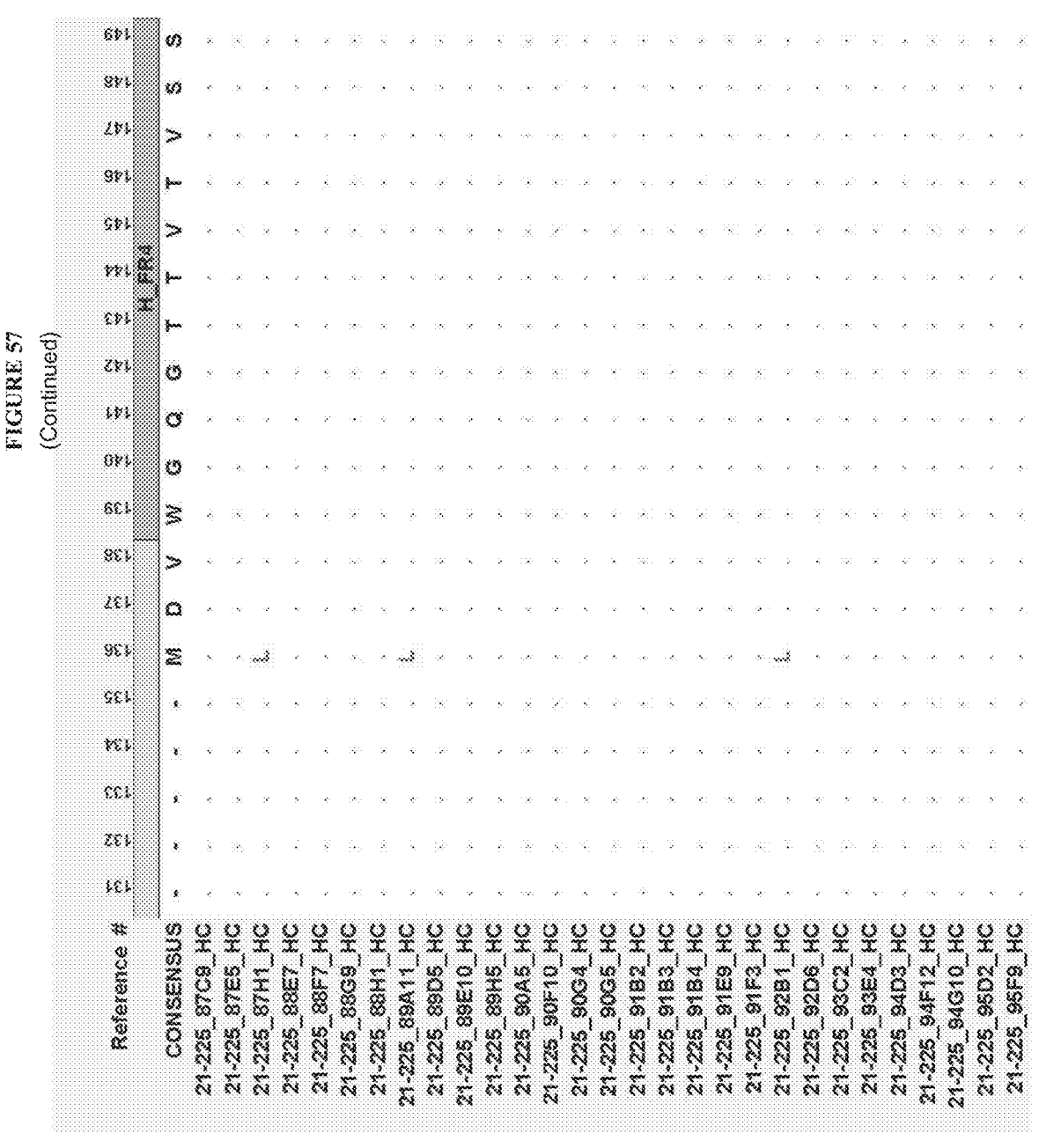
Figure 57:
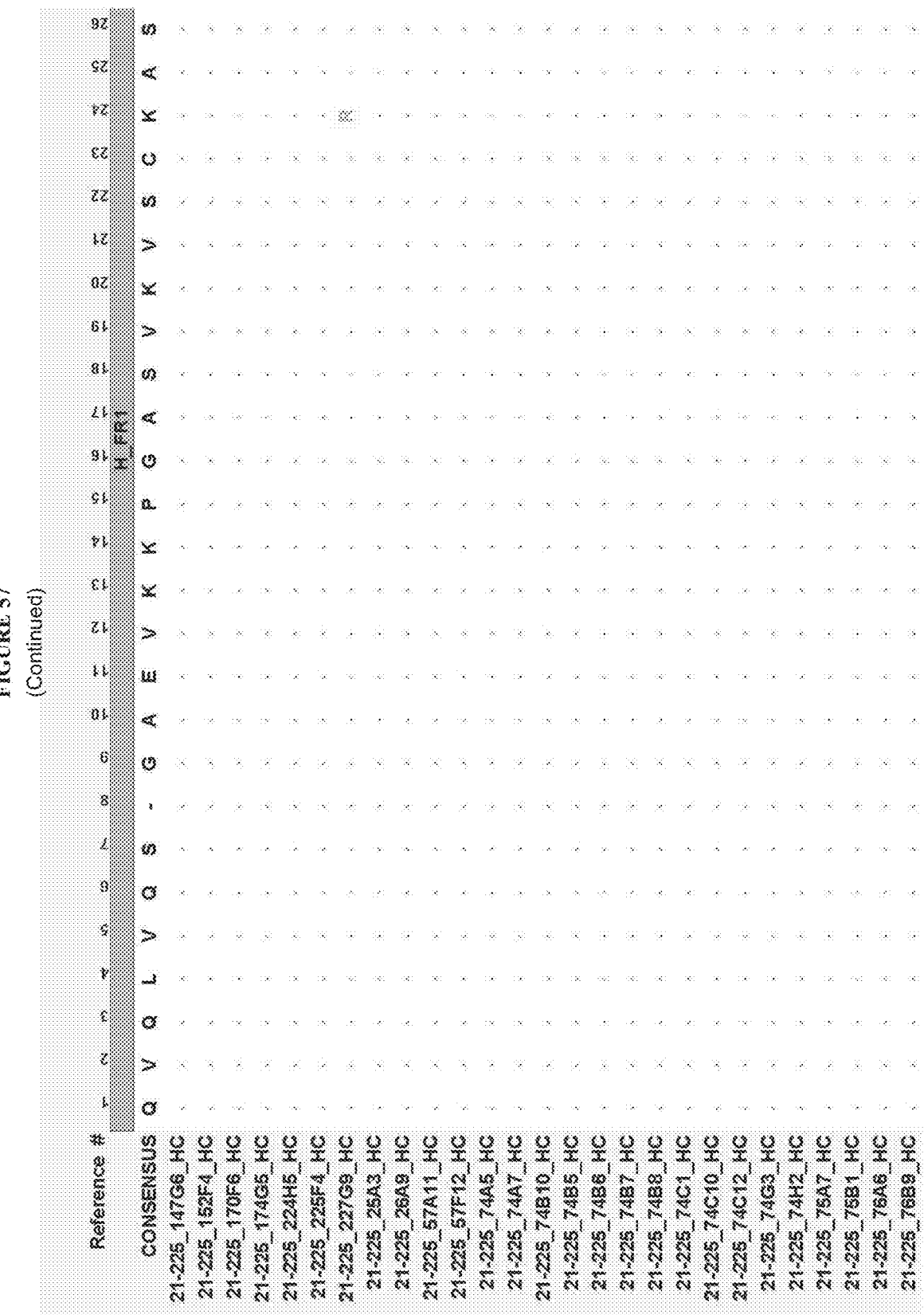
Figure 57:
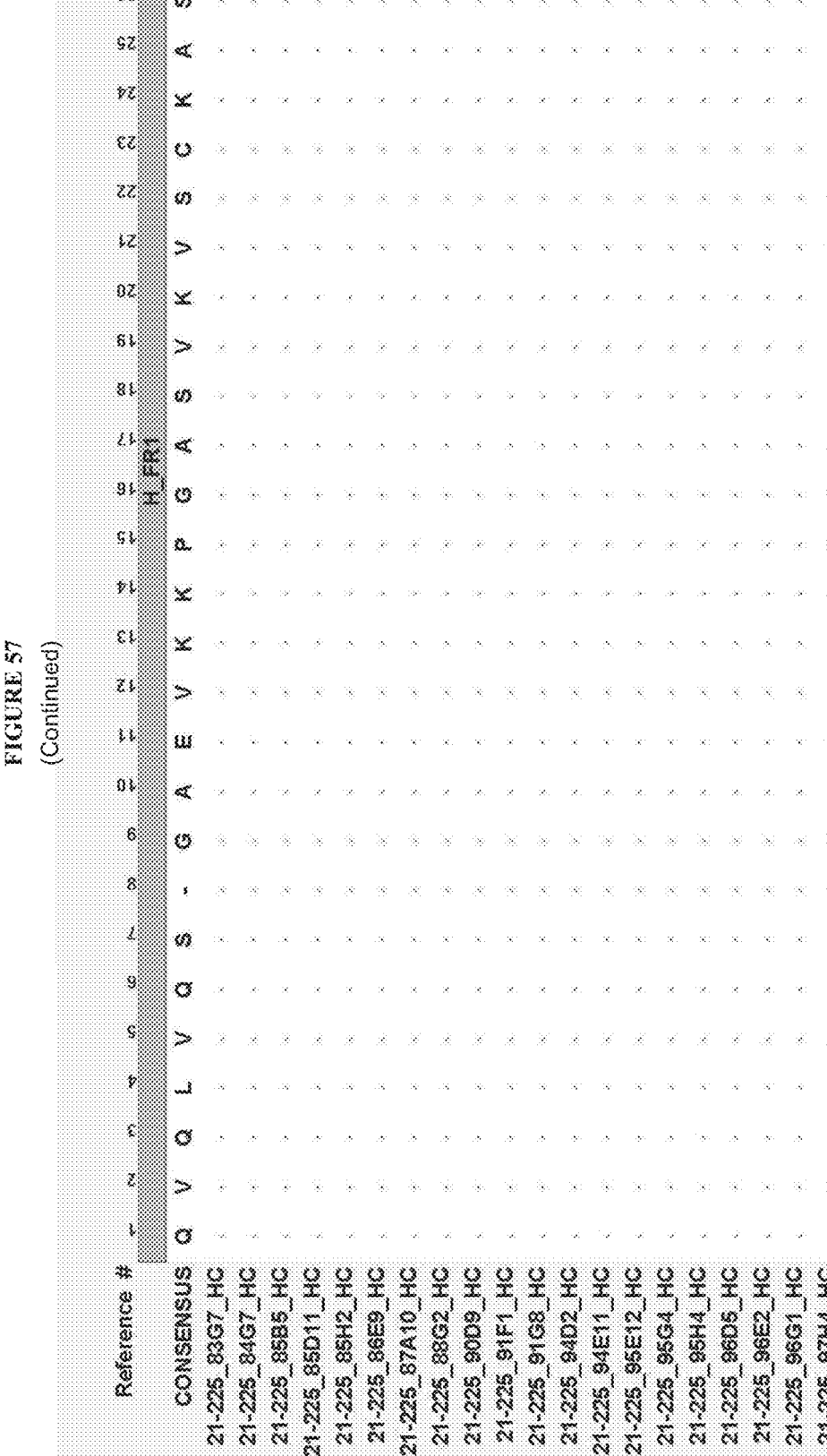
Figure 57:
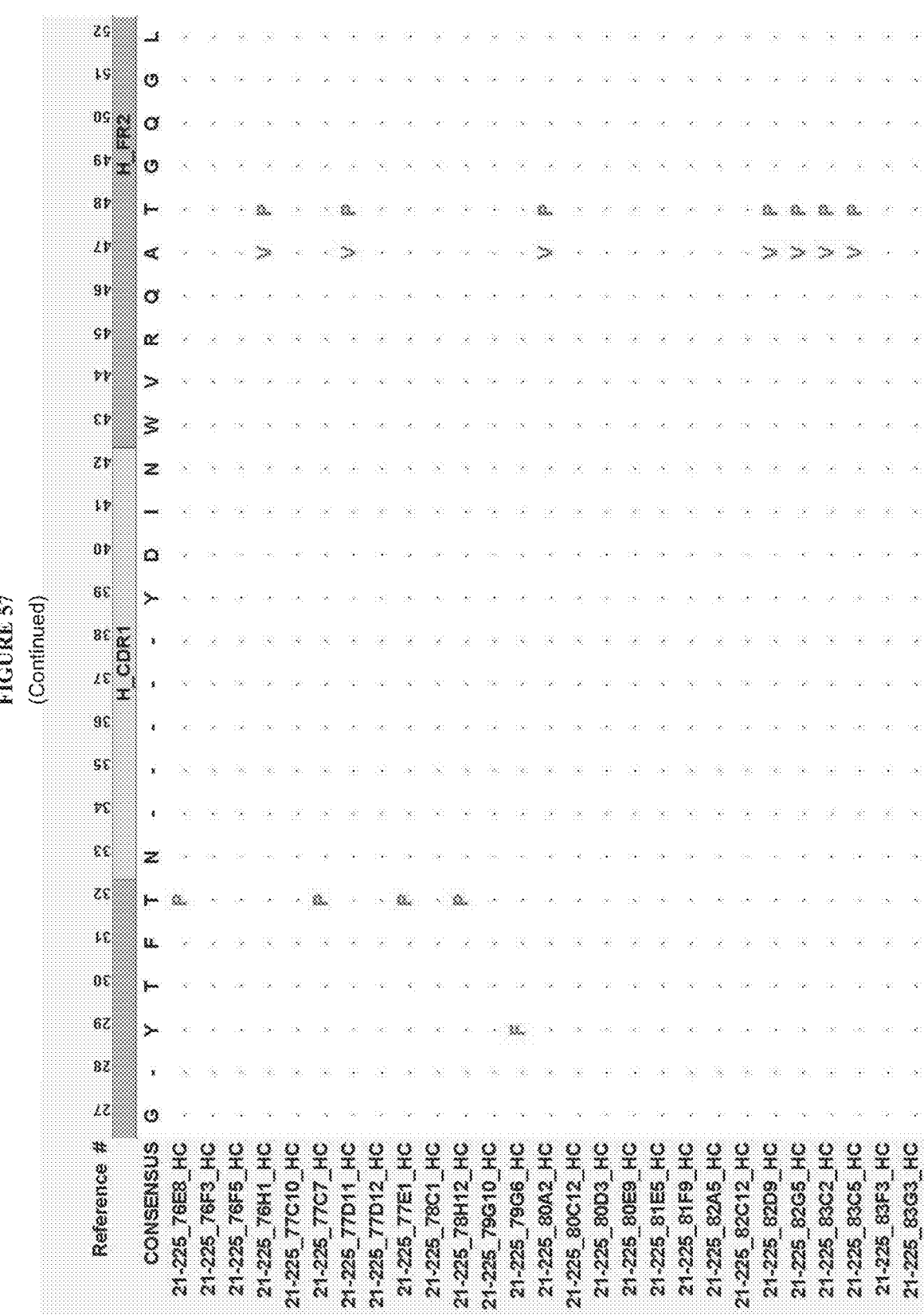
Figure 57:
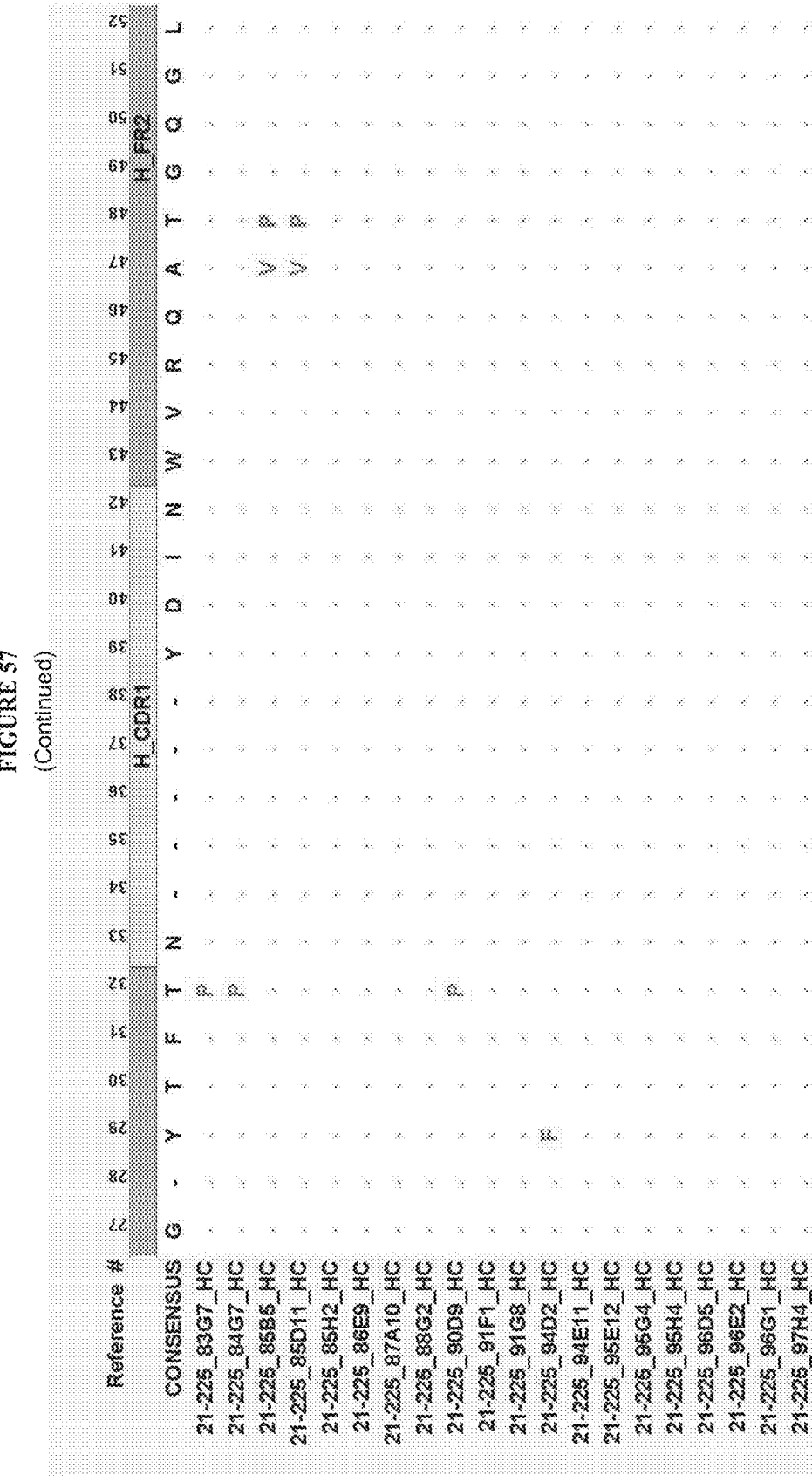
Figure 57:
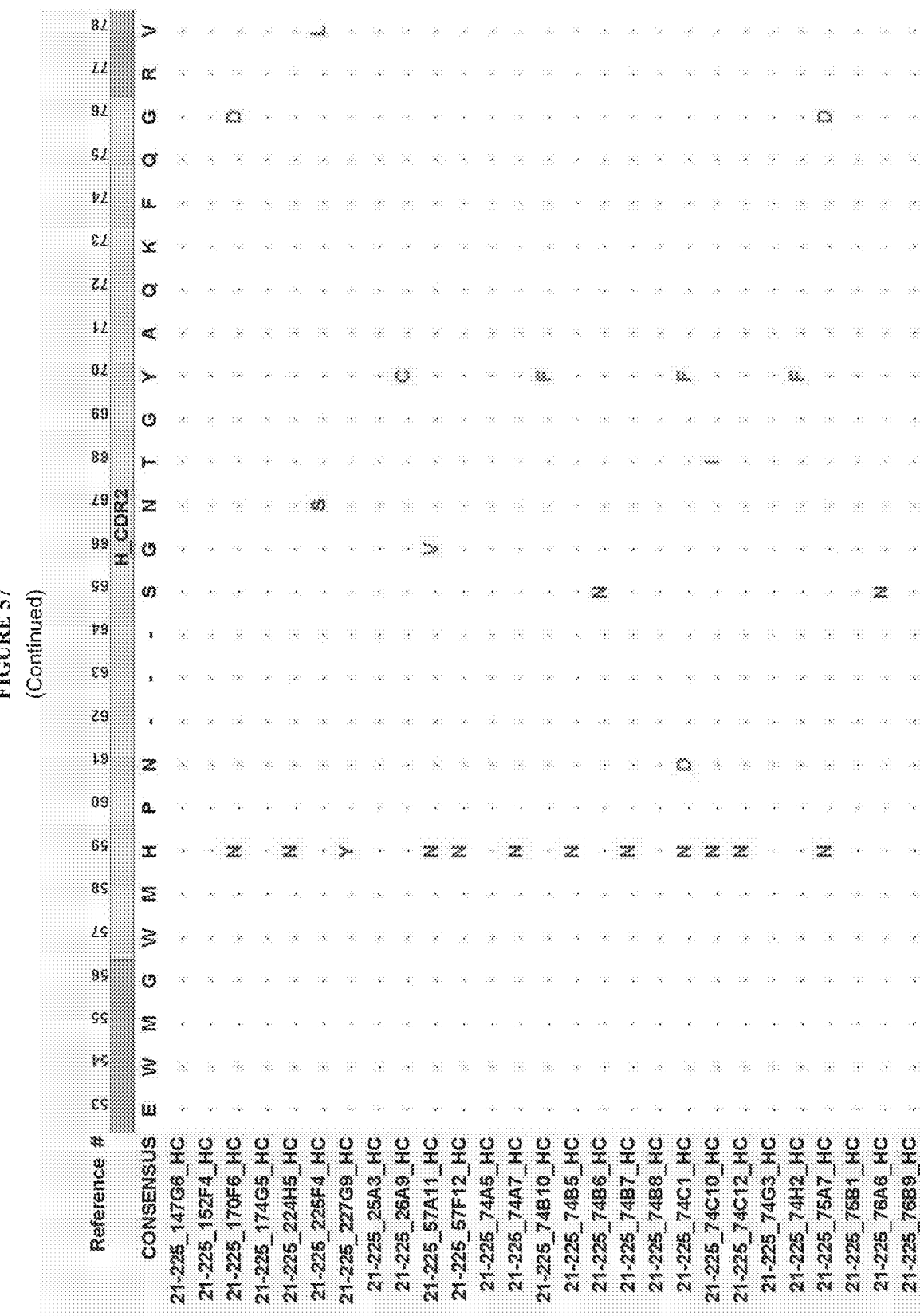
Figure 57:
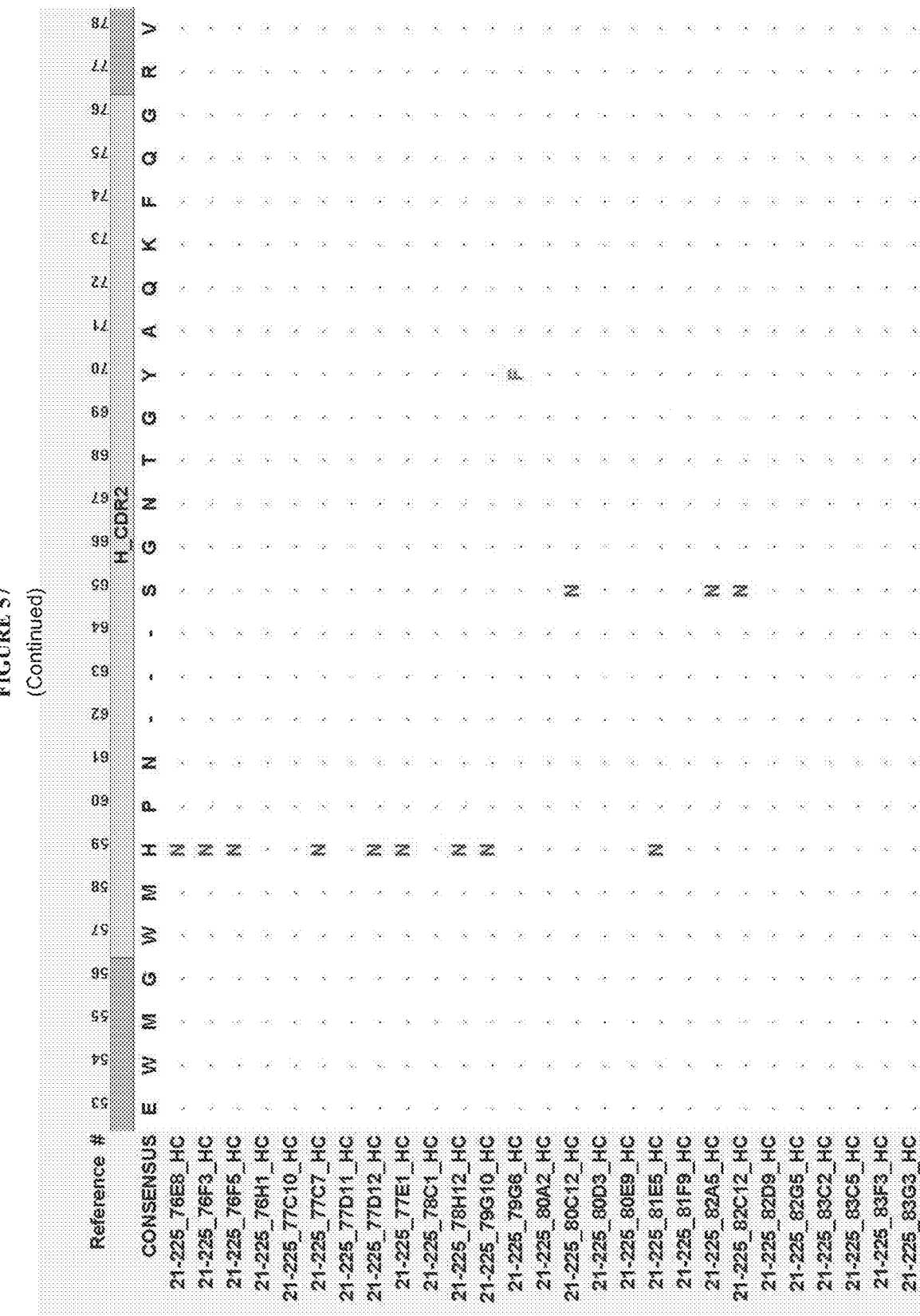
Figure 57:
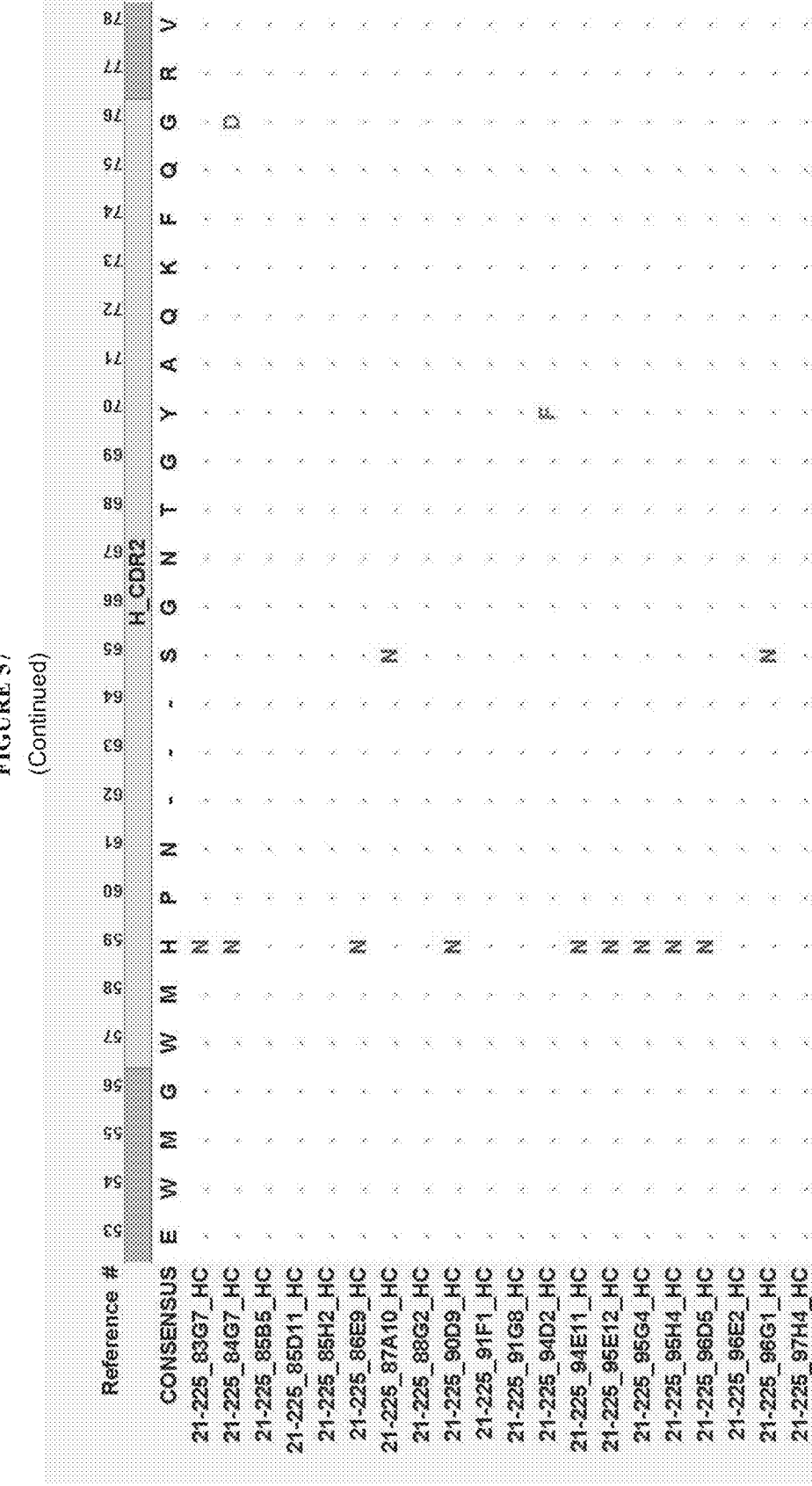
Figure 57:
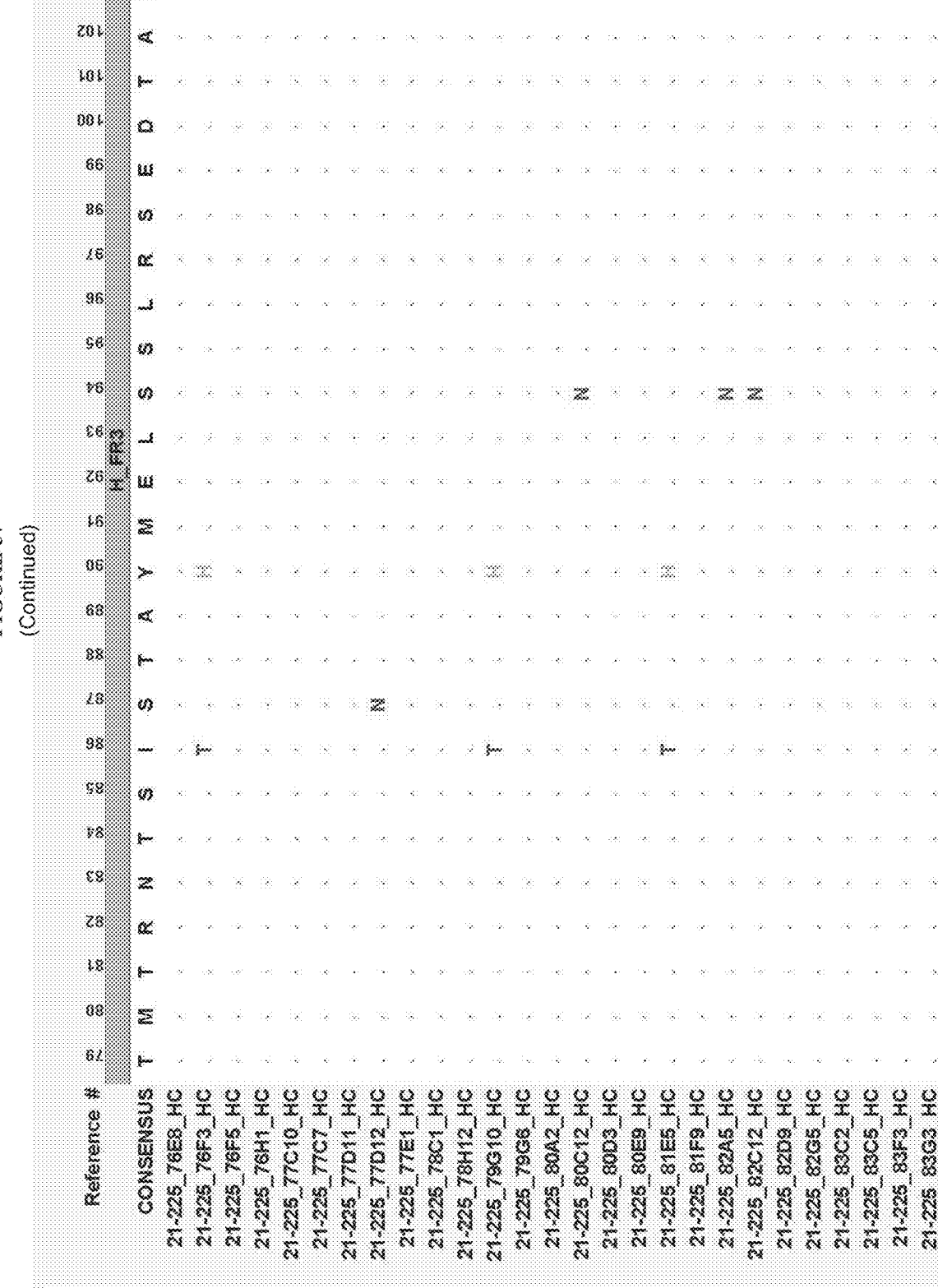
Figure 57:
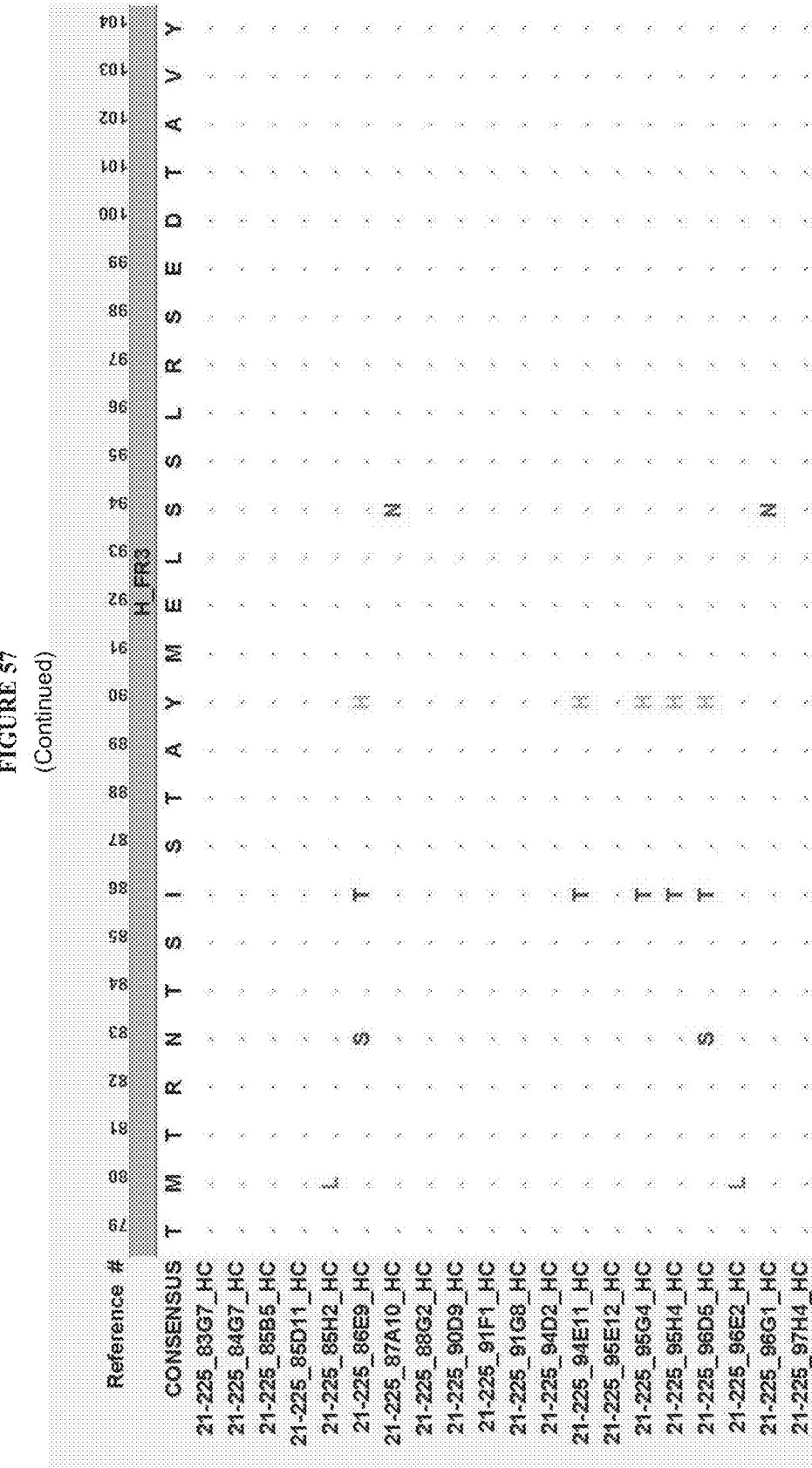
Figure 57:
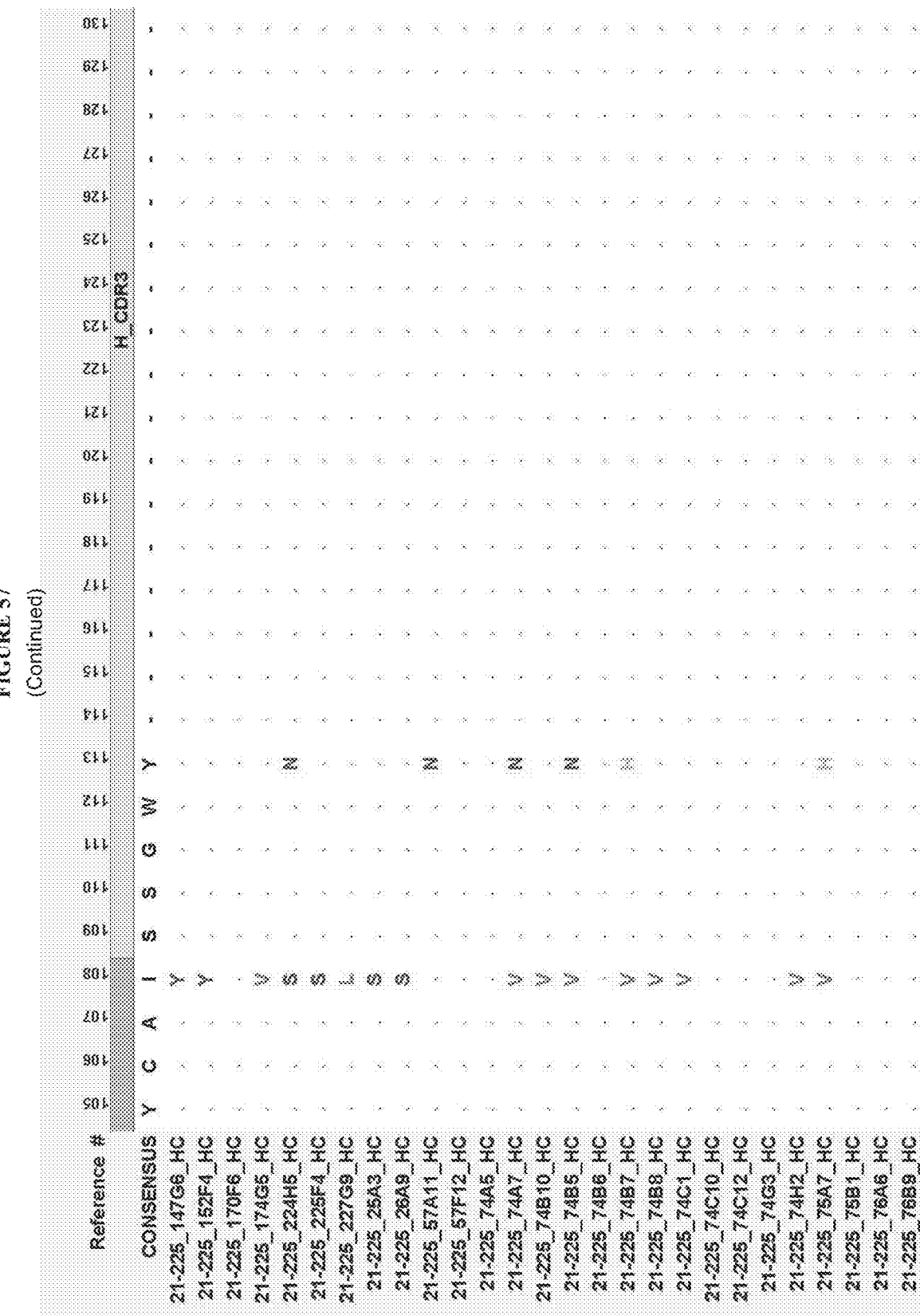
Figure 57:
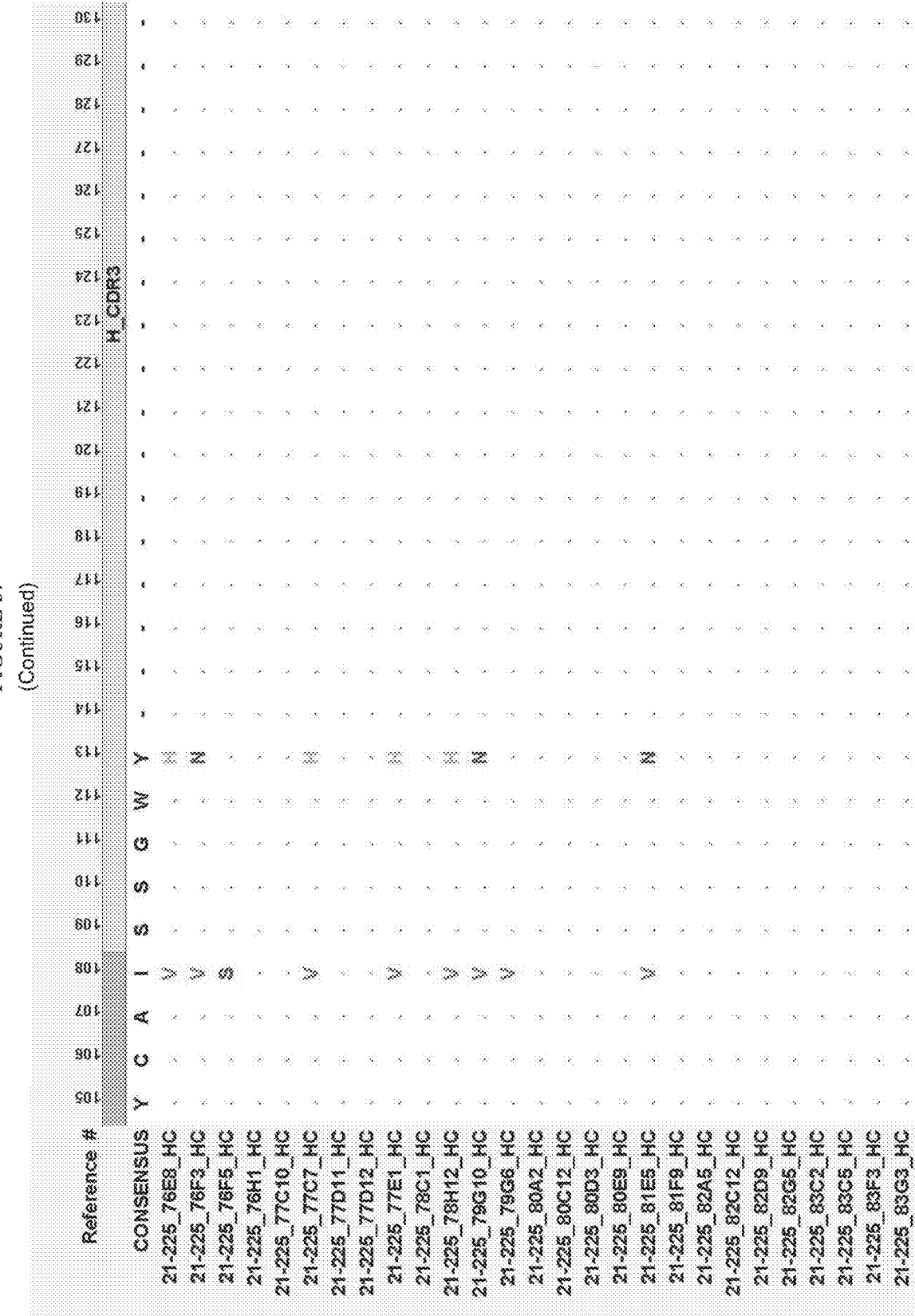
Figure 57:
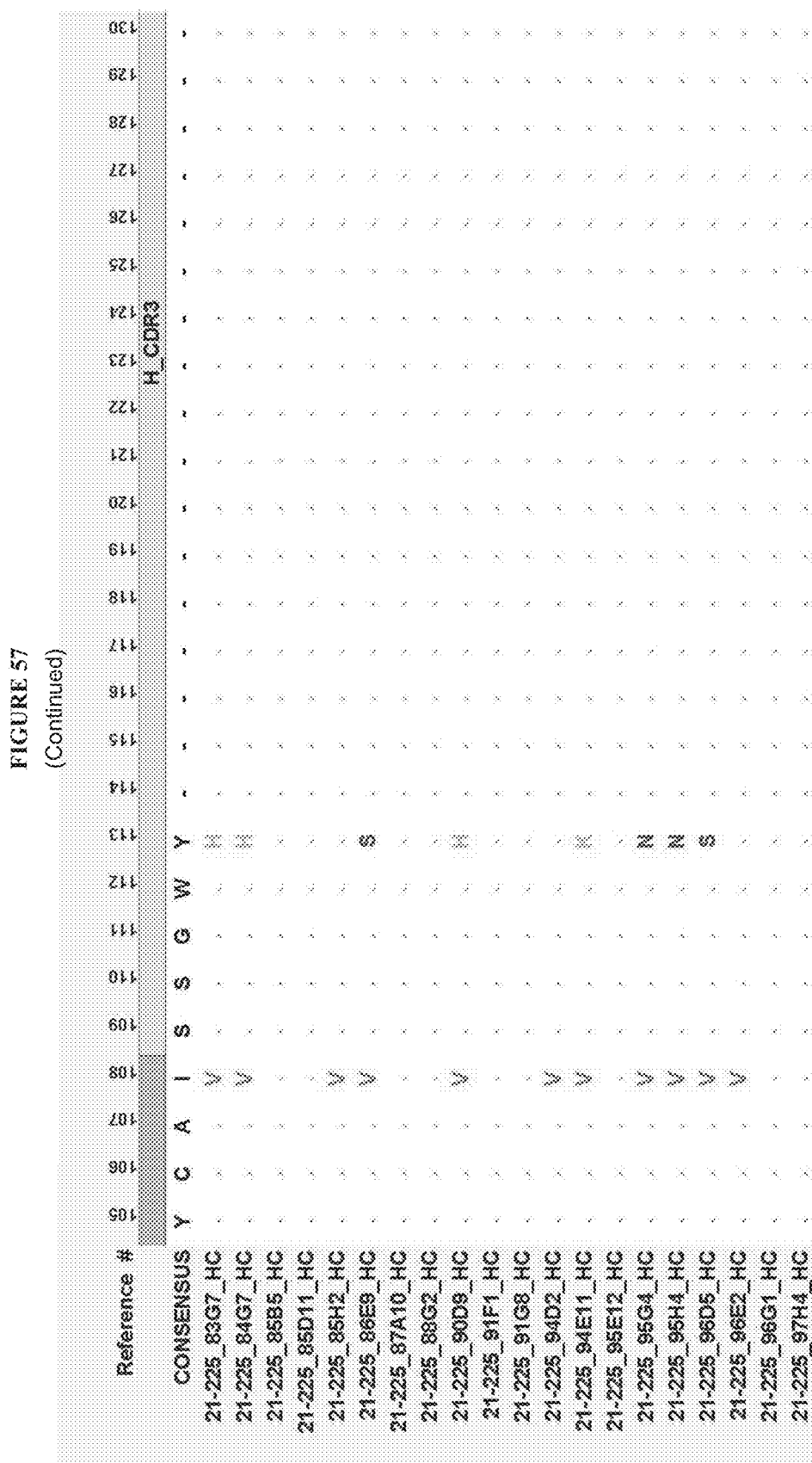
Figure 57:
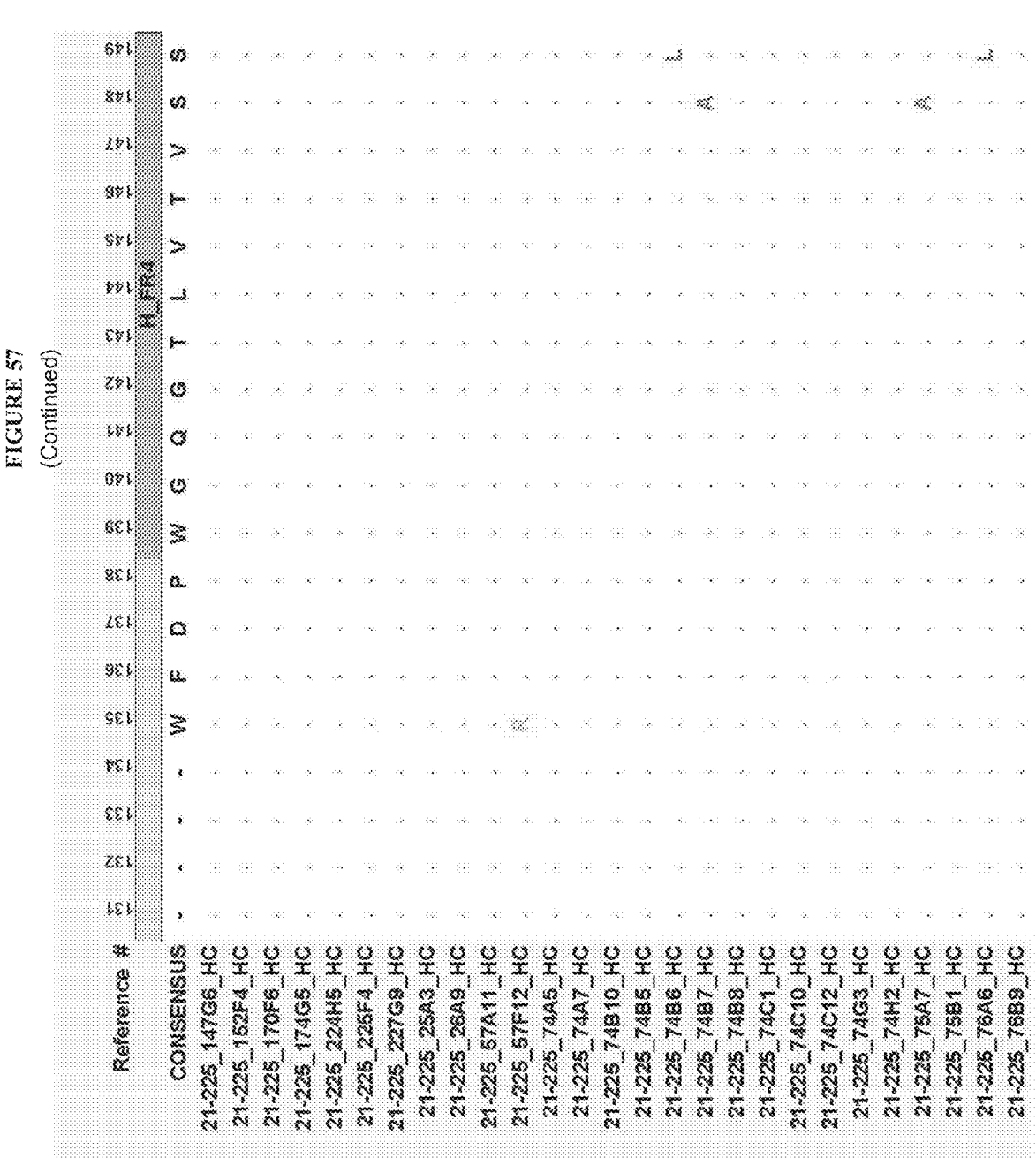
Figure 57:
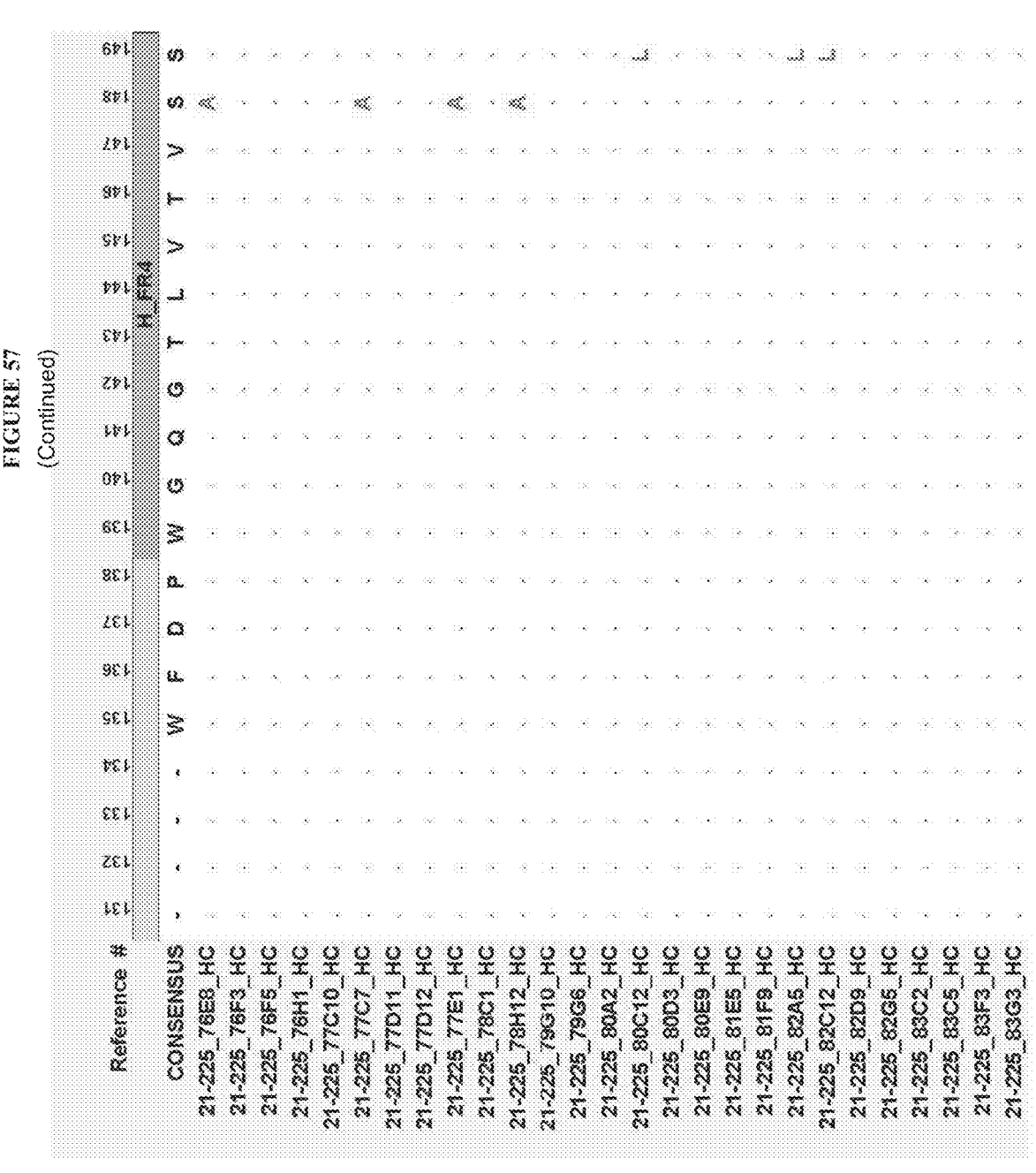
Figure 57:
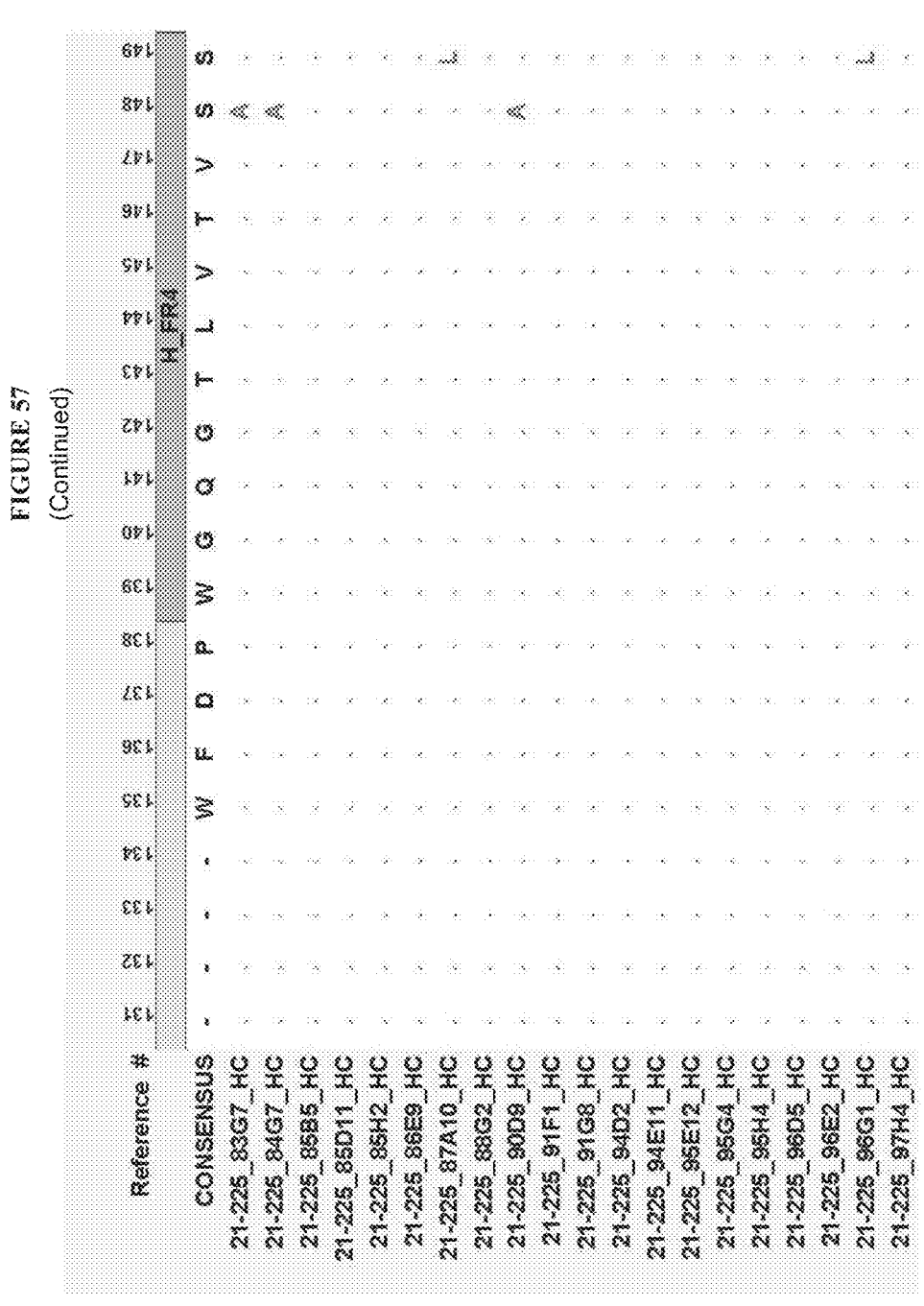
Figure 57:
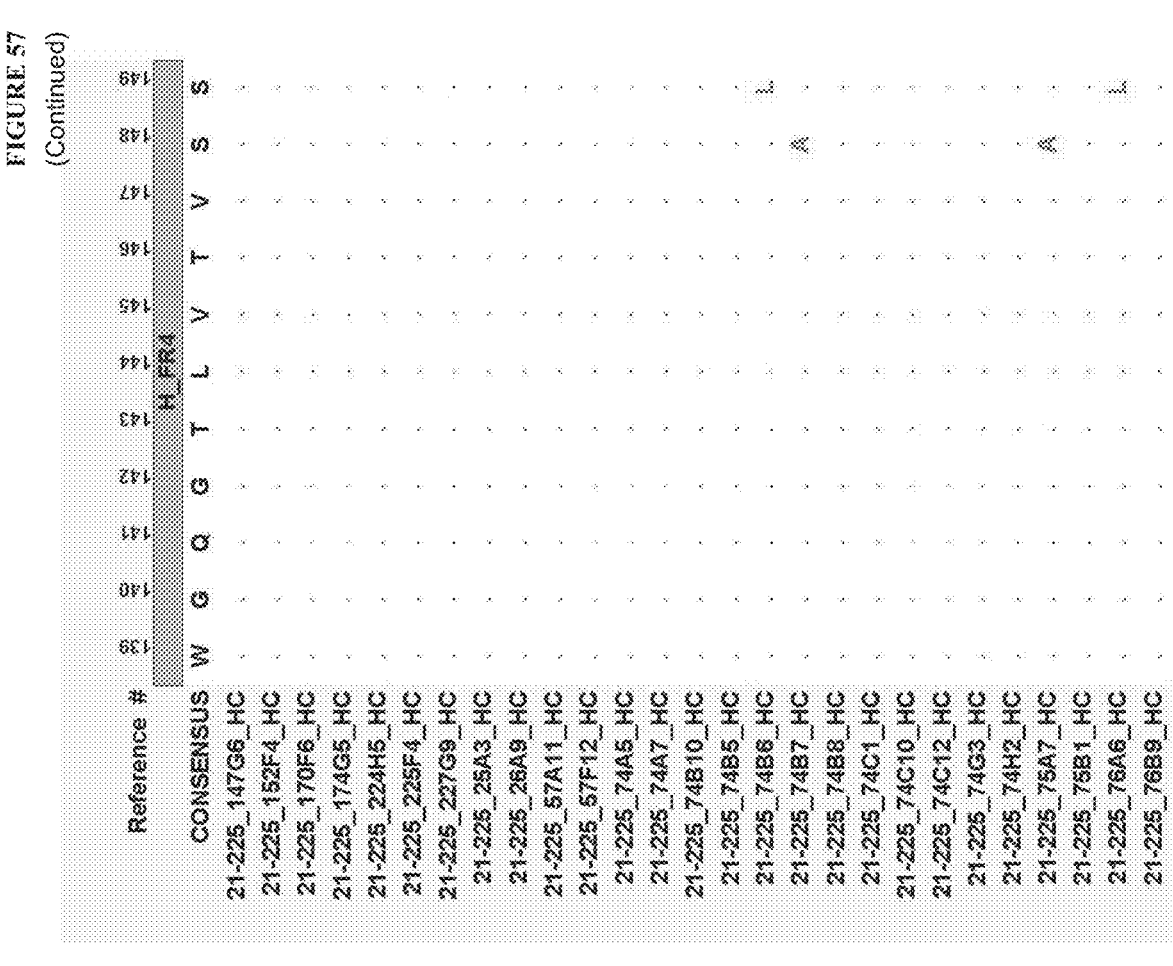
Figure 57:
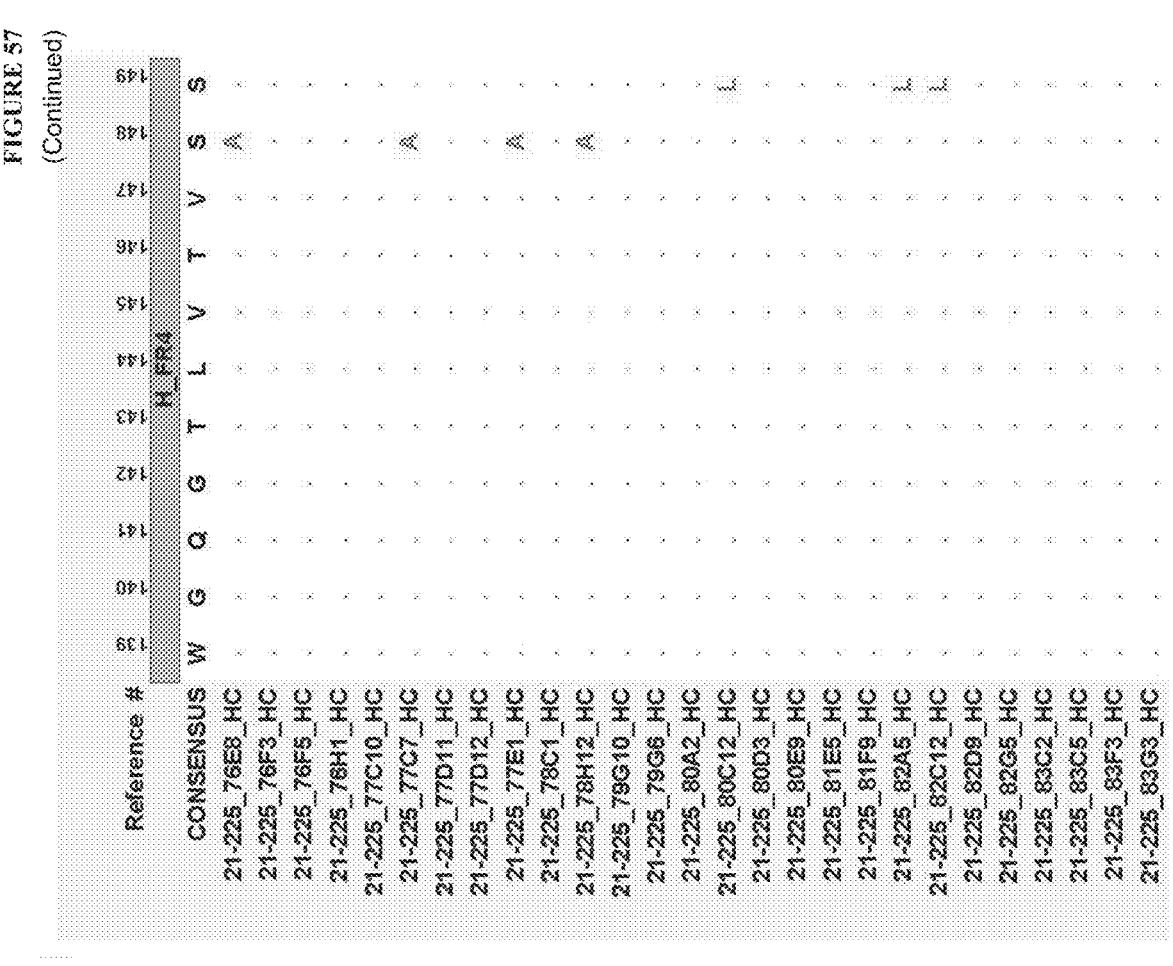
Figure 57:
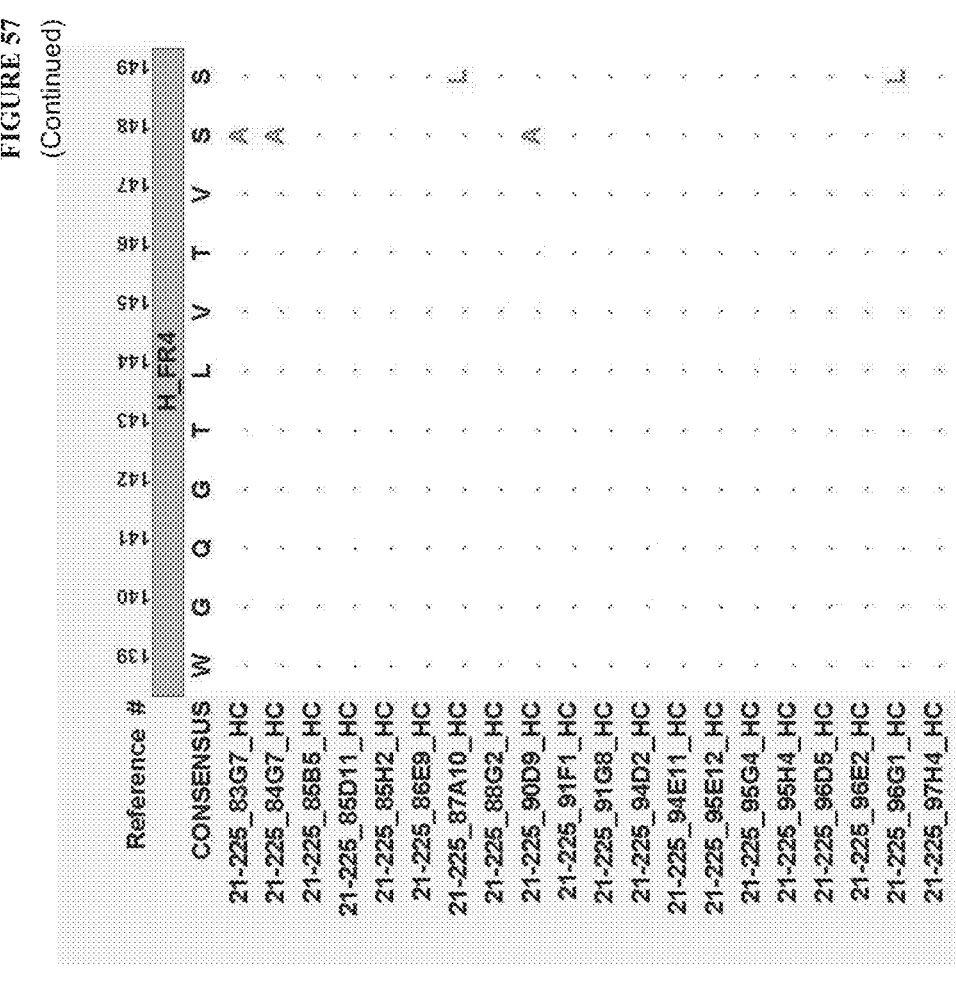
Figure 57:
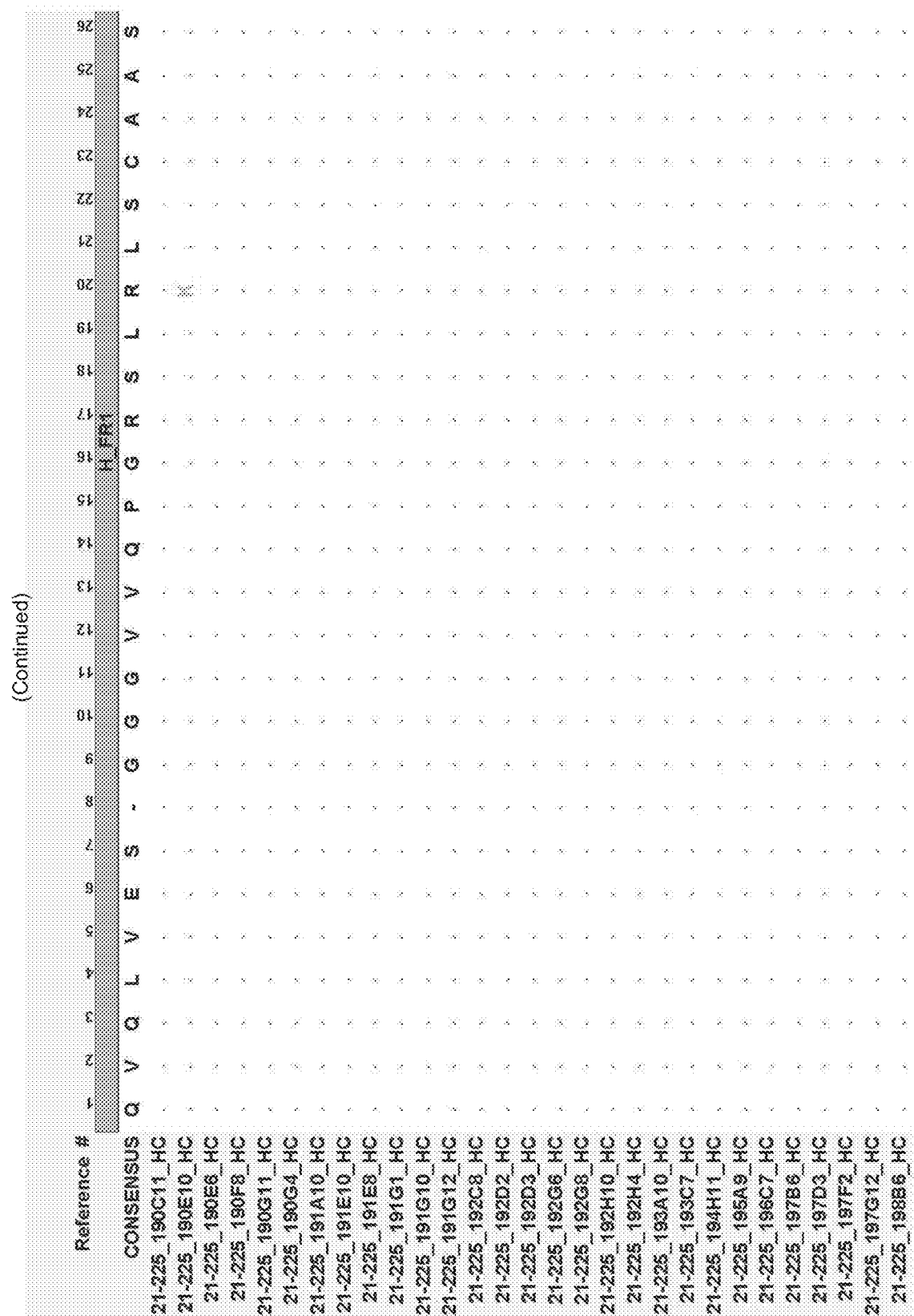
Figure 57:
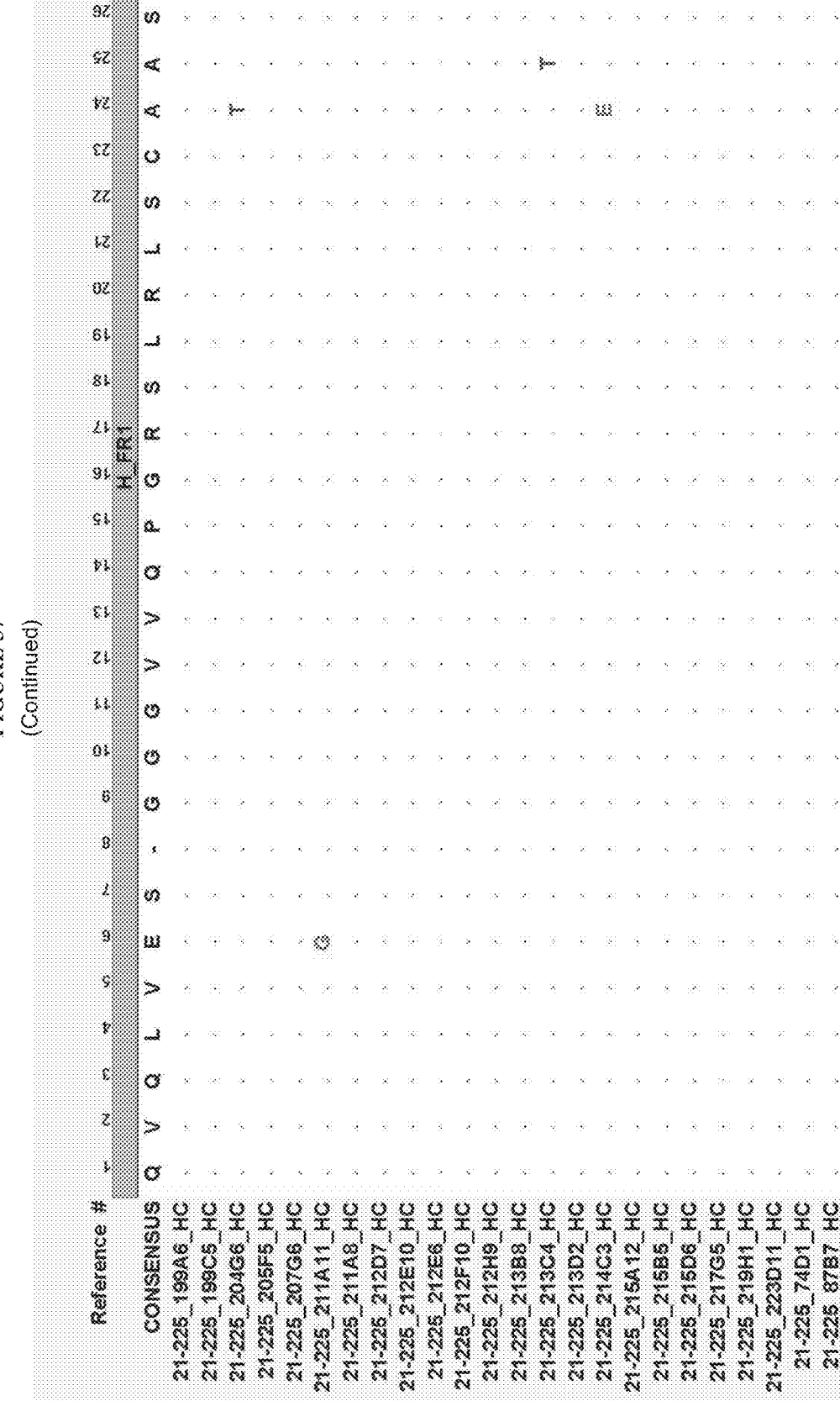
Figure 57:
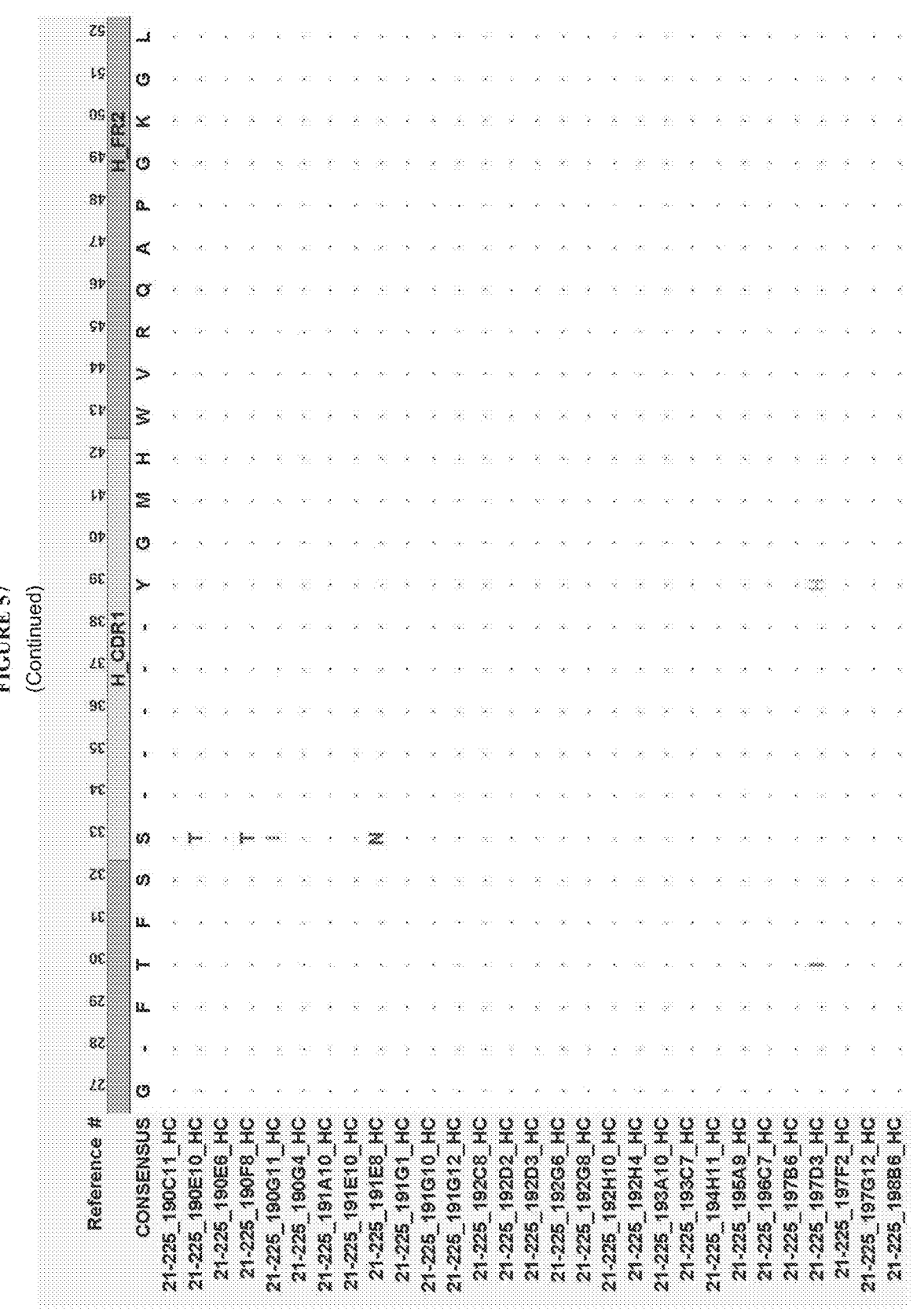
Figure 57:
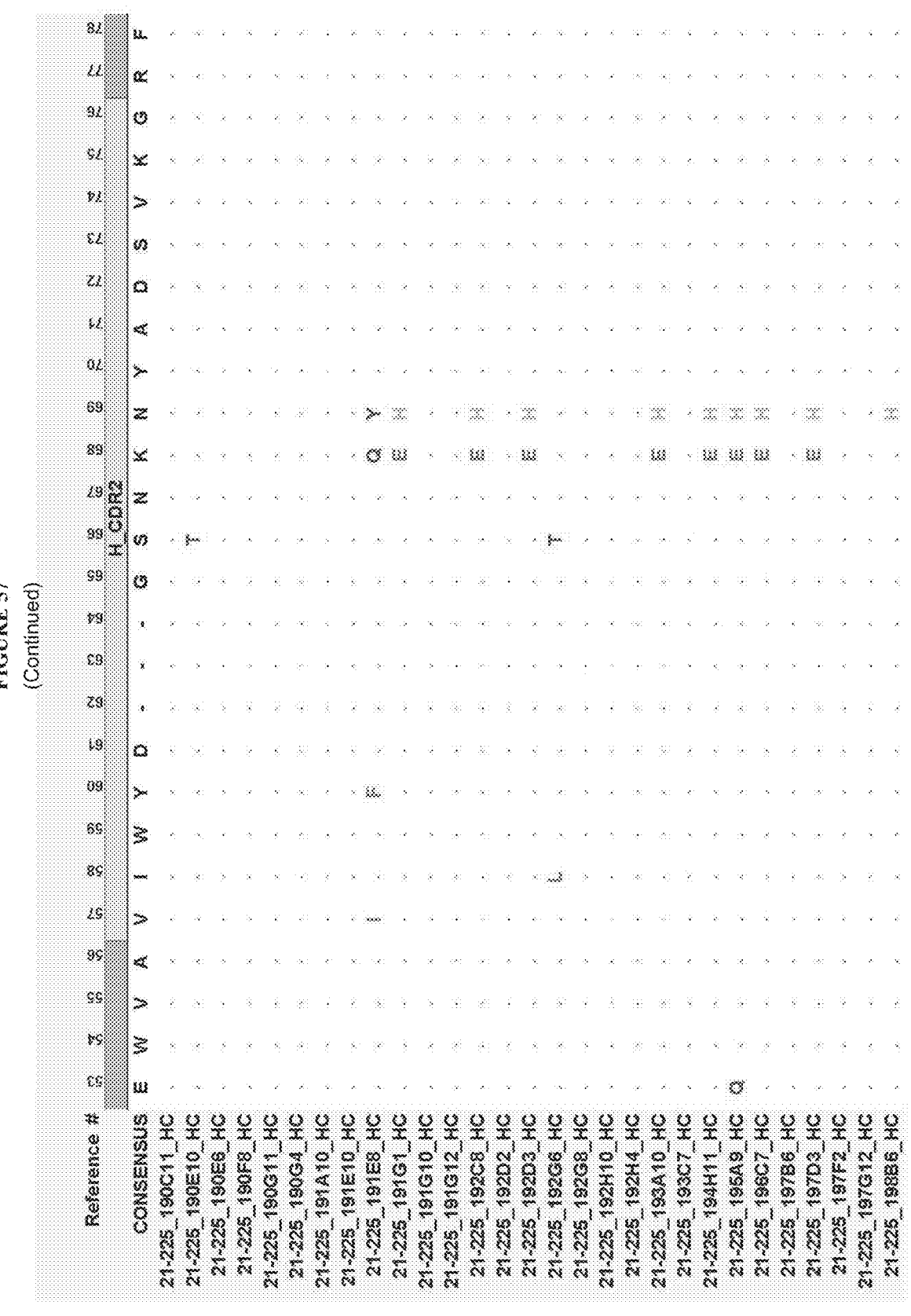
Figure 57:
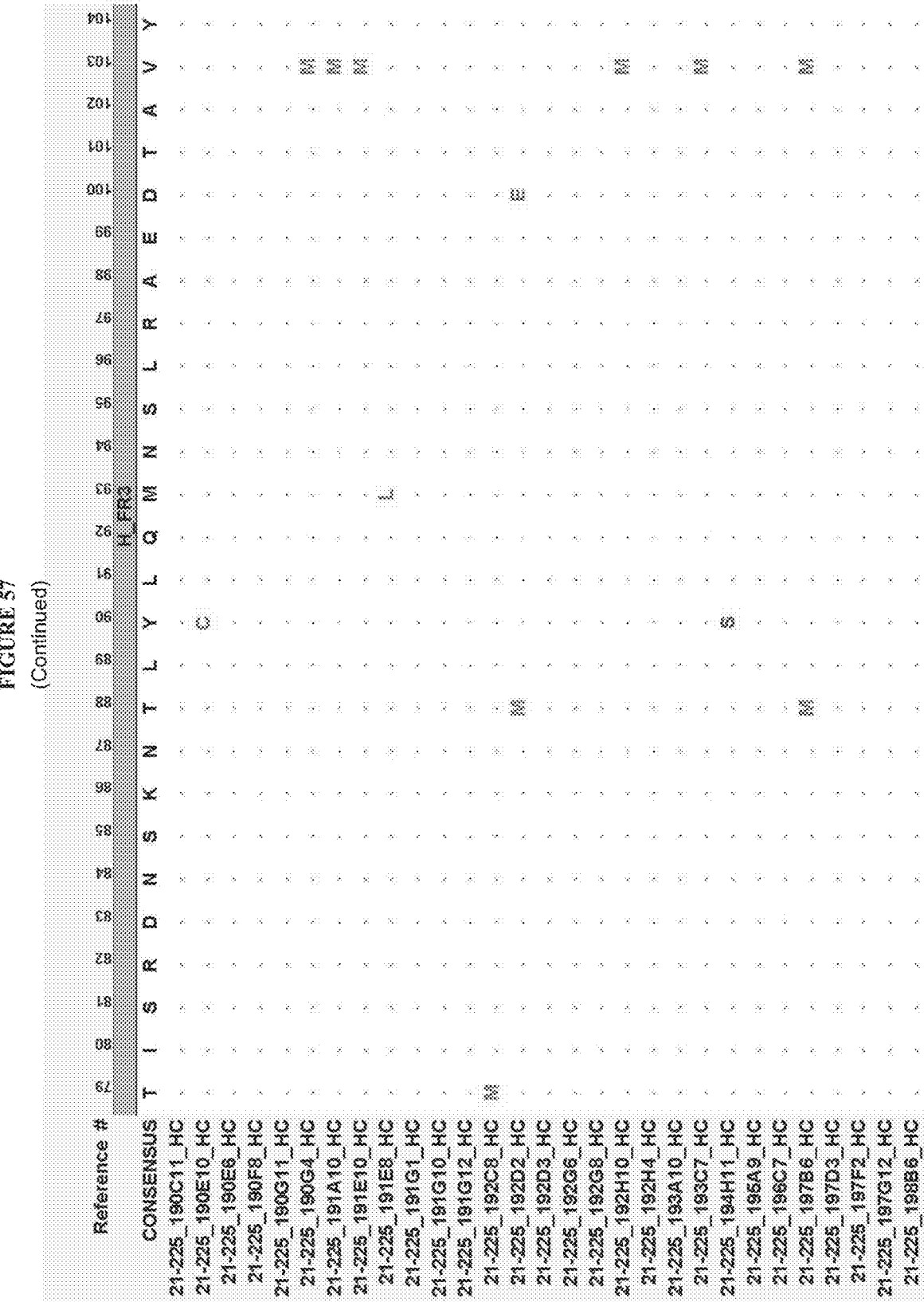
Figure 57:
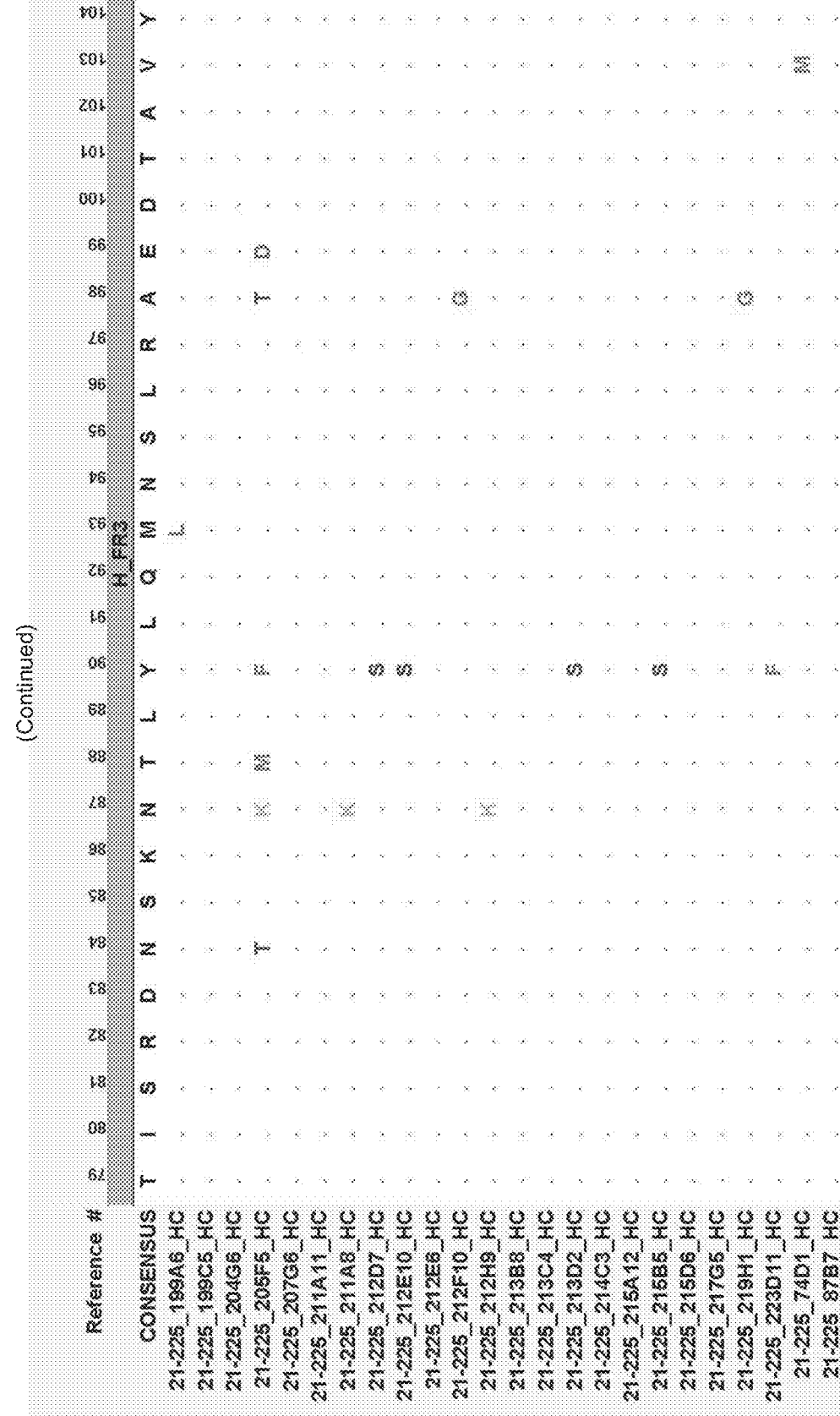
Figure 57:
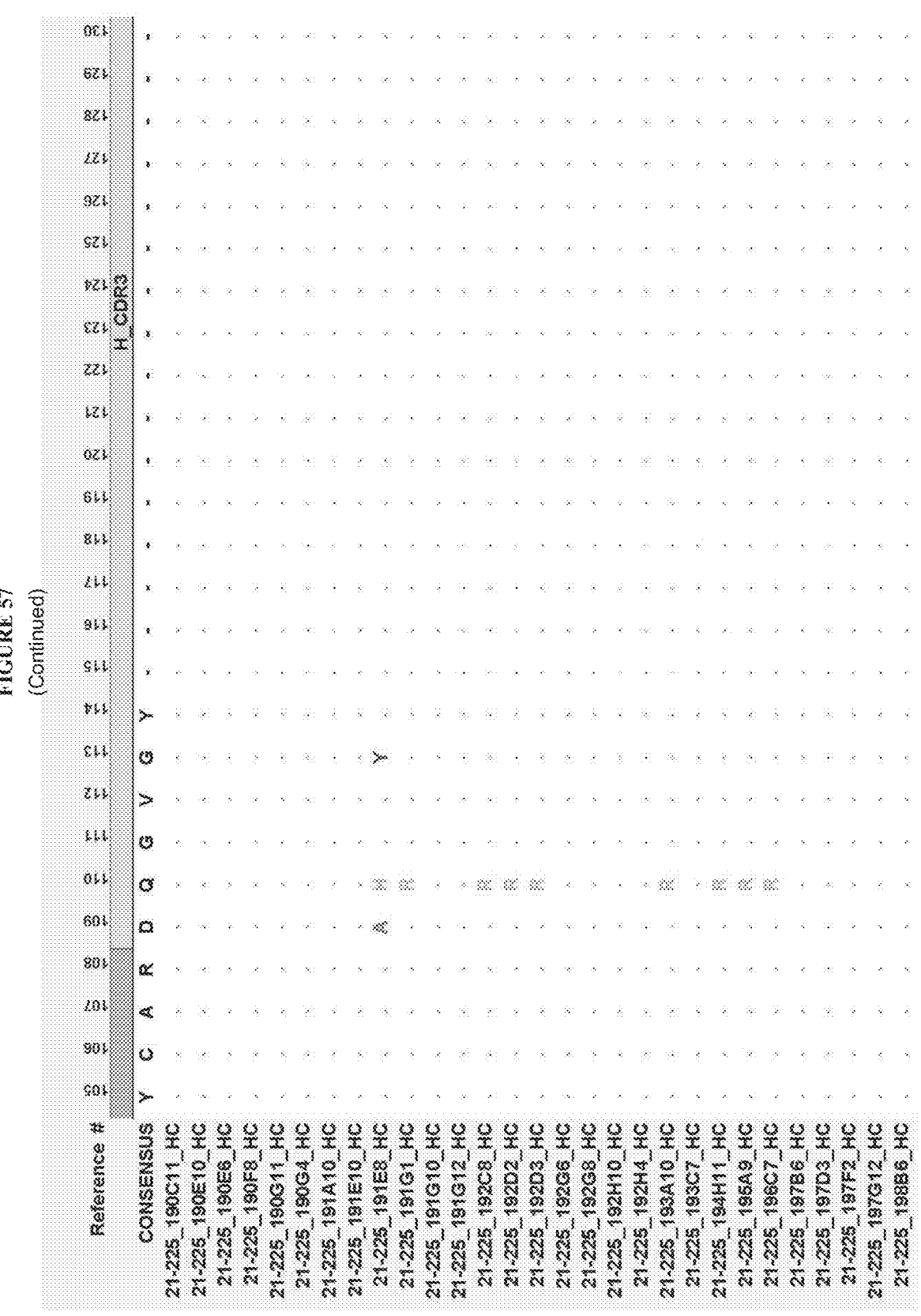
Figure 57:
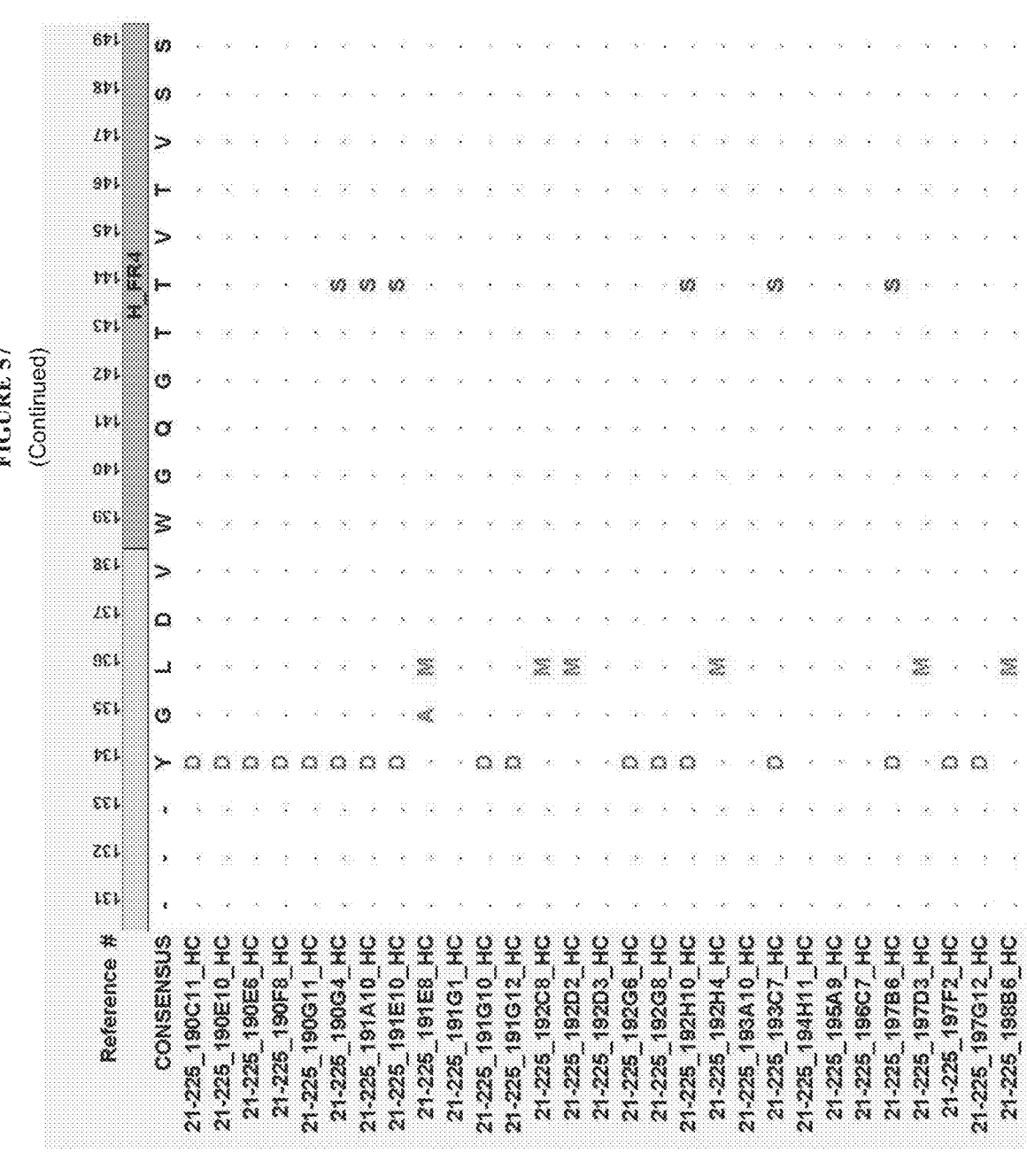
Figure 57:
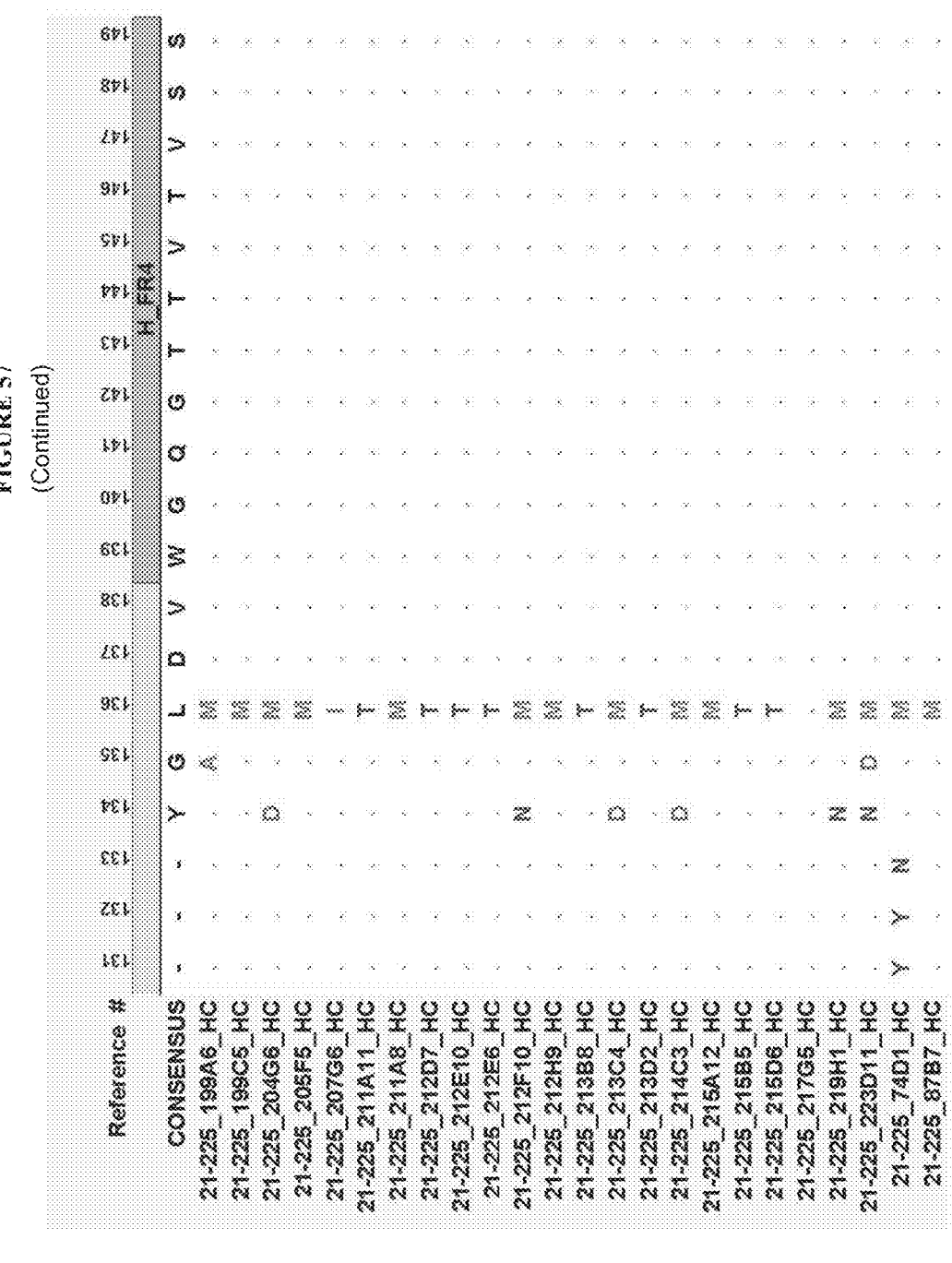
Figure 57:
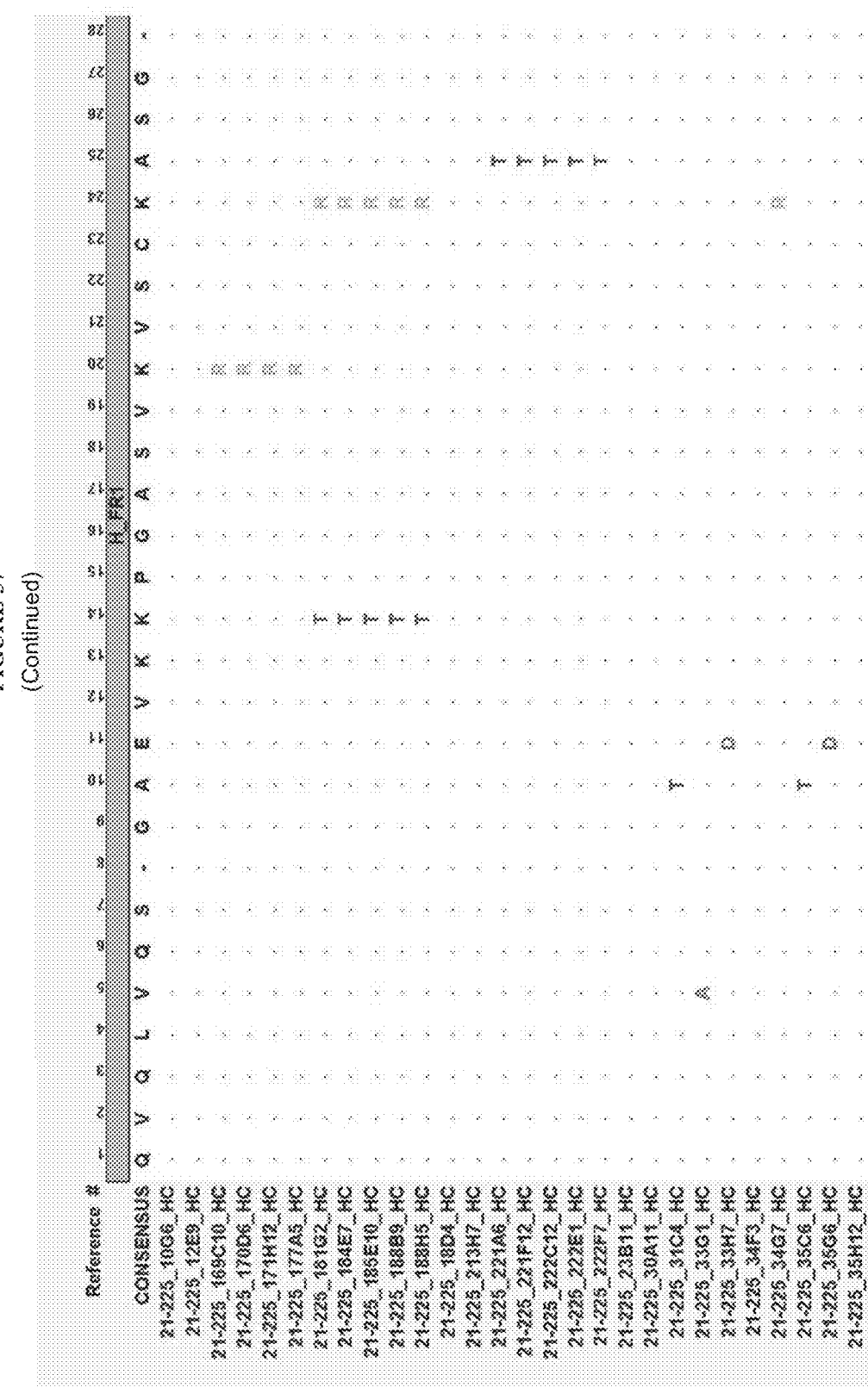
Figure 57:
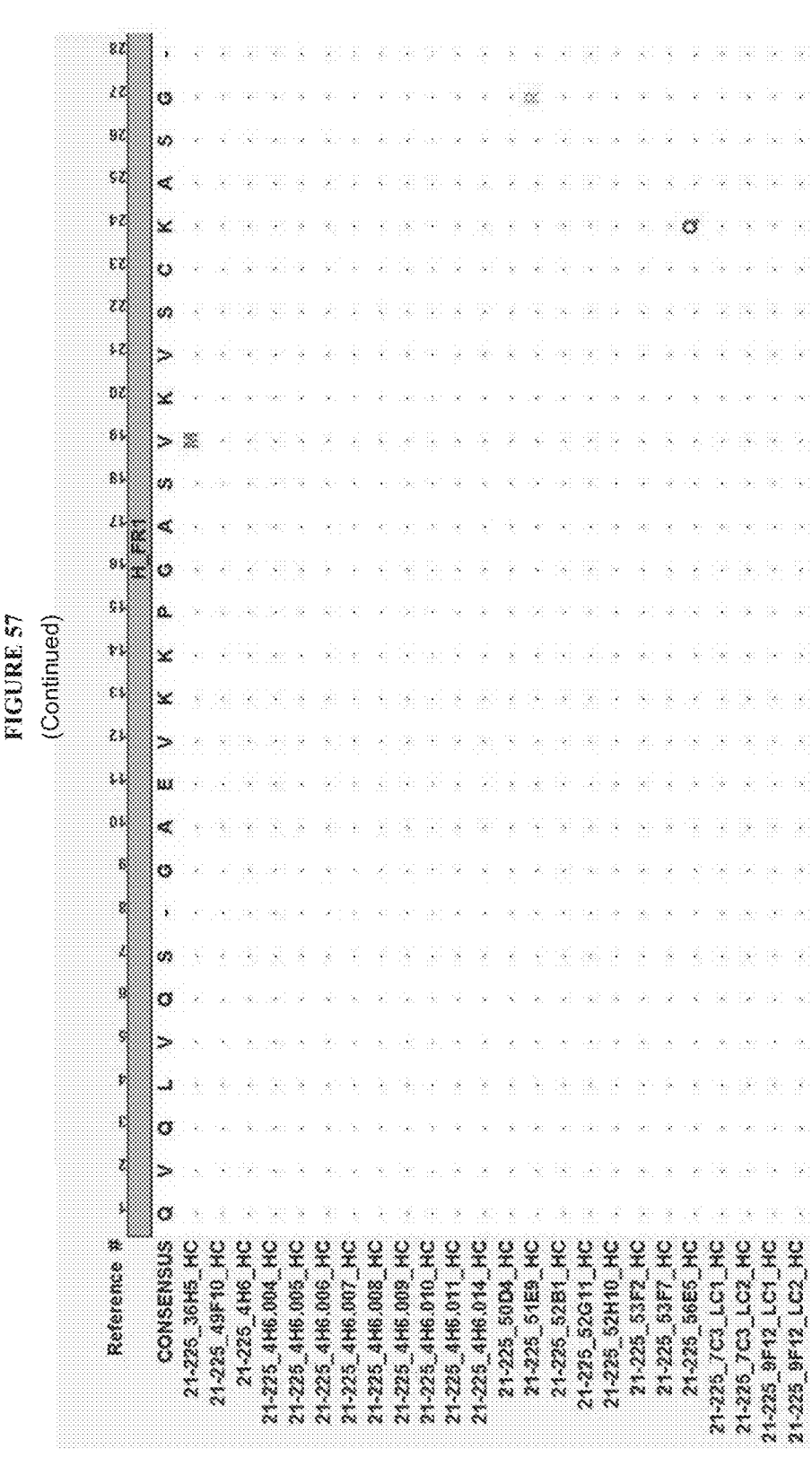
Figure 57:
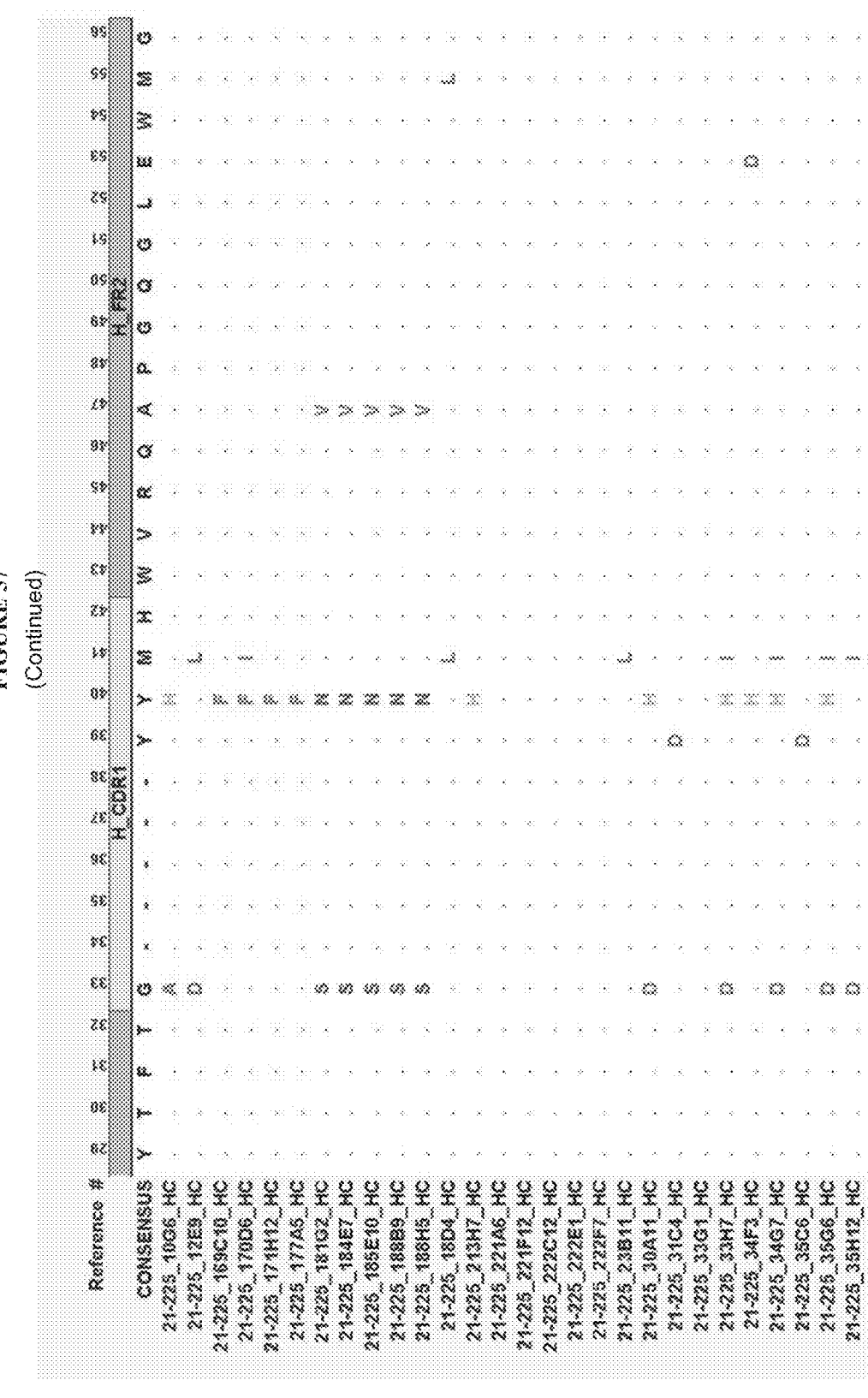
Figure 57:
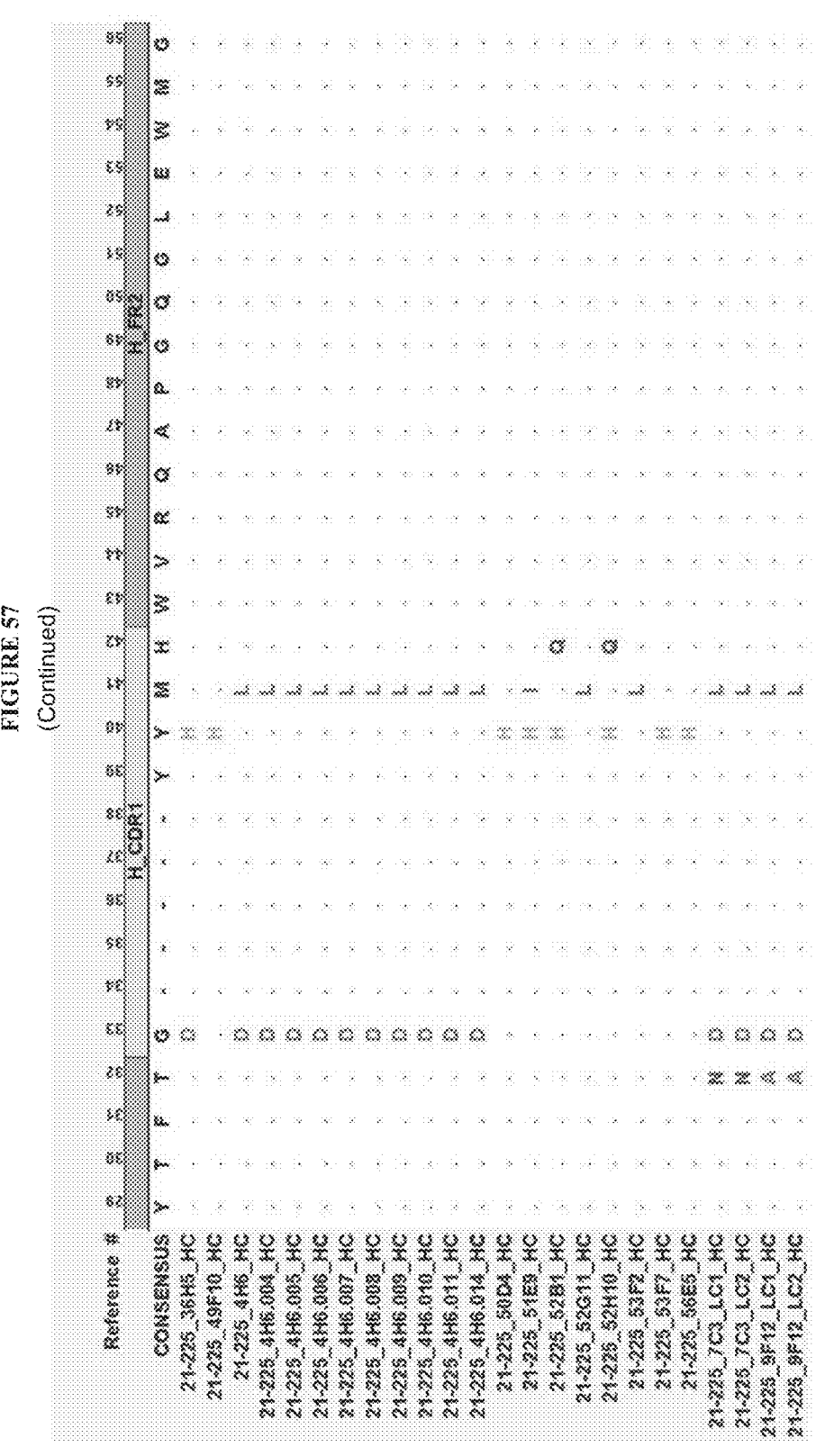
Figure 57:
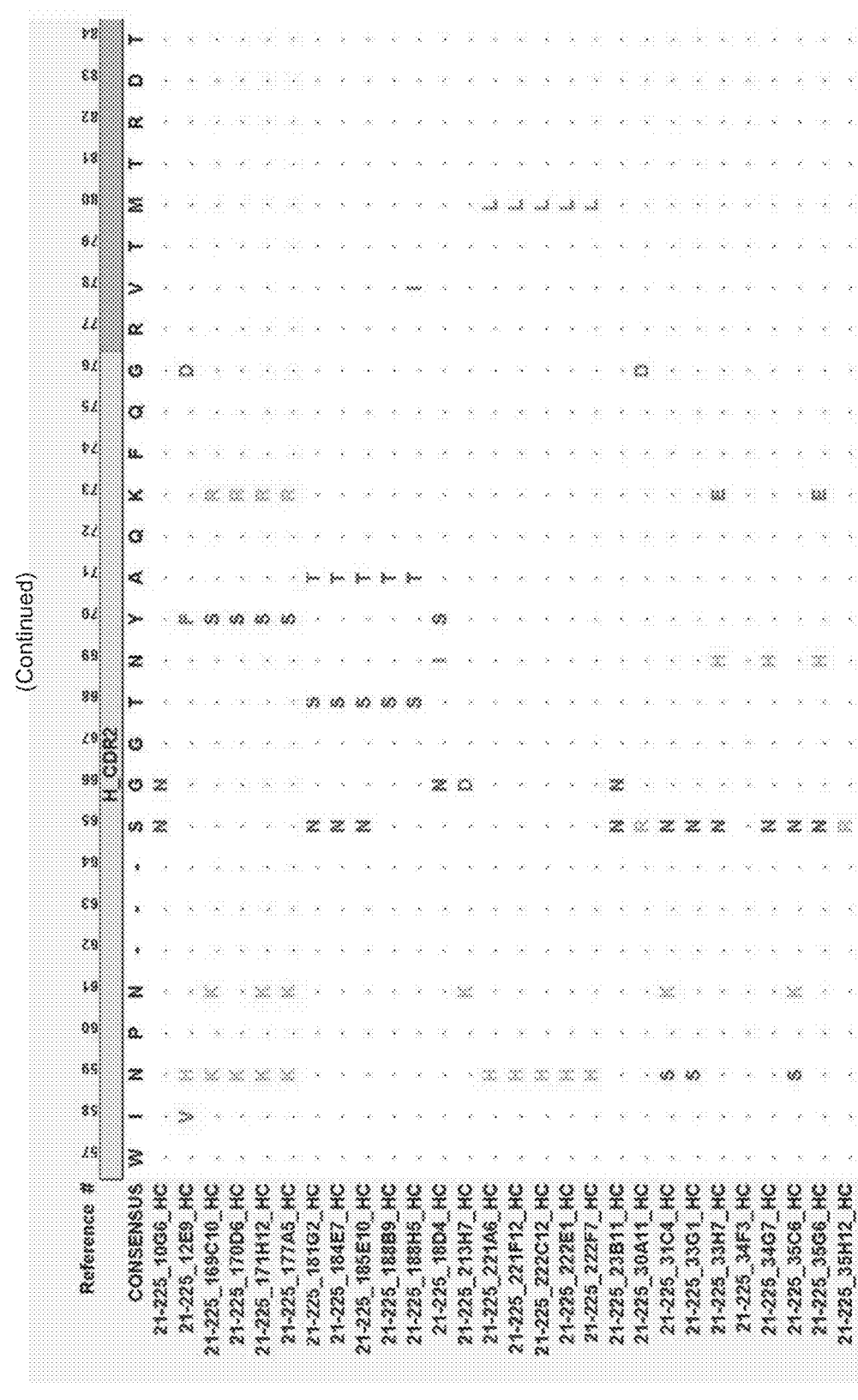
Figure 57:
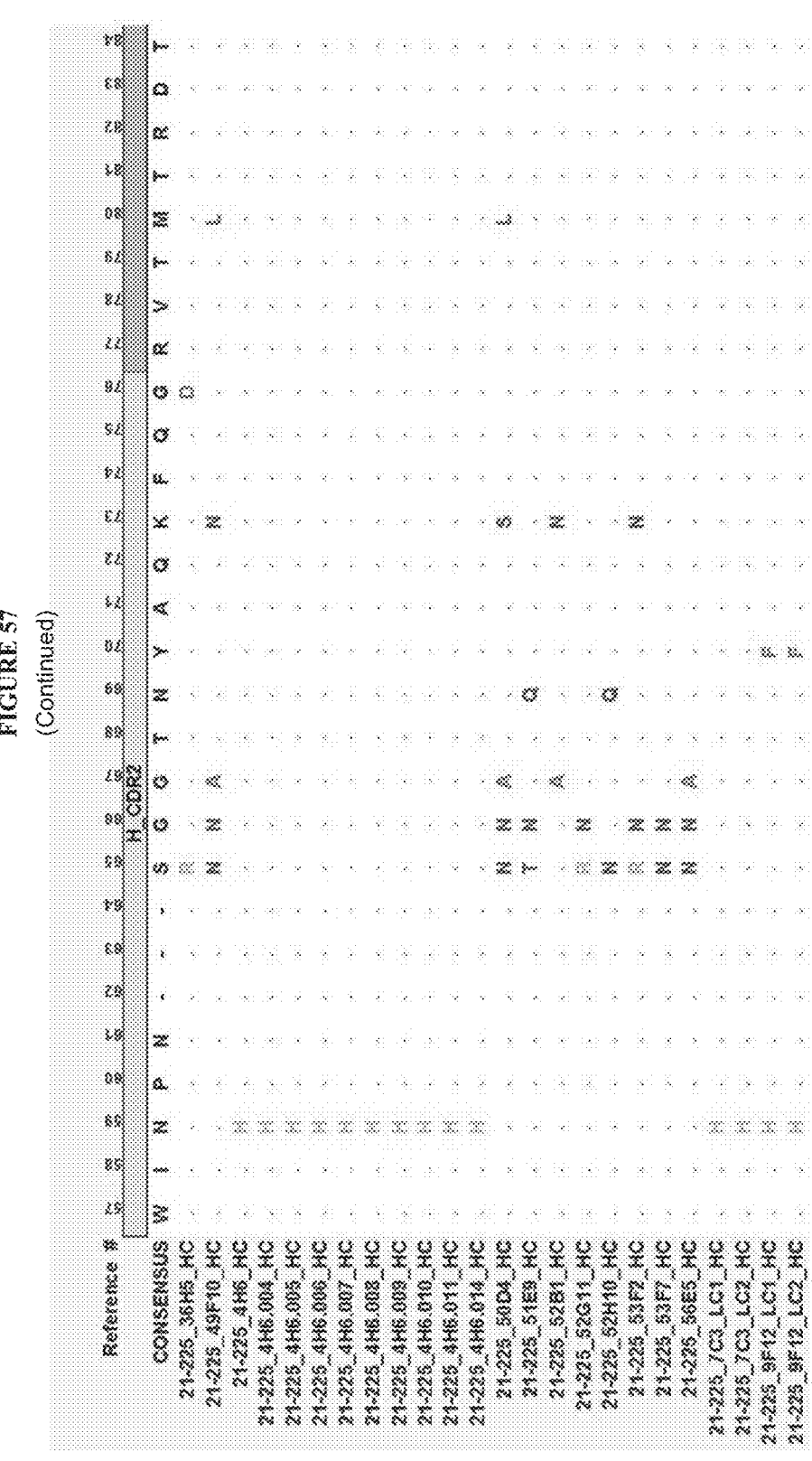
Figure 57:
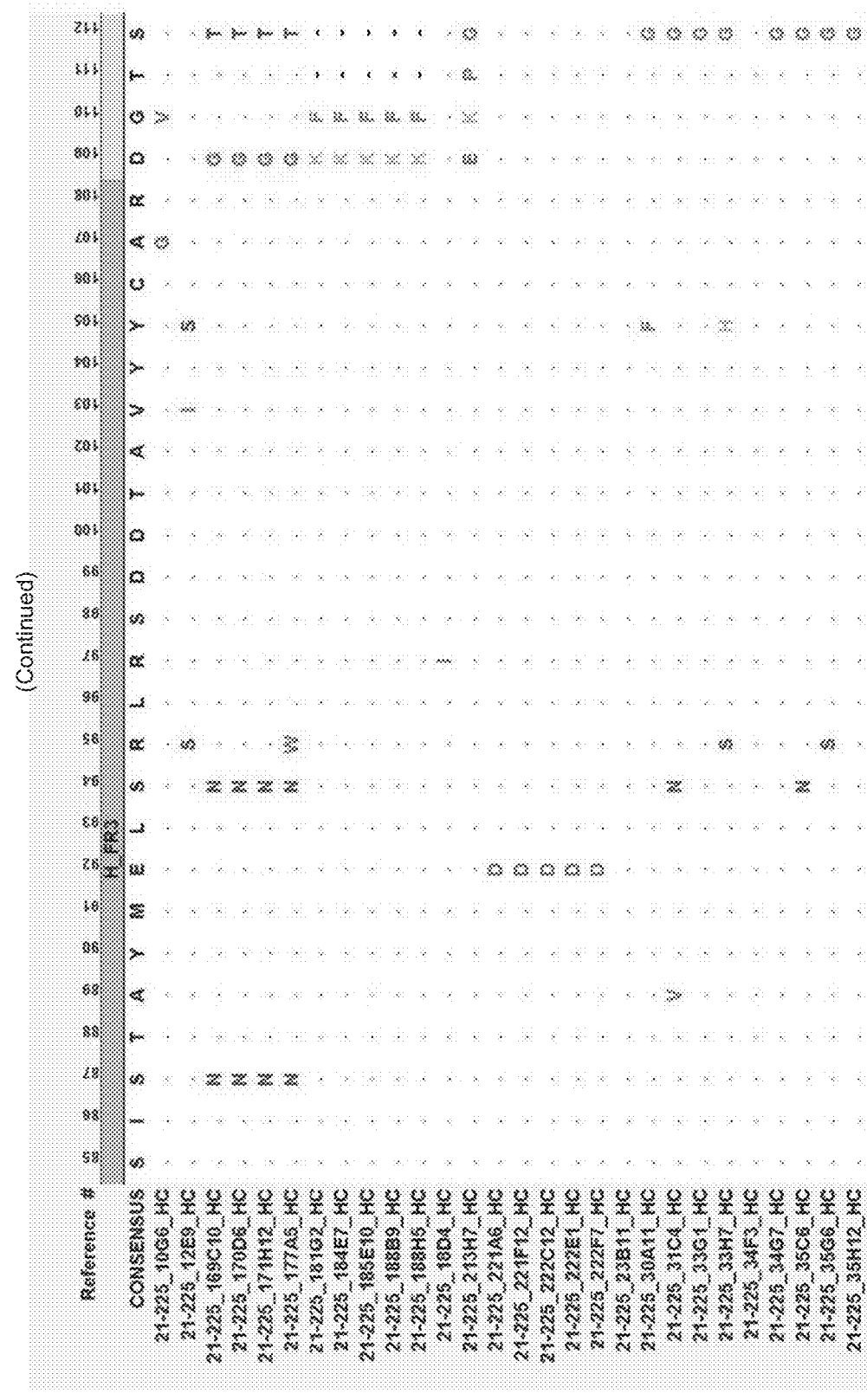
Figure 57:
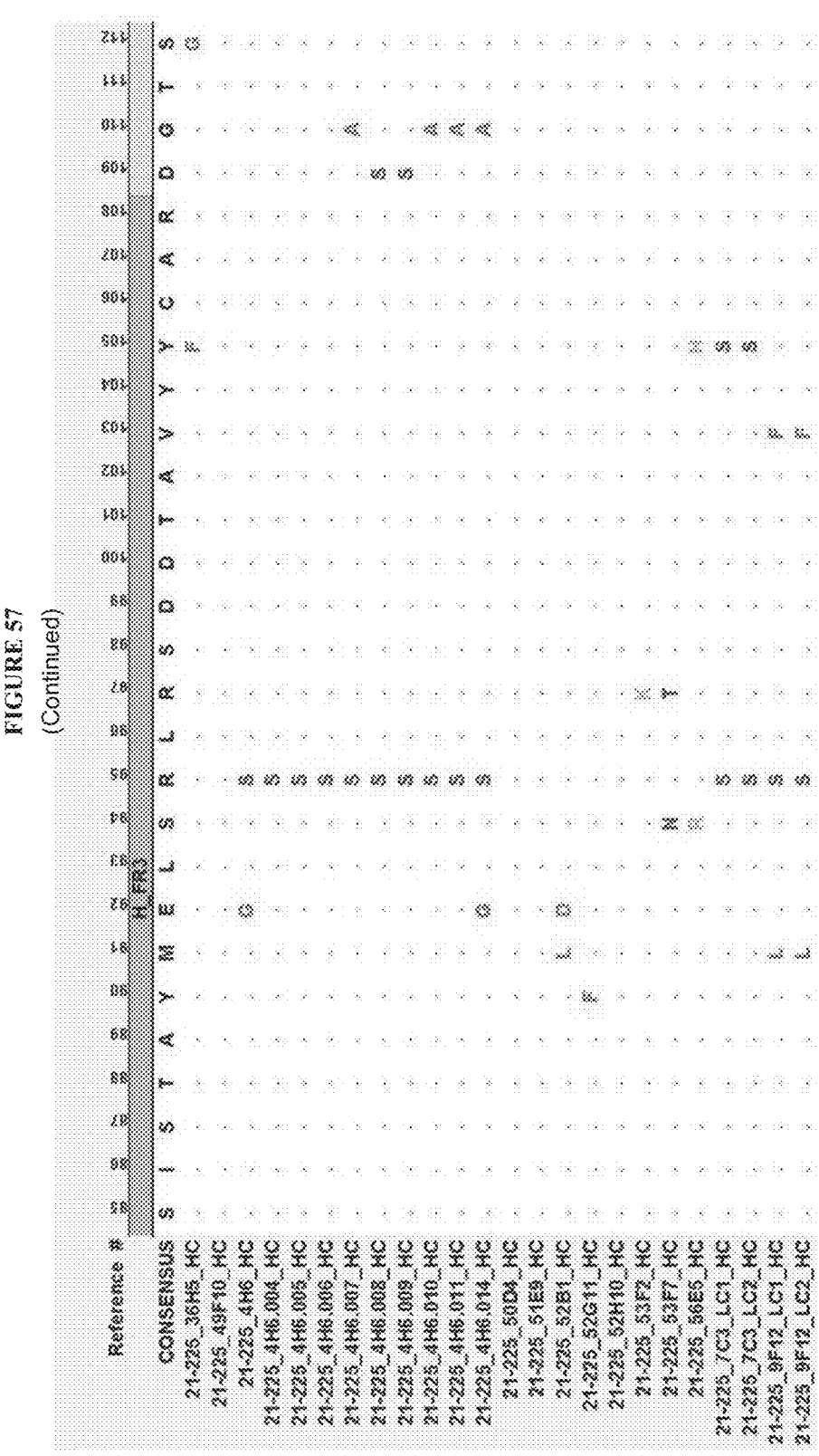
Figure 57:
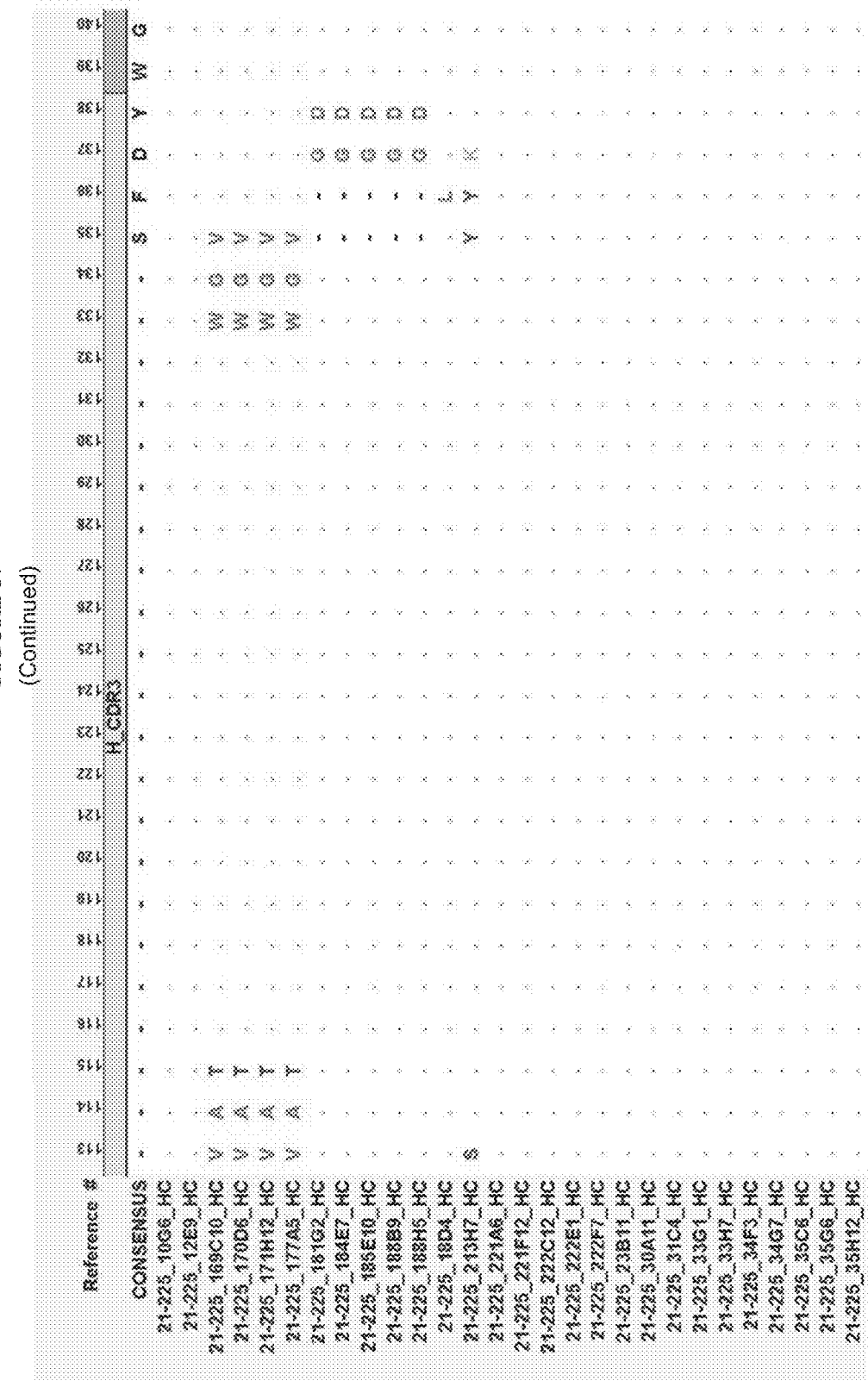
Figure 57:
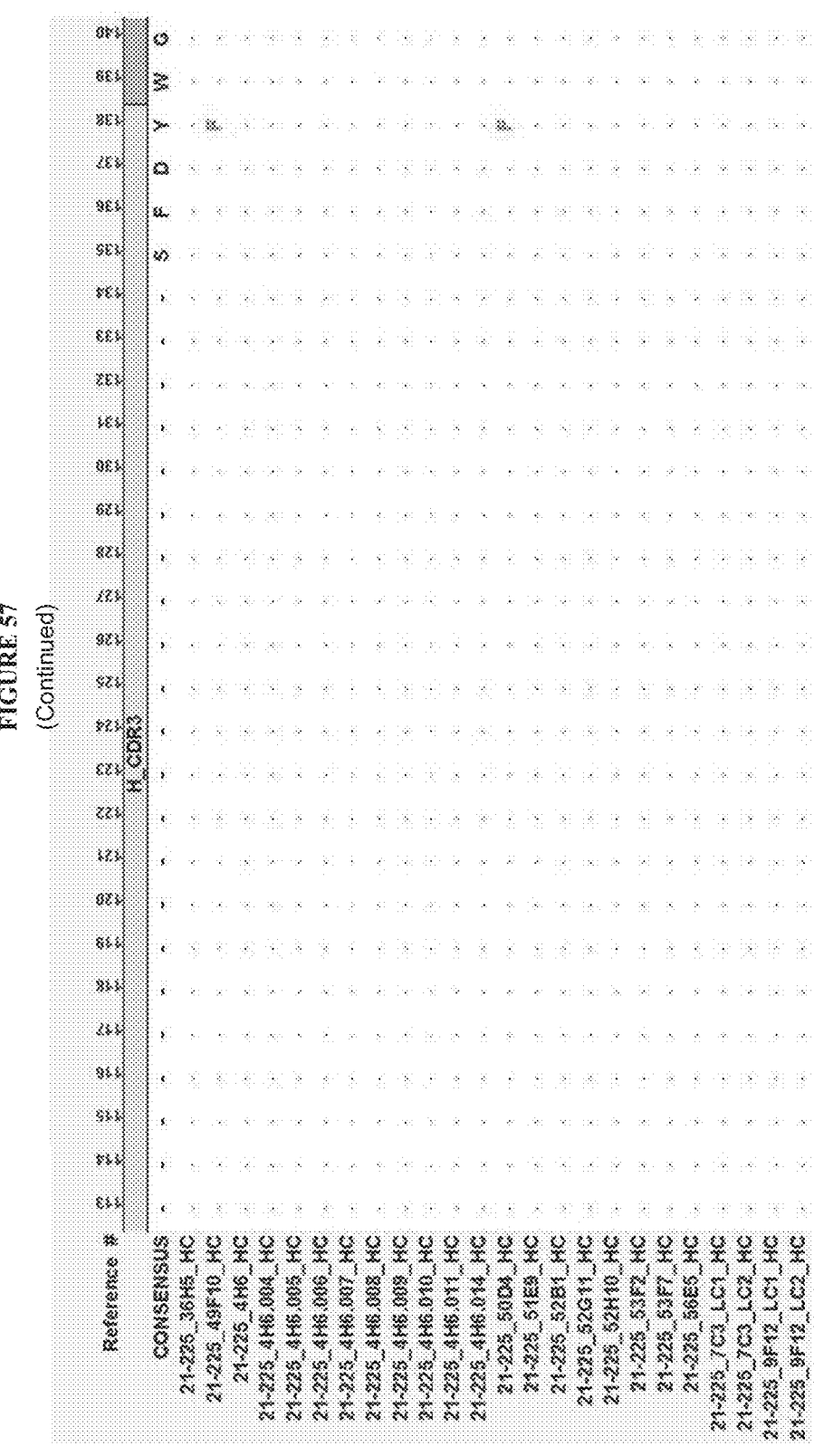
Figure 57:
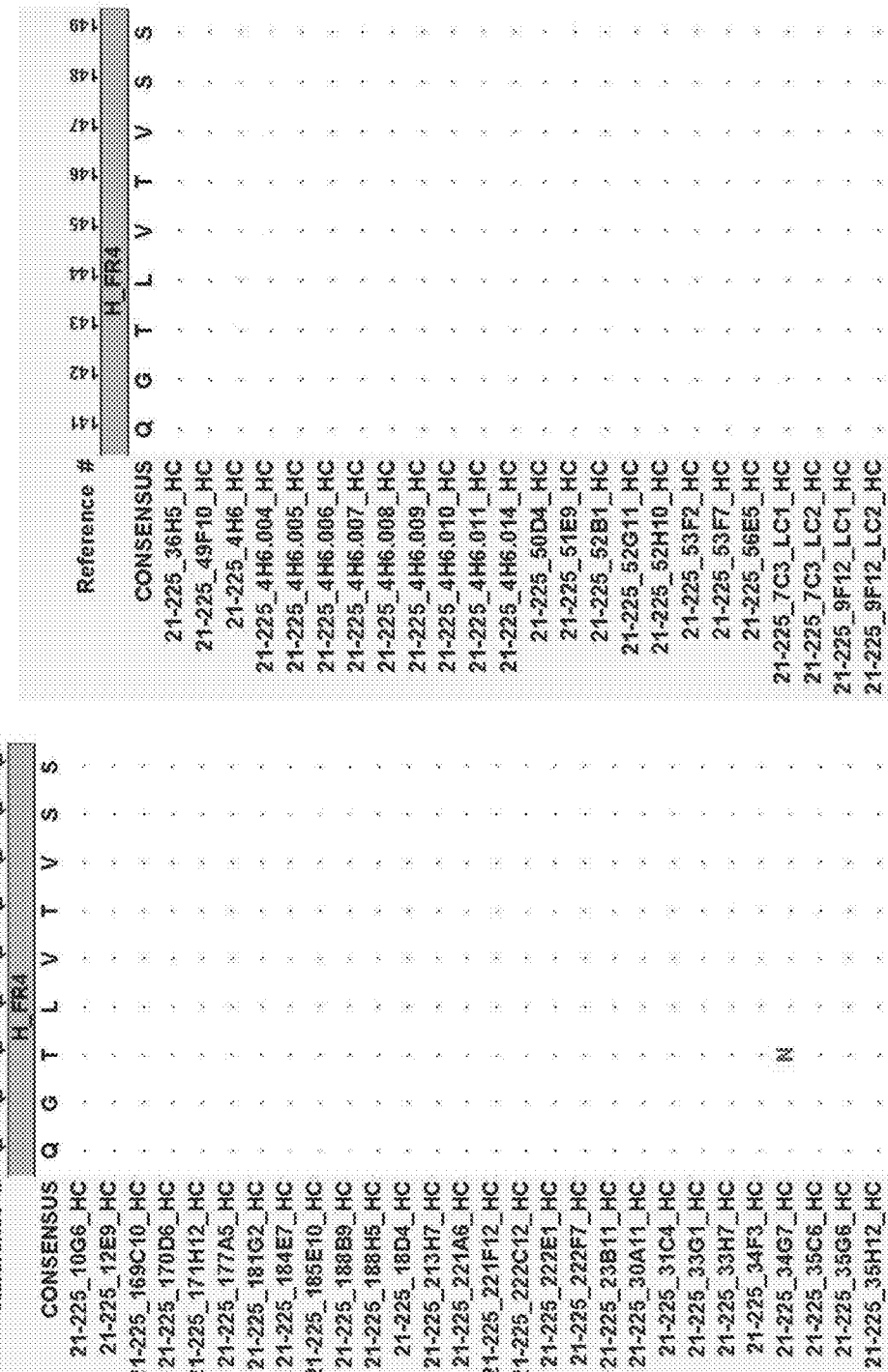
Figure 57:
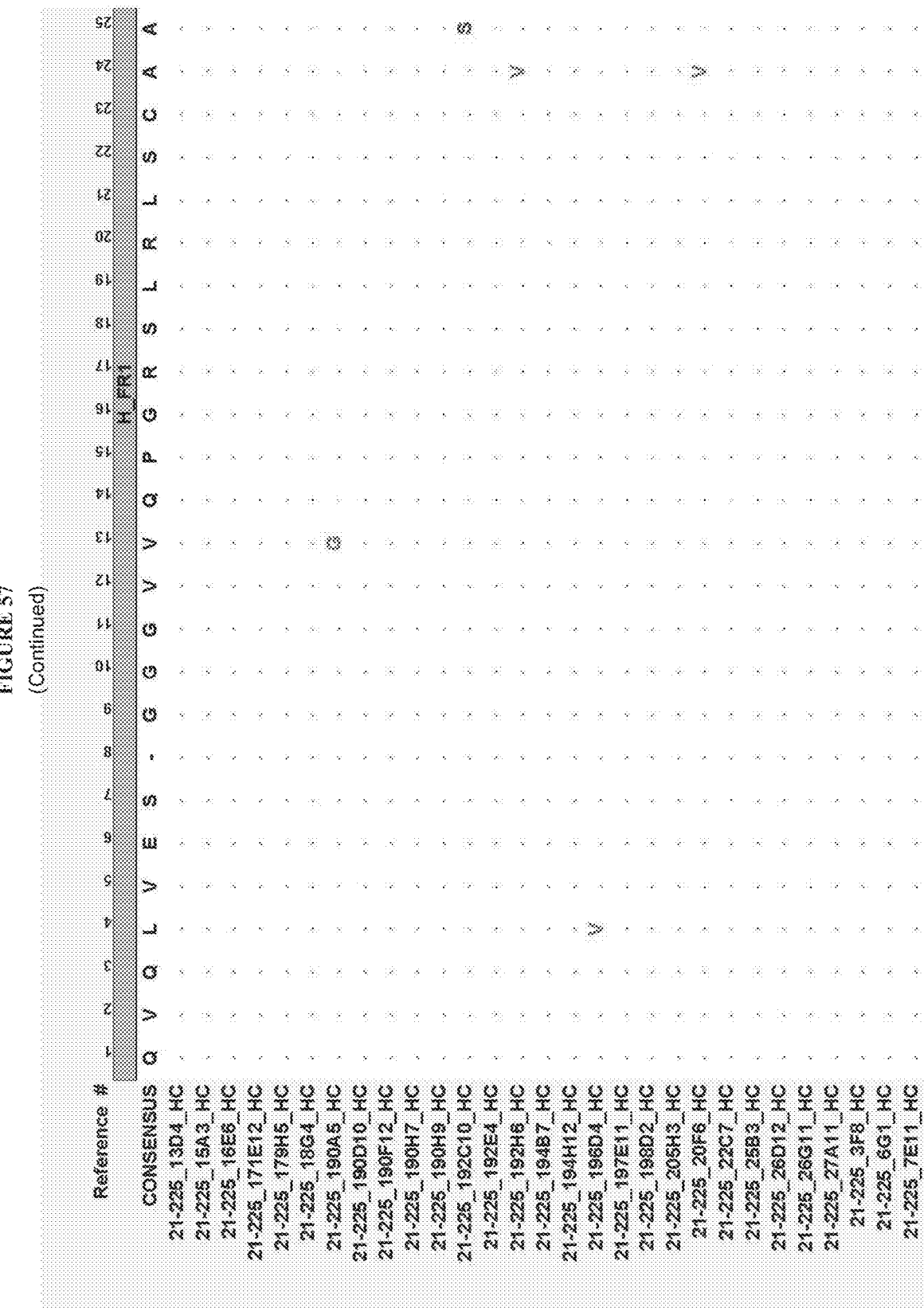
Figure 57:
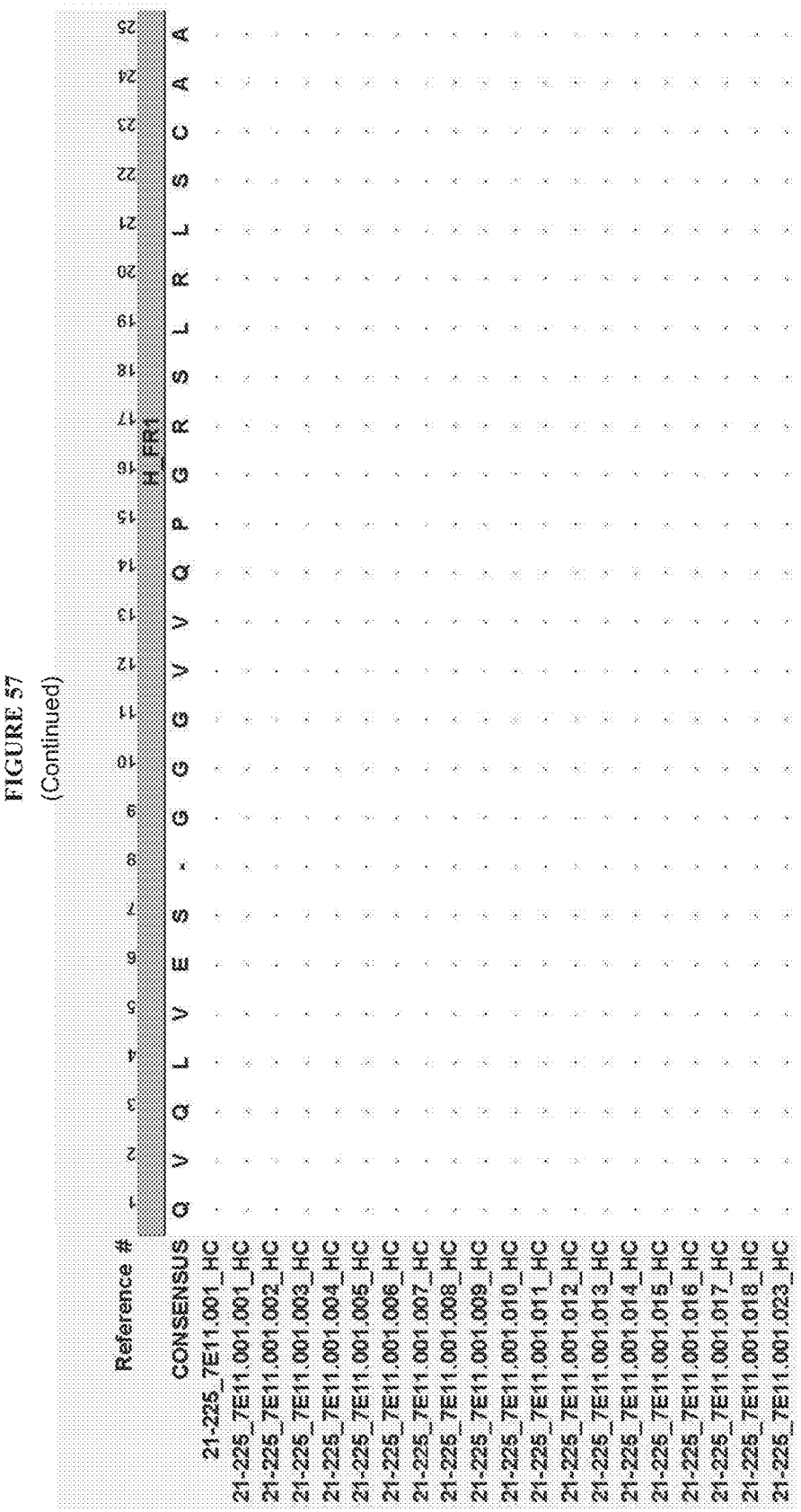
Figure 57:
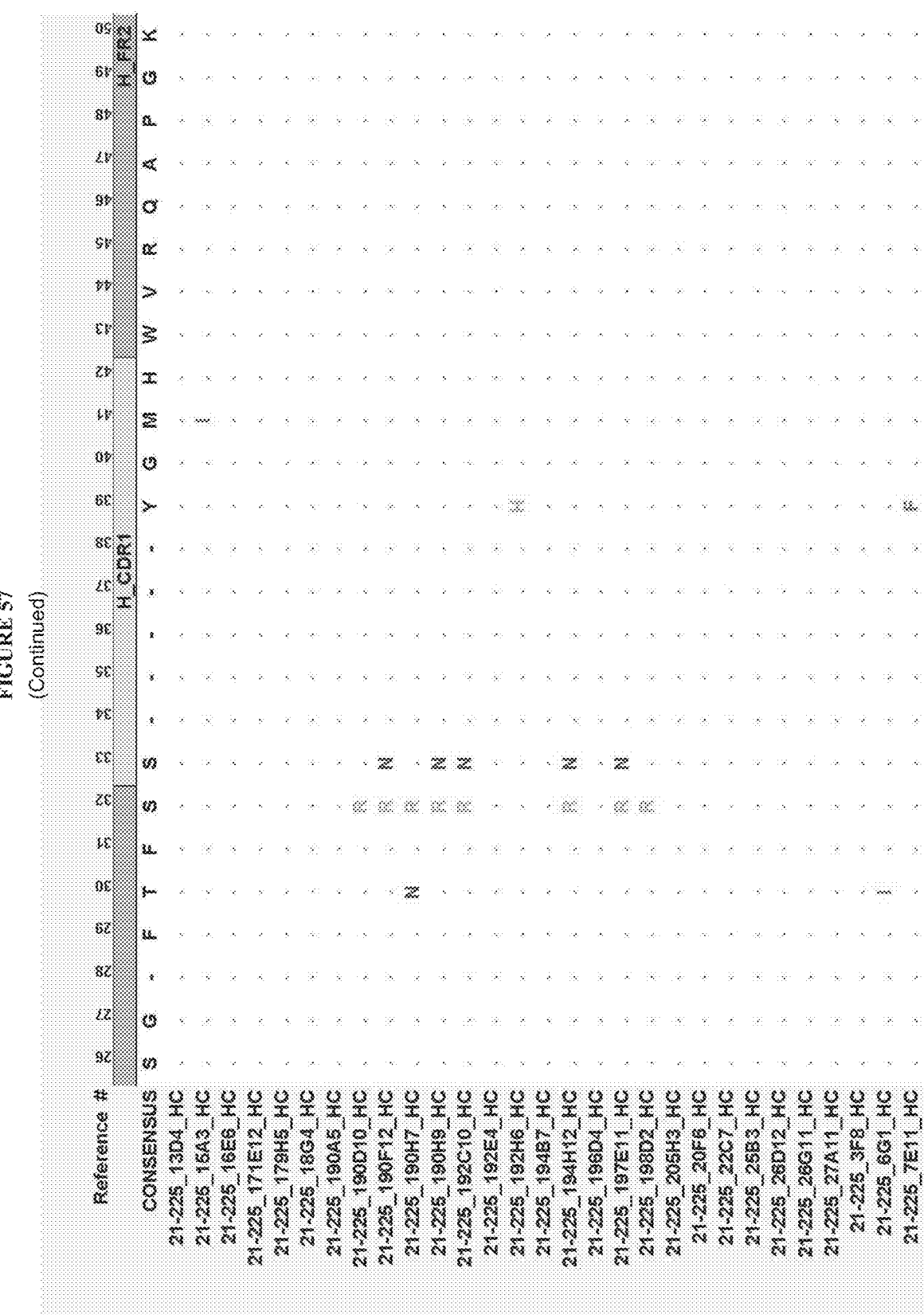
Figure 57:
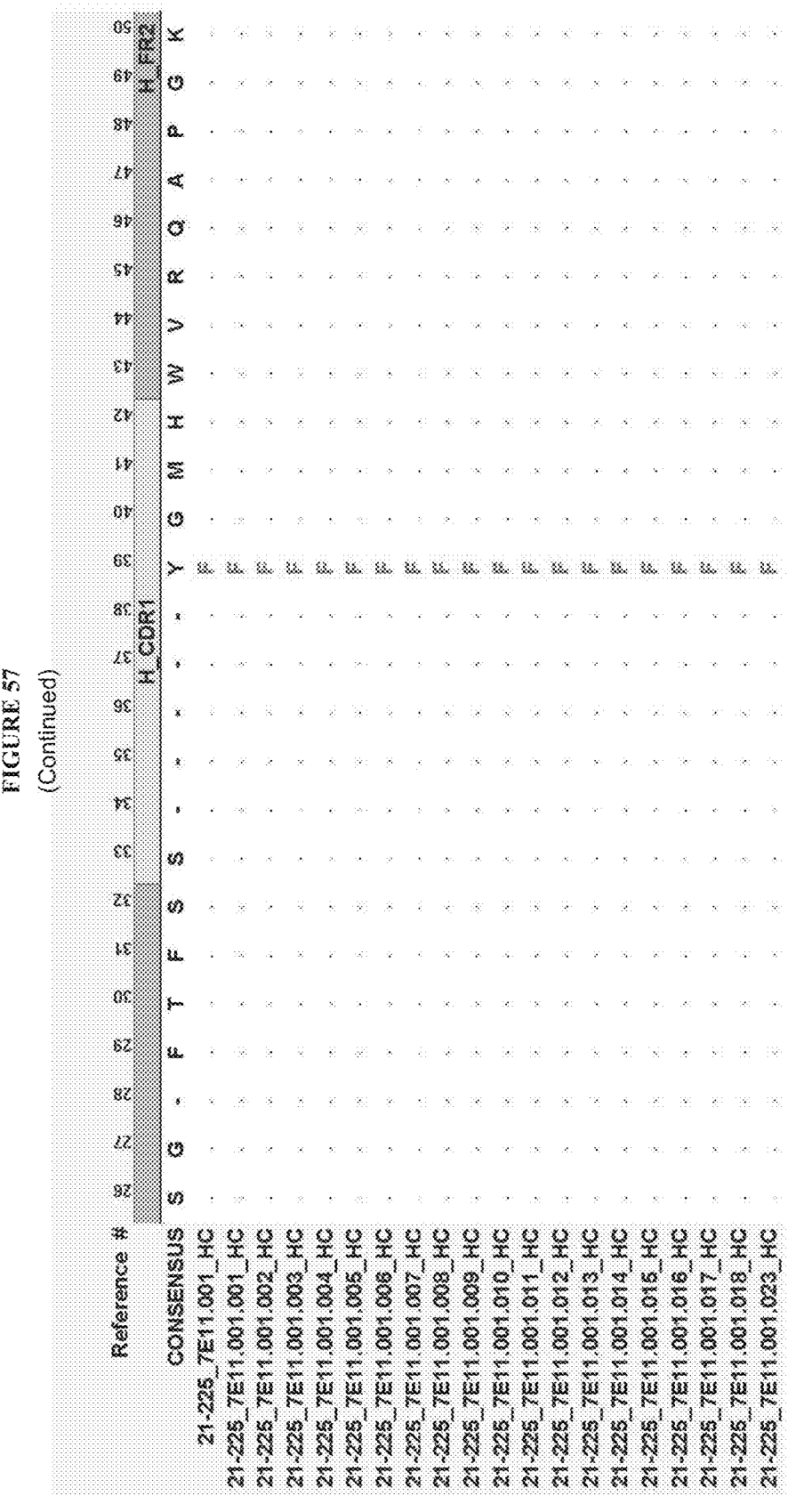
Figure 57:
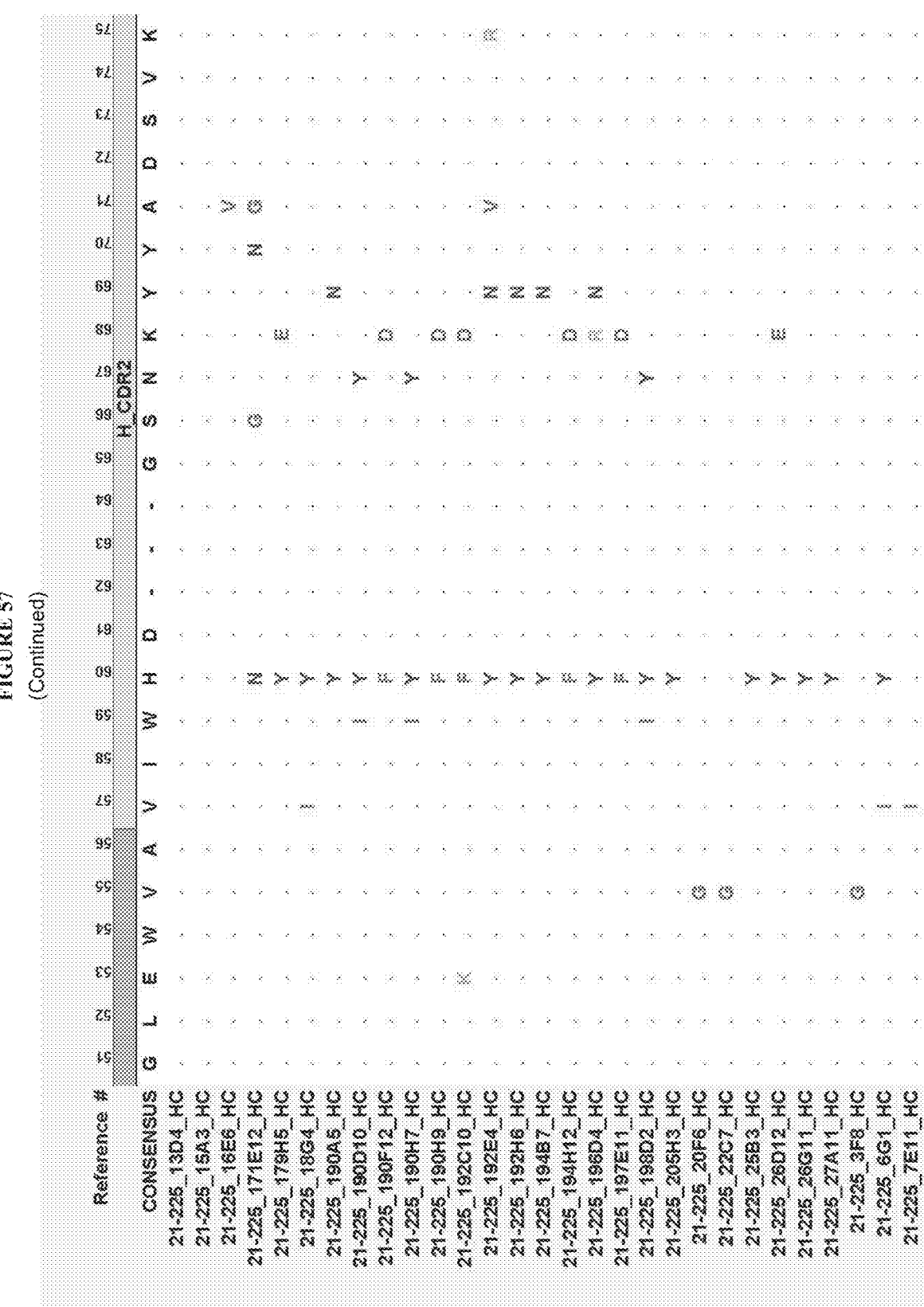
Figure 57:
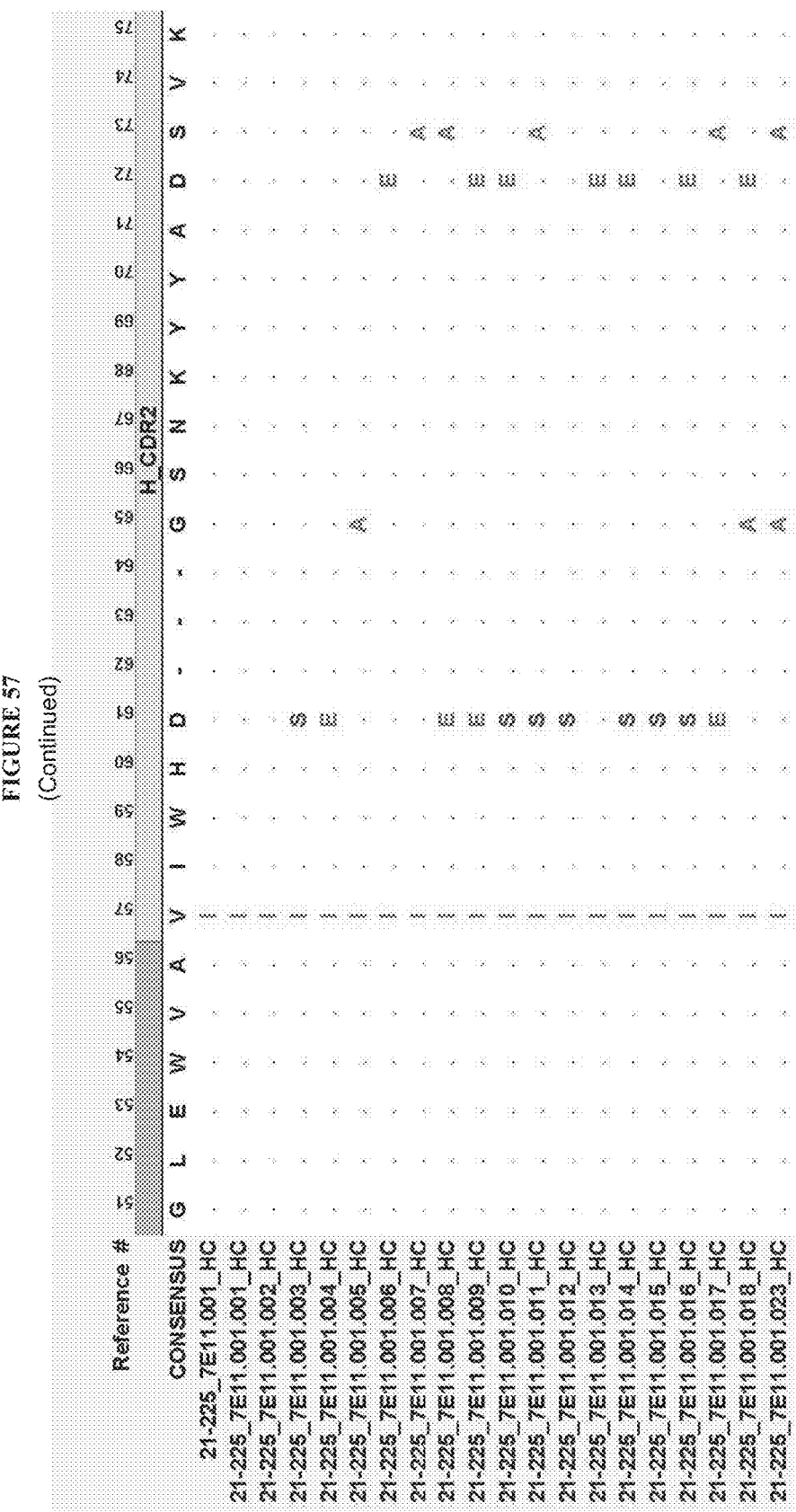
Figure 57:
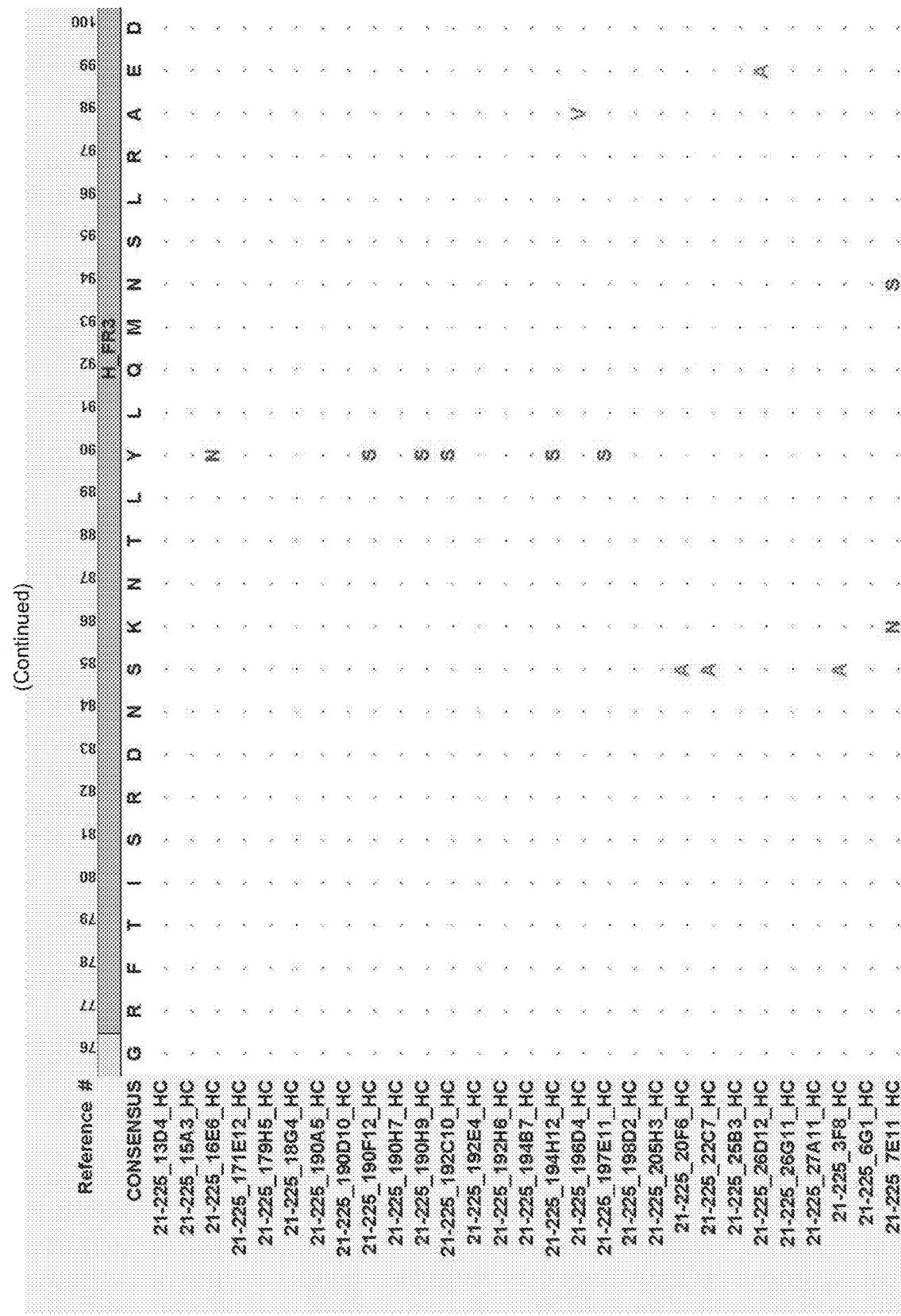
Figure 57:
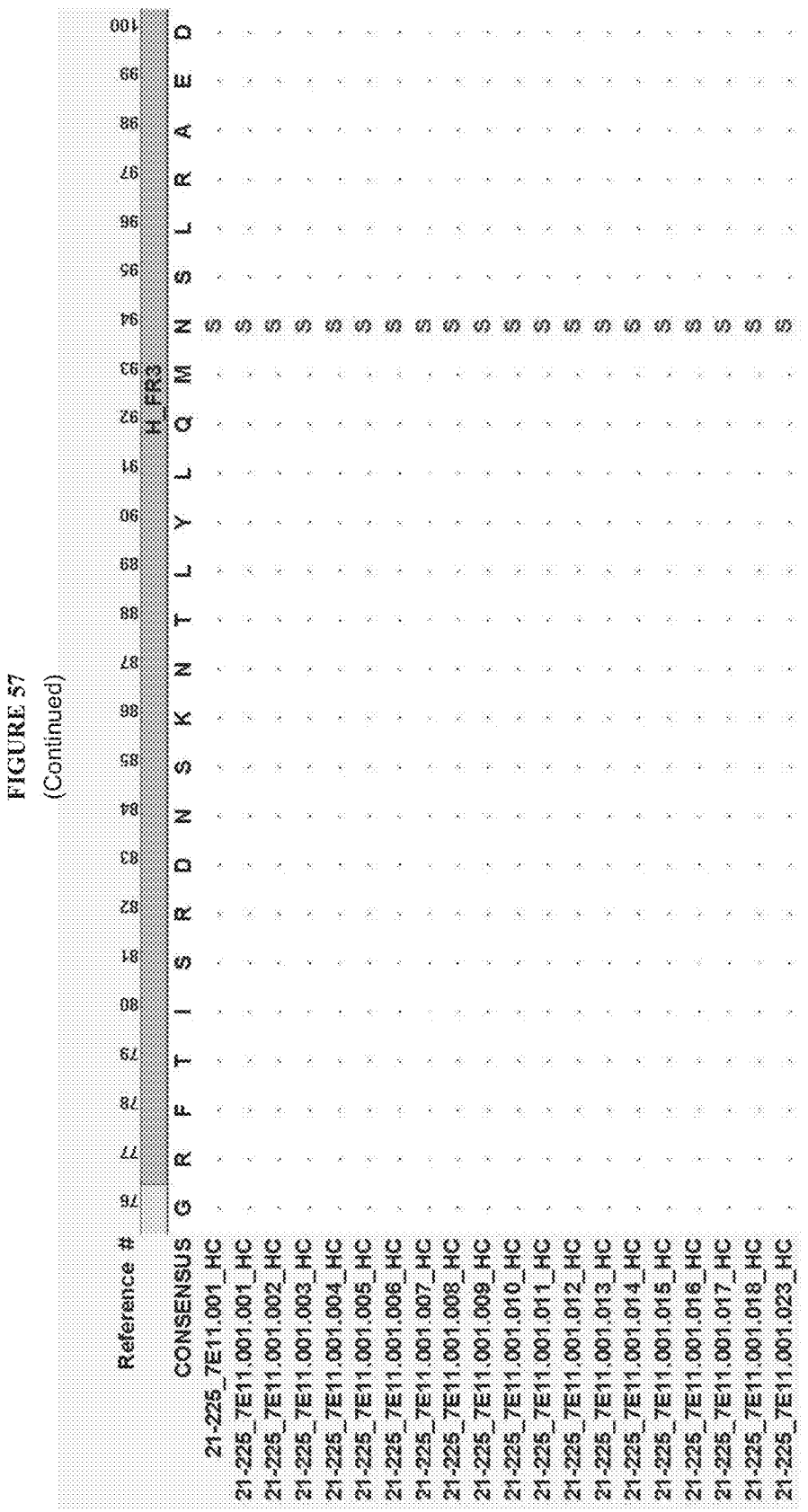
Figure 57:
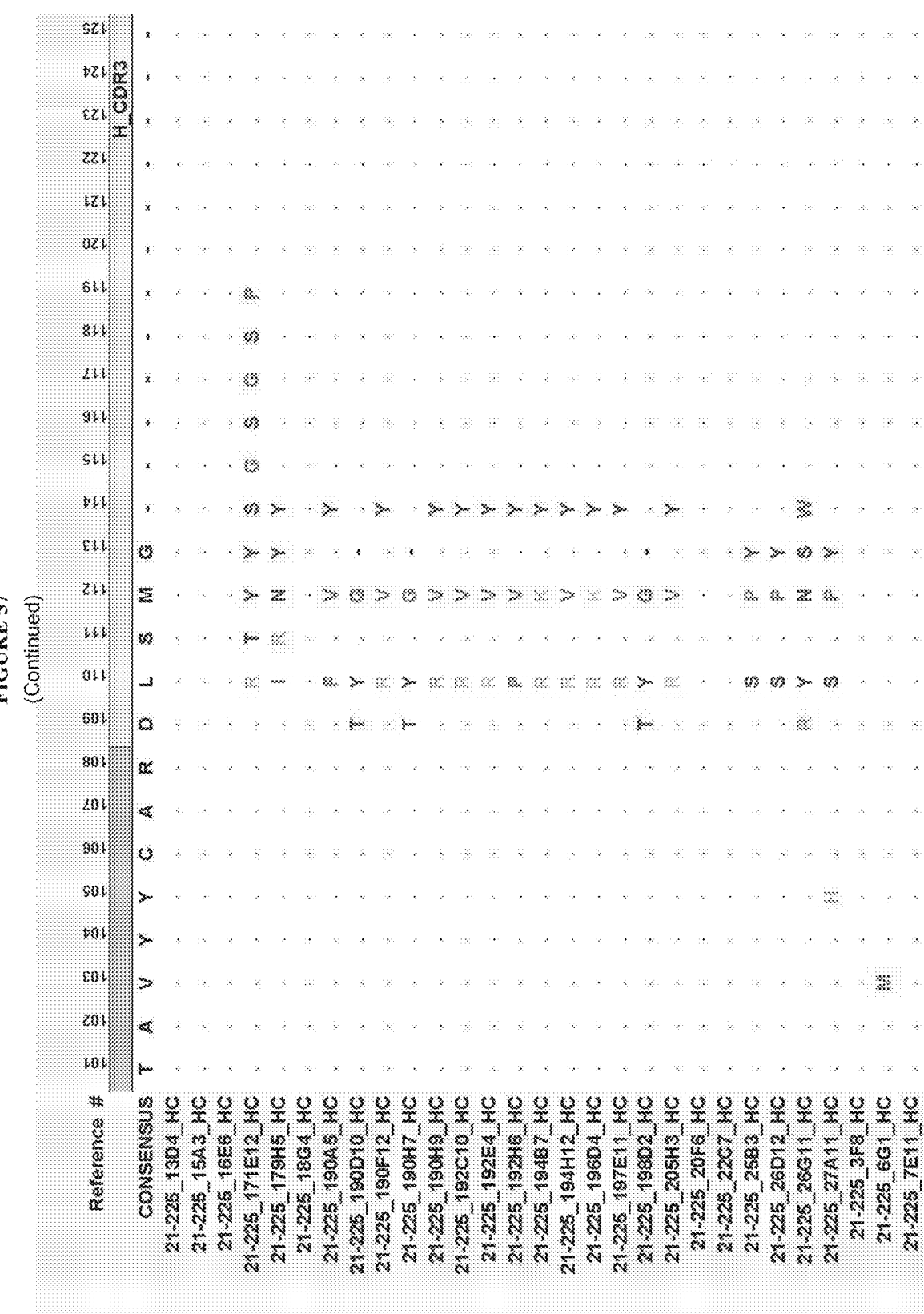
Figure 57:
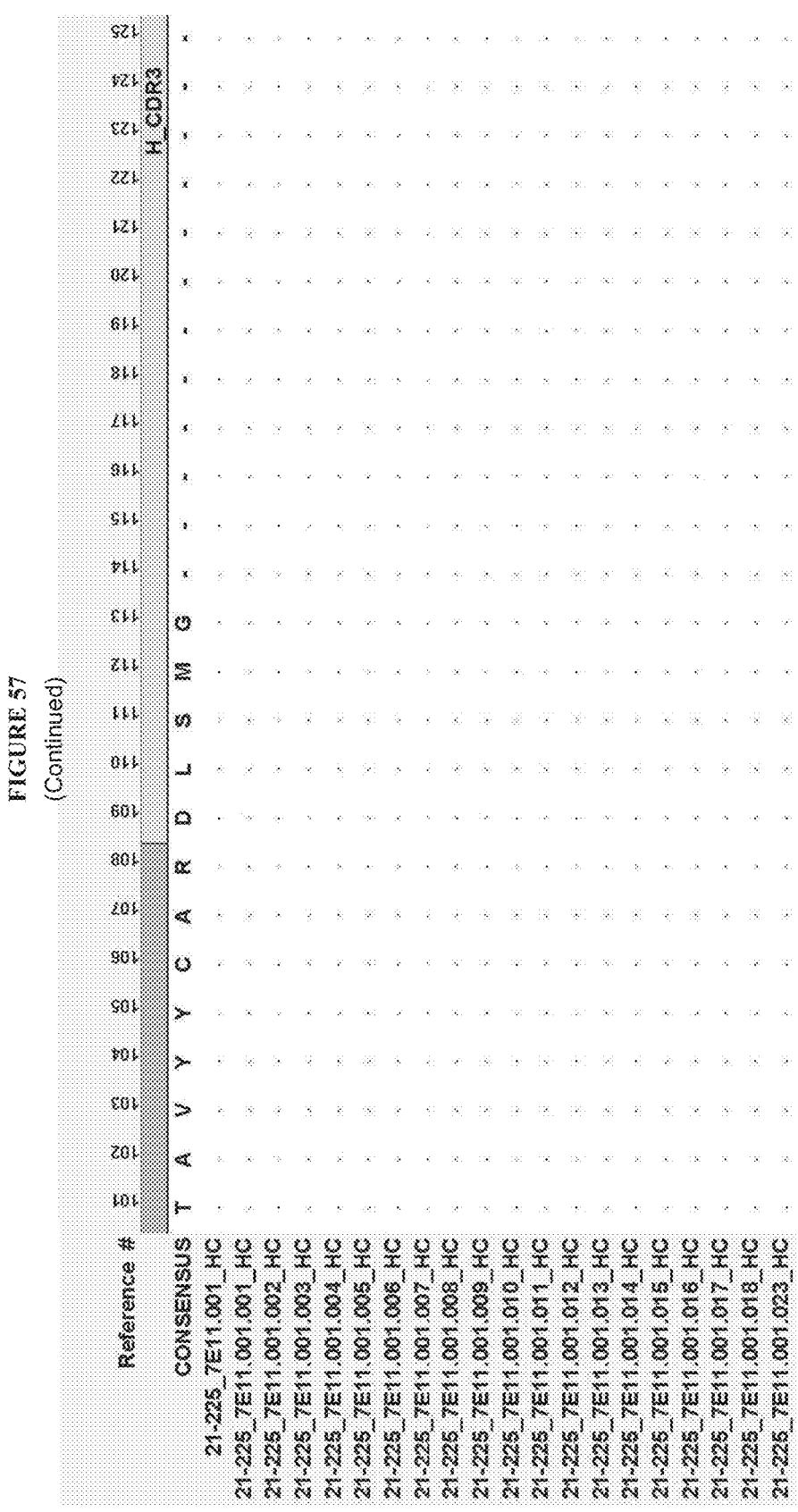
Figure 57:
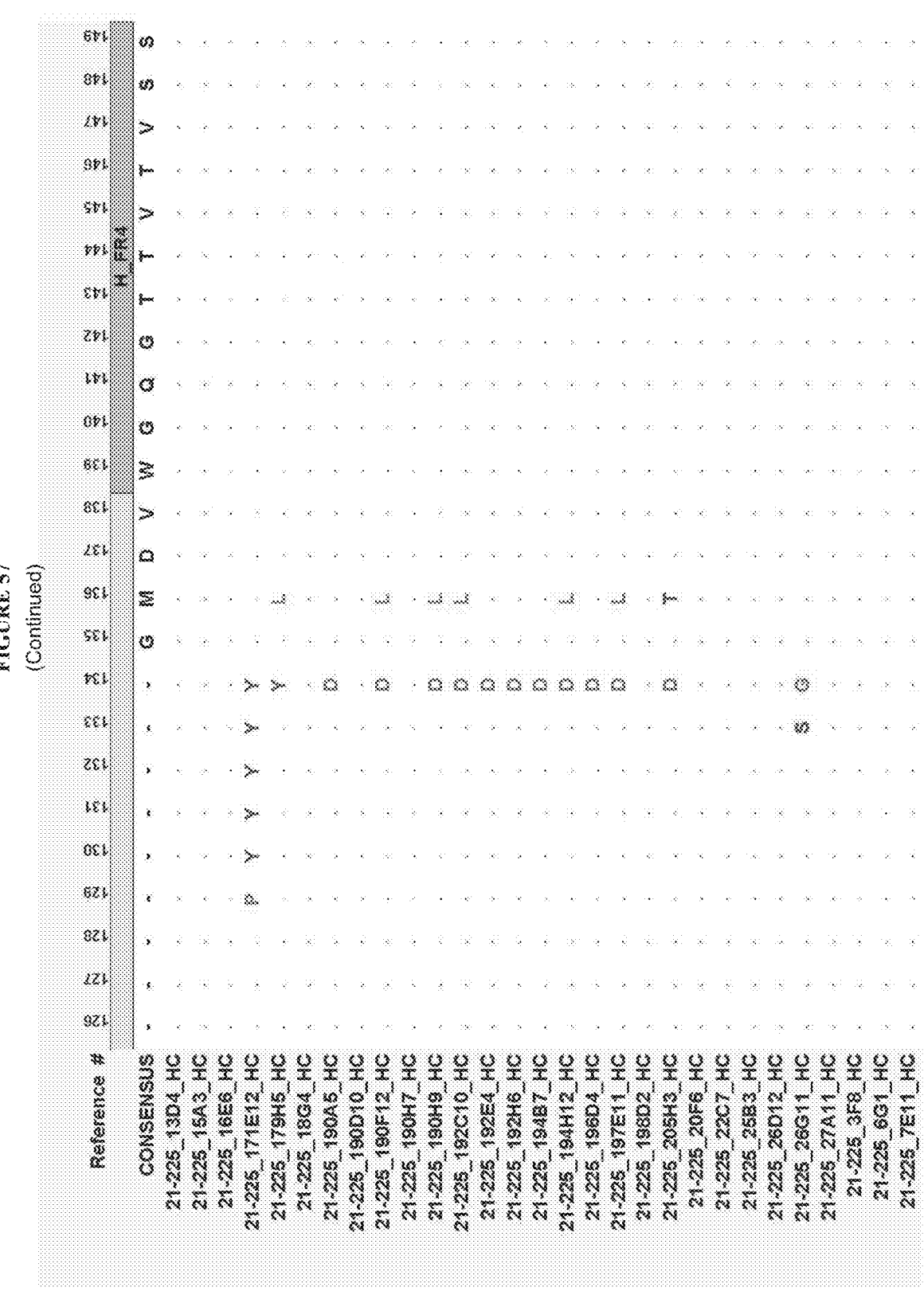
Figure 57:
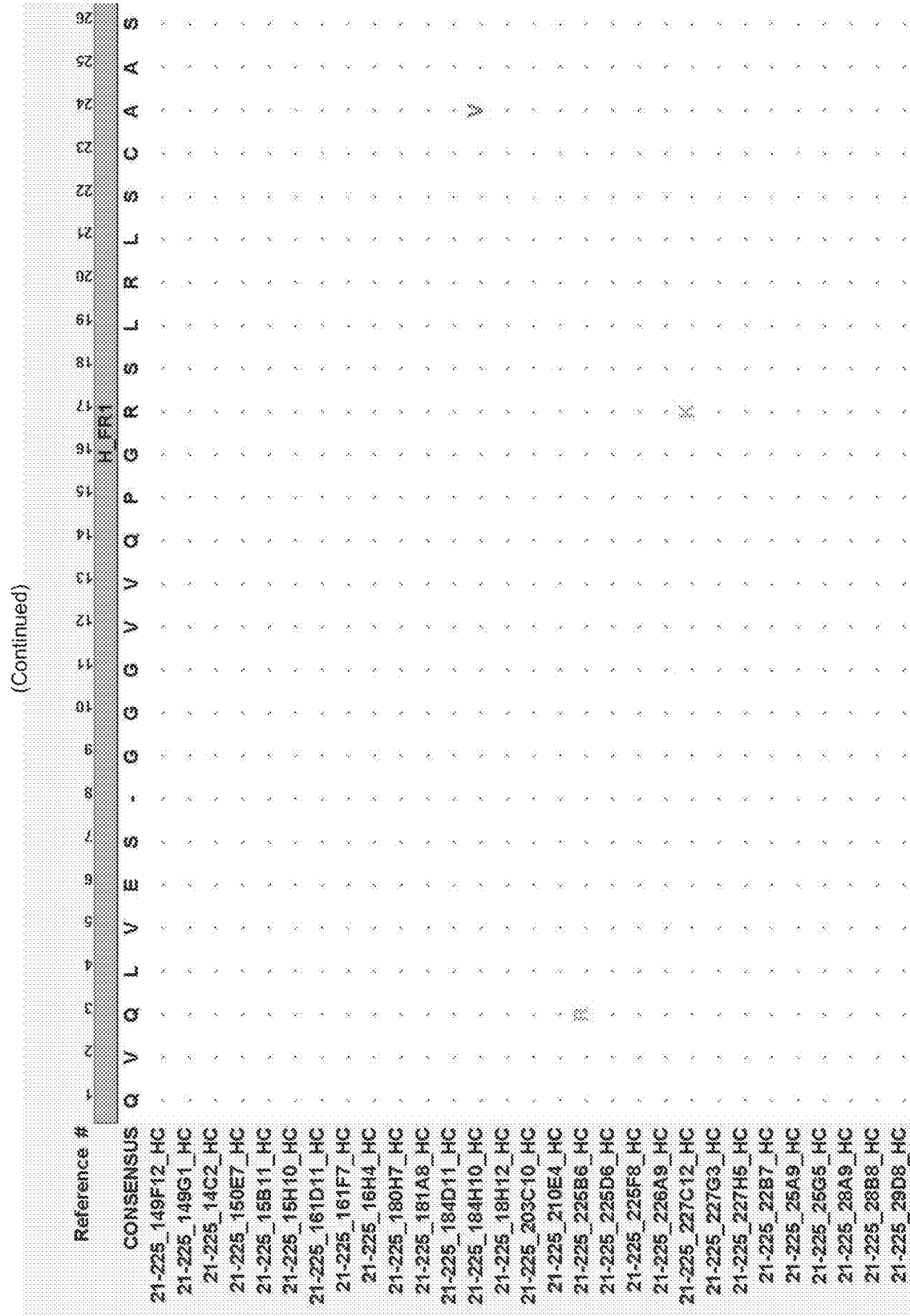
Figure 57:
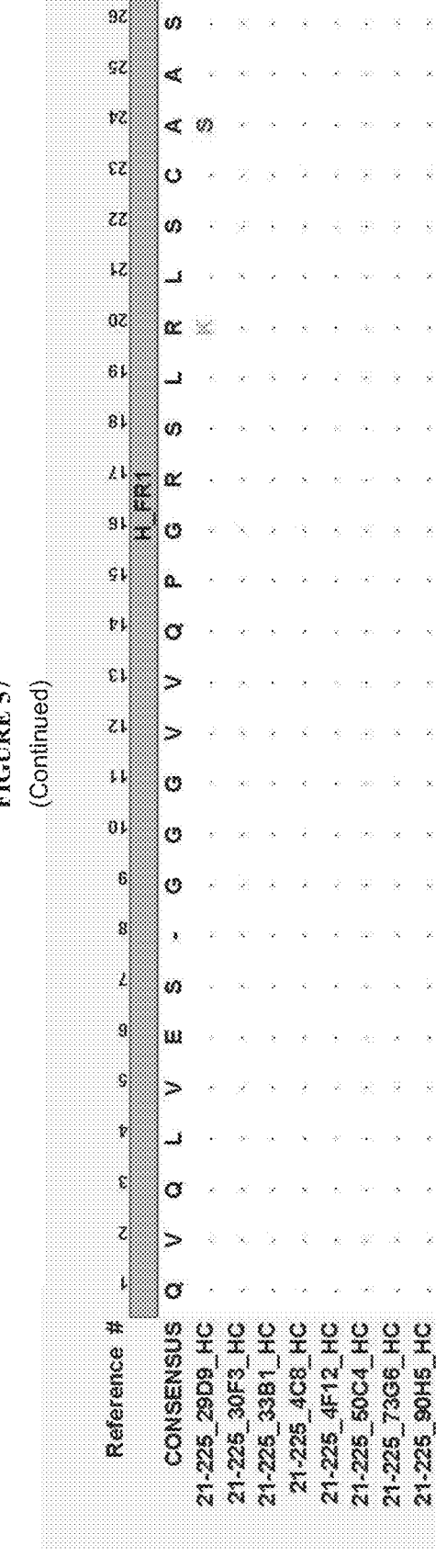
Figure 57:
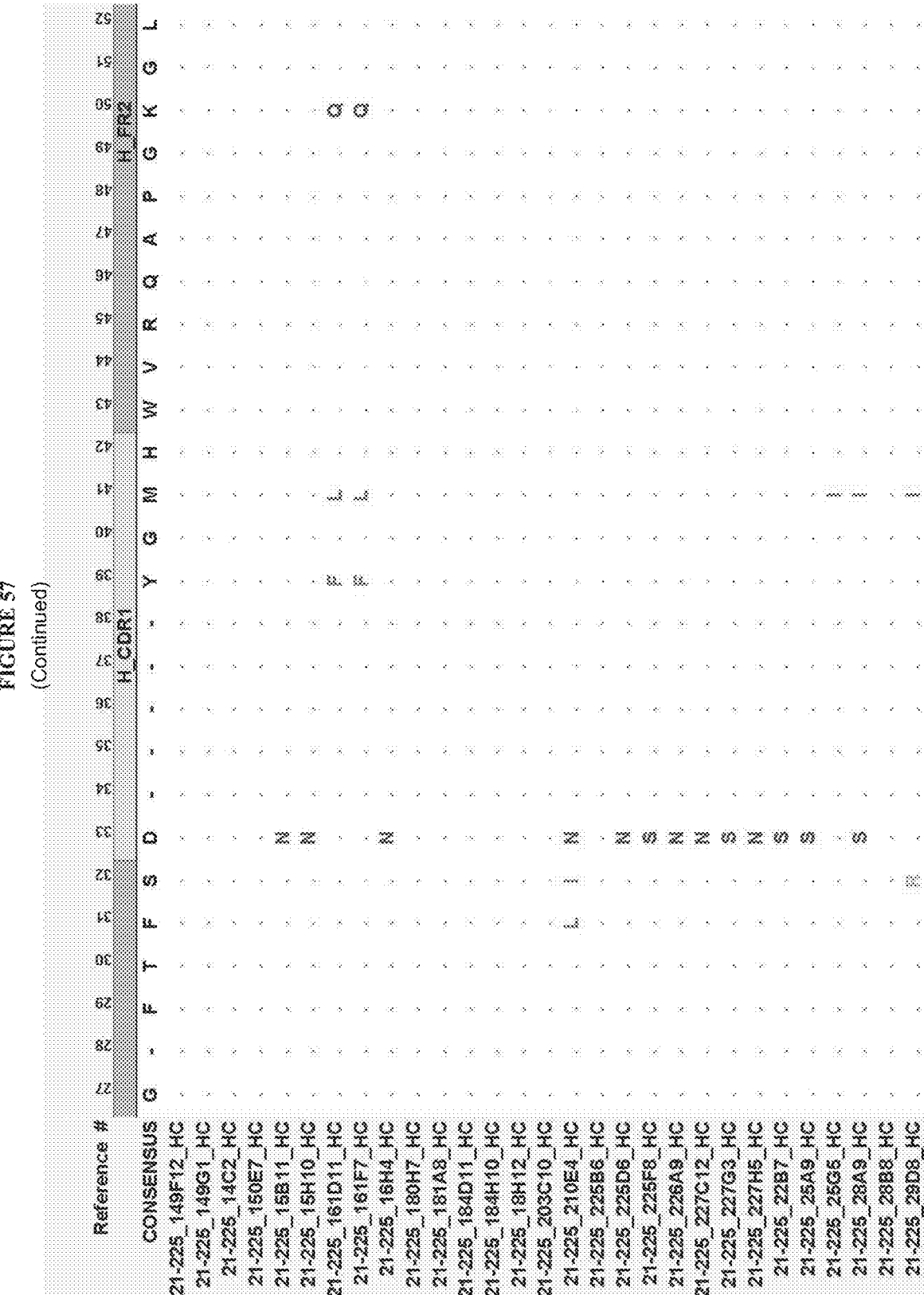
Figure 57:
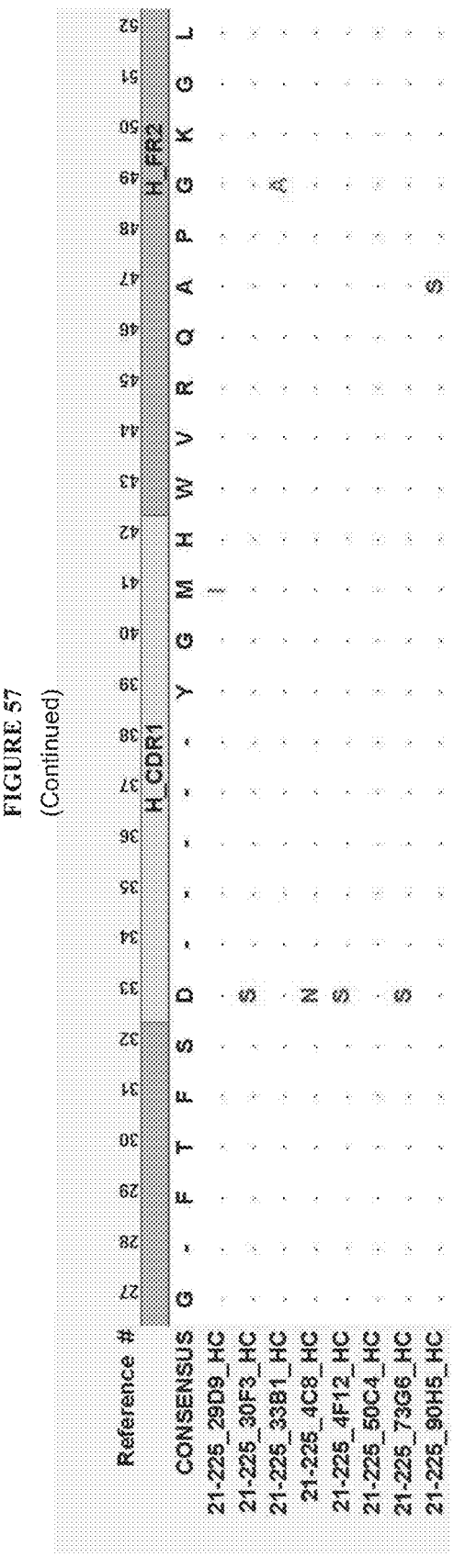
Figure 57:
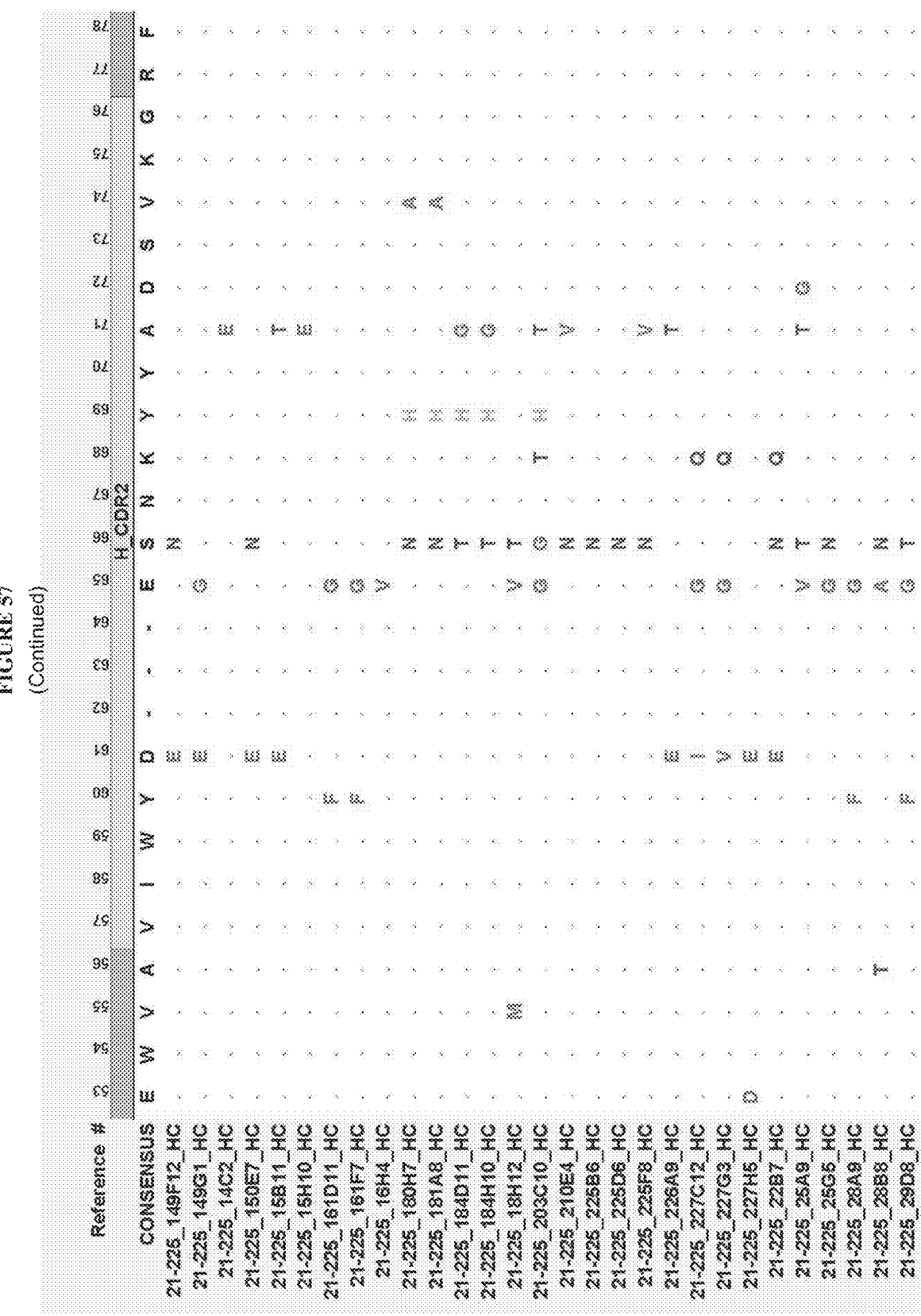
Figure 57:
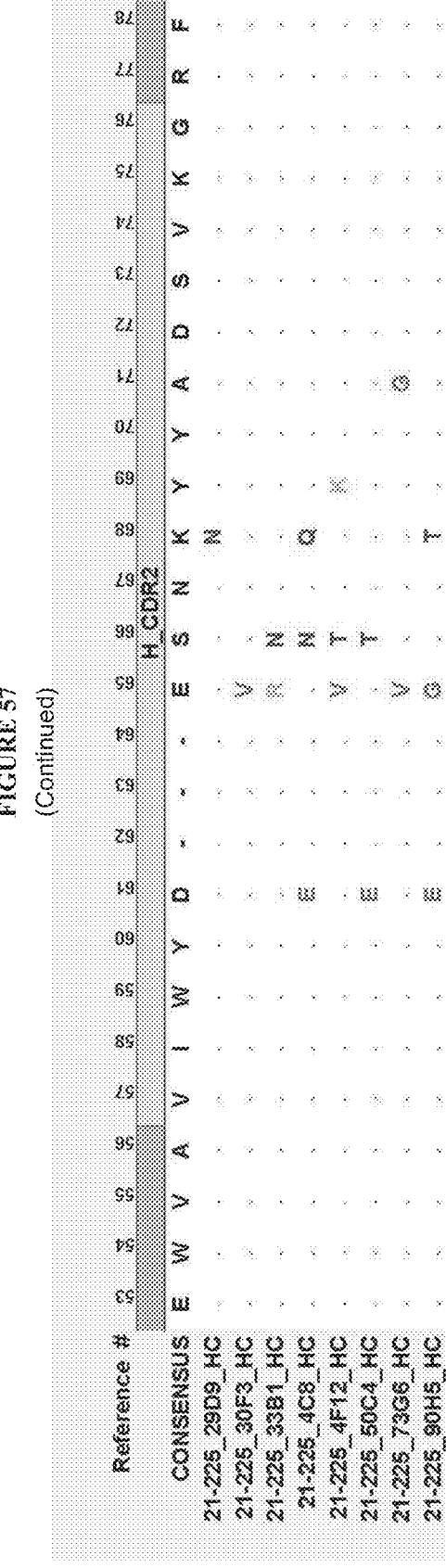
Figure 57:
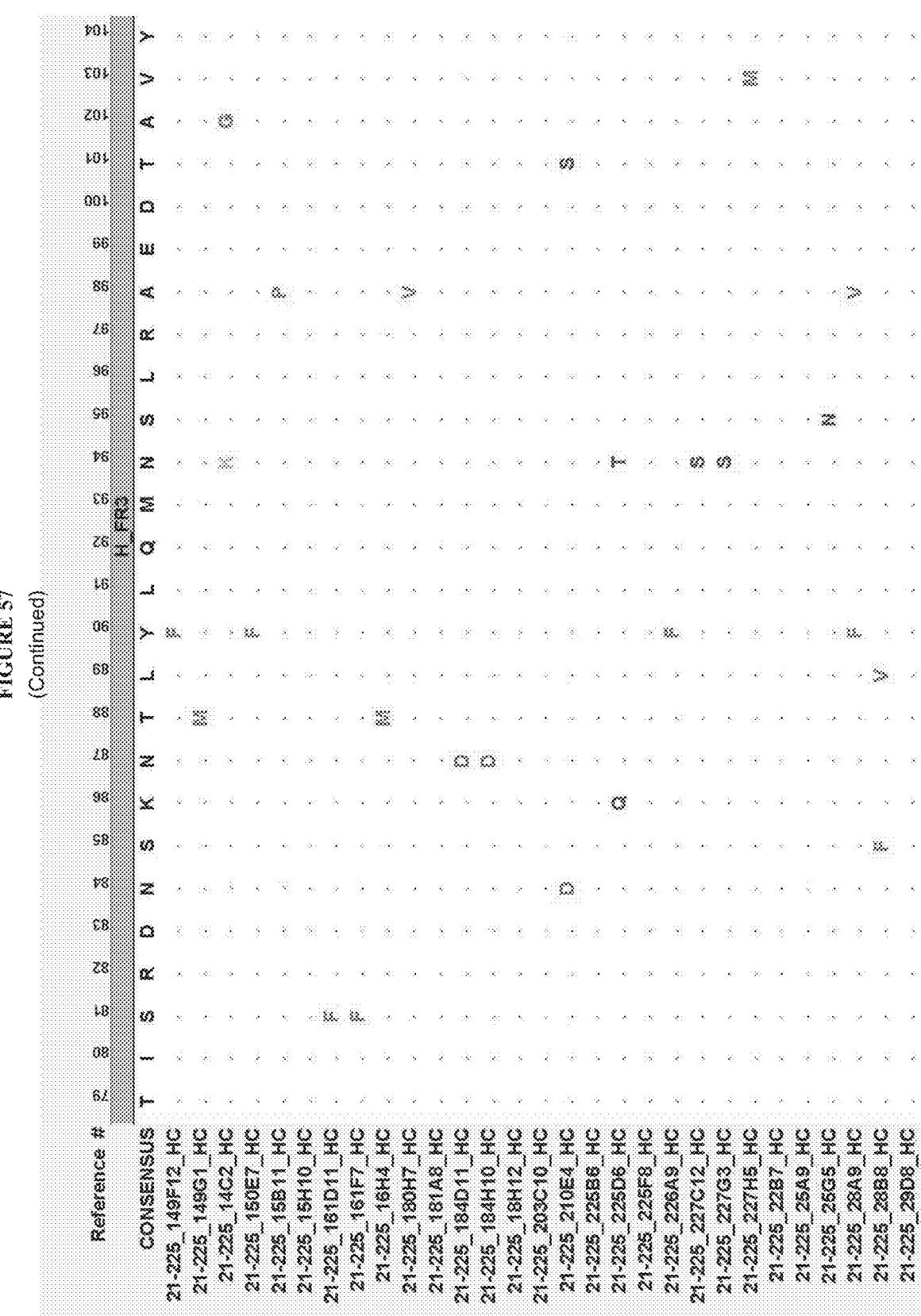
Figure 57:
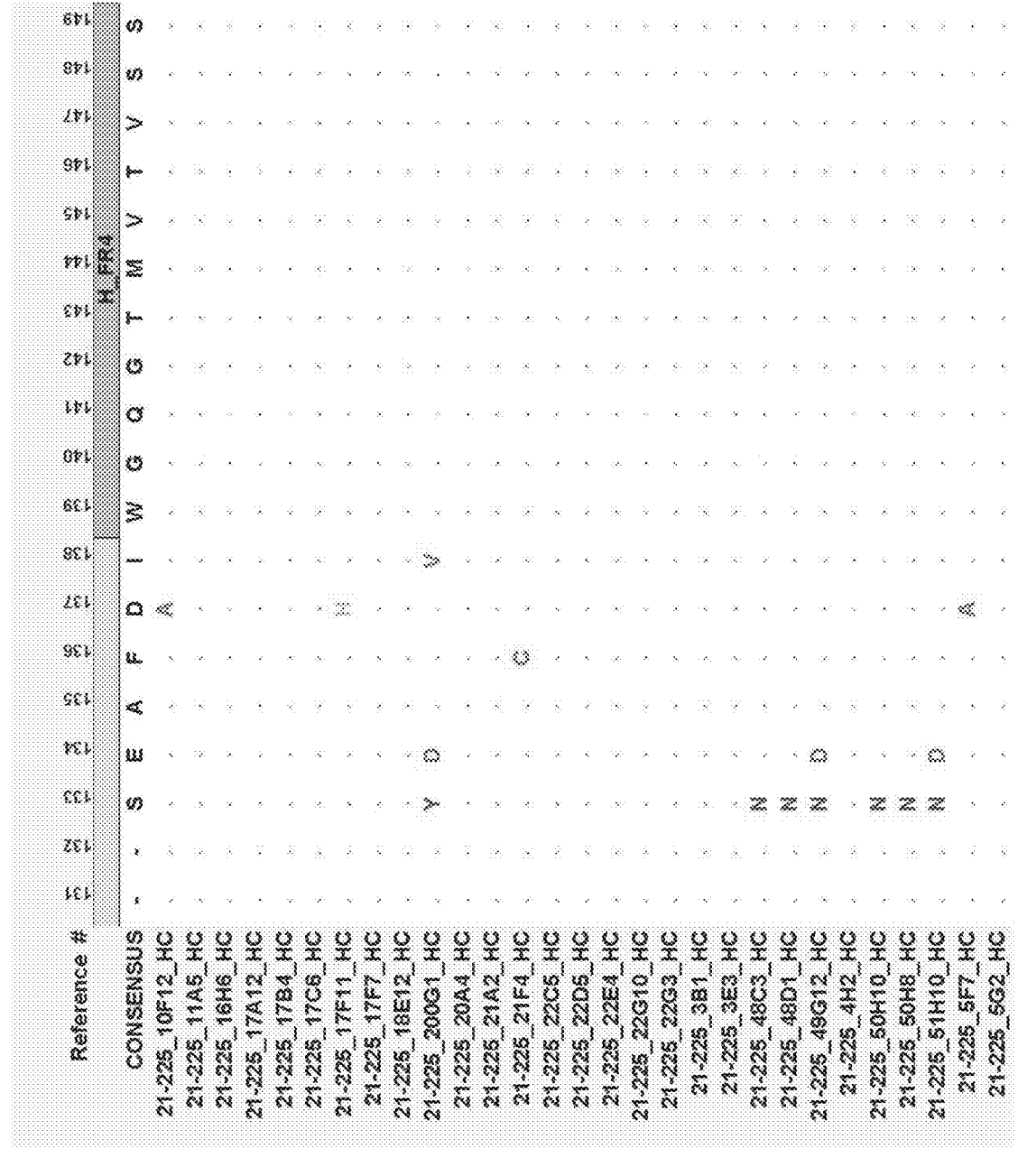
Figure 57:
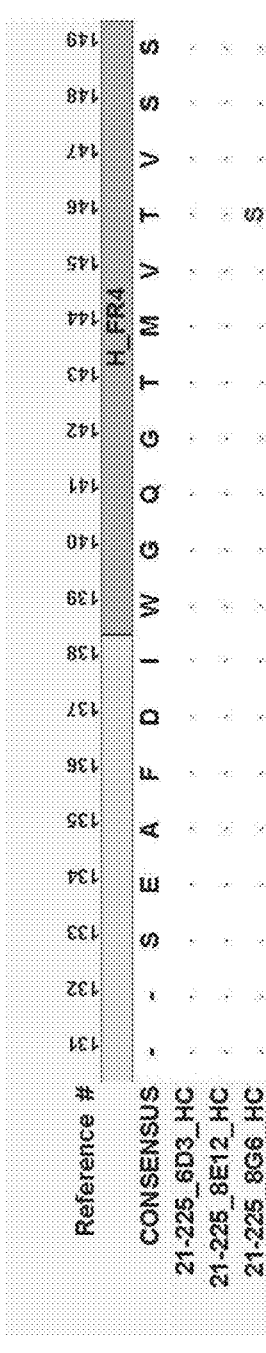
Figure 57:
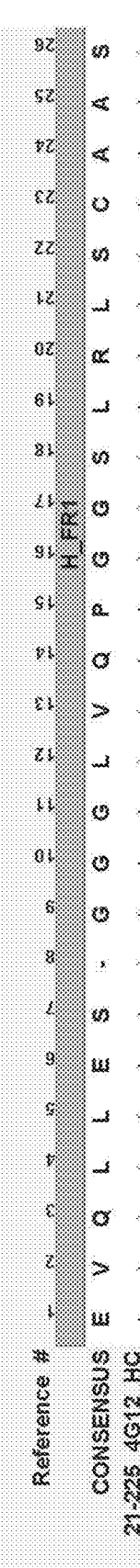
Figure 57:
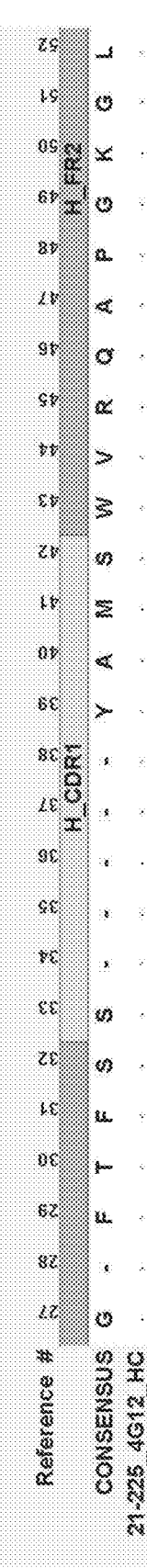
Figure 57:
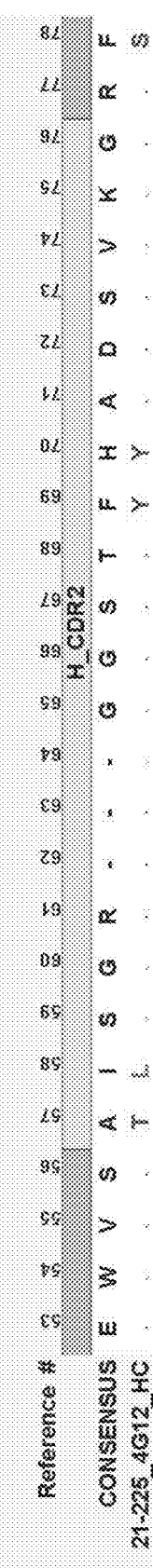
Figure 57:
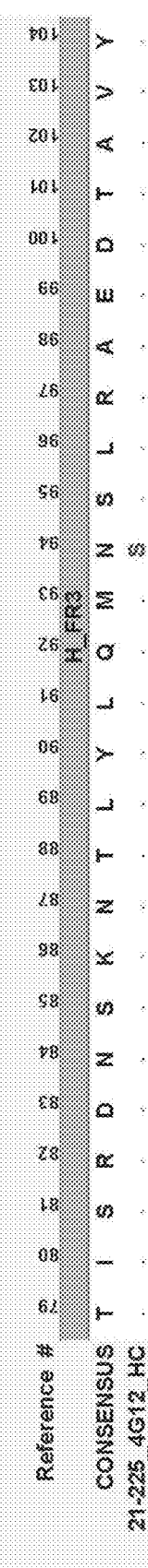
Figure 57:
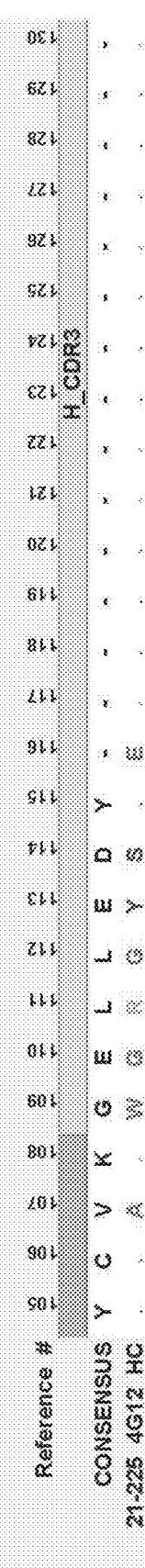
Figure 57:
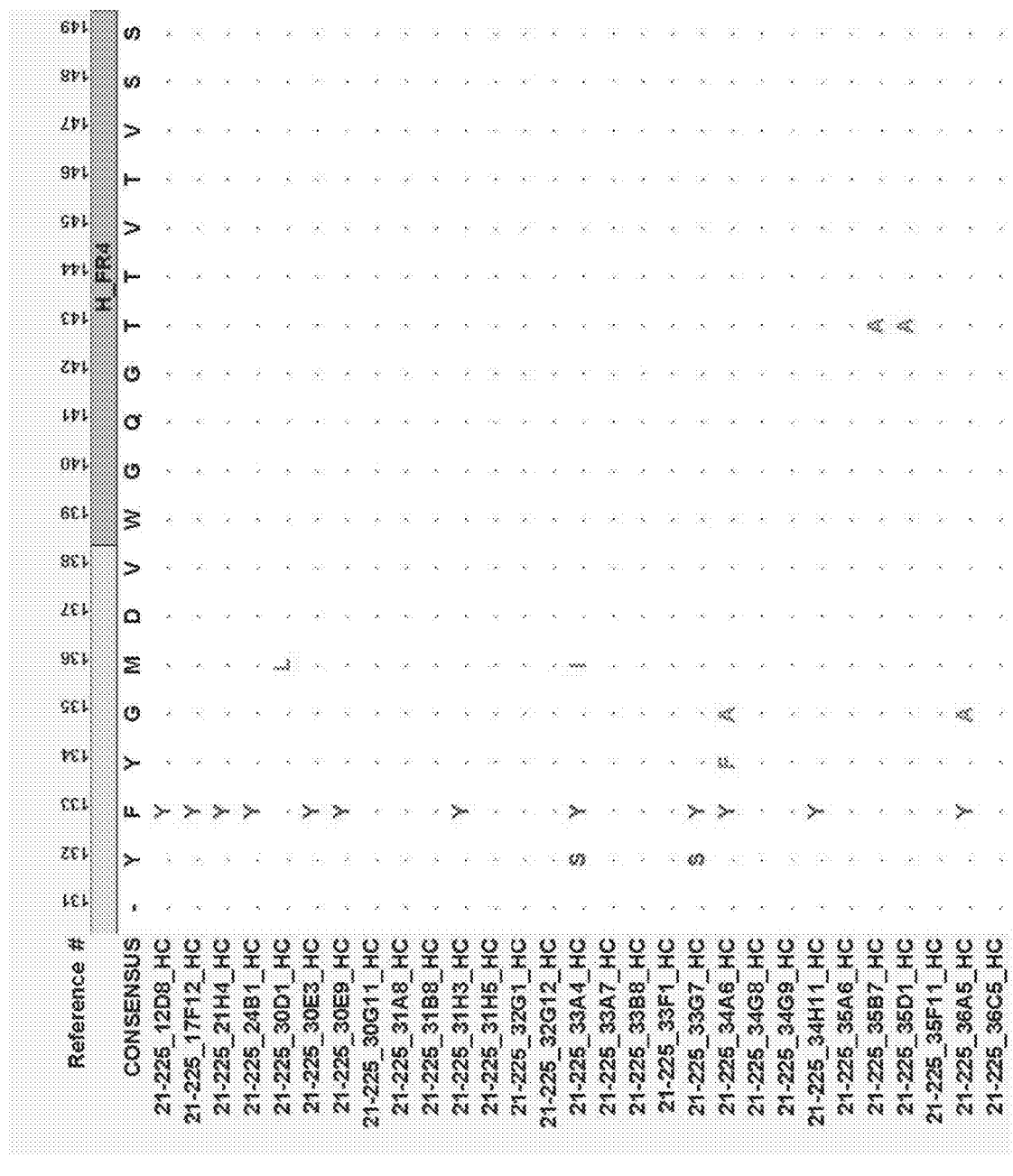
Figure 57:
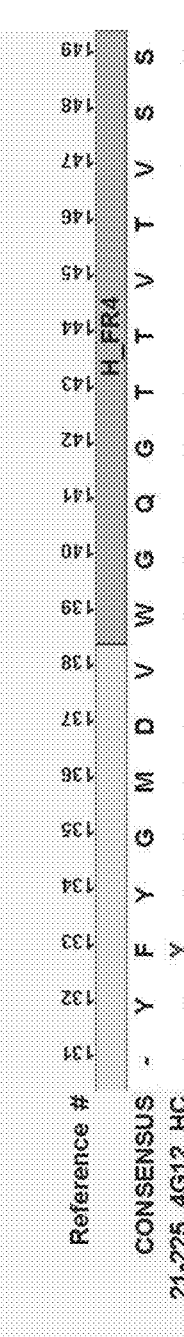
Figure 57:
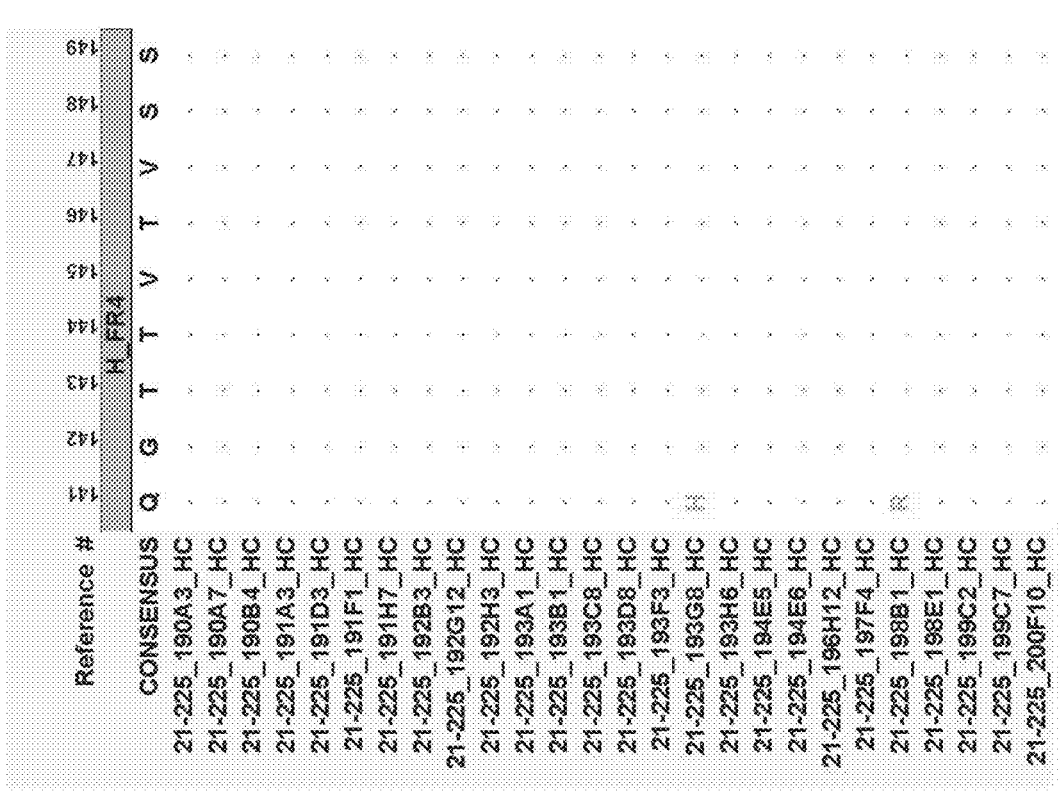
Figure 57:
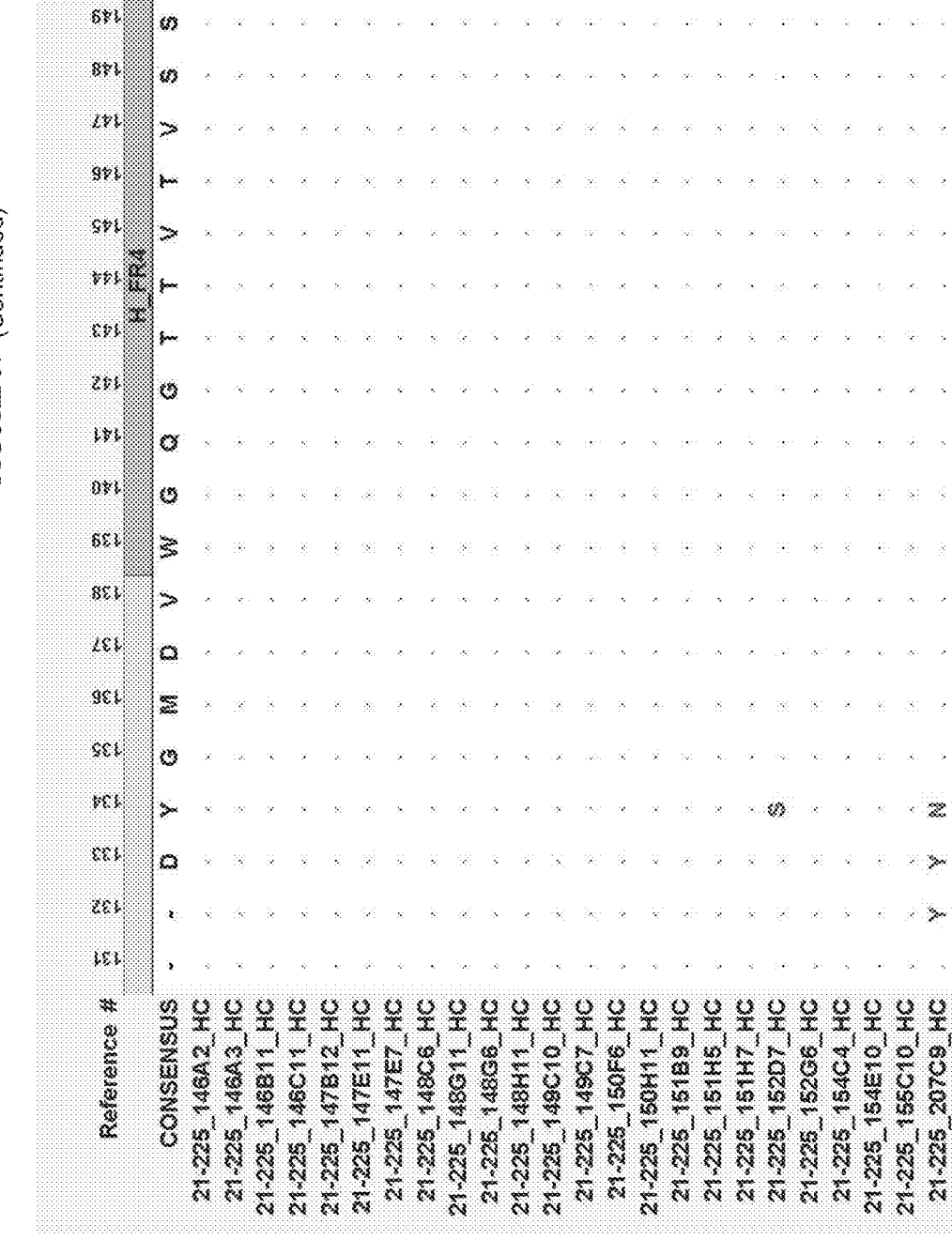
Figure 57:
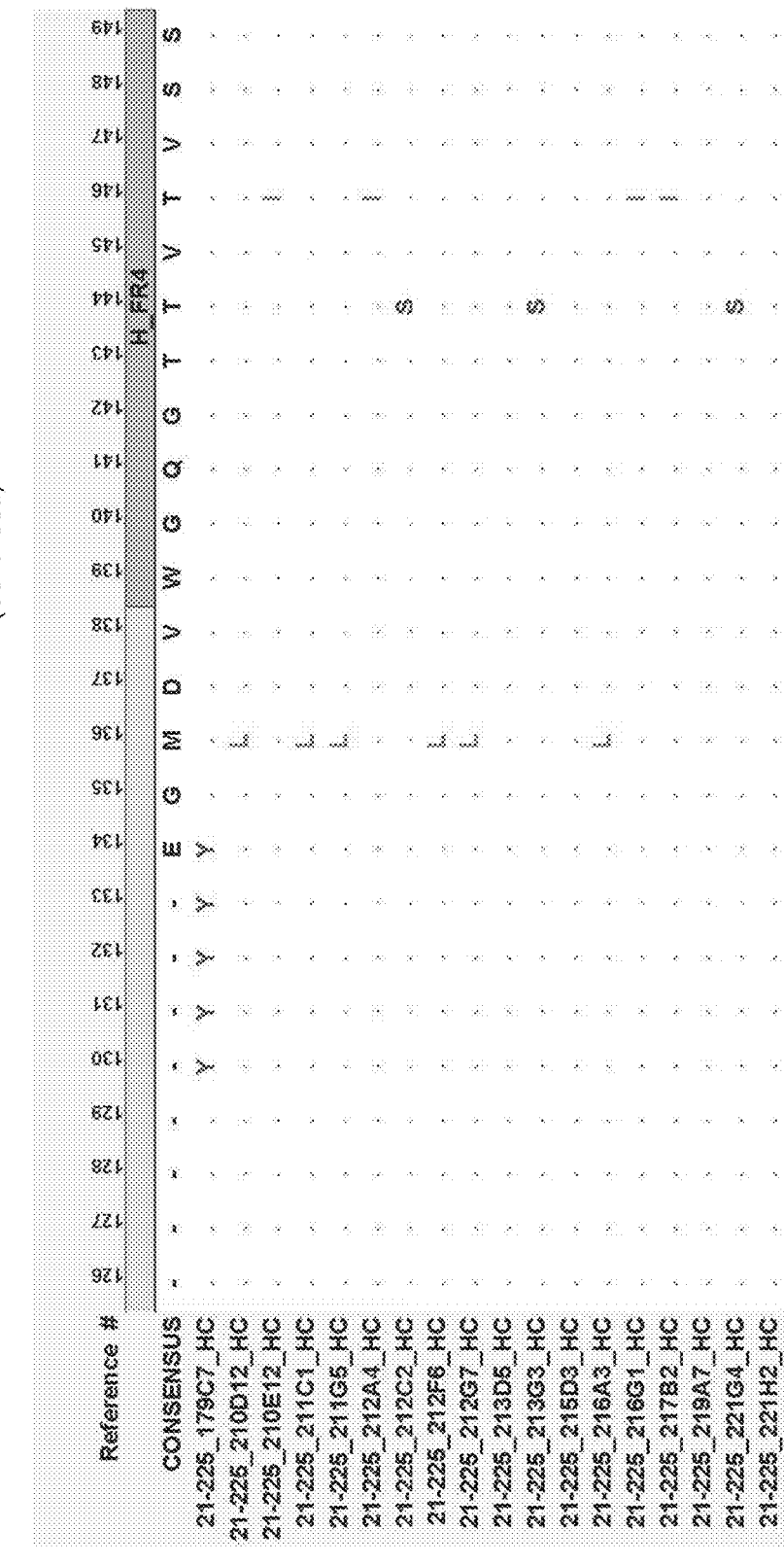
Figure 57:
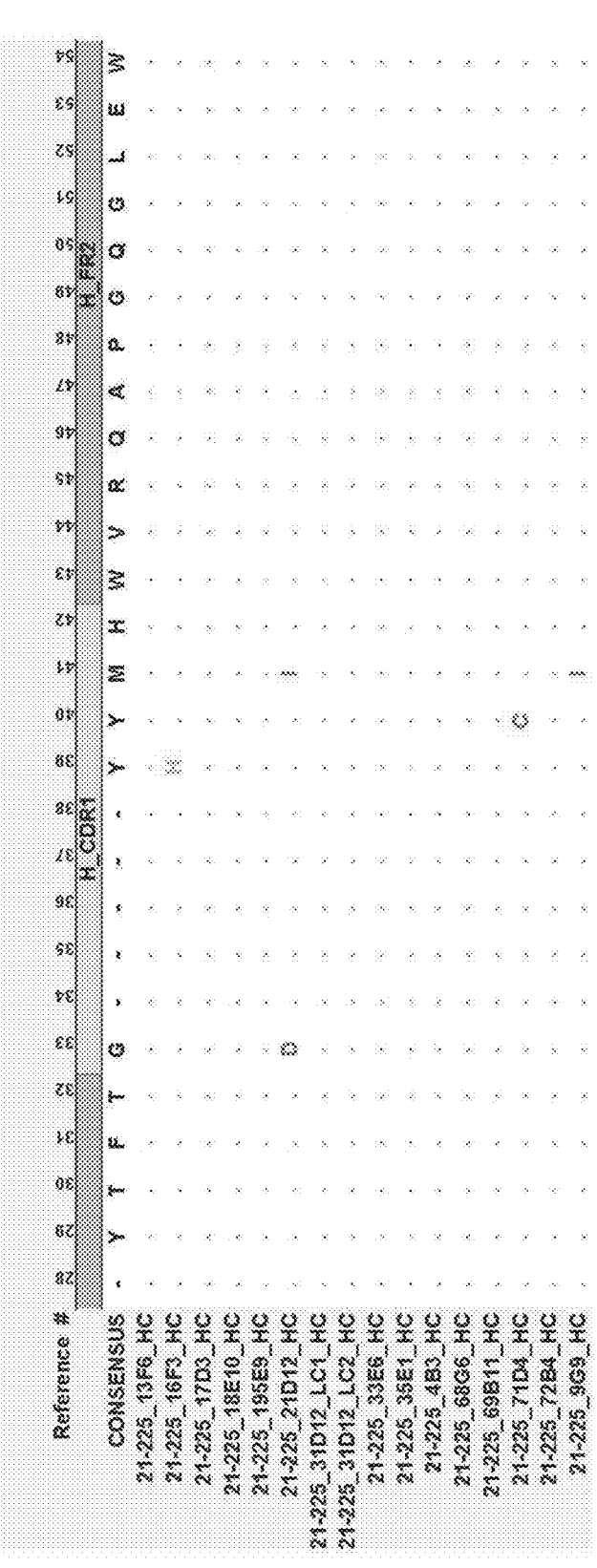
Figure 57:
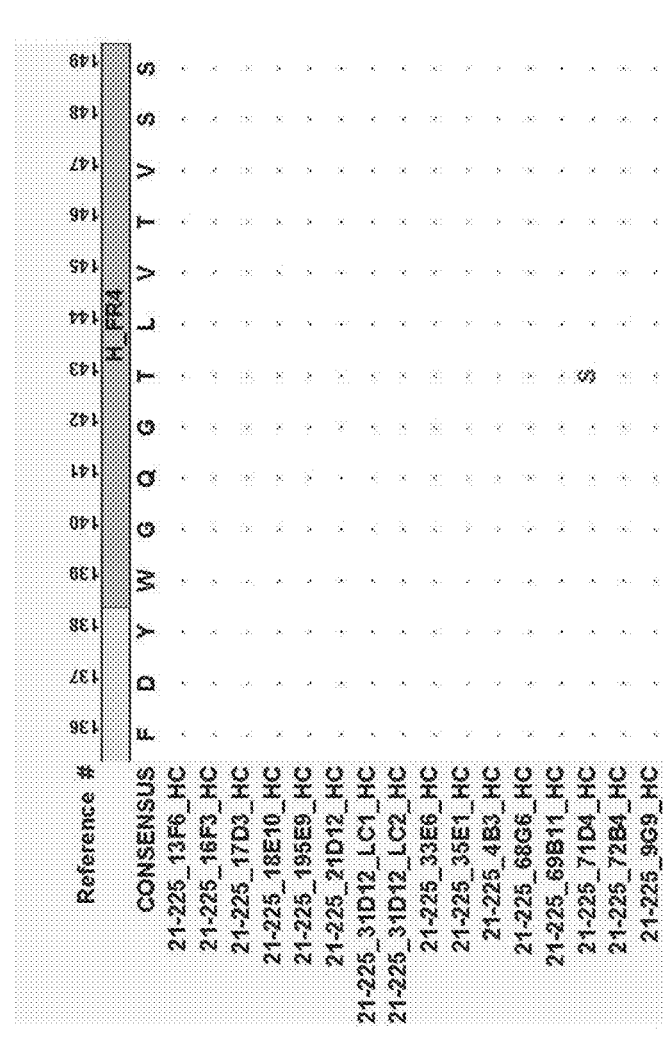
Figure 57:
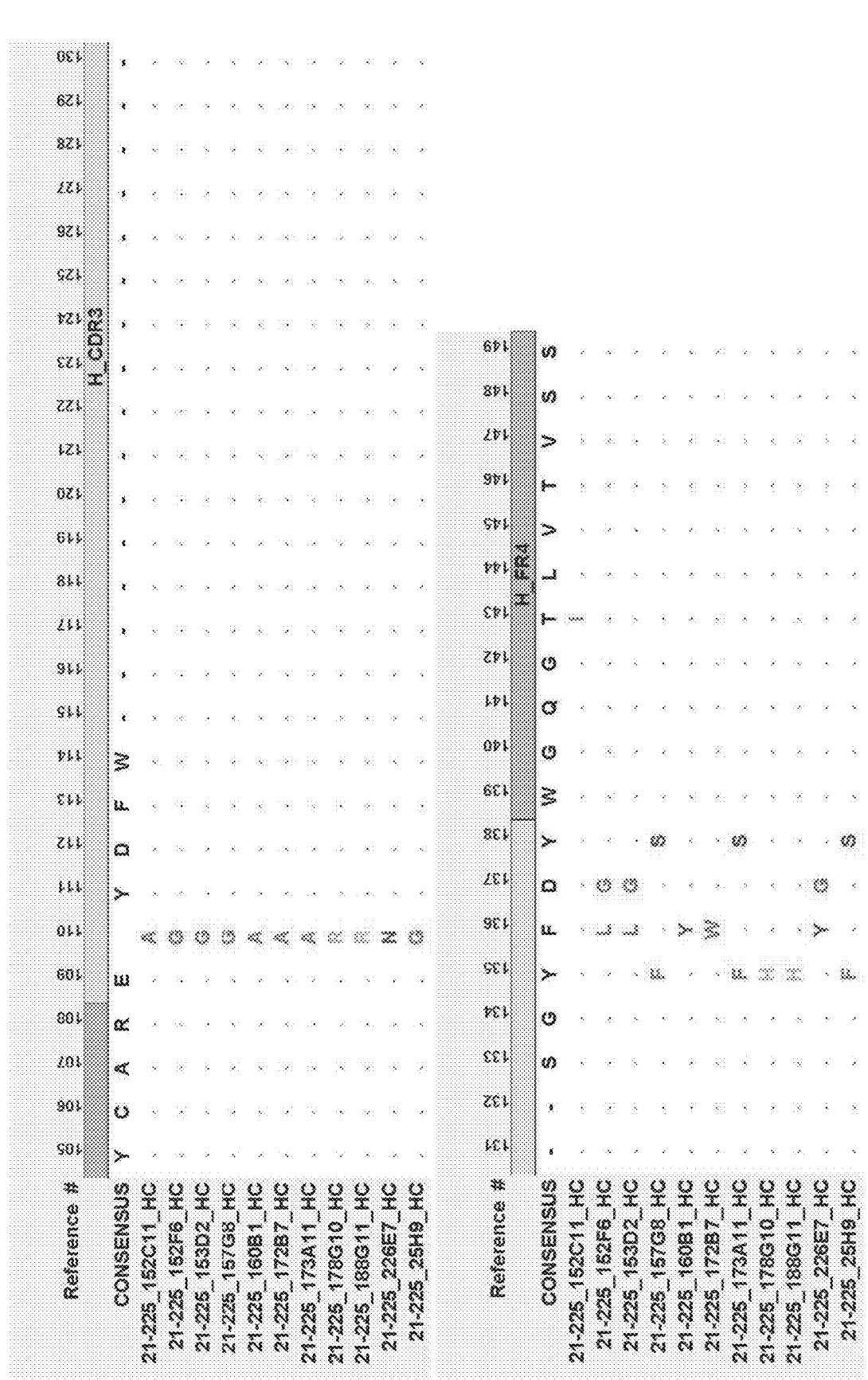
Figure 57:
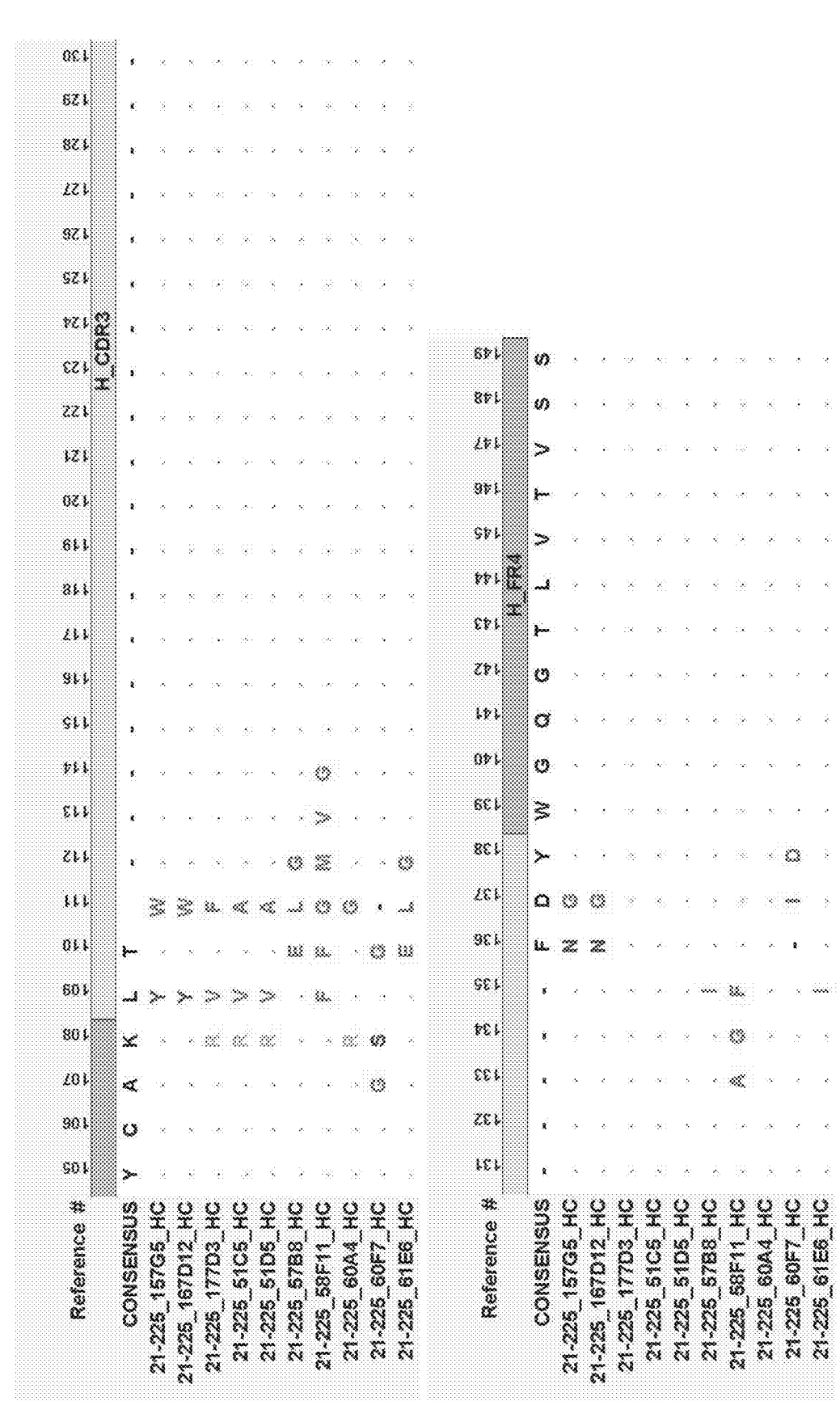
Figure 57:
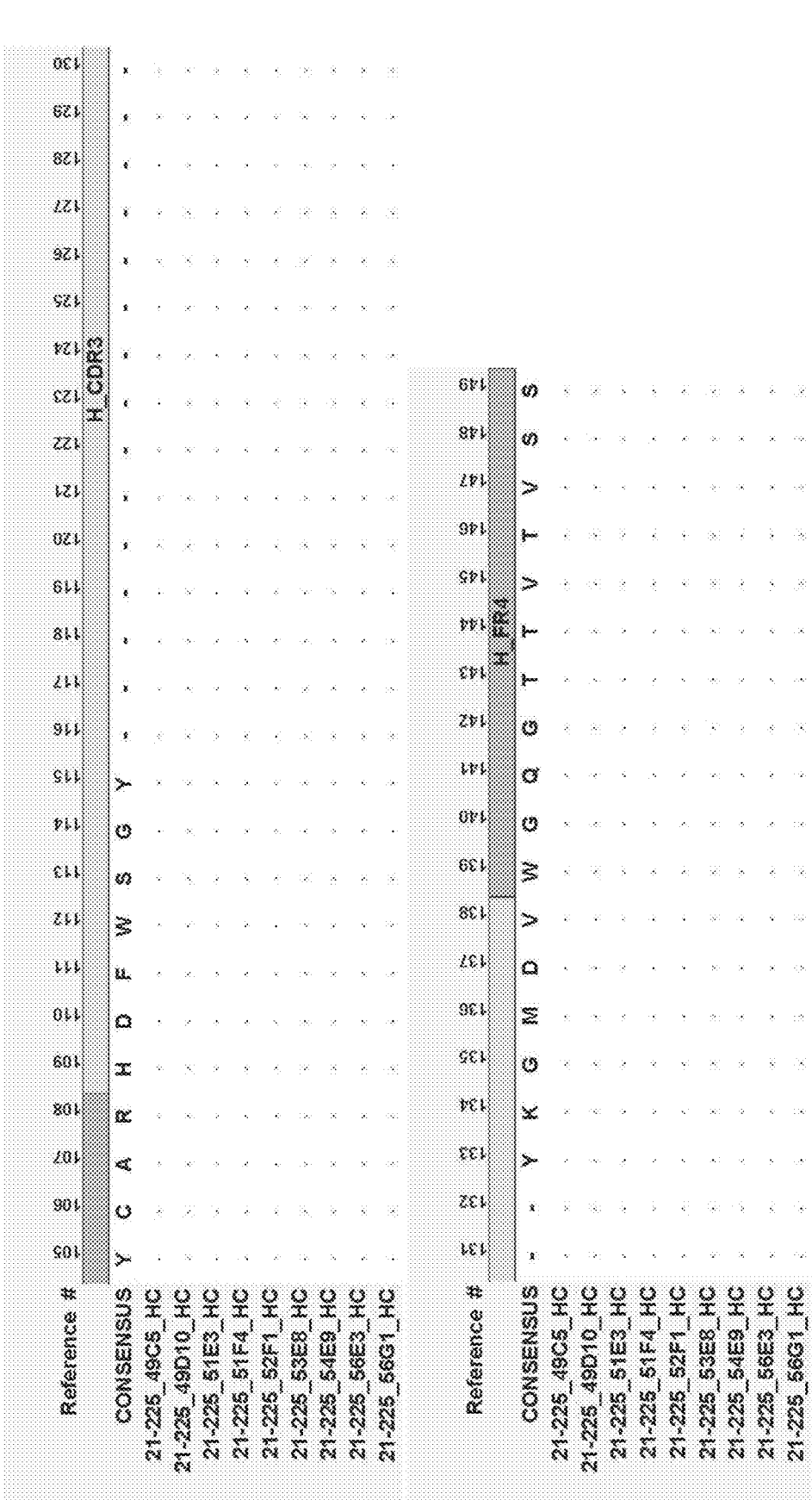
Figure 57:
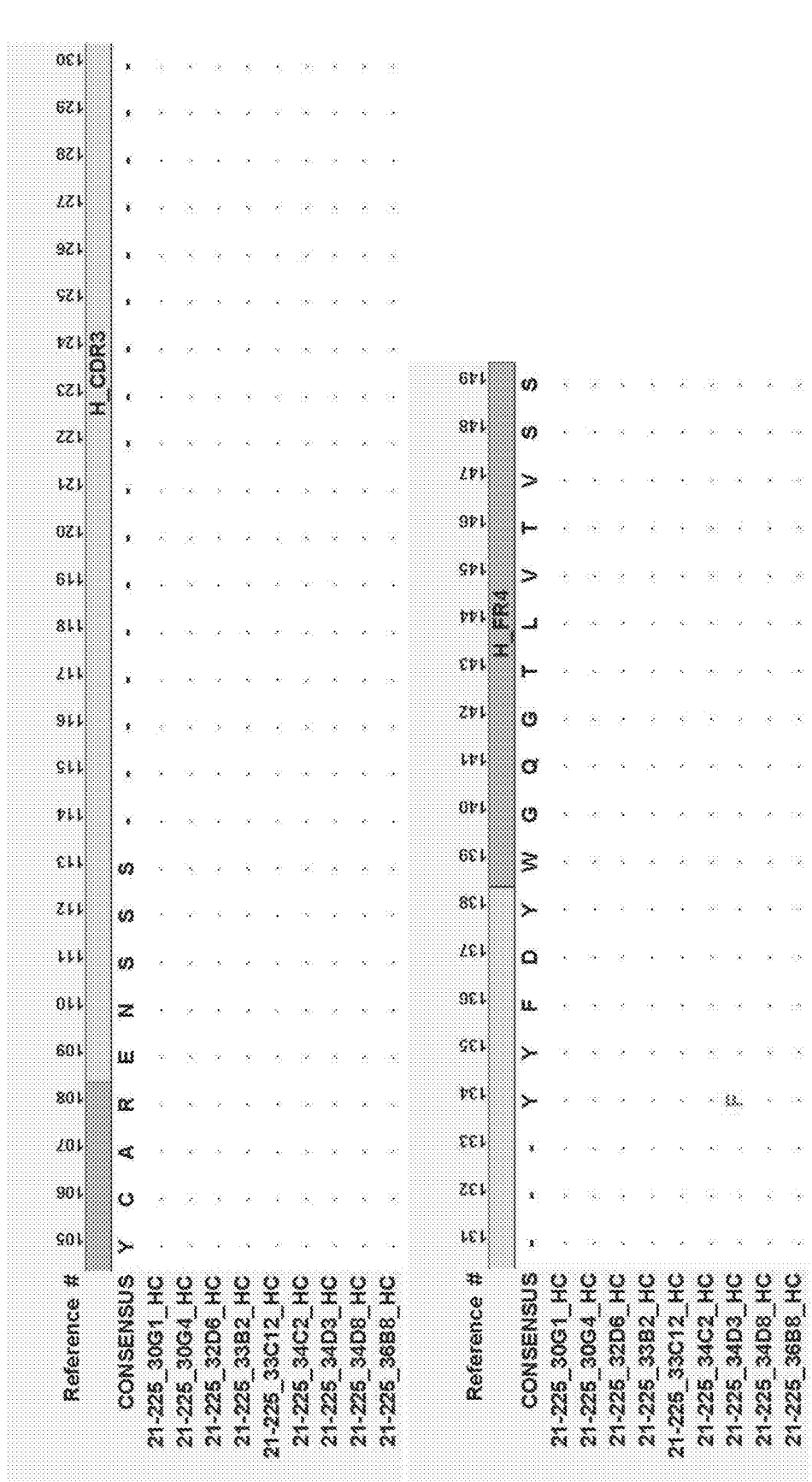
Figure 57:
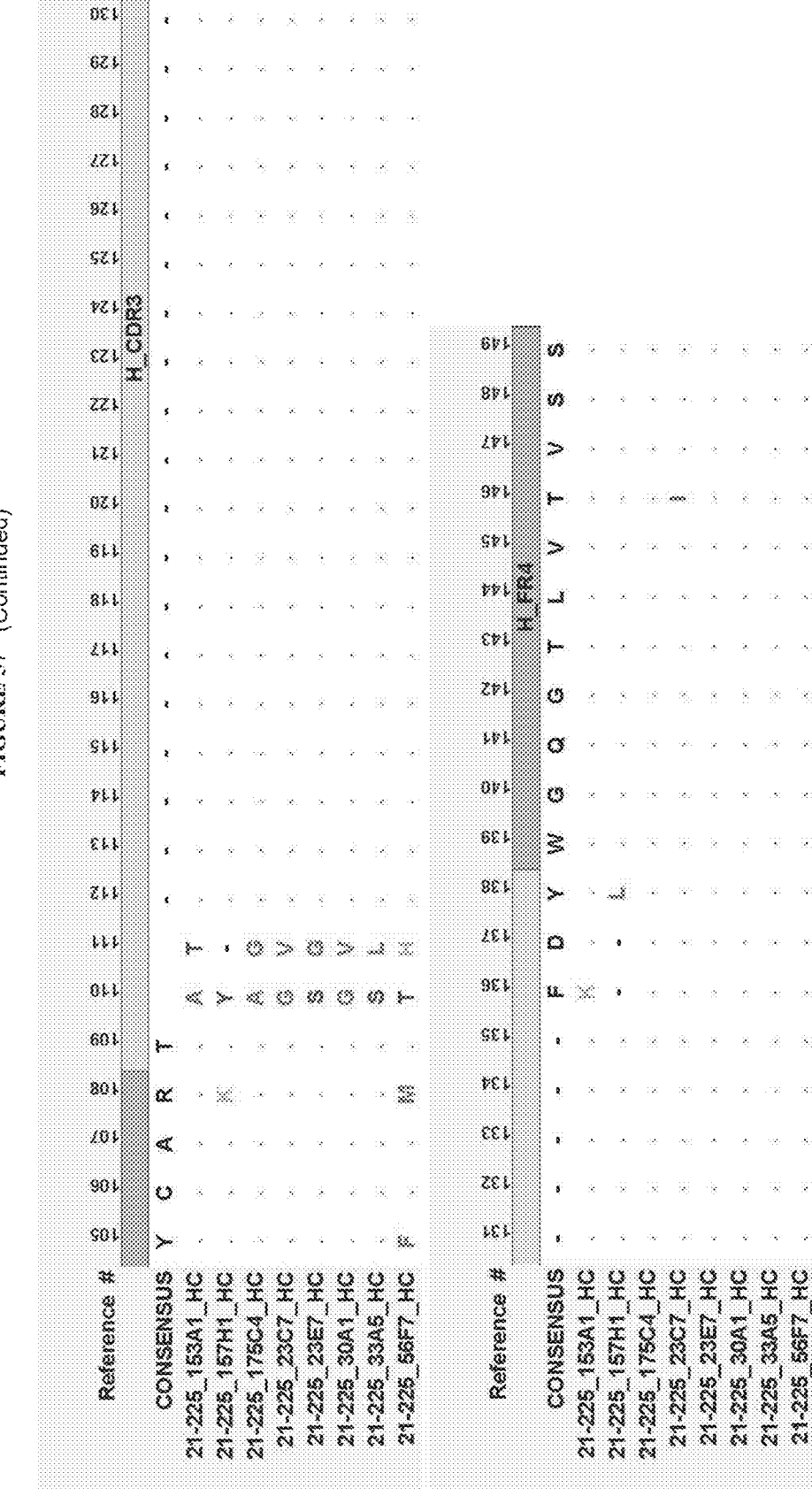
Figure 57:
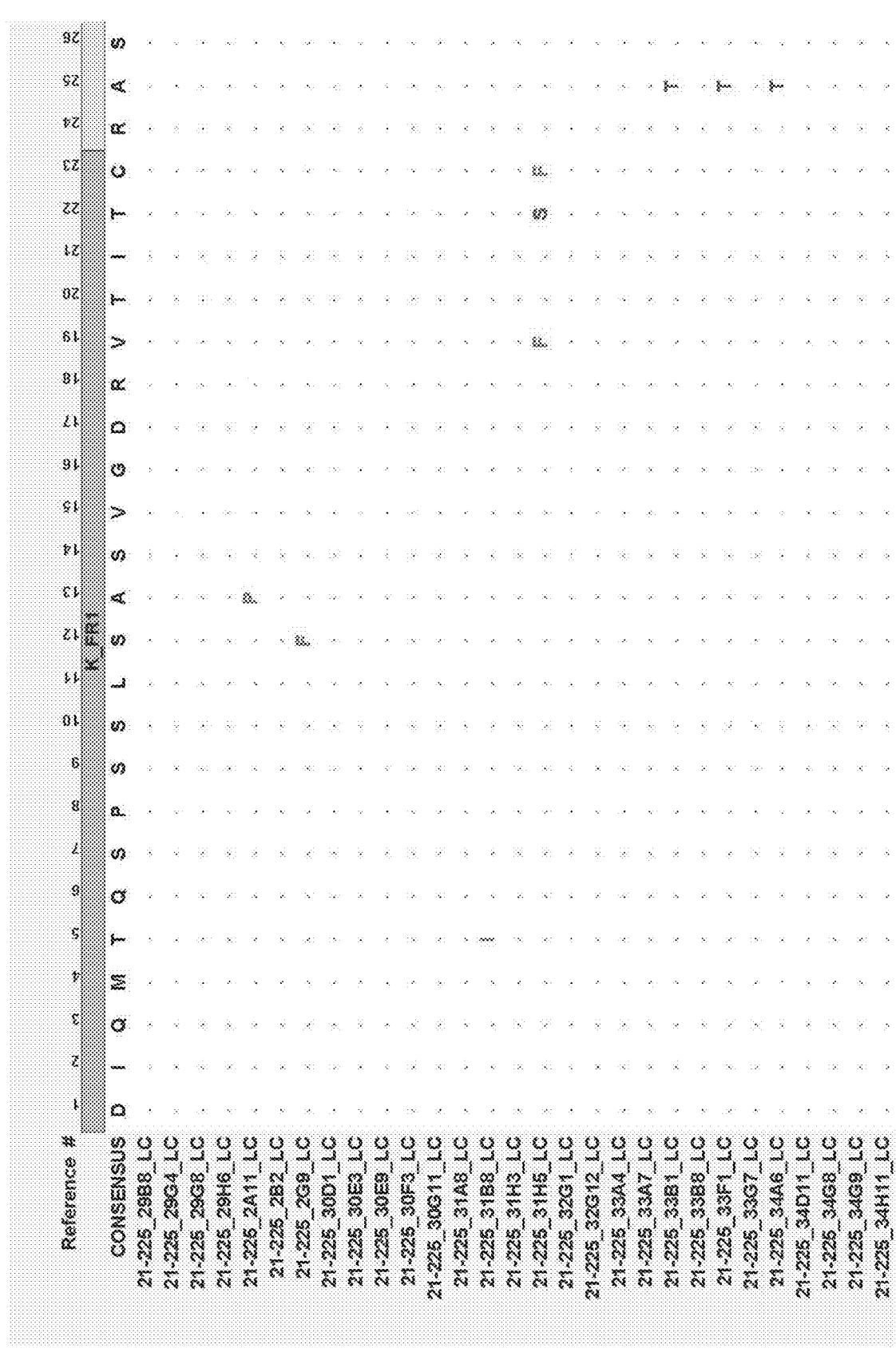
Figure 57:
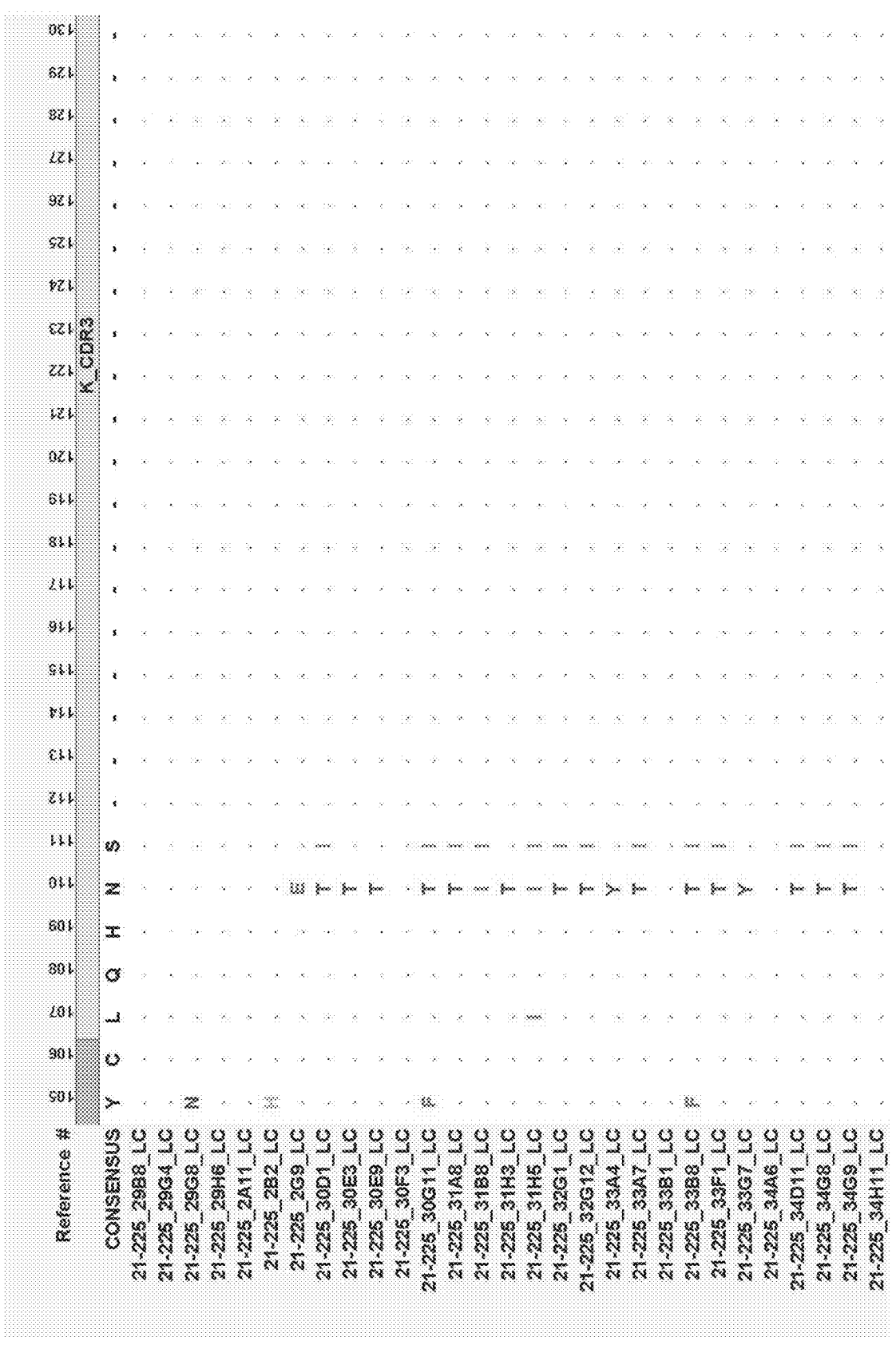
Figure 57:
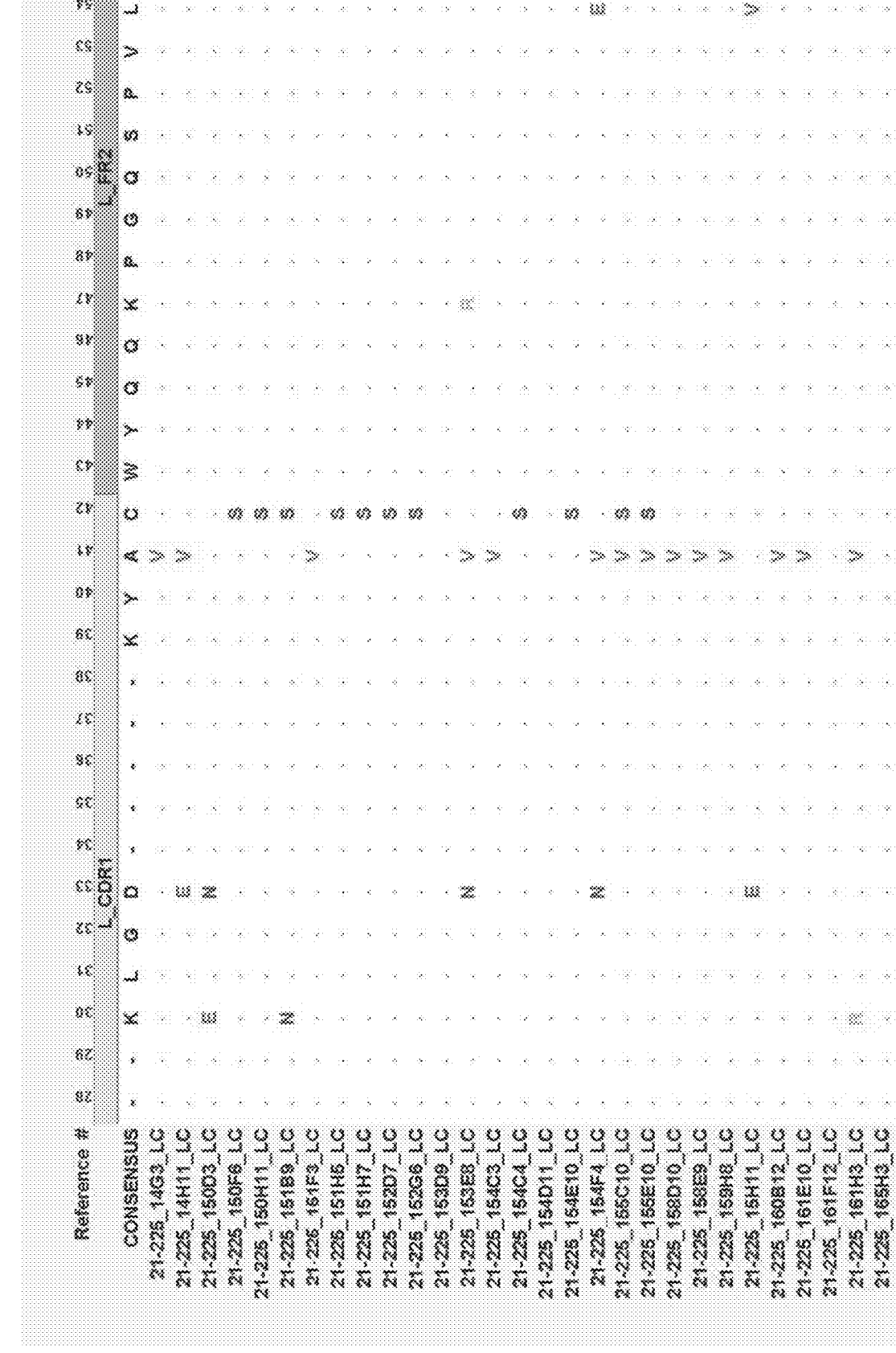
Figure 57:
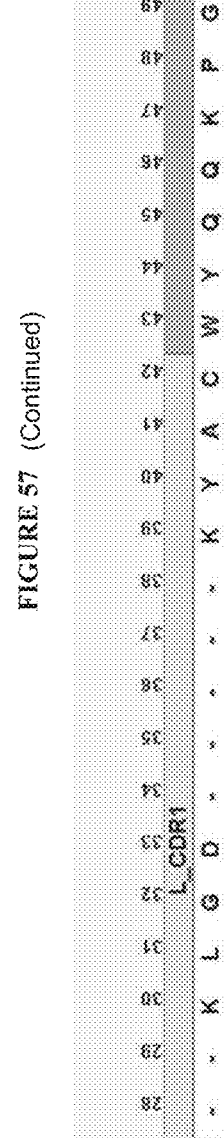
Figure 57:
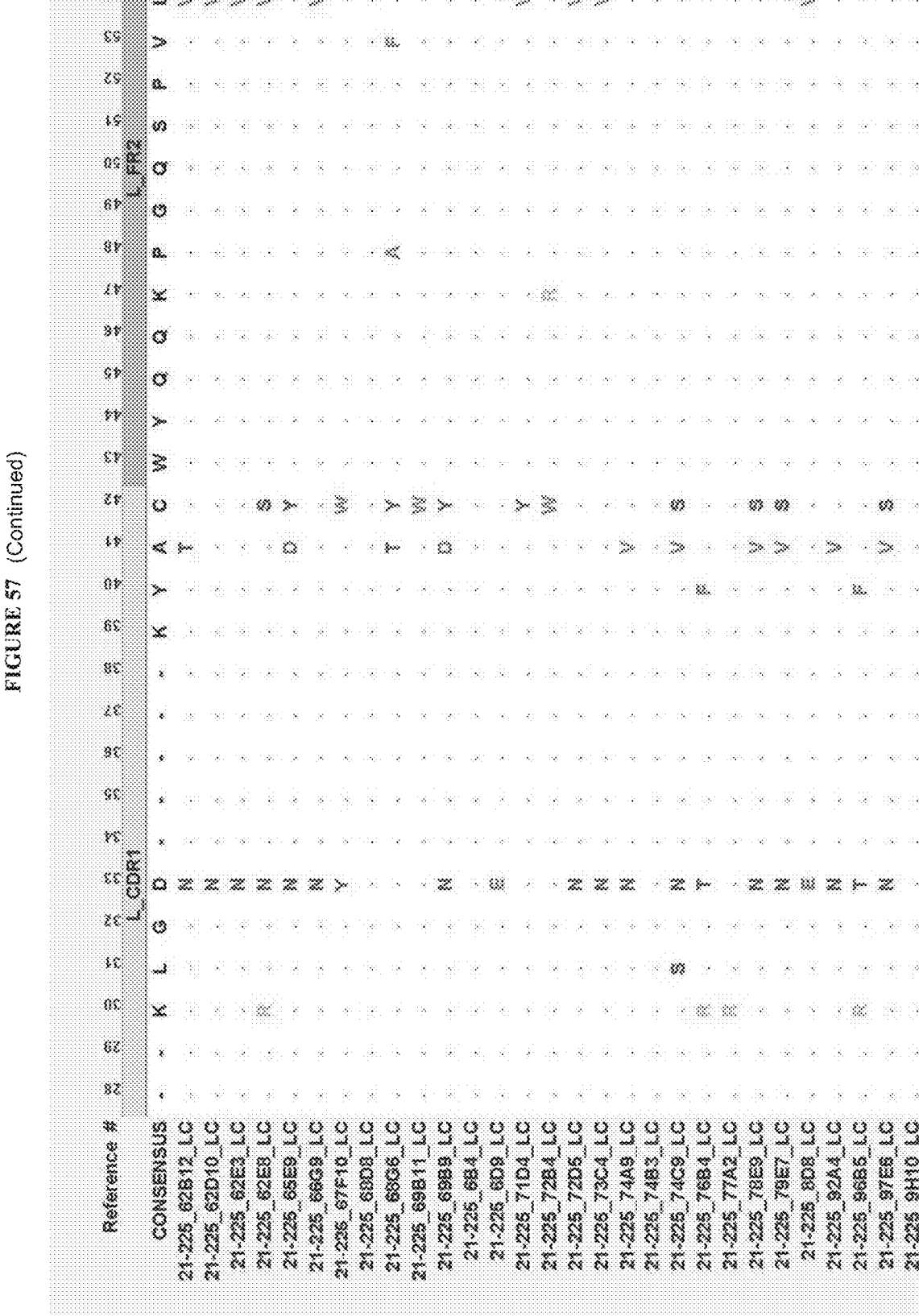
Figure 57:
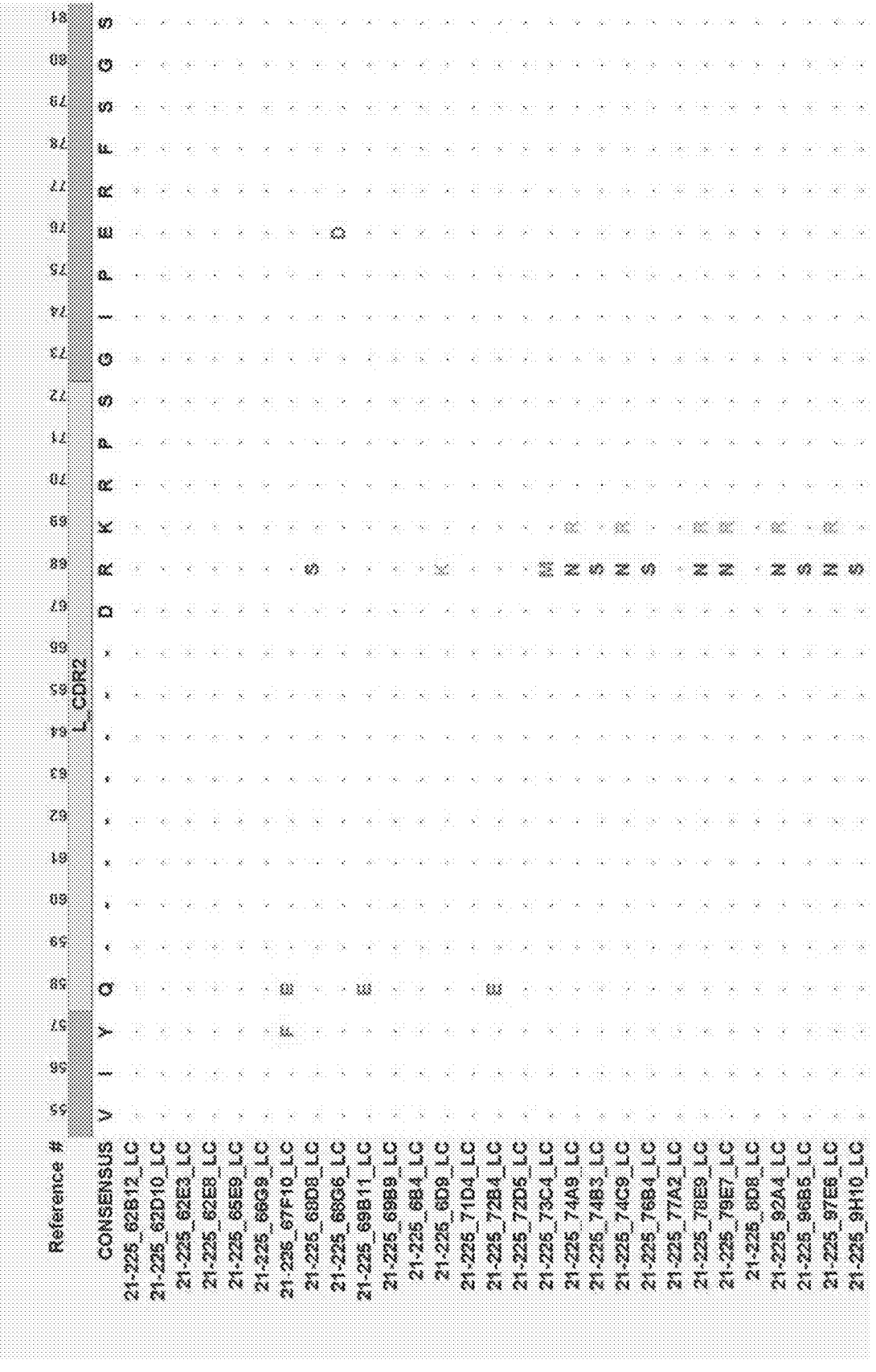
Figure 57:
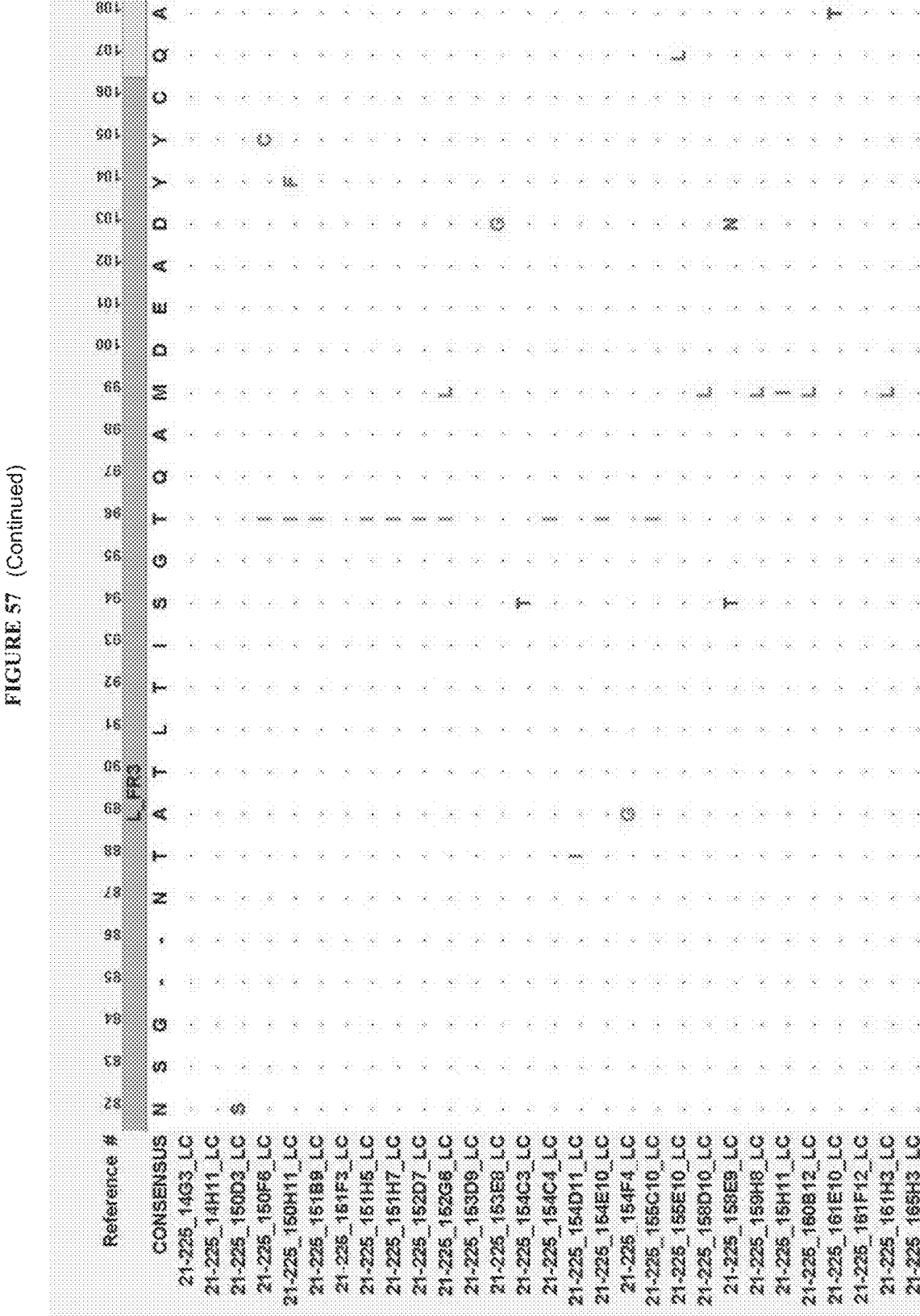
Figure 57:
Figure 57:
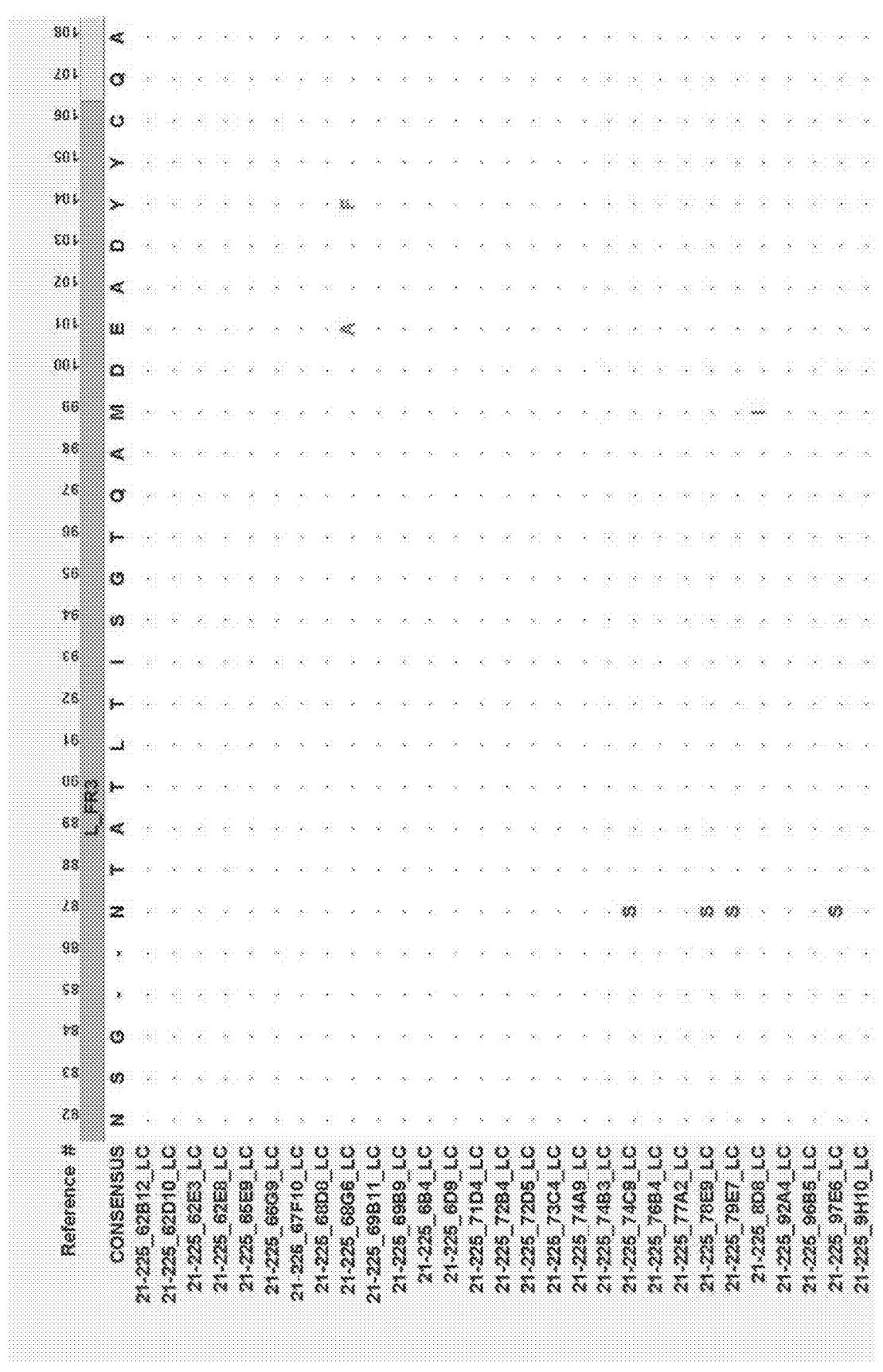
Figure 57:
Figure 57:
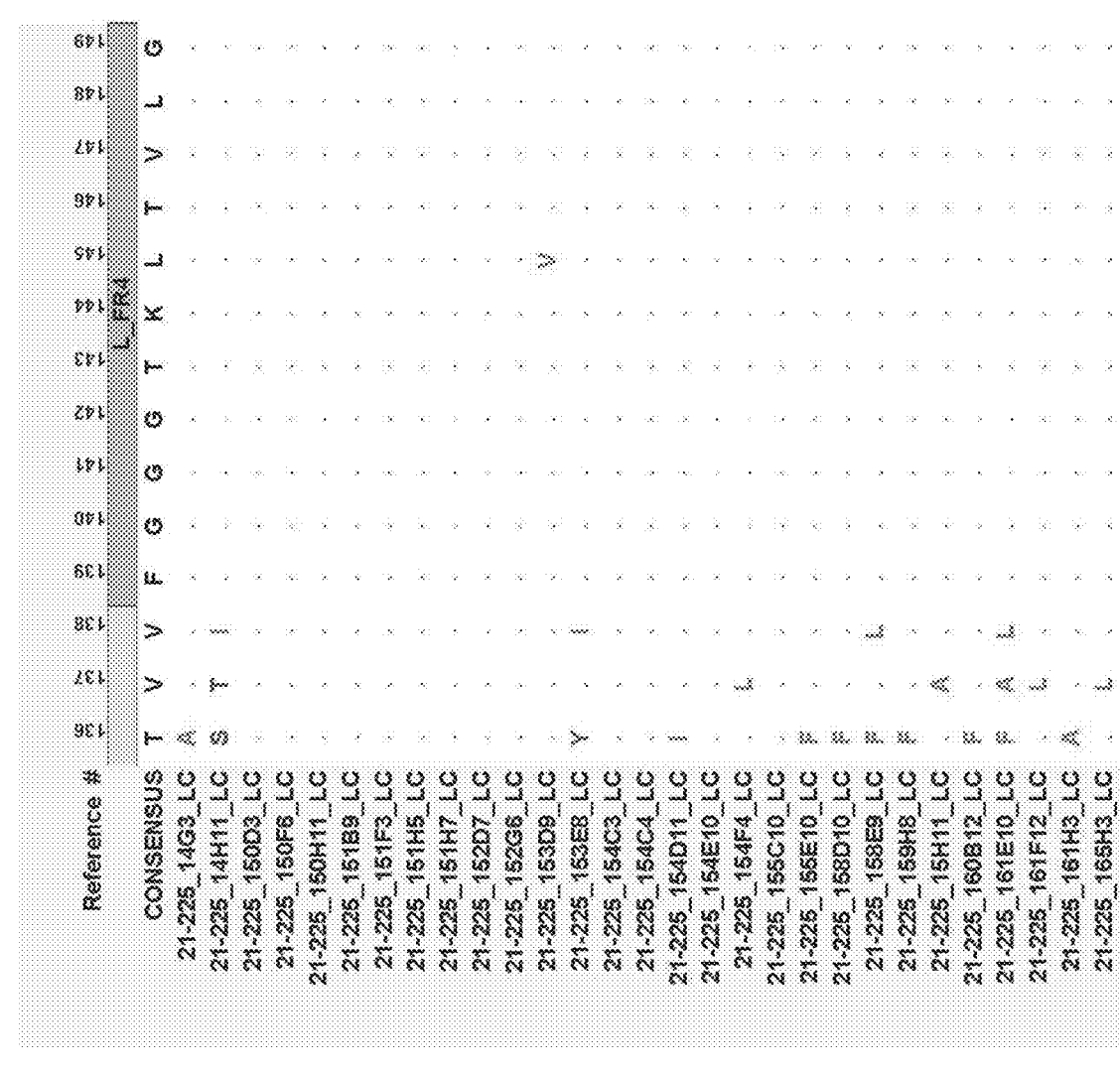
Figure 57:
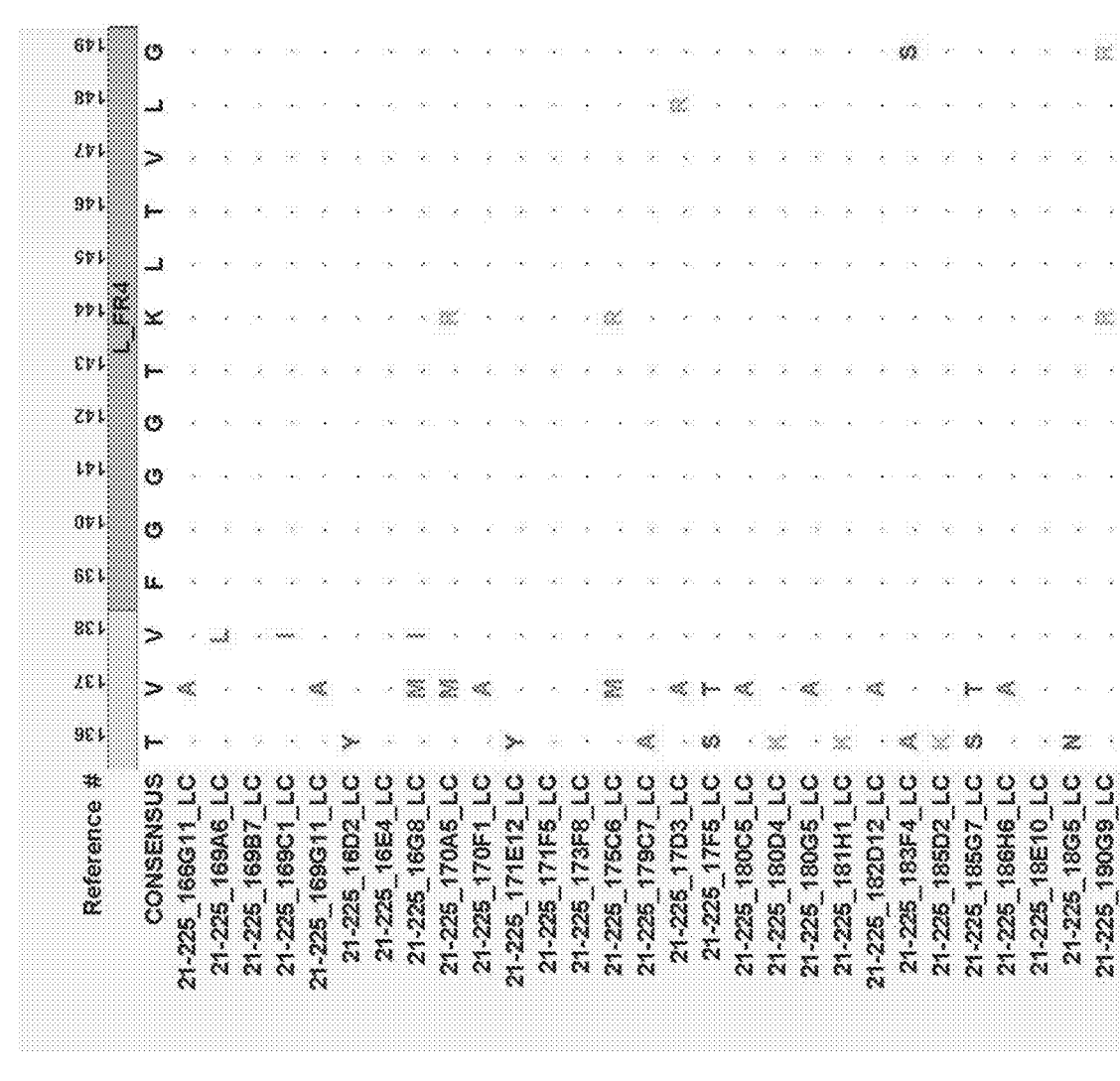
Figure 57:
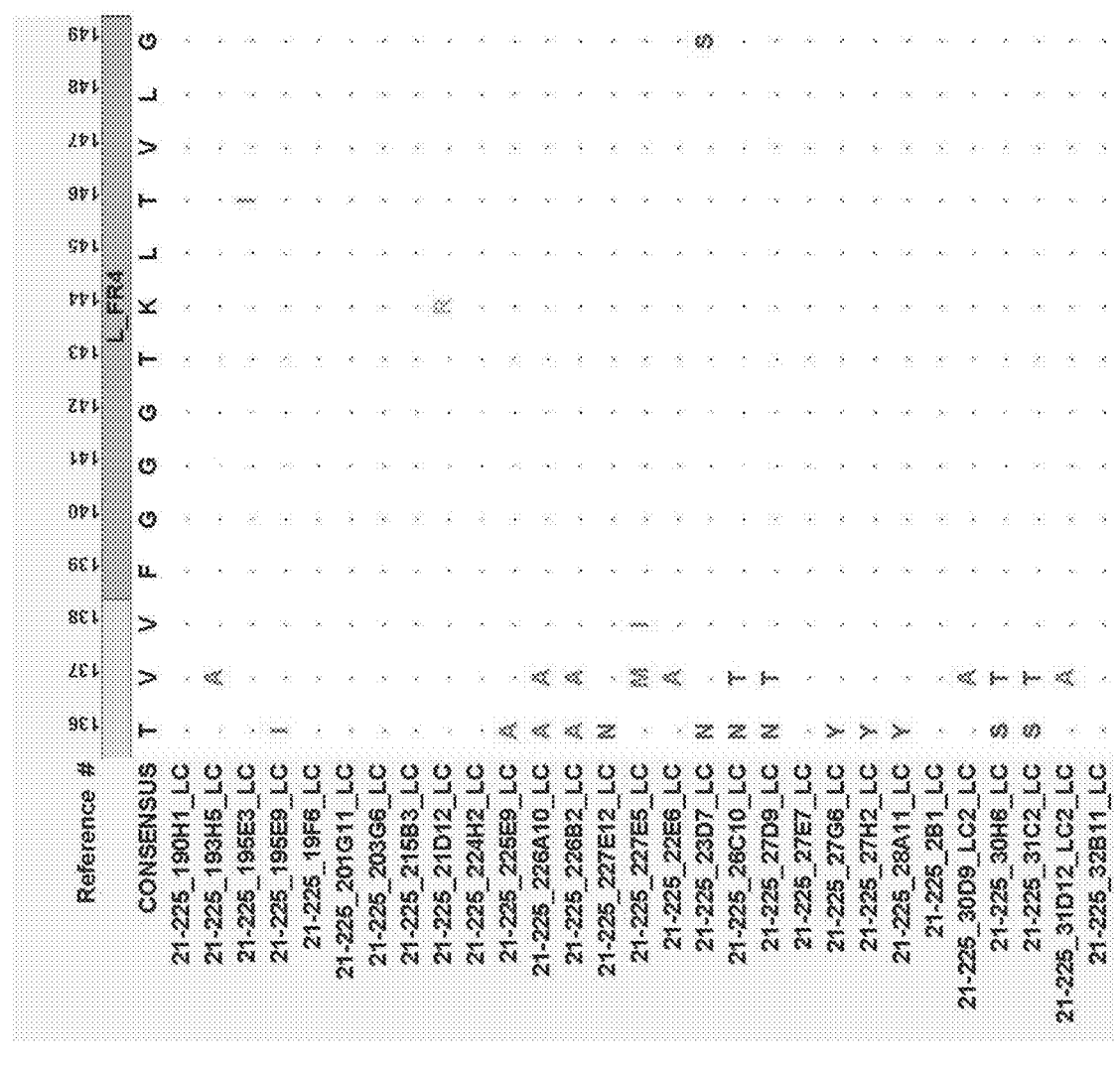
Figure 57:
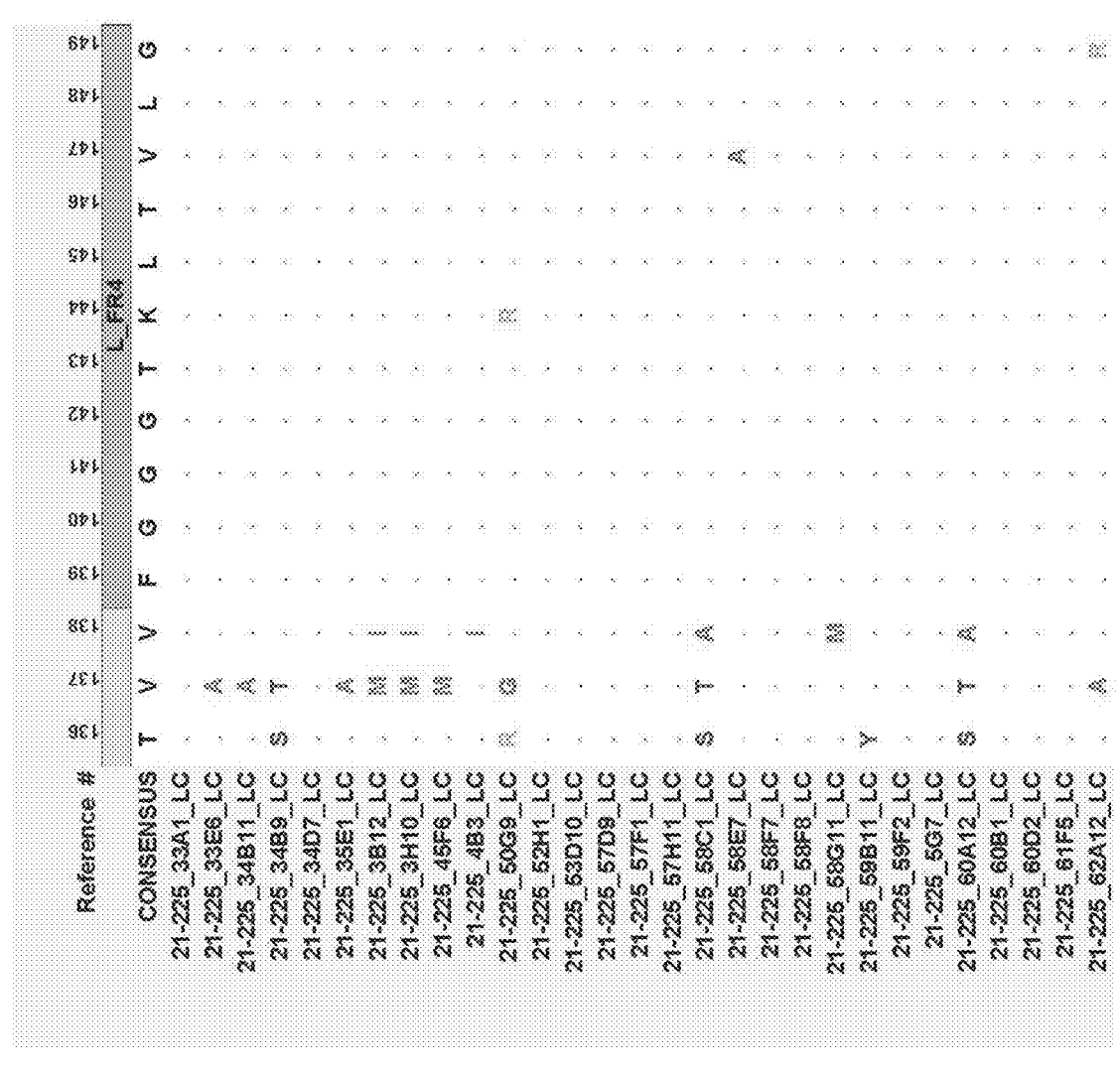
Figure 57:
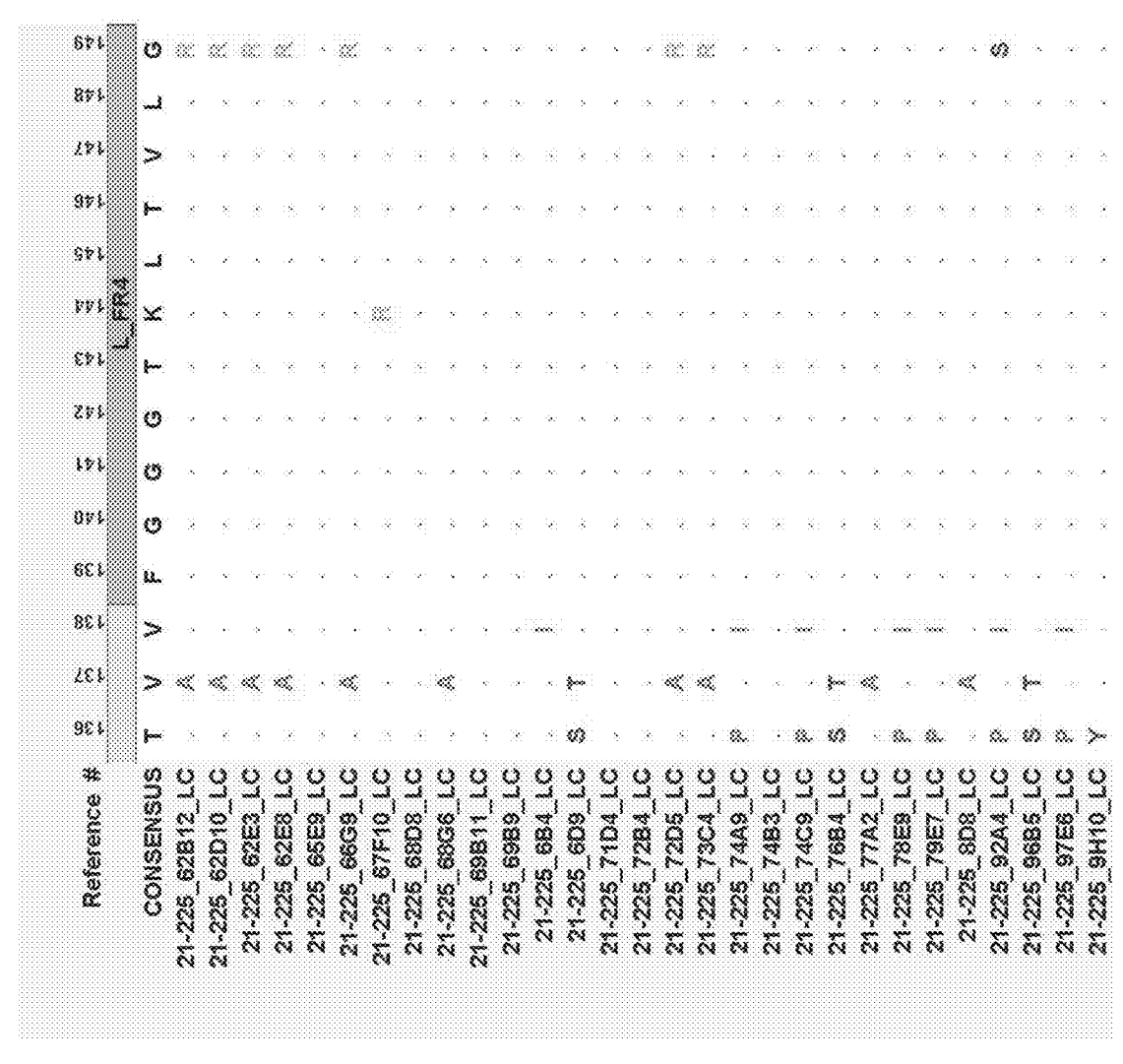
Figure 57:
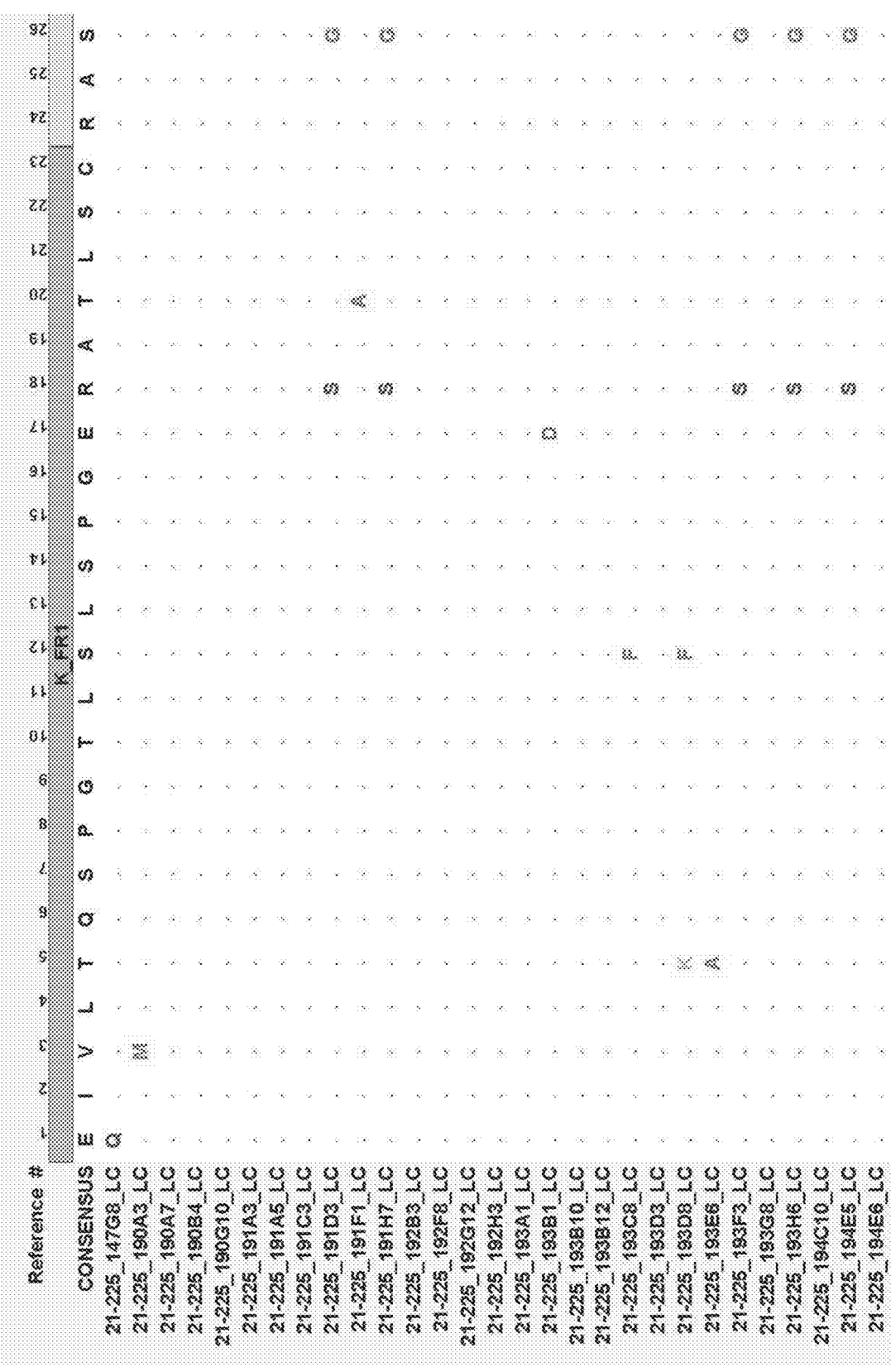
Figure 57:
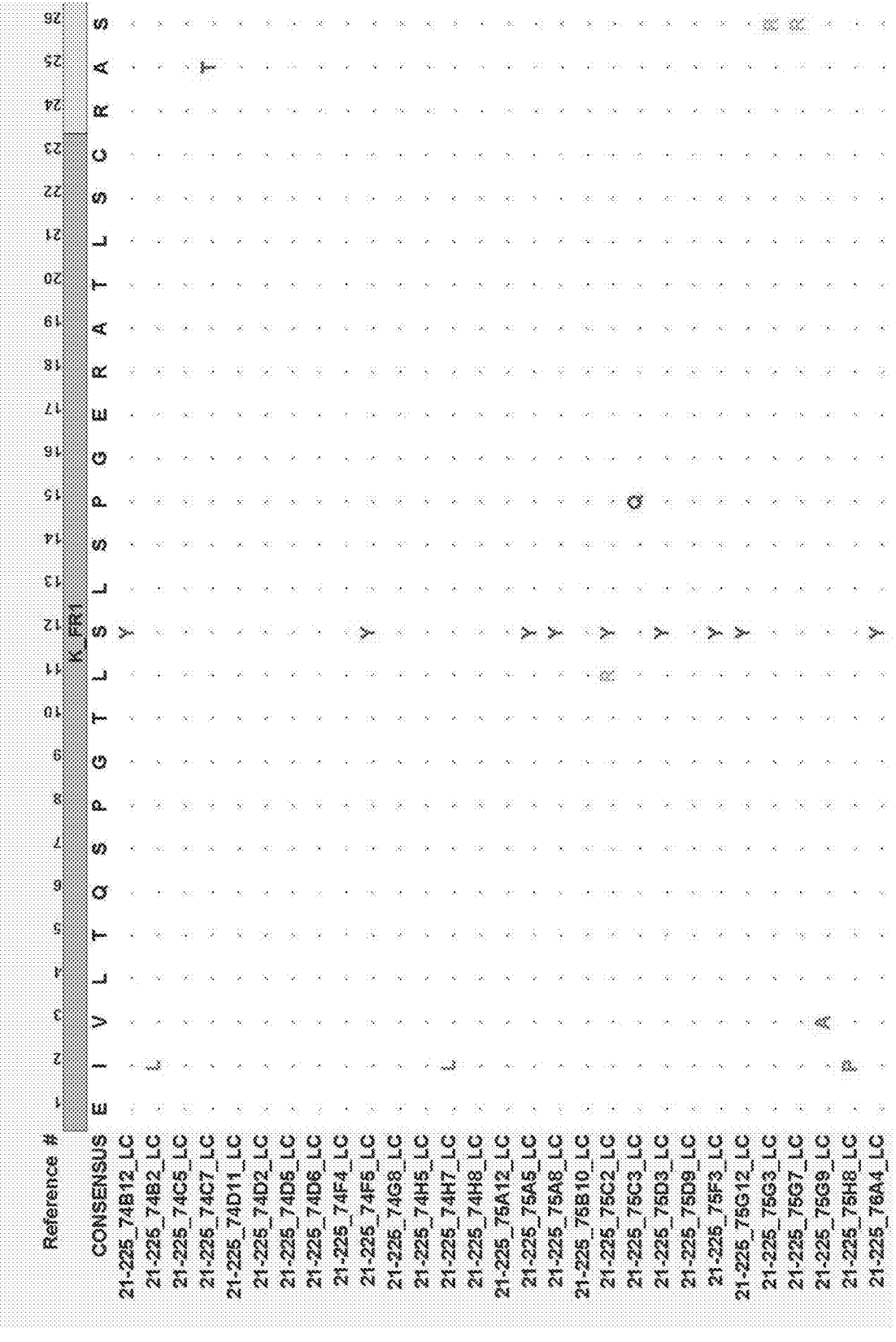
Figure 57:
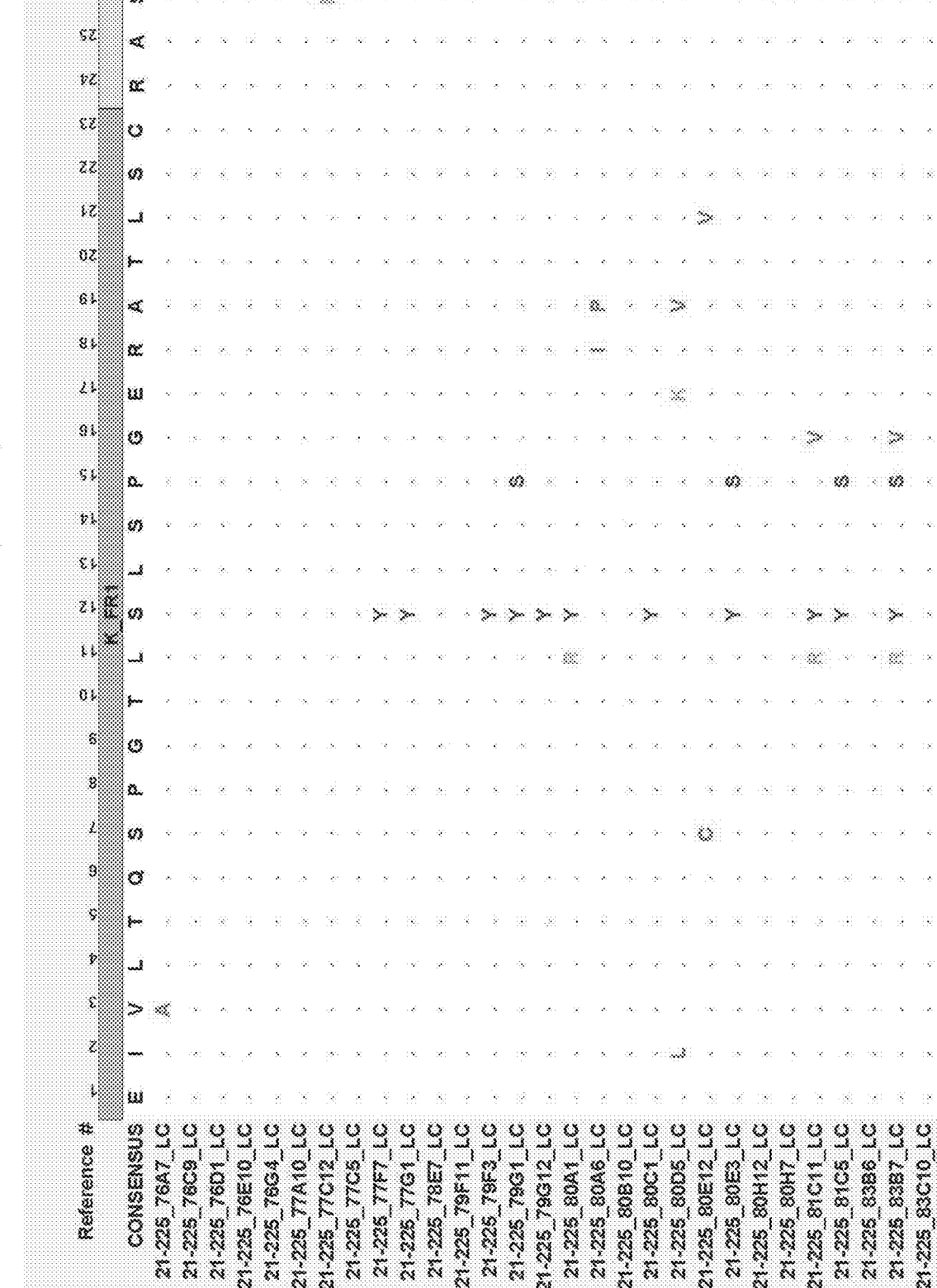
Figure 57:
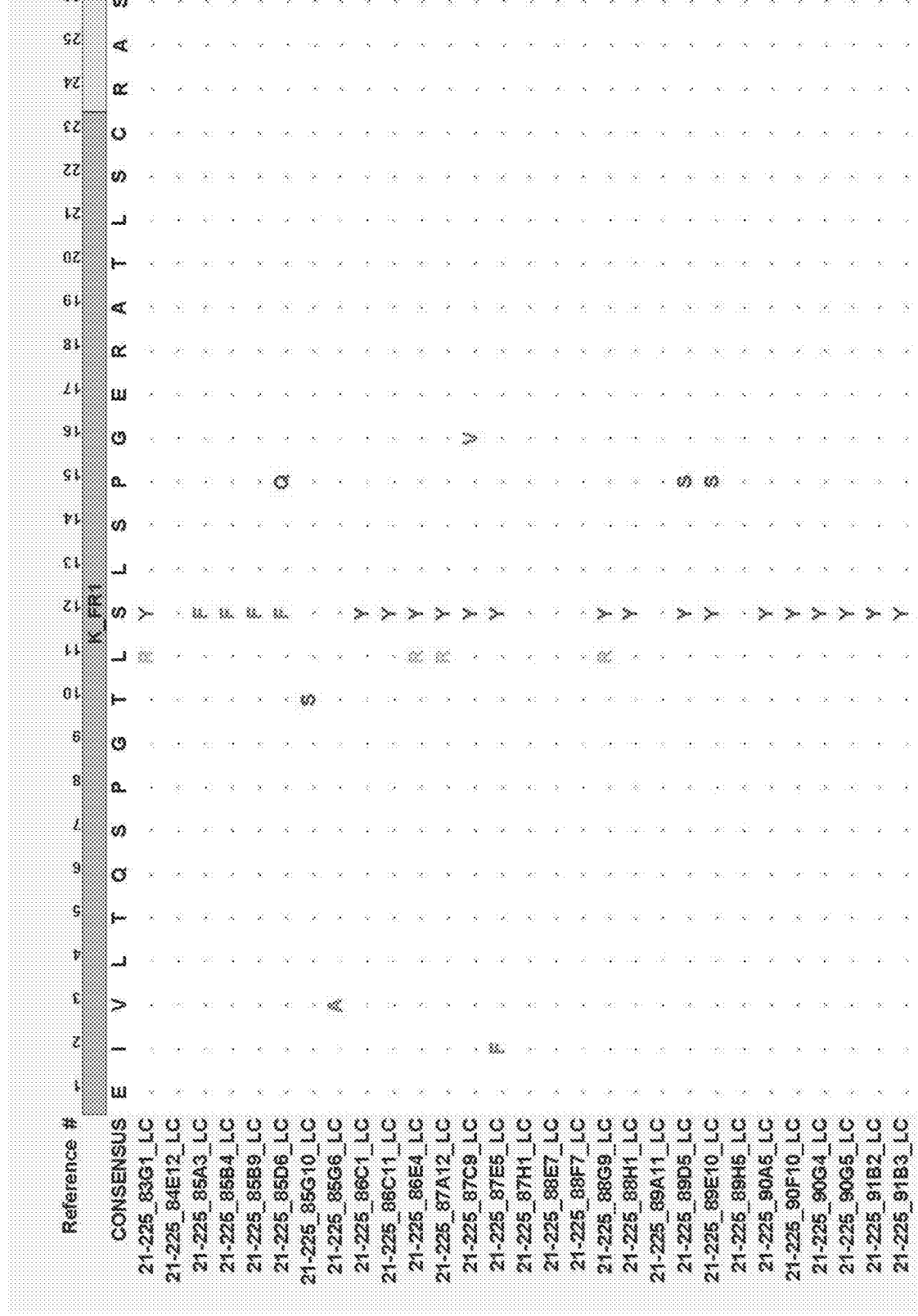
Figure 57:
Figure 57:
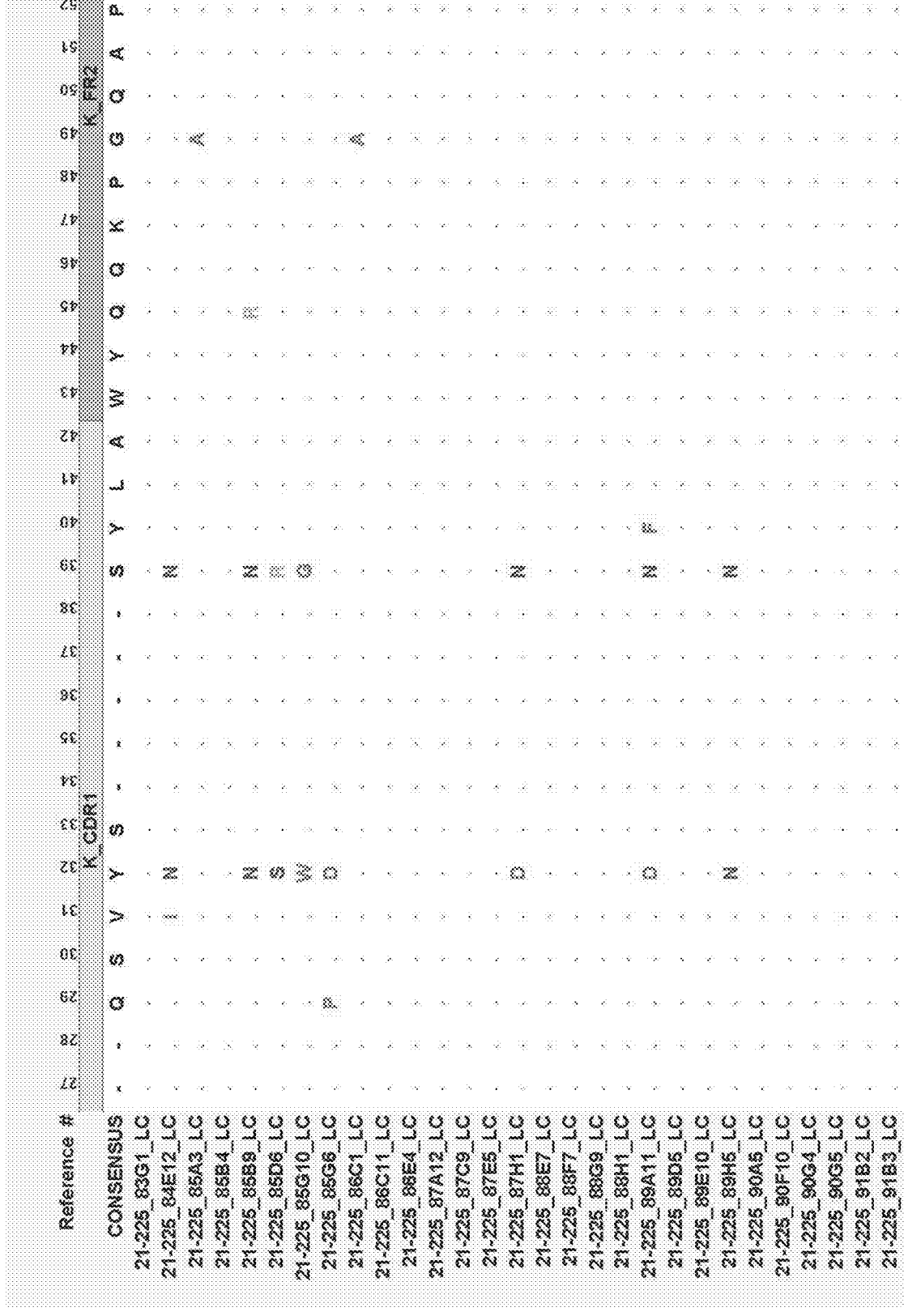
Figure 57:
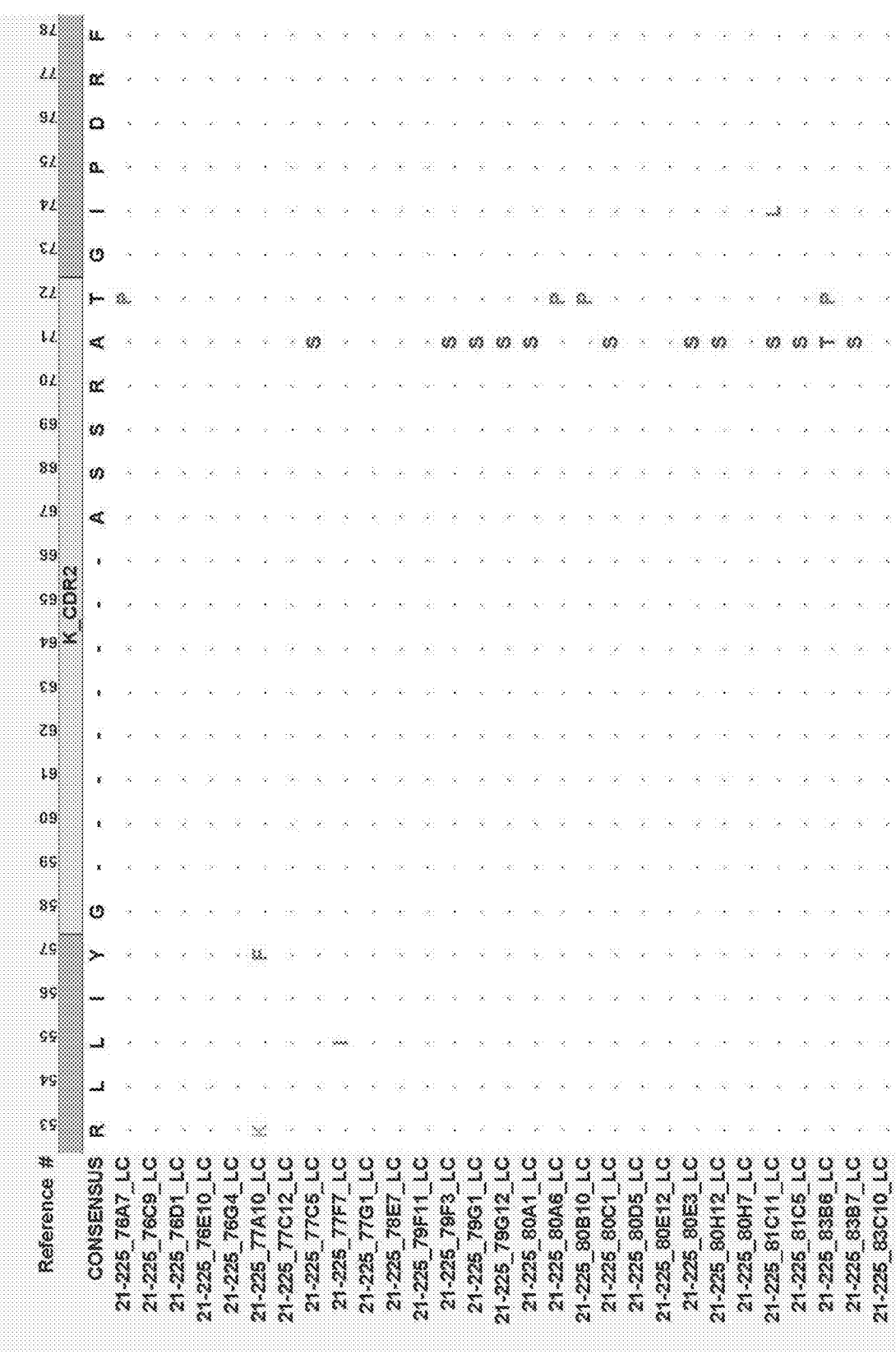
Figure 57:
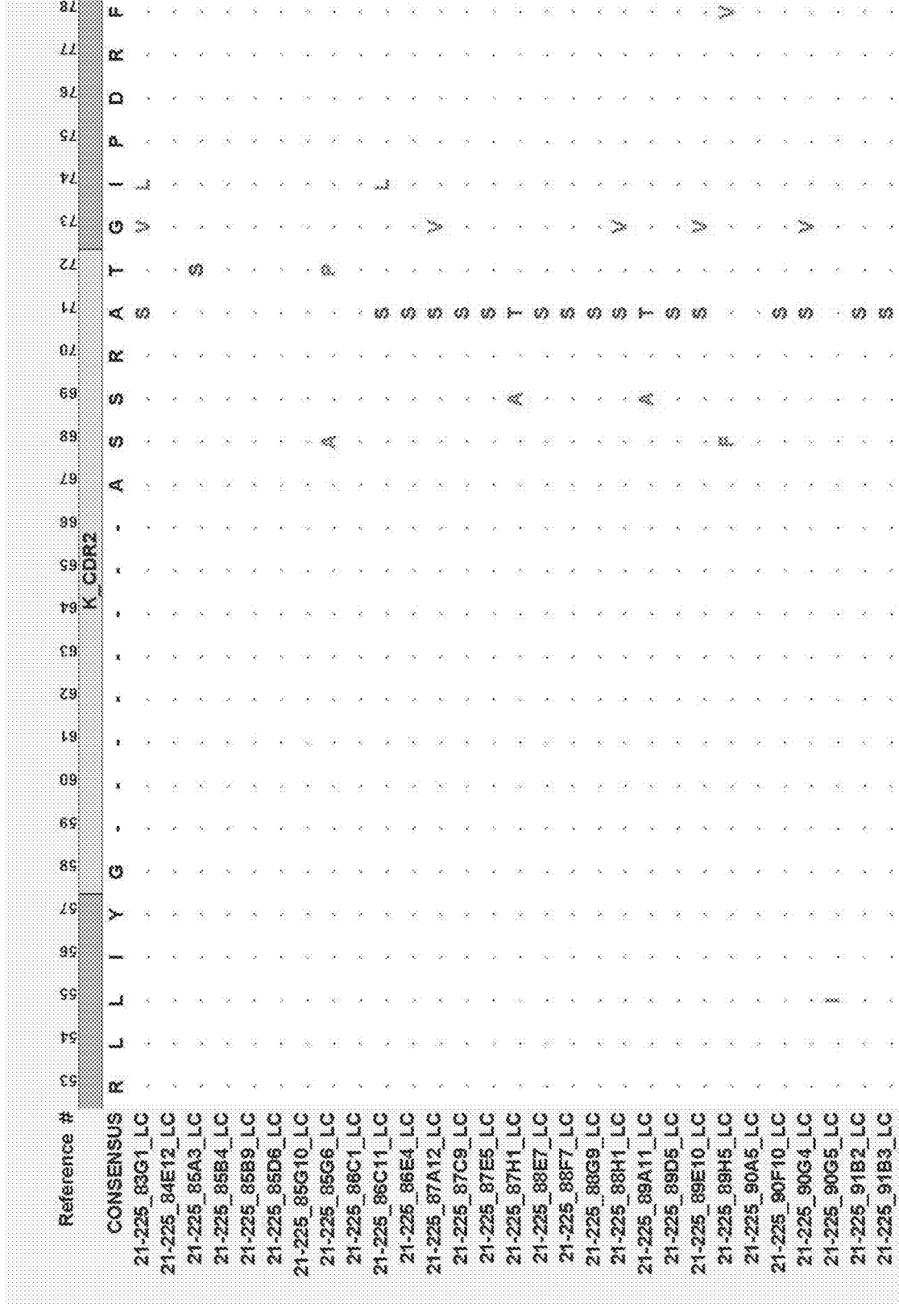
Figure 57:
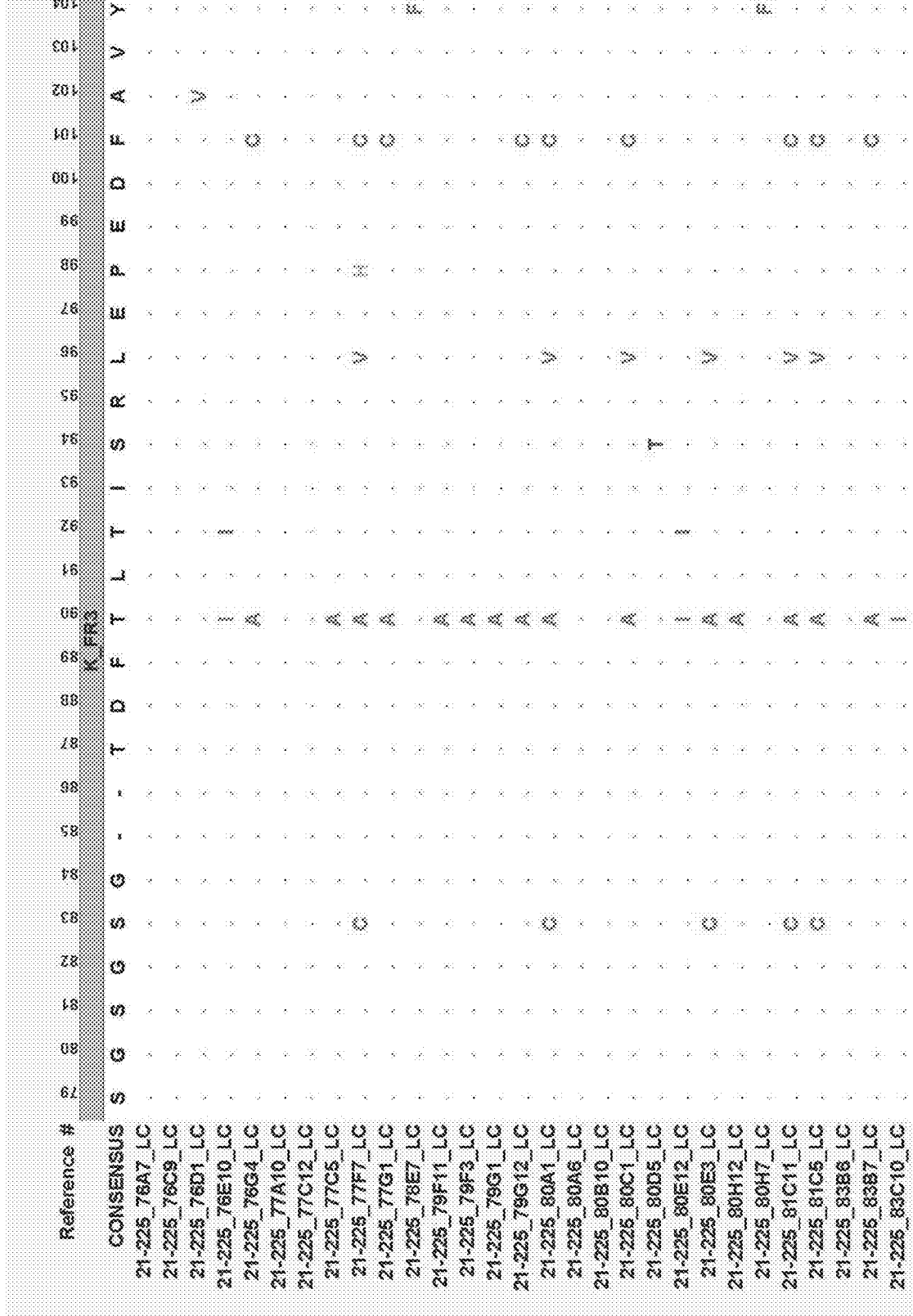
Figure 57:
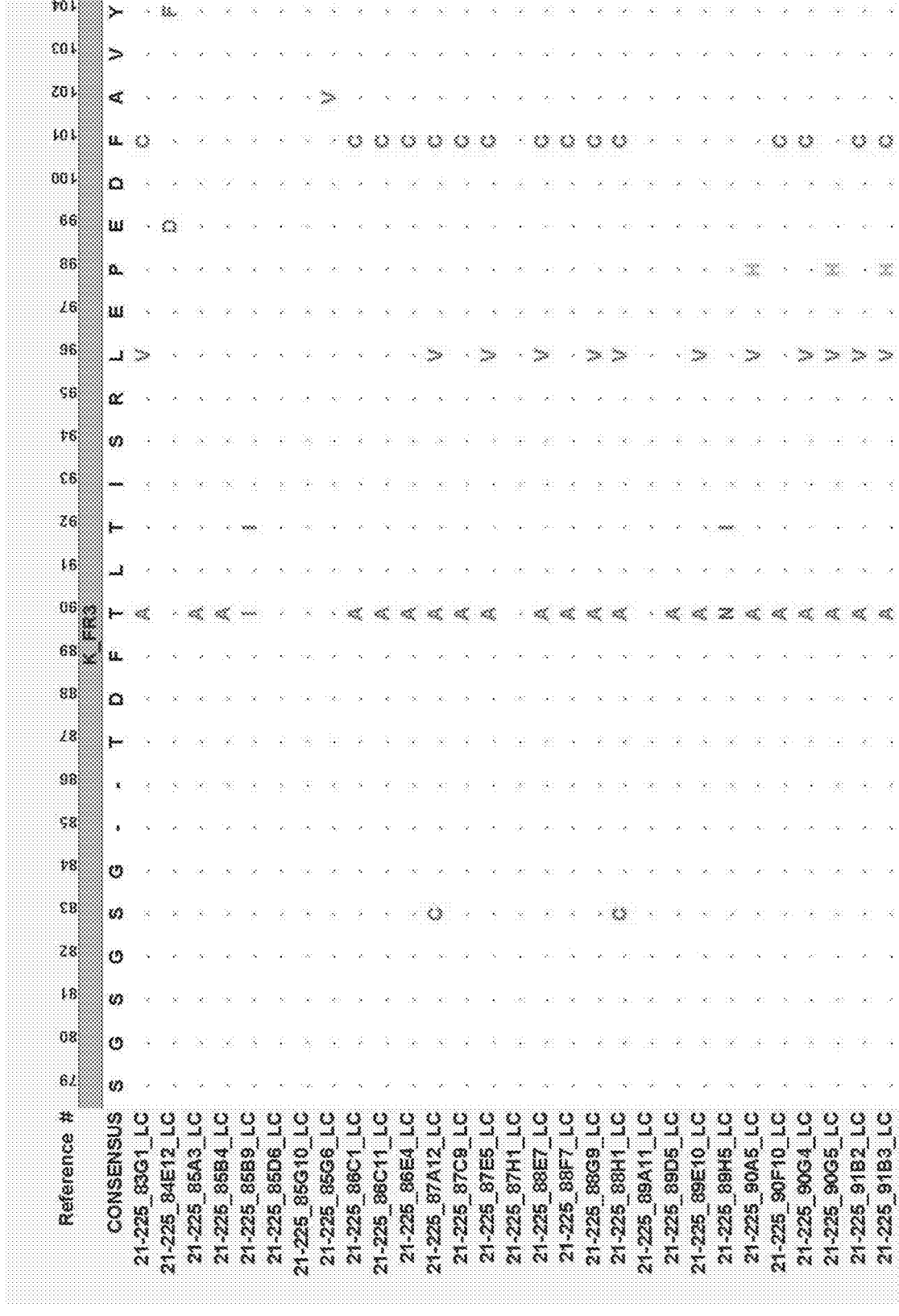
Figure 57:
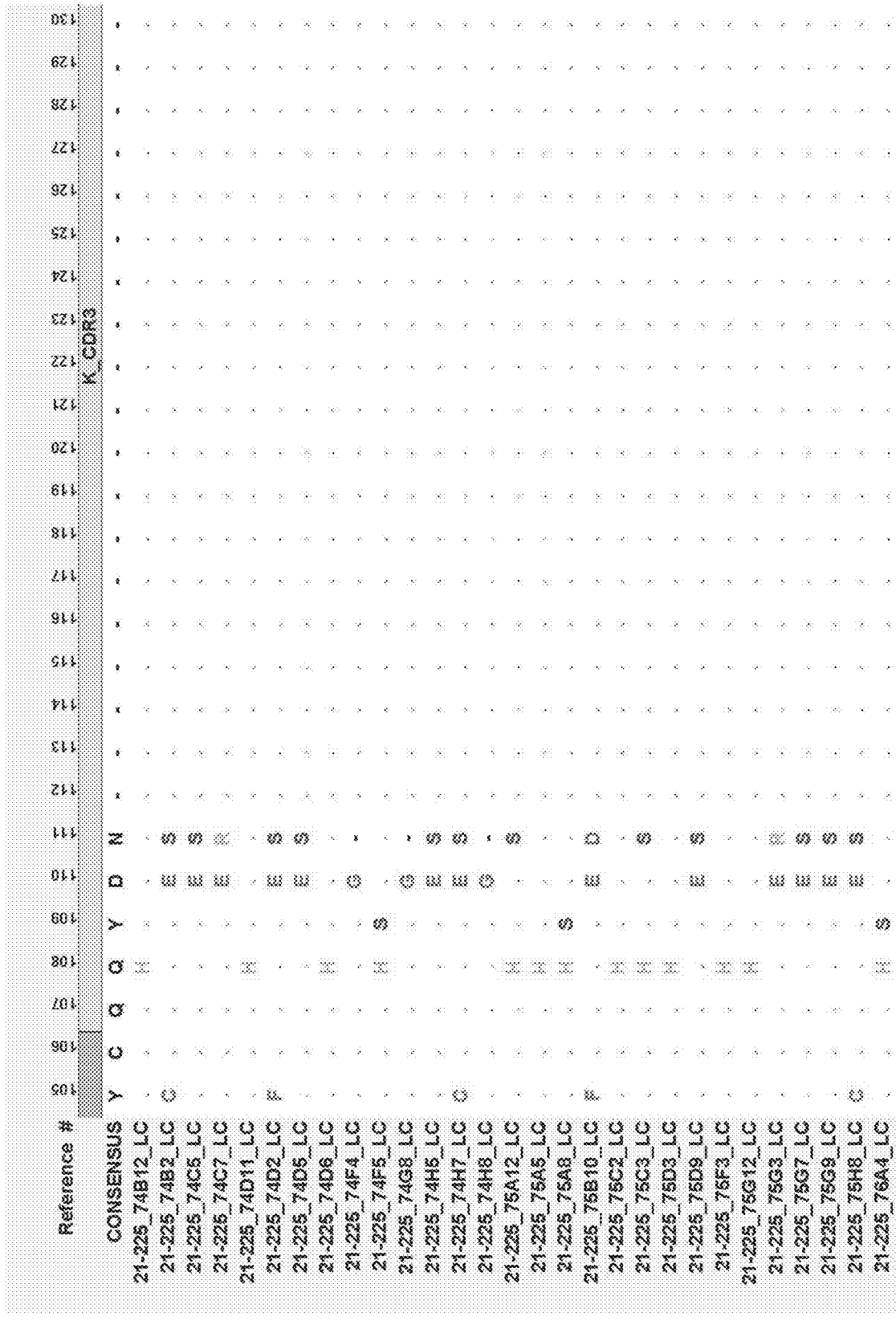
Figure 57:
Figure 57:
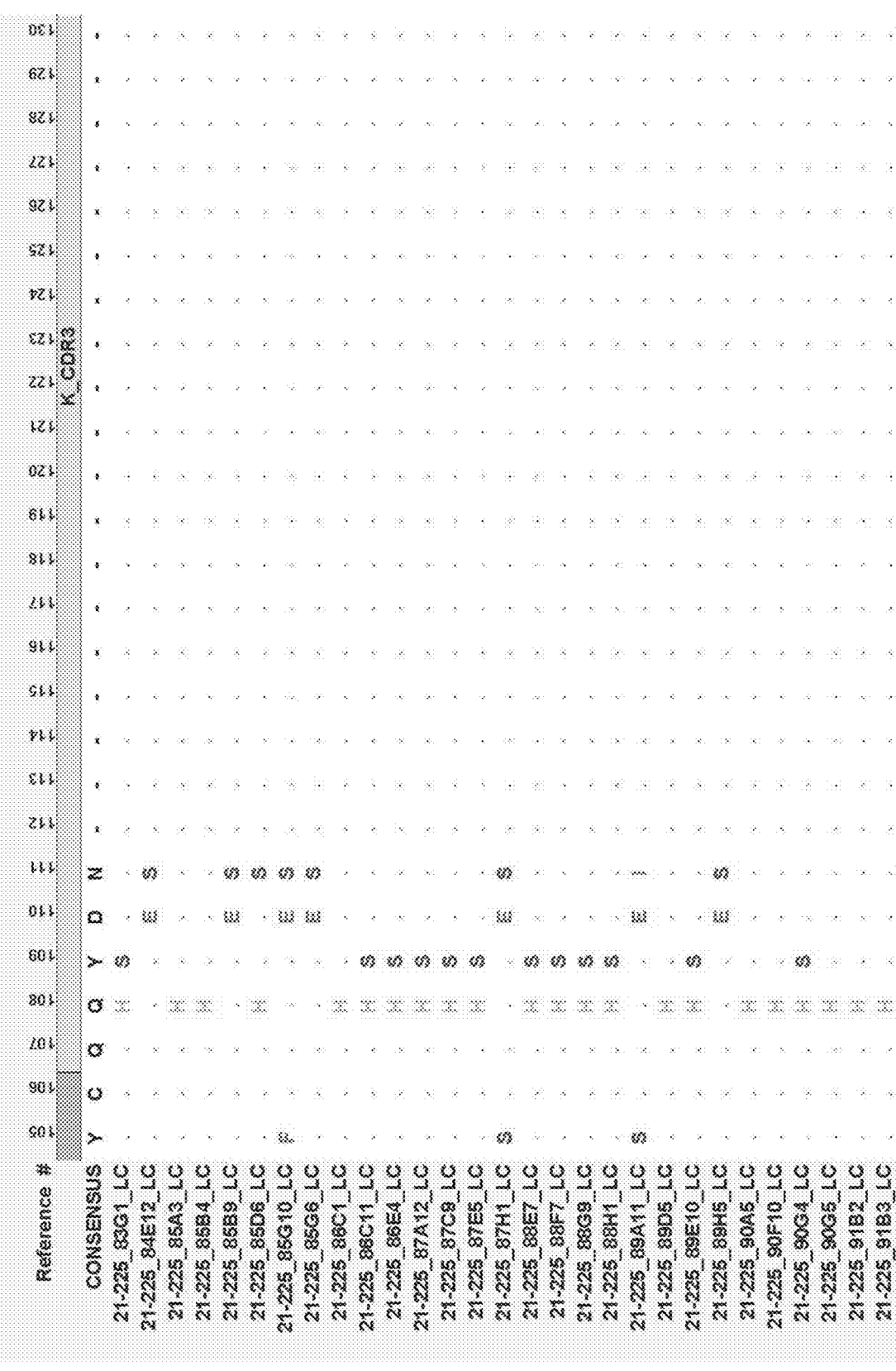
Figure 57:
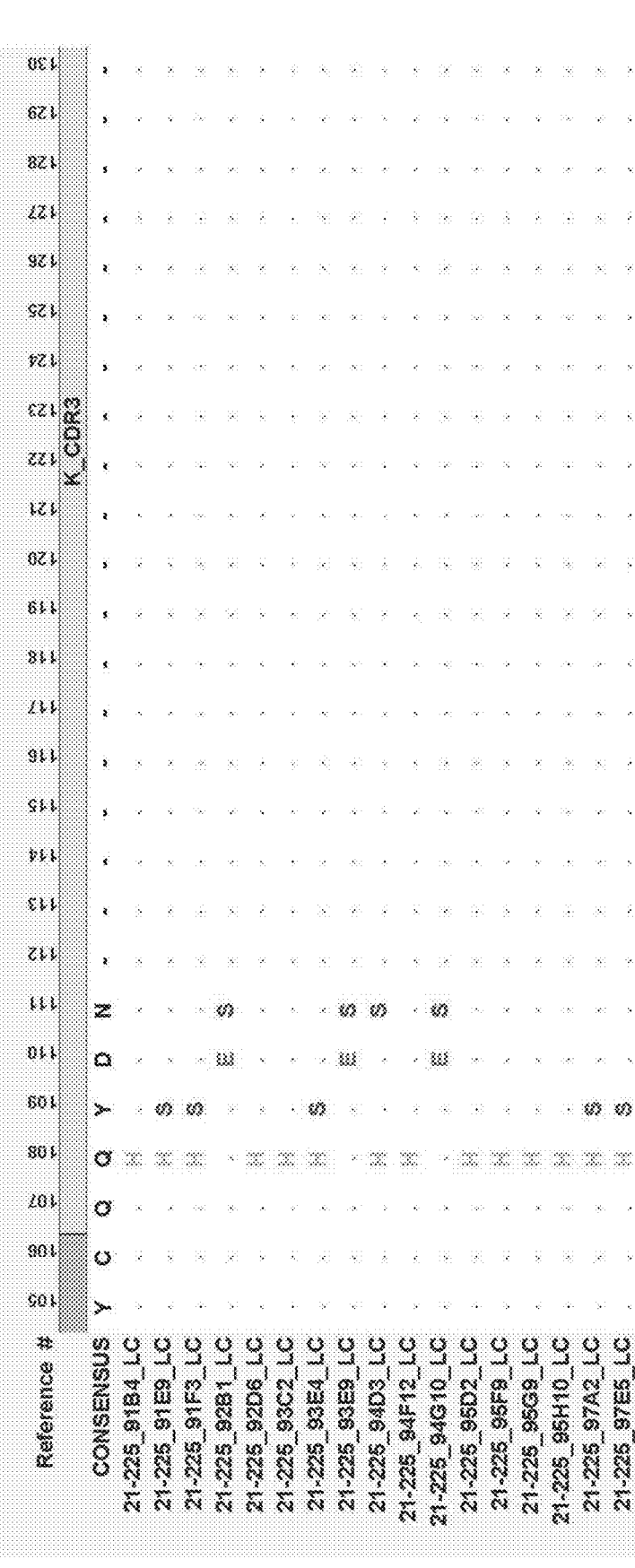
Figure 57:
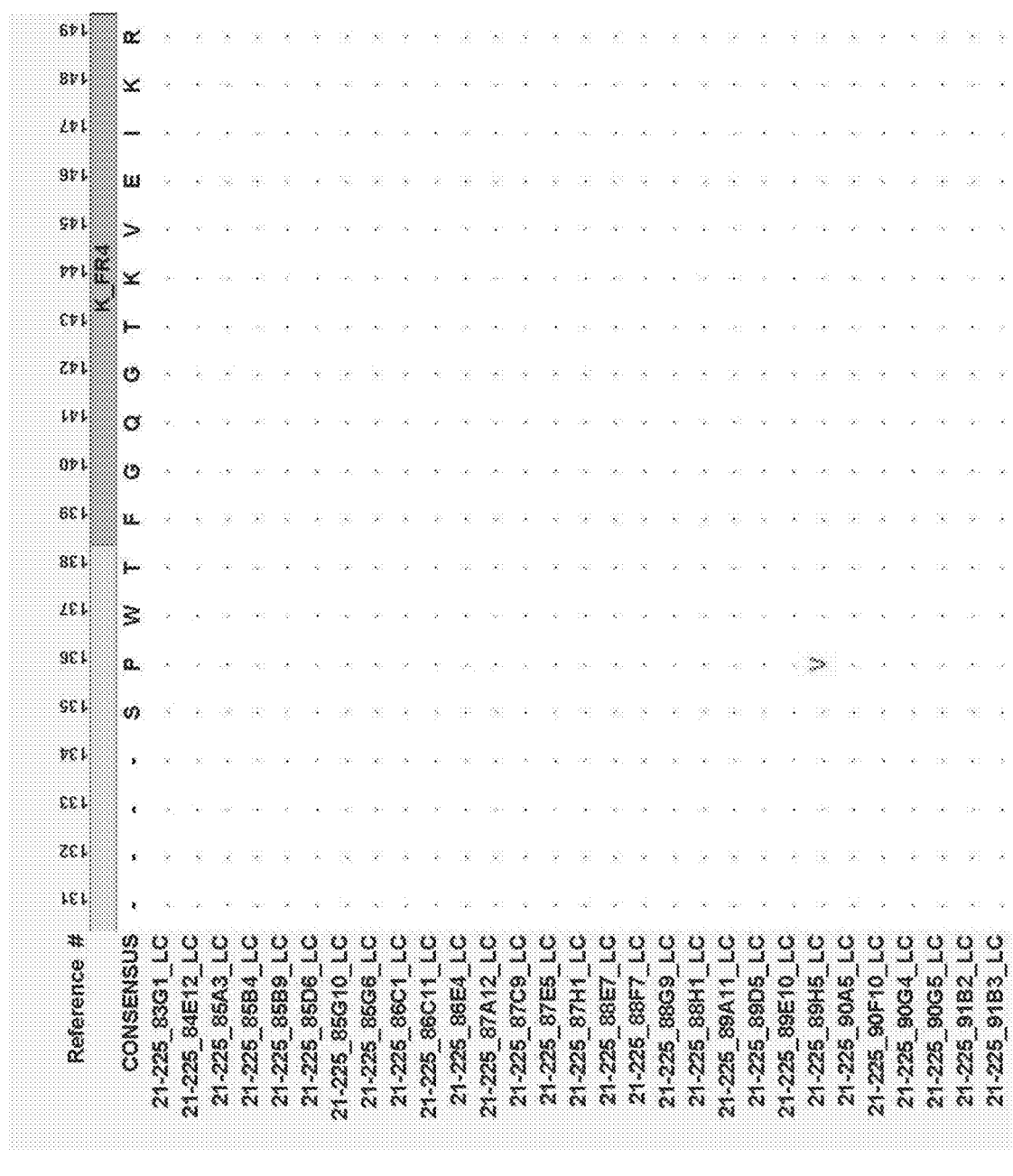
Figure 57:
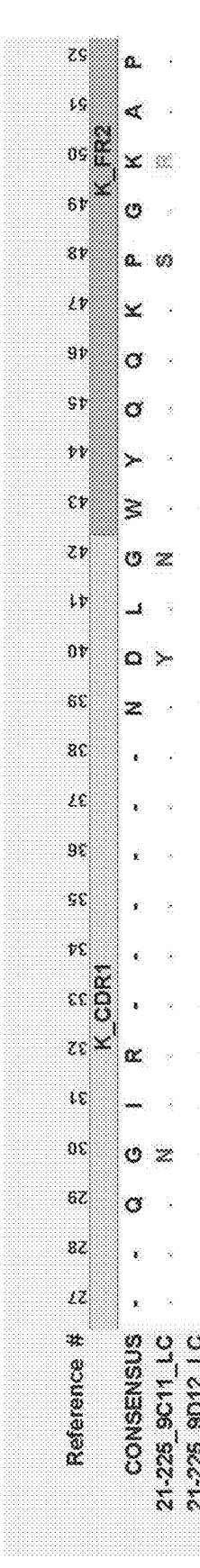
Figure 57:
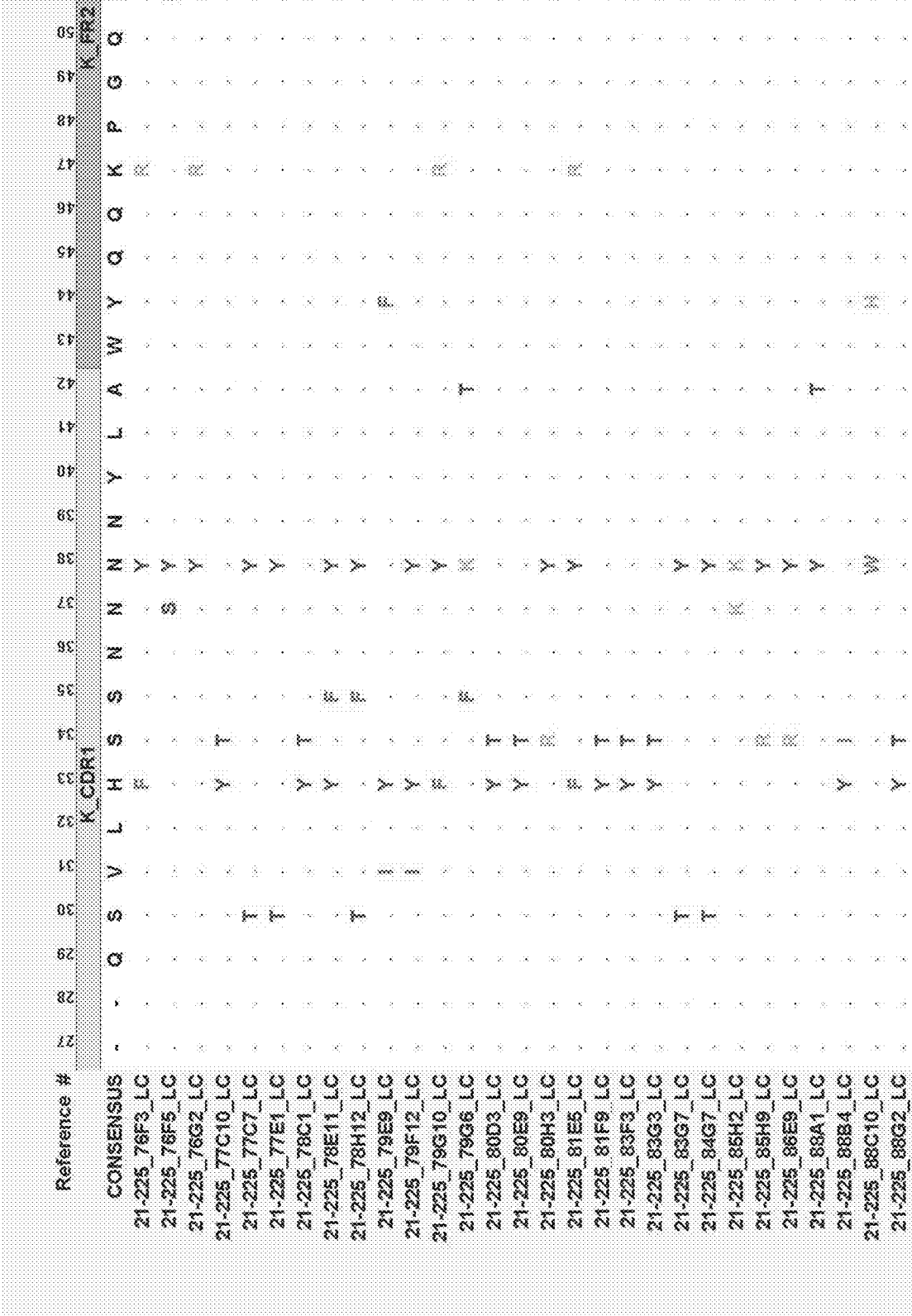
Figure 57:
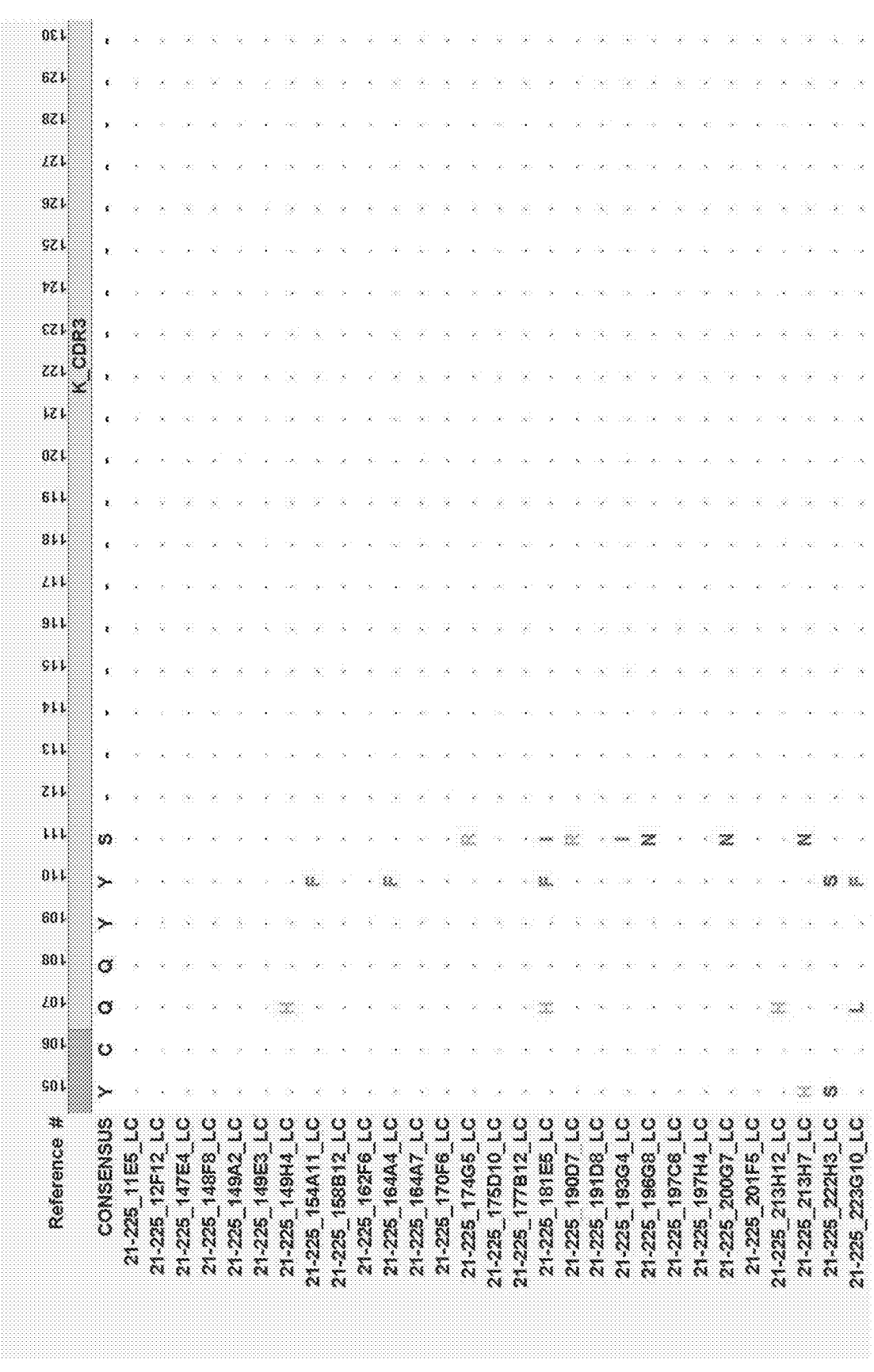
Figure 57:
Figure 57:
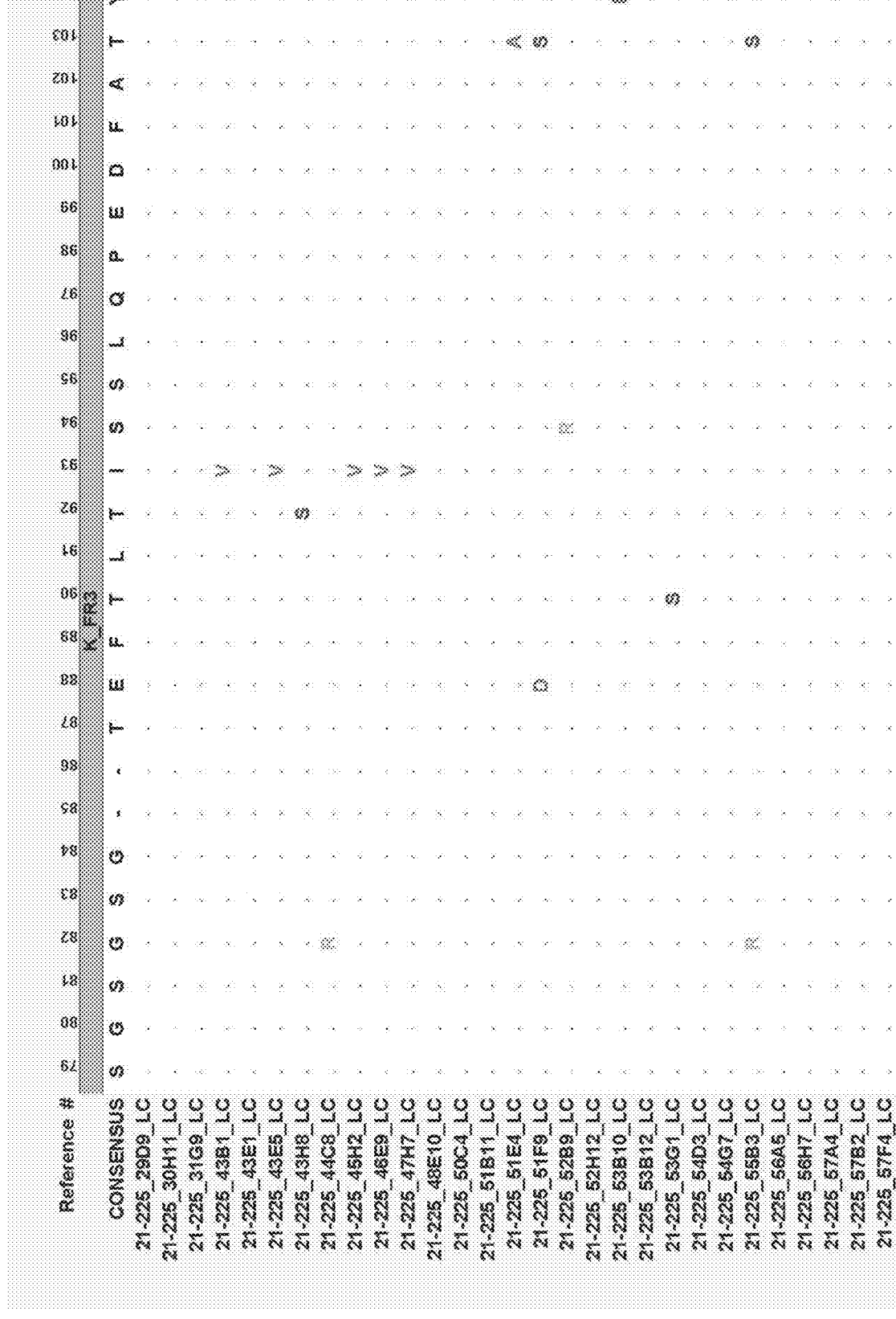
Figure 57:
Figure 57:
Figure 57:
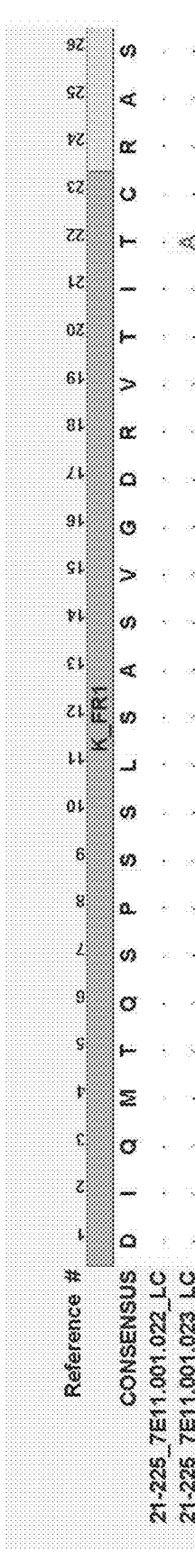
Figure 57:
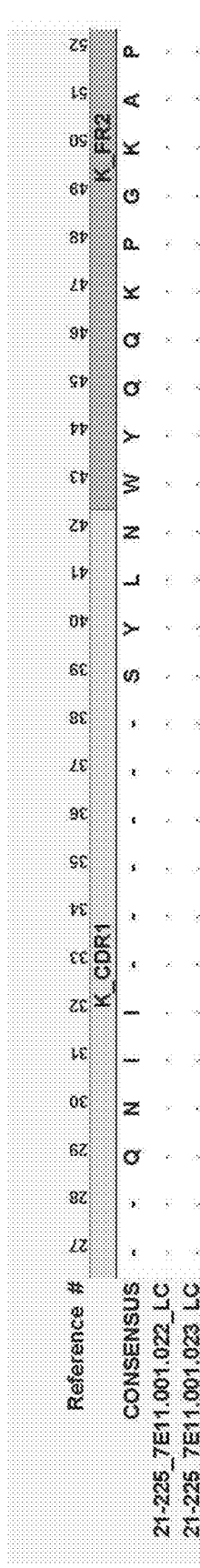
Figure 57:
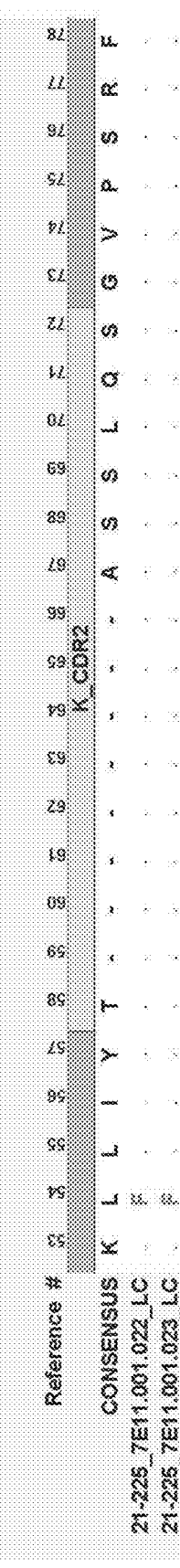
Figure 57:
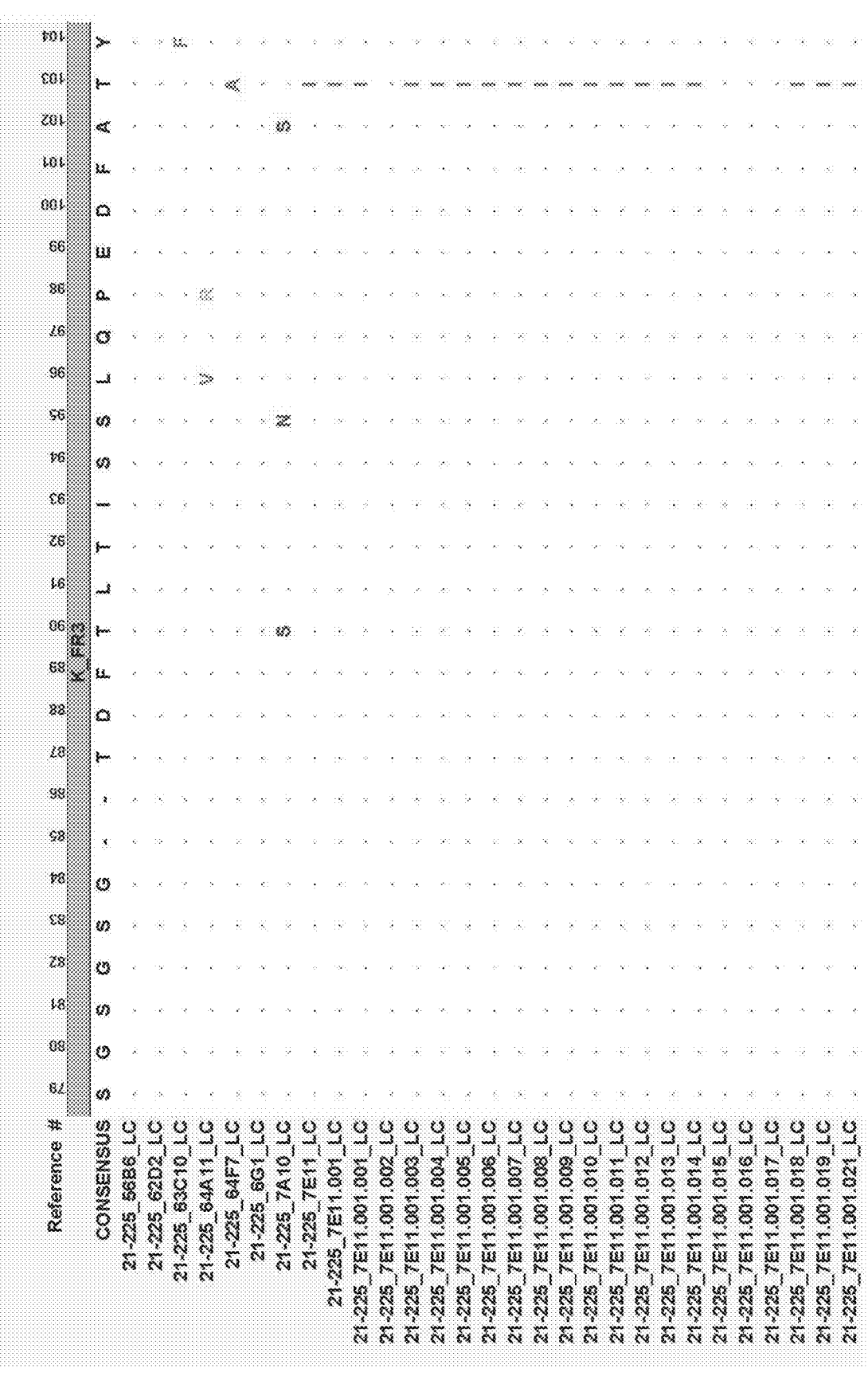
Figure 57:
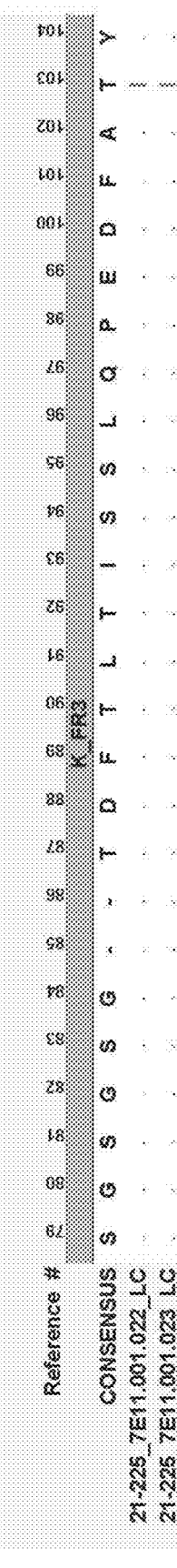
Figure 57:
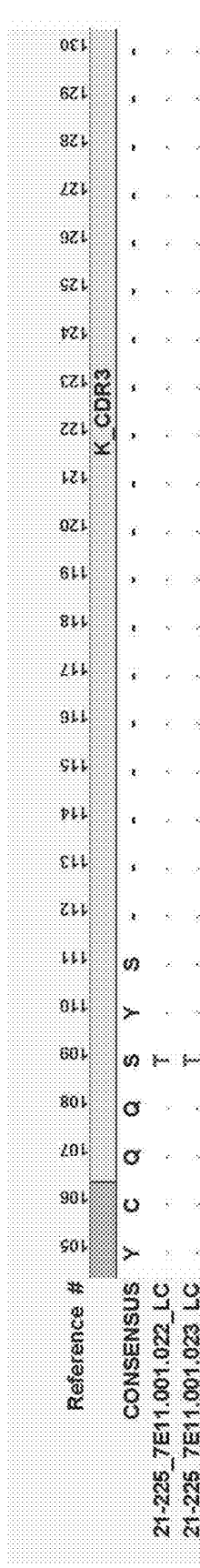
Figure 57:
Figure 57:
Figure 57:
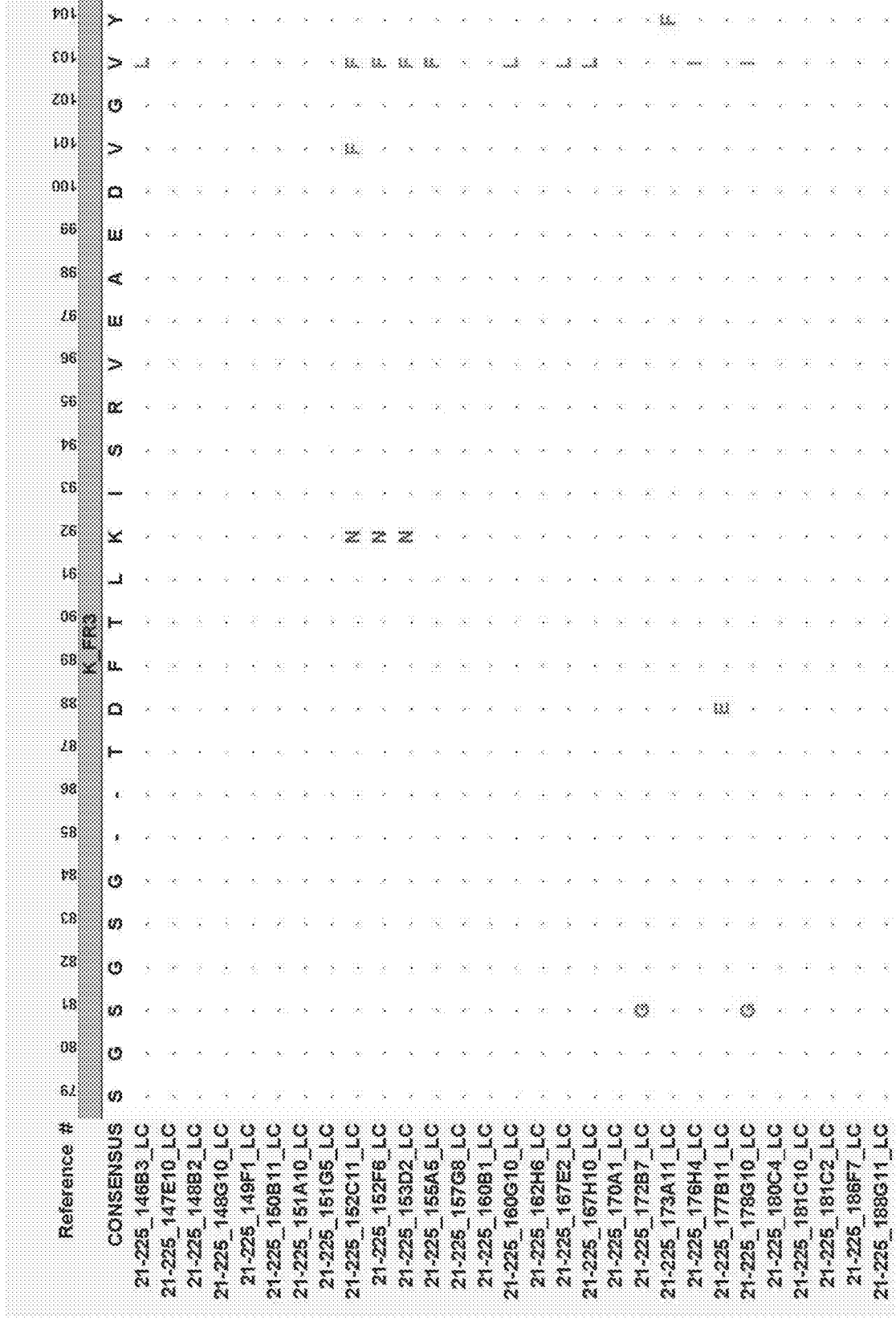
Figure 57:
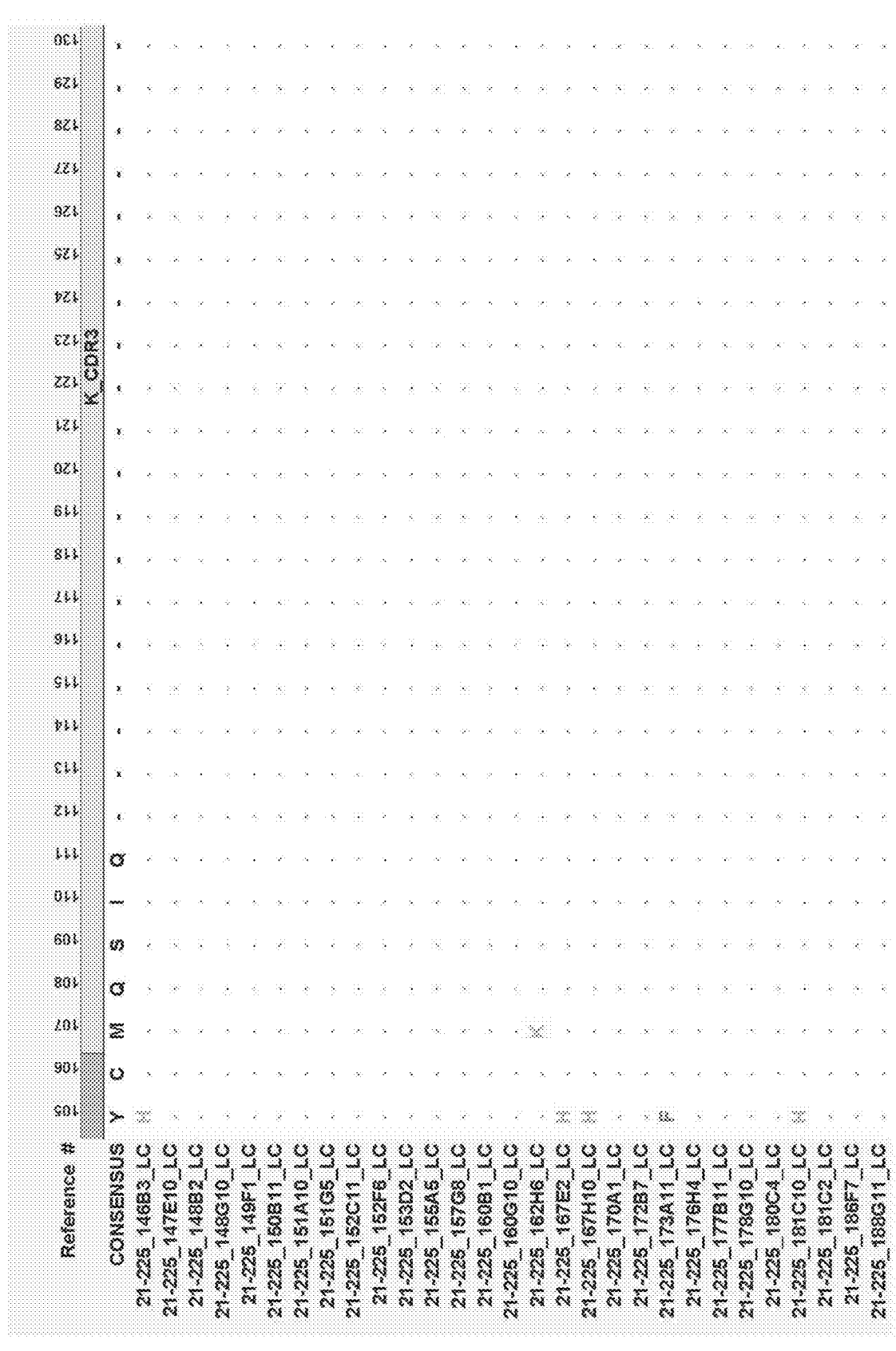
Figure 57:
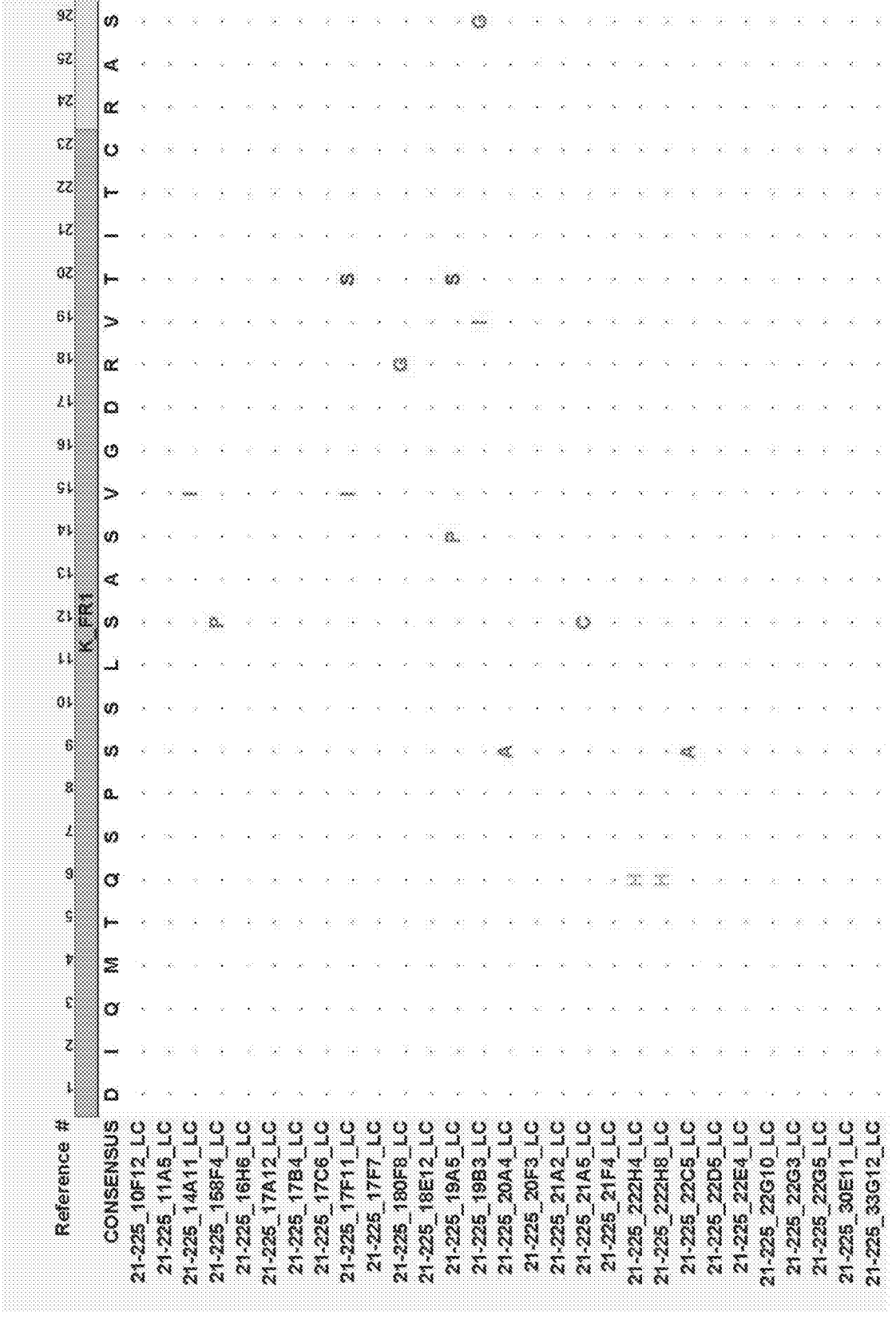
Figure 57:
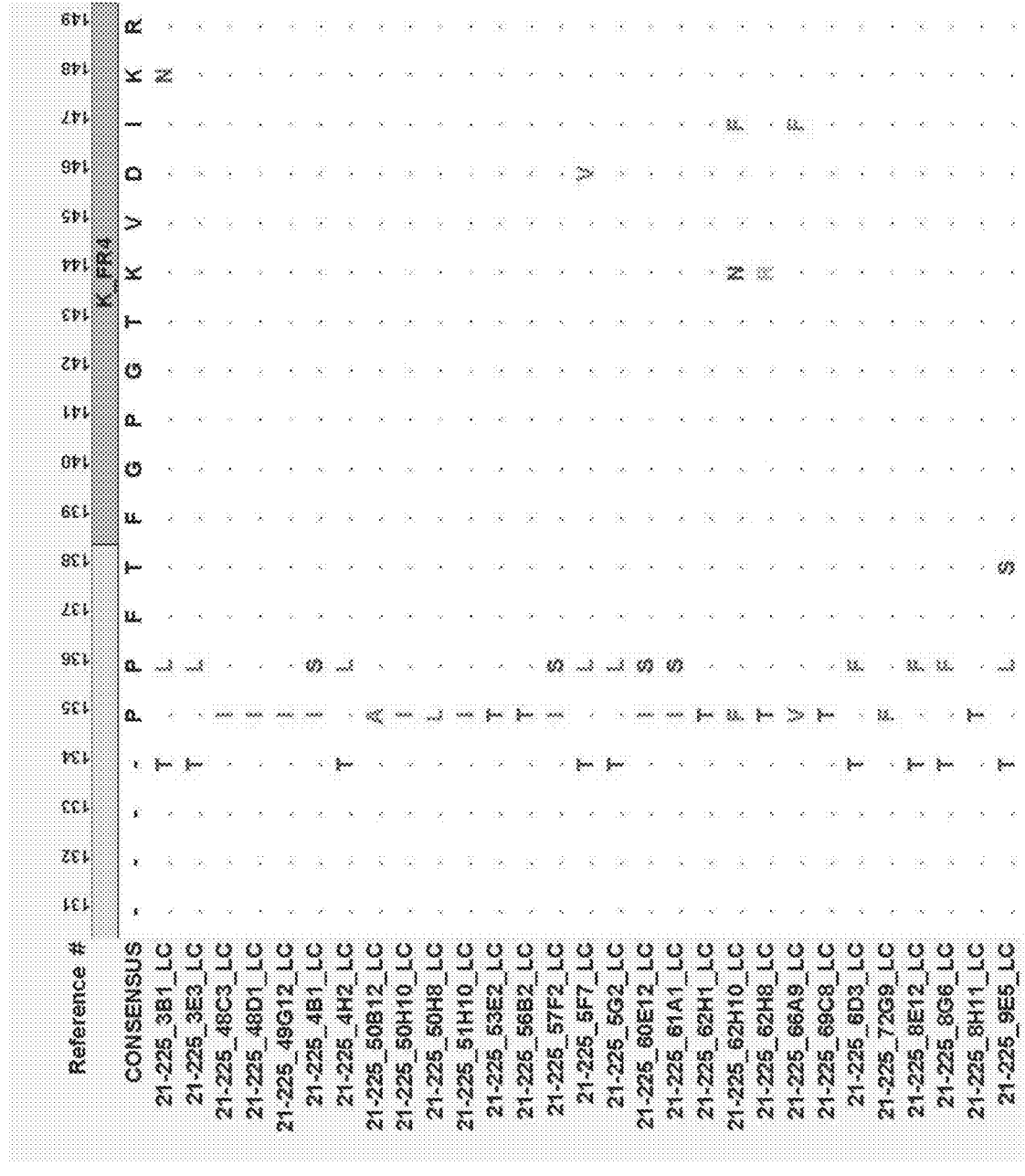
Figure 57:
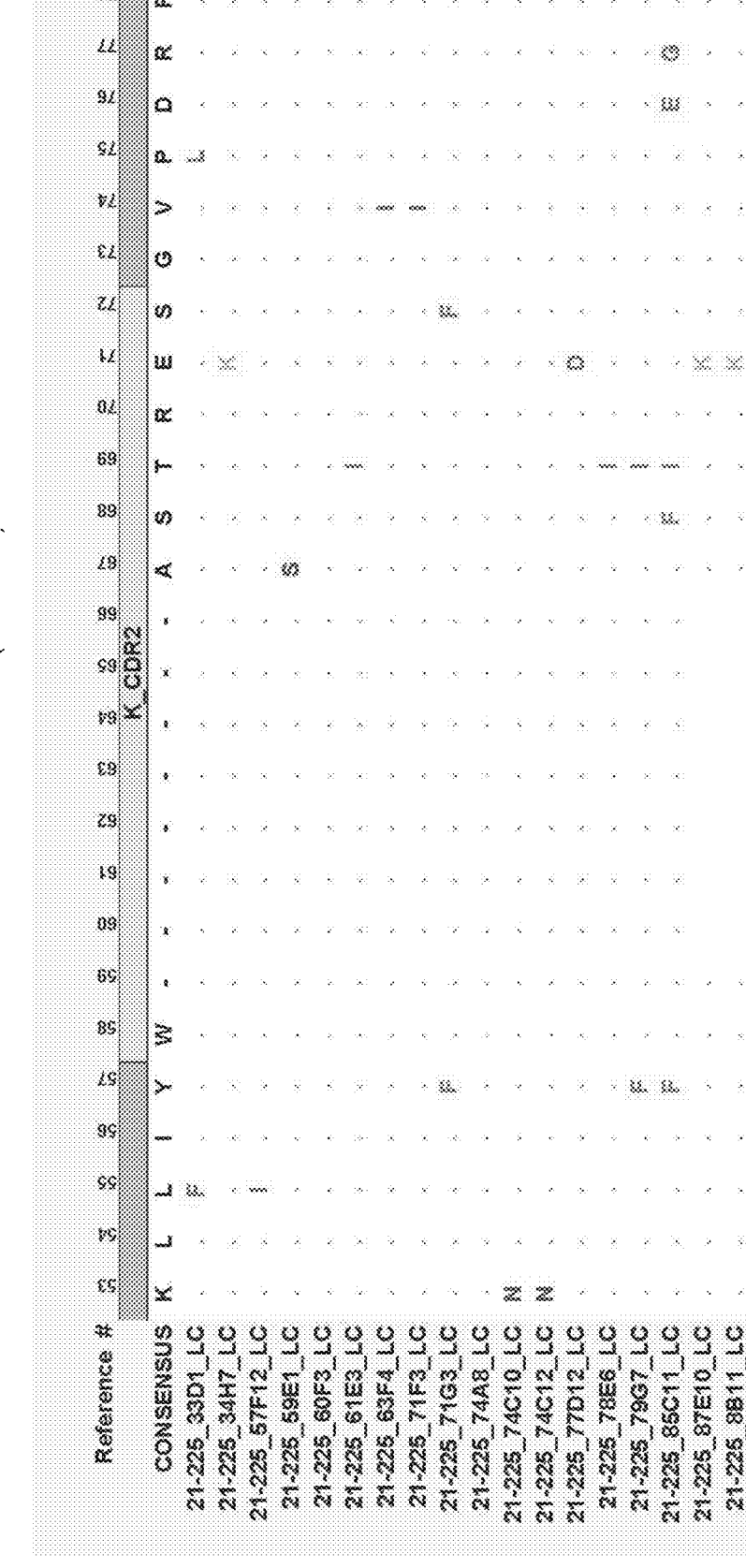
Figure 57:
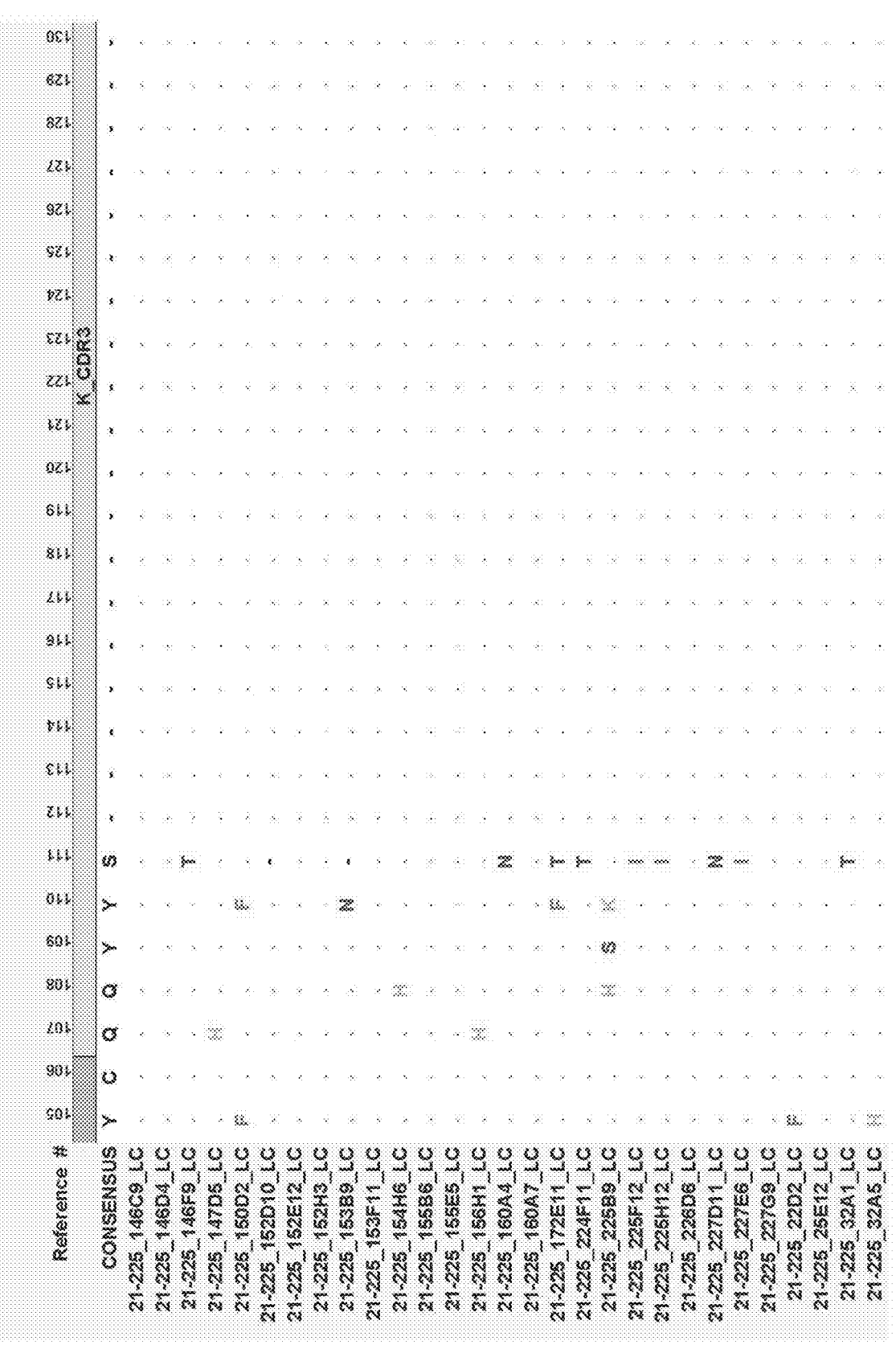
Figure 57:
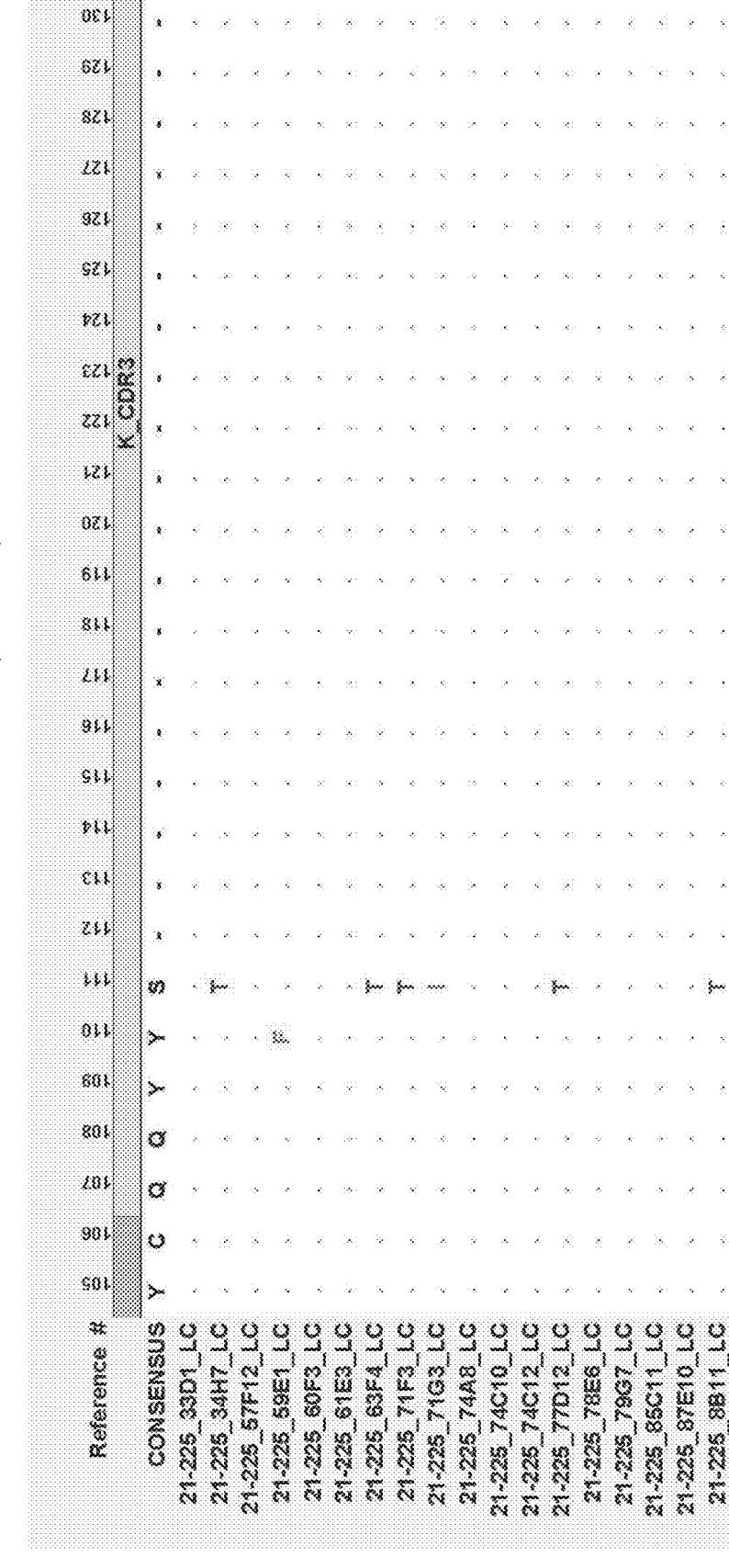
Figure 57:
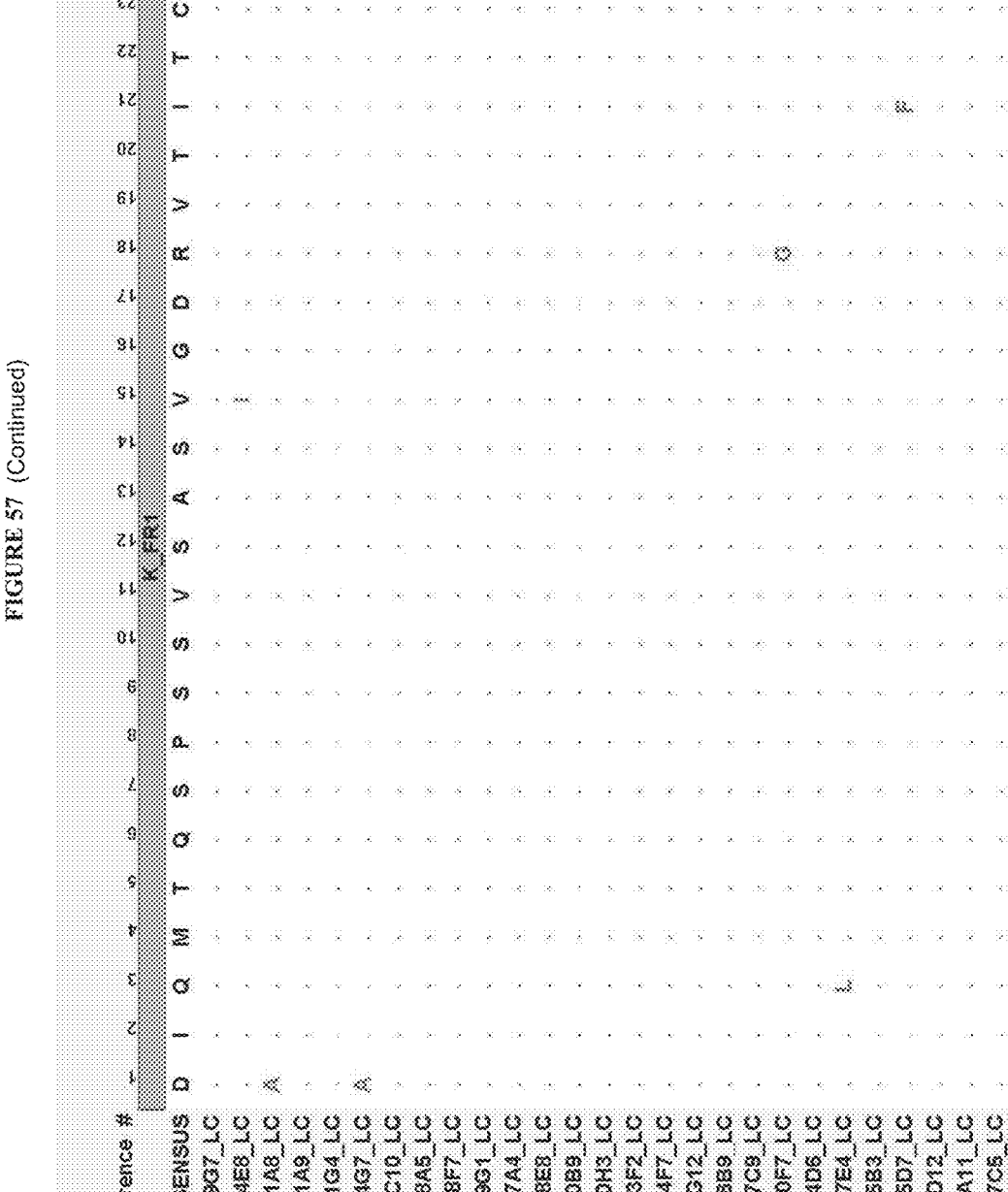
Figure 57:
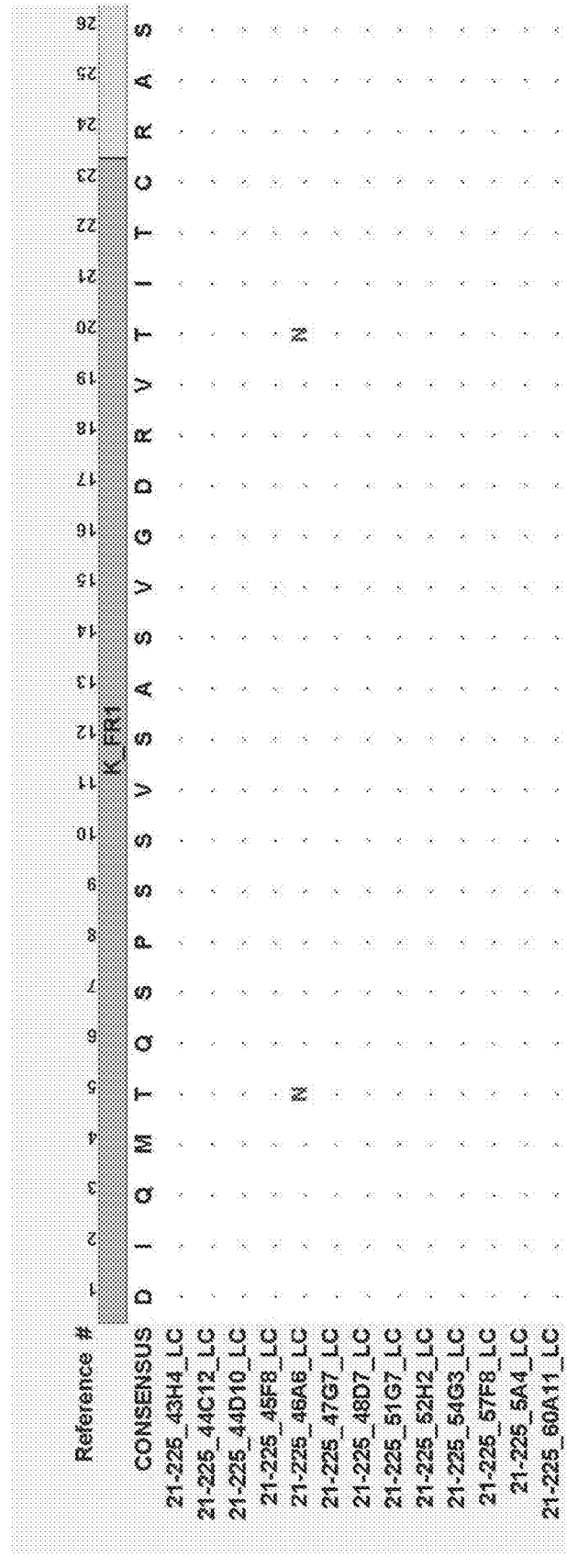
Figure 57:
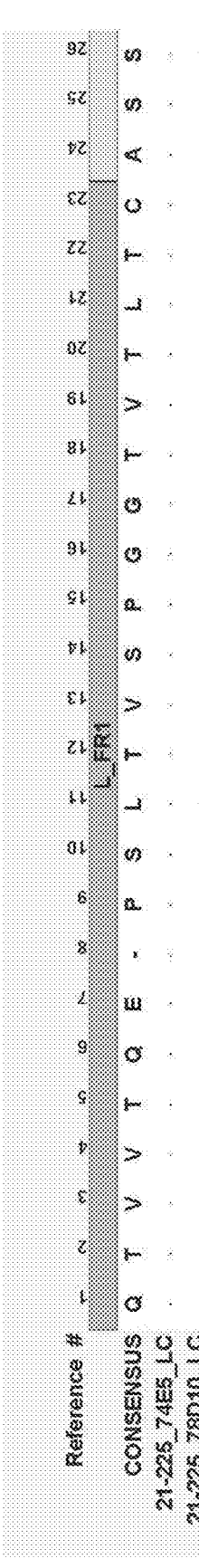
Figure 57:
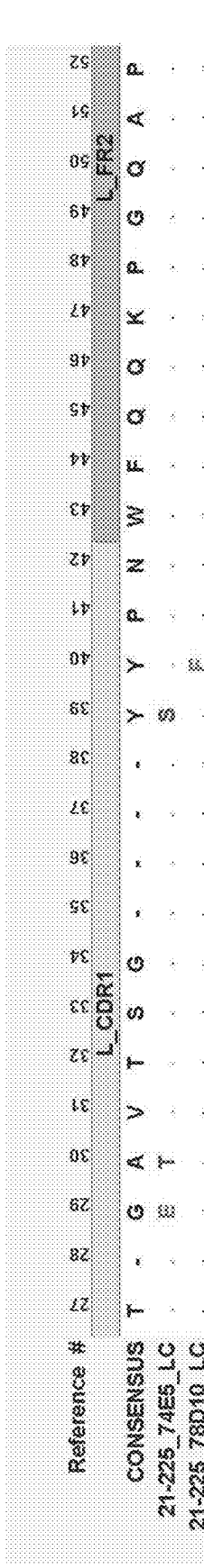
Figure 57:
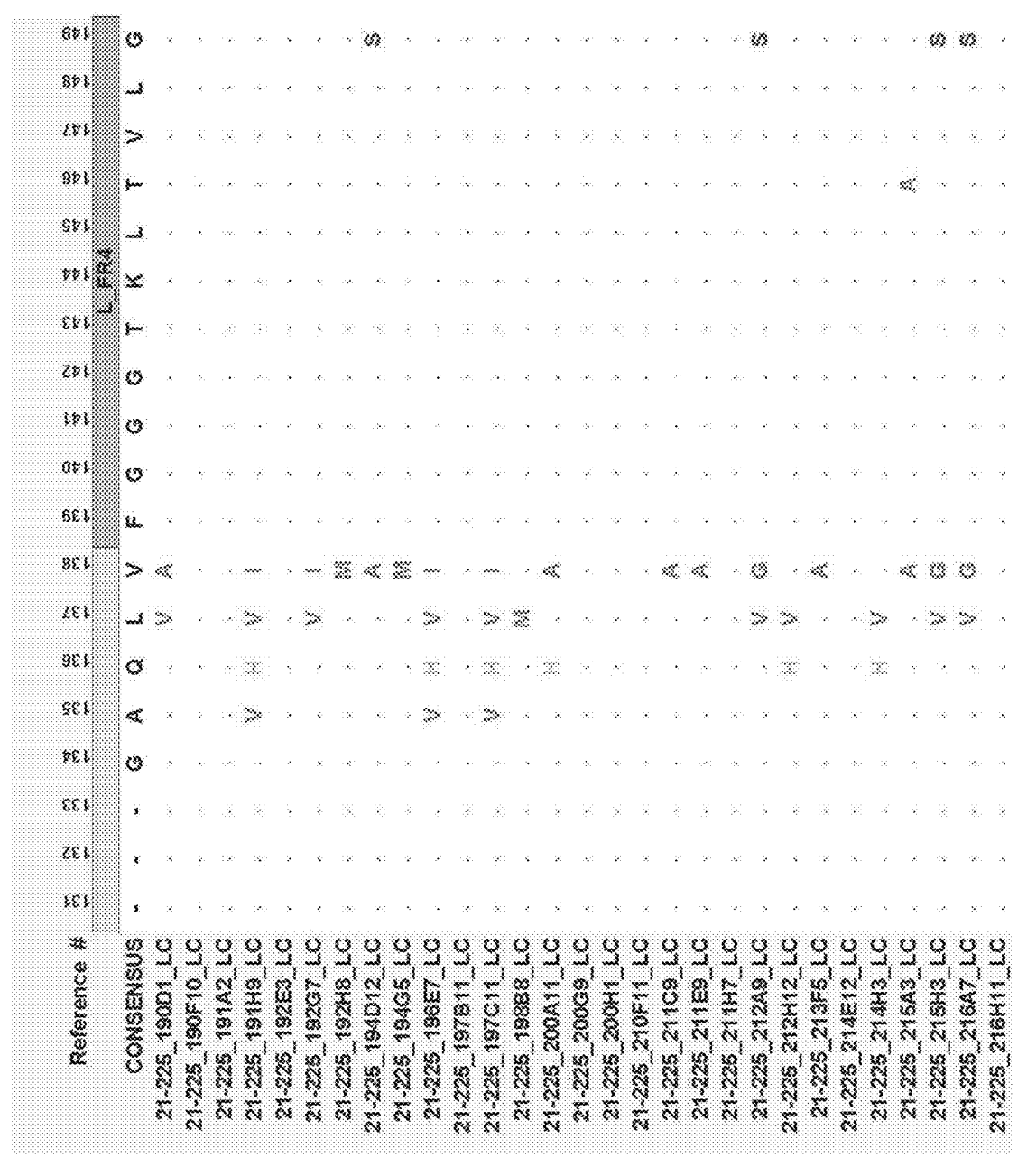
Figure 57:
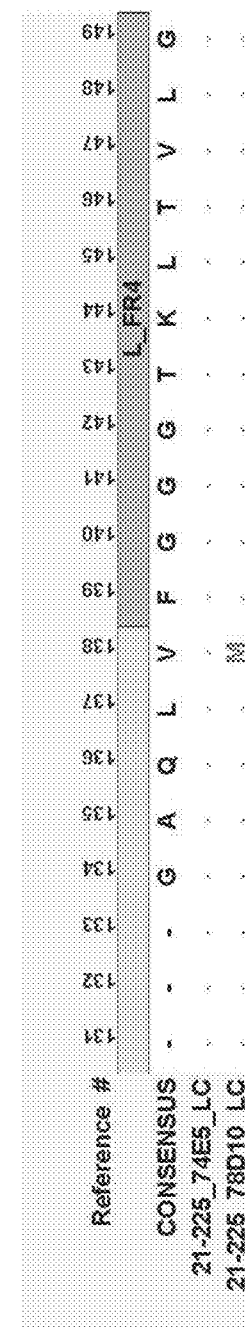
Figure 57:
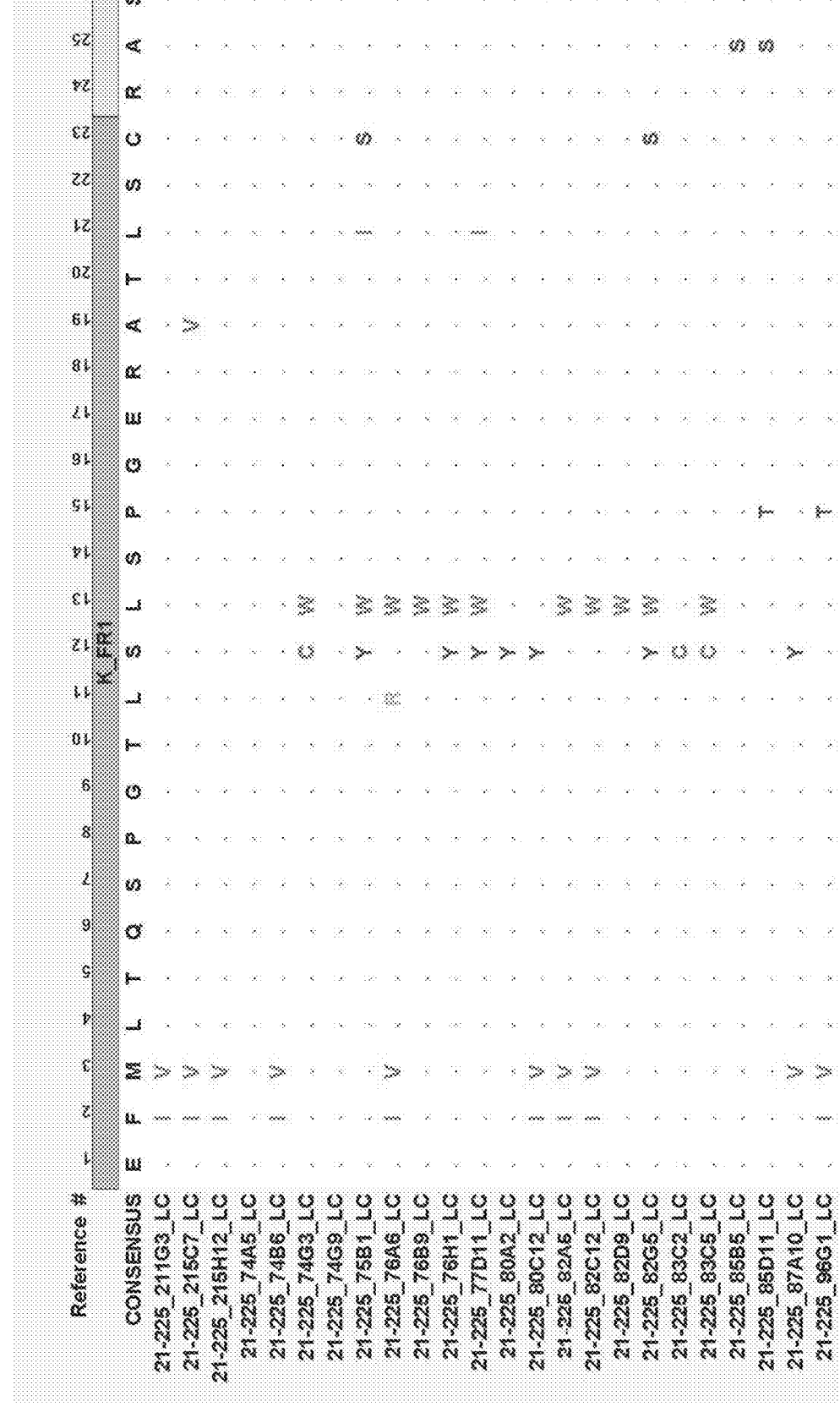
Figure 57:
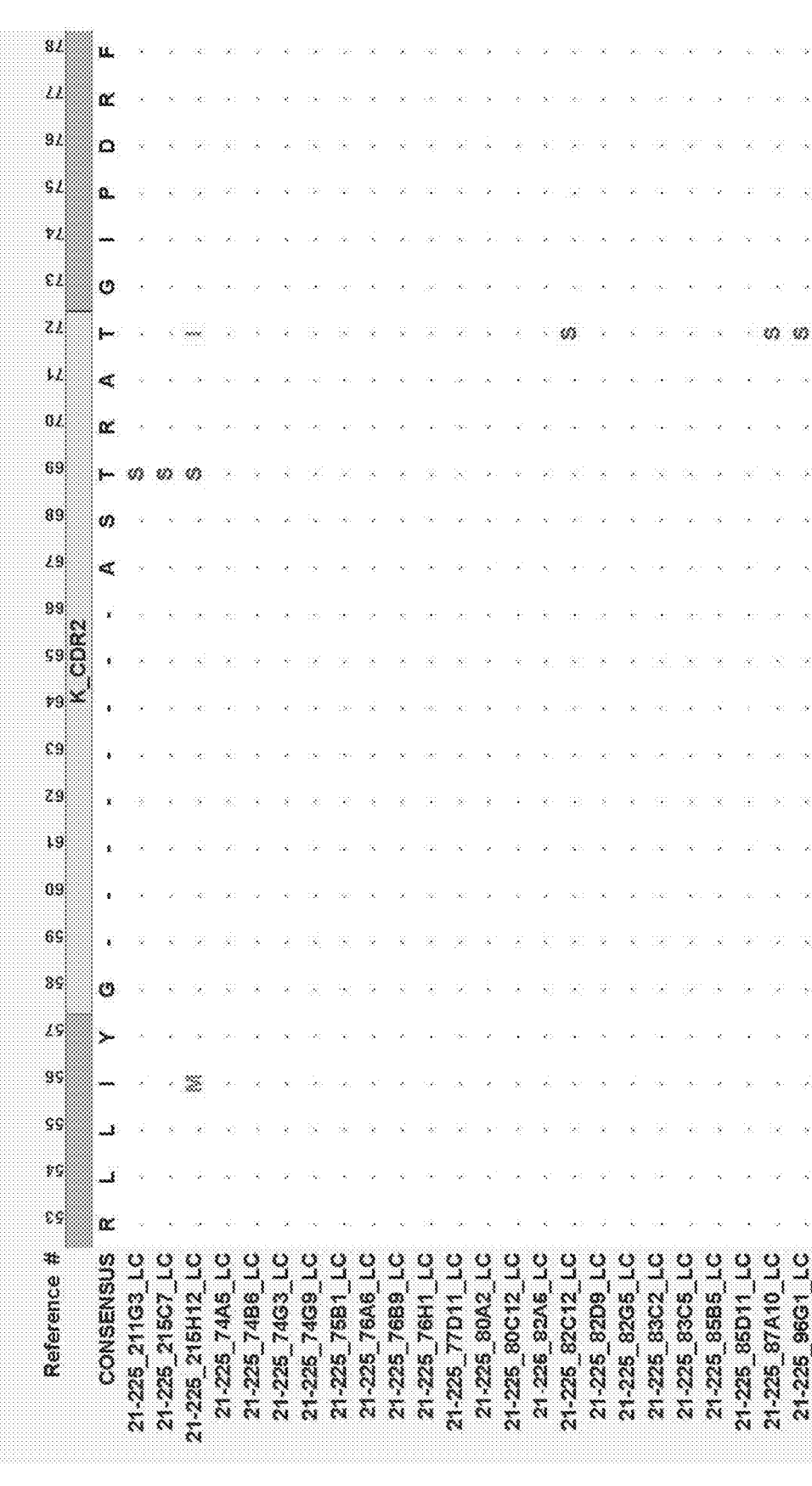
Figure 57:
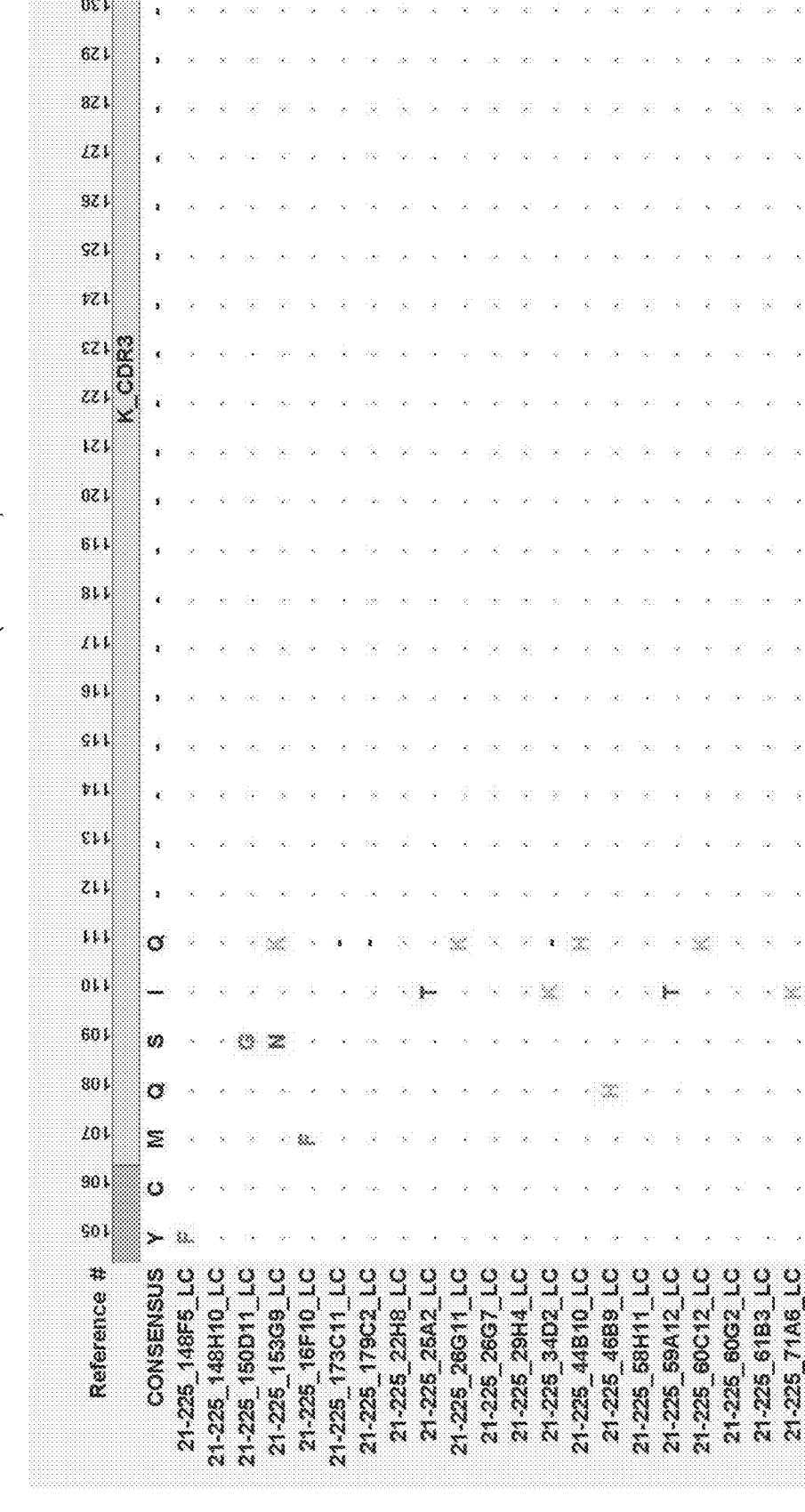
Figure 57:
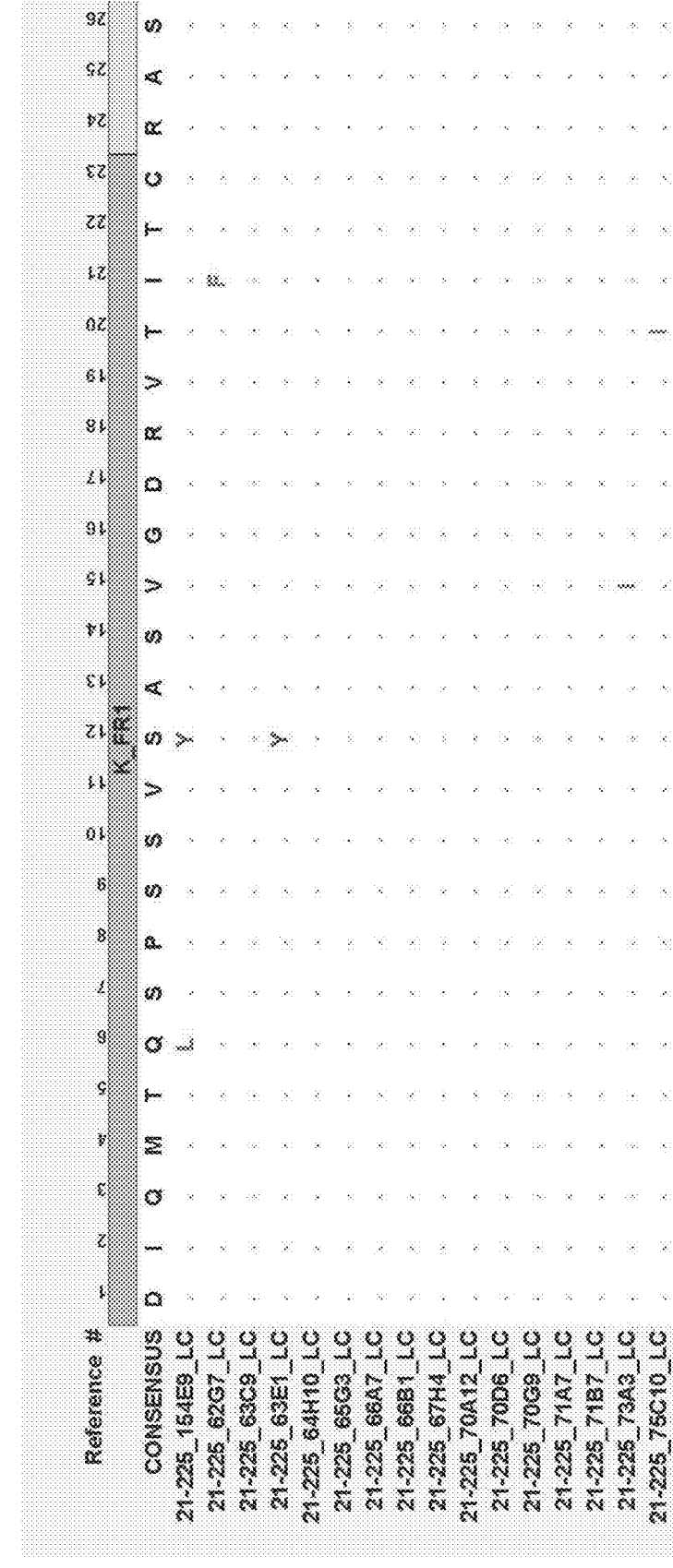
Figure 57:
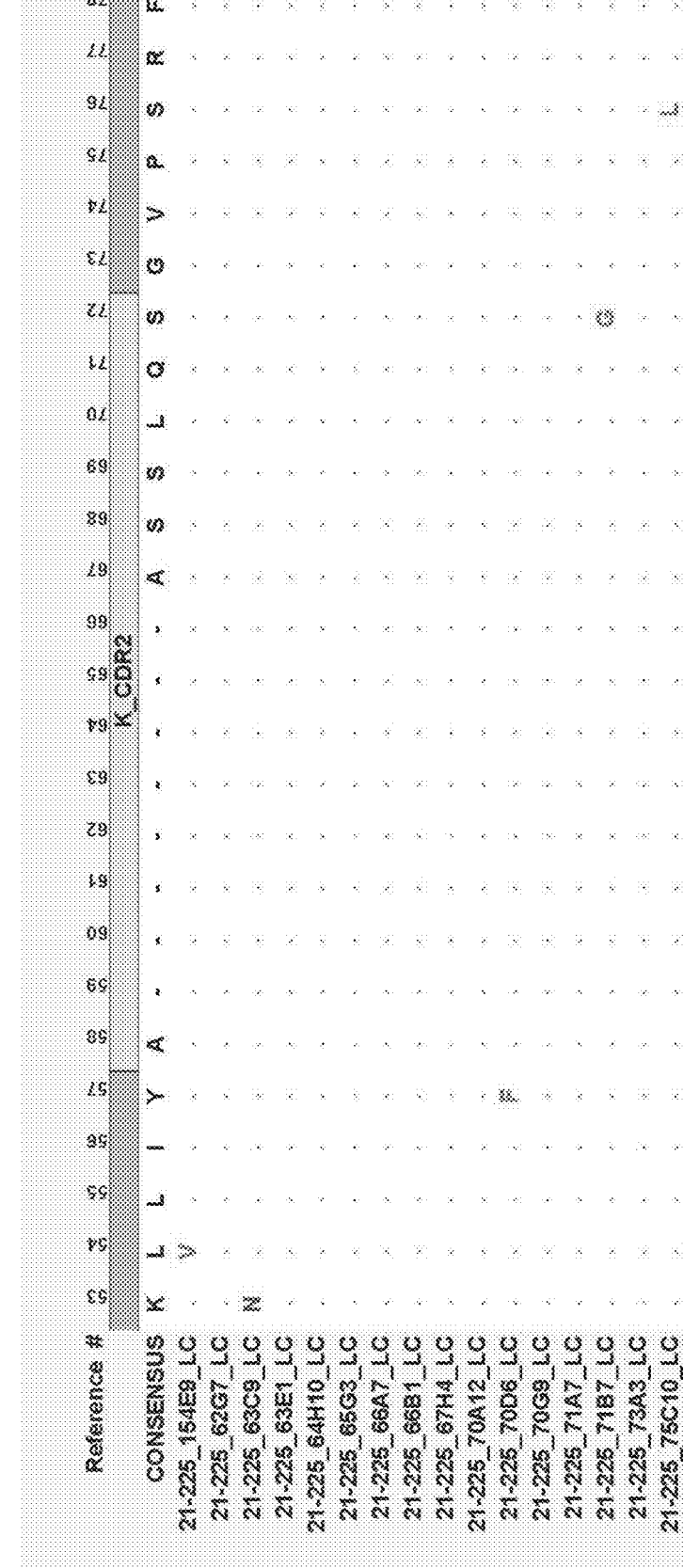
Figure 57:
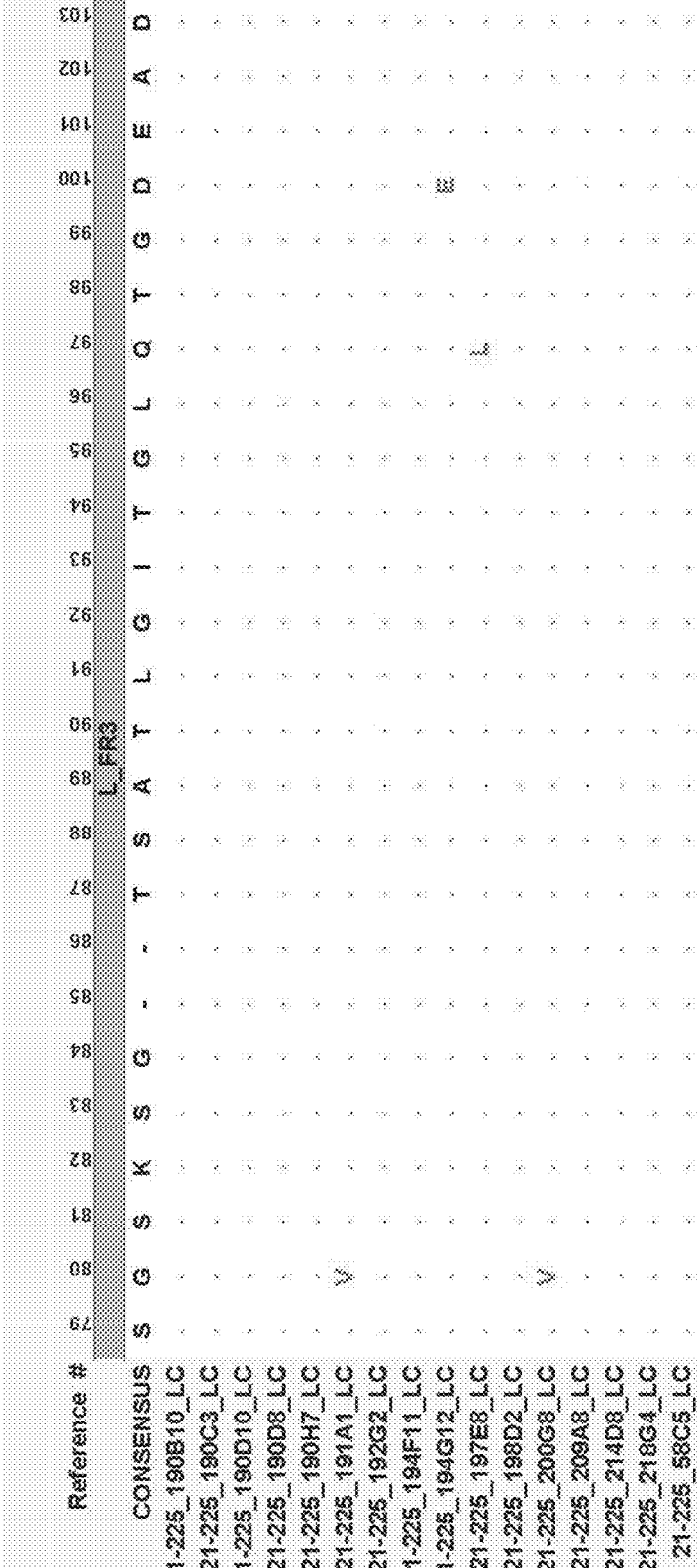

FIG. 57. A group of tables presenting the consensus protein alignment of various light and heavy chain variable regions for certain antigen binding proteins of the present invention (Tables 49-134).

Figure 58:
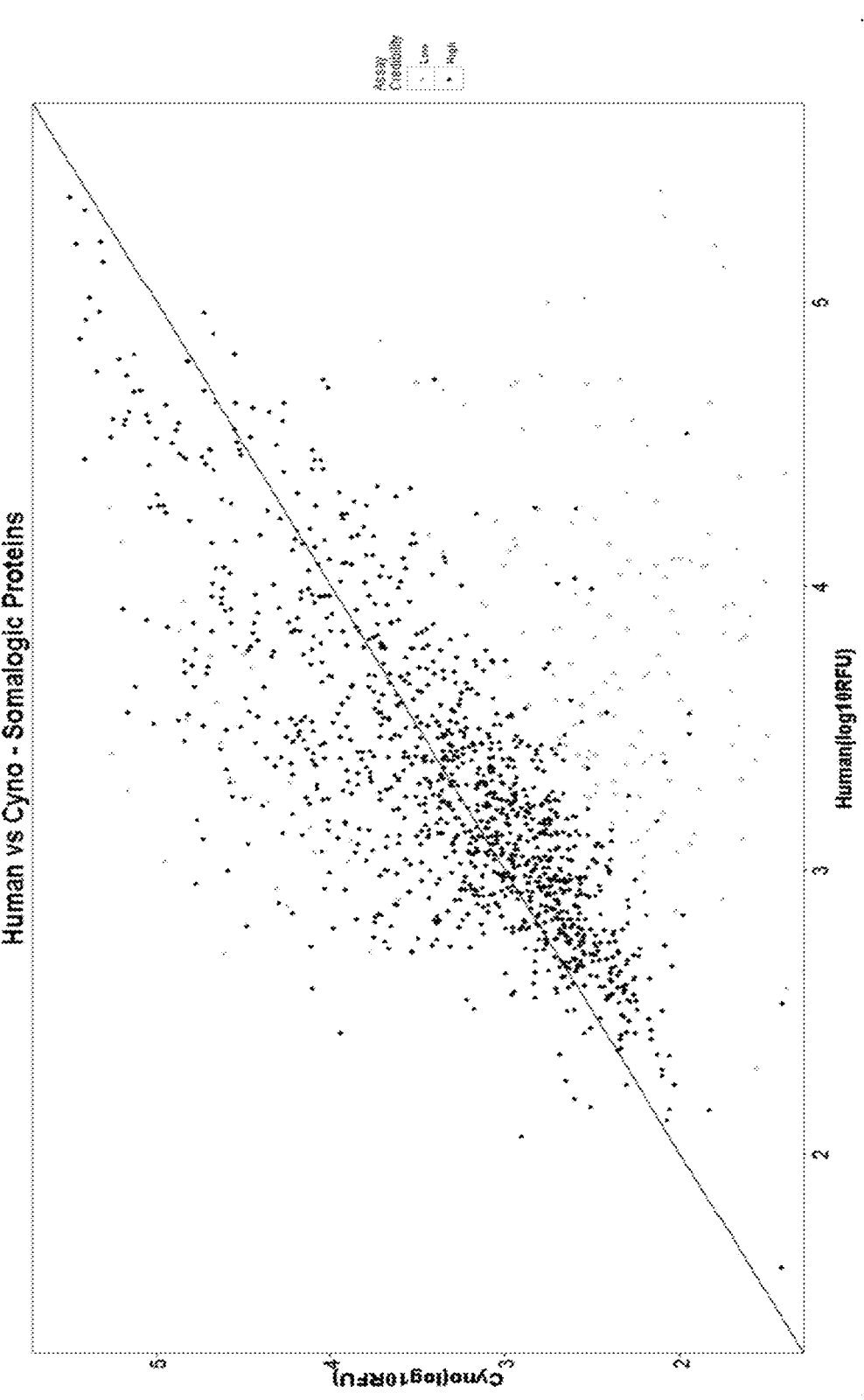

FIG. 58. A graph depicting the credibility of protein measurements in cynomolgus monkey. Log 10 RFU of mean protein levels in the two species are plotted and the ones with low credibility (light dots) and high credibility (darker dots) are marked.

Figure 59:
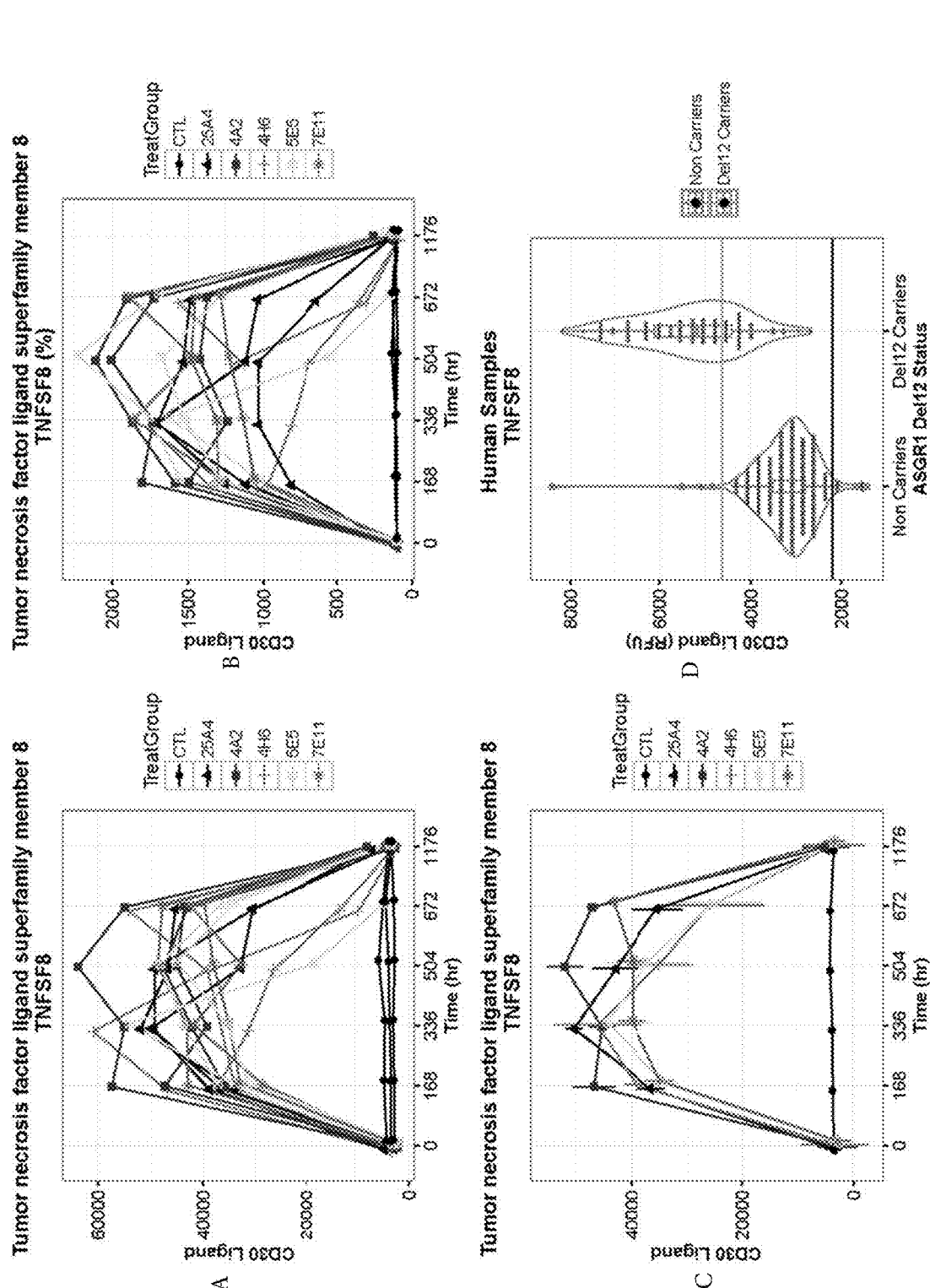

FIG. 59. Serum protein analysis of cynomolgus monkey treated with anti-ASGR-1 antibodies. Panel A is a graph depicting TNFSF8 protein levels in individual animals of different treatment group across the time points. Panel B is a graph depicting normalized TNFSF8 protein levels (percent of time point 0) in individual animals of different treatment groups across the time points. Panel C is a graph depicting TNFSF8 protein levels in each treatment group (n=3, error bar represents the SEM), and Panel D is a graph depicting the distribution of TNFSF8 protein levels in human ASGR1 del12 carriers and non-carriers.

FIG. 60. A table presenting ASGR-1 residues identified as hits via Arg/Glu scanning mutagenesis.

DETAILED DESCRIPTION OF THE VARIOUS EMBODIMENTS

As shown in Example 1 below, sequence variants in ASGR-1 (which resulted in either a faster degrading ASGR1 or a loss of function ASGR1 mutation) resulted in a lowering in the level of non-HDL cholesterol in humans. This in turn resulted in a decrease in the risk of coronary artery disease experienced by these people. As loss of function mutations in ASGR-1 resulted in both the lowering of non-HDL cholesterol and the lowering of coronary artery disease, antibodies and inhibitory RNA that effectively block ASGR can be used to lower the risk of coronary artery disease.

The present invention is directed to inhibitors of ASGR, ASGR-1 and/or ASGR-2. The present invention provides antigen binding proteins that specifically bind to human ASGR, ASGR-1 and/or ASGR-2 and inhibit human ASGR, ASGR-1 and/or ASGR-2 binding to a ligand. The present invention also provides antigen binding proteins that specifically bind to other species of ASGR, ASGR-1 and/or ASGR-2. The present invention is further directed to methods of treating or preventing cardiovascular disease in a human subject comprising administering an inhibitor of ASGR, ASGR-1 and/or ASGR-2, wherein the ASGR inhibitor an antigen binding protein and/or an interfering RNA (e.g., siRNA or shRNA).

The present invention further provides compositions, kits, and methods relating to antigen binding proteins that specifically bind to human ASGR, human ASGR-1, and/or human ASGR-2. Also provided are nucleic acid molecules comprising a sequence of polynucleotides that encode all or a portion of a polypeptide that specifically binds to human ASGR, human ASGR-1, and/or human ASGR-2. The present invention further provides vectors and plasmids comprising such nucleic acids, and cells or cell lines comprising such nucleic acids and/or vectors and plasmids. The provided methods further include, for example, methods of making, identifying, or isolating antigen binding proteins that bind to human ASGR, human ASGR-1, and/or human ASGR-2, methods of determining whether an antigen binding protein binds to human ASGR, human ASGR-1, and/or human ASGR-2, methods of making compositions, such as pharmaceutical compositions, comprising an antigen binding protein that binds to human ASGR, human ASGR-1, and/or human ASGR-2, and methods for administering an antigen binding protein that binds human ASGR, human ASGR-1, and/or human ASGR-2 to a human subject.

It is to be understood that both the foregoing general description and the following detailed description are exemplary and explanatory only and are not restrictive of the invention as claimed. In this application, the use of the singular includes the plural unless specifically stated otherwise. In this application, the use of "or" means "and/or" unless stated otherwise. Furthermore, the use of the term "including", as well as other forms, such as "includes" and "included", is not limiting. Also, terms such as "element" or "component" encompass both elements and components comprising one unit and elements and components that comprise more than one subunit unless specifically stated otherwise. Also, the use of the term "portion" can include part of a moiety or the entire moiety.

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. See, e.g., Sambrook et al. Molecular Cloning: A Laboratory Manual, 2d ed., Cold Spring Harbor Laboratory Press, Cold Spring Harbor, N.Y. (1989) and Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

Polynucleotide and polypeptide sequences are indicated using standard one- or three-letter abbreviations. Unless otherwise indicated, polypeptide sequences have their amino termini at the left and their carboxy termini at the right, and single-stranded nucleic acid sequences, and the top strand of double-stranded nucleic acid sequences, have their 5' termini at the left and their 3' termini at the right. A particular section of a polypeptide can be designated by amino acid residue number such as amino acids 1 to 50, or by the actual residue at that site such as asparagine to proline. A particular polypeptide or polynucleotide sequence also can be described by explaining how it differs from a reference sequence.

The following terms, unless otherwise indicated, shall be understood to have the following meanings:

The term "inhibitor" as used herein, is a compound that decreases the magnitude of at least one activity or function of a molecule compared to the magnitude of the activity or function observed in the absence of the inhibitor. In some instances, an inhibitor will substantially decrease the magnitude of at least one activity or function of a molecule compared to the magnitude of the activity or function observed in the absence of the inhibitor. In some instances, an inhibitor will completely diminish the magnitude of at least one activity or function of a molecule compared to the magnitude of the activity or function observed in the absence of the inhibitor. Certain exemplary inhibitors include, but are not limited to, proteins, peptides, antibodies, peptibodies, aptamers, antisense oligonucleotides, interfering RNA, carbohydrates or small organic molecules.

The term "isolated molecule" (where the molecule is, for example, a polypeptide, a polynucleotide, antigen binding protein or an antibody) is a molecule that by virtue of its origin or source of derivation (1) is not associated with naturally associated components that accompany it in its native state, (2) is substantially free of other molecules from the same species (3) is expressed by a cell from a different species, or (4) does not occur in nature. Thus, a molecule that is chemically synthesized, or expressed in a cellular system different from the cell from which it naturally originates, will be "isolated" from its naturally associated components. A molecule also may be rendered substantially free of naturally associated components by isolation, using purification techniques well known in the art. Molecule purity or homogeneity may be assayed by a number of means well known in the art. For example, the purity of a polypeptide sample may be assayed using polyacrylamide gel electrophoresis and staining of the gel to visualize the polypeptide using techniques well known in the art. For certain purposes, higher resolution may be provided by using HPLC or other means well known in the art for purification.

The terms "polynucleotide," "oligonucleotide" and "nucleic acid" are used interchangeably throughout and include DNA molecules (e.g., cDNA or genomic DNA), RNA molecules (e.g., mRNA), analogs of the DNA or RNA generated using nucleotide analogs (e.g., peptide nucleic acids and non-naturally occurring nucleotide analogs), and hybrids thereof. The nucleic acid molecule can be single-stranded or double-stranded. In one embodiment, the nucleic acid molecules of the invention comprise a contiguous open reading frame encoding an antibody, or a fragment, derivative, mutein, or variant thereof, of the invention.

A "vector" is a nucleic acid that can be used to introduce another nucleic acid linked to it into a cell. One type of vector is a "plasmid," which refers to a linear or circular double stranded DNA molecule into which additional nucleic acid segments can be ligated. Another type of vector is a viral vector (e.g., replication defective retroviruses, adenoviruses and adeno-associated viruses), wherein additional DNA segments can be introduced into the viral genome. Certain vectors are capable of autonomous replication in a host cell into which they are introduced (e.g., bacterial vectors comprising a bacterial origin of replication and episomal mammalian vectors). Other vectors (e.g., non-episomal mammalian vectors) are integrated into the genome of a host cell upon introduction into the host cell, and thereby are replicated along with the host genome. An "expression vector" is a type of vector that can direct the expression of a chosen polynucleotide.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, Calif. and Baron et al., 1995, Nucleic Acids Res. 23:3605-06.

A "host cell" is a cell that can be used to express a nucleic acid, e.g., a nucleic acid of the invention. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Typically, a host cell is a cultured cell that can be transformed or transfected with a polypeptide-encoding nucleic acid, which can then be expressed in the host cell. The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

ASGR

Genomic database analysis is one manner that allows for the discovery of associations between disease states and particular targets and/or pathways. For example, genetic analysis of patients with familial hypercholesterolemia resulted in the discovery of proprotein convertase subtilisin/kexin type 9 (PCSK9) being involved with regulating serum LDL cholesterol levels and risk of developing coronary artery disease, and ultimately, in the development of the recently approved Repatha®, an anti-hPCSK9 antibody (see, e.g., Jackson et al., U.S. Pat. No. 8,030,457). Advances in DNA sequencing technology provide the means to sequence the genomes of large numbers of individuals allowing for discovery of rare variants. deCODE Genetics (an Amgen company) has previously reported methods to analyze whole genomes of large numbers of Icelanders in order to search for associations between genetic variants and traits of interest. (Gudbjartsson et al., Nature Genetics; Vol. 47(5) May 2015; p. 435-444).

This methodology has now been applied in the search for novel genetic variants that affect cardiovascular disease, including cholesterol levels, and the risk for developing coronary artery disease and myocardial infarction (MI). The groundbreaking analysis performed has identified novel sequence variants of the Ashwell-Morell Receptor that are implicated in cardiovascular disease.

In the present invention, whole-genome sequencing of the Icelandic population discovered a rare, 12 base pair deletion ("del12") in intron 4 of the ASGR-1 gene that is also present in other European ancestry populations. This deletion leads to a frameshift predicted to generate a truncated ASGR-1 receptor subunit that is lacking both the oligomerization and extracellular carbohydrate recognition domains (also known as "CRD," "carbohydrate binding domain" or "CBD") or may generate an unstable and rapidly degraded transcript (and therefore no protein) due to nonsense mediated decay. In the present invention, whole-genome sequencing of the Icelandic population also discovered a second rare loss of function variant in the ASGR-1 gene; namely, a 4 base pair insertion in exon 7 (c.469-472dupAACT or "W158X"). This 4 base pair insertion in exon 7 causes a frameshift and introduces a premature stop codon at amino acid 158 out of the 291 amino acid full length protein (NP_001662.1: p.W158X). This variant is predicted to encode a protein lacking the carbohydrate recognition domain of the receptor or may generate an unstable and rapidly degraded transcript (and therefore no protein) due to nonsense mediated decay. Furthermore, the W158X variant effects all reported refseq transcripts of ASGR-1 regardless of tissue or cell type of expression. Without wishing to be bound by any particular hypothesis, the analysis indicates that del12 and W158X results in lower non-HDL cholesterol levels, protection against CAD and MI, leading to prolonged life. Additionally, the analysis indicates that del12 and W158X also associates with increased levels of circulating ALP and vitamin B12. Supporting this del12 and W158X association with increased levels of ALP are data from mice having a Y272C variant in ASGR-1, showing that these mice exhibit a phenotype of increased plasma ALP (Sabrautzki et al., Mamm. Genome, 23, 416-430, 2012). The Y272 position in mouse ASGR-1 corresponds to the Y273 position in human ASGR-1 (see FIG. 1A).

The Ashwell-Morell Receptor (AMR), originally named the hepatic asialoglycoprotein receptor, was one of the first cellular receptors to be isolated and identified. (Grewal, Methods in Enzymology, Volume 479, Chapter 13, 2010, pp. 223-241). This receptor is also known as the Ashwell Receptor, the hepatic galactose/N-acetylgalactosamine (GalNAc) receptor, or the hepatic lectin receptor. However, this receptor is now more commonly known as "ASGPR," or simply "ASGR."

ASGR is a C-type lectin that is expressed on the surface of hepatocytes and is made up of 48 kDa major subunit(s) (ASGR-1) and 40 kDa minor subunit(s) (ASGR-2). (Roggenbuck et al., Autoimmune Highlights, 2012, 3:119-125). Functional variants of ASGR are formed by the oligomerization of the ASGR-1 and ASGR-2 subunits. (Grewal). The receptor complexes can comprise homo-oligomers and hetero-oligomers of the ASGR-1 and ASGR-2 subunits, with (ASGR-1)$_2$-(ASGR-2)$_1$ trimer being the most common form and having the highest affinity to substrate. (Grewal). Other identified forms of ASGR include (ASGR-1)$_2$, (ASGR-1)$_3$, (ASGR-1)$_2$-(ASGR-2)$_2$, (ASGR-1)$_3$-(ASGR-2)$_2$. (Grewal).

Figure 3:
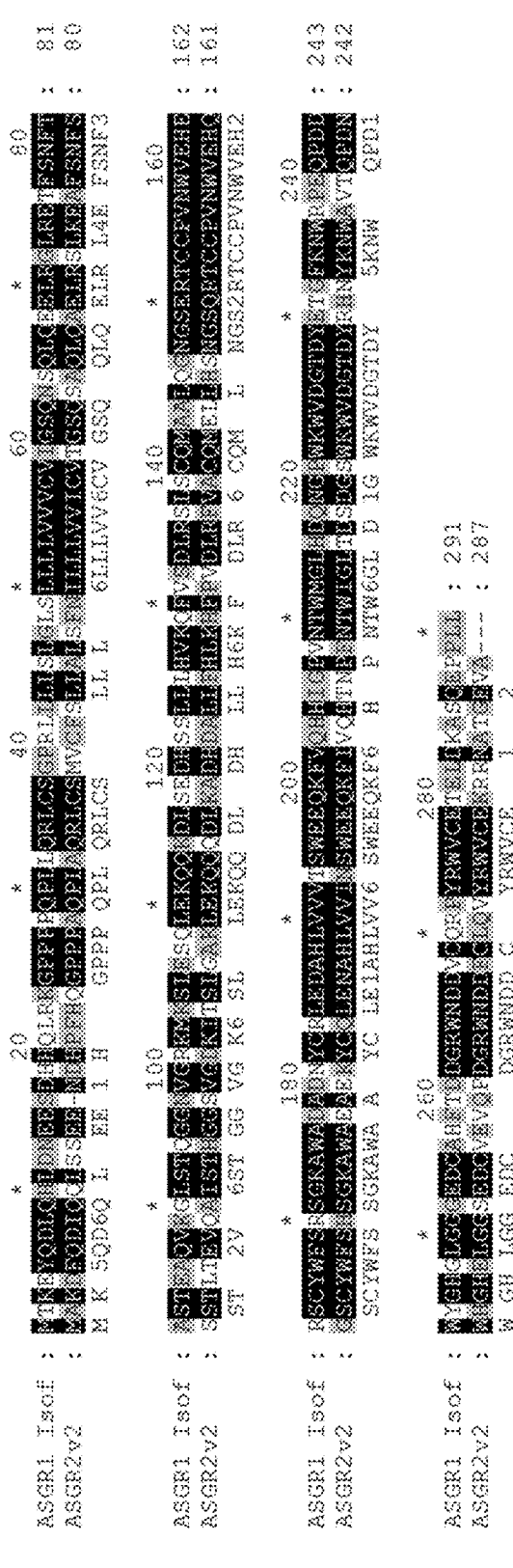
FIG. 3. Human ASGR-1 (SEQ ID NO: 32717) vs. human ASGR-2v2 (SEQ ID NO: 32718) alignments are provided.

The polynucleotide and polypeptide sequences for several species of ASGR-1 and ASGR-2 are known. Table 1 presents sequences for human, mouse, rat, pig, dog and cynomolgus. FIGS. 1A, 1B and 2 present sequence alignments of various species of ASGR-1 and ASGR-2, and FIG. 3 presents a sequence alignment between human ASGR-1 and human ASGR-2.

ASGR-1 is a single pass transmembrane protein and is the major subunit of ASGR. The galactose (Gal) or N-acetylgalactosamine (GalNAc) residues of glycoproteins are exposed by removal of sialic acid by sialidases, hence the term asialoglycoprotein for the ligands of ASGR. Although ASGR expression is detected in other tissues, liver is the predominant site of expression. A circulating form of the receptor, generated from ASGR-1 transcripts lacking exon two, has also been reported. (Liu J, Hu B, Yang Y, et al. A new splice variant of the major subunit of human asialoglycoprotein receptor encodes a secreted form in hepatocytes. PloS one 2010; 5:e12934). The del12 and W158X variants are predicted to truncate both the membrane bound and the circulating form of the receptor, and as mentioned above, the W158X variant may generate an unstable and rapidly degraded transcript (and therefore no protein) due to nonsense mediated decay.

The primary reported function of ASGR is to bind and internalize glycoproteins in the circulation that contain terminal galactose or N-acetylgalactosamine residues (asialoglycoproteins), resulting in the clearance of these proteins from the circulation. (Roggenbuck). Reported endogenous ligands include components of the blood coagulation system, such as platelets and Von Willebrand Factor. (Grewal).

As used herein, the terms "ASGR, ASGR-1, and/or ASGR-2 function" or "ASGR, ASGR-1, and/or ASGR-2 activity" includes any biological effect of ASGR, ASGR-1 and/or ASGR-2. In certain embodiments, ASGR function or activity includes the ability of ASGR to interact or bind to a ligand. In some embodiments, ASGR function or activity is represented by the ability of ASGR to interact or bind to sugars including but not limited to lactose, galactose, and/or GalNAc or glycoproteins displaying such sugars including but not limited to fetuin, orosomucoid and/or alkaline phosphatase. In some embodiments, ASGR function or activity includes any biological activity resulting from ASGR response. Exemplary activities include, but are not limited to, clearance of asialoglycoproteins from the circulation; clearance of IgA from circulation; removal of apoptotic cells; clearance of low density lipoprotein (LDL) and/or the disposal of cellular fibronectin (Roggenbuck).

Given the location of ASGR on the surface of liver hepatocytes and its implication in hepatocyte entry by certain viruses (Roggenbuck), the receptor has become a target of convenience for therapeutics that require delivery to the liver and internalization into the cells. Examples of these uses include the targeted delivery of doxorubicin to hepatocellular carcinoma (Wei et al., Int J Nanomedicine, 2015, 10:5123-37), gene delivery to hepatocytes (D'Souza et al., J Control Release, 2015, 203:126-39), and targeted delivery of siRNA to hepatocytes (Rajeev et al., Chembiochem, 2015, 16(6):903-8).

Although the ASGR and its ability to mediate endocytosis and degradation of desialylated glycoproteins has been known for nearly 4 decades, the endogenous ligands and the physiological function of the receptor have been difficult to establish. (Weigel P H, Yik J H. Glycans as endocytosis signals: the cases of the asialoglycoprotein and hyaluronan/chondroitin sulfate receptors. Biochimica et biophysica acta 2002; 1572:341-63). It has been reported that ASGR-1-/- mice (lacking any ASGR activity) thrive normally and do not accumulate desialylated glycoproteins in their circulation although they are unable to clear exogenously added asialoglycoproteins, suggesting that under normal physiological condition ASGR is not essential for homeostasis of circulating asialoglycoproteins. (Tozawa R, Ishibashi S, Osuga J, et al. Asialoglycoprotein receptor deficiency in mice lacking the major receptor subunit. Its obligate requirement for the stable expression of oligomeric receptor. The Journal of Biological Chemistry 2001; 276:12624-8).

In contrast to the ASGR-1 knockout mice which lack an apparent phenotype, the present invention has established a clear physiological role for human ASGR-1 in cardiovascular disease, for example, but not limited to, the regulation of non-HDL levels and modulation of CAD and MI risk. The present invention has also demonstrated the association of del12 and W158X with increased levels of circulating ALP and vitamin B12. Furthermore, the present invention shows that disturbing one allele of ASGR-1 appears to have an overall beneficial effect as heterozygotes carriers of del12 live on average 1.5 years longer than non-carriers.

Surprisingly, the various embodiments provided herein demonstrate that the del12 variant and the W158 variant both have an effect on non-HDL levels that is opposite to their effect on ALP and vitamin B12 levels; decreasing non-HDL and increasing ALP and vitamin B12. While not wishing to be bound by any particular hypothesis, it is important to note that the common variant previously described that associates with ALP and LDL cholesterol also has opposing effects on these serum components; hence ASGR-1 may affect the level of these molecules through different mechanisms. It is unlikely that the ALP increase mediated by del12 or W158X reflects an underlying liver disease since other measures of liver function are not affected. Both ALP and the vitamin B12 transporter in the circulation, haptocorrin, are asialylated glycoproteins known to bind ASGR-1 and be cleared from the circulation by the receptor (Tuin A, Huizinga-Van der Vlag A, van Loenen-Weemaes A M, Meijer D K, Poelstra K. On the role and fate of LPS-dephosphorylating activity in the rat liver. American Journal of Physiology Gastrointestinal and Liver Physiology 2006; 290:G377-85; Furger E, Fedosov S N, Lildballe D L, et al. Comparison of recombinant human haptocorrin expressed in human embryonic kidney cells and native haptocorrin. PloS one 2012; 7:e37421; Burger R L, Schneider R J, Mehlman C S, Allen R H. Human plasma R-type vitamin B12-binding proteins. II. The role of transcobalamin I, transcobalamin III, and the normal granulocyte vitamin B12-binding protein in the plasma transport of vitamin B12. The Journal of Biological Chemistry 1975; 250:7707-13; Steirer L M, Park E I, Townsend R R, Baenziger J U. The asialoglycoprotein receptor regulates levels of plasma glycoproteins terminating with sialic acid alpha 2,6-galactose. The Journal of Biological Chemistry 2009; 284:3777-83). While not wishing to be bound by any particular hypothesis, the more likely reason for the increased levels of ALP and vitamin B12 in del12 carriers and in W158X carriers is decreased clearance of desialylated forms of these molecules from the circulation, due to reduced number of functional ASGR receptors in del12 carriers and in W158X carriers, suggesting a role for ASGR-1 in maintaining homeostasis of circulating ALP and vitamin B12.

While not wishing to be bound by any particular hypothesis, the decreased levels of non-HDL in del12 carriers and in W158X carriers in the face of reduced ASGR-1 function suggest that ASGR-1 affects non-HDL levels by mechanisms other than direct binding and endocytosis of cholesterol particles. In mice expressing a hypomorphic form of neuraminidase 1 (Neu1), a sialidase that cleaves the sialic acid residues thereby generating substrates for ASGR-1, the LDL receptor (LDLR) is sialylated and this form of the receptor was more stable and took up LDL cholesterol more avidly (LDL levels were decreased in these mice) than the asialylated form of the wild type LDLR (Yang A, Gyulay G, Mitchell M, White E, Trigatti B L Igdoura S A. Hypomorphic sialidase expression decreases serum cholesterol by downregulation of VLDL production in mice Journal of Lipid Research 2012; 53:2573-2585). Both ASGR and LDLR are located in clathrin-coated pits on hepatocytes and ASGR may be capable of interacting with the asialylated form of the LDLR and blocking its activity.

Two novel rare variants in ASGR-1 have been identified herein that play a role in cardiovascular disease, including, but not limited to, lowering non-HDL levels and protecting against CAD and MI. These variants disrupt ASGR-1 protein function. Accordingly, the present invention is further directed to methods of inhibiting ASGR function, methods of inhibiting ASGR-1 function and/or methods of inhibiting ASGR-2 function. The present invention is further directed to molecules (for example, but not limited to, antigen binding proteins or interfering RNA) that inhibit ASGR function, ASGR-1 function and/or ASGR-2 function.

Antigen Binding Proteins

In some embodiments, the invention comprises antigen binding proteins that bind to ASGR, ASGR-1, and/or ASGR-2 of different species, including, but not limited to, human, cynomolgus, porcine, canine, murine and rat. In some embodiments, the antigen binding proteins specifically bind to ASGR, ASGR-1, and/or ASGR-2 of different species, including, but not limited to, human, cynomolgus, porcine, canine, and murine and rat. Exemplary amino acid sequences of human, cyno, dog, pig, rat and mouse ASGR-1 and ASGR-2 are provided in FIGS. 1-3. In some embodiments, the antigen binding proteins further inhibit ASGR, ASGR-1 and/or ASGR-2 from binding to a ligand.

An "antigen binding protein" is a protein comprising an antigen binding fragment that binds to an antigen and, optionally, a scaffold or framework portion that allows the antigen binding fragment to adopt a conformation that promotes binding of the antigen binding protein to the antigen. In the instant application, the antigen is ASGR, ASGR-1 and/or ASGR-2 protein or a fragment thereof. In some embodiments, the antigen binding fragment comprises at least one CDR from an antibody that binds to the antigen, and in some embodiments comprises the heavy chain CDR3 from an antibody that binds to the antigen. In some embodiments, the antigen binding fragment comprises all three CDRs from the heavy chain of an antibody that binds to the antigen or from the light chain of an antibody that binds to the antigen. In still some embodiments, the antigen binding fragment comprises all six CDRs from an antibody that binds to the antigen (three from the heavy chain and three from the light chain). The antigen binding fragment in certain embodiments is an antibody fragment.

Nonlimiting examples of antigen binding proteins include antibodies, antibody fragments (e.g., an antigen binding fragment of an antibody), antibody derivatives, and antibody analogs. Further specific examples include, but are not limited to, a single-chain variable fragment (scFv), a nanobody (e.g. VH domain of camelid heavy chain antibodies; VHH fragment, see Cortez-Retamozo et al., Cancer Research, Vol. 64:2853-57, 2004), a Fab fragment, a Fab' fragment, a F(ab')2 fragment, a Fv fragment, a Fd fragment, and a complementarity determining region (CDR) fragment. These molecules can be derived from any mammalian source, such as human, mouse, rat, rabbit, or pig, dog, or camelid. Antibody fragments may compete for binding of a target antigen with an intact antibody and the fragments may be produced by the modification of intact antibodies (e.g. enzymatic or chemical cleavage) or synthesized de novo using recombinant DNA technologies or peptide synthesis. The antigen binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen binding protein as well as wholly synthetic scaffolds comprising, for example, a biocompatible polymer. See, for example, Korndorfer et al., 2003, Proteins: Structure, Function, and Bioinformatics, Volume 53, Issue 1:121-129 (2003); Roque et al., Biotechnol. Prog. 20:639-654 (2004). In addition, peptide antibody mimetics ("PAMs") can be used, as well as scaffolds based on antibody mimetics utilizing fibronectin components as a scaffold.

An antigen binding protein can also include a protein comprising one or more antibody fragments incorporated into a single polypeptide chain or into multiple polypeptide chains. For instance, antigen binding proteins can include, but are not limited to, a diabody (see, e.g., EP 404,097; WO 93/11161; and Hollinger et al., Proc. Natl. Acad. Sci. USA, Vol. 90:6444-6448, 1993); an intrabody; a domain antibody (single VL or VH domain or two or more VH domains joined by a peptide linker; see Ward et al., Nature, Vol. 341:544-546, 1989); a maxibody (2 scFvs fused to Fc region, see Fredericks et al., Protein Engineering, Design & Selection, Vol. 17:95-106, 2004 and Powers et al., Journal of Immunological Methods, Vol. 251:123-135, 2001); a triabody; a tetrabody; a minibody (scFv fused to CH3 domain; see Olafsen et al., Protein Eng Des Sel., Vol. 17:315-23, 2004); a peptibody (one or more peptides attached to an Fc region, see WO 00/24782); a linear antibody (a pair of tandem Fd segments (VH-CH1-VH-CH1) which, together with complementary light chain polypeptides, form a pair of antigen binding regions, see Zapata et al., Protein Eng., Vol. 8:1057-1062, 1995); a small modular immunopharmaceutical (see U.S. Patent Publication No. 20030133939); and immunoglobulin fusion proteins (e.g. IgG-scFv, IgG-Fab, 2scFv-IgG, 4scFv-IgG, VH-IgG, IgG-VH, and Fab-scFv-Fc).

In certain embodiments, an antigen binding protein can have, for example, the structure of an immunoglobulin. An "immunoglobulin" is a tetrameric molecule, with each tetramer comprising two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function.

Within light and heavy chains, the variable (V) and constant regions (C) are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4.

Human light chains are classified as kappa and lambda light chains. The term "light chain" refers to a polypeptide comprising, from amino terminus to carboxyl terminus, a single immunoglobulin light chain variable region (VL) and a single immunoglobulin light chain constant domain (CL). Heavy chains are classified as mu (μ), delta (Δ), gamma (γ), alpha (α), and epsilon (ε), and define the antibody's isotype as IgM, IgD, IgG, IgA, and IgE, respectively. The term "heavy chain" refers to a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4). The IgG-class is further divided into subclasses, namely, IgG1, IgG2, IgG3, and IgG4. The IgA-class is further divided into subclasses, namely IgA1 and IgA2. The IgM has subclasses including, but not limited to, IgM1 and IgM2. The heavy chains in IgG, IgA, and IgD antibodies have three domains (CH1, CH2, and CH3), whereas the heavy chains in IgM and IgE antibodies have four domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (i.e. between the light and heavy chain) and between the hinge regions of the antibody heavy chains.

The term "antibody" refers to an intact immunoglobulin of any isotype, and includes, for instance, chimeric, humanized, human, and bispecific antibodies. An "antibody" is a species of an antigen binding protein. An intact antibody will generally comprise at least two full-length heavy chains and two full-length light chains. Antibody sequences can be derived solely from a single species, or can be "chimeric," that is, different portions of the antibody can be derived from two different species as described further below. Unless otherwise indicated, the term "antibody" also includes antibodies comprising two substantially full-length heavy chains and two substantially full-length light chains provided the antibodies retain the same or similar binding and/or function as the antibody comprised of two full length light and heavy chains. For example, antibodies having 1, 2, 3, 4, or 5 amino acid residue substitutions, insertions or deletions at the N-terminus and/or C-terminus of the heavy and/or light chains are included in the definition provided that the antibodies retain the same or similar binding and/or function as the antibodies comprising two full length heavy chains and two full length light chains. Furthermore, unless explicitly excluded, antibodies include, for example, monoclonal antibodies, polyclonal antibodies, chimeric antibodies, humanized antibodies, human antibodies, bispecific antibodies, and synthetic antibodies. In some sections of the present disclosure, examples of antigen binding proteins are described herein in terms of the hybridoma line number as "number/letter/number" (e.g., 25A4). In these cases, the exact name denotes a specific monoclonal antibody derived from a specific hybridoma having a specific light chain variable region and heavy chain variable region. In some sections of the present disclosure, examples of antigen binding proteins are described herein in terms of "number/letter/number/"dot"/number" (e.g., 25A4.001) or number/letter/number/"dot"/number/"dot"/number (e.g., 25A4.001.001). In these cases, the name denotes a variant of a specific antibody having a light chain variable region and a heavy chain variable region that is related to, but distinct from the antibody derived from a hybridoma. That is, for example, an antigen binding protein named 25A4 is not the same as an antibody named 25A4.001 or an antibody named 25A4.001.001.

A "polyclonal antibody" refers to a population of antibodies that are typically widely varied in composition and binding specificity. A "monoclonal antibody" ("mAb") as used herein refers to one or more of a population of antibodies having identical sequences. Monoclonal antibodies bind to the antigen at a particular epitope on the antigen.

In some embodiments, the antigen binding protein is a "fragment" or "antigen binding fragment" of an antibody. As used herein and unless otherwise specified, an "antibody fragment" refers to the Fab, Fab', F(ab')₂, and Fv fragments that contain at least one CDR of an immunoglobulin that is sufficient to confer specific antigen binding to ASGR, ASGR-1 and/or ASGR-2. Antibody fragments may be produced by recombinant DNA techniques or by enzymatic or chemical cleavage of intact antibodies.

A Fab fragment is a monovalent fragment having the VL, VH, CL and CH1 domains; a F(ab')₂ fragment is a bivalent fragment having two Fab fragments linked by a disulfide bridge at the hinge region; a Fd fragment has the VH and CH1 domains; an Fv fragment has the VL and VH domains of a single arm of an antibody; and a dAb fragment has a VH domain, a VL domain, or an antigen-binding fragment of a VH or VL domain (U.S. Pat. Nos. 6,846,634, 6,696,245, US App. Pub. No. 05/0202512, 04/0202995, 04/0038291, 04/0009507, 03/0039958, Ward et al., Nature 341:544-546 (1989)). In certain embodiments, these antibody fragments can be incorporated into single domain antibodies, single-chain antibodies, maxibodies, minibodies, intrabodies, diabodies, triabodies, tetrabodies, v-NAR and bis-scFv (see e.g., Hollinger and Hudson, 2005, Nature Biotechnology, 23, 9, 1126-1136). Other antigen binding proteins envisioned are antibody polypeptides such as those disclosed in U.S. Pat. No. 6,703,199, including fibronectin polypeptide monobodies, the polypeptides as disclosed in U.S. Patent Publication 2005/0238646. In some embodiments, the antibodies comprise at least one CDR set forth in Tables 2 or 6 herein.

A "single-chain variable fragment" ("scFv") is a fusion protein in which a VL and a VH region are joined via a linker (e.g., a synthetic sequence of amino acid residues) to form a continuous protein chain wherein the linker is long enough to allow the protein chain to fold back on itself and form a monovalent antigen binding site (see, e.g., Bird et al., Science 242:423-26 (1988) and Huston et al., 1988, Proc. Natl. Acad. Sci. USA 85:5879-83 (1988)). For the sake of clarity, a "single-chain variable fragment" is not an antibody or an antibody fragment as defined herein. Diabodies are bivalent antibodies comprising two polypeptide chains, wherein each polypeptide chain comprises VH and VL domains joined by a linker that is too short to allow for pairing between two domains on the same chain, thus allowing each domain to pair with a complementary domain on another polypeptide chain (see, e.g., Holliger et al., 1993, Proc. Natl. Acad. Sci. USA 90:6444-48 (1993), and Poljak et al., Structure 2:1121-23 (1994)). If the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

The term "CDR" refers to the complementarity determining region (also termed "minimal recognition units" or "hypervariable region") within antibody variable sequences. The CDRs permit the antigen binding protein to specifically bind to a particular antigen of interest. There are three heavy chain variable region CDRs (CDRH1, CDRH2 and CDRH3) and three light chain variable region CDRs (CDRL1, CDRL2 and CDRL3). The CDRs in each of the two chains typically are aligned by the framework regions to form a structure that binds specifically to a specific epitope or domain on the target protein. From N-terminus to C-terminus, naturally-occurring light and heavy chain variable regions both typically conform to the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342: 878-883. Complementarity determining regions (CDRs) and framework regions (FR) of a given antibody may be identified using this system. Other numbering systems for the amino acids in immunoglobulin chains include IMGT® (the international ImMunoGeneTics information system; Lefranc et al, Dev. Comp. Immunol. 29:185-203; 2005) and AHo (Honegger and Pluckthun, J. Mol. Biol. 309(3):657-670; 2001). One or more CDRs may be incorporated into a molecule either covalently or noncovalently to make it an antigen binding protein.

In some embodiments, an antigen binding protein of the invention may incorporate the CDR(s) as part of a larger polypeptide chain, may covalently link the CDR(s) to another polypeptide chain, or may incorporate the CDR(s) noncovalently. The antigen binding molecules may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically the biocompatible framework structures are based on protein scaffolds or skeletons other than immunoglobulin domains. For example, those based on fibronectin, ankyrin, lipocalin, neocarzinostatin, cytochrome b, CP1 zinc finger, PST1, coiled coil, LACI-D1, Z domain and tendamistat domains may be used (See e.g., Nygren and Uhlen, 1997, Current Opinion in Structural Biology, 7, 463-469).

An antigen binding protein may have one or more binding sites. If there is more than one binding site, the binding sites may be identical to one another or may be different. For example, an antibody typically has two identical binding sites, while a "bispecific" or "bifunctional" antibody has two different binding sites. The two binding sites of a bispecific antigen binding protein or antibody will bind to two different epitopes, which can reside on the same or different protein targets.

In some embodiments, the ASGR-1 antigen binding protein is a bispecific antibody. In certain embodiments, a bispecific antibody binds to ASGR, ASGR-1 or ASGR-2 and PCSK9. In some embodiments, a bispecific antibody will bind to the ASGR-1 CBD and will inhibit ASGR-1 function, in addition to binding to PCSK9 and inhibiting the binding of PCSK9 to the LDLR. Methods of making bispecific antibodies are known in the art. One such method of making a "bispecific," or "bifunctional" antigen binding protein or antibody involves the fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553. Another method involves engineering the Fc portion of the heavy chains such as to create "knobs" and "holes" which facilitate heterodimer formation of the heavy chains when co-expressed in a cell. U.S. Pat. No. 7,695,963. Still another method also involves engineering the Fc portion of the heavy chain but uses electrostatic steering to encourage heterodimer formation while discouraging homodimer formation of the heavy chains when co-expressed in a cell. WO 09/089,004, which is incorporated herein by reference in its entirety.

The term "human antibody" includes antibodies having antibody regions such as variable and constant regions or domains which correspond substantially to human germline immunoglobulin sequences known in the art, including, for example, those described by Kabat et al. (1991) (loc. cit.). The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies can have at least one, two, three, four, five, or more positions replaced with an amino acid residue that is not encoded by the human germline immunoglobulin sequence. The definition of human antibodies as used herein also contemplates fully human antibodies, which include only non-artificially and/or genetically altered human sequences of antibodies as those can be derived by using technologies or systems known in the art, such as for example, phage display technology or transgenic mouse technology, including but not limited to the Xenomouse.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

The term "chimeric antibody" refers to an antibody that contains one or more regions from one antibody and one or more regions from one or more other antibodies. In one embodiment, one or more of the CDRs are derived from a human anti-ASGR, ASGR-1 or ASGR-2 antibody. In another embodiment, all of the CDRs are derived from a human anti-ASGR, ASGR-1 or ASGR-2 antibody. In another embodiment, the CDRs from more than one human anti-ASGR, ASGR-1 or ASGR-2 antibodies are mixed and matched in a chimeric antibody. For instance, a chimeric antibody may comprise a CDR1 from the light chain of a first human anti-ASGR, ASGR-1 or ASGR-2 antibody, a CDR2 and a CDR3 from the light chain of a second human anti-ASGR, ASGR-1 or ASGR-2 antibody, and the CDRs from the heavy chain from a third anti-ASGR, ASGR-1 or ASGR-2 antibody. Further, the framework regions may be derived from one of the same anti-ASGR, ASGR-1 or ASGR-2 antibodies, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody or antibodies from another species or belonging to another antibody class or subclass. Also included are fragments of such antibodies that exhibit the desired biological activity.

A "neutralizing antigen binding protein" or "inhibitory antigen binding protein" or "antagonizing antigen binding protein" (e.g., "neutralizing antibody" or "inhibitory antibody" or "antagonizing antibody") refers to an antigen binding protein or antibody, respectively, that binds to a target molecule and reduces and/or prevents the biological effect of that target molecule. This can be done, for example, by directly blocking a site on the target molecule through which the target molecule interacts with other molecules (e.g. blocking a ligand binding site of a receptor) or by indirectly blocking a site on the target molecule through which the target molecule interacts with other molecules (such as structural or energetic alterations in the target molecule). In some embodiments, these terms can also denote an antigen binding protein or antibody that prevents the target molecule to which it is bound from performing a biological function. In assessing the binding and/or specificity of an antigen binding protein, e.g., an antibody or immunologically functional fragment thereof, an antibody or fragment can substantially inhibit binding of a target molecule to its binding partner when an excess of antibody reduces the quantity of binding partner bound to the target molecule by at least about 1-20, 20-30%, 30-40%, 40-50%, 50-60%, 60-70%, 70-80%, 80-85%, 85-90%, 90-95%, 95-97%, 97-98%, 98-99%, 99.5%, 99.9% and 100%. In some embodiments, inhibition is complete. The measurement of reduction of binding is done using various assays known to those skilled in the art, (e.g., an in vitro competitive binding assay) and performed using relevant control molecules so that actual inhibition is measured. For example, numerous competition assays are well known in the art, with nonlimiting examples being competition ELISA, use of the BiaCore® platform, the Kinexa® platform, or the like. Further examples include: solid phase direct or indirect radioimmunoassay (RA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, *J. Immunol.* 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using I-125 label (see, e.g., Morel et al., 1988, Molec. Immunol. 25:7-15); solid phase direct biotin-avidin EIA (see, e.g., Cheung, et al., 1990, Virology 176:546-552); and direct labeled RIA (Moldenhauer et al., 1990, Scand. J. Immunol. 32:7-82). Typically, such an assay involves the use of purified antigen bound to a solid surface or cells bearing either of these, an unlabelled test antigen binding protein and a labeled reference antigen binding protein. In some embodiments, in the case of ASGR, ASGR-1 and/or ASGR-2, such a neutralizing antigen binding protein or antibody can diminish the ability of ASGR, ASGR-1 and/or ASGR-2 to bind to a ligand. In some embodiments, the neutralizing ability is characterized and/or described via a competition assay. In some embodiments, the neutralizing ability is described in terms of an $IC_{50}$ or $EC_{50}$ value. The antigen binding proteins in at least Table C are strong neutralizers. In some embodiments, the antibodies or antigen binding proteins neutralize by binding to ASGR, ASGR-1 and/or ASGR-2 and preventing ASGR, ASGR-1 and/or ASGR-2 from binding to a ligand, including sugars such as lactose, galactose, and/or GalNAc or glycoproteins displaying such sugars, such as fetuin, orosomucoid and/or alkaline phosphatase (or reducing the ability of ASGR, ASGR-1 and/or ASGR-2 to bind to ligand).

Competitive inhibition can be measured by determining the amount of labelled ligand bound to the solid surface or cells in the presence of the test antigen binding protein. Usually the test antigen binding protein is present in excess. Antigen binding proteins or antibodies identified by competition assay (competing antigen binding proteins or antibodies) include antigen binding proteins binding to the same epitope as the reference antigen binding proteins and antigen binding proteins binding to an adjacent epitope sufficiently proximal to the epitope bound by the reference antigen binding protein for steric hindrance to occur. Usually, when a competing antigen binding protein is present in excess, it will inhibit (e.g., reduce) specific binding of a reference antigen binding protein to a target antigen by at least 40-45%, 45-50%, 50-55%, 55-60%, 60-65%, 65-70%, 70-75% or 75% or more. In some embodiments, binding is inhibited by at least 40%, 45%, 50%, 55%, 60%, 65%, 70%, 75%, 80%, 85%, 90%, or 95%. In some embodiments, binding is inhibited by at least 80-85%, 85-90%, 90-95%, 95-97%, or 97% or more, including up to 100% inhibition.

In some embodiments, a ligand binding assay is used where cells expressing the target protein (e.g., ASGR-1) are mixed with antigen binding proteins and incubated for a time period, then washed. These cells are then incubated with labelled ligand (e.g., β-GalNAc) for a time period and then washed and analyzed for ligand binding, where reduced ligand binding as compared to a relevant control antigen binding protein indicates inhibition of binding due to the antigen binding protein blocking or inhibiting this binding.

Another manner in which the reduction in binding can be measured is the half maximal inhibitory concentration (IC50). The IC50 measures the amount or concentration of antigen binding protein that is needed to inhibit a given attribute (e.g., ligand binding) by half. In certain embodiments, the antigen binding proteins (e.g., human antibodies) have an IC50 value of 90 nM or less, in another embodiment, an IC50 value of 80 nM or less, in another embodiment, 70 nM or less, in another embodiment, 60 nM or less, in another embodiment, 50 nM or less, in another embodiment, 40 nM or less, in another embodiment, 30 nM or less, in another embodiment 25 nM or less.

In certain embodiments, the antigen binding proteins of the invention bind to an ASGR-1 monomer. In some embodiments, the antigen binding proteins of the invention bind to an ASGR-1 oligomer. In further embodiments, the antigen binding proteins of the invention bind to an ASGR-2 monomer. In some embodiments, the antigen binding proteins of the invention bind to an ASGR-2 oligomer. In certain embodiments, the antigen binding proteins of the invention bind to both ASGR-1 monomers and ASGR-2 monomers. In certain embodiments, the antigen binding proteins of the invention bind to an ASGR oligomer comprising an $(ASGR-1)_2$-$(ASGR-2)_1$ trimer. In some embodiments, the antigen binding proteins of the invention bind to an ASGR oligomer comprising an $(ASGR-1)_2$ dimer. In further embodiments, the antigen binding proteins of the invention bind to an ASGR oligomer comprising an $(ASGR-1)_3$ trimer. In yet further embodiments, the antigen binding proteins of the invention bind to an ASGR oligomer comprising an $(ASGR-1)_2$-$(ASGR-2)_2$ tetramer. In further embodiments, the antigen binding proteins of the invention bind to an ASGR oligomer comprising an $(ASGR-1)_3$-$(ASGR-2)_2$ pentamer. In some embodiments, the antigen binding proteins of the invention bind to a multimeric complex comprising at least two subunits of ASGR-1 and/or ASGR-2.

In certain embodiments, the antigen binding proteins (e.g., antibodies, antibody fragments, etc.) bind to ASGR, ASGR-1 and/or ASGR-2 and inhibit ASGR, ASGR-1 and/or ASGR-2 from binding to a ligand, wherein the antigen binding proteins comprise specific amino acid residues at particular positions in the molecule (e.g., in the VH, VL or CDRs). These residues may be involved in the binding properties of desired molecules (e.g., part of the paratope). A "paratope" are used herein is the location in an antibody that binds to the antigen. The paratope can comprise several amino acid residues from the VH and/or VL CDRs, and also can comprise residues from the framework regions. The paratope binds to the antigen's epitope. Paratopes can be determined using methodologies similar to those described determining epitopes. Once the amino acid residues involved in the binding properties of desired molecules, are identified, this information can be used to design antigen binding proteins (e.g., antibodies, antibody fragments, etc.) that can bind to ASGR, ASGR-1 and/or ASGR-2 and inhibit ASGR function (e.g., inhibit ASGR, ASGR-1 and/or ASGR-2 from binding to ligand).

The binding site (or interface) between the representative antibodies and human ASGR-1 can be determined/defined a number of ways. For example, binding of representative antigen binding proteins (e.g., antibodies) to human ASGR-1 was analyzed in Example 10 using X-ray crystallography, and the binding site or interface was determined using distance. The crystal structure of the antibody/huASGR1 complex provides information as to which residues of representative antibodies form the interface with human ASGR-1. As mentioned above, one of ordinary skill in the art may use this information to design antigen binding proteins and antigen binding protein variants, including those that contain variable domains having 90% identity or greater, 95% identity or greater, 97% identity or greater, 99% identity or greater, or those antigen binding protein variants that contain variable domains having 20 or less, 15 or less, or 10 or less, or 5 or less insertions, deletions, and/or substitutions within the light chain and/or heavy chain variable domain of the antigen binding proteins disclosed herein. One may wish to maintain the amino acids within the interface while altering non-interface residues. Thus, in some embodiments, one may design and create antigen binding proteins and antigen binding protein variants of the antigen binding proteins disclosed herein having one or more amino acid additions, substitutions, and/or deletions within one or more CDRs that maintain binding to human ASGR-1 and inhibit ASGR, ASGR-1 and/or ASGR-2 function (e.g., inhibit ASGR, ASGR-1 and or ASGR-2 from binding to ligand).

In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13 or all amino acid residues selected from the group consisting of Q27, R30, D32, H91, Y92, S93, Y94, I2, G28, I29, L33, Q90, P95, and R96 of SEQ ID NO:25010 and/or the heavy chain variable region comprises at least 1, 2, 3, 4, 5, 6, 7, 8, 9, 10, 11, 12, 13, 14, 15, 16, 17, 18, 19, 20, 21, 22, 23 or all amino acid residues selected from the group consisting of S30, N31, W52, Y53, D54, S56, N57, Y59, Y101, S102, S103, G104, W105, Y106, D107, Y32, V33, V50, G55, K58, N74, E99, V100, and Y108 of SEQ ID NO:29016. In some embodiments, the light chain variable region comprises at least 1, 2, 3, 4, 5, 6 or all amino acid residues selected from the group consisting of Q27, R30, D32, H91, Y92, S93, and Y94 of SEQ ID NO:25010 and/or the heavy chain variable region comprises at least 1, 2, 3, 4, 5, 6, 7, 8, 9, 10, 11, 12, 13, 14, or all amino acid residues selected from the group consisting of S30, N31, W52, Y53, D54, S56, N57, Y59, Y101, S102, S103, G104, W105, Y106, and D107 of SEQ ID NO:29016. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15 or all amino acid residues selected from the group consisting of H31, S33, N34, N36, Y38, W56, Y97, Y98, I29, S32, N35, N37, Y55, T59, Q96, N99, T100 of SEQ ID NO:25164 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26 or all amino acid residues selected from the group consisting of T28, F29, T30, N31, Y32, D33, W50, H52, S55, N57, S99, S100, G101, W102, Y103, Y27, I34, N35, W47, M51, P53, N54, G56, T58, G59, Y104, D106 of SEQ ID NO:29170. In some embodiments, the light chain variable region comprises at least 1, 2, 3, 4, 5, 6, 7 or all amino acid residues selected from the group consisting H31, S33, N34, N36, Y38, W56, Y97, Y98 of SEQ ID NO:25164 and/or the heavy chain variable region comprises at least 1, 2, 3, 4, 5, 6, 7, 8, 9, 10, 11, 12, 13, 14, or all amino acid residues selected from the group consisting of T28, F29, T30, N31, Y32, D33, W50, H52, S55, N57, S99, S100, G101, W102, Y103 of SEQ ID NO:29170. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18 or all amino acid residues selected from the group consisting of I30, Y32, T91, Y92, S93, T94, I96, I2, Q27, N28, I29, S31, L33, N34, T50, S67, Q89, Q90, P95 of SEQ ID NO:24908 and/or the heavy chain variable region comprises at least 1, 2, 3, 4, 5, 6, 7, 8, 9, 10, 11, 12, 13, 14, 15, 16, 17, 18, 19, 20, 21, 22 or all amino acid residues selected from the group consisting of S30, S31, I50, W52, H53, S56, N57, Y59, S01, M102, G103, T28, F29, F32, G33, H35, W47, I51, D54, K58, D99, L100, G104 of SEQ ID NO:28914. In some embodiments, the light chain variable region comprises at least 1, 2, 3, 4, 5, 6 or all amino acid residues selected from the group consisting I30, Y32, T91, Y92, S93, T94, I96 of SEQ ID NO:24908 and/or the heavy chain variable region comprises at least 1, 2, 3, 4, 5, 6, 7, 8, 9, 10 or all amino acid residues selected from the group consisting of S30, S31, I50, W52, H53, S56, N57, Y59, S01, M102, G103 of SEQ ID NO:28914. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15 or all amino acid residues selected from the group consisting of Y32, S91, Y92, R93, Thr94, Pro95, F97, Ile2, Q27, N28, NAG100, Ile29, S30, S31, Q90, and L96 of SEQ ID NO:24362 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27 or all amino acid residues selected from the group consisting of A33, Val50, Ile51, S52, R53, S54, G55, G56, Y57, Y59, R99, A101, A103, G104, E106, S30, S31, Y32, Met34, N35, W47, S49, Thr58, R72, N74, L100, Val102, and S105 of SEQ ID NO:28368. In some embodiments, the light chain variable region comprises at least 1, 2, 3, 4, 5, 6, or all amino acid residues selected from the group consisting of Y32, S91, Y92, R93, Thr94, Pro95, and F97 of SEQ ID NO:24362, and/or the heavy chain variable region comprises at least 1, 2, 3, 4, 5, 6, 7, 8, 9, 10, 11, 12, 13, 14, or all amino acid residues selected from the group consisting of A33, Val50, Ile51, S52, R53, S54, G55, G56, Y57, Y59, R99, A101, A103, G104, and E106 of SEQ ID NO:28368. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17 or all amino acid residues selected from the group consisting of Q27, W32, A91, N92, S93, F94, F96, D1, I2, G28, I29, S30, R31, Y49, G50, Q89, Q90, and P95 of SEQ ID NO:24930 and/or the heavy chain variable region comprises at least 1, 2, 3, 4, 5, 6, 7, 8, 9, 10, 11, 12, 13, 14, 15, 16, 17, 18, 19, 20, 21, 22 or all amino acid residues selected from the group consisting of Y33, H35, W50, H52, S55, G57, T58, N59, D99, G100, T101, S102, D31, Y32, L34, W47, I51, N54, G56, Y60, Q65, S103, and F104 of SEQ ID NO:28936. In some embodiments, the light chain variable region comprises at least 1, 2, 3, 4, 5, 6 or all amino acid residues selected from the group consisting of Q27, W32, A91, N92, S93, F94, and F96 of SEQ ID NO:24930 and/or the heavy chain variable region comprises at least 1, 2, 3, 4, 5, 6, 7, 8, 9, 10, 11 or all amino acid residues selected from the group consisting of Y33, H35, W50, H52, S55, G57, T58, N59, D99, G100, T101, and S102 of SEQ ID NO:28936. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residue selected from the group consisting of Y32, Y49, T50, Q55, S91, H92, S93, F94, F96, S28, I29, T30, N33, L46, S53, L54, S56, Q89, Q90, and P95 of SEQ ID NO:28074 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27, 28 or all amino acid residues selected from the group consisting of G26, F27, T28, S30, S31, Y32, S33, S52, G53, S54, S56, Y57, Y59, R98, G100, S101, R102, V2, F29, N35, S50, T51, S55, I58, R72, G99, G103, F104 and D105 of SEQ ID NO:32080. In some embodiments, the light chain variable region comprises at least 1, 2, 3, 4, 5, 6, 7, 8 or all amino acid residues selected from the group consisting of Y32, Y49, T50, Q55, S91, H92, S93, F94, and F96 of SEQ ID NO:28074 and/or heavy chain variable region comprises at least 1, 2, 3, 4, 5, 6, 7, 8, 9, 10, 11, 12, 13, 14, 15, 16 or all amino acid residues selected from the group consisting of G26, F27, T28, S30, S31, Y32, S33, S52, G53, S54, S56, Y57, Y59, R98, G100, S101 and R102 of SEQ ID NO:32080. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19, 20, 21 or all amino acid residues selected from the group consisting of V29, S30, I32, Y33, L47, Y50, R55, A56, T57, Y94, G28, N31, L48, I49, G51, N54, G58, I59, S68, G69, D93, and S95 of SEQ ID NO:26814 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25 or all amino acid residues selected from the group consisting of V31, Y32, Y33, W50, N52, S55, G57, R98, G99, Y100, D101, I102, T204, V2, Y27, T30, L34, N35, P53, N54, G56, T58, N59, A97, L103, and G105 of SEQ ID NO:30820. In some embodiments, the light chain variable region comprises at least 1, 2, 3, 4, 5, 6, 7, 8, 9, or all amino acid residues selected from the group consisting of V29, S30, I32, Y33, L47, Y50, R55, A56, T57, and Y94 of SEQ ID NO:26814 and/or heavy chain variable region comprises at least 1, 2, 3, 4, 5, 6, 7, 8, 9, 10, 11, 12 or all amino acid residues selected from the group consisting of V31, Y32, Y33, W50, N52, S55, G57, R98, G99, Y100, D101, I102, and T204 of SEQ ID NO:30820. In some embodiments, the antigen binding protein or the antibody comprises a light chain variable region and/or a heavy chain variable region, wherein the light chain variable region comprises at least 1, 2, 3 or all amino acid residues selected from the group consisting of N31, Y50, V51, Q54 SEQ ID NO:27482; and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25, 26, 27 or all amino acid residues selected from the group consisting of N30, S31, Y32, S52, Y54, N55, K59, R98, D100, F101, W102, S103, G104, Y105, K107, D110, V2, Y27, T28, F29, G33, W50, A53, G56, N57, H99, Y106, or G108 of SEQ ID NO:31488. In some embodiments, the antigen binding protein or the antibody comprises a light chain variable region and/or a heavy chain variable region, wherein the heavy chain variable region comprises at least 1, 2, 3, 4, 5, 6, 7, 8, 9, 10, 11, 12, 13, 14, 15, or all amino acid residues selected from the group consisting of N30, S31, Y32, S52, Y54, N55, K59, R98, D100, F101, W102, S103, G104, Y105, K107, and D110 of SEQ ID NO:31488. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, or all amino acid residues selected from the group consisting of Y33, Y50, D51, N53, K54, S57, V34, S52, R55, P56, G58, and G65 of SEQ ID NO:27780 and/or the heavy chain variable region comprises at least 1, 2, 3, 4, 5, 6, 7, 8, 9, 10, 11, 12, 13, 14, 15, 16, 17, 18, 19, 20, 21, 22, 23, 24, 25 or all amino acid residues selected from the group consisting of Q1, V2, F27, S30, S31, Y32, Y53, D54, W99, Y100, Y101, Y102, G26, T28, F29, G33, W52, G55, R72, N74, N98, Y103, Y104, D107, and V108 of SEQ ID NO:31786. In some embodiments, the light chain variable region comprises at least 1, 2, 3, 4, 5 or all amino acid residues selected from the group consisting of Y33, Y50, D51, N53, K54 and S57 of SEQ ID NO:27780 and/or heavy chain variable region comprises at least 1, 2, 3, 4, 5, 6, 7, 8, 9, 10, 11 or all amino acid residues selected from the group consisting of Q1, V2, F27, S30, S31, Y32, Y53, D54, W99, Y100, Y101, and Y102 of SEQ ID NO:31786. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residues selected from the group consisting of H31, G32, D33, G34, K35, Y37, I97, Q98, I99, I2, Q27, S28, L29, L30, T36, E55, Q95, S96, P100, and W101 of SEQ ID NO:26536 and/or the heavy chain variable region comprises at least 1, 2, 3, 4, 5, 6, 7, 8, 9, 10, 11, 12, 13, 14, 15, 16, 17, 18, 19, 20, 21, 22, 23 or all amino acid residues selected from the group consisting of S31, W52, Y53, D54, Y57, Y59, D102, F103, W104, T28, S30, Y32, G33, W47, I50, I51, S56, K58, Y60, K65, D99, H101, S105, and G106 of SEQ ID NO:30542. In some embodiments, the light chain variable region comprises at least 1, 2, 3, 4, 5, 6, 7, 8 or all amino acid residues selected from the group consisting of H31, G32, D33, G34, K35, Y37, I97, Q98, and I99 of SEQ ID NO:26536 and/or heavy chain variable region comprises at least 1, 2, 3, 4, 5, 6, 7, 8 or all amino acid residues selected from the group consisting of S31, W52, Y53, D54, Y57, Y59, D102, F103 and W104 of SEQ ID NO:30542. In some embodiments, the antigen binding protein or the antibody comprises a light chain variable region and/or a heavy chain variable region, wherein the light chain variable region comprises at least 1, 2, 3, 4, 5, 6, 7, 8, 9, 10, 11, 12, 13, 14, 15, 16, 17, 18, 19 or all amino acid residues selected from the group consisting of N30, S31, Y33, F50, S54, S68, Y92, E93, W97, S28, V29, G32, L47, G51, A52, S53, R55, A56, G69, Q90, Q91, S94, and S95 of SEQ ID NO:26826 and/or the heavy chain variable region comprises at least 1, 2, 3, 4, 5, 6, 7, 8, 9, 10, 11, 12, 13, 14, 15, 16, 17, 18, 19, 20, 21, 22, 23, 24 or all amino acid residues selected from the group consisting of R30, Y31, Y33, E50, S54, S56, N58, D98, Y99, G100, S28, Y32, W34, S35, W47, G49, I51, S52, H53, G55, T57, R97, A101, F102 and D103 of SEQ ID NO:30832. In some embodiments, the light chain variable region comprises at least 1, 2, 3, 4, 5, 6, 7, 8 or all amino acid residues selected from the group consisting of N30, S31, Y33, F50, S54, S68, Y92, E93, and W97 of SEQ ID NO:26826 and/or heavy chain variable region comprises at least 1, 2, 3, 4, 5, 6, 7, 8, 9 or all amino acid residues selected from the group consisting of R30, Y31, Y33, E50, S54, S56, N58, D98, Y99 and G100 of SEQ ID NO:30832.

In further embodiments, consensus sequences among the antigen binding proteins of the inventions are envisioned. For example, the variable heavy chain and variable light chain regions (VH and VL) and the CDRs (HCDR1/2/3 and LCDR1/2/3) of the invention include consensus sequences derived from groups of related monoclonal antibodies. In some embodiments, the antigen binding proteins (e.g., antibodies) may be related by both sequence homology and function. As described herein, a "consensus sequence" refers to amino acid sequences having conserved amino acids common among a number of sequences and amino acids that vary within given amino acid sequences at certain positions. In some embodiments, the varied amino acid at a certain position is a substitution. In some embodiments, the varied amino acid at a certain position is a deletion. In some embodiments, the varied amino acid at a certain position is an addition or insertion. These varied amino acids will be apparent to one of skill in the art when analyzing particular antibody VH, VL and/or CDR sequences.

For example, antibody sequences were analyzed using the following methodology. The Smith-Waterman algorithm was used to align amino acid sequences against translated IMGT germline V, D and J genes. The V gene was located first, then the J gene was located in the region downstream from located V gene, and finally the D gene was located in the region between V and J regions. Note, that since D gene is a relatively short sequence that is located in the hypervariable CDR3 region, a spurious match is possible and as such, was taken into consideration.

Sequences from each group were then subjected to sequence similarity alignment interrogation using a program that employs a standard ClustalW algorithm (see, Thompson et al., 1994, Nucleic Acids Res. 22:4673-4680). In some cases, the Biosum cost matrix was used with a gap creation penalty of 50 was employed along with a gap extension penalty of 0.1. The sequence logos were generated by Geneious (v8.1.7, Biomatters) once the alignments were made and then exported as PDF images. The consensus sequences were generated in Geneious (v8.1.7, Biomatters) with a 0% threshold and exported as FASTA files. Amino acids that varied within each group were noted with the notation X within each consensus sequence. See Table 19A VH Consensus 1-14 and Table 20A VL Consensus 1-14 in FIG. 55, and Tables 21-48 in FIG. 56 for the consensus sequences resulting from this analysis. In other cases, the consensus sequences were generated in Abinitio. See Table 19A VH Consensus-15-60 and Table 20A VL Consensus 15-54 in FIG. 55, and Tables 49-134 in FIG. 57 for the consensus sequences resulting from this analysis.

Alternatively, different methods of analysis readily available to one of skill in the art can be used. For example, consensus sequences can be determined using standard phylogenetic analyses of the CDRs corresponding to the VH (i.e., Variable Heavy, etc.) & VL (i.e., Variable Light, etc.) of antibodies. For example, amino acid sequences corresponding to the entire variable domains of either VH or VL can be converted to FASTA formatting for ease in processing comparative alignments and inferring phylogenies. Next, framework regions of these sequences can be replaced with an artificial linker sequence so that examination of the CDRs alone can be performed without introducing any amino acid position weighting bias due to coincident events (e.g., such as unrelated antibodies that serendipitously share a common germline framework heritage) while still keeping CDRs contiguous within the same sequence corresponding to a VH or VL. VH or VL sequences of this format can then be subjected to sequence similarity alignment interrogation using a program that employs a standard ClustalW-like algorithm (see, Thompson et al., 1994, Nucleic Acids Res. 22:4673-4680). A gap creation penalty of 8.0 can be employed along with a gap extension penalty of 2.0. This program likewise generated phylograms (phylogenetic tree illustrations) based on sequence similarity alignments using either UPGMA (unweighted pair group method using arithmetic averages) or Neighbor-Joining methods (see, Saitou and Nei, 1987, Molecular Biology and Evolution 4:406-425) to construct & illustrate similarity and distinction of sequence groups via branch length comparison and grouping. The original sequence alignments generated can be employed to empirically examine and document the occurrence of amino acids tolerated at each position with a consensus group. Consensus sequences for the groups of similar sequences within each CDR can then be prepared.

In another type of approach, CDR consensus sequences can be determined for each separate CDR, independently of their contiguous context within the same sequence corresponding to a VH or VL. In this approach the consensus sequences can be determined by aligning each H-CDR1, H-CDR2, H-CDR3, L-CDR1, L-CDR2, and L-CDR3 in groups, i.e., by aligning the individual H-CDR1 sequences of the antigen binding proteins to determine a H-CDR1 consensus sequence, by aligning the individual H-CDR2 sequences of the antigen binding proteins to determine a H-CDR2 consensus sequence, by aligning the individual H-CDR3 sequences of the antigen binding proteins to determine a H-CDR3 consensus sequence, by aligning the individual L-CDR1 sequences of the antigen binding proteins to determine a L-CDR1 consensus sequence, by aligning the individual L-CDR2 sequences of the antigen binding proteins to determine a L-CDR2 consensus sequence, and by aligning the individual L-CDR3 sequences of the antigen binding proteins to determine a L-CDR3 consensus sequence. Similarities between sequences within each individual CDR sequences can be identified. Consensus sequences for the groups of similar sequences within each CDR can then be prepared.

Various embodiments of Variable Heavy chain (VH) Consensus amino acid sequences of the present invention are set forth in Table 19A of FIG. 55 (CDRs are underlined, with the first being CDR1). Various embodiments of VH CDR Consensus amino acid sequences of the present invention are set forth in Tables 19B and 19C of FIG. 55. In some cases, an "X" is present in the amino acid sequences set forth in Tables 19A and 19B which signifies that more than one amino acid (or no amino acid) may be present at this location (see FIGS. 56 and 57 for details of the consensus protein alignment). In some cases a "-" is present in Table 19A (which is the result of the consensus alignment) and signifies that no amino acid is present at the location (see FIGS. 56 and 57 for details of the consensus protein alignment). The VH Consensus sequences and the VH CDR Consensus sequences are based on analysis of 8 or more aligned VH/VH CDR antibody sequences, as described above. In some cases, the VH/VH CDR Consensus sequence is based on analysis of 25 or more, 50 or more, 75 or more, or 100 or more aligned VH antibody sequences. In one case, the VH/VH CDR Consensus sequence is based on analysis of 149 aligned VH antibody sequences.

Various embodiments of Variable Light chain (VL) Consensus amino acid sequences of the present invention are set forth in Table 20A of FIG. 55 (CDRs are underlined, with the first being CDR1). Various embodiments of VL CDR Consensus amino acid sequences of the present invention are set forth in Tables 20B and 20C of FIG. 55. As mentioned above, in some cases, an "X" is present in the amino acid sequences set forth in Tables 20A and 20B which signifies that more than one amino acid (or no amino acid) may be present at this location (see FIGS. 56 and 57 for details of the consensus protein alignment). In some cases a "-" is present in Table 20A (which is the result of the consensus alignment) and signifies that no amino acid is present at the location (see FIGS. 56 and 57 for details of the consensus protein alignment). The VL Consensus sequences and the VL CDR Consensus sequences are based on analysis of 8 or more aligned VL/VL CDR antibody sequences, as described above. In some cases, the VL/VL CDR Consensus sequence is based on analysis of 25 or more, 50 or more, 75 or more, or 100 or more, 125 or more, or 150 or more aligned VL antibody sequences. In one case, the VL/VL CDR Consensus sequence is based on analysis of 209 aligned VL antibody sequences.

As discussed above, the consensus sequences in certain embodiments can comprise substitutions, deletions, or additions/insertions at different positions in the sequence. Specific examples of these substitutions, deletions, or additions/insertions can be found in Tables 19C and 20C of FIG. 55, as well as Tables 21-48 of FIG. 56 and Tables 49-134 of FIG. 57, all of which are included herein. However, in no way should the amino acid substitutions, deletions, or additions/insertions exemplified in Tables 19A-C and 20A-C in FIG. 55 or in Tables 21-48 in FIG. 56 or in Tables 49-134 in FIG. 57 be construed to limit the invention to only those amino acid substitutions, deletions, or additions at any position in the identified consensus sequences (VH, VL and/or CDRs) with any amino acid is contemplated herein.

In certain embodiments, the antigen binding proteins of the invention comprise 3 VH CDRs and 3 VL CDRs, wherein at least one VH CDR is a VH1 CDR selected from Table 19B or Table 19C as depicted in FIG. 55. In certain embodiments, the antigen binding proteins of the invention comprise 3 VH CDRs and 3 VL CDRs, wherein at least one VH CDR is a VH2 CDR selected from Table 19B or Table 19C as depicted in FIG. 55. In certain embodiments, the antigen binding proteins of the invention comprise 3 VH CDRs and 3 VL CDRs, wherein at least one VH CDR is a VH3 CDR selected from Table 19B or Table 19C as depicted in FIG. 55. In certain embodiments, the antigen binding proteins of the invention comprise 3 VH CDRs and 3 VL CDRs, wherein the VH1 CDR, the VH2 CDR and the VH3 CDR is selected from Table 19B or Table 19C as depicted in FIG. 55.

In certain embodiments, the antigen binding proteins of the invention comprise 3 VH CDRs and 3 VL CDRs, wherein at least one VL CDR is a VL1 CDR selected from Table 20B or Table 20C as depicted in FIG. 55. In certain embodiments, the antigen binding proteins of the invention comprise 3 VH CDRs and 3 VL CDRs, wherein at least one VL CDR is a VL2 CDR selected from Table 20B or Table 20C as depicted in FIG. 55. In certain embodiments, the antigen binding proteins of the invention comprise 3 VH CDRs and 3 VL CDRs, wherein at least one VL CDR is a VL3 CDR selected from Table 20B or Table 20C as depicted in FIG. 55. In certain embodiments, the antigen binding proteins of the invention comprise 3 VH CDRs and 3 VL CDRs, wherein the VL1 CDR, the VL2 CDR and the VL3 CDR is selected from Table 20B or Table 20C as depicted in FIG. 55.

In some embodiments, antigen binding proteins comprise no more than one, two, three, four, five, or six amino acid additions, deletions or substitutions of a VH. In some embodiments, antigen binding proteins comprise no more than one, two, three, four, five, or six amino acid additions, deletions or substitutions of a VL. In further embodiments, antigen binding proteins comprise no more than one, two, three, four, five, or six amino acid additions, deletions or substitutions within a VH1 CDR. In further embodiments, antigen binding proteins comprise no more than one, two, three, four, five, or six amino acid additions, deletions or substitutions within a VH2 CDR. In further embodiments, antigen binding proteins comprise no more than one, two, three, four, five, or six amino acid additions, deletions or substitutions within a VH3 CDR. In further embodiments, antigen binding proteins comprise no more than one, two, three, four, five, or six amino acid additions, deletions or substitutions within a VL1 CDR. In further embodiments, antigen binding proteins comprise no more than one, two, three, four, five, or six amino acid additions, deletions or substitutions within a VL2 CDR. In further embodiments, antigen binding proteins comprise no more than one, two, three, four, five, or six amino acid additions, deletions or substitutions within a VL3 CDR.

In some embodiments, antigen binding proteins comprise no more than one, two, three, four, five, or six amino acid additions, deletions or substitutions of a VH consensus sequence. In some embodiments, antigen binding proteins comprise no more than one, two, three, four, five, or six amino acid additions, deletions or substitutions of a VL consensus sequence. In further embodiments, antigen binding proteins comprise no more than one, two, three, four, five, or six amino acid additions, deletions or substitutions within a VH1 CDR Consensus sequence. In further embodiments, antigen binding proteins comprise no more than one, two, three, four, five, or six amino acid additions, deletions or substitutions within a VH2 CDR Consensus sequence. In further embodiments, antigen binding proteins comprise no more than one, two, three, four, five, or six amino acid additions, deletions or substitutions within a VH3 CDR Consensus sequence. In further embodiments, antigen binding proteins comprise no more than one, two, three, four, five, or six amino acid additions, deletions or substitutions within a VL1 CDR Consensus sequence. In further embodiments, antigen binding proteins comprise no more than one, two, three, four, five, or six amino acid additions, deletions or substitutions within a VL2 CDR Consensus sequence. In further embodiments, antigen binding proteins comprise no more than one, two, three, four, five, or six amino acid additions, deletions or substitutions within a VL3 CDR Consensus sequence.

In some embodiments, framework consensus sequences are encompassed by the present invention. Examples of these framework consensus sequences and additions, deletions or substitutions are shown in Tables 21-48 in FIG. 56 and Tables 49-134 in FIG. 57 herein.

In a further embodiment, the antigen binding proteins of the invention bind to ASGR of different species, including, but not limited to, human, cynomolgus, porcine, canine, murine and rat. In some embodiments, the antigen binding proteins of the invention bind to human. In some embodiments, the antigen binding proteins of the invention bind to cynomolgus ASGR. In some embodiments, the antigen binding proteins of the invention bind to porcine ASGR. In some embodiments, the antigen binding proteins of the invention bind to canine ASGR. In some embodiments, the antigen binding proteins of the invention bind to murine ASGR. In some embodiments, the antigen binding proteins of the invention bind to rat ASGR. In some embodiments, the antigen binding proteins specifically bind to ASGR of the different species.

In some embodiments, the antigen binding proteins of the invention bind to ASGR-1 of different species, including, but not limited to, human, cynomolgus, porcine, canine, murine and rat. In some embodiments, the antigen binding proteins of the invention bind to human ASGR-1. In some embodiments, the antigen binding proteins of the invention bind to cynomolgus ASGR-1. In some embodiments, the antigen binding proteins of the invention bind to porcine ASGR-1. In some embodiments, the antigen binding proteins of the invention bind to canine ASGR-1. In some embodiments, the antigen binding proteins of the invention bind to murine ASGR-1. In some embodiments, the antigen binding proteins of the invention bind to rat ASGR-1. In some embodiments, the antigen binding proteins specifically bind to ASGR-1 of the different species.

In some embodiments, the antigen binding proteins of the invention binds to ASGR-2 of different species, including, but not limited to, human, cynomolgus, porcine, canine, murine and rat. In some embodiments, the antigen binding proteins of the invention bind to human ASGR-2. In some embodiments, the antigen binding proteins of the invention bind to cynomolgus ASGR-2. In some embodiments, the antigen binding proteins of the invention bind to porcine ASGR-2. In some embodiments, the antigen binding proteins of the invention bind to canine ASGR-2. In some embodiments, the antigen binding proteins of the invention bind to murine ASGR-2. In some embodiments, the antigen binding proteins of the invention bind to rat ASGR-2. In some embodiments, the antigen binding proteins specifically bind to ASGR-2 of the different species.

In some embodiments, the antigen binding proteins of the invention bind to ASGR, ASGR-1 and/or ASGR-2 from two or more different species, and/or bind ASGR, ASGR-1 and/or ASGR-2 from the same species. For example, but not limited to: an antibody that binds human and cynomolgus ASGR-1; an antibody that binds to human, cynomolgus and porcine ASGR-1; an antibody that binds to human, cynomolgus, rat and murine ASGR-2; an antibody that binds human ASGR-1 and human ASGR-2; an antibody that binds human and cynomolgus ASGR-1 and ASGR-2. In some embodiments, the antigen binding proteins specifically bind to ASGR, ASGR-1 and/or ASGR-2 from two or more different species and/or specifically bind ASGR, ASGR-1 and/or ASGR-2 from the same species.

As discussed herein, the ASGR receptor, and ASGR-1 and/or ASGR-2 separately, internalize into the cell upon ligand binding. Accordingly, in certain embodiments, the invention provides antigen binding proteins that inhibit or reduce internalization of ASGR, ASGR-1 and/or ASGR-2. In certain embodiments, the antigen binding proteins of the invention reduce ligand binding and also inhibit internalization of ASGR, ASGR-1 and/or ASGR-2. In some embodiments, the antigen binding proteins of the invention inhibit internalization without necessarily inhibiting ligand binding.

In some embodiments, the antigen binding proteins (e.g., antibodies) of the invention are pH and/or calcium insensitive molecules, as well as binding to ASGR, ASGR-1 and/or ASGR-2 and inhibiting the binding to a ligand. It is envisioned that these properties are desired to reduce or prevent the molecule from disassociating from the receptor during the endocytotic process in order to extend the half-life of the molecule. In some embodiments, the antigen binding proteins (e.g., antibodies) with pH-independent binding to its antigen such that the affinity for the antigen binding at physiological pH (i.e., pH 7.4) is similar to that at endosomal pH (i.e., pH 5.5-6.0). In some embodiments, the antigen binding proteins (e.g., antibodies) with calcium-independent binding to its antigen such that the affinity for the antigen binding at assay conditions (i.e., 1 mM calcium) is similar to that in the absence of exogenously added calcium. In some embodiments, the antigen binding proteins with both pH- and calcium-independent binding to its antigen such that the affinity for the antigen binding at physiologic pH and in the presence of calcium is similar to that at endosomal pH (i.e., pH 5.5-6.0) and in the absence of calcium. Any number of methods known to one skilled in the art can be used to measure pH and/or calcium insensitivity, such as the method described in Example 7C below.

ASGR-1, an asialoglycoprotein receptor, contains an N-term cytosolic domain, a transmembrane domain, a stalk region and a carbohydrate recognition domain (CRD) (alternatively known as the carbohydrate binding domain, or "CBD"). The carbohydrate recognition domain ("CRD") structure of ASGR-1 is reported in literature (M. Meier et al, JMB (2000)300, 857-865). The structure of ASGR-1 at a higher resolution than reported, and also when bound to various ligands (e.g., sugars including but not limited to lactose, galactose, and/or GalNAc or glycoproteins displaying such sugars including but not limited to fetuin, orosomucoid and/or alkaline phosphatase) is provided herein (see Example 10 and FIGS. 18-21 herein). Given the importance of this domain to the function of ASGR-1, in some embodiments, it is desirable to target this domain with the antigen binding proteins of the present invention.

Accordingly, in some embodiments, the antigen binding proteins of the invention bind to the CBD of ASGR-1. In certain embodiments, the antigen binding proteins of the invention bind to the CBD of human ASGR-1. In certain embodiments, the antigen binding proteins of the invention bind to the CBD of SEQ ID NO:5. In some embodiments, the antigen binding proteins of the invention bind to amino acid residues selected from the group consisting of 148-291, 149-291, 150-291, 151-291, 152-291, 153-291, and 154-291 of SEQ ID NO:5. In some embodiments, the invention comprises an isolated antigen binding protein that binds to human ASGR-1 CBD within Helix α-1 or Helix α-2. In some embodiments, the invention comprises an isolated antigen binding protein that binds to human ASGR-1 CBD within residues 174-186 of SEQ ID NO:5. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 CBD at the same or overlapping binding site as where a ligand binds (e.g., sugars including but not limited to lactose, galactose, and/or GalNAc or glycoproteins displaying such sugars including but not limited to fetuin, orosomucoid and/or alkaline phosphatase or other sugars and glycoproteins capable of binding to ASGR, ASGR-1, and/or ASGR-2). In some embodiments, the invention comprises an isolated antigen binding protein that binds to human ASGR-1 CBD within residues 237-273 or residues 240-267 of SEQ ID NO:5. In some embodiments, the antigen binding proteins of the invention bind to the CBD of cynomolgus ASGR-1. In some embodiments, the antigen binding proteins of the invention bind to the CBD of porcine ASGR-1. In some embodiments, the antigen binding proteins of the invention bind to the CBD of canine ASGR-1. In some embodiments, the antigen binding proteins of the invention bind to the CBD of murine ASGR-1. In yet some embodiments, the antigen binding proteins of the invention bind to the CBD of rat ASGR-1. In yet some embodiments, the antigen binding proteins of the invention bind to the CBD of two or more different ASGR-1 species, for example, but not limited to, human ASGR-1 and cynomolgus ASGR-1, or human ASGR-1, cynomolgus ASGR-1 and canine ASGR-1, or human ASGR-1 and murine ASGR-1.

In further embodiments, the antigen binding proteins of the invention bind to ASGR-1 and inhibit binding of ligand to ASGR-1. In a specific embodiment, the ligands that are inhibited include, but are not limited to, sugars including but not limited to lactose, galactose, and/or GalNAc or glycoproteins displaying such sugars including but not limited to fetuin, orosomucoid and/or alkaline phosphatase or other sugars and glycoproteins capable of binding to ASGR, ASGR-1, and/or ASGR-2.

The tyrosine at position 272 of murine ASGR-1 (position 273 of human ASGR-1 (SEQ ID NO:5)) appears to be important for protein stability, as it displays hydrogen bonding to D266 of murine ASGR-1 and several van der Waals contacts to other residues of murine ASGR-1 (N208, W210, H256, and R270). Additionally, by analogy with other lectins, Y272 of murine ASGR-1 may play a role in carbohydrate binding and function of ASGR-1. Accordingly, in some embodiments, the antigen binding proteins of the invention bind to or interact with Y273 of human ASGR-1. In some embodiments, the antigen binding proteins of the invention bind to ASGR-1 at an epitope that comprises Y273 of human ASGR-1. In some embodiments, the antigen binding proteins of the invention bind to ASGR-1 at an epitope that results in Y273 of human ASGR-1 being unable to take part in binding ligand.

Analysis of the crystal structure of hASGR-1 revealed specific amino acids that are involved in the interaction between hASGR-1 and the ligands (e.g., sugars including but not limited to lactose, galactose, and/or GalNAc or glycoproteins displaying such sugars including but not limited to fetuin, orosomucoid and/or alkaline phosphatase). Accordingly, in further embodiments, the antigen binding proteins of the invention bind to or interact with at least one of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least one of Q240, D242, W244, E253, N265, D266, D267, N209, R237, P238, E239, P241, D243, Y245, G246, H247, G252, C255, H257, T259, D260, V268, R271, Y273, F258, R263, or W264. In further embodiments, the antigen binding proteins of the invention bind to hASGR-1and block or reduce the binding or interaction of at least one of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase).

In further embodiments, the antigen binding proteins of the invention bind to or interact with at least one of Q240, D242, W244, E253, N265, D266, D267, R237, P238, H257, T259, or Y273. In some embodiments, the antigen binding proteins of the invention bind at an epitope comprising at least one of Q240, D242, W244, E253, N265, D266, D267, R237, P238, H257, T259, or Y273. In further embodiments, the antigen binding proteins of the invention bind to hASGR-1 and block or reduce the binding or interaction of at least one of Q240, D242, W244, E253, N265, D266, D267, R237, P238, H257, T259, or Y273 with a ligand (e.g., sugars including but not limited to lactose, galactose, and/or GalNAc or glycoproteins displaying such sugars including but not limited to fetuin, orosomucoid and/or alkaline phosphatase).

In some embodiments, the antigen binding proteins of the invention bind to or interact with at least two of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least three of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least four of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least five of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least six of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least seven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eight of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least nine of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least ten of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind to or interact with at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264.

In some embodiments, the antigen binding proteins of the invention bind to or interact with at least two of Q240, D242, W244, E253, N265, D266, D267, R237, P238, H257, T259, or Y273. In some embodiments, the antigen binding proteins of the invention bind to or interact with at least three of Q240, D242, W244, E253, N265, D266, D267, R237, P238, H257, T259, or Y273. In some embodiments, the antigen binding proteins of the invention bind to or interact with at least four of Q240, D242, W244, E253, N265, D266, D267, R237, P238, H257, T259, or Y273. In some embodiments, the antigen binding proteins of the invention bind to or interact with at least five of Q240, D242, W244, E253, N265, D266, D267, R237, P238, H257, T259, or Y273. In some embodiments, the antigen binding proteins of the invention bind to or interact with at least six of Q240, D242, W244, E253, N265, D266, D267, R237, P238, H257, T259, or Y273. In some embodiments, the antigen binding proteins of the invention bind to or interact with at least seven of Q240, D242, W244, E253, N265, D266, D267, R237, P238, H257, T259, or Y273. In some embodiments, the antigen binding proteins of the invention bind to or interact with at least eight of Q240, D242, W244, E253, N265, D266, D267, R237, P238, H257, T259, or Y273. In some embodiments, the antigen binding proteins of the invention bind to or interact with at least nine of Q240, D242, W244, E253, N265, D266, D267, R237, P238, H257, T259, or Y273. In some embodiments, the antigen binding proteins of the invention bind to or interact with at least ten of Q240, D242, W244, E253, N265, D266, D267, R237, P238, H257, T259, or Y273. In some embodiments, the antigen binding proteins of the invention bind to or interact with at least eleven of Q240, D242, W244, E253, N265, D266, D267, R237, P238, H257, T259, or Y273. In some embodiments, the antigen binding proteins of the invention bind to or interact with at least all of Q240, D242, W244, E253, N265, D266, D267, R237, P238, H257, T259, or Y273.

In some embodiments, the antigen binding proteins of the invention bind at an epitope comprising at least two of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least three of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least four of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least five of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least six of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least seven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eight of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least nine of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least ten of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264. In some embodiments, the antigen binding proteins of the invention bind at an epitope comprising at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264.

In some embodiments, the antigen binding proteins of the invention bind at an epitope comprising at least two of Q240, D242, W244, E253, N265, D266, D267, R237, P238, H257, T259, or Y273. In some embodiments, the antigen binding proteins of the invention bind at an epitope comprising at least three of Q240, D242, W244, E253, N265, D266, D267, R237, P238, H257, T259, or Y273. In some embodiments, the antigen binding proteins of the invention bind at an epitope comprising at least four of Q240, D242, W244, E253, N265, D266, D267, R237, P238, H257, T259, or Y273. In some embodiments, the antigen binding proteins of the invention bind at an epitope comprising at least five of Q240, D242, W244, E253, N265, D266, D267, R237, P238, H257, T259, or Y273. In some embodiments, the antigen binding proteins of the invention bind at an epitope comprising at least six of Q240, D242, W244, E253, N265, D266, D267, R237, P238, H257, T259, or Y273. In some embodiments, the antigen binding proteins of the invention bind at an epitope comprising at least seven of Q240, D242, W244, E253, N265, D266, D267, R237, P238, H257, T259, or Y273. In some embodiments, the antigen binding proteins of the invention bind at an epitope comprising at least eight of Q240, D242, W244, E253, N265, D266, D267, R237, P238, H257, T259, or Y273. In some embodiments, the antigen binding proteins of the invention bind at an epitope comprising at least nine of Q240, D242, W244, E253, N265, D266, D267, R237, P238, H257, T259, or Y273. In some embodiments, the antigen binding proteins of the invention bind at an epitope comprising at least ten of Q240, D242, W244, E253, N265, D266, D267, R237, P238, H257, T259, or Y273. In some embodiments, the antigen binding proteins of the invention bind at an epitope comprising at least eleven of Q240, D242, W244, E253, N265, D266, D267, R237, P238, H257, T259, or Y273. In some embodiments, the antigen binding proteins of the invention bind at an epitope comprising all of Q240, D242, W244, E253, N265, D266, D267, R237, P238, H257, T259, or Y273.

In further embodiments, the antigen binding proteins of the invention bind to hASGR-1 and block or reduce the binding or interaction of at least two of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least three of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least four of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least five of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least six of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least seven of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least eight of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g, sugars including but not limited to lactose, galactose, and/or GalNAc or glycoproteins displaying such sugars including but not limited to fetuin, orosomucoid and/or alkaline phosphatase). In further embodiments, the antigen binding proteins of the invention bind to hASGR-1 and block or reduce the binding or interaction of at least nine of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least ten of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least eleven of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least twelve of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least thirteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least fourteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least fifteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least sixteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least seventeen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least eighteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least nineteen of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc). In further embodiments, the antigen binding proteins of the invention bind to hASGR-1 and block or reduce the binding or interaction of at least twenty of Q240, D242, W244, E253, N265, D266, D267, N209, R237, P238, E239, P241, D243, Y245, G246, H247, G252, C255, H257, T259, D260, V268, R271, Y273, F258, R263, or W264 with a ligand (e.g., lactose, galactose and/or GalNAc).

In further embodiments, the antigen binding proteins of the invention bind to hASGR-1 and block or reduce the binding or interaction of at least two of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least three of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least four of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least five of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least six of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least seven of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least eight of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least nine of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least ten of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of at least eleven of Q240, D242, W244, E253, N265, D266, D267, R237, P238, H257, T259, or Y273 with a ligand (e.g., lactose, galactose and/or GalNAc). In further embodiments, the antigen binding proteins of the invention bind to hASGR-1 and block or reduce the binding or interaction of all of Q240, D242, W244, E253, N265, D266, D267, R237, P238, H257, T259, or Y273 with a ligand (e.g., lactose, galactose and/or GalNAc).

In order to relate unique antigen binding protein sequence features to specific functions or binding characteristics, sequences from antigen binding proteins of the invention from various characterization bins can be analyzed. For example, antigen binding proteins of the invention can be tested for their ability to bind a variety of binning probes (e.g., membrane preps from cells expressing ASGR-1 from different species or soluble huASGR-1). For each unique binding bin, the heavy and light chain sequences from each of the antigen binding proteins can be compared and claded based on, for example: 1. the unique VDJ and VJ rearrangements; 2. divergence from germline (ie. unique somatic hypermutation); and 3. relatedness to other antigen binding proteins of the same bin. Accordingly, in certain embodiments, the antigen binding proteins comprising the same or similar sequence features and patterns, will have substantially the same or similar binding characteristics. In specific embodiments, these antigen binding proteins can bind to the same or similar epitope with varying affinities.

The exemplary antigen binding proteins described herein have properties based on the epitope on ASGR, ASGR-1 and/or ASGR-2 that is bound by the antigen binding protein. The term "epitope" includes any determinant capable of being bound by an antigen binding protein, such as an antibody. An epitope is a region of an antigen that is bound by, or interacts with, an antigen binding protein that targets that antigen, and when the antigen is a protein, includes specific amino acids that directly contact, or interact with, the antigen binding protein. An epitope can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is a group of discontinuous amino acids (e.g., in a polypeptide, amino acid residues that are not contiguous in the polypeptide's primary sequence but that, in the context of the polypeptide's tertiary and quaternary structure, are near enough to each other to be bound by an antigen binding protein). Epitope determinants can include chemically active surface groupings of molecules such as amino acids, sugar side chains, phosphoryl or sulfonyl groups, and can have specific three dimensional structural characteristics, and/or specific charge characteristics. Generally, antigen binding proteins specific for a particular target molecule will preferentially recognize an epitope on the target molecule in a complex mixture of proteins and/or macromolecules.

Methods of characterizing the epitope bound by an antigen binding protein are well known in the art, including, but not limited to, binning (competition and/or cross-competition) (Miller et al "Epitope binning of murine monoclonal antibodies by a multiplexed pairing assay" *J Immunol Methods* (2011) 365, 118-25), peptide mapping (e.g., PEPSPOT™) (Albert et al "The B-cell Epitope of the Monoclonal Anti-Factor VIII Antibody ESH8 Characterized by Peptide Array Analysis" 2008 *Thromb Haemost* 99, 634-7), mutagenesis methods such as chimeras (Song et al "Epitope Mapping of Ibalizumab, a Humanized Anti-CD4 Monoclonal Antibody with Anti-HIV-1 Activity in Infected Patients" *J. Virol.* (2010) 84, 6935-6942), alanine scanning (Cunningham and Wells "High-resolution epitope mapping of HGH-receptor interactions by alanine-scanning mutagenesis" Science (1989) 244, 1081-1085), arginine scanning (Lim et al "A diversity of antibody epitopes can induce signaling through the erythropoietin receptor" *Biochemistry* (2010) 49, 3797-3804), HD exchange methods (Coates et al "Epitope mapping by amide hydrogen/deuterium exchange coupled with immobilization of antibody, on-line proteolysis, liquid chromatography and mass spectrometry" *Rapid Commun. Mass Spectrom.* (2009) 23 639-647), NMR cross saturation methods (Morgan et al "Precise epitope mapping of malaria parasite inhibitory antibodies by TROSY NMR cross-saturation" *Biochemistry* (2005) 44, 518-23), and crystallography (Gerhardt et al "Structure of IL-17A in complex with a potent, fully human neutralizing antibody" *J. Mol. Biol* (2009) 394, 905-21). The methods vary in the level of detail they provide as to the amino acids comprising the epitope.

Antigen binding proteins of the present invention include those that have an identical or overlapping epitope with an exemplary antigen binding protein described in Tables 2-7. In some embodiments, the antigen binding protein has an identical epitope as to the exemplary antigen binding proteins. In other embodiments, the antigen binding protein binds only a subset of the same amino acids as the exemplary antigen binding protein. In some embodiments, antigen binding proteins that might bind to any of the epitopes that are bound by the antibodies listed in Tables A, B, C or 6 are especially useful.

In certain embodiments, the antigen binding proteins of the present invention have an identical or overlapping epitope to the antigen binding proteins in Table 2-7 and comprise a) a light chain variable domain having at least 90% identity, at least 95% identity, or is identical to the amino acid sequence of the antigen binding proteins described in Tables 2-7; b) a heavy chain variable domain having at least 90% identity, at least 95% identity, or is identical to the amino acid sequence of the antigen binding proteins set forth in Tables 2-7; or c) the light chain variable domain of a) and the heavy chain variable domain of b).

In certain embodiments, the antigen binding protein of the present invention has an identical or overlapping epitope to the antigen binding proteins selected from the group consisting of 25A4, 4H6, 4A2, 5E5, 7E11, 54E9, 22G5, 194A4, 218G4, 176H4 and 194C10 wherein the antigen binding protein comprises a light chain variable domain having at least 90% identity, at least 95% identity, or is identical to the amino acid sequence of 25A4 and a heavy chain variable domain having at least 90% identity, at least 95% identity, or is identical to the amino acid sequence of 25A4; those comprising a light chain variable domain having at least 90% identity, at least 95% identity, or is identical to the amino acid sequence of 4H6 and a heavy chain variable domain having at least 90% identity, at least 95% identity, or is identical to the amino acid sequence of 4H6; those comprising a light chain variable domain having at least 90% identity, at least 95% identity, or is identical to the amino acid sequence of 4A2 and a heavy chain variable domain having at least 90% identity, at least 95% identity, or is identical to the amino acid sequence of 4A2; those comprising a light chain variable domain having at least 90% identity, at least 95% identity, or is identical to the amino acid sequence of 5E5 and a heavy chain variable domain having at least 90% identity, at least 95% identity, or is identical to the amino acid sequence of 5E5; those comprising a light chain variable domain having at least 90% identity, at least 95% identity, or is identical to the amino acid sequence of 7E11 and a heavy chain variable domain having at least 90% identity, at least 95% identity, or is identical to the amino acid sequence of 7E11; those comprising a light chain variable domain having at least 90% identity, at least 95% identity, or is identical to the amino acid sequence of 54E9 and a heavy chain variable domain having at least 90% identity, at least 95% identity, or is identical to the amino acid sequence of 54E9; those comprising a light chain variable domain having at least 90% identity, at least 95% identity, or is identical to the amino acid sequence of 22G5 and a heavy chain variable domain having at least 90% identity, at least 95% identity, or is identical to the amino acid sequence of 22G5; those comprising a light chain variable domain having at least 90% identity, at least 95% identity, or is identical to the amino acid sequence of 194A4 and a heavy chain variable domain having at least 90% identity, at least 95% identity, or is identical to the amino acid sequence of 194A4; those comprising a light chain variable domain having at least 90% identity, at least 95% identity, or is identical to the amino acid sequence of 218G4G4 and a heavy chain variable domain having at least 90% identity, at least 95% identity, or is identical to the amino acid sequence of 218G4; those comprising a light chain variable domain having at least 90% identity, at least 95% identity, or is identical to the amino acid sequence of 176H4 and a heavy chain variable domain having at least 90% identity, at least 95% identity, or is identical to the amino acid sequence of 176H4; those comprising a light chain variable domain having at least 90% identity, at least 95% identity, or is identical to the amino acid sequence of 194C10 and a heavy chain variable domain having at least 90% identity, at least 95% identity, or is identical to the amino acid sequence of 194C10.

In certain embodiments, the ASGR-1 antigen binding protein of the invention has an identical or overlapping epitope as the antibodies in Tables 2-7, and comprises a light chain variable domain comprising an LCDR1 having no more than three amino acid additions, deletions, or substitutions from the LCDR1 sequence set forth in Table 2; an LCDR2 having no more than three amino acid additions, deletions, or substitutions from the LCDR2 sequence set forth in Table 2; and an LCDR3 having no more than three amino acid additions, deletions, or substitutions from the LCDR3 sequence set forth in Table 2; and a heavy chain variable domain comprising a) an HCDR1 having no more than three amino acid additions, deletions, or substitutions from the HCDR1 sequence set forth in Table 2; an HCDR2 having no more than three amino acid additions, deletions, or substitutions from the HCDR2 sequence set forth in Table 2; and an HCDR3 having no more than three amino acid additions, deletions, or substitutions from the HCDR3 sequence set forth in Table 2.

In certain embodiments, the ASGR-1 antigen binding protein of the invention has an identical or overlapping epitope as the antibodies in Tables A, B, C or 6, and comprises a light chain variable domain comprising an LCDR1 having no more than three amino acid additions, deletions, or substitutions from the LCDR1 sequence set forth in Tables A, B, C or 6; an LCDR2 having no more than three amino acid additions, deletions, or substitutions from the LCDR2 sequence set forth in Tables A, B, C or 6; and an LCDR3 having no more than three amino acid additions, deletions, or substitutions from the LCDR3 sequence set forth in Tables A, B, C or 6; and a heavy chain variable domain comprising a) an HCDR1 having no more than three amino acid additions, deletions, or substitutions from the HCDR1 sequence set forth in Tables A, B, C or 6; an HCDR2 having no more than three amino acid additions, deletions, or substitutions from the HCDR2 sequence set forth in Tables A, B, C or 6; and an HCDR3 having no more than three amino acid additions, deletions, or substitutions from the HCDR3 sequence set forth in Tables A, B, C or 6.

In certain embodiments, the ASGR-1 antigen binding protein of the invention has an identical or overlapping epitope as the antibody, 25A4, and comprises a light chain variable domain comprising an LCDR1 having no more than three amino acid additions, deletions, or substitutions from the LCDR1 sequence set forth in SEQ ID NO:480; an LCDR2 having no more than three amino acid additions, deletions, or substitutions from the LCDR2 sequence set forth in SEQ ID NO:8492; and an LCDR3 having no more than three amino acid additions, deletions, or substitutions from the LCDR3 sequence set forth in SEQ ID NO:16504; and a heavy chain variable domain comprising an HCDR1 having no more than three amino acid additions, deletions, or substitutions from the HCDR1 sequence set forth in SEQ ID NO:4488; an HCDR2 having no more than three amino acid additions, deletions, or substitutions from the HCDR2 sequence set forth in SEQ ID NO:12500; and an HCDR3 having no more than three amino acid additions, deletions, or substitutions from the HCDR3 sequence set forth in SEQ ID NO:20512.

In certain embodiments, the ASGR-1 antigen binding protein of the invention has an identical or overlapping epitope as the antibody, 4H6, and comprises a light chain variable domain comprising an LCDR1 having no more than three amino acid additions, deletions, or substitutions from the LCDR1 sequence set forth in SEQ ID NO:894; an LCDR2 having no more than three amino acid additions, deletions, or substitutions from the LCDR2 sequence set forth in SEQ ID NO:8906; and an LCDR3 having no more than three amino acid additions, deletions, or substitutions from the LCDR3 sequence set forth in SEQ ID NO:16918; and a heavy chain variable domain comprising an HCDR1 having no more than three amino acid additions, deletions, or substitutions from the HCDR1 sequence set forth in SEQ ID NO:4902; an HCDR2 having no more than three amino acid additions, deletions, or substitutions from the HCDR2 sequence set forth in SEQ ID NO:12914; and an HCDR3 having no more than three amino acid additions, deletions, or substitutions from the HCDR3 sequence set forth in SEQ ID NO:20926.

In certain embodiments, the ASGR-1 antigen binding protein of the invention has an identical or overlapping epitope as the antibody, 4A2, and comprises a light chain variable domain comprising an LCDR1 having no more than three amino acid additions, deletions, or substitutions from the LCDR1 sequence set forth in SEQ ID NO:1130; an LCDR2 having no more than three amino acid additions, deletions, or substitutions from the LCDR2 sequence set forth in SEQ ID NO:9142; and an LCDR3 having no more than three amino acid additions, deletions, or substitutions from the LCDR3 sequence set forth in SEQ ID NO:17154; and a heavy chain variable domain comprising an HCDR1 having no more than three amino acid additions, deletions, or substitutions from the HCDR1 sequence set forth in SEQ ID NO:5136; an HCDR2 having no more than three amino acid additions, deletions, or substitutions from the HCDR2 sequence set forth in SEQ ID NO:13148; and an HCDR3 having no more than three amino acid additions, deletions, or substitutions from the HCDR3 sequence set forth in SEQ ID NO:21160.

In certain embodiments, the ASGR-1 antigen binding protein of the invention has an identical or overlapping epitope as the antibody, 5E5, and comprises a light chain variable domain comprising an LCDR1 having no more than three amino acid additions, deletions, or substitutions from the LCDR1 sequence set forth in SEQ ID NO:974; an LCDR2 having no more than three amino acid additions, deletions, or substitutions from the LCDR2 sequence set forth in SEQ ID NO:8986; and an LCDR3 having no more than three amino acid additions, deletions, or substitutions from the LCDR3 sequence set forth in SEQ ID NO:16998; and a heavy chain variable domain comprising an HCDR1 having no more than three amino acid additions, deletions, or substitutions from the HCDR1 sequence set forth in SEQ ID NO:4982; an HCDR2 having no more than three amino acid additions, deletions, or substitutions from the HCDR2 sequence set forth in SEQ ID NO:12994; and an HCDR3 having no more than three amino acid additions, deletions, or substitutions from the HCDR3 sequence set forth in SEQ ID NO:21006.

In certain embodiments, the ASGR-1 antigen binding protein of the invention has an identical or overlapping epitope as the antibody, 7E11, and comprises a light chain variable domain comprising an LCDR1 having no more than three amino acid additions, deletions, or substitutions from the LCDR1 sequence set forth in SEQ ID NO:872; an LCDR2 having no more than three amino acid additions, deletions, or substitutions from the LCDR2 sequence set forth in SEQ ID NO:8884; and an LCDR3 having no more than three amino acid additions, deletions, or substitutions from the LCDR3 sequence set forth in SEQ ID NO:16896; and a heavy chain variable domain comprising an HCDR1 having no more than three amino acid additions, deletions, or substitutions from the HCDR1 sequence set forth in SEQ ID NO:4880; an HCDR2 having no more than three amino acid additions, deletions, or substitutions from the HCDR2 sequence set forth in SEQ ID NO:12892; and an HCDR3 having no more than three amino acid additions, deletions, or substitutions from the HCDR3 sequence set forth in SEQ ID NO:20904.

In certain embodiments, the ASGR-1 antigen binding protein of the invention has an identical or overlapping epitope as the antibody, 54E9, and comprises a light chain variable domain comprising an LCDR1 having no more than three amino acid additions, deletions, or substitutions from the LCDR1 sequence set forth in SEQ ID NO:3448; an LCDR2 having no more than three amino acid additions, deletions, or substitutions from the LCDR2 sequence set forth in SEQ ID NO:11460; and an LCDR3 having no more than three amino acid additions, deletions, or substitutions from the LCDR3 sequence set forth in SEQ ID NO:19472; and a heavy chain variable domain comprising an HCDR1 having no more than three amino acid additions, deletions, or substitutions from the HCDR1 sequence set forth in SEQ ID NO:7452; an HCDR2 having no more than three amino acid additions, deletions, or substitutions from the HCDR2 sequence set forth in SEQ ID NO:15464; and an HCDR3 having no more than three amino acid additions, deletions, or substitutions from the HCDR3 sequence set forth in SEQ ID NO:23476.

In certain embodiments, the ASGR-1 antigen binding protein of the invention has an identical or overlapping epitope as the antibody, 22G5, and comprises a light chain variable domain comprising an LCDR1 having no more than three amino acid additions, deletions, or substitutions from the LCDR1 sequence set forth in SEQ ID NO:326; an LCDR2 having no more than three amino acid additions, deletions, or substitutions from the LCDR2 sequence set forth in SEQ ID NO:8338; and an LCDR3 having no more than three amino acid additions, deletions, or substitutions from the LCDR3 sequence set forth in SEQ ID NO:16350; and a heavy chain variable domain comprising an HCDR1 having no more than three amino acid additions, deletions, or substitutions from the HCDR1 sequence set forth in SEQ ID NO:4334; an HCDR2 having no more than three amino acid additions, deletions, or substitutions from the HCDR2 sequence set forth in SEQ ID NO:12346; and an HCDR3 having no more than three amino acid additions, deletions, or substitutions from the HCDR3 sequence set forth in SEQ ID NO:20358.

In certain embodiments, the ASGR-1 antigen binding protein of the invention has an identical or overlapping epitope as the antibody, 194A4, and comprises a light chain variable domain comprising an LCDR1 having no more than three amino acid additions, deletions, or substitutions from the LCDR1 sequence set forth in SEQ ID NO:2780; an LCDR2 having no more than three amino acid additions, deletions, or substitutions from the LCDR2 sequence set forth in SEQ ID NO:10792; and an LCDR3 having no more than three amino acid additions, deletions, or substitutions from the LCDR3 sequence set forth in SEQ ID NO:18804; and a heavy chain variable domain comprising an HCDR1 having no more than three amino acid additions, deletions, or substitutions from the HCDR1 sequence set forth in SEQ ID NO:6786; an HCDR2 having no more than three amino acid additions, deletions, or substitutions from the HCDR2 sequence set forth in SEQ ID NO:14798; and an HCDR3 having no more than three amino acid additions, deletions, or substitutions from the HCDR3 sequence set forth in SEQ ID NO:22810.

In certain embodiments, the ASGR-1 antigen binding protein of the invention has an identical or overlapping epitope as the antibody, 218G4, and comprises a light chain variable domain comprising an LCDR1 having no more than three amino acid additions, deletions, or substitutions from the LCDR1 sequence set forth in SEQ ID NO:3746; an LCDR2 having no more than three amino acid additions, deletions, or substitutions from the LCDR2 sequence set forth in SEQ ID NO:11758; and an LCDR3 having no more than three amino acid additions, deletions, or substitutions from the LCDR3 sequence set forth in SEQ ID NO:19770; and a heavy chain variable domain comprising an HCDR1 having no more than three amino acid additions, deletions, or substitutions from the HCDR1 sequence set forth in SEQ ID NO:7750; an HCDR2 having no more than three amino acid additions, deletions, or substitutions from the HCDR2 sequence set forth in SEQ ID NO:15762; and an HCDR3 having no more than three amino acid additions, deletions, or substitutions from the HCDR3 sequence set forth in SEQ ID NO:23774.

In certain embodiments, the ASGR-1 antigen binding protein of the invention has an identical or overlapping epitope as the antibody, 176H4, and comprises a light chain variable domain comprising an LCDR1 having no more than three amino acid additions, deletions, or substitutions from the LCDR1 sequence set forth in SEQ ID NO:2502; an LCDR2 having no more than three amino acid additions, deletions, or substitutions from the LCDR2 sequence set forth in SEQ ID NO:10514; and an LCDR3 having no more than three amino acid additions, deletions, or substitutions from the LCDR3 sequence set forth in SEQ ID NO:18526; and a heavy chain variable domain comprising an HCDR1 having no more than three amino acid additions, deletions, or substitutions from the HCDR1 sequence set forth in SEQ ID NO:6508; an HCDR2 having no more than three amino acid additions, deletions, or substitutions from the HCDR2 sequence set forth in SEQ ID NO:14520; and an HCDR3 having no more than three amino acid additions, deletions, or substitutions from the HCDR3 sequence set forth in SEQ ID NO:22532.

In certain embodiments, the ASGR-1 antigen binding protein of the invention has an identical or overlapping epitope as the antibody, 194C10, and comprises a light chain variable domain comprising an LCDR1 having no more than three amino acid additions, deletions, or substitutions from the LCDR1 sequence set forth in SEQ ID NO:2792; an LCDR2 having no more than three amino acid additions, deletions, or substitutions from the LCDR2 sequence set forth in SEQ ID NO:10804; and an LCDR3 having no more than three amino acid additions, deletions, or substitutions from the LCDR3 sequence set forth in SEQ ID NO:18816; and a heavy chain variable domain comprising an HCDR1 having no more than three amino acid additions, deletions, or substitutions from the HCDR1 sequence set forth in SEQ ID NO:6798; an HCDR2 having no more than three amino acid additions, deletions, or substitutions from the HCDR2 sequence set forth in SEQ ID NO:14810; and an HCDR3 having no more than three amino acid additions, deletions, or substitutions from the HCDR3 sequence set forth in SEQ ID NO:22822.

Antigen binding proteins that have an identical or overlapping epitope will often compete for binding to the antigen, ASGR, ASGR1 and/or ASGR2. Thus, in certain embodiments, an antigen binding protein (e.g., antibody or antibody fragment thereof) of the invention competes with the antigen binding proteins described in Tables 2-7. In some embodiments, an antigen binding protein (e.g., antibody or antibody fragment thereof) of the invention competes with the antigen binding proteins described in Tables A, B and C. In some embodiments, an antigen binding protein (e.g., antibody or antibody fragment thereof) of the invention competes with the antigen binding proteins described in Table 6. To "compete" or "competition" means the antigen binding proteins compete for the same epitope or binding site on a target. Such competition can be determined by an assay in which the reference antigen binding protein (e.g., antibody or antibody fragment thereof) prevents or inhibits specific binding of a test antigen binding protein. Numerous types of competitive binding assays can be used to determine if a test molecule competes with a reference molecule for binding. Examples of assays that can be employed include solid phase direct or indirect radioimmunoassay (RIA), solid phase direct or indirect enzyme immunoassay (EIA), sandwich competition assay (see, e.g., Stahli et al. (1983) *Methods in Enzymology* 9:242-253), solid phase direct biotin-avidin EIA (see, e.g., Kirkland et al., (1986) *J. Immunol.* 137:3614-3619), solid phase direct labeled assay, solid phase direct labeled sandwich assay, Luminex (Jia et al "A novel method of Multiplexed Competitive Antibody Binning for the characterization of monoclonal antibodies" *J. Immunological Methods* (2004) 288, 91-98) and surface plasmon resonance ((Song et al "Epitope Mapping of Ibalizumab, a Humanized Anti-CD4 Monoclonal Antibody with Anti-HIV-1 Activity in Infected Patients" *J. Virol.* (2010) 84, 6935-6942). An exemplary method of determining competition is described in Example 7D. Usually, when a competing antigen binding protein is present in excess, it will inhibit binding of a reference antigen binding protein to a common antigen by at least 50%, 55%, 60%, 65%, 70%, or 75%. In some instances, binding to ASGR-1 is inhibited by at least 80%, 85%, 90%, 95%, 96%, 97%, 98%, 99%, or more.

Besides competition, antigen binding proteins (e.g., antibodies or antibody fragments thereof) with identical, overlapping, or similar epitopes may be affected by mutagenesis of ASGR, ASGR-1 and/or ASGR-2 similarly. In brief, the domain(s)/region(s) containing residues that are in contact with or are buried by an antibody can be identified by mutating specific residues in ASGR, ASGR-1 and/or ASGR-2 (e.g., a wild-type antigen) and determining whether the antigen binding protein can bind the mutated or variant ASGR, ASGR-1 and/or ASGR-2 protein. By making a number of individual mutations, residues that play a direct role in binding or that are in sufficiently close proximity to the antibody such that a mutation can affect binding between the antigen binding protein and antigen can be identified. From the knowledge of these amino acids, the domain(s) or region(s) of the antigen that contain residues in contact with the antigen binding protein or covered by the antibody can be elucidated. Such a domain can include the binding epitope of an antigen binding protein. As mentioned above, one specific example of this general approach utilizes an arginine/glutamic acid scanning protocol (see, e.g., Nanevicz, T., et al., 1995, *J. Biol. Chem.*, 270:37, 21619-21625 and Zupnick, A., et al., 2006, *J. Biol. Chem.*, 281:29, 20464-20473). In general, arginine and glutamic acids are substituted (typically individually) for an amino acid in the wild-type polypeptide because these amino acids are charged and bulky and thus have the potential to disrupt binding between an antigen binding protein and an antigen in the region of the antigen where the mutation is introduced. Arginine residues that exist in the wild-type antigen are replaced with glutamic acid. A variety of such individual mutants are obtained and the collected binding results analyzed to determine what residues affect binding. In Example 7E, scanning arginine/glutamic acid mutagenesis was performed using the human ASGR-1 CBD domain and the effect on exemplary antibodies was determined. Included with the scope of the invention are ASGR, ASGR-1 and/or ASGR-2 antigen binding proteins having characteristics such that they are affected in a similar way as an exemplary antibody to mutagenesis.

Example 7E describes one such arginine/glutamic acid scanning of ASGR-1 for ASGR-1 antigen binding proteins provided herein. A series of mutant ASGR-1 antigens were created, with each mutant antigen having a single mutation. Binding of each mutant ASGR-1 antigen with various ASGR-1 antigen binding proteins was measured and compared to the ability of the selected antigen binding proteins to bind to human ASGR-1 (SEQ ID NO:5). In certain embodiments, binding of an antigen binding protein of the present invention to ASGR-1 is inhibited by a single mutation in ASGR-1, wherein the single mutation is selected from the group consisting of R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, the ASGR-1 antigen binding proteins share the attributes of antibody 4A2 and their binding to ASGR-1 is inhibited a mutation of any of W195, E196, K199, H204, P207, and R263. In some embodiments, the ASGR-1 antigen binding proteins share the attributes of antibody 4B3 and their binding to ASGR-1 is inhibited by a mutation of any of H203, H204, P220, and G251. In some embodiments, the ASGR-1 antigen binding proteins share the attributes of antibody 5E5 and their binding to ASGR-1 is inhibited by a mutation of any of W195, K199, and R263. In some embodiments, the ASGR-1 antigen binding proteins share the attributes of antibody 6G7 and their binding to ASGR-1 is inhibited by a mutation of any of R183, L184, H215, P220, P238, G246, H247, G248, G251, and N265. In some embodiments, the ASGR-1 antigen binding proteins share the attributes of antibody 149D11 and their binding is inhibited by a mutation of any of R170, S171, and L184. In some embodiments, the ASGR-1 antigen binding proteins share the attributes of antibody 175F4 and their binding is inhibited by a mutation of R183. In some embodiments, the ASGR-1 antigen binding proteins share the attributes of antibody 17H6 and their binding is inhibited by a mutation of any of P241, D242, D243, Y245, G251, and E253. In some embodiments, the ASGR-1 antigen binding proteins share the attributes of antibody 194A4 and their binding is inhibited by a mutation of D260. In some embodiments, the ASGR-1 antigen binding proteins share the attributes of antibody 60C12 and their binding is inhibited by a mutation of any of R170, R237, E239, P241, T259, D260, R263, and N265. In some embodiments, the ASGR-1 antigen binding proteins share the attributes of antibody 65D5 and their binding is inhibited by a mutation of any of R237, T259, D260 and R263. In some embodiments, the ASGR-1 antigen binding proteins share the attributes of antibody 190F8 or 191G1 and their binding is inhibited by a mutation of any of R170, S171, G172, E196, H204, P207, V208, N209, H215, D216, D225, D228, P238, D243, G248, L249, G251, D260, Q270, R271, P272, R274 and E280. In some embodiments, the ASGR-1 antigen binding proteins share the attributes of antibody 199A7 and their binding is inhibited by a mutation of any of R170, R183, H215 and Q270. In some embodiments, the ASGR-1 antigen binding proteins share the attributes of antibody 146B6 and their binding is inhibited by a mutation of any of P241, T259, and N265. In some embodiments, the ASGR-1 antigen binding proteins share the attributes of antibody 193E7 and their binding is inhibited by a mutation of any of P207 and R263. In some embodiments, any of two or more, three or more, four or more, five or more, six or more, seven or more, eight or more nine or more, ten or more, or all of the single mutations of the aforementioned groups individually inhibit binding of the ASGR-1 antigen binding protein to ASGR-1.

Binding of various anti-ASGR-1 antigen binding proteins (e.g., antibodies 5E5, 22G5, 7E11, 4A2, 4H6, 72G9, 194A4, 54E9, 218G4, 176H4 and 194C10) were further analyzed using X-ray crystallography. The results from the X-ray crystallography were highly correlated with the results from the Arginine/Glutamic acid mutagenesis profiling described above and in Example 7E. The interface between an antigen binding protein and the antigen can be determined/defined a number of ways. In Examples 10B-L, the interface was determined by selecting interface residues having at least one atom within a predefined distance to its partner protein. In some embodiments, ASGR-1 residues that are within the interface with antibody, 5E5, as determined by distance of 8 Å or less are: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, ASGR-1 residues that are within the interface with antibody, 5E5, as determined by distance of 5 Å or less are: H161, E162, W195, E196, Q198, K199, F200, Q202, H203, H204, G232, F233, K234, N235, W236, R237, P238, D261, G262, or R263 (SEQ ID NO:5). In certain embodiments, the ASGR-1 antigen binding protein forms an interface with ASGR-1 that overlaps with that of antibody 5E5, including those wherein any of: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5) are within the interface. In certain embodiments, the ASGR-1 antigen binding protein forms an interface with ASGR-1 that overlaps with that of antibody 5E5, including those wherein any of: H161, E162, W195, E196, Q198, K199, F200, Q202, H203, H204, G232, F233, K234, N235, W236, R237, or P238 (SEQ ID NO:5) are within the interface.

In some embodiments, ASGR-1 residues that are within the interface with antibody, 22G5, as determined by distance of 8 Å or less are: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, ASGR-1 residues that are within the interface with antibody, 22G5, as determined by distance of 5 Å or less are: W167, S171, G172, K173, A174, A176, D177, N180, Y181, R183, L184, E185, D186, Q270, P272, or W275 (SEQ ID NO:5). In certain embodiments, the ASGR-1 antigen binding protein forms an interface with ASGR-1 that overlaps with that of antibody 5E5, including those wherein any of: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5) are within the interface. In certain embodiments, the ASGR-1 antigen binding protein forms an interface with ASGR-1 that overlaps with that of antibody 5E5, including those wherein any of: W167, S171, G172, K173, A174, A176, D177, N180, Y181, R183, L184, E185, D186, Q270, P272, or W275 (SEQ ID NO:5) are within the interface.

In some embodiments, ASGR-1 residues that are within the interface with antibody, 4A2, as determined by distance of 8 Å or less are: R170, W195, E196, K199, Q202, H203, H204, I205, G206, P207, V208, F233, K234, N235, W236, P238, D260, D261, G262, R263, R274, P155, N157, W158, F168, S169, R170, W175, A178, D179, C182, A187, W211, C269, R271, Y273, R274, C277, or T279 (SEQ ID NO:5). In some embodiments, ASGR-1 residues that are within the interface with antibody, 4A2, as determined by distance of 5 Å or less are: R170, W195, E196, K199, Q202, H203, H204, I205, G206, P207, V208, F233, K234, N235, W236, P238, D260, D261, G262, R263, or R274 (SEQ ID NO:5). In certain embodiments, the ASGR-1 antigen binding protein forms an interface with ASGR-1 that overlaps with that of antibody 4A2, including those wherein any of: R170, W195, E196, K199, Q202, H203, H204, I205, G206, P207, V208, F233, K234, N235, W236, P238, D260, D261, G262, R263, R274, P155, N157, W158, F168, S169, R170, W175, A178, D179, C182, A187, W211, C269, R271, Y273, R274, C277, or T279 (SEQ ID NO:5) are within the interface. In certain embodiments, the ASGR-1 antigen binding protein forms an interface with ASGR-1 that overlaps with that of antibody 4A2, including those wherein any of: R170, W195, E196, K199, Q202, H203, H204, I205, G206, P207, V208, F233, K234, N235, W236, P238, D260, D261, G262, R263, R274 (SEQ ID NO:5) are within the interface.

In some embodiments, ASGR-1 residues that are within the interface with antibody, 7E11, as determined by distance of 8 Å or less are: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, ASGR-1 residues that are within the interface with antibody, 7E11, as determined by distance of 5 Å or less are: H161, S194, W195, E196, Q198, K199, F200, Q202, H203, F233, K234, N235, W236, R237, P238, or R263 (SEQ ID NO:5). In certain embodiments, the ASGR-1 antigen binding protein forms an interface with ASGR-1 that overlaps with that of antibody 7E11, including those wherein any of: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5) are within the interface. In certain embodiments, the ASGR-1 antigen binding protein forms an interface with ASGR-1 that overlaps with that of antibody 7E11, including those wherein any of are within the surface: H161, S194, W195, E196, Q198, K199, F200, Q202, H203, F233, K234, N235, W236, R237, P238, or R263 (SEQ ID NO:5) are within the interface.

In some embodiments, ASGR-1 residues that are within the interface with antibody, 4H6, as determined by distance of 8 Å or less are: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, ASGR-1 residues that are within the interface with antibody, 4H6, as determined by distance of 5 Å or less are: H161, E162, T193, S194, W195, E196, K199, Q202, T231, G232, F233, K234, N235, P238, D261, or R263 (SEQ ID NO:5). In certain embodiments, the ASGR-1 antigen binding protein forms an interface with ASGR-1 that overlaps with that of antibody 4H6, including those wherein any of: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5) are within the interface. In certain embodiments, the ASGR-1 antigen binding protein forms an interface with ASGR-1 that overlaps with that of antibody 4H6, including those wherein any of are within the surface: H161, E162, T193, S194, W195, E196, K199, Q202, T231, G232, F233, K234, N235, P238, D261, or R263 (SEQ ID NO:5) are within the interface.

In some embodiments, ASGR-1 residues that are within the interface with antibody, 72G9, as determined by distance of 8 Å or less are: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, ASGR-1 residues that are within the interface with antibody, 72G9, as determined by distance of 5 Å or less are: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In certain embodiments, the ASGR-1 antigen binding protein forms an interface with ASGR-1 that overlaps with that of antibody 72G9, including those wherein any of: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269 (SEQ ID NO:5) are within the interface. In certain embodiments, the ASGR-1 antigen binding protein forms an interface with ASGR-1 that overlaps with that of antibody 72G9, including those wherein any of: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5) are within the interface.

In some embodiments, ASGR-1 residues that are within the interface with antibody, 194A4, as determined by distance of 8 Å or less are: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments, ASGR-1 residues that are within the interface with antibody, 194A4, as determined by distance of 5 Å or less are: T193, S194, W195, E196, P220, W221, G226, T227, D228, Y229, E230, T231, G232, F233, K234, N235, W236, R237, P238, E239, or G252 (SEQ ID NO:5). In certain embodiments, the ASGR-1 antigen binding protein forms an interface with ASGR-1 that overlaps with that of antibody 194A4, including those wherein any of: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5) are within the interface. In certain embodiments, the ASGR-1 antigen binding protein forms an interface with ASGR-1 that overlaps with that of antibody 194A4, including those wherein any of are within the surface: T193, S194, W195, E196, P220, W221, G226, T227, D228, Y229, E230, T231, G232, F233, K234, N235, W236, R237, P238, E239, or G252 (SEQ ID NO:5) within the interface.

In some embodiments, ASGR-1 residues that are within the interface with antibody, 194C10, as determined by distance of 8 Å or less are: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments, ASGR-1 residues that are within the interface with antibody, 194C10, as determined by distance of 5 Å or less are: N157, R170, S171, G172, Q202, H203, H204, I205, G206, P207, V208, N209, T210, D260, R271, P272, Y273 or R274 (SEQ ID NO:5). In certain embodiments, the ASGR-1 antigen binding protein forms an interface with ASGR-1 that overlaps with that of antibody 194C10, including those wherein any of: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5) are within the interface. In certain embodiments, the ASGR-1 antigen binding protein forms an interface with ASGR-1 that overlaps with that of antibody 194C10, including those wherein any of: N157, R170, S171, G172, Q202, H203, H204, I205, G206, P207, V208, N209, T210, D260, R271, P272, Y273, or R274 (SEQ ID NO:5) are within the interface.

In some embodiments, ASGR-1 residues that are within the interface with antibody, 54E9, as determined by distance of 8 Å or less are: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments, ASGR-1 residues that are within the interface with antibody, 54E9, as determined by distance of 5 Å or less are: W195, N209, N235, R237, P238, E239, Q240, D242, H257, T259, D260, D261, R263, N265, D267, R271, or Y273 (SEQ ID NO:5). In certain embodiments, the ASGR-1 antigen binding protein forms an interface with ASGR-1 that overlaps with that of antibody 54E9, including those wherein any of: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5) are within the interface. In certain embodiments, the ASGR-1 antigen binding protein forms an interface with ASGR-1 that overlaps with that of antibody 54E9, including those wherein any of: W195, N209, N235, R237, P238, E239, Q240, D242, H257, T259, D260, D261, R263, N265, D267, R271, or Y273 (SEQ ID NO:5) are within the interface.

In some embodiments, ASGR-1 residues that are within the interface with antibody, 218G4, as determined by distance of 8 Å or less are: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, ASGR-1 residues that are within the interface with antibody, 218G4, as determined by distance of 5 Å or less are: R170, S171, G172, A174, H204, I205, G206, P207, V208, N209, H257, D260, N265, D267, Q270, R271, P272, Y273, or R274 (SEQ ID NO:5). In certain embodiments, the ASGR-1 antigen binding protein forms an interface with ASGR-1 that overlaps with that of antibody 218G4, including those wherein any of: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5) are within the interface. In certain embodiments, the ASGR-1 antigen binding protein forms an interface with ASGR-1 that overlaps with that of antibody 218G4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273 or R274 (SEQ ID NO:5) are within the interface.

In some embodiments, ASGR-1 residues that are within the interface with antibody, 176H4, as determined by distance of 8 Å or less are: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, ASGR-1 residues that are within the interface with antibody, 176H4, as determined by distance of 5 Å or less are: R170, S171, G172, K173, A174, D177, P207, V208, N209, R237, Q240, W244, G246, H247, G248, L249, E253, H257, T259, D260, N265, D267, Q270, R271, P272, Y273 or R274 (SEQ ID NO:5). In certain embodiments, the ASGR-1 antigen binding protein forms an interface with ASGR-1 that overlaps with that of antibody 176H4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275 (SEQ ID NO:5) are within the interface. In certain embodiments, the ASGR-1 antigen binding protein forms an interface with ASGR-1 that overlaps with that of antibody 176H4, including those wherein any of: R170, S171, G172, K173, A174, D177, P207, V208, N209, R237, Q240, W244, G246, H247, G248, L249, E253, H257, T259, D260, N265, D267, Q270, R271, P272, Y273, R274 (SEQ ID NO:5) are within the interface.

In some embodiments, the ASGR-1 residues that are involved in ligand binding are also in close proximity to the areas where antibodies 72G9, 54E9, 218G4 or 176H4 bind and can be useful for manipulating ASGR-1 binding to ligand. In some embodiments, the ASGR-1 antigen binding protein forms an interface with ASGR-1 that overlaps with that of antibody 72G9 and the ligand (e.g., GalNAc), including those wherein any of Q240, D242, W244, E239, P241, D243, Y245, G246, G252, R237, E253, P238, H247, C255, or V268 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, or W244 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, W244, E239, P241, D243, Y245, G246 or G252 (SEQ ID NO:5) are within the interface. In some embodiments, the ASGR-1 antigen binding protein forms an interface with ASGR-1 that overlaps with that of antibody 72G9 and the ligand (e.g., GalNAc), including those wherein any of Q240, D242, W244, R237 or E253 (SEQ ID NO:5) are within the interface. As noted in the examples below, the extent of inhibition resulting from 72G9 is lower than other direct blocking antibodies provided herein. While not intended to be limiting, this is understood to occur due to the nature of the relative orientations of the ASGR-1 protein and the antibody when bound to one another. For example, when the 72G9 antibody is bound to ASGR-1, there is still sufficient space for a ligand to reach the binding site, to some (althouth lesser) extent. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, P238, E239, D260, R263, R271, E253, D266, D243, F258, or W264 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, or Y273 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, P238, E239, D260, R263, or R271 (SEQ ID NO:5) are within the interface. In some embodiments, the ASGR-1 antigen binding protein forms an interface with ASGR-1 that overlaps with that of antibody 54E9 and the ligand (e.g., GalNAc), including those wherein any of N209, R237, Q240, D242, H257, T259, N265, D267, Y273, E253 or D266 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273, D260, R271, R237, T259, D266, F258 or V268 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, or Y273 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273, D260 or R271 (SEQ ID NO:5) are within the interface. In some embodiments, the ASGR-1 antigen binding protein forms an interface with ASGR-1 that overlaps with that of antibody 218G4 and the ligand (e.g., GalNAc), including those wherein any of N209, H257, N265, D267, Y273. R237, T259 or D266 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, G246, H247, D260, R271, D266, P238, E239, Y245, F258, R263, W264, or V268 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, or Y273 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, G246, H247, D260, or R271 (SEQ ID NO:5) are within the interface. In some embodiments, the ASGR-1 antigen binding protein forms an interface with ASGR-1 that overlaps with that of antibody 176H4 and the ligand (e.g., GalNAc), including those wherein any of N209, R237, Q240, W244, E253, H257, T259, N265, D267, Y273, or D266 (SEQ ID NO:5) are within the interface.

As discussed above, the binding interaction between huASGR-1 and ligand (e.g., lactose, galactose, GalNAc), as well as the binding interaction between huASGR-1 and various embodiments of the antigen binding proteins (e.g., antibodies) of the present invention was evaluated using x-ray crystallography as described in Example 10. The binding interaction between huASGR-1 and various embodiments of the antigen binding proteins (e.g., antibodies) of the present invention was also evaluated using methodologies, including epitope binning as described in Example 7D, and arginine/glutamic acid mutational profiling as described in Example 7E. A summary of the data obtained through these methodologies is set forth in Table D below. This summary illustrates the various binding characteristics of representative antigen binding proteins (e.g., antibodies) of the present invention and their ability to directly and/or indirectly inhibit ligand binding to huASGR-1. In some embodiments, antibodies that interact with residues in common across different ligands can result in a similar form of inhibition (direct) across the various ligands. Examples of such residues are underlined and in bold in Table D.

TABLE D

Summary of Binding Characteristics of Representative Antigen Binding Proteins Derived from Examples 7 and 10.

| Ligand/mAb Name | mAb Epitope (bin) | Interaction Site (crystal structure <5 angstroms) | Interaction Site (crystal structure 5-8 angstroms) | R/E scan |
|---|---|---|---|---|
| Ligand/ Lactose | ND | Q240, D242, W244, E253, N265, D266, D267 | N209, R237, P238, E239, P241, D243, Y245, G246, H247, G252, C255, H257, T259, D260, V268, R271, Y273 | ND |
| Ligand/ Galactose | ND | R237, D240, D242, W244, E253, N265, D266, D267 | N209, P238, E239, P241, D243, Y245, G246, H247, G252, C255, H257, T259, V268, R271, Y273 | ND |
| Ligand/ GalNAc | ND | N209, R237, D240, D242, W244, E253, H257, T259, N265, D266, D267, Y273 | P238, E239, P241, D243, Y245, G246, H247, G252, C255, F258, D260, R263, W264, V268, R271 | ND |
| 5E5 - Interaction is representative of indirect inhibition of ligand binding | A | H161, E162, W195, E196, Q198, K199, F200, Q202, H203, H204, G232, F233, K234, N235, W236, R237, P238, D261, G262, R263 | V159, E160, R163, T193, S194, E197, V201, I205, G206, P207, Y229, E230, T231, E239, F258, T259, D260, W264 | W195, K199 |
| 4A2 - Interaction is representative of indirect inhibition of ligand binding | A | R170, W195, E196, K199, Q202, H203, H204, I205, G206, P207, V208, F233, K234, N235, W236, P238, D260, D261, G262, R263, R274 | N157, V159, F168, S169, S171, S194, Q198, F200, V201, T210, R237, E239, Q240, F258, T259, W264 | W195 |

TABLE D-continued

Summary of Binding Characteristics of Representative Antigen Binding Proteins Derived from Examples 7 and 10.

| Ligand/mAb Name | mAb Epitope (bin) | Interaction Site (crystal structure <5 angstroms) | Interaction Site (crystal structure 5-8 angstroms) | R/E scan |
|---|---|---|---|---|
| 7E11 - Interaction is representative of indirect inhibition of ligand binding | A | H161, S194, W195, E196, Q198, K199, F200, Q202, H203, F233, K234, N235, W236, R237, P238, R263 | E160, E162, V192, T193, E197, V201, H204, Y229, E230, T231, G232, E239, Q240, P241, D261, G262, W264 | W195 |
| 4H6 - Interaction is representative of indirect inhibition of ligand binding | A | H161, E162, T193, S194, W195, E196, K199, Q202, T231, G232, F233, K234, N235, P238, D261, R263 | R163, V192, E197, Q198, H203, P207, D228, E230, W236, R237, D260, G262, W264 | ND |
| 22G5 - Interaction is representative of indirect inhibition of ligand binding | B | W167, S171, G172, K173, A174, A176, D177, N180, Y181, R183, L184, E185, D186, Q270, P272, W275 | P155, N157, W158, F168, S169, R170, W175, A178, D179, C182, A187, W211, C269, R271, Y273, R274, C277, T279 | R183, L184, H215, P220, G246, G248, G251, N265 |
| 194A4 - Interaction is representative of indirect inhibition of ligand binding | C | T193, S194, W195, E196, P220, W221, G226, T227, D228, Y229, E230, T231, G232, F233, K234, N235, W236, R237, P238, E239, G252 | H161, E162, V191, V192, E197, Q198, D216, G219, K222, W223, D225, R263, W264 | D260 |
| 72G9 - Interaction is representative of direct inhibition of ligand binding | C | D216, Q217, N218, G219, P220, W221, Y229, E230, K234, W236, E239, Q240, P241, D242, D243, W244, Y245, G246, L249, G250, G251, G252, D254, Q270 | H215, K222, T231, G232, R237, P238, H247, G248, E253, C255, D266, V268, C269 | P241, D242, D243, Y245, G251, E253 |
| 54E9 - Interaction is representative of direct inhibition of ligand binding | E | W195, N209, N235, R237, P238, E239, Q240, D242, H257, T259, D260, D261, R263, N265, D267, R271, Y273 | Q198, Q202, P207, V208, F233, W236, D243, E253, F258, G262, W264, D266 | R237, E239, P241, T259, D260, R263, N265 |
| 218G4 - Interaction is representative of direct inhibition of ligand binding | L/O | R170, S171, G172, A174, H204, I205, G206, P207, V208, N209, H257, D260, N265, D267, Q270, R271, P272, Y273, R274 | W167, F168, S169, K173, W175, D177, Y181, Q202, H203, T210, W211, R237, F258, T259, D261, D266, V268, C269, W275 | R171, G172, P238, R274 |
| 176H4 - Interaction is representative of direct inhibition of ligand binding | L/R | R170, S171, G172, K173, A174, D177, P207, V208, N209, R237, Q240, W244, G246, H247, G248, L249, E253, H257, T259, D260, N265, D267, Q270, R271, P272, Y273, R274 | S169, W175, A176, A178, T210, W211, W236, P238, E239, D242, Y245, G250, G251, F258, D261, G262, R263, W264, D266, V268, C269, W275 | G172, P241, D242, H247, L249, N265, R271, P272 |
| 194C10 - Interaction is representative of direct and/or indirect inhibition of ligand binding | L/T | N157, R170, S171, G172, Q202, H203, H204, I205, G206, P207, V208, N209, T210, D260, R271, P272, Y273, R274 | V156, W158, V159, H161, W167, F168, S169, K173, K199, F200, V201, W211, R237, H257, F258, T259, D261, D267, V268, Q270, W275 | R170, G172, V208, R274 |

In some embodiments, the antibody can directly inhibit ASGR-1 CBD/Ligand binding. While described herein in greater detail, and while not intended to be limiting by theory, such an interaction can denote that the antibody interacts with the section of ASGR-1 CBD that binds to its ligand directly, such that a paratope or other section of an antigen binding protein (e.g., antibody) directly obstructs the ligand's access to the binding site in ASGR1 CBD. An antigen binding protein or antibody can be designated as a direct inhibitor when it has one or more of the characteristics of the direct inhibitors provided herein, including the examples below (such as example 10, or the crystal structures referenced therein). Some examples of direct inhibition are shown by 72G9, 54E9, 218G4 and 176H4 and are indicated in Table D. In some embodiments, a direct inhibitor can bind to one or more of residues 237-273 or residues 240-267 of SEQ ID NO:5 of ASGR-1.

In some embodiments, the antigen binding protein or antibody can indirectly inhibit ASGR-1 CBD/Ligand binding. While described herein in greater detail, and while not intended to be limiting by theory, this denotes that the antigen binding protein or antibody binds to ASGR-1 CBD, but need not directly obstruct the ligand's access to the binding site in ASGR-1 CBD. An antigen binding protein or antibody can be designated as an indirect inhibitor when it has one or more of the characteristics of the indirect inhibitors provided herein, including the examples below (such as example 10 or the crystal structures provided therein). Some examples of indirect inhibition are shown by 5E5, 4A2, 7E11, 4H6, 22G5, 194A4, and are indicated in Table D. While not limiting, it is noted that indirect inhibition can occur from a variety of interactions or rearrangements. For example, indirect inhibition may occur from a conformational rearrangement of the carbohydrate binding loop occurs which could impair the carbohydrate binding loop from binding to/interacting with ligand (i.e., carbohydrates). In some embodiments, an indirect inhibitor can bind to one or more of the residues in ASGR-1 CBD helix alpha 1 and/or helix alpha 2. In some embodiments, the antibody binds to ASGR-1 and results in the disordering of the CBD.

In some embodiments, an antigen binding protein or antibody can have characteristics of both direct and indirect inhibition and/or bind to areas on ASGR-1 CBD that are common to both types of inhibition. Of course, such an embodiment may have sufficient inhibition capability through its direct, indirect, or both direct and indirect interactions.

In some embodiments, the distinction between direct and indirect inhibition need not be made. In some embodiments, denoting that an antigen binding protein or antibody provides direct or indirect inhibition means that it provides at least that form of inhibition (e.g., ASGR-1 CBD/Ligand blocking). In some embodiments, an antigen binding protein or antibody that provides direct inhibition, may also provide indirect aspects as well (such as other conformational changes). In addition, as shown in Table D, as the interation between ASGR-1 CBD and its ligands can vary for each of the noted three ligands, what may be a direct or indirect interaction for one ligand, need not be direct or indirect for another. While the antibodies provided herein that have the properties of direct and/or indirect inhibition will function accordingly, and the guidance provided herein allows for one to screen for and produce additional such antibodies, the fact that an antibody simply binds to ASGR-1 CBD does not necessarily mean that it will bind at the relevant locations on ASGR-1 to allow for direct or indirect inhibition.

In some embodiments, an isolated antigen binding protein that binds to human ASGR and inhibits ASGR function is provided. In one embodiment, the invention comprises an isolated antigen binding protein that binds to human ASGR and inhibits ASGR binding to ligand. In another embodiment, the invention comprises an isolated antigen binding protein that binds to human ASGR-1 and inhibits ASGR-1 binding to ligand and/or ASGR-1 interaction with ASGR-2. In another embodiment, the invention comprises an isolated antigen binding protein that binds to human ASGR-2 and inhibits ASGR-2 binding to ligand and/or ASGR-2 interaction with ASGR-1. In yet another embodiment, the invention comprises an isolated antigen binding protein that binds to human ASGR-1 and human ASGR-2, and inhibits ASGR-1 and/or ASGR-2 binding to ligand. In some embodiments, the isolated binding protein binds specifically to human ASGR, ASGR-1 and/or ASGR-2.

In some embodiments, an isolated antigen binding protein is provided, wherein the isolated antigen binding protein binds to human ASGR-1 and comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7. In some embodiments, the invention comprises an isolated antigen binding protein, wherein the isolated antigen binding protein binds to human ASGR-1 and comprises one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one or more VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one or more VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises one VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and one VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises two VH CDR1, VH CDR2 or VH CDR3 having an amino acid sequence identical to or comprising 1, 2, or 3 amino acid residue substitutions, deletions or insertions in each CDR relative to the VH of any of the sequences set forth in Tables 3-7, and two VL CDR1, VL CDR2 or VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2 and VH CDR3 having an amino acid sequence identical to or comprising 1, 2, or 3 amino acid residue substitutions, deletions or insertions in each CDR relative to the VH of any of the sequences set forth in Tables 3-7, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in Tables 3-7. In some embodiments, the isolated antigen binding protein comprises the VH CDR1, VH CDR2, VH CDR3, VL CDR1, VL CDR2, and VL CDR3 having an amino acid sequence identical to any of the sequences set forth in Tables 3-7. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE A. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE A, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE A. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE A. In some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE B. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE B, and the VL CDR1, VL CDR2 and VL CDR3 having an amino acid sequence identical to or comprising 1, 2, or 3 amino acid residue substitutions, deletions or insertions in each CDR relative to the VL of any of the sequences set forth in TABLE B. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE B. In still some embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in TABLE C. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in TABLE C, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in TABLE C. In some embodiments, the isolated antigen binding protein comprises the VH CDR1, VH CDR2, VH CDR3, VL CDR1, VL CDR2, and VL CDR3 having an amino acid sequence identical to any of the sequences set forth in TABLE C. In further embodiments, the isolated antigen binding protein comprises the VH CDR1, VH CDR2 or VH CDR3 having an amino acid sequence identical to or comprising 1, 2, or 3 amino acid residue substitutions, deletions or insertions in each CDR relative to the VH of any of the sequences set forth in Table 6. In some embodiments, the isolated antigen binding protein comprises the VL CDR1, VL CDR2 or VL CDR3 having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, and VH CDR3 having an amino acid sequence identical to or comprising 1, 2, or 3 amino acid residue substitutions, deletions or insertions in each CDR relative to the VH of any of the sequences set forth in Table 6, and the VL CDR1, VL CDR2 and VL CDR3, having an amino acid sequence identical to or comprising 1, 2, or 3 amino acid residue substitutions, deletions or insertions in each CDR relative to the VL of any of the sequences set forth in Table 6. In some embodiments, the isolated antigen binding protein comprises the VH CDR1, VH CDR2, VH CDR3, VL CDR1, VL CDR2, and VL CDR3 having an amino acid sequence identical to any of the sequences set forth in Table 6.

In some embodiments, an isolated antigen binding protein is provided, wherein the antigen binding protein specifically binds human ASGR-1 and comprises a heavy chain variable domain having at least 90% identity to any of the VH domain amino acid sequences set forth in Tables 3-7. In some aspects, the invention provides an isolated antigen binding protein, wherein the antigen binding protein specifically binds human ASGR-1 and comprises a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Tables 3-7, and a light chain variable domain having at least 90% identity to any of the VL domain amino acid sequences set forth in Tables 3-7. In some embodiments, the invention provides an isolated antigen binding protein, wherein the antigen binding protein specifically binds human ASGR-1 and comprises a heavy chain variable domain having any of the VH domain amino acid sequences set forth in Tables 3-7, and a light chain variable domain having any of the VL domain amino acid sequences set forth in Tables 3-7. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table A, and a light chain variable domain having at least 90% identity to any of the VL domain amino acid sequences set forth in Table A. In some embodiments, the invention provides an isolated antigen binding protein, wherein the antigen binding protein specifically binds human ASGR-1 and comprises a heavy chain variable domain having any of the VH domain amino acid sequences set forth in Table A, and a light chain variable domain having any of the VL domain amino acid sequences set forth in Table A. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table B, and a light chain variable domain having at least 90% identity to any of the VL domain amino acid sequences set forth in Table B. In some embodiments, the invention provides an isolated antigen binding protein, wherein the antigen binding protein specifically binds human ASGR-1 and comprises a heavy chain variable domain having any of the VH domain amino acid sequences set forth in Table B, and a light chain variable domain having any of the VL domain amino acid sequences set forth in Table B. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table C, and a light chain variable domain having at least 90% identity to any of the VL domain amino acid sequences set forth in Table C. In some embodiments, the invention provides an isolated antigen binding protein, wherein the antigen binding protein specifically binds human ASGR-1 and comprises a heavy chain variable domain having any of the VH domain amino acid sequences set forth in Table C, and a light chain variable domain having any of the VL domain amino acid sequences set forth in Table C. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6. In some embodiments, the invention provides an isolated antigen binding protein, wherein the antigen binding protein specifically binds human ASGR-1 and comprises a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having at least 90% identity to any of the VH domain amino acid sequences set forth in Table 6, and a light chain variable domain having at least 90% identity to any of the VL domain amino acid sequences set forth in Table 6. In some embodiments, the invention provides an isolated antigen binding protein, wherein the antigen binding protein specifically binds human ASGR-1 and comprises a heavy chain variable domain having any of the VH domain amino acid sequences set forth in Table 6, and a light chain variable domain having any of the VL domain amino acid sequences set forth in Table 6.

In some embodiments, an isolated antigen binding protein is provided, wherein the antigen binding protein binds human ASGR-1 and comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Table 19B or 19C, as depicted in FIG. 55. In some aspects, the invention comprises an isolated antigen binding protein, wherein the isolated antigen binding protein binds to human ASGR-1 and comprises one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises one or more VH CDR1, VH CDR2 or VH CDR3 having an amino acid sequence identical to or comprising no more than 18 amino acid residue substitutions, insertions or deletions in each CDR relative to the VH of any of the sequences set forth in Table 19A, as depicted in FIG. 55, and one or more VL CDR1, VL CDR2 or VL CDR3 having an amino acid sequence identical to or comprising no more than 14 amino acid residue substitutions, insertions or deletions in each CDR relative to the VL of any of the sequences set forth in Table 20A as depicted in FIG. 55. In some embodiments, the invention provides an isolated antigen binding protein, wherein the antigen binding protein binds human ASGR-1 and comprises one or more VH CDR1, VH CDR2 or VH CDR3 having an amino acid sequence identical to or comprising a conservative substitution of any of the amino acid sequences set forth in Table 19B or 19C, as depicted in FIG. 55, and one or more VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises one VH CDR1, VH CDR2 or VH CDR3 having an amino acid sequence identical no more than 18 amino acid residue substitutions, insertions or deletions in each CDR relative to the VH of any of the sequences set forth in Table19A, as depicted in FIG. 55, and one VL CDR1, VL CDR2 or VL CDR3 having an amino acid sequence identical to or comprising no more than 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises one VH CDR1, VH CDR2 or VH CDR3 having an amino acid sequence identical to or comprising a conservative substitution of any of the amino acid sequences set forth in Table 19B or 19C, as depicted in FIG. 55, and one VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises two VH CDR1, VH CDR2 or VH CDR3 having an amino acid sequence identical to or comprising up to 18 amino acid residue substitutions, insertions or deletions in each CDR relative to the VH of any of the sequences set forth in Table 19A, as depicted in FIG. 55, and two VL CDR1, VL CDR2 or VL CDR3 having an amino acid sequence identical to or comprising up to 14 amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises two VH CDR1, VH CDR2 or VH CDR3 having an amino acid sequence identical to or comprising a conservative substitution of any of the amino acid sequences set forth in Table 19B or 19C, as depicted in FIG. 55, and two VL CDR1, VL CDR2 or VL CDR3 having an amino acid sequence identical to or comprising a conservative substitution of any of the amino acid sequences set forth in Table 20B or 20C, as depicted in FIG. 55. In some embodiments, the isolated antigen binding protein comprises the VH CDR1, VH CDR2 and VH CDR3 having an amino acid sequence identical to or comprising up to 18 amino acid residue substitutions, insertions or deletions in each CDR relative to the VH of any of the sequences set forth in Table 19A, as depicted in FIG. 55, and the VL CDR1, VL CDR2 and VL CDR3 having an amino acid sequence identical to or comprising up to 14amino acid residue substitutions, insertions or deletions in each CDR relative to the VL of any of the sequences set forth in Table 20A, as depicted in FIG. 55. In some embodiments, the invention provides an isolated antigen binding protein, wherein the antigen binding protein binds human ASGR-1 and comprises the VH CDR1, VH CDR2 or VH CDR3 having an amino acid sequence identical to or comprising a conservative substitution of any of the amino acid sequences set forth in Table 19B or 19C, as depicted in FIG. 55, and the VL CDR1, VL CDR2 or VL CDR3 having an amino acid sequence identical to or comprising a conservative substitution of any of the amino acid sequences set forth in Table 20B or 20C, as depicted in FIG. 55.

In some embodiments, an isolated antigen binding protein is provided, wherein the antigen binding protein specifically binds human ASGR-1 and comprises a heavy chain variable domain having at least 90% identity to any of the VH domain amino acid sequences set forth in Tables 19A, as depicted in FIG. 55 or in Tables 21-34 as depicted in FIG. 56 or in Tables 49-95 as depicted in FIG. 56. In some aspects, the invention provides an isolated antigen binding protein, wherein the antigen binding protein specifically binds human ASGR-1 and comprises a light chain variable domain having at least 90% identity to any of the VL domain amino acid sequences set forth in Table 20A, as depicted in FIG. 55, or in Tables 35-48, as depicted in FIG. 56 or in Tables 96-134 as depicted in FIG. 57. In some embodiments, the antigen binding protein comprises a heavy chain variable domain having at least 90% identity to any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having at least 90% identity to any of the VL domain amino acid sequences set forth in Table 20A as depicted in FIG. 55 or in Tables 35-48 as depicted in FIG. 56 or in Tables 96-134 as depicted in FIG. 57. In some embodiments, the antigen binding protein comprises a heavy chain variable domain having any of the VH domain amino acid sequences set forth in Tables 19A as depicted in FIG. 55, or in Tables 21-34 as depicted in FIG. 56 or in Tables 49-95 as depicted in FIG. 57, and a light chain variable domain having any of the VL domain amino acid sequences set forth in Table 20A as depicted in FIG. 55 or in Tables 35-48 as depicted in FIG. 56 or in Tables 96-134 as depicted in FIG. 57.

In some embodiments, an antigen binding protein that specifically binds to human ASGR-1 at an epitope that is bound by any of the antigen binding proteins disclosed herein is provided. In some embodiments, the invention provides an isolated antigen binding protein that specifically binds to human ASGR-1 at an epitope that is bound by at least one of the antigen binding proteins set forth in Tables 2-7. In some embodiments, the invention provides an isolated antigen binding protein that specifically binds to human ASGR-1 at an epitope that is bound by at least one of the antigen binding proteins set forth in Table A. In some embodiments, the invention provides an isolated antigen binding protein that specifically binds to human ASGR-1 at an epitope that is bound by at least one of the antigen binding proteins set forth in Table B. In some embodiments, the invention provides an isolated antigen binding protein that specifically binds to human ASGR-1 at an epitope that is bound by at least one of the antigen binding proteins set forth in Table C. In some embodiments, the invention provides an isolated antigen binding protein that specifically binds to human ASGR-1 at an epitope that is bound by at least one of the antigen binding proteins set forth in Table 6.

In some embodiments, the invention provides an isolated antigen binding protein that competes for binding to human ASGR-1 with any of the antigen binding proteins disclosed herein. In some embodiments, the invention provides an isolated antigen binding protein that competes for binding with any of the antigen binding proteins set forth in Tables 2-7. In some embodiments, the invention provides an isolated antigen binding protein that competes for binding with any of the antigen binding proteins set forth in Table A. In some embodiments, the invention provides an isolated antigen binding protein that competes for binding with any of the antigen binding proteins set forth in Table B. In still some embodiments, the invention provides an isolated antigen binding protein that competes for binding with any of the antigen binding proteins set forth in Table C. In yet another embodiment, the invention provides an isolated antigen binding protein that competes for binding with any of the antigen binding proteins set forth in Table 6.

In some embodiments, an isolated antigen binding protein that binds to human ASGR-1 within the carbohydrate recognition domain ("CRD") (also known as the carbohydrate binding domain or "CBD") and inhibits human ASGR-1 binding to ligand is provided. In some embodiments, the antigen binding protein binds to human ASGR-1 within residues 148-291, or 149-291, or 150-291, or 151-291, or 152-291, or 153-291, or 154-291, or 155-291 of SEQ ID NO:5. In some embodiments, the invention comprises an isolated antigen binding protein that binds to human ASGR-1 CBD within Helix α-1. In some embodiments, the invention comprises an isolated antigen binding protein that binds to human ASGR-1 within residues 174-186 of SEQ ID NO:5. In some embodiments, the invention comprises an isolated antigen binding protein that binds to human ASGR-1 CBD within Helix α-2. In some embodiments, the invention comprises an isolated antigen binding protein that binds to human ASGR-1 CBD within residues 194-206 of SEQ ID NO:5. In some embodiments, the invention comprises an isolated antigen binding protein that binds to human ASGR-1 within residues 237-273 or residues 240-267 of SEQ ID NO:5. In some embodiments, the antigen binding protein binds to ASGR-1 having an amino acid sequence that is at least 90% identical to SEQ ID NO:5. In some embodiments, the antigen binding protein is an antibody.

In some embodiments, an isolated antigen binding protein or an antibody that binds to human ASGR-1 and inhibits human ASGR-1 function is provided. In some embodiments, the isolated antigen binding protein or an antibody binds to human ASGR-1 and inhibits human ASGR-1 from binding to a ligand. In some embodiments, the antigen binding protein or antibody or a paratope in an antibody binds to human ASGR-1 at an epitope comprising at least one of the following amino acid residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, G260, N265, D267, G206, P207, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or paratope in an antibody binds to human ASGR-1 at an epitope comprising at least one of the following residues: D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or paratope in an antibody binds to human ASGR-1 at an epitope comprising at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments, the antigen binding protein or antibody or a paratope in an antibody binds to human ASGR-1 at an epitope comprising at least one of the following amino acid residues: H161, E162, W195, E196, Q198, K199, F200, Q202, H203, H204, G232, F233, K234, N235, W236, R237, P238, D261, G262, or R263 (SEQ ID NO:5). In some embodiments, the antigen binding protein or antibody or a paratope in an antibody binds to human ASGR1 at an epitope comprising at least one of the following amino acid residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments, the antigen binding protein or antibody or a paratope in an antibody binds to human ASGR-1 at an epitope comprising at least one of the following amino acid residues: W167, S171, G172, K173, A174, A176, D177, N180, Y181, R183, L184, E185, D186, Q270, P272, or W275 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments, the antigen binding protein or antibody or a paratope in an antibody binds to human ASGR-1 at an epitope comprising at least one of the following amino acid residues: R170, W195, E196, K199, Q202, H203, H204, I205, G206, P207, V208, F233, K234, N235, W236, P238, D260, D261, G262, R263, or R274 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments, the antigen binding protein or antibody or a paratope in an antibody binds to human ASGR-1 at an epitope comprising at least one of the following amino acid residues: H161, S194, W195, E196, Q198, K199, F200, Q202, H203, F233, K234, N235, W236, R237, P238, or R263 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments, the antigen binding protein or antibody or a paratope in an antibody binds to human ASGR-1 at an epitope comprising at least one of the following amino acid residues: H161, E162, T193, S194, W195, E196, K199, Q202, T231, G232, F233, K234, N235, P238, D261, or R263 (SEQ ID NO:5).

In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments, the antigen binding protein or antibody or a paratope in an antibody binds to human ASGR-1 at an epitope comprising at least one of the following amino acid residues: T193, S194, W195, E196, P220, W221, G226, T227, D228, Y229, E230, T231, G232, F233, K234, N235, W236, R237, P238, E239, or G252 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments, the antigen binding protein or antibody or a paratope in an antibody binds to human ASGR-1 at an epitope comprising at least one of the following amino acid residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments, the antigen binding protein or antibody or a paratope in an antibody binds to human ASGR-1 at an epitope comprising at least one of the following amino acid residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments, the antigen binding protein or antibody or a paratope in an antibody binds to human ASGR-1 at an epitope comprising at least one of the following amino acid residues: N157, R170, S171, G172, Q202, H203, H204, I205, G206, P207, V208, N209, T210, D260, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, A174, H204, I205, G206, P207, V208, N209, H257, D260, N265, D267, Q270, R271, P272, Y273, or R274 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments, the antigen binding protein or antibody or a paratope in an antibody binds to human ASGR-1 at an epitope comprising at least one of the following amino acid residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5).

In some embodiments, an isolated antigen binding protein or an antibody or a paratope in an antibody that specifically binds to human ASGR-1 and inhibits human ASGR-1 function is provided. In some embodiments, the isolated antigen binding protein or an antibody or a paratope in an antibody specifically binds to human ASGR-1 and inhibits human ASGR-1 from binding to a ligand. In some embodiments, the antigen binding protein or antibody or a paratope in an antibody specifically binds to human ASGR-1 within residues 148-291 of SEQ ID NO:5. In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5).

In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, H257, T259, N265, D266, D267, Y273, P238, E239, P241, D243, Y245, G246, H247, G252, C255, F258, D260, R263, W264, V268, R271, D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, R271, Y273, Q198, Q202, P207, V208, F233, W236, D243, E253, F258, G262, W264, D266, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, Y273, D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, N209, R237, P238, E239, P241, D243, Y245, G246, H247, G252, C255, H257, T259, D260, V268, R271, Y273, R237, Q240, D242, W244, E253, N265, D266, D267, N209, P238, E239, P241, D243, Y245, G246, H247, G252, C255, H257, T259, V268, R271, Y273, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: Q240, D242, W244, E253, N265, D266, D267, R237, Q240, D242, W244, E253, N265, D266, D267, N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R237, Q240, D242, W244, E253, N265, D266, D267, N209, P238, E239, P241, D243, Y245, G246, H247, G252, C255, H257, T259, V268, R271, or Y273 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R237, Q240, D242, W244, E253, N265, D266, or D267 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N209, R237, Q240, D242, W244, E253, H257, T259, N265, D266, D267, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, or C269 (SEQ ID NO:5). In some embodiments when the antigen binding protein or antibody is bound to human ASGR-1, the antigen binding protein or antibody or a paratope in an antibody is positioned 5 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, or Q270 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W195, N209, N235, R237, P238, E239, Q240, D242, H257, T259, D260, D261, R263, N265, D267, R271, Y273, Q198, Q202, P207, V208, F233, W236, D243, E253, F258, G262, W264, or D266 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W195, N209, N235, R237, P238, E239, Q240, D242, H257, T259, D260, D261, R263, N265, D267, R271, or Y273 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, A174, H204, I205, G206, P207, V208, N209, H257, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: R170, S171, G172, K173, A174, D177, P207, V208, N209, R237, Q240, W244, G246, H247, G248, L249, E253, H257, T259, D260, N265, D267, Q270, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: D216, Q217, N218, G219, P220, W221, Y229, E230, K234, W236, E239, Q240, P241, D242, D243, W244, Y245, G246, L249, G250, G251, G252, D254, Q270, H215, K222, T231, G232, R237, P238, H247, G248, E253, C255, D266, V268, C269, W195, N209, N235, R237, P238, E239, Q240, D242, H257, T259, D260, D261, R263, N265, D267, R271, Y273, Q198, Q202, P207, V208, F233, W236, D243, E253, F258, G262, W264, D266, H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, R170, S171, G172, A174, H204, I205, G206, P207, V208, N209, H257, D260, N265, D267, Q270, R271, P272, Y273, R274, W167, F168, S169, K173, W175, D177, Y181, Q202, H203, T210, W211, R237, F258, T259, D261, D266, V268, C269, W275, R170, S171, G172, K173, A174, D177, P207, V208, N209, R237, Q240, W244, G246, H247, G248, L249, E253, H257, T259, D260, N265, D267, Q270, R271, P272, Y273, R274, S169, W175, A176, A178, T210, W211, W236, P238, E239, D242, Y245, G250, G251, F258, D261, G262, R263, W264, D266, V268, C269, W275, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): D216, Q217, N218, G219, P220, W221, Y229, E230, K234, W236, E239, Q240, P241, D242, D243, W244, Y245, G246, L249, G250, G251, G252, D254, Q270, W195, N209, N235, R237, P238, E239, Q240, D242, H257, T259, D260, D261, R263, N265, D267, R271, Y273, H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, R170, S171, G172, A174, H204, I205, G206, P207, V208, N209, H257, D260, N265, D267, Q270, R271, P272, Y273, R274, R170, S171, G172, K173, A174, D177, P207, V208, N209, R237, Q240, W244, G246, H247, G248, L249, E253, H257, T259, D260, N265, D267, Q270, R271, P272, Y273, R274, N157, R170, S171, G172, Q202, H203, H204, I205, G206, P207, V208, N209, T210, D260, R271, P272, Y273, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, W264, W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, T279, R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, W264, H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, W264, H161, E162, T193, S194, W195, E196, K199, Q202, T231, G232, F233, K234, N235, P238, D261, R263, R163, V192, E197, Q198, H203, P207, D228, E230, W236, R237, D260, G262, or W264, T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, W264, N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270, or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, W195, E196, Q198, K199, F200, Q202, H203, H204, G232, F233, K234, N235, W236, R237, P238, D261, G262, R263, W167, S171, G172, K173, A174, A176, D177, N180, Y181, R183, L184, E185, D186, Q270, P272, W275, R170, W195, E196, K199, Q202, H203, H204, I205, G206, P207, V208, F233, K234, N235, W236, P238, D260, D261, G262, R263, R274, H161, S194, W195, E196, Q198, K199, F200, Q202, H203, F233, K234, N235, W236, R237, P238, R263, H161, E162, T193, S194, W195, E196, K199, Q202, T231, G232, F233, K234, N235, P238, D261, R263, T193, S194, W195, E196, P220, W221, G226, T227, D228, Y229, E230, T231, G232, F233, K234, N235, W236, R237, P238, E239, G252, N157, R170, S171, G172, Q202, H203, H204, I205, G206, P207, V208, N209, T210, D260, R271, P272, Y273, R274, V156, W158, V159, H161, W167, F168, S169, K173, (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, W195, E196, Q198, K199, F200, Q202, H203, H204, G232, F233, K234, N235, W236, R237, P238, D261, G262, R263, V159, E160, R163, T193, S194, E197, V201, I205, G206, P207, Y229, E230, T231, E239, F258, T259, D260, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues of human ASGR-1 (SEQ ID NO:5): H161, E162, W195, E196, Q198, K199, F200, Q202, H203, H204, G232, F233, K234, N235, W236, R237, P238, D261, G262, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: W167, S171, G172, K173, A174, A176, D177, N180, Y181, R183, L184, E185, D186, Q270, P272, W275, P155, N157, W158, F168, S169, R170, W175, A178, D179, C182, A187, W211, C269, R271, Y273, R274, C277, or T279 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: W167, S171, G172, K173, A174, A176, D177, N180, Y181, R183, L184, E185, D186, Q270, P272, or W275 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: R170, W195, E196, K199, Q202, H203, H204, I205, G206, P207, V208, F233, K234, N235, W236, P238, D260, D261, G262, R263, R274, N157, V159, F168, S169, S171, S194, Q198, F200, V201, T210, R237, E239, Q240, F258, T259, or W264 (SEQ ID NO:5). In some embodiments when the antigen binding protein or antibody or a paratope in an antibody is bound to human ASGR-1, the antigen binding protein or or a paratope in an antibody is positioned 5 angstroms or less from at least one of the following residues: R170, W195, E196, K199, Q202, H203, H204, I205, G206, P207, V208, F233, K234, N235, W236, P238, D260, D261, G262, R263, or R274 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, S194, W195, E196, Q198, K199, F200, Q202, H203, F233, K234, N235, W236, R237, P238, R263, E160, E162, V192, T193, E197, V201, H204, Y229, E230, T231, G232, E239, Q240, P241, D261, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, S194, W195, E196, Q198, K199, F200, Q202, H203, F233, K234, N235, W236, R237, P238, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: H161, E162, T193, S194, W195, E196, K199, Q202, T231, G232, F233, K234, N235, P238, D261, R263, R163, V192, E197, Q198, H203, P207, D228, E230, W236, R237, D260, G262, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: H161, E162, T193, S194, W195, E196, K199, Q202, T231, G232, F233, K234, N235, P238, D261, or R263 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: T193, S194, W195, E196, P220, W221, G226, T227, D228, Y229, E230, T231, G232, F233, K234, N235, W236, R237, P238, E239, G252, H161, E162, V191, V192, E197, Q198, D216, G219, K222, W223, D225, R263, or W264 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: T193, S194, W195, E196, P220, W221, G226, T227, D228, Y229, E230, T231, G232, F233, K234, N235, W236, R237, P238, E239, or G252 (SEQ ID NO:5). In some embodiments when the antigen binding protein or antibody or a paratope in an antibody is bound to human ASGR-1, the antigen binding protein or antibody or a paratope in an antibody is positioned 8 angstroms or less from at least one of the following residues: N157, R170, S171, G172, Q202, H203, H204, I205, G206, P207, V208, N209, T210, D260, R271, P272, Y273, R274, V156, W158, V159, H161, W167, F168, S169, K173, K199, F200, V201, W211, R237, H257, F258, T259, D261, D267, V268, Q270 or W275 (SEQ ID NO:5). In some embodiments when the antigen binding protein or antibody or a paratope in an antibody is bound to human ASGR-1, the antigen binding protein or antibody or a paratope in an antibody is positioned 5 angstroms or less from at least one of the following residues: N157, R170, S171, G172, Q202, H203, H204, I205, G206, P207, V208, N209, T210, D260, R271, P272, Y273 or R274 (SEQ ID NO:5).

In some embodiments, an isolated antigen binding protein or antibody that specifically binds to human ASGR-1 and inhibits human ASGR-1 function is provided. In some embodiments, the isolated antigen binding protein or antibody that specifically binds to human ASGR-1 inhibits binding of human ASGR-1 binding to a ligand. In some embodiments, the antigen binding protein or antibody specifically binds to human ASGR-1 at a location that overlaps with a location where a ligand binds to human ASGR-1. In some embodiments, the location where a ligand binds to ASGR-1 includes at least one amino acid residue selected from the group consisting of: N209, R237, Q240, D242, W244, E253, H257, T259, N265, D266, D267, Y273, P238, E239, P241, D243, Y245, G246, H247, G252, C255, F258, D260, R263, W264, V268, or R271 (SEQ ID NO:5). In some embodiments, an isolated antigen binding protein or an antibody specifically binds to human ASGR-1 at a location that overlaps with a location that a ligand binds to ASGR-1. In some embodiments, the location that a ligand binds to human ASGR-1 includes at least one amino acid residue selected from the group consisting of: N209, R237, Q240, D242, W244, E253, H257, T259, N265, D266, D267, and Y273 (SEQ ID NO:5).

In some embodiments, an isolated antigen binding protein that binds to human ASGR-1 and inhibits human ASGR, ASGR-1 and/or ASGR-2 function is provided, wherein the antigen binding protein does not bind to a variant ASGR-1 protein, and wherein said variant ASGR-1 protein comprises a single mutation of a residue selected the group consisting of: R170, S171, G172, R183, L184, W195, E196, K199, H203, H204, P207, V208, N209, H215, D216, P220, D225, D228, R237, P238, E239, P241, D242, D243, Y245, G246, H247, G248, L249, G251, E253, T259, D260, R263, N265, Q270, R271, P272, R274, and E280 as shown in SEQ ID NO:5. In some embodiments, an isolated antigen binding protein or an antibody is contemplated. An antigen binding protein “does not bind” to a variant ASGR-1 protein when the measured reduction in antibody binding signal to a variant ASGR-1 protein (compared to that determined for binding to wild type ASGR-1) is statistically significant as measured by any number of methods known to one skilled in the art, such as the method described in Example 7E below. In some embodiments, the variant ASGR-1 protein comprises a single mutation of a residue at a position selected from the group consisting of: W195, E196, K199, H203, H204, P207, P220, G251, and R263 as shown in SEQ ID NO:5. In some embodiments, the single mutation is selected from the group consisting of H203, H204, P220, and G251. In some embodiments, the single mutation is selected from the group consisting of W195, E196 and K199. In some embodiments, the single mutation is selected from the group consisting of W195, E196 and H204. In some embodiments, the single mutation is selected from the group consisting W195, K199, and R263. In some embodiments, the single mutation is selected from the group consisting of W195 and E196. In some embodiments, the single mutation is selected from the group consisting of W195 and K199. In some embodiments, the single mutation is selected from the group consisting of W195 or P207. In some embodiments, the single mutation is selected from the group consisting of W195 and R263. In some embodiments, the single mutation is selected from the group consisting of H203 and H204. In some embodiments, the single mutation is selected from the group consisting of K199 and R263. In some embodiments, the single mutation is a mutation of residue W195. In some embodiments, the variant ASGR-1 protein comprises a single mutation of a residue selected the group consisting of: R170, S171, R183, L184, H215, P220, P238, G246, H247, G248, G251, and N265 as shown in SEQ ID NO:5. In some embodiments, the single mutation is selected from the group consisting of R183, L184, H215, P220, G246, G248, G251, and N265. In some embodiments, the single mutation is selected from the group consisting of L184, P220, P238, H247, and G251. In some embodiments, the single mutation is selected from the group consisting of R170, S171, and L184. In some embodiments, the single mutation is a mutation of residue R183. In some embodiments, the single mutation is a mutation of residue L184. In some embodiments, the variant ASGR-1 protein comprises a single mutation of a residue at a position selected from the group consisting of: P241, D242, D243, Y245, G251, E253 and D260 as shown in SEQ ID NO:5. In some embodiments, the single mutation is selected from the group consisting of P241, D243, Y245, G251, E253 and D260. In some embodiments, the single mutation is selected from the group consisting of P241, D243, and E253. In some embodiments, the single mutation is a mutation of residue D260. In some embodiments, the variant ASGR-1 protein comprises a single mutation of a residue at a position selected from the group consisting or comprising: R170, R237, E239, P241, T259, D260, R263, and N265 as shown in SEQ ID NO:5. In some embodiments, the single mutation is selected from the group consisting of R237, D260 and R263. In some embodiments, the single mutation is selected from the group consisting of R237, T259, D260 and R263. In some embodiments, the single mutation is selected from the group consisting of R170, R237, P241, T259, D260, R263 and N265. In some embodiments, the single mutation is selected from the group consisting of R237, E239, P241, T259, D260, R263 and N265. In some embodiments, the variant ASGR-1 protein comprises a single mutation of a residue at a position selected from the group consisting or comprising: R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, V208, N209, H215, D216, D225, D228, P238, P241, D242, D243, H247, G248, L249, G251, D260, R263, N265, Q270, R271, P272, R274 and E280 as shown in SEQ ID NO:5. In some embodiments, the single mutation is selected from the group consisting of R170, S171, G172, E196, H204, P207, H215, D216, D225, D228, D243, G248, L249, G251, D260, Q270, R271, P272, R274 and E280. In some embodiments, the single mutation is selected from the group consisting of G172, V208, R271, P272 and R274. In some embodiments, the single mutation is selected from the group consisting of G172, R271 and R274. In some embodiments, the single mutation is selected from the group consisting of G172, N209, and R271. In some embodiments, the single mutation is selected from the group consisting of R170, G172, V208, R271 and P272. In some embodiments, the single mutation is selected from the group consisting of G172, V208, P238, R271, P272 and R274. In some embodiments, the single mutation is selected from the group consisting of G172, P238, R271, P272 and R274. In some embodiments, the variant ASGR-1 protein comprises a single mutation of a residue at a position selected from the group consisting or comprising: G172, P238, R271 and R274 as shown in SEQ ID NO:5. In some embodiments, the variant ASGR-1 protein comprises a single mutation of a residue at a position selected from the group consisting or comprising: R170, G172, V208 and R274 as shown in SEQ ID NO:5. In some embodiments, the variant ASGR-1 protein comprises a single mutation of a residue at a position selected from the group consisting or comprising: R170, R183, H215 and Q270 as shown in SEQ ID NO:5. In some embodiments, the variant ASGR-1 protein comprises a single mutation of a residue at a position selected from the group consisting or comprising: P241, T259, and N265 as shown in SEQ ID NO:5. In some embodiments, the variant ASGR-1 protein comprises a single mutation of a residue at a position selected from the group consisting or comprising: P207 and R263 as shown in SEQ ID NO:5. In some embodiments, the variant ASGR-1 protein comprises a single mutation of a residue at a position selected from the group consisting or comprising: G172, P241, D242, H247, L249, N265, R271 and P272 as shown in SEQ ID NO:5. In some embodiments, the antigen binding protein or antibody does not bind to two or more variant ASGR-1 proteins, wherein the variant ASGR-1 proteins comprise the single mutations of the group individually.

A "CDR grafted antibody" is an antibody comprising one or more CDRs derived from an antibody of a particular species or isotype and the framework of another antibody of the same or different species or isotype.

A "multi-specific antibody" is an antibody that recognizes more than one epitope on one or more antigens. A subclass of this type of antibody is a "bi-specific antibody" which recognizes two distinct epitopes on the same or different antigens.

An antigen binding protein including an antibody "specifically binds" to an antigen, such as ASGR, ASGR-1 or ASGR-2, if it binds to the antigen with a tight binding affinity as determined by a equilibrium dissociation constant ($K_D$, or corresponding $K_D$, as defined below) value of $10^{-7}$ M or less. An antigen binding protein that specifically binds to human ASGR, ASGR-1 or ASGR-2 may be able to bind to ASGR, ASGR-1 or ASGR-2 from other species as well with the same or different affinities.

Affinity can be determined using a variety of techniques known in the art, for example but not limited to, equilibrium methods (e.g., enzyme-linked immunoabsorbent assay (ELISA); KinExA, Rathanaswami et al. Analytical *Biochemistry*, Vol. 373:52-60, 2008; or radioimmunoassay (RIA)), or by a surface plasmon resonance assay or other mechanism of kinetics-based assay (e.g., BIACORE® analysis or Octet® analysis (ForteBIO)), and other methods such as indirect binding assays, competitive binding assays fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions. One example of a competitive binding assay is a radioimmunoassay comprising the incubation of labeled antigen with the antibody of interest in the presence of increasing amounts of unlabeled antigen, and the detection of the antibody bound to the labeled antigen. The affinity of the antibody of interest for a particular antigen and the binding off-rates can be determined from the data by scatchard plot analysis. Competition with a second antibody can also be determined using radioimmunoassays. In this case, the antigen is incubated with antibody of interest conjugated to a labeled compound in the presence of increasing amounts of an unlabeled second antibody.

Further embodiments of the invention provide antigen binding molecules (e.g., antibodies) that specifically bind ASGR, ASGR-1 and/or ASGR-2 with an equilibrium dissociation constant or $K_D$ ($k_{off}/k_{on}$) of less than $10^{-7}$ M, or of less than $10^{-8}$ M, or of less than $10^{-9}$ M, or of less than $10^{-10}$ M, or of less than $10^{-11}$ M, or of less than $10^{-12}$ M, or of less than $10^{-13}$ M, or of less than $5\times10^{-13}$ M (lower values indicating tighter binding affinity). Yet further embodiments of the invention are antigen binding molecules that specifically bind ASGR, ASGR-1 and/or ASGR-2 with an equilibrium dissociation constant or $K_D$ ($k_{off}/k_{on}$) of less than about $10^{-7}$ M, or of less than about $10^{-8}$ M, or of less than about $10^{-9}$ M, or of less than about $10^{-10}$ M, or of less than about $10^{-11}$ M, or of less than about $10^{-12}$ M, or of less than about $10^{-13}$ M, or of less than about $5\times10^{-13}$ M.

In still another embodiment, an antigen binding protein of the invention (e.g., an antibody) that specifically bind ASGR, ASGR-1 and/or ASGR-2 has an equilibrium dissociation constant or $K_D$ ($k_{off}/k_{on}$) of between about $10^{-7}$ M and about $10^{-8}$ M, between about $10^{-8}$ M and about $10^{-9}$ M, between about $10^{-9}$ M and about $10^{-10}$ M, between about $10^{-10}$ M and about $10^{-11}$ M, between about $10^{-11}$ M and about $10^{-12}$ M, between about $10^{-12}$ M and about $10^{-13}$ M. In still another embodiment, an antibody of the invention that specifically bind ASGR, ASGR-1 and/or ASGR-2 has an equilibrium dissociation constant or $K_D$ ($k_{off}/k_{on}$) of between $10^{-7}$ M and $10^{-8}$ M, between $10^{-8}$ M and $10^{-9}$ M, between $10^{-9}$ M and $10^{-10}$ M, between $10^{-10}$ M and $10^{-11}$ M, between $10^{-11}$ M and $10^{-12}$ M, between $10^{-12}$ M and $10^{-13}$ M.

It will be appreciated that an antigen binding protein of the present invention (e.g., an antibody or fragments thereof) may have at least one amino acid substitution, providing that the antigen binding protein retains the same or better desired binding specificity (e.g., binding to human ASGR, human ASGR-1, and/or human ASGR-2)(See Example 14). Therefore, modifications to the antigen binding protein structures are encompassed within the scope of the invention. In one embodiment, the antigen binding protein (e.g., but not limited to, an antibody) comprises sequences that each independently differ by 5, 4, 3, 2, 1, or 0 single amino acid additions, substitutions, and/or deletions from a CDR sequence of those set forth in Table 2 herein. As used herein, a CDR sequence that differs by no more than a total of, for example, four amino acid additions, substitutions and/or deletions from a CDR sequence shown in Table 2 below refers to a sequence with 4, 3, 2, 1 or 0 single amino acid additions, substitutions, and/or deletions compared with the sequences shown in Table 2. These may include amino acid substitutions, which may be conservative or non-conservative that do not destroy the desired binding capability of an antibody. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position. In some embodiments, the one or more substitutions to one or more of the antibody sequences can be as follows for each noted section in the noted antibody: 1) VH1|1-08/D6|6-19|RF1/JH4, 25A4 H CDR2 sequence—WMYPN - - - SGNTGYAQKFQG, where N at 11 can be S or Q and T at 12 can be A or V, such that the sequence can be Trp Met Tyr Pro Asn Ser Gly X1 X2 Gly Tyr Ala Gln Lys Phe Gln Gly (SEQ ID NO: 50259) wherein X1=N or S or Q or a conservative substitution thereof, X2=T or A or V or a conservative substitution thereof. 2) VH1|1-08/D6|6-19|RF1/JH4, 4A2 H CDR2 sequence—WMHPN - - - SGNTGYAQKFQG, where N at 11 can be S or Q, and T at 12 can be A or E, such that the sequence can be Trp Met His Pro Asn Ser Gly X1 X2 Gly Tyr Ala Gln Lys Phe Gln Gly (SEQ ID NO: 50260) wherein X1=N or S or Q or a conservative substitution thereof, X2=T or A or E or a conservative substitution thereof. 3) VK4|B3/JK3, 4A2 L CDR3 sequence—QQYYN - - - TPVT, where N at 5 can be Q, and T at 29 can be A, such that the sequence can be Gln Gln Tyr Tyr X1 X2 Pro Val Thr (SEQ ID NO: 50261) wherein X1=N or Q or a conservative substitution thereof, X2=T or A or a conservative substitution thereof. 4) VH1|1-02/D1|1-1|RF1/JH4, 4H6 H CDR3 sequence—DGTS - - - SFDY, where D at 1 can be S, G at 2 can be A, such that the sequence can be X1 X2 Thr Ser Ser Phe Asp Tyr (SEQ ID NO: 50262) wherein X1=D or S or a conservative substitution thereof, X2=or A or a conservative substitution thereof. 5) VH3|3-33/D4|4-11|RF2/JH6 and VH3|3-07/D4|4-11|RF2/JH6, 7E11 H CDR2 sequence—IIWHD - - - GSNKYYADSVKG, where D at 5 can be S or E, G at 9 can be A, D at 16 can be E, and S at 17 can be A, such that the sequence can be Ile Ile Trp His X1 X2 Ser Asn Lys Tyr Tyr Ala X3 X4 Val Lys Gly (SEQ ID NO: 50263) wherein X1=D or S or E or a conservative substitution thereof, X2=G or A or a conservative substitution thereof, X3=D or E or a conservative substitution thereof, X4=S or A or a conservative substitution thereof. 6) VH3|3-33/D6|6-6|RF1/JH6 and VH3|3-07/D6|6-6|RF1/JH6, 5E5 H CDR2 sequence VIWYD - - - GSNKYYADSVKG, where G at 9 can be A, D at 16 can be E or G, and S at 17 can be A, such that the sequence can be Val Ile Trp Tyr Asp X1 Ser Asn Lys Tyr Tyr Ala X2 X3 Val Lys Gly (SEQ ID NO: 50264) wherein X1=G or A or a conservative substitution thereof X2=D or E or G or a conservative substitution thereof X3=S or A or a conservative substitution thereof. 7) VH3|3-33/D6|6-6|RF1/JH6 and VH3|3-07/D6|6-6|RF1/JH6, 5E5 H CDR3 sequence EVYSSGW - - - YDYGMDV, where W at 7 can be F, such that the sequence can be Glu Val Tyr Ser Ser Gly X1 Tyr Asp Tyr Gly Met Asp Val (SEQ ID NO: 50265) wherein X1=W or F or a conservative substitution thereof.

In some embodiments, any one or more of the above CDR sequences can be combined with any one or more of the CDR sequences provided herein (e.g., Table 2 in FIG. 49, and Tables 19A-C and Tables 20A-C in FIG. 55). In some embodiments, any one or more of the above CDR sequences can be combined with any one or more CDR sequences provided herein for the designated antibody to provide an antibody of 6 CDRs (LCDR1, LCDR2, LCDR3, HCDR1, HCDR2, and HCDR3). For example, any one or more of the above CDRs can be used as one of the CDRs for the antibodies provided in Table 2 in FIG. 49 and/or Tables 19A, 19B, 19C, 20A, 20B and/or 20C in FIG. 55. In some embodiments, the variant positions provided in the above consensus sequences can be further combined as optional variations with the variations of sequence provided in Table 2 in FIG. 49, and Tables 19A-C and Tables 20A-C in FIG. 55, such that any demonstrated combination of sequences in one consensus sequence (e.g., for an antibody, such as 4A2 H CDR2 above) can be combined with all permissible options outlined for the relevant antibody in Table 2 in FIG. 49, and Tables 19A-C and Tables 20A-C in FIG. 55 (e.g., the corresponding 4A2 H CDR2), which can further be combined with any of the other 4A2 sequences in Table 2 in FIG. 49, and Tables 19A-C and Tables 20A-C in FIG. 55 (e.g., HCDR1, HCDR3, LCDR1, LCDR2, and LCDR3). Of course, 4A2 L CDR3 noted above can similarly be combined, and/or combined with the immediate combination as well. Thus, such sequences are not disclosed herein as needing to be alternative sequences, but are contemplated as additional options for the noted sequences. In some embodiments, variants of such sequences are also contemplated. Such variants can retain or have superior desired activity. Examples of such aspects are provided in Example 14 and tables 6 and 7. In some embodiments, any one or more of the FR regions in tables 6 and 7 can be combined with any one or more of the CDR sequences provided herein. In some embodiments, any one or more of the FR regions provided in Table 6 or 7 can be combined with the corresponding CDR set for the corresponding antibody (as a set of 6 CDRs). Thus, variants of antibody 4A2 are provided that include 6 CDRs (HCDR1, HCDR2, HCDR3, LCDR1, LCDR2, and LCDR3) and 8 FRs HFR1, HFR2, HFR3, HFR4, LFR1, LFR2, LFR3, and LFR4), any particular sequence of which can be from any of the designated sequences for antibody 4A2 provided herein (the present paragraph, Tables 2, 6 and/or 7, tables 19A, 19B, and 19C, 20A, 20B and 20C, etc).

Non-conservative substitutions may involve the exchange of a member of one class of amino acids or amino acid mimetics for a member from another class with different physical properties (e.g. size, polarity, hydrophobicity, charge). In certain embodiments, such substituted residues may be introduced into regions of a human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the antigen binding protein as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides as has been describe above. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art may opt for chemically similar amino acid substitutions for such predicted important amino acid residues.

In some embodiments, one skilled in the art may identify residues that may be changed that result in enhanced properties as desired. For example, an amino acid substitution (conservative or non-conservative) may result in enhanced binding affinity to human ASGR, human ASGR-1, and/or human ASGR-2, or enhanced binding affinity to other species of ASGR, ASGR-1, and/or ASGR-2.

One skilled in the art can also analyze the three-dimensional structure and amino acid sequence in relation to that structure in similar polypeptides. In view of such information, one skilled in the art may predict the alignment of amino acid residues of an antibody with respect to its three dimensional structure. In certain embodiments, one skilled in the art may choose not to make radical changes to amino acid residues predicted to be on the surface of the protein, since such residues may be involved in important interactions with other molecules. A number of scientific publications have been devoted to the prediction of secondary structure. See Moult J., Curr. Op. in Biotech., 7(4):422-427 (1996), Chou et al., Biochemistry, 13(2):222-245 (1974); Chou et al., Biochemistry, 113(2):211-222 (1974); Chou et al., Adv. Enzymol. Relat. Areas Mol. Biol., 47:45-148 (1978); Chou et al., Ann. Rev. Biochem., 47:251-276 and Chou et al., Biophys. J., 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The growth of the protein structural database (PDB) has provided enhanced predictability of secondary structure, including the potential number of folds within a polypeptide's or protein's structure. See Holm et al., Nucl. Acid. Res., 27(1):244-247 (1999). Additional methods of predicting secondary structure include "threading" (Jones, D., Curr. Opin. Struct. Biol., 7(3):377-87 (1997); Sippl et al., Structure, 4(1):15-19 (1996)), "profile analysis" (Bowie et al., Science, 253:164-170 (1991); Gribskov et al., Meth. Enzym., 183:146-159 (1990); Gribskov et al., Proc. Nat. Acad. Sci., 84(13):4355-4358 (1987)), and "evolutionary linkage" (See Holm, supra (1999), and Brenner, supra (1997)).

In certain embodiments, variants of the antigen binding protein include glycosylation variants wherein the number and/or type of glycosylation site has been altered compared to the amino acid sequences of a parent polypeptide. In certain embodiments, variants comprise a greater or a lesser number of N-linked glycosylation sites than the native protein. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional antibody variants include cysteine variants wherein one or more cysteine residues are deleted from or substituted for another amino acid (e.g., serine) as compared to the parent amino acid sequence. Cysteine variants may be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

Desired amino acid substitutions (whether conservative or non-conservative) can be determined by those skilled in the art at the time such substitutions are desired. In certain embodiments, amino acid substitutions can be used to identify important residues of antibodies to the target of interest, or to increase or decrease the affinity of the antibodies to the target of interest described herein.

According to certain embodiments, desired amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) may be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. Nature 354:105 (1991), which are each incorporated herein by reference.

Antigen Binding Protein Sequences

The amino acid sequences of the light chain CDRs of exemplary antigen binding proteins (antibodies) and the heavy chain CDRs of exemplary antigen binding proteins (antibodies) are shown in Tables 2-7, in addition to the exemplary antigen binding proteins described above as consensus light chain CDRs and/or consensus heavy chain CDRs (see Tables 19 B and C and Tables 20 B and C in FIG. 55). Also shown are polynucleotide sequences which encode the amino acid sequences of the CDRs (Table 2). Tables 3-7 and Tables A, B and C further provide the amino acid sequences of the VH and VL of exemplary antigen binding proteins (e.g., antibodies), in addition to the exemplary antigen binding proteins described above as consensus variable light chain sequences and/or consensus variable heavy chain sequences (see Table 19A and Table 20A in FIG. 55, as well as the Tables in FIGS. 56 and 57). Table 3 further provides the polynucleotide (DNA) sequences encoding the amino acid sequences of the variable light and variable heavy domains for exemplary antibodies.

Particular embodiments of antigen binding proteins of the present invention comprise one or more amino acid sequences that are identical to the amino acid sequences of one or more of the CDRs and/or FRs (framework regions) illustrated herein in Tables 2-7, and Tables A-C below. In one embodiment, the antigen binding protein comprises a light chain CDR1 sequence illustrated herein in Table 2 in FIG. 49 and Table C below. In another embodiment, the antigen binding protein comprises a light chain CDR2 sequence illustrated herein in Table 2 in FIG. 49 and Table C below. In another embodiment, the antigen binding protein comprises a light chain CDR3 sequence illustrated in herein in Table 2 in FIG. 49 and Table C below. In another embodiment, the antigen binding protein comprises a heavy chain CDR1 sequence illustrated in herein in Table 2 in FIG. 49 and Table C below. In another embodiment, the antigen binding protein comprises a heavy chain CDR2 sequence illustrated herein in Table 2 in FIG. 49 and Table C below. In another embodiment, the antigen binding protein comprises a heavy chain CDR3 sequence illustrated herein in Table 2 in FIG. 49 and Table C below. In another embodiment, the antigen binding protein comprises a light chain FR1 sequence illustrated herein in Tables 3-7 in FIGS. 50-54, respectively. In another embodiment, the antigen binding protein comprises a light chain FR2 sequence illustrated herein in Tables 3-7 in FIGS. 50-54, respectively. In another embodiment, the antigen binding protein comprises a light chain FR3 sequence illustrated herein in Tables 3-7 in FIGS. 50-54, respectively. In another embodiment, the antigen binding protein comprises a light chain FR4 sequence illustrated herein in Table 3-7 in FIGS. 50-54, respectively. In another embodiment, the antigen binding protein comprises a heavy chain FR1 sequence illustrated herein in Table 3-7 in FIGS. 50-54, respectively. In another embodiment, the antigen binding protein comprises a heavy chain FR2 sequence illustrated herein in Table 3-7 in FIGS. 50-54, respectively. In another embodiment, the antigen binding protein comprises a heavy chain FR3 sequence illustrated herein in Table 3-7 in FIGS. 50-54, respectively. In another embodiment, the antigen binding protein comprises a heavy chain FR4 sequence illustrated herein in Table 3-7 in FIGS. 50-54, respectively.

In another embodiment, at least one of the antigen binding protein's CDR3 sequences differs by no more than 6, 5, 4, 3, 2, 1 or 0 single amino acid addition, substitution, and/or deletion from a CDR3 sequence from the sequences as shown in Table 2 in FIG. 49 or Table C below. In another embodiment, the antigen binding protein's light chain CDR3 sequence differs by no more than 6, 5, 4, 3, 2, 1 or 0 single amino acid addition, substitution, and/or deletion from a light chain CDR3 sequence from the sequences as shown in Table 2 in FIG. 49 or Table C below and the antigen binding protein's heavy chain CDR3 sequence differs by no more than 6, 5, 4, 3, 2, 1 or 0 single amino acid addition, substitution, and/or deletion from a heavy chain CDR3 sequence from the sequences as shown in Table 2 in FIG. 49 or Table C below. In another embodiment, the antigen binding protein further comprises 1, 2, 3, 4, or 5 CDR sequences that each independently differs by 6, 5, 4, 3, 2, 1, or 0 single amino acid additions, substitutions, and/or deletions from a CDR sequence of the sequences shown in Table 2 in FIG. 49 or Table C below. In another embodiment, the antigen binding protein comprises the CDRs of the light chain variable region and the CDRs of the heavy chain variable region set forth in Table 2 in FIG. 49 or Table C below. In a further embodiment, the antigen binding protein comprises the CDRs of any one of the antibodies in Table 2 in FIG. 49 or Table C below. In one embodiment, the antigen binding protein is a human antibody. In another embodiment, the antigen binding protein is a humanized antibody. In certain embodiments, the VH CDRs and the VL CDRs are paired in a manner indicated in Tables 2-7 in FIGS. 49-54, respectively.

In one embodiment, the antigen binding protein (e.g., an antibody) comprises a light chain variable domain comprising a sequence of amino acids that differs from the sequence of a light chain variable domain listed in Table 3-7 in FIGS. 50-54, respectively at 15, 14, 13, 12, 11, 10, 9, 8, 7, 6, 5, 4, 3, 2, 1 or 0 residues, wherein each such sequence difference is independently either a deletion, insertion, or substitution of one amino acid residue. In another embodiment, the antigen binding protein (e.g., an antibody) comprises a heavy chain variable domain comprising a sequence of amino acids that differs from the sequence of a heavy chain variable domain listed in Table 3-7 in FIGS. 50-54, respectively at 15, 14, 13, 12, 11, 10, 9, 8, 7, 6, 5, 4, 3, 2, 1 or 0 residues, wherein each such sequence difference is independently either a deletion, insertion, or substitution of one amino acid residue. In certain embodiments, the antigen binding protein comprises a light chain variable domain and a heavy chain variable domain that are paired in a manner indicated in Tables 3-7 in FIGS. 50-54, respectively. In certain embodiments, the antigen binding protein comprises a light chain variable domain and a heavy chain variable domain that are paired in a manner indicated in Tables A-C below.

In a particular embodiment, the antigen binding protein (e.g., antibody) binds to human ASGR-1 and comprises a heavy chain variable domain containing one or more VH CDR1 (HCDR1), VH CDR2 (HCDR2) and/or VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470.

In a particular embodiment, the antigen binding protein (e.g., antibody) binds to human ASGR-1 and comprises a light chain variable domain containing one or more VL CDR1 (LCDR1), VL CDR2 (LCDR2) and/or VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261.

In a particular embodiment, the antigen binding protein (e.g., antibody) binds to human ASGR-1 and comprises A) a heavy chain variable domain containing one or more VH CDR1 (HCDR1), VH CDR2 (HCDR2) and/or VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470; and B) a light chain variable domain containing one or more VL CDR1 (LCDR1), VL CDR2 (LCDR2) and/or VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261. In one embodiment, the antigen binding protein (e.g., antibody) comprises A) a heavy chain variable domain containing a VH CDR1 (HCDR1), a VH CDR2 (HCDR2) and a VH CDR3 (HCDR3), wherein the VH CDR1 (HCDR1) has an amino acid sequence identical to, or comprising not more than 3 amino acid additions/insertions, deletions or substitutions as compared to, the amino acid sequences selected from the group consisting of SEQ ID NO:5136, SEQ ID NO:50001, SEQ ID NO:50012 and SEQ ID NO:50468; the VH CDR2 (HCDR2) has an amino acid sequence identical to, or comprising not more than 3 amino acid additions/insertions, deletions or substitutions as compared to, the amino acid sequences selected from the group consisting of SEQ ID NO:13148, SEQ ID NO:50002, SEQ ID NO:50014, and SEQ ID NO:50260; and the VH CDR3 (HCDR3) has an amino acid sequence identical to, or comprising not more than 3 amino acid additions/insertions, deletions or substitutions as compared to, the amino acid sequences selected from the group consisting of SEQ ID NO:21160, SEQ ID NO:50003, and SEQ ID NO:50470; and B) a light chain variable domain containing a VL CDR1 (LCDR1), a VL CDR2 (LCDR2) and a VL CDR3 (LCDR3), wherein the VL CDR1 (LCDR1) has an amino acid sequence identical to, or comprising not more than 3 amino acid additions/insertions, deletions or substitutions as compared to, the amino acid sequences selected from the group consisting of SEQ ID NO:1130, SEQ ID NO:50133, SEQ ID NO:50156 and SEQ ID NO:50162; the VL CDR2 (LCDR2) has an amino acid sequence identical to, or comprising not more than 3 amino acid additions/insertions, deletions or substitutions as compared to, the amino acid sequences selected from the group consisting of SEQ ID NO:9142, SEQ ID NO:50157, SEQ ID NO:50163, SEQ ID NO:50229, SEQ ID NO:50643 and SEQ ID NO:50649; and the VL CDR3 (LCDR3) has an amino acid sequence identical to, or comprising not more than 3 amino acid additions/insertions, deletions or substitutions as compared to, the amino acid sequences selected from the group consisting of SEQ ID NO:17154, SEQ ID NO:50134, SEQ ID NO:50164, and SEQ ID NO:50261. In one embodiment, the antigen binding protein comprises A) a heavy chain variable domain containing a VH CDR1 (HCDR1), a VH CDR2 (HCDR2) and a VH CDR3 (HCDR3), wherein the VH CDR1 (HCDR1) amino acid sequence is selected from the group consisting of SEQ ID NO:5136, SEQ ID NO:50001, SEQ ID NO:50012 and SEQ ID NO:50468; the VH CDR2 (HCDR2) amino acid sequence is selected from the group consisting of SEQ ID NO:13148, SEQ ID NO:50002, SEQ ID NO:50014, and SEQ ID NO:50260; and the VH CDR3 (HCDR3) amino acid sequence is selected from the group consisting of SEQ ID NO:21160, SEQ ID NO:50003, and SEQ ID NO:50470; and B) a light chain variable domain containing a VL CDR1 (LCDR1), a VL CDR2 (LCDR2) and a VL CDR3 (LCDR3), wherein the VL CDR1 (LCDR1) amino acid sequence is selected from the group consisting of SEQ ID NO:1130, SEQ ID NO:50133, SEQ ID NO:50156 and SEQ ID NO:50162; the VL CDR2 (LCDR2) amino acid sequence is selected from the group consisting of SEQ ID NO:9142, SEQ ID NO:50157, SEQ ID NO:50163, SEQ ID NO:50229, SEQ ID NO:50619, SEQ ID NO:50643 and SEQ ID NO:50649; and the VL CDR3 (LCDR3) amino acid sequence is selected from the group consisting of SEQ ID NO:17154, SEQ ID NO:50134, SEQ ID NO:50164, and SEQ ID NO:50261. In one embodiment, the antigen binding protein comprises a heavy chain variable domain and a light chain variable domain containing a VH CDR1 having the amino acid sequence set forth in SEQ ID NO:5136; a VH CDR2 having the amino acid sequence set forth in SEQ ID NO:13148; a VH CDR3 having the amino acid sequence set forth in SEQ ID NO:21160; a VL CDR1 having the amino acid sequence set forth in SEQ ID NO:1130; a VL CDR2 having the amino acid sequence set forth in SEQ ID NO:9142; and a VL CDR3 having the amino acid sequence set forth in SEQ ID NO:17154.

In a particular embodiment, the antigen binding protein (e.g., antibody) comprises a) a light chain variable domain having no more than ten or no more than five amino acid additions/insertions, deletions or substitutions from the amino acid sequence set forth in SEQ ID NO:25164 or SEQ ID NO:50326; b) a heavy chain variable domain having no more than ten or no more than five amino acid additions/insertions, deletions or substitutions from the amino acid sequence set forth in SEQ ID NO:29170 or SEQ ID NO:50266; or c) the light chain variable domain of a) and the heavy chain variable domain of b). In one embodiment, the antigen binding protein comprises a light chain variable domain having the amino acid sequence set forth in SEQ ID NO:25164 or SEQ ID NO:50326; and a heavy chain variable domain having the amino acid sequence set forth in SEQ ID NO:29170 or SEQ ID NO:50266. In one embodiment, the antigen binding protein comprises a light chain variable domain having the amino acid sequence set forth in SEQ ID NO:50326; and a heavy chain variable domain having the amino acid sequence set forth in SEQ ID NO:50266. In one embodiment, the antigen binding protein comprises a light chain variable domain having the amino acid sequence set forth in SEQ ID NO:25164; and a heavy chain variable domain having the amino acid sequence set forth in SEQ ID NO:29170.

While specific embodiments relating to the antigen binding protein identified as 4A2 are set forth above with particularity, the embodiments of the present invention are not intended to be limited in scope to this individual embodiment. The embodiments directed to 4A2 are intended merely as single illustrations of individual embodiments. It is fully anticipated that the embodiments of the present invention include antigen binding proteins comprising heavy chain variable domains containing one or more VH CDR1 (HCDR1), VH CDR2 (HCDR2) and/or VH CDR3 (HCDR3) and/or light chain variable domains containing one or more VL CDR1 (LCDR1), VL CDR2 (LCDR2) and/or VL CDR3 (LCDR3) as set forth in Tables 2-7 in FIGS. 49-57, respectively, as well as Tables 19A-C and Tables 20A-C in FIG. 55, Tables 21-134 in FIGS. 56 and 57, and Tables A, B and C.

TABLE A

Exemplary Heavy and Light Chain Variable Regions

| Ab name | SEQ ID NOs: VH/VL | Ab name | SEQ ID NOs: VH/VL | Ab name | SEQ ID NOs: VH/VL | Ab name | SEQ ID NOs: VH/VL |
|---|---|---|---|---|---|---|---|
| 10G6 | 29184/25178 | 59F2 | 31512/27506 | 147E9 | 30172/26166 | 191G10 | 30846/26840 |
| 11E2 | 29040/25034 | 5E5 | 29016/25010 | 184E7 | 30660/26654 | 191G12 | 30730/26724 |
| 11F5 | 29054/25048 | 60D2 | 31518/27512 | 194A4 | 30820/26814 | 192C10 | 30764/26758 |
| 12E9 | 29186/25180 | 60E8 | 29494/25488 | 208A2 | 28136/24130 | 192C8 | 30756/26750 |
| 12F11 | 29178/25172 | 63A10 | 31536/27530 | 210G10 | 31054/27048 | 192E4 | 30744/26738 |
| 12F12 | 29188/25182 | 63G7 | 31534/27528 | 4B1 | 28878/24872 | 192G6 | 30752/26746 |
| 13F6 | 28772/24766 | 64B12 | 29624/25618 | 60E12 | 29502/25496 | 192G8 | 30760/26754 |
| 148E10 | 28132/24126 | 65F10 | 28134/24128 | 61A1 | 29504/25498 | 192H10 | 30768/26762 |
| 154F4 | 31392/27386 | 68G6 | 28224/24218 | 62H10 | 31832/27826 | 193C7 | 30794/26788 |
| 159H8 | 31416/27410 | 6A6 | 28806/24800 | 63H8 | 29604/25598 | 194B7 | 30828/26822 |
| 160B12 | 31418/27412 | 6D4 | 28816/24810 | 72G9 | 32080/28074 | 194C1 | 30816/26810 |
| 175D10 | 30538/26532 | 6D9 | 29154/25148 | 8D8 | 29168/25162 | 196C7 | 30870/26864 |
| 177D2 | 31858/27852 | 6G6 | 29198/25192 | 12D2 | 29036/25030 | 197B6 | 30894/26888 |
| 25A4 | 28522/24516 | 70D1 | 29670/25664 | 148H10 | 30196/26190 | 197E11 | 30906/26900 |
| 25D12 | 28510/24504 | 7A10 | 29194/25188 | 173C11 | 30520/26514 | 197F2 | 30886/26880 |
| 26C4 | 28580/24574 | 7E11 | 28914/24908 | 179C2 | 30570/26564 | 197G3 | 30888/26882 |
| 27E7 | 28744/24738 | 7F4 | 28814/24808 | 47C1 | 29286/25280 | 198G3 | 30620/26614 |
| 28H2 | 29190/25184 | 7F8 | 28948/24942 | 49C1 | 29320/25314 | 213B3 | 31092/27086 |
| 29E2 | 29192/25186 | 7G4 | 28966/24960 | 60C12 | 29500/25494 | 219H1 | 31156/27150 |
| 29E6 | 28550/24544 | 8D12 | 29050/25044 | 60G2 | 29482/25476 | 74C8 | 29768/25762 |
| 29H8 | 28798/24792 | 9F12LC1 | 28216/24210 | 65D5 | 29632/25626 | 74G6 | 29894/25888 |
| 32D6 | 29196/25190 | 9F12LC2 | 28217/24211 | 66H11 | 28130/24124 | 75G3 | 29714/25708 |

TABLE A-continued

Exemplary Heavy and Light Chain Variable Regions

| Ab name | SEQ ID NOs: VH/VL | Ab name | SEQ ID NOs: VH/VL | Ab name | SEQ ID NOs: VH/VL |
|---|---|---|---|---|---|
| 3G7 | 28840/24834 | 9G9 | 28790/24784 | 71A6 | 28128/24122 |
| 45B4 | 29252/25246 | 65E9 | 31538/27532 | 73G1 | 31556/27550 |
| 49F10 | 29334/25328 | 72B4 | 31552/27546 | 49C5 | 32086/28080 |
| 4A2 | 29170/25164 | 7H7 | 28944/24938 | 49D10 | 32088/28082 |
| 4B3 | 28750/24744 | 9C11 | 28856/24850 | 51E3 | 30958/26952 |
| 4H6 | 28936/24930 | 12B12 | 28978/24972 | 51F4 | 31476/27470 |
| 50D4 | 29362/25356 | 147D10 | 30174/26168 | 53E8 | 32090/28084 |
| 50G9 | 32082/28076 | 149D11 | 30226/26220 | 54E9 | 31488/27482 |
| 51E9 | 29366/25360 | 149F8 | 30222/26216 | 56E3 | 31492/27486 |
| 52G11 | 28138/24132 | 151B9 | 31372/27366 | 56G1 | 31490/27484 |
| 52H1 | 31482/27476 | 175F4 | 31456/27450 | 190C11 | 30602/26596 |
| 53F2 | 28140/24134 | 22G5 | 28368/24362 | 190E6 | 30642/26636 |
| 53F7 | 29412/25406 | 48B12 | 31820/27814 | 190F12 | 30618/26612 |
| 55B1 | 29430/25424 | 52H2 | 29380/25374 | 190F8 | 30712/26706 |
| 56E5 | 29466/25460 | 6G7 | 28880/24874 | 190G11 | 30608/26602 |
| 65C12 | 32078/28072 | 7G2 | 28942/24936 | 190H9 | 30716/26710 |

| Ab name | SEQ ID NOs: VH/VL | Ab name | SEQ ID NOs: VH/VL | Ab name | SEQ ID NOs: VH/VL |
|---|---|---|---|---|---|
| 89A11 | 30028/26022 | | | | |
| 74B2 | 29736/25730 | | | | |
| 74H7 | 29966/25960 | | | | |
| 85F7 | 29766/25760 | | | | |
| 198B9 | 30918/26912 | | | | |
| 199A7 | 30932/26926 | | | | |
| 218G4 | 31786/27780 | | | | |
| 146A8 | 31332/27326 | | | | |
| 146B6 | 31334/27328 | | | | |
| 149A1 | 31344/27338 | | | | |
| 172B12 | 31452/27446 | | | | |
| 172C3 | 31450/27444 | | | | |
| 193E7 | 30796/26790 | | | | |
| 199E3 | 30926/26920 | | | | |
| 226F9 | 31264/27258 | | | | |
| 227C1 | 31280/27274 | | | | |

| Ab name | SEQ ID NOs: VH/VL | Ab name | SEQ ID NOs: VH/VL | Ab name | SEQ ID NOs: VH/VL |
|---|---|---|---|---|---|
| 176H4 | 30542/26536 | 72F5 | 29700/25694 | 48D7 | 29306/25300 |
| 194C10 | 30832/26826 | 191A10 | 30724/26718 | 52D10 | 29388/25382 |
| 191E10 | 30726/26720 | 191G1 | 30628/26622 | 59E6 | 29590/25584 |
| 196F4 | 30868/26862 | 227F2 | 31282/27276 | 64E2 | 31836/27830 |
| 198D2 | 31604/27598 | 31D12LC1 | 29176/25170 | 57A7 | 29554/25548 |
| 202A3 | 30972/26966 | 31D12LC2 | 29174/25168 | 58G11 | 31510/27504 |
| 204G6 | 31004/26998 | 7C3LC1 | 28212/24206 | 64G12 | 29626/25620 |
| 224G1 | 31196/27190 | 7C3LC2 | 28214/24208 | | |

TABLE B

| Ab name | SEQ ID NOs: VH/VL | Ab name | SEQ ID NOs: VH/VL | Ab name | SEQ ID NOs: VH/VL | Ab name | SEQ ID NOs: VH/VL |
|---|---|---|---|---|---|---|---|
| 175D10 | 30538/26532 | 184E7 | 30660/26654 | 192E4 | 30744/26738 | 74B2 | 29736/25730 |
| 25A4 | 28522/24516 | 194A4 | 30820/26814 | 192G6 | 30752/26746 | 74H7 | 29966/25960 |
| 26C4 | 28580/24574 | 208A2 | 28136/24130 | 192G8 | 30760/26754 | 85F7 | 29766/25760 |
| 29H8 | 28798/24792 | 210G10 | 31054/27048 | 192H10 | 30768/26762 | 218G4 | 31786/27780 |
| 49F10 | 29334/25328 | 4B1 | 28878/24872 | 193C7 | 30794/26788 | 172B12 | 31452/27446 |
| 4A2 | 29170/25164 | 72G9 | 32080/28074 | 194B7 | 30828/26822 | 172C3 | 31450/27444 |
| 4H6 | 28936/24930 | 190C11 | 30602/26596 | 194C1 | 30816/26810 | 193E7 | 30796/26790 |
| 50D4 | 29362/25356 | 190E6 | 30642/26636 | 196C7 | 30870/26864 | 199E3 | 30926/26920 |
| 51E9 | 29366/25360 | 190F12 | 30618/26612 | 197B6 | 30894/26888 | 191E10 | 30726/26720 |
| 52H1 | 31482/27476 | 190F8 | 30712/26706 | 197E11 | 30906/26900 | 196F4 | 30868/26862 |
| 55B1 | 29430/25424 | 190G11 | 30608/26602 | 197F2 | 30886/26880 | 198D2 | 31604/27598 |
| 56E5 | 29466/25460 | 190H9 | 30716/26710 | 197G3 | 30888/26882 | 202A3 | 30972/26966 |
| 64B12 | 29624/25618 | 191A10 | 30724/26718 | 198G3 | 30620/26614 | 204G6 | 31004/26998 |
| 6G6 | 29198/25192 | 191G1 | 30628/26622 | 213B3 | 31092/27086 | 10G6 | 29184/25178 |
| 7F4 | 28814/24808 | 191G10 | 30846/26840 | 219H1 | 31156/27150 | 160B12 | 31418/27412 |
| 7G4 | 28966/24960 | 191G12 | 30730/26724 | 74C8 | 29768/25762 | 177D2 | 31858/27852 |
| 149F8 | 30222/26216 | 192C10 | 30764/26758 | 74G6 | 29894/25888 | 53F7 | 29412/25406 |
| 48B12 | 31820/27814 | 192C8 | 30756/26750 | 75G3 | 29714/25708 | 63A10 | 31536/24530 |
| 7E11 | 28914/24908 | 198B9 | 30918/26912 | 146B6 | 31334/27328 | 22G5 | 28368/24362 |
| 6G7 | 28880/24874 | 199A7 | 30932/26926 | 176H4 | 30542/26536 | 5E5 | 29016/25010 |
| 147E9 | 30172/26166 | 146A8 | 31332/27326 | 149A1 | 31344/27338 | 194C10 | 30832/26826 |
| 54E9 | 31488/27482 | 12D2 | 29036/25030 | | | | |

TABLE C

| Exemplary Heavy and Light Chain Variable Regions and Heavy and Light Chain CDR1/2/3 | | | | | | | | |
|---|---|---|---|---|---|---|---|---|
| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
| 25A4 | 28522 or 50266 | 24516 or 50316 | 4488, 50468, 50001 or 50013 | 12500, 50002, 50014 or 50259 | 20512, 50003 or 50470 | 480, 50133 or 50162 | 8492, 50157, 50229, 50619, 50643 or 50649 | 16504, 50134, 50164 or 50620 |
| 26C4 | 28580 or 50266 | 24574 or 50316 | 4546, 50001, 50013 or 50468 | 12588 or 50002 | 20570, 50003 or 50470 | 538, 50133 or 50156 | 8550, 50157, 50163, 50229, 50619, 50643 or 50649 | 16562, 50134, 50164 or 50620 |
| 29H8 | 28798 or 50266 | 24792 or 50316 | 4764, 50001, 50013 or 50468 | 12776 or 50002 | 20788 or 50003 or 50470 | 756 or 50133 | 8768, 50157, 50163 50229, 50619, 50643 or 50649 | 16780 or 50134 |
| 4A2 | 29170 or 50266 | 25164 or 50326 | 5136, 50001, 50013, or 50468 | 13148, 50002, 50014 or 50260 | 21160, 50003 or 50470 | 1130, 50133, 50156 or 50162 | 9142, 50157, 50163 50229, 50619, 50643 or 50649 | 17154, 50134, 50164 or 50261 |
| 4H6 | 28936 or 50272 | 24930 or 50321 | 4902 or 50019 | 12914 or 50020 | 20926 or 50021 or 50262 | 894, 50147 or 50159 | 8096, 50148 or 50160 | 16918 or 50149 |
| 56E5 | 29466 or 50272 | 25460 or 50321 | 5432, 50019 or 50058 | 13444 or 50020 | 21456 or 50021 | 1426 or 50147 | 9438, 50123, 50131, 50136, 50139, 50142, 50145, 50148, 50154, 50160, 50181, 50184, 50199, 50202, 50213 or 50248 | 17450 or 50149 |
| 7F4 | 28814 or 50284 | 24808 or 50312 | 4780, 50046 or 50075 | 12792 or 50047 | 20804 or 50048 | 772, 50122, 50130, 50135 or 50198 | 8784, 50123, 50131, 50136, 50139, 50142, 50145, 50148, 50154, 50160, 50181, 50199 or 50213 | 16796 or 50124 |
| 7G4 | 28966 or 50267 | 24960 or 50315 | 4932, 50004, 50037 or 50107 | 12944, 50005, 50008, 50017, 50023, 50026, 50038, 50053, 50067, 50073, 50085, 50088, 50100, | 20956 or 50006 | 924, 50122, 50130, 50135, 50198, or 50247 | 8936, 50123, 50131, 50136, 50139, 50142, 50145, 50148, 50154, 50160, 50181, 50184, 50199, | 16948 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| 48B12 | 31820 or 50267 | 27814 | 7784, 50034, 50055, 50093, 50113 or 50116 | 50108, 50238 or 50254 15796, 50032, 50035, 50056, 50070, 50091, 50105 or 50117 | 23808 | 3780 | 50202, 50213 or 50248 11792 or 50126 | 19804 |
| 184E7 | 30660 or 50272 | 26654 or 50320 | 6626, 50019 or 50237 | 14638 or 50020 | 22650 | 2620, 50138, 50144, 50147, 50183 or 50212 | 10632, 50123, 50131, 50136, 50139, 50142, 50145, 50148, 50154, 50160, 50181, 50184, 50199, 50202, 50213 or 50248 | 18644 or 50146 |
| 194A4 | 30820 | 26814 or 50342 | 6786 | 14798, 50020, 50050, 50059 or 50079 | 22810 | 2780 or 50206 | 10792, 50128 or 50207 | 18804 or 50208 |
| 4B1 | 28878 | 24872 or 50323 | 4844 | 12856 | 20868 | 836, 50141 or 50153 | 8848, 50123, 50131, 50136, 50139, 50142, 50145, 50148, 50154, 50160, 50181, 50184, 50199, 50202, 50213 or 50248 | 16860, 50143 or 50203 |
| 190F8 | 30712 or 50271 | 26706 or 50318 | 6678, 50007, 50016, 50037, 50066, 50072 50084, 50237 or 50253 | 14690, 50017, 50023, 50038 or 50088 | 22702 or 50018 | 2672, 50138 or 50144 | 10684 or 50139 | 18696, 50140, or 50146 |
| 191G1 | 30628 or 50271 | 26622 or 50318 | 6594, 50004, 50007, 50016, 50022, 50025, 50037, 50066, 50072, 50084, 50087, 50096, 50099, 50107, 50237 or 50252 | 14606, 50008 or 50017 | 22618 or 50018 | 2588, 50138, 50144, 50147, 50183, or 50212 | 10600, 50123, 50131, 50136, 50139, 50142, 50145, 50148, 50154, 50160, 50181, 50184, 50199, 50202, 50213 or 50214 | 18612 or 50140 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| 191G10 | 30846 or 50271 | 26840 or 50318 | 6812, 50004, 50007, 50016, 50022, 50025, 50037, 50066, 50072, 50084, 50087, 50096, 50099, 50107, 50237 or 50253 | 14824, 50017, 50023, 50038, or 50088 | 22836 or 50018 | 2806, 50138 or 50144 | 10818 or 50139 | 18830 or 50140 |
| 194C1 | 30816 | 26810 | 6782, 50004, 50007, 50016, 50022, 50025, 50037, 50066, 50072, 50084, 50087, 50096, 50099, 50107, 50237 or 50253 | 14794, 50008, or 50017 | 22806 | 2776, 50138, 50144, 50147, 50183 or 50212 | 10788, 50123, 50131, 50136, 50139, 50142, 50145, 50148, 50154, 50160, 50181, 50184, 50199, 50202, 50213 or 50248 | 18800 or 50140 |
| 197G3 | 30888 or 50273 | 26882 or 50320 | 6854, 50016 or 50022 | 14866, 50017, 50023, 50038, or 50088 | 22878 or 50024 | 2848, 50138 or 50144 | 10860, 50123, 50131, 50136, 50139, 50142, 50145, 50148, 50154, 50160, 50181, 50184, 50199, 50202, 50213 or 50248 | 18872 or 50140 |
| 198G3 | 30620 or 50271 | 26614 or 50318 | 6586, 50007, 50016, 50037, 50066, 50072, 50084, 50237 or 50253 | 14598, 50017, or 50038 | 22610 or 50018 | 2580 or 50138 | 10592 or 50139 | 18604 or 50140 |
| 75G3 | 29714 or 50283 | 25708 or 50314 | 5680, 50010 or 50233 | 13692 | 21704 or 50235 | 1674 or 50127 | 9686 or 50128 | 17698 or 50129 |
| 218G4 | 31786 or 50298 | 27780 or 50335 | 7750, 50004, 50025, 50037, 50087, 50096 or 50253 | 15762, 50005, 50008, 50017, 50023, 50026, 50038, 50053, 50067, 50073, 50085, 50088, 50100, 50108, | 23774 | 3746 or 50189 | 11758 or 50190 | 19770 or 50191 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| 193E7 | 30796 | 26790 or 50312 | 6762 | 50238 or 50254 14774, 50011, or 50234 | 22786 | 2756, 50122, 50130, 50135, 50198, or 50247 | 10768, 50123 or 50142 | 18780 or 50124 |
| 198D2 | 31604 or 50273 | 27598 or 50335 | 7568, 50004, 50007, 50016, 50022, 50025, 50037, 50066, 50072, 50084, 50087, 50096, 50099, 50107, 50237 or 50253 | 15580 or 50023 | 23592 | 3564 or 50189 | 11576 or 50190 | 19588 or 50191 |
| 202A3 | 30972 | 26966 or 50317 | 6938 | 14950 | 22962 | 2932, 50122, 50130, 50135, 50198, or 50247 | 10944, 50123, 50131, 50136, 50139, 50142, 50148, or 50213 | 18956 or 50137 |
| 7E11 | 28914 or 50273 | 24908 or 50319 | 4880, 50004, 50007, 50022, 50025 or 50037 | 12892 or 50263 or 50023 | 20904 or 50024 | 872 or 50141 or 50153 | 8884, 50123, 50131, 50136, 50139, 50142, 50145, 50148, 50154, 50160, 50181, 50199 or 50213 | 16896, or 50143 |
| 22G5 | 28368 | 24362 or 50323 | 4334, 50031, 50034, 50055, 50093, 50113 or 50116 | 12346 or 50032 | 20358 or 50033 | 326, 50141, 50153, 50180 or 50201 | 8338, 50123, 50131, 50136, 50139, 50142, 50148, 50154 or 50160 | 16350 |
| 5E5 | 29016 or 50267 | 25010 or 50315 | 4982, 50004, 50037 or 50107 | 12994, 50005, 50008, 50017, 50023, 50026, 50038, 50053, 50067, 50073, 50085, 50088, 50100, 50108, 50238, 50254 or 50264 | 21006, 50006 or 50265 | 974, 50122, 50130, 50135, 50198, or 50247 | 8986, 50123, 50131, 50136, 50139, 50142, 50145, 50148, 50154, 50160, 50181, 50184, 50199, 50202, 50213 or 50248 | 16998 or 50132 |
| 54E9 | 31488 or 50303 | 27482 or 50338 | 7452 or 50102 | 15464 or 50103 | 23476 or 50227 | 3448 or 50195 | 11460 or 50196 | 19472 or 50197 |

TABLE C-continued

Exemplary Heavy and Light Chain Variable Regions and Heavy and Light Chain CDR1/2/3

| Ab name | VH SEQ ID NOs: | VL SEQ ID NOs: | HCDR1 SEQ ID NOs: | HCDR2 SEQ ID NOs: | HCDR3 SEQ ID NOs: | LCDR1 SEQ ID NOs: | LCDR2 SEQ ID NOs: | LCDR3 SEQ ID NOs: |
|---|---|---|---|---|---|---|---|---|
| 6G7 | 28880 | 24874 or 50334 | 4846, 50004, 50007, 50016, 50022, 50025, 50037, 50066, 50072, 50084, 50087, 50096, 50099, 50107, 50237 or 50253 | 12858 | 20870 or 50098 | 838 or 50186 | 8850 or 50187 | 16862 or 50188 |
| 176H4 | 30542 or 50282 | 26536 or 50322 | 6508, 50004, 50007, 50016, 50022, 50025, 50037, 50066, 50072, 50084, 50087, 50096, 50099, 50107, 50237 or 50253 | 14520, 50023, 50053, 50085 or 50254 | 22532, or 50255 | 2502, 50150, or 50174 | 10514, 50151, 50175 or 50205 | 18526 or 50152 |
| 194C10 | 30832 | 26826 or 50314 | 6798 or 50233 | 14810, 50011 or 50234 | 22822 | 2792 or 50146 | 10804 or 50128 | 18816 or 50129 |

In the exemplary embodiments described above, the antigen binding proteins maintain desired binding to the various desired species of ASGR, ASGR-1 and/or ASGR-2.

In another embodiment, the light-chain variable domain comprises a sequence of amino acids that is at least 70%, 75%, 80%, 85%, 90%, 91%, 92%, 93%, 94%, 95%, 96%, 97%, 98%, 99% or 100% identical to the sequence of a light chain variable domain listed above.

In another embodiment, the light chain variable domain comprises a sequence of amino acids that is encoded by a nucleotide sequence that is at least 70%, 75%, 80%, 85%, 90%, 91%, 92%, 93%, 94%, 95%, 96%, 97%, 98%, 99% or 100% identical to the polynucleotide sequence listed above. In another embodiment, the light chain variable domain comprises a sequence of amino acids that is encoded by a polynucleotide that hybridizes under moderately stringent conditions to the complement of a polynucleotide that encodes a light chain variable domain selected from the sequences listed above. In another embodiment, the light chain variable domain comprises a sequence of amino acids that is encoded by a polynucleotide that hybridizes under stringent conditions to the complement of a polynucleotide that encodes a light chain variable domain selected from the group consisting of the sequences listed above.

In another embodiment, the heavy chain variable domain comprises a sequence of amino acids that is at least 70%, 75%, 80%, 85%, 90%, 91%, 92%, 93%, 94%, 95%, 96%, 97%, 98%, 99% or 100% identical to the sequence of a heavy chain variable domain selected from the sequences listed above. In another embodiment, the heavy chain variable domain comprises a sequence of amino acids that is encoded by a nucleotide sequence that is at least 70%, 75%, 80%, 85%, 90%, 91%, 92%, 93%, 94%, 95%, 96%, 97%, 98%, 99% or 100% identical to a nucleotide sequence that encodes a heavy chain variable domain selected from the sequences listed above. In another embodiment, the heavy chain variable domain comprises a sequence of amino acids that is encoded by a polynucleotide that hybridizes under moderately stringent conditions to the complement of a polynucleotide that encodes a heavy chain variable domain selected from the sequences listed above. In another embodiment, the heavy chain variable domain comprises a sequence of amino acids that is encoded by a polynucleotide that hybridizes under stringent conditions to the complement of a polynucleotide that encodes a heavy chain variable domain selected from the sequences listed above.

In the exemplary embodiments described above, the antigen binding proteins maintain desired binding to the various desired species of ASGR, ASGR-1 and/or ASGR-2.

Antigen binding proteins of the invention (e.g., antibodies) can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lanitto et al., Methods Mol. Biol. 178:303-16 (2002).

In one embodiment, an antigen binding protein of the invention further comprises the constant light chain kappa or lambda domains or a fragment of these. Exemplary sequences of the light chain constant regions and polynucleotides encoding them are provided in Table 15 below, and are generally well known in the art. In another embodiment, an antigen binding protein of the invention further comprises a heavy chain constant domain, or a fragment thereof, such as the IgG1 or IgG2 heavy chain constant region provided in Table 15.

The antigen binding proteins (for example, antibodies) of the present invention include those having a desired isotype (for example, IgA, IgG1, IgG2, IgG3, IgG4, IgM, IgE, and IgD) as well as Fab or F(ab')$_2$ fragments thereof. Moreover, if an IgG4 is desired, it may also be desired to introduce a point mutation in the hinge region as described in Bloom et al., 1997, Protein Science 6:407, (incorporated by reference herein) to alleviate a tendency to form intra-H chain disulfide bonds that can lead to heterogeneity in the IgG4 antibodies.

Generation of Antibodies

Antibodies of the invention may be prepared by techniques that are well known to those skilled in the art. For example, by immunizing an animal (e.g., a mouse or rat or rabbit) and then by immortalizing spleen cells harvested from the animal after completion of the immunization schedule. The spleen cells can be immortalized using any technique known in the art, e.g., by fusing them with myeloma cells to produce hybridomas. See, for example, Antibodies; Harlow and Lane, Cold Spring Harbor Laboratory Press, 1$^{st}$ Edition, e.g. from 1988, or 2$^{nd}$ Edition, e.g. from 2014).

In one embodiment, a humanized monoclonal antibody comprises the variable domain of a murine antibody (or all or part of the antigen binding site thereof) and a constant domain derived from a human antibody. Alternatively, a humanized antibody fragment may comprise the antigen binding site of a murine monoclonal antibody and a variable domain fragment (lacking the antigen-binding site) derived from a human antibody. Procedures for the production of engineered monoclonal antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619; 5,225,539; 5,821, 337; 5,859,205; 6,881,557, Padlan et al., 1995, FASEB J. 9:133-39, Tamura et al., 2000, J. Immunol. 164:1432-41, Zhang, W., et al., Molecular Immunology. 42(12):1445-1451, 2005; Hwang W. et al., Methods. 36(1):35-42, 2005; Dall'Acqua W F, et al., Methods 36(1):43-60, 2005; and Clark, M., Immunology Today. 21(8):397-402, 2000.

An antibody of the present invention may also be a fully human monoclonal antibody. Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein.

Procedures have been developed for generating human monoclonal antibodies in non-human animals. For example, mice in which one or more endogenous immunoglobulin genes have been inactivated by various means have been prepared. Human immunoglobulin genes have been introduced into the mice to replace the inactivated mouse genes. In this technique, elements of the human heavy and light chain locus are introduced into strains of mice derived from embryonic stem cell lines that contain targeted disruptions of the endogenous heavy chain and light chain loci (see also Bruggemann et al., Curr. Opin. Biotechnol. 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue.

Antibodies produced in the animal incorporate human immunoglobulin polypeptide chains encoded by the human genetic material introduced into the animal. In one embodiment, a non-human animal, such as a transgenic mouse, is immunized with a suitable immunogen.

Examples of techniques for production and use of transgenic animals for the production of human or partially human antibodies are described in U.S. Pat. Nos. 5,814,318, 5,569,825, and 5,545,806, Davis et al., Production of human antibodies from transgenic mice in Lo, ed. Antibody Engineering: Methods and Protocols, Humana Press, NJ:191-200 (2003), Kellermann et al., 2002, Curr Opin Biotechnol. 13:593-97, Russel et al., 2000, Infect Immun. 68:1820-26, Gallo et al., 2000, Eur J Immun. 30:534-40, Davis et al., 1999, Cancer Metastasis Rev. 18:421-25, Green, 1999, J Immunol Methods. 231:11-23, Jakobovits, 1998, Advanced Drug Delivery Reviews 31:33-42, Green et al., 1998, J Exp Med. 188:483-95, Jakobovits A, 1998, Exp. Opin. Invest. Drugs. 7:607-14, Tsuda et al., 1997, Genomics. 42:413-21, Mendez et al., 1997, Nat Genet. 15:146-56, Jakobovits, 1994, Curr Biol. 4:761-63, Arbones et al., 1994, Immunity. 1:247-60, Green et al., 1994, Nat Genet. 7:13-21, Jakobovits et al., 1993, Nature. 362:255-58, Jakobovits et al., 1993, Proc Natl Acad Sci USA. 90:2551-55. Chen, J., M. Trounstine, F. W. Alt, F. Young, C. Kurahara, J. Loring, D. Huszar. "Immunoglobulin gene rearrangement in B-cell deficient mice generated by targeted deletion of the JH locus." International Immunology 5 (1993): 647-656, Choi et al., 1993, Nature Genetics 4: 117-23, Fishwild et al., 1996, Nature Biotechnology 14: 845-51, Harding et al., 1995, Annals of the New York Academy of Sciences, Lonberg et al., 1994, Nature 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, Nature Biotechnology 14: 826, Taylor et al., 1992, Nucleic Acids Research 20: 6287-95, Taylor et al., 1994, International Immunology 6: 579-91, Tomizuka et al., 1997, Nature Genetics 16: 133-43, Tomizuka et al., 2000, Proceedings of the National Academy of Sciences USA 97: 722-27, Tuaillon et al., 1993, Proceedings of the National Academy of Sciences USA 90: 3720-24, and Tuaillon et al., 1994, Journal of Immunology 152: 2912-20; Lonberg et al., Nature 368:856, 1994; Taylor et al., Int. Immun. 6:579, 1994; U.S. Pat. No. 5,877,397; Bruggemann et al., 1997 Curr. Opin. Biotechnol. 8:455-58; Jakobovits et al., 1995 Ann. N. Y. Acad. Sci. 764:525-35. In addition, protocols involving the XenoMouse® (Abgenix, now Amgen, Inc.) are described, for example in U.S. Pub. No. 2005/0118643 and WO 05/694879, WO 98/24838, WO 00/76310, and U.S. Pat. No. 7,064,244.

Lymphoid cells from the immunized transgenic mice are fused with myeloma cells for example to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in such fusions include Sp-20, P3-X63/Ag8, P3-X63-Ag8.653, NS1/1.Ag4 1, Sp210-Ag14, FO, NSO/U, MPC-11, MPC11-X45-GTG 1.7 and S194/5XX0 Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

The lymphoid (e.g., spleen) cells and the myeloma cells may be combined for a few minutes with a membrane fusion-promoting agent, such as polyethylene glycol or a nonionic detergent, and then plated at low density on a selective medium that supports the growth of hybridoma cells but not unfused myeloma cells. One selection media is HAT (hypoxanthine, aminopterin, thymidine). After a sufficient time, usually about one to two weeks, colonies of cells are observed. Single colonies are isolated, and antibodies produced by the cells may be tested for binding activity to, for example, human ASGR-1, using any one of a variety of immunoassays known in the art and described herein. The hybridomas are cloned (e.g., by limited dilution cloning or by soft agar plaque isolation) and positive clones that produce an antibody specific to, for example, human ASGR-1, are selected and cultured. The monoclonal antibodies from the hybridoma cultures may be isolated from the supernatants of hybridoma cultures. Thus the present invention provides hybridomas that comprise polynucleotides encoding the antigen binding proteins of the invention in the chromosomes of the cell. These hybridomas can be cultured according to methods described herein and known in the art.

Another method for generating human antibodies of the invention includes immortalizing human peripheral blood cells by EBV transformation. See, e.g., U.S. Pat. No. 4,464, 456. Such an immortalized B-cell line (or lymphoblastoid cell line) producing a monoclonal antibody that specifically binds to, for example, human ASGR-1, can be identified by immunodetection methods as provided herein, for example, an ELISA, and then isolated by standard cloning techniques. The stability of the lymphoblastoid cell line producing an antibody may be improved by fusing the transformed cell line with a murine myeloma to produce a mouse-human hybrid cell line according to methods known in the art (see, e.g., Glasky et al., Hybridoma 8:377-89 (1989)). Still another method to generate human monoclonal antibodies is in vitro immunization, which includes priming human splenic B-cells with antigen, followed by fusion of primed B-cells with a heterohybrid fusion partner. See, e.g., Boerner et al., 1991 J. Immunol. 147:86-95.

In certain embodiments, a B-cell that is producing a desired antibody is selected and the light chain and heavy chain variable regions are cloned from the B-cell according to molecular biology techniques known in the art (WO 92/02551; U.S. Pat. No. 5,627,052; Babcook et al., Proc. Natl. Acad. Sci. USA 93:7843-48 (1996)) and described herein. B-cells from an immunized animal may be isolated from the spleen, lymph node, or peripheral blood sample by selecting a cell that is producing a desired antibody. B-cells may also be isolated from humans, for example, from a peripheral blood sample. Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains antigen. Binding of the specific antibody produced by the B-cell to the antigen results in the formation of a complex, which may be visible as an immunoprecipitate. After the B-cells producing the desired antibody are selected, the specific antibody genes may be cloned by isolating and amplifying DNA or mRNA according to methods known in the art and described herein.

An additional method for obtaining antibodies of the invention is by phage display. See, e.g., Winter et al., 1994 Annu. Rev. Immunol. 12:433-55; Burton et al., 1994 Adv. Immunol. 57:191-280. Human or murine immunoglobulin variable region gene combinatorial libraries may be created in phage vectors that can be screened to select Ig fragments (Fab, Fv, sFv, or multimers thereof) that bind specifically to TGF-beta binding protein or variant or fragment thereof. See, e.g., U.S. Pat. No. 5,223,409; Huse et al., 1989 Science 246:1275-81; Sastry et al., Proc. Natl. Acad. Sci. USA 86:5728-32 (1989); Alting-Mees et al., Strategies in Molecular Biology 3:1-9 (1990); Kang et al., 1991 Proc. Natl. Acad. Sci. USA 88:4363-66; Hoogenboom et al., 1992 J. Molec. Biol. 227:381-388; Schlebusch et al., 1997 Hybridoma 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698,426).

Heavy and light chain immunoglobulin cDNA expression libraries may also be prepared in lambda phage, for example, using λImmunoZap™(H) and λImmunoZap™(L) vectors (Stratagene, La Jolla, Calif.). Briefly, mRNA is isolated from a B-cell population, and used to create heavy and light chain immunoglobulin cDNA expression libraries in the λImmunoZap(H) and λImmunoZap(L) vectors. These vectors may be screened individually or co-expressed to form Fab fragments or antibodies (see Huse et al., supra; see also Sastry et al., supra). Positive plaques may subsequently be converted to a non-lytic plasmid that allows high level expression of monoclonal antibody fragments from E. coli.

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, Calif.), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into *E. coli*, yeast, or mammalian-based systems for expression. Large amounts of a single-chain protein containing a fusion of the VH and $V_L$ domains may be produced using these methods (see Bird et al., Science 242:423-426, 1988).

In certain embodiments, the antigen binding proteins of the invention are obtained from transgenic animals (e.g., mice) that produce "heavy chain only" antibodies or "HCAbs." HCAbs are analogous to naturally occurring camel and llama single-chain VHH antibodies.

See, for example, U.S. Pat. Nos. 8,507,748 and 8,502,014, and U.S. Patent Application Publication Nos. US2009/0285805A1, US2009/0169548A1, US2009/0307787A1, US2011/0314563A1, US2012/0151610A1, WO2008/122886A2, and WO2009/013620A2.

Once cells producing antibodies according to the invention have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the invention.

In certain embodiments, antibodies are generated by first identifying antibodies that bind to cells expressing, for example, human ASGR, human ASGR-1 and/or human ASGR-2, and/or compete for binding with the antibodies described in this application.

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperazine formation, aspartate isomerization and asparagine deamidation. A frequent modification is the loss of a carboxy-terminal basic residue (such as lysine or arginine) due to the action of carboxypeptidases (as described in Harris, R. J. Journal of Chromatography 705:129-134, 1995).

An alternative method for production of a murine monoclonal antibody is to inject the hybridoma cells into the peritoneal cavity of a syngeneic mouse, for example, a mouse that has been treated (e.g., pristane-primed) to promote formation of ascites fluid containing the monoclonal antibody. Monoclonal antibodies can be isolated and purified by a variety of well-established techniques. Such isolation techniques include affinity chromatography with Protein-A Sepharose, size-exclusion chromatography, and ion-exchange chromatography (see, for example, Coligan at pages 2.7.1-2.7.12 and pages 2.9.1-2.9.3; Baines et al., "Purification of Immunoglobulin G (IgG)," in Methods in Molecular Biology, Vol. 10, pages 79-104 (The Humana Press, Inc. 1992)). Monoclonal antibodies may be purified by affinity chromatography using an appropriate ligand selected based on particular properties of the antibody (e.g., heavy or light chain isotype, binding specificity, etc.). Examples of a suitable ligand, immobilized on a solid support, include Protein A, Protein G, an anticonstant region (light chain or heavy chain) antibody, an anti-idiotype antibody, and a TGF-beta binding protein, or fragment or variant thereof.

Molecular evolution of the complementarity determining regions (CDRs) in the center of the antibody binding site also has been used to isolate antibodies with increased affinity, for example, those as described by Schier et al., 1996, J. Mol. Biol. 263:551. Accordingly, such techniques are useful in preparing antibodies of the invention.

Although human, partially human, or humanized antibodies will be suitable for many applications, particularly those involving administration of the antibody to a human subject, other types of antigen binding proteins will be suitable for certain applications. The non-human antibodies of the invention can be, for example, derived from any antibody-producing animal, such as mouse, rat, rabbit, goat, donkey, or non-human primate (for example, monkey such as cynomologus or rhesus monkey or ape (e.g., chimpanzee)). Non-human antibodies of the invention can be used, for example, in in vitro and cell-culture based applications, or any other application where an immune response to the antibody of the invention does not occur, is insignificant, can be prevented, is not a concern, or is desired. An antibody from a particular species can be made by, for example, immunizing an animal of that species with the desired immunogen or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

Antibodies also may be prepared by any of a number of other conventional techniques. For example, they may be purified from cells that naturally express them (e.g., an antibody can be purified from a hybridoma that produces it), or produced in recombinant expression systems, using any technique known in the art. See, for example, Monoclonal Antibodies, Hybridomas: A New Dimension in Biological Analyses, Kenneth et al. (eds.), Plenum Press, New York (1980); and Antibodies: A Laboratory Manual, Harlow and Land (eds.), Cold Spring Harbor Laboratory Press, Cold Spring Harbor, N.Y., (1988).

Where it is desired to improve the affinity of antibodies according to the invention containing one or more of the above-mentioned CDRs can be obtained by a number of affinity maturation protocols including maintaining the CDRs (Yang et al., J. Mol. Biol., 254, 392-403, 1995), chain shuffling (Marks et al., Bio/Technology, 10, 779-783, 1992), use of mutation strains of *E. coli*. (Low et al., J. Mol. Biol., 250, 350-368, 1996), DNA shuffling (Patten et al., Curr. Opin. Biotechnol., 8, 724-733, 1997), phage display (Thompson et al., J. Mol. Biol., 256, 7-88, 1996) and additional PCR techniques (Crameri, et al., Nature, 391, 288-291, 1998). All of these methods of affinity maturation are discussed by Vaughan et al. (Nature Biotechnology, 16, 535-539, 1998).

Single chain antibodies may be formed by linking heavy and light chain variable domain (Fv region) fragments via an amino acid bridge (short peptide linker), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, Prot. Eng. 10:423; Kortt et al., 2001, Biomol. Eng. 18:95-108). By combining different $V_L$ and $V_H$-comprising polypeptides, one can form multimeric scFvs that bind to different epitopes (Kriangkum et al., 2001, Biomol. Eng. 18:31-40). Techniques developed for the production of single chain antibodies include those described in U.S. Pat. No. 4,946,778; Bird, 1988, Science 242:423; Huston et al., 1988, Proc. Natl. Acad. Sci. USA 85:5879; Ward et al., 1989, Nature 334:544, de Graaf et al., 2002, Methods Mol Biol. 178:379-87.

Antigen binding fragments derived from an antibody can also be obtained, for example, by proteolytic hydrolysis of the antibody, for example, pepsin or papain digestion of whole antibodies according to conventional methods. By way of example, antibody fragments can be produced by enzymatic cleavage of antibodies with pepsin to provide a 5S fragment termed $F(ab')_2$. This fragment can be further cleaved using a thiol reducing agent to produce 3.5S Fab' monovalent fragments. Optionally, the cleavage reaction can be performed using a blocking group for the sulfhydryl groups that result from cleavage of disulfide linkages. As an alternative, an enzymatic cleavage using papain produces two monovalent Fab fragments and an Fc fragment directly. These methods are described, for example, by Goldenberg, U.S. Pat. No. 4,331,647, Nisonoff et al., Arch. Biochem. Biophys. 89:230, 1960; Porter, Biochem. J. 73:119, 1959; Edelman et al., in Methods in Enzymology 1:422 (Academic Press 1967); and by Andrews, S. M. and Titus, J. A. in Current Protocols in Immunology (Coligan J. E., et al., eds), John Wiley & Sons, New York (2003), pages 2.8.1-2.8.10 and 2.10A.1-2.10A.5. Other methods for cleaving antibodies, such as separating heavy chains to form monovalent light-heavy chain fragments (Fd), further cleaving of fragments, or other enzymatic, chemical, or genetic techniques may also be used, so long as the fragments bind to the antigen that is recognized by the intact antibody.

Another exemplary form of an antigen binding protein is a peptide comprising one or more complementarity determining regions (CDRs) of an antibody. CDRs can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., Methods: A Companion to Methods in Enzymology 2:106, 1991; Courtenay-Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley-Liss, Inc. 1995)). The antibody fragment further may comprise at least one variable region domain of an antibody described herein. Thus, for example, the V region domain may be monomeric and be a $V_H$ or $V_L$ domain, which is capable of independently binding a desired target (e.g., human ASGR-1) with an affinity at least equal to $10^{-7}$M or less as described herein.

The variable region may be any naturally occurring variable domain or an engineered version thereof. By engineered version is meant a variable region that has been created using recombinant DNA engineering techniques. Such engineered versions include those created, for example, from a specific antibody variable region by insertions, deletions, or changes in or to the amino acid sequences of the specific antibody. One of ordinary skill in the art can use any known methods for identifying amino acid residues appropriate for engineering, such as the amino acid residues depicted with shading in Tables 21-48 of FIG. 56. Additional examples include engineered variable regions containing at least one CDR and optionally one or more framework amino acids from a first antibody and the remainder of the variable region domain from a second antibody. Engineered versions of antibody variable domains may be generated by any number of techniques with which those having ordinary skill in the art will be familiar, including but not limited to the methods outlined in Example 14 below.

The variable region may be covalently attached at a C-terminal amino acid to at least one other antibody domain or a fragment thereof. Thus, for example, a VH that is present in the variable region may be linked to an immunoglobulin CH1 domain. Similarly a $V_L$ domain may be linked to a $C_K$ domain. In this way, for example, the antibody may be a Fab fragment wherein the antigen binding domain contains associated $V_H$ and $V_L$ domains covalently linked at their C-termini to a CH1 and $C_K$ domain, respectively. The CH1 domain may be extended with further amino acids, for example to provide a hinge region or a portion of a hinge region domain as found in a Fab' fragment, or to provide further domains, such as antibody CH2 and CH3 domains.

Derivatives and Variants

The nucleotide sequences of the antigen binding proteins of the present invention, encoding the corresponding amino acid sequences of the antibodies of the present invention, can be altered, for example, by random mutagenesis or by site-directed mutagenesis (e.g., oligonucleotide-directed site-specific mutagenesis) to create an altered polynucleotide comprising one or more particular nucleotide substitutions, deletions, or insertions as compared to the non-mutated polynucleotide. Examples of techniques for making such alterations are described in Walder et al., 1986, Gene 42:133; Bauer et al. 1985, Gene 37:73; Craik, BioTechniques, January 1985, 12-19; Smith et al., 1981, Genetic Engineering: Principles and Methods, Plenum Press; and U.S. Pat. Nos. 4,518,584 and 4,737,462. These and other methods can be used to make, for example, derivatives of the antigen binding proteins that have a desired property, for example, increased affinity, avidity, or specificity for a desired target, increased activity or stability in vivo or in vitro, or reduced in vivo side-effects as compared to the underivatized antibody.

Other derivatives of the antigen binding proteins within the scope of this invention include covalent or aggregative conjugates of the antigen binding proteins, with other proteins or polypeptides, such as by expression of recombinant fusion proteins comprising heterologous polypeptides fused to the N-terminus or C-terminus of a polypeptide. For example, the conjugated peptide may be a heterologous signal (or leader) polypeptide, e.g., the yeast alpha-factor leader, or a peptide such as an epitope tag. Antigen binding protein-containing fusion proteins can comprise peptides added to facilitate purification or identification of antigen binding protein (e.g., poly-His). An antigen binding protein also can be linked to the FLAG peptide as described in Hopp et al., Bio/Technology 6:1204, 1988, and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

In another embodiment, the antigen binding proteins within the scope of this invention include antibody conjugates where antibody is conjugated to a non-proteinaceous chemical (drug) to form an antibody drug conjugate (ADC). Generally the ADC comprises an antibody conjugated to a chemotherapeutic agent, e.g., a cytotoxic agent, a cytostatic agent, a toxin, or a radioactive agent. A linker molecule can be used to conjugate the drug to the antibody. A wide variety of linkers and drugs useful in ADC technology are known in the art and may be used in embodiments of the present invention. (See US20090028856; US2009/0274713; US2007/0031402; WO2005/084390; WO2009/099728; U.S. Pat. Nos. 5,208,020; 5,416,064; 5,475,092; 5,585,499; 6,436,931; 6,372,738; and 6,340,701, all incorporated herein by reference).

In another embodiment, oligomers that contain one or more antigen binding proteins may be employed in certain embodiments of the present invention. Oligomers may be in the form of covalently-linked or non-covalently-linked dimers, trimers, or higher oligomers. Oligomers comprising two or more antigen binding protein are contemplated for use, with one example being a homodimer. Other oligomers include heterodimers, homotrimers, heterotrimers, homotetramers, heterotetramers, etc.

One embodiment is directed to oligomers comprising multiple antigen binding proteins joined via covalent or non-covalent interactions between peptide moieties fused to the antigen binding proteins. Such peptides may be peptide linkers (spacers), or peptides that have the property of promoting oligomerization. Leucine zippers and certain polypeptides derived from antibodies are among the peptides that can promote oligomerization of antigen binding proteins attached thereto, as described in more detail below.

In particular embodiments, the oligomers comprise from two to four antigen binding proteins. The antigen binding proteins of the oligomer may be in any form, such as any of the forms described above, e.g., variants.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., 1991, PNAS USA 88:10535; Byrn et al., 1990, Nature 344:677; and Hollenbaugh et al., 1992 "Construction of Immunoglobulin Fusion Proteins", in Current Protocols in Immunology, Suppl. 4, pages 10.19.1-10.19.11.

One embodiment of the present invention is directed to a dimer comprising two fusion proteins created by fusing an antigen binding fragment of an anti-ASGR, ASGR-1, and/or ASGR-2 antibody to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of facile purification by affinity chromatography over Protein A or Protein G columns.

One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

In some embodiments, the variable portion of the heavy and/or light chains of a desired antibody may be substituted for the variable portion of an antibody heavy and/or light chain.

Alternatively, the oligomer is a fusion protein comprising multiple antigen binding proteins, with or without peptide linkers (spacer peptides). Among the suitable peptide linkers are those described in U.S. Pat. Nos. 4,751,180 and 4,935,233.

Another method for preparing oligomeric antigen binding proteins involves use of a leucine zipper. Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191, hereby incorporated by reference. The use of a modified leucine zipper that allows for stable trimerization of a heterologous protein fused thereto is described in Fanslow et al., 1994, Semin. Immunol. 6:267-78. In one approach, recombinant fusion proteins comprising a desired antibody fragment or derivative fused to a leucine zipper peptide are expressed in suitable host cells, and the soluble oligomeric antibody fragments or derivatives that form are recovered from the culture supernatant.

In another embodiment, the antigen binding proteins (e.g., antibodies) can be conjugated to a suitable vehicle to enhance the half-life thereof. Suitable vehicles include, but are not limited to Fc, albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent. In an example, an antibody derivative comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose. In certain embodiments, antibodies of the invention may be chemically bonded with polymers, lipids, or other moieties.

Nucleic Acids Encoding Antigen Binding Proteins

In another embodiment, the present invention provides isolated nucleic acid molecules that encode the antigen binding proteins of the present invention. In addition, provided are vectors comprising the nucleic acids, cell comprising the nucleic acids, and methods of making the antigen binding proteins of the invention. The nucleic acids comprise, for example, polynucleotides that encode all or part of an antigen binding protein, for example, one or both chains of an antibody of the invention, or a fragment, derivative, mutein, or variant thereof, polynucleotides sufficient for use as hybridization probes, PCR primers or sequencing primers for identifying, analyzing, mutating or amplifying a polynucleotide encoding a polypeptide, antisense nucleic acids for inhibiting expression of a polynucleotide, and complementary sequences of the foregoing. The nucleic acids can be any length as appropriate for the desired use or function, and can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Nucleic acids encoding antibody polypeptides (e.g., heavy or light chain, variable domain only, or full length) may be isolated from B-cells of mice that have been immunized with antigen. The nucleic acid may be isolated by conventional procedures such as polymerase chain reaction (PCR).

Nucleic acid sequences encoding the variable regions of the heavy and light chain variable regions are included herein. The skilled artisan will appreciate that, due to the degeneracy of the genetic code, each of the polypeptide sequences disclosed herein is encoded by a large number of other nucleic acid sequences. The present invention provides each degenerate nucleotide sequence encoding each antigen binding protein of the invention.

The invention further provides nucleic acids that hybridize to other nucleic acids under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, for example, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98 or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. Changes can be introduced by mutation into a nucleic acid, thereby leading to changes in the amino acid sequence of a polypeptide (e.g., an antigen binding protein) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. In one embodiment, a nucleotide sequence provided herein for of the antibodies of the present invention, or a desired fragment, variant, or derivative thereof, is mutated such that it encodes an amino acid sequence comprising one or more deletions or substitutions of amino acid residues that are shown herein for the light chains of the antibodies of the present invention or the heavy chains of the antibodies of the present invention to be residues where two or more sequences differ. In another embodiment, the mutagenesis inserts an amino acid adjacent to one or more amino acid residues shown herein for the light chains of the antibodies of the present invention or the heavy chains of the antibodies of the present invention to be residues where two or more sequences differ. Alternatively, one or more mutations can be introduced into a nucleic acid that selectively change the biological activity of a polypeptide that it encodes.

In another embodiment, the present invention provides vectors comprising a nucleic acid encoding a polypeptide of the invention or a portion thereof. Examples of vectors include, but are not limited to, plasmids, viral vectors, non-episomal mammalian vectors and expression vectors, for example, recombinant expression vectors.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionein promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

In another embodiment, the present invention provides host cells into which a recombinant expression vector of the invention has been introduced. A host cell can be any prokaryotic cell or eukaryotic cell. Prokaryotic host cells include gram negative or gram positive organisms, for example E. coli or bacilli. Higher eukaryotic cells include insect cells, yeast cells, and established cell lines of mammalian origin. Examples of suitable mammalian host cell lines include Chinese hamster ovary (CHO) cells or their derivatives such as Veggie CHO and related cell lines which grow in serum-free media (see Rasmussen et al., 1998, Cytotechnology 28:31) or CHO strain DXB-11, which is deficient in DHFR (see Urlaub et al., 1980, Proc. Natl. Acad. Sci. USA 77:4216-20). Additional CHO cell lines include CHO-K1 (ATCC# CCL-61), EM9 (ATCC# CRL-1861), and UV20 (ATCC# CRL-1862). Additional host cells include the COS-7 line of monkey kidney cells (ATCC CRL 1651) (see Gluzman et al., 1981, Cell 23:175), L cells, C127 cells, 3T3 cells (ATCC CCL 163), AM-1/D cells (described in U.S. Pat. No. 6,210,924), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Appropriate cloning and expression vectors for use with bacterial, fungal, yeast, and mammalian cellular hosts are described by Pouwels et al. (Cloning Vectors: A Laboratory Manual, Elsevier, New York, 1985).

Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Additional selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide recovered by conventional protein purification procedures. Polypeptides contemplated for use herein include substantially homogeneous recombinant mammalian antibody polypeptides substantially free of contaminating endogenous materials.

Cells containing the nucleic acid encoding the antigen binding proteins of the present invention also include hybridomas. The production and culturing of hybridomas are discussed in the antibody section above.

In some embodiments, a vector comprising a nucleic acid molecule as described herein is provided. In some embodiments, the invention comprises a host cell comprising a nucleic acid molecule as described herein.

In some embodiments, a nucleic acid molecule encoding the antigen binding protein as described herein is provided.

In some embodiments, a pharmaceutical composition comprising at least one antigen binding protein described herein is provided.

Antigen Binding Protein Production

The antigen binding proteins of the invention can be produced by any method known in the art for the synthesis of proteins (e.g., antibodies), in particular, by chemical synthesis or preferably, by recombinant expression techniques.

Recombinant expression of the antigen binding proteins requires construction of an expression vector containing a polynucleotide that encodes the antigen binding proteins. Once a polynucleotide encoding the antigen binding proteins molecule has been obtained, the vector for the production of the antigen binding proteins may be produced by recombinant DNA technology. An expression vector is constructed containing the antigen binding proteins coding sequences and appropriate transcriptional and translational control signals. These methods include, for example, in vitro recombinant DNA techniques, synthetic techniques, and in vivo genetic recombination.

The expression vector is transferred to a host cell by conventional techniques and the transfected cells are then cultured by conventional techniques to produce an antigen binding proteins of the invention. In one embodiment of the invention, vectors encoding both the heavy and light chains of an antibody may be co-expressed in the host cell for expression of the entire immunoglobulin molecule, as detailed below.

A variety of host-expression vector systems may be utilized to express the antigen binding proteins of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. Bacterial cells such as E. coli, and eukaryotic cells are commonly used for the expression of a recombinant antibody molecule, especially for the expression of whole recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include, but are not limited to, CHO, COS, 293, 3T3, or myeloma cells.

For long-term, high-yield production of recombinant proteins, stable expression is preferred. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compounds that interact directly or indirectly with the antibody molecule.

A number of selection systems may be used, including but not limited to the herpes simplex virus thymidine kinase (Wigler et al., Cell 11:223 (1977)), hypoxanthine-guanine phosphoribosyltransferase (Szybalska & Szybalski, Proc. Natl. Acad. Sci. USA 48:202 (1992)), and adenine phosphoribosyltransferase (Lowy et al., Cell 22:817 (1980)) genes can be employed in tk, hgprt or aprt-cells, respectively. Also, antimetabolite resistance can be used as the basis of selection for the following genes: dhfr, which confers resistance to methotrexate (Wigler et al., Proc. Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Wu and Wu, Biotherapy 3:87-95 (1991)); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, N Y (1993); Kriegler, Gene Transfer and Expression, A Laboratory Manual, Stockton Press, N Y (1990); and in Chapters 12 and 13, Dracopoli et al. (eds), Current Protocols in Human Genetics, John Wiley & Sons, N Y (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, "The use of vectors based on gene amplification for the expression of cloned genes in mammalian cells" (DNA Cloning, Vol. 3. Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., Mol. Cell. Biol. 3:257 (1983)).

The host cell may be co-transfected with two expression vectors of the invention, for example, the first vector encoding an antibody heavy chain derived polypeptide and the second vector encoding an antibody light chain derived polypeptide. The two vectors may contain identical selectable markers which enable equal expression of heavy and light chain polypeptides. Alternatively, a single vector may be used which encodes, and is capable of expressing, for example, both antibody heavy and light chain polypeptides. In such situations, the light chain should be placed before the heavy chain to avoid an excess of toxic free heavy chain (Proudfoot, Nature 322:52 (1986); Kohler, Proc. Natl. Acad. Sci. USA 77:2197 (1980)). The coding sequences for the heavy and light chains may comprise cDNA or genomic DNA.

Once an antibody molecule of the invention has been produced by an animal, chemically synthesized, or recombinantly expressed, it may be purified by any method known in the art for purification of an immunoglobulin molecule, for example, by chromatography (e.g., ion exchange, affinity, particularly by affinity for the specific antigen after Protein A, and size-exclusion chromatography), centrifugation, differential solubility, or by any other standard technique for the purification of proteins. In addition, the antibodies of the present invention or fragments thereof can be fused to heterologous polypeptide sequences described herein or otherwise known in the art, to facilitate purification.

In some embodiments, the present invention encompasses antibodies recombinantly fused or chemically conjugated (including both covalently and non-covalently conjugations) to a polypeptide. Fused or conjugated antibodies of the present invention may be used for ease in purification. See e.g., Harbor et al., supra, and PCT publication WO 93/21232; EP 439,095; Naramura et al., Immunol. Lett. 39:91-99 (1994); U.S. Pat. No. 5,474,981; Gillies et al., Proc. Natl. Acad. Sci. 89:1428-1432 (1992); Fell et al., J. Immunol. 146:2446-2452 (1991).

Moreover, the antibodies or fragments thereof of the present invention can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the "HA" tag, which corresponds to an epitope derived from the influenza hemagglutinin protein (Wilson et al., Cell 37:767 (1984)) and the "flag" tag.

Antibody Effector Function

In some embodiments, the present invention provides antigen binding proteins (e.g., antibodies) with altered effector function (e.g., decreasing or increasing effector function). Nonlimiting examples of methods for increasing effector function can be found in U.S. Pat. Nos. 5,624,821, 6,602,684, 7,029,872, U.S. Patent Application Publication Nos. 2006/0067930A1, 2005/0272128A1, 2005/0079605A1, 2005/0123546A1, 2004/0072290A1, 2006/0257399A1, 2004/0261148A1, 2007/0092521, 2006/0040325A1, and 2006/0039904A1, and International Patent Application Publication Nos. WO 04/029207, WO03011878, WO05044859, WO 06071856, and WO 06071280.

Methods of engineering Fc regions of antibodies so as to alter effector functions are known in the art (e.g., U.S. Patent Publication No. 20040185045 and PCT Publication No. WO 2004/016750, both to Koenig et al., which describe altering the Fc region to enhance the binding affinity for Fc gamma RIIB as compared with the binding affinity for FC gamma RIIA; see, also, PCT Publication Nos. WO 99/58572 to Armour et al., WO 99/51642 to Idusogie et al., and U.S. Pat. No. 6,395,272 to Deo et al.). Methods of modifying the Fc region to decrease binding affinity to Fc gamma RIIB are also known in the art (e.g., U.S. Patent Publication No. 20010036459 and PCT Publication No. WO 01/79299, both to Ravetch et al.). Modified antibodies having variant Fc regions with enhanced binding affinity for Fc gamma RIIIA and/or Fc gamma RIIA as compared with a wildtype Fc region have also been described (e.g., PCT Publication Nos. WO 2004/063351, to Stavenhagen et al., the disclosure of which is incorporated herein in its entirety).

Antibody effector function may also be modified through the generation of antibodies with altered glycosylation patterns. Such altered glycosylation patterns have been demonstrated to increase or decrease the ADCC ability of antibodies, as desired. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation.

Half-Life Alteration

In some embodiments, the present invention provides for antigen binding proteins (e.g., antibodies) which have an extended half-life in vivo. In particular, the present invention provides antigen binding proteins which have a half-life in a mammal (for example, but not limited to, a human), of greater than 3 days, greater than 7 days, greater than 10 days, greater than 15 days, greater than 25 days, greater than 30 days, greater than 35 days, greater than 40 days, greater than 45 days, greater than 2 months, greater than 3 months, greater than 4 months, or greater than 5 months.

To prolong the serum circulation of antigen binding proteins (for example, monoclonal antibodies) or antibody fragments (for example, Fab fragments) in vivo, for example, inert polymer molecules such as high molecular weight polyethyleneglycol (PEG) can be attached to the antibodies (including antibody fragments thereof) with or without a multifunctional linker either through site-specific conjugation of the PEG to the N- or C-terminus of the antibodies or via epsilon-amino groups present on lysine residues. Linear or branched polymer derivatization that results in minimal loss of biological activity will be used. The degree of conjugation can be closely monitored by SDS-PAGE and mass spectrometry to ensure proper conjugation of PEG molecules to the antigen binding proteins. Unreacted PEG can be separated from antigen binding proteins-PEG conjugates by size-exclusion or by ion-exchange chromatography. PEG-derivatized antigen binding proteins can be tested for binding activity as well as for in vivo efficacy using methods known to those of skill in the art, for example, by immunoassays described herein.

In certain embodiments, antibodies having an increased half-life in vivo can also be generated by introducing one or more amino acid modifications (i.e., substitutions, insertions or deletions) into an IgG constant domain, or FcRn binding fragment thereof (e.g., Fc or hinge Fc domain fragment). See, e.g., International Publication No. WO 98/23289; International Publication No. WO 97/34631; and U.S. Pat. No. 6,277,375, each of which is incorporated herein by reference in its entirety.

Conjugates

In some embodiments, covalent modifications of the antigen binding proteins of the invention are included within the scope of this invention. They may be made by chemical synthesis or by enzymatic or chemical cleavage of the antigen binding proteins, if applicable. Other types of covalent modifications of the antigen binding proteins are introduced into the molecule by reacting targeted amino acid residues of the antibody with an organic derivatizing agent that is capable of reacting with selected side chains or the N- or C-terminal residues.

Cysteinyl residues most commonly are reacted with alpha-haloacetates (and corresponding amines), such as chloroacetic acid or chloroacetamide, to give carboxymethyl or carboxyamidomethyl derivatives. Similarly, iodo-reagents may also be used. Cysteinyl residues also are derivatized by reaction with bromotrifluoroacetone, alpha-bromo-beta-(5-imidazolyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysyl and amino-terminal residues are reacted with succinic or other carboxylic acid anhydrides. Derivatization with these agents has the effect of reversing the charge of the lysinyl residues. Other suitable reagents for derivatizing .alpha.-amino-containing residues and/or e-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginyl residues generally requires that the reaction be performed in alkaline conditions because of the high pKa of the guanidine functional group. Furthermore, these reagents may react with the epsilon-amino groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $I^{125}$ or $I^{131}$ to prepare labeled proteins for use in radioimmunoassay.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl)carbodiimide or 1-ethyl-3-(4-azonia-4,4-dimethylpentyl)carbodiimide. Furthermore, aspartyl and glutamyl residues are converted to asparaginyl and glutaminyl residues by reaction with ammonium ions.

Glutaminyl and asparaginyl residues are frequently deamidated to the corresponding glutamyl and aspartyl residues, respectively. These residues are deamidated under neutral or basic conditions. The deamidated form of these residues falls within the scope of this invention.

Other modifications include hydroxylation of proline and lysine, phosphorylation of hydroxyl groups of seryl or threonyl residues, methylation of the .alpha.-amino groups of lysine, arginine, and histidine side chains (T. E. Creighton, Proteins: Structure and Molecular Properties, W.H. Freeman & Co., San Francisco, pp. 79-86 (1983)), acetylation of the N-terminal amine, and amidation of any C-terminal carboxyl group.

Another type of covalent modification involves chemically or enzymatically coupling glycosides to the antibody. These procedures are advantageous in that they do not require production of the antibody in a host cell that has glycosylation capabilities for N- or O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published 11 Sep. 1987, and in Aplin and Wriston, CRC Crit. Rev. Biochem., pp. 259-306 (1981).

Interfering RNA

In some embodiments, the present invention provides polynucleotide compositions that target ASGR-1 and/or ASGR-2 and are useful for methods for treatment, therapy, and prophylaxis in disease related to ASGR, ASGR-1 and/or ASGR-2 expression, where reduction or inhibition of the expression or function of a selected target polynucleotide sequence is desired. Examples of polynucleotides that can be used to target ASGR-1 and/or ASGR-2 sequences and reduce ASGR-1 and/or ASGR-2 expression include, but are not limited to, antisense oligonucleotides, and RNA interference (RNAi) agents, including short or small interfering RNA (siRNA), short hairpin RNA (shRNA), and microRNA (miRNA). See, for example, U.S. Pat. Nos. 6,506,559; 8,394,628; 7,056,704; 7,078,196; 6,107,094; 5,898,031; 6,573,099; and European Patent No. 1,144,623. See also, for example, U.S. patent application publication nos. 2015/0259689; 2015/0197746; 2011/0092565; U.S. Pat. Nos. 8,877,917; 8,507,455; and 7,579,451.

In certain embodiments, a composition for inhibiting the function or expression of a target polynucleotide sequence (e.g. ASGR-1 mRNA sequence, ASGR-2 mRNA sequence) in a mammalian cell, according to this invention, comprises an agent that provides to a mammalian cell an at least partially double-stranded RNA molecule (e.g., an interfering RNA molecule). A double-stranded RNA molecule may include chemical modifications to ribonucleotides, including modifications to the ribose sugar, base, or backbone components of the ribonucleotides, such as those described herein or known in the art. Any such modifications, as used in a double-stranded RNA molecule (e.g. siRNA, shRNA, or the like), are encompassed by the term "double-stranded RNA" for the purposes of this disclosure. Thus, in general, the term "RNA" may also include RNA-DNA hybrids and polynucleotides comprising one or more modified nucleotides (e.g. nucleotides with modifications at the 2' position of the ribose ring), except where specified otherwise, e.g., where a 2'-OH group of ribose is required for a particular linkage.

In some embodiments at least 10% of a partially double-stranded RNA molecule is double-stranded. Alternatively, the double stranded portion of these RNA molecules can be at least 30% of the length of the molecule. In another embodiment, the double stranded portion of these molecules can be at least 50% of the length of the molecule. In still another embodiment, the double stranded portion of these molecules can be at least 70% of the length of the molecule. In another embodiment, the double stranded portion of these molecules can be at least 90% of the length of the molecule. In another embodiment, the molecule can be double stranded over its entire length. Alternatively, the double-stranded portion of these molecules can occur at either or both termini, or in some middle portion of the molecule, if the molecule is linear. Similarly, the double-stranded portion can be in any location if the molecule is circular. In certain embodiments of the present invention, the double-stranded portion of the RNA molecule becomes double-stranded only when the molecule is in the mammalian cell. In still other embodiment of this invention, the partially double-stranded molecule is an RNA/DNA hybrid, for example, a single strand containing RNA and DNA, prepared in vitro; or a duplex of two such single strands or portions thereof. In yet another embodiment, the RNA molecule, made in vivo or in vitro, is a duplex comprised of an RNA single strand and a DNA single strand. In some embodiments, the partially double-stranded RNA molecule comprises a polynucleotide sequence that is substantially homologous to the target polynucleotide sequence in order to effectively reduce or inhibit the function or expression thereof. The necessary homology may be suitably defined by use of a computer algorithm. As known in the art and discussed herein, "homology" or "identity" means the degree of sequence relatedness between two polypeptide or two polynucleotide sequences as determined by the identity of the match between two lengths of such sequences. Both identity and homology can be readily calculated by methods in the prior art [See also, e.g., COMPUTATIONAL MOLECULAR BIOLOGY, Lesk, A. M., ed., Oxford University Press, New York, (1988); BIOCOMPUTING: INFORMATICS AND GENOME PROJECTS, Smith, D. W., ed., Academic Press, New York, (1993); COMPUTER ANALYSIS OF SEQUENCE DATA, PART I, Griffin, A. M., and Griffin, H. G., eds., Humana Press, New Jersey, (1994); SEQUENCE ANALYSIS IN MOLECULAR BIOLOGY, von Heinje, G., Academic Press, (1987); and SEQUENCE ANALYSIS PRIMER, Gribskov, M. and Devereux, J., eds., M Stockton Press, New York, (1991)]. While there exist a number of methods to measure identity and homology between two polynucleotide sequences, the terms "identity", "similarity" and homology are well known to skilled artisans [H. Carillo and D. Lipton, SIAM J. Applied Math., 48:1073 (1988)]. Methods commonly employed to determine identity or homology between two sequences include, but are not limited to, those disclosed in Guide to Huge Computers, Martin J. Bishop, ed., Academic Press, San Diego, 1994, and H. Carillo and D. Lipton, SIAM J. Applied Math., 48:1073 (1988). Preferred methods to determine identity or homology are designed to give the largest match between the two sequences tested. Methods to determine identity and similarity are codified in computer programs. Preferred computer program to determine identity and homology between two sequences include, but are not limited to, the algorithm BESTFIT from the GCG program package [J. Devereux et al., Nucl. Acids Res., 12(1):387 (1984)], the related MACVECTOR program (Oxford), and the FASTA (Pearson) programs. For instance, searches for sequence similarities in databases between significant naturally occurring mammalian polynucleotide sequences and target polynucleotide sequences enable the design of suitable RNA molecules desired for use in the invention. The algorithm and/or the degree of homology necessary for any particular RNA molecule may be selected by one of skill in the art, depending on the identity of the target, and/or the closeness of homology of the target sequence to any naturally occurring mammalian sequence, which is desired to be left functioning normally after use of the methods of this invention.

In some embodiments, a polynucleotide composition for reducing the expression or function of ASGR-1 and/or ASGR-2 sequences is an RNAi agent comprising a double-stranded RNA molecule which comprises two antiparallel strands of contiguous nucleotides that are sufficiently complementary to each other to hybridize to form a duplex region. "Hybridize" or "hybridization" refers to the pairing of complementary polynucleotides, typically via hydrogen bonding (e.g. Watson-Crick, Hoogsteen or reversed Hoogsteen hydrogen bonding) between complementary bases in the two polynucleotides. The strand comprising a region having a sequence that is substantially complementary to a target sequence (e.g. target mRNA) is referred to as the "antisense strand." The "sense strand" refers to the strand that includes a region that is substantially complementary to a region of the antisense strand. In some embodiments, the sense strand may comprise a region that has a sequence that is substantially identical to the target sequence.

As used herein, a first sequence is "complementary" to a second sequence if a polynucleotide comprising the first sequence can hybridize to a polynucleotide comprising the second sequence to form a duplex region under certain conditions, such as physiological conditions. Other such conditions can include moderate or stringent hybridization conditions, which are known to those of skill in the art. A first sequence is considered to be fully complementary (100% complementary) to a second sequence if a polynucleotide comprising the first sequence base pairs with a polynucleotide comprising the second sequence over the entire length of one or both nucleotide sequences without any mismatches. A sequence is "substantially complementary" to a target sequence if the sequence is at least about 80%, 85%, 90%, 95%, 96%, 97%, 98%, 99% or 100% complementary to a target sequence. Percent complementarity can be calculated by dividing the number of bases in a first sequence that are complementary to bases at corresponding positions in a second or target sequence by the total length of the first sequence. A sequence may also be said to be substantially complementary to another sequence if there are no more than 5, 4, 3, or 2 mismatches over a 30 base pair duplex region when the two sequences are hybridized. Generally, if any nucleotide overhangs, as defined herein, are present, the sequence of such overhangs is not considered in determining the degree of complementarity between two sequences. By way of example, a sense strand of 21 nucleotides in length and an antisense strand of 21 nucleotides in length that hybridize to form a 19 base pair duplex region with a 2 nucleotide overhang at the 3' end of each strand would be considered to be fully complementary as the term is used herein.

In some embodiments, a region of the antisense strand comprises a sequence that is fully complementary to a region of the target RNA sequence (e.g. ASGR-1 and/or ASGR-2 mRNA). In such embodiments, the sense strand may comprise a sequence that is fully complementary to the sequence of the antisense strand. In other such embodiments, the sense strand may comprise a sequence that is substantially complementary to the sequence of the antisense strand, e.g. having 1, 2, 3, 4, or 5 mismatches in the duplex region formed by the sense and antisense strands. In certain embodiments, it is preferred that any mismatches occur within the terminal regions (e.g. within 6, 5, 4, 3, or 2 nucleotides of the 5' and/or 3' ends of the strands). In one embodiment, any mismatches in the duplex region formed from the sense and antisense strands occur within 6, 5, 4, 3, or 2 nucleotides of the 5' end of the antisense strand.

In certain embodiments, the sense strand and antisense strand of the double-stranded RNA may be two separate molecules that hybridize to form a duplex region, but are otherwise unconnected. Such double-stranded RNA molecules formed from two separate strands are referred to as "small interfering RNAs" or "short interfering RNAs" (siRNAs).

In other embodiments, the sense strand and the antisense strand that hybridize to form a duplex region may be part of a single RNA molecule, i.e. the sense and antisense strands are part of a self-complementary region of a single RNA molecule. In such cases, a single RNA molecule comprises a duplex region (also referred to as a stem region) and a loop region. The 3' end of the sense strand is connected to the 5' end of the antisense strand by a contiguous sequence of unpaired nucleotides, which will form the loop region. The loop region is typically of a sufficient length to allow the RNA molecule to fold back on itself such that the antisense strand can base pair with the sense strand to form the duplex or stem region. The loop region can comprise from about 3 to about 25, from about 5 to about 15, or from about 8 to about 12 unpaired nucleotides. Such RNA molecules with at least partially self-complementary regions are referred to as "short hairpin RNAs" (shRNAs). The length of a single, at least partially self-complementary RNA molecule can be from about 35 nucleotides to about 100 nucleotides, from about 45 nucleotides to about 85 nucleotides, or from about 50 to about 60 nucleotides and comprise a duplex region and loop region each having the lengths recited herein.

In some embodiments, the double-stranded RNA molecule comprises a sense strand and an antisense strand, wherein the antisense strand comprises a region having a sequence that is substantially or fully complementary to an ASGR-1 messenger RNA (mRNA) sequence and/or ASGR-2 mRNA sequence. As used herein, an "ASGR-1 mRNA sequence" or "ASGR-2 mRNA sequence" refers to any messenger RNA sequence, including splice variants, encoding an ASGR-1 protein or ASGR-2 protein, including ASGR-1 or ASGR-2 protein variants or isoforms from any species (e.g. mouse, rat, non-human primate, human).

The sense strand of the double-stranded RNA molecule typically comprises a sequence that is sufficiently complementary to the sequence of the antisense strand such that the two strands hybridize under physiological conditions to form a duplex region. A "duplex region" refers to the region in two complementary or substantially complementary polynucleotides that form base pairs with one another, either by Watson-Crick base pairing or other hydrogen bonding interaction, to create a duplex between the two polynucleotides. The duplex region of the RNA molecule should be of sufficient length to allow the RNA molecule to enter the RNA interference pathway, e.g. by engaging the Dicer enzyme and/or the RISC complex. For instance, in some embodiments, the duplex region is about 15 to about 30 base pairs in length. Other lengths for the duplex region within this range are also suitable, such as about 15 to about 28 base pairs, about 15 to about 26 base pairs, about 15 to about 24 base pairs, about 15 to about 22 base pairs, about 17 to about 28 base pairs, about 17 to about 26 base pairs, about 17 to about 24 base pairs, about 17 to about 23 base pairs, about 17 to about 21 base pairs, about 19 to about 25 base pairs, about 19 to about 23 base pairs, or about 19 to about 21 base pairs. In one embodiment, the duplex region is about 17 to about 24 base pairs in length. In another embodiment, the duplex region is about 19 to about 21 base pairs in length.

For embodiments in which the sense strand and antisense strand are two separate molecules (e.g. RNAi agent is a siRNA), the sense strand and antisense strand need not be the same length as the length of the duplex region. For instance, one or both strands may be longer than the duplex region and have one or more unpaired nucleotides or mismatches flanking the duplex region. Thus, in some embodiments, the double-stranded RNA molecule comprises at least one nucleotide overhang. As used herein, a "nucleotide overhang" refers to the unpaired nucleotide or nucleotides that extend beyond the duplex region at the terminal ends of the strands. Nucleotide overhangs are typically created when the 3' end of one strand extends beyond the 5' end of the other strand or when the 5' end of one strand extends beyond the 3' end of the other strand. The length of a nucleotide overhang is generally between 1 and 6 nucleotides, 1 and 5 nucleotides, 1 and 4 nucleotides, 1 and 3 nucleotides, 2 and 6 nucleotides, 2 and 5 nucleotides, or 2 and 4 nucleotides. In some embodiments, the nucleotide overhang comprises 1, 2, 3, 4, 5, or 6 nucleotides. In one particular embodiment, the nucleotide overhang comprises 1 to 4 nucleotides. In certain embodiments, the nucleotide overhang comprises 2 nucleotides. The nucleotides in the overhang can be ribonucleotides, deoxyribonucleotides, or modified nucleotides as described herein.

The nucleotide overhang can be at the 5' end or 3' end of one or both strands. For example, in one embodiment, the double-stranded RNA molecule comprises a nucleotide overhang at the 5' end and the 3' end of the antisense strand. In another embodiment, the double-stranded RNA molecule comprises a nucleotide overhang at the 5' end and the 3' end of the sense strand. In some embodiments, the double-stranded RNA molecule comprises a nucleotide overhang at the 5' end of the sense strand and the 5' end of the antisense strand. In other embodiments, the double-stranded RNA molecule comprises a nucleotide overhang at the 3' end of the sense strand and the 3' end of the antisense strand.

The double-stranded RNA molecules may comprise a single nucleotide overhang at one end of the molecule and a blunt end at the other. A "blunt end" means that the sense strand and antisense strand are fully base-paired at the end of the molecule and there are no unpaired nucleotides that extend beyond the duplex region. In some embodiments, the double-stranded RNA molecule comprises a nucleotide overhang at the 3' end of the sense strand and a blunt end at the 5' end of the sense strand and 3' end of the antisense strand. In other embodiments, the double-stranded RNA molecule comprises a nucleotide overhang at the 3' end of the antisense strand and a blunt end at the 5' end of the antisense strand and the 3' end of the sense strand. In certain embodiments, the double-stranded RNA molecule comprises a blunt end at both ends of the double-stranded RNA molecule. In such embodiments, the sense strand and antisense strand have the same length and the duplex region is the same length as the sense and antisense strands (i.e. the molecule is double-stranded over its entire length).

The sense strand and antisense strand can each independently be about 15 to about 30 nucleotides in length, about 18 to about 28 nucleotides in length, about 19 to about 27 nucleotides in length, about 19 to about 25 nucleotides in length, about 19 to about 23 nucleotides in length, about 21 to about 25 nucleotides in length, or about 21 to about 23 nucleotides in length. In certain embodiments, the sense strand and antisense strand are each about 18, about 19, about 20, about 21, about 22, about 23, about 24, or about 25 nucleotides in length. In some embodiments, the sense strand and antisense strand have the same length but form a duplex region that is shorter than the strands such that the double-stranded RNA molecule has two nucleotide overhangs. For instance, in one embodiment, the double-stranded RNA molecule comprises (i) a sense strand and an antisense strand that are each 21 nucleotides in length, (ii) a duplex region that is 19 base pairs in length, and (iii) nucleotide overhangs of 2 unpaired nucleotides at both the 3' end of the sense strand and the 3' end of the antisense strand. In another embodiment, the double-stranded RNA molecule comprises (i) a sense strand and an antisense strand that are each 23 nucleotides in length, (ii) a duplex region that is 21 base pairs in length, and (iii) nucleotide overhangs of 2 unpaired nucleotides at both the 3' end of the sense strand and the 3' end of the antisense strand. In other embodiments, the sense strand and antisense strand have the same length and form a duplex region over their entire length such that there are no nucleotide overhangs on either end of the double-stranded molecule. In one such embodiment, the double-stranded RNA molecule is blunt ended and comprises (i) a sense strand and an antisense strand, each of which is 21 nucleotides in length, and (ii) a duplex region that is 21 base pairs in length. In another such embodiment, the double-stranded RNA molecule is blunt ended and comprises (i) a sense strand and an antisense strand, each of which is 23 nucleotides in length, and (ii) a duplex region that is 23 base pairs in length.

In other embodiments, the sense strand or the antisense strand is longer than the other strand and the two strands form a duplex region having a length equal to that of the shorter strand such that the double-stranded RNA molecule comprises at least one nucleotide overhang. For example, in one embodiment, the double-stranded RNA molecule comprises (i) a sense strand that is 19 nucleotides in length, (ii) an antisense strand that is 21 nucleotides in length, (iii) a duplex region of 19 base pairs in length, and (iv) a single nucleotide overhang of 2 unpaired nucleotides at the 3' end of the antisense strand. In another embodiment, the double-stranded RNA molecule comprises (i) a sense strand that is 21 nucleotides in length, (ii) an antisense strand that is 23 nucleotides in length, (iii) a duplex region of 21 base pairs in length, and (iv) a single nucleotide overhang of 2 unpaired nucleotides at the 3' end of the antisense strand.

Off-target toxicity is a constant concern in the development of pharmaceutical products. With interfering RNA agents, the potential exists for homology with certain endogenous polynucleotide sequences that could lead to unintended toxic effects in the patient receiving the interfering RNA. Accordingly, in some embodiments, the RNA molecule comprises a polynucleotide sequence that is also substantially non-homologous to any naturally occurring, normally functioning, and essential mammalian polynucleotide sequence, so that the RNA molecule does not adversely affect the function of any essential naturally occurring mammalian polynucleotide sequence, when used in the methods of this invention. Such naturally occurring functional mammalian polynucleotide sequences include mammalian sequences that encode desired proteins, as well as mammalian sequences that are non-coding, but that provide for essential regulatory sequences in a healthy mammal. Preferably, the RNA molecule useful in the methods of the invention must be sufficiently distinct in sequence from any mammalian polynucleotide sequence expressed in the target cells (e.g. liver cells) for which the function is intended to be undisturbed after any of the methods of this invention are performed. As described for determining the homology to the target sequence above, one of skill in the art may resort to the above-identified computer algorithms to define the essential lack of homology between the RNA molecule polynucleotide sequence and the normal mammalian sequences expressed in the target cells. For example, in a specific embodiment, the homology between the sequence of an RNAi agent and the selected normal sequence expressed in the target cells is less than the homologies of the formulae described above. In some embodiments, there is almost no homology at all between the sequence of an RNAi agent and any normal mammalian sequence.

The double-stranded RNA molecules used in the methods of the invention may comprise one or more modified nucleotides. A "modified nucleotide" refers to a nucleotide that has one or more chemical modifications to the nucleoside, nucleobase, pentose ring, or phosphate group. The double-stranded RNA molecules may comprise combinations of modified nucleotides, ribonucleotides, and deoxyribonucleotides. Incorporation of modified nucleotides into one or both strands of double-stranded RNA molecules can improve the in vivo stability of the RNA molecules, e.g., by reducing the molecules' susceptibility to nucleases and other degradation processes. The potency of double-stranded RNA molecules for reducing expression of the target gene can also be enhanced by incorporation of modified nucleotides.

In certain embodiments, the modified nucleotides have a modification of the ribose sugar. These sugar modifications can include modifications at the 2' and/or 5' position of the pentose ring. A 2'-modified nucleotide refers to a nucleotide having a pentose ring with a substituent at the 2' position other than H or OH. Such 2'-modifications include, but are not limited to, 2'-O-alkyl (e.g. O—$C_1$-$C_{10}$ or O—$C_1$-$C_{10}$ substituted alkyl), 2'-O-allyl (O—$CH_2CH=CH_2$), 2'-C-allyl, 2'-fluoro, 2'-O-methyl ($OCH_3$), 2'-O-methoxyethyl (O—$(CH_2)_2OCH_3$), 2'-$OCF_3$, 2'-$O(CH_2)_2SCH_3$, 2'—O-aminoalkyl, 2'-amino (e.g. $NH_2$), 2'-O-ethylamine, and 2'-azido. Modifications at the 5' position of the pentose ring include, but are not limited to, 5'-methyl (R or S); 5'-vinyl; and 5'-methoxy.

The double-stranded RNA molecules employed in the methods of the invention may also comprise one or more modified internucleotide linkages. As used herein, the term "modified internucleotide linkage" refers to an internucleotide linkage other than the natural 3' to 5' phosphodiester linkage. In some embodiments, the modified internucleotide linkage is a phosphorous-containing internucleotide linkage, such as a phosphotriester, aminoalkylphosphotriester, an alkylphosphonate (e.g. methylphosphonate, 3'-alkylene phosphonate), a phosphinate, a phosphoramidate (e.g. 3'-amino phosphoramidate and aminoalkylphosphoramidate), a phosphorothioate (P=S), a chiral phosphorothioate, a phosphorodithioate, a thionophosphoramidate, a thionoalkylphosphonate, a thionoalkylphosphotriester, and a boranophosphate. In one embodiment, a modified internucleotide linkage is a 2' to 5' phosphodiester linkage. In other embodiments, the modified internucleotide linkage is a non-phosphorous-containing internucleotide linkage and thus can be referred to as a modified internucleoside linkage. Such non-phosphorous-containing linkages include, but are not limited to, morpholino linkages (formed in part from the sugar portion of a nucleoside); siloxane linkages (—O—Si(H)$_2$—O—); sulfide, sulfoxide and sulfone linkages; formacetyl and thioformacetyl linkages; alkene containing backbones; sulfamate backbones; methylenemethylimino (—CH$_2$—N(CH$_3$)—O—CH$_2$—) and methylenehydrazino linkages; sulfonate and sulfonamide linkages; amide linkages; and others having mixed N, O, S and CH$_2$ component parts. In one embodiment, the modified internucleoside linkage is a peptide-based linkage (e.g. aminoethylglycine) to create a peptide nucleic acid or PNA, such as those described in U.S. Pat. Nos. 5,539,082; 5,714,331; and 5,719, 262. Other suitable modified internucleotide and internucleoside linkages that may be employed in the double-stranded RNA molecules are described in U.S. Pat. Nos. 6,693,187, 9,181,551, U.S. Patent Publication No. 2016/0122761, and Deleavey and Damha, Chemistry and Biology, Vol. 19: 937-954, 2012, all of which are hereby incorporated by reference in their entireties.

Interfering RNA Delivery

The interfering RNA compounds can be administered by any method suitable for administration of nucleic acid agents, such as a DNA vaccine or gene therapy vectors. These methods include gene guns, bio injectors, and skin patches as well as needle-free methods such as the microparticle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from, for example, Alza Corporation and Nova Pharmaceuticals, Inc. Liposomal suspensions can also be used as pharmaceutically acceptable carriers. These can be prepared according to methods known to those skilled in the art, for example, as described in U.S. Pat. No. 4,522,811.

The interfering RNA molecule may be conjugated to one or more carbohydrate moieties to optimize one or more properties of the interfering RNA molecule. In many cases, the carbohydrate moiety will be attached to a modified subunit of the interfering RNA molecule or at the 5' or 3' end of one of strands of the interfering RNA molecule. E.g., the ribose sugar of one or more ribonucleotide subunits of an interfering RNA molecule can be replaced with another moiety, e.g., a non-carbohydrate (preferably cyclic) carrier to which is attached a carbohydrate moiety. A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The carbohydrate moiety may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

In some embodiments the interfering RNA molecule of the invention is conjugated to a carbohydrate moiety via a carrier, wherein the carrier can be cyclic group or acyclic group; in specific embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

Targeting the Interfering RNA

Given that ASGR, ASGR-1 and/or ASGR-2 is expressed on the surface of liver cells (e.g. hepatocytes), in certain embodiments, it is desirable to deliver the interfering RNA molecules to those liver cells so that the interfering effect can be exerted specifically within liver cells. Accordingly, in certain embodiments, the interfering RNA molecules are specifically targeted to liver cells using various methodologies known in the art and described herein. For example, in certain embodiments, antigen binding proteins (e.g. antibodies) or other targeting moieties disclosed herein below can be used to specifically target the interfering RNA molecules to the hepatocytes using various different receptors expressed on the surface of hepatocytes. In certain embodiments, the interfering RNA molecules are targeted to liver cells using the surface expressed ASGR, ASGR-1 and/or ASGR-2. In these embodiments, it is envisioned that this can result in a self-regulating system that reduces the amount of RNAi agent delivered to the liver cells as expression of ASGR, ASGR-1, and/or ASGR-2 is reduced due to the effect of the targeted interfering RNA.

A wide variety of targeting moieties can be coupled to the oligonucleotides of the present invention. In some embodiments, the targeting moieties are coupled, e.g., covalently, either directly or indirectly via an intervening tether.

In some embodiments, a targeting moiety alters the distribution, targeting or lifetime of the molecule into which it is incorporated. In preferred embodiments a targeting moiety provides an enhanced affinity for a selected target, e.g., molecule, cell or cell type, compartment, receptor e.g., a cellular or organ compartment, tissue, organ or region of the body, as, e.g., compared to a species absent such a targeting moiety. Targeting moieties providing enhanced affinity for a selected target are also termed targeting moieties.

Some targeting moieties can have endosomolytic properties. The endosomolytic targeting moieties promote the lysis of the endosome and/or transport of the composition of the invention, or its components, from the endosome to the cytoplasm of the cell. The endosomolytic targeting moiety may be a polyanionic peptide or peptidomimetic which shows pH-dependent membrane activity and fusogenicity. In one embodiment, the endosomolytic targeting moiety assumes its active conformation at endosomal pH. The "active" conformation is that conformation in which the endosomolytic targeting moiety promotes lysis of the endosome and/or transport of the composition of the invention, or its components, from the endosome to the cytoplasm of the cell. Exemplary endosomolytic targeting moieties include the GALA peptide (Subbarao et al., Biochemistry, 1987, 26: 2964-2972), the EALA peptide (Vogel et al., J. Am. Chem. Soc., 1996, 118: 1581-1586), and their derivatives (Turk et al., Biochem. Biophys. Acta, 2002, 1559: 56-68). In one embodiment, the endosomolytic component may contain a chemical group (e.g., an amino acid) which will undergo a change in charge or protonation in response to a change in pH. The endosomolytic component may be linear or branched.

In certain embodiments, targeting moieties can improve transport, hybridization, and specificity properties and may also improve nuclease resistance of the resultant natural or modified oligoribonucleotide, or a polymeric molecule comprising any combination of monomers described herein and/or natural or modified ribonucleotides.

In some embodiments, targeting moieties in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Targeting moieties can include a naturally occurring substance, such as a protein (e.g., human serum albumin (I), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The targeting moiety may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly (L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylarcrylic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Targeting moieties can also include other targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Other examples of targeting moieties include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g. EDTA), lipophilic molecules, e.g, cholesterol, cholic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Targeting moieties can be proteins, e.g., glycoproteins, or peptides, e.g., molecules having a specific affinity for a co-moiety, or antigen binding proteins, such as antibodies; e.g., an antibody, that binds to a specified cell type such as a liver hepatocyte. Targeting moieties may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The targeting moiety can be, for example, a lipopolysaccharide.

The targeting moiety can be a substance, e.g, a drug, which can increase the uptake of the interfering RNA molecule into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, jasplakinolide, latrunculin A, phalloidin, swinholide A, indanocine, or myoseverin.

The targeting moiety can increase the uptake of the interfering RNA molecule into the cell by activating an inflammatory response, for example. Exemplary targeting moieties that would have such an effect include tumor necrosis factor alpha (TNFalpha), interleukin-1 beta, or gamma interferon.

In one embodiment, the targeting moiety is a lipid or lipid-based molecule. Such a lipid or lipid-based molecule preferably binds a serum protein, e.g., human serum albumin (I). A serum protein binding targeting moiety, in certain embodiments, allows for distribution of the conjugate to a target tissue, e.g., a non-kidney target tissue of the body. For example, the target tissue can be the liver, including hepatocytes or parenchymal cells of the liver. Other molecules that can bind serum proteins can also be used as targeting moieties. For example, naproxen or aspirin can be used. A lipid or lipid-based targeting moiety can (a) increase resistance to degradation of the conjugate, (b) increase targeting or transport into a target cell or cell membrane, and/or (c) can be used to adjust binding to a serum protein.

A lipid based targeting moiety can be used to modulate, e.g., control the binding of the conjugate to a target tissue. For example, a lipid or lipid-based targeting moiety that binds to a serum protein more strongly will be less likely to be targeted to the kidney and therefore less likely to be cleared from the body. A lipid or lipid-based targeting moiety that binds to a serum protein less strongly can be used to target the conjugate to the kidney, if so desired.

In one embodiment, the lipid based targeting moiety binds human serum albumin. In a specific embodiment, it binds human serum albumin with a sufficient affinity such that the conjugate will be preferably distributed to a non-kidney tissue. In certain embodiments, it is preferred that the affinity not be so strong that the human serum albumin targeting moiety binding cannot be reversed.

In another preferred embodiment, the lipid based targeting moiety binds human serum albumin weakly or not at all, such that the conjugate will be preferably distributed to the kidney. Other moieties that target to kidney cells can also be used in place of or in addition to the lipid-based targeting moiety.

In another embodiment, the targeting moiety is for example a vitamin, e.g., a vitamin, which is taken up by a target cell, e.g., a proliferating cell. Exemplary vitamins include vitamin A, E, and K. Other exemplary vitamins include B vitamins, e.g., folic acid, B12, riboflavin, biotin, pyridoxal or other vitamins or nutrients taken up by cells. Also included are low density lipoprotein (LDL) and high-density lipoprotein (HDL).

In another embodiment, the targeting moiety is a cell-permeation agent, preferably a helical cell-permeation agent. In some embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The targeting moiety can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 5-50 amino acids long, e.g., about 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVL-LALLAP. An RFGF analogue (e.g., amino acid sequence AALLPVLLAAP) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ) and the Drosophila Antennapedia protein (RQIKIWFQNRRMKWKK) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). In some embodiments, the peptide or peptidomimetic tethered to an interfering RNA molecule via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized. An RGD peptide can facilitate targeting of an interfering RNA molecule to cells of a variety of other tissues, including the lung, kidney, spleen, or liver (Aoki et al., Cancer Gene Therapy 8:783-787, 2001). The RGD peptide can be linear or cyclic, and can be modified, e.g., glycosylated or methylated to facilitate targeting to specific tissues. For example, a glycosylated RGD peptide can deliver an interfering RNA molecule to a cell expressing $\alpha V\beta_3$ (Haubner et al., Jour. Nucl. Med., 42:326-336, 2001). Peptides that target markers enriched in proliferating cells can be used. E.g., RGD containing peptides and peptidomimetics can target cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Cecropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

In one embodiment, a targeting peptide can be an amphipathic α-helical peptide. Exemplary amphipathic α-helical peptides include, but are not limited to, cecropins, lycotoxins, pardaxins, buforin, CPF, bombinin-like peptide (BLP), cathelicidins, ceratotoxins, S. clava peptides, hagfish intestinal antimicrobial peptides (HFIAPs), magainins, brevinins-2, dermaseptins, melittins, pleurocidin, H.sub.2A peptides, Xenopus peptides, esculentin-1, and caerins.

Peptide and peptidomimetic targeting moieties include those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting moiety can be any moiety that is capable of targeting a specific receptor. Examples are: folate, GalNAc, galactose, mannose, mannose-6P, clusters of sugars such as GalNAc cluster, mannose cluster, galactose cluster, or an aptamer. A cluster is a combination of two or more sugar units. The targeting moieties also include integrin receptor moieties, chemokine receptor moieties, transferrin, biotin, serotonin receptor moieties, PSMA, endothelin, GCPII, somatostatin, LDL and HDL moieties. The targeting moieties can also be based on nucleic acid, e.g., an aptamer. The aptamer can be unmodified or have any combination of modifications disclosed herein.

Other exemplary endosomal release agents include imidazoles, poly or oligoimidazoles, PEIs, peptides, fusogenic peptides, polycarboxylates, polycations, masked oligo or poly cations or anions, acetals, polyacetals, ketals/polyketals, orthoesters, polymers with masked or unmasked cationic or anionic charges, dendrimers with masked or unmasked cationic or anionic charges.

Pharmacokinetic ("PK") modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g. oligonucleotides of about 5 bases, 10 bases, 15 bases or 20 bases, comprising multiple of phosphorothioate linkages in the backbone are also amenable to the present invention as targeting moieties (e.g. as PK modulating moieties). In addition, aptamers that bind serum components (e.g. serum proteins) are also amenable to the present invention as PK modulating moieties.

When two or more targeting moieties are present, the targeting moieties can all have same properties, all have different properties or some targeting moieties have the same properties while others have different properties. For example, a targeting moiety can have targeting properties, have endosomolytic activity and/or have PK modulating properties. In certain embodiments, all the have different properties.

In some embodiments, a targeting moiety can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The 1' position can also be attached to a conjugate moiety, such as in an abasic residue. Internucleosidic linkages can also bear conjugate moieties. For phosphorus-containing linkages (e.g., phosphodiester, phosphorothioate, phosphorodithiotate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

It is envisioned that any suitable targeting moiety in the field of RNA interference may be used, although the targeting moiety is typically a carbohydrate e.g. monosaccharide (such as GalNAc), disaccharide, trisaccharide, tetrasaccharide, polysaccharide. Linkers that conjugate the targeting moiety to the nucleic acid include those discussed herein. For example, the targeting moiety can be one or more GalNAc derivatives attached through a bivalent or trivalent branched linker.

In certain embodiments, cleavable linking groups are utilized. A cleavable linking group is one which is sufficiently stable outside the cell, but which upon entry into a target cell is cleaved to release the two parts the linker is holding together. In one embodiment, the cleavable linking group is cleaved at least 10 times or more, and in some embodiments, at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing the cationic lipid from the moiety inside the cell, or into the desired compartment of the cell.

A linker can include a cleavable linking group that is cleavable by a particular enzyme. The type of cleavable linking group incorporated into a linker can depend on the cell to be targeted. For example, liver targeting targeting moieties can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis. Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

In some embodiments, redox cleavable linking groups are utilized. Redox cleavable linking groups are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular interfering RNA molecule and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In a specific embodiment, candidate compounds are cleaved by at most 10% in the blood. In some embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In yet some embodiments, phosphate-based cleavable linking groups are cleaved by agents that degrade or hydrolyze the phosphate group. An example of an agent that cleaves phosphate groups in cells are enzymes such as phosphatases in cells. Examples of phosphate-based linking groups are —O—P(O)(Ork)-O—, —O—P(S)(Ork)-O—, —O—P(S)(SRk)-O—, —S—P(O) (Ork)-O—, —O—P(O)(Ork)-S—, —S—P(O)(Ork)-S—, —O—P(S)(Ork)-S—, —S—P(S)(Ork)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Specific embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. Another specific embodiment is —O—P(O)(OH)—O—. These candidates can be evaluated using methods analogous to those described above.

In some embodiments, acid cleavable linking groups, which are linking groups that are cleaved under acidic conditions, are envisioned. In some embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—C(O)O, or —OC(O). A specific embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

In some embodiments, ester-based cleavable linking groups, which are cleaved by enzymes such as esterases and amidases in cells, are envisioned. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In yet further embodiments, peptide-based cleavable linking groups, which are cleaved by enzymes such as peptidases and proteases in cells, are envisioned. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHR$^A$C(O)NHCHR$^B$C(O)—, where R$^A$ and R$^B$ are the R groups of the two adjacent amino acids. These candidates can be evaluated using methods analogous to those described above. As used herein, "carbohydrate" refers to a compound which is either a carbohydrate per se made up of one or more monosaccharide units having at least 6 carbon atoms (which may be linear, branched or cyclic) with an oxygen, nitrogen or sulfur atom bonded to each carbon atom; or a compound having as a part thereof a carbohydrate moiety made up of one or more monosaccharide units each having at least six carbon atoms (which may be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums.

Synthesis of Interfering RNA

The interfering RNA molecules that can be employed in the methods of the present invention can readily be made using techniques known in the art, for example, using conventional RNA solid phase synthesis. See, for example, U.S. Pat. No. 8,877,917. The polynucleotides of the double-stranded RNA molecules can be assembled on a suitable nucleic acid synthesizer utilizing standard nucleotide or nucleoside precursors (e.g. phosphoramidites). Automated nucleic acid synthesizers are sold commercially by several vendors, including DNA/RNA synthesizers from Applied Biosystems (Foster City, Calif.), MerMade synthesizers from BioAutomation (Irving, Tex.), and OligoPilot synthesizers from GE Healthcare Life Sciences (Pittsburgh, Pa.).

The 2' silyl protecting group can be used in conjunction with acid labile dimethoxytrityl (DMT) at the 5' position of ribonucleosides to synthesize oligonucleotides via phosphoramidite chemistry. Final deprotection conditions are known not to significantly degrade RNA products. All syntheses can be conducted in any automated or manual synthesizer on large, medium, or small scale. The syntheses may also be carried out in multiple well plates or glass slides.

The 2'-O-silyl group can be removed via exposure to fluoride ions, which can include any source of fluoride ion, e.g., those salts containing fluoride ion paired with inorganic counterions e.g., cesium fluoride and potassium fluoride or those salts containing fluoride ion paired with an organic counterion, e.g., a tetraalkylammonium fluoride. A crown ether catalyst can be utilized in combination with the inorganic fluoride in the deprotection reaction. Preferred fluoride ion source are tetrabutylammonium fluoride or aminehydrofluorides (e.g., combining aqueous HF with triethylamine in a dipolar aprotic solvent, e.g., dimethylformamide).

The choice of protecting groups for use on the phosphite triesters and phosphotriesters can alter the stability of the triesters towards fluoride. Methyl protection of the phosphotriester or phosphitetriester can stabilize the linkage against fluoride ions and improve process yields.

Since ribonucleosides have a reactive 2' hydroxyl substituent, it can be desirable to protect the reactive 2' position in RNA with a protecting group that is orthogonal to a 5'-O-dimethoxytrityl protecting group, e.g., one stable to treatment with acid. Silyl protecting groups meet this criterion and can be readily removed in a final fluoride deprotection step that can result in minimal RNA degradation.

Tetrazole catalysts can be used in the standard phosphoramidite coupling reaction. Preferred catalysts include e.g., tetrazole, S-ethyl-tetrazole, p-nitrophenyltetrazole.

See also, for example, Trufert et al., Tetrahedron, 52:3005, 1996; and Manoharan, "Oligonucleotide Conjugates in Antisense Technology," in Antisense Drug Technology, ed. S. T. Crooke, Marcel Dekker, Inc., 2001. The protected monomer compounds can be separated from a reaction mixture and further purified by a method such as column chromatography, high pressure liquid chromatography, or recrystallization. As can be appreciated by the skilled artisan, further methods of synthesizing the compounds of the formulae herein will be evident to those of ordinary skill in the art. Additionally, the various synthetic steps may be performed in an alternate sequence or order to give the desired compounds. Other synthetic chemistry transformations, protecting groups (e.g., for hydroxyl, amino, etc. present on the bases) and protecting group methodologies (protection and deprotection) useful in synthesizing the compounds described herein are known in the art and include, for example, those such as described in R. Larock, Comprehensive Organic Transformations, VCH Publishers (1989); T. W. Greene and P. G. M. Wuts, Protective Groups in Organic Synthesis, 2d. Ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

Methods of Treatment

In further embodiments of the present invention, a method of treating a human subject, comprising administering a therapeutic dosage of the antigen binding proteins or antibodies or interfering RNA (e.g., siRNA or shRNA) of the present invention is provided. In one embodiment, the antigen binding proteins are monoclonal antibodies. In one embodiment, the antigen binding proteins are human antibodies. In another embodiment, the antigen binding proteins or antibodies are humanized antibodies. In another embodiment, interfering RNA (e.g., siRNA or shRNA) is administered. As used herein the term "subject" refers to a mammal, including humans, and can be used interchangeably with the term "patient".

Given the results of the Icelandic study presented in the examples below, there need not be any particular further manipulation downstream in a host receiving a therapy involving administering the ASGR inhibitor (e.g., antigen binding proteins or antibodies or RNAi) to the host. That is, in some embodiments, the antibody (or RNAi) need simply be one or more of the antibodies (or RNAi) described herein, which binds to (and inhibits) ASGR (such as ASGR1), and be administered in an amount, and at a frequency sufficient to reduce the risk of cardiovascular disease, myocardial infarction, or other disorders provided herein. In some embodiments, the antibody (or RNAi) is administered in an amount sufficient to result in a lowering of non-HDL cholesterol. In some embodiments, the antibody (or RNAi) is administered in an amount sufficient to result in lowering LDL cholesterol. While not intended to be limiting unless expressed otherwise, below is a description of various embodiments through which ASGR can have an impact on various disorders, and thus, how the various antibodies (or RNAi) provided herein (which can inhibit (e.g., reduce) ASGR function) can have an impact on the various disorders provided herein.

In some embodiments, the ASGR inhibitor (e.g., antigen binding proteins or antibodies or RNAi) operates through ASGR's role in platelet clearance. Inhibiting (e.g., reducing) the receptor results in a reduction in clearance of old platelets. Such older platelets do not coagulate as well as new platelets and as a result, the blood is thinner. As a result, plaques can lessen and there can be a positive impact (e.g., stroke is lessened) for the subject.

In some embodiments, the ASGR inhibitor (e.g., antigen binding proteins or antibodies or RNAi) binds to ASGR to alter inflammation. For example, reducing the ASGR-1 receptor results in a modification of the immune response. Normally, there can be an increase in proinflammatory cytokines. These proinflammatory cytokines are circulating in the native state (one where the ASGR1 receptor is not reduced). However, ALP (alkaline phosphatase) can have an anti-inflammatory role thereby reducing inflammation and coagulopathy systemically. In some embodiments, the mechanism of action involves reducing ASGR1 which increases ALP and therefore reduces inflammation.

In some embodiments, and without intending to be limited by theory (unless expressed otherwise), the ASGR inhibitor (e.g., antigen binding proteins or antibodies or RNAi) can reduce an activity due to ASGR interacting with one or more other molecules, either directly or indirectly. For example, various embodiments for various proteins are provided herein in Examples 18 and 19. As noted above, this selection of proteins can also be useful for determining the effectiveness of the ASGR inhibitor (e.g., antigen binding proteins or antibodies or RNAi) (and/or the amount of the antibody and/or identification of a subject who can respond to the therapy (or RNAi)) by monitoring one or more of these proteins as a Cardiovascular Disease marker. Thus, these markers are useful as markers and, without intending to be limited by theory, in some embodiments, one or more of the proteins disclosed below is the protein through which (directly or indirectly) ASGR1 modulation achieves its benefit for one or more of the disorders provided herein, including cardiovascular disease.

In addition to the marker proteins described in Examples 18 and 19 herein (which also allow for various mechanisms of action and monitoring the effectiveness of various ASGR inhibitors (e.g., antigen binding proteins or antibodies or RNAi) and dosage regimes), the following proteins of interest are those that interact with ASGR, and ASGR-1 in particular, directly by binding to them. Thus, these are additional interactions that can be inhibited (e.g., reduced) for various embodiments provided herein, by various ASGR inhibitors (e.g., antigen binding proteins or antibodies or RNAi). While not intending to be limited by theory (unless explicitly stated otherwise), ASGR-1's binding to one or more of the following proteins can be inhibited (e.g., reduced) by using an ASGR-1 inhibitor (e.g., antigen binding protein or antibody or RNAi) provided herein that inhibits (e.g., reduces) the noted binding. While in some embodiments, the protein interactions are contemplated as resulting mechanisms of action that occur downstream from when ASGR levels are effectively reduced by an ASGR inhibitor (e.g., antigen binding protein or antibody binding or via RNAi), the following list is a list of proteins that directly bind to ASGR1, and thus whose direct binding to ASGR-1 can be inhibited (e.g., reduced) by one or more of the antigen binding proteins or antibodies provided herein (or RNAi). In some embodiments, the ASGR-1 inhibitor (e.g., antigen binding protein or antibody or RNAi) inhibits (e.g., reduces) ASGR-1's binding to one or more of: Alpha-2-HS-glycoprotein (aka Fetuin A) (see Tozawa et al, J Biol Chem (2001) 276:12624-12628); Asialoglycoprotein receptor 1 (see Stockert et al (1977) Science 197:667-668), Orosomucoid (aka alpha-1-acid glycoprotein) (see Tozawa et al, J Biol Chem (2001) 276:12624-12628), Alkaline phosphatase, (see Hardonk M J, Scholtens H B. Histochemistry. 1980; 69(3):289-97 and Scholtens H B, Meijer D K, Hardonk M J. Liver. 1982 March; 2(1):14-21), LDL and chylomicrons (Windler et al Biochem J (1991) 276:79-87), Fibronectin (see Rotundo et al Hepatology (1998) 28:475-485), and IgA (see Stockert et al PNAS (1982) 79:6229-6231). In some embodiments, the ASGR inhibitor (e.g., antigen binding protein or antibody or RNAi) antibody binds to ASGR and inhibits (e.g., reduces) ASGR's interaction with a molecule that has a terminal Gal or GalNAc, including, but not limited to protein ligands, synthetic polysaccharides, solid substrates, etc. In some embodiments, the ASGR inhibitor (e.g., antigen binding proteins or antibodies or RNAi) inhibits (e.g., reduces) ASGR1's ability to bind to an asialylated molecule. In some embodiments, the invention provides a method of treating or preventing a cardiovascular disease comprising administering to a patient in need thereof a therapeutically effective dose of an ASGR inhibitor as described herein. In some embodiments, the cardiovascular disease is coronary artery disease or myocardial infarction. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient. Some non-limiting examples of cardiovascular disease include atherosclerotic diseases, such as, for example, coronary heart disease, coronary artery disease, peripheral arterial disease, stroke (ischaemic and hemorrhagic), angina pectoris, cerebrovascular disease, acute coronary syndrome, and myocardial infarction. In some embodiments, the ASGR, ASGR-1 and/or ASGR-2 inhibitors of the present invention are useful in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries. In some embodiments, the ASGR, ASGR-1 and/or ASGR-2 inhibitors of the present invention and methods can be used to reduce the risk of recurrent cardiovascular events.

In some embodiments, the invention provides a method of decreasing the risk of acquiring coronary artery disease or having an MI comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of coronary artery disease or MI is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

In some embodiments, the invention provides a method of reducing blood LDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the blood LDL cholesterol level in the patient is reduced by at least about 15%, as compared to a predose level of blood LDL cholesterol in the patient. In some embodiments of this aspect of the invention, the blood LDL cholesterol level of said patient is lowered by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of blood LDL cholesterol in the patient.

In some embodiments, the invention provides a method of reducing non-HDL cholesterol levels in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the non-HDL cholesterol level in the patient is reduced by at least about 5%, as compared to a predose level of non-HDL cholesterol in the patient. In some embodiments of this aspect of the invention, the non-HDL cholesterol level of said patient is lowered by at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of non-HDL cholesterol in the patient.

In some embodiments, the invention provides a method of increasing ALP levels in a patient comprising administering to a patient in need thereof a therapeutically effective dose of of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the ALP level in the patient is increased by at least about 30%, as compared to a predose level of ALP in the patient. In some embodiments of this aspect of the invention, the ALP level of said patient is increased by at least about at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose ALP level in the patient. In some embodiments, ALP levels are increased at least about, 1.5×, 2×, 2.5×, 3×, 3.5×, 4×, 4.5×, and 5× over pretreatment.

In some embodiments, the invention provides a method of antagonizing ASGR, ASGR-1 and/or ASGR-2 in a patient comprising administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein.

In some embodiments, a method of treating or preventing a cardiovascular disease is provided and comprises administering to a patient in need thereof a therapeutically effective dose of an ASGR inhibitor as described herein. In some embodiments, the ASGR inhibitor is an inhibitor of ASGR-1. In some embodiments, the ASGR inhibitor is an inhibitor of ASGR-2. In some embodiments, the ASGR inhibitor is an inhibitor of ASGR-1 and ASGR-2. In some embodiments, the ASGR, ASGR-1 and/or ASGR-2 inhibitor is one or more of the antigen binding proteins described herein. In some embodiments, the ASGR, ASGR-1 and/or ASGR-2 inhibitor is an interfering RNA (e.g., siRNA or shRNA) as described herein. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

The term "treatment" encompasses alleviation of at least one symptom or other embodiment of a disorder, or reduction of disease severity, and the like. An antigen binding protein, in particular a human antibody according to the present invention, need not effect a complete cure, or eradicate every symptom or manifestation of a disease, to constitute a viable therapeutic agent. As is recognized in the pertinent field, drugs employed as therapeutic agents may reduce the severity of a given disease state, but need not abolish every manifestation of the disease to be regarded as useful therapeutic agents. Simply reducing the impact of a disease (for example, by reducing the number or severity of its symptoms, or by increasing the effectiveness of another treatment, or by producing another beneficial effect), or reducing the likelihood that the disease will occur or worsen in a subject, is sufficient. One embodiment of the invention is directed to a method comprising administering to a patient an antigen binding protein or interfering RNA in an amount and for a time sufficient to induce a sustained improvement over baseline of an indicator that reflects the severity of the particular disorder.

The term "prevention" encompasses prevention of at least one symptom or other embodiment of a disorder, and the like. A prophylactically administered treatment incorporating an antigen binding protein, in particular a human antibody according to the present invention, need not be completely effective in preventing the onset of a condition in order to constitute a viable prophylactic agent. Simply reducing the likelihood that the disease will occur or worsen in a subject, is sufficient.

The term "non-HDL cholesterol" encompasses all cholesterol-containing proatherogenic lipoproteins, including LDL cholesterol, very-low-density lipoprotein, intermediate-density lipoprotein, lipoprotein(a), and chylomicron. Non-HDL cholesterol levels are calculated by subtracting HDL cholesterol levels from total cholesterol levels.

As is understood in the pertinent field, pharmaceutical compositions comprising the antigen binding proteins and/or interfering RNA are administered to a subject in a manner appropriate to the indication and the composition. In one embodiment, pharmaceutical compositions comprise the human antibodies of the present invention. In another embodiment, pharmaceutical compositions comprise interfering RNA. Pharmaceutical compositions may be administered by any suitable technique, including but not limited to parenterally, topically, or by inhalation. If injected, the pharmaceutical composition can be administered, for example, via intra-articular, intravenous, intramuscular, intralesional, intraperitoneal or subcutaneous routes, by bolus injection, or continuous infusion. Delivery by inhalation includes, for example, nasal or oral inhalation, use of a nebulizer, inhalation of the antigen binding protein in aerosol form, and the like. Other alternatives include oral preparations including pills, syrups, or lozenges.

Advantageously, the antigen binding proteins or interfering RNA are administered in the form of a composition comprising one or more additional components such as a physiologically acceptable carrier, excipient or diluent. Optionally, the composition additionally comprises one or more physiologically active agents. In various particular embodiments, the composition comprises one, two, three, four, five, or six physiologically active agents in addition to one or more antigen binding proteins (e.g, human antibodies) or interfering RNA.

Kits for use by medical practitioners are provided including one or more antigen binding proteins or interfering RNA and a label or other instructions for use in treating any of the conditions discussed herein. In one embodiment, the kit includes a sterile preparation of one or more human antibodies, or one or more interfering RNA which may be in the form of a composition as disclosed herein, and may be in one or more vials.

Dosages and the frequency of administration may vary according to such factors as the route of administration, the particular antigen binding proteins or interfering RNA employed, the nature and severity of the disease to be treated, whether the condition is acute or chronic, and the size and general condition of the subject. Appropriate dosages can be determined by procedures known in the pertinent art, e.g. in clinical trials that may involve dose escalation studies.

An antigen binding protein, e.g., monoclonal antibodies, or interfering RNA may be administered, for example, once or more than once, e.g., at regular intervals over a period of time. In particular embodiments, an antigen binding protein or interfering RNA is administered over a period of at least once a month or more, e.g., for one, two, or three months or even indefinitely. For treating chronic conditions, long-term treatment is generally most effective. However, for treating acute conditions, administration for shorter periods, e.g. from one to six weeks, may be sufficient. In general, the antigen binding protein or interfering RNA is administered until the patient manifests a medically relevant degree of improvement over baseline for the chosen indicator or indicators.

One example of therapeutic regimens provided herein comprise subcutaneous injection of an antigen binding protein or interfering RNA once a week, or once every two weeks, or once every month, once every other month, once every three months, once every six months or longer, at an appropriate dosage, to treat a condition in which it is desired to target cells expressing ASGR, ASGR-1 and/or ASGR-2. Weekly or monthly administration of antigen binding protein could be continued until a desired result is achieved, e.g., the subject's symptoms subside. Treatment may resume as needed, or, alternatively, maintenance doses may be administered.

In some embodiments, one or more of the markers in Tables 18.1, 18.2, 19.3, and 19.4 can be used to determine whether or not the amount of ASGR inhibitor (e.g., antigen binding protein and/or antibody and/or RNAi) administered is sufficient for its intended therapeutic application. In some embodiments, when one or more of the alterations in protein level, for the proteins outlined in one or more of Tables 18.1, 18.2, 19.3, and 19.4 changes in response to administering the antigen binding protein, antibody and/or RNAi, the antigen binding protein, antibody and/or RNAi is having an effect in the host. In some embodiments, the amount is sufficient when it alters the level of non-HDL cholesterol to a desired amount or reduces it by a desired amount. In some embodiments, the markers used can be one or more of those in one or more of Tiers 1, 2, 3, 4, and 5 of Table 19.4. In some embodiments, the markers used can be one or more of those in one or more of Tiers 1 and 5 of Table 19.4.

Combination Therapies

Particular embodiments of methods and compositions of the invention involve the use of at least one antigen binding protein and/or interfering RNA and one or more other therapeutics useful for treating or preventing cardiovascular disease, for example. In one embodiment, antigen binding proteins and/or interfering RNA are administered alone or in combination with other agents useful for treating the condition with which the patient is afflicted. Examples of such agents include both proteinaceous and non-proteinaceous drugs. When multiple therapeutics are co-administered, dosages may be adjusted accordingly, as is recognized in the pertinent art. "Co-administration" and combination therapy are not limited to simultaneous administration, but also include treatment regimens in which an antigen binding protein is administered at least once during a course of treatment that involves administering at least one other therapeutic agent to the patient. In certain embodiments, an antigen binding protein or interfering RNA is administered prior to the administration of at least one other therapeutic agent. In certain embodiments, an antigen binding protein or interfering RNA is administered concurrent with the administration of at least one other therapeutic agent. In certain embodiments, an antigen binding protein or interfering RNA is administered subsequent to the administration of at least one other therapeutic agent.

In one embodiment, the at least one antigen binding protein or antibody and/or the interfering RNA is administered to a subject in combination with an anti-PCSK9 antibody (e.g., Repatha®, Praluent®, bococizumab). In another embodiment, the at least one antigen binding protein or antibody and/or the interfering RNA is administered to a subject in combination with at least one other cholesterol-lowering (serum and/or total body cholesterol) agent. In some embodiments, the agents that increase the expression of LDLR, have been observed to increase serum HDL levels, lower LDL levels or lower triglyceride levels. Exemplary agents include, but are not limited to, statins (e.g., atorvastatin, cerivastatin, fluvastatin, lovastatin, mevastatin, pitavastatin, pravastatin, rosuvastatin, simvastatin), Nicotinic acid (Niacin) (NIACOR, NIASPAN (slow release niacin), SLO-NIACIN (slow release niacin)), Fibric acid (LOPID (Gemfibrozil), TRICOR (fenofibrate), Bile acid sequestrants (QUESTRAN (cholestyramine), colesevelam (WELCHOL), COLESTID (colestipol)), Cholesterol absorption inhibitors (ZETIA (ezetimibe)), combining nicotinic acid with statin (ADVICOR (LOVASTATIN and NIASPAN), combining a statin with an absorption inhibitor (VYTORIN (ZOCOR and ZETIA) and/or lipid modifying agents. In some embodiments, the at least one antigen binding protein and/or interfering RNA is combined with PPAR gamma agonsits, PPAR alpha/gamma agonists, squalene synthase inhibitors, CETP inhibitors, anti-hypertensives, anti-diabetic agents (such as sulphonyl ureas, insulin, GLP-1 analogs, DDPIV inhibitors), ApoB modulators, MTP inhibitors and/or arteriosclerosis obliterans treatments. In some embodiments, the at least one antigen binding protein and/or interfering RNA is combined with an agent that increases the level of LDLR protein in a subject, such as statins, certain cytokines like oncostatin M, estrogen, and/or certain herbal ingredients such as berberine. In some embodiments, the at least one antigen binding protein and/or interfering RNA is combined with an agent that increases serum cholesterol levels in a subject (such as certain antipsychotic agents, certain HIV protease inhibitors, dietary factors such as high fructose, sucrose, cholesterol or certain fatty acids and certain nuclear receptor agonists and antagonists for RXR, RAR, LXR, FXR). The combination of the two can allow for the undesirable side-effects of other agents to be mitigated by the antigen binding protein or interfering RNA.

Diagnostic Uses

In one embodiment, antigen binding proteins of the invention are useful for detecting the presence of ASGR, ASGR-1 and/or ASGR-2 in a biological sample. The term "detecting" as used herein encompasses quantitative or qualitative detection. In certain embodiments, a biological sample comprises a cell or tissue. In certain embodiments, such tissues include tissues that express ASGR, ASGR-1 and/or ASGR-2 at higher levels relative to other tissues.

In one embodiment, the invention provides a method of detecting the presence of ASGR, ASGR-1 and/or ASGR-2 in a biological sample. In certain embodiments, the method comprises contacting the biological sample with an antigen binding protein of the invention under conditions permissive for binding of an antigen binding protein to ASGR, ASGR-1 and/or ASGR-2, and detecting whether a complex is formed between the antigen binding protein and ASGR, ASGR-1 and/or ASGR-2.

In one embodiment, the invention provides a method of diagnosing a disorder associated with increased or decreased expression of ASGR, ASGR-1 and/or ASGR-2. In certain embodiments, the method comprises contacting a test cell with an antigen binding protein; determining the level of expression (either quantitatively or qualitatively) of ASGR, ASGR-1 and/or ASGR-2 by the test cell by detecting binding of the antigen binding protein to ASGR, ASGR-1 and/or ASGR-2; and comparing the level of expression of ASGR, ASGR-1 and/or ASGR-2 by the test cell with the level of expression of ASGR, ASGR-1 and/or ASGR-2 by a control cell (e.g., a normal cell of the same tissue origin as the test cell or a cell that expresses ASGR, ASGR-1 and/or ASGR-2 at levels comparable to such a normal cell), wherein a higher or lower level of expression of ASGR, ASGR-1 and/or ASGR-2 by the test cell as compared to the control cell indicates the presence of a disorder associated with increased or decreased expression of ASGR, ASGR-1 and/or ASGR-2. In certain embodiments, the test cell is obtained from an individual suspected of having a disorder associated with increased or decreased expression of ASGR, ASGR-1 and/or ASGR-2.

In certain embodiments, a method of diagnosis or detection, such as those described above, comprises detecting binding of an antigen binding protein of the invention to ASGR, ASGR-1 and/or ASGR-2 expressed on the surface of a cell or in a membrane preparation obtained from a cell expressing ASGR, ASGR-1 and/or ASGR-2 on its surface.

In certain embodiments, the method comprises contacting a cell with an antigen binding protein under conditions permissive for binding of an antigen binding protein of the invention to ASGR, ASGR-1 and/or ASGR-2, and detecting whether a complex is formed between the antigen binding protein of the invention and ASGR, ASGR-1 and/or ASGR-2 on the cell surface. An exemplary assay for detecting binding of an antigen binding protein of the invention to ASGR, ASGR-1 and/or ASGR-2 expressed on the surface of a cell is a "FACS" assay.

Certain other methods can be used to detect binding of antigen binding protein of the invention to ASGR, ASGR-1 and/or ASGR-2. Such methods include, but are not limited to, antigen-binding assays that are well known in the art, such as western blots, radioimmunoassays, ELISA (enzyme linked immunosorbent assay), "sandwich" immunoassays, immunoprecipitation assays, fluorescent immunoassays, protein A immunoassays, and immunohistochemistry (IHC).

In certain embodiments, antigen binding proteins of the invention are labeled. Labels include, but are not limited to, labels or moieties that are detected directly (such as fluorescent, chromophoric, electron-dense, chemiluminescent, and radioactive labels), as well as moieties, such as enzymes or ligands, that are detected indirectly, e.g., through an enzymatic reaction, or molecular interaction. Exemplary labels include, but are not limited to, the radioisotopes $^{32}P$, $^{14}C$, $^{125}I$, $^{3}H$, and $^{131}I$, fluorophores such as rare earth chelates or fluorescein and its derivatives, rhodamine and its derivatives, dansyl, umbelliferone, luciferases, e.g., firefly luciferase and bacterial luciferase (U.S. Pat. No. 4,737,456), luciferin, 2,3-dihydrophthalazinediones, horseradish peroxidase (HRP), alkaline phosphatase, beta-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

In certain embodiments, antigen binding proteins of the invention are immobilized on an insoluble matrix. Immobilization entails separating the antigen binding protein of the invention from any ASGR, ASGR-1 and/or ASGR-2 that remains free in solution. This conventionally is accomplished by either insolubilizing the antigen binding protein of the invention before the assay procedure, as by adsorption to a water-insoluble matrix or surface (see, e.g., Bennich et al., U.S. Pat. No. 3,720,760), or by covalent coupling (for example, using glutaraldehyde cross-linking), or by insolubilizing the antigen binding protein of the invention after formation of a complex between the antigen binding protein of the invention and ASGR, ASGR-1 and/or ASGR-2, e.g., by immunoprecipitation.

The invention having been described, the following examples are offered by way of illustration, and not limitation.

Numerous sequences have been provided herein. Where there is a discrepancy in the sequences, the sequences in the tables presented within the figures control, unless there is an indication otherwise. If there is any unintended difference between the same consensus sequences, the consensus sequences as provided in the figures (from the tables within the figures) will control (unless indicated otherwise). For any further discrepancies (rather than just alternative sequences) the sequences within Tables 1-7 will control, unless designated otherwise. The figures contain multiple sequences, sequence alignments and sequence components of various nucleic and amino acid sequences. The present specification references this information in terms of the designated tables and/or the designated figures. Either reference (via figure or table) can be used and either designation (figure or table) will indicate the alternative designation as well, where appropriate. Thus, FIG. 48 designates Table 1, FIG. 49 designates Table 2, FIG. 50 designates Table 3, FIG. 51 designates Table 4, FIG. 52 designates Table 5, FIG. 53 designates Table 6, FIG. 54 designates Table 7, FIG. 55 designates Tables 19A, 19B, 19C, 20A, 20B, and 20C, FIG. 56 designates Tables 21-48, and FIG. 57 designates Tables 49-134, and vice versa. As such, any discussion herein in regard to the above figures or tables is interchangeable with respect to the "table" or "figure" nomenclature.

EXAMPLES

Example 1—Identification of Rare Sequence Variants that Disrupt ASGR-1 Function and Lower Non-HDL Cholesterol and Protect Against Coronary Artery Disease The level of circulating non-high density lipoprotein (non-HDL) cholesterol is heritable and strongly correlated with the risk of coronary artery disease (CAD) and myocardial infraction (MI). Whole-genome sequencing offers the potential to search for rare sequence variants that have large effects on serum lipid levels and hence the risk of cardiovascular disease, such as CAD and MI.

Methods

Study Participants:

Details of the population sample sets from Iceland, Denmark and The Netherlands, used to measure the various lipids traits (non-HDL cholesterol, HDL cholesterol, LDL cholesterol and triglycerides), alkaline phosphatase (ALP), ferritin, and vitamin B12, are outlined in Table 1.2. The dataset for ferritin is not shown. The coronary artery disease case-control sample sets that were a part of the study are outlined in Table 1.1.

Icelandic Study Population

Study participants were enrolled as part of various genetics programs at deCODE. Blood lipid levels (total cholesterol, non-high density lipoprotein cholesterol (non-HDL-C), low density lipoprotein cholesterol (LDL-C), high density lipoprotein cholesterol (HDL-C) and triglycerides), alkaline phosphatase and vitamin B12 levels were obtained from three of the largest laboratories in Iceland: 1) Landspítali—The National University Hospital of Iceland (LUH), Reykjavik (measurements performed between the years 1993 and 2012, hospitalized and ambulatory patients), 2) The Laboratory in Mjódd (RAM), Reykjavik (measurements performed between 2004 and 2012, ambulatory patients) and 3) Akureyri Hospital, The Regional Hospital in North Iceland, Akureyri (performed between 2004 and 2010, hospitalized and ambulatory patients). Information on the participants is outlined in Table 1.2. Lipid levels were adjusted for sex, year of birth and age at measurement, lipid lowering medication and measurement site, using the average of multiple measurements for an individual, and then normalized to a standard normal distribution using quantile normalization. To obtain effect estimates in mmol/L the estimates from the regression analysis were multiplied by the estimated standard deviation of lipid level in the population. Given their approximately log-normal distribution, triglyceride levels were log-transformed before adjustment and the corresponding effect estimates are presented as percentage change instead of units of mmol/L. The total number of individuals with non-HDL cholesterol, LDL cholesterol, HDL cholesterol and triglycerides in Iceland is shown in the Table 1.3 below. For each lipid, the number of chip-typed and directly imputed individuals and those with familial imputations is also shown.

TABLE 1.3

Lipid levels of Icelandic Study Participants

|  | Non-HDL-C | LDL-C | HDL-C | Triglycerides |
| --- | --- | --- | --- | --- |
| Total number | 119,146 | 53,841 | 119,514 | 80,111 |
| Direct imputation | 69,277 | 51,029 | 69,414 | 59,678 |
| Familial imputation | 49,869 | 2,812 | 50,100 | 20,433 |

The total number of Icelandic individuals with lipid values used in the study and the breakdown into those that were chip-typed and directly imputed (Direct imputation) and those that were first and second degree relatives of chip-typed individuals and had their genotypes inferred based on genealogy (Familial imputation).

Non-HDL cholesterol was obtained by subtracting HDL cholesterol from total cholesterol and measures the amount of cholesterol carried within all atherogenic lipoprotein particles (VLDL, IDL, LDL, chylomicrons and Lp(a)). The LDL cholesterol was calculated, using the Friedewald equation (for triglyceride levels <4.00 mmol/L) (Friedewald, W. T., Levy, R. I. & Fredrickson, D. S. Estimation of the concentration of low-density lipoprotein cholesterol in plasma, without use of the preparative ultracentrifuge. Clin. Chem. 18, 499-502 (1972)). Total cholesterol and HDL-cholesterol values are a mixture of fasting and non-fasting values, whereas triglycerides are fasting values exclusively.

Coronary artery disease (CAD) was defined as a) individuals in the MONICA registry who suffered myocardial infarction (MI) before the age of 75 in Iceland between 1981 and 2002 and satisfied the MONICA criteria (Gudbjartsson, et al., Large-scale whole-genome sequencing of the Icelandic population. Nature genetics 2015), b) subjects with CAD discharge diagnoses (ICD 9 codes 410.*, 411.*, 412.*, 414.* or ICD 10 codes I20.0, I21.*, I22.*, I23.*, I24.*, I25.*) from LUH, c) subjects diagnosed with significant angiographic CAD (see defined below) identified from a nationwide clinical registry of coronary angiography and percutaneous coronary interventions at LUH between the years 1987 and 2012, d) subjects undergoing coronary artery bypass grafting (CABG) procedures at LUH between the years 2002 and 2011 or e) cause of death or contributing cause of death listed as MI or CAD (ICD 9 or 10 codes) on death registries between the years 1996 and 2009. Coronary angiograms in the nationwide registry were evaluated by an interventional cardiologist. Patients were considered to have significant angiographic CAD if one or more of the three major epicardial coronary vessels or the left main coronary artery was found to have at least 50% stenosis by visual estimation.

Non-Icelandic Study Populations

Characteristics of the non-Icelandic sample sets are outlined in Table 1.1 and Table 1.2. All the studies outlined in Tables 1.1 and 1.2 were approved by appropriate bioethics and/or data protection authorities. For samples from the Nijmegen Biomedical Study, Netherlands, the lipid values (namely, total cholesterol, HDL-cholesterol and triglycerides) were all non-fasting values. For samples from the Danish Inter99 and Addition studies, the lipid values were all fasting values. All participating subjects donating biological samples signed informed consents. Personal identities of the phenotypes and biological samples were encrypted by a third party system provided by the Icelandic Data Protection Authority.

Data Generation and Analysis

Whole-Genome Sequencing, SNP Calling, and Imputation

The Icelandic samples were genotyped using Illumina microarrays (Samani N J et al., Genomewide association analysis of coronary artery disease. The New England journal of medicine 2007; 357:443-53). The whole-genomes of 2,636 Icelanders were sequenced using the standard TruSeq methodology (Illumina) to a mean depth of at least 10× (median 20×) (Samani N J et al., Genomewide association analysis of coronary artery disease. The New England journal of medicine 2007; 357:443-53). For improved sequencing coverage of the GC-rich intron 4 in ASGR-1 gene, the whole-genome sequence data generated for 738 Icelanders was analyzed using TruSeq PCR-free method from Illumina (mean depth of 30×). The del12 variant in intron 4 of ASGR-1 was detected in this dataset.

Single-Track Assay SNP and Microsatellite Genotyping:

We performed single SNP genotyping of rs186021206, using the Centaurus (Nanogen) platform (Gretarsdottir S, et al., Genome-wide association study identifies a sequence variant within the DAB2IP gene conferring susceptibility to abdominal aortic aneurysm. Nature genetics 2010; 42:692). The del12 variant was genotyped using a PCR based method with the following primers: forward primer (NED labelled) 5'-TTCATCTTTCTTCCCACATTGC-3' (SEQ ID NO: 32600), reverse primer 5'-GGGCCTGAGAGAGACGTTCA-3' (SEQ ID NO: 32601). An internal size standard was added to the resulting PCR products and the fragments were separated and detected on an Applied Biosystems model 3730 sequencer, using in-house Allele Caller software.

Statistical Analyses:

Associations between imputed genotypes and serum lipids (non-HDL cholesterol, HDL cholesterol, LDL cholesterol and triglycerides), ALP, ferritin and vitamin B12 levels in the Icelandic dataset were tested using a generalized linear regression, assuming an additive genetic model (Samani N J et al., Genomewide association analysis of coronary artery disease. The New England journal of medicine 2007; 357:443-53; and Olsen M H, et al., N-terminal probrain natriuretic peptide, but not high sensitivity C-reactive protein, improves cardiovascular risk prediction in the general population. European heart journal 2007; 28:1374-81). For the Icelandic dataset, logistic regression was used to test for association between the del12 variant and coronary artery disease and myocardial infarction, treating the disease status as the response and the number of copies of del12 an individual carries as the explanatory variable. Coronary artery disease case-control association analysis for the non-Icelandic sample sets was done using the NEMO software (Jorgensen A B, et al., Loss-of-function mutations in APOC3 and risk of ischemic vascular disease. The New England journal of medicine 2014; 371:32-41) assuming a multiplicative risk model. Results for the Icelandic and the non-Icelandic sample sets were combined using a Mantel-Haenszel fixed effects model. To estimate the effect of the del12 variant on myocardial infarction-free survival, Kaplan-Meier curves were estimated for survival to first myocardial infarction in heterozygous carriers and non-carriers (Hoogendoorn E H, et al., Thyroid function and prevalence of anti-thyroperoxidase antibodies in a population with borderline sufficient iodine intake: influences of age and sex. Clinical chemistry 2006; 52:104-11) by dividing the corresponding chi-square statistic by 1.36 for non-HDL cholesterol, 1.57 for HDL cholesterol, 1.40 for triglycerides, 1.53 for ALP, 1.30 for vitamin B12, 1.71 for coronary artery disease and 1.48 for myocardial infarction.

To obtain a reliable imputation of the del12 variant, 3,799 Icelandic individuals were genotyped for the del12 variant and those genotypes were used as a training set for imputation of the del12 variant into the rest of the Icelandic population. The imputation information for del12 was 0.99.

The Icelandic samples were genotyped using Illumina microarrays as described above (Gudbartssoon, D F, et al., Large Scale whole-genome sequencing of the Icelandic population. Nature Genetics 2015). The whole-genomes of 2,636 Icelanders were sequenced using Illumina standard TruSeq methodology to a mean depth of at least 10× (median 20×) (Di Angelantonio E, et al., Major lipids, apolipoproteins, and risk of vascular disease. Jama 2009; 302:1993-2000). A total of 35.5 million autosomal SNPs and INDEL's were identified using the Genome Analysis Toolkit version 2.3.9. Information about haplotype sharing was used to improve variant genotyping, taking advantage of the fact that all sequenced individuals had also been chip-typed and long-range-phased. Variants were annotated using Ensembl release 72 and Variant Effect Predictor (VEP) version 2.8. Of the 35.5 million sequence variants found, 25.3 million variants passed the quality threshold and were imputed into 104,220 Icelanders who had been genotyped using Illumina chips. Additionally, using the Icelandic genealogy, genotype probabilities were calculated for 294,212 untyped individuals who are first and second degree relatives of the chip-typed individuals born after 1880 (Gudbartssoon, D F, et al., Large Scale whole-genome sequencing of the Icelandic population. Nature Genetics 2015). The informativeness of genotype imputation (imputation information) was estimated by the ratio of the variance of imputed expected allele counts and the variance of the actual allele counts:

$$\frac{Var(E(\theta \mid \text{chip data}))}{Var(\theta)},$$

where $\theta$ is the allele count. $Var(E(\theta|\text{chip data}))$ was estimated by the observed variance of the imputed expected counts and $Var(O)$ was estimated by $p(1-p)$, where p is the allele frequency.

For improved sequencing coverage of the GC-rich intron 4 in ASGR-1 gene, whole-genome sequence ("WGS") data generated for 738 Icelanders was analyzed using TruSeq PCR-free method from Illumina (mean depth of 30×). This PCR-free method gave much better coverage of GC-rich regions including the ASGR-1 intron 4. The del12 variant in intron 4 of ASGR-1 was detected in five individuals in this dataset.

To provide improved coverage of the associated region (1 Mb centered on ASGR-1), a new dataset was analyzed that included an additional 5,817 WGS individuals (on top of the 2,636 WGS Icelanders). These additional individuals were sequenced with either Illumina TruSeq PCR free or TrueSeq Nano methods. These Illumina TrueSeq methods give enhanced sequence coverage as compared to the standard Illumina TrueSeq method (median sequencing depth 32×). The identified sequence variants were imputed into 150,656 Icelandic chipped-typed individuals, and with the use of genealogy information, into primary and secondary relatives of chip-typed individuals that were un-typed. In this expanded dataset, we identified another rare (0.027%), novel variant, W158X. The W158X variant is a four bp INDEL in exon 7 of ASGR-1 (NM_001671.4:c.469_472dupAACT) that causes frameshift and introduction of premature stop codon at amino acid 158 out of the 291 amino acid full length protein (NP_001662.1:p.Trp158X). A total of 345 individuals were Sanger-sequenced based on the imputation predicted carriers and non-carriers of c.469_472 dupAACT. In this dataset, 79 c.469_472 dupAACT carriers and 270 non-carriers were identified. This genotype data was then used to re-impute the variant into the Icelandic dataset. For non-HDL cholesterol, a larger sample set (n=136,261) was used in the association analysis outlined in Tables 1.4A and 1.4B.

Associations between imputed genotypes and serum lipids (non-HDL cholesterol, HDL cholesterol, LDL cholesterol and triglycerides), ALP and vitamin B12 levels in the Icelandic dataset were tested using a generalized linear regression, assuming an additive genetic model (Gudbjartsson D F, et al., Large-scale whole-genome sequencing of the Icelandic population. Nature genetics 2015; and Steinthorsdottir V, et al., Identification of low-frequency and rare sequence variants associated with elevated or reduced risk of type 2 diabetes. Nature genetics 2014; 46:294-8). All measurements were adjusted for age, sex and measurement site, and average was taken over the available measurements after adjustment and inverse normal transformation. The lipid measurements were further adjusted for statin use. Removing individual known to take lipid lowering drugs in the Icelandic dataset did not alter the association with non-HDL cholesterol. The effect, in standardized units, changed from −0.29 (95% CI −0.38, −0.20; P=$4.0\times10^{-11}$) to −0.30 (−0.39, −0.21; P=$6.7\times10^{-11}$). This amounted to excluding 16,295 individuals, out of 119,146 individuals with non-HDL cholesterol information.

The lipid, ALP and vitamin B12 measurements from the Danish Inter99 study, ADDITION Denmark screening cohort, and the Nijmegen biomedical study, were adjusted and transformed in the same way and tested for association with allele count of del12 and rs186021206 using the linear regression implemented in the R software package. Results from the different populations were combined using the inverse variance fixed-effects method with METAL (Willer C J, et al., METAL: fast and efficient meta-analysis of genomewide association scans. Bioinformatics 2010; 26:2190-1). Effect estimates from the regression analysis are expressed in units of standard deviation (SD). To obtain effect estimates in mg/dL for non-HDL cholesterol, LDL cholesterol and HDL cholesterol, the estimates from the regression analysis were multiplied by the estimated SD of the population distributions. Triglyceride, ALP and vitamin B12 levels were log-transformed before adjustment as their distributions are approximately log-normal, and the corresponding effect estimates are presented as percentage change.

For the Icelandic dataset, logistic regression was used to test for association between the del12 variant and coronary artery disease and myocardial infarction, treating the disease status as the response and the number of copies of the deletion an individual carries as the explanatory variable. Other available individual characteristics that correlate with disease status were also included in the model as nuisance variables (Gudbjartsson D F, et al., Large-scale whole-genome sequencing of the Icelandic population. Nature genetics 2015). Coronary artery disease case-control association analysis for the non-Icelandic sample sets was done using the NEMO software (Gretarsdottir S, et al., The gene encoding phosphodiesterase 4D confers risk of ischemic stroke. Nature genetics 2003; 35:131-8) assuming a multiplicative risk model. Results for the Icelandic and the non-Icelandic sample sets were combined using a Mantel-Haenszel fixed-effects model. Heterogeneity in the effect estimate was tested assuming that the estimated odds ratios for different groups follows a log-normal distribution using a likelihood ratio test with degrees of freedom equal to the number of groups compared minus one.

To estimate the effect of the del12 variant on myocardial infarction free survival, we estimated the Kaplan-Meier curves for survival to first myocardial infarction in heterozygous carriers and non-carriers stratified by sex and tested the difference in survival between carriers and non-carriers using the Cox proportional model. The analysis was performed using the survival library in the R software package. The survival analysis was based on 87,718 chip genotyped Icelanders and 44,655 Icelandic first and second degree relatives of chip typed individuals after restricting our analysis to those who lived to be at least 40 years old. Death was treated as a censoring event.

Functional Characterization of the Del12 Variant in ASGR-1 cDNA Preparation, Amplification, Sanger Sequencing and Next Generation Sequencing:

RNA was isolated from blood samples from carriers and non-carriers of del12. Following cDNA generation, the region between exon 3 and 5 in ASGR-1 was PCR amplified and the identified PCR products (two for del12 carriers and one for non-carriers) were Sanger sequenced using standard methodology to determine the sequence difference between the identified cDNA products. To quantify the ratio between the two amplified cDNA PCR products, they were sequenced using Illumina MiSeq instrument coupled with the MiSeq v2 reagent kit.

Western Blot Analysis:

The wild type ASGR-1 cDNA and ASGR-1 cDNA with the 22 bp deletion were transiently overexpressed in HeLa cells to determine if ASGR-1 transcripts with the 22 bp deletion generated stable truncated ASGR-1 protein as evaluated by western blot analysis.

RNA was isolated from blood samples using a Qiagen RNA maxi kit. Concentration and quality of the RNA was determined using an Agilent 2100 Bioanalyzer (Agilent Technologies), all samples had RIN values over 7. Following cDNA generation, the region between exon 3 and 5 in ASGR-1 was PCR amplified using the Advantage® 2 Polymerase kit (Clontech) with the forward primer, CACTCAGGTCCTTCTGCTGTTTC (SEQ ID NO: 32602) and the reverse primer, 5'-ACCTCGCCTCCTCCTGCT-3' (SEQ ID NO: 32603). The resulting products were resolved on agarose gel and the identified PCR products (two for del12 carriers and one for non-carriers) were Sanger sequenced using standard methodology to determine the sequence difference between the identified cDNA products. To quantitate the ratio between the two amplified cDNA PCR products, they were sequenced using Illumina MiSeq instrument coupled with the MiSeq v2 reagent kit.

Transient Overexpression of Wild Type and Mutated ASGR-1 Harbouring the 22 bp Deletion at the End of Exon 4 in HeLa Cells.

Generation and cloning of wild type and mutated ASGR-1 cDNA:

cDNA of ASGR-1 was obtained by PCR on human liver marathon ready cDNA (BD biosciences Clontech). The primers used were Forward 5'GCCAGCCCTATCATGAC-CAA'3 (SEQ ID NO: 32604) and Reverse 5'GCAGGTCGAGGCATTGAAGA'3 (SEQ ID NO: 32605). The resulting cDNA contained all exons including the start and stop codons of ASGR-1. PCR product was run on 1.6% Agarose gel and a band of the correct size was excised out and purified using QIAquick gel extraction kit (QIAGEN 28704) following the manufacturer's protocol. For cloning of ASGR-1 cDNA into pcDNA3.1/V5-His TOPO vector (Invitrogen K4800-01), 2 µl of the gel extraction product was used and the manufacturer's protocol was followed resulting in pcDNA3.1_ASGR-1_WT. Transformed TOP10 chemically competent cells (Invitrogen C4040-10) were plated on LB plates containing 50 µg/ml ampicillin. Colonies were expanded in 3 ml LB medium containing 50 µg/ml ampicillin. Plasmids were purified using QIAGEN plasmid mini kit (QIAGEN 12125) following the manufacturer's protocol. The plasmid sequence was confirmed by Sanger sequencing using the following sequencing primers: T7: 5'TAATACGACTCAC-TATAGGG'3 (SEQ ID NO: 32606), BGH: 5'TAGAAGGCACAGTCGAGG'3 (SEQ ID NO: 32607) and ASGR-1: 5'GAGGCAATGTGGGAAGAAAGATG'3 (SEQ ID NO: 32608) Introduction of 22 bp deletion in ASGR-1:

In order to generate a cDNA representative of the del12 carrier mRNA, targeted mutagenesis was performed. The Q5 Site-directed mutagenesis kit (New England BioLabs E0554S) and the pcDNA3.1_ASGR-1_WT plasmid was used as a template. In short, a PCR reaction was performed using the following primers 5'GAGGCAATGTGG-GAAGAAAGATGAAGTCG'3 (SEQ ID NO: 32609) and 5'CTGGGCCTCCGTGCTCGC'3 (SEQ ID NO: 32610), resulting in a double-stranded DNA fragment representing the entire pcDNA3.1_ASGR-1_WT plasmid lacking the 22 bp at the end of exon 4. Following the manufacturers recommendation, 1 uL of the PCR reaction was used in the KLD reaction (New England BioLabs E0554S) wherein the PCR fragment is phosphorylated, re-circularized and the non-mutated template plasmid is removed. Mutated plasmids were transformed into NEB 5-alpha Competent cells (New England BioLabs C2987H) and plated on LB plates containing 50 µg/ml ampicillin. Colonies were expanded in 3 ml LB medium containing 50 µg/ml ampicillin. Plasmids were purified using QIAGEN plasmid mini kit (QIAGEN 12125) following the manufacturer's protocol. ASGR-1_22 bp_del sequence was confirmed by Sanger sequencing.

Expression of ASGR-1 in Cultured cells:

Two days prior to transfection, 100,000 HeLa cells (Public Health England 93021013) were seeded into each well of a 6-well plate in 3 mL of DMEM medium (11995-065, ThermoFisher) supplemented with 10% fetal calf serum (ThermoFisher 10500-064) and 50 units/mL penicillin and 50 ug/mL streptomycin (ThermoFisher 15070-063). Cells were incubated at 37° C. and 5% $CO_2$ in a humidified incubator.

The day before transfection, media was replaced with the without antibiotics. On the day of transfection, for each transfected well, 2.5 ug of plasmids containing ASGR-1 WT or ASGR-1_del22 cDNA were diluted in 125 uL Opti-Mem medium (ThermoFisher 31985-047) and 5 uL of P3000 reagent (ThermoFisher L3000-008). Next, 3.75 uL Lipofectamine 3000 (ThermoFisher L3000-008) were mixed with 125 uL of Opti-Mem. Subsequently, the diluted plasmid solution was mixed with the Lipofectamine 3000 solution at a 1:1 ratio and incubated at room temperature for 5 minutes before the addition of 250 uL of the combined solution to each transfected well.

24 hours post transfection, the spent media was replaced with fresh without antibiotics. Selected wells were supplemented with 10 uM MG132 (TOCRIS 1748) for 4.5 hours prior to harvesting of cells. 48 hours post transfection cells were harvested for analysis by washing wells 2× with PBS (ThermoFisher 14190-250) followed by an 8 minute incubation with 1 mL of 0.5 mM EDTA in PBS (ThermoFisher 15575-020). Next, the EDTA solution was aspirated and cells dislodged by pipetting of 2 mL of fresh media. 3×6-wells were pooled for each experimental condition and cells were spun down at 300×g for 5 minutes. The equivalent of 2×6-wells were lysed in 200 uL of RIPA buffer for Western blot analysis. The remainder of cells were split in two and lysed in 300 uL RLT buffer (Qiagen 74106) or 900 uL Tissue and Cell lysis solution (Epicentre MTC096H) and snap frozen on dry ice for RNA and DNA extraction respectively. Three different transient expression experiments were done and all gave the same results.

Quantitative PCR Analysis:

RNA was isolated from cells using the RNeasy Mini Kit (Qiagen 74106) according to manufacturer's recommendations, and concentration and quality was determined with Nanodrop 1000 spectrophotometer (Thermo Scientific). cDNA was synthesized using the High capacity cDNA reverse transcriptase kit (ThermoFisher). DNA was isolated from cells using the MasterPure DNA Purification Kit (Epicentre MCD85201) according to manufacturer's recommendation.

Analysis of gene expression and transfection efficiency was performed on total cDNA and DNA respectively, with real-time PCR on an ABI Prism 7900HT Sequence Detection System (ThermoFisher) using forward (AGACCTTCAGCATCTGGACAATG (SEQ ID NO: 32611)) and reverse (CGAGGTCCGGAGCAGAGA (SEQ ID NO: 32612)) primers and fluorescent labelled probe spanning exon junction 2-3 of the ASGR-1 gene (6FAM-CAGAAAAGGGCCACCTC-MGB (SEQ ID NO: 32613) (ThermoFisher). Human betaActin assay (ThermoFisher 4326315E) was run in parallel to verify normalization of input cDNA and DNA.

Western Blot Analysis:

Cells corresponding to two wells of a 6 well plate were lysed using 200 µl of RIPA buffer with 1:100 Halt protease and phosphatase inhibitor cocktail (Thermo Scientific 78442). Lysates were kept on ice for 10 min with agitation followed by sonication for 20 sec (Branson 2510) and additional agitation on ice for 10 min. Lysates were spun down at 4° C. for 15 min at 14,000×g. Total protein amount of lysates was estimated using the Pierce BCA protein assay kit (Thermo Scientific 23227). Samples were prepared using Novex Bolt LDS sample buffer (4×) (Life technologies B0007) and Novex Bolt sample reducing agent (10×) (Life technologies B0009) and run on Novex Nupage 4-12% Bis-Tris gel (Life technologies NP0335BOX). Total protein amount per lane was 24 µg and PageRuler (Thermo scientific 26616) was used to estimate protein size. The gel was run at a constant of 200V for 50 min. Proteins were transferred to a nitrocellulose membrane (Life technologies IB23002) using iBlot2 (Life technologies). Membranes were allowed to dry and were then hydrated with MQ water before blotting. Membranes were blocked for 1 hour at room temperature using Odyssey blocking buffer PBS (Li-Cor 927-40000). Primary antibodies used were α-ASGR-1 (Sigma-Aldrich HPA011954) 1:500 (recognizes amino acid 1-41) and α-beta-actin (Abcam ab6276) 1:5000 incubated in blocking buffer with the addition of 0.1% Tween for 3 hours at room temperature. Secondary antibodies used were α-Rabbit 680RD (Li-Cor 926-68073) and α-Mouse 800CW (Li-Cor 926-32212) both 1:20,000 in PBST+0.01% SDS for 1 hour at room temperature. After washing the membrane it was allowed to dry and then scanned using the Odyssey infrared imaging system (Li-Cor Biosciences).

Other Diseases and Traits in deCODE Database:

The deCODE Genetics phenotype database contains medical information on diseases and traits obtained through collaboration with specialists in each field. This includes information on cardiovascular diseases (e.g., myocardial infarction, coronary arterial disease, peripheral arterial disease, atrial fibrillation, sick sinus syndrome and stroke), metabolic disorders (e.g., obesity, diabetes, and metabolic syndrome), psychiatric disorders (e.g., schizophrenia, bipolar disorder, anxiety and depression), addictions (e.g., nicotine, alcohol), inflammatory diseases (e.g., rheumatoid arthritis, lupus, and asthma), musculoskeletal disorders (e.g., osteoarthritis, osteoporosis), eye diseases (e.g., glaucoma), kidney diseases (e.g., kidney stones, kidney failure) and 29 types of cancer. Anthropometric measures have also been collected through several of these projects. Routinely measured traits from patient workups (e.g., sodium, potassium, bicarbonate, calcium, phosphate, creatinine, blood cell counts, hemoglobin, hematocrit, immunoglobulins, iron, vitamins, lipids, liver function tests and more) were obtained from the Landspitali University Hospital, Reykjavik, and the Icelandic Medical Center Laboratory in Mjodd (Laeknasetrid), Reykjavik. The number of independent and uncorrelated secondary traits tested for association with del12 amounts to 400.

Results

Association of Sequence Variants with Non-HDL Cholesterol Levels

Sequence variants were first identified through whole-genome sequencing ("WSG") of 2,636 Icelanders to a median depth of 20×. These variants were imputed (assisted by long-range phased haplotypes) into the genomes of 104,220 Icelanders who had been genotyped using Illumina single nucleotide polymorphism (SNP) arrays. In addition, Icelandic genealogical information was used to calculate genotype probabilities for 294,212 close relatives to those genotyped. Using these data we screened for novel rare variants that associated with non-HDL cholesterol levels (n=119, 146). A set of seven correlated (pairwise $r^2 > 0.7$) rare non-coding SNPs on chromosome 17p13.1 associated with non-HDL cholesterol level. The seven variants span 80 kb, including the asialoglycoprotein receptor 1 and 2 (ASGR-1 and ASGR-2) genes. The strongest association was represented by rs186021206 (minor allele frequency (MAF)= 0.43%) located downstream of ASGR-1 that associates with 8.9±1.5 mg/dl lowering of non-HDL cholesterol ($P=1.4 \times 10^{-9}$)(Table 1.4B).

The associated region was well covered by the whole-genome sequencing except for intron 4 of ASGR-1. This intron is 79 base pairs (bp) long and very GC rich. To explore this region further 738 individuals were whole genome sequenced with PCR-free sequencing (Illumina), that gave enhanced coverage of the intron and led to the identification of a 12 bp deletion within the intron; NM_001671.4:c.284-36_283+33delCTGGGGCTGGGG here after referred to as del12. Following direct genotyping of del12 and imputation into the Icelandic dataset, we observed that del12 (MAF=0.41%) is highly correlated with rs186021206 ($r2=0.86$) and the six other correlated SNPs and associates even more strongly with lowering of non-HDL cholesterol levels (decrease of 10.2±1.5 mg/dl, P=2.5× 10−10) (Table 1.9A). Del12 also increases HDL cholesterol and decreases triglyceride (TG) levels, albeit to a much lesser degree than for non-HDL cholesterol (Tables 1.4A and 1.9B). None of the seven SNPs maintained a significant association with non-HDL cholesterol after adjusting for del12 indicating that del12 is sufficient to explain the non-HDL association.

To validate the del12 association with non-HDL cholesterol levels, del12 in samples from The Netherlands (Nijmegen Biomedical Study18) and Denmark (Danish Inter9919 and Danish Addition study20) were genotyped. Del12 associated with non-HDL cholesterol in each sample set with similar effect size as in Iceland (Table 1.2, Tables 1.4A and 1.4B and Table 1.9B). When all three datasets were combined with the Icelandic discovery data, it was established that del12 lowers non-HDL cholesterol by 11.6±1.5 mg/dl ($P=1.0 \times 10^{-16}$)(Table 1.9B).

To identify additional additional loss of function variants in ASGR-1, an extended dataset was screened based on sequence variants identified through whole-genome sequencing ("WSG") of an additional group of 5,817 WGS Icelanders on top of the 2,636 described above. In this dataset, a rare four bp insertion mutation was identified; namely, MAF=0.027%; NM_001671.4: c.469_472dupAACT. As mentioned throughout, this frameshift mutation introduces a premature stop codon at amino acid 158 out of the 291 amino acid full length protein (NP_001662.1:p.W158X). Potential carriers and non-carriers were directly genotyped using Sanger sequencing. Those genotypes were then used to re-impute p.W158X into 150, 656 Icelandic chipped typed individuals and their first and second degree relatives. In this dataset, c.469_472dupAACT associates significantly with a decrease in non-HDL cholesterol (−21.6 mg/dL, 95% CI-34.2 to −9.6) and an increase in ALP (45.3% increase, 95% CI 20.4 to 68.2, $P=7.9 \times 10^{-6}$) (Table 1.8). The direction of the effects of c.469_472 dupAACT and the effect sizes are similar to that of del12 (Table 1.8). Given that a single test was performed, these results provide a significant replication of the ASGR-1 loss of function effect on non-HDL and ALP. Furthermore, since W158X is not correlated with del12 (i.e. there was no overlap between individuals carrying W158X and del12), the W158X variant provides yet further proof that the loss of function in the ASGR-1 gene is responsible for the observed changes in non-HDL, Triglycerides, Alkaline Phosphatase, Ferritin and Vitamin B12 levels. For coronary artery disease, the odds ratio for W158X (c.469_472 dupAACT) was 0.65 (95% CI 0.26 to 1.40; P=0.24). As mentioned above, the W158X (c.469_472 dupAACT) variant is independent of del12 and none of the 79 carriers found in Iceland carried del12. The variant also appears to be specific to the Icelandic population as it is not detected in large population databases such as (Exome Aggregation Consortium (ExAC), Exome Variant Server (EVS), Genomes of the Netherlands (GoNL) and dbSNP.

Figure 4:
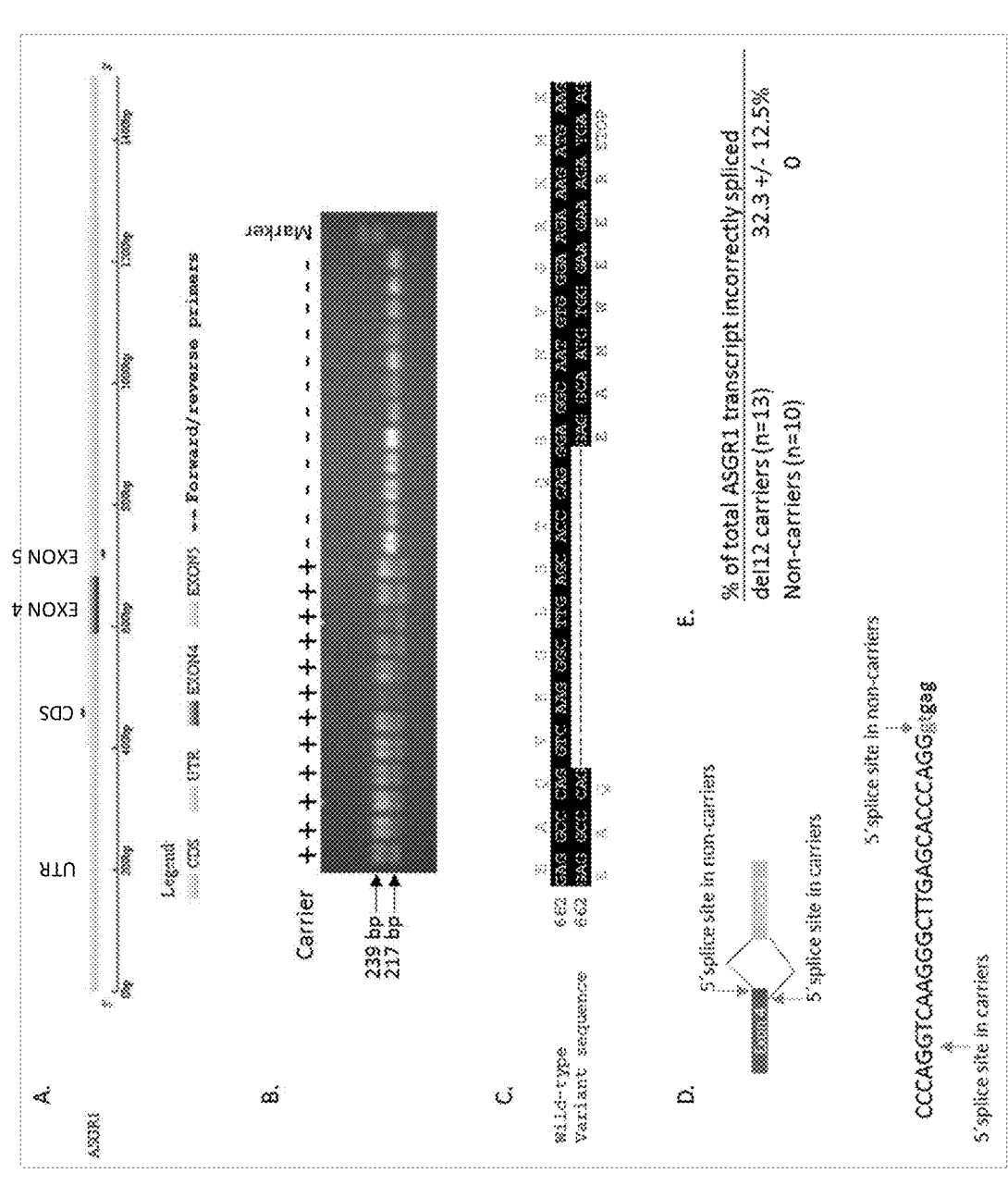
FIG. 4. The del12 variant is associated with a splicing error and frameshift in ASGR-1. (A) Overview of the structure of the ASGR-1 mRNA. Exons 4 and 5 are highlighted (the del12 variant lies within intron 4 between exons 4 and 5 in the unspliced RNA) along with the positions of the PCR primers (red arrows) used to amplify the cDNA. (B) Agarose gel showing the PCR products generated by amplifying cDNA generated from RNA isolated from the blood of del12 carriers and non-carriers. Arrows indicate both the size of the expected PCR product (239 bp) along with the size of the truncated band (217 bp) observed only in del12 heterozygote carriers. (C) Shown is the sequence difference between the full-length (239 bp) and variant (217 bp) cDNA fragments based on Sanger sequencing. The variant sequence in del12 carriers lacks 22 bp at the end of exon 4 compared to the wild-type sequence that results in frameshift and introduction of a stop codon. (D) Diagrammatic representation of the splicing defect observed in del12 carriers. The sequence around the exon 4-intron 4 boundary (exon 4 sequence in capital letters and intron 4 sequence in small letters) is shown along with the 5' splice site in non-carriers and the cryptic 5' splice site activated in del12 carriers. (E) Quantification of the full-length (239 bp) and variant (217 bp) cDNA fragments from heterozygote del12 carriers and non-carriers by direct digital counting of sequencing reads generated following sequencing of the amplified cDNA product from carriers and non-carriers of del12 using the Illumina TruSeq method. The percentage of incorrectly spliced ASGR-1 transcript is shown. Note that the incorrectly spliced form was completely undetectable in non-carriers.

Del12 within Intron 4 of ASGR-1 Causes a Splicing Error Resulting in A Frameshift Since del12 is located in intron 4 of ASGR-1, we examined its effect on splicing between exons 4 and 5. The region between exon 3 and 5 in cDNA generated from blood samples from 12 non-carriers and 12 heterozygous carriers of del12 was PCR amplified (FIG. 4). The PCR products were resolved by gel electrophoresis demonstrating a band of 239 bp in non-carrier. In del12 carriers, however, a smaller 217 bp band was noted in addition to the expected 239 bp PCR product (FIG. 4B). Upon Sanger sequencing of the cDNA products we identified in the 217 bp cDNA fragment a 22 bp deletion at the end of exon 4 (FIG. 4C). The deletion of these 22 bp from the ASGR-1 transcript appears to be driven by a pseudo 5'-splice site in exon 4 (FIG. 4D). It causes a frameshift in carriers such that, if translated, the resulting protein would lack both the oligomerization and carbohydrate recognition domains. To quantify this splicing defect we used the Illumina TruSeq method for direct digital counting of sequencing reads that were generated by sequencing the two cDNA products found in del12 carriers. On average, 32±13% of the total ASGR-1 transcripts were accounted for by the incorrectly spliced isoform (FIG. 4E). This form could not be detected in non-carriers (FIG. 4E). Together, these data identify ASGR-1 as the target gene for the non-HDL association at this locus and are consistent with the associated mutation, del12, disrupting the function of the ASGR-1 protein. ASGR-1 is the major subunit of the hepatic asialoglycoprotein receptor (ASGR) known to recognize and mediate the endocytosis and degradation of a wide variety of desialylated glycoproteins that contain terminal galactose (Gal) or N-acetylgalactosamine (Gal-NAc) residues on their N-linked carbohydrate chains (Morell A G, Gregoriadis G, Scheinberg I H, Hickman J, Ashwell G. The role of sialic acid in determining the survival of glycoproteins in the circulation. The Journal of biological chemistry 1971; 246:1461-7; Van Den Hamer C J, Morell A G, Scheinberg I H, Hickman J, Ashwell G. Physical and chemical studies on ceruloplasmin. IX. The role of galactosyl residues in the clearance of ceruloplasmin from the circulation. The Journal of biological chemistry 1970; 245:4397-402; Ashwell G, Harford J. Carbohydrate-specific receptors of the liver. Annual review of biochemistry 1982; 51:531-54; Weigel P H. Galactosyl and N-acetylgalactosaminyl homeostasis: a function for mammalian asialoglycoprotein receptors. BioEssays: news and reviews in molecular, cellular and developmental biology 1994; 16:519-24).

The Del12 Variant in ASGR-1 and Risk of Coronary Artery Disease

Given the effect of del12 on non-HDL cholesterol levels, its impact on risk of CAD in 33,090 cases and 236,254 controls from Iceland and 8,558 cases and 11,120 controls from the USA, the UK, New Zealand and Denmark was assessed. It was found that carriers of del12 have a lower risk of CAD than non-carriers (odds ratio 0.66; 95% confidence interval [CI] 0.55 to 0.79; P=6.3×10−6) (FIG. 5A). There was no evidence of heterogeneity across the eight study populations (Phet=0.96). Del12 also decreases risk of MI in Iceland (hazard ratio 0.64; 95% CI, 0.64 to 0.80; P=8.5×10−5) (FIG. 5B). In addition, del12 carriers have a 1.5 years longer lifespan than non-carriers (95% CI, 0.2 to 2.8 years; P=0.020).

There is a strong positive correlation between the effect of sequence variants on non-HDL cholesterol levels and risk of CAD (Haddad L, Day I N, Hunt S, Williams R R, Humphries S E, Hopkins P N. Evidence for a third genetic locus causing familial hypercholesterolemia. A non-LDLR, non-APOB kindred. Journal of lipid research 1999; 40:1113-22; Timms K M, Wagner S, Samuels M E, et al. A mutation in PCSK9 causing autosomal-dominant hypercholesterolemia in a Utah pedigree. Human genetics 2004; 114:349-53; Varret M, Rabes J P, Saint-Jore B, et al. A third major locus for autosomal dominant hypercholesterolemia maps to 1p34.1-p32. American journal of human genetics 1999; 64:1378-87; Hunt S C, Hopkins P N, Bulka K, et al. Genetic localization to chromosome 1p32 of the third locus for familial hypercholesterolemia in a Utah kindred. Arterioscler Thromb Vasc Biol 2000; 20:1089-93; Do R, Willer C J, Schmidt E M, et al. Common variants associated with plasma triglycerides and risk for coronary artery disease. Nature genetics 2013; 45:1345-52) (FIG. 6, Table 1.5). However, several published variants, deviate from the overall trend. For example, LPA and ANGPTL4 variants have a substantially greater effect on CAD than their non-HDL effects would predict while the effect of the APOE variants is weaker than predicted by the non-HDL effect. Del12 in ASGR-1 is another example of a variant whose effect on CAD is stronger than predicted by the effect non-HDL cholesterol effect (FIG. 6, Table 1.5).

Association of Del12 with Serum Levels of ALP and Vitamin B12

To determine the overall effect of del12 in ASGR-1, its effect on a variety of human diseases and other traits in the Icelandic dataset was screened. A highly significant association of del12 with higher levels of circulating alkaline phosphatase (ALP) (33.6±2.8 U/L increase, P=3.6×10−63) and vitamin B12 (58.4±8.3 pmol/L increase, P=3.1×10−12) was observed (Tables 8A and 8B and Table 18). An increase in ALP levels may reflect liver disease, however, there was no increase in del 12 carriers in serum gamma glutamyl transferase (GGT), bilirubin, alanine aminotransferase or other measures of liver function that commonly parallel changes in ALP in liver disease (Table 1.6).

The del12 association with higher levels of ALP and vitamin B12 in individuals from the Danish Inter99 study with comparable effect sizes (P=9.9×10−69 for ALP and P=9.9×10−14 for vitamin B12) was replicated (Table 1.10).

A common variant upstream of ASGR-1 (rs314253; MAF=35.1%) has been reported to associate modestly with both LDL cholesterol and ALP levels (Chambers J C, Zhang W, Sehmi J, et al. Genome-wide association study identifies loci influencing concentrations of liver enzymes in plasma. Nature genetics 2011; 43:1131-8; Willer C J, Schmidt E M, Sengupta S, et al. Discovery and refinement of loci associated with lipid levels. Nature genetics 2013; 45:1274-83). This common variant association is replicated in the data of the present invention (strongest association for both ALP and non-HDL with the correlated rs56093546; MAF=21.6%) and that its associations with ALP and non-HDL are independent of the rare signal represented by del12 ($r^2$<0.001, Table 1.5) as demonstrated. As for del12, this common variant has opposite effects on ALP and non-HDL; the allele that increases ALP decreases non-HDL (see Chambers; Willer) (Table 1.7).

TABLE 1.1

| Study | Design | Definition of CAD and MI cases | Ascertainment of controls | Reference |
|---|---|---|---|---|
| Iceland | Case/control | CAD and MI cases were defined by: a) discharge diagnoses (ICD 9 codes 410.*, 411.*, 412.*, 414.* or ICD 10 codes I20.0, I21.*, I22.*, I23.*, I24.*, I25.*) from LUH, b) significant angiographic | Study participants from various deCODE genetics programs without known CVD. | Helgadottir A, Thorleifsson G, Manolescu A, et al. A common variant on |

TABLE 1.1-continued

| Study | Design | Definition of CAD and MI cases | Ascertainment of controls | Reference |
|---|---|---|---|---|
| | | CAD (≥50% stenosis of the major coronary vessels), c) undergone coronary revascularisation (CABG) d) MI or CAD (ICD 9 or 10 codes) listed in death registries, or e) MI before the age of 75 from MONICA registry | | chromosome 9p21 affects the risk of myocardial infarction. Science (New York, NY) 2007; 316:1 491-3. |
| UK 1 - Leicester MI Study | Case/control | Cases included MI patients admitted to the coronary care units of the Leicester Royal Infirmary, Leicester and the Royal Hallamshire Hospital, Sheffield and satisfied the WHO criteria for acute MI. | Controls included adult visitors of individuals with non-cardiovascular disease from each hospital or individuals from three primary care practices located in the same geographical area. Individuals who reported a history of CAD were excluded. | Helgadottir A, Manolescu A, Thorleifsson G, et al. The gene encoding 5-lipoxygenase activating protein confers risk of myocardial infarction and stroke. Nature genetics 2004; 36:23 3-9. |
| UK2 - BHF Family Heart Study | Case/control | The British Heart Foundation Family Heart Study (BHF-FHS) CAD cases were index cases from families of European ancestry with a strong familial history of defined CAD recruited from throughout the United Kingdom. CAD was defined as a validated history of myocardial infarction or coronary revascularisation (PTCA or CABG) before the 66th birthday. | Controls were blood donors recruited by the United Kingdom Blood Service (UKBS) as part of the Wellcome Trust Case Control Consortium Study. | Genome-wide association study of 14,000 cases of seven common diseases and 3,000 shared controls. Nature 2007; 447:6 61-78, and Samani NJ, Erdmann J, Hall AS, et al. Genomewide association analysis of coronary artery disease. The New England journal of medicine 2007; 357:4 43-53. |
| Emory (Atlanta, Georgia, USA) | Case/control | Cases were identified from subjects undergoing cardiac catheterization at the Emory University Hospital. CAD cases included those that had at least one significant stenosis (≥50%) in any of the major coronary arteries on angiography, or those without significant stenosis but had history of MI, CABG, or PCI. | Controls included individuals undergoing cardiac catheterization with no or minimal CAD (<20% stenosis) and had no prior history of MI or CAD. Additional controls were recruited from the Grady Memorial Hospitals and Clinical Registry in Neurology (CRIN) and included individuals with non-vascular neurological diseases (mainly Parkinson's and | Helgadottir A, et al. (2007) |

TABLE 1.1-continued

| Study | Design | Definition of CAD and MI cases | Ascertainment of controls | Reference |
|---|---|---|---|---|
| | | | Alzheimer's diseases), their spouses, unrelated friends and community volunteers; excluding those with a known history of CAD. | |
| Duke (Durham, North Carolina, USA) | Case/control | Participants were enrolled at Duke University Medical Center through the cardiac catheterization laboratories. MI cases included those with self-reported history of MI (corroborated by review of medical records), or those who suffered an MI during the study follow-up period. | Controls included those with no history of MI prior or subsequent to the index cardiac catheterization and no PCI or CABG ejection fraction on left ventriculogram greater than 40%, and stenosis less than 50% on coronary angiography. | Helgadottir A, et al. (2007) |
| UPenn (Philadelphia, Pennsylvania, USA) | Case/control | The study participants were enrolled at the University of Pennsylvania Medical Center and included subjects undergoing cardiac catheterization. CAD cases included those that had at least one significant stenosis (≥50%) in any of the major coronary arteries on angiography, or those without significant stenosis but had history of MI, CABG, or PCI. | Controls included individuals without significant luminal stenosis on coronary angiography (luminal stenosis less than 50%). | Helgadottir A, et al. (2007) |
| New Zealand | Case/control | a) Significant angiographic CAD (≥50% stenosis of the major coronary vessels), b) CABG-procedures c) MI or CAD (ICD 9 or 10 codes) in a clinical registry. | Study participants without known CAD and ultrasound screened for carotid artery disease and abdominal aortic aneurysm, with ankle brachial index to exclude peripheral artery disease. | Gretarsdottir S, Baas AF, Thorleifsson G, et al. Genome-wide association study identifies a sequence variant within the DAB2IP gene conferring susceptibility to abdominal aortic aneurysm. Nature genetics 2010; 42:692-7. |
| Denmark 1 (Gentofte cadlab) | Case/control | Cases were identified from subject investigated by coronary artery angiography because of suspected ischemic heart disease, valvular heart disease or cardiomyopathy. CAD cases included those that had at least one significant stenosis (≥50%) in any of the major coronary arteries on angiography | Individuals in Monica10 and Inter99 studies without CAD diagnosis based on information from the Danish National Patient Registry and the Danish Register of Causes of Death. | |
| Denmark 2 (Monica10) | Case/control | Monica10 is a population based study. Participants were recruited from the Danish Central Personal Register as random samples of the population | Individuals in Monica10 and Inter99 studies without CAD diagnosis based on information from the Danish National Patient Registry and the | Olsen MH, Hansen TW, Christensen MK, et al. N-terminal pro-brain |

TABLE 1.1-continued

| Study | Design | Definition of CAD and MI cases | Ascertainment of controls | Reference |
|---|---|---|---|---|
| | | in the southern part of the former Copenhagen County. Cardiovascular events were defined as first ever non-fatal or fatal CVD (ICD-8: 390-448/ICD-10: I00-I79). Assessment of the cardiovascular endpoints was based on data from the Danish National Patient Registry and the Danish Register of Causes of Death. | Danish Register of Causes of Death. | natriuretic peptide, but not high sensitivity C-reactive protein, improves cardiovascular general risk prediction in the general population. European heart journal 2007; 28:13 74-81. |
| Denmark 3 (Inter99) | Case/control | The Inter99 study is a population-based randomized controlled trial (CT00289237, ClinicalTrials.gov) investigating the effects of lifestyle intervention on cardiovascular disease. Cardiovascular events were defined as first ever non-fatal or fatal CVD (ICD-8: 390-448/ICD-10: I00-I79). Assessment of the cardiovascular endpoints was based on data from the Danish National Patient Registry and the Danish Register of Causes of Death. | Individuals in Monica10 and Inter99 studies without CAD diagnosis based on information from the Danish National Patient Registry and the Danish Register of Causes of Death. | 14. Jorgensen AB, Frikke-Schmidt R, Nordestgaard BG, Tybjaerg-Hansen A. Loss-of-function mutations in APOC3 and risk of ischemic vascular disease. The New England journal of medicine 2014; 371:3 2-41. |
| Sweden | Case/Control | Ischemic stroke patients from the clinic at Karolinska University Hospital, Stockholm. The ischemic stroke diagnosis was based on clinical findings and brain imaging (CT or MRI). | Population-based controls, either healthy blood donors or healthy volunteers recruited at the Karolinska Hospital | Gretarsdottir et al (2008) Traylor et al (2012) |
| South Germany | Case/Control | Ischemic stroke patients recruited at the stroke unit of the Department of Neurology, Klinikum Grosshadern, University of Munich. Diagnoses were based on clinical findings and imaging evidence (either CT or MRI), and were clinically confirmed by neurologists. | Gender and age matched individuals without history of cardiovascular disease selected from the KORA S4 Study | Traylor et al (2008) Gschwendtner et al (2009) Wichmann et al (2005) |
| West Germany | Case/Control | Ischemic stroke patients recruited through hospitals participating in the regional Westphalian Stroke Register. Diagnoses were based on clinical findings and imaging evidence (either CT or MRI), and were clinically confirmed by neurologists. | Population controls with a self-reported history of stroke from the population based Dortmund Health Study | Traylor et al (2008) Berger et al (2007) |
| United Kingdom | Case/Control | Ischemic stroke patients recruited through a cerebrovascular service clinic. All cases were phenotyped by one | Community controls, age and gender matched and free of symptomatic cerebrovascular disease were recruited from the | Traylor et al (2008) Gschwendtner et al (2009) |

TABLE 1.1-continued

| Study | Design | Definition of CAD and MI cases | Ascertainment of controls | Reference |
|---|---|---|---|---|
| | | experienced stroke neurologist with review of original brain imaging with CT or MRI. | same geographic area as the patients. | |

TABLE 1.2

Characteristics of Participants in the Discovery and Replication Studies of the association of del12 Variant with Plasma Lipid, Alkaline Phosphatase, and Vitamin B12 levels

| Trait[a] | Iceland | Nijmegen Biomedical Study (Netherlands)[c] | Inter99 study (Denmark)[d] | Addition Study (Denmark)[e] |
|---|---|---|---|---|
| Ancestry | Caucasian | Caucasian | Caucasian | Caucasian |
| N[b] | 194,958 | 5,645 | 7,633 | 9,689 |
| Mean age (SD), yrs | 58.2 (40.6-75.8) | 55.8 (38.0-73.6) | 48.5 (36.1-55.5) | 59.9 (53.1-66.7) |
| Gender, % female | 53.4% | 53.6% | 49.9% | 46.4% |
| Non-HDL cholesterol (SD), mg/dL | 154.7 (109.1-200.3) | 170.7 (129.4-212.0) | 161.6 (117.5-205.7) | 164.7 (124.0-205.4) |
| LDL cholesterol (SD), mg/dL | 133.0 (91.6-174.4) | 138.6 (102.2-175.0) | 137.2 (99.7-174.7) | 139.3 (101.9-176.1) |
| HDL cholesterol (SD), mg/dL | 54.7 (37.7-71.7) | 52.6 (39.2-66.0) | 54.2 (38.4-70.0) | 60.0 (43.6-76.4) |
| Total Cholesterol (SD), mg/dL | 208.0 (162.6-253.4) | 223.4 (180.9-265.9) | 215.8 (173.6-258.0) | 224.7 (183.9-265.5) |
| Triglycerides (SD), mg/dL | 133.6 (67.6-190.5) | 155.8 (94.5-256.8) | 105.8 (60.8-183.9) | 117.4 (73.5-187.3) |
| Alkaline phosphatase (SD), IU/l | 87.1 (53.5-141.7) | na | 41.3 (30.7-55.6) | na |
| Vitamin B12 (SD), pmol/l | 398 (256-618) | na | 398 (286-554) | na |

[a]The average values (where available) for each of the traits listed is shown (± one SD).
[b]Number of individuals with measurements for at least one of the traits.
[c]Wetzels et al (2007)[5],
[d]Jörgensen et at (2003)[6],
[e]Lauritzen et al (2000)[7].

TABLE 1.4A

Association of del12 with Non-HDL Cholesterol, LDL Cholesterol, HDL Cholesterol, Triglyceride, ALP and Vitamin B12 in Iceland, Denmark and The Netherlands

| | Study population (n) | del12 freq. (%) | Effect (95% CI)[a] mg/dL | P value | Population mean value[e] (±1SD) mg/dL |
|---|---|---|---|---|---|
| Non-HDL cholesterol | | | | | |
| Discovery | Iceland (119,146) | 0.41 | −13.6 (−17.7, −9.4) | $2.5 \times 10^{-10}$ | 154.7 (109.1-200.3) |
| Replication | Denmark A[b] (6,182) | 0.22 | −21.3 (−36.8, −5.9) | 0.0069 | 161.6 (117.5-205.7) |
| Replication | Denmark B[c] (9,656) | 0.32 | −22.2 (−32.8, −11.7) | $3.8 \times 10^{-5}$ | 164.7 (124.0-205.4) |
| Replication | The Netherlands[d] (5,537) | 0.50 | −17.0 (−28.3, −5.7) | 0.0032 | 170.7 (129.4-212.0) |
| | Combined | | −15.3 (−18.9, −11.7) | $1.0 \times 10^{-16}$ | |
| LDL cholesterol | | | mg/dL | | |
| Discovery | Iceland (53,841) | 0.41 | −9.5 (−14.0, −5.1) | $2.8 \times 10^{-5}$ | 133.0 (91.6-174.4) |
| Replication | Denmark A (6,098) | 0.22 | −22.1 (−35.5, −8.7) | 0.0012 | 137.2 (99.7-174.7) |
| Replication | Denmark B (8,080) | 0.32 | −19.0 (−29.2, −8.8) | 0.00026 | 139.3 (101.9-176.1) |
| Replication | The Netherlands (5,523) | 0.50 | −16.0 (−26.1, −6.0) | 0.0018 | 138.6 (102.2-175.0) |
| | Combined | | −12.5 (−16.2, −8.8) | $3.9 \times 10^{-11}$ | |
| HDL cholesterol | | | mg/dL | | mg/dL |
| Discovery | Iceland (119,514) | 0.41 | 2.4 (0.7, 4.1) | 0.0058 | 54.7 (37.7-71.7) |
| Replication | Denmark A (6,182) | 0.22 | 4.6 (−0.8, 9.9) | 0.096 | 54.2 (38.4-70.0) |

TABLE 1.4A-continued

Association of del12 with Non-HDL Cholesterol, LDL Cholesterol, HDL Cholesterol,
Triglyceride, ALP and Vitamin B12 in Iceland, Denmark and The Netherlands

| Study population (n) | | | Effect (95% CI)[a] | P value | Population mean value[e] (±1SD) |
|---|---|---|---|---|---|
| Replication | Denmark B (9,656) | 0.32 | 2.4 (−1.8, 6.7) | 0.26 | 60.0 (43.6-76.4) |
| Replication | The Netherlands (5,537) | 0.50 | 2.4 (−1.3, 6.0) | 0.20 | 52.6 (39.2-66.0) |
| | Combined | | 2.5 (1.1, 4.0) | 0.00039 | |
| | Triglyceride | | % change | | mg/dL |
| Discovery | Iceland (80,011) | 0.41 | −6.1 (−10.8, −1.5) | 0.012 | 133.6 (67.6-190.5) |
| Replication | Denmark A (6,182) | 0.22 | −6.0 (−25.2, 11.4) | 0.53 | 105.8 (60.8-183.9) |
| Replication | Denmark B (8,163) | 0.32 | −8.9 (−21.0, 2.3) | 0.15 | 117.4 (73.5-187.3) |
| Replication | The Netherlands (5,537) | 0.50 | −4.4 (−17.9, 8.2) | 0.52 | 155.8 (94.5-256.8) |
| | Combined | | −6.3 (−10.3, −2.3) | 0.0032 | |
| | ALP | | % change | | U/L |
| Discovery | Iceland (126,060) | 0.41 | 50.1 (42.9, 57.2) | $3.6 \times 10^{-63}$ | 87.1 (53.5-141.7) |
| Replication | Denmark A[c] (5,829) | 0.22 | 29.1 (14.8, 42.5) | $3.1 \times 10^{-6}$ | 41.3 (30.7-55.6) |
| | Combined | | 46.5 (40.1, 52.7) | $5.6 \times 10^{-69}$ | |
| | Vitamin B12 | | % change | | pmol/L |
| Discovery | Iceland (97,910) | 0.41 | 16.6 (11.5, 21.5) | $3.1 \times 10^{-12}$ | 398 (256-618) |
| Replication | Denmark A[c] (5,826) | 0.22 | 18.6 (3.9, 32.4) | 0.0053 | 398 (286-554) |
| | Combined | | 16.8 (12.0, 21.5) | $8.3 \times 10^{-14}$ | |

[a]Effect estimates and 95% confidence intervals (95% CI) in mg/dL for the non-HDL cholesterol and HDL cholesterol and as percentage change for triglyceride, ALP and vitamin B12.
[b]The Danish Inter99 study (Jørgensen et al. 2003).
[c]The Danish Addition study (van den Donk et al. 2011).
[d]The Nijmegen Biomedical Study (Hoogendoorn et al. 2006).
[e]For triglyceride, ALP and vitamin B12, the population mean and the SD are calculated for log-transformed values and transformed back to original units. To convert the values for non-HDL and HDL cholesterol to millimoles per liter, multiply by 0.02586. To convert triglyceride to mmol/L, multiply by 0.01129.

TABLE 1.4B

Association of del12 and rs186021206 with Cholesterols, Triglyceride, Alkaline Phosphatase and Vitamin B12 Measurements in Iceland, Denmark and the Netherlands.

| Trait/Cohort (n)[a] | rs186021206 | | | | del12 | | |
|---|---|---|---|---|---|---|---|
| | Effect[b] SD | Effect (95% CI)[c] mg/dL | P | $P_{adj}$[d] | Effect[b] | Effect (95% CI)[c] mg/dL | P |
| Non-HDL cholesterol | | | | | | | |
| Iceland (119,146) | −0.28 | −12.9 (−17.1, −8.7) | $1.4 \times 10^{-9}$ | 0.39 | −0.30 | −13.6 (−17.7, −9.4) | $2.5 \times 10^{-10}$ |
| Denmark A (6,182) | −0.38 | −16.7 (−27.9, −5.4) | 0.0038 | 0.64 | −0.48 | −21.3 (−36.8, −5.9) | 0.0069 |
| Denmark B (9,656) | −0.32 | −13.1 (−21.0, −5.3) | 0.0011 | 0.74 | −0.55 | −22.2 (−32.8, −11.7) | $3.8 \times 10^{-5}$ |
| The Netherlands (5,537) | −0.23 | −9.7 (−19.9, 0.5) | 0.062 | 0.19 | −0.41 | −17.0 (−28.3, −5.7) | 0.0032 |
| Combined | −0.29 | −12.9 (−16.3, −9.6) | $2.0 \times 10^{-14}$ | 0.24 | −0.34 | −15.3 (−18.9, −11.7) | $1.0 \times 10^{-16}$ |
| LDL cholesterol | | | | | | | |
| Iceland (53,841) | −0.22 | −9.2 (−13.6, −4.7) | $5.5 \times 10^{-5}$ | 0.78 | −0.23 | −9.5 (−14.0, −5.1) | $2.8 \times 10^{-5}$ |
| Denmark A (6,098) | −0.43 | −16.1 (−25.8, −6.3) | 0.0012 | 0.56 | −0.59 | −22.1 (−35.5, −8.7) | 0.0012 |
| Denmark B (8,080) | −0.34 | −12.5 (−20.3, −4.7) | 0.0016 | 0.86 | −0.51 | −19.0 (−29.2, −8.8) | 0.00026 |
| The Netherlands (5,523) | −0.36 | −13.2 (−22.3, −4.2) | 0.0041 | 0.81 | −0.44 | −16.0 (−26.1, −6.0) | 0.0018 |
| Combined | −0.28 | −11.1 (−14.5, −7.8) | $1.0 \times 10^{-10}$ | 0.70 | −0.31 | −12.5 (−16.2, −8.8) | $3.9 \times 10^{-11}$ |
| Total cholesterol | | | | | | | |
| Iceland (125,381) | −0.22 | −9.9 (−14.0, −5.7) | $3.1 \times 10^{-6}$ | 0.78 | −0.23 | −10.5 (−14.7, −6.4) | $6.5 \times 10^{-7}$ |
| Denmark A (6,182) | −0.32 | −13.5 (−24.2, −2.8) | 0.014 | 0.54 | −0.33 | −14.0 (−28.7, 0.8) | 0.063 |
| Denmark B (9,656) | −0.30 | −12.0 (−19.9, −4.2) | 0.0027 | 0.97 | −0.47 | −19.2 (−29.8, −8.6) | 0.00040 |
| The Netherlands (5,537) | −0.21 | −9.0 (−19.5, 1.5) | 0.0927 | 0.48 | −0.33 | −14.1 (−25.7, −2.5) | 0.018 |
| Combined | −0.24 | −10.5 (−13.8, −7.2) | $5.1 \times 10^{-10}$ | 0.68 | −0.27 | −12.0 (−15.6, −8.5) | $5.6 \times 10^{-11}$ |
| HDL cholesterol | | | | | | | |
| Iceland (119,514) | 0.13 | 2.2 (0.5, 3.9) | 0.011 | 0.0055 | 0.14 | 2.4 (0.7, 4.1) | 0.0058 |
| Denmark A (6,182) | 0.15 | 2.4 (−1.5, 6.4) | 0.22 | 0.84 | 0.29 | 4.6 (−0.8, 9.9) | 0.096 |
| Denmark B (9,656) | 0.03 | 0.4 (−2.7, 3.6) | 0.79 | 0.32 | 0.15 | 2.4 (−1.8, 6.7) | 0.26 |
| The Netherlands (5,537) | 0.02 | 0.2 (−3.1, 3.5) | 0.9 | 0.043 | 0.18 | 2.4 (−1.3, 6.0) | 0.20 |
| Combined | 0.10 | 1.6 (0.4, 2.9) | 0.01 | 0.001 | 0.15 | 2.5 (1.1, 4.0) | 0.00039 |

TABLE 1.4B-continued

Association of del12 and rs186021206 with Cholesterols, Triglyceride, Alkaline Phosphatase and Vitamin B12 Measurements in Iceland, Denmark and the Netherlands.

| Trait/Cohort (n)[a] | rs186021206 | | | | del12 | | |
|---|---|---|---|---|---|---|---|
| | Effect[b] | Effect (95% CI)[c] % change | P | $P_{adj}$[d] | Effect[b] | Effect (95% CI)[c] % change | P |
| Triglyceride | | | | | | | |
| Iceland (80,011) | −0.11 | −5.4 (−10.1, −0.8) | 0.027 | 0.13 | −0.12 | −6.1 (−10.8, −1.5) | 0.012 |
| Denmark A (6,182) | −0.26 | −13.4 (−26.1, −1.6) | 0.046 | 0.11 | −0.11 | −6.0 (−25.2, 11.4) | 0.53 |
| Denmark B (8,163) | −0.03 | −1.3 (−11.2, 8.0) | 0.79 | 0.099 | −0.2 | −8.9 (−21.0, 2.3) | 0.15 |
| The Netherlands (5,537) | 0.13 | 6.5 (−7.0, 19.1) | 0.32 | 0.0057 | −0.09 | −4.4 (−17.9, 8.2) | 0.52 |
| Combined | −0.09 | −4.2 (−7.9, −0.6) | 0.028 | 0.0066 | −0.13 | −6.3 (−10.3, −2.3) | 0.003 |
| ALP | | | | | | | |
| Iceland (126,060) | 0.82 | 48.9 (41.8, 55.8) | $1.2 \times 10^{-61}$ | 0.10 | 0.84 | 50.1 (42.9, 57.2) | $3.6 \times 10^{-63}$ |
| Denmark A (6,035) | 0.70 | 23.0 (13.2, 32.4) | $2.2 \times 10^{-7}$ | 0.092 | 0.86 | 29.1 (14.8, 42.5) | $3.1 \times 10^{-6}$ |
| Combined | 0.80 | 41.5 (35.9, 47.0) | $1.9 \times 10^{-67}$ | 0.026 | 0.84 | 46.5 (40.1, 52.7) | $5.6 \times 10^{-69}$ |
| Vitamin B12 | | | | | | | |
| Iceland (97,910) | 0.33 | 15.8 (10.8, 20.7) | $2.0 \times 10^{-11}$ | 0.15 | 0.35 | 16.6 (11.5, 21.5) | $3.1 \times 10^{-12}$ |
| Denmark A (6,032) | 0.49 | 17.6 (7.2, 27.7) | 0.00027 | 0.011 | 0.52 | 18.6 (3.9, 32.4) | 0.0053 |
| Combined | 0.35 | 16.1 (11.6, 20.6) | $4.3 \times 10^{-14}$ | 0.84 | 0.36 | 16.8 (12.0, 21.5) | $8.3 \times 10^{-14}$ |

[a]Number of individuals with trait value and genotypes.
[b]Effect estimates from the regression in units of standard deviations (SD) of the distributions of the adjusted values.
[c]Effect estimates and 95% confidence intervals (95% CI) in mg/dL for the cholesterol, and as percentage change for triglyceride, ALP and vitamin B12.
[d]P-values adjusted for the effect of del12. "The Netherlands", The Nijmegen Biomedical Study[15]; "Denmark A", The Danish Inter99 study[6]; "Denmark B", The Danish Addition study[16].

TABLE 1.5

The association of published lipid variants with non-HDL cholesterol levels and coronary artery disease in Iceland.

| Chr | Build 36 position Position (hg18) | MAF | Info | Non-HDL (mg/dL) Effect | SE | Coronary artery disease OR | 95% CI | |
|---|---|---|---|---|---|---|---|---|
| 1 | 25,641,524 | 0.47184 | 0.996 | 0.7 | 0.2 | 0.99 | 0.97 | 1.02 |
| 1 | 55,278,235 | 0.01173 | 0.986 | −17.2 | 1.0 | 0.73 | 0.66 | 0.81 |
| 1 | 62,725,961 | 0.21814 | 0.996 | 1.6 | 0.3 | 1.01 | 0.98 | 1.03 |
| 1 | 62,906,518 | 0.33844 | 0.998 | −2.3 | 0.2 | 0.99 | 0.97 | 1.01 |
| 1 | 92,766,395 | 0.19052 | 0.999 | 0.8 | 0.3 | 0.99 | 0.97 | 1.02 |
| 1 | 109,620,053 | 0.20789 | 0.999 | 4.8 | 0.3 | 1.08 | 1.06 | 1.11 |
| 1 | 110,000,250 | 0.41287 | 0.995 | 1.0 | 0.2 | 1.01 | 0.99 | 1.03 |
| 1 | 149,225,460 | 0.15162 | 0.997 | −0.7 | 0.3 | 1.03 | 1.00 | 1.06 |
| 1 | 154,967,275 | 0.28892 | 0.998 | −0.5 | 0.2 | 0.99 | 0.97 | 1.02 |
| 1 | 219,036,651 | 0.28689 | 0.994 | 0.9 | 0.2 | 1.01 | 0.98 | 1.03 |
| 1 | 228,362,314 | 0.39128 | 0.999 | −1.1 | 0.2 | 0.99 | 0.97 | 1.01 |
| 1 | 232,915,962 | 0.4424 | 0.999 | 1.2 | 0.2 | 1.00 | 0.98 | 1.03 |
| 2 | 21,087,477 | 0.04518 | 0.999 | −6.1 | 0.5 | 0.94 | 0.89 | 0.99 |
| 2 | 21,117,405 | 0.3491 | 0.997 | 2.9 | 0.2 | 1.05 | 1.03 | 1.07 |
| 2 | 21,139,562 | 0.1408 | 0.999 | 4.3 | 0.3 | 1.08 | 1.04 | 1.11 |
| 2 | 27,584,444 | 0.34466 | 0.998 | −1.8 | 0.2 | 1.00 | 0.98 | 1.03 |
| 2 | 27,584,716 | 0.20151 | 0.995 | −1.4 | 0.3 | 1.00 | 0.97 | 1.02 |
| 2 | 43,927,385 | 0.27892 | 0.999 | −2.6 | 0.2 | 0.95 | 0.93 | 0.98 |
| 2 | 43,953,086 | 0.19027 | 0.997 | −1.5 | 0.3 | 0.96 | 0.94 | 0.99 |
| 2 | 63,003,061 | 0.32014 | 0.997 | 0.9 | 0.2 | 1.02 | 1.00 | 1.05 |
| 2 | 118,293,479 | 0.07895 | 0.998 | −0.8 | 0.4 | 1.02 | 0.98 | 1.06 |
| 2 | 121,025,958 | 0.41077 | 0.994 | 0.6 | 0.2 | 1.03 | 1.01 | 1.06 |
| 2 | 169,538,401 | 0.37685 | 0.999 | −0.5 | 0.2 | 0.99 | 0.97 | 1.01 |
| 2 | 216,012,629 | 0.32322 | 0.998 | 0.8 | 0.2 | 0.95 | 0.93 | 0.97 |
| 3 | 12,271,469 | 0.3667 | 0.998 | −1.2 | 0.2 | 0.99 | 0.97 | 1.02 |
| 3 | 32,508,014 | 0.07924 | 0.997 | −1.6 | 0.4 | 0.98 | 0.94 | 1.02 |
| 3 | 133,691,893 | 0.11977 | 0.998 | −1.1 | 0.3 | 0.99 | 0.96 | 1.03 |
| 3 | 172,209,912 | 0.07646 | 0.999 | 0.8 | 0.4 | 1.08 | 1.04 | 1.12 |
| 4 | 3,442,937 | 0.40281 | 0.991 | 0.7 | 0.2 | 1.03 | 1.00 | 1.05 |
| 4 | 25,672,088 | 0.14802 | 0.993 | 0.9 | 0.3 | 1.04 | 1.01 | 1.07 |
| 4 | 88,249,285 | 0.40279 | 0.999 | 0.7 | 0.2 | 1.00 | 0.98 | 1.02 |
| 4 | 100,233,828 | 0.42298 | 0.998 | 0.5 | 0.2 | 1.01 | 0.99 | 1.03 |
| 5 | 74,661,243 | 0.35407 | 0.999 | 2.8 | 0.2 | 1.04 | 1.02 | 1.06 |
| 5 | 122,883,315 | 0.47211 | 0.995 | 0.5 | 0.2 | 1.00 | 0.98 | 1.02 |
| 5 | 156,322,875 | 0.35741 | 0.998 | 1.7 | 0.2 | 1.01 | 0.99 | 1.03 |
| 6 | 16,217,142 | 0.46163 | 0.995 | −0.8 | 0.2 | 0.99 | 0.97 | 1.01 |
| 6 | 26,201,120 | 0.06713 | 1.000 | −1.5 | 0.4 | 0.99 | 0.95 | 1.03 |
| 6 | 31,373,469 | 0.29084 | 0.993 | 0.8 | 0.2 | 1.02 | 1.00 | 1.04 |
| 6 | 43,865,874 | 0.47286 | 0.993 | 0.9 | 0.2 | 1.02 | 1.00 | 1.04 |
| 6 | 100,706,818 | 0.19956 | 0.998 | −1.0 | 0.3 | 1.00 | 0.97 | 1.02 |
| 6 | 116,444,196 | 0.40848 | 0.998 | −0.6 | 0.2 | 0.98 | 0.96 | 1.00 |
| 6 | 127,494,332 | 0.47183 | 0.999 | 0.9 | 0.2 | 1.01 | 0.99 | 1.03 |
| 6 | 139,873,450 | 0.42692 | 0.999 | −0.7 | 0.2 | 0.98 | 0.96 | 1.00 |
| 6 | 160,881,127 | 0.01773 | 1.000 | 4.0 | 0.8 | 1.31 | 1.21 | 1.41 |
| 6 | 160,930,108 | 0.06104 | 0.984 | 2.3 | 0.4 | 1.27 | 1.22 | 1.33 |
| 7 | 21,573,877 | 0.22512 | 0.992 | 1.5 | 0.3 | 1.00 | 0.98 | 1.02 |
| 7 | 25,958,351 | 0.14423 | 0.993 | 0.9 | 0.3 | 1.05 | 1.02 | 1.08 |
| 7 | 44,548,856 | 0.2013 | 0.990 | 2.0 | 0.3 | 1.02 | 1.00 | 1.05 |
| 7 | 44,567,220 | 0.42549 | 0.998 | −1.2 | 0.2 | 0.97 | 0.95 | 0.99 |
| 7 | 72,620,810 | 0.11552 | 0.998 | −0.9 | 0.3 | 1.02 | 0.99 | 1.06 |
| 7 | 72,697,942 | 0.46468 | 0.997 | 0.5 | 0.2 | 0.99 | 0.97 | 1.01 |
| 7 | 130,095,474 | 0.44163 | 0.998 | −0.5 | 0.2 | 0.96 | 0.94 | 0.98 |
| 8 | 9,221,641 | 0.07554 | 0.997 | 1.9 | 0.4 | 1.04 | 1.00 | 1.08 |
| 8 | 18,316,718 | 0.18705 | 0.996 | −1.3 | 0.3 | 0.96 | 0.94 | 0.99 |
| 8 | 19,888,502 | 0.08181 | 0.996 | −2.1 | 0.4 | 0.93 | 0.89 | 0.97 |
| 8 | 19,910,123 | 0.45471 | 0.996 | −1.0 | 0.2 | 0.96 | 0.94 | 0.98 |
| 8 | 55,584,167 | 0.24432 | 1.000 | 1.0 | 0.2 | 1.02 | 0.99 | 1.04 |
| 8 | 59,548,473 | 0.31037 | 0.998 | −1.4 | 0.2 | 0.99 | 0.97 | 1.01 |
| 8 | 116,733,072 | 0.26318 | 0.999 | −1.1 | 0.2 | 1.00 | 0.97 | 1.02 |
| 8 | 126,543,488 | 0.22755 | 0.997 | −1.9 | 0.3 | 0.96 | 0.94 | 0.99 |
| 8 | 126,551,803 | 0.49199 | 0.999 | −2.3 | 0.2 | 0.95 | 0.93 | 0.97 |
| 8 | 145,094,645 | 0.385 | 0.990 | 0.7 | 0.2 | 0.98 | 0.96 | 1.00 |
| 9 | 2,630,759 | 0.09898 | 0.998 | −1.3 | 0.4 | 0.97 | 0.94 | 1.01 |
| 9 | 16,894,846 | 0.31865 | 0.998 | −0.5 | 0.2 | 0.97 | 0.95 | 0.99 |
| 9 | 106,704,122 | 0.25781 | 0.999 | −1.1 | 0.2 | 0.97 | 0.95 | 0.99 |
| 9 | 106,724,051 | 0.28833 | 0.997 | −0.6 | 0.2 | 0.99 | 0.97 | 1.02 |
| 9 | 135,122,694 | 0.38646 | 0.997 | −0.9 | 0.2 | 0.99 | 0.97 | 1.01 |
| 9 | 135,143,989 | 0.15248 | 0.995 | 1.0 | 0.3 | 1.05 | 1.02 | 1.08 |
| 10 | 94,829,632 | 0.42892 | 0.993 | −0.6 | 0.2 | 0.99 | 0.97 | 1.01 |
| 11 | 18,612,847 | 0.30731 | 0.998 | 0.8 | 0.2 | 1.02 | 1.00 | 1.04 |

TABLE 1.5-continued

The association of published lipid variants with non-HDL cholesterol levels and coronary artery disease in Iceland.

| Chr | Build 36 position Position (hg18) | MAF | Info | Non-HDL (mg/dL) Effect | SE | Coronary artery disease OR | 95% CI | |
|---|---|---|---|---|---|---|---|---|
| 11 | 61,305,450 | 0.27208 | 0.991 | 0.8 | 0.2 | 1.01 | 0.99 | 1.04 |
| 11 | 61,354,548 | 0.38782 | 0.998 | −1.1 | 0.2 | 1.00 | 0.98 | 1.02 |
| 11 | 116,144,314 | 0.06787 | 0.999 | −5.8 | 0.4 | 0.94 | 0.91 | 0.98 |
| 11 | 116,159,645 | 0.46743 | 0.999 | −0.5 | 0.2 | 0.97 | 0.95 | 0.99 |
| 11 | 116,206,564 | 0.00228 | 0.979 | −15.1 | 2.3 | 0.91 | 0.73 | 1.14 |
| 11 | 122,039,714 | 0.40275 | 0.996 | 0.6 | 0.2 | 1.01 | 0.99 | 1.03 |
| 11 | 125,749,162 | 0.10572 | 0.999 | 0.7 | 0.3 | 1.02 | 0.99 | 1.06 |
| 12 | 110,492,139 | 0.38236 | 0.999 | 0.8 | 0.2 | 0.94 | 0.92 | 0.96 |
| 12 | 110,794,963 | 0.2284 | 0.999 | 0.8 | 0.3 | 0.94 | 0.92 | 0.97 |
| 12 | 119,901,033 | 0.30901 | 0.994 | 0.9 | 0.2 | 1.03 | 1.01 | 1.05 |
| 13 | 31,851,388 | 0.44766 | 0.999 | −0.7 | 0.2 | 0.99 | 0.97 | 1.01 |
| 14 | 23,953,727 | 0.49889 | 0.995 | 0.8 | 0.2 | 0.98 | 0.96 | 1.01 |
| 15 | 56,518,445 | 0.19278 | 0.999 | −0.6 | 0.3 | 0.99 | 0.97 | 1.02 |
| 16 | 55,542,640 | 0.38939 | 0.991 | −1.8 | 0.2 | 0.97 | 0.95 | 0.99 |
| 16 | 55,572,592 | 0.06047 | 0.997 | 2.9 | 0.5 | 1.04 | 1.00 | 1.09 |
| 16 | 66,485,543 | 0.10432 | 1.000 | −0.8 | 0.3 | 0.97 | 0.94 | 1.01 |
| 16 | 70,665,594 | 0.14755 | 0.997 | 1.3 | 0.3 | 1.03 | 1.00 | 1.06 |
| 17 | 7,032,374 | 0.35058 | 0.996 | −1.0 | 0.2 | 0.98 | 0.96 | 1.00 |
| 17 | 8,101,874 | 0.49481 | 0.998 | −0.4 | 0.2 | 0.96 | 0.94 | 0.98 |
| 17 | 39,281,652 | 0.03364 | 0.989 | 1.3 | 0.6 | 1.08 | 1.02 | 1.15 |
| 17 | 42,746,803 | 0.28266 | 0.998 | 0.6 | 0.2 | 1.02 | 1.00 | 1.04 |
| 17 | 64,394,061 | 0.32561 | 0.995 | 0.5 | 0.2 | 1.03 | 1.01 | 1.05 |
| 18 | 45,363,953 | 0.01171 | 0.999 | 4.8 | 1.0 | 1.00 | 0.91 | 1.09 |
| 19 | 8,335,323 | 0.02392 | 0.965 | −4.7 | 0.7 | 0.80 | 0.74 | 0.86 |
| 19 | 11,063,306 | 0.0888 | 0.995 | −6.8 | 0.4 | 0.89 | 0.86 | 0.92 |
| 19 | 11,088,602 | 0.45236 | 0.997 | 1.4 | 0.2 | 1.02 | 1.00 | 1.04 |
| 19 | 19,268,718 | 0.07838 | 0.997 | −3.8 | 0.4 | 0.96 | 0.92 | 1.00 |
| 19 | 50,103,781 | 0.16819 | 0.980 | 8.4 | 0.3 | 1.05 | 1.02 | 1.08 |
| 19 | 50,103,919 | 0.05236 | 0.968 | −16.9 | 0.5 | 0.83 | 0.79 | 0.87 |
| 19 | 53,898,229 | 0.39118 | 0.997 | 1.1 | 0.2 | 1.00 | 0.98 | 1.03 |
| 19 | 57,016,028 | 0.27115 | 0.999 | 0.6 | 0.2 | 1.03 | 1.01 | 1.06 |
| 19 | 59,489,660 | 0.21613 | 0.990 | −0.6 | 0.3 | 0.99 | 0.96 | 1.02 |
| 20 | 12,910,718 | 0.45731 | 0.998 | 0.4 | 0.2 | 1.00 | 0.98 | 1.03 |
| 20 | 17,793,921 | 0.15541 | 0.991 | 0.8 | 0.3 | 0.98 | 0.95 | 1.01 |
| 20 | 38,613,850 | 0.34358 | 0.997 | −1.1 | 0.2 | 0.98 | 0.96 | 1.00 |
| 20 | 39,157,752 | 0.45945 | 0.997 | 1.1 | 0.2 | 0.99 | 0.97 | 1.01 |
| 20 | 42,475,778 | 0.04599 | 0.993 | −1.3 | 0.5 | 0.98 | 0.93 | 1.03 |
| 20 | 44,018,827 | 0.21978 | 0.998 | 1.3 | 0.3 | 0.98 | 0.96 | 1.01 |

Shown are the build 36 positions (hg18), minor allele frequency (MAF), imputation information, the non-HDL effect in mg/dL and the standard error of the estimate (SE), and the OR for coronary artery disease and 95% CI for the minor allele.

TABLE 1.6.

Association of del12 with various measures of liver function in Iceland

| Phenotype | n[a] | Effect[b] | Effect (95% CI)[c] | P | Mean (±1 SD)[d] |
|---|---|---|---|---|---|
| | | | % change | | |
| Alanine Transaminase | 144,402 | 0.087 | 5.8 (−0.4, 12.2) | 0.065 | 28.7 (15.0-54.8) units/L |
| Alkaline Phosphatase | 126,060 | 0.840 | 50.1 (42.9, 57.2) | $3.6 \times 10^{-63}$ | 87.1 (53.5-141.7) units/L |
| Aspartate Transaminase | 144,931 | 0.072 | 4.1 (−2.9, 11.4) | 0.095 | 28.1 (14.2-55.6) units/L |
| Bilirubin | 94,805 | 0.054 | 3.7 (−2.6, 10.4) | 0.25 | 9.1 (4.6-18.0) μm/L |
| Gamma Glutamyl Transpeptidase | 138,844 | 0.113 | 10.3 (1.7, 19.2) | 0.015 | 30.9 (13.1-72.9) units/L |
| | | | g/L | | |
| Albumin | 78,555 | −0.109 | −0.72 (−1.37, 0.06) | 0.033 | 39.5 (33.0-46.0) g/L |

[a]Number of individuals used in the association analysis for each of the traits.
[b]Effect estimate, in units of standard deviation, from regression of adjusted trait values on the expected genotype count of del12.
[c]Effect estimates and 95% CI in original units. For traits with log-normal distribution the effects are presented as percentage change with 95% CI.
[d]Mean trait values, ±one SD, in the Icelandic population. For traits with log-normal distribution the mean and SD is calculated for log-transformed trait values and transformed back to original units.

TABLE 1.7

Common Variants at the ASGR-1 Locus Associated with Non-HDL Cholesterol and Alkaline Phosphatase in Iceland

| | rs314253 | rs56093546 | del12 |
|---|---|---|---|
| Chromosome position | 17: 7032374 | 17: 7004539 | 17: 7020979 |
| MAF (%) | 35.06 | 21.63 | 0.43 |
| Effect[a] on non-HDL cholesterol | −0.03 | −0.04 | −0.30 |
| (P value) | $(5.9 \times 10^{-6})$ | $(2.0 \times 10^{-6})$ | $(2.5 \times 10^{-10})$ |
| Adjusted for rs314253 (P) | — | 0,022 | $7.9 \times 10^{-11}$ |
| Adjusted for rs56093546 (P) | 0,0068 | — | $7.2 \times 10^{-11}$ |
| Adjusted for del12 (P) | $6.4 \times 10^{-7}$ | $1.7 \times 10^{-6}$ | — |
| Effect[a] on ALP | 0.050 | 0.068 | 0.82 |
| (P value) | $(3.9 \times 10^{-21})$ | $(7.4 \times 10^{-28})$ | $(3.6 \times 10^{-63})$ |

TABLE 1.7-continued

Common Variants at the ASGR-1 Locus Associated with Non-HDL Cholesterol and Alkaline Phosphatase in Iceland

| Chromosome position | rs314253 17: 7032374 | rs56093546 17: 7004539 | del12 17: 7020979 |
|---|---|---|---|
| Adjusted for rs314253 (P) | — | $5.7 \times 10^{-12}$ | $4.1 \times 10^{-66}$ |
| Adjusted for rs56093546 (P) | 0,000042 | — | $2.0 \times 10^{-66}$ |
| Adjusted for del12 (P) | $4.2 \times 10^{-24}$ | $4.0 \times 10^{-31}$ | — |
| $r^2$, D' (relative to rs314253) | — | 0.29, 0.76 | 0.001, 0.60 |
| $r^2$, D' (relative to rs56093546) | 0.29, 0.76 | — | 0.001, 1.00 |

[a]Effect estimates from the regression in units of standard deviations of the distributions of the adjusted values.
The association of rs314253 with LDL cholesterol was reported in Willer et al 2013 and with ALP in Chambers et al., 2011.

TABLE 1.8

Association of p.w158X and del12 with Cholesterols, Triglyceride, Alkaline Phosphatase, Vitamin B12 and CAD in an extended Icelandic dataset

| | p.W158X | | | del12 | | |
|---|---|---|---|---|---|---|
| Trait/(n)[a] | Effect[b] SD | Effect (95% CI)[c] mg/dL | P | Effect[b] SD | Effect (95% CI)[c] mg/dL | P |
| Non-HDL cholesterol | | | | | | |
| (136,261) | −0.45 | −21.6 (−34.2, −9.6) | 0.00057 | −0.29 | −13.3 (−17.2, −9.3) | $4.0 \times 10^{-11}$ |
| LDL cholesterol | | | | | | |
| (53,932) | −0.38 | −15.9 (−32.7, 0.9) | 0.064 | −0.23 | −9.7 (−14.1, −5.1) | $2.8 \times 10^{-5}$ |
| Total cholesterol | | | | | | |
| (131,879) | −0.30 | −13.5 (−29.3, 2.2) | 0.091 | −0.23 | −10.4 (−14.2, −6.5) | $1.4 \times 10^{-7}$ |
| HDL cholesterol | | | | | | |
| (124,437) | 0.14 | 2.4 (−3.9, 8.7) | 0.45 | 0.15 | 2.5 (1.0, 4.0) | 0.0016 |
| | | % change | | | % change | |
| Triglyceride | | | | | | |
| (82,569) | −0.17 | −8.4 (−25.5, 7.2) | 0.33 | −0.12 | −6.0 (−10.4, −1.8) | 0.0075 |
| ALP | | | | | | |
| (131,966) | 0.77 | 45.3 (20.4, 68.2) | $7.9 \times 10^{-6}$ | 0.80 | 47.7 (2.2, 87.1) | $5.6 \times 10^{-76}$ |
| Vitamin B12 | | | | | | |
| (102,624) | 0.26 | 15.6 (−4.3, 34.0) | 0.084 | 0.33 | 17.5 (3.1, 30.9) | $5.6 \times 10^{-16}$ |
| CAD | | OR | P | | OR | P |
| (35,134/275,567) | | 0.61 (0.26, 1.40) | 0.24 | | 0.66 (0.54, 0.81) | $4.5 \times 10^{-5}$ |

[a]Number of individuals with trait value and genotypes.
[b]Effect estimates from the regression in units of standard deviations (SD) of the distributions of the adjusted values.
[c]Effect estimates and 95% confidence intervals (95% CI) in mg/dL for the cholesterols, and as percentage change for triglyceride, ALP and vitamin B12.
[d]P-values adjusted for the effect of del12. This analysis was done on an updated Icelandic dataset that includes 8,453 WGS individuals and imputation into 150,656 Icelandic individuals. For none-HDL cholesterol association analysis an updated sample set was used that contained 136,261 Icelanders.

TABLE 1.9A

Correlation and conditional analysis for del12 and the seven other SNPs that show the strongest association at 17p13.1 with non-HDL cholesterol in Iceland

| | | | | | | non-HDL | | | |
|---|---|---|---|---|---|---|---|---|---|
| Variant | Pos | EA | OA | EA. freq (%) | $r^{2\,d}$ | Effect[c] | P | $P_{adjdel12}{}^a$ | $P_{adjSNP}{}^b$ |
| chr17:6930020:S | 6930020 | T | C | 0.39 | 0.85 | −0.243 | $5.2 \times 10^{-7}$ | 0.10 | 2.8E−05 |
| rs188743906 | 6931736 | T | C | 0.39 | 0.85 | −0.243 | $5.2 \times 10^{-7}$ | 0.18 | 2.9E−05 |
| rs150983647 | 6942021 | T | C | 0.44 | 0.76 | −0.232 | $5.3 \times 10^{-7}$ | 0.39 | 7.6E−05 |

TABLE 1.9A-continued

Correlation and conditional analysis for del12 and the seven other SNPs that show the strongest association at 17p13.1 with non-HDL cholesterol in Iceland

| | | | | | | non-HDL | | | |
|---|---|---|---|---|---|---|---|---|---|
| Variant | Pos | EA | OA | EA. freq (%) | $r^{2\,d}$ | Effect$^c$ | P | $P_{adjdel12}{}^a$ | $P_{adjSNP}{}^b$ |
| chr17:6944653:S | 6944653 | A | G | 0.39 | 0.85 | −0.242 | $5.9 \times 10^{-7}$ | 0.10 | 2.3E−05 |
| rs146261845 | 6952978 | T | C | 0.40 | 0.75 | −0.259 | $1.1 \times 10^{-7}$ | 0.88 | 0.00053 |
| chr17:6961021:S | 6961021 | C | T | 0.39 | 0.85 | −0.250 | $2.2 \times 10^{-7}$ | 0.18 | 0.00010 |
| rs186021206 | 7010136 | A | G | 0.43 | 0.86 | −0.283 | $1.4 \times 10^{-9}$ | 0.39 | 0.067 |
| del12 | 7020979 | del12 | — | 0.41 | | −0.297 | $2.5 \times 10^{-10}$ | — | — |

$^a$P-value for correlation between the SNP and the trait, tested conditional on the association of the trait with del12.
$^b$P-value for the correlation between the trait and del12, tested conditional on the association of the trait with the SNP.
$^c$Effect estimated in units of standardized trait values.
$^d$Correlation $r^2$ between del12 and sequencing genotypes of the SNPs in 2,128 Icelandic individuals. Shown are the build 36 positions (hg18).

TABLE 1.9B

Association of del12 with Non-HDL Cholesterol, HDL Cholesterol and Triglyceride Measurements, in Iceland, Denmark and the Netherlands

| | Study population (n) | Change$^a$ ± SE | P value | Mean value$^b$ in non-carriers (SD) |
|---|---|---|---|---|
| | Non-HDL cholesterol | mg/dl | | mg/dl |
| Discovery | Iceland (119,146) | −10.4 ± 1.5 | $2.5 \times 10^{-10}$ | 156.8 (38.2) |
| Replication | The Netherlands$^c$ (5,156) | −15.4 ± 5.4 | 0.0032 | 170.7 (41.3) |
| Replication | Denmark A$^d$ (5,968) | −17.4 ± 8.1 | 0.0069 | 158.3 (42.9) |
| Replication | Denmark B$^e$ (8,822) | −21.6 ± 5.4 | $3.8 \times 10^{-5}$ | 164.5 (40.5) |
| | Combined | −11.6 ± 1.5 | $1.0 \times 10^{-16}$ | |
| | HDL cholesterol | mg/dl | | mg/dl |
| Discovery | Iceland (119,514) | 0 ± 0.4 | 0.0058 | 55.2 (15.8) |
| Replication | The Netherlands (5,537) | 2.7 ± 1.5 | 0.20 | 52.2 (13.1) |
| Replication | Denmark A (6,182) | 1.2 ± 2.7 | 0.096 | 55.2 (15.4) |
| Replication | Denmark B (9,656) | 1.5 ± 1.2 | 0.26 | 59.9 (16.2) |
| | Combined | 0 ± 0.4 | 0.00039 | |
| | Triglyceride-mg/dl | mg/dl | | mg/dl |
| Discovery | Iceland (80,011) | −1.2 ± 1.5 | 0.012 | 130.9 (75.2) |
| Replication | The Netherlands (5,537) | −0.4 ± 5.8 | 0.52 | 176.9 (121.2) |
| Replication | Denmark A (6,182) | 8.1 ± 6.9 | 0.53 | 116.8 (84.0) |
| Replication | Denmark B (8,163) | −3.5 ± 2.3 | 0.15 | 131.8 (118.5) |
| | Combined | −1.5 ± 1.2 | 0.0030 | |

$^a$Effect size, ± standard error, represents the difference in mean values between heterozygote carriers and non-carriers of the variants after adjusting for age, sex and, for Iceland, site and statin use.
$^b$Calculated based on unadjusted values.
$^c$The Nijmegen Biomedical Study (Wetzels et al. 2007).
$^d$The Danish Inter99 study (Jørgensen et al. 2003).
$^e$The Danish Addition study (Lauritzen et al. 2000).
To convert the values for non-HDL cholesterol to millimoles per liter, multiply by 0.02586

TABLE 1.10

Association of del12 with Alkaline Phosphatase and Vitamin B12 Serum Measurements in Iceland and Denmark

| | Study population (n) | Change$^a$ ± SE | P value | Mean value$^b$ in non-carriers (SD) |
|---|---|---|---|---|
| | ALP | U/L | | U/L |
| Discovery | Iceland (126,060) | +33.6 ± 2.8 | $3.6 \times 10^{-63}$ | 92.8 (64.0) |
| Replication | Denmark A (5,829) | +15.8 ± 2.6 | $1.7 \times 10^{-6}$ | 42.9 (13.5) |
| | Combined | +24.1 ± 1.9 | $9.9 \times 10^{-69}$ | |

TABLE 1.10-continued

Association of del12 with Alkaline Phosphatase and
Vitamin B12 Serum Measurements in Iceland and Denmark

| | Study population (n) | Change[a] ± SE | P value | Mean value[b] in non-carriers (SD) |
|---|---|---|---|---|
| | Vitamin B12 | pmol/L | | pmol/L |
| Discovery | Iceland (97,910) | +58.4 ± 8.3 | $3.1 \times 10^{-12}$ | 439.0 (171.0) |
| Replication | Denmark A (5,826) | +75.9 ± 29.2 | 0.0069 | 420.0 (146.0) |
| | Combined | +59.7 ± 7.9 | $9.9 \times 10^{-14}$ | |

[a]Effect size, ± standard error, represents the difference in mean values between heterozygote carriers and non-carriers of the variants after adjusting for age, sex and, for Iceland, site and statin use.
[b]Calculated based on unadjusted values.
[c]The Nijmegen Biomedical Study (Wetzels et al. 2007).
[d]The Danish Inter99 study (Jørgensen et al. 2003).
[e]The Danish Addition study (Lauritzen et al. 2000).
To convert the values for non-HDL cholesterol to millimoles per liter, multiply by 0.02586

Example 2—ALP Data from ASGR-1 Knockout Mice

ASGR-1 KO mice (strain B6.129S4-ASGR-1[tm1Sau]/SaubJxmJ) were obtained from Jackson Labs and maintained on a chow diet. Serum was collected from male and female animals after a 4 hr fast and tested in an Olympus AU640 Clinical Chemistry Analyzer. Compared to wild-type mice, serum ALP is elevated in ASGR-1 knockout mice (*, $p<0.05$; ****, $p<0.0001$, one-way ANOVA with Dunnett test). Levels of alanine transaminase (ALT) and aspartate transaminase (AST) were not significantly different between the groups. These data are summarized in FIG. 7 herein. WT=wild-type; HE=heterozygous; HO=homozygous.

Example 3—RNAi

Material and Methods
siRNA Constructs

TABLE 3.1

| Vendor | Vendor catalog# | Primary Gene Target | Target Sequence | SEQ ID NO: | matched control | SEQ ID NO: |
|---|---|---|---|---|---|---|
| Fisher/Ambion | S1662 | hASGR-1 | ACUUCACAGCGAGCACGGA | 32614 | ACUUCACACGCAGCACGGA | 32632 |
| GE/Dharmacon | D-011215-01 | hASGR-2 | GCCAAGGACUUUCAAGAUA | 32615 | GCCAAGGAGAAUCAAGAUA | 32633 |
| GE/Dharmacon | D-011215-03 | hASGR-2 | UGACGGAGGUCCAGGCAAU | 32616 | UGACGGAGCAGCAGGCAAU | 32634 |
| GE/Dharmacon | D-011215-04 | hASGR-2 | AGUGAUGGCUCUUGGAAAU | 32617 | AGUGAUGGGAGUUGGAAAU | 32635 |
| Fisher/Ambion | S1665 | hASGR-2 | GACUAUAGGCACAACUACA | 32618 | GACUAUAGCGUCAACUACA | 32636 |
| Fisher/Ambion | S194296 | hASGR-2 | CUGUGUGACUGGGUCCCAA | 32619 | CUGUGUGAGACGGUCCCAA | 32637 |
| Fisher/Ambion | S194297 | hASGR-2 | CACCUCUGGCUAACCCAUA | 32620 | CACCUCUGCGAAACCCAUA | 32638 |
| GE/Dharmacon | D-042958-01 | mASGR-1 | GAGACAGGCUUCCAGAAUU | 32621 | GAGACAGGGAACCAGAAUU | 32639 |
| GE/Dharmacon | D-042958-04 | mASGR-1 | UGAAGUUAGUGGAGUCGAA | 32622 | UGAAGUUACACGAGUCGAA | 32640 |
| Fisher/Ambion | S62656 | mASGR-1 | AGAUCACUCCAGUUUGCUA | 32623 | AGAUCACUGGUGUUUGCUA | 32641 |
| Qiagen | S102735796 | mASGR-1 | CCAUCAUGACAAAGGAUUA | 32624 | CCAUCAUGUGUAAGGAUUA | 32642 |
| GE/Dharmacon | D-061966-01 | mASGR-2 | GGAUGGAACUGAUUAUAGA | 32625 | GGAUGGAAGACAUUAUAGA | 32643 |
| GE/Dharmacon | D-061966-02 | mASGR-2 | GGAAUGGGCCUUCACUCA | 32626 | GGAAUGGCGGUUCACUCA | 32644 |

TABLE 3.1-continued

| Vendor | Vendor catalog# | Primary Gene Target | Target Sequence | SEQ ID NO: | matched control | SEQ ID NO: |
|---|---|---|---|---|---|---|
| GE/Dharmacon | D-061966-03 | mASGR-2 | GACGGAACAUC ACCCACUA | 32627 | GACGGAACUAG ACCCACUA | 32645 |
| GE/Dharmacon | D-061966-04 | mASGR-2 | GGAUAGGUCUU ACCGACAG | 32628 | GGAUAGGUGAA ACCGACAG | 32646 |
| GE/Dharmacon | S62659 | mASGR-2 | GCAGGAUCCU AGGAUAGAA | 32629 | GCAGGAUCGAU GGAUAGAA | 32647 |
| Fisher/Ambion | S62660 | mASGR-2 | ACAUUGCUCU UUCACCUGA | 32630 | ACAUUGCUGAA UCACCUGA | 32648 |
| Fisher/Ambion | S62661 | mASGR-2 | GAAGAGUUUC GGACCCUGA | 32631 | GAAGAGUUAGC GACCCUGA | 32649 |

Expression Analysis

RNA was isolated from the HepG2, CHOs stable cell lines, or liver tissues treated with scrambled siRNA, matched control siRNA or siRNAs against hASGR-1, hASGR-2, mASGR-1 or mASGR-2 using the Qiacube and standard Qiagen RNA isolation protocol. The RNA was DNase treated using the RQ1 DNase kit (Promega). Quantitative PCR was performed according to the manufacturer's protocol on the Quantstudio 7 using the indicated primer probe set (hASGR-1: Hs01005019_ml; hASGR-2: Hs00910102_ml; mASGR-1: Mm01245581_ml, mASGR-2:Mm00431863_ml) from Applied Biosystems. 50 ng RNA/well was used and normalized with 18S internal control.

siRNA Transfection

Cells were transfected with 10 nM indicated scrambled siRNA, matched control siRNA or siRNAs against hASGR-1, hASGR-2, mASGR-1 or mASGR-2 siRNA for 3-4 days, using Lipofectamine RNAIMAX (Thermo Scientific) following manufacturer's RNAi reverse transfection protocol. Transfection was done in 96 well Screenstar microplates (Greiner bio-one) for internalization assay as well as in 96 well clear tissue culture plates (Corning) for QPCR and Western blotting.

Western Blotting

Cells were lysed in RIPA buffer containing inhibitors 3-4 days after siRNA transfection. Cell lysates were passed through a 21 gauge syringe five times and then centrifuged at 13000 rpm at 4° C. for 15 mins. Supernatants were collected and protein concentrations were determined. If needed, 30 ug of protein was deglycosylated using the deglycosylation kit (Genzyme). 10 ug-30 ug of total protein was loaded in each well. The gel was transferred onto a nitrocellulose membrane and the membrane was blocked with 5% blocking buffer for 1 hr at RT. Membrane was then probed with anti-mASGR-1 (1:1000, R &D), hASGR-1 (1:1000, ProteinTech), hASGR-2 (1:1000, Abcam), anti-flag (1:5000, Sigma), anti-his (1:1000, Cell signaling) and mouse anti β-actin (1:5000, Thermo Fisher or Cell signaling) o/n at 4° C. The membrane was further probed with anti-mouse and anti-rat secondary antibodies to detection the indicated bands.

Ligand Internalization Assay

CHO stable cell lines were treated with scrambled siRNA, matched control siRNA or siRNAs against hASGR-1, hASGR-2, mASGR-1 or mASGR-2 siRNA for 3-4 days and plated in 96-well plate. Biotin-GalNAc-PAA was incubated and streptavidin-Alexa488 was further added to cells. Draq5 was used to counterstain cells (for both cytoplasm and nuclei). Cells were scanned with Operetta Image System and data analyzed by Columbus.

Animal Study

All animal housing conditions and research protocols were approved by the Amgen Institutional Animal Care and Use Committee (IACUC). Mice were housed in a specified-pathogen free, AAALAC, Intl-accredited facility in ventilated microisolators. Procedures and housing rooms are positively pressured and regulated on a 12:12 dark:light cycle. All animals received reverse-osmosis purified water ad libitum via an automatic watering system. 10-12 week old C57BL/6J animals (The Jackson Laboratory) were singly housed and were fed standard chow (2020x Teklad global soy protein-free extruded rodent diet; Harlan).

siRNAs modified for in vivo studies were formulated with Invivofectamine 3.0 (Thermo Scientific) following the manufacturer's protocol. In brief, siRNAs were pre-mixed with complex buffer (provided by manufacturer) and Invivofectamine 3.0, and then incubated at 50° C. for 30 minute and further diluted by PBS before injection.

Mice were i.v. injected with buffer, indicated siRNA and matched control siRNA at 1-2 mg/kg body weight in 0.25 ml buffer at indicated time. Liver total RNA from harvested animals was processed for qPCR analysis.

Data from these studies is provided in FIGS. 8-17 herein.

Example 4—Y272C Mutant Data

Stable pools of Chinese hamster ovary (CHO) cells expressing C-terminal FLAG epitope-tagged murine wild-type or Y272C ASGR-1 were generated by established methods using puromycin selection. Cell surface expression of ASGR-1 was confirmed by FACS using anti-FLAG antibody both during selection process and at the time of the experiment. Ligand binding was assessed by FACS using β-GalNAc-PAA-biotin (Glycotech Corporation) and streptavidin-phycoerythrin (PE). Briefly, ligand was added to 100 ul cells (1×10$^6$ cells) in Dulbecco's Modified Eagle Medium (DMEM) without phenol red plus 2% bovine serum albumin (BSA) and incubated on ice for 60 minutes. Cells were then washed 3× with DMEM without phenol red plus 2% BSA. Streptavidin-PE was then added at 1 μg/ml for 20 minutes on ice followed by 3 more washes in DMEM without phenol red plus 2% BSA, at which point the cells were resuspended in 0.5 ml DMEM without phenol red plus 2% BSA and 5 ul of 0.1 mM SyTOx Blue viability dye and analyzed on a BD LSR II (BD Biosciences). Data are presented as Median Fluorescence Intensity as shown in Table 4.1, below.

TABLE 4.1

ASGR-1 Y272C has reduced ligand binding compared to wild-type ASGR-1

| | β-GalNAc-PAA-biotin, ug/ml | | | Anti-FLAG antibody |
|---|---|---|---|---|
| | 0 | 0.1 | 0.3 | |
| Parental | 5.23 | 5.52 | 5.57 | 7.3 |
| WT | 4.87 | 763.51 | 1394.86 | 3959.65 |
| Y272C | 5.28 | 5.47 | 6.10 | 973.38 |

Example 5—Generation of Antibodies

Molecular Cloning of ASGR-1 and ASGR-2 Sequences

For production of recombinant ASGR-1 and ASGR-2 vectors, cDNA sequences were synthesized, obtained from a commercial source or compiled from RNA sequencing data (Amgen). Human, mouse and rat ASGR cDNA clones were from obtained commercially (OriGene Technologies, Inc.). All other ASGR cDNAs were synthesized (Integrated DNA Technologies, Inc.). GenBank accession numbers are as follows: human ASGR-1 (NM_001671.4), human ASGR-2 (NM_080913.3), mouse ASGR-1 (BC022106.1), mouse ASGR-2 (BC011197.1), rat ASGR-1 (NM_012503), rat ASGR-2 (NM_017189), pig ASGR-1 (NM_001244458), pig ASGR-2 (XM_005669199), dog ASGR-1 (XM_546579), dog ASGR-2 (XM_003434599), cynomologus monkey ASGR-1 (XP_005582755). Since the NCBI entry for cynomologus ASGR-2 was a partial amino acid sequence (NCBI protein accession # EHH57653), the complete nucleotide sequence was compiled through the analysis of the cyno genome (genome build Macaca_fascicularis_5.0; GenBank accession number GCA_000364345.1; Washington University) and RNA sequencing data (Amgen) from cyno liver, heart and skin tissue. For transient or stable mammalian expression, cDNAs were cloned into pTT5 (National Research Council of Canada), pSLX235a (SureTech) or pJiF1 (Boyce Lab, Massachusetts General Hospital, U.S. Pat. No. 7,192,933). For individual recombinant protein production in mammalian cells, most sequences were tagged at their C-termini with a 6xHis purification tag. For complexes of huASGR-1 and huASGR-2, huASGR-2 was expressed without the 6xHis tag. For recombinant expression in E. coli, sequences were cloned into pET21a (Novagen, EMD Millipore). The amino acid sequences of the resultant ASGR proteins are shown in Table 1.

Expression and Purification of Recombinant Proteins

Generation of Stable CHO—S Cell Pools for Recombinant Protein Expression

CHO—S(Invitrogen, Carlsbad, Calif.) cells were transfected with the pSLX235a vector encoding ASGR-1 or ASGR-2 using Lipofectamine LTX according to the manufacturer's recommendations (ThermoFisher Scientific). Stable pools were selected using 10 ug/ml puromycin (single selections) or 10 ug/ml puromycin and 400 ug/ml hygromycin (double selections) and by culturing the cells in fresh media every 2 days. Stable pools were then used for recombinant protein production.

Recombinant Protein Production and Purification from CHO—S Cell Stable Pools

Cells from the selected stable pools were expanded in growth medium. When sufficient cell numbers had been obtained, cultures were seeded in 2 L conical flasks in a volume of 1 L of growth medium at a viable cell density of $8 \times 10^5$ cells/ml. Cells were then cultured in suspension at 37° C., in 5% $CO_2$ for three days, after which the temperature was dropped to 31° C. for the final 7 days of production. Centrifugation was used to pellet the cells, and the resulting supernatant was filtered to generate conditioned medium.

Individual recombinant proteins were purified via the 6xHis tag using Ni-Excel resin (GE Healthcare). Briefly, 1.4 L of conditioned medium was loaded onto 3×5 ml Ni-Excel Hi-trap columns and then washed with 10 column volumes of wash buffer (25 mM HEPES, pH7.6, 250 mM NaCl, 1 mM $CaCl_2$, 50 mM imidazole). Protein was eluted from the columns with 7 column volumes of elution buffer (25 mM HEPES, pH7.6, 250 mM NaCl, 1 mM $CaCl_2$, 400 mM imidazole). The eluted fractions were loaded onto a HiLoad Superdex 200 column via 2×10 ml injections and eluted with 25 mM HEPES, pH 7.6; 150 mM NaCl, 1 mM $CaCl_2$. The final fractions were collected based on their expected molecular weight. The identity of the proteins in each eluted peak was confirmed by LC-TOF-MS after deglycosylation (with N-glycanase, O-glycanase and sialidase) and reduction. ASGR-1/ASGR-2 complexes were purified by preincubating the ASGR-1-6xHis Tag conditioned medium with ASGR-2-no 6xHis Tag conditioned medium. These conditions permitted association of both proteins giving a complex that could be purified via the standard two-step Ni-Excel/SEC method.

Recombinant Protein Production and Purification from E. coli

E. coli codon optimized sequences were cloned into the pET21a expression plasmid. Plasmids were transformed into E. coli strain BL21(DE3) Star (ThermoFisher Scientific Inc.) and individual clones were selected using carbenicillin. For expression, cells were grown in 1 L TB growth medium (supplemented with carbenicillin) in a 4 L flask at 37° C. with shaking. When an optical density of 2 was achieved, protein expression was induced by the addition of 1 mM IPTG (final concentration). After 4 hours of induction at 37° C., the cell paste was harvested by centrifugation (recovering between 7 and 14 g cell paste/L culture). Protein localization into the insoluble fraction was confirmed by SDS-PAGE.

Inclusion bodies were recovered from the cell paste and solubilized in 6M guanidinium containing 10 mM DTT. Successful protein refolding was established by screening a matrix of 32 conditions that included a variety of buffers, pHs, denaturants, stabilizing agents and reducing agents. The refolding procedure was initiated by rapidly diluting the dissolved inclusion bodies at a ratio of 1:15 into the appropriate refold buffer, maintaining approximately 1 mg of protein per condition. The samples were then incubated at 4° C. for 60 hours. The resulting batches were analysed by SDS-PAGE and Ion Exchange chromatography to identify the optimal refolding conditions. For the ASGR-1 CBD (148-291), the final refold conditions were: pH 9.5, 2.5M urea, 20% glycerol, 4 mM cysteine and 4 mM cystamine.

Generation of Anti-ASGR Immune Responses

Mouse Strains

Fully human antibodies to human ASGR were generated by immunizing XENOMOUSE® transgenic mice (U.S. Pat. Nos. 6,114,598; 6,162,963; 6,833,268; 7,049,426; 7,064,244, which are incorporated herein by references in their entirety; Green et al., 1994, Nature Genetics 7:13-21; Mendez et al., 1997, Nature Genetics 15:146-156; Green and Jakobovitis, 1998, *J. Ex. Med,* 188:483-495; Kellerman and Green, *Current Opinion in Biotechnology* 13, 593-597, 2002). Animals from the XMG2-K, XMG2-KL, XMG4-K and XMG4-KL XENOMOUSE® strains were used for all immunizations.

Mouse anti-human ASGR antibodies were generated by immunizing BALB/c, C57BL/6 and CD-1 mice (Charles River Laboratories, San Diego, Calif.) as well as B6.12954-ASGR-1$^{tm1Sau}$/SaubJxmJ (ASGR-1 KO mice) and C57BL6×129 F1 mice (Jackson Laboratory, Sacramento, Calif.).

Fully human, heavy chain only antibodies (HCAbs) were generated by immunizing the VH4 and 8V3 strains of transgenic Harbour mice (Janssens et al. 2006, PNAS 103: 15130-15135; Harbour Biologics, Rotterdam, Netherlands). Rat anti-mouse ASGR antibodies were generated using Brown Norway Rats (Charles River Laboratories, San Diego, Calif.).

Immunizations

Multiple immunogens and routes of immunization were used to generate anti-human ASGR immune responses. For genetic immunizations, mice were immunized 12-14 times over 6-8 weeks using the Helios Gene Gun system according to the manufacturer's instructions (BioRad, Hercules, Calif.). Briefly, expression vectors encoding wild type human or mouse ASGR-1 (or both huASGR-1+huASGR-2, muASGR-1+muASGR-2) were coated onto gold beads (BioRad, Hercules, Calif.) and delivered to the epidermis of a shaved mouse or rat abdomen. For cell-based immunizations, mice and rats were immunized with CHO-s cells (Invitrogen, Carlsbad, Calif.) or 293-6E cells (National Resource Council of Canada) transiently transfected with expression vectors encoding human or mouse ASGR-1 (or both huASGR-1+huASGR-2, muASGR-1+muASGR-2). Animals were immunized with cells mixed with Alum prepared from aluminum potassium sulfate (EMD Chemicals Inc., Gibbstown, N.J.) and CpG-ODN (Eurofins MWG Operon LLC, Huntsville, Ala.) 10 times over 6 weeks using a protocol that alternated between sub-cutaneous and intra-peritoneal injections. The initial boost was comprised of 4×10$^6$ cells while subsequent boosts contained 2×10$^6$ cells. For soluble protein immunizations, mice were immunized with a variety of human ASGR recombinant proteins representing the complete extracellular domain (ECD), the carbohydrate binding domain (CBD) or the complex of ASGR-1 and ASGR-2 ECDs (Table 5.1). Animals were immunized with recombinant protein (or recombinant protein conjugated to KLH using standard methods) mixed with Alum and CpG-ODN, Complete Freund's Adjuvant (Sigma), or MPL+ Adjuvant (Sigma) 10 times over 4-6 weeks using sub-cutaneous injections. The initial boost was comprised of 10 µg while subsequent boosts contained 5-10 µg. Human ASGR-1-specific serum titers were monitored by live-cell FACS analysis on an Accuri flow cytometer (BD Biosciences). Animals with the highest antigen-specific serum titers were sacrificed and used for hybridoma generation (Kohler and Milstein, 1975).

TABLE 5.1

Soluble, Recombinant Protein Antigens Used for Immunizations

| Recombinant Protein Immunogen | Source |
| --- | --- |
| huASGR-1 (Cat#: C428) ECD-KLH conjugate | Novoprotein |
| huASGR-1 (64-291) ECD-KLH conjugate | Amgen |
| huASGR-1 (64-291) ECD | Amgen |
| huASGR-1 (154-291) CBD | Amgen |
| huASGR-1(64-291)/huASGR-2 (61-287) ECD Complex | Amgen |
| huASGR-1(64-291)/huASGR-2 (61-287) ECD Complex-KLH conjugate | Amgen |
| muASGR-1 (63-284) | Amgen |

Preparation of Monoclonal Antibodies

Hybridoma Generation

Animals exhibiting suitable serum titers were identified and lymphocytes were obtained from spleen and/or draining lymphnodes. Pooled lymphocytes (from each immunization cohort) were dissociated from lymphoid tissue by grinding in a suitable medium (for example, Dulbecco's Modified Eagle Medium (DMEM); Invitrogen, Carlsbad, Calif.). B cells were selected and/or expanded using standard methods, and fused with a suitable fusion partner using techniques that were known in the art.

Antigen Enrichment of Hybridoma Pools

Fused hybridoma pools from each immune tissue harvest were used as a source of material for FACS-based enrichments using a variety of probes. To enrich for hybridomas expressing antibodies specific to native (full length, on-cell) human, cyno, mouse, rat, dog, or pig ASGR-1 (and native human ASGR-2) membranes were prepared from 293T cells transiently expressing the relevant ASGR cDNA construct. 24 hours after transfection using 293-fectin (ThermoFisher Scientific Inc.), cells were biotinylated with E-Z link NHS-LC-LC-Biotin according to the manufacturer's recommendation (ThermoFisher Scientific Inc.). After biotinylation, cells were homogenized with a needle and syringe to form membrane fragments and referred to as "membrane preps". The biotinylated membrane preps were then used to detect hybridomas expressing surface antibodies specific to the target of interest via standard biotin-streptavidin chemistry. To enrich for hybridomas capable of binding to the recombinant ASGR-1 ECD or CBD, soluble, 6xHis-tagged ASGR-1 proteins were used (Amgen).

To enrich hybridoma pools for the antigen of interest, they were first incubated with the appropriate membrane prep or soluble probe. For soluble forms of ASGR-1, the recombinant protein probes were added to the hybridomas and allowed to bind. Excess probe was then washed away and the antigen-specific hybridomas were identified by simultaneous detection of surface IgG (with an Alexa 488 conjugated secondary antibody (Jackson ImmunoResearch) (Gt anti-mouse Fc for wild type mouse hybridomas and Gt anti-human Fc for transgenic mouse hybridomas)) and the soluble ASGR-1 probe via its 6xHis tag (using an Amgen-derived anti-6xHis monoclonal antibody conjugated to Alexa 647 via an Alexa 647 labeling kit (ThermoFisher Scientific Inc). Hybridomas expressing surface IgG and binding antigen were detected by FACS analysis on an Accuri flow cytometer. Dual positive events were sorted as single cells into 384-well plates on a FACS Aria cell sorter (BD Biosciences). For native forms of ASGR-1, biotinylated membrane preps were prepared as described from 293T cells transiently expressing the appropriate antigen. After washing away unbound probe, dual positive hybridomas expressing cell surface IgG and binding antigen were detected using an Alexa 488 conjugated secondary antibody (to detect IgG) and streptavidin conjugated to Alexa 647 (Jackson ImmunoResearch) to detect antigen. These events were sorted as single cells into 384-well plates on a FACS Aria cell sorter. After several days of culture, the hybridoma supernatants containing monoclonal antibodies were collected and used in the screening assays described in the examples below.

Example 6: Identification of ASGR-1 Specific Antibodies

The following Table 6.1 summarizes the approximate numbers of antibodies assayed:

TABLE 6.1

Summary of the identification and selection of huASGR-1 binding, ligand blocking antibodies.

| ASGR-1 Screen | Number of Antibodies |
| --- | --- |
| huASGR-1 Binders | 15731 |
| huASGR-1-Ligand Blockers (>60%) | 5306 |
| Sequences Unique huASGR-1-Ligand Blockers | 2603 (disclosed in Table 3) |
| huASGR-1-Ligand Blockers (>50%) | 172 (disclosed in Table 3) |

Example 6-A: Initial Selection of ASGR-1 Specific Binding Antibodies

Hybridoma supernatants (monoclonal antibodies) were screened for binding to human ASGR-1 transiently expressed on Human Embryonic Kidney (HEK) 293 cells using the Cell Insight™ High Content Imaging Platform (ThermoFisher Scientific). Human ASGR-1 was transiently expressed on host HEK 293 cells by transfection using human ASGR-1 DNA, Gibco™ Opti-MEM® media and 293Fectin™ reagents following the protocol set out by the manufacturer. Transfected HEK 293 cells expressing the human ASGR-1, hybridoma supernatant or control samples, Alexa Fluor® 488 IgG Fc fragment-specific detection antibody and Hoechst 33342 stain were mixed and incubated for 3 hours at room temperature. Samples were then washed and analyzed on the CellInsight™ system. Supernatants were counter-screened against HEK 293 cells transfected with empty parental vector (referred to as mock). Analysis was done using irrelevant IgG antibody supernatant sample signal; hybridoma supernatant samples showing two times or greater signal over irrelevant IgG antibody sample were considered to be exhibiting ASGR-1-specific binding profiles and selected for further characterization. See Table 6.1.

Example 6-B: Identification of ASGR-1 Receptor-Ligand Blocking Antibodies

ASGR-1-binding hybridoma supernatants were tested for their ability to block ASGR-1 from binding ligand. Competitive binding assays were performed on the antigen specific hybridoma supernatant samples using FACS on either HEK 293 cells transiently expressing human ASGR-1 or CHO—S cells stably expressing Human ASGR-1 as follows. HEK 293 cells or CHO—S cells expressing human ASGR-1 were mixed with the antibody sample (hybridoma supernatants specific for ASGR-1) and incubated for 1 hour at 4° C., and then washed twice. Cells with bound sample were then incubated with precomplexed β-GalNAc-PAA-Biotin (GlycoTech, Gaithersburg, Md.)/Alexa Fluor® 647-Streptavidin for 45 minutes at 4° C. The concentration of β-GalNAc-PAA-Biotin was used at the binding EC50 concentration on the specific cell line. The concentration of Alexa Fluor® 647 Streptavidin was used at a 2:1 molar ratio to β-GalNAc-PAA-Biotin. The 7-AAD cell viability stain was then added and the cells incubated for a further 15 minutes at 4° C., washed twice and resuspended in FACS buffer. Where tolerated by cell viability, FACS buffer supplemented with 1 mM Calcium Chloride was used in all steps. Samples were analyzed using a BD Accuri™ Flow Cytometer and an Intellicyt HyperCyt Autosampler. Analysis was done using irrelevant (non-ASGR-1 specific) IgG antibody supernatant control signal on both mock transfected HEK 293 cells and Human ASGR-1 transfected HEK 293 cells to determine maximum and minimum β-GalNAc-PAA-Biotin binding signal. Using these maximum and minimum binding signals, the % β-GalNAc-PAA-Biotin binding inhibition was determined. ASGR-1 antibodies having the ability to reduce ligand binding ≥60% were identified (Table 6.1), and sequenced using methods available to those skilled in the art. The sequences of unique ASGR-1-specific, ligand blocking antibodies are displayed in Table 2-7 herein.

The unique ASGR-1-specific, ligand blocking antibodies were then tested for their ability to block the GalNAc ligand under more stringent conditions using a single, known antibody concentration (5 ug/ml). The receptor-ligand blocking assays were performed using 293T cells transiently expressing ASGR-1 or CHOs cells that had been stably transfected with ASGR-1. ASGR-1 antibodies having the ability to reduce ligand binding >50% were identified. See Table 6.1.

Example 7: Antibody Characterization Assays

A. ASGR-1 Species Cross Reactivity, ASGR-2 Selectivity Assays and Hepatoma (HEPG2) Binding Assays Human ASGR-1-specific, ligand competing antibody samples were tested for binding to ASGR-1 from other species (cynomologus monkey ASGR-1, mouse ASGR-1, rat ASGR-1, dog ASGR-1, and pig ASGR-1) as well as to human ASGR-2 in FACS binding assays at normalized antibody concentrations. For cell-based assays, HEK 293 cells expressing the appropriate antigen of interest were mixed with antibody sample or controls, incubated for 1 hour at 4° C., and then washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. As a negative control, supernatants and controls were also screened against HEK 293 cells transfected with empty parental vector. Analysis was done using irrelevant (non-ASGR-1 specific) IgG antibody supernatant sample signal; hybridoma supernatant samples showing at least two times the signal over irrelevant IgG antibody sample were considered to be exhibiting ASGR-1-species specific binding profiles. For membrane-prep binding assays, ASGR-1 species specific membrane preps were used to coat LumAvidin® microspheres (beads) and tested for binding to selected hybridoma supernatants or controls. Briefly, ASGR-1 species specific membrane preps were incubated with streptavidin-coated LumAvidin® beads for 45 minutes in the dark at room temperature and washed twice. Beads were resuspeneded in FACS buffer containing StabilGuard®. Antigen-bound beads were then incubated with normalized antibody sample for 1 hour in the dark at room temperature, washed twice, incubated with Alexa Fluor® 488 IgG Fc fragment-specific detection antibody for 15 minutes in the dark at room temperature, washed once and finally resuspended in FACS buffer. Samples were analyzed using an Intellicyt iQue™ Screener Platform. FACS buffer supplemented with 1 mM Calcium Chloride was used in all steps. As a negative control, supernatants and controls were also screened against a non-ASGR-1 antigen membrane prep coated on the LumAvidin® beads. Analysis was done using irrelevant (non-ASGR-1 specific) IgG antibody supernatant sample signal; hybridoma supernatant samples showing two times or greater signal over irrelevant IgG antibody sample were considered to be exhibiting HepG2 ASGR-1 specific binding profiles. See Table 7.1.

TABLE 7.1

Summary of the binding specificities of the selected human ASGR-1 binding antibodies.

Binding Data Summary

| mAh | Human ASGR-1 | Cyno ASGR-1 | Mouse ASGR-1 | Rat ASGR-1 | Dog ASGR-1 | Pig ASGR-1 | HEPG2 Cells | Human ASGR-2 |
|---|---|---|---|---|---|---|---|---|
| 25A4 | Y | Y | N | Y | N | Y | Y | N |
| 26C4 | Y | Y | N | Y | N | Y | Y | N |
| 29H8 | Y | Y | N | Y | N | Y | Y | N |
| 4A2 | Y | Y | N | Y | N | Y | Y | N |
| 4H6 | Y | Y | Y | Y | N | Y | Y | N |
| 56E5 | Y | Y | N | N | N | Y | Y | N |
| 7F4 | Y | Y | N | no data | Y | Y | Y | Y |
| 7G4 | Y | Y | N | N | N | Y | Y | N |
| 48B12 | Y | Y | N | N | N | Y | Y | N |
| 184E7 | Y | Y | Y | Y | Y | Y | Y | N |
| 194A4 | Y | Y | N | Y | Y | Y | Y | N |
| 4B1 | Y | Y | Y | Y | Y | Y | Y | N |
| 72G9 | Y | Y | Y | Y | Y | Y | Y | N |
| 190F8 | Y | Y | N | N | Y | Y | Y | N |
| 191G1 | Y | Y | N | N | Y | Y | Y | N |
| 191G10 | Y | Y | N | N | Y | Y | Y | N |
| 194C1 | Y | Y | N | N | Y | Y | Y | N |
| 197G3 | Y | Y | N | N | Y | Y | Y | N |
| 198G3 | Y | Y | N | N | Y | Y | Y | N |
| 75G3 | Y | Y | N | N | Y | Y | Y | N |
| 218G4 | Y | Y | N | N | Y | Y | Y | N |
| 193E7 | Y | Y | N | N | Y | N | Y | N |
| 198D2 | Y | Y | N | Y | N | Y | Y | N |
| 202A3 | Y | Y | N | N | Y | Y | Y | N |
| 7E11 | Y | Y | N | N | N | Y | Y | N |
| 22G5 | Y | Y | N | N | N | N | Y | N |
| 5E5 | Y | Y | N | Y | N | N | Y | N |
| 54E9 | Y | Y | N | N | Y | N | Y | N |
| 6G7 | Y | Y | N | Y | N | N | Y | Y |
| 176H4 | Y | Y | N | N | Y | Y | Y | N |
| 194C10 | Y | Y | N | N | Y | Y | Y | N |
| 12D2 | Y | Y | Y | Y | Y | Y | Y | N | was done using irrelevant (non-ASGR-1 specific) IgG antibody supernatant sample signal; hybridoma supernatant samples showing at least two times the signal over irrelevant IgG antibody sample were considered to be exhibiting specific binding profiles. See Table 7.1.

Human ASGR-1-specific, ligand competing hybridoma supernatant samples were screened for binding to the human hepatocellular carcinoma cell line HepG2 (ATCC HB-8065) at normalized antibody concentrations. For FACS binding assays, HepG2 cells were mixed with normalized antibody samples or controls, incubated for 1 hour at 4° C., and washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. For high content imaging binding assays, HepG2 cells were mixed with normalized antibody samples or controls, incubated for 1 hour at room temperature and washed twice. Cells with bound antibody were then incubated with Alexa Fluor® 488 IgG Fc fragment-specific detection antibody and Hoechst 33342 stain for 30 minutes at room temperature, washed twice and analyzed on the CellInsight™ system. Where tolerated by cell viability, FACS buffer supplemented with 1 mM Calcium Chloride was used in all steps. Analysis was done using irrelevant (non-ASGR-1 specific) IgG antibody supernatant sample signal; hybridoma supernatant samples showing two times or greater signal over irrelevant IgG antibody sample were considered to be exhibiting HepG2 ASGR-1 specific binding profiles. See Table 7.1.

B. Relative Binding Affinities for ASGR-Specific mAbs

To assess antibody and antigen interaction strength (relative binding affinity), ASGR-1 specific, ligand competing antibody hybridoma supernatants were tested in a limiting antigen binding assay. Titrated amounts of recombinant, soluble ASGR-1 biotinylated protein was incubated with streptavidin-coated LumAvidin Beads® for 45 minutes in the dark at room temperature and washed twice. Beads were resuspeneded in FACS buffer containing StabilGuard® and 0.05% Sodium Azide. Antigen-bound beads were then incubated with normalized hybridoma supernatant sample or controls for 18 hours in the dark at room temperature, washed twice, incubated with Alexa Fluor® 488 IgG fragment-specific detection antibody for 15 minutes in the dark at room temperature, washed once and finally resuspended in FACS buffer. Samples were analyzed using an Intellicyt iQue™ Screener Platform. FACS buffer supplemented with 1 mM Calcium Chloride was used in all steps. Analysis was done using irrelevant (non-ASGR-1 specific) IgG antibody supernatant sample signal; hybridoma supernatant samples showing at least two times or greater signal over irrelevant IgG antibody sample were considered to be exhibiting ASGR-1 specific binding profiles. In this assay method, the antibody binding signal correlates with antibody affinity.

Antibody binding data for a representative antigen coating concentration that fell in the linear range of the instrument signal detection is shown in Table 7.2. The degree of antibody binding to the target (ASGR-1) correlates with the measured fluorescent intensity and thus allows a relative comparison of affinities across the panel.

TABLE 7.2

Limited Antigen Binding Assay to Assess Relative Affinities of selected mAbs

| mAb | Soluble ASGR-1 2.5 ng/mL (FACS Geomean) | mAb | Soluble ASGR-1 2.5 ng/mL (FACS Geomean) | mAb | Soluble ASGR-1 2.5 ng/mL (FACS Geomean) | mAb | Soluble ASGR-1 2.5 ng/mL (FACS Geomean) |
|---|---|---|---|---|---|---|---|
| 25A4 | 17952 | 48B12 | 26989 | 194C1 | 16937 | 7E11 | 4662 |
| 26C4 | 12007 | 184E7 | 40198 | 197G3 | 17708 | 22G5 | 1078 |
| 29H8 | 12179 | 194A4 | 38934 | 198G3 | 25969 | 5E5 | 3278 |
| 4A2 | 16604 | 4B1 | 10060 | 75G3 | 35840 | 54E9 | 6487 |
| 4H6 | 2990 | 72G9 | 34014 | 218G4 | 15105 | 6G7 | 2290 |
| 56E5 | 22648 | 190F8 | 13899 | 193E7 | 18315 | 176H4 | 29444 |
| 7F4 | 4910 | 191G1 | 9546 | 198D2 | 1872 | 194C10 | 21854 |
| 7G4 | 6795 | 191G10 | 24154 | 202A3 | 2152 | 12D2 | 105 |

C. pH and Calcium Sensitivity

This Example characterizes ASGR-1 antibodies based on the effect of pH and/or calcium on their ability to bind the target. For this example, a label-free, kinetic antibody-ASGR-1 binding assay was employed to assess the sensitivity of the antibodies to changes in pH and calcium. Briefly, the ASGR-1-specific, ligand-competing antibodies were first immobilized and then allowed to bind recombinant, soluble huASGR-1 under physiological conditions (ie. pH 7.4, 1 mM CaCl2). The amount of binding was determined and set to 100%. In order to determine if the antibody-ASGR-1 interaction was sensitive to changes in pH or Ca, the assay buffer was then changed to conditions lacking calcium, a reduced pH (pH 5.6) or both lacking calcium and reduced pH (pH 5.6), and dissociation of ASGR-1 from the mAbs monitored. The amount of ASGR-1 remaining bound under each condition was assessed and expressed as a percent of the starting signal. If a >10% difference in ASGR-1 binding signal was calculated (when compared to that measured under physiological conditions), a particular antibody was classified as being sensitive to that condition. Using this method, the selected antibodies were classified into 5 categories:

1. affected by the removal of calcium
2. unaffected by the removal of calcium or drop in pH
3. affected when both calcium is removed and pH is dropped
4. affected by calcium removal, pH drop and both combined
5. affected by the drop in pH The relative dissociation of ASGR-1 from antibodies was measured using a label-free assay on an OctetHTX instrument (ForteBio). Antibody samples were captured on anti-HuFc kinetic biosensors (ForteBio cat #18-5064) at 5 ug/mL in assay buffer (10 mM Tris, 0.1% Triton, 150 mM NaCl, 1 mg/mL BSA, 1 mM CaCl2, pH7.4) for three minutes. A one minute baseline stabilization step was performed in assay buffer. Soluble ASGR-1 (Amgen) at 6 ug/ml in assay buffer was added and association to the antibodies was monitored for two minutes. Subsequent dissociation of ASGR-1 from the antibodies was performed by incubating the ASGR-1-mAb complexes for 10 minutes under each of the following conditions:

| pH 7.4 + calcium | 10mM Tris, 0.1% Triton, 150 mM NaCl, 1 mg/mL BSA, pH 7.4, 1 mM CaCl2 |
| pH 7.4 − calcium | 10mM Tris, 0.1% Triton, 150 mM NaCl, 1 mg/mL BSA, pH 7.4 |

-continued

| pH 5.6 + calcium | 10mM Tris, 0.1% Triton, 150 mM NaCl, 1 mg/mL BSA, pH 5.6, 1 mM CaCl2 |
| pH 5.6 − calcium | 10mM Tris, 0.1% Triton, 150 mM NaCl, 1 mg/mL BSA, pH 5.6 |

The binding signal at the end of the 2 minute association phase for each dissociation experiment was set to 100% and used to represent the maximal level of ASGR-1 binding. After 1 minute of dissociation, the percentage of ASGR-1 remaining bound was calculated. The lower the percent remaining at a given time point indicates increased levels of dissociation in response to the test conditions (ie. different pH and/or calcium concentrations). The change in the percentage of ASGR-1 remaining bound in response to each test condition relative to the percent remaining in the control conditions (ie. pH 7.4+calcium) was determined. Cut-offs for an antibody to be categorized as being sensitive to a particular condition were set to >10% (ie. if >10% of the ASGR-1 dissociates from the antibody under a particular test condition compared to control condition, it was deemed sensitive to that condition). The analysis was done using the 1 minute dissociation time point (except for mAb 149A1 which was binned based on the 4 minute dissociation time point). Using this analysis, the ASGR-1-binding, receptor-ligand blocking antibodies were separated into groups according to their dissociation profiles in response to pH and calcium (Table 7.3). Antibodies belonging to each category were observed.

TABLE 7.3 pH and Calcium Sensitivity of ASGR-1-mAb Interactions
pH and Calcium Sensitivity Determination
(% Change Compared to pH 7.4 + Calcium)

| mAb | pH 7.4 minus Calcium | pH 5.6 plus Calcium | pH 5.6 minus Calcium | Calcium sensitive | pH sensitive | pH and calcium sensitive | pH bin |
|---|---|---|---|---|---|---|---|
| 10G6 | 7% | 4% | 15% | N | N | Y | 3 |
| 148E10 | 7% | 19% | 33% | N | Y | Y | 5 |
| 154F4 | 10% | 41% | 67% | N | Y | Y | 5 |
| 159H8 | 6% | 10% | 26% | N | Y | Y | 5 |

TABLE 7.3-continued pH and Calcium Sensitivity of ASGR-1-mAb Interactions
pH and Calcium Sensitivity Determination
(% Change Compared to pH 7.4 + Calcium)

| mAb | pH 7.4 minus Calcium | pH 5.6 plus Calcium | pH 5.6 minus Calcium | Calcium sensitive | pH sensitive | pH and calcium sensitive | pH bin |
|---|---|---|---|---|---|---|---|
| 160B12 | 6% | 8% | 22% | N | N | Y | 3 |
| 175D10 | 4% | -3% | 2% | N | N | N | 2 |
| 177D2 | 3% | 2% | 10% | N | N | Y | 3 |
| 25A4 | 2% | -3% | -1% | N | N | N | 2 |
| 26C4 | 3% | 2% | 2% | N | N | N | 2 |
| 27E7 | 20% | 35% | 46% | Y | Y | Y | 4 |
| 29E2 | 5% | 25% | 38% | N | Y | Y | 5 |
| 29H8 | 2% | -2% | 2% | N | N | N | 2 |
| 31D12 | 10% | 27% | 34% | Y | Y | Y | 4 |
| 32D6 | 26% | 33% | 55% | Y | Y | Y | 4 |
| 45B4 | 4% | 10% | 23% | N | Y | Y | 5 |
| 49F10 | 4% | -2% | 8% | N | N | N | 2 |
| 4A2 | 1% | -3% | 1% | N | N | N | 2 |
| 4B3 | 12% | 33% | 45% | Y | Y | Y | 4 |
| 4H6 | 5% | -1% | 2% | N | N | N | 2 |
| 50D4 | 6% | 0% | 9% | N | N | N | 2 |
| 50G9 | 37% | 62% | 44% | Y | Y | Y | 4 |
| 51E9 | 3% | -5% | 2% | N | N | N | 2 |
| 52G11 | 15% | 1% | 13% | Y | N | Y | 1 |
| 52H1 | 5% | -1% | 10% | N | N | N | 2 |
| 53F2 | 15% | 1% | 13% | Y | N | Y | 1 |
| 53F7 | 9% | 3% | 13% | N | N | Y | 3 |
| 55B1 | 5% | -2% | 4% | N | N | N | 2 |
| 56E5 | 1% | -6% | -1% | N | N | N | 2 |
| 57A7 | 13% | 13% | 29% | Y | Y | Y | 4 |
| 58G11 | 38% | 12% | 51% | Y | Y | Y | 4 |
| 59F2 | 48% | 52% | 74% | Y | Y | Y | 4 |
| 5E5 | 7% | 18% | 42% | N | Y | Y | 5 |
| 60D2 | 20% | 42% | 49% | Y | Y | Y | 4 |
| 60E8 | 3% | 11% | 18% | N | Y | Y | 5 |
| 63A10 | 8% | 3% | 47% | N | N | Y | 3 |
| 63G7 | 20% | 15% | 59% | Y | Y | Y | 4 |
| 64B12 | 6% | 6% | 7% | N | N | N | 2 |
| 65F10 | 25% | 18% | 37% | Y | Y | Y | 4 |
| 68G6 | 22% | 39% | 47% | Y | Y | Y | 4 |
| 6D9 | 14% | 25% | 42% | Y | Y | Y | 4 |
| 6G6 | 1% | -3% | 0% | N | N | N | 2 |
| 70D1 | 17% | 12% | 29% | Y | Y | Y | 4 |
| 7E11 | 9% | 5% | 14% | N | N | Y | 3 |
| 7F4 | 4% | 6% | 9% | N | N | N | 2 |
| 7G4 | 2% | 1% | 7% | N | N | N | 2 |
| 9G9 | 25% | 38% | 55% | Y | Y | Y | 4 |
| 65E9 | 22% | 30% | 35% | Y | Y | Y | 4 |
| 72B4 | 32% | 26% | 43% | Y | Y | Y | 4 |
| 147D10 | 13% | 4% | 11% | Y | N | Y | 1 |
| 149D11 | 11% | 3% | 11% | Y | N | Y | 1 |
| 149F8 | 1% | -8% | -1% | N | N | N | 2 |
| 22G5 | 40% | 35% | No Data | Y | Y | No Data | 4* |
| 48B12 | 4% | -6% | 0% | N | N | N | 2 |
| 52H2 | 26% | 11% | 32% | Y | Y | Y | 4 |
| 6G7 | 8% | 4% | 16% | N | N | Y | 3 |
| 64G12 | 24% | 10% | 24% | Y | N | Y | 1 |
| 72F5 | 64% | 20% | 30% | Y | Y | Y | 4 |
| 147E9 | 5% | -4% | 20% | N | N | Y | 3 |
| 184E7 | 1% | -9% | -3% | N | N | N | 2 |
| 194A4 | -1% | -7% | -3% | N | N | N | 2 |
| 208A2 | -4% | -10% | -5% | N | N | N | 2 |
| 210G10 | -3% | -10% | -5% | N | N | N | 2 |
| 4B1 | 6% | -5% | -2% | N | N | N | 2 |
| 62H10 | 13% | -2% | 14% | Y | N | Y | 1 |
| 72G9 | 1% | -7% | -1% | N | N | N | 2 |
| 148H10 | 45% | 10% | 47% | Y | N | Y | 1 |
| 173C11 | 17% | 0% | 29% | Y | N | Y | 1 |
| 179C2 | 25% | 0% | 45% | Y | N | Y | 1 |
| 47C1 | 13% | -1% | 10% | Y | N | Y | 1 |
| 49C1 | 72% | 23% | 64% | Y | Y | Y | 4 |
| 60C12 | 14% | -3% | 12% | Y | N | Y | 1 |
| 60G2 | 36% | 7% | 31% | Y | N | Y | 1 |
| 65D5 | 34% | 7% | 61% | Y | N | Y | 1 |
| 66H11 | 81% | 36% | 52% | Y | Y | Y | 4 |
| 73G1 | 100% | 33% | 62% | Y | Y | Y | 4 |
| 51E3 | 65% | 16% | 42% | Y | Y | Y | 4 |
| 53E8 | 68% | 20% | 64% | Y | Y | Y | 4 |
| 54E9 | 79% | 24% | 75% | Y | Y | Y | 4 |
| 56E3 | 75% | 21% | 16% | Y | Y | Y | 4 |
| 190C11 | -1% | -6% | -6% | N | N | N | 2 |
| 190E6 | -1% | -12% | -6% | N | N | N | 2 |
| 190F12 | -1% | -6% | -6% | N | N | N | 2 |
| 190F8 | -1% | -5% | -5% | N | N | N | 2 |
| 190G11 | -2% | -8% | -5% | N | N | N | 2 |
| 190H9 | -1% | -6% | -7% | N | N | N | 2 |
| 191A10 | 0% | -5% | -5% | N | N | N | 2 |
| 191G1 | -10% | -15% | -11% | N | N | N | 2 |
| 191G10 | 0% | -5% | -5% | N | N | N | 2 |
| 191G12 | -2% | -5% | -6% | N | N | N | 2 |
| 192C10 | -1% | -6% | -6% | N | N | N | 2 |
| 192C8 | -9% | -14% | -14% | N | N | N | 2 |
| 192E4 | -2% | -9% | -8% | N | N | N | 2 |
| 192G6 | -1% | -6% | -6% | N | N | N | 2 |
| 192G8 | -1% | -5% | -6% | N | N | N | 2 |
| 192H10 | 0% | -5% | -4% | N | N | N | 2 |
| 193C7 | -1% | -8% | -8% | N | N | N | 2 |
| 194B7 | 1% | -4% | -4% | N | N | N | 2 |
| 194C1 | -7% | -12% | -8% | N | N | N | 2 |
| 196C7 | -8% | -12% | -12% | N | N | N | 2 |
| 197B6 | -1% | -8% | -7% | N | N | N | 2 |
| 197E11 | -1% | -5% | -4% | N | N | N | 2 |
| 197F2 | 0% | -6% | -6% | N | N | N | 2 |
| 197G3 | 2% | -3% | -3% | N | N | N | 2 |
| 198G3 | -1% | -4% | -4% | N | N | N | 2 |
| 213B3 | -1% | -7% | -3% | N | N | N | 2 |
| 219H1 | 2% | -3% | 1% | N | N | N | 2 |
| 74C8 | 1% | -7% | -3% | N | N | N | 2 |
| 74G6 | 1% | -9% | -4% | N | N | N | 2 |
| 75G3 | -1% | -1% | 2% | N | N | N | 2 |
| 74B2 | 8% | -9% | -5% | N | N | N | 2 |
| 74H7 | 1% | -2% | 1% | N | N | N | 2 |
| 85F7 | 2% | -2% | 2% | N | N | N | 2 |
| 198B9 | 3% | 2% | 11% | N | N | Y | 3 |
| 199A7 | 1% | 1% | 10% | N | N | Y | 3 |
| 218G4 | 1% | -4% | 0% | N | N | N | 2 |
| 146A8 | 2% | -9% | 25% | N | N | Y | 3 |
| 146B6 | 2% | -5% | 13% | N | N | Y | 3 |
| 149A1 | 2% | -7% | 9% | N | N | Y | 3* |
| 172B12 | -14% | -27% | -13% | N | N | N | 2 |
| 172C3 | -9% | -26% | 0% | N | N | N | 2 |
| 193E7 | -9% | -9% | -4% | N | N | N | 2 |
| 199E3 | -5% | -4% | -4% | N | N | N | 2 |
| 226F9 | 100% | 51% | 77% | Y | Y | Y | 4 |
| 227C1 | 100% | 54% | 73% | Y | Y | Y | 4 |
| 227F2 | 80% | 50% | 100% | Y | Y | Y | 4 |
| 65C12 | 13% | 0% | 23% | Y | N | Y | 1 |
| 176H4 | 2% | -4% | 26% | N | N | Y | 3 |
| 194C10 | 2% | 10% | 16% | N | Y | Y | 5 |
| 191E10 | -1% | -9% | -9% | N | N | N | 2 |
| 196F4 | -8% | -5% | -6% | N | N | N | 2 |
| 198D2 | -8% | -30% | -28% | N | N | N | 2 |
| 202A3 | -21% | -22% | -23% | N | N | N | 2 |
| 204G6 | -5% | -11% | -10% | N | N | N | 2 |
| 224G1 | 77% | 41% | 65% | Y | Y | Y | 4 |
| 52D10 | 21% | 3% | 45% | Y | N | Y | 1 |
| 64E2 | 48% | 29% | 49% | Y | Y | Y | 4 |

*No actual data; bin predicted on the totality of information regarding the antibody.

D. Relative Epitope Binning/Profiling

A common way to characterize epitopes is through competition experiments. Antibodies that compete with each other can be thought of as binding the same or overlapping site on the target. This example describes a method of determining competition for binding to hASGR-1 and the results of the method when applied to a number of antibodies described herein.

Binning experiments can be conducted in a number of ways, and the method employed may have an effect on the assay results. Common to these methods is that ASGR-1 is typically bound by one reference antibody and probed by another. If the reference antibody prevents the binding of the probe antibody then the antibodies are said to be in the same bin. The order in which the antibodies are employed is important. If antibody A is employed as the reference antibody and blocks the binding of antibody B the converse is not always true: antibody B used as the reference antibody will not necessarily block antibody A. There are a number of factors in play here: the binding of an antibody can cause conformational changes in the target which prevent the binding of the second antibody, or epitopes which overlap but do not completely occlude each other may allow for the second antibody to still have enough high-affinity interactions with the target to allow binding. In general, if competition is observed in either order the antibodies are said to bin together, and if both antibodies can block each other then it is likely that the epitopes overlap more completely.

For this example, a modified antibody-antibody competition assay was used to determine the relative epitope binning profiles of the ASGR-1 specific, ligand blocking antibodies in a high throughput manner. Briefly, individual antibodies were tested for their ability to compete for binding with a panel of reference antibodies chosen based on their different binding characteristics (eg. species cross reactivity, HEPG2 binding, etc.) and primary sequences. The pattern of competition/binding of each test antibody with the reference antibody panel was then determined and compared to those produced from the other test antibodies. The degree of correlation between the individual test antibody competition/binding profiles was then compared. Antibodies that showed similar competition/binding profiles were binned (grouped) together (eg. Binning Profile A, B, etc.).

Biotinylated recombinant soluble human ASGR-1 protein was coupled to streptavidin coated, uniquely barcoded LumAvidin Beads® (LumAvidin Microspheres, Cat #:L101-LXXX-01; Luminex Corp., Austin, Tex., U.S.A.) for 45 minutes in the dark at room temperature and washed twice. The reference antibody hybridoma supernatant samples were incubated with the antigen-coated beads for 1 hour in the dark at room temperature and washed three times. Beads were resuspended in FACS buffer containing StabilGuard®. The antigen-coated, reference antibody-bound beads were pooled and then divided into individual sample wells containing a normalized (2.5 ug/ml) test antibody (hybridoma supernatant) sample (or negative control), incubated for 1 hour in the dark at room temperature and washed twice. The samples were then incubated with Alexa Fluor® 488 IgG fragment-specific detection antibody for 15 minutes in the dark at room temperature, washed once and resuspended in FACS buffer. FACS buffer supplemented with 1 mM Calcium Chloride was used in all steps. Samples were analyzed using an Intellicyt iQue™ Screener Platform.

To determine the antibody competition/binding profiles of the individual test antibodies, the reference-only antibody binding signal was subtracted from the reference plus test antibody signal for each competition/binding reaction (ie. across the entire reference antibody set). An individual antibody binding profile was defined as the collection of net binding values for each competition/binding reaction. The degree of similarity between individual profiles was then assessed by calculating the coefficient of determination between each of the test antibody profiles. Test antibodies showing high degrees of similarity ($R^2 \geq 0.8$) to each other were then grouped into common binning profiles. Separate binning profiles were only defined if there were two or more samples with a high degree of correlation. If individual unique antibody binning profiles were observed (ie. they displayed a low degree of similarity to other test antibody binding profiles), the bin was classified as unknown. Using this method, the ASGR-1-binding, receptor-ligand blocking antibodies were sub-divided into 14 unique binning profiles (A, B, C, D, E, L, M, N, O, P, Q, R, T and unknown) (Table 7.4). Antibodies that displayed a unique binning profile (as defined above) but shared a relatively high degree of similarity to another profile ($R^2=0.6$-$0.8$) were categorized as a sub-bin (ie. A.1, A.2, etc.) of that profile.

TABLE 7.4

Relative Epitope Binning/Profiling of ASGR-1 Specific Receptor-Ligand Blocking mAbs

| mAb | Epitope BIN | mAb | Epitope BIN | mAb | Epitope BIN | mAb | Epitope BIN |
|---|---|---|---|---|---|---|---|
| 10G6 | A | 52H1 | A | 9C11 | A.3 | 60G2 | E |
| 11E2 | A | 53F2 | A | 12B12 | B | 65D5 | E |
| 11F5 | A | 53F7 | A | 147D10 | B | 66H11 | E |
| 12E9 | A | 55B1 | A | 149D11 | B | 71A6 | E |
| 12F11 | A | 56E5 | A | 149F8 | B | 73G1 | E |
| 12F12 | A | 57A7 | A | 151B9 | B | 49C5 | E.1 |
| 13F6 | A | 58G11 | A | 175F4 | B | 49D10 | E.1 |
| 148E10 | A | 59F2 | A | 22G5 | B | 51E3 | E.1 |
| 154F4 | A | 5E5 | A | 48B12 | B | 51F4 | E.1 |
| 159H8 | A | 60D2 | A | 52H2 | B | 53E8 | E.1 |
| 160B12 | A | 60E8 | A | 6G7 | B | 54E9 | E.1 |
| 175D10 | A | 63A10 | A | 7G2 | B | 56E3 | E.1 |
| 177D2 | A | 63G7 | A | 64G12 | B.1 | 56G1 | E.1 |
| 25A4 | A | 64B12 | A | 72F5 | B.1 | 190C11 | L |
| 25D12 | A | 65F10 | A | 147E9 | C | 190E6 | L |
| 26C4 | A | 68G6 | A | 184E7 | C | 190F12 | L |
| 27E7 | A | 6A6 | A | 194A4 | C | 190F8 | L |
| 28H2 | A | 6D4 | A | 208A2 | C | 190G11 | L |
| 29E2 | A | 6D9 | A | 210G10 | C | 190H9 | L |
| 29E6 | A | 6G6 | A | 4B1 | C | 191A10 | L |
| 29H8 | A | 70D1 | A | 60E12 | C | 191G1 | L |
| 31D12 | A | 7A10 | A | 61A1 | C | 191G10 | L |
| 32D6 | A | 7C3 | A | 62H10 | C | 191G12 | L |
| 3G7 | A | 7E11 | A | 63H8 | C | 192C10 | L |
| 45B4 | A | 7F4 | A | 72G9 | C | 192C8 | L |
| 49F10 | A | 7F8 | A | 8D8 | D.1 | 192E4 | L |
| 4A2 | A | 7G4 | A | 12D2 | E | 192G6 | L |
| 4B3 | A | 8D12 | A | 148H10 | E | 192G8 | L |
| 4H6 | A | 9F12 | A | 173C11 | E | 192H10 | L |
| 50D4 | A | 9G9 | A | 179C2 | E | 193C7 | L |
| 50G9 | A | 65E9 | A.1 | 47C1 | E | 194B7 | L |
| 51E9 | A | 72B4 | A.1 | 49C1 | E | 194C1 | L |
| 52G11 | A | 7H7 | A.2 | 60C12 | E | 196C7 | L |
| 197B6 | L | 197F2 | L | 198G3 | L | 219H1 | L |
| 197E11 | L | 197G3 | L | 213B3 | L | 74C8 | L |
| 74G6 | L | 74H7 | M.1 | 218G4 | O | 172B12 | Q |
| 75G3 | M | 85F7 | M.1 | 146A8 | P | 172C3 | Q |
| 89A11 | M | 198B9 | N | 146B6 | P | 193E7 | Q |
| 74B2 | M.1 | 199A7 | N | 149A1 | P | 199E3 | Q |
| 226F9 | Q | 227F2 | Q | 176H4 | R | | |
| 227C1 | Q | 65C12 | Q | 194C10 | T | | |

E. Epitope Mapping—Arginine/Glutamic Acid Mutational Profiling

This Example characterizes ASGR-1 antibodies based on the effect of mutagenesis of ASGR-1 on their ability to bind the target. Previous data indicated that the ASGR-1 CBD is primarily responsible for antibody binding for the panel of antibodies. As such, only the ASGR-1 CBD was considered structurally in the context of the full length ASGR-1 in the design of mutation sites.

Arginine/Glutamic acid mutational mapping was used to characterize epitopes bound by human ASGR-1-specific, ligand blocking antibodies. Briefly, 144 individual point mutations were made across the CBD domain of human ASGR-1 protein (SEQ ID NO:5) starting at position 148. Ninety-one constructs, representing surface residues (modelled using the ASGR-1 crystal structure in the PyMOL Molecular Graphics System (Version 1.8; Schrödinger, LLC.)) and therefore potentially accessible for antibody binding, were selected for these assays. Mutant hASGR-1 variants were constructed such that non-arginine residues were changed to arginine and where wild type arginine residues were mutated to glutamic acid. Each mutant hASGR-1 sequence was then cloned into a mammalian expression vector and used to transiently transfect CHOs cells. The ability of human ASGR-1-specific, ligand competing antibodies to bind to the mutant hASGR-1 proteins was assessed by FACS as described above.

Antibodies were tested for binding to the individual mutant and wild type ASGR-1 constructs using normalized antibody concentrations (5 ug/ml). CHO—S cells transiently expressing the appropriate mutated or non-mutated antigen of interest were mixed with antibody sample or controls, incubated for 1 hour at 4° C., and then washed twice. Cells with bound antibody were then incubated with Alexa Fluor® 647 IgG Fc fragment-specific detection antibody and 7-AAD viability stain for 15 minutes at 4° C., washed once and resuspended in FACS buffer. Samples were analyzed using a BD Accuri™ Flow Cytometer and an Intellicyt HyperCyt Autosampler. As a negative control, supernatants and controls were also screened against CHO—S cells transfected with empty parental vector (referred to as mock).

In order to exclude mutants that were poorly expressed or produced mis-folded antigen, only constructs that yielded a binding data average of at least 25% or greater compared to the average binding observed on wildtype hASGR-1 was used for further analysis. Because mutant hASGR-1 expression levels varied relative to each other, sample binding data for each construct was normalized for expression by dividing the binding data from an antibody not affected by the mutations (e.g., 65C12) by the binding values of each test antibody on a given mutant construct. Also, because the antibody binding affinities varied amongst the samples, the expression corrected data (above) was further normalized by comparing test antibody binding on each mutant construct to wild type hASGR-1. Identification of specific mutations that affected test antibody binding was performed by an interquartile range (IQR) analysis to determine statistical outliers. A mutation was identified as a "hit" if the calculated values were >3× the IQR (above the $3^{rd}$ quartile/upper fence) for a given mutant construct. Although IQR analysis was used here to determine significance and identify hits, one skilled in the art will recognize that a number of methods could be employed in order to normalize the data (eg. using epitope-tagged constructs or other ASGR-1-binding antibodies directed against non-CBD epitopes). Any statistically significant reduction in antibody binding signal to a mutant construct (compared to that determined for binding to wild type ASGR-1) determined by these methods could be used for hit identification.

For illustrative purposes, Table 7.5 shows the IQR analysis with a single mutant construct (i.e., H203).

TABLE 7.5

| | IQR analysis (representative data for construct H203) | | | | | | | |
|---|---|---|---|---|---|---|---|---|
| | FACS Binding Geomean | | Expression Normalization to mAb 65C12 | | Antibody Binding Normalization to wt ASGR1 Binding | | >Q3 + 3 × IQR Gating | |
| mAb | wt ASGR1 | H203 | wt ASGR1 | H203 | wt ASGR1 | H203 | wt ASGR1 | H203 |
| 4A2 | 41104 | 18946 | 1.3644 | 1.3597 | 1.0000 | 0.9966 | 1.0000 | 0.9966 |
| 7E11 | 45453 | 14714 | 1.2338 | 1.7509 | 1.0000 | 1.4191 | 1.0000 | 1.4191 |
| 56E5 | 42617 | 20345 | 1.3159 | 1.2662 | 1.0000 | 0.9622 | 1.0000 | 0.9622 |
| 7G4 | 48526 | 18542 | 1.1557 | 1.3893 | 1.0000 | 1.2022 | 1.0000 | 1.2022 |
| 53F7 | 43474 | 18081 | 1.2900 | 1.4248 | 1.0000 | 1.1045 | 1.0000 | 1.1045 |
| 10G6 | 43059 | 18213 | 1.3024 | 1.4145 | 1.0000 | 1.0860 | 1.0000 | 1.0860 |
| 26C4 | 45991 | 13484 | 1.2194 | 1.9105 | 1.0000 | 1.5668 | 1.0000 | 1.5668 |
| 6G6 | 47628 | 20505 | 1.1775 | 1.2564 | 1.0000 | 1.0670 | 1.0000 | 1.0670 |
| 29H8 | 40927 | 13217 | 1.3702 | 1.9491 | 1.0000 | 1.4225 | 1.0000 | 1.4225 |
| 25A4 | 55579 | 20036 | 1.0090 | 1.2858 | 1.0000 | 1.2743 | 1.0000 | 1.2743 |
| 32D6 | 36128 | 13465 | 1.5522 | 1.9132 | 1.0000 | 1.2325 | 1.0000 | 1.2325 |
| 198D2 | 16882 | 7138 | 3.3219 | 3.6090 | 1.0000 | 1.0864 | 1.0000 | 1.0864 |
| 4B3 | 35561 | 1696 | 1.5770 | 15.1900 | 1.0000 | 9.6323 | 1.0000 | _9.6323_ |
| 50G9 | 37326 | 1506 | 1.5024 | 17.1095 | 1.0000 | 11.3879 | 1.0000 | _11.3879_ |
| 60D2 | 29631 | 1368 | 1.8926 | 18.8256 | 1.0000 | 9.9467 | 1.0000 | _9.9467_ |
| 59F2 | 27915 | 1346 | 2.0089 | 19.1372 | 1.0000 | 9.5260 | 1.0000 | _9.5260_ |
| 60E8 | 38653 | 1518 | 1.4509 | 16.9692 | 1.0000 | 11.6960 | 1.0000 | _11.6960_ |
| 65E9 | 29613 | 1471 | 1.8938 | 17.5097 | 1.0000 | 9.2460 | 1.0000 | _9.2460_ |
| 5E5 | 40651 | 12616 | 1.3796 | 2.0420 | 1.0000 | 1.4802 | 1.0000 | 1.4802 |
| 29E2 | 25781 | 15058 | 2.1752 | 1.7108 | 1.0000 | 0.7865 | 1.0000 | 0.7865 |
| 45B4 | 30350 | 14012 | 1.8478 | 1.8385 | 1.0000 | 0.9950 | 1.0000 | 0.9950 |
| 6G7 | 38643 | 15089 | 1.4512 | 1.7073 | 1.0000 | 1.1764 | 1.0000 | 1.1764 |
| 72F5 | 27993 | 10499 | 2.0034 | 2.4537 | 1.0000 | 1.2248 | 1.0000 | 1.2248 |
| 22G5 | 45048 | 15060 | 1.2449 | 1.7105 | 1.0000 | 1.3740 | 1.0000 | 1.3740 |
| 48B12 | 52493 | 20467 | 1.0683 | 1.2587 | 1.0000 | 1.1782 | 1.0000 | 1.1782 |
| 151B9 | 23527 | 9738 | 2.3837 | 2.6454 | 1.0000 | 1.1098 | 1.0000 | 1.1098 |
| 52H2 | 47957 | 18609 | 1.1694 | 1.3843 | 1.0000 | 1.1838 | 1.0000 | 1.1838 |
| 149D11 | 23601 | 8866 | 2.3761 | 2.9055 | 1.0000 | 1.2228 | 1.0000 | 1.2228 |
| 175F4 | 33619 | 14804 | 1.6681 | 1.7401 | 1.0000 | 1.0432 | 1.0000 | 1.0432 |
| 147E9 | 40166 | 21513 | 1.3962 | 1.1975 | 1.0000 | 0.8577 | 1.0000 | 0.8577 |
| 61A1 | 39965 | 20142 | 1.4032 | 1.2790 | 1.0000 | 0.9115 | 1.0000 | 0.9115 |
| 184E7 | 42704 | 18354 | 1.3132 | 1.4036 | 1.0000 | 1.0688 | 1.0000 | 1.0688 |

TABLE 7.5-continued

IQR analysis (representative data for construct H203)

| mAb | FACS Binding Geomean | | Expression Normalization to mAb 65C12 | | Antibody Binding Normalization to wt ASGR1 Binding | | >Q3 + 3 × IQR Gating | |
|---|---|---|---|---|---|---|---|---|
| | wt ASGR1 | H203 | wt ASGR1 | H203 | wt ASGR1 | H203 | wt ASGR1 | H203 |
| 72G9 | 36507 | 18778 | 1.5361 | 1.3719 | 1.0000 | 0.8931 | 1.0000 | 0.8931 |
| 194A4 | 16291 | 12149 | 3.4424 | 2.1204 | 1.0000 | 0.6160 | 1.0000 | 0.6160 |
| 60C12 | 31286 | 19812 | 1.7925 | 1.3003 | 1.0000 | 0.7254 | 1.0000 | 0.7254 |
| 173C11 | 28526 | 13861 | 1.9659 | 1.8586 | 1.0000 | 0.9454 | 1.0000 | 0.9454 |
| 56E3 | 33876 | 20425 | 1.6555 | 1.2613 | 1.0000 | 0.7619 | 1.0000 | 0.7619 |
| 54E9 | 38589 | 15344 | 1.4533 | 1.6789 | 1.0000 | 1.1552 | 1.0000 | 1.1552 |
| 65D5 | 41007 | 20291 | 1.3676 | 1.2696 | 1.0000 | 0.9283 | 1.0000 | 0.9283 |
| 190F8 | 36503 | 15073 | 1.5363 | 1.7091 | 1.0000 | 1.1125 | 1.0000 | 1.1125 |
| 198G3 | 21467 | 13143 | 2.6124 | 1.9600 | 1.0000 | 0.7503 | 1.0000 | 0.7503 |
| 191G10 | 33829 | 17045 | 1.6578 | 1.5114 | 1.0000 | 0.9117 | 1.0000 | 0.9117 |
| 202A3 | 24848 | 12497 | 2.2570 | 2.0614 | 1.0000 | 0.9134 | 1.0000 | 0.9134 |
| 194C1 | 20860 | 11044 | 2.6884 | 2.3325 | 1.0000 | 0.8676 | 1.0000 | 0.8676 |
| 176H4 | 33506 | 10237 | 1.6737 | 2.5166 | 1.0000 | 1.5036 | 1.0000 | 1.5036 |
| 197G3 | 13308 | 3503 | 4.2141 | 7.3547 | 1.0000 | 1.7453 | 1.0000 | 1.7453 |
| 191G1 | 25298 | 10876 | 2.2168 | 2.3687 | 1.0000 | 1.0685 | 1.0000 | 1.0685 |
| 213B3 | 15070 | 12846 | 3.7212 | 2.0054 | 1.0000 | 0.5389 | 1.0000 | 0.5389 |
| 218G4 | 12212 | 7933 | 4.5923 | 3.2472 | 1.0000 | 0.7071 | 1.0000 | 0.7071 |
| 75G3 | 37223 | 14472 | 1.5066 | 1.7801 | 1.0000 | 1.1815 | 1.0000 | 1.1815 |
| 194C10 | 28138 | 13217 | 1.9930 | 1.9491 | 1.0000 | 0.9780 | 1.0000 | 0.9780 |
| 85F7 | 32968 | 16509 | 1.7010 | 1.5605 | 1.0000 | 0.9174 | 1.0000 | 0.9174 |
| 199A7 | 17005 | 9455 | 3.2978 | 2.7247 | 1.0000 | 0.8262 | 1.0000 | 0.8262 |
| 146B6 | 24138 | 14412 | 2.3233 | 1.7875 | 1.0000 | 0.7694 | 1.0000 | 0.7694 |
| 193E7 | 35508 | 13783 | 1.5794 | 1.8691 | 1.0000 | 1.1835 | 1.0000 | 1.1835 |
| 65C12 | 56080 | 25761 | 1.0000 | 1.0000 | 1.0000 | 1.0000 | 1.0000 | 1.0000 |

The bolded, underlined, and italicized values for antibodies 4B3, 50G9, 60D2, 59F2, 60E8, and 65E9 in Table 7.5 represent the statistically significant hits (i.e., >3× the IQR) whose binding was affected by mutations H203.

A summary of the hASGR-1 residues important for binding of the representative antibodies is shown in (FIG. 60, labeled as Table 7.6 in the figure). In addition, this analysis revealed that the mutation of some ASGR-1 residues had more dramatic effects on a given antibody binding than others. This likely reflects the relative contribution or importance that these residues have in mediating interactions with specific test antibodies. The degree by which each mutation impacted the ability of a test antibody to bind was determined by calculating the magnitude of an individual binding data point above the upper gate determined by each IQR analysis. The relative impact of each mutation on the binding of a given test antibody was then ranked using this method and displayed as a heatmap in FIG. 60. Dark grey shading indicates the data point deviated dramatically from the upper gate (ie. a large effect on antibody binding), while light grey/white shading indicates the data point was very close to the cut offs (ie. 3× the IQR) (FIG. 60). When aligned with the relative epitope profiling bin assignments (Example 7D above), this analysis reveals a set of core ASGR-1 amino acid positions that, when mutated, disrupt test antibody binding. As such, these positions are likely part of the ASGR-1 epitopes bound by the selected antibodies. These amino acid residues either directly contact or are involved in the interaction with the antibody, or are in close enough proximity that, when mutated, interfere with antibody binding. Amino acid positions identified as statistically significant hits, but barely made the cut offs, and map to surface ASGR-1 locations distinct from the main epitope bins (FIG. 47) may represent residues that, when mutated, disrupt the conformation of ASGR-1 such that an antibody that binds to a distinct epitope is affected (ie. an indirect effect). mAb 197G3 is an example of an antibody displaying a range of binding sensitivities in this assay, yet the most important residues (R274 and R271) can be identified by rank ordering them as described.

In order to compare the mutational hit patterns of the individual test antibodies with each other, the coefficient of determination between the test antibodies was determined. The expression and antibody binding normalized data set was used to generate binding profiles for each test antibody across the mutant panel. The resulting profiles for each individual test antibody were then compared for their degree of similarity to all of the other test antibodies. The coefficient of determination ($R^2$) for each combination was determined and converted into a heat map in order to visualize the resulting patterns (FIG. 46). For simplicity, a representative antibody from each unique mutational profile (Reference Antibody) is shown in FIG. 46. This analysis revealed 7 predominant hit patterns or mutational clusters. Test antibodies affected by the 7 predominant mutational clusters correspond to those from competition/binding binning profiles A, B, C, E and L (3 distinct hit/mutational clusters of bin A antibodies and 1 distinct hit/mutational cluster of bin B, bin C, bin E and bin L antibodies). The remaining antibodies, categorized as displaying separate binning profiles (compared to bins A, B, C, E and L), are affected by distinct mutations in ASGR-1, but also include residues that partially overlap with test antibodies belonging to the predominant bins.

This data indicates the selected antibodies bind to epitopes that partially overlap with the 7 predominant epitope regions. The residues important for the binding of antibodies belonging to the 7 predominant epitope regions were then mapped onto a computer representation of the surface of the ASGR-1 structure using the PyMOL Molecular Graphics System (Version 1.8; Schrödinger, LLC.) (FIG. 47). A residue on the surface of ASGR-1 was considered part of the same epitope region if at least one antibody from a distinct binning profile (ie. A, B, C, E and L) was identified as being sensitive to mutation. For example, the predominant epitope region for antibodies belonging to binning profile C includes hASGR-1 residues P241, D242, D243, Y245, G251 and E253 (SEQ ID NO:5). The binding of antibody 147E9 is affected by mutation of all of these residues, while antibody 184E7 is only disrupted by mutation of P241, D243 and E253. Thus, the predominant epitope region of ASGR-1 bound by antibodies belonging to binning profile C is defined as including one or more of (but not limited to) P241, D242, D243, Y245, G251 and E253 (SEQ ID NO:5). Also, note that the antibody 194A4 was classified as belonging to Bin C as determined in Example 7D, however, the results of this arginine/glutamic acid mutational profiling (as well as the results from crystal structure analysis of the ASGR-1 CBD/194A4 complex described in Example 10H) suggests that the relative epitope profiling may have been inaccurate.

Antibodies belonging to binning profile A were further sub-divided into 3 distinct mutational clusters. These clusters mapped to ASGR-1 surface positions that overlap with, or are in extremely close physical proximity to, each other consistent with a common binning profile. Antibodies that displayed binning profiles distinct from the 5 major bins (i.e., A, B, C, E and L) also showed distinct patterns of mutations that affected their binding (FIG. 46). Some binning profiles (R, O, M, M.1 and T) share significant overlap with antibodies from binning profile L, and can be considered sub-bins of this profile. Taken together, this data indicates that antibodies capable of blocking ASGR-1-ligand interactions bind to 5 major epitope regions. In addition, blocking antibodies were identified that bind to partially overlapping epitopes of these major regions.

Example 8: ASGR Internalization Assay

To determine whether the antibodies bind and also prevent internalization of ASGR-1 into cells expressing ASGR-1, an in vitro internalization assay is performed of various antibody samples.
Human ASGR-1 Internalization Cellular Imaging Assay Protocol
Reagents:
U2OS (Human Osteosarcoma) cell line
McCoy's 5A Medium: Gibco, #16600-082
MEM NEAA (100×): Gibco, #11140-050
Penicillin-Streptomycin (10,000 U/ml, 100×) Gibco, #15140-122
L-Glutamine (100×): Gibco, #25030-081
Fetal Bovine Serum: Gibco, #16000-044
DPBS (without Ca and Mg): Gibco, #14190-136
DPBS (with Ca and Mg): Gibco, #14040-133
Cell Dissociation Buffer: Gibco, #13151-014
1 Liter Filter: Corning, #430517
Hepes Buffer (1M): Gibco, #15630-080
BacMam Virus—huASGR-1: GS: SNAP26f
β-GalNAc-PAA-Biotin: GlycoTech, #01-011
SNAP-Surface Alexa Fluor 546: New England Biolabs, #S9132S
Streptavidin-Alexa Fluor 633: Life Technologies, #S21375
Hoechst 33342: Invitrogen, #H3570
Pitstop2: abcam Biochemical, #ab120687
Pitstop2—negative control: abcam Biochemical, #ab120688
Paraformaldehyde (8% Aqueous Solution): Electron Microscopy Sciences, #157-8-100
Imaging plate—96 well Optical Bottom: Thermo Scientific Nunc, #165305
Operetta High Content Imager: Perkin Elmer
U2OS complete growth medium:
McCoy's 5A with 10% FBS, 1XMEM NEAA, 1XL-Glutamine, and 1× Penicillin-Streptomycin
Medium was filtered before use on cells
U2OS cell plating and culturing:
U2OS cells were grown to 75-85% confluence in T175 before plating into a 96 well plate.
1. The U2OS culture medium was aspirated off the cells in the T175 flask
2. Cells were washed with 10 mls of DPBS and aspirated off
3. 3 mls of Cell Dissociation Buffer was added to the cells and incubated for 5 minutes inside a cell incubator (37° C., 5% $CO_2$) to detach the cells from the T175 flask.
4. The detached cells were diluted with 7 mls of the growth medium
5. 1 ml of cells were used to count the number of cells available to plate
6. The cells were diluted in growth medium to give a final concentration of 28,000 cells/well and BacMam virus (huASGR-1: GS: SNAP26f) was also added to the cells at this time with the desired concentration (MOI).
7. The cells were mixed together with the BacMam virus for 1-2 minutes and then plated on the 96 well imaging plate at a volume of 100 ul/well.
8. The plate was placed inside an incubator (37° C., 5% $CO_2$) for 16-20 hours before treatment.
Treatment of Cells (16-20 Hours Incubation)
1. The next day, the medium on the 96 well plate was dumped out and washed once with DPBS.
2. McCoy's 5A Medium plus 10 mM of Hepes buffer (assay buffer) was added to the cells (100 ul) for 1 hour inside the incubator.
3. After the 1 hour incubation, the medium was dumped out and washed once with DPBS containing Ca and Mg.
4. Pitstop2 and Pitstop2 negative control were prepared in assay buffer at 20 uM.
5. Volume of 100 ul per well of the inhibitors were added to the U2OS cells for 15 minutes inside the incubator.
6. GalNAc-biotin (100 nM) and streptavidin-Alexa633 (100 nM) were pre-mixed in assay buffer and incubated for 10 minutes at room temperature.
7. SNAP-Surface Alexa Fluor 546 (2.5 uM) was prepared in assay buffer.
8. After the 15 minutes incubation, both GalNAc-biotin-streptavidin-Alexa633 and SNAP-Surface Alexa Fluor 546 were directly added (10 ul) to the medium containing Pitstop2 inhibitors for 30 minutes inside the incubator.
9. After the 30 minutes incubation, medium was dumped out and the cells were washed once with DPBS.
10. The cells were fixed by adding 50 ul of 4% Paraformaldehyde (8% paraformaldehyde was diluted with DPBS) containing Hoechst dye (1:5000 dilution) to the cells for 10 minutes at room temperature.
11. After 10 minutes incubation, the cells were washed twice with DPBS and 100 ul of DPBS was added to each well.
12. The plate was imaged on the Operetta instrument with three channels measuring the different fluorescence dyes.
1) Hoechst was measured using filters in the range of excitation: 360-400 nm and emission: 410-480 nm
2) GalNAc-biotin-streptavidin-Alexa633 was measured using filters in the range of excitation: 600-630 nm and emission: 640-680 nm 3) SNAP-Surface Alexa Fluor 546 was measured using filters in the range of excitation: 520-550 nm and emission: 560-630

13. Harmony 3.5 software (Perkin Elmer) was used to identify and quantify internalized spots for fluorescence dyes added in the assay.

This internalization assay can be performed to assay the antigen binding proteins of the invention to determine how much they reduce or inhibit internalization of ASGR, ASGR-1, and/or ASGR-2.

Example 9: Additional Ligand Blocking Assays

Preparation of Desialylated Protein Ligands (Asialofetuin and Orosomucoid)

A. Asialofetuin

Bovine fetuin (AHSG) was obtained commercially (Sigma) and purified using a CaptoQ Impres (GE Healthcare Life Sciences) matrix. Briefly, the material was loaded in 25 mM TRIS pH 7.9 at up to 17 mg/ml resin, resolved in 20 mM BisTRIS (pH6.5) with a gradient of sodium chloride. The main peak was gradient pooled (~0.15M NaCl final) and resolved on a SuperDex200 SEC (GE Healthcare Life Sciences) in Hepes-buffered saline (pH 7.9). The purified AHSG was then concentrated and incubated with Innolink Biotin 354S (EMD Millipore) according to the manufacturer's instructions. The biotinylated protein was then desalted by gel filtration and concentrated once again.

The purified, biotinylated protein was subsequently desialylated by incubation with C. perfringens neuraminidase (Sigma; 1 unit/10 mg protein for 12 hours at 37° C. in 50 mM sodium phosphate, 9 mM HEPES, 0.12M NaCl, pH6). The resulting material was harvested and digested for an additional 3 hours with A. ureafaciens neuraminidase (QAbio; 0.5 units/10 mg protein at 37° C.). The digested sample was diluted 3 fold with 20 mM HEPES containing 0.15M NaCl (pH 7.5) (HBS) to neutral pH and applied to a monomeric Avidin agarose (Pierce) HR16/10 column, run at 60 cm/hour. The loaded column was held for 15 minutes then washed with four column volumes of HBS. The biotinylated, desialylated protein was finally eluted with three column volumes of HBS containing 2 mM Biotin plus an additional two column volumes of 0.1M Glycine-HCl (pH 2.8), which was immediately neutralized during collection with 50 mM TRIS Base). Protein-containing fractions from both types of elutions were identified, pooled, concentrated, dialyzed extensively against 10 mM HEPES, 0.14M NaCl (pH 7.5), re-concentrated and finally filtered sterilized. The purified lots were then analyzed by SDS-PAGE and mass spectrometry prior to use in the described assays.

B. Orosomucoid

Bovine orosomucoid (AGP) was obtained commercially (Sigma) and purified over SuperDex200 resin equilibrated in HBS (pH7.9) by size exclusion chromatography. The front of the main AGP peak was combined from 3 individual runs to generate hyperglycosylated AGP, with the remainder of the main peaks (from the 3 combined runs) to generate hypoglycosylated AGP. For biotinylation, the purified AGP was concentrated to 5 mg/ml and incubated with Innolink Biotin 354S as described. The biotinylated protein was then desalted by gel filtration and concentrated.

After biotinylation, the protein was desialylated by incubating it for 18 hours at 37° C. with one unit of C. perfringens neuraminidase (Sigma) per 10 mg protein in 50 mM sodium phosphate, 9 mM HEPES, 0.12M NaCl (pH6). The resulting material was harvested and digested for an additional 6 hours at 37° C. with 0.5 units A. ureafaciens neuraminidase (QAbio) per 10 mg protein. The sample was diluted 3 fold with HBS to achieve a neutral pH and applied to a monomeric Avidin agarose (Pierce) HR16/10 column, run at 60 cm/hour. The loaded column was held for 15 minutes and then washed with four column volumes of HBS. The biotinylated, desialylated protein was subsequently eluted with three column volumes of HBS containing 2 mM Biotin, plus two column volumes 0.1M Glycine-HCl (pH 2.8), which was immediately neutralized during collection with 50 mM TRIS Base. Protein-containing fractions from both types of elutions were identified, pooled, concentrated, dialyzed extensively against 10 mM HEPES, 0.14M NaCl (pH 7.5), re-concentrated and finally filtered sterilized. The purified lots were then analyzed by SDS-PAGE and mass spectrometry prior to use in the described assays.

These ligands can be used in additional ligand binding assays to determine antigen binding protein inhibition of ligand binding to ASGR, ASGR-1 and/or ASGR-2.

Example 10: Crystal Structure Analysis of Interaction Between Ligands and ASGR-1 and Antibodies and ASGR-1

A. Crystal Structures of ASGR-1 Carbohydrate Binding Domain with Ligand Bound

Introduction

The crystal structure of ligand free ASGR-1 CBD (carbohydrate binding domain) has been previously described (1). Protein expression of ASGR-1 CBD (SEQ ID NO:5), purification and crystallization was performed similar to the published method, however the structures described here differ from the published crystal structure. Analysis of these structures shows extra N- and C-terminal amino acids compared to the published structure, how various ligands interact with the ASGR-1 carbohydrate binding domain, and possible selectivity determinants between ASGR-1/ASGR-2 for various saccharides.

Results

Lactose Binds in the Carbohydrate Binding Pocket of ASGR-1

Protein crystals of the ASGR-1/Lactose complex were grown and the crystal structure was determined at 2.05 Å. Although a method similar to that of the published structure was followed, clear electron density is present for the lactose disaccharide in the carbohydrate binding pocket. See FIGS. 18A and 18B. In this structure, the galactose ring of the lactose disaccharide sits on top of the calcium ion at the carbohydrate binding domain and forms the majority of the contacts with the ASGR-1 protein. Hydrogen bonds are formed between lactose and ASGR-1 amino acids Q240, D242, E253, and N265. Additionally, van der Waals interactions are formed with at least W244 (SEQ ID NO:5). See FIG. 18C.

Analysis of the crystal structure identifies specific amino acids involved in the interaction between ASGR-1 and lactose. Interacting with at least these amino acids by an alternate molecule can completely or partially affect the interaction between ASGR-1 and lactose.

ASGR-1/Lactose Analysis (Distances Below were Calculated with PyMOL):

Amino acids with at least one non-hydrogen atom 4.5 Å or less to the bound lactose molecule were identified and include: Q240, D242, W244, E253, N265, D266, D267 (SEQ ID NO:5).

Amino acids with at least one non-hydrogen atom 5 Å or less to the bound lactose molecule were identified and include: Q240, D242, W244, E253, N265, D266, D267 (SEQ ID NO:5).

Amino acids with at least one non-hydrogen atom 5-8 Å from the bound lactose molecule were identified and include: N209, R237, P238, E239, P241, D243, Y245, G246, H247, G252, C255, H257, T259, D260, V268, R271, Y273 (SEQ ID NO:5).

Galactose Binds in the Carbohydrate Binding Pocket of ASGR-1 Similar to Lactose

Protein crystals of the ASGR-1/Galactose complex were grown and the crystal structure was determined at 2.4 Å. Although a method similar to that of the published structure was followed, clear electron density is present for the galactose saccharide in the carbohydrate binding domain. See FIGS. 19A and 19B.

In this structure, galactose sits on top of the calcium ion at the carbohydrate binding site and forms contacts with the ASGR-1 protein. Hydrogen bonds are formed between galactose and ASGR-1 amino acids Q240, D242, E253, and N265 (SEQ ID NO:5). Additionally, van der Waals interactions are formed with at least W244. See FIG. 19C.

Analysis of the crystal structure identifies specific amino acids involved in the interaction between ASGR-1 and galactose. Interacting with at least these amino acids by an alternate molecule may completely or partially affect the interaction between ASGR-1 and galactose. Distances below were calculated with PyMOL.

ASGR-1/Galactose Analysis (Distances Below were Calculated with PyMOL):

Amino acids with at least one non-hydrogen atom 4.5 Å or less to the bound galactose molecule were identified and include: R237, Q240, D242, W244, E253, N265, D266, D267 (SEQ ID NO:5). Amino acids with at least one non-hydrogen atom 5 Å or less to the bound lactose molecule were identified and include: R237, Q240, D242, W244, E253, N265, D266, D267 (SEQ ID NO:5).

Amino acids with at least one non-hydrogen atom 5-8 Å from the bound lactose molecule were identified and include: N209, P238, E239, P241, D243, Y245, G246, H247, G252, C255, H257, T259, V268, R271, Y273 (SEQ ID NO:5).

When comparing the ASGR-1/Lactose and ASGR-1/Galactose structures, the galactose rings of each saccharide superimpose very well. One difference in the proteins in the two structures is the conformation of R237, an amino acid in close proximity to the carbohydrate binding site. In the superimposition shown in FIG. 20, the ASGR-1/Lactose structure is shown in white and the ASGR-1/Galactose structure is shown in black.

N-Acetyl-D-Galactosamine (GalNAc) Binds in the Carbohydrate Binding Pocket of ASGR-1 Similar to Galactose, Buts Forms Additional Interactions Protein crystals of the ASGR-1/GalNAc complex were grown and the crystal structure was determined at 2.2 Å. Although a method similar to that of the published structure was followed, clear electron density is present for the GalNAc saccharide in the carbohydrate binding pocket. See FIG. 21A and FIG. 21B.

In this structure, GalNAc sits on top of the calcium ion at the carbohydrate binding site and forms contacts with the ASGR-1 protein. Hydrogen bonds are formed between GalNAc and ASGR-1 amino acids Q240, D242, E253, and N265. Additionally, van der Waals interactions are formed with at least W244. In this structure, R237 is in a similar conformation as observed in the galactose complex. However, in this case hydrogen bonds are formed between R237 and the acetyl of GalNAc. These additional interactions with R237 help explain both the observed tighter binding of GalNAc (than galactose) to ASGR-1, and the tighter binding to GalNAc to ASGR-1 (than ASGR-2, in which this amino acid is Ala rather than Arg). See FIG. 21C.

ASGR-1/GalNAc Analysis (Distances were Calculated with PyMOL):

Analysis of the crystal structure identifies specific amino acids involved in the interaction between ASGR-1 and GalNAc. Interacting with at least one of these amino acids by an alternate molecule may completely or partially inhibit the interaction between ASGR-1 and GalNAc.

Amino acids with at least one atom 4.5 Å or less to the bound GalNAc molecule were identified and include: N209, R237, Q240, D242, W244, E253, H257, T259, N265, D266, D267, Y273 (SEQ ID NO:5). Amino acids with at least one non-hydrogen atom 5 Å or less to the bound lactose molecule were identified and include: N209, R237, Q240, D242, W244, E253, H257, T259, N265, D266, D267, Y273 (SEQ ID NO:5).

Amino acids with at least one non-hydrogen atom 5-8 Å from the bound lactose molecule were identified and include: P238, E239, P241, D243, Y245, G246, H247, G252, C255, F258, D260, R263, W264, V268, R271 (SEQ ID NO:5).

The coordinates for the ASGR-1 CBD/GalNAc crystal structure complex are presented in Table 10.1.

Methods

ASGR-1 Expression and Purification

For all chrystallography experiments in Example 12, Human ASGR-1 CBD protein (SEQ ID NO:5) was expressed in E. coli and refolded and purified.

ASGR-1 Crystallization

Purified human ASGR-1 CBD (148-291) protein was concentrated to 8-12 mg/ml. ASGR-1/carbohydrate complex crystals grow in 0.1 M sodium cacodylate pH 6.8, 0.08 M ammonium sulfate, 21-23% PEG 8000 in the presence of 20 mM ligand (lactose, galactose or GalNAc).

Data Collection and Structure Determination

Datasets for ASGR-1 CBD complexes were collected on a Rigaku FR-E X-ray source (ASGR-1/Lactose and ASGR-1/Galactose) or at Berkeley Advanced Light Source beamline 5.0.2 (ASGR-1/GalNAc). All datasets were processed with iMosflm(2) and scaled with AIMLESS(3) from the CCP4 program suite(4).

ASGR-1/Lactose crystals grow in the C2 space group with unit cell dimensions a=113.5, b=32.3, c=40.4 Å, β=92.3° with one complex molecule per asymmetric unit, and diffract to 2.05 Å resolution. The ASGR-1 structure was solved by molecular replacement with the program PHASER(5) using the published ASGR-1 structure(1) as the starting search model. The structure was improved with multiple rounds of model building with Coot(6) and refinement with PHENIX(7). The refined structure has R=18.9 and $R_{free}$=24.4.

ASGR-1/Galactose crystals grow in the C2 space group with unit cell dimensions a=113.1, b=32.7, c=40.7 Å, β=91.6° with one complex molecule per asymmetric unit, and diffract to 2.4 Å resolution. The ASGR-1/Lactose structure was used as the starting molecule for molecular replacement, and model building and refinement were performed as described for the ASGR-1/Lactose complex to R=15.8 and $R_{free}$=22.9.

ASGR-1/GalNAc crystals grow in the C2 space group with unit cell dimensions a=112.7, b=32.3, c=40.5 Å, β=91.7° with one complex molecule per asymmetric unit, and diffract to 2.2 Å resolution. The ASGR-1/Lactose structure was used as the starting molecule for molecular replacement, and model building and refinement were performed as described for the ASGR-1/Lactose complex to R=16.5 and $R_{free}$=23.0.

Structure analysis and distance calculations were performed with the program PyMOL(8).

REFERENCES

1. Meier, M., Bider, M. D., Malashkevich, V. N., Spiess, M., and Burkhard, P. (2000) Crystal structure of the carbohydrate recognition domain of the H1 subunit of the asialoglycoprotein receptor. Journal of molecular biology 300, 857-865
2. Battye, T. G., Kontogiannis, L., Johnson, O., Powell, H. R., and Leslie, A. G. (2011) iMOSFLM: a new graphical interface for diffraction-image processing with MOSFLM. Acta crystallographica 67, 271-281
3. Evans, P. (2006) Scaling and assessment of data quality. Acta crystallographica 62, 72-82
4. CCP4. (1994) The CCP4 suite: programs for protein crystallography. Acta crystallographica 50, 760-763
5. McCoy, A. J., Grosse-Kunstleve, R. W., Adams, P. D., Winn, M. D., Storoni, L. C., and Read, R. J. (2007) Phaser crystallographic software. Journal of applied crystallography 40, 658-674
6. Emsley, P., Lohkamp, B., Scott, W. G., and Cowtan, K. (2010) Features and development of Coot. Acta crystallographica 66, 486-501
7. Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., McCoy, A. J., Moriarty, N. W., Oeffner, R., Read, R. J., Richardson, D. C., Richardson, J. S., Terwilliger, T. C., and Zwart, P. H. (2010) PHENIX: a comprehensive Python-based system for macromolecular structure solution. Acta crystallographica 66, 213-221
8. DeLano, W. L. (2002) The PyMOL Molecular Graphics System. Palo Alto B. Crystal Structure of ASGR-1 Carbohydrate Binding Domain (CBD) with 5E5

The present example presents the crystal structure of the ASGR-1 CBD bound to the Fab fragment of 5E5, determined to 1.95 Å resolution (the conditions for which are described in the below). This structure, depicted in FIGS. 22A&B, shows that when 5E5 binds to/interacts with ASGR-1, a conformational rearrangement of the carbohydrate binding loop occurs, impairing the carbohydrate binding loop from binding to/interacting with ligand (i.e., carbohydrates). This demonstrates that the 5E5 Fab indirectly inhibits the ASGR-1 CBD/Ligand binding.

The depicted structure also allows one to identify specific core ASGR amino acid residues for the interaction interface of 5E5 with ASGR-1. This was defined as residues that are within 5 Å of the 5E5 protein. The core residues are as follows: H161, E162, W195, E196, Q198, K199, F200, Q202, H203, H204, G232, F233, K234, N235, W236, R237, P238, D261, G262, R263 (SEQ ID NO:5).

The structures were also used to identify boundary ASGR-1 amino acid residues for the interaction interface with 5E5. These residues were ASGR-1 residues that were from 5-8 Å of the 5E5 protein. The boundary residues are as follows: V159, E160, R163, T193, S194, E197, V201, I205, G206, P207, Y229, E230, T231, E239, F258, T259, D260, W264 (SEQ ID NO:5).

Specific core 5E5 amino acid residues of the interaction interface with ASGR-1 were defined as 5E5 residues that are within 5 Å of the ASGR-1 protein. The core 5E5 Heavy Chain residues include: S30, N31, W52, Y53, D54, S56, N57, Y59, Y101, S102, S103, G104, W105, Y106, D107; and the core 5E5 Light Chain residues include: 5E5 Light Chain: Q27, R30, D32, H91, Y92, S93, Y94.

Boundary 5E5 amino acid residues of the interaction interface with ASGR-1 were defined as 5E5 residues that are 5-8 Å from the ASGR-1 protein. The boundary 5E5 Heavy Chain residues include: Y32, V33, V50, G55, K58, N74, E99, V100, Y108; and the boundary 5E5 Light Chain residues include: 12, G28, 129, L33, Q90, P95, R96.

Methods

Expression and Purification of Protein Samples

The 5E5 Fab fragment was generated by cleaving the 5E5 mAb with caspase 3. Post caspase cleavage, the Fab was isolated by purification on a MonoS ion exchange column. Ni Sepharose Excel subtraction was then performed to ensure the Fc domain was removed from the sample.

5E5 mAb Heavy Chain (SEQ ID NO: 32695):

```
QVQLVESGGGVVQPGRSLRLSCAASGFTFSNYVMHWVRQAPGKGLEWVAV
IWYDGSNKYYADSVKGRFTISRDNSKNTLYLQMNSLRAEDTAVYYCTREV
YSSGWYDYGMDVWGQGTTVTVSSASTKGPSVFPLAPSSKSTSGGTAALGC
LVKDYFPEPVTVSWNSGALTSGVHTFPAVLQSSGLYSLSSVVTVPSSSLG
TQTYICNVNHKPSNTKVDKKVEPKSCGSDEVDGGDKTHTCPPCPAPELLG
GPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHY
TQKSLSLSPGHHHHHH
```

5E5 mAb Light Chain (SEQ ID NO:32696):

```
DIQMTQSPSSLSASVGDRVTITCRASQGIRNDLGWYQQKPGKAPKRLIYA
ASSLQSGVPSRFSGSGSGTEFTLTISSLQPEDFATYYCLQHYSYPRTFGQ
GTKVEVKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC
```

5E5 Fab Heavy Chain (Post Cleavage) (SEQ ID NO:32697):

```
QVQLVESGGGVVQPGRSLRLSCAASGFTFSNYVMHWVRQAPGKGLEWVAV
IWYDGSNKYYADSVKGRFTISRDNSKNTLYLQMNSLRAEDTAVYYCTREV
YSSGWYDYGMDVWGQGTTVTVSSASTKGPSVFPLAPSSKSTSGGTAALGC
LVKDYFPEPVTVSWNSGALTSGVHTFPAVLQSSGLYSLSSVVTVPSSSLG
TQTYICNVNHKPSNTKVDKKVEPKSCGSDEVD
```

5E5 Fab Light Chain (Post Cleavage) (SEQ ID NO:32698):

```
DIQMTQSPSSLSASVGDRVTITCRASQGIRNDLGWYQQKPGKAPKRLIYA
ASSLQSGVPSRFSGSGSGTEFTLTISSLQPEDFATYYCLQHYSYPRTFGQ
```

-continued

```
GTKVEVKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC
```

Complex Formation and Crystallization

The ASGR-1 CBD/5E5 Fab complex was made by mixing a molar excess of ASGR-1 CBD with 5E5 Fab. The complex was separated from excess ASGR-1 by purification on a size exclusion chromatography column. The ASGR-1 CBD/5E5 Fab complex was concentrated to 10 mg/ml and crystallizes in 0.1 M Tris pH 8.5, 12% PEG 4000.

Data Collection and Structure Determination

The dataset for the ASGR-1 CBD/5E5 Fab complex crystal was collected on beamline 5.0.2 at the Berkeley synchrotron and processed with Mosflm[1]/Aimless[2].

ASGR-1 CBD/5E5 Fab complex crystals grow in the P2$_1$ space group with unit cell dimensions a=62.93, b=41.75, c=118.89 Å and β=97.16 with one complex molecule per asymmetric unit, and diffract to 1.95 Å resolution. The ASGR-1 CBD/5E5 Fab complex structure was solved by molecular replacement with the program Molrep[2]. The structure was improved with multiple rounds of model building with Coot[3] and refinement with Phenix[4], to a final R=25.9/R$_{free}$=30.5. While the electron density for the ASGR-1 CBD and 5E5 Fab variable domain (along with the corresponding interface) is quite good, the electron density for the 5E5 constant domain is poor (most likely due to poor packing within the crystal lattice). This likely explains the higher R/R$_{free}$ observed from this structure refinement.

Core interaction interface amino acids were determined as being all amino acid residues with at least one non-hydrogen atom less than or equal to 5 Å from the partner protein. 5 Å was chosen as the core region cutoff distance to allow for atoms within a van der Waals radius plus a possible water-mediated hydrogen bond. Boundary interaction interface amino acids were determined as all amino acid residues with at least one non-hydrogen atom less than or equal to 8 Å from the partner protein but not included in the core interaction list. Less than or equal to 8 Å was chosen as the boundary region cutoff distance to allow for the length of an extended arginine amino acid. Amino acids that met these distance criteria were calculated with the program PyMOL[5].

REFERENCES

1. Battye, T. G., Kontogiannis, L., Johnson, O., Powell, H. R. & Leslie, A. G. iMOSFLM: a new graphical interface for diffraction-image processing with MOSFLM. *Acta Crystallogr D Biol Crystallogr* 67, 271-81 (2011).
2. CCP4. The CCP4 suite: programs for protein crystallography. *Acta Crystallogr D Biol Crystallogr* 50, 760-3 (1994).
3. Emsley, P., Lohkamp, B., Scott, W. G. & Cowtan, K. Features and development of Coot. *Acta Crystallogr D Biol Crystallogr* 66, 486-501 (2010).
4. Adams, P. D. et al. PHENIX: a comprehensive Python-based system for macromolecular structure solution. *Acta Crystallogr D Biol Crystallogr* 66, 213-21 (2010).
5. DeLano, W. L. The PyMOL Molecular Graphics System. (Palo Alto, 2002).

C. Crystal Structure of ASGR-1 Carbohydrate Binding Domain (CBD) with 22G5

The present example presents the crystal structure of the ASGR-1 CBD bound to the Fab fragment of 22G5, determined to 2.1 Å resolution (the conditions of which are described above in B). This structure, depicted in FIGS. 23A&B, shows that when 22G5 binds to/interacts with ASGR-1, a conformational rearrangement of the carbohydrate binding loop occurs, impairing the carbohydrate binding loop from binding to/interacting with ligand (i.e., carbohydrates). This demonstrates that the 22G5 Fab indirectly inhibits the ASGR-1 CBD/Ligand binding.

The depicted structure also allows one to identify specific core ASGR amino acid residues for the interaction interface of 22G5 with ASGR-1. This was defined as residues that are within 5 Å of the 22G5 protein. The core residues are as follows: W167, S171, G172, K173, A174, A176, D177, N180, Y181, R183, L184, E185, D186, Q270, P272, W275 (SEQ ID N0:5).

The structures were also used to identify boundary ASGR-1 amino acid residues for the interaction interface with 22G5. These residues were ASGR-1 residues that were from 5-8 Å of the 22G5 protein. The boundary residues are as follows: P155, N157, W158, F168, S169, R170, W175, A178, D179, C182, A187, W211, C269, R271, Y273, R274, C277, T279 (SEQ ID N0:5).

Specific core 22G5 amino acid residues of the interaction interface with ASGR-1 were defined as 22G5 residues that are within 5 Å of the ASGR-1 protein. The core 22G5 Heavy Chain residues include: A33, V50, I51, S52, R53, S54, G55, G56, Y57, Y59, R99, A101, A103, G104, E106; and the core 22G5 Light Chain residues include: 22G5 Light Chain: Y32, S91, Y92, R93, Thr94, Pro95, F97.

Boundary 22G5 amino acid residues of the interaction interface with ASGR-1 were defined as 22G5 residues that are 5-8 Å from the ASGR-1 protein. The boundary 22G5 Heavy Chain residues include: S30, S31, Y32, M34, N35, W47, S49, T58, R72, N74, L100, V102, S105; and the boundary 22G5 Light Chain residues include: 12, Q27, N28, NAG100, 129, S30, S31, Q90, L96.

Methods:

The same methods were followed as described above in Example 10B except for the following changes:

The 22G5 Fab fragment was generated by cleaving the 22G5-IgG4 mAb with papain;

The ASGR-1 CBD/22G5 Fab complex was concentrated to 8 mg/ml and crystallized in 0.1 Bis-Tris pH 6.5, 0.2 sodium malonate, 20% PEG 3350;

The dataset was processed with XDS/Aimless;

ASGR-1 CBD/22G5 Fab complex crystals grow in the P212121 space group with unit cell dimensions a=46.04, b=80.34, c=169.14 Å with one complex molecule per asymmetric unit, and diffract to 2.1 Å resolution; and The structure was improved with multiple rounds of model building with Coot3 and refinement with Phenix4, to a final R=17.8/R$_{free}$=22.5.

D. Crystal Structure of ASGR-1 Carbohydrate Binding Domain (CBD) with 4A2

The present example presents the crystal structure of the ASGR-1 CBD bound to the Fab fragment of 4A2, determined to 2.15 Å resolution (the conditions of which are described above in section B of this Example). This structure, depicted in FIGS. 24, 25 and 26, shows that when 4A2 binds to/interacts with ASGR-1, a conformational rearrangement of the carbohydrate binding loop occurs, impairing the carbohydrate binding loop from binding to/interacting with ligand (i.e., carbohydrates). This demonstrates that the 4A2 Fab indirectly inhibits the ASGR-1 CBD/Ligand binding.

The depicted structure also allows one to identify specific core ASGR amino acid residues for the interaction interface of 4A2 with ASGR-1. This was defined as residues that are within 5 Å of the 4A2 protein. The core residues are as follows: R170, W195, E196, K199, Q202, H203, H204, I205, G206, P207, V208, F233, K234, N235, W236, P238, D260, D261, G262, R263, R274 (SEQ ID NO:5).

The structures were also used to identify boundary ASGR-1 amino acid residues for the interaction interface with 4A2. These residues were ASGR-1 residues that were from 5-8 Å of the 4A2 protein. The boundary residues are as follows: N157, V159, F168, S169, S171, S194, Q198, F200, V201, T210, R237, E239, Q240, F258, T259, W264 (SEQ ID NO:5).

Specific core 4A2 amino acid residues of the interaction interface with ASGR-1 were defined as 4A2 residues that are within 5 Å of the ASGR-1 protein. The core 4A2 Heavy Chain residues include: T28, F29, T30, N31, Y32, D33, W50, H52, S55, N57, S99, S100, G101, W102, Y103; and the core 4A2 Light Chain residues include: 4A2 Light Chain: H31, S33, N34, N36, Y38, W56, Y97, Y98.

Boundary 4A2 amino acid residues of the interaction interface with ASGR-1 were defined as 4A2 residues that are 5-8 Å from the ASGR-1 protein. The boundary 4A2 Heavy Chain residues include: Y27, I34, N35, W47, M51, P53, N54, G56, T58, G59, Y104, D106; and the boundary 4A2 Light Chain residues include: I29, S32, N35, N37, Y55, T59, Q96, N99, T100.

The coordinates for the ASGR-1 CBD/4A2 crystal structure complex are presented in Table 10.2.

Methods:

The same methods were followed as described above in part B of this Example except for the following changes:

1. For this antibody only, a double stop codon was inserted at the end of CH$_1$ domain that allowed for expression of a 4A2 Fab. The Fab purification was carried out via an affinity and a cation exchanger column. The final sequence of 4A2 Fab is:

Heavy Chain (SEQ ID NO:32650):

QVQLVQSGTEVKKPGASVKVSCKASGYTFTNYDINWVRQATGQGLEWMGW

MHPNSGNTGYAQKFQGRVTLTRDTSISTAYMELSSLRSEDTAVYYCASSS

GWYYFDYWGQGTLVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCGSDEVDGGD

Light Chain (SEQ ID NO:32651):

DIVMTQSPDSLAVSLGERATINCKSSQSILHSSNNNNYLAWFQQKPGQPP

KLLLYWASTRESGVPDRFSGSGSGTDFTLTISSLQPEDVAVYYCQQYYNT

PVTFGPGTKVGIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC

1. The ASGR-1 CBD/4A2 Fab complex was concentrated to 20 mg/ml and crystallized in 0.2 M Tri-Lithium citrate and 20% PEG3350;
2. The ASGR-1 CBD/4A2 Fab complex crystals grow in the P212121 space group with unit cell dimensions a=63.42, b=76.37, c=156.67 Å with one complex molecule per asymmetric unit, and diffract to 2.15 Å resolution; and
3. The structure was improved with multiple rounds of model building with Coot[3] and refinement with Phenix[4], to a final R=17.9/R$_{free}$=21.8.

Crystal Structure of ASGR-1 Carbohydrate Binding Domain (CBD) with 7E11

The present example presents the crystal structure of the ASGR-1 CBD bound to the Fab fragment of 7E11, determined to 2.0 Å resolution (the conditions of which are described above in section B of this Example). This structure, depicted in FIGS. 27 and 28, shows that when 7E11 binds to/interacts with ASGR-1, a conformational rearrangement of the carbohydrate binding loop occurs, impairing the carbohydrate binding loop from binding to/interacting with ligand (i.e., carbohydrates). This demonstrates that the 7E11 Fab indirectly inhibits the ASGR-1 CBD/Ligand binding.

The depicted structure also allows one to identify specific core ASGR amino acid residues for the interaction interface of 7E11 with ASGR-1. This was defined as residues that are within 5 Å of the 7E11 protein. The core residues are as follows: H161, S194, W195, E196, Q198, K199, F200, Q202, H203, F233, K234, N235, W236, R237, P238, R263 (SEQ ID NO:5).

The structures were also used to identify boundary ASGR-1 amino acid residues for the interaction interface with 7E11. These residues were ASGR-1 residues that were from 5-8 Å of the 7E11 protein. The boundary residues are as follows: E160, E162, V192, T193, E197, V201, H204, Y229, E230, T231, G232, E239, Q240, P241, D261, G262, W264 (SEQ ID NO:5).

Specific core 7E11 amino acid residues of the interaction interface with ASGR-1 were defined as 7E11 residues that are within 5 Å of the ASGR-1 protein. The core 7E11 Heavy Chain residues include: S30, S31, I50, W52, H53, S56, N57, Y59, S01, M102, G103; and the core 7E11 Light Chain residues include: 130, Y32, T91, Y92, S93, T94, I96.

Boundary 7E11 amino acid residues of the interaction interface with ASGR-1 were defined as 7E11 residues that are 5-8 Å from the ASGR-1 protein. The boundary 7E11 Heavy Chain residues include: T28, F29, F32, G33, H35, W47, I51, D54, K58, D99, L100, G104; and the boundary 7E11 Light Chain residues include: 12, Q27, N28, 129, S31, L33, N34, T50, S67, Q89, Q90, P95.

Methods:

The same methods were followed as described above in part B of this example except for the following changes:

The 7E11 Fab fragment was generated by cleaving the 7E11 mAb with caspase 3:

7E11 mAb Heavy Chain (SEQ ID NO:32652):

QVQLVESGGGVVQPGRSLRLSCAASGFTFSSFGMHWVRQAPGKGLEWVAI

IWHDGSNKYYADSVKGRFTISRDNSNNTLYLQMSSLRAEDTAVYYCARDL

SMGGMDVWGQGTTVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKKVEPKSCGSDEVDGGDKTHTCPPCPAPELLGGPSVF

LFPPKPKDTLMISRTPEVTCVVVDVSHEDPEVKFNWYVDGVEVHNAKTKP

REEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNY

KTTPPVLDSDGSFFLYSKLTVDKSRWQQGNVFSCSVMHEALHNHYTQKSL

SLSPGHHHHHH

7E11 mAb Light Chain (SEQ ID NO:32653):

DIQMTQSPSSLSASVGDRVTIACRASQNIISYLNWYQQKPGKAPKFLIYT
ASSLQSGVPSRFSGSGSGTDFTLTISSLQPEDFAIYYCQQTYSTPLTFGG
GTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

7E11 Fab Heavy Chain (Post-Cleavage) (SEQ ID NO:32654):

QVQLVESGGGVVQPGRSLRLSCAASGFTFSSFGMHWVRQAPGKGLEWVAI
IWHDGSNKYYADSVKGRFTISRDNSNNTLYLQMSSLRAEDTAVYYCARDL
SMGGMDVWGQGTTVTVSSASTKGPSVFPLAPSSKSTSGGTAALGCLVKDY
FPEPVTVSWNSGALTSGVHTFPAVLQSSGLYSLSSVVTVPSSSLGTQTYI
CNVNHKPSNTKVDKKVEPKSCGSDEVD

7E11 Fab Light Chain (Post-Cleavage) (SEQ ID NO:32655):

DIQMTQSPSSLSASVGDRVTIACRASQNIISYLNWYQQKPGKAPKFLIYT
ASSLQSGVPSRFSGSGSGTDFTLTISSLQPEDFAIYYCQQTYSTPLTFGG
GTKVEIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

1. The ASGR-1 CBD/7E11 Fab complex was concentrated to 20 mg/ml and crystallized in 0.2 M Potassium Phosphate monobasic and 20% PEG3350;
2. The ASGR-1 CBD/7E11 Fab complex crystals grow in the P6222 space group with unit cell dimensions a=105.75, b=105.75, c=193.75 Å and γ=120.0° with one complex molecule per asymmetric unit, and diffract to 2.0 Å resolution;
3. The dataset was processed with XDS/CCP4;
4. The ASGR-1 CBD/7E11 Fab complex structure was solved by molecular replacement with the program Phaser; and
5. The structure was improved with multiple rounds of model building with Coot[3] and refinement with Phenix[4], to a final R=21.4/$R_{free}$=26.9.

E. Crystal Structure of ASGR-1 Carbohydrate Binding Domain (CBD) with 4H6

The present example presents the crystal structure of the ASGR-1 CBD bound to the Fab fragment of 4H6, determined to 2.6 Å resolution (the conditions of which are described above in section B of this Example). This structure, depicted in FIGS. 29 and 30, shows that when 4H6 binds to/interacts with ASGR-1, a conformational rearrangement of the carbohydrate binding loop occurs, impairing the carbohydrate binding loop from binding to/interacting with ligand (i.e., carbohydrates). This demonstrates that the 4H6 Fab indirectly inhibits the ASGR-1 CBD/Ligand binding.

The depicted structure also allows one to identify specific core ASGR amino acid residues for the interaction interface of 4H6 with ASGR-1. This was defined as residues that are within 5 Å of the 4H6 protein. The core residues are as follows: H161, E162, T193, S194, W195, E196, K199, Q202, T231, G232, F233, K234, N235, P238, D261, R263 (SEQ ID NO:5).

The structures were also used to identify boundary ASGR-1 amino acid residues for the interaction interface with 4H6. These residues were ASGR-1 residues that were from 5-8 Å of the 4H6 protein. The boundary residues are as follows: R163, V192, E197, Q198, H203, P207, D228, E230, W236, R237, D260, G262, W264 (SEQ ID NO:5).

Specific core 4H6 amino acid residues of the interaction interface with ASGR-1 were defined as 4H6 residues that are within 5 Å of the ASGR-1 protein. The core 4H6 Heavy Chain residues include: Y33, H35, W50, H52, S55, G57, T58, N59, D99, G100, T101, S102; and the core 4H6 Light Chain residues include: Q27, W32, A91, N92, S93, F94, F96.

Boundary 4H6 amino acid residues of the interaction interface with ASGR-1 were defined as 4H6 residues that are 5-8 Å from the ASGR-1 protein. The boundary 4H6 Heavy Chain residues include: D31, Y32, L34, W47, I51, N54, G56, Y60, Q65, S103, F104; and the boundary 4H6 Light Chain residues include: D1, I2, G28, I29, S30, R31, Y49, G50, Q89, Q90, P95.

Methods:

The same methods were followed as described above in part B of this example except for the following changes:
1. The 4H6 Fab fragment was generated by cleaving the 4H6 mAb with caspase 3.

4H6 mAb Heavy Chain (SEQ ID NO:32656):

QVQLVQSGAEVKKPGASVKVSCKASGYTFTDYYLHWVRQAPGQGLEWMGW
IHPNSGGTNYAQKFQGRVTMTRDTSISTAYMGLSSLRSDDTAVYYCARDG
TSSFDYWGQGTLVTVSSASTKGPSVFPLAPSSKSTSGGTAALGCLVKDYF
PEPVTVSWNSGALTSGVHTFPAVLQSSGLYSLSSVVTVPSSSLGTQTYIC
NVNHKPSNTKVDKKVEPKSCGSDEVDGGDKTHTCPPCPAPELLGGPSVFL
FPPKPKDTLMISRTPEVTCVVVDVSHEDPEVKFNWYVDGVEVHNAKTKPR
EEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYK
TTPPVLDSDGSFFLYSKLTVDKSRWQQGNVFSCSVMHEALHNHYTQKSLS
LSPGHHHHHH

4H6 mAb Light Chain (SEQ ID NO:32657):

DIQMTQSPSSVSASVGDRVTITCRASQGISRWLAWYQQKPGKAPKLLIYG
ASSLQSGVPSRFSGSGSGTDFTLTISSLQPEDFAIYYCQQANSFPFTFGP
GTKVDIKGTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

4H6 Fab Heavy Chain (Post-Cleavage) (SEQ ID NO:32658):

QVQLVQSGAEVKKPGASVKVSCKASGYTFTDYYLHWVRQAPGQGLEWMGW
IHPNSGGTNYAQKFQGRVTMTRDTSISTAYMGLSSLRSDDTAVYYCARDG
TSSFDYWGQGTLVTVSSASTKGPSVFPLAPSSKSTSGGTAALGCLVKDYF
PEPVTVSWNSGALTSGVHTFPAVLQSSGLYSLSSVVTVPSSSLGTQTYIC
NVNHKPSNTKVDKKVEPKSCGSDEVD

4H6 Fab Light Chain (Post-Cleavage) (SEQ ID NO:32659):

DIQMTQSPSSVSASVGDRVTITCRASQGISRWLAWYQQKPGKAPKLLIYG
ASSLQSGVPSRFSGSGSGTDFTLTISSLQPEDFAIYYCQQANSFPFTFGP
GTKVDIKGTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

2. The ASGR-1 CBD/4H6 Fab complex was concentrated to 20 mg/ml and crystallized in 0.2M Sodium fluoride, 0.1 M Bis Tris propane pH8.5, 20% PEG3350;
3. The dataset was collected on beamline ID22 at the APS synchrotron and processed with HKL2000/CCP4;
4. The ASGR-1 CBD/4H6 Fab complex crystals grow in the P1211 space group with unit cell dimensions a=57.20, b=43.58, c=131.65 Å and β=90.7° with one complex molecule per asymmetric unit, and diffract to 2.6 Å resolution;
5. The ASGR-1 CBD/4H6 Fab complex structure was solved by molecular replacement with the program Phaser; and
6. The structure was improved with multiple rounds of model building with Coot[3] and refinement with Phenix[4], to a final R=17.9/$R_{free}$=22.5.

F. Crystal Structure of ASGR-1 Carbohydrate Binding Domain (CBD) with 72G9

The present example presents the crystal structure of the ASGR-1 CBD bound to the Fab fragment of 72G9, determined to 2.55 Å resolution (the conditions of which are described above in section B of this Example). This structure, depicted in FIGS. 31 and 32A and 32B, shows that when 72G9 binds to/interacts with ASGR-1, the CDR H2 loop of the Fab fragment appears to directly block the ligand (i.e., carbohydrate) binding/interacting to ASGR-1 CBD. This demonstrates that the 72G9 Fab directly inhibits the ASGR-1 CBD/Ligand binding.

The deicted structure also allows one to identify specific core ASGR amino acid residues for the interaction interface of 72G9 with ASGR-1. This was defined as residues that are within 5 Å of the 72G9 protein. The core residues are as follows: D216, Q217, N218, G219, P220, W221, Y229, E230, K234, W236, E239, Q240, P241, D242, D243, W244, Y245, G246, L249, G250, G251, G252, D254, Q270 ((SEQ ID NO:5).

The structures were also used to identify boundary ASGR-1 amino acid residues for the interaction interface with 72G9. These residues were ASGR-1 residues that were from 5-8 Å of the 72G9 protein. The boundary residues are as follows: H215, K222, T231, G232, R237, P238, H247, G248, E253, C255, D266, V268, C269 (SEQ ID NO:5).

Specific core 72G9 amino acid residues of the interaction interface with ASGR-1 were defined as 72G9 residues that are within 5 Å of the ASGR-1 protein. The core 72G9 Heavy Chain residues include: G26, F27, T28, S30, S31, Y32, S33, S52, G53, S54, S56, Y57, Y59, R98, G100, S101, R102; and the core 72G9 Light Chain residues include: Y32, Y49, T50, Q55, S91, H92, S93, F94, F96.

Boundary 72G9 amino acid residues of the interaction interface with ASGR-1 were defined as 72G9 residues that are 5-8 Å from the ASGR-1 protein. The boundary 72G9 Heavy Chain residues include: V2, F29, N35, S50, T51, S55, I58, R72, G99, G103, F104, D105; and the boundary 72G9 Light Chain residues include: S28, I29, T30, N33, L46, S53, L54, S56, Q89, Q90, P95.

Methods:

The same methods were followed as described above in part B of this example except for the following changes:
1. The 72G9 Fab fragment was generated by cleaving the 72G9 mAb with caspase 3.

72G9 mAb Heavy Chain (SEQ ID NO:32660):

EVQLVESGGGLVKPGGSLRLSCAASGFTFSSYSMNWVRQAPGKGLEWVSS
ISGSSSYIYYADSVKGRFTISRDNAKNSLYLQMNSLRAEDTAVYFCARGG
SRGFDPWGQGTLVTVSSASTKGPSVFPLAPSSKSTSGGTAALGCLVKDYF
PEPVTVSWNSGALTSGVHTFPAVLQSSGLYSLSSVVTVPSSSLGTQTYIC
NVNHKPSNTKVDKKVEPKSCGSDEVDGGDKTHTCPPCPAPELLGGPSVFL
FPPKPKDTLMISRTPEVTCVVVDVSHEDPEVKFNWYVDGVEVHNAKTKPR
EEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYK
TTPPVLDSDGSFFLYSKLTVDKSRWQQGNVFSCSVMHEALHNHYTQKSLS
LSPGHHHHHH

72G9 mAb Light Chain (SEQ ID NO:32661):

DIQMTQSPSSLSASVGDRVTITCRASQSITSYLNWYQQKPGKAPKLLIYT
ASSLQSGVPSRFSGSGSGTDFTLTISSLQPEDFATYYCQQSHSFPFTFGP
GTKVDIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

72G9 Fab Heavy Chain (Post-Cleavage) (SEQ ID NO:32662):

EVQLVESGGGLVKPGGSLRLSCAASGFTFSSYSMNWVRQAPGKGLEWVSS
ISGSSSYIYYADSVKGRFTISRDNAKNSLYLQMNSLRAEDTAVYFCARGG
SRGFDPWGQGTLVTVSSASTKGPSVFPLAPSSKSTSGGTAALGCLVKDYF
PEPVTVSWNSGALTSGVHTFPAVLQSSGLYSLSSVVTVPSSSLGTQTYIC
NVNHKPSNTKVDKKVEPKSCGSDEVD

72G9 Fab Light Chain (Post-Cleavage) (SEQ ID NO:32663):

DIQMTQSPSSLSASVGDRVTITCRASQSITSYLNWYQQKPGKAPKLLIYT
ASSLQSGVPSRFSGSGSGTDFTLTISSLQPEDFATYYCQQSHSFPFTFGP
GTKVDIKRTVAAPSVFIFPPSDEQLKSGTASVVCLLNNFYPREAKVQWKV
DNALQSGNSQESVTEQDSKDSTYSLSSTLTLSKADYEKHKVYACEVTHQG
LSSPVTKSFNRGEC

2. The 72G9 Fab/ASGR-1 CBD complex was concentrated to 0.2 M Magnesium Sulfate heptahydrate, 20% PEG3350;
3. The ASGR-1 CBD/72G9 Fab complex crystals grew in the P21 space group with unit cell dimensions a=100.98, b=64.95, c=100.68 Å and β=96.43° with one complex molecule per asymmetric unit, and diffract to 2.55 Å resolution;

4. The dataset was processed with XDS/CCP4;

5. The ASGR-1 CBD/72G9 Fab complex structure was solved by molecular replacement with the program Phaser; and 6. The structure was improved with multiple rounds of model building with Coot[3] and refinement with Phenix[4], to a final R=20.4/$R_{free}$=23.4.

G. Crystal Structure of ASGR-1 Carbohydrate Binding Domain (CBD) with 194A4

The present example presents the crystal structure of the ASGR-1 CBD bound to the Fab fragment of 194A4, determined to 2.6 Å resolution (the conditions of which are described above in section B of this Example). This structure, depicted in FIGS. 33 and 34, shows that when 194A4 binds to/interacts with ASGR-1, a conformational rearrangement of the carbohydrate binding loop occurs, impairing the carbohydrate binding loop from binding to/interacting with ligand (i.e., carbohydrates). This demonstrates that the 194A4 Fab indirectly inhibits the ASGR-1 CBD/Ligand binding.

The depicted structure also allows one to identify specific core ASGR amino acid residues for the interaction interface of 194A4 with ASGR-1. This was defined as residues that are within 5 Å of the 194A4 protein. The core residues are as follows: T193, S194, W195, E196, P220, W221, G226, T227, D228, Y229, E230, T231, G232, F233, K234, N235, W236, R237, P238, E239, G252 (SEQ ID NO:5).

The structures were also used to identify boundary ASGR-1 amino acid residues for the interaction interface with 194A4. These residues were ASGR-1 residues that were from 5-8 Å of the 194A4 protein. The boundary residues are as follows: H161, E162, V191, V192, E197, Q198, D216, G219, K222, W223, D225, R263, W264 (SEQ ID NO:5).

Specific core 194A4 amino acid residues of the interaction interface with ASGR-1 were defined as 194A4 residues that are within 5 Å of the ASGR-1 protein. The core 194A4 Heavy Chain residues include: V31, Y32, Y33, W50, N52, S55, G57, R98, G99, Y100, D101, I102, T204; and the core 194A4 Light Chain residues include: V29, S30, I32, Y33, L47, Y50, R55, A56, T57, Y94.

Boundary 194A4 amino acid residues of the interaction interface with ASGR-1 were defined as 194A4 residues that are 5-8 Å from the ASGR-1 protein. The boundary 194A4 Heavy Chain residues include: V2, Y27, T30, L34, N35, P53, N54, G56, T58, N59, A97, L103, G105; and the boundary 194A4 Light Chain residues include: G28, N31, L48, I49, G51, N54, G58, I59, S68, G69, D93, S95.

Methods:

The same methods were followed as described above in part B of this example except for the following changes:

1. The 194A4 Fab fragment was generated by cleaving the 194A4 mAb with caspase 3.

194A4 mAb Heavy Chain (SEQ ID NO:326641:

QVQLVQSGTEVKKPGASLKVSCKASGYTFTVYYLNWVRQAPGQGLEWMGW

INPNSGGTNYAQKFQGRVTMTRDTSISTAYMELSRLRSDDTAVYYCARGY

DILTGWGQGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCGSDEVDGGDKTHTCPPCPAPELLGGPSVFLF

PPKPKDTLMISRTPEVTCVVVDVSHEDPEVKFNWYVDGVEVHNAKTKPRE

EQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKT

TPPVLDSDGSFFLYSKLTVDKSRWQQGNVFSCSVMHEALHNHYTQKSLSL

SPGHHHHHH

194A4 mAb Light Chain (SEQ ID NO:32665):

EIVLTQSPGTLSLSPGERATLSCRASRGVSNIYLAWYQQKPGQAPRLLIY

GASNRATGIPDRFSGSGSGTDFTLTISRLEPEDFAVYYCQHNDYSMFTFG

PGTKVDIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC

194A4 Fab Heavy Chain (Post-Cleavage) (SEQ ID NO:32666):

QVQLVQSGTEVKKPGASLKVSCKASGYTFTVYYLNWVRQAPGQGLEWMGW

INPNSGGTNYAQKFQGRVTMTRDTSISTAYMELSRLRSDDTAVYYCARGY

DILTGWGQGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCGSDEVD

194A4 Fab Light Chain (Post-Cleavage) (SEQ ID NO:32667):

EIVLTQSPGTLSLSPGERATLSCRASRGVSNIYLAWYQQKPGQAPRLLIY

GASNRATGIPDRFSGSGSGTDFTLTISRLEPEDFAVYYCQHNDYSMFTFG

PGTKVDIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC

2. The 194A4 Fab/ASGR-1 CBD complex was concentrated to 13.1 mg/mL and crystallized with 0.2 M Sodium chloride, 0.1M MES pH6.0, 20% PEG2000 MME;

3. The dataset was processed with XDS/CCP4;

4. The 194A4 Fab/ASGR-1 CBD complex crystals grow in the $P2_12_12_1$ space group with unit cell dimensions a=52.23, b=66.40, c=177.75 Å with one complex molecule per asymmetric unit, and diffract to 2.6 Å resolution;

5. The ASGR-1 CBD/194A4 Fab complex structure was solved by molecular replacement with the program Phaser; and 6. The structure was improved with multiple rounds of model building with Coot[3] and refinement with Phenix[4], to a final R=20.1/$R_{free}$=24.6.

H. Crystal Structure of ASGR-1 Carbohydrate Binding Domain (CBD) with 54E9

The present example presents the crystal structure of the ASGR-1 CBD bound to the Fab fragment of 54E9, determined to 2.6 Å resolution (the conditions of which are described above in section B of this Example). This structure, depicted in FIG. 35 and FIG. 36A and FIG. 36B, shows that when 54E9 binds to/interacts with ASGR-1, the CDR H3 loop of the Fab fragment appears to directly block the ligand (i.e., carbohydrate) from binding/interacting to ASGR-1 CBD. This demonstrates that the 54E9 Fab directly inhibits the ASGR-1 CBD/Ligand binding.

The depicted structure also allows one to identify specific core ASGR amino acid residues for the interaction interface of 54E9 with ASGR-1. This was defined as residues that are within 5 Å of the 54E9 protein. The core residues are as follows: W195, N209, N235, R237, P238, E239, Q240, D242, H257, T259, D260, D261, R263, N265, D267, R271, Y273 (SEQ ID NO:5).

The structures were also used to identify boundary ASGR-1 amino acid residues for the interaction interface with 54E9. These residues were ASGR-1 residues that were from 5-8 Å of the 54E9 protein. The boundary residues are as follows: Q198, Q202, P207, V208, F233, W236, D243, E253, F258, G262, W264, D266 (SEQ ID NO:5).

Specific core 54E9 amino acid residues of the interaction interface with ASGR-1 were defined as 54E9 residues that are within 5 Å of the ASGR-1 protein. The core 54E9 Heavy Chain residues include: N30, S31, Y32, S52, Y54, N55, K59, R98, D100, F101, W102, S103, G104, Y105, K107, D110; and the core 54E9 Light Chain residues include: none.

Boundary 54E9 amino acid residues of the interaction interface with ASGR-1 were defined as 54E9 residues that are 5-8 Å from the ASGR-1 protein. The boundary 54E9 Heavy Chain residues include: V2, Y27, T28, F29, G33, W50, A53, G56, N57, H99, Y106, G108; and the boundary 54E9 Light Chain residues include: N31, Y50, V51, Q54.

Methods:

The same methods were followed as described above in part B of this example except for the following changes:

1. The 54E9 Fab fragment was generated by cleaving the 54E9 mAb with caspase 3.

54E9 mAb Heavy Chain (SEQ ID NO:32668):

QVQLVQSGAEVKKPGASVKVSCKASGYTFNSYGISWVRLAPGQGLEWMGW

ISAYNGNTKNAQKLQGRVTMTTDTSTSTAYMELRSLRSDDTAVYYCARHD

FWSGYYKGMDVWGQGTTVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKKVEPKSCGSDEVDGGDKTHTCPPCPAPELLGG

PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYT

QKSLSLSPGHHHHHH

54E9 mAb Light Chain (SEQ ID NO: 32669):

QSVLTQPPSASGTPGQRVTISCSGSNSNIGNNIVTWYQQLPGTAPKLLIY

VNDQRPSGVPDRFSGSKSGTSASLAISGLQSEDEADYYCAAWDDSLNGWV

FGGGTTLTVLGQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

54E9 Fab Heavy Chain (Post-Cleavage) (SEQ ID NO:32670):

QVQLVQSGAEVKKPGASVKVSCKASGYTFNSYGISWVRLAPGQGLEWMGW

ISAYNGNTKNAQKLQGRVTMTTDTSTSTAYMELRSLRSDDTAVYYCARHD

FWSGYYKGMDVWGQGTTVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKKVEPKSCGSDEVD

54E9 Fab Light Chain (Post-Cleavage) (SEQ ID NO:32671):

QSVLTQPPSASGTPGQRVTISCSGSNSNIGNNIVTWYQQLPGTAPKLLIY

VNDQRPSGVPDRFSGSKSGTSASLAISGLQSEDEADYYCAAWDDSLNGWV

FGGGTTLTVLGQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

1. The 54E9 Fab/ASGR-1 CBD complex was concentrated to 14.8 mg/mL and crystallized with 0.2 M Magnesium Chloride hexahydrate, 20% PEG3350;

2. The dataset was processed with XDS/CCP4;

3. The 54E9 Fab/ASGR-1 CBD complex crystals grow in the 12 space group with unit cell dimensions a=64.66, b=41.65, c=224.59 Å and β=97.60° with one complex molecule per asymmetric unit, and diffract to 2.6 Å resolution;

4. The 54E9 Fab/ASGR-1 CBD complex structure was solved by molecular replacement with the program Phaser; and 5. The structure was improved with multiple rounds of model building with Coot[3] and refinement with Phenix[4], to a final R=19.1/$R_{free}$=25.9.

I. Crystal Structure of ASGR-1 Carbohydrate Binding Domain (CBD) with 218G4

The present example presents the crystal structure of the ASGR-1 CBD bound to the Fab fragment of 218G4, determined to 2.4 Å resolution (the conditions of which are described above in section B of this Example). This structure, depicted in FIGS. 37 and 38, shows that when 218G4 binds to/interacts with ASGR-1, it impairs its ability to bind to ligand (e.g., carbohydrate). This demonstrates that the 218G4 Fab directly inhibits the ASGR-1 CBD/Ligand binding.

The depicted structure also allows one to identify specific core ASGR amino acid residues for the interaction interface of 218G4 with ASGR-1. This was defined as residues that are within 5 Å of the 218G4 protein. The core residues are as follows: R170, S171, G172, A174, H204, I205, G206, P207, V208, N209, H257, D260, N265, D267, Q270, R271, P272, Y273, R274 (SEQ ID NO:5).

The structures were also used to identify boundary ASGR-1 amino acid residues for the interaction interface with 218G4. These residues were ASGR-1 residues that were from 5-8 Å of the 218G4 protein. The boundary residues are as follows: W167, F168, S169, K173, W175, D177, Y181, Q202, H203, T210, W211, R237, F258, T259, D261, D266, V268, C269, W275 (SEQ ID NO:5).

Specific core 218G4 amino acid residues of the interaction interface with ASGR-1 were defined as 218G4 residues that are within 5 Å of the ASGR-1 protein. The core 218G4 Heavy Chain residues include: Q1, V2, F27, S30, S31, Y32, Y53, D54, W99, Y100, Y101, Y102; and the core 218G4 Light Chain residues include: Y33, Y50, D51, N53, K54, S57.

Boundary 218G4 amino acid residues of the interaction interface with ASGR-1 were defined as 218G4 residues that are 5-8 Å from the ASGR-1 protein. The boundary 218G4 Heavy Chain residues include: G26, T28, F29, G33, W52, G55, R72, N74, N98, Y103, Y104, D107, V108; and the boundary 218G4 Light Chain residues include: V34, S52, R55, P56, G58, G65.

The coordinates for the ASGR-1 CBD/GalNAc crystal structure complex are presented in Table 10.3.

Methods:

The same methods were followed as described above in part B of this example except for the following changes:

1. The 218G4 Fab fragment was generated by cleaving the 218G4 mAb with caspase 3.

218G4 mAb Heavy Chain (SEQ ID NO:32672):

QVQLVESGGGVVQPGRSLRLSCAASGFTFSSYGLHWVRQAPGKGLEWVAV

IWYDGSNKYYADSVKGRFTISRDNSKNTLYLQMNSLRVEDTAVYYCANWY

YYYYGMDVWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCGSDEVDGGDKTHTCPPCPAPELLGGPSV

FLFPPKPKDTLMISRTPEVTCVVVDVSHEDPEVKFNWYVDGVEVHNAKTK

PREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQKS

LSLSPGHHHHHH

218G4 mAb Light Chain (SEQ ID NO: 32673):

QSVLTQPPSVSAAPGQKVTISCSGSSSNIGNNYVSWYQQLPGTAPKLLLY

DSNKRPSGIPARFSGSKSGTSATLGITGLQTGDEADYYCGTWDSSLNTVV

FGGGTKLTVLSQPKAAPSVTLFPPSSEELQANKATLVCLISDFYPGAVTV

AWKADSSPVKAGVETTTPSKQSNNKYAASSYLSLTPEQWKSHRSYSCQVT

HEGSTVEKTVAPTECS

218G4 Fab Heavy Chain (Post-Cleavage)(SEQ ID NO: 32674):

QVQLVESGGGVVQPGRSLRLSCAASGFTFSSYGLHWVRQAPGKGLEWVAV

IWYDGSNKYYADSVKGRFTISRDNSKNTLYLQMNSLRVEDTAVYYCANWY

YYYYGMDVWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCGSDEVD

218G4 Fab Light Chain (Post-Cleavage):

Same sequence as 218G4 mAb Light chain

1. The 218G4 Fab/ASGR-1 CBD complex was concentrated to 16.4 mg/mL and crystallized with 0.1M Tris pH8 and 1.6M Lithium Sulfate;

2. The dataset was collected from a single crystal on beamline ID22 at the Argonne National Laboratory and processed with XDS/CCP4;

3. The 218G4 Fab/ASGR-1 CBD complex crystals grow in the C222 space group with unit cell dimensions a=137.24, b=245.26, c=118.91 Å with two complex molecules per asymmetric unit and diffract to 2.6 Å resolution;

4. The 218G4 Fab/ASGR-1 CBD complex structure was solved by molecular replacement with the program Phaser; and 5. The structure was improved with multiple rounds of model building with Coot[3] and refinement with Phenix[4], to a final $R_{factor}=18.4/R_{free}=21.6$.

J. Crystal Structure of ASGR-1 Carbohydrate Binding Domain (CBD) with 176H4

The present example presents the crystal structure of the ASGR-1 CBD bound to the Fab fragment of 176H5, determined to 2.3 Å resolution (the conditions of which are described above in section B of this Example). This structure, depicted in FIGS. 39 and 40, show that when 176H4 binds to/interacts with ASGR-1, it appears to block ligand (e.g., carbohydrate) binding by ASGR-1 CBD, with the paratope of the 176H4 antibody located directly on top of the carbohydrate binding pocket. This demonstrates that the 174H4 Fab directly inhibits the ASGR-1 CBD/Ligand binding.

The depicted structure also allows one to identify specific core ASGR amino acid residues for the interaction interface of 176H4 with ASGR-1. This was defined as residues that are within 5 Å of the 176H4 protein. The core residues are as follows: R170, S171, G172, K173, A174, D177, P207, V208, N209, R237, Q240, W244, G246, H247, G248, L249, E253, H257, T259, D260, N265, D267, Q270, R271, P272, Y273, R274 (SEQ ID NO:5).

The structures were also used to identify boundary ASGR-1 amino acid residues for the interaction interface with 176H4. These residues were ASGR-1 residues that were from 5-8 Å of the 176H4 protein. The boundary residues are as follows: S169, W175, A176, A178, T210, W211, W236, P238, E239, D242, Y245, G250, G251, F258, D261, G262, R263, W264, D266, V268, C269, W275 (SEQ ID NO:5).

Specific core 176H4 amino acid residues of the interaction interface with ASGR-1 were defined as 176H4 residues that are within 5 Å of the ASGR-1 protein. The core 176H4 Heavy Chain residues include: S31, W52, Y53, D54, Y57, Y59, D102, F103, W104; and the core 176H4 Light Chain residues include: H31, G32, D33, G34, K35, Y37, I97, Q98, I99.

Boundary 176H4 amino acid residues of the interaction interface with ASGR-1 were defined as 176H4 residues that are 5-8 Å from the ASGR-1 protein. The boundary 176H4 Heavy Chain residues include: T28, S30, Y32, G33, W47, I50, I51, S56, K58, Y60, K65, D99, H101, S105, G106; and the boundary 176H4 Light Chain residues include: I2, Q27, S28, L29, L30, T36, E55, Q95, S96, P100, W101.

Methods:

The same methods were followed as described above in part B of this example except for the following changes:

1. The 176H4 Fab fragment was generated by cleaving the 176H4 mAb with caspase 3.

176H4 mAb Heavy Chain (SEQ ID NO:32675):

QVQLVESGGGVVQPGRSLRLSCAASGFTFSSYGMHWVRQAPGKGLEWVAI

IWYDGSYKYYADSVKGRFTISRDNSKNTLYLQMSSLRAEDTAVYYCARDA

HDFWSGYFAYWGQGALVTVSSASTKGPSVFPLAPSSKSTSGGTAALGCLV

```
KDYFPEPVTVSWNSGALTSGVHTFPAVLQSSGLYSLSSVVTVPSSSLGTQ

TYICNVNHKPSNTKVDKKVEPKSCGSDEVDGGDKTHTCPPCPAPELLGGP

SVFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTISK

AKGQPREPQVYTLPPSREEMTKNQVSLTCLVKGFYPSDIAVEWESNGQPE

NNYKTTPPVLDSDGSFFLYSKLTVDKSRWQQGNVFSCSVMHEALHNHYTQ

KSLSLSPGHHHHHH
```

176H4 mAb Light Chain (SEQ ID NO: 32676):

```
DIVMTQTPLSLSVTPGQPASISCKSSQSLLHGDGKTYLYWYLQKPGQPPQ

LLIYEVSNRFSGVPDRFSGSGSGTDFTLKISRVEAEDVGIYYCMQSIQIP

WTFGQGTRVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC
```

176H4 Fab Heavy Chain (Post-Cleavage)(SEQ ID NO:32677):

```
QVQLVESGGGVVQPGRSLRLSCAASGFTFSSYGMHWVRQAPGKGLEWVAI

IWYDGSYKYYADSVKGRFTISRDNSKNTLYLQMSSLRAEDTAVYYCARDA

HDFWSGYFAYWGQGALVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKKVEPKSCGSDEVD
```

176H4 Fab Light Chain (Post-Cleavage): Same sequence as 176H4 mAb Light chain

1. The 176H4 Fab/ASGR-1 CBD complex was concentrated to 14.9 mg/mL and crystallized 1 with 0.2 M Sodium Nitrate, 20% PEG3350;
2. The dataset was collected from a single crystal on beamline ID22 at the Argonne National Laboratory and processed with XDS/CCP4;
3. The 176H4 Fab/ASGR-1 CBD complex crystals grow in the 1121 space group with unit cell dimensions a=68.31, b=126.31, c=134.13 Å and β=101.6° with two complex molecules per asymmetric unit, and diffract to 2.3 Å resolution;
4. The 176H4 Fab/ASGR-1 CBD complex structure was solved by molecular replacement with the program Phaser; and
5. The structure was improved with multiple rounds of model building with Coot[3] and refinement with Phenix[4], to a final $R_{factor}$=17.9/$R_{free}$=23.3.

K. Crystal Structure of ASGR-1 Carbohydrate Binding Domain (CBD) with 194C10

The present example presents the crystal structure of the ASGR-1 CBD bound to the Fab fragment of 194C10, determined to 2.6 Å resolution (the conditions of which are described above in section B of this Example). This structure, depicted in FIGS. 41 and 42, shows that when 194C10 binds to/interacts with ASGR-1, it likely induces a conformational rearrangement of the carbohydrate binding loop, impairing ASGR-1 CBD from binding to ligand (e.g., carbohydrate), as well as possibly blocking the ligand (e.g., carbohydrate) binding by ASGR-1 CBD, with the paratope of the 194C10 Fab. These data indicate that the 174H4 Fab may directly and/or indirectly inhibit the ASGR-1 CBD/Ligand binding.

The depicted structure also allows one to identify specific core ASGR amino acid residues for the interaction interface of 194C10 with ASGR-1. This was defined as residues that are within 5 Å of the 194C10 protein. The core residues are as follows: N157, R170, S171, G172, Q202, H203, H204, I205, G206, P207, V208, N209, T210, D260, R271, P272, Y273, R274 (SEQ ID NO:5).

The structures were also used to identify boundary ASGR-1 amino acid residues for the interaction interface with 194C10. These residues were ASGR-1 residues that were from 5-8 Å of the 194C10 protein. The boundary residues are as follows: V156, W158, V159, H161, W167, F168, S169, K173, K199, F200, V201, W211, R237, H257, F258, T259, D261, D267, V268, Q270, W275 (SEQ ID NO:5).

Specific core 194C10 amino acid residues of the interaction interface with ASGR-1 were defined as 194C10 residues that are within 5 Å of the ASGR-1 protein. The core 194C10 Heavy Chain residues include: R30, Y31, Y33, E50, S54, S56, N58, D98, Y99, G100; and the core 194C10 Light Chain residues include: N30, S31, Y33, F50, S54, S68, Y92, E93, W97.

Boundary 194C10 amino acid residues of the interaction interface with ASGR-1 were defined as 194C10 residues that are 5-8 Å from the ASGR-1 protein. The boundary 194C10 Heavy Chain residues include: S28, Y32, W34, S35, W47, G49, I51, S52, H53, G55, T57, R97, A101, F102, D103; and the boundary 194C10 Light Chain residues include: S28, V29, G32, L47, G51, A52, S53, R55, A56, G69, Q90, Q91, S94, S95.

The coordinates for the ASGR-1 CBD/GalNAc crystal structure complex are presented in Table 10.4.

Methods:

The same methods were followed as described above in part B of this example except for the following changes:
1. 194C10 Fab fragment was generated by cleaving the 194C10 mAb with caspase 3.

194C10 mAb Heavy Chain (SEQ ID NO:32678):

```
QVQLQQWGAGLLKPSETLSLTCAVSGGSFRYYYWSWIRQPPGKGLEWFGE

INHAGSTNYNPSLKSRVTISIDTSKNQFSLKLRSVTAADTAVYYCARDYG

AFDIWGQGTMVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKKVEPKSCG
```

194C10 mAb Light Chain (SEQ ID NO:32679):

```
EIVLTQSPGTLSLSPGERATLSCRASPSVNSGYLAWYQQKPGQTPRLLIF

GASSRATGIPDRFSASGSGADFTLTISRLEPEDFAVYFCQQYESSPWTFG

QGTKVEIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC*
```

194C10 Fab Heavy Chain (Post-Cleavage)(SEQ ID NO:32680):

```
QVQLQQWGAGLLKPSETLSLTCAVSGGSFRYYYWSWIRQPPGKGLEWFGE

INHAGSTNYNPSLKSRVTISIDTSKNQFSLKLRSVTAADTAVYYCARDYG
```

-continued
AFDIWGQGTMVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKKVEPKSCGSDEVD

194C10 Fab Light Chain (Post-Cleavage):

Same sequence as 194C10 mAb Light chain

1. The 194C10 Fab/ASGR-1 CBD complex was concentrated to 13.6 mg/mL and crystallized with 0.2 M Ammonium Sulfate, 0.1 M Tris pH7.5, 20% PEG5000MME;

2. The dataset was collected from a single crystal on beamline ID22 at the Argonne National Laboratory and processed with XDS/CCP4;

3. The 194C10 Fab/ASGR-1 CBD complex crystals grow in the P1211 space group with unit cell dimensions a=65.62, b=130.44, c=85.93 Å and β=111.6° with two complex molecules per asymmetric unit, and diffract to 2.6 Å resolution;

4. The 194C10 Fab/ASGR-1 CBD complex structure was solved by molecular replacement with the program Phaser; and 5. The structure was improved with multiple rounds of model building with Coot[3] and refinement with Phenix[4], to a final $R_{factor}$=17.1/Rfree=22.8.

L. Interaction between GalNAc, ASGR-1 and certain Antibodies

The structure of the 72G9/ASGR-1 complex (Item G above) was overlaid on the ASGR-1/ligand (GalNac) structure (Item A above) and the result of this combination is depicted in FIG. 31B. The structure of the 54E9/ASGR-1 complex (Item I above) was also overlaid on the ASGR-1/ligand (GalNac) structure (Item A above) and the result of this combination is depicted in FIG. 35B. The structure of the 218G4/ASGR-1 complex (Item J above) was overlaid on the ASGR-1/ligand (GalNac) structure (Item A above) and the result of this combination is depicted in FIG. 38. The structure of the 176H4/ASGR-1 complex (Item K above) was overlaid on the ASGR-1/ligand (GalNac) structure (Item A above) and the result of this combination is depicted in FIG. 40. These figures demonstrate areas on ASGR-1 which can be usefully targeted to inhibit ASGR-1 interaction with a ligand, e.g., GalNac. These figures show that 72G9, 54E9, 218G4 and 176H4 directly interact with a subset of amino acid residues that are specifically involved in binding to the ligand (e.g., GalNAc).

As noted above, analysis of the crystal structures identified specific amino acids involved in the interaction between ASGR-1 and the partner proteins (the core and boundary regions of the interface on the ASGR-1 surface) and the spatial requirements of these partner proteins to interact with ASGR-1. The structures suggest ways to inhibit the interaction between ASGR-1 and a ligand, GalNAc. First, as noted above, binding an agent to ASGR-1 where it shares residues in common with the binding site of a ligand such as GalNAc would inhibit the interaction between ASGR-1 and the ligand. Second, an agent that binds outside of the residues in common can sterically interfere with the ligand that are either N- or C-terminal to the ligand to prevent the interaction between ASGR-1 and a ligand.

In some embodiments, the residues that are involved in both ligand binding and are close to the areas where the above noted antigen binding proteins bind are especially useful for manipulating ASGR-1 binding to ligand. For example, amino acid residues from interfaces in common in both the core region and boundary region for the different binding partners are listed in Table 10.5 below.

TABLE 10.5

| Parameters | Amino acid position(s) |
|---|---|
| 72G9/GalNAc both under 5 Å | Q240, D242, W244 |
| 72G9 under 5 Å/GalNAc 5-8 Å | E239, P241, D243, Y245, G246, G252 |
| 72G9 at 5-8 Å/GalNAc under 5 Å | R237, E253 |
| 72G9/GalNAc both at 5-8 Å | P238, H247, C255, V268 |
| 54E9/GalNAc both under 5 Å | N209, R237, Q240, D242, H257, T259, N265, D267, Y273 |
| 54E9 under 5 Å/GalNAc 5-8 Å | P238, E239, D260, R263, R271 |
| 54E9 at 5-8 Å/GalNAc under 5 Å | E253, D266 |
| 54E9/GalNAc both at 5-8 Å | D243, F258, W264 |
| 218G4/GalNAc both under 5 Å | N209, H257, N265, D267, Y273 |
| 218G4 under 5 Å/GalNAc 5-8 Å | D260, R271 |
| 218G4 at 5-8 Å/GalNAc under 5 Å | R237, T259, D266 |
| 218G4/GalNAc both at 5-8 Å | F258, V268 |
| 176H4/GalNAc both under 5 Å | N209, R237, Q240, W244, E253, H257, T259, N265, D267, Y273 |
| 176H4 under 5 Å/GalNAc 5-8 Å | G246, H247, D260, R271 |
| 176H4 at 5-8 Å/GalNAc under 5 Å | D266 |
| 176H4/GalNAc both at 5-8 Å | P238, E239, Y245, F258, R263, W264, V268 |

As will be appreciated by one of skill in the art, in some embodiments, the antigen binding proteins bind to and/or block at least one of the above noted residues.

Antigen binding proteins and molecules that interact with the relevant areas or residues of the structure of ASGR-1 (including those areas or residues within 15, 15-8, 8, 8-5, 5, or fewer angstroms from where ligands, such as GalNAc, or the antibodies, interact with ASGR-1) depicted in the figures (e.g., FIGS. 19-42) and/or their corresponding positions on the structures from the coordinates are also contemplated.

Example 11: Determination of the Binding Affinity of ASGR-1 Specific Antibodies

To quantitate the binding affinity of specific antibodies for ASGR-1 (either purified from hybridoma supernatants or made recombinantly), association and dissociation rates can be measured using a ForteBio Octet instrument. The antibodies were covalently coupled to AR2G tips to load levels close to 2 nm and then bound to the soluble human ASGR-1 carbohydrate binding domain (CBD; amino acid residues 154-281; N-terminal 6xHis tag) in a 3-fold serial dilution series starting typically at 30 nM with either 3-point or 6-point dilution series. Experimental kinetic results were globally fit to a 1:1 binding model in order to determine the association and dissociation rate constants as well as the equilibrium dissociation constant. Association and dissociation times were chosen to ensure that curvature was present during association curves and measured dissociation levels dropped at least 5% from starting levels. All Octet buffers contained 10 mM Tris (pH7.5), 150 mM NaCl, 1 mM $CaCl_2$), 0.10 mg/ml BSA and 0.13% Triton X-100. Octet assays were run at 27° C. Because this assay only measures binding to the ASGR-1 CBD, antibodies that recognize epitopes partially or entirely outside the CBD and/or recognize ASGR-1 in the context of a native ASGR complex, for example, as could occur on cell membranes, may not score as positive in this assay. Data provided for representative antibodies in TABLE 11.1.

TABLE 11.1

| Ab name | Octet binding $K_D$ (nM) |
|---|---|
| 4H6 | 4.8 |
| 4B1 | >30 |
| 4A2 | 0.06 |
| 5E5 | 7.6 |
| 6G7 | 2.0 |
| 7G4 | 0.9 |
| 7F4 | 1.2 |
| 7E11 | 1.6 |
| 12D2 | >30 |
| 22G5 | 1.4 |
| 25A4 | 0.03 |
| 26C4 | 0.4 |
| 29H8 | 1.0 |
| 48B12 | 0.3 |
| 54E9 | >30 |
| 56E5 | 0.5 |
| 72G9 | 0.5 |
| 75G3 | 1.0 |
| 176H4 | 0.8 |
| 184E7 | 0.3 |
| 190F8 | 0.6 |
| 191G1 | 2.4 |
| 191G10 | 0.5 |
| 193E7 | 3.5 |
| 194A4 | 0.7 |
| 194C1 | 1.3 |
| 194C10 | 4 |
| 197G3 | 0.8 |
| 198D2 | >30 |
| 198G3 | 0.04 |
| 202A3 | >30 |
| 218G4 | 2.6 |
| 4A2.001 | 0.06 |
| 4A2.001.003 | 0.04 |
| 4A2.001.004 | 0.03 |
| 4A2.001.005 | 0.02 |
| 4A2.001.010 | 0.04 |
| 4A2.001.012 | 0.04 |
| 25A4.001 | 0.06 |
| 25A4.001.021 | 0.04 |
| 4H6.009 | 0.28 |
| 7E11.001 | 0.71 |
| 7E11.001.005 | 0.42 |
| 7E11.001.007 | 0.62 |
| 5E5.016 | 1.46 |
| 5E5.019 | 1.80 |
| 5E5.005 | 2.00 |

Example 12: CHO—S:huASGR-1 Cell Binding Assay

CHO—S stable high-expressing cell line were developed for both human ASGR-1 as well as mouse ASGR-1. A typical 384 well plate multiplex flow cytometry-based cell binding method is described as followed: Parental CHO—S cells and CHO—S:huASGR-1 cells were respectively labeled using a CellTrace CFSE Cell Proliferation Kit (ThermoFisher Catalog #C34554) and CellTrace Violet Cell Proliferation Kit (ThermoFisher Catalog #C34557) CHO—S: muASGR-1 were not labeled. 20 ul of cells at 4° C. were added to duplicate wells of the 384 well plate. The cells were equally mixed from all three cell lines (30K cells/well). Then 20 ul of the ASGR-1 antibodies (either purified from hybridoma supernatants or made recombinantly) were added in an 11-point dose response using a 1:2 fold serial dilution starting at 100 nM. The cells and antibodies were incubated for 30 min at 4° C. and then spun down and washed twice with FACS buffer containing 1 mM CaCl2. 30 ul of anti-huIgG-APC secondary antibodies were then added at a 1:1000 dilution for 30 min at 4° C. and then washed once with the same buffer. 60 ul of PI (1:1000) was added and then the cells were read by a core flow cytometry facility. The cells were gated first for live cells, then for single cells and finally for the cell dyes to separate the mixed cells into the three different cell populations. Histograms of signal vs count representing the binding profile of each antibody at each antibody concentration were automatically analyzed for the median of the binding signal and then a binding graph was made with log 10 antibody concentration in nM on the X axis with standard deviation of the median signals from the duplicate wells on the Y-axis. The binding curves were fit with a standard four parameter sigmoidal binding curve and EC50's reported for all graphs with full curves. Data provided for representative antibodies in TABLE 12.1.

TABLE 12.1

| Ab name | Cell binding EC50 (nM) |
|---|---|
| 4H6 | 1.70 |
| 4B1 | 4.1 |
| 4A2 | 0.82 |
| 4A2.001 | 1.8 |
| 5E5 | 3.80 |
| 6G7 | 0.6 |
| 7G4 | 0.69 |
| 7F4 | 5.40 |
| 7E11 | 1.40 |
| 7E11.001 | 3.2 |
| 12D2 | 3.2 |
| 22G5 | 7.2 |
| 25A4 | 1.6 |
| 25A4.001 | 1.2 |
| 26C4 | 11 |
| 29H8 | 1.9 |
| 48B12 | 38 |
| 54E9 | 5 |
| 56E5 | 1.1 |
| 72G9 | 0.41 |
| 75G3 | 1 |
| 176H4 | 1 |
| 184E7 | 1 |
| 190F8 | 9 |
| 191G1 | 0.16 |
| 191G10 | 0.31 |
| 193E7 | 0.13 |
| 194A4 | 25 |
| 194C1 | 0.11 |
| 194C10 | 0.56 |
| 197G3 | 0.25 |
| 198D2 | 0.14 |
| 198G3 | 0.21 |
| 202A3 | 0.8 |
| 218G4 | 2.2 |

For human ASGR-2, CHO—S stable cells expressing C-terminal His-tagged human ASGR-2 were resuspended in cold flow buffer (10 mM Tris, pH 7.5, 137 mM NaCl, 1 mM CaCl2 and 2% fetal bovine serum) and 1.5×10e6 cells per well were added to a 96-well, v-bottom plate in a volume of 80 ul. 80 ul of antibody at 400 nM was then added to each well. After incubation on ice for 30 min, the cells were centrifuged at 1400 rpm for 3 min and then washed twice in cold flow buffer. The cells were then resuspended in 120 ul of anti-human IgG-APC (diluted 1:1000 in flow buffer) and incubated on ice for 30 minutes, centrifuged and washed twice as before, and resuspended in 200 ul cold flow buffer, and then analyzed on a BD-LSR II flow cytometer. Data provided for antibody 7F4 in FIG. 43.

Example 13: CHO—S:huASGR-1 Ligand Blocking Assay

All ASGR-1 antibodies that bound either human or mouse ASGR-1 stable CHO—S cells were then tested for ligand blocking using both a protein ligand and a synthetic sugar ligand. The method in brief is as follows: first, 20 ul of either CHO-Shuman or mouse ASGR-1 cells were added to wells of a 384 well plate (30 k cells/well) followed by spin and discarding the supernatant. Second, 10 ul of the antibodies (either purified from hybridoma supernatants or made recombinantly) were added in duplicate to the cells in a dilution series (200 nM top concentration, 1:2 serial dilution, 11 point curve) and were incubated for 30 min at 4° C. Third, 10 ul of the minimally biotinylated ligands were added at 2× their binding EC05, so that the wells contained a final 20 ul volume with Ab starting at 100 nM and the ligand at their EC50. After 30 min incubation at 4° C., the plate was spun and washed twice with FACS buffer+1 mM CaCl2 followed by the detection streptavidin-AF647 at 1:1000 dilution. After 30 min at 4° C., the cells were spun and washed once and then 60 ul PI added at 1:1000 dilution and the plates delivered to a core flow cytometry facility. The plates were read and processed similarly to the cell binding method except the signal now represents an inhibition curve and typically decreases a function of increasing antibody concentration. IC50 nM potency and % Inhibition were reported. The desialylated, biotinylated asialofetuin (see Example 9A) and biotinylated GALNAc-PAA (Fisher #NC9024754) were used as ligands with measured binding EC50s of 10.7 and 5.4 nM. Differences in the ability of antibodies to block these two ligands could occur as a result of differences in, for example, avidity stemming from differences in the number and/or orientation of the ASGR binding terminal sugar residues of each ligand, steric hindrance between antibody and each ligand, and/or changes in the conformation of ASGR induced by antibody binding that selectively alters the binding of each ligand. Data provided for representative antibodies in TABLE 13.1.

TABLE 13.1

| | Ligand Blocking | | | |
|---|---|---|---|---|
| | bn-GalNAc-PAA | | bn-asialofetuin | |
| Ab name | IC50 (nM) | % Inhibition | IC50 (nM) | % Inhibition |
| 4H6 | 8.1 | 20% | 12 | 85% |
| 4B1 | 42 | 36% | 64 | 75% |
| 4A2 | 54 | 70% | 11 | 99% |
| 4A2.001 | 28 | 75 | 12 | 99 |
| 5E5 | >200 | 0% | 16 | 95% |
| 6G7 | >200 | 0% | 11 | 99% |
| 7G4 | 20 | −30% | 14 | 96% |
| 7F4 | 0.24 | 30% | 2.6 | 99% |
| 7E11 | 40 | 37% | 13 | 99% |
| 7E11.001 | >100 | 50 | 13 | 99 |
| 12D2 | 2.1 | 10% | 10 | 20% |
| 22G5 | 11 | 93% | 3.4 | 99% |
| 25A4 | 40 | 77% | 11 | 99% |
| 25A4.001 | 31 | 68 | 8.1 | 99 |
| 26C4 | 36 | 83% | 6.6 | 99% |
| 29H8 | 17 | 99% | 7 | 99% |
| 48B12 | 86 | 94% | 19 | 99% |
| 54E9 | 100 | 19% | 50 | 75% |
| 56E5 | 45 | 99% | 23 | 99% |
| 72G9 | 24 | 20% | 53 | 20% |
| 75G3 | 115 | 99% | 29 | 99% |
| 176H4 | 73 | 79% | 59 | 99% |
| 184E7 | 10 | 99% | 23 | 99% |
| 190F8 | 44 | 83% | 34 | 98% |
| 191G1 | 62 | 78% | 24 | 99% |
| 191G10 | 56 | 99% | 27 | 99% |
| 193E7 | 33 | 60% | 30 | 99% |
| 194A4 | 48 | 60% | 57 | 99% |
| 194C1 | 72 | 89% | 34 | 99% |
| 194C10 | 87 | 99% | 30 | 99% |

TABLE 13.1-continued

| | Ligand Blocking | | | |
|---|---|---|---|---|
| | bn-GalNAc-PAA | | bn-asialofetuin | |
| Ab name | IC50 (nM) | % Inhibition | IC50 (nM) | % Inhibition |
| 197G3 | 15 | 74% | 29 | 90% |
| 198D2 | 55 | 99% | 22 | 99% |
| 198G3 | 5 | 81% | 26 | 99% |
| 202A3 | 32 | 96% | 16 | 98% |
| 218G4 | 71 | 99% | 28 | 99% |

Example 14: ASGR-1 Specific Antibody Optimization (Chemical Degradation Site Engineering)

Variable domain sequence motifs having a high risk of sidechain degradation were engineered out of ASGR-1 specific antibodies. See for example, ASGR-1 specific antibody sequences in Tables 6 and 7.

Certain high risk motifs included: (1) CDR 'NG' and 'NT' sequences prone to asparagine deamidation, (2) CDR 'DG,' 'DH', 'DS,' and 'DT' sequences prone to aspartic acid isomerization, (3) and CDR3 tryptophans prone to oxidation. Bioinformatics and structural analyses were used to identify substitutions likely to retain binding affinity to the ASGR-1 CBD. Typically, substitution identities were derived from germline sequences or from sequence-related ASGR-1 CBD-binding mAbs. These substitutions were then modeled into a homology model of the unbound mAb using the software MOE (CCG)[1] to predict structural fitness. For cases in which the bioinformatics or structural analyses did not provide a clear substitution identity, residue types chemically similar to the parent residue were identified.

Variable domain sequence motifs violating multiple sequence alignment-based pair-wise residue covariance trends[2] were also engineered out of ASGR-1 specific antibodies. Substitution identities for covariance violators were identified using a hybrid bioinformatics/structural approach similar to that used to remediate degradation sites.

1. *Molecular Operating Environment* (*MOE*), 2013.08; Chemical Computing Group, Inc., 1010 Sherbooke St. West, Suit #910, Montreal, QC, Canada, H3A 2R7, 2016.
2. Kannan, G. *Method of Correlated Mutational Analysis to Improve Therapeutic Antibodies*. US Patent Application PCT/US2012/028596 filed Mar. 9, 2012.

Example 15: Epitope Mapping Using Peptide Arrays

Custom peptide microarrays were obtained commercially (PEPperPRINT GmbH). For epitope mapping using linear arrays, the antigen (ASGR-1) was translated into 291 different overlapping 15 amino acid (aa) peptides printed in duplicate (582 peptide spots per array copy). For epitope mapping using cyclized arrays, the antigen (ASGR-1) was translated into 888 different overlapping 7 aa, 10 aa and 13 aa peptides printed in duplicate (1,776 peptide spots per array copy). Peptide cyclization was accomplished using N- to C-terminal thioether formation with and without an additional scaffold for varying conformational restriction. Each PEPperCHIP® Peptide array is framed by Flag (DYKDDDDKAS) and HA (YPYDVPDYAG) control peptides. Assay buffer was PBS-T (PBS, pH7.4, 0.05% Tween 20), blocking buffer was Rockland Blocking Buffer (Rockland Immunochemicals), staining buffer was assay buffer+

10% Rockland Blocking buffer. Secondary antibody was goat anti-human IRDye680LT (Li-Cor). Control antibodies were anti-FLAG M2 DyLight800, anti-HA DyLight680. Arrays were scanned on Li-Cor Odyssey with an offset of 0.65 mm, 21 um resolution.

Array staining and detection was per manufacturer's instructions. Briefly, arrays were pre-stained with secondary antibodies for 30 minutes, washed and scanned to detect background binding. Arrays were then stained with commercially available primary antibodies overnight, followed by washing and 30 minute incubation with labeled secondary antibodies. Arrays were scanned to detect binding of anti-ASGR-1 antibodies. Finally, arrays were stained with control antibodies for 45 minutes prior to washing and scanning to detect control peptides.

Antigen binding proteins with desired binding properties can be identified using this assay.

Example 16: In Vivo Studies

RNAi constructs that reduce expression of ASGR-1 and/or ASGR-2 and/or antigen binding proteins, such as monoclonal antibodies, that inhibit ligand binding to ASGR, ASGR-1, and/or ASGR-2 in vitro can be administered in vivo to a relevant animal model and levels and/or activity of endogenous blood proteins like alkaline phosphatase measured. In addition, the clearance of exogenously administered ASGR ligands (for example asialoglycoproteins, certain non-asialylated proteins, synthetic ligands, etc.) can be inhibited by pre-treatment with RNAi or a co- or pre-administered antibody.

Additionally, physiologic effects of the antigen binding proteins or RNAi can be evaluated in relevant animal models of cardiovascular disease using readouts including blood pressure, primary and secondary hemostasis, heart function and morphology, endothelial function, LDL cholesterol levels, non-HDL cholesterol levels, inflammation, and atherosclerosis.

Example 17: Effect of ASGR-1 Antibody 4A2 on Serum LDL Cholesterol and Alkaline Phosphatase in Normal and Obese Cynomolgus Monkeys The purpose of the study was to evaluate the LDL cholesterol (LDL-C)-lowering activity of anti-ASGR inhibitors. In general, cynomolgus monkeys do not have high levels of total cholesterol, HDL-C or LDL-C. Therefore, both normal and dyslipidemic models were utilized in this example. In the dyslipidemic model, monkeys were selected if their LDL levels were at least 100 mg/dL (normal is 40-60 mg/dL), and if there body mass index was over 41 kg/m$^2$ (normal is below 35 kg/m$^2$). Animals that met these criteria on standard diet were classified as spontaneously obese dylipidemic. Other animals were fed a high-fat diet (HFD; 4.15 kcal/gm, 32% fat) prior to inclusion in the study and were classified as HFD obese dyslipidemic.

Naive male spontaneous obese dyslipidemic and HFD obese dyslipidemic cynomolgous monkeys were given a single subcutaneous injection of anti-ASGR-1 antibody 4A2.001 (IgG1z-SEFL2) (10 mg/kg in 10 mM sodium acetate, 9% sucrose, 0.01% polysorbate-80, pH 5.2). Naïve male and female normal cynomolgus monkeys were given a single intravenous injection of anti-ASGR-1 antibody 4A2.001 (IgG1z-SEFL2) (100 mg/kg in 10 mM sodium acetate, 9% sucrose, 0.01% polysorbate-80, pH 5.2). Blood was collected from overnight fasted animals to monitor LDL-C and alkaline phosphatase (ALP) levels post-antibody injection. Blood was collected 70, 118, 190 and 268 hours post-injection (dyslipidemic models) and at 0.05, 0.25, 0.5, 1, 4, 8, 24, 48, 72, 168, 240, 336, 504, 672, 840, 1008, and 1176 hours post-injection (normal). LDL-C decrease (%) and ALP increase (%) were the main endpoints of the study and were measured on Roche C311 and C501 chemistry analyzers. Baseline levels of LDL-C and ALP were established from blood collected 7 days prior to antibody administration.

Dyslipidemic model:
Species: *Macaca fascicularis*
Weight Range: >7.0 kg
BMI Range: >41 kg/m$^2$
Age range: 12-17 years
Time on HFD: 6 months
Source: KBI monkey colony
Number and Sex: 3 male spontaneous obese monkeys and 3 male HFD induced obese monkeys (BMI>41, LDL>80 mg/dL)). Animals were selected from a larger pool based on similar baseline LDL and ALP levels Normal model:
Species: *Macaca fascicularis*
Weight Range: 2.6-4.2 kg
Age range: 2.5-4 years
Number and Sex: 2 male and 1 female fed normal laboratory diet Data for this study is provided in FIG. 44 (dyslipidemic model) and FIG. 45 (normal model).

Example 18: Proteomic Profiling of Serum Samples from Human ASGR1 Carriers and Controls Introduction As described above in Example 1, ASGR1 loss-of-function (LOF) was found to be associated with a beneficial phenotype (protected from coronary artery disease, lower LDL cholesterol and longer life span) in human[1]. To understand the mechanism of action underlying this association and find potential biomarkers, proteomic measurement of human serum samples were performed and compared to changes in circulating protein levels between the ASGR1 LOF variant carriers and controls.

Materials and Methods

Sample Collection and Proteomic Profiling

A total of 333 human serum samples were acquired from the deCODE Icelandic population study, including 100 ASGR1 del12 heterozygous carriers (cases group) and 233 non-carriers (controls group). The Case/Control Groups are well matched by sex, age and collection time/freezer storage time. 150 ul serum samples were shipped to SomaLogic Inc, where 1310 proteins were measured by the SOMAscan Assay 1.3 k. The 1310 proteins were SOMAmer® Reagents Generated to Human Proteins, the complete list of tested proteins are summarized in the SOMAscan Assay 1.3K Content, Rev 1 (Effective: Sep. 21, 2015) which is incorporated by reference herein in its entirety.

The SOMAscan assay measured serum protein concentration using a Slow Off-rate Modified DNA Aptamer (SOMAmer)-based capture array. Each of the 1310 proteins is bond by its respective fluorescently labeled SOMAmer in the assay and their concentrations are reflected by the respective SOMAmer's relative fluorescence units (RFU).

Data Analysis

2 Samples were removed due to low volume that did not meet Somascan requirements and 13 samples were removed because they had been treated with EDTA. The RFU data of each measured protein was log transformed, then centered and scaled to calculate standardized RFU values for this protein. Principle components (PCs) were derived from 1310 standardized RFU values by principle components analysis. An outlier removal based on Hotellings T2 distribution of PC1 and PC2 was applied and excluded another 8 samples from further analysis.

After QC, the remaining 93 ASGR1 Del12 heterozygous Carriers (cases group) and 217 samples without the Del12 allele (controls group) and their standardized RFU values of each protein were analyzed by a linear model adjusting for Age, Sex, FreezerTime and the first 10 PCs, $$Yi = \beta 0 + \beta 1 Gi + \beta 2 AGEi + \beta 3 SEXi + \beta 4 FTi + \beta 5 PC1i + \ldots + \beta 15 PC10i + \varepsilon i$$

where Yi is the standardized RFU value for the $i^{th}$ sample for a particular protein, Gi is the Del12 genotype the $i^{th}$ sample and β1 capture the estimates of the mean difference between human samples with Del12 and without Del12. Since 1310 tests were performed for the proteins on Somascan platform, we calculated the significant threshold by Bonferroni method ($0.05/1310=3.82 \times 10^{-5}$) assuming these are independent tests. However, the Bonferroni correction is likely too stringent because proteins are often correlated with each other therefore these tests are not independent. Thus a realistic threshold of significance ($5.19 \times 10^{-5}$) was obtained by performing 100,000 permutations using the method by Sham and Purcell 2014[3].

Results and Discussion

Using the permutation threshold, 41 Proteins were identified to have significant serum levels between human ASGR1 del12 carriers and non-carriers ($P<5.19 \times 10^{-5}$). Of those, 26 show significant increase in the carriers (Table 18.1) and 15 decrease significantly in the carriers (Table 18.2). These changes are likely to mediate the beneficial effects resulting from ASGR1 loss of function seen in the del12 carriers. The levels of these proteins in blood can serve as biomarkers for ASGR1 loss of function and be used to assess ASGR1-targeted therapy during drug development.

TABLE 18.1

Proteins with significant increase in serum of ASGR1 del12 carriers.

| p value | Estimate (SD) | Gene | Full Name |
|---|---|---|---|
| 3.71E−54 | 1.34 | TNFSF8 | Tumor necrosis factor ligand superfamily member 8 |
| 1.33E−52 | 1.45 | CD163 | Scavenger receptor cysteine-rich type 1 protein M130 |
| 2.07E−25 | 1.09 | CSF1R | Macrophage colony-stimulating factor 1 receptor |
| 1.44E−24 | 1.16 | LYVE1 | Lymphatic vessel endothelial hyaluronic acid receptor 1 |
| 1.03E−22 | 0.65 | IL6ST | Interleukin-6 receptor subunit beta |
| 4.56E−15 | 0.67 | IL18BP | Interleukin-18-binding protein |
| 1.16E−12 | 0.74 | CD300C | CMRF35-like molecule 6 |
| 2.47E−12 | 0.59 | TYRO3 | Tyrosine-protein kinase receptor TYRO3 |
| 8.85E−12 | 0.80 | LRP8 | Low-density lipoprotein receptor-related protein 8 |
| 1.76E−09 | 0.66 | IL1RL1 | Interleukin-1 receptor-like 1 |
| 2.62E−09 | 0.61 | ISLR2 | Immunoglobulin superfamily containing leucine-rich repeat protein 2 |
| 4.01E−09 | 0.55 | SIGLEC7 | Sialic acid-binding Ig-like lectin 7 |
| 4.47E−09 | 0.48 | NRXN3 | Neurexin-3-beta |
| 1.03E−07 | 0.58 | PLAU | Urokinase-type plasminogen activator |

TABLE 18.1-continued

Proteins with significant increase in serum of ASGR1 del12 carriers.

| p value | Estimate (SD) | Gene | Full Name |
|---|---|---|---|
| 2.96E−07 | 0.37 | CD55 | Complement decay-accelerating factor |
| 8.27E−07 | 0.53 | CD48 | CD48 antigen |
| 1.22E−06 | 0.31 | TNFRSF21 | Tumor necrosis factor receptor superfamily member 21 |
| 1.62E−06 | 0.36 | MRC2 | C-type mannose receptor 2 |
| 3.82E−06 | 0.57 | KLK13 | Kallikrein-13 |
| 4.95E−06 | 0.33 | IGF1R | Insulin-like growth factor 1 receptor |
| 1.46E−05 | 0.45 | ANGPT2 | Angiopoietin-2 |
| 2.02E−05 | 0.39 | CNTN4 | Contactin-4 |
| 2.57E−05 | 0.47 | FCGR3B | Low affinity immunoglobulin gamma Fc region receptor III-B |
| 2.93E−05 | 0.38 | C1S | Complement C1s subcomponent |
| 3.92E−05 | 0.40 | LY9 | T-lymphocyte surface antigen Ly-9 |
| 4.48E−05 | 0.46 | CD200R1 | Cell surface glycoprotein CD200 receptor 1 |

TABLE 18.2

Proteins with significant decrease in serum of ASGR1 del12 carriers.

| p value | Estimate (SD) | Gene | Target Full Name |
|---|---|---|---|
| 1.08E−09 | −0.52 | CD93 | Complement component C1q receptor |
| 6.32E−09 | −0.50 | IDS | Iduronate 2-sulfatase |
| 1.56E−07 | −0.34 | RGMB | RGM domain family member B |
| 2.91E−07 | −0.44 | TGFBI | Transforming growth factor-beta-induced protein ig-h3 |
| 5.56E−07 | −0.48 | LUM | Lumican |
| 6.67E−07 | −0.46 | MMP2 | 72 kDa type IV collagenase |
| 1.36E−06 | −0.38 | FLRT2 | Leucine-rich repeat transmembrane protein FLRT2 |
| 2.18E−06 | −0.48 | AHSG | Alpha-2-HS-glycoprotein |
| 2.44E−06 | −0.37 | CSH1 CSH2 | Chorionic somatomammotropin hormone |
| 3.16E−06 | −0.54 | ESM1 | Endothelial cell-specific molecule 1 |
| 1.36E−05 | −0.52 | AFM | Afamin |
| 1.67E−05 | −0.48 | TNFRSF17 | Tumor necrosis factor receptor superfamily member 17 |
| 2.68E−05 | −0.46 | OMD | Osteomodulin |
| 4.69E−05 | −0.23 | GDI2 | Rab GDP dissociation inhibitor beta |
| 5.09E−05 | −0.45 | SPOCK2 | Testican-2 |

REFERENCES

1 See also, Nioi, P. et al. Variant ASGR1 Associated with a Reduced Risk of Coronary Artery Disease. *The New England journal of medicine* 374, 2131-2141, doi: 10.1056/NEJMoa1508419 (2016).
2 Gold, L. et al. Aptamer-based multiplexed proteomic technology for biomarker discovery. *PLoS One* 5, e15004, doi:10.1371/journal.pone.0015004 (2010).
3 Sham, P. C. & Purcell, S. M. Statistical power and significance testing in large-scale genetic studies. *Nature reviews. Genetics* 15, 335-346, doi:10.1038/nrg3706 (2014).

Example 19: Proteomic Profiling of Serum Samples from ASGr1 Cyno PK-PD Study

Introduction

As described above in Example 1, ASGR1 loss-of-function (LOF) was found to be associated with a beneficial phenotype (protected from coronary artery disease, lower LDL cholesterol and longer life span) in human[1]. Certain ASGR-1 antigen binding proteins disclosed herein were found to mimic the LOF effects, and can be useful in the treatment of coronary artery disease. In brief, cynomolgus monkeys were treated with certain ASGR-1 specific, ligand blocking antibodies in order to study the PK-PD profile of these antibodies. Moreover, a dose-dependent elevation of alkaline phosphatase (ALP) levels was observed in the Ab-treated cynos, which resembles the ALP elevation seen in human ASGR1 LOF carriers. In addition to ALP, proteomic profiling in human serum identified 41 proteins that potentially underlie the beneficial effects caused by ASGR1 LOF as described above in Example 18. To compare effects of anti-ASGR1 antibody treatment with the human ASGR1 LOF and identify comparable signatures in cynomolgus monkey, proteomic measurement of the serum samples from this study was conducted. The list of proteins with altered levels in the antibody-treated animals is compared to the ones identified in human LOF carriers.

Materials and Methods
Sample Selection and Proteomic Profiling 6 animal groups with 3 animals in each group were selected for proteomic profiling. The 6 groups include 5 antibody-treated groups (mAb1/25A4, mAb2/4A2, mAb3/7E11, mAb4/5E5 and mAb8/4H6) and a vehicle control group (mAb6). The animals were dosed once at 100 mg/kg. Serum samples from time points 0, 168, 336, 504, 672 and 1176 hours were collected for each animal (Table 19.1 & 19.2). The only exception is group mAb8/4H6, where time point 1008 hour is used instead of 1176 hour. 120 ul serum samples were shipped to SomaLogic Inc, where 1310 proteins (see table 18.0) were measured by the SOMAscan Assay 1.3 k.

The SOMAscan assay measures serum protein concentration using a Slow Off-rate Modified DNA Aptamer (SOMAmer)-based capture array. Each of the 1310 proteins is bond by its respective fluorescently labeled SOMAmer in the assay and their concentrations are reflected by the respective SOMAmer's relative fluorescence units (RFU).

TABLE 19.1

Serum sample selection

| | | Time points | | | | | |
| --- | --- | --- | --- | --- | --- | --- | --- |
| Animal group | Animal Number | D 0 0 hr | D 8 168 hr | D 15 336 hr | D 22 504 hr | D 29 672 hr | D 50 1176 hr |
| 25A4 | 701, 702, 703 | ✓ | ✓ | ✓ | ✓ | ✓ | ✓ |
| 4A2 | 704, 705, 706 | ✓ | ✓ | ✓ | ✓ | ✓ | ✓ |
| 7E11 | 707, 708, 711 | ✓ | ✓ | ✓ | ✓ | ✓ | ✓ |
| 5E5 | 709, 710, 712 | ✓ | ✓ | ✓ | ✓ | ✓ | ✓ |
| SEFL2-control | 716, 717, 718 | ✓ | ✓ | ✓ | ✓ | ✓ | ✓ |
| 4H6 | 204, 205, 206 | ✓ | ✓ | ✓ | ✓ | ✓ | ✓* |

*4H6 was collected at D 43 (1008 hr).

TABLE 19.2

List of all sample groups by treatment and time points.

| Sample group | Treatment (e.g., drug, vehicle, etc.) | Time point | # of Samples in Group | Subject ID |
| --- | --- | --- | --- | --- |
| 25A4_D0 | mAb1 | 0 Hr | 3 | 701, 702, 703 |
| 25A4_D8 | mAb1 | 168 Hr | 3 | 701, 702, 703 |
| 25A4_D15 | mAb1 | 336 Hr | 3 | 701, 702, 703 |
| 25A4_D22 | mAb1 | 504 Hr | 3 | 701, 702, 703 |
| 25A4_D29 | mAb1 | 672 Hr | 3 | 701, 702, 703 |
| 25A4_D50 | mAb1 | 1176 Hr | 3 | 701, 702, 703 |
| 4A2_D0 | mAb2 | 0 Hr | 3 | 704, 705, 706 |
| 4A2_D8 | mAb2 | 168 Hr | 3 | 704, 705, 706 |
| 4A2_D15 | mAb2 | 336 Hr | 3 | 704, 705, 706 |
| 4A2_D22 | mAb2 | 504 Hr | 3 | 704, 705, 706 |
| 4A2_D29 | mAb2 | 672 Hr | 3 | 704, 705, 706 |
| 4A2_D50 | mAb2 | 1176 Hr | 3 | 704, 705, 706 |
| 7E11_D0 | mAb3 | 0 Hr | 3 | 707, 708, 711 |
| 7E11_D8 | mAb3 | 168 Hr | 3 | 707, 708, 711 |
| 7E11_D15 | mAb3 | 336 Hr | 3 | 707, 708, 711 |
| 7E11_D22 | mAb3 | 504 Hr | 3 | 707, 708, 711 |
| 7E11_D29 | mAb3 | 672 Hr | 3 | 707, 708, 711 |
| 7E11_D50 | mAb3 | 1176 Hr | 3 | 707, 708, 711 |
| 5E5_D0 | mAb4 | 0 Hr | 3 | 709, 710, 712 |
| 5E5_D8 | mAb4 | 168 Hr | 3 | 709, 710, 712 |
| 5E5_D15 | mAb4 | 336 Hr | 3 | 709, 710, 712 |
| 5E5_D22 | mAb4 | 504 Hr | 3 | 709, 710, 712 |
| 5E5_D29 | mAb4 | 672 Hr | 3 | 709, 710, 712 |
| 5E5_D50 | mAb4 | 1176 Hr | 3 | 709, 710, 712 |
| CTL_D0 | mAb6 | 0 Hr | 3 | 716, 717, 718 |
| CTL_D8 | mAb6 | 168 Hr | 3 | 716, 717, 718 |
| CTL_D15 | mAb6 | 336 Hr | 3 | 716, 717, 718 |
| CTL_D22 | mAb6 | 504 Hr | 3 | 716, 717, 718 |
| CTL_D29 | mAb6 | 672 Hr | 3 | 716, 717, 718 |
| CTL_D50 | mAb6 | 1176 Hr | 3 | 716, 717, 718 |
| 4H6_D0 | mAb8 | 0 Hr | 3 | 204, 205, 206 |
| 4H6_D8 | mAb8 | 168 Hr | 3 | 204, 205, 206 |
| 4H6_D15 | mAb8 | 336 Hr | 3 | 204, 205, 206 |
| 4H6_D22 | mAb8 | 504 Hr | 3 | 204, 205, 206 |
| 4H6_D29 | mAb8 | 672 Hr | 3 | 204, 205, 206 |
| 4H6_D43 | mAb8 | 1008 Hr | 3 | 204, 205, 206 |

Data Analysis

As the SOMAscan assay was developed for humans, some proteins in cynomolgus monkey may not be recognized by the SOMAmer reagents. As a result, SOMAscan measurements of these proteins would have low credibility and may not reflect the true protein levels. A simple criterion was defined to determine the credibility of the measurements, assuming the serum levels of a given protein are in relatively close range in human and cynomolgus monkey. The mean and range of each protein level in human are calculated based on the 217 human control samples from the human proteomic study described in Example 18. The mean and range of each protein level in cynomolgus monkey are calculated based on a total of 48 samples including measurements of all time points for the SEFL-2 control group and the pre-treatment (DO) and washout period (D50) measurements of all the other groups. A protein measurement would be assigned low credibility if (1) its range in cynomolgus monkey is not overlapping with human; and (2) there is a 5 fold difference between the mean level of this protein in human and cynomolgus monkey. A total of 162 proteins were determined as low-credibility by these criteria and were excluded (FIG. 58, which depicts a summary of the credibility of protein measurements in cynomolgus monkey). In FIG. 58, log 10 RFU of mean protein levels in the two species are plotted and the ones with low credibility (light shading) and high credibility (black) are marked.

One sample in the 4H6 group was removed due to low volume that did not meet the requirements for the SOMAscan assay. No outliers were found in the principle components analysis. A linear mixed model adjusting for potential confounding factors was used to test whether the ASGR1 antibody treatment changes each protein level differently from the control group over time points, $$Y_{ti}=\beta_0+\beta_1 TREATGROUP_i+\beta_2 TIME_{ti}+\beta_3(TREATGROUP_i)(TIME_{ti})+\beta_4\ COV_{ti}+\ldots+\beta_{m+4}COV_{ti}+b_{0i}+\varepsilon_{ti}$$

which is determined by the p-value for $\beta_3$ (i.e., treatment by time interaction; mean difference in slopes between treatment conditions). The random effect $b_{0i}$ captures individual animal heterogeneity. The TREATGROUP is coded as (25A4=4A2=7E11=5E5=4H6=1; SELF-2=0) and TIME is coded as (D8=D15=D22=D29=1; D0=D50=0) to test for the ASGR1 antibodies effect after treatment comparing to pre-treatment and washout period. Since multiple tests were performed for the proteins on SOMAscan platform, a Bonferroni corrected significant threshold ($5\times10^{-5}$) was used.

Results and Discussion 33 proteins were identified to have significant serum level changes after ASGR1 antibody treatment (Table 19.3; $P<5\times10^{-5}$). Interestingly, all the 33 proteins show increased levels (1.36-10.18 fold) after ASGR1 antibody treatment.

TABLE 19.3

Proteins with significant changes after ASGR1 antibody treatment in Cynomolgus monkey.

| P-value | Estimated Fold Change | Gene | Full Name |
|---|---|---|---|
| 1.87E−13 | 10.18 | TNFSF8 | Tumor necrosis factor ligand superfamily member 8 |
| 1.01E−06 | 8.56 | ASGR1 | Asialoglycoprotein receptor 1 |
| 1.35E−10 | 3.93 | ADGRE2 | Adhesion G protein-coupled receptor E2 |
| 2.74E−11 | 2.86 | CD86 | T-lymphocyte activation antigen CD86 |
| 1.46E−11 | 2.81 | TNFRSF21 | Tumor necrosis factor receptor superfamily member 21 |
| 7.48E−10 | 2.57 | L1CAM | Neural cell adhesion molecule L1 |
| 6.09E−12 | 2.42 | PLXNC1 | Plexin-C1 |
| 1.22E−07 | 2.11 | MRC2 | C-type mannose receptor 2 |
| 1.18E−06 | 2.10 | AMIGO2 | Amphoterin-induced protein 2 |
| 2.28E−11 | 2.02 | ANGPT2 | Angiopoietin-2 |
| 6.68E−09 | 1.99 | INSR | Insulin receptor |
| 1.02E−10 | 1.93 | IL17RA | Interleukin-17 receptor A |
| 7.12E−12 | 1.90 | NRXN3 | Neurexin-3-beta |
| 5.95E−06 | 1.85 | GPNMB | Transmembrane glycoprotein NMB |
| 2.03E−06 | 1.74 | IGF1R | Insulin-like growth factor 1 receptor |
| 3.91E−09 | 1.73 | PLAUR | Urokinase plasminogen activator surface receptor |
| 3.58E−09 | 1.69 | FGFR1 | Fibroblast growth factor receptor 1 |
| 1.26E−06 | 1.60 | LRP8 | Low-density lipoprotein receptor-related protein 8 |
| 3.87E−09 | 1.55 | LYPD3 | Ly6/PLAUR domain-containing protein 3 |
| 3.17E−06 | 1.55 | GRN | Granulins |
| 4.27E−05 | 1.54 | CNTN4 | Contactin-4 |
| 4.59E−07 | 1.54 | KDR | Vascular endothelial growth factor receptor 2 |
| 4.99E−06 | 1.53 | IL12RB2 | Interleukin-12 receptor subunit beta-2 |
| 5.85E−06 | 1.52 | ROBO3 | Roundabout homolog 3 |
| 1.44E−06 | 1.50 | ALCAM | CD166 antigen |
| 3.83E−05 | 1.46 | TYRO3 | Tyrosine-protein kinase receptor TYRO3 |
| 3.09E−05 | 1.45 | CADM1 | Cell adhesion molecule 1 |
| 1.53E−08 | 1.44 | JAG1 | Protein jagged-1 |
| 2.58E−09 | 1.43 | ISLR2 | Immunoglobulin superfamily containing leucine-rich repeat protein 2 |
| 3.11E−05 | 1.39 | SET | Protein SET |
| 4.64E−05 | 1.38 | IL20RA | Interleukin-20 receptor subunit alpha |

TABLE 19.3-continued

Proteins with significant changes after ASGR1 antibody treatment in Cynomolgus monkey.

| P-value | Estimated Fold Change | Gene | Full Name |
|---|---|---|---|
| 2.15E−06 | 1.36 | KLRK1 | NKG2-D type II integral membrane protein |
| 2.39E−05 | 1.36 | GFRA2 | GDNF family receptor alpha-2 |

To compare results from this study with the human proteomic study, a list of proteins made by the 33 proteins in Table 19.3 and the top 41 proteins identified in human was compiled. This results in a list of 64 proteins total. The estimates of protein level change and p-value of the changes in the studies were compared (Table 19.4). Based on concordance of change in the cyno (in response to ASGR1 antibody treatment) and human (in response to ASGR1 LOF) studies, the proteins are classified into 5 tiers. Tier 1 includes 10 proteins that pass the stringent Bonferroni corrected significance level ($p<5\times10^{-5}$) in both studies with the same direction of changes. The number of proteins supported by strong evidence in both studies are much higher than the number one would expect by chance ($p=1.58\times10^{-8}$; Fisher's exact test). It indicates that ASGR1 Ab treatment can induce a serum protein levels change in cyno that is similar to the effect of del12 LOF variant in Human. Therefore, these proteins are the core biomarkers. For example, the strongest biomarker TNFSF8 had more than 10 fold increase after ASGR1 Antibody treatment (FIGS. 59A-59D, which depict the results of serum protein levels of TNFSF8 in cyno and human studies).

Tier 2 contains 12 proteins with strong evidence ($p<5\times10^{-5}$) in the cyno study and suggestive evidence ($p<0.05$) in human with the same direction of changes. Both Tier 1 and 2 proteins have increased levels in both studies. Tier 3 includes 11 proteins that are found significant only in the cyno study but not human. These proteins are likely to be biomarkers specific for the drug modality or for cynomolgus monkeys. For example, the soluble secreted form of ASGR1 increased more than 10 fold after antibody treatment but no significant difference was observed in human between the ASGR1 del12 carriers and non-carriers. Tier 4 contains 17 proteins with significant evidence ($p<5\times10^{-5}$) in the human study but not supported by the cyno study. Majority of the proteins in Tier 4 has decrease levels in human del12 carriers. This observation may indicate a difference between antibody treatment and constitutive gene LOF. It could also possibly be due to species difference or simply caused by lower statistical power in the cyno study.

Lastly, there are 14 proteins with significant changes in human classified as Tier 5 because they were excluded in the cyno study due to the low credibility of their SOMAmer reagents.

In summary, the two studies show high degree of concordance between the antibody treatment in cynomolgus monkey and ASGR1 LOF in humans, with 10 proteins (Tier 1) showing very significant changes in the same direction in both studies. The ASGR-1 antibody treatment is working well as a way of mimicking the effects of ASGR1 LOF in humans and can be useful in the treatment of coronary artery disease.

TABLE 19.4

Five tiers of protein biomarkers and comparison of the estimates of protein level change and p-value between the two studies.

| Target Full Name | Gene | Human Estimate (SD) | Human P-value | Cyno Estimate log2FC | Cyno P-value | Tier |
|---|---|---|---|---|---|---|
| Tumor necrosis factor ligand superfamily member 8 | TNFSF8 | 1.34 | 3.7E−54 | 3.35 | 1.87E−13 | 1 |
| Tumor necrosis factor receptor superfamily member 21 | TNFRSF21 | 0.31 | 1.2E−06 | 1.49 | 1.46E−11 | 1 |
| C-type mannose receptor 2 | MRC2 | 0.36 | 1.6E−06 | 1.08 | 1.22E−07 | 1 |
| Angiopoietin-2 | ANGPT2 | 0.45 | 1.5E−05 | 1.01 | 2.28E−11 | 1 |
| Neurexin-3-beta | NRXN3 | 0.48 | 4.5E−09 | 0.93 | 7.12E−12 | 1 |
| Insulin-like growth factor 1 receptor | IGF1R | 0.33 | 5.0E−06 | 0.80 | 2.03E−06 | 1 |
| Low-density lipoprotein receptor-related protein 8 | LRP8 | 0.80 | 8.9E−12 | 0.68 | 1.26E−06 | 1 |
| Contactin-4 | CNTN4 | 0.39 | 2.0E−05 | 0.63 | 4.27E−05 | 1 |
| Tyrosine-protein kinase receptor TYRO3 | TYRO3 | 0.59 | 2.5E−12 | 0.55 | 3.83E−05 | 1 |
| Immunoglobulin superfamily containing leucine-rich repeat protein 2 | ISLR2 | 0.61 | 2.6E−09 | 0.52 | 2.58E−09 | 1 |
| T-lymphocyte activation antigen CD86 | CD86 | 0.39 | 2.1E−03 | 1.52 | 2.74E−11 | 2 |
| Neural cell adhesion molecule L1 | L1CAM | 0.30 | 5.5E−03 | 1.36 | 7.48E−10 | 2 |
| Plexin-C1 | PLXNC1 | 0.40 | 1.0E−04 | 1.28 | 6.09E−12 | 2 |
| Amphoterin-induced protein 2 | AMIGO2 | 0.44 | 1.9E−04 | 1.07 | 1.18E−06 | 2 |
| Interleukin-17 receptor A | IL17RA | 0.29 | 0.03 | 0.95 | 1.02E−10 | 2 |
| Urokinase plasminogen activator surface receptor | PLAUR | 0.35 | 3.3E−04 | 0.79 | 3.91E−09 | 2 |
| Fibroblast growth factor receptor 1 | FGFR1 | 0.30 | 2.3E−03 | 0.75 | 3.58E−09 | 2 |
| Granulins | GRN | 0.27 | 5.7E−03 | 0.63 | 3.17E−06 | 2 |
| CD166 antigen | ALCAM | 0.20 | 9.1E−03 | 0.58 | 1.44E−06 | 2 |
| Protein jagged-1 | JAG1 | 0.17 | 0.01 | 0.53 | 1.53E−08 | 2 |
| Protein SET | SET | 0.28 | 2.1E−03 | 0.47 | 3.11E−05 | 2 |
| GDNF family receptor alpha-2 | GFRA2 | 0.39 | 9.2E−05 | 0.44 | 2.39E−05 | 2 |
| Asialoglycoprotein receptor 1 | ASGR1 | 0.00 | 0.99 | 3.10 | 1.01E−06 | 3 |
| Adhesion G protein-coupled receptor E2 | ADGRE2 | 0.04 | 0.70 | 1.97 | 1.35E−10 | 3 |
| Insulin receptor | INSR | 0.20 | 0.06 | 1.00 | 6.68E−09 | 3 |
| Transmembrane glycoprotein NMB | GPNMB | −0.22 | 0.01 | 0.89 | 5.95E−06 | 3 |
| Ly6/PLAUR domain-containing protein 3 | LYPD3 | −0.06 | 0.26 | 0.63 | 3.87E−09 | 3 |
| Vascular endothelial growth factor receptor 2 | KDR | 0.19 | 0.09 | 0.63 | 4.59E−07 | 3 |
| Interleukin-12 receptor subunit beta-2 | IL12RB2 | 0.11 | 0.38 | 0.61 | 4.99E−06 | 3 |
| Roundabout homolog 3 | ROBO3 | 0.08 | 0.55 | 0.61 | 5.85E−06 | 3 |
| Cell adhesion molecule 1 | CADM1 | −0.17 | 0.02 | 0.53 | 3.09E−05 | 3 |
| Interleukin-20 receptor subunit alpha | IL20RA | 0.05 | 0.69 | 0.47 | 4.64E−05 | 3 |
| NKG2-D type II integral membrane protein | KLRK1 | −0.14 | 0.25 | 0.44 | 2.15E−06 | 3 |
| Lymphatic vessel endothelial hyaluronic acid receptor 1 | LYVE1 | 1.16 | 1.44E−24 | 0.00 | 0.96 | 4 |
| CMRF35-like molecule 6 | CD300C | 0.74 | 1.16E−12 | 0.03 | 0.39 | 4 |
| Interleukin-1 receptor-like 1 | IL1RL1 | 0.66 | 1.76E−09 | 0.75 | 0.10 | 4 |
| Kallikrein-13 | KLK13 | 0.57 | 3.82E−06 | 0.08 | 0.42 | 4 |
| CD48 antigen | CD48 | 0.53 | 8.27E−07 | −0.06 | 0.81 | 4 |
| Rab GDP dissociation inhibitor beta | GDI2 | −0.23 | 4.69E−05 | −0.27 | 0.09 | 4 |
| Chorionic somatomammotropin hormone | CSH1 CSH2 | −0.37 | 2.44E−06 | 0.19 | 9.4E−03 | 4 |
| Leucine-rich repeat transmembrane protein FLRT2 | FLRT2 | −0.38 | 1.36E−06 | 0.30 | 0.03 | 4 |
| Transforming growth factor-beta-induced protein ig-h3 | TGFBI | −0.44 | 2.91E−07 | 0.13 | 0.46 | 4 |
| Testican-2 | SPOCK2 | −0.45 | 5.09E−05 | 0.10 | 0.96 | 4 |
| 72 kDa type IV collagenase | MMP2 | −0.46 | 6.67E−07 | 0.13 | 0.48 | 4 |
| Osteomodulin | OMD | −0.46 | 2.68E−05 | 0.12 | 0.78 | 4 |
| Alpha-2-HS-glycoprotein | AHSG | −0.48 | 2.18E−06 | 0.00 | 0.97 | 4 |
| Iduronate 2-sulfatase | IDS | −0.50 | 6.32E−09 | 0.05 | 0.33 | 4 |
| Complement component C1q receptor | CD93 | −0.52 | 1.08E−09 | 0.19 | 0.15 | 4 |
| Afamin | AFM | −0.52 | 1.36E−05 | 0.02 | 0.94 | 4 |
| Endothelial cell-specific molecule 1 | ESM1 | −0.54 | 3.16E−06 | 0.09 | 0.56 | 4 |
| Scavenger receptor cysteine-rich type 1 protein M130 | CD163 | 1.45 | 1.33E−52 | NA | NA | 5 |
| Macrophage colony-stimulating factor 1 receptor | CSF1R | 1.09 | 2.07E−25 | NA | NA | 5 |
| Interleukin-18-binding protein | IL18BP | 0.67 | 4.56E−15 | NA | NA | 5 |
| Interleukin-6 receptor subunit beta | IL6ST | 0.65 | 1.03E−22 | NA | NA | 5 |
| Urokinase-type plasminogen activator | PLAU | 0.58 | 1.03E−07 | NA | NA | 5 |
| Sialic acid-binding Ig-like lectin 7 | SIGLEC7 | 0.55 | 4.01E−09 | NA | NA | 5 |
| Low affinity immunoglobulin gamma Fc region receptor III-B | FCGR3B | 0.47 | 2.57E−05 | NA | NA | 5 |
| Cell surface glycoprotein CD200 receptor 1 | CD200R1 | 0.46 | 4.48E−05 | NA | NA | 5 |
| T-lymphocyte surface antigen Ly-9 | LY9 | 0.40 | 3.92E−05 | NA | NA | 5 |
| Complement C1s subcomponent | C1S | 0.38 | 2.93E−05 | NA | NA | 5 |
| Complement decay-accelerating factor | CD55 | 0.37 | 2.96E−07 | NA | NA | 5 |
| RGM domain family member B | RGMB | −0.34 | 1.56E−07 | NA | NA | 5 |
| Lumican | LUM | −0.48 | 5.56E−07 | NA | NA | 5 |

TABLE 19.4-continued

Five tiers of protein biomarkers and comparison of the estimates of protein level change and p-value between the two studies.

| | | Human | | Cyno | | |
| --- | --- | --- | --- | --- | --- | --- |
| Target Full Name | Gene | Estimate (SD) | P-value | Estimate log2FC | P-value | Tier |
| Tumor necrosis factor receptor superfamily member 17 | TNFRSF17 | −0.48 | 1.67E−05 | NA | NA | 5 |

REFERENCES

1 See also, Nioi, P. et al. Variant ASGR1 Associated with a Reduced Risk of Coronary Artery Disease. *The New England journal of medicine* 374, 2131-2141, doi: 10.1056/NEJMoa1508419 (2016).
2 Gold, L. et al. Aptamer-based multiplexed proteomic technology for biomarker discovery. *PLoS One* 5, e15004, doi:10.1371/journal.pone.0015004 (2010).

Example 20: Method of Reducing a Risk of Cardiovascular Disease

A subject at risk of cardiovascular disease is identified. One or more antibodies as provided herein (see Example 7, as well as Tables A, B and C) and/or RNAi constructs that reduce expression of ASGR-1 and/or ASGR-2 (as outlined in Example 3), are administered to a subject at risk of cardiovascular disease. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The risk that the subject will experience cardio vascular disease is decreased.

Additionally, as a further option, physiologic effects of the antibody and/or RNAi can be evaluated in relevant animal models of cardiovascular disease using readouts including blood pressure, primary and secondary hemostasis, heart function and morphology, endothelial function, LDL cholesterol levels, non-HDL cholesterol levels, inflammation, and/or atherosclerosis.

Example 21: Method of Reducing a Risk of Myocardial Infarction or Coronary Artery Disease A subject at risk of a myocardial infarction or coronary artery disease is identified. One or more antibodies as provided herein (see Example 7, as well as Tables A, B and C) and/or RNAi constructs that reduce expression of ASGR-1 and/or ASGR-2 (as outlined in Example 3), are administered to a subject at risk of a myocardial infarction or coronary artery disease. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The risk that the subject will experience a myocardial infarction or coronary artery disease is decreased.

Additionally, as a further option, physiologic effects of the antibody and/or RNAi can be evaluated in relevant animal models of myocardial infarction or coronary artery disease using readouts including blood pressure, primary and secondary hemostasis, heart function and morphology, endothelial function, LDL cholesterol levels, non-HDL cholesterol levels, inflammation, and/or atherosclerosis.

Example 22: Method of Reducing LDL Cholesterol

A subject having a LDL cholesterol level to be lowered is identified. One or more antibodies as provided herein (see Example 7, as well as Tables A, B and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., tier 1) is monitored to make certain that an adequate amount of the antibody and/or RNAi construct is administered and is functioning as desired. The level of LDL cholesterol in the subject is thereby reduced.

Example 23: Method of Reducing Non-HDL Cholesterol

A subject having a non-HDL cholesterol level to be lowered is identified. One or more antibodies as provided herein (see Example 7, as well as Tables A, B and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The level of non-HDL cholesterol in the subject is thereby reduced.

Example 24: Method of Increasing ALP Levels

One or more antibodies as provided herein (see Example 7, as well as Tables A, B, and C) and/or RNAi constructs that reduce expression of ASGR-1 and/or ASGR-2 (as outlined in Example 3), are administered to the subject. The antibody and/or RNAi construct reduces the level of expression of ASGR, ASGR-1 and/or ASGR-2. Subsequent rounds of antibodies and/or RNAi are administered to the subject. One or more of the markers in Example 19 (e.g., Tier 1) is monitored to make certain that an adequate amount of the antibody and/or RNAi construct is administered and is functioning as desired. The level of ALP in the subject is thereby increased.

Example 25: Method of Monitoring the Effectiveness of an ASGR-1 Therapy

One or more antibodies as provided herein (see Example 7, as well as Tables A, B and C) and/or RNAi constructs that reduce expression of ASGR-1 and/or ASGR-2 (as outlined in Example 3), are administered to the subject. One or more of the markers in Example 19 is monitored to make certain that an adequate amount of the antibody and/or RNAi construct is administered and is functioning as desired. When the marker level changes in a similar manner to those changes noted in Example 19 (e.g., Tier 1), it is evidence that the amount of the one or more antibody and/or RNAi is effective. Additionally, as a further option, the effectiveness of this biochemical change can be observed by its physiologic effects from the antibody and/or RNAi, which can be evaluated using readouts including blood pressure, primary and secondary hemostasis, heart function and morphology, endothelial function, LDL cholesterol levels, non-HDL cholesterol levels, inflammation, and/or atherosclerosis.

TABLE 10.1

| ATOM | 1 | O | THR | A | 151 | −35.000 | −25.802 | 13.973 | 1.00 | 41.82 | O |
|---|---|---|---|---|---|---|---|---|---|---|---|
| ATOM | 2 | N | THR | A | 151 | −34.909 | −27.403 | 11.804 | 1.00 | 40.99 | N |
| ATOM | 3 | CA | THR | A | 151 | −34.274 | −27.888 | 13.020 | 1.00 | 40.74 | C |
| ATOM | 4 | C | THR | A | 151 | −34.232 | −26.755 | 14.051 | 1.00 | 40.85 | C |
| ATOM | 5 | CB | THR | A | 151 | −32.835 | −28.381 | 12.758 | 1.00 | 37.81 | C |
| ATOM | 6 | OG1 | THR | A | 151 | −32.738 | −28.919 | 11.438 | 1.00 | 46.22 | O |
| ATOM | 7 | CG2 | THR | A | 151 | −32.470 | −29.491 | 13.725 | 1.00 | 44.52 | C |
| ATOM | 8 | O | CYS | A | 152 | −30.928 | −26.774 | 16.222 | 1.00 | 27.69 | O |
| ATOM | 9 | N | CYS | A | 152 | −33.315 | −26.861 | 15.005 | 1.00 | 43.00 | N |
| ATOM | 10 | CA | CYS | A | 152 | −33.119 | −25.852 | 16.027 | 1.00 | 32.33 | C |
| ATOM | 11 | C | CYS | A | 152 | −31.621 | −25.772 | 16.312 | 1.00 | 30.92 | C |
| ATOM | 12 | CB | CYS | A | 152 | −33.900 | −26.213 | 17.289 | 1.00 | 36.97 | C |
| ATOM | 13 | SG | CYS | A | 152 | −34.435 | −24.804 | 18.287 | 1.00 | 47.04 | S |
| ATOM | 14 | N | CYS | A | 153 | −31.104 | −24.590 | 16.620 | 1.00 | 26.78 | N |
| ATOM | 15 | CA | CYS | A | 153 | −29.716 | −24.493 | 17.055 | 1.00 | 24.74 | C |
| ATOM | 16 | C | CYS | A | 153 | −29.577 | −25.058 | 18.464 | 1.00 | 26.56 | C |
| ATOM | 17 | O | CYS | A | 153 | −30.538 | −25.026 | 19.235 | 1.00 | 25.88 | O |
| ATOM | 18 | CB | CYS | A | 153 | −29.243 | −23.040 | 17.017 | 1.00 | 21.46 | C |
| ATOM | 19 | SG | CYS | A | 153 | −29.368 | −22.304 | 15.376 | 1.00 | 33.20 | S |
| ATOM | 20 | N | PRO | A | 154 | −28.379 | −25.571 | 18.813 | 1.00 | 26.96 | N |
| ATOM | 21 | CA | PRO | A | 154 | −28.146 | −26.019 | 20.190 | 1.00 | 20.79 | C |
| ATOM | 22 | C | PRO | A | 154 | −28.236 | −24.848 | 21.163 | 1.00 | 22.57 | C |
| ATOM | 23 | O | PRO | A | 154 | −28.081 | −23.710 | 20.737 | 1.00 | 22.50 | O |
| ATOM | 24 | CB | PRO | A | 154 | −26.715 | −26.585 | 20.147 | 1.00 | 20.99 | C |
| ATOM | 25 | CG | PRO | A | 154 | −26.432 | −26.822 | 18.709 | 1.00 | 21.42 | C |
| ATOM | 26 | CD | PRO | A | 154 | −27.183 | −25.760 | 17.974 | 1.00 | 19.94 | C |
| ATOM | 27 | N | VAL | A | 155 | −28.499 | −25.124 | 22.438 | 1.00 | 21.58 | N |
| ATOM | 28 | CA | VAL | A | 155 | −28.490 | −24.090 | 23.462 | 1.00 | 20.72 | C |
| ATOM | 29 | C | VAL | A | 155 | −27.187 | −23.287 | 23.412 | 1.00 | 25.13 | C |
| ATOM | 30 | O | VAL | A | 155 | −26.109 | −23.865 | 23.218 | 1.00 | 27.20 | O |
| ATOM | 31 | CB | VAL | A | 155 | −28.664 | −24.704 | 24.884 | 1.00 | 23.97 | C |
| ATOM | 32 | CG1 | VAL | A | 155 | −28.384 | −23.669 | 25.957 | 1.00 | 27.90 | C |
| ATOM | 33 | CG2 | VAL | A | 155 | −30.062 | −25.267 | 25.061 | 1.00 | 25.53 | C |
| ATOM | 34 | N | ASN | A | 156 | −27.299 | −21.968 | 23.586 | 1.00 | 20.81 | N |
| ATOM | 35 | CA | ASN | A | 156 | −26.158 | −21.050 | 23.634 | 1.00 | 24.68 | C |
| ATOM | 36 | C | ASN | A | 156 | −25.568 | −20.824 | 22.253 | 1.00 | 25.74 | C |
| ATOM | 37 | O | ASN | A | 156 | −24.518 | −20.206 | 22.106 | 1.00 | 25.52 | O |
| ATOM | 38 | CB | ASN | A | 156 | −25.070 | −21.552 | 24.603 | 1.00 | 30.21 | C |
| ATOM | 39 | CG | ASN | A | 156 | −25.565 | −21.628 | 26.041 | 1.00 | 38.75 | C |
| ATOM | 40 | OD1 | ASN | A | 156 | −26.494 | −20.908 | 26.430 | 1.00 | 35.88 | O |
| ATOM | 41 | ND2 | ASN | A | 156 | −24.953 | −22.502 | 26.835 | 1.00 | 33.84 | N |
| ATOM | 42 | N | TRP | A | 157 | −26.247 | −21.340 | 21.237 | 1.00 | 24.43 | N |
| ATOM | 43 | CA | TRP | A | 157 | −25.928 | −20.981 | 19.866 | 1.00 | 23.93 | C |
| ATOM | 44 | C | TRP | A | 157 | −26.920 | −19.930 | 19.389 | 1.00 | 26.16 | C |
| ATOM | 45 | O | TRP | A | 157 | −28.032 | −19.841 | 19.904 | 1.00 | 28.51 | O |
| ATOM | 46 | CB | TRP | A | 157 | −25.965 | −22.202 | 18.965 | 1.00 | 22.94 | C |
| ATOM | 47 | CG | TRP | A | 157 | −24.818 | −23.129 | 19.174 | 1.00 | 24.76 | C |
| ATOM | 48 | CD1 | TRP | A | 157 | −24.459 | −23.752 | 20.336 | 1.00 | 20.94 | C |
| ATOM | 49 | CD2 | TRP | A | 157 | −23.887 | −23.562 | 18.180 | 1.00 | 19.03 | C |
| ATOM | 50 | NE1 | TRP | A | 157 | −23.355 | −24.540 | 20.126 | 1.00 | 23.79 | N |
| ATOM | 51 | CE2 | TRP | A | 157 | −22.983 | −24.440 | 18.809 | 1.00 | 21.53 | C |
| ATOM | 52 | CE3 | TRP | A | 157 | −23.717 | −23.273 | 16.828 | 1.00 | 15.83 | C |
| ATOM | 53 | CZ2 | TRP | A | 157 | −21.927 | −25.043 | 18.124 | 1.00 | 16.56 | C |
| ATOM | 54 | CZ3 | TRP | A | 157 | −22.667 | −23.866 | 16.152 | 1.00 | 18.56 | C |
| ATOM | 55 | CH2 | TRP | A | 157 | −21.790 | −24.746 | 16.798 | 1.00 | 13.77 | C |
| ATOM | 56 | N | VAL | A | 158 | −26.520 | −19.120 | 18.420 | 1.00 | 25.61 | N |
| ATOM | 57 | CA | VAL | A | 158 | −27.394 | −18.058 | 17.951 | 1.00 | 23.85 | C |
| ATOM | 58 | C | VAL | A | 158 | −27.857 | −18.367 | 16.536 | 1.00 | 26.75 | C |
| ATOM | 59 | O | VAL | A | 158 | −27.048 | −18.589 | 15.642 | 1.00 | 24.47 | O |
| ATOM | 60 | CB | VAL | A | 158 | −26.698 | −16.690 | 17.998 | 1.00 | 26.10 | C |
| ATOM | 61 | CG1 | VAL | A | 158 | −27.691 | −15.587 | 17.690 | 1.00 | 21.15 | C |
| ATOM | 62 | CG2 | VAL | A | 158 | −26.076 | −16.469 | 19.368 | 1.00 | 27.52 | C |
| ATOM | 63 | N | GLU | A | 159 | −29.170 | −18.411 | 16.351 | 1.00 | 30.02 | N |
| ATOM | 64 | CA | GLU | A | 159 | −29.751 | −18.659 | 15.043 | 1.00 | 28.56 | C |
| ATOM | 65 | C | GLU | A | 159 | −29.824 | −17.359 | 14.272 | 1.00 | 25.78 | C |
| ATOM | 66 | O | GLU | A | 159 | −30.140 | −16.313 | 14.840 | 1.00 | 24.18 | O |
| ATOM | 67 | CB | GLU | A | 159 | −31.145 | −19.279 | 15.182 | 1.00 | 24.88 | C |
| ATOM | 68 | CG | GLU | A | 159 | −31.764 | −19.742 | 13.875 | 1.00 | 35.35 | C |
| ATOM | 69 | CD | GLU | A | 159 | −33.213 | −20.190 | 14.052 | 1.00 | 41.67 | C |

TABLE 10.1-continued

| | | | | | | | | | | |
|---|---|---|---|---|---|---|---|---|---|---|
| ATOM | 70 | OE1 | GLU | A | 159 | −34.123 | −19.392 | 13.733 | 1.00 | 44.61 O |
| ATOM | 71 | OE2 | GLU | A | 159 | −33.441 | −21.333 | 14.516 | 1.00 | 36.73 O |
| ATOM | 72 | N | HIS | A | 160 | −29.542 | −17.432 | 12.977 | 1.00 | 25.27 N |
| ATOM | 73 | CA | HIS | A | 160 | −29.577 | −16.257 | 12.118 | 1.00 | 31.03 C |
| ATOM | 74 | C | HIS | A | 160 | −29.525 | −16.672 | 10.656 | 1.00 | 30.42 C |
| ATOM | 75 | O | HIS | A | 160 | −28.530 | −17.261 | 10.205 | 1.00 | 26.33 O |
| ATOM | 76 | CB | HIS | A | 160 | −28.411 | −15.317 | 12.426 | 1.00 | 29.99 C |
| ATOM | 77 | CG | HIS | A | 160 | −28.320 | −14.150 | 11.493 | 1.00 | 28.06 C |
| ATOM | 78 | ND1 | HIS | A | 160 | −29.043 | −12.991 | 11.679 | 1.00 | 33.48 N |
| ATOM | 79 | CD2 | HIS | A | 160 | −27.605 | −13.970 | 10.359 | 1.00 | 29.69 C |
| ATOM | 80 | CE1 | HIS | A | 160 | −28.770 | −12.143 | 10.703 | 1.00 | 30.20 C |
| ATOM | 81 | NE2 | HIS | A | 160 | −27.903 | −12.713 | 9.887 | 1.00 | 29.37 N |
| ATOM | 82 | N | GLU | A | 161 | −30.593 | −16.361 | 9.925 | 1.00 | 29.26 N |
| ATOM | 83 | CA | GLU | A | 161 | −30.696 | −16.730 | 8.520 | 1.00 | 30.40 C |
| ATOM | 84 | C | GLU | A | 161 | −30.349 | −18.188 | 8.278 | 1.00 | 30.86 C |
| ATOM | 85 | O | GLU | A | 161 | −29.548 | −18.493 | 7.393 | 1.00 | 34.60 O |
| ATOM | 86 | CB | GLU | A | 161 | −29.788 | −15.852 | 7.659 | 1.00 | 35.54 C |
| ATOM | 87 | CG | GLU | A | 161 | −30.197 | −14.386 | 7.604 | 1.00 | 41.66 C |
| ATOM | 88 | CD | GLU | A | 161 | −31.526 | −14.165 | 6.901 | 1.00 | 42.46 C |
| ATOM | 89 | OE1 | GLU | A | 161 | −32.027 | −15.108 | 6.252 | 1.00 | 47.99 O |
| ATOM | 90 | OE2 | GLU | A | 161 | −32.070 | −13.043 | 7.001 | 1.00 | 40.82 O |
| ATOM | 91 | N | ARG | A | 162 | −30.928 | −19.068 | 9.092 | 1.00 | 24.36 N |
| ATOM | 92 | CA | ARG | A | 162 | −30.792 | −20.516 | 8.931 | 1.00 | 31.86 C |
| ATOM | 93 | C | ARG | A | 162 | −29.374 | −21.045 | 9.202 | 1.00 | 30.42 C |
| ATOM | 94 | O | ARG | A | 162 | −29.030 | −22.166 | 8.814 | 1.00 | 31.05 O |
| ATOM | 95 | CB | ARG | A | 162 | −31.250 | −20.930 | 7.528 | 1.00 | 38.14 C |
| ATOM | 96 | CG | ARG | A | 162 | −32.267 | −22.051 | 7.540 | 1.00 | 48.13 C |
| ATOM | 97 | CD | ARG | A | 162 | −33.076 | −22.071 | 6.261 | 1.00 | 59.39 C |
| ATOM | 98 | NE | ARG | A | 162 | −33.517 | −23.423 | 5.921 | 1.00 | 73.66 N |
| ATOM | 99 | CZ | ARG | A | 162 | −34.365 | −23.702 | 4.937 | 1.00 | 64.55 C |
| ATOM | 100 | NH1 | ARG | A | 162 | −34.866 | −22.720 | 4.200 | 1.00 | 53.99 N |
| ATOM | 101 | NH2 | ARG | A | 162 | −34.711 | −24.960 | 4.694 | 1.00 | 63.33 N |
| ATOM | 102 | N | SER | A | 163 | −28.556 | −20.240 | 9.869 | 1.00 | 24.82 N |
| ATOM | 103 | CA | SER | A | 163 | −27.287 | −20.728 | 10.379 | 1.00 | 27.06 C |
| ATOM | 104 | C | SER | A | 163 | −27.270 | −20.611 | 11.897 | 1.00 | 28.98 C |
| ATOM | 105 | O | SER | A | 163 | −27.914 | −19.730 | 12.474 | 1.00 | 28.00 O |
| ATOM | 106 | CB | SER | A | 163 | −26.110 | −19.963 | 9.768 | 1.00 | 26.42 C |
| ATOM | 107 | OG | SER | A | 163 | −25.629 | −20.605 | 8.596 | 1.00 | 27.29 O |
| ATOM | 108 | N | CYS | A | 164 | −26.548 | −21.522 | 12.537 | 1.00 | 26.62 N |
| ATOM | 109 | CA | CYS | A | 164 | −26.342 | −21.469 | 13.975 | 1.00 | 23.71 C |
| ATOM | 110 | C | CYS | A | 164 | −24.920 | −20.996 | 14.249 | 1.00 | 23.70 C |
| ATOM | 111 | O | CYS | A | 164 | −23.980 | −21.412 | 13.579 | 1.00 | 20.95 O |
| ATOM | 112 | CB | CYS | A | 164 | −26.591 | −22.838 | 14.601 | 1.00 | 25.60 C |
| ATOM | 113 | SG | CYS | A | 164 | −28.228 | −23.515 | 14.210 | 1.00 | 29.69 S |
| ATOM | 114 | N | TYR | A | 165 | −24.766 | −20.116 | 15.227 | 1.00 | 23.47 N |
| ATOM | 115 | CA | TYR | A | 165 | −23.469 | −19.539 | 15.507 | 1.00 | 21.97 C |
| ATOM | 116 | C | TYR | A | 165 | −23.139 | −19.708 | 16.970 | 1.00 | 22.33 C |
| ATOM | 117 | O | TYR | A | 165 | −23.970 | −19.473 | 17.835 | 1.00 | 21.92 O |
| ATOM | 118 | CB | TYR | A | 165 | −23.434 | −18.055 | 15.141 | 1.00 | 17.23 C |
| ATOM | 119 | CG | TYR | A | 165 | −23.665 | −17.761 | 13.679 | 1.00 | 18.76 C |
| ATOM | 120 | CD1 | TYR | A | 165 | −24.949 | −17.615 | 13.174 | 1.00 | 22.13 C |
| ATOM | 121 | CD2 | TYR | A | 165 | −22.601 | −17.602 | 12.813 | 1.00 | 21.90 C |
| ATOM | 122 | CE1 | TYR | A | 165 | −25.169 | −17.327 | 11.833 | 1.00 | 25.39 C |
| ATOM | 123 | CE2 | TYR | A | 165 | −22.808 | −17.317 | 11.470 | 1.00 | 23.30 C |
| ATOM | 124 | CZ | TYR | A | 165 | −24.096 | −17.177 | 10.990 | 1.00 | 24.28 C |
| ATOM | 125 | OH | TYR | A | 165 | −24.295 | −16.900 | 9.663 | 1.00 | 25.37 O |
| ATOM | 126 | N | TRP | A | 166 | −21.913 | −20.111 | 17.243 | 1.00 | 17.81 N |
| ATOM | 127 | CA | TRP | A | 166 | −21.436 | −20.129 | 18.601 | 1.00 | 20.06 C |
| ATOM | 128 | C | TRP | A | 166 | −20.213 | −19.213 | 18.680 | 1.00 | 18.56 C |
| ATOM | 129 | O | TRP | A | 166 | −19.289 | −19.307 | 17.870 | 1.00 | 18.84 O |
| ATOM | 130 | CB | TRP | A | 166 | −21.117 | −21.554 | 19.040 | 1.00 | 18.95 C |
| ATOM | 131 | CG | TRP | A | 166 | −20.709 | −21.665 | 20.486 | 1.00 | 22.40 C |
| ATOM | 132 | CD1 | TRP | A | 166 | −21.533 | −21.745 | 21.563 | 1.00 | 21.92 C |
| ATOM | 133 | CD2 | TRP | A | 166 | −19.369 | −21.697 | 21.001 | 1.00 | 22.78 C |
| ATOM | 134 | NE1 | TRP | A | 166 | −20.797 | −21.831 | 22.717 | 1.00 | 26.27 N |
| ATOM | 135 | CE2 | TRP | A | 166 | −19.464 | −21.805 | 22.400 | 1.00 | 22.51 C |
| ATOM | 136 | CE3 | TRP | A | 166 | −18.098 | −21.648 | 20.408 | 1.00 | 20.00 C |
| ATOM | 137 | CZ2 | TRP | A | 166 | −18.343 | −21.869 | 23.221 | 1.00 | 19.21 C |
| ATOM | 138 | CZ3 | TRP | A | 166 | −16.989 | −21.716 | 21.214 | 1.00 | 19.92 C |
| ATOM | 139 | CH2 | TRP | A | 166 | −17.116 | −21.820 | 22.616 | 1.00 | 20.77 C |
| ATOM | 140 | N | PHE | A | 167 | −20.233 | −18.308 | 19.648 | 1.00 | 20.52 N |
| ATOM | 141 | CA | PHE | A | 167 | −19.189 | −17.304 | 19.803 | 1.00 | 17.05 C |
| ATOM | 142 | C | PHE | A | 167 | −18.367 | −17.589 | 21.039 | 1.00 | 23.11 C |
| ATOM | 143 | O | PHE | A | 167 | −18.847 | −17.397 | 22.149 | 1.00 | 20.92 O |
| ATOM | 144 | CB | PHE | A | 167 | −19.794 | −15.905 | 19.894 | 1.00 | 17.09 C |
| ATOM | 145 | CG | PHE | A | 167 | −20.649 | −15.533 | 18.712 | 1.00 | 19.67 C |
| ATOM | 146 | CD1 | PHE | A | 167 | −22.012 | −15.806 | 18.710 | 1.00 | 20.06 C |
| ATOM | 147 | CD2 | PHE | A | 167 | −20.087 | −14.907 | 17.598 | 1.00 | 18.66 C |
| ATOM | 148 | CE1 | PHE | A | 167 | −22.807 | −15.457 | 17.615 | 1.00 | 21.81 C |
| ATOM | 149 | CE2 | PHE | A | 167 | −20.860 | −14.555 | 16.501 | 1.00 | 14.19 C |

TABLE 10.1-continued

| ATOM | 150 | CZ | PHE | A | 167 | −22.230 | −14.836 | 16.502 | 1.00 | 20.28 | C |
|---|---|---|---|---|---|---|---|---|---|---|---|
| ATOM | 151 | N | SER | A | 168 | −17.127 | −18.039 | 20.853 | 1.00 | 20.07 | N |
| ATOM | 152 | CA | SER | A | 168 | −16.296 | −18.360 | 22.000 | 1.00 | 19.88 | C |
| ATOM | 153 | C | SER | A | 168 | −16.073 | −17.121 | 22.847 | 1.00 | 23.65 | C |
| ATOM | 154 | O | SER | A | 168 | −16.105 | −15.992 | 22.331 | 1.00 | 22.61 | O |
| ATOM | 155 | CB | SER | A | 168 | −14.950 | −18.952 | 21.570 | 1.00 | 13.34 | C |
| ATOM | 156 | OG | SER | A | 168 | −14.018 | −17.940 | 21.262 | 1.00 | 16.40 | O |
| ATOM | 157 | N | ARG | A | 169 | −15.877 | −17.339 | 24.149 | 1.00 | 18.01 | N |
| ATOM | 158 | CA | ARG | A | 169 | −15.443 | −16.284 | 25.038 | 1.00 | 22.03 | C |
| ATOM | 159 | C | ARG | A | 169 | −14.033 | −16.614 | 25.568 | 1.00 | 21.36 | C |
| ATOM | 160 | O | ARG | A | 169 | −13.617 | −16.124 | 26.615 | 1.00 | 24.92 | O |
| ATOM | 161 | CB | ARG | A | 169 | −16.447 | −16.082 | 26.182 | 1.00 | 26.09 | C |
| ATOM | 162 | CG | ARG | A | 169 | −17.858 | −15.584 | 25.733 | 1.00 | 33.24 | C |
| ATOM | 163 | CD | ARG | A | 169 | −17.799 | −14.586 | 24.532 | 1.00 | 35.48 | C |
| ATOM | 164 | NE | ARG | A | 169 | −19.120 | −14.199 | 24.007 | 1.00 | 41.60 | N |
| ATOM | 165 | CZ | ARG | A | 169 | −19.315 | −13.401 | 22.953 | 1.00 | 38.23 | C |
| ATOM | 166 | NH1 | ARG | A | 169 | −18.279 | −12.905 | 22.281 | 1.00 | 28.72 | N |
| ATOM | 167 | NH2 | ARG | A | 169 | −20.550 | −13.100 | 22.559 | 1.00 | 36.96 | N |
| ATOM | 168 | N | SER | A | 170 | −13.303 | −17.438 | 24.823 | 1.00 | 16.23 | N |
| ATOM | 169 | CA | SER | A | 170 | −11.877 | −17.660 | 25.065 | 1.00 | 16.00 | C |
| ATOM | 170 | C | SER | A | 170 | −11.094 | −17.698 | 23.742 | 1.00 | 17.67 | C |
| ATOM | 171 | O | SER | A | 170 | −11.662 | −17.537 | 22.663 | 1.00 | 16.96 | O |
| ATOM | 172 | CB | SER | A | 170 | −11.652 | −18.958 | 25.851 | 1.00 | 17.57 | C |
| ATOM | 173 | OG | SER | A | 170 | −12.101 | −20.084 | 25.121 | 1.00 | 18.85 | O |
| ATOM | 174 | N | GLY | A | 171 | −9.783 | −17.916 | 23.824 | 1.00 | 19.23 | N |
| ATOM | 175 | CA | GLY | A | 171 | −8.947 | −17.854 | 22.645 | 1.00 | 12.77 | C |
| ATOM | 176 | C | GLY | A | 171 | −8.169 | −19.115 | 22.334 | 1.00 | 16.65 | C |
| ATOM | 177 | O | GLY | A | 171 | −7.701 | −19.820 | 23.236 | 1.00 | 16.99 | O |
| ATOM | 178 | N | LYS | A | 172 | −8.037 | −19.389 | 21.039 | 1.00 | 15.85 | N |
| ATOM | 179 | CA | LYS | A | 172 | −7.313 | −20.542 | 20.533 | 1.00 | 13.77 | C |
| ATOM | 180 | C | LYS | A | 172 | −6.509 | −20.164 | 19.309 | 1.00 | 17.02 | C |
| ATOM | 181 | O | LYS | A | 172 | −6.873 | −19.224 | 18.576 | 1.00 | 17.20 | O |
| ATOM | 182 | CB | LYS | A | 172 | −8.262 | −21.678 | 20.148 | 1.00 | 16.06 | C |
| ATOM | 183 | CG | LYS | A | 172 | −8.818 | −22.506 | 21.281 | 1.00 | 17.04 | C |
| ATOM | 184 | CD | LYS | A | 172 | −9.638 | −23.666 | 20.687 | 1.00 | 17.13 | C |
| ATOM | 185 | CE | LYS | A | 172 | −10.400 | −24.441 | 21.766 | 1.00 | 16.06 | C |
| ATOM | 186 | NZ | LYS | A | 172 | −9.439 | 25.070 | 22.711 | 1.00 | 20.45 | N |
| ATOM | 187 | N | ALA | A | 173 | −5.427 | −20.902 | 19.074 | 1.00 | 13.08 | N |
| ATOM | 188 | CA | ALA | A | 173 | −4.750 | −20.834 | 17.792 | 1.00 | 14.02 | C |
| ATOM | 189 | C | ALA | A | 173 | −5.758 | −21.289 | 16.754 | 1.00 | 16.04 | C |
| ATOM | 190 | O | ALA | A | 173 | −6.675 | −22.056 | 17.064 | 1.00 | 15.29 | O |
| ATOM | 191 | CB | ALA | A | 173 | −3.482 | −21.720 | 17.766 | 1.00 | 14.17 | C |
| ATOM | 192 | N | TRP | A | 174 | −5.591 | −20.827 | 15.522 | 1.00 | 16.89 | N |
| ATOM | 193 | CA | TRP | A | 174 | −6.571 | −21.098 | 14.492 | 1.00 | 15.29 | C |
| ATOM | 194 | C | TRP | A | 174 | −6.839 | −22.598 | 14.329 | 1.00 | 17.24 | C |
| ATOM | 195 | O | TRP | A | 174 | −8.000 | −23.030 | 14.334 | 1.00 | 17.21 | O |
| ATOM | 196 | CB | TRP | A | 174 | −6.111 | −20.486 | 13.185 | 1.00 | 15.83 | C |
| ATOM | 197 | CG | TRP | A | 174 | −7.133 | −20.523 | 12.123 | 1.00 | 17.80 | C |
| ATOM | 198 | CD1 | TRP | A | 174 | −8.015 | −19.532 | 11.795 | 1.00 | 14.69 | C |
| ATOM | 199 | CD2 | TRP | A | 174 | −7.375 | −21.598 | 11.217 | 1.00 | 17.89 | C |
| ATOM | 200 | NE1 | TRP | A | 174 | −8.784 | −19.926 | 10.732 | 1.00 | 13.89 | N |
| ATOM | 201 | CE2 | TRP | A | 174 | −8.416 | −21.193 | 10.361 | 1.00 | 17.17 | C |
| ATOM | 202 | CE3 | TRP | A | 174 | −6.803 | −22.865 | 11.036 | 1.00 | 20.13 | C |
| ATOM | 203 | CZ2 | TRP | A | 174 | −8.911 | −22.013 | 9.353 | 1.00 | 17.46 | C |
| ATOM | 204 | CZ3 | TRP | A | 174 | −7.294 | −23.675 | 10.039 | 1.00 | 18.74 | C |
| ATOM | 205 | CH2 | TRP | A | 174 | −8.338 | −23.246 | 9.208 | 1.00 | 21.31 | C |
| ATOM | 206 | N | ALA | A | 175 | −5.781 | −23.395 | 14.229 | 1.00 | 14.70 | N |
| ATOM | 207 | CA | ALA | A | 175 | −5.950 | −24.829 | 13.999 | 1.00 | 16.88 | C |
| ATOM | 208 | C | ALA | A | 175 | −6.707 | −25.488 | 15.138 | 1.00 | 18.55 | C |
| ATOM | 209 | O | ALA | A | 175 | −7.444 | −26.448 | 14.921 | 1.00 | 18.63 | O |
| ATOM | 210 | CB | ALA | A | 175 | −4.595 | −25.512 | 13.803 | 1.00 | 20.43 | C |
| ATOM | 211 | N | ASP | A | 176 | −6.530 | −24.982 | 16.355 | 1.00 | 15.66 | N |
| ATOM | 212 | CA | ASP | A | 176 | −7.267 | −25.535 | 17.479 | 1.00 | 14.07 | C |
| ATOM | 213 | C | ASP | A | 176 | −8.717 | −25.047 | 17.471 | 1.00 | 17.62 | C |
| ATOM | 214 | O | ASP | A | 176 | −9.621 | −25.790 | 17.834 | 1.00 | 19.92 | O |
| ATOM | 215 | CB | ASP | A | 176 | −6.566 | −25.191 | 18.784 | 1.00 | 17.82 | C |
| ATOM | 216 | CG | ASP | A | 176 | −5.169 | −25.805 | 18.865 | 1.00 | 32.45 | C |
| ATOM | 217 | OD2 | ASP | A | 176 | −4.231 | −25.127 | 19.349 | 1.00 | 29.94 | O |
| ATOM | 218 | OD1 | ASP | A | 176 | −5.003 | −26.959 | 18.405 | 1.00 | 34.43 | O |
| ATOM | 219 | N | ALA | A | 177 | −8.951 | −23.811 | 17.036 | 1.00 | 15.88 | N |
| ATOM | 220 | CA | ALA | A | 177 | −10.324 | −23.342 | 16.867 | 1.00 | 15.36 | C |
| ATOM | 221 | C | ALA | A | 177 | −11.000 | −24.134 | 15.765 | 1.00 | 14.26 | C |
| ATOM | 222 | O | ALA | A | 177 | −12.176 | −24.472 | 15.856 | 1.00 | 17.76 | O |
| ATOM | 223 | CB | ALA | A | 177 | −10.355 | −21.866 | 16.550 | 1.00 | 12.43 | C |
| ATOM | 224 | N | ASP | A | 178 | −10.250 | −24.417 | 14.710 | 1.00 | 17.91 | N |
| ATOM | 225 | CA | ASP | A | 178 | −10.776 | −25.168 | 13.575 | 1.00 | 18.45 | C |
| ATOM | 226 | C | ASP | A | 178 | −11.241 | −26.540 | 14.045 | 1.00 | 20.72 | C |
| ATOM | 227 | O | ASP | A | 178 | −12.390 | −26.930 | 13.819 | 1.00 | 17.75 | O |
| ATOM | 228 | CB | ASP | A | 178 | −9.714 | −25.301 | 12.493 | 1.00 | 18.31 | C |
| ATOM | 229 | CG | ASP | A | 178 | −10.161 | −26.169 | 11.346 | 1.00 | 24.63 | C |

TABLE 10.1-continued

| | | | | | | | | | | |
|---|---|---|---|---|---|---|---|---|---|---|
| ATOM | 230 | OD1 | ASP | A | 178 | −11.279 | −25.949 | 10.829 | 1.00 | 26.01 O |
| ATOM | 231 | OD2 | ASP | A | 178 | −9.388 | −27.067 | 10.960 | 1.00 | 28.35 O |
| ATOM | 232 | N | ASN | A | 179 | −10.343 | −27.251 | 14.729 | 1.00 | 18.35 N |
| ATOM | 233 | CA | ASN | A | 179 | −10.668 | −28.541 | 15.329 | 1.00 | 20.73 C |
| ATOM | 234 | C | ASN | A | 179 | −11.839 | −28.466 | 16.310 | 1.00 | 21.76 C |
| ATOM | 235 | O | ASN | A | 179 | −12.689 | −29.359 | 16.343 | 1.00 | 22.85 O |
| ATOM | 236 | CB | ASN | A | 179 | −9.443 | −29.130 | 16.037 | 1.00 | 19.26 C |
| ATOM | 237 | CG | ASN | A | 179 | −9.756 | −30.435 | 16.752 | 1.00 | 24.98 C |
| ATOM | 238 | OD1 | ASN | A | 179 | −9.955 | −30.455 | 17.961 | 1.00 | 27.04 O |
| ATOM | 239 | ND2 | ASN | A | 179 | −9.814 | −31.528 | 16.002 | 1.00 | 24.23 N |
| ATOM | 240 | N | TYR | A | 180 | −11.897 | −27.407 | 17.110 | 1.00 | 17.86 N |
| ATOM | 241 | CA | TYR | A | 180 | −13.001 | −27.265 | 18.054 | 1.00 | 16.79 C |
| ATOM | 242 | C | TYR | A | 180 | −14.342 | −27.266 | 17.313 | 1.00 | 19.82 C |
| ATOM | 243 | O | TYR | A | 180 | −15.287 | −27.948 | 17.709 | 1.00 | 19.73 O |
| ATOM | 244 | CB | TYR | A | 180 | −12.861 | −25.985 | 18.891 | 1.00 | 16.59 C |
| ATOM | 245 | CG | TYR | A | 180 | −14.056 | −25.719 | 19.810 | 1.00 | 19.48 C |
| ATOM | 246 | CD2 | TYR | A | 180 | −13.996 | −26.024 | 21.162 | 1.00 | 24.26 C |
| ATOM | 247 | CD1 | TYR | A | 180 | −15.245 | −25.156 | 19.316 | 1.00 | 18.40 C |
| ATOM | 248 | CE2 | TYR | A | 180 | −15.089 | −25.789 | 22.008 | 1.00 | 20.67 C |
| ATOM | 249 | CE1 | TYR | A | 180 | −16.328 | −24.922 | 20.135 | 1.00 | 16.82 C |
| ATOM | 250 | CZ | TYR | A | 180 | −16.243 | −25.239 | 21.483 | 1.00 | 23.60 C |
| ATOM | 251 | OH | TYR | A | 180 | −17.312 | −25.009 | 22.311 | 1.00 | 27.99 O |
| ATOM | 252 | N | CYC | A | 181 | −14.416 | −26.480 | 16.247 | 1.00 | 21.68 N |
| ATOM | 253 | CA | CYS | A | 181 | −15.634 | −26.361 | 15.468 | 1.00 | 21.18 C |
| ATOM | 254 | C | CYS | A | 181 | −16.005 | −27.691 | 14.816 | 1.00 | 22.39 C |
| ATOM | 255 | O | CYS | A | 181 | −17.173 | −28.054 | 14.738 | 1.00 | 17.23 O |
| ATOM | 256 | CB | CYS | A | 181 | −15.479 | −25.268 | 14.414 | 1.00 | 17.00 C |
| ATOM | 257 | SG | CYS | A | 181 | −15.347 | −23.612 | 15.108 | 1.00 | 21.92 S |
| ATOM | 258 | N | ARG | A | 182 | −15.008 | −28.435 | 14.366 | 1.00 | 22.70 N |
| ATOM | 259 | CA | ARG | A | 182 | −15.309 | −29.699 | 13.720 | 1.00 | 25.40 C |
| ATOM | 260 | C | ARG | A | 182 | −15.881 | −30.687 | 14.737 | 1.00 | 22.32 C |
| ATOM | 261 | O | ARG | A | 182 | −16.756 | −31.489 | 14.417 | 1.00 | 21.62 O |
| ATOM | 262 | CB | ARG | A | 182 | −14.064 | −30.255 | 13.031 | 1.00 | 22.43 C |
| ATOM | 263 | CG | ARG | A | 182 | −13.757 | −29.535 | 11.727 | 1.00 | 27.35 C |
| ATOM | 264 | CD | ARG | A | 182 | −12.390 | −29.887 | 11.188 | 1.00 | 27.56 C |
| ATOM | 265 | NE | ARG | A | 182 | −11.981 | −28.956 | 10.139 | 1.00 | 34.68 N |
| ATOM | 266 | CZ | ARG | A | 182 | −12.311 | −29.080 | 8.851 | 1.00 | 37.24 C |
| ATOM | 267 | NH1 | ARG | A | 182 | −13.062 | −30.100 | 8.446 | 1.00 | 30.09 N |
| ATOM | 268 | NH2 | ARG | A | 182 | −11.900 | −28.176 | 7.966 | 1.00 | 33.00 N |
| ATOM | 269 | N | LEU | A | 183 | −15.415 | −30.609 | 15.975 | 1.00 | 22.21 N |
| ATOM | 270 | CA | LEU | A | 183 | −15.858 | −31.565 | 16.980 | 1.00 | 20.10 C |
| ATOM | 271 | C | LEU | A | 183 | −17.289 | −31.265 | 17.408 | 1.00 | 22.94 C |
| ATOM | 272 | O | LEU | A | 183 | −17.907 | −32.076 | 18.096 | 1.00 | 23.53 O |
| ATOM | 273 | CB | LEU | A | 183 | −14.918 | −31.577 | 18.182 | 1.00 | 19.03 C |
| ATOM | 274 | CG | LEU | A | 183 | −13.826 | −32.651 | 18.153 | 1.00 | 24.47 C |
| ATOM | 275 | CD1 | LEU | A | 183 | −13.119 | −32.696 | 16.809 | 1.00 | 24.47 C |
| ATOM | 276 | CD2 | LEU | A | 183 | −12.816 | −32.407 | 19.258 | 1.00 | 24.08 C |
| ATOM | 277 | N | GLU | A | 184 | −17.809 | −30.113 | 16.977 | 1.00 | 23.63 N |
| ATOM | 278 | CA | GLU | A | 184 | −19.222 | −29.762 | 17.156 | 1.00 | 23.63 N |
| ATOM | 279 | C | GLU | A | 184 | −20.075 | −29.971 | 15.910 | 1.00 | 22.40 C |
| ATOM | 280 | O | GLU | A | 184 | −21.110 | −29.330 | 15.791 | 1.00 | 22.93 O |
| ATOM | 281 | CB | GLU | A | 184 | −19.372 | −28.292 | 17.560 | 1.00 | 23.75 C |
| ATOM | 282 | CG | GLU | A | 184 | −18.635 | −27.890 | 18.806 | 1.00 | 26.06 C |
| ATOM | 283 | CD | GLU | A | 184 | −19.139 | −28.631 | 20.019 | 1.00 | 33.11 C |
| ATOM | 284 | OE1 | GLU | A | 184 | −20.363 | −28.913 | 20.075 | 1.00 | 34.32 O |
| ATOM | 285 | OE2 | GLU | A | 184 | −18.305 | −28.946 | 20.899 | 1.00 | 34.75 O |
| ATOM | 286 | N | ASP | A | 185 | −19.651 | −30.834 | 14.989 | 1.00 | 21.89 N |
| ATOM | 287 | CA | ASP | A | 185 | −20.270 | −30.908 | 13.664 | 1.00 | 25.50 C |
| ATOM | 288 | C | ASP | A | 185 | −20.452 | −29.523 | 13.066 | 1.00 | 22.06 C |
| ATOM | 289 | O | ASP | A | 185 | −21.511 | −29.206 | 12.547 | 1.00 | 21.39 O |
| ATOM | 290 | CB | ASP | A | 185 | −21.637 | −31.606 | 13.701 | 1.00 | 40.42 C |
| ATOM | 291 | CG | ASP | A | 185 | −21.531 | −33.104 | 13.910 | 1.00 | 51.64 C |
| ATOM | 292 | OD1 | ASP | A | 185 | −20.401 | −33.647 | 13.831 | 1.00 | 55.89 O |
| ATOM | 293 | OD2 | ASP | A | 185 | −22.589 | −33.745 | 14.116 | 1.00 | 52.07 O |
| ATOM | 294 | N | ALA | A | 186 | −19.419 | −28.693 | 13.152 | 1.00 | 25.31 N |
| ATOM | 295 | CA | ALA | A | 186 | −19.521 | −27.315 | 12.702 | 1.00 | 21.25 C |
| ATOM | 296 | C | ALA | A | 186 | −18.262 | −26.920 | 11.989 | 1.00 | 18.66 C |
| ATOM | 297 | O | ALA | A | 186 | −17.353 | −27.723 | 11.805 | 1.00 | 20.79 O |
| ATOM | 298 | CB | ALA | A | 186 | −19.779 | −26.377 | 13.882 | 1.00 | 18.33 C |
| ATOM | 299 | N | HIS | A | 187 | −18.199 | −25.658 | 11.603 | 1.00 | 18.96 N |
| ATOM | 300 | CA | HIS | A | 187 | −17.012 | −25.135 | 10.969 | 1.00 | 17.14 C |
| ATOM | 301 | C | HIS | A | 187 | −16.810 | −23.710 | 11.439 | 1.00 | 17.01 C |
| ATOM | 302 | O | HIS | A | 187 | −17.776 | −23.033 | 11.778 | 1.00 | 19.70 O |
| ATOM | 303 | CB | HIS | A | 187 | −17.156 | −25.191 | 9.450 | 1.00 | 15.59 C |
| ATOM | 304 | CG | HIS | A | 187 | −18.323 | −24.414 | 8.940 | 1.00 | 15.47 C |
| ATOM | 305 | ND1 | HIS | A | 187 | −18.281 | −23.048 | 8.761 | 1.00 | 15.92 N |
| ATOM | 306 | CD2 | HIS | A | 187 | −19.578 | −24.800 | 8.606 | 1.00 | 18.70 C |
| ATOM | 307 | CE1 | HIS | A | 187 | −19.456 | −22.628 | 8.323 | 1.00 | 18.66 C |
| ATOM | 308 | NE2 | HIS | A | 187 | −20.261 | −23.671 | 8.223 | 1.00 | 21.90 N |
| ATOM | 309 | N | LEU | A | 188 | −15.560 | −23.264 | 11.480 | 1.00 | 16.40 N |

TABLE 10.1-continued

| | | | | | | | | | |
|---|---|---|---|---|---|---|---|---|---|
| ATOM | 310 | CA | LEU | A | 188 | −15.256 | −21.859 | 11.698 | 1.00 | 14.33 C |
| ATOM | 311 | C | LEU | A | 188 | −16.058 | −20.996 | 10.738 | 1.00 | 16.82 C |
| ATOM | 312 | O | LEU | A | 188 | −16.141 | −21.289 | 9.527 | 1.00 | 15.26 O |
| ATOM | 313 | CB | LEU | A | 188 | −13.761 | −21.602 | 11.512 | 1.00 | 13.49 C |
| ATOM | 314 | CG | LEU | A | 188 | −12.853 | −21.922 | 12.696 | 1.00 | 16.50 C |
| ATOM | 315 | CD1 | LEU | A | 188 | −11.390 | −21.816 | 12.290 | 1.00 | 18.24 C |
| ATOM | 316 | CD2 | LEU | A | 188 | −13.163 | −20.975 | 13.841 | 1.00 | 15.22 C |
| ATOM | 317 | N | VAL | A | 189 | −16.613 | −19.915 | 11.271 | 1.00 | 15.19 N |
| ATOM | 318 | CA | VAL | A | 189 | −17.596 | −19.127 | 10.543 | 1.00 | 13.95 C |
| ATOM | 319 | C | VAL | A | 189 | −17.130 | −18.784 | 9.129 | 1.00 | 14.59 C |
| ATOM | 320 | O | VAL | A | 189 | −15.970 | −18.432 | 8.894 | 1.00 | 13.02 O |
| ATOM | 321 | CB | VAL | A | 189 | −17.957 | −17.836 | 11.6316 | 1.00 | 15.19 C |
| ATOM | 322 | CG1 | VAL | A | 189 | −16.788 | −16.866 | 11.361 | 1.00 | 13.58 C |
| ATOM | 323 | CG2 | VAL | A | 189 | −19.191 | −17.168 | 10.700 | 1.00 | 19.68 C |
| ATOM | 324 | N | VAL | A | 190 | −18.041 | −18.966 | 8.183 | 1.00 | 16.77 N |
| ATOM | 325 | CA | VAL | A | 190 | −17.814 | −18.617 | 6.786 | 1.00 | 18.83 C |
| ATOM | 326 | C | VAL | A | 190 | −18.720 | −17.429 | 6.469 | 1.00 | 18.58 C |
| ATOM | 327 | O | VAL | A | 190 | −19.925 | −17.526 | 6.604 | 1.00 | 17.97 O |
| ATOM | 328 | CB | VAL | A | 190 | −18.113 | −19.808 | 5.843 | 1.00 | 19.02 C |
| ATOM | 329 | CG1 | VAL | A | 190 | −18.145 | −19.357 | 4.367 | 1.00 | 16.14 C |
| ATOM | 330 | CG2 | VAL | A | 190 | −17.092 | −20.917 | 6.052 | 1.00 | 17.67 C |
| ATOM | 331 | N | VAL | A | 191 | −18.146 | −16.297 | 6.086 | 1.00 | 16.96 N |
| ATOM | 332 | CA | VAL | A | 191 | −18.956 | −15.094 | 5.909 | 1.00 | 16.61 C |
| ATOM | 333 | C | VAL | A | 191 | −19.163 | −14.813 | 4.424 | 1.00 | 21.27 C |
| ATOM | 334 | O | VAL | A | 191 | −18.196 | −14.541 | 3.705 | 1.00 | 19.05 O |
| ATOM | 335 | CB | VAL | A | 191 | −18.302 | −13.887 | 6.589 | 1.00 | 19.68 C |
| ATOM | 336 | CG1 | VAL | A | 191 | −19.161 | −12.637 | 6.414 | 1.00 | 16.81 C |
| ATOM | 337 | CG2 | VAL | A | 191 | −18.073 | −14.187 | 8.076 | 1.00 | 17.57 C |
| ATOM | 338 | N | THR | A | 192 | −20.410 | −14.895 | 3.960 | 1.00 | 17.29 N |
| ATOM | 339 | CA | THR | A | 192 | −20.686 | −14.767 | 2.523 | 1.00 | 21.54 C |
| ATOM | 340 | C | THR | A | 192 | −21.558 | −13.571 | 2.143 | 1.00 | 21.36 C |
| ATOM | 341 | O | THR | A | 192 | −21.854 | −13.372 | 0.976 | 1.00 | 21.17 O |
| ATOM | 342 | CB | THR | A | 192 | −21.344 | −16.046 | 1.963 | 1.00 | 19.51 C |
| ATOM | 343 | OG1 | THR | A | 192 | −22.486 | −16.392 | 2.755 | 1.00 | 23.52 O |
| ATOM | 344 | CG2 | THR | A | 192 | −20.354 | −17.193 | 2.007 | 1.00 | 19.60 C |
| ATOM | 345 | N | SER | A | 193 | −21.938 | −12.744 | 3.107 | 1.00 | 18.59 N |
| ATOM | 346 | CA | SER | A | 193 | −22.678 | −11.549 | 2.755 | 1.00 | 21.89 C |
| ATOM | 347 | C | SER | A | 193 | −22.432 | −10.451 | 3.763 | 1.00 | 26.64 C |
| ATOM | 348 | O | SER | A | 193 | −21.913 | −10.693 | 4.856 | 1.00 | 19.28 O |
| ATOM | 349 | CB | SER | A | 193 | −24.172 | −11.847 | 2.681 | 1.00 | 23.78 C |
| ATOM | 350 | OG | SER | A | 193 | −24.655 | −12.141 | 3.986 | 1.00 | 23.32 O |
| ATOM | 351 | N | TRP | A | 194 | −22.825 | −9.241 | 3.378 | 1.00 | 27.24 N |
| ATOM | 352 | CA | TRP | A | 194 | −22.794 | −8.087 | 4.260 | 1.00 | 24.77 C |
| ATOM | 353 | C | TRP | A | 194 | −23.633 | −8.331 | 5.504 | 1.00 | 25.57 C |
| ATOM | 354 | O | TRP | A | 194 | −23.199 | −8.061 | 6.624 | 1.00 | 26.59 O |
| ATOM | 355 | CB | TRP | A | 194 | −23.295 | −6.845 | 3.519 | 1.00 | 28.68 C |
| ATOM | 356 | CG | TRP | A | 194 | −23.125 | −5.572 | 4.283 | 1.00 | 38.36 C |
| ATOM | 357 | CD1 | TRP | A | 194 | −24.116 | −4.747 | 4.741 | 1.00 | 37.90 C |
| ATOM | 358 | CD2 | TRP | A | 194 | −21.884 | −4.976 | 4.696 | 1.00 | 44.56 C |
| ATOM | 359 | NE1 | TRP | A | 194 | −23.569 | −3.668 | 5.400 | 1.00 | 43.45 N |
| ATOM | 360 | CE2 | TRP | A | 194 | −22.202 | −3.785 | 5.388 | 1.00 | 46.98 C |
| ATOM | 361 | CE3 | TRP | A | 194 | −20.538 | −5.334 | 4.546 | 1.00 | 36.22 C |
| ATOM | 362 | CZ2 | TRP | A | 194 | −21.219 | −2.949 | 5.932 | 1.00 | 52.52 C |
| ATOM | 363 | CZ3 | TRP | A | 194 | −19.560 | −4.503 | 5.089 | 1.00 | 42.44 C |
| ATOM | 364 | CH2 | TRP | A | 194 | −19.908 | −3.325 | 5.773 | 1.00 | 54.05 C |
| ATOM | 365 | N | GLU | A | 195 | −24.848 | −8.824 | 5.293 | 1.00 | 26.92 N |
| ATOM | 366 | CA | GLU | A | 195 | −25.764 | −9.112 | 6.385 | 1.00 | 23.47 C |
| ATOM | 367 | C | GLU | A | 195 | −25.105 | −9.996 | 7.433 | 1.00 | 23.12 C |
| ATOM | 368 | O | GLU | A | 195 | −25.175 | −9.715 | 8.632 | 1.00 | 28.18 O |
| ATOM | 369 | CB | GLU | A | 195 | −27.037 | −9.781 | 5.846 | 1.00 | 30.26 C |
| ATOM | 370 | CG | GLU | A | 195 | −27.820 | −10.627 | 6.876 | 1.00 | 40.78 C |
| ATOM | 371 | CD | GLU | A | 195 | −27.676 | −12.144 | 6.673 | 1.00 | 40.62 C |
| ATOM | 372 | OE1 | GLU | A | 195 | −27.945 | −12.645 | 5.559 | 1.00 | 43.62 O |
| ATOM | 373 | OE2 | GLU | A | 195 | −27.294 | −12.841 | 7.634 | 1.00 | 42.10 O |
| ATOM | 374 | N | GLU | A | 196 | −24.454 | −11.059 | 6.975 | 1.00 | 20.16 N |
| ATOM | 375 | CA | GLU | A | 196 | −23.824 | −12.005 | 7.884 | 1.00 | 25.02 C |
| ATOM | 376 | C | GLU | A | 196 | −22.610 | −11.407 | 8.600 | 1.00 | 21.89 C |
| ATOM | 377 | O | GLU | A | 196 | −22.377 | −11.689 | 9.775 | 1.00 | 18.44 O |
| ATOM | 378 | CB | GLU | A | 196 | −23.416 | −13.265 | 7.136 | 1.00 | 20.96 C |
| ATOM | 379 | CG | GLU | A | 196 | −22.822 | −14.312 | 8.049 | 1.00 | 22.24 C |
| ATOM | 380 | CD | GLU | A | 196 | −22.589 | −15.613 | 7.337 | 1.00 | 22.15 C |
| ATOM | 381 | OE1 | GLU | A | 196 | −22.492 | −15.604 | 6.093 | 1.00 | 19.92 O |
| ATOM | 382 | OE2 | GLU | A | 196 | −22.506 | −16.645 | 8.028 | 1.00 | 24.74 O |
| ATOM | 383 | N | GLN | A | 197 | −21.851 | −10.584 | 7.881 | 1.00 | 18.28 N |
| ATOM | 384 | CA | GLN | A | 197 | −20.751 | −9.817 | 8.456 | 1.00 | 18.47 C |
| ATOM | 385 | C | GLN | A | 197 | −21.217 | −8.914 | 9.600 | 1.00 | 24.91 C |
| ATOM | 386 | O | GLN | A | 197 | −20.639 | −8.924 | 10.694 | 1.00 | 18.25 O |
| ATOM | 387 | CB | GLN | A | 197 | −20.084 | −8.973 | 7.373 | 1.00 | 18.68 C |
| ATOM | 388 | CG | GLN | A | 197 | −19.167 | −7.888 | 7.890 | 1.00 | 23.19 C |
| ATOM | 389 | CD | GLN | A | 197 | −17.832 | −8.428 | 8.348 | 1.00 | 19.88 C |

TABLE 10.1-continued

| ATOM | 390 | OE1 | GLN | A | 197 | −17.290 | −9.361 | 7.758 | 1.00 | 19.94 | O |
|---|---|---|---|---|---|---|---|---|---|---|---|
| ATOM | 391 | NE2 | GLN | A | 197 | −17.289 | −7.840 | 9.406 | 1.00 | 20.73 | N |
| ATOM | 392 | N | LYS | A | 198 | −22.253 | −8.118 | 9.334 | 1.00 | 26.27 | N |
| ATOM | 393 | CA | LYS | A | 198 | −22.775 | −7.197 | 10.330 | 1.00 | 20.44 | C |
| ATOM | 394 | C | LYS | A | 198 | −23.308 | −7.995 | 11.495 | 1.00 | 18.19 | C |
| ATOM | 395 | O | LYS | A | 198 | −23.199 | −7.578 | 12.637 | 1.00 | 20.09 | O |
| ATOM | 396 | CB | LYS | A | 198 | −23.886 | −6.312 | 9.757 | 1.00 | 26.97 | C |
| ATOM | 397 | CG | LYS | A | 198 | −23.441 | −5.26 | 8.806 | 1.00 | 32.65 | C |
| ATOM | 398 | CD | LYS | A | 198 | −24.652 | −4.387 | 8.368 | 1.00 | 47.94 | C |
| ATOM | 399 | CE | LYS | A | 198 | −25.404 | −3.782 | 9.568 | 1.00 | 44.86 | C |
| ATOM | 400 | NZ | LYS | A | 198 | −26.475 | −2.822 | 9.154 | 1.00 | 46.87 | N |
| ATOM | 401 | N | PHE | A | 199 | −23.903 | −9.142 | 11.196 | 1.00 | 16.78 | N |
| ATOM | 402 | CA | PHE | A | 199 | −24.438 | −9.981 | 12.248 | 1.00 | 18.71 | C |
| ATOM | 403 | C | PHE | A | 199 | −23.319 | −10.480 | 13.161 | 1.00 | 19.39 | C |
| ATOM | 404 | O | PHE | A | 199 | −23.448 | −10.481 | 14.383 | 1.00 | 19.46 | O |
| ATOM | 405 | CB | PHE | A | 199 | −25.204 | −11.163 | 11.669 | 1.00 | 15.44 | C |
| ATOM | 406 | CG | PHE | A | 199 | −25.498 | −12.218 | 12.675 | 1.00 | 18.84 | C |
| ATOM | 407 | CD2 | PHE | A | 199 | −24.739 | −13.374 | 12.732 | 1.00 | 22.90 | C |
| ATOM | 408 | CD1 | PHE | A | 199 | −26.510 | −12.045 | 13.596 | 1.00 | 23.16 | C |
| ATOM | 409 | CE2 | PHE | A | 199 | −24.998 | −14.339 | 13.686 | 1.00 | 25.42 | C |
| ATOM | 410 | CE1 | PHE | A | 199 | −26.775 | −13.011 | 14.557 | 1.00 | 24.25 | C |
| ATOM | 411 | CZ | PHE | A | 199 | −26.023 | −14.155 | 14.603 | 1.00 | 20.45 | C |
| ATOM | 412 | N | VAL | A | 200 | −22.220 | −10.923 | 12.568 | 1.00 | 20.88 | N |
| ATOM | 413 | CA | VAL | A | 200 | −21.127 | −11.461 | 13.366 | 1.00 | 19.97 | C |
| ATOM | 414 | C | VAL | A | 200 | −20.361 | −10.342 | 14.096 | 1.00 | 19.76 | C |
| ATOM | 415 | O | VAL | A | 200 | −20.037 | −10.494 | 15.267 | 1.00 | 18.57 | O |
| ATOM | 416 | CB | VAL | A | 200 | −20.201 | −12.301 | 12.496 | 1.00 | 20.92 | C |
| ATOM | 417 | CG1 | VAL | A | 200 | −18.898 | −12.658 | 13.243 | 1.00 | 18.59 | C |
| ATOM | 418 | CG2 | VAL | A | 200 | −20.942 | −13.551 | 12.046 | 1.00 | 16.54 | C |
| ATOM | 419 | N | GLN | A | 201 | −20.126 | −9.211 | 13.430 | 1.00 | 19.23 | N |
| ATOM | 420 | CA | GLN | A | 201 | −19.564 | −8.024 | 14.096 | 1.00 | 22.96 | C |
| ATOM | 421 | C | GLN | A | 201 | −20.288 | −7.714 | 15.403 | 1.00 | 25.56 | C |
| ATOM | 422 | O | GLN | A | 201 | −19.649 | −7.493 | 16.437 | 1.00 | 22.68 | O |
| ATOM | 423 | CB | GLN | A | 201 | −19.648 | −6.781 | 13.199 | 1.00 | 23.94 | C |
| ATOM | 424 | CG | GLN | A | 201 | −18.493 | −6.549 | 12.235 | 1.00 | 24.31 | C |
| ATOM | 425 | CD | GLN | A | 201 | −18.865 | −5.570 | 11.096 | 1.00 | 31.70 | C |
| ATOM | 426 | OE1 | GLN | A | 201 | −18.274 | −5.595 | 10.007 | 1.00 | 25.36 | O |
| ATOM | 427 | NE2 | GLN | A | 201 | −19.856 | −4.718 | 11.349 | 1.00 | 28.05 | N |
| ATOM | 428 | N | HIS | A | 202 | −21.625 | −7.687 | 15.349 | 1.00 | 19.95 | N |
| ATOM | 429 | CA | HIS | A | 202 | −22.415 | −7.330 | 16.514 | 1.00 | 20.60 | C |
| ATOM | 430 | C | HIS | A | 202 | −22.126 | −8.228 | 17.715 | 1.00 | 23.45 | C |
| ATOM | 431 | O | HIS | A | 202 | −21.915 | −7.742 | 18.822 | 1.00 | 26.55 | O |
| ATOM | 432 | CB | HIS | A | 202 | −23.906 | −7.382 | 16.207 | 1.00 | 22.12 | C |
| ATOM | 433 | CG | HIS | A | 202 | −24.758 | −7.236 | 17.425 | 1.00 | 21.72 | C |
| ATOM | 434 | ND1 | HIS | A | 202 | −25.123 | −6.010 | 17.931 | 1.00 | 25.57 | N |
| ATOM | 435 | CD2 | HIS | A | 202 | −25.276 | −8.160 | 18.267 | 1.00 | 25.38 | C |
| ATOM | 436 | CE1 | HIS | A | 202 | −25.846 | −6.183 | 19.022 | 1.00 | 23.46 | C |
| ATOM | 437 | NE2 | HIS | A | 202 | −25.958 | −7.481 | 19.244 | 1.00 | 23.52 | N |
| ATOM | 438 | N | HIS | A | 203 | −22.128 | −9.537 | 17.495 | 1.00 | 22.74 | N |
| ATOM | 439 | CA | HIS | A | 203 | −21.920 | −10.478 | 18.584 | 1.00 | 21.81 | C |
| ATOM | 440 | C | HIS | A | 203 | −20.469 | −10.633 | 19.043 | 1.00 | 21.12 | C |
| ATOM | 441 | O | HIS | A | 203 | −20.243 | −11.066 | 20.168 | 1.00 | 31.14 | O |
| ATOM | 442 | CB | HIS | A | 203 | −22.455 | −11.849 | 18.201 | 1.00 | 19.70 | C |
| ATOM | 443 | CG | HIS | A | 203 | −23.947 | −11.937 | 18.209 | 1.00 | 27.48 | C |
| ATOM | 444 | ND1 | HIS | A | 203 | −24.669 | −12.220 | 19.349 | 1.00 | 27.80 | N |
| ATOM | 445 | CD2 | HIS | A | 203 | −24.855 | −11.767 | 17.220 | 1.00 | 22.28 | C |
| ATOM | 446 | CE1 | HIS | A | 203 | −25.958 | −12.223 | 19.061 | 1.00 | 21.84 | C |
| ATOM | 447 | NE2 | HIS | A | 203 | −26.097 | −11.945 | 17.777 | 1.00 | 20.85 | N |
| ATOM | 448 | N | ILE | A | 204 | −19.487 | −10.319 | 18.206 | 1.00 | 19.01 | N |
| ATOM | 449 | CA | ILE | A | 204 | −18.102 | −10.491 | 18.664 | 1.00 | 24.65 | C |
| ATOM | 450 | C | ILE | A | 204 | −17.506 | −9.213 | 19.247 | 1.00 | 23.37 | C |
| ATOM | 451 | O | ILE | A | 204 | −16.502 | −9.262 | 19.956 | 1.00 | 29.46 | O |
| ATOM | 452 | CB | ILE | A | 204 | −17.156 | −10.992 | 17.550 | 1.00 | 19.60 | C |
| ATOM | 453 | CG1 | ILE | A | 204 | −17.032 | −9.970 | 16.421 | 1.00 | 22.94 | C |
| ATOM | 454 | CG2 | ILE | A | 204 | −17.581 | −12.351 | 17.037 | 1.00 | 18.69 | C |
| ATOM | 455 | CD1 | ILE | A | 204 | −15.981 | −10.357 | 15.400 | 1.00 | 18.85 | C |
| ATOM | 456 | N | GLY | A | 205 | −18.118 | −8.075 | 18.954 | 1.00 | 21.26 | N |
| ATOM | 457 | CA | GLY | A | 205 | −17.663 | −6.811 | 19.504 | 1.00 | 22.73 | C |
| ATOM | 458 | C | GLY | A | 205 | −16.273 | −6.438 | 19.025 | 1.00 | 24.53 | C |
| ATOM | 459 | O | GLY | A | 205 | −15.782 | −6.990 | 18.041 | 1.00 | 29.29 | O |
| ATOM | 460 | N | PRO | A | 206 | −15.614 | −5.508 | 19.729 | 1.00 | 27.53 | N |
| ATOM | 461 | CA | PRO | A | 206 | −14.313 | −5.000 | 19.264 | 1.00 | 25.17 | C |
| ATOM | 462 | C | PRO | A | 206 | −13.141 | −5.982 | 19.496 | 1.00 | 23.26 | C |
| ATOM | 463 | O | PRO | A | 206 | −12.078 | −5.584 | 19.979 | 1.00 | 27.76 | O |
| ATOM | 464 | CB | PRO | A | 206 | −14.137 | −3.729 | 20.092 | 1.00 | 24.03 | C |
| ATOM | 465 | CG | PRO | A | 206 | −14.809 | −4.066 | 21.394 | 1.00 | 21.52 | C |
| ATOM | 466 | CD | PRO | A | 206 | −16.016 | −4.911 | 21.018 | 1.00 | 22.26 | C |
| ATOM | 467 | N | VAL | A | 207 | −13.325 | −7.240 | 19.114 | 1.00 | 21.78 | N |
| ATOM | 468 | CA | VAL | A | 207 | −12.381 | −8.298 | 19.464 | 1.00 | 22.06 | C |
| ATOM | 469 | C | VAL | A | 207 | −11.844 | −9.063 | 18.248 | 1.00 | 21.75 | C |

TABLE 10.1-continued

| | | | | | | | | | | |
|---|---|---|---|---|---|---|---|---|---|---|
| ATOM | 470 | O | VAL | A | 207 | −12.602 | −9.464 | 17.361 | 1.00 | 16.31 O |
| ATOM | 471 | CB | VAL | A | 207 | −13.044 | −9.308 | 20.425 | 1.00 | 18.92 C |
| ATOM | 472 | CG1 | VAL | A | 207 | −12.057 | −10.360 | 20.865 | 1.00 | 16.73 C |
| ATOM | 473 | CG2 | VAL | A | 207 | −13.637 | −8.587 | 21.612 | 1.00 | 15.45 C |
| ATOM | 474 | N | ASN | A | 208 | −10.532 | −9.277 | 18.220 | 1.00 | 20.49 N |
| ATOM | 475 | CA | ASN | A | 208 | −9.922 | −10.105 | 17.191 | 1.00 | 18.16 C |
| ATOM | 476 | C | ASN | A | 208 | −10.499 | −11.507 | 17.256 | 1.00 | 15.84 C |
| ATOM | 477 | O | ASN | A | 208 | −10.423 | −12.147 | 18.294 | 1.00 | 16.63 O |
| ATOM | 478 | CB | ASN | A | 208 | −8.413 | −10.156 | 17.367 | 1.00 | 16.49 C |
| ATOM | 479 | CG | ASN | A | 208 | −7.741 | −8.839 | 17.055 | 1.00 | 18.40 C |
| ATOM | 480 | OD1 | ASN | A | 208 | −6.915 | −8.354 | 17.828 | 1.00 | 21.56 O |
| ATOM | 481 | ND2 | ASN | A | 208 | −8.067 | −8.269 | 15.912 | 1.00 | 15.53 N |
| ATOM | 482 | N | THR | A | 209 | −11.073 | −11.982 | 16.157 | 1.00 | 14.76 N |
| ATOM | 483 | CA | THR | A | 209 | −11.804 | −13.251 | 16.157 | 1.00 | 13.30 C |
| ATOM | 484 | C | THR | A | 209 | −11.524 | −14.065 | 14.892 | 1.00 | 14.80 C |
| ATOM | 485 | O | THR | A | 209 | −11.708 | −13.581 | 13.778 | 1.00 | 13.11 O |
| ATOM | 486 | CB | THR | A | 209 | −13.330 | −13.001 | 16.288 | 1.00 | 15.05 C |
| ATOM | 487 | OG1 | THR | A | 209 | −13.573 | −12.186 | 17.436 | 1.00 | 17.23 O |
| ATOM | 488 | CG2 | THR | A | 209 | −14.102 | −14.310 | 16.450 | 1.00 | 12.52 C |
| ATOM | 489 | N | TRP | A | 210 | −11.075 | −15.300 | 15.058 | 1.00 | 12.28 N |
| ATOM | 490 | CA | TRP | A | 210 | −10.804 | −16.146 | 13.905 | 1.00 | 13.62 C |
| ATOM | 491 | C | TRP | A | 210 | −12.057 | −16.440 | 13.089 | 1.00 | 15.28 C |
| ATOM | 492 | O | TRP | A | 210 | −13.124 | −16.679 | 13.649 | 1.00 | 14.02 O |
| ATOM | 493 | CB | TRP | A | 210 | −10.197 | −17.482 | 14.330 | 1.00 | 13.45 C |
| ATOM | 494 | CG | TRP | A | 210 | −8.783 | −17.472 | 14.852 | 1.00 | 12.79 C |
| ATOM | 495 | CD1 | TRP | A | 210 | −8.352 | −18.038 | 16.003 | 1.00 | 14.29 C |
| ATOM | 496 | CD2 | TRP | A | 210 | −7.619 | −16.907 | 14.223 | 1.00 | 12.57 C |
| ATOM | 497 | NE1 | TRP | A | 210 | −6.992 | −17.868 | 16.141 | 1.00 | 14.57 N |
| ATOM | 498 | CE2 | TRP | A | 210 | −6.521 | −17.177 | 15.057 | 1.00 | 12.81 C |
| ATOM | 499 | CE3 | TRP | A | 210 | −7.401 | −16.202 | 13.033 | 1.00 | 13.91 C |
| ATOM | 500 | CZ2 | TRP | A | 210 | −5.225 | −16.755 | 14.754 | 1.00 | 15.48 C |
| ATOM | 501 | CZ3 | TRP | A | 210 | −6.107 | −15.791 | 12.729 | 1.00 | 15.74 C |
| ATOM | 502 | CH2 | TRP | A | 210 | −5.038 | −16.076 | 13.582 | 1.00 | 14.80 C |
| ATOM | 503 | N | MET | A | 211 | −11.917 | −16.443 | 11.763 | 1.00 | 14.46 N |
| ATOM | 504 | CA | MET | A | 211 | −12.972 | −16.939 | 10.897 | 1.00 | 13.94 C |
| ATOM | 505 | C | MET | A | 211 | −12.389 | −18.101 | 10.107 | 1.00 | 18.15 C |
| ATOM | 506 | O | MET | A | 211 | −11.183 | −18.368 | 10.203 | 1.00 | 14.39 O |
| ATOM | 507 | CB | MET | A | 211 | −13.511 | −15.843 | 9.973 | 1.00 | 14.29 C |
| ATOM | 508 | CG | MET | A | 211 | −12.639 | −15.552 | 8.758 | 1.00 | 15.21 C |
| ATOM | 509 | SD | MET | A | 211 | −13.121 | −14.063 | 7.849 | 1.00 | 15.99 S |
| ATOM | 510 | CE | MET | A | 211 | −12.617 | −12.803 | 9.002 | 1.00 | 13.06 C |
| ATOM | 511 | N | GLY | A | 212 | −13.234 | −18.800 | 9.348 | 1.00 | 16.19 N |
| ATOM | 512 | CA | GLY | A | 212 | −12.811 | −20.001 | 8.645 | 1.00 | 14.73 C |
| ATOM | 513 | C | GLY | A | 212 | −12.179 | −19.746 | 7.292 | 1.00 | 14.61 C |
| ATOM | 514 | O | GLY | A | 212 | −12.524 | −20.367 | 6.306 | 1.00 | 14.25 O |
| ATOM | 515 | N | LEU | A | 213 | −11.231 | −18.824 | 7.260 | 1.00 | 15.62 N |
| ATOM | 516 | CA | LEU | A | 213 | −10.589 | −18.426 | 6.023 | 1.00 | 13.96 C |
| ATOM | 517 | C | LEU | A | 213 | −9.080 | −18.461 | 6.261 | 1.00 | 16.13 C |
| ATOM | 518 | O | LEU | A | 213 | −8.604 | −17.950 | 7.283 | 1.00 | 13.92 O |
| ATOM | 519 | CB | LEU | A | 213 | −11.069 | −17.041 | 5.609 | 1.00 | 12.59 C |
| ATOM | 520 | CG | LEU | A | 213 | −10.425 | −16.377 | 4.404 | 1.00 | 13.49 C |
| ATOM | 521 | CD1 | LEU | A | 213 | −10.715 | −17.173 | 3.139 | 1.00 | 12.34 C |
| ATOM | 522 | CD2 | LEU | A | 213 | −10.899 | −14.942 | 4.283 | 1.00 | 13.03 C |
| ATOM | 523 | N | HIS | A | 214 | −8.348 | −19.107 | 5.356 | 1.00 | 14.35 N |
| ATOM | 524 | CA | HIS | A | 214 | −6.894 | −19.291 | 5.509 | 1.00 | 16.41 C |
| ATOM | 525 | C | HIS | A | 214 | −6.244 | −19.539 | 4.160 | 1.00 | 18.20 C |
| ATOM | 526 | O | HIS | A | 214 | −6.940 | −19.874 | 3.207 | 1.00 | 16.31 O |
| ATOM | 527 | CB | HIS | A | 214 | −6.577 | −20.464 | 6.440 | 1.00 | 13.36 C |
| ATOM | 528 | CG | HIS | A | 214 | −6.949 | −21.797 | 5.874 | 1.00 | 17.43 C |
| ATOM | 529 | ND1 | HIS | A | 214 | −6.016 | −22.687 | 5.391 | 1.00 | 23.48 N |
| ATOM | 530 | CD2 | HIS | A | 214 | −8.158 | −22.382 | 5.690 | 1.00 | 19.34 C |
| ATOM | 531 | CE1 | HIS | A | 214 | −6.630 | −23.772 | 4.494 | 1.00 | 21.50 C |
| ATOM | 532 | NE2 | HIS | a | 214 | −7.930 | −23.613 | 5.122 | 1.00 | 22.11 N |
| ATOM | 533 | N | ASP | A | 215 | −4.920 | −19.376 | 4.079 | 1.00 | 18.22 N |
| ATOM | 534 | CA | ASP | A | 215 | −4.188 | −19.750 | 2.867 | 1.00 | 17.30 C |
| ATOM | 535 | C | ASP | A | 215 | −2.925 | −20.539 | 3.240 | 1.00 | 19.55 C |
| ATOM | 536 | O | ASP | A | 215 | −1.834 | −20.316 | 2.712 | 1.00 | 19.31 O |
| ATOM | 537 | CB | ASP | A | 215 | −3.849 | −18.504 | 2.029 | 1.00 | 14.78 C |
| ATOM | 538 | CG | ASP | A | 215 | −2.730 | −17.641 | 2.638 | 1.00 | 17.69 C |
| ATOM | 539 | OD1 | ASP | A | 215 | −2.483 | −17.688 | 3.869 | 1.00 | 15.15 O |
| ATOM | 540 | OD2 | ASP | A | 215 | −2.095 | −16.899 | 1.866 | 1.00 | 17.44 O |
| ATOM | 541 | N | GLN | A | 216 | −3.078 | −21.470 | 4.167 | 1.00 | 21.06 N |
| ATOM | 542 | CA | GLN | A | 216 | −1.934 | −22.227 | 4.657 | 1.00 | 24.33 C |
| ATOM | 543 | C | GLN | A | 216 | −1.340 | −23.160 | 3.607 | 1.00 | 21.68 C |
| ATOM | 544 | O | GLN | A | 216 | −0.150 | −23.452 | 3.649 | 1.00 | 24.43 O |
| ATOM | 545 | CB | GLN | A | 216 | −2.333 | −23.029 | 5.886 | 1.00 | 23.90 C |
| ATOM | 546 | CG | GLN | A | 216 | −2.684 | −22.189 | 7.079 | 1.00 | 20.99 C |
| ATOM | 547 | CD | GLN | A | 216 | −3.202 | −23.036 | 8.215 | 1.00 | 30.17 C |
| ATOM | 548 | OE1 | GLN | A | 216 | −4.266 | −23.648 | 8.110 | 1.00 | 26.71 O |
| ATOM | 549 | NE2 | GLN | A | 216 | −2.440 | −23.098 | 9.305 | 1.00 | 40.70 N |

TABLE 10.1-continued

| | | | | | | | | | |
|---|---|---|---|---|---|---|---|---|---|
| ATOM | 550 | N | ASN | A | 217 | −2.162 | −23.621 | 2.668 | 1.00 | 23.32 N |
| ATOM | 551 | CA | ASN | A | 217 | −1.685 | −24.532 | 1.629 | 1.00 | 20.04 C |
| ATOM | 552 | C | ASN | A | 217 | −1.612 | −23.852 | 0.283 | 1.00 | 24.86 C |
| ATOM | 553 | O | ASN | A | 217 | −1.540 | −24.510 | −0.756 | 1.00 | 27.21 O |
| ATOM | 554 | CB | ASN | A | 217 | −2.588 | −25.759 | 1.517 | 1.00 | 28.11 C |
| ATOM | 555 | CG | ASN | A | 217 | −2.888 | −26.378 | 2.852 | 1.00 | 32.30 C |
| ATOM | 556 | OD1 | ASN | A | 217 | −4.055 | −26.547 | 3.218 | 1.00 | 38.88 O |
| ATOM | 557 | ND2 | ASN | A | 217 | −1.841 | −26.715 | 3.600 | 1.00 | 27.42 N |
| ATOM | 558 | N | GLY | A | 218 | −1.658 | −22.529 | 0.295 | 1.00 | 22.21 N |
| ATOM | 559 | CA | GLY | A | 218 | −1.460 | −21.777 | −0.918 | 1.00 | 20.14 C |
| ATOM | 560 | C | GLY | A | 218 | −2.428 | −20.632 | −1.068 | 1.00 | 22.88 C |
| ATOM | 561 | O | GLY | A | 218 | −2.165 | −19.536 | −0.571 | 1.00 | 23.78 O |
| ATOM | 562 | N | PRO | A | 219 | −3.534 | −20.871 | −1.791 | 1.00 | 26.59 N |
| ATOM | 563 | CA | PRO | A | 219 | −4.537 | −19.838 | −2.062 | 1.00 | 23.67 C |
| ATOM | 564 | C | PRO | A | 219 | −5.541 | −19.712 | −0.933 | 1.00 | 20.80 C |
| ATOM | 565 | O | PRO | A | 219 | −5.700 | −20.647 | −0.143 | 1.00 | 21.41 O |
| ATOM | 566 | CB | PRO | A | 219 | −5.216 | −20.342 | −3.341 | 1.00 | 21.68 C |
| ATOM | 567 | CG | PRO | A | 219 | −5.134 | −21.823 | −3.228 | 1.00 | 22.20 C |
| ATOM | 568 | CD | PRO | A | 219 | −3.775 | −22.087 | −2.592 | 1.00 | 27.98 C |
| ATOM | 569 | N | TRP | A | 220 | −6.210 | −18.564 | −0.867 | 1.00 | 19.23 N |
| ATOM | 570 | CA | TRP | A | 220 | −7.281 | −18.357 | 0.093 | 1.00 | 20.89 C |
| ATOM | 571 | C | TRP | A | 220 | −8.394 | −19.370 | −0.119 | 1.00 | 18.11 C |
| ATOM | 572 | O | TRP | A | 220 | −8.890 | −19.549 | −1.237 | 1.00 | 16.24 O |
| ATOM | 573 | CB | TRP | A | 220 | −7.818 | −16.924 | 0.000 | 1.00 | 20.98 C |
| ATOM | 574 | CG | TRP | A | 220 | −6.855 | −15.955 | 0.591 | 1.00 | 19.44 C |
| ATOM | 575 | CD1 | TRP | A | 220 | −6.071 | −15.058 | −0.079 | 1.00 | 22.05 C |
| ATOM | 576 | CD2 | TRP | A | 220 | −6.519 | −15.825 | 1.977 | 1.00 | 16.53 C |
| ATOM | 577 | NE1 | TRP | A | 220 | −5.286 | −14.361 | 0.811 | 1.00 | 14.72 N |
| ATOM | 578 | CE2 | TRP | A | 220 | −5.539 | −14.815 | 2.077 | 1.00 | 13.97 C |
| ATOM | 579 | CE3 | TRP | A | 220 | −6.958 | −16.456 | 3.143 | 1.00 | 12.82 C |
| ATOM | 580 | CZ2 | TRP | A | 220 | −4.997 | −14.422 | 3.295 | 1.00 | 16.02 C |
| ATOM | 581 | CZ3 | TRP | A | 220 | −6.422 | −16.062 | 4.347 | 1.00 | 15.01 C |
| ATOM | 582 | CH2 | TRP | A | 220 | −5.449 | −15.060 | 4.418 | 1.00 | 18.72 C |
| ATOM | 583 | N | LYS | A | 221 | −8.744 | −20.038 | 0.979 | 1.00 | 18.43 N |
| ATOM | 584 | CA | LYS | A | 221 | −9.784 | −21.059 | 1.030 | 1.00 | 20.12 C |
| ATOM | 585 | C | LYS | A | 221 | −10.651 | −20.866 | 2.269 | 1.00 | 17.14 C |
| ATOM | 586 | O | LYS | A | 221 | −10.133 | −20.648 | 3.354 | 1.00 | 17.85 O |
| ATOM | 587 | CB | LYS | A | 221 | −9.169 | −22.463 | 1.059 | 1.00 | 22.71 C |
| ATOM | 588 | CG | LYS | A | 221 | −8.599 | −22.928 | −0.263 | 1.00 | 30.31 C |
| ATOM | 589 | CD | LYS | A | 221 | −7.862 | −24.250 | −0.113 | 1.00 | 39.91 C |
| ATOM | 590 | CE | LYS | A | 221 | −7.419 | −24.776 | −1.471 | 1.00 | 44.01 C |
| ATOM | 591 | NZ | LYS | A | 221 | −6.601 | −26.016 | −1.336 | 1.00 | 58.69 N |
| ATOM | 592 | N | TRP | A | 222 | −11.965 | −20.938 | 2.096 | 1.00 | 20.05 N |
| ATOM | 593 | CA | TRP | A | 222 | −12.893 | −21.059 | 3.220 | 1.00 | 18.07 C |
| ATOM | 594 | C | TRP | A | 222 | −12.973 | −22.520 | 3.658 | 1.00 | 15.25 C |
| ATOM | 595 | O | TRP | A | 222 | −12.883 | −23.404 | 2.821 | 1.00 | 22.45 O |
| ATOM | 596 | CB | TRP | A | 222 | −14.280 | −20.553 | 2.827 | 1.00 | 18.47 C |
| ATOM | 597 | CG | TRP | A | 222 | −14.383 | −19.074 | 2.639 | 1.00 | 15.11 C |
| ATOM | 598 | CD1 | TRP | A | 222 | −14.384 | −18.397 | 1.458 | 1.00 | 15.59 C |
| ATOM | 599 | CD2 | TRP | A | 222 | −14.536 | −18.090 | 3.667 | 1.00 | 12.30 C |
| ATOM | 600 | NE1 | TRP | A | 222 | −14.525 | −17.045 | 1.686 | 1.00 | 17.01 N |
| ATOM | 601 | CE2 | TRP | A | 222 | −14.621 | −16.834 | 3.037 | 1.00 | 14.83 C |
| ATOM | 602 | CE3 | TRP | A | 222 | −14.607 | −18.148 | 5.058 | 1.00 | 15.63 C |
| ATOM | 603 | CZ2 | TRP | A | 222 | −14.774 | −15.651 | 3.749 | 1.00 | 14.19 C |
| ATOM | 604 | CZ3 | TRP | A | 222 | −14.750 | −16.975 | 5.761 | 1.00 | 14.82 C |
| ATOM | 605 | CH2 | TRP | A | 222 | −14.833 | −15.741 | 5.103 | 1.00 | 16.93 C |
| ATOM | 606 | N | VAL | A | 223 | −13.160 | −22.781 | 4.948 | 1.00 | 18.67 N |
| ATOM | 607 | CA | VAL | A | 223 | −13.104 | −24.154 | 5.453 | 1.00 | 21.37 C |
| ATOM | 608 | C | VAL | A | 223 | −14.214 | −25.092 | 4.955 | 1.00 | 19.54 C |
| ATOM | 609 | O | VAL | A | 223 | −14.002 | −26.293 | 4.883 | 1.00 | 26.83 O |
| ATOM | 610 | CB | VAL | A | 223 | −13.127 | −24.195 | 7.000 | 1.00 | 20.27 C |
| ATOM | 611 | CG1 | VAL | A | 223 | −11.823 | −23.684 | 7.550 | 1.00 | 16.93 C |
| ATOM | 612 | CG2 | VAL | A | 223 | −14.323 | −23.424 | 7.546 | 1.00 | 13.22 C |
| ATOM | 613 | N | ASP | A | 224 | −15.391 | −24.575 | 4.627 | 1.00 | 20.49 N |
| ATOM | 614 | CA | ASP | A | 224 | −16.455 | −25.453 | 4.129 | 1.00 | 28.05 C |
| ATOM | 615 | C | ASP | A | 224 | −16.450 | −25.610 | 2.592 | 1.00 | 31.47 C |
| ATOM | 616 | O | ASP | A | 224 | −17.344 | −26.231 | 2.017 | 1.00 | 34.41 O |
| ATOM | 617 | CB | ASP | A | 224 | −17.832 | −24.956 | 4.606 | 1.00 | 26.17 C |
| ATOM | 618 | CG | ASP | A | 224 | −18.313 | −23.720 | 3.861 | 1.00 | 30.40 C |
| ATOM | 619 | OD1 | ASP | A | 224 | −17.480 | −22.971 | 3.288 | 1.00 | 27.86 O |
| ATOM | 620 | OD2 | ASP | A | 224 | −19.548 | −23.486 | 3.866 | 1.00 | 41.83 O |
| ATOM | 621 | N | GLY | A | 225 | −15.442 | −25.060 | 1.930 | 1.00 | 26.37 N |
| ATOM | 622 | CA | GLY | A | 225 | −15.325 | −25.234 | 0.495 | 1.00 | 24.35 C |
| ATOM | 623 | C | GLY | A | 225 | −15.828 | −24.060 | −0.325 | 1.00 | 26.11 C |
| ATOM | 624 | O | GLY | A | 225 | −15.605 | −24.021 | −1.532 | 1.00 | 30.45 O |
| ATOM | 625 | N | THR | A | 226 | −16.512 | −23.114 | 0.322 | 1.00 | 28.38 N |
| ATOM | 626 | CA | THR | A | 226 | −16.991 | −21.894 | −0.346 | 1.00 | 26.57 C |
| ATOM | 627 | C | THR | A | 226 | −15.853 | −21.219 | −1.107 | 1.00 | 27.23 C |
| ATOM | 628 | O | THR | A | 226 | −14.732 | −21.105 | −0.602 | 1.00 | 25.68 O |
| ATOM | 629 | CB | THR | A | 226 | −17.587 | −20.886 | 0.669 | 1.00 | 26.04 C |

TABLE 10.1-continued

| | | | | | | | | | | |
|---|---|---|---|---|---|---|---|---|---|---|
| ATOM | 630 | OG1 | THR | A | 226 | −18.644 | −21.511 | 1.408 | 1.00 | 31.78 O |
| ATOM | 631 | CG2 | THR | A | 226 | −18.109 | −19.649 | −0.025 | 1.00 | 22.83 C |
| ATOM | 632 | N | ASP | A | 227 | −16.131 | −20.791 | −2.331 | 1.00 | 25.74 N |
| ATOM | 633 | CA | ASP | A | 227 | −15.101 | −20.198 | −3.157 | 1.00 | 24.58 C |
| ATOM | 634 | C | ASP | A | 227 | −14.769 | −18.774 | −2.724 | 1.00 | 27.29 C |
| ATOM | 635 | O | ASP | A | 227 | −15.658 | −17.943 | −2.523 | 1.00 | 23.84 O |
| ATOM | 636 | CB | ASP | A | 227 | −15.523 | −20.199 | −4.625 | 1.00 | 31.00 C |
| ATOM | 637 | CG | ASP | A | 227 | −14.712 | −19.226 | −5.447 | 1.00 | 33.32 C |
| ATOM | 638 | OD1 | ASP | A | 227 | −13.509 | −19.502 | −5.653 | 1.00 | 36.87 O |
| ATOM | 639 | OD2 | ASP | A | 227 | −15.261 | −18.175 | −5.849 | 1.00 | 32.69 O |
| ATOM | 640 | N | TYR | A | 228 | −13.480 | −18.485 | −2.609 | 1.00 | 25.74 N |
| ATOM | 641 | CA | TYR | A | 228 | −13.055 | −17.195 | −2.090 | 1.00 | 22.35 C |
| ATOM | 642 | C | TYR | A | 228 | −13.186 | −16.074 | −3.109 | 1.00 | 22.96 C |
| ATOM | 643 | O | TYR | A | 228 | −13.706 | −15.006 | −2.779 | 1.00 | 21.88 O |
| ATOM | 644 | CB | TYR | A | 228 | −11.610 | −17.272 | −1.590 | 1.00 | 17.43 C |
| ATOM | 645 | CG | TYR | A | 228 | −10.989 | −15.928 | −1.261 | 1.00 | 18.06 C |
| ATOM | 646 | CD2 | TYR | A | 228 | −10.176 | −15.269 | −2.181 | 1.00 | 19.30 C |
| ATOM | 647 | CD1 | TYR | A | 228 | −11.208 | −15.316 | −0.019 | 1.00 | 18.53 C |
| ATOM | 648 | CE2 | TYR | A | 228 | −9.602 | −14.021 | −1.886 | 1.00 | 18.76 C |
| ATOM | 649 | CE1 | TYR | A | 228 | −10.630 | −14.081 | 0.293 | 1.00 | 15.99 C |
| ATOM | 650 | CZ | TYR | A | 228 | −9.826 | −13.436 | −0.643 | 1.00 | 20.11 C |
| ATOM | 651 | OH | TYR | A | 228 | −9.245 | −12.212 | −0.342 | 1.00 | 16.25 O |
| ATOM | 652 | N | GLU | A | 229 | −12.717 | −16.293 | −4.339 | 1.00 | 24.84 N |
| ATOM | 653 | CA | GLU | A | 229 | −12.560 | −15.153 | −5.244 | 1.00 | 26.92 C |
| ATOM | 654 | C | GLU | A | 229 | −13.890 | −14.532 | −5.653 | 1.00 | 27.92 C |
| ATOM | 655 | O | GLU | A | 229 | −13.958 | −13.314 | −5.816 | 1.00 | 23.76 O |
| ATOM | 656 | CB | GLU | A | 229 | −11.744 | −15.529 | −6.482 | 1.00 | 31.64 C |
| ATOM | 657 | CG | GLU | A | 229 | −12.229 | −16.734 | −7.265 | 1.00 | 42.79 C |
| ATOM | 658 | CD | GLU | A | 229 | −11.112 | −17.346 | −8.115 | 1.00 | 43.21 C |
| ATOM | 659 | OE1 | GLU | A | 229 | −10.142 | −16.627 | −8.448 | 1.00 | 39.47 O |
| ATOM | 660 | OE2 | GLU | A | 229 | −11.196 | −18.552 | −8.440 | 1.00 | 52.24 O |
| ATOM | 661 | N | THR | A | 230 | −14.945 | −15.341 | −5.782 | 1.00 | 26.03 N |
| ATOM | 662 | CA | THR | A | 230 | −16.276 | −14.802 | −6.087 | 1.00 | 26.83 C |
| ATOM | 663 | C | THR | A | 230 | −17.120 | −14.519 | −4.847 | 1.00 | 30.75 C |
| ATOM | 664 | O | THR | A | 230 | −18.233 | −14.006 | −4.945 | 1.00 | 30.18 O |
| ATOM | 665 | CB | THR | A | 230 | −17.090 | −15.754 | −6.977 | 1.00 | 27.80 C |
| ATOM | 666 | OG1 | THR | A | 230 | −17.113 | −17.052 | −6.378 | 1.00 | 25.69 O |
| ATOM | 667 | CG2 | THR | A | 230 | −16.472 | −15.855 | −8.362 | 1.00 | 25.73 C |
| ATOM | 668 | N | GLY | A | 231 | −16.610 | −14.872 | −3.678 | 1.00 | 25.26 N |
| ATOM | 669 | CA | GLY | A | 231 | −17.362 | −14.653 | −2.463 | 1.00 | 27.26 C |
| ATOM | 670 | C | GLY | A | 231 | −17.154 | −13.274 | −1.878 | 1.00 | 26.63 C |
| ATOM | 671 | O | GLY | A | 231 | −16.290 | −12.519 | −2.321 | 1.00 | 25.15 O |
| ATOM | 672 | N | PHE | A | 232 | −17.973 | −12.959 | −0.882 | 1.00 | 23.85 N |
| ATOM | 673 | CA | PHE | A | 232 | −17.839 | −11.763 | −0.056 | 1.00 | 25.36 C |
| ATOM | 674 | C | PHE | A | 232 | −16.433 | −11.627 | 0.530 | 1.00 | 22.51 C |
| ATOM | 675 | O | PHE | A | 232 | −15.815 | −12.623 | 0.898 | 1.00 | 24.64 O |
| ATOM | 676 | CB | PHE | A | 232 | −18.875 | −11.820 | 1.062 | 1.00 | 23.46 C |
| ATOM | 677 | CG | PHE | A | 232 | −18.859 | −10.645 | 1.971 | 1.00 | 24.65 C |
| ATOM | 678 | CD1 | PHE | A | 232 | −19.395 | −9.429 | 1.564 | 1.00 | 19.49 C |
| ATOM | 679 | CD2 | PHE | A | 232 | −18.354 | −10.760 | 3.254 | 1.00 | 17.94 C |
| ATOM | 680 | CE1 | PHE | A | 232 | −19.391 | −8.337 | 2.414 | 1.00 | 21.52 C |
| ATOM | 681 | CE2 | PHE | A | 232 | −18.350 | −9.671 | 4.102 | 1.00 | 20.16 C |
| ATOM | 682 | CZ | PHE | A | 232 | −18.870 | −8.457 | 3.678 | 1.00 | 22.04 C |
| ATOM | 683 | N | LYS | A | 233 | −15.923 | −10.400 | 0.576 | 1.00 | 24.28 N |
| ATOM | 684 | CA | LYD | A | 233 | −14.642 | −10.099 | 1.224 | 1.00 | 22.92 C |
| ATOM | 685 | C | LYS | A | 233 | −14.782 | −8.799 | 1.978 | 1.00 | 22.84 C |
| ATOM | 686 | O | LYS | A | 233 | −15.471 | −7.891 | 1.516 | 1.00 | 22.56 O |
| ATOM | 687 | CB | LYS | A | 233 | −13.495 | −9.991 | 0.212 | 1.00 | 17.41 C |
| ATOM | 688 | CG | LYS | A | 233 | −13.227 | −11.274 | −0.560 | 1.00 | 20.00 C |
| ATOM | 689 | CD | LYS | A | 233 | −12.285 | −11.032 | −1.710 | 1.00 | 21.13 C |
| ATOM | 690 | CE | LYS | A | 233 | −12.419 | −12.105 | −2.767 | 1.00 | 26.26 C |
| ATOM | 691 | NZ | LYS | A | 233 | −13.753 | −12.082 | −3.453 | 1.00 | 23.06 N |
| ATOM | 692 | N | ASN | A | 234 | −14.132 | −8.705 | 3.134 | 1.00 | 17.57 N |
| ATOM | 693 | CA | ASN | A | 234 | −14.165 | −7.467 | 3.910 | 1.00 | 21.38 C |
| ATOM | 694 | C | ASN | A | 234 | −12.791 | −7.112 | 4.486 | 1.00 | 19.87 C |
| ATOM | 695 | O | ASN | A | 234 | −12.683 | −6.685 | 5.629 | 1.00 | 23.24 O |
| ATOM | 696 | CB | ASN | A | 234 | −15.212 | −7.571 | 5.033 | 1.00 | 18.47 C |
| ATOM | 697 | CG | ASN | A | 234 | −15.554 | −6.222 | 5.643 | 1.00 | 19.07 C |
| ATOM | 698 | OD1 | ASN | A | 234 | −15.762 | −6.106 | 6.848 | 1.00 | 22.84 O |
| ATOM | 699 | ND2 | ASN | A | 234 | −15.579 | −5.191 | 4.817 | 1.00 | 21.10 N |
| ATOM | 700 | N | TRP | A | 235 | −11.742 | −7.311 | 3.697 | 1.00 | 19.16 N |
| ATOM | 701 | CA | TRP | A | 235 | −10.390 | −6.975 | 4.135 | 1.00 | 22.32 C |
| ATOM | 702 | C | TRP | A | 235 | −10.264 | −5.498 | 4.467 | 1.00 | 20.90 C |
| ATOM | 703 | O | TRP | A | 235 | −10.730 | −4.642 | 3.719 | 1.00 | 27.44 O |
| ATOM | 704 | CB | TRP | A | 235 | −9.354 | −7.319 | 3.063 | 1.00 | 20.49 C |
| ATOM | 705 | CG | TRP | A | 235 | −9.281 | −8.753 | 2.684 | 1.00 | 20.76 C |
| ATOM | 706 | CD1 | TRP | A | 235 | −9.712 | −9.314 | 1.523 | 1.00 | 19.71 C |
| ATOM | 707 | CD2 | TRP | A | 235 | −8.736 | −9.816 | 3.467 | 1.00 | 18.48 C |
| ATOM | 708 | NE1 | TRP | A | 235 | −9.475 | −10.663 | 1.532 | 1.00 | 18.33 N |
| ATOM | 709 | CE2 | TRP | A | 235 | −8.869 | −10.998 | 2.713 | 1.00 | 17.93 C |

TABLE 10.1-continued

| ATOM | 710 | CE3 | TRP | A | 235 | −8.135 | −9.883 | 4.730 | 1.00 | 17.04 | C |
|---|---|---|---|---|---|---|---|---|---|---|---|
| ATOM | 711 | CZ2 | TRP | A | 235 | −8.427 | −12.236 | 3.180 | 1.00 | 18.19 | C |
| ATOM | 712 | CZ3 | TRP | A | 235 | −7.703 | −11.102 | 5.193 | 1.00 | 14.22 | C |
| ATOM | 713 | CH2 | TRP | A | 235 | −7.855 | −12.269 | 4.423 | 1.00 | 16.87 | C |
| ATOM | 714 | N | ARG | A | 236 | −9.630 | −5.198 | 5.585 | 1.00 | 23.85 | N |
| ATOM | 715 | CA | ARG | A | 236 | −9.169 | −3.842 | 5.826 | 1.00 | 25.84 | C |
| ATOM | 716 | C | ARG | A | 236 | −8.260 | −3.466 | 4.669 | 1.00 | 25.73 | C |
| ATOM | 717 | O | ARG | A | 236 | −7.521 | −4.318 | 4.166 | 1.00 | 27.18 | O |
| ATOM | 718 | CB | ARG | A | 236 | −8.428 | −3.743 | 7.159 | 1.00 | 24.94 | C |
| ATOM | 719 | CG | ARG | A | 236 | −8.108 | −2.312 | 7.586 | 1.00 | 32.25 | C |
| ATOM | 720 | CD | ARG | A | 236 | −7.436 | −2.288 | 8.947 | 1.00 | 30.42 | C |
| ATOM | 721 | NE | ARG | A | 236 | −6.217 | −3.084 | 8.934 | 1.00 | 38.54 | N |
| ATOM | 722 | CZ | ARG | A | 236 | −5.711 | −3.700 | 10.000 | 1.00 | 39.09 | C |
| ATOM | 723 | NH1 | ARG | A | 236 | −6.327 | −3.608 | 11.176 | 1.00 | 39.28 | N |
| ATOM | 724 | NH2 | ARG | A | 236 | −4.588 | −4.409 | 9.889 | 1.00 | 27.72 | N |
| ATOM | 725 | N | PRO | A | 237 | −8.333 | −2.210 | 4.212 | 1.00 | 25.65 | N |
| ATOM | 726 | CA | PRO | A | 237 | −7.412 | −1.747 | 3.167 | 1.00 | 31.88 | C |
| ATOM | 727 | C | PRO | A | 237 | −5.951 | −2.048 | 3.497 | 1.00 | 27.32 | C |
| ATOM | 728 | O | PRO | A | 237 | −5.531 | −1.839 | 4.638 | 1.00 | 28.86 | O |
| ATOM | 729 | CB | PRO | A | 237 | −7.678 | −0.242 | 3.122 | 1.00 | 33.60 | C |
| ATOM | 730 | CG | PRO | A | 237 | −9.149 | −0.156 | 3.436 | 1.00 | 32.49 | C |
| ATOM | 731 | CD | PRO | A | 237 | −9.367 | −1.203 | 4.515 | 1.00 | 29.17 | C |
| ATOM | 732 | N | GLU | A | 238 | −5.231 | −2.563 | 2.501 | 1.00 | 21.38 | N |
| ATOM | 733 | CA | GLU | A | 238 | −3.843 | −3.022 | 2.608 | 1.00 | 23.04 | C |
| ATOM | 734 | C | GLU | A | 238 | −3.741 | −4.424 | 3.231 | 1.00 | 19.36 | C |
| ATOM | 735 | O | GLU | A | 238 | −2.648 | −4.901 | 3.526 | 1.00 | 20.85 | O |
| ATOM | 736 | CB | GLU | A | 238 | −2.978 | −2.022 | 3.397 | 1.00 | 26.89 | C |
| ATOM | 737 | CG | GLU | A | 238 | −2.828 | −0.651 | 2.740 | 1.00 | 31.80 | C |
| ATOM | 738 | CD | GLU | A | 238 | −2.337 | 0.424 | 3.713 | 1.00 | 51.15 | C |
| ATOM | 739 | OE1 | GLU | A | 238 | −2.205 | 0.128 | 4.926 | 1.00 | 50.89 | O |
| ATOM | 740 | OE2 | GLU | A | 238 | −2.101 | 1.573 | 3.269 | 1.00 | 56.05 | O |
| ATOM | 741 | N | GLN | A | 239 | −4.872 | −5.089 | 3.427 | 1.00 | 20.11 | N |
| ATOM | 742 | CA | GLN | A | 239 | −4.840 | −6.495 | 3.825 | 1.00 | 21.60 | C |
| ATOM | 743 | C | GLN | A | 239 | −5.501 | −7.317 | 2.736 | 1.00 | 19.53 | C |
| ATOM | 744 | O | GLN | A | 239 | −6.332 | −6.792 | 2.011 | 1.00 | 21.20 | O |
| ATOM | 745 | CB | GLN | A | 239 | −5.543 | −6.726 | 5.166 | 1.00 | 17.31 | C |
| ATOM | 746 | CG | GLN | A | 239 | −5.020 | −5.893 | 6.310 | 1.00 | 21.03 | C |
| ATOM | 747 | CD | GLN | A | 239 | −3.565 | −6.156 | 6.618 | 1.00 | 18.65 | C |
| ATOM | 748 | OE1 | GLN | A | 239 | −3.045 | −7.232 | 6.343 | 1.00 | 17.67 | O |
| ATOM | 749 | NE2 | GLN | A | 239 | −2.897 | −5.165 | 7.184 | 1.00 | 18.18 | N |
| ATOM | 750 | N | PRO | A | 240 | −5.132 | −8.601 | 2.601 | 1.00 | 16.46 | N |
| ATOM | 751 | CA | PRO | A | 240 | −4.108 | −9.345 | 3.337 | 1.00 | 20.08 | C |
| ATOM | 752 | C | PRO | A | 240 | −2.696 | −8.938 | 2.901 | 1.00 | 19.97 | C |
| ATOM | 753 | O | PRO | A | 240 | −2.486 | −8.679 | 1.708 | 1.00 | 19.33 | O |
| ATOM | 754 | CB | PRO | A | 240 | −4.412 | −10.806 | 2.966 | 1.00 | 15.73 | C |
| ATOM | 755 | CG | PRO | A | 240 | −4.999 | −10.714 | 1.622 | 1.00 | 20.40 | C |
| ATOM | 756 | CD | PRO | A | 240 | −5.783 | −9.438 | 1.580 | 1.00 | 18.17 | C |
| ATOM | 757 | N | ASP | A | 241 | −1.744 | −8.882 | 3.830 | 1.00 | 16.04 | N |
| ATOM | 758 | CA | ASP | A | 241 | −0.399 | −8.446 | 3.472 | 1.00 | 12.88 | C |
| ATOM | 759 | C | ASP | A | 241 | 0.663 | −9.491 | 3.732 | 1.00 | 12.48 | C |
| ATOM | 760 | O | ASP | A | 241 | 1.842 | −9.234 | 3.490 | 1.00 | 15.24 | O |
| ATOM | 761 | CB | ASP | A | 241 | −0.035 | −7.164 | 4.212 | 1.00 | 15.52 | C |
| ATOM | 762 | CG | ASP | A | 241 | −0.053 | −7.332 | 5.733 | 1.00 | 19.38 | C |
| ATOM | 763 | OD1 | ASP | A | 241 | −0.451 | −8.416 | 6.231 | 1.00 | 19.33 | O |
| ATOM | 764 | OD2 | ASP | A | 241 | 0.293 | −6.358 | 6.430 | 1.00 | 17.43 | O |
| ATOM | 765 | N | ASP | A | 242 | 0.249 | −10.652 | 4.237 | 1.00 | 17.41 | N |
| ATOM | 766 | CA | ASP | A | 242 | 1.166 | −11.774 | 4.527 | 1.00 | 16.54 | C |
| ATOM | 767 | C | ASP | A | 242 | 2.465 | −11.313 | 5.190 | 1.00 | 16.20 | C |
| ATOM | 768 | O | ASP | A | 242 | 3.572 | −11.552 | 4.700 | 1.00 | 18.85 | O |
| ATOM | 769 | CB | ASP | A | 242 | 1.487 | −12.530 | 3.261 | 1.00 | 16.74 | C |
| ATOM | 770 | CG | ASP | A | 242 | 2.053 | −13.888 | 3.538 | 1.00 | 21.40 | C |
| ATOM | 771 | OD1 | ASP | A | 242 | 1.481 | −14.576 | 4.413 | 1.00 | 17.68 | O |
| ATOM | 772 | OD2 | ASP | A | 242 | 3.066 | −14.253 | 2.887 | 1.00 | 16.85 | O |
| ATOM | 773 | N | TRP | A | 243 | 2.301 | −10.617 | 6.299 | 1.00 | 15.83 | N |
| ATOM | 774 | CA | TRP | A | 243 | 3.382 | −9.929 | 6.960 | 1.00 | 16.80 | C |
| ATOM | 775 | C | TRP | A | 243 | 4.390 | −10.913 | 7.545 | 1.00 | 16.03 | C |
| ATOM | 776 | O | TRP | A | 243 | 4.020 | −11.905 | 8.153 | 1.00 | 15.06 | O |
| ATOM | 777 | CB | TRP | A | 243 | 2.799 | −9.041 | 8.043 | 1.00 | 19.08 | C |
| ATOM | 778 | CG | TRP | A | 243 | 3.727 | −8.029 | 8.570 | 1.00 | 24.75 | C |
| ATOM | 779 | CD1 | TRP | A | 243 | 4.591 | −7.248 | 7.857 | 1.00 | 21.85 | C |
| ATOM | 780 | CD2 | TRP | A | 243 | 3.888 | −7.665 | 9.942 | 1.00 | 19.00 | C |
| ATOM | 781 | NE1 | TRP | A | 243 | 5.274 | −6.417 | 8.707 | 1.00 | 20.11 | N |
| ATOM | 782 | CE2 | TRP | A | 243 | 4.858 | −6.653 | 9.993 | 1.00 | 17.79 | C |
| ATOM | 783 | CE3 | TRP | A | 243 | 3.296 | −8.092 | 11.133 | 1.00 | 19.98 | C |
| ATOM | 784 | CZ2 | TRP | A | 243 | 5.259 | −6.067 | 11.189 | 1.00 | 19.26 | C |
| ATOM | 785 | CZ3 | TRP | A | 243 | 3.697 | −7.508 | 12.321 | 1.00 | 19.32 | C |
| ATOM | 786 | CH2 | TRP | A | 243 | 4.666 | −6.508 | 12.338 | 1.00 | 14.64 | C |
| ATOM | 787 | N | TYR | A | 244 | 5.671 | −10.643 | 7.350 | 1.00 | 19.42 | N |
| ATOM | 788 | CA | TYR | A | 244 | 6.694 | −11.486 | 7.945 | 1.00 | 20.57 | C |
| ATOM | 789 | C | TYR | A | 244 | 7.295 | −10.760 | 9.140 | 1.00 | 19.06 | C |

TABLE 10.1-continued

| | | | | | | | | | | |
|---|---|---|---|---|---|---|---|---|---|---|
| ATOM | 790 | O | TYR | A | 244 | 8.022 | −11.353 | 9.930 | 1.00 | 17.76 O |
| ATOM | 791 | CB | TYR | A | 244 | 7.784 | −11.833 | 6.932 | 1.00 | 18.60 C |
| ATOM | 792 | CG | TYR | A | 244 | 7.501 | −13.035 | 6.056 | 1.00 | 24.25 C |
| ATOM | 793 | CD1 | TYR | A | 244 | 6.568 | −12.970 | 5.020 | 1.00 | 17.33 C |
| ATOM | 794 | CD2 | TYR | A | 244 | 8.189 | −14.228 | 6.244 | 1.00 | 24.36 C |
| ATOM | 795 | CE1 | TYR | A | 244 | 6.321 | −14.070 | 4.203 | 1.00 | 18.22 C |
| ATOM | 796 | CE2 | TYR | A | 244 | 7.945 | −15.342 | 5.436 | 1.00 | 21.75 C |
| ATOM | 797 | CZ | TYR | A | 244 | 7.016 | −15.257 | 4.415 | 1.00 | 19.74 C |
| ATOM | 798 | OH | TYR | A | 244 | 6.776 | −16.367 | 3.620 | 1.00 | 14.89 O |
| ATOM | 799 | N | GLY | A | 245 | 6.958 | −9.478 | 9.265 | 1.00 | 19.02 N |
| ATOM | 800 | CA | GLY | A | 245 | 7.658 | −8.568 | 10.152 | 1.00 | 20.36 C |
| ATOM | 801 | C | GLY | A | 245 | 7.367 | −8.768 | 11.621 | 1.00 | 19.87 C |
| ATOM | 802 | O | GLY | A | 245 | 7.941 | −8.086 | 12.475 | 1.00 | 21.29 O |
| ATOM | 803 | N | HIS | A | 246 | 6.463 | −9.696 | 11.910 | 1.00 | 19.33 N |
| ATOM | 804 | CA | HIS | A | 246 | 6.150 | −10.062 | 13.277 | 1.00 | 17.48 C |
| ATOM | 805 | C | HIS | A | 246 | 7.284 | −10.899 | 13.844 | 1.00 | 18.02 C |
| ATOM | 806 | O | HIS | A | 246 | 7.418 | −11.015 | 15.053 | 1.00 | 22.65 O |
| ATOM | 807 | CB | HIS | A | 246 | 4.825 | −10.823 | 13.340 | 1.00 | 15.31 C |
| ATOM | 808 | CG | HIS | A | 246 | 4.719 | −11.907 | 12.316 | 1.00 | 19.52 C |
| ATOM | 809 | ND1 | HIS | A | 246 | 5.326 | −13.134 | 12.467 | 1.00 | 16.40 N |
| ATOM | 810 | CD2 | HIS | A | 246 | 4.101 | −11.937 | 11.112 | 1.00 | 16.23 C |
| ATOM | 811 | CE1 | HIS | A | 246 | 5.085 | −13.875 | 11.400 | 1.00 | 17.63 C |
| ATOM | 812 | NE2 | HIS | A | 246 | 4.343 | −13.172 | 10.564 | 1.00 | 16.33 N |
| ATOM | 813 | N | GLY | A | 247 | 8.098 | −11.482 | 12.968 | 1.00 | 18.78 N |
| ATOM | 814 | CA | GLY | A | 247 | 9.295 | −12.193 | 13.394 | 1.00 | 17.32 C |
| ATOM | 815 | C | GLY | A | 247 | 9.030 | −13.544 | 14.022 | 1.00 | 19.13 C |
| ATOM | 816 | O | GLY | A | 247 | 9.904 | −14.116 | 14.677 | 1.00 | 21.71 O |
| ATOM | 817 | N | LEU | A | 248 | 7.828 | −14.074 | 13.81 | 1.00 | 20.58 N |
| ATOM | 818 | CA | LEU | A | 248 | 7.427 | −15.330 | 14.447 | 1.00 | 17.12 C |
| ATOM | 819 | C | LEU | A | 248 | 7.676 | −16.527 | 13.537 | 1.00 | 14.44 C |
| ATOM | 820 | O | LEU | A | 248 | 7.565 | −17.670 | 13.977 | 1.00 | 17.33 O |
| ATOM | 821 | CB | LEU | A | 248 | 5.951 | −15.270 | 14.852 | 1.00 | 19.74 C |
| ATOM | 822 | CG | LEU | A | 248 | 5.635 | −14.119 | 15.804 | 1.00 | 17.23 C |
| ATOM | 823 | CD1 | LEU | A | 248 | 4.193 | −14.193 | 16.254 | 1.00 | 17.05 C |
| ATOM | 824 | CD2 | LEU | A | 248 | 6.599 | −14.120 | 17.007 | 1.00 | 16.08 C |
| ATOM | 825 | N | GLY | A | 249 | 7.920 | −16.261 | 12.263 | 1.00 | 17.53 N |
| ATOM | 826 | CA | GLY | A | 249 | 8.159 | −17.332 | 11.315 | 1.00 | 16.74 C |
| ATOM | 827 | C | GLY | A | 249 | 7.032 | −17.381 | 10.316 | 1.00 | 15.59 C |
| ATOM | 828 | O | GLY | A | 249 | 5.874 | −17.344 | 10.708 | 1.00 | 17.37 O |
| ATOM | 829 | N | GLY | A | 250 | 7.370 | −17.451 | 9.029 | 1.00 | 14.92 N |
| ATOM | 830 | CA | GLY | A | 250 | 6.370 | −17.435 | 7.982 | 1.00 | 19.03 C |
| ATOM | 831 | C | GLY | A | 250 | 5.672 | −16.090 | 7.891 | 1.00 | 20.35 C |
| ATOM | 832 | O | GLY | A | 250 | 6.054 | −15.119 | 8.549 | 1.00 | 18.82 O |
| ATOM | 833 | N | GLY | A | 251 | 4.646 | −16.022 | 7.057 | 1.00 | 21.60 N |
| ATOM | 834 | CA | GLY | A | 251 | 3.910 | −14.787 | 6.880 | 1.00 | 17.04 C |
| ATOM | 835 | C | GLY | A | 251 | 2.691 | −14.851 | 7.752 | 1.00 | 16.59 C |
| ATOM | 836 | O | GLY | A | 251 | 2.778 | −15.115 | 8.952 | 1.00 | 22.55 O |
| ATOM | 837 | N | GLU | A | 252 | 1.539 | −14.636 | 7.137 | 1.00 | 16.53 N |
| ATOM | 838 | CA | GLU | A | 252 | 0.272 | −14.664 | 7.846 | 1.00 | 15.39 C |
| ATOM | 839 | C | GLU | A | 252 | −0.760 | −15.400 | 7.016 | 1.00 | 17.17 C |
| ATOM | 840 | O | GLU | A | 252 | −1.021 | −15.027 | 5.864 | 1.00 | 14.07 O |
| ATOM | 841 | CB | GLU | A | 252 | −0.201 | −13.253 | 8.143 | 1.00 | 15.30 C |
| ATOM | 842 | CG | GLU | A | 252 | 0.748 | −12.448 | 8.970 | 1.00 | 16.44 C |
| ATOM | 843 | CD | GLU | A | 252 | 0.242 | −11.045 | 9.189 | 1.00 | 18.48 C |
| ATOM | 844 | OE1 | GLU | A | 252 | 0.261 | −10.579 | 10.340 | 1.00 | 16.20 O |
| ATOM | 845 | OE2 | GLU | A | 252 | −0.159 | −10.400 | 8.200 | 1.00 | 15.99 O |
| ATOM | 846 | N | ASP | A | 253 | −1.355 | −16.437 | 7.590 | 1.00 | 15.10 N |
| ATOM | 847 | CA | ASP | A | 253 | −2.163 | −17.337 | 6.787 | 1.00 | 16.04 C |
| ATOM | 848 | C | ASP | A | 253 | −3.600 | −17.499 | 7.243 | 1.00 | 15.46 C |
| ATOM | 849 | O | ASP | A | 253 | −4.310 | −18.320 | 6.713 | 1.00 | 17.45 O |
| ATOM | 850 | CB | ASP | A | 253 | −1.519 | −18.719 | 6.745 | 1.00 | 15.26 C |
| ATOM | 851 | CG | ASP | A | 253 | −0.090 | −18.683 | 6.258 | 1.00 | 18.84 C |
| ATOM | 852 | OD1 | ASP | A | 253 | 0.337 | −17.664 | 5.670 | 1.00 | 19.76 O |
| ATOM | 853 | OD2 | ASP | A | 253 | 0.605 | −19.703 | 6.423 | 1.00 | 24.71 O |
| ATOM | 854 | N | CYS | A | 254 | −4.029 | −16.745 | 8.238 | 1.00 | 15.58 N |
| ATOM | 855 | CA | CYS | A | 254 | −5.321 | −17.012 | 8.818 | 1.00 | 13.38 C |
| ATOM | 856 | C | CYS | A | 254 | −6.083 | −15.715 | 9.012 | 1.00 | 17.24 C |
| ATOM | 857 | O | CYS | A | 254 | −5.577 | −14.778 | 9.643 | 1.00 | 17.90 O |
| ATOM | 858 | CB | CYS | A | 254 | −5.161 | −17.762 | 10.147 | 1.00 | 17.64 C |
| ATOM | 859 | SG | CYS | A | 254 | −4.659 | −19.487 | 9.965 | 1.00 | 15.82 S |
| ATOM | 860 | N | ALA | A | 255 | −7.298 | −15.672 | 8.474 | 1.00 | 10.34 N |
| ATOM | 861 | CA | ALA | A | 255 | −8.134 | −14.474 | 8.555 | 1.00 | 15.36 C |
| ATOM | 862 | C | ALA | A | 255 | −8.863 | −14.334 | 9.886 | 1.00 | 16.38 C |
| ATOM | 863 | O | ALA | A | 255 | −9.420 | −15.293 | 10.424 | 1.00 | 15.65 O |
| ATOM | 864 | CB | ALA | A | 255 | −9.153 | −14.460 | 7.430 | 1.00 | 13.09 C |
| ATOM | 865 | N | HIS | A | 256 | −8.886 | −13.116 | 10.401 | 1.00 | 15.41 N |
| ATOM | 866 | CA | HIS | A | 256 | −9.712 | −12.834 | 11.552 | 1.00 | 16.09 C |
| ATOM | 867 | C | HIS | A | 256 | −10.427 | −11.512 | 11.367 | 1.00 | 14.49 C |
| ATOM | 868 | O | HIS | A | 256 | −9.986 | −10.664 | 10.599 | 1.00 | 17.03 O |
| ATOM | 869 | CB | HIS | A | 256 | −8.874 | −12.816 | 12.841 | 1.00 | 11.61 C |

TABLE 10.1-continued

| ATOM | 870 | CG | HIS | A | 256 | −7.844 | 11.733 | 12.885 | 1.00 | 15.00 | C |
|---|---|---|---|---|---|---|---|---|---|---|---|
| ATOM | 871 | ND1 | HIS | A | 256 | −7.979 | 10.609 | 13.673 | 1.00 | 13.69 | N |
| ATOM | 872 | CD2 | HIS | A | 256 | −6.657 | 11.605 | 12.245 | 1.00 | 13.08 | C |
| ATOM | 873 | CE1 | HIS | A | 256 | −6.915 | −9.840 | 13.522 | 1.00 | 15.34 | C |
| ATOM | 874 | NE2 | HIS | A | 256 | −6.098 | 10.423 | 12.661 | 1.00 | 15.12 | N |
| ATOM | 875 | N | PHE | A | 257 | −11.543 | 11.357 | 12.065 | 1.00 | 16.75 | N |
| ATOM | 876 | CA | PHE | A | 257 | −12.147 | 10.057 | 12.229 | 1.00 | 14.34 | C |
| ATOM | 877 | C | PHE | A | 257 | −11.246 | −9.225 | 13.119 | 1.00 | 16.09 | C |
| ATOM | 878 | O | PHE | A | 257 | −10.752 | −9.703 | 14.142 | 1.00 | 16.99 | O |
| ATOM | 879 | CB | PHE | A | 257 | −13.541 | 10.159 | 12.844 | 1.00 | 13.50 | C |
| ATOM | 880 | CG | PHE | A | 257 | −14.430 | 11.166 | 12.176 | 1.00 | 21.06 | C |
| ATOM | 881 | CD2 | PHE | A | 257 | −14.462 | 12.477 | 12.618 | 1.00 | 16.97 | C |
| ATOM | 882 | CD1 | PHE. | A | 257 | −15.233 | 10.803 | 11.098 | 1.00 | 18.50 | C |
| ATOM | 883 | CE2 | PHE | A | 257 | −15.277 | 13.410 | 12.003 | 1.00 | 17.90 | C |
| ATOM | 884 | CE1 | PHE | A | 257 | −16.049 | 11.729 | 10.487 | 1.00 | 16.37 | C |
| ATOM | 885 | CZ | PHE | A | 257 | −16.066 | 13.029 | 10.928 | 1.00 | 14.28 | C |
| ATOM | 886 | N | THR | A | 258 | −11.039 | −7.979 | 12.734 | 1.00 | 15.18 | N |
| ATOM | 887 | CA | THR | A | 258 | −10.337 | −7.053 | 13.597 | 1.00 | 19.93 | C |
| ATOM | 888 | C | THR | A | 258 | −11.351 | −6.356 | 14.465 | 1.00 | 22.34 | C |
| ATOM | 889 | O | THR | A | 258 | −12.557 | −6.616 | 14.356 | 1.00 | 28.29 | O |
| ATOM | 890 | CB | THR | A | 258 | −9.553 | −6.014 | 12.814 | 1.00 | 18.33 | C |
| ATOM | 891 | OG1 | THR | A | 258 | −10.468 | −5.213 | 12.058 | 1.00 | 17.14 | O |
| ATOM | 892 | CG2 | THR | A | 258 | −8.569 | −6.692 | 11.876 | 1.00 | 19.40 | C |
| ATOM | 893 | N | ASP | A | 259 | −10.869 | −5.459 | 15.316 | 1.00 | 20.10 | N |
| ATOM | 894 | CA | ASP | A | 259 | −11.735 | −4.749 | 16.250 | 1.00 | 23.59 | C |
| ATOM | 895 | C | ASP | A | 259 | −12.909 | −4.037 | 15.572 | 1.00 | 23.64 | C |
| ATOM | 896 | O | ASP | A | 259 | −13.984 | −3.947 | 16.148 | 1.00 | 24.14 | O |
| ATOM | 897 | CB | ASP | A | 259 | −10.911 | −3.747 | 17.079 | 1.00 | 22.86 | C |
| ATOM | 898 | CG | ASP | A | 259 | −10.205 | −2.685 | 16.223 | 1.00 | 30.45 | C |
| ATOM | 899 | OD1 | ASP | A | 259 | −10.086 | −2.851 | 14.987 | 1.00 | 32.11 | O |
| ATOM | 900 | OD2 | ASP | A | 259 | −9.736 | −1.679 | 16.808 | 1.00 | 36.17 | O |
| ATOM | 901 | N | ASP | A | 260 | −12.710 | −3.542 | 14.351 | 1.00 | 27.68 | N |
| ATOM | 902 | CA | ASP | A | 260 | −13.762 | −2.778 | 13.673 | 1.00 | 24.53 | C |
| ATOM | 903 | C | ASP | A | 260 | −14.544 | −3.664 | 12.716 | 1.00 | 23.69 | C |
| ATOM | 904 | O | ASP | A | 260 | −15.474 | −3.208 | 12.055 | 1.00 | 27.59 | O |
| ATOM | 905 | CB | ASP | A | 260 | −13.177 | −1.551 | 12.934 | 1.00 | 23.65 | C |
| ATOM | 906 | CG | ASP | A | 260 | −12.279 | −1.920 | 11.738 | 1.00 | 31.18 | C |
| ATOM | 907 | OD1 | ASP | A | 260 | −12.578 | −2.896 | 11.008 | 1.00 | 25.05 | O |
| ATOM | 908 | OD2 | ASP | A | 260 | −11.267 | −1.206 | 11.514 | 1.00 | 30.59 | O |
| ATOM | 909 | N | GLY | A | 261 | −14.138 | −4.927 | 12.617 | 1.00 | 24.03 | N |
| ATOM | 910 | CA | GLY | A | 261 | −14.898 | −5.908 | 11.863 | 1.00 | 18.76 | C |
| ATOM | 911 | C | GLY | A | 261 | −14.236 | −6.262 | 10.550 | 1.00 | 17.99 | C |
| ATOM | 912 | O | GLY | A | 261 | −14.459 | −7.331 | 10.004 | 1.00 | 13.89 | O |
| ATOM | 913 | N | ARG | A | 262 | −13.392 | −5.373 | 10.048 | 1.00 | 19.30 | N |
| ATOM | 914 | CA | ARC | A | 262 | −12.709 | −5.649 | 8.791 | 1.00 | 19.10 | C |
| ATOM | 915 | C | ARG | A | 262 | −11.659 | −6.749 | 8.989 | 1.00 | 19.94 | C |
| ATOM | 916 | O | ARG | A | 262 | −11.216 | −7.016 | 10.120 | 1.00 | 12.26 | O |
| ATOM | 917 | CB | ARG | A | 262 | −12.115 | −4.356 | 8.232 | 1.00 | 20.66 | C |
| ATOM | 918 | CG | ARG | A | 262 | −13.219 | −3.351 | 7.897 | 1.00 | 25.30 | C |
| ATOM | 919 | CD | ARG | A | 262 | −12.667 | −2.017 | 7.453 | 1.00 | 28.34 | C |
| ATOM | 920 | NE | ARG | A | 262 | −11.765 | −1.459 | 8.449 | 1.00 | 25.73 | N |
| ATOM | 921 | CZ | ARG | A | 262 | −11.035 | −0.367 | 8.254 | 1.00 | 29.19 | C |
| ATOM | 922 | NH1 | ARG | A | 262 | −11.114 | 0.278 | 7.100 | 1.00 | 24.96 | N |
| ATOM | 923 | NH2 | ARG | A | 262 | −10.229 | 0.079 | 9.208 | 1.00 | 29.61 | N |
| ATOM | 924 | N | TRP | A | 263 | −11.307 | −7.432 | 7.903 | 1.00 | 14.26 | N |
| ATOM | 925 | CA | TRP | A | 263 | −10.517 | −8.648 | 8.041 | 1.00 | 16.50 | C |
| ATOM | 926 | C | TRP | A | 263 | −9.043 | −8.337 | 8.000 | 1.00 | 15.53 | C |
| ATOM | 927 | O | TRP | A | 263 | −8.627 | −7.337 | 7.443 | 1.00 | 16.65 | O |
| ATOM | 928 | CB | TRP | A | 263 | −10.851 | −9.661 | 6.946 | 1.00 | 13.91 | C |
| ATOM | 929 | CG | TRP | A | 263 | −12.290 | 10.013 | 6.862 | 1.00 | 16.25 | C |
| ATOM | 930 | CD1 | TRP | A | 263 | −13.273 | −9.643 | 7.721 | 1.00 | 13.40 | C |
| ATOM | 931 | CD2 | TRP | A | 263 | −12.918 | 10.804 | 5.846 | 1.00 | 17.03 | C |
| ATOM | 932 | NE1 | TRP | A | 263 | −14.473 | 10.156 | 7.314 | 1.00 | 15.19 | N |
| ATOM | 933 | CE2 | TRP | A | 263 | −14.284 | 10.870 | 6.160 | 1.00 | 14.98 | C |
| ATOM | 934 | CE3 | TRP | A | 263 | −12.456 | 11.455 | 4.697 | 1.00 | 13.09 | C |
| ATOM | 935 | CZ2 | TRP | A | 263 | −15.196 | 11.577 | 5.378 | 1.00 | 19.78 | C |
| ATOM | 936 | CZ3 | TRP | A | 263 | −13.360 | 12.154 | 3.922 | 1.00 | 16.68 | C |
| ATOM | 937 | CH2 | TRP | A | 263 | −14.716 | 12.206 | 4.261 | 1.00 | 16.08 | C |
| ATOM | 938 | N | ASN | A | 264 | −8.262 | −9.226 | 8.588 | 1.00 | 15.51 | N |
| ATOM | 939 | CA | ASN | A | 264 | −6.816 | −9.162 | 8.521 | 1.00 | 14.14 | C |
| ATOM | 940 | C | ASN | A | 264 | −6.313 | 10.573 | 8.398 | 1.00 | 14.75 | C |
| ATOM | 941 | O | ASN | A | 264 | −6.994 | 11.503 | 8.817 | 1.00 | 18.31 | O |
| ATOM | 942 | CB | ASN | A | 264 | −6.239 | −8.490 | 9.768 | 1.00 | 17.34 | C |
| ATOM | 943 | CG | ASN | A | 264 | −4.721 | −8.499 | 9.794 | 1.00 | 18.04 | C |
| ATOM | 944 | OD1 | ASN | A | 264 | −4.070 | −8.128 | 8.820 | 1.00 | 13.84 | O |
| ATOM | 945 | ND2 | ASN | A | 264 | −4.151 | −8.917 | 10.923 | 1.00 | 16.66 | N |
| ATOM | 946 | N | ASP | A | 265 | −5.146 | 10.757 | 7.795 | 1.00 | 18.48 | N |
| ATOM | 947 | CA | ASP | A | 265 | −4.527 | 12.072 | 7.800 | 1.00 | 18.19 | C |
| ATOM | 948 | C | ASP | A | 265 | −3.499 | 11.991 | 8.902 | 1.00 | 17.54 | C |
| ATOM | 949 | O | ASP | A | 265 | −2.814 | 10.980 | 9.030 | 1.00 | 18.38 | O |

TABLE 10.1-continued

| | | | | | | | | | |
|---|---|---|---|---|---|---|---|---|---|
| ATOM | 950 | CB | ASP | A | 265 | −3.912 | −12.455 | 6.438 | 1.00 | 15.50 C |
| ATOM | 951 | CG | ASP | A | 265 | −2.875 | −11.458 | 5.943 | 1.00 | 16.55 C |
| ATOM | 952 | OD1 | ASP | A | 265 | −2.920 | −10.277 | 6.358 | 1.00 | 15.74 O |
| ATOM | 953 | OD2 | ASP | A | 265 | −2.022 | −11.858 | 5.106 | 1.00 | 16.21 O |
| ATOM | 954 | N | ASP | A | 266 | −3.449 | −13.013 | 9.745 | 1.00 | 15.99 N |
| ATOM | 955 | CA | ASP | A | 266 | −2.527 | −12.977 | 10.867 | 1.00 | 16.72 C |
| ATOM | 956 | C | ASP | A | 266 | −1.843 | −14.321 | 11.085 | 1.00 | 19.73 C |
| ATOM | 957 | O | ASP | A | 266 | −2.100 | −15.292 | 10.371 | 1.00 | 18.63 O |
| ATOM | 958 | CB | ASP | A | 266 | −3.244 | −12.542 | 12.139 | 1.00 | 15.67 C |
| ATOM | 959 | CG | ASP | A | 266 | −2.356 | −11.743 | 13.041 | 1.00 | 20.35 C |
| ATOM | 960 | OD2 | ASP | A | 266 | −2.877 | −10.827 | 13.717 | 1.00 | 20.40 O |
| ATOM | 961 | OD1 | ASP | A | 266 | −1.130 | −12.024 | 13.055 | 1.00 | 18.05 O |
| ATOM | 962 | N | VAL | A | 267 | −0.951 | −14.365 | 12.069 | 1.00 | 21.31 N |
| ATOM | 963 | CA | VAL | A | 267 | −0.236 | −15.588 | 12.357 | 1.00 | 20.03 C |
| ATOM | 964 | C | VAL | A | 267 | −1.206 | −16.604 | 12.957 | 1.00 | 17.18 C |
| ATOM | 965 | O | VAL | A | 267 | −1.904 | −16.301 | 13.923 | 1.00 | 19.78 O |
| ATOM | 966 | CB | VAL | A | 267 | 0.935 | −15.327 | 13.302 | 1.00 | 18.16 C |
| ATOM | 967 | CG1 | VAL | A | 267 | 1.670 | −16.609 | 13.576 | 1.00 | 19.68 C |
| ATOM | 968 | CG2 | VAL | A | 267 | 1.862 | −14.301 | 12.685 | 1.00 | 15.95 C |
| ATOM | 969 | N | CYS | A | 268 | −1.246 | −17.803 | 12.383 | 1.00 | 12.37 N |
| ATOM | 970 | CA | CYS | A | 268 | −2.213 | −18.818 | 12.785 | 1.00 | 14.68 C |
| ATOM | 971 | C | CYS | A | 268 | −2.031 | −19.284 | 14.238 | 1.00 | 14.79 C |
| ATOM | 972 | O | CYS | A | 268 | −2.960 | −19.800 | 14.855 | 1.00 | 17.64 O |
| ATOM | 973 | CB | CYS | A | 268 | −2.140 | −20.010 | 11.832 | 1.00 | 15.66 C |
| ATOM | 974 | SG | CYS | A | 268 | −2.628 | −19.567 | 10.101 | 1.00 | 27.47 S |
| ATOM | 975 | N | GLN | A | 269 | −0.851 | −19.069 | 14.786 | 1.00 | 13.72 N |
| ATOM | 976 | CA | GLN | A | 269 | −0.559 | −19.493 | 16.149 | 1.00 | 16.48 C |
| ATOM | 977 | C | GLN | A | 269 | −1.136 | −18.565 | 17.190 | 1.00 | 15.79 C |
| ATOM | 978 | O | GLN | A | 269 | −1.204 | −18.920 | 18.376 | 1.00 | 17.70 O |
| ATOM | 979 | CB | GLN | A | 269 | 0.934 | −19.562 | 16.397 | 1.00 | 17.79 C |
| ATOM | 980 | CG | GLN | A | 269 | 1.752 | −20.417 | 15.507 | 1.00 | 20.66 C |
| ATOM | 981 | CD | GLN | A | 269 | 3.240 | −20.205 | 15.825 | 1.00 | 31.48 C |
| ATOM | 982 | OE1 | GLN | A | 269 | 3.870 | −19.269 | 15.315 | 1.00 | 28.23 O |
| ATOM | 983 | NE2 | GLN | A | 269 | 3.786 | −21.039 | 16.708 | 1.00 | 24.46 N |
| ATOM | 984 | N | ARG | A | 270 | −1.501 | −17.358 | 16.781 | 1.00 | 13.72 N |
| ATOM | 985 | CA | ARG | A | 270 | −2.043 | −16.420 | 17.759 | 1.00 | 14.78 C |
| ATOM | 986 | C | ARG | A | 270 | −3.318 | −16.974 | 18.307 | 1.00 | 13.79 C |
| ATOM | 987 | O | ARG | A | 270 | −4.116 | −17.542 | 17.558 | 1.00 | 16.01 O |
| ATOM | 988 | CB | ARG | A | 270 | −2.301 | −15.045 | 17.162 | 1.00 | 13.63 C |
| ATOM | 989 | CG | ARG | A | 270 | −1.059 | −14.369 | 16.672 | 1.00 | 17.92 C |
| ATOM | 990 | CD | ARG | A | 270 | −1.316 | −12.904 | 16.442 | 1.00 | 15.26 C |
| ATOM | 991 | NE | ARG | A | 270 | −0.240 | −12.295 | 15.678 | 1.00 | 18.21 N |
| ATOM | 992 | CZ | ARG | A | 270 | 0.907 | −11.880 | 16.206 | 1.00 | 17.13 C |
| ATOM | 993 | NH1 | ARG | A | 270 | 1.137 | −12.008 | 17.513 | 1.00 | 15.71 N |
| ATOM | 994 | NH2 | ARG | A | 270 | 1.814 | −11.320 | 15.426 | 1.00 | 12.96 N |
| ATOM | 995 | N | PRO | A | 271 | −3.503 | −16.833 | 19.623 | 1.00 | 14.36 N |
| ATOM | 996 | CA | PRO | A | 271 | −4.769 | −17.166 | 20.253 | 1.00 | 12.34 C |
| ATOM | 997 | C | PRO | A | 271 | −5.760 | −15.999 | 20.077 | 1.00 | 13.26 C |
| ATOM | 998 | O | PRO | A | 271 | −5.535 | −14.874 | 20.507 | 1.00 | 14.69 O |
| ATOM | 999 | CB | PRO | A | 271 | −4.381 | −17.391 | 21.727 | 1.00 | 15.38 C |
| ATOM | 1000 | CG | PRO | A | 271 | −3.151 | −16.556 | 21.928 | 1.00 | 15.88 C |
| ATOM | 1001 | CD | PRO | A | 271 | −2.502 | −16.336 | 20.593 | 1.00 | 15.31 C |
| ATOM | 1002 | N | TYR | A | 272 | −6.855 | −16.285 | 19.400 | 1.00 | 13.29 N |
| ATOM | 1003 | CA | TYR | A | 272 | −7.918 | −15.315 | 19.193 | 1.00 | 16.14 C |
| ATOM | 1004 | C | TYR | A | 272 | −9.201 | −16.027 | 19.549 | 1.00 | 13.34 C |
| ATOM | 1005 | O | TYR | A | 272 | −9.224 | −17.253 | 19.601 | 1.00 | 12.02 O |
| ATOM | 1006 | CB | TYR | A | 272 | −7.982 | −14.830 | 17.736 | 1.00 | 11.47 C |
| ATOM | 1007 | CG | TYR | A | 272 | −6.967 | −13.776 | 17.310 | 1.00 | 13.69 C |
| ATOM | 1008 | CD1 | TYR | A | 272 | −6.439 | −12.872 | 18.213 | 1.00 | 9.93 C |
| ATOM | 1009 | CD2 | TYR | A | 272 | −6.574 | −13.673 | 15.969 | 1.00 | 12.95 C |
| ATOM | 1010 | CE1 | TYR | A | 272 | −5.538 | −11.914 | 17.807 | 1.00 | 11.19 C |
| ATOM | 1011 | CE2 | TYR | A | 272 | −5.684 | −12.723 | 15.561 | 1.00 | 9.94 C |
| ATOM | 1012 | CZ | TYR | A | 272 | −5.164 | −11.845 | 16.484 | 1.00 | 14.00 C |
| ATOM | 1013 | OH | TYR | A | 272 | −4.257 | −10.893 | 16.080 | 1.00 | 17.41 O |
| ATOM | 1014 | N | ARG | A | 273 | −10.271 | −15.272 | 19.765 | 1.00 | 12.95 N |
| ATOM | 1015 | CA | ARG | A | 273 | −11.572 | −15.885 | 19.870 | 1.00 | 12.35 C |
| ATOM | 1016 | C | ARG | A | 273 | −11.927 | −16.389 | 18.493 | 1.00 | 14.06 C |
| ATOM | 1017 | O | ARG | A | 273 | −11.229 | −16.088 | 17.517 | 1.00 | 14.38 O |
| ATOM | 1018 | CB | ARG | A | 273 | −12.611 | −14.905 | 20.397 | 1.00 | 14.33 C |
| ATOM | 1019 | CG | ARG | A | 273 | −12.364 | −14.520 | 21.841 | 1.00 | 12.78 C |
| ATOM | 1020 | CD | ARG | A | 273 | −13.449 | −13.645 | 22.401 | 1.00 | 17.64 C |
| ATOM | 1021 | NE | ARG | A | 273 | −13.276 | −13.515 | 23.840 | 1.00 | 21.61 N |
| ATOM | 1022 | CZ | ARG | A | 273 | −14.015 | −12.742 | 24.625 | 1.00 | 24.75 C |
| ATOM | 1023 | NH1 | ARG | A | 273 | −14.997 | −12.010 | 24.109 | 1.00 | 30.00 N |
| ATOM | 1024 | NH2 | ARG | A | 273 | −13.763 | −12.702 | 25.930 | 1.00 | 20.72 N |
| ATOM | 1025 | N | TRP | A | 274 | −12.986 | −17.183 | 18.411 | 1.00 | 13.15 N |
| ATOM | 1026 | CA | TRP | A | 274 | −13.420 | −17.706 | 17.130 | 1.00 | 13.83 C |
| ATOM | 1027 | C | TRP | A | 274 | −14.926 | −17.845 | 17.166 | 1.00 | 15.15 C |
| ATOM | 1028 | O | TRP | A | 274 | −15.525 | −17.760 | 18.227 | 1.00 | 14.10 O |
| ATOM | 1029 | CB | TRP | A | 274 | −12.758 | −19.043 | 16.833 | 1.00 | 12.63 C |

TABLE 10.1-continued

| | | | | | | | | | |
|---|---|---|---|---|---|---|---|---|---|
| ATOM | 1030 | CG | TRP | A | 274 | −13.207 | −20.135 | 17.726 | 1.00 | 16.63 C |
| ATOM | 1031 | CD1 | TRP | A | 274 | −14.106 | −21.107 | 17.428 | 1.00 | 18.08 C |
| ATOM | 1032 | CD2 | TRP | A | 274 | −12.780 | −20.377 | 19.080 | 1.00 | 14.16 C |
| ATOM | 1033 | NE1 | TRP | A | 274 | −14.265 | −21.951 | 18.507 | 1.00 | 15.30 N |
| ATOM | 1034 | CE2 | TRP | A | 274 | −13.463 | −21.521 | 19.533 | 1.00 | 15.80 C |
| ATOM | 1035 | CE3 | TRP | A | 274 | −11.874 | −19.744 | 19.944 | 1.00 | 16.39 C |
| ATOM | 1036 | CZ2 | TRP | A | 274 | −13.282 | −22.046 | 20.822 | 1.00 | 16.41 C |
| ATOM | 1037 | CZ3 | TRP | A | 274 | −11.700 | −20.261 | 21.226 | 1.00 | 17.93 C |
| ATOM | 1038 | CH2 | TRP | A | 274 | −12.407 | −21.401 | 21.651 | 1.00 | 14.81 C |
| ATOM | 1039 | N | VAL | A | 275 | −15.532 | −18.025 | 16.003 | 1.00 | 13.91 N |
| ATOM | 1040 | CA | VAL | A | 275 | −16.954 | −18.282 | 15.911 | 1.00 | 14.90 C |
| ATOM | 1041 | C | VAL | A | 275 | −17.157 | −19.604 | 15.214 | 1.00 | 17.68 C |
| ATOM | 1042 | O | VAL | A | 275 | −16.570 | −19.843 | 14.160 | 1.00 | 16.82 O |
| ATOM | 1043 | CB | VAL | A | 275 | −17.690 | −17.199 | 15.126 | 1.00 | 15.04 C |
| ATOM | 1044 | CG1 | VAL | A | 275 | −19.194 | −17.473 | 15.122 | 1.00 | 14.67 C |
| ATOM | 1045 | CG2 | VAL | A | 275 | −17.359 | −15.825 | 15.676 | 1.00 | 12.68 C |
| ATOM | 1046 | N | CYS | A | 276 | −17.993 | −20.463 | 15.791 | 1.00 | 18.92 N |
| ATOM | 1047 | CA | CYS | A | 276 | −18.396 | −21.676 | 15.095 | 1.00 | 20.03 C |
| ATOM | 1048 | C | CYS | A | 276 | −19.725 | −21.444 | 14.397 | 1.00 | 19.45 C |
| ATOM | 1049 | O | CYS | A | 276 | −20.581 | −20.714 | 14.896 | 1.00 | 17.29 O |
| ATOM | 1050 | CB | CYS | A | 276 | −18.493 | −22.859 | 16.055 | 1.00 | 22.59 C |
| ATOM | 1051 | SG | CYS | A | 276 | −16.895 | −23.523 | 16.446 | 1.00 | 31.78 S |
| ATOM | 1052 | N | GLU | A | 277 | −19.865 | −22.050 | 13.225 | 1.00 | 18.94 N |
| ATOM | 1053 | CA | GLU | A | 277 | −21.077 | −21.941 | 12.437 | 1.00 | 21.40 C |
| ATOM | 1054 | C | GLU | A | 277 | −21.492 | −23.299 | 11.919 | 1.00 | 19.98 C |
| ATOM | 1055 | O | GLU | A | 277 | −20.668 | −24.086 | 11.467 | 1.00 | 20.59 O |
| ATOM | 1056 | CB | GLU | A | 277 | −20.887 | −20.988 | 11.263 | 1.00 | 17.46 C |
| ATOM | 1057 | CG | GLU | A | 277 | −22.187 | −20.673 | 10.536 | 1.00 | 21.39 C |
| ATOM | 1058 | CD | GLU | A | 277 | −21.972 | −20.063 | 9.154 | 1.00 | 22.43 C |
| ATOM | 1059 | OE1 | GLU | A | 277 | −20.817 | −20.032 | 8.682 | 1.00 | 21.58 O |
| ATOM | 1060 | OE2 | GLU | A | 277 | −22.962 | −19.607 | 8.540 | 1.00 | 22.39 O |
| ATOM | 1061 | N | THR | A | 278 | −22.778 | −23.572 | 11.998 | 1.00 | 19.21 N |
| ATOM | 1062 | CA | THR | A | 278 | −23.351 | −24.710 | 11.309 | 1.00 | 24.97 C |
| ATOM | 1063 | C | THR | A | 278 | −24.612 | −24.250 | 10.581 | 1.00 | 25.29 C |
| ATOM | 1064 | O | THR | A | 278 | −25.166 | −23.196 | 10.887 | 1.00 | 24.46 O |
| ATOM | 1065 | CB | THR | A | 278 | −23.688 | −25.846 | 12.267 | 1.00 | 25.96 C |
| ATOM | 1066 | OG1 | THR | A | 278 | −23.799 | −27.063 | 11.527 | 1.00 | 36.51 O |
| ATOM | 1067 | CG2 | THR | A | 278 | −24.996 | −25.566 | 12.973 | 1.00 | 23.69 C |
| ATOM | 1068 | N | GLU | A | 279 | −25.065 | −25.033 | 9.613 | 1.00 | 29.02 N |
| ATOM | 1069 | CA | GLU | A | 279 | −26.228 | −24.630 | 8.841 | 1.00 | 31.70 C |
| ATOM | 1070 | C | GLU | A | 279 | −27.438 | −25.498 | 9.167 | 1.00 | 29.56 C |
| ATOM | 1071 | O | GLU | A | 279 | −27.299 | −26.687 | 9.406 | 1.00 | 29.11 O |
| ATOM | 1072 | CB | GLU | A | 279 | −25.911 | −24.678 | 7.347 | 1.00 | 28.64 C |
| ATOM | 1073 | CG | GLU | A | 279 | −24.969 | −23.568 | 6.885 | 1.00 | 27.57 C |
| ATOM | 1074 | CD | GLU | A | 279 | −23.497 | −23.939 | 7.011 | 1.00 | 31.65 C |
| ATOM | 1075 | OE1 | GLU | A | 279 | −22.662 | −23.026 | 7.182 | 1.00 | 30.86 O |
| ATOM | 1076 | OE2 | GLU | A | 279 | −23.166 | −25.139 | 6.923 | 1.00 | 32.59 O |
| ATOM | 1077 | N | LEU | A | 280 | −28.617 | −24.885 | 9.219 | 1.00 | 34.32 N |
| ATOM | 1078 | CA | LEU | A | 280 | −29.855 | −25.649 | 9.304 | 1.00 | 35.91 C |
| ATOM | 1079 | C | LEU | A | 280 | −30.265 | −26.069 | 7.893 | 1.00 | 40.23 C |
| ATOM | 1080 | O | LEU | A | 280 | −30.735 | −27.187 | 7.666 | 1.00 | 43.65 O |
| ATOM | 1081 | CB | LEU | A | 280 | −30.974 | −24.837 | 9.959 | 1.00 | 37.40 C |
| ATOM | 1082 | CG | LEU | A | 280 | −30.811 | −24.359 | 11.398 | 1.00 | 33.17 C |
| ATOM | 1083 | CD1 | LEU | A | 280 | −32.064 | −23.616 | 11.839 | 1.00 | 39.13 C |
| ATOM | 1084 | CD2 | LEU | A | 280 | −30.516 | −25.518 | 12.322 | 1.00 | 36.44 C |
| ATOM | 1085 | OXT | LEU | A | 280 | −30.126 | −25.285 | 6.942 | 1.00 | 35.92 O |
| HETATM | 1086 | CA | CA | A | 1001 | −0.390 | −15.928 | 3.667 | 1.00 | 18.60 Ca |
| HETATM | 1087 | CA | CA | A | 1002 | −1.936 | −8.931 | 8.005 | 1.00 | 15.61 Ca |
| HETATM | 1088 | CA | CA | A | 1003 | −22.072 | −18.548 | 6.675 | 1.00 | 20.87 Ca |
| HETATM | 1089 | CL | CL | A | 1004 | −0.586 | −12.976 | 20.217 | 1.00 | 15.82 Cl |
| HETATM | 1090 | CL | CL | A | 1005 | −16.511 | −11.093 | 27.288 | 1.00 | 51.09 Cl |
| TER | | | | | | | | | | |
| HETATM | 1091 | C1 | NGA | D | 1 | −0.855 | −5.202 | 11.893 | 1.00 | 29.65 C |
| HETATM | 1092 | C2 | NGA | D | 1 | −1.637 | −6.424 | 11.455 | 1.00 | 25.74 C |
| HETATM | 1093 | C3 | NGA | D | 1 | −0.719 | −7.433 | 10.877 | 1.00 | 19.12 C |
| HETATM | 1094 | C4 | NGA | D | 1 | 0.140 | −6.858 | 9.782 | 1.00 | 26.89 C |
| HETATM | 1095 | C5 | NGA | D | 1 | 0.800 | −5.564 | 10.227 | 1.00 | 27.00 C |
| HETATM | 1096 | C6 | NGA | D | 1 | 1.564 | −49.50 | 9.107 | 1.00 | 23.07 C |
| HETATM | 1097 | C7 | NGA | D | 1 | −3.674 | −6.716 | 12.908 | 1.00 | 23.79 C |
| HETATM | 1098 | C8 | NGA | D | 1 | −4.345 | −7.353 | 14.124 | 1.00 | 17.91 C |
| HETATM | 1099 | N2 | NGA | D | 1 | −2.306 | −7.017 | 12.612 | 1.00 | 24.92 N |
| HETATM | 1100 | O1 | NGA | D | 1 | −1.657 | −4.257 | 12.478 | 1.00 | 40.15 O |
| HETATM | 1101 | O3 | NGA | D | 1 | −1.485 | −8.575 | 10.399 | 1.00 | 17.51 O |
| HETATM | 1102 | O4 | NGA | D | 1 | −0.627 | −6.578 | 8.599 | 1.00 | 18.77 O |
| HETATM | 1103 | O5 | NGA | D | 1 | −0.199 | −4.606 | 10.704 | 1.00 | 21.93 O |
| HETATM | 1104 | O6 | NGA | D | 1 | 2.201 | −3.801 | 9.619 | 1.00 | 23.93 O |
| HETATM | 1105 | O7 | NGA | D | 1 | −4.290 | −5.954 | 12.181 | 1.00 | 26.58 O |
| TER | | | | | | | | | | |
| END | | | | | | | | | | |

TABLE 10.2

| | | | | | | | | | | |
|---|---|---|---|---|---|---|---|---|---|---|
| ATOM | 1 | N | GLN | A | 1 | 4.287 | −11.302 | 31.298 | 1.00 | 52.13 | N |
| ATOM | 2 | CA | GLN | A | 1 | 2.840 | −11.140 | 31.183 | 1.00 | 68.91 | C |
| ATOM | 3 | C | GLN | A | 1 | 2.320 | −11.699 | 29.861 | 1.00 | 58.31 | C |
| ATOM | 4 | O | GLN | A | 1 | 3.071 | −11.816 | 28.894 | 1.00 | 49.26 | O |
| ATOM | 5 | CB | GLN | A | 1 | 2.457 | −9.664 | 31.320 | 1.00 | 75.74 | C |
| ATOM | 6 | CG | GLN | A | 1 | 2.710 | −9.088 | 32.707 | 1.00 | 88.73 | C |
| ATOM | 7 | CD | GLN | A | 1 | 1.879 | −9.771 | 33.783 | 1.00 | 100.20 | C |
| ATOM | 8 | NE2 | GLN | A | 1 | 2.448 | −9.903 | 34.978 | 1.00 | 94.67 | N |
| ATOM | 9 | OE1 | GLN | A | 1 | 0.742 | −10.179 | 33.539 | 1.00 | 98.51 | O |
| ATOM | 10 | N | VAL | A | 2 | 1.035 | −12.043 | 29.824 | 1.00 | 56.43 | N |
| ATOM | 11 | CA | VAL | A | 2 | 0.425 | −12.599 | 28.617 | 1.00 | 47.45 | C |
| ATOM | 12 | C | VAL | A | 2 | 0.210 | −11.533 | 27.541 | 1.00 | 49.76 | C |
| ATOM | 13 | O | VAL | A | 2 | −0.422 | −10.506 | 27.790 | 1.00 | 52.22 | O |
| ATOM | 14 | CB | VAL | A | 2 | −0.928 | −13.275 | 28.926 | 1.00 | 51.59 | C |
| ATOM | 15 | CG1 | VAL | A | 2 | −1.627 | −13.682 | 27.636 | 1.00 | 51.80 | C |
| ATOM | 16 | CG2 | VAL | A | 2 | −0.727 | −14.481 | 29.825 | 1.00 | 44.15 | C |
| ATOM | 17 | N | GLN | A | 3 | 0.740 | −11.785 | 26.348 | 1.00 | 39.57 | N |
| ATOM | 18 | CA | GLN | A | 3 | 0.582 | −10.876 | 25.219 | 1.00 | 41.94 | C |
| ATOM | 19 | C | GLN | A | 3 | 0.085 | −11.615 | 23.981 | 1.00 | 38.69 | C |
| ATOM | 20 | O | GLN | A | 3 | 0.586 | −12.691 | 23.649 | 1.00 | 39.97 | O |
| ATOM | 21 | CB | GLN | A | 3 | 1.903 | −10.176 | 24.891 | 1.00 | 40.78 | C |
| ATOM | 22 | CG | GLN | A | 3 | 2.450 | −9.275 | 25.980 | 1.00 | 61.11 | C |
| ATOM | 23 | CD | GLN | A | 3 | 3.756 | −8.612 | 25.570 | 1.00 | 71.25 | C |
| ATOM | 24 | NE2 | GLN | A | 3 | 4.265 | −7.724 | 26.417 | 1.00 | 63.18 | N |
| ATOM | 25 | OE1 | GLN | A | 3 | 4.299 | −8.899 | 24.502 | 1.00 | 74.87 | O |
| ATOM | 26 | N | LEU | A | 4 | −0.896 | −11.035 | 23.298 | 1.00 | 33.31 | N |
| ATOM | 27 | CA | LEU | A | 4 | −1.361 | −11.577 | 22.025 | 1.00 | 32.23 | C |
| ATOM | 28 | C | LEU | A | 4 | −1.077 | −10.581 | 20.903 | 1.00 | 34.08 | C |
| ATOM | 29 | O | LEU | A | 4 | −1.523 | −9.436 | 20.954 | 1.00 | 35.79 | O |
| ATOM | 30 | CB | LEU | A | 4 | −2.854 | −11.904 | 22.076 | 1.00 | 24.96 | C |
| ATOM | 31 | CG | LEU | A | 4 | −3.339 | −12.906 | 23.123 | 1.00 | 35.14 | C |
| ATOM | 32 | CD1 | LEU | A | 4 | −4.849 | −13.045 | 23.036 | 1.00 | 33.63 | C |
| ATOM | 33 | CD2 | LEU | A | 4 | −2.665 | −14.259 | 22.950 | 1.00 | 36.57 | C |
| ATOM | 34 | N | VAL | A | 5 | −0.333 | −11.023 | 19.894 | 1.00 | 34.68 | N |
| ATOM | 35 | CA | VAL | A | 5 | 0.072 | −10.150 | 18.794 | 1.00 | 31.10 | C |
| ATOM | 36 | C | VAL | A | 5 | −0.418 | −10.708 | 17.466 | 1.00 | 27.37 | C |
| ATOM | 37 | O | VAL | A | 5 | −0.029 | −11.804 | 17.061 | 1.00 | 33.78 | O |
| ATOM | 38 | CB | VAL | A | 5 | 1.603 | −9.971 | 18.747 | 1.00 | 33.23 | C |
| ATOM | 39 | CG1 | VAL | A | 5 | 2.000 | −9.098 | 17.564 | 1.00 | 39.33 | C |
| ATOM | 40 | CG2 | VAL | A | 5 | 2.107 | −9.365 | 20.052 | 1.00 | 30.20 | C |
| ATOM | 41 | N | GLN | A | 6 | −1.280 | −9.951 | 16.792 | 1.00 | 27.57 | N |
| ATOM | 42 | CA | GLN | A | 6 | −1.882 | −10.411 | 15.545 | 1.00 | 31.03 | C |
| ATOM | 43 | C | GLN | A | 6 | −1.155 | −9.849 | 14.333 | 1.00 | 32.02 | C |
| ATOM | 44 | O | GLN | A | 6 | −0.447 | −8.847 | 14.431 | 1.00 | 31.18 | O |
| ATOM | 45 | CB | GLN | A | 6 | −3.362 | −10.026 | 15.492 | 1.00 | 23.97 | C |
| ATOM | 46 | CG | GLN | A | 6 | −4.154 | −10.551 | 16.674 | 1.00 | 31.59 | C |
| ATOM | 47 | CD | GLN | A | 6 | −5.613 | −10.158 | 16.634 | 1.00 | 31.89 | C |
| ATOM | 48 | NE2 | GLN | A | 6 | −6.203 | −10.163 | 15.438 | 1.00 | 30.10 | N |
| ATOM | 49 | OE1 | GLN | A | 6 | −6.210 | −9.863 | 17.669 | 1.00 | 28.34 | O |
| ATOM | 50 | N | SER | A | 7 | −1.343 | −10.498 | 13.190 | 1.00 | 28.18 | N |
| ATOM | 51 | CA | SER | A | 7 | −0.769 | −10.018 | 11.941 | 1.00 | 37.96 | C |
| ATOM | 52 | C | SER | A | 7 | −1.529 | −8.784 | 11.456 | 1.00 | 36.31 | C |
| ATOM | 53 | O | SER | A | 7 | −2.504 | −8.356 | 12.088 | 1.00 | 29.94 | O |
| ATOM | 54 | CB | SER | A | 7 | −0.782 | −11.125 | 10.884 | 1.00 | 31.07 | C |
| ATOM | 55 | OG | SER | A | 7 | −2.003 | −11.840 | 10.917 | 1.00 | 34.72 | O |
| ATOM | 56 | N | GLY | A | 8 | −1.084 | −8.220 | 10.336 | 1.00 | 37.68 | N |
| ATOM | 57 | CA | GLY | A | 8 | −1.579 | −6.932 | 9.880 | 1.00 | 34.93 | C |
| ATOM | 58 | C | GLY | A | 8 | −2.778 | −6.994 | 8.957 | 1.00 | 39.24 | C |
| ATOM | 59 | O | GLY | A | 8 | −3.278 | −8.071 | 8.641 | 1.00 | 43.54 | O |
| ATOM | 60 | N | THR | A | 9 | −3.221 | −5.818 | 8.519 | 1.00 | 33.12 | N |
| ATOM | 61 | CA | THR | A | 9 | −4.417 | −5.660 | 7.698 | 1.00 | 34.90 | C |
| ATOM | 62 | C | THR | A | 9 | −4.411 | −6.499 | 6.424 | 1.00 | 34.53 | C |
| ATOM | 63 | O | THR | A | 9 | −3.369 | −6.699 | 5.809 | 1.00 | 36.17 | O |
| ATOM | 64 | CB | THR | A | 9 | −4.612 | −4.186 | 7.290 | 1.00 | 34.99 | C |
| ATOM | 65 | OG1 | THR | A | 9 | −4.305 | −3.333 | 8.400 | 1.00 | 54.03 | O |
| ATOM | 66 | CG2 | THR | A | 9 | −6.032 | −3.948 | 6.877 | 1.00 | 25.09 | C |
| ATOM | 67 | N | GLU | A | 10 | −5.591 | −6.977 | 6.042 | 1.00 | 38.28 | N |
| ATOM | 68 | CA | GLU | A | 10 | −5.770 | −7.781 | 4.840 | 1.00 | 36.11 | C |
| ATOM | 69 | C | GLU | A | 10 | −6.846 | −7.183 | 3.942 | 1.00 | 42.38 | C |
| ATOM | 70 | O | GLU | A | 10 | −7.825 | −6.614 | 4.433 | 1.00 | 36.65 | O |
| ATOM | 71 | CB | GLU | A | 10 | −6.156 | −9.217 | 5.204 | 1.00 | 41.15 | C |
| ATOM | 72 | CG | GLU | A | 10 | −5.177 | −9.938 | 6.112 | 1.00 | 45.12 | C |
| ATOM | 73 | CD | GLU | A | 10 | −4.128 | −10.719 | 5.342 | 1.00 | 54.57 | C |
| ATOM | 74 | OE1 | GLU | A | 10 | −3.998 | −10.501 | 4.118 | 1.00 | 60.79 | O |
| ATOM | 75 | OE2 | GLU | A | 10 | −3.438 | −11.556 | 5.963 | 1.00 | 51.03 | O |
| ATOM | 76 | N | VAL | A | 11 | −6.659 | −7.314 | 2.630 | 1.00 | 33.01 | N |
| ATOM | 77 | CA | VAL | A | 11 | −7.690 | −6.970 | 1.654 | 1.00 | 35.41 | C |
| ATOM | 78 | C | VAL | A | 11 | −7.886 | −8.152 | 0.709 | 1.00 | 37.75 | C |
| ATOM | 79 | O | VAL | A | 11 | −6.920 | −8.678 | 0.153 | 1.00 | 40.66 | O |
| ATOM | 80 | CB | VAL | A | 11 | −7.331 | −5.718 | 0.826 | 1.00 | 41.44 | C |

TABLE 10.2-continued

| | | | | | | | | | | |
|---|---|---|---|---|---|---|---|---|---|---|
| ATOM | 81 | CG1 | VAL | A | 11 | −8.587 | −5.137 | 0.181 | 1.00 | 34.49 | C |
| ATOM | 82 | CG2 | VAL | A | 11 | −6.642 | −4.681 | 1.692 | 1.00 | 43.75 | C |
| ATOM | 83 | N | LYS | A | 12 | −9.133 | −8.572 | 0.535 | 1.00 | 35.34 | N |
| ATOM | 84 | CA | LYS | A | 12 | −9.430 | −9.745 | −0.276 | 1.00 | 34.88 | C |
| ATOM | 85 | C | LYS | A | 12 | −10.619 | −9.497 | −1.196 | 1.00 | 41.54 | C |
| ATOM | 86 | O | LYS | A | 12 | −11.503 | −8.701 | −0.881 | 1.00 | 37.51 | O |
| ATOM | 87 | CB | LYS | A | 12 | −9.716 | −10.958 | 0.618 | 1.00 | 37.30 | C |
| ATOM | 88 | CG | LYS | A | 12 | −8.570 | −11.375 | 1.529 | 1.00 | 31.97 | C |
| ATOM | 89 | CD | LYS | A | 12 | −7.396 | −11.926 | 0.737 | 1.00 | 39.11 | C |
| ATOM | 90 | CE | LYS | A | 12 | −6.276 | −12.372 | 1.664 | 1.00 | 40.25 | C |
| ATOM | 91 | NZ | LYS | A | 12 | −5.084 | −12.848 | 0.910 | 1.00 | 43.21 | N |
| ATOM | 92 | N | LYS | A | 13 | −10.641 | −10.186 | −2.332 | 1.00 | 40.85 | N |
| ATOM | 93 | CA | LYS | A | 13 | −11.800 | −10.147 | −3.217 | 1.00 | 46.07 | C |
| ATOM | 94 | C | LYS | A | 13 | −12.873 | −11.095 | −2.687 | 1.00 | 41.63 | C |
| ATOM | 95 | O | LYS | A | 13 | −12.557 | −12.058 | −1.991 | 1.00 | 42.80 | O |
| ATOM | 96 | CB | LYS | A | 13 | −11.401 | −10.525 | −4.646 | 1.00 | 44.49 | C |
| ATOM | 97 | CG | LYS | A | 13 | −10.368 | −9.597 | −5.262 | 1.00 | 51.17 | C |
| ATOM | 98 | CD | LYS | A | 13 | −10.037 | −10.015 | −6.686 | 1.00 | 69.57 | C |
| ATOM | 99 | CE | LYS | A | 13 | −9.093 | −9.026 | −7.351 | 1.00 | 76.15 | C |
| ATOM | 100 | NZ | LYS | A | 13 | −8.805 | −9.405 | −8.763 | 1.00 | 81.80 | N |
| ATOM | 101 | N | PRO | A | 14 | −14.149 | −10.815 | −2.992 | 1.00 | 40.61 | N |
| ATOM | 102 | CA | PRO | A | 14 | −15.210 | −11.741 | −2.581 | 1.00 | 42.09 | C |
| ATOM | 103 | C | PRO | A | 14 | −14.959 | −13.147 | −3.124 | 1.00 | 43.49 | C |
| ATOM | 104 | O | PRO | A | 14 | −14.532 | −13.286 | −4.268 | 1.00 | 43.97 | O |
| ATOM | 105 | CB | PRO | A | 14 | −16.474 | −11.125 | −3.191 | 1.00 | 41.78 | C |
| ATOM | 106 | CG | PRO | A | 14 | −16.153 | −9.669 | −3.327 | 1.00 | 42.84 | C |
| ATOM | 107 | CD | PRO | A | 14 | −14.683 | −9.605 | −3.641 | 1.00 | 40.32 | C |
| ATOM | 108 | N | GLY | A | 15 | −15.191 | −14.166 | −2.302 | 1.00 | 44.15 | N |
| ATOM | 109 | CA | GLY | A | 15 | −14.989 | −15.542 | −2.716 | 1.00 | 39.13 | C |
| ATOM | 110 | C | GLY | A | 15 | −13.611 | −16.090 | −2.391 | 1.00 | 48.08 | C |
| ATOM | 111 | O | GLY | A | 15 | −13.385 | −17.297 | −2.469 | 1.00 | 45.50 | O |
| ATOM | 112 | N | ALA | A | 16 | −12.683 | −15.208 | −2.028 | 1.00 | 41.49 | N |
| ATOM | 113 | CA | ALA | A | 16 | −11.334 | −15.636 | −1.665 | 1.00 | 40.38 | C |
| ATOM | 114 | C | ALA | A | 16 | −11.263 | −16.095 | −0.209 | 1.00 | 44.65 | C |
| ATOM | 115 | O | ALA | A | 16 | −12.281 | −16.184 | 0.478 | 1.00 | 39.46 | O |
| ATOM | 116 | CB | ALA | A | 16 | −10.340 | −14.512 | −1.908 | 1.00 | 42.69 | C |
| ATOM | 117 | N | SER | A | 17 | −10.052 | −16.383 | 0.257 | 1.00 | 41.27 | N |
| ATOM | 118 | C | SER | A | 17 | −8.822 | −15.906 | 2.328 | 1.00 | 41.94 | C |
| ATOM | 119 | O | SER | A | 17 | −7.925 | −15.363 | 1.688 | 1.00 | 46.41 | O |
| ATOM | 120 | CA | ASER | A | 17 | −9.841 | −16.800 | 1.638 | 0.70 | 41.50 | C |
| ATOM | 121 | CB | ASER | A | 17 | −9.382 | −18.258 | 1.699 | 0.70 | 42.17 | C |
| ATOM | 122 | OG | ASER | A | 17 | −10.402 | −19.130 | 1.247 | 0.70 | 48.56 | O |
| ATOM | 123 | CA | BSER | A | 17 | −9.844 | −16.800 | 1.638 | 0.30 | 41.51 | C |
| ATOM | 124 | CB | BSER | A | 17 | −9.387 | −18.259 | 1.703 | 0.30 | 42.20 | C |
| ATOM | 125 | OG | BSER | A | 17 | −8.050 | −18.394 | 1.253 | 0.30 | 38.89 | O |
| ATOM | 126 | N | VAL | A | 18 | −8.963 | −15.760 | 3.639 | 1.00 | 40.15 | N |
| ATOM | 127 | CA | VAL | A | 18 | −8.023 | −14.966 | 4.414 | 1.00 | 37.97 | C |
| ATOM | 128 | C | VAL | A | 18 | −7.539 | −15.771 | 5.615 | 1.00 | 36.78 | C |
| ATOM | 129 | O | VAL | A | 18 | −8.313 | −16.499 | 6.237 | 1.00 | 43.11 | O |
| ATOM | 130 | CB | VAL | A | 18 | −8.657 | −13.636 | 4.879 | 1.00 | 39.97 | C |
| ATOM | 131 | CG1 | VAL | A | 18 | −9.911 | −13.893 | 5.706 | 1.00 | 34.36 | C |
| ATOM | 132 | CG2 | VAL | A | 18 | −7.651 | −12.802 | 5.661 | 1.00 | 41.62 | C |
| ATOM | 133 | N | LYS | A | 19 | −6.251 | −15.664 | 5.921 | 1.00 | 39.92 | N |
| ATOM | 134 | CA | LYS | A | 19 | −5.706 | −16.304 | 7.110 | 1.00 | 40.61 | C |
| ATOM | 135 | C | LYS | A | 19 | −5.015 | −15.279 | 8.012 | 1.00 | 41.01 | C |
| ATOM | 136 | O | LYS | A | 19 | −4.067 | −14.610 | 7.599 | 1.00 | 42.89 | O |
| ATOM | 137 | CB | LYS | A | 19 | −4.737 | −17.424 | 6.731 | 1.00 | 38.22 | C |
| ATOM | 138 | CG | LYS | A | 19 | −4.105 | −18.105 | 7.932 | 1.00 | 35.23 | C |
| ATOM | 139 | CD | LYS | A | 19 | −3.153 | −19.219 | 7.527 | 1.00 | 37.78 | C |
| ATOM | 140 | CE | LYS | A | 19 | −3.892 | −20.532 | 7.324 | 1.00 | 52.29 | C |
| ATOM | 141 | NZ | LYS | A | 19 | −2.953 | −21.693 | 7.310 | 1.00 | 57.68 | N |
| ATOM | 142 | N | VAL | A | 20 | −5.511 | −15.165 | 9.241 | 1.00 | 38.03 | N |
| ATOM | 143 | CA | VAL | A | 20 | −4.982 | −14.234 | 10.235 | 1.00 | 34.63 | C |
| ATOM | 144 | C | VAL | A | 20 | −4.240 | −15.005 | 11.332 | 1.00 | 39.64 | C |
| ATOM | 145 | O | VAL | A | 20 | −4.658 | −16.099 | 11.720 | 1.00 | 36.81 | O |
| ATOM | 146 | CB | VAL | A | 20 | −6.115 | −13.388 | 10.867 | 1.00 | 33.08 | C |
| ATOM | 147 | CG1 | VAL | A | 20 | −5.553 | −12.359 | 11.839 | 1.00 | 39.43 | C |
| ATOM | 148 | CG2 | VAL | A | 20 | −6.941 | −12.707 | 9.784 | 1.00 | 38.82 | C |
| ATOM | 149 | N | SER | A | 21 | −3.144 | −14.439 | 11.832 | 1.00 | 30.21 | N |
| ATOM | 150 | CA | SER | A | 21 | −2.338 | −15.124 | 12.838 | 1.00 | 32.22 | C |
| ATOM | 151 | C | SER | A | 21 | −2.354 | −14.384 | 14.168 | 1.00 | 34.12 | C |
| ATOM | 152 | O | SER | A | 21 | −2.566 | −13.176 | 14.218 | 1.00 | 32.94 | O |
| ATOM | 153 | CB | SER | A | 21 | −0.892 | −15.289 | 12.354 | 1.00 | 32.38 | C |
| ATOM | 154 | OG | SER | A | 21 | −0.205 | −14.046 | 12.353 | 1.00 | 35.31 | O |
| ATOM | 155 | N | CYS | A | 22 | −2.116 | −15.123 | 15.244 | 1.00 | 36.35 | N |
| ATOM | 156 | CA | CYS | A | 22 | −2.109 | −14.565 | 16.587 | 1.00 | 33.43 | C |
| ATOM | 157 | C | CYS | A | 22 | −0.985 | −15.204 | 17.401 | 1.00 | 38.78 | C |
| ATOM | 158 | O | CYS | A | 22 | −1.059 | −16.380 | 17.757 | 1.00 | 39.38 | O |
| ATOM | 159 | CB | CYS | A | 22 | −3.468 | −14.791 | 17.260 | 1.00 | 38.36 | C |
| ATOM | 160 | SG | CYS | A | 22 | −3.592 | −14.210 | 18.969 | 1.00 | 47.87 | S |

TABLE 10.2-continued

| | | | | | | | | | | |
|---|---|---|---|---|---|---|---|---|---|---|
| ATOM | 161 | N | LYS | A | 23 | 0.064 | −14.440 | 17.681 | 1.00 | 37.86 | N |
| ATOM | 162 | CA | LYS | A | 23 | 1.207 | −14.980 | 18.410 | 1.00 | 40.02 | C |
| ATOM | 163 | C | LYS | A | 23 | 1.019 | −14.817 | 19.912 | 1.00 | 36.84 | C |
| ATOM | 164 | O | LYS | A | 23 | 0.925 | −13.697 | 20.415 | 1.00 | 38.22 | O |
| ATOM | 165 | CB | LYS | A | 23 | 2.506 | −14.303 | 17.966 | 1.00 | 40.53 | C |
| ATOM | 166 | CG | LYS | A | 23 | 3.763 | −15.022 | 18.446 | 1.00 | 49.89 | C |
| ATOM | 167 | CD | LYS | A | 23 | 5.015 | −14.206 | 18.167 | 1.00 | 49.82 | C |
| ATOM | 168 | CE | LYS | A | 23 | 6.195 | −15.104 | 17.823 | 1.00 | 63.34 | C |
| ATOM | 169 | NZ | LYS | A | 23 | 6.392 | −16.183 | 18.827 | 1.00 | 59.88 | N |
| ATOM | 170 | N | ALA | A | 24 | 0.960 | −15.940 | 20.621 | 1.00 | 39.67 | N |
| ATOM | 171 | CA | ALA | A | 24 | 0.756 | −15.929 | 22.066 | 1.00 | 44.74 | C |
| ATOM | 172 | C | ALA | A | 24 | 2.070 | −16.103 | 22.819 | 1.00 | 52.29 | C |
| ATOM | 173 | O | ALA | A | 24 | 2.952 | −16.844 | 22.390 | 1.00 | 57.40 | O |
| ATOM | 174 | CB | ALA | A | 24 | −0.227 | −17.014 | 22.468 | 1.00 | 43.19 | C |
| ATOM | 175 | N | SER | A | 25 | 2.193 | −15.416 | 23.949 | 1.00 | 49.70 | N |
| ATOM | 176 | CA | SER | A | 25 | 3.390 | −15.511 | 24.771 | 1.00 | 51.40 | C |
| ATOM | 177 | C | SER | A | 25 | 3.108 | −15.073 | 26.206 | 1.00 | 52.18 | C |
| ATOM | 178 | O | SER | A | 25 | 2.195 | −14.282 | 26.449 | 1.00 | 44.33 | O |
| ATOM | 179 | CB | SER | A | 25 | 4.513 | −14.665 | 24.171 | 1.00 | 54.47 | C |
| ATOM | 180 | OG | SER | A | 25 | 4.108 | −13.314 | 24.022 | 1.00 | 61.15 | O |
| ATOM | 181 | N | GLY | A | 26 | 3.887 | −15.597 | 27.149 | 1.00 | 43.62 | N |
| ATOM | 182 | CA | GLY | A | 26 | 3.797 | −15.182 | 28.539 | 1.00 | 42.96 | C |
| ATOM | 183 | C | GLY | A | 26 | 2.914 | −16.042 | 29.429 | 1.00 | 47.24 | C |
| ATOM | 184 | O | GLY | A | 26 | 2.711 | −15.718 | 30.599 | 1.00 | 47.28 | O |
| ATOM | 185 | N | TYR | A | 27 | 2.388 | −17.136 | 28.889 | 1.00 | 41.19 | N |
| ATOM | 186 | CA | TYR | A | 27 | 1.504 | −18.006 | 29.657 | 1.00 | 39.91 | C |
| ATOM | 187 | C | TYR | A | 27 | 2.259 | −18.809 | 30.704 | 1.00 | 53.27 | C |
| ATOM | 188 | O | TYR | A | 27 | 3.307 | −19.393 | 30.423 | 1.00 | 48.93 | O |
| ATOM | 189 | CB | TYR | A | 27 | 0.740 | −18.956 | 28.733 | 1.00 | 48.01 | C |
| ATOM | 190 | CG | TYR | A | 27 | −0.376 | −18.280 | 27.978 | 1.00 | 52.64 | C |
| ATOM | 191 | CD2 | TYR | A | 27 | −0.151 | −17.727 | 26.726 | 1.00 | 45.16 | C |
| ATOM | 192 | CD1 | TYR | A | 27 | −1.655 | −18.180 | 28.526 | 1.00 | 47.65 | C |
| ATOM | 193 | CE2 | TYR | A | 27 | −1.163 | −17.099 | 26.032 | 1.00 | 50.12 | C |
| ATOM | 194 | CE1 | TYR | A | 27 | −2.678 | −17.555 | 27.837 | 1.00 | 41.89 | C |
| ATOM | 195 | CZ | TYR | A | 27 | −2.422 | −17.015 | 26.590 | 1.00 | 49.26 | C |
| ATOM | 196 | OH | TYR | A | 27 | −3.417 | −16.385 | 25.887 | 1.00 | 50.17 | O |
| ATOM | 197 | N | THR | A | 28 | 1.705 | −18.844 | 31.910 | 1.00 | 55.54 | N |
| ATOM | 198 | CA | THR | A | 28 | 2.345 | −19.511 | 33.035 | 1.00 | 52.97 | C |
| ATOM | 199 | C | THR | A | 28 | 1.695 | −20.867 | 33.330 | 1.00 | 58.74 | C |
| ATOM | 200 | O | THR | A | 28 | 2.080 | −21.560 | 34.275 | 1.00 | 53.17 | O |
| ATOM | 201 | CB | THR | A | 28 | 2.301 | −18.622 | 34.297 | 1.00 | 45.57 | C |
| ATOM | 202 | CG2 | THR | A | 28 | 0.870 | −18.237 | 34.629 | 1.00 | 50.36 | C |
| ATOM | 203 | OG1 | THR | A | 28 | 2.873 | −19.326 | 35.405 | 1.00 | 80.42 | O |
| ATOM | 204 | O | PHE | A | 29 | −0.347 | −22.422 | 30.294 | 1.00 | 42.50 | O |
| ATOM | 205 | N | PHE | A | 29 | 0.711 | −21.242 | 32.516 | 1.00 | 52.37 | N |
| ATOM | 206 | CA | PHE | A | 29 | 0.048 | −22.536 | 32.661 | 1.00 | 40.27 | C |
| ATOM | 207 | C | PHE | A | 29 | −0.288 | −23.133 | 31.297 | 1.00 | 41.00 | C |
| ATOM | 208 | CB | PHE | A | 29 | −1.216 | −22.409 | 33.519 | 1.00 | 44.95 | C |
| ATOM | 209 | CG | PHE | A | 29 | −2.147 | −21.312 | 33.081 | 1.00 | 42.97 | C |
| ATOM | 210 | CD2 | PHE | A | 29 | −2.146 | −20.087 | 33.728 | 1.00 | 44.83 | C |
| ATOM | 211 | CD1 | PHE | A | 29 | −3.034 | −21.512 | 32.034 | 1.00 | 41.74 | C |
| ATOM | 212 | CE2 | PHE | A | 29 | −3.005 | −19.077 | 33.334 | 1.00 | 49.55 | C |
| ATOM | 213 | CE1 | PHE | A | 29 | −3.893 | −20.508 | 31.635 | 1.00 | 43.96 | C |
| ATOM | 214 | CZ | PHE | A | 29 | −3.879 | −19.287 | 32.286 | 1.00 | 50.75 | C |
| ATOM | 215 | O | THR | A | 30 | −1.919 | −25.101 | 28.021 | 1.00 | 42.53 | O |
| ATOM | 216 | N | THR | A | 30 | −0.530 | −24.439 | 31.272 | 1.00 | 40.36 | N |
| ATOM | 217 | CA | THR | A | 30 | −0.586 | −25.179 | 30.016 | 1.00 | 42.39 | C |
| ATOM | 218 | C | THR | A | 30 | −1.914 | −25.074 | 29.255 | 1.00 | 42.49 | C |
| ATOM | 219 | CB | THR | A | 30 | −0.281 | −26.682 | 30.251 | 1.00 | 43.93 | C |
| ATOM | 220 | OG1 | THR | A | 30 | −1.295 | −27.254 | 31.083 | 1.00 | 62.78 | O |
| ATOM | 221 | CG2 | THR | A | 30 | 1.071 | −26.857 | 30.923 | 1.00 | 45.80 | C |
| ATOM | 222 | O | ASN | A | 31 | −5.415 | −23.080 | 30.210 | 1.00 | 32.62 | O |
| ATOM | 223 | N | ASN | A | 31 | −3.035 | −24.959 | 29.965 | 1.00 | 33.58 | N |
| ATOM | 224 | CA | ASN | A | 31 | −4.334 | −25.021 | 29.288 | 1.00 | 29.92 | C |
| ATOM | 225 | C | ASN | A | 31 | −5.085 | −23.699 | 29.201 | 1.00 | 35.69 | C |
| ATOM | 226 | CB | ASN | A | 31 | −5.230 | −26.055 | 29.963 | 1.00 | 36.07 | C |
| ATOM | 227 | CG | ASN | A | 31 | −4.646 | −27.449 | 29.903 | 1.00 | 37.13 | C |
| ATOM | 228 | OD1 | ASN | A | 31 | −4.449 | −28.006 | 28.821 | 1.00 | 32.81 | O |
| ATOM | 229 | ND2 | ASN | A | 31 | −4.361 | −28.018 | 31.066 | 1.00 | 28.91 | N |
| ATOM | 230 | N | TYR | A | 32 | −5.354 | −23.289 | 27.968 | 1.00 | 31.28 | N |
| ATOM | 231 | CA | TYR | A | 32 | −6.159 | −22.112 | 27.677 | 1.00 | 34.89 | C |
| ATOM | 232 | C | TYR | A | 32 | −6.695 | −22.261 | 26.258 | 1.00 | 37.67 | C |
| ATOM | 233 | O | TYR | A | 32 | −6.197 | −23.085 | 25.491 | 1.00 | 29.11 | O |
| ATOM | 234 | CB | TYR | A | 32 | −5.339 | −20.825 | 27.826 | 1.00 | 30.61 | C |
| ATOM | 235 | CG | TYR | A | 32 | −4.090 | −20.799 | 26.970 | 1.00 | 42.67 | C |
| ATOM | 236 | CD1 | TYR | A | 32 | −2.900 | −21.355 | 27.425 | 1.00 | 39.54 | C |
| ATOM | 237 | CD2 | TYR | A | 32 | −4.101 | −20.225 | 25.704 | 1.00 | 38.42 | C |
| ATOM | 238 | CE1 | TYR | A | 32 | −1.758 | −21.341 | 26.643 | 1.00 | 41.78 | C |
| ATOM | 239 | CE2 | TYR | A | 32 | −2.962 | −20.206 | 24.921 | 1.00 | 42.06 | C |
| ATOM | 240 | CZ | TYR | A | 32 | −1.797 | −20.765 | 25.393 | 1.00 | 47.23 | C |

TABLE 10.2-continued

| ATOM | 241 | OH | TYR | A | 32 | −0.666 | −20.741 | 24.609 | 1.00 | 56.16 | O |
|---|---|---|---|---|---|---|---|---|---|---|---|
| ATOM | 242 | N | ASP | A | 33 | −7.716 | −21.482 | 25.919 | 1.00 | 30.49 | N |
| ATOM | 243 | CA | ASP | A | 33 | −8.271 | −21.484 | 24.570 | 1.00 | 29.65 | C |
| ATOM | 244 | C | ASP | A | 33 | −7.998 | −20.161 | 23.883 | 1.00 | 31.10 | C |
| ATOM | 245 | O | ASP | A | 33 | −8.062 | −19.113 | 24.513 | 1.00 | 28.34 | O |
| ATOM | 246 | CB | ASP | A | 33 | −9.779 | −21.734 | 24.591 | 1.00 | 29.08 | C |
| ATOM | 247 | CG | ASP | A | 33 | −10.139 | −23.124 | 25.082 | 1.00 | 34.81 | C |
| ATOM | 248 | OD1 | ASP | A | 33 | −9.427 | −24.090 | 24.729 | 1.00 | 31.12 | O |
| ATOM | 249 | OD2 | ASP | A | 33 | −11.145 | −23.247 | 25.814 | 1.00 | 30.55 | O |
| ATOM | 250 | N | ILE | A | 34 | −7.685 | −20.204 | 22.593 | 1.00 | 28.80 | N |
| ATOM | 251 | CA | ILE | A | 34 | −7.698 | −18.898 | 21.801 | 1.00 | 29.45 | C |
| ATOM | 252 | C | ILE | A | 34 | −9.070 | −18.897 | 21.155 | 1.00 | 28.08 | C |
| ATOM | 253 | O | ILE | A | 34 | −9.518 | −19.838 | 20.500 | 1.00 | 32.08 | O |
| ATOM | 254 | CB | ILE | A | 34 | −6.587 | −18.954 | 20.729 | 1.00 | 34.02 | C |
| ATOM | 255 | CG1 | ILE | A | 34 | −5.301 | −18.380 | 21.315 | 1.00 | 40.10 | C |
| ATOM | 256 | CG2 | ILE | A | 34 | −6.981 | −18.048 | 19.581 | 1.00 | 33.89 | C |
| ATOM | 257 | CD1 | ILE | A | 34 | −4.555 | −19.327 | 22.160 | 1.00 | 37.52 | C |
| ATOM | 258 | N | ASN | A | 35 | −9.743 | −17.774 | 21.381 | 1.00 | 23.45 | N |
| ATOM | 259 | CA | ASN | A | 35 | −11.044 | −17.502 | 20.786 | 1.00 | 28.14 | C |
| ATOM | 260 | C | ASN | A | 35 | −10.911 | −16.447 | 19.693 | 1.00 | 30.81 | C |
| ATOM | 261 | O | ASN | A | 35 | −10.013 | −15.607 | 19.733 | 1.00 | 33.76 | O |
| ATOM | 262 | CB | ASN | A | 35 | −12.045 | −17.023 | 21.849 | 1.00 | 30.44 | C |
| ATOM | 263 | CG | ASN | A | 35 | −12.218 | −18.015 | 22.989 | 1.00 | 30.22 | C |
| ATOM | 264 | OD1 | ASN | A | 35 | −13.183 | −18.779 | 23.018 | 1.00 | 29.29 | O |
| ATOM | 265 | ND2 | ASN | A | 35 | −11.293 | −17.995 | 23.943 | 1.00 | 26.20 | N |
| ATOM | 266 | N | TRP | A | 36 | −11.802 | −16.482 | 18.715 | 1.00 | 28.47 | N |
| ATOM | 267 | CA | TRP | A | 36 | −11.807 | −15.447 | 17.697 | 1.00 | 32.59 | C |
| ATOM | 268 | C | TRP | A | 36 | −13.139 | −14.720 | 17.718 | 1.00 | 32.65 | C |
| ATOM | 269 | O | TRP | A | 36 | −14.202 | −15.337 | 17.703 | 1.00 | 30.35 | O |
| ATOM | 270 | CB | TRP | A | 36 | −11.509 | −16.038 | 16.318 | 1.00 | 30.51 | C |
| ATOM | 271 | CG | TRP | A | 36 | −10.106 | −16.553 | 16.242 | 1.00 | 27.75 | C |
| ATOM | 272 | CD1 | TRP | A | 36 | −9.665 | −17.781 | 16.637 | 1.00 | 28.80 | C |
| ATOM | 273 | CD2 | TRP | A | 36 | −8.951 | −15.840 | 15.779 | 1.00 | 33.27 | C |
| ATOM | 274 | CE2 | TRP | A | 36 | −7.847 | −16.707 | 15.906 | 1.00 | 31.39 | C |
| ATOM | 275 | CE3 | TRP | A | 36 | −8.745 | −14.557 | 15.260 | 1.00 | 31.98 | C |
| ATOM | 276 | NE1 | TRP | A | 36 | −8.309 | −17.884 | 16.434 | 1.00 | 36.72 | N |
| ATOM | 277 | CZ2 | TRP | A | 36 | −6.554 | −16.334 | 15.535 | 1.00 | 38.10 | C |
| ATOM | 278 | CZ3 | TRP | A | 36 | −7.457 | −14.186 | 14.890 | 1.00 | 30.43 | C |
| ATOM | 279 | CH2 | TRP | A | 36 | −6.380 | −15.071 | 15.030 | 1.00 | 33.42 | C |
| ATOM | 280 | N | VAL | A | 37 | −13.053 | −13.397 | 17.790 | 1.00 | 27.11 | N |
| ATOM | 281 | CA | VAL | A | 37 | −14.207 | −12.528 | 17.936 | 1.00 | 30.57 | C |
| ATOM | 282 | C | VAL | A | 37 | −14.076 | −11.410 | 16.914 | 1.00 | 33.89 | C |
| ATOM | 283 | O | VAL | A | 37 | −13.032 | −10.759 | 16.846 | 1.00 | 33.58 | O |
| ATOM | 284 | CB | VAL | A | 37 | −14.301 | −11.929 | 19.370 | 1.00 | 25.89 | C |
| ATOM | 285 | CG1 | VAL | A | 37 | −15.467 | −10.957 | 19.478 | 1.00 | 27.13 | C |
| ATOM | 286 | CG2 | VAL | A | 37 | −14.423 | −13.031 | 20.417 | 1.00 | 26.86 | C |
| ATOM | 287 | N | ARG | A | 38 | −15.116 | −11.188 | 16.115 | 1.00 | 29.31 | N |
| ATOM | 288 | CA | ARG | A | 38 | −15.054 | −10.150 | 15.088 | 1.00 | 28.87 | C |
| ATOM | 289 | C | ARG | A | 38 | −16.002 | −8.995 | 15.395 | 1.00 | 32.02 | C |
| ATOM | 290 | O | ARG | A | 38 | −17.005 | −9.163 | 16.089 | 1.00 | 30.64 | O |
| ATOM | 291 | CB | ARG | A | 38 | −15.367 | −10.732 | 13.708 | 1.00 | 35.52 | C |
| ATOM | 292 | CG | ARG | A | 38 | −16.652 | −11.529 | 13.656 | 1.00 | 39.93 | C |
| ATOM | 293 | CD | ARG | A | 38 | −17.550 | −11.096 | 12.506 | 1.00 | 43.60 | C |
| ATOM | 294 | NE | ARG | A | 38 | −17.164 | −11.681 | 11.229 | 1.00 | 44.71 | N |
| ATOM | 295 | CZ | ARG | A | 38 | −18.023 | −12.119 | 10.311 | 1.00 | 45.96 | C |
| ATOM | 296 | NH1 | ARG | A | 38 | −19.329 | −12.055 | 10.529 | 1.00 | 39.60 | N |
| ATOM | 297 | NH2 | ARG | A | 38 | −17.572 | −12.626 | 9.170 | 1.00 | 33.94 | N |
| ATOM | 298 | N | GLN | A | 39 | −15.669 | −7.821 | 14.871 | 1.00 | 30.63 | N |
| ATOM | 299 | CA | GLN | A | 39 | −16.452 | −6.618 | 15.103 | 1.00 | 28.53 | C |
| ATOM | 300 | C | GLN | A | 39 | −16.568 | −5.795 | 13.825 | 1.00 | 31.84 | C |
| ATOM | 301 | O | GLN | A | 39 | −15.569 | −5.314 | 13.294 | 1.00 | 29.51 | O |
| ATOM | 302 | CB | GLN | A | 39 | −15.819 | −5.775 | 16.219 | 1.00 | 30.14 | C |
| ATOM | 303 | CG | GLN | A | 39 | −16.516 | −4.444 | 16.478 | 1.00 | 28.25 | C |
| ATOM | 304 | CD | GLN | A | 39 | −16.024 | −3.781 | 17.751 | 1.00 | 39.30 | C |
| ATOM | 305 | NE2 | GLN | A | 39 | −16.896 | −3.689 | 18.751 | 1.00 | 30.37 | N |
| ATOM | 306 | OE1 | GLN | A | 39 | −14.870 | −3.368 | 17.839 | 1.00 | 39.08 | O |
| ATOM | 307 | N | ALA | A | 40 | −17.788 | −5.637 | 13.330 | 1.00 | 37.04 | N |
| ATOM | 308 | CA | ALA | A | 40 | −18.016 | −4.815 | 12.149 | 1.00 | 44.35 | C |
| ATOM | 309 | C | ALA | A | 40 | −18.259 | −3.363 | 12.548 | 1.00 | 49.15 | C |
| ATOM | 310 | O | ALA | A | 40 | −18.880 | −3.094 | 13.579 | 1.00 | 49.51 | O |
| ATOM | 311 | CB | ALA | A | 40 | −19.190 | −5.352 | 11.341 | 1.00 | 36.53 | C |
| ATOM | 312 | N | THR | A | 41 | −17.768 | −2.444 | 11.715 | 1.00 | 55.43 | N |
| ATOM | 313 | CA | THR | A | 41 | −17.923 | −0.987 | 11.865 | 1.00 | 45.13 | C |
| ATOM | 314 | C | THR | A | 41 | −17.917 | −0.449 | 13.304 | 1.00 | 61.05 | C |
| ATOM | 315 | O | THR | A | 41 | −18.779 | 0.345 | 13.688 | 1.00 | 60.70 | O |
| ATOM | 316 | CB | THR | A | 41 | −19.224 | −0.480 | 11.157 | 1.00 | 56.54 | C |
| ATOM | 317 | OG1 | THR | A | 41 | −19.398 | 0.918 | 11.416 | 1.00 | 74.65 | O |
| ATOM | 318 | CG2 | THR | A | 41 | −20.475 | −1.233 | 11.611 | 1.00 | 50.35 | C |
| ATOM | 319 | N | GLY | A | 42 | −16.931 | −0.880 | 14.088 | 1.00 | 60.31 | N |
| ATOM | 320 | CA | GLY | A | 42 | −16.677 | −0.311 | 15.402 | 1.00 | 50.20 | C |

TABLE 10.2-continued

| ATOM | 321 | C | GLY | A | 42 | −17.674 | −0.603 | 16.515 | 1.00 | 58.90 | C |
|---|---|---|---|---|---|---|---|---|---|---|---|
| ATOM | 322 | O | GLY | A | 42 | −17.496 | −0.125 | 17.638 | 1.00 | 64.22 | O |
| ATOM | 323 | N | GLN | A | 43 | −18.718 | −1.377 | 16.225 | 1.00 | 61.17 | N |
| ATOM | 324 | CA | GLN | A | 43 | −19.700 | −1.716 | 17.255 | 1.00 | 58.73 | C |
| ATOM | 325 | C | GLN | A | 43 | −20.368 | −3.072 | 17.007 | 1.00 | 47.27 | C |
| ATOM | 326 | O | GLN | A | 43 | −20.811 | −3.369 | 15.897 | 1.00 | 54.96 | O |
| ATOM | 327 | CB | GLN | A | 43 | −20.761 | −0.613 | 17.362 | 1.00 | 57.68 | C |
| ATOM | 328 | CG | GLN | A | 43 | −21.613 | −0.690 | 18.627 | 1.00 | 55.99 | C |
| ATOM | 329 | CD | GLN | A | 43 | −22.130 | 0.669 | 19.075 | 1.00 | 60.55 | C |
| ATOM | 330 | NE2 | GLN | A | 43 | −21.668 | 1.727 | 18.416 | 1.00 | 61.26 | N |
| ATOM | 331 | OE1 | GLN | A | 43 | −22.929 | 0.765 | 20.007 | 1.00 | 62.03 | O |
| ATOM | 332 | N | GLY | A | 44 | −20.438 | −3.885 | 18.059 | 1.00 | 52.11 | N |
| ATOM | 333 | CA | GLY | A | 44 | −21.017 | −5.215 | 17.978 | 1.00 | 38.87 | C |
| ATOM | 334 | C | GLY | A | 44 | −19.946 | −6.290 | 17.933 | 1.00 | 40.89 | C |
| ATOM | 335 | O | GLY | A | 44 | −19.033 | −6.225 | 17.115 | 1.00 | 48.89 | O |
| ATOM | 336 | N | LEU | A | 45 | −20.051 | −7.281 | 18.811 | 1.00 | 28.02 | N |
| ATOM | 337 | CA | LEU | A | 45 | −19.065 | −8.355 | 18.862 | 1.00 | 32.48 | C |
| ATOM | 338 | C | LEU | A | 45 | −19.726 | −9.703 | 18.639 | 1.00 | 29.29 | C |
| ATOM | 339 | O | LEU | A | 45 | −20.768 | −9.993 | 19.226 | 1.00 | 35.37 | O |
| ATOM | 340 | CB | LEU | A | 45 | −18.331 | −8.345 | 20.209 | 1.00 | 30.66 | C |
| ATOM | 341 | CG | LEU | A | 45 | −17.553 | −7.072 | 20.561 | 1.00 | 31.07 | C |
| ATOM | 342 | CD1 | LEU | A | 45 | −17.379 | −6.937 | 22.068 | 1.00 | 32.58 | C |
| ATOM | 343 | CD2 | LEU | A | 45 | −16.198 | −7.075 | 19.873 | 1.00 | 29.40 | C |
| ATOM | 344 | N | GLU | A | 46 | −19.140 | −10.533 | 17.785 | 1.00 | 29.17 | N |
| ATOM | 345 | CA | GLU | A | 46 | −19.639 | −11.895 | 17.673 | 1.00 | 35.62 | C |
| ATOM | 346 | C | GLU | A | 46 | −18.513 | −12.920 | 17.699 | 1.00 | 35.22 | C |
| ATOM | 347 | O | GLU | A | 46 | −17.496 | −12.798 | 17.009 | 1.00 | 32.17 | O |
| ATOM | 348 | CB | GLU | A | 46 | −20.511 | −12.072 | 16.421 | 1.00 | 37.90 | C |
| ATOM | 349 | CG | GLU | A | 46 | −19.828 | −11.914 | 15.092 | 1.00 | 47.11 | C |
| ATOM | 350 | CD | GLU | A | 46 | −20.765 | −12.211 | 13.925 | 1.00 | 55.52 | C |
| ATOM | 351 | OE1 | GLU | A | 46 | −21.675 | −13.052 | 14.087 | 1.00 | 54.51 | O |
| ATOM | 352 | OE2 | GLU | A | 46 | −20.601 | −11.595 | 12.850 | 1.00 | 58.10 | O |
| ATOM | 353 | N | TRP | A | 47 | −18.732 | −13.926 | 18.536 | 1.00 | 32.28 | N |
| ATOM | 354 | CA | TRP | A | 47 | −17.800 | −15.012 | 18.788 | 1.00 | 36.07 | C |
| ATOM | 355 | C | TRP | A | 47 | −17.838 | −16.016 | 17.641 | 1.00 | 34.08 | C |
| ATOM | 356 | O | TRP | A | 47 | −18.910 | −16.392 | 17.169 | 1.00 | 29.79 | O |
| ATOM | 357 | CB | TRP | A | 47 | −18.166 | −15.664 | 20.121 | 1.00 | 25.80 | C |
| ATOM | 358 | CG | TRP | A | 47 | −17.311 | −16.791 | 20.594 | 1.00 | 33.81 | C |
| ATOM | 359 | CD1 | TRP | A | 47 | −16.096 | −16.703 | 21.210 | 1.00 | 32.06 | C |
| ATOM | 360 | CD2 | TRP | A | 47 | −17.644 | −18.182 | 20.562 | 1.00 | 33.38 | C |
| ATOM | 361 | CE2 | TRP | A | 47 | −16.572 | −18.882 | 21.149 | 1.00 | 34.18 | C |
| ATOM | 362 | CE3 | TRP | A | 47 | −18.740 | −18.904 | 20.079 | 1.00 | 35.50 | C |
| ATOM | 363 | NE1 | TRP | A | 47 | −15.638 | −17.957 | 21.536 | 1.00 | 29.56 | N |
| ATOM | 364 | CZ2 | TRP | A | 47 | −16.565 | −20.271 | 21.268 | 1.00 | 31.56 | C |
| ATOM | 365 | CZ3 | TRP | A | 47 | −18.729 | −20.282 | 20.196 | 1.00 | 42.35 | C |
| ATOM | 366 | CH2 | TRP | A | 47 | −17.647 | −20.950 | 20.787 | 1.00 | 34.97 | C |
| ATOM | 367 | N | MET | A | 48 | −16.668 | −16.437 | 17.179 | 1.00 | 32.09 | N |
| ATOM | 368 | CA | MET | A | 48 | −16.596 | −17.326 | 16.028 | 1.00 | 30.89 | C |
| ATOM | 369 | C | MET | A | 48 | −16.261 | −18.755 | 16.429 | 1.00 | 29.94 | C |
| ATOM | 370 | O | MET | A | 48 | −16.653 | −19.705 | 15.757 | 1.00 | 33.43 | O |
| ATOM | 371 | CB | MET | A | 48 | −15.558 | −16.823 | 15.028 | 1.00 | 28.48 | C |
| ATOM | 372 | CG | MET | A | 48 | −15.790 | −15.409 | 14.538 | 1.00 | 33.13 | C |
| ATOM | 373 | SD | MET | A | 48 | −14.488 | −14.924 | 13.396 | 1.00 | 37.93 | S |
| ATOM | 374 | CE | MET | A | 48 | −14.665 | −16.165 | 12.119 | 1.00 | 39.94 | C |
| ATOM | 375 | N | GLY | A | 49 | −15.511 | −18.908 | 17.511 | 1.00 | 33.42 | N |
| ATOM | 376 | CA | GLY | A | 49 | −15.128 | −20.234 | 17.955 | 1.00 | 33.05 | C |
| ATOM | 377 | C | GLY | A | 49 | −13.878 | −20.244 | 18.806 | 1.00 | 34.29 | C |
| ATOM | 378 | O | GLY | A | 49 | −13.256 | −19.202 | 19.031 | 1.00 | 34.24 | O |
| ATOM | 379 | N | TRP | A | 50 | −13.509 | −21.429 | 19.279 | 1.00 | 30.14 | N |
| ATOM | 380 | CA | TRP | A | 50 | −12.368 | −21.562 | 20.176 | 1.00 | 27.60 | C |
| ATOM | 381 | C | TRP | A | 50 | −11.393 | −22.619 | 19.679 | 1.00 | 36.00 | C |
| ATOM | 382 | O | TRP | A | 50 | −11.758 | −23.513 | 18.915 | 1.00 | 26.22 | O |
| ATOM | 383 | CB | TRP | A | 50 | −12.833 | −21.906 | 21.595 | 1.00 | 27.32 | C |
| ATOM | 384 | CG | TRP | A | 50 | −13.525 | −23.240 | 21.714 | 1.00 | 31.33 | C |
| ATOM | 385 | CD1 | TRP | A | 50 | −14.867 | −23.479 | 21.627 | 1.00 | 31.09 | C |
| ATOM | 386 | CD2 | TRP | A | 50 | −12.907 | −24.513 | 21.952 | 1.00 | 32.23 | C |
| ATOM | 387 | CE2 | TRP | A | 50 | −13.936 | −25.476 | 21.994 | 1.00 | 36.04 | C |
| ATOM | 388 | CE3 | TRP | A | 50 | −11.583 | −24.932 | 22.133 | 1.00 | 35.42 | C |
| ATOM | 389 | NE1 | TRP | A | 50 | −15.122 | −24.819 | 21.791 | 1.00 | 30.64 | N |
| ATOM | 390 | CZ2 | TRP | A | 50 | −13.684 | −26.834 | 22.208 | 1.00 | 34.17 | C |
| ATOM | 391 | CZ3 | TRP | A | 50 | −11.334 | −26.282 | 22.347 | 1.00 | 33.78 | C |
| ATOM | 392 | CH2 | TRP | A | 50 | −12.379 | −27.215 | 22.381 | 1.00 | 34.68 | C |
| ATOM | 393 | N | MET | A | 51 | −10.147 | −22.507 | 20.120 | 1.00 | 29.16 | N |
| ATOM | 394 | CA | MET | A | 51 | +9.148 | −23.507 | 19.807 | 1.00 | 28.07 | C |
| ATOM | 395 | C | MET | A | 51 | −8.191 | −23.679 | 20.975 | 1.00 | 31.55 | C |
| ATOM | 396 | O | MET | A | 51 | −7.728 | −22.696 | 21.553 | 1.00 | 33.21 | O |
| ATOM | 397 | CB | MET | A | 51 | −8.374 | −23.130 | 18.549 | 1.00 | 31.45 | C |
| ATOM | 398 | CG | MET | A | 51 | −7.420 | −24.221 | 18.093 | 1.00 | 37.56 | C |
| ATOM | 399 | SD | MET | A | 51 | −5.818 | −23.586 | 17.594 | 1.00 | 57.24 | S |
| ATOM | 400 | CE | MET | A | 51 | −5.222 | −22.920 | 19.142 | 1.00 | 46.36 | C |

TABLE 10.2-continued

| | | | | | | | | | | |
|---|---|---|---|---|---|---|---|---|---|---|
| ATOM | 401 | N | HIS | A | 52 | −7.902 | −24.935 | 21.305 | 1.00 | 27.88 | N |
| ATOM | 402 | CA | HIS | A | 52 | −6.991 | −25.294 | 22.391 | 1.00 | 35.15 | C |
| ATOM | 403 | C | HIS | A | 52 | −5.615 | −25.621 | 21.816 | 1.00 | 35.88 | C |
| ATOM | 404 | O | HIS | A | 52 | −5.449 | −26.650 | 21.169 | 1.00 | 39.53 | O |
| ATOM | 405 | CB | HIS | A | 52 | −7.557 | −26.491 | 23.173 | 1.00 | 31.19 | C |
| ATOM | 406 | CG | HIS | A | 52 | −6.737 | −26.899 | 24.362 | 1.00 | 32.88 | C |
| ATOM | 407 | CD2 | HIS | A | 52 | −6.353 | −26.213 | 25.462 | 1.00 | 35.83 | C |
| ATOM | 408 | ND1 | HIS | A | 52 | −6.248 | −28.180 | 24.520 | 1.00 | 33.47 | N |
| ATOM | 409 | CE1 | HIS | A | 52 | −5.585 | −28.258 | 25.660 | 1.00 | 32.93 | C |
| ATOM | 410 | NE2 | HIS | A | 52 | −5.631 | −27.080 | 26.252 | 1.00 | 33.96 | N |
| ATOM | 411 | N | PRO | A | 53 | −4.629 | −24.737 | 22.035 | 1.00 | 36.74 | N |
| ATOM | 412 | CA | PRO | A | 53 | −3.284 | −24.901 | 21.465 | 1.00 | 41.48 | C |
| ATOM | 413 | C | PRO | A | 53 | −2.619 | −26.232 | 21.802 | 1.00 | 43.82 | C |
| ATOM | 414 | O | PRO | A | 53 | −1.959 | −26.811 | 20.941 | 1.00 | 42.27 | O |
| ATOM | 415 | CB | PRO | A | 53 | −2.497 | −23.744 | 22.088 | 1.00 | 37.52 | C |
| ATOM | 416 | CG | PRO | A | 53 | −3.521 | −22.710 | 22.372 | 1.00 | 42.21 | C |
| ATOM | 417 | CD | PRO | A | 53 | −4.768 | −23.456 | 22.751 | 1.00 | 37.85 | C |
| ATOM | 418 | N | ASN | A | 54 | −2.795 | −26.709 | 23.029 | 1.00 | 40.74 | N |
| ATOM | 419 | CA | ASN | A | 54 | −2.088 | −27.903 | 23.482 | 1.00 | 40.42 | C |
| ATOM | 420 | C | ASN | A | 54 | −2.575 | −29.192 | 22.814 | 1.00 | 44.96 | C |
| ATOM | 421 | O | ASN | A | 54 | −1.848 | −30.184 | 22.781 | 1.00 | 53.00 | O |
| ATOM | 422 | CB | ASN | A | 54 | −2.201 | −28.035 | 25.003 | 1.00 | 41.59 | C |
| ATOM | 423 | CG | ASN | A | 54 | −0.988 | −28.704 | 25.620 | 1.00 | 48.60 | C |
| ATOM | 424 | ND2 | ASN | A | 54 | −1.220 | −29.565 | 26.607 | 1.00 | 49.53 | N |
| ATOM | 425 | OD1 | ASN | A | 54 | 0.146 | −28.456 | 25.208 | 1.00 | 54.90 | O |
| ATOM | 426 | N | SER | A | 55 | −3.792 | −29.179 | 22.276 | 1.00 | 41.51 | N |
| ATOM | 427 | CA | SER | A | 55 | −4.354 | −30.372 | 21.641 | 1.00 | 39.42 | C |
| ATOM | 428 | C | SER | A | 55 | −4.800 | −30.137 | 20.196 | 1.00 | 45.89 | C |
| ATOM | 429 | O | SER | A | 55 | −4.958 | −31.083 | 19.428 | 1.00 | 45.29 | O |
| ATOM | 430 | CB | SER | A | 55 | −5.544 | −30.886 | 22.444 | 1.00 | 40.90 | C |
| ATOM | 431 | OG | SER | A | 55 | −6.661 | −30.030 | 22.269 | 1.00 | 41.20 | O |
| ATOM | 432 | N | GLY | A | 56 | −5.020 | −28.878 | 19.831 | 1.00 | 39.03 | N |
| ATOM | 433 | CA | GLY | A | 56 | −5.491 | −28.550 | 18.497 | 1.00 | 34.31 | C |
| ATOM | 434 | C | GLY | A | 56 | −6.992 | −28.707 | 18.348 | 1.00 | 33.47 | C |
| ATOM | 435 | O | GLY | A | 56 | −7.551 | −28.402 | 17.298 | 1.00 | 35.63 | O |
| ATOM | 436 | N | ASN | A | 57 | −7.649 | −29.185 | 19.401 | 1.00 | 32.07 | N |
| ATOM | 437 | CA | ASN | A | 57 | −9.099 | −29.323 | 19.384 | 1.00 | 35.35 | C |
| ATOM | 438 | C | ASN | A | 57 | −9.792 | −27.972 | 19.257 | 1.00 | 35.99 | C |
| ATOM | 439 | O | ASN | A | 57 | −9.298 | −26.956 | 19.753 | 1.00 | 31.96 | O |
| ATOM | 440 | CB | ASN | A | 57 | −9.585 | −30.042 | 20.638 | 1.00 | 36.70 | C |
| ATOM | 441 | CG | ASN | A | 57 | −9.149 | −31.490 | 20.679 | 1.00 | 51.73 | C |
| ATOM | 442 | OD1 | ASN | A | 57 | −8.193 | −31.882 | 20.005 | 1.00 | 51.72 | O |
| ATOM | 443 | ND2 | ASN | A | 57 | −9.851 | −32.297 | 21.467 | 1.00 | 40.02 | N |
| ATOM | 444 | N | THR | A | 58 | −10.938 | −27.966 | 18.585 | 1.00 | 32.70 | N |
| ATOM | 445 | CA | THR | A | 58 | −11.657 | −26.728 | 18.315 | 1.00 | 34.35 | C |
| ATOM | 446 | C | THR | A | 58 | −13.149 | −26.874 | 18.543 | 1.00 | 36.07 | C |
| ATOM | 447 | O | THR | A | 58 | −13.664 | −27.985 | 18.682 | 1.00 | 35.59 | O |
| ATOM | 448 | CB | THR | A | 58 | −11.463 | −26.251 | 16.859 | 1.00 | 35.50 | C |
| ATOM | 449 | CG2 | THR | A | 58 | −9.986 | −26.209 | 16.474 | 1.00 | 29.82 | C |
| ATOM | 450 | OG1 | THR | A | 58 | −12.167 | −27.132 | 15.976 | 1.00 | 34.89 | O |
| ATOM | 451 | N | GLY | A | 59 | −13.833 | −25.735 | 18.563 | 1.00 | 34.36 | N |
| ATOM | 452 | CA | GLY | A | 59 | −15.283 | −25.682 | 18.542 | 1.00 | 31.26 | C |
| ATOM | 453 | C | GLY | A | 59 | −15.712 | −24.404 | 17.843 | 1.00 | 36.02 | C |
| ATOM | 454 | O | GLY | A | 59 | −15.268 | −23.319 | 18.214 | 1.00 | 34.77 | O |
| ATOM | 455 | N | TYR | A | 60 | −16.561 | −24.528 | 16.826 | 1.00 | 38.85 | N |
| ATOM | 456 | CA | TYR | A | 60 | −17.004 | −23.374 | 16.045 | 1.00 | 36.79 | C |
| ATOM | 457 | C | TYR | A | 60 | −18.467 | −23.041 | 16.310 | 1.00 | 43.76 | C |
| ATOM | 458 | O | TYR | A | 60 | −19.269 | −23.933 | 16.581 | 1.00 | 40.31 | O |
| ATOM | 459 | CB | TYR | A | 60 | −16.818 | −23.630 | 14.546 | 1.00 | 40.99 | C |
| ATOM | 460 | CG | TYR | A | 60 | −15.446 | −24.123 | 14.157 | 1.00 | 40.11 | C |
| ATOM | 461 | CD1 | TYR | A | 60 | −14.305 | −23.583 | 14.729 | 1.00 | 37.87 | C |
| ATOM | 462 | CD2 | TYR | A | 60 | −15.292 | −25.132 | 13.213 | 1.00 | 40.09 | C |
| ATOM | 463 | CE1 | TYR | A | 60 | −13.050 | −24.031 | 14.374 | 1.00 | 39.91 | C |
| ATOM | 464 | CE2 | TYR | A | 60 | −14.037 | −25.587 | 12.851 | 1.00 | 40.87 | C |
| ATOM | 465 | CZ | TYR | A | 60 | −12.920 | −25.030 | 13.436 | 1.00 | 42.40 | C |
| ATOM | 466 | OH | TYR | A | 60 | −11.666 | −25.467 | 13.091 | 1.00 | 41.60 | O |
| ATOM | 467 | N | ALA | A | 61 | −18.816 | −21.760 | 16.223 | 1.00 | 32.46 | N |
| ATOM | 468 | CA | ALA | A | 61 | −20.219 | −21.370 | 16.223 | 1.00 | 39.25 | C |
| ATOM | 469 | C | ALA | A | 61 | −20.873 | −21.880 | 14.940 | 1.00 | 40.91 | C |
| ATOM | 470 | O | ALA | A | 61 | −20.228 | −21.916 | 13.891 | 1.00 | 43.24 | O |
| ATOM | 471 | CB | ALA | A | 61 | −20.363 | −19.856 | 16.343 | 1.00 | 34.62 | C |
| ATOM | 472 | N | GLN | A | 62 | −22.140 | −22.280 | 15.030 | 1.00 | 45.76 | N |
| ATOM | 473 | CA | GLN | A | 62 | −22.878 | −22.825 | 13.887 | 1.00 | 53.88 | C |
| ATOM | 474 | C | GLN | A | 62 | −22.795 | −21.937 | 12.646 | 1.00 | 47.20 | C |
| ATOM | 475 | O | GLN | A | 62 | −22.716 | −22.431 | 11.522 | 1.00 | 48.71 | O |
| ATOM | 476 | CB | GLN | A | 62 | −24.349 | −23.042 | 14.258 | 1.00 | 52.36 | C |
| ATOM | 477 | CG | GLN | A | 62 | −24.596 | −24.209 | 15.206 | 1.00 | 79.57 | C |
| ATOM | 478 | CD | GLN | A | 62 | −24.422 | −25.562 | 14.534 | 1.00 | 86.89 | C |
| ATOM | 479 | NE2 | GLN | A | 62 | −24.222 | −26.603 | 15.339 | 1.00 | 75.39 | N |
| ATOM | 480 | OE1 | GLN | A | 62 | −24.468 | −25.670 | 13.306 | 1.00 | 81.01 | O |

TABLE 10.2-continued

| | | | | | | | | | | |
|---|---|---|---|---|---|---|---|---|---|---|
| ATOM | 481 | N | LYS | A | 63 | −22.804 | −20.626 | 12.865 | 1.00 | 48.15 | N |
| ATOM | 482 | CA | LYS | A | 63 | −22.788 | −19.644 | 11.787 | 1.00 | 42.61 | C |
| ATOM | 483 | C | LYS | A | 63 | −21.524 | −19.723 | 10.919 | 1.00 | 43.90 | C |
| ATOM | 484 | O | LYS | A | 63 | −21.540 | −19.325 | 9.756 | 1.00 | 41.77 | O |
| ATOM | 485 | CB | LYS | A | 63 | −22.936 | −18.235 | 12.377 | 1.00 | 45.82 | C |
| ATOM | 486 | CG | LYS | A | 63 | −23.079 | −17.120 | 11.353 | 1.00 | 50.01 | C |
| ATOM | 487 | CD | LYS | A | 63 | −23.154 | −15.753 | 12.024 | 1.00 | 52.82 | C |
| ATOM | 488 | CE | LYS | A | 63 | −23.046 | −14.631 | 10.996 | 1.00 | 50.15 | C |
| ATOM | 489 | NZ | LYS | A | 63 | −23.127 | −13.283 | 11.624 | 1.00 | 61.30 | N |
| ATOM | 490 | N | PHE | A | 64 | −20.435 | −20.246 | 11.478 | 1.00 | 41.78 | N |
| ATOM | 491 | CA | PHE | A | 64 | −19.156 | −20.267 | 10.768 | 1.00 | 39.68 | C |
| ATOM | 492 | C | PHE | A | 64 | −18.656 | −21.675 | 10.456 | 1.00 | 44.13 | C |
| ATOM | 493 | O | PHE | A | 64 | −17.611 | −21.836 | 9.821 | 1.00 | 46.68 | O |
| ATOM | 494 | CB | PHE | A | 64 | −18.094 | −19.513 | 11.574 | 1.00 | 35.08 | C |
| ATOM | 495 | CG | PHE | A | 64 | −18.454 | −18.086 | 11.848 | 1.00 | 41.60 | C |
| ATOM | 496 | CD1 | PHE | A | 64 | −18.254 | −17.109 | 10.885 | 1.00 | 42.81 | C |
| ATOM | 497 | CD2 | PHE | A | 64 | −19.008 | −17.720 | 13.062 | 1.00 | 34.34 | C |
| ATOM | 498 | CE1 | PHE | A | 64 | −18.593 | −15.790 | 11.135 | 1.00 | 34.56 | C |
| ATOM | 499 | CE2 | PHE | A | 64 | −19.350 | −16.405 | 13.313 | 1.00 | 40.22 | C |
| ATOM | 500 | CZ | PHE | A | 64 | −19.142 | −15.441 | 12.348 | 1.00 | 32.48 | C |
| ATOM | 501 | N | GLN | A | 65 | −19.389 | −22.689 | 10.907 | 1.00 | 49.73 | N |
| ATOM | 502 | CA | GLN | A | 65 | −19.066 | −24.069 | 10.552 | 1.00 | 46.28 | C |
| ATOM | 503 | C | GLN | A | 65 | −19.116 | −24.231 | 9.040 | 1.00 | 44.61 | C |
| ATOM | 504 | O | GLN | A | 65 | −20.120 | −23.905 | 8.408 | 1.00 | 45.36 | O |
| ATOM | 505 | CB | GLN | A | 65 | −20.024 | −25.051 | 11.229 | 1.00 | 47.60 | C |
| ATOM | 506 | CG | GLN | A | 65 | −19.573 | −25.483 | 12.619 | 1.00 | 59.40 | C |
| ATOM | 507 | CD | GLN | A | 65 | −20.692 | −26.096 | 13.442 | 1.00 | 69.19 | C |
| ATOM | 508 | NE2 | GLN | A | 65 | −20.460 | −26.234 | 14.745 | 1.00 | 55.87 | N |
| ATOM | 509 | OE1 | GLN | A | 65 | −21.754 | −26.434 | 12.916 | 1.00 | 71.81 | O |
| ATOM | 510 | N | GLY | A | 66 | −18.019 | −24.711 | 8.464 | 1.00 | 39.34 | N |
| ATOM | 511 | CA | GLY | A | 66 | −17.919 | −24.856 | 7.026 | 1.00 | 46.10 | C |
| ATOM | 512 | C | GLY | A | 66 | −17.130 | −23.748 | 6.349 | 1.00 | 56.88 | C |
| ATOM | 513 | O | GLY | A | 66 | −16.677 | −23.912 | 5.214 | 1.00 | 58.19 | O |
| ATOM | 514 | N | ARG | A | 67 | −16.966 | −22.617 | 7.031 | 1.00 | 44.44 | N |
| ATOM | 515 | CA | ARG | A | 67 | −16.192 | −21.511 | 6.470 | 1.00 | 43.73 | C |
| ATOM | 516 | C | ARG | A | 67 | −14.935 | −21.213 | 7.280 | 1.00 | 45.38 | C |
| ATOM | 517 | O | ARG | A | 67 | −13.937 | −20.745 | 6.732 | 1.00 | 45.99 | O |
| ATOM | 518 | CB | ARG | A | 67 | −17.045 | −20.244 | 6.368 | 1.00 | 47.99 | C |
| ATOM | 519 | CG | ARG | A | 67 | −18.207 | −20.359 | 5.406 | 1.00 | 47.03 | C |
| ATOM | 520 | CD | ARG | A | 67 | −18.570 | −19.011 | 4.793 | 1.00 | 47.09 | C |
| ATOM | 521 | ME | ARG | A | 67 | −19.006 | −18.032 | 5.783 | 1.00 | 50.09 | N |
| ATOM | 522 | CZ | ARG | A | 67 | −18.526 | −16.794 | 5.866 | 1.00 | 49.71 | C |
| ATOM | 523 | NH1 | ARG | A | 67 | −17.590 | −16.383 | 5.020 | 1.00 | 46.73 | N |
| ATOM | 524 | NK2 | ARG | A | 67 | −18.983 | −15.964 | 6.794 | 1.00 | 47.52 | N |
| ATOM | 525 | N | VAL | A | 68 | −14.979 | −21.480 | 8.582 | 1.00 | 39.50 | N |
| ATOM | 526 | CA | VAL | A | 68 | −13.848 | −21.157 | 9.443 | 1.00 | 35.99 | C |
| ATOM | 527 | C | VAL | A | 68 | −12.994 | −22.390 | 9.737 | 1.00 | 39.26 | C |
| ATOM | 528 | O | VAL | A | 68 | −13.491 | −23.514 | 9.795 | 1.00 | 40.40 | O |
| ATOM | 529 | CB | VAL | A | 68 | −14.314 | −20.511 | 10.777 | 1.00 | 43.31 | C |
| ATOM | 530 | CG1 | VAL | A | 68 | −14.925 | −21.554 | 11.709 | 1.00 | 44.00 | C |
| ATOM | 531 | CG2 | VAL | A | 68 | −13.155 | −19.793 | 11.461 | 1.00 | 36.66 | C |
| ATOM | 532 | N | THR | A | 69 | −11.694 | −22.167 | 9.893 | 1.00 | 34.83 | N |
| ATOM | 533 | CA | THR | A | 69 | −10.772 | −23.220 | 10.282 | 1.00 | 37.94 | C |
| ATOM | 534 | C | THR | A | 69 | −9.749 | −22.651 | 11.247 | 1.00 | 36.48 | C |
| ATOM | 535 | O | THR | A | 69 | −9.020 | −21.722 | 10.905 | 1.00 | 39.14 | O |
| ATOM | 536 | CB | THR | A | 69 | −10.049 | −23.833 | 9.069 | 1.00 | 38.15 | C |
| ATOM | 537 | CG2 | THR | A | 69 | −9.167 | −24.998 | 9.508 | 1.00 | 36.65 | C |
| ATOM | 538 | OG1 | THR | A | 69 | −11.015 | −24.297 | 8.120 | 1.00 | 40.71 | O |
| ATOM | 539 | N | LEU | A | 70 | −9.705 | −23.202 | 12.454 | 1.00 | 32.50 | N |
| ATOM | 540 | CA | LEU | A | 70 | −8.759 | −22.746 | 13.463 | 1.00 | 32.88 | C |
| ATOM | 541 | C | LEU | A | 70 | −7.647 | −23.769 | 13.633 | 1.00 | 41.47 | C |
| ATOM | 542 | O | LEU | A | 70 | −7.911 | −24.942 | 13.900 | 1.00 | 41.36 | O |
| ATOM | 543 | CB | LEU | A | 70 | −9.465 | −22.501 | 14.797 | 1.00 | 32.92 | C |
| ATOM | 544 | CG | LEU | A | 70 | −10.682 | −21.573 | 14.763 | 1.00 | 41.37 | C |
| ATOM | 545 | CD1 | LEU | A | 70 | −11.203 | −21.301 | 16.178 | 1.00 | 36.02 | C |
| ATOM | 546 | CD2 | LEU | A | 70 | −10.360 | −20.271 | 14.047 | 1.00 | 32.82 | C |
| ATOM | 547 | N | THR | A | 71 | −6.405 | −23.324 | 13.465 | 1.00 | 33.46 | N |
| ATOM | 548 | CA | THR | A | 71 | −5.250 | −24.204 | 13.587 | 1.00 | 35.36 | C |
| ATOM | 549 | C | THR | A | 71 | −4.166 | −23.523 | 14.409 | 1.00 | 39.68 | C |
| ATOM | 550 | O | THR | A | 71 | −4.299 | −22.357 | 14.775 | 1.00 | 38.29 | O |
| ATOM | 551 | CB | THR | A | 71 | −4.684 | −24.607 | 12.203 | 1.00 | 40.98 | C |
| ATOM | 552 | CG2 | THR | A | 71 | −5.679 | −25.475 | 11.451 | 1.00 | 37.98 | C |
| ATOM | 553 | OG1 | THR | A | 71 | −4.413 | −23.432 | 11.427 | 1.00 | 44.28 | O |
| ATOM | 554 | N | ARG | A | 72 | −3.097 | −24.250 | 14.713 | 1.00 | 41.13 | N |
| ATOM | 555 | CA | ARG | A | 72 | −1.996 | −23.659 | 15.460 | 1.00 | 41.98 | C |
| ATOM | 556 | C | ARG | A | 72 | −0.644 | −24.252 | 15.077 | 1.00 | 44.70 | C |
| ATOM | 557 | O | ARG | A | 72 | −0.566 | −25.292 | 14.429 | 1.00 | 41.56 | O |
| ATOM | 558 | CB | ARG | A | 72 | −2.231 | −23.811 | 16.970 | 1.00 | 44.74 | C |
| ATOM | 559 | CG | ARG | A | 72 | −2.599 | −25.216 | 17.439 | 1.00 | 46.36 | C |
| ATOM | 560 | CD | ARG | A | 72 | −1.366 | −26.056 | 17.691 | 1.00 | 52.55 | C |

TABLE 10.2-continued

| | | | | | | | | | | |
|---|---|---|---|---|---|---|---|---|---|---|
| ATOM | 561 | NE | ARG | A | 72 | −1.653 | −27.299 | 18.401 | 1.00 | 45.44 | N |
| ATOM | 562 | CZ | ARG | A | 72 | −2.105 | −28.406 | 17.824 | 1.00 | 51.24 | C |
| ATOM | 563 | NH1 | ARG | A | 72 | −2.353 | −28.429 | 16.522 | 1.00 | 53.24 | N |
| ATOM | 564 | NH2 | ARG | A | 72 | −2.319 | −29.492 | 18.553 | 1.00 | 55.87 | N |
| ATOM | 565 | N | ASP | A | 73 | 0.413 | −23.563 | 15.488 | 1.00 | 44.00 | N |
| ATOM | 566 | CA | ASP | A | 73 | 1.779 | −24.033 | 15.331 | 1.00 | 45.95 | C |
| ATOM | 567 | C | ASP | A | 73 | 2.510 | −23.807 | 16.652 | 1.00 | 45.15 | C |
| ATOM | 568 | O | ASP | A | 73 | 3.010 | −22.710 | 16.916 | 1.00 | 46.41 | O |
| ATOM | 569 | CB | ASP | A | 73 | 2.473 | −23.305 | 14.175 | 1.00 | 52.61 | C |
| ATOM | 570 | CG | ASP | A | 73 | 3.922 | −23.728 | 13.995 | 1.00 | 58.41 | C |
| ATOM | 571 | OD1 | ASP | A | 73 | 4.345 | −24.730 | 14.609 | 1.00 | 57.08 | O |
| ATOM | 572 | OD2 | ASP | A | 73 | 4.639 | −23.059 | 13.220 | 1.00 | 60.43 | O |
| ATOM | 573 | N | THR | A | 74 | 2.560 | −24.847 | 17.480 | 1.00 | 46.17 | N |
| ATOM | 574 | CA | THR | A | 74 | 3.082 | −24.726 | 18.841 | 1.00 | 48.47 | C |
| ATOM | 575 | C | THR | A | 74 | 4.559 | −24.346 | 18.884 | 1.00 | 46.89 | C |
| ATOM | 576 | O | THR | A | 74 | 5.012 | −23.723 | 19.842 | 1.00 | 53.90 | O |
| ATOM | 577 | CB | THR | A | 74 | 2.888 | −26.035 | 19.636 | 1.00 | 54.20 | C |
| ATOM | 578 | CG2 | THR | A | 74 | 1.439 | −26.185 | 20.072 | 1.00 | 48.42 | C |
| ATOM | 579 | OG1 | THR | A | 74 | 3.250 | −27.155 | 18.817 | 1.00 | 60.06 | O |
| ATOM | 580 | N | SER | A | 75 | 5.303 | −24.710 | 17.845 | 1.00 | 51.70 | N |
| ATOM | 581 | CA | SER | A | 75 | 6.737 | −24.436 | 17.801 | 1.00 | 54.91 | C |
| ATOM | 582 | C | SER | A | 75 | 7.036 | −22.937 | 17.815 | 1.00 | 55.26 | C |
| ATOM | 583 | O | SER | A | 75 | 8.114 | −22.515 | 18.237 | 1.00 | 49.86 | O |
| ATOM | 584 | CB | SER | A | 75 | 7.365 | −25.088 | 16.568 | 1.00 | 55.81 | C |
| ATOM | 585 | OG | SER | A | 75 | 6.713 | −24.668 | 15.382 | 1.00 | 60.43 | O |
| ATOM | 586 | N | ILE | A | 76 | 6.077 | −22.136 | 17.359 | 1.00 | 52.63 | N |
| ATOM | 587 | CA | ILE | A | 76 | 6.224 | −20.684 | 17.386 | 1.00 | 47.56 | C |
| ATOM | 588 | C | ILE | A | 76 | 5.090 | −20.021 | 18.170 | 1.00 | 50.56 | C |
| ATOM | 589 | O | ILE | A | 76 | 4.920 | −18.802 | 18.109 | 1.00 | 52.59 | O |
| ATOM | 590 | CB | ILE | A | 76 | 6.271 | −20.093 | 15.962 | 1.00 | 50.46 | C |
| ATOM | 591 | CG1 | ILE | A | 76 | 5.040 | −20.521 | 15.163 | 1.00 | 47.49 | C |
| ATOM | 592 | CG2 | ILE | A | 76 | 7.536 | −20.531 | 15.248 | 1.00 | 46.69 | C |
| ATOM | 593 | CD1 | ILE | A | 76 | 4.922 | −19.840 | 13.817 | 1.00 | 48.75 | C |
| ATOM | 594 | N | SER | A | 77 | 4.324 | −20.834 | 18.896 | 1.00 | 49.81 | N |
| ATOM | 595 | CA | SER | A | 77 | −3.229 | −20.357 | 19.744 | 1.00 | 45.00 | C |
| ATOM | 596 | C | SER | A | 77 | 2.246 | −19.470 | 18.988 | 1.00 | 46.19 | C |
| ATOM | 597 | O | SER | A | 77 | 1.894 | −18.387 | 19.456 | 1.00 | 40.30 | O |
| ATOM | 598 | CB | SER | A | 77 | 3.781 | −19.591 | 20.951 | 1.00 | 43.85 | C |
| ATOM | 599 | OG | SER | A | 77 | 4.716 | −20.370 | 21.673 | 1.00 | 63.87 | O |
| ATOM | 600 | N | THR | A | 78 | 1.800 | −19.925 | 17.822 | 1.00 | 39.04 | N |
| ATOM | 601 | CA | THR | A | 78 | 0.956 | −19.090 | 16.979 | 1.00 | 37.69 | C |
| ATOM | 602 | C | THR | A | 78 | −0.337 | −19.788 | 16.575 | 1.00 | 37.97 | C |
| ATOM | 603 | O | THR | A | 78 | −0.325 | −20.930 | 16.115 | 1.00 | 39.48 | O |
| ATOM | 604 | CB | THR | A | 78 | 1.718 | −18.641 | 15.712 | 1.00 | 38.64 | C |
| ATOM | 605 | CG2 | THR | A | 78 | 0.810 | −17.840 | 14.787 | 1.00 | 38.64 | C |
| ATOM | 606 | OG1 | THR | A | 78 | 2.828 | −17.822 | 16.094 | 1.00 | 35.01 | O |
| ATOM | 607 | N | ALA | A | 79 | −1.454 | −19.093 | 16.765 | 1.00 | 33.81 | N |
| ATOM | 608 | CA | ALA | A | 79 | −2.756 | −19.592 | 16.336 | 1.00 | 34.16 | C |
| ATOM | 609 | C | ALA | A | 79 | −3.165 | −18.934 | 15.023 | 1.00 | 34.47 | C |
| ATOM | 610 | O | ALA | A | 79 | −2.748 | −17.815 | 14.720 | 1.00 | 33.95 | O |
| ATOM | 611 | CB | ALA | A | 79 | −3.805 | −19.340 | 17.403 | 1.00 | 24.34 | C |
| ATOM | 612 | N | TYR | A | 80 | −3.990 | −19.631 | 14.252 | 1.00 | 31.73 | N |
| ATOM | 613 | CA | TYR | A | 80 | −4.432 | −19.135 | 12.958 | 1.00 | 37.57 | C |
| ATOM | 614 | C | TYR | A | 80 | −5.942 | −19.198 | 12.810 | 1.00 | 39.18 | C |
| ATOM | 615 | O | TYR | A | 80 | −6.598 | −20.132 | 13.278 | 1.00 | 37.02 | O |
| ATOM | 616 | CB | TYR | A | 80 | −3.786 | −19.929 | 11.819 | 1.00 | 36.79 | C |
| ATOM | 617 | CG | TYR | A | 80 | −2.281 | −19.862 | 11.797 | 1.00 | 40.36 | C |
| ATOM | 618 | CD1 | TYR | A | 80 | −1.621 | −18.821 | 11.158 | 1.00 | 37.20 | C |
| ATOM | 619 | CD2 | TYR | A | 80 | −1.517 | −20.847 | 12.413 | 1.00 | 38.74 | C |
| ATOM | 620 | CE1 | TYR | A | 80 | −0.238 | −18.761 | 11.135 | 1.00 | 37.53 | C |
| ATOM | 621 | CE2 | TYR | A | 80 | −0.140 | −20.797 | 12.395 | 1.00 | 37.97 | C |
| ATOM | 622 | CZ | TYR | A | 80 | 0.497 | −19.755 | 11.756 | 1.00 | 43.48 | C |
| ATOM | 623 | OH | TYR | A | 80 | 1.872 | −19.708 | 11.742 | 1.00 | 41.36 | O |
| ATOM | 624 | N | MET | A | 81 | −6.486 | −18.195 | 12.141 | 1.00 | 31.97 | N |
| ATOM | 625 | CA | MET | A | 81 | −7.895 | −18.185 | 11.803 | 1.00 | 37.08 | C |
| ATOM | 626 | C | MET | A | 81 | −7.999 | −18.062 | 10.297 | 1.00 | 34.14 | C |
| ATOM | 627 | O | MET | A | 81 | −7.505 | −17.096 | 9.717 | 1.00 | 38.01 | O |
| ATOM | 628 | CB | MET | A | 81 | −8.619 | −17.036 | 12.509 | 1.00 | 39.39 | C |
| ATOM | 629 | CG | MET | A | 81 | −10.137 | −17.099 | 12.445 | 1.00 | 43.17 | C |
| ATOM | 630 | SD | MET | A | 81 | −10.835 | −16.468 | 10.907 | 1.00 | 56.54 | S |
| ATOM | 631 | CE | MET | A | 81 | −10.224 | −14.782 | 10.930 | 1.00 | 40.20 | C |
| ATOM | 632 | N | GLU | A | 82 | −8.606 | −19.054 | 9.659 | 1.00 | 36.27 | N |
| ATOM | 633 | CA | GLU | A | 82 | −8.825 | −18.989 | 8.222 | 1.00 | 37.25 | C |
| ATOM | 634 | C | GLU | A | 82 | −10.310 | −18.963 | 7.908 | 1.00 | 38.89 | C |
| ATOM | 635 | O | GLU | A | 82 | −11.064 | −19.831 | 8.343 | 1.00 | 42.10 | O |
| ATOM | 636 | CB | GLU | A | 82 | −8.159 | −20.161 | 7.504 | 1.00 | 34.97 | C |
| ATOM | 637 | CG | GLU | A | 82 | −8.406 | −20.149 | 6.003 | 1.00 | 48.29 | C |
| ATOM | 638 | CD | GLU | A | 82 | −7.374 | −20.946 | 5.228 | 1.00 | 61.14 | C |
| ATOM | 639 | OE1 | GLU | A | 82 | −6.617 | −21.717 | 5.858 | 1.00 | 70.53 | O |
| ATOM | 640 | OE2 | GLU | A | 82 | −7.313 | −20.793 | 3.989 | 1.00 | 62.98 | O |

TABLE 10.2-continued

| | | | | | | | | | | |
|---|---|---|---|---|---|---|---|---|---|---|
| ATOM | 641 | N | LEU | A | 83 | −10.726 | −17.946 | 7.161 | 1.00 | 41.14 | N |
| ATOM | 642 | CA | LEU | A | 83 | −12.118 | −17.807 | 6.766 | 1.00 | 40.75 | C |
| ATOM | 643 | C | LEU | A | 83 | −12.204 | −17.828 | 5.246 | 1.00 | 42.77 | C |
| ATOM | 644 | O | LEU | A | 83 | −11.572 | −17.017 | 4.569 | 1.00 | 46.85 | O |
| ATOM | 645 | CB | LEU | A | 83 | −12.716 | −16.519 | 7.336 | 1.00 | 38.47 | C |
| ATOM | 646 | CG | LEU | A | 83 | −14.233 | −16.359 | 7.216 | 1.00 | 41.96 | C |
| ATOM | 647 | CD1 | LEU | A | 83 | −14.956 | −17.499 | 7.919 | 1.00 | 40.57 | C |
| ATOM | 648 | CD2 | LEU | A | 83 | −14.677 | −15.015 | 7.776 | 1.00 | 38.68 | C |
| ATOM | 649 | N | SER | A | 84 | −12.974 | −18.769 | 4.711 | 1.00 | 41.64 | N |
| ATOM | 650 | CA | SER | A | 84 | −13.079 | −18.936 | 3.267 | 1.00 | 42.87 | C |
| ATOM | 651 | C | SER | A | 84 | −14.426 | −18.442 | 2.740 | 1.00 | 44.92 | C |
| ATOM | 652 | O | SER | A | 84 | −15.304 | −18.067 | 3.522 | 1.00 | 44.37 | O |
| ATOM | 653 | CB | SER | A | 84 | −12.868 | −20.402 | 2.888 | 1.00 | 39.46 | C |
| ATOM | 654 | OG | SER | A | 84 | −13.903 | −21.211 | 3.416 | 1.00 | 44.27 | O |
| ATOM | 655 | N | SER | A | 85 | −14.572 | −18.454 | 1.414 | 1.00 | 47.43 | N |
| ATOM | 656 | CA | SER | A | 85 | −15.769 | −17.960 | 0.732 | 1.00 | 41.86 | C |
| ATOM | 657 | C | SER | A | 85 | −16.189 | −16.591 | 1.245 | 1.00 | 43.45 | C |
| ATOM | 658 | O | SER | A | 85 | −17.337 | −16.392 | 1.652 | 1.00 | 44.70 | O |
| ATOM | 659 | CB | SER | A | 85 | −16.922 | −18.952 | 0.882 | 1.00 | 45.07 | C |
| ATOM | 660 | OG | SER | A | 85 | −16.674 | −20.125 | 0.128 | 1.00 | 51.48 | O |
| ATOM | 661 | N | LEU | A | 86 | −15.249 | −15.560 | 1.223 | 1.00 | 43.44 | N |
| ATOM | 662 | CA | LEU | A | 86 | −15.457 | −14.338 | 1.826 | 1.00 | 41.57 | C |
| ATOM | 663 | C | LEU | A | 86 | −16.526 | −13.526 | 1.104 | 1.00 | 46.59 | C |
| ATOM | 664 | O | LEU | A | 86 | −16.551 | −13.456 | −0.128 | 1.00 | 40.39 | O |
| ATOM | 665 | CB | LEU | A | 86 | −14.142 | −13.557 | 1.858 | 1.00 | 40.33 | C |
| ATOM | 666 | CG | LEU | A | 86 | −13.076 | −14.119 | 2.800 | 1.00 | 41.08 | C |
| ATOM | 667 | CD1 | LEU | A | 86 | −11.732 | −13.444 | 2.573 | 1.00 | 39.92 | C |
| ATOM | 668 | CD2 | LEU | A | 86 | −13.527 | −13.966 | 4.241 | 1.00 | 33.71 | C |
| ATOM | 669 | N | ARG | A | 87 | −17.420 | −12.933 | 1.888 | 1.00 | 37.30 | N |
| ATOM | 670 | CA | ARG | A | 87 | −18.411 | −12.002 | 1.371 | 1.00 | 42.71 | C |
| ATOM | 671 | C | ARG | A | 87 | −18.086 | −10.616 | 1.905 | 1.00 | 44.74 | C |
| ATOM | 672 | O | ARG | A | 87 | −17.304 | −10.483 | 2.846 | 1.00 | 42.11 | O |
| ATOM | 673 | CB | ARG | A | 87 | −19.828 | −12.418 | 1.774 | 1.00 | 47.73 | C |
| ATOM | 674 | CG | ARG | A | 87 | −20.231 | −13.806 | 1.298 | 1.00 | 57.87 | C |
| ATOM | 675 | CD | ARG | A | 87 | −21.702 | −14.088 | 1.577 | 1.00 | 78.50 | C |
| ATOM | 676 | NE | ARG | A | 87 | −22.154 | −15.318 | 0.928 | 1.00 | 98.72 | N |
| ATOM | 677 | CZ | ARG | A | 87 | −23.391 | −15.800 | 1.009 | 1.00 | 102.44 | C |
| ATOM | 678 | NH1 | ARG | A | 87 | −24.311 | −15.158 | 1.716 | 1.00 | 100.96 | N |
| ATOM | 679 | NH2 | ARG | A | 87 | −23.708 | −16.927 | 0.384 | 1.00 | 94.73 | N |
| ATOM | 680 | N | SER | A | 88 | −18.682 | −9.586 | 1.315 | 1.00 | 48.46 | N |
| ATOM | 681 | CA | SER | A | 88 | −18.426 | −8.221 | 1.759 | 1.00 | 47.83 | C |
| ATOM | 682 | C | SER | A | 88 | −18.871 | −8.035 | 3.212 | 1.00 | 43.27 | C |
| ATOM | 683 | O | SER | A | 88 | −18.315 | −7.210 | 3.935 | 1.00 | 45.67 | O |
| ATOM | 684 | CB | SER | A | 88 | −19.126 | −7.209 | 0.843 | 1.00 | 46.62 | C |
| ATOM | 685 | OG | SER | A | 88 | −20.530 | −7.399 | 0.826 | 1.00 | 56.66 | O |
| ATOM | 686 | N | GLU | A | 89 | −19.857 | −8.823 | 3.638 | 1.00 | 43.65 | N |
| ATOM | 687 | CA | GLU | A | 89 | −20.347 | −8.780 | 5.012 | 1.00 | 42.47 | C |
| ATOM | 688 | C | GLU | A | 89 | −19.332 | −9.323 | 6.015 | 1.00 | 42.20 | C |
| ATOM | 689 | O | GLU | A | 89 | −19.508 | −9.163 | 7.224 | 1.00 | 44.31 | O |
| ATOM | 690 | CB | GLU | A | 89 | −21.658 | −9.562 | 5.146 | 1.00 | 48.07 | C |
| ATOM | 691 | CG | GLU | A | 89 | −22.881 | −8.844 | 4.594 | 1.00 | 69.24 | C |
| ATOM | 692 | CD | GLU | A | 89 | −22.970 | −8.904 | 3.079 | 1.00 | 77.53 | C |
| ATOM | 693 | OE1 | GLU | A | 89 | −22.301 | −9.773 | 2.476 | 1.00 | 65.90 | O |
| ATOM | 694 | OE2 | GLU | A | 89 | −23.710 | −8.081 | 2.493 | 1.00 | 76.65 | O |
| ATOM | 695 | N | ASP | A | 90 | −18.279 | −9.969 | 5.519 | 1.00 | 36.36 | N |
| ATOM | 696 | CA | ASP | A | 90 | −17.213 | −10.463 | 6.388 | 1.00 | 34.38 | C |
| ATOM | 697 | C | ASP | A | 90 | −16.197 | −9.364 | 6.709 | 1.00 | 39.43 | C |
| ATOM | 698 | O | ASP | A | 90 | −15.250 | −9.589 | 7.463 | 1.00 | 38.18 | O |
| ATOM | 699 | CB | ASP | A | 90 | −16.494 | −11.658 | 5.751 | 1.00 | 38.88 | C |
| ATOM | 700 | CG | ASP | A | 90 | −17.361 | −12.903 | 5.681 | 1.00 | 42.31 | C |
| ATOM | 701 | OD1 | ASP | A | 90 | −18.157 | −13.146 | 6.616 | 1.00 | 37.56 | O |
| ATOM | 702 | OD2 | ASP | A | 90 | −17.237 | −13.646 | 4.683 | 1.00 | 47.30 | O |
| ATOM | 703 | N | THR | A | 91 | −16.389 | −8.183 | 6.127 | 1.00 | 34.63 | N |
| ATOM | 704 | CA | THR | A | 91 | −15.525 | −7.042 | 6.418 | 1.00 | 35.67 | C |
| ATOM | 705 | C | THR | A | 91 | −15.661 | −6.663 | 7.887 | 1.00 | 34.77 | C |
| ATOM | 706 | O | THR | A | 91 | −16.743 | −6.285 | 8.340 | 1.00 | 34.99 | O |
| ATOM | 707 | CB | THR | A | 91 | −15.858 | −5.818 | 5.532 | 1.00 | 37.50 | C |
| ATOM | 708 | CG2 | THR | A | 91 | −15.075 | −4.591 | 5.994 | 1.00 | 34.40 | C |
| ATOM | 709 | OG1 | THR | A | 91 | −15.529 | −6.104 | 4.164 | 1.00 | 40.03 | O |
| ATOM | 710 | N | ALA | A | 92 | −14.562 | −6.772 | 8.626 | 1.00 | 29.62 | N |
| ATOM | 711 | CA | ALA | A | 92 | −14.588 | −6.570 | 10.070 | 1.00 | 32.67 | C |
| ATOM | 712 | C | ALA | A | 92 | −13.190 | −6.544 | 10.665 | 1.00 | 27.73 | C |
| ATOM | 713 | O | ALA | A | 92 | −12.209 | −6.882 | 10.001 | 1.00 | 29.29 | O |
| ATOM | 714 | CB | ALA | A | 92 | −15.416 | −7.671 | 10.746 | 1.00 | 33.43 | C |
| ATOM | 715 | N | VAL | A | 93 | −13.112 | −6.143 | 11.929 | 1.00 | 30.17 | N |
| ATOM | 716 | CA | VAL | A | 93 | −11.897 | −6.308 | 12.704 | 1.00 | 26.67 | C |
| ATOM | 717 | C | VAL | A | 93 | −11.959 | −7.652 | 13.424 | 1.00 | 29.85 | C |
| ATOM | 718 | O | VAL | A | 93 | −12.911 | −7.934 | 14.154 | 1.00 | 32.54 | O |
| ATOM | 719 | CB | VAL | A | 93 | −11.705 | −5.169 | 13.726 | 1.00 | 31.84 | C |
| ATOM | 720 | CG1 | VAL | A | 93 | −10.539 | −5.475 | 14.653 | 1.00 | 24.37 | C |

TABLE 10.2-continued

| | | | | | | | | | | |
|---|---|---|---|---|---|---|---|---|---|---|
| ATOM | 721 | CG2 | VAL | A | 93 | −11.487 | −3.842 | 13.009 | 1.00 | 25.26 | C |
| ATOM | 722 | N | TYR | A | 94 | −10.948 | −8.484 | 13.207 | 1.00 | 26.52 | N |
| ATOM | 723 | CA | TYR | A | 94 | −10.911 | −9.806 | 13.816 | 1.00 | 31.35 | C |
| ATOM | 724 | C | TYR | A | 94 | −9.961 | −9.826 | 15.005 | 1.00 | 33.59 | C |
| ATOM | 725 | O | TYR | A | 94 | −8.769 | −9.546 | 14.867 | 1.00 | 31.79 | O |
| ATOM | 726 | CB | TYR | A | 94 | −10.518 | −10.861 | 12.774 | 1.00 | 25.00 | C |
| ATOM | 727 | CG | TYR | A | 94 | −11.629 | −11.105 | 11.781 | 1.00 | 27.22 | C |
| ATOM | 728 | CD1 | TYR | A | 94 | −11.863 | −10.216 | 10.739 | 1.00 | 30.50 | C |
| ATOM | 729 | CD2 | TYR | A | 94 | −12.469 | −12.207 | 11.906 | 1.00 | 23.97 | C |
| ATOM | 730 | CE1 | TYR | A | 94 | −12.893 | −10.423 | 9.842 | 1.00 | 27.95 | C |
| ATOM | 731 | CE2 | TYR | A | 94 | −13.492 | −12.423 | 11.022 | 1.00 | 26.58 | C |
| ATOM | 732 | CZ | TYR | A | 94 | −13.703 | −11.527 | 9.898 | 1.00 | 32.87 | C |
| ATOM | 733 | OH | TYR | A | 94 | −14.730 | −11.739 | 9.104 | 1.00 | 30.47 | O |
| ATOM | 734 | N | TYR | A | 95 | −10.511 | −10.135 | 16.177 | 1.00 | 24.85 | N |
| ATOM | 735 | CA | TYR | A | 95 | −9.731 | −10.215 | 17.406 | 1.00 | 28.45 | C |
| ATOM | 736 | C | TYR | A | 95 | −9.474 | −11.661 | 17.805 | 1.00 | 27.62 | C |
| ATOM | 737 | O | TYR | A | 95 | −10.356 | −12.508 | 17.688 | 1.00 | 28.27 | O |
| ATOM | 738 | CB | TYR | A | 95 | −10.450 | −9.512 | 18.564 | 1.00 | 24.54 | C |
| ATOM | 739 | CG | TYR | A | 95 | −10.626 | −8.019 | 18.419 | 1.00 | 26.81 | C |
| ATOM | 740 | CD1 | TYR | A | 95 | −9.580 | −7.148 | 18.692 | 1.00 | 27.26 | C |
| ATOM | 741 | CD2 | TYR | A | 95 | −11.847 | −7.481 | 18.036 | 1.00 | 28.58 | C |
| ATOM | 742 | CE1 | TYR | A | 95 | −9.737 | −5.778 | 18.571 | 1.00 | 27.06 | C |
| ATOM | 743 | CE2 | TYR | A | 95 | −12.017 | −6.113 | 17.913 | 1.00 | 27.13 | C |
| ATOM | 744 | CZ | TYR | A | 95 | −10.960 | −5.269 | 18.184 | 1.00 | 27.27 | C |
| ATOM | 745 | OH | TYR | A | 95 | −11.125 | −3.911 | 18.060 | 1.00 | 31.79 | O |
| ATOM | 746 | N | CYS | A | 96 | −8.274 | −11.945 | 18.289 | 1.00 | 23.92 | N |
| ATOM | 747 | CA | CYS | A | 96 | −8.073 | −13.182 | 19.025 | 1.00 | 30.30 | C |
| ATOM | 748 | C | CYS | A | 96 | −8.115 | −12.829 | 20.505 | 1.00 | 27.04 | C |
| ATOM | 749 | O | CYS | A | 96 | −7.708 | −11.736 | 20.899 | 1.00 | 28.05 | O |
| ATOM | 750 | CB | CYS | A | 96 | −6.758 | −13.877 | 18.645 | 1.00 | 33.84 | C |
| ATOM | 751 | SG | CYS | A | 96 | −5.246 | −13.010 | 19.099 | 1.00 | 48.82 | S |
| ATOM | 752 | N | ALA | A | 97 | −8.634 | −13.742 | 21.316 | 1.00 | 28.58 | N |
| ATOM | 753 | CA | ALA | A | 97 | −8.783 | −13.497 | 22.743 | 1.00 | 26.57 | C |
| ATOM | 754 | C | ALA | A | 97 | −8.768 | −14.816 | 23.507 | 1.00 | 32.11 | C |
| ATOM | 755 | O | ALA | A | 97 | −9.409 | −15.780 | 23.091 | 1.00 | 30.87 | O |
| ATOM | 756 | CB | ALA | A | 97 | −10.065 | −12.736 | 23.016 | 1.00 | 26.61 | C |
| ATOM | 757 | N | SER | A | 98 | −8.042 | −14.864 | 24.621 | 1.00 | 27.25 | N |
| ATOM | 758 | CA | SER | A | 98 | −7.888 | −16.121 | 25.348 | 1.00 | 32.20 | C |
| ATOM | 759 | C | SER | A | 98 | −8.839 | −16.275 | 26.532 | 1.00 | 29.23 | C |
| ATOM | 760 | O | SER | A | 98 | −9.249 | −15.294 | 27.153 | 1.00 | 25.23 | O |
| ATOM | 761 | CB | SER | A | 98 | −6.453 | −16.280 | 25.845 | 1.00 | 33.45 | C |
| ATOM | 762 | OG | SER | A | 98 | −6.155 | −15.337 | 26.856 | 1.00 | 45.41 | O |
| ATOM | 763 | N | SER | A | 99 | −9.169 | −17.528 | 26.833 | 1.00 | 29.87 | N |
| ATOM | 764 | CA | SER | A | 99 | −9.971 | −17.885 | 28.001 | 1.00 | 30.05 | C |
| ATOM | 765 | C | SER | A | 99 | −9.348 | −19.099 | 28.689 | 1.00 | 35.19 | C |
| ATOM | 766 | O | SER | A | 99 | −8.528 | −19.794 | 28.086 | 1.00 | 30.60 | O |
| ATOM | 767 | CB | SER | A | 99 | −11.417 | −18.171 | 27.596 | 1.00 | 26.53 | C |
| ATOM | 768 | OG | SER | A | 99 | −11.485 | −19.129 | 26.552 | 1.00 | 29.62 | O |
| ATOM | 769 | N | SER | A | 100 | −9.738 | −19.355 | 29.938 | 1.00 | 33.90 | N |
| ATOM | 770 | CA | SER | A | 100 | −9.099 | −20.396 | 30.749 | 1.00 | 39.84 | C |
| ATOM | 771 | C | SER | A | 100 | −10.060 | −21.427 | 31.338 | 1.00 | 33.23 | C |
| ATOM | 772 | O | SER | A | 100 | −9.932 | −21.793 | 32.506 | 1.00 | 40.18 | O |
| ATOM | 773 | CB | SER | A | 100 | −8.319 | −19.758 | 31.900 | 1.00 | 32.53 | C |
| ATOM | 774 | OG | SER | A | 100 | −7.194 | −19.048 | 31.424 | 1.00 | 49.78 | O |
| ATOM | 775 | O | GLY | A | 101 | −14.315 | −23.137 | 30.676 | 1.00 | 40.43 | O |
| ATOM | 776 | N | GLY | A | 101 | −11.017 | −21.899 | 30.547 | 1.00 | 31.28 | N |
| ATOM | 777 | CA | GLY | A | 101 | −11.974 | −22.868 | 31.048 | 1.00 | 28.36 | C |
| ATOM | 778 | C | GLY | A | 101 | −13.406 | −22.374 | 30.999 | 1.00 | 32.57 | C |
| ATOM | 779 | O | TRP | A | 102 | −13.530 | −18.918 | 29.800 | 1.00 | 32.97 | O |
| ATOM | 780 | N | TRP | A | 102 | −13.617 | −21.110 | 31.357 | 1.00 | 23.41 | N |
| ATOM | 781 | CA | TRP | A | 102 | −14.879 | −20.435 | 31.059 | 1.00 | 26.91 | C |
| ATOM | 782 | C | TRP | A | 102 | −14.626 | −19.471 | 29.916 | 1.00 | 30.14 | C |
| ATOM | 783 | CB | TRP | A | 102 | −15.432 | −19.683 | 32.271 | 1.00 | 27.64 | C |
| ATOM | 784 | CG | TRP | A | 102 | −15.721 | −20.553 | 33.447 | 1.00 | 28.49 | C |
| ATOM | 785 | CD1 | TRP | A | 102 | −16.761 | −21.428 | 33.587 | 1.00 | 25.22 | C |
| ATOM | 786 | CD2 | TRP | A | 102 | −14.972 | −20.618 | 34.664 | 1.00 | 25.37 | C |
| ATOM | 787 | NE1 | TRP | A | 102 | −16.701 | −22.038 | 34.818 | 1.00 | 26.75 | N |
| ATOM | 788 | CE2 | TRP | A | 102 | −15.611 | −21.559 | 35.498 | 1.00 | 23.51 | C |
| ATOM | 789 | CE3 | TRP | A | 102 | −13.819 | −19.977 | 35.128 | 1.00 | 23.78 | C |
| ATOM | 790 | CZ2 | TRP | A | 102 | −15.134 | −21.874 | 36.772 | 1.00 | 27.12 | C |
| ATOM | 791 | CZ3 | TRP | A | 102 | −13.346 | −20.291 | 36.396 | 1.00 | 31.84 | C |
| ATOM | 792 | CH2 | TRP | A | 102 | −14.003 | −21.232 | 37.202 | 1.00 | 24.60 | C |
| ATOM | 793 | O | TYR | A | 103 | −16.560 | −16.374 | 27.434 | 1.00 | 35.87 | O |
| ATOM | 794 | N | TYR | A | 103 | −15.628 | −19.268 | 29.071 | 1.00 | 23.62 | N |
| ATOM | 795 | CA | TYR | A | 103 | −15.441 | −18.444 | 27.884 | 1.00 | 33.88 | C |
| ATOM | 796 | C | TYR | A | 103 | −15.723 | −16.960 | 28.117 | 1.00 | 34.03 | C |
| ATOM | 797 | CB | TYR | A | 103 | −16.321 | −18.949 | 26.742 | 1.00 | 27.85 | C |
| ATOM | 798 | CG | TYR | A | 103 | −15.988 | −20.342 | 26.265 | 1.00 | 32.69 | C |
| ATOM | 799 | CD1 | TYR | A | 103 | −14.804 | −20.601 | 25.588 | 1.00 | 31.32 | C |
| ATOM | 800 | CD3 | TYR | A | 103 | −16.866 | −21.396 | 26.478 | 1.00 | 31.92 | C |

TABLE 10.2-continued

| ATOM | 801 | CE1 | TYR | A | 103 | −14.498 | −21.879 | 25.143 | 1.00 | 32.07 | C |
|---|---|---|---|---|---|---|---|---|---|---|---|
| ATOM | 802 | CE2 | TYR | A | 103 | −16.571 | −22.673 | 26.036 | 1.00 | 31.82 | C |
| ATOM | 803 | CZ | TYR | A | 103 | −15.385 | −22.908 | 25.370 | 1.00 | 34.61 | C |
| ATOM | 804 | OH | TYR | A | 103 | −15.090 | −24.176 | 24.931 | 1.00 | 37.00 | O |
| ATOM | 805 | N | TYR | A | 104 | −15.035 | −16.359 | 29.085 | 1.00 | 30.47 | N |
| ATOM | 806 | CA | TYR | A | 104 | −14.929 | −14.904 | 29.133 | 1.00 | 34.52 | C |
| ATOM | 807 | C | TYR | A | 104 | −13.452 | −14.557 | 28.940 | 1.00 | 37.81 | C |
| ATOM | 808 | O | TYR | A | 104 | −12.571 | −15.311 | 29.359 | 1.00 | 33.63 | O |
| ATOM | 809 | CB | TYR | A | 104 | −15.488 | −14.328 | 30.439 | 1.00 | 28.01 | C |
| ATOM | 810 | CG | TYR | A | 104 | −14.762 | −14.755 | 31.690 | 1.00 | 29.48 | C |
| ATOM | 811 | CD2 | TYR | A | 104 | −15.209 | −15.837 | 32.442 | 1.00 | 31.05 | C |
| ATOM | 812 | CD1 | TYR | A | 104 | −13.639 | −14.068 | 32.132 | 1.00 | 33.84 | C |
| ATOM | 813 | CE2 | TYR | A | 104 | −14.547 | −16.227 | 33.600 | 1.00 | 31.77 | C |
| ATOM | 814 | CE1 | TYR | A | 104 | −12.968 | −14.452 | 33.282 | 1.00 | 38.93 | C |
| ATOM | 815 | CZ | TYR | A | 104 | −13.424 | −15.530 | 34.009 | 1.00 | 35.52 | C |
| ATOM | 816 | OH | TYR | A | 104 | −12.751 | −15.905 | 35.147 | 1.00 | 47.88 | O |
| ATOM | 817 | N | PHE | A | 105 | −13.180 | −13.423 | 28.308 | 1.00 | 34.39 | N |
| ATOM | 818 | CA | PHE | A | 105 | −11.862 | −13.201 | 27.718 | 1.00 | 31.85 | C |
| ATOM | 819 | C | PHE | A | 105 | −11.046 | −12.124 | 28.419 | 1.00 | 31.30 | C |
| ATOM | 820 | O | PHE | A | 105 | −11.367 | −10.938 | 28.347 | 1.00 | 33.02 | O |
| ATOM | 821 | CB | PHE | A | 105 | −12.046 | −12.872 | 26.240 | 1.00 | 27.43 | C |
| ATOM | 822 | CG | PHE | A | 105 | −13.093 | −13.719 | 25.583 | 1.00 | 32.14 | C |
| ATOM | 823 | CD1 | PHE | A | 105 | −12.894 | −15.083 | 25.423 | 1.00 | 32.34 | C |
| ATOM | 824 | CD2 | PHE | A | 105 | −14.292 | −13.168 | 25.166 | 1.00 | 33.77 | C |
| ATOM | 825 | CE1 | PHE | A | 105 | −13.866 | −15.879 | 24.840 | 1.00 | 28.51 | C |
| ATOM | 826 | CE2 | PHE | A | 105 | −15.267 | −13.959 | 24.577 | 1.00 | 36.93 | C |
| ATOM | 827 | CZ | PHE | A | 105 | −15.052 | −15.317 | 24.413 | 1.00 | 31.65 | C |
| ATOM | 828 | N | ASP | A | 106 | −9.981 | −12.543 | 29.097 | 1.00 | 31.31 | N |
| ATOM | 829 | CA | ASP | A | 106 | −9.205 | −11.614 | 29.914 | 1.00 | 33.51 | C |
| ATOM | 830 | C | ASP | A | 106 | −8.015 | −11.014 | 29.167 | 1.00 | 32.69 | C |
| ATOM | 831 | O | ASP | A | 106 | −7.485 | −9.983 | 29.578 | 1.00 | 38.29 | O |
| ATOM | 832 | CB | ASP | A | 106 | −8.734 | −12.298 | 31.206 | 1.00 | 37.27 | C |
| ATOM | 833 | CG | ASP | A | 106 | −8.078 | −13.645 | 30.962 | 1.00 | 44.11 | C |
| ATOM | 834 | OD1 | ASP | A | 106 | −8.298 | −14.243 | 29.886 | 1.00 | 44.95 | O |
| ATOM | 835 | OD2 | ASP | A | 106 | −7.347 | −14.114 | 31.860 | 1.00 | 39.24 | O |
| ATOM | 836 | N | TYR | A | 107 | −7.604 | −11.645 | 28.069 | 1.00 | 33.81 | N |
| ATOM | 837 | CA | TYR | A | 107 | −6.550 | −11.085 | 27.220 | 1.00 | 31.46 | C |
| ATOM | 838 | C | TYR | A | 107 | −6.967 | −11.061 | 25.752 | 1.00 | 27.21 | C |
| ATOM | 839 | O | TYR | A | 107 | −7.565 | −12.015 | 25.256 | 1.00 | 27.70 | O |
| ATOM | 840 | CB | TYR | A | 107 | −5.250 | −11.870 | 27.388 | 1.00 | 34.62 | C |
| ATOM | 841 | CG | TYR | A | 107 | −4.719 | −11.830 | 28.802 | 1.00 | 39.20 | C |
| ATOM | 842 | CD1 | TYR | A | 107 | −4.065 | −10.705 | 29.284 | 1.00 | 44.79 | C |
| ATOM | 843 | CD2 | TYR | A | 107 | −4.882 | −12.912 | 29.659 | 1.00 | 42.77 | C |
| ATOM | 844 | CE1 | TYR | A | 107 | −3.584 | −10.658 | 30.583 | 1.00 | 57.22 | C |
| ATOM | 845 | CE2 | TYR | A | 107 | −4.403 | −12.875 | 30.957 | 1.00 | 50.96 | C |
| ATOM | 846 | CZ | TYR | A | 107 | −3.758 | −11.746 | 31.414 | 1.00 | 48.15 | C |
| ATOM | 847 | OH | TYR | A | 107 | −3.279 | −11.702 | 32.703 | 1.00 | 71.00 | O |
| ATOM | 848 | N | TRP | A | 108 | −6.638 | −9.967 | 25.066 | 1.00 | 27.81 | N |
| ATOM | 849 | CA | TRP | A | 108 | −7.055 | −9.741 | 23.679 | 1.00 | 21.18 | C |
| ATOM | 850 | C | TRP | A | 108 | −5.892 | −9.324 | 22.782 | 1.00 | 26.32 | C |
| ATOM | 851 | O | TRP | A | 108 | −4.984 | −8.615 | 23.218 | 1.00 | 29.92 | O |
| ATOM | 852 | CB | TRP | A | 108 | −8.132 | −8.654 | 23.610 | 1.00 | 21.90 | C |
| ATOM | 853 | CG | TRP | A | 108 | −9.444 | −9.007 | 24.233 | 1.00 | 27.98 | C |
| ATOM | 854 | CD1 | TRP | A | 108 | −9.700 | −9.207 | 25.560 | 1.00 | 27.08 | C |
| ATOM | 855 | CD2 | TRP | A | 108 | −10.693 | −9.171 | 23.554 | 1.00 | 27.01 | C |
| ATOM | 856 | CE2 | TRP | A | 108 | −11.663 | −9.484 | 24.530 | 1.00 | 25.58 | C |
| ATOM | 857 | CE3 | TRP | A | 108 | −11.085 | −9.093 | 22.212 | 1.00 | 25.64 | C |
| ATOM | 858 | NE1 | TRP | A | 108 | −11.032 | −9.500 | 25.746 | 1.00 | 24.70 | N |
| ATOM | 859 | CZ2 | TRP | A | 108 | −12.999 | −9.715 | 24.208 | 1.00 | 25.47 | C |
| ATOM | 860 | CZ3 | TRP | A | 108 | −12.414 | −9.322 | 21.893 | 1.00 | 32.29 | C |
| ATOM | 861 | CH2 | TRP | A | 108 | −13.355 | −9.630 | 22.889 | 1.00 | 32.24 | C |
| ATOM | 862 | N | GLY | A | 109 | −5.928 | −9.748 | 21.523 | 1.00 | 27.02 | N |
| ATOM | 863 | CA | GLY | A | 109 | −5.002 | −9.227 | 20.531 | 1.00 | 28.74 | C |
| ATOM | 864 | C | GLY | A | 109 | −5.415 | −7.812 | 20.159 | 1.00 | 31.88 | C |
| ATOM | 865 | O | GLY | A | 109 | −6.476 | −7.346 | 20.584 | 1.00 | 26.79 | O |
| ATOM | 866 | N | GLN | A | 110 | −4.595 | −7.120 | 19.373 | 1.00 | 28.50 | N |
| ATOM | 867 | CA | GLN | A | 110 | −4.878 | −5.721 | 19.055 | 1.00 | 29.47 | C |
| ATOM | 868 | C | GLN | A | 110 | −5.904 | −5.611 | 17.928 | 1.00 | 30.21 | C |
| ATOM | 869 | O | GLN | A | 110 | −6.432 | −4.532 | 17.659 | 1.00 | 36.00 | O |
| ATOM | 870 | CB | GLN | A | 110 | −3.591 | −4.966 | 18.683 | 1.00 | 23.57 | C |
| ATOM | 871 | CG | GLN | A | 110 | −3.125 | −5.156 | 17.239 | 1.00 | 29.23 | C |
| ATOM | 872 | CD | GLN | A | 110 | −2.309 | −6.419 | 17.032 | 1.00 | 33.10 | C |
| ATOM | 873 | NE2 | GLN | A | 110 | −1.568 | −6.467 | 15.929 | 1.00 | 31.73 | N |
| ATOM | 874 | OE1 | GLN | A | 110 | −2.343 | −7.342 | 17.850 | 1.00 | 35.23 | O |
| ATOM | 875 | N | GLY | A | 111 | −6.192 | −6.733 | 17.277 | 1.00 | 31.62 | N |
| ATOM | 876 | CA | GLY | A | 111 | −7.188 | −6.760 | 16.225 | 1.00 | 31.32 | C |
| ATOM | 877 | C | GLY | A | 111 | −6.604 | −6.675 | 14.831 | 1.00 | 34.22 | C |
| ATOM | 878 | O | GLY | A | 111 | −5.561 | −6.059 | 14.612 | 1.00 | 31.13 | O |
| ATOM | 879 | N | THR | A | 112 | −7.291 | −7.299 | 13.882 | 1.00 | 29.50 | N |
| ATOM | 880 | CA | THR | A | 112 | −6.858 | −7.300 | 12.494 | 1.00 | 30.89 | C |

TABLE 10.2-continued

| | | | | | | | | | | |
|---|---|---|---|---|---|---|---|---|---|---|
| ATOM | 881 | C | THR | A | 112 | −8.008 | −6.901 | 11.587 | 1.00 | 30.69 | C |
| ATOM | 882 | O | THR | A | 112 | −9.035 | −7.577 | 11.551 | 1.00 | 28.68 | O |
| ATOM | 883 | CB | THR | A | 112 | −6.334 | −8.683 | 12.064 | 1.00 | 34.70 | C |
| ATOM | 884 | CG2 | THR | A | 112 | −5.960 | −8.683 | 10.584 | 1.00 | 33.17 | C |
| ATOM | 885 | OG1 | THR | A | 112 | −5.182 | −9.025 | 12.846 | 1.00 | 39.75 | O |
| ATOM | 886 | N | LEU | A | 113 | −7.842 | −5.804 | 10.859 | 1.00 | 28.77 | N |
| ATOM | 887 | CA | LEU | A | 113 | −8.868 | −5.372 | 9.917 | 1.00 | 26.18 | C |
| ATOM | 888 | C | LEU | A | 113 | −8.801 | −6.203 | 8.635 | 1.00 | 32.80 | C |
| ATOM | 889 | O | LEU | A | 113 | −7.769 | −6.263 | 7.968 | 1.00 | 31.11 | O |
| ATOM | 890 | CB | LEU | A | 113 | −8.721 | −3.883 | 9.587 | 1.00 | 26.67 | C |
| ATOM | 891 | CG | LEU | A | 113 | −9.680 | −3.339 | 8.518 | 1.00 | 32.26 | C |
| ATOM | 892 | CD1 | LEU | A | 113 | −11.139 | −3.581 | 8.899 | 1.00 | 29.02 | C |
| ATOM | 893 | CD2 | LEU | A | 113 | −9.437 | −1.855 | 8.262 | 1.00 | 32.24 | C |
| ATOM | 894 | N | VAL | A | 114 | −9.904 | −6.859 | 8.305 | 1.00 | 28.44 | N |
| ATOM | 895 | CA | VAL | A | 114 | −10.009 | −7.566 | 7.036 | 1.00 | 30.93 | C |
| ATOM | 896 | C | VAL | A | 114 | −11.076 | −6.899 | 6.188 | 1.00 | 30.62 | C |
| ATOM | 897 | O | VAL | A | 114 | −12.233 | −6.788 | 6.601 | 1.00 | 29.64 | O |
| ATOM | 898 | CB | VAL | A | 114 | −10.353 | −9.058 | 7.225 | 1.00 | 31.72 | C |
| ATOM | 899 | CG1 | VAL | A | 114 | −10.535 | −9.740 | 5.869 | 1.00 | 33.36 | C |
| ATOM | 900 | CG2 | VAL | A | 114 | −9.265 | −9.750 | 8.042 | 1.00 | 32.90 | C |
| ATOM | 901 | N | THR | A | 115 | −10.676 | −6.436 | 5.009 | 1.00 | 35.29 | N |
| ATOM | 902 | CA | THR | A | 115 | −11.604 | −5.788 | 4.100 | 1.00 | 34.33 | C |
| ATOM | 903 | C | THR | A | 115 | −11.863 | −6.700 | 2.912 | 1.00 | 36.39 | C |
| ATOM | 904 | O | THR | A | 115 | −10.929 | −7.156 | 2.251 | 1.00 | 35.90 | O |
| ATOM | 905 | CB | THR | A | 115 | −11.068 | −4.426 | 3.610 | 1.00 | 36.40 | C |
| ATOM | 906 | CG2 | THR | A | 115 | −12.038 | −3.785 | 2.628 | 1.00 | 34.46 | C |
| ATOM | 907 | OG1 | THR | A | 115 | −10.890 | −3.552 | 4.730 | 1.00 | 37.23 | O |
| ATOM | 908 | N | VAL | A | 116 | −13.136 | −6.976 | 2.657 | 1.00 | 39.45 | N |
| ATOM | 909 | CA | VAL | A | 116 | −13.527 | −7.775 | 1.504 | 1.00 | 34.84 | C |
| ATOM | 910 | C | VAL | A | 116 | −14.212 | −6.875 | 0.490 | 1.00 | 38.13 | C |
| ATOM | 911 | O | VAL | A | 116 | −15.289 | −6.339 | 0.755 | 1.00 | 35.45 | O |
| ATOM | 912 | CB | VAL | A | 116 | −14.475 | −8.932 | 1.886 | 1.00 | 39.24 | C |
| ATOM | 913 | CG1 | VAL | A | 116 | −14.679 | −9.864 | 0.693 | 1.00 | 39.66 | C |
| ATOM | 914 | CG2 | VAL | A | 116 | −13.924 | −9.705 | 3.075 | 1.00 | 38.07 | C |
| ATOM | 915 | N | SER | A | 117 | −13.589 | −6.706 | −0.671 | 1.00 | 34.44 | N |
| ATOM | 916 | CA | SER | A | 117 | −14.126 | −5.795 | −1.671 | 1.00 | 40.89 | C |
| ATOM | 917 | C | SER | A | 117 | −13.687 | −6.131 | −3.091 | 1.00 | 40.89 | C |
| ATOM | 918 | O | SER | A | 117 | −12.598 | −6.661 | −3.313 | 1.00 | 38.45 | O |
| ATOM | 919 | CB | SER | A | 117 | −13.716 | −4.359 | −1.345 | 1.00 | 34.47 | C |
| ATOM | 920 | OG | SER | A | 117 | −14.224 | −3.460 | −2.318 | 1.00 | 43.36 | O |
| ATOM | 921 | O | SER | A | 118 | −12.636 | −4.911 | −6.922 | 1.00 | 43.31 | O |
| ATOM | 922 | N | SER | A | 118 | −14.546 | −5.795 | −4.047 | 1.00 | 42.01 | N |
| ATOM | 923 | CA | SER | A | 118 | −14.232 | −5.940 | −5.462 | 1.00 | 52.20 | C |
| ATOM | 924 | C | SER | A | 118 | −13.391 | −4.770 | −5.963 | 1.00 | 47.46 | C |
| ATOM | 925 | CB | SER | A | 118 | −15.516 | −6.046 | −6.287 | 1.00 | 44.49 | C |
| ATOM | 926 | OG | SER | A | 118 | −16.364 | −7.057 | −5.772 | 1.00 | 64.31 | O |
| ATOM | 927 | O | ALA | A | 119 | −10.794 | −3.378 | −5.023 | 1.00 | 46.60 | O |
| ATOM | 928 | N | ALA | A | 119 | −13.530 | −3.617 | −5.311 | 1.00 | 44.58 | N |
| ATOM | 929 | CA | ALA | A | 119 | −12.862 | −2.393 | −5.753 | 1.00 | 40.93 | C |
| ATOM | 930 | C | ALA | A | 119 | −11.342 | −2.520 | −5.714 | 1.00 | 45.33 | C |
| ATOM | 931 | CB | ALA | A | 119 | −13.312 | −1.211 | −4.908 | 1.00 | 36.58 | C |
| ATOM | 932 | N | SER | A | 120 | −10.666 | −1.656 | −6.462 | 1.00 | 46.47 | N |
| ATOM | 933 | CA | SER | A | 120 | −9.215 | −1.709 | −6.568 | 1.00 | 45.38 | C |
| ATOM | 934 | C | SER | A | 120 | −8.519 | −1.011 | −5.404 | 1.00 | 40.94 | C |
| ATOM | 935 | O | SER | A | 120 | −8.988 | 0.011 | −4.907 | 1.00 | 41.57 | O |
| ATOM | 936 | CB | SER | A | 120 | −8.765 | −1.087 | −7.888 | 1.00 | 48.55 | C |
| ATOM | 937 | OG | SER | A | 120 | −9.353 | −1.760 | −8.986 | 1.00 | 60.18 | O |
| ATOM | 938 | N | THR | A | 121 | −7.396 | −1.579 | −4.977 | 1.00 | 34.74 | N |
| ATOM | 939 | CA | THR | A | 121 | −6.548 | −0.974 | −3.960 | 1.00 | 32.02 | C |
| ATOM | 940 | C | THR | A | 121 | −5.820 | 0.246 | −4.520 | 1.00 | 36.76 | C |
| ATOM | 941 | O | THR | A | 121 | −5.170 | 0.163 | −5.560 | 1.00 | 38.97 | O |
| ATOM | 942 | CB | THR | A | 121 | −5.515 | −1.984 | −3.424 | 1.00 | 34.58 | C |
| ATOM | 943 | CG2 | THR | A | 121 | −4.467 | −1.287 | −2.564 | 1.00 | 34.08 | C |
| ATOM | 944 | OG1 | THR | A | 121 | −6.183 | −2.982 | −2.643 | 1.00 | 35.30 | O |
| ATOM | 945 | N | LYS | A | 122 | −5.925 | 1.374 | −3.822 | 1.00 | 38.80 | N |
| ATOM | 946 | CA | LYS | A | 122 | −5.311 | 2.619 | −4.276 | 1.00 | 33.51 | C |
| ATOM | 947 | C | LYS | A | 122 | −4.612 | 3.348 | −3.137 | 1.00 | 34.96 | C |
| ATOM | 948 | O | LYS | A | 122 | −5.217 | 3.618 | −2.103 | 1.00 | 36.45 | O |
| ATOM | 949 | CB | LYS | A | 122 | −6.364 | 3.533 | −4.907 | 1.00 | 31.35 | C |
| ATOM | 950 | CG | LYS | A | 122 | −5.799 | 4.818 | −5.474 | 1.00 | 41.47 | C |
| ATOM | 951 | CD | LYS | A | 122 | −6.894 | 5.726 | −6.013 | 1.00 | 44.52 | C |
| ATOM | 952 | CE | LYS | A | 122 | −6.300 | 6.975 | −6.653 | 1.00 | 45.34 | C |
| ATOM | 953 | NZ | LYS | A | 122 | −5.380 | 7.695 | −5.723 | 1.00 | 52.67 | N |
| ATOM | 954 | N | GLY | A | 123 | −3.336 | 3.665 | −3.328 | 1.00 | 34.17 | N |
| ATOM | 955 | CA | GLY | A | 123 | −2.581 | 4.418 | −2.344 | 1.00 | 31.92 | C |
| ATOM | 956 | C | GLY | A | 123 | −2.957 | 5.889 | −2.359 | 1.00 | 38.36 | C |
| ATOM | 957 | O | GLY | A | 123 | −3.423 | 6.403 | −3.375 | 1.00 | 39.10 | O |
| ATOM | 958 | N | PRO | A | 124 | −2.747 | 6.578 | −1.228 | 1.00 | 35.34 | N |
| ATOM | 959 | CA | PRO | A | 124 | −3.181 | 7.963 | −1.024 | 1.00 | 33.85 | C |
| ATOM | 960 | C | PRO | A | 124 | −2.245 | 9.021 | −1.600 | 1.00 | 38.95 | C |

TABLE 10.2-continued

| | | | | | | | | | | |
|---|---|---|---|---|---|---|---|---|---|---|
| ATOM | 961 | O | PRO | A | 124 | −1.036 | 8.809 | −1.689 | 1.00 | 33.76 | O |
| ATOM | 962 | CB | PRO | A | 124 | −3.209 | 8.084 | 0.497 | 1.00 | 31.61 | C |
| ATOM | 963 | CG | PRO | A | 124 | −2.100 | 7.184 | 0.944 | 1.00 | 31.80 | C |
| ATOM | 964 | CO | PRO | A | 124 | −2.095 | 6.024 | −0.026 | 1.00 | 35.65 | C |
| ATOM | 965 | N | SER | A | 125 | −2.817 | 10.160 | −1.974 | 1.00 | 31.51 | N |
| ATOM | 966 | CA | SER | A | 125 | −2.038 | 11.366 | −2.216 | 1.00 | 34.17 | C |
| ATOM | 967 | C | SER | A | 125 | −2.015 | 12.176 | −0.926 | 1.00 | 32.77 | C |
| ATOM | 968 | O | SER | A | 125 | −3.041 | 12.315 | −0.261 | 1.00 | 38.58 | O |
| ATOM | 969 | CB | SER | A | 125 | −2.631 | 12.189 | −3.362 | 1.00 | 40.17 | C |
| ATOM | 970 | OG | SER | A | 125 | −2.812 | 11.397 | −4.524 | 1.00 | 45.30 | O |
| ATOM | 971 | N | VAL | A | 126 | −0.851 | 12.695 | −0.557 | 1.00 | 28.64 | N |
| ATOM | 972 | CA | VAL | A | 126 | −0.734 | 13.466 | 0.674 | 1.00 | 28.98 | C |
| ATOM | 973 | C | VAL | A | 126 | −0.444 | 14.927 | 0.363 | 1.00 | 33.93 | C |
| ATOM | 974 | O | VAL | A | 126 | 0.556 | 15.244 | −0.279 | 1.00 | 37.76 | O |
| ATOM | 975 | CB | VAL | A | 126 | 0.367 | 12.905 | 1.593 | 1.00 | 28.89 | C |
| ATOM | 976 | CG1 | VAL | A | 126 | 0.374 | 13.641 | 2.930 | 1.00 | 28.32 | C |
| ATOM | 977 | CG2 | VAL | A | 126 | 0.169 | 11.413 | 1.797 | 1.00 | 24.48 | C |
| ATOM | 978 | N | PHE | A | 127 | −1.325 | 15.809 | 0.825 | 1.00 | 29.15 | N |
| ATOM | 979 | CA | PHE | A | 127 | −1.212 | 17.236 | 0.557 | 1.00 | 31.17 | C |
| ATOM | 980 | C | PHE | A | 127 | −1.034 | 18.028 | 1.850 | 1.00 | 38.80 | C |
| ATOM | 981 | O | PHE | A | 127 | −1.578 | 17.657 | 2.892 | 1.00 | 31.26 | O |
| ATOM | 982 | CB | PHE | A | 127 | −2.448 | 17.739 | −0.198 | 1.00 | 29.74 | C |
| ATOM | 983 | CG | PHE | A | 127 | −2.709 | 17.013 | −1.484 | 1.00 | 32.93 | C |
| ATOM | 984 | CD1 | PHE | A | 127 | −1.798 | 17.076 | −2.529 | 1.00 | 36.91 | C |
| ATOM | 985 | CD2 | PHE | A | 127 | −3.869 | 16.275 | −1.657 | 1.00 | 33.66 | C |
| ATOM | 986 | CE1 | PHE | A | 127 | −2.033 | 16.407 | −3.718 | 1.00 | 30.94 | C |
| ATOM | 987 | CE2 | PHE | A | 127 | −4.114 | 15.605 | −2.848 | 1.00 | 38.29 | C |
| ATOM | 988 | CZ | PHE | A | 127 | −3.194 | 15.670 | −3.878 | 1.00 | 33.93 | C |
| ATOM | 989 | N | PRO | A | 128 | −0.278 | 19.134 | 1.785 | 1.00 | 38.69 | N |
| ATOM | 990 | CA | PRO | A | 128 | −0.029 | 19.931 | 2.990 | 1.00 | 31.44 | C |
| ATOM | 991 | C | PRO | A | 128 | −1.230 | 20.772 | 3.410 | 1.00 | 34.99 | C |
| ATOM | 992 | O | PRO | A | 128 | −1.930 | 21.318 | 2.562 | 1.00 | 36.42 | O |
| ATOM | 993 | CB | PRO | A | 128 | 1.136 | 20.832 | 2.575 | 1.00 | 35.21 | C |
| ATOM | 994 | CG | PRO | A | 128 | 0.966 | 20.997 | 1.104 | 1.00 | 31.99 | C |
| ATOM | 995 | CD | PRO | A | 128 | 0.395 | 19.694 | 0.598 | 1.00 | 31.14 | C |
| ATOM | 996 | N | LEU | A | 129 | −1.470 | 20.845 | 4.714 | 1.00 | 31.68 | N |
| ATOM | 997 | CA | LEU | A | 129 | −2.354 | 21.853 | 5.280 | 1.00 | 32.81 | C |
| ATOM | 998 | C | LEU | A | 129 | −1.451 | 22.903 | 5.908 | 1.00 | 29.54 | C |
| ATOM | 999 | O | LEU | A | 129 | −1.054 | 22.777 | 7.063 | 1.00 | 28.79 | O |
| ATOM | 1000 | CB | LEU | A | 129 | −3.309 | 21.249 | 6.314 | 1.00 | 28.35 | C |
| ATOM | 1001 | CG | LEU | A | 129 | −4.272 | 20.181 | 5.787 | 1.00 | 32.12 | C |
| ATOM | 1002 | CD1 | LEU | A | 129 | −5.104 | 19.577 | 6.917 | 1.00 | 27.87 | C |
| ATOM | 1003 | CD2 | LEU | A | 129 | −5.170 | 20.762 | 4.700 | 1.00 | 27.99 | C |
| ATOM | 1004 | N | ALA | A | 130 | −1.106 | 23.923 | 5.130 | 1.00 | 30.89 | N |
| ATOM | 1005 | CA | ALA | A | 130 | −0.044 | 24.853 | 5.509 | 1.00 | 38.77 | C |
| ATOM | 1006 | C | ALA | A | 130 | −0.484 | 25.820 | 6.595 | 1.00 | 37.50 | C |
| ATOM | 1007 | O | ALA | A | 130 | −1.576 | 26.378 | 6.524 | 1.00 | 41.37 | O |
| ATOM | 1008 | CB | ATA | A | 130 | −0.445 | 25.624 | 4.286 | 1.00 | 37.41 | C |
| ATOM | 1009 | N | PRO | A | 131 | 0.381 | 26.031 | 7.599 | 1.00 | 45.74 | N |
| ATOM | 1010 | CA | PRO | A | 131 | 0.059 | 26.928 | 8.714 | 1.00 | 46.02 | C |
| ATOM | 1011 | C | PRO | A | 131 | −0.111 | 28.370 | 8.245 | 1.00 | 52.71 | C |
| ATOM | 1012 | O | PRO | A | 131 | 0.650 | 28.845 | 7.397 | 1.00 | 47.91 | O |
| ATOM | 1013 | CB | PRO | A | 131 | 1.264 | 26.778 | 9.647 | 1.00 | 40.81 | C |
| ATOM | 1014 | CG | PRO | A | 131 | 2.376 | 26.354 | 8.764 | 1.00 | 45.92 | C |
| ATOM | 1015 | CD | PRO | A | 131 | 1.751 | 25.499 | 7.694 | 1.00 | 43.34 | C |
| ATOM | 1016 | N | SER | A | 132 | −1.117 | 29.043 | 8.793 | 1.00 | 55.56 | N |
| ATOM | 1017 | CA | SER | A | 132 | −1.473 | 30.396 | 8.380 | 1.00 | 71.89 | C |
| ATOM | 1018 | C | SER | A | 132 | −0.309 | 31.371 | 8.517 | 1.00 | 74.46 | C |
| ATOM | 1019 | O | SER | A | 132 | 0.408 | 31.364 | 9.518 | 1.00 | 79.24 | O |
| ATOM | 1020 | CB | SER | A | 132 | −2.670 | 30.896 | 9.198 | 1.00 | 76.95 | C |
| ATOM | 1021 | OG | SER | A | 132 | −3.053 | 32.204 | 8.811 | 1.00 | 77.97 | O |
| ATOM | 1022 | N | SER | A | 133 | −0.120 | 32.201 | 7.496 | 1.00 | 80.68 | N |
| ATOM | 1023 | CA | SER | A | 133 | 0.838 | 33.296 | 7.575 | 1.00 | 89.81 | C |
| ATOM | 1024 | C | SER | A | 133 | 0.309 | 34.331 | 8.560 | 1.00 | 95.47 | C |
| ATOM | 1025 | O | SER | A | 133 | 1.072 | 35.087 | 9.166 | 1.00 | 92.23 | O |
| ATOM | 1026 | CB | SER | A | 133 | 1.075 | 33.922 | 6.198 | 1.00 | 81.20 | C |
| ATOM | 1027 | OG | SER | A | 133 | −0.144 | 34.340 | 5.609 | 1.00 | 74.80 | O |
| ATOM | 1028 | N | LYS | A | 134 | −1.012 | 34.343 | 8.717 | 1.00 | 93.18 | N |
| ATOM | 1029 | CA | LYS | A | 134 | −1.678 | 35.224 | 9.665 | 1.00 | 90.77 | C |
| ATOM | 1030 | C | LYS | A | 134 | −1.923 | 34.525 | 11.001 | 1.00 | 94.50 | C |
| ATOM | 1031 | O | LYS | A | 134 | −2.896 | 34.825 | 11.696 | 1.00 | 94.00 | O |
| ATOM | 1032 | CB | LYS | A | 134 | −3.003 | 35.729 | 9.089 | 1.00 | 86.16 | C |
| ATOM | 1033 | CG | LYS | A | 134 | −2.852 | 36.635 | 7.879 | 1.00 | 83.75 | C |
| ATOM | 1034 | CD | LYS | A | 134 | −4.135 | 37.409 | 7.614 | 1.00 | 91.56 | C |
| ATOM | 1035 | CE | LYS | A | 134 | −3.926 | 38.492 | 6.567 | 1.00 | 95.47 | C |
| ATOM | 1036 | NZ | LYS | A | 134 | −5.110 | 39.389 | 6.446 | 1.00 | 88.66 | N |
| ATOM | 1037 | N | SER | A | 135 | −1.045 | 33.588 | 11.353 | 1.00 | 96.11 | N |
| ATOM | 1038 | CA | SER | A | 135 | −1.111 | 32.936 | 12.658 | 1.00 | 97.73 | C |
| ATOM | 1039 | C | SER | A | 135 | −0.885 | 33.973 | 13.753 | 1.00 | 102.54 | C |
| ATOM | 1040 | O | SER | A | 135 | −0.148 | 34.941 | 13.555 | 1.00 | 102.52 | O |

TABLE 10.2-continued

| | | | | | | | | | |
|---|---|---|---|---|---|---|---|---|---|
| ATOM | 1041 | CB | SER | A | 135 | −0.077 | 31.810 | 12.768 | 1.00 | 83.08 | C |
| ATOM | 1042 | OG | SER | A | 135 | −0.335 | 30.775 | 11.834 | 1.00 | 78.24 | O |
| ATOM | 1043 | N | THR | A | 136 | −1.524 | 33.775 | 14.901 | 1.00 | 102.47 | N |
| ATOM | 1044 | CA | THR | A | 136 | −1.399 | 34.717 | 16.009 | 1.00 | 105.40 | C |
| ATOM | 1045 | C | THR | A | 136 | 0.030 | 34.741 | 16.550 | 1.00 | 104.11 | C |
| ATOM | 1046 | O | THR | A | 136 | 0.518 | 33.744 | 17.085 | 1.00 | 99.44 | O |
| ATOM | 1047 | CB | THR | A | 136 | −2.377 | 34.379 | 17.154 | 1.00 | 99.90 | C |
| ATOM | 1048 | CG2 | THR | A | 136 | −3.817 | 34.548 | 16.692 | 1.00 | 100.80 | C |
| ATOM | 1049 | OG1 | THR | A | 136 | −2.173 | 33.027 | 17.582 | 1.00 | 97.52 | O |
| ATOM | 1050 | N | SER | A | 137 | 0.696 | 35.883 | 16.395 | 1.00 | 105.35 | N |
| ATOM | 1051 | CA | SER | A | 137 | 2.071 | 36.049 | 16.858 | 1.00 | 104.45 | C |
| ATOM | 1052 | C | SER | A | 137 | 2.168 | 35.866 | 18.370 | 1.00 | 102.60 | C |
| ATOM | 1053 | O | SER | A | 137 | 1.517 | 36.580 | 19.135 | 1.00 | 98.58 | O |
| ATOM | 1054 | CB | SER | A | 137 | 2.610 | 37.424 | 16.456 | 1.00 | 105.78 | C |
| ATOM | 1055 | OG | SER | A | 137 | 2.624 | 37.578 | 15.047 | 1.00 | 96.80 | O |
| ATOM | 1056 | N | GLY | A | 138 | 2.981 | 34.902 | 18.790 | 1.00 | 97.35 | N |
| ATOM | 1057 | CA | GLY | A | 138 | 3.115 | 34.571 | 20.197 | 1.00 | 98.58 | C |
| ATOM | 1058 | C | GLY | A | 138 | 1.978 | 33.692 | 20.685 | 1.00 | 99.72 | C |
| ATOM | 1059 | O | GLY | A | 138 | 1.816 | 33.480 | 21.888 | 1.00 | 98.83 | O |
| ATOM | 1060 | N | GLY | A | 139 | 1.188 | 33.180 | 19.744 | 1.00 | 93.81 | N |
| ATOM | 1061 | CA | GLY | A | 139 | 0.044 | 32.348 | 20.066 | 1.00 | 77.07 | C |
| ATOM | 1062 | C | GLY | A | 139 | 0.181 | 30.926 | 19.557 | 1.00 | 70.80 | C |
| ATOM | 1063 | O | GLY | A | 139 | 1.247 | 30.316 | 19.662 | 1.00 | 65.42 | O |
| ATOM | 1064 | N | THR | A | 140 | −0.904 | 30.398 | 18.998 | 1.00 | 65.95 | N |
| ATOM | 1065 | CA | THR | A | 140 | −0.941 | 29.012 | 18.541 | 1.00 | 60.59 | C |
| ATOM | 1066 | C | THR | A | 140 | −1.281 | 28.906 | 17.053 | 1.00 | 54.28 | C |
| ATOM | 1067 | O | THR | A | 140 | −2.238 | 29.520 | 16.580 | 1.00 | 54.81 | O |
| ATOM | 1068 | CB | THR | A | 140 | −1.963 | 28.189 | 19.360 | 1.00 | 57.65 | C |
| ATOM | 1069 | CG2 | THR | A | 140 | −2.218 | 26.832 | 18.719 | 1.00 | 45.39 | C |
| ATOM | 1070 | OG1 | THR | A | 140 | −1.463 | 27.993 | 20.689 | 1.00 | 65.11 | O |
| ATOM | 1071 | N | ALA | A | 141 | −0.488 | 28.129 | 16.321 | 1.00 | 41.19 | N |
| ATOM | 1072 | CA | ALA | A | 141 | −0.767 | 27.862 | 14.914 | 1.00 | 47.82 | C |
| ATOM | 1073 | C | ALA | A | 141 | −1.193 | 26.410 | 14.708 | 1.00 | 39.86 | C |
| ATOM | 1074 | O | ALA | A | 141 | −0.881 | 25.541 | 15.521 | 1.00 | 42.63 | O |
| ATOM | 1075 | CB | ALA | A | 141 | 0.447 | 28.181 | 14.059 | 1.00 | 33.31 | C |
| ATOM | 1076 | N | ALA | A | 142 | −1.911 | 26.151 | 13.621 | 1.00 | 35.54 | N |
| ATOM | 1077 | CA | ALA | A | 142 | −2.279 | 24.787 | 13.265 | 1.00 | 32.56 | C |
| ATOM | 1078 | C | ALA | A | 142 | −1.747 | 24.446 | 11.885 | 1.00 | 30.50 | C |
| ATOM | 1079 | O | ALA | A | 142 | −1.761 | 25.276 | 10.978 | 1.00 | 39.38 | O |
| ATOM | 1080 | CB | ALA | A | 142 | −3.791 | 24.600 | 13.317 | 1.00 | 33.11 | C |
| ATOM | 1081 | N | LEU | A | 143 | −1.267 | 23.220 | 11.735 | 1.00 | 29.03 | N |
| ATOM | 1082 | CA | LEU | A | 143 | −0.827 | 22.726 | 10.447 | 1.00 | 27.15 | C |
| ATOM | 1083 | C | LEU | A | 143 | −1.214 | 21.263 | 10.343 | 1.00 | 29.85 | C |
| ATOM | 1084 | O | LEU | A | 143 | −1.577 | 20.643 | 11.340 | 1.00 | 30.37 | O |
| ATOM | 1085 | CB | LEU | A | 143 | 0.681 | 22.922 | 10.267 | 1.00 | 31.63 | C |
| ATOM | 1086 | CG | LEU | A | 143 | 1.648 | 22.236 | 11.232 | 1.00 | 36.90 | C |
| ATOM | 1087 | CD1 | LEU | A | 143 | 2.145 | 20.915 | 10.665 | 1.00 | 35.87 | C |
| ATOM | 1088 | CD2 | LEU | A | 143 | 2.817 | 23.154 | 11.551 | 1.00 | 37.42 | C |
| ATOM | 1089 | N | GLY | A | 144 | −1.155 | 20.708 | 9.140 | 1.00 | 25.86 | N |
| ATOM | 1090 | CA | GLY | A | 144 | −1.542 | 19.327 | 8.968 | 1.00 | 28.52 | C |
| ATOM | 1091 | C | GLY | A | 144 | −1.254 | 18.715 | 7.615 | 1.00 | 24.81 | C |
| ATOM | 1092 | O | GLY | A | 144 | −0.577 | 19.300 | 6.774 | 1.00 | 28.21 | O |
| ATOM | 1093 | N | CYS | A | 145 | −1.779 | 17.511 | 7.428 | 1.00 | 23.50 | N |
| ATOM | 1094 | CA | CYS | A | 145 | −1.680 | 16.777 | 6.178 | 1.00 | 26.22 | C |
| ATOM | 1095 | C | CYS | A | 145 | −3.059 | 16.307 | 5.759 | 1.00 | 29.48 | C |
| ATOM | 1096 | O | CYS | A | 145 | −3.828 | 15.820 | 6.587 | 1.00 | 28.29 | O |
| ATOM | 1097 | CB | CYS | A | 145 | −0.745 | 15.567 | 6.317 | 1.00 | 32.48 | C |
| ATOM | 1098 | SG | CYS | A | 145 | 1.014 | 15.968 | 6.295 | 1.00 | 53.28 | S |
| ATOM | 1099 | N | LEU | A | 146 | −3.364 | 16.447 | 4.475 | 1.00 | 31.34 | N |
| ATOM | 1100 | CA | LEU | A | 146 | −4.579 | 15.883 | 3.911 | 1.00 | 25.63 | C |
| ATOM | 1101 | C | LEU | A | 146 | −4.235 | 14.603 | 3.157 | 1.00 | 30.29 | C |
| ATOM | 1102 | O | LEU | A | 146 | −3.490 | 14.627 | 2.177 | 1.00 | 34.41 | O |
| ATOM | 1103 | CB | LEU | A | 146 | −5.265 | 16.895 | 2.991 | 1.00 | 30.65 | C |
| ATOM | 1104 | CG | LEU | A | 146 | −6.575 | 16.493 | 2.311 | 1.00 | 36.27 | C |
| ATOM | 1105 | CD1 | LEU | A | 146 | −7.664 | 16.170 | 3.329 | 1.00 | 29.24 | C |
| ATOM | 1106 | CD2 | LEU | A | 146 | −7.027 | 17.607 | 1.378 | 1.00 | 36.45 | C |
| ATOM | 1107 | N | VAL | A | 147 | −4.772 | 13.485 | 3.628 | 1.00 | 30.39 | N |
| ATOM | 1108 | CA | VAL | A | 147 | −4.504 | 12.182 | 3.033 | 1.00 | 27.86 | C |
| ATOM | 1109 | C | VAL | A | 147 | −5.700 | 11.750 | 2.184 | 1.00 | 27.94 | C |
| ATOM | 1110 | O | VAL | A | 147 | −6.718 | 11.321 | 2.711 | 1.00 | 33.43 | O |
| ATOM | 1111 | CB | VAL | A | 147 | −4.209 | 11.143 | 4.123 | 1.00 | 30.05 | C |
| ATOM | 1112 | CG1 | VAL | A | 147 | −3.807 | 9.811 | 3.509 | 1.00 | 31.17 | C |
| ATOM | 1113 | CG2 | VAL | A | 147 | −3.116 | 11.661 | 5.053 | 1.00 | 29.02 | C |
| ATOM | 1114 | N | LYS | A | 148 | −5.579 | 11.870 | 0.866 | 1.00 | 32.05 | N |
| ATOM | 1115 | CA | LYS | S A | 148 | −6.760 | 11.820 | 0.010 | 1.00 | 38.00 | C |
| ATOM | 1116 | C | LYS | A | 148 | −6.740 | 10.696 | −1.026 | 1.00 | 35.47 | C |
| ATOM | 1117 | O | LYS | A | 148 | −5.685 | 10.328 | −1.539 | 1.00 | 38.98 | O |
| ATOM | 1118 | CB | LYS | A | 148 | −6.935 | 13.172 | −0.697 | 1.00 | 39.17 | C |
| ATOM | 1119 | CG | LYS | A | 148 | −8.280 | 13.343 | −1.383 | 1.00 | 47.97 | C |
| ATOM | 1120 | CD | LYS | A | 148 | −8.527 | 14.785 | −1.779 | 1.00 | 41.88 | C |

TABLE 10.2-continued

| | | | | | | | | | |
|---|---|---|---|---|---|---|---|---|---|
| ATOM | 1121 | CE | LYS | A | 148 | −9.901 | 14.951 | −2.417 | 1.00 | 51.38 | C |
| ATOM | 1122 | NZ | LYS | A | 148 | −10.035 | 14.191 | −3.688 | 1.00 | 52.46 | N |
| ATOM | 1123 | N | ASP | A | 149 | −7.929 | 10.160 | −1.309 | 1.00 | 39.61 | N |
| ATOM | 1124 | CA | ASP | A | 149 | −8.162 | 9.206 | −2.398 | 1.00 | 36.49 | C |
| ATOM | 1125 | C | ASP | A | 149 | −7.423 | 7.886 | −2.225 | 1.00 | 40.38 | C |
| ATOM | 1126 | O | ASP | A | 149 | −6.620 | 7.499 | −3.076 | 1.00 | 38.28 | O |
| ATOM | 1127 | CB | ASP | A | 149 | −7.779 | 9.829 | −3.748 | 1.00 | 35.81 | C |
| ATOM | 1128 | CG | ASP | A | 149 | −8.690 | 10.975 | −4.139 | 1.00 | 44.23 | C |
| ATOM | 1129 | OD1 | ASP | A | 149 | −9.834 | 11.014 | −3.642 | 1.00 | 45.39 | O |
| ATOM | 1130 | OD2 | ASP | A | 149 | −8.265 | 11.835 | −4.940 | 1.00 | 51.78 | O |
| ATOM | 1131 | N | TYR | A | 150 | −7.702 | 7.185 | −1.133 | 1.00 | 28.61 | N |
| ATOM | 1132 | CA | TYR | A | 150 | −7.115 | 5.872 | −0.950 | 1.00 | 31.03 | C |
| ATOM | 1133 | C | TYR | A | 150 | −8.197 | 4.827 | −0.728 | 1.00 | 38.37 | C |
| ATOM | 1134 | O | TYR | A | 150 | −9.354 | 5.159 | −0.456 | 1.00 | 36.04 | O |
| ATOM | 1135 | CB | TYR | A | 150 | −6.113 | 5.872 | 0.212 | 1.00 | 29.48 | C |
| ATOM | 1136 | CG | TYR | A | 150 | −6.713 | 6.143 | 1.571 | 1.00 | 32.63 | C |
| ATOM | 1137 | CD1 | TYR | A | 150 | −6.837 | 7.439 | 2.051 | 1.00 | 31.16 | C |
| ATOM | 1138 | CD2 | TYR | A | 150 | −7.145 | 5.100 | 2.380 | 1.00 | 34.56 | C |
| ATOM | 1139 | CE1 | TYR | A | 150 | −7.381 | 7.689 | 3.295 | 1.00 | 26.37 | C |
| ATOM | 1140 | CE2 | TYR | A | 150 | −7.691 | 5.340 | 3.625 | 1.00 | 30.49 | C |
| ATOM | 1141 | CZ | TYR | A | 150 | −7.804 | 6.633 | 4.079 | 1.00 | 32.92 | C |
| ATOM | 1142 | OH | TYR | A | 150 | −8.347 | 6.865 | 5.322 | 1.00 | 33.53 | O |
| ATOM | 1143 | N | PHE | A | 151 | −7.807 | 3.565 | −0.866 | 1.00 | 30.04 | N |
| ATOM | 1144 | CA | PHE | A | 151 | −8.699 | 2.437 | −0.650 | 1.00 | 32.42 | C |
| ATOM | 1145 | C | PHE | A | 151 | −7.861 | 1.173 | −0.518 | 1.00 | 32.34 | C |
| ATOM | 1146 | O | PHE | A | 151 | −6.895 | 0.992 | −1.258 | 1.00 | 38.41 | O |
| ATOM | 1147 | CB | PHE | A | 151 | −9.708 | 2.298 | −1.799 | 1.00 | 32.75 | C |
| ATOM | 1148 | CG | PHE | A | 151 | −10.788 | 1.287 | −1.535 | 1.00 | 35.46 | C |
| ATOM | 1149 | CD2 | PHE | A | 151 | −11.978 | 1.669 | −0.936 | 1.00 | 38.75 | C |
| ATOM | 1150 | CD1 | PHE | A | 151 | −10.605 | −0.047 | −1.863 | 1.00 | 36.37 | C |
| ATOM | 1151 | CE2 | PHE | A | 151 | −12.969 | 0.743 | −0.676 | 1.00 | 37.03 | C |
| ATOM | 1152 | CE1 | PHE | A | 151 | −11.595 | −0.981 | −1.605 | 1.00 | 36.99 | C |
| ATOM | 1153 | CZ | PHE | A | 151 | −12.777 | −0.584 | +0.013 | 1.00 | 38.87 | C |
| ATOM | 1154 | N | PRO | A | 152 | −8.207 | 0.307 | 0.446 | 1.00 | 36.93 | N |
| ATOM | 1155 | CA | PRO | A | 152 | −9.241 | 0.535 | 1.456 | 1.00 | 33.39 | C |
| ATOM | 1156 | C | PRO | A | 152 | −8.638 | 1.119 | 2.726 | 1.00 | 36.06 | C |
| ATOM | 1157 | O | PRO | A | 152 | −7.493 | 1.579 | 2.706 | 1.00 | 30.72 | O |
| ATOM | 1158 | CB | PRO | A | 152 | −9.775 | −0.869 | 1.707 | 1.00 | 35.39 | C |
| ATOM | 1159 | CG | PRO | A | 152 | −8.534 | −1.711 | 1.609 | 1.00 | 34.66 | C |
| ATOM | 1160 | CD | PRO | A | 152 | −7.652 | −1.056 | 0.552 | 1.00 | 34.24 | C |
| ATOM | 1161 | N | GLU | A | 153 | −9.400 | 1.095 | 3.816 | 1.00 | 31.54 | N |
| ATOM | 1162 | CA | GLU | A | 153 | −8.855 | 1.413 | 5.132 | 1.00 | 35.20 | C |
| ATOM | 1163 | C | GLU | A | 153 | −7.853 | 0.323 | 5.528 | 1.00 | 30.90 | C |
| ATOM | 1164 | O | GLU | A | 153 | −7.918 | −0.790 | 5.012 | 1.00 | 30.88 | O |
| ATOM | 1165 | CB | GLU | A | 153 | −9.979 | 1.531 | 6.170 | 1.00 | 34.19 | C |
| ATOM | 1166 | CG | GLU | A | 153 | −10.884 | 2.735 | 5.978 | 1.00 | 30.47 | C |
| ATOM | 1167 | CD | GLU | A | 153 | −10.607 | 3.838 | 6.980 | 1.00 | 49.19 | C |
| ATOM | 1168 | OE1 | GLU | A | 153 | −11.550 | 4.226 | 7.705 | 1.00 | 56.79 | O |
| ATOM | 1169 | OE2 | GLU | A | 153 | −9.452 | 4.323 | 7.042 | 1.00 | 53.78 | O |
| ATOM | 1170 | N | PRO | A | 154 | −6.923 | 0.634 | 6.444 | 1.00 | 31.40 | N |
| ATOM | 1171 | CA | PRO | A | 154 | −6.719 | 1.915 | 7.118 | 1.00 | 33.58 | C |
| ATOM | 1172 | C | PRO | A | 154 | −5.436 | 2.624 | 6.692 | 1.00 | 34.09 | C |
| ATOM | 1173 | O | PRO | A | 154 | −4.576 | 2.024 | 6.047 | 1.00 | 33.03 | O |
| ATOM | 1174 | CB | PRO | A | 154 | −6.614 | 1.494 | 8.576 | 1.00 | 27.86 | C |
| ATOM | 1175 | CG | PRO | A | 154 | −5.808 | 0.210 | 8.476 | 1.00 | 30.94 | C |
| ATOM | 1176 | CD | PRO | A | 154 | −6.178 | −0.435 | 7.133 | 1.00 | 33.22 | C |
| ATOM | 1177 | N | VAL | A | 155 | −5.306 | 3.892 | 7.059 | 1.00 | 34.38 | N |
| ATOM | 1178 | CA | VAL | A | 155 | −4.006 | 4.540 | 7.013 | 1.00 | 35.85 | C |
| ATOM | 1179 | C | VAL | A | 155 | −3.648 | 4.982 | 8.420 | 1.00 | 35.04 | C |
| ATOM | 1180 | O | VAL | A | 155 | −4.525 | 5.310 | 9.219 | 1.00 | 34.51 | O |
| ATOM | 1181 | CB | VAL | A | 155 | −3.966 | 5.755 | 6.060 | 1.00 | 36.38 | C |
| ATOM | 1182 | CG1 | VAL | A | 155 | −4.367 | 5.351 | 4.656 | 1.00 | 37.19 | C |
| ATOM | 1183 | CG2 | VAL | A | 155 | −4.850 | 6.870 | 6.572 | 1.00 | 41.10 | C |
| ATOM | 1184 | N | THR | A | 156 | −2.358 | 4.966 | 8.730 | 1.00 | 32.78 | N |
| ATOM | 1185 | CA | THR | A | 156 | −1.887 | 5.503 | 9.994 | 1.00 | 29.21 | C |
| ATOM | 1186 | C | THR | A | 156 | −1.074 | 6.759 | 9.733 | 1.00 | 35.34 | C |
| ATOM | 1187 | O | THR | A | 156 | −0.448 | 6.916 | 8.675 | 1.00 | 29.04 | O |
| ATOM | 1188 | CB | THR | A | 156 | −1.034 | 4.487 | 10.785 | 1.00 | 34.00 | C |
| ATOM | 1189 | CG2 | THR | A | 156 | −1.843 | 3.230 | 11.088 | 1.00 | 33.80 | C |
| ATOM | 1190 | OG1 | THR | A | 156 | 0.132 | 4.140 | 10.028 | 1.00 | 35.62 | O |
| ATOM | 1191 | N | VAL | A | 157 | −1.099 | 7.665 | 10.700 | 1.00 | 27.89 | N |
| ATOM | 1192 | CA | VAL | A | 157 | −0.375 | 8.916 | 10.582 | 1.00 | 33.47 | C |
| ATOM | 1193 | C | VAL | A | 157 | 0.370 | 9.197 | 11.867 | 1.00 | 28.46 | C |
| ATOM | 1194 | O | VAL | A | 157 | −0.216 | 9.168 | 12.949 | 1.00 | 36.97 | O |
| ATOM | 1195 | CB | VAL | A | 157 | −1.319 | 10.100 | 10.276 | 1.00 | 28.34 | C |
| ATOM | 1196 | CG1 | VAL | A | 157 | −0.523 | 11.395 | 10.154 | 1.00 | 28.04 | C |
| ATOM | 1197 | CG2 | VAL | A | 157 | −2.120 | 9.833 | 9.011 | 1.00 | 26.05 | C |
| ATOM | 1198 | N | SER | A | 158 | 1.665 | 9.455 | 11.752 | 1.00 | 30.73 | N |
| ATOM | 1199 | CA | SER | A | 158 | 2.429 | 9.964 | 12.880 | 1.00 | 36.51 | C |
| ATOM | 1200 | C | SER | A | 158 | 3.087 | 11.267 | 12.461 | 1.00 | 32.08 | C |

TABLE 10.2-continued

| ATOM | 1201 | O | SER | A | 158 | 3.162 | 11.571 | 11.270 | 1.00 | 30.98 | O |
|---|---|---|---|---|---|---|---|---|---|---|---|
| ATOM | 1202 | CB | SER | A | 158 | 3.476 | 8.951 | 13.347 | 1.00 | 35.17 | C |
| ATOM | 1203 | OG | SER | A | 158 | 4.538 | 8.848 | 12.419 | 1.00 | 40.81 | O |
| ATOM | 1204 | N | TRP | A | 159 | 3.546 | 12.040 | 13.440 | 1.00 | 27.85 | N |
| ATOM | 1205 | CA | TRP | A | 159 | 4.263 | 13.276 | 13.166 | 1.00 | 30.67 | C |
| ATOM | 1206 | C | TRP | A | 159 | 5.684 | 13.207 | 13.707 | 1.00 | 31.39 | C |
| ATOM | 1207 | O | TRP | A | 159 | 5.900 | 12.792 | 14.845 | 1.00 | 30.84 | O |
| ATOM | 1208 | CB | TRP | A | 159 | 3.519 | 14.470 | 13.761 | 1.00 | 28.15 | C |
| ATOM | 1209 | CG | TRP | A | 159 | 2.278 | 14.795 | 13.004 | 1.00 | 35.31 | C |
| ATOM | 1210 | CD1 | TRP | A | 159 | 1.049 | 14.237 | 13.170 | 1.00 | 31.91 | C |
| ATOM | 1211 | CD2 | TRP | A | 159 | 2.149 | 15.745 | 11.942 | 1.00 | 33.46 | C |
| ATOM | 1212 | CE2 | TRP | A | 159 | 0.807 | 15.716 | 11.518 | 1.00 | 32.34 | C |
| ATOM | 1213 | CE3 | TRP | A | 159 | 3.038 | 16.620 | 11.310 | 1.00 | 33.99 | C |
| ATOM | 1214 | NE1 | TRP | A | 159 | 0.157 | 14.784 | 12.283 | 1.00 | 31.36 | N |
| ATOM | 1215 | CZ2 | TRP | A | 159 | 0.331 | 16.526 | 10.489 | 1.00 | 30.53 | C |
| ATOM | 1216 | CZ3 | TRP | A | 159 | 2.565 | 17.423 | 10.289 | 1.00 | 30.89 | C |
| ATOM | 1217 | CH2 | TRP | A | 159 | 1.223 | 17.372 | 9.890 | 1.00 | 33.28 | C |
| ATOM | 1218 | N | ASN | A | 160 | 6.639 | 13.617 | 12.875 | 1.00 | 26.79 | N |
| ATOM | 1219 | CA | ASN | A | 160 | 8.061 | 13.584 | 13.208 | 1.00 | 28.03 | C |
| ATOM | 1220 | C | ASN | A | 160 | 8.491 | 12.236 | 13.778 | 1.00 | 33.44 | C |
| ATOM | 1221 | O | ASN | A | 160 | 9.200 | 12.171 | 14.784 | 1.00 | 32.52 | O |
| ATOM | 1222 | CB | ASN | A | 160 | 8.405 | 14.708 | 14.185 | 1.00 | 27.50 | C |
| ATOM | 1223 | CG | ASN | A | 160 | 8.269 | 16.078 | 13.559 | 1.00 | 30.24 | C |
| ATOM | 1224 | ND2 | ASN | A | 160 | 8.292 | 17.119 | 14.385 | 1.00 | 34.83 | N |
| ATOM | 1225 | OD1 | ASN | A | 160 | 8.153 | 16.199 | 12.342 | 1.00 | 37.06 | O |
| ATOM | 1226 | N | SER | A | 161 | 8.026 | 11.168 | 13.135 | 1.00 | 32.54 | N |
| ATOM | 1227 | CA | SER | A | 161 | 8.394 | 9.801 | 13.492 | 1.00 | 38.63 | C |
| ATOM | 1228 | C | SER | A | 161 | 7.988 | 9.425 | 14.916 | 1.00 | 37.84 | C |
| ATOM | 1229 | O | SER | A | 161 | 8.601 | 8.556 | 15.530 | 1.00 | 36.85 | O |
| ATOM | 1230 | CB | SER | A | 161 | 9.901 | 9.598 | 13.310 | 1.00 | 33.00 | C |
| ATOM | 1231 | OG | SER | A | 161 | 10.292 | 9.901 | 11.983 | 1.00 | 36.60 | O |
| ATOM | 1232 | N | GLY | A | 162 | 6.951 | 10.074 | 15.434 | 1.00 | 33.46 | N |
| ATOM | 1233 | CA | GLY | A | 162 | 6.456 | 9.771 | 16.764 | 1.00 | 33.72 | C |
| ATOM | 1234 | C | GLY | A | 162 | 7.005 | 10.686 | 17.843 | 1.00 | 35.30 | C |
| ATOM | 1235 | O | GLY | A | 162 | 6.639 | 10.568 | 19.011 | 1.00 | 42.69 | O |
| ATOM | 1236 | N | ALA | A | 163 | 7.885 | 11.602 | 17.457 | 1.00 | 37.22 | N |
| ATOM | 1237 | CA | ALA | A | 163 | 8.439 | 12.561 | 18.405 | 1.00 | 36.88 | C |
| ATOM | 1238 | C | ALA | A | 163 | 7.428 | 13.661 | 18.725 | 1.00 | 41.59 | C |
| ATOM | 1239 | O | ALA | A | 163 | 7.524 | 14.318 | 19.762 | 1.00 | 40.49 | O |
| ATOM | 1240 | CB | ALA | A | 163 | 9.725 | 13.165 | 17.865 | 1.00 | 30.59 | C |
| ATOM | 1241 | N | LEU | A | 164 | 6.460 | 13.858 | 17.833 | 1.00 | 36.52 | N |
| ATOM | 1242 | CA | LEU | A | 164 | 5.423 | 14.863 | 18.052 | 1.00 | 35.71 | C |
| ATOM | 1243 | C | LEU | A | 164 | 4.089 | 14.180 | 18.333 | 1.00 | 36.12 | C |
| ATOM | 1244 | O | LEU | A | 164 | 3.517 | 13.513 | 17.468 | 1.00 | 35.37 | O |
| ATOM | 1245 | CB | LEU | A | 164 | 5.316 | 15.802 | 16.849 | 1.00 | 30.79 | C |
| ATOM | 1246 | CG | LEU | A | 164 | 4.328 | 16.965 | 16.961 | 1.00 | 36.59 | C |
| ATOM | 1247 | CD1 | LEU | A | 164 | 4.537 | 17.756 | 18.256 | 1.00 | 36.35 | C |
| ATOM | 1248 | CD2 | LEU | A | 164 | 4.450 | 17.875 | 15.752 | 1.00 | 33.18 | C |
| ATOM | 1249 | N | THR | A | 165 | 3.601 | 14.359 | 19.555 | 1.00 | 33.05 | N |
| ATOM | 1250 | CA | THR | A | 165 | 2.442 | 13.623 | 20.048 | 1.00 | 39.48 | C |
| ATOM | 1251 | C | THR | A | 165 | 1.347 | 14.555 | 20.562 | 1.00 | 39.43 | C |
| ATOM | 1252 | O | THR | A | 165 | 0.164 | 14.353 | 20.285 | 1.00 | 39.07 | O |
| ATOM | 1253 | CB | THR | A | 165 | 2.864 | 12.646 | 21.174 | 1.00 | 34.92 | C |
| ATOM | 1254 | CG2 | THR | A | 165 | 1.693 | 12.309 | 22.089 | 1.00 | 52.65 | C |
| ATOM | 1255 | OG1 | THR | A | 165 | 3.367 | 11.442 | 20.588 | 1.00 | 50.23 | O |
| ATOM | 1256 | N | SER | A | 166 | 1.750 | 15.577 | 21.308 | 1.00 | 33.38 | N |
| ATOM | 1257 | CA | SER | A | 166 | 0.804 | 16.495 | 21.930 | 1.00 | 35.48 | C |
| ATOM | 1258 | C | SER | A | 166 | 0.202 | 17.452 | 20.915 | 1.00 | 34.11 | C |
| ATOM | 1259 | O | SER | A | 166 | 0.920 | 18.061 | 20.123 | 1.00 | 37.38 | O |
| ATOM | 1260 | CB | SER | A | 166 | 1.487 | 17.285 | 23.047 | 1.00 | 37.23 | C |
| ATOM | 1261 | OG | SER | A | 166 | 2.094 | 16.406 | 23.982 | 1.00 | 58.12 | O |
| ATOM | 1262 | N | GLY | A | 167 | −1.120 | 17.583 | 20.945 | 1.00 | 36.94 | N |
| ATOM | 1263 | CA | GLY | A | 167 | −1.809 | 18.532 | 20.090 | 1.00 | 35.05 | C |
| ATOM | 1264 | C | GLY | A | 167 | −2.196 | 17.943 | 18.750 | 1.00 | 38.60 | C |
| ATOM | 1265 | O | GLY | A | 167 | −2.701 | 18.650 | 17.879 | 1.00 | 38.31 | O |
| ATOM | 1266 | N | VAL | A | 168 | −1.965 | 16.643 | 18.586 | 1.00 | 35.11 | N |
| ATOM | 1267 | CA | VAL | A | 168 | −2.262 | 15.968 | 17.328 | 1.00 | 34.52 | C |
| ATOM | 1268 | C | VAL | A | 168 | −3.690 | 15.438 | 17.297 | 1.00 | 33.72 | C |
| ATOM | 1269 | O | VAL | A | 168 | −4.145 | 14.801 | 18.242 | 1.00 | 33.06 | O |
| ATOM | 1270 | CB | VAL | A | 168 | −1.295 | 14.792 | 17.074 | 1.00 | 34.33 | C |
| ATOM | 1271 | CG1 | VAL | A | 168 | −1.662 | 14.059 | 15.783 | 1.00 | 32.11 | C |
| ATOM | 1272 | CG2 | VAL | A | 168 | 0.141 | 15.285 | 17.027 | 1.00 | 30.55 | C |
| ATOM | 1273 | N | HIS | A | 169 | −4.392 | 15.712 | 16.203 | 1.00 | 34.59 | N |
| ATOM | 1274 | CA | HIS | A | 169 | −5.693 | 15.108 | 15.953 | 1.00 | 33.15 | C |
| ATOM | 1275 | C | HIS | A | 169 | −5.701 | 14.463 | 14.577 | 1.00 | 34.43 | C |
| ATOM | 1276 | O | HIS | A | 169 | −5.556 | 15.147 | 13.561 | 1.00 | 32.61 | O |
| ATOM | 1277 | CB | HIS | A | 169 | −6.822 | 16.140 | 16.039 | 1.00 | 33.41 | C |
| ATOM | 1278 | CG | HIS | A | 169 | −7.036 | 16.702 | 17.409 | 1.00 | 38.03 | C |
| ATOM | 1279 | CD2 | HIS | A | 169 | −6.891 | 17.961 | 17.887 | 1.00 | 35.39 | C |
| ATOM | 1280 | ND1 | HIS | A | 169 | −7.482 | 15.940 | 18.467 | 1.00 | 45.83 | N |

TABLE 10.2-continued

| | | | | | | | | | | |
|---|---|---|---|---|---|---|---|---|---|---|
| ATOM | 1281 | CE1 | HIS | A | 169 | −7.592 | 16.702 | 19.541 | 1.00 | 37.15 | C |
| ATOM | 1282 | NE2 | HIS | A | 169 | −7.240 | 17.933 | 19.215 | 1.00 | 39.39 | N |
| ATOM | 1283 | N | THR | A | 170 | −5.857 | 13.145 | 14.551 | 1.00 | 33.36 | N |
| ATOM | 1284 | CA | THR | A | 170 | −6.059 | 12.424 | 13.304 | 1.00 | 31.63 | C |
| ATOM | 1285 | C | THR | A | 170 | −7.525 | 12.030 | 13.217 | 1.00 | 32.95 | C |
| ATOM | 1286 | O | THR | A | 170 | −8.032 | 11.288 | 14.056 | 1.00 | 37.08 | O |
| ATOM | 1287 | CB | THR | A | 170 | −5.168 | 11.178 | 13.200 | 1.00 | 35.35 | C |
| ATOM | 1288 | CG2 | THR | A | 170 | −5.437 | 10.439 | 11.895 | 1.00 | 29.64 | C |
| ATOM | 1289 | OG1 | THR | A | 170 | −3.792 | 11.576 | 13.246 | 1.00 | 35.66 | O |
| ATOM | 1290 | N | PHE | A | 171 | −8.202 | 12.553 | 12.204 | 1.00 | 30.34 | N |
| ATOM | 1291 | CA | PHE | A | 171 | −9.641 | 12.398 | 12.076 | 1.00 | 30.60 | C |
| ATOM | 1292 | C | PHE | A | 171 | −10.036 | 11.082 | 11.422 | 1.00 | 29.79 | C |
| ATOM | 1293 | O | PHE | A | 171 | −9.297 | 10.551 | 10.5977 | 1.00 | 31.35 | O |
| ATOM | 1294 | CG | PHE | A | 171 | −10.214 | 13.574 | 11.286 | 1.00 | 23.31 | C |
| ATOM | 1295 | CG | PHE | A | 171 | −10.141 | 14.874 | 12.024 | 1.00 | 25.50 | C |
| ATOM | 1296 | CD2 | PHE | A | 171 | −11.197 | 15.295 | 12.810 | 1.00 | 29.91 | C |
| ATOM | 1297 | CD1 | PHE | A | 171 | −9.004 | 15.662 | 11.957 | 1.00 | 31.55 | C |
| ATOM | 1298 | CE2 | PHE | A | 171 | −11.133 | 16.488 | 13.502 | 1.00 | 30.68 | C |
| ATOM | 1299 | CE1 | PHE | A | 171 | −8.931 | 16.856 | 12.647 | 1.00 | 36.15 | C |
| ATOM | 1300 | CZ | PHE | A | 171 | −10.001 | 17.269 | 13.422 | 1.00 | 30.59 | C |
| ATOM | 1301 | N | PRO | A | 172 | −11.204 | 10.546 | 11.805 | 1.00 | 35.35 | N |
| ATOM | 1302 | CA | PRO | A | 172 | −11.781 | 9.388 | 11.117 | 1.00 | 36.50 | C |
| ATOM | 1303 | C | PRO | A | 172 | −11.928 | 9.670 | 9.627 | 1.00 | 36.86 | C |
| ATOM | 1304 | O | PRO | A | 172 | −12.265 | 10.794 | 9.253 | 1.00 | 33.48 | O |
| ATOM | 1305 | CB | PRO | A | 172 | −13.151 | 9.225 | 11.784 | 1.00 | 32.84 | C |
| ATOM | 1306 | CG | PRO | A | 172 | −12.979 | 9.826 | 13.137 | 1.00 | 36.13 | C |
| ATOM | 1307 | CD | PRO | A | 172 | −12.018 | 10.968 | 12.961 | 1.00 | 33.84 | C |
| ATOM | 1308 | N | ALA | A | 173 | −11.661 | 8.675 | 8.791 | 1.00 | 32.35 | N |
| ATOM | 1309 | CA | ALA | A | 173 | −11.783 | 8.850 | 7.349 | 1.00 | 35.00 | C |
| ATOM | 1310 | C | ALA | A | 173 | −13.237 | 9.021 | 6.930 | 1.00 | 34.52 | C |
| ATOM | 1311 | O | ALA | A | 173 | −14.132 | 8.415 | 7.516 | 1.00 | 37.71 | O |
| ATOM | 1312 | CB | ALA | A | 173 | −11.168 | 7.666 | 6.618 | 1.00 | 34.54 | C |
| ATOM | 1313 | N | VAL | A | 174 | −13.473 | 9.849 | 5.920 | 1.00 | 33.54 | N |
| ATOM | 1314 | CA | VAL | A | 174 | −14.792 | 9.909 | 5.307 | 1.00 | 33.28 | C |
| ATOM | 1315 | C | VAL | A | 174 | −14.737 | 9.250 | 3.939 | 1.00 | 35.09 | C |
| ATOM | 1316 | O | VAL | A | 174 | −13.734 | 9.348 | 3.223 | 1.00 | 34.87 | O |
| ATOM | 1317 | CB | VAL | A | 174 | −15.320 | 11.360 | 5.171 | 1.00 | 32.47 | C |
| ATOM | 1318 | CG1 | VAL | A | 174 | −15.378 | 12.032 | 6.534 | 1.00 | 40.37 | C |
| ATOM | 1319 | CG2 | VAL | A | 174 | −14.469 | 12.168 | 4.196 | 1.00 | 37.12 | C |
| ATOM | 1320 | N | LEU | A | 175 | −15.809 | 8.550 | 3.591 | 1.00 | 40.76 | N |
| ATOM | 1321 | CA | LEU | A | 175 | −15.921 | 7.932 | 2.280 | 1.00 | 38.53 | C |
| ATOM | 1322 | C | LEU | A | 175 | −16.501 | 8.941 | 1.300 | 1.00 | 37.30 | C |
| ATOM | 1323 | O | LEU | A | 175 | −17.605 | 9.447 | 1.494 | 1.00 | 43.25 | O |
| ATOM | 1324 | CB | LEU | A | 175 | −16.788 | 6.669 | 2.344 | 1.00 | 37.54 | C |
| ATOM | 1325 | CG | LEU | A | 175 | −16.905 | 5.864 | 1.047 | 1.00 | 40.58 | C |
| ATOM | 1326 | CD1 | LEU | A | 175 | −15.529 | 5.519 | 0.504 | 1.00 | 37.07 | C |
| ATOM | 1327 | CD2 | LEU | A | 175 | −17.733 | 4.598 | 1.258 | 1.00 | 43.41 | C |
| ATOM | 1328 | N | GLN | A | 176 | −15.744 | 9.239 | 0.252 | 1.00 | 44.15 | N |
| ATOM | 1329 | CA | GLN | A | 176 | −16.163 | 10.211 | −0.746 | 1.00 | 37.45 | C |
| ATOM | 1330 | C | GLN | A | 176 | −17.095 | 9.569 | −1.769 | 1.00 | 44.09 | C |
| ATOM | 1331 | O | GLN | A | 176 | −17.298 | 8.356 | −1.756 | 1.00 | 44.31 | O |
| ATOM | 1332 | CB | GLN | A | 176 | −14.941 | 10.815 | −1.439 | 1.00 | 39.61 | C |
| ATOM | 1333 | CG | GLN | A | 176 | −13.940 | 11.448 | −0.480 | 1.00 | 41.98 | C |
| ATOM | 1334 | CD | GLN | A | 176 | −12.634 | 11.818 | −1.160 | 1.00 | 45.48 | C |
| ATOM | 1335 | NE2 | GLN | A | 176 | −11.917 | 10.813 | −1.655 | 1.00 | 33.19 | N |
| ATOM | 1336 | OE1 | GLN | A | 176 | −12.270 | 12.993 | −1.231 | 1.00 | 52.08 | O |
| ATOM | 1337 | N | SER | A | 177 | −17.655 | 10.390 | −2.655 | 1.00 | 43.50 | N |
| ATOM | 1338 | CA | SER | A | 177 | −18.571 | 9.913 | −3.690 | 1.00 | 44.39 | C |
| ATOM | 1339 | C | SER | A | 177 | −17.886 | 8.978 | −4.679 | 1.00 | 42.75 | C |
| ATOM | 1340 | O | SER | A | 177 | −18.534 | 8.157 | −5.323 | 1.00 | 48.60 | O |
| ATOM | 1341 | CB | SER | A | 177 | −19.180 | 11.096 | −4.443 | 1.00 | 49.14 | C |
| ATOM | 1342 | OG | SER | A | 177 | −19.961 | 11.895 | −3.575 | 1.00 | 52.77 | O |
| ATOM | 1343 | N | SER | A | 178 | −16.571 | 9.116 | −4.793 | 1.00 | 39.08 | N |
| ATOM | 1344 | CA | SER | A | 178 | −15.780 | 8.312 | −5.714 | 1.00 | 38.13 | C |
| ATOM | 1345 | C | SER | A | 178 | −15.542 | 6.890 | −5.215 | 1.00 | 39.53 | C |
| ATOM | 1346 | O | SER | A | 178 | −14.972 | 6.064 | −5.930 | 1.00 | 46.28 | O |
| ATOM | 1347 | CB | SER | A | 178 | −14.435 | 8.991 | −5.957 | 1.00 | 43.23 | C |
| ATOM | 1348 | OG | SER | A | 178 | −13.792 | 9.255 | −4.720 | 1.00 | 49.71 | O |
| ATOM | 1349 | N | GLY | A | 179 | −15.960 | 6.608 | −3.985 | 1.00 | 41.09 | N |
| ATOM | 1350 | CA | GLY | A | 179 | −15.696 | 5.317 | −3.379 | 1.00 | 35.99 | C |
| ATOM | 1351 | C | GLY | A | 179 | −14.316 | 5.259 | −2.746 | 1.00 | 41.20 | C |
| ATOM | 1352 | O | GLY | A | 179 | −13.882 | 4.210 | −2.266 | 1.00 | 37.34 | O |
| ATOM | 1353 | N | LEU | A | 180 | −13.623 | 6.393 | −2.742 | 1.00 | 37.81 | N |
| ATOM | 1354 | CA | LEU | A | 180 | −12.302 | 6.482 | −2.127 | 1.00 | 39.78 | C |
| ATOM | 1355 | C | LEU | A | 180 | −12.370 | 7.247 | −0.808 | 1.00 | 38.81 | C |
| ATOM | 1356 | O | LEU | A | 180 | −13.165 | 8.179 | −0.659 | 1.00 | 34.97 | O |
| ATOM | 1357 | CB | LEU | A | 180 | −11.310 | 7.152 | −3.082 | 1.00 | 38.31 | C |
| ATOM | 1358 | CG | LEU | A | 180 | −11.181 | 6.507 | −4.470 | 1.00 | 38.11 | C |
| ATOM | 1359 | CD1 | LEU | A | 180 | −10.351 | 7.381 | −5.408 | 1.00 | 33.95 | C |
| ATOM | 1360 | CD2 | LEU | A | 180 | −10.577 | 5.119 | −4.359 | 1.00 | 35.65 | C |

TABLE 10.2-continued

| | | | | | | | | | | |
|---|---|---|---|---|---|---|---|---|---|---|
| ATOM | 1361 | N | TYR | A | 181 | −11.534 | 6.849 | 0.147 | 1.00 | 33.32 | N |
| ATOM | 1362 | CA | TYR | A | 181 | −11.492 | 7.494 | 1.457 | 1.00 | 34.27 | C |
| ATOM | 1363 | C | TYR | A | 181 | −10.628 | 8.746 | 1.466 | 1.00 | 36.24 | C |
| ATOM | 1364 | O | TYR | A | 181 | −9.805 | 8.964 | 0.573 | 1.00 | 31.81 | O |
| ATOM | 1365 | CB | TYR | A | 181 | −10.969 | 6.527 | 2.524 | 1.00 | 29.72 | C |
| ATOM | 1366 | CG | TYR | A | 181 | −11.916 | 5.396 | 2.837 | 1.00 | 35.89 | C |
| ATOM | 1367 | CD1 | TYR | A | 181 | −12.985 | 5.582 | 3.707 | 1.00 | 33.01 | C |
| ATOM | 1368 | CD2 | TYR | A | 181 | −11.743 | 4.140 | 2.267 | 1.00 | 31.28 | C |
| ATOM | 1369 | CE1 | TYR | A | 181 | −13.859 | 4.547 | 4.002 | 1.00 | 34.04 | C |
| ATOM | 1370 | CE2 | TYR | A | 181 | −12.614 | 3.095 | 2.560 | 1.00 | 35.99 | C |
| ATOM | 1371 | CZ | TYR | A | 181 | −13.669 | 3.306 | 3.427 | 1.00 | 35.87 | C |
| ATOM | 1372 | OH | TYR | A | 181 | −14.539 | 2.278 | 3.721 | 1.00 | 42.84 | O |
| ATOM | 1373 | N | SER | A | 182 | −10.815 | 9.555 | 2.503 | 1.00 | 33.72 | N |
| ATOM | 1374 | CA | SER | A | 182 | −9.993 | 10.731 | 2.727 | 1.00 | 30.09 | C |
| ATOM | 1375 | C | SER | A | 182 | −9.965 | 11.071 | 4.214 | 1.00 | 35.24 | C |
| ATOM | 1376 | O | SER | A | 182 | −10.975 | 10.941 | 4.907 | 1.00 | 35.29 | O |
| ATOM | 1377 | CB | SER | A | 182 | −10.521 | 11.913 | 1.917 | 1.00 | 35.11 | C |
| ATOM | 1378 | OG | SER | A | 182 | −9.824 | 13.099 | 2.239 | 1.00 | 44.24 | O |
| ATOM | 1379 | N | LEU | A | 183 | −8.809 | 11.488 | 4.713 | 1.00 | 24.60 | N |
| ATOM | 1380 | CA | LEU | A | 183 | −8.745 | 11.992 | 6.077 | 1.00 | 33.42 | C |
| ATOM | 1381 | C | LEU | A | 183 | −7.713 | 13.095 | 6.223 | 1.00 | 28.32 | C |
| ATOM | 1382 | O | LEU | A | 183 | −6.855 | 13.293 | 5.365 | 1.00 | 35.46 | O |
| ATOM | 1383 | CB | LEU | A | 183 | −8.455 | 10.858 | 7.075 | 1.00 | 32.60 | C |
| ATOM | 1384 | CG | LEU | A | 183 | −7.132 | 10.092 | 7.186 | 1.00 | 38.46 | C |
| ATOM | 1385 | CD1 | LEU | A | 183 | −6.003 | 10.910 | 7.815 | 1.00 | 32.89 | C |
| ATOM | 1386 | CD2 | LEU | A | 183 | −7.377 | 8.845 | 8.013 | 1.00 | 35.96 | C |
| ATOM | 1387 | N | SER | A | 184 | −7.801 | 13.812 | 7.329 | 1.00 | 28.07 | N |
| ATOM | 1388 | CA | SER | A | 184 | −6.803 | 14.806 | 7.644 | 1.00 | 30.87 | C |
| ATOM | 1389 | C | SER | A | 184 | −6.202 | 14.512 | 9.009 | 1.00 | 36.19 | C |
| ATOM | 1390 | O | SER | A | 184 | −6.846 | 13.908 | 9.869 | 1.00 | 32.31 | O |
| ATOM | 1391 | CB | SER | A | 184 | −7.411 | 16.198 | 7.619 | 1.00 | 27.57 | C |
| ATOM | 1392 | OG | SER | A | 184 | −8.437 | 16.292 | 8.586 | 1.00 | 37.02 | O |
| ATOM | 1393 | N | SER | A | 185 | −4.958 | 14.930 | 9.190 | 1.00 | 29.68 | N |
| ATOM | 1394 | CA | SER | A | 185 | −4.309 | 14.883 | 10.487 | 1.00 | 27.58 | C |
| ATOM | 1395 | C | SER | A | 185 | −3.733 | 16.254 | 10.747 | 1.00 | 29.16 | C |
| ATOM | 1396 | O | SER | A | 185 | −3.023 | 16.799 | 9.908 | 1.00 | 34.94 | O |
| ATOM | 1397 | CB | SER | A | 185 | −3.211 | 13.822 | 10.533 | 1.00 | 29.89 | C |
| ATOM | 1398 | OG | SER | A | 185 | −2.506 | 13.889 | 11.762 | 1.00 | 33.01 | O |
| ATOM | 1399 | N | VAL | A | 186 | −4.051 | 16.825 | 11.898 | 1.00 | 31.07 | N |
| ATOM | 1400 | CA | VAL | A | 186 | −3.573 | 18.158 | 12.209 | 1.00 | 32.17 | C |
| ATOM | 1401 | C | VAL | A | 186 | −2.863 | 18.166 | 13.545 | 1.00 | 30.53 | C |
| ATOM | 1402 | O | VAL | A | 186 | −3.002 | 17.244 | 14.347 | 1.00 | 29.86 | O |
| ATOM | 1403 | CB | VAL | A | 186 | −4.719 | 19.179 | 12.231 | 1.00 | 30.64 | C |
| ATOM | 1404 | CG1 | VAL | A | 186 | −5.443 | 19.180 | 10.890 | 1.00 | 27.44 | C |
| ATOM | 1405 | CG2 | VAL | A | 186 | −5.684 | 18.868 | 13.369 | 1.00 | 31.93 | C |
| ATOM | 1406 | N | VAL | A | 187 | −2.082 | 19.211 | 13.765 | 1.00 | 28.24 | N |
| ATOM | 1407 | CA | VAL | A | 187 | −1.402 | 19.397 | 15.028 | 1.00 | 29.57 | C |
| ATOM | 1408 | C | VAL | A | 187 | −1.341 | 20.894 | 15.298 | 1.00 | 33.56 | C |
| ATOM | 1409 | O | VAL | A | 187 | −1.156 | 21.689 | 14.377 | 1.00 | 33.65 | O |
| ATOM | 1410 | CB | VAL | A | 187 | 0.013 | 18.764 | 15.013 | 1.00 | 32.42 | C |
| ATOM | 1411 | CG1 | VAL | A | 187 | 0.854 | 19.335 | 13.875 | 1.00 | 35.03 | C |
| ATOM | 1412 | CG2 | VAL | A | 187 | 0.712 | 18.946 | 16.361 | 1.00 | 32.60 | C |
| ATOM | 1413 | N | THR | A | 188 | −1.553 | 21.282 | 16.549 | 1.00 | 31.74 | N |
| ATOM | 1414 | CA | THR | A | 188 | −1.405 | 22.674 | 16.943 | 1.00 | 36.08 | C |
| ATOM | 1415 | C | THR | A | 188 | −0.048 | 22.862 | 17.608 | 1.00 | 40.20 | C |
| ATOM | 1416 | O | THR | A | 188 | 0.332 | 22.092 | 18.488 | 1.00 | 42.98 | O |
| ATOM | 1417 | CB | THR | A | 188 | −2.526 | 23.122 | 17.898 | 1.00 | 35.80 | C |
| ATOM | 1418 | CG2 | THR | A | 188 | −3.810 | 23.379 | 17.124 | 1.00 | 36.31 | C |
| ATOM | 1419 | OG1 | THR | A | 188 | −2.765 | 22.093 | 18.865 | 1.00 | 43.98 | O |
| ATOM | 1420 | N | VAL | A | 189 | 0.685 | 23.878 | 17.166 | 1.00 | 34.48 | N |
| ATOM | 1421 | CA | VAL | A | 189 | 2.034 | 24.144 | 17.655 | 1.00 | 36.93 | C |
| ATOM | 1422 | C | VAL | A | 189 | 2.205 | 25.642 | 17.918 | 1.00 | 45.71 | C |
| ATOM | 1423 | O | VAL | A | 189 | 1.428 | 26.453 | 17.409 | 1.00 | 48.89 | O |
| ATOM | 1424 | CB | VAL | A | 189 | 3.105 | 23.673 | 16.645 | 1.00 | 39.16 | C |
| ATOM | 1425 | CG1 | VAL | A | 189 | 2.983 | 22.178 | 16.378 | 1.00 | 36.29 | C |
| ATOM | 1426 | CG2 | VAL | A | 189 | 2.999 | 24.470 | 15.354 | 1.00 | 30.72 | C |
| ATOM | 1427 | N | PRO | A | 190 | 3.216 | 26.018 | 18.719 | 1.00 | 45.89 | N |
| ATOM | 1428 | CA | PRO | A | 190 | 3.473 | 27.449 | 18.936 | 1.00 | 50.63 | C |
| ATOM | 1429 | C | PRO | A | 190 | 3.852 | 28.173 | 17.644 | 1.00 | 48.93 | C |
| ATOM | 1430 | O | PRO | A | 190 | 4.637 | 27.643 | 16.858 | 1.00 | 44.98 | O |
| ATOM | 1431 | CB | PRO | A | 190 | 4.645 | 27.450 | 19.924 | 1.00 | 48.82 | C |
| ATOM | 1432 | CG | PRO | A | 190 | 4.553 | 26.131 | 20.620 | 1.00 | 46.27 | C |
| ATOM | 1433 | CD | PRO | A | 190 | 4.067 | 25.170 | 19.574 | 1.00 | 42.43 | C |
| ATOM | 1434 | N | SER | A | 191 | 3.297 | 29.364 | 17.433 | 1.00 | 48.29 | N |
| ATOM | 1435 | CA | SER | A | 191 | 3.581 | 30.147 | 16.231 | 1.00 | 50.08 | C |
| ATOM | 1436 | C | SER | A | 191 | 5.068 | 30.440 | 16.074 | 1.00 | 50.39 | C |
| ATOM | 1437 | O | SER | A | 191 | 5.585 | 30.495 | 14.959 | 1.00 | 44.82 | O |
| ATOM | 1438 | CB | SER | A | 191 | 2.802 | 31.463 | 16.249 | 1.00 | 57.90 | C |
| ATOM | 1439 | OG | SER | A | 191 | 1.415 | 31.239 | 16.078 | 1.00 | 74.28 | O |
| ATOM | 1440 | N | SER | A | 192 | 5.753 | 30.618 | 17.200 | 1.00 | 46.04 | N |

TABLE 10.2-continued

| ATOM | 1441 | CA | SER | A | 192 | 7.169 | 30.965 | 17.193 | 1.00 | 48.53 | C |
| ATOM | 1442 | C | SER | A | 192 | 8.062 | 29.808 | 16.739 | 1.00 | 53.82 | C |
| ATOM | 1443 | O | SER | A | 192 | 9.241 | 30.009 | 16.445 | 1.00 | 58.88 | O |
| ATOM | 1444 | CB | SER | A | 192 | 7.598 | 31.447 | 18.582 | 1.00 | 52.00 | C |
| ATOM | 1445 | OG | SER | A | 192 | 7.184 | 30.541 | 19.592 | 1.00 | 49.57 | O |
| ATOM | 1446 | N | SER | A | 193 | 7.507 | 28.601 | 16.671 | 1.00 | 54.17 | N |
| ATOM | 1447 | CA | SER | A | 193 | 8.299 | 27.443 | 16.260 | 1.00 | 50.73 | C |
| ATOM | 1448 | C | SER | A | 193 | 8.291 | 27.260 | 14.741 | 1.00 | 50.16 | C |
| ATOM | 1449 | O | SER | A | 193 | 9.128 | 26.541 | 14.197 | 1.00 | 53.54 | O |
| ATOM | 1450 | CB | SER | A | 193 | 7.795 | 26.168 | 36.944 | 1.00 | 44.93 | C |
| ATOM | 1451 | OG | SER | A | 193 | 6.626 | 25.670 | 16.317 | 1.00 | 46.77 | O |
| ATOM | 1452 | N | LEU | A | 194 | 7.349 | 27.907 | 14.060 | 1.00 | 45.24 | N |
| ATOM | 1453 | CA | LEU | A | 194 | 7.292 | 27.842 | 12.602 | 1.00 | 46.01 | C |
| ATOM | 1454 | C | LEU | A | 194 | 8.520 | 28.519 | 12.007 | 1.00 | 55.53 | C |
| ATOM | 1455 | O | LEU | A | 194 | 8.857 | 29.643 | 12.376 | 1.00 | 62.86 | O |
| ATOM | 1456 | CB | LEU | A | 194 | 6.021 | 28.502 | 12.073 | 1.00 | 39.49 | C |
| ATOM | 1457 | CG | LEU | A | 194 | 4.678 | 28.001 | 12.599 | 1.00 | 46.53 | C |
| ATOM | 1458 | CD1 | LEU | A | 194 | 3.550 | 28.840 | 12.024 | 1.00 | 43.35 | C |
| ATOM | 1459 | CD2 | LEU | A | 194 | 4.476 | 26.535 | 12.261 | 1.00 | 44.15 | C |
| ATOM | 1460 | N | GLY | A | 195 | 9.195 | 27.832 | 11.091 | 1.00 | 59.38 | N |
| ATOM | 1461 | CA | GLY | A | 195 | 10.422 | 28.355 | 10.519 | 1.00 | 62.95 | C |
| ATOM | 1462 | C | GLY | A | 195 | 11.653 | 27.847 | 11.246 | 1.00 | 59.76 | C |
| ATOM | 1463 | O | GLY | A | 195 | 12.729 | 27.733 | 10.660 | 1.00 | 64.18 | O |
| ATOM | 1464 | N | THR | A | 196 | 11.493 | 27.540 | 12.529 | 1.00 | 59.45 | N |
| ATOM | 1465 | CA | THR | A | 196 | 12.570 | 26.958 | 13.320 | 1.00 | 58.51 | C |
| ATOM | 1466 | C | THR | A | 196 | 12.448 | 25.434 | 13.387 | 1.00 | 60.43 | C |
| ATOM | 1467 | O | THR | A | 196 | 13.414 | 24.713 | 13.138 | 1.00 | 61.86 | O |
| ATOM | 1468 | CB | THR | A | 196 | 12.583 | 27.522 | 14.754 | 1.00 | 61.27 | C |
| ATOM | 1469 | CG2 | THR | A | 196 | 13.706 | 26.891 | 15.568 | 1.00 | 57.43 | C |
| ATOM | 1470 | OG1 | THR | A | 196 | 12.767 | 28.942 | 14.708 | 1.00 | 68.83 | O |
| ATOM | 1471 | N | GLN | A | 197 | 11.254 | 24.954 | 13.725 | 1.00 | 49.07 | N |
| ATOM | 1472 | CA | GLN | A | 197 | 11.009 | 23.525 | 13.894 | 1.00 | 41.26 | C |
| ATOM | 1473 | C | GLN | A | 197 | 10.473 | 22.872 | 12.619 | 1.00 | 42.46 | C |
| ATOM | 1474 | O | GLN | A | 197 | 9.577 | 23.400 | 11.963 | 1.00 | 40.55 | O |
| ATOM | 1475 | CB | GLN | A | 197 | 10.030 | 23.290 | 15.049 | 1.00 | 44.12 | C |
| ATOM | 1476 | CG | GLN | A | 197 | 9.629 | 21.833 | 15.242 | 1.00 | 47.27 | C |
| ATOM | 1477 | CD | GLN | A | 197 | 10.769 | 20.968 | 15.751 | 1.00 | 57.04 | C |
| ATOM | 1478 | NE2 | GLN | A | 197 | 10.939 | 19.790 | 15.150 | 1.00 | 43.31 | N |
| ATOM | 1479 | OE1 | GLN | A | 197 | 11.490 | 21.354 | 16.673 | 1.00 | 51.73 | O |
| ATOM | 1480 | N | THR | A | 198 | 11.034 | 21.719 | 12.273 | 1.00 | 41.32 | N |
| ATOM | 1481 | CA | THR | A | 198 | 10.577 | 20.958 | 11.121 | 1.00 | 35.03 | C |
| ATOM | 1482 | C | THR | A | 198 | 9.365 | 20.113 | 11.502 | 1.00 | 36.05 | C |
| ATOM | 1483 | O | THR | A | 198 | 9.359 | 19.468 | 12.550 | 1.00 | 35.98 | O |
| ATOM | 1484 | CB | THR | A | 198 | 11.705 | 20.058 | 10.565 | 1.00 | 33.49 | C |
| ATOM | 1485 | CG2 | THR | A | 198 | 11.153 | 19.010 | 9.620 | 1.00 | 33.33 | C |
| ATOM | 1486 | OG1 | THR | A | 198 | 12.644 | 20.870 | 9.848 | 1.00 | 47.14 | O |
| ATOM | 1487 | N | TYR | A | 199 | 8.334 | 20.141 | 10.660 | 1.00 | 34.82 | N |
| ATOM | 1488 | CA | TYR | A | 199 | 7.135 | 19.338 | 10.882 | 1.00 | 33.85 | C |
| ATOM | 1489 | C | TYR | A | 199 | 6.877 | 18.409 | 9.704 | 1.00 | 31.69 | C |
| ATOM | 1490 | O | TYR | A | 199 | 6.644 | 18.859 | 8.582 | 1.00 | 34.22 | O |
| ATOM | 1491 | CB | TYR | A | 199 | 5.924 | 20.238 | 11.129 | 1.00 | 28.42 | C |
| ATOM | 1492 | CG | TYR | A | 199 | 6.043 | 21.030 | 12.407 | 1.00 | 33.72 | C |
| ATOM | 1493 | CD1 | TYR | A | 199 | 5.935 | 20.405 | 13.640 | 1.00 | 27.74 | C |
| ATOM | 1494 | CD2 | TYR | A | 199 | 6.288 | 22.398 | 12.385 | 1.00 | 27.12 | C |
| ATOM | 1495 | CE1 | TYR | A | 199 | 6.058 | 21.120 | 14.822 | 1.00 | 37.15 | C |
| ATOM | 1496 | CE2 | TYR | A | 199 | 6.412 | 23.122 | 13.561 | 1.00 | 35.98 | C |
| ATOM | 1497 | CZ | TYR | A | 199 | 6.294 | 22.477 | 14.776 | 1.00 | 33.49 | C |
| ATOM | 1498 | OH | TYR | A | 199 | 6.414 | 23.184 | 15.948 | 1.00 | 40.19 | O |
| ATOM | 1499 | N | ILE | A | 200 | 6.935 | 17.108 | 9.969 | 1.00 | 30.26 | N |
| ATOM | 1500 | CA | ILE | A | 200 | 6.768 | 16.097 | 8.933 | 1.00 | 31.27 | C |
| ATOM | 1501 | C | ILE | A | 200 | 5.710 | 15.089 | 9.347 | 1.00 | 33.53 | C |
| ATOM | 1502 | O | ILE | A | 200 | 5.768 | 14.546 | 10.452 | 1.00 | 32.98 | O |
| ATOM | 1503 | CB | ILE | A | 200 | 8.093 | 15.352 | 8.644 | 1.00 | 32.27 | C |
| ATOM | 1504 | CG1 | ILE | A | 200 | 9.164 | 16.333 | 8.160 | 1.00 | 37.70 | C |
| ATOM | 1505 | CG2 | ILE | A | 200 | 7.880 | 14.236 | 7.619 | 1.00 | 26.84 | C |
| ATOM | 1506 | CD1 | ILE | A | 200 | 10.495 | 15.689 | 7.860 | 1.00 | 36.87 | C |
| ATOM | 1507 | N | CYS | A | 201 | 4.739 | 14.842 | 8.470 | 1.00 | 28.73 | N |
| ATOM | 1508 | CA | CYS | A | 201 | 3.747 | 13.812 | 8.746 | 1.00 | 31.40 | C |
| ATOM | 1509 | C | CYS | A | 201 | 4.129 | 12.523 | 8.032 | 1.00 | 31.76 | C |
| ATOM | 1510 | O | CYS | A | 201 | 4.442 | 12.518 | 6.837 | 1.00 | 30.36 | O |
| ATOM | 1511 | CB | CYS | A | 201 | 2.338 | 14.264 | 8.341 | 1.00 | 29.40 | C |
| ATOM | 1512 | SG | CYS | A | 201 | 1.974 | 14.198 | 6.581 | 1.00 | 46.24 | S |
| ATOM | 1513 | N | ASN | A | 202 | 4.123 | 11.434 | 8.788 | 1.00 | 32.10 | N |
| ATOM | 1514 | CA | ASN | A | 202 | 4.479 | 10.126 | 8.262 | 1.00 | 32.09 | C |
| ATOM | 1515 | C | ASN | A | 202 | 3.216 | 9.332 | 7.990 | 1.00 | 30.31 | C |
| ATOM | 1516 | O | ASN | A | 202 | 2.476 | 8.990 | 8.908 | 1.00 | 34.67 | O |
| ATOM | 1517 | CB | ASN | A | 202 | 5.384 | 9.380 | 9.243 | 1.00 | 31.62 | C |
| ATOM | 1518 | CG | ASN | A | 202 | 6.445 | 10.276 | 9.849 | 1.00 | 34.57 | C |
| ATOM | 1519 | ND2 | ASN | A | 202 | 7.425 | 10.661 | 9.041 | 1.00 | 31.78 | N |
| ATOM | 1520 | OD1 | ASN | A | 202 | 6.382 | 10.621 | 11.030 | 1.00 | 37.73 | O |

TABLE 10.2-continued

| | | | | | | | | | | |
|---|---|---|---|---|---|---|---|---|---|---|
| ATOM | 1521 | N | VAL | A | 203 | 2.958 | 9.057 | 6.722 | 1.00 | 31.29 | N |
| ATOM | 1522 | CA | VAL | A | 203 | 1.730 | 8.384 | 6.341 | 1.00 | 29.99 | C |
| ATOM | 1523 | C | VAL | A | 203 | 2.037 | 6.982 | 5.860 | 1.00 | 29.95 | C |
| ATOM | 1524 | O | VAL | A | 203 | 2.962 | 6.775 | 5.079 | 1.00 | 32.94 | O |
| ATOM | 1525 | CB | VAL | A | 203 | 0.981 | 9.163 | 5.243 | 1.00 | 35.04 | C |
| ATOM | 1526 | CG1 | VAL | A | 203 | −0.314 | 8.459 | 4.876 | 1.00 | 28.65 | C |
| ATOM | 1527 | CG2 | VAL | A | 203 | 0.710 | 10.592 | 5.707 | 1.00 | 26.66 | C |
| ATOM | 1528 | N | ASN | A | 204 | 1.264 | 6.019 | 6.345 | 1.00 | 29.35 | N |
| ATOM | 1529 | CA | ASN | A | 204 | 1.449 | 4.631 | 5.961 | 1.00 | 31.31 | C |
| ATOM | 1530 | C | ASN | A | 204 | 0.127 | 4.003 | 5.525 | 1.00 | 33.24 | C |
| ATOM | 1531 | O | ASN | A | 204 | −0.888 | 4.112 | 6.214 | 1.00 | 34.37 | O |
| ATOM | 1532 | CB | ASN | A | 204 | 2.073 | 3.843 | 7.117 | 1.00 | 37.45 | C |
| ATOM | 1533 | CG | ASN | A | 204 | 2.259 | 2.373 | 6.789 | 1.00 | 54.72 | C |
| ATOM | 1534 | ND2 | ASN | A | 204 | 3.039 | 2.091 | 5.754 | 1.00 | 50.83 | N |
| ATOM | 1535 | OD1 | ASN | A | 204 | 1.698 | 1.501 | 7.455 | 1.00 | 73.44 | O |
| ATOM | 1536 | N | HIS | A | 205 | 0.141 | 3.373 | 4.358 | 1.00 | 31.18 | N |
| ATOM | 1537 | CA | HIS | A | 205 | −1.028 | 2.675 | 3.844 | 1.00 | 37.56 | C |
| ATOM | 1538 | C | HIS | A | 205 | −0.605 | 1.286 | 3.413 | 1.00 | 34.89 | C |
| ATOM | 1539 | O | HIS | A | 205 | −0.256 | 1.068 | 2.253 | 1.00 | 36.52 | O |
| ATOM | 1540 | CB | HIS | A | 205 | −1.658 | 3.433 | 2.675 | 1.00 | 27.77 | C |
| ATOM | 1541 | CG | HIS | A | 205 | −2.917 | 2.803 | 2.155 | 1.00 | 35.56 | C |
| ATOM | 1542 | CD2 | HIS | A | 205 | −4.104 | 2.562 | 2.753 | 1.00 | 33.13 | C |
| ATOM | 1543 | ND1 | HIS | A | 205 | −3.037 | 2.344 | 0.859 | 1.00 | 35.44 | N |
| ATOM | 1544 | CE1 | HIS | A | 205 | −4.248 | 1.846 | 0.686 | 1.00 | 33.94 | C |
| ATOM | 1545 | NE2 | HIS | A | 205 | −4.919 | 1.967 | 1.815 | 1.00 | 29.56 | N |
| ATOM | 1546 | N | LYS | A | 206 | −0.623 | 0.353 | 4.358 | 1.00 | 34.52 | N |
| ATOM | 1547 | CA | LYS | A | 206 | −0.155 | −1.008 | 4.104 | 1.00 | 41.43 | C |
| ATOM | 1548 | C | LYS | A | 206 | −0.833 | −1.754 | 2.942 | 1.00 | 35.74 | C |
| ATOM | 1549 | O | LYS | A | 206 | −0.155 | −2.493 | 2.231 | 1.00 | 39.67 | O |
| ATOM | 1550 | CB | LYS | A | 206 | −0.277 | −1.846 | 5.379 | 1.00 | 47.00 | C |
| ATOM | 1551 | CG | LYS | A | 206 | 0.830 | −1.575 | 6.386 | 1.00 | 57.13 | C |
| ATOM | 1552 | CD | LYS | A | 206 | 0.895 | −2.659 | 7.452 | 1.00 | 81.12 | C |
| ATOM | 1553 | CE | LYS | A | 206 | 2.103 | −2.473 | 8.361 | 1.00 | 81.79 | C |
| ATOM | 1554 | NZ | LYS | A | 206 | 2.106 | −1.138 | 9.024 | 1.00 | 63.36 | N |
| ATOM | 1555 | N | PRO | A | 207 | −2.158 | −1.589 | 2.748 | 1.00 | 37.38 | N |
| ATOM | 1556 | CA | PRO | A | 207 | −2.759 | −2.328 | 1.624 | 1.00 | 32.27 | C |
| ATOM | 1557 | C | PRO | A | 207 | −2.137 | −2.030 | 0.252 | 1.00 | 38.84 | C |
| ATOM | 1558 | O | PRO | A | 207 | −2.064 | −2.930 | −0.578 | 1.00 | 37.23 | O |
| ATOM | 1559 | CB | PRO | A | 207 | −4.218 | −1.876 | 1.655 | 1.00 | 34.91 | C |
| ATOM | 1560 | CG | PRO | A | 207 | −4.471 | −1.559 | 3.085 | 1.00 | 40.39 | C |
| ATOM | 1561 | CD | PRO | A | 207 | −3.192 | −0.955 | 3.590 | 1.00 | 32.89 | C |
| ATOM | 1562 | N | SER | A | 208 | −1.696 | −0.797 | 0.020 | 1.00 | 38.69 | N |
| ATOM | 1563 | CA | SER | A | 208 | −1.064 | −0.446 | −1.250 | 1.00 | 34.52 | C |
| ATOM | 1564 | C | SER | A | 208 | 0.454 | −0.414 | −1.115 | 1.00 | 40.84 | C |
| ATOM | 1565 | O | SER | A | 208 | 1.157 | −0.044 | −2.056 | 1.00 | 41.36 | O |
| ATOM | 1566 | CB | SER | A | 208 | −1.565 | 0.911 | −1.751 | 1.00 | 37.36 | C |
| ATOM | 1567 | OG | SER | A | 208 | −1.111 | 1.961 | −0.912 | 1.00 | 32.83 | O |
| ATOM | 1568 | N | ASN | A | 209 | 0.942 | −0.792 | 0.065 | 1.00 | 38.90 | N |
| ATOM | 1569 | CA | ASN | A | 209 | 2.367 | −0.729 | 0.389 | 1.00 | 42.99 | C |
| ATOM | 1570 | C | ASN | A | 209 | 2.941 | 0.680 | 0.177 | 1.00 | 43.61 | C |
| ATOM | 1571 | O | ASN | A | 209 | 4.051 | 0.841 | −0.327 | 1.00 | 47.92 | O |
| ATOM | 1572 | CB | ASN | A | 209 | 3.147 | −1.756 | −0.441 | 1.00 | 48.09 | C |
| ATOM | 1573 | CG | ASN | A | 209 | 4.502 | −2.086 | 0.159 | 1.00 | 71.77 | C |
| ATOM | 1574 | ND2 | ASN | A | 209 | 5.502 | −2.260 | −0.700 | 1.00 | 76.92 | N |
| ATOM | 1575 | OD1 | ASN | A | 209 | 4.649 | −2.177 | 1.379 | 1.00 | 76.40 | O |
| ATOM | 1576 | N | THR | A | 210 | 2.174 | 1.692 | 0.575 | 1.00 | 40.46 | N |
| ATOM | 1577 | CA | THR | A | 210 | 2.546 | 3.090 | 0.371 | 1.00 | 38.21 | C |
| ATOM | 1578 | C | THR | A | 210 | 3.020 | 3.766 | 1.656 | 1.00 | 38.99 | C |
| ATOM | 1579 | O | THR | A | 210 | 2.320 | 3.746 | 2.670 | 1.00 | 38.40 | O |
| ATOM | 1580 | CB | THR | A | 210 | 1.361 | 3.901 | −0.200 | 1.00 | 38.96 | C |
| ATOM | 1581 | CG2 | THR | A | 210 | 1.720 | 5.376 | −0.316 | 1.00 | 37.56 | C |
| ATOM | 1582 | OG1 | THR | A | 210 | 1.006 | 3.395 | −1.494 | 1.00 | 42.32 | O |
| ATOM | 1583 | N | LYS | A | 211 | 4.214 | 4.353 | 1.607 | 1.00 | 32.28 | N |
| ATOM | 1584 | CA | LYS | A | 211 | 4.716 | 5.195 | 2.693 | 1.00 | 35.66 | C |
| ATOM | 1585 | C | LYS | A | 211 | 5.072 | 6.573 | 2.155 | 1.00 | 33.89 | C |
| ATOM | 1586 | O | LYS | A | 211 | 5.786 | 6.698 | 1.158 | 1.00 | 32.27 | O |
| ATOM | 1587 | CB | LYS | A | 211 | 5.940 | 4.569 | 3.370 | 1.00 | 36.77 | C |
| ATOM | 1588 | CG | LYS | A | 211 | 5.624 | 3.421 | 4.316 | 1.00 | 45.64 | C |
| ATOM | 1589 | CD | LYS | A | 211 | 6.864 | 2.974 | 5.086 | 1.00 | 52.89 | C |
| ATOM | 1590 | CE | LYS | A | 211 | 7.970 | 2.513 | 4.143 | 1.00 | 58.66 | C |
| ATOM | 1591 | NZ | LYS | A | 211 | 9.223 | 2.152 | 4.870 | 1.00 | 61.89 | N |
| ATOM | 1592 | N | VAL | A | 212 | 4.564 | 7.608 | 2.811 | 1.00 | 27.70 | N |
| ATOM | 1593 | CA | VAL | A | 212 | 4.861 | 8.978 | 2.416 | 1.00 | 34.14 | C |
| ATOM | 1594 | C | VAL | A | 212 | 5.294 | 9.800 | 3.623 | 1.00 | 33.04 | C |
| ATOM | 1595 | O | VAL | A | 212 | 4.657 | 9.748 | 4.677 | 1.00 | 34.67 | O |
| ATOM | 1596 | CB | VAL | A | 212 | 3.640 | 9.659 | 1.741 | 1.00 | 28.22 | C |
| ATOM | 1597 | CG1 | VAL | A | 212 | 3.944 | 11.111 | 1.424 | 1.00 | 26.60 | C |
| ATOM | 1598 | CG2 | VAL | A | 212 | 3.236 | 8.911 | 0.475 | 1.00 | 33.62 | C |
| ATOM | 1599 | N | ASP | A | 213 | 6.387 | 10.544 | 3.469 | 1.00 | 31.96 | N |
| ATOM | 1600 | CA | ASP | A | 213 | 6.802 | 11.535 | 4.460 | 1.00 | 31.89 | C |

TABLE 10.2-continued

| | | | | | | | | | | |
|---|---|---|---|---|---|---|---|---|---|---|
| ATOM | 1601 | C | ASP | A | 213 | 6.622 | 12.935 | 3.886 | 1.00 | 34.24 | C |
| ATOM | 1602 | O | ASP | A | 213 | 7.286 | 13.306 | 2.918 | 1.00 | 32.65 | O |
| ATOM | 1603 | CB | ASP | A | 213 | 8.258 | 11.323 | 4.883 | 1.00 | 35.66 | C |
| ATOM | 1604 | CG | ASP | A | 213 | 8.479 | 9.985 | 5.572 | 1.00 | 47.44 | C |
| ATOM | 1605 | OD1 | ASP | A | 213 | 7.659 | 9.616 | 6.445 | 1.00 | 42.96 | O |
| ATOM | 1606 | OD2 | ASP | A | 213 | 9.475 | 9.302 | 5.238 | 1.00 | 43.88 | O |
| ATOM | 1607 | N | LYS | A | 214 | 5.728 | 13.708 | 4.492 | 1.00 | 33.17 | N |
| ATOM | 1608 | CA | LYS | A | 214 | 5.361 | 15.016 | 3.967 | 1.00 | 30.01 | C |
| ATOM | 1609 | C | LYS | A | 214 | 5.791 | 16.138 | 4.906 | 1.00 | 30.73 | C |
| ATOM | 1610 | O | LYS | A | 214 | 5.254 | 16.286 | 6.004 | 1.00 | 29.64 | O |
| ATOM | 1611 | CB | LYS | A | 214 | 3.849 | 15.082 | 3.727 | 1.00 | 28.75 | C |
| ATOM | 1612 | CG | LYS | A | 214 | 3.356 | 16.407 | 3.174 | 1.00 | 34.59 | C |
| ATOM | 1613 | CD | LYS | A | 214 | 3.879 | 16.624 | 1.767 | 1.00 | 33.64 | C |
| ATOM | 1614 | CE | LYS | A | 214 | 3.468 | 17.978 | 1.222 | 1.00 | 44.70 | C |
| ATOM | 1615 | NZ | LYS | A | 214 | 4.102 | 18.251 | −0.100 | 1.00 | 46.18 | N |
| ATOM | 1616 | N | LYS | A | 215 | 6.760 | 16.932 | 4.469 | 1.00 | 31.30 | N |
| ATOM | 1617 | CA | LYS | A | 215 | 7.181 | 18.086 | 5.247 | 1.00 | 29.47 | C |
| ATOM | 1618 | C | LYS | A | 215 | 6.197 | 19.230 | 5.031 | 1.00 | 34.25 | C |
| ATOM | 1619 | O | LYS | A | 215 | 5.887 | 19.587 | 3.895 | 1.00 | 30.95 | O |
| ATOM | 1620 | CB | LYS | A | 215 | 8.597 | 18.521 | 4.870 | 1.00 | 32.87 | C |
| ATOM | 1621 | CG | LYS | A | 215 | 9.076 | 19.731 | 5.657 | 1.00 | 32.92 | C |
| ATOM | 1622 | CD | LYS | A | 215 | 10.523 | 20.071 | 5.351 | 1.00 | 42.60 | C |
| ATOM | 1623 | CE | LYS | A | 215 | 10.950 | 21.339 | 6.087 | 1.00 | 41.79 | C |
| ATOM | 1624 | NZ | LYS | A | 215 | 12.411 | 21.587 | 5.969 | 1.00 | 52.69 | N |
| ATOM | 1625 | N | VAL | A | 216 | 5.697 | 19.798 | 6.121 | 1.00 | 27.91 | N |
| ATOM | 1626 | CA | VAL | A | 216 | 4.736 | 20.883 | 6.011 | 1.00 | 31.50 | C |
| ATOM | 1627 | C | VAL | A | 216 | 5.346 | 22.189 | 6.512 | 1.00 | 35.76 | C |
| ATOM | 1628 | O | VAL | A | 216 | 5.803 | 22.282 | 7.654 | 1.00 | 31.10 | O |
| ATOM | 1629 | CB | VAL | A | 216 | 3.443 | 20.567 | 6.782 | 1.00 | 32.04 | C |
| ATOM | 1630 | CG1 | VAL | A | 216 | 2.447 | 21.716 | 6.650 | 1.00 | 29.56 | C |
| ATOM | 1631 | CG2 | VAL | A | 216 | 2.833 | 19.265 | 6.271 | 1.00 | 28.39 | C |
| ATOM | 1632 | N | GLU | A | 217 | 5.357 | 23.187 | 5.634 | 1.00 | 39.92 | N |
| ATOM | 1633 | CA | GLU | A | 217 | 5.937 | 24.497 | 5.924 | 1.00 | 46.47 | C |
| ATOM | 1634 | C | GLU | A | 217 | 4.917 | 25.604 | 5.714 | 1.00 | 44.08 | C |
| ATOM | 1635 | O | GLU | A | 217 | 3.980 | 25.443 | 4.933 | 1.00 | 41.16 | O |
| ATOM | 1636 | CB | GLU | A | 217 | 7.149 | 24.764 | 5.026 | 1.00 | 44.32 | C |
| ATOM | 1637 | CG | GLU | A | 217 | 8.396 | 23.976 | 5.365 | 1.00 | 58.93 | C |
| ATOM | 1638 | CD | GLU | A | 217 | 9.501 | 24.188 | 4.344 | 1.00 | 64.34 | C |
| ATOM | 1639 | OE1 | GLU | A | 217 | 10.678 | 24.300 | 4.750 | 1.00 | 75.54 | O |
| ATOM | 1640 | OE2 | GLU | A | 217 | 9.192 | 24.239 | 3.135 | 1.00 | 64.80 | O |
| ATOM | 1641 | N | PRO | A | 218 | 5.099 | 26.740 | 6.406 | 1.00 | 48.25 | N |
| ATOM | 1642 | CA | PRO | A | 218 | 4.315 | 27.925 | 6.039 | 1.00 | 50.69 | C |
| ATOM | 1643 | C | PRO | A | 218 | 4.667 | 28.339 | 4.615 | 1.00 | 57.06 | C |
| ATOM | 1644 | O | PRO | A | 218 | 5.822 | 28.177 | 4.218 | 1.00 | 55.63 | O |
| ATOM | 1645 | CB | PRO | A | 218 | 4.757 | 28.979 | 7.060 | 1.00 | 50.18 | C |
| ATOM | 1646 | CG | PRO | A | 218 | 6.087 | 28.500 | 7.561 | 1.00 | 50.76 | C |
| ATOM | 1647 | CD | PRO | A | 218 | 6.027 | 27.005 | 7.521 | 1.00 | 42.82 | C |
| ATOM | 1648 | N | LYS | A | 219 | 3.703 | 28.834 | 3.846 | 1.00 | 55.24 | N |
| ATOM | 1649 | CA | LYS | A | 219 | 3.998 | 29.214 | 2.468 | 1.00 | 72.58 | C |
| ATOM | 1650 | C | LYS | A | 219 | 4.426 | 30.679 | 2.392 | 1.00 | 77.04 | C |
| ATOM | 1651 | O | LYS | A | 219 | 3.946 | 31.522 | 3.156 | 1.00 | 71.74 | O |
| ATOM | 1652 | CB | LYS | A | 219 | 2.796 | 28.952 | 1.553 | 1.00 | 66.67 | C |
| ATOM | 1653 | CG | LYS | A | 219 | 3.147 | 29.002 | 0.068 | 1.00 | 73.26 | C |
| ATOM | 1654 | CD | LYS | A | 219 | 2.190 | 28.182 | −0.790 | 1.00 | 78.60 | C |
| ATOM | 1655 | CE | LYS | A | 219 | 0.862 | 28.890 | −1.001 | 1.00 | 76.20 | C |
| ATOM | 1656 | NZ | LYS | A | 219 | 0.010 | 28.168 | −1.992 | 1.00 | 70.66 | N |
| ATOM | 1657 | N | SER | A | 220 | 5.346 | 30.969 | 1.477 | 1.00 | 78.80 | N |
| ATOM | 1658 | CA | SER | A | 220 | 5.870 | 32.319 | 1.306 | 1.00 | 86.14 | C |
| ATOM | 1659 | C | SER | A | 220 | 5.245 | 33.004 | 0.096 | 1.00 | 76.66 | C |
| ATOM | 1660 | O | SER | A | 220 | 4.778 | 32.339 | −0.829 | 1.00 | 76.17 | O |
| ATOM | 1661 | CB | SER | A | 220 | 7.394 | 32.284 | 1.164 | 1.00 | 88.61 | C |
| ATOM | 1662 | OG | SER | A | 220 | 7.787 | 31.375 | 0.150 | 1.00 | 79.58 | O |
| ATOM | 1663 | N | ASP | B | 1 | −30.071 | −19.770 | 21.044 | 1.00 | 55.86 | N |
| ATOM | 1664 | CA | ASP | B | 1 | −28.959 | −18.907 | 21.429 | 1.00 | 51.10 | C |
| ATOM | 1665 | C | ASP | B | 1 | −29.427 | −17.792 | 22.359 | 1.00 | 49.42 | C |
| ATOM | 1666 | O | ASP | B | 1 | −30.475 | −17.185 | 22.139 | 1.00 | 43.10 | O |
| ATOM | 1667 | CB | ASP | B | 1 | −28.287 | −18.316 | 20.190 | 1.00 | 44.13 | C |
| ATOM | 1668 | CG | ASP | B | 1 | −27.652 | −19.377 | 19.308 | 1.00 | 61.47 | C |
| ATOM | 1669 | OD2 | ASP | B | 1 | −26.859 | −19.009 | 18.415 | 1.00 | 60.15 | O |
| ATOM | 1670 | OD1 | ASP | B | 1 | −27.951 | −20.577 | 19.503 | 1.00 | 63.76 | O |
| ATOM | 1671 | N | ILE | B | 2 | −28.649 | −17.533 | 23.404 | 1.00 | 43.87 | N |
| ATOM | 1672 | CA | ILE | B | 2 | −29.004 | −16.506 | 24.372 | 1.00 | 42.91 | C |
| ATOM | 1673 | C | ILE | B | 2 | −28.769 | −15.115 | 23.794 | 1.00 | 45.05 | C |
| ATOM | 1674 | O | ILE | B | 2 | −27.663 | −14.787 | 23.359 | 1.00 | 46.40 | O |
| ATOM | 1675 | CB | ILE | B | 2 | −28.207 | −16.666 | 25.675 | 1.00 | 39.78 | C |
| ATOM | 1676 | CG1 | ILE | B | 2 | −28.476 | −18.041 | 26.288 | 1.00 | 37.36 | C |
| ATOM | 1677 | CG2 | ILE | B | 2 | −28.563 | −15.558 | 26.659 | 1.00 | 35.94 | C |
| ATOM | 1678 | CD1 | ILE | B | 2 | −27.665 | −18.321 | 27.537 | 1.00 | 32.11 | C |
| ATOM | 1679 | N | VAL | B | 3 | −29.824 | −14.306 | 23.783 | 1.00 | 41.92 | N |
| ATOM | 1680 | CA | VAL | B | 3 | −29.759 | −12.953 | 23.249 | 1.00 | 38.55 | C |

TABLE 10.2-continued

| | | | | | | | | | |
|---|---|---|---|---|---|---|---|---|---|
| ATOM | 1681 | C | VAL | B | 3 | −29.539 | −11.943 | 24.372 | 1.00 | 39.90 | C |
| ATOM | 1682 | O | VAL | B | 3 | −30.258 | −11.945 | 25.372 | 1.00 | 40.51 | O |
| ATOM | 1683 | CB | VAL | B | 3 | −31.042 | −12.599 | 22.476 | 1.00 | 39.53 | C |
| ATOM | 1684 | CG1 | VAL | B | 3 | −30.987 | −11.169 | 21.965 | 1.00 | 34.86 | C |
| ATOM | 1685 | CG2 | VAL | B | 3 | −31.241 | −13.570 | 21.324 | 1.00 | 38.27 | C |
| ATOM | 1686 | N | MET | B | 4 | −28.528 | −11.094 | 24.214 | 1.00 | 35.54 | N |
| ATOM | 1687 | CA | MET | B | 4 | −28.248 | −10.063 | 25.208 | 1.00 | 37.31 | C |
| ATOM | 1688 | C | MET | B | 4 | −28.677 | −8.695 | 24.687 | 1.00 | 34.89 | C |
| ATOM | 1689 | O | MET | B | 4 | −28.362 | −8.327 | 23.559 | 1.00 | 35.92 | O |
| ATOM | 1690 | CB | MET | B | 4 | −26.760 | −10.043 | 25.570 | 1.00 | 29.00 | C |
| ATOM | 1691 | CG | MET | B | 4 | −26.173 | −11.410 | 25.886 | 1.00 | 32.64 | C |
| ATOM | 1692 | SD | MET | B | 4 | −26.854 | −12.116 | 27.401 | 1.00 | 36.18 | S |
| ATOM | 1693 | CE | MET | B | 4 | −26.247 | −10.945 | 28.614 | 1.00 | 29.96 | C |
| ATOM | 1694 | N | THR | B | 5 | −29.405 | −7.953 | 25.510 | 1.00 | 36.75 | N |
| ATOM | 1695 | CA | THR | B | 5 | −29.788 | −6.591 | 25.170 | 1.00 | 36.17 | C |
| ATOM | 1696 | C | THR | B | 5 | −29.273 | −5.640 | 26.238 | 1.00 | 38.85 | C |
| ATOM | 1697 | O | THR | B | 5 | −29.080 | −6.029 | 27.392 | 1.00 | 40.10 | O |
| ATOM | 1698 | CB | THR | B | 5 | −31.315 | −6.436 | 25.040 | 1.00 | 33.68 | C |
| ATOM | 1699 | CG2 | THR | B | 5 | −31.853 | −7.309 | 23.910 | 1.00 | 30.80 | C |
| ATOM | 1700 | OG1 | THR | B | 5 | −31.938 | −6.816 | 26.270 | 1.00 | 36.62 | O |
| ATOM | 1701 | N | GLN | B | 6 | −29.038 | −4.394 | 25.848 | 1.00 | 33.36 | N |
| ATOM | 1702 | CA | GLN | B | 6 | −28.602 | −3.376 | 26.788 | 1.00 | 33.06 | C |
| ATOM | 1703 | C | GLN | B | 6 | −29.438 | −2.119 | 26.620 | 1.00 | 31.88 | C |
| ATOM | 1704 | O | GLN | B | 6 | −30.040 | −1.899 | 25.571 | 1.00 | 35.73 | O |
| ATOM | 1705 | CB | GLN | B | 6 | −27.116 | −3.048 | 26.599 | 1.00 | 33.60 | C |
| ATOM | 1706 | CG | GLN | B | 6 | −26.169 | −4.214 | 26.870 | 1.00 | 36.92 | C |
| ATOM | 1707 | CD | GLN | B | 6 | −24.721 | −3.883 | 26.533 | 1.00 | 38.24 | C |
| ATOM | 1708 | NE2 | GLN | B | 6 | −24.272 | −2.702 | 26.941 | 1.00 | 30.52 | N |
| ATOM | 1709 | OE1 | GLN | B | 6 | −24.017 | −4.682 | 25.915 | 1.00 | 36.39 | O |
| ATOM | 1710 | N | SER | B | 7 | −29.470 | −1.302 | 27.665 | 1.00 | 32.38 | N |
| ATOM | 1711 | CA | SER | B | 7 | −30.103 | 0.006 | 27.606 | 1.00 | 37.23 | C |
| ATOM | 1712 | C | SER | B | 7 | −29.416 | 0.933 | 28.601 | 1.00 | 36.04 | C |
| ATOM | 1713 | O | SER | B | 7 | −28.976 | 0.485 | 29.662 | 1.00 | 39.38 | O |
| ATOM | 1714 | CB | SER | B | 7 | −31.602 | −0.096 | 27.901 | 1.00 | 37.67 | C |
| ATOM | 1715 | OG | SER | B | 7 | −31.826 | −0.591 | 29.208 | 1.00 | 50.24 | O |
| ATOM | 1716 | N | PRO | B | 8 | −29.296 | 2.226 | 28.258 | 1.00 | 38.41 | N |
| ATOM | 1717 | CA | PRO | B | 8 | −29.712 | 2.835 | 26.989 | 1.00 | 38.28 | C |
| ATOM | 1718 | C | PRO | B | 8 | −28.708 | 2.568 | 25.872 | 1.00 | 44.42 | C |
| ATOM | 1719 | O | PRO | B | 8 | −27.687 | 1.924 | 26.117 | 1.00 | 41.31 | O |
| ATOM | 1720 | CB | PRO | B | 8 | −29.766 | 4.326 | 27.325 | 1.00 | 41.32 | C |
| ATOM | 1721 | CG | PRO | B | 8 | −28.725 | 4.492 | 28.383 | 1.00 | 37.24 | C |
| ATOM | 1722 | CD | PRO | B | 8 | −28.754 | 3.226 | 29.197 | 1.00 | 31.36 | C |
| ATOM | 1723 | N | ASP | B | 9 | −28.994 | 3.049 | 24.667 | 1.00 | 42.66 | N |
| ATOM | 1724 | CA | ASP | B | 9 | −28.037 | 2.952 | 23.570 | 1.00 | 44.47 | C |
| ATOM | 1725 | C | ASP | B | 9 | −26.850 | 3.863 | 23.842 | 1.00 | 46.92 | C |
| ATOM | 1726 | O | ASP | B | 9 | −25.699 | 3.503 | 23.588 | 1.00 | 38.54 | O |
| ATOM | 1727 | CB | ASP | B | 9 | −28.687 | 3.322 | 22.236 | 1.00 | 44.64 | C |
| ATOM | 1728 | CG | ASP | B | 9 | −29.773 | 2.349 | 21.827 | 1.00 | 70.41 | C |
| ATOM | 1729 | OD1 | ASP | B | 9 | −29.730 | 1.81 | 22.272 | 1.00 | 74.55 | O |
| ATOM | 1730 | OD2 | ASP | B | 9 | −30.671 | 2.753 | 21.057 | 1.00 | 80.56 | O |
| ATOM | 1731 | N | SER | B | 10 | −27.150 | 5.044 | 24.371 | 1.00 | 42.57 | N |
| ATOM | 1732 | CA | SER | B | 10 | −26.146 | 6.061 | 24.628 | 1.00 | 39.96 | C |
| ATOM | 1733 | C | SER | B | 10 | −26.395 | 6.721 | 25.978 | 1.00 | 42.60 | C |
| ATOM | 1734 | O | SER | B | 10 | −27.522 | 6.742 | 26.475 | 1.00 | 43.39 | O |
| ATOM | 1735 | CB | SER | B | 10 | −26.149 | 7.110 | 23.515 | 1.00 | 29.15 | C |
| ATOM | 1736 | OG | SER | B | 10 | −25.012 | 7.943 | 23.611 | 1.00 | 55.37 | O |
| ATOM | 1737 | N | LEU | B | 11 | −25.342 | 7.286 | 26.553 | 1.00 | 38.86 | N |
| ATOM | 1738 | CA | LEU | B | 11 | −25.384 | 7.756 | 27.927 | 1.00 | 39.26 | C |
| ATOM | 1739 | C | LEU | B | 11 | −24.310 | 8.819 | 28.132 | 1.00 | 33.06 | C |
| ATOM | 1740 | O | LEU | B | 11 | −23.172 | 8.636 | 27.709 | 1.00 | 43.59 | O |
| ATOM | 1741 | CB | LEU | B | 11 | −25.186 | 6.564 | 28.875 | 1.00 | 46.93 | C |
| ATOM | 1742 | CG | LEU | B | 11 | −25.354 | 6.653 | 30.391 | 1.00 | 40.86 | C |
| ATOM | 1743 | CD1 | LEU | B | 11 | −24.122 | 7.245 | 31.054 | 1.00 | 49.46 | C |
| ATOM | 1744 | CD2 | LEU | B | 11 | −26.602 | 7.452 | 30.735 | 1.00 | 58.72 | C |
| ATOM | 1745 | N | ALA | B | 12 | −24.668 | 9.930 | 28.768 | 1.00 | 34.90 | N |
| ATOM | 1746 | CA | ALA | B | 12 | −23.695 | 10.979 | 29.078 | 1.00 | 32.04 | C |
| ATOM | 1747 | C | ALA | B | 12 | −23.942 | 11.565 | 30.460 | 1.00 | 35.38 | C |
| ATOM | 1748 | O | ALA | B | 12 | −25.070 | 11.894 | 30.813 | 1.00 | 40.40 | O |
| ATOM | 1749 | CB | ALA | B | 12 | −23.733 | 12.076 | 28.027 | 1.00 | 39.73 | C |
| ATOM | 1750 | N | VAL | B | 13 | −22.874 | 11.709 | 31.235 | 1.00 | 38.02 | N |
| ATOM | 1751 | CA | VAL | B | 13 | −22.987 | 12.114 | 32.629 | 1.00 | 32.52 | C |
| ATOM | 1752 | C | VAL | B | 13 | −21.794 | 12.994 | 33.009 | 1.00 | 41.29 | C |
| ATOM | 1753 | O | VAL | B | 13 | −20.707 | 12.841 | 32.450 | 1.00 | 40.66 | O |
| ATOM | 1754 | CB | VAL | B | 13 | −23.098 | 10.856 | 33.537 | 1.00 | 47.79 | C |
| ATOM | 1755 | CG1 | VAL | B | 13 | −22.187 | 10.934 | 34.752 | 1.00 | 44.21 | C |
| ATOM | 1756 | CG2 | VAL | B | 13 | −24.548 | 10.619 | 33.939 | 1.00 | 43.75 | C |
| ATOM | 1757 | N | SER | B | 14 | −21.999 | 13.933 | 33.931 | 1.00 | 41.23 | N |
| ATOM | 1758 | CA | SER | B | 14 | −20.938 | 14.857 | 34.333 | 1.00 | 36.91 | C |
| ATOM | 1759 | C | SER | B | 14 | −19.862 | 14.158 | 35.162 | 1.00 | 39.93 | C |
| ATOM | 1760 | O | SER | B | 14 | −20.125 | 13.118 | 35.766 | 1.00 | 42.44 | O |

TABLE 10.2-continued

| | | | | | | | | | | |
|---|---|---|---|---|---|---|---|---|---|---|
| ATOM | 1761 | CB | SER | B | 14 | −21.528 | 16.030 | 35.121 | 1.00 | 46.50 | C |
| ATOM | 1762 | OG | SER | B | 14 | −22.570 | 16.660 | 34.393 | 1.00 | 52.97 | O |
| ATOM | 1763 | N | LEU | B | 15 | −18.656 | 14.729 | 35.182 | 1.00 | 35.81 | N |
| ATOM | 1764 | CA | LEU | B | 15 | −17.549 | 14.188 | 35.975 | 1.00 | 41.19 | C |
| ATOM | 1765 | C | LEU | B | 15 | −17.949 | 13.897 | 37.417 | 1.00 | 46.73 | C |
| ATOM | 1766 | O | LEU | B | 15 | −18.711 | 14.651 | 38.022 | 1.00 | 44.31 | O |
| ATOM | 1767 | CB | LEU | B | 15 | −16.356 | 15.148 | 35.990 | 1.00 | 42.78 | C |
| ATOM | 1768 | CG | LEU | B | 15 | −15.368 | 15.192 | 34.825 | 1.00 | 60.55 | C |
| ATOM | 1769 | CD1 | LEU | B | 15 | −15.877 | 16.103 | 33.716 | 1.00 | 58.51 | C |
| ATOM | 1770 | CD2 | LEU | B | 15 | −13.996 | 15.648 | 35.316 | 1.00 | 59.55 | C |
| ATOM | 1771 | N | GLY | B | 16 | −17.431 | 12.800 | 37.960 | 1.00 | 41.51 | N |
| ATOM | 1772 | CA | GLY | B | 16 | −17.639 | 12.466 | 39.355 | 1.00 | 38.32 | C |
| ATOM | 1773 | C | GLY | B | 16 | −19.048 | 12.012 | 39.675 | 1.00 | 37.62 | C |
| ATOM | 1774 | O | GLY | B | 16 | −19.362 | 11.730 | 40.829 | 1.00 | 45.66 | O |
| ATOM | 1775 | N | GLU | B | 17 | −19.902 | 11.938 | 38.661 | 1.00 | 40.92 | N |
| ATOM | 1776 | CA | GLU | B | 17 | −21.273 | 11.496 | 38.876 | 1.00 | 41.65 | C |
| ATOM | 1777 | C | GLU | B | 17 | −21.458 | 10.032 | 38.491 | 1.00 | 45.71 | C |
| ATOM | 1778 | O | GLU | B | 17 | −20.568 | 9.404 | 37.912 | 1.00 | 38.54 | O |
| ATOM | 1779 | CB | GLU | B | 17 | −22.256 | 12.378 | 38.104 | 1.00 | 42.09 | C |
| ATOM | 1780 | CG | GLU | B | 17 | −22.365 | 13.791 | 38.659 | 1.00 | 48.23 | C |
| ATOM | 1781 | CD | GLU | B | 17 | −23.478 | 14.596 | 38.011 | 1.00 | 66.55 | C |
| ATOM | 1782 | OE1 | GLU | B | 17 | −23.909 | 14.234 | 36.894 | 1.00 | 71.11 | O |
| ATOM | 1783 | OE2 | GLU | B | 17 | +23.923 | 15.591 | 38.624 | 1.00 | 74.03 | O |
| ATOM | 1784 | N | ARC | B | 18 | −22.627 | 9.500 | 38.823 | 1.00 | 45.65 | N |
| ATOM | 1785 | CA | ARG | B | 18 | −22.899 | 8.077 | 38.701 | 1.00 | 45.58 | C |
| ATOM | 1786 | C | ARG | B | 18 | −23.508 | 7.729 | 37.346 | 1.00 | 40.92 | C |
| ATOM | 1787 | O | ARG | B | 18 | −24.379 | 8.436 | 36.843 | 1.00 | 38.35 | O |
| ATOM | 1788 | CB | ARG | B | 18 | −23.826 | 7.638 | 39.838 | 1.00 | 43.55 | C |
| ATOM | 1789 | CG | ARG | B | 18 | −24.162 | 6.165 | 39.879 | 1.00 | 54.20 | C |
| ATOM | 1790 | CD | ARG | B | 18 | −24.969 | 5.853 | 41.132 | 1.00 | 66.41 | C |
| ATOM | 1791 | NE | ARG | B | 18 | −25.394 | 4.459 | 41.181 | 1.00 | 84.38 | N |
| ATOM | 1792 | CZ | ARG | B | 18 | −26.076 | 3.921 | 42.186 | 1.00 | 83.62 | C |
| ATOM | 1793 | NH1 | ARG | B | 18 | −26.412 | 4.662 | 43.234 | 1.00 | 81.35 | N |
| ATOM | 1794 | NH2 | ARG | B | 18 | −26.420 | 2.640 | 42.142 | 1.00 | 85.37 | N |
| ATOM | 1795 | N | ALA | B | 19 | −23.030 | 6.643 | 36.751 | 1.00 | 35.20 | N |
| ATOM | 1796 | CA | ALA | B | 19 | −23.584 | 6.161 | 35.491 | 1.00 | 34.46 | C |
| ATOM | 1797 | C | ALA | B | 19 | −23.980 | 4.696 | 35.617 | 1.00 | 39.57 | C |
| ATOM | 1798 | O | ALA | B | 19 | −23.276 | 3.904 | 36.247 | 1.00 | 38.45 | O |
| ATOM | 1799 | CB | ALA | B | 19 | −22.588 | 6.351 | 34.356 | 1.00 | 36.85 | C |
| ATOM | 1800 | N | THR | B | 20 | −25.105 | 4.344 | 35.004 | 1.00 | 33.06 | N |
| ATOM | 1801 | CA | THR | B | 20 | −25.654 | 3.001 | 35.107 | 1.00 | 35.98 | C |
| ATOM | 1802 | C | THR | B | 20 | −26.066 | 2.452 | 33.742 | 1.00 | 38.75 | C |
| ATOM | 1803 | O | THR | B | 20 | −26.762 | 3.118 | 32.979 | 1.00 | 37.55 | O |
| ATOM | 1804 | CB | THR | B | 20 | −26.866 | 2.987 | 36.062 | 1.00 | 38.02 | C |
| ATOM | 1805 | CG2 | THR | B | 20 | −27.718 | 1.757 | 35.842 | 1.00 | 44.22 | C |
| ATOM | 1806 | OG1 | THR | B | 20 | −26.398 | 3.008 | 37.419 | 1.00 | 45.86 | O |
| ATOM | 1807 | N | ILE | B | 21 | −25.622 | 1.235 | 33.441 | 1.00 | 37.58 | N |
| ATOM | 1808 | CA | ILE | B | 21 | −25.973 | 0.559 | 32.196 | 1.00 | 35.14 | C |
| ATOM | 1809 | C | ILE | B | 21 | −26.661 | −0.765 | 32.507 | 1.00 | 37.66 | C |
| ATOM | 1810 | O | ILE | B | 21 | −26.193 | −1.527 | 33.350 | 1.00 | 32.81 | O |
| ATOM | 1811 | CB | ILE | B | 21 | −24.733 | 0.284 | 31.326 | 1.00 | 38.29 | C |
| ATOM | 1812 | CG1 | ILE | B | 21 | −23.964 | 1.573 | 31.057 | 1.00 | 37.46 | C |
| ATOM | 1813 | CG2 | ILE | B | 21 | −25.127 | −0.395 | 30.018 | 1.00 | 45.60 | C |
| ATOM | 1814 | CD1 | ILE | B | 21 | −22.717 | 1.348 | 30.238 | 1.00 | 41.15 | C |
| ATOM | 1815 | N | ASN | B | 22 | −27.761 | −1.046 | 31.819 | 1.00 | 30.24 | N |
| ATOM | 1816 | CA | ASN | B | 22 | −28.521 | −2.260 | 32.084 | 1.00 | 37.10 | C |
| ATOM | 1817 | C | ASN | B | 22 | −28.270 | −3.358 | 31.050 | 1.00 | 40.28 | C |
| ATOM | 1818 | O | ASN | B | 22 | −28.041 | −3.081 | 29.870 | 1.00 | 35.19 | O |
| ATOM | 1819 | CB | ASN | B | 22 | −30.013 | −1.932 | 32.157 | 1.00 | 36.20 | C |
| ATOM | 1820 | CG | ASN | B | 22 | −30.308 | −0.788 | 33.121 | 1.00 | 60.60 | C |
| ATOM | 1821 | OD1 | ASN | B | 22 | −30.309 | −0.974 | 34.341 | 1.00 | 57.11 | O |
| ATOM | 1822 | ND2 | ASN | B | 22 | −30.547 | 0.407 | 32.576 | 1.00 | 55.17 | N |
| ATOM | 1823 | N | CYS | B | 23 | −28.315 | −4.604 | 31.509 | 1.00 | 36.70 | N |
| ATOM | 1824 | CA | CYS | B | 23 | −28.121 | −5.762 | 30.647 | 1.00 | 34.30 | C |
| ATOM | 1825 | C | CYS | B | 23 | −29.231 | −6.791 | 30.872 | 1.00 | 38.13 | C |
| ATOM | 1826 | O | CYS | B | 23 | −29.570 | −7.107 | 32.012 | 1.00 | 40.38 | O |
| ATOM | 1827 | CB | CYS | B | 23 | −26.748 | −6.391 | 30.913 | 1.00 | 37.80 | C |
| ATOM | 1828 | SG | CYS | B | 23 | −26.222 | −7.657 | 29.735 | 1.00 | 53.67 | S |
| ATOM | 1829 | N | LYS | B | 24 | −29.794 | −7.312 | 29.786 | 1.00 | 33.98 | N |
| ATOM | 1830 | CA | LYS | B | 24 | −30.813 | −8.356 | 29.871 | 1.00 | 36.97 | C |
| ATOM | 1831 | C | LYS | B | 24 | −30.440 | −9.564 | 29.024 | 1.00 | 42.52 | C |
| ATOM | 1832 | O | LYS | B | 24 | −29.979 | −9.419 | 27.890 | 1.00 | 38.82 | O |
| ATOM | 1833 | CB | LYS | B | 24 | −32.181 | −7.831 | 29.425 | 1.00 | 43.72 | C |
| ATOM | 1834 | CG | LYS | B | 24 | −33.084 | −7.356 | 30.550 | 1.00 | 55.35 | C |
| ATOM | 1835 | CD | LYS | B | 24 | −34.508 | −7.143 | 30.045 | 1.00 | 61.25 | C |
| ATOM | 1836 | CE | LYS | B | 24 | −35.433 | −6.673 | 31.155 | 1.00 | 65.56 | C |
| ATOM | 1837 | NZ | LYS | B | 24 | −35.055 | −5.323 | 31.656 | 1.00 | 61.27 | N |
| ATOM | 1838 | N | SER | B | 25 | −30.644 | −10.755 | 29.580 | 1.00 | 37.96 | N |
| ATOM | 1839 | CA | SER | B | 25 | −30.438 | −11.991 | 28.835 | 1.00 | 41.49 | C |
| ATOM | 1840 | C | SER | B | 25 | −31.782 | −12.646 | 28.540 | 1.00 | 40.87 | C |

TABLE 10.2-continued

| | | | | | | | | | | |
|---|---|---|---|---|---|---|---|---|---|---|
| ATOM | 1841 | O | SER | B | 25 | −32.677 | −12.640 | 29.379 | 1.00 | 42.24 | O |
| ATOM | 1842 | CB | SER | B | 25 | −29.524 | −12.949 | 29.603 | 1.00 | 33.20 | C |
| ATOM | 1843 | OG | SER | B | 25 | −29.974 | −13.149 | 30.931 | 1.00 | 36.26 | O |
| ATOM | 1844 | N | SER | B | 26 | −31.915 | −13.209 | 27.342 | 1.00 | 38.29 | N |
| ATOM | 1845 | CA | SER | B | 26 | −33.176 | −13.790 | 26.895 | 1.00 | 38.35 | C |
| ATOM | 1846 | C | SER | B | 26 | −33.605 | −14.975 | 27.759 | 1.00 | 43.66 | C |
| ATOM | 1847 | O | SER | B | 26 | −34.760 | −15.394 | 27.720 | 1.00 | 40.54 | O |
| ATOM | 1848 | CB | SER | B | 26 | −33.067 | −14.224 | 25.434 | 1.00 | 35.59 | C |
| ATOM | 1849 | OG | SER | B | 26 | −32.037 | −15.182 | 25.272 | 1.00 | 38.41 | O |
| ATOM | 1850 | N | GLN | B | 27 | −32.66 | −15.519 | 28.527 | 1.00 | 42.85 | N |
| ATOM | 1851 | CA | GLN | B | 27 | −32.979 | −16.560 | 29.498 | 1.00 | 39.30 | C |
| ATOM | 1852 | C | GLN | B | 27 | −32.004 | −16.465 | 30.660 | 1.00 | 43.02 | C |
| ATOM | 1853 | O | GLN | B | 27 | −31.011 | −15.745 | 30.581 | 1.00 | 38.87 | O |
| ATOM | 1854 | CB | GLN | B | 27 | −32.926 | −17.946 | 28.858 | 1.00 | 40.88 | C |
| ATOM | 1855 | CG | GLN | B | 27 | −31.538 | −18.387 | 28.447 | 1.00 | 44.20 | C |
| ATOM | 1856 | CD | GLN | B | 27 | −31.549 | −19.707 | 27.705 | 1.00 | 51.33 | C |
| ATOM | 1857 | NE2 | GLN | B | 27 | −31.158 | −20.776 | 28.393 | 1.00 | 42.28 | N |
| ATOM | 1858 | OE1 | GLN | B | 27 | −31.906 | −19.769 | 26.525 | 1.00 | 47.83 | O |
| ATOM | 1859 | N | SER | B | 28 | −32.291 | −17.187 | 31.738 | 1.00 | 40.20 | N |
| ATOM | 1860 | CA | SER | B | 28 | −31.473 | −17.109 | 32.941 | 1.00 | 36.91 | C |
| ATOM | 1861 | C | SER | B | 28 | −30.065 | −17.631 | 32.699 | 1.00 | 41.10 | C |
| ATOM | 1862 | O | SER | B | 28 | −29.871 | −18.659 | 32.048 | 1.00 | 36.62 | O |
| ATOM | 1863 | CB | SER | B | 28 | −32.120 | −17.889 | 34.087 | 1.00 | 41.70 | C |
| ATOM | 1864 | OG | SER | B | 28 | −31.399 | −17.700 | 35.294 | 1.00 | 42.03 | O |
| ATOM | 1865 | N | ILE | B | 29 | −29.084 | −16.906 | 33.227 | 1.00 | 36.07 | N |
| ATOM | 1866 | CA | ILE | B | 29 | −27.692 | −17.320 | 33.149 | 1.00 | 34.98 | C |
| ATOM | 1867 | C | ILE | B | 29 | −27.143 | −17.474 | 34.565 | 1.00 | 36.30 | C |
| ATOM | 1868 | O | ILE | B | 29 | −25.934 | −17.400 | 34.795 | 1.00 | 34.45 | O |
| ATOM | 1869 | CB | ILE | B | 29 | −26.846 | −16.316 | 32.344 | 1.00 | 31.71 | C |
| ATOM | 1870 | CG1 | ILE | B | 29 | −26.947 | −14.916 | 32.949 | 1.00 | 29.95 | C |
| ATOM | 1871 | CG2 | ILE | B | 29 | −27.310 | −16.276 | 30.898 | 1.00 | 29.61 | C |
| ATOM | 1872 | CD1 | ILE | B | 29 | −26.198 | −13.855 | 32.145 | 1.00 | 31.42 | C |
| ATOM | 1873 | O | LEU | B | 30 | −28.655 | −20.230 | 36.655 | 1.00 | 44.52 | O |
| ATOM | 1874 | N | LEU | B | 30 | −28.058 | −17.672 | 35.508 | 1.00 | 33.91 | N |
| ATOM | 1875 | CA | LEU | B | 30 | −27.709 | −18.044 | 36.873 | 1.00 | 39.31 | C |
| ATOM | 1876 | C | LEU | B | 30 | −27.673 | −19.563 | 36.977 | 1.00 | 38.06 | C |
| ATOM | 1877 | CB | LEU | B | 30 | −28.716 | −17.465 | 37.872 | 1.00 | 37.18 | C |
| ATOM | 1878 | CG | LEU | B | 30 | −28.589 | −17.932 | 39.327 | 1.00 | 39.11 | C |
| ATOM | 1879 | CD2 | LEU | B | 30 | −29.827 | −17.558 | 40.128 | 1.00 | 36.35 | C |
| ATOM | 1880 | CD1 | LEU | B | 30 | −27.331 | −17.378 | 39.987 | 1.00 | 36.12 | C |
| ATOM | 1881 | O | HIS | B | 31 | −26.681 | −21.536 | 39.965 | 1.00 | 38.61 | O |
| ATOM | 1882 | N | HIS | B | 31 | −26.546 | −20.117 | 37.411 | 1.00 | 33.48 | N |
| ATOM | 1883 | CA | HIS | B | 31 | −26.464 | −21.562 | 37.580 | 1.00 | 38.93 | C |
| ATOM | 1884 | C | HIS | B | 31 | −27.113 | −21.968 | 38.897 | 1.00 | 39.33 | C |
| ATOM | 1885 | CB | HIS | B | 31 | −25.018 | −22.046 | 37.533 | 1.00 | 38.09 | C |
| ATOM | 1886 | CG | HIS | B | 31 | −24.889 | −23.538 | 37.446 | 1.00 | 39.11 | C |
| ATOM | 1887 | ND1 | HIS | B | 31 | −24.604 | −24.190 | 36.272 | 1.00 | 42.93 | N |
| ATOM | 1888 | CD2 | HIS | B | 31 | −25.028 | −24.496 | 38.394 | 1.00 | 37.40 | C |
| ATOM | 1889 | CE1 | HIS | B | 31 | −24.560 | −25.497 | 36.497 | 1.00 | 40.76 | C |
| ATOM | 1890 | NE2 | HIS | B | 31 | −24.816 | −25.705 | 37.772 | 1.00 | 41.52 | N |
| ATOM | 1891 | O | SER | B | 32 | −28.568 | −23.745 | 42.260 | 1.00 | 57.25 | O |
| ATOM | 1892 | N | SER | B | 32 | −28.140 | −22.809 | 38.812 | 1.00 | 43.81 | N |
| ATOM | 1893 | CA | SER | B | 32 | −28.969 | −23.149 | 39.972 | 1.00 | 49.61 | C |
| ATOM | 1894 | C | SER | B | 32 | −28.209 | −23.866 | 41.089 | 1.00 | 43.17 | C |
| ATOM | 1895 | CB | SER | B | 32 | −30.159 | −24.004 | 39.530 | 1.00 | 47.25 | C |
| ATOM | 1896 | OG | SER | B | 32 | −29.731 | −25.115 | 38.758 | 1.00 | 56.93 | O |
| ATOM | 1897 | O | SER | B | 33 | −25.191 | −24.612 | 43.655 | 1.00 | 47.19 | O |
| ATOM | 1898 | N | SER | B | 33 | −27.155 | −24.596 | 40.737 | 1.00 | 40.34 | N |
| ATOM | 1899 | CA | SER | B | 33 | −26.407 | −25.373 | 41.729 | 1.00 | 50.61 | C |
| ATOM | 1900 | C | SER | B | 33 | −25.300 | −24.578 | 42.428 | 1.00 | 46.45 | C |
| ATOM | 1901 | CB | SER | B | 33 | −25.807 | −26.621 | 41.079 | 1.00 | 46.34 | C |
| ATOM | 1902 | OG | SER | B | 33 | −26.825 | −27.469 | 40.581 | 1.00 | 54.71 | O |
| ATOM | 1903 | O | ASN | B | 34 | −22.973 | −20.977 | 43.235 | 1.00 | 37.27 | O |
| ATOM | 1904 | N | ASN | B | 34 | −24.470 | −23.875 | 41.661 | 1.00 | 42.95 | N |
| ATOM | 1905 | CA | ASN | B | 34 | −23.365 | −23.137 | 42.269 | 1.00 | 42.26 | C |
| ATOM | 1906 | C | ASN | B | 34 | −23.735 | −21.686 | 42.578 | 1.00 | 34.30 | C |
| ATOM | 1907 | CB | ASN | B | 34 | −22.112 | −23.195 | 41.378 | 1.00 | 39.81 | C |
| ATOM | 1908 | CG | ASN | B | 34 | −22.306 | −22.519 | 40.027 | 1.00 | 38.01 | C |
| ATOM | 1909 | OD1 | ASN | B | 34 | −22.552 | −21.313 | 39.949 | 1.00 | 35.29 | O |
| ATOM | 1910 | ND2 | ASN | B | 34 | −22.163 | −23.292 | 38.952 | 1.00 | 32.57 | N |
| ATOM | 1911 | O | ASN | B | 35 | −24.573 | −17.694 | 42.495 | 1.00 | 38.12 | O |
| ATOM | 1912 | N | ASN | B | 35 | −24.900 | −21.256 | 42.095 | 1.00 | 36.64 | N |
| ATOM | 1913 | CA | ASN | B | 35 | −25.455 | −19.936 | 42.414 | 1.00 | 41.38 | C |
| ATOM | 1914 | C | ASN | B | 35 | −24.612 | −18.762 | 41.888 | 1.00 | 38.67 | C |
| ATOM | 1915 | CB | ASN | B | 35 | −25.650 | −19.805 | 43.936 | 1.00 | 38.07 | C |
| ATOM | 1916 | CG | ASN | B | 35 | −26.644 | −18.719 | 44.315 | 1.00 | 52.73 | C |
| ATOM | 1917 | OD1 | ASN | B | 35 | −27.611 | −18.462 | 43.594 | 1.00 | 51.71 | O |
| ATOM | 1918 | ND2 | ASN | B | 35 | −26.403 | −18.069 | 45.452 | 1.00 | 46.79 | N |
| ATOM | 1919 | O | ASN | B | 36 | −24.385 | −18.267 | 38.068 | 1.00 | 37.24 | O |
| ATOM | 1920 | N | ASN | B | 36 | −23.947 | −18.955 | 40.752 | 1.00 | 32.67 | N |

TABLE 10.2-continued

| ATOM | 1921 | CA | ASN | B | 36 | −23.207 | −17.863 | 40.120 | 1.00 | 35.30 | C |
|---|---|---|---|---|---|---|---|---|---|---|---|
| ATOM | 1922 | C | ASN | B | 36 | −23.838 | −17.439 | 38.801 | 1.00 | 30.07 | C |
| ATOM | 1923 | CB | ASN | B | 36 | −21.743 | −18.252 | 39.888 | 1.00 | 30.99 | C |
| ATOM | 1924 | CG | ASN | B | 36 | −20.922 | −18.234 | 41.165 | 1.00 | 39.65 | C |
| ATOM | 1925 | OD1 | ASN | B | 36 | −20.340 | −17.210 | 41.526 | 1.00 | 36.59 | O |
| ATOM | 1926 | ND2 | ASN | B | 36 | −20.870 | −19.369 | 41.854 | 1.00 | 34.78 | N |
| ATOM | 1927 | O | ASN | B | 37 | −22.048 | −14.928 | 36.474 | 1.00 | 26.67 | O |
| ATOM | 1928 | N | ASN | B | 37 | −23.761 | −16.144 | 38.510 | 1.00 | 28.56 | N |
| ATOM | 1929 | CA | ASN | B | 37 | −24.222 | −15.603 | 37.237 | 1.00 | 32.35 | C |
| ATOM | 1930 | C | ASN | B | 37 | −23.090 | −15.540 | 36.217 | 1.00 | 35.69 | C |
| ATOM | 1931 | CB | ASN | B | 37 | −24.817 | −14.214 | 37.437 | 1.00 | 33.21 | C |
| ATOM | 1932 | CG | ASN | B | 37 | −25.996 | −14.219 | 38.386 | 1.00 | 35.83 | C |
| ATOM | 1933 | OD1 | ASN | B | 37 | −25.854 | −13.922 | 39.573 | 1.00 | 39.01 | O |
| ATOM | 1934 | ND2 | ASN | B | 37 | −27.166 | −14.566 | 37.868 | 1.00 | 28.90 | N |
| ATOM | 1935 | N | TYR | B | 38 | −23.306 | −16.156 | 35.059 | 1.00 | 26.80 | N |
| ATOM | 1936 | CA | TYR | B | 38 | −22.251 | −16.313 | 34.063 | 1.00 | 31.80 | C |
| ATOM | 1937 | C | TYR | B | 38 | −22.234 | −15.119 | 33.118 | 1.00 | 29.97 | C |
| ATOM | 1938 | O | TYR | B | 38 | −22.505 | −15.241 | 31.924 | 1.00 | 29.53 | O |
| ATOM | 1939 | CB | TYR | B | 38 | −22.431 | −17.628 | 33.295 | 1.00 | 28.25 | C |
| ATOM | 1940 | CG | TYR | B | 38 | −22.072 | −18.859 | 34.115 | 1.00 | 31.67 | C |
| ATOM | 1941 | CD2 | TYR | B | 38 | −21.149 | −19.792 | 33.649 | 1.00 | 32.47 | C |
| ATOM | 1942 | CD1 | TYR | B | 38 | −22.656 | −19.083 | 35.358 | 1.00 | 26.38 | C |
| ATOM | 1943 | CE2 | TYR | B | 38 | −20.816 | −20.912 | 34.406 | 1.00 | 31.96 | C |
| ATOM | 1944 | CE1 | TYR | B | 38 | −22.327 | −20.190 | 36.118 | 1.00 | 30.74 | C |
| ATOM | 1945 | CZ | TYR | B | 38 | −21.414 | −21.102 | 35.639 | 1.00 | 32.95 | C |
| ATOM | 1946 | OH | TYR | B | 38 | −21.096 | −22.200 | 36.403 | 1.00 | 33.05 | O |
| ATOM | 1947 | N | LEU | B | 39 | −21.905 | −13.963 | 33.680 | 1.00 | 29.02 | N |
| ATOM | 1948 | CA | LEU | B | 39 | −21.932 | −12.703 | 32.957 | 1.00 | 26.70 | C |
| ATOM | 1949 | C | LEU | B | 39 | −20.623 | −11.945 | 33.112 | 1.00 | 25.80 | C |
| ATOM | 1950 | O | LEU | B | 39 | −20.043 | −11.912 | 34.202 | 1.00 | 29.17 | O |
| ATOM | 1951 | CB | LEU | B | 39 | −23.082 | −11.829 | 33.457 | 1.00 | 30.90 | C |
| ATOM | 1952 | CG | LEU | B | 39 | −23.219 | −10.510 | 32.698 | 1.00 | 33.97 | C |
| ATOM | 1953 | CD1 | LEU | B | 39 | −24.064 | −10.714 | 31.458 | 1.00 | 27.79 | C |
| ATOM | 1954 | CD2 | LEU | B | 39 | −23.785 | −9.419 | 33.577 | 1.00 | 33.15 | C |
| ATOM | 1955 | N | ALA | B | 40 | −20.168 | −11.330 | 32.025 | 1.00 | 28.13 | N |
| ATOM | 1956 | CA | ALA | B | 40 | −18.989 | −10.470 | 32.068 | 1.00 | 25.92 | C |
| ATOM | 1957 | C | ALA | B | 40 | −19.287 | −9.078 | 31.501 | 1.00 | 26.60 | C |
| ATOM | 1958 | O | ALA | B | 40 | −20.162 | −8.917 | 30.648 | 1.00 | 25.73 | O |
| ATOM | 1959 | CB | ALA | B | 40 | −17.836 | −11.111 | 31.309 | 1.00 | 26.93 | C |
| ATOM | 1960 | N | TRP | B | 41 | −18.556 | −8.079 | 31.986 | 1.00 | 26.55 | N |
| ATOM | 1961 | CA | TRP | B | 41 | −18.651 | −6.720 | 31.455 | 1.00 | 30.35 | C |
| ATOM | 1962 | C | TRP | B | 41 | −17.325 | −6.293 | 30.832 | 1.00 | 29.83 | C |
| ATOM | 1963 | O | TRP | B | 41 | −16.261 | −6.507 | 31.415 | 1.00 | 26.54 | O |
| ATOM | 1964 | CB | TRP | B | 41 | −19.042 | −5.723 | 32.549 | 1.00 | 25.43 | C |
| ATOM | 1965 | CG | TRP | B | 41 | −20.484 | −5.762 | 32.956 | 1.00 | 30.44 | C |
| ATOM | 1966 | CD1 | TRP | B | 41 | −21.014 | −6.405 | 34.039 | 1.00 | 30.19 | C |
| ATOM | 1967 | CD2 | TRP | B | 41 | −21.581 | −5.116 | 32.297 | 1.00 | 28.45 | C |
| ATOM | 1968 | CE2 | TRP | B | 41 | −22.747 | −5.418 | 33.032 | 1.00 | 31.50 | C |
| ATOM | 1969 | CE3 | TRP | B | 41 | −21.692 | −4.318 | 31.154 | 1.00 | 33.61 | C |
| ATOM | 1970 | NE1 | TRP | B | 41 | −22.372 | −6.204 | 34.090 | 1.00 | 28.08 | N |
| ATOM | 1971 | CZ2 | TRP | B | 41 | −24.008 | −4.946 | 32.664 | 1.00 | 32.35 | C |
| ATOM | 1972 | CZ3 | TRP | B | 41 | −22.947 | −3.846 | 30.787 | 1.00 | 31.41 | C |
| ATOM | 1973 | CH2 | TRP | B | 41 | −24.087 | −4.163 | 31.541 | 1.00 | 36.76 | C |
| ATOM | 1974 | N | PHE | B | 42 | −17.400 | −5.679 | 29.655 | 1.00 | 25.32 | N |
| ATOM | 1975 | CA | PHE | B | 42 | −16.220 | −5.212 | 28.939 | 1.00 | 27.15 | C |
| ATOM | 1976 | C | PHE | B | 42 | −16.271 | −3.715 | 28.680 | 1.00 | 31.54 | C |
| ATOM | 1977 | O | PHE | B | 42 | −17.338 | −3.154 | 28.431 | 1.00 | 31.28 | O |
| ATOM | 1978 | CB | PHE | B | 42 | −16.073 | −5.944 | 27.601 | 1.00 | 23.42 | C |
| ATOM | 1979 | CG | PHE | B | 42 | −15.772 | −7.405 | 27.739 | 1.00 | 26.14 | C |
| ATOM | 1980 | CD1 | PHE | B | 42 | −14.462 | −7.847 | 27.845 | 1.00 | 24.13 | C |
| ATOM | 1981 | CD2 | PHE | B | 42 | −16.794 | −8.337 | 27.758 | 1.00 | 29.43 | C |
| ATOM | 1982 | CE1 | PHE | B | 42 | −14.181 | −9.195 | 27.976 | 1.00 | 28.57 | C |
| ATOM | 1983 | CE2 | PHE | B | 42 | −16.518 | −9.690 | 27.887 | 1.00 | 26.26 | C |
| ATOM | 1984 | CZ | PHE | B | 42 | −15.212 | −10.116 | 27..997 | 1.00 | 25.92 | C |
| ATOM | 1985 | N | GLN | B | 43 | −15.109 | −3.076 | 28.723 | 1.00 | 27.61 | N |
| ATOM | 1986 | CA | GLN | B | 43 | −14.976 | −1.691 | 28.289 | 1.00 | 26.82 | C |
| ATOM | 1987 | C | GLN | B | 43 | −14.148 | −1.643 | 27.004 | 1.00 | 32.12 | C |
| ATOM | 1988 | O | GLN | B | 43 | −13.062 | −2.221 | 26.945 | 1.00 | 29.12 | O |
| ATOM | 1989 | CB | GLN | B | 43 | −14.317 | −0.842 | 29.375 | 1.00 | 23.34 | C |
| ATOM | 1990 | CG | GLN | B | 43 | −14.190 | 0.629 | 29.022 | 1.00 | 24.31 | C |
| ATOM | 1991 | CD | GLN | B | 43 | −13.172 | 13.45 | 29.891 | 1.00 | 29.32 | C |
| ATOM | 1992 | NE2 | GLN | B | 43 | −13.650 | 2.131 | 30.851 | 1.00 | 31.37 | N |
| ATOM | 1993 | OE1 | GLN | B | 43 | −11.970 | 1.192 | 29.701 | 1.00 | 31.73 | O |
| ATOM | 1994 | N | GLN | B | 44 | −14.656 | −0.977 | 25.972 | 1.00 | 20.12 | N |
| ATOM | 1995 | CA | GLN | B | 44 | −13.869 | −0.810 | 24.754 | 1.00 | 26.13 | C |
| ATOM | 1996 | C | GLN | B | 44 | −13.601 | 0.662 | 24.464 | 1.00 | 26.14 | C |
| ATOM | 1997 | O | GLN | B | 44 | −14.477 | 1.377 | 23.977 | 1.00 | 29.23 | O |
| ATOM | 1998 | CB | GLN | B | 44 | −14.559 | −1.470 | 23.556 | 1.00 | 24.46 | C |
| ATOM | 1999 | CG | GLN | B | 44 | −13.755 | −1.359 | 22.263 | 1.00 | 26.38 | C |
| ATOM | 2000 | CD | GLN | B | 44 | −14.303 | −2.228 | 21.137 | 1.00 | 28.28 | C |

TABLE 10.2-continued

| ATOM | 2001 | NE2 | GLN | B | 44 | −13.407 | −2.827 | 20.355 | 1.00 | 28.01 | N |
| --- | --- | --- | --- | --- | --- | --- | --- | --- | --- | --- | --- |
| ATOM | 2002 | OE1 | GLN | B | 44 | −15.512 | −2.363 | 20.977 | 1.00 | 28.62 | O |
| ATOM | 2003 | N | LYS | B | 45 | −12.388 | 1.103 | 24.786 | 1.00 | 27.16 | N |
| ATOM | 2004 | CA | LYS | B | 45 | −11.913 | 2.448 | 24.466 | 1.00 | 35.42 | C |
| ATOM | 2005 | C | LYS | B | 45 | −11.696 | 2.581 | 22.963 | 1.00 | 35.66 | C |
| ATOM | 2006 | O | LYS | B | 45 | −11.493 | 1.577 | 22.281 | 1.00 | 35.60 | O |
| ATOM | 2007 | CB | LYS | B | 45 | −10.602 | 2.752 | 25.205 | 1.00 | 33.99 | C |
| ATOM | 2008 | CG | LYS | B | 45 | −10.694 | 2.701 | 26.707 | 1.00 | 42.68 | C |
| ATOM | 2009 | CD | LYS | B | 45 | −9.353 | 3.040 | 27.351 | 1.00 | 41.29 | C |
| ATOM | 2010 | CE | LYS | B | 45 | −8.230 | 2.156 | 26.828 | 1.00 | 41.00 | C |
| ATOM | 2011 | NZ | LYS | B | 45 | −7.078 | 2.115 | 27.785 | 1.00 | 34.96 | N |
| ATOM | 2012 | N | PRO | B | 46 | −11.726 | 3.820 | 22.440 | 1.00 | 38.26 | N |
| ATOM | 2013 | CA | PRO | B | 46 | −11.508 | 4.031 | 21.001 | 1.00 | 37.25 | C |
| ATOM | 2014 | C | PRO | B | 46 | −10.173 | 3.470 | 20.504 | 1.00 | 36.36 | C |
| ATOM | 2015 | O | PRO | B | 46 | −9.125 | 3.762 | 21.087 | 1.00 | 35.60 | O |
| ATOM | 2016 | CB | PRO | B | 46 | −11.537 | 5.559 | 20.865 | 1.00 | 41.28 | C |
| ATOM | 2017 | CG | PRO | B | 46 | −12.362 | 6.021 | 22.009 | 1.00 | 39.45 | C |
| ATOM | 2018 | CD | PRO | B | 46 | −12.046 | 5.080 | 23.138 | 1.00 | 35.28 | C |
| ATOM | 2019 | N | GLY | B | 47 | −10.225 | 2.664 | 19.447 | 1.00 | 34.42 | N |
| ATOM | 2020 | CA | GLY | B | 47 | −9.034 | 2.100 | 18.835 | 1.00 | 31.31 | C |
| ATOM | 2021 | C | GLY | B | 47 | −8.501 | 0.849 | 19.517 | 1.00 | 42.85 | C |
| ATOM | 2022 | O | GLY | B | 47 | −7.507 | 0.270 | 19.074 | 1.00 | 30.21 | O |
| ATOM | 2023 | N | GLN | B | 48 | −9.163 | 0.425 | 20.589 | 1.00 | 29.62 | N |
| ATOM | 2024 | CA | GLN | B | 48 | −8.662 | −0.672 | 21.411 | 1.00 | 33.47 | C |
| ATOM | 2025 | C | GLN | B | 48 | −9.588 | −1.887 | 21.411 | 1.00 | 33.23 | C |
| ATOM | 2026 | O | GLN | B | 48 | −10.787 | −1.757 | 21.171 | 1.00 | 26.94 | O |
| ATOM | 2027 | CB | GLN | B | 48 | −8.451 | −0.187 | 22.850 | 1.00 | 32.23 | C |
| ATOM | 2028 | CG | GLN | B | 48 | −7.391 | 0.893 | 22.990 | 1.00 | 33.96 | C |
| ATOM | 2029 | CD | GLN | B | 48 | −6.011 | 0.404 | 22.590 | 1.00 | 43.63 | C |
| ATOM | 2030 | OE1 | GLN | B | 48 | −5.276 | 1.095 | 21.885 | 1.00 | 42.98 | O |
| ATOM | 2031 | NE2 | GLN | B | 48 | −5.652 | −0.796 | 23.042 | 1.00 | 39.16 | N |
| ATOM | 2032 | N | PRO | B | 49 | −9.032 | −3.077 | 21.691 | 1.00 | 30.89 | N |
| ATOM | 2033 | CA | PRO | B | 49 | −9.885 | −4.246 | 21.918 | 1.00 | 26.27 | C |
| ATOM | 2034 | C | PRO | B | 49 | −10.687 | −4.069 | 23.203 | 1.00 | 27.88 | C |
| ATOM | 2035 | O | PRO | B | 49 | −10.290 | −3.264 | 24.045 | 1.00 | 27.50 | O |
| ATOM | 2036 | CB | PRO | B | 49 | −8.883 | −5.396 | 22.049 | 1.00 | 26.15 | C |
| ATOM | 2037 | CG | PRO | B | 49 | −7.629 | −4.740 | 22.538 | 1.00 | 28.99 | C |
| ATOM | 2038 | CD | PRO | B | 49 | −7.602 | −3.394 | 21.865 | 1.00 | 32.59 | C |
| ATOM | 2039 | N | PRO | B | 50 | −11.803 | −4.799 | 23.351 | 1.00 | 25.78 | N |
| ATOM | 2040 | CA | PRO | B | 50 | −12.539 | −4.746 | 24.621 | 1.00 | 23.59 | C |
| ATOM | 2041 | C | PRO | B | 50 | −11.625 | −5.113 | 25.793 | 1.00 | 30.73 | C |
| ATOM | 2042 | O | PRO | B | 50 | −10.661 | −5.859 | 25.608 | 1.00 | 26.96 | O |
| ATOM | 2043 | CB | PRO | B | 50 | −13.643 | −5.791 | 24.438 | 1.00 | 24.85 | C |
| ATOM | 2044 | CG | PRO | B | 50 | −13.817 | −5.908 | 22.949 | 1.00 | 25.66 | C |
| ATOM | 2045 | CD | PRO | B | 50 | −12.441 | −5.694 | 22.370 | 1.00 | 25.19 | C |
| ATOM | 2046 | N | LYS | B | 51 | −11.909 | −4.574 | 26.972 | 1.00 | 27.75 | N |
| ATOM | 2047 | CA | LYS | B | 51 | −11.131 | −4.899 | 28.158 | 1.00 | 25.94 | C |
| ATOM | 2048 | C | LYS | B | 51 | −12.052 | −5.420 | 29.251 | 1.00 | 30.23 | C |
| ATOM | 2049 | O | LYS | B | 51 | −13.083 | −4.818 | 29.547 | 1.00 | 25.89 | O |
| ATOM | 2050 | CB | LYS | B | 51 | −10.351 | −3.680 | 28.654 | 1.00 | 29.25 | C |
| ATOM | 2051 | CG | LYS | B | 51 | −9.163 | −4.045 | 29.535 | 1.00 | 32.02 | C |
| ATOM | 2052 | CD | LYS | B | 51 | −9.469 | −3.859 | 31.001 | 1.00 | 37.80 | C |
| ATOM | 2053 | CE | LYS | B | 51 | −8.409 | −4.533 | 31.869 | 1.00 | 37.22 | C |
| ATOM | 2054 | NZ | LYS | B | 51 | −8.655 | −5.999 | 32.014 | 1.00 | 34.08 | N |
| ATOM | 2055 | N | LEU | B | 52 | −11.680 | −6.547 | 29.845 | 1.00 | 24.57 | N |
| ATOM | 2056 | CA | LEU | B | 52 | −12.514 | −7.177 | 30.860 | 1.00 | 28.11 | C |
| ATOM | 2057 | C | LEU | B | 52 | −12.555 | −6.335 | 32.130 | 1.00 | 24.97 | C |
| ATOM | 2058 | O | LEU | B | 52 | −11.514 | −5.962 | 32.663 | 1.00 | 30.29 | O |
| ATOM | 2059 | CB | LEU | B | 52 | −11.998 | −8.583 | 31.172 | 1.00 | 26.30 | C |
| ATOM | 2060 | CG | LEU | B | 52 | −12.775 | −9.420 | 32.190 | 1.00 | 32.39 | C |
| ATOM | 2061 | CD1 | LEU | B | 52 | −14.222 | −9.597 | 31.751 | 1.00 | 25.02 | C |
| ATOM | 2062 | CD2 | LEU | B | 52 | −12.099 | −10.772 | 32.378 | 1.00 | 30.83 | C |
| ATOM | 2063 | N | LEU | B | 53 | −13.760 | −6.030 | 32.600 | 1.00 | 27.61 | N |
| ATOM | 2064 | CA | LEU | B | 53 | −13.938 | −5.297 | 33.854 | 1.00 | 30.52 | C |
| ATOM | 2065 | C | LEU | B | 53 | −14.434 | −6.219 | 34.956 | 1.00 | 31.29 | C |
| ATOM | 2066 | O | LEU | B | 53 | −13.913 | −6.226 | 36.068 | 1.00 | 30.02 | O |
| ATOM | 2067 | CB | LEU | B | 53 | −14.936 | −4.153 | 33.688 | 1.00 | 25.25 | C |
| ATOM | 2068 | CG | LEU | B | 53 | −14.711 | −3.080 | 32.627 | 1.00 | 33.70 | C |
| ATOM | 2069 | CD1 | LEU | B | 53 | −15.917 | −2.149 | 32.611 | 1.00 | 26.80 | C |
| ATOM | 2070 | CD2 | LEU | B | 53 | −13.432 | −2.308 | 32.907 | 1.00 | 32.50 | C |
| ATOM | 2071 | N | LEU | B | 54 | −15.460 | −6.993 | 34.631 | 1.00 | 28.48 | N |
| ATOM | 2072 | CA | LEU | B | 54 | −16.169 | −7.782 | 35.623 | 1.00 | 30.79 | C |
| ATOM | 2073 | C | LEU | B | 54 | −16.516 | −9.152 | 35.071 | 1.00 | 28.54 | C |
| ATOM | 2074 | O | LEU | B | 54 | −16.791 | −9.294 | 33.883 | 1.00 | 26.65 | O |
| ATOM | 2075 | CB | LEU | B | 54 | −17.448 | −7.055 | 36.059 | 1.00 | 31.42 | C |
| ATOM | 2076 | CG | LEU | B | 54 | −17.289 | −5.722 | 36.798 | 1.00 | 33.30 | C |
| ATOM | 2077 | CD1 | LEU | B | 54 | −18.529 | −4.870 | 36.615 | 1.00 | 32.48 | C |
| ATOM | 2078 | CD2 | LEU | B | 54 | −17.052 | −5.971 | 38.268 | 1.00 | 34.07 | C |
| ATOM | 2079 | N | TYR | B | 55 | −16.502 | −10.158 | 35.938 | 1.00 | 29.20 | N |
| ATOM | 2080 | CA | TYR | B | 55 | −17.005 | −11.475 | 35.580 | 1.00 | 29.74 | C |

TABLE 10.2-continued

| | | | | | | | | | | |
|---|---|---|---|---|---|---|---|---|---|---|
| ATOM | 2081 | C | TYR | B | 55 | −17.755 | −12.043 | 36.791 | 1.00 | 32.63 | C |
| ATOM | 2082 | O | TYR | B | 55 | −17.726 | −11.449 | 37.872 | 1.00 | 31.32 | O |
| ATOM | 2083 | CB | TYR | B | 55 | −15.869 | −12.393 | 35.101 | 1.00 | 28.86 | C |
| ATOM | 2084 | CG | TYR | B | 55 | −14.714 | −12.558 | 36.065 | 1.00 | 30.07 | C |
| ATOM | 2085 | CD1 | TYR | B | 55 | −13.746 | −11.572 | 36.204 | 1.00 | 31.15 | C |
| ATOM | 2086 | CD2 | TYR | B | 55 | −14.578 | −13.717 | 36.814 | 1.00 | 30.26 | C |
| ATOM | 2087 | CE1 | TYR | B | 55 | −12.686 | −11.728 | 37.088 | 1.00 | 34.78 | C |
| ATOM | 2088 | CE2 | TYR | B | 55 | −13.525 | −13.886 | 37.695 | 1.00 | 33.93 | C |
| ATOM | 2089 | CZ | TYR | B | 55 | −12.582 | −12.889 | 37.828 | 1.00 | 36.44 | C |
| ATOM | 2090 | OH | TYR | B | 55 | −11.534 | −13.059 | 38.705 | 1.00 | 37.42 | O |
| ATOM | 2091 | N | TRP | B | 56 | −18.448 | −13.165 | 36.599 | 1.00 | 28.09 | N |
| ATOM | 2092 | CA | TRP | B | 56 | −19.439 | −13.657 | 37.566 | 1.00 | 26.67 | C |
| ATOM | 2093 | C | TRP | B | 56 | −20.387 | −12.528 | 37.984 | 1.00 | 27.89 | C |
| ATOM | 2094 | O | TRP | B | 56 | −20.767 | −12.420 | 39.151 | 1.00 | 24.63 | O |
| ATOM | 2095 | CB | TRP | B | 56 | −18.769 | −14.276 | 38.799 | 1.00 | 22.01 | C |
| ATOM | 2096 | CG | TRP | B | 56 | −17.799 | −15.367 | 38.462 | 1.00 | 27.09 | C |
| ATOM | 2097 | CD1 | TRP | B | 56 | −16.475 | −15.402 | 38.777 | 1.00 | 26.84 | C |
| ATOM | 2098 | CD2 | TRP | B | 56 | −18.068 | −16.569 | 37.720 | 1.00 | 23.97 | C |
| ATOM | 2099 | NE1 | TRP | B | 56 | −15.901 | −16.551 | 38.286 | 1.00 | 28.86 | N |
| ATOM | 2100 | CE2 | TRP | B | 56 | −16.857 | −17.284 | 37.633 | 1.00 | 25.06 | C |
| ATOM | 2101 | CE3 | TRP | B | 56 | −19.214 | −17.112 | 37.131 | 1.00 | 23.47 | C |
| ATOM | 2102 | CZ2 | TRP | B | 56 | −16.758 | −18.514 | 36.983 | 1.00 | 28.72 | C |
| ATOM | 2103 | CZ3 | TRP | B | 56 | −19.117 | −18.334 | 36.486 | 1.00 | 28.66 | C |
| ATOM | 2104 | CH2 | TRP | B | 56 | −17.896 | −19.021 | 36.414 | 1.00 | 29.03 | C |
| ATOM | 2105 | N | ALA | B | 57 | −20.734 | −11.686 | 37.009 | 1.00 | 26.41 | N |
| ATOM | 2106 | CA | ALA | B | 57 | −21.626 | −10.531 | 37.167 | 1.00 | 29.78 | C |
| ATOM | 2107 | C | ALA | B | 57 | −21.083 | −9.421 | 38.079 | 1.00 | 31.22 | C |
| ATOM | 2108 | O | ALA | B | 57 | −21.331 | −8.242 | 37.817 | 1.00 | 35.13 | O |
| ATOM | 2109 | CB | ALA | B | 57 | −23.008 | −10.985 | 37.667 | 1.00 | 27.19 | C |
| ATOM | 2110 | N | SER | B | 58 | −20.344 | −9.767 | 39.132 | 1.00 | 32.27 | N |
| ATOM | 2111 | CA | SER | B | 58 | −19.992 | −8.748 | 40.125 | 1.00 | 31.56 | C |
| ATOM | 2112 | C | SER | B | 58 | −18.563 | −8.741 | 40.672 | 1.00 | 32.07 | C |
| ATOM | 2113 | O | SER | B | 58 | −18.251 | −7.901 | 41.517 | 1.00 | 37.30 | O |
| ATOM | 2114 | CB | SER | B | 58 | −20.955 | −8.849 | 41.315 | 1.00 | 36.25 | C |
| ATOM | 2115 | OG | SER | B | 58 | −20.817 | −10.091 | 41.985 | 1.00 | 37.37 | O |
| ATOM | 2116 | N | THR | B | 59 | −17.687 | −9.640 | 40.229 | 1.00 | 31.17 | N |
| ATOM | 2117 | CA | THR | B | 59 | −16.319 | −9.596 | 40.759 | 1.00 | 29.77 | C |
| ATOM | 2118 | C | THR | B | 59 | −15.365 | −8.910 | 39.770 | 1.00 | 30.97 | C |
| ATOM | 2119 | O | THR | B | 59 | −15.367 | −9.201 | 38.575 | 1.00 | 31.74 | O |
| ATOM | 2120 | CB | THR | B | 59 | −15.786 | −11.014 | 41.142 | 1.00 | 36.77 | C |
| ATOM | 2121 | OG1 | THR | B | 59 | −14.721 | −11.403 | 40.269 | 1.00 | 41.80 | O |
| ATOM | 2122 | CG2 | THR | B | 59 | −16.890 | −12.053 | 41.102 | 1.00 | 28.98 | C |
| ATOM | 2123 | N | ARG | B | 60 | −14.565 | −7.978 | 40.284 | 1.00 | 32.62 | N |
| ATOM | 2124 | CA | ARG | B | 60 | −13.693 | −7.159 | 39.449 | 1.00 | 36.43 | C |
| ATOM | 2125 | C | ARG | B | 60 | −12.441 | −7.902 | 39.022 | 1.00 | 35.37 | C |
| ATOM | 2126 | O | ARG | B | 60 | −11.819 | −8.588 | 39.825 | 1.00 | 33.08 | O |
| ATOM | 2127 | CB | ARG | B | 60 | −13.278 | −5.877 | 40.182 | 1.00 | 33.09 | C |
| ATOM | 2128 | CG | ARG | B | 60 | −14.342 | −4.796 | 40.212 | 1.00 | 39.07 | C |
| ATOM | 2129 | CD | ARG | B | 60 | −13.752 | −3.436 | 40.558 | 1.00 | 37.50 | C |
| ATOM | 2130 | NE | ARG | B | 60 | −12.854 | −3.495 | 41.707 | 1.00 | 43.68 | N |
| ATOM | 2131 | CZ | ARG | B | 60 | −13.259 | −3.551 | 42.971 | 1.00 | 51.03 | C |
| ATOM | 2132 | NH1 | ARG | B | 60 | −14.555 | −3.560 | 43.254 | 1.00 | 53.34 | N |
| ATOM | 2133 | NH2 | ARG | B | 60 | −12.368 | −3.603 | 43.952 | 1.00 | 52.19 | N |
| ATOM | 2134 | N | GLU | B | 61 | −12.061 | −7.747 | 37.759 | 1.00 | 30.40 | N |
| ATOM | 2135 | CA | GLU | B | 61 | −10.764 | −8.235 | 37.310 | 1.00 | 35.70 | C |
| ATOM | 2136 | C | GLU | B | 61 | −9.659 | −7.523 | 38.077 | 1.00 | 35.51 | C |
| ATOM | 2137 | O | GLU | B | 61 | −9.863 | −6.424 | 38.598 | 1.00 | 36.52 | O |
| ATOM | 2138 | CB | GLU | B | 61 | −10.285 | −8.023 | 35.805 | 1.00 | 30.95 | C |
| ATOM | 2139 | CG | GLU | B | 61 | −10.406 | −9.307 | 35.015 | 1.00 | 51.01 | C |
| ATOM | 2140 | CD | GLU | B | 61 | −9.084 | −10.015 | 35.278 | 1.00 | 47.16 | C |
| ATOM | 2141 | OE1 | GLU | B | 61 | −8.884 | −10.535 | 36.397 | 1.00 | 57.21 | O |
| ATOM | 2142 | OE2 | GLU | B | 61 | −8.245 | −10.063 | 34.354 | 1.00 | 55.45 | O |
| ATOM | 2143 | N | SER | B | 62 | −8.491 | −8.148 | 38.143 | 1.00 | 36.53 | N |
| ATOM | 2144 | CA | SER | B | 62 | −7.352 | −7.559 | 38.838 | 1.00 | 37.86 | C |
| ATOM | 2145 | C | SER | B | 62 | −6.959 | −6.222 | 38.211 | 1.00 | 35.62 | C |
| ATOM | 2146 | O | SER | B | 62 | −6.919 | −6.086 | 36.992 | 1.00 | 34.27 | O |
| ATOM | 2147 | CB | SER | B | 62 | −6.166 | −8.527 | 38.822 | 1.00 | 40.55 | C |
| ATOM | 2148 | OG | SER | B | 62 | −5.113 | −8.060 | 39.646 | 1.00 | 56.20 | O |
| ATOM | 2149 | N | GLY | B | 63 | −6.690 | −5.228 | 39.049 | 1.00 | 32.40 | N |
| ATOM | 2150 | CA | GLY | B | 63 | −6.280 | −3.924 | 38.561 | 1.00 | 32.97 | C |
| ATOM | 2151 | C | GLY | B | 63 | −7.413 | −2.971 | 38.213 | 1.00 | 38.33 | C |
| ATOM | 2152 | O | GLY | B | 63 | −7.194 | −1.767 | 38.099 | 1.00 | 40.50 | O |
| ATOM | 2153 | N | VAL | B | 64 | −8.624 | −3.498 | 38.045 | 1.00 | 31.70 | N |
| ATOM | 2154 | CA | VAL | B | 64 | −9.780 | −2.664 | 37.711 | 1.00 | 30.42 | C |
| ATOM | 2155 | C | VAL | B | 64 | −10.188 | −1.782 | 38.894 | 1.00 | 34.52 | C |
| ATOM | 2156 | O | VAL | B | 64 | −10.378 | −2.279 | 40.004 | 1.00 | 36.24 | O |
| ATOM | 2157 | CB | VAL | B | 64 | −10.988 | −3.525 | 37.269 | 1.00 | 33.44 | C |
| ATOM | 2158 | CG1 | VAL | B | 64 | −12.241 | −2.668 | 37.101 | 1.00 | 31.47 | C |
| ATOM | 2159 | CG2 | VAL | B | 64 | −10.668 | −4.271 | 35.985 | 1.00 | 30.34 | C |
| ATOM | 2160 | N | PRO | B | 65 | −10.326 | −0.466 | 38.655 | 1.00 | 35.36 | N |

TABLE 10.2-continued

| | | | | | | | | | | |
|---|---|---|---|---|---|---|---|---|---|---|
| ATOM | 2161 | CA | PRO | B | 65 | −10.693 | 0.500 | 39.701 | 1.00 | 33.81 | C |
| ATOM | 2162 | C | PRO | B | 65 | −12.039 | 0.170 | 40.344 | 1.00 | 36.63 | C |
| ATOM | 2163 | O | PRO | B | 65 | −12.940 | −0.301 | 39.649 | 1.00 | 30.63 | O |
| ATOM | 2164 | CB | PRO | B | 65 | −10.765 | 1.831 | 38.946 | 1.00 | 31.15 | C |
| ATOM | 2165 | CG | PRO | B | 65 | −9.947 | 1.623 | 37.710 | 1.00 | 35.40 | C |
| ATOM | 2166 | CD | PRO | B | 65 | −10.131 | 0.182 | 37.347 | 1.00 | 33.17 | C |
| ATOM | 2167 | N | ASP | B | 66 | −12.177 | 0.421 | 41.645 | 1.00 | 33.02 | N |
| ATOM | 2168 | CA | ASP | B | 66 | −13.408 | 0.069 | 42.357 | 1.00 | 39.73 | C |
| ATOM | 2169 | C | ASP | B | 66 | −14.599 | 0.965 | 41.998 | 1.00 | 39.77 | C |
| ATOM | 2170 | O | ASP | B | 66 | −15.703 | 0.752 | 42.499 | 1.00 | 35.02 | O |
| ATOM | 2171 | CB | ASP | B | 66 | −13.180 | 0.093 | 43.874 | 1.00 | 38.87 | C |
| ATOM | 2172 | CG | ASP | B | 66 | −12.527 | 1.374 | 44.354 | 1.00 | 46.60 | C |
| ATOM | 2173 | OD1 | ASP | B | 66 | −12.535 | 2.376 | 43.608 | 1.00 | 57.95 | O |
| ATOM | 2174 | OD2 | ASP | B | 66 | −12.004 | 1.377 | 45.489 | 1.00 | 64.41 | O |
| ATOM | 2175 | N | ARG | B | 67 | −14.376 | 1.953 | 41.129 | 1.00 | 35.35 | N |
| ATOM | 2176 | CA | ARG | B | 67 | −15.470 | 2.752 | 40.569 | 1.00 | 31.85 | C |
| ATOM | 2177 | C | ARG | B | 67 | −16.456 | 1.880 | 39.807 | 1.00 | 34.69 | C |
| ATOM | 2178 | O | ARG | B | 67 | −17.638 | 2.209 | 39.698 | 1.00 | 35.56 | O |
| ATOM | 2179 | CB | ARG | B | 67 | −14.947 | 3.828 | 39.614 | 1.00 | 39.18 | C |
| ATOM | 2180 | CG | ARG | B | 67 | −13.752 | 4.611 | 40.095 | 1.00 | 51.83 | C |
| ATOM | 2181 | CD | ARG | B | 67 | −13.589 | 5.861 | 39.242 | 1.00 | 57.84 | C |
| ATOM | 2182 | NE | ARG | B | 67 | −13.490 | 5.570 | 37.810 | 1.00 | 38.84 | N |
| ATOM | 2183 | CZ | ARG | B | 67 | −12.335 | 5.389 | 37.179 | 1.00 | 42.20 | C |
| ATOM | 2184 | NH1 | ARG | B | 67 | −11.197 | 5.458 | 37.859 | 1.00 | 41.09 | N |
| ATOM | 2185 | NH2 | ARG | B | 67 | −12.314 | 5.140 | 35.878 | 1.00 | 37.06 | N |
| ATOM | 2186 | N | PHE | B | 68 | −15.948 | 0.785 | 39.245 | 1.00 | 28.82 | N |
| ATOM | 2187 | CA | PHE | B | 68 | −16.759 | −0.122 | 38.443 | 1.00 | 36.23 | C |
| ATOM | 2188 | C | PHE | B | 68 | −17.314 | −1.232 | 39.308 | 1.00 | 34.50 | C |
| ATOM | 2189 | O | PHE | B | 68 | −16.564 | −1.931 | 39.995 | 1.00 | 31.34 | O |
| ATOM | 2190 | CB | PHE | B | 68 | −15.941 | −0.727 | 37.297 | 1.00 | 30.38 | C |
| ATOM | 2191 | CG | PHE | B | 68 | −15.401 | 0.287 | 36.337 | 1.00 | 34.41 | C |
| ATOM | 2192 | CD1 | PHE | B | 68 | −16.127 | 0.651 | 35.215 | 1.00 | 31.80 | C |
| ATOM | 2193 | CD2 | PHE | B | 68 | −14.163 | 0.874 | 36.551 | 1.00 | 34.95 | C |
| ATOM | 2194 | CE1 | PHE | B | 68 | −15.629 | 1.586 | 34.328 | 1.00 | 29.96 | C |
| ATOM | 2195 | CE2 | PHE | B | 68 | −13.661 | 1.807 | 35.666 | 1.00 | 35.32 | C |
| ATOM | 2196 | CZ | PHE | B | 68 | −14.396 | 2.163 | 34.554 | 1.00 | 31.86 | C |
| ATOM | 2197 | N | SER | B | 69 | −18.627 | −1.408 | 39.275 | 1.00 | 30.82 | N |
| ATOM | 2198 | CA | SER | B | 69 | −19.228 | −2.482 | 40.044 | 1.00 | 30.92 | C |
| ATOM | 2199 | C | SER | B | 69 | −20.364 | −3.114 | 39.268 | 1.00 | 34.45 | C |
| ATOM | 2200 | O | SER | B | 69 | −20.998 | −2.468 | 38.430 | 1.00 | 35.02 | O |
| ATOM | 2201 | CB | SER | B | 69 | −19.724 | −1.970 | 41.397 | 1.00 | 32.49 | C |
| ATOM | 2202 | O | SER | B | 69 | −20.797 | −1.062 | 41.230 | 1.00 | 37.05 | O |
| ATOM | 2203 | N | GLY | B | 70 | −20.610 | −4.387 | 39.550 | 1.00 | 30.93 | N |
| ATOM | 2204 | CA | GLY | B | 70 | −21.673 | −5.116 | 38.896 | 1.00 | 28.03 | C |
| ATOM | 2205 | C | GLY | B | 70 | −22.689 | −5.620 | 39.898 | 1.00 | 38.68 | C |
| ATOM | 2206 | O | GLY | B | 70 | −22.361 | −5.887 | 41.056 | 1.00 | 36.13 | O |
| ATOM | 2207 | N | SER | B | 71 | −23.932 | −5.737 | 39.449 | 1.00 | 35.97 | N |
| ATOM | 2208 | CA | SER | B | 71 | −24.996 | −6.282 | 40.276 | 1.00 | 32.81 | C |
| ATOM | 2209 | C | SER | B | 71 | −26.038 | −6.927 | 39.380 | 1.00 | 36.09 | C |
| ATOM | 2210 | O | SER | B | 71 | −25.980 | −6.798 | 38.157 | 1.00 | 36.12 | O |
| ATOM | 2211 | CB | SER | B | 71 | −25.632 | −5.193 | 41.136 | 1.00 | 38.54 | C |
| ATOM | 2212 | OG | SER | B | 71 | −26.284 | −4.232 | 40.322 | 1.00 | 42.67 | O |
| ATOM | 2213 | N | GLY | B | 72 | −26.996 | −7.612 | 39.992 | 1.00 | 35.53 | N |
| ATOM | 2214 | CA | GLY | B | 72 | −28.054 | −8.256 | 39.242 | 1.00 | 32.26 | C |
| ATOM | 2215 | C | GLY | B | 72 | −28.025 | −9.760 | 39.411 | 1.00 | 33.08 | C |
| ATOM | 2216 | O | GLY | B | 72 | −27.109 | −10.312 | 40.020 | 1.00 | 37.03 | O |
| ATOM | 2217 | N | SER | B | 73 | −29.038 | −10.420 | 38.869 | 1.00 | 35.95 | N |
| ATOM | 2218 | CA | SER | B | 73 | −29.166 | −11.861 | 38.993 | 1.00 | 39.04 | C |
| ATOM | 2219 | C | SER | B | 73 | −30.132 | −12.395 | 37.946 | 1.00 | 40.07 | C |
| ATOM | 2220 | O | SER | B | 73 | −31.042 | −11.691 | 37.512 | 1.00 | 40.54 | O |
| ATOM | 2221 | CB | SER | B | 73 | −29.643 | −12.235 | 40.398 | 1.00 | 44.78 | C |
| ATOM | 2222 | OG | SER | B | 73 | −29.753 | −13.638 | 40.538 | 1.00 | 50.73 | O |
| ATOM | 2223 | N | GLY | B | 74 | −29.920 | −13.638 | 37.531 | 1.00 | 41.84 | N |
| ATOM | 2224 | CA | GLY | B | 74 | −30.816 | −14.291 | 36.597 | 1.00 | 37.63 | C |
| ATOM | 2225 | C | GLY | B | 74 | −30.776 | −13.743 | 35.182 | 1.00 | 41.67 | C |
| ATOM | 2226 | O | GLY | B | 74 | −29.999 | −14.211 | 34.347 | 1.00 | 37.99 | O |
| ATOM | 2227 | N | THR | B | 75 | −31.628 | −12.761 | 34.907 | 1.00 | 34.80 | N |
| ATOM | 2228 | CA | THR | B | 75 | −31.767 | −12.239 | 33.553 | 1.00 | 38.56 | C |
| ATOM | 2229 | C | THR | B | 75 | −31.515 | −10.733 | 33.475 | 1.00 | 38.78 | C |
| ATOM | 2230 | O | THR | B | 75 | −31.439 | −10.173 | 32.384 | 1.00 | 44.01 | O |
| ATOM | 2231 | CB | THR | B | 75 | −33.176 | −12.534 | 32.980 | 1.00 | 38.87 | C |
| ATOM | 2232 | CG2 | THR | B | 75 | −33.477 | −14.025 | 33.021 | 1.00 | 37.18 | C |
| ATOM | 2233 | OG1 | THR | B | 75 | −34.163 | −11.838 | 33.749 | 1.00 | 46.98 | O |
| ATOM | 2234 | N | ASP | B | 76 | −31.389 | −10.083 | 34.629 | 1.00 | 37.55 | N |
| ATOM | 2235 | CA | ASP | B | 76 | −31.244 | −8.628 | 34.678 | 1.00 | 38.55 | C |
| ATOM | 2236 | C | ASP | B | 76 | −29.989 | −8.211 | 35.414 | 1.00 | 30.72 | C |
| ATOM | 2237 | O | ASP | B | 76 | −29.767 | −8.605 | 36.557 | 1.00 | 39.41 | O |
| ATOM | 2238 | CB | ASP | B | 76 | −32.463 | −7.978 | 35.340 | 1.00 | 39.46 | C |
| ATOM | 2239 | CG | ASP | B | 76 | −33.567 | −7.680 | 34.352 | 1.00 | 54.19 | C |
| ATOM | 2240 | OD2 | ASP | B | 76 | −34.444 | −8.548 | 34.149 | 1.00 | 61.43 | O |

TABLE 10.2-continued

| | | | | | | | | | | |
|---|---|---|---|---|---|---|---|---|---|---|
| ATOM | 2241 | OD1 | ASP | B | 76 | −33.553 | −6.575 | 33.770 | 1.00 | 68.17 | O |
| ATOM | 2242 | N | PHE | B | 77 | −29.173 | −7.397 | 34.756 | 1.00 | 32.93 | N |
| ATOM | 2243 | CA | PHE | B | 77 | −27.890 | −6.999 | 35.314 | 1.00 | 34.16 | C |
| ATOM | 2244 | C | PHE | B | 77 | −27.608 | −5.540 | 35.021 | 1.00 | 28.32 | C |
| ATOM | 2245 | O | PHE | B | 77 | −28.054 | −5.005 | 34.010 | 1.00 | 34.43 | O |
| ATOM | 2246 | CB | PHE | B | 77 | −26.769 | −7.870 | 34.748 | 1.00 | 33.65 | C |
| ATOM | 2247 | CG | PHE | B | 77 | −27.008 | −9.340 | 34.908 | 1.00 | 31.73 | C |
| ATOM | 2248 | CD1 | PHE | B | 77 | −26.584 | −10.004 | 36.050 | 1.00 | 34.33 | C |
| ATOM | 2249 | CD2 | PHE | B | 77 | −27.663 | −10.061 | 33.924 | 1.00 | 30.60 | C |
| ATOM | 2250 | CE1 | PHE | B | 77 | −26.807 | −11.363 | 36.204 | 1.00 | 28.94 | C |
| ATOM | 2251 | CE2 | PHE | B | 77 | −27.892 | −11.420 | 34.078 | 1.00 | 32.18 | C |
| ATOM | 2252 | CZ | PHE | B | 77 | −27.463 | −12.067 | 35.215 | 1.00 | 28.31 | C |
| ATOM | 2253 | N | THR | B | 78 | −26.864 | −4.894 | 35.909 | 1.00 | 33.91 | N |
| ATOM | 2254 | CA | THR | B | 78 | −26.454 | −3.520 | 35.673 | 1.00 | 36.80 | C |
| ATOM | 2255 | C | THR | B | 78 | −24.972 | −3.332 | 35.956 | 1.00 | 35.53 | C |
| ATOM | 2256 | O | THR | B | 78 | −24.429 | −3.893 | 36.909 | 1.00 | 33.42 | O |
| ATOM | 2257 | CB | THR | B | 78 | −27.250 | −2.514 | 36.536 | 1.00 | 36.13 | C |
| ATOM | 2258 | CG2 | THR | B | 78 | −28.744 | −2.790 | 36.465 | 1.00 | 35.39 | C |
| ATOM | 2259 | OG1 | THR | B | 78 | −26.815 | −2.600 | 37.896 | 1.00 | 52.08 | O |
| ATOM | 2260 | N | LEU | B | 79 | −24.321 | −2.546 | 35.108 | 1.00 | 33.37 | N |
| ATOM | 2261 | CA | LEU | B | 79 | −22.978 | −2.072 | 35.382 | 1.00 | 32.04 | C |
| ATOM | 2262 | C | LEU | B | 79 | −23.082 | −0.689 | 36.000 | 1.00 | 35.99 | C |
| ATOM | 2263 | O | LEU | B | 79 | −23.805 | 0.166 | 35.494 | 1.00 | 30.23 | O |
| ATOM | 2264 | CB | LEU | B | 79 | −22.138 | −2.030 | 34.105 | 1.00 | 32.75 | C |
| ATOM | 2265 | CG | LEU | B | 79 | −20.814 | −1.269 | 34.215 | 1.00 | 31.00 | C |
| ATOM | 2266 | CD1 | LEU | B | 79 | −19.875 | −1.948 | 35.189 | 1.00 | 30.67 | C |
| ATOM | 2267 | CD2 | LEU | B | 79 | −20.151 | −1.129 | 32.853 | 1.00 | 29.83 | C |
| ATOM | 2268 | N | THR | B | 80 | −22.379 | −0.467 | 37.102 | 1.00 | 37.73 | N |
| ATOM | 2269 | CA | THR | B | 80 | −22.390 | 0.852 | 37.711 | 1.00 | 37.01 | C |
| ATOM | 2270 | C | THR | B | 80 | −20.999 | 1.468 | 37.726 | 1.00 | 37.89 | C |
| ATOM | 2271 | O | THR | B | 80 | −20.044 | 0.876 | 38.229 | 1.00 | 33.52 | O |
| ATOM | 2272 | CB | THR | B | 80 | −22.938 | 0.816 | 39.152 | 1.00 | 47.22 | C |
| ATOM | 2273 | CG2 | THR | B | 80 | −22.815 | 2.194 | 39.802 | 1.00 | 42.48 | C |
| ATOM | 2274 | OG1 | THR | B | 80 | −24.316 | 0.427 | 39.130 | 1.00 | 44.17 | O |
| ATOM | 2275 | N | ILE | B | 81 | −20.893 | 2.659 | 37.152 | 1.00 | 36.66 | N |
| ATOM | 2276 | CA | ILE | B | 81 | −19.699 | 3.464 | 37.321 | 1.00 | 35.94 | C |
| ATOM | 2277 | C | ILE | B | 81 | −20.013 | 4.576 | 38.308 | 1.00 | 41.22 | C |
| ATOM | 2278 | O | ILE | B | 81 | −20.729 | 5.527 | 37.984 | 1.00 | 39.45 | O |
| ATOM | 2279 | CB | ILE | B | 81 | −19.206 | 4.068 | 35.997 | 1.00 | 29.74 | C |
| ATOM | 2280 | CG1 | ILE | B | 81 | −19.077 | 2.986 | 34.927 | 1.00 | 31.37 | C |
| ATOM | 2281 | CG2 | ILE | B | 81 | −17.875 | 4.784 | 36.204 | 1.00 | 37.10 | C |
| ATOM | 2282 | CD1 | ILE | B | 81 | −18.674 | 3.527 | 33.563 | 1.00 | 36.05 | C |
| ATOM | 2283 | N | SER | B | 82 | −19.506 | 4.442 | 39.525 | 1.00 | 36.61 | N |
| ATOM | 2284 | CA | SER | B | 82 | −19.621 | 5.521 | 40.489 | 1.00 | 47.92 | C |
| ATOM | 2285 | C | SER | B | 82 | −18.478 | 6.491 | 40.221 | 1.00 | 54.74 | C |
| ATOM | 2286 | O | SER | B | 82 | −17.328 | 6.069 | 40.079 | 1.00 | 68.40 | O |
| ATOM | 2287 | CB | SER | B | 82 | −19.571 | 4.991 | 41.921 | 1.00 | 38.83 | C |
| ATOM | 2288 | OG | SER | B | 82 | −18.240 | 4.674 | 42.287 | 1.00 | 41.65 | O |
| ATOM | 2289 | N | SER | B | 83 | −18.803 | 7.776 | 40.124 | 1.00 | 52.26 | N |
| ATOM | 2290 | CA | SER | B | 83 | −17.818 | 8.825 | 39.853 | 1.00 | 47.12 | C |
| ATOM | 2291 | C | SER | B | 83 | −17.144 | 8.663 | 38.481 | 1.00 | 47.93 | C |
| ATOM | 2292 | O | SER | B | 83 | −15.999 | 8.217 | 38.381 | 1.00 | 37.39 | O |
| ATOM | 2293 | CB | SER | B | 83 | −16.763 | 8.864 | 40.962 | 1.00 | 42.74 | C |
| ATOM | 2294 | OG | SER | B | 83 | −15.929 | 10.003 | 40.831 | 1.00 | 61.34 | O |
| ATOM | 2295 | N | LEU | B | 84 | −17.862 | 9.054 | 37.432 | 1.00 | 39.91 | N |
| ATOM | 2296 | CA | LEU | B | 84 | −17.373 | 8.932 | 36.061 | 1.00 | 40.35 | C |
| ATOM | 2297 | C | LEU | B | 84 | −16.120 | 9.777 | 35.825 | 1.00 | 43.92 | C |
| ATOM | 2298 | O | LEU | B | 84 | −16.079 | 10.954 | 36.188 | 1.00 | 32.91 | O |
| ATOM | 2299 | CB | LEU | B | 84 | −18.470 | 9.334 | 35.072 | 1.00 | 36.00 | C |
| ATOM | 2300 | CG | LEU | B | 84 | −18.281 | 8.902 | 33.616 | 1.00 | 40.11 | C |
| ATOM | 2301 | CD1 | LEU | B | 84 | −18.455 | 7.396 | 33.472 | 1.00 | 34.46 | C |
| ATOM | 2302 | CD2 | LEU | B | 84 | −19.246 | 9.639 | 32.702 | 1.00 | 39.38 | C |
| ATOM | 2303 | N | GLN | B | 85 | −15.103 | 9.166 | 35.221 | 1.00 | 35.37 | N |
| ATOM | 2304 | CA | GLN | B | 85 | −13.839 | 9.844 | 34.940 | 1.00 | 35.03 | C |
| ATOM | 2305 | C | GLN | B | 85 | −13.682 | 10.088 | 33.432 | 1.00 | 35.85 | C |
| ATOM | 2306 | O | GLN | B | 85 | −14.311 | 9.400 | 32.627 | 1.00 | 30.69 | O |
| ATOM | 2307 | CB | GLN | B | 85 | −12.665 | 9.023 | 35.484 | 1.00 | 33.69 | C |
| ATOM | 2308 | CG | GLN | B | 85 | −12.719 | 8.782 | 36.990 | 1.00 | 39.42 | C |
| ATOM | 2309 | CD | GLN | B | 85 | −12.651 | 10.069 | 37.795 | 1.00 | 43.01 | C |
| ATOM | 2310 | NE2 | GLN | B | 85 | −13.732 | 10.386 | 38.500 | 1.00 | 38.02 | N |
| ATOM | 2311 | OE1 | GLN | B | 85 | −11.640 | 10.772 | 37.778 | 1.00 | 40.65 | O |
| ATOM | 2312 | N | PRO | B | 86 | −12.857 | 11.082 | 33.046 | 1.00 | 33.28 | N |
| ATOM | 2313 | CA | PRO | B | 86 | −12.643 | 11.413 | 31.631 | 1.00 | 31.64 | C |
| ATOM | 2314 | C | PRO | B | 86 | −12.220 | 10.209 | 30.792 | 1.00 | 35.32 | C |
| ATOM | 2315 | O | PRO | B | 86 | −12.635 | 10.093 | 29.641 | 1.00 | 30.64 | O |
| ATOM | 2316 | CB | PRO | B | 86 | −11.520 | 12.456 | 31.681 | 1.00 | 34.31 | C |
| ATOM | 2317 | CG | PRO | B | 86 | −11.690 | 13.108 | 33.001 | 1.00 | 42.02 | C |
| ATOM | 2318 | CD | PRO | B | 86 | −12.146 | 12.020 | 33.936 | 1.00 | 35.55 | C |
| ATOM | 2319 | N | GLU | B | 87 | −11.423 | 9.316 | 31.373 | 1.00 | 32.17 | N |
| ATOM | 2320 | CA | GLU | B | 87 | −10.921 | 8.161 | 30.637 | 1.00 | 31.69 | C |

TABLE 10.2-continued

| ATOM | 2321 | C | GLU | B | 87 | −11.975 | 7.063 | 30.470 | 1.00 | 31.13 | C |
|---|---|---|---|---|---|---|---|---|---|---|---|
| ATOM | 2322 | O | GLU | B | 87 | −11.744 | 6.086 | 29.761 | 1.00 | 31.02 | O |
| ATOM | 2323 | CB | GLU | B | 87 | −9.681 | 7.583 | 31.327 | 1.00 | 32.83 | C |
| ATOM | 2324 | CG | GLU | B | 87 | −9.941 | 6.983 | 32.703 | 1.00 | 34.70 | C |
| ATOM | 2325 | CD | GLU | B | 87 | −9.628 | 7.950 | 33.834 | 1.00 | 47.47 | C |
| ATOM | 2326 | OE1 | GLU | B | 87 | −9.890 | 9.166 | 33.681 | 1.00 | 39.21 | O |
| ATOM | 2327 | OE2 | GLU | B | 87 | −9.111 | 7.486 | 34.876 | 1.00 | 49.29 | O |
| ATOM | 2328 | N | ASP | B | 88 | −13.131 | 7.227 | 31.108 | 1.00 | 28.67 | N |
| ATOM | 2329 | CA | ASP | B | 88 | −14.175 | 6.210 | 31.053 | 1.00 | 29.26 | C |
| ATOM | 2330 | C | ASP | B | 88 | −15.032 | 6.315 | 29.787 | 1.00 | 31.41 | C |
| ATOM | 2331 | O | ASP | B | 88 | −15.961 | 5.532 | 29.602 | 1.00 | 31.09 | O |
| ATOM | 2332 | CB | ASP | B | 88 | −15.070 | 6.293 | 32.295 | 1.00 | 32.59 | C |
| ATOM | 2333 | CG | ASP | B | 88 | −14.287 | 6.153 | 33.595 | 1.00 | 39.45 | C |
| ATOM | 2334 | OD1 | ASP | B | 88 | −13.166 | 5.597 | 33.565 | 1.00 | 34.75 | O |
| ATOM | 2335 | OD2 | ASP | B | 88 | −14.794 | 6.595 | 34.650 | 1.00 | 40.00 | O |
| ATOM | 2336 | N | VAL | B | 89 | −14.725 | 7.276 | 28.920 | 1.00 | 27.74 | N |
| ATOM | 2337 | CA | VAL | B | 89 | −15.437 | 7.395 | 27.648 | 1.00 | 29.97 | C |
| ATOM | 2338 | C | VAL | B | 89 | −15.162 | 6.169 | 26.783 | 1.00 | 26.75 | C |
| ATOM | 2339 | O | VAL | B | 89 | −14.020 | 5.928 | 26.391 | 1.00 | 32.52 | O |
| ATOM | 2340 | CB | VAL | B | 89 | −15.029 | 8.662 | 26.862 | 1.00 | 36.47 | C |
| ATOM | 2341 | CG1 | VAL | B | 89 | −15.785 | 8.732 | 25.538 | 1.00 | 36.88 | C |
| ATOM | 2342 | CG2 | VAL | B | 89 | −15.281 | 9.908 | 27.681 | 1.00 | 41.88 | C |
| ATOM | 2343 | N | ALA | B | 90 | −16.209 | 5.410 | 26.479 | 1.00 | 25.10 | N |
| ATOM | 2344 | CA | ALA | B | 90 | −16.063 | 4.149 | 25.764 | 1.00 | 28.51 | C |
| ATOM | 2345 | C | ALA | B | 90 | −17.410 | 3.508 | 25.491 | 1.00 | 30.70 | C |
| ATOM | 2346 | O | ALA | B | 90 | −18.448 | 3.995 | 25.943 | 1.00 | 27.64 | O |
| ATOM | 2347 | CB | ALA | B | 90 | −15.185 | 3.178 | 26.561 | 1.00 | 30.46 | C |
| ATOM | 2348 | N | VAL | B | 91 | −17.377 | 2.401 | 24.755 | 1.00 | 29.92 | N |
| ATOM | 2349 | CA | VAL | B | 91 | −18.539 | 1.542 | 24.606 | 1.00 | 28.27 | C |
| ATOM | 2350 | C | VAL | B | 91 | −18.425 | 0.364 | 25.573 | 1.00 | 33.48 | C |
| ATOM | 2351 | O | VAL | B | 91 | −17.368 | −0.265 | 25.684 | 1.00 | 25.89 | O |
| ATOM | 2352 | CB | VAL | B | 91 | −18.683 | 1.024 | 23.172 | 1.00 | 28.97 | C |
| ATOM | 2353 | CG1 | VAL | B | 91 | −19.940 | 0.178 | 23.045 | 1.00 | 28.55 | C |
| ATOM | 2354 | CG2 | VAL | B | 91 | −18.723 | 2.194 | 22.196 | 1.00 | 29.32 | C |
| ATOM | 2355 | N | TYR | B | 92 | −19.511 | 0.077 | 26.281 | 1.00 | 29.51 | N |
| ATOM | 2356 | CA | TYR | B | 92 | −19.509 | −0.993 | 27.267 | 1.00 | 29.47 | C |
| ATOM | 2357 | C | TYR | B | 92 | −20.379 | −2.148 | 26.793 | 1.00 | 33.18 | C |
| ATOM | 2358 | O | TYR | B | 92 | −21.477 | −1.945 | 26.267 | 1.00 | 29.29 | O |
| ATOM | 2359 | CB | TYR | B | 92 | −19.978 | −0.472 | 28.630 | 1.00 | 23.56 | C |
| ATOM | 2360 | CG | TYR | B | 92 | −19.010 | 0.510 | 29.254 | 1.00 | 27.95 | C |
| ATOM | 2361 | CD2 | TYR | B | 92 | −18.114 | 0.104 | 30.236 | 1.00 | 31.49 | C |
| ATOM | 2362 | CD1 | TYR | B | 92 | −18.978 | 1.841 | 28.848 | 1.00 | 28.41 | C |
| ATOM | 2363 | CE2 | TYR | B | 92 | −17.222 | 0.995 | 30.808 | 1.00 | 26.89 | C |
| ATOM | 2364 | CE1 | TYR | B | 92 | −18.086 | 2.740 | 29.411 | 1.00 | 25.28 | C |
| ATOM | 2365 | CZ | TYR | B | 92 | −17.213 | 2.309 | 30.387 | 1.00 | 27.09 | C |
| ATOM | 2366 | OH | TYR | B | 92 | −16.325 | 3.190 | 30.940 | 1.00 | 27.92 | O |
| ATOM | 2367 | N | TYR | B | 93 | −19.863 | −3.361 | 26.962 | 1.00 | 27.67 | N |
| ATOM | 2368 | CA | TYR | B | 93 | −20.548 | −4.569 | 26.524 | 1.00 | 26.66 | C |
| ATOM | 2369 | C | TYR | B | 93 | −20.725 | −5.548 | 27.673 | 1.00 | 29.56 | C |
| ATOM | 2370 | O | TYR | B | 93 | −19.802 | −5.759 | 28.458 | 1.00 | 27.75 | O |
| ATOM | 2371 | CB | TYR | B | 93 | −19.765 | −5.270 | 25.412 | 1.00 | 25.28 | C |
| ATOM | 2372 | CG | TYR | B | 93 | −19.615 | −4.503 | 24.125 | 1.00 | 28.54 | C |
| ATOM | 2373 | CD2 | TYR | B | 93 | −20.529 | −4.662 | 23.090 | 1.00 | 26.88 | C |
| ATOM | 2374 | CD1 | TYR | B | 93 | −18.540 | −3.644 | 23.928 | 1.00 | 27.13 | C |
| ATOM | 2375 | CE2 | TYR | B | 93 | −20.386 | −3.973 | 21.899 | 1.00 | 32.89 | C |
| ATOM | 2376 | CE1 | TYR | B | 93 | −18.385 | −2.955 | 22.743 | 1.00 | 29.51 | C |
| ATOM | 2377 | CZ | TYR | B | 93 | −19.309 | −3.123 | 21.731 | 1.00 | 32.69 | C |
| ATOM | 2378 | OH | TYR | B | 93 | −19.161 | −2.436 | 20.550 | 1.00 | 33.36 | O |
| ATOM | 2379 | N | CYS | B | 94 | −21.901 | −6.157 | 27.762 | 1.00 | 25.68 | N |
| ATOM | 2380 | CA | CYS | B | 94 | −22.079 | −7.300 | 28.644 | 1.00 | 25.53 | C |
| ATOM | 2381 | C | CYS | B | 94 | −21.899 | −8.557 | 27.810 | 1.00 | 28.07 | C |
| ATOM | 2382 | O | CYS | B | 94 | −22.013 | −8.516 | 26.585 | 1.00 | 28.25 | O |
| ATOM | 2383 | CB | CYS | B | 94 | −23.450 | −7.282 | 29.329 | 1.00 | 30.94 | C |
| ATOM | 2384 | SG | CYS | B | 94 | −24.873 | −7.383 | 28.210 | 1.00 | 35.78 | S |
| ATOM | 2385 | N | GLN | B | 95 | −21.606 | −9.671 | 28.468 | 1.00 | 25.81 | N |
| ATOM | 2386 | CA | GLN | B | 95 | −21.373 | −10.920 | 27.758 | 1.00 | 28.41 | C |
| ATOM | 2387 | C | GLN | B | 95 | −21.819 | −12.093 | 28.612 | 1.00 | 24.10 | C |
| ATOM | 2388 | O | GLN | B | 95 | −21.476 | −12.169 | 29.789 | 1.00 | 33.33 | O |
| ATOM | 2389 | CB | GLN | B | 95 | −19.891 | −11.065 | 27.391 | 1.00 | 24.57 | C |
| ATOM | 2390 | CG | GLN | B | 95 | −19.574 | −12.277 | 26.523 | 1.00 | 27.70 | C |
| ATOM | 2391 | CD | GLN | B | 95 | −18.497 | −13.168 | 27.121 | 1.00 | 30.66 | C |
| ATOM | 2392 | NE2 | GLN | B | 95 | −18.756 | −14.468 | 27.147 | 1.00 | 41.67 | N |
| ATOM | 2393 | OE1 | GLN | B | 95 | −17.452 | −12.695 | 27.557 | 1.00 | 36.39 | O |
| ATOM | 2394 | N | GLN | B | 96 | −22.584 | −13.008 | 28.031 | 1.00 | 30.99 | N |
| ATOM | 2395 | CA | GLN | B | 96 | −22.926 | −14.232 | 28.748 | 1.00 | 28.28 | C |
| ATOM | 2396 | C | GLN | B | 96 | −21.986 | −15.347 | 28.313 | 1.00 | 31.50 | C |
| ATOM | 2397 | O | GLN | B | 96 | −21.612 | −15.447 | 27.141 | 1.00 | 27.92 | O |
| ATOM | 2398 | CB | GLN | B | 96 | −24.392 | −14.630 | 28.517 | 1.00 | 24.83 | C |
| ATOM | 2399 | CG | GLN | B | 96 | −24.737 | −15.108 | 27.104 | 1.00 | 28.68 | C |
| ATOM | 2400 | CD | GLN | B | 96 | −24.439 | −16.586 | 26.876 | 1.00 | 32.36 | C |

TABLE 10.2-continued

| | | | | | | | | | |
|---|---|---|---|---|---|---|---|---|---|
| ATOM | 2401 | NE2 | GLN | B | 96 | −24.396 | −16.992 | 25.611 | 1.00 | 32.40 | N |
| ATOM | 2402 | OE1 | GLN | B | 96 | −24.241 | −17.348 | 27.826 | 1.00 | 32.56 | O |
| ATOM | 2403 | N | TYR | B | 97 | −21.592 | −16.182 | 29.261 | 1.00 | 26.53 | N |
| ATOM | 2404 | CA | TYR | B | 97 | −20.838 | −17.370 | 28.18 | 1.00 | 30.75 | C |
| ATOM | 2405 | C | TYR | B | 97 | −21.465 | −18.571 | 29.608 | 1.00 | 31.37 | C |
| ATOM | 2406 | O | TYR | B | 97 | −20.778 | −19.519 | 29.989 | 1.00 | 28.22 | O |
| ATOM | 2407 | CB | TYR | B | 97 | −19.367 | −17.209 | 29.294 | 1.00 | 27.16 | C |
| ATOM | 2408 | CG | TYR | B | 97 | −19.121 | −16.745 | 30.714 | 1.00 | 30.11 | C |
| ATOM | 2409 | CD2 | TYR | B | 97 | −18.893 | −17.661 | 31.737 | 1.00 | 25.04 | C |
| ATOM | 2410 | CD1 | TYR | B | 97 | −19.093 | −15.390 | 31.026 | 1.00 | 26.12 | C |
| ATOM | 2411 | CE2 | TYR | B | 97 | −18.650 | −17.239 | 33.033 | 1.00 | 26.05 | C |
| ATOM | 2412 | CE1 | TYR | B | 97 | −18.856 | −14.960 | 32.316 | 1.00 | 30.26 | C |
| ATOM | 2413 | CZ | TYR | B | 97 | −18.634 | −15.887 | 33.314 | 1.00 | 28.89 | C |
| ATOM | 2414 | OH | TYR | B | 97 | −18.396 | −15.458 | 34.597 | 1.00 | 29.84 | O |
| ATOM | 2415 | N | TYR | B | 98 | −22.784 | −18.510 | 29.762 | 1.00 | 37.70 | N |
| ATOM | 2416 | CA | TYR | B | 98 | −23.553 | −19.601 | 30.349 | 1.00 | 32.36 | C |
| ATOM | 2417 | C | TYR | B | 98 | −23.579 | −20.801 | 29.410 | 1.00 | 37.08 | C |
| ATOM | 2418 | O | TYR | B | 98 | −23.446 | −21.942 | 29.849 | 1.00 | 37.43 | O |
| ATOM | 2419 | CB | TYR | B | 98 | −24.981 | −19.153 | 30.672 | 1.00 | 32.63 | C |
| ATOM | 2420 | CG | TYR | B | 98 | −25.769 | −20.191 | 31.440 | 1.00 | 40.80 | C |
| ATOM | 2421 | CD1 | TYR | B | 98 | −25.434 | −20.511 | 32.750 | 1.00 | 39.01 | C |
| ATOM | 2422 | CD2 | TYR | B | 98 | −26.844 | −20.853 | 30.857 | 1.00 | 44.09 | C |
| ATOM | 2423 | CE1 | TYR | B | 98 | −26.146 | −21.462 | 33.461 | 1.00 | 46.24 | C |
| ATOM | 2424 | CE2 | TYR | B | 98 | −27.566 | −21.807 | 31.563 | 1.00 | 46.44 | C |
| ATOM | 2425 | CZ | TYR | B | 98 | −27.209 | −22.107 | 32.864 | 1.00 | 48.82 | C |
| ATOM | 2426 | OH | TYR | B | 98 | −27.913 | −23.052 | 33.574 | 1.00 | 61.88 | O |
| ATOM | 2427 | N | ASN | B | 99 | −23.758 | −20.542 | 28.117 | 1.00 | 36.19 | N |
| ATOM | 2428 | CA | ASN | B | 99 | −23.611 | −21.596 | 27.119 | 1.00 | 44.15 | C |
| ATOM | 2429 | C | ASN | B | 99 | −23.116 | −21.074 | 25.778 | 1.00 | 42.06 | C |
| ATOM | 2430 | O | ASN | B | 99 | −23.118 | −19.868 | 25.521 | 1.00 | 43.16 | O |
| ATOM | 2431 | CB | ASN | B | 99 | −24.927 | −22.361 | 26.924 | 1.00 | 49.30 | C |
| ATOM | 2432 | CG | ASN | B | 99 | −26.102 | −21.455 | 26.600 | 1.00 | 51.38 | C |
| ATOM | 2433 | OD1 | ASN | B | 99 | −27.134 | −21.508 | 27.271 | 1.00 | 68.12 | O |
| ATOM | 2434 | ND2 | ASN | B | 99 | −25.959 | −20.628 | 25.568 | 1.00 | 49.12 | N |
| ATOM | 2435 | N | THR | B | 100 | −22.700 | −22.001 | 24.924 | 1.00 | 38.31 | N |
| ATOM | 2436 | CA | THR | B | 100 | −22.195 | −21.657 | 23.607 | 1.00 | 37.71 | C |
| ATOM | 2438 | O | THR | B | 100 | −24.243 | −22.506 | 22.713 | 1.00 | 45.21 | O |
| ATOM | 2439 | CB | THR | B | 100 | −21.076 | −22.618 | 23.173 | 1.00 | 40.81 | C |
| ATOM | 2440 | OG1 | THR | B | 100 | −21.540 | −23.966 | 23.286 | 1.00 | 41.71 | O |
| ATOM | 2441 | CG2 | THR | B | 100 | −19.855 | −22.442 | 24.069 | 1.00 | 34.33 | C |
| ATOM | 2442 | N | PRO | B | 101 | −23.313 | −20.765 | 21.617 | 1.00 | 37.91 | N |
| ATOM | 2443 | CA | PRO | B | 101 | −22.253 | −19.773 | 21.404 | 1.00 | 35.04 | C |
| ATOM | 2444 | C | PRO | B | 101 | −22.295 | −18.613 | 22.395 | 1.00 | 38.94 | C |
| ATOM | 2445 | O | PRO | B | 101 | −23.368 | −18.135 | 22.774 | 1.00 | 33.27 | O |
| ATOM | 2446 | CB | PRO | B | 101 | −22.526 | −19.273 | 19.983 | 1.00 | 36.11 | C |
| ATOM | 2447 | CG | PRO | B | 101 | −24.004 | −19.394 | 19.839 | 1.00 | 36.49 | C |
| ATOM | 2448 | CD | PRO | B | 101 | −24.388 | −20.638 | 20.615 | 1.00 | 42.27 | C |
| ATOM | 2449 | N | VAL | B | 102 | −21.111 | −18.192 | 22.823 | 1.00 | 35.40 | N |
| ATOM | 2450 | CA | VAL | B | 102 | −20.943 | −16.980 | 23.610 | 1.00 | 34.45 | C |
| ATOM | 2451 | C | VAL | B | 102 | −21.531 | −15.794 | 22.858 | 1.00 | 35.11 | C |
| ATOM | 2452 | O | VAL | B | 102 | −21.300 | −15.643 | 21.659 | 1.00 | 30.87 | O |
| ATOM | 2453 | CB | VAL | B | 102 | −19.454 | −16.735 | 23.911 | 1.00 | 38.34 | C |
| ATOM | 2454 | CG1 | VAL | B | 102 | −19.155 | −15.250 | 24.058 | 1.00 | 41.39 | C |
| ATOM | 2455 | CG2 | VAL | B | 102 | −19.046 | −17.509 | 25.142 | 1.00 | 38.42 | C |
| ATOM | 2456 | N | THR | B | 103 | −22.307 | −14.966 | 23.549 | 1.00 | 28.91 | N |
| ATOM | 2457 | CA | THR | B | 103 | −22.929 | −13.817 | 22.901 | 1.00 | 32.04 | C |
| ATOM | 2458 | C | THR | B | 103 | −22.740 | −12.532 | 23.711 | 1.00 | 33.94 | C |
| ATOM | 2459 | O | THR | B | 103 | −22.715 | −12.554 | 24.945 | 1.00 | 30.64 | O |
| ATOM | 2460 | CB | THR | B | 103 | −24.437 | −14.054 | 22.659 | 1.00 | 33.42 | C |
| ATOM | 2461 | CG2 | THR | B | 103 | −24.658 | −15.178 | 21.636 | 1.00 | 30.57 | C |
| ATOM | 2462 | OG1 | THR | B | 103 | −25.068 | −14.415 | 23.890 | 1.00 | 35.52 | O |
| ATOM | 2463 | N | PHE | B | 104 | −22.594 | −11.419 | 22.996 | 1.00 | 27.76 | N |
| ATOM | 2464 | CA | PHE | B | 104 | −22.429 | −10.102 | 23.604 | 1.00 | 32.55 | C |
| ATOM | 2465 | C | PHE | B | 104 | −23.693 | −9.274 | 23.430 | 1.00 | 34.05 | C |
| ATOM | 2466 | O | PHE | B | 104 | −24.481 | −9.520 | 22.519 | 1.00 | 32.37 | O |
| ATOM | 2467 | CB | PHE | B | 104 | −21.257 | −9.342 | 22.971 | 1.00 | 30.42 | C |
| ATOM | 2468 | CG | PHE | B | 104 | −19.915 | −9.986 | 23.175 | 1.00 | 30.59 | C |
| ATOM | 2469 | CD1 | PHE | B | 104 | −19.531 | −11.079 | 22.417 | 1.00 | 27.18 | C |
| ATOM | 2470 | CD2 | PHE | B | 104 | −19.019 | −9.467 | 24.094 | 1.00 | 30.39 | C |
| ATOM | 2471 | CE1 | PHE | B | 104 | −18.289 | −11.660 | 22.590 | 1.00 | 31.59 | C |
| ATOM | 2472 | CE2 | PHE | B | 104 | −17.775 | −10.044 | 24.274 | 1.00 | 31.20 | C |
| ATOM | 2473 | CZ | PHE | B | 104 | −17.411 | −11.144 | 23.519 | 1.00 | 33.50 | C |
| ATOM | 2474 | N | GLY | B | 105 | −23.873 | −8.278 | 24.291 | 1.00 | 34.23 | N |
| ATOM | 2475 | CA | GLY | B | 105 | −24.878 | −7.258 | 24.057 | 1.00 | 26.27 | C |
| ATOM | 2476 | C | GLY | B | 105 | −24.415 | −6.334 | 22.941 | 1.00 | 34.89 | C |
| ATOM | 2477 | O | GLY | B | 105 | −23.264 | −6.413 | 22.509 | 1.00 | 31.29 | O |
| ATOM | 2478 | N | PRO | B | 106 | −25.307 | −5.447 | 22.470 | 1.00 | 35.38 | N |
| ATOM | 2479 | CA | PRO | B | 106 | −25.028 | −4.559 | 21.336 | 1.00 | 33.90 | C |
| ATOM | 2480 | C | PRO | B | 106 | −24.100 | −3.399 | 21.689 | 1.00 | 32.12 | C |
| ATOM | 2481 | O | PRO | B | 106 | −23.610 | −2.715 | 20.794 | 1.00 | 34.27 | O |

TABLE 10.2-continued

| ATOM | 2482 | CB | PRO | B | 106 | −26.417 | −4.037 | 20.956 | 1.00 | 29.01 | C |
|------|------|----|-----|---|-----|---------|--------|--------|------|-------|---|
| ATOM | 2483 | CG | PRO | B | 106 | −27.173 | −4.053 | 22.248 | 1.00 | 37.44 | C |
| ATOM | 2484 | CD | PRO | B | 106 | −26.676 | −5.267 | 22.989 | 1.00 | 33.03 | C |
| ATOM | 2485 | N | GLY | B | 107 | −23.874 | −3.177 | 22.978 | 1.00 | 34.23 | N |
| ATOM | 2486 | CA | GLY | B | 107 | −22.984 | −2.120 | 23.415 | 1.00 | 34.20 | C |
| ATOM | 2487 | C | GLY | B | 107 | −23.701 | −0.843 | 23.807 | 1.00 | 34.29 | C |
| ATOM | 2488 | O | GLY | B | 107 | −24.725 | −0.489 | 23.230 | 1.00 | 37.38 | O |
| ATOM | 2489 | N | THR | B | 108 | −23.149 | −0.148 | 24.795 | 1.00 | 33.98 | N |
| ATOM | 2490 | CA | THR | B | 108 | −23.695 | 1.121 | 25.256 | 1.00 | 35.86 | C |
| ATOM | 2491 | C | THR | B | 108 | −22.617 | 2.190 | 25.231 | 1.00 | 33.06 | C |
| ATOM | 2492 | O | THR | B | 108 | −21.586 | 2.039 | 25.866 | 1.00 | 33.05 | O |
| ATOM | 2493 | CB | THR | B | 108 | −24.251 | 1.016 | 26.690 | 1.00 | 31.62 | C |
| ATOM | 2494 | CG2 | THR | B | 108 | −24.619 | 2.395 | 27.221 | 1.00 | 36.86 | C |
| ATOM | 2495 | OG1 | THR | B | 108 | −25.406 | 0.174 | 26.702 | 1.00 | 36.12 | O |
| ATOM | 2496 | N | LYS | B | 109 | −22.847 | 3.271 | 24.493 | 1.00 | 28.00 | N |
| ATOM | 2497 | CA | LYS | B | 109 | −21.850 | 4.337 | 24.418 | 1.00 | 33.62 | C |
| ATOM | 2498 | C | LYS | B | 109 | −21.956 | 5.254 | 25.634 | 1.00 | 38.15 | C |
| ATOM | 2499 | O | LYS | B | 109 | −23.026 | 5.786 | 25.931 | 1.00 | 41.81 | O |
| ATOM | 2500 | CB | LYS | B | 109 | −22.008 | 5.142 | 23.124 | 1.00 | 36.39 | C |
| ATOM | 2501 | CG | LYS | B | 109 | −22.625 | 4.343 | 21.980 | 1.00 | 56.96 | C |
| ATOM | 2502 | CD | LYS | B | 109 | −21.807 | 4.421 | 20.696 | 1.00 | 56.13 | C |
| ATOM | 2503 | CE | LYS | B | 109 | −21.884 | 5.792 | 20.054 | 1.00 | 62.08 | C |
| ATOM | 2504 | NZ | LYS | B | 109 | −21.138 | 5.822 | 18.763 | 1.00 | 74.82 | N |
| ATOM | 2505 | N | VAL | B | 110 | −20.848 | 5.420 | 26.348 | 1.00 | 32.23 | N |
| ATOM | 2506 | CA | VAL | B | 110 | −20.804 | 6.345 | 27.474 | 1.00 | 29.73 | C |
| ATOM | 2507 | C | VAL | B | 110 | −19.884 | 7.524 | 27.185 | 1.00 | 32.33 | C |
| ATOM | 2508 | O | VAL | B | 110 | −18.699 | 7.340 | 26.904 | 1.00 | 33.08 | O |
| ATOM | 2509 | CB | VAL | B | 110 | −20.328 | 5.659 | 28.765 | 1.00 | 31.47 | C |
| ATOM | 2510 | CG1 | VAL | B | 110 | −20.223 | 6.678 | 29.886 | 1.00 | 29.96 | C |
| ATOM | 2511 | CG2 | VAL | B | 110 | −21.270 | 4.525 | 29.142 | 1.00 | 34.90 | C |
| ATOM | 2512 | N | GLY | B | 111 | −20.440 | 8.730 | 27.249 | 1.00 | 29.76 | N |
| ATOM | 2513 | CA | GLY | B | 111 | −19.666 | 9.945 | 27.076 | 1.00 | 29.88 | C |
| ATOM | 2514 | C | GLY | B | 111 | −19.749 | 10.757 | 28.351 | 1.00 | 39.68 | C |
| ATOM | 2515 | O | GLY | B | 111 | −20.459 | 10.374 | 29.280 | 1.00 | 39.37 | O |
| ATOM | 2516 | N | ILE | B | 112 | −19.030 | 11.872 | 28.416 | 1.00 | 31.76 | N |
| ATOM | 2517 | CA | ILE | B | 112 | −19.082 | 12.697 | 29.613 | 1.00 | 36.49 | C |
| ATOM | 2518 | C | ILE | B | 112 | −19.508 | 14.132 | 29.295 | 1.00 | 41.86 | C |
| ATOM | 2519 | O | ILE | B | 112 | −19.221 | 14.665 | 28.216 | 1.00 | 33.11 | O |
| ATOM | 2520 | CB | ILE | B | 112 | −17.720 | 12.704 | 30.366 | 1.00 | 36.62 | C |
| ATOM | 2521 | CG1 | ILE | B | 112 | −16.745 | 13.711 | 29.766 | 1.00 | 42.34 | C |
| ATOM | 2522 | CG2 | ILE | B | 112 | −17.105 | 11.311 | 30.403 | 1.00 | 53.62 | C |
| ATOM | 2523 | CD1 | ILE | B | 112 | −16.711 | 15.042 | 30.519 | 1.00 | 54.93 | C |
| ATOM | 2524 | O | LYS | B | 113 | −19.210 | 16.754 | 32.044 | 1.00 | 44.16 | O |
| ATOM | 2525 | N | LYS | B | 113 | −20.201 | 14.744 | 30.251 | 1.00 | 37.92 | N |
| ATOM | 2526 | CA | LYS | B | 113 | −20.582 | 16.147 | 30.170 | 1.00 | 39.34 | C |
| ATOM | 2527 | C | LYS | B | 113 | −19.560 | 17.015 | 30.892 | 1.00 | 43.78 | C |
| ATOM | 2528 | CB | LYS | B | 113 | −21.965 | 16.381 | 30.778 | 1.00 | 41.17 | C |
| ATOM | 2529 | CG | LYS | B | 113 | −23.120 | 15.740 | 30.040 | 1.00 | 40.99 | C |
| ATOM | 2530 | CD | LYS | B | 113 | −24.434 | 16.062 | 30.750 | 1.00 | 46.55 | C |
| ATOM | 2531 | CE | LYS | B | 113 | −25.614 | 15.365 | 30.094 | 1.00 | 50.82 | C |
| ATOM | 2532 | NZ | LYS | B | 113 | −26.868 | 15.545 | 30.882 | 1.00 | 66.34 | N |
| ATOM | 2533 | O | ARG | B | 114 | −19.706 | 20.614 | 29.907 | 1.00 | 33.63 | O |
| ATOM | 2534 | N | ARG | B | 114 | −19.080 | 18.045 | 30.208 | 1.00 | 37.75 | N |
| ATOM | 2535 | CA | ARG | B | 114 | −18.179 | 19.009 | 30.821 | 1.00 | 32.69 | C |
| ATOM | 2536 | C | ARG | B | 114 | −18.661 | 20.423 | 30.526 | 1.00 | 32.37 | C |
| ATOM | 2537 | CB | ARG | B | 114 | −16.747 | 18.815 | 30.316 | 1.00 | 29.43 | C |
| ATOM | 2538 | CG | ARG | B | 114 | −16.605 | 18.850 | 28.801 | 1.00 | 32.96 | C |
| ATOM | 2539 | CD | ARG | B | 114 | −15.228 | 19.372 | 28.400 | 1.00 | 29.78 | C |
| ATOM | 2540 | NE | ARG | B | 114 | −15.053 | 20.768 | 28.793 | 1.00 | 30.75 | N |
| ATOM | 2541 | CZ | ARG | B | 114 | −13.893 | 21.418 | 28.775 | 1.00 | 35.05 | C |
| ATOM | 2542 | NH1 | ARG | B | 114 | −13.841 | 22.691 | 29.144 | 1.00 | 37.02 | N |
| ATOM | 2543 | NH2 | ARG | B | 114 | −12.784 | 20.801 | 28.392 | 1.00 | 37.36 | N |
| ATOM | 2544 | O | THR | B | 115 | −17.390 | 22.466 | 28.475 | 1.00 | 30.86 | O |
| ATOM | 2545 | N | THR | B | 115 | −17.898 | 21.413 | 30.968 | 1.00 | 34.13 | N |
| ATOM | 2546 | CA | THR | B | 115 | −18.244 | 22.800 | 30.701 | 1.00 | 37.77 | C |
| ATOM | 2547 | C | THR | B | 115 | −18.146 | 23.108 | 29.207 | 1.00 | 38.67 | C |
| ATOM | 2548 | CB | THR | B | 115 | −17.336 | 23.763 | 31.484 | 1.00 | 35.59 | C |
| ATOM | 2549 | OG1 | THR | B | 115 | −15.972 | 23.545 | 31.106 | 1.00 | 34.24 | O |
| ATOM | 2550 | CG2 | THR | B | 115 | −17.485 | 25.531 | 32.986 | 1.00 | 28.14 | C |
| ATOM | 2551 | N | VAL | B | 116 | −18.932 | 24.080 | 28.762 | 1.00 | 39.57 | N |
| ATOM | 2552 | CA | VAL | B | 116 | −18.884 | 24.545 | 27.383 | 1.00 | 35.06 | C |
| ATOM | 2553 | C | VAL | B | 116 | −17.491 | 25.075 | 27.047 | 1.00 | 35.92 | C |
| ATOM | 2554 | O | VAL | B | 116 | −16.872 | 25.772 | 27.855 | 1.00 | 32.43 | O |
| ATOM | 2555 | CB | VAL | B | 116 | −19.938 | 25.649 | 27.133 | 1.00 | 35.82 | C |
| ATOM | 2556 | CG1 | VAL | B | 116 | −19.734 | 26.295 | 25.778 | 1.00 | 33.41 | C |
| ATOM | 2557 | CG2 | VAL | B | 116 | −21.347 | 25.082 | 27.253 | 1.00 | 29.35 | C |
| ATOM | 2558 | N | ALA | B | 117 | −16.991 | 24.725 | 25.865 | 1.00 | 29.09 | N |
| ATOM | 2559 | CA | ALA | B | 117 | −15.719 | 25.259 | 25.387 | 1.00 | 27.87 | C |
| ATOM | 2560 | C | ALA | B | 117 | −15.829 | 25.618 | 23.913 | 1.00 | 34.19 | C |
| ATOM | 2561 | O | ALA | B | 117 | −16.203 | 24.779 | 23.088 | 1.00 | 29.90 | O |

TABLE 10.2-continued

| | | | | | | | | | | |
|---|---|---|---|---|---|---|---|---|---|---|
| ATOM | 2562 | CB | ALA | B | 117 | −14.589 | 24.258 | 25.615 | 1.00 | 30.76 | C |
| ATOM | 2563 | N | ALA | B | 118 | −15.522 | 26.870 | 23.588 | 1.00 | 32.82 | N |
| ATOM | 2564 | CA | ALA | B | 118 | −15.615 | 27.347 | 22.212 | 1.00 | 34.29 | C |
| ATOM | 2565 | C | ALA | B | 118 | −14.474 | 26.788 | 21.370 | 1.00 | 29.81 | C |
| ATOM | 2566 | O | ALA | B | 118 | −13.357 | 26.625 | 21.858 | 1.00 | 31.85 | O |
| ATOM | 2567 | CB | ALA | B | 118 | −15.614 | 28.877 | 22.173 | 1.00 | 29.49 | C |
| ATOM | 2568 | N | PRO | B | 119 | −14.753 | 26.481 | 20.097 | 1.00 | 31.49 | N |
| ATOM | 2569 | CA | PRO | B | 119 | −13.680 | 25.979 | 19.237 | 1.00 | 32.80 | C |
| ATOM | 2570 | C | PRO | B | 119 | −12.745 | 27.089 | 18.790 | 1.00 | 34.11 | C |
| ATOM | 2571 | O | PRO | B | 119 | −13.190 | 28.218 | 18.601 | 1.00 | 30.89 | O |
| ATOM | 2572 | CB | PRO | B | 119 | −14.436 | 25.404 | 18.039 | 1.00 | 29.59 | C |
| ATOM | 2573 | CG | PRO | B | 119 | −15.668 | 26.247 | 17.957 | 1.00 | 33.03 | C |
| ATOM | 2574 | CO | PRO | B | 119 | −16.043 | 26.559 | 19.386 | 1.00 | 30.58 | C |
| ATOM | 2575 | N | SER | B | 120 | −11.467 | 26.769 | 18.635 | 1.00 | 29.42 | N |
| ATOM | 2576 | CA | SER | B | 120 | −10.567 | 27.624 | 17.878 | 1.00 | 36.74 | C |
| ATOM | 2577 | C | SER | B | 120 | −10.661 | 27.181 | 16.418 | 1.00 | 34.59 | C |
| ATOM | 2578 | O | SER | B | 120 | −10.687 | 25.983 | 16.131 | 1.00 | 33.48 | O |
| ATOM | 2579 | CB | SER | B | 120 | −9.135 | 27.531 | 18.407 | 1.00 | 31.92 | C |
| ATOM | 2580 | OG | SER | B | 120 | −8.627 | 26.219 | 18.245 | 1.00 | 50.83 | O |
| ATOM | 2581 | N | VAL | B | 121 | −10.734 | 28.139 | 15.499 | 1.00 | 34.03 | N |
| ATOM | 2582 | CA | VAL | B | 121 | −11.015 | 27.831 | 14.096 | 1.00 | 29.08 | C |
| ATOM | 2583 | C | VAL | B | 121 | −9.845 | 28.195 | 13.179 | 1.00 | 31.62 | C |
| ATOM | 2584 | O | VAL | B | 121 | −9.239 | 29.257 | 13.314 | 1.00 | 33.72 | O |
| ATOM | 2585 | CB | VAL | B | 121 | −12.300 | 28.560 | 13.616 | 1.00 | 30.04 | C |
| ATOM | 2586 | CG1 | VAL | B | 121 | −12.663 | 28.158 | 12.193 | 1.00 | 30.45 | C |
| ATOM | 2587 | CG2 | VAL | B | 121 | −13.460 | 28.259 | 14.551 | 1.00 | 31.72 | C |
| ATOM | 2588 | N | PHE | B | 122 | −9.534 | 27.295 | 12.251 | 1.00 | 27.86 | N |
| ATOM | 2589 | CA | PHE | B | 122 | −8.463 | 27.498 | 11.283 | 1.00 | 29.57 | C |
| ATOM | 2590 | C | PHE | B | 122 | −8.935 | 27.084 | 9.890 | 1.00 | 39.92 | C |
| ATOM | 2591 | O | PHE | B | 122 | −9.622 | 26.068 | 9.734 | 1.00 | 34.52 | O |
| ATOM | 2592 | CB | PHE | B | 122 | −7.215 | 26.689 | 11.663 | 1.00 | 36.36 | C |
| ATOM | 2593 | CG | PHE | B | 122 | −6.747 | 26.906 | 13.078 | 1.00 | 32.19 | C |
| ATOM | 2594 | CD1 | PHE | B | 122 | −7.271 | 26.158 | 14.117 | 1.00 | 36.97 | C |
| ATOM | 2595 | CD2 | PHE | B | 122 | −5.770 | 27.847 | 13.362 | 1.00 | 34.40 | C |
| ATOM | 2596 | CE1 | PHE | B | 122 | −6.836 | 26.352 | 15.419 | 1.00 | 41.91 | C |
| ATOM | 2597 | CE2 | PHE | B | 122 | −5.330 | 28.044 | 14.661 | 1.00 | 36.84 | C |
| ATOM | 2598 | CZ | PHE | B | 122 | −5.864 | 27.294 | 15.689 | 1.00 | 37.49 | C |
| ATOM | 2599 | N | ILE | B | 123 | −8.566 | 27.862 | 8.879 | 1.00 | 28.07 | N |
| ATOM | 2600 | CA | ILE | B | 123 | −8.915 | 27.528 | 7.505 | 1.00 | 32.41 | C |
| ATOM | 2601 | C | ILE | B | 123 | −7.636 | 27.277 | 6.701 | 1.00 | 32.00 | C |
| ATOM | 2602 | O | ILE | B | 123 | −6.622 | 27.942 | 6.907 | 1.00 | 31.75 | O |
| ATOM | 2603 | CB | ILE | B | 123 | −9.777 | 28.646 | 6.846 | 1.00 | 28.87 | C |
| ATOM | 2604 | CG1 | ILE | B | 123 | −10.347 | 28.183 | 5.502 | 1.00 | 32.47 | C |
| ATOM | 2605 | CG2 | ILE | B | 123 | −8.985 | 29.938 | 6.700 | 1.00 | 28.48 | C |
| ATOM | 2606 | CD1 | ILE | B | 123 | −11.358 | 29.154 | 4.896 | 1.00 | 31.95 | C |
| ATOM | 2607 | N | PHE | B | 124 | −7.679 | 26.291 | 5.811 | 1.00 | 31.26 | N |
| ATOM | 2608 | CA | PHE | B | 124 | −6.514 | 25.928 | 5.009 | 1.00 | 30.58 | C |
| ATOM | 2609 | C | PHE | B | 124 | −6.854 | 25.944 | 3.523 | 1.00 | 35.12 | C |
| ATOM | 2610 | O | PHE | B | 124 | −7.774 | 25.250 | 3.089 | 1.00 | 33.03 | O |
| ATOM | 2611 | CB | PHE | B | 124 | −5.992 | 24.540 | 5.390 | 1.00 | 32.40 | C |
| ATOM | 2612 | CG | PHE | B | 124 | −5.566 | 24.410 | 6.825 | 1.00 | 32.10 | C |
| ATOM | 2613 | CD1 | PHE | B | 124 | −4.314 | 24.842 | 7.232 | 1.00 | 31.26 | C |
| ATOM | 2614 | CD2 | PHE | B | 124 | −6.407 | 23.820 | 7.759 | 1.00 | 31.84 | C |
| ATOM | 2615 | CE1 | PHE | B | 124 | −3.913 | 24.711 | 8.549 | 1.00 | 34.33 | C |
| ATOM | 2616 | CE2 | PHE | B | 124 | −6.015 | 23.684 | 9.076 | 1.00 | 34.28 | C |
| ATOM | 2617 | CZ | PHE | B | 124 | −4.765 | 24.133 | 9.474 | 1.00 | 35.30 | C |
| ATOM | 2618 | N | PRO | B | 125 | −6.107 | 26.731 | 2.734 | 1.00 | 37.67 | N |
| ATOM | 2619 | CA | PRO | B | 125 | −6.296 | 26.753 | 1.278 | 1.00 | 33.34 | C |
| ATOM | 2620 | C | PRO | B | 125 | −5.816 | 25.454 | 0.646 | 1.00 | 32.58 | C |
| ATOM | 2621 | O | PRO | B | 125 | −4.996 | 24.766 | 1.247 | 1.00 | 29.20 | O |
| ATOM | 2622 | CB | PRO | B | 125 | −5.422 | 27.930 | 0.816 | 1.00 | 33.45 | C |
| ATOM | 2623 | CG | PRO | B | 125 | −5.036 | 28.671 | 2.074 | 1.00 | 39.04 | C |
| ATOM | 2624 | CD | PRO | B | 125 | −5.049 | 27.658 | 3.171 | 1.00 | 32.49 | C |
| ATOM | 2625 | N | PRO | B | 126 | −6.307 | 25.126 | −0.557 | 1.00 | 31.25 | N |
| ATOM | 2626 | CA | PRO | B | 126 | −5.736 | 23.974 | −1.263 | 1.00 | 36.87 | C |
| ATOM | 2627 | C | PRO | B | 126 | −4.265 | 24.213 | −1.615 | 1.00 | 37.25 | C |
| ATOM | 2628 | O | PRO | B | 126 | −3.844 | 25.360 | −1.778 | 1.00 | 32.38 | O |
| ATOM | 2629 | CB | PRO | B | 126 | −6.599 | 23.868 | −2.527 | 1.00 | 31.74 | C |
| ATOM | 2630 | CG | PRO | B | 126 | −7.137 | 25.243 | −2.728 | 1.00 | 32.69 | C |
| ATOM | 2631 | CD | PRO | B | 126 | −7.351 | 25.800 | −1.348 | 1.00 | 31.78 | C |
| ATOM | 2632 | N | SER | B | 127 | −3.491 | 23.139 | −1.709 | 1.00 | 33.45 | N |
| ATOM | 2633 | CA | SER | B | 127 | −2.082 | 23.251 | −2.055 | 1.00 | 37.63 | C |
| ATOM | 2634 | C | SER | B | 127 | −1.931 | 23.368 | −3.565 | 1.00 | 41.08 | C |
| ATOM | 2635 | O | SER | B | 127 | −2.812 | 22.939 | −4.317 | 1.00 | 38.62 | O |
| ATOM | 2636 | CB | SER | B | 127 | −1.299 | 22.043 | −1.542 | 1.00 | 33.64 | C |
| ATOM | 2637 | OG | SER | B | 127 | −1.647 | 20.874 | −2.267 | 1.00 | 31.28 | O |
| ATOM | 2638 | N | ASP | B | 128 | −0.814 | 23.938 | −4.008 | 1.00 | 40.33 | N |
| ATOM | 2639 | CA | ASP | B | 128 | −0.544 | 24.044 | −5.437 | 1.00 | 42.97 | C |
| ATOM | 2640 | C | ASP | B | 128 | −0.439 | 22.664 | −6.066 | 1.00 | 36.76 | C |
| ATOM | 2641 | O | ASP | B | 128 | −0.783 | 22.481 | −7.232 | 1.00 | 42.27 | O |

TABLE 10.2-continued

| | | | | | | | | | | |
|---|---|---|---|---|---|---|---|---|---|---|
| ATOM | 2642 | CB | ASP | B | 128 | 0.737 | 24.841 | −5.695 | 1.00 | 46.63 | C |
| ATOM | 2643 | CG | ASP | B | 128 | 0.570 | 26.322 | −5.406 | 1.00 | 59.28 | C |
| ATOM | 2644 | OD1 | ASP | B | 128 | −0.562 | 26.834 | −5.546 | 1.00 | 59.20 | O |
| ATOM | 2645 | OD2 | ASP | B | 128 | 1.570 | 26.974 | −5.040 | 1.00 | 62.56 | O |
| ATOM | 2646 | N | GLU | B | 129 | 0.022 | 21.690 | −5.286 | 1.00 | 37.90 | N |
| ATOM | 2647 | CA | GLU | B | 129 | 0.240 | 20.347 | −5.809 | 1.00 | 41.75 | C |
| ATOM | 2648 | C | GLU | B | 129 | −1.075 | 19.666 | −6.183 | 1.00 | 42.49 | C |
| ATOM | 2649 | O | GLU | B | 129 | −1.157 | 18.982 | −7.202 | 1.00 | 42.15 | O |
| ATOM | 2650 | CB | GLU | B | 129 | 1.008 | 19.489 | −4.800 | 1.00 | 38.29 | C |
| ATOM | 2651 | CG | GLU | B | 129 | 1.521 | 18.181 | −5.394 | 1.00 | 55.48 | C |
| ATOM | 2652 | CD | GLU | B | 129 | 2.471 | 17.435 | −4.469 | 1.00 | 75.53 | C |
| ATOM | 2653 | OE1 | GLU | B | 129 | 3.644 | 17.234 | −4.857 | 1.00 | 78.69 | O |
| ATOM | 2654 | OE2 | GLU | B | 129 | 2.044 | 17.043 | −3.360 | 1.00 | 72.25 | O |
| ATOM | 2655 | N | GLN | B | 130 | −2.104 | 19.857 | −5.365 | 1.00 | 37.24 | N |
| ATOM | 2656 | CA | GLN | B | 130 | −3.403 | 19.259 | −5.654 | 1.00 | 34.81 | C |
| ATOM | 2657 | C | GLN | B | 130 | −4.093 | 19.947 | −6.829 | 1.00 | 35.05 | C |
| ATOM | 2658 | O | GLN | B | 130 | −4.774 | 19.297 | −7.622 | 1.00 | 36.82 | O |
| ATOM | 2659 | CB | GLN | B | 130 | −4.312 | 19.312 | −4.427 | 1.00 | 32.75 | C |
| ATOM | 2660 | CG | GLN | B | 130 | −5.631 | 18.597 | −4.645 | 1.00 | 30.49 | C |
| ATOM | 2661 | CD | GLN | B | 130 | −6.626 | 18.848 | −3.534 | 1.00 | 38.30 | C |
| ATOM | 2662 | NE2 | GLN | B | 130 | −7.643 | 18.000 | −3.456 | 1.00 | 35.08 | N |
| ATOM | 2663 | OE1 | GLN | B | 130 | −6.485 | 19.793 | −2.754 | 1.00 | 31.99 | O |
| ATOM | 2664 | N | LEU | B | 131 | −3.930 | 21.265 | −6.924 | 1.00 | 34.78 | N |
| ATOM | 2665 | CA | LEU | B | 131 | −4.512 | 22.036 | −8.019 | 1.00 | 46.01 | C |
| ATOM | 2666 | C | LEU | B | 131 | −4.044 | 21.506 | −9.369 | 1.00 | 40.30 | C |
| ATOM | 2667 | O | LEU | B | 131 | −4.800 | 21.497 | −10.337 | 1.00 | 49.24 | O |
| ATOM | 2668 | CB | LEU | B | 131 | −4.160 | 23.521 | −7.884 | 1.00 | 39.51 | C |
| ATOM | 2669 | CG | LEU | B | 131 | −4.884 | 24.279 | −6.773 | 1.00 | 41.36 | C |
| ATOM | 2670 | CD1 | LEU | B | 131 | −4.458 | 25.736 | −6.738 | 1.00 | 42.24 | C |
| ATOM | 2671 | CD2 | LEU | B | 131 | −6.385 | 24.168 | −6.956 | 1.00 | 37.48 | C |
| ATOM | 2672 | N | LYS | B | 132 | −2.798 | 21.048 | −9.414 | 1.00 | 43.36 | N |
| ATOM | 2673 | CA | LYS | B | 132 | −2.214 | 20.462 | −10.616 | 1.00 | 47.83 | C |
| ATOM | 2674 | C | LYS | B | 132 | −2.933 | 19.197 | −11.086 | 1.00 | 46.86 | C |
| ATOM | 2675 | O | LYS | B | 132 | −2.715 | 18.740 | −12.206 | 1.00 | 54.52 | O |
| ATOM | 2676 | CB | LYS | B | 132 | −0.737 | 20.146 | −10.373 | 1.00 | 49.58 | C |
| ATOM | 2677 | CG | LYS | B | 132 | 0.229 | 21.216 | −10.868 | 1.00 | 56.15 | C |
| ATOM | 2678 | CD | LYS | B | 132 | 1.614 | 21.060 | −10.241 | 1.00 | 64.07 | C |
| ATOM | 2679 | CE | LYS | B | 132 | 2.009 | 19.593 | −10.066 | 1.00 | 66.31 | C |
| ATOM | 2680 | NZ | LYS | B | 132 | 2.086 | 18.843 | −11.352 | 1.00 | 66.61 | N |
| ATOM | 2681 | N | SER | B | 133 | −3.776 | 18.626 | −10.232 | 1.00 | 47.49 | N |
| ATOM | 2682 | CA | SER | B | 133 | −4.497 | 17.403 | −10.578 | 1.00 | 38.87 | C |
| ATOM | 2683 | C | SER | B | 133 | −5.963 | 17.680 | −10.922 | 1.00 | 45.85 | C |
| ATOM | 2684 | O | SER | B | 133 | −6.718 | 16.757 | −11.226 | 1.00 | 45.58 | O |
| ATOM | 2685 | CB | SER | B | 133 | −4.415 | 16.389 | −9.433 | 1.00 | 48.92 | C |
| ATOM | 2686 | OG | SER | B | 133 | −5.127 | 16.848 | −8.293 | 1.00 | 52.02 | O |
| ATOM | 2687 | N | GLY | B | 134 | −6.365 | 18.947 | −10.858 | 1.00 | 39.38 | N |
| ATOM | 2688 | CA | GLY | B | 134 | −7.692 | 19.349 | −11.294 | 1.00 | 38.72 | C |
| ATOM | 2689 | C | GLY | B | 134 | −8.737 | 19.497 | −10.202 | 1.00 | 40.64 | C |
| ATOM | 2690 | O | GLY | B | 134 | −9.904 | 19.767 | −10.488 | 1.00 | 47.67 | O |
| ATOM | 2691 | N | THR | B | 135 | −8.320 | 19.335 | −8.951 | 1.00 | 44.09 | N |
| ATOM | 2692 | CA | THR | B | 135 | −9.239 | 19.382 | −7.816 | 1.00 | 41.60 | C |
| ATOM | 2693 | C | THR | B | 135 | −8.700 | 20.294 | −6.716 | 1.00 | 38.79 | C |
| ATOM | 2694 | O | THR | B | 135 | −7.490 | 20.386 | −6.515 | 1.00 | 39.11 | O |
| ATOM | 2695 | CB | THR | B | 135 | −9.485 | 17.965 | −7.246 | 1.00 | 42.58 | C |
| ATOM | 2696 | CG2 | THR | B | 135 | −10.545 | 17.982 | −6.153 | 1.00 | 36.34 | C |
| ATOM | 2697 | OG1 | THR | B | 135 | −9.910 | 17.092 | −8.300 | 1.00 | 49.29 | O |
| ATOM | 2698 | N | ALA | B | 136 | −9.599 | 20.979 | −6.016 | 1.00 | 39.56 | N |
| ATOM | 2699 | CA | ALA | B | 136 | −9.218 | 21.845 | −4.907 | 1.00 | 31.14 | C |
| ATOM | 2700 | C | ALA | B | 136 | −9.980 | 21.476 | −3.637 | 1.00 | 41.19 | C |
| ATOM | 2701 | O | ALA | B | 136 | −11.211 | 21.514 | −3.609 | 1.00 | 38.90 | O |
| ATOM | 2702 | CB | ALA | B | 136 | −9.465 | 23.300 | −5.257 | 1.00 | 30.89 | C |
| ATOM | 2703 | N | SER | B | 137 | −9.243 | 21.121 | −2.588 | 1.00 | 32.83 | N |
| ATOM | 2704 | CA | SER | B | 137 | −9.844 | 20.823 | −1.295 | 1.00 | 29.16 | C |
| ATOM | 2705 | C | SER | B | 137 | −9.551 | 21.947 | −0.312 | 1.00 | 31.90 | C |
| ATOM | 2706 | O | SER | B | 137 | −8.391 | 22.273 | −0.060 | 1.00 | 32.52 | O |
| ATOM | 2707 | CB | SER | B | 137 | −9.325 | 19.493 | −0.742 | 1.00 | 31.20 | C |
| ATOM | 2708 | OG | SER | B | 137 | −9.665 | 18.411 | −1.588 | 1.00 | 35.83 | O |
| ATOM | 2709 | N | VAL | B | 138 | −10.605 | 22.549 | 0.227 | 1.00 | 29.38 | N |
| ATOM | 2710 | CA | VAL | B | 138 | −10.455 | 23.578 | 1.250 | 1.00 | 28.61 | C |
| ATOM | 2711 | C | VAL | B | 138 | −10.856 | 22.986 | 2.596 | 1.00 | 28.33 | C |
| ATOM | 2712 | O | VAL | B | 138 | −11.896 | 22.332 | 2.708 | 1.00 | 28.89 | O |
| ATOM | 2713 | CB | VAL | B | 138 | −11.304 | 24.821 | 0.943 | 1.00 | 32.25 | C |
| ATOM | 2714 | CG1 | VAL | B | 138 | −10.880 | 25.981 | 1.825 | 1.00 | 32.25 | C |
| ATOM | 2715 | CG2 | VAL | B | 138 | −11.171 | 25.197 | −0.524 | 1.00 | 34.85 | C |
| ATOM | 2716 | N | VAL | B | 139 | −10.031 | 23.208 | 3.615 | 1.00 | 27.05 | N |
| ATOM | 2717 | CA | VAL | B | 139 | −10.241 | 22.558 | 4.906 | 1.00 | 30.66 | C |
| ATOM | 2718 | C | VAL | B | 139 | −10.472 | 23.556 | 6.033 | 1.00 | 28.68 | C |
| ATOM | 2719 | O | VAL | B | 139 | −9.741 | 24.537 | 6.173 | 1.00 | 29.77 | O |
| ATOM | 2720 | CB | VAL | B | 139 | −9.042 | 21.646 | 5.267 | 1.00 | 31.42 | C |
| ATOM | 2721 | CG1 | VAL | B | 139 | −9.199 | 21.067 | 6.665 | 1.00 | 30.03 | C |

TABLE 10.2-continued

| | | | | | | | | | | |
|---|---|---|---|---|---|---|---|---|---|---|
| ATOM | 2722 | CG2 | VAL | B | 139 | −8.904 | 20.529 | 4.239 | 1.00 | 29.56 | C |
| ATOM | 2723 | N | CYS | B | 140 | −11.507 | 23.300 | 6.826 | 1.00 | 31.41 | N |
| ATOM | 2724 | CA | CYS | B | 140 | −11.792 | 24.088 | 8.015 | 1.00 | 30.57 | C |
| ATOM | 2725 | C | CYS | B | 140 | −11.634 | 23.207 | 9.245 | 1.00 | 36.50 | C |
| ATOM | 2726 | O | CYS | B | 140 | −12.198 | 22.113 | 9.306 | 1.00 | 29.35 | O |
| ATOM | 2727 | CB | CYS | B | 140 | −13.205 | 24.672 | 7.960 | 1.00 | 32.78 | C |
| ATOM | 2728 | SG | CYS | B | 140 | −13.561 | 25.937 | 9.212 | 1.00 | 47.42 | S |
| ATOM | 2729 | N | LEU | B | 141 | −10.871 | 23.686 | 10.222 | 1.00 | 34.12 | N |
| ATOM | 2730 | CA | LEU | B | 141 | −10.629 | 22.931 | 11.444 | 1.00 | 30.81 | C |
| ATOM | 2731 | C | LEU | B | 141 | −11.230 | 23.619 | 12.672 | 1.00 | 33.78 | C |
| ATOM | 2732 | O | LEU | B | 141 | −11.006 | 24.809 | 12.904 | 1.00 | 32.21 | O |
| ATOM | 2733 | CB | LEU | B | 141 | −9.126 | 22.721 | 11.649 | 1.00 | 30.25 | C |
| ATOM | 2734 | CG | LEU | B | 141 | −8.728 | 22.199 | 13.032 | 1.00 | 33.72 | C |
| ATOM | 2735 | CD1 | LEU | B | 141 | −9.143 | 20.737 | 13.205 | 1.00 | 28.38 | C |
| ATOM | 2736 | CD2 | LEU | B | 141 | −7.234 | 22.383 | 13.280 | 1.00 | 35.34 | C |
| ATOM | 2737 | N | LEU | B | 142 | −12.006 | 22.862 | 13.442 | 1.00 | 25.85 | N |
| ATOM | 2738 | CA | LEU | B | 142 | −12.538 | 23.331 | 14.721 | 1.00 | 29.63 | C |
| ATOM | 2739 | C | LEU | B | 142 | −11.865 | 22.526 | 15.822 | 1.00 | 31.52 | C |
| ATOM | 2740 | O | LEU | B | 142 | −11.966 | 21.300 | 15.848 | 1.00 | 32.17 | O |
| ATOM | 2741 | CB | LEU | B | 142 | −14.062 | 23.177 | 14.796 | 1.00 | 28.07 | C |
| ATOM | 2742 | CG | LEU | B | 142 | −14.992 | 24.140 | 14.044 | 1.00 | 29.90 | C |
| ATOM | 2743 | CD1 | LEU | B | 142 | −14.697 | 24.189 | 12.550 | 1.00 | 36.79 | C |
| ATOM | 2744 | CD2 | LEU | B | 142 | −16.440 | 23.731 | 14.274 | 1.00 | 27.06 | C |
| ATOM | 2745 | N | ASN | B | 143 | −11.174 | 23.209 | 16.723 | 1.00 | 25.29 | N |
| ATOM | 2746 | CA | ASN | B | 143 | −10.291 | 22.521 | 17.648 | 1.00 | 31.88 | C |
| ATOM | 2747 | C | ASN | B | 143 | −10.754 | 22.593 | 19.100 | 1.00 | 34.33 | C |
| ATOM | 2748 | O | ASN | B | 143 | −11.042 | 23.673 | 19.618 | 1.00 | 32.56 | O |
| ATOM | 2749 | CB | ASN | B | 143 | −8.876 | 23.089 | 17.512 | 1.00 | 32.86 | C |
| ATOM | 2750 | CG | ASN | B | 143 | −7.813 | 22.134 | 18.016 | 1.00 | 43.50 | C |
| ATOM | 2751 | ND2 | ASN | B | 143 | −7.037 | 22.574 | 18.997 | 1.00 | 47.72 | N |
| ATOM | 2752 | OD1 | ASN | B | 143 | −7.683 | 21.018 | 17.518 | 1.00 | 44.96 | O |
| ATOM | 2753 | N | ASN | B | 144 | −10.840 | 21.421 | 19.733 | 1.00 | 33.53 | N |
| ATOM | 2754 | CA | ASN | B | 144 | −11.100 | 21.284 | 21.171 | 1.00 | 31.24 | C |
| ATOM | 2755 | C | ASN | B | 144 | −12.330 | 22.023 | 21.688 | 1.00 | 29.06 | C |
| ATOM | 2756 | O | ASN | B | 144 | −12.211 | 22.953 | 22.482 | 1.00 | 33.00 | O |
| ATOM | 2757 | CB | ASN | B | 144 | −9.873 | 21.743 | 21.962 | 1.00 | 30.14 | C |
| ATOM | 2758 | CG | ASN | B | 144 | −8.626 | 20.965 | 21.598 | 1.00 | 37.05 | C |
| ATOM | 2759 | ND2 | ASN | B | 144 | −7.468 | 21.575 | 21.802 | 1.00 | 43.00 | N |
| ATOM | 2760 | OD1 | ASN | B | 144 | −8.704 | 19.827 | 21.134 | 1.00 | 38.36 | O |
| ATOM | 2761 | N | PHE | B | 145 | −13.513 | 21.602 | 21.258 | 1.00 | 31.89 | N |
| ATOM | 2762 | CA | PHE | B | 145 | −14.732 | 22.260 | 21.706 | 1.00 | 29.94 | C |
| ATOM | 2763 | C | PHE | B | 145 | −15.672 | 21.295 | 22.416 | 1.00 | 34.88 | C |
| ATOM | 2764 | O | PHE | B | 145 | −15.533 | 20.074 | 22.317 | 1.00 | 26.87 | O |
| ATOM | 2765 | CB | PHE | B | 145 | −15.455 | 22.936 | 20.529 | 1.00 | 26.54 | C |
| ATOM | 2766 | CG | PHE | B | 145 | −15.846 | 21.994 | 19.418 | 1.00 | 27.20 | C |
| ATOM | 2767 | CD1 | PHE | B | 145 | −14.961 | 21.705 | 18.392 | 1.00 | 25.82 | C |
| ATOM | 2768 | CD2 | PHE | B | 145 | −17.102 | 21.413 | 19.392 | 1.00 | 29.78 | C |
| ATOM | 2769 | CE1 | PHE | B | 145 | −15.316 | 20.839 | 17.368 | 1.00 | 27.58 | C |
| ATOM | 2770 | CE2 | PHE | B | 145 | −17.467 | 20.551 | 18.372 | 1.00 | 29.41 | C |
| ATOM | 2771 | CZ | PHE | B | 145 | −16.569 | 20.263 | 17.356 | 1.00 | 27.09 | C |
| ATOM | 2772 | N | TYR | B | 146 | −16.619 | 21.871 | 23.149 | 1.00 | 28.10 | N |
| ATOM | 2773 | CA | TYR | B | 146 | −17.698 | 21.125 | 23.778 | 1.00 | 30.54 | C |
| ATOM | 2774 | C | TYR | B | 145 | −18.886 | 22.071 | 23.962 | 1.00 | 29.20 | C |
| ATOM | 2775 | O | TYR | B | 146 | −18.702 | 23.217 | 24.364 | 1.00 | 28.71 | O |
| ATOM | 2776 | CB | TYR | B | 146 | −17.262 | 20.527 | 25.128 | 1.00 | 31.96 | C |
| ATOM | 2777 | CG | TYR | B | 146 | −18.319 | 19.621 | 25.711 | 1.00 | 34.78 | C |
| ATOM | 2778 | CD2 | TYR | B | 146 | −18.334 | 18.262 | 25.418 | 1.00 | 31.97 | C |
| ATOM | 2779 | CD1 | TYR | B | 146 | −19.334 | 20.131 | 26.515 | 1.00 | 31.84 | C |
| ATOM | 2780 | CE2 | TYR | R | 146 | −19.319 | 17.432 | 25.925 | 1.00 | 32.92 | C |
| ATOM | 2781 | CE1 | TYR | B | 146 | −20.324 | 19.311 | 27.022 | 1.00 | 32.17 | C |
| ATOM | 2782 | CZ | TYR | B | 146 | −20.310 | 17.965 | 26.725 | 1.00 | 34.30 | C |
| ATOM | 2783 | OH | TYR | B | 146 | −21.291 | 17.149 | 27.228 | 1.00 | 42.60 | O |
| ATOM | 2784 | N | PRO | B | 147 | −20.112 | 21.593 | 23.695 | 1.00 | 25.21 | N |
| ATOM | 2785 | CA | PRO | B | 147 | −20.474 | 20.225 | 23.311 | 1.00 | 31.43 | C |
| ATOM | 2786 | C | PRO | B | 147 | −20.233 | 19.921 | 21.838 | 1.00 | 34.10 | C |
| ATOM | 2787 | O | PRO | B | 147 | −19.696 | 20.751 | 21.103 | 1.00 | 33.70 | O |
| ATOM | 2788 | CB | PRO | B | 147 | −21.967 | 20.159 | 23.643 | 1.00 | 32.07 | C |
| ATOM | 2789 | CG | PRO | B | 147 | −22.446 | 21.552 | 23.429 | 1.00 | 27.75 | C |
| ATOM | 2790 | CD | PRO | B | 147 | −21.301 | 22.453 | 23.836 | 1.00 | 31.95 | C |
| ATOM | 2791 | N | ARG | B | 148 | −20.646 | 18.725 | 21.434 | 1.00 | 34.40 | N |
| ATOM | 2792 | CA | ARG | B | 148 | −20.383 | 18.168 | 20.110 | 1.00 | 32.34 | C |
| ATOM | 2793 | C | ARG | B | 148 | −21.069 | 18.932 | 18.975 | 1.00 | 32.84 | C |
| ATOM | 2794 | O | ARG | B | 148 | −20.505 | 19.087 | 17.892 | 1.00 | 29.63 | O |
| ATOM | 2795 | CB | ARG | B | 148 | −20.823 | 16.700 | 20.101 | 1.00 | 35.79 | C |
| ATOM | 2796 | CG | ARG | B | 148 | −20.923 | 16.051 | 18.744 | 1.00 | 41.03 | C |
| ATOM | 2797 | CD | ARG | B | 148 | −19.703 | 15.208 | 18.453 | 1.00 | 47.90 | C |
| ATOM | 2798 | NE | ARG | B | 148 | −20.044 | 13.980 | 17.738 | 1.00 | 56.46 | N |
| ATOM | 2799 | CZ | ARG | B | 148 | −20.405 | 13.932 | 16.458 | 1.00 | 56.76 | C |
| ATOM | 2800 | NH1 | ARG | B | 148 | −20.485 | 15.048 | 15.740 | 1.00 | 54.31 | N |
| ATOM | 2801 | NH2 | ARG | B | 148 | −20.688 | 12.767 | 15.893 | 1.00 | 51.59 | N |

TABLE 10.2-continued

| ATOM | 2802 | N | GLU | B | 149 | −22.284 | 19.404 | 19.230 | 1.00 | 36.40 | N |
|------|------|----|-----|---|-----|---------|--------|--------|------|-------|---|
| ATOM | 2803 | CA | GLU | B | 149 | −23.068 | 20.115 | 18.224 | 1.00 | 39.72 | C |
| ATOM | 2804 | C | GLU | B | 149 | −22.387 | 21.403 | 17.779 | 1.00 | 39.89 | C |
| ATOM | 2805 | O | GLU | B | 149 | −22.182 | 22.319 | 18.577 | 1.00 | 39.53 | O |
| ATOM | 2806 | CB | GLU | B | 149 | −24.473 | 20.431 | 18.755 | 1.00 | 34.93 | C |
| ATOM | 2807 | CG | GLU | B | 149 | −25.369 | 19.209 | 18.956 | 1.00 | 45.72 | C |
| ATOM | 2808 | CD | GLU | B | 149 | −24.967 | 18.363 | 20.158 | 1.00 | 54.80 | C |
| ATOM | 2809 | OE1 | GLU | B | 149 | −24.402 | 18.920 | 21.125 | 1.00 | 48.46 | O |
| ATOM | 2810 | OE2 | GLU | B | 149 | −25.211 | 17.138 | 20.130 | 1.00 | 62.82 | O |
| ATOM | 2811 | N | ALA | B | 150 | −22.042 | 21.462 | 16.498 | 1.00 | 35.98 | N |
| ATOM | 2812 | CA | ALA | B | 150 | −21.432 | 22.649 | 15.914 | 1.00 | 37.14 | C |
| ATOM | 2813 | C | ALA | B | 150 | −21.867 | 22.779 | 14.465 | 1.00 | 43.97 | C |
| ATOM | 2814 | O | ALA | B | 150 | −22.094 | 21.778 | 13.786 | 1.00 | 46.01 | O |
| ATOM | 2815 | CB | ALA | B | 150 | −19.914 | 22.586 | 16.014 | 1.00 | 32.49 | C |
| ATOM | 2816 | N | LYS | B | 151 | −21.987 | 24.012 | 13.992 | 1.00 | 39.41 | N |
| ATOM | 2817 | CA | LYS | B | 151 | −22.417 | 24.246 | 12.624 | 1.00 | 43.48 | C |
| ATOM | 2818 | C | LYS | B | 151 | −21.319 | 24.913 | 11.807 | 1.00 | 39.53 | C |
| ATOM | 2819 | O | LYS | B | 151 | −20.799 | 25.966 | 12.179 | 1.00 | 36.87 | O |
| ATOM | 2820 | CB | LYS | B | 151 | −23.687 | 25.099 | 12.596 | 1.00 | 43.88 | C |
| ATOM | 2821 | CG | LYS | B | 151 | −24.256 | 25.301 | 11.196 | 1.00 | 55.40 | C |
| ATOM | 2822 | CD | LYS | B | 151 | −25.547 | 26.104 | 11.223 | 1.00 | 53.19 | C |
| ATOM | 2823 | CE | LYS | B | 151 | −26.147 | 26.222 | 9.830 | 1.00 | 70.97 | C |
| ATOM | 2824 | NZ | LYS | B | 151 | −27.463 | 26.923 | 9.839 | 1.00 | 84.38 | N |
| ATOM | 2825 | N | VAL | B | 152 | −20.968 | 24.282 | 10.694 | 1.00 | 36.81 | N |
| ATOM | 2826 | CA | VAL | B | 152 | −19.990 | 24.837 | 9.774 | 1.00 | 37.97 | C |
| ATOM | 2827 | C | VAL | B | 152 | −20.652 | 25.168 | 8.446 | 1.00 | 36.38 | C |
| ATOM | 2828 | O | VAL | B | 152 | −21.221 | 24.292 | 7.790 | 1.00 | 36.25 | O |
| ATOM | 2829 | CB | VAL | B | 152 | −18.820 | 23.867 | 9.535 | 1.00 | 39.90 | C |
| ATOM | 2830 | CG1 | VAL | B | 152 | −17.884 | 24.420 | 8.470 | 1.00 | 35.36 | C |
| ATOM | 2831 | CG2 | VAL | B | 152 | −18.078 | 23.614 | 10.834 | 1.00 | 39.55 | C |
| ATOM | 2832 | N | GLN | B | 153 | −20.590 | 26.437 | 8.060 | 1.00 | 32.64 | N |
| ATOM | 2833 | CA | GLN | B | 153 | −21.118 | 26.864 | 6.771 | 1.00 | 34.66 | C |
| ATOM | 2834 | C | GLN | B | 153 | −19.999 | 27.378 | 5.884 | 1.00 | 38.08 | C |
| ATOM | 2835 | O | GLN | B | 153 | −19.290 | 28.319 | 6.244 | 1.00 | 38.02 | O |
| ATOM | 2836 | CB | GLN | B | 153 | −22.187 | 27.946 | 6.946 | 1.00 | 37.83 | C |
| ATOM | 2837 | CG | GLN | B | 153 | −23.590 | 27.404 | 7.164 | 1.00 | 60.26 | C |
| ATOM | 2838 | CD | GLN | B | 153 | −24.596 | 28.498 | 7.470 | 1.00 | 67.71 | C |
| ATOM | 2839 | NE2 | GLN | B | 153 | −25.857 | 28.257 | 7.123 | 1.00 | 56.86 | N |
| ATOM | 2840 | OE1 | GLN | B | 153 | −24.244 | 29.548 | 8.009 | 1.00 | 70.19 | O |
| ATOM | 2841 | N | TRP | B | 154 | −19.840 | 26.747 | 4.727 | 1.00 | 31.58 | N |
| ATOM | 2842 | CA | TRP | B | 154 | −18.864 | 27.189 | 3.747 | 1.00 | 27.44 | C |
| ATOM | 2843 | C | TRP | B | 154 | −19.449 | 28.300 | 2.884 | 1.00 | 33.80 | C |
| ATOM | 2844 | O | TRP | B | 154 | −20.592 | 28.209 | 2.436 | 1.00 | 30.68 | O |
| ATOM | 2845 | CB | TRP | B | 154 | −18.415 | 26.022 | 2.869 | 1.00 | 25.14 | C |
| ATOM | 2846 | CG | TRP | B | 154 | −17.449 | 25.089 | 3.532 | 1.00 | 34.77 | C |
| ATOM | 2847 | CD1 | TRP | B | 154 | −17.729 | 23.870 | 4.080 | 1.00 | 29.48 | C |
| ATOM | 2848 | CD2 | TRP | B | 154 | −16.042 | 25.295 | 3.709 | 1.00 | 33.52 | C |
| ATOM | 2849 | CE2 | TRP | B | 154 | −15.534 | 24.159 | 4.369 | 1.00 | 36.13 | C |
| ATOM | 2850 | CE3 | TRP | B | 154 | −15.163 | 26.328 | 3.370 | 1.00 | 28.50 | C |
| ATOM | 2851 | NE1 | TRP | B | 154 | −16.584 | 23.304 | 4.582 | 1.00 | 32.42 | N |
| ATOM | 2852 | CZ2 | TRP | B | 154 | −14.186 | 24.028 | 4.697 | 1.00 | 35.02 | C |
| ATOM | 2853 | CZ3 | TRP | B | 154 | −13.827 | 26.199 | 3.699 | 1.00 | 32.42 | C |
| ATOM | 2854 | CH2 | TRP | B | 154 | −13.350 | 25.056 | 4.355 | 1.00 | 33.88 | C |
| ATOM | 2855 | N | LYS | B | 155 | −18.661 | 29.343 | 2.652 | 1.00 | 26.76 | N |
| ATOM | 2856 | CA | LYS | B | 155 | −19.089 | 30.458 | 1.818 | 1.00 | 34.70 | C |
| ATOM | 2857 | C | LYS | B | 155 | −18.018 | 30.803 | 0.795 | 1.00 | 35.14 | C |
| ATOM | 2858 | O | LYS | B | 155 | −16.869 | 31.063 | 1.149 | 1.00 | 34.32 | O |
| ATOM | 2859 | CB | LYS | B | 155 | −19.415 | 31.685 | 2.671 | 1.00 | 31.08 | C |
| ATOM | 2860 | CG | LYS | B | 155 | −20.658 | 31.527 | 3.525 | 1.00 | 39.61 | C |
| ATOM | 2861 | CD | LYS | B | 155 | −20.861 | 32.722 | 4.439 | 1.00 | 45.78 | C |
| ATOM | 2862 | CE | LYS | B | 155 | −22.086 | 32.531 | 5.322 | 1.00 | 52.43 | C |
| ATOM | 2863 | NZ | LYS | B | 155 | −22.240 | 33.644 | 6.300 | 1.00 | 64.93 | N |
| ATOM | 2864 | N | VAL | B | 156 | −18.404 | 30.787 | −0.474 | 1.00 | 33.51 | N |
| ATOM | 2865 | CA | VAL | B | 156 | −17.512 | 31.163 | −1.562 | 1.00 | 34.85 | C |
| ATOM | 2866 | C | VAL | B | 156 | −18.043 | 32.430 | −2.235 | 1.00 | 37.05 | C |
| ATOM | 2867 | O | VAL | B | 156 | −19.085 | 32.398 | −2.889 | 1.00 | 36.43 | O |
| ATOM | 2868 | CB | VAL | B | 156 | −17.378 | 30.035 | −2.590 | 1.00 | 37.60 | C |
| ATOM | 2869 | CG1 | VAL | B | 156 | −16.452 | 30.450 | −3.701 | 1.00 | 36.02 | C |
| ATOM | 2870 | CG2 | VAL | B | 156 | −16.863 | 28.772 | −1.921 | 1.00 | 31.56 | C |
| ATOM | 2871 | N | ASP | B | 157 | −17.321 | 33.536 | −2.060 | 1.00 | 38.87 | N |
| ATOM | 2872 | CA | ASP | B | 157 | −17.785 | 34.866 | −2.468 | 1.00 | 41.38 | C |
| ATOM | 2873 | C | ASP | B | 157 | −19.196 | 35.139 | −1.951 | 1.00 | 44.37 | C |
| ATOM | 2874 | O | ASP | B | 157 | −20.058 | 35.627 | −2.684 | 1.00 | 49.49 | O |
| ATOM | 2875 | CB | ASP | B | 157 | −17.733 | 35.023 | −3.991 | 1.00 | 42.34 | C |
| ATOM | 2876 | CG | ASP | B | 157 | −16.326 | 35.296 | −4.499 | 1.00 | 44.58 | C |
| ATOM | 2877 | OD1 | ASP | B | 157 | −15.517 | 35.866 | −3.734 | 1.00 | 49.40 | O |
| ATOM | 2878 | OD2 | ASP | B | 157 | −16.029 | 34.942 | −5.659 | 1.00 | 49.33 | O |
| ATOM | 2879 | N | ASN | B | 158 | −19.405 | 34.809 | −0.678 | 1.00 | 38.79 | N |
| ATOM | 2880 | CA | ASN | B | 158 | −20.688 | 34.958 | 0.016 | 1.00 | 46.07 | C |
| ATOM | 2881 | C | ASN | B | 158 | −21.827 | 34.101 | −0.535 | 1.00 | 42.73 | C |

TABLE 10.2-continued

| ATOM | 2882 | O | ASN | B | 158 | −22.992 | 34.335 | −0.218 | 1.00 | 49.48 | O |
|---|---|---|---|---|---|---|---|---|---|---|---|
| ATOM | 2883 | CB | ASN | B | 158 | −21.115 | 36.426 | 0.033 | 1.00 | 47.14 | C |
| ATOM | 2884 | CG | ASN | B | 158 | −20.716 | 37.122 | 1.313 | 1.00 | 64.92 | C |
| ATOM | 2885 | ND2 | ASN | B | 158 | −20.238 | 38.356 | 1.196 | 1.00 | 70.04 | N |
| ATOM | 2886 | OD1 | ASN | B | 158 | −20.825 | 36.549 | 2.400 | 1.00 | 67.22 | O |
| ATOM | 2887 | N | ALA | B | 159 | −21.497 | 33.100 | −1.341 | 1.00 | 37.66 | N |
| ATOM | 2888 | CA | ALA | B | 159 | −22.492 | 32.110 | −1.731 | 1.00 | 37.19 | C |
| ATOM | 2889 | C | ALA | B | 159 | −22.368 | 30.887 | −0.823 | 1.00 | 39.41 | C |
| ATOM | 2890 | O | ALA | B | 159 | −21.298 | 30.285 | −0.720 | 1.00 | 32.50 | O |
| ATOM | 2891 | CB | ALA | B | 159 | −22.330 | 31.717 | −3.191 | 1.00 | 30.09 | C |
| ATOM | 2892 | N | LEU | B | 160 | −23.464 | 30.537 | −0.159 | 1.00 | 34.32 | N |
| ATOM | 2893 | CA | LEU | B | 160 | −23.496 | 29.376 | 0.720 | 1.00 | 29.40 | C |
| ATOM | 2894 | C | LEU | B | 160 | −23.360 | 28.083 | −0.073 | 1.00 | 33.09 | C |
| ATOM | 2895 | O | LEU | B | 160 | −24.083 | 27.858 | −1.044 | 1.00 | 36.96 | O |
| ATOM | 2896 | CB | LEU | B | 160 | −24.790 | 29.348 | 1.540 | 1.00 | 37.86 | C |
| ATOM | 2897 | CG | LEU | B | 160 | −24.960 | 30.336 | 2.701 | 1.00 | 54.68 | C |
| ATOM | 2898 | CD1 | LEU | B | 160 | −25.190 | 31.767 | 2.222 | 1.00 | 48.85 | C |
| ATOM | 2899 | CD2 | LEU | B | 160 | −26.100 | 29.883 | 3.608 | 1.00 | 60.01 | C |
| ATOM | 2900 | N | GLN | B | 161 | −22.427 | 27.238 | 0.347 | 1.00 | 30.58 | N |
| ATOM | 2901 | CA | GLN | B | 161 | −22.206 | 25.943 | −0.284 | 1.00 | 30.22 | C |
| ATOM | 2902 | C | GLN | B | 161 | −22.919 | 24.850 | 0.499 | 1.00 | 35.29 | C |
| ATOM | 2903 | O | GLN | B | 161 | −22.868 | 24.821 | 1.727 | 1.00 | 38.99 | O |
| ATOM | 2904 | CB | GLN | B | 161 | −20.710 | 25.633 | −0.371 | 1.00 | 31.23 | C |
| ATOM | 2905 | CG | GLN | B | 161 | −19.880 | 26.761 | −0.958 | 1.00 | 30.86 | C |
| ATOM | 2906 | CD | GLN | B | 161 | −20.221 | 27.015 | −2.407 | 1.00 | 32.74 | C |
| ATOM | 2907 | NE2 | GLN | B | 161 | −20.715 | 28.210 | −2.698 | 1.00 | 30.42 | N |
| ATOM | 2908 | OE1 | GLN | B | 161 | −20.062 | 26.138 | −3.252 | 1.00 | 34.09 | O |
| ATOM | 2909 | N | SER | B | 162 | −23.588 | 23.955 | −0.215 | 1.00 | 27.98 | N |
| ATOM | 2910 | CA | SER | B | 162 | −24.234 | 22.815 | 0.416 | 1.00 | 38.77 | C |
| ATOM | 2911 | C | SER | B | 162 | −24.111 | 21.602 | −0.496 | 1.00 | 34.56 | C |
| ATOM | 2912 | O | SER | B | 162 | −24.271 | 21.717 | −1.713 | 1.00 | 33.35 | O |
| ATOM | 2913 | CB | SER | B | 162 | −25.703 | 23.126 | 0.723 | 1.00 | 31.67 | C |
| ATOM | 2914 | OG | SER | B | 162 | −26.329 | 22.040 | 1.385 | 1.00 | 49.66 | O |
| ATOM | 2915 | N | GLY | B | 163 | −23.800 | 20.449 | 0.090 | 1.00 | 33.25 | N |
| ATOM | 2916 | CA | GLY | B | 163 | −23.739 | 19.206 | −0.661 | 1.00 | 28.14 | C |
| ATOM | 2917 | C | GLY | B | 163 | −22.356 | 18.880 | −1.192 | 1.00 | 32.51 | C |
| ATOM | 2918 | O | GLY | B | 163 | −22.101 | 17.758 | −1.620 | 1.00 | 33.73 | O |
| ATOM | 2919 | N | ASN | B | 164 | −21.457 | 19.859 | −1.164 | 1.00 | 30.22 | N |
| ATOM | 2920 | CA | ASN | B | 164 | −20.114 | 19.664 | −1.694 | 1.00 | 31.34 | C |
| ATOM | 2921 | C | ASN | B | 164 | −19.043 | 19.693 | −0.605 | 1.00 | 35.48 | C |
| ATOM | 2922 | O | ASN | B | 164 | −17.881 | 19.990 | −0.876 | 1.00 | 31.32 | O |
| ATOM | 2923 | CB | ASN | B | 164 | −19.809 | 20.722 | −2.767 | 1.00 | 30.74 | C |
| ATOM | 2924 | CG | ASN | B | 164 | −19.951 | 22.147 | −2.248 | 1.00 | 33.60 | C |
| ATOM | 2925 | ND2 | ASN | B | 164 | −19.572 | 23.116 | −3.073 | 1.00 | 33.79 | N |
| ATOM | 2926 | OD1 | ASN | B | 164 | −20.405 | 22.374 | −1.127 | 1.00 | 32.68 | O |
| ATOM | 2927 | N | SER | B | 165 | −19.435 | 19.387 | 0.628 | 1.00 | 35.40 | N |
| ATOM | 2928 | CA | SER | B | 165 | −18.470 | 19.275 | 1.714 | 1.00 | 35.79 | C |
| ATOM | 2929 | C | SER | B | 165 | −18.750 | 18.042 | 2.561 | 1.00 | 32.53 | C |
| ATOM | 2930 | O | SER | B | 165 | −19.849 | 17.490 | 2.521 | 1.00 | 29.82 | O |
| ATOM | 2931 | CB | SER | B | 165 | −18.478 | 20.530 | 2.593 | 1.00 | 32.78 | C |
| ATOM | 2932 | OG | SER | B | 165 | −19.639 | 20.592 | 3.401 | 1.00 | 33.05 | O |
| ATOM | 2933 | N | GLN | B | 166 | −17.742 | 17.606 | 3.311 | 1.00 | 30.86 | N |
| ATOM | 2934 | CA | GLN | B | 166 | −17.896 | 16.486 | 4.236 | 1.00 | 32.40 | C |
| ATOM | 2935 | C | GLN | B | 166 | −17.194 | 16.792 | 5.553 | 1.00 | 32.23 | C |
| ATOM | 2936 | O | GLN | B | 166 | −16.181 | 17.493 | 5.575 | 1.00 | 33.90 | O |
| ATOM | 2937 | CB | GLN | B | 166 | −17.346 | 15.189 | 3.634 | 1.00 | 26.55 | C |
| ATOM | 2938 | CG | GLN | B | 166 | −18.110 | 14.694 | 2.418 | 1.00 | 37.55 | C |
| ATOM | 2939 | CD | GLN | B | 166 | −17.656 | 13.318 | 1.960 | 1.00 | 45.88 | C |
| ATOM | 2940 | NE2 | GLN | B | 166 | −16.458 | 13.247 | 1.393 | 1.00 | 37.75 | N |
| ATOM | 2941 | OE1 | GLN | B | 166 | −18.378 | 12.332 | 2.110 | 1.00 | 44.50 | O |
| ATOM | 2942 | N | GLU | B | 167 | −17.741 | 16.260 | 6.642 | 1.00 | 26.95 | N |
| ATOM | 2943 | CA | GLU | B | 167 | −17.217 | 16.491 | 7.985 | 1.00 | 34.35 | C |
| ATOM | 2944 | C | GLU | B | 167 | −16.789 | 15.199 | 8.666 | 1.00 | 31.65 | C |
| ATOM | 2945 | O | GLU | B | 167 | −17.351 | 14.136 | 8.416 | 1.00 | 31.31 | O |
| ATOM | 2946 | CB | GLU | B | 167 | −18.263 | 17.166 | 8.868 | 1.00 | 33.65 | C |
| ATOM | 2947 | CG | GLU | B | 167 | −18.526 | 18.617 | 8.585 | 1.00 | 50.67 | C |
| ATOM | 2948 | CD | GLU | B | 167 | −19.553 | 19.191 | 9.544 | 1.00 | 59.29 | C |
| ATOM | 2949 | OE1 | GLU | B | 167 | −20.018 | 18.431 | 10.425 | 1.00 | 49.27 | O |
| ATOM | 2950 | OE2 | GLU | B | 167 | −19.895 | 20.388 | 9.418 | 1.00 | 59.18 | O |
| ATOM | 2951 | N | SER | B | 168 | −15.815 | 15.317 | 9.556 | 1.00 | 28.62 | N |
| ATOM | 2952 | CA | SER | B | 168 | −15.393 | 14.216 | 10.407 | 1.00 | 32.03 | C |
| ATOM | 2953 | C | SER | B | 168 | −15.096 | 14.753 | 11.802 | 1.00 | 31.07 | C |
| ATOM | 2954 | O | SER | B | 168 | −14.499 | 15.819 | 11.945 | 1.00 | 28.49 | O |
| ATOM | 2955 | CB | SER | B | 168 | −14.165 | 13.522 | 9.817 | 1.00 | 34.82 | C |
| ATOM | 2956 | OG | SER | B | 168 | −13.566 | 12.666 | 10.762 | 1.00 | 40.29 | O |
| ATOM | 2957 | N | AVAL | B | 169 | −15.514 | 14.013 | 12.828 | 0.89 | 30.56 | N |
| ATOM | 2958 | CA | AVAL | B | 169 | −15.342 | 14.433 | 14.221 | 0.89 | 30.43 | C |
| ATOM | 2959 | C | AVAL | B | 169 | −14.558 | 13.389 | 15.017 | 0.89 | 31.75 | C |
| ATOM | 2960 | O | AVAL | B | 169 | −14.796 | 12.193 | 14.870 | 0.89 | 33.51 | O |
| ATOM | 2961 | CB | AVAL | B | 169 | −16.708 | 14.663 | 14.910 | 0.89 | 32.02 | C |

TABLE 10.2-continued

| ATOM | 2962 | CG1 | AVAL | B | 169 | −16.518 | 15.215 | 16.317 | 0.89 | 33.65 | C |
|---|---|---|---|---|---|---|---|---|---|---|---|
| ATOM | 2963 | CG2 | AVAL | B | 169 | −17.578 | 15.591 | 14.079 | 0.89 | 31.73 | C |
| ATOM | 2964 | N | BVAL | B | 169 | −15.523 | 14.018 | 12.822 | 0.11 | 30.45 | N |
| ATOM | 2965 | CA | BVAL | B | 169 | −15.292 | 14.424 | 14.200 | 0.11 | 31.12 | C |
| ATOM | 2966 | C | BVAL | B | 169 | −14.467 | 13.380 | 14.937 | 0.11 | 31.77 | C |
| ATOM | 2967 | O | BVAL | B | 169 | −14.578 | 12.184 | 14.669 | 0.11 | 33.10 | O |
| ATOM | 2968 | CB | BVAL | B | 169 | −16.616 | 14.648 | 14.953 | 0.11 | 32.66 | C |
| ATOM | 2969 | CG1 | BVAL | B | 169 | −17.352 | 15.847 | 14.385 | 0.11 | 32.73 | C |
| ATOM | 2970 | CG2 | BVAL | B | 169 | −17.482 | 13.403 | 14.878 | 0.11 | 33.85 | C |
| ATOM | 2971 | N | THR | B | 170 | −13.633 | 13.837 | 15.862 | 1.00 | 29.38 | N |
| ATOM | 2972 | CA | THR | B | 170 | −12.847 | 12.921 | 16.682 | 1.00 | 36.76 | C |
| ATOM | 2973 | C | THR | B | 170 | −13.703 | 12.346 | 17.805 | 1.00 | 33.01 | C |
| ATOM | 2974 | O | THR | B | 170 | −14.762 | 12.885 | 18.133 | 1.00 | 30.78 | O |
| ATOM | 2975 | CB | THR | B | 170 | −11.620 | 13.605 | 17.308 | 1.00 | 30.27 | C |
| ATOM | 2976 | CG2 | THR | B | 170 | −10.719 | 14.211 | 16.235 | 1.00 | 34.58 | C |
| ATOM | 2977 | OG1 | THR | B | 170 | −12.057 | 14.633 | 18.199 | 1.00 | 31.73 | O |
| ATOM | 2978 | N | GLU | B | 171 | −13.243 | 11.248 | 18.390 | 1.00 | 34.68 | N |
| ATOM | 2979 | CA | GLU | B | 171 | −13.843 | 10.746 | 19.618 | 1.00 | 35.38 | C |
| ATOM | 2980 | C | GLU | B | 171 | −13.613 | 11.768 | 20.720 | 1.00 | 37.95 | C |
| ATOM | 2981 | O | GLU | B | 171 | −12.689 | 12.584 | 20.639 | 1.00 | 34.11 | O |
| ATOM | 2982 | CB | GLU | B | 171 | −13.247 | 9.391 | 20.011 | 1.00 | 35.96 | C |
| ATOM | 2983 | CG | GLU | B | 171 | −13.457 | 8.290 | 18.984 | 1.00 | 47.50 | C |
| ATOM | 2984 | CD | GLU | B | 171 | −14.850 | 7.683 | 19.038 | 1.00 | 65.62 | C |
| ATOM | 2985 | OE1 | GLU | B | 171 | −15.595 | 7.969 | 20.002 | 1.00 | 65.84 | O |
| ATOM | 2986 | OE2 | GLU | B | 171 | −15.198 | 6.912 | 18.116 | 1.00 | 70.74 | O |
| ATOM | 2987 | N | GLN | B | 172 | −14.456 | 11.734 | 21.743 | 1.00 | 34.37 | N |
| ATOM | 2988 | CA | GLN | B | 172 | −14.272 | 12.609 | 22.885 | 1.00 | 27.96 | C |
| ATOM | 2989 | C | GLN | B | 172 | −12.897 | 12.347 | 23.509 | 1.00 | 29.48 | C |
| ATOM | 2990 | O | GLN | B | 172 | −12.544 | 11.210 | 23.785 | 1.00 | 33.27 | O |
| ATOM | 2991 | CB | GLN | B | 172 | −15.399 | 12.399 | 23.899 | 1.00 | 31.65 | C |
| ATOM | 2992 | CG | GLN | B | 172 | −15.483 | 13.474 | 24.959 | 1.00 | 34.27 | C |
| ATOM | 2993 | CD | GLN | B | 172 | −16.804 | 13.457 | 25.706 | 1.00 | 37.13 | C |
| ATOM | 2994 | NE2 | GLN | B | 172 | −17.166 | 14.594 | 26.286 | 1.00 | 32.91 | N |
| ATOM | 2995 | OE1 | GLN | B | 172 | −17.496 | 12.437 | 25.755 | 1.00 | 34.99 | O |
| ATOM | 2996 | N | ASP | B | 173 | −12.120 | 13.408 | 23.700 | 1.00 | 30.64 | N |
| ATOM | 2997 | CA | ASP | B | 173 | −10.766 | 13.296 | 24.231 | 1.00 | 32.58 | C |
| ATOM | 2998 | C | ASP | B | 173 | −10.749 | 12.684 | 25.636 | 1.00 | 36.32 | C |
| ATOM | 2999 | O | ASP | B | 173 | −11.537 | 13.069 | 26.502 | 1.00 | 30.09 | O |
| ATOM | 3000 | CB | ASP | B | 173 | −10.097 | 14.671 | 24.246 | 1.00 | 32.10 | C |
| ATOM | 3001 | CG | ASP | B | 173 | −8.613 | 14.593 | 24.538 | 1.00 | 36.21 | C |
| ATOM | 3002 | OD2 | ASP | B | 173 | −8.222 | 14.802 | 25.708 | 1.00 | 36.85 | O |
| ATOM | 3003 | OD1 | ASP | B | 173 | −7.836 | 14.324 | 23.595 | 1.00 | 37.22 | O |
| ATOM | 3004 | N | SER | B | 174 | −9.844 | 11.737 | 25.863 | 1.00 | 32.20 | N |
| ATOM | 3005 | CA | SER | B | 174 | −9.818 | 11.015 | 27.134 | 1.00 | 38.98 | C |
| ATOM | 3006 | C | SER | B | 174 | −9.243 | 11.855 | 28.275 | 1.00 | 32.61 | C |
| ATOM | 3007 | O | SER | B | 174 | −9.301 | 11.447 | 29.432 | 1.00 | 42.30 | O |
| ATOM | 3008 | CB | SER | B | 174 | −9.017 | 9.717 | 26.998 | 1.00 | 36.54 | C |
| ATOM | 3009 | OG | SER | B | 174 | −7.630 | 9.986 | 26.883 | 1.00 | 46.81 | O |
| ATOM | 3010 | N | LYS | B | 175 | −8.691 | 13.020 | 27.954 | 1.00 | 35.47 | N |
| ATOM | 3011 | CA | LYS | B | 175 | −8.142 | 13.907 | 28.981 | 1.00 | 33.77 | C |
| ATOM | 3012 | C | LYS | B | 175 | −9.040 | 15.113 | 29.278 | 1.00 | 36.43 | C |
| ATOM | 3013 | O | LYS | B | 175 | −9.479 | 15.287 | 30.410 | 1.00 | 30.79 | O |
| ATOM | 3014 | CB | LYS | B | 175 | −6.749 | 14.404 | 28.581 | 1.00 | 36.54 | C |
| ATOM | 3015 | CG | LYS | B | 175 | −5.717 | 13.303 | 28.387 | 1.00 | 47.29 | C |
| ATOM | 3016 | CD | LYS | B | 175 | −4.339 | 13.895 | 28.117 | 1.00 | 54.56 | C |
| ATOM | 3017 | CE | LYS | B | 175 | −3.317 | 12.811 | 27.821 | 1.00 | 53.35 | C |
| ATOM | 3018 | NZ | LYS | B | 175 | −1.931 | 13.358 | 27.809 | 1.00 | 53.83 | N |
| ATOM | 3019 | N | ASP | B | 176 | −9.306 | 15.950 | 28.275 | 1.00 | 35.92 | N |
| ATOM | 3020 | CA | ASP | B | 176 | −10.070 | 17.176 | 28.522 | 1.00 | 33.42 | C |
| ATOM | 3021 | C | ASP | B | 176 | −11.526 | 17.072 | 28.069 | 1.00 | 33.69 | C |
| ATOM | 3022 | O | ASP | B | 176 | −12.293 | 18.025 | 28.205 | 1.00 | 32.10 | O |
| ATOM | 3023 | CB | ASP | B | 176 | −9.391 | 18.387 | 27.857 | 1.00 | 37.93 | C |
| ATOM | 3024 | CG | ASP | B | 176 | −9.374 | 18.315 | 26.326 | 1.00 | 44.81 | C |
| ATOM | 3025 | OD1 | ASP | B | 176 | −10.135 | 17.530 | 25.718 | 1.00 | 39.09 | O |
| ATOM | 3026 | OD2 | ASP | B | 176 | −8.591 | 19.081 | 25.721 | 1.00 | 49.31 | O |
| ATOM | 3027 | N | SER | B | 177 | −11.879 | 15.923 | 27.501 | 1.00 | 31.41 | N |
| ATOM | 3028 | CA | SER | B | 177 | −13.259 | 15.601 | 27.145 | 1.00 | 32.38 | C |
| ATOM | 3029 | C | SER | B | 177 | −13.869 | 16.487 | 26.062 | 1.00 | 31.53 | C |
| ATOM | 3030 | O | SER | B | 177 | −15.087 | 16.651 | 26.017 | 1.00 | 29.23 | O |
| ATOM | 3031 | CB | SER | B | 177 | −14.142 | 15.665 | 28.390 | 1.00 | 29.13 | C |
| ATOM | 3032 | OG | SER | B | 177 | −13.689 | 14.767 | 29.386 | 1.00 | 32.14 | O |
| ATOM | 3033 | N | THR | B | 178 | −13.031 | 17.045 | 25.192 | 1.00 | 32.85 | N |
| ATOM | 3034 | CA | THR | B | 178 | −13.521 | 17.873 | 24.091 | 1.00 | 31.34 | C |
| ATOM | 3035 | C | THR | B | 178 | −13.603 | 17.102 | 22.779 | 1.00 | 29.53 | C |
| ATOM | 3036 | O | THR | B | 178 | −13.145 | 15.960 | 22.680 | 1.00 | 31.68 | O |
| ATOM | 3037 | CB | THR | B | 178 | −12.627 | 19.108 | 23.865 | 1.00 | 330.04 | C |
| ATOM | 3038 | CG2 | THR | B | 178 | −12.576 | 19.979 | 25.117 | 1.000 | 31.87 | C |
| ATOM | 3039 | OG1 | THR | B | 178 | −11.302 | 18.683 | 23.526 | 1.00 | 33.96 | O |
| ATOM | 3040 | N | TYR | B | 179 | −14.199 | 17.738 | 21.776 | 1.00 | 26.97 | N |
| ATOM | 3041 | CA | TYR | B | 179 | −14.198 | 17.225 | 20.411 | 1.00 | 27.62 | C |

TABLE 10.2-continued

| ATOM | 3042 | C | TYR | B | 179 | −13.395 | 18.139 | 19.503 | 1.00 | 28.49 | C |
|------|------|------|-----|---|-----|---------|--------|--------|------|-------|---|
| ATOM | 3043 | O | TYR | B | 179 | −13.193 | 19.316 | 19.809 | 1.00 | 27.60 | O |
| ATOM | 3044 | CB | TYR | B | 179 | −15.620 | 17.110 | 19.862 | 1.00 | 23.93 | C |
| ATOM | 3045 | CG | TYR | B | 179 | −16.540 | 16.224 | 20.659 | 1.00 | 32.03 | C |
| ATOM | 3046 | CD2 | TYR | B | 179 | −16.701 | 14.884 | 20.326 | 1.00 | 29.16 | C |
| ATOM | 3047 | CD1 | TYR | B | 179 | −17.266 | 16.729 | 21.735 | 1.00 | 27.55 | C |
| ATOM | 3048 | CE2 | TYR | B | 179 | −17.549 | 14.065 | 21.046 | 1.00 | 36.83 | C |
| ATOM | 3049 | CE1 | TYR | B | 179 | −18.118 | 15.915 | 22.467 | 1.00 | 35.32 | C |
| ATOM | 3050 | CZ | TYR | B | 179 | −18.254 | 14.584 | 22.118 | 1.00 | 36.45 | C |
| ATOM | 3051 | OH | TYR | B | 179 | −19.096 | 13.768 | 22.837 | 1.00 | 41.00 | O |
| ATOM | 3052 | N | SER | B | 180 | −12.945 | 17.597 | 18.379 | 1.00 | 27.52 | N |
| ATOM | 3053 | CA | SER | B | 180 | −12.437 | 18.418 | 17.288 | 1.00 | 29.79 | C |
| ATOM | 3054 | C | SF.R | B | 180 | −13.143 | 18.002 | 16.00 | 1.00 | 28.83 | C |
| ATOM | 3055 | O | SER | B | 180 | −13.591 | 16.862 | 15.875 | 1.00 | 26.78 | O |
| ATOM | 3056 | CB | SER | B | 180 | −10.921 | 18.287 | 17.150 | 1.00 | 34.04 | C |
| ATOM | 3057 | OG | SER | B | 180 | −10.255 | 18.889 | 18.246 | 1.00 | 36.05 | O |
| ATOM | 3058 | N | LEU | B | 181 | −13.252 | 18.928 | 15.053 | 1.00 | 27.50 | N |
| ATOM | 3059 | CA | LEU | B | 181 | −13.984 | 18.670 | 13.819 | 1.00 | 29.24 | C |
| ATOM | 3060 | C | LEU | B | 181 | −13.206 | 19.150 | 12.595 | 1.00 | 34.49 | C |
| ATOM | 3061 | O | LEU | B | 181 | −12.583 | 20.214 | 12.610 | 1.00 | 29.64 | O |
| ATOM | 3062 | CB | LEU | B | 181 | −15.367 | 19.337 | 13.866 | 1.00 | 31.76 | C |
| ATOM | 3063 | CG | LEU | B | 181 | −16.315 | 19.197 | 12.662 | 1.00 | 33.92 | C |
| ATOM | 3064 | CD1 | LEU | B | 181 | −17.770 | 19.237 | 13.115 | 1.00 | 33.67 | C |
| ATOM | 3065 | CD2 | LEU | B | 181 | −16.071 | 20.275 | 11.620 | 1.00 | 27.36 | C |
| ATOM | 3066 | N | SER | B | 182 | −13.266 | 18.355 | 11.534 | 1.00 | 30.45 | N |
| ATOM | 3067 | CA | SER | B | 182 | −12.622 | 18.683 | 10.273 | 1.00 | 32.39 | C |
| ATOM | 3068 | C | SER | B | 182 | −13.653 | 18.706 | 9.157 | 1.00 | 34.50 | C |
| ATOM | 3069 | O | SER | B | 182 | −14.346 | 17.715 | 8.935 | 1.00 | 32.11 | O |
| ATOM | 3070 | CB | SER | B | 182 | −11.521 | 17.671 | 9.953 | 1.00 | 35.13 | C |
| ATOM | 3071 | OG | SER | B | 182 | −10.952 | 17.929 | 8.684 | 1.00 | 35.29 | O |
| ATOM | 3072 | N | SER | B | 183 | −13.769 | 19.841 | 8.473 | 1.00 | 32.48 | N |
| ATOM | 3073 | CA | SER | B | 183 | −14.666 | 19.946 | 7.327 | 1.00 | 31.00 | C |
| ATOM | 3074 | C | SER | B | 183 | −13.877 | 20.240 | 6.058 | 1.00 | 37.54 | C |
| ATOM | 3075 | O | SER | B | 183 | −13.014 | 21.119 | 6.041 | 1.00 | 34.24 | O |
| ATOM | 3076 | CB | SER | B | 183 | −15.720 | 21.028 | 7.548 | 1.00 | 28.88 | C |
| ATOM | 3077 | OG | SER | B | 183 | −16.568 | 21.127 | 6.415 | 1.00 | 34.00 | O |
| ATOM | 3078 | N | THR | B | 184 | −14.185 | 19.495 | 5.002 | 1.00 | 29.33 | N |
| ATOM | 3079 | CA | THR | B | 184 | −13.490 | 19.618 | 3.733 | 1.00 | 32.43 | C |
| ATOM | 3080 | C | THR | B | 184 | −14.449 | 20.002 | 2.609 | 1.00 | 33.53 | C |
| ATOM | 3081 | O | THR | B | 184 | −15.375 | 19.258 | 2.296 | 1.00 | 30.24 | O |
| ATOM | 3082 | CB | THR | B | 184 | −12.778 | 18.303 | 3.347 | 1.00 | 30.27 | C |
| ATOM | 3083 | CG2 | THR | B | 184 | −12.075 | 18.448 | 1.993 | 1.00 | 34.53 | C |
| ATOM | 3084 | OG1 | THR | B | 184 | −11.813 | 17.966 | 4.348 | 1.00 | 43.02 | O |
| ATOM | 3085 | N | LEU | B | 185 | −14.212 | 21.164 | 2.013 | 1.00 | 29.43 | N |
| ATOM | 3086 | CA | LEU | B | 185 | −14.950 | 21.610 | 0.838 | 1.00 | 26.42 | C |
| ATOM | 3087 | C | LEU | B | 185 | −14.195 | 21.216 | −0.428 | 1.00 | 31.67 | C |
| ATOM | 3088 | O | LEU | B | 185 | −13.021 | 21.549 | −0.587 | 1.00 | 32.58 | O |
| ATOM | 3089 | CB | LEU | B | 185 | −15.162 | 23.123 | 0.882 | 1.00 | 26.19 | C |
| ATOM | 3090 | CG | LEU | B | 185 | −15.801 | 23.777 | −0.346 | 1.00 | 33.72 | C |
| ATOM | 3091 | CD1 | LEU | B | 185 | −17.290 | 23.451 | −0.426 | 1.00 | 29.32 | C |
| ATOM | 3092 | CD2 | LEU | B | 185 | −15.570 | 25.285 | −0.336 | 1.00 | 29.64 | C |
| ATOM | 3093 | N | THR | B | 186 | −14.862 | 20.503 | −1.330 | 1.00 | 27.07 | N |
| ATOM | 3094 | CA | THR | B | 186 | −14.200 | 20.043 | −2.544 | 1.00 | 32.13 | C |
| ATOM | 3095 | C | THR | B | 186 | −14.797 | 20.676 | −3.794 | 1.00 | 34.19 | C |
| ATOM | 3096 | O | THR | B | 186 | −15.999 | 20.569 | −4.046 | 1.00 | 32.51 | O |
| ATOM | 3097 | CB | THR | B | 186 | −14.265 | 18.512 | −2.672 | 1.00 | 35.70 | C |
| ATOM | 3098 | CG2 | THR | B | 186 | −13.532 | 18.054 | −3.919 | 1.00 | 33.31 | C |
| ATOM | 3099 | OG1 | THR | B | 186 | −13.652 | 17.913 | −1.522 | 1.00 | 40.62 | O |
| ATOM | 3100 | N | LEU | B | 187 | −13.941 | 21.346 | −4.562 | 1.00 | 35.11 | N |
| ATOM | 3101 | CA | LEU | B | 187 | −14.315 | 21.945 | −5.843 | 1.00 | 35.77 | C |
| ATOM | 3102 | C | LEU | B | 187 | −13.339 | 21.525 | −6.932 | 1.00 | 37.88 | C |
| ATOM | 3103 | O | LEU | B | 187 | −12.206 | 21.145 | −6.642 | 1.00 | 36.56 | O |
| ATOM | 3104 | CB | LEU | B | 187 | −14.333 | 23.471 | −5.755 | 1.00 | 30.60 | C |
| ATOM | 3105 | CG | LEU | B | 187 | −15.286 | 24.143 | −4.775 | 1.00 | 36.33 | C |
| ATOM | 3106 | CD1 | LEU | B | 187 | −15.031 | 25.641 | −4.767 | 1.00 | 43.76 | C |
| ATOM | 3107 | CD2 | LEU | B | 187 | −16.729 | 23.835 | −5.147 | 1.00 | 50.34 | C |
| ATOM | 3108 | N | SER | B | 188 | −13.767 | 21.609 | −8.187 | 1.00 | 38.12 | N |
| ATOM | 3109 | CA | SER | B | 188 | −12.839 | 21.434 | −9.297 | 1.00 | 37.37 | C |
| ATOM | 3110 | C | SER | B | 188 | −11.888 | 22.627 | −9.343 | 1.00 | 37.79 | C |
| ATOM | 3111 | O | SER | B | 188 | −12.169 | 23.681 | −8.761 | 1.00 | 33.69 | O |
| ATOM | 3112 | CB | SER | B | 188 | −13.584 | 21.297 | −10.625 | 1.00 | 36.22 | C |
| ATOM | 3113 | OG | SER | B | 188 | −14.208 | 22.519 | −10.973 | 1.00 | 39.78 | O |
| ATOM | 3114 | N | LYS | B | 189 | −10.765 | 22.460 | −10.031 | 1.00 | 38.51 | N |
| ATOM | 3115 | CA | LYS | B | 189 | −9.809 | 23.546 | −10.193 | 1.00 | 37.38 | C |
| ATOM | 3116 | C | LYS | B | 189 | −10.460 | 24.721 | −10.915 | 1.00 | 37.61 | C |
| ATOM | 3117 | O | LYS | B | 189 | −10.331 | 25.869 | −10.491 | 1.00 | 42.81 | O |
| ATOM | 3118 | CB | LYS | B | 189 | −8.576 | 23.064 | −10.959 | 1.00 | 43.42 | C |
| ATOM | 3119 | CG | LYS | B | 189 | −7.574 | 24.158 | −11.293 | 1.00 | 45.58 | C |
| ATOM | 3120 | CD | LYS | B | 189 | −6.453 | 23.615 | −12.166 | 1.00 | 47.94 | C |
| ATOM | 3121 | CE | LYS | B | 189 | −5.477 | 24.704 | −12.561 | 1.00 | 50.50 | C |

TABLE 10.2-continued

| ATOM | 3122 | NZ | LYS | B | 189 | −4.369 | 24.160 | −13.395 | 1.00 | 67.88 | N |
|------|------|------|-----|---|-----|---------|---------|---------|------|-------|---|
| ATOM | 3123 | N | ALA | B | 190 | −11.175 | 24.415 | −11.995 | 1.00 | 37.86 | N |
| ATOM | 3124 | CA | ALA | B | 190 | −11.862 | 25.429 | −12.791 | 1.00 | 38.31 | C |
| ATOM | 3125 | C | ALA | B | 190 | −12.825 | 26.252 | −11.947 | 1.00 | 41.13 | C |
| ATOM | 3126 | O | ALA | B | 190 | −12.859 | 27.477 | −12.057 | 1.00 | 45.90 | O |
| ATOM | 3127 | CB | ALA | B | 190 | −12.602 | 24.777 | −13.953 | 1.00 | 30.47 | C |
| ATOM | 3128 | N | ASP | B | 191 | −13.602 | 25.582 | −11.100 | 1.00 | 38.92 | N |
| ATOM | 3129 | CA | ASP | B | 191 | −14.536 | 26.287 | −10.226 | 1.00 | 37.31 | C |
| ATOM | 3130 | C | ASP | B | 191 | −13.796 | 27.103 | −9.175 | 1.00 | 35.97 | C |
| ATOM | 3131 | O | ASP | B | 191 | −14.211 | 28.214 | −8.831 | 1.00 | 35.16 | O |
| ATOM | 3132 | CB | ASP | B | 191 | −15.497 | 25.308 | −9.542 | 1.00 | 40.65 | C |
| ATOM | 3133 | CG | ASP | B | 191 | −16.675 | 24.932 | −10.425 | 1.00 | 54.48 | C |
| ATOM | 3134 | OD1 | ASP | B | 191 | −16.840 | 25.554 | −11.498 | 1.00 | 48.85 | O |
| ATOM | 3135 | OD2 | ASP | B | 191 | −17.445 | 24.024 | −10.039 | 1.00 | 50.23 | O |
| ATOM | 3136 | N | TYR | B | 192 | −12.700 | 26.549 | −8.667 | 1.00 | 35.50 | N |
| ATOM | 3137 | CA | TYR | B | 192 | −11.948 | 27.193 | −7.595 | 1.00 | 34.33 | C |
| ATOM | 3138 | C | TYR | B | 192 | −11.381 | 28.543 | −8.022 | 1.00 | 37.59 | C |
| ATOM | 3139 | O | TYR | B | 192 | −11.395 | 29.505 | −7.256 | 1.00 | 35.83 | O |
| ATOM | 3140 | CB | TYR | B | 192 | −10.814 | 26.288 | −7.115 | 1.00 | 34.12 | C |
| ATOM | 3141 | CG | TYR | B | 192 | −9.932 | 26.940 | −6.076 | 1.00 | 36.45 | C |
| ATOM | 3142 | CD1 | TYR | B | 192 | −10.429 | 27.251 | −4.815 | 1.00 | 34.80 | C |
| ATOM | 3143 | CD2 | TYR | B | 192 | −8.606 | 27.243 | −6.350 | 1.00 | 32.17 | C |
| ATOM | 3144 | CE1 | TYR | B | 192 | −9.632 | 27.849 | −3.857 | 1.00 | 32.72 | C |
| ATOM | 3145 | CE2 | TYR | B | 192 | −7.797 | 27.838 | −5.394 | 1.00 | 34.13 | C |
| ATOM | 3146 | CZ | TYR | B | 192 | −8.319 | 28.142 | −4.152 | 1.00 | 31.36 | C |
| ATOM | 3147 | OH | TYR | B | 192 | −7.526 | 28.732 | −3.197 | 1.00 | 35.96 | O |
| ATOM | 3148 | N | GLU | B | 193 | −10.895 | 28.609 | −9.255 | 1.00 | 39.80 | N |
| ATOM | 3149 | CA | GLU | B | 193 | −10.237 | 29.811 | −9.763 | 1.00 | 43.18 | C |
| ATOM | 3150 | C | GLU | B | 193 | −11.213 | 30.900 | −10.210 | 1.00 | 39.55 | C |
| ATOM | 3151 | O | GLU | B | 193 | −10.799 | 32.022 | −10.496 | 1.00 | 44.13 | O |
| ATOM | 3152 | CB | GLU | B | 193 | −9.311 | 29.440 | −10.921 | 1.00 | 44.18 | C |
| ATOM | 3153 | CG | GLU | B | 193 | −8.172 | 28.528 | −10.515 | 1.00 | 46.87 | C |
| ATOM | 3154 | CD | GLU | B | 193 | −7.393 | 28.010 | −11.704 | 1.00 | 66.53 | C |
| ATOM | 3155 | OE1 | GLU | B | 193 | −7.965 | 27.968 | −12.815 | 1.00 | 70.34 | O |
| ATOM | 3156 | OE2 | GLU | B | 193 | −6.210 | 27.648 | −11.529 | 1.00 | 73.19 | O |
| ATOM | 3157 | N | LYS | B | 194 | −12.502 | 30.575 | −10.261 | 1.00 | 41.15 | N |
| ATOM | 3158 | CA | LYS | B | 194 | −13.522 | 31.554 | −10.634 | 1.00 | 39.86 | C |
| ATOM | 3159 | C | LYS | B | 194 | −13.955 | 32.429 | −9.461 | 1.00 | 44.25 | C |
| ATOM | 3160 | O | LYS | B | 194 | −14.816 | 33.295 | −9.615 | 1.00 | 42.88 | O |
| ATOM | 3161 | CB | LYS | B | 194 | −14.754 | 30.855 | −11.214 | 1.00 | 43.14 | C |
| ATOM | 3162 | CG | LYS | B | 194 | −14.506 | 30.110 | −12.507 | 1.00 | 50.46 | C |
| ATOM | 3163 | CD | LYS | B | 194 | −15.768 | 29.418 | −12.991 | 1.00 | 54.94 | C |
| ATOM | 3164 | CE | LYS | B | 194 | −15.503 | 28.612 | −14.255 | 1.00 | 65.50 | C |
| ATOM | 3165 | NZ | LYS | B | 194 | −14.922 | 29.454 | −15.339 | 1.00 | 69.52 | N |
| ATOM | 3166 | N | HIS | B | 195 | −13.373 | 32.204 | −8.288 | 1.00 | 42.19 | N |
| ATOM | 3167 | CA | HIS | B | 195 | −13.799 | 32.939 | −7.099 | 1.00 | 42.19 | C |
| ATOM | 3168 | C | HIS | B | 195 | −12.625 | 33.455 | −6.285 | 1.00 | 36.87 | C |
| ATOM | 3169 | O | HIS | B | 195 | −11.498 | 32.976 | −6.423 | 1.00 | 37.36 | O |
| ATOM | 3170 | CB | HIS | B | 195 | −14.687 | 32.061 | −6.214 | 1.00 | 38.63 | C |
| ATOM | 3171 | CG | HIS | B | 195 | −15.894 | 31.518 | −6.914 | 1.00 | 41.06 | C |
| ATOM | 3172 | CD2 | HIS | B | 195 | −16.180 | 30.270 | −7.356 | 1.00 | 44.21 | C |
| ATOM | 3173 | ND1 | HIS | B | 195 | −16.987 | 32.296 | −7.224 | 1.00 | 43.75 | N |
| ATOM | 3174 | CE1 | HIS | B | 195 | −17.894 | 31.554 | −7.834 | 1.00 | 44.35 | C |
| ATOM | 3175 | NE2 | HIS | B | 195 | −17.430 | 30.321 | −7.926 | 1.00 | 44.01 | N |
| ATOM | 3176 | N | LYS | B | 196 | −12.908 | 34.424 | −5.420 | 1.00 | 38.25 | N |
| ATOM | 3177 | CA | LYS | B | 196 | −11.876 | 35.084 | −4.639 | 1.00 | 35.29 | C |
| ATOM | 3178 | C | LYS | B | 196 | −11.915 | 34.716 | −3.152 | 1.00 | 39.07 | C |
| ATOM | 3179 | O | LYS | B | 196 | −10.942 | 34.190 | −2.615 | 1.00 | 39.45 | O |
| ATOM | 3180 | CB | LYS | B | 196 | −11.998 | 36.602 | −4.793 | 1.00 | 41.25 | C |
| ATOM | 3181 | CG | LYS | B | 196 | −10.931 | 37.391 | −4.047 | 1.00 | 43.11 | C |
| ATOM | 3182 | CD | LYS | B | 196 | −11.215 | 38.884 | −4.099 | 1.00 | 57.11 | C |
| ATOM | 3183 | CE | LYS | B | 196 | −10.103 | 39.686 | −3.447 | 1.00 | 60.58 | C |
| ATOM | 3184 | NZ | LYS | B | 196 | −10.341 | 41.150 | −3.566 | 1.00 | 75.28 | N |
| ATOM | 3185 | N | VAL | B | 197 | −13.032 | 35.002 | −2.488 | 1.00 | 33.64 | N |
| ATOM | 3186 | CA | VAL | B | 197 | −13.108 | 34.851 | −1.037 | 1.00 | 41.13 | C |
| ATOM | 3187 | C | VAL | B | 197 | −13.640 | 33.478 | −0.620 | 1.00 | 39.79 | C |
| ATOM | 3188 | O | VAL | B | 197 | −14.758 | 33.098 | −0.973 | 1.00 | 35.93 | O |
| ATOM | 3189 | CB | VAL | B | 197 | −13.993 | 35.943 | −0.400 | 1.00 | 39.79 | C |
| ATOM | 3190 | CG1 | VAL | B | 197 | −13.964 | 35.829 | 1.117 | 1.00 | 33.80 | C |
| ATOM | 3191 | CG2 | VAL | B | 197 | −13.532 | 37.330 | −0.834 | 1.00 | 36.75 | C |
| ATOM | 3192 | N | TYR | B | 198 | −12.827 | 32.743 | 0.134 | 1.00 | 36.80 | N |
| ATOM | 3193 | CA | TYR | B | 198 | −13.223 | 31.442 | 0.662 | 1.00 | 31.41 | C |
| ATOM | 3194 | C | TYR | B | 198 | −13.289 | 31.518 | 2.173 | 1.00 | 34.47 | C |
| ATOM | 3195 | O | TYR | B | 198 | −12.324 | 31.909 | 2.821 | 1.00 | 35.65 | O |
| ATOM | 3196 | CB | TYR | B | 198 | −12.252 | 30.347 | 0.210 | 1.00 | 29.88 | C |
| ATOM | 3197 | CG | TYR | B | 198 | −12.394 | 30.041 | −1.259 | 1.00 | 32.49 | C |
| ATOM | 3198 | CD1 | TYR | B | 198 | −11.774 | 30.838 | −2.219 | 1.00 | 31.45 | C |
| ATOM | 3199 | CD2 | TYR | B | 198 | −13.179 | 28.978 | −1.694 | 1.00 | 30.07 | C |
| ATOM | 3200 | CE1 | TYR | B | 198 | −11.919 | 30.573 | −3.572 | 1.00 | 35.86 | C |
| ATOM | 3201 | CE2 | TYR | B | 198 | −13.327 | 28.706 | −3.043 | 1.00 | 31.84 | C |

TABLE 10.2-continued

| ATOM | 3202 | CZ | TYR | B | 198 | −12.695 | 29.509 | −3.975 | 1.00 | 31.78 | C |
|---|---|---|---|---|---|---|---|---|---|---|---|
| ATOM | 3203 | OH | TYR | B | 198 | −12.842 | 29.245 | −5.313 | 1.00 | 37.12 | O |
| ATOM | 3204 | N | ALA | B | 199 | −14.435 | 31.148 | 2.731 | 1.00 | 31.33 | N |
| ATOM | 3205 | CA | ALA | B | 199 | −14.672 | 31.330 | 4.155 | 1.00 | 35.87 | C |
| ATOM | 3206 | C | ALA | B | 199 | −15.414 | 30.150 | 4.755 | 1.00 | 37.75 | C |
| ATOM | 3207 | O | ALA | B | 199 | −16.236 | 29.517 | 4.090 | 1.00 | 29.26 | O |
| ATOM | 3208 | CB | ALA | B | 199 | −15.454 | 32.614 | 4.394 | 1.00 | 28.89 | C |
| ATOM | 3209 | N | CYS | B | 200 | −15.114 | 29.844 | 6.012 | 1.00 | 29.79 | N |
| ATOM | 3210 | CA | CYS | B | 200 | −15.967 | 28.940 | 6.764 | 1.00 | 30.62 | C |
| ATOM | 3211 | C | CYS | B | 200 | −16.481 | 29.695 | 7.980 | 1.00 | 34.82 | C |
| ATOM | 3212 | O | CYS | B | 200 | −15.727 | 30.376 | 8.673 | 1.00 | 35.07 | O |
| ATOM | 3213 | CB | CYS | B | 200 | −15.232 | 27.651 | 7.157 | 1.00 | 39.10 | C |
| ATOM | 3214 | SG | CYS | B | 200 | −13.954 | 27.783 | 8.432 | 1.00 | 54.20 | S |
| ATOM | 3215 | N | GLU | B | 201 | −17.785 | 29.598 | 8.205 | 1.00 | 34.80 | N |
| ATOM | 3216 | CA | GLU | B | 201 | −18.438 | 30.312 | 9.289 | 1.00 | 35.26 | C |
| ATOM | 3217 | C | GLU | B | 201 | −18.905 | 29.313 | 10.338 | 1.00 | 33.11 | C |
| ATOM | 3218 | O | GLU | B | 201 | −19.670 | 28.395 | 10.036 | 1.00 | 30.25 | O |
| ATOM | 3219 | CB | GLU | B | 201 | −19.619 | 31.134 | 8.764 | 1.00 | 31.34 | C |
| ATOM | 3220 | CG | GLU | B | 201 | −20.333 | 31.938 | 9.838 | 1.00 | 46.76 | C |
| ATOM | 3221 | CD | GLU | B | 201 | −21.725 | 32.382 | 9.423 | 1.00 | 57.59 | C |
| ATOM | 3222 | OE1 | GLU | B | 201 | −22.650 | 31.538 | 9.431 | 1.00 | 59.83 | O |
| ATOM | 3223 | OE2 | GLU | B | 201 | −21.893 | 33.575 | 9.093 | 1.00 | 62.46 | O |
| ATOM | 3224 | N | VAL | B | 202 | −18.450 | 29.490 | 11.572 | 1.00 | 33.14 | N |
| ATOM | 3225 | CA | VAL | B | 202 | −18.715 | 28.498 | 12.604 | 1.00 | 34.14 | C |
| ATOM | 3226 | C | VAL | B | 202 | −19.683 | 28.996 | 13.674 | 1.00 | 34.64 | C |
| ATOM | 3227 | O | VAL | B | 202 | −19.512 | 30.079 | 14.236 | 1.00 | 32.69 | O |
| ATOM | 3228 | CB | VAL | B | 202 | −17.408 | 28.046 | 13.276 | 1.00 | 32.83 | C |
| ATOM | 3229 | CG1 | VAL | B | 202 | −17.699 | 27.136 | 14.458 | 1.00 | 27.65 | C |
| ATOM | 3230 | CG2 | VAL | B | 202 | −16.513 | 27.355 | 12.258 | 1.00 | 31.56 | C |
| ATOM | 3231 | N | THR | B | 203 | −20.702 | 28.185 | 13.942 | 1.00 | 30.80 | N |
| ATOM | 3232 | CA | THR | B | 203 | −21.670 | 28.455 | 14.997 | 1.00 | 34.07 | C |
| ATOM | 3233 | C | THR | B | 203 | −21.556 | 27.394 | 16.091 | 1.00 | 36.01 | C |
| ATOM | 3234 | O | THR | B | 203 | −21.518 | 26.196 | 15.802 | 1.00 | 34.64 | O |
| ATOM | 3235 | CB | THR | B | 203 | −23.111 | 28.477 | 14.444 | 1.00 | 36.63 | C |
| ATOM | 3236 | CG2 | THR | B | 203 | −24.102 | 28.883 | 15.526 | 1.00 | 36.15 | C |
| ATOM | 3237 | OG1 | THR | B | 203 | −23.190 | 29.403 | 13.356 | 1.00 | 45.86 | O |
| ATOM | 3238 | N | HIS | B | 204 | −21.499 | 27.841 | 17.343 | 1.00 | 32.76 | N |
| ATOM | 3239 | CA | HIS | B | 204 | −21.356 | 26.946 | 18.487 | 1.00 | 34.42 | C |
| ATOM | 3240 | C | HIS | B | 204 | −21.850 | 27.620 | 19.764 | 1.00 | 33.50 | C |
| ATOM | 3241 | O | HIS | B | 204 | −21.750 | 28.837 | 19.909 | 1.00 | 34.28 | O |
| ATOM | 3242 | CB | HIS | B | 204 | −19.895 | 26.510 | 18.656 | 1.00 | 29.00 | C |
| ATOM | 3243 | CG | HIS | B | 204 | −19.689 | 25.483 | 19.728 | 1.00 | 38.33 | C |
| ATOM | 3244 | CD2 | HIS | B | 204 | −19.847 | 24.138 | 19.717 | 1.00 | 32.84 | C |
| ATOM | 3245 | ND1 | HIS | B | 204 | −19.266 | 25.810 | 20.999 | 1.00 | 29.49 | N |
| ATOM | 3246 | CE1 | HIS | B | 204 | −19.177 | 24.710 | 21.726 | 1.00 | 34.17 | C |
| ATOM | 3247 | NE2 | HIS | B | 204 | −19.522 | 23.681 | 20.973 | 1.00 | 33.34 | N |
| ATOM | 3248 | N | GLN | B | 205 | −22.367 | 26.816 | 20.687 | 1.00 | 33.90 | N |
| ATOM | 3249 | CA | GLN | B | 205 | −22.892 | 27.307 | 21.961 | 1.00 | 33.84 | C |
| ATOM | 3250 | C | GLN | B | 205 | −21.905 | 28.198 | 22.725 | 1.00 | 36.35 | C |
| ATOM | 3251 | O | GLN | B | 205 | −22.313 | 29.126 | 23.425 | 1.00 | 40.21 | O |
| ATOM | 3252 | CB | GLN | B | 205 | −23.309 | 26.121 | 22.835 | 1.00 | 33.40 | C |
| ATOM | 3253 | CG | GLN | B | 205 | −23.981 | 26.507 | 24.136 | 1.00 | 49.24 | C |
| ATOM | 3254 | CD | GLN | B | 205 | −24.475 | 25.304 | 24.914 | 1.00 | 50.37 | C |
| ATOM | 3255 | NE2 | GLN | B | 205 | −24.852 | 25.527 | 26.168 | 1.00 | 57.58 | N |
| ATOM | 3256 | OE1 | GLN | B | 205 | −24.518 | 24.186 | 24.396 | 1.00 | 53.77 | O |
| ATOM | 3257 | N | GLY | B | 206 | −20.610 | 27.931 | 22.578 | 1.00 | 30.24 | N |
| ATOM | 3258 | CA | GLY | B | 206 | −19.587 | 28.728 | 23.237 | 1.00 | 32.96 | C |
| ATOM | 3259 | C | GLY | B | 206 | −19.239 | 30.036 | 22.542 | 1.00 | 34.80 | C |
| ATOM | 3260 | O | GLY | B | 206 | −18.466 | 30.834 | 23.064 | 1.00 | 30.49 | O |
| ATOM | 3261 | N | LEU | B | 207 | −19.806 | 30.260 | 21.363 | 1.00 | 38.67 | N |
| ATOM | 3262 | CA | LEU | B | 207 | −19.553 | 31.492 | 20.619 | 1.00 | 41.75 | C |
| ATOM | 3263 | C | LEU | B | 207 | −20.765 | 32.412 | 20.674 | 1.00 | 40.10 | C |
| ATOM | 3264 | O | LEU | B | 207 | −21.848 | 32.050 | 20.210 | 1.00 | 42.41 | O |
| ATOM | 3265 | CB | LEU | B | 207 | −19.204 | 31.180 | 19.165 | 1.00 | 34.75 | C |
| ATOM | 3266 | CG | LEU | B | 207 | −17.957 | 30.336 | 18.917 | 1.00 | 35.04 | C |
| ATOM | 3267 | CD1 | LEU | B | 207 | −17.871 | 29.946 | 17.444 | 1.00 | 32.97 | C |
| ATOM | 3268 | CD2 | LEU | B | 207 | −16.709 | 31.087 | 19.362 | 1.00 | 34.44 | C |
| ATOM | 3269 | N | SEE | B | 208 | −20.582 | 33.600 | 21.239 | 1.00 | 41.65 | N |
| ATOM | 3270 | CA | SER | B | 208 | −21.685 | 34.551 | 21.366 | 1.00 | 50.19 | C |
| ATOM | 3271 | C | SER | B | 208 | −22.189 | 34.991 | 19.989 | 1.00 | 43.51 | C |
| ATOM | 3272 | O | SER | B | 208 | −23.367 | 35.307 | 19.824 | 1.00 | 51.88 | O |
| ATOM | 3273 | CB | SER | B | 208 | −21.260 | 35.758 | 22.207 | 1.00 | 41.21 | C |
| ATOM | 3274 | OG | SER | B | 208 | −19.985 | 36.239 | 21.815 | 1.00 | 63.38 | O |
| ATOM | 3275 | N | SER | B | 209 | −21.296 | 34.995 | 19.002 | 1.00 | 40.06 | N |
| ATOM | 3276 | CA | SER | B | 209 | −21.682 | 35.228 | 17.613 | 1.00 | 44.47 | C |
| ATOM | 3277 | C | SER | B | 209 | −20.812 | 34.364 | 16.695 | 1.00 | 38.33 | C |
| ATOM | 3278 | O | SER | B | 209 | −19.696 | 34.005 | 17.067 | 1.00 | 43.33 | O |
| ATOM | 3279 | CB | SER | B | 209 | −21.557 | 36.715 | 17.253 | 1.00 | 45.07 | C |
| ATOM | 3280 | OG | SER | B | 209 | −20.203 | 37.102 | 17.120 | 1.00 | 49.50 | O |
| ATOM | 3281 | N | PRO | B | 210 | −21.323 | 34.017 | 15.499 | 1.00 | 44.65 | N |

TABLE 10.2-continued

| | | | | | | | | | |
|---|---|---|---|---|---|---|---|---|---|
| ATOM | 3282 | CA | PRO | B | 210 | −20.580 | 33.149 | 14.574 | 1.00 | 38.77 | C |
| ATOM | 3283 | C | PRO | B | 210 | −19.176 | 33.661 | 14.264 | 1.00 | 41.23 | C |
| ATOM | 3284 | O | PRO | B | 210 | −18.966 | 34.867 | 14.141 | 1.00 | 45.61 | O |
| ATOM | 3285 | CB | PRO | B | 210 | −21.450 | 33.156 | 13.315 | 1.00 | 39.30 | C |
| ATOM | 3286 | CG | PRO | B | 210 | −22.826 | 33.399 | 13.826 | 1.00 | 43.89 | C |
| ATOM | 3287 | CD | PRO | B | 210 | −22.658 | 34.357 | 14.974 | 1.00 | 40.75 | C |
| ATOM | 3288 | N | VAL | B | 211 | −18.224 | 32.741 | 14.155 | 1.00 | 39.40 | N |
| ATOM | 3289 | CA | VAL | B | 211 | −16.834 | 33.090 | 13.883 | 1.00 | 39.75 | C |
| ATOM | 3290 | C | VAL | B | 211 | −16.475 | 32.703 | 12.452 | 1.00 | 40.69 | C |
| ATOM | 3291 | O | VAL | B | 211 | −16.747 | 31.582 | 12.020 | 1.00 | 36.87 | O |
| ATOM | 3292 | CB | VAL | B | 211 | −15.877 | 32.398 | 14.880 | 1.00 | 38.99 | C |
| ATOM | 3293 | CG1 | VAL | B | 211 | −14.429 | 32.537 | 14.436 | 1.00 | 34.79 | C |
| ATOM | 3294 | CG2 | VAL | B | 211 | −16.071 | 32.973 | 16.272 | 1.00 | 40.49 | C |
| ATOM | 3295 | N | THR | B | 212 | −15.880 | 33.639 | 11.716 | 1.00 | 35.72 | N |
| ATOM | 3296 | CA | THR | B | 212 | −15.550 | 33.409 | 10.314 | 1.00 | 39.63 | C |
| ATOM | 3297 | C | THR | B | 212 | −14.055 | 33.500 | 10.046 | 1.00 | 35.76 | C |
| ATOM | 3298 | O | THR | B | 212 | −13.424 | 34.518 | 10.323 | 1.00 | 42.94 | O |
| ATOM | 3299 | CB | THR | B | 212 | −16.272 | 34.414 | 9.391 | 1.00 | 38.85 | C |
| ATOM | 3300 | CG2 | THR | B | 212 | −15.814 | 34.238 | 7.953 | 1.00 | 37.83 | C |
| ATOM | 3301 | OG1 | THR | B | 212 | −17.687 | 34.196 | 9.461 | 1.00 | 46.70 | O |
| ATOM | 3302 | N | LYS | B | 213 | −13.491 | 32.424 | 9.513 | 1.00 | 33.60 | N |
| ATOM | 3303 | CA | LYS | B | 213 | −12.120 | 32.451 | 9.029 | 1.00 | 36.19 | C |
| ATOM | 3304 | C | LYS | B | 213 | −12.155 | 32.386 | 7.514 | 1.00 | 38.31 | C |
| ATOM | 3305 | O | LYS | B | 213 | −12.964 | 31.659 | 6.938 | 1.00 | 40.76 | O |
| ATOM | 3306 | CB | LYS | B | 213 | −11.298 | 31.295 | 9.602 | 1.00 | 35.13 | C |
| ATOM | 3307 | CG | LYS | B | 213 | −11.186 | 31.301 | 11.120 | 1.00 | 41.13 | C |
| ATOM | 3308 | CD | LYS | B | 213 | −10.462 | 32.537 | 11.635 | 1.00 | 36.48 | C |
| ATOM | 3309 | CE | LYS | B | 213 | −10.432 | 32.550 | 13.161 | 1.00 | 36.86 | C |
| ATOM | 3310 | NZ | LYS | B | 213 | −9.699 | 33.727 | 13.703 | 1.00 | 51.87 | N |
| ATOM | 3311 | N | SER | B | 214 | −11.283 | 33.149 | 6.869 | 1.00 | 36.97 | N |
| ATOM | 3312 | CA | SER | B | 214 | −11.301 | 33.233 | 5.420 | 1.00 | 35.10 | C |
| ATOM | 3313 | C | SER | B | 214 | −9.934 | 33.547 | 4.827 | 1.00 | 37.64 | C |
| ATOM | 3314 | O | SER | B | 214 | −9.021 | 33.986 | 5.524 | 1.00 | 41.48 | O |
| ATOM | 3315 | CB | SER | B | 214 | −12.307 | 34.291 | 4.971 | 1.00 | 35.76 | C |
| ATOM | 3316 | OG | SER | B | 214 | −11.918 | 35.574 | 5.422 | 1.00 | 40.23 | O |
| ATOM | 3317 | N | PHE | B | 215 | −9.804 | 33.297 | 3.530 | 1.00 | 36.45 | N |
| ATOM | 3318 | CA | PHE | B | 215 | −8.651 | 33.746 | 2.767 | 1.00 | 39.24 | C |
| ATOM | 3319 | C | PHE | B | 215 | −9.114 | 34.202 | 1.388 | 1.00 | 45.83 | C |
| ATOM | 3320 | O | PHE | B | 215 | −10.185 | 33.804 | 0.916 | 1.00 | 37.02 | O |
| ATOM | 3321 | CB | PHE | B | 215 | −7.598 | 32.640 | 2.645 | 1.00 | 32.01 | C |
| ATOM | 3322 | CG | PHE | B | 215 | −8.066 | 31.428 | 1.878 | 1.00 | 38.83 | C |
| ATOM | 3323 | CD1 | PHE | B | 215 | −8.729 | 30.397 | 2.524 | 1.00 | 31.21 | C |
| ATOM | 3324 | CD2 | PHE | B | 215 | −7.830 | 31.315 | 0.516 | 1.00 | 35.76 | C |
| ATOM | 3325 | CE1 | PHE | B | 215 | −9.156 | 29.279 | 1.825 | 1.00 | 33.60 | C |
| ATOM | 3326 | CE2 | PHE | B | 215 | −8.251 | 30.201 | −0.190 | 1.00 | 35.19 | C |
| ATOM | 3327 | CZ | PHE | B | 215 | −8.915 | 29.180 | 0.466 | 1.00 | 34.00 | C |
| ATOM | 3328 | N | ASN | B | 216 | −8.316 | 35.057 | 0.761 | 1.00 | 45.06 | N |
| ATOM | 3329 | CA | ASN | B | 216 | −8.533 | 35.429 | −0.629 | 1.00 | 42.67 | C |
| ATOM | 3330 | C | ASN | B | 216 | −7.591 | 34.626 | −1.499 | 1.00 | 39.47 | C |
| ATOM | 3331 | O | ASN | B | 216 | −6.388 | 34.607 | −1.255 | 1.00 | 45.25 | O |
| ATOM | 3332 | CB | ASN | B | 216 | −8.310 | 36.926 | −0.843 | 1.00 | 45.51 | C |
| ATOM | 3333 | CG | ASN | B | 216 | −9.256 | 37.778 | −0.024 | 1.00 | 49.43 | C |
| ATOM | 3334 | ND2 | ASN | B | 216 | −8.785 | 38.943 | 0.402 | 1.00 | 55.43 | N |
| ATOM | 3335 | OD1 | ASN | B | 216 | −10.396 | 37.393 | 0.227 | 1.00 | 51.90 | O |
| ATOM | 3336 | N | ARC | B | 217 | −8.138 | 33.946 | −2.499 | 1.00 | 39.98 | N |
| ATOM | 3337 | CA | ARG | B | 217 | −7.327 | 33.135 | −3.396 | 1.00 | 43.37 | C |
| ATOM | 3338 | C | ARG | B | 217 | −6.257 | 33.985 | −4.069 | 1.00 | 49.33 | C |
| ATOM | 3339 | O | ARG | B | 217 | −6.559 | 35.019 | −4.665 | 1.00 | 52.85 | O |
| ATOM | 3340 | CB | ARG | B | 217 | −8.207 | 32.457 | −4.449 | 1.00 | 42.40 | C |
| ATOM | 3341 | CG | ARG | B | 217 | −7.441 | 31.578 | −5.420 | 1.00 | 38.23 | C |
| ATOM | 3342 | CD | ARG | B | 217 | −8.358 | 31.012 | −6.485 | 1.00 | 38.31 | C |
| ATOM | 3343 | NE | ARG | B | 217 | −9.059 | 32.068 | −7.204 | 1.00 | 42.76 | N |
| ATOM | 3344 | CZ | ARG | B | 217 | −8.588 | 32.665 | −8.292 | 1.00 | 51.33 | C |
| ATOM | 3345 | NH1 | ARG | B | 217 | −7.414 | 32.303 | −8.793 | 1.00 | 42.73 | N |
| ATOM | 3346 | NH2 | ARG | B | 217 | −9.294 | 33.622 | −8.883 | 1.00 | 48.38 | N |
| ATOM | 3347 | N | GLY | B | 218 | −5.004 | 33.555 | −3.952 | 1.00 | 53.01 | N |
| ATOM | 3348 | CA | GLY | B | 218 | −3.897 | 34.253 | −4.582 | 1.00 | 57.34 | C |
| ATOM | 3349 | C | GLY | B | 218 | −3.338 | 35.410 | −3.771 | 1.00 | 63.03 | C |
| ATOM | 3350 | O | GLY | B | 218 | −2.818 | 36.373 | −4.334 | 1.00 | 67.80 | O |
| ATOM | 3351 | N | GLU | B | 219 | −3.443 | 35.321 | −2.449 | 1.00 | 60.01 | N |
| ATOM | 3352 | CA | GLU | B | 219 | −2.900 | 36.353 | −1.571 | 1.00 | 61.79 | C |
| ATOM | 3353 | C | GLU | B | 219 | −2.130 | 35.742 | −0.405 | 1.00 | 61.79 | C |
| ATOM | 3354 | O | GLU | B | 219 | −1.976 | 34.525 | −0.321 | 1.00 | 69.81 | O |
| ATOM | 3355 | CB | GLU | B | 219 | −4.015 | 37.259 | −1.042 | 1.00 | 62.53 | C |
| ATOM | 3356 | CG | GLU | B | 219 | −4.663 | 38.151 | −2.096 | 1.00 | 56.22 | C |

TABLE 10.2-continued

| ATOM | 3357 | CD | GLU | B | 219 | −5.625 | 39.161 | −1.489 | 1.00 | 74.19 | | C |
| --- | --- | --- | --- | --- | --- | --- | --- | --- | --- | --- | --- | --- |
| ATOM | 3358 | OE1 | GLU | B | 219 | −5.593 | 39.345 | −0.252 | 1.00 | 78.86 | | O |
| ATOM | 3359 | OE2 | GLU | B | 219 | −6.413 | 39.770 | −2.247 | 1.00 | 64.28 | | O |
| TER | | | | | | | | | | | | |
| ATOM | 3360 | N | THR | C | 152 | −29.241 | −45.858 | 26.627 | 1.00 | 80.47 | D000 | N |
| ATOM | 3361 | CA | THR | C | 152 | −29.487 | −45.616 | 28.045 | 1.00 | 91.58 | D000 | C |
| ATOM | 3362 | C | THR | C | 152 | −29.269 | −44.146 | 28.405 | 1.00 | 88.87 | D000 | C |
| ATOM | 3363 | O | THR | C | 152 | −28.934 | −43.329 | 27.545 | 1.00 | 88.60 | D000 | O |
| ATOM | 3364 | CB | THR | C | 152 | −28.582 | −46.499 | 28.936 | 1.00 | 90.05 | D000 | C |
| ATOM | 3365 | CG2 | THR | C | 152 | −29.009 | −47.960 | 28.857 | 1.00 | 70.32 | D000 | C |
| ATOM | 3366 | OG1 | THR | C | 152 | −27.220 | −46.382 | 28.506 | 1.00 | 79.38 | D000 | O |
| ATOM | 3367 | N | CYS | C | 153 | −29.465 | −43.813 | 29.677 | 1.00 | 83.40 | D000 | N |
| ATOM | 3368 | CA | CYS | C | 153 | −29.261 | −42.446 | 30.143 | 1.00 | 72.69 | D000 | C |
| ATOM | 3369 | C | CYS | C | 153 | −28.836 | −42.415 | 31.611 | 1.00 | 63.73 | D000 | C |
| ATOM | 3370 | O | CYS | C | 153 | −28.923 | −43.419 | 32.318 | 1.00 | 52.26 | D000 | O |
| ATOM | 3371 | CB | CYS | C | 153 | −30.532 | −41.616 | 29.941 | 1.00 | 73.56 | D000 | C |
| ATOM | 3372 | SG | CYS | C | 153 | −30.281 | −39.826 | 30.081 | 1.00 | 98.30 | D000 | S |
| ATOM | 3373 | N | CYS | C | 154 | −28.370 | −41.254 | 32.059 | 1.00 | 61.15 | D000 | N |
| ATOM | 3374 | CA | CYS | C | 154 | −27.916 | −41.085 | 33.434 | 1.00 | 58.46 | D000 | C |
| ATOM | 3375 | C | CYS | C | 154 | −29.071 | −41.141 | 34.432 | 1.00 | 51.28 | D000 | C |
| ATOM | 3376 | O | CYS | C | 154 | −30.208 | −40.827 | 34.086 | 1.00 | 47.54 | D000 | O |
| ATOM | 3377 | CB | CYS | C | 154 | −27.160 | −39.758 | 33.580 | 1.00 | 53.06 | D000 | C |
| ATOM | 3378 | SG | CYS | C | 154 | −25.446 | −39.818 | 33.000 | 1.00 | 71.64 | D000 | S |
| ATOM | 3379 | N | PRO | C | 155 | −28.781 | −41.556 | 35.674 | 1.00 | 43.23 | D000 | N |
| ATOM | 3380 | CA | PRO | C | 155 | −29.767 | −41.494 | 36.757 | 1.00 | 48.50 | D000 | C |
| ATOM | 3381 | C | PRO | C | 155 | −30.193 | −40.062 | 37.062 | 1.00 | 49.23 | D000 | C |
| ATOM | 3382 | O | PRO | C | 155 | −29.481 | −39.117 | 36.708 | 1.00 | 42.32 | D000 | O |
| ATOM | 3383 | CB | PRO | C | 155 | −29.020 | −42.104 | 37.953 | 1.00 | 42.80 | D000 | C |
| ATOM | 3384 | CG | PRO | C | 155 | −27.576 | −41.991 | 37.609 | 1.00 | 50.48 | D000 | C |
| ATOM | 3385 | CD | PRO | C | 155 | −27.514 | −42.158 | 36.122 | 1.00 | 50.94 | D000 | C |
| ATOM | 3386 | N | VAL | C | 156 | −31.343 | −39.913 | 37.713 | 1.00 | 40.74 | D000 | N |
| ATOM | 3387 | CA | VAL | C | 156 | −31.863 | −38.598 | 38.077 | 1.00 | 48.19 | D000 | C |
| ATOM | 3388 | C | VAL | C | 156 | −30.837 | −37.822 | 38.897 | 1.00 | 42.17 | D000 | C |
| ATOM | 3389 | O | VAL | C | 156 | −30.149 | −38.403 | 39.739 | 1.00 | 40.87 | D000 | O |
| ATOM | 3390 | CB | VAL | C | 156 | −33.183 | −38.717 | 38.875 | 1.00 | 54.12 | D000 | C |
| ATOM | 3391 | CGI | VAL | C | 156 | −33.775 | −37.341 | 39.149 | 1.00 | 44.84 | D000 | C |
| ATOM | 3392 | CG2 | VAL | C | 156 | −34.181 | −39.590 | 38.122 | 1.00 | 50.34 | D000 | C |
| ATOM | 3393 | N | ASN | C | 157 | −30.727 | −36.522 | 38.610 | 1.00 | 41.21 | D000 | N |
| ATOM | 3394 | CA | ASN | C | 157 | −29.820 | −35.593 | 39.292 | 1.00 | 41.02 | D000 | C |
| ATOM | 3395 | C | ASN | C | 157 | −28.353 | −35.786 | 38.927 | 1.00 | 39.65 | D000 | C |
| ATOM | 3396 | O | ASN | C | 157 | −27.481 | −35.121 | 39.485 | 1.00 | 47.91 | D000 | O |
| ATOM | 3397 | CB | ASN | C | 157 | −29.979 | −35.689 | 40.812 | 1.00 | 45.93 | D000 | C |
| ATOM | 3398 | CG | ASN | C | 157 | −31.360 | −35.289 | 41.276 | 1.00 | 51.89 | D000 | C |
| ATOM | 3399 | ND2 | ASN | C | 157 | −31.885 | −36.011 | 42.260 | 1.00 | 51.21 | D000 | N |
| ATOM | 3400 | OD1 | ASN | C | 157 | −31.953 | −34.347 | 40.752 | 1.00 | 55.30 | D000 | O |
| ATOM | 3401 | N | TRP | C | 158 | −28.081 | −36.696 | 37.997 | 1.00 | 38.04 | D000 | N |
| ATOM | 3402 | CA | TRP | C | 158 | −26.737 | −36.841 | 37.449 | 1.00 | 35.52 | D000 | C |
| ATOM | 3403 | C | TRP | C | 158 | −26.694 | −36.212 | 36.061 | 1.00 | 41.15 | D000 | C |
| ATOM | 3404 | O | TRP | C | 158 | −27.720 | −36.118 | 35.387 | 1.00 | 32.47 | D000 | O |
| ATOM | 3405 | CB | TRP | C | 158 | −26.323 | −38.313 | 37.394 | 1.00 | 35.29 | D000 | C |
| ATOM | 3406 | CG | TRP | C | 158 | −26.115 | −38.930 | 38.751 | 1.00 | 40.11 | D000 | C |
| ATOM | 3407 | CD1 | TRP | C | 158 | −27.045 | −39.064 | 39.741 | 1.00 | 38.54 | D000 | C |
| ATOM | 3408 | CD2 | TRP | C | 158 | −24.903 | −39.505 | 39.262 | 1.00 | 36.91 | D000 | C |
| ATOM | 3409 | CE2 | TRP | C | 158 | −25.175 | −39.961 | 40.568 | 1.00 | 38.54 | D000 | C |
| ATOM | 3410 | CE3 | TRP | C | 158 | −23.615 | −39.676 | 38.743 | 1.00 | 32.86 | D000 | C |
| ATOM | 3411 | NE1 | TRP | C | 158 | −26.488 | −39.677 | 40.837 | 1.00 | 42.00 | D000 | N |
| ATOM | 3412 | CZ2 | TRP | C | 158 | −24.209 | −40.576 | 41.362 | 1.00 | 34.01 | D000 | C |
| ATOM | 3413 | CZ3 | TRP | C | 158 | −22.657 | −40.286 | 39.533 | 1.00 | 31.10 | D000 | C |
| ATOM | 3414 | CH2 | TRP | C | 158 | −22.958 | −40.728 | 40.827 | 1.00 | 31.72 | D000 | C |
| ATOM | 3415 | N | VAL | C | 159 | −25.511 | −35.775 | 35.640 | 1.00 | 37.12 | D000 | N |
| ATOM | 3416 | CA | VAL | C | 159 | −25.359 | −35.091 | 34.360 | 1.00 | 35.19 | D000 | C |
| ATOM | 3417 | C | VAL | C | 159 | −24.434 | −35.876 | 33.422 | 1.00 | 42.52 | D000 | C |
| ATOM | 3418 | O | VAL | C | 159 | −23.383 | −36.372 | 33.837 | 1.00 | 37.10 | D000 | O |
| ATOM | 3419 | CB | VAL | C | 159 | −24.811 | −33.660 | 34.557 | 1.00 | 36.85 | D000 | C |
| ATOM | 3420 | CG1 | VAL | C | 159 | −24.794 | −32.907 | 33.240 | 1.00 | 35.63 | D000 | C |
| ATOM | 3421 | CG2 | VAL | C | 159 | −25.650 | −32.909 | 35.583 | 1.00 | 36.56 | D000 | C |
| ATOM | 3422 | N | GLU | C | 160 | −24.827 | −35.987 | 32.157 | 1.00 | 36.06 | D000 | N |
| ATOM | 3423 | CA | GLU | C | 160 | −24.070 | −36.784 | 31.197 | 1.00 | 43.73 | D000 | C |
| ATOM | 3424 | C | GLU | C | 160 | −23.047 | −35.975 | 30.405 | 1.00 | 36.77 | D000 | C |
| ATOM | 3425 | O | GLU | C | 160 | −23.328 | −34.874 | 29.939 | 1.00 | 41.07 | D000 | O |
| ATOM | 3426 | CB | GLU | C | 160 | −25.018 | −37.481 | 30.221 | 1.00 | 43.94 | D000 | C |
| ATOM | 3427 | CG | GLU | C | 160 | −24.301 | −38.291 | 29.158 | 1.00 | 50.04 | D000 | C |
| ATOM | 3428 | CD | GLU | C | 160 | −25.222 | −38.743 | 28.045 | 1.00 | 67.78 | D000 | C |
| ATOM | 3429 | OE1 | GLU | C | 160 | −26.430 | −38.930 | 28.308 | 1.00 | 69.69 | D000 | O |
| ATOM | 3430 | OE2 | GLU | C | 160 | −24.735 | −38.904 | 26.905 | 1.00 | 67.23 | D000 | O |
| ATOM | 3431 | N | HIS | C | 161 | −21.856 | −36.541 | 30.261 | 1.00 | 37.45 | D000 | N |
| ATOM | 3432 | CA | HIS | C | 161 | −20.829 | −35.993 | 29.388 | 1.00 | 38.41 | D000 | C |
| ATOM | 3433 | C | HIS | C | 161 | −19.987 | −37.135 | 28.842 | 1.00 | 40.31 | D000 | C |
| ATOM | 3434 | O | HIS | C | 161 | −19.301 | −37.816 | 29.604 | 1.00 | 36.78 | D000 | O |
| ATOM | 3435 | CB | HIS | C | 161 | −19.951 | −34.987 | 30.134 | 1.00 | 35.44 | D000 | C |

TABLE 10.2-continued

| | | | | | | | | | | | |
|---|---|---|---|---|---|---|---|---|---|---|---|
| ATOM | 3436 | CG | HIS | C | 161 | −18.785 | −34.487 | 29.334 | 1.00 | 39.39 | D000 C |
| ATOM | 3437 | CD2 | HIS | C | 161 | −17.492 | −34.888 | 29.300 | 1.00 | 37.49 | D000 C |
| ATOM | 3438 | ND1 | HIS | C | 161 | −18.888 | −33.445 | 28.439 | 1.00 | 37.81 | D000 N |
| ATOM | 3439 | CE1 | HIS | C | 161 | −17.707 | −33.223 | 27.887 | 1.00 | 36.44 | D000 C |
| ATOM | 3440 | NE2 | HIS | C | 161 | −16.844 | −34.085 | 28.390 | 1.00 | 39.12 | D000 N |
| ATOM | 3441 | N | GLU | C | 162 | −20.066 | −37.349 | 27.529 | 1.00 | 45.55 | D000 N |
| ATOM | 3442 | CA | GLU | C | 162 | −19.271 | −38.365 | 26.834 | 1.00 | 40.64 | D000 C |
| ATOM | 3443 | C | GLU | C | 162 | −19.341 | −39.749 | 27.484 | 1.00 | 41.12 | D000 C |
| ATOM | 3444 | O | GLU | C | 162 | −18.318 | −40.305 | 27.887 | 1.00 | 42.56 | D000 O |
| ATOM | 3445 | CB | GLU | C | 162 | −17.806 | −37.919 | 26.744 | 1.00 | 41.10 | D000 C |
| ATOM | 3446 | CG | GLU | C | 162 | −17.596 | −36.576 | 26.052 | 1.00 | 49.56 | D000 C |
| ATOM | 3447 | CD | GLU | C | 162 | −18.120 | −36.554 | 24.622 | 1.00 | 68.97 | D000 C |
| ATOM | 3448 | OE1 | GLU | C | 162 | −18.103 | −37.612 | 23.955 | 1.00 | 61.44 | D000 O |
| ATOM | 3449 | OE2 | GLU | C | 162 | −18.551 | −35.472 | 24.163 | 1.00 | 82.19 | D000 O |
| ATOM | 3450 | N | ARG | C | 163 | −20.550 | −40.289 | 27.586 | 1.00 | 39.55 | D000 N |
| ATOM | 3451 | CA | ARG | C | 163 | −20.790 | −41.614 | 28.175 | 1.00 | 50.72 | D000 C |
| ATOM | 3452 | C | ARG | C | 163 | −20.305 | −41.757 | 29.628 | 1.00 | 46.47 | D000 C |
| ATOM | 3453 | O | ARG | C | 163 | −20.132 | −42.870 | 30.127 | 1.00 | 44.94 | D000 O |
| ATOM | 3454 | CB | ARG | C | 163 | −20.156 | −42.710 | 27.306 | 1.00 | 49.40 | D000 C |
| ATOM | 3455 | CG | ARG | C | 163 | −20.768 | −42.827 | 25.907 | 1.00 | 51.79 | D000 C |
| ATOM | 3456 | CD | ARG | C | 163 | −20.685 | −44.252 | 25.348 | 1.00 | 44.72 | D000 C |
| ATOM | 3457 | NE | ARG | C | 163 | −21.723 | −45.140 | 25.879 | 1.00 | 51.93 | D000 N |
| ATOM | 3458 | CZ | ARG | C | 163 | −21.483 | −46.234 | 26.606 | 1.00 | 59.01 | D000 C |
| ATOM | 3459 | NH1 | ARG | C | 163 | −22.492 | −46.980 | 27.044 | 1.00 | 45.88 | D000 N |
| ATOM | 3460 | NH2 | ARG | C | 163 | −20.236 | −46.586 | 26.897 | 1.00 | 49.85 | D000 N |
| ATOM | 3461 | N | SER | C | 164 | −20.099 | −40.633 | 30.306 | 1.00 | 43.03 | D000 N |
| ATOM | 3462 | CA | SER | C | 164 | −19.865 | −40.646 | 31.746 | 1.00 | 37.64 | D000 C |
| ATOM | 3463 | C | SER | C | 164 | −20.969 | −39.876 | 32.459 | 1.00 | 37.23 | D000 C |
| ATOM | 3464 | O | SER | C | 164 | −21.536 | −38.933 | 31.903 | 1.00 | 37.58 | D000 O |
| ATOM | 3465 | CB | SER | C | 164 | −18.498 | −40.052 | 32.092 | 1.00 | 37.20 | D000 C |
| ATOM | 3466 | OG | SER | C | 164 | −17.509 | −41.061 | 32.172 | 1.00 | 40.60 | D000 O |
| ATOM | 3467 | N | CYS | C | 165 | −21.272 | −40.283 | 33.687 | 1.00 | 36.28 | D000 N |
| ATOM | 3468 | CA | CYS | C | 165 | −22.296 | −39.624 | 34.493 | 1.00 | 35.32 | D000 C |
| ATOM | 3469 | C | CYS | C | 165 | −21.666 | −38.921 | 35.688 | 1.00 | 39.53 | D000 C |
| ATOM | 3470 | O | CYS | C | 165 | −20.843 | −39.504 | 36.398 | 1.00 | 33.29 | D000 O |
| ATOM | 3471 | CB | CYS | C | 165 | −23.344 | −40.632 | 34.974 | 1.00 | 42.45 | D000 C |
| ATOM | 3472 | SG | CYS | C | 165 | −24.315 | −41.382 | 33.657 | 1.00 | 55.85 | D000 S |
| ATOM | 3473 | N | TYR | C | 166 | −22.065 | −37.674 | 35.915 | 1.00 | 29.38 | D000 N |
| ATOM | 3474 | CA | TYR | C | 166 | −21.475 | −36.870 | 36.976 | 1.00 | 33.48 | D000 C |
| ATOM | 3475 | C | TYR | C | 166 | −22.532 | −36.391 | 37.963 | 1.00 | 33.01 | D000 C |
| ATOM | 3476 | O | TYR | C | 166 | −23.665 | −36.110 | 37.589 | 1.00 | 33.24 | D000 O |
| ATOM | 3477 | CB | TYR | C | 166 | −20.730 | −35.667 | 36.388 | 1.00 | 32.05 | D000 C |
| ATOM | 3478 | CG | TYR | C | 166 | −19.658 | −36.030 | 35.383 | 1.00 | 31.06 | D000 C |
| ATOM | 3479 | CD1 | TYR | C | 166 | −19.990 | −36.385 | 34.080 | 1.00 | 30.70 | D000 C |
| ATOM | 3480 | CD2 | TYR | C | 166 | −18.313 | −36.003 | 35.732 | 1.00 | 30.70 | D000 C |
| ATOM | 3481 | CE1 | TYR | C | 166 | −19.017 | −36.713 | 33.153 | 1.00 | 33.69 | D000 C |
| ATOM | 3482 | CE2 | TYR | C | 166 | −17.329 | −36.329 | 34.807 | 1.00 | 32.22 | D000 C |
| ATOM | 3483 | CZ | TYR | C | 166 | −17.690 | −36.682 | 33.519 | 1.00 | 32.45 | D000 C |
| ATOM | 3484 | OH | TYR | C | 166 | −16.723 | −37.007 | 32.593 | 1.00 | 35.47 | D000 O |
| ATOM | 3485 | N | TRP | C | 167 | −22.156 | −36.309 | 39.231 | 1.00 | 33.71 | D000 N |
| ATOM | 3486 | CA | TRP | C | 167 | −23.032 | −35.743 | 40.246 | 1.00 | 35.55 | D000 C |
| ATOM | 3487 | C | TRP | C | 167 | −22.262 | −34.685 | 41.017 | 1.00 | 32.66 | D000 C |
| ATOM | 3488 | O | TRP | C | 167 | −21.140 | −34.931 | 41.470 | 1.00 | 31.46 | D000 O |
| ATOM | 3489 | CB | TRP | C | 167 | −23.559 | −36.827 | 41.186 | 1.00 | 35.80 | D000 C |
| ATOM | 3490 | CG | TRP | C | 167 | −24.458 | −36.290 | 42.265 | 1.00 | 43.58 | D000 C |
| ATOM | 3491 | CD1 | TRP | C | 167 | −25.805 | −36.079 | 42.183 | 1.00 | 38.70 | D000 C |
| ATOM | 3492 | CD2 | TRP | C | 167 | −24.070 | −35.896 | 43.587 | 1.00 | 35.59 | D000 C |
| ATOM | 3493 | CE2 | TRP | C | 167 | −25.235 | −35.456 | 44.251 | 1.00 | 41.09 | D000 C |
| ATOM | 3494 | CE3 | TRP | C | 167 | −22.852 | −35.869 | 44.271 | 1.00 | 35.37 | D000 C |
| ATOM | 3495 | NE1 | TRP | C | 167 | −26.280 | −35.577 | 43.373 | 1.00 | 39.42 | D000 N |
| ATOM | 3496 | CZ2 | TRP | C | 167 | −25.215 | −34.997 | 45.567 | 1.00 | 38.44 | D000 C |
| ATOM | 3497 | CZ3 | TRP | C | 167 | −22.835 | −35.415 | 45.579 | 1.00 | 37.33 | D000 C |
| ATOM | 3498 | CH2 | TRP | C | 167 | −24.008 | −34.985 | 46.213 | 1.00 | 36.75 | D000 C |
| ATOM | 3499 | N | PHE | C | 168 | −22.858 | −33.505 | 41.155 | 1.00 | 33.58 | D000 N |
| ATOM | 3500 | CA | PHE | C | 168 | −22.172 | −32.374 | 41.778 | 1.00 | 33.25 | D000 C |
| ATOM | 3501 | C | PHE | C | 168 | −22.773 | −32.041 | 43.134 | 1.00 | 31.97 | D000 C |
| ATOM | 3502 | O | PHE | C | 168 | −23.953 | −31.721 | 43.227 | 1.00 | 34.21 | D000 O |
| ATOM | 3503 | CB | PHE | C | 168 | −22.229 | −31.148 | 40.861 | 1.00 | 28.44 | D000 C |
| ATOM | 3504 | CG | PHE | C | 168 | −21.573 | −31.363 | 39.526 | 1.00 | 30.16 | D000 C |
| ATOM | 3505 | CD1 | PHE | C | 168 | −22.287 | −31.896 | 38.463 | 1.00 | 31.96 | D000 C |
| ATOM | 3506 | CD2 | PHE | C | 168 | −20.239 | −31.038 | 39.337 | 1.00 | 29.17 | D000 C |
| ATOM | 3507 | CE1 | PHE | C | 168 | −21.682 | −32.099 | 37.229 | 1.00 | 29.38 | D000 C |
| ATOM | 3508 | CE2 | PHE | C | 168 | −19.625 | −31.242 | 38.114 | 1.00 | 28.14 | D000 C |
| ATOM | 3509 | CZ | PHE | C | 168 | −20.348 | −31.776 | 37.057 | 1.00 | 28.28 | D000 C |
| ATOM | 3510 | N | SER | C | 169 | −21.961 | −32.110 | 44.186 | 1.00 | 30.11 | D000 N |
| ATOM | 3511 | CA | SER | C | 169 | −22.462 | −31.851 | 45.528 | 1.00 | 31.18 | D000 C |
| ATOM | 3512 | C | SER | C | 169 | −22.693 | −30.360 | 45.740 | 1.00 | 37.87 | D000 C |
| ATOM | 3513 | O | SER | C | 169 | −22.121 | −29.522 | 45.038 | 1.00 | 34.20 | D000 O |
| ATOM | 3514 | CB | SER | C | 169 | −21.494 | −32.389 | 46.583 | 1.00 | 30.35 | D000 C |
| ATOM | 3515 | OG | SER | C | 169 | −20.471 | −31.453 | 46.859 | 1.00 | 30.05 | D000 O |

TABLE 10.2-continued

| | | | | | | | | | | | |
|---|---|---|---|---|---|---|---|---|---|---|---|
| ATOM | 3516 | N | ARG | C | 170 | −23.536 | −30.027 | 46.708 | 1.00 | 37.76 | D000 N |
| ATOM | 3517 | CA | ARG | C | 170 | −23.767 | −28.628 | 47.046 | 1.00 | 42.71 | D000 C |
| ATOM | 3518 | C | ARG | C | 170 | −23.330 | −28.383 | 48.488 | 1.00 | 43.83 | D000 C |
| ATOM | 3519 | O | ARG | C | 170 | −23.437 | −27.274 | 49.010 | 1.00 | 47.78 | D000 O |
| ATOM | 3520 | CB | ARG | C | 170 | −25.237 | −28.254 | 46.829 | 1.00 | 44.70 | D000 C |
| ATOM | 3521 | CG | ARG | C | 170 | −25.717 | −28.513 | 45.395 | 1.00 | 57.03 | D000 C |
| ATOM | 3522 | CD | ARG | C | 170 | −27.063 | −27.862 | 45.082 | 1.00 | 63.29 | D000 C |
| ATOM | 3523 | NE | ARG | C | 170 | −28.144 | −28.365 | 45.925 | 1.00 | 84.25 | D000 N |
| ATOM | 3524 | CZ | ARG | C | 170 | −28.822 | −229.485 | 45.688 | 1.00 | 84.39 | D000 C |
| ATOM | 3525 | NH1 | ARG | C | 170 | −29.792 | −29.862 | 46.511 | 1.00 | 72.14 | D000 N |
| ATOM | 3526 | NH2 | ARG | C | 170 | −28.528 | −30.230 | 44.631 | 1.00 | 91.59 | D000 N |
| ATOM | 3527 | N | SER | C | 171 | −22.817 | −29.439 | 49.112 | 1.00 | 39.23 | D000 N |
| ATOM | 3528 | CA | SER | C | 171 | −22.298 | −29.372 | 50.470 | 1.00 | 41.01 | D000 C |
| ATOM | 3529 | C | SER | C | 171 | −20.827 | −29.773 | 50.489 | 1.00 | 37.33 | D000 C |
| ATOM | 3530 | O | SER | C | 171 | −20.305 | −30.281 | 49.499 | 1.00 | 31.87 | D000 O |
| ATOM | 3531 | CB | SER | C | 171 | −23.106 | −30.277 | 51.401 | 1.00 | 36.62 | D000 C |
| ATOM | 3532 | OG | SER | C | 171 | −23.00 | −31.633 | 51.004 | 1.00 | 43.48 | D000 O |
| ATOM | 3533 | N | GLY | C | 172 | −20.166 | −29.549 | 51.620 | 1.00 | 31.79 | D000 N |
| ATOM | 3534 | CA | GLY | C | 172 | −18.749 | −29.840 | 51.743 | 1.00 | 31.58 | D000 C |
| ATOM | 3535 | C | GLY | C | 172 | −18.428 | −31.069 | 52.573 | 1.00 | 37.61 | D000 C |
| ATOM | 3536 | O | GLY | C | 172 | −19.161 | −31.427 | 53.495 | 1.00 | 34.62 | D000 O |
| ATOM | 3537 | N | LYS | C | 173 | −17.317 | −31.714 | 52.231 | 1.00 | 32.21 | D000 N |
| ATOM | 3538 | CA | LYS | C | 173 | −16.818 | −32.878 | 52.954 | 1.00 | 30.84 | D000 C |
| ATOM | 3539 | C | LYS | C | 173 | −15.300 | −32.903 | 52.885 | 1.00 | 36.15 | D000 C |
| ATOM | 3540 | O | LYS | C | 173 | −14.715 | −32.463 | 51.894 | 1.00 | 35.63 | D000 O |
| ATOM | 3541 | CB | LYS | C | 173 | −17.365 | −34.184 | 52.367 | 1.00 | 35.20 | D000 C |
| ATOM | 3542 | CG | LYS | C | 173 | −18.746 | −34.590 | 52.824 | 1.00 | 33.26 | D000 C |
| ATOM | 3543 | CD | LYS | C | 173 | −19.092 | −35.966 | 52.277 | 1.00 | 36.71 | D000 C |
| ATOM | 3544 | CE | LYS | C | 173 | −20.518 | −36.364 | 52.617 | 1.00 | 39.30 | D000 C |
| ATOM | 3545 | NZ | LYS | C | 173 | −20.706 | −36.532 | 54.082 | 1.00 | 42.46 | D000 N |
| ATOM | 3546 | N | ALA | C | 174 | −14.665 | −33.423 | 53.930 | 1.00 | 34.50 | D000 N |
| ATOM | 3547 | CA | ALA | C | 174 | −13.244 | −33.733 | 53.871 | 1.00 | 32.78 | D000 C |
| ATOM | 3548 | C | ALA | C | 174 | −13.011 | −34.731 | 52.737 | 1.00 | 30.79 | D000 C |
| ATOM | 3549 | O | ALA | C | 174 | −13.918 | −35.486 | 52.375 | 1.00 | 27.51 | D000 O |
| ATOM | 3550 | CB | ALA | C | 174 | −12.756 | −34.296 | 55.201 | 1.00 | 32.37 | D000 C |
| ATOM | 3551 | N | TRP | C | 175 | −11.802 | −34.736 | 52.182 | 1.00 | 28.74 | D000 N |
| ATOM | 3552 | CA | TRP | C | 175 | −11.510 | −35.556 | 51.011 | 1.00 | 34.63 | D000 C |
| ATOM | 3553 | C | TRP | C | 175 | −11.853 | −37.026 | 51.230 | 1.00 | 31.83 | D000 C |
| ATOM | 3554 | O | TRP | C | 175 | −12.520 | −37.640 | 50.398 | 1.00 | 31.59 | D000 O |
| ATOM | 3555 | CB | TRP | C | 175 | −10.041 | −35.430 | 50.606 | 1.00 | 31.97 | D000 C |
| ATOM | 3556 | CG | TRP | C | 175 | −9.771 | −36.017 | 49.251 | 1.00 | 27.08 | D000 C |
| ATOM | 3557 | CD1 | TRP | C | 175 | −9.812 | −35.364 | 48.051 | 1.00 | 33.57 | D000 C |
| ATOM | 3558 | CD2 | TRP | C | 175 | −9.442 | −37.378 | 48.955 | 1.00 | 30.56 | D000 C |
| ATOM | 3559 | CE2 | TRP | C | 175 | −9.285 | −37.476 | 47.558 | 1.00 | 29.73 | D000 C |
| ATOM | 3560 | CE3 | TRP | C | 175 | −9.257 | −38.524 | 49.737 | 1.00 | 31.43 | D000 C |
| ATOM | 3561 | NE1 | TRP | C | 175 | −9.518 | −36.234 | 47.029 | 1.00 | 30.16 | D000 N |
| ATOM | 3562 | CZ2 | TRP | C | 175 | −8.958 | −38.674 | 46.926 | 1.00 | 31.89 | D000 C |
| ATOM | 3563 | CZ3 | TRP | C | 175 | −8.934 | −39.711 | 49.107 | 1.00 | 33.11 | D000 C |
| ATOM | 3564 | CH2 | TRP | C | 175 | −8.787 | −39.777 | 47.715 | 1.00 | 31.57 | D000 C |
| ATOM | 3565 | N | ALA | C | 176 | −11.402 | −37.585 | 52.349 | 1.00 | 36.55 | D000 N |
| ATOM | 3566 | CA | ALA | C | 176 | −11.654 | −38.992 | 52.642 | 1.00 | 34.85 | D000 C |
| ATOM | 3567 | C | ALA | C | 176 | −13.153 | −39.287 | 52.720 | 1.00 | 31.81 | D000 C |
| ATOM | 3568 | O | ALA | C | 176 | −13.611 | −40.335 | 52.264 | 1.00 | 32.34 | D000 O |
| ATOM | 3569 | CB | ALA | C | 176 | −10.961 | −39.397 | 53.940 | 1.00 | 39.21 | D000 C |
| ATOM | 3570 | N | ASP | C | 177 | −13.921 | −38.362 | 53.286 | 1.00 | 29.24 | D000 N |
| ATOM | 3571 | CA | ASP | C | 177 | −15.363 | −38.562 | 53.387 | 1.00 | 30.70 | D000 C |
| ATOM | 3572 | C | ASP | C | 177 | −16.048 | −38.465 | 52.021 | 1.00 | 34.41 | D000 C |
| ATOM | 3573 | O | ASP | C | 177 | −17.005 | −39.186 | 51.749 | 1.00 | 30.91 | D000 O |
| ATOM | 3574 | CB | ASP | C | 177 | −15.976 | −37.560 | 54.363 | 1.00 | 36.68 | D000 C |
| ATOM | 3575 | CG | ASP | C | 177 | −15.641 | −37.883 | 55.810 | 1.00 | 47.91 | D000 C |
| ATOM | 3576 | OD1 | ASP | C | 177 | −15.459 | −39.080 | 56.124 | 1.00 | 48.52 | D000 O |
| ATOM | 3577 | OD2 | ASP | C | 177 | −15.561 | −36.943 | 56.631 | 1.00 | 44.32 | D000 O |
| ATOM | 3578 | N | ALA | C | 178 | −15.558 | −37.575 | 51.164 | 1.00 | 33.94 | D000 N |
| ATOM | 3579 | CA | ALA | C | 178 | −16.104 | −37.450 | 49.814 | 1.00 | 37.48 | D000 C |
| ATOM | 3580 | C | ALA | C | 178 | −15.776 | −38.696 | 48.994 | 1.00 | 30.71 | D000 C |
| ATOM | 3581 | O | ALA | C | 178 | −16.620 | −39.219 | 48.265 | 1.00 | 33.32 | D000 O |
| ATOM | 3582 | CB | ALA | C | 178 | −15.568 | −36.197 | 49.130 | 1.00 | 29.20 | D000 C |
| ATOM | 3583 | N | ASP | C | 179 | −14.540 | −39.161 | 49.134 | 1.00 | 30.70 | D000 N |
| ATOM | 3584 | CA | ASP | C | 179 | −14.078 | −40.389 | 48.501 | 1.00 | 27.81 | D000 C |
| ATOM | 3585 | C | ASP | C | 179 | −14.986 | −41.564 | 48.868 | 1.00 | 36.66 | D000 C |
| ATOM | 3586 | O | ASP | C | 179 | −15.411 | −42.333 | 48.005 | 1.00 | 36.40 | D000 O |
| ATOM | 3587 | CB | ASP | C | 179 | −12.630 | −40.671 | 48.918 | 1.00 | 31.15 | D000 C |
| ATOM | 3588 | CG | ASP | C | 179 | −12.068 | −41.935 | 48.289 | 1.00 | 39.74 | D000 C |
| ATOM | 3589 | OD1 | ASP | C | 179 | −12.435 | −42.255 | 47.139 | 1.00 | 49.64 | D000 O |
| ATOM | 3590 | OD2 | ASP | C | 179 | −11.247 | −42.607 | 48.947 | 1.00 | 47.11 | D000 O |
| ATOM | 3591 | N | ASN | C | 180 | −15.299 | −41.680 | 50.153 | 1.00 | 32.38 | D000 N |
| ATOM | 3592 | CA | ASN | C | 180 | −16.155 | −42.751 | 50.642 | 1.00 | 33.10 | D000 C |
| ATOM | 3593 | C | ASN | C | 180 | −17.598 | −42.602 | 50.155 | 1.00 | 32.93 | D000 C |
| ATOM | 3594 | O | ASN | C | 180 | −18.224 | −43.582 | 49.755 | 1.00 | 36.93 | D000 O |
| ATOM | 3595 | CB | ASN | C | 180 | −16.108 | −42.799 | 52.171 | 1.00 | 39.79 | D000 C |

TABLE 10.2-continued

| | | | | | | | | | | | |
|---|---|---|---|---|---|---|---|---|---|---|---|
| ATOM | 3596 | CG | ASN | C | 180 | −16.936 | −43.931 | 52.745 | 1.00 | 50.05 | D000 C |
| ATOM | 3597 | ND2 | ASN | C | 180 | −16.557 | −45.165 | 52.427 | 1.00 | 44.28 | D000 N |
| ATOM | 3598 | OD1 | ASN | C | 180 | −17.911 | −43.699 | 53.461 | 1.00 | 53.44 | D000 O |
| ATOM | 3599 | N | TYR | C | 181 | −18.120 | −41.378 | 50.182 | 1.00 | 33.15 | D000 N |
| ATOM | 3600 | CA | TYR | C | 181 | −19.460 | −41.105 | 49.659 | 1.00 | 36.25 | D000 C |
| ATOM | 3601 | C | TYR | C | 181 | −19.609 | −41.606 | 48.218 | 1.00 | 38.76 | D000 C |
| ATOM | 3602 | O | TYR | C | 181 | −20.608 | −42.238 | 47.875 | 1.00 | 36.89 | D000 O |
| ATOM | 3603 | CB | TYR | C | 181 | −19.775 | −39.605 | 49.728 | 1.00 | 29.33 | D000 C |
| ATOM | 3604 | CG | TYR | C | 181 | −21.139 | −39.226 | 49.184 | 1.00 | 38.78 | D000 C |
| ATOM | 3605 | CD1 | TYR | C | 181 | −21.333 | −39.016 | 47.820 | 1.00 | 39.24 | D000 C |
| ATOM | 3606 | CD2 | TYR | C | 181 | −22.232 | −39.065 | 50.032 | 1.00 | 37.86 | D000 C |
| ATOM | 3607 | CE1 | TYR | C | 181 | −22.574 | −38.670 | 47.316 | 1.00 | 41.79 | D000 C |
| ATOM | 3608 | CE2 | TYR | C | 181 | −23.484 | −38.716 | 49.534 | 1.00 | 30.18 | D000 C |
| ATOM | 3609 | CZ | TYR | C | 181 | −23.643 | −38.520 | 48.173 | 1.00 | 43.34 | D000 C |
| ATOM | 3610 | OH | TYR | C | 181 | −24.868 | −38.175 | 47.654 | 1.00 | 43.72 | D000 O |
| ATOM | 3611 | N | CYS | C | 182 | −18.617 | −41.321 | 47.379 | 1.00 | 32.27 | D000 N |
| ATOM | 3612 | CA | CYS | C | 182 | −18.688 | −41.720 | 45.977 | 1.00 | 33.21 | D000 C |
| ATOM | 3613 | C | CYS | C | 182 | −18.666 | −43.240 | 45.819 | 1.00 | 36.35 | D000 C |
| ATOM | 3614 | O | CYS | C | 182 | −19.433 | −43.793 | 45.032 | 1.00 | 28.20 | D000 O |
| ATOM | 3615 | CB | CYS | C | 182 | −17.550 | −41.079 | 45.177 | 1.00 | 33.72 | D000 C |
| ATOM | 3616 | SG | CYS | C | 182 | −17.775 | −39.294 | 44.910 | 1.00 | 35.82 | D000 S |
| ATOM | 3617 | N | ARG | C | 183 | −17.798 | −43.911 | 46.573 | 1.00 | 38.71 | D000 N |
| ATOM | 3618 | CA | ARG | C | 183 | −17.731 | −45.373 | −46.546 | 1.00 | 38.40 | D000 C |
| ATOM | 3619 | C | ARG | C | 183 | −19.071 | −45.997 | 46.942 | 1.00 | 41.03 | D000 C |
| ATOM | 3620 | O | ARG | C | 183 | −19.466 | −47.030 | 46.409 | 1.00 | 42.99 | D000 O |
| ATOM | 3621 | CB | ARG | C | 183 | −16.621 | −45.880 | 47.473 | 1.00 | 39.02 | D000 C |
| ATOM | 3622 | CG | ARG | C | 183 | −15.217 | −45.538 | 47.002 | 1.00 | 46.96 | D000 C |
| ATOM | 3623 | CD | ARG | C | 183 | −14.169 | −45.992 | 48.007 | 1.00 | 60.57 | D000 C |
| ATOM | 3624 | NE | ARG | C | 183 | −12.816 | −45.655 | 47.570 | 1.00 | 80.77 | D000 N |
| ATOM | 3625 | CZ | ARG | C | 183 | −11.722 | −45.845 | 48.301 | 1.00 | 85.00 | D000 C |
| ATOM | 3626 | NH1 | ARG | C | 183 | −11.814 | −46.372 | 49.516 | 1.00 | 72.80 | D000 N |
| ATOM | 3627 | NH2 | ARG | C | 183 | −10.532 | −45.505 | 47.818 | 1.00 | 88.26 | D000 N |
| ATOM | 3628 | N | LEU | C | 184 | −19.769 | −45.348 | 47.869 | 1.00 | 38.52 | D000 N |
| ATOM | 3629 | CA | LEU | C | 184 | −21.063 | −45.822 | 48.348 | 1.00 | 45.53 | D000 C |
| ATOM | 3630 | C | LEU | C | 184 | −22.165 | −45.627 | 47.305 | 1.00 | 44.46 | D000 C |
| ATOM | 3631 | O | LEU | C | 184 | −23.192 | −46.300 | 47.344 | 1.00 | 49.42 | D000 O |
| ATOM | 3632 | CB | LEU | C | 184 | −21.436 | −45.110 | 49.656 | 1.00 | 38.94 | D000 C |
| ATOM | 3633 | CG | LEU | C | 184 | −21.111 | −45.837 | 50.967 | 1.00 | 47.53 | D000 C |
| ATOM | 3634 | CD1 | LEU | C | 184 | −19.766 | −46.545 | 50.898 | 1.00 | 51.14 | D000 C |
| ATOM | 3635 | CD2 | LEU | C | 184 | −21.138 | −44.869 | 52.138 | 1.00 | 42.20 | D000 C |
| ATOM | 3636 | N | GLU | C | 185 | −21.953 | −44.701 | 46.376 | 1.00 | 42.20 | D000 N |
| ATOM | 3637 | CA | GLU | C | 185 | −22.903 | −44.483 | 45.288 | 1.00 | 39.20 | D000 C |
| ATOM | 3638 | C | GLU | C | 185 | −22.504 | −45.293 | 44.056 | 1.00 | 40.02 | D000 C |
| ATOM | 3639 | O | GLU | C | 185 | −22.992 | −45.040 | 42.954 | 1.00 | 41.00 | D000 O |
| ATOM | 3640 | CB | GLU | C | 185 | −22.991 | −42.997 | 44.936 | 1.00 | 43.28 | D000 C |
| ATOM | 3641 | CG | GLU | C | 185 | −23.645 | −42.139 | 46.005 | 1.00 | 50.04 | D000 C |
| ATOM | 3642 | CD | GLU | C | 185 | −25.132 | −42.410 | 46.144 | 1.00 | 63.83 | D000 C |
| ATOM | 3643 | OE1 | GLU | C | 185 | −25.853 | −42.327 | 45.125 | 1.00 | 64.40 | D000 O |
| ATOM | 3644 | OE2 | GLU | C | 185 | −25.578 | −42.711 | 47.274 | 1.00 | 66.65 | D000 O |
| ATOM | 3645 | N | ASP | C | 186 | −21.618 | −46.266 | 44.266 | 1.00 | 39.71 | D000 N |
| ATOM | 3646 | CA | ASP | C | 186 | −21.073 | −47.104 | 43.197 | 1.00 | 46.14 | D000 C |
| ATOM | 3647 | C | ASP | C | 186 | −20.374 | −46.235 | 42.149 | 1.00 | 46.36 | D000 C |
| ATOM | 3648 | O | ASP | C | 186 | −20.472 | −46.469 | 40.940 | 1.00 | 37.33 | D000 O |
| ATOM | 3649 | CB | ASP | C | 186 | −22.172 | −47.957 | 42.555 | 1.00 | 48.03 | D000 C |
| ATOM | 3650 | CG | ASP | C | 186 | −21.616 | −49.072 | 41.689 | 1.00 | 57.58 | D000 C |
| ATOM | 3651 | OD1 | ASP | C | 186 | −20.621 | −49.705 | 42.104 | 1.00 | 69.48 | D000 O |
| ATOM | 3652 | OD2 | ASP | C | 186 | −22.167 | −49.306 | 40.592 | 1.00 | 63.55 | D000 O |
| ATOM | 3653 | N | ALA | C | 187 | −19.667 | −45.222 | 42.634 | 1.00 | 37.49 | D000 N |
| ATOM | 3654 | CA | ALA | C | 187 | −18.974 | −44.291 | 41.763 | 1.00 | 36.04 | D000 C |
| ATOM | 3655 | C | ALA | C | 187 | −17.592 | −43.992 | 42.322 | 1.00 | 37.13 | D000 C |
| ATOM | 3656 | O | ALA | C | 187 | −17.086 | −44.715 | 43.183 | 1.00 | 35.71 | D000 O |
| ATOM | 3657 | CB | ALA | C | 187 | −19.784 | −43.005 | 41.603 | 1.00 | 29.96 | D000 C |
| ATOM | 3658 | N | HIS | C | 188 | −16.981 | −42.924 | 41.826 | 1.00 | 31.72 | D000 N |
| ATOM | 3659 | CA | HIS | C | 188 | −15.693 | −42.486 | 42.332 | 1.00 | 29.40 | D000 C |
| ATOM | 3660 | C | HIS | C | 188 | −15.569 | −40.982 | 42.157 | 1.00 | 28.01 | D000 C |
| ATOM | 3661 | O | HIS | C | 188 | −16.236 | −40.391 | 41.329 | 1.00 | 26.39 | D000 O |
| ATOM | 3662 | CB | HIS | C | 188 | −14.556 | −43.211 | 41.618 | 1.00 | 23.87 | D000 C |
| ATOM | 3663 | CG | HIS | C | 188 | −14.541 | −43.002 | 40.137 | 1.00 | 35.80 | D000 C |
| ATOM | 3664 | CD2 | HIS | C | 188 | −14.996 | −43.776 | 39.123 | 1.00 | 32.29 | D000 C |
| ATOM | 3665 | ND1 | HIS | C | 188 | −14.009 | −41.874 | 39.548 | 1.00 | 32.82 | D000 N |
| ATOM | 3666 | CE1 | HIS | C | 188 | −14.134 | −41.964 | 38.236 | 1.00 | 33.00 | D000 C |
| ATOM | 3667 | NE2 | HIS | C | 188 | −14.729 | −43.109 | 37.951 | 1.00 | 33.93 | D000 N |
| ATOM | 3668 | N | LEU | C | 189 | −14.708 | −40.364 | 42.958 | 1.00 | 26.16 | D000 N |
| ATOM | 3669 | CA | LEU | C | 189 | −14.400 | −38.950 | 42.784 | 1.00 | 28.90 | D000 C |
| ATOM | 3670 | C | LEU | C | 189 | −13.909 | −38.716 | 41.362 | 1.00 | 29.00 | D000 C |
| ATOM | 3671 | O | LEU | C | 189 | −13.176 | −39.541 | 40.805 | 1.00 | 27.16 | D000 O |
| ATOM | 3672 | CB | LEU | C | 189 | −13.356 | −38.488 | 43.796 | 1.00 | 26.67 | D000 C |
| ATOM | 3673 | CG | LEU | C | 189 | −13.882 | −38.242 | 45.208 | 1.00 | 33.12 | D000 C |
| ATOM | 3674 | CD1 | LEU | C | 189 | −12.735 | −37.973 | 46.169 | 1.00 | 33.71 | D000 C |
| ATOM | 3675 | CD2 | LEU | C | 189 | −14.857 | −37.076 | 45.186 | 1.00 | 27.90 | D000 C |

TABLE 10.2-continued

| | | | | | | | | | | | |
|---|---|---|---|---|---|---|---|---|---|---|---|
| ATOM | 3676 | N | VAL | C | 190 | −14.320 | −37.592 | 40.786 | 1.00 | 27.74 | D000 N |
| ATOM | 3677 | CA | VAL | C | 190 | −14.117 | +37.333 | 39.365 | 1.00 | 27.15 | D000 C |
| ATOM | 3678 | C | VAL | C | 190 | −12.644 | −37.428 | 38.968 | 1.00 | 29.08 | D000 C |
| ATOM | 3679 | O | VAL | C | 190 | −11.743 | −36.982 | 39.690 | 1.00 | 26.29 | D000 O |
| ATOM | 3680 | CB | VAL | C | 190 | −14.699 | −35.946 | 38.957 | 1.00 | 29.42 | D000 C |
| ATOM | 3681 | CG1 | VAL | C | 190 | −13.956 | −34.796 | 39.654 | 1.00 | 25.30 | D000 C |
| ATOM | 3682 | CG2 | VAL | C | 190 | −14.705 | −35.779 | 37.434 | 1.00 | 23.06 | D000 C |
| ATOM | 3683 | N | VAL | C | 191 | −12.420 | −38.079 | 37.834 | 1.00 | 26.83 | D000 N |
| ATOM | 3684 | CA | VAL | C | 191 | −11.106 | −38.192 | 37.221 | 1.00 | 30.57 | D000 C |
| ATOM | 3685 | C | VAL | C | 191 | −11.136 | −37.388 | 35.927 | 1.00 | 28.23 | D000 C |
| ATOM | 3686 | O | VAL | C | 191 | −12.017 | −37.590 | 35.096 | 1.00 | 26.03 | D000 O |
| ATOM | 3687 | CB | VAL | C | 191 | −10.739 | −39.664 | 36.942 | 1.00 | 28.44 | D000 C |
| ATOM | 3688 | CG1 | VAL | C | 191 | −9.433 | −39.763 | 36.170 | 1.00 | 25.60 | D000 C |
| ATOM | 3689 | CG2 | VAL | C | 191 | −10.663 | −40.445 | 38.256 | 1.00 | 26.79 | D000 C |
| ATOM | 3690 | N | VAL | C | 192 | −10.200 | −36.457 | 35.770 | 1.00 | 28.93 | D000 N |
| ATOM | 3691 | CA | VAL | C | 192 | −10.224 | −35.550 | 34.629 | 1.00 | 27.42 | D000 C |
| ATOM | 3692 | C | VAL | C | 192 | −9.181 | −35.963 | 33.602 | 1.00 | 31.88 | D000 C |
| ATOM | 3693 | O | VAL | C | 192 | −7.984 | −35.957 | 33.888 | 1.00 | 27.55 | D000 O |
| ATOM | 3694 | CB | VAL | C | 192 | −9.979 | −34.094 | 35.061 | 1.00 | 23.02 | D000 C |
| ATOM | 3695 | CG1 | VAL | C | 192 | −10.008 | −33.170 | 33.851 | 1.00 | 23.08 | D000 C |
| ATOM | 3696 | CG2 | VAL | C | 192 | −11.017 | −33.670 | 36.085 | 1.00 | 21.27 | D000 C |
| ATOM | 3697 | N | THR | C | 193 | −9.637 | −36.314 | 32.403 | 1.00 | 25.64 | D000 N |
| ATOM | 3698 | CA | THR | C | 193 | −8.751 | −36.918 | 31.415 | 1.00 | 32.64 | D000 C |
| ATOM | 3699 | C | THR | C | 193 | −8.608 | −36.120 | 30.125 | 1.00 | 31.08 | D000 C |
| ATOM | 3700 | O | THR | C | 193 | −7.920 | −36.558 | 29.206 | 1.00 | 30.10 | D000 O |
| ATOM | 3701 | CB | THR | C | 193 | −9.223 | −38.333 | 31.040 | 1.00 | 33.34 | D000 C |
| ATOM | 3702 | CG2 | THR | C | 193 | −9.327 | −39.208 | 32.285 | 1.00 | 32.24 | D000 C |
| ATOM | 3703 | OG1 | THR | C | 193 | −10.501 | −38.252 | 30.398 | 1.00 | 34.27 | D000 O |
| ATOM | 3704 | N | SER | C | 194 | −9.247 | −34.958 | 30.049 | 1.00 | 29.11 | D000 N |
| ATOM | 3705 | CA | SER | C | 194 | −9.115 | −34.111 | 28.866 | 1.00 | 29.77 | D000 C |
| ATOM | 3706 | C | SER | C | 194 | −9.525 | −32.671 | 29.159 | 1.00 | 29.25 | D000 C |
| ATOM | 3707 | O | SER | C | 194 | −10.227 | −32.400 | 30.137 | 1.00 | 23.94 | D000 O |
| ATOM | 3708 | CB | SER | C | 194 | −9.956 | −34.663 | 27.708 | 1.00 | 25.83 | D000 C |
| ATOM | 3709 | OG | SER | C | 194 | −11.335 | −34.423 | 27.935 | 1.00 | 28.83 | D000 O |
| ATOM | 3710 | N | TRP | C | 195 | −9.080 | −31.753 | 28.305 | 1.00 | 28.44 | D000 N |
| ATOM | 3711 | CA | TRP | C | 195 | −9.456 | −30.343 | 28.409 | 1.00 | 29.60 | D000 C |
| ATOM | 3712 | C | TRP | C | 195 | −10.972 | −30.177 | 28.304 | 1.00 | 25.02 | D000 C |
| ATOM | 3713 | O | TRP | C | 195 | −11.553 | −29.331 | 28.974 | 1.00 | 29.97 | D000 O |
| ATOM | 3714 | CB | TRP | C | 195 | −8.737 | −29.531 | 27.323 | 1.00 | 26.47 | D000 C |
| ATOM | 3715 | CG | TRP | C | 195 | −9.010 | −28.039 | 27.283 | 1.00 | 32.42 | D000 C |
| ATOM | 3716 | CD1 | TRP | C | 195 | −9.356 | −27.306 | 26.181 | 1.00 | 34.68 | D000 C |
| ATOM | 3717 | CD2 | TRP | C | 195 | −8.932 | −27.101 | 28.375 | 1.00 | 30.83 | D000 C |
| ATOM | 3718 | CE2 | TRP | C | 195 | −9.245 | −25.827 | 27.853 | 1.00 | 34.03 | D000 C |
| ATOM | 3719 | CE3 | TRP | C | 195 | −8.631 | −27.215 | 29.736 | 1.00 | 30.71 | D000 C |
| ATOM | 3720 | NE1 | TRP | C | 195 | −9.498 | −25.981 | 26.515 | 1.00 | 32.39 | D000 N |
| ATOM | 3721 | CZ2 | TRP | C | 195 | −9.271 | −24.678 | 28.645 | 1.00 | 31.06 | D000 C |
| ATOM | 3722 | CZ3 | TRP | C | 195 | −8.655 | −26.071 | 30.523 | 1.00 | 32.95 | D000 C |
| ATOM | 3723 | CH2 | TRP | C | 195 | −8.969 | −24.820 | 29.974 | 1.00 | 30.07 | D000 C |
| ATOM | 3724 | N | GLU | C | 196 | −11.607 | −30.999 | 27.471 | 1.00 | 26.97 | D000 N |
| ATOM | 3725 | CA | GLU | C | 196 | −13.060 | −30.960 | 27.306 | 1.00 | 30.42 | D000 C |
| ATOM | 3726 | C | GLU | C | 196 | −13.794 | −31.365 | 28.580 | 1.00 | 34.02 | D000 C |
| ATOM | 3727 | O | GLU | C | 196 | −14.802 | −30.757 | 28.943 | 1.00 | 28.31 | D000 O |
| ATOM | 3728 | CB | GLU | C | 196 | −13.505 | −31.871 | 26.158 | 1.00 | 30.46 | D000 C |
| ATOM | 3729 | CG | GLU | C | 196 | −13.221 | −31.329 | 24.769 | 1.00 | 41.10 | D000 C |
| ATOM | 3730 | CD | GLU | C | 196 | −11.772 | −31.498 | 24.353 | 1.00 | 46.52 | D000 C |
| ATOM | 3731 | OE1 | GLU | C | 196 | −11.002 | −32.155 | 25.092 | 1.00 | 42.32 | D000 O |
| ATOM | 3732 | OE2 | GLU | C | 196 | −11.406 | −30.973 | 23.281 | 1.00 | 46.49 | D000 O |
| ATOM | 3733 | N | GLU | C | 197 | −13.297 | −32.404 | 29.245 | 1.00 | 29.50 | D000 N |
| ATOM | 3734 | CA | GLU | C | 197 | −13.899 | −32.854 | 30.489 | 1.00 | 26.78 | D000 C |
| ATOM | 3735 | C | GLU | C | 197 | −13.708 | −31.790 | 31.574 | 1.00 | 26.09 | D000 C |
| ATOM | 3736 | O | GLU | C | 197 | −14.631 | −31.493 | 32.329 | 1.00 | 27.28 | D000 O |
| ATOM | 3737 | CB | GLU | C | 197 | −13.305 | −34.198 | 30.930 | 1.00 | 26.61 | D000 C |
| ATOM | 3738 | CG | GLU | C | 197 | −14.055 | −34.841 | 32.100 | 1.00 | 27.35 | D000 C |
| ATOM | 3739 | CD | GLU | C | 197 | −13.518 | −36.215 | 32.488 | 1.00 | 37.87 | D000 C |
| ATOM | 3740 | OE1 | GLU | C | 197 | −12.434 | −36.602 | 32.003 | 1.00 | 33.97 | D000 O |
| ATOM | 3741 | OE2 | GLU | C | 197 | −14.187 | −36.910 | 33.285 | 1.00 | 39.22 | D000 O |
| ATOM | 3742 | N | GLN | C | 198 | −12.514 | −31.205 | 31.629 | 1.00 | 25.72 | D000 N |
| ATOM | 3743 | CA | GLN | C | 198 | −12.214 | −30.140 | 32.588 | 1.00 | 25.80 | D000 C |
| ATOM | 3744 | C | GLN | C | 198 | −13.189 | −28.975 | 32.463 | 1.00 | 29.00 | D000 C |
| ATOM | 3745 | O | GLN | C | 198 | −13.685 | −28.458 | 33.464 | 1.00 | 24.52 | D000 O |
| ATOM | 3746 | CB | GLN | C | 198 | −10.783 | −29.632 | 32.394 | 1.00 | 23.78 | D000 C |
| ATOM | 3747 | CG | GLN | C | 198 | −10.506 | −28.288 | 33.045 | 1.00 | 25.75 | D000 C |
| ATOM | 3748 | CD | GLN | C | 198 | −10.246 | −28.397 | 34.537 | 1.00 | 33.71 | D000 C |
| ATOM | 3749 | NE2 | GLN | C | 198 | −10.599 | −27.350 | 35.279 | 1.00 | 25.10 | D000 N |
| ATOM | 3750 | OE1 | GLN | C | 198 | −9.734 | −29.410 | 35.017 | 1.00 | 28.06 | D000 O |
| ATOM | 3751 | N | LYS | C | 199 | −13.466 | −28.574 | 31.226 | 1.00 | 30.60 | D000 N |
| ATOM | 3752 | CA | LYS | C | 199 | −14.326 | −27.424 | 30.974 | 1.00 | 34.08 | D000 C |
| ATOM | 3753 | C | LYS | C | 199 | −15.770 | −27.743 | 31.319 | 1.00 | 28.60 | D000 C |
| ATOM | 3754 | O | LYS | C | 199 | −16.489 | −26.895 | 31.848 | 1.00 | 25.57 | D000 O |
| ATOM | 3755 | CB | LYS | C | 199 | −14.212 | −26.978 | 29.517 | 1.00 | 28.25 | D000 C |

TABLE 10.2-continued

| ATOM | 3756 | CG | LYS | C | 199 | −12.855 | −26.386 | 29.183 | 1.00 | 34.79 | D000 | C |
|---|---|---|---|---|---|---|---|---|---|---|---|---|
| ATOM | 3757 | CD | LYS | C | 199 | −12.532 | −26.545 | 27.711 | 1.00 | 43.54 | D000 | C |
| ATOM | 3758 | CE | LYS | C | 199 | −13.150 | −25.447 | 26.892 | 1.00 | 38.89 | D000 | C |
| ATOM | 3759 | NZ | LYS | C | 199 | −12.740 | −25.539 | 25.453 | 1.00 | 35.02 | D000 | N |
| ATOM | 3760 | N | PHE | C | 200 | −16.188 | −28.968 | 31.013 | 1.00 | 29.54 | D000 | N |
| ATOM | 3761 | CA | PHE | C | 200 | −17.515 | −29.436 | 31.393 | 1.00 | 30.79 | D000 | C |
| ATOM | 3762 | C | PHE | C | 200 | −17.682 | −29.381 | 32.909 | 1.00 | 25.62 | D000 | C |
| ATOM | 3763 | O | PHE | C | 200 | −18.651 | −28.807 | 33.414 | 1.00 | 25.66 | D000 | O |
| ATOM | 3764 | CB | PHE | C | 200 | −17.762 | −30.861 | 30.891 | 1.00 | 27.79 | D000 | C |
| ATOM | 3765 | CG | PHE | C | 200 | −18.939 | −31.530 | 31.541 | 1.00 | 33.05 | D000 | C |
| ATOM | 3766 | CD1 | PHE | C | 200 | −20.230 | −31.216 | 31.154 | 1.00 | 29.57 | D000 | C |
| ATOM | 3767 | CD2 | PHE | C | 200 | −18.754 | −32.467 | 32.547 | 1.00 | 33.93 | D000 | C |
| ATOM | 3768 | CE1 | PHE | C | 200 | −21.315 | −31.826 | 31.753 | 1.00 | 31.19 | D000 | C |
| ATOM | 3769 | CE2 | PHE | C | 200 | −19.837 | −33.077 | 33.154 | 1.00 | 30.44 | D000 | C |
| ATOM | 3770 | CZ | PHE | C | 200 | −21.118 | −32.756 | 32.755 | 1.00 | 33.80 | D000 | C |
| ATOM | 3771 | N | VAL | C | 201 | −16.730 | −29.971 | 33.627 | 1.00 | 27.40 | D000 | N |
| ATOM | 3772 | CA | VAL | C | 201 | −16.756 | −29.964 | 35.088 | 1.00 | 26.65 | D000 | C |
| ATOM | 3773 | C | VAL | C | 201 | −16.750 | −28.533 | 35.609 | 1.00 | 33.34 | D000 | C |
| ATOM | 3774 | O | VAL | C | 201 | −17.593 | −28.149 | 36.428 | 1.00 | 25.82 | D000 | O |
| ATOM | 3775 | CB | VAL | C | 201 | −15.557 | −30.727 | 35.679 | 1.00 | 30.52 | D000 | C |
| ATOM | 3776 | CG1 | VAL | C | 201 | −15.448 | −30.466 | 37.173 | 1.00 | 27.81 | D000 | C |
| ATOM | 3777 | CG2 | VAL | C | 201 | −15.677 | −32.219 | 35.392 | 1.00 | 24.80 | D000 | C |
| ATOM | 3778 | N | GLN | C | 202 | −15.804 | −27.748 | 35.098 | 1.00 | 28.75 | D000 | N |
| ATOM | 3779 | CA | GLN | C | 202 | −15.629 | −26.353 | 35.482 | 1.00 | 28.03 | D000 | C |
| ATOM | 3780 | C | GLN | C | 202 | −16.905 | −25.544 | 35.295 | 1.00 | 26.50 | D000 | C |
| ATOM | 3781 | O | GLN | C | 202 | −17.221 | −24.662 | 36.097 | 1.00 | 30.81 | D000 | O |
| ATOM | 3782 | CB | GLN | C | 202 | −14.495 | −25.736 | 34.663 | 1.00 | 28.31 | D000 | C |
| ATOM | 3783 | CG | GLN | C | 202 | −13.779 | −24.603 | 35.333 | 1.00 | 34.63 | D000 | C |
| ATOM | 3784 | CD | GLN | C | 202 | −12.592 | −24.127 | 34.524 | 1.00 | 36.40 | D000 | C |
| ATOM | 3785 | NE2 | GLN | C | 202 | −12.382 | −22.815 | 34.494 | 1.00 | 34.64 | D000 | N |
| ATOM | 3786 | OE1 | GLN | C | 202 | −11.874 | −24.931 | 33.924 | 1.00 | 33.68 | D000 | O |
| ATOM | 3787 | N | HIS | C | 203 | −17.640 | −25.848 | 34.232 | 1.00 | 28.19 | D000 | N |
| ATOM | 3788 | CA | HIS | C | 203 | −18.895 | −25.158 | 33.971 | 1.00 | 28.76 | D000 | C |
| ATOM | 3789 | C | HIS | C | 203 | −19.921 | −25.389 | 35.081 | 1.00 | 37.82 | D000 | C |
| ATOM | 3790 | O | HIS | C | 203 | −20.664 | −24.477 | 35.450 | 1.00 | 30.91 | D000 | O |
| ATOM | 3791 | CB | HIS | C | 203 | −19.490 | −25.597 | 32.633 | 1.00 | 27.45 | D000 | C |
| ATOM | 3792 | CG | HIS | C | 203 | −20.836 | −25.002 | 32.361 | 1.00 | 35.85 | D000 | C |
| ATOM | 3793 | CD2 | HIS | C | 203 | −21.189 | −23.825 | 31.791 | 1.00 | 40.47 | D000 | C |
| ATOM | 3794 | ND1 | HIS | C | 203 | −22.010 | −25.619 | 32.728 | 1.00 | 42.36 | D000 | N |
| ATOM | 3795 | CE1 | HIS | C | 203 | −23.035 | −24.857 | 32.380 | 1.00 | 38.39 | D000 | C |
| ATOM | 3796 | NE2 | HIS | C | 203 | −22.561 | −23.764 | 31.810 | 1.00 | 42.37 | D000 | N |
| ATOM | 3797 | N | HIS | C | 204 | −19.970 | −26.608 | 35.612 | 1.00 | 31.47 | D000 | N |
| ATOM | 3798 | CA | HIS | C | 204 | −20.992 | −26.941 | 36.602 | 1.00 | 30.96 | D000 | C |
| ATOM | 3799 | C | HIS | C | 204 | −20.619 | −26.543 | 38.023 | 1.00 | 29.48 | D000 | C |
| ATOM | 3800 | O | HIS | C | 204 | −21.489 | −26.143 | 38.796 | 1.00 | 28.82 | D000 | O |
| ATOM | 3801 | CB | HIS | C | 204 | −21.317 | −28.434 | 36.545 | 1.00 | 30.72 | D000 | C |
| ATOM | 3802 | CG | HIS | C | 204 | −22.172 | −28.808 | 35.376 | 1.00 | 31.65 | D000 | C |
| ATOM | 3803 | CD2 | HIS | C | 204 | −21.889 | −29.495 | 34.244 | 1.00 | 34.41 | D000 | C |
| ATOM | 3804 | ND1 | HIS | C | 204 | −23.494 | −28.433 | 35.274 | 1.00 | 39.82 | D000 | N |
| ATOM | 3805 | CE1 | HIS | C | 204 | −23.993 | −28.884 | 34.138 | 1.00 | 35.14 | D000 | C |
| ATOM | 3806 | NE2 | HIS | C | 204 | −23.038 | −29.531 | 33.493 | 1.00 | 39.82 | D000 | N |
| ATOM | 3807 | N | ILE | C | 205 | −19.340 | −26.628 | 38.375 | 1.00 | 26.45 | D000 | N |
| ATOM | 3808 | CA | ILE | C | 205 | −18.942 | −26.275 | 39.735 | 1.00 | 32.57 | D000 | C |
| ATOM | 3809 | C | ILE | C | 205 | −18.811 | −24.758 | 39.911 | 1.00 | 29.31 | D000 | C |
| ATOM | 3810 | O | ILE | C | 205 | −18.976 | −24.244 | 41.015 | 1.00 | 30.32 | D000 | O |
| ATOM | 3811 | CB | ILE | C | 205 | −17.613 | −26.955 | 40.152 | 1.00 | 31.86 | D000 | C |
| ATOM | 3812 | CG1 | ILE | C | 205 | −16.437 | −26.421 | 39.339 | 1.00 | 31.34 | D000 | C |
| ATOM | 3813 | CG2 | ILE | C | 205 | −17.710 | −28.477 | 40.014 | 1.00 | 29.23 | D000 | C |
| ATOM | 3814 | CD1 | ILE | C | 205 | −15.107 | −26.968 | 39.802 | 1.00 | 32.36 | D000 | C |
| ATOM | 3815 | N | GLY | C | 206 | −18.540 | −24.043 | 38.825 | 1.00 | 24.89 | D000 | N |
| ATOM | 3816 | CA | GLY | C | 206 | −18.307 | −22.613 | 38.912 | 1.00 | 26.12 | D000 | C |
| ATOM | 3817 | C | GLY | C | 206 | −17.033 | −22.318 | 39.688 | 1.00 | 33.16 | D000 | C |
| ATOM | 3818 | O | GLY | C | 206 | −16.182 | −23.197 | 39.845 | 1.00 | 27.62 | D000 | O |
| ATOM | 3819 | N | PRO | C | 207 | −16.895 | −21.081 | 40.189 | 1.00 | 27.47 | D000 | N |
| ATOM | 3820 | CA | PRO | C | 207 | −15.679 | −20.657 | 40.895 | 1.00 | 28.28 | D000 | C |
| ATOM | 3821 | C | PRO | C | 207 | −15.651 | −21.107 | 42.360 | 1.00 | 33.47 | D000 | C |
| ATOM | 3822 | O | PRO | C | 207 | −15.598 | −20.266 | 43.255 | 1.00 | 30.13 | D000 | O |
| ATOM | 3823 | CB | PRO | C | 207 | −15.741 | −19.130 | 40.792 | 1.00 | 27.65 | D000 | C |
| ATOM | 3824 | CG | PRO | C | 207 | −17.204 | −18.830 | 40.787 | 1.00 | 30.21 | D000 | C |
| ATOM | 3825 | CD | PRO | C | 207 | −17.873 | −19.984 | 40.065 | 1.00 | 29.69 | D000 | C |
| ATOM | 3826 | N | VAL | C | 208 | −15.674 | −22.417 | 42.594 | 1.00 | 36.48 | D000 | N |
| ATOM | 3827 | CA | VAL | C | 208 | −15.803 | −22.969 | 43.944 | 1.00 | 29.83 | D000 | C |
| ATOM | 3828 | C | VAL | C | 208 | −14.809 | −24.105 | 44.182 | 1.00 | 33.04 | D000 | C |
| ATOM | 3829 | O | VAL | C | 208 | −14.697 | −25.001 | 43.351 | 1.00 | 26.89 | D000 | O |
| ATOM | 3830 | CB | VAL | C | 208 | −17.233 | −23.504 | 44.191 | 1.00 | 35.14 | D000 | C |
| ATOM | 3831 | CG1 | VAL | C | 208 | −17.349 | −24.108 | 45.585 | 1.00 | 33.92 | D000 | C |
| ATOM | 3832 | CG2 | VAL | C | 208 | −18.271 | −22.402 | 43.981 | 1.00 | 32.86 | D000 | C |
| ATOM | 3833 | N | ASN | C | 209 | −14.092 | −24.071 | 45.306 | 1.00 | 30.99 | D000 | N |
| ATOM | 3834 | CA | ASN | C | 209 | −13.164 | −25.153 | 45.649 | 1.00 | 31.35 | D000 | C |
| ATOM | 3835 | C | ASN | C | 209 | −13.881 | −26.500 | 45.682 | 1.00 | 32.29 | D000 | C |

TABLE 10.2-continued

| | | | | | | | | | | | |
|---|---|---|---|---|---|---|---|---|---|---|---|
| ATOM | 3836 | O | ASN | C | 209 | −14.881 | −26.666 | 46.379 | 1.00 | 29.08 | D000 O |
| ATOM | 3837 | CB | ASN | C | 209 | −12.486 | −24.895 | 46.994 | 1.00 | 25.98 | D000 C |
| ATOM | 3838 | CG | ASN | C | 209 | −11.461 | −23.781 | 46.931 | 1.00 | 30.97 | D000 C |
| ATOM | 3839 | ND2 | ASN | C | 209 | −11.376 | −22.997 | 48.000 | 1.00 | 35.10 | D000 N |
| ATOM | 3840 | OD1 | ASN | C | 209 | −10.750 | −23.626 | 45.938 | 1.00 | 30.97 | D000 O |
| ATOM | 3841 | N | THR | C | 210 | −13.363 | −27.457 | 44.919 | 1.00 | 30.16 | D000 N |
| ATOM | 3842 | CA | THR | C | 210 | −14.049 | −28.725 | 44.705 | 1.00 | 26.80 | D000 C |
| ATOM | 3843 | C | THR | C | 210 | −13.049 | −29.865 | 44.549 | 1.00 | 26.68 | D000 C |
| ATOM | 3844 | O | THR | C | 210 | −12.182 | −29.822 | 43.673 | 1.00 | 30.56 | D000 O |
| ATOM | 3845 | CB | THR | C | 210 | −14.949 | −28.655 | 43.456 | 1.00 | 29.42 | D000 C |
| ATOM | 3846 | CG2 | THR | C | 210 | −15.785 | −29.916 | 43.312 | 1.00 | 22.22 | D000 C |
| ATOM | 3847 | OG1 | THR | C | 210 | −15.813 | −27.515 | 43.556 | 1.00 | 26.16 | D000 O |
| ATOM | 3848 | N | TRP | C | 211 | −13.165 | −30.872 | 45.410 | 1.00 | 25.09 | D000 N |
| ATOM | 3849 | CA | TRP | C | 211 | −12.294 | −32.041 | 45.357 | 1.00 | 30.07 | D000 C |
| ATOM | 3850 | C | TRP | C | 211 | −12.423 | −32.796 | 44.038 | 1.00 | 36.81 | D000 C |
| ATOM | 3851 | O | TRP | C | 211 | −13.510 | −32.874 | 43.456 | 1.00 | 27.60 | D000 O |
| ATOM | 3852 | CB | TRP | C | 211 | −12.605 | −33.013 | 46.501 | 1.00 | 27.04 | D000 C |
| ATOM | 3853 | CG | TRP | C | 211 | −12.261 | −32.549 | 47.900 | 1.00 | 28.12 | D000 C |
| ATOM | 3854 | CD1 | TRP | C | 211 | −13.097 | −32.529 | 48.983 | 1.00 | 28.01 | D000 C |
| ATOM | 3855 | CD2 | TRP | C | 211 | −10.991 | −32.072 | 48.366 | 1.00 | 26.23 | D000 C |
| ATOM | 3856 | CE2 | TRP | C | 211 | −11.136 | −31.771 | 49.739 | 1.00 | 31.66 | D000 C |
| ATOM | 3857 | CE3 | TRP | C | 211 | −9.751 | −31.857 | 47.756 | 1.00 | 23.53 | D000 C |
| ATOM | 3858 | NE1 | TRP | C | 211 | −12.428 | −32.060 | 50.091 | 1.00 | 29.06 | D000 N |
| ATOM | 3859 | CZ2 | TRP | C | 211 | −10.084 | −31.274 | 50.509 | 1.00 | 31.81 | D000 C |
| ATOM | 3860 | CZ3 | TRP | C | 211 | −8.709 | −31.361 | 48.522 | 1.00 | 26.50 | D000 C |
| ATOM | 3861 | CH2 | TRP | C | 211 | −8.881 | −31.078 | 49.885 | 1.00 | 32.71 | D000 C |
| ATOM | 3862 | N | MET | C | 212 | −11.310 | −33.363 | 43.585 | 1.00 | 29.78 | D000 N |
| ATOM | 3863 | CA | MET | C | 212 | −11.327 | −34.332 | 42.500 | 1.00 | 26.98 | D000 C |
| ATOM | 3864 | C | MET | C | 212 | −10.681 | −35.620 | 43.009 | 1.00 | 30.71 | D000 C |
| ATOM | 3865 | O | MET | C | 212 | −10.179 | −35.655 | 44.134 | 1.00 | 26.90 | D000 O |
| ATOM | 3866 | CB | MET | C | 212 | −10.598 | −33.793 | 41.266 | 1.00 | 28.53 | D000 C |
| ATOM | 3867 | CG | MET | C | 212 | −9.082 | −33.872 | 41.344 | 1.00 | 27.04 | D000 C |
| ATOM | 3868 | SD | MET | C | 212 | −8.287 | −32.882 | 40.061 | 1.00 | 30.51 | D000 S |
| ATOM | 3869 | CE | MET | C | 212 | −8.761 | −31.231 | 40.597 | 1.00 | 22.33 | D000 C |
| ATOM | 3870 | N | GLY | C | 213 | −10.693 | −36.673 | 42.195 | 1.00 | 23.24 | D000 N |
| ATOM | 3871 | CA | GLY | C | 213 | −10.149 | −37.955 | 42.612 | 1.00 | 21.72 | D000 C |
| ATOM | 3872 | C | GLY | C | 213 | −8.655 | −38.108 | 42.405 | 1.00 | 27.75 | D000 C |
| ATOM | 3873 | O | GLY | C | 213 | −8.199 | −39.106 | 41.851 | 1.00 | 28.41 | D000 O |
| ATOM | 3874 | N | LEU | C | 214 | −7.891 | −37.124 | 42.870 | 1.00 | 25.92 | D000 N |
| ATOM | 3875 | CA | LEU | C | 214 | −6.443 | −37.109 | 42.691 | 1.00 | 26.73 | D000 C |
| ATOM | 3876 | C | LEU | C | 214 | −5.755 | −36.799 | 44.018 | 1.00 | 25.75 | D000 C |
| ATOM | 3877 | O | LEU | C | 214 | −6.073 | −35.802 | 44.659 | 1.00 | 25.95 | D000 O |
| ATOM | 3878 | CB | LEU | C | 214 | −6.049 | −36.076 | 41.629 | 1.00 | 24.90 | D000 C |
| ATOM | 3879 | CG | LEU | C | 214 | −4.566 | −35.777 | 41.383 | 1.00 | 25.82 | D000 C |
| ATOM | 3880 | CD1 | LEU | C | 214 | −3.840 | −37.006 | 40.861 | 1.00 | 22.24 | D000 C |
| ATOM | 3881 | CD2 | LEU | C | 214 | −4.428 | −34.615 | 40.402 | 1.00 | 20.00 | D000 C |
| ATOM | 3882 | N | HIS | C | 215 | −4.819 | −37.653 | 44.426 | 1.00 | 28.82 | D000 N |
| ATOM | 3883 | CA | HIS | C | 215 | −4.139 | −37.488 | 45.709 | 1.00 | 25.47 | D000 C |
| ATOM | 3884 | C | HIS | C | 215 | −2.797 | −38.207 | 45.727 | 1.00 | 27.39 | D000 C |
| ATOM | 3885 | O | HIS | C | 215 | −2.570 | −39.123 | 44.938 | 1.00 | 28.76 | D000 O |
| ATOM | 3886 | CB | HIS | C | 215 | −5.011 | −38.011 | 46.850 | 1.00 | 25.17 | D000 C |
| ATOM | 3887 | CG | HIS | C | 215 | −5.082 | −39.505 | 46.915 | 1.00 | 33.85 | D000 C |
| ATOM | 3888 | CD2 | HIS | C | 215 | −5.484 | −40.419 | 45.999 | 1.00 | 36.27 | D000 C |
| ATOM | 3889 | ND1 | HIS | C | 215 | −4.705 | −40.221 | 48.030 | 1.00 | 43.52 | D000 N |
| ATOM | 3890 | CE1 | HIS | C | 215 | −4.874 | −41.511 | 47.800 | 1.00 | 45.66 | D000 C |
| ATOM | 3891 | NE2 | HIS | C | 215 | −5.347 | −41.657 | 46.575 | 1.00 | 38.89 | D000 N |
| ATOM | 3892 | N | ASP | C | 216 | −1.908 | −37.808 | 46.632 | 1.00 | 31.91 | D000 N |
| ATOM | 3893 | CA | ASP | C | 216 | −0.623 | −38.485 | 46.760 | 1.00 | 28.17 | D000 C |
| ATOM | 3894 | C | ASP | C | 216 | −0.369 | −38.944 | 48.199 | 1.00 | 35.16 | D000 C |
| ATOM | 3895 | O | ASP | C | 216 | 0.764 | −38.955 | 48.668 | 1.00 | 31.36 | D000 O |
| ATOM | 3896 | CB | ASP | C | 216 | 0.518 | −37.585 | 46.258 | 1.00 | 28.42 | D000 C |
| ATOM | 3897 | CG | ASP | C | 216 | −0.795 | −36.394 | 47.171 | 1.00 | 35.01 | D000 C |
| ATOM | 3898 | OD1 | ASP | C | 216 | −0.013 | −36.142 | 48.110 | 1.00 | 28.86 | D000 O |
| ATOM | 3899 | OD2 | ASP | C | 216 | 1.805 | −35.695 | 46.936 | 1.00 | 31.47 | D000 O |
| ATOM | 3900 | N | GLN | C | 217 | −1.432 | −39.332 | 48.894 | 1.00 | 31.06 | D000 N |
| ATOM | 3901 | CA | GLN | C | 217 | −1.305 | −39.781 | 50.278 | 1.00 | 41.47 | D000 C |
| ATOM | 3902 | C | GLN | C | 217 | −0.531 | −41.103 | 50.385 | 1.00 | 38.57 | D000 C |
| ATOM | 3903 | O | GLN | C | 217 | 0.157 | −41.346 | 51.374 | 1.00 | 44.82 | D000 O |
| ATOM | 3904 | CB | GLN | C | 217 | −2.688 | −39.926 | 50.918 | 1.00 | 37.52 | D000 C |
| ATOM | 3905 | CG | GLN | C | 217 | −3.504 | −38.644 | 50.919 | 1.00 | 33.20 | D000 C |
| ATOM | 3906 | CD | GLN | C | 217 | −4.837 | −38.799 | 51.626 | 1.00 | 39.32 | D000 C |
| ATOM | 3907 | NE2 | GLN | C | 217 | −5.810 | −39.389 | 50.941 | 1.00 | 31.27 | D000 N |
| ATOM | 3908 | OE1 | GLN | C | 217 | −4.989 | −38.391 | 52.775 | 1.00 | 48.65 | D000 O |
| ATOM | 3909 | N | ASN | C | 218 | −0.630 | −41.939 | 49.356 | 1.00 | 38.48 | D000 N |
| ATOM | 3910 | CA | ASN | C | 218 | 0.018 | −43.251 | 49.363 | 1.00 | 53.29 | D000 C |
| ATOM | 3911 | C | ASN | C | 218 | 1.205 | −43.357 | 48.405 | 1.00 | 47.43 | D000 C |
| ATOM | 3912 | O | ASN | C | 218 | 1.397 | −44.389 | 47.761 | 1.00 | 58.53 | D000 O |
| ATOM | 3913 | CB | ASN | C | 218 | −1.004 | −44.339 | 49.018 | 1.00 | 57.61 | D000 C |
| ATOM | 3914 | CG | ASN | C | 218 | −2.213 | −44.313 | 49.933 | 1.00 | 65.75 | D000 C |
| ATOM | 3915 | ND2 | ASN | C | 218 | −1.966 | −44.302 | 51.241 | 1.00 | 59.68 | D000 N |

TABLE 10.2-continued

| | | | | | | | | | | |
|---|---|---|---|---|---|---|---|---|---|---|
| ATOM | 3916 | OD1 | ASN | C | 218 | −3.356 | −44.293 | 49.471 | 1.00 | 59.70 | D000 O |
| ATOM | 3917 | N | GLY | C | 219 | 2.001 | −42.299 | 48.313 | 1.00 | 35.56 | D000 N |
| ATOM | 3918 | CA | GLY | C | 219 | 3.081 | −42.255 | 47.344 | 1.00 | 36.85 | D000 C |
| ATOM | 3919 | C | GLY | C | 219 | 2.873 | −41.128 | 46.353 | 1.00 | 34.18 | D000 C |
| ATOM | 3920 | O | GLY | C | 219 | 2.347 | −40.080 | 46.716 | 1.00 | 32.25 | D000 O |
| ATOM | 3921 | N | PRO | C | 220 | 3.284 | −41.332 | 45.092 | 1.00 | 35.79 | D000 N |
| ATOM | 3922 | CA | PRO | C | 220 | 3.144 | −40.284 | 44.072 | 1.00 | 33.07 | D000 C |
| ATOM | 3923 | C | PRO | C | 220 | 1.683 | −40.001 | 43.728 | 1.00 | 31.10 | D000 C |
| ATOM | 3924 | O | PRO | C | 220 | 0.801 | −40.767 | 44.117 | 1.00 | 29.49 | D000 O |
| ATOM | 3925 | CB | PRO | C | 220 | 3.897 | −40.859 | 42.867 | 1.00 | 37.25 | D000 C |
| ATOM | 3926 | CG | PRO | C | 220 | 3.868 | −42.336 | 43.073 | 1.00 | 41.99 | D000 C |
| ATOM | 3927 | CD | PRO | C | 220 | 3.925 | −42.547 | 44.558 | 1.00 | 34.70 | D000 C |
| ATOM | 3928 | N | TRP | C | 221 | 1.433 | −38.904 | 43.019 | 1.00 | 28.69 | D000 N |
| ATOM | 3929 | CA | TRP | C | 221 | 0.070 | −38.514 | 42.668 | 1.00 | 29.66 | D000 C |
| ATOM | 3930 | C | TRP | C | 221 | −0.626 | −39.607 | 41.857 | 1.00 | 29.27 | D000 C |
| ATOM | 3931 | O | TRP | C | 221 | −0.081 | −40.110 | 40.879 | 1.00 | 26.36 | D000 O |
| ATOM | 3932 | CB | TRP | C | 221 | 0.075 | −37.185 | 41.900 | 1.00 | 27.58 | D000 C |
| ATOM | 3933 | CG | TRP | C | 221 | 0.406 | −36.020 | 42.782 | 1.00 | 30.86 | D000 C |
| ATOM | 3934 | CD1 | TRP | C | 221 | 1.629 | −35.437 | 42.947 | 1.00 | 32.27 | D000 C |
| ATOM | 3935 | CD2 | TRP | C | 221 | −0.495 | −35.311 | 43.643 | 1.00 | 27.75 | D000 C |
| ATOM | 3936 | CE2 | TRP | C | 221 | 0.253 | −34.309 | 44.298 | 1.00 | 32.54 | D000 C |
| ATOM | 3937 | CE3 | TRP | C | 221 | −1.861 | −35.428 | 43.926 | 1.00 | 25.76 | D000 C |
| ATOM | 3938 | NE1 | TRP | C | 221 | 1.545 | −34.406 | 43.853 | 1.00 | 32.24 | D000 N |
| ATOM | 3939 | CZ2 | TRP | C | 221 | −0.320 | −33.425 | 45.219 | 1.00 | 27.09 | D000 C |
| ATOM | 3940 | CZ3 | TRP | C | 221 | −2.430 | −34.549 | 44.841 | 1.00 | 29.33 | D000 C |
| ATOM | 3941 | CK2 | TRP | C | 221 | −1.658 | −33.560 | 45.474 | 1.00 | 29.04 | D000 C |
| ATOM | 3942 | N | LYS | C | 222 | −1.826 | −39.981 | 42.289 | 1.00 | 30.12 | D000 N |
| ATOM | 3943 | CA | LYS | C | 222 | −2.585 | −41.046 | 41.643 | 1.00 | 30.34 | D000 C |
| ATOM | 3944 | C | LYS | C | 222 | −4.058 | −40.687 | 41.501 | 1.00 | 27.82 | D000 C |
| ATOM | 3945 | O | LYS | C | 222 | −4.627 | −40.026 | 42.370 | 1.00 | 29.51 | D000 O |
| ATOM | 3946 | CB | LYS | C | 222 | −2.453 | −42.351 | 42.436 | 1.00 | 35.42 | D000 C |
| ATOM | 3947 | CG | LYS | C | 222 | −1.072 | −42.983 | 42.388 | 1.00 | 42.04 | D000 C |
| ATOM | 3948 | CD | LYS | C | 222 | −0.966 | −44.138 | 43.373 | 1.00 | 62.76 | D000 C |
| ATOM | 3949 | CE | LYS | C | 222 | 0.452 | −44.687 | 43.443 | 1.00 | 66.16 | D000 C |
| ATOM | 3950 | NZ | LYS | C | 222 | 0.599 | −45.699 | 44.533 | 1.00 | 72.02 | D000 N |
| ATOM | 3951 | N | TRP | C | 223 | −4.670 | −41.121 | 40.406 | 1.00 | 29.14 | D000 N |
| ATOM | 3952 | CA | TRP | C | 223 | −6.119 | −41.022 | 40.249 | 1.00 | 31.28 | D000 C |
| ATOM | 3953 | C | TRP | C | 223 | −6.787 | −42.218 | 40.920 | 1.00 | 29.31 | D000 C |
| ATOM | 3954 | O | TRP | C | 223 | −6.254 | −43.321 | 40.883 | 1.00 | 30.17 | D000 O |
| ATOM | 3955 | CB | TRP | C | 223 | −6.512 | −40.959 | 38.774 | 1.00 | 23.94 | D000 C |
| ATOM | 3956 | CG | TRP | C | 223 | −6.104 | −39.694 | 38.085 | 1.00 | 27.95 | D000 C |
| ATOM | 3957 | CD1 | TRP | C | 223 | −5.059 | −39.530 | 37.226 | 1.00 | 23.23 | D000 C |
| ATOM | 3958 | CD2 | TRP | C | 223 | −6.742 | −38.414 | 38.191 | 1.00 | 24.93 | D000 C |
| ATOM | 3959 | CE2 | TRP | C | 223 | −6.026 | −37.523 | 37.365 | 1.00 | 23.92 | D000 C |
| ATOM | 3960 | CE3 | TRP | C | 223 | −7.851 | −37.938 | 38.901 | 1.00 | 23.92 | D000 C |
| ATOM | 3961 | NE1 | TRP | C | 223 | −5.002 | −38.228 | 36.790 | 1.00 | 25.78 | D000 N |
| ATOM | 3962 | CZ2 | TRP | C | 223 | −6.382 | −36.182 | 37.228 | 1.00 | 28.71 | D000 C |
| ATOM | 3963 | CZ3 | TRP | C | 223 | −8.201 | −36.603 | 38.771 | 1.00 | 28.69 | D000 C |
| ATOM | 3964 | CH2 | TRP | C | 223 | −7.468 | −35.740 | 37.941 | 1.00 | 27.80 | D000 C |
| ATOM | 3965 | N | VAL | C | 224 | −7.958 | −42.001 | 41.514 | 1.00 | 28.47 | D000 N |
| ATOM | 3966 | CA | VAL | C | 224 | −8.620 | −43.038 | 42.302 | 1.00 | 29.16 | D000 C |
| ATOM | 3967 | C | VAL | C | 224 | −9.055 | −44.259 | 41.486 | 1.00 | 31.96 | D000 C |
| ATOM | 3968 | O | VAL | C | 224 | −9.186 | −45.349 | 42.038 | 1.00 | 33.21 | D000 O |
| ATOM | 3969 | CB | VAL | C | 224 | −9.866 | −42.485 | 43.037 | 1.00 | 27.95 | D000 C |
| ATOM | 3970 | CG1 | VAL | C | 224 | −9.463 | −41.450 | 44.071 | 1.00 | 29.62 | D000 C |
| ATOM | 3971 | CG2 | VAL | C | 224 | −10.863 | −41.900 | 42.050 | 1.00 | 31.35 | D000 C |
| ATOM | 3972 | N | ASP | C | 225 | −9.272 | −44.083 | 40.184 | 1.00 | 30.51 | D000 N |
| ATOM | 3973 | CA | ASP | C | 225 | −9.755 | −45.182 | 39.347 | 1.00 | 33.42 | D000 C |
| ATOM | 3974 | C | ASP | C | 225 | −8.622 | −45.903 | 38.615 | 1.00 | 35.01 | D000 C |
| ATOM | 3975 | O | ASP | C | 225 | −8.866 | −46.705 | 37.717 | 1.00 | 45.07 | D000 O |
| ATOM | 3976 | CB | ASP | C | 225 | −10.798 | −44.673 | 38.337 | 1.00 | 34.24 | D000 C |
| ATOM | 3977 | CG | ASP | C | 225 | −10.187 | −43.849 | 37.205 | 1.00 | 39.60 | D000 C |
| ATOM | 3978 | OD1 | ASP | C | 225 | −9.032 | −43.379 | 37.334 | 1.00 | 35.30 | D000 O |
| ATOM | 3979 | OD2 | ASP | C | 225 | −10.878 | −43.658 | 36.179 | 1.00 | 41.15 | D000 O |
| ATOM | 3980 | N | GLY | C | 226 | −7.383 | −45.605 | 38.989 | 1.00 | 34.08 | D000 N |
| ATOM | 3981 | CA | GLY | C | 226 | −6.241 | −46.272 | 38.389 | 1.00 | 29.68 | D000 C |
| ATOM | 3982 | C | GLY | C | 226 | −5.723 | −45.631 | 37.115 | 1.00 | 34.65 | D000 C |
| ATOM | 3983 | O | GLY | C | 226 | −4.725 | −46.086 | 36.555 | 1.00 | 35.05 | D000 O |
| ATOM | 3984 | N | THR | C | 227 | −6.394 | −44.578 | 36.652 | 1.00 | 34.54 | D000 N |
| ATOM | 3985 | CA | THR | C | 227 | −5.926 | −43.829 | 35.486 | 1.00 | 32.36 | D000 C |
| ATOM | 3986 | C | THR | C | 227 | −4.500 | −43.333 | 35.821 | 1.00 | 35.82 | D000 C |
| ATOM | 3987 | O | THR | C | 227 | −4.196 | −42.779 | 36.779 | 1.00 | 36.25 | D000 O |
| ATOM | 3988 | CB | THR | C | 227 | −6.840 | −42.625 | 35.175 | 1.00 | 36.95 | D000 C |
| ATOM | 3989 | CG2 | THR | C | 227 | −6.315 | −41.834 | 33.980 | 1.00 | 37.07 | D000 C |
| ATOM | 3990 | OG1 | THR | C | 227 | −8.164 | −43.089 | 34.891 | 1.00 | 40.09 | D000 O |
| ATOM | 3991 | N | ASP | C | 228 | −3.625 | −43.540 | 34.743 | 1.00 | 35.21 | D000 N |
| ATOM | 3992 | CA | ASP | C | 228 | −2.227 | −43.165 | 34.900 | 1.00 | 35.66 | D000 C |
| ATOM | 3993 | C | ASP | C | 228 | −2.063 | −41.648 | 34.951 | 1.00 | 40.45 | D000 C |
| ATOM | 3994 | O | ASP | C | 228 | −2.550 | −40.926 | 34.080 | 1.00 | 33.72 | D000 O |
| ATOM | 3995 | CB | ASP | C | 228 | −1.378 | −43.748 | 33.773 | 1.00 | 36.06 | D000 C |

TABLE 10.2-continued

| | | | | | | | | | | |
|---|---|---|---|---|---|---|---|---|---|---|
| ATOM | 3996 | CG | ASP | C | 228 | 0.098 | −43.451 | 33.953 | 1.00 | 42.86 | D000 C |
| ATOM | 3997 | OD1 | ASP | C | 228 | 0.720 | −44.052 | 34.855 | 1.00 | 52.83 | D000 O |
| ATOM | 3998 | OD2 | ASP | C | 228 | 0.636 | −42.613 | 33.199 | 1.00 | 43.62 | D000 O |
| ATOM | 3999 | N | TYR | C | 229 | −1.372 | −41.168 | 35.970 | 1.00 | 34.02 | D000 N |
| ATOM | 4000 | CA | TYR | C | 229 | −1.267 | −39.735 | 36.202 | 1.00 | 35.25 | D000 C |
| ATOM | 4001 | C | TYR | C | 229 | −0.210 | −39.078 | 35.320 | 1.00 | 32.64 | D000 C |
| ATOM | 4002 | O | TYR | C | 229 | −0.470 | −38.045 | 34.713 | 1.00 | 32.76 | D000 O |
| ATOM | 4003 | CB | TYR | C | 229 | −0.967 | −39.448 | 37.676 | 1.00 | 34.94 | D000 C |
| ATOM | 4004 | CG | TYR | C | 229 | −0.488 | −38.039 | 37.936 | 1.00 | 31.42 | D000 C |
| ATOM | 4005 | CD1 | TYR | C | 229 | −1.381 | −36.975 | 37.988 | 1.00 | 28.67 | D000 C |
| ATOM | 4006 | CD2 | TYR | C | 229 | 0.860 | −37.773 | 38.129 | 1.00 | 36.14 | D000 C |
| ATOM | 4007 | CE1 | TYR | C | 229 | −0.941 | −35.684 | 38.220 | 1.00 | 24.57 | D000 C |
| ATOM | 4008 | CE2 | TYR | C | 229 | 1.309 | −36.493 | 38.366 | 1.00 | 33.76 | D000 C |
| ATOM | 4009 | CZ | TYR | C | 229 | 0.407 | −35.452 | 38.412 | 1.00 | 34.92 | D000 C |
| ATOM | 4010 | OH | TYR | C | 229 | 0.869 | −34.176 | 38.646 | 1.00 | 35.23 | D000 O |
| ATOM | 4011 | N | GLU | C | 230 | 0.973 | −39.679 | 35.244 | 1.00 | 32.24 | D000 N |
| ATOM | 4012 | CA | GLU | C | 230 | 2.108 | −39.042 | 34.578 | 1.00 | 40.08 | D000 C |
| ATOM | 4013 | C | GLU | C | 230 | 1.866 | −38.810 | 33.086 | 1.00 | 34.17 | D000 C |
| ATOM | 4014 | O | GLU | C | 230 | 2.253 | −37.777 | 32.545 | 1.00 | 32.51 | D000 O |
| ATOM | 4015 | CB | GLU | C | 230 | 3.381 | −39.869 | 34.774 | 1.00 | 40.46 | D000 C |
| ATOM | 4016 | CG | GLU | C | 230 | 4.639 | −39.157 | 34.302 | 1.00 | 62.30 | D000 C |
| ATOM | 4017 | CD | GLU | C | 230 | −5.913 | −39.799 | 34.821 | 1.00 | 100.35 | D000 C |
| ATOM | 4018 | OE1 | GLU | C | 230 | 5.824 | −40.683 | 35.701 | 1.00 | 96.71 | D000 O |
| ATOM | 4019 | OE2 | GLU | C | 230 | −7.006 | −39.416 | 34.349 | 1.00 | 104.16 | D000 O |
| ATOM | 4020 | N | THR | C | 231 | 1.210 | −39.760 | 32.428 | 1.00 | 32.37 | D000 N |
| ATOM | 4021 | CA | THR | C | 231 | 0.942 | −39.638 | 31.001 | 1.00 | 35.98 | D000 C |
| ATOM | 4022 | C | THR | C | 231 | −0.426 | −39.018 | 30.742 | 1.00 | 40.00 | D000 C |
| ATOM | 4023 | O | THR | C | 231 | −0.829 | −38.837 | 29.593 | 1.00 | 34.33 | D000 O |
| ATOM | 4024 | CB | THR | C | 231 | 1.015 | −41.005 | 30.291 | 1.00 | 45.18 | D000 C |
| ATOM | 4025 | CG2 | THR | C | 231 | 2.392 | −41.634 | 30.485 | 1.00 | 36.03 | D000 C |
| ATOM | 4026 | OG1 | THR | C | 231 | 0.004 | −41.878 | 30.813 | 1.00 | 40.41 | D000 O |
| ATOM | 4027 | N | GLY | C | 232 | −1.135 | −38.685 | 31.815 | 1.00 | 31.90 | D000 N |
| ATOM | 4028 | CA | GLY | C | 232 | −2.478 | −38.155 | 31.689 | 1.00 | 35.88 | D000 C |
| ATOM | 4029 | C | GLY | C | 232 | −2.556 | −36.641 | 31.641 | 1.00 | 31.67 | D000 C |
| ATOM | 4030 | O | GLY | C | 232 | −1.569 | −35.940 | 31.855 | 1.00 | 34.20 | D000 O |
| ATOM | 4031 | N | PHE | C | 233 | −3.754 | −36.148 | 31.351 | 1.00 | 34.66 | D000 N |
| ATOM | 4032 | CA | PHE | C | 233 | −4.057 | −34.723 | 31.357 | 1.00 | 30.10 | D000 C |
| ATOM | 4033 | C | PHE | C | 233 | −3.792 | −34.089 | 32.730 | 1.00 | 28.30 | D000 C |
| ATOM | 4034 | O | PHE | C | 233 | −4.053 | −34.702 | 33.766 | 1.00 | 31.59 | D000 O |
| ATOM | 4035 | CB | PHE | C | 233 | −5.520 | −34.520 | 30.932 | 1.00 | 29.82 | D000 C |
| ATOM | 4036 | CG | PHE | C | 233 | −6.022 | −33.115 | 31.094 | 1.00 | 33.74 | D000 C |
| ATOM | 4037 | CD1 | PHE | C | 233 | −5.829 | −32.175 | 30.088 | 1.00 | 27.88 | D000 C |
| ATOM | 4038 | CD2 | PHE | C | 233 | −6.715 | −32.739 | 32.240 | 1.00 | 24.62 | D000 C |
| ATOM | 4039 | CE1 | PHE | C | 233 | −6.298 | −30.878 | 30.231 | 1.00 | 27.56 | D000 C |
| ATOM | 4040 | CE2 | PHE | C | 233 | −7.184 | −31.441 | 32.389 | 1.00 | 32.64 | D000 C |
| ATOM | 4041 | CZ | PHE | C | 233 | −6.975 | −30.510 | 31.381 | 1.00 | 27.36 | D000 C |
| ATOM | 4042 | N | LYS | C | 234 | −3.267 | −32.866 | 32.730 | 1.00 | 29.76 | D000 N |
| ATOM | 4043 | CA | LYS | C | 234 | −3.045 | −32.109 | 33.963 | 1.00 | 29.48 | D000 C |
| ATOM | 4044 | C | LYS | C | 234 | −3.455 | −30.646 | 33.789 | 1.00 | 31.02 | D000 C |
| ATOM | 4045 | O | LYS | C | 234 | −3.316 | −30.077 | 32.704 | 1.00 | 25.86 | D000 O |
| ATOM | 4046 | CB | LYS | C | 234 | −1.579 | −32.189 | 34.397 | 1.00 | 32.09 | D000 C |
| ATOM | 4047 | CG | LYS | C | 234 | −1.056 | −33.603 | 34.611 | 1.00 | 30.92 | D000 C |
| ATOM | 4048 | CD | LYS | C | 234 | 0.422 | −33.598 | 34.955 | 1.00 | 34.48 | D000 C |
| ATOM | 4049 | CE | LYS | C | 234 | 1.026 | −34.993 | 34.843 | 1.00 | 34.77 | D000 C |
| ATOM | 4050 | NZ | LYS | C | 234 | 1.050 | −35.479 | 33.432 | 1.00 | 34.51 | D000 N |
| ATOM | 4051 | N | ASN | C | 235 | −3.957 | −30.040 | 34.861 | 1.00 | 29.35 | D000 N |
| ATOM | 4052 | CA | ASN | C | 235 | −4.382 | −28.644 | 34.822 | 1.00 | 26.46 | D000 C |
| ATOM | 4053 | C | ASN | C | 235 | −4.012 | −27.912 | 36.116 | 1.00 | 26.48 | D000 C |
| ATOM | 4054 | O | ASN | C | 235 | −4.814 | −27.157 | 36.659 | 1.00 | 29.79 | D000 O |
| ATOM | 4055 | CB | ASN | C | 235 | −5.896 | −28.559 | 34.573 | 1.00 | 25.06 | D000 C |
| ATOM | 4056 | CG | ASN | C | 235 | −6.345 | −27.173 | 34.127 | 1.00 | 27.67 | D000 C |
| ATOM | 4057 | ND2 | ASN | C | 235 | −7.464 | −26.705 | 34.673 | 1.00 | 26.28 | D000 N |
| ATOM | 4058 | OD1 | ASN | C | 235 | −5.692 | −26.533 | 33.308 | 1.00 | 27.02 | D000 O |
| ATOM | 4059 | N | TRP | C | 236 | −2.795 | −28.145 | 36.607 | 1.00 | 27.50 | D000 N |
| ATOM | 4060 | CA | TRP | C | 236 | −2.325 | −27.526 | 37.850 | 1.00 | 27.74 | D000 C |
| ATOM | 4061 | C | TRP | C | 236 | −2.206 | −26.010 | 37.747 | 1.00 | 27.99 | D000 C |
| ATOM | 4062 | O | TRP | C | 236 | −1.870 | −25.474 | 36.690 | 1.00 | 31.33 | D000 O |
| ATOM | 4063 | CB | TRP | C | 236 | −0.960 | −28.092 | 38.264 | 1.00 | 23.47 | D000 C |
| ATOM | 4064 | CG | TRP | C | 236 | −0.967 | −29.533 | 38.710 | 1.00 | 24.40 | D000 C |
| ATOM | 4065 | CD1 | TRP | C | 236 | −0.544 | −30.616 | 37.990 | 1.00 | 25.63 | D000 C |
| ATOM | 4066 | CD2 | TRP | C | 236 | −1.407 | −30.040 | 39.979 | 1.00 | 27.52 | D000 C |
| ATOM | 4067 | CE2 | TRP | C | 236 | −1.224 | −31.442 | 39.955 | 1.00 | 25.85 | D000 C |
| ATOM | 4068 | CE3 | TRP | C | 236 | −1.940 | −29.450 | 41.132 | 1.00 | 25.98 | D000 C |
| ATOM | 4069 | NE1 | TRP | C | 236 | −0.696 | −31.766 | 38.732 | 1.00 | 26.26 | D000 N |
| ATOM | 4070 | CZ2 | TRP | C | 236 | −1.551 | −32.258 | 41.037 | 1.00 | 25.53 | D000 C |
| ATOM | 4071 | CZ3 | TRP | C | 236 | −2.267 | −30.263 | 42.208 | 1.00 | 25.29 | D000 C |
| ATOM | 4072 | CH2 | TRP | C | 236 | −2.071 | −31.654 | 42.152 | 1.00 | 26.90 | D000 C |
| ATOM | 4073 | N | ARG | C | 237 | −2.473 | −25.323 | 38.855 | 1.00 | 29.23 | D000 N |
| ATOM | 4074 | CA | ARG | C | 237 | −2.100 | −23.918 | 38.983 | 1.00 | 34.44 | D000 C |
| ATOM | 4075 | C | ARG | C | 237 | −0.586 | −23.790 | 38.820 | 1.00 | 34.81 | D000 C |

TABLE 10.2-continued

| ATOM | 4076 | O | ARG | C | 237 | 0.147 | −24.755 | 39.052 | 1.00 | 28.62 | D000 | O |
|---|---|---|---|---|---|---|---|---|---|---|---|---|
| ATOM | 4077 | CB | ARG | C | 237 | −2.547 | −23.349 | 40.337 | 1.00 | 30.99 | D000 | C |
| ATOM | 4078 | CG | ARG | C | 237 | −4.048 | −23.189 | 40.474 | 1.00 | 37.60 | D000 | C |
| ATOM | 4079 | CD | ARG | C | 237 | −4.455 | −21.737 | 40.591 | 1.00 | 42.14 | D000 | C |
| ATOM | 4080 | NE | ARG | C | 237 | −4.482 | −21.299 | 41.980 | 1.00 | 49.94 | D000 | N |
| ATOM | 4081 | CZ | ARG | C | 237 | −5.493 | −20.641 | 42.538 | 1.00 | 55.18 | D000 | C |
| ATOM | 4082 | NH1 | ARG | C | 237 | −6.568 | −20.334 | 41.822 | 1.00 | 41.85 | D000 | N |
| ATOM | 4083 | NH2 | ARG | C | 237 | −5.428 | −20.287 | 43.814 | 1.00 | 55.93 | D000 | N |
| ATOM | 4084 | N | PRO | C | 238 | −0.113 | −22.606 | 38.401 | 1.00 | 36.47 | D000 | N |
| ATOM | 4085 | CA | PRO | C | 238 | 1.334 | −22.380 | 38.314 | 1.00 | 36.67 | D000 | C |
| ATOM | 4086 | C | PRO | C | 238 | 2.051 | −22.730 | 39.619 | 1.00 | 31.29 | D000 | C |
| ATOM | 4087 | O | PRO | C | 238 | 1.581 | −22.352 | 40.6392 | 1.00 | 39.20 | D000 | O |
| ATOM | 4088 | CB | PRO | C | 238 | 1.435 | −20.881 | 38.015 | 1.00 | 41.44 | D000 | C |
| ATOM | 4089 | CG | PRO | C | 238 | 0.172 | −20.566 | 37.297 | 1.00 | 41.47 | D000 | C |
| ATOM | 4090 | CD | PRO | C | 238 | −0.886 | −21.461 | 37.885 | 1.00 | 34.59 | D000 | C |
| ATOM | 4091 | N | GLU | C | 239 | 3.149 | −23.473 | 39.502 | 1.00 | 34.14 | D000 | N |
| ATOM | 4092 | CA | GLU | C | 239 | 4.016 | −23.854 | 40.624 | 1.00 | 40.34 | D000 | C |
| ATOM | 4093 | C | GLU | C | 239 | 3.405 | −24.898 | 41.566 | 1.00 | 40.27 | D000 | C |
| ATOM | 4094 | O | GLU | C | 239 | 3.952 | −25.164 | 42.636 | 1.00 | 43.88 | D000 | O |
| ATOM | 4095 | CB | GLU | C | 239 | 4.428 | −22.615 | 41.426 | 1.00 | 43.42 | D000 | C |
| ATOM | 4096 | CG | GLU | C | 239 | 5.157 | −21.571 | 40.598 | 1.00 | 50.20 | D000 | C |
| ATOM | 4097 | CD | GLU | C | 239 | 5.859 | −20.539 | 41.453 | 1.00 | 75.90 | D000 | C |
| ATOM | 4098 | OE1 | GLU | C | 239 | 5.212 | −19.540 | 41.836 | 1.0 | 82.09 | D000 | O |
| ATOM | 4099 | OE2 | GLU | C | 239 | 7.059 | −20.732 | 41.744 | 1.00 | 84.44 | D000 | O |
| ATOM | 4100 | N | GLN | C | 240 | 2.285 | −25.493 | 41.165 | 1.00 | 33.28 | D000 | N |
| ATOM | 4101 | CA | GLN | C | 240 | 1.703 | −26.611 | 41.904 | 1.00 | 31.36 | D000 | C |
| ATOM | 4102 | C | GLN | C | 240 | 1.873 | −27.891 | 41.082 | 1.00 | 31.46 | D000 | C |
| ATOM | 4103 | O | GLN | C | 240 | 1.926 | −27.827 | 39.856 | 1.00 | 30.03 | D000 | O |
| ATOM | 4104 | CB | GLN | C | 240 | 0.224 | −26.354 | 42.208 | 1.00 | 28.17 | D000 | C |
| ATOM | 4105 | CG | GLN | C | 240 | −0.065 | −25.007 | 42.862 | 1.00 | 36.91 | D000 | C |
| ATOM | 4106 | CD | GLN | C | 240 | 0.799 | −24.737 | 44.083 | 1.00 | 42.84 | D000 | C |
| ATOM | 4107 | NE2 | GLN | C | 240 | 1.452 | −23.580 | 44.095 | 1.00 | 37.20 | D000 | N |
| ATOM | 4108 | OE1 | GLN | C | 240 | 0.885 | −25.559 | 45.001 | 1.00 | 41.85 | D000 | O |
| ATOM | 4109 | N | PRO | C | 241 | 1.968 | −29.060 | 41.746 | 1.00 | 31.89 | D000 | N |
| ATOM | 4110 | CA | PRO | C | 241 | 1.952 | −29.276 | 43.200 | 1.00 | 36.63 | D000 | C |
| ATOM | 4111 | C | PRO | C | 241 | 3.307 | −28.999 | 43.845 | 1.00 | 34.40 | D000 | C |
| ATOM | 4112 | O | PRO | C | 241 | 4.332 | −29.013 | 43.162 | 1.00 | 31.05 | D000 | O |
| ATOM | 4113 | CB | PRO | C | 241 | 1.583 | −30.757 | 43.326 | 1.00 | 30.98 | D000 | C |
| ATOM | 4114 | CG | PRO | C | 241 | 2.166 | −31.380 | 42.097 | 1.00 | 28.05 | D000 | C |
| ATOM | 4115 | CD | PRO | C | 241 | 2.042 | −30.334 | 41.004 | 1.00 | 28.29 | D000 | C |
| ATOM | 4116 | N | ASP | C | 242 | 3.306 | −28.762 | 45.151 | 1.00 | 31.20 | D000 | N |
| ATOM | 4117 | CA | ASP | C | 242 | 4.534 | −28.429 | 45.869 | 1.00 | 33.88 | D000 | C |
| ATOM | 4118 | C | ASP | C | 242 | 5.428 | −29.640 | 46.150 | 1.00 | 36.07 | D000 | C |
| ATOM | 4119 | O | ASP | C | 242 | 6.583 | −29.482 | 46.545 | 1.00 | 35.39 | D000 | O |
| ATOM | 4120 | CB | ASP | C | 242 | 4.189 | −27.712 | 47.176 | 1.00 | 30.91 | D000 | C |
| ATOM | 4121 | CG | ASP | C | 242 | 3.796 | −26.257 | 46.953 | 1.00 | 42.15 | D000 | C |
| ATOM | 4122 | OD2 | ASP | C | 242 | 2.709 | −25.848 | 47.409 | 1.00 | 41.70 | D000 | O |
| ATOM | 4123 | OD1 | ASP | C | 242 | 4.571 | −25.527 | 46.298 | 1.00 | 38.03 | D000 | O |
| ATOM | 4124 | N | ASP | C | 243 | 4.894 | −30.841 | 45.935 | 1.00 | 33.28 | D000 | N |
| ATOM | 4125 | CA | ASP | C | 243 | 5.659 | −32.080 | 46.098 | 1.00 | 33.76 | D000 | C |
| ATOM | 4126 | C | ASP | C | 243 | 5.140 | −33.135 | 45.123 | 1.00 | 36.43 | D000 | C |
| ATOM | 4127 | O | ASP | C | 243 | 4.000 | −33.045 | 44.662 | 1.00 | 31.00 | D000 | O |
| ATOM | 4128 | CB | ASP | C | 243 | 5.562 | −32.592 | 47.539 | 1.00 | 33.56 | D000 | C |
| ATOM | 4129 | CG | ASP | C | 243 | 6.805 | −33.360 | 47.980 | 1.00 | 45.01 | D000 | C |
| ATOM | 4130 | OD1 | ASP | C | 243 | 7.510 | −33.935 | 47.118 | 1.00 | 32.68 | D000 | O |
| ATOM | 4131 | OD2 | ASP | C | 243 | 7.073 | −33.389 | 49.201 | 1.00 | 41.68 | D000 | O |
| ATOM | 4132 | O | TRP | C | 244 | 4.635 | −37.408 | 43.978 | 1.00 | 29.40 | D000 | O |
| ATOM | 4133 | N | TRP | C | 244 | 5.959 | −34.135 | 44.811 | 1.00 | 26.76 | D000 | N |
| ATOM | 4134 | CA | TRP | C | 244 | 5.530 | −35.179 | 43.886 | 1.00 | 32.96 | D000 | C |
| ATOM | 4135 | C | TRP | C | 244 | 5.096 | −36.460 | 44.610 | 1.00 | 33.98 | D000 | C |
| ATOM | 4136 | CB | TRP | C | 244 | 6.635 | −35.486 | 42.872 | 1.00 | 22.49 | D000 | C |
| ATOM | 4137 | CG | TRP | C | 244 | 7.926 | −35.939 | 43.487 | 1.00 | 31.66 | D000 | C |
| ATOM | 4138 | CD1 | TRP | C | 244 | 8.985 | −35.153 | 43.851 | 1.00 | 35.24 | D000 | C |
| ATOM | 4139 | CD2 | TRP | C | 244 | 8.301 | −37.286 | 43.797 | 1.00 | 28.87 | D000 | C |
| ATOM | 4140 | NE1 | TRP | C | 244 | 9.992 | −35.930 | 44.374 | 1.00 | 39.02 | D000 | N |
| ATOM | 4141 | CE2 | TRP | C | 244 | 9.597 | −37.243 | 44.351 | 1.00 | 34.79 | D000 | C |
| ATOM | 4142 | CE3 | TRP | C | 244 | 7.666 | −38.526 | 43.661 | 1.00 | 27.95 | D000 | C |
| ATOM | 4143 | CZ2 | TRP | C | 244 | 10.267 | −38.390 | 44.770 | 1.00 | 32.14 | D000 | C |
| ATOM | 4144 | CZ3 | TRP | C | 244 | 8.333 | −39.662 | 44.076 | 1.00 | 30.86 | D000 | C |
| ATOM | 4145 | CH2 | TRP | C | 244 | 9.621 | −39.586 | 44.624 | 1.00 | 31.78 | D000 | C |
| ATOM | 4146 | O | TYR | C | 245 | 4.758 | −35.925 | 48.510 | 1.00 | 29.36 | D000 | O |
| ATOM | 4147 | N | TYR | C | 245 | 5.250 | −36.491 | 45.930 | 1.00 | 32.02 | D000 | N |
| ATOM | 4148 | CA | TYR | C | 245 | 4.614 | −37.534 | 46.735 | 1.00 | 28.48 | D000 | C |
| ATOM | 4149 | C | TYR | C | 245 | 4.247 | −36.969 | 48.099 | 1.00 | 30.14 | D000 | C |
| ATOM | 4150 | CB | TYR | C | 245 | 5.502 | −38.778 | 46.871 | 1.00 | 25.38 | D000 | C |
| ATOM | 4151 | CG | TYR | C | 245 | 6.734 | −38.633 | 47.739 | 1.00 | 32.91 | D000 | C |
| ATOM | 4152 | CD2 | TYR | C | 245 | 6.785 | −39.200 | 49.009 | 1.00 | 31.25 | D000 | C |
| ATOM | 4153 | CD1 | TYR | C | 245 | −7.865 | −37.975 | 47.270 | 1.00 | 30.40 | D000 | C |
| ATOM | 4154 | CE2 | TYR | C | 245 | 7.920 | −39.093 | 49.795 | 1.00 | 28.79 | D000 | C |
| ATOM | 4155 | CE1 | TYR | C | 245 | 8.999 | −37.860 | 48.049 | 1.00 | 32.06 | D000 | C |

TABLE 10.2-continued

| | | | | | | | | | | |
|---|---|---|---|---|---|---|---|---|---|---|
| ATOM | 4156 | CZ | TYR | C | 245 | 9.025 | −38.420 | 49.307 | 1.00 | 29.81 | D000 C |
| ATOM | 4157 | OH | TYR | C | 245 | −10.159 | −38.300 | 50.077 | 1.00 | 27.57 | D000 O |
| ATOM | 4158 | O | GLY | C | 246 | 4.628 | −37.473 | 51.323 | 1.00 | 34.84 | D000 O |
| ATOM | 4159 | N | GLY | C | 246 | 3.340 | −37.650 | 48.789 | 1.00 | 31.19 | D000 N |
| ATOM | 4160 | CA | GLY | C | 246 | 2.703 | −37.067 | 49.955 | 1.00 | 35.76 | D000 C |
| ATOM | 4161 | C | GLY | C | 246 | 3.427 | −37.207 | 51.272 | 1.00 | 33.62 | D000 C |
| ATOM | 4162 | O | HIS | C | 247 | 2.259 | −37.710 | 55.785 | 1.00 | 43.05 | D000 O |
| ATOM | 4163 | N | HIS | C | 247 | 2.664 | −37.031 | 52.345 | 1.00 | 38.43 | D000 N |
| ATOM | 4164 | CA | HIS | C | 247 | 3.202 | −36.998 | 53.694 | 1.00 | 39.05 | D000 C |
| ATOM | 4165 | C | HIS | C | 247 | 2.411 | −37.945 | 54.588 | 1.00 | 38.77 | D000 C |
| ATOM | 4166 | CB | HIS | C | 247 | 3.164 | −35.565 | 54.234 | 1.00 | 39.25 | D000 C |
| ATOM | 4167 | CG | HIS | C | 247 | 3.692 | −34.553 | 53.266 | 1.00 | 36.64 | D000 C |
| ATOM | 4168 | ND1 | HIS | C | 247 | 4.970 | −34.039 | 53.346 | 1.00 | 46.82 | D000 N |
| ATOM | 4169 | CD2 | HIS | C | 247 | 3.126 | −33.978 | 52.179 | 1.00 | 35.16 | D000 C |
| ATOM | 4170 | CE1 | HIS | C | 247 | 5.163 | −33.185 | 52.358 | 1.00 | 42.11 | D000 C |
| ATOM | 4171 | NE2 | HIS | C | 247 | 4.059 | −33.130 | 51.632 | 1.00 | 47.04 | D000 N |
| ATOM | 4172 | O | GLY | C | 248 | −0.747 | −38.509 | 54.445 | 1.00 | 40.24 | D000 O |
| ATOM | 4173 | N | GLY | C | 248 | 1.903 | −39.018 | 53.991 | 1.00 | 40.96 | D000 N |
| ATOM | 4174 | CA | GLY | C | 248 | 1.118 | −39.995 | 54.720 | 1.00 | 37.66 | D000 C |
| ATOM | 4175 | C | GLY | C | 248 | −0.330 | −39.578 | 54.902 | 1.00 | 47.53 | D000 C |
| ATOM | 4176 | O | LEU | C | 249 | −3.773 | −38.603 | 57.140 | 1.00 | 54.25 | D000 O |
| ATOM | 4177 | N | LEU | C | 249 | −1.097 | −40.433 | 55.574 | 1.00 | 52.35 | D000 N |
| ATOM | 4178 | CA | LEU | C | 249 | −2.508 | −40.173 | 55.842 | 1.00 | 52.11 | D000 C |
| ATOM | 4179 | C | LEU | C | 249 | −2.689 | −39.160 | 56.968 | 1.00 | 52.40 | D000 C |
| ATOM | 4180 | CB | LEU | C | 249 | −3.233 | −41.474 | 56.202 | 1.00 | 42.33 | D000 C |
| ATOM | 4181 | CG | LEU | C | 249 | −3.333 | −42.572 | 55.139 | 1.00 | 60.62 | D000 C |
| ATOM | 4182 | CD2 | LEU | C | 249 | −4.287 | −42.165 | 54.027 | 1.00 | 56.35 | D000 C |
| ATOM | 4183 | CD1 | LEU | C | 249 | −3.789 | −43.874 | 55.773 | 1.00 | 55.71 | D000 C |
| ATOM | 4184 | O | GLY | C | 250 | −1.984 | −35.849 | 59.639 | 1.00 | 57.54 | D000 O |
| ATOM | 4185 | N | GLY | C | 250 | −1.622 | −38.924 | 57.727 | 1.00 | 52.24 | D000 N |
| ATOM | 4186 | CA | GLY | C | 250 | −1.698 | −38.112 | 58.930 | 1.00 | 50.41 | D000 C |
| ATOM | 4187 | C | GLY | C | 250 | −1.663 | −36.608 | 58.725 | 1.00 | 57.93 | D000 C |
| ATOM | 4188 | N | GLY | C | 251 | −1.269 | −36.168 | 57.535 | 1.00 | 52.64 | D000 N |
| ATOM | 4189 | CA | GLY | C | 251 | −1.203 | −34.746 | 57.250 | 1.00 | 44.98 | D000 C |
| ATOM | 4190 | C | GLY | C | 251 | −0.639 | −34.433 | 55.880 | 1.00 | 46.45 | D000 C |
| ATOM | 4191 | O | GLY | C | 251 | −0.459 | −35.329 | 55.051 | 1.00 | 43.28 | D000 O |
| ATOM | 4192 | N | GLY | C | 252 | −0.369 | −33.152 | 55.642 | 1.00 | 37.49 | D000 N |
| ATOM | 4193 | CA | GLY | C | 252 | 0.205 | −32.710 | 54.387 | 1.00 | 32.69 | D000 C |
| ATOM | 4194 | C | GLY | C | 252 | −0.831 | −32.272 | 53.366 | 1.00 | 34.76 | D000 C |
| ATOM | 4195 | O | GLY | C | 252 | −2.005 | −32.646 | 53.445 | 1.00 | 30.54 | D000 O |
| ATOM | 4196 | N | GLU | C | 253 | −0.385 | −31.472 | 52.402 | 1.00 | 33.99 | D000 N |
| ATOM | 4197 | CA | GLU | C | 253 | −1.250 | −30.989 | 51.331 | 1.00 | 40.45 | D000 C |
| ATOM | 4198 | C | GLU | C | 253 | −1.285 | −32.029 | 50.222 | 1.00 | 29.00 | D000 C |
| ATOM | 4199 | O | GLU | C | 253 | −0.676 | −31.860 | 49.168 | 1.00 | 35.30 | D000 O |
| ATOM | 4200 | CB | GLU | C | 253 | −0.757 | −29.632 | 50.821 | 1.00 | 34.32 | D000 C |
| ATOM | 4201 | CG | GLU | C | 253 | −0.717 | −28.572 | 51.926 | 1.00 | 42.40 | D000 C |
| ATOM | 4202 | CD | GLU | C | 253 | −0.225 | −27.217 | 51.444 | 1.00 | 58.06 | D000 C |
| ATOM | 4203 | OE1 | GLU | C | 253 | −0.620 | −26.792 | 50.337 | 1.00 | 59.58 | D000 O |
| ATOM | 4204 | OE2 | GLU | C | 253 | 0.557 | −26.574 | 52.177 | 1.00 | 57.93 | D000 O |
| ATOM | 4205 | N | ASP | C | 254 | −2.015 | −33.109 | 50.484 | 1.00 | 27.38 | D000 N |
| ATOM | 4206 | CA | ASP | C | 254 | −1.921 | −34.327 | 49.693 | 1.00 | 31.18 | D000 C |
| ATOM | 4207 | C | ASP | C | 254 | −3.140 | −34.599 | 48.805 | 1.00 | 33.58 | D000 C |
| ATOM | 4208 | O | ASP | C | 254 | −3.216 | −35.646 | 48.158 | 1.00 | 27.45 | D000 O |
| ATOM | 4209 | CB | ASP | C | 254 | −1.700 | −35.535 | 50.623 | 1.00 | 29.94 | D000 C |
| ATOM | 4210 | CG | ASP | C | 254 | −0.346 | −35.504 | 51.328 | 1.00 | 36.48 | D000 C |
| ATOM | 4211 | OD1 | ASP | C | 254 | 0.494 | −34.630 | 51.013 | 1.00 | 28.05 | D000 O |
| ATOM | 4212 | OD2 | ASP | C | 254 | −0.117 | −36.374 | 52.196 | 1.00 | 35.72 | D000 O |
| ATOM | 4213 | N | CYS | C | 255 | −4.090 | −33.670 | 48.768 | 1.00 | 26.75 | D000 N |
| ATOM | 4214 | CA | CYS | C | 255 | −5.294 | −33.867 | 47.963 | 1.00 | 26.33 | D000 C |
| ATOM | 4215 | C | CYS | C | 255 | −5.518 | −32.727 | 46.977 | 1.00 | 32.54 | D000 C |
| ATOM | 4216 | O | CYS | C | 255 | −5.323 | −31.559 | 47.316 | 1.00 | 27.66 | D000 O |
| ATOM | 4217 | CB | CYS | C | 255 | −6.514 | −34.024 | 48.869 | 1.00 | 27.73 | D000 C |
| ATOM | 4218 | SG | CYS | C | 255 | −6.407 | −35.447 | 49.969 | 1.00 | 35.91 | D000 S |
| ATOM | 4219 | N | ALA | C | 256 | −5.930 | −33.072 | 45.758 | 1.00 | 28.09 | D000 N |
| ATOM | 4220 | CA | ALA | C | 256 | −6.116 | −32.073 | 44.710 | 1.00 | 28.14 | D000 C |
| ATOM | 4221 | C | ALA | C | 256 | −7.560 | −31.598 | 44.637 | 1.00 | 28.47 | D000 C |
| ATOM | 4222 | O | ALA | C | 256 | −8.500 | −32.389 | 44.749 | 1.00 | 30.35 | D000 O |
| ATOM | 4223 | CB | ALA | C | 256 | −5.678 | −32.627 | 43.357 | 1.00 | 25.70 | D000 C |
| ATOM | 4224 | N | HIS | C | 257 | −7.732 | −30.298 | 44.444 | 1.00 | 28.56 | D000 N |
| ATOM | 4225 | CA | HIS | C | 257 | −9.054 | −29.742 | 44.223 | 1.00 | 25.18 | D000 C |
| ATOM | 4226 | C | HIS | C | 257 | −9.020 | −28.689 | 43.127 | 1.00 | 31.48 | D000 C |
| ATOM | 4227 | O | HIS | C | 257 | −7.990 | −28.054 | 42.895 | 1.00 | 26.66 | D000 O |
| ATOM | 4228 | CB | HIS | C | 257 | −9.615 | −29.139 | 45.514 | 1.00 | 24.94 | D000 C |
| ATOM | 4229 | CG | HIS | C | 257 | −8.842 | −27.958 | 46.023 | 1.00 | 29.72 | D000 C |
| ATOM | 4230 | CD2 | HIS | C | 257 | −7.685 | −27.880 | 46.715 | 1.00 | 26.19 | D000 C |
| ATOM | 4231 | ND1 | HIS | C | 257 | −9.275 | −26.658 | 45.852 | 1.00 | 31.92 | D000 N |
| ATOM | 4232 | CE1 | HIS | C | 257 | −8.411 | −25.834 | 46.415 | 1.00 | 33.33 | D000 C |
| ATOM | 4233 | NE2 | HIS | C | 257 | −7.434 | −26.546 | 46.943 | 1.00 | 31.64 | D000 N |
| ATOM | 4234 | N | PHE | C | 258 | −10.146 | −28.528 | 42.441 | 1.00 | 25.00 | D000 N |
| ATOM | 4235 | CA | PHE | C | 258 | −10.340 | −27.385 | 41.567 | 1.00 | 28.97 | D000 C |

TABLE 10.2-continued

| | | | | | | | | | | |
|---|---|---|---|---|---|---|---|---|---|---|
| ATOM | 4236 | C | PHE | C | 258 | −10.347 | −26.129 | 42.421 | 1.00 | 30.92 | D000 C |
| ATOM | 4237 | O | PHE | C | 258 | −10.917 | −26.128 | 43.511 | 1.00 | 27.46 | D000 O |
| ATOM | 4238 | CB | PHE | C | 258 | −11.655 | −27.491 | 40.788 | 1.00 | 28.67 | D000 C |
| ATOM | 4239 | CG | PHE | C | 258 | −11.790 | −28.752 | 39.975 | 1.00 | 28.57 | D000 C |
| ATOM | 4240 | CD1 | PHE | C | 258 | −11.253 | −28.831 | 38.699 | 1.00 | 24.14 | D000 C |
| ATOM | 4241 | CD2 | PHE | C | 258 | −12.475 | −29.845 | 40.477 | 1.00 | 26.98 | D000 C |
| ATOM | 4242 | CE1 | PHE | C | 258 | −11.385 | −29.982 | 37.944 | 1.00 | 27.83 | D000 C |
| ATOM | 4243 | CE2 | PHE | C | 258 | −12.610 | −31.002 | 39.727 | 1.00 | 29.05 | D000 C |
| ATOM | 4244 | CZ | PHE | C | 258 | −12.064 | −31.067 | 38.458 | 1.00 | 26.68 | D000 C |
| ATOM | 4245 | N | THR | C | 259 | −9.709 | −25.068 | 41.935 | 1.00 | 31.52 | D000 N |
| ATOM | 4246 | CA | THR | C | 259 | −9.778 | −23.766 | 42.596 | 1.00 | 27.35 | D000 C |
| ATOM | 4247 | C | THR | C | 259 | −10.853 | −22.908 | 41.947 | 1.00 | 32.37 | D000 C |
| ATOM | 4248 | O | THR | C | 259 | −11.547 | −23.361 | 41.038 | 1.00 | 28.98 | D000 O |
| ATOM | 4249 | CB | THR | C | 259 | −8.450 | −23.013 | 42.517 | 1.00 | 30.50 | D000 C |
| ATOM | 4250 | CG2 | THR | C | 259 | −7.336 | −23.832 | 43.146 | 1.00 | 29.47 | D000 C |
| ATOM | 4251 | OG1 | THR | C | 259 | −8.141 | −22.759 | 41.139 | 1.00 | 26.60 | D000 O |
| ATOM | 4252 | N | ASP | C | 260 | −10.966 | −21.657 | 42.383 | 1.00 | 33.47 | D000 N |
| ATOM | 4253 | CA | ASP | C | 260 | −11.989 | −20.772 | 41.841 | 1.00 | 32.04 | D000 C |
| ATOM | 4254 | C | ASP | C | 260 | −11.660 | −20.274 | 40.432 | 1.00 | 28.10 | D000 C |
| ATOM | 4255 | O | ASP | C | 260 | −12.469 | −19.571 | 39.833 | 1.00 | 35.94 | D000 O |
| ATOM | 4256 | CB | ASP | C | 260 | −12.232 | −19.574 | 42.774 | 1.00 | 31.62 | D000 C |
| ATOM | 4257 | CG | ASP | C | 260 | −10.952 | −18.844 | 43.150 | 1.00 | 39.51 | D000 C |
| ATOM | 4258 | OD1 | ASP | C | 260 | −9.894 | −19.114 | 42.544 | 1.00 | 46.04 | D000 O |
| ATOM | 4259 | OD2 | ASP | C | 260 | −11.010 | −17.986 | 44.057 | 1.00 | 48.87 | D000 O |
| ATOM | 4260 | N | ASP | C | 261 | −10.494 | −20.631 | 39.890 | 1.00 | 32.99 | D000 N |
| ATOM | 4261 | CA | ASP | C | 261 | −10.219 | −20.308 | 38.483 | 1.00 | 33.63 | D000 C |
| ATOM | 4262 | C | ASP | C | 261 | −10.169 | −21.568 | 37.618 | 1.00 | 34.02 | D000 C |
| ATOM | 4263 | O | ASP | C | 261 | −9.808 | −21.517 | 36.440 | 1.00 | 35.61 | D000 O |
| ATOM | 4264 | CB | ASP | C | 261 | −8.920 | −19.493 | 38.330 | 1.00 | 34.41 | D000 C |
| ATOM | 4265 | CG | ASP | C | 261 | −7.663 | −20.257 | 38.749 | 1.00 | 41.30 | D000 C |
| ATOM | 4266 | OD1 | ASP | C | 261 | −7.662 | −21.504 | 38.780 | 1.00 | 38.03 | D000 O |
| ATOM | 4267 | OD2 | ASP | C | 261 | −6.644 | −19.591 | 39.031 | 1.00 | 47.65 | D000 O |
| ATOM | 4268 | N | GLY | C | 262 | −10.525 | −22.701 | 38.214 | 1.00 | 34.67 | D000 N |
| ATOM | 4269 | CA | GLY | C | 262 | −10.608 | −23.949 | 37.477 | 1.00 | 29.76 | D000 C |
| ATOM | 4270 | C | GLY | C | 262 | −9.366 | −24.810 | 37.571 | 1.00 | 25.05 | D000 C |
| ATOM | 4271 | O | GLY | C | 262 | −9.449 | −26.038 | 37.513 | 1.00 | 31.23 | D000 O |
| ATOM | 4272 | N | ARG | C | 263 | −8.207 | −24.177 | 37.710 | 1.00 | 26.83 | D000 N |
| ATOM | 4273 | CA | ARG | C | 263 | −6.952 | −24.919 | 37.778 | 1.00 | 26.39 | D000 C |
| ATOM | 4274 | C | ARG | C | 263 | −6.771 | −25.578 | 39.148 | 1.00 | 30.19 | D000 C |
| ATOM | 4275 | O | ARG | C | 263 | −7.392 | −25.172 | 40.135 | 1.00 | 28.43 | D000 O |
| ATOM | 4276 | CB | ARG | C | 263 | −5.775 | −24.000 | 37.443 | 1.00 | 27.07 | D000 C |
| ATOM | 4277 | CG | ARG | C | 263 | −5.652 | −23.711 | 35.943 | 1.00 | 29.33 | D000 C |
| ATOM | 4278 | CD | ARG | C | 263 | −4.595 | −22.643 | 35.649 | 1.00 | 33.17 | D000 C |
| ATOM | 4279 | NE | ARG | C | 263 | −5.071 | −21.305 | 35.982 | 1.00 | 44.51 | D000 N |
| ATOM | 4280 | CZ | ARG | C | 263 | −5.787 | −20.547 | 35.156 | 1.00 | 52.96 | D000 C |
| ATOM | 4281 | NH1 | ARG | C | 263 | −6.105 | −21.002 | 33.951 | 1.00 | 49.17 | D000 N |
| ATOM | 4282 | NH2 | ARG | C | 263 | −6.188 | −19.340 | 35.532 | 1.00 | 51.57 | D000 N |
| ATOM | 4283 | N | TRP | C | 264 | −5.916 | −26.596 | 39.202 | 1.00 | 26.05 | D000 N |
| ATOM | 4284 | CA | TRP | C | 264 | −5.847 | −27.477 | 40.365 | 1.00 | 28.26 | D000 C |
| ATOM | 4285 | C | TRP | C | 264 | −4.859 | −27.000 | 41.415 | 1.00 | 27.92 | D000 C |
| ATOM | 4286 | O | TRP | C | 264 | −3.844 | −26.385 | 41.097 | 1.00 | 28.53 | D000 O |
| ATOM | 4287 | CB | TRP | C | 264 | −5.460 | −28.897 | 39.938 | 1.00 | 24.67 | D000 C |
| ATOM | 4288 | CG | TRP | C | 264 | −6.268 | −29.456 | 38.814 | 1.00 | 25.08 | D000 C |
| ATOM | 4289 | CD1 | TRP | C | 264 | −7.436 | −28.958 | 38.304 | 1.00 | 26.48 | D000 C |
| ATOM | 4290 | CD2 | TRP | C | 264 | −5.963 | −30.627 | 38.048 | 1.00 | 26.55 | D000 C |
| ATOM | 4291 | CE2 | TRP | C | 264 | −6.994 | −30.785 | 37.098 | 1.00 | 22.22 | D000 C |
| ATOM | 4292 | CE3 | TRP | C | 264 | −4.923 | −31.565 | 38.081 | 1.00 | 25.16 | D000 C |
| ATOM | 4293 | NE1 | TRP | C | 264 | −7.879 | −29.752 | 37.276 | 1.00 | 26.28 | D000 N |
| ATOM | 4294 | CZ2 | TRP | C | 264 | −7.012 | −31.837 | 36.181 | 1.00 | 27.60 | D000 C |
| ATOM | 4295 | CZ3 | TRP | C | 264 | −4.944 | −32.616 | 37.170 | 1.00 | 22.92 | D000 C |
| ATOM | 4296 | CH2 | TRP | C | 264 | −5.979 | −32.739 | 36.232 | 1.00 | 24.94 | D000 C |
| ATOM | 4297 | N | ASN | C | 265 | −5.155 | −27.313 | 42.670 | 1.00 | 30.65 | D000 N |
| ATOM | 4298 | CA | ASN | C | 265 | −4.243 | −27.018 | 43.762 | 1.00 | 29.62 | D000 C |
| ATOM | 4299 | C | ASN | C | 265 | −4.178 | −28.182 | 44.735 | 1.00 | 27.94 | D000 C |
| ATOM | 4300 | O | ASN | C | 265 | −5.157 | −28.904 | 44.910 | 1.00 | 27.71 | D000 O |
| ATOM | 4301 | CB | ASN | C | 265 | −4.668 | −25.746 | 44.490 | 1.00 | 31.63 | D000 C |
| ATOM | 4302 | CG | ASN | C | 265 | −3.717 | −25.373 | 45.605 | 1.00 | 37.30 | D000 C |
| ATOM | 4303 | ND2 | ASN | C | 265 | −4.220 | −25.357 | 46.839 | 1.00 | 35.10 | D000 N |
| ATOM | 4304 | OD1 | ASN | C | 265 | −2.541 | −25.102 | 45.367 | 1.00 | 39.83 | D000 O |
| ATOM | 4305 | N | ASP | C | 266 | −3.021 | −28.364 | 45.358 | 1.00 | 24.21 | D000 N |
| ATOM | 4306 | CA | ASP | C | 266 | −2.850 | −29.405 | 46.366 | 1.00 | 28.45 | D000 C |
| ATOM | 4307 | C | ASP | C | 266 | −3.066 | −28.832 | 47.763 | 1.00 | 36.19 | D000 C |
| ATOM | 4308 | O | ASP | C | 266 | −2.397 | −27.880 | 48.157 | 1.00 | 35.56 | D000 O |
| ATOM | 4309 | CB | ASP | C | 266 | −1.463 | −30.046 | 46.253 | 1.00 | 25.57 | D000 C |
| ATOM | 4310 | CG | ASP | C | 266 | −0.349 | −29.020 | 46.030 | 1.00 | 36.15 | D000 C |
| ATOM | 4311 | OD1 | ASP | C | 266 | −0.572 | −28.006 | 45.326 | 1.00 | 34.08 | D000 O |
| ATOM | 4312 | OD2 | ASP | C | 266 | 0.762 | −29.236 | 46.554 | 1.00 | 38.58 | D000 O |
| ATOM | 4313 | N | ASP | C | 267 | −4.007 | −29.412 | 48.507 | 1.00 | 32.84 | D000 N |
| ATOM | 4314 | CA | ASP | C | 267 | −4.386 | −28.883 | 49.817 | 1.00 | 30.12 | D000 C |
| ATOM | 4315 | C | ASP | C | 267 | −4.571 | −30.002 | 50.845 | 1.00 | 33.99 | D000 C |

TABLE 10.2-continued

| ATOM | 4316 | O | ASP | C | 267 | -4.684 | -31.181 | 50.488 | 1.00 | 23.96 | D000 | O |
|------|------|------|-----|---|-----|---------|---------|--------|------|-------|------|---|
| ATOM | 4317 | CB | ASP | C | 267 | -5.675 | -28.058 | 49.701 | 1.00 | 33.91 | D000 | C |
| ATOM | 4318 | CG | ASP | C | 267 | -5.729 | -26.898 | 50.691 | 1.00 | 39.18 | D000 | C |
| ATOM | 4319 | OD1 | ASP | C | 267 | -4.872 | -26.833 | 51.601 | 1.00 | 39.63 | D000 | O |
| ATOM | 4320 | OD2 | ASP | C | 267 | -6.640 | -26.051 | 50.560 | 1.00 | 41.15 | D000 | O |
| ATOM | 4321 | N | VAL | C | 268 | -4.610 | -29.625 | 52.121 | 1.00 | 30.38 | D000 | N |
| ATOM | 4322 | CA | VAL | C | 268 | -4.808 | -30.587 | 53.202 | 1.00 | 34.77 | D000 | C |
| ATOM | 4323 | C | VAL | C | 268 | -6.169 | -31.260 | 53.054 | 1.00 | 31.59 | D000 | C |
| ATOM | 4324 | O | VAL | C | 268 | -7.157 | -30.630 | 52.685 | 1.00 | 30.27 | D000 | O |
| ATOM | 4325 | CB | VAL | C | 268 | -4.683 | -29.923 | 54.596 | 1.00 | 36.31 | D000 | C |
| ATOM | 4326 | CG1 | VAL | C | 268 | -3.302 | -29.294 | 54.757 | 1.00 | 31.26 | D000 | C |
| ATOM | 4327 | CG2 | VAL | C | 268 | -5.770 | -28.881 | 54.801 | 1.00 | 33.82 | D000 | C |
| ATOM | 4328 | N | CYS | C | 269 | -6.209 | -32.555 | 53.334 | 1.00 | 32.86 | D000 | N |
| ATOM | 4329 | CA | CYS | C | 269 | -7.369 | -33.364 | 52.991 | 1.00 | 31.61 | D000 | C |
| ATOM | 4330 | C | CYS | C | 269 | -8.559 | -33.098 | 53.917 | 1.00 | 36.95 | D000 | C |
| ATOM | 4331 | O | CYS | C | 269 | -9.684 | -33.504 | 53.627 | 1.00 | 36.14 | D000 | O |
| ATOM | 4332 | CB | CYS | C | 269 | -6.984 | -34.839 | 53.009 | 1.00 | 44.62 | D000 | C |
| ATOM | 4333 | SG | CYS | C | 269 | -5.637 | -35.218 | 51.830 | 1.00 | 60.76 | D000 | S |
| ATOM | 4334 | N | GLN | C | 270 | -8.305 | -32.384 | 55.009 | 1.00 | 31.38 | D000 | N |
| ATOM | 4335 | CA | GLN | C | 270 | -9.324 | -32.047 | 55.992 | 1.00 | 34.32 | D000 | C |
| ATOM | 4336 | C | GLN | C | 270 | -10.328 | -30.995 | 55.495 | 1.00 | 35.28 | D000 | C |
| ATOM | 4337 | O | GLN | C | 270 | -11.434 | -30.895 | 56.022 | 1.00 | 38.13 | D000 | O |
| ATOM | 4338 | CB | GLN | C | 270 | -8.640 | -31.552 | 57.265 | 1.00 | 41.74 | D000 | C |
| ATOM | 4339 | CG | GLN | C | 270 | -9.526 | -31.531 | 58.491 | 1.00 | 57.53 | D000 | C |
| ATOM | 4340 | CD | GLN | C | 270 | -8.755 | -31.148 | 59.743 | 1.00 | 62.03 | D000 | C |
| ATOM | 4341 | NE2 | GLN | C | 270 | -9.057 | -29.975 | 60.280 | 1.00 | 54.32 | D000 | N |
| ATOM | 4342 | OE1 | GLN | C | 270 | -7.898 | -31.898 | 60.222 | 1.00 | 60.58 | D000 | O |
| ATOM | 4343 | N | ARG | C | 271 | -9.940 | -30.207 | 54.495 | 1.00 | 30.92 | D000 | N |
| ATOM | 4344 | CA | ARG | C | 271 | -10.790 | -29.124 | 53.996 | 1.00 | 30.72 | D000 | C |
| ATOM | 4345 | C | ARG | C | 271 | -12.159 | -29.633 | 53.533 | 1.00 | 38.04 | D000 | C |
| ATOM | 4346 | O | ARG | C | 271 | -12.246 | -30.543 | 52.709 | 1.00 | 31.45 | D000 | O |
| ATOM | 4347 | CB | ARG | C | 271 | -10.096 | -28.385 | 52.849 | 1.00 | 34.39 | D000 | C |
| ATOM | 4348 | CG | ARG | C | 271 | -8.799 | -27.676 | 53.234 | 1.00 | 35.61 | D000 | C |
| ATOM | 4349 | CD | ARG | C | 271 | -9.066 | -26.393 | 53.999 | 1.00 | 43.95 | D000 | C |
| ATOM | 4350 | NE | ARG | C | 271 | -7.837 | -25.661 | 54.292 | 1.00 | 42.12 | D000 | N |
| ATOM | 4351 | CZ | ARG | C | 271 | -7.169 | -25.750 | 55.438 | 1.00 | 45.47 | D000 | C |
| ATOM | 4352 | NH1 | ARG | C | 271 | -7.606 | -26.547 | 56.406 | 1.00 | 42.46 | D000 | N |
| ATOM | 4353 | NH2 | ARG | C | 271 | -6.059 | -25.048 | 55.614 | 1.00 | 47.94 | D000 | N |
| ATOM | 4354 | N | PRO | C | 272 | -13.237 | -29.045 | 54.074 | 1.00 | 35.02 | D000 | N |
| ATOM | 4355 | CA | PRO | C | 272 | -14.604 | -29.446 | 53.724 | 1.00 | 34.48 | D000 | C |
| ATOM | 4356 | C | PRO | C | 272 | -15.064 | -28.856 | 52.392 | 1.00 | 34.36 | D000 | C |
| ATOM | 4357 | O | PRO | C | 272 | -16.036 | -28.104 | 52.355 | 1.00 | 37.58 | D000 | O |
| ATOM | 4358 | CB | PRO | C | 272 | -15.433 | -28.887 | 54.881 | 1.00 | 36.83 | D000 | C |
| ATOM | 4359 | CG | PRO | C | 272 | -14.678 | -27.668 | 55.306 | 1.00 | 32.07 | D000 | C |
| ATOM | 4360 | CD | PRO | C | 272 | -13.217 | -28.007 | 55.121 | 1.00 | 35.31 | D000 | C |
| ATOM | 4361 | N | TYR | C | 273 | -14.370 | -29.197 | 51.312 | 1.00 | 34.00 | D000 | N |
| ATOM | 4362 | CA | TYR | C | 273 | -14.725 | -28.690 | 49.994 | 1.00 | 34.47 | D000 | C |
| ATOM | 4363 | C | TYR | C | 273 | -15.886 | -29.467 | 49.399 | 1.00 | 31.88 | D000 | C |
| ATOM | 4364 | O | TYR | C | 273 | -16.205 | -30.571 | 49.848 | 1.00 | 34.84 | D000 | O |
| ATOM | 4365 | CB | TYR | C | 273 | -13.523 | -28.760 | 49.048 | 1.00 | 33.39 | D000 | C |
| ATOM | 4366 | CG | TYR | C | 273 | -12.391 | -27.827 | 49.412 | 1.00 | 29.84 | D000 | C |
| ATOM | 4367 | CD1 | TYR | C | 273 | -12.634 | -26.642 | 50.096 | 1.00 | 31.84 | D000 | C |
| ATOM | 4368 | CD2 | TYR | C | 273 | -11.077 | -28.131 | 49.065 | 1.00 | 27.54 | D000 | C |
| ATOM | 4369 | CE1 | TYR | C | 273 | -11.595 | -25.778 | 50.431 | 1.00 | 30.36 | D000 | C |
| ATOM | 4370 | CE2 | TYR | C | 273 | -10.036 | -27.280 | 49.391 | 1.00 | 31.31 | D000 | C |
| ATOM | 4371 | CZ | TYR | C | 273 | -10.303 | -26.104 | 50.075 | 1.00 | 31.94 | D000 | C |
| ATOM | 4372 | OH | TYR | C | 273 | -9.273 | -25.261 | 50.404 | 1.00 | 32.60 | D000 | O |
| ATOM | 4373 | N | ARG | C | 274 | -16.510 | -28.891 | 48.377 | 1.00 | 29.76 | D000 | N |
| ATOM | 4374 | CA | ARG | C | 274 | -17.470 | -29.627 | 47.566 | 1.00 | 28.81 | D000 | C |
| ATOM | 4375 | C | ARG | C | 274 | -16.750 | -30.733 | 46.802 | 1.00 | 30.11 | D000 | C |
| ATOM | 4376 | O | ARG | C | 274 | -15.520 | -30.772 | 46.766 | 1.00 | 28.45 | D000 | O |
| ATOM | 4377 | CB | ARG | C | 274 | -18.191 | -28.689 | 46.601 | 1.00 | 31.26 | D000 | C |
| ATOM | 4378 | CG | ARG | C | 274 | -19.110 | -27.703 | 47.298 | 1.00 | 35.55 | D000 | C |
| ATOM | 4379 | CD | ARG | C | 274 | -19.871 | -26.844 | 46.309 | 1.00 | 33.61 | D000 | C |
| ATOM | 4380 | NE | ARG | C | 274 | -20.885 | -26.046 | 46.984 | 1.00 | 39.40 | D000 | N |
| ATOM | 4381 | CZ | ARG | C | 274 | -21.630 | -25.121 | 46.389 | 1.00 | 48.65 | D000 | C |
| ATOM | 4382 | NH1 | ARG | C | 274 | -21.474 | -24.867 | 45.097 | 1.00 | 48.98 | D000 | N |
| ATOM | 4383 | NH2 | ARG | C | 274 | -22.531 | -24.446 | 47.090 | 1.00 | 55.24 | D000 | N |
| ATOM | 4384 | N | TRP | C | 275 | -17.507 | -31.639 | 46.198 | 1.00 | 28.06 | D000 | N |
| ATOM | 4385 | CA | TRP | C | 275 | -16.887 | -32.709 | 45.432 | 1.00 | 28.84 | D000 | C |
| ATOM | 4386 | C | TRP | C | 275 | -17.754 | -33.114 | 44.252 | 1.00 | 29.72 | D000 | C |
| ATOM | 4387 | O | TRP | C | 275 | -18.905 | -32.693 | 44.130 | 1.00 | 26.78 | D000 | O |
| ATOM | 4388 | CB | TRP | C | 275 | -16.601 | -33.927 | 46.322 | 1.00 | 29.81 | D000 | C |
| ATOM | 4389 | CG | TRP | C | 275 | -17.824 | -34.715 | 46.717 | 1.00 | 31.96 | D000 | C |
| ATOM | 4390 | CD1 | TRP | C | 275 | -18.293 | -35.855 | 46.125 | 1.00 | 31.44 | D000 | C |
| ATOM | 4391 | CD2 | TRP | C | 275 | -18.726 | -34.423 | 47.795 | 1.00 | 29.40 | D000 | C |
| ATOM | 4392 | CE2 | TRP | C | 275 | -19.718 | -35.426 | 47.793 | 1.00 | 31.93 | D000 | C |
| ATOM | 4393 | CE3 | TRP | C | 275 | -18.791 | -33.412 | 48.759 | 1.00 | 32.50 | D000 | C |
| ATOM | 4394 | NE1 | TRP | C | 275 | -19.430 | -36.288 | 46.767 | 1.00 | 36.68 | D000 | N |
| ATOM | 4395 | CZ2 | TRP | C | 275 | -20.761 | -35.447 | 48.718 | 1.00 | 33.08 | D000 | C |

TABLE 10.2-continued

| ATOM | 4396 | CZ3 | TRP | C | 275 | −19.829 | −33.433 | 49.676 | 1.00 | 33.96 | D000 | C |
|---|---|---|---|---|---|---|---|---|---|---|---|---|
| ATOM | 4397 | CH2 | TRP | C | 275 | −20.801 | −34.443 | 49.648 | 1.00 | 35.93 | D000 | C |
| ATOM | 4398 | N | VAL | C | 276 | −17.178 | −33.926 | 43.376 | 1.00 | 28.10 | D000 | N |
| ATOM | 4399 | CA | VAL | C | 276 | −17.870 | −34.412 | 42.195 | 1.00 | 29.03 | D000 | C |
| ATOM | 4400 | C | VAL | C | 276 | −17.737 | −35.924 | 42.114 | 1.00 | 27.19 | D000 | C |
| ATOM | 4401 | O | VAL | C | 276 | −16.628 | −36.454 | 42.177 | 1.00 | 28.31 | D000 | O |
| ATOM | 4402 | CB | VAL | C | 276 | −17.302 | −33.780 | 40.905 | 1.00 | 28.00 | D000 | C |
| ATOM | 4403 | CG1 | VAL | C | 276 | −18.046 | −34.293 | 39.688 | 1.00 | 27.41 | D000 | C |
| ATOM | 4404 | CG2 | VAL | C | 276 | −17.364 | −32.259 | 40.982 | 1.00 | 28.48 | D000 | C |
| ATOM | 4405 | N | CYS | C | 277 | −18.862 | −36.619 | 41.988 | 1.00 | 26.93 | D000 | N |
| ATOM | 4406 | CA | CYS | C | 277 | −18.832 | −38.058 | 41.751 | 1.00 | 33.14 | D000 | C |
| ATOM | 4407 | C | CYS | C | 277 | −18.994 | −38.338 | 40.262 | 1.00 | 37.44 | D000 | C |
| ATOM | 4408 | O | CYS | C | 277 | −19.699 | −37.612 | 39.564 | 1.00 | 33.29 | D000 | O |
| ATOM | 4409 | CB | CYS | C | 277 | −19.922 | −38.770 | 42.562 | 1.00 | 32.89 | D000 | C |
| ATOM | 4410 | SG | CYS | C | 277 | −19.660 | −38.700 | 44.364 | 1.00 | 47.93 | D000 | S |
| ATOM | 4411 | N | GLU | C | 278 | −18.324 | −39.386 | 39.787 | 1.00 | 30.10 | D000 | N |
| ATOM | 4412 | CA | GLU | C | 278 | −18.367 | −39.774 | 38.386 | 1.00 | 28.53 | D000 | C |
| ATOM | 4413 | C | GLU | C | 278 | −18.528 | −41.288 | 38.252 | 1.00 | 32.73 | D000 | C |
| ATOM | 4414 | O | GLU | C | 278 | −17.931 | −42.050 | 39.008 | 1.00 | 29.46 | D000 | O |
| ATOM | 4415 | CB | GLU | C | 278 | −17.095 | −39.315 | 37.655 | 1.00 | 32.72 | D000 | C |
| ATOM | 4416 | CG | GLU | C | 278 | −16.913 | −39.932 | 36.260 | 1.00 | 32.26 | D000 | C |
| ATOM | 4417 | CD | GLU | C | 278 | −15.636 | −39.483 | 35.555 | 1.00 | 39.23 | D000 | C |
| ATOM | 4418 | OE1 | GLU | C | 278 | −14.646 | −39.151 | 36.241 | 1.00 | 36.80 | D000 | O |
| ATOM | 4419 | OE2 | GLU | C | 278 | −15.622 | −39.463 | 34.303 | 1.00 | 40.68 | D000 | O |
| ATOM | 4420 | N | THR | C | 279 | −19.346 | −41.717 | 37.297 | 1.00 | 27.04 | D000 | N |
| ATOM | 4421 | CA | THR | C | 279 | −19.453 | −43.132 | 36.963 | 1.00 | 34.21 | D000 | C |
| ATOM | 4422 | C | THR | C | 279 | −19.688 | −43.285 | 35.460 | 1.00 | 36.69 | D000 | C |
| ATOM | 4423 | O | THR | C | 279 | −19.848 | −42.296 | 34.746 | 1.00 | 39.25 | D000 | O |
| ATOM | 4424 | CB | THR | C | 279 | −20.586 | −43.826 | 37.758 | 1.00 | 39.26 | D000 | C |
| ATOM | 4425 | CG2 | THR | C | 279 | −21.950 | −43.311 | 37.326 | 1.00 | 34.73 | D000 | C |
| ATOM | 4426 | OG1 | THR | C | 279 | −20.522 | −45.244 | 37.554 | 1.00 | 42.37 | D000 | O |
| ATOM | 4427 | N | GLU | C | 280 | −19.704 | −44.522 | 34.980 | 1.00 | 32.85 | D000 | N |
| ATOM | 4428 | CA | GLU | C | 280 | −19.835 | −44.782 | 33.548 | 1.00 | 50.68 | D000 | C |
| ATOM | 4429 | C | GLU | C | 280 | −21.239 | −45.225 | 33.156 | 1.00 | 52.22 | D000 | C |
| ATOM | 4430 | O | GLU | C | 280 | −22.086 | −45.481 | 34.011 | 1.00 | 55.73 | D000 | O |
| ATOM | 4431 | CB | GLU | C | 280 | −18.829 | −45.846 | 33.118 | 1.00 | 52.68 | D000 | C |
| ATOM | 4432 | CG | GLU | C | 280 | −17.416 | −45.583 | 33.593 | 1.00 | 64.50 | D000 | C |
| ATOM | 4433 | CD | GLU | C | 280 | −16.653 | −46.863 | 33.862 | 1.00 | 89.69 | D000 | C |
| ATOM | 4434 | OE1 | GLU | C | 280 | −17.283 | −47.943 | 33.861 | 1.00 | 93.00 | D000 | O |
| ATOM | 4435 | OE2 | GLU | C | 280 | −15.424 | −46.790 | 34.078 | 1.00 | 104.15 | D000 | O |
| ATOM | 4436 | O | LEU | C | 281 | −22.641 | −47.686 | 29.761 | 1.00 | 76.02 | D000 | O |
| ATOM | 4437 | N | LEU | C | 281 | −21.477 | −45.319 | 31.852 | 1.00 | 63.81 | D000 | N |
| ATOM | 4438 | CA | LEU | C | 281 | −22.728 | −45.870 | 31.340 | 1.00 | 65.22 | D000 | C |
| ATOM | 4439 | C | LEU | C | 281 | −22.565 | −47.338 | 30.941 | 1.00 | 72.08 | D000 | C |
| ATOM | 4440 | CB | LEU | C | 281 | −23.228 | −45.044 | 30.158 | 1.00 | 59.22 | D000 | C |
| ATOM | 4441 | CG | LEU | C | 281 | −23.879 | −43.727 | 30.578 | 1.00 | 63.11 | D000 | C |
| ATOM | 4442 | CD1 | LEU | C | 281 | −24.279 | −42.891 | 29.370 | 1.00 | 48.41 | D000 | C |
| ATOM | 4443 | CD2 | LEU | C | 281 | −25.083 | −44.021 | 31.458 | 1.00 | 67.92 | D000 | C |
| ATOM | 4444 | O | ASP | C | 282 | −20.760 | −51.176 | 30.617 | 1.00 | 50.93 | D000 | O |
| ATOM | 4445 | N | ASP | C | 282 | −22.342 | −48.183 | 31.947 | 1.00 | 77.43 | D000 | N |
| ATOM | 4446 | CA | ASP | C | 282 | −22.184 | −49.629 | 31.778 | 1.00 | 80.26 | D000 | C |
| ATOM | 4447 | C | ASP | C | 282 | −21.144 | −50.009 | 30.726 | 1.00 | 71.14 | D000 | C |
| ATOM | 4448 | CB | ASP | C | 282 | −23.529 | −50.272 | 31.433 | 1.00 | 81.46 | D000 | C |
| ATOM | 4449 | CG | ASP | C | 282 | −24.448 | −50.366 | 32.632 | 1.00 | 80.75 | D000 | C |
| ATOM | 4450 | OD1 | ASP | C | 282 | −24.417 | −49.445 | 33.476 | 1.00 | 77.18 | D000 | O |
| ATOM | 4451 | OD2 | ASP | C | 282 | −25.192 | −51.364 | 32.736 | 1.00 | 78.02 | D000 | O |
| TER | | | | | | | | | | | | |

TABLE 10.3

| ATOM | 1 | N | GLN | C | 1 | 12.778 | 87.875 | 6.343 | 1.00 | 63.46 | N |
|---|---|---|---|---|---|---|---|---|---|---|---|
| ATOM | 2 | CA | GLN | C | 1 | 12.935 | 86.437 | 6.168 | 1.00 | 57.97 | C |
| ATOM | 3 | C | GLN | C | 1 | 11.798 | 85.716 | 6.845 | 1.00 | 55.78 | C |
| ATOM | 4 | O | GLN | C | 1 | 11.088 | 86.308 | 7.656 | 1.00 | 58.48 | O |
| ATOM | 5 | CB | GLN | C | 1 | 14.271 | 85.946 | 6.714 | 1.00 | 51.88 | C |
| ATOM | 6 | CG | GLN | C | 1 | 14.814 | 84.739 | 5.974 | 1.00 | 59.79 | C |
| ATOM | 7 | CD | GLN | C | 1 | 14.717 | 84.869 | 4.445 | 1.00 | 78.61 | C |
| ATOM | 8 | OE1 | GLN | C | 1 | 14.676 | 85.980 | 3.896 | 1.00 | 61.52 | O |
| ATOM | 9 | NE2 | GLN | C | 1 | 14.669 | 83.721 | 3.743 | 1.00 | 84.10 | N |
| ATOM | 10 | N | VAL | C | 2 | 11.615 | 84.445 | 6.497 | 1.00 | 50.14 | N |
| ATOM | 11 | C | VAL | C | 2 | 10.404 | 83.710 | 6.828 | 1.00 | 46.16 | C |
| ATOM | 12 | C | VAL | C | 2 | 10.800 | 82.363 | 7.396 | 1.00 | 45.45 | C |
| ATOM | 13 | O | VAL | C | 2 | 11.642 | 81.667 | 6.822 | 1.00 | 49.37 | O |
| ATOM | 14 | CB | VAL | C | 2 | 9.493 | 83.521 | 5.596 | 1.00 | 45.22 | C |
| ATOM | 15 | CG1 | VAL | C | 2 | 8.322 | 82.567 | 5.911 | 1.00 | 45.47 | C |
| ATOM | 16 | CG2 | VAL | C | 2 | 8.965 | 84.848 | 5.109 | 1.00 | 40.64 | C |
| ATOM | 17 | N | GLN | C | 3 | 10.163 | 81.983 | 8.498 | 1.00 | 50.52 | N |

TABLE 10.3-continued

| | | | | | | | | | | |
|---|---|---|---|---|---|---|---|---|---|---|
| ATOM | 18 | CA | GLN | C | 3 | 10.262 | 80.648 | 9.066 | 1.00 | 49.86 | C |
| ATOM | 19 | C | GLN | C | 3 | 8.856 | 80.074 | 9.158 | 1.00 | 45.53 | C |
| ATOM | 20 | O | GLN | C | 3 | 7.924 | 80.766 | 9.596 | 1.00 | 40.46 | O |
| ATOM | 21 | CB | GLN | C | 3 | 10.933 | 80.674 | 10.449 | 1.00 | 52.58 | C |
| ATOM | 22 | CG | GLN | C | 3 | 12.476 | 80.689 | 10.448 | 1.00 | 67.48 | C |
| ATOM | 23 | CD | GLN | C | 3 | 13.103 | 82.051 | 10.135 | 1.00 | 74.06 | C |
| ATOM | 24 | OE1 | GLN | C | 3 | 12.444 | 83.102 | 10.186 | 1.00 | 75.22 | O |
| ATOM | 25 | NE2 | GLN | C | 3 | 14.394 | 82.033 | 9.811 | 1.00 | 80.56 | N |
| ATOM | 26 | N | LEU | C | 4 | 8.702 | 78.828 | 8.714 | 1.00 | 36.58 | N |
| ATOM | 27 | CA | LEU | C | 4 | 7.451 | 78.093 | 8.811 | 1.00 | 35.24 | C |
| ATOM | 28 | C | LEU | C | 4 | 7.674 | 76.836 | 9.634 | 1.00 | 35.32 | C |
| ATOM | 29 | O | LEU | C | 4 | 8.563 | 76.043 | 9.319 | 1.00 | 34.10 | O |
| ATOM | 30 | CB | LEU | C | 4 | 6.925 | 77.728 | 7.417 | 1.00 | 35.59 | C |
| ATOM | 31 | CG | LEU | C | 4 | 6.747 | 78.896 | 6.452 | 1.00 | 38.97 | C |
| ATOM | 32 | CD1 | LEU | C | 4 | 6.422 | 78.423 | 5.045 | 1.00 | 39.74 | C |
| ATOM | 33 | CD2 | LEU | C | 4 | 5.653 | 79.806 | 6.970 | 1.00 | 42.54 | C |
| ATOM | 34 | N | VAL | C | 5 | 6.835 | 76.623 | 10.647 | 1.00 | 40.31 | N |
| ATOM | 35 | CA | VAL | C | 5 | 6.970 | 75.492 | 11.568 | 1.00 | 38.30 | C |
| ATOM | 36 | C | VAL | C | 5 | 5.625 | 74.776 | 11.675 | 1.00 | 41.55 | C |
| ATOM | 37 | O | VAL | C | 5 | 4.663 | 75.325 | 12.232 | 1.00 | 47.07 | O |
| ATOM | 38 | CB | VAL | C | 5 | 7.451 | 75.939 | 12.956 | 1.00 | 35.88 | C |
| ATOM | 39 | CG1 | VAL | C | 5 | 7.568 | 74.743 | 13.871 | 1.00 | 36.28 | C |
| ATOM | 40 | CG2 | VAL | C | 5 | 8.763 | 76.660 | 12.847 | 1.00 | 26.29 | C |
| ATOM | 41 | N | GLU | C | 6 | 5.558 | 73.556 | 11.169 | 1.00 | 42.37 | N |
| ATOM | 42 | CA | GLU | C | 6 | 4.354 | 72.741 | 11.241 | 1.00 | 43.70 | C |
| ATOM | 43 | C | GLU | C | 6 | 4.281 | 71.970 | 12.559 | 1.00 | 43.98 | C |
| ATOM | 44 | O | GLU | C | 6 | 5.290 | 71.677 | 13.196 | 1.00 | 49.49 | O |
| ATOM | 45 | CB | GLU | C | 6 | 4.290 | 71.749 | 10.081 | 1.00 | 44.93 | C |
| ATOM | 46 | CG | GLU | C | 6 | 4.481 | 72.363 | 8.699 | 1.00 | 44.29 | C |
| ATOM | 47 | CD | GLU | C | 6 | 5.949 | 72.419 | 8.267 | 1.00 | 44.27 | C |
| ATOM | 48 | OE1 | GLU | C | 6 | 6.215 | 72.317 | 7.041 | 1.00 | 42.60 | O |
| ATON | 49 | OE2 | GLU | C | 6 | 6.832 | 72.490 | 9.153 | 1.00 | 47.82 | O1− |
| ATOM | 50 | N | SER | C | 7 | 3.061 | 71.619 | 12.950 | 1.00 | 48.19 | N |
| ATOM | 51 | CA | SER | C | 7 | 2.851 | 70.788 | 14.128 | 1.00 | 51.74 | C |
| ATOM | 52 | C | SER | C | 7 | 1.509 | 70.084 | 13.994 | 1.00 | 45.51 | C |
| ATOM | 53 | O | SER | C | 7 | 0.681 | 70.437 | 13.151 | 1.00 | 43.94 | O |
| ATOM | 54 | CB | SER | C | 7 | 2.904 | 71.620 | 15.410 | 1.00 | 38.38 | C |
| ATOM | 55 | OG | SER | C | 7 | 1.907 | 72.623 | 15.354 | 1.00 | 49.56 | O |
| ATOM | 56 | N | GLY | C | 8 | 1.310 | 69.067 | 14.829 | 1.00 | 48.93 | N |
| ATOM | 57 | CA | GLY | C | 8 | 0.030 | 68.405 | 14.930 | 1.00 | 34.09 | C |
| ATOM | 58 | C | GLY | C | 8 | −0.065 | 67.069 | 14.246 | 1.00 | 43.11 | C |
| ATOM | 59 | O | GLY | C | 8 | −1.148 | 66.466 | 14.255 | 1.00 | 46.79 | O |
| ATOM | 60 | N | GLY | C | 9 | 1.015 | 66.567 | 13.666 | 1.00 | 37.58 | N |
| ATOM | 61 | CA | GLY | C | 9 | 0.947 | 65.229 | 13.116 | 1.00 | 47.86 | C |
| ATOM | 62 | C | GLY | C | 9 | 0.747 | 64.199 | 14.226 | 1.00 | 51.47 | C |
| ATOM | 63 | O | GLY | C | 9 | 0.716 | 64.509 | 15.419 | 1.00 | 54.50 | O |
| ATOM | 64 | N | GLY | C | 10 | 0.731 | 62.943 | 13.833 | 1.00 | 46.74 | N |
| ATOM | 65 | CA | GLY | C | 10 | 0.618 | 61.871 | 14.804 | 1.00 | 46.77 | C |
| ATOM | 66 | C | GLY | C | 10 | −0.035 | 60.648 | 14.193 | 1.00 | 52.50 | C |
| ATOM | 67 | 0 | GLY | C | 10 | −0.310 | 60.586 | 12.994 | 1.00 | 47.51 | O |
| ATOM | 68 | N | VAL | C | 11 | −0.256 | 59.651 | 15.049 | 1.00 | 51.48 | N |
| ATOM | 69 | CA | VAL | C | 11 | −0.832 | 58.380 | 14.625 | 1.00 | 53.97 | C |
| ATOM | 70 | C | VAL | C | 11 | −2.320 | 58.434 | 14.900 | 1.00 | 52.43 | C |
| ATOM | 71 | O | VAL | C | 11 | −2.739 | 58.881 | 15.975 | 1.00 | 50.83 | O |
| ATOM | 72 | CB | VAL | C | 11 | −0.183 | 57.184 | 15.345 | 1.00 | 43.91 | C |
| ATOM | 73 | CG1 | VAL | C | 11 | −0.742 | 55.891 | 14.787 | 1.00 | 43.96 | C |
| ATOM | 74 | CG2 | VAL | C | 11 | 1.317 | 57.226 | 15.201 | 1.00 | 43.94 | C |
| ATOM | 75 | N | VAL | C | 12 | −3.117 | 58.015 | 13.916 | 1.00 | 45.99 | N |
| ATOM | 76 | CA | VAL | C | 12 | −4.570 | 58.072 | 13.996 | 1.00 | 46.88 | C |
| ATOM | 77 | C | VAL | C | 12 | −5.115 | 56.950 | 13.139 | 1.00 | 46.73 | C |
| ATOM | 78 | O | VAL | C | 12 | −4.469 | 56.494 | 12.191 | 1.00 | 47.91 | O |
| ATOM | 79 | CB | VAL | C | 12 | −5.179 | 59.425 | 13.540 | 1.00 | 47.29 | C |
| ATOM | 80 | CG1 | VAL | C | 12 | −4.763 | 60.547 | 14.468 | 1.00 | 46.14 | C |
| ATOM | 81 | CG2 | VAL | C | 12 | −4.755 | 59.739 | 12.130 | 1.00 | 48.50 | C |
| ATOM | 82 | N | GLN | C | 13 | −6.316 | 56.547 | 13.443 | 1.00 | 51.98 | N |
| ATOM | 83 | CA | GLN | C | 13 | −7.001 | 55.451 | 12.787 | 1.00 | 48.11 | C |
| ATOM | 84 | C | GLN | C | 13 | −7.748 | 55.950 | 11.559 | 1.00 | 42.02 | C |
| ATOM | 85 | O | GLN | C | 13 | −8.237 | 57.082 | 11.548 | 1.00 | 45.22 | O |
| ATOM | 86 | CB | GLN | C | 13 | −8.005 | 54.841 | 13.740 | 1.00 | 57.37 | C |
| ATOM | 87 | CG | GLN | C | 13 | −7.409 | 54.422 | 15.035 | 1.00 | 67.65 | C |
| ATOM | 88 | CD | GLN | C | 13 | −8.286 | 53.439 | 15.730 | 1.00 | 79.97 | C |
| ATOM | 89 | OE1 | GLN | C | 13 | −8.845 | 53.737 | 16.788 | 1.00 | 93.60 | O |
| ATOM | 90 | NE2 | GLN | C | 13 | −8.446 | 52.258 | 15.130 | 1.00 | 91.83 | N |
| ATOM | 91 | N | PRO | C | 14 | −7.878 | 55.101 | 10.541 | 1.00 | 38.64 | N |
| ATOM | 92 | CA | PRO | C | 14 | −8.652 | 55.475 | 9.351 | 1.00 | 37.32 | C |
| ATOM | 93 | C | PRO | C | 14 | −10.050 | 55.954 | 9.725 | 1.00 | 48.06 | C |
| ATOM | 94 | O | PRO | C | 14 | −10.688 | 55.419 | 10.634 | 1.00 | 50.66 | O |
| ATOM | 95 | CB | PRO | C | 14 | −8.711 | 54.174 | 8.539 | 1.00 | 35.18 | C |
| ATOM | 96 | CG | PRO | C | 14 | −7.556 | 53.370 | 9.005 | 1.00 | 40.76 | C |
| ATOM | 97 | CD | PRO | C | 14 | −7.351 | 53.727 | 10.456 | 1.00 | 40.72 | C |

TABLE 10.3-continued

| | | | | | | | | | | |
|---|---|---|---|---|---|---|---|---|---|---|
| ATOM | 98 | N | GLY | C | 15 | −10.525 | 56.982 | 9.023 | 1.00 | 45.47 | N |
| ATOM | 99 | CA | GLY | C | 15 | −11.836 | 57.526 | 9.264 | 1.00 | 39.13 | C |
| ATOM | 100 | C | GLY | C | 15 | −11.886 | 58.622 | 10.303 | 1.00 | 40.65 | C |
| ATOM | 101 | O | GLY | C | 15 | −12.887 | 59.331 | 10.374 | 1.00 | 51.10 | O |
| ATOM | 102 | N | ARG | C | 16 | −10.842 | 58.781 | 11.109 | 1.00 | 42.12 | N |
| ATOM | 103 | CA | ARG | C | 16 | −10.778 | 59.854 | 12.087 | 1.00 | 42.11 | C |
| ATOM | 104 | C | ARG | C | 16 | −10.275 | 61.158 | 11.450 | 1.00 | 49.72 | C |
| ATOM | 105 | O | ARG | C | 16 | −10.040 | 61.255 | 10.237 | 1.00 | 41.14 | O |
| ATOM | 106 | CB | ARG | C | 16 | −9.865 | 59.456 | 13.243 | 1.00 | 48.99 | C |
| ATOM | 107 | CG | ARG | C | 16 | −10.287 | 58.203 | 13.961 | 1.00 | 58.16 | C |
| ATOM | 108 | CD | ARG | C | 16 | −11.621 | 58.360 | 14.645 | 1.00 | 60.17 | C |
| ATOM | 109 | NE | ARG | C | 16 | −11.592 | 57.775 | 15.983 | 1.00 | 78.30 | N |
| ATOM | 110 | CZ | ARG | C | 16 | −12.669 | 57.597 | 16.743 | 1.00 | 90.64 | C |
| ATOM | 111 | NH1 | ARG | C | 16 | −13.866 | 57.952 | 16.295 | 1.00 | 92.41 | N1+ |
| ATOM | 112 | NH2 | ARG | C | 16 | −12.552 | 57.058 | 17.950 | 1.00 | 96.43 | N |
| ATOM | 113 | N | SER | C | 17 | −10.093 | 62.174 | 12.299 | 1.00 | 44.14 | N |
| ATOM | 114 | CA | SER | C | 17 | −9.731 | 63.516 | 11.876 | 1.00 | 45.83 | C |
| ATOM | 115 | C | SER | C | 17 | −8.490 | 63.998 | 12.604 | 1.00 | 44.89 | C |
| ATOM | 116 | O | SER | C | 17 | −8.207 | 63.600 | 13.738 | 1.00 | 51.51 | O |
| ATOM | 117 | CB | SER | C | 17 | −10.853 | 64.535 | 12.132 | 1.00 | 45.46 | C |
| ATOM | 118 | OG | SER | C | 17 | −11.938 | 64.263 | 11.274 | 1.00 | 59.74 | O |
| ATOM | 119 | N | LEU | C | 18 | −7.817 | 64.947 | 11.961 | 1.00 | 41.62 | N |
| ATOM | 120 | CA | LEU | C | 18 | −6.610 | 65.573 | 12.473 | 1.00 | 44.03 | C |
| ATOM | 121 | C | LEU | C | 18 | −6.536 | 66.971 | 11.886 | 1.00 | 41.33 | C |
| ATOM | 122 | O | LEU | C | 18 | −6.961 | 67.203 | 10.756 | 1.00 | 44.87 | O |
| ATOM | 123 | CB | LEU | C | 18 | −5.366 | 64.772 | 12.079 | 1.00 | 41.97 | C |
| ATOM | 124 | CG | LEU | C | 18 | −4.114 | 64.794 | 12.940 | 1.00 | 54.29 | C |
| ATOM | 125 | CD1 | LEU | C | 18 | −4.440 | 64.407 | 14.380 | 1.00 | 50.61 | C |
| ATOM | 126 | CD2 | LEU | C | 18 | −3.075 | 63.836 | 12.334 | 1.00 | 49.38 | C |
| ATOM | 127 | N | ARG | C | 19 | −6.000 | 67.902 | 12.654 | 1.00 | 39.81 | N |
| ATOM | 128 | CA | ARG | C | 19 | −5.810 | 69.262 | 12.189 | 1.00 | 40.64 | C |
| ATOM | 129 | C | ARG | C | 19 | −4.334 | 69.605 | 12.283 | 1.00 | 48.86 | C |
| ATOM | 130 | O | ARG | C | 19 | −3.778 | 69.652 | 13.386 | 1.00 | 48.74 | O |
| ATOM | 131 | CB | ARG | C | 19 | −6.650 | 70.222 | 13.021 | 1.00 | 41.19 | C |
| ATOM | 132 | CG | ARG | C | 19 | −6.806 | 71.632 | 12.452 | 1.00 | 46.04 | C |
| ATOM | 133 | CD | ARG | C | 19 | −6.323 | 72.509 | 13.554 | 1.00 | 49.64 | C |
| ATOM | 134 | NE | ARG | C | 19 | −7.182 | 73.633 | 13.872 | 1.00 | 52.33 | N |
| ATOM | 135 | CZ | ARG | C | 19 | −6.947 | 74.447 | 14.900 | 1.00 | 60.69 | C |
| ATOM | 136 | NH1 | ARG | C | 19 | −5.914 | 74.205 | 15.702 | 1.00 | 60.16 | N1+ |
| ATOM | 137 | NH2 | ARG | C | 19 | −7.741 | 75.487 | 15.142 | 1.00 | 61.67 | N |
| ATOM | 138 | N | LEU | C | 20 | −3.716 | 69.890 | 11.137 | 1.00 | 44.47 | N |
| ATOM | 139 | CA | LEU | C | 20 | −2.328 | 70.331 | 11.121 | 1.00 | 42.17 | C |
| ATOM | 140 | C | LEU | C | 20 | −2.270 | 71.840 | 11.202 | 1.00 | 40.77 | C |
| ATOM | 141 | O | LEU | C | 20 | −3.145 | 72.544 | 10.691 | 1.00 | 39.38 | O |
| ATOM | 142 | CB | LEU | C | 20 | −1.591 | 69.860 | 9.864 | 1.00 | 32.38 | C |
| ATOM | 143 | CG | LEU | C | 20 | −1.658 | 68.360 | 9.649 | 1.00 | 39.39 | C |
| ATOM | 144 | CD1 | LEU | C | 20 | −0.808 | 67.907 | 8.483 | 1.00 | 38.47 | C |
| ATOM | 145 | CD2 | LEU | C | 20 | −1.266 | 67.633 | 10.930 | 1.00 | 41.15 | C |
| ATOM | 146 | N | SER | C | 21 | −1.221 | 72.328 | 11.845 | 1.00 | 39.02 | N |
| ATOM | 147 | CA | SER | C | 21 | −0.951 | 73.748 | 11.950 | 1.00 | 40.69 | C |
| ATOM | 148 | C | SER | C | 21 | 0.423 | 74.053 | 11.372 | 1.00 | 47.84 | C |
| ATOM | 149 | O | SER | C | 21 | 1.339 | 73.221 | 11.416 | 1.00 | 45.59 | O |
| ATOM | 150 | CB | SER | C | 21 | −1.011 | 74.211 | 13.397 | 1.00 | 38.57 | C |
| ATOM | 151 | OG | SER | C | 21 | −2.330 | 74.127 | 13.871 | 1.00 | 56.62 | O |
| ATOM | 152 | N | CYS | C | 22 | 0.546 | 75.263 | 10.834 | 1.00 | 38.99 | N |
| ATOM | 153 | CA | CYS | C | 22 | 1.795 | 75.794 | 10.299 | 1.00 | 44.99 | C |
| ATOM | 154 | C | CYS | C | 22 | 1.951 | 77.220 | 10.827 | 1.00 | 46.04 | C |
| ATOM | 155 | O | CYS | C | 22 | 1.172 | 78.113 | 10.465 | 1.00 | 41.82 | O |
| ATOM | 156 | CB | CYS | C | 22 | 1.788 | 75.761 | 8.768 | 1.00 | 44.73 | C |
| ATOM | 157 | SG | CYS | C | 22 | 3.139 | 76.705 | 7.941 | 1.00 | 52.54 | S |
| ATOM | 158 | N | ALA | C | 23 | 2.921 | 77.417 | 11.717 | 1.00 | 39.89 | N |
| ATOM | 159 | CA | ALA | C | 23 | 3.158 | 78.694 | 12.375 | 1.00 | 39.98 | C |
| ATOM | 160 | C | ALA | C | 23 | 4.271 | 79.454 | 11.659 | 1.00 | 41.32 | C |
| ATOM | 161 | O | ALA | C | 23 | 5.359 | 78.912 | 11.428 | 1.00 | 44.39 | O |
| ATOM | 162 | CB | ALA | C | 23 | 3.522 | 78.488 | 13.850 | 1.00 | 35.18 | C |
| ATOM | 163 | N | ALA | C | 24 | 3.999 | 80.703 | 11.327 | 1.00 | 39.85 | N |
| ATOM | 164 | CA | ALA | C | 24 | 4.895 | 81.524 | 10.537 | 1.00 | 43.27 | C |
| ATOM | 165 | C | ALA | C | 24 | 5.477 | 82.657 | 11.372 | 1.00 | 46.72 | C |
| ATOM | 166 | O | ALA | C | 24 | 4.801 | 83.237 | 12.220 | 1.00 | 48.85 | O |
| ATOM | 167 | CB | ALA | C | 24 | 4.157 | 82.110 | 9.339 | 1.00 | 38.90 | C |
| ATOM | 168 | N | SER | C | 25 | 6.720 | 83.018 | 11.076 | 1.00 | 44.32 | N |
| ATOM | 169 | CA | SER | C | 25 | 7.328 | 84.177 | 11.710 | 1.00 | 46.12 | C |
| ATOM | 170 | C | SER | C | 25 | 8.226 | 84.874 | 10.695 | 1.00 | 44.36 | C |
| ATOM | 171 | O | SER | C | 25 | 8.623 | 84.304 | 9.673 | 1.00 | 43.53 | O |
| ATOM | 172 | CB | SER | C | 25 | 8.122 | 83.783 | 12.966 | 1.00 | 46.62 | C |
| ATOM | 173 | OG | SER | C | 25 | 9.191 | 82.915 | 12.642 | 1.00 | 42.94 | O |
| ATOM | 174 | N | GLY | C | 26 | 8.563 | 86.112 | 11.001 | 1.00 | 46.40 | N |
| ATOM | 175 | CA | GLY | C | 26 | 9.394 | 86.915 | 10.124 | 1.00 | 42.45 | C |
| ATOM | 176 | C | GLY | C | 26 | 8.527 | 87.884 | 9.326 | 1.00 | 52.00 | C |
| ATOM | 177 | O | GLY | C | 26 | 7.673 | 88.572 | 9.891 | 1.00 | 48.03 | O |

TABLE 10.3-continued

| | | | | | | | | | | |
|---|---|---|---|---|---|---|---|---|---|---|
| ATOM | 178 | N | PHE | C | 27 | 8.729 | 87.910 | 8.013 | 1.00 | 49.49 | N |
| ATOM | 179 | CA | PHE | C | 27 | 7.986 | 88.820 | 7.151 | 1.00 | 45.04 | C |
| ATOM | 180 | C | PHE | C | 27 | 6.479 | 88.576 | 7.273 | 1.00 | 44.14 | C |
| ATOM | 181 | O | PHE | C | 27 | 6.025 | 87.430 | 7.293 | 1.00 | 47.90 | O |
| ATOM | 182 | CB | PHE | C | 27 | 8.449 | 88.611 | 5.712 | 1.00 | 45.76 | C |
| ATOM | 183 | CG | PHE | C | 27 | 7.704 | 89.421 | 4.711 | 1.00 | 48.04 | C |
| ATOM | 184 | CD1 | PHE | C | 27 | 7.470 | 90.769 | 4.937 | 1.00 | 50.27 | C |
| ATOM | 185 | CD2 | PHE | C | 27 | 7.236 | 88.838 | 3.539 | 1.00 | 49.31 | C |
| ATOM | 186 | CE1 | PHE | C | 27 | 6.784 | 91.537 | 4.011 | 1.00 | 53.69 | C |
| ATOM | 187 | CE2 | PHE | C | 27 | 6.550 | 89.591 | 2.606 | 1.00 | 47.82 | C |
| ATOM | 188 | CZ | PHE | C | 27 | 6.320 | 90.951 | 2.846 | 1.00 | 49.54 | C |
| ATOM | 189 | N | THR | C | 28 | 5.709 | 89.671 | 7.335 | 1.00 | 44.86 | N |
| ATOM | 190 | CA | THR | C | 28 | 4.261 | 89.693 | 7.577 | 1.00 | 38.38 | C |
| ATOM | 191 | C | THR | C | 28 | 3.475 | 88.544 | 6.941 | 1.00 | 42.91 | C |
| ATOM | 192 | O | THR | C | 28 | 3.343 | 88.483 | 5.711 | 1.00 | 36.78 | O |
| ATOM | 193 | CB | THR | C | 28 | 3.679 | 90.998 | 7.038 | 1.00 | 49.68 | C |
| ATOM | 194 | OG1 | THR | C | 28 | 4.434 | 92.106 | 7.536 | 1.00 | 46.23 | O |
| ATOM | 195 | CG2 | THR | C | 28 | 2.208 | 91.133 | 7.410 | 1.00 | 44.54 | C |
| ATOM | 196 | N | PHE | C | 29 | 2.891 | 87.687 | 7.790 | 1.00 | 38.44 | N |
| ATOM | 197 | CA | PHE | C | 29 | 2.154 | 86.502 | 7.350 | 1.00 | 40.01 | C |
| ATOM | 198 | C | PHE | C | 29 | 1.089 | 86.822 | 6.304 | 1.00 | 36.82 | C |
| ATOM | 199 | O | PHE | C | 29 | 0.942 | 86.092 | 5.316 | 1.00 | 36.46 | O |
| ATOM | 200 | CB | PHE | C | 29 | 1.508 | 85.858 | 8.571 | 1.00 | 39.47 | C |
| ATOM | 201 | CG | PHE | C | 29 | 0.772 | 84.586 | 8.296 | 1.00 | 41.07 | C |
| ATOM | 202 | CD1 | PHE | C | 29 | 1.443 | 83.470 | 7.809 | 1.00 | 39.25 | C |
| ATOM | 203 | CD2 | PHE | C | 29 | −0.586 | 84.484 | 8.581 | 1.00 | 37.61 | C |
| ATOM | 204 | CE1 | PHE | C | 29 | 0.782 | 82.271 | 7.600 | 1.00 | 37.53 | C |
| ATOM | 205 | CE2 | PHE | C | 29 | −1.260 | 83.280 | 8.380 | 1.00 | 42.81 | C |
| ATOM | 206 | CZ | PHE | C | 29 | −0.575 | 82.170 | 7.878 | 1.00 | 41.35 | C |
| ATOM | 207 | N | SER | C | 30 | 0.352 | 87.917 | 6.489 | 1.00 | 34.06 | N |
| ATOM | 208 | CA | SER | C | 30 | −0.719 | 88.270 | 5.564 | 1.00 | 37.45 | C |
| ATOM | 209 | C | SER | C | 30 | −0.200 | 88.707 | 4.203 | 1.00 | 39.61 | C |
| ATOM | 210 | O | SER | C | 30 | −1.018 | 88.991 | 3.319 | 1.00 | 35.46 | O |
| ATOM | 211 | CB | SER | C | 30 | −1.587 | 89.392 | 6.141 | 1.00 | 31.23 | C |
| ATOM | 212 | OG | SER | C | 30 | −0.804 | 90.566 | 6.341 | 1.00 | 38.68 | O |
| ATOM | 213 | N | SER | C | 31 | 1.115 | 88.752 | 3.998 | 1.00 | 31.95 | N |
| ATOM | 214 | CA | SER | C | 31 | 1.653 | 89.144 | 2.705 | 1.00 | 42.10 | C |
| ATOM | 215 | C | SER | C | 31 | 1.858 | 87.979 | 1.743 | 1.00 | 36.93 | C |
| ATOM | 216 | O | SER | C | 31 | 2.347 | 88.199 | 0.629 | 1.00 | 40.45 | O |
| ATOM | 217 | CB | SER | C | 31 | 2.975 | 89.887 | 2.883 | 1.00 | 38.00 | C |
| ATOM | 218 | OG | SER | C | 31 | 2.725 | 91.165 | 3.425 | 1.00 | 50.55 | O |
| ATOM | 219 | N | TYR | C | 32 | 1.476 | 86.759 | 2.103 | 1.00 | 32.77 | N |
| ATOM | 220 | CA | TYR | C | 32 | 1.671 | 85.678 | 1.145 | 1.00 | 37.31 | C |
| ATOM | 221 | C | TYR | C | 32 | 0.613 | 84.597 | 1.312 | 1.00 | 35.54 | C |
| ATOM | 222 | O | TYR | C | 32 | 0.059 | 84.403 | 2.401 | 1.00 | 33.81 | O |
| ATOM | 223 | CB | TYR | C | 32 | 3.083 | 85.087 | 1.282 | 1.00 | 33.59 | C |
| ATOM | 224 | CG | TYR | C | 32 | 3.516 | 84.779 | 2.701 | 1.00 | 29.77 | C |
| ATOM | 225 | CD1 | TYR | C | 32 | 3.130 | 83.599 | 3.315 | 1.00 | 33.82 | C |
| ATOM | 226 | CD2 | TYR | C | 32 | 4.353 | 85.643 | 3.405 | 1.00 | 38.18 | C |
| ATOM | 227 | CE1 | TYR | C | 32 | 3.550 | 83.271 | 4.603 | 1.00 | 38.72 | C |
| ATOM | 228 | CE2 | TYR | C | 32 | 4.781 | 85.340 | 4.703 | 1.00 | 39.15 | C |
| ATOM | 229 | CZ | TYR | C | 32 | 4.365 | 84.145 | 5.296 | 1.00 | 45.73 | C |
| ATOM | 230 | OH | TYR | C | 32 | 4.741 | 83.816 | 6.579 | 1.00 | 41.78 | O |
| ATOM | 231 | N | GLY | C | 33 | 0.344 | 83.893 | 0.209 | 1.00 | 34.05 | N |
| ATOM | 232 | CA | GLY | C | 33 | −0.428 | 82.670 | 0.260 | 1.00 | 32.21 | C |
| ATOM | 233 | C | GLY | C | 33 | 0.446 | 81.497 | 0.679 | 1.00 | 39.56 | C |
| ATOM | 234 | O | GLY | C | 33 | 1.665 | 81.640 | 0.823 | 1.00 | 32.33 | O |
| ATOM | 235 | N | LEU | C | 34 | −0.196 | 80.340 | 0.907 | 1.00 | 32.53 | N |
| ATOM | 236 | CA | LEU | C | 34 | 0.521 | 79.169 | 1.401 | 1.00 | 34.46 | C |
| ATOM | 237 | C | LEU | C | 34 | −0.060 | 77.886 | 0.824 | 1.00 | 30.24 | C |
| ATOM | 238 | O | LEU | C | 34 | −1.200 | 77.841 | 0.360 | 1.00 | 33.75 | O |
| ATOM | 239 | CB | LEU | C | 34 | 0.515 | 79.085 | 2.933 | 1.00 | 38.99 | C |
| ATOM | 240 | CG | LEU | C | 34 | 1.236 | 80.236 | 3.655 | 1.00 | 41.08 | C |
| ATOM | 241 | CD1 | LEU | C | 34 | 0.223 | 81.245 | 4.217 | 1.00 | 33.75 | C |
| ATOM | 242 | CD2 | LEU | C | 34 | 2.165 | 79.704 | 4.725 | 1.00 | 35.97 | C |
| ATOM | 243 | N | HIS | C | 35 | 0.768 | 76.846 | 0.863 | 1.00 | 31.72 | N |
| ATOM | 244 | CA | HIS | C | 35 | 0.503 | 75.507 | 0.371 | 1.00 | 29.96 | C |
| ATOM | 245 | C | HIS | C | 35 | 0.618 | 74.498 | 1.498 | 1.00 | 33.37 | C |
| ATOM | 246 | O | HIS | C | 35 | 1.323 | 74.717 | 2.484 | 1.00 | 34.65 | O |
| ATOM | 247 | CB | HIS | C | 35 | 1.534 | 75.064 | −0.671 | 1.00 | 31.82 | C |
| ATOM | 248 | CG | HIS | C | 35 | 1.514 | 75.835 | −1.949 | 1.00 | 38.58 | C |
| ATOM | 249 | ND1 | HIS | C | 35 | 0.781 | 75.435 | −3.047 | 1.00 | 31.99 | N |
| ATOM | 250 | CD2 | HIS | C | 35 | 2.200 | 76.940 | −2.333 | 1.00 | 34.19 | C |
| ATOM | 251 | CE1 | HIS | C | 35 | 1.008 | 76.269 | −4.046 | 1.00 | 28.49 | C |
| ATOM | 252 | NE2 | HIS | C | 35 | 1.855 | 77.197 | −3.635 | 1.00 | 33.84 | N |
| ATOM | 253 | N | TRP | C | 36 | −0.010 | 73.347 | 1.298 | 1.00 | 29.55 | N |
| ATOM | 254 | CA | TRP | C | 36 | 0.381 | 72.110 | 1.957 | 1.00 | 30.04 | C |
| ATOM | 255 | C | TRP | C | 36 | 0.870 | 71.151 | 0.887 | 1.00 | 32.99 | C |
| ATOM | 256 | O | TRP | C | 36 | 0.217 | 70.995 | −0.149 | 1.00 | 33.39 | O |
| ATOM | 257 | CB | TRP | C | 36 | −0.771 | 71.490 | 2.735 | 1.00 | 30.51 | C |

TABLE 10.3-continued

| | | | | | | | | | | |
|---|---|---|---|---|---|---|---|---|---|---|
| ATOM | 258 | CG | TRP | C | 36 | −1.084 | 72.233 | 3.977 | 1.00 | 36.65 | C |
| ATOM | 259 | CD1 | TRP | C | 36 | −2.063 | 73.191 | 4.152 | 1.00 | 36.08 | C |
| ATOM | 260 | CD2 | TRP | C | 36 | −0.447 | 72.073 | 5.246 | 1.00 | 33.16 | C |
| ATOM | 261 | NE1 | TRP | C | 36 | −2.055 | 73.637 | 5.456 | 1.00 | 34.80 | N |
| ATOM | 262 | CE2 | TRP | C | 36 | −1.073 | 72.972 | 6.146 | 1.00 | 31.89 | C |
| ATOM | 263 | CE3 | TRP | C | 36 | 0.602 | 71.272 | 5.706 | 1.00 | 33.27 | C |
| ATOM | 264 | CZ2 | TRP | C | 36 | −0.690 | 73.079 | 7.475 | 1.00 | 35.29 | C |
| ATOM | 265 | CZ3 | TRP | C | 36 | 0.976 | 71.373 | 7.022 | 1.00 | 36.31 | C |
| ATOM | 266 | CH2 | TRP | C | 36 | 0.334 | 72.276 | 7.898 | 1.00 | 37.43 | C |
| ATOM | 267 | N | VAL | C | 37 | 2.037 | 70.544 | 1.114 | 1.00 | 31.46 | N |
| ATOM | 268 | CA | VAL | C | 37 | 2.588 | 69.540 | 0.215 | 1.00 | 28.53 | C |
| ATOM | 269 | C | VAL | C | 37 | 2.937 | 68.334 | 1.066 | 1.00 | 37.43 | C |
| ATOM | 270 | O | VAL | C | 37 | 3.354 | 68.473 | 2.221 | 1.00 | 38.22 | O |
| ATOM | 271 | CB | VAL | C | 37 | 3.832 | 70.056 | −0.554 | 1.00 | 32.46 | C |
| ATOM | 272 | CG1 | VAL | C | 37 | 4.424 | 68.959 | −1.463 | 1.00 | 28.26 | C |
| ATOM | 273 | CG2 | VAL | C | 37 | 3.501 | 71.313 | −1.364 | 1.00 | 25.69 | C |
| ATOM | 274 | N | ARG | C | 38 | 2.787 | 67.142 | 0.503 | 1.00 | 30.65 | N |
| ATOM | 275 | CA | ARG | C | 38 | 3.030 | 65.960 | 1.303 | 1.00 | 35.42 | C |
| ATOM | 276 | C | ARG | C | 38 | 3.936 | 64.983 | 0.565 | 1.00 | 33.75 | C |
| ATOM | 277 | O | ARG | C | 38 | 4.133 | 65.061 | −0.657 | 1.00 | 31.48 | O |
| ATOM | 278 | CB | ARG | C | 38 | 1.721 | 65.273 | 1.714 | 1.00 | 31.04 | C |
| ATOM | 279 | CG | ARG | C | 38 | 1.037 | 64.459 | 0.654 | 1.00 | 31.84 | C |
| ATOM | 280 | CD | ARG | C | 38 | −0.318 | 63.986 | 1.190 | 1.00 | 28.76 | C |
| ATOM | 281 | NE | ARG | C | 38 | −1.059 | 63.233 | 0.184 | 1.00 | 33.40 | N |
| ATOM | 282 | CZ | ARG | C | 38 | −2.280 | 62.718 | 0.368 | 1.00 | 33.79 | C |
| ATOM | 283 | NH1 | ARG | C | 38 | −2.940 | 62.867 | 1.523 | 1.00 | 29.44 | N1+ |
| ATOM | 284 | NH2 | ARG | C | 38 | −2.845 | 62.057 | −0.617 | 1.00 | 27.56 | N |
| ATOM | 285 | N | GLN | C | 39 | 4.517 | 64.077 | 1.344 | 1.00 | 31.44 | N |
| ATOM | 286 | CA | GLN | C | 39 | 5.466 | 63.101 | 0.809 | 1.00 | 33.90 | C |
| ATOM | 287 | C | GLN | C | 39 | 5.299 | 61.833 | 1.621 | 1.00 | 30.60 | C |
| ATOM | 288 | O | GLN | C | 39 | 5.589 | 61.823 | 2.816 | 1.00 | 37.53 | O |
| ATOM | 289 | CB | GLN | C | 39 | 6.908 | 63.606 | 0.880 | 1.00 | 29.62 | C |
| ATOM | 290 | CG | GLN | C | 39 | 7.950 | 62.614 | 0.336 | 1.00 | 33.68 | C |
| ATOM | 291 | CD | GLN | C | 39 | 9.317 | 63.272 | 0.142 | 1.00 | 38.26 | C |
| ATOM | 292 | CE1 | GLN | C | 39 | 9.832 | 63.941 | 1.041 | 1.00 | 36.27 | O |
| ATOM | 293 | NE2 | GLN | C | 39 | 9.884 | 63.121 | −1.051 | 1.00 | 31.46 | N |
| ATOM | 294 | N | ALA | C | 40 | 4.806 | 60.795 | 0.980 | 1.00 | 33.74 | N |
| ATOM | 295 | CA | ALA | C | 40 | 4.687 | 59.501 | 1.621 | 1.00 | 42.24 | C |
| ATOM | 296 | C | ALA | C | 40 | 6.082 | 58.868 | 1.723 | 1.00 | 41.93 | C |
| ATOM | 297 | O | ALA | C | 40 | 6.967 | 59.180 | 0.921 | 1.00 | 39.79 | O |
| ATOM | 298 | CB | ALA | C | 40 | 3.726 | 58.625 | 0.811 | 1.00 | 21.89 | C |
| ATOM | 299 | N | PRO | C | 41 | 6.304 | 57.974 | 2.691 | 1.00 | 47.02 | N |
| ATOM | 300 | CA | PRO | C | 41 | 7.671 | 57.444 | 2.920 | 1.00 | 46.31 | C |
| ATOM | 301 | C | PRO | C | 41 | 8.252 | 56.774 | 1.681 | 1.00 | 40.48 | C |
| ATOM | 302 | O | PRO | C | 41 | 7.677 | 55.834 | 1.127 | 1.00 | 49.95 | O |
| ATOM | 303 | CB | PRO | C | 41 | 7.475 | 56.438 | 4.065 | 1.00 | 38.60 | C |
| ATOM | 304 | CG | PRO | C | 41 | 6.179 | 56.872 | 4.754 | 1.00 | 43.78 | C |
| ATOM | 305 | CD | PRO | C | 41 | 5.319 | 57.433 | 3.651 | 1.00 | 44.84 | C |
| ATOM | 306 | N | GLY | C | 42 | 9.416 | 57.254 | 1.256 | 1.00 | 49.67 | N |
| ATOM | 307 | CA | GLY | C | 42 | 10.049 | 56.738 | 0.054 | 1.00 | 47.19 | C |
| ATOM | 308 | C | GLY | C | 42 | 9.476 | 57.189 | −1.279 | 1.00 | 48.22 | C |
| ATOM | 309 | O | GLY | C | 42 | 9.825 | 56.588 | −2.300 | 1.00 | 45.62 | O |
| ATOM | 310 | N | LYS | C | 43 | 8.627 | 58.223 | −1.325 | 1.00 | 42.77 | N |
| ATOM | 311 | CA | LYS | C | 43 | 7.904 | 58.581 | −2.556 | 1.00 | 40.19 | C |
| ATOM | 312 | C | LYS | C | 43 | 8.149 | 60.040 | −2.956 | 1.00 | 36.26 | C |
| ATOM | 313 | O | LYS | C | 43 | 8.895 | 60.789 | −2.310 | 1.00 | 41.39 | O |
| ATOM | 314 | CB | LYS | C | 43 | 6.402 | 58.338 | −2.390 | 1.00 | 43.74 | C |
| ATOM | 315 | CG | LYS | C | 43 | 6.020 | 56.900 | −2.068 | 1.00 | 44.39 | C |
| ATOM | 316 | CD | LYS | C | 43 | 6.527 | 55.936 | −3.112 | 1.00 | 56.25 | C |
| ATOM | 317 | CE | LYS | C | 43 | 5.920 | 54.540 | −2.918 | 1.00 | 72.49 | C |
| ATOM | 318 | NZ | LYS | C | 43 | 6.709 | 53.467 | −3.617 | 1.00 | 73.82 | N1+ |
| ATOM | 319 | N | GLY | C | 44 | 7.498 | 60.457 | −4.036 | 1.00 | 35.63 | N |
| ATOM | 320 | CA | GLY | C | 44 | 7.709 | 61.788 | −4.551 | 1.00 | 29.55 | C |
| ATOM | 321 | C | GLY | C | 44 | 6.833 | 62.802 | −3.843 | 1.00 | 34.99 | C |
| ATOM | 322 | O | GLY | C | 44 | 6.008 | 62.475 | −2.990 | 1.00 | 36.77 | O |
| ATOM | 323 | N | LEU | C | 45 | 7.026 | 64.067 | −4.205 | 1.00 | 30.55 | N |
| ATOM | 324 | CA | LEU | C | 45 | 6.192 | 65.134 | −3.664 | 1.00 | 32.18 | C |
| ATOM | 325 | C | LEU | C | 45 | 4.783 | 65.057 | −4.257 | 1.00 | 31.76 | C |
| ATOM | 326 | O | LEU | C | 45 | 4.597 | 64.740 | −5.440 | 1.00 | 25.93 | O |
| ATOM | 327 | CB | LEU | C | 45 | 6.820 | 66.508 | −3.939 | 1.00 | 31.66 | C |
| ATOM | 328 | CG | LEU | C | 45 | 8.233 | 66.714 | −3.370 | 1.00 | 32.55 | C |
| ATOM | 329 | CD1 | LEU | C | 45 | 8.776 | 68.091 | −3.682 | 1.00 | 27.48 | C |
| ATOM | 330 | CD2 | LEU | C | 45 | 8.219 | 66.491 | −1.871 | 1.00 | 28.43 | C |
| ATOM | 331 | N | GLU | C | 45 | 3.784 | 65.298 | −3.413 | 1.00 | 27.12 | N |
| ATOM | 332 | CA | GLU | C | 46 | 2.404 | 65.402 | −3.865 | 1.00 | 32.84 | C |
| ATOM | 333 | C | GLU | C | 46 | 1.799 | 66.669 | −3.286 | 1.00 | 32.06 | C |
| ATOM | 334 | O | GLU | C | 46 | 1.754 | 66.837 | −2.062 | 1.00 | 31.76 | O |
| ATOM | 335 | CB | GLU | C | 46 | 1.579 | 64.183 | −3.451 | 1.00 | 36.78 | C |
| ATOM | 336 | CG | GLU | C | 46 | 0.226 | 64.173 | −4.126 | 1.00 | 44.38 | C |
| ATOM | 337 | CD | GLU | C | 46 | −0.758 | 63.166 | −3.539 | 1.00 | 46.89 | C |

TABLE 10.3-continued

| | | | | | | | | | | |
|---|---|---|---|---|---|---|---|---|---|---|
| ATOM | 338 | OE1 | GLU | C | 46 | 0.435 | 62.467 | −2.548 | 1.00 | 45.34 | O |
| ATOM | 339 | OE2 | GLU | C | 46 | −1.871 | 63.088 | −4.092 | 1.00 | 50.23 | O1− |
| ATOM | 340 | N | TRP | C | 47 | 1.330 | 67.548 | −4.162 | 1.00 | 27.92 | N |
| ATOM | 341 | CA | TRP | C | 47 | 0.676 | 68.764 | −3.715 | 1.00 | 31.90 | C |
| ATOM | 342 | C | TRP | C | 47 | −0.664 | 68.439 | −3.079 | 1.00 | 31.01 | C |
| ATOM | 343 | O | TRP | C | 47 | −1.386 | 67.555 | −3.546 | 1.00 | 32.31 | O |
| ATOM | 344 | CB | TRP | C | 47 | 0.485 | 69.713 | −4.900 | 1.00 | 35.33 | C |
| ATOM | 345 | CG | TRP | C | 47 | −0.297 | 70.972 | −4.630 | 1.00 | 30.11 | C |
| ATOM | 346 | CD1 | TRP | C | 47 | 0.104 | 72.068 | −3.910 | 1.00 | 29.39 | C |
| ATOM | 347 | CD2 | TRP | C | 47 | −1.616 | 71.270 | −5.118 | 1.00 | 29.40 | C |
| ATOM | 348 | NE1 | TRP | C | 47 | −0.886 | 73.032 | −3.925 | 1.00 | 32.24 | N |
| ATOM | 349 | CE2 | TRP | C | 47 | −1.952 | 72.563 | −4.660 | 1.00 | 34.57 | C |
| ATOM | 350 | CE3 | TRP | C | 47 | −2.534 | 70.575 | −5.913 | 1.00 | 30.62 | C |
| ATOM | 351 | CZ2 | TRP | C | 47 | −3.190 | 73.165 | −4.958 | 1.00 | 29.29 | C |
| ATOM | 352 | CZ3 | TRP | C | 47 | −3.764 | 71.177 | −6.215 | 1.00 | 31.59 | C |
| ATOM | 353 | CH2 | TRP | C | 47 | −4.075 | 72.459 | −5.736 | 1.00 | 32.18 | C |
| ATOM | 354 | N | VAL | C | 48 | −1.010 | 69.189 | −2.031 | 1.00 | 31.17 | N |
| ATOM | 355 | CA | VAL | C | 48 | −2.268 | 69.019 | −1.303 | 1.00 | 28.29 | C |
| ATOM | 356 | C | VAL | C | 48 | −3.239 | 70.192 | −1.553 | 1.00 | 34.03 | C |
| ATOM | 357 | O | VAL | C | 48 | −4.371 | 69.989 | −2.002 | 1.00 | 29.40 | O |
| ATOM | 358 | CB | VAL | C | 48 | −2.007 | 68.824 | 0.206 | 1.00 | 29.92 | C |
| ATOM | 359 | CG1 | VAL | C | 48 | −3.321 | 68.671 | 0.944 | 1.00 | 32.67 | C |
| ATOM | 360 | CG2 | VAL | C | 48 | −1.117 | 67.606 | 0.433 | 1.00 | 28.26 | C |
| ATOM | 361 | N | ALA | C | 49 | −2.825 | 71.421 | −1.237 | 1.00 | 30.79 | N |
| ATOM | 362 | CA | ALA | C | 49 | −3.747 | 72.546 | −1.373 | 1.00 | 31.82 | C |
| ATOM | 363 | C | ALA | C | 49 | −2.974 | 73.854 | −1.325 | 1.00 | 32.29 | C |
| ATOM | 364 | O | ALA | C | 49 | −1.845 | 73.908 | −0.823 | 1.00 | 30.87 | O |
| ATOM | 365 | CB | ALA | C | 49 | −4.821 | 72.517 | −0.277 | 1.00 | 30.36 | C |
| ATOM | 366 | N | AVAL | C | 50 | −3.605 | 74.914 | −1.835 | 0.50 | 31.84 | N |
| ATOM | 367 | CA | AVAL | C | 50 | −3.060 | 76.269 | −1.763 | 0.50 | 30.56 | C |
| ATOM | 368 | C | AVAL | C | 50 | −4.179 | 77.222 | −1.373 | 0.50 | 31.68 | C |
| ATOM | 369 | O | AVAL | C | 50 | −5.333 | 77.047 | −1.784 | 0.50 | 29.47 | O |
| ATOM | 370 | CB | AVAL | C | 50 | −2.408 | 76.711 | −3.093 | 0.50 | 30.12 | C |
| ATOM | 371 | CG1 | AVAL | C | 50 | −3.459 | 76.855 | −4.204 | 0.50 | 28.96 | C |
| ATOM | 372 | CG2 | AVAL | C | 50 | −1.624 | 77.987 | −2.912 | 0.50 | 24.87 | C |
| ATOM | 373 | N | BVAL | C | 50 | −3.584 | 74.900 | −1.900 | 0.50 | 32.14 | N |
| ATOM | 374 | CA | BVAL | C | 50 | −3.117 | 76.279 | −1.776 | 0.50 | 30.77 | C |
| ATOM | 375 | C | BVAL | C | 50 | −4.231 | 77.106 | −1.160 | 0.50 | 31.70 | C |
| ATOM | 376 | O | BVAL | C | 50 | −5.415 | 76.765 | −1.240 | 0.50 | 30.32 | O |
| ATOM | 377 | CB | BVAL | C | 50 | −2.698 | 76.932 | −3.115 | 0.50 | 30.01 | C |
| ATOM | 378 | CG1 | BVAL | C | 50 | −2.103 | 75.960 | −4.000 | 0.50 | 36.11 | C |
| ATOM | 379 | CG2 | BVAL | C | 50 | −3.896 | 77.491 | −3.831 | 0.50 | 31.66 | C |
| ATOM | 380 | N | ILE | C | 51 | −3.834 | 78.232 | −0.574 | 1.00 | 31.49 | N |
| ATOM | 381 | CA | ILE | C | 51 | −4.770 | 79.260 | −0.151 | 1.00 | 28.89 | C |
| ATOM | 382 | C | ILE | C | 51 | −4.143 | 80.593 | −0.519 | 1.00 | 37.27 | C |
| ATOM | 383 | O | ILE | C | 51 | −2.913 | 80.736 | −0.534 | 1.00 | 32.74 | O |
| ATOM | 384 | CB | ILE | C | 51 | −5.085 | 79.203 | 1.356 | 1.00 | 33.18 | C |
| ATOM | 385 | CG1 | ILE | C | 51 | −6.238 | 80.154 | 1.691 | 1.00 | 31.97 | C |
| ATOM | 386 | CG2 | ILE | C | 51 | −3.837 | 79.550 | 2.210 | 1.00 | 26.57 | C |
| ATOM | 387 | CD1 | ILE | C | 51 | −6.766 | 79.971 | 3.093 | 1.00 | 31.63 | C |
| ATOM | 388 | N | TRP | C | 52 | −5.000 | 81.561 | −0.838 | 1.00 | 30.70 | N |
| ATOM | 389 | CA | TRP | C | 52 | −4.563 | 82.882 | −1.241 | 1.00 | 25.99 | C |
| ATOM | 390 | C | TRP | C | 52 | −4.040 | 83.652 | −0.036 | 1.00 | 29.12 | C |
| ATOM | 391 | O | TRP | C | 52 | −4.302 | 83.303 | 1.117 | 1.00 | 36.14 | O |
| ATOM | 392 | CB | TRP | C | 52 | −5.722 | 83.638 | −1.898 | 1.00 | 27.78 | C |
| ATOM | 393 | CG | TRP | C | 52 | −5.405 | 84.135 | −3.270 | 1.00 | 33.59 | C |
| ATOM | 394 | CD1 | TRP | C | 52 | −5.333 | 85.445 | −3.676 | 1.00 | 32.68 | C |
| ATOM | 395 | CD2 | TRP | C | 52 | −5.102 | 83.340 | −4.426 | 1.00 | 30.76 | C |
| ATOM | 396 | NE1 | TRP | C | 52 | −5.004 | 85.510 | −5.010 | 1.00 | 32.81 | N |
| ATOM | 397 | CE2 | TRP | C | 52 | −4.853 | 84.235 | −5.495 | 1.00 | 33.10 | C |
| ATOM | 398 | CE3 | TRP | C | 52 | −4.989 | 81.962 | −4.657 | 1.00 | 33.14 | C |
| ATOM | 399 | CZ2 | TRP | C | 52 | −4.516 | 83.792 | −6.779 | 1.00 | 32.67 | C |
| ATOM | 400 | CZ3 | TRP | C | 52 | −4.670 | 81.524 | −5.941 | 1.00 | 33.56 | C |
| ATOM | 401 | CH2 | TRP | C | 52 | −4.435 | 82.436 | −6.983 | 1.00 | 32.43 | C |
| ATOM | 402 | N | TYR | C | 53 | −3.304 | 84.726 | −0.315 | 1.00 | 29.93 | N |
| ATOM | 403 | CA | TYR | C | 53 | −2.784 | 85.558 | 0.768 | 1.00 | 38.06 | C |
| ATOM | 404 | C | TYR | C | 53 | −3.898 | 86.148 | 1.630 | 1.00 | 40.02 | C |
| ATOM | 405 | O | TYR | C | 53 | −3.690 | 86.389 | 2.829 | 1.00 | 43.14 | O |
| ATOM | 406 | CB | TYR | C | 53 | −1.915 | 86.685 | 0.203 | 1.00 | 36.99 | C |
| ATOM | 407 | CG | TYR | C | 53 | −2.522 | 87.380 | −0.992 | 1.00 | 42.26 | C |
| ATOM | 408 | CD1 | TYR | C | 53 | −3.449 | 88.409 | −0.831 | 1.00 | 39.71 | C |
| ATOM | 409 | CD2 | TYR | C | 53 | −2.172 | 86.999 | −2.290 | 1.00 | 38.52 | C |
| ATOM | 410 | CE1 | TYR | C | 53 | −4.015 | 89.042 | −1.927 | 1.00 | 38.70 | C |
| ATOM | 411 | CE2 | TYR | C | 53 | −2.720 | 87.631 | −3.397 | 1.00 | 43.88 | C |
| ATOM | 412 | CZ | TYR | C | 53 | −3.647 | 88.654 | −3.211 | 1.00 | 46.93 | C |
| ATOM | 413 | OH | TYR | C | 53 | −4.205 | 89.264 | −4.318 | 1.00 | 49.29 | O |
| ATOM | 414 | N | ASP | C | 54 | −5.082 | 86.385 | 1.058 | 1.00 | 35.51 | N |
| ATOM | 415 | CA | ASP | C | 54 | −6.200 | 86.943 | 1.811 | 1.00 | 38.58 | C |
| ATOM | 416 | C | ASP | C | 54 | −7.258 | 85.899 | 2.166 | 1.00 | 37.13 | C |
| ATOM | 417 | O | ASP | C | 54 | −8.397 | 86.262 | 2.468 | 1.00 | 42.80 | O |

TABLE 10.3-continued

| | | | | | | | | | | |
|---|---|---|---|---|---|---|---|---|---|---|
| ATOM | 418 | CB | ASP | C | 54 | −6.839 | 88.093 | 1.036 | 1.00 | 35.61 | C |
| ATOM | 419 | CG | ASP | C | 54 | −7.319 | 87.664 | −0.336 | 1.00 | 39.47 | C |
| ATOM | 420 | OD1 | ASP | C | 54 | −7.355 | 86.435 | −0.617 | 1.00 | 40.37 | O |
| ATOM | 421 | OD2 | ASP | C | 54 | −7.678 | 88.551 | −1.129 | 1.00 | 40.04 | O1− |
| ATOM | 422 | N | GLY | C | 55 | −6.921 | 84.614 | 2.110 | 1.00 | 38.50 | N |
| ATOM | 423 | CA | GLY | C | 55 | −7.878 | 83.579 | 2.451 | 1.00 | 30.61 | C |
| ATOM | 424 | C | GLY | C | 55 | −9.007 | 83.374 | 1.465 | 1.00 | 39.39 | C |
| ATOM | 425 | O | GLY | C | 55 | −9.946 | 82.625 | 1.773 | 1.00 | 37.86 | O |
| ATOM | 426 | N | SER | C | 56 | −8.944 | 83.988 | 0.276 | 1.00 | 37.78 | N |
| ATOM | 427 | CA | SER | C | 56 | −10.036 | 83.866 | −0.689 | 1.00 | 30.88 | C |
| ATOM | 428 | C | SER | C | 56 | −9.948 | 82.566 | −1.485 | 1.00 | 29.51 | C |
| ATOM | 429 | O | SER | C | 56 | −10.561 | 81.560 | −1.107 | 1.00 | 35.66 | O |
| ATOM | 430 | CB | SER | C | 56 | −10.050 | 85.075 | −1.634 | 1.00 | 31.22 | C |
| ATOM | 431 | OG | SER | C | 56 | −8.824 | 85.214 | −2.331 | 1.00 | 32.22 | O |
| ATOM | 432 | N | ASN | C | 57 | −9.192 | 82.555 | −2.578 | 1.00 | 28.37 | N |
| ATOM | 433 | CA | ASN | C | 57 | −9.143 | 81.363 | −3.423 | 1.00 | 35.02 | C |
| ATOM | 434 | C | ASN | C | 57 | −8.480 | 80.196 | −2.691 | 1.00 | 32.70 | C |
| ATOM | 435 | O | ASN | C | 57 | −7.544 | 80.388 | −1.909 | 1.00 | 29.84 | O |
| ATOM | 436 | CB | ASN | C | 57 | −8.407 | 81.655 | −4.733 | 1.00 | 29.59 | C |
| ATOM | 437 | CG | ASN | C | 57 | −9.224 | 82.532 | −5.682 | 1.00 | 35.30 | C |
| ATOM | 438 | OD1 | ASN | C | 57 | −10.082 | 83.295 | −5.248 | 1.00 | 31.05 | O |
| ATOM | 439 | ND2 | ASN | C | 57 | −8.982 | 82.390 | −6.988 | 1.00 | 33.63 | N |
| ATOM | 440 | N | LYS | C | 58 | −9.018 | 78.992 | −2.915 | 1.00 | 28.81 | N |
| ATOM | 441 | CA | LYS | C | 58 | −8.510 | 77.731 | −2.374 | 1.00 | 33.21 | C |
| ATOM | 442 | C | LYS | C | 58 | −8.561 | 76.699 | −3.485 | 1.00 | 31.65 | C |
| ATOM | 443 | O | LYS | C | 58 | −9.609 | 76.539 | −4.111 | 1.00 | 31.96 | O |
| ATOM | 444 | CB | LYS | C | 58 | −9.356 | 77.210 | −1.201 | 1.00 | 29.22 | C |
| ATOM | 445 | CG | LYS | C | 58 | −9.438 | 78.136 | −0.030 | 1.00 | 39.00 | C |
| ATOM | 446 | CD | LYS | C | 58 | −10.443 | 77.655 | 1.024 | 1.00 | 28.02 | C |
| ATOM | 447 | CE | LYS | C | 58 | −10.456 | 78.663 | 2.179 | 1.00 | 29.93 | C |
| ATOM | 448 | NZ | LYS | C | 58 | −11.039 | 78.171 | 3.465 | 1.00 | 34.24 | N1+ |
| ATOM | 449 | N | TYR | C | 59 | −7.465 | 75.969 | −3.693 | 1.00 | 33.17 | N |
| ATOM | 450 | CA | TYR | C | 59 | −7.402 | 74.893 | −4.680 | 1.00 | 31.69 | C |
| ATOM | 451 | C | TYR | C | 59 | −6.931 | 73.623 | −3.988 | 1.00 | 32.39 | C |
| ATOM | 452 | O | TYR | C | 59 | −6.165 | 73.681 | −3.025 | 1.00 | 32.73 | O |
| ATOM | 453 | CB | TYR | C | 59 | −6.450 | 75.203 | −5.856 | 1.00 | 33.11 | C |
| ATOM | 454 | CG | TYR | C | 59 | −6.646 | 76.536 | −6.574 | 1.00 | 41.69 | C |
| ATOM | 455 | CD1 | TYR | C | 59 | −6.539 | 77.741 | −5.914 | 1.00 | 48.94 | C |
| ATOM | 456 | CD2 | TYR | C | 59 | −6.892 | 76.574 | −7.925 | 1.00 | 52.57 | C |
| ATOM | 457 | CE1 | TYR | C | 59 | −6.714 | 78.936 | −6.579 | 1.00 | 54.05 | C |
| ATOM | 458 | CE2 | TYR | C | 59 | −7.055 | 77.762 | −8.590 | 1.00 | 51.75 | C |
| ATOM | 459 | CZ | TYR | C | 59 | −6.973 | 78.936 | −7.916 | 1.00 | 42.38 | C |
| ATOM | 460 | OH | TYR | C | 59 | −7.155 | 80.120 | −8.583 | 1.00 | 40.63 | O |
| ATOM | 461 | N | TYR | C | 60 | −7.401 | 72.470 | −4.475 | 1.00 | 28.26 | N |
| ATOM | 462 | CA | TYR | C | 60 | −7.080 | 71.205 | −3.835 | 1.00 | 26.89 | C |
| ATOM | 463 | C | TYR | C | 60 | −6.720 | 70.156 | −4.864 | 1.00 | 32.21 | C |
| ATOM | 464 | O | TYR | C | 60 | −7.276 | 70.128 | −5.967 | 1.00 | 30.27 | O |
| ATOM | 465 | CB | TYR | C | 60 | −8.232 | 70.657 | −3.004 | 1.00 | 28.01 | C |
| ATOM | 466 | CCG | TYR | C | 60 | −8.665 | 71.517 | −1.854 | 1.00 | 34.24 | C |
| ATOM | 467 | CD1 | TYR | C | 60 | −9.607 | 72.540 | −2.036 | 1.00 | 31.75 | C |
| ATOM | 468 | CD2 | TYR | C | 60 | −8.169 | 71.297 | −0.570 | 1.00 | 31.69 | C |
| ATOM | 469 | CE1 | TYR | C | 60 | −10.020 | 73.341 | −0.963 | 1.00 | 28.22 | C |
| ATOM | 470 | CE2 | TYR | C | 60 | −8.595 | 72.093 | 0.512 | 1.00 | 30.87 | C |
| ATOM | 471 | CZ | TYR | C | 60 | −9.516 | 73.111 | 0.301 | 1.00 | 28.55 | C |
| ATOM | 472 | OH | TYR | C | 60 | −9.924 | 73.903 | 1.354 | 1.00 | 30.94 | O |
| ATOM | 473 | N | TYR | C | 61 | −5.807 | 69.267 | −4.468 | 1.00 | 27.28 | N |
| ATOM | 474 | CA | ALA | C | 61 | −5.533 | 68.075 | −5.252 | 1.00 | 28.59 | C |
| ATOM | 475 | C | ALA | C | 61 | −6.745 | 67.149 | −5.238 | 1.00 | 34.61 | C |
| ATOM | 476 | O | ALA | C | 61 | −7.493 | 67.808 | −4.260 | 1.00 | 31.50 | O |
| ATOM | 477 | CB | ALA | C | 61 | −4.315 | 67.342 | −4.706 | 1.00 | 23.81 | C |
| ATOM | 478 | N | ALA | C | 62 | −6.920 | 66.423 | −6.341 | 1.00 | 38.58 | N |
| ATOM | 479 | CA | ALA | C | 62 | −8.069 | 65.537 | −6.487 | 1.00 | 40.90 | C |
| ATOM | 480 | C | ASP | C | 62 | −8.129 | 64.490 | −5.382 | 1.00 | 41.29 | C |
| ATOM | 481 | O | ASP | C | 62 | −9.210 | 64.175 | −4.884 | 1.00 | 43.64 | O |
| ATOM | 482 | CB | ASP | C | 62 | −8.027 | 64.862 | −7.858 | 1.00 | 41.48 | C |
| ATOM | 483 | CG | ASP | C | 62 | −8.775 | 65.657 | −8.908 | 1.00 | 52.54 | C |
| ATOM | 484 | OD1 | ASP | C | 62 | −9.074 | 66.853 | −8.639 | 1.00 | 50.91 | O |
| ATOM | 485 | OD2 | ASP | C | 62 | −9.074 | 65.083 | −9.984 | 1.00 | 54.03 | O1− |
| ATOM | 486 | N | SER | C | 63 | −6.978 | 63.960 | −4.967 | 1.00 | 38.35 | N |
| ATOM | 487 | CA | SER | C | 63 | −6.931 | 62.918 | −3.948 | 1.00 | 40.77 | C |
| ATOM | 488 | C | SER | C | 63 | −7.429 | 63.398 | −2.589 | 1.00 | 41.73 | C |
| ATOM | 489 | O | SER | C | 63 | −7.557 | 62.586 | −1.666 | 1.00 | 37.97 | O |
| ATOM | 490 | CB | SER | C | 63 | −5.493 | 62.386 | −3.804 | 1.00 | 39.37 | C |
| ATOM | 491 | OG | SER | C | 63 | −4.582 | 63.445 | −3.547 | 1.00 | 39.82 | O |
| ATOM | 492 | N | VAL | C | 64 | −7.730 | 64.681 | −2.445 | 1.00 | 37.08 | N |
| ATOM | 493 | CA | VAL | C | 64 | −7.937 | 65.265 | −1.130 | 1.00 | 34.49 | C |
| ATOM | 494 | C | VAL | C | 64 | −9.234 | 66.090 | −1.105 | 1.00 | 35.91 | C |
| ATOM | 495 | O | VAL | C | 64 | −9.766 | 66.419 | −0.033 | 1.00 | 35.61 | O |
| ATOM | 496 | CB | VAL | C | 64 | −6.652 | 66.052 | −0.800 | 1.00 | 37.75 | C |
| ATOM | 497 | CG1 | VAL | C | 64 | −6.895 | 67.438 | −0.272 | 1.00 | 34.28 | C |

TABLE 10.3-continued

| ATOM | 498 | CG2 | VAL | C | 64 | −5.734 | 65.214 | 0.078 | 1.00 | 37.52 | C |
|---|---|---|---|---|---|---|---|---|---|---|---|
| ATOM | 499 | N | LYS | C | 65 | −9.774 | 66.389 | −2.294 | 1.00 | 33.05 | N |
| ATOM | 500 | CA | LYS | C | 65 | −11.007 | 67.169 | −2.424 | 1.00 | 35.12 | C |
| ATOM | 501 | C | LYS | C | 65 | −12.143 | 66.581 | −1.599 | 1.00 | 41.45 | C |
| ATOM | 502 | O | LYS | C | 65 | −12.378 | 65.368 | −1.600 | 1.00 | 37.85 | O |
| ATOM | 503 | CB | LYS | C | 65 | −11.463 | 67.244 | −3.888 | 1.00 | 35.87 | C |
| ATOM | 504 | CG | LYS | C | 65 | −10.771 | 68.290 | −4.714 | 1.00 | 35.54 | C |
| ATOM | 505 | CD | LYS | C | 65 | −11.454 | 68.428 | −6.057 | 1.00 | 42.42 | C |
| ATOM | 506 | CE | LYS | C | 65 | −10.975 | 69.680 | −6.795 | 1.00 | 38.45 | C |
| ATOM | 507 | NZ | LYS | C | 65 | −9.588 | 69.479 | −7.281 | 1.00 | 40.01 | N1+ |
| ATOM | 508 | N | GLY | C | 66 | −12.876 | 67.460 | −0.925 | 1.00 | 38.42 | N |
| ATOM | 509 | CA | GLY | C | 66 | −14.008 | 67.048 | −0.131 | 1.00 | 34.79 | C |
| ATOM | 510 | C | GLY | C | 66 | −13.656 | 66.580 | 1.252 | 1.00 | 43.32 | C |
| ATOM | 511 | O | GLY | C | 66 | −14.504 | 66.628 | 2.139 | 1.00 | 44.56 | O |
| ATOM | 512 | N | ARG | C | 67 | −12.416 | 66.177 | 1.488 | 1.00 | 42.85 | N |
| ATOM | 513 | CA | ARG | C | 67 | −12.040 | 65.681 | 2.798 | 1.00 | 33.59 | C |
| ATOM | 514 | C | ARG | C | 67 | −11.185 | 66.653 | 3.587 | 1.00 | 38.28 | C |
| ATOM | 515 | O | ARG | C | 67 | −11.308 | 66.698 | 4.812 | 1.00 | 35.39 | O |
| ATOM | 516 | CB | ARG | C | 67 | −11.317 | 64.333 | 2.663 | 1.00 | 38.43 | C |
| ATOM | 517 | CG | ARG | C | 67 | −12.241 | 63.220 | 2.171 | 1.00 | 33.48 | C |
| ATOM | 518 | CD | ARG | C | 67 | −11.540 | 61.860 | 2.172 | 1.00 | 39.76 | C |
| ATOM | 519 | NE | ARG | C | 67 | −10.284 | 61.891 | 1.423 | 1.00 | 38.65 | N |
| ATOM | 520 | CZ | ARG | C | 67 | −9.081 | 61.717 | 1.967 | 1.00 | 39.28 | C |
| ATOM | 521 | NH1 | ARG | C | 67 | −8.981 | 61.482 | 3.259 | 1.00 | 31.68 | N1+ |
| ATOM | 522 | NH2 | ARG | C | 67 | −7.977 | 61.785 | 1.224 | 1.00 | 36.70 | N |
| ATOM | 523 | N | PHE | C | 68 | −10.304 | 67.413 | 2.922 | 1.00 | 37.96 | N |
| ATOM | 524 | CA | PHE | C | 68 | −9.395 | 68.344 | 3.576 | 1.00 | 30.65 | C |
| ATOM | 525 | C | PHE | C | 68 | −9.874 | 69.766 | 3.351 | 1.00 | 34.00 | C |
| ATOM | 526 | O | PHE | C | 68 | −10.488 | 70.071 | 2.325 | 1.00 | 36.05 | O |
| ATOM | 527 | CB | PHE | C | 68 | −7.959 | 68.224 | 3.047 | 1.00 | 37.02 | C |
| ATOM | 528 | CG | PHE | C | 68 | −7.264 | 66.900 | 3.360 | 1.00 | 38.71 | C |
| ATOM | 529 | CD1 | PHE | C | 68 | −7.954 | 65.814 | 3.888 | 1.00 | 35.33 | C |
| ATOM | 530 | CD2 | PHE | C | 68 | −5.894 | 66.767 | 3.140 | 1.00 | 37.81 | C |
| ATOM | 531 | CE1 | PHE | C | 68 | −7.299 | 64.615 | 4.164 | 1.00 | 36.61 | C |
| ATOM | 532 | CE2 | PHE | C | 68 | −5.218 | 65.569 | 3.425 | 1.00 | 33.40 | C |
| ATOM | 533 | CZ | THR | C | 69 | −5.919 | 64.498 | 3.934 | 1.00 | 40.51 | C |
| ATOM | 534 | N | THR | C | 69 | −9.582 | 70.646 | 4.307 | 1.00 | 35.34 | N |
| ATOM | 535 | CA | THR | C | 69 | −9.924 | 72.055 | 4.163 | 1.00 | 29.08 | C |
| ATOM | 536 | C | THR | C | 69 | −8.743 | 72.900 | 4.621 | 1.00 | 31.52 | C |
| ATOM | 537 | O | THR | C | 69 | −8.229 | 72.710 | 5.725 | 1.00 | 33.87 | O |
| ATOM | 538 | CB | THR | C | 69 | −11.198 | 72.407 | 4.954 | 1.00 | 32.76 | C |
| ATOM | 539 | OG1 | THR | C | 69 | −12.294 | 71.663 | 4.427 | 1.00 | 36.96 | O |
| ATOM | 540 | CG2 | THR | C | 69 | −11.545 | 73.923 | 4.828 | 1.00 | 25.39 | C |
| ATOM | 541 | N | ILE | C | 70 | −8.309 | 73.827 | 3.778 | 1.00 | 33.09 | N |
| ATOM | 542 | CA | ILE | C | 70 | −7.201 | 74.720 | 4.113 | 1.00 | 29.2 | C |
| ATOM | 543 | C | ILE | C | 70 | −7.786 | 76.038 | 4.602 | 1.00 | 32.22 | C |
| ATOM | 544 | O | ILE | C | 70 | −8.810 | 76.503 | 4.093 | 1.00 | 33.11 | O |
| ATOM | 545 | CB | ILE | C | 70 | −6.265 | 74.911 | 2.899 | 1.00 | 35.27 | C |
| ATOM | 546 | CG1 | ILE | C | 70 | −4.942 | 75.579 | 3.288 | 1.00 | 31.47 | C |
| ATOM | 547 | CG2 | ILE | C | 70 | −6.939 | 75.726 | 1.800 | 1.00 | 23.76 | C |
| ATOM | 548 | CD1 | ILE | C | 70 | −3.965 | 75.590 | 2.138 | 1.00 | 31.12 | C |
| ATOM | 549 | N | SER | C | 71 | −7.174 | 76.618 | 5.627 | 1.00 | 35.69 | N |
| ATOM | 550 | CA | SER | C | 71 | −7.670 | 77.883 | 6.153 | 1.00 | 38.73 | C |
| ATOM | 551 | C | SER | C | 71 | −6.513 | 78.588 | 6.845 | 1.00 | 37.39 | C |
| ATOM | 552 | O | SER | C | 71 | −5.444 | 78.009 | 7.046 | 1.00 | 41.40 | O |
| ATOM | 553 | CB | SER | C | 71 | −8.849 | 77.655 | 7.100 | 1.00 | 37.80 | C |
| ATOM | 554 | OG | SER | C | 71 | −8.444 | 76.880 | 8.217 | 1.00 | 38.72 | O |
| ATOM | 555 | N | ARG | C | 72 | −6.726 | 79.852 | 7.204 | 1.00 | 35.68 | N |
| ATOM | 556 | CA | ARG | C | 72 | −5.674 | 80.600 | 7.876 | 1.00 | 36.89 | C |
| ATOM | 557 | C | ARG | C | 72 | −6.274 | 81.545 | 8.908 | 1.00 | 40.29 | C |
| ATOM | 558 | O | ARG | C | 72 | −7.421 | 81.973 | 8.791 | 1.00 | 38.24 | O |
| ATOM | 559 | CB | ARG | C | 72 | −4.825 | 81.385 | 6.864 | 1.00 | 35.87 | C |
| ATOM | 560 | CG | ARG | C | 72 | −5.636 | 82.390 | 6.057 | 1.00 | 34.72 | C |
| ATOM | 561 | CD | ARG | C | 72 | −4.828 | 82.983 | 4.903 | 1.00 | 30.54 | C |
| ATOM | 562 | NE | ARG | C | 72 | −3.674 | 83.722 | 5.397 | 1.00 | 39.63 | N |
| ATOM | 563 | CZ | ARG | C | 72 | −2.575 | 83.951 | 4.694 | 1.00 | 41.45 | C |
| ATOM | 564 | NH1 | ARG | C | 72 | −2.475 | 83.499 | 3.449 | 1.00 | 37.50 | N1+ |
| ATOM | 565 | NH2 | ARG | C | 72 | −1.579 | 84.643 | 5.240 | 1.00 | 38.82 | N |
| ATOM | 566 | N | ASP | C | 73 | −5.478 | 81.878 | 9.920 | 1.00 | 38.55 | N |
| ATOM | 567 | CA | ASP | C | 73 | −5.852 | 82.875 | 10.919 | 1.00 | 40.45 | C |
| ATOM | 568 | C | ASP | C | 73 | −4.704 | 83.871 | 11.015 | 1.00 | 44.31 | C |
| ATOM | 569 | O | ASP | C | 73 | −3.699 | 83.601 | 11.676 | 1.00 | 47.19 | O |
| ATOM | 570 | CB | ASP | C | 73 | −6.142 | 82.239 | 12.277 | 1.00 | 45.34 | C |
| ATOM | 571 | CG | ASP | C | 73 | −6.685 | 83.247 | 13.303 | 1.00 | 48.06 | C |
| ATOM | 572 | OD1 | ASP | C | 73 | −6.492 | 84.479 | 13.138 | 1.00 | 54.90 | O |
| ATOM | 573 | OD2 | ASP | C | 73 | −7.277 | 82.797 | 14.305 | 1.00 | 53.87 | O1− |
| ATOM | 574 | N | ASN | C | 74 | −4.865 | 85.028 | 10.374 | 1.00 | 39.84 | N |
| ATOM | 575 | CA | ASN | C | 74 | −3.778 | 85.991 | 10.341 | 1.00 | 43.99 | C |
| ATOM | 576 | C | ASN | C | 74 | −3.450 | 86.497 | 11.739 | 1.00 | 48.38 | C |
| ATOM | 577 | O | ASN | C | 74 | −2.282 | 86.767 | 12.040 | 1.00 | 55.63 | O |

TABLE 10.3-continued

| ATOM | 578 | CB | ASN | C | 74 | −4.126 | 87.136 | 9.385 | 1.00 | 39.05 | C |
|---|---|---|---|---|---|---|---|---|---|---|---|
| ATOM | 579 | CG | ASN | C | 74 | −3.974 | 86.735 | 7.922 | 1.00 | 46.52 | C |
| ATOM | 580 | OD1 | ASN | C | 74 | −3.620 | 85.591 | 7.606 | 1.00 | 45.49 | O |
| ATOM | 581 | ND2 | ASN | C | 74 | −4.238 | 87.668 | 7.024 | 1.00 | 41.67 | N |
| ATOM | 582 | N | SER | C | 75 | −4.444 | 86.570 | 12.626 | 1.00 | 52.35 | N |
| ATOM | 583 | CA | SER | C | 75 | −4.172 | 87.063 | 13.973 | 1.00 | 49.93 | C |
| ATOM | 584 | C | SER | C | 75 | −3.251 | 86.138 | 14.759 | 1.00 | 51.44 | C |
| ATOM | 585 | O | SER | C | 75 | −2.606 | 86.596 | 15.705 | 1.00 | 53.63 | O |
| ATOM | 586 | CB | SER | C | 75 | −5.480 | 87.277 | 14.735 | 1.00 | 45.73 | C |
| ATOM | 587 | OG | SER | C | 75 | −6.025 | 86.059 | 15.205 | 1.00 | 53.39 | O |
| ATOM | 588 | N | LYS | C | 76 | −3.158 | 84.860 | 14.387 | 1.00 | 49.51 | N |
| ATOM | 589 | CA | LYS | C | 76 | −2.235 | 83.925 | 15.018 | 1.00 | 43.14 | C |
| ATOM | 590 | C | LYS | C | 76 | −1.069 | 83.563 | 14.114 | 1.00 | 50.55 | C |
| ATOM | 591 | O | LYS | C | 76 | −0.325 | 82.632 | 14.440 | 1.00 | 45.43 | O |
| ATOM | 592 | CB | LYS | C | 76 | −2.951 | 82.633 | 15.422 | 1.00 | 45.66 | C |
| ATOM | 593 | CG | LYS | C | 76 | −4.185 | 82.802 | 16.282 | 1.00 | 49.74 | C |
| ATOM | 594 | CD | LYS | C | 76 | −4.789 | 81.447 | 16.612 | 1.00 | 50.31 | C |
| ATOM | 595 | CE | LYS | C | 76 | −6.147 | 81.588 | 17.303 | 1.00 | 56.50 | C |
| ATOM | 596 | NZ | LYS | C | 76 | −6.769 | 80.256 | 17.607 | 1.00 | 68.70 | N1+ |
| ATOM | 597 | N | ASN | C | 77 | −0.896 | 84.275 | 12.992 | 1.00 | 47.54 | N |
| ATOM | 598 | CA | ASN | C | 77 | 0.093 | 83.953 | 11.963 | 1.00 | 44.06 | C |
| ATOM | 599 | C | ASN | C | 77 | 0.174 | 82.458 | 11.667 | 1.00 | 45.22 | C |
| ATOM | 600 | O | ASN | C | 77 | 1.278 | 81.913 | 11.537 | 1.00 | 43.31 | O |
| ATOM | 601 | CB | ASN | C | 77 | 1.470 | 84.476 | 12.358 | 1.00 | 41.59 | C |
| ATOM | 602 | CG | ASN | C | 77 | 1.530 | 85.984 | 12.365 | 1.00 | 44.41 | C |
| ATOM | 603 | OD1 | ASN | C | 77 | 0.827 | 86.646 | 11.609 | 1.00 | 48.47 | O |
| ATOM | 604 | ND2 | ASN | C | 77 | 2.354 | 86.535 | 13.232 | 1.00 | 44.19 | N |
| ATOM | 605 | N | THR | C | 78 | −0.981 | 81.789 | 11.547 | 1.00 | 36.70 | N |
| ATOM | 606 | CA | THR | C | 78 | −1.021 | 80.336 | 11.472 | 1.00 | 40.83 | C |
| ATOM | 607 | C | THR | C | 78 | −1.861 | 79.905 | 10.280 | 1.00 | 44.26 | C |
| ATOM | 608 | O | THR | C | 78 | −2.909 | 80.500 | 10.003 | 1.00 | 37.17 | O |
| ATOM | 609 | CB | THR | C | 78 | −1.599 | 79.724 | 12.774 | 1.00 | 40.36 | C |
| ATOM | 610 | OG1 | THR | C | 78 | −0.819 | 80.156 | 13.888 | 1.00 | 45.18 | O |
| ATOM | 611 | CG2 | THR | C | 78 | −1.572 | 78.205 | 12.739 | 1.00 | 38.53 | C |
| ATOM | 612 | N | LEU | C | 78 | −1.365 | 78.886 | 9.574 | 1.00 | 39.56 | N |
| ATOM | 613 | CA | LEU | C | 79 | −2.067 | 78.174 | 8.513 | 1.00 | 33.74 | C |
| ATOM | 614 | C | LEU | C | 79 | −2.557 | 76.821 | 9.033 | 1.00 | 37.68 | C |
| ATOM | 615 | O | LEU | C | 79 | −1.875 | 76.162 | 9.822 | 1.00 | 39.25 | O |
| ATOM | 616 | CB | LEU | C | 79 | −1.133 | 77.969 | 7.307 | 1.00 | 40.59 | C |
| ATOM | 617 | CG | LEU | C | 79 | −1.615 | 77.032 | 6.178 | 1.00 | 40.09 | C |
| ATOM | 618 | CD1 | LEU | C | 79 | −2.574 | 77.739 | 5.277 | 1.00 | 28.75 | C |
| ATOM | 619 | CD2 | LEU | C | 79 | −0.476 | 76.386 | 5.372 | 1.00 | 31.11 | C |
| ATOM | 620 | N | TYR | C | 80 | −3.738 | 76.399 | 8.599 | 1.00 | 35.37 | N |
| ATOM | 621 | CA | TYR | C | 80 | −4.296 | 75.136 | 9.067 | 1.00 | 38.96 | C |
| ATOM | 622 | C | TYR | C | 80 | −4.592 | 74.197 | 7.909 | 1.00 | 36.52 | C |
| ATOM | 623 | O | TYR | C | 80 | −4.895 | 74.629 | 6.798 | 1.00 | 37.65 | O |
| ATOM | 624 | CB | TYR | C | 80 | −5.592 | 75.328 | 9.872 | 1.00 | 36.20 | C |
| ATOM | 625 | CG | TYR | C | 80 | −5.421 | 76.193 | 11.073 | 1.00 | 41.77 | C |
| ATOM | 626 | CD1 | TYR | C | 80 | −4.830 | 75.697 | 12.234 | 1.00 | 41.02 | C |
| ATOM | 627 | CD2 | TYR | C | 80 | −5.845 | 77.516 | 11.052 | 1.00 | 39.70 | C |
| ATOM | 628 | CE1 | TYR | C | 80 | −4.655 | 76.511 | 13.345 | 1.00 | 44.22 | C |
| ATOM | 629 | CE2 | TYR | C | 80 | −5.685 | 78.340 | 12.152 | 1.00 | 40.29 | C |
| ATOM | 630 | CZ | TYR | C | 80 | −5.089 | 77.837 | 13.297 | 1.00 | 49.44 | C |
| ATOM | 631 | OH | TYR | C | 80 | −4.938 | 78.666 | 14.388 | 1.00 | 54.21 | O |
| ATOM | 632 | N | LEU | C | 81 | −4.520 | 72.901 | 8.194 | 1.00 | 36.72 | N |
| ATOM | 633 | CA | LEU | C | 81 | −5.055 | 71.869 | 7.317 | 1.00 | 41.79 | C |
| ATOM | 634 | C | LEU | C | 81 | −5.970 | 70.979 | 8.151 | 1.00 | 40.31 | C |
| ATOM | 635 | O | LEU | C | 81 | −5.497 | 70.223 | 9.006 | 1.00 | 40.72 | O |
| ATOM | 636 | CB | LEU | C | 81 | −3.943 | 71.050 | 6.665 | 1.00 | 36.53 | C |
| ATOM | 637 | CG | LEU | C | 81 | −4.473 | 70.006 | 5.677 | 1.00 | 29.95 | C |
| ATOM | 638 | CD1 | LEU | C | 81 | −5.070 | 70.688 | 4.452 | 1.00 | 35.27 | C |
| ATOM | 639 | CD2 | LEU | C | 81 | −3.369 | 69.024 | 5.277 | 1.00 | 31.44 | C |
| ATOM | 640 | N | GLN | C | 82 | −7.274 | 71.101 | 7.926 | 1.00 | 38.93 | N |
| ATOM | 641 | CA | GLN | C | 82 | −8.277 | 70.254 | 8.566 | 1.00 | 35.95 | C |
| ATOM | 642 | C | GLN | C | 82 | −8.454 | 68.996 | 7.728 | 1.00 | 36.48 | C |
| ATOM | 643 | O | GLN | C | 82 | −8.834 | 69.081 | 6.557 | 1.00 | 41.11 | O |
| ATOM | 644 | CB | GLN | C | 82 | −9.606 | 71.009 | 8.718 | 1.00 | 32.87 | C |
| ATOM | 645 | CG | GLN | C | 82 | −10.720 | 70.190 | 9.383 | 1.00 | 27.13 | C |
| ATOM | 646 | CD | GLN | C | 82 | −10.339 | 69.723 | 10.783 | 1.00 | 41.21 | C |
| ATOM | 647 | OE1 | GLN | C | 82 | −9.875 | 70.511 | 11.621 | 1.00 | 41.00 | O |
| ATOM | 648 | NE2 | GLN | C | 82 | −10.466 | 68.418 | 11.018 | 1.00 | 37.49 | N |
| ATOM | 649 | N | MET | C | 83 | −8.136 | 67.839 | 8.304 | 1.00 | 36.04 | N |
| ATOM | 650 | CA | MET | C | 83 | −8.151 | 66.557 | 7.594 | 1.00 | 39.43 | C |
| ATOM | 651 | C | MET | C | 83 | −9.242 | 65.670 | 8.174 | 1.00 | 41.49 | C |
| ATOM | 652 | O | MET | C | 83 | −9.145 | 65.225 | 9.321 | 1.00 | 46.39 | O |
| ATOM | 653 | CB | MET | C | 83 | −6.791 | 65.854 | 7.669 | 1.00 | 42.85 | C |
| ATOM | 654 | CG | MET | C | 83 | −5.616 | 66.618 | 7.030 | 1.00 | 44.37 | C |
| ATOM | 655 | SD | MET | C | 83 | −4.047 | 65.719 | 7.166 | 1.00 | 45.89 | S |
| ATOM | 656 | CE | MET | C | 83 | −3.833 | 65.851 | 8.911 | 1.00 | 41.39 | C |
| ATOM | 657 | N | ASN | C | 84 | −10.284 | 65.432 | 7.400 | 1.00 | 37.96 | N |

TABLE 10.3-continued

| | | | | | | | | | | |
|---|---|---|---|---|---|---|---|---|---|---|
| ATOM | 658 | CA | ASN | C | 84 | −11.368 | 64.560 | 7.811 | 1.00 | 38.76 | C |
| ATOM | 659 | C | ASN | C | 84 | −11.332 | 63.268 | 7.002 | 1.00 | 40.86 | C |
| ATOM | 660 | O | ASN | C | 84 | −10.744 | 63.205 | 5.918 | 1.00 | 40.04 | O |
| ATOM | 661 | CB | ASN | C | 84 | −12.715 | 65.273 | 7.649 | 1.00 | 33.01 | C |
| ATOM | 662 | CG | ASN | C | 84 | −12.807 | 66.525 | 8.498 | 1.00 | 37.92 | C |
| ATOM | 663 | OD1 | ASN | C | 84 | −12.179 | 66.617 | 9.548 | 1.00 | 46.79 | O |
| ATOM | 664 | ND2 | ASN | C | 84 | −13.617 | 67.480 | 8.071 | 1.00 | 40.77 | N |
| ATOM | 665 | N | SER | C | 85 | −11.956 | 62.226 | 7.547 | 1.00 | 43.43 | N |
| ATOM | 666 | CA | SER | C | 85 | −12.072 | 60.945 | 6.852 | 1.00 | 40.65 | C |
| ATOM | 667 | C | SER | C | 85 | −10.714 | 60.421 | 6.406 | 1.00 | 39.67 | C |
| ATOM | 668 | O | SER | C | 85 | −10.529 | 60.022 | 5.252 | 1.00 | 36.84 | O |
| ATOM | 669 | CB | SER | C | 85 | −13.010 | 61.055 | 5.654 | 1.00 | 38.73 | C |
| ATOM | 670 | OG | SER | C | 85 | −14.333 | 61.254 | 6.094 | 1.00 | 48.16 | O |
| ATOM | 671 | N | LEU | C | 86 | −9.757 | 60.421 | 7.331 | 1.00 | 38.73 | N |
| ATOM | 672 | CA | LEU | C | 86 | −8.390 | 60.056 | 6.977 | 1.00 | 37.86 | C |
| ATOM | 673 | C | LEU | C | 86 | −8.328 | 58.625 | 6.457 | 1.00 | 38.76 | C |
| ATOM | 674 | O | LEU | C | 86 | −9.063 | 57.749 | 6.909 | 1.00 | 43.94 | O |
| ATOM | 675 | CB | LEU | C | 86 | −7.471 | 60.241 | 8.184 | 1.00 | 39.02 | C |
| ATOM | 676 | CG | LEU | C | 86 | −7.098 | 61.711 | 8.395 | 1.00 | 38.85 | C |
| ATOM | 677 | CD1 | LEU | C | 86 | −6.467 | 61.983 | 9.765 | 1.00 | 37.48 | C |
| ATOM | 678 | CD2 | LEU | C | 86 | −6.157 | 62.137 | 7.290 | 1.00 | 41.68 | C |
| ATOM | 679 | N | ARG | C | 87 | −7.468 | 58.400 | 5.470 | 1.00 | 41.40 | N |
| ATOM | 680 | CA | ARG | C | 87 | −7.251 | 57.088 | 4.882 | 1.00 | 37.22 | C |
| ATOM | 681 | C | ARG | C | 87 | −5.782 | 56.695 | 5.005 | 1.00 | 43.89 | C |
| ATOM | 682 | O | ARG | C | 87 | −4.900 | 57.546 | 5.190 | 1.00 | 37.28 | O |
| ATOM | 683 | CB | ARG | C | 87 | −7.661 | 57.052 | 3.409 | 1.00 | 41.43 | C |
| ATOM | 684 | CG | ARG | C | 87 | −8.995 | 57.661 | 3.103 | 1.00 | 47.94 | C |
| ATOM | 685 | CD | ARG | C | 87 | −9.556 | 57.025 | 1.858 | 1.00 | 52.28 | C |
| ATOM | 686 | NE | ARG | C | 87 | −9.802 | 57.968 | 0.770 | 1.00 | 59.65 | N |
| ATOM | 687 | CZ | ARG | C | 87 | −10.945 | 58.629 | 0.592 | 1.00 | 56.84 | C |
| ATOM | 688 | NH1 | ARG | C | 87 | −11.947 | 58.483 | 1.459 | 1.00 | 62.30 | N1+ |
| ATOM | 689 | NH2 | ARG | C | 87 | −11.079 | 59.444 | −0.449 | 1.00 | 58.47 | N |
| ATOM | 690 | N | VAL | C | 88 | −5.536 | 55.384 | 4.900 | 1.00 | 37.13 | N |
| ATOM | 691 | CA | VAL | C | 88 | −4.184 | 54.851 | 5.067 | 1.00 | 40.40 | C |
| ATOM | 692 | C | VAL | C | 88 | −3.218 | 55.550 | 4.113 | 1.00 | 41.32 | C |
| ATOM | 693 | O | VAL | C | 88 | −2.142 | 56.021 | 4.510 | 1.00 | 39.20 | O |
| ATOM | 694 | CB | VAL | C | 88 | −4.191 | 53.320 | 4.863 | 1.00 | 38.65 | C |
| ATOM | 695 | CG1 | VAL | C | 88 | −2.774 | 52.764 | 4.702 | 1.00 | 37.78 | C |
| ATOM | 696 | CG2 | VAL | C | 88 | −4.883 | 52.634 | 6.045 | 1.00 | 35.60 | C |
| ATOM | 697 | N | GLU | C | 89 | −3.621 | 55.684 | 2.856 | 1.00 | 36.74 | N |
| ATOM | 698 | CA | GLU | C | 89 | −2.794 | 56.334 | 1.849 | 1.00 | 37.93 | C |
| ATOM | 699 | C | GLU | C | 89 | −2.629 | 57.845 | 2.082 | 1.00 | 39.72 | C |
| ATOM | 700 | O | GLU | C | 89 | −1.953 | 58.480 | 1.274 | 1.00 | 41.02 | O |
| ATOM | 701 | CB | GLU | C | 89 | −3.324 | 56.041 | 0.434 | 1.00 | 30.08 | C |
| ATOM | 702 | CG | GLU | C | 89 | −4.747 | 56.489 | 0.150 | 1.00 | 44.00 | C |
| ATOM | 703 | CD | GLU | C | 89 | −5.802 | 55.528 | 0.720 | 1.00 | 65.19 | C |
| ATOM | 704 | OE1 | GLU | C | 89 | −7.001 | 55.726 | 0.398 | 1.00 | 72.89 | O |
| ATOM | 705 | OE2 | GLU | C | 89 | −5.434 | 54.580 | 1.479 | 1.00 | 57.08 | O1− |
| ATOM | 706 | N | ASP | C | 90 | −3.261 | 58.456 | 3.092 | 1.00 | 34.66 | N |
| ATOM | 707 | CA | ASP | C | 90 | −2.892 | 59.824 | 3.461 | 1.00 | 35.63 | C |
| ATOM | 708 | C | ASP | C | 90 | −1.648 | 59.885 | 4.344 | 1.00 | 36.64 | C |
| ATOM | 709 | O | ASP | C | 90 | −1.213 | 60.994 | 4.704 | 1.00 | 34.03 | O |
| ATOM | 710 | CB | ASP | C | 90 | −4.032 | 60.545 | 4.200 | 1.00 | 37.08 | C |
| ATOM | 711 | CG | ASP | C | 90 | −5.265 | 60.761 | 3.338 | 1.00 | 41.53 | C |
| ATOM | 712 | OD1 | ASP | C | 90 | −5.126 | 61.135 | 2.135 | 1.00 | 39.64 | O |
| ATOM | 713 | OD2 | ASP | C | 90 | −6.380 | 60.541 | 3.882 | 1.00 | 36.67 | O1− |
| ATOM | 714 | N | THR | C | 91 | −1.085 | 58.733 | 4.713 | 1.00 | 35.16 | N |
| ATOM | 715 | CA | THR | C | 91 | 0.114 | 58.684 | 5.552 | 1.00 | 38.29 | C |
| ATOM | 716 | C | THR | C | 91 | 1.260 | 59.354 | 4.826 | 1.00 | 31.75 | C |
| ATOM | 717 | O | THR | C | 91 | 1.572 | 58.989 | 3.690 | 1.00 | 36.79 | O |
| ATOM | 718 | CB | THR | C | 91 | 0.484 | 57.225 | 5.857 | 1.00 | 49.62 | C |
| ATOM | 719 | OG1 | THR | C | 91 | −0.561 | 56.594 | 6.611 | 1.00 | 40.91 | O |
| ATOM | 720 | CG2 | THR | C | 91 | 1.824 | 57.138 | 6.602 | 1.00 | 35.10 | C |
| ATOM | 721 | N | ALA | C | 92 | 1.876 | 60.340 | 5.462 | 1.00 | 34.05 | N |
| ATOM | 722 | CA | ALA | C | 92 | 2.886 | 61.136 | 4.778 | 1.00 | 32.82 | C |
| ATOM | 723 | C | ALA | C | 92 | 3.495 | 62.111 | 5.760 | 1.00 | 30.84 | C |
| ATOM | 724 | O | ALA | C | 92 | 2.938 | 62.368 | 6.827 | 1.00 | 30.26 | O |
| ATOM | 725 | CB | ALA | C | 92 | 2.304 | 61.923 | 3.596 | 1.00 | 36.15 | C |
| ATOM | 726 | N | VAL | C | 93 | 4.648 | 62.657 | 5.382 | 1.00 | 35.57 | N |
| ATOM | 727 | CA | VAL | C | 93 | 5.111 | 63.910 | 5.967 | 1.00 | 35.12 | C |
| ATOM | 728 | C | VAL | C | 93 | 4.408 | 65.064 | 5.265 | 1.00 | 34.14 | C |
| ATOM | 729 | O | VAL | C | 93 | 4.322 | 65.099 | 4.032 | 1.00 | 35.63 | O |
| ATOM | 730 | CB | VAL | C | 93 | 6.633 | 64.038 | 5.857 | 1.00 | 34.90 | C |
| ATOM | 731 | CG1 | VAL | C | 93 | 7.077 | 65.442 | 6.323 | 1.00 | 28.59 | C |
| ATOM | 732 | CG2 | VAL | C | 93 | 7.297 | 62.925 | 6.680 | 1.00 | 31.28 | C |
| ATOM | 733 | N | TYR | C | 94 | 3.897 | 66.006 | 6.045 | 1.00 | 33.45 | N |
| ATOM | 734 | CA | TYR | C | 94 | 3.184 | 67.159 | 5.518 | 1.00 | 37.19 | C |
| ATOM | 735 | C | TYR | C | 94 | 4.043 | 68.395 | 5.707 | 1.00 | 36.22 | C |
| ATOM | 736 | O | TYR | C | 94 | 4.511 | 68.654 | 6.820 | 1.00 | 37.12 | O |
| ATOM | 737 | CB | TYR | C | 94 | 1.826 | 67.335 | 6.216 | 1.00 | 29.33 | C |

TABLE 10.3-continued

| | | | | | | | | | | |
|---|---|---|---|---|---|---|---|---|---|---|
| ATOM | 738 | CG | TYR | C | 94 | 0.818 | 66.349 | 5.708 | 1.00 | 38.48 | C |
| ATOM | 739 | CD1 | TYR | C | 94 | 0.931 | 64.986 | 6.003 | 1.00 | 33.38 | C |
| ATOM | 740 | CD2 | TYR | C | 94 | −0.223 | 66.760 | 4.887 | 1.00 | 34.11 | C |
| ATOM | 741 | CE1 | TYR | C | 94 | 0.012 | 64.069 | 5.508 | 1.00 | 35.06 | C |
| ATOM | 742 | CE2 | TYR | C | 94 | −1.143 | 65.848 | 4.386 | 1.00 | 32.26 | C |
| ATOM | 743 | CZ | TYR | C | 94 | −1.033 | 64.510 | 4.706 | 1.00 | 31.31 | C |
| ATOM | 744 | OH | TYR | C | 94 | −1.955 | 63.614 | 4.184 | 1.00 | 29.76 | O |
| ATOM | 745 | N | TYR | C | 95 | 4.240 | 69.154 | 4.625 | 1.00 | 33.06 | N |
| ATOM | 746 | CA | TYR | C | 95 | 4.988 | 70.408 | 4.660 | 1.00 | 37.25 | C |
| ATOM | 747 | C | TYR | C | 95 | 4.091 | 71.583 | 4.292 | 1.00 | 38.95 | C |
| ATOM | 748 | O | TYR | C | 95 | 3.283 | 71.491 | 3.356 | 1.00 | 34.73 | O |
| ATOM | 749 | CB | TYR | C | 95 | 6.160 | 70.409 | 3.680 | 1.00 | 33.44 | C |
| ATOM | 750 | CG | TYR | C | 95 | 7.187 | 69.311 | 3.833 | 1.00 | 36.03 | C |
| ATOM | 751 | CD1 | TYR | C | 95 | 8.260 | 69.444 | 4.718 | 1.00 | 30.51 | C |
| ATOM | 752 | CD2 | TYR | C | 95 | 7.124 | 68.165 | 3.036 | 1.00 | 34.65 | C |
| ATOM | 753 | CE1 | TYR | C | 95 | 9.231 | 68.431 | 4.825 | 1.00 | 35.04 | C |
| ATOM | 754 | CE2 | TYR | C | 95 | 8.078 | 67.163 | 3.132 | 1.00 | 35.40 | C |
| ATOM | 755 | CZ | TYR | C | 95 | 9.124 | 67.295 | 4.023 | 1.00 | 36.07 | C |
| ATOM | 756 | OH | TYR | C | 95 | 10.054 | 66.281 | 4.097 | 1.00 | 43.55 | O |
| ATOM | 757 | N | CYS | C | 96 | 4.277 | 72.713 | 4.969 | 1.00 | 32.29 | N |
| ATOM | 758 | CA | CYS | C | 96 | 3.722 | 73.935 | 4.419 | 1.00 | 35.55 | C |
| ATOM | 759 | C | CYS | C | 96 | 4.819 | 74.668 | 3.674 | 1.00 | 34.71 | C |
| ATOM | 760 | O | CYS | C | 96 | 6.007 | 74.463 | 3.919 | 1.00 | 37.92 | O |
| ATOM | 761 | CB | CYS | C | 96 | 3.090 | 74.846 | 5.484 | 1.00 | 37.18 | C |
| ATOM | 762 | SG | CYS | C | 96 | 4.149 | 75.311 | 6.821 | 1.00 | 55.09 | S |
| ATOM | 763 | N | ALA | C | 97 | 4.391 | 75.493 | 2.720 | 1.00 | 37.06 | N |
| ATOM | 764 | CA | ALA | C | 97 | 5.252 | 76.388 | 1.965 | 1.00 | 33.86 | C |
| ATOM | 765 | C | ALA | C | 97 | 4.453 | 77.646 | 1.659 | 1.00 | 36.16 | C |
| ATOM | 766 | O | ALA | C | 97 | 3.224 | 77.620 | 1.638 | 1.00 | 37.96 | O |
| ATOM | 767 | CB | ALA | C | 97 | 5.744 | 75.736 | 0.667 | 1.00 | 31.03 | C |
| ATOM | 768 | N | ASN | C | 98 | 5.141 | 78.756 | 1.411 | 1.00 | 36.24 | N |
| ATOM | 769 | CA | ASN | C | 98 | 4.402 | 79.933 | 0.984 | 1.00 | 36.16 | C |
| ATOM | 770 | C | ASN | C | 98 | 4.643 | 80.154 | −0.505 | 1.00 | 33.85 | C |
| ATOM | 771 | O | ASN | C | 98 | 5.379 | 79.405 | −1.150 | 1.00 | 34.25 | O |
| ATOM | 772 | CB | ASN | C | 98 | 4.750 | 81.159 | 1.836 | 1.00 | 33.87 | C |
| ATOM | 773 | CG | ASN | C | 98 | 6.152 | 81.689 | 1.602 | 1.00 | 36.19 | C |
| ATOM | 774 | OD1 | ASN | C | 98 | 6.912 | 81.172 | 0.781 | 1.00 | 35.81 | O |
| ATOM | 775 | ND2 | ASN | C | 98 | 6.490 | 82.759 | 2.312 | 1.00 | 32.46 | N |
| ATOM | 776 | N | TRP | C | 99 | 4.001 | 81.179 | −1.060 | 1.00 | 29.34 | N |
| ATOM | 777 | CA | TRP | C | 99 | 4.253 | 81.534 | −2.451 | 1.00 | 32.42 | C |
| ATOM | 778 | C | TRP | C | 99 | 4.141 | 83.043 | −2.609 | 1.00 | 34.35 | C |
| ATOM | 779 | O | TRP | C | 99 | 3.294 | 83.677 | −1.978 | 1.00 | 36.87 | O |
| ATOM | 780 | CB | TRP | C | 99 | 3.301 | 80.808 | −3.409 | 1.00 | 31.13 | C |
| ATOM | 781 | CG | TRP | C | 99 | 1.832 | 81.172 | −3.311 | 1.00 | 38.60 | C |
| ATOM | 782 | CD1 | TRP | C | 99 | 0.869 | 80.545 | −2.558 | 1.00 | 36.35 | C |
| ATOM | 783 | CD2 | TRP | C | 99 | 1.160 | 82.217 | −4.028 | 1.00 | 33.13 | C |
| ATOM | 784 | NE1 | TRP | C | 99 | −0.359 | 81.151 | −2.754 | 1.00 | 32.28 | N |
| ATOM | 785 | CE2 | TRP | C | 99 | −0.207 | 82.175 | −3.653 | 1.00 | 36.97 | C |
| ATOM | 786 | CE3 | TRP | C | 99 | 1.580 | 83.187 | −4.949 | 1.00 | 33.81 | C |
| ATOM | 787 | CZ2 | TRP | C | 99 | −1.155 | 83.078 | −4.160 | 1.00 | 35.91 | C |
| ATOM | 788 | CZ3 | TRP | C | 99 | 0.639 | 84.078 | −5.459 | 1.00 | 33.25 | C |
| ATOM | 789 | CH2 | TRP | C | 99 | −0.712 | 84.016 | −5.059 | 1.00 | 34.18 | C |
| ATOM | 790 | N | TYR | C | 100 | 5.011 | 83.606 | −3.443 | 1.00 | 35.97 | N |
| ATOM | 791 | CA | TYR | C | 100 | 5.148 | 85.048 | −3.651 | 1.00 | 34.82 | C |
| ATOM | 792 | C | TYR | C | 100 | 4.693 | 85.512 | −5.022 | 1.00 | 35.71 | C |
| ATOM | 793 | O | TYR | C | 100 | 4.101 | 86.591 | −5.143 | 1.00 | 33.01 | O |
| ATOM | 794 | CB | TYR | C | 100 | 6.615 | 85.472 | −3.493 | 1.00 | 28.22 | C |
| ATOM | 795 | CG | TYR | C | 100 | 7.184 | 85.286 | −2.114 | 1.00 | 36.73 | C |
| ATOM | 796 | CD1 | TYR | C | 100 | 6.415 | 85.536 | −0.971 | 1.00 | 34.55 | C |
| ATOM | 797 | CD2 | TYR | C | 100 | 8.496 | 84.852 | −1.946 | 1.00 | 35.48 | C |
| ATOM | 798 | CE1 | TYR | C | 100 | 6.951 | 85.365 | 0.299 | 1.00 | 36.55 | C |
| ATOM | 799 | CE2 | TYR | C | 100 | 9.032 | 84.666 | −0.684 | 1.00 | 33.46 | C |
| ATOM | 800 | CZ | TYR | C | 100 | 8.263 | 84.929 | 0.430 | 1.00 | 36.36 | C |
| ATOM | 801 | OH | TYR | C | 100 | 8.813 | 84.749 | 1.674 | 1.00 | 36.68 | O |
| ATOM | 802 | N | TYR | C | 101 | 4.990 | 84.731 | −6.059 | 1.00 | 32.01 | N |
| ATOM | 803 | CA | TYR | C | 101 | 4.927 | 85.197 | −7.439 | 1.00 | 31.46 | C |
| ATOM | 804 | C | TYR | C | 101 | 3.758 | 84.539 | −8.159 | 1.00 | 31.46 | C |
| ATOM | 805 | O | TYR | C | 101 | 2.795 | 85.215 | −8.492 | 1.00 | 32.52 | O |
| ATOM | 806 | CB | TYR | C | 101 | 6.249 | 84.921 | −8.157 | 1.00 | 25.12 | C |
| ATOM | 807 | CCG | TYR | C | 101 | 7.430 | 85.482 | −7.409 | 1.00 | 31.29 | C |
| ATOM | 808 | CD1 | TYR | C | 101 | 7.594 | 86.850 | −7.307 | 1.00 | 30.52 | C |
| ATOM | 809 | CD2 | TYR | C | 101 | 8.385 | 84.653 | −6.796 | 1.00 | 34.01 | C |
| ATOM | 810 | CE1 | TYR | C | 101 | 8.646 | 87.393 | −6.644 | 1.00 | 31.83 | C |
| ATOM | 811 | CE2 | TYR | C | 101 | 9.470 | 85.205 | −6.099 | 1.00 | 29.33 | C |
| ATOM | 812 | CZ | TYR | C | 101 | 9.586 | 86.589 | −6.042 | 1.00 | 34.04 | C |
| ATOM | 813 | OH | TYR | C | 101 | 10.613 | 87.238 | −5.396 | 1.00 | 38.85 | O |
| ATOM | 814 | N | TYR | C | 102 | 3.818 | 83.241 | −8.407 | 1.00 | 32.18 | N |
| ATOM | 815 | CA | TYR | C | 102 | 2.692 | 82.528 | −8.984 | 1.00 | 26.83 | C |
| ATOM | 816 | C | TYR | C | 102 | 2.185 | 81.474 | −8.000 | 1.00 | 34.57 | C |
| ATOM | 817 | O | TYR | C | 102 | 2.959 | 80.888 | −7.237 | 1.00 | 30.16 | O |

TABLE 10.3-continued

| | | | | | | | | | | |
|---|---|---|---|---|---|---|---|---|---|---|
| ATOM | 818 | CB | TYR | C | 102 | 3.069 | 81.916 | −10.328 | 1.00 | 26.41 | C |
| ATOM | 819 | CG | TYR | C | 102 | 4.422 | 81.207 | −10.424 | 1.00 | 31.59 | C |
| ATOM | 820 | CD1 | TYR | C | 102 | 5.586 | 81.894 | −10.776 | 1.00 | 25.87 | C |
| ATOM | 821 | CD2 | TYR | C | 102 | 4.510 | 79.827 | −10.218 | 1.00 | 34.03 | C |
| ATOM | 822 | CE1 | TYR | C | 102 | 6.807 | 81.225 | −10.900 | 1.00 | 28.32 | C |
| ATOM | 823 | CE2 | TYR | C | 102 | 5.708 | 79.150 | −10.339 | 1.00 | 29.44 | C |
| ATOM | 824 | CZ | TYR | C | 102 | 6.856 | 79.842 | −10.677 | 1.00 | 37.60 | C |
| ATOM | 825 | OH | TYR | C | 102 | 8.030 | 79.125 | −10.804 | 1.00 | 31.27 | O |
| ATOM | 826 | N | TYR | C | 103 | 0.861 | 81.255 | −8.005 | 1.00 | 34.62 | N |
| ATOM | 827 | CA | TYR | C | 103 | 0.206 | 80.545 | −6.908 | 1.00 | 30.24 | C |
| ATOM | 828 | C | TYR | C | 103 | 0.561 | 79.069 | −6.860 | 1.00 | 33.90 | C |
| ATOM | 829 | O | TYR | C | 103 | 0.334 | 78.431 | −5.826 | 1.00 | 33.35 | O |
| ATOM | 830 | CB | TYR | C | 103 | −1.330 | 80.708 | −6.981 | 1.00 | 32.59 | C |
| ATOM | 831 | CG | TYR | C | 103 | −1.968 | 80.050 | −8.196 | 1.00 | 3.066 | C |
| ATOM | 832 | CD1 | TYR | C | 103 | −2.097 | 80.744 | −9.398 | 1.00 | 32.62 | C |
| ATOM | 833 | CD2 | TYR | C | 103 | −2.439 | 78.739 | −8.145 | 1.00 | 31.75 | C |
| ATOM | 834 | CE1 | TYR | C | 103 | −2.677 | 80.151 | −10.526 | 1.00 | 34.17 | C |
| ATOM | 835 | CE2 | TYR | C | 103 | −3.030 | 78.132 | −9.277 | 1.00 | 35.45 | C |
| ATOM | 836 | CZ | TYR | C | 103 | −3.140 | 78.851 | −10.460 | 1.00 | 38.01 | C |
| ATOM | 837 | OH | TYR | C | 103 | −3.707 | 78.286 | −11.585 | 1.00 | 43.93 | O |
| ATOM | 838 | N | TYR | C | 104 | 1.090 | 78.503 | −7.941 | 1.00 | 33.41 | N |
| ATOM | 839 | CA | TYR | C | 104 | 1.431 | 77.088 | −7.959 | 1.00 | 31.54 | C |
| ATOM | 840 | C | TYR | C | 104 | 2.921 | 76.846 | −7.775 | 1.00 | 35.80 | C |
| ATOM | 841 | O | TYR | C | 104 | 3.383 | 75.706 | −7.933 | 1.00 | 34.83 | O |
| ATOM | 842 | CB | TYR | C | 104 | 0.942 | 76.437 | −9.254 | 1.00 | 31.39 | C |
| ATOM | 843 | CG | TYR | C | 104 | 1.310 | 77.192 | −10.505 | 1.00 | 35.92 | C |
| ATOM | 844 | CD1 | TYR | C | 104 | 2.537 | 76.979 | −11.134 | 1.00 | 29.90 | C |
| ATOM | 845 | CD2 | TYR | C | 104 | 0.431 | 78.136 | −11.058 | 1.00 | 37.72 | C |
| ATOM | 846 | CE1 | TYR | C | 104 | 2.887 | 77.682 | −12.297 | 1.00 | 31.96 | C |
| ATOM | 847 | CE2 | TYR | C | 104 | 0.773 | 78.853 | −12.216 | 1.00 | 33.33 | C |
| ATOM | 848 | CZ | TYR | C | 104 | 1.997 | 78.611 | −12.832 | 1.00 | 37.08 | C |
| ATOM | 849 | OH | TYR | C | 104 | 2.322 | 79.290 | −13.988 | 100 | 38.85 | O |
| ATOM | 850 | N | TYR | C | 105 | 3.677 | 77.881 | −7.424 | 1.00 | 30.57 | N |
| ATOM | 851 | CA | GLY | C | 105 | 5.069 | 77.729 | −7.046 | 1.00 | 31.29 | C |
| ATOM | 852 | C | GLY | C | 105 | 5.189 | 77.804 | −5.536 | 1.00 | 35.97 | C |
| ATOM | 853 | O | GLY | C | 105 | 4.381 | 78.439 | −4.880 | 1.00 | 39.78 | O |
| ATOM | 854 | N | MET | C | 106 | 6.174 | 77.104 | −4.983 | 1.00 | 35.79 | N |
| ATOM | 855 | CA | MET | C | 106 | 6.477 | 77.149 | −3.560 | 1.00 | 29.65 | C |
| ATOM | 856 | C | MET | C | 106 | 7.811 | 77.844 | −3.359 | 1.00 | 34.76 | C |
| ATOM | 857 | O | MET | C | 106 | 8.814 | 77.447 | −3.964 | 1.00 | 40.34 | O |
| ATOM | 858 | CB | MET | C | 106 | 6.531 | 75.749 | −2.967 | 1.00 | 33.58 | C |
| ATOM | 859 | CG | MET | C | 106 | 5.200 | 75.079 | −2.997 | 1.00 | 40.63 | C |
| ATOM | 860 | SD | MET | C | 106 | 5.175 | 73.827 | −4.259 | 1.00 | 38.99 | S |
| ATOM | 861 | CE | MET | C | 106 | 3.449 | 73.894 | −4.753 | 1.00 | 39.97 | C |
| ATOM | 862 | N | ASP | C | 107 | 7.833 | 78.872 | −2.510 | 1.00 | 32.14 | N |
| ATOM | 863 | CA | ASP | C | 107 | 9.038 | 79.679 | −2.359 | 1.00 | 36.28 | C |
| ATOM | 864 | C | ASP | C | 107 | 9.814 | 79.363 | −1.087 | 1.00 | 36.05 | C |
| ATOM | 865 | O | ASP | C | 107 | 10.987 | 79.00 | −1.168 | 1.00 | 43.22 | O |
| ATOM | 866 | CB | ASP | C | 107 | 8.684 | 81.166 | −2.419 | 1.00 | 35.85 | C |
| ATOM | 867 | CG | ASP | C | 107 | 8.243 | 81.582 | −3.791 | 1.00 | 36.58 | C |
| ATOM | 868 | OD1 | ASP | C | 107 | 9.126 | 81.733 | −4.663 | 1.00 | 39.74 | O1− |
| ATOM | 869 | OD2 | ASP | C | 107 | 7.024 | 81.741 | −4.005 | 1.00 | 38.36 | O |
| ATOM | 870 | N | VAL | C | 108 | 9.185 | 79.486 | 0.079 | 1.00 | 34.27 | N |
| ATOM | 871 | CA | VAL | C | 108 | 9.795 | 79.131 | 1.354 | 1.00 | 37.63 | C |
| ATOM | 872 | C | VAL | C | 108 | 9.081 | 77.906 | 1.893 | 1.00 | 35.71 | C |
| ATOM | 873 | O | VAL | C | 108 | 7.853 | 77.818 | 1.820 | 1.00 | 36.94 | O |
| ATOM | 874 | CB | VAL | C | 108 | 9.716 | 80.275 | 2.375 | 1.00 | 39.13 | C |
| ATOM | 875 | CG1 | VAL | C | 108 | 10.395 | 79.854 | 3.662 | 1.00 | 34.94 | C |
| ATOM | 876 | CG2 | VAL | C | 108 | 10.334 | 81.534 | 1.809 | 1.00 | 37.63 | C |
| ATOM | 877 | N | TRP | C | 109 | 9.845 | 76.969 | 2.442 | 1.00 | 35.86 | N |
| ATOM | 878 | CA | TRP | C | 109 | 9.305 | 75.713 | 2.950 | 1.00 | 38.43 | C |
| ATOM | 879 | C | TRP | C | 109 | 9.523 | 75.578 | 4.452 | 1.00 | 36.07 | C |
| ATOM | 880 | O | TRP | C | 109 | 10.470 | 76.127 | 5.011 | 1.00 | 34.83 | O |
| ATOM | 881 | CB | TRP | C | 109 | 9.935 | 74.510 | 2.270 | 1.00 | 28.64 | C |
| ATOM | 882 | CG | TRP | C | 109 | 9.627 | 74.379 | 0.834 | 1.00 | 32.20 | C |
| ATOM | 883 | CD1 | TRP | C | 109 | 10.053 | 75.196 | −0.178 | 1.00 | 33.19 | C |
| ATOM | 884 | CD2 | TRP | C | 109 | 8.857 | 73.338 | 0.215 | 1.00 | 30.88 | C |
| ATOM | 885 | NE1 | TRP | C | 109 | 9.589 | 74.729 | −1.385 | 1.00 | 32.70 | N |
| ATOM | 886 | CE2 | TRP | C | 109 | 8.853 | 73.589 | −1.171 | 1.00 | 32.73 | C |
| ATOM | 887 | CE3 | TRP | C | 109 | 8.175 | 72.219 | 0.696 | 1.00 | 31.39 | C |
| ATOM | 888 | CZ2 | TRP | C | 109 | 8.183 | 72.759 | −2.079 | 1.00 | 27.14 | C |
| ATOM | 889 | CZ3 | TRP | C | 109 | 7.510 | 71.395 | −0.205 | 1.00 | 25.68 | C |
| ATOM | 890 | CH2 | TRP | C | 109 | 7.532 | 71.661 | −1.575 | 1.00 | 25.11 | C |
| ATOM | 891 | N | GLY | C | 110 | 8.611 | 74.852 | 5.095 | 1.00 | 38.56 | N |
| ATOM | 892 | CA | GLY | C | 110 | 8.732 | 74.483 | 6.489 | 1.00 | 37.65 | C |
| ATOM | 893 | C | GLY | C | 110 | 9.578 | 73.243 | 6.689 | 1.00 | 38.90 | C |
| ATOM | 894 | O | GLY | C | 110 | 10.348 | 72.825 | 5.821 | 1.00 | 44.35 | O |
| ATOM | 895 | N | GLN | C | 111 | 9.417 | 72.638 | 7.864 | 1.00 | 37.08 | N |
| ATOM | 896 | CA | GLN | C | 111 | 10.257 | 71.526 | 8.265 | 1.00 | 37.72 | C |
| ATOM | 897 | C | GLN | C | 111 | 9.554 | 70.171 | 8.274 | 1.00 | 39.10 | C |

TABLE 10.3-continued

| | | | | | | | | | | | |
|---|---|---|---|---|---|---|---|---|---|---|---|
| ATOM | 898 | O | GLN | C | 111 | 10.241 | 69.143 | 8.268 | 1.00 | 46.62 | O |
| ATOM | 899 | CB | GLN | C | 111 | 10.854 | 71.823 | 9.646 | 1.00 | 41.49 | C |
| ATOM | 900 | CG | GLN | C | 111 | 9.971 | 71.407 | 10.795 | 1.00 | 57.57 | C |
| ATOM | 901 | CD | GLN | C | 111 | 10.317 | 72.142 | 12.083 | 1.00 | 71.42 | C |
| ATOM | 902 | OE1 | GLN | C | 111 | 11.162 | 73.046 | 12.079 | 1.00 | 67.32 | O |
| ATOM | 903 | NE2 | GLN | C | 111 | 9.662 | 71.761 | 13.194 | 1.00 | 62.29 | N |
| ATOM | 904 | N | GLY | C | 112 | 8.229 | 70.137 | 8.247 | 1.00 | 38.85 | N |
| ATOM | 905 | CA | GLY | C | 112 | 7.483 | 68.892 | 8.185 | 1.00 | 37.13 | C |
| ATOM | 906 | C | GLY | C | 112 | 6.892 | 68.477 | 9.528 | 1.00 | 40.61 | C |
| ATOM | 907 | O | GLY | C | 112 | 7.389 | 68.837 | 10.601 | 1.00 | 43.71 | O |
| ATOM | 908 | N | THR | C | 113 | 5.771 | 67.754 | 9.462 | 1.00 | 38.16 | N |
| ATOM | 909 | CA | THR | C | 113 | 5.125 | 67.066 | 10.574 | 1.00 | 37.93 | C |
| ATOM | 910 | C | THR | C | 113 | 4.592 | 65.777 | 9.967 | 1.00 | 40.18 | C |
| ATOM | 911 | O | THR | C | 113 | 4.106 | 65.791 | 8.834 | 1.00 | 43.97 | O |
| ATOM | 912 | CB | THR | C | 113 | 4.008 | 67.924 | 11.231 | 1.00 | 40.04 | C |
| ATOM | 913 | OG1 | THR | C | 113 | 3.470 | 67.248 | 12.370 | 1.00 | 48.01 | O |
| ATOM | 914 | CG2 | THR | C | 113 | 2.863 | 68.248 | 10.265 | 1.00 | 39.86 | C |
| ATOM | 915 | N | ATHR | C | 114 | 4.716 | 64.665 | 10.689 | 0.50 | 39.81 | N |
| ATOM | 916 | CA | ATHR | C | 114 | 4.418 | 63.359 | 10.110 | 0.50 | 39.05 | C |
| ATOM | 917 | C | ATHR | C | 114 | 3.038 | 62.873 | 10.545 | 0.50 | 39.83 | C |
| ATOM | 918 | O | ATHR | C | 114 | 2.650 | 63.015 | 11.709 | 0.50 | 39.84 | O |
| ATOM | 919 | CB | ATHR | C | 114 | 5.484 | 62.320 | 10.487 | 0.50 | 39.38 | C |
| ATOM | 920 | OG1 | ATHR | C | 114 | 5.310 | 61.937 | 11.853 | 0.50 | 49.44 | O |
| ATOM | 921 | CG2 | ATHR | C | 114 | 6.901 | 62.878 | 10.295 | 0.50 | 34.14 | C |
| ATOM | 922 | N | BTHR | C | 114 | 4.722 | 64.656 | 10.669 | 0.50 | 39.81 | N |
| ATOM | 923 | CA | BTHR | C | 114 | 4.413 | 63.376 | 10.040 | 0.50 | 39.04 | C |
| ATOM | 924 | C | BTHR | C | 114 | 3.083 | 62.819 | 10.539 | 0.50 | 39.82 | C |
| ATOM | 925 | O | BTHR | C | 114 | 2.766 | 62.880 | 11.731 | 0.50 | 39.90 | O |
| ATOM | 926 | CB | BTHR | C | 114 | 5.554 | 62.360 | 10.232 | 0.50 | 39.16 | C |
| ATOM | 927 | OG1 | BTHR | C | 114 | 5.037 | 61.021 | 10.248 | 0.50 | 33.47 | O |
| ATOM | 928 | CG2 | BTHR | C | 114 | 6.343 | 62.647 | 11.490 | 0.50 | 42.84 | C |
| ATOM | 929 | N | VAL | C | 115 | 2.298 | 62.308 | 9.592 | 1.00 | 38.42 | N |
| ATOM | 930 | CA | VAL | C | 115 | 0.962 | 61.778 | 9.817 | 1.00 | 36.25 | C |
| ATOM | 931 | C | VAL | C | 115 | 0.968 | 60.298 | 9.446 | 1.00 | 37.55 | C |
| ATOM | 932 | O | VAL | C | 115 | 1.310 | 59.940 | 8.313 | 1.00 | 39.55 | O |
| ATOM | 933 | CB | VAL | C | 115 | −0.092 | 62.536 | 8.991 | 1.00 | 37.32 | C |
| ATOM | 934 | CG1 | VAL | C | 115 | −1.443 | 61.798 | 9.049 | 1.00 | 33.92 | C |
| ATOM | 935 | CG2 | VAL | C | 115 | −0.223 | 63.961 | 9.492 | 1.00 | 31.70 | C |
| ATOM | 936 | N | THR | C | 116 | 0.580 | 59.443 | 10.388 | 1.00 | 35.49 | N |
| ATOM | 937 | CA | THR | C | 116 | 0.471 | 58.014 | 10.145 | 1.00 | 38.36 | C |
| ATOM | 938 | C | THR | C | 116 | −0.987 | 57.603 | 10.309 | 1.00 | 43.76 | C |
| ATOM | 939 | O | THR | C | 116 | −1.596 | 57.873 | 11.350 | 1.00 | 43.30 | O |
| ATOM | 940 | CB | THR | C | 116 | 1.379 | 57.223 | 11.096 | 1.00 | 45.91 | C |
| ATOM | 941 | OG1 | THR | C | 116 | 2.734 | 57.660 | 10.937 | 1.00 | 47.40 | O |
| ATOM | 942 | CG2 | THR | C | 116 | 1.342 | 55.751 | 10.742 | 1.00 | 42.59 | C |
| ATOM | 943 | N | VAL | C | 117 | −1.553 | 56.977 | 9.283 | 1.00 | 36.12 | N |
| ATOM | 944 | CA | VAL | C | 117 | −2.926 | 56.501 | 9.346 | 1.00 | 41.60 | C |
| ATOM | 945 | C | VAL | C | 117 | −2.891 | 54.978 | 9.276 | 1.00 | 45.74 | C |
| ATOM | 946 | O | VAL | C | 117 | −2.634 | 54.394 | 8.211 | 1.00 | 44.01 | O |
| ATOM | 947 | CB | VAL | C | 117 | −3.813 | 57.107 | 8.244 | 1.00 | 42.69 | C |
| ATOM | 948 | CG1 | VAL | C | 117 | −5.257 | 56.664 | 8.437 | 1.00 | 34.13 | C |
| ATOM | 949 | CG2 | VAL | C | 117 | −3.720 | 58.666 | 8.235 | 1.00 | 38.65 | C |
| ATOM | 950 | N | SER | C | 118 | −3.181 | 54.330 | 10.407 | 1.00 | 42.18 | N |
| ATOM | 951 | CA | SER | C | 118 | −3.101 | 52.882 | 10.500 | 1.00 | 45.65 | C |
| ATOM | 952 | C | SER | C | 118 | −4.244 | 52.329 | 11.345 | 1.00 | 46.76 | C |
| ATOM | 953 | O | SER | C | 118 | −4.596 | 52.891 | 12.389 | 1.00 | 43.45 | O |
| ATOM | 954 | CB | SER | C | 118 | −1.764 | 52.442 | 11.101 | 1.00 | 45.42 | C |
| ATOM | 955 | OG | SER | C | 118 | −1.694 | 51.028 | 11.142 | 1.00 | 53.46 | O |
| ATOM | 956 | N | SER | C | 119 | −4.800 | 51.204 | 10.901 | 1.00 | 39.96 | N |
| ATOM | 957 | CA | SER | C | 119 | −5.765 | 50.456 | 11.697 | 1.00 | 55.76 | C |
| ATOM | 958 | C | SER | C | 119 | −5.145 | 49.241 | 12.384 | 1.00 | 58.97 | C |
| ATOM | 959 | O | SER | C | 119 | −5.879 | 48.417 | 12.940 | 1.00 | 56.42 | O |
| ATOM | 960 | CB | SER | C | 119 | −6.956 | 50.024 | 10.833 | 1.00 | 47.59 | C |
| ATOM | 961 | OG | SER | C | 119 | −6.537 | 49.473 | 9.592 | 1.00 | 60.90 | O |
| ATOM | 962 | N | ALA | C | 120 | −3.821 | 49.092 | 12.325 | 1.00 | 53.37 | N |
| ATOM | 963 | CA | ALA | C | 120 | −3.157 | 47.942 | 12.923 | 1.00 | 49.27 | C |
| ATOM | 964 | C | ALA | C | 120 | −3.115 | 48.063 | 14.439 | 1.00 | 53.61 | C |
| ATOM | 965 | O | ALA | C | 120 | −3.088 | 49.160 | 15.007 | 1.00 | 51.80 | O |
| ATOM | 966 | CB | ALA | C | 120 | −1.736 | 47.799 | 12.376 | 1.00 | 54.97 | C |
| ATOM | 967 | N | SER | C | 121 | −3.101 | 46.918 | 15.104 | 1.00 | 50.81 | GZ00 N |
| ATOM | 968 | CA | SER | C | 121 | −2.922 | 46.921 | 16.546 | 1.00 | 62.62 | GZ00 C |
| ATOM | 969 | C | SER | C | 121 | −1.817 | 45.945 | 16.925 | 1.00 | 55.18 | GZ00 C |
| ATOM | 970 | O | SER | C | 121 | −1.492 | 45.015 | 16.175 | 1.00 | 50.22 | GZ00 O |
| ATOM | 971 | CB | SER | C | 121 | −4.226 | 46.571 | 17.271 | 1.00 | 60.87 | GZ00 C |
| ATOM | 972 | OG | SER | C | 121 | −4.902 | 45.539 | 16.576 | 1.00 | 67.02 | GZ00 O |
| ATOM | 973 | N | THR | C | 122 | −1.276 | 46.170 | 18.123 | 1.00 | 43.63 | GZ00 N |
| ATOM | 974 | CA | THR | C | 122 | −0.125 | 45.444 | 18.640 | 1.00 | 49.19 | GZ00 C |
| ATOM | 975 | C | THR | C | 122 | −0.197 | 43.955 | 18.342 | 1.00 | 48.67 | GZ00 C |
| ATOM | 976 | O | THR | C | 122 | −1.207 | 43.300 | 18.591 | 1.00 | 54.63 | GZ00 O |
| ATOM | 977 | CB | THR | C | 122 | −0.014 | 45.661 | 20.147 | 1.00 | 51.65 | GZ00 C |

TABLE 10.3-continued

| | | | | | | | | | | |
|---|---|---|---|---|---|---|---|---|---|---|
| ATOM | 978 | OG1 | THR | C | 122 | 0.017 | 47.074 | 20.426 | 1.00 | 49.30 GZ00 O |
| ATOM | 979 | CG2 | THR | C | 122 | 1.260 | 44.988 | 20.690 | 1.00 | 49.88 GZ00 C |
| ATOM | 980 | N | LYS | C | 123 | 0.890 | 43.430 | 17.795 | 1.00 | 50.80 GZ00 N |
| ATOM | 981 | CA | LYS | C | 123 | 0.976 | 42.015 | 17.485 | 1.00 | 49.10 GZ00 C |
| ATOM | 982 | C | LYS | C | 123 | 2.446 | 41.622 | 17.506 | 1.00 | 56.41 GZ00 C |
| ATOM | 983 | O | LYS | C | 123 | 3.290 | 42.358 | 16.985 | 1.00 | 49.74 GZ00 O |
| ATOM | 984 | CB | LYS | C | 123 | 0.338 | 41.693 | 16.133 | 1.00 | 44.99 GZ00 C |
| ATOM | 985 | CG | LYS | C | 123 | 0.499 | 40.238 | 15.807 | 1.00 | 44.28 GZ00 C |
| ATOM | 986 | CD | LYS | C | 123 | −0.078 | 39.820 | 14.484 | 1.00 | 49.15 GZ00 C |
| ATOM | 987 | CE | LYS | C | 123 | 0.361 | 38.368 | 14.217 | 1.00 | 62.00 GZ00 C |
| ATOM | 988 | NZ | LYS | C | 123 | −0.182 | 37.795 | 12.951 | 1.00 | 72.41 GZ00 N1+ |
| ATOM | 989 | N | GLY | C | 124 | 2.752 | 40.507 | 18.178 | 1.00 | 53.97 GZ00 N |
| ATOM | 990 | CA | GLY | C | 124 | 4.094 | 39.983 | 18.217 | 1.00 | 39.15 GZ00 C |
| ATOM | 991 | C | GLY | C | 124 | 4.382 | 39.194 | 16.962 | 1.00 | 43.80 GZ00 C |
| ATOM | 992 | O | GLY | C | 124 | 3.474 | 38.686 | 16.297 | 1.00 | 46.60 GZ00 O |
| ATOM | 993 | N | PRO | C | 125 | 5.658 | 39.060 | 16.625 | 1.00 | 47.07 GZ00 N |
| ATOM | 994 | CA | PRO | C | 125 | 6.043 | 38.419 | 15.362 | 1.00 | 48.03 GZ00 C |
| ATOM | 995 | C | PRO | C | 125 | 6.129 | 36.902 | 15.443 | 1.00 | 43.83 GZ00 C |
| ATOM | 996 | O | PRO | C | 125 | 6.341 | 36.326 | 16.503 | 1.00 | 45.86 GZ00 O |
| ATOM | 997 | CB | PRO | C | 125 | 7.440 | 38.999 | 15.095 | 1.00 | 45.07 GZ00 C |
| ATOM | 998 | CG | PRO | C | 125 | 7.989 | 39.254 | 16.464 | 1.00 | 48.96 GZ00 C |
| ATOM | 999 | CD | PRO | C | 125 | 6.800 | 39.689 | 17.314 | 1.00 | 46.04 GZ00 C |
| ATOM | 1000 | N | SER | C | 126 | 5.963 | 36.270 | 14.280 | 1.00 | 42.83 GZ00 N |
| ATOM | 1001 | CA | SER | C | 126 | 6.393 | 34.900 | 14.053 | 1.00 | 46.91 GZ00 C |
| ATOM | 1002 | C | SER | C | 126 | 7.817 | 34.900 | 13.498 | 1.00 | 49.79 GZ00 C |
| ATOM | 1003 | O | SER | C | 126 | 8.157 | 35.713 | 12.635 | 1.00 | 45.82 GZ00 O |
| ATOM | 1004 | CB | SER | C | 126 | 5.461 | 34.192 | 13.071 | 1.00 | 50.64 GZ00 C |
| ATOM | 1005 | OG | SER | C | 126 | 4.145 | 34.158 | 13.572 | 1.00 | 58.04 GZ00 O |
| ATOM | 1006 | N | VAL | C | 127 | 8.645 | 33.980 | 13.986 | 1.00 | 49.68 GZ00 N |
| ATOM | 1007 | CA | VAL | C | 127 | 10.059 | 33.915 | 13.624 | 1.00 | 45.00 GZ00 C |
| ATOM | 1008 | C | VAL | C | 127 | 10.335 | 32.584 | 12.950 | 1.00 | 42.10 GZ00 C |
| ATOM | 1009 | O | VAL | C | 127 | 10.021 | 31.528 | 13.504 | 1.00 | 57.42 GZ00 O |
| ATOM | 1010 | CB | VAL | C | 127 | 10.958 | 34.110 | 14.855 | 1.00 | 44.31 GZ00 C |
| ATOM | 1011 | CG1 | VAL | C | 127 | 12.431 | 34.119 | 14.456 | 1.00 | 47.62 GZ00 C |
| ATOM | 1012 | CG2 | VAL | C | 127 | 1.0577 | 35.406 | 15.554 | 1.00 | 41.45 GZ00 C |
| ATOM | 1013 | N | PHE | C | 128 | 10.912 | 32.635 | 11.758 | 1.00 | 43.32 GZ00 N |
| ATOM | 1014 | CA | PHE | C | 128 | 11.244 | 31.451 | 10.983 | 1.00 | 44.87 GZ00 C |
| ATOM | 1015 | C | PHE | C | 128 | 12.729 | 31.447 | 10.629 | 1.00 | 50.79 GZ00 C |
| ATOM | 1016 | O | PHE | C | 128 | 13.324 | 32.511 | 10.435 | 1.00 | 47.46 GZ00 O |
| ATOM | 1017 | CB | PHE | C | 128 | 10.425 | 31.399 | 9.694 | 1.00 | 48.10 GZ00 C |
| ATOM | 1018 | CG | PHE | C | 128 | 8.942 | 31.384 | 9.922 | 1.00 | 58.19 GZ00 C |
| ATOM | 1019 | CD1 | PHE | C | 128 | 8.272 | 30.200 | 10.176 | 1.00 | 58.46 GZ00 C |
| ATOM | 1020 | CD2 | PHE | C | 128 | 82.220 | 32.566 | 9.912 | 1.00 | 56.25 GZ00 C |
| ATOM | 1021 | CE1 | PHE | C | 128 | 6.912 | 30.198 | 10.387 | 1.00 | 58.84 GZ00 C |
| ATOM | 1022 | CE2 | PHE | C | 128 | 6.855 | 32.568 | 10.128 | 1.00 | 55.91 GZ00 C |
| ATOM | 1023 | CZ | PHE | C | 128 | 6.205 | 31.387 | 1.358 | 1.00 | 55.09 GZ00 C |
| ATOM | 1024 | N | PRO | C | 129 | 13.360 | 30.275 | 10.560 | 1.00 | 52.59 GZ00 N |
| ATOM | 1025 | CA | PRO | C | 129 | 14.779 | 30.230 | 10.200 | 1.00 | 40.71 GZ00 C |
| ATOM | 1026 | C | PRO | C | 129 | 14.975 | 30.363 | 8.705 | 1.00 | 44.60 GZ00 C |
| ATOM | 1027 | O | PRO | C | 129 | 14.205 | 29.819 | 7.907 | 1.00 | 48.43 GZ00 O |
| ATOM | 1028 | CB | PRO | C | 129 | 15.218 | 28.840 | 10.681 | 1.00 | 53.19 GZ00 C |
| ATOM | 1029 | CG | PRO | C | 129 | 13.998 | 28.000 | 10.486 | 1.00 | 46.32 GZ00 C |
| ATOM | 1030 | CD | PRO | C | 129 | 12.829 | 28.925 | 10.840 | 1.00 | 50.96 GZ00 C |
| ATOM | 1031 | N | LEU | C | 130 | 16.017 | 31.101 | 8.330 | 1.00 | 39.68 GZ00 N |
| ATOM | 1032 | CA | LEU | C | 130 | 16.463 | 31.190 | 6.947 | 1.00 | 38.79 GZ00 C |
| ATOM | 1033 | C | LEU | C | 130 | 17.725 | 30.330 | 6.838 | 1.00 | 45.86 GZ00 C |
| ATOM | 1034 | O | LEU | C | 130 | 18.834 | 30.778 | 7.150 | 1.00 | 44.51 GZ00 O |
| ATOM | 1035 | CB | LEU | C | 130 | 16.699 | 32.647 | 6.568 | 1.00 | 41.81 GZ00 C |
| ATOM | 1036 | CG | LEU | C | 130 | 15.436 | 33.491 | 6.795 | 1.00 | 45.70 GZ00 C |
| ATOM | 1037 | CD1 | LEU | C | 130 | 15639 | 34.968 | 6.444 | 1.00 | 40.24 GZ00 C |
| ATOM | 1038 | CD2 | LEU | C | 130 | 14.275 | 32.910 | 6.003 | 1.00 | 44.72 GZ00 C |
| ATOM | 1039 | N | ALA | C | 131 | 17.552 | 29.096 | 6.402 | 1.00 | 46.13 GZ00 N |
| ATOM | 1040 | CA | ALA | C | 131 | 18.618 | 28.113 | 6.528 | 1.00 | 43.66 GZ00 C |
| ATOM | 1041 | C | ALA | C | 131 | 19.672 | 28.301 | 5.441 | 1.00 | 44.63 GZ00 C |
| ATOM | 1042 | O | ALA | C | 131 | 19.339 | 28.524 | 4.278 | 1.00 | 46.42 GZ00 O |
| ATOM | 1043 | CB | ALA | C | 131 | 18.060 | 26.703 | 6.457 | 1.00 | 36.60 GZ00 C |
| ATOM | 1044 | N | PRO | C | 132 | 20.943 | 28.159 | 5.792 | 1.00 | 50.91 GZ00 N |
| ATOM | 1045 | CA | PRO | C | 132 | 22.009 | 28.205 | 4.784 | 1.00 | 52.92 GZ00 C |
| ATOM | 1046 | C | PRO | C | 132 | 22.027 | 26.951 | 3.921 | 1.00 | 63.10 GZ00 C |
| ATOM | 1047 | O | PRO | C | 132 | 21.557 | 25.876 | 4.315 | 1.00 | 65.83 GZ00 O |
| ATOM | 1048 | CB | PRO | C | 132 | 23.279 | 28.301 | 5.631 | 1.00 | 51.34 GZ00 C |
| ATOM | 1049 | CG | PRO | C | 132 | 22.910 | 27.548 | 6.901 | 1.00 | 47.48 GZ00 C |
| ATOM | 1050 | CD | PRO | C | 132 | 21.454 | 27.876 | 7.145 | 1.00 | 49.36 GZ00 C |
| ATOM | 1051 | N | SER | C | 133 | 22.606 | 27.103 | 2.724 | 1.00 | 65.77 GZ00 N |
| ATOM | 1052 | CA | SER | C | 133 | 22.642 | 26.041 | 1.718 | 1.00 | 75.34 GZ00 C |
| ATOM | 1053 | C | SER | C | 133 | 23.713 | 26.317 | 0.668 | 1.00 | 79.20 GZ00 C |
| ATOM | 1054 | O | SER | C | 133 | 24.893 | 26.462 | 0.990 | 1.00 | 81.66 GZ00 O |
| ATOM | 1055 | CB | SER | C | 133 | 21.272 | 25.900 | 1.043 | 1.00 | 74.63 GZ00 C |
| ATOM | 1056 | OG | SER | C | 133 | 20.727 | 27.170 | 0.711 | 1.00 | 72.62 GZ00 O |
| ATOM | 1057 | N | SER | C | 134 | 23.317 | 26.372 | −0.599 | 1.00 | 91.08 GZ00 N |

TABLE 10.3-continued

| | | | | | | | | | | |
|---|---|---|---|---|---|---|---|---|---|---|
| ATOM | 1058 | CA | SER | C | 134 | 24.136 | 27.032 | −1.612 | 1.00 | 84.25 | GZ00 C |
| ATOM | 1059 | C | SER | C | 134 | 23.720 | 28.503 | −1.692 | 1.00 | 85.59 | GZ00 C |
| ATOM | 1060 | O | SER | C | 134 | 23.292 | 29.031 | −2.718 | 1.00 | 89.34 | GZ00 O |
| ATOM | 1061 | CB | SER | C | 134 | 24.022 | 26.312 | −2.950 | 1.00 | 90.76 | GZ00 C |
| ATOM | 1062 | OG | SER | C | 134 | 24.604 | 25.016 | −2.867 | 1.00 | 71.01 | GZ00 O |
| ATOM | 1063 | N | SER | C | 136 | 23.766 | 29.125 | −0.514 | 1.00 | 87.58 | GZ00 N |
| ATOM | 1064 | CA | SER | C | 136 | 23.877 | 30.568 | −0.336 | 1.00 | 76.32 | GZ00 C |
| ATOM | 1065 | C | SER | C | 136 | 25.274 | 30.904 | 0.199 | 1.00 | 70.77 | GZ00 C |
| ATOM | 1066 | O | SER | C | 136 | 25.441 | 31.713 | 1.121 | 1.00 | 56.45 | GZ00 O |
| ATOM | 1067 | CB | SER | C | 136 | 22.777 | 31.098 | 0.588 | 1.00 | 64.27 | GZ00 C |
| ATOM | 1068 | OG | SER | C | 136 | 22.863 | 30.567 | 1.905 | 1.00 | 55.15 | GZ00 O |
| ATOM | 1069 | N | THR | C | 137 | 26.294 | 30.248 | −0.363 | 1.00 | 68.34 | GZ00 N |
| ATOM | 1070 | CA | THR | C | 137 | 27.686 | 30.490 | −0.008 | 1.00 | 69.91 | GZ00 C |
| ATOM | 1071 | C | THR | C | 137 | 28.416 | 31.190 | −1.157 | 1.00 | 67.19 | GZ00 C |
| ATOM | 1072 | O | THR | C | 137 | 28.180 | 30.891 | −2.332 | 1.00 | 69.81 | GZ00 O |
| ATOM | 1073 | CB | THR | C | 137 | 28.407 | 29.183 | 0.387 | 1.00 | 64.52 | GZ00 C |
| ATOM | 1074 | OG1 | THR | C | 137 | 29.096 | 28.626 | −0.739 | 1.00 | 77.04 | GZ00 O |
| ATOM | 1075 | CG2 | THR | C | 137 | 27.427 | 28.167 | 0.946 | 1.00 | 58.14 | GZ00 C |
| ATOM | 1076 | N | SER | C | 138 | 29.289 | 32.144 | −0.810 | 1.00 | 68.23 | GZ00 N |
| ATOM | 1077 | CA | SER | C | 138 | 30.030 | 32.950 | −1.784 | 1.00 | 66.23 | GZ00 C |
| ATOM | 1078 | C | SER | C | 138 | 31.526 | 32.891 | −1.454 | 1.00 | 65.41 | GZ00 C |
| ATOM | 1079 | O | SER | C | 138 | 32.054 | 33.661 | −0.629 | 1.00 | 62.93 | GZ00 O |
| ATOM | 1080 | CB | SER | C | 138 | 29.508 | 34.383 | −1.828 | 1.00 | 70.26 | GZ00 C |
| ATOM | 1081 | OG | SER | C | 138 | 29.183 | 34.732 | −3.162 | 1.00 | 77.29 | GZ00 O |
| ATOM | 1082 | N | GLY | C | 139 | 32.210 | 31.988 | −2.153 | 1.00 | 65.74 | GZ00 N |
| ATOM | 1083 | CA | GLY | C | 139 | 33.577 | 31.673 | −1.822 | 1.00 | 55.52 | GZ00 C |
| ATOM | 1084 | C | GLY | C | 139 | 33.581 | 30.952 | −0.495 | 1.00 | 52.92 | GZ00 C |
| ATOM | 1085 | O | GLY | C | 139 | 32.963 | 29.889 | −0.339 | 1.00 | 56.98 | GZ00 O |
| ATOM | 1086 | N | GLY | C | 140 | 34.241 | 31.550 | 0.483 | 1.00 | 39.11 | GZ00 N |
| ATOM | 1087 | CA | GLY | C | 140 | 34.394 | 30.917 | 1.767 | 1.00 | 37.84 | GZ00 C |
| ATOM | 1088 | C | GLY | C | 140 | 33.435 | 31.476 | 2.782 | 1.00 | 35.31 | GZ00 C |
| ATOM | 1089 | O | GLY | C | 140 | 33.686 | 31.410 | 3.987 | 1.00 | 35.90 | GZ00 O |
| ATOM | 1090 | N | THR | C | 141 | 32.312 | 31.990 | 2.314 | 1.00 | 30.60 | GZ00 N |
| ATOM | 1091 | CA | THR | C | 141 | 31.371 | 32.678 | 3.180 | 1.00 | 35.07 | GZ00 C |
| ATOM | 1092 | C | THR | C | 141 | 29.975 | 32.121 | 2.959 | 1.00 | 45.03 | GZ00 C |
| ATOM | 1093 | O | THR | C | 141 | 29.638 | 31.698 | 1.858 | 1.00 | 45.95 | GZ00 O |
| ATOM | 1094 | CB | THR | C | 141 | 31.469 | 34.196 | 2.898 | 1.00 | 34.50 | GZ00 C |
| ATOM | 1095 | OG1 | THR | C | 141 | 31.995 | 34.851 | 4.055 | 1.00 | 45.09 | GZ00 C |
| ATOM | 1096 | CG2 | THR | C | 141 | 30.182 | 34.807 | 2.446 | 1.00 | 40.84 | GZ00 C |
| ATOM | 1097 | N | ALA | C | 142 | 29.186 | 32.058 | 4.026 | 1.00 | 40.91 | GZ00 N |
| ATOM | 1098 | CA | ALA | C | 142 | 27.833 | 31.528 | 3.943 | 1.00 | 37.80 | GZ00 C |
| ATOM | 1099 | C | ALA | C | 142 | 26.893 | 32.457 | 4.683 | 1.00 | 34.33 | GZ00 C |
| ATOM | 1100 | O | ALA | C | 142 | 27.251 | 33.006 | 5.730 | 1.00 | 37.65 | GZ00 O |
| ATOM | 1101 | CB | ALA | C | 142 | 27.729 | 30.125 | 4.539 | 1.00 | 37.82 | GZ00 C |
| ATOM | 1102 | N | ALA | C | 143 | 25.685 | 32.608 | 4.148 | 1.00 | 31.94 | GZ00 N |
| ATOM | 1103 | CA | ALA | C | 143 | 24.649 | 33.451 | 4.731 | 1.00 | 31.30 | GZ00 C |
| ATOM | 1104 | C | ALA | C | 143 | 23.527 | 32.602 | 5.324 | 1.00 | 38.60 | GZ00 C |
| ATOM | 1105 | O | ALA | C | 143 | 23.079 | 31.624 | 4.715 | 1.00 | 36.49 | GZ00 O |
| ATOM | 1106 | CB | ALA | C | 143 | 24.062 | 34.401 | 3.689 | 1.00 | 33.71 | GZ00 C |
| ATOM | 1107 | N | LEU | C | 144 | 23.099 | 32.976 | 6.529 | 1.00 | 37.05 | GZ00 N |
| ATOM | 1108 | CA | LEU | C | 144 | 21.975 | 32.361 | 7.208 | 1.00 | 40.29 | GZ00 C |
| ATOM | 1109 | C | LEU | C | 144 | 21.227 | 33.458 | 7.957 | 1.00 | 40.87 | GZ00 C |
| ATOM | 1110 | O | LEU | C | 144 | 21.800 | 34.504 | 8.281 | 1.00 | 41.49 | GZ00 O |
| ATOM | 1111 | CB | LEU | C | 144 | 22.463 | 31.247 | 8.144 | 1.00 | 42.35 | GZ00 C |
| ATOM | 1112 | CG | LEU | C | 144 | 23.403 | 31.747 | 9.239 | 1.00 | 47.05 | GZ00 C |
| ATOM | 1113 | CD1 | LEU | C | 144 | 22.647 | 31.926 | 10.545 | 1.00 | 49.65 | GZ00 C |
| ATOM | 1114 | CD2 | LEU | C | 144 | 24.583 | 30.834 | 9.410 | 1.00 | 40.72 | GZ00 C |
| ATOM | 1115 | N | GLY | C | 145 | 19.949 | 33.219 | 8.252 | 1.00 | 37.19 | GZ00 N |
| ATOM | 1116 | CA | GLY | C | 145 | 19.181 | 34.289 | 8.851 | 1.00 | 39.70 | GZ00 C |
| ATOM | 1117 | C | GLY | C | 145 | 17.884 | 33.886 | 9.522 | 1.00 | 40.16 | GZ00 C |
| ATOM | 1118 | O | GLY | C | 145 | 17.574 | 32.702 | 9.685 | 1.00 | 44.79 | GZ00 O |
| ATOM | 1119 | N | CYS | C | 146 | 17.133 | 34.916 | 9.910 | 1.00 | 38.48 | GZ00 N |
| ATOM | 1120 | CA | CYS | C | 146 | 15.879 | 34.810 | 10.641 | 1.00 | 40.61 | GZ00 C |
| ATOM | 1121 | C | CYS | C | 146 | 14.846 | 35.719 | 9.998 | 1.00 | 48.21 | GZ00 C |
| ATOM | 1122 | O | CYS | C | 146 | 15.099 | 36.916 | 9.820 | 1.00 | 41.15 | GZ00 O |
| ATOM | 1123 | CB | CYS | C | 146 | 16.058 | 35.212 | 12.114 | 1.00 | 36.30 | GZ00 C |
| ATOM | 1124 | SG | CYS | C | 146 | 16.447 | 33.783 | 13.156 | 1.00 | 70.07 | GZ00 S |
| ATOM | 1125 | N | LEU | C | 147 | 13.679 | 35.163 | 9.688 | 1.00 | 47.77 | GZ00 N |
| ATOM | 1126 | CA | LEU | C | 147 | 12.549 | 35.928 | 9.168 | 1.00 | 37.79 | GZ00 C |
| ATOM | 1127 | C | LEU | C | 147 | 11.641 | 36.320 | 10.333 | 1.00 | 45.95 | GZ00 C |
| ATOM | 1128 | O | LEU | C | 147 | 11.217 | 35.458 | 11.112 | 1.00 | 45.78 | GZ00 O |
| ATOM | 1129 | CB | LEU | C | 147 | 11.786 | 35.101 | 8.140 | 1.00 | 39.44 | GZ00 C |
| ATOM | 1130 | CG | LEU | C | 147 | 10.457 | 35.637 | 7.600 | 1.00 | 42.29 | GZ00 C |
| ATOM | 1131 | CD1 | LEU | C | 147 | 10.605 | 37.010 | 6.924 | 1.00 | 35.22 | GZ00 C |
| ATOM | 1132 | CD2 | LEU | C | 147 | 9.902 | 34.623 | 6.626 | 1.00 | 41.37 | GZ00 C |
| ATOM | 1133 | N | VAL | C | 148 | 11.392 | 37.614 | 10.493 | 1.00 | 36.60 | GZ00 N |
| ATOM | 1134 | CA | VAL | C | 148 | 10.604 | 38.136 | 11.607 | 1.00 | 39.69 | GZ00 C |
| ATOM | 1135 | C | VAL | C | 148 | 9.309 | 38.707 | 11.027 | 1.00 | 47.33 | GZ00 C |
| ATOM | 1136 | O | VAL | C | 148 | 9.266 | 39.872 | 10.617 | 1.00 | 45.03 | GZ00 O |
| ATOM | 1137 | CB | VAL | C | 148 | 11.375 | 39.192 | 12.409 | 1.00 | 42.14 | GZ00 C |

TABLE 10.3-continued

| ATOM | 1138 | CG1 | VAL | C | 148 | 10.549 | 39.661 | 13.557 | 1.00 | 34.51 | GZ00 C |
| --- | --- | --- | --- | --- | --- | --- | --- | --- | --- | --- | --- |
| ATOM | 1139 | CG2 | VAL | C | 148 | 12.701 | 38.631 | 12.933 | 1.00 | 38.14 | GZ00 C |
| ATOM | 1140 | N | LYS | C | 149 | 8.226 | 37.923 | 11.045 | 1.00 | 47.26 | GZ00 N |
| ATOM | 1141 | CA | LYS | C | 149 | 7.039 | 38.205 | 10.244 | 1.00 | 49.61 | GZ00 C |
| ATOM | 1142 | C | LYS | C | 149 | 5.887 | 38.797 | 11.059 | 1.00 | 48.25 | GZ00 C |
| ATOM | 1143 | O | LYS | C | 149 | 5.698 | 38.455 | 12.228 | 1.00 | 50.60 | GZ00 O |
| ATOM | 1144 | CB | LYS | C | 149 | 6.563 | 36.933 | 9.547 | 1.00 | 49.65 | GZ00 C |
| ATOM | 1145 | CG | LYS | C | 149 | 6.317 | 37.131 | 8.074 | 1.00 | 60.63 | GZ00 C |
| ATOM | 1146 | CD | LYS | C | 149 | 5.120 | 36.330 | 7.579 | 1.00 | 59.80 | GZ00 C |
| ATOM | 1147 | CE | LYS | C | 149 | 5.405 | 34.849 | 7.597 | 1.00 | 63.78 | GZ00 C |
| ATOM | 1148 | NZ | LYS | C | 149 | 4.321 | 34.077 | 6.887 | 1.00 | 62.06 | GZ00 N1+ |
| ATOM | 1149 | N | ASP | C | 150 | 5.154 | 39.729 | 10.430 | 1.00 | 52.54 | GZ00 N |
| ATOM | 1150 | CA | ASP | C | 150 | 3.795 | 40.160 | 10.809 | 1.00 | 43.96 | GZ00 C |
| ATOM | 1151 | C | ASP | C | 150 | 3.707 | 40.710 | 12.236 | 1.00 | 45.35 | GZ00 C |
| ATOM | 1152 | O | ASP | C | 150 | 2.955 | 40.200 | 13.068 | 1.00 | 47.95 | GZ00 O |
| ATOM | 1153 | CB | ASP | C | 150 | 2.782 | 39.021 | 10.633 | 1.00 | 43.67 | GZ00 C |
| ATOM | 1154 | CG | ASP | C | 150 | 2.587 | 38.624 | 9.190 | 1.00 | 49.50 | GZ00 C |
| ATOM | 1155 | OD1 | ASP | C | 150 | 2.874 | 39.436 | 8.284 | 1.00 | 47.60 | GZ00 O |
| ATOM | 1156 | OD2 | ASP | C | 150 | 2.133 | 37.486 | 8.957 | 1.00 | 63.54 | GZ00 O1− |
| ATOM | 1157 | N | TYR | C | 151 | 4.437 | 41.792 | 12.498 | 1.00 | 38.78 | GZ00 N |
| ATOM | 1158 | CA | TYR | C | 151 | 4.395 | 42.435 | 13.802 | 1.00 | 42.10 | GZ00 C |
| ATOM | 1159 | C | TYR | C | 151 | 4.012 | 43.911 | 13.689 | 1.00 | 41.99 | GZ00 C |
| ATOM | 1160 | O | TYR | C | 151 | 4.115 | 44.534 | 12.628 | 1.00 | 46.82 | GZ00 O |
| ATOM | 1161 | CB | TYR | C | 151 | 5.751 | 42.308 | 14.529 | 1.00 | 46.66 | GZ00 C |
| ATOM | 1162 | CG | TYR | C | 151 | 6.892 | 43.080 | 13.890 | 1.00 | 45.23 | GZ00 C |
| ATOM | 1163 | CF1 | TYR | C | 151 | 7.665 | 42.517 | 12.871 | 1.00 | 43.89 | GZ00 C |
| ATOM | 1164 | CD2 | TYR | C | 151 | 7.206 | 44.366 | 14.317 | 1.00 | 45.36 | GZ00 C |
| ATOM | 1165 | CE1 | TYR | C | 151 | 8.726 | 43.223 | 12.280 | 1.00 | 43.44 | GZ00 C |
| ATOM | 1166 | CE2 | TYR | C | 151 | 8.259 | 45.082 | 13.739 | 1.00 | 52.49 | GZ00 C |
| ATOM | 1167 | CZ | TYR | C | 151 | 9.018 | 44.504 | 12.721 | 1.00 | 50.42 | GZ00 C |
| ATOM | 1168 | OH | TYR | C | 151 | 10.045 | 45.224 | 12.149 | 1.00 | 41.96 | GZ00 O |
| ATOM | 1169 | N | PHE | C | 152 | 3.617 | 44.474 | 14.824 | 1.00 | 40.95 | GZ00 N |
| ATOM | 1170 | CA | PHE | C | 152 | 3.224 | 45.868 | 14.926 | 1.00 | 45.04 | GZ00 C |
| ATOM | 1171 | C | PHE | C | 152 | 3.209 | 46.273 | 16.388 | 1.00 | 42.56 | GZ00 C |
| ATOM | 1172 | O | PHE | C | 152 | 2.802 | 45.496 | 17.235 | 1.00 | 45.01 | GZ00 O |
| ATOM | 1173 | CB | PHE | C | 152 | 1.847 | 46.113 | 14.294 | 1.00 | 47.75 | GZ00 C |
| ATOM | 1174 | CG | PHE | C | 152 | 1.465 | 47.558 | 14.260 | 1.00 | 48.38 | GZ00 C |
| ATOM | 1175 | CD1 | PHE | C | 152 | 0.824 | 48.148 | 15.339 | 1.00 | 48.32 | GZ00 C |
| ATOM | 1176 | CD2 | PHE | C | 152 | 1.783 | 48.342 | 13.167 | 1.00 | 51.92 | GZ00 C |
| ATOM | 1177 | CE1 | PHE | C | 152 | 0.510 | 49.493 | 15.322 | 1.00 | 46.78 | GZ00 C |
| ATOM | 1178 | CE2 | PHE | C | 152 | 1.451 | 49.693 | 13.144 | 1.00 | 49.11 | GZ00 C |
| ATOM | 1179 | CZ | PHE | C | 152 | 0.824 | 50.262 | 14.228 | 1.00 | 41.05 | GZ00 C |
| ATOM | 1180 | N | PRO | C | 153 | 3.698 | 47.479 | 16.702 | 1.00 | 42.68 | GZ00 N |
| ATOM | 1181 | CA | PRO | C | 153 | 4.419 | 48.428 | 15.848 | 1.00 | 52.96 | GZ00 C |
| ATOM | 1182 | C | PRO | C | 153 | 5.930 | 48.163 | 15.829 | 1.00 | 52.60 | GZ00 C |
| ATOM | 1183 | O | PRO | C | 153 | 6.398 | 47.155 | 16.353 | 1.00 | 54.71 | GZ00 O |
| ATOM | 1184 | CB | PRO | C | 153 | 4.152 | 49.766 | 16.532 | 1.00 | 43.17 | GZ00 C |
| ATOM | 1185 | CG | PRO | C | 153 | 4.224 | 49.393 | 17.978 | 1.00 | 39.59 | GZ00 C |
| ATOM | 1186 | CD | PRO | C | 153 | 3.545 | 48.016 | 18.065 | 1.00 | 40.76 | GZ00 C |
| ATOM | 1187 | N | GLU | C | 154 | 6.682 | 49.068 | 15.220 | 1.00 | 50.80 | GZ00 N |
| ATOM | 1188 | CA | GLU | C | 154 | 8.130 | 49.012 | 15.287 | 1.00 | 47.84 | GZ00 C |
| ATOM | 1189 | C | GLU | C | 154 | 8.530 | 49.382 | 16.706 | 1.00 | 45.65 | GZ00 C |
| ATOM | 1190 | O | GLU | C | 154 | 7.755 | 49.990 | 17.417 | 1.00 | 48.79 | GZ00 O |
| ATOM | 1191 | CB | GLU | C | 154 | 8.749 | 49.958 | 14.264 | 1.00 | 45.04 | GZ00 C |
| ATOM | 1192 | CG | GLU | C | 154 | 8.425 | 49.586 | 12.831 | 1.00 | 49.34 | GZ00 C |
| ATOM | 1193 | CD | GLU | C | 154 | 9.635 | 49.012 | 12.119 | 1.00 | 59.99 | GZ00 C |
| ATOM | 1194 | OE1 | GLU | C | 154 | 10.114 | 49.663 | 11.168 | 1.00 | 58.68 | GZ00 O |
| ATOM | 1195 | OE2 | GLU | C | 154 | 10.120 | 47.929 | 12.535 | 1.00 | 57.95 | GZ00 O1− |
| ATOM | 1196 | N | PRO | C | 155 | 9.737 | 49.006 | 17.137 | 1.00 | 50.54 | GZ00 N |
| ATOM | 1197 | CA | PRO | C | 155 | 10.755 | 48.195 | 16.472 | 1.00 | 44.50 | GZ00 C |
| ATOM | 1198 | C | PRO | C | 155 | 10.803 | 46.753 | 16.983 | 1.00 | 53.89 | GZ00 C |
| ATOM | 1199 | O | PRO | C | 155 | 10.174 | 46.436 | 17.999 | 1.00 | 55.35 | GZ00 O |
| ATOM | 1200 | CB | PRO | C | 155 | 12.031 | 48.921 | 16.845 | 1.00 | 44.74 | GZ00 C |
| ATOM | 1201 | CG | PRO | C | 155 | 11.773 | 49.333 | 18.257 | 1.00 | 44.99 | GZ00 C |
| ATOM | 1202 | CD | PRO | C | 155 | 10.279 | 49.641 | 18.350 | 1.00 | 39.64 | GZ00 C |
| ATOM | 1203 | N | VAL | C | 156 | 11.530 | 45.887 | 16.278 | 1.00 | 45.82 | GZ00 N |
| ATOM | 1204 | CA | VAL | C | 156 | 12.054 | 44.666 | 16.870 | 1.00 | 55.31 | GZ00 C |
| ATOM | 1205 | C | VAL | C | 156 | 13.562 | 44.814 | 16.945 | 1.00 | 52.03 | GZ00 C |
| ATOM | 1206 | O | VAL | C | 156 | 14.183 | 45.530 | 16.153 | 1.00 | 55.45 | GZ00 O |
| ATOM | 1207 | CB | VAL | C | 156 | 11.698 | 43.375 | 16.105 | 1.00 | 52.00 | GZ00 C |
| ATOM | 1208 | CG1 | VAL | C | 156 | 10.204 | 43.139 | 16.092 | 1.00 | 51.44 | GZ00 C |
| ATOM | 1209 | CG2 | VAL | C | 156 | 12.231 | 43.446 | 14.719 | 1.00 | 48.82 | GZ00 C |
| ATOM | 1210 | N | THR | C | 157 | 14.153 | 44.146 | 17.919 | 1.00 | 53.96 | GZ00 N |
| ATOM | 1211 | CA | THR | C | 157 | 15.596 | 44.007 | 17.989 | 1.00 | 54.98 | GZ00 C |
| ATOM | 1212 | C | THR | C | 157 | 15.949 | 42.554 | 17.732 | 1.00 | 54.62 | GZ00 C |
| ATOM | 1213 | O | THR | C | 157 | 15.221 | 41.644 | 18.142 | 1.00 | 54.87 | GZ00 O |
| ATOM | 1214 | CB | THR | C | 157 | 16.140 | 44.458 | 19.341 | 1.00 | 45.77 | GZ00 C |
| ATOM | 1215 | OG1 | THR | C | 157 | 15.663 | 43.570 | 20.361 | 1.00 | 57.07 | GZ00 O |
| ATOM | 1216 | CG2 | THR | C | 157 | 15.691 | 45.877 | 19.627 | 1.00 | 51.52 | GZ00 C |
| ATOM | 1217 | N | VAL | C | 158 | 17.042 | 42.345 | 17.015 | 1.00 | 51.30 | GZ00 N |

TABLE 10.3-continued

| ATOM | 1218 | CA | VAL | C | 158 | 17.521 | 41.010 | 16.706 | 1.00 | 47.26 | GZ00 C |
|---|---|---|---|---|---|---|---|---|---|---|---|
| ATOM | 1219 | C | VAL | C | 158 | 18.988 | 40.957 | 17.085 | 1.00 | 50.93 | GZ00 C |
| ATOM | 1220 | O | VAL | C | 158 | 19.767 | 41.833 | 16.92 | 1.00 | 49.49 | GZ00 O |
| ATOM | 1221 | CB | VAL | C | 158 | 17.343 | 40.660 | 15.219 | 1.00 | 46.28 | GZ00 C |
| ATOM | 1222 | CG1 | VAL | C | 158 | 17.733 | 39.213 | 14.986 | 1.00 | 46.68 | GZ00 C |
| ATOM | 1223 | CG2 | VAL | C | 158 | 15.911 | 40.951 | 14.752 | 1.00 | 43.16 | GZ00 C |
| ATOM | 1224 | N | SER | C | 159 | 19.361 | 39.943 | 17.850 | 1.00 | 51.31 | GZ00 N |
| ATOM | 1225 | CA | SER | C | 159 | 20.756 | 39.667 | 18.134 | 1.00 | 44.21 | GZ00 C |
| ATOM | 1226 | C | SER | C | 159 | 21.001 | 38.215 | 17.769 | 1.00 | 45.69 | GZ00 C |
| ATOM | 1227 | O | SER | C | 159 | 20.063 | 37.437 | 17.578 | 1.00 | 44.40 | GZ00 O |
| ATOM | 1218 | CB | SER | C | 159 | 21.126 | 39.946 | 19.605 | 1.00 | 39.33 | GZ00 C |
| ATOM | 1229 | OG | SER | C | 159 | 20.384 | 39.132 | 20.511 | 1.00 | 48.22 | GZ00 O |
| ATOM | 1230 | N | TRP | C | 160 | 22.270 | 37.863 | 17.648 | 1.00 | 44.65 | GZ00 N |
| ATOM | 1231 | CA | TRP | C | 160 | 22.671 | 36.505 | 17.332 | 1.00 | 38.87 | GZ00 C |
| ATOM | 1232 | C | TRP | C | 160 | 23.533 | 35.984 | 18.468 | 1.00 | 43.64 | GZ00 C |
| ATOM | 1233 | O | TRP | C | 160 | 24.351 | 36.729 | 19.025 | 1.00 | 42.33 | GZ00 O |
| ATOM | 1234 | CB | TRP | C | 160 | 23.420 | 36.436 | 15.998 | 1.00 | 36.78 | GZ00 C |
| ATOM | 1235 | CG | TRP | C | 160 | 22.520 | 36.662 | 14.945 | 1.00 | 41.44 | GZ00 C |
| ATOM | 1236 | CD1 | TRP | C | 160 | 22.178 | 37.861 | 14.294 | 1.00 | 39.79 | GZ00 C |
| ATOM | 1237 | CD2 | TRP | C | 160 | 21.786 | 35.664 | 14.123 | 1.00 | 40.51 | GZ00 C |
| ATOM | 1238 | NE1 | TRP | C | 160 | 21.304 | 37.671 | 13.245 | 1.00 | 37.10 | GZ00 N |
| ATOM | 1239 | CE2 | TRP | C | 160 | 21.038 | 36.335 | 13.125 | 1.00 | 36.83 | GZ00 C |
| ATOM | 1240 | CE3 | TRP | C | 160 | 21.695 | 34.270 | 14.216 | 1.00 | 38.13 | GZ00 C |
| ATOM | 1241 | CZ2 | TRP | C | 160 | 20.209 | 35.662 | 12.228 | 1.00 | 37.10 | GZ00 C |
| ATOM | 1242 | CZ3 | TRP | C | 160 | 20.878 | 33.596 | 13.314 | 1.00 | 42.58 | GZ00 C |
| ATOM | 1243 | CH2 | TRP | C | 160 | 20.142 | 34.294 | 12.336 | 1.00 | 43.28 | GZ00 C |
| ATOM | 1244 | N | ASN | C | 161 | 23.291 | 34.718 | 18.825 | 1.00 | 41.18 | GZ00 N |
| ATOM | 1245 | CA | ASN | C | 161 | 23.956 | 34.018 | 19.929 | 1.00 | 45.75 | GZ00 C |
| ATOM | 1246 | C | ASN | C | 161 | 24.057 | 34.898 | 21.169 | 1.00 | 45.89 | GZ00 C |
| ATOM | 1247 | O | ASN | C | 161 | 25.123 | 35.079 | 21.763 | 1.00 | 49.59 | GZ00 O |
| ATOM | 1248 | CB | ASN | C | 161 | 25.315 | 33.479 | 19.496 | 1.00 | 36.85 | GZ00 C |
| ATOM | 1249 | CG | ASN | C | 161 | 25.181 | 32.440 | 18.399 | 1.00 | 44.50 | GZ00 C |
| ATOM | 1250 | OD1 | ASN | C | 161 | 24.067 | 32.010 | 18.062 | 1.00 | 46.14 | GZ00 O |
| ATOM | 1251 | ND2 | ASN | C | 161 | 26.306 | 31.997 | 17.865 | 1.00 | 43.54 | GZ00 N |
| ATOM | 1252 | N | SER | C | 162 | 22.918 | 35.503 | 21.508 | 1.00 | 46.88 | GZ00 N |
| ATOM | 1253 | CA | SER | C | 162 | 22.740 | 36.290 | 22.727 | 1.00 | 43.45 | GZ00 C |
| ATOM | 1254 | C | SER | C | 162 | 23.687 | 37.476 | 22.784 | 1.00 | 47.59 | GZ00 C |
| ATOM | 1255 | O | SER | C | 162 | 24.110 | 37.883 | 23.866 | 1.00 | 49.00 | GZ00 O |
| ATOM | 1256 | CB | SER | C | 162 | 22.879 | 35.412 | 23.972 | 1.00 | 38.83 | GZ00 C |
| ATOM | 1257 | OG | SER | C | 162 | 22.029 | 34.280 | 23.821 | 1.00 | 48.75 | GZ00 O |
| ATOM | 1258 | N | GLY | C | 163 | 24.028 | 38.040 | 21.622 | 1.00 | 48.38 | GZ00 N |
| ATOM | 1259 | CA | GLY | C | 163 | 24.887 | 39.205 | 21.551 | 1.00 | 40.94 | GZ00 C |
| ATOM | 1260 | C | GLY | C | 163 | 26.359 | 38.927 | 21.292 | 1.00 | 53.03 | GZ00 C |
| ATOM | 1261 | O | GLY | C | 163 | 27.105 | 39.878 | 20.999 | 1.00 | 49.49 | GZ00 O |
| ATOM | 1262 | N | ALA | C | 164 | 26.804 | 37.665 | 21.374 | 1.00 | 39.35 | GZ00 N |
| ATOM | 1263 | CA | ALA | C | 164 | 28.227 | 37.381 | 21.179 | 1.00 | 50.46 | GZ00 C |
| ATOM | 1264 | C | ALA | C | 164 | 28.658 | 37.609 | 19.732 | 1.00 | 52.21 | GZ00 C |
| ATOM | 1265 | O | ALA | C | 164 | 29.776 | 38.077 | 19.475 | 1.00 | 52.82 | GZ00 O |
| ATOM | 1266 | CB | ALA | C | 164 | 28.544 | 35.947 | 21.599 | 1.00 | 41.14 | GZ00 C |
| ATOM | 1267 | N | LEU | C | 165 | 27.793 | 37.267 | 18.780 | 1.00 | 42.69 | GZ00 N |
| ATOM | 1268 | CA | LEU | C | 165 | 28.085 | 37.349 | 17.355 | 1.00 | 43.42 | GZ00 C |
| ATOM | 1269 | C | LEU | C | 165 | 27.513 | 38.653 | 16.821 | 1.00 | 44.45 | GZ00 C |
| ATOM | 1270 | O | LEU | C | 165 | 26.292 | 38.824 | 16.778 | 1.00 | 55.89 | GZ00 O |
| ATOM | 1271 | CB | LEU | C | 165 | 27.476 | 36.152 | 16.631 | 1.00 | 43.81 | GZ00 C |
| ATOM | 1272 | CG | LEU | C | 165 | 27.622 | 36.030 | 15.125 | 1.00 | 44.99 | GZ00 C |
| ATOM | 1273 | CD1 | LEU | C | 165 | 29.090 | 36.095 | 14.649 | 1.00 | 39.41 | GZ00 C |
| ATOM | 1274 | CD2 | LEU | C | 165 | 26.958 | 34.734 | 14.708 | 1.00 | 42.07 | GZ00 C |
| ATOM | 1275 | N | THR | C | 166 | 28.389 | 39.563 | 16.411 | 1.00 | 43.67 | GZ00 N |
| ATOM | 1276 | CA | THR | C | 166 | 28.013 | 40.872 | 15.890 | 1.00 | 50.96 | GZ00 C |
| ATOM | 1277 | C | THR | C | 166 | 28.621 | 41.169 | 14.521 | 1.00 | 48.02 | GZ00 C |
| ATOM | 1278 | O | THR | C | 166 | 27.950 | 41.770 | 13.676 | 1.00 | 46.23 | GZ00 O |
| ATOM | 1279 | CB | THR | C | 166 | 28.415 | 41.954 | 16.912 | 1.00 | 52.37 | GZ00 C |
| ATOM | 1280 | OG1 | THR | C | 166 | 29.835 | 41.950 | 17.073 | 1.00 | 48.81 | GZ00 C |
| ATOM | 1281 | CG2 | THR | C | 166 | 27.770 | 41.663 | 18.271 | 1.00 | 45.85 | GZ00 C |
| ATOM | 1282 | N | SER | C | 167 | 29.856 | 40.736 | 14.268 | 1.00 | 44.72 | GZ00 N |
| ATOM | 1283 | CA | SER | C | 167 | 30.445 | 40.880 | 12.941 | 1.00 | 46.25 | GZ00 C |
| ATOM | 1284 | C | SER | C | 167 | 29.673 | 40.045 | 11.937 | 1.00 | 42.05 | GZ00 C |
| ATOM | 1285 | O | SER | C | 167 | 29.319 | 38.894 | 12.201 | 1.00 | 43.05 | GZ00 O |
| ATOM | 1286 | CB | SER | C | 167 | 31.909 | 40.437 | 12.933 | 1.00 | 39.29 | GZ00 C |
| ATOM | 1287 | OG | SER | C | 167 | 32.675 | 41.320 | 13.706 | 1.00 | 49.43 | GZ00 O |
| ATOM | 1288 | N | GLY | C | 168 | 29.424 | 40.629 | 10.779 | 1.00 | 39.63 | GZ00 N |
| ATOM | 1289 | CA | GLY | C | 168 | 28.689 | 39.955 | 9.740 | 1.00 | 37.44 | GZ00 C |
| ATOM | 1290 | C | GLY | C | 168 | 27.189 | 39.958 | 9.919 | 1.00 | 39.53 | GZ00 C |
| ATOM | 1291 | O | GLY | C | 168 | 26.500 | 39.304 | 9.131 | 1.00 | 41.74 | GZ00 O |
| ATOM | 1292 | N | VAL | C | 169 | 26.653 | 40.702 | 10.893 | 1.00 | 37.21 | GZ00 N |
| ATOM | 1293 | CA | VAL | C | 169 | 25.219 | 40.711 | 11.158 | 1.00 | 39.62 | GZ00 C |
| ATOM | 1294 | C | VAL | C | 169 | 24.583 | 41.858 | 10.391 | 1.00 | 34.91 | GZ00 C |
| ATOM | 1295 | O | VAL | C | 169 | 24.991 | 43.010 | 10.529 | 1.00 | 35.65 | GZ00 O |
| ATOM | 1296 | CB | VAL | C | 169 | 24.921 | 40.858 | 12.660 | 1.000 | 42.01 | GZ00 C |
| ATOM | 1297 | CG1 | VAL | C | 169 | 23.404 | 41.063 | 12.867 | 1.00 | 36.86 | GZ00 C |

TABLE 10.3-continued

| ATOM | 1298 | CG2 | VAL | C | 169 | 25.410 | 39.673 | 13.434 | 1.00 | 42.36 | GZ00 C |
|---|---|---|---|---|---|---|---|---|---|---|---|
| ATOM | 1299 | N | HIS | C | 170 | 23.545 | 41.564 | 9.630 | 1.00 | 37.60 | GZ00 N |
| ATOM | 1300 | CA | HIS | C | 170 | 22.842 | 42.603 | 8.889 | 1.00 | 37.31 | GZ00 C |
| ATOM | 1301 | C | HIS | C | 170 | 21.345 | 42.438 | 9.134 | 1.00 | 37.74 | GZ00 C |
| ATOM | 1302 | O | HIS | C | 170 | 20.704 | 41.559 | 8.554 | 1.00 | 38.41 | GZ00 O |
| ATOM | 1303 | CB | HIS | C | 170 | 23.180 | 42.538 | 7.406 | 1.00 | 34.76 | GZ00 C |
| ATOM | 1304 | CG | HIS | C | 170 | 22.719 | 43.735 | 6.634 | 1.00 | 43.07 | GZ00 C |
| ATOM | 1305 | ND1 | HIS | C | 170 | 22.966 | 43.897 | 5.287 | 1.00 | 43.71 | GZ00 N |
| ATOM | 1306 | CD2 | HIS | C | 170 | 22.022 | 44.830 | 7.023 | 1.00 | 40.56 | GZ00 C |
| ATOM | 1307 | CE1 | HIS | C | 170 | 22.453 | 45.045 | 4.883 | 1.00 | 45.93 | GZ00 C |
| ATOM | 1308 | NE2 | HIS | C | 170 | 21.866 | 45.626 | 5.915 | 1.00 | 45.52 | GZ00 N |
| ATOM | 1309 | N | THR | C | 171 | 20.787 | 43.270 | 10.006 | 1.00 | 40.13 | GZ00 N |
| ATOM | 1310 | CA | THR | C | 171 | 19.342 | 43.337 | 10.182 | 1.00 | 39.22 | GZ00 C |
| ATOM | 1311 | C | THR | C | 171 | 18.800 | 44.400 | 9.230 | 1.00 | 39.29 | GZ00 C |
| ATOM | 1312 | O | THR | C | 171 | 19.079 | 45.581 | 9.404 | 1.00 | 36.69 | GZ00 O |
| ATOM | 1313 | CB | THR | C | 171 | 18.984 | 43.680 | 11.629 | 1.00 | 39.31 | GZ00 C |
| ATOM | 1314 | OG1 | THR | C | 171 | 19.473 | 42.647 | 12.494 | 1.00 | 41.01 | GZ00 O |
| ATOM | 1315 | CG2 | THR | C | 171 | 17.445 | 43.812 | 11.801 | 1.00 | 33.43 | GZ00 C |
| ATOM | 1316 | N | PHE | C | 172 | 17.989 | 43.982 | 8.262 | 1.00 | 38.72 | GZ00 N |
| ATOM | 1317 | CA | PHE | C | 172 | 17.457 | 44.839 | 7.215 | 1.00 | 38.37 | GZ00 C |
| ATOM | 1318 | C | PHE | C | 172 | 16.263 | 45.638 | 7.728 | 1.00 | 39.77 | GZ00 C |
| ATOM | 1319 | O | PHE | C | 172 | 15.478 | 45.140 | 8.537 | 1.00 | 41.83 | GZ00 O |
| ATOM | 1320 | CB | PHE | C | 172 | 16.990 | 44.017 | 6.013 | 1.00 | 35.77 | GZ00 C |
| ATOM | 1321 | CG | PHE | C | 172 | 18.092 | 43.449 | 5.195 | 1.00 | 34.43 | GZ00 C |
| ATOM | 1322 | CD1 | PHE | C | 172 | 18.884 | 42.416 | 5.679 | 1.00 | 40.25 | GZ00 C |
| ATOM | 1323 | CD2 | PHE | C | 172 | 18.354 | 43.957 | 3.936 | 1.00 | 40.94 | GZ00 C |
| ATOM | 1324 | CE1 | PHE | C | 172 | 19.914 | 41.886 | 4.906 | 1.00 | 37.45 | GZ00 C |
| ATOM | 1325 | CE2 | PHE | C | 172 | 19.389 | 43.434 | 3.162 | 1.00 | 43.89 | GZ00 C |
| ATOM | 1326 | CZ | PHE | C | 172 | 20.164 | 42.395 | 3.650 | 1.00 | 36.64 | GZ00 C |
| ATOM | 1327 | N | PRO | C | 173 | 16.092 | 46.871 | 7.252 | 1.00 | 37.95 | GZ00 N |
| ATOM | 1328 | CA | PRO | C | 173 | 14.883 | 47.639 | 7.596 | 1.00 | 33.97 | GZ00 C |
| ATOM | 1329 | C | PRO | C | 173 | 13.616 | 46.905 | 7.173 | 1.00 | 35.10 | GZ00 C |
| ATOM | 1330 | O | PRO | C | 173 | 13.585 | 46.195 | 6.163 | 1.00 | 33.25 | GZ00 O |
| ATOM | 1331 | CB | PRO | C | 173 | 15.064 | 48.945 | 6.817 | 1.00 | 35.19 | GZ00 C |
| ATOM | 1332 | CG | PRO | C | 173 | 16.573 | 49.046 | 6.616 | 1.00 | 34.04 | GZ00 C |
| ATOM | 1333 | CD | PRO | C | 173 | 17.049 | 47.638 | 6.441 | 1.00 | 32.78 | GZ00 C |
| ATOM | 1334 | N | ALA | C | 174 | 12.550 | 47.109 | 7.945 | 1.00 | 39.15 | GZ00 N |
| ATOM | 1335 | CA | ALA | C | 174 | 11.316 | 46.339 | 7.783 | 1.00 | 39.81 | GZ00 C |
| ATOM | 1336 | C | ALA | C | 174 | 10.533 | 46.750 | 6.532 | 1.00 | 35.98 | GZ00 C |
| ATOM | 1337 | O | ALA | C | 174 | 10.677 | 47.856 | 6.028 | 1.00 | 39.58 | GZ00 O |
| ATOM | 1338 | CB | ALA | C | 174 | 10.432 | 46.527 | 9.013 | 1.00 | 43.39 | GZ00 C |
| ATOM | 1339 | N | VAL | C | 175 | 9.686 | 45.824 | 6.013 | 1.00 | 38.79 | GZ00 N |
| ATOM | 1340 | CA | VAL | C | 175 | 8.639 | 46.209 | 5.066 | 1.00 | 39.33 | GZ00 C |
| ATOM | 1341 | C | VAL | C | 175 | 7.400 | 46.592 | 5.844 | 1.00 | 44.21 | GZ00 C |
| ATOM | 1342 | O | VAL | C | 175 | 7.056 | 45.957 | 6.847 | 1.00 | 43.28 | GZ00 O |
| ATOM | 1343 | CB | VAL | C | 175 | 8.256 | 45.087 | 4.084 | 1.00 | 50.56 | GZ00 C |
| ATOM | 1344 | CG1 | VAL | C | 175 | 8.851 | 45.303 | 2.713 | 1.00 | 51.62 | GZ00 C |
| ATOM | 1345 | CG2 | VAL | C | 175 | 8.510 | 43.718 | 4.667 | 1.00 | 44.82 | GZ00 C |
| ATOM | 1346 | N | LEU | C | 176 | 6.686 | 47.587 | 5.342 | 1.00 | 46.20 | GZ00 N |
| ATOM | 1347 | CA | LEU | C | 176 | 5.329 | 47.863 | 5.785 | 1.00 | 41.81 | GZ00 C |
| ATOM | 1348 | C | LEU | C | 176 | 4.400 | 47.199 | 4.775 | 1.00 | 42.53 | GZ00 C |
| ATOM | 1349 | O | LEU | C | 176 | 4.405 | 47.554 | 3.595 | 1.00 | 55.35 | GZ00 O |
| ATOM | 1350 | CB | LEU | C | 176 | 5.082 | 49.361 | 5.889 | 1.00 | 43.16 | GZ00 C |
| ATOM | 1351 | CG | LEU | C | 176 | 3.653 | 49.738 | 6.270 | 1.00 | 46.81 | GZ00 C |
| ATOM | 1352 | CD1 | LEU | C | 176 | 3.653 | 49.738 | 6.270 | 1.00 | 46.81 | GZ00 C |
| ATOM | 1353 | CD2 | LEU | C | 176 | 3.565 | 51.241 | 6.509 | 1.00 | 41.80 | GZ00 C |
| ATOM | 1354 | N | GLN | C | 177 | 3.666 | 46.189 | 5.219 | 1.00 | 44.53 | GZ00 N |
| ATOM | 1355 | CA | GLN | C | 177 | 2.809 | 45.403 | 4.345 | 1.00 | 50.59 | GZ00 C |
| ATOM | 1356 | C | GLN | C | 177 | 1.442 | 46.069 | 4.173 | 1.00 | 49.14 | GZ00 C |
| ATOM | 1357 | O | GLN | C | 177 | 0.999 | 46.856 | 5.018 | 1.00 | 43.05 | GZ00 O |
| ATOM | 1358 | CB | GLN | C | 177 | 2.634 | 43.990 | 4.909 | 1.00 | 46.96 | GZ00 C |
| ATOM | 1359 | CG | GLN | C | 177 | 3.923 | 43.188 | 5.105 | 1.00 | 49.24 | GZ00 C |
| ATOM | 1360 | CD | GLN | C | 177 | 3.666 | 41.894 | 5.863 | 1.00 | 56.86 | GZ00 C |
| ATOM | 1361 | OE1 | GLN | C | 177 | 3.214 | 40.898 | 5.285 | 1.00 | 62.22 | GZ00 O |
| ATOM | 1362 | NE2 | GLN | C | 177 | 3.939 | 41.905 | 7.170 | 1.00 | 48.26 | GZ00 N |
| ATOM | 1363 | B | SER | C | 178 | 0.751 | 45.698 | 3.084 | 1.00 | 45.38 | GZ00 N |
| ATOM | 1364 | CA | SER | C | 178 | −0.624 | 46.166 | 2.867 | 1.00 | 48.86 | GZ00 C |
| ATOM | 1365 | C | SER | C | 178 | −1.544 | 45.854 | 4.039 | 1.00 | 46.49 | GZ00 C |
| ATOM | 1366 | O | SER | C | 178 | −2.528 | 46.562 | 4.260 | 100 | 57.16 | GZ00 O |
| ATOM | 1367 | CB | SER | C | 178 | −1.216 | 45.531 | 1.617 | 1.00 | 50.40 | GZ00 C |
| ATOM | 1368 | OG | SER | C | 178 | V0.204 | 45.003 | 0.795 | 1.00 | 71.70 | GZ00 O |
| ATOM | 1369 | N | SER | C | 179 | −1.258 | 44.793 | 4.786 | 1.00 | 50.74 | GZ00 N |
| ATOM | 1370 | CA | SER | C | 179 | −1.988 | 44.477 | 6.007 | 1.00 | 43.18 | GZ00 C |
| ATOM | 1371 | C | SER | C | 179 | −1.776 | 45.503 | 7.110 | 1.00 | 49.34 | GZ00 C |
| ATOM | 1372 | O | SER | C | 179 | −2.482 | 45.454 | 8.121 | 1.00 | 48.58 | GZ00 O |
| ATOM | 1373 | CB | SER | C | 179 | −1.54 | 43.111 | 6.513 | 1.00 | 44.27 | GZ00 C |
| ATOM | 1374 | OG | SER | C | 179 | −0.258 | 43.204 | 7.095 | 1.00 | 48.97 | GZ00 O |
| ATOM | 1375 | N | GLY | C | 180 | −0.798 | 46.398 | 6.970 | 1.00 | 46.74 | GZ00 N |
| ATOM | 1376 | CA | GLY | C | 180 | −0.440 | 47.281 | 8.059 | 1.00 | 45.92 | GZ00 C |
| ATOM | 1377 | C | GLY | C | 180 | 0.566 | 46.707 | 9.037 | 1.00 | 50.25 | GZ00 C |

TABLE 10.3-continued

| ATOM | 1378 | O | GLY | C | 180 | 0.916 | 47.389 | 10.012 | 1.00 | 43.25 | GZ00 O |
|---|---|---|---|---|---|---|---|---|---|---|---|
| ATOM | 1379 | N | LEU | C | 181 | 1.039 | 45.481 | 8.813 | 1.00 | 44.89 | GZ00 N |
| ATOM | 1380 | CA | LEU | C | 181 | 2.003 | 44.836 | 9.695 | 1.00 | 49.99 | GZ00 C |
| ATOM | 1381 | C | LEU | C | 181 | 3.408 | 44.908 | 9.101 | 1.00 | 47.59 | GZ00 C |
| ATOM | 1382 | O | LEU | C | 181 | 3.594 | 45.023 | 7.887 | 1.00 | 47.03 | GZ00 O |
| ATOM | 1383 | CB | LEU | C | 181 | 1.621 | 43.373 | 9.938 | 1.00 | 43.97 | GZ00 C |
| ATOM | 1384 | CG | LEU | C | 181 | 0.269 | 43.159 | 10.616 | 1.00 | 50.80 | GZ00 C |
| ATOM | 1385 | CD1 | LEU | C | 181 | −0.047 | 41.676 | 10.719 | 1.00 | 43.98 | GZ00 C |
| ATOM | 1386 | CD2 | LEU | C | 181 | 0.246 | 43.830 | 11.981 | 1.00 | 46.56 | GZ00 C |
| ATOM | 1387 | N | TYR | C | 182 | 4.404 | 44.833 | 9.973 | 1.00 | 45.32 | GZ00 N |
| ATOM | 1388 | CA | TYR | C | 182 | 5.793 | 44.866 | 9.536 | 1.00 | 45.62 | GZ00 C |
| ATOM | 1389 | C | TYR | C | 182 | 6.381 | 43.465 | 9.437 | 1.00 | 44.85 | GZ00 C |
| ATOM | 1390 | O | TYR | C | 182 | 5.955 | 42.536 | 10.124 | 1.00 | 51.18 | GZ00 O |
| ATOM | 1391 | CB | TYR | C | 182 | 6.645 | 45.701 | 10.484 | 1.00 | 44.25 | GZ00 C |
| ATOM | 1392 | CG | TYR | C | 182 | 6.265 | 47.162 | 10.529 | 1.00 | 49.19 | GZ00 C |
| ATOM | 1393 | CD1 | TYR | C | 182 | 6.805 | 48.072 | 9..628 | 1.00 | 49.61 | GZ00 C |
| ATOM | 1394 | CD2 | TYR | C | 182 | 5.368 | 47.633 | 11.474 | 1.00 | 51.64 | GZ00 C |
| ATOM | 1395 | CE1 | TYR | C | 182 | 6.474 | 49.408 | 9.678 | 1.00 | 43.85 | GZ00 C |
| ATOM | 1396 | CE2 | TYR | C | 182 | 5.029 | 48.974 | 11.530 | 1.00 | 55.94 | GZ00 C |
| ATOM | 1397 | CZ | TYR | C | 182 | 5.587 | 49.853 | 10.626 | 1.00 | 50.36 | GZ00 C |
| ATOM | 1398 | OH | TYR | C | 182 | 5.243 | 51.177 | 10.679 | 1.00 | 43.75 | GZ00 O |
| ATOM | 1399 | N | SER | C | 183 | 7.374 | 43.326 | 8.569 | 1.00 | 46.44 | GZ00 N |
| ATOM | 1400 | CA | SER | C | 183 | 8.231 | 42.152 | 8.534 | 1.00 | 42.34 | GZ00 C |
| ATOM | 1401 | C | SER | C | 183 | 9.673 | 42.600 | 8.304 | 1.00 | 42.61 | GZ00 C |
| ATOM | 1402 | O | SER | C | 183 | 9.927 | 43.635 | 7.681 | 1.00 | 42.07 | GZ00 O |
| ATOM | 1403 | CB | SER | C | 183 | 7.799 | 41.173 | 7.452 | 1.00 | 40.89 | GZ00 C |
| ATOM | 1404 | OG | SER | C | 183 | 6.531 | 40.617 | 7.751 | 1.00 | 50.66 | GZ00 O |
| ATOM | 1405 | N | LEU | C | 184 | 10.622 | 41.838 | 8.842 | 1.00 | 42.23 | GZ00 N |
| ATOM | 1406 | CA | LEU | C | 184 | 12.018 | 42.081 | 8.515 | 1.00 | 39.25 | GZ00 C |
| ATOM | 1407 | C | LEU | C | 184 | 12.794 | 40.772 | 8.518 | 1.00 | 43.48 | GZ00 C |
| ATOM | 1408 | O | LEU | C | 184 | 12.337 | 39.746 | 9.029 | 1.00 | 40.77 | GZ00 O |
| ATOM | 1409 | CB | LEU | C | 184 | 12.650 | 43.095 | 9.473 | 1.00 | 35.18 | GZ00 C |
| ATOM | 1410 | CG | LEU | C | 184 | 12.809 | 42.808 | 10.965 | 1.00 | 45.00 | GZ00 C |
| ATOM | 1411 | CD1 | LEU | C | 184 | 13.869 | 41.700 | 11.303 | 1.00 | 40.29 | GZ00 C |
| ATOM | 1412 | CD2 | LEU | C | 184 | 13.218 | 44.117 | 11.588 | 1.00 | 33.99 | GZ00 C |
| ATOM | 1413 | N | SER | C | 185 | 14.012 | 40.842 | 7.986 | 1.00 | 44.24 | GZ00 N |
| ATOM | 1414 | CA | SER | C | 185 | 14.963 | 39.747 | 8.041 | 1.00 | 35.64 | GZ00 C |
| ATOM | 1415 | C | SER | C | 185 | 16.258 | 40.228 | 8.669 | 1.00 | 41.38 | GZ00 C |
| ATOM | 1416 | O | SER | C | 185 | 16.650 | 41.392 | 8.526 | 1.00 | 39.54 | GZ00 O |
| ATOM | 1417 | CB | SER | C | 185 | 15.260 | 39.197 | 6.661 | 1.00 | 36.15 | GZ00 C |
| ATOM | 1418 | OG | SER | C | 185 | 14.075 | 38.752 | 6.055 | 1.00 | 40.64 | GZ00 O |
| ATOM | 1419 | N | SER | C | 186 | 16.927 | 39.308 | 9.349 | 1.00 | 38.32 | GZ00 N |
| ATOM | 1420 | CA | SER | C | 186 | 18.265 | 39.524 | 9.871 | 1.00 | 36.92 | GZ00 C |
| ATOM | 1421 | C | SER | C | 186 | 19.108 | 38.382 | 9.349 | 1.00 | 40.04 | GZ00 C |
| ATOM | 1422 | O | SER | C | 186 | 18.687 | 37.226 | 9.434 | 1.00 | 43.87 | GZ00 O |
| ATOM | 1423 | CB | SER | C | 186 | 18.273 | 39.558 | 11.396 | 1.00 | 38.94 | GZ00 C |
| ATOM | 1424 | OG | SER | C | 186 | 19.589 | 39.675 | 11.902 | 1.00 | 39.68 | GZ00 O |
| ATOM | 1425 | N | VAL | C | 187 | 20.267 | 38.698 | 8.773 | 1.00 | 38.05 | GZ00 N |
| ATOM | 1426 | CA | VAL | C | 187 | 21.164 | 37.675 | 8.245 | 1.00 | 39.23 | GZ00 C |
| ATOM | 1427 | C | VAL | C | 187 | 22.543 | 37.869 | 8.849 | 1.00 | 38.02 | GZ00 C |
| ATOM | 1428 | O | VAL | C | 187 | 22.977 | 38.990 | 9.130 | 1.00 | 40.44 | GZ00 O |
| ATOM | 1429 | CB | VAL | C | 187 | 21.291 | 37.714 | 6.708 | 1.00 | 42.17 | GZ00 C |
| ATOM | 1430 | CG1 | VAL | C | 187 | 19.984 | 37.334 | 6.048 | 1.00 | 51.50 | GZ00 C |
| ATOM | 1431 | CG2 | VAL | C | 187 | 21.733 | 39.100 | 6.265 | 1.00 | 42.55 | GZ00 C |
| ATOM | 1432 | N | VAL | C | 188 | 23.252 | 36.770 | 9.018 | 1.00 | 36.36 | GZ00 N |
| ATOM | 1433 | CA | VAL | C | 188 | 24.640 | 36.836 | 9.426 | 1.00 | 36.04 | GZ00 C |
| ATOM | 1434 | C | VAL | C | 188 | 25.458 | 36.076 | 8.397 | 1.00 | 29.41 | GZ00 C |
| ATOM | 1435 | O | VAL | C | 188 | 25.037 | 35.025 | 7.901 | 1.00 | 36.76 | GZ00 O |
| ATOM | 1436 | CB | VAL | C | 188 | 24.848 | 36.314 | 10.861 | 1.00 | 42.84 | GZ00 C |
| ATOM | 1437 | CG1 | VAL | C | 188 | 24.200 | 34.977 | 11.043 | 1.00 | 38.37 | GZ00 C |
| ATOM | 1438 | CG2 | VAL | C | 188 | 26.343 | 36.272 | 11.210 | 1.00 | 41.22 | GZ00 C |
| ATOM | 1439 | N | THR | C | 189 | 26.558 | 36.673 | 8.000 | 1.00 | 28.33 | GZ00 N |
| ATOM | 1440 | CA | THR | C | 189 | 27.541 | 36.056 | 7.132 | 1.00 | 32.84 | GZ00 C |
| ATOM | 1441 | C | THR | C | 189 | 28.628 | 35.434 | 8.001 | 1.00 | 34.03 | GZ00 C |
| ATOM | 1442 | O | THR | C | 189 | 29.180 | 36.100 | 8.883 | 1.00 | 35.30 | GZ00 O |
| ATOM | 1443 | CB | THR | C | 189 | 28.159 | 37.112 | 6.215 | 1.00 | 32.93 | GZ00 C |
| ATOM | 1444 | OG1 | THR | C | 189 | 27.144 | 37.724 | 5.48 | 1.00 | 45.99 | GZ00 O |
| ATOM | 1445 | CG2 | THR | C | 189 | 29.182 | 36.491 | 5.293 | 1.00 | 42.71 | GZ00 C |
| ATOM | 1446 | N | VAL | C | 190 | 28.939 | 34.171 | 7.745 | 1.00 | 34.62 | GZ00 N |
| ATOM | 1447 | CA | VAL | C | 190 | 29.911 | 33.429 | 8.544 | 1.00 | 31.43 | GZ00 C |
| ATOM | 1448 | C | VAL | C | 190 | 30.828 | 32.676 | 7.590 | 1.00 | 33.62 | GZ00 C |
| ATOM | 1449 | O | VAL | C | 190 | 30.489 | 32.452 | 6.412 | 1.00 | 32.38 | GZ00 O |
| ATOM | 1450 | CB | VAL | C | 190 | 29.217 | 32.438 | 9.514 | 1.00 | 32.44 | GZ00 C |
| ATOM | 1451 | CG1 | VAL | C | 190 | 28.249 | 33.160 | 1.0466 | 1.00 | 30.52 | GZ00 C |
| ATOM | 1452 | CG2 | VAL | C | 190 | 28.56 | 31.364 | 8.716 | 1.00 | 32.19 | GZ00 C |
| ATOM | 1453 | N | PRO | C | 191 | 31.989 | 32.240 | 8.078 | 1.00 | 30.12 | GZ00 N |
| ATOM | 1454 | CA | PRO | C | 191 | 32.826 | 31.359 | 7.271 | 1.00 | 32.76 | GZ00 C |
| ATOM | 1455 | C | PRO | C | 191 | 32.058 | 30.080 | 6.963 | 1.00 | 30.65 | GZ00 C |
| ATOM | 1456 | O | PRO | C | 191 | 31.363 | 29.531 | 7.820 | 1.00 | 33.10 | GZ00 O |
| ATOM | 1457 | CB | PRO | C | 191 | 34.045 | 31.120 | 8.172 | 1.00 | 32.26 | GZ00 C |

TABLE 10.3-continued

| | | | | | | | | | | |
|---|---|---|---|---|---|---|---|---|---|---|
| ATOM | 1458 | CG | PRO | C | 191 | 34.060 | 32.297 | 9.081 | 1.00 | 34.77 GZ00 C |
| ATOM | 1459 | CD | PRO | C | 191 | 32.645 | 32.579 | 9.350 | 1.00 | 27.68 GZ00 C |
| ATOM | 1460 | N | SER | C | 192 | 32.149 | 29.634 | 5.711 | 1.00 | 29.53 GZ00 N |
| ATOM | 1461 | CA | SER | C | 192 | 31.350 | 28.487 | 5.287 | 1.00 | 39.33 GZ00 C |
| ATOM | 1462 | C | SER | C | 192 | 31.675 | 27.230 | 6.099 | 1.00 | 36.23 GZ00 C |
| ATOM | 1463 | O | SER | C | 192 | 30.769 | 26.485 | 6.472 | 1.00 | 42.93 GZ00 O |
| ATOM | 1464 | CB | SER | C | 192 | 31.541 | 28.240 | 3.789 | 1.00 | 38.81 GZ00 C |
| ATOM | 1465 | OG | SER | C | 192 | 32.874 | 27.909 | 3.459 | 1.00 | 43.23 GZ00 O |
| ATOM | 1466 | N | SER | C | 193 | 32.938 | 27.035 | 6.471 | 1.00 | 34.82 GZ00 N |
| ATOM | 1467 | CA | SER | C | 193 | 33.323 | 25.884 | 7.287 | 1.00 | 34.53 GZ00 C |
| ATOM | 1468 | C | SER | C | 193 | 32.696 | 25.922 | 8.671 | 1.00 | 34.09 GZ00 C |
| ATOM | 1469 | O | SER | C | 193 | 32.757 | 24.928 | 9.386 | 1.00 | 39.08 GZ00 O |
| ATOM | 1470 | CB | SER | C | 193 | 34.853 | 25.776 | 7.406 | 1.00 | 30.12 GZ00 C |
| ATOM | 1471 | OG | SER | C | 193 | 35.392 | 26.892 | 8.093 | 1.00 | 36.36 GZ00 O |
| ATOM | 1472 | N | SER | C | 194 | 32.163 | 27.056 | 9.102 | 1.00 | 38.37 GZ00 N |
| ATOM | 1473 | CA | SER | C | 194 | 31.530 | 27.087 | 10.411 | 1.00 | 33.39 GZ00 C |
| ATOM | 1474 | C | SER | C | 194 | 30.113 | 26.516 | 10.401 | 1.00 | 42.74 GZ00 C |
| ATOM | 1475 | O | SER | C | 194 | 29.523 | 26.338 | 11.474 | 1.00 | 39.11 GZ00 O |
| ATOM | 1476 | CB | SER | C | 194 | 31.499 | 28.525 | 10.943 | 1.00 | 36.98 GZ00 C |
| ATOM | 1477 | OG | SER | C | 194 | 32.808 | 29.033 | 11.127 | 1.00 | 48.78 GZ00 O |
| ATOM | 1478 | N | LEU | C | 195 | 29.544 | 26.221 | 9.235 | 1.00 | 39.64 GZ00 N |
| ATOM | 1479 | CA | LEU | C | 195 | 28.171 | 25.716 | 9.219 | 1.00 | 49.46 GZ00 C |
| ATOM | 1480 | C | LEU | C | 195 | 28.073 | 24.358 | 9.912 | 1.00 | 44.13 GZ00 C |
| ATOM | 1481 | O | LEU | C | 195 | 27.079 | 24.064 | 10.584 | 1.00 | 58.41 GZ00 O |
| ATOM | 1482 | CB | LEU | C | 195 | 27.658 | 25.619 | 7.783 | 1.00 | 39.54 GZ00 C |
| ATOM | 1483 | CG | LEU | C | 195 | 27.446 | 26.952 | 7.097 | 1.00 | 40.14 GZ00 C |
| ATOM | 1484 | CD1 | LEU | C | 195 | 26.943 | 26.739 | 5.696 | 1.00 | 44.58 GZ00 C |
| ATOM | 1485 | CD2 | LEU | C | 195 | 26.470 | 27.772 | 7.904 | 1.00 | 40.80 GZ00 C |
| ATOM | 1486 | N | GLY | C | 196 | 29.081 | 23.506 | 9.744 | 1.00 | 51.36 GZ00 N |
| ATOM | 1487 | CA | GLY | C | 196 | 29.046 | 22.221 | 10.420 | 1.00 | 65.18 GZ00 C |
| ATOM | 1488 | C | GLY | C | 196 | 29.407 | 22.268 | 11.889 | 1.00 | 66.41 GZ00 C |
| ATOM | 1489 | O | GLY | C | 196 | 29.013 | 21.375 | 12.644 | 1.00 | 61.49 GZ00 O |
| ATOM | 1490 | N | THR | C | 197 | 30.128 | 23.300 | 12.314 | 1.00 | 62.25 GZ00 N |
| ATOM | 1491 | CA | THR | C | 197 | 30.755 | 23.340 | 13.626 | 1.00 | 58.93 GZ00 C |
| ATOM | 1492 | C | THR | C | 197 | 29.995 | 24.161 | 14.655 | 1.00 | 58.26 GZ00 C |
| ATOM | 1493 | O | THR | C | 197 | 30.047 | 23.842 | 15.845 | 1.00 | 62.50 GZ00 O |
| ATOM | 1494 | CB | THR | C | 197 | 32.165 | 23.899 | 13.486 | 1.00 | 60.74 GZ00 C |
| ATOM | 1495 | OG1 | THR | C | 197 | 32.961 | 23.642 | 14.759 | 1.00 | 62.30 GZ00 O |
| ATOM | 1496 | CG2 | THR | C | 197 | 32.961 | 23.642 | 14.759 | 1.00 | 74.83 GZ00 C |
| ATOM | 1497 | N | GLN | C | 198 | 29.373 | 25.261 | 14.243 | 1.00 | 52.75 GZ00 N |
| ATOM | 1498 | CA | GLN | C | 198 | 28.836 | 26.250 | 15.166 | 1.00 | 50.37 GZ00 C |
| ATOM | 1499 | C | GLN | C | 198 | 27.314 | 26.260 | 15.176 | 1.00 | 47.44 GZ00 C |
| ATOM | 1500 | O | GLN | C | 198 | 26.650 | 25.910 | 14.197 | 1.00 | 47.96 GZ00 O |
| ATOM | 1501 | CB | GLN | C | 198 | 29.345 | 27.650 | 14.839 | 1.00 | 49.33 GZ00 C |
| ATOM | 1502 | CG | GLN | C | 198 | 30.852 | 27.725 | 14.782 | 1.00 | 55.27 GZ00 C |
| ATOM | 1503 | CD | GLN | C | 198 | 31.515 | 27.225 | 16.062 | 1.00 | 61.24 GZ00 C |
| ATOM | 1504 | OE1 | GLN | C | 198 | 32.566 | 26.585 | 16.007 | 1.00 | 51.30 GZ00 O |
| ATOM | 1505 | NE2 | GLN | C | 198 | 30.903 | 27.517 | 17.218 | 1.00 | 56.92 GZ00 N |
| ATOM | 1506 | N | THR | C | 199 | 26.773 | 26.623 | 16.322 | 1.00 | 52.47 GZ00 N |
| ATOM | 1507 | CA | THR | C | 199 | 25.343 | 26.782 | 16.481 | 1.00 | 55.26 GZ00 C |
| ATOM | 1508 | C | THR | C | 199 | 25.008 | 28.268 | 16.402 | 1.00 | 49.37 GZ00 C |
| ATOM | 1509 | O | THR | C | 199 | 25.618 | 29.094 | 17.092 | 1.00 | 42.11 GZ00 O |
| ATOM | 1510 | CB | THR | C | 199 | 24.875 | 26.156 | 17.795 | 1.00 | 51.51 GZ00 C |
| ATOM | 1511 | OG1 | THR | C | 199 | 24.993 | 24.734 | 17.686 | 1.00 | 63.19 GZ00 O |
| ATOM | 1512 | CG2 | THR | C | 199 | 23.428 | 26.505 | 18.070 | 1.00 | 53.59 GZ00 C |
| ATOM | 1513 | N | TYR | C | 200 | 24.078 | 28.610 | 15.518 | 1.00 | 48.90 GZ00 N |
| ATOM | 1514 | CA | TYR | C | 200 | 23.662 | 29.990 | 15.315 | 1.00 | 48.61 GZ00 C |
| ATOM | 1515 | C | TYR | C | 200 | 22.209 | 30.127 | 15.721 | 1.00 | 46.13 GZ00 C |
| ATOM | 1516 | O | TYR | C | 200 | 21.332 | 29.443 | 15.173 | 1.00 | 44.41 GZ00 O |
| ATOM | 1517 | CB | TYR | C | 200 | 23.885 | 30.425 | 13.871 | 1.00 | 40.49 GZ00 C |
| ATOM | 1518 | CG | TYR | C | 200 | 25.348 | 30.403 | 13.527 | 1.00 | 43.98 GZ00 C |
| ATOM | 1519 | CD1 | TYR | C | 200 | 26.196 | 31.359 | 14.053 | 1.00 | 42.42 GZ00 C |
| ATOM | 1520 | CD2 | TYR | C | 200 | 25.891 | 29.415 | 12.718 | 1.00 | 41.47 GZ00 C |
| ATOM | 1521 | CE1 | TYR | C | 200 | 27.536 | 31.356 | 13.770 | 1.00 | 39.19 GZ00 C |
| ATOM | 1522 | CE2 | TYR | C | 200 | 27.254 | 29.408 | 12.425 | 1.00 | 45.38 GZ00 C |
| ATOM | 1523 | CZ | TYR | C | 200 | 28.062 | 30.394 | 12.954 | 1.00 | 39.23 GZ00 C |
| ATOM | 1524 | OH | TYR | C | 200 | 29.417 | 30.433 | 12.699 | 1.00 | 45.19 GZ00 O |
| ATOM | 1525 | N | ILE | C | 201 | 21.975 | 30.996 | 16.697 | 1.00 | 42.87 GZ00 N |
| ATOM | 1526 | CA | ILE | C | 201 | 20.663 | 31.253 | 17.264 | 1.00 | 42.84 GZ00 C |
| ATOM | 1527 | C | ILE | C | 201 | 20.414 | 32.743 | 17.188 | 1.00 | 44.10 GZ00 C |
| ATOM | 1528 | O | ILE | C | 201 | 21.240 | 33.530 | 17.663 | 1.00 | 46.46 GZ00 O |
| ATOM | 1529 | CB | ILE | C | 201 | 20.581 | 30.788 | 18.727 | 1.00 | 50.09 GZ00 C |
| ATOM | 1530 | CG1 | ILE | C | 201 | 20.743 | 29.262 | 18.814 | 1.00 | 45.99 GZ00 C |
| ATOM | 1531 | CG2 | ILE | C | 201 | 19.298 | 31.312 | 19.375 | 1.00 | 42.60 GZ00 C |
| ATOM | 1532 | CD1 | ILE | C | 201 | 20.953 | 28.790 | 20.208 | 1.00 | 32.65 GZ00 C |
| ATOM | 1533 | N | CYS | C | 202 | 19.279 | 33.131 | 16.604 | 1.00 | 42.47 GZ00 N |
| ATOM | 1534 | CA | CYS | C | 202 | 18.862 | 34.523 | 16.601 | 1.00 | 43.27 GZ00 C |
| ATOM | 1535 | C | CYS | C | 202 | 17.860 | 34.776 | 17.723 | 1.00 | 49.37 GZ00 C |
| ATOM | 1536 | O | CYS | C | 202 | 17.021 | 33.922 | 18.040 | 1.00 | 48.50 GZ00 O |
| ATOM | 1537 | CB | CYS | C | 202 | 18.262 | 34.923 | 15.250 | 1.00 | 47.82 GZ00 C |

TABLE 10.3-continued

| | | | | | | | | | | |
|---|---|---|---|---|---|---|---|---|---|---|
| ATOM | 1538 | SG | CYS | C | 202 | 16.539 | 34.525 | 15.045 | 1.00 | 59.08 GZ00 S |
| ATOM | 1539 | N | ASN | C | 203 | 17.976 | 35.945 | 18.341 | 1.00 | 44.56 GZ00 N |
| ATOM | 1540 | CA | ASN | C | 203 | 17.167 | 36.321 | 19.492 | 1.00 | 39.69 GZ00 C |
| ATOM | 1541 | C | ASN | C | 203 | 16.329 | 37.519 | 19.079 | 1.00 | 46.86 GZ00 C |
| ATOM | 1542 | O | ASN | C | 203 | 16.862 | 38.616 | 18.876 | 1.00 | 43.01 GZ00 O |
| ATOM | 1543 | CB | ASN | C | 203 | 18.043 | 36.660 | 20.698 | 1.00 | 40.17 GZ00 C |
| ATOM | 1544 | CG | ASN | C | 203 | 19.277 | 35.769 | 20.785 | 1.00 | 50.91 GZ00 C |
| ATOM | 1545 | OD1 | ASN | C | 203 | 20.407 | 36.239 | 20.626 | 1.00 | 44.43 GZ00 O |
| ATOM | 1546 | ND2 | ASN | C | 203 | 19.057 | 34.467 | 20.968 | 1.00 | 40.98 GZ00 N |
| ATOM | 1547 | N | VAL | C | 204 | 15.027 | 37.320 | 18.972 | 1.00 | 44.56 GZ00 N |
| ATOM | 1548 | CA | VAL | C | 204 | 14.126 | 38.360 | 18.515 | 1.00 | 46.34 GZ00 C |
| ATOM | 1549 | C | VAL | C | 204 | 13.377 | 38.894 | 19.715 | 1.00 | 43.52 GZ00 C |
| ATOM | 1550 | O | VAL | C | 204 | 12.839 | 38.122 | 20.516 | 1.00 | 51.43 GZ00 O |
| ATOM | 1551 | CB | VAL | C | 204 | 13.166 | 37.826 | 17.447 | 1.00 | 50.83 GZ00 C |
| ATOM | 1552 | CG1 | VAL | C | 204 | 12.204 | 38.932 | 17.006 | 1.00 | 40.92 GZ00 C |
| ATOM | 1553 | CG2 | VAL | C | 204 | 13.984 | 37.271 | 16.291 | 1.00 | 38.78 GZ00 C |
| ATOM | 1554 | N | ASN | C | 205 | 13.361 | 40.208 | 19.858 | 1.00 | 40.86 GZ00 N |
| ATOM | 1555 | CA | ASN | C | 205 | 12.687 | 40.856 | 20.970 | 1.00 | 54.57 GZ00 C |
| ATOM | 1556 | C | ASN | C | 205 | 11.772 | 41.947 | 20.431 | 1.00 | 58.30 GZ00 C |
| ATOM | 1557 | O | ASN | C | 205 | 12.237 | 42.886 | 19.776 | 1.00 | 55.70 GZ00 O |
| ATOM | 1558 | CB | ASN | C | 205 | 13.691 | 41.445 | 21.965 | 1.00 | 49.16 GZ00 C |
| ATOM | 1559 | CG | ASN | C | 205 | 13.009 | 42.013 | 23.204 | 1.00 | 69.12 GZ00 C |
| ATOM | 1560 | OD1 | ASN | C | 205 | 11.837 | 41.702 | 23.489 | 1.00 | 63.20 GZ00 O |
| ATOM | 1561 | ND2 | ASN | C | 205 | 13.716 | 42.884 | 23.921 | 1.00 | 72.08 GZ00 N |
| ATOM | 1562 | N | HIS | C | 206 | 10.482 | 41.839 | 20.732 | 1.00 | 55.60 GZ00 N |
| ATOM | 1563 | CA | HIS | C | 206 | 9.489 | 42.834 | 20.326 | 1.00 | 56.54 GZ00 C |
| ATOM | 1564 | C | HIS | C | 206 | 8.843 | 43.347 | 21.611 | 1.00 | 58.64 GZ00 C |
| ATOM | 1565 | O | HIS | C | 206 | 7.857 | 42.788 | 22.098 | 1.00 | 54.70 GZ00 O |
| ATOM | 1566 | CB | HIS | C | 206 | 8.472 | 42.249 | 19.356 | 1.00 | 51.09 GZ00 C |
| ATOM | 1567 | CG | HIS | C | 206 | 7.482 | 43.251 | 18.851 | 1.00 | 60.00 GZ00 C |
| ATOM | 1568 | ND1 | HIS | C | 206 | 6.150 | 42.954 | 18.660 | 1.00 | 56.09 GZ00 N |
| ATOM | 1569 | CD2 | HIS | C | 206 | 7.633 | 44.548 | 18.494 | 1.00 | 60.16 GZ00 C |
| ATOM | 1570 | CE1 | HIS | C | 206 | 5.525 | 44.026 | 18.209 | 1.00 | 55.91 GZ00 C |
| ATOM | 1571 | NE2 | HIS | C | 206 | 6.402 | 45.007 | 18.100 | 1.00 | 50.50 GZ00 N |
| ATOM | 1572 | N | LYS | C | 207 | 9.435 | 44.398 | 22.179 | 1.00 | 59.62 GZ00 N |
| ATOM | 1573 | CA | LYS | C | 207 | 8.977 | 44.892 | 23.475 | 1.00 | 60.73 GZ00 C |
| ATOM | 1574 | C | LYS | C | 207 | 7.519 | 45.338 | 23.493 | 1.00 | 69.23 GZ00 C |
| ATOM | 1575 | O | LYS | C | 207 | 6.848 | 45.083 | 24.509 | 1.00 | 66.50 GZ00 O |
| ATOM | 1576 | CB | LYS | C | 207 | 9.906 | 46.014 | 23.956 | 1.00 | 58.40 GZ00 C |
| ATOM | 1577 | CG | LYS | C | 207 | 11.292 | 45.481 | 24.321 | 1.00 | 69.34 GZ00 C |
| ATOM | 1578 | CD | LYS | C | 207 | 12.257 | 46.543 | 24.809 | 1.00 | 77.26 GZ00 C |
| ATOM | 1579 | CE | LYS | C | 207 | 13.596 | 45.890 | 25.148 | 1.00 | 81.04 GZ00 C |
| ATOM | 1580 | NZ | LYS | C | 207 | 14.641 | 46.873 | 25.530 | 1.00 | 87.24 GZ00 N1+ |
| ATOM | 1581 | N | PRO | C | 208 | 6.956 | 45.959 | 22.441 | 1.00 | 69.40 GZ00 N |
| ATOM | 1582 | CA | PRO | C | 208 | 5.540 | 46.372 | 22.538 | 1.00 | 59.57 GZ00 C |
| ATOM | 1583 | C | PRO | C | 208 | 4.585 | 45.244 | 22.898 | 1.00 | 64.04 GZ00 C |
| ATOM | 1584 | O | PRO | C | 208 | 3.640 | 45.466 | 23.666 | 1.00 | 69.66 GZ00 O |
| ATOM | 1585 | CB | PRO | C | 208 | 5.257 | 46.942 | 21.148 | 1.00 | 53.38 GZ00 C |
| ATOM | 1586 | CG | PRO | C | 208 | 6.582 | 47.479 | 20.704 | 1.00 | 65.93 GZ00 C |
| ATOM | 1587 | CD | PRO | C | 208 | 7.608 | 46.524 | 21.241 | 1.00 | 55.91 GZ00 C |
| ATOM | 1588 | N | SER | C | 209 | 4.814 | 44.034 | 22.401 | 1.00 | 60.28 GZ00 N |
| ATOM | 1589 | CA | SER | C | 209 | 4.019 | 42.880 | 22.786 | 1.00 | 57.00 GZ00 C |
| ATOM | 1590 | C | SER | C | 209 | 4.762 | 41.960 | 23.758 | 1.00 | 67.68 GZ00 C |
| ATOM | 1591 | O | SER | C | 209 | 4.284 | 40.848 | 24.024 | 1.00 | 64.38 GZ00 O |
| ATOM | 1592 | CB | SER | C | 209 | 3.586 | 42.091 | 21.546 | 1.00 | 56.00 GZ00 C |
| ATOM | 1593 | OG | SER | C | 209 | 4.691 | 41.469 | 20.915 | 1.00 | 63.30 GZ00 O |
| ATOM | 1594 | N | ASN | C | 210 | 5.918 | 42.392 | 24.271 | 1.00 | 68.38 GZ00 N |
| ATOM | 1595 | CA | ASN | C | 210 | 6.846 | 41.563 | 25.049 | 1.00 | 66.63 GZ00 C |
| ATOM | 1596 | C | ASN | C | 210 | 6.898 | 40.139 | 24.505 | 1.00 | 64.18 GZ00 C |
| ATOM | 1597 | O | ASN | C | 210 | 6.538 | 39.164 | 25.164 | 1.00 | 67.42 GZ00 O |
| ATOM | 1598 | CB | ASN | C | 210 | 6.528 | 41.574 | 26.543 | 1.00 | 74.01 GZ00 C |
| ATOM | 1599 | CG | ASN | C | 210 | 5.055 | 41.657 | 26.828 | 1.00 | 83.26 GZ00 C |
| ATOM | 1600 | OD1 | ASN | C | 210 | 4.483 | 42.750 | 26.885 | 1.00 | 89.02 GZ00 O |
| ATOM | 1601 | ND2 | ASN | C | 210 | 4.420 | 40.502 | 26.997 | 1.00 | 83.49 GZ00 N |
| ATOM | 1602 | N | THR | C | 211 | 7.358 | 40.045 | 23.268 | 1.00 | 61.55 GZ00 N |
| ATOM | 1603 | CA | THR | C | 211 | 7.633 | 38.772 | 22.633 | 1.00 | 57.57 GZ00 C |
| ATOM | 1604 | C | THR | C | 211 | 9.143 | 38.608 | 22.609 | 1.00 | 60.01 GZ00 C |
| ATOM | 1605 | O | THR | C | 211 | 9.862 | 39.532 | 22.214 | 1.00 | 65.19 GZ00 O |
| ATOM | 1606 | CB | THR | C | 211 | 7.089 | 38.734 | 21.209 | 1.00 | 54.23 GZ00 C |
| ATOM | 1607 | OG1 | THR | C | 211 | 5.691 | 39.013 | 21.227 | 1.00 | 60.96 GZ00 O |
| ATOM | 1608 | CG2 | THR | C | 211 | 7.316 | 37.377 | 20.586 | 1.00 | 57.50 GZ00 C |
| ATOM | 1609 | N | LYS | C | 212 | 9.620 | 37.460 | 23.084 | 1.00 | 60.21 GZ00 N |
| ATOM | 1610 | CA | LYS | C | 212 | 11.018 | 37.076 | 22.951 | 1.00 | 52.01 GZ00 C |
| ATOM | 1611 | C | LYS | C | 212 | 11.042 | 35.689 | 22.350 | 1.00 | 52.91 GZ00 C |
| ATOM | 1612 | O | LYS | C | 212 | 10.456 | 34.760 | 22.906 | 1.00 | 57.94 GZ00 O |
| ATOM | 1613 | CB | LYS | C | 212 | 11.753 | 37.110 | 24.290 | 1.00 | 47.41 GZ00 C |
| ATOM | 1614 | CG | LYS | C | 212 | 11.691 | 38.475 | 24.978 | 1.00 | 57.15 GZ00 C |
| ATOM | 1615 | CD | LYS | C | 212 | 12.644 | 38.565 | 26.174 | 1.00 | 66.23 GZ00 C |
| ATOM | 1616 | CE | LYS | C | 212 | 12.433 | 39.861 | 26.969 | 1.00 | 79.81 GZ00 C |
| ATOM | 1617 | NZ | LYS | C | 212 | 13.705 | 40.467 | 27.503 | 1.00 | 78.51 GZ00 N1+ |

TABLE 10.3-continued

| | | | | | | | | | | |
|---|---|---|---|---|---|---|---|---|---|---|
| ATOM | 1618 | N | VAL | C | 213 | 11.710 | 35.555 | 21.215 | 1.00 | 55.55 GZ00 N |
| ATOM | 1619 | CA | VAL | C | 213 | 11.839 | 34.287 | 20.520 | 1.00 | 49.66 GZ00 C |
| ATOM | 1620 | C | VAL | C | 213 | 13.319 | 34.021 | 20.272 | 1.00 | 50.74 GZ00 C |
| ATOM | 1621 | O | VAL | C | 213 | 14.050 | 34.906 | 19.810 | 1.00 | 48.29 GZ00 O |
| ATOM | 1622 | CB | VAL | C | 213 | 11.051 | 34.291 | 19.199 | 1.00 | 51.80 GZ00 C |
| ATOM | 1623 | CG1 | VAL | C | 213 | 11.260 | 32.982 | 18.441 | 1.00 | 52.63 GZ00 C |
| ATOM | 1624 | CG2 | VAL | C | 213 | 9.583 | 34.508 | 19.477 | 1.00 | 52.72 GZ00 C |
| ATOM | 1625 | N | ASP | C | 214 | 13.757 | 32.813 | 20.598 | 1.00 | 51.96 GZ00 N |
| ATOM | 1626 | CA | ASP | C | 214 | 15.054 | 32.301 | 20.199 | 1.00 | 43.41 GZ00 C |
| ATOM | 1627 | C | ASP | C | 214 | 14.791 | 31.231 | 19.160 | 1.00 | 52.09 GZ00 C |
| ATOM | 1628 | O | ASP | C | 214 | 13.923 | 30.374 | 19.356 | 1.00 | 60.39 GZ00 O |
| ATOM | 1629 | CB | ASP | C | 214 | 15.820 | 31.717 | 21.384 | 1.00 | 47.17 GZ00 C |
| ATOM | 1630 | CG | ASP | C | 214 | 16.093 | 32.742 | 22.473 | 1.00 | 53.34 GZ00 C |
| ATOM | 1631 | OD1 | ASP | C | 214 | 16.343 | 33.921 | 22.145 | 1.00 | 53.82 GZ00 O |
| ATOM | 1632 | OD2 | ASP | C | 214 | 16.071 | 32.367 | 23.665 | 1.00 | 64.40 GZ00 O1− |
| ATOM | 1633 | N | LYS | C | 215 | 15.527 | 31.282 | 18.060 | 1.00 | 49.22 GZ00 N |
| ATOM | 1634 | CA | LYS | C | 215 | 15.322 | 30.324 | 16.993 | 1.00 | 46.64 GZ00 C |
| ATOM | 1635 | C | LYS | C | 215 | 16.691 | 29.904 | 16.489 | 1.00 | 51.67 GZ00 C |
| ATOM | 1636 | O | LYS | C | 215 | 17.531 | 30.748 | 16.165 | 1.00 | 50.73 GZ00 O |
| ATOM | 1637 | CB | LYS | C | 215 | 14.459 | 30.916 | 15.877 | 1.00 | 41.93 GZ00 C |
| ATOM | 1638 | CG | LYS | C | 215 | 14.213 | 29.983 | 14.699 | 1.00 | 58.37 GZ00 C |
| ATOM | 1639 | CD | LYS | C | 215 | 13.161 | 28.894 | 14.993 | 1.00 | 57.43 GZ00 C |
| ATOM | 1640 | CE | LYS | C | 215 | 11.848 | 29.473 | 15.498 | 1.00 | 54.91 GZ00 C |
| ATOM | 1641 | NZ | LYS | C | 215 | 10.704 | 28.533 | 15.296 | 1.00 | 59.67 GZ00 N1+ |
| ATOM | 1642 | N | LYS | C | 216 | 16.916 | 28.597 | 16.475 | 1.00 | 48.55 GZ00 N |
| ATOM | 1643 | CA | LYS | C | 216 | 18.160 | 28.025 | 16.004 | 1.00 | 44.55 GZ00 C |
| ATOM | 1644 | C | LYS | C | 216 | 18.075 | 27.873 | 14.498 | 1.00 | 51.23 GZ00 C |
| ATOM | 1645 | O | LYS | C | 216 | 17.073 | 27.377 | 13.973 | 1.00 | 48.07 GZ00 O |
| ATOM | 1646 | CB | LYS | C | 216 | 18.384 | 26.667 | 16.671 | 1.00 | 53.16 GZ00 C |
| ATOM | 1647 | CG | LYS | C | 216 | 19.666 | 25.939 | 16.297 | 1.00 | 58.06 GZ00 C |
| ATOM | 1648 | CD | LYS | C | 216 | 19.698 | 24.568 | 16.972 | 1.00 | 68.72 GZ00 C |
| ATOM | 1649 | CE | LYS | C | 216 | 21.064 | 23.901 | 16.884 | 1.00 | 76.90 GZ00 C |
| ATOM | 1650 | NZ | LYS | C | 216 | 21.133 | 22.703 | 17.775 | 1.00 | 81.06 GZ00 N1+ |
| ATOM | 1651 | N | VAL | C | 217 | 19.122 | 28.296 | 13.802 | 1.00 | 42.74 GZ00 N |
| ATOM | 1652 | CA | VAL | C | 217 | 19.158 | 28.228 | 12.355 | 1.00 | 45.91 GZ00 C |
| ATOM | 1653 | C | VAL | C | 217 | 20.199 | 27.179 | 12.003 | 1.00 | 52.09 GZ00 C |
| ATOM | 1654 | O | VAL | C | 217 | 21.399 | 27.371 | 12.243 | 1.00 | 50.43 GZ00 O |
| ATOM | 1655 | CB | VAL | C | 217 | 19.472 | 29.594 | 11.727 | 1.00 | 47.85 GZ00 C |
| ATOM | 1656 | CG1 | VAL | C | 217 | 19.352 | 29.534 | 10.217 | 1.00 | 36.68 GZ00 C |
| ATOM | 1657 | CG2 | VAL | C | 217 | 18.552 | 30.667 | 12.314 | 1.00 | 38.98 GZ00 C |
| ATOM | 1658 | N | GLU | C | 218 | 19.742 | 26.069 | 11.431 | 1.00 | 54.61 GZ00 N |
| ATOM | 1659 | CA | GLU | C | 218 | 20.591 | 24.937 | 11.107 | 1.00 | 54.05 GZ00 C |
| ATOM | 1660 | C | GLU | C | 218 | 20.622 | 24.755 | 9.603 | 1.00 | 49.13 GZ00 C |
| ATOM | 1661 | O | GLU | C | 218 | 19.647 | 25.082 | 8.922 | 1.00 | 58.50 GZ00 O |
| ATOM | 1662 | CB | GLU | C | 218 | 20.080 | 23.637 | 11.742 | 1.00 | 65.26 GZ00 C |
| ATOM | 1663 | CG | GLU | C | 218 | 19.944 | 23.671 | 13.253 | 1.00 | 70.38 GZ00 C |
| ATOM | 1664 | CD | GLU | C | 218 | 19.413 | 22.365 | 13.822 | 1.00 | 84.00 GZ00 C |
| ATOM | 1665 | OE1 | GLU | C | 218 | 18.889 | 21.534 | 13.040 | 1.00 | 82.26 GZ00 O |
| ATOM | 1666 | OE2 | GLU | C | 218 | 19.515 | 22.180 | 15.056 | 1.00 | 91.02 GZ00 O1− |
| ATOM | 1667 | N | PRO | C | 219 | 21.716 | 24.232 | 9.056 | 1.00 | 57.01 GZ00 N |
| ATOM | 1668 | CA | PRO | C | 219 | 20.755 | 23.952 | 7.612 | 1.00 | 53.03 GZ00 C |
| ATOM | 1669 | C | PRO | C | 219 | 20.705 | 22.941 | 7.170 | 1.00 | 58.97 GZ00 C |
| ATOM | 1670 | O | PRO | C | 219 | 19.991 | 22.384 | 8.008 | 1.00 | 62.86 GZ00 O |
| ATOM | 1671 | CB | PRO | C | 219 | 23.185 | 23.443 | 7.393 | 1.00 | 49.20 GZ00 C |
| ATOM | 1672 | CG | PRO | C | 219 | 23.796 | 23.307 | 8.761 | 1.00 | 47.12 GZ00 C |
| ATOM | 1673 | CD | PRO | C | 219 | 23.051 | 24.186 | 9.671 | 1.00 | 55.30 GZ00 C |
| ATOM | 1674 | N | LYS | C | 220 | 20.623 | 22.700 | 5.857 | 1.00 | 71.75 GZ00 N |
| ATOM | 1675 | CA | LYS | C | 220 | 19.610 | 21.841 | 5.209 | 1.00 | 68.27 GZ00 C |
| ATOM | 1676 | C | LYS | C | 220 | 18.226 | 22.491 | 5.306 | 1.00 | 73.79 GZ00 C |
| ATOM | 1677 | O | LYS | C | 220 | 17.355 | 22.046 | 6.058 | 1.00 | 80.81 GZ00 O |
| ATOM | 1678 | CB | LYS | C | 220 | 19.570 | 20.424 | 5.812 | 1.00 | 60.33 GZ00 C |
| ATOM | 1679 | CG | LYS | C | 220 | 18.562 | 19.498 | 5.140 | 1.00 | 75.19 GZ00 C |
| ATOM | 1680 | CD | LYS | C | 220 | 18.194 | 18.314 | 6.009 | 1.00 | 81.62 GZ00 C |
| ATOM | 1681 | CE | LYS | C | 220 | 17.204 | 17.408 | 5.284 | 1.00 | 83.68 GZ00 C |
| ATOM | 1682 | NZ | LYS | C | 220 | 15.922 | 18.107 | 4.974 | 1.00 | 81.30 GZ00 N1+ |
| TER | | | | | | | | | | |
| ATOM | 1683 | N | GLN | D | 1 | 3.622 | 57.068 | −14.037 | 1.00 | 73.81 N |
| ATOM | 1684 | CA | GLN | D | 1 | 2.256 | 57.519 | −13.830 | 1.00 | 77.03 C |
| ATOM | 1685 | C | GLN | D | 1 | 2.220 | 58.975 | −13.340 | 1.00 | 71.19 C |
| ATOM | 1686 | O | GLN | D | 1 | 1.170 | 59.618 | −13.403 | 1.00 | 70.55 O |
| ATOM | 1687 | CB | GLN | D | 1 | 1.535 | 56.594 | −12.844 | 1.00 | 76.72 C |
| ATOM | 1688 | CG | GLN | D | 1 | 0.016 | 56.704 | −12.856 | 1.00 | 83.42 C |
| ATOM | 1689 | CD | GLN | D | 1 | −0.568 | 56.892 | −11.458 | 1.00 | 94.69 C |
| ATOM | 1690 | OE1 | GLN | D | 1 | 0.127 | 56.720 | −10.448 | 1.00 | 86.56 O |
| ATOM | 1691 | NE2 | GLN | D | 1 | −1.851 | 57.255 | −11.395 | 1.00 | 91.59 N |
| ATOM | 1692 | N | SER | D | 2 | 3.352 | 59.504 | −12.865 | 1.00 | 62.32 N |
| ATOM | 1693 | CA | SER | D | 2 | 3.404 | 60.928 | −12.539 | 1.00 | 62.06 C |
| ATOM | 1694 | C | SER | D | 2 | 3.359 | 61.752 | −13.826 | 1.00 | 54.47 C |
| ATOM | 1695 | O | SER | D | 2 | 3.840 | 61.331 | −14.885 | 1.00 | 54.37 O |
| ATOM | 1696 | CB | SER | D | 2 | 4.637 | 61.269 | −11.685 | 1.00 | 55.55 C |

TABLE 10.3-continued

| | | | | | | | | | | |
|---|---|---|---|---|---|---|---|---|---|---|
| ATOM | 1697 | OG | SER | D | 2 | 5.815 | 61.429 | −12.445 | 1.00 | 44.68 | O |
| ATOM | 1698 | N | VAL | D | 3 | 2.765 | 62.942 | −13.725 | 1.00 | 51.09 | N |
| ATOM | 1699 | CA | VAL | D | 3 | 2.399 | 63.693 | −14.926 | 1.00 | 44.98 | C |
| ATOM | 1700 | C | VAL | D | 3 | 3.625 | 64.277 | −15.623 | 1.00 | 44.14 | C |
| ATOM | 1701 | O | VAL | D | 3 | 3.682 | 64.317 | −16.858 | 1.00 | 42.24 | O |
| ATOM | 1702 | CB | VAL | D | 3 | 1.355 | 64.762 | −14.561 | 1.00 | 48.49 | C |
| ATOM | 1703 | CG1 | VAL | D | 3 | 1.035 | 65.656 | −15.762 | 1.00 | 33.38 | C |
| ATOM | 1704 | CG2 | VAL | D | 3 | 0.095 | 64.072 | −13.994 | 1.00 | 36.61 | C |
| ATOM | 1705 | N | LEU | D | 4 | 4.610 | 64.757 | −14.867 | 1.00 | 40.88 | N |
| ATOM | 1706 | CA | LEU | D | 4 | 5.895 | 65.115 | −15.451 | 1.00 | 38.31 | C |
| ATOM | 1707 | C | LEU | D | 4 | 6.842 | 63.946 | −15.255 | 1.00 | 42.46 | C |
| ATOM | 1708 | O | LEU | D | 4 | 6.841 | 63.318 | −14.195 | 1.00 | 41.68 | O |
| ATOM | 1709 | CB | LEU | D | 4 | 6.484 | 66.365 | −14.808 | 1.00 | 36.49 | C |
| ATOM | 1710 | CG | LEU | D | 4 | 5.476 | 67.494 | −14.624 | 1.00 | 34.13 | C |
| ATOM | 1711 | CD1 | LEU | D | 4 | 6.074 | 68.656 | −13.825 | 1.00 | 34.44 | C |
| ATOM | 1712 | CD2 | LEU | D | 4 | 4.978 | 67.953 | −15.972 | 1.00 | 29.23 | C |
| ATOM | 1713 | N | THR | D | 5 | 7.637 | 63.640 | −16.273 | 1.00 | 39.33 | N |
| ATOM | 1714 | CA | THR | D | 5 | 8.541 | 62.503 | −16.203 | 1.00 | 34.69 | C |
| ATOM | 1715 | C | THR | D | 5 | 9.987 | 62.990 | −16.144 | 1.00 | 41.85 | C |
| ATOM | 1716 | O | THR | D | 5 | 10.420 | 63.814 | −16.959 | 1.00 | 32.54 | O |
| ATOM | 1717 | CB | THR | D | 5 | 8.307 | 61.529 | −17.363 | 1.00 | 40.41 | C |
| ATOM | 1718 | OG1 | THR | D | 5 | 8.542 | 62.190 | −18.596 | 1.00 | 58.56 | O |
| ATOM | 1719 | CG2 | THR | D | 5 | 6.858 | 61.060 | −17.366 | 100 | 35.80 | C |
| ATOM | 1720 | N | GLN | D | 6 | 10.703 | 62.522 | −15.132 | 1.00 | 33.22 | N |
| ATOM | 1721 | CA | GLN | D | 6 | 12.100 | 62.739 | −14.872 | 1.00 | 31.46 | C |
| ATOM | 1722 | C | GLN | D | 6 | 12.802 | 61.390 | −14.902 | 1.00 | 35.85 | C |
| ATOM | 1723 | O | GLN | D | 6 | 12.187 | 60.381 | −14.554 | 1.00 | 35.36 | O |
| ATOM | 1724 | CB | GLN | D | 6 | 12.302 | 63.370 | −13.490 | 1.00 | 31.54 | C |
| ATOM | 1725 | CG | GLN | D | 6 | 11.670 | 64.731 | −13.302 | 1.00 | 32.96 | C |
| ATOM | 1726 | CD | GLN | D | 6 | 11.827 | 65.238 | −11.884 | 1.00 | 38.63 | C |
| ATOM | 1727 | OE1 | GLN | D | 6 | 10.841 | 65.645 | −11.248 | 1.00 | 36.32 | O |
| ATOM | 1728 | NE2 | GLN | D | 6 | 13.073 | 65.220 | −11.367 | 1.00 | 31.40 | N |
| ATOM | 1729 | N | PRO | D | 7 | 14.069 | 61.323 | −15.306 | 1.00 | 39.24 | N |
| ATOM | 1730 | CA | PRO | D | 7 | 14.832 | 60.087 | −15.078 | 1.00 | 33.07 | C |
| ATOM | 1731 | C | PRO | D | 7 | 14.881 | 59.791 | −13.588 | 1.00 | 34.60 | C |
| ATOM | 1732 | O | PRO | D | 7 | 15.015 | 60.714 | −12.764 | 1.00 | 32.93 | O |
| ATOM | 1733 | CB | PRO | D | 7 | 16.235 | 60.402 | −15.652 | 1.00 | 31.22 | C |
| ATOM | 1734 | CG | PRO | D | 7 | 16.356 | 61.910 | −15.589 | 1.00 | 34.93 | C |
| ATOM | 1735 | CD | PRO | D | 7 | 14.921 | 62.430 | −15.806 | 1.00 | 35.72 | C |
| ATOM | 1736 | N | PRO | D | 8 | 14.755 | 58.518 | −13.197 | 1.00 | 33.41 | N |
| ATOM | 1737 | CA | PRO | D | 8 | 14.682 | 58.200 | −11.756 | 1.00 | 33.71 | C |
| ATOM | 1738 | C | PRO | D | 8 | 15.987 | 58.443 | −11.027 | 1.00 | 36.29 | C |
| ATOM | 1739 | O | PRO | D | 8 | 15.966 | 58.847 | −9.855 | 1.00 | 35.95 | O |
| ATOM | 1740 | CB | PRO | D | 8 | 14.299 | 56.705 | −11.730 | 1.00 | 31.63 | C |
| ATOM | 1741 | CG | PRO | D | 8 | 14.777 | 56.181 | −13.032 | 1.00 | 33.24 | C |
| ATOM | 1742 | CO | PRO | D | 8 | 14.568 | 57.333 | −14.040 | 1.00 | 28.70 | C |
| ATOM | 1743 | N | SER | D | 9 | 17.128 | 58.252 | −11.679 | 1.00 | 31.20 | N |
| ATOM | 1744 | CA | SER | D | 9 | 18.367 | 58.463 | −10.945 | 1.00 | 41.37 | C |
| ATOM | 1745 | C | SER | D | 9 | 19.485 | 58.910 | −11.869 | 1.00 | 41.68 | C |
| ATOM | 1746 | O | SER | D | 9 | 19.492 | 58.642 | −13.075 | 1.00 | 39.62 | O |
| ATOM | 1747 | CB | SER | D | 9 | 18.788 | 57.197 | −10.195 | 1.00 | 32.55 | C |
| ATOM | 1748 | OG | SER | D | 9 | 18.984 | 56.168 | −11.129 | 1.00 | 46.27 | O |
| ATOM | 1749 | N | VAL | D | 10 | 20.465 | 59.553 | −11.259 | 1.00 | 35.48 | N |
| ATOM | 1750 | CA | VAL | D | 10 | 21.529 | 60.199 | −12.000 | 1.00 | 37.87 | C |
| ATOM | 1751 | C | VAL | D | 10 | 22.736 | 60.253 | −11.082 | 1.00 | 34.78 | C |
| ATOM | 1752 | O | VAL | D | 10 | 22.605 | 60.523 | −9.880 | 1.00 | 36.71 | O |
| ATOM | 1753 | CB | VAL | D | 10 | 21.041 | 61.588 | −12.472 | 1.00 | 40.73 | C |
| ATOM | 1754 | CG1 | VAL | D | 10 | 21.926 | 62.691 | −11.971 | 1.00 | 40.07 | C |
| ATOM | 1755 | CG2 | VAL | D | 10 | 20.845 | 61.613 | −13.973 | 1.00 | 38.95 | C |
| ATOM | 1756 | N | SER | D | 11 | 23.915 | 59.963 | −11.625 | 1.00 | 37.46 | N |
| ATOM | 1757 | CA | SER | D | 11 | 25.092 | 59.962 | −10.762 | 1.00 | 35.14 | C |
| ATOM | 1758 | C | SER | D | 11 | 26.324 | 60.390 | −11.542 | 1.00 | 31.82 | C |
| ATOM | 1759 | O | SER | D | 11 | 26.474 | 60.057 | −12.715 | 1.00 | 37.48 | O |
| ATOM | 1760 | CB | SER | D | 11 | 25.311 | 58.580 | −10.130 | 1.00 | 33.24 | C |
| ATOM | 1761 | OG | SER | D | 11 | 25.640 | 57.636 | −11.125 | 1.00 | 37.23 | O |
| ATOM | 1762 | N | ALA | D | 12 | 27.196 | 61.139 | −10.877 | 1.00 | 35.26 | N |
| ATOM | 1763 | CA | ALA | D | 12 | 28.433 | 61.620 | −11.469 | 1.00 | 34.57 | C |
| ATOM | 1764 | C | ALA | D | 12 | 29.379 | 61.996 | −10.338 | 1.00 | 39.68 | C |
| ATOM | 1765 | O | ALA | D | 12 | 28.955 | 62.218 | −9.199 | 1.00 | 31.45 | O |
| ATOM | 1766 | CB | ALA | D | 12 | 28.200 | 62.814 | −12.409 | 1.00 | 31.29 | C |
| ATOM | 1767 | N | ALA | D | 13 | 30.673 | 62.071 | −10.679 | 1.00 | 36.93 | N |
| ATOM | 1768 | CA | ALA | D | 13 | 31.748 | 62.366 | −9.733 | 1.00 | 40.49 | C |
| ATOM | 1769 | C | ALA | D | 13 | 31.847 | 63.860 | −9.433 | 1.00 | 40.25 | C |
| ATOM | 1770 | O | ALA | D | 13 | 31.411 | 64.695 | −10.236 | 1.00 | 39.24 | O |
| ATOM | 1771 | CB | ALA | D | 13 | 33.081 | 61.875 | −10.291 | 1.00 | 30.80 | C |
| ATOM | 1772 | N | PRO | D | 14 | 32.434 | 64.225 | −8.288 | 1.00 | 33.52 | N |
| ATOM | 1773 | CA | PRO | D | 14 | 32.647 | 65.646 | −7.994 | 1.00 | 38.76 | C |
| ATOM | 1774 | C | PRO | D | 14 | 33.382 | 66.324 | −9.141 | 1.00 | 44.78 | C |
| ATOM | 1775 | O | PRO | D | 14 | 34.233 | 65.718 | −9.798 | 1.00 | 36.43 | O |
| ATOM | 1776 | CB | PRO | D | 14 | 33.485 | 65.629 | −6.711 | 1.00 | 35.31 | C |

TABLE 10.3-continued

| | | | | | | | | | | |
|---|---|---|---|---|---|---|---|---|---|---|
| ATOM | 1777 | CG | PRO | D | 14 | 33.152 | 64.283 | −6.060 | 1.00 | 30.30 | C |
| ATOM | 1778 | CD | PRO | D | 14 | 32.928 | 63.345 | −7.208 | 1.00 | 32.96 | C |
| ATOM | 1779 | N | GLY | D | 15 | 33.008 | 67.579 | −9.410 | 1.00 | 45.92 | N |
| ATOM | 1780 | CA | GLY | D | 15 | 33.585 | 68.342 | −10.484 | 1.00 | 34.84 | C |
| ATOM | 1781 | C | GLY | D | 15 | 32.932 | 68.138 | −11.829 | 1.00 | 41.92 | C |
| ATOM | 1782 | O | GLY | D | 15 | 33.143 | 68.956 | −12.728 | 1.00 | 49.13 | O |
| ATOM | 1783 | N | GLN | D | 16 | 32.143 | 67.083 | −12.001 | 1.00 | 37.37 | N |
| ATOM | 1784 | CA | GLN | D | 16 | 31.533 | 66.844 | −13.302 | 1.00 | 48.89 | C |
| ATOM | 1785 | C | GLN | D | 16 | 30.220 | 67.627 | −13.500 | 1.00 | 47.03 | C |
| ATOM | 1786 | O | GLN | D | 16 | 29.744 | 68.367 | −12.628 | 1.00 | 39.51 | O |
| ATOM | 1787 | CB | GLN | D | 16 | 31.306 | 65.355 | −13.502 | 1.00 | 50.09 | C |
| ATOM | 1788 | CG | GLN | D | 16 | 32.570 | 64.589 | −13.809 | 1.00 | 57.03 | C |
| ATOM | 1789 | CD | GLN | D | 16 | 32.260 | 63.311 | −14.566 | 1.00 | 75.65 | C |
| ATOM | 1790 | OE1 | GLN | D | 16 | 31.830 | 62.302 | −13.979 | 1.00 | 62.08 | O |
| ATOM | 1791 | NE2 | GLN | D | 16 | 32.445 | 63.353 | −15.886 | 1.00 | 86.71 | N |
| ATOM | 1792 | N | LYS | D | 17 | 29.674 | 67.481 | −14.711 | 1.00 | 50.37 | N |
| ATOM | 1793 | CA | LYS | D | 17 | 28.424 | 68.054 | −15.189 | 1.00 | 47.34 | C |
| ATOM | 1794 | C | LYS | D | 17 | 27.325 | 67.004 | −15.183 | 1.00 | 51.01 | C |
| ATOM | 1795 | O | LYS | D | 17 | 27.566 | 65.822 | −15.440 | 1.00 | 57.21 | O |
| ATOM | 1796 | CB | LYS | D | 17 | 28.537 | 68.558 | −16.635 | 1.00 | 48.76 | C |
| ATOM | 1797 | CG | LYS | D | 17 | 29.325 | 69.812 | −16.889 | 1.00 | 66.24 | C |
| ATOM | 1798 | CD | LYS | D | 17 | 29.537 | 69.967 | −18.408 | 1.00 | 76.78 | C |
| ATOM | 1799 | CE | LYS | D | 17 | 30.502 | 71.109 | −18.742 | 1.00 | 85.45 | C |
| ATOM | 1800 | NZ | LYS | D | 17 | 30.739 | 71..204 | −20.209 | 1.00 | 85.79 | N |
| ATOM | 1801 | N | AVAL | D | 18 | 26.098 | 67.456 | −14.947 | 0.60 | 46.54 | N |
| ATOM | 1802 | CA | AVAL | D | 18 | 24.936 | 66.572 | −14.935 | 0.60 | 45.04 | C |
| ATOM | 1803 | C | AVAL | D | 18 | 23.728 | 67.369 | −15.412 | 0.60 | 42.17 | C |
| ATOM | 1804 | O | AVAL | D | 18 | 23.622 | 68.572 | −15.150 | 0.60 | 42.21 | O |
| ATOM | 1805 | CB | AVAL | D | 18 | 24.745 | 65.967 | −13.527 | 0.60 | 43.33 | C |
| ATOM | 1806 | CG1 | AVAL | D | 18 | 23.328 | 66.101 | −13.049 | 0.60 | 41.29 | C |
| ATOM | 1807 | CG2 | AVAL | D | 18 | 25.187 | 64.524 | −13.516 | 0.60 | 41.57 | C |
| ATOM | 1808 | N | BVAL | D | 18 | 26.101 | 67.445 | −14.920 | 0.40 | 46.52 | N |
| ATOM | 1809 | CA | BVAL | D | 18 | 24.961 | 66.551 | −15.030 | 0.40 | 45.04 | C |
| ATOM | 1810 | C | BVAL | D | 18 | 23.744 | 67.363 | −15.441 | 0.40 | 42.19 | C |
| ATOM | 1811 | O | BVAL | D | 18 | 23.643 | 68.561 | −15.158 | 0.40 | 42.6 | O |
| ATOM | 1812 | CB | BVAL | D | 18 | 24.729 | 65.769 | −13.718 | 0.40 | 43.17 | C |
| ATOM | 1813 | CG1 | BVAL | D | 18 | 24.057 | 66.644 | −12.663 | 0.40 | 42.54 | C |
| ATOM | 1814 | CG2 | BVAL | D | 18 | 23.942 | 64.530 | −14.005 | 0.40 | 42.54 | C |
| ATOM | 1815 | N | THR | D | 19 | 22.831 | 66.698 | −16.143 | 1.00 | 46.67 | N |
| ATOM | 1816 | CA | THR | D | 19 | 21.594 | 67.285 | −16.650 | 1.00 | 42.21 | C |
| ATOM | 1817 | C | THR | D | 19 | 20.412 | 66.449 | −16.178 | 1.00 | 42.60 | C |
| ATOM | 1818 | O | THR | D | 19 | 20.469 | 65.212 | −16.217 | 1.00 | 40.66 | O |
| ATOM | 1819 | CB | THR | D | 19 | 21.646 | 67.356 | −18.189 | 1.00 | 36.82 | C |
| ATOM | 1820 | OG1 | THR | D | 19 | 21.854 | 68.714 | −18.572 | 1.00 | 49.09 | O |
| ATOM | 1821 | CG2 | THR | D | 19 | 20.396 | 66.796 | −18.859 | 1.00 | 40.02 | C |
| ATOM | 1822 | N | ILE | D | 20 | 19.343 | 67.117 | −15.733 | 1.00 | 35.88 | N |
| ATOM | 1823 | CA | ILE | D | 20 | 18.132 | 66.439 | −15.267 | 1.00 | 33.46 | C |
| ATOM | 1824 | C | ILE | D | 20 | 16.954 | 66.997 | −16.042 | 1.00 | 38.36 | C |
| ATOM | 1825 | O | ILE | D | 20 | 16.680 | 68.200 | −15.976 | 1.00 | 36.03 | O |
| ATOM | 1826 | CB | ILE | D | 20 | 17.907 | 66.602 | −13.753 | 1.00 | 38.27 | C |
| ATOM | 1827 | CG1 | ILE | D | 20 | 19.043 | 65.927 | −12.976 | 1.00 | 32.31 | C |
| ATOM | 1828 | CG2 | ILE | D | 20 | 16.555 | 65.993 | −13.341 | 1.00 | 34.30 | C |
| ATOM | 1829 | CD1 | ILE | D | 20 | 19.010 | 66.199 | −11.490 | 1.00 | 28.88 | C |
| ATOM | 1830 | N | SER | D | 21 | 16.253 | 66.127 | −16.764 | 1.00 | 31.98 | N |
| ATOM | 1831 | CA | SER | D | 21 | 15.188 | 66.575 | −17.643 | 1.00 | 36.18 | C |
| ATOM | 1832 | C | SER | D | 21 | 13.814 | 66.346 | −17.011 | 1.00 | 40.44 | C |
| ATOM | 1833 | O | SER | D | 21 | 13.639 | 65.541 | −16.094 | 1.00 | 35.10 | O |
| ATOM | 1834 | CB | SER | D | 21 | 15.267 | 65.862 | −18.988 | 1.00 | 35.20 | C |
| ATOM | 1835 | OG | SER | D | 21 | 15.097 | 64.461 | −18.840 | 1.00 | 43.09 | O |
| ATOM | 1836 | N | CYS | D | 22 | 12.829 | 67.052 | −17.552 | 1.00 | 32.32 | N |
| ATOM | 1837 | CA | CYS | D | 22 | 11.476 | 67.044 | −17.012 | 1.00 | 36.57 | C |
| ATOM | 1838 | C | CYS | D | 22 | 10.549 | 67.317 | −18.192 | 1.00 | 36.72 | C |
| ATOM | 1839 | O | CYS | D | 22 | 10.444 | 68.454 | −18.656 | 1.00 | 33.99 | O |
| ATOM | 1840 | CB | CYS | D | 22 | 11.339 | 68.103 | −15.933 | 1.00 | 34.58 | C |
| ATOM | 1841 | SG | CYS | D | 22 | 9.650 | 68.451 | −15.371 | 1.00 | 54.36 | S |
| ATOM | 1842 | N | SER | D | 23 | 9.915 | 66.282 | −18.703 | 1.00 | 34.27 | N |
| ATOM | 1843 | CA | SER | D | 23 | 9.059 | 66.460 | −19.859 | 1.00 | 42.72 | C |
| ATOM | 1844 | C | SER | D | 23 | 7.582 | 66.345 | −19.454 | 1.00 | 41.50 | C |
| ATOM | 1845 | O | SER | D | 23 | 7.209 | 65.545 | −18.582 | 1.00 | 29.92 | O |
| ATOM | 1846 | CB | SER | D | 23 | 9.450 | 65.476 | −20.954 | 1.00 | 34.92 | C |
| ATOM | 1847 | OG | SER | D | 23 | 8.893 | 64.230 | −20.677 | 1.00 | 50.39 | O |
| ATOM | 1848 | N | GLY | D | 24 | 6.765 | 67.218 | −20.037 | 1.00 | 36.33 | N |
| ATOM | 1849 | CA | GLY | D | 24 | 5.336 | 67.237 | −19.809 | 1.00 | 38.73 | C |
| ATOM | 1850 | C | GLY | D | 24 | 4.600 | 67.510 | −21.103 | 1.00 | 39.14 | C |
| ATOM | 1851 | O | GLY | D | 24 | 4.942 | 66.945 | −22.139 | 1.00 | 42.42 | O |
| ATOM | 1852 | N | SER | D | 25 | 3.620 | 68.406 | −21.078 | 1.00 | 36.67 | N |
| ATOM | 1853 | CA | SER | D | 25 | 2.743 | 68.598 | −22.221 | 1.00 | 39.25 | C |
| ATOM | 1854 | C | SER | D | 25 | 2.382 | 70.072 | −22.346 | 1.00 | 38.01 | C |
| ATOM | 1855 | O | SER | D | 25 | 2.754 | 70.902 | −21.506 | 1.00 | 33.82 | O |
| ATOM | 1856 | CB | SER | D | 25 | 1.496 | 67.732 | −22.067 | 1.00 | 41.16 | C |

TABLE 10.3-continued

| ATOM | 1857 | OG | SER | D | 25 | 0.709 | 68.227 | −20.994 | 1.00 | 50.29 | O |
|---|---|---|---|---|---|---|---|---|---|---|---|
| ATOM | 1858 | N | SER | D | 26 | 1.657 | 70.404 | −23.420 | 1.00 | 31.89 | N |
| ATOM | 1859 | CA | SER | D | 26 | 1.329 | 71.809 | −23.656 | 1.00 | 36.67 | C |
| ATOM | 1860 | C | SER | D | 26 | 0.486 | 72.395 | −22.527 | 1.00 | 38.14 | C |
| ATOM | 1861 | O | SER | D | 26 | 0.548 | 73.600 | −22.271 | 1.00 | 38.11 | O |
| ATOM | 1862 | CB | SER | D | 26 | 0.624 | 71.976 | −25.002 | 1.00 | 31.63 | C |
| ATOM | 1863 | OG | SER | D | 26 | −0.356 | 70.980 | −25.146 | 1.00 | 53.99 | O |
| ATOM | 1864 | N | SER | D | 27 | −0.279 | 71.575 | −21.818 | 1.00 | 33.81 | N |
| ATOM | 1865 | CA | SER | D | 27 | −1.109 | 72.150 | −20.773 | 1.00 | 37.80 | C |
| ATOM | 1866 | C | SER | D | 27 | −0.387 | 72.281 | −19.431 | 1.00 | 40.08 | C |
| ATOM | 1867 | O | SER | D | 27 | −0.954 | 72.862 | −18.498 | 1.00 | 36.37 | O |
| ATOM | 1868 | CB | SER | D | 27 | −2.393 | 71.336 | −20.608 | 1.00 | 31.40 | C |
| ATOM | 1869 | OG | SER | D | 27 | −2.088 | 70.014 | −20.236 | 1.00 | 50.96 | O |
| ATOM | 1870 | N | ASN | D | 28 | 0.839 | 71.765 | −19.295 | 1.00 | 34.89 | N |
| ATOM | 1871 | CA | ASN | D | 28 | 1.555 | 72.073 | −18.068 | 1.00 | 33.57 | C |
| ATOM | 1872 | C | ASN | D | 28 | 2.831 | 72.854 | −18.389 | 1.00 | 34.78 | C |
| ATOM | 1873 | O | ASN | D | 28 | 2.800 | 74.091 | −18.405 | 1.00 | 36.75 | O |
| ATOM | 1874 | CB | ASN | D | 28 | 1.817 | 70.808 | −17.214 | 1.00 | 34.30 | C |
| ATOM | 1875 | CG | ASN | D | 28 | 2.277 | 69.580 | −18.027 | 1.00 | 34.72 | C |
| ATOM | 1876 | OD1 | ASN | D | 28 | 3.345 | 69.568 | −18.641 | 1.00 | 33.73 | O |
| ATOM | 1877 | ND2 | ASN | D | 28 | 1.500 | 68.515 | −17.949 | 1.00 | 35.11 | N |
| ATOM | 1878 | N | ILE | D | 29 | 3.952 | 72.171 | −18.633 | 1.00 | 33.54 | N |
| ATOM | 1879 | CA | ILE | D | 29 | 5.218 | 72.866 | −18.877 | 1.00 | 34.11 | C |
| ATOM | 1880 | C | ILE | D | 29 | 5.107 | 73.810 | −20.072 | 1.00 | 36.11 | C |
| ATOM | 1881 | O | ILE | D | 29 | 5.691 | 74.897 | −20.082 | 1.00 | 33.26 | O |
| ATOM | 1882 | CB | ILE | D | 29 | 6.350 | 71.840 | −19.063 | 1.00 | 33.30 | C |
| ATOM | 1883 | CG1 | ILE | D | 29 | 6.604 | 71.107 | −17.741 | 1.00 | 32.39 | C |
| ATOM | 1884 | CG2 | ILE | D | 29 | 7.621 | 72.520 | −19.555 | 1.00 | 25.88 | C |
| ATOM | 1885 | CD1 | ILE | D | 29 | 7.724 | 70.138 | −17.806 | 1.00 | 36.95 | C |
| ATOM | 1886 | N | GLY | D | 30 | 4.368 | 73.412 | −21.103 | 1.00 | 38.51 | N |
| ATOM | 1887 | CA | GLY | D | 30 | 4.274 | 74.237 | −22.289 | 1.00 | 30.45 | C |
| ATOM | 1888 | C | GLY | D | 30 | 3.608 | 75.580 | −22.062 | 1.00 | 38.50 | C |
| ATOM | 1889 | O | GLY | D | 30 | 3.763 | 76.475 | −22.889 | 1.00 | 40.64 | O |
| ATOM | 1890 | N | ASN | D | 31 | 2.836 | 75.744 | −20.987 | 1.00 | 37.18 | N |
| ATOM | 1891 | CA | ASN | D | 31 | 2.178 | 77.031 | −20.815 | 1.00 | 37.16 | C |
| ATOM | 1892 | C | ASN | D | 31 | 2.192 | 77.595 | −19.395 | 1.00 | 36.18 | C |
| ATOM | 1893 | O | ASN | D | 31 | 1.488 | 78.576 | −19.137 | 1.00 | 42.11 | O |
| ATOM | 1894 | CB | ASN | D | 31 | 0.731 | 76.942 | −21.340 | 1.00 | 41.60 | C |
| ATOM | 1895 | CG | ASN | D | 31 | 0.681 | 77.025 | −22.867 | 1.00 | 53.09 | C |
| ATOM | 1896 | OD1 | ASN | D | 31 | 0.759 | 78.110 | −23.442 | 1.00 | 63.01 | O |
| ATOM | 1897 | ND2 | ASN | D | 31 | 0.591 | 755.877 | −23.525 | 1.00 | 45.20 | N |
| ATOM | 1898 | N | ASN | D | 32 | 2.985 | 77.059 | −18.471 | 1.00 | 38.29 | N |
| ATOM | 1899 | CA | ASN | D | 32 | 3.026 | 77.622 | −17.128 | 1.00 | 35.50 | C |
| ATOM | 1900 | C | ASN | D | 32 | 4.467 | 77.757 | −16.662 | 1.00 | 33.99 | C |
| ATOM | 1901 | O | ASN | D | 32 | 5.394 | 77.247 | −17.291 | 1.00 | 37.19 | O |
| ATOM | 1902 | CB | ASN | D | 32 | 2.192 | 76.787 | −16.158 | 1.00 | 29.83 | C |
| ATOM | 1903 | CG | ASN | D | 32 | 0.731 | 76.754 | −16.548 | 1.00 | 35.04 | C |
| ATOM | 1904 | OD1 | ASN | D | 32 | 0.003 | 77.720 | −16.321 | 1.00 | 41.43 | O |
| ATOM | 1905 | ND2 | ASN | D | 32 | 0.299 | 75.657 | −17.166 | 1.00 | 38.66 | N |
| ATOM | 1906 | N | TYR | D | 33 | 4.647 | 78.497 | −15.572 | 1.00 | 30.88 | N |
| ATOM | 1907 | CA | TYR | D | 33 | 5.973 | 78.725 | −15.020 | 1.00 | 31.61 | C |
| ATOM | 1908 | C | TYR | D | 33 | 6.529 | 77.443 | −14.422 | 1.00 | 39.01 | C |
| ATOM | 1909 | O | TYR | D | 33 | 5.815 | 76.704 | −13.751 | 1.00 | 35.01 | O |
| ATOM | 1910 | CB | TYR | D | 33 | 5.925 | 79.804 | −13.951 | 1.00 | 27.05 | C |
| ATOM | 1911 | CG | TYR | D | 33 | 5.492 | 81.136 | −14.476 | 1.00 | 32.55 | C |
| ATOM | 1912 | CD1 | TYR | D | 33 | 6.214 | 81.780 | −15.478 | 1.00 | 29.14 | C |
| ATOM | 1913 | CD2 | TYR | D | 33 | 4.358 | 81.770 | −13.965 | 1.00 | 38.90 | C |
| ATOM | 1914 | CE1 | TYR | D | 33 | 5.805 | 83.036 | −15.967 | 1.00 | 36.47 | C |
| ATOM | 1915 | CE2 | TYR | D | 33 | 3.948 | 83.013 | −14.438 | 1.00 | 33.42 | C |
| ATOM | 1916 | CZ | TYR | D | 33 | 4.671 | 83.642 | −15.438 | 1.00 | 37.47 | C |
| ATOM | 1917 | OH | TYR | D | 33 | 4.246 | 84.866 | −15.903 | 1.00 | 36.22 | O |
| ATOM | 1918 | N | VAL | D | 34 | 7.821 | 77.195 | −14.623 | 1.00 | 33.97 | N |
| ATOM | 1919 | CA | VAL | D | 34 | 8.440 | 75.966 | −14.138 | 1.00 | 32.04 | C |
| ATOM | 1920 | C | VAL | D | 34 | 9.272 | 76.250 | −12.896 | 1.00 | 31.06 | C |
| ATOM | 1921 | O | VAL | D | 34 | 9.986 | 77.254 | −12.832 | 1.00 | 32.29 | O |
| ATOM | 1922 | CB | VAL | D | 34 | 9.292 | 75.308 | −15.236 | 1.00 | 33.98 | C |
| ATOM | 1923 | CG1 | VAL | D | 34 | 10.002 | 74.100 | −14.684 | 1.00 | 30.92 | C |
| ATOM | 1924 | CG2 | VAL | D | 34 | 8.407 | 74.884 | −16.397 | 1.00 | 34.56 | C |
| ATOM | 1925 | N | SER | D | 35 | 9.166 | 75.373 | −11.896 | 1.00 | 31.29 | N |
| ATOM | 1926 | CA | SER | D | 35 | 9.991 | 75.425 | −10.697 | 1.00 | 30.60 | C |
| ATOM | 1927 | C | SER | D | 35 | 10.791 | 74.134 | −10.560 | 1.00 | 35.34 | C |
| ATOM | 1928 | O | SER | D | 35 | 10.367 | 73.068 | −11.017 | 1.00 | 31.50 | O |
| ATOM | 1929 | CB | SER | D | 35 | 9.166 | 75.614 | −9.423 | 1.00 | 26.83 | C |
| ATOM | 1930 | OG | SER | D | 35 | 8.548 | 76.889 | −9.407 | 1.00 | 31.37 | O |
| ATOM | 1931 | N | TRP | D | 36 | 11.967 | 74.248 | −9.938 | 1.00 | 31.19 | N |
| ATOM | 1932 | CA | TRP | D | 36 | 12.774 | 73.104 | −9.559 | 1.00 | 30.26 | C |
| ATOM | 1933 | C | TRP | D | 36 | 12.996 | 73.142 | −8.060 | 1.00 | 29.04 | C |
| ATOM | 1934 | O | TRP | D | 36 | 13.286 | 74.196 | −7.491 | 1.00 | 29.53 | O |
| ATOM | 1935 | CB | TRP | D | 36 | 14.112 | 73.084 | −10.274 | 1.00 | 25.90 | C |
| ATOM | 1936 | CG | TRP | D | 36 | 14.009 | 72.705 | −11.713 | 1.00 | 32.87 | C |

TABLE 10.3-continued

| | | | | | | | | | | |
|---|---|---|---|---|---|---|---|---|---|---|
| ATOM | 1937 | CD1 | TRP | D | 36 | 13.867 | 73.552 | −12.773 | 1.00 | 33.05 | C |
| ATOM | 1938 | CD2 | TRP | D | 36 | 14.049 | 71.383 | −12.259 | 1.00 | 32.92 | C |
| ATOM | 1939 | NE1 | TRP | D | 36 | 13.812 | 72.835 | −13.947 | 1.00 | 33.23 | N |
| ATOM | 1940 | CE2 | TRP | D | 36 | 13.941 | 71.505 | −13.660 | 1.00 | 29.67 | C |
| ATOM | 1941 | CE3 | TRP | D | 36 | 14.187 | 70.108 | −11.701 | 1.00 | 32.52 | C |
| ATOM | 1942 | CZ2 | TRP | D | 36 | 13.946 | 70.401 | −14.512 | 1.00 | 32.64 | C |
| ATOM | 1943 | CZ3 | TRP | D | 36 | 14.185 | 69.012 | −12.546 | 1.00 | 30.06 | C |
| ATOM | 1944 | CH2 | TRP | D | 36 | 14.058 | 69.166 | −13.936 | 1.00 | 35.04 | C |
| ATOM | 1945 | N | TYR | D | 37 | 12.874 | 71.982 | −7.429 | 1.00 | 31.89 | N |
| ATOM | 1946 | CA | TYR | D | 37 | 13.051 | 71.848 | −5.995 | 1.00 | 29.68 | C |
| ATOM | 1947 | C | TYR | D | 37 | 14.168 | 70.859 | −5.693 | 1.00 | 36.72 | C |
| ATOM | 1948 | O | TYR | D | 37 | 14.324 | 69.839 | −6.383 | 1.00 | 33.31 | O |
| ATOM | 1949 | CB | TYR | D | 37 | 11.735 | 71.417 | −5.343 | 1.00 | 28.40 | C |
| ATOM | 1950 | CG | TYR | D | 37 | 10.598 | 72.378 | −5.659 | 1.00 | 30.46 | C |
| ATOM | 1951 | CD1 | TYR | D | 37 | 10.417 | 73.540 | −4.921 | 1.00 | 27.52 | C |
| ATOM | 1952 | CD2 | TYR | D | 37 | 9.723 | 72.130 | −6.719 | 1.00 | 29.85 | C |
| ATOM | 1953 | CE1 | TYR | D | 37 | 9.368 | 74.423 | −5.219 | 1.00 | 32.37 | C |
| ATOM | 1954 | CE2 | TYR | D | 37 | 8.691 | 72.993 | −7.019 | 1.00 | 27.34 | C |
| ATOM | 1955 | CZ | TYR | D | 37 | 8.517 | 74.137 | −6.271 | 1.00 | 30.55 | C |
| ATOM | 1956 | OH | TYR | D | 37 | 7.495 | 74.995 | −6.595 | 1.00 | 35.11 | O |
| ATOM | 1957 | N | GLN | D | 38 | 14.938 | 71.174 | −4.653 | 1.00 | 32.56 | N |
| ATOM | 1958 | CA | GLN | D | 38 | 16.019 | 70.332 | −4.174 | 1.00 | 30.13 | C |
| ATOM | 1959 | C | GLN | D | 38 | 15.690 | 69.837 | −2.770 | 1.00 | 33.68 | C |
| ATOM | 1960 | O | GLN | D | 38 | 15.362 | 70.635 | −1.880 | 1.00 | 31.93 | O |
| ATOM | 1961 | CB | GLN | D | 38 | 17.349 | 71.102 | −4.170 | 1.00 | 30.01 | C |
| ATOM | 1962 | CG | GLN | D | 38 | 18.527 | 70.323 | −3.564 | 1.00 | 28.04 | C |
| ATOM | 1963 | CD | GLN | D | 38 | 19.729 | 71.214 | −3.280 | 1.00 | 34.96 | C |
| ATOM | 1964 | OE1 | GLN | D | 38 | 19.664 | 72.147 | −2.473 | 1.00 | 32.51 | O |
| ATOM | 1965 | NE2 | GLN | D | 38 | 20.828 | 70.944 | −3.971 | 1.00 | 33.81 | N |
| ATOM | 1966 | N | GLN | D | 39 | 15.790 | 68.528 | −2.572 | 1.00 | 32.31 | N |
| ATOM | 1967 | CA | GLN | D | 39 | 15.552 | 67.918 | −1.266 | 1.00 | 38.47 | C |
| ATOM | 1968 | C | GLN | D | 39 | 16.805 | 67.162 | −0.843 | 1.00 | 33.22 | C |
| ATOM | 1969 | O | GLN | D | 39 | 17.057 | 66.051 | −1.324 | 1.00 | 33.95 | O |
| ATOM | 1970 | CB | GLN | D | 39 | 14.336 | 67.001 | −1.294 | 1.00 | 32.82 | C |
| ATOM | 1971 | CG | GLN | D | 39 | 13.941 | 66.543 | 0.090 | 1.00 | 38.29 | C |
| ATOM | 1972 | CD | GLN | D | 39 | 12.621 | 65.809 | 0.118 | 1.00 | 34.34 | C |
| ATOM | 1973 | OE1 | GLN | D | 39 | 12.221 | 65.165 | −0.862 | 1.00 | 38.36 | O |
| ATOM | 1974 | NE2 | GLN | D | 39 | 11.909 | 65.942 | 1.236 | 1.00 | 30.94 | N |
| ATOM | 1975 | N | LEU | D | 40 | 17.612 | 67.779 | 0.023 | 1.00 | 37.41 | N |
| ATOM | 1976 | CA | LEU | D | 40 | 18.766 | 67.069 | 0.571 | 1.00 | 41.50 | C |
| ATOM | 1977 | C | LEU | D | 40 | 18.281 | 65.913 | 1.450 | 1.00 | 44.75 | C |
| ATOM | 1978 | O | LEU | D | 40 | 17.202 | 65.988 | 2.051 | 1.00 | 39.49 | O |
| ATOM | 1979 | CB | LEU | D | 40 | 19.659 | 68.020 | 1.368 | 1.00 | 41.85 | C |
| ATOM | 1980 | CG | LEU | D | 40 | 20.144 | 69.262 | 0.592 | 1.00 | 42.10 | C |
| ATOM | 1981 | CD1 | LEU | D | 40 | 20.614 | 70.363 | 1.515 | 1.00 | 38.12 | C |
| ATOM | 1982 | CD2 | LEU | D | 40 | 21.236 | 68.903 | −0.380 | 1.00 | 31.04 | C |
| ATOM | 1983 | N | PRO | D | 41 | 19.045 | 64.827 | 1.520 | 1.00 | 47.88 | N |
| ATOM | 1984 | CA | PRO | D | 41 | 18.568 | 63.625 | 2.225 | 1.00 | 42.38 | C |
| ATOM | 1985 | C | PRO | D | 41 | 18.152 | 63.935 | 3.656 | 1.00 | 45.34 | C |
| ATOM | 1986 | O | PRO | D | 41 | 18.876 | 64.603 | 4.404 | 1.00 | 46.53 | O |
| ATOM | 1987 | CB | PRO | D | 41 | 19.780 | 62.691 | 2.182 | 1.00 | 43.44 | C |
| ATOM | 1988 | CG | PRO | D | 41 | 20.639 | 63.217 | 1.062 | 1.00 | 46.87 | C |
| ATOM | 1989 | CD | PRO | D | 41 | 20.427 | 64.690 | 1.030 | 1.00 | 42.00 | C |
| ATOM | 1990 | N | GLY | D | 42 | 16.963 | 63.459 | 4.029 | 1.00 | 38.47 | N |
| ATOM | 1991 | CA | GLY | D | 42 | 16.400 | 63.729 | 5.346 | 1.00 | 39.47 | C |
| ATOM | 1992 | C | GLY | D | 42 | 15.980 | 65.164 | 5.648 | 1.00 | 51.21 | C |
| ATOM | 1993 | O | GLY | D | 42 | 15.801 | 65.501 | 6.822 | 1.00 | 48.36 | O |
| ATOM | 1994 | N | THR | D | 43 | 15.793 | 4.642 | 4.642 | 1.00 | 44.85 | N |
| ATOM | 1995 | CA | THR | D | 43 | 15.393 | 67.415 | 4.867 | 1.00 | 47.53 | C |
| ATOM | 1996 | C | THR | D | 43 | 14.123 | 67.747 | 4.090 | 1.00 | 39.84 | C |
| ATOM | 1997 | O | THR | D | 43 | 13.599 | 66.944 | 3.315 | 1.00 | 42.92 | O |
| ATOM | 1998 | CB | THR | D | 43 | 16.503 | 68.414 | 4.475 | 1.00 | 45.75 | C |
| ATOM | 1999 | OG1 | THR | D | 43 | 16.602 | 68.488 | 3.045 | 1.00 | 36.10 | O |
| ATOM | 2000 | CG2 | THR | D | 43 | 17.857 | 67.992 | 5.056 | 1.00 | 41.52 | C |
| ATOM | 2001 | N | ALA | D | 44 | 13.619 | 68.952 | 4.318 | 1.00 | 38.36 | N |
| ATOM | 2002 | CA | ALA | D | 44 | 12.484 | 69.426 | 3.553 | 1.00 | 38.31 | C |
| ATOM | 2003 | C | ALA | D | 44 | 12.916 | 69.799 | 2.137 | 1.00 | 39.83 | C |
| ATOM | 2004 | O | ALA | D | 44 | 14.100 | 70.032 | 1.878 | 1.00 | 37.35 | O |
| ATOM | 2005 | CB | ALA | D | 44 | 11.849 | 70.632 | 4.238 | 1.00 | 38.73 | C |
| ATOM | 2006 | N | PRO | D | 45 | 11.977 | 69.838 | 1.194 | 1.00 | 36.33 | N |
| ATOM | 2007 | CA | PRO | D | 45 | 12.277 | 70.462 | −0.097 | 1.00 | 35.97 | C |
| ATOM | 2008 | C | PRO | D | 45 | 12.678 | 71.911 | 0.121 | 1.00 | 33.44 | C |
| ATOM | 2009 | O | PRO | D | 45 | 12.384 | 72.519 | 1.155 | 1.00 | 33.83 | O |
| ATOM | 2010 | CB | PRO | D | 45 | 10.948 | 70.365 | −0.872 | 1.00 | 28.82 | C |
| ATOM | 2011 | CG | PRO | D | 45 | 10.265 | 69.198 | −0.245 | 1.00 | 36.55 | C |
| ATOM | 2012 | CD | PRO | D | 45 | 10.615 | 69.281 | 1.225 | 1.00 | 34.97 | C |
| ATOM | 2013 | N | LYS | D | 46 | 13.362 | 72.460 | −0.880 | 1.00 | 35.89 | N |
| ATOM | 2014 | CA | LYS | D | 46 | 13.782 | 73.855 | −0.903 | 1.00 | 35.89 | C |
| ATOM | 2015 | C | LYS | D | 46 | 13.682 | 74.312 | −2.350 | 1.00 | 36.30 | C |
| ATOM | 2016 | O | LYS | D | 46 | 13.953 | 73.521 | −3.262 | 1.00 | 37.16 | O |

TABLE 10.3-continued

| | | | | | | | | | | |
|---|---|---|---|---|---|---|---|---|---|---|
| ATOM | 2017 | CB | LYS | D | 46 | 15.212 | 73.986 | −0.348 | 1.00 | 36.94 | C |
| ATOM | 2018 | CG | LYS | D | 46 | 15.919 | 45.292 | −0.569 | 1.00 | 43.26 | C |
| ATOM | 2019 | CD | LYS | D | 46 | 17.430 | 75.058 | −0.548 | 1.00 | 46.21 | C |
| ATOM | 2020 | CE | LYS | D | 46 | 18.178 | 76.121 | 0.262 | 1.00 | 53.10 | C |
| ATOM | 2021 | NZ | LYS | D | 46 | 19.663 | 75.960 | 0.110 | 1.00 | 59.22 | N1+ |
| ATOM | 2022 | N | LEU | D | 47 | 13.270 | 75.565 | −2.569 | 1.00 | 31.33 | N |
| ATOM | 2023 | CA | LEU | D | 47 | 13.200 | 76.086 | −3.931 | 1.00 | 31.83 | C |
| ATOM | 2024 | C | LEU | D | 47 | 14.601 | 76.299 | −4.513 | 1.00 | 35.29 | C |
| ATOM | 2025 | O | LEU | D | 47 | 15.454 | 76.963 | −3.911 | 1.00 | 33.02 | O |
| ATOM | 2026 | CB | LEU | D | 47 | 12.417 | 77.388 | −3.962 | 1.00 | 26.35 | C |
| ATOM | 2027 | CG | LEU | D | 47 | 12.230 | 78.066 | −5.326 | 1.00 | 35.90 | C |
| ATOM | 2028 | CD1 | LEU | D | 47 | 11.484 | 77.183 | −6.337 | 1.00 | 30.55 | C |
| ATOM | 2029 | CD2 | LEU | D | 47 | 11.508 | 79.411 | −5.153 | 1.00 | 30.96 | C |
| ATOM | 2030 | N | LEU | D | 48 | 14.837 | 75.725 | −5.687 | 1.00 | 34.87 | N |
| ATOM | 2031 | CA | LEU | D | 48 | 16.123 | 75.799 | −6.374 | 1.00 | 37.46 | C |
| ATOM | 2032 | C | LEU | D | 48 | 16.107 | 76.811 | −7.513 | 1.00 | 33.53 | C |
| ATOM | 2033 | O | LEU | D | 48 | 17.043 | 77.600 | −7.660 | 1.00 | 38.96 | O |
| ATOM | 2034 | CB | LEU | D | 48 | 16.516 | 74.416 | −6.926 | 1.00 | 27.18 | C |
| ATOM | 2035 | CG | LEU | D | 48 | 17.944 | 74.289 | −7.452 | 1.00 | 28.56 | C |
| ATOM | 2036 | CD1 | LEU | D | 48 | 18.892 | 74.353 | −6.289 | 1.00 | 32.28 | C |
| ATOM | 2037 | CD2 | LEU | D | 48 | 18.153 | 72.987 | −8.196 | 1.00 | 32.35 | C |
| ATOM | 2038 | N | LEU | D | 49 | 15.063 | 76.766 | −8.334 | 1.00 | 29.89 | N |
| ATOM | 2039 | CA | LEU | D | 49 | 14.871 | 77.609 | −9.500 | 1.00 | 31.38 | C |
| ATOM | 2040 | C | LEU | D | 49 | 13.383 | 77.885 | −9.629 | 1.00 | 35.27 | C |
| ATOM | 2041 | O | LEU | D | 49 | 12.563 | 76.964 | −9.504 | 1.00 | 32.72 | O |
| ATOM | 2042 | CB | LEU | D | 49 | 15.360 | 76.932 | −10.789 | 1.00 | 28.28 | C |
| ATOM | 2043 | CG | LEU | D | 49 | 16.848 | 76.621 | −10.937 | 1.00 | 40.25 | C |
| ATOM | 2044 | CD1 | LEU | D | 49 | 17.100 | 75.739 | −12.173 | 1.00 | 34.47 | C |
| ATOM | 2045 | CD2 | LEU | D | 49 | 17.642 | 77.943 | −10.996 | 1.00 | 32.52 | C |
| ATOM | 2046 | N | TYR | D | 50 | 13.031 | 79.136 | −9.909 | 1.00 | 28.76 | N |
| ATOM | 2047 | CA | TYR | D | 50 | 11.656 | 79.423 | −10.287 | 1.00 | 31.24 | C |
| ATOM | 2048 | C | TYR | D | 50 | 11.659 | 80.149 | −11.622 | 1.00 | 31.13 | C |
| ATOM | 2049 | O | TYR | D | 50 | 12.697 | 80.634 | −12.077 | 1.00 | 32.85 | O |
| ATOM | 2050 | CB | TYR | D | 50 | 10.923 | 80.211 | −9.196 | 1.00 | 30.09 | C |
| ATOM | 2051 | CG | TYR | D | 50 | 11.519 | 81.554 | −8.869 | 1.00 | 27.45 | C |
| ATOM | 2052 | CD1 | TYR | D | 50 | 12.726 | 81.672 | −8.163 | 1.00 | 31.73 | C |
| ATOM | 2053 | CD2 | TYR | D | 50 | 10.859 | 82.708 | −9.238 | 1.00 | 29.79 | C |
| ATOM | 2054 | CE1 | TYR | D | 50 | 13.253 | 82.920 | −7.843 | 1.00 | 34.25 | C |
| ATOM | 2055 | CE2 | TYR | D | 50 | 11.366 | 83.964 | −8.921 | 1.00 | 36.09 | C |
| ATOM | 2056 | CZ | TYR | D | 50 | 12.546 | 84.072 | −8.229 | 1.00 | 36.80 | C |
| ATOM | 2057 | OH | TYR | D | 50 | 12.995 | 85.340 | −7.954 | 1.00 | 34.65 | O |
| ATOM | 2058 | N | ASP | D | 51 | 10.487 | 80.198 | −12.260 | 1.00 | 33.46 | N |
| ATOM | 2059 | CA | ASP | D | 51 | 10.371 | 80.678 | −13.638 | 1.00 | 34.13 | C |
| ATOM | 2060 | C | ASP | D | 51 | 11.474 | 80.078 | −14.517 | 1.00 | 35.70 | C |
| ATOM | 2061 | O | ASP | D | 51 | 12.269 | 80.788 | −15.139 | 1.00 | 32.50 | O |
| ATOM | 2062 | CB | ASP | D | 51 | 10.410 | 82.199 | −13.683 | 1.00 | 33.19 | C |
| ATOM | 2063 | CG | ASP | D | 51 | 10.091 | 82.738 | −15.053 | 1.00 | 36.53 | C |
| ATOM | 2064 | OD1 | ASP | D | 51 | 9.413 | 82.007 | −15.813 | 1.00 | 37.05 | O |
| ATOM | 2065 | OD2 | ASP | D | 51 | 10.507 | 83.882 | −15.361 | 1.00 | 3634 | O1− |
| ATOM | 2066 | N | SER | D | 52 | 11.565 | 78.745 | −14.494 | 1.00 | 35.41 | N |
| ATOM | 2067 | CA | SER | D | 52 | 12.525 | 77.980 | −15.295 | 1.00 | 35.10 | C |
| ATOM | 2068 | C | SER | D | 52 | 13.986 | 78.153 | −14.884 | 1.00 | 34.26 | C |
| ATOM | 2069 | O | SER | D | 52 | 14.730 | 77.167 | −14.836 | 1.00 | 34.09 | O |
| ATOM | 2070 | CB | SER | D | 52 | 12.393 | 78.333 | −16.779 | 1.00 | 29.40 | C |
| ATOM | 2071 | OG | SER | D | 52 | 11.152 | 77.892 | −17.275 | 1.00 | 42.15 | O |
| ATOM | 2072 | N | ASN | D | 53 | 14.437 | 79.386 | −14.628 | 1.00 | 32.85 | N |
| ATOM | 2073 | CA | ASN | D | 53 | 15.878 | 79.558 | −14.463 | 1.00 | 32.56 | C |
| ATOM | 2074 | C | ASN | D | 53 | 16.290 | 80.660 | −13.495 | 1.00 | 34.70 | C |
| ATOM | 2075 | O | ASN | D | 53 | 17.467 | 81.027 | −13.485 | 1.00 | 34.38 | O |
| ATOM | 2076 | CB | ASN | D | 53 | 16.536 | 79.814 | −15.804 | 1.00 | 29.46 | C |
| ATOM | 2077 | CG | ASN | D | 53 | 16.066 | 81.113 | −16.443 | 1.00 | 40.20 | C |
| ATOM | 2078 | OD1 | ASN | D | 53 | 15.192 | 81.817 | −15.918 | 1.00 | 32.59 | O |
| ATOM | 2079 | ND2 | ASN | D | 53 | 16.652 | 81.440 | −17.583 | 1.00 | 37.64 | N |
| ATOM | 2080 | N | LYS | D | 54 | 15.391 | 81.191 | −12.677 | 1.00 | 36.81 | N |
| ATOM | 2081 | CA | LYS | D | 54 | 15.761 | 82.209 | −11.713 | 1.00 | 29.79 | C |
| ATOM | 2082 | C | LYS | D | 54 | 16.163 | 81.540 | −10.408 | 1.00 | 35.07 | C |
| ATOM | 2083 | O | LYS | D | 54 | 15.433 | 80.686 | −9.887 | 1.00 | 34.40 | O |
| ATOM | 2084 | CB | LYS | D | 54 | 14.601 | 83.166 | −11.469 | 1.00 | 34.19 | C |
| ATOM | 2085 | CG | LYS | D | 54 | 14.979 | 84.334 | −10.607 | 1.00 | 39.09 | C |
| ATOM | 2086 | CD | LYS | D | 54 | 15.984 | 85.215 | −11.319 | 1.00 | 36.81 | C |
| ATOM | 2087 | CE | LYS | D | 54 | 16.480 | 86.282 | −10.370 | 1.00 | 39.74 | C |
| ATOM | 2088 | NZ | LYS | D | 54 | 17.279 | 87.308 | −11.098 | 1.00 | 49.26 | N1+ |
| ATOM | 2089 | N | ARG | D | 55 | 17.318 | 81.924 | −9.890 | 1.00 | 38.57 | N |
| ATOM | 2090 | C | ARG | D | 55 | 17.333 | 82.285 | −7.476 | 1.00 | 39.73 | C |
| ATOM | 2091 | O | ARG | D | 55 | 17.511 | 83.503 | −7.533 | 1.00 | 41.35 | O |
| ATOM | 2092 | CA | AARG | D | 55 | 17.814 | 81.402 | −8.621 | 0.50 | 38.68 | C |
| ATOM | 2093 | CB | AARG | D | 55 | 19.341 | 81.344 | −8.605 | 0.50 | 37.77 | C |
| ATOM | 2094 | CG | AARG | D | 55 | 19.958 | 80.202 | −9.404 | 0.50 | 40.11 | C |
| ATOM | 2095 | CD | AARG | D | 55 | 21.494 | 80.251 | −9.387 | 0.50 | 40.35 | C |
| ATOM | 2096 | NE | AARG | D | 55 | 22.017 | 81.378 | −10.159 | 0.50 | 39.90 | N |

TABLE 10.3-continued

| ATOM | 2097 | CZ | AARG | D | 55 | 22.738 | 82.377 | −9.659 | 0.50 | 39.21 | C |
| ATOM | 2098 | NH1 | AARG | D | 55 | 23.141 | 83.349 | −10.459 | 0.50 | 39.24 | N1+ |
| ATOM | 2099 | NH2 | AARG | D | 55 | 23.060 | 82.406 | −8.369 | 0.50 | 34.82 | N |
| ATOM | 2100 | CA | BARG | D | 55 | 17.803 | 81.399 | −8.621 | 0.50 | 38.68 | C |
| ATOM | 2101 | CB | BARG | D | 55 | 19.324 | 81.321 | −8.607 | 0.50 | 37.74 | C |
| ATOM | 2102 | CG | BARG | D | 55 | 19.902 | 80.435 | −9.684 | 0.50 | 40.11 | C |
| ATOM | 2103 | CD | BARG | D | 55 | 21.390 | 80.690 | −9.875 | 0.50 | 41.27 | C |
| ATOM | 2104 | NE | BARG | D | 55 | 21.881 | 80.029 | −11.080 | 0.50 | 44.29 | N |
| ATOM | 2105 | CZ | BARG | D | 55 | 21.979 | 80.606 | −12.275 | 0.50 | 41.10 | C |
| ATOM | 2106 | NH1 | BARG | D | 55 | 21.632 | 81.878 | −12.448 | 0.50 | 43.98 | N1+ |
| ATOM | 2107 | NH2 | BARG | D | 55 | 22.436 | 79.903 | −13.299 | 0.50 | 37.99 | N |
| ATOM | 2108 | N | PRO | D | 56 | 16.709 | 81.722 | −6.444 | 1.00 | 42.43 | N |
| ATOM | 2109 | CA | PRO | D | 56 | 16.550 | 82.476 | −5.202 | 1.00 | 39.14 | C |
| ATOM | 2110 | C | PRO | D | 56 | 17.937 | 82.781 | −4.673 | 1.00 | 39.14 | C |
| ATOM | 2111 | O | PRO | D | 56 | 18.921 | 82.132 | −5.037 | 1.00 | 39.24 | O |
| ATOM | 2112 | CB | PRO | D | 56 | 15.800 | 81.513 | −4.264 | 1.00 | 40.40 | C |
| ATOM | 2113 | CG | PRO | D | 56 | 15.350 | 80.384 | −5.079 | 1.00 | 36.67 | C |
| ATOM | 2114 | CD | PRO | D | 56 | 16.195 | 80.347 | −6.344 | 1.00 | 38.20 | C |
| ATOM | 2115 | N | SER | D | 57 | 18.025 | 83.787 | −3.819 | 1.00 | 38.52 | N |
| ATOM | 2116 | CA | SER | D | 57 | 19.326 | 84.087 | −3.245 | 1.00 | 45.88 | C |
| ATOM | 2117 | C | SER | D | 57 | 19.760 | 82.911 | −2.381 | 1.00 | 44.76 | C |
| ATOM | 2118 | O | SER | D | 57 | 18.928 | 82.206 | −1.807 | 1.00 | 46.46 | O |
| ATOM | 2119 | CB | SER | D | 57 | 19.282 | 85.384 | −2.441 | 1.00 | 45.60 | C |
| ATOM | 2120 | OG | SER | D | 57 | 18.126 | 85.430 | −1.652 | 1.00 | 61.35 | O |
| ATOM | 2121 | N | GLY | D | 58 | 21.056 | 82.630 | −2.375 | 1.00 | 45.80 | N |
| ATOM | 2122 | CA | GLY | D | 58 | 21.558 | 81.468 | −1.677 | 1.00 | 38.95 | C |
| ATOM | 2123 | C | GLY | D | 58 | 21.780 | 80.253 | −2.549 | 1.00 | 45.79 | C |
| ATOM | 2124 | O | GLY | D | 58 | 22.406 | 79.290 | −2.093 | 1.00 | 50.05 | O |
| ATOM | 2125 | N | ILE | D | 59 | 21.280 | 80.246 | −3.777 | 1.00 | 44.59 | N |
| ATOM | 2126 | CA | ILE | D | 59 | 21.479 | 79.123 | −4.684 | 1.00 | 37.66 | C |
| ATOM | 2127 | C | ILE | D | 59 | 22.682 | 79.446 | −5.571 | 1.00 | 42.15 | C |
| ATOM | 2128 | O | ILE | D | 59 | 22.645 | 80.454 | −6.294 | 1.00 | 41.34 | O |
| ATOM | 2129 | CB | ILE | D | 59 | 20.232 | 78.831 | −5.528 | 1.00 | 40.49 | C |
| ATOM | 2130 | CG1 | ILE | D | 59 | 19.045 | 78.500 | −4.616 | 1.00 | 37.44 | C |
| ATOM | 2131 | CG2 | ILE | D | 59 | 20.527 | 77.690 | −6.542 | 1.00 | 36.08 | C |
| ATOM | 2132 | CD1 | ILE | D | 59 | 19.273 | 77.277 | −3.723 | 1.00 | 34.90 | C |
| ATOM | 2133 | N | PRO | D | 60 | 23.724 | 78.612 | −5.571 | 1.00 | 38.05 | N |
| ATOM | 2134 | CA | PRO | D | 60 | 24.938 | 78.914 | −6.342 | 1.00 | 42.90 | C |
| ATOM | 2135 | C | PRO | D | 60 | 24.666 | 78.936 | −7.835 | 1.00 | 40.36 | C |
| ATOM | 2136 | O | PRO | D | 60 | 23.778 | 78.245 | −8.333 | 1.00 | 40.44 | O |
| ATOM | 2137 | CB | PRO | D | 60 | 25.888 | 77.754 | −5.990 | 1.00 | 43.52 | C |
| ATOM | 2138 | CG | PRO | D | 60 | 25.222 | 76.963 | −4.934 | 1.00 | 44.09 | C |
| ATOM | 2139 | CD | PRO | D | 60 | 23.756 | 77.268 | −4.984 | 1.00 | 41.65 | C |
| ATOM | 2140 | N | ALA | D | 61 | 25.495 | 79.695 | −8.557 | 1.00 | 38.15 | N |
| ATOM | 2141 | CA | ALA | D | 61 | 25.351 | 79.835 | −10.003 | 1.00 | 46.92 | C |
| ATOM | 2142 | C | ALA | D | 61 | 25.639 | 78.546 | −10.780 | 1.00 | 41.95 | C |
| ATOM | 2143 | O | ALA | D | 61 | 25.376 | 78.501 | −11.990 | 1.00 | 41.08 | O |
| ATOM | 2144 | CB | ALA | D | 61 | 26.268 | 80.955 | −10.507 | 1.00 | 37.90 | C |
| ATOM | 2145 | N | ARG | D | 62 | 26.167 | 77.501 | −10.144 | 1.00 | 40.02 | N |
| ATOM | 2146 | CA | ARG | D | 62 | 26.364 | 76.277 | −10.909 | 1.00 | 39.12 | C |
| ATOM | 2147 | C | ARG | D | 62 | 25.061 | 75.511 | −11.136 | 1.00 | 41.84 | C |
| ATOM | 2148 | O | ARG | D | 62 | 25.060 | 74.529 | −11.894 | 1.00 | 38.44 | O |
| ATOM | 2149 | CB | ARG | D | 62 | 27.411 | 75.384 | −10.240 | 1.00 | 40.13 | C |
| ATOM | 2150 | CG | ARG | D | 62 | 27.061 | 74.940 | −8.830 | 1.00 | 51.16 | C |
| ATOM | 2151 | CD | ARG | D | 62 | 28.110 | 73.962 | −8.276 | 1.00 | 54.07 | C |
| ATOM | 2152 | NE | ARG | D | 62 | 27.617 | 73.327 | −7.065 | 1.00 | 42.44 | N |
| ATOM | 2153 | CZ | ARG | D | 62 | 27.632 | 73.937 | −5.888 | 1.00 | 48.82 | C |
| ATOM | 2154 | NH1 | ARG | D | 62 | 28.139 | 75.165 | −5.790 | 1.00 | 55.75 | N1+ |
| ATOM | 2155 | NH2 | ARG | D | 62 | 27.145 | 73.336 | −4.819 | 1.00 | 44.87 | N |
| ATOM | 2156 | N | PHE | D | 63 | 23.959 | 75.946 | −10.518 | 1.00 | 35.81 | N |
| ATOM | 2157 | CA | PHE | D | 63 | 22.630 | 75.461 | −10.857 | 1.00 | 36.89 | C |
| ATOM | 2158 | C | PHE | D | 63 | 22.032 | 76.381 | −11.914 | 1.00 | 41.20 | C |
| ATOM | 2159 | O | PHE | D | 63 | 22.021 | 77.610 | −11.749 | 1.00 | 39.30 | O |
| ATOM | 2160 | CB | PHE | D | 63 | 21.724 | 75.420 | −9.622 | 1.00 | 36.15 | C |
| ATOM | 2161 | CG | PHE | D | 63 | 22.177 | 74.455 | −8.550 | 1.00 | 35.88 | C |
| ATOM | 2162 | CD1 | PHE | D | 63 | 23.020 | 74.870 | −7.539 | 1.00 | 36.00 | C |
| ATOM | 2163 | CD2 | PHE | D | 63 | 21.747 | 73.132 | −8.556 | 1.00 | 38.64 | C |
| ATOM | 2164 | CE1 | PHE | D | 63 | 23.443 | 73.983 | −6.550 | 1.00 | 43.00 | C |
| ATOM | 2165 | CE2 | PHE | D | 63 | 22.165 | 72.239 | −7.572 | 1.00 | 37.52 | C |
| ATOM | 2166 | CZ | PHE | D | 63 | 23.013 | 72.664 | −6.565 | 1.00 | 36.44 | C |
| ATOM | 2167 | N | SER | D | 64 | 21.548 | 75.795 | −13.005 | 1.00 | 35.81 | N |
| ATOM | 2168 | CA | SER | D | 64 | 20.854 | 76.595 | −14.008 | 1.00 | 37.12 | C |
| ATOM | 2169 | C | SER | D | 64 | 19.753 | 75.760 | −14.648 | 1.00 | 38.07 | C |
| ATOM | 2170 | O | SER | D | 64 | 19.691 | 74.529 | −14.505 | 1.00 | 38.30 | O |
| ATOM | 2171 | CB | SER | D | 64 | 21.812 | 77.151 | −15.076 | 1.00 | 31.57 | C |
| ATOM | 2172 | OG | SER | D | 64 | 22.505 | 76.104 | −15.730 | 1.00 | 44.67 | O |
| ATOM | 2173 | N | GLY | D | 65 | 18.868 | 76.454 | −15.349 | 1.00 | 34.85 | N |
| ATOM | 2174 | CA | GLY | D | 65 | 17.712 | 75.817 | −15.927 | 1.00 | 38.26 | C |
| ATOM | 2175 | C | GLY | D | 65 | 17.422 | 76.371 | −17.302 | 1.00 | 40.50 | C |
| ATOM | 2176 | O | GLY | D | 65 | 17.829 | 77.479 | −17.661 | 1.00 | 39.25 | O |

TABLE 10.3-continued

| | | | | | | | | | | |
|---|---|---|---|---|---|---|---|---|---|---|
| ATOM | 2177 | N | SER | D | 66 | 16.706 | 75.570 | −18.071 | 1.00 | 33.85 | N |
| ATOM | 2178 | CA | SER | D | 66 | 16.204 | 76.050 | −19.344 | 1.00 | 35.96 | C |
| ATOM | 2179 | C | SER | D | 66 | 14.865 | 75.386 | −19.584 | 1.00 | 39.56 | C |
| ATOM | 2180 | O | SER | D | 66 | 14.493 | 74.412 | −18.914 | 1.00 | 36.55 | O |
| ATOM | 2181 | CB | SER | D | 66 | 17.164 | 75.765 | −20.490 | 1.00 | 36.16 | C |
| ATOM | 2182 | OG | SER | D | 66 | 17.463 | 74.379 | −20.517 | 1.00 | 43.70 | O |
| ATOM | 2183 | N | LYS | D | 67 | 14.132 | 75.959 | −20.522 | 1.00 | 31.53 | N |
| ATOM | 2184 | CA | LYS | D | 67 | 12.820 | 75.482 | −20.896 | 1.00 | 33.07 | C |
| ATOM | 2185 | C | LYS | D | 67 | 12.746 | 75.549 | −22.407 | 1.00 | 38.33 | C |
| ATOM | 2186 | O | LYS | D | 67 | 13.238 | 76.494 | −23.014 | 1.00 | 43.23 | O |
| ATOM | 2187 | CB | LYS | D | 67 | 11.690 | 76.313 | −20.249 | 1.00 | 32.47 | C |
| ATOM | 2188 | CG | LYS | D | 67 | 10.269 | 75.914 | −20.705 | 1.00 | 28.80 | C |
| ATOM | 2189 | CD | LYS | D | 67 | 9.194 | 76.736 | −20.001 | 1.00 | 35.59 | C |
| ATOM | 2190 | CE | LYS | D | 67 | 7.890 | 76.733 | −20.788 | 1.00 | 45.34 | C |
| ATOM | 2191 | NZ | LYS | D | 67 | 6.693 | 77.312 | −20.018 | 1.00 | 45.74 | N1+ |
| ATOM | 2192 | N | SER | D | 68 | 12.175 | 74.523 | −23.008 | 1.00 | 40.72 | N |
| ATOM | 2193 | CA | SER | D | 68 | 11.983 | 74.502 | −24.446 | 1.00 | 40.77 | C |
| ATOM | 2194 | C | SER | D | 68 | 10.705 | 73.722 | −24.702 | 1.00 | 40.33 | C |
| ATOM | 2195 | O | SER | D | 68 | 10.665 | 72.518 | −24.439 | 1.00 | 41.36 | O |
| ATOM | 2196 | CB | SER | D | 68 | 13.179 | 73.866 | −25.139 | 1.00 | 44.26 | C |
| ATOM | 2197 | OG | SER | D | 68 | 12.935 | 73.761 | −26.526 | 1.00 | 55.67 | O |
| ATOM | 2198 | N | GLY | D | 69 | 9.655 | 74.408 | −25.145 | 1.00 | 37.35 | N |
| ATOM | 2199 | CA | GLY | D | 69 | 8.413 | 73.715 | −25.466 | 1.00 | 34.14 | C |
| ATOM | 2200 | C | GLY | D | 69 | 7.800 | 73.055 | −24.242 | 1.00 | 37.93 | C |
| ATOM | 2201 | O | GLY | D | 69 | 7.543 | 73.700 | −23.220 | 1.00 | 34.02 | O |
| ATOM | 2202 | N | THR | D | 69 | 7.592 | 71.738 | −24.310 | 1.00 | 38.48 | N |
| ATOM | 2203 | CA | THR | D | 70 | 6.956 | 71.011 | −23.219 | 1.00 | 38.13 | C |
| ATOM | 2204 | C | THR | D | 70 | 7.967 | 70.318 | −22.304 | 1.00 | 39.79 | C |
| ATOM | 2205 | O | THR | D | 70 | 7.590 | 69.416 | −21.549 | 1.00 | 40.93 | O |
| ATOM | 2206 | CB | THR | D | 70 | 5.968 | 69.982 | −23.771 | 1.00 | 37.94 | C |
| ATOM | 2207 | OG1 | THR | D | 70 | 6.672 | 69.053 | −24.608 | 1.00 | 38.51 | O |
| ATOM | 2208 | CG2 | THR | D | 70 | 4.899 | 70.665 | −24.571 | 1.00 | 27.17 | C |
| ATOM | 2209 | N | SER | D | 71 | 9.240 | 70.702 | −22.357 | 1.00 | 32.96 | N |
| ATOM | 2210 | CA | SER | D | 71 | 10.202 | 70.129 | −21.431 | 1.00 | 40.52 | C |
| ATOM | 2211 | C | SER | D | 71 | 11.091 | 71.219 | −20.853 | 1.00 | 36.32 | C |
| ATOM | 2212 | O | SER | D | 71 | 11.231 | 72.312 | −21.411 | 1.00 | 44.52 | O |
| ATOM | 2213 | CB | SER | D | 71 | 11.049 | 69.031 | −22.089 | 1.00 | 48.49 | C |
| ATOM | 2214 | OG | SER | D | 71 | 11.991 | 69.599 | −22.976 | 1.00 | 58.32 | O |
| ATOM | 2215 | N | ALA | D | 72 | 11.645 | 70.915 | −19.686 | 1.00 | 31.74 | N |
| ATOM | 2216 | CA | ALA | D | 72 | 12.519 | 71.800 | −18.942 | 1.00 | 32.67 | C |
| ATOM | 2217 | C | ALA | D | 72 | 13.688 | 70.976 | −18.443 | 1.00 | 37.05 | C |
| ATOM | 2218 | O | ALA | D | 72 | 13.541 | 69.784 | −18.161 | 1.00 | 35.94 | O |
| ATOM | 2219 | CB | ALA | D | 72 | 11.796 | 72.461 | −17.758 | 1.00 | 29.67 | C |
| ATOM | 2220 | N | THR | D | 73 | 14.861 | 71.594 | −18.349 | 1.00 | 33.25 | N |
| ATOM | 2221 | CA | THR | D | 73 | 15.969 | 70.834 | −17.809 | 1.00 | 33.69 | C |
| ATOM | 2222 | C | THR | D | 73 | 16.765 | 71.667 | −16.813 | 1.00 | 36.67 | C |
| ATOM | 2223 | O | THR | D | 73 | 16.912 | 72.886 | −16.951 | 1.00 | 37.39 | O |
| ATOM | 2224 | CB | THR | D | 73 | 16.875 | 70.239 | −18.916 | 1.00 | 40.87 | C |
| ATOM | 2225 | OG1 | THR | D | 73 | 18.214 | 70.724 | −18.799 | 1.00 | 48.32 | O |
| ATOM | 2226 | CG2 | THR | D | 73 | 16.335 | 70.483 | −20.289 | 1.00 | 31.17 | C |
| ATOM | 2227 | N | LEU | D | 74 | 17.224 | 70.979 | −15.775 | 1.00 | 36.18 | N |
| ATOM | 2228 | CA | LEU | D | 74 | 18.084 | 71.536 | −14.749 | 1.00 | 40.71 | C |
| ATOM | 2229 | C | LEU | D | 74 | 19.514 | 71.068 | −15.005 | 1.00 | 39.16 | C |
| ATOM | 2230 | O | LEU | D | 74 | 19.747 | 69.887 | −15.269 | 1.00 | 36.86 | O |
| ATOM | 2231 | CB | LEU | D | 74 | 17.597 | 71.088 | −13.375 | 1.00 | 32.52 | C |
| ATOM | 2232 | CG | LEU | D | 74 | 18.632 | 71.088 | −12.262 | 1.00 | 33.76 | C |
| ATOM | 2233 | CD1 | LEU | D | 74 | 18.979 | 72.495 | −11.837 | 1.00 | 34.80 | C |
| ATOM | 2234 | CD2 | LEU | D | 74 | 18.078 | 70.285 | −11.105 | 1.00 | 28.46 | C |
| ATOM | 2235 | N | GLY | D | 75 | 20.456 | 71.992 | −14.964 | 1.00 | 39.23 | N |
| ATOM | 2236 | CA | GLY | D | 75 | 21.861 | 71.676 | −15.155 | 1.00 | 34.28 | C |
| ATOM | 2237 | C | GLY | D | 75 | 22.643 | 71.975 | −13.891 | 1.00 | 35.73 | C |
| ATOM | 2238 | O | GLY | D | 75 | 22.380 | 72.971 | −13.212 | 1.00 | 31.27 | O |
| ATOM | 2239 | N | ILE | D | 76 | 23.572 | 71.083 | −13.555 | 1.00 | 37.91 | N |
| ATOM | 2240 | CA | ILE | D | 76 | 24.460 | 71.270 | −12.416 | 1.00 | 37.96 | C |
| ATOM | 2241 | C | ILE | D | 76 | 25.880 | 71.043 | −12.900 | 1.00 | 44.61 | C |
| ATOM | 2242 | O | ILE | D | 76 | 26.245 | 69.912 | −13.243 | 1.00 | 45.05 | O |
| ATOM | 2243 | CB | ILE | D | 76 | 24.132 | 70.324 | −11.259 | 1.00 | 37.47 | C |
| ATOM | 2244 | CG1 | ILE | D | 76 | 22.612 | 70.258 | −11.056 | 1.00 | 38.58 | C |
| ATOM | 2245 | CG2 | ILE | D | 76 | 24.842 | 70.801 | −10.019 | 1.00 | 34.75 | C |
| ATOM | 2246 | CD1 | ILE | D | 76 | 22.182 | 69.396 | −9.926 | 1.00 | 35.25 | C |
| ATOM | 2247 | N | THR | D | 77 | 26.684 | 72.103 | −12.916 | 1.00 | 41.92 | N |
| ATOM | 2248 | CA | THR | D | 77 | 28.105 | 72.001 | −13.217 | 1.00 | 45.22 | C |
| ATOM | 2249 | C | THR | D | 77 | 28.911 | 71.995 | −11.922 | 1.00 | 49.05 | C |
| ATOM | 2250 | O | THR | D | 77 | 28.433 | 72.413 | −10.863 | 1.00 | 46.09 | O |
| ATOM | 2251 | CB | THR | D | 77 | 28.570 | 73.156 | −14.111 | 1.00 | 45.74 | C |
| ATOM | 2252 | OG1 | THR | D | 77 | 28.494 | 74.389 | −13.383 | 1.00 | 45.10 | O |
| ATOM | 2253 | CG2 | THR | D | 77 | 27.707 | 73.246 | −15.356 | 1.00 | 41.50 | C |
| ATOM | 2254 | N | GLY | D | 78 | 30.136 | 71.474 | −12.015 | 1.00 | 50.10 | N |
| ATOM | 2255 | CA | GLY | D | 78 | 31.054 | 71.450 | −10.893 | 1.00 | 40.32 | C |
| ATOM | 2256 | C | GLY | D | 78 | 30.509 | 70.763 | −9.660 | 1.00 | 47.60 | C |

TABLE 10.3-continued

| ATOM | 2257 | O | GLY | D | 78 | 30.599 | 71.321 | −8.562 | 1.00 | 46.13 | O |
|------|------|-----|-----|---|----|--------|--------|--------|------|-------|-----|
| ATOM | 2258 | N | LEU | D | 79 | 29.977 | 69.545 | −9.822 | 1.00 | 44.28 | N |
| ATOM | 2259 | CA | LEU | D | 79 | 29.291 | 68.851 | −8.735 | 1.00 | 41.62 | C |
| ATOM | 2260 | C | LEU | D | 79 | 30.097 | 68.875 | −7.445 | 1.00 | 41.28 | C |
| ATOM | 2261 | O | LEU | D | 79 | 31.306 | 68.625 | −7.445 | 1.00 | 43.99 | O |
| ATOM | 2262 | CB | LEU | D | 79 | 29.044 | 67.391 | −9.108 | 1.00 | 44.54 | C |
| ATOM | 2263 | CG | LEU | D | 79 | 27.718 | 66.829 | −9.591 | 1.00 | 41.80 | C |
| ATOM | 2264 | CD1 | LEU | D | 79 | 26.548 | 67.743 | −9.317 | 1.00 | 41.01 | C |
| ATOM | 2265 | CD2 | LEU | D | 79 | 27.807 | 66.456 | −11.048 | 1.00 | 48.29 | C |
| ATOM | 2266 | N | GLN | D | 80 | 29.407 | 69.147 | −6.341 | 1.00 | 38.12 | N |
| ATOM | 2267 | CA | GLN | D | 80 | 29.955 | 69.025 | −5.000 | 1.00 | 37.63 | C |
| ATOM | 2268 | C | GLN | D | 80 | 29.166 | 67.992 | −4.207 | 1.00 | 39.83 | C |
| ATOM | 2269 | O | GLN | D | 80 | 27.975 | 67.771 | −4.461 | 1.00 | 44.36 | O |
| ATOM | 2270 | CB | GLN | D | 80 | 29.925 | 70.349 | −4.277 | 1.00 | 35.93 | C |
| ATOM | 2271 | CG | GLN | D | 80 | 30.598 | 71.424 | −5.072 | 1.00 | 44.41 | C |
| ATOM | 2272 | CD | GLN | D | 80 | 30.602 | 72.746 | −4.351 | 1.00 | 48.07 | C |
| ATOM | 2273 | OE1 | GLN | D | 80 | 30.141 | 72.848 | −3.211 | 1.00 | 51.38 | O |
| ATOM | 2274 | NE2 | GLN | D | 80 | 31.108 | 73.778 | −5.018 | 1.00 | 49.68 | N |
| ATOM | 2275 | N | THR | D | 81 | 29.838 | 67.362 | −3.236 | 1.00 | 39.23 | N |
| ATOM | 2276 | CA | THR | D | 81 | 29.185 | 66.313 | −2.459 | 1.00 | 43.43 | C |
| ATOM | 2277 | C | THR | D | 81 | 27.905 | 66.827 | −1.825 | 1.00 | 38.49 | C |
| ATOM | 2278 | O | THR | D | 81 | 26.949 | 66.066 | −1.660 | 1.00 | 43.22 | O |
| ATOM | 2279 | CB | THR | D | 81 | 30.122 | 65.740 | −1.386 | 1.00 | 33.08 | C |
| ATOM | 2280 | OG1 | THR | D | 81 | 30.589 | 66.796 | −0.558 | 1.00 | 47.69 | O |
| ATOM | 2281 | CG2 | THR | D | 81 | 31.307 | 65.035 | −2.020 | 1.00 | 35.64 | C |
| ATOM | 2282 | N | GLY | D | 82 | 27.859 | 68.112 | −1.498 | 1.00 | 35.25 | N |
| ATOM | 2283 | CA | GLY | D | 82 | 26.664 | 68.722 | −0.952 | 1.00 | 40.04 | C |
| ATOM | 2284 | C | GLY | D | 82 | 25.510 | 68.895 | −1.929 | 1.00 | 38.60 | C |
| ATOM | 2285 | O | GLY | D | 82 | 24.437 | 69.339 | −1.510 | 1.00 | 35.12 | O |
| ATOM | 2286 | N | ASP | D | 83 | 25.694 | 68.543 | −3.200 | 1.00 | 33.43 | N |
| ATOM | 2287 | CA | ASP | D | 83 | 24.619 | 68.564 | −4.179 | 1.00 | 37.84 | C |
| ATOM | 2288 | C | ASP | D | 83 | 23.834 | 67.251 | −4.245 | 1.00 | 43.45 | C |
| ATOM | 2289 | O | ASP | D | 83 | 22.814 | 67.191 | −4.957 | 1.00 | 40.21 | O |
| ATOM | 2290 | CB | ASP | D | 83 | 25.181 | 68.882 | −5.566 | 1.00 | 33.25 | C |
| ATOM | 2291 | CG | ASP | D | 83 | 25.971 | 70.173 | −5.593 | 1.00 | 42.35 | C |
| ATOM | 2292 | OD1 | ASP | D | 83 | 25.680 | 71.085 | −4.788 | 1.00 | 36.88 | O |
| ATOM | 2293 | OD2 | ASP | D | 83 | 26.882 | 70.284 | −6.440 | 1.00 | 44.43 | O1− |
| ATOM | 2294 | N | GLU | D | 84 | 24.310 | 66.192 | −3.577 | 1.00 | 37.08 | N |
| ATOM | 2295 | CA | GLU | D | 84 | 23.578 | 64.931 | −3.529 | 1.00 | 38.14 | C |
| ATOM | 2296 | C | GLU | D | 84 | 22.192 | 65.159 | −2.929 | 1.00 | 37.73 | C |
| ATOM | 2297 | O | GLU | D | 84 | 22.075 | 65.642 | −1.800 | 1.00 | 36.95 | O |
| ATOM | 2298 | CB | GLU | D | 84 | 24.359 | 63.904 | −2.708 | 1.00 | 33.68 | C |
| ATOM | 2299 | CG | GLU | D | 84 | 23.683 | 62.544 | −2.653 | 1.00 | 41.33 | C |
| ATOM | 2300 | CD | GLU | D | 84 | 24.682 | 61.389 | −2.458 | 1.00 | 46.09 | C |
| ATOM | 2301 | OE1 | GLU | D | 84 | 24.374 | 60.429 | −1.716 | 1.00 | 49.48 | O |
| ATOM | 2302 | OE2 | GLU | D | 84 | 25.766 | 61.427 | −3.078 | 1.00 | 45.22 | O1− |
| ATOM | 2303 | N | ALA | D | 85 | 21.146 | 64.836 | −3.688 | 1.00 | 31.07 | N |
| ATOM | 2304 | CA | ALA | D | 85 | 19.786 | 65.206 | −3.298 | 1.00 | 29.56 | C |
| ATOM | 2305 | C | ALA | D | 85 | 18.818 | 64.596 | −4.293 | 1.00 | 32.77 | C |
| ATOM | 2306 | O | ALA | D | 85 | 19.218 | 64.022 | −5.314 | 1.00 | 32.03 | O |
| ATOM | 2307 | CB | ALA | D | 85 | 19.590 | 66.729 | −3.227 | 1.00 | 30.06 | C |
| ATOM | 2308 | N | ASP | D | 86 | 17.531 | 64.697 | −3.959 | 1.00 | 30.95 | N |
| ATOM | 2309 | CA | ASP | D | 86 | 16.457 | 64.474 | −4.921 | 1.00 | 30.44 | C |
| ATOM | 2310 | C | ASP | D | 86 | 16.015 | 65.817 | −5.481 | 1.00 | 33.26 | C |
| ATOM | 2311 | O | ASP | D | 86 | 15.958 | 66.816 | −4.752 | 1.00 | 29.91 | O |
| ATOM | 2312 | CB | ASP | D | 86 | 15.261 | 63.780 | −4.283 | 1.00 | 36.23 | C |
| ATOM | 2313 | CG | ASP | D | 86 | 15.600 | 62.414 | −3.757 | 1.00 | 39.79 | C |
| ATOM | 2314 | OD1 | ASP | D | 86 | 16.287 | 61.640 | −4.460 | 1.00 | 49.35 | O |
| ATOM | 2315 | OD2 | ASP | D | 86 | 15.202 | 62.134 | −2.620 | 1.00 | 52.11 | O1− |
| ATOM | 2316 | N | TYR | D | 87 | 15.723 | 65.834 | −6.775 | 1.00 | 28.24 | N |
| ATOM | 2317 | CA | TYR | D | 87 | 15.349 | 67.045 | −7.481 | 1.00 | 30.37 | C |
| ATOM | 2318 | C | TYR | D | 87 | 13.993 | 66.832 | −8.116 | 1.00 | 30.53 | C |
| ATOM | 2319 | O | TYR | D | 87 | 13.736 | 65.781 | −8.716 | 1.00 | 31.12 | O |
| ATOM | 2320 | CB | TYR | D | 87 | 16.407 | 67.425 | −8.550 | 1.00 | 31.35 | C |
| ATOM | 2321 | CG | TYR | D | 87 | 17.707 | 67.860 | −7.930 | 1.00 | 28.53 | C |
| ATOM | 2322 | CD2 | TYR | D | 87 | 18.711 | 66.933 | −7.628 | 1.00 | 29.65 | C |
| ATOM | 2323 | CD1 | TYR | D | 87 | 17.919 | 69.192 | −7.596 | 1.00 | 30.97 | C |
| ATOM | 2324 | CE2 | TYR | D | 87 | 19.913 | 67.350 | −7.040 | 1.00 | 36.12 | C |
| ATOM | 2325 | CE1 | TYR | D | 87 | 19.110 | 69.620 | −6.999 | 1.00 | 32.34 | C |
| ATOM | 2326 | CZ | TYR | D | 87 | 20.101 | 68.700 | −6.728 | 1.00 | 36.00 | C |
| ATOM | 2327 | OH | TYR | D | 87 | 21.261 | 69.124 | −6.123 | 1.00 | 36.35 | O |
| ATOM | 2328 | N | TYR | D | 88 | 13.130 | 67.833 | −7.986 | 1.00 | 31.77 | N |
| ATOM | 2329 | CA | TYR | D | 88 | 11.763 | 67.756 | −8.495 | 1.00 | 30.69 | C |
| ATOM | 2330 | C | TYR | D | 88 | 11.442 | 68.977 | −9.350 | 1.00 | 33.16 | C |
| ATOM | 2331 | O | TYR | D | 88 | 11.697 | 70.123 | −8.943 | 1.00 | 27.49 | O |
| ATOM | 2332 | CB | TYR | D | 88 | 10.755 | 67.662 | −7.330 | 1.00 | 28.47 | C |
| ATOM | 2333 | CG | TYR | D | 88 | 10.863 | 66.418 | −6.469 | 1.00 | 32.12 | C |
| ATOM | 2334 | CD1 | TYR | D | 88 | 10.157 | 65.254 | −6.797 | 1.00 | 33.44 | C |
| ATOM | 2335 | CD2 | TYR | D | 88 | 11.639 | 66.407 | −5.312 | 1.00 | 35.30 | C |
| ATOM | 2336 | CE1 | TYR | D | 88 | 10.246 | 64.107 | −6.011 | 1.00 | 33.26 | C |

TABLE 10.3-continued

| | | | | | | | | | | |
|---|---|---|---|---|---|---|---|---|---|---|
| ATOM | 2337 | CE2 | TYR | D | 88 | 11.735 | 65.256 | −4.505 | 1.00 | 28.88 | C |
| ATOM | 2338 | CZ | TYR | D | 88 | 11.038 | 64.121 | −4.860 | 1.00 | 35.12 | C |
| ATOM | 2339 | OH | TYR | D | 88 | 11.138 | 63.001 | −4.067 | 1.00 | 41.20 | O |
| ATOM | 2340 | N | CYS | D | 89 | 10.860 | 68.743 | −10.520 | 1.00 | 29.10 | N |
| ATOM | 2341 | CA | CYS | D | 89 | 10.217 | 69.855 | −11.206 | 1.00 | 33.19 | C |
| ATOM | 2342 | C | CYS | D | 89 | 8.723 | 69.907 | −10.850 | 1.00 | 37.48 | C |
| ATOM | 2343 | O | CYS | D | 89 | 8.110 | 68.906 | −10.450 | 1.00 | 33.89 | O |
| ATOM | 2344 | CB | CYS | D | 89 | 10.397 | 69.751 | 12.722 | 1.00 | 35.57 | C |
| ATOM | 2345 | SG | CYS | D | 89 | 9.788 | 68.160 | −13.353 | 1.00 | 50.43 | S |
| ATOM | 2346 | N | GLY | D | 90 | 8.153 | 71.103 | −10.985 | 1.00 | 35.51 | N |
| ATOM | 2347 | CA | GLY | D | 90 | 6.747 | 71.329 | −10.696 | 1.00 | 31.51 | C |
| ATOM | 2348 | C | GLY | D | 90 | 6.184 | 72.474 | −11.510 | 1.00 | 32.91 | C |
| ATOM | 2349 | O | GLY | C | 90 | 6.886 | 73.440 | −11.821 | 1.00 | 37.81 | O |
| ATOM | 2350 | N | THR | D | 91 | 4.905 | 72.347 | −11.876 | 1.00 | 29.44 | N |
| ATOM | 2351 | CA | THR | D | 91 | 4.112 | 73.391 | −12.523 | 1.00 | 35.31 | C |
| ATOM | 2352 | C | THR | D | 91 | 2.648 | 73.192 | −12.187 | 1.00 | 34.83 | C |
| ATOM | 2353 | O | TTHR | D | 91 | 2.252 | 72.229 | −11.533 | 1.00 | 31.62 | O |
| ATOM | 2354 | CB | THR | D | 91 | 4.039 | 73.364 | −14.063 | 1.00 | 36.67 | C |
| ATOM | 2355 | OG1 | THR | D | 91 | 4.722 | 72.256 | −14.635 | 1.00 | 42.40 | O |
| ATOM | 2356 | CG2 | THR | D | 91 | 4.377 | 74.637 | −14.683 | 1.00 | 25.98 | C |
| ATOM | 2357 | N | TRP | D | 92 | 1.845 | 74.047 | −12.800 | 1.00 | 33.75 | N |
| ATOM | 2358 | CA | TRP | D | 92 | 0.422 | 73.882 | −12.929 | 1.00 | 32.47 | C |
| ATOM | 2359 | C | TRP | D | 92 | 0.088 | 73.103 | −14.202 | 1.00 | 34.81 | C |
| ATOM | 2360 | O | TRP | D | 92 | 0.757 | 73.209 | −15.235 | 1.00 | 30.64 | O |
| ATOM | 2361 | CB | TRP | D | 92 | −0.234 | 75.251 | −12.956 | 1.00 | 33.91 | C |
| ATOM | 2362 | CG | TRP | D | 92 | −1.719 | 75.251 | −12.940 | 1.00 | 35.91 | C |
| ATOM | 2363 | CD1 | TRP | D | 92 | −2.553 | 75.591 | −13.969 | 1.00 | 31.74 | C |
| ATOM | 2364 | CD2 | TRP | D | 92 | −2.557 | 74.949 | −11.818 | 1.00 | 34.97 | C |
| ATOM | 2365 | NE1 | TRP | D | 92 | −3.860 | 75.519 | −13.554 | 1.00 | 37.78 | N |
| ATOM | 2366 | CE2 | TRP | D | 92 | −3.893 | 75.127 | −12.238 | 1.00 | 39.89 | C |
| ATOM | 2367 | CE3 | TRP | D | 92 | −2.308 | 74.567 | −10.494 | 1.00 | 27.09 | C |
| ATOM | 2368 | CZ2 | TRP | D | 92 | −4.979 | 74.921 | −11.380 | 1.00 | 36.03 | C |
| ATOM | 2369 | CZ3 | TRP | D | 92 | −3.384 | 74.357 | −9.643 | 1.00 | 35.46 | C |
| ATOM | 2370 | CH2 | TRP | D | 92 | −4.706 | 74.542 | −10.087 | 1.00 | 35.32 | C |
| ATOM | 2371 | N | ASP | D | 93 | −0.943 | 72.296 | −14.109 | 1.00 | 32.62 | N |
| ATOM | 2372 | CA | ASP | D | 93 | −1.540 | 71.671 | −15.277 | 1.00 | 38.27 | C |
| ATOM | 2373 | C | ASP | D | 93 | −2.925 | 72.275 | −15.476 | 1.00 | 37.51 | C |
| ATOM | 2374 | O | ASP | D | 93 | −3.809 | 72.089 | −14.634 | 1.00 | 39.63 | O |
| ATOM | 2375 | CB | ASP | D | 93 | −1.609 | 70.162 | −15.121 | 1.00 | 37.98 | C |
| ATOM | 2376 | CG | ASP | D | 93 | −2.016 | 69.490 | −16.396 | 1.00 | 37.56 | C |
| ATOM | 2377 | OD1 | ASP | D | 93 | −3.109 | 69.827 | −16.919 | 1.00 | 38.96 | O1− |
| ATOM | 2378 | OD2 | ASP | D | 93 | −1.226 | 68.659 | −16.884 | 1.00 | 37.13 | O |
| ATOM | 2379 | N | SER | D | 94 | −3.094 | 73.010 | −16.583 | 1.00 | 40.55 | N |
| ATOM | 2380 | CA | SER | D | 94 | −4.324 | 73.756 | −16.838 | 1.00 | 43.35 | C |
| ATOM | 2381 | C | SER | D | 94 | −5.502 | 72.843 | −17.132 | 1.00 | 41.15 | C |
| ATOM | 2382 | O | SER | D | 94 | −6.643 | 73.204 | −16.848 | 1.00 | 47.84 | O |
| ATOM | 2383 | CB | SER | D | 94 | −4.124 | 74.716 | −18.009 | 1.00 | 37.93 | C |
| ATOM | 2384 | OG | SER | D | 94 | −3.093 | 75.653 | −17.720 | 1.00 | 50.29 | O |
| ATOM | 2385 | N | SER | D | 95 | −5.261 | 71.659 | −17.656 | 1.00 | 39.23 | N |
| ATOM | 2386 | CA | SER | D | 95 | −6.392 | 70.814 | −17.991 | 1.00 | 45.37 | C |
| ATOM | 2387 | C | SER | D | 95 | −6.795 | 69.916 | −16.843 | 1.00 | 44.47 | C |
| ATOM | 2388 | O | SER | D | 95 | −7.981 | 69.617 | −16.704 | 1.00 | 52.00 | O |
| ATOM | 2389 | CB | SER | D | 95 | −6.084 | 69.960 | −19.223 | 1.00 | 44.25 | C |
| ATOM | 2390 | OG | SER | D | 95 | −5.390 | 68.785 | −18.856 | 1.00 | 58.75 | O |
| ATOM | 2391 | N | LEU | D | 96 | −5.845 | 69.487 | −16.012 | 1.00 | 43.88 | N |
| ATOM | 2392 | CA | LEU | D | 96 | −6.173 | 68.775 | −14.780 | 1.00 | 37.73 | C |
| ATOM | 2393 | C | LEU | D | 96 | −6.491 | 69.723 | −13.621 | 1.00 | 36.61 | C |
| ATOM | 2394 | O | LEU | D | 96 | −6.885 | 69.255 | −12.550 | 1.00 | 38.29 | O |
| ATOM | 2395 | CB | LEU | D | 96 | −5.019 | 67.839 | −14.391 | 1.00 | 41.42 | C |
| ATOM | 2396 | CG | LEU | D | 96 | −4.577 | 66.750 | −15.380 | 1.00 | 39.10 | C |
| ATOM | 2397 | CD1 | LEU | D | 96 | −3.261 | 66.160 | −14.963 | 1.00 | 34.94 | C |
| ATOM | 2398 | CD2 | LEU | D | 96 | −5.612 | 65.640 | −15.506 | 1.00 | 35.48 | C |
| ATOM | 2399 | N | ASN | D | 97 | −6.353 | 71.034 | −13.811 | 1.00 | 37.50 | N |
| ATOM | 2400 | CA | ASN | D | 97 | −6.524 | 72.032 | −12.750 | 1.00 | 39.48 | C |
| ATOM | 2401 | C | ASN | D | 97 | −5.885 | 71.606 | −11.418 | 1.00 | 35.80 | C |
| ATOM | 2402 | O | ASN | D | 97 | −6.519 | 71.581 | −10.367 | 1.00 | 35.42 | O |
| ATOM | 2403 | CB | ASN | D | 97 | −8.002 | 72.403 | −12.591 | 1.00 | 33.46 | C |
| ATOM | 2404 | CG | ASN | D | 97 | −8.304 | 73.766 | −13.211 | 1.00 | 59.81 | C |
| ATOM | 2405 | OD1 | ASN | D | 97 | −8.600 | 74.731 | −12.490 | 1.00 | 63.64 | O |
| ATOM | 2406 | ND2 | ASN | D | 97 | −8.104 | 73.888 | −14.535 | 1.00 | 48.78 | N |
| ATOM | 2407 | N | THR | D | 98 | −4.584 | 71.319 | −11.468 | 1.00 | 34.96 | N |
| ATOM | 2408 | CA | THR | D | 98 | −3.880 | 70.883 | −10.267 | 1.00 | 40.51 | C |
| ATOM | 2409 | C | THR | D | 98 | −2.389 | 71.197 | −10.382 | 1.00 | 33.13 | C |
| ATOM | 2410 | O | THR | D | 98 | −1.843 | 71.349 | −11.482 | 1.00 | 33.25 | O |
| ATOM | 2411 | CB | THR | D | 98 | −4.095 | 69.378 | −10.000 | 1.00 | 31.21 | C |
| ATOM | 2412 | OG1 | THR | D | 98 | −3.498 | 69.047 | −8.749 | 1.00 | 36.06 | O |
| ATOM | 2413 | CG2 | THR | D | 98 | −3.428 | 68.531 | −11.061 | 1.00 | 31.76 | C |
| ATOM | 2414 | N | VAL | D | 99 | −1.730 | 71.290 | −9.222 | 1.00 | 29.98 | N |
| ATOM | 2415 | CA | VAL | D | 99 | −0.267 | 71.342 | −9.211 | 1.00 | 34.24 | C |
| ATOM | 2416 | C | VAL | D | 99 | 0.296 | 69.972 | −9.558 | 1.00 | 34.16 | C |

TABLE 10.3-continued

| | | | | | | | | | | |
|---|---|---|---|---|---|---|---|---|---|---|
| ATOM | 2417 | O | VAL | D | 99 | −0.215 | 68.936 | −9.120 | 1.00 | 34.33 | O |
| ATOM | 2418 | CB | VAL | D | 99 | 0.278 | 71.796 | −7.849 | 1.00 | 33.92 | C |
| ATOM | 2419 | CG1 | VAL | D | 99 | 1.787 | 71.619 | −7.819 | 1.00 | 30.13 | C |
| ATOM | 2420 | CG2 | VAL | D | 99 | −0.114 | 73.241 | −7.535 | 1.00 | 28.38 | C |
| ATOM | 2421 | N | VAL | D | 100 | 1.375 | 69.952 | −10.321 | 1.00 | 29.37 | N |
| ATOM | 2422 | CA | VAL | D | 100 | 1.871 | 68.706 | −10.875 | 1.00 | 30.81 | C |
| ATOM | 2423 | C | VAL | D | 100 | 3.380 | 68.659 | −10.653 | 1.00 | 33.23 | C |
| ATOM | 2424 | O | VAL | D | 100 | 4.072 | 69.662 | −10.890 | 1.00 | 32.58 | O |
| ATOM | 2425 | CB | VAL | D | 100 | 1.442 | 68.618 | −12.352 | 1.00 | 32.14 | C |
| ATOM | 2426 | CG1 | VAL | D | 100 | 2.538 | 68.362 | −13.255 | 1.00 | 38.21 | C |
| ATOM | 2427 | CG2 | VAL | D | 100 | 0.327 | 67.591 | −12.507 | 1.00 | 35.01 | C |
| ATOM | 2428 | N | PHE | D | 101 | 3.869 | 67.537 | −10.090 | 1.00 | 32.44 | N |
| ATOM | 2429 | CA | PHE | D | 101 | 5.292 | 67.296 | −9.826 | 1.00 | 28.74 | C |
| ATOM | 2430 | C | PHE | D | 101 | 5.824 | 66.191 | −10.728 | 1.00 | 30.41 | C |
| ATOM | 2431 | O | PHE | D | 101 | 5.091 | 65.280 | −11.116 | 1.00 | 36.07 | O |
| ATOM | 2432 | CB | PHE | D | 101 | 5.571 | 66.879 | −8.367 | 1.00 | 29.14 | C |
| ATOM | 2433 | CG | PHE | D | 101 | 5.505 | 68.006 | −7.372 | 1.00 | 29.14 | C |
| ATOM | 2434 | CD1 | PHE | D | 101 | 6.472 | 68.991 | −7.355 | 1.00 | 29.41 | C |
| ATOM | 2435 | CD2 | PHE | D | 101 | 4.483 | 68.067 | −6.438 | 1.00 | 29.40 | C |
| ATOM | 2436 | CE1 | PHE | D | 101 | 6.421 | 70.041 | −6.430 | 1.00 | 30.71 | C |
| ATOM | 2437 | CE2 | PHE | D | 101 | 4.412 | 69.107 | −5.519 | 1.00 | 31.48 | C |
| ATOM | 2438 | CZ | PHE | D | 101 | 5.388 | 70.100 | −5.509 | 1.00 | 28.28 | C |
| ATOM | 2439 | N | GLY | D | 102 | 7.112 | 66.269 | −11.069 | 1.00 | 35.21 | N |
| ATOM | 2440 | CA | GLY | D | 102 | 7.774 | 65.104 | −11.621 | 1.00 | 30.07 | C |
| ATOM | 2441 | C | GLY | D | 102 | 7.949 | 64.054 | −10.539 | 1.00 | 34.24 | C |
| ATOM | 2442 | O | GLY | D | 102 | 7.809 | 64.324 | −9.342 | 1.00 | 32.05 | O |
| ATOM | 2443 | N | GLY | D | 103 | 8.282 | 62.833 | −10.962 | 1.00 | 33.87 | N |
| ATOM | 2444 | CA | GLY | D | 103 | 8.500 | 61.756 | −9.998 | 1.00 | 30.14 | C |
| ATOM | 2445 | C | GLY | D | 103 | 9.767 | 61.896 | −9.164 | 1.00 | 33.06 | C |
| ATOM | 2446 | O | GLY | D | 103 | 9.929 | 61.153 | −8.195 | 1.00 | 33.57 | O |
| ATOM | 2447 | N | GLY | D | 104 | 10.649 | 62.840 | −9.500 | 1.00 | 34.22 | N |
| ATOM | 2448 | CA | GLY | D | 104 | 11.866 | 63.034 | −8.746 | 1.00 | 30.60 | C |
| ATOM | 2449 | C | GLY | D | 104 | 13.056 | 62.330 | −9.363 | 1.00 | 32.84 | C |
| ATOM | 2450 | O | GLY | D | 104 | 12.939 | 61.230 | −9.914 | 1.00 | 37.98 | O |
| ATOM | 2451 | N | THR | D | 105 | 14.219 | 62.953 | −9.267 | 1.00 | 33.92 | N |
| ATOM | 2452 | CA | THR | D | 105 | 15.460 | 62.372 | −9.749 | 1.00 | 32.14 | C |
| ATOM | 2453 | C | THR | D | 105 | 16.422 | 62.308 | −8.581 | 1.00 | 35.31 | C |
| ATOM | 2454 | O | THR | D | 105 | 16.683 | 63.335 | −7.945 | 1.00 | 33.86 | O |
| ATOM | 2455 | CB | THR | D | 105 | 16.052 | 63.202 | −10.878 | 1.00 | 35.69 | C |
| ATOM | 2456 | OG1 | THR | D | 105 | 15.118 | 63.236 | −11.966 | 1.00 | 33.00 | O |
| ATOM | 2457 | CG2 | THR | D | 105 | 17.374 | 62.575 | −11.328 | 1.00 | 32.50 | C |
| ATOM | 2458 | N | LYS | D | 106 | 16.895 | 61.095 | −8.260 | 1.00 | 35.10 | N |
| ATOM | 2459 | CA | LYS | D | 106 | 17.920 | 60.928 | −7.232 | 1.00 | 39.20 | C |
| ATOM | 2460 | C | LYS | D | 106 | 19.287 | 61.212 | −7.857 | 1.00 | 35.77 | C |
| ATOM | 2461 | O | LYS | D | 106 | 19.709 | 60.517 | −8.796 | 1.00 | 33.65 | O |
| ATOM | 2462 | CB | LYS | D | 106 | 17.875 | 59.523 | −6.612 | 1.00 | 37.13 | C |
| ATOM | 2463 | CG | LYS | D | 106 | 18.991 | 59.257 | −5.575 | 1.00 | 41.72 | C |
| ATOM | 2464 | CD | LYS | D | 106 | 18.843 | 57.864 | −4.893 | 1.00 | 66.03 | C |
| ATOM | 2465 | CE | LYS | D | 106 | 20.060 | 57.472 | −4.002 | 1.00 | 43.48 | C |
| ATOM | 2466 | NZ | LYS | D | 106 | 20.399 | 58.527 | −2.969 | 1.00 | 59.67 | N1+ |
| ATOM | 2467 | N | LEU | D | 107 | 19.955 | 62.253 | −7.355 | 1.00 | 37.32 | N |
| ATOM | 2468 | CA | LEU | D | 107 | 21.313 | 62.606 | −7.757 | 1.00 | 39.36 | C |
| ATOM | 2469 | C | LEU | D | 107 | 22.264 | 62.033 | −6.720 | 1.00 | 37.65 | C |
| ATOM | 2470 | O | LEU | D | 107 | 22.211 | 62.419 | −5.542 | 1.00 | 38.47 | O |
| ATOM | 2471 | CB | LEU | D | 107 | 21.518 | 64.129 | −7.855 | 1.00 | 26.67 | C |
| ATOM | 2472 | CG | LEU | D | 107 | 22.784 | 64.731 | −8.570 | 1.00 | 37.81 | C |
| ATOM | 2473 | CD1 | LEU | D | 107 | 23.134 | 66.182 | −8.167 | 1.00 | 38.40 | C |
| ATOM | 2474 | CD2 | LEU | D | 107 | 24.043 | 63.923 | −8.466 | 1.00 | 34.25 | C |
| ATOM | 2475 | N | THR | D | 108 | 23.176 | 61.171 | −7.148 | 1.00 | 30.15 | N |
| ATOM | 2476 | CA | THR | D | 108 | 24.270 | 60.823 | −6.255 | 1.00 | 39.12 | C |
| ATOM | 2477 | C | THR | D | 108 | 25.591 | 61.351 | −6.810 | 1.00 | 33.08 | C |
| ATOM | 2478 | O | THR | D | 108 | 25.888 | 61.234 | −8.004 | 1.00 | 36.87 | O |
| ATOM | 2479 | CB | THR | D | 108 | 24.311 | 59.316 | −5.951 | 1.00 | 42.14 | C |
| ATOM | 2480 | OG1 | THR | D | 108 | 25.514 | 58.733 | −6.459 | 1.00 | 51.43 | O |
| ATOM | 2481 | CG2 | THR | D | 108 | 23.075 | 58.603 | −6.471 | 1.00 | 39.87 | C |
| ATOM | 2482 | N | VAL | D | 109 | 26.338 | 62.011 | −5.950 | 1.00 | 28.89 | N |
| ATOM | 2483 | CA | VAL | D | 109 | 27.679 | 62.461 | −6.272 | 1.00 | 36.64 | C |
| ATOM | 2484 | C | VAL | D | 109 | 28.632 | 61.337 | −5.873 | 1.00 | 36.03 | C |
| ATOM | 2485 | O | VAL | D | 109 | 28.838 | 61.088 | −4.686 | 1.00 | 34.38 | O |
| ATOM | 2486 | CB | VAL | D | 109 | 27.999 | 63.769 | −5.547 | 1.00 | 39.07 | C |
| ATOM | 2487 | CG1 | VAL | D | 109 | 29.402 | 64.264 | −5.930 | 1.00 | 39.69 | C |
| ATOM | 2488 | CG2 | VAL | D | 109 | 26.914 | 64.807 | −5.871 | 1.00 | 39.03 | C |
| ATOM | 2489 | N | LEU | D | 110 | 29.179 | 60.637 | −6.868 | 1.00 | 36.80 | N |
| ATOM | 2490 | CA | LEU | D | 110 | 29.935 | 59.407 | −6.646 | 1.00 | 35.35 | C |
| ATOM | 2491 | C | LEU | D | 110 | 31.166 | 59.653 | −5.794 | 1.00 | 38.39 | C |
| ATOM | 2492 | O | LEU | D | 110 | 32.109 | 60.294 | −6.255 | 1.00 | 39.60 | O |
| ATOM | 2493 | CB | LEU | D | 110 | 30.358 | 58.813 | −7.978 | 1.00 | 31.68 | C |
| ATOM | 2494 | CG | LEU | D | 110 | 29.190 | 58.470 | −8.886 | 1.00 | 42.08 | C |
| ATOM | 2495 | CD1 | LEU | D | 110 | 29.720 | 58.230 | −10.264 | 1.00 | 33.32 | C |
| ATOM | 2496 | CD2 | LEU | D | 110 | 28.489 | 57.239 | −8.343 | 1.00 | 40.75 | C |

TABLE 10.3-continued

| | | | | | | | | | | |
|---|---|---|---|---|---|---|---|---|---|---|
| ATOM | 2497 | N | SER | D | 111 | 31.182 | 59.144 | −4.564 | 1.00 | 38.34 | N |
| ATOM | 2498 | CA | SER | D | 111 | 32.330 | 59.296 | −3.680 | 1.00 | 44.10 | C |
| ATOM | 2499 | C | SER | D | 111 | 32.991 | 57.956 | −3.361 | 1.00 | 43.27 | C |
| ATOM | 2500 | O | SER | D | 111 | 33.843 | 57.885 | −2.476 | 1.00 | 38.62 | O |
| ATOM | 2501 | CB | SER | D | 111 | 31.917 | 60.001 | −2.396 | 1.00 | 39.42 | C |
| ATOM | 2502 | OG | SER | D | 111 | 30.920 | 59.235 | −1.763 | 1.00 | 48.72 | O |
| ATOM | 2503 | N | GLN | D | 112 | 32.606 | 56.901 | −4.058 | 1.00 | 36.34 | N |
| ATOM | 2504 | CA | GLN | D | 112 | 33.300 | 55.623 | −4.010 | 1.00 | 36.47 | C |
| ATOM | 2505 | C | GLN | D | 112 | 32.964 | 54.900 | −5.300 | 1.00 | 39.73 | C |
| ATOM | 2506 | O | GLN | D | 112 | 32.074 | 55.336 | −6.045 | 1.00 | 41.47 | O |
| ATOM | 2507 | CB | GLN | D | 112 | 32.884 | 54.798 | −2.774 | 1.00 | 34.11 | C |
| ATOM | 2508 | CG | GLN | D | 112 | 31.427 | 54.370 | −2.745 | 1.00 | 40.26 | C |
| ATOM | 2509 | CD | GLN | D | 112 | 31.098 | 53.480 | −1.545 | 1.00 | 44.54 | C |
| ATOM | 2510 | OE1 | GLN | D | 112 | 31.422 | 52.289 | −1.542 | 1.00 | 49.63 | O |
| ATOM | 2511 | NE2 | GLN | D | 112 | 30.446 | 54.054 | −0.523 | 1.00 | 32.71 | N |
| ATOM | 2512 | N | PRO | D | 113 | 33.662 | 53.816 | −5.614 | 1.00 | 35.83 | GZ00 N |
| ATOM | 2513 | CA | PRO | D | 113 | 33.350 | 53.105 | −6.859 | 1.00 | 29.36 | GZ00 C |
| ATOM | 2514 | C | PRO | D | 113 | 31.937 | 52.559 | −6.824 | 1.00 | 41.40 | GZ00 C |
| ATOM | 2515 | O | PRO | D | 113 | 31.391 | 52.249 | −5.763 | 1.00 | 33.72 | GZ00 O |
| ATOM | 2516 | CB | PRO | D | 113 | 34.371 | 51.969 | −6.897 | 1.00 | 29.06 | GZ00 C |
| ATOM | 2517 | CG | PRO | D | 113 | 35.545 | 52.491 | −6.029 | 1.00 | 36.02 | GZ00 C |
| ATOM | 2518 | CD | PRO | D | 113 | 34.878 | 53.300 | −4.948 | 1.00 | 37.13 | GZ00 C |
| ATOM | 2519 | N | LYS | D | 114 | 31.346 | 52.445 | −8.007 | 1.00 | 41.30 | GZ00 N |
| ATOM | 2520 | CA | LYS | D | 114 | 30.050 | 51.806 | −8.112 | 1.00 | 39.99 | GZ00 C |
| ATOM | 2521 | C | LYS | D | 114 | 30.168 | 50.332 | −7.726 | 1.00 | 42.17 | GZ00 C |
| ATOM | 2522 | O | LYS | D | 114 | 31.189 | 49.691 | −7.965 | 1.00 | 37.31 | GZ00 O |
| ATOM | 2523 | CB | LYS | D | 114 | 29.510 | 51.967 | −9.527 | 1.00 | 38.27 | GZ00 C |
| ATOM | 2524 | CG | LYS | D | 114 | 29.198 | 53.426 | −9.890 | 1.00 | 48.75 | GZ00 C |
| ATOM | 2525 | CD | LYS | D | 114 | 28.597 | 53.502 | −11.284 | 1.00 | 54.69 | GZ00 C |
| ATOM | 2526 | CE | LYS | D | 114 | 27.812 | 54.779 | −11.536 | 1.00 | 43.93 | GZ00 C |
| ATOM | 2527 | NZ | LYS | D | 114 | 26.918 | 54.529 | −12.718 | 1.00 | 45.98 | GZ00 N1+ |
| ATOM | 2528 | N | ALA | D | 115 | 29.108 | 49.806 | −7.107 | 1.00 | 37.03 | GZ00 N |
| ATOM | 2529 | CA | ALA | D | 115 | 29.084 | 48.455 | −6.562 | 1.00 | 31.87 | GZ00 C |
| ATOM | 2530 | C | ALA | D | 115 | 27.754 | 47.802 | −6.906 | 1.00 | 41.28 | GZ00 C |
| ATOM | 2531 | O | ALA | D | 115 | 26.691 | 48.304 | −6.514 | 1.00 | 37.09 | GZ00 O |
| ATOM | 2532 | CB | ALA | D | 115 | 29.280 | 48.470 | −5.040 | 1.00 | 29.90 | GZ00 C |
| ATOM | 2533 | N | ALA | D | 116 | 27.816 | 46.676 | −7.610 | 1.00 | 34.16 | GZ00 N |
| ATOM | 2534 | CA | ALA | D | 116 | 26.622 | 45.929 | −7.933 | 1.00 | 37.15 | GZ00 C |
| ATOM | 2535 | C | ALA | D | 116 | 26.071 | 45.289 | −6.658 | 1.00 | 37.53 | GZ00 C |
| ATOM | 2536 | O | ALA | D | 116 | 26.816 | 45.037 | −5.715 | 1.00 | 41.85 | GZ00 O |
| ATOM | 2537 | CB | ALA | D | 116 | 26.937 | 44.870 | −8.989 | 1.00 | 28.78 | GZ00 C |
| ATOM | 2538 | N | PRO | D | 117 | 24.772 | 45.028 | −6.594 | 1.00 | 40.96 | GZ00 N |
| ATOM | 2539 | CA | PRO | D | 117 | 24.207 | 44.481 | −5.355 | 1.00 | 39.65 | GZ00 C |
| ATOM | 2540 | C | PRO | D | 117 | 24.590 | 43.022 | −5.180 | 1.00 | 40.39 | GZ00 C |
| ATOM | 2541 | O | PRO | D | 117 | 24.686 | 42.263 | −6.149 | 1.00 | 43.42 | GZ00 O |
| ATOM | 2542 | CB | PRO | D | 117 | 22.699 | 44.620 | −5.568 | 1.00 | 37.24 | GZ00 C |
| ATOM | 2543 | CG | PRO | D | 117 | 22.553 | 44.435 | −7.049 | 1.00 | 32.78 | GZ00 C |
| ATOM | 2544 | CD | PRO | D | 117 | 23.761 | 45.109 | −7.664 | 1.00 | 38.78 | GZ00 C |
| ATOM | 2545 | N | SER | D | 118 | 24.817 | 42.626 | −3.934 | 1.00 | 40.21 | GZ00 N |
| ATOM | 2546 | CA | SER | D | 118 | 24.859 | 41.203 | −3.626 | 1.00 | 43.65 | GZ00 C |
| ATOM | 2547 | C | SER | D | 118 | 23.460 | 40.793 | −3.190 | 1.00 | 44.22 | GZ00 C |
| ATOM | 2548 | O | SER | D | 118 | 22.822 | 41.475 | −2.371 | 1.00 | 39.75 | GZ00 O |
| ATOM | 2549 | CB | SER | D | 118 | 25.901 | 40.867 | −2.559 | 1.00 | 37.70 | GZ00 C |
| ATOM | 2550 | OG | SER | D | 118 | 25.559 | 41.468 | −1.335 | 1.00 | 51.03 | GZ00 O |
| ATOM | 2551 | N | VAL | D | 119 | 22.982 | 39.701 | −3.774 | 1.00 | 39.65 | GZ00 N |
| ATOM | 2552 | CA | VAL | D | 119 | 21.609 | 39.244 | −3.641 | 1.00 | 39.06 | GZ00 C |
| ATOM | 2553 | C | VAL | D | 119 | 21.647 | 37.843 | −3.065 | 1.00 | 44.09 | GZ00 C |
| ATOM | 2554 | O | VAL | D | 119 | 22.315 | 36.966 | −3.626 | 1.00 | 39.00 | GZ00 O |
| ATOM | 2555 | CB | VAL | D | 119 | 20.894 | 39.235 | −5.007 | 1.00 | 40.58 | GZ00 C |
| ATOM | 2556 | CG1 | VAL | D | 119 | 19.469 | 38.765 | −4.865 | 1.00 | 33.51 | GZ00 C |
| ATOM | 2557 | CG2 | VAL | D | 119 | 20.964 | 40.602 | −5.658 | 1.00 | 38.29 | GZ00 C |
| ATOM | 2558 | N | THR | D | 120 | 20.928 | 37.620 | −1.963 | 1.00 | 38.97 | GZ00 N |
| ATOM | 2559 | CA | THR | D | 120 | 20.719 | 36.256 | −1.507 | 1.00 | 40.40 | GZ00 C |
| ATOM | 2560 | C | THR | D | 120 | 19.218 | 36.005 | −1.360 | 1.00 | 41.57 | GZ00 C |
| ATOM | 2561 | O | THR | D | 120 | 18.487 | 36.826 | −0.798 | 1.00 | 39.96 | GZ00 O |
| ATOM | 2562 | CB | THR | D | 120 | 21.524 | 35.939 | −0.211 | 1.00 | 48.39 | GZ00 C |
| ATOM | 2563 | OG1 | THR | D | 120 | 20.649 | 35.655 | 0.882 | 1.00 | 55.57 | GZ00 O |
| ATOM | 2564 | CG2 | THR | D | 120 | 22.506 | 37.053 | 0.178 | 1.00 | 42.25 | GZ00 C |
| ATOM | 2565 | N | LEU | D | 121 | 18.761 | 34.879 | −1.903 | 1.00 | 42.65 | GZ00 N |
| ATOM | 2566 | CA | LEU | D | 121 | 17.343 | 34.562 | −2.031 | 1.00 | 44.51 | GZ00 C |
| ATOM | 2567 | C | LEU | D | 121 | 17.063 | 33.332 | −1.184 | 1.00 | 42.61 | GZ00 C |
| ATOM | 2568 | O | LEU | D | 121 | 17.626 | 32.269 | −1.444 | 1.00 | 39.39 | GZ00 O |
| ATOM | 2569 | CB | LEU | D | 121 | 16.993 | 34.281 | −3.495 | 1.00 | 42.30 | GZ00 C |
| ATOM | 2570 | CG | LEU | D | 121 | 15.574 | 34.358 | −4.059 | 1.00 | 45.15 | GZ00 C |
| ATOM | 2571 | CD1 | LEU | D | 121 | 15.333 | 33.234 | −5.034 | 1.00 | 45.85 | GZ00 C |
| ATOM | 2572 | CD2 | LEU | D | 121 | 14.485 | 34.413 | −2.986 | 1.00 | 44.86 | GZ00 C |
| ATOM | 2573 | N | PHE | D | 122 | 16.200 | 33.467 | −0.209 | 1.00 | 37.70 | GZ00 N |
| ATOM | 2574 | CA | PHE | D | 122 | 15.865 | 32.293 | 0.587 | 1.00 | 43.33 | GZ00 C |
| ATOM | 2575 | C | PHE | D | 122 | 14.487 | 31.766 | 0.221 | 1.00 | 49.36 | GZ00 C |
| ATOM | 2576 | O | PHE | D | 122 | 13.539 | 32.551 | 0.069 | 1.00 | 41.30 | GZ00 O |

TABLE 10.3-continued

| | | | | | | | | | | |
|---|---|---|---|---|---|---|---|---|---|---|
| ATOM | 2577 | CB | PHE | D | 122 | 15.850 | 32.606 | 2.079 | 1.00 | 39.48 GZ00 C |
| ATOM | 2578 | CG | PHE | D | 122 | 17.181 | 32.910 | 2.660 | 1.00 | 38.94 GZ00 C |
| ATOM | 2579 | CD1 | PHE | D | 122 | 18.057 | 31.887 | 2.982 | 1.00 | 38.46 GZ00 C |
| ATOM | 2580 | CD2 | PHE | D | 122 | 17.533 | 34.229 | 2.949 | 1.00 | 36.53 GZ00 C |
| ATOM | 2581 | CE1 | PHE | D | 122 | 19.288 | 32.169 | 3.550 | 1.00 | 45.61 GZ00 C |
| ATOM | 2582 | CE2 | PHE | D | 122 | 18.740 | 34.526 | 3.528 | 1.00 | 38.72 GZ00 C |
| ATOM | 2583 | CZ | PHE | D | 122 | 19.636 | 33.494 | 3.830 | 1.00 | 40.64 GZ00 C |
| ATOM | 2584 | N | PRO | D | 123 | 14.347 | 30.448 | 0.130 | 1.00 | 50.41 GZ00 N |
| ATOM | 2585 | CA | PRO | D | 123 | 13.024 | 29.850 | −0.048 | 1.00 | 46.66 GZ00 C |
| ATOM | 2586 | C | PRO | D | 123 | 12.262 | 29.853 | 1.266 | 1.00 | 47.32 GZ00 C |
| ATOM | 2587 | O | PRO | D | 123 | 12.829 | 30.182 | 2.317 | 1.00 | 41.78 GZ00 O |
| ATOM | 2588 | CB | PRO | D | 123 | 13.356 | 28.423 | −0.505 | 1.00 | 53.34 GZ00 C |
| ATOM | 2589 | CG | PRO | D | 123 | 14.625 | 28.122 | 0.208 | 1.00 | 54.44 GZ00 C |
| ATOM | 2590 | CD | PRO | D | 123 | 15.402 | 29.428 | 0.251 | 1.00 | 49.34 GZ00 C |
| ATOM | 2591 | N | PRO | D | 124 | 10.968 | 29.530 | 1.259 | 1.00 | 54.23 GZ00 N |
| ATOM | 2592 | CA | PRO | D | 124 | 10.243 | 29.456 | 2.533 | 1.00 | 49.80 GZ00 C |
| ATOM | 2593 | C | PRO | D | 124 | 10.766 | 28.290 | 3.353 | 1.00 | 47.27 GZ00 C |
| ATOM | 2594 | O | PRO | D | 124 | 11.127 | 27.246 | 2.809 | 1.00 | 40.84 GZ00 O |
| ATOM | 2595 | CB | PRO | D | 124 | 8.786 | 29.239 | 2.109 | 1.00 | 52.85 GZ00 C |
| ATOM | 2596 | CG | PRO | D | 124 | 8.882 | 28.604 | 0.771 | 1.00 | 58.62 GZ00 C |
| ATOM | 2597 | CD | PRO | D | 124 | 10.120 | 29.144 | 0.117 | 1.00 | 50.64 GZ00 C |
| ATOM | 2598 | N | SER | D | 125 | 10.848 | 28.487 | 4.665 | 1.00 | 47.15 GZ00 N |
| ATOM | 2599 | CA | SER | D | 125 | 11.315 | 27.415 | 5.533 | 1.00 | 46.19 GZ00 C |
| ATOM | 2600 | C | SER | D | 125 | 10.226 | 26.360 | 5.725 | 1.00 | 55.91 GZ00 C |
| ATOM | 2601 | O | SER | D | 125 | 9.024 | 26.627 | 5.602 | 1.00 | 48.89 GZ00 O |
| ATOM | 2602 | CB | SER | D | 125 | 11.725 | 27.963 | 6.895 | 1.00 | 46.67 GZ00 C |
| ATOM | 2603 | OG | SER | D | 125 | 10.587 | 28.428 | 7.610 | 1.00 | 43.78 GZ00 O |
| ATOM | 2604 | N | SER | D | 126 | 10.661 | 25.150 | 6.076 | 1.00 | 53.45 GZ00 N |
| ATOM | 2605 | CA | SER | D | 126 | 9.697 | 24.081 | 6.294 | 1.00 | 49.33 GZ00 C |
| ATOM | 2606 | C | SER | D | 126 | 8.769 | 24.420 | 7.455 | 1.00 | 51.40 GZ00 C |
| ATOM | 2607 | O | SER | D | 126 | 7.564 | 24.166 | 7.392 | 1.00 | 57.31 GZ00 O |
| ATOM | 2608 | CB | SER | D | 126 | 10.432 | 22.769 | 6.528 | 1.00 | 46.88 GZ00 C |
| ATOM | 2609 | OG | SER | D | 126 | 11.378 | 22.938 | 7.552 | 1.00 | 58.67 GZ00 O |
| ATOM | 2610 | N | GLU | D | 127 | 9.303 | 25.045 | 8.500 | 1.00 | 46.78 GZ00 N |
| ATOM | 2611 | CA | GLU | D | 127 | 8.464 | 25.457 | 9.621 | 1.00 | 50.81 GZ00 C |
| ATOM | 2612 | C | GLU | D | 127 | 7.347 | 26.393 | 9.173 | 1.00 | 60.09 GZ00 C |
| ATOM | 2613 | O | GLU | D | 127 | 6.256 | 26.382 | 9.759 | 1.00 | 61.69 GZ00 O |
| ATOM | 2614 | CB | GLU | D | 127 | 9.329 | 26.118 | 10.686 | 1.00 | 53.57 GZ00 C |
| ATOM | 2615 | CG | GLU | D | 127 | 10.626 | 25.340 | 10.894 | 1.00 | 62.62 GZ00 C |
| ATOM | 2616 | CD | GLU | D | 127 | 11.443 | 25.816 | 12.072 | 1.00 | 72.05 GZ00 C |
| ATOM | 2617 | OE1 | GLU | D | 127 | 10.899 | 26.562 | 12.933 | 1.00 | 69.83 GZ00 O |
| ATOM | 2618 | OE2 | GLU | D | 127 | 12.635 | 25.426 | 12.129 | 1.00 | 72.47 GZ00 O1− |
| ATOM | 2619 | N | GLU | D | 128 | 7.608 | 27.240 | 8.170 | 1.00 | 56.85 GZ00 N |
| ATOM | 2620 | CA | GLU | D | 128 | 6.568 | 28.148 | 7.700 | 1.00 | 54.23 GZ00 C |
| ATOM | 2621 | C | GLU | D | 128 | 5.590 | 27.441 | 6.774 | 1.00 | 52.82 GZ00 C |
| ATOM | 2622 | O | GLU | D | 128 | 4.390 | 27.728 | 6.804 | 1.00 | 53.66 GZ00 0 |
| ATOM | 2623 | CB | GLU | D | 128 | 7.174 | 29.364 | 6.983 | 1.00 | 52.45 GZ00 C |
| ATOM | 2624 | CG | GLU | D | 128 | 6.132 | 30.482 | 6.745 | 1.00 | 57.44 GZ00 C |
| ATOM | 2625 | CD | GLU | D | 128 | 6.545 | 31.555 | 5.722 | 1.00 | 58.50 GZ00 C |
| ATOM | 2626 | OE1 | GLU | D | 128 | 5.856 | 32.590 | 5.684 | 1.00 | 54.07 GZ00 O |
| ATOM | 2627 | OE2 | GLU | D | 128 | 7.518 | 31.373 | 4.950 | 1.00 | 49.75 GZ00 O1− |
| ATOM | 2628 | N | LEU | D | 129 | 6.095 | 26.539 | 5.927 | 1.00 | 52.50 GZ00 N |
| ATOM | 2629 | CA | LEU | D | 129 | 5.226 | 25.707 | 5.104 | 1.00 | 51.40 GZ00 C |
| ATOM | 2630 | C | LEU | D | 129 | 4.279 | 24.879 | 5.969 | 1.00 | 59.74 GZ00 C |
| ATOM | 2631 | O | LEU | D | 129 | 3.106 | 24.702 | 5.623 | 1.00 | 63.72 GZ00 O |
| ATOM | 2632 | CB | LEU | D | 129 | 6.078 | 24.807 | 4.214 | 1.00 | 51.65 GZ00 C |
| ATOM | 2633 | CG | LEU | D | 129 | 6.868 | 25.538 | 3.131 | 1.00 | 52.87 GZ00 C |
| ATOM | 2634 | CD1 | LEU | D | 129 | 7.857 | 24.604 | 2.459 | 1.00 | 44.54 GZ00 C |
| ATOM | 2635 | CD2 | LEU | D | 129 | 5.917 | 26.140 | 2.101 | 1.00 | 49.64 GZ00 C |
| ATOM | 2636 | N | GLN | D | 130 | 4.767 | 24.388 | 7.115 | 1.00 | 54.99 GZ00 N |
| ATOM | 2637 | CA | GLN | D | 130 | 3.913 | 23.640 | 8.032 | 1.00 | 66.06 GZ00 C |
| ATOM | 2638 | C | GLN | D | 130 | 2.760 | 24.489 | 8.552 | 1.00 | 64.20 GZ00 C |
| ATOM | 2639 | O | GLN | D | 130 | 1.673 | 23.958 | 8.810 | 1.00 | 68.64 GZ00 O |
| ATOM | 2640 | CB | GLN | D | 130 | 4.729 | 23.097 | 9.210 | 1.00 | 64.34 GZ00 C |
| ATOM | 2641 | CG | GLN | D | 130 | 5.729 | 22.005 | 8.863 | 1.00 | 65.01 GZ00 C |
| ATOM | 2642 | CD | GLN | D | 130 | 6.363 | 21.409 | 10.113 | 1.00 | 78.91 GZ00 C |
| ATOM | 2643 | OE1 | GLN | D | 130 | 5.663 | 21.103 | 11.083 | 1.00 | 88.40 GZ00 O |
| ATOM | 2644 | NE2 | GLN | D | 130 | 7.691 | 21.262 | 10.108 | 1.00 | 62.99 GZ00 N |
| ATOM | 2645 | N | ALA | D | 131 | 2.972 | 25.794 | 8.729 | 1.00 | 53.92 GZ00 N |
| ATOM | 2646 | CA | ALA | D | 131 | 1.903 | 26.700 | 9.129 | 1.00 | 51.41 GZ00 C |
| ATOM | 2647 | C | ALA | D | 131 | 1.100 | 27.196 | 7.943 | 1.00 | 56.66 GZ00 C |
| ATOM | 2648 | O | ALA | D | 131 | 0.366 | 28.184 | 8.075 | 1.00 | 63.18 GZ00 O |
| ATOM | 2649 | CB | ALA | D | 131 | 2.459 | 27.889 | 9.915 | 1.00 | 45.31 GZ00 C |
| ATOM | 2650 | N | ASN | D | 132 | 1.246 | 26.543 | 6.784 | 1.00 | 55.73 GZ00 N |
| ATOM | 2651 | CA | ASN | D | 132 | 0.472 | 26.840 | 5.573 | 1.00 | 65.28 GZ00 C |
| ATOM | 2652 | C | ASN | D | 132 | 0.645 | 28.283 | 5.100 | 1.00 | 66.61 GZ00 C |
| ATOM | 2653 | O | ASN | D | 132 | −0.264 | 28.869 | 4.507 | 1.00 | 68.44 GZ00 O |
| ATOM | 2654 | CB | ASN | D | 132 | −1.018 | 26.502 | 5.762 | 1.00 | 67.97 GZ00 C |
| ATOM | 2655 | CG | ASN | D | 132 | −1.347 | 25.065 | 5.335 | 1.00 | 88.31 GZ00 C |
| ATOM | 2656 | OD1 | ASN | D | 132 | −1.487 | 24.776 | 4.134 | 1.00 | 78.43 GZ00 O |

TABLE 10.3-continued

| ATOM | 2657 | ND2 | ASN | D | 132 | −1.448 | 24.155 | 6.318 | 1.00 | 80.50 | GZ00 N |
| ATOM | 2658 | N | LYS | D | 133 | 1.812 | 28.866 | 5.352 | 1.00 | 68.70 | GZ00 N |
| ATOM | 2659 | CA | LYS | D | 133 | 2.244 | 30.090 | 4.696 | 1.00 | 59.67 | GZ00 C |
| ATOM | 2660 | C | LYS | D | 133 | 3.522 | 29.799 | 3.923 | 1.00 | 57.71 | GZ00 C |
| ATOM | 2661 | O | LYS | D | 133 | 4.135 | 28.737 | 4.069 | 1.00 | 58.17 | GZ00 O |
| ATOM | 2662 | CB | LYS | D | 133 | 2.468 | 31.225 | 5.701 | 1.00 | 52.27 | GZ00 C |
| ATOM | 2663 | CG | LYS | D | 133 | 1.236 | 31.650 | 6.454 | 1.00 | 58.15 | GZ00 C |
| ATOM | 2664 | CD | LYS | D | 133 | 1.590 | 32.644 | 7.547 | 1.00 | 82.46 | GZ00 C |
| ATOM | 2665 | CE | LYS | D | 133 | 0.389 | 32.977 | 8.428 | 1.00 | 90.01 | GZ00 C |
| ATOM | 2666 | NZ | LYS | D | 133 | −0.049 | 31.789 | 9.221 | 1.00 | 85.20 | GZ00 N1+ |
| ATOM | 2667 | N | ALA | D | 134 | 3.923 | 30.754 | 3.087 | 1.00 | 59.30 | GZ00 N |
| ATOM | 2668 | CA | ALA | D | 134 | 5.167 | 30.615 | 2.328 | 1.00 | 57.19 | GZ00 C |
| ATOM | 2669 | C | ALA | D | 134 | 5.607 | 31.994 | 1.872 | 1.00 | 56.76 | GZ00 C |
| ATOM | 2670 | O | ALA | D | 134 | 4.842 | 32.692 | 1.196 | 1.00 | 55.80 | GZ00 O |
| ATOM | 2671 | CB | ALA | D | 134 | 4.985 | 29.678 | 1.129 | 1.00 | 53.33 | GZ00 C |
| ATOM | 2672 | N | THR | D | 135 | 6.826 | 32.399 | 2.238 | 1.00 | 51.12 | GZ00 N |
| ATOM | 2673 | CA | THR | D | 135 | 7.368 | 33.652 | 1.730 | 1.00 | 46.27 | GZ00 C |
| ATOM | 2674 | C | THR | D | 135 | 8.764 | 33.429 | 1.168 | 1.00 | 50.06 | GZ00 C |
| ATOM | 2675 | O | THR | D | 135 | 9.604 | 32.783 | 1.803 | 1.00 | 41.99 | GZ00 O |
| ATOM | 2676 | CB | THR | D | 135 | 7.422 | 34.735 | 2.803 | 1.00 | 43.17 | GZ00 C |
| ATOM | 2677 | OG1 | THR | D | 135 | 8.619 | 34.572 | 3.555 | 1.00 | 70.40 | GZ00 O |
| ATOM | 2678 | CG2 | THR | D | 135 | 6.270 | 34.632 | 3.735 | 1.00 | 40.85 | GZ00 C |
| ATOM | 2679 | N | LEU | D | 136 | 9.002 | 33.964 | −0.025 | 1.00 | 49.86 | GZ00 N |
| ATOM | 2680 | CA | LEU | D | 136 | 10.344 | 34.047 | −0.574 | 1.00 | 43.03 | GZ00 C |
| ATOM | 2681 | C | LEU | D | 136 | 10.956 | 35.371 | −0.127 | 1.00 | 44.71 | GZ00 C |
| ATOM | 2682 | O | LEU | D | 136 | 10.274 | 36.400 | −0.088 | 1.00 | 45.54 | GZ00 O |
| ATOM | 2683 | CB | LEU | D | 136 | 10.328 | 33.951 | −2.101 | 1.00 | 48.82 | GZ00 C |
| ATOM | 2684 | CG | LEU | D | 136 | 9.744 | 32.685 | −2.734 | 1.00 | 50.57 | GZ00 C |
| ATOM | 2685 | CD1 | LEU | D | 136 | 9.722 | 32.777 | −4.241 | 1.00 | 43.90 | GZ00 C |
| ATOM | 2686 | CD2 | LEU | D | 136 | 10.592 | 31.534 | −2.313 | 1.00 | 54.51 | GZ00 C |
| ATOM | 2687 | N | VAL | D | 137 | 12.231 | 35.329 | 0.251 | 1.00 | 38.61 | GZ00 N |
| ATOM | 2688 | CA | VAL | D | 137 | 12.914 | 36.459 | 0.867 | 1.00 | 39.76 | GZ00 C |
| ATOM | 2689 | C | VAL | D | 137 | 14.144 | 36.781 | 0.037 | 1.00 | 43.30 | GZ00 C |
| ATOM | 2690 | O | VAL | D | 137 | 15.046 | 35.946 | −0.086 | 1.00 | 43.19 | GZ00 O |
| ATOM | 2691 | CB | VAL | D | 137 | 13.286 | 36.167 | 2.326 | 1.00 | 40.83 | GZ00 C |
| ATOM | 2692 | CG1 | VAL | D | 137 | 13.930 | 37.386 | 2.954 | 1.00 | 40.34 | GZ00 C |
| ATOM | 2693 | CG2 | VAL | D | 137 | 12.032 | 35.756 | 3.116 | 1.00 | 39.27 | GZ00 C |
| ATOM | 2694 | N | CYS | D | 138 | 14.161 | 37.969 | −0.563 | 1.00 | 39.42 | GZ00 N |
| ATOM | 2695 | CA | CYS | D | 138 | 15.270 | 38.436 | −1.392 | 1.00 | 38.06 | GZ00 C |
| ATOM | 2696 | C | CYS | D | 138 | 15.958 | 39.590 | −0.669 | 1.00 | 42.98 | GZ00 C |
| ATOM | 2697 | O | CYS | D | 138 | 15.379 | 40.679 | −0.549 | 1.00 | 42.34 | GZ00 O |
| ATOM | 2698 | CB | CYS | D | 138 | 14.764 | 38.869 | −2.767 | 1.00 | 46.28 | GZ00 C |
| ATOM | 2699 | SG | CYS | D | 138 | 16.005 | 39.055 | −4.058 | 1.00 | 46.59 | GZ00 S |
| ATOM | 2700 | N | LEU | D | 139 | 17.165 | 39.345 | −0.149 | 1.00 | 35.86 | GZ00 N |
| ATOM | 2701 | CA | LEU | D | 139 | 17.953 | 40.386 | 0.503 | 1.00 | 34.94 | GZ00 C |
| ATOM | 2702 | C | LEU | D | 139 | 18.994 | 40.946 | −0.456 | 1.00 | 40.09 | GZ00 C |
| ATOM | 2703 | O | LEU | D | 139 | 19.692 | 40.198 | −1.153 | 1.00 | 38.00 | GZ00 O |
| ATOM | 2704 | CB | LEU | D | 139 | 18.641 | 39.914 | 1.784 | 1.00 | 38.60 | GZ00 C |
| ATOM | 2705 | CG | LEU | D | 139 | 17.851 | 39.429 | 2.994 | 1.00 | 42.05 | GZ00 C |
| ATOM | 2706 | CD1 | LEU | D | 139 | 16.412 | 39.996 | 2.992 | 1.00 | 34.31 | GZ00 C |
| ATOM | 2707 | CD2 | LEU | D | 139 | 17.888 | 37.954 | 3.110 | 1.00 | 41.56 | GZ00 C |
| ATOM | 2708 | N | ILE | D | 140 | 19.072 | 42.271 | −0.498 | 1.00 | 36.85 | GZ00 N |
| ATOM | 2709 | CA | ILE | D | 140 | 19.852 | 42.991 | −1.490 | 1.00 | 40.84 | GZ00 C |
| ATOM | 2710 | C | ILE | D | 140 | 20.717 | 43.982 | −0.735 | 1.00 | 39.30 | GZ00 C |
| ATOM | 2711 | O | ILE | D | 140 | 20.196 | 44.821 | 0.012 | 1.00 | 36.82 | GZ00 O |
| ATOM | 2712 | CB | ILE | D | 140 | 18.946 | 43.703 | −2.510 | 1.00 | 36.07 | GZ00 C |
| ATOM | 2713 | CG1 | ILE | D | 140 | 17.852 | 42.738 | −2.998 | 1.00 | 41.84 | GZ00 C |
| ATOM | 2714 | CG2 | ILE | D | 140 | 19.749 | 44.191 | −3.673 | 1.00 | 33.32 | GZ00 C |
| ATOM | 2715 | CD1 | ILE | D | 140 | 16.606 | 43.414 | −3.540 | 1.00 | 40.09 | GZ00 C |
| ATOM | 2716 | N | SER | D | 141 | 22.028 | 43.899 | −0.928 | 1.00 | 33.24 | GZ00 N |
| ATOM | 2717 | CA | SER | D | 141 | 22.918 | 44.678 | −0.083 | 1.00 | 40.45 | GZ00 C |
| ATOM | 2718 | C | SER | D | 141 | 24.146 | 45.120 | −0.865 | 1.00 | 40.51 | GZ00 C |
| ATOM | 2719 | O | SER | D | 141 | 24.453 | 44.592 | −1.948 | 1.00 | 33.29 | GZ00 O |
| ATOM | 2720 | CB | SER | D | 141 | 23.348 | 43.878 | 1.155 | 1.00 | 39.86 | GZ00 C |
| ATOM | 2721 | OG | SER | D | 141 | 23.964 | 42.664 | 0.748 | 1.00 | 40.92 | GZ00 O |
| ATOM | 2722 | N | ASP | D | 142 | 24.835 | 46.117 | −0.288 | 1.00 | 34.55 | GZ00 N |
| ATOM | 2723 | CA | ASP | D | 142 | 26.137 | 46.573 | −0.776 | 1.00 | 45.39 | GZ00 C |
| ATOM | 2724 | C | ASP | D | 142 | 26.059 | 47.148 | −2.192 | 1.00 | 42.72 | GZ00 C |
| ATOM | 2725 | O | ASP | D | 142 | 26.985 | 46.983 | −2.988 | 1.00 | 37.05 | GZ00 O |
| ATOM | 2726 | CB | ASP | D | 142 | 27.165 | 45.436 | −0.742 | 1.00 | 42.27 | GZ00 C |
| ATOM | 2727 | CG | ASP | D | 142 | 27.636 | 45.114 | 0.650 | 1.00 | 45.03 | GZ00 C |
| ATOM | 2728 | OD1 | ASP | D | 142 | 27.734 | 46.043 | 1.489 | 1.00 | 49.79 | GZ00 O |
| ATOM | 2729 | OD2 | ASP | D | 142 | 27.890 | 43.921 | 0.902 | 1.00 | 52.25 | GZ00 O1− |
| ATOM | 2730 | N | PHE | D | 143 | 24.967 | 47.826 | −2.529 | 1.00 | 33.33 | GZ00 N |
| ATOM | 2731 | CA | PHE | D | 143 | 24.908 | 48.407 | −3.858 | 1.00 | 35.29 | GZ00 C |
| ATOM | 2732 | C | PHE | D | 143 | 25.067 | 49.921 | −3.775 | 1.00 | 33.78 | GZ00 C |
| ATOM | 2733 | O | PHE | D | 143 | 24.717 | 50.556 | −2.773 | 1.00 | 36.42 | GZ00 O |
| ATOM | 2734 | CB | PHE | D | 143 | 23.637 | 48.009 | −4.617 | 1.00 | 34.97 | GZ00 C |
| ATOM | 2735 | CG | PHE | D | 143 | 22.340 | 48.333 | −3.911 | 1.00 | 35.61 | GZ00 C |
| ATOM | 2736 | CD1 | PHE | D | 143 | 21.712 | 49.549 | −4.113 | 1.00 | 32.64 | GZ00 C |

TABLE 10.3-continued

| | | | | | | | | | | | |
|---|---|---|---|---|---|---|---|---|---|---|---|
| ATOM | 2737 | CD2 | PHE | D | 143 | 21.709 | 47.379 | −3.112 | 1.00 | 38.53 | GZ00 C |
| ATOM | 2738 | CE1 | PHE | D | 143 | 20.485 | 49.834 | −3.493 | 1.00 | 41.16 | GZ00 C |
| ATOM | 2739 | CE2 | PHE | D | 143 | 20.494 | 47.658 | −2.486 | 1.00 | 40.15 | GZ00 C |
| ATOM | 2740 | CZ | PHE | D | 143 | 19.880 | 48.890 | −2.672 | 1.00 | 32.95 | GZ00 C |
| ATOM | 2741 | N | TYR | D | 144 | 25.665 | 50.471 | −4.824 | 1.00 | 35.76 | GZ00 N |
| ATOM | 2742 | CA | TYR | D | 144 | 26.002 | 51.882 | −4.906 | 1.00 | 37.17 | GZ00 C |
| ATOM | 2743 | C | TYR | D | 144 | 26.142 | 52.286 | −6.363 | 1.00 | 41.07 | GZ00 C |
| ATOM | 2744 | O | TYR | D | 144 | 26.899 | 51.649 | −7.096 | 1.00 | 40.05 | GZ00 O |
| ATOM | 2745 | CB | TYR | D | 144 | 27.305 | 52.176 | −4.182 | 1.00 | 31.07 | GZ00 C |
| ATOM | 2746 | CG | TYR | D | 144 | 27.652 | 53.644 | −4.148 | 1.00 | 33.84 | GZ00 C |
| ATOM | 2747 | CD | 1TYR | D | 144 | 27.125 | 54.478 | −3.168 | 1.00 | 34.22 | GZ00 C |
| ATOM | 2748 | CD | 2TYR | D | 144 | 28.485 | 54.207 | −5.107 | 1.00 | 34.49 | GZ00 C |
| ATOM | 2749 | CE | 1TYR | D | 144 | 27.433 | 55.822 | −3.129 | 1.00 | 36.40 | GZ00 C |
| ATOM | 2750 | CE | 2TYR | D | 144 | 28.800 | 55.559 | −5.076 | 1.00 | 35.36 | GZ00 C |
| ATOM | 2751 | CZ | TYR | D | 144 | 28.271 | 56.358 | −4.082 | 1.00 | 35.95 | GZ00 C |
| ATOM | 2752 | OH | TYR | D | 144 | 28.578 | 57.699 | −4.037 | 1.00 | 40.59 | GZ00 O |
| ATOM | 2753 | N | PRO | D | 145 | 25.442 | 53.357 | −6.782 | 1.00 | 35.13 | GZ00 N |
| ATOM | 2754 | CA | PRO | D | 145 | 24.556 | 54.168 | −5.930 | 1.00 | 41.08 | GZ00 C |
| ATOM | 2755 | C | PRO | D | 145 | 23.258 | 53.476 | −5.465 | 1.00 | 39.60 | GZ00 C |
| ATOM | 2756 | O | PRO | D | 145 | 22.944 | 52.359 | −5.874 | 1.00 | 35.16 | GZ00 O |
| ATOM | 2757 | CB | PRO | D | 145 | 24.231 | 55.395 | −6.811 | 1.00 | 40.78 | GZ00 C |
| ATOM | 2758 | CG | PRO | D | 145 | 24.659 | 55.048 | −8.190 | 1.00 | 39.08 | GZ00 C |
| ATOM | 2759 | CD | PRO | D | 145 | 25.708 | 53.989 | −8.088 | 1.00 | 36.76 | GZ00 C |
| ATOM | 2760 | N | GLY | D | 146 | 22.514 | 54.161 | −4.600 | 1.00 | 34.87 | GZ00 N |
| ATOM | 2761 | CA | GLY | D | 146 | 21.429 | 53.525 | −3.892 | 1.00 | 34.83 | GZ00 C |
| ATOM | 2762 | C | GLY | D | 146 | 20.087 | 53.444 | −4.593 | 1.00 | 36.93 | GZ00 C |
| ATOM | 2763 | O | GLY | D | 146 | 19.088 | 53.931 | −4.062 | 1.00 | 34.26 | GZ00 O |
| ATOM | 2764 | N | ALA | D | 147 | 20.037 | 52.844 | −5.777 | 1.00 | 32.90 | GZ00 N |
| ATOM | 2765 | CA | ALA | D | 147 | 18.750 | 52.609 | −6.410 | 1.00 | 32.84 | GZ00 C |
| ATOM | 2766 | C | ALA | D | 147 | 18.802 | 51.314 | −7.178 | 1.00 | 32.60 | GZ00 C |
| ATOM | 2767 | O | ALA | D | 147 | 19.792 | 51.008 | −7.841 | 1.00 | 39.02 | GZ00 O |
| ATOM | 2768 | CB | ALA | D | 147 | 18.326 | 53.719 | −7.365 | 1.00 | 29.65 | GZ00 C |
| ATOM | 2769 | N | VAL | D | 148 | 17.684 | 50.603 | −7.141 | 1.00 | 33.58 | GZ00 N |
| ATOM | 2770 | CA | VAL | D | 148 | 17.588 | 49.253 | −7.651 | 1.00 | 34.66 | GZ00 C |
| ATOM | 2771 | C | VAL | D | 148 | 16.121 | 49.045 | −7.985 | 1.00 | 41.83 | GZ00 C |
| ATOM | 2772 | O | VAL | D | 148 | 15.247 | 49.684 | −7.396 | 1.00 | 32.66 | GZ00 O |
| ATOM | 2773 | CB | VAL | D | 148 | 18.126 | 48.264 | −6.582 | 1.00 | 38.73 | GZ00 C |
| ATOM | 2774 | CG1 | VAL | D | 148 | 17.030 | 47.484 | −5.915 | 1.00 | 37.24 | GZ00 C |
| ATOM | 2775 | CG2 | VAL | D | 148 | 19.218 | 47.381 | −7.146 | 1.00 | 41.31 | GZ00 C |
| ATOM | 2776 | N | THR | D | 149 | 15.845 | 48.198 | −8.967 | 1.00 | 38.40 | GZ00 N |
| ATOM | 2777 | CA | THR | D | 149 | 14.472 | 47.753 | −9.182 | 1.00 | 44.38 | GZ00 C |
| ATOM | 2778 | C | THR | D | 149 | 14.427 | 46.229 | −9.138 | 1.00 | 46.22 | GZ00 C |
| ATOM | 2779 | O | THR | D | 149 | 15.385 | 45.556 | −9.546 | 1.00 | 43.23 | GZ00 O |
| ATOM | 2780 | CB | THR | D | 149 | 13.899 | 48.266 | −10.513 | 1.00 | 46.92 | GZ00 C |
| ATOM | 2781 | OG1 | THR | D | 149 | 14.727 | 47.815 | −11.599 | 1.00 | 50.51 | GZ00 O |
| ATOM | 2782 | CG2 | THR | D | 149 | 13.810 | 49.796 | −10.512 | 1.00 | 38.30 | GZ00 C |
| ATOM | 2783 | N | VAL | D | 150 | 13.311 | 45.686 | −8.642 | 1.00 | 36.64 | GZ00 N |
| ATOM | 2784 | CA | VAL | D | 150 | 13.203 | 44.262 | −8.355 | 1.00 | 39.12 | GZ00 C |
| ATOM | 2785 | C | VAL | D | 150 | 12.046 | 43.662 | −9.128 | 1.00 | 38.75 | GZ00 C |
| ATOM | 2786 | O | VAL | D | 150 | 10.920 | 44.160 | −9.054 | 1.00 | 46.61 | GZ00 O |
| ATOM | 2787 | CB | VAL | D | 150 | 13.032 | 43.987 | −6.853 | 1.00 | 39.37 | GZ00 C |
| ATOM | 2788 | CG1 | VAL | D | 150 | 12.929 | 42.488 | −6.631 | 1.00 | 41.26 | GZ00 C |
| ATOM | 2789 | CG2 | VAL | D | 150 | 14.213 | 44.522 | −6.121 | 1.00 | 34.76 | GZ00 C |
| ATOM | 2790 | N | ALA | D | 151 | 12.333 | 42.596 | −9.865 | 1.00 | 39.71 | GZ00 N |
| ATOM | 2791 | CA | ALA | D | 151 | 11.333 | 41.805 | −10.560 | 1.00 | 44.18 | GZ00 C |
| ATOM | 2792 | C | ALA | D | 151 | 11.434 | 40.350 | −10.127 | 1.00 | 50.02 | GZ00 C |
| ATOM | 2793 | O | ALA | D | 151 | 12.534 | 39.784 | −10.032 | 1.00 | 47.26 | GZ00 O |
| ATOM | 2794 | CB | ALA | D | 151 | 11.494 | 41.895 | −12.081 | 1.00 | 37.34 | GZ00 C |
| ATOM | 2795 | N | TRP | D | 152 | 10.276 | 39.748 | −9.889 | 1.00 | 47.18 | GZ00 N |
| ATOM | 2796 | CA | TRP | D | 152 | 10.164 | 38.343 | −9.544 | 1.00 | 47.04 | GZ00 C |
| ATOM | 2797 | C | TRP | D | 152 | 9.629 | 37.556 | −10.731 | 1.00 | 49.55 | GZ00 C |
| ATOM | 2798 | O | TRP | D | 152 | 8.800 | 38.055 | −11.498 | 1.00 | 59.75 | GZ00 O |
| ATOM | 2799 | CB | TRP | D | 152 | 9.248 | 38.155 | −8.345 | 1.00 | 41.47 | GZ00 C |
| ATOM | 2800 | CG | TRP | D | 152 | 9.799 | 38.641 | −7.051 | 1.00 | 45.78 | GZ00 C |
| ATOM | 2801 | CD1 | TRP | D | 152 | 9.786 | 39.918 | −6.579 | 1.00 | 49.07 | GZ00 C |
| ATOM | 2802 | CD2 | TRP | D | 152 | 10.400 | 37.837 | −6.026 | 1.00 | 43.34 | GZ00 C |
| ATOM | 2803 | NE1 | TRP | D | 152 | 10.361 | 39.967 | −5.325 | 1.00 | 46.95 | GZ00 N |
| ATOM | 2804 | CE2 | TRP | D | 152 | 10.736 | 38.700 | −4.961 | 1.00 | 46.03 | GZ00 C |
| ATOM | 2805 | CE3 | TRP | D | 152 | 10.699 | 36.468 | −5.914 | 1.00 | 44.86 | GZ00 C |
| ATOM | 2806 | CZ2 | TRP | D | 152 | 11.364 | 38.245 | −3.792 | 1.00 | 48.01 | GZ00 C |
| ATOM | 2807 | CZ3 | TRP | D | 152 | 11.318 | 36.008 | −4.748 | 1.00 | 46.08 | GZ00 C |
| ATOM | 2808 | CH2 | TRP | D | 152 | 11.649 | 36.905 | −3.702 | 1.00 | 46.48 | GZ00 C |
| ATOM | 2809 | N | LYS | D | 153 | 10.109 | 36.330 | −10.882 | 1.00 | 54.87 | GZ00 N |
| ATOM | 2810 | CA | LYS | D | 153 | 9.649 | 35.434 | −11.929 | 1.00 | 57.27 | GZ00 C |
| ATOM | 2811 | C | LYS | D | 153 | 9.247 | 34.090 | −11.331 | 1.00 | 66.16 | GZ00 C |
| ATOM | 2812 | O | LYS | D | 153 | 9.884 | 33.591 | −10.396 | 1.00 | 64.92 | GZ00 O |
| ATOM | 2813 | CB | LYS | D | 153 | 10.728 | 35.247 | −12.999 | 1.00 | 61.27 | GZ00 C |
| ATOM | 2814 | CG | LYS | D | 153 | 10.832 | 36.442 | −13.910 | 1.00 | 66.71 | GZ00 C |
| ATOM | 2815 | CD | LYS | D | 153 | 11.805 | 36.232 | −15.044 | 1.00 | 71.68 | GZ00 C |
| ATOM | 2816 | CE | LYS | D | 153 | 11.839 | 37.483 | −15.930 | 1.00 | 79.74 | GZ00 C |

TABLE 10.3-continued

| | | | | | | | | | | |
|---|---|---|---|---|---|---|---|---|---|---|
| ATOM | 2817 | NZ | LYS | D | 153 | 12.960 | 37.469 | −16.930 | 1.00 | 89.60 GZ00 N1+ |
| ATOM | 2818 | N | ALA | D | 154 | 8.145 | 33.543 | −11.836 | 1.00 | 68.05 GZ00 N |
| ATOM | 2819 | CA | ALA | D | 154 | 7.729 | 32.169 | −11.568 | 1.00 | 66.27 GZ00 C |
| ATOM | 2820 | C | ALA | D | 154 | 7.933 | 31.392 | −12.864 | 1.00 | 70.66 GZ00 C |
| ATOM | 2821 | O | ALA | D | 154 | 7.229 | 31.641 | −13.848 | 1.00 | 74.13 GZ00 O |
| ATOM | 2822 | CB | ALA | D | 154 | 6.280 | 32.108 | −11.092 | 1.00 | 57.49 GZ00 C |
| ATOM | 2823 | N | ASP | D | 155 | 8.892 | 30.464 | −12.866 | 1.00 | 69.01 GZ00 N |
| ATOM | 2824 | CA | ASP | D | 155 | 9.320 | 29.751 | −14.079 | 1.00 | 76.96 GZ00 C |
| ATOM | 2825 | C | ASP | D | 155 | 9.440 | 30.697 | −15.267 | 1.00 | 78.16 GZ00 C |
| ATOM | 2826 | O | ASP | D | 155 | 8.849 | 30.482 | −16.327 | 1.00 | 86.27 GZ00 O |
| ATOM | 2827 | CB | ASP | D | 155 | 8.342 | 28.625 | −14.445 | 1.00 | 79.86 GZ00 C |
| ATOM | 2828 | CG | ASP | D | 155 | 8.311 | 27.503 | −13.442 | 1.00 | 77.78 GZ00 C |
| ATOM | 2829 | OD1 | ASP | D | 155 | 9.379 | 27.134 | −12.919 | 1.00 | 80.60 GZ00 O1− |
| ATOM | 2830 | OD2 | ASP | D | 155 | 7.205 | 26.974 | −13.197 | 1.00 | 86.69 GZ00 O |
| ATOM | 2831 | N | SER | D | 156 | 10.188 | 31.777 | −15.083 | 1.00 | 72.25 GZ00 N |
| ATOM | 2832 | CA | SER | D | 156 | 10.451 | 32.741 | −16.147 | 1.00 | 79.24 GZ00 C |
| ATOM | 2833 | C | SER | D | 156 | 9.207 | 33.506 | −16.599 | 1.00 | 70.74 GZ00 C |
| ATOM | 2834 | O | SER | D | 156 | 9.242 | 34.141 | −17.656 | 1.00 | 70.59 GZ00 O |
| ATOM | 2835 | CB | SER | D | 156 | 11.103 | 32.085 | −17.366 | 1.00 | 79.59 GZ00 C |
| ATOM | 2836 | OG | SER | D | 156 | 10.117 | 31.458 | −18.157 | 1.00 | 81.93 GZ00 O |
| ATOM | 2837 | N | SER | D | 157 | 8.086 | 33.449 | −15.840 | 1.00 | 66.95 GZ00 N |
| ATOM | 2838 | CA | SER | D | 157 | 6.934 | 34.326 | −16.090 | 1.00 | 65.14 GZ00 C |
| ATOM | 2839 | C | SER | D | 157 | 6.878 | 35.425 | −15.047 | 1.00 | 67.53 GZ00 C |
| ATOM | 2840 | O | SER | D | 157 | 7.031 | 35.145 | −13.848 | 1.00 | 64.92 GZ00 O |
| ATOM | 2841 | CB | SER | D | 157 | 5.624 | 33.544 | −16.060 | 1.00 | 63.23 GZ00 C |
| ATOM | 2842 | OG | SER | D | 157 | 5.562 | 32.633 | −17.136 | 1.00 | 75.81 GZ00 O |
| ATOM | 2843 | N | PRO | D | 158 | 6.652 | 36.670 | −15.446 | 1.00 | 66.82 GZ00 N |
| ATOM | 2844 | CA | PRO | D | 158 | 6.585 | 37.756 | −14.462 | 1.00 | 56.39 GZ00 C |
| ATOM | 2845 | C | PRO | D | 158 | 5.538 | 37.504 | −13.392 | 1.00 | 59.58 GZ00 C |
| ATOM | 2846 | O | PRO | D | 158 | 4.450 | 36.989 | −13.660 | 1.00 | 66.88 GZ00 O |
| ATOM | 2847 | CB | PRO | D | 158 | 6.236 | 38.986 | −15.308 | 1.00 | 52.59 GZ00 C |
| ATOM | 2848 | CG | PRO | D | 158 | 5.845 | 38.451 | −16.652 | 1.00 | 66.17 GZ00 C |
| ATOM | 2849 | CD | PRO | D | 158 | 6.585 | 37.169 | −16.824 | 1.00 | 63.85 GZ00 C |
| ATOM | 2850 | N | VAL | D | 159 | 5.900 | 37.834 | −12.160 | 1.00 | 59.53 GZ00 N |
| ATOM | 2851 | CA | VAL | D | 159 | 5.012 | 37.741 | −11.012 | 1.00 | 57.33 GZ00 C |
| ATOM | 2852 | C | VAL | D | 159 | 4.480 | 39.133 | −10.721 | 1.00 | 64.87 GZ00 C |
| ATOM | 2853 | O | VAL | D | 159 | 5.261 | 40.073 | −10.535 | 1.00 | 75.66 GZ00 O |
| ATOM | 2854 | CB | VAL | D | 159 | 5.735 | 37.169 | −9.785 | 1.00 | 58.46 GZ00 C |
| ATOM | 2855 | CG1 | VAL | D | 159 | 4.831 | 37.239 | −8.567 | 1.00 | 61.48 GZ00 C |
| ATOM | 2856 | CG2 | VAL | D | 159 | 6.174 | 35.737 | −10.050 | 1.00 | 55.69 GZ00 C |
| ATOM | 2857 | N | LYS | D | 160 | 3.157 | 39.269 | −10.654 | 1.00 | 74.88 GZ00 N |
| ATOM | 2858 | CA | LYS | D | 160 | 2.552 | 40.558 | −10.329 | 1.00 | 76.06 GZ00 C |
| ATOM | 2859 | C | LYS | D | 160 | 2.274 | 40.696 | −8.831 | 1.00 | 82.77 GZ00 C |
| ATOM | 2860 | O | LYS | D | 160 | 2.850 | 41.565 | −8.160 | 1.00 | 78.66 GZ00 O |
| ATOM | 2861 | CB | LYS | D | 160 | 1.265 | 40.755 | −11.142 | 1.00 | 83.14 GZ00 C |
| ATOM | 2862 | CG | LYS | D | 160 | 1.460 | 41.529 | −12.445 | 1.00 | 91.80 GZ00 C |
| ATOM | 2863 | CD | LYS | D | 160 | 2.006 | 42.934 | −12.175 | 1.00 | 100.07 GZ00 C |
| ATOM | 2864 | CE | LYS | D | 160 | 1.058 | 43.758 | −11.302 | 1.00 | 96.51 GZ00 C |
| ATOM | 2865 | NZ | LYS | D | 160 | 1.729 | 44.973 | −10.750 | 1.00 | 94.46 GZ00 N1+ |
| ATOM | 2866 | N | ALA | D | 161 | 1.410 | 39.836 | −8.293 | 1.00 | 72.49 GZ00 N |
| ATOM | 2867 | CA | ALA | D | 161 | 0.885 | 40.022 | −6.947 | 1.00 | 69.27 GZ00 C |
| ATOM | 2868 | C | ALA | D | 161 | 1.739 | 39.312 | −5.903 | 1.00 | 63.52 GZ00 C |
| ATOM | 2869 | O | ALA | D | 161 | 2.490 | 38.379 | −6.201 | 1.00 | 56.61 GZ00 O |
| ATOM | 2870 | CB | ALA | D | 161 | −0.551 | 39.514 | −6.859 | 1.00 | 71.61 GZ00 C |
| ATOM | 2871 | N | GLY | D | 162 | 1.608 | 39.774 | −4.659 | 1.00 | 50.21 GZ00 N |
| ATOM | 2872 | CA | GLY | D | 162 | 2.313 | 39.191 | −3.536 | 1.00 | 58.65 GZ00 C |
| ATOM | 2873 | C | GLY | D | 162 | 3.711 | 39.714 | −3.291 | 1.00 | 57.47 GZ00 C |
| ATOM | 2874 | O | GLY | D | 162 | 4.417 | 39.167 | −2.426 | 1.00 | 54.30 GZ00 O |
| ATOM | 2875 | N | VAL | D | 163 | 4.135 | 40.745 | −4.023 | 1.00 | 51.81 GZ00 N |
| ATOM | 2876 | CA | VAL | D | 163 | 5.480 | 41.291 | −3.929 | 1.00 | 45.48 GZ00 C |
| ATOM | 2877 | C | VAL | D | 163 | 5.431 | 42.543 | −3.074 | 1.00 | 47.42 GZ00 C |
| ATOM | 2878 | O | VAL | D | 163 | 4.618 | 43.442 | −3.316 | 1.00 | 44.17 GZ00 O |
| ATOM | 2879 | CB | VAL | D | 163 | 6.060 | 41.604 | −5.319 | 1.00 | 46.37 GZ00 C |
| ATOM | 2880 | CG1 | VAL | D | 163 | 7.423 | 42.278 | −5.184 | 1.00 | 50.48 GZ00 C |
| ATOM | 2881 | CG2 | VAL | D | 163 | 6.183 | 40.338 | −6.140 | 1.00 | 47.00 GZ00 C |
| ATOM | 2882 | N | GLU | D | 164 | 6.301 | 42.609 | −2.076 | 1.00 | 45.49 GZ00 N |
| ATOM | 2883 | CA | GLU | D | 164 | 6.498 | 43.832 | −1.326 | 1.00 | 39.71 GZ00 C |
| ATOM | 2884 | C | GLU | D | 164 | 7.990 | 44.067 | −1.169 | 1.00 | 48.75 GZ00 C |
| ATOM | 2885 | O | GLU | D | 164 | 8.749 | 43.133 | −0.864 | 1.00 | 44.83 GZ00 O |
| ATOM | 2886 | CB | GLU | D | 164 | 5.764 | 43.793 | 0.009 | 1.00 | 46.37 GZ00 C |
| ATOM | 2887 | CG | GLU | D | 164 | 4.308 | 44.218 | −0.195 | 1.00 | 59.54 GZ00 C |
| ATOM | 2888 | CD | GLU | D | 164 | 3.415 | 43.931 | 0.978 | 1.00 | 60.43 GZ00 C |
| ATOM | 2889 | OE1 | GLU | D | 164 | 3.928 | 43.465 | 2.015 | 1.00 | 70.95 GZ00 O |
| ATOM | 2890 | OE2 | GLU | D | 164 | 2.197 | 44.189 | 0.869 | 1.00 | 56.32 GZ00 O1− |
| ATOM | 2891 | N | THR | D | 165 | 8.400 | 45.308 | −1.434 | 1.00 | 43.26 GZ00 N |
| ATOM | 2892 | CA | THR | D | 165 | 9.794 | 45.691 | −1.572 | 1.00 | 34.34 GZ00 C |
| ATOM | 2893 | C | THR | D | 165 | 10.043 | 46.955 | −0.778 | 1.00 | 37.84 GZ00 C |
| ATOM | 2894 | O | THR | D | 165 | 9.267 | 47.903 | −0.883 | 1.00 | 43.88 GZ00 O |
| ATOM | 2895 | CB | THR | D | 165 | 10.122 | 45.903 | −3.040 | 1.00 | 37.47 GZ00 C |
| ATOM | 2896 | OG1 | THR | D | 165 | 9.909 | 44.671 | −3.730 | 1.00 | 39.61 GZ00 O |

TABLE 10.3-continued

| | | | | | | | | | | |
|---|---|---|---|---|---|---|---|---|---|---|
| ATOM | 2897 | CG2 | THR | D | 165 | 11.578 | 46.354 | −3.240 | 1.00 | 38.05 | GZ00 C |
| ATOM | 2898 | N | THR | D | 166 | 11.131 | 46.982 | −0.011 | 1.00 | 37.74 | GZ00 N |
| ATOM | 2899 | CA | THR | D | 166 | 11.464 | 48.177 | 0.757 | 1.00 | 47.21 | GZ00 C |
| ATOM | 2900 | C | THR | D | 166 | 12.099 | 49.231 | −0.141 | 1.00 | 40.41 | GZ00 C |
| ATOM | 2901 | O | THR | D | 166 | 12.548 | 48.951 | −1.256 | 1.00 | 41.42 | GZ00 O |
| ATOM | 2902 | CB | THR | D | 166 | 12.470 | 47.888 | 1.882 | 1.00 | 40.73 | GZ00 C |
| ATOM | 2903 | OG1 | THR | D | 166 | 13.677 | 47.375 | 1.311 | 1.00 | 36.35 | GZ00 O |
| ATOM | 2904 | CG2 | THR | D | 166 | 11.922 | 46.878 | 2.882 | 1.00 | 40.85 | GZ00 C |
| ATOM | 2905 | N | THR | D | 167 | 12.135 | 50.451 | 0.365 | 1.00 | 42.55 | GZ00 N |
| ATOM | 2906 | CA | THR | D | 167 | 12.976 | 51.467 | −0.237 | 1.00 | 49.39 | GZ00 C |
| ATOM | 2907 | C | THR | D | 167 | 14.429 | 51.231 | 0.164 | 1.00 | 47.70 | GZ00 C |
| ATOM | 2908 | O | THR | D | 167 | 14.702 | 50.656 | 1.218 | 1.00 | 50.42 | GZ00 O |
| ATOM | 2909 | CB | THR | D | 167 | 12.564 | 52.846 | 0.231 | 1.00 | 42.03 | GZ00 C |
| ATOM | 2910 | OG1 | THR | D | 167 | 12.784 | 52.916 | 1.640 | 1.00 | 55.83 | GZ00 O |
| ATOM | 2911 | CG2 | THR | D | 167 | 11.133 | 53.079 | −0.052 | 1.00 | 40.08 | GZ00 C |
| ATOM | 2912 | N | PRO | D | 168 | 15.383 | 51.666 | −0.647 | 1.00 | 50.17 | GZ00 N |
| ATOM | 2913 | CA | PRO | D | 168 | 16.789 | 51.463 | −0.271 | 1.00 | 46.73 | GZ00 C |
| ATOM | 2914 | C | PRO | D | 168 | 17.132 | 52.312 | 0.943 | 1.00 | 48.10 | GZ00 C |
| ATOM | 2915 | O | PRO | D | 168 | 16.592 | 53.405 | 1.140 | 1.00 | 47.07 | GZ00 O |
| ATOM | 2916 | CB | PRO | D | 168 | 17.572 | 51.906 | −1.515 | 1.00 | 44.24 | GZ00 C |
| ATOM | 2917 | CG | PRO | D | 168 | 16.579 | 52.648 | −2.378 | 1.00 | 51.68 | GZ00 C |
| ATOM | 2918 | CD | PRO | D | 168 | 15.216 | 52.134 | −2.030 | 1.00 | 42.84 | GZ00 C |
| ATOM | 2919 | N | SER | D | 169 | 18.006 | 51.773 | 1.789 | 1.00 | 38.56 | GZ00 N |
| ATOM | 2920 | CA | SER | D | 169 | 18.460 | 52.490 | 2.976 | 1.00 | 44.06 | GZ00 C |
| ATOM | 2921 | C | SER | D | 169 | 19.974 | 52.364 | 3.091 | 1.00 | 40.12 | GZ00 C |
| ATOM | 2922 | O | SER | D | 169 | 20.562 | 51.347 | 2.703 | 1.00 | 42.12 | GZ00 O |
| ATOM | 2923 | CB | SER | D | 169 | 17.776 | 51.973 | 4.261 | 1.00 | 37.35 | GZ00 C |
| ATOM | 2924 | OG | SER | D | 169 | 18.098 | 50.608 | 4.455 | 1.00 | 51.17 | GZ00 O |
| ATOM | 2925 | N | LYS | D | 170 | 20.601 | 53.409 | 3.614 | 1.00 | 38.28 | GZ00 N |
| ATOM | 2926 | CA | LYS | D | 170 | 22.053 | 53.472 | 3.624 | 1.00 | 42.03 | GZ00 C |
| ATOM | 2927 | C | LYS | D | 170 | 22.610 | 52.541 | 4.691 | 1.00 | 41.78 | GZ00 C |
| ATOM | 2928 | O | LYS | D | 170 | 22.160 | 52.564 | 5.839 | 1.00 | 44.51 | GZ00 O |
| ATOM | 2929 | CB | LYS | D | 170 | 22.542 | 54.897 | 3.877 | 1.00 | 38.33 | GZ00 C |
| ATOM | 2930 | CG | LYS | D | 170 | 24.014 | 55.068 | 3.482 | 1.00 | 45.43 | GZ00 C |
| ATOM | 2931 | CD | LYS | D | 170 | 24.575 | 56.405 | 3.934 | 1.00 | 48.05 | GZ00 C |
| ATOM | 2932 | CE | LYS | D | 170 | 23.962 | 57.548 | 3.176 | 1.00 | 54.50 | GZ00 C |
| ATOM | 2933 | NZ | LYS | D | 170 | 24.635 | 58.806 | 3.569 | 1.00 | 69.11 | GZ00 N1+ |
| ATOM | 2934 | N | GLN | D | 171 | 23.589 | 51.723 | 4.305 | 1.00 | 41.93 | GZ00 N |
| ATOM | 2935 | CA | GLN | D | 171 | 24.346 | 50.889 | 5.228 | 1.00 | 47.20 | GZ00 C |
| ATOM | 2936 | C | GLN | D | 171 | 25.483 | 51.692 | 5.858 | 1.00 | 45.26 | GZ00 C |
| ATOM | 2937 | O | GLN | D | 171 | 25.816 | 52.797 | 5.422 | 1.00 | 47.74 | GZ00 O |
| ATOM | 2938 | CB | GLN | D | 171 | 24.933 | 49.672 | 4.508 | 1.00 | 38.79 | GZ00 C |
| ATOM | 2939 | CG | GLN | D | 171 | 23.914 | 48.809 | 3.823 | 1.00 | 38.60 | GZ00 C |
| ATOM | 2940 | CD | GLN | D | 171 | 24.560 | 47.787 | 2.932 | 1.00 | 45.79 | GZ00 C |
| ATOM | 2941 | OE1 | GLN | D | 171 | 23.900 | 46.859 | 2.433 | 1.00 | 43.80 | GZ00 O |
| ATOM | 2942 | NE2 | GLN | D | 171 | 25.868 | 47.942 | 2.715 | 1.00 | 45.31 | GZ00 N |
| ATOM | 2943 | N | SER | D | 172 | 26.118 | 51.089 | 6.865 | 1.00 | 49.48 | GZ00 N |
| ATOM | 2944 | CA | SER | D | 172 | 27.258 | 51.724 | 7.529 | 1.00 | 45.76 | GZ00 C |
| ATOM | 2945 | C | SER | D | 172 | 28.391 | 52.012 | 6.557 | 1.00 | 43.14 | GZ00 C |
| ATOM | 2946 | O | SER | D | 172 | 29.073 | 53.033 | 6.675 | 1.00 | 51.69 | GZ00 O |
| ATOM | 2947 | CB | SER | D | 172 | 27.769 | 50.826 | 8.658 | 1.00 | 55.56 | GZ00 C |
| ATOM | 2948 | OG | SER | D | 172 | 26.906 | 50.898 | 9.777 | 1.00 | 71.74 | GZ00 O |
| ATOM | 2949 | N | ASN | D | 173 | 28.628 | 51.122 | 5.601 | 1.00 | 40.90 | GZ00 N |
| ATOM | 2950 | CA | ASN | D | 173 | 29.697 | 51.363 | 4.646 | 1.00 | 37.43 | GZ00 C |
| ATOM | 2951 | C | ASN | D | 173 | 29.304 | 52.349 | 3.542 | 1.00 | 44.12 | GZ00 C |
| ATOM | 2952 | O | ASN | D | 173 | 30.080 | 52.526 | 2.588 | 1.00 | 41.37 | GZ00 O |
| ATOM | 2953 | CB | ASN | D | 173 | 30.171 | 50.030 | 4.038 | 1.00 | 41.28 | GZ00 C |
| ATOM | 2954 | CG | ASN | D | 173 | 29.139 | 49.370 | 3.147 | 1.00 | 44.26 | GZ00 C |
| ATOM | 2955 | OD1 | ASN | D | 173 | 28.038 | 49.887 | 2.944 | 1.00 | 43.64 | GZ00 O |
| ATOM | 2956 | ND2 | ASN | D | 173 | 29.500 | 48.208 | 2.597 | 1.00 | 50.50 | GZ00 N |
| ATOM | 2957 | N | ASN | D | 174 | 28.142 | 52.999 | 3.669 | 1.00 | 41.55 | GZ00 N |
| ATOM | 2958 | CA | ASN | D | 174 | 27.608 | 54.005 | 2.759 | 1.00 | 44.88 | GZ00 C |
| ATOM | 2959 | C | ASN | D | 174 | 27.151 | 53.429 | 1.426 | 1.00 | 44.23 | GZ00 C |
| ATOM | 2960 | O | ASN | D | 174 | 26.811 | 54.200 | 0.525 | 1.00 | 39.27 | GZ00 O |
| ATOM | 2961 | CB | ASN | D | 174 | 28.610 | 55.139 | 2.484 | 1.00 | 42.38 | GZ00 C |
| ATOM | 2962 | CG | ASN | D | 174 | 28.741 | 56.082 | 3.653 | 1.00 | 45.60 | GZ00 C |
| ATOM | 2963 | OD1 | ASN | D | 174 | 27.827 | 56.220 | 4.457 | 1.00 | 52.29 | GZ00 O |
| ATOM | 2964 | ND2 | ASN | D | 174 | 29.895 | 56.706 | 3.775 | 1.00 | 48.22 | GZ00 N |
| ATOM | 2965 | N | LYS | D | 175 | 27.187 | 52.114 | 1.242 | 1.00 | 43.55 | GZ00 N |
| ATOM | 2966 | CA | LYS | D | 175 | 26.380 | 51.487 | 0.204 | 1.00 | 46.60 | GZ00 C |
| ATOM | 2967 | C | LYS | D | 175 | 24.958 | 51.250 | 0.748 | 1.00 | 40.26 | GZ00 C |
| ATOM | 2968 | O | LYS | D | 175 | 24.628 | 51.624 | 1.877 | 1.00 | 36.35 | GZ00 O |
| ATOM | 2969 | CB | LYS | D | 175 | 27.054 | 50.204 | −0.272 | 1.00 | 43.68 | GZ00 C |
| ATOM | 2970 | CG | LYS | D | 175 | 28.501 | 50.379 | −0.772 | 1.00 | 42.53 | GZ00 C |
| ATOM | 2971 | CD | LYS | D | 175 | 29.043 | 48.983 | −1.135 | 1.00 | 47.00 | GZ00 C |
| ATOM | 2972 | CE | LYS | D | 175 | 30.522 | 48.940 | −1.403 | 1.00 | 54.60 | GZ00 C |
| ATOM | 2973 | NZ | LYS | D | 175 | 30.884 | 47.568 | −1.857 | 1.00 | 65.92 | GZ00 N |
| ATOM | 2974 | N | TYR | D | 176 | 24.091 | 50.623 | −0.042 | 1.00 | 37.23 | GZ00 N |
| ATOM | 2975 | CA | TYR | D | 176 | 22.676 | 50.583 | 0.302 | 1.00 | 36.34 | GZ00 C |
| ATOM | 2976 | C | TYR | D | 176 | 22.145 | 49.158 | 0.349 | 1.00 | 42.73 | GZ00 C |

TABLE 10.3-continued

| | | | | | | | | | | |
|---|---|---|---|---|---|---|---|---|---|---|
| ATOM | 2977 | O | TYR | D | 176 | 22.657 | 48.244 | −0.314 | 1.00 | 36.34 GZ00 O |
| ATOM | 2978 | CB | TYR | D | 176 | 21.844 | 51.409 | −0.693 | 1.00 | 36.80 GZ00 C |
| ATOM | 2979 | CG | TYR | D | 176 | 22.044 | 52.899 | −0.563 | 1.00 | 36.36 GZ00 C |
| ATOM | 2980 | CD2 | TYR | D | 176 | 21.057 | 53.710 | −0.021 | 1.00 | 37.31 GZ00 C |
| ATOM | 2981 | CD1 | TYR | D | 176 | 23.222 | 53.497 | −0.996 | 1.00 | 41.41 GZ00 C |
| ATOM | 2982 | CE2 | TYR | D | 176 | 21.252 | 55.072 | 0.098 | 1.00 | 40.59 GZ00 C |
| ATOM | 2983 | CE1 | TYR | D | 176 | 23.423 | 54.857 | −0.883 | 1.00 | 39.52 GZ00 C |
| ATOM | 2984 | CZ | TYR | D | 176 | 22.440 | 55.639 | −0.347 | 1.00 | 39.72 GZ00 C |
| ATOM | 2985 | OH | TYR | D | 176 | 22.662 | 56.981 | −0.238 | 1.00 | 49.13 GZ00 O |
| ATOM | 2986 | N | ALA | D | 177 | 21.056 | 49.003 | 1.103 | 1.00 | 41.16 GZ00 N |
| ATOM | 2987 | CA | ALA | D | 177 | 20.371 | 47.728 | 1.246 | 1.00 | 39.60 GZ00 C |
| ATOM | 2988 | C | ALA | D | 177 | 18.886 | 47.901 | 0.957 | 1.00 | 37.33 GZ00 C |
| ATOM | 2989 | O | ALA | D | 177 | 18.321 | 48.987 | 1.140 | 1.00 | 41.92 GZ00 O |
| ATOM | 2990 | CB | ALA | D | 177 | 20.552 | 47.133 | 2.665 | 1.00 | 35.41 GZ00 C |
| ATOM | 2991 | N | ALA | D | 178 | 18.271 | 46.809 | 0.488 | 1.00 | 36.97 GZ00 N |
| ATOM | 2992 | CA | ALA | D | 178 | 16.829 | 46.711 | 0.308 | 1.00 | 39.14 GZ00 C |
| ATOM | 2993 | C | ALA | D | 178 | 16.415 | 45.246 | 0.381 | 1.00 | 41.15 GZ00 C |
| ATOM | 2994 | O | ALA | D | 178 | 17.230 | 44.339 | 0.192 | 1.00 | 38.19 GZ00 O |
| ATOM | 2995 | CB | ALA | D | 178 | 16.380 | 47.324 | −1.023 | 1.00 | 31.46 GZ00 C |
| ATOM | 2996 | N | SER | D | 179 | 15.125 | 45.012 | 0.628 | 1.00 | 39.23 GZ00 N |
| ATOM | 2997 | CA | SER | D | 179 | 14.626 | 43.644 | 0.607 | 1.00 | 42.89 GZ00 C |
| ATOM | 2998 | C | SER | D | 179 | 13.279 | 43.569 | −0.100 | 1.00 | 42.30 GZ00 C |
| ATOM | 2999 | O | SER | D | 179 | 12.526 | 44.543 | −0.157 | 1.00 | 39.32 GZ00 O |
| ATOM | 3000 | CB | SER | D | 179 | 14.561 | 43.043 | 2.026 | 1.00 | 37.57 GZ00 C |
| ATOM | 3001 | OG | SER | D | 179 | 14.059 | 43.953 | 2.960 | 1.00 | 39.68 GZ00 O |
| ATOM | 3002 | N | SER | D | 180 | 13.012 | 42.399 | −0.673 | 1.00 | 39.99 GZ00 N |
| ATOM | 3003 | CA | SER | D | 180 | 11.786 | 42.133 | −1.407 | 1.00 | 45.51 GZ00 C |
| ATOM | 3004 | C | SER | D | 180 | 11.212 | 40.781 | −0.972 | 1.00 | 51.71 GZ00 C |
| ATOM | 3005 | O | SER | D | 180 | 11.932 | 39.774 | −0.921 | 1.00 | 43.37 GZ00 O |
| ATOM | 3006 | CB | SER | D | 180 | 12.062 | 42.153 | −2.911 | 1.00 | 42.12 GZ00 C |
| ATOM | 3007 | OG | SER | D | 180 | 10.869 | 42.076 | −3.655 | 1.00 | 40.91 GZ00 O |
| ATOM | 3008 | N | TYR | D | 181 | 9.914 | 40.756 | −0.686 | 1.00 | 44.23 GZ00 N |
| ATOM | 3009 | CA | TYR | D | 181 | 9.237 | 39.561 | −0.206 | 1.00 | 45.60 GZ00 C |
| ATOM | 3010 | C | TYR | D | 181 | 8.159 | 39.158 | −1.203 | 1.00 | 48.02 GZ00 C |
| ATOM | 3011 | O | TYR | D | 181 | 7.369 | 40.001 | −1.637 | 1.00 | 44.19 GZ00 O |
| ATOM | 3012 | CB | TYR | D | 181 | 8.612 | 39.804 | 1.164 | 1.00 | 39.73 GZ00 C |
| ATOM | 3013 | CG | TYR | D | 181 | 9.601 | 40.149 | 2.246 | 1.00 | 42.39 GZ00 C |
| ATOM | 3014 | CD2 | TYR | D | 181 | 10.094 | 39.167 | 3.100 | 1.00 | 35.39 GZ00 C |
| ATOM | 3015 | CD1 | TYR | D | 181 | 10.050 | 41.464 | 2.416 | 1.00 | 38.95 GZ00 C |
| ATOM | 3016 | CE2 | TYR | D | 181 | 11.005 | 39.477 | 4.098 | 1.00 | 38.77 GZ00 C |
| ATOM | 3017 | CE1 | TYR | D | 181 | 10.958 | 41.786 | 3.414 | 1.00 | 42.49 GZ00 C |
| ATOM | 3018 | CZ | TYR | D | 181 | 11.437 | 40.785 | 4.254 | 1.00 | 40.93 GZ00 C |
| ATOM | 3019 | OH | TYR | D | 181 | 12.335 | 41.092 | 5.250 | 1.00 | 36.93 GZ00 O |
| ATOM | 3020 | N | LEU | D | 182 | 8.137 | 37.878 | −1.576 | 1.00 | 39.63 GZ00 N |
| ATOM | 3021 | CA | LEU | D | 182 | 7.075 | 37.312 | −2.399 | 1.00 | 48.32 GZ00 C |
| ATOM | 3022 | C | LEU | D | 182 | 6.258 | 36.347 | −1.533 | 1.00 | 49.68 GZ00 C |
| ATOM | 3023 | O | LEU | D | 182 | 6.774 | 35.321 | −1.072 | 1.00 | 44.59 GZ00 O |
| ATOM | 3024 | CB | LEU | D | 182 | 7.672 | 36.616 | −3.621 | 1.00 | 45.93 GZ00 C |
| ATOM | 3025 | CG | LEU | D | 182 | 6.711 | 35.859 | −4.540 | 1.00 | 54.86 GZ00 C |
| ATOM | 3026 | CD1 | LEU | D | 182 | 5.643 | 36.822 | −5.050 | 1.00 | 49.90 GZ00 C |
| ATOM | 3027 | CD2 | LEU | D | 182 | 7.467 | 35.191 | −5.703 | 1.00 | 43.02 GZ00 C |
| ATOM | 3028 | N | SER | D | 183 | 4.992 | 36.680 | −1.295 | 1.00 | 52.23 GZ00 N |
| ATOM | 3029 | CA | SER | D | 183 | 4.099 | 35.806 | −0.538 | 1.00 | 47.98 GZ00 C |
| ATOM | 3030 | C | SER | D | 183 | 3.397 | 34.840 | −1.481 | 1.00 | 47.04 GZ00 C |
| ATOM | 3031 | O | SER | D | 183 | 2.956 | 35.225 | −2.564 | 1.00 | 52.72 GZ00 O |
| ATOM | 3032 | CB | SER | D | 183 | 3.072 | 36.608 | 0.251 | 1.00 | 45.88 GZ00 C |
| ATOM | 3033 | OG | SER | D | 183 | 3.720 | 37.533 | 1.102 | 1.00 | 53.76 GZ00 O |
| ATOM | 3034 | N | LEU | D | 184 | 3.356 | 33.574 | −1.088 | 1.00 | 51.61 GZ00 N |
| ATOM | 3035 | CA | LEU | D | 184 | 2.741 | 32.523 | −1.874 | 1.00 | 51.65 GZ00 C |
| ATOM | 3036 | C | LEU | D | 184 | 1.951 | 31.621 | −0.944 | 1.00 | 60.30 GZ00 C |
| ATOM | 3037 | O | LEU | D | 184 | 2.089 | 31.679 | 0.284 | 1.00 | 57.40 GZ00 O |
| ATOM | 3038 | CB | LEU | D | 184 | 3.777 | 31.687 | −2.623 | 1.00 | 53.86 GZ00 C |
| ATOM | 3039 | CG | LEU | D | 184 | 4.672 | 32.341 | −3.654 | 1.00 | 51.77 GZ00 C |
| ATOM | 3040 | CD1 | LEU | D | 184 | 5.638 | 31.317 | −4.213 | 1.00 | 50.48 GZ00 C |
| ATOM | 3041 | CD2 | LEU | D | 184 | 3.803 | 32.927 | −4.738 | 1.00 | 58.87 GZ00 C |
| ATOM | 3042 | N | THR | D | 185 | 1.097 | 30.745 | −1.569 | 1.00 | 63.83 GZ00 N |
| ATOM | 3043 | CA | THR | D | 185 | 0.577 | 29.598 | −0.843 | 1.00 | 63.50 GZ00 C |
| ATOM | 3044 | C | THR | D | 185 | 1.550 | 28.438 | −0.977 | 1.00 | 60.27 GZ00 C |
| ATOM | 3045 | O | THR | D | 185 | 2.270 | 28.332 | −1.982 | 1.00 | 54.12 GZ00 O |
| ATOM | 3046 | CB | THR | D | 185 | −0.782 | 29.160 | −1.397 | 1.00 | 58.04 GZ00 C |
| ATOM | 3047 | OG1 | THR | D | 185 | −0.611 | 28.645 | −2.727 | 1.00 | 62.01 GZ00 O |
| ATOM | 3048 | CG2 | THR | D | 185 | −1.765 | 30.324 | −1.417 | 1.00 | 49.17 GZ00 C |
| ATOM | 3049 | N | PRO | D | 186 | 1.567 | 27.545 | 0.008 | 1.00 | 56.65 GZ00 N |
| ATOM | 3050 | CA | PRO | D | 186 | 2.337 | 26.307 | −0.160 | 1.00 | 61.35 GZ00 C |
| ATOM | 3051 | C | PRO | D | 186 | 2.054 | 25.617 | −1.484 | 1.00 | 70.92 GZ00 C |
| ATOM | 3052 | O | PRO | D | 186 | 2.972 | 25.043 | −2.089 | 1.00 | 71.62 GZ00 O |
| ATOM | 3053 | CB | PRO | D | 186 | 1.893 | 25.474 | 1.047 | 1.00 | 64.94 GZ00 C |
| ATOM | 3054 | CG | PRO | D | 186 | 1.565 | 26.502 | 2.095 | 1.00 | 56.23 GZ00 C |
| ATOM | 3055 | CD | PRO | D | 186 | 0.970 | 27.657 | 1.353 | 1.00 | 57.72 GZ00 C |
| ATOM | 3056 | N | GLU | D | 187 | 0.815 | 25.725 | −1.981 | 1.00 | 72.13 GZ00 N |

TABLE 10.3-continued

| | | | | | | | | | | |
|---|---|---|---|---|---|---|---|---|---|---|
| ATOM | 3057 | CA | GLU | D | 187 | 0.440 | 25.117 | −3.255 | 1.00 | 73.38 | GZ00 C |
| ATOM | 3058 | C | GLU | D | 187 | 1.182 | 25.782 | −4.408 | 1.00 | 71.22 | GZ00 C |
| ATOM | 3059 | O | GLU | D | 187 | 1.817 | 25.105 | −5.229 | 1.00 | 67.47 | GZ00 O |
| ATOM | 3060 | CB | GLU | D | 187 | −1.074 | 25.235 | −3.473 | 1.00 | 72.72 | GZ00 C |
| ATOM | 3061 | CG | GLU | D | 187 | −1.909 | 25.465 | −2.206 | 1.00 | 73.60 | GZ00 C |
| ATOM | 3062 | CD | GLU | D | 187 | −1.655 | 24.438 | −1.114 | 1.00 | 91.17 | GZ00 C |
| ATOM | 3063 | OE1 | GLU | D | 187 | −1.492 | 23.239 | −1.442 | 1.00 | 95.11 | GZ00 O |
| ATOM | 3064 | OE2 | GLU | D | 187 | −1.608 | 24.842 | 0.072 | 1.00 | 86.41 | GZ00 O1− |
| ATOM | 3065 | N | GLN | D | 188 | 1.080 | 27.116 | −4.499 | 1.00 | 63.92 | GZ00 N |
| ATOM | 3066 | CA | GLN | D | 188 | 1.803 | 27.852 | −5.532 | 1.00 | 67.27 | GZ00 C |
| ATOM | 3067 | C | GLN | D | 188 | 3.302 | 27.589 | −5.466 | 1.00 | 68.44 | GZ00 C |
| ATOM | 3068 | O | GLN | D | 188 | 3.959 | 27.448 | −6.507 | 1.00 | 68.93 | GZ00 O |
| ATOM | 3069 | CB | GLN | D | 188 | 1.524 | 29.347 | −5.411 | 1.00 | 69.32 | GZ00 C |
| ATOM | 3070 | CG | GLN | D | 188 | 0.092 | 29.737 | −5.677 | 1.00 | 64.52 | GZ00 C |
| ATOM | 3071 | CD | GLN | D | 188 | −0.225 | 31.124 | −5.174 | 1.00 | 74.32 | GZ00 C |
| ATOM | 3072 | OE1 | GLN | D | 188 | 0.362 | 31.585 | −4.199 | 1.00 | 75.61 | GZ00 O |
| ATOM | 3073 | NE2 | GLN | D | 188 | −1.147 | 31.808 | −5.847 | 1.00 | 79.67 | GZ00 N |
| ATOM | 3074 | N | TRP | D | 189 | 3.865 | 27.522 | −4.255 | 1.00 | 65.05 | GZ00 N |
| ATOM | 3075 | CA | TRP | D | 189 | 5.304 | 27.301 | −4.130 | 1.00 | 65.52 | GZ00 C |
| ATOM | 3076 | C | TRP | D | 189 | 5.697 | 25.960 | −4.734 | 1.00 | 70.69 | GZ00 C |
| ATOM | 3077 | O | TRP | D | 189 | 6.669 | 25.871 | −5.497 | 1.00 | 69.56 | GZ00 O |
| ATOM | 3078 | CB | TRP | D | 189 | 5.730 | 27.397 | −2.659 | 1.00 | 64.52 | GZ00 C |
| ATOM | 3079 | CG | TRP | D | 189 | 7.127 | 26.879 | −2.336 | 1.00 | 69.67 | GZ00 C |
| ATOM | 3080 | CD1 | TRP | D | 189 | 7.448 | 25.892 | −1.442 | 1.00 | 67.82 | GZ00 C |
| ATOM | 3081 | CD2 | TRP | D | 189 | 8.372 | 27.335 | −2.885 | 1.00 | 66.64 | GZ00 C |
| ATOM | 3082 | NE1 | TRP | D | 189 | 8.806 | 25.699 | −1.414 | 1.00 | 62.01 | GZ00 N |
| ATOM | 3083 | CE2 | TRP | D | 189 | 9.399 | 26.569 | −2.287 | 1.00 | 64.99 | GZ00 C |
| ATOM | 3084 | CE3 | TRP | D | 189 | 8.720 | 28.305 | −3.833 | 1.00 | 68.36 | GZ00 C |
| ATOM | 3085 | CZ2 | TRP | D | 189 | 10.750 | 26.753 | −2.592 | 1.00 | 66.69 | GZ00 C |
| ATOM | 3086 | CZ3 | TRP | D | 189 | 10.067 | 28.481 | −4.146 | 1.00 | 68.79 | GZ00 C |
| ATOM | 3087 | CH2 | TRP | D | 189 | 11.064 | 27.704 | −3.527 | 1.00 | 63.38 | GZ00 C |
| ATOM | 3088 | N | LYS | D | 190 | 4.925 | 24.909 | −4.437 | 1.00 | 74.93 | GZ00 N |
| ATOM | 3089 | CA | LYS | D | 190 | 5.269 | 23.562 | −4.875 | 1.00 | 74.61 | GZ00 C |
| ATOM | 3090 | C | LYS | D | 190 | 4.919 | 23.317 | −6.334 | 1.00 | 72.06 | GZ00 C |
| ATOM | 3091 | O | LYS | D | 190 | 5.471 | 22.395 | −6.946 | 1.00 | 76.50 | GZ00 O |
| ATOM | 3092 | CB | LYS | D | 190 | 4.556 | 22.538 | −3.988 | 1.00 | 72.08 | GZ00 C |
| ATOM | 3093 | CG | LYS | D | 190 | 5.012 | 22.585 | −2.539 | 1.00 | 73.58 | GZ00 C |
| ATOM | 3094 | CD | LYS | D | 190 | 4.154 | 21.723 | −1.635 | 1.00 | 86.29 | GZ00 C |
| ATOM | 3095 | CE | LYS | D | 190 | 4.625 | 21.833 | −0.191 | 1.00 | 92.57 | GZ00 C |
| ATOM | 3096 | NZ | LYS | D | 190 | 3.732 | 21.118 | 0.762 | 1.00 | 99.72 | GZ00 N1+ |
| ATOM | 3097 | N | SER | D | 191 | 4.050 | 24.142 | −6.915 | 1.00 | 68.71 | GZ00 N |
| ATOM | 3098 | CA | SER | D | 191 | 3.582 | 23.882 | −8.272 | 1.00 | 73.46 | GZ00 C |
| ATOM | 3099 | C | SER | D | 191 | 4.650 | 24.213 | −9.315 | 1.00 | 72.57 | GZ00 C |
| ATOM | 3100 | O | SER | D | 191 | 4.878 | 23.431 | −10.244 | 1.00 | 79.90 | GZ00 O |
| ATOM | 3101 | CB | SER | D | 191 | 2.289 | 24.655 | −8.529 | 1.00 | 70.09 | GZ00 C |
| ATOM | 3102 | OG | SER | D | 191 | 2.531 | 26.044 | −8.539 | 1.00 | 81.55 | GZ00 O |
| ATOM | 3103 | N | HIS | D | 192 | 5.313 | 25.363 | −9.190 | 1.00 | 72.67 | GZ00 N |
| ATOM | 3104 | CA | HIS | D | 192 | 6.267 | 25.792 | −10.210 | 1.00 | 69.13 | GZ00 C |
| ATOM | 3105 | C | HIS | D | 192 | 7.641 | 25.135 | −10.038 | 1.00 | 66.99 | GZ00 C |
| ATOM | 3106 | O | HIS | D | 192 | 8.020 | 24.695 | −8.951 | 1.00 | 72.31 | GZ00 O |
| ATOM | 3107 | CB | HIS | D | 192 | 6.420 | 27.313 | −10.199 | 1.00 | 72.85 | GZ00 C |
| ATOM | 3108 | CG | HIS | D | 192 | 5.178 | 28.049 | −10.597 | 1.00 | 71.64 | GZ00 C |
| ATOM | 3109 | ND1 | HIS | D | 192 | 4.172 | 28.355 | −9.704 | 1.00 | 70.93 | GZ00 N |
| ATOM | 3110 | CD2 | HIS | D | 192 | 4.763 | 28.504 | −11.803 | 1.00 | 68.93 | GZ00 C |
| ATOM | 3111 | CE1 | HIS | D | 192 | 3.202 | 28.990 | −10.338 | 1.00 | 65.00 | GZ00 C |
| ATOM | 3112 | NE2 | HIS | D | 192 | 3.534 | 29.089 | −11.614 | 1.00 | 73.86 | GZ00 N |
| ATOM | 3113 | N | ARG | D | 193 | 8.390 | 25.070 | −11.148 | 1.00 | 64.89 | GZ00 N |
| ATOM | 3114 | CA | ARG | D | 193 | 9.731 | 24.476 | −11.135 | 1.00 | 69.27 | GZ00 C |
| ATOM | 3115 | C | ARG | D | 193 | 10.705 | 25.313 | −10.313 | 1.00 | 67.85 | GZ00 C |
| ATOM | 3116 | O | ARG | D | 193 | 11.542 | 24.769 | −9.586 | 1.00 | 68.86 | GZ00 O |
| ATOM | 3117 | CB | ARG | D | 193 | 10.269 | 24.354 | −12.565 | 1.00 | 71.73 | GZ00 C |
| ATOM | 3118 | CG | ARG | D | 193 | 9.414 | 23.557 | −13.540 | 1.00 | 81.33 | GZ00 C |
| ATOM | 3119 | CD | ARG | D | 193 | 9.846 | 23.822 | −14.993 | 1.00 | 88.10 | GZ00 C |
| ATOM | 3120 | NE | ARG | D | 193 | 8.722 | 24.419 | −15.728 | 1.00 | 99.94 | GZ00 N |
| ATOM | 3121 | CZ | ARG | D | 193 | 8.814 | 25.092 | −16.875 | 1.00 | 101.58 | GZ00 C |
| ATOM | 3122 | NH1 | ARG | D | 193 | 7.716 | 25.589 | −17.441 | 1.00 | 88.37 | GZ00 N1+ |
| ATOM | 3123 | NH2 | ARG | D | 193 | 9.997 | 25.305 | −17.440 | 1.00 | 99.51 | GZ00 N |
| ATOM | 3124 | N | SER | D | 194 | 10.619 | 26.637 | −10.428 | 1.00 | 68.05 | GZ00 N |
| ATOM | 3125 | CA | SER | D | 194 | 11.553 | 27.534 | −9.768 | 1.00 | 62.46 | GZ00 C |
| ATOM | 3126 | C | SER | D | 194 | 10.936 | 28.917 | −9.658 | 1.00 | 66.77 | GZ00 C |
| ATOM | 3127 | O | SER | D | 194 | 9.957 | 29.242 | −10.334 | 1.00 | 71.03 | GZ00 O |
| ATOM | 3128 | CB | SER | D | 194 | 12.876 | 27.622 | −10.529 | 1.00 | 66.04 | GZ00 C |
| ATOM | 3129 | OG | SER | D | 194 | 12.739 | 28.441 | −11.681 | 1.00 | 66.32 | GZ00 O |
| ATOM | 3130 | N | TYR | D | 195 | 11.520 | 29.722 | −8.782 | 1.00 | 64.92 | GZ00 N |
| ATOM | 3131 | CA | TYR | D | 195 | 11.219 | 31.142 | −8.688 | 1.00 | 63.56 | GZ00 C |
| ATOM | 3132 | C | TYR | D | 195 | 12.522 | 31.927 | −8.748 | 1.00 | 61.50 | GZ00 C |
| ATOM | 3133 | O | TYR | D | 195 | 13.580 | 31.431 | −8.351 | 1.00 | 54.93 | GZ00 O |
| ATOM | 3134 | CB | TYR | D | 195 | 10.481 | 31.482 | −7.408 | 1.00 | 57.26 | GZ00 C |
| ATOM | 3135 | CG | TYR | D | 195 | 9.037 | 31.058 | −7.392 | 1.00 | 64.67 | GZ00 C |
| ATOM | 3136 | CD1 | TYR | D | 195 | 8.679 | 29.742 | −7.126 | 1.00 | 69.64 | GZ00 C |

TABLE 10.3-continued

| | | | | | | | | | | |
|---|---|---|---|---|---|---|---|---|---|---|
| ATOM | 3137 | CD2 | TYR | D | 195 | 8.025 | 31.986 | −7.618 | 1.00 | 66.11 | GZ00 C |
| ATOM | 3138 | CE1 | TYR | D | 195 | 7.350 | 29.362 | −7.094 | 1.00 | 72.89 | GZ00 C |
| ATOM | 3139 | CE2 | TYR | D | 195 | 6.704 | 31.621 | −7.592 | 1.00 | 63.75 | GZ00 C |
| ATOM | 3140 | CZ | TYR | D | 195 | 6.369 | 30.311 | −7.336 | 1.00 | 69.62 | GZ00 C |
| ATOM | 3141 | OH | TYR | D | 195 | 5.043 | 29.958 | −7.309 | 1.00 | 71.41 | GZ00 O |
| ATOM | 3142 | N | SER | D | 196 | 12.441 | 33.161 | −9.235 | 1.00 | 58.30 | GZ00 N |
| ATOM | 3143 | CA | SER | D | 196 | 13.627 | 33.990 | −9.396 | 1.00 | 54.75 | GZ00 C |
| ATOM | 3144 | C | SER | D | 196 | 13.387 | 35.383 | −8.852 | 1.00 | 52.46 | GZ00 C |
| ATOM | 3145 | O | SER | D | 196 | 12.282 | 35.924 | −8.944 | 1.00 | 50.50 | GZ00 O |
| ATOM | 3146 | CB | SER | D | 196 | 14.068 | 34.102 | −10.856 | 1.00 | 55.06 | GZ00 C |
| ATOM | 3147 | OG | SER | D | 196 | 14.543 | 32.862 | −11.337 | 1.00 | 59.56 | GZ00 O |
| ATOM | 3148 | N | CYS | D | 197 | 14.434 | 35.941 | −8.263 | 1.00 | 51.88 | GZ00 N |
| ATOM | 3149 | CA | CYS | D | 197 | 14.485 | 37.334 | −7.862 | 1.00 | 48.95 | GZ00 C |
| ATOM | 3150 | C | CYS | D | 197 | 15.499 | 38.031 | −8.771 | 1.00 | 49.99 | GZ00 C |
| ATOM | 3151 | O | CYS | D | 197 | 16.667 | 37.641 | −8.809 | 1.00 | 46.06 | GZ00 O |
| ATOM | 3152 | CB | CYS | D | 197 | 14.868 | 37.443 | −6.389 | 1.00 | 50.65 | GZ00 C |
| ATOM | 3153 | SG | CYS | D | 197 | 14.970 | 39.121 | −5.807 | 1.00 | 59.52 | GZ00 S |
| ATOM | 3154 | N | GLN | D | 198 | 15.048 | 39.021 | −9.538 | 1.00 | 50.95 | GZ00 N |
| ATOM | 3155 | CA | GLN | D | 198 | 15.912 | 39.731 | −10.476 | 1.00 | 45.62 | GZ00 C |
| ATOM | 3156 | C | GLN | D | 198 | 16.058 | 41.165 | −10.006 | 1.00 | 45.99 | GZ00 C |
| ATOM | 3157 | O | GLN | D | 198 | 15.064 | 41.888 | −9.860 | 1.00 | 43.74 | GZ00 O |
| ATOM | 3158 | CB | GLN | D | 198 | 15.372 | 39.667 | −11.901 | 1.00 | 43.17 | GZ00 C |
| ATOM | 3159 | CG | GLN | D | 198 | 15.534 | 38.283 | −12.527 | 1.00 | 59.20 | GZ00 C |
| ATOM | 3160 | CD | GLN | D | 198 | 14.770 | 38.107 | −13.837 | 1.00 | 67.77 | GZ00 C |
| ATOM | 3161 | OE1 | GLN | D | 198 | 14.034 | 38.996 | −14.273 | 1.00 | 68.74 | GZ00 O |
| ATOM | 3162 | NE2 | GLN | D | 198 | 14.933 | 36.945 | −14.460 | 1.00 | 69.92 | GZ00 N |
| ATOM | 3163 | N | VAL | D | 199 | 17.291 | 41.556 | −9.722 | 1.00 | 43.86 | GZ00 N |
| ATOM | 3164 | CA | VAL | D | 199 | 17.600 | 42.869 | −9.177 | 1.00 | 43.86 | GZ00 C |
| ATOM | 3165 | C | VAL | D | 199 | 18.389 | 43.626 | −10.233 | 1.00 | 44.40 | GZ00 C |
| ATOM | 3166 | O | VAL | D | 199 | 19.480 | 43.197 | −10.619 | 1.00 | 41.88 | GZ00 O |
| ATOM | 3167 | CB | VAL | D | 199 | 18.389 | 42.750 | −7.865 | 1.00 | 40.13 | GZ00 C |
| ATOM | 3168 | CG1 | VAL | D | 199 | 18.560 | 44.088 | −7.241 | 1.00 | 33.53 | GZ00 C |
| ATOM | 3169 | CG2 | VAL | D | 199 | 17.679 | 41.778 | −6.906 | 1.00 | 37.93 | GZ00 C |
| ATOM | 3170 | N | THR | D | 200 | 17.838 | 44.732 | −10.719 | 1.00 | 43.84 | GZ00 N |
| ATOM | 3171 | CA | THR | D | 200 | 18.513 | 45.558 | −11.712 | 1.00 | 42.52 | GZ00 C |
| ATOM | 3172 | C | THR | D | 200 | 19.125 | 46.783 | −11.044 | 1.00 | 39.89 | GZ00 C |
| ATOM | 3173 | O | THR | D | 200 | 18.442 | 47.506 | −10.310 | 1.00 | 39.87 | GZ00 O |
| ATOM | 3174 | CB | THR | D | 200 | 17.542 | 45.987 | −12.813 | 1.00 | 48.84 | GZ00 C |
| ATOM | 3175 | OG1 | THR | D | 200 | 16.958 | 44.805 | −13.380 | 1.00 | 46.64 | GZ00 O |
| ATOM | 3176 | CG2 | THR | D | 200 | 18.290 | 46.806 | −13.918 | 1.00 | 33.12 | GZ00 C |
| ATOM | 3177 | N | HIS | D | 201 | 20.406 | 47.016 | −11.313 | 1.00 | 40.27 | GZ00 N |
| ATOM | 3178 | CA | HIS | D | 201 | 21.145 | 48.125 | −10.723 | 1.00 | 39.47 | GZ00 C |
| ATOM | 3179 | C | HIS | D | 201 | 22.047 | 48.723 | −11.790 | 1.00 | 44.85 | GZ00 C |
| ATOM | 3180 | O | HIS | D | 201 | 22.892 | 48.013 | −12.345 | 1.00 | 39.41 | GZ00 O |
| ATOM | 3181 | CB | HIS | D | 201 | 21.973 | 47.660 | −9.532 | 1.00 | 37.22 | GZ00 C |
| ATOM | 3182 | CG | HIS | D | 201 | 22.797 | 48.738 | −8.905 | 1.00 | 34.72 | GZ00 C |
| ATOM | 3183 | ND1 | HIS | D | 201 | 24.134 | 48.915 | −9.190 | 1.00 | 33.61 | GZ00 N |
| ATOM | 3184 | CD2 | HIS | D | 201 | 22.486 | 49.658 | −7.960 | 1.00 | 33.33 | GZ00 C |
| ATOM | 3185 | CE1 | HIS | D | 201 | 24.608 | 49.907 | −8.455 | 1.00 | 40.99 | GZ00 C |
| ATOM | 3186 | NE2 | HIS | D | 201 | 23.628 | 50.377 | −7.699 | 1.00 | 33.68 | GZ00 N |
| ATOM | 3187 | N | GLU | D | 202 | 21.840 | 50.010 | −12.100 | 1.00 | 47.82 | GZ00 N |
| ATOM | 3188 | CA | GLU | D | 202 | 22.672 | 50.726 | −13.064 | 1.00 | 45.90 | GZ00 C |
| ATOM | 3189 | C | GLU | D | 202 | 22.753 | 49.963 | −14.385 | 1.00 | 44.77 | GZ00 C |
| ATOM | 3190 | O | GLU | D | 202 | 23.828 | 49.757 | −14.947 | 1.00 | 45.87 | GZ00 O |
| ATOM | 3191 | CB | GLU | D | 202 | 24.068 | 50.973 | −12.485 | 1.00 | 40.73 | GZ00 C |
| ATOM | 3192 | CG | GLU | D | 202 | 24.078 | 51.833 | −11.241 | 1.00 | 37.51 | GZ00 C |
| ATOM | 3193 | CD | GLU | D | 202 | 23.780 | 53.301 | −11.543 | 1.00 | 53.62 | GZ00 C |
| ATOM | 3194 | OE1 | GLU | D | 202 | 24.472 | 53.880 | −12.414 | 1.00 | 54.80 | GZ00 O |
| ATOM | 3195 | OE2 | GLU | D | 202 | 22.853 | 53.878 | −10.924 | 1.00 | 56.28 | GZ00 O1− |
| ATOM | 3196 | N | GLY | D | 203 | 21.600 | 49.498 | −14.862 | 1.00 | 40.18 | GZ00 N |
| ATOM | 3197 | CA | GLY | D | 203 | 21.584 | 48.775 | −16.117 | 1.00 | 41.95 | GZ00 C |
| ATOM | 3198 | C | GLY | D | 203 | 22.137 | 47.357 | −16.110 | 1.00 | 51.05 | GZ00 C |
| ATOM | 3199 | O | GLY | D | 203 | 22.259 | 46.760 | −17.186 | 1.00 | 50.18 | GZ00 O |
| ATOM | 3200 | N | SER | D | 206 | 22.505 | 46.793 | −14.958 | 1.00 | 47.41 | GZ00 N |
| ATOM | 3201 | CA | SER | D | 206 | 22.921 | 45.390 | −14.906 | 1.00 | 50.13 | GZ00 C |
| ATOM | 3202 | C | SER | D | 206 | 22.101 | 44.640 | −13.874 | 1.00 | 46.73 | GZ00 C |
| ATOM | 3203 | O | SER | D | 206 | 21.921 | 45.117 | −12.747 | 1.00 | 45.75 | GZ00 O |
| ATOM | 3204 | CB | SER | D | 206 | 24.404 | 45.243 | −14.607 | 1.00 | 46.12 | GZ00 C |
| ATOM | 3205 | OG | SER | D | 206 | 25.155 | 45.750 | −15.688 | 1.00 | 57.53 | GZ00 O |
| ATOM | 3206 | N | THR | D | 207 | 21.592 | 43.477 | −14.262 | 1.00 | 41.69 | GZ00 N |
| ATOM | 3207 | CA | THR | D | 207 | 20.697 | 42.720 | −13.400 | 1.00 | 50.12 | GZ00 C |
| ATOM | 3208 | C | THR | D | 207 | 21.425 | 41.525 | −12.797 | 1.00 | 47.45 | GZ00 C |
| ATOM | 3209 | O | THR | D | 207 | 22.129 | 40.793 | −13.501 | 1.00 | 43.02 | GZ00 O |
| ATOM | 3210 | CB | THR | D | 207 | 19.449 | 42.249 | −14.155 | 1.00 | 49.49 | GZ00 C |
| ATOM | 3211 | OG1 | THR | D | 207 | 19.797 | 41.130 | −14.968 | 1.00 | 59.30 | GZ00 O |
| ATOM | 3212 | CG2 | THR | D | 207 | 18.885 | 43.358 | −15.031 | 1.00 | 37.86 | GZ00 C |
| ATOM | 3213 | N | VAL | D | 208 | 21.234 | 41.328 | −11.495 | 1.00 | 45.06 | GZ00 N |
| ATOM | 3214 | CA | VAL | D | 208 | 21.724 | 40.163 | −10.767 | 1.00 | 49.03 | GZ00 C |
| ATOM | 3215 | C | VAL | D | 208 | 20.514 | 39.301 | −10.447 | 1.00 | 44.06 | GZ00 C |
| ATOM | 3216 | O | VAL | D | 208 | 19.493 | 39.815 | −9.974 | 1.00 | 50.95 | GZ00 O |

TABLE 10.3-continued

| | | | | | | | | | | |
|---|---|---|---|---|---|---|---|---|---|---|
| ATOM | 3217 | CB | VAL | D | 208 | 22.467 | 40.579 | −9.484 | 1.00 | 48.97 GZ00 C |
| ATOM | 3218 | CG1 | VAL | D | 208 | 22.858 | 39.372 | −8.668 | 1.00 | 41.12 GZ00 C |
| ATOM | 3219 | CG2 | VAL | D | 208 | 23.700 | 41.376 | −9.829 | 1.00 | 39.61 GZ00 C |
| ATOM | 3220 | N | GLU | D | 209 | 20.614 | 38.005 | −10.709 | 1.00 | 41.82 GZ00 N |
| ATOM | 3221 | CA | GLU | D | 209 | 19.483 | 37.103 | −10.538 | 1.00 | 43.40 GZ00 C |
| ATOM | 3222 | C | GLU | D | 209 | 19.835 | 35.970 | −9.586 | 1.00 | 50.61 GZ00 C |
| ATOM | 3223 | O | GLU | D | 209 | 20.917 | 35.383 | −9.674 | 1.00 | 57.28 GZ00 O |
| ATOM | 3224 | CB | GLU | D | 209 | 19.042 | 36.508 | −11.873 | 1.00 | 49.58 GZ00 C |
| ATOM | 3225 | CG | GLU | D | 209 | 17.851 | 35.561 | −11.761 | 1.00 | 62.21 GZ00 C |
| ATOM | 3226 | CD | GLU | D | 209 | 17.419 | 34.999 | −13.108 | 1.00 | 75.52 GZ00 C |
| ATOM | 3227 | OE1 | GLU | D | 209 | 17.297 | 33.759 | −13.240 | 1.00 | 85.24 GZ00 O |
| ATOM | 3228 | OE2 | GLU | D | 209 | 17.155 | 35.806 | −14.026 | 1.00 | 77.80 GZ00 O1− |
| ATOM | 3229 | N | LYS | D | 210 | 18.902 | 35.636 | −8.705 | 1.00 | 48.46 GZ00 N |
| ATOM | 3230 | CA | LYS | D | 210 | 19.006 | 34.443 | −7.885 | 1.00 | 52.58 GZ00 C |
| ATOM | 3231 | C | LYS | D | 210 | 17.741 | 33.630 | −8.066 | 1.00 | 49.39 GZ00 C |
| ATOM | 3232 | O | LYS | D | 210 | 16.639 | 34.182 | −8.150 | 1.00 | 51.83 GZ00 O |
| ATOM | 3233 | CB | LYS | D | 210 | 19.228 | 34.785 | −6.401 | 1.00 | 50.40 GZ00 C |
| ATOM | 3234 | CG | LYS | D | 210 | 20.608 | 35.341 | −6.116 | 1.00 | 46.93 GZ00 C |
| ATOM | 3235 | CD | LYS | D | 210 | 21.675 | 34.454 | −6.726 | 1.00 | 45.41 GZ00 C |
| ATOM | 3236 | CE | LYS | D | 210 | 23.095 | 35.008 | −6.476 | 1.00 | 52.18 GZ00 C |
| ATOM | 3237 | NZ | LYS | D | 210 | 23.541 | 34.804 | −5.009 | 1.00 | 57.98 GZ00 N1+ |
| ATOM | 3238 | N | THR | D | 211 | 17.900 | 32.324 | −8.168 | 1.00 | 47.49 GZ00 N |
| ATOM | 3239 | CA | THR | D | 211 | 16.750 | 31.460 | −8.337 | 1.00 | 56.28 GZ00 C |
| ATOM | 3240 | C | THR | D | 211 | 16.772 | 30.374 | −7.276 | 1.00 | 53.77 GZ00 C |
| ATOM | 3241 | O | THR | D | 211 | 17.832 | 29.917 | −6.845 | 1.00 | 60.67 GZ00 O |
| ATOM | 3242 | CB | THR | D | 211 | 16.708 | 30.815 | −9.722 | 1.00 | 53.88 GZ00 C |
| ATOM | 3243 | OG1 | THR | D | 211 | 17.474 | 29.617 | −9.690 | 1.00 | 68.57 GZ00 O |
| ATOM | 3244 | CG2 | THR | D | 211 | 17.315 | 31.729 | −10.774 | 1.00 | 54.97 GZ00 C |
| ATOM | 3245 | N | VAL | D | 212 | 15.583 | 29.943 | −6.893 | 1.00 | 54.81 GZ00 N |
| ATOM | 3246 | CA | VAL | D | 212 | 15.393 | 28.942 | −5.858 | 1.00 | 54.01 GZ00 C |
| ATOM | 3247 | C | VAL | D | 212 | 14.264 | 28.011 | −6.313 | 1.00 | 62.68 GZ00 C |
| ATOM | 3248 | O | VAL | D | 212 | 13.334 | 28.429 | −7.016 | 1.00 | 62.49 GZ00 O |
| ATOM | 3249 | CB | VAL | D | 212 | 15.121 | 29.656 | −4.510 | 1.00 | 51.80 GZ00 C |
| ATOM | 3250 | CG1 | VAL | D | 212 | 13.642 | 30.033 | −4.363 | 1.00 | 48.35 GZ00 C |
| ATOM | 3251 | CG2 | VAL | D | 212 | 15.626 | 28.849 | −3.351 | 1.00 | 63.22 GZ00 C |
| ATOM | 3252 | N | ALA | D | 213 | 14.367 | 26.729 | −5.951 | 1.00 | 62.74 GZ00 N |
| ATOM | 3253 | CA | ALA | D | 213 | 13.422 | 25.713 | −6.406 | 1.00 | 61.72 GZ00 C |
| ATOM | 3254 | C | ALA | D | 213 | 12.828 | 24.959 | −5.225 | 1.00 | 66.88 GZ00 C |
| ATOM | 3255 | O | ALA | D | 213 | 13.502 | 24.746 | −4.213 | 1.00 | 69.81 GZ00 O |
| ATOM | 3256 | CB | ALA | D | 213 | 14.074 | 24.712 | −7.370 | 1.00 | 52.61 GZ00 C |
| ATOM | 3257 | N | PRO | D | 214 | 11.554 | 24.566 | −5.318 | 1.00 | 71.94 GZ00 N |
| ATOM | 3258 | CA | PRO | D | 214 | 10.911 | 23.880 | −4.181 | 1.00 | 73.82 GZ00 C |
| ATOM | 3259 | C | PRO | D | 214 | 11.485 | 22.508 | −3.872 | 1.00 | 83.15 GZ00 C |
| ATOM | 3260 | O | PRO | D | 214 | 11.296 | 22.024 | −2.748 | 1.00 | 87.02 GZ00 O |
| ATOM | 3261 | CB | PRO | D | 214 | 9.437 | 23.798 | −4.599 | 1.00 | 71.13 GZ00 C |
| ATOM | 3262 | CG | PRO | D | 214 | 9.430 | 24.016 | −6.077 | 1.00 | 76.39 GZ00 C |
| ATOM | 3263 | CD | PRO | D | 214 | 10.598 | 24.897 | −6.388 | 1.00 | 73.27 GZ00 C |
| ATOM | 3264 | N | THR | D | 215 | 12.167 | 21.863 | −4.815 | 1.00 | 81.47 GZ00 N |
| ATOM | 3265 | CA | THR | D | 215 | 12.918 | 20.647 | −4.512 | 1.00 | 88.36 GZ00 C |
| ATOM | 3266 | C | THR | D | 215 | 14.100 | 21.003 | −3.608 | 1.00 | 95.90 GZ00 C |
| ATOM | 3267 | O | THR | D | 215 | 15.126 | 21.513 | −4.071 | 1.00 | 92.30 GZ00 O |
| ATOM | 3268 | CB | THR | D | 215 | 13.383 | 19.978 | −5.802 | 1.00 | 93.99 GZ00 C |
| ATOM | 3269 | OG1 | THR | D | 215 | 14.373 | 20.797 | −6.434 | 1.00 | 97.00 GZ00 O |
| ATOM | 3270 | CG2 | THR | D | 215 | 12.210 | 19.791 | −6.759 | 1.00 | 92.11 GZ00 C |
| ATOM | 3271 | N | GLU | D | 216 | 13.956 | 20.757 | −2.306 | 1.00 | 96.37 GZ00 N |
| ATOM | 3272 | CA | GLU | D | 216 | 14.997 | 21.115 | −1.340 | 1.00 | 94.49 GZ00 C |
| ATOM | 3273 | C | GLU | D | 216 | 15.586 | 19.863 | −0.689 | 1.00 | 103.70 GZ00 C |
| ATOM | 3274 | O | GLU | D | 216 | 16.586 | 19.934 | 0.031 | 1.00 | 103.19 GZ00 O |
| ATOM | 3275 | CB | GLU | D | 216 | 14.453 | 22.060 | −0.258 | 1.00 | 98.63 GZ00 C |
| ATOM | 3276 | CG | GLU | D | 216 | 14.051 | 23.474 | −0.741 | 1.00 | 99.48 GZ00 C |
| ATOM | 3277 | CD | GLU | D | 216 | 13.551 | 24.375 | 0.397 | 1.00 | 94.82 GZ00 C |
| ATOM | 3278 | OE1 | GLU | D | 216 | 14.356 | 24.704 | 1.304 | 1.00 | 90.53 GZ00 O |
| ATOM | 3279 | OE2 | GLU | D | 216 | 12.349 | 24.740 | 0.394 | 1.00 | 84.44 GZ00 O1− |
| TER | | | | | | | | | | |
| ATOM | 3280 | N | GLN | A | 1 | −34.534 | 69.246 | −14.750 | 1.00 | 68.93 N |
| ATOM | 3281 | CA | GLN | A | 1 | −35.181 | 70.408 | −14.148 | 1.00 | 63.15 C |
| ATOM | 3282 | C | GLN | A | 1 | −34.574 | 70.759 | −12.783 | 1.00 | 64.87 C |
| ATOM | 3283 | O | GLN | A | 1 | −34.907 | 70.176 | −11.757 | 1.00 | 73.80 O |
| ATOM | 3284 | CB | GLN | A | 1 | −36.678 | 70.168 | −14.001 | 1.00 | 72.61 C |
| ATOM | 3285 | CG | GLN | A | 1 | −37.438 | 71.350 | −13.425 | 1.00 | 79.05 C |
| ATOM | 3286 | CD | GLN | A | 1 | −38.607 | 70.901 | −12.574 | 1.00 | 82.55 C |
| ATOM | 3287 | OE1 | GLN | A | 1 | −38.585 | 69.803 | −12.013 | 1.00 | 76.25 O |
| ATOM | 3288 | NE2 | GLN | A | 1 | −39.638 | 71.743 | −12.478 | 1.00 | 75.07 N |
| ATOM | 3289 | N | VAL | A | 2 | −33.670 | 71.708 | −12.792 | 1.00 | 52.55 N |
| ATOM | 3290 | CA | VAL | A | 2 | −33.090 | 72.273 | −11.587 | 1.00 | 39.46 C |
| ATOM | 3291 | C | VAL | A | 2 | −33.760 | 73.615 | −11.340 | 1.00 | 37.36 C |
| ATOM | 3292 | O | VAL | A | 2 | −34.051 | 74.357 | −12.286 | 1.00 | 42.98 O |
| ATOM | 3293 | CB | VAL | A | 2 | −31.561 | 72.402 | −11.744 | 1.00 | 37.95 C |
| ATOM | 3294 | CG1 | VAL | A | 2 | −30.942 | 73.173 | −10.605 | 1.00 | 32.40 C |
| ATOM | 3295 | CG2 | VAL | A | 2 | −30.938 | 71.007 | −11.812 | 1.00 | 38.29 C |

TABLE 10.3-continued

| | | | | | | | | | | |
|---|---|---|---|---|---|---|---|---|---|---|
| ATOM | 3296 | N | GLN | A | 3 | −34.074 | 73.905 | −10.086 | 1.00 | 28.57 | N |
| ATOM | 3297 | CA | GLN | A | 3 | −34.530 | 75.234 | −9.705 | 1.00 | 36.17 | C |
| ATOM | 3298 | C | GLN | A | 3 | −33.616 | 75.802 | −8.623 | 1.00 | 32.07 | C |
| ATOM | 3299 | O | GLN | A | 3 | −33.291 | 75.112 | −7.650 | 1.00 | 33.31 | O |
| ATOM | 3300 | CB | GLN | A | 3 | −35.981 | 75.198 | −9.230 | 1.00 | 33.26 | C |
| ATOM | 3301 | CG | GLN | A | 3 | −36.980 | 75.166 | −10.396 | 1.00 | 48.28 | C |
| ATOM | 3302 | CD | GLN | A | 3 | −38.422 | 75.482 | −9.975 | 1.00 | 66.43 | C |
| ATOM | 3303 | OE1 | GLN | A | 3 | −38.748 | 75.535 | −8.779 | 1.00 | 59.16 | O |
| ATOM | 3304 | NE2 | GLN | A | 3 | −39.284 | 75.714 | −10.964 | 1.00 | 65.91 | N |
| ATOM | 3305 | N | LEU | A | 4 | −33.202 | 77.051 | −8.798 | 1.00 | 28.83 | N |
| ATOM | 3306 | CA | LEU | A | 4 | −32.404 | 77.779 | −7.823 | 1.00 | 34.07 | N |
| ATOM | 3307 | C | LEU | A | 4 | −33.199 | 79.004 | −7.385 | 1.00 | 31.68 | C |
| ATOM | 3308 | O | LEU | A | 4 | −33.759 | 79.699 | −8.231 | 1.00 | 35.93 | O |
| ATOM | 3309 | CB | LEU | A | 4 | −31.054 | 78.181 | −8.431 | 1.00 | 31.35 | C |
| ATOM | 3310 | CG | LEU | A | 4 | −30.271 | 77.022 | −9.054 | 1.00 | 35.66 | C |
| ATOM | 3311 | CD1 | LEU | A | 4 | −29.061 | 77.538 | −9.848 | 1.00 | 33.22 | C |
| ATOM | 3312 | CD2 | LEU | A | 4 | −29.820 | 76.024 | −7.986 | 1.00 | 28.58 | C |
| ATOM | 3313 | N | VAL | A | 5 | −33.296 | 79.236 | −6.074 | 1.00 | 31.24 | C |
| ATOM | 3314 | CA | VAL | A | 5 | −34.075 | 80.340 | −5.501 | 1.00 | 29.71 | N |
| ATOM | 3315 | C | VAL | A | 5 | −33.192 | 81.106 | −4.521 | 1.00 | 30.40 | C |
| ATOM | 3316 | O | VAL | A | 5 | −32.883 | 80.594 | −3.439 | 1.00 | 34.07 | C |
| ATOM | 3317 | CB | VAL | A | 5 | −35.352 | 79.849 | −4.790 | 1.00 | 33.16 | O |
| ATOM | 3318 | CG1 | VAL | A | 5 | −36.116 | 81.023 | −4.194 | 1.00 | 22.32 | C |
| ATOM | 3319 | CG2 | VAL | A | 5 | −36.244 | 79.088 | −5.746 | 1.00 | 27.68 | C |
| ATOM | 3320 | N | GLU | A | 6 | −32.830 | 82.344 | −4.866 | 1.00 | 27.45 | C |
| ATOM | 3321 | CA | GLU | A | 6 | −32.039 | 83.183 | −3.970 | 1.00 | 34.31 | N |
| ATOM | 3322 | C | GLU | A | 6 | −32.938 | 83.895 | −2.964 | 1.00 | 35.66 | C |
| ATOM | 3323 | O | GLU | A | 6 | −34.094 | 84.211 | −3.250 | 1.00 | 35.15 | C |
| ATOM | 3324 | CB | GLU | A | 6 | −31.242 | 84.251 | −4.738 | 1.00 | 35.33 | O |
| ATOM | 3325 | CG | GLU | A | 6 | −30.370 | 83.745 | −5.877 | 1.00 | 36.08 | C |
| ATOM | 3326 | CD | GLU | A | 6 | −31.115 | 83.636 | −7.209 | 1.00 | 39.10 | C |
| ATOM | 3327 | OE1 | GLU | A | 6 | −32.369 | 83.508 | −7.199 | 1.00 | 35.08 | O |
| ATOM | 3328 | OE2 | GLU | A | 6 | −30.432 | 83.628 | −8.263 | 1.00 | 35.04 | O1− |
| ATOM | 3329 | N | SER | A | 7 | −32.368 | 84.204 | −1.800 | 1.00 | 36.13 | C |
| ATOM | 3330 | CA | SER | A | 7 | −33.075 | 84.945 | −0.763 | 1.00 | 34.15 | C |
| ATOM | 3331 | C | SER | A | 7 | −32.033 | 85.588 | 0.132 | 1.00 | 31.67 | C |
| ATOM | 3332 | O | SER | A | 7 | −30.848 | 85.263 | 0.062 | 1.00 | 34.14 | O |
| ATOM | 3333 | CB | SER | A | 7 | −34.004 | 84.045 | 0.060 | 1.00 | 29.39 | C |
| ATOM | 3334 | OG | SER | A | 7 | −33.246 | 83.029 | 0.704 | 1.00 | 39.57 | O |
| ATOM | 3335 | N | GLY | A | 8 | −32.484 | 86.520 | 0.962 | 1.00 | 33.72 | N |
| ATOM | 3336 | CA | GLY | A | 8 | −31.621 | 87.148 | 1.934 | 1.00 | 31.16 | C |
| ATOM | 3337 | C | GLY | A | 8 | −31.165 | 88.543 | 1.590 | 1.00 | 40.14 | C |
| ATOM | 3338 | O | GLY | A | 8 | −30.323 | 89.095 | 2.311 | 1.00 | 41.88 | O |
| ATOM | 3339 | N | GLY | A | 9 | −31.679 | 89.131 | 0.518 | 1.00 | 30.46 | N |
| ATOM | 3340 | CA | GLY | A | 9 | −31.281 | 90.478 | 0.150 | 1.00 | 42.56 | C |
| ATOM | 3341 | C | GLY | A | 9 | −31.699 | 91.554 | 1.150 | 1.00 | 45.12 | C |
| ATOM | 3342 | O | GLY | A | 9 | −31.989 | 91.303 | 2.319 | 1.00 | 45.51 | O |
| ATOM | 3343 | N | GLY | A | 10 | −31.614 | 92.794 | 0.695 | 1.00 | 40.16 | N |
| ATOM | 3344 | CA | GLY | A | 10 | −32.173 | 93.880 | 1.461 | 1.00 | 36.55 | C |
| ATOM | 3345 | C | GLY | A | 10 | −31.303 | 95.118 | 1.379 | 1.00 | 41.88 | C |
| ATOM | 3346 | O | GLY | A | 10 | −30.334 | 95.184 | 0.617 | 1.00 | 34.74 | O |
| ATOM | 3347 | N | VAL | A | 11 | −31.676 | 96.112 | 2.184 | 1.00 | 37.50 | N |
| ATOM | 3348 | CA | VAL | A | 11 | −30.953 | 97.369 | 2.303 | 1.00 | 38.58 | C |
| ATOM | 3349 | C | VAL | A | 11 | −30.020 | 97.243 | 3.493 | 1.00 | 43.54 | C |
| ATOM | 3350 | O | VAL | A | 11 | −30.423 | 96.759 | 4.555 | 1.00 | 47.55 | C |
| ATOM | 3351 | CB | VAL | A | 11 | −31.911 | 98.559 | 2.483 | 1.00 | 48.63 | O |
| ATOM | 3352 | CG1 | VAL | A | 11 | −31.118 | 99.850 | 2.585 | 1.00 | 43.07 | C |
| ATOM | 3353 | CG2 | VAL | A | 11 | −32.901 | 98.626 | 1.323 | 1.00 | 45.11 | C |
| ATOM | 3354 | N | VAL | A | 12 | −28.773 | 97.676 | 3.324 | 1.00 | 36.28 | C |
| ATOM | 3355 | CA | VAL | A | 12 | −27.767 | 97.511 | 4.364 | 1.00 | 44.38 | N |
| ATOM | 3356 | C | VAL | A | 12 | −26.802 | 98.696 | 4.298 | 1.00 | 42.35 | C |
| ATOM | 3357 | O | VAL | A | 12 | −26.638 | 99.336 | 3.253 | 1.00 | 42.56 | C |
| ATOM | 3358 | CB | VAL | A | 12 | −27.051 | 96.138 | 4.207 | 1.00 | 47.04 | O |
| ATOM | 3359 | CG1 | VAL | A | 12 | −26.272 | 96.069 | 2.897 | 1.00 | 44.35 | C |
| ATOM | 3360 | CG2 | VAL | A | 12 | −26.125 | 95.864 | 5.359 | 1.00 | 49.20 | C |
| ATOM | 3361 | N | GLN | A | 13 | −26.197 | 99.009 | 5.427 | 1.00 | 43.55 | C |
| ATOM | 3362 | CA | GLN | A | 13 | −25.312 | 100.156 | 5.405 | 1.00 | 44.17 | N |
| ATOM | 3363 | C | GLN | A | 13 | −23.884 | 99.743 | 5.086 | 1.00 | 47.16 | C |
| ATOM | 3364 | O | GLN | A | 13 | −23.471 | 98.619 | 5.399 | 1.00 | 45.14 | C |
| ATOM | 3365 | CB | GLN | A | 13 | −25.334 | 100.881 | 6.734 | 1.00 | 45.16 | O |
| ATOM | 3366 | CG | GLN | A | 13 | −26.698 | 101.357 | 7.135 | 1.00 | 59.94 | C |
| ATOM | 3367 | CD | GLN | A | 13 | −26.607 | 102.516 | 8.099 | 1.00 | 69.00 | C |
| ATOM | 3368 | OE1 | GLN | A | 13 | −26.037 | 103.566 | 7.771 | 1.00 | 69.47 | C |
| ATOM | 3369 | NE2 | GLN | A | 13 | −27.151 | 102.335 | 9.297 | 1.00 | 70.89 | O |
| ATOM | 3370 | N | PRO | A | 14 | −23.132 | 100.657 | 4.472 | 1.00 | 41.71 | N |
| ATOM | 3371 | CA | PRO | A | 14 | −21.726 | 100.372 | 4.167 | 1.00 | 38.64 | N |
| ATOM | 3372 | C | PRO | A | 14 | −21.00 | 199.888 | 5.411 | 1.00 | 41.46 | C |
| ATOM | 3373 | O | PRO | A | 14 | −21.225 | 100.390 | 6.512 | 1.00 | 43.96 | C |
| ATOM | 3374 | CB | PRO | A | 14 | −21.191 | 101.725 | 3.683 | 1.00 | 36.30 | O |
| ATOM | 3375 | CG | PRO | A | 14 | −22.417 | 102.449 | 3.166 | 1.00 | 37.34 | C |

TABLE 10.3-continued

| ATOM | 3376 | CD | PRO | A | 14 | −23.553 | 101.995 | 4.015 | 1.00 | 42.17 | C |
|---|---|---|---|---|---|---|---|---|---|---|---|
| ATOM | 3377 | N | GLY | A | 15 | −20.150 | 98.877 | 5.237 | 1.00 | 39.52 | C |
| ATOM | 3378 | CA | GLY | A | 15 | −19.389 | 98.318 | 6.335 | 1.00 | 35.94 | N |
| ATOM | 3379 | C | GLY | A | 15 | −20.077 | 97.199 | 7.088 | 1.00 | 40.72 | C |
| ATOM | 3380 | O | GLY | A | 15 | −19.407 | 96.463 | 7.826 | 1.00 | 44.51 | C |
| ATOM | 3381 | N | ARG | A | 16 | −21.388 | 97.045 | 6.924 | 1.00 | 39.84 | O |
| ATOM | 3382 | CA | ARG | A | 16 | −22.114 | 95.953 | 7.556 | 1.00 | 53.52 | N |
| ATOM | 3383 | C | ARG | A | 16 | −21.962 | 94.660 | 6.746 | 1.00 | 46.84 | C |
| ATOM | 3384 | O | ARG | A | 16 | −21.259 | 94.600 | 5.727 | 1.00 | 39.84 | O |
| ATOM | 3385 | CB | ARG | A | 16 | −23.592 | 96.303 | 7.706 | 1.00 | 54.09 | O |
| ATOM | 3386 | CG | ARG | A | 16 | −23.880 | 97.531 | 8.533 | 1.00 | 61.92 | C |
| ATOM | 3387 | CD | ARG | A | 16 | −23.430 | 97.323 | 9.960 | 1.00 | 69.75 | C |
| ATOM | 3388 | NE | ARG | A | 16 | −24.436 | 97.796 | 10.906 | 1.00 | 97.69 | C |
| ATOM | 3389 | CZ | ARG | A | 16 | −24.245 | 97.901 | 12.218 | 1.00 | 105.26 | N |
| ATOM | 3390 | NH1 | ARG | A | 16 | −23.075 | 97.566 | 12.754 | 1.00 | 97.15 | C |
| ATOM | 3391 | NH2 | ARG | A | 16 | −25.226 | 98.346 | 12.995 | 1.00 | 108.93 | N1+ |
| ATOM | 3392 | N | SER | A | 17 | −22.664 | 93.625 | 7.206 | 1.00 | 37.36 | N |
| ATOM | 3393 | CA | SER | A | 17 | −22.586 | 92.271 | 6.692 | 1.00 | 37.19 | N |
| ATOM | 3394 | C | SER | A | 17 | −23.962 | 91.796 | 6.274 | 1.00 | 41.75 | C |
| ATOM | 3395 | O | SER | A | 17 | −24.980 | 92.251 | 6.795 | 1.00 | 39.73 | O |
| ATOM | 3396 | CB | SER | A | 17 | −22.044 | 91.275 | 7.738 | 1.00 | 42.19 | C |
| ATOM | 3397 | OG | SER | A | 17 | −20.664 | 91.495 | 7.994 | 1.00 | 55.67 | O |
| ATOM | 3398 | N | LEU | A | 18 | −23.976 | 90.833 | 5.361 | 1.00 | 40.66 | N |
| ATOM | 3399 | CA | LEU | A | 18 | −25.220 | 90.256 | 4.877 | 1.00 | 42.98 | C |
| ATOM | 3400 | C | LEU | A | 18 | −24.901 | 88.861 | 4.361 | 1.00 | 40.59 | C |
| ATOM | 3401 | O | LEU | A | 18 | −23.804 | 88.623 | 3.850 | 1.00 | 41.78 | O |
| ATOM | 3402 | CB | LEU | A | 18 | −25.806 | 91.135 | 3.773 | 1.00 | 44.15 | C |
| ATOM | 3403 | CG | LEU | A | 18 | −27.278 | 91.269 | 3.460 | 1.00 | 54.36 | C |
| ATOM | 3404 | CD1 | LEU | A | 18 | −28.038 | 91.644 | 4.712 | 1.00 | 49.30 | C |
| ATOM | 3405 | CD2 | LEU | A | 18 | −27.392 | 92.395 | 2.454 | 1.00 | 49.78 | C |
| ATOM | 3406 | N | ARG | A | 19 | −25.848 | 87.940 | 4.497 | 1.00 | 30.82 | N |
| ATOM | 3407 | CA | ARG | A | 19 | −25.670 | 86.595 | 3.965 | 1.00 | 34.82 | C |
| ATOM | 3408 | C | ARG | A | 19 | −26.783 | 86.270 | 2.981 | 1.00 | 34.54 | C |
| ATOM | 3409 | O | ARG | A | 19 | −27.959 | 86.364 | 3.329 | 1.00 | 38.10 | O |
| ATOM | 3410 | CB | ARG | A | 19 | −25.635 | 85.549 | 5.073 | 1.00 | 35.74 | C |
| ATOM | 3411 | CG | ARG | A | 19 | −25.012 | 84.268 | 4.606 | 1.00 | 37.23 | C |
| ATOM | 3412 | CD | ARG | A | 19 | −25.223 | 83.128 | 5.579 | 1.00 | 38.05 | C |
| ATOM | 3413 | NE | ARG | A | 19 | −26.633 | 82.826 | 5.730 | 1.00 | 39.69 | N |
| ATOM | 3414 | CZ | ARG | A | 19 | −27.107 | 81.838 | 6.477 | 1.00 | 47.15 | C |
| ATOM | 3415 | NH1 | ARG | A | 19 | −28.419 | 81.642 | 6.559 | 1.00 | 43.39 | N1+ |
| ATOM | 3416 | NH2 | ARG | A | 19 | −26.271 | 81.043 | 7.130 | 1.00 | 46.94 | N |
| ATOM | 3417 | N | LEU | A | 20 | −26.416 | 85.921 | 1.750 | 1.00 | 33.95 | N |
| ATOM | 3418 | CA | LEU | A | 20 | −27.386 | 85.431 | 0.783 | 1.00 | 32.04 | C |
| ATOM | 3419 | C | LEU | A | 20 | −27.486 | 83.908 | 0.841 | 1.00 | 35.48 | C |
| ATOM | 3420 | O | LEU | A | 20 | −26.522 | 83.206 | 1.174 | 1.00 | 34.13 | C |
| ATOM | 3421 | CB | LEU | A | 20 | −27.019 | 85.873 | −0.631 | 1.00 | 26.84 | O |
| ATOM | 3422 | CG | LEU | A | 20 | −26.829 | 87.380 | −0.792 | 1.00 | 31.60 | C |
| ATOM | 3423 | CD1 | LEU | A | 20 | −26.621 | 87.704 | −2.261 | 1.00 | 25.55 | C |
| ATOM | 3424 | CD2 | LEU | A | 20 | −28.028 | 88.140 | −0.220 | 1.00 | 24.15 | C |
| ATOM | 3425 | N | SER | A | 21 | −28.675 | 83.403 | 0.528 | 1.00 | 33.17 | C |
| ATOM | 3426 | CA | SER | A | 21 | −28.924 | 81.976 | 0.391 | 1.00 | 32.39 | N |
| ATOM | 3427 | C | SER | A | 21 | −29.441 | 81.658 | −1.002 | 1.00 | 34.28 | C |
| ATOM | 3428 | O | SER | A | 21 | −30.123 | 82.470 | −1.633 | 1.00 | 35.15 | O |
| ATOM | 3429 | CB | SER | A | 21 | −29.944 | 81.457 | 1.411 | 1.00 | 29.91 | C |
| ATOM | 3430 | OG | SER | A | 21 | −29.401 | 81.456 | 2.706 | 1.00 | 32.59 | O |
| ATOM | 3431 | N | CYS | A | 22 | −29.122 | 80.452 | −1.463 | 1.00 | 29.55 | N |
| ATOM | 3432 | CA | CYS | A | 22 | −29.608 | 79.954 | −2.740 | 1.00 | 29.82 | C |
| ATOM | 3433 | C | CYS | A | 22 | −30.059 | 78.520 | −2.506 | 1.00 | 34.08 | C |
| ATOM | 3434 | O | CYS | A | 22 | −29.225 | 77.635 | −2.286 | 1.00 | 33.80 | O |
| ATOM | 3435 | CB | CYS | A | 22 | −28.515 | 80.040 | −3.803 | 1.00 | 37.60 | C |
| ATOM | 3436 | SG | CYS | A | 22 | −28.846 | 79.175 | −5.362 | 1.00 | 44.81 | S |
| ATOM | 3437 | N | ALA | A | 23 | −31.366 | 78.297 | −2.544 | 1.00 | 27.47 | N |
| ATOM | 3438 | CA | ALA | A | 23 | −31.956 | 77.006 | −2.235 | 1.00 | 31.62 | C |
| ATOM | 3439 | C | ALA | A | 23 | −32.152 | 76.263 | −3.540 | 1.00 | 32.14 | C |
| ATOM | 3440 | O | ALA | A | 23 | −32.753 | 76.799 | −4.480 | 1.00 | 32.98 | O |
| ATOM | 3441 | CB | ALA | A | 23 | −33.296 | 77.155 | −1.500 | 1.00 | 23.36 | C |
| ATOM | 3442 | N | ALA | A | 24 | −31.646 | 75.037 | −3.593 | 1.00 | 31.79 | N |
| ATOM | 3443 | CA | ALA | A | 24 | −31.642 | 74.239 | −4.809 | 1.00 | 29.92 | C |
| ATOM | 3444 | C | ALA | A | 24 | −32.595 | 73.062 | −4.685 | 1.00 | 29.71 | C |
| ATOM | 3445 | O | ALA | A | 24 | −32.735 | 72.476 | −3.612 | 1.00 | 39.67 | O |
| ATOM | 3446 | CB | ALA | A | 24 | −30.238 | 73.724 | −5.104 | 1.00 | 27.23 | C |
| ATOM | 3447 | N | SER | A | 25 | −33.239 | 72.708 | −5.790 | 1.00 | 32.42 | N |
| ATOM | 3448 | CA | SER | A | 25 | −34.067 | 71.515 | −5.851 | 1.00 | 28.53 | C |
| ATOM | 3449 | C | SER | A | 25 | −34.108 | 70.982 | −7.273 | 1.00 | 34.80 | C |
| ATOM | 3450 | O | SER | A | 25 | −33.754 | 71.688 | −8.228 | 1.00 | 28.65 | O |
| ATOM | 3451 | CB | SER | A | 25 | −35.484 | 71.822 | −5.400 | 1.00 | 36.68 | C |
| ATOM | 3452 | OG | SER | A | 25 | −36.046 | 72.798 | −6.269 | 1.00 | 34.63 | O |
| ATOM | 3453 | N | GLY | A | 26 | −34.558 | 69.720 | −7.410 | 1.00 | 31.26 | N |
| ATOM | 3454 | CA | GLY | A | 26 | −34.824 | 69.150 | −8.718 | 1.00 | 31.69 | C |
| ATOM | 3455 | C | GLY | A | 26 | −33.759 | 68.254 | −9.323 | 1.00 | 50.48 | C |

TABLE 10.3-continued

| | | | | | | | | | | |
|---|---|---|---|---|---|---|---|---|---|---|
| ATOM | 3456 | O | GLY | A | 26 | −33.944 | 67.786 | −10.460 | 1.00 | 59.29 | O |
| ATOM | 3457 | N | PHE | A | 27 | −32.666 | 68.001 | −8.613 | 1.00 | 34.76 | N |
| ATOM | 3458 | CA | PHE | A | 27 | −31.536 | 67.198 | −9.082 | 1.00 | 36.25 | C |
| ATOM | 3459 | C | PHE | A | 27 | −30.495 | 67.347 | −8.004 | 1.00 | 35.91 | C |
| ATOM | 3460 | O | PHE | A | 27 | −30.163 | 68.473 | −7.622 | 1.00 | 41.91 | O |
| ATOM | 3461 | CB | PHE | A | 27 | −30.986 | 67.647 | −10.455 | 1.00 | 34.34 | C |
| ATOM | 3462 | CG | PHE | A | 27 | −29.671 | 66.974 | −10.868 | 1.00 | 35.77 | C |
| ATOM | 3463 | CD1 | PHE | A | 27 | −29.467 | 65.601 | −10.706 | 1.00 | 38.27 | C |
| ATOM | 3464 | CD2 | PHE | A | 27 | −28.645 | 67.728 | −11.455 | 1.00 | 39.96 | C |
| ATOM | 3465 | CE1 | PHE | A | 27 | −28.246 | 64.992 | −11.075 | 1.00 | 42.34 | C |
| ATOM | 3466 | CE2 | PHE | A | 27 | −27.422 | 67.132 | −11.848 | 1.00 | 39.02 | C |
| ATOM | 3467 | CZ | PHE | A | 27 | −27.221 | 65.758 | −11.651 | 1.00 | 37.64 | C |
| ATOM | 3468 | N | THR | A | 28 | −29.960 | 66.224 | −7.555 | 1.00 | 34.00 | N |
| ATOM | 3469 | CA | THR | A | 28 | −29.086 | 66.145 | −6.398 | 1.00 | 32.16 | C |
| ATOM | 3470 | C | THR | A | 28 | −28.160 | 67.347 | −6.297 | 1.00 | 32.73 | C |
| ATOM | 3471 | O | THR | A | 28 | −27.324 | 67.570 | −7.174 | 1.00 | 34.74 | O |
| ATOM | 3472 | CB | THR | A | 28 | −28.286 | 64.858 | −6.521 | 1.00 | 39.57 | C |
| ATOM | 3473 | OG1 | THR | A | 28 | −29.211 | 63.801 | −6.780 | 1.00 | 48.76 | O |
| ATOM | 3474 | CG2 | THR | A | 28 | −27.527 | 64.570 | −5.250 | 1.00 | 39.97 | C |
| ATOM | 3475 | N | PHE | A | 29 | −28.340 | 68.137 | −5.232 | 1.00 | 37.84 | N |
| ATOM | 3476 | CA | PHE | A | 29 | −27.545 | 69.348 | −5.012 | 1.00 | 34.13 | C |
| ATOM | 3477 | C | PHE | A | 29 | −26.050 | 69.063 | −5.057 | 1.00 | 35.71 | C |
| ATOM | 3478 | O | PHE | A | 29 | −25.277 | 69.821 | −5.666 | 1.00 | 31.39 | O |
| ATOM | 3479 | CB | PHE | A | 29 | −27.924 | 69.954 | −3.661 | 1.00 | 33.04 | C |
| ATOM | 3480 | CG | PHE | A | 29 | −27.217 | 71.251 | −3.309 | 1.00 | 29.10 | C |
| ATOM | 3481 | CD1 | PHE | A | 29 | −27.347 | 72.386 | −4.112 | 1.00 | 28.49 | C |
| ATOM | 3482 | CD2 | PHE | A | 29 | −26.505 | 71.364 | −2.117 | 1.00 | 30.52 | C |
| ATOM | 3483 | CE1 | PHE | A | 29 | −26.748 | 73.607 | −3.754 | 1.00 | 29.07 | C |
| ATOM | 3484 | CE2 | PHE | A | 29 | −25.893 | 72.592 | −1.755 | 1.00 | 33.69 | C |
| ATOM | 3485 | CZ | PHE | A | 29 | −26.023 | 73.707 | −2.578 | 1.00 | 27.96 | C |
| ATOM | 3486 | N | SER | A | 30 | −25.628 | 67.963 | −4.434 | 1.00 | 33.43 | N |
| ATOM | 3487 | CA | SER | A | 30 | −24.208 | 67.634 | −4.348 | 1.00 | 38.52 | C |
| ATOM | 3488 | C | SER | A | 30 | −23.621 | 67.208 | −5.682 | 1.00 | 33.12 | C |
| ATOM | 3489 | O | SER | A | 30 | −22.422 | 66.936 | −5.741 | 1.00 | 35.08 | O |
| ATOM | 3490 | CB | SER | A | 30 | −23.988 | 66.534 | −3.303 | 1.00 | 28.69 | C |
| ATOM | 3491 | OG | SER | A | 30 | −24.728 | 65.385 | −3.669 | 1.00 | 38.89 | O |
| ATOM | 3492 | N | SER | A | 31 | −24.419 | 67.147 | −6.740 | 1.00 | 27.16 | N |
| ATOM | 3493 | CA | SER | A | 31 | −23.905 | 66.778 | −8.045 | 1.00 | 38.98 | C |
| ATOM | 3494 | C | SER | A | 31 | −23.443 | 67.962 | −8.896 | 1.00 | 39.11 | C |
| ATOM | 3495 | O | SER | A | 31 | −23.036 | 67.740 | −10.050 | 1.00 | 33.54 | O |
| ATOM | 3496 | CB | SER | A | 31 | −24.944 | 65.966 | −8.806 | 1.00 | 31.50 | C |
| ATOM | 3497 | OG | SER | A | 31 | −25.034 | 64.689 | −8.205 | 1.00 | 43.55 | O |
| ATOM | 3498 | N | TYR | A | 32 | −23.469 | 69.194 | −8.377 | 1.00 | 30.49 | N |
| ATOM | 3499 | CA | TYR | A | 32 | −22.942 | 70.307 | −9.164 | 1.00 | 28.71 | C |
| ATOM | 3500 | C | TYR | A | 32 | −22.356 | 71.382 | −8.268 | 1.00 | 29.76 | C |
| ATOM | 3501 | O | TYR | A | 32 | −22.712 | 71.503 | −7.092 | 1.00 | 29.23 | O |
| ATOM | 3502 | CB | TYR | A | 32 | −24.002 | 70.910 | −10.078 | 1.00 | 34.80 | C |
| ATOM | 3503 | CG | TYR | A | 32 | −25.331 | 71.155 | −9.416 | 1.00 | 32.18 | C |
| ATOM | 3504 | CD1 | TYR | A | 32 | −25.549 | 72.299 | −8.660 | 1.00 | 33.21 | C |
| ATOM | 3505 | CD2 | TYR | A | 32 | −26.364 | 70.259 | −9.562 | 1.00 | 32.73 | C |
| ATOM | 3506 | CE1 | TYR | A | 32 | −26.770 | 72.536 | −8.050 | 1.00 | 37.14 | C |
| ATOM | 3507 | CE2 | TYR | A | 32 | −27.589 | 70.484 | −8.953 | 1.00 | 36.08 | C |
| ATOM | 3508 | CZ | TYR | A | 32 | −27.783 | 71.621 | −8.202 | 1.00 | 34.54 | C |
| ATOM | 3509 | OH | TYR | A | 32 | −28.995 | 71.854 | −7.605 | 1.00 | 42.41 | O |
| ATOM | 3510 | N | GLY | A | 33 | −21.391 | 72.118 | −8.828 | 1.00 | 29.06 | N |
| ATOM | 3511 | CA | GLY | A | 33 | −20.917 | 73.336 | −8.213 | 1.00 | 26.22 | C |
| ATOM | 3512 | C | GLY | A | 33 | −21.823 | 74.508 | −8.562 | 1.00 | 32.33 | C |
| ATOM | 3513 | O | GLY | A | 33 | −22.749 | 74.389 | −9.373 | 1.00 | 32.28 | O |
| ATOM | 3514 | N | LEU | A | 34 | −21.549 | 75.660 | −7.944 | 1.00 | 28.11 | N |
| ATOM | 3515 | CA | LEU | A | 34 | −22.397 | 76.825 | −8.149 | 1.00 | 28.06 | C |
| ATOM | 3516 | C | LEU | A | 34 | −21.579 | 78.107 | −8.137 | 1.00 | 32.81 | C |
| ATOM | 3517 | O | LEU | A | 34 | −20.482 | 78.185 | −7.562 | 1.00 | 30.26 | O |
| ATOM | 3518 | CB | LEU | A | 34 | −23.503 | 76.934 | −7.083 | 1.00 | 25.69 | C |
| ATOM | 3519 | CG | LEU | A | 34 | −24.496 | 75.772 | −7.075 | 1.00 | 29.24 | C |
| ATOM | 3520 | CD1 | LEU | A | 34 | −24.122 | 74.810 | −5.948 | 1.00 | 25.51 | C |
| ATOM | 3521 | CD2 | LEU | A | 34 | −25.937 | 76.248 | −6.951 | 1.00 | 28.69 | C |
| ATOM | 3522 | N | HIS | A | 35 | −22.174 | 79.124 | −8.757 | 1.00 | 25.76 | N |
| ATOM | 3523 | CA | HIS | A | 35 | −21.645 | 80.469 | −8.877 | 1.00 | 28.30 | C |
| ATOM | 3524 | C | HIS | A | 35 | −22.559 | 81.459 | −8.167 | 1.00 | 28.45 | C |
| ATOM | 3525 | O | HIS | A | 35 | −23.771 | 81.255 | −8.047 | 1.00 | 26.56 | O |
| ATOM | 3526 | CB | HIS | A | 35 | −21.583 | 80.946 | −10.334 | 1.00 | 27.75 | C |
| ATOM | 3527 | CG | HIS | A | 35 | −20.599 | 80.236 | −11.204 | 1.00 | 34.48 | C |
| ATOM | 3528 | ND1 | HIS | A | 35 | −19.305 | 80.689 | −11.377 | 1.00 | 31.96 | N |
| ATOM | 3529 | CD2 | HIS | A | 35 | −20.742 | 79.174 | −12.034 | 1.00 | 27.73 | C |
| ATOM | 3530 | CE1 | HIS | A | 35 | −18.693 | 79.927 | −12.263 | 1.00 | 30.71 | C |
| ATOM | 3531 | NE2 | HIS | A | 35 | −19.537 | 78.989 | −12.664 | 1.00 | 32.82 | N |
| ATOM | 3532 | N | TRP | A | 36 | −21.971 | 82.583 | −7.793 | 1.00 | 24.52 | N |
| ATOM | 3533 | CA | TRP | A | 36 | −22.702 | 83.815 | −7.578 | 1.00 | 24.53 | C |
| ATOM | 3534 | C | TRP | A | 36 | −22.276 | 84.804 | −8.656 | 1.00 | 30.64 | C |
| ATOM | 3535 | O | TRP | A | 36 | −21.078 | 84.979 | −8.895 | 1.00 | 31.45 | O |

TABLE 10.3-continued

| ATOM | 3536 | CB | TRP | A | 36 | −22.431 | 84.389 | −6.184 | 1.00 | 25.38 | C |
|---|---|---|---|---|---|---|---|---|---|---|---|
| ATOM | 3537 | CG | TRP | A | 36 | −23.102 | 83.636 | −5.061 | 1.00 | 34.21 | C |
| ATOM | 3538 | CD1 | TRP | A | 36 | −22.528 | 82.700 | −4.225 | 1.00 | 27.01 | C |
| ATOM | 3539 | CD2 | TRP | A | 36 | −24.483 | 83.734 | −4.662 | 1.00 | 29.26 | C |
| ATOM | 3540 | NE1 | TRP | A | 36 | −23.464 | 82.236 | −3.328 | 1.00 | 29.61 | N |
| ATOM | 3541 | CE2 | TRP | A | 36 | −24.669 | 82.850 | −3.574 | 1.00 | 29.15 | C |
| ATOM | 3542 | CE3 | TRP | A | 36 | −25.569 | 84.500 | −5.104 | 1.00 | 31.70 | C |
| ATOM | 3543 | CZ2 | TRP | A | 36 | −25.902 | 82.707 | −2.925 | 1.00 | 29.62 | C |
| ATOM | 3544 | CZ3 | TRP | A | 36 | −26.795 | 84.353 | −4.464 | 1.00 | 31.58 | C |
| ATOM | 3545 | CH2 | TRP | A | 36 | −26.950 | 83.447 | −3.390 | 1.00 | 32.02 | C |
| ATOM | 3546 | N | VAL | A | 37 | −23.255 | 85.430 | −9.315 | 1.00 | 26.17 | N |
| ATOM | 3547 | CA | VAL | A | 37 | −23.052 | 86.487 | −10.305 | 1.00 | 26.93 | C |
| ATOM | 3548 | C | VAL | A | 37 | −23.911 | 87.683 | −9.909 | 1.00 | 31.18 | C |
| ATOM | 3549 | O | VAL | A | 37 | −24.979 | 87.514 | −9.311 | 1.00 | 32.57 | O |
| ATOM | 3550 | CB | VAL | A | 37 | −23.436 | 86.003 | −11.725 | 1.00 | 30.07 | C |
| ATOM | 3551 | CG1 | VAL | A | 37 | −23.336 | 87.141 | −12.741 | 1.00 | 25.17 | C |
| ATOM | 3552 | CG2 | VAL | A | 37 | −22.577 | 84.797 | −12.141 | 1.00 | 27.92 | C |
| ATOM | 3553 | N | ARG | A | 38 | −23.451 | 88.900 | −10.217 | 1.00 | 26.83 | N |
| ATOM | 3554 | CA | ARG | A | 38 | −24.222 | 90.086 | −9.838 | 1.00 | 28.59 | C |
| ATOM | 3555 | C | ARG | A | 38 | −24.327 | 91.074 | −10.987 | 1.00 | 32.00 | C |
| ATOM | 3556 | O | ARG | A | 38 | −23.546 | 91.042 | −11.942 | 1.00 | 34.12 | O |
| ATOM | 3557 | CB | ARG | A | 38 | −23.649 | 90.790 | −8.616 | 1.00 | 24.52 | C |
| ATOM | 3558 | CG | ARG | A | 38 | −22.405 | 91.581 | −8.863 | 1.00 | 27.87 | C |
| ATOM | 3559 | CD | ARG | A | 38 | −21.832 | 92.016 | −7.532 | 1.00 | 25.42 | C |
| ATOM | 3560 | NE | ARG | A | 38 | −20.569 | 92.691 | −7.719 | 1.00 | 26.21 | N |
| ATOM | 3561 | CZ | ARG | A | 38 | −19.825 | 93.186 | −6.735 | 1.00 | 33.88 | C |
| ATOM | 3562 | NH1 | ARG | A | 38 | −20.207 | 93.058 | −5.470 | 1.00 | 31.46 | N1+ |
| ATOM | 3563 | NH2 | ARG | A | 38 | −18.700 | 93.822 | −7.026 | 1.00 | 27.28 | N |
| ATOM | 3564 | N | GLN | A | 39 | −25.317 | 91.961 | −10.874 | 1.00 | 31.14 | N |
| ATOM | 3565 | CA | GLN | A | 39 | −25.594 | 92.942 | −11.923 | 1.00 | 26.67 | C |
| ATOM | 3566 | C | GLN | A | 39 | −26.067 | 94.237 | −11.278 | 1.00 | 33.37 | C |
| ATOM | 3567 | O | GLN | A | 39 | −27.144 | 94.282 | −10.657 | 1.00 | 30.44 | O |
| ATOM | 3568 | CB | GLN | A | 39 | −26.635 | 92.419 | −12.901 | 1.00 | 29.71 | C |
| ATOM | 3569 | CG | GLN | A | 39 | −26.977 | 93.391 | −14.031 | 1.00 | 30.87 | C |
| ATOM | 3570 | CD | GLN | A | 39 | −27.797 | 92.710 | −15.108 | 1.00 | 35.35 | C |
| ATOM | 3571 | OE1 | GLN | A | 39 | −28.796 | 92.048 | −14.812 | 1.00 | 37.94 | O |
| ATOM | 3572 | NE2 | GLN | A | 39 | −27.370 | 92.841 | −16.358 | 1.00 | 26.92 | N |
| ATOM | 3573 | N | ALA | A | 40 | −25.269 | 95.279 | −11.425 | 1.00 | 28.05 | N |
| ATOM | 3574 | CA | ALA | A | 40 | −25.664 | 96.588 | −10.926 | 1.00 | 34.65 | C |
| ATOM | 3575 | C | ALA | A | 40 | −26.709 | 97.199 | −11.859 | 1.00 | 34.83 | C |
| ATOM | 3576 | O | ALA | A | 40 | −26.757 | 96.861 | −13.039 | 1.00 | 32.60 | O |
| ATOM | 3577 | CB | ALA | A | 40 | −24.443 | 97.499 | −10.812 | 1.00 | 29.23 | C |
| ATOM | 3578 | N | PRO | A | 41 | −27.556 | 98.095 | −11.352 | 1.00 | 41.70 | N |
| ATOM | 3579 | CA | PRO | A | 41 | −28.654 | 98.645 | −12.175 | 1.00 | 37.62 | C |
| ATOM | 3580 | C | PRO | A | 41 | −28.143 | 99.327 | −13.440 | 1.00 | 38.87 | C |
| ATOM | 3581 | O | PRO | A | 41 | −27.259 | 100.188 | −13.392 | 1.00 | 37.58 | O |
| ATOM | 3582 | CB | PRO | A | 41 | −29.330 | 99.656 | −11.236 | 1.00 | 34.86 | C |
| ATOM | 3583 | CG | PRO | A | 41 | −28.936 | 99.229 | −9.859 | 1.00 | 40.20 | C |
| ATOM | 3584 | CD | PRO | A | 41 | −27.557 | 98.641 | −9.983 | 1.00 | 35.94 | C |
| ATOM | 3585 | N | GLY | A | 42 | −28.698 | 98.918 | −14.578 | 1.00 | 36.04 | N |
| ATOM | 3586 | CA | GLY | A | 42 | −28.295 | 99.408 | −15.887 | 1.00 | 32.92 | C |
| ATOM | 3587 | C | GLY | A | 42 | −26.969 | 98.887 | −16.429 | 1.00 | 42.89 | C |
| ATOM | 3588 | O | GLY | A | 42 | −26.492 | 99.395 | −17.446 | 1.00 | 48.01 | O |
| ATOM | 3589 | N | LYS | A | 43 | −26.358 | 97.882 | −15.817 | 1.00 | 37.13 | N |
| ATOM | 3590 | CA | LYS | A | 43 | −25.003 | 97.473 | −16.196 | 1.00 | 39.84 | C |
| ATOM | 3591 | C | LYS | A | 43 | −24.961 | 95.989 | −16.548 | 1.00 | 36.76 | C |
| ATOM | 3592 | O | LYS | A | 43 | −25.989 | 95.301 | −16.591 | 1.00 | 33.65 | O |
| ATOM | 3593 | CB | LYS | A | 43 | −24.004 | 97.816 | −15.094 | 1.00 | 35.22 | C |
| ATOM | 3594 | CG | LYS | A | 43 | −23.960 | 99.326 | −14.833 | 1.00 | 42.47 | C |
| ATOM | 3595 | CD | LYS | A | 43 | −22.804 | 99.688 | −13.941 | 1.00 | 57.71 | C |
| ATOM | 3596 | CE | LYS | A | 43 | −22.589 | 101.201 | −13.864 | 1.00 | 72.06 | C |
| ATOM | 3597 | NZ | LYS | A | 43 | −21.339 | 101.531 | −13.103 | 1.00 | 70.64 | N1+ |
| ATOM | 3598 | N | GLY | A | 44 | −23.743 | 95.520 | −16.834 | 1.00 | 31.12 | N |
| ATOM | 3599 | CA | GLY | A | 44 | −23.510 | 94.165 | −17.290 | 1.00 | 28.92 | C |
| ATOM | 3600 | C | GLY | A | 44 | −23.333 | 93.158 | −16.166 | 1.00 | 33.92 | C |
| ATOM | 3601 | O | GLY | A | 44 | −23.295 | 93.484 | −14.979 | 1.00 | 35.65 | O |
| ATOM | 3602 | N | LEU | A | 45 | −23.202 | 91.898 | −16.569 | 1.00 | 31.47 | N |
| ATOM | 3603 | CA | LEU | A | 45 | −22.959 | 90.839 | −15.606 | 1.00 | 26.60 | C |
| ATOM | 3604 | C | LEU | A | 45 | −21.542 | 90.959 | −15.072 | 1.00 | 31.15 | C |
| ATOM | 3605 | O | LEU | A | 45 | −20.601 | 91.246 | −15.820 | 1.00 | 31.96 | O |
| ATOM | 3606 | CB | LEU | A | 45 | −23.173 | 89.462 | −16.256 | 1.00 | 28.04 | C |
| ATOM | 3607 | CG | LEU | A | 45 | −24.575 | 89.294 | −16.881 | 1.00 | 33.18 | C |
| ATOM | 3608 | CD1 | LEU | A | 45 | −24.804 | 87.921 | −17.544 | 1.00 | 29.82 | C |
| ATOM | 3609 | CD2 | LEU | A | 45 | −25.639 | 89.585 | −15.859 | 1.00 | 27.89 | C |
| ATOM | 3610 | N | GLU | A | 46 | −21.397 | 90.735 | −13.767 | 1.00 | 30.38 | N |
| ATOM | 3611 | CA | GLU | A | 46 | −20.101 | 90.660 | −13.112 | 1.00 | 31.96 | C |
| ATOM | 3612 | C | GLU | A | 46 | −20.049 | 89.376 | −12.306 | 1.00 | 28.71 | C |
| ATOM | 3613 | O | GLU | A | 46 | −20.899 | 89.156 | −11.440 | 1.00 | 28.54 | O |
| ATOM | 3614 | CB | GLU | A | 46 | −19.854 | 91.859 | −12.196 | 1.00 | 30.82 | C |
| ATOM | 3615 | CG | GLU | A | 46 | −18.411 | 91.886 | −11.708 | 1.00 | 35.43 | C |

TABLE 10.3-continued

| | | | | | | | | | |
|---|---|---|---|---|---|---|---|---|---|
| ATOM | 3616 | CD | GLU | A | 46 | −18.145 | 92.863 | −10.551 | 1.00 | 42.19 | C |
| ATOM | 3617 | OE1 | GLU | A | 46 | −19.076 | 93.544 | −10.038 | 1.00 | 34.18 | O |
| ATOM | 3618 | OE2 | GLU | A | 46 | −16.968 | 92.932 | −10.154 | 1.00 | 46.04 | O1− |
| ATOM | 3619 | N | TRP | A | 47 | −19.052 | 88.537 | −12.584 | 1.00 | 28.91 | N |
| ATOM | 3620 | CA | TRP | A | 47 | −18.888 | 87.300 | −11.834 | 1.00 | 28.05 | C |
| ATOM | 3621 | C | TRP | A | 47 | −18.433 | 87.610 | −10.414 | 1.00 | 28.38 | C |
| ATOM | 3622 | O | TRP | A | 47 | −17.652 | 88.534 | −10.199 | 1.00 | 29.03 | O |
| ATOM | 3623 | CB | TRP | A | 47 | −17.882 | 86.396 | −12.547 | 1.00 | 28.79 | C |
| ATOM | 3624 | CG | TRP | A | 47 | −17.570 | 85.150 | −11.808 | 1.00 | 27.80 | C |
| ATOM | 3625 | CD1 | TRP | A | 47 | −18.396 | 84.090 | −11.618 | 1.00 | 26.75 | C |
| ATOM | 3626 | CD2 | TRP | A | 47 | −16.330 | 84.810 | −11.186 | 1.00 | 29.28 | C |
| ATOM | 3627 | NE1 | TRP | A | 47 | −17.759 | 83.119 | −10.900 | 1.00 | 30.04 | N |
| ATOM | 3628 | CE2 | TRP | A | 47 | −16.487 | 83.529 | −10.623 | 1.00 | 26.53 | C |
| ATOM | 3629 | CE3 | TRP | A | 47 | −15.093 | 85.455 | −11.067 | 1.00 | 30.37 | C |
| ATOM | 3630 | CZ2 | TRP | A | 47 | −15.454 | 82.870 | −9.945 | 1.00 | 30.41 | C |
| ATOM | 3631 | CZ3 | TRP | A | 47 | −14.058 | 84.797 | −10.376 | 1.00 | 27.15 | C |
| ATOM | 3632 | CH2 | TRP | A | 47 | −14.251 | 83.527 | −9.832 | 1.00 | 30.81 | C |
| ATOM | 3633 | N | VAL | A | 48 | −18.923 | 86.836 | −9.441 | 1.00 | 26.85 | N |
| ATOM | 3634 | CA | VAL | A | 48 | −18.590 | 87.031 | −8.026 | 1.00 | 26.22 | C |
| ATOM | 3635 | C | VAL | A | 48 | −17.740 | 85.890 | −7.475 | 1.00 | 27.91 | C |
| ATOM | 3636 | O | VAL | A | 48 | −16.641 | 86.118 | −6.962 | 1.00 | 31.20 | O |
| ATOM | 3637 | CB | VAL | A | 48 | −19.858 | 87.245 | −7.171 | 1.00 | 29.89 | C |
| ATOM | 3638 | CG1 | VAL | A | 48 | −19.465 | 87.415 | −5.709 | 1.00 | 27.30 | C |
| ATOM | 3639 | CG2 | VAL | A | 48 | −20.640 | 88.465 | −7.680 | 1.00 | 27.25 | C |
| ATOM | 3640 | N | ALA | A | 49 | −18.234 | 84.656 | −7.552 | 1.00 | 27.92 | N |
| ATOM | 3641 | CA | ALA | A | 49 | −17.498 | 83.540 | −6.964 | 1.00 | 27.21 | C |
| ATOM | 3642 | C | ALA | A | 49 | −18.028 | 82.240 | −7.528 | 1.00 | 29.25 | C |
| ATOM | 3643 | O | ALA | A | 49 | −19.155 | 82.178 | −8.025 | 1.00 | 29.04 | O |
| ATOM | 3644 | CB | ALA | A | 49 | −17.590 | 83.500 | −5.429 | 1.00 | 22.18 | C |
| ATOM | 3645 | N | VAL | A | 50 | −17.187 | 81.190 | −7.435 | 1.00 | 25.65 | N |
| ATOM | 3646 | CA | VAL | A | 50 | −17.592 | 79.835 | −7.777 | 1.00 | 25.46 | C |
| ATOM | 3647 | C | VAL | A | 50 | −17.129 | 78.894 | −6.678 | 1.00 | 28.11 | C |
| ATOM | 3648 | O | VAL | A | 50 | −16.137 | 79.144 | −5.988 | 1.00 | 30.11 | O |
| ATOM | 3649 | CB | VAL | A | 50 | −17.068 | 79.380 | −9.162 | 1.00 | 31.87 | C |
| ATOM | 3650 | CG1 | VAL | A | 50 | −15.561 | 79.238 | −9.175 | 1.00 | 28.23 | C |
| ATOM | 3651 | CG2 | VAL | A | 50 | −17.767 | 78.084 | −9.606 | 1.00 | 28.82 | C |
| ATOM | 3652 | N | ILE | A | 51 | −17.884 | 77.821 | −6.484 | 1.00 | 29.93 | N |
| ATOM | 3653 | CA | ILE | A | 51 | −17.514 | 76.799 | −5.522 | 1.00 | 25.88 | C |
| ATOM | 3654 | C | ILE | A | 51 | −17.657 | 75.447 | −6.203 | 1.00 | 26.86 | C |
| ATOM | 3655 | O | ILE | A | 51 | −18.486 | 75.262 | −7.100 | 1.00 | 26.48 | O |
| ATOM | 3656 | CB | ILE | A | 51 | −18.354 | 76.879 | −4.227 | 1.00 | 28.38 | C |
| ATOM | 3657 | CG1 | ILE | A | 51 | −17.776 | 75.932 | −3.163 | 1.00 | 29.68 | C |
| ATOM | 3658 | CG2 | ILE | A | 51 | −19.831 | 76.565 | −4.498 | 1.00 | 23.38 | C |
| ATOM | 3659 | CD1 | ILE | A | 51 | −18.344 | 76.180 | −1.775 | 1.00 | 28.59 | C |
| ATOM | 3660 | N | TRP | A | 52 | −16.821 | 74.510 | −5.793 | 1.00 | 24.08 | N |
| ATOM | 3661 | CA | TRP | A | 52 | −16.856 | 73.188 | −6.392 | 1.00 | 28.60 | C |
| ATOM | 3662 | C | TRP | A | 52 | −18.074 | 72.397 | −5.899 | 1.00 | 30.88 | C |
| ATOM | 3663 | O | TRP | A | 52 | −18.688 | 72.722 | −4.879 | 1.00 | 26.43 | O |
| ATOM | 3664 | CB | TRP | A | 52 | −15.559 | 72.452 | −6.066 | 1.00 | 30.05 | C |
| ATOM | 3665 | CG | TRP | A | 52 | −14.821 | 71.992 | −7.256 | 1.00 | 31.59 | C |
| ATOM | 3666 | CD1 | TRP | A | 52 | −14.551 | 70.701 | −7.601 | 1.00 | 34.80 | C |
| ATOM | 3667 | CD2 | TRP | A | 52 | −14.265 | 72.811 | −8.293 | 1.00 | 30.63 | C |
| ATOM | 3668 | NE1 | TRP | A | 52 | −13.842 | 70.664 | −8.781 | 1.00 | 33.66 | N |
| ATOM | 3669 | CE2 | TRP | A | 52 | −13.652 | 71.942 | −9.228 | 1.00 | 31.14 | C |
| ATOM | 3670 | CE3 | TRP | A | 52 | −14.220 | 74.183 | −8.522 | 1.00 | 28.98 | C |
| ATOM | 3671 | CZ2 | TRP | A | 52 | −12.999 | 72.404 | −10.368 | 1.00 | 30.12 | C |
| ATOM | 3672 | CZ3 | TRP | A | 52 | −13.564 | 74.646 | −9.663 | 1.00 | 37.05 | C |
| ATOM | 3673 | CH2 | TRP | A | 52 | −12.953 | 73.756 | −10.562 | 1.00 | 36.23 | C |
| ATOM | 3674 | N | TYR | A | 53 | −18.401 | 71.330 | −6.635 | 1.00 | 28.62 | N |
| ATOM | 3675 | CA | TYR | A | 53 | −19.539 | 70.484 | −6.281 | 1.00 | 31.01 | C |
| ATOM | 3676 | C | TYR | A | 53 | −19.373 | 69.846 | −4.909 | 1.00 | 36.12 | C |
| ATOM | 3677 | O | TYR | A | 53 | −20.370 | 69.557 | −4.240 | 1.00 | 36.43 | O |
| ATOM | 3678 | CB | TYR | A | 53 | −19.743 | 69.393 | −7.329 | 1.00 | 31.97 | C |
| ATOM | 3679 | CG | TYR | A | 53 | −18.458 | 68.713 | −7.742 | 1.00 | 35.13 | C |
| ATOM | 3680 | CD1 | TYR | A | 53 | −17.918 | 67.672 | −6.989 | 1.00 | 37.05 | C |
| ATOM | 3681 | CD2 | TYR | A | 53 | −17.791 | 69.104 | −8.896 | 1.00 | 37.33 | C |
| ATOM | 3682 | CE1 | TYR | A | 53 | −16.755 | 67.058 | −7.366 | 1.00 | 36.11 | C |
| ATOM | 3683 | CE2 | TYR | A | 53 | −16.614 | 68.492 | −9.286 | 1.00 | 40.57 | C |
| ATOM | 3684 | CZ | TYR | A | 53 | −16.095 | 67.479 | −8.521 | 1.00 | 40.64 | C |
| ATOM | 3685 | OH | TYR | A | 53 | −14.916 | 66.886 | −8.923 | 1.00 | 51.83 | O |
| ATOM | 3686 | N | ASP | A | 54 | −18.136 | 69.613 | −4.468 | 1.00 | 31.86 | N |
| ATOM | 3687 | CA | ASP | A | 54 | −17.896 | 69.044 | −3.150 | 1.00 | 32.47 | C |
| ATOM | 3688 | C | ASP | A | 54 | −17.433 | 70.090 | −2.141 | 1.00 | 32.55 | C |
| ATOM | 3689 | O | ASP | A | 54 | −16.894 | 69.732 | −1.097 | 1.00 | 34.26 | O |
| ATOM | 3690 | CB | ASP | A | 54 | −16.882 | 67.901 | −3.245 | 1.00 | 33.69 | C |
| ATOM | 3691 | CG | ASP | A | 54 | −15.550 | 68.344 | −3.878 | 1.00 | 41.63 | C |
| ATOM | 3692 | OD1 | ASP | A | 54 | −15.332 | 69.574 | −4.029 | 1.00 | 35.39 | O |
| ATOM | 3693 | OD2 | ASP | A | 54 | −14.721 | 67.462 | −4.224 | 1.00 | 41.66 | O1− |
| ATOM | 3694 | N | GLY | A | 55 | −17.633 | 71.376 | −2.428 | 1.00 | 35.34 | N |
| ATOM | 3695 | CA | GLY | A | 55 | −17.197 | 72.416 | −1.516 | 1.00 | 28.60 | C |

TABLE 10.3-continued

| ATOM | 3696 | C | GLY | A | 55 | −15.696 | 72.626 | −1.397 | 1.00 | 30.85 | C |
|---|---|---|---|---|---|---|---|---|---|---|---|
| ATOM | 3697 | O | GLY | A | 55 | −15.261 | 73.340 | −0.483 | 1.00 | 31.85 | O |
| ATOM | 3698 | N | SER | A | 56 | −14.880 | 72.030 | −2.271 | 1.00 | 31.41 | N |
| ATOM | 3699 | CA | SER | A | 56 | −13.427 | 72.159 | −2.138 | 1.00 | 28.55 | C |
| ATOM | 3700 | C | SER | A | 56 | −12.921 | 73.456 | −2.773 | 1.00 | 29.96 | C |
| ATOM | 3701 | O | SER | A | 56 | −12.790 | 74.463 | −2.071 | 1.00 | 35.87 | O |
| ATOM | 3702 | CB | SER | A | 56 | −12.716 | 70.922 | −2.715 | 1.00 | 29.73 | C |
| ATOM | 3703 | OG | SER | A | 56 | −13.055 | 70.688 | −4.069 | 1.00 | 33.14 | O |
| ATOM | 3704 | N | ASN | A | 57 | −12.648 | 73.468 | −4.080 | 1.00 | 27.89 | N |
| ATOM | 3705 | CA | ASN | A | 57 | −12.094 | 74.669 | −4.708 | 1.00 | 30.78 | C |
| ATOM | 3706 | C | ASN | A | 57 | −13.090 | 75.836 | −4.663 | 1.00 | 34.96 | C |
| ATOM | 3707 | O | ASN | A | 57 | −14.296 | 75.655 | −4.883 | 1.00 | 29.93 | O |
| ATOM | 3708 | CB | ASN | A | 57 | −11.712 | 74.392 | −6.167 | 1.00 | 28.41 | C |
| ATOM | 3709 | CG | ASN | A | 57 | −10.430 | 73.551 | −6.316 | 1.00 | 36.02 | C |
| ATOM | 3710 | OD1 | ASN | A | 57 | −10.034 | 72.789 | −5.427 | 1.00 | 31.33 | O |
| ATOM | 3711 | ND2 | ASN | A | 57 | −9.779 | 73.703 | −7.462 | 1.00 | 33.91 | N |
| ATOM | 3712 | N | LYS | A | 58 | −12.562 | 77.042 | −4.418 | 1.00 | 30.71 | N |
| ATOM | 3713 | CA | LYS | A | 58 | −13.307 | 78.299 | −4.384 | 1.00 | 31.44 | C |
| ATOM | 3714 | C | LYS | A | 58 | −12.504 | 79.356 | −5.117 | 1.00 | 31.50 | C |
| ATOM | 3715 | O | LYS | A | 58 | −11.306 | 79.491 | −4.858 | 1.00 | 35.00 | O |
| ATOM | 3716 | CB | LYS | A | 58 | −13.541 | 78.796 | −2.953 | 1.00 | 28.26 | C |
| ATOM | 3717 | CG | LYS | A | 58 | −14.308 | 77.853 | −2.071 | 1.00 | 32.31 | C |
| ATOM | 3718 | CD | LYS | A | 58 | −14.359 | 78.350 | −0.623 | 1.00 | 29.79 | C |
| ATOM | 3719 | CE | LYS | A | 58 | −15.146 | 77.337 | 0.247 | 1.00 | 31.84 | C |
| ATOM | 3720 | NZ | LYS | A | 58 | −15.624 | 77.954 | 1.523 | 1.00 | 28.78 | N1+ |
| ATOM | 3721 | N | TYR | A | 59 | −13.143 | 80.105 | −6.025 | 1.00 | 31.81 | N |
| ATOM | 3722 | CA | TYR | A | 59 | −12.489 | 81.224 | −6.704 | 1.00 | 29.74 | C |
| ATOM | 3723 | C | TYR | A | 59 | −13.349 | 82.463 | −6.543 | 1.00 | 31.86 | C |
| ATOM | 3724 | O | TYR | A | 59 | −14.581 | 82.379 | −6.491 | 1.00 | 36.21 | O |
| ATOM | 3725 | CB | TYR | A | 59 | −12.258 | 80.990 | −8.212 | 1.00 | 35.36 | C |
| ATOM | 3726 | CG | TYR | A | 59 | −11.620 | 79.662 | −8.593 | 1.00 | 35.36 | C |
| ATOM | 3727 | CD1 | TYR | A | 59 | −10.873 | 78.936 | −7.693 | 1.00 | 49.05 | C |
| ATOM | 3728 | CD2 | TYR | A | 59 | −11.776 | 79.141 | −9.849 | 1.00 | 46.01 | C |
| ATOM | 3729 | CE1 | TYR | A | 59 | −10.317 | 77.708 | −8.033 | 1.00 | 56.82 | C |
| ATOM | 3730 | CE2 | TYR | A | 59 | −11.212 | 77.925 | −10.198 | 1.00 | 50.42 | C |
| ATOM | 3731 | CZ | TYR | A | 59 | −10.494 | 77.215 | −9.292 | 1.00 | 45.11 | C |
| ATOM | 3732 | OH | TYR | A | 59 | −9.945 | 76.014 | −9.656 | 1.00 | 44.41 | O |
| ATOM | 3733 | N | TYR | A | 60 | −12.706 | 83.617 | −6.491 | 1.00 | 28.31 | N |
| ATOM | 3734 | CA | TYR | A | 60 | −13.418 | 84.868 | −6.277 | 1.00 | 31.56 | C |
| ATOM | 3735 | C | TYR | A | 60 | −12.950 | 85.928 | −7.263 | 1.00 | 33.13 | C |
| ATOM | 3736 | O | TYR | A | 60 | −11.782 | 85.963 | −7.657 | 1.00 | 36.90 | O |
| ATOM | 3737 | CB | TYR | A | 60 | −13.221 | 85.407 | −4.884 | 1.00 | 26.95 | C |
| ATOM | 3738 | CG | TYR | A | 60 | −13.706 | 84.522 | −3.780 | 1.00 | 31.53 | C |
| ATOM | 3739 | CD1 | TYR | A | 60 | −12.877 | 83.520 | −3.249 | 1.00 | 34.43 | C |
| ATOM | 3740 | CD2 | TYR | A | 60 | −14.958 | 84.703 | −3.225 | 1.00 | 29.79 | C |
| ATOM | 3741 | CE1 | TYR | A | 60 | −13.308 | 82.707 | −2.215 | 1.00 | 28.05 | C |
| ATOM | 3742 | CE2 | TYR | A | 60 | −15.400 | 83.896 | −2.183 | 1.00 | 32.79 | C |
| ATOM | 3743 | CZ | TYR | A | 60 | −14.567 | 82.900 | −1.679 | 1.00 | 33.02 | C |
| ATOM | 3744 | OH | TYR | A | 60 | −14.995 | 82.098 | −0.641 | 1.00 | 31.57 | O |
| ATOM | 3745 | N | ALA | A | 61 | −13.872 | 86.804 | −7.650 | 1.00 | 23.00 | N |
| ATOM | 3746 | CA | ALA | A | 61 | −13.464 | 87.976 | −8.406 | 1.00 | 28.65 | C |
| ATOM | 3747 | C | ALA | A | 61 | −12.612 | 88.888 | −7.526 | 1.00 | 32.06 | C |
| ATOM | 3748 | O | ALA | A | 61 | −12.759 | 88.923 | −6.301 | 1.00 | 30.34 | O |
| ATOM | 3749 | CB | ALA | A | 61 | −14.679 | 88.736 | −8.937 | 1.00 | 25.89 | C |
| ATOM | 3750 | N | ASP | A | 62 | −11.713 | 89.633 | −8.171 | 1.00 | 32.65 | N |
| ATOM | 3751 | CA | ASP | A | 62 | −10.805 | 90.522 | −7.445 | 1.00 | 32.02 | C |
| ATOM | 3752 | C | ASP | A | 62 | −11.551 | 91.559 | −6.605 | 1.00 | 31.30 | C |
| ATOM | 3753 | O | ASP | A | 62 | −11.125 | 91.882 | −5.492 | 1.00 | 33.95 | O |
| ATOM | 3754 | CB | ASP | A | 62 | −9.856 | 91.208 | −8.428 | 1.00 | 30.42 | C |
| ATOM | 3755 | CG | ASP | A | 62 | −8.574 | 90.404 | −8.671 | 1.00 | 42.21 | C |
| ATOM | 3756 | OD1 | ASP | A | 62 | −8.521 | 89.196 | −8.308 | 1.00 | 50.07 | O |
| ATOM | 3757 | OD2 | ASP | A | 62 | −7.625 | 90.972 | −9.257 | 1.00 | 56.07 | O1− |
| ATOM | 3758 | N | SER | A | 63 | −12.672 | 92.082 | −7.106 | 1.00 | 28.74 | N |
| ATOM | 3759 | CA | SER | A | 63 | −13.409 | 93.118 | −6.383 | 1.00 | 32.42 | C |
| ATOM | 3760 | C | SER | A | 63 | −13.980 | 92.646 | −5.048 | 1.00 | 39.97 | C |
| ATOM | 3761 | O | SER | A | 63 | −14.490 | 93.477 | −4.280 | 1.00 | 38.00 | O |
| ATOM | 3762 | CB | SER | A | 63 | −14.542 | 93.641 | −7.263 | 1.00 | 35.16 | C |
| ATOM | 3763 | OG | SER | A | 63 | −15.314 | 92.561 | −7.747 | 1.00 | 42.20 | O |
| ATOM | 3764 | N | VAL | A | 64 | −13.865 | 91.356 | −4.740 | 1.00 | 33.69 | N |
| ATOM | 3765 | CA | VAL | A | 64 | −14.600 | 90.717 | −3.663 | 1.00 | 31.03 | C |
| ATOM | 3766 | C | VAL | A | 64 | −13.681 | 89.860 | −2.780 | 1.00 | 35.18 | C |
| ATOM | 3767 | O | VAL | A | 64 | −14.040 | 89.490 | −1.651 | 1.00 | 33.73 | O |
| ATOM | 3768 | CB | VAL | A | 64 | −15.740 | 89.918 | −4.330 | 1.00 | 34.61 | C |
| ATOM | 3769 | CG1 | VAL | A | 64 | −15.732 | 88.417 | −4.001 | 1.00 | 22.27 | C |
| ATOM | 3770 | CG2 | VAL | A | 64 | −17.031 | 90.609 | −4.115 | 1.00 | 28.14 | C |
| ATOM | 3771 | N | LYS | A | 65 | −12.476 | 89.566 | −3.273 | 1.00 | 30.69 | N |
| ATOM | 3772 | CA | LYS | A | 65 | −11.498 | 88.785 | −2.511 | 1.00 | 32.30 | C |
| ATOM | 3773 | C | LYS | A | 65 | −11.300 | 89.377 | −1.126 | 1.00 | 35.92 | C |
| ATOM | 3774 | O | LYS | A | 65 | −11.119 | 90.590 | −0.975 | 1.00 | 37.34 | O |
| ATOM | 3775 | CB | LYS | A | 65 | −10.155 | 88.769 | −3.242 | 1.00 | 31.37 | C |

TABLE 10.3-continued

| ATOM | 3776 | CG | LYS | A | 65 | −10.056 | 87.772 | −4.365 | 1.00 | 35.93 | C |
|---|---|---|---|---|---|---|---|---|---|---|---|
| ATOM | 3777 | CD | LYS | A | 65 | −8.637 | 87.667 | −4.881 | 1.00 | 39.14 | C |
| ATOM | 3778 | CE | LYS | A | 65 | −8.443 | 86.411 | −5.742 | 1.00 | 40.69 | C |
| ATOM | 3779 | NZ | LYS | A | 65 | −9.097 | 86.500 | −7.077 | 1.00 | 44.27 | N1+ |
| ATOM | 3780 | N | GLY | A | 66 | −11.300 | 88.509 | −0.118 | 1.00 | 36.76 | N |
| ATOM | 3781 | CA | GLY | A | 66 | −11.109 | 88.926 | 1.249 | 1.00 | 34.77 | C |
| ATOM | 3782 | C | GLY | A | 66 | −12.355 | 89.409 | 1.957 | 1.00 | 37.43 | C |
| ATOM | 3783 | O | GLY | A | 66 | −12.361 | 89.462 | 3.185 | 1.00 | 43.41 | O |
| ATOM | 3784 | N | ARG | A | 67 | −13.407 | 89.779 | 1.231 | 1.00 | 37.34 | N |
| ATOM | 3785 | CA | ARG | A | 67 | −14.630 | 90.281 | 1.849 | 1.00 | 34.16 | C |
| ATOM | 3786 | C | ARG | A | 67 | −15.789 | 89.302 | 1.783 | 1.00 | 32.20 | C |
| ATOM | 3787 | O | ARG | A | 67 | −16.554 | 89.208 | 2.745 | 1.00 | 35.10 | O |
| ATOM | 3788 | CB | ARG | A | 67 | −15.047 | 91.609 | 1.199 | 1.00 | 28.81 | C |
| ATOM | 3789 | CG | ARG | A | 67 | −14.047 | 92.745 | 1.481 | 1.00 | 38.29 | C |
| ATOM | 3790 | CD | ARG | A | 67 | −14.504 | 94.103 | 0.942 | 1.00 | 39.40 | C |
| ATOM | 3791 | NE | ARG | A | 67 | −14.857 | 94.018 | −0.470 | 1.00 | 34.94 | N |
| ATOM | 3792 | CZ | ARG | A | 67 | −16.086 | 94.209 | −0.939 | 1.00 | 36.27 | C |
| ATOM | 3793 | NH1 | ARG | A | 67 | −17.074 | 94.532 | −0.113 | 1.00 | 29.46 | N1+ |
| ATOM | 3794 | NH2 | ARG | A | 67 | −16.325 | 94.083 | −2.236 | 1.00 | 33.40 | N |
| ATOM | 3795 | N | PHE | A | 68 | −15.936 | 88.558 | 0.688 | 1.00 | 31.92 | N |
| ATOM | 3796 | CA | PHE | A | 68 | −17.046 | 87.626 | 0.523 | 1.00 | 33.41 | C |
| ATOM | 3797 | C | PHE | A | 68 | −16.540 | 86.204 | 0.697 | 1.00 | 34.08 | C |
| ATOM | 3798 | O | PHE | A | 68 | −15.382 | 85.903 | 0.405 | 1.00 | 35.01 | O |
| ATOM | 3799 | CB | PHE | A | 68 | −17.727 | 87.743 | −0.850 | 1.00 | 29.41 | C |
| ATOM | 3800 | CG | PHE | A | 68 | −18.410 | 89.076 | −1.108 | 1.00 | 31.18 | C |
| ATOM | 3801 | CD1 | PHE | A | 68 | −18.242 | 90.156 | −0.256 | 1.00 | 28.93 | C |
| ATOM | 3802 | CD2 | PHE | A | 68 | −19.236 | 89.231 | −2.206 | 1.00 | 29.68 | C |
| ATOM | 3803 | CE1 | PHE | A | 68 | −18.851 | 91.388 | −0.518 | 1.00 | 33.26 | C |
| ATOM | 3804 | CE2 | PHE | A | 68 | −19.865 | 90.444 | −2.462 | 1.00 | 36.39 | C |
| ATOM | 3805 | CZ | PHE | A | 68 | −19.660 | 91.532 | −1.618 | 1.00 | 35.74 | C |
| ATOM | 3806 | N | THR | A | 69 | −17.413 | 85.325 | 1.177 | 1.00 | 33.37 | N |
| ATOM | 3807 | CA | THR | A | 69 | −17.054 | 83.917 | 1.293 | 1.00 | 32.05 | C |
| ATOM | 3808 | C | THR | A | 69 | −18.206 | 83.085 | 0.775 | 1.00 | 30.76 | C |
| ATOM | 3809 | O | THR | A | 69 | −19.354 | 83.292 | 1.177 | 1.00 | 28.56 | O |
| ATOM | 3810 | CB | THR | A | 69 | −16.720 | 83.513 | 2.739 | 1.00 | 38.78 | C |
| ATOM | 3811 | OG1 | THR | A | 69 | −15.552 | 84.216 | 3.173 | 1.00 | 33.71 | O |
| ATOM | 3812 | CG2 | THR | A | 69 | −16.475 | 81.992 | 2.856 | 1.00 | 30.01 | C |
| ATOM | 3813 | N | ILE | A | 70 | −17.892 | 82.169 | −0.143 | 1.00 | 28.12 | N |
| ATOM | 3814 | CA | ILE | A | 70 | −18.862 | 81.246 | −0.708 | 1.00 | 31.36 | C |
| ATOM | 3815 | C | ILE | A | 70 | −18.754 | 79.918 | 0.040 | 1.00 | 32.93 | C |
| ATOM | 3816 | O | ILE | A | 70 | −17.655 | 79.472 | 0.402 | 1.00 | 33.29 | O |
| ATOM | 3817 | CB | ILE | A | 70 | −18.656 | 81.079 | −2.230 | 1.00 | 31.45 | C |
| ATOM | 3818 | CG1 | ILE | A | 70 | −19.832 | 80.302 | −2.852 | 1.00 | 29.85 | C |
| ATOM | 3819 | CG2 | ILE | A | 70 | −17.257 | 80.401 | −2.554 | 1.00 | 29.79 | C |
| ATOM | 3820 | CD1 | ILE | A | 70 | −19.805 | 80.244 | −4.411 | 1.00 | 27.30 | C |
| ATOM | 3821 | N | SER | A | 71 | −19.899 | 79.300 | 0.307 | 1.00 | 30.39 | N |
| ATOM | 3822 | CA | SER | A | 71 | −19.935 | 78.023 | 1.017 | 1.00 | 34.30 | C |
| ATOM | 3823 | C | SER | A | 71 | −21.233 | 77.320 | 0.648 | 1.00 | 30.83 | C |
| ATOM | 3824 | O | SER | A | 71 | −22.137 | 77.905 | 0.046 | 1.00 | 34.13 | O |
| ATOM | 3825 | CB | SER | A | 71 | −19.827 | 78.201 | 2.544 | 1.00 | 28.89 | C |
| ATOM | 3826 | OG | SER | A | 71 | −20.944 | 78.930 | 3.075 | 1.00 | 31.85 | O |
| ATOM | 3827 | N | ARG | A | 72 | −21.333 | 76.064 | 1.046 | 1.00 | 33.01 | N |
| ATOM | 3828 | CA | ARG | A | 72 | −22.531 | 75.307 | 0.753 | 1.00 | 33.51 | C |
| ATOM | 3829 | C | ARG | A | 72 | −22.820 | 74.404 | 1.941 | 1.00 | 36.68 | C |
| ATOM | 3830 | O | ARG | A | 72 | −21.918 | 74.070 | 2.713 | 1.00 | 32.75 | O |
| ATOM | 3831 | CB | ARG | A | 72 | −22.364 | 74.492 | −0.545 | 1.00 | 29.96 | C |
| ATOM | 3832 | CG | ARG | A | 72 | −21.230 | 73.458 | −0.489 | 1.00 | 29.86 | C |
| ATOM | 3833 | CD | ARG | A | 72 | −20.985 | 72.827 | −1.859 | 1.00 | 31.26 | C |
| ATOM | 3834 | NE | ARG | A | 72 | −22.179 | 72.130 | −2.344 | 1.00 | 36.14 | N |
| ATOM | 3835 | CZ | ARG | A | 72 | −22.480 | 71.942 | −3.627 | 1.00 | 33.42 | C |
| ATOM | 3836 | NH1 | ARG | A | 72 | −21.683 | 72.400 | −4.575 | 1.00 | 31.33 | N1+ |
| ATOM | 3837 | NH2 | ARG | A | 72 | −23.599 | 71.322 | −3.972 | 1.00 | 33.70 | N |
| ATOM | 3838 | N | ASP | A | 73 | −24.094 | 74.046 | 2.108 | 1.00 | 35.23 | N |
| ATOM | 3839 | CA | ASP | A | 73 | −24.523 | 73.070 | 3.119 | 1.00 | 36.76 | C |
| ATOM | 3840 | C | ASP | A | 73 | −25.407 | 72.032 | 2.428 | 1.00 | 39.51 | C |
| ATOM | 3841 | O | ASP | A | 73 | −26.597 | 72.270 | 2.181 | 1.00 | 34.82 | O |
| ATOM | 3842 | CB | ASP | A | 73 | −25.251 | 73.761 | 4.266 | 1.00 | 34.22 | C |
| ATOM | 3843 | CG | ASP | A | 73 | −25.616 | 72.808 | 5.397 | 1.00 | 42.95 | C |
| ATOM | 3844 | OD1 | ASP | A | 73 | −25.733 | 71.576 | 5.175 | 1.00 | 42.54 | O |
| ATOM | 3845 | OD2 | ASP | A | 73 | −25.774 | 73.306 | 6.532 | 1.00 | 48.48 | O1− |
| ATOM | 3846 | N | ASN | A | 74 | −24.825 | 70.874 | 2.117 | 1.00 | 37.32 | N |
| ATOM | 3847 | CA | ASN | A | 74 | −25.569 | 69.888 | 1.350 | 1.00 | 37.99 | C |
| ATOM | 3848 | C | ASN | A | 74 | −26.773 | 69.366 | 2.126 | 1.00 | 38.75 | C |
| ATOM | 3849 | O | ASN | A | 74 | −27.823 | 69.104 | 1.530 | 1.00 | 38.15 | O |
| ATOM | 3850 | CB | ASN | A | 74 | −24.634 | 68.757 | 0.923 | 1.00 | 38.26 | C |
| ATOM | 3851 | CG | ASN | A | 74 | −23.691 | 69.174 | −0.228 | 1.00 | 43.82 | C |
| ATOM | 3852 | OD1 | ASN | A | 74 | −23.726 | 70.314 | −0.699 | 1.00 | 41.08 | O |
| ATOM | 3853 | ND2 | ASN | A | 74 | −22.837 | 68.252 | −0.664 | 1.00 | 42.34 | N |
| ATOM | 3854 | N | SER | A | 75 | −26.678 | 69.273 | 3.454 | 1.00 | 37.68 | N |
| ATOM | 3855 | CA | SER | A | 75 | −27.820 | 68.764 | 4.205 | 1.00 | 40.41 | C |

TABLE 10.3-continued

| ATOM | 3856 | C | SER | A | 75 | −29.031 | 69.694 | 4.108 | 1.00 | 39.19 | C |
|---|---|---|---|---|---|---|---|---|---|---|---|
| ATOM | 3857 | O | SER | A | 75 | −30.152 | 69.250 | 4.331 | 1.00 | 38.81 | O |
| ATOM | 3858 | CB | SER | A | 75 | −27.433 | 68.533 | 5.666 | 1.00 | 34.54 | C |
| ATOM | 3859 | OG | SER | A | 75 | −27.418 | 69.751 | 6.380 | 1.00 | 41.65 | O |
| ATOM | 3860 | N | LYS | A | 76 | −28.840 | 70.966 | 3.765 | 1.00 | 39.96 | N |
| ATOM | 3861 | CA | LYS | A | 76 | −29.947 | 71.888 | 3.540 | 1.00 | 32.91 | C |
| ATOM | 3862 | C | LYS | A | 76 | −30.127 | 72.270 | 2.076 | 1.00 | 33.45 | C |
| ATOM | 3863 | O | LYS | A | 76 | −30.819 | 73.255 | 1.793 | 1.00 | 32.73 | O |
| ATOM | 3864 | CB | LYS | A | 76 | −29.760 | 73.156 | 4.371 | 1.00 | 34.21 | C |
| ATOM | 3865 | CG | LYS | A | 76 | −29.536 | 72.893 | 5.843 | 1.00 | 39.47 | C |
| ATOM | 3866 | CD | LYS | A | 76 | −29.433 | 74.203 | 6.610 | 1.00 | 37.51 | C |
| ATOM | 3867 | CE | LYS | A | 76 | −29.059 | 73.960 | 8.060 | 1.00 | 36.30 | C |
| ATOM | 3868 | NZ | LYS | A | 76 | −28.974 | 75.226 | 8.812 | 1.00 | 53.39 | N1+ |
| ATOM | 3869 | N | ASN | A | 77 | −29.486 | 71.560 | 1.142 | 1.00 | 34.23 | N |
| ATOM | 3870 | CA | ASN | A | 77 | −29.510 | 71.936 | −0.275 | 1.00 | 34.08 | C |
| ATOM | 3871 | C | ASN | A | 77 | −29.340 | 73.439 | −0.531 | 1.00 | 33.69 | C |
| ATOM | 3872 | O | ASN | A | 77 | −30.019 | 73.994 | −1.395 | 1.00 | 31.88 | O |
| ATOM | 3873 | CB | ASN | A | 77 | −30.814 | 71.468 | −0.910 | 1.00 | 35.11 | C |
| ATOM | 3874 | CG | ASN | A | 77 | −30.897 | 69.952 | −1.020 | 1.00 | 45.26 | C |
| ATOM | 3875 | OD1 | ASN | A | 77 | −29.889 | 69.267 | −1.184 | 1.00 | 51.24 | O |
| ATOM | 3876 | ND2 | ASN | A | 77 | −32.095 | 69.426 | −0.909 | 1.00 | 53.41 | N |
| ATOM | 3877 | N | THR | A | 78 | −28.427 | 74.101 | 0.184 | 1.00 | 28.09 | N |
| ATOM | 3878 | CA | THR | A | 78 | −28.320 | 75.550 | 0.139 | 1.00 | 34.16 | C |
| ATOM | 3879 | C | THR | A | 78 | −26.883 | 75.999 | −0.101 | 1.00 | 31.55 | C |
| ATOM | 3880 | O | THR | A | 78 | −25.941 | 75.476 | 0.499 | 1.00 | 29.95 | O |
| ATOM | 3881 | CB | THR | A | 78 | −28.867 | 76.150 | 1.432 | 1.00 | 32.28 | C |
| ATOM | 3882 | OG1 | THR | A | 78 | −30.230 | 75.746 | 1.559 | 1.00 | 36.31 | O |
| ATOM | 3883 | CG2 | THR | A | 78 | −28.789 | 77.662 | 1.405 | 1.00 | 32.86 | C |
| ATOM | 3884 | N | LEU | A | 79 | −26.747 | 76.977 | −0.989 | 1.00 | 33.81 | N |
| ATOM | 3885 | CA | LEU | A | 79 | −25.515 | 77.701 | −1.273 | 1.00 | 30.18 | C |
| ATOM | 3886 | C | LEU | A | 79 | −25.571 | 79.060 | −0.585 | 1.00 | 32.22 | C |
| ATOM | 3887 | O | LEU | A | 79 | −26.606 | 79.724 | −0.617 | 1.00 | 34.07 | O |
| ATOM | 3888 | CB | LEU | A | 79 | −25.381 | 77.913 | −2.782 | 1.00 | 31.42 | C |
| ATOM | 3889 | CG | LEU | A | 79 | −24.281 | 78.860 | −3.263 | 1.00 | 32.10 | C |
| ATOM | 3890 | CD1 | LEU | A | 79 | −22.973 | 78.101 | −3.223 | 1.00 | 23.19 | C |
| ATOM | 3891 | CD2 | LEU | A | 79 | −24.601 | 79.393 | −4.668 | 1.00 | 27.71 | C |
| ATOM | 3892 | N | TYR | A | 80 | −24.450 | 79.498 | −0.015 | 1.00 | 30.45 | N |
| ATOM | 3893 | CA | TYR | A | 80 | −24.385 | 80.758 | 0.715 | 1.00 | 29.65 | C |
| ATOM | 3894 | C | TYR | A | 80 | −23.352 | 81.714 | 0.114 | 1.00 | 36.35 | C |
| ATOM | 3895 | O | TYR | A | 80 | −22.353 | 81.294 | −0.486 | 1.00 | 29.45 | O |
| ATOM | 3896 | CB | TYR | A | 80 | −24.022 | 80.536 | 2.194 | 1.00 | 29.90 | C |
| ATOM | 3897 | CG | TYR | A | 80 | −24.972 | 79.655 | 2.914 | 1.00 | 35.65 | C |
| ATOM | 3898 | CD1 | TYR | A | 80 | −26.209 | 80.148 | 3.347 | 1.00 | 31.27 | C |
| ATOM | 3899 | CD2 | TYR | A | 80 | −24.656 | 78.311 | 3.162 | 1.00 | 32.71 | C |
| ATOM | 3900 | CE1 | TYR | A | 80 | −27.109 | 79.334 | 4.006 | 1.00 | 30.61 | C |
| ATOM | 3901 | CE2 | TYR | A | 80 | −25.548 | 77.480 | 3.834 | 1.00 | 34.98 | C |
| ATOM | 3902 | CZ | TYR | A | 80 | −26.780 | 77.999 | 4.253 | 1.00 | 43.60 | C |
| ATOM | 3903 | OH | TYR | A | 80 | −27.691 | 77.183 | 4.903 | 1.00 | 43.60 | O |
| ATOM | 3904 | N | LEU | A | 81 | −23.608 | 83.016 | 0.286 | 1.00 | 33.92 | N |
| ATOM | 3905 | CA | LEU | A | 81 | −22.616 | 84.067 | 0.062 | 1.00 | 32.11 | C |
| ATOM | 3906 | C | LEU | A | 81 | −22.609 | 84.955 | 1.294 | 1.00 | 35.72 | C |
| ATOM | 3907 | O | LEU | A | 81 | −23.559 | 85.712 | 1.534 | 1.00 | 31.37 | O |
| ATOM | 3908 | CB | LEU | A | 81 | −22.899 | 84.890 | −1.193 | 1.00 | 29.72 | C |
| ATOM | 3909 | CG | LEU | A | 81 | −21.820 | 85.907 | −1.554 | 1.00 | 30.90 | C |
| ATOM | 3910 | CD1 | LEU | A | 81 | −20.535 | 85.193 | −2.008 | 1.00 | 31.13 | C |
| ATOM | 3911 | CD2 | LEU | A | 81 | −22.311 | 86.863 | −2.620 | 1.00 | 29.96 | C |
| ATOM | 3912 | N | GLN | A | 82 | −21.546 | 84.836 | 2.077 | 1.00 | 35.14 | N |
| ATOM | 3913 | CA | GLN | A | 82 | −21.322 | 85.681 | 3.236 | 1.00 | 35.67 | C |
| ATOM | 3914 | C | GLN | A | 82 | −20.628 | 86.948 | 2.753 | 1.00 | 33.89 | C |
| ATOM | 3915 | O | GLN | A | 82 | −19.504 | 86.883 | 2.239 | 1.00 | 36.17 | O |
| ATOM | 3916 | CB | GLN | A | 82 | −20.463 | 84.940 | 4.264 | 1.00 | 33.97 | C |
| ATOM | 3917 | CG | GLN | A | 82 | −20.206 | 85.726 | 5.526 | 1.00 | 35.10 | C |
| ATOM | 3918 | CD | GLN | A | 82 | −21.509 | 86.106 | 6.226 | 1.00 | 41.65 | C |
| ATOM | 3919 | OE1 | GLN | A | 82 | −22.419 | 85.279 | 6.375 | 1.00 | 41.07 | O |
| ATOM | 3920 | NE2 | GLN | A | 82 | −21.598 | 87.354 | 6.669 | 1.00 | 39.37 | N |
| ATOM | 3921 | N | MET | A | 83 | −21.290 | 88.089 | 2.892 | 1.00 | 34.01 | N |
| ATOM | 3922 | CA | MET | A | 83 | −20.762 | 89.349 | 2.360 | 1.00 | 40.25 | C |
| ATOM | 3923 | C | MET | A | 83 | −20.390 | 90.231 | 3.540 | 1.00 | 34.20 | C |
| ATOM | 3924 | O | MET | A | 83 | −21.271 | 90.753 | 4.231 | 1.00 | 43.36 | O |
| ATOM | 3925 | CB | MET | A | 83 | −21.782 | 90.054 | 1.460 | 1.00 | 35.88 | C |
| ATOM | 3926 | CG | MET | A | 83 | −22.247 | 89.246 | 0.242 | 1.00 | 40.32 | C |
| ATOM | 3927 | SD | MET | A | 83 | −23.444 | 90.120 | −0.837 | 1.00 | 45.75 | S |
| ATOM | 3928 | CE | MET | A | 83 | −24.869 | 90.178 | 0.214 | 1.00 | 39.89 | C |
| ATOM | 3929 | N | ASN | A | 84 | −19.098 | 90.416 | 3.767 | 1.00 | 34.41 | N |
| ATOM | 3930 | CA | ASN | A | 84 | −18.649 | 91.282 | 4.849 | 1.00 | 35.66 | C |
| ATOM | 3931 | C | ASN | A | 84 | −18.114 | 92.576 | 4.266 | 1.00 | 35.32 | C |
| ATOM | 3932 | O | ASN | A | 84 | −17.798 | 92.660 | 3.078 | 1.00 | 37.11 | O |
| ATOM | 3933 | CB | ASN | A | 84 | −17.563 | 90.616 | 5.694 | 1.00 | 33.02 | C |
| ATOM | 3934 | CG | ASN | A | 84 | −18.033 | 89.347 | 6.358 | 1.00 | 38.60 | C |
| ATOM | 3935 | OD1 | ASN | A | 84 | −19.196 | 89.206 | 6.717 | 1.00 | 38.86 | O |

TABLE 10.3-continued

| ATOM | 3936 | ND2 | ASN | A | 84 | −17.127 | 88.398 | 6.499 | 1.00 | 43.30 | N |
|------|------|-----|-----|---|----|---------|--------|-------|------|-------|---|
| ATOM | 3937 | N | SER | A | 85 | −18.051 | 93.598 | 5.113 | 1.00 | 37.32 | N |
| ATOM | 3938 | CA | SER | A | 85 | −17.446 | 94.870 | 4.742 | 1.00 | 40.34 | C |
| ATOM | 3939 | C | SER | A | 85 | −18.091 | 95.435 | 3.483 | 1.00 | 36.53 | C |
| ATOM | 3940 | O | SER | A | 85 | −17.417 | 95.833 | 2.536 | 1.00 | 42.50 | O |
| ATOM | 3941 | CB | SER | A | 85 | −15.936 | 94.707 | 4.545 | 1.00 | 41.25 | C |
| ATOM | 3942 | OG | SER | A | 85 | −15.303 | 94.426 | 5.777 | 1.00 | 48.30 | O |
| ATOM | 3943 | N | LEU | A | 86 | −19.419 | 95.440 | 3.469 | 1.00 | 36.42 | N |
| ATOM | 3944 | CA | LEU | A | 86 | −20.121 | 95.839 | 2.269 | 1.00 | 30.29 | C |
| ATOM | 3945 | C | LEU | A | 86 | −19.768 | 97.269 | 1.898 | 1.00 | 37.87 | C |
| ATOM | 3946 | O | LEU | A | 86 | −19.530 | 98.126 | 2.759 | 1.00 | 39.88 | O |
| ATOM | 3947 | CB | LEU | A | 86 | −21.620 | 95.670 | 2.458 | 1.00 | 37.21 | C |
| ATOM | 3948 | CG | LEU | A | 86 | −22.026 | 94.199 | 2.267 | 1.00 | 41.48 | C |
| ATOM | 3949 | CD1 | LEU | A | 86 | −23.420 | 93.965 | 2.745 | 1.00 | 31.33 | C |
| ATOM | 3950 | CD2 | LEU | A | 86 | −21.912 | 93.809 | 0.788 | 1.00 | 34.28 | C |
| ATOM | 3951 | N | ARG | A | 87 | −19.673 | 97.500 | 0.601 | 1.00 | 31.11 | N |
| ATOM | 3952 | CA | ARG | A | 87 | −19.397 | 98.809 | 0.054 | 1.00 | 36.58 | C |
| ATOM | 3953 | C | ARG | A | 87 | −20.539 | 99.186 | −0.890 | 1.00 | 37.14 | C |
| ATOM | 3954 | O | ARG | A | 87 | −21.233 | 98.322 | −1.439 | 1.00 | 30.93 | O |
| ATOM | 3955 | CB | ARG | A | 87 | −18.047 | 98.816 | −0.688 | 1.00 | 36.84 | C |
| ATOM | 3956 | CG | ARG | A | 87 | −16.843 | 98.100 | −0.017 | 1.00 | 39.75 | C |
| ATOM | 3957 | CD | ARG | A | 87 | −15.620 | 98.762 | −0.560 | 1.00 | 50.01 | C |
| ATOM | 3958 | NE | ARG | A | 87 | −14.715 | 97.898 | −1.313 | 1.00 | 57.70 | N |
| ATOM | 3959 | CZ | ARG | A | 87 | −13.636 | 97.274 | −0.840 | 1.00 | 54.84 | C |
| ATOM | 3960 | NH1 | ARG | A | 87 | −13.275 | 97.378 | 0.442 | 1.00 | 55.39 | N1+ |
| ATOM | 3961 | NH2 | ARG | A | 87 | −12.907 | 96.541 | −1.682 | 1.00 | 46.24 | N |
| ATOM | 3962 | N | VAL | A | 88 | −20.706 | 100.495 | −1.088 | 1.00 | 33.94 | N |
| ATOM | 3963 | CA | VAL | A | 88 | −21.786 | 101.015 | −1.927 | 1.00 | 35.85 | C |
| ATOM | 3964 | C | VAL | A | 88 | −21.768 | 100.348 | −3.297 | 1.00 | 33.17 | C |
| ATOM | 3965 | O | VAL | A | 88 | −22.812 | 99.996 | −3.856 | 1.00 | 34.21 | O |
| ATOM | 3966 | CB | VAL | A | 88 | −21.681 | 102.557 | −2.018 | 1.00 | 41.36 | C |
| ATOM | 3967 | CG1 | VAL | A | 88 | −22.508 | 103.125 | −3.182 | 1.00 | 34.83 | C |
| ATOM | 3968 | CG2 | VAL | A | 88 | −22.191 | 103.172 | −0.697 | 1.00 | 32.83 | C |
| ATOM | 3969 | N | GLU | A | 89 | −20.577 | 100.142 | −3.842 | 1.00 | 32.51 | N |
| ATOM | 3970 | CA | GLU | A | 89 | −20.416 | 99.535 | −5.149 | 1.00 | 32.60 | C |
| ATOM | 3971 | C | GLU | A | 89 | −20.831 | 98.070 | −5.195 | 1.00 | 35.92 | C |
| ATOM | 3972 | O | GLU | A | 89 | −20.914 | 97.531 | −6.303 | 1.00 | 32.77 | O |
| ATOM | 3973 | CB | GLU | A | 89 | −18.947 | 99.625 | −5.598 | 1.00 | 33.36 | C |
| ATOM | 3974 | CG | GLU | A | 89 | −18.249 | 100.917 | −5.267 | 1.00 | 52.01 | C |
| ATOM | 3975 | CD | GLU | A | 89 | −17.581 | 100.894 | −3.898 | 1.00 | 57.81 | C |
| ATOM | 3976 | OE1 | GLU | A | 89 | −18.121 | 101.544 | −2.969 | 1.00 | 46.95 | O |
| ATOM | 3977 | OE2 | GLU | A | 89 | −16.513 | 100.230 | −3.762 | 1.00 | 68.05 | O1− |
| ATOM | 3978 | N | ASP | A | 90 | −21.123 | 97.427 | −4.048 | 1.00 | 30.72 | N |
| ATOM | 3979 | CA | ASP | A | 90 | −21.653 | 96.063 | −4.058 | 1.00 | 34.90 | C |
| ATOM | 3980 | C | ASP | A | 90 | −23.142 | 96.017 | −4.360 | 1.00 | 35.83 | C |
| ATOM | 3981 | O | ASP | A | 90 | −23.710 | 94.912 | −4.422 | 1.00 | 33.53 | O |
| ATOM | 3982 | CB | ASP | A | 90 | −21.377 | 95.351 | −2.721 | 1.00 | 28.51 | C |
| ATOM | 3983 | CG | ASP | A | 90 | −19.884 | 95.173 | −2.453 | 1.00 | 37.19 | C |
| ATOM | 3984 | OD1 | ASP | A | 90 | −19.142 | 94.821 | −3.411 | 1.00 | 36.43 | O |
| ATOM | 3985 | OD2 | ASP | A | 90 | −19.439 | 95.412 | −1.300 | 1.00 | 36.43 | O1− |
| ATOM | 3986 | N | THR | A | 91 | −23.778 | 97.180 | −4.534 | 1.00 | 30.48 | N |
| ATOM | 3987 | CA | THR | A | 91 | −25.207 | 97.244 | −4.843 | 1.00 | 34.41 | C |
| ATOM | 3988 | C | THR | A | 91 | −25.488 | 96.586 | −6.183 | 1.00 | 29.60 | C |
| ATOM | 3989 | O | THR | A | 91 | −24.889 | 96.958 | −7.192 | 1.00 | 33.51 | O |
| ATOM | 3990 | CB | THR | A | 91 | −25.655 | 98.705 | −4.865 | 1.00 | 34.98 | C |
| ATOM | 3991 | OG1 | THR | A | 91 | −25.482 | 99.260 | −3.556 | 1.00 | 33.04 | O |
| ATOM | 3992 | CG2 | THR | A | 91 | −27.119 | 98.836 | −5.317 | 1.00 | 22.08 | C |
| ATOM | 3993 | N | ALA | A | 92 | −26.384 | 95.601 | −6.196 | 1.00 | 26.49 | N |
| ATOM | 3994 | CA | ALA | A | 92 | −26.628 | 94.831 | −7.418 | 1.00 | 33.82 | C |
| ATOM | 3995 | C | ALA | A | 92 | −27.764 | 93.858 | −7.167 | 1.00 | 31.11 | C |
| ATOM | 3996 | O | ALA | A | 92 | −28.109 | 93.559 | −6.019 | 1.00 | 33.45 | O |
| ATOM | 3997 | CB | ALA | A | 92 | −25.374 | 94.036 | −7.893 | 1.00 | 29.95 | C |
| ATOM | 3998 | N | VAL | A | 93 | −28.318 | 93.336 | −8.255 | 1.00 | 27.74 | N |
| ATOM | 3999 | CA | VAL | A | 93 | −29.052 | 92.083 | −8.161 | 1.00 | 27.69 | C |
| ATOM | 4000 | C | VAL | A | 93 | −28.035 | 90.949 | −8.156 | 1.00 | 32.05 | C |
| ATOM | 4001 | O | VAL | A | 93 | −27.098 | 90.935 | −8.970 | 1.00 | 32.98 | O |
| ATOM | 4002 | CB | VAL | A | 93 | −30.043 | 91.925 | −9.321 | 1.00 | 30.90 | C |
| ATOM | 4003 | CG1 | VAL | A | 93 | −30.675 | 90.530 | −9.260 | 1.00 | 27.42 | C |
| ATOM | 4004 | CG2 | VAL | A | 93 | −31.106 | 93.006 | −9.272 | 1.00 | 22.48 | C |
| ATOM | 4005 | N | TYR | A | 94 | −28.210 | 90.005 | −7.236 | 1.00 | 28.80 | N |
| ATOM | 4006 | CA | TYR | A | 94 | −27.333 | 88.851 | −7.090 | 1.00 | 27.10 | C |
| ATOM | 4007 | C | TYR | A | 94 | −28.052 | 87.579 | −7.535 | 1.00 | 30.77 | C |
| ATOM | 4008 | O | TYR | A | 94 | −29.164 | 87.290 | −7.070 | 1.00 | 32.21 | O |
| ATOM | 4009 | CB | TYR | A | 94 | −26.849 | 88.711 | −5.643 | 1.00 | 25.98 | C |
| ATOM | 4010 | CG | TYR | A | 94 | −25.744 | 89.678 | −5.299 | 1.00 | 35.21 | C |
| ATOM | 4011 | CD1 | TYR | A | 94 | −26.003 | 91.042 | −5.195 | 1.00 | 33.48 | C |
| ATOM | 4012 | CD2 | TYR | A | 94 | −24.448 | 89.235 | −5.071 | 1.00 | 28.53 | C |
| ATOM | 4013 | CE1 | TYR | A | 94 | −25.011 | 91.927 | −4.887 | 1.00 | 31.11 | C |
| ATOM | 4014 | CE2 | TYR | A | 94 | −23.439 | 90.127 | −4.754 | 1.00 | 34.57 | C |
| ATOM | 4015 | CZ | TYR | A | 94 | −23.734 | 91.482 | −4.674 | 1.00 | 34.25 | C |

TABLE 10.3-continued

| ATOM | 4016 | OH | TYR | A | 94 | −22.756 | 92.410 | −4.395 | 1.00 | 31.02 | O |
| ATOM | 4017 | N | TYR | A | 95 | −27.399 | 86.815 | −8.412 | 1.00 | 27.50 | N |
| ATOM | 4018 | CA | TYR | A | 95 | −27.904 | 85.566 | −8.958 | 1.00 | 28.28 | C |
| ATOM | 4019 | C | TYR | A | 95 | −26.990 | 84.436 | −8.531 | 1.00 | 30.88 | C |
| ATOM | 4020 | O | TYR | A | 95 | −25.769 | 84.610 | −8.464 | 1.00 | 30.35 | O |
| ATOM | 4021 | CB | TYR | A | 95 | −27.948 | 85.576 | i•-i>o'-I | 1.00 | 23.11 | C |
| ATOM | 4022 | CG | TYR | A | 95 | −28.742 | 86.673 | −11.106 | 1.00 | 28.17 | C |
| ATOM | 4023 | CD1 | TYR | A | 95 | −30.120 | 86.537 | −11.313 | 1.00 | 35.38 | C |
| ATOM | 4024 | CD2 | TYR | A | 95 | −28.128 | 87.864 | −11.486 | 1.00 | 31.26 | C |
| ATOM | 4025 | CE1 | TYR | A | 95 | −30.863 | 87.559 | −11.882 | 1.00 | 29.38 | C |
| ATOM | 4026 | CE2 | TYR | A | 95 | −28.854 | 88.887 | −12.059 | 1.00 | 27.86 | C |
| ATOM | 4027 | CZ | TYR | A | 95 | −30.210 | 88.733 | −12.251 | 1.00 | 32.29 | C |
| ATOM | 4028 | OH | TYR | A | 95 | −30.913 | 89.752 | −12.812 | 1.00 | 36.01 | O |
| ATOM | 4029 | N | CYS | A | 96 | −27.576 | 83.288 | −8.237 | 1.00 | 28.07 | N |
| ATOM | 4030 | CA | CYS | A | 96 | −26.795 | 82.069 | −8.201 | 1.00 | 31.83 | C |
| ATOM | 4031 | C | CYS | A | 96 | −27.035 | 81.314 | −9.498 | 1.00 | 30.66 | C |
| ATOM | 4032 | O | CYS | A | 96 | −28.063 | 81.482 | −10.165 | 1.00 | 27.69 | O |
| ATOM | 4033 | CB | CYS | A | 96 | −27.113 | 81.176 | −6.989 | 1.00 | 35.63 | C |
| ATOM | 4034 | SG | CYS | A | 96 | −28.807 | 80.660 | −6.800 | 1.00 | 52.39 | S |
| ATOM | 4035 | N | ALA | A | 97 | −26.055 | 80.500 | −9.860 | 1.00 | 25.32 | N |
| ATOM | 4036 | CA | ALA | A | 97 | −26.171 | 79.615 | −11.005 | 1.00 | 29.44 | C |
| ATOM | 4037 | C | ALA | A | 97 | −25.383 | 78.346 | −10.695 | 1.00 | 29.42 | C |
| ATOM | 4038 | O | ALA | A | 97 | −24.512 | 78.346 | −9.823 | 1.00 | 32.47 | O |
| ATOM | 4039 | CB | ALA | A | 97 | −25.671 | 80.294 | −12.287 | 1.00 | 26.70 | C |
| ATOM | 4040 | N | ASN | A | 98 | −25.693 | 77.251 | −11.396 | 1.00 | 25.38 | N |
| ATOM | 4041 | CA | ASN | A | 98 | −24.856 | 76.072 | −11.236 | 1.00 | 31.07 | C |
| ATOM | 4042 | C | ASN | A | 98 | −23.922 | 75.893 | −12.441 | 1.00 | 25.38 | C |
| ATOM | 4043 | O | ASN | A | 98 | −23.936 | 76.655 | −13.416 | 1.00 | 26.89 | O |
| ATOM | 4044 | CB | ASN | A | 98 | −25.714 | 74.832 | −10.962 | 1.00 | 26.42 | C |
| ATOM | 4045 | CG | ASN | A | 98 | −26.528 | 74.385 | −12.153 | 1.00 | 31.33 | C |
| ATOM | 4046 | OD1 | ASN | A | 98 | −26.444 | 74.948 | −13.257 | 1.00 | 31.54 | O |
| ATOM | 4047 | ND2 | ASN | A | 98 | −27.362 | 73.366 | −11.925 | 1.00 | 34.14 | N |
| ATOM | 4048 | N | TRP | A | 99 | −23.088 | 74.869 | −12.372 | 1.00 | 27.06 | N |
| ATOM | 4049 | CA | TRP | A | 99 | −22.251 | 74.549 | −13.521 | 1.00 | 30.36 | C |
| ATOM | 4050 | C | TRP | A | 99 | −22.064 | 73.046 | −13.590 | 1.00 | 30.04 | C |
| ATOM | 4051 | O | TRP | A | 99 | −21.903 | 72.391 | −12.555 | 1.00 | 29.39 | O |
| ATOM | 4052 | CB | TRP | A | 99 | −20.897 | 75.266 | −13.450 | 1.00 | 25.45 | C |
| ATOM | 4053 | CG | TRP | A | 99 | −19.972 | 74.863 | −12.353 | 1.00 | 29.81 | C |
| ATOM | 4054 | CD1 | TRP | A | 99 | −19.834 | 75.449 | −11.122 | 1.00 | 28.02 | C |
| ATOM | 4055 | CD2 | TRP | A | 99 | −18.997 | 73.810 | −12.408 | 1.00 | 26.75 | C |
| ATOM | 4056 | NE1 | TRP | A | 99 | −18.818 | 74.830 | −10.414 | 1.00 | 23.44 | N |
| ATOM | 4057 | CE2 | TRP | A | 99 | −18.300 | 73.816 | −11.178 | 1.00 | 25.89 | C |
| ATOM | 4058 | CE3 | TRP | A | 99 | −18.634 | 72.880 | −13.385 | 1.00 | 28.32 | C |
| ATOM | 4059 | CZ2 | TRP | A | 99 | −17.278 | 72.904 | −10.891 | 1.00 | 30.78 | C |
| ATOM | 4060 | CZ3 | TRP | A | 99 | −17.613 | 71.972 | −13.101 | 1.00 | 30.19 | C |
| ATOM | 4061 | CH2 | TRP | A | 99 | −16.951 | 71.992 | −11.859 | 1.00 | 28.00 | C |
| ATOM | 4062 | N | TYR | A | 100 | −22.084 | 72.513 | −14.814 | 1.00 | 30.79 | N |
| ATOM | 4063 | CA | TYR | A | 100 | −22.044 | 71.070 | −15.081 | 1.00 | 34.23 | C |
| ATOM | 4064 | C | TYR | A | 100 | −20.741 | 70.594 | −15.703 | 1.00 | 36.36 | C |
| ATOM | 4065 | O | TYR | A | 100 | −20.246 | 69.521 | −15.339 | 1.00 | 31.49 | O |
| ATOM | 4066 | CB | TYR | A | 100 | −23.188 | 70.657 | −16.023 | 1.00 | 29.48 | C |
| ATOM | 4067 | CG | TYR | A | 100 | −24.563 | 70.844 | −15.457 | 1.00 | 29.45 | C |
| ATOM | 4068 | CD1 | TYR | A | 100 | −24.812 | 70.621 | −14.106 | 1.00 | 32.61 | C |
| ATOM | 4069 | CD2 | TYR | A | 100 | −25.623 | 71.233 | −16.273 | 1.00 | 31.46 | C |
| ATOM | 4070 | CE1 | TYR | A | 100 | −26.081 | 70.796 | −13.576 | 1.00 | 32.67 | C |
| ATOM | 4071 | CE2 | TYR | A | 100 | −26.904 | 71.403 | −15.756 | 1.00 | 30.44 | C |
| ATOM | 4072 | CZ | TYR | A | 100 | −27.124 | 71.173 | −14.404 | 1.00 | 31.95 | C |
| ATOM | 4073 | OH | TYR | A | 100 | −28.372 | 71.337 | −13.866 | 1.00 | 30.17 | O |
| ATOM | 4074 | N | TYR | A | 101 | −20.183 | 71.382 | −16.626 | 1.00 | 29.07 | N |
| ATOM | 4075 | CA | TYR | A | 101 | −19.125 | 70.940 | −17.527 | 1.00 | 29.25 | C |
| ATOM | 4076 | C | TYR | A | 101 | −17.797 | 71.608 | −17.189 | 1.00 | 34.28 | C |
| ATOM | 4077 | O | TYR | A | 101 | −16.868 | 70.944 | −16.723 | 1.00 | 35.11 | O |
| ATOM | 4078 | CB | TYR | A | 101 | −19.548 | 71.243 | −18.955 | 1.00 | 24.67 | C |
| ATOM | 4079 | CG | TYR | A | 101 | −20.914 | 70.690 | −19.282 | 1.00 | 32.07 | C |
| ATOM | 4080 | CD1 | TYR | A | 101 | −21.119 | 69.317 | −19.342 | 1.00 | 32.40 | C |
| ATOM | 4081 | CD2 | TYR | A | 101 | −21.996 | 71.534 | −19.549 | 1.00 | 27.53 | C |
| ATOM | 4082 | CE1 | TYR | A | 101 | −22.357 | 68.791 | −19.657 | 1.00 | 33.92 | C |
| ATOM | 4083 | CE2 | TYR | A | 101 | −23.255 | 71.019 | −19.850 | 1.00 | 27.34 | C |
| ATOM | 4084 | CZ | TYR | A | 101 | −23.419 | 69.641 | −19.902 | 1.00 | 34.29 | C |
| ATOM | 4085 | OH | TYR | A | 101 | −24.622 | 69.081 | −20.215 | 1.00 | 35.46 | O |
| ATOM | 4086 | N | TYR | A | 102 | −17.670 | 72.911 | −17.415 | 1.00 | 28.83 | N |
| ATOM | 4087 | CA | TYR | A | 102 | −16.483 | 73.631 | −16.998 | 1.00 | 29.54 | C |
| ATOM | 4088 | C | TYR | A | 102 | −16.872 | 74.660 | −15.951 | 1.00 | 31.00 | C |
| ATOM | 4089 | O | TYR | A | 102 | −17.957 | 75.244 | −16.004 | 1.00 | 33.23 | O |
| ATOM | 4090 | CB | TYR | A | 102 | −15.761 | 74.287 | −18.187 | 1.00 | 27.78 | C |
| ATOM | 4091 | CG | TYR | A | 102 | −16.664 | 74.965 | −19.187 | 1.00 | 30.93 | C |
| ATOM | 4092 | CD1 | TYR | A | 102 | −17.186 | 74.251 | −20.261 | 1.00 | 31.23 | C |
| ATOM | 4093 | CD2 | TYR | A | 102 | −16.985 | 76.326 | −19.074 | 1.00 | 27.14 | C |
| ATOM | 4094 | CE1 | TYR | A | 102 | −18.004 | 74.864 | −21.204 | 1.00 | 29.52 | C |
| ATOM | 4095 | CE2 | TYR | A | 102 | −17.801 | 76.957 | −20.027 | 1.00 | 26.32 | C |

TABLE 10.3-continued

| | | | | | | | | | | |
|---|---|---|---|---|---|---|---|---|---|---|
| ATOM | 4096 | CZ | TYR | A | 102 | −18.311 | 76.217 | −21.086 | 1.00 | 29.71 | C |
| ATOM | 4097 | OH | TYR | A | 102 | −19.120 | 76.803 | −22.045 | 1.00 | 27.38 | O |
| ATOM | 4098 | N | TYR | A | 103 | −15.960 | 74.870 | −15.000 | 1.00 | 33.17 | N |
| ATOM | 4099 | CA | TYR | A | 103 | −16.282 | 75.569 | −13.768 | 1.00 | 30.18 | C |
| ATOM | 4100 | C | TYR | A | 103 | −16.585 | 77.043 | −13.983 | 1.00 | 30.85 | C |
| ATOM | 4101 | O | TYR | A | 103 | −17.198 | 77.659 | −13.111 | 1.00 | 31.82 | O |
| ATOM | 4102 | CB | TYR | A | 103 | −15.133 | 75.420 | −12.772 | 1.00 | 30.32 | C |
| ATOM | 4103 | CG | TYR | A | 103 | −13.820 | 76.094 | −13.175 | 1.00 | 36.74 | C |
| ATOM | 4104 | CD1 | TYR | A | 103 | −12.864 | 75.419 | −13.922 | 1.00 | 34.48 | C |
| ATOM | 4105 | CD2 | TYR | A | 103 | −13.527 | 77.399 | −12.776 | 1.00 | 36.39 | C |
| ATOM | 4106 | CE1 | TYR | A | 103 | −11.652 | 76.031 | −14.266 | 1.00 | 37.99 | C |
| ATOM | 4107 | CE2 | TYR | A | 103 | −12.332 | 78.012 | −13.120 | 1.00 | 34.39 | C |
| ATOM | 4108 | CZ | TYR | A | 103 | −11.394 | 77.329 | −13.860 | 1.00 | 40.90 | C |
| ATOM | 4109 | OH | TYR | A | 103 | −10.196 | 77.947 | −14.206 | 1.00 | 43.10 | O |
| ATOM | 4110 | N | TYR | A | 104 | −16.189 | 77.616 | −15.112 | 1.00 | 27.43 | N |
| ATOM | 4111 | CA | TYR | A | 104 | −16.416 | 79.027 | −15.373 | 1.00 | 29.07 | C |
| ATOM | 4112 | C | TYR | A | 104 | −17.599 | 79.242 | −16.291 | 1.00 | 28.87 | C |
| ATOM | 4113 | O | TYR | A | 104 | −17.791 | 80.354 | −16.780 | 1.00 | 35.12 | O |
| ATOM | 4114 | CB | TYR | A | 104 | −15.149 | 79.690 | −15.953 | 1.00 | 25.68 | C |
| ATOM | 4115 | CG | TYR | A | 104 | −14.499 | 78.931 | −17.095 | 1.00 | 30.36 | C |
| ATOM | 4116 | CD1 | TYR | A | 104 | −13.573 | 77.894 | −16.846 | 1.00 | 29.10 | C |
| ATOM | 4117 | CD2 | TYR | A | 104 | −14.813 | 79.233 | −18.429 | 1.00 | 27.13 | C |
| ATOM | 4118 | CE1 | TYR | A | 104 | −12.964 | 77.181 | −17.913 | 1.00 | 27.53 | C |
| ATOM | 4119 | CE2 | TYR | A | 104 | −14.225 | 78.528 | −19.494 | 1.00 | 27.81 | C |
| ATOM | 4120 | CZ | TYR | A | 104 | −13.296 | 77.508 | −19.232 | 1.00 | 31.37 | C |
| ATOM | 4121 | OH | TYR | A | 104 | −12.708 | 76.829 | −20.282 | 1.00 | 33.25 | O |
| ATOM | 4122 | N | GLY | A | 105 | −18.385 | 78.199 | −16.546 | 1.00 | 33.05 | N |
| ATOM | 4123 | CA | GLY | A | 105 | −19.642 | 78.324 | −17.262 | 1.00 | 28.37 | C |
| ATOM | 4124 | C | GLY | A | 105 | −20.806 | 78.259 | −16.290 | 1.00 | 33.54 | C |
| ATOM | 4125 | O | GLY | A | 105 | −20.731 | 77.601 | −15.262 | 1.00 | 36.54 | O |
| ATOM | 4126 | N | MET | A | 106 | −21.885 | 78.955 | −16.614 | 1.00 | 33.38 | N |
| ATOM | 4127 | CA | MET | A | 106 | −23.107 | 78.909 | −15.818 | 1.00 | 33.92 | C |
| ATOM | 4128 | C | MET | A | 106 | −24.192 | 78.210 | −16.619 | 1.00 | 33.40 | C |
| ATOM | 4129 | O | MET | A | 106 | −24.516 | 78.645 | −17.727 | 1.00 | 41.54 | O |
| ATOM | 4130 | CB | MET | A | 106 | −23.575 | 80.314 | −15.438 | 1.00 | 31.98 | C |
| ATOM | 4131 | CG | MET | A | 106 | −22.640 | 81.023 | −14.492 | 1.00 | 38.84 | C |
| ATOM | 4132 | SD | MET | A | 106 | −21.690 | 82.292 | −15.342 | 1.00 | 39.21 | S |
| ATOM | 4133 | CE | MET | A | 106 | −20.191 | 82.280 | −14.355 | 1.00 | 44.14 | C |
| ATOM | 4134 | N | ASP | A | 107 | −24.786 | 77.161 | −16.049 | 1.00 | 30.51 | N |
| ATOM | 4135 | CA | ASP | A | 107 | −25.760 | 76.380 | −16.809 | 1.00 | 30.12 | C |
| ATOM | 4136 | C | ASP | A | 107 | −27.213 | 76.688 | −16.421 | 1.00 | 31.04 | C |
| ATOM | 4137 | O | ASP | A | 107 | −28.019 | 76.977 | −17.300 | 1.00 | 30.61 | O |
| ATOM | 4138 | CB | ASP | A | 107 | −25.432 | 74.882 | −16.678 | 1.00 | 32.36 | C |
| ATOM | 4139 | CG | ASP | A | 107 | −24.108 | 74.509 | −17.383 | 1.00 | 34.37 | C |
| ATOM | 4140 | OD1 | ASP | A | 107 | −24.105 | 74.413 | −18.627 | 1.00 | 32.86 | O1− |
| ATOM | 4141 | OD2 | ASP | A | 107 | −23.060 | 74.339 | −16.705 | 1.00 | 36.09 | O |
| ATOM | 4142 | N | VAL | A | 108 | −27.581 | 76.603 | −15.138 | 1.00 | 32.41 | N |
| ATOM | 4143 | CA | VAL | A | 108 | −28.922 | 76.954 | −14.662 | 1.00 | 26.51 | C |
| ATOM | 4144 | C | VAL | A | 108 | −28.818 | 78.175 | −13.754 | 1.00 | 32.76 | C |
| ATOM | 4145 | O | VAL | A | 108 | −27.911 | 78.254 | −12.920 | 1.00 | 31.62 | O |
| ATOM | 4146 | CB | VAL | A | 108 | −29.590 | 75.776 | −13.915 | 1.00 | 28.43 | C |
| ATOM | 4147 | CG1 | VAL | A | 108 | −31.028 | 76.146 | −13.506 | 1.00 | 27.65 | C |
| ATOM | 4148 | CG2 | VAL | A | 108 | −29.617 | 74.516 | −14.803 | 1.00 | 30.87 | C |
| ATOM | 4149 | N | TRP | A | 109 | −29.752 | 79.117 | −13.893 | 1.00 | 33.08 | N |
| ATOM | 4150 | CA | TRP | A | 109 | −29.744 | 80.348 | −13.102 | 1.00 | 34.02 | C |
| ATOM | 4151 | C | TRP | A | 109 | −30.981 | 80.440 | −12.208 | 1.00 | 33.68 | C |
| ATOM | 4152 | O | TRP | A | 109 | −32.064 | 79.966 | −12.563 | 1.00 | 33.19 | O |
| ATOM | 4153 | CB | TRP | A | 109 | −29.716 | 81.605 | −13.997 | 1.00 | 30.84 | C |
| ATOM | 4154 | CG | TRP | A | 109 | −28.485 | 81.762 | −14.834 | 1.00 | 36.98 | C |
| ATOM | 4155 | CD1 | TRP | A | 109 | −28.097 | 80.972 | −15.893 | 1.00 | 30.27 | C |
| ATOM | 4156 | CD2 | TRP | A | 109 | −27.503 | 82.805 | −14.730 | 1.00 | 31.30 | C |
| ATOM | 4157 | NE1 | TRP | A | 109 | −26.927 | 81.459 | −16.432 | 1.00 | 31.83 | N |
| ATOM | 4158 | CE2 | TRP | A | 109 | −26.534 | 82.571 | −15.731 | 1.00 | 29.54 | C |
| ATOM | 4159 | CE3 | TRP | A | 109 | −27.339 | 83.902 | −13.875 | 1.00 | 30.44 | C |
| ATOM | 4160 | CZ2 | TRP | A | 109 | −25.409 | 83.392 | −15.896 | 1.00 | 31.19 | C |
| ATOM | 4161 | CZ3 | TRP | A | 109 | −26.223 | 84.723 | −14.042 | 1.00 | 30.38 | C |
| ATOM | 4162 | CH2 | TRP | A | 109 | −25.271 | 84.460 | −15.043 | 1.00 | 29.90 | C |
| ATOM | 4163 | N | GLY | A | 110 | −30.820 | 81.113 | −11.066 | 1.00 | 29.11 | N |
| ATOM | 4164 | CA | GLY | A | 110 | −31.931 | 81.457 | −10.200 | 1.00 | 35.80 | C |
| ATOM | 4165 | C | GLY | A | 110 | −32.644 | 82.701 | −10.704 | 1.00 | 37.01 | C |
| ATOM | 4166 | O | GLY | A | 110 | −32.532 | 83.075 | −11.871 | 1.00 | 37.79 | O |
| ATOM | 4167 | N | GLN | A | 111 | −33.399 | 83.358 | −9.817 | 1.00 | 35.07 | N |
| ATOM | 4168 | CA | GLN | A | 111 | −34.189 | 84.495 | −10.276 | 1.00 | 30.15 | C |
| ATOM | 4169 | C | GLN | A | 111 | −33.645 | 85.841 | −9.831 | 1.00 | 32.38 | C |
| ATOM | 4170 | O | GLN | A | 111 | −34.080 | 86.862 | −10.372 | 1.00 | 33.82 | O |
| ATOM | 4171 | CB | GLN | A | 111 | −35.644 | 84.410 | −9.787 | 1.00 | 37.66 | C |
| ATOM | 4172 | CG | GLN | A | 111 | −35.874 | 85.115 | −8.454 | 1.00 | 36.90 | C |
| ATOM | 4173 | CD | GLN | A | 111 | −35.642 | 84.208 | −7.281 | 1.00 | 42.01 | C |
| ATOM | 4174 | OE1 | GLN | A | 111 | −35.896 | 82.996 | −7.380 | 1.00 | 52.02 | O |
| ATOM | 4175 | NE2 | GLN | A | 111 | −35.176 | 84.777 | −6.142 | 1.00 | 30.60 | N |

TABLE 10.3-continued

| ATOM | 4176 | N   | GLY  | A | 112 | −32.755 | 85.872  | −8.846 | 1.00 | 31.52 |       | N |
|------|------|-----|------|---|-----|---------|---------|--------|------|-------|-------|---|
| ATOM | 4177 | CA  | GLY  | A | 112 | −32.098 | 87.079  | −8.391 | 1.00 | 29.27 |       | C |
| ATOM | 4178 | C   | GLY  | A | 112 | −32.707 | 87.635  | −7.114 | 1.00 | 30.54 |       | C |
| ATOM | 4179 | O   | GLY  | A | 112 | −33.900 | 87.487  | −6.840 | 1.00 | 36.59 |       | O |
| ATOM | 4180 | N   | THR  | A | 113 | −31.873 | 88.297  | −6.326 | 1.00 | 32.24 |       | N |
| ATOM | 4181 | CA  | THR  | A | 113 | −32.301 | 89.057  | −5.166 | 1.00 | 33.85 |       | C |
| ATOM | 4182 | C   | THR  | A | 113 | −31.459 | 90.323  | −5.122 | 1.00 | 32.53 |       | C |
| ATOM | 4183 | O   | THR  | A | 113 | −30.284 | 90.295  | −5.496 | 1.00 | 30.25 |       | O |
| ATOM | 4184 | CB  | THR  | A | 113 | −32.150 | 88.240  | −3.878 | 1.00 | 31.09 |       | C |
| ATOM | 4185 | OG1 | THR  | A | 113 | −32.645 | 89.016  | −2.780 | 1.00 | 36.12 |       | O |
| ATOM | 4186 | CG2 | THR  | A | 113 | −30.672 | 87.868  | −3.623 | 1.00 | 30.38 |       | C |
| ATOM | 4187 | NA  | THR  | A | 114 | −32.052 | 91.460  | −4.734 | 0.50 | 32.93 |       | N |
| ATOM | 4188 | CA  | ATHR | A | 114 | −31.300 | 92.714  | −4.776 | 0.50 | 30.39 |       | C |
| ATOM | 4189 | C   | ATHR | A | 114 | −30.691 | 93.019  | −3.419 | 0.50 | 31.37 |       | C |
| ATOM | 4190 | O   | ATHR | A | 114 | −31.310 | 92.805  | −2.374 | 0.50 | 33.91 |       | O |
| ATOM | 4191 | CB  | ATHR | A | 114 | −32.120 | 93.928  | −5.266 | 0.50 | 31.38 |       | C |
| ATOM | 4192 | OG1 | ATHR | A | 114 | −31.978 | 95.061  | −4.375 | 0.50 | 27.49 |       | O |
| ATOM | 4193 | CG2 | ATHR | A | 114 | −33.533 | 93.593  | −5.476 | 0.50 | 26.66 |       | C |
| ATOM | 4194 | N   | BTHR | A | 114 | −32.061 | 91.410  | −4.642 | 0.50 | 32.98 |       | N |
| ATOM | 4195 | CA  | BTHR | A | 114 | −31.413 | 92.712  | −4.641 | 0.50 | 30.32 |       | C |
| ATOM | 4196 | C   | BTHR | A | 114 | −30.650 | 92.930  | −3.345 | 0.50 | 31.38 |       | C |
| ATOM | 4197 | O   | BTHR | A | 114 | −31.141 | 92.610  | −2.260 | 0.50 | 34.03 |       | O |
| ATOM | 4198 | CB  | BTHR | A | 114 | −32.434 | 93.834  | −4.810 | 0.50 | 30.28 |       | C |
| ATOM | 4199 | OG1 | BTHR | A | 114 | −33.299 | 93.846  | −3.681 | 0.50 | 37.62 |       | O |
| ATOM | 4200 | CG2 | BTHR | A | 114 | −33.258 | 93.627  | −6.018 | 0.50 | 25.95 |       | C |
| ATOM | 4201 | N   | VAL  | A | 115 | −29.451 | 93.489  | −3.463 | 1.00 | 29.38 |       | N |
| ATOM | 4202 | CA  | VAL  | A | 115 | −28.711 | 93.973  | −2.317 | 1.00 | 31.80 |       | C |
| ATOM | 4203 | C   | VAL  | A | 115 | −28.460 | 95.452  | −2.583 | 1.00 | 32.96 |       | C |
| ATOM | 4204 | O   | VAL  | A | 115 | −27.891 | 95.811  | −3.622 | 1.00 | 32.78 |       | O |
| ATOM | 4205 | CB  | VAL  | A | 115 | −27.392 | 93.209  | −2.130 | 1.00 | 36.32 |       | C |
| ATOM | 4206 | CG1 | VAL  | A | 115 | −26.569 | 93.856  | −1.020 | 1.00 | 35.15 |       | C |
| ATOM | 4207 | CG2 | VAL  | A | 115 | −27.651 | 91.686  | −1.886 | 1.00 | 32.11 |       | C |
| ATOM | 4208 | N   | THR  | A | 116 | −28.917 | 96.307  | −1.676 | 1.00 | 32.75 |       | N |
| ATOM | 4209 | CA  | THR  | A | 116 | −28.678 | 97.741  | −1.754 | 1.00 | 34.57 |       | C |
| ATOM | 4210 | C   | THR  | A | 116 | −27.787 | 98.139  | −0.584 | 1.00 | 34.59 |       | C |
| ATOM | 4211 | O   | THR  | A | 116 | −28.121 | 97.881  | 0.580  | 1.00 | 36.50 |       | O |
| ATOM | 4212 | CB  | THR  | A | 116 | −29.995 | 98.522  | −1.736 | 1.00 | 43.36 |       | C |
| ATOM | 4213 | OG1 | THR  | A | 116 | −30.802 | 98.125  | −2.856 | 1.00 | 40.71 |       | O |
| ATOM | 4214 | CG2 | THR  | A | 116 | −29.731 | 100.021 | −1.809 | 1.00 | 29.94 |       | C |
| ATOM | 4215 | N   | VAL  | A | 117 | −26.649 | 98.738  | −0.890 | 1.00 | 34.23 |       | N |
| ATOM | 4216 | CA  | VAL  | A | 117 | −25.719 | 99.181  | 0.134  | 1.00 | 34.01 |       | C |
| ATOM | 4217 | C   | VAL  | A | 117 | −25.756 | 100.691 | 0.076  | 1.00 | 33.64 |       | C |
| ATOM | 4218 | O   | VAL  | A | 117 | −25.318 | 101.293 | −0.906 | 1.00 | 37.46 |       | O |
| ATOM | 4219 | CB  | VAL  | A | 117 | −24.301 | 98.631  | −0.073 | 1.00 | 36.31 |       | C |
| ATOM | 4220 | CG1 | VAL  | A | 117 | −23.392 | 99.053  | 1.093  | 1.00 | 33.46 |       | C |
| ATOM | 4221 | CG2 | VAL  | A | 117 | −24.317 | 97.090  | −0.232 | 1.00 | 29.32 |       | C |
| ATOM | 4222 | N   | SER  | A | 118 | −26.359 | 101.302 | 1.081  | 1.00 | 39.03 |       | N |
| ATOM | 4223 | CA  | SER  | A | 118 | −26.566 | 102.738 | 1.077  | 1.00 | 39.96 |       | C |
| ATOM | 4224 | C   | SER  | A | 118 | −26.419 | 103.243 | 2.497  | 1.00 | 45.19 |       | C |
| ATOM | 4225 | O   | SER  | A | 118 | −26.858 | 102.579 | 3.439  | 1.00 | 47.46 |       | O |
| ATOM | 4226 | CB  | SER  | A | 118 | −27.961 | 103.097 | 0.529  | 1.00 | 38.81 |       | C |
| ATOM | 4227 | OG  | SER  | A | 118 | −28.165 | 104.501 | 0.460  | 1.00 | 48.85 |       | O |
| ATOM | 4228 | N   | SER  | A | 119 | −25.802 | 104.406 | 2.653  | 1.00 | 46.28 |       | N |
| ATOM | 4229 | CA  | SER  | A | 119 | −25.847 | 105.090 | 3.935  | 1.00 | 53.97 |       | C |
| ATOM | 4230 | C   | SER  | A | 119 | −26.871 | 106.217 | 3.954  | 1.00 | 56.65 |       | C |
| ATOM | 4231 | O   | SER  | A | 119 | −26.985 | 106.913 | 4.961  | 1.00 | 67.20 |       | O |
| ATOM | 4232 | CB  | SER  | A | 119 | −24.468 | 105.628 | 4.292  | 1.00 | 47.03 |       | C |
| ATOM | 4233 | OG  | SER  | A | 119 | −23.903 | 106.260 | 3.168  | 1.00 | 54.58 |       | O |
| ATOM | 4234 | N   | ALA  | A | 120 | −27.649 | 106.385 | 2.890  | 1.00 | 48.46 |       | N |
| ATOM | 4235 | CA  | ALA  | A | 120 | −28.631 | 107.451 | 2.863  | 1.00 | 46.93 |       | C |
| ATOM | 4236 | C   | ALA  | A | 120 | −29.791 | 107.119 | 3.793  | 1.00 | 50.99 |       | C |
| ATOM | 4237 | O   | ALA  | A | 120 | −30.104 | 105.957 | 4.047  | 1.00 | 62.07 |       | O |
| ATOM | 4238 | CB  | ALA  | A | 120 | −29.138 | 107.672 | 1.439  | 1.00 | 43.79 |       | C |
| ATOM | 4239 | N   | SER  | A | 121 | −30.399 | 108.159 | 4.341  | 1.00 | 61.71 | GZ00  | N |
| ATOM | 4240 | CA  | SER  | A | 121 | −31.605 | 108.063 | 5.149  | 1.00 | 54.23 | GZ00  | C |
| ATOM | 4241 | C   | SER  | A | 121 | −32.579 | 109.105 | 4.648  | 1.00 | 47.84 | GZ00  | C |
| ATOM | 4242 | O   | SER  | A | 121 | −32.202 | 110.015 | 3.907  | 1.00 | 55.11 | GZ00  | O |
| ATOM | 4243 | CB  | SER  | A | 121 | −31.338 | 108.273 | 6.640  | 1.00 | 50.17 | GZ00  | C |
| ATOM | 4244 | OG  | SER  | A | 121 | −30.386 | 109.312 | 6.829  | 1.00 | 66.59 | GZ00  | O |
| ATOM | 4245 | N   | THR  | A | 122 | −33.838 | 108.938 | 5.041  | 1.00 | 46.14 | GZ00  | N |
| ATOM | 4246 | CA  | THR  | A | 122 | −34.934 | 109.776 | 4.572  | 1.00 | 52.42 | GZ00  | C |
| ATOM | 4247 | C   | THR  | A | 122 | −34.557 | 111.248 | 4.510  | 1.00 | 56.26 | GZ00  | C |
| ATOM | 4248 | O   | THR  | A | 122 | −33.924 | 111.783 | 5.426  | 1.00 | 48.53 | GZ00  | O |
| ATOM | 4249 | CB  | THR  | A | 122 | −36.129 | 109.606 | 5.486  | 1.00 | 52.24 | GZ00  | C |
| ATOM | 4250 | OG1 | THR  | A | 122 | −36.428 | 108.215 | 5.593  | 1.00 | 57.02 | GZ00  | O |
| ATOM | 4251 | CG2 | THR  | A | 122 | −37.310 | 110.342 | 4.912  | 1.00 | 53.18 | GZ00  | C |
| ATOM | 4252 | N   | LYS  | A | 123 | −34.894 | 111.876 | 3.385  | 1.00 | 54.75 | GZ00  | N |
| ATOM | 4253 | CA  | LYS  | A | 123 | −34.659 | 113.296 | 3.176  | 1.00 | 45.96 | GZ00  | C |
| ATOM | 4254 | C   | LYS  | A | 123 | −35.645 | 113.763 | 2.125  | 1.00 | 53.79 | GZ00  | C |
| ATOM | 4255 | O   | LYS  | A | 123 | −35.799 | 113.095 | 1.099  | 1.00 | 47.21 | GZ00  | O |

TABLE 10.3-continued

| | | | | | | | | | | |
|---|---|---|---|---|---|---|---|---|---|---|
| ATOM | 4256 | CB | LYS | A | 123 | −33.228 | 113.577 | 2.727 | 1.00 | 48.41 GZ00 C |
| ATOM | 4257 | CG | LYS | A | 123 | −32.969 | 115.041 | 2.451 | 1.00 | 46.73 GZ00 C |
| ATOM | 4258 | CD | LYS | A | 123 | −31.559 | 115.291 | 1.972 | 1.00 | 52.19 GZ00 C |
| ATOM | 4259 | CE | LYS | A | 123 | −31.365 | 116.750 | 1.520 | 1.00 | 54.71 GZ00 C |
| ATOM | 4260 | NZ | LYS | A | 123 | −32.367 | 117.163 | 0.481 | 1.00 | 49.08 GZ00 N1+ |
| ATOM | 4261 | N | GLY | A | 124 | −36.311 | 114.898 | 2.382 | 1.00 | 53.18 GZ00 N |
| ATOM | 4262 | CA | GLY | A | 124 | −37.243 | 115.482 | 1.440 | 1.00 | 35.65 GZ00 C |
| ATOM | 4263 | C | GLY | A | 124 | −36.503 | 116.234 | 0.347 | 1.00 | 38.66 GZ00 C |
| ATOM | 4264 | O | GLY | A | 124 | −35.330 | 116.589 | 0.499 | 1.00 | 39.24 GZ00 O |
| ATOM | 4265 | N | PRO | A | 125 | −37.165 | 116.475 | −0.782 | 1.00 | 39.30 GZ00 N |
| ATOM | 4266 | CA | PRO | A | 125 | −36.474 | 117.071 | −1.933 | 1.00 | 45.65 GZ00 C |
| ATOM | 4267 | C | PRO | A | 125 | −36.378 | 118.586 | −1.844 | 1.00 | 46.64 GZ00 C |
| ATOM | 4268 | O | PRO | A | 125 | −37.212 | 119.253 | −1.230 | 1.00 | 46.44 GZ00 O |
| ATOM | 4269 | CB | PRO | A | 125 | −37.378 | 116.684 | −3.110 | 1.00 | 44.97 GZ00 C |
| ATOM | 4270 | CG | PRO | A | 125 | −38.764 | 116.674 | −2.504 | 1.00 | 34.50 GZ00 C |
| ATOM | 4271 | CD | PRO | A | 125 | −38.573 | 116.145 | −1.088 | 1.00 | 36.15 GZ00 C |
| ATOM | 4272 | N | SER | A | 126 | −35.358 | 119.126 | −2.502 | 1.00 | 46.29 GZ00 N |
| ATOM | 4273 | CA | SER | A | 126 | −35.329 | 120.540 | −2.858 | 1.00 | 46.55 GZ00 C |
| ATOM | 4274 | C | SER | A | 126 | −35.926 | 120.698 | −4.247 | 1.00 | 51.08 GZ00 C |
| ATOM | 4275 | O | SER | A | 126 | −35.646 | 119.893 | −5.139 | 1.00 | 52.88 GZ00 O |
| ATOM | 4276 | CB | SER | A | 126 | −33.903 | 121.093 | −2.860 | 1.00 | 40.26 GZ00 C |
| ATOM | 4277 | OG | SER | A | 126 | −33.293 | 120.973 | −1.591 | 1.00 | 55.79 GZ00 O |
| ATOM | 4278 | N | VAL | A | 127 | −36.744 | 121.735 | −4.438 | 1.00 | 47.44 GZ00 N |
| ATOM | 4279 | CA | VAL | A | 127 | −37.420 | 121.956 | −5.713 | 1.00 | 40.11 GZ00 C |
| ATOM | 4280 | C | VAL | A | 127 | −36.980 | 123.290 | −6.314 | 1.00 | 43.78 GZ00 C |
| ATOM | 4281 | O | VAL | A | 127 | −37.076 | 124.339 | −5.665 | 1.00 | 52.62 GZ00 O |
| ATOM | 4282 | CB | VAL | A | 127 | −38.948 | 121.898 | −5.553 | 1.00 | 45.33 GZ00 C |
| ATOM | 4283 | CG1 | VAL | A | 127 | −39.618 | 122.036 | −6.908 | 1.00 | 44.26 GZ00 C |
| ATOM | 4284 | CG2 | VAL | A | 127 | −39.359 | 120.584 | −4.873 | 1.00 | 41.94 GZ00 C |
| ATOM | 4285 | N | PHE | A | 128 | −36.517 | 123.250 | −7.564 | 1.00 | 40.88 GZ00 N |
| ATOM | 4286 | CA | PHE | A | 128 | −36.074 | 124.425 | −8.285 | 1.00 | 43.70 GZ00 C |
| ATOM | 4287 | C | PHE | A | 128 | −36.857 | 124.590 | −9.578 | 1.00 | 46.15 GZ00 C |
| ATOM | 4288 | O | PHE | A | 128 | −37.192 | 123.598 | −10.227 | 1.00 | 47.49 GZ00 O |
| ATOM | 4289 | CB | PHE | A | 128 | −34.582 | 124.356 | −8.615 | 1.00 | 42.40 GZ00 C |
| ATOM | 4290 | CG | PHE | A | 128 | −33.714 | 124.253 | −7.406 | 1.00 | 49.59 GZ00 C |
| ATOM | 4291 | CD1 | PHE | A | 128 | −33.404 | 125.389 | −6.666 | 1.00 | 47.01 GZ00 C |
| ATOM | 4292 | CD2 | PHE | A | 128 | −33.188 | 123.033 | −7.012 | 1.00 | 45.42 GZ00 C |
| ATOM | 4293 | CE1 | PHE | A | 128 | −32.604 | 125.308 | −5.538 | 1.00 | 45.05 GZ00 C |
| ATOM | 4294 | CE2 | PHE | A | 128 | −32.379 | 122.946 | −5.890 | 1.00 | 55.33 GZ00 C |
| ATOM | 4295 | CZ | PHE | A | 128 | −32.084 | 124.085 | −5.152 | 1.00 | 51.39 GZ00 C |
| ATOM | 4296 | N | PRO | A | 129 | −37.153 | 125.823 | −9.985 | 1.00 | 44.34 GZ00 N |
| ATOM | 4297 | CA | PRO | A | 129 | −37.894 | 126.021 | −11.233 | 1.00 | 46.78 GZ00 C |
| ATOM | 4298 | C | PRO | A | 129 | −36.975 | 125.867 | −12.426 | 1.00 | 45.16 GZ00 C |
| ATOM | 4299 | O | PRO | A | 129 | −35.815 | 126.280 | −12.397 | 1.00 | 53.62 GZ00 O |
| ATOM | 4300 | CB | PRO | A | 129 | −38.404 | 127.460 | −11.109 | 1.00 | 47.94 GZ00 C |
| ATOM | 4301 | CG | PRO | A | 129 | −37.334 | 128.141 | −10.336 | 1.00 | 40.44 GZ00 C |
| ATOM | 4302 | CD | PRO | A | 129 | −36.844 | 127.103 | −9.323 | 1.00 | 47.69 GZ00 C |
| ATOM | 4303 | N | LEU | A | 130 | −37.486 | 125.227 | −13.465 | 1.00 | 44.60 GZ00 N |
| ATOM | 4304 | CA | LEU | A | 130 | −36.794 | 125.147 | −14.749 | 1.00 | 49.12 GZ00 C |
| ATOM | 4305 | C | LEU | A | 130 | −37.528 | 126.108 | −15.677 | 1.00 | 54.30 GZ00 C |
| ATOM | 4306 | O | LEU | A | 130 | −38.580 | 125.769 | −16.225 | 1.00 | 53.88 GZ00 O |
| ATOM | 4307 | CB | LEU | A | 130 | −36.764 | 123.714 | −15.283 | 1.00 | 52.10 GZ00 C |
| ATOM | 4308 | CG | LEU | A | 130 | −36.085 | 122.707 | −14.338 | 1.00 | 49.99 GZ00 C |
| ATOM | 4309 | CD1 | LEU | A | 130 | −36.064 | 121.284 | −14.876 | 1.00 | 44.72 GZ00 C |
| ATOM | 4310 | CD2 | LEU | A | 130 | −34.670 | 123.167 | −14.003 | 1.00 | 49.22 GZ00 C |
| ATOM | 4311 | N | ALA | A | 131 | −36.979 | 127.339 | −15.828 | 1.00 | 51.83 GZ00 N |
| ATOM | 4312 | CA | ALA | A | 131 | −37.752 | 128.405 | −16.461 | 1.00 | 60.57 GZ00 C |
| ATOM | 4313 | C | ALA | A | 131 | −37.777 | 128.241 | −17.979 | 1.00 | 58.44 GZ00 C |
| ATOM | 4314 | O | ALA | A | 131 | −36.767 | 127.860 | −18.578 | 1.00 | 62.01 GZ00 O |
| ATOM | 4315 | CB | ALA | A | 131 | −37.182 | 129.780 | −16.118 | 1.00 | 52.12 GZ00 C |
| ATOM | 4316 | N | PRO | A | 132 | −38.922 | 128.508 | −18.610 | 1.00 | 63.89 GZ00 N |
| ATOM | 4317 | CA | PRO | A | 132 | −38.974 | 128.551 | −20.076 | 1.00 | 60.84 GZ00 C |
| ATOM | 4318 | C | PRO | A | 132 | −38.312 | 129.818 | −20.583 | 1.00 | 68.50 GZ00 C |
| ATOM | 4319 | O | PRO | A | 132 | −38.605 | 130.917 | −20.107 | 1.00 | 78.71 GZ00 O |
| ATOM | 4320 | CB | PRO | A | 132 | −40.477 | 128.546 | −20.374 | 1.00 | 61.98 GZ00 C |
| ATOM | 4321 | CG | PRO | A | 132 | −41.076 | 129.218 | −19.186 | 1.00 | 59.91 GZ00 C |
| ATOM | 4322 | CD | PRO | A | 132 | −40.239 | 128.787 | −18.005 | 1.00 | 64.04 GZ00 C |
| ATOM | 4323 | N | SER | A | 133 | −37.403 | 129.660 | −21.536 | 1.00 | 78.25 GZ00 N |
| ATOM | 4324 | CA | SER | A | 133 | −36.712 | 130.783 | −22.151 | 1.00 | 90.93 GZ00 C |
| ATOM | 4325 | C | SER | A | 133 | −36.986 | 130.784 | −23.647 | 1.00 | 95.12 GZ00 C |
| ATOM | 4326 | O | SER | A | 133 | −37.432 | 129.785 | −24.219 | 1.00 | 92.73 GZ00 O |
| ATOM | 4327 | CB | SER | A | 133 | −35.195 | 130.741 | −21.878 | 1.00 | 93.56 GZ00 C |
| ATOM | 4328 | OG | SER | A | 133 | −34.721 | 129.411 | −21.727 | 1.00 | 92.59 GZ00 O |
| ATOM | 4329 | N | SER | A | 134 | −36.724 | 131.923 | −24.279 | 1.00 | 101.62 GZ00 N |
| ATOM | 4330 | CA | SER | A | 134 | −37.027 | 132.073 | −25.696 | 1.00 | 101.63 GZ00 C |
| ATOM | 4331 | C | SER | A | 134 | −35.957 | 131.408 | −26.549 | 1.00 | 98.00 GZ00 C |
| ATOM | 4332 | O | SER | A | 134 | −36.000 | 130.197 | −26.770 | 1.00 | 105.90 GZ00 O |
| ATOM | 4333 | CB | SER | A | 134 | −37.165 | 133.548 | −26.069 | 1.00 | 96.91 GZ00 C |
| ATOM | 4334 | OG | SER | A | 134 | −37.994 | 133.692 | −27.209 | 1.00 | 104.41 GZ00 O |
| ATOM | 4335 | N | GLY | A | 139 | −42.971 | 131.608 | −30.259 | 1.00 | 100.95 GZ00 N |

TABLE 10.3-continued

| ATOM | 4336 | CA | GLY | A | 139 | −44.001 | 130.908 | −31.008 | 1.00 | 110.26 | GZ00 C |
|---|---|---|---|---|---|---|---|---|---|---|---|
| ATOM | 4337 | C | GLY | A | 139 | −43.531 | 129.600 | −31.626 | 1.00 | 116.15 | GZ00 C |
| ATOM | 4338 | O | GLY | A | 139 | −42.529 | 129.576 | −32.345 | 1.00 | 129.42 | GZ00 O |
| ATOM | 4339 | N | GLY | A | 140 | −44.252 | 128.512 | −31.352 | 1.00 | 102.94 | GZ00 N |
| ATOM | 4340 | CA | GLY | A | 140 | −45.429 | 128.577 | −30.509 | 1.00 | 98.08 | GZ00 C |
| ATOM | 4341 | C | GLY | A | 140 | −45.549 | 127.510 | −29.435 | 1.00 | 93.20 | GZ00 C |
| ATOM | 4342 | O | GLY | A | 140 | −46.648 | 127.229 | −28.960 | 1.00 | 88.91 | GZ00 O |
| ATOM | 4343 | N | THR | A | 141 | −44.427 | 126.906 | −29.049 | 1.00 | 94.52 | GZ00 N |
| ATOM | 4344 | CA | THR | A | 141 | −44.434 | 125.891 | −28.005 | 1.00 | 84.86 | GZ00 C |
| ATOM | 4345 | C | THR | A | 141 | −43.275 | 126.163 | −27.053 | 1.00 | 82.99 | GZ00 C |
| ATOM | 4346 | O | THR | A | 141 | −42.191 | 126.566 | −27.485 | 1.00 | 81.83 | GZ00 O |
| ATOM | 4347 | CB | THR | A | 141 | −44.353 | 124.474 | −28.595 | 1.00 | 90.26 | GZ00 C |
| ATOM | 4348 | OG1 | THR | A | 141 | −44.628 | 123.513 | −27.566 | 1.00 | 85.35 | GZ00 O |
| ATOM | 4349 | CG2 | THR | A | 141 | −42.971 | 124.203 | −29.232 | 1.00 | 79.54 | GZ00 C |
| ATOM | 4350 | N | ALA | A | 142 | −43.506 | 125.953 | −25.756 | 1.00 | 80.86 | GZ00 N |
| ATOM | 4351 | CA | ALA | A | 142 | −42.487 | 126.212 | −24.745 | 1.00 | 77.11 | GZ00 C |
| ATOM | 4352 | C | ALA | A | 142 | −42.460 | 125.082 | −23.731 | 1.00 | 70.08 | GZ00 C |
| ATOM | 4353 | O | ALA | A | 142 | −43.508 | 124.527 | −23.382 | 1.00 | 69.86 | GZ00 O |
| ATOM | 4354 | CB | ALA | A | 142 | −42.731 | 127.539 | −24.014 | 1.00 | 76.03 | GZ00 C |
| ATOM | 4355 | N | ALA | A | 143 | −41.262 | 124.748 | −23.262 | 1.00 | 59.75 | GZ00 N |
| ATOM | 4356 | CA | ALA | A | 143 | −41.079 | 123.717 | −22.248 | 1.00 | 63.56 | GZ00 C |
| ATOM | 4357 | C | ALA | A | 143 | −40.608 | 124.351 | −20.947 | 1.00 | 58.18 | GZ00 C |
| ATOM | 4358 | O | ALA | A | 143 | −39.664 | 125.152 | −20.948 | 1.00 | 54.35 | GZ00 O |
| ATOM | 4359 | CB | ALA | A | 143 | −40.072 | 122.666 | −22.710 | 1.00 | 62.26 | GZ00 C |
| ATOM | 4360 | N | LEU | A | 144 | −41.241 | 123.961 | −19.840 | 1.00 | 51.02 | GZ00 N |
| ATOM | 4361 | CA | LEU | A | 144 | −40.864 | 124.417 | −18.507 | 1.00 | 54.73 | GZ00 C |
| ATOM | 4362 | C | LEU | A | 144 | −41.027 | 123.254 | −17.537 | 1.00 | 53.32 | GZ00 C |
| ATOM | 4363 | O | LEU | A | 144 | −41.753 | 122.293 | −17.812 | 1.00 | 53.18 | GZ00 O |
| ATOM | 4364 | CB | LEU | A | 144 | −41.709 | 125.621 | −18.047 | 1.00 | 46.73 | GZ00 C |
| ATOM | 4365 | CG | LEU | A | 144 | −43.215 | 125.351 | −17.951 | 1.00 | 56.02 | GZ00 C |
| ATOM | 4366 | CD1 | LEU | A | 144 | −43.665 | 125.025 | −16.521 | 1.00 | 52.68 | GZ00 C |
| ATOM | 4367 | CD2 | LEU | A | 144 | −44.014 | 126.520 | −18.513 | 1.00 | 58.59 | GZ00 C |
| ATOM | 4368 | N | GLY | A | 145 | −40.359 | 123.341 | −16.391 | 1.00 | 51.88 | GZ00 N |
| ATOM | 4369 | CA | GLY | A | 145 | −40.399 | 122.209 | −15.497 | 1.00 | 48.27 | GZ00 C |
| ATOM | 4370 | C | GLY | A | 145 | −39.960 | 122.514 | −14.085 | 1.00 | 51.16 | GZ00 C |
| ATOM | 4371 | O | GLY | A | 145 | −39.791 | 123.673 | −13.698 | 1.00 | 53.82 | GZ00 O |
| ATOM | 4372 | N | CYS | A | 146 | −39.798 | 121.434 | −13.315 | 1.00 | 44.69 | GZ00 N |
| ATOM | 4373 | CA | CYS | A | 146 | −39.413 | 121.470 | −11.910 | 1.00 | 47.10 | GZ00 C |
| ATOM | 4374 | C | CYS | A | 146 | −38.297 | 120.462 | −11.680 | 1.00 | 45.37 | GZ00 C |
| ATOM | 4375 | O | CYS | A | 146 | −38.433 | 119.290 | −12.038 | 1.00 | 42.62 | GZ00 O |
| ATOM | 4376 | CB | CYS | A | 146 | −40.597 | 121.139 | −10.990 | 1.00 | 47.73 | GZ00 C |
| ATOM | 4377 | SG | CYS | A | 146 | −41.531 | 122.590 | −10.443 | 1.00 | 76.23 | GZ00 S |
| ATOM | 4378 | N | LEU | A | 147 | −37.207 | 120.910 | −11.080 | 1.00 | 47.76 | GZ00 N |
| ATOM | 4379 | CA | LEU | A | 147 | −36.102 | 120.037 | −10.725 | 1.00 | 40.76 | GZ00 C |
| ATOM | 4380 | C | LEU | A | 147 | −36.281 | 119.619 | −9.279 | 1.00 | 43.78 | GZ00 C |
| ATOM | 4381 | O | LEU | A | 147 | −36.273 | 120.470 | −8.388 | 1.00 | 44.48 | GZ00 O |
| ATOM | 4382 | CB | LEU | A | 147 | −34.767 | 120.742 | −10.938 | 1.00 | 37.72 | GZ00 C |
| ATOM | 4383 | CG | LEU | A | 147 | −33.513 | 120.047 | −10.400 | 1.00 | 47.51 | GZ00 C |
| ATOM | 4384 | CD1 | LEU | A | 147 | −33.360 | 118.653 | −10.996 | 1.00 | 40.15 | GZ00 C |
| ATOM | 4385 | CD2 | LEU | A | 147 | −32.260 | 120.918 | −10.669 | 1.00 | 37.25 | GZ00 C |
| ATOM | 4386 | N | VAL | A | 148 | −36.396 | 118.311 | −9.046 | 1.00 | 48.64 | GZ00 N |
| ATOM | 4387 | CA | VAL | A | 148 | −36.699 | 117.743 | −7.733 | 1.00 | 46.35 | GZ00 C |
| ATOM | 4388 | C | VAL | A | 148 | −35.441 | 117.031 | −7.252 | 1.00 | 49.34 | GZ00 C |
| ATOM | 4389 | O | VAL | A | 148 | −35.200 | 115.861 | −7.576 | 1.00 | 50.72 | GZ00 O |
| ATOM | 4390 | CB | VAL | A | 148 | −37.896 | 116.788 | −7.790 | 1.00 | 38.94 | GZ00 C |
| ATOM | 4391 | CG1 | VAL | A | 148 | −38.234 | 116.266 | −6.410 | 1.00 | 40.39 | GZ00 C |
| ATOM | 4392 | CG2 | VAL | A | 148 | −39.087 | 117.487 | −8.380 | 1.00 | 40.04 | GZ00 C |
| ATOM | 4393 | N | LYS | A | 149 | −34.660 | 117.721 | −6.440 | 1.00 | 45.78 | GZ00 N |
| ATOM | 4394 | CA | LYS | A | 149 | −33.291 | 117.334 | −6.155 | 1.00 | 45.80 | GZ00 C |
| ATOM | 4395 | C | LYS | A | 149 | −33.137 | 116.710 | −4.774 | 1.00 | 47.10 | GZ00 C |
| ATOM | 4396 | O | LYS | A | 149 | −33.791 | 117.126 | −3.815 | 1.00 | 47.43 | GZ00 O |
| ATOM | 4397 | CB | LYS | A | 149 | −32.379 | 118.554 | −6.266 | 1.00 | 47.24 | GZ00 C |
| ATOM | 4398 | CG | LYS | A | 149 | −31.174 | 118.293 | −7.097 | 1.00 | 56.69 | GZ00 C |
| ATOM | 4399 | CD | LYS | A | 149 | −29.975 | 119.004 | −6.564 | 1.00 | 59.82 | GZ00 C |
| ATOM | 4400 | CE | LYS | A | 149 | −30.099 | 120.481 | −6.760 | 1.00 | 57.45 | GZ00 C |
| ATOM | 4401 | NZ | LYS | A | 149 | −28.781 | 121.117 | −6.434 | 1.00 | 60.94 | GZ00 N1+ |
| ATOM | 4402 | N | ASP | A | 150 | −32.254 | 115.710 | −4.694 | 1.00 | 49.92 | GZ00 N |
| ATOM | 4403 | CA | ASP | A | 150 | −31.630 | 115.231 | −3.456 | 1.00 | 45.59 | GZ00 C |
| ATOM | 4404 | C | ASP | A | 150 | −32.643 | 114.736 | −2.423 | 1.00 | 44.92 | GZ00 C |
| ATOM | 4405 | O | ASP | A | 150 | −32.679 | 115.208 | −1.289 | 1.00 | 51.88 | GZ00 O |
| ATOM | 4406 | CB | ASP | A | 150 | −30.741 | 116.314 | −2.838 | 1.00 | 42.77 | GZ00 C |
| ATOM | 4407 | CG | ASP | A | 150 | −29.533 | 116.637 | −3.689 | 1.00 | 56.92 | GZ00 C |
| ATOM | 4408 | OD1 | ASP | A | 150 | −29.136 | 115.782 | −4.512 | 1.00 | 57.01 | GZ00 O |
| ATOM | 4409 | OD2 | ASP | A | 150 | −28.970 | 117.747 | −3.525 | 1.00 | 62.51 | GZ00 O1− |
| ATOM | 4410 | N | TYR | A | 151 | −33.415 | 113.725 | −2.802 | 1.00 | 45.00 | GZ00 N |
| ATOM | 4411 | CA | TYR | A | 151 | −34.367 | 113.102 | −1.894 | 1.00 | 49.20 | GZ00 C |
| ATOM | 4412 | C | TYR | A | 151 | −34.088 | 111.606 | −1.765 | 1.00 | 57.02 | GZ00 C |
| ATOM | 4413 | O | TYR | A | 151 | −33.356 | 111.009 | −2.563 | 1.00 | 54.16 | GZ00 O |
| ATOM | 4414 | CB | TYR | A | 151 | −35.807 | 113.316 | −2.346 | 1.00 | 41.84 | GZ00 C |
| ATOM | 4415 | CG | TYR | A | 151 | −36.146 | 112.630 | −3.642 | 1.00 | 53.39 | GZ00 C |

TABLE 10.3-continued

| ATOM | 4416 | CD1 | TYR | A | 151 | −36.579 | 111.294 | −3.672 | 1.00 | 58.67 | GZ00 C |
|---|---|---|---|---|---|---|---|---|---|---|---|
| ATOM | 4417 | CD2 | TYR | A | 151 | −36.045 | 113.316 | −4.845 | 1.00 | 47.72 | GZ00 C |
| ATOM | 4418 | CE1 | TYR | A | 151 | −36.898 | 110.679 | −4.879 | 1.00 | 55.52 | GZ00 C |
| ATOM | 4419 | CE2 | TYR | A | 151 | −36.365 | 112.718 | −6.041 | 1.00 | 47.90 | GZ00 C |
| ATOM | 4420 | CZ | TYR | A | 151 | −36.782 | 111.403 | −6.063 | 1.00 | 54.44 | GZ00 C |
| ATOM | 4421 | OH | TYR | A | 151 | −37.077 | 110.834 | −7.286 | 1.00 | 56.96 | GZ00 O |
| ATOM | 4422 | N | PHE | A | 152 | −34.688 | 111.011 | −0.737 | 1.00 | 52.17 | GZ00 N |
| ATOM | 4423 | CA | PHE | A | 152 | −34.494 | 109.613 | −0.424 | 1.00 | 56.95 | GZ00 C |
| ATOM | 4424 | C | PHE | A | 152 | −35.543 | 109.170 | 0.575 | 1.00 | 59.21 | GZ00 C |
| ATOM | 4425 | O | PHE | A | 152 | −35.877 | 109.929 | 1.472 | 1.00 | 56.82 | GZ00 O |
| ATOM | 4426 | CB | PHE | A | 152 | −33.097 | 109.382 | 0.144 | 1.00 | 56.68 | GZ00 C |
| ATOM | 4427 | CG | PHE | A | 152 | −32.764 | 107.946 | 0.349 | 1.00 | 56.75 | GZ00 C |
| ATOM | 4428 | CD1 | PHE | A | 152 | −33.106 | 107.301 | 1.528 | 1.00 | 57.37 | GZ00 C |
| ATOM | 4429 | CD2 | PHE | A | 152 | −32.097 | 107.233 | −0.640 | 1.00 | 61.45 | GZ00 C |
| ATOM | 4430 | CE1 | PHE | A | 152 | −32.796 | 105.963 | 1.718 | 1.00 | 62.30 | GZ00 C |
| ATOM | 4431 | CE2 | PHE | A | 152 | −31.784 | 105.899 | −0.457 | 1.00 | 54.88 | GZ00 C |
| ATOM | 4432 | CZ | PHE | A | 152 | −32.136 | 105.258 | 0.722 | 1.00 | 52.68 | GZ00 C |
| ATOM | 4433 | N | PRO | A | 153 | −36.081 | 107.947 | 0.414 | 1.00 | 64.15 | GZ00 N |
| ATOM | 4434 | CA | PRO | A | 153 | −35.890 | 107.052 | −0.728 | 1.00 | 60.57 | GZ00 C |
| ATOM | 4435 | C | PRO | A | 153 | −36.949 | 107.343 | −1.784 | 1.00 | 57.01 | GZ00 C |
| ATOM | 4436 | O | PRO | A | 153 | −37.736 | 108.261 | −1.579 | 1.00 | 57.18 | GZ00 O |
| ATOM | 4437 | CB | PRO | A | 153 | −36.104 | 105.684 | −0.109 | 1.00 | 56.69 | GZ00 C |
| ATOM | 4438 | CG | PRO | A | 153 | −37.250 | 105.962 | 0.843 | 1.00 | 50.72 | GZ00 C |
| ATOM | 4439 | CD | PRO | A | 153 | −36.942 | 107.317 | 1.434 | 1.00 | 59.37 | GZ00 C |
| ATOM | 4440 | N | GLU | A | 154 | −37.022 | 106.550 | −2.848 | 1.00 | 55.69 | GZ00 N |
| ATOM | 4441 | CA | GLU | A | 154 | −38.086 | 106.727 | −3.833 | 1.00 | 52.35 | GZ00 C |
| ATOM | 4442 | C | GLU | A | 154 | −39.389 | 106.318 | −3.182 | 1.00 | 47.39 | GZ00 C |
| ATOM | 4443 | O | GLU | A | 154 | −39.364 | 105.619 | −2.171 | 1.00 | 52.96 | GZ00 O |
| ATOM | 4444 | CB | GLU | A | 154 | −37.805 | 105.905 | −5.093 | 1.00 | 53.56 | GZ00 C |
| ATOM | 4445 | CG | GLU | A | 154 | −36.530 | 106.322 | −5.818 | 1.00 | 58.65 | GZ00 C |
| ATOM | 4446 | CD | GLU | A | 154 | −36.727 | 106.415 | −7.315 | 1.00 | 67.26 | GZ00 C |
| ATOM | 4447 | OE1 | GLU | A | 154 | −36.043 | 105.662 | −8.041 | 1.00 | 74.85 | GZ00 O |
| ATOM | 4448 | OE2 | GLU | A | 154 | −37.572 | 107.227 | −7.765 | 1.00 | 66.72 | GZ00 O1− |
| ATOM | 4449 | N | PRO | A | 155 | −40.533 | 106.779 | −3.713 | 1.00 | 45.32 | GZ00 N |
| ATOM | 4450 | CA | PRO | A | 155 | −40.792 | 107.703 | −4.827 | 1.00 | 55.68 | GZ00 C |
| ATOM | 4451 | C | PRO | A | 155 | −41.144 | 109.144 | −4.437 | 1.00 | 57.15 | GZ00 C |
| ATOM | 4452 | O | PRO | A | 155 | −41.413 | 109.427 | −3.272 | 1.00 | 61.59 | GZ00 O |
| ATOM | 4453 | CB | PRO | A | 155 | −42.020 | 107.086 | −5.474 | 1.00 | 54.31 | GZ00 C |
| ATOM | 4454 | CG | PRO | A | 155 | −42.813 | 106.627 | −4.281 | 1.00 | 36.78 | GZ00 C |
| ATOM | 4455 | CD | PRO | A | 155 | −41.792 | 106.177 | −3.235 | 1.00 | 36.78 | GZ00 C |
| ATOM | 4456 | N | VAL | A | 156 | −41.135 | 110.047 | −5.417 | 1.00 | 56.20 | GZ00 N |
| ATOM | 4457 | CA | VAL | A | 156 | −41.884 | 111.294 | −5.339 | 1.00 | 56.13 | GZ00 C |
| ATOM | 4458 | C | VAL | A | 156 | −42.962 | 111.242 | −6.407 | 1.00 | 55.59 | GZ00 C |
| ATOM | 4459 | O | VAL | A | 156 | −42.818 | 110.570 | −7.432 | 1.00 | 66.78 | GZ00 O |
| ATOM | 4460 | CB | VAL | A | 156 | −41.023 | 112.567 | −5.514 | 1.00 | 57.46 | GZ00 C |
| ATOM | 4461 | CG1 | VAL | A | 156 | −40.008 | 112.698 | −4.399 | 1.00 | 56.24 | GZ00 C |
| ATOM | 4462 | CG2 | VAL | A | 156 | −40.327 | 112.555 | −6.838 | 1.00 | 58.46 | GZ00 C |
| ATOM | 4463 | N | THR | A | 157 | −44.052 | 111.949 | −6.156 | 1.00 | 55.63 | GZ00 N |
| ATOM | 4464 | CA | THR | A | 157 | −45.091 | 112.189 | −7.145 | 1.00 | 48.48 | GZ00 C |
| ATOM | 4465 | C | THR | A | 157 | −45.079 | 113.673 | −7.480 | 1.00 | 56.97 | GZ00 C |
| ATOM | 4466 | 0 | THR | A | 157 | −44.819 | 114.506 | −6.606 | 1.00 | 54.54 | GZ00 0 |
| ATOM | 4467 | CB | THR | A | 157 | −46.464 | 111.777 | −6.608 | 1.00 | 58.63 | GZ00 C |
| ATOM | 4468 | OG1 | THR | A | 157 | −46.837 | 112.659 | −5.542 | 1.00 | 69.16 | GZ00 O |
| ATOM | 4469 | CG2 | THR | A | 157 | −46.413 | 110.369 | −6.046 | 1.00 | 52.02 | GZ00 C |
| ATOM | 4470 | N | VAL | A | 158 | −45.317 | 114.003 | −8.747 | 1.00 | 52.48 | GZ00 N |
| ATOM | 4471 | CA | VAL | A | 158 | −45.344 | 115.385 | −9.209 | 1.00 | 49.55 | GZ00 C |
| ATOM | 4472 | C | VAL | A | 158 | −46.619 | 115.606 | −10.001 | 1.00 | 53.68 | GZ00 C |
| ATOM | 4473 | O | VAL | A | 158 | −46.942 | 114.809 | −10.885 | 1.00 | 58.24 | GZ00 O |
| ATOM | 4474 | CB | VAL | A | 158 | −44.131 | 115.743 | −10.087 | 1.00 | 53.34 | GZ00 C |
| ATOM | 4475 | CG1 | VAL | A | 158 | −44.181 | 117.245 | −10.447 | 1.00 | 47.23 | GZ00 C |
| ATOM | 4476 | CG2 | VAL | A | 158 | −42.819 | 115.357 | −9.407 | 1.00 | 50.02 | GZ00 C |
| ATOM | 4477 | N | SER | A | 159 | −47.337 | 116.684 | −9.693 | 1.00 | 53.96 | GZ00 N |
| ATOM | 4478 | CA | SER | A | 159 | −48.485 | 117.098 | −10.485 | 1.00 | 54.02 | GZ00 C |
| ATOM | 4479 | C | SER | A | 159 | −48.334 | 118.563 | −10.856 | 1.00 | 57.99 | GZ00 C |
| ATOM | 4480 | O | SER | A | 159 | −47.487 | 119.282 | −10.319 | 1.00 | 58.35 | GZ00 O |
| ATOM | 4481 | CB | SER | A | 159 | −49.802 | 116.870 | −9.741 | 1.00 | 57.03 | GZ00 C |
| ATOM | 4482 | OG | SER | A | 159 | −49.841 | 117.623 | −8.548 | 1.00 | 64.29 | GZ00 O |
| ATOM | 4483 | N | TRP | A | 160 | −49.143 | 119.008 | −11.804 | 1.00 | 52.93 | GZ00 N |
| ATOM | 4484 | CA | TRP | A | 160 | −49.127 | 120.403 | −12.198 | 1.00 | 53.69 | GZ00 C |
| ATOM | 4485 | C | TRP | A | 160 | −50.507 | 120.996 | −11.965 | 1.00 | 60.22 | GZ00 C |
| ATOM | 4486 | O | TRP | A | 160 | −51.524 | 120.353 | −12.254 | 1.00 | 56.05 | GZ00 O |
| ATOM | 4487 | CB | TRP | A | 160 | −48.667 | 120.551 | −13.654 | 1.00 | 52.01 | GZ00 C |
| ATOM | 4488 | CG | TRP | A | 160 | −47.199 | 120.239 | −13.791 | 1.00 | 61.18 | GZ00 C |
| ATOM | 4489 | CD1 | TRP | A | 160 | −46.630 | 119.002 | −13.982 | 1.00 | 51.63 | GZ00 C |
| ATOM | 4490 | CD2 | TRP | A | 160 | −46.108 | 121.169 | −13.703 | 1.00 | 51.85 | GZ00 C |
| ATOM | 4491 | NE1 | TRP | A | 160 | −45.260 | 119.116 | −14.035 | 1.00 | 51.65 | GZ00 N |
| ATOM | 4492 | CE2 | TRP | A | 160 | −44.914 | 120.433 | −13.871 | 1.00 | 55.17 | GZ00 C |
| ATOM | 4493 | CE3 | TRP | A | 160 | −46.025 | 122.550 | −13.513 | 1.00 | 49.96 | GZ00 C |
| ATOM | 4494 | CZ2 | TRP | A | 160 | −43.654 | 121.035 | −13.847 | 1.00 | 52.75 | GZ00 C |
| ATOM | 4495 | CZ3 | TRP | A | 160 | −44.772 | 123.148 | −13.502 | 1.00 | 55.98 | GZ00 C |

TABLE 10.3-continued

| ATOM | 4496 | CH2 | TRP | A | 160 | −43.604 | 122.389 | −13.663 | 1.00 | 51.25 | GZ00 C |
| ATOM | 4497 | N | ASN | A | 161 | −50.521 | 122.215 | −11.417 | 1.00 | 59.30 | GZ00 N |
| ATOM | 4498 | CA | ASN | A | 161 | −51.738 | 122.946 | −11.048 | 1.00 | 53.77 | GZ00 C |
| ATOM | 4499 | C | ASN | A | 161 | −52.737 | 122.039 | −10.336 | 1.00 | 58.01 | GZ00 C |
| ATOM | 4500 | O | ASN | A | 161 | −53.929 | 122.014 | −10.642 | 1.00 | 64.68 | GZ00 O |
| ATOM | 4501 | CB | ASN | A | 161 | −52.353 | 123.615 | −12.267 | 1.00 | 42.97 | GZ00 C |
| ATOM | 4502 | CG | ASN | A | 161 | −51.430 | 124.645 | −12.851 | 1.00 | 59.88 | GZ00 C |
| ATOM | 4503 | OD1 | ASN | A | 161 | −50.421 | 124.988 | −12.231 | 1.00 | 57.52 | GZ00 O |
| ATOM | 4504 | ND2 | ASN | A | 161 | −51.743 | 125.141 | −14.043 | 1.00 | 62.17 | GZ00 N |
| ATOM | 4505 | N | SER | A | 162 | −52.218 | 121.280 | −9.367 | 1.00 | 60.34 | GZ00 N |
| ATOM | 4506 | CA | SER | A | 162 | −53.022 | 120.430 | −8.483 | 1.00 | 66.27 | GZ00 C |
| ATOM | 4507 | C | SER | A | 162 | −53.790 | 119.353 | −9.244 | 1.00 | 71.65 | GZ00 C |
| ATOM | 4508 | O | SER | A | 162 | −54.873 | 118.941 | −8.821 | 1.00 | 79.00 | GZ00 O |
| ATOM | 4509 | CB | SER | A | 162 | −53.984 | 121.273 | −7.641 | 1.00 | 67.29 | GZ00 C |
| ATOM | 4510 | OG | SER | A | 162 | −53.287 | 122.322 | −6.987 | 1.00 | 70.91 | GZ00 O |
| ATOM | 4511 | N | GLY | A | 163 | −53.224 | 118.858 | −10.349 | 1.00 | 70.85 | GZ00 N |
| ATOM | 4512 | CA | GLY | A | 163 | −53.876 | 117.868 | −11.181 | 1.00 | 59.17 | GZ00 C |
| ATOM | 4513 | C | GLY | A | 163 | −54.598 | 118.443 | −12.385 | 1.00 | 68.56 | GZ00 C |
| ATOM | 4514 | O | GLY | A | 163 | −55.017 | 117.675 | −13.255 | 1.00 | 76.49 | GZ00 O |
| ATOM | 4515 | N | ALA | A | 164 | −54.744 | 119.772 | −12.463 | 1.00 | 67.36 | GZ00 N |
| ATOM | 4516 | CA | ALA | A | 164 | −55.483 | 120.392 | −13.561 | 1.00 | 63.96 | GZ00 C |
| ATOM | 4517 | C | ALA | A | 164 | −54.755 | 120.239 | −14.885 | 1.00 | 68.34 | GZ00 C |
| ATOM | 4518 | O | ALA | A | 164 | −55.391 | 120.060 | −15.927 | 1.00 | 75.07 | GZ00 O |
| ATOM | 4519 | CB | ALA | A | 164 | −55.712 | 121.879 | −13.280 | 1.00 | 57.29 | GZ00 C |
| ATOM | 4520 | N | LEU | A | 165 | −53.431 | 120.361 | −14.874 | 1.00 | 70.33 | GZ00 N |
| ATOM | 4521 | CA | LEU | A | 165 | −52.620 | 120.265 | −16.082 | 1.00 | 64.91 | GZ00 C |
| ATOM | 4522 | C | LEU | A | 165 | −52.055 | 118.846 | −16.163 | 1.00 | 69.76 | GZ00 C |
| ATOM | 4523 | O | LEU | A | 165 | −51.263 | 118.438 | −15.303 | 1.00 | 66.93 | GZ00 O |
| ATOM | 4524 | CB | LEU | A | 165 | −51.521 | 121.324 | −16.062 | 1.00 | 64.77 | GZ00 C |
| ATOM | 4525 | CG | LEU | A | 165 | −50.556 | 121.397 | −17.245 | 1.00 | 68.60 | GZ00 C |
| ATOM | 4526 | CD1 | LEU | A | 165 | −51.313 | 121.483 | −18.560 | 1.00 | 68.89 | GZ00 C |
| ATOM | 4527 | CD2 | LEU | A | 165 | −49.654 | 122.612 | −17.083 | 1.00 | 68.22 | GZ00 C |
| ATOM | 4528 | N | THR | A | 166 | −52.506 | 118.076 | −17.164 | 1.00 | 75.54 | GZ00 N |
| ATOM | 4529 | CA | THR | A | 166 | −52.042 | 116.700 | −17.363 | 1.00 | 72.10 | GZ00 C |
| ATOM | 4530 | C | THR | A | 166 | −51.554 | 116.504 | −18.792 | 1.00 | 68.22 | GZ00 C |
| ATOM | 4531 | O | THR | A | 166 | −50.624 | 115.732 | −19.042 | 1.00 | 71.78 | GZ00 O |
| ATOM | 4532 | CB | THR | A | 166 | −53.133 | 115.662 | −17.055 | 1.00 | 67.33 | GZ00 C |
| ATOM | 4533 | OG1 | THR | A | 166 | −54.242 | 115.850 | −17.938 | 1.00 | 72.47 | GZ00 O |
| ATOM | 4534 | CG2 | THR | A | 166 | −53.609 | 115.751 | −15.608 | 1.00 | 70.69 | GZ00 C |
| ATOM | 4535 | N | SER | A | 167 | −52.193 | 117.175 | −19.742 | 1.00 | 70.73 | GZ00 N |
| ATOM | 4536 | CA | SER | A | 167 | −51.742 | 117.096 | −21.121 | 1.00 | 77.77 | GZ00 C |
| ATOM | 4537 | C | SER | A | 167 | −50.357 | 117.710 | −21.242 | 1.00 | 66.92 | GZ00 C |
| ATOM | 4538 | O | SER | A | 167 | −50.104 | 118.796 | −20.717 | 1.00 | 69.96 | GZ00 O |
| ATOM | 4539 | CB | SER | A | 167 | −52.734 | 117.819 | −22.039 | 1.00 | 74.39 | GZ00 C |
| ATOM | 4540 | OG | SER | A | 167 | −52.114 | 118.270 | −23.233 | 1.00 | 68.17 | GZ00 O |
| ATOM | 4541 | N | GLY | A | 168 | −49.455 | 117.012 | −21.932 | 1.00 | 64.19 | GZ00 N |
| ATOM | 4542 | CA | GLY | A | 168 | −48.125 | 117.554 | −22.141 | 1.00 | 62.50 | GZ00 C |
| ATOM | 4543 | C | GLY | A | 168 | −47.169 | 117.414 | −20.977 | 1.00 | 58.51 | GZ00 C |
| ATOM | 4544 | O | GLY | A | 168 | −46.115 | 118.053 | −20.994 | 1.00 | 54.75 | GZ00 O |
| ATOM | 4545 | N | VAL | A | 169 | −47.512 | 116.619 | −19.963 | 1.00 | 59.87 | GZ00 N |
| ATOM | 4546 | CA | VAL | A | 169 | −46.709 | 116.442 | −18.757 | 1.00 | 53.22 | GZ00 C |
| ATOM | 4547 | C | VAL | A | 169 | −45.837 | 115.206 | −18.906 | 1.00 | 57.24 | GZ00 C |
| ATOM | 4548 | O | VAL | A | 169 | −46.341 | 114.121 | −19.219 | 1.00 | 54.95 | GZ00 O |
| ATOM | 4549 | CB | VAL | A | 169 | −47.605 | 116.322 | −17.514 | 1.00 | 52.90 | GZ00 C |
| ATOM | 4550 | CG1 | VAL | A | 169 | −46.789 | 115.872 | −16.311 | 1.00 | 50.21 | GZ00 C |
| ATOM | 4551 | CG2 | VAL | A | 169 | −48.279 | 117.657 | −17.237 | 1.00 | 56.97 | GZ00 C |
| ATOM | 4552 | N | HIS | A | 170 | −44.533 | 115.362 | −18.656 | 1.00 | 49.30 | GZ00 N |
| ATOM | 4553 | CA | HIS | A | 170 | −43.571 | 114.263 | −18.742 | 1.00 | 46.23 | GZ00 C |
| ATOM | 4554 | C | HIS | A | 170 | −42.653 | 114.312 | −17.519 | 1.00 | 45.18 | GZ00 C |
| ATOM | 4555 | O | HIS | A | 170 | −41.702 | 115.095 | −17.482 | 1.00 | 48.42 | GZ00 O |
| ATOM | 4556 | CB | HIS | A | 170 | −42.786 | 114.360 | −20.050 | 1.00 | 46.88 | GZ00 C |
| ATOM | 4557 | CG | HIS | A | 170 | −41.995 | 113.136 | −20.400 | 1.00 | 50.83 | GZ00 C |
| ATOM | 4558 | ND1 | HIS | A | 170 | −41.756 | 112.109 | −19.507 | 1.00 | 51.60 | GZ00 N |
| ATOM | 4559 | CD2 | HIS | A | 170 | −41.374 | 112.784 | −21.551 | 1.00 | 45.43 | GZ00 C |
| ATOM | 4560 | CE1 | HIS | A | 170 | −41.020 | 111.180 | −20.092 | 1.00 | 44.58 | GZ00 C |
| ATOM | 4561 | NE2 | HIS | A | 170 | −40.776 | 111.565 | −21.332 | 1.00 | 49.60 | GZ00 N |
| ATOM | 4562 | N | THR | A | 171 | −42.927 | 113.466 | −16.529 | 1.00 | 43.26 | GZ00 N |
| ATOM | 4563 | CA | THR | A | 171 | −42.052 | 113.277 | −15.380 | 1.00 | 42.92 | GZ00 C |
| ATOM | 4564 | C | THR | A | 171 | −41.082 | 112.128 | −15.662 | 1.00 | 43.51 | GZ00 C |
| ATOM | 4565 | O | THR | A | 171 | −41.505 | 111.018 | −15.974 | 1.00 | 42.46 | GZ00 O |
| ATOM | 4566 | CB | THR | A | 171 | −42.883 | 113.022 | −14.124 | 1.00 | 37.89 | GZ00 C |
| ATOM | 4567 | OG1 | THR | A | 171 | −43.681 | 114.176 | −13.878 | 1.00 | 47.19 | GZ00 O |
| ATOM | 4568 | CG2 | THR | A | 171 | −42.006 | 112.776 | −12.906 | 1.00 | 32.66 | GZ00 C |
| ATOM | 4569 | N | PHE | A | 172 | −39.793 | 112.421 | −15.634 | 1.00 | 46.02 | GZ00 N |
| ATOM | 4570 | CA | PHE | A | 172 | −38.722 | 111.494 | −15.965 | 1.00 | 45.07 | GZ00 C |
| ATOM | 4571 | C | PHE | A | 172 | −38.336 | 110.651 | −14.754 | 1.00 | 49.93 | GZ00 C |
| ATOM | 4572 | O | PHE | A | 172 | −38.364 | 111.141 | −13.628 | 1.00 | 51.84 | GZ00 O |
| ATOM | 4573 | CB | PHE | A | 172 | −37.501 | 112.256 | −16.475 | 1.00 | 38.72 | GZ00 C |
| ATOM | 4574 | CG | PHE | A | 172 | −37.680 | 112.793 | −17.855 | 1.00 | 43.18 | GZ00 C |
| ATOM | 4575 | CD1 | PHE | A | 172 | −38.599 | 113.810 | −18.104 | 1.00 | 42.98 | GZ00 C |

TABLE 10.3-continued

| | | | | | | | | | | |
|---|---|---|---|---|---|---|---|---|---|---|
| ATOM | 4576 | CD2 | PHE | A | 172 | −36.942 | 112.277 | −18.917 | 1.00 | 40.18 GZ00 C |
| ATOM | 4577 | CE1 | PHE | A | 172 | −38.782 | 114.304 | −19.389 | 1.00 | 43.59 GZ00 C |
| ATOM | 4578 | CE2 | PHE | A | 172 | −37.108 | 112.779 | −20.216 | 1.00 | 44.39 GZ00 C |
| ATOM | 4579 | CZ | PHE | A | 172 | −38.030 | 113.797 | −20.449 | 1.00 | 45.10 GZ00 C |
| ATOM | 4580 | N | PRO | A | 173 | −37.971 | 109.388 | −14.970 | 1.00 | 45.23 GZ00 N |
| ATOM | 4581 | CA | PRO | A | 173 | −37.427 | 108.573 | −13.877 | 1.00 | 46.41 GZ00 C |
| ATOM | 4582 | C | PRO | A | 173 | −36.181 | 109.215 | −13.275 | 1.00 | 46.24 GZ00 C |
| ATOM | 4583 | O | PRO | A | 173 | −35.412 | 109.890 | −13.963 | 1.00 | 49.60 GZ00 O |
| ATOM | 4584 | CB | PRO | A | 173 | −37.083 | 107.243 | −14.568 | 1.00 | 43.84 GZ00 C |
| ATOM | 4585 | CG | PRO | A | 173 | −37.966 | 107.212 | −15.777 | 1.00 | 42.54 GZ00 C |
| ATOM | 4586 | CD | PRO | A | 173 | −38.103 | 108.633 | −16.230 | 1.00 | 42.67 GZ00 C |
| ATOM | 4587 | N | ALA | A | 174 | −35.971 | 108.971 | −11.983 | 1.00 | 43.82 GZ00 N |
| ATOM | 4588 | CA | ALA | A | 174 | −34.906 | 109.615 | −11.225 | 1.00 | 43.70 GZ00 C |
| ATOM | 4589 | C | ALA | A | 174 | −33.520 | 109.033 | −11.547 | 1.00 | 43.64 GZ00 C |
| ATOM | 4590 | O | ALA | A | 174 | −33.392 | 107.905 | −12.020 | 1.00 | 48.77 GZ00 O |
| ATOM | 4591 | CB | ALA | A | 174 | −35.195 | 109.486 | −9.733 | 1.00 | 46.19 GZ00 C |
| ATOM | 4592 | N | VAL | A | 175 | −32.460 | 109.857 | −11.304 | 1.00 | 40.72 GZ00 N |
| ATOM | 4593 | CA | VAL | A | 175 | −31.066 | 109.414 | −11.216 | 1.00 | 40.07 GZ00 C |
| ATOM | 4594 | C | VAL | A | 175 | −30.766 | 109.037 | −9.779 | 1.00 | 49.10 GZ00 C |
| ATOM | 4595 | O | VAL | A | 175 | −31.260 | 109.680 | −8.847 | 1.00 | 49.26 GZ00 O |
| ATOM | 4596 | CB | VAL | A | 175 | −30.053 | 110.495 | −11.665 | 1.00 | 47.05 GZ00 C |
| ATOM | 4597 | CG1 | VAL | A | 175 | −29.752 | 110.424 | −13.122 | 1.00 | 49.41 GZ00 C |
| ATOM | 4598 | CG2 | VAL | A | 175 | −30.479 | 111.906 | −11.241 | 1.00 | 43.16 GZ00 C |
| ATOM | 4599 | N | LEU | A | 176 | −29.930 | 108.011 | −9.593 | 1.00 | 45.95 GZ00 N |
| ATOM | 4600 | CA | LEU | A | 176 | −29.317 | 107.724 | −8.305 | 1.00 | 45.89 GZ00 C |
| ATOM | 4601 | C | LEU | A | 176 | −27.916 | 108.315 | −8.322 | 1.00 | 50.82 GZ00 C |
| ATOM | 4602 | O | LEU | A | 176 | −27.048 | 107.853 | −9.066 | 1.00 | 64.34 GZ00 O |
| ATOM | 4603 | CB | LEU | A | 176 | −29.278 | 106.231 | −8.012 | 1.00 | 50.15 GZ00 C |
| ATOM | 4604 | CG | LEU | A | 176 | −28.524 | 105.913 | −6.714 | 1.00 | 55.35 GZ00 C |
| ATOM | 4605 | CD1 | LEU | A | 176 | −29.054 | 106.726 | −5.525 | 1.00 | 46.25 GZ00 C |
| ATOM | 4606 | CD2 | LEU | A | 176 | −28.546 | 104.409 | −6.408 | 1.00 | 46.32 GZ00 C |
| ATOM | 4607 | N | GLN | A | 177 | −27.691 | 109.322 | −7.492 | 1.00 | 52.50 GZ00 N |
| ATOM | 4608 | CA | GLN | A | 177 | −26.422 | 110.026 | −7.518 | 1.00 | 63.27 GZ00 C |
| ATOM | 4609 | C | GLN | A | 177 | −25.368 | 109.285 | −6.697 | 1.00 | 56.88 GZ00 C |
| ATOM | 4610 | O | GLN | A | 177 | −25.678 | 108.456 | −5.831 | 1.00 | 51.21 GZ00 O |
| ATOM | 4611 | CB | GLN | A | 177 | −26.600 | 111.448 | −6.985 | 1.00 | 64.89 GZ00 C |
| ATOM | 4612 | CG | GLN | A | 177 | −27.646 | 112.247 | −7.732 | 1.00 | 67.73 GZ00 C |
| ATOM | 4613 | CD | GLN | A | 177 | −27.955 | 113.563 | −7.061 | 1.00 | 68.75 GZ00 C |
| ATOM | 4614 | OE1 | GLN | A | 177 | −27.236 | 114.552 | −7.240 | 1.00 | 87.07 GZ00 O |
| ATOM | 4615 | NE2 | GLN | A | 177 | −29.018 | 113.581 | −6.259 | 1.00 | 58.03 GZ00 N |
| ATOM | 4616 | N | SER | A | 178 | −24.100 | 109.596 | −6.997 | 1.00 | 53.78 GZ00 N |
| ATOM | 4617 | CA | SER | A | 178 | −22.982 | 109.070 | −6.216 | 1.00 | 54.16 GZ00 C |
| ATOM | 4618 | C | SER | A | 178 | −23.113 | 109.421 | −4.744 | 1.00 | 58.69 GZ00 C |
| ATOM | 4619 | O | SER | A | 178 | −22.550 | 108.730 | −3.889 | 1.00 | 66.24 GZ00 O |
| ATOM | 4620 | CB | SER | A | 178 | −21.648 | 109.588 | −6.769 | 1.00 | 54.96 GZ00 C |
| ATOM | 4621 | OG | SER | A | 178 | −21.589 | 111.004 | −6.780 | 1.00 | 68.48 GZ00 O |
| ATOM | 4622 | N | SER | A | 179 | −23.821 | 110.508 | −4.432 | 1.00 | 59.99 GZ00 N |
| ATOM | 4623 | CA | SER | A | 179 | −24.134 | 110.871 | −3.058 | 1.00 | 57.94 GZ00 C |
| ATOM | 4624 | C | SER | A | 179 | −25.059 | 109.870 | −2.372 | 1.00 | 50.10 GZ00 C |
| ATOM | 4625 | O | SER | A | 179 | −25.232 | 109.952 | −1.154 | 1.00 | 50.29 GZ00 O |
| ATOM | 4626 | CB | SER | A | 179 | −24.787 | 112.254 | −3.030 | 1.00 | 52.99 GZ00 C |
| ATOM | 4627 | OG | SER | A | 179 | −26.135 | 112.159 | −3.478 | 1.00 | 61.58 GZ00 O |
| ATOM | 4628 | N | GLY | A | 180 | −25.671 | 108.949 | −3.113 | 1.00 | 43.93 GZ00 N |
| ATOM | 4629 | CA | GLY | A | 180 | −26.698 | 108.079 | −2.571 | 1.00 | 44.88 GZ00 C |
| ATOM | 4630 | C | GLY | A | 180 | −28.110 | 108.631 | −2.606 | 1.00 | 52.65 GZ00 C |
| ATOM | 4631 | O | GLY | A | 180 | −29.037 | 107.923 | −2.196 | 1.00 | 57.69 GZ00 O |
| ATOM | 4632 | N | LEU | A | 181 | −28.306 | 109.863 | −3.094 | 1.00 | 54.40 GZ00 N |
| ATOM | 4633 | CA | LEU | A | 181 | −29.609 | 110.513 | −3.171 | 1.00 | 55.39 GZ00 C |
| ATOM | 4634 | C | LEU | A | 181 | −30.141 | 110.518 | −4.600 | 1.00 | 52.55 GZ00 C |
| ATOM | 4635 | O | LEU | A | 181 | −29.377 | 110.492 | −5.571 | 1.00 | 47.86 GZ00 O |
| ATOM | 4636 | CB | LEU | A | 181 | −29.523 | 111.954 | −2.660 | 1.00 | 50.22 GZ00 C |
| ATOM | 4637 | CG | LEU | A | 181 | −29.108 | 112.109 | −1.207 | 1.00 | 54.13 GZ00 C |
| ATOM | 4638 | CD1 | LEU | A | 181 | −28.919 | 113.590 | −0.837 | 1.00 | 45.91 GZ00 C |
| ATOM | 4639 | CD2 | LEU | A | 181 | −30.175 | 111.435 | −0.357 | 1.00 | 50.94 GZ00 C |
| ATOM | 4640 | N | TYR | A | 182 | −31.469 | 110.607 | −4.712 | 1.00 | 45.18 GZ00 N |
| ATOM | 4641 | CA | TYR | A | 182 | −32.159 | 110.643 | −5.991 | 1.00 | 44.17 GZ00 C |
| ATOM | 4642 | C | TYR | A | 182 | −32.489 | 112.069 | −6.403 | 1.00 | 48.41 GZ00 C |
| ATOM | 4643 | O | TYR | A | 182 | −32.683 | 112.946 | −5.562 | 1.00 | 50.13 GZ00 O |
| ATOM | 4644 | CB | TYR | A | 182 | −33.454 | 109.832 | −5.939 | 1.00 | 51.31 GZ00 C |
| ATOM | 4645 | CG | TYR | A | 182 | −33.222 | 108.357 | −5.719 | 1.00 | 51.52 GZ00 C |
| ATOM | 4646 | CD1 | TYR | A | 182 | −32.971 | 107.499 | −6.796 | 1.00 | 53.09 GZ00 C |
| ATOM | 4647 | CD2 | TYR | A | 182 | −33.255 | 107.817 | −4.441 | 1.00 | 49.04 GZ00 C |
| ATOM | 4648 | CE1 | TYR | A | 182 | −32.746 | 106.144 | −6.595 | 1.00 | 57.42 GZ00 C |
| ATOM | 4649 | CE2 | TYR | A | 182 | −33.037 | 106.464 | −4.231 | 1.00 | 58.73 GZ00 C |
| ATOM | 4650 | CZ | TYR | A | 182 | −32.784 | 105.634 | −5.305 | 1.00 | 56.88 GZ00 C |
| ATOM | 4651 | OH | TYR | A | 182 | −32.567 | 104.299 | −5.082 | 1.00 | 64.47 GZ00 O |
| ATOM | 4652 | N | SER | A | 183 | −32.565 | 112.285 | −7.718 | 1.00 | 46.87 GZ00 N |
| ATOM | 4653 | CA | SER | A | 183 | −33.102 | 113.509 | −8.298 | 1.00 | 44.44 GZ00 C |
| ATOM | 4654 | C | SER | A | 183 | −33.911 | 113.162 | −9.541 | 1.00 | 46.59 GZ00 C |
| ATOM | 4655 | O | SER | A | 183 | −33.582 | 112.222 | −10.262 | 1.00 | 44.22 GZ00 O |

TABLE 10.3-continued

| ATOM | 4656 | CB  | SER | A | 183 | -31.992 | 114.502 | -8.679  | 1.00 | 39.93 | GZ00 C |
| ATOM | 4657 | OG  | SER | A | 183 | -31.284 | 114.978 | -7.545  | 1.00 | 50.25 | GZ00 O |
| ATOM | 4658 | N   | LEU | A | 184 | -34.945 | 113.951 | -9.821  | 1.00 | 43.36 | GZ00 N |
| ATOM | 4659 | CA  | LEU | A | 184 | -35.653 | 113.810 | -11.084 | 1.00 | 43.02 | GZ00 C |
| ATOM | 4660 | C   | LEU | A | 184 | -36.113 | 115.182 | -11.552 | 1.00 | 47.62 | GZ00 C |
| ATOM | 4661 | O   | LEU | A | 184 | -36.058 | 116.171 | -10.815 | 1.00 | 47.17 | GZ00 O |
| ATOM | 4662 | CB  | LEU | A | 184 | -36.840 | 112.839 | -10.975 | 1.00 | 38.26 | GZ00 C |
| ATOM | 4663 | CG  | LEU | A | 184 | -38.061 | 113.103 | -10.085 | 1.00 | 43.98 | GZ00 C |
| ATOM | 4664 | CD1 | LEU | A | 184 | -38.998 | 114.216 | -10.603 | 1.00 | 40.01 | GZ00 C |
| ATOM | 4665 | CD2 | LEU | A | 184 | -38.840 | 111.795 | -9.902  | 1.00 | 43.99 | GZ00 C |
| ATOM | 4666 | N   | SER | A | 185 | -36.568 | 115.229 | -12.801 | 1.00 | 43.75 | GZ00 N |
| ATOM | 4667 | CA  | SER | A | 185 | -37.198 | 116.411 | -13.358 | 1.00 | 38.83 | GZ00 C |
| ATOM | 4668 | C   | SER | A | 185 | -38.565 | 116.044 | -13.909 | 1.00 | 43.09 | GZ00 C |
| ATOM | 4669 | O   | SER | A | 185 | -38.803 | 114.901 | -14.312 | 1.00 | 45.04 | GZ00 O |
| ATOM | 4670 | CB  | SER | A | 185 | -36.346 | 117.037 | -14.462 | 1.00 | 38.03 | GZ00 C |
| ATOM | 4671 | OG  | SER | A | 185 | -35.075 | 117.365 | -13.952 | 1.00 | 38.25 | GZ00 O |
| ATOM | 4672 | N   | SER | A | 186 | -39.468 | 117.023 | -13.889 | 1.00 | 39.49 | GZ00 N |
| ATOM | 4673 | CA  | SER | A | 186 | -40.767 | 116.950 | -14.544 | 1.00 | 41.04 | GZ00 C |
| ATOM | 4674 | C   | SER | A | 186 | -40.899 | 118.159 | -15.449 | 1.00 | 42.89 | GZ00 C |
| ATOM | 4675 | O   | SER | A | 186 | -40.584 | 119.272 | -15.032 | 1.00 | 44.02 | GZ00 O |
| ATOM | 4676 | CB  | SER | A | 186 | -41.917 | 116.931 | -13.536 | 1.00 | 44.24 | GZ00 C |
| ATOM | 4677 | OG  | SER | A | 186 | -43.174 | 117.016 | -14.199 | 1.00 | 48.30 | GZ00 O |
| ATOM | 4678 | N   | VAL | A | 187 | -41.298 | 117.945 | -16.698 | 1.00 | 47.04 | GZ00 N |
| ATOM | 4679 | CA  | VAL | A | 187 | -41.489 | 119.062 | -17.613 | 1.00 | 45.11 | GZ00 C |
| ATOM | 4680 | C   | VAL | A | 187 | -42.849 | 118.971 | -18.275 | 1.00 | 51.54 | GZ00 C |
| ATOM | 4681 | O   | VAL | A | 187 | -43.401 | 117.887 | -18.494 | 1.00 | 53.22 | GZ00 O |
| ATOM | 4682 | CB  | VAL | A | 187 | -40.385 | 119.152 | -18.666 | 1.00 | 43.95 | GZ00 C |
| ATOM | 4683 | CG1 | VAL | A | 187 | -39.102 | 119.540 | -17.976 | 1.00 | 54.28 | GZ00 C |
| ATOM | 4684 | CG2 | VAL | A | 187 | -40.236 | 117.828 | -19.352 | 1.00 | 52.33 | GZ00 C |
| ATOM | 4685 | N   | VAL | A | 188 | -43.405 | 120.132 | -18.564 | 1.00 | 54.43 | GZ00 N |
| ATOM | 4686 | CA  | VAL | A | 188 | -44.641 | 120.228 | -19.315 | 1.00 | 58.17 | GZ00 C |
| ATOM | 4687 | C   | VAL | A | 188 | -44.385 | 121.161 | -20.480 | 1.00 | 59.55 | GZ00 C |
| ATOM | 4688 | O   | VAL | A | 188 | -43.710 | 122.188 | -20.330 | 1.00 | 58.11 | GZ00 O |
| ATOM | 4689 | CB  | VAL | A | 188 | -45.821 | 120.710 | -18.443 | 1.00 | 59.93 | GZ00 C |
| ATOM | 4690 | CG1 | VAL | A | 188 | -45.449 | 121.979 | -17.680 | 1.00 | 60.26 | GZ00 C |
| ATOM | 4691 | CG2 | VAL | A | 188 | -47.062 | 120.912 | -19.297 | 1.00 | 61.12 | GZ00 C |
| ATOM | 4692 | N   | THR | A | 189 | -44.859 | 120.768 | -21.655 | 1.00 | 62.33 | GZ00 N |
| ATOM | 4693 | CA  | THR | A | 189 | -44.814 | 121.638 | -22.815 | 1.00 | 66.67 | GZ00 C |
| ATOM | 4694 | C   | THR | A | 189 | -46.153 | 122.362 | -22.930 | 1.00 | 69.89 | GZ00 C |
| ATOM | 4695 | O   | THR | A | 189 | -47.220 | 121.739 | -22.815 | 1.00 | 62.33 | GZ00 O |
| ATOM | 4696 | CB  | THR | A | 189 | -44.477 | 120.837 | -24.072 | 1.00 | 67.75 | GZ00 C |
| ATOM | 4697 | OG1 | THR | A | 189 | -44.384 | 119.450 | -23.731 | 1.00 | 69.60 | GZ00 O |
| ATOM | 4698 | CG2 | THR | A | 189 | -43.130 | 121.278 | -24.620 | 1.00 | 74.71 | GZ00 C |
| ATOM | 4699 | N   | VAL | A | 190 | -46.084 | 123.681 | -23.102 | 1.00 | 66.60 | GZ00 N |
| ATOM | 4700 | CA  | VAL | A | 190 | -47.263 | 124.547 | -23.133 | 1.00 | 66.10 | GZ00 C |
| ATOM | 4701 | C   | VAL | A | 190 | -47.136 | 125.490 | -24.322 | 1.00 | 73.09 | GZ00 C |
| ATOM | 4702 | O   | VAL | A | 190 | -46.045 | 125.641 | -24.901 | 1.00 | 71.87 | GZ00 O |
| ATOM | 4703 | CB  | VAL | A | 190 | -47.425 | 125.349 | -21.818 | 1.00 | 64.66 | GZ00 C |
| ATOM | 4704 | CG1 | VAL | A | 190 | -47.569 | 124.428 | -20.610 | 1.00 | 58.32 | GZ00 C |
| ATOM | 4705 | CG2 | VAL | A | 190 | -46.261 | 126.316 | -21.640 | 1.00 | 59.75 | GZ00 C |
| ATOM | 4706 | N   | PRO | A | 191 | -48.245 | 126.108 | -24.739 | 1.00 | 74.14 | GZ00 N |
| ATOM | 4707 | CA  | PRO | A | 191 | -48.160 | 127.158 | -25.763 | 1.00 | 74.58 | GZ00 C |
| ATOM | 4708 | C   | PRO | A | 191 | -47.354 | 128.344 | -25.261 | 1.00 | 76.75 | GZ00 C |
| ATOM | 4709 | O   | PRO | A | 191 | -47.577 | 128.839 | -24.154 | 1.00 | 81.03 | GZ00 O |
| ATOM | 4710 | CB  | PRO | A | 191 | -49.625 | 127.539 | -26.000 | 1.00 | 69.86 | GZ00 C |
| ATOM | 4711 | CG  | PRO | A | 191 | -50.402 | 126.339 | -25.563 | 1.00 | 73.10 | GZ00 C |
| ATOM | 4712 | CD  | PRO | A | 191 | -49.645 | 125.802 | -24.391 | 1.00 | 71.77 | GZ00 C |
| ATOM | 4713 | N   | SER | A | 192 | -46.422 | 128.813 | -26.093 | 1.00 | 74.74 | GZ00 N |
| ATOM | 4714 | CA  | SER | A | 192 | -45.569 | 129.925 | -25.684 | 1.00 | 84.32 | GZ00 C |
| ATOM | 4715 | C   | SER | A | 192 | -46.375 | 131.203 | -25.449 | 1.00 | 87.52 | GZ00 C |
| ATOM | 4716 | O   | SER | A | 192 | -46.000 | 132.033 | -24.611 | 1.00 | 90.45 | GZ00 O |
| ATOM | 4717 | CB  | SER | A | 192 | -44.469 | 130.145 | -26.720 | 1.00 | 82.62 | GZ00 C |
| ATOM | 4718 | OG  | SER | A | 192 | -45.022 | 130.471 | -27.977 | 1.00 | 97.04 | GZ00 O |
| ATOM | 4719 | N   | SER | A | 193 | -47.472 | 131.392 | -26.187 | 1.00 | 89.79 | GZ00 N |
| ATOM | 4720 | CA  | SER | A | 193 | -48.307 | 132.573 | -25.998 | 1.00 | 89.74 | GZ00 C |
| ATOM | 4721 | C   | SER | A | 193 | -48.972 | 132.612 | -24.626 | 1.00 | 93.59 | GZ00 C |
| ATOM | 4722 | O   | SER | A | 193 | -49.320 | 133.699 | -24.148 | 1.00 | 95.20 | GZ00 O |
| ATOM | 4723 | CB  | SER | A | 193 | -49.389 | 132.613 | -27.076 | 1.00 | 81.94 | GZ00 C |
| ATOM | 4724 | OG  | SER | A | 193 | -50.265 | 131.503 | -26.929 | 1.00 | 74.81 | GZ00 O |
| ATOM | 4725 | N   | SER | A | 194 | -49.138 | 131.462 | -23.975 | 1.00 | 87.57 | GZ00 N |
| ATOM | 4726 | CA  | SER | A | 194 | -49.771 | 131.416 | -22.662 | 1.00 | 89.09 | GZ00 C |
| ATOM | 4727 | C   | SER | A | 194 | -48.823 | 131.758 | -21.516 | 1.00 | 91.10 | GZ00 C |
| ATOM | 4728 | O   | SER | A | 194 | -49.278 | 131.840 | -20.368 | 1.00 | 89.32 | GZ00 O |
| ATOM | 4729 | CB  | SER | A | 194 | -50.372 | 130.030 | -22.418 | 1.00 | 81.55 | GZ00 C |
| ATOM | 4730 | OG  | SER | A | 194 | -49.347 | 129.061 | -22.241 | 1.00 | 88.02 | GZ00 O |
| ATOM | 4731 | N   | LEU | A | 195 | -47.528 | 131.951 | -21.791 | 1.00 | 87.53 | GZ00 N |
| ATOM | 4732 | CA  | LEU | A | 195 | -46.560 | 132.107 | -20.708 | 1.00 | 88.74 | GZ00 C |
| ATOM | 4733 | C   | LEU | A | 195 | -46.827 | 133.359 | -19.882 | 1.00 | 89.05 | GZ00 C |
| ATOM | 4734 | O   | LEU | A | 195 | -46.677 | 133.340 | -18.654 | 1.00 | 89.42 | GZ00 O |
| ATOM | 4735 | CB  | LEU | A | 195 | -45.137 | 132.120 | -21.267 | 1.00 | 85.76 | GZ00 C |

TABLE 10.3-continued

| | | | | | | | | | | |
|---|---|---|---|---|---|---|---|---|---|---|
| ATOM | 4736 | CG | LEU | A | 195 | −44.685 | 130.772 | −21.838 | 1.00 | 84.17 | GZ00 C |
| ATOM | 4737 | CD1 | LEU | A | 195 | −43.245 | 130.846 | −22.337 | 1.00 | 78.51 | GZ00 C |
| ATOM | 4738 | CD2 | LEU | A | 195 | −44.872 | 129.643 | −20.827 | 1.00 | 71.43 | GZ00 C |
| ATOM | 4739 | N | GLY | A | 196 | −47.240 | 134.451 | −20.529 | 1.00 | 92.67 | GZ00 N |
| ATOM | 4740 | CA | GLY | A | 196 | −47.552 | 135.661 | −19.789 | 1.00 | 83.87 | GZ00 C |
| ATOM | 4741 | C | GLY | A | 196 | −48.867 | 135.611 | −19.045 | 1.00 | 82.81 | GZ00 C |
| ATOM | 4742 | O | GLY | A | 196 | −49.054 | 136.368 | −18.090 | 1.00 | 84.91 | GZ00 O |
| ATOM | 4743 | N | THR | A | 197 | −49.775 | 134.728 | −19.455 | 1.00 | 85.57 | GZ00 N |
| ATOM | 4744 | CA | THR | A | 197 | −51.143 | 134.692 | −18.952 | 1.00 | 86.43 | GZ00 C |
| ATOM | 4745 | C | THR | A | 197 | −51.368 | 133.631 | −17.888 | 1.00 | 86.30 | GZ00 C |
| ATOM | 4746 | O | THR | A | 197 | −52.058 | 133.892 | −16.898 | 1.00 | 86.17 | GZ00 O |
| ATOM | 4747 | CB | THR | A | 197 | −52.121 | 134.417 | −20.097 | 1.00 | 86.40 | GZ00 C |
| ATOM | 4748 | OG1 | THR | A | 197 | −51.849 | 135.303 | −21.187 | 1.00 | 91.08 | GZ00 O |
| ATOM | 4749 | CG2 | THR | A | 197 | −53.569 | 134.569 | −19.626 | 1.00 | 80.19 | GZ00 C |
| ATOM | 4750 | N | GLN | A | 198 | −50.770 | 132.454 | −18.048 | 1.00 | 84.30 | GZ00 N |
| ATOM | 4751 | CA | GLN | A | 198 | −51.154 | 131.288 | −17.272 | 1.00 | 78.44 | GZ00 C |
| ATOM | 4752 | C | GLN | A | 198 | −50.118 | 131.004 | −16.194 | 1.00 | 79.40 | GZ00 C |
| ATOM | 4753 | O | GLN | A | 198 | −48.910 | 131.155 | −16.412 | 1.00 | 78.37 | GZ00 O |
| ATOM | 4754 | CB | GLN | A | 198 | −51.315 | 130.071 | −18.184 | 1.00 | 76.20 | GZ00 C |
| ATOM | 4755 | CG | GLN | A | 198 | −51.543 | 128.762 | −17.443 | 1.00 | 79.56 | GZ00 C |
| ATOM | 4756 | CD | GLN | A | 198 | −52.867 | 128.724 | −16.710 | 1.00 | 81.18 | GZ00 C |
| ATOM | 4757 | OE1 | GLN | A | 198 | −53.881 | 129.172 | −17.236 | 1.00 | 93.21 | GZ00 O |
| ATOM | 4758 | NE2 | GLN | A | 198 | −52.867 | 128.185 | −15.493 | 1.00 | 73.89 | GZ00 N |
| ATOM | 4759 | N | THR | A | 199 | −50.606 | 130.551 | −15.043 | 1.00 | 73.01 | GZ00 N |
| ATOM | 4760 | CA | THR | A | 199 | −49.774 | 130.248 | −13.891 | 1.00 | 76.95 | GZ00 C |
| ATOM | 4761 | C | THR | A | 199 | −49.518 | 128.747 | −13.834 | 1.00 | 74.20 | GZ00 C |
| ATOM | 4762 | O | THR | A | 199 | −50.462 | 127.944 | −13.805 | 1.00 | 70.39 | GZ00 O |
| ATOM | 4763 | CB | THR | A | 199 | −50.445 | 130.746 | −12.610 | 1.00 | 71.33 | GZ00 C |
| ATOM | 4764 | OG1 | THR | A | 199 | −50.421 | 132.179 | −12.601 | 1.00 | 73.00 | GZ00 O |
| ATOM | 4765 | CG2 | THR | A | 199 | −49.728 | 130.224 | −11.382 | 1.00 | 65.14 | GZ00 C |
| ATOM | 4766 | N | TYR | A | 200 | −48.242 | 128.376 | −13.805 | 1.00 | 68.08 | GZ00 N |
| ATOM | 4767 | CA | TYR | A | 200 | −47.829 | 126.982 | −13.781 | 1.00 | 61.58 | GZ00 C |
| ATOM | 4768 | C | TYR | A | 200 | −47.135 | 126.697 | −12.461 | 1.00 | 60.20 | GZ00 C |
| ATOM | 4769 | O | TYR | A | 200 | −46.093 | 127.293 | −12.153 | 1.00 | 57.85 | GZ00 O |
| ATOM | 4770 | CB | TYR | A | 200 | −46.911 | 126.674 | −14.955 | 1.00 | 57.54 | GZ00 C |
| ATOM | 4771 | CG | TYR | A | 200 | −47.580 | 126.881 | −16.287 | 1.00 | 62.50 | GZ00 C |
| ATOM | 4772 | CD1 | TYR | A | 200 | −48.564 | 126.013 | −16.731 | 1.00 | 61.12 | GZ00 C |
| ATOM | 4773 | CD2 | TYR | A | 200 | −47.218 | 127.943 | −17.106 | 1.00 | 67.26 | GZ00 C |
| ATOM | 4774 | CE1 | TYR | A | 200 | −49.178 | 126.194 | −17.951 | 1.00 | 65.39 | GZ00 C |
| ATOM | 4775 | CE2 | TYR | A | 200 | −47.820 | 128.135 | −18.333 | 1.00 | 69.26 | GZ00 C |
| ATOM | 4776 | CZ | TYR | A | 200 | −48.802 | 127.257 | −18.753 | 1.00 | 70.05 | GZ00 C |
| ATOM | 4777 | OH | TYR | A | 200 | −49.409 | 127.447 | −19.979 | 1.00 | 69.68 | GZ00 O |
| ATOM | 4778 | N | ILE | A | 201 | −47.710 | 125.775 | −11.699 | 1.00 | 54.42 | GZ00 N |
| ATOM | 4779 | CA | ILE | A | 201 | −47.224 | 125.396 | −10.384 | 1.00 | 55.01 | GZ00 C |
| ATOM | 4780 | C | ILE | A | 201 | −47.026 | 123.891 | −10.383 | 1.00 | 53.67 | GZ00 C |
| ATOM | 4781 | O | ILE | A | 201 | −47.944 | 123.147 | −10.738 | 1.00 | 51.99 | GZ00 O |
| ATOM | 4782 | CB | ILE | A | 201 | −48.220 | 125.791 | −9.275 | 1.00 | 53.52 | GZ00 C |
| ATOM | 4783 | CG1 | ILE | A | 201 | −48.406 | 127.304 | −9.225 | 1.00 | 59.92 | GZ00 C |
| ATOM | 4784 | CG2 | ILE | A | 201 | −47.757 | 125.257 | −7.920 | 1.00 | 51.50 | GZ00 C |
| ATOM | 4785 | CD1 | ILE | A | 201 | −49.568 | 127.719 | −8.359 | 1.00 | 59.25 | GZ00 C |
| ATOM | 4786 | N | CYS | A | 202 | −45.846 | 123.434 | −9.979 | 1.00 | 49.43 | GZ00 N |
| ATOM | 4787 | CA | CYS | A | 202 | −45.655 | 122.005 | −9.794 | 1.00 | 52.57 | GZ00 C |
| ATOM | 4788 | C | CYS | A | 202 | −45.814 | 121.642 | −8.324 | 1.00 | 50.37 | GZ00 C |
| ATOM | 4789 | O | CYS | A | 202 | −45.364 | 122.364 | −7.433 | 1.00 | 52.12 | GZ00 O |
| ATOM | 4790 | CB | CYS | A | 202 | −44.301 | 121.549 | −10.331 | 1.00 | 62.40 | GZ00 C |
| ATOM | 4791 | SG | CYS | A | 202 | −42.952 | 121.799 | −9.238 | 1.00 | 64.20 | GZ00 S |
| ATOM | 4792 | N | ASN | A | 203 | −46.465 | 120.516 | −8.082 | 1.00 | 47.36 | GZ00 N |
| ATOM | 4793 | CA | ASN | A | 203 | −46.831 | 120.068 | −6.747 | 1.00 | 46.99 | GZ00 C |
| ATOM | 4794 | C | ASN | A | 203 | −46.058 | 118.791 | −6.497 | 1.00 | 48.88 | GZ00 C |
| ATOM | 4795 | O | ASN | A | 203 | −46.287 | 117.778 | −7.163 | 1.00 | 57.36 | GZ00 O |
| ATOM | 4796 | CB | ASN | A | 203 | −48.342 | 119.850 | −6.635 | 1.00 | 48.02 | GZ00 C |
| ATOM | 4797 | CG | ASN | A | 203 | −49.137 | 120.936 | −7.344 | 1.00 | 55.33 | GZ00 C |
| ATOM | 4798 | OD1 | ASN | A | 203 | −49.750 | 120.696 | −8.385 | 1.00 | 60.59 | GZ00 O |
| ATOM | 4799 | ND2 | ASN | A | 203 | −49.148 | 122.139 | −6.765 | 1.00 | 49.46 | GZ00 N |
| ATOM | 4800 | N | VAL | A | 204 | −45.120 | 118.858 | −5.568 | 1.00 | 44.47 | GZ00 N |
| ATOM | 4801 | CA | VAL | A | 204 | −44.215 | 117.764 | −5.274 | 1.00 | 47.87 | GZ00 C |
| ATOM | 4802 | C | VAL | A | 204 | −44.619 | 117.151 | −3.949 | 1.00 | 46.74 | GZ00 C |
| ATOM | 4803 | O | VAL | A | 204 | −44.770 | 117.864 | −2.952 | 1.00 | 50.77 | GZ00 O |
| ATOM | 4804 | CB | VAL | A | 204 | −42.755 | 118.248 | −5.231 | 1.00 | 44.63 | GZ00 C |
| ATOM | 4805 | CG1 | VAL | A | 204 | −41.843 | 117.090 | −4.887 | 1.00 | 38.03 | GZ00 C |
| ATOM | 4806 | CG2 | VAL | A | 204 | −42.380 | 118.903 | −6.567 | 1.00 | 40.53 | GZ00 C |
| ATOM | 4807 | N | ASN | A | 205 | −44.767 | 115.832 | −3.928 | 1.00 | 48.79 | GZ00 N |
| ATOM | 4808 | CA | ASN | A | 205 | −45.133 | 115.123 | −2.714 | 1.00 | 47.93 | GZ00 C |
| ATOM | 4809 | C | ASN | A | 205 | −44.153 | 113.974 | −2.534 | 1.00 | 49.20 | GZ00 C |
| ATOM | 4810 | O | ASN | A | 205 | −43.964 | 113.166 | −3.445 | 1.00 | 60.40 | GZ00 O |
| ATOM | 4811 | CB | ASN | A | 205 | −46.588 | 114.648 | −2.781 | 1.00 | 53.37 | GZ00 C |
| ATOM | 4812 | CG | ASN | A | 205 | −47.095 | 114.117 | −1.449 | 1.00 | 66.37 | GZ00 C |
| ATOM | 4813 | OD1 | ASN | A | 205 | −46.479 | 114.336 | −0.404 | 1.00 | 69.20 | GZ00 O |
| ATOM | 4814 | ND2 | ASN | A | 205 | −48.254 | 113.468 | −1.473 | 1.00 | 77.20 | GZ00 N |
| ATOM | 4815 | N | HIS | A | 206 | −43.476 | 113.954 | −1.396 | 1.00 | 45.52 | GZ00 N |

TABLE 10.3-continued

| ATOM | 4816 | CA | HIS | A | 206 | −42.524 | 112.919 | −1.028 | 1.00 | 43.97 | GZ00 C |
| --- | --- | --- | --- | --- | --- | --- | --- | --- | --- | --- | --- |
| ATOM | 4817 | C | HIS | A | 206 | −42.971 | 112.323 | 0.309 | 1.00 | 53.01 | GZ00 C |
| ATOM | 4818 | O | HIS | A | 206 | −42.520 | 112.750 | 1.378 | 1.00 | 53.77 | GZ00 O |
| ATOM | 4819 | CB | HIS | A | 206 | −41.137 | 113.478 | −0.951 | 1.00 | 40.28 | GZ00 C |
| ATOM | 4820 | CG | HIS | A | 206 | −40.104 | 112.463 | −0.585 | 1.00 | 48.58 | GZ00 C |
| ATOM | 4821 | ND1 | HIS | A | 206 | −39.422 | 112.498 | 0.611 | 1.00 | 53.96 | GZ00 N |
| ATOM | 4822 | CD2 | HIS | A | 206 | −39.646 | 111.374 | −1.247 | 1.00 | 48.75 | GZ00 C |
| ATOM | 4823 | CE1 | HIS | A | 206 | −38.579 | 111.482 | 0.667 | 1.00 | 51.43 | GZ00 C |
| ATOM | 4824 | NE2 | HIS | A | 206 | −38.689 | 110.790 | −0.453 | 1.00 | 52.90 | GZ00 N |
| ATOM | 4825 | N | LYS | A | 207 | −43.829 | 111.306 | 0.233 | 1.00 | 54.92 | GZ00 N |
| ATOM | 4826 | CA | LYS | A | 207 | −44.424 | 110.729 | 1.434 | 1.00 | 48.15 | GZ00 C |
| ATOM | 4827 | C | LYS | A | 207 | −43.418 | 110.140 | 2.423 | 1.00 | 52.26 | GZ00 C |
| ATOM | 4828 | O | LYS | A | 207 | −43.648 | 110.282 | 3.635 | 1.00 | 59.42 | GZ00 O |
| ATOM | 4829 | CB | LYS | A | 207 | −45.481 | 109.710 | 1.007 | 1.00 | 49.63 | GZ00 C |
| ATOM | 4830 | CG | LYS | A | 207 | −46.665 | 110.413 | 0.313 | 1.00 | 60.89 | GZ00 C |
| ATOM | 4831 | CD | LYS | A | 207 | −47.752 | 109.458 | −0.167 | 1.00 | 75.35 | GZ00 C |
| ATOM | 4832 | CE | LYS | A | 207 | −48.892 | 110.226 | −0.848 | 1.00 | 81.98 | GZ00 C |
| ATOM | 4833 | NZ | LYS | A | 207 | −49.961 | 109.352 | −1.445 | 1.00 | 90.80 | GZ00 N1+ |
| ATOM | 4834 | N | PRO | A | 208 | −42.313 | 109.506 | 2.016 | 1.00 | 53.20 | GZ00 N |
| ATOM | 4835 | CA | PRO | A | 208 | −41.376 | 108.969 | 3.026 | 1.00 | 54.32 | GZ00 C |
| ATOM | 4836 | C | PRO | A | 208 | −40.864 | 109.993 | 4.034 | 1.00 | 57.05 | GZ00 C |
| ATOM | 4837 | O | PRO | A | 208 | −40.579 | 109.623 | 5.178 | 1.00 | 57.60 | GZ00 O |
| ATOM | 4838 | CB | PRO | A | 208 | −40.231 | 108.409 | 2.174 | 1.00 | 48.60 | GZ00 C |
| ATOM | 4839 | CG | PRO | A | 208 | −40.871 | 108.022 | 0.913 | 1.00 | 50.40 | GZ00 C |
| ATOM | 4840 | CD | PRO | A | 208 | −41.948 | 109.055 | 0.660 | 1.00 | 50.23 | GZ00 C |
| ATOM | 4841 | N | SER | A | 209 | −40.691 | 111.254 | 3.636 | 1.00 | 61.65 | GZ00 N |
| ATOM | 4842 | CA | SER | A | 209 | −40.273 | 112.325 | 4.535 | 1.00 | 62.97 | GZ00 C |
| ATOM | 4843 | C | SER | A | 209 | −41.416 | 113.260 | 4.930 | 1.00 | 61.87 | GZ00 C |
| ATOM | 4844 | O | SER | A | 209 | −41.174 | 114.251 | 5.630 | 1.00 | 60.78 | GZ00 O |
| ATOM | 4845 | CB | SER | A | 209 | −39.165 | 113.147 | 3.879 | 1.00 | 59.23 | GZ00 C |
| ATOM | 4846 | OG | SER | A | 209 | −39.685 | 113.856 | 2.755 | 1.00 | 55.04 | GZ00 O |
| ATOM | 4847 | N | ASN | A | 210 | −42.646 | 112.940 | 4.539 | 1.00 | 55.47 | GZ00 N |
| ATOM | 4848 | CA | ASN | A | 210 | −43.808 | 113.822 | 4.651 | 1.00 | 56.64 | GZ00 C |
| ATOM | 4849 | C | ASN | A | 210 | −43.460 | 115.261 | 4.290 | 1.00 | 56.98 | GZ00 C |
| ATOM | 4850 | O | ASN | A | 210 | −43.558 | 116.181 | 5.100 | 1.00 | 62.92 | GZ00 O |
| ATOM | 4851 | CB | ASN | A | 210 | −44.398 | 113.761 | 6.053 | 1.00 | 60.66 | GZ00 C |
| ATOM | 4852 | CG | ASN | A | 210 | −44.555 | 112.358 | 6.550 | 1.00 | 60.50 | GZ00 C |
| ATOM | 4853 | OD1 | ASN | A | 210 | −45.556 | 111.702 | 6.273 | 1.00 | 64.24 | GZ00 O |
| ATOM | 4854 | ND2 | ASN | A | 210 | −43.562 | 111.880 | 7.288 | 1.00 | 60.19 | GZ00 N |
| ATOM | 4855 | N | THR | A | 211 | −43.011 | 115.442 | 3.057 | 1.00 | 54.32 | GZ00 N |
| ATOM | 4856 | CA | THR | A | 211 | −42.767 | 116.765 | 2.504 | 1.00 | 47.32 | GZ00 C |
| ATOM | 4857 | C | THR | A | 211 | −43.723 | 117.022 | 1.349 | 1.00 | 47.89 | GZ00 C |
| ATOM | 4858 | O | THR | A | 211 | −43.910 | 116.159 | 0.489 | 1.00 | 54.45 | GZ00 O |
| ATOM | 4859 | CB | THR | A | 211 | −41.317 | 116.913 | 2.046 | 1.00 | 49.88 | GZ00 C |
| ATOM | 4860 | OG1 | THR | A | 211 | −40.444 | 116.645 | 3.148 | 1.00 | 51.07 | GZ00 O |
| ATOM | 4861 | CG2 | THR | A | 211 | −41.061 | 118.318 | 1.560 | 1.00 | 42.66 | GZ00 C |
| ATOM | 4862 | N | LYS | A | 212 | −44.338 | 118.194 | 1.339 | 1.00 | 50.89 | GZ00 N |
| ATOM | 4863 | CA | LYS | A | 212 | −45.112 | 118.659 | 0.198 | 1.00 | 47.65 | GZ00 C |
| ATOM | 4864 | C | LYS | A | 212 | −44.570 | 120.029 | −0.168 | 1.00 | 47.72 | GZ00 C |
| ATOM | 4865 | O | LYS | A | 212 | −44.386 | 120.878 | 0.712 | 1.00 | 52.21 | GZ00 O |
| ATOM | 4866 | CB | LYS | A | 212 | −46.611 | 118.715 | 0.514 | 1.00 | 52.77 | GZ00 C |
| ATOM | 4867 | CG | LYS | A | 212 | −47.140 | 117.383 | 1.052 | 1.00 | 63.53 | GZ00 C |
| ATOM | 4868 | CD | LYS | A | 212 | −48.662 | 117.295 | 1.167 | 1.00 | 63.25 | GZ00 C |
| ATOM | 4869 | CE | LYS | A | 212 | −49.049 | 116.010 | 1.920 | 1.00 | 71.43 | GZ00 C |
| ATOM | 4870 | NZ | LYS | A | 212 | −50.290 | 115.345 | 1.415 | 1.00 | 66.03 | GZ00 N1+ |
| ATOM | 4871 | N | VAL | A | 213 | −44.223 | 120.212 | −1.437 | 1.00 | 41.63 | GZ00 N |
| ATOM | 4872 | CA | VAL | A | 213 | −43.729 | 121.485 | −1.935 | 1.00 | 44.71 | GZ00 C |
| ATOM | 4873 | C | VAL | A | 213 | −44.585 | 121.894 | −3.121 | 1.00 | 48.49 | GZ00 C |
| ATOM | 4874 | O | VAL | A | 213 | −44.882 | 121.063 | −3.983 | 1.00 | 53.14 | GZ00 O |
| ATOM | 4875 | CB | VAL | A | 213 | −42.246 | 121.419 | −2.347 | 1.00 | 43.73 | GZ00 C |
| ATOM | 4876 | CG1 | VAL | A | 213 | −41.816 | 122.764 | −2.924 | 1.00 | 39.48 | GZ00 C |
| ATOM | 4877 | CG2 | VAL | A | 213 | −41.362 | 121.029 | −1.165 | 1.00 | 37.84 | GZ00 C |
| ATOM | 4878 | N | ASP | A | 214 | −45.015 | 123.156 | −3.139 | 1.00 | 47.97 | GZ00 N |
| ATOM | 4879 | CA | ASP | A | 214 | −45.585 | 123.795 | −4.317 | 1.00 | 44.59 | GZ00 C |
| ATOM | 4880 | C | ASP | A | 214 | −44.598 | 124.838 | −4.810 | 1.00 | 46.54 | GZ00 C |
| ATOM | 4881 | O | ASP | A | 214 | −44.025 | 125.579 | −4.009 | 1.00 | 54.01 | GZ00 0 |
| ATOM | 4882 | CB | ASP | A | 214 | −46.929 | 124.477 | −4.017 | 1.00 | 51.53 | GZ00 C |
| ATOM | 4883 | CG | ASP | A | 214 | −47.982 | 123.512 | −3.513 | 1.00 | 63.26 | GZ00 C |
| ATOM | 4884 | OD2 | ASP | A | 214 | −48.796 | 123.914 | −2.654 | 1.00 | 87.44 | GZ00 O1− |
| ATOM | 4885 | OD1 | ASP | A | 214 | −48.012 | 122.352 | −3.969 | 1.00 | 69.85 | GZ00 O |
| ATOM | 4886 | N | LYS | A | 215 | −44.377 | 124.888 | −6.119 | 1.00 | 44.93 | GZ00 N |
| ATOM | 4887 | CA | LYS | A | 215 | −43.442 | 125.855 | −6.679 | 1.00 | 46.63 | GZ00 C |
| ATOM | 4888 | C | LYS | A | 215 | −43.978 | 126.399 | −7.988 | 1.00 | 52.58 | GZ00 C |
| ATOM | 4889 | O | LYS | A | 215 | −44.348 | 125.626 | −8.878 | 1.00 | 52.15 | GZ00 O |
| ATOM | 4890 | CB | LYS | A | 215 | −42.051 | 125.248 | −6.899 | 1.00 | 47.58 | GZ00 C |
| ATOM | 4891 | CG | LYS | A | 215 | −40.969 | 125.964 | −6.129 | 1.00 | 50.19 | GZ00 C |
| ATOM | 4892 | CD | LYS | A | 215 | −40.152 | 126.858 | −7.027 | 1.00 | 48.08 | GZ00 C |
| ATOM | 4893 | CE | LYS | A | 215 | −39.413 | 127.923 | −6.211 | 1.00 | 55.88 | GZ00 C |
| ATOM | 4894 | NZ | LYS | A | 215 | −38.638 | 127.415 | −5.023 | 1.00 | 63.59 | GZ00 N1+ |
| ATOM | 4895 | N | LYS | A | 216 | −44.024 | 127.727 | −8.093 | 1.00 | 50.59 | GZ00 N |

TABLE 10.3-continued

| | | | | | | | | | | |
|---|---|---|---|---|---|---|---|---|---|---|
| ATOM | 4896 | CA | LYS | A | 216 | −44.437 | 128.396 | −9.312 | 1.00 | 51.04 | GZ00 C |
| ATOM | 4897 | C | LYS | A | 216 | −43.241 | 128.550 | −10.244 | 1.00 | 53.52 | GZ00 C |
| ATOM | 4898 | O | LYS | A | 216 | −42.135 | 128.880 | −9.807 | 1.00 | 49.36 | GZ00 O |
| ATOM | 4899 | CB | LYS | A | 216 | −45.052 | 129.760 | −8.996 | 1.00 | 56.62 | GZ00 C |
| ATOM | 4900 | CG | LYS | A | 216 | −45.566 | 130.514 | −10.215 | 1.00 | 61.12 | GZ00 C |
| ATOM | 4901 | CD | LYS | A | 216 | −46.136 | 131.864 | −9.823 | 1.00 | 67.36 | GZ00 C |
| ATOM | 4902 | CE | LYS | A | 216 | −46.919 | 132.483 | −10.962 | 1.00 | 66.87 | GZ00 C |
| ATOM | 4903 | NZ | LYS | A | 216 | −47.732 | 133.632 | −10.483 | 1.00 | 75.15 | GZ00 N1+ |
| ATOM | 4904 | N | VAL | A | 217 | −43.462 | 128.277 | −11.526 | 1.00 | 51.79 | GZ00 N |
| ATOM | 4905 | CA | VAL | A | 217 | −42.414 | 128.342 | −12.536 | 1.00 | 53.46 | GZ00 C |
| ATOM | 4906 | C | VAL | A | 217 | −42.741 | 129.494 | −13.465 | 1.00 | 54.54 | GZ00 C |
| ATOM | 4907 | O | VAL | A | 217 | −43.747 | 129.455 | −14.179 | 1.00 | 59.89 | GZ00 O |
| ATOM | 4908 | CB | VAL | A | 217 | −42.292 | 127.021 | −13.308 | 1.00 | 55.15 | GZ00 C |
| ATOM | 4909 | CG1 | VAL | A | 217 | −41.110 | 127.076 | −14.255 | 1.00 | 49.43 | GZ00 C |
| ATOM | 4910 | CG2 | VAL | A | 217 | −42.184 | 125.845 | −12.330 | 1.00 | 40.65 | GZ00 C |
| ATOM | 4911 | N | GLU | A | 218 | −41.905 | 130.525 | −13.455 | 1.00 | 58.16 | GZ00 N |
| ATOM | 4912 | CA | GLU | A | 218 | −42.169 | 131.714 | −14.244 | 1.00 | 61.44 | GZ00 C |
| ATOM | 4913 | C | GLU | A | 218 | −41.064 | 131.965 | −15.263 | 1.00 | 73.28 | GZ00 C |
| ATOM | 4914 | O | GLU | A | 218 | −39.904 | 131.589 | −15.043 | 1.00 | 69.38 | GZ00 O |
| ATOM | 4915 | CB | GLU | A | 218 | −42.312 | 132.955 | −13.350 | 1.00 | 65.18 | GZ00 C |
| ATOM | 4916 | CG | GLU | A | 218 | −43.436 | 132.867 | −12.323 | 1.00 | 71.84 | GZ00 C |
| ATOM | 4917 | CD | GLU | A | 218 | −43.518 | 134.104 | −11.427 | 1.00 | 80.98 | GZ00 C |
| ATOM | 4918 | OE1 | GLU | A | 218 | −42.537 | 134.884 | −11.391 | 1.00 | 69.24 | GZ00 O |
| ATOM | 4919 | OE2 | GLU | A | 218 | −44.568 | 134.295 | −10.769 | 1.00 | 78.83 | GZ00 O1− |
| ATOM | 4920 | N | PRO | A | 219 | −41.401 | 132.592 | −16.400 | 1.00 | 72.81 | GZ00 N |
| ATOM | 4921 | CA | PRO | A | 219 | −40.374 | 133.004 | −17.371 | 1.00 | 73.28 | GZ00 C |
| ATOM | 4922 | C | PRO | A | 219 | −39.387 | 134.017 | −16.815 | 1.00 | 77.52 | GZ00 C |
| ATOM | 4923 | O | PRO | A | 219 | −39.500 | 134.420 | −15.653 | 1.00 | 81.78 | GZ00 O |
| ATOM | 4924 | CB | PRO | A | 219 | −41.194 | 133.614 | −18.517 | 1.00 | 73.25 | GZ00 C |
| ATOM | 4925 | CG | PRO | A | 219 | −42.619 | 133.679 | −18.024 | 1.00 | 67.58 | GZ00 C |
| ATOM | 4926 | CD | PRO | A | 219 | −42.759 | 132.663 | −16.958 | 1.00 | 67.19 | GZ00 C |
| ATOM | 4927 | N | LYS | A | 220 | −38.405 | 134.405 | −17.627 | 1.00 | 81.29 | GZ00 N |
| ATOM | 4928 | CA | LYS | A | 220 | −37.376 | 135.375 | −17.234 | 1.00 | 82.90 | GZ00 C |
| ATOM | 4929 | C | LYS | A | 220 | −36.507 | 134.815 | −16.117 | 1.00 | 88.96 | GZ00 C |
| ATOM | 4930 | O | LYS | A | 220 | −36.186 | 133.626 | −16.112 | 1.00 | 89.60 | GZ00 0 |
| ATOM | 4931 | CB | LYS | A | 220 | −38.003 | 136.710 | −16.809 | 1.00 | 83.44 | GZ00 C |
| ATOM | 4932 | CG | LYS | A | 220 | −37.004 | 137.772 | −16.372 | 1.00 | 79.50 | GZ00 C |
| ATOM | 4933 | CD | LYS | A | 220 | −36.117 | 138.217 | −17.516 | 1.00 | 78.87 | GZ00 C |
| ATOM | 4934 | CE | LYS | A | 220 | −35.095 | 139.231 | −17.031 | 1.00 | 76.44 | GZ00 C |
| ATOM | 4935 | NZ | LYS | A | 220 | −34.316 | 139.811 | −18.154 | 1.00 | 72.11 | GZ00 N1+ |
| TER | | | | | | | | | | | |
| ATOM | 4936 | N | GLN | X | 1 | −13.182 | 99.213 | −18.301 | 1.00 | 76.62 | N |
| ATOM | 4937 | CA | GLN | X | 1 | −13.330 | 98.583 | −19.611 | 1.00 | 76.63 | C |
| ATOM | 4938 | C | GLN | X | 1 | −13.561 | 97.073 | −19.505 | 1.00 | 74.72 | C |
| ATOM | 4939 | O | GLN | X | 1 | −12.891 | 96.390 | −18.727 | 1.00 | 80.15 | O |
| ATOM | 4940 | CB | GLN | X | 1 | −12.095 | 98.863 | −20.464 | 1.00 | 81.35 | C |
| ATOM | 4941 | CG | GLN | X | 1 | −11.908 | 100.324 | −20.759 | 1.00 | 87.31 | C |
| ATOM | 4942 | CD | GLN | X | 1 | −13.144 | 100.930 | −21.400 | 1.00 | 101.98 | C |
| ATOM | 4943 | OE1 | GLN | X | 1 | −13.815 | 101.779 | −20.806 | 1.00 | 102.82 | O |
| ATOM | 4944 | NE2 | GLN | X | 1 | −13.454 | 100.491 | −22.619 | 1.00 | 97.35 | N |
| ATOM | 4945 | N | SER | X | 2 | −14.506 | 96.551 | −20.287 | 1.00 | 67.44 | N |
| ATOM | 4946 | CA | SER | X | 2 | −14.749 | 95.113 | −20.298 | 1.00 | 60.09 | C |
| ATOM | 4947 | C | SER | X | 2 | −13.572 | 94.377 | −20.927 | 1.00 | 57.36 | C |
| ATOM | 4948 | O | SER | X | 2 | −12.944 | 94.860 | −21.875 | 1.00 | 53.67 | O |
| ATOM | 4949 | CB | SER | X | 2 | −16.026 | 94.785 | −21.086 | 1.00 | 46.51 | C |
| ATOM | 4950 | OG | SER | X | 2 | −17.130 | 94.586 | −20.224 | 1.00 | 58.04 | O |
| ATOM | 4951 | N | VAL | X | 3 | −13.284 | 93.183 | −20.403 | 1.00 | 47.89 | N |
| ATOM | 4952 | CA | VAL | X | 3 | −12.146 | 92.428 | −20.923 | 1.00 | 46.54 | C |
| ATOM | 4953 | C | VAL | X | 3 | −12.475 | 91.869 | −22.301 | 1.00 | 47.23 | C |
| ATOM | 4954 | O | VAL | X | 3 | −11.622 | 91.855 | −23.201 | 1.00 | 45.87 | O |
| ATOM | 4955 | CB | VAL | X | 3 | −11.731 | 91.309 | −19.951 | 1.00 | 44.31 | C |
| ATOM | 4956 | CG1 | VAL | X | 3 | −10.685 | 90.401 | −20.593 | 1.00 | 34.16 | C |
| ATOM | 4957 | CG2 | VAL | X | 3 | −11.202 | 91.895 | −18.640 | 1.00 | 39.33 | C |
| ATOM | 4958 | N | LEU | X | 4 | −13.716 | 91.408 | −22.490 | 1.00 | 42.72 | N |
| ATOM | 4959 | CA | LEU | X | 4 | −14.234 | 91.004 | −23.790 | 1.00 | 40.50 | C |
| ATOM | 4960 | C | LEU | X | 4 | −15.023 | 92.164 | −24.377 | 1.00 | 38.73 | C |
| ATOM | 4961 | O | LEU | X | 4 | −15.756 | 92.844 | −23.656 | 1.00 | 38.68 | O |
| ATOM | 4962 | CB | LEU | X | 4 | −15.120 | 89.761 | −23.666 | 1.00 | 32.58 | C |
| ATOM | 4963 | CG | LEU | X | 4 | −14.559 | 88.652 | −22.763 | 1.00 | 35.07 | C |
| ATOM | 4964 | CD1 | LEU | X | 4 | −15.572 | 87.502 | −22.591 | 1.00 | 33.11 | C |
| ATOM | 4965 | CD2 | LEU | X | 4 | −13.193 | 88.130 | −23.260 | 1.00 | 26.20 | C |
| ATOM | 4966 | N | THR | X | 5 | −14.874 | 92.394 | −25.683 | 1.00 | 30.86 | N |
| ATOM | 4967 | CA | THR | X | 5 | −15.506 | 93.541 | −26.318 | 1.00 | 31.01 | C |
| ATOM | 4968 | C | THR | X | 5 | −16.635 | 93.087 | −27.228 | 1.00 | 32.92 | C |
| ATOM | 4969 | O | THR | X | 5 | −16.412 | 92.301 | −28.156 | 1.00 | 34.89 | O |
| ATOM | 4970 | CB | THR | X | 5 | −14.488 | 94.361 | −27.114 | 1.00 | 35.46 | C |
| ATOM | 4971 | OG1 | THR | X | 5 | −13.373 | 94.678 | −26.280 | 1.00 | 37.79 | O |
| ATOM | 4972 | CG2 | THR | X | 5 | −15.130 | 95.668 | −27.583 | 1.00 | 23.38 | C |
| ATOM | 4973 | N | GLN | X | 6 | −17.836 | 93.608 | −26.972 | 1.00 | 31.00 | N |
| ATOM | 4974 | CA | GLN | X | 6 | −19.060 | 93.406 | −27.730 | 1.00 | 33.70 | C |

TABLE 10.3-continued

| | | | | | | | | | | |
|---|---|---|---|---|---|---|---|---|---|---|
| ATOM | 4975 | C | GLN | X | 6 | −19.549 | 94.756 | −28.224 | 1.00 | 33.00 | C |
| ATOM | 4976 | O | GLN | X | 6 | −19.399 | 95.759 | −27.519 | 1.00 | 30.42 | O |
| ATOM | 4977 | CB | GLN | X | 6 | −20.188 | 92.765 | −26.892 | 1.00 | 30.43 | C |
| ATOM | 4978 | CG | GLN | X | 6 | −19.910 | 91.392 | −26.335 | 1.00 | 28.80 | C |
| ATOM | 4979 | CD | GLN | X | 6 | −21.049 | 90.852 | −25.456 | 1.00 | 32.96 | C |
| ATOM | 4980 | OE1 | GLN | X | 6 | −20.823 | 90.407 | −24.329 | 1.00 | 32.89 | O |
| ATOM | 4981 | NE2 | GLN | X | 6 | −22.266 | 90.879 | −25.978 | 1.00 | 26.46 | N |
| ATOM | 4982 | N | PRO | X | 7 | −20.179 | 94.813 | −29.392 | 1.00 | 28.38 | N |
| ATOM | 4983 | CA | PRO | X | 7 | −20.880 | 96.043 | −29.796 | 1.00 | 33.26 | C |
| ATOM | 4984 | C | PRO | X | 7 | −21.977 | 96.356 | −28.791 | 1.00 | 38.21 | C |
| ATOM | 4985 | O | PRO | X | 7 | −22.613 | 95.435 | −28.252 | 1.00 | 35.17 | O |
| ATOM | 4986 | CB | PRO | X | 7 | −21.461 | 95.693 | −31.181 | 1.00 | 33.21 | C |
| ATOM | 4987 | CG | PRO | X | 7 | −21.607 | 94.178 | −31.146 | 1.00 | 34.98 | C |
| ATOM | 4988 | CD | PRO | X | 7 | −20.480 | 93.673 | −30.276 | 1.00 | 33.91 | C |
| ATOM | 4989 | N | PRO | X | 8 | −22.189 | 97.632 | −28.468 | 1.00 | 34.91 | N |
| ATOM | 4990 | CA | PRO | X | 8 | −23.156 | 97.962 | −27.407 | 1.00 | 29.83 | C |
| ATOM | 4991 | C | PRO | X | 8 | −24.604 | 97.731 | −27.792 | 1.00 | 37.56 | C |
| ATOM | 4992 | O | PRO | X | 8 | −25.412 | 97.420 | −26.908 | 1.00 | 36.02 | O |
| ATOM | 4993 | CB | PRO | X | 8 | −22.879 | 99.443 | −27.119 | 1.00 | 28.75 | C |
| ATOM | 4994 | CG | PRO | X | 8 | −22.237 | 99.952 | −28.379 | 1.00 | 41.44 | C |
| ATOM | 4995 | CD | PRO | X | 8 | −21.416 | 98.803 | −28.911 | 1.00 | 31.17 | C |
| ATOM | 4996 | N | SER | X | 9 | −24.980 | 97.891 | −29.057 | 1.00 | 30.64 | N |
| ATOM | 4997 | CA | SER | X | 9 | −26.373 | 97.657 | −29.406 | 1.00 | 33.12 | C |
| ATOM | 4998 | C | SER | X | 9 | −26.487 | 97.243 | −30.864 | 1.00 | 36.96 | C |
| ATOM | 4999 | O | SER | X | 9 | −25.582 | 97.451 | −31.685 | 1.00 | 34.35 | O |
| ATOM | 5000 | CB | SER | X | 9 | −27.257 | 98.873 | −29.146 | 1.00 | 35.68 | C |
| ATOM | 5001 | OG | SER | X | 9 | −26.883 | 99.958 | −29.965 | 1.00 | 42.47 | O |
| ATOM | 5002 | N | VAL | X | 10 | −27.628 | 96.644 | −31.164 | 1.00 | 33.72 | N |
| ATOM | 5003 | CA | VAL | X | 10 | −27.851 | 95.977 | −32.431 | 1.00 | 34.33 | C |
| ATOM | 5004 | C | VAL | X | 10 | −29.358 | 95.932 | −32.642 | 1.00 | 34.97 | C |
| ATOM | 5005 | O | VAL | X | 10 | −30.118 | 95.725 | −31.688 | 1.00 | 36.04 | O |
| ATOM | 5006 | CB | VAL | X | 10 | −27.170 | 94.585 | −32.397 | 1.00 | 36.02 | C |
| ATOM | 5007 | CG1 | VAL | X | 10 | −28.071 | 93.486 | −32.875 | 1.00 | 38.30 | C |
| ATOM | 5008 | CG2 | VAL | X | 10 | −25.823 | 94.625 | −33.148 | 1.00 | 34.46 | C |
| ATOM | 5009 | N | SER | X | 11 | −29.801 | 96.196 | −33.872 | 1.00 | 35.57 | N |
| ATOM | 5010 | CA | SER | X | 11 | −31.238 | 96.220 | −34.114 | 1.00 | 38.43 | C |
| ATOM | 5011 | C | SER | X | 11 | −31.565 | 95.782 | −35.531 | 1.00 | 38.48 | C |
| ATOM | 5012 | O | SER | X | 11 | −30.839 | 96.101 | −36.473 | 1.00 | 39.31 | O |
| ATOM | 5013 | CB | SER | X | 11 | −31.841 | 97.609 | −33.833 | 1.00 | 38.56 | C |
| ATOM | 5014 | OG | SER | X | 11 | −31.368 | 98.589 | −34.727 | 1.00 | 43.26 | O |
| ATOM | 5015 | N | ALA | X | 12 | −32.670 | 95.054 | −35.669 | 1.00 | 37.39 | N |
| ATOM | 5016 | CA | ALA | X | 12 | −33.132 | 94.581 | −36.965 | 1.00 | 35.97 | C |
| ATOM | 5017 | C | ALA | X | 12 | −34.610 | 94.221 | −36.869 | 1.00 | 39.63 | C |
| ATOM | 5018 | O | ALA | X | 12 | −35.144 | 93.969 | −35.782 | 1.00 | 37.40 | O |
| ATOM | 5019 | CB | ALA | X | 12 | −32.317 | 93.374 | −37.454 | 1.00 | 32.40 | C |
| ATOM | 5020 | N | ALA | X | 13 | −35.245 | 94.137 | −38.035 | 1.00 | 39.79 | N |
| ATOM | 5021 | CA | ALA | X | 13 | −36.664 | 93.835 | −38.153 | 1.00 | 40.54 | C |
| ATOM | 5022 | C | ALA | X | 13 | −36.949 | 92.341 | −37.964 | 1.00 | 39.36 | C |
| ATOM | 5023 | O | ALA | X | 13 | −36.060 | 91.493 | −38.120 | 1.00 | 38.64 | O |
| ATOM | 5024 | CB | ALA | X | 13 | −37.170 | 94.286 | −39.518 | 1.00 | 26.30 | C |
| ATOM | 5025 | N | PRO | X | 14 | −38.182 | 91.992 | −37.606 | 1.00 | 39.35 | N |
| ATOM | 5026 | CA | PRO | X | 14 | −38.543 | 90.572 | −37.547 | 1.00 | 40.01 | C |
| ATOM | 5027 | C | PRO | X | 14 | −38.206 | 89.887 | −38.865 | 1.00 | 43.81 | C |
| ATOM | 5028 | O | PRO | X | 14 | −38.330 | 90.469 | −39.949 | 1.00 | 40.74 | O |
| ATOM | 5029 | CB | PRO | X | 14 | −40.050 | 90.596 | −37.287 | 1.00 | 28.16 | C |
| ATOM | 5030 | CG | PRO | X | 14 | −40.292 | 91.919 | −36.614 | 1.00 | 38.63 | C |
| ATOM | 5031 | CD | PRO | X | 14 | −39.300 | 92.873 | −37.204 | 1.00 | 38.01 | C |
| ATOM | 5032 | N | GLY | X | 15 | −37.742 | 88.649 | −38.754 | 1.00 | 42.53 | N |
| ATOM | 5033 | CA | GLY | X | 15 | −37.352 | 87.856 | −39.886 | 1.00 | 39.20 | C |
| ATOM | 5034 | C | GLY | X | 15 | −35.927 | 88.040 | −40.349 | 1.00 | 44.97 | C |
| ATOM | 5035 | O | GLY | X | 15 | −35.426 | 87.186 | −41.077 | 1.00 | 48.28 | O |
| ATOM | 5036 | N | GLN | X | 16 | −35.257 | 89.115 | −39.944 | 1.00 | 41.58 | N |
| ATOM | 5037 | CA | GLN | X | 16 | −33.915 | 89.385 | −40.433 | 1.00 | 43.47 | C |
| ATOM | 5038 | C | GLN | X | 16 | −32.862 | 88.623 | −39.621 | 1.00 | 47.57 | C |
| ATOM | 5039 | O | GLN | X | 16 | −33.167 | 87.903 | −38.664 | 1.00 | 46.60 | O |
| ATOM | 5040 | CB | GLN | X | 16 | −33.635 | 90.888 | −40.417 | 1.00 | 52.99 | C |
| ATOM | 5041 | CG | GLN | X | 16 | −34.303 | 91.702 | −41.539 | 1.00 | 46.17 | C |
| ATOM | 5042 | CD | GLN | X | 16 | −33.566 | 93.024 | −41.807 | 1.00 | 74.76 | C |
| ATOM | 5043 | OE1 | GLN | X | 16 | −33.715 | 94.021 | −41.064 | 1.00 | 62.51 | O |
| ATOM | 5044 | NE2 | GLN | X | 16 | −32.758 | 93.034 | −42.866 | 1.00 | 79.00 | N |
| ATOM | 5045 | N | LYS | X | 17 | −31.607 | 88.762 | −40.053 | 1.00 | 53.20 | N |
| ATOM | 5046 | CA | LYS | X | 17 | −30.415 | 88.195 | −39.436 | 1.00 | 49.52 | C |
| ATOM | 5047 | C | LYS | X | 17 | −29.695 | 89.254 | −38.627 | 1.00 | 51.74 | C |
| ATOM | 5048 | O | LYS | X | 17 | −29.796 | 90.454 | −38.883 | 1.00 | 62.58 | O |
| ATOM | 5049 | CB | LYS | X | 17 | −29.417 | 87.662 | −40.469 | 1.00 | 49.86 | C |
| ATOM | 5050 | CG | LYS | X | 17 | −29.783 | 86.391 | −41.150 | 1.00 | 61.26 | C |
| ATOM | 5051 | CD | LYS | X | 17 | −28.839 | 86.137 | −42.317 | 1.00 | 75.06 | C |
| ATOM | 5052 | CE | LYS | X | 17 | −29.295 | 84.939 | −43.148 | 1.00 | 82.27 | C |
| ATOM | 5053 | NZ | LYS | X | 17 | −28.391 | 84.723 | −44.304 | 1.00 | 82.49 | N |
| ATOM | 5054 | N | VAL | X | 18 | −28.913 | 88.785 | −37.670 | 1.00 | 51.92 | N |

TABLE 10.3-continued

| | | | | | | | | | | |
|---|---|---|---|---|---|---|---|---|---|---|
| ATOM | 5055 | CA | VAL | X | 18 | −28.083 | 89.670 | −36.876 | 1.00 | 47.06 | C |
| ATOM | 5056 | C | VAL | X | 18 | −26.882 | 88.857 | −36.416 | 1.00 | 42.24 | C |
| ATOM | 5057 | O | VAL | X | 18 | −26.969 | 87.645 | −36.210 | 1.00 | 39.00 | O |
| ATOM | 5058 | CB | VAL | X | 18 | −28.932 | 90.288 | −35.735 | 1.00 | 50.43 | C |
| ATOM | 5059 | CG1 | VAL | X | 18 | −28.437 | 89.925 | −34.363 | 1.00 | 44.21 | C |
| ATOM | 5060 | CG2 | VAL | X | 18 | −29.054 | 91.783 | −35.919 | 1.00 | 48.19 | C |
| ATOM | 5061 | N | THR | X | 19 | −25.745 | 89.520 | −36.323 | 1.00 | 40.09 | N |
| ATOM | 5062 | CA | THR | X | 19 | −24.519 | 88.924 | −35.825 | 1.00 | 43.49 | C |
| ATOM | 5063 | C | THR | X | 19 | −24.005 | 89.770 | −34.672 | 1.00 | 39.57 | C |
| ATOM | 5064 | O | THR | X | 19 | −24.036 | 91.000 | −34.737 | 1.00 | 39.43 | O |
| ATOM | 5065 | CB | THR | X | 19 | −23.484 | 88.816 | −36.961 | 1.00 | 40.40 | C |
| ATOM | 5066 | OG1 | THR | X | 19 | −23.352 | 87.443 | −37.322 | 1.00 | 51.45 | O |
| ATOM | 5067 | CG2 | THR | X | 19 | −22.132 | 89.395 | −36.582 | 1.00 | 45.74 | C |
| ATOM | 5068 | N | ILE | X | 20 | −23.557 | 89.116 | −33.607 | 1.00 | 36.67 | N |
| ATOM | 5069 | CA | ILE | X | 20 | −23.009 | 89.805 | −32.449 | 1.00 | 34.08 | C |
| ATOM | 5070 | C | ILE | X | 20 | −21.638 | 89.219 | −32.166 | 1.00 | 35.80 | C |
| ATOM | 5071 | O | ILE | X | 20 | −21.517 | 88.008 | −31.946 | 1.00 | 34.42 | O |
| ATOM | 5072 | CB | ILE | X | 20 | −23.917 | 89.679 | −31.210 | 1.00 | 36.76 | C |
| ATOM | 5073 | CG1 | ILE | X | 20 | −25.269 | 90.345 | −31.467 | 1.00 | 35.10 | C |
| ATOM | 5074 | CG2 | ILE | X | 20 | −23.257 | 90.324 | −29.996 | 1.00 | 27.82 | C |
| ATOM | 5075 | CD1 | ILE | X | 20 | −26.276 | 90.127 | −30.364 | 1.00 | 28.66 | C |
| ATOM | 5076 | N | SER | X | 21 | −20.614 | 90.068 | −32.153 | 1.00 | 38.15 | N |
| ATOM | 5077 | CA | SER | X | 21 | −19.237 | 89.614 | −31.980 | 1.00 | 37.42 | C |
| ATOM | 5078 | C | SER | X | 21 | −18.762 | 89.818 | −30.547 | 1.00 | 38.58 | C |
| ATOM | 5079 | O | SER | X | 21 | −19.344 | 90.570 | −29.762 | 1.00 | 39.24 | O |
| ATOM | 5080 | CB | SER | X | 21 | −18.290 | 90.351 | −32.932 | 1.00 | 30.39 | C |
| ATOM | 5081 | OG | SER | X | 21 | −18.312 | 91.741 | −32.656 | 1.00 | 45.43 | O |
| ATOM | 5082 | N | CYS | X | 22 | −17.662 | 89.152 | −30.226 | 1.00 | 31.32 | N |
| ATOM | 5083 | CA | CYS | X | 22 | −17.099 | 89.156 | −28.883 | 1.00 | 33.00 | C |
| ATOM | 5084 | C | CYS | X | 22 | −15.601 | 88.936 | −29.035 | 1.00 | 36.67 | C |
| ATOM | 5085 | O | CYS | X | 22 | −15.179 | 87.824 | −29.367 | 1.00 | 33.05 | O |
| ATOM | 5086 | CB | CYS | X | 22 | −17.737 | 88.067 | −28.029 | 1.00 | 33.80 | C |
| ATOM | 5087 | SG | CYS | X | 22 | −16.950 | 87.740 | −26.422 | 1.00 | 49.12 | S |
| ATOM | 5088 | N | SER | X | 23 | −14.806 | 89.986 | −28.830 | 1.00 | 35.27 | N |
| ATOM | 5089 | CA | SER | X | 23 | −13.362 | 89.917 | −29.015 | 1.00 | 36.02 | C |
| ATOM | 5090 | C | SER | X | 23 | −12.635 | 89.893 | −27.682 | 1.00 | 35.20 | C |
| ATOM | 5091 | O | SER | X | 23 | −12.961 | 90.659 | −26.765 | 1.00 | 32.83 | 0 |
| ATOM | 5092 | CB | SER | X | 23 | −12.847 | 91.105 | −29.824 | 1.00 | 34.28 | C |
| ATOM | 5093 | OG | SER | X | 23 | −13.487 | 91.109 | −31.082 | 1.00 | 60.42 | O |
| ATOM | 5094 | N | GLY | X | 24 | −11.631 | 89.027 | −27.600 | 1.00 | 29.76 | N |
| ATOM | 5095 | CA | GLY | X | 24 | −10.801 | 88.942 | −26.426 | 1.00 | 32.74 | C |
| ATOM | 5096 | C | GLY | X | 24 | −9.364 | 88.732 | −26.822 | 1.00 | 36.96 | C |
| ATOM | 5097 | O | GLY | X | 24 | −8.898 | 89.366 | −27.766 | 1.00 | 35.74 | O |
| ATOM | 5098 | N | SER | X | 25 | −8.666 | 87.829 | −26.132 | 1.00 | 34.51 | N |
| ATOM | 5099 | CA | SER | X | 25 | −7.238 | 87.632 | −26.326 | 1.00 | 35.15 | C |
| ATOM | 5100 | C | SER | X | 25 | −6.925 | 86.161 | −26.114 | 1.00 | 38.46 | C |
| ATOM | 5101 | O | SER | X | 25 | −7.793 | 85.366 | −25.733 | 1.00 | 35.89 | O |
| ATOM | 5102 | CB | SER | X | 25 | −6.411 | 88.485 | −25.366 | 1.00 | 31.48 | C |
| ATOM | 5103 | OG | SER | X | 25 | −6.531 | 87.980 | −24.047 | 1.00 | 41.73 | O |
| ATOM | 5104 | N | SER | X | 26 | −5.656 | 85.811 | −26.338 | 1.00 | 32.62 | N |
| ATOM | 5105 | CA | SER | X | 26 | −5.255 | 84.410 | −26.269 | 1.00 | 40.22 | C |
| ATOM | 5106 | C | SER | X | 26 | −5.478 | 83.825 | −24.886 | 1.00 | 39.50 | C |
| ATOM | 5107 | O | SER | X | 26 | −5.701 | 82.616 | −24.755 | 1.00 | 43.16 | O |
| ATOM | 5108 | CB | SER | X | 26 | −3.779 | 84.236 | −26.645 | 1.00 | 33.65 | C |
| ATOM | 5109 | OG | SER | X | 26 | −2.978 | 85.154 | −25.933 | 1.00 | 50.17 | O |
| ATOM | 5110 | N | SER | X | 27 | −5.442 | 84.650 | −23.847 | 1.00 | 37.12 | N |
| ATOM | 5111 | CA | SER | X | 27 | −5.564 | 84.097 | −22.504 | 1.00 | 35.96 | C |
| ATOM | 5112 | C | SER | X | 27 | −7.010 | 83.927 | −22.062 | 1.00 | 36.99 | C |
| ATOM | 5113 | O | SER | X | 27 | −7.236 | 83.380 | −20.976 | 1.00 | 37.69 | O |
| ATOM | 5114 | CB | SER | X | 27 | −4.848 | 84.982 | −21.480 | 1.00 | 32.77 | C |
| ATOM | 5115 | OG | SER | X | 27 | −5.484 | 86.238 | −21.459 | 1.00 | 46.10 | O |
| ATOM | 5116 | N | ASN | X | 28 | −7.992 | 84.407 | −22.840 | 1.00 | 35.46 | N |
| ATOM | 5117 | CA | ASN | X | 28 | −9.372 | 84.080 | −22.495 | 1.00 | 33.17 | C |
| ATOM | 5118 | C | ASN | X | 28 | −10.056 | 83.327 | −23.636 | 1.00 | 34.99 | C |
| ATOM | 5119 | O | ASN | X | 28 | −10.028 | 82.089 | −23.659 | 1.00 | 30.44 | O |
| ATOM | 5120 | CB | ASN | X | 28 | −10.161 | 85.324 | −22.072 | 1.00 | 29.46 | C |
| ATOM | 5121 | CG | ASN | X | 28 | −9.945 | 86.529 | −22.981 | 1.00 | 33.39 | C |
| ATOM | 5122 | OD1 | ASN | X | 28 | −10.325 | 86.527 | −24.163 | 1.00 | 33.37 | O |
| ATOM | 5123 | ND2 | ASN | X | 28 | −9.394 | 87.594 | −22.408 | 1.00 | 28.13 | N |
| ATOM | 5124 | N | ILE | X | 29 | −10.677 | 84.041 | −24.577 | 1.00 | 26.63 | N |
| ATOM | 5125 | CA | ILE | X | 29 | −11.370 | 83.349 | −25.660 | 1.00 | 33.95 | C |
| ATOM | 5126 | C | ILE | X | 29 | −10.423 | 82.422 | −26.417 | 1.00 | 37.55 | C |
| ATOM | 5127 | O | ILE | X | 29 | −10.814 | 81.335 | −26.857 | 1.00 | 33.77 | O |
| ATOM | 5128 | CB | ILE | X | 29 | −12.029 | 84.355 | −26.611 | 1.00 | 31.78 | C |
| ATOM | 5129 | CG1 | ILE | X | 29 | −13.165 | 85.074 | −25.894 | 1.00 | 37.08 | C |
| ATOM | 5130 | CG2 | ILE | X | 29 | −12.570 | 83.634 | −27.846 | 1.00 | 27.80 | C |
| ATOM | 5131 | CD1 | ILE | X | 29 | −13.921 | 85.975 | −26.801 | 1.00 | 36.60 | C |
| ATOM | 5132 | N | GLY | X | 30 | −9.171 | 82.838 | −26.596 | 1.00 | 38.13 | N |
| ATOM | 5133 | CA | GLY | X | 30 | −8.264 | 82.044 | −27.399 | 1.00 | 32.55 | C |
| ATOM | 5134 | C | GLY | X | 30 | −7.961 | 80.683 | −26.819 | 1.00 | 33.31 | C |

TABLE 10.3-continued

| | | | | | | | | | | |
|---|---|---|---|---|---|---|---|---|---|---|
| ATOM | 5135 | O | GLY | X | 30 | −7.589 | 79.781 | −27.559 | 1.00 | 43.57 | O |
| ATOM | 5136 | N | ASN | X | 31 | −8.136 | 80.495 | −25.521 | 1.00 | 40.07 | N |
| ATOM | 5137 | CA | ASN | X | 31 | −7.797 | 79.191 | −24.968 | 1.00 | 37.30 | C |
| ATOM | 5138 | C | ASN | X | 31 | −8.808 | 78.618 | −23.980 | 1.00 | 36.23 | C |
| ATOM | 5139 | O | ASN | X | 31 | −8.500 | 77.622 | −23.324 | 1.00 | 37.83 | O |
| ATOM | 5140 | CB | ASN | X | 31 | −6.405 | 79.245 | −24.343 | 1.00 | 43.50 | C |
| ATOM | 5141 | CG | ASN | X | 31 | −5.314 | 79.117 | −25.408 | 1.00 | 56.73 | C |
| ATOM | 5142 | OD1 | ASN | X | 31 | −5.006 | 78.007 | −25.858 | 1.00 | 58.50 | O |
| ATOM | 5143 | ND2 | ASN | X | 31 | −4.764 | 80.253 | −25.851 | 1.00 | 48.77 | N |
| ATOM | 5144 | N | ASN | X | 32 | −10.015 | 79.157 | −23.886 | 1.00 | 33.81 | N |
| ATOM | 5145 | CA | ASN | X | 32 | −10.979 | 78.603 | −22.954 | 1.00 | 35.74 | C |
| ATOM | 5146 | C | ASN | X | 32 | −12.338 | 78.460 | −23.628 | 1.00 | 33.34 | C |
| ATOM | 5147 | O | ASN | X | 32 | −12.583 | 79.011 | −24.700 | 1.00 | 34.66 | 0 |
| ATOM | 5148 | CB | ASN | X | 32 | −11.035 | 79.466 | −21.699 | 1.00 | 32.31 | C |
| ATOM | 5149 | CG | ASN | X | 32 | −9.711 | 79.508 | −20.983 | 1.00 | 33.00 | C |
| ATOM | 5150 | OD1 | ASN | X | 32 | −9.339 | 78.559 | −20.300 | 1.00 | 35.81 | O |
| ATOM | 5151 | ND2 | ASN | X | 32 | −8.979 | 80.606 | −21.141 | 1.00 | 40.72 | N |
| ATOM | 5152 | N | TYR | X | 33 | −13.220 | 77.691 | −22.998 | 1.00 | 33.41 | N |
| ATOM | 5153 | CA | TYR | X | 33 | −14.543 | 77.451 | −23.572 | 1.00 | 35.49 | C |
| ATOM | 5154 | C | TYR | X | 33 | −15.355 | 78.735 | −23.542 | 1.00 | 30.39 | C |
| ATOM | 5155 | O | TYR | X | 33 | −15.333 | 79.455 | −22.555 | 1.00 | 29.67 | O |
| ATOM | 5156 | CB | TYR | X | 33 | −15.281 | 76.348 | −22.793 | 1.00 | 28.71 | C |
| ATOM | 5157 | CG | TYR | X | 33 | −14.627 | 74.978 | −22.878 | 1.00 | 33.53 | C |
| ATOM | 5158 | CD1 | TYR | X | 33 | −14.513 | 74.311 | −24.098 | 1.00 | 27.38 | C |
| ATOM | 5159 | CD2 | TYR | X | 33 | −14.115 | 74.356 | −21.740 | 1.00 | 32.47 | C |
| ATOM | 5160 | CE1 | TYR | X | 33 | −13.915 | 73.063 | −24.178 | 1.00 | 30.49 | C |
| ATOM | 5161 | CE2 | TYR | X | 33 | −13.514 | 73.101 | −21.813 | 1.00 | 31.14 | C |
| ATOM | 5162 | CZ | TYR | X | 33 | −13.409 | 72.468 | −23.043 | 1.00 | 31.76 | C |
| ATOM | 5163 | OH | TYR | X | 33 | −12.815 | 71.235 | −23.121 | 1.00 | 31.17 | O |
| ATOM | 5164 | N | VAL | X | 34 | −16.106 | 79.006 | −24.602 | 1.00 | 29.15 | N |
| ATOM | 5165 | CA | VAL | X | 34 | −16.887 | 80.240 | −24.708 | 1.00 | 36.08 | C |
| ATOM | 5166 | C | VAL | X | 34 | −18.366 | 79.954 | −24.434 | 1.00 | 32.87 | C |
| ATOM | 5167 | O | VAL | X | 34 | −18.934 | 79.011 | −24.996 | 1.00 | 30.79 | O |
| ATOM | 5168 | CB | VAL | X | 34 | −16.704 | 80.865 | −26.098 | 1.00 | 33.81 | C |
| ATOM | 5169 | CG1 | VAL | X | 34 | −17.582 | 82.090 | −26.255 | 1.00 | 27.19 | C |
| ATOM | 5170 | CG2 | VAL | X | 34 | −15.243 | 81.172 | −26.332 | 1.00 | 32.31 | C |
| ATOM | 5171 | N | SER | X | 35 | −19.008 | 80.798 | −23.617 | 1.00 | 32.88 | N |
| ATOM | 5172 | CA | SER | X | 35 | −20.444 | 80.696 | −23.349 | 1.00 | 30.32 | C |
| ATOM | 5173 | C | SER | X | 35 | −21.176 | 81.975 | −23.759 | 1.00 | 32.72 | C |
| ATOM | 5174 | O | SER | X | 35 | −20.616 | 83.075 | −23.709 | 1.00 | 28.89 | O |
| ATOM | 5175 | CB | SER | X | 35 | −20.725 | 80.419 | −21.869 | 1.00 | 28.37 | C |
| ATOM | 5176 | OG | SER | X | 35 | −20.265 | 79.144 | −21.480 | 1.00 | 28.41 | O |
| ATOM | 5177 | N | TRP | X | 36 | −22.446 | 81.832 | −24.154 | 1.00 | 28.96 | N |
| ATOM | 5178 | CA | TRP | X | 36 | −23.308 | 82.972 | −24.451 | 1.00 | 27.19 | C |
| ATOM | 5179 | C | TRP | X | 36 | −24.541 | 82.934 | −23.566 | 1.00 | 32.55 | C |
| ATOM | 5180 | O | TRP | X | 36 | −25.151 | 81.873 | −23.374 | 1.00 | 33.96 | O |
| ATOM | 5181 | CB | TRP | X | 36 | −23.738 | 83.010 | −25.915 | 1.00 | 28.66 | C |
| ATOM | 5182 | CG | TRP | X | 36 | −22.661 | 83.470 | −26.893 | 1.00 | 32.03 | C |
| ATOM | 5183 | CD1 | TRP | X | 36 | −21.775 | 82.676 | −27.576 | 1.00 | 30.86 | C |
| ATOM | 5184 | CD2 | TRP | X | 36 | −22.382 | 84.821 | −27.305 | 1.00 | 29.58 | C |
| ATOM | 5185 | NE1 | TRP | X | 36 | −20.965 | 83.451 | −28.377 | 1.00 | 29.86 | N |
| ATOM | 5186 | CE2 | TRP | X | 36 | −21.320 | 84.767 | −28.231 | 1.00 | 32.46 | C |
| ATOM | 5187 | CE3 | TRP | X | 36 | −22.926 | 86.067 | −26.979 | 1.00 | 30.71 | C |
| ATOM | 5188 | CZ2 | TRP | X | 36 | −20.784 | 85.917 | −28.827 | 1.00 | 34.25 | C |
| ATOM | 5189 | CZ3 | TRP | X | 36 | −22.391 | 87.204 | −27.571 | 1.00 | 32.12 | C |
| ATOM | 5190 | CH2 | TRP | X | 36 | −21.329 | 87.120 | −28.480 | 1.00 | 31.97 | C |
| ATOM | 5191 | N | TYR | X | 37 | −24.909 | 84.105 | −23.040 | 1.00 | 34.18 | N |
| ATOM | 5192 | CA | TYR | X | 37 | −26.054 | 84.256 | −22.152 | 1.00 | 28.55 | C |
| ATOM | 5193 | C | TYR | X | 37 | −27.044 | 85.232 | −22.763 | 1.00 | 30.63 | C |
| ATOM | 5194 | O | TYR | X | 37 | −26.646 | 86.220 | −23.399 | 1.00 | 30.08 | O |
| ATOM | 5195 | CB | TYR | X | 37 | −25.607 | 84.731 | −20.760 | 1.00 | 24.98 | C |
| ATOM | 5196 | CG | TYR | X | 37 | −24.567 | 83.797 | −20.195 | 1.00 | 29.34 | C |
| ATOM | 5197 | CD1 | TYR | X | 37 | −24.941 | 82.601 | −19.573 | 1.00 | 27.60 | C |
| ATOM | 5198 | CD2 | TYR | X | 37 | −23.210 | 84.059 | −20.346 | 1.00 | 27.93 | C |
| ATOM | 5199 | CE1 | TYR | X | 37 | −23.978 | 81.699 | −19.056 | 1.00 | 30.73 | C |
| ATOM | 5200 | CE2 | TYR | X | 37 | −22.234 | 83.172 | −19.828 | 1.00 | 31.38 | C |
| ATOM | 5201 | CZ | TYR | X | 37 | −22.629 | 81.990 | −19.195 | 1.00 | 32.90 | C |
| ATOM | 5202 | OH | TYR | X | 37 | −21.685 | 81.119 | −18.701 | 1.00 | 30.71 | O |
| ATOM | 5203 | N | GLN | X | 38 | −28.331 | 84.926 | −22.592 | 1.00 | 29.50 | N |
| ATOM | 5204 | CA | GLN | X | 38 | −29.430 | 85.780 | −23.026 | 1.00 | 30.90 | C |
| ATOM | 5205 | C | GLN | X | 38 | −30.211 | 86.252 | −21.807 | 1.00 | 31.01 | C |
| ATOM | 5206 | O | GLN | X | 38 | −30.612 | 85.436 | −20.970 | 1.00 | 29.04 | O |
| ATOM | 5207 | CB | GLN | X | 38 | −30.365 | 85.044 | −23.979 | 1.00 | 27.81 | C |
| ATOM | 5208 | CG | GLN | X | 38 | −31.587 | 85.851 | −24.407 | 1.00 | 27.64 | C |
| ATOM | 5209 | CD | GLN | X | 38 | −32.640 | 84.958 | −25.007 | 1.00 | 34.54 | C |
| ATOM | 5210 | OE1 | GLN | X | 38 | −33.141 | 84.043 | −24.329 | 1.00 | 34.50 | O |
| ATOM | 5211 | NE2 | GLN | X | 38 | −32.985 | 85.195 | −26.279 | 1.00 | 26.87 | N |
| ATOM | 5212 | N | GLN | X | 39 | −30.416 | 87.566 | −21.705 | 1.00 | 29.58 | N |
| ATOM | 5213 | CA | GLN | X | 39 | −31.199 | 88.157 | −20.623 | 1.00 | 29.79 | C |
| ATOM | 5214 | C | GLN | X | 39 | −32.378 | 88.907 | −21.252 | 1.00 | 36.36 | C |

TABLE 10.3-continued

| | | | | | | | | | | |
|---|---|---|---|---|---|---|---|---|---|---|
| ATOM | 5215 | O | GLN | X | 39 | −32.234 | 90.040 | −21.731 | 1.00 | 37.54 | O |
| ATOM | 5216 | CB | GLN | X | 39 | −30.341 | 89.067 | −19.749 | 1.00 | 26.28 | C |
| ATOM | 5217 | CG | GLN | X | 39 | −31.077 | 89.513 | −18.479 | 1.00 | 31.07 | C |
| ATOM | 5218 | CD | GLN | X | 39 | −30.207 | 90.302 | −17.520 | 1.00 | 33.21 | C |
| ATOM | 5219 | OE1 | GLN | X | 39 | −29.255 | 90.951 | −17.926 | 1.00 | 33.77 | O |
| ATOM | 5220 | NE2 | GLN | X | 39 | −30.542 | 90.260 | −16.241 | 1.00 | 34.37 | N |
| ATOM | 5221 | N | LEU | X | 40 | −33.539 | 88.255 | −21.271 | 1.00 | 32.04 | N |
| ATOM | 5222 | CA | LEU | X | 40 | −34.756 | 88.889 | −21.729 | 1.00 | 34.90 | C |
| ATOM | 5223 | C | LEU | X | 40 | −35.132 | 90.007 | −20.753 | 1.00 | 38.54 | C |
| ATOM | 5224 | O | LEU | X | 40 | −34.759 | 89.948 | −19.575 | 1.00 | 31.68 | O |
| ATOM | 5225 | CB | LEU | X | 40 | −35.872 | 87.851 | −21.832 | 1.00 | 33.07 | C |
| ATOM | 5226 | CG | LEU | X | 40 | −35.490 | 86.643 | −22.697 | 1.00 | 39.00 | C |
| ATOM | 5227 | CD1 | LEU | X | 40 | −36.411 | 85.450 | −22.373 | 1.00 | 38.05 | C |
| ATOM | 5228 | CD2 | TEU | X | 40 | −35.493 | 86.947 | −24.228 | 1.00 | 26.12 | C |
| ATOM | 5229 | N | PRO | X | 41 | −35.826 | 91.047 | −21.227 | 1.00 | 36.64 | N |
| ATOM | 5230 | CA | PRO | X | 41 | −36.146 | 92.208 | −20.371 | 1.00 | 41.13 | C |
| ATOM | 5231 | C | PRO | X | 41 | −36.855 | 91.770 | −19.096 | 1.00 | 38.67 | C |
| ATOM | 5232 | O | PRO | X | 41 | −37.737 | 90.913 | −19.128 | 1.00 | 32.82 | O |
| ATOM | 5233 | CB | PRO | X | 41 | −37.079 | 93.058 | −21.246 | 1.00 | 36.21 | C |
| ATOM | 5234 | CG | PRO | X | 41 | −36.885 | 92.555 | −22.651 | 1.00 | 38.84 | C |
| ATOM | 5235 | CD | PRO | X | 41 | −36.528 | 91.097 | −22.519 | 1.00 | 39.30 | C |
| ATOM | 5236 | N | GLY | X | 42 | −36.410 | 92.308 | −17.961 | 1.00 | 37.25 | N |
| ATOM | 5237 | CA | GLY | X | 42 | −36.981 | 91.946 | −16.678 | 1.00 | 39.06 | C |
| ATOM | 5238 | C | GLY | X | 42 | −36.772 | 90.514 | −16.194 | 1.00 | 47.15 | C |
| ATOM | 5239 | O | GLY | X | 42 | −37.474 | 90.080 | −15.269 | 1.00 | 47.29 | O |
| ATOM | 5240 | N | THR | X | 43 | −35.830 | 89.759 | −16.760 | 1.00 | 42.87 | N |
| ATOM | 5241 | CA | THR | X | 43 | −35.594 | 88.390 | −16.295 | 1.00 | 41.60 | C |
| ATOM | 5242 | C | THR | X | 43 | −34.125 | 88.218 | −15.937 | 1.00 | 34.86 | C |
| ATOM | 5243 | O | THR | X | 43 | −33.283 | 89.070 | −16.225 | 1.00 | 35.66 | O |
| ATOM | 5244 | CB | THR | X | 43 | −35.966 | 87.300 | −17.340 | 1.00 | 38.72 | C |
| ATOM | 5245 | OG1 | THR | X | 43 | −34.965 | 87.232 | −18.372 | 1.00 | 37.04 | O |
| ATOM | 5246 | CG2 | THR | X | 43 | −37.299 | 87.578 | −18.007 | 1.00 | 39.86 | C |
| ATOM | 5247 | N | ALA | X | 44 | −33.838 | 87.056 | −15.351 | 1.00 | 36.79 | N |
| ATOM | 5248 | CA | ALA | X | 44 | −32.495 | 86.614 | −15.069 | 1.00 | 33.26 | C |
| ATOM | 5249 | C | ALA | X | 44 | −31.804 | 86.190 | −16.368 | 1.00 | 34.93 | C |
| ATOM | 5250 | O | ALA | X | 44 | −32.466 | 85.879 | −17.358 | 1.00 | 32.13 | O |
| ATOM | 5251 | CB | ALA | X | 44 | −32.537 | 85.449 | −14.085 | 1.00 | 29.97 | C |
| ATOM | 5252 | N | PRO | X | 45 | −30.470 | 86.187 | −16.399 | 1.00 | 31.73 | N |
| ATOM | 5253 | CA | PRO | X | 45 | −29.779 | 85.591 | −17.540 | 1.00 | 29.03 | C |
| ATOM | 5254 | C | PRO | X | 45 | −30.152 | 84.124 | −17.700 | 1.00 | 32.97 | C |
| ATOM | 5255 | O | PRO | X | 45 | −30.631 | 83.455 | −16.779 | 1.00 | 27.00 | O |
| ATOM | 5256 | CB | PRO | X | 45 | −28.294 | 85.750 | −17.187 | 1.00 | 29.30 | C |
| ATOM | 5257 | CG | PRO | X | 45 | −28.267 | 86.928 | −16.262 | 1.00 | 32.14 | C |
| ATOM | 5258 | CD | PRO | X | 45 | −29.524 | 86.784 | −15.442 | 1.00 | 28.71 | C |
| ATOM | 5259 | N | LYS | X | 46 | −29.905 | 83.624 | −18.898 | 1.00 | 28.36 | N |
| ATOM | 5260 | CA | LYS | X | 46 | −30.155 | 82.237 | −19.238 | 1.00 | 34.68 | C |
| ATOM | 5261 | C | LYS | X | 46 | −29.009 | 81.792 | −20.131 | 1.00 | 35.47 | C |
| ATOM | 5262 | O | LYS | X | 46 | −28.503 | 82.593 | −20.930 | 1.00 | 27.61 | O |
| ATOM | 5263 | CB | LYS | X | 46 | −31.500 | 82.135 | −19.949 | 1.00 | 31.10 | C |
| ATOM | 5264 | CG | LYS | X | 46 | −31.750 | 80.915 | −20.700 | 1.00 | 41.49 | C |
| ATOM | 5265 | CD | LYS | X | 46 | −32.725 | 81.196 | −21.858 | 1.00 | 47.60 | C |
| ATOM | 5266 | CE | LYS | X | 46 | −33.943 | 81.979 | −21.420 | 1.00 | 48.37 | C |
| ATOM | 5267 | NZ | LYS | X | 46 | −35.081 | 81.729 | −22.345 | 1.00 | 49.13 | N1+ |
| ATOM | 5268 | N | LEU | X | 47 | −28.574 | 80.539 | −19.977 | 1.00 | 28.77 | N |
| ATOM | 5269 | CA | LEU | X | 47 | −27.546 | 80.027 | −20.872 | 1.00 | 24.97 | C |
| ATOM | 5270 | C | LEU | X | 47 | −28.138 | 79.828 | −22.264 | 1.00 | 32.77 | C |
| ATOM | 5271 | O | LEU | X | 47 | −29.190 | 79.200 | −22.426 | 1.00 | 29.18 | O |
| ATOM | 5272 | CB | LEU | X | 47 | −26.955 | 78.730 | −20.347 | 1.00 | 26.07 | C |
| ATOM | 5273 | CG | LEU | X | 47 | −25.872 | 78.105 | −21.231 | 1.00 | 29.09 | C |
| ATOM | 5274 | CD1 | LEU | X | 47 | −24.689 | 79.042 | −21.402 | 1.00 | 29.03 | C |
| ATOM | 5275 | CD2 | LEU | X | 47 | −25.420 | 76.789 | −20.647 | 1.00 | 27.90 | C |
| ATOM | 5276 | N | LEU | X | 48 | −27.482 | 80.418 | −23.260 | 1.00 | 30.28 | N |
| ATOM | 5277 | CA | LEU | X | 48 | −27.901 | 80.361 | −24.651 | 1.00 | 33.70 | C |
| ATOM | 5278 | C | LEU | X | 48 | −27.075 | 79.352 | −25.441 | 1.00 | 38.84 | C |
| ATOM | 5279 | O | LEU | X | 48 | −27.633 | 78.536 | −26.179 | 1.00 | 35.80 | O |
| ATOM | 5280 | CB | LEU | X | 48 | −27.787 | 81.757 | −25.286 | 1.00 | 30.10 | C |
| ATOM | 5281 | CG | LEU | X | 48 | −28.388 | 81.949 | −26.684 | 1.00 | 36.25 | C |
| ATOM | 5282 | CD1 | LEU | X | 48 | −29.916 | 81.905 | −26.686 | 1.00 | 29.13 | C |
| ATOM | 5283 | CD2 | LEU | X | 48 | −27.887 | 83.232 | −27.342 | 1.00 | 32.77 | C |
| ATOM | 5284 | N | LEU | X | 49 | −25.749 | 79.397 | −25.279 | 1.00 | 38.10 | N |
| ATOM | 5285 | CA | LEU | X | 49 | −24.799 | 78.535 | −25.968 | 1.00 | 29.61 | C |
| ATOM | 5286 | C | LEU | X | 49 | −23.642 | 78.253 | −25.028 | 1.00 | 31.16 | C |
| ATOM | 5287 | O | LEU | X | 49 | −23.153 | 79.160 | −24.352 | 1.00 | 32.51 | O |
| ATOM | 5288 | CB | LEU | X | 49 | −24.241 | 79.177 | −27.235 | 1.00 | 29.50 | C |
| ATOM | 5289 | CG | LEU | X | 49 | −25.158 | 79.484 | −28.410 | 1.00 | 35.20 | C |
| ATOM | 5290 | CD1 | LEU | X | 49 | −24.385 | 80.328 | −29.434 | 1.00 | 32.31 | C |
| ATOM | 5291 | CD2 | LEU | X | 49 | −25.624 | 78.172 | −29.024 | 1.00 | 29.29 | C |
| ATOM | 5292 | N | TYR | X | 50 | −23.204 | 77.003 | −24.983 | 1.00 | 27.72 | N |
| ATOM | 5293 | CA | TYR | X | 50 | −21.976 | 76.679 | −24.285 | 1.00 | 28.60 | C |
| ATOM | 5294 | C | TYR | X | 50 | −21.037 | 75.963 | −25.242 | 1.00 | 30.23 | C |

TABLE 10.3-continued

| | | | | | | | | | | |
|---|---|---|---|---|---|---|---|---|---|---|
| ATOM | 5295 | O | TYR | X | 50 | −21.429 | 75.569 | −26.346 | 1.00 | 31.08 | O |
| ATOM | 5296 | CB | TYR | X | 50 | −22.250 | 75.864 | −23.018 | 1.00 | 28.65 | C |
| ATOM | 5297 | CG | TYR | X | 50 | −22.900 | 74.531 | −23.227 | 1.00 | 33.55 | C |
| ATOM | 5298 | CD1 | TYR | X | 50 | −24.246 | 74.422 | −23.613 | 1.00 | 37.48 | C |
| ATOM | 5299 | CD2 | TYR | X | 50 | −22.196 | 73.384 | −22.985 | 1.00 | 29.14 | C |
| ATOM | 5300 | CE1 | TYR | X | 50 | −24.833 | 73.183 | −23.799 | 1.00 | 34.48 | C |
| ATOM | 5301 | CE2 | TYR | X | 50 | −22.768 | 72.149 | −23.152 | 1.00 | 39.17 | C |
| ATOM | 5302 | CZ | TYR | X | 50 | −24.076 | 72.041 | −23.550 | 1.00 | 38.17 | C |
| ATOM | 5303 | OH | TYR | X | 50 | −24.590 | 70.771 | −23.700 | 1.00 | 35.08 | O |
| ATOM | 5304 | N | ASP | X | 51 | −19.768 | 75.877 | −24.840 | 1.00 | 31.56 | N |
| ATOM | 5305 | CA | ASP | X | 51 | −18.698 | 75.390 | −25.713 | 1.00 | 29.21 | C |
| ATOM | 5306 | C | ASP | X | 51 | −18.816 | 76.000 | −27.122 | 1.00 | 34.44 | C |
| ATOM | 5307 | O | ASP | X | 51 | −18.908 | 75.308 | −28.144 | 1.00 | 31.23 | O |
| ATOM | 5308 | CB | ASP | X | 51 | −18.699 | 73.865 | −25.753 | 1.00 | 30.93 | C |
| ATOM | 5309 | CG | ASP | X | 51 | −17.509 | 73.308 | −26.507 | 1.00 | 34.52 | C |
| ATOM | 5310 | OD1 | ASP | X | 51 | −16.467 | 74.009 | −26.589 | 1.00 | 38.97 | O |
| ATOM | 5311 | OD2 | ASP | X | 51 | −17.633 | 72.187 | −27.047 | 1.00 | 37.63 | O1− |
| ATOM | 5312 | N | SER | X | 52 | −18.882 | 77.333 | −27.151 | 1.00 | 29.36 | N |
| ATOM | 5313 | CA | SER | X | 52 | −18.957 | 78.121 | −28.379 | 1.00 | 32.69 | C |
| ATOM | 5314 | C | SER | X | 52 | −20.258 | 77.970 | −29.163 | 1.00 | 32.50 | C |
| ATOM | 5315 | O | SER | X | 52 | −20.805 | 78.977 | −29.637 | 1.00 | 32.67 | O |
| ATOM | 5316 | CB | SER | X | 52 | −17.781 | 77.808 | −29.305 | 1.00 | 32.99 | C |
| ATOM | 5317 | OG | SER | X | 52 | −16.569 | 78.277 | −28.744 | 1.00 | 42.26 | O |
| ATOM | 5318 | N | ASN | X | 53 | −20.772 | 76.746 | −29.333 | 1.00 | 31.33 | N |
| ATOM | 5319 | CA | ASN | X | 53 | −21.880 | 76.604 | −30.271 | 1.00 | 33.53 | C |
| ATOM | 5320 | C | ASN | X | 53 | −22.896 | 75.532 | −29.886 | 1.00 | 36.41 | C |
| ATOM | 5321 | O | ASN | X | 53 | −23.725 | 75.172 | −30.735 | 1.00 | 34.64 | O |
| ATOM | 5322 | CB | ASN | X | 53 | −21.326 | 76.305 | −31.671 | 1.00 | 29.24 | C |
| ATOM | 5323 | CG | ASN | X | 53 | −20.625 | 74.953 | −31.730 | 1.00 | 38.39 | C |
| ATOM | 5324 | OD1 | ASN | X | 53 | −20.519 | 74.254 | −30.721 | 1.00 | 35.56 | O |
| ATOM | 5325 | ND2 | ASN | X | 53 | −20.163 | 74.573 | −32.906 | 1.00 | 35.38 | N |
| ATOM | 5326 | N | LYS | X | 54 | −22.879 | 75.013 | −28.657 | 1.00 | 37.93 | N |
| ATOM | 5327 | CA | LYS | X | 54 | −23.821 | 73.978 | −28.239 | 1.00 | 37.84 | C |
| ATOM | 5328 | C | LYS | X | 54 | −25.063 | 74.592 | −27.605 | 1.00 | 33.93 | C |
| ATOM | 5329 | O | LYS | X | 54 | −24.957 | 75.380 | −26.656 | 1.00 | 33.00 | O |
| ATOM | 5330 | CB | LYS | X | 54 | −23.165 | 73.014 | −27.250 | 1.00 | 34.82 | C |
| ATOM | 5331 | CG | LYS | X | 54 | −24.025 | 71.814 | −26.907 | 1.00 | 36.40 | C |
| ATOM | 5332 | CD | LYS | X | 54 | −24.191 | 70.937 | −28.131 | 1.00 | 37.62 | C |
| ATOM | 5333 | CE | LYS | X | 54 | −25.209 | 69.832 | −27.894 | 1.00 | 33.30 | C |
| ATOM | 5334 | NZ | LYS | X | 54 | −25.145 | 68.918 | −29.053 | 1.00 | 47.57 | N1+ |
| ATOM | 5335 | N | AARG | X | 55 | −26.235 | 74.212 | −28.121 | 0.50 | 35.72 | N |
| ATOM | 5336 | CA | AARG | X | 55 | −27.511 | 74.703 | −27.600 | 0.50 | 37.84 | C |
| ATOM | 5337 | C | AARG | X | 55 | −27.955 | 73.849 | −26.418 | 0.50 | 37.19 | C |
| ATOM | 5338 | O | AARG | X | 55 | −28.052 | 72.622 | −26.555 | 0.50 | 39.62 | O |
| ATOM | 5339 | CB | AARG | X | 55 | −28.585 | 74.683 | −28.683 | 0.50 | 35.53 | C |
| ATOM | 5340 | CG | AARG | X | 55 | −28.487 | 75.808 | −29.722 | 0.50 | 38.76 | C |
| ATOM | 5341 | CD | AARG | X | 55 | −29.610 | 75.753 | −30.781 | 0.50 | 37.60 | C |
| ATOM | 5342 | NE | AARG | X | 55 | −29.427 | 74.636 | −31.705 | 0.50 | 42.24 | N |
| ATOM | 5343 | CZ | AARG | X | 55 | −30.198 | 73.555 | −31.759 | 0.50 | 40.39 | C |
| ATOM | 5344 | NH1 | AARG | X | 55 | −29.919 | 72.598 | −32.628 | 0.50 | 43.66 | N1+ |
| ATOM | 5345 | NH2 | AARG | X | 55 | −31.248 | 73.434 | −30.961 | 0.50 | 39.76 | N |
| ATOM | 5346 | N | BARG | X | 55 | −26.235 | 74.213 | −28.110 | 0.50 | 35.73 | N |
| ATOM | 5347 | CA | BARG | X | 55 | −27.499 | 74.742 | −27.594 | 0.50 | 37.86 | C |
| ATOM | 5348 | C | BARG | X | 55 | −27.999 | 73.875 | −26.441 | 0.50 | 37.17 | C |
| ATOM | 5349 | O | BARG | X | 55 | −28.165 | 72.661 | −26.619 | 0.50 | 39.65 | O |
| ATOM | 5350 | CB | BARG | X | 55 | −28.548 | 74.810 | −28.701 | 0.50 | 35.58 | C |
| ATOM | 5351 | CG | BARG | X | 55 | −28.335 | 75.971 | −29.695 | 0.50 | 38.67 | C |
| ATOM | 5352 | CD | BARG | X | 55 | −29.274 | 75.940 | −30.919 | 0.50 | 37.26 | C |
| ATOM | 5353 | NE | BARG | X | 55 | −28.921 | 74.866 | −31.845 | 0.50 | 42.86 | N |
| ATOM | 5354 | CZ | BARG | X | 55 | −28.062 | 74.983 | −32.859 | 0.50 | 43.30 | C |
| ATOM | 5355 | NH1 | BARG | X | 55 | −27.465 | 76.140 | −33.108 | 0.50 | 28.23 | N1+ |
| ATOM | 5356 | NH2 | BARG | X | 55 | −27.803 | 73.928 | −33.632 | 0.50 | 47.26 | N |
| ATOM | 5357 | N | PRO | X | 56 | −28.209 | 74.432 | −25.251 | 1.00 | 39.61 | N |
| ATOM | 5358 | CA | PRO | X | 56 | −28.924 | 73.683 | −24.208 | 1.00 | 37.27 | C |
| ATOM | 5359 | C | PRO | X | 56 | −30.328 | 73.384 | −24.708 | 1.00 | 37.17 | C |
| ATOM | 5360 | O | PRO | X | 56 | −30.836 | 74.048 | −25.614 | 1.00 | 35.06 | O |
| ATOM | 5361 | CB | PRO | X | 56 | −28.960 | 74.643 | −23.020 | 1.00 | 32.87 | C |
| ATOM | 5362 | CG | PRO | X | 56 | −28.041 | 75.768 | −23.374 | 1.00 | 39.79 | C |
| ATOM | 5363 | CD | PRO | X | 56 | −27.841 | 75.794 | −24.846 | 1.00 | 34.03 | C |
| ATOM | 5364 | N | SER | X | 57 | −30.973 | 72.378 | −24.127 | 1.00 | 35.37 | N |
| ATOM | 5365 | CA | SER | X | 57 | −32.324 | 72.095 | −24.603 | 1.00 | 45.77 | C |
| ATOM | 5366 | C | SER | X | 57 | −33.240 | 73.271 | −24.286 | 1.00 | 39.53 | C |
| ATOM | 5367 | O | SER | X | 57 | −33.082 | 73.960 | −23.274 | 1.00 | 42.51 | O |
| ATOM | 5368 | CB | SER | X | 57 | −32.860 | 70.777 | −24.033 | 1.00 | 44.76 | C |
| ATOM | 5369 | OG | SER | X | 57 | −32.486 | 70.611 | −22.686 | 1.00 | 57.37 | O |
| ATOM | 5370 | N | GLY | X | 58 | −34.149 | 73.551 | −25.208 | 1.00 | 46.11 | N |
| ATOM | 5371 | CA | GLY | X | 58 | −35.017 | 74.704 | −25.108 | 1.00 | 38.41 | C |
| ATOM | 5372 | C | GLY | X | 58 | −34.575 | 75.906 | −25.915 | 1.00 | 46.36 | C |
| ATOM | 5373 | O | GLY | X | 58 | −35.360 | 76.846 | −26.056 | 1.00 | 47.75 | O |
| ATOM | 5374 | N | ILE | X | 59 | −33.356 | 75.916 | −26.442 | 1.00 | 38.47 | N |

TABLE 10.3-continued

| | | | | | | | | | | |
|---|---|---|---|---|---|---|---|---|---|---|
| ATOM | 5375 | CA | ILE | X | 59 | −32.858 | 77.042 | −27.231 | 1.00 | 39.45 | C |
| ATOM | 5376 | C | ILE | X | 59 | −33.096 | 76.740 | −28.706 | 1.00 | 38.36 | C |
| ATOM | 5377 | O | ILE | X | 59 | −32.567 | 75.743 | −29.218 | 1.00 | 41.39 | O |
| ATOM | 5378 | CB | ILE | X | 59 | −31.372 | 77.301 | −26.950 | 1.00 | 41.60 | C |
| ATOM | 5379 | CG1 | ILE | X | 59 | −31.165 | 77.604 | −25.460 | 1.00 | 39.46 | C |
| ATOM | 5380 | CG2 | ILE | X | 59 | −30.858 | 78.449 | −27.839 | 1.00 | 36.16 | C |
| ATOM | 5381 | CD1 | ILE | X | 59 | −31.957 | 78.855 | −24.970 | 1.00 | 33.58 | C |
| ATOM | 5382 | N | PRO | X | 60 | −33.829 | 77.583 | −29.429 | 1.00 | 38.04 | N |
| ATOM | 5383 | CA | PRO | X | 60 | −34.124 | 77.311 | −30.841 | 1.00 | 40.67 | C |
| ATOM | 5384 | C | PRO | X | 60 | −32.877 | 77.315 | −31.712 | 1.00 | 41.79 | C |
| ATOM | 5385 | O | PRO | X | 60 | −31.899 | 78.020 | −31.439 | 1.00 | 39.12 | O |
| ATOM | 5386 | CB | PRO | X | 60 | −35.047 | 78.468 | −31.240 | 1.00 | 37.50 | C |
| ATOM | 5387 | CG | PRO | X | 60 | −35.340 | 79.184 | −30.024 | 1.00 | 40.79 | C |
| ATOM | 5388 | CD | PRO | X | 60 | −34.325 | 78.891 | −29.004 | 1.00 | 41.33 | C |
| ATOM | 5389 | N | ALA | X | 61 | −32.956 | 76.574 | −32.821 | 1.00 | 41.88 | N |
| ATOM | 5390 | CA | ALA | X | 61 | −31.816 | 76.464 | −33.727 | 1.00 | 41.28 | C |
| ATOM | 5391 | C | ALA | X | 61 | −31.500 | 77.762 | −34.449 | 1.00 | 37.80 | C |
| ATOM | 5392 | O | ALA | X | 61 | −30.440 | 77.855 | −35.066 | 1.00 | 37.27 | O |
| ATOM | 5393 | CB | ALA | X | 61 | −32.043 | 75.362 | −34.759 | 1.00 | 34.30 | C |
| ATOM | 5394 | N | ARG | X | 62 | −32.356 | 78.779 | −34.366 | 1.00 | 38.43 | N |
| ATOM | 5395 | CA | ARG | X | 62 | −31.978 | 80.019 | −35.031 | 1.00 | 42.28 | C |
| ATOM | 5396 | C | ARG | X | 62 | −30.888 | 80.776 | −34.273 | 1.00 | 39.16 | C |
| ATOM | 5397 | O | ARG | X | 62 | −30.360 | 81.763 | −34.795 | 1.00 | 42.60 | O |
| ATOM | 5398 | CB | ARG | X | 62 | −33.215 | 80.894 | −35.260 | 1.00 | 40.18 | C |
| ATOM | 5399 | CG | ARG | X | 62 | −33.956 | 81.319 | −34.029 | 1.00 | 45.22 | C |
| ATOM | 5400 | CD | ARG | X | 62 | −35.169 | 82.228 | −34.403 | 1.00 | 57.00 | C |
| ATOM | 5401 | NE | ARG | X | 62 | −35.710 | 82.874 | −33.214 | 1.00 | 45.98 | N |
| ATOM | 5402 | CZ | ARG | X | 62 | −36.485 | 82.241 | −32.345 | 1.00 | 47.84 | C |
| ATOM | 5403 | NH1 | ARG | X | 62 | −36.807 | 80.976 | −32.560 | 1.00 | 50.34 | N1+ |
| ATOM | 5404 | NH2 | ARG | X | 62 | −36.923 | 82.855 | −31.261 | 1.00 | 51.21 | N |
| ATOM | 5405 | N | PHE | X | 63 | −30.522 | 80.330 | −33.074 | 1.00 | 40.25 | N |
| ATOM | 5406 | CA | PHE | X | 63 | −29.323 | 80.816 | −32.410 | 1.00 | 41.09 | C |
| ATOM | 5407 | C | PHE | X | 63 | −28.171 | 79.886 | −32.756 | 1.00 | 41.66 | C |
| ATOM | 5408 | O | PHE | X | 63 | −28.299 | 78.666 | −32.622 | 1.00 | 35.82 | O |
| ATOM | 5409 | CB | PHE | X | 63 | −29.510 | 80.887 | −30.891 | 1.00 | 33.46 | C |
| ATOM | 5410 | CG | PHE | X | 63 | −30.586 | 81.832 | −30.473 | 1.00 | 36.45 | C |
| ATOM | 5411 | CD1 | PHE | X | 63 | −30.310 | 83.184 | −30.280 | 1.00 | 39.83 | C |
| ATOM | 5412 | CD2 | PHE | X | 63 | −31.884 | 81.377 | −30.287 | 1.00 | 34.93 | C |
| ATOM | 5413 | CE1 | PHE | X | 63 | −31.325 | 84.085 | −29.906 | 1.00 | 36.05 | C |
| ATOM | 5414 | CE2 | PHE | X | 63 | −32.889 | 82.251 | −29.923 | 1.00 | 38.93 | C |
| ATOM | 5415 | CZ | PHE | X | 63 | −32.614 | 83.614 | −29.734 | 1.00 | 35.26 | C |
| ATOM | 5416 | N | SER | X | 64 | −27.053 | 80.455 | −33.207 | 1.00 | 33.96 | N |
| ATOM | 5417 | CA | SER | X | 64 | −25.866 | 79.646 | −33.436 | 1.00 | 36.60 | C |
| ATOM | 5418 | C | SER | X | 64 | −24.626 | 80.455 | −33.101 | 1.00 | 33.97 | C |
| ATOM | 5419 | O | SER | X | 64 | −24.663 | 81.684 | −32.984 | 1.00 | 37.04 | O |
| ATOM | 5420 | CB | SER | X | 64 | −25.792 | 79.134 | −34.878 | 1.00 | 33.50 | C |
| ATOM | 5421 | OG | SER | X | 64 | −25.828 | 80.219 | −35.797 | 1.00 | 41.55 | O |
| ATOM | 5422 | N | GLY | X | 65 | −23.514 | 79.743 | −32.965 | 1.00 | 33.67 | N |
| ATOM | 5423 | CA | GLY | X | 65 | −22.271 | 80.366 | −32.569 | 1.00 | 32.37 | C |
| ATOM | 5424 | C | GLY | X | 65 | −21.099 | 79.800 | −33.342 | 1.00 | 37.26 | C |
| ATOM | 5425 | O | GLY | X | 65 | −21.144 | 78.694 | −33.885 | 1.00 | 37.56 | O |
| ATOM | 5426 | N | SER | X | 66 | −20.044 | 80.596 | −33.386 | 1.00 | 36.95 | N |
| ATOM | 5427 | CA | SER | X | 66 | −18.782 | 80.154 | −33.937 | 1.00 | 39.89 | C |
| ATOM | 5428 | C | SER | X | 66 | −17.675 | 80.805 | −33.137 | 1.00 | 38.97 | C |
| ATOM | 5429 | O | SER | X | 66 | −17.884 | 81.794 | −32.427 | 1.00 | 42.94 | O |
| ATOM | 5430 | CB | SER | X | 66 | −18.645 | 80.521 | −35.416 | 1.00 | 43.54 | C |
| ATOM | 5431 | OG | SER | X | 66 | −18.842 | 81.914 | −35.579 | 1.00 | 44.16 | O |
| ATOM | 5432 | N | LYS | X | 67 | −16.493 | 80.236 | −33.268 | 1.00 | 37.88 | N |
| ATOM | 5433 | CA | LYS | X | 67 | −15.318 | 80.724 | −32.578 | 1.00 | 38.71 | C |
| ATOM | 5434 | C | LYS | X | 67 | −14.182 | 80.683 | −33.584 | 1.00 | 41.62 | C |
| ATOM | 5435 | O | LYS | X | 67 | −14.049 | 79.712 | −34.332 | 1.00 | 36.78 | O |
| ATOM | 5436 | CB | LYS | X | 67 | −14.996 | 79.866 | −31.337 | 1.00 | 34.63 | C |
| ATOM | 5437 | CG | LYS | X | 67 | −13.718 | 80.278 | −30.577 | 1.00 | 39.36 | C |
| ATOM | 5438 | CD | LYS | X | 67 | −13.483 | 79.408 | −29.335 | 1.00 | 43.58 | C |
| ATOM | 5439 | CE | LYS | X | 67 | −12.029 | 79.470 | −28.865 | 1.00 | 49.06 | C |
| ATOM | 5440 | NZ | LYS | X | 67 | −11.798 | 78.829 | −27.509 | 1.00 | 45.19 | N1+ |
| ATOM | 5441 | N | SER | X | 68 | −13.372 | 81.733 | −33.603 | 1.00 | 32.64 | N |
| ATOM | 5442 | CA | SER | X | 68 | −12.213 | 81.766 | −34.484 | 1.00 | 39.05 | C |
| ATOM | 5443 | C | SER | X | 68 | −11.107 | 82.533 | −33.774 | 1.00 | 44.53 | C |
| ATOM | 5444 | O | SER | X | 68 | −11.196 | 83.760 | −33.617 | 1.00 | 37.82 | 0 |
| ATOM | 5445 | CB | SER | X | 68 | −12.578 | 82.412 | −35.816 | 1.00 | 40.60 | C |
| ATOM | 5446 | OG | SER | X | 68 | −11.432 | 82.493 | −36.637 | 1.00 | 69.58 | 0 |
| ATOM | 5447 | N | GLY | X | 69 | −10.073 | 81.825 | −33.344 | 1.00 | 41.45 | N |
| ATOM | 5448 | CA | GLY | X | 69 | −8.973 | 82.520 | −32.683 | 1.00 | 38.45 | C |
| ATOM | 5449 | C | GLY | X | 69 | −9.424 | 83.162 | −31.382 | 1.00 | 38.09 | C |
| ATOM | 5450 | O | GLY | X | 69 | −9.944 | 82.493 | −30.485 | 1.00 | 40.05 | O |
| ATOM | 5451 | N | THR | X | 70 | −9.248 | 84.479 | −31.260 | 1.00 | 38.95 | N |
| ATOM | 5452 | CA | THR | X | 70 | −9.575 | 85.191 | −30.033 | 1.00 | 31.37 | C |
| ATOM | 5453 | C | THR | X | 70 | −10.914 | 85.919 | −30.101 | 1.00 | 36.24 | C |
| ATOM | 5454 | O | THR | X | 70 | −11.192 | 86.796 | −29.271 | 1.00 | 37.77 | O |

TABLE 10.3-continued

| | | | | | | | | | | |
|---|---|---|---|---|---|---|---|---|---|---|
| ATOM | 5455 | CB | THR | X | 70 | −8.458 | 86.171 | −29.692 | 1.00 | 36.81 | C |
| ATOM | 5456 | OG1 | THR | X | 70 | −8.349 | 87.134 | −30.744 | 1.00 | 30.74 | O |
| ATOM | 5457 | CG2 | THR | X | 70 | −7.134 | 85.414 | −29.544 | 1.00 | 25.19 | C |
| ATOM | 5458 | N | SER | X | 71 | −11.765 | 85.574 | −31.048 | 1.00 | 37.57 | N |
| ATOM | 5459 | CA | SER | X | 71 | −13.081 | 86.175 | −31.072 | 1.00 | 38.07 | C |
| ATOM | 5460 | C | SER | X | 71 | −14.125 | 85.082 | −31.262 | 1.00 | 38.54 | C |
| ATOM | 5461 | O | SER | X | 71 | −13.834 | 83.992 | −31.759 | 1.00 | 37.91 | O |
| ATOM | 5462 | CB | SER | X | 71 | −13.185 | 87.249 | −32.162 | 1.00 | 40.23 | C |
| ATOM | 5463 | OG | SER | X | 71 | −13.241 | 86.662 | −33.448 | 1.00 | 48.33 | O |
| ATOM | 5464 | N | ALA | X | 72 | −15.344 | 85.387 | −30.821 | 1.00 | 30.70 | N |
| ATOM | 5465 | CA | ALA | X | 72 | −16.491 | 84.505 | −30.944 | 1.00 | 32.65 | C |
| ATOM | 5466 | C | ALA | X | 72 | −17.649 | 85.344 | −31.464 | 1.00 | 33.91 | C |
| ATOM | 5467 | O | ALA | X | 72 | −17.724 | 86.538 | −31.199 | 1.00 | 35.37 | O |
| ATOM | 5468 | CB | ALA | X | 72 | −16.847 | 83.861 | −29.596 | 1.00 | 28.85 | C |
| ATOM | 5469 | N | ATHR | X | 73 | −18.543 | 84.722 | −32.219 | 0.60 | 34.81 | N |
| ATOM | 5470 | CA | ATHR | X | 73 | −19.686 | 85.428 | −32.781 | 0.60 | 36.26 | C |
| ATOM | 5471 | C | ATHR | X | 73 | −20.968 | 84.644 | −32.530 | 0.60 | 38.23 | C |
| ATOM | 5472 | O | ATHR | X | 73 | −21.021 | 83.423 | −32.730 | 0.60 | 36.94 | O |
| ATOM | 5473 | CB | ATHR | X | 73 | −19.528 | 85.662 | −34.285 | 0.60 | 37.26 | C |
| ATOM | 5474 | OG1 | ATHR | X | 73 | −19.317 | 84.403 | −34.929 | 0.60 | 39.56 | O |
| ATOM | 5475 | CG2 | ATHR | X | 73 | −18.350 | 86.575 | −34.575 | 0.60 | 38.40 | C |
| ATOM | 5476 | N | BTHR | X | 73 | −18.549 | 84.710 | −32.211 | 0.40 | 34.91 | N |
| ATOM | 5477 | CA | BTHR | X | 73 | −19.684 | 85.400 | −32.812 | 0.40 | 36.39 | C |
| ATOM | 5478 | C | BTHR | X | 73 | −20.970 | 84.636 | −32.529 | 0.40 | 38.11 | C |
| ATOM | 5479 | O | BTHR | X | 73 | −21.026 | 83.413 | −32.708 | 0.40 | 36.77 | O |
| ATOM | 5480 | CB | BTHR | X | 73 | −19.509 | 85.557 | −34.327 | 0.40 | 37.24 | C |
| ATOM | 5481 | OG1 | BTHR | X | 73 | −18.230 | 86.138 | −34.608 | 0.40 | 37.63 | O |
| ATOM | 5482 | CG2 | BTHR | X | 73 | −20.620 | 86.434 | −34.910 | 0.40 | 32.90 | C |
| ATOM | 5483 | N | LEU | X | 74 | −21.997 | 85.359 | −32.097 | 1.00 | 35.38 | N |
| ATOM | 5484 | CA | LEU | X | 74 | −23.326 | 84.804 | −31.943 | 1.00 | 34.79 | C |
| ATOM | 5485 | C | LEU | X | 74 | −24.147 | 85.205 | −33.156 | 1.00 | 36.97 | C |
| ATOM | 5486 | O | LEU | X | 74 | −24.156 | 86.379 | −33.545 | 1.00 | 33.92 | O |
| ATOM | 5487 | CB | LEU | X | 74 | −23.986 | 85.314 | −30.665 | 1.00 | 32.61 | C |
| ATOM | 5488 | CG | LEU | X | 74 | −25.507 | 85.206 | −30.626 | 1.00 | 31.72 | C |
| ATOM | 5489 | CD1 | LEU | X | 74 | −25.882 | 83.725 | −30.473 | 1.00 | 30.32 | C |
| ATOM | 5490 | CD2 | LEU | X | 74 | −26.036 | 86.026 | −29.454 | 1.00 | 27.99 | C |
| ATOM | 5491 | N | GLY | X | 75 | −24.840 | 84.247 | −33.745 | 1.00 | 36.52 | N |
| ATOM | 5492 | CA | GLY | X | 75 | −25.703 | 84.512 | −34.884 | 1.00 | 34.24 | C |
| ATOM | 5493 | C | GLY | X | 75 | −27.148 | 84.242 | −34.527 | 1.00 | 37.87 | C |
| ATOM | 5494 | O | GLY | X | 75 | −27.451 | 83.245 | −33.871 | 1.00 | 37.63 | O |
| ATOM | 5495 | N | ILE | X | 76 | −28.035 | 85.141 | −34.957 | 1.00 | 39.75 | N |
| ATOM | 5496 | CA | ILE | X | 76 | −29.479 | 84.985 | −34.802 | 1.00 | 41.67 | C |
| ATOM | 5497 | C | ILE | X | 76 | −30.121 | 85.182 | −36.168 | 1.00 | 42.37 | C |
| ATOM | 5498 | O | ILE | X | 76 | −30.094 | 86.290 | −36.715 | 1.00 | 44.35 | O |
| ATOM | 5499 | CB | ILE | X | 76 | −30.078 | 85.974 | −33.790 | 1.00 | 40.33 | C |
| ATOM | 5500 | CG1 | ILE | X | 76 | −29.186 | 86.075 | −32.552 | 1.00 | 41.66 | C |
| ATOM | 5501 | CG2 | ILE | X | 76 | −31.481 | 85.526 | −33.397 | 1.00 | 35.42 | C |
| ATOM | 5502 | CD1 | ILE | X | 76 | −29.726 | 86.959 | −31.465 | 1.00 | 37.72 | C |
| ATOM | 5503 | N | THR | X | 77 | −30.686 | 84.119 | −36.725 | 1.00 | 43.91 | N |
| ATOM | 5504 | CA | THR | X | 77 | −31.472 | 84.236 | −37.948 | 1.00 | 48.21 | C |
| ATOM | 5505 | C | THR | X | 77 | −32.958 | 84.232 | −37.615 | 1.00 | 43.41 | C |
| ATOM | 5506 | O | THR | X | 77 | −33.376 | 83.754 | −36.561 | 1.00 | 53.87 | O |
| ATOM | 5507 | CB | THR | X | 77 | −31.176 | 83.090 | −38.915 | 1.00 | 48.60 | C |
| ATOM | 5508 | OG1 | THR | X | 77 | −31.675 | 81.879 | −38.346 | 1.00 | 50.81 | O |
| ATOM | 5509 | CG2 | THR | X | 77 | −29.695 | 82.947 | −39.136 | 1.00 | 39.95 | C |
| ATOM | 5510 | N | GLY | X | 78 | −33.757 | 84.758 | −38.536 | 1.00 | 46.47 | N |
| ATOM | 5511 | CA | GLY | X | 78 | −35.202 | 84.734 | −38.389 | 1.00 | 39.22 | C |
| ATOM | 5512 | C | GLY | X | 78 | −35.720 | 85.391 | −37.128 | 1.00 | 45.27 | C |
| ATOM | 5513 | O | GLY | X | 78 | −36.522 | 84.791 | −36.407 | 1.00 | 43.17 | O |
| ATOM | 5514 | N | LEU | X | 79 | −35.270 | 86.624 | −36.870 | 1.00 | 46.54 | N |
| ATOM | 5515 | CA | LEU | X | 79 | −35.555 | 87.331 | −35.624 | 1.00 | 38.18 | C |
| ATOM | 5516 | C | LEU | X | 79 | −37.039 | 87.325 | −35.285 | 1.00 | 35.99 | C |
| ATOM | 5517 | O | LEU | X | 79 | −37.888 | 87.609 | −36.131 | 1.00 | 36.59 | O |
| ATOM | 5518 | CB | LEU | X | 79 | −35.059 | 88.776 | −35.730 | 1.00 | 39.04 | C |
| ATOM | 5519 | CG | LEU | X | 79 | −33.807 | 89.295 | −34.996 | 1.00 | 40.52 | C |
| ATOM | 5520 | CD1 | LEU | X | 79 | −33.440 | 88.520 | −33.740 | 1.00 | 39.26 | C |
| ATOM | 5521 | CD2 | LEU | X | 79 | −32.618 | 89.397 | −35.910 | 1.00 | 54.14 | C |
| ATOM | 5522 | N | GLN | X | 80 | −37.345 | 87.044 | −34.026 | 1.00 | 38.14 | N |
| ATOM | 5523 | CA | GLN | X | 80 | −38.697 | 87.144 | −33.497 | 1.00 | 39.98 | C |
| ATOM | 5524 | C | GLN | X | 80 | −38.700 | 88.184 | −32.389 | 1.00 | 41.62 | C |
| ATOM | 5525 | O | GLN | X | 80 | −37.668 | 88.422 | −31.753 | 1.00 | 36.20 | O |
| ATOM | 5526 | CB | GLN | X | 80 | −39.186 | 85.813 | −32.942 | 1.00 | 33.25 | C |
| ATOM | 5527 | CG | GLN | X | 80 | −39.044 | 84.680 | −33.904 | 1.00 | 43.46 | C |
| ATOM | 5528 | CD | GLN | X | 80 | −39.580 | 83.358 | −33.355 | 1.00 | 50.00 | C |
| ATOM | 5529 | OE1 | GLN | X | 80 | −39.521 | 82.335 | −34.031 | 1.00 | 49.67 | O |
| ATOM | 5530 | NE2 | GLN | X | 80 | −40.101 | 83.378 | −32.131 | 1.00 | 47.24 | N |
| ATOM | 5531 | N | THR | X | 81 | −39.865 | 88.806 | −32.161 | 1.00 | 42.32 | N |
| ATOM | 5532 | CA | THR | X | 81 | −39.935 | 89.865 | −31.159 | 1.00 | 40.35 | C |
| ATOM | 5533 | C | THR | X | 81 | −39.450 | 89.373 | −29.794 | 1.00 | 36.41 | C |
| ATOM | 5534 | O | THR | X | 81 | −38.817 | 90.132 | −29.050 | 1.00 | 35.09 | O |

TABLE 10.3-continued

| | | | | | | | | | | |
|---|---|---|---|---|---|---|---|---|---|---|
| ATOM | 5535 | CB | THR | X | 81 | −41.369 | 90.415 | −31.067 | 1.00 | 40.85 | C |
| ATOM | 5536 | OG1 | THR | X | 81 | −42.261 | 89.347 | −30.772 | 1.00 | 57.82 | O |
| ATOM | 5537 | CG2 | THR | X | 81 | −41.798 | 90.998 | −32.377 | 1.00 | 43.15 | C |
| ATOM | 5538 | N | GLY | X | 82 | −39.684 | 88.094 | −29.474 | 1.00 | 36.68 | N |
| ATOM | 5539 | CA | GLY | X | 82 | −39.232 | 87.486 | −28.236 | 1.00 | 28.64 | C |
| ATOM | 5540 | C | GLY | X | 82 | −37.724 | 87.287 | −28.129 | 1.00 | 37.77 | C |
| ATOM | 5541 | O | GLY | X | 82 | −37.248 | 86.752 | −27.124 | 1.00 | 34.17 | O |
| ATOM | 5542 | N | ASP | X | 83 | −36.959 | 87.652 | −29.150 | 1.00 | 30.06 | N |
| ATOM | 5543 | CA | ASP | X | 83 | −35.509 | 87.630 | −29.043 | 1.00 | 32.84 | C |
| ATOM | 5544 | C | ASP | X | 83 | −34.923 | 88.941 | −28.517 | 1.00 | 34.01 | C |
| ATOM | 5545 | O | ASP | X | 83 | −33.729 | 88.984 | −28.208 | 1.00 | 31.84 | O |
| ATOM | 5546 | CB | ASP | X | 83 | −34.907 | 87.303 | −30.404 | 1.00 | 31.73 | C |
| ATOM | 5547 | CG | ASP | X | 83 | −35.427 | 85.990 | −30.952 | 1.00 | 41.54 | C |
| ATOM | 5548 | OD1 | ASP | X | 83 | −35.746 | 85.088 | −30.133 | 1.00 | 36.80 | O |
| ATOM | 5549 | OD2 | ASP | X | 83 | −35.522 | 85.868 | −32.194 | 1.00 | 42.52 | O1− |
| ATOM | 5550 | N | GLU | X | 84 | −35.724 | 90.002 | −28.424 | 1.00 | 31.24 | N |
| ATOM | 5551 | CA | GLU | X | 84 | −35.262 | 91.272 | −27.871 | 1.00 | 37.59 | C |
| ATOM | 5552 | C | GLU | X | 84 | −34.719 | 91.031 | −26.459 | 1.00 | 32.26 | C |
| ATOM | 5553 | O | GLU | X | 84 | −35.402 | 90.452 | −25.609 | 1.00 | 35.56 | O |
| ATOM | 5554 | CB | GLU | X | 84 | −36.416 | 92.283 | −27.890 | 1.00 | 30.20 | C |
| ATOM | 5555 | CG | GLU | X | 84 | −36.070 | 93.629 | −27.345 | 1.00 | 45.30 | C |
| ATOM | 5556 | CD | GLU | X | 84 | −36.947 | 94.775 | −27.890 | 1.00 | 45.92 | C |
| ATOM | 5557 | OE1 | GLU | X | 84 | −37.343 | 95.625 | −27.064 | 1.00 | 55.26 | O |
| ATOM | 5558 | OE2 | GLU | X | 84 | −37.238 | 94.832 | −29.112 | 1.00 | 39.84 | O1− |
| ATOM | 5559 | N | ALA | X | 85 | −33.455 | 91.385 | −26.241 | 1.00 | 33.55 | N |
| ATOM | 5560 | CA | ALA | X | 85 | −32.741 | 90.944 | −25.047 | 1.00 | 30.96 | C |
| ATOM | 5561 | C | ALA | X | 85 | −31.361 | 91.575 | −25.034 | 1.00 | 28.54 | C |
| ATOM | 5562 | O | ALA | X | 85 | −30.916 | 92.168 | −26.021 | 1.00 | 32.81 | O |
| ATOM | 5563 | CB | ALA | X | 85 | −32.594 | 89.409 | −24.997 | 1.00 | 30.64 | C |
| ATOM | 5564 | N | ASP | X | 86 | −30.680 | 91.413 | −23.903 | 1.00 | 29.41 | N |
| ATOM | 5565 | CA | ASP | X | 86 | −29.249 | 91.647 | −23.793 | 1.00 | 31.96 | C |
| ATOM | 5566 | C | ASP | X | 86 | −28.504 | 90.322 | −23.884 | 1.00 | 32.23 | C |
| ATOM | 5567 | O | ASP | X | 86 | −28.925 | 89.318 | −23.303 | 1.00 | 33.09 | 0 |
| ATOM | 5568 | CB | ASP | X | 86 | −28.907 | 92.357 | −22.482 | 1.00 | 33.01 | C |
| ATOM | 5569 | CG | ASP | X | 86 | −29.599 | 93.708 | −22.367 | 1.00 | 39.16 | C |
| ATOM | 5570 | OD1 | ASP | X | 86 | −29.651 | 94.437 | −23.368 | 1.00 | 40.13 | O |
| ATOM | 5571 | OD2 | ASP | X | 86 | −30.101 | 94.037 | −21.280 | 1.00 | 48.35 | O1− |
| ATOM | 5572 | N | TYR | X | 87 | −27.386 | 90.329 | −24.599 | 1.00 | 31.45 | N |
| ATOM | 5573 | CA | TYR | X | 87 | −26.601 | 89.129 | −24.842 | 1.00 | 28.71 | C |
| ATOM | 5574 | C | TYR | X | 87 | −25.182 | 89.374 | −24.358 | 1.00 | 32.26 | C |
| ATOM | 5575 | O | TYR | X | 87 | −24.609 | 90.435 | −24.628 | 1.00 | 31.02 | O |
| ATOM | 5576 | CB | TYR | X | 87 | −26.621 | 88.762 | −26.326 | 1.00 | 26.11 | C |
| ATOM | 5577 | CG | TYR | X | 87 | −28.002 | 88.352 | −26.816 | 1.00 | 30.12 | C |
| ATOM | 5578 | CD1 | TYR | X | 87 | −28.925 | 89.305 | −27.224 | 1.00 | 29.60 | C |
| ATOM | 5579 | CD2 | TYR | X | 87 | −28.378 | 87.014 | −26.863 | 1.00 | 28.20 | C |
| ATOM | 5580 | CE1 | TYR | X | 87 | −30.188 | 88.932 | −27.678 | 1.00 | 34.26 | C |
| ATOM | 5581 | CE2 | TYR | X | 87 | −29.626 | 86.630 | −27.320 | 1.00 | 32.08 | C |
| ATOM | 5582 | CZ | TYR | X | 87 | −30.527 | 87.596 | −27.726 | 1.00 | 34.03 | C |
| ATOM | 5583 | OH | TYR | X | 87 | −31.777 | 87.223 | −28.150 | 1.00 | 31.35 | O |
| ATOM | 5584 | N | TYR | X | 88 | −24.632 | 88.394 | −23.642 | 1.00 | 29.11 | N |
| ATOM | 5585 | CA | TYR | X | 88 | −23.311 | 88.458 | −23.036 | 1.00 | 28.65 | C |
| ATOM | 5586 | C | TYR | X | 88 | −22.534 | 87.201 | −23.398 | 1.00 | 32.64 | C |
| ATOM | 5587 | O | TYR | X | 88 | −23.054 | 86.084 | −23.241 | 1.00 | 32.58 | O |
| ATOM | 5588 | CB | TYR | X | 88 | −23.408 | 88.547 | −21.508 | 1.00 | 27.95 | C |
| ATOM | 5589 | CG | TYR | X | 88 | −24.118 | 89.757 | −20.959 | 1.00 | 30.42 | C |
| ATOM | 5590 | CD1 | TYR | X | 88 | −25.501 | 89.759 | −20.792 | 1.00 | 28.19 | C |
| ATOM | 5591 | CD2 | TYR | X | 88 | −23.401 | 90.890 | −20.574 | 1.00 | 31.06 | C |
| ATOM | 5592 | CE1 | TYR | X | 88 | −26.162 | 90.867 | −20.275 | 1.00 | 27.13 | C |
| ATOM | 5593 | CE2 | TYR | X | 88 | −24.041 | 92.005 | −20.067 | 1.00 | 32.77 | C |
| ATOM | 5594 | CZ | TYR | X | 88 | −25.424 | 91.989 | −19.920 | 1.00 | 36.54 | C |
| ATOM | 5595 | OH | TYR | X | 88 | −26.055 | 93.090 | −19.405 | 1.00 | 30.95 | O |
| ATOM | 5596 | N | CYS | X | 89 | −21.287 | 87.372 | −23.833 | 1.00 | 28.04 | N |
| ATOM | 5597 | CA | CYS | X | 89 | −20.334 | 86.269 | −23.902 | 1.00 | 28.74 | C |
| ATOM | 5598 | C | CYS | X | 89 | −19.528 | 86.212 | −22.607 | 1.00 | 32.37 | C |
| ATOM | 5599 | O | CYS | X | 89 | −19.378 | 87.212 | −21.902 | 1.00 | 35.41 | O |
| ATOM | 5600 | CB | CYS | X | 89 | −19.378 | 86.436 | −25.082 | 1.00 | 33.37 | C |
| ATOM | 5601 | SG | CYS | X | 89 | −18.463 | 88.060 | −25.073 | 1.00 | 43.75 | S |
| ATOM | 5602 | N | GLY | X | 90 | −19.005 | 85.032 | −22.303 | 1.00 | 32.61 | N |
| ATOM | 5603 | CA | GLY | X | 90 | −18.237 | 84.821 | −21.083 | 1.00 | 31.53 | C |
| ATOM | 5604 | C | GLY | X | 90 | −17.235 | 83.695 | −21.244 | 1.00 | 33.08 | C |
| ATOM | 5605 | O | GLY | X | 90 | −17.445 | 82.767 | −22.030 | 1.00 | 35.81 | O |
| ATOM | 5606 | N | THR | X | 91 | −16.107 | 83.816 | −20.531 | 1.00 | 25.99 | N |
| ATOM | 5607 | CA | THR | X | 91 | −15.089 | 82.778 | −20.428 | 1.00 | 29.82 | C |
| ATOM | 5608 | C | THR | X | 91 | −14.309 | 82.951 | −19.143 | 1.00 | 31.29 | C |
| ATOM | 5609 | O | THR | X | 91 | −14.533 | 83.878 | −18.365 | 1.00 | 34.63 | O |
| ATOM | 5610 | CB | THR | X | 91 | −13.968 | 82.816 | −21.479 | 1.00 | 38.46 | C |
| ATOM | 5611 | OG1 | THR | X | 91 | −14.245 | 83.717 | −22.547 | 1.00 | 45.88 | O |
| ATOM | 5612 | CG2 | THR | X | 91 | −13.680 | 81.476 | −21.973 | 1.00 | 27.98 | C |
| ATOM | 5613 | N | TRP | X | 92 | −13.306 | 82.097 | −19.016 | 1.00 | 27.25 | N |
| ATOM | 5614 | CA | TRP | X | 92 | −12.219 | 82.230 | −18.077 | 1.00 | 29.16 | C |

TABLE 10.3-continued

| ATOM | 5615 | C | TRP | X | 92 | −11.070 | 83.003 | −18.714 | 1.00 | 32.78 | C |
|---|---|---|---|---|---|---|---|---|---|---|---|
| ATOM | 5616 | O | TRP | X | 92 | −10.800 | 82.873 | −19.912 | 1.00 | 30.90 | O |
| ATOM | 5617 | CB | TRP | X | 92 | −11.757 | 80.836 | −17.670 | 1.00 | 27.36 | C |
| ATOM | 5618 | CG | TRP | X | 92 | −10.715 | 80.810 | −16.612 | 1.00 | 35.33 | C |
| ATOM | 5619 | CD1 | TRP | X | 92 | −9.392 | 80.455 | −16.757 | 1.00 | 34.95 | C |
| ATOM | 5620 | CD2 | TRP | X | 92 | −10.900 | 81.116 | −15.227 | 1.00 | 34.91 | C |
| ATOM | 5621 | NE1 | TRP | X | 92 | −8.751 | 80.510 | −15.535 | 1.00 | 33.88 | N |
| ATOM | 5622 | CE2 | TRP | X | 92 | −9.647 | 80.927 | −14.584 | 1.00 | 35.68 | C |
| ATOM | 5623 | CE3 | TRP | X | 92 | −11.998 | 81.527 | −14.465 | 1.00 | 29.27 | C |
| ATOM | 5624 | CZ2 | TRP | X | 92 | −9.471 | 81.141 | −13.221 | 1.00 | 32.90 | C |
| ATOM | 5625 | CZ3 | TRP | X | 92 | −11.821 | 81.740 | −13.107 | 1.00 | 30.95 | C |
| ATOM | 5626 | CH2 | TRP | X | 92 | −10.571 | 81.542 | −12.498 | 1.00 | 36.18 | C |
| ATOM | 5627 | N | ASP | X | 93 | −10.389 | 83.802 | −17.915 | 1.00 | 34.71 | N |
| ATOM | 5628 | CA | ASP | X | 93 | −9.143 | 84.431 | −18.340 | 1.00 | 35.49 | C |
| ATOM | 5629 | C | ASP | X | 93 | −8.004 | 83.809 | −17.537 | 1.00 | 35.61 | C |
| ATOM | 5630 | O | ASP | X | 93 | −7.912 | 84.013 | −16.322 | 1.00 | 38.60 | O |
| ATOM | 5631 | CB | ASP | X | 93 | −9.192 | 85.940 | −18.151 | 1.00 | 30.03 | C |
| ATOM | 5632 | CG | ASP | X | 93 | −8.045 | 86.639 | −18.857 | 1.00 | 39.44 | C |
| ATOM | 5633 | OD1 | ASP | X | 93 | −6.878 | 86.282 | −18.573 | 1.00 | 37.16 | O1− |
| ATOM | 5634 | OD2 | ASP | X | 93 | −8.317 | 87.531 | −19.701 | 1.00 | 32.36 | O |
| ATOM | 5635 | N | SER | X | 94 | −7.137 | 83.061 | −18.223 | 1.00 | 33.93 | N |
| ATOM | 5636 | CA | SER | X | 94 | −6.072 | 82.302 | −17.571 | 1.00 | 37.23 | C |
| ATOM | 5637 | C | SER | X | 94 | −5.010 | 83.199 | −16.958 | 1.00 | 43.27 | C |
| ATOM | 5638 | O | SER | X | 94 | −4.321 | 82.779 | −16.024 | 1.00 | 47.17 | O |
| ATOM | 5639 | CB | SER | X | 94 | −5.415 | 81.337 | −18.557 | 1.00 | 35.59 | C |
| ATOM | 5640 | OG | SER | X | 94 | −6.349 | 80.369 | −19.056 | 1.00 | 47.61 | O |
| ATOM | 5641 | N | SER | X | 95 | −4.851 | 84.415 | −17.456 | 1.00 | 36.82 | N |
| ATOM | 5642 | CA | SER | X | 95 | −3.842 | 85.284 | −16.877 | 1.00 | 40.13 | C |
| ATOM | 5643 | C | SER | X | 95 | −4.390 | 86.199 | −15.784 | 1.00 | 43.12 | C |
| ATOM | 5644 | O | SER | X | 95 | −3.652 | 86.546 | −14.858 | 1.00 | 44.13 | O |
| ATOM | 5645 | CB | SER | X | 95 | −3.177 | 86.104 | −17.979 | 1.00 | 38.64 | C |
| ATOM | 5646 | OG | SER | X | 95 | −3.953 | 87.241 | −18.283 | 1.00 | 52.16 | O |
| ATOM | 5647 | N | LEU | X | 96 | −5.653 | 86.623 | −15.858 | 1.00 | 49.30 | N |
| ATOM | 5648 | CA | TEU | X | 96 | −6.260 | 87.359 | −14.750 | 1.00 | 41.53 | C |
| ATOM | 5649 | C | LEU | X | 96 | −6.849 | 86.436 | −13.685 | 1.00 | 36.33 | C |
| ATOM | 5650 | O | LEU | X | 96 | −7.332 | 86.925 | −12.663 | 1.00 | 40.59 | O |
| ATOM | 5651 | CB | LEU | X | 96 | −7.345 | 88.299 | −15.263 | 1.00 | 31.21 | C |
| ATOM | 5652 | CG | LEU | X | 96 | −6.975 | 89.345 | −16.315 | 1.00 | 35.69 | C |
| ATOM | 5653 | CD1 | TEU | X | 96 | −8.257 | 89.972 | −16.878 | 1.00 | 32.73 | C |
| ATOM | 5654 | CD2 | LEU | X | 96 | −6.072 | 90.443 | −15.740 | 1.00 | 33.32 | C |
| ATOM | 5655 | N | ASN | X | 97 | −6.819 | 85.128 | −13.908 | 1.00 | 33.69 | N |
| ATOM | 5656 | CA | ASN | X | 97 | −7.457 | 84.113 | −13.054 | 1.00 | 40.52 | C |
| ATOM | 5657 | C | ASN | X | 97 | −8.862 | 84.515 | −12.585 | 1.00 | 37.02 | C |
| ATOM | 5658 | O | ASN | X | 97 | −9.170 | 84.528 | −11.394 | 1.00 | 38.37 | O |
| ATOM | 5659 | CB | ASN | X | 97 | −6.566 | 83.762 | −11.863 | 1.00 | 40.15 | C |
| ATOM | 5660 | CG | ASN | X | 97 | −5.793 | 82.485 | −12.103 | 1.00 | 56.68 | C |
| ATOM | 5661 | OD1 | ASN | X | 97 | −6.057 | 81.431 | −11.474 | 1.00 | 58.82 | O |
| ATOM | 5662 | ND2 | ASN | X | 97 | −4.866 | 82.541 | −13.069 | 1.00 | 45.20 | N |
| ATOM | 5663 | N | THR | X | 98 | −9.736 | 84.807 | −13.551 | 1.00 | 33.40 | N |
| ATOM | 5664 | CA | THR | X | 98 | −11.086 | 85.225 | −13.198 | 1.00 | 36.45 | C |
| ATOM | 5665 | C | THR | X | 98 | −12.042 | 84.934 | −14.345 | 1.00 | 31.02 | C |
| ATOM | 5666 | O | THR | X | 98 | −11.637 | 84.809 | −15.497 | 1.00 | 29.12 | O |
| ATOM | 5667 | CB | THR | X | 98 | −11.138 | 86.713 | −12.830 | 1.00 | 32.72 | C |
| ATOM | 5668 | OG1 | THR | X | 98 | −12.455 | 87.038 | −12.382 | 1.00 | 37.61 | O |
| ATOM | 5669 | CG2 | THR | X | 98 | −10.840 | 87.569 | −14.031 | 1.00 | 32.00 | C |
| ATOM | 5670 | N | VAL | X | 99 | −13.326 | 84.815 | −14.005 | 1.00 | 30.06 | N |
| ATOM | 5671 | CA | VAL | X | 99 | −14.358 | 84.769 | −15.027 | 1.00 | 24.45 | C |
| ATOM | 5672 | C | VAL | X | 99 | −14.563 | 86.160 | −15.611 | 1.00 | 29.75 | C |
| ATOM | 5673 | O | VAL | X | 99 | −14.620 | 87.174 | −14.897 | 1.00 | 26.93 | O |
| ATOM | 5674 | CB | VAL | X | 99 | −15.680 | 84.233 | −14.460 | 1.00 | 28.00 | C |
| ATOM | 5675 | CG1 | VAL | X | 99 | −16.739 | 84.291 | −15.532 | 1.00 | 26.99 | C |
| ATOM | 5676 | CG2 | VAL | X | 99 | −15.525 | 82.801 | −13.869 | 1.00 | 29.57 | C |
| ATOM | 5677 | N | VAL | X | 100 | −14.775 | 86.208 | −16.906 | 1.00 | 29.21 | N |
| ATOM | 5678 | CA | VAL | X | 100 | −14.748 | 87.464 | −17.623 | 1.00 | 28.67 | C |
| ATOM | 5679 | C | VAL | X | 100 | −15.948 | 87.512 | −18.574 | 1.00 | 32.26 | C |
| ATOM | 5680 | O | VAL | X | 100 | −16.225 | 86.546 | −19.296 | 1.00 | 33.30 | O |
| ATOM | 5681 | CB | VAL | X | 100 | −13.355 | 87.559 | −18.285 | 1.00 | 34.89 | C |
| ATOM | 5682 | CG1 | VAL | X | 100 | −13.294 | 87.188 | −19.773 | 1.00 | 28.07 | C |
| ATOM | 5683 | CG2 | VAL | X | 100 | −12.657 | 88.799 | −17.889 | 1.00 | 30.67 | C |
| ATOM | 5684 | N | PHE | X | 101 | −16.709 | 88.599 | −18.512 | 1.00 | 29.76 | N |
| ATOM | 5685 | CA | PHE | X | 101 | −17.876 | 88.803 | −19.365 | 1.00 | 37.29 | C |
| ATOM | 5686 | C | PHE | X | 101 | −17.634 | 89.939 | −20.348 | 1.00 | 33.64 | C |
| ATOM | 5687 | O | PHE | X | 101 | −16.940 | 90.913 | −20.039 | 1.00 | 36.04 | O |
| ATOM | 5688 | CB | PHE | X | 101 | −19.138 | 89.186 | −18.567 | 1.00 | 33.79 | C |
| ATOM | 5689 | CG | PHE | X | 101 | −19.780 | 88.069 | −17.808 | 1.00 | 32.73 | C |
| ATOM | 5690 | CD1 | PHE | X | 101 | −20.482 | 87.064 | −18.464 | 1.00 | 38.68 | C |
| ATOM | 5691 | CD2 | PHE | X | 101 | −19.729 | 88.057 | −16.407 | 1.00 | 31.51 | C |
| ATOM | 5692 | CE1 | PHE | X | 101 | −21.114 | 86.044 | −17.743 | 1.00 | 34.99 | C |
| ATOM | 5693 | CE2 | PHE | X | 101 | −20.345 | 87.044 | −15.674 | 1.00 | 28.97 | C |
| ATOM | 5694 | CZ | PHE | X | 101 | −21.040 | 86.028 | −16.349 | 1.00 | 30.18 | C |

TABLE 10.3-continued

| | | | | | | | | | |
|---|---|---|---|---|---|---|---|---|---|
| ATOM | 5695 | N | GLY | X | 102 | −18.283 | 89.846 | −21.507 | 1.00 | 31.53 | N |
| ATOM | 5696 | CA | GLY | X | 102 | −18.420 | 91.004 | −22.354 | 1.00 | 30.93 | C |
| ATOM | 5697 | C | GLY | X | 102 | −19.343 | 92.039 | −21.708 | 1.00 | 38.01 | C |
| ATOM | 5698 | O | GLY | X | 102 | −20.047 | 91.780 | −20.724 | 1.00 | 32.78 | O |
| ATOM | 5699 | N | GLY | X | 103 | −19.311 | 93.246 | −22.272 | 1.00 | 29.12 | N |
| ATOM | 5700 | CA | GLY | X | 103 | −20.117 | 94.353 | −21.794 | 1.00 | 29.37 | C |
| ATOM | 5701 | C | GLY | X | 103 | −21.583 | 94.244 | −22.120 | 1.00 | 33.08 | C |
| ATOM | 5702 | O | GLY | X | 103 | −22.376 | 95.015 | −21.576 | 1.00 | 35.44 | O |
| ATOM | 5703 | N | GLY | X | 104 | −21.964 | 93.300 | −22.974 | 1.00 | 34.27 | N |
| ATOM | 5704 | CA | GLY | X | 104 | −23.358 | 93.149 | −23.326 | 1.00 | 29.50 | C |
| ATOM | 5705 | C | GLY | X | 104 | −23.731 | 93.836 | −24.619 | 1.00 | 29.53 | C |
| ATOM | 5706 | O | GLY | X | 104 | −23.197 | 94.891 | −24.951 | 1.00 | 32.35 | O |
| ATOM | 5707 | N | THR | X | 105 | −24.636 | 93.220 | −25.369 | 1.00 | 34.88 | N |
| ATOM | 5708 | CA | THR | X | 105 | −25.182 | 93.780 | −26.591 | 1.00 | 32.20 | C |
| ATOM | 5709 | C | THR | X | 105 | −26.689 | 93.826 | −26.424 | 1.00 | 34.52 | C |
| ATOM | 5710 | O | THR | X | 105 | −27.326 | 92.787 | −26.221 | 1.00 | 32.97 | O |
| ATOM | 5711 | CB | THR | X | 105 | −24.791 | 92.943 | −27.812 | 1.00 | 30.26 | C |
| ATOM | 5712 | OG1 | THR | X | 105 | −23.367 | 92.949 | −27.935 | 1.00 | 36.62 | O |
| ATOM | 5713 | CG2 | THR | X | 105 | −25.397 | 93.520 | −29.084 | 1.00 | 27.38 | C |
| ATOM | 5714 | N | LYS | X | 106 | −27.246 | 95.027 | −26.490 | 1.00 | 33.22 | N |
| ATOM | 5715 | CA | LYS | X | 106 | −28.686 | 95.209 | −26.472 | 1.00 | 35.13 | C |
| ATOM | 5716 | C | LYS | X | 106 | −29.210 | 94.955 | −27.877 | 1.00 | 32.47 | C |
| ATOM | 5717 | O | LYS | X | 106 | −28.824 | 95.647 | −28.822 | 1.00 | 37.14 | O |
| ATOM | 5718 | CB | LYS | X | 106 | −29.035 | 96.619 | −26.001 | 1.00 | 33.00 | C |
| ATOM | 5719 | CG | LYS | X | 106 | −30.515 | 96.974 | −26.093 | 1.00 | 40.50 | C |
| ATOM | 5720 | CD | LYS | X | 106 | −30.760 | 98.406 | −25.536 | 1.00 | 50.00 | C |
| ATOM | 5721 | CE | LYS | X | 106 | −32.202 | 98.919 | −25.776 | 1.00 | 54.95 | C |
| ATOM | 5722 | NZ | LYS | X | 106 | −33.307 | 98.040 | −25.259 | 1.00 | 53.87 | N1+ |
| ATOM | 5723 | N | LEU | X | 107 | −30.039 | 93.941 | −28.022 | 1.00 | 31.69 | N |
| ATOM | 5724 | CA | LEU | X | 107 | −30.702 | 93.641 | −29.282 | 1.00 | 35.95 | C |
| ATOM | 5725 | C | LEU | X | 107 | −32.109 | 94.195 | −29.217 | 1.00 | 34.06 | C |
| ATOM | 5726 | O | LEU | X | 107 | −32.890 | 93.810 | −28.335 | 1.00 | 36.06 | O |
| ATOM | 5727 | CB | LEU | X | 107 | −30.764 | 92.135 | −29.542 | 1.00 | 29.30 | C |
| ATOM | 5728 | CG | LEU | X | 107 | −31.101 | 91.566 | −30.925 | 1.00 | 36.45 | C |
| ATOM | 5729 | CD1 | LEU | X | 107 | −31.582 | 90.117 | −30.792 | 1.00 | 47.08 | C |
| ATOM | 5730 | CD2 | LEU | X | 107 | −32.108 | 92.310 | −31.732 | 1.00 | 35.75 | C |
| ATOM | 5731 | N | ATHR | X | 108 | −32.447 | 95.068 | −30.150 | 0.50 | 29.34 | N |
| ATOM | 5732 | CA | ATHR | X | 108 | −33.819 | 95.519 | −30.281 | 0.50 | 34.47 | C |
| ATOM | 5733 | C | ATHR | X | 108 | −34.372 | 94.993 | −31.598 | 0.50 | 34.43 | C |
| ATOM | 5734 | O | ATHR | X | 108 | −33.730 | 95.114 | −32.645 | 0.50 | 33.84 | O |
| ATOM | 5735 | CB | ATHR | X | 108 | −33.929 | 97.050 | −30.167 | 0.50 | 35.43 | C |
| ATOM | 5736 | OG1 | ATHR | X | 108 | −34.721 | 97.575 | −31.244 | 0.50 | 39.77 | O |
| ATOM | 5737 | CG2 | ATHR | X | 108 | −32.553 | 97.713 | −30.114 | 0.50 | 36.64 | C |
| ATOM | 5738 | N | BTHR | X | 108 | −32.435 | 95.083 | −30.149 | 0.50 | 28.73 | N |
| ATOM | 5739 | CA | BTHR | X | 108 | −33.795 | 95.559 | −30.334 | 0.50 | 34.59 | C |
| ATOM | 5740 | C | BTHR | X | 108 | −34.344 | 94.934 | −31.610 | 0.50 | 34.22 | C |
| ATOM | 5741 | O | BTHR | X | 108 | −33.682 | 94.959 | −32.651 | 0.50 | 33.77 | O |
| ATOM | 5742 | CB | BTHR | X | 108 | −33.864 | 97.095 | −30.407 | 0.50 | 35.40 | C |
| ATOM | 5743 | OG1 | BTHR | X | 108 | −33.311 | 97.671 | −29.217 | 0.50 | 29.14 | O |
| ATOM | 5744 | CG2 | BTHR | X | 108 | −35.332 | 97.571 | −30.561 | 0.50 | 36.81 | C |
| ATOM | 5745 | N | VAL | X | 109 | −35.533 | 94.354 | −31.521 | 1.00 | 34.56 | N |
| ATOM | 5746 | CA | VAL | X | 109 | −36.242 | 93.847 | −32.687 | 1.00 | 37.76 | C |
| ATOM | 5747 | C | VAL | X | 109 | −37.211 | 94.947 | −33.124 | 1.00 | 37.56 | C |
| ATOM | 5748 | O | VAL | X | 109 | −38.195 | 95.233 | −32.435 | 1.00 | 39.51 | O |
| ATOM | 5749 | CB | VAL | X | 109 | −36.957 | 92.526 | −32.370 | 1.00 | 36.89 | C |
| ATOM | 5750 | CG1 | VAL | X | 109 | −37.657 | 91.986 | −33.592 | 1.00 | 37.00 | C |
| ATOM | 5751 | CG2 | VAL | X | 109 | −35.944 | 91.498 | −31.854 | 1.00 | 35.12 | C |
| ATOM | 5752 | N | LEU | X | 110 | −36.903 | 95.596 | −34.249 | 1.00 | 40.19 | N |
| ATOM | 5753 | CA | LEU | X | 110 | −37.598 | 96.804 | −34.693 | 1.00 | 37.97 | C |
| ATOM | 5754 | C | LEU | X | 110 | −39.089 | 96.596 | −34.915 | 1.00 | 42.37 | C |
| ATOM | 5755 | O | LEU | X | 110 | −39.492 | 95.862 | −35.816 | 1.00 | 42.06 | O |
| ATOM | 5756 | CB | LEU | X | 110 | −36.952 | 97.330 | −35.974 | 1.00 | 32.89 | C |
| ATOM | 5757 | CG | LEU | X | 110 | −35.483 | 97.738 | −35.777 | 1.00 | 44.78 | C |
| ATOM | 5758 | CD1 | LEU | X | 110 | −34.740 | 97.954 | −37.095 | 1.00 | 36.15 | C |
| ATOM | 5759 | CD2 | LEU | X | 110 | −35.451 | 98.999 | −34.936 | 1.00 | 37.61 | C |
| ATOM | 5760 | N | SER | X | 111 | −39.923 | 97.222 | −34.090 | 1.00 | 44.41 | N |
| ATOM | 5761 | CA | SER | X | 111 | −41.366 | 97.119 | −34.268 | 1.00 | 50.21 | C |
| ATOM | 5762 | C | SER | X | 111 | −42.007 | 98.460 | −34.601 | 1.00 | 49.69 | C |
| ATOM | 5763 | O | SER | X | 111 | −43.235 | 98.560 | −34.605 | 1.00 | 52.76 | O |
| ATOM | 5764 | CB | SER | X | 111 | −42.017 | 96.500 | −33.028 | 1.00 | 44.40 | C |
| ATOM | 5765 | OG | SER | X | 111 | −41.726 | 97.270 | −31.878 | 1.00 | 60.88 | O |
| ATOM | 5766 | N | GLN | X | 112 | −41.211 | 99.487 | −34.878 | 1.00 | 47.15 | N |
| ATOM | 5767 | CA | GLN | X | 112 | −41.707 | 100.757 | −35.390 | 1.00 | 48.33 | C |
| ATOM | 5768 | C | GLN | X | 112 | −40.538 | 101.473 | −36.048 | 1.00 | 46.20 | C |
| ATOM | 5769 | O | GLN | X | 112 | −39.389 | 101.022 | −35.937 | 1.00 | 50.86 | O |
| ATOM | 5770 | CB | GLN | X | 112 | −42.328 | 101.613 | −34.268 | 1.00 | 45.44 | C |
| ATOM | 5771 | CG | GLN | X | 112 | −41.332 | 102.017 | −33.210 | 1.00 | 54.29 | C |
| ATOM | 5772 | CD | GLN | X | 112 | −41.921 | 102.957 | −32.174 | 1.00 | 55.17 | C |
| ATOM | 5773 | OE1 | GLN | X | 112 | −42.268 | 102.535 | −31.064 | 1.00 | 50.12 | O |
| ATOM | 5774 | NE2 | GLN | X | 112 | −42.016 | 104.247 | −32.523 | 1.00 | 51.29 | N |

TABLE 10.3-continued

| ATOM | 5775 | N | PRO | X | 113 | −40.791 | 102.573 | −36.760 | 1.00 | 47.86 | GZ00 N |
|---|---|---|---|---|---|---|---|---|---|---|---|
| ATOM | 5776 | CA | PRO | X | 113 | −39.684 | 103.305 | −37.392 | 1.00 | 44.33 | GZ00 C |
| ATOM | 5777 | C | PRO | X | 113 | −38.722 | 103.861 | −36.360 | 1.00 | 47.98 | GZ00 C |
| ATOM | 5778 | O | PRO | X | 113 | −39.099 | 104.165 | −35.229 | 1.00 | 51.31 | GZ00 O |
| ATOM | 5779 | CB | PRO | X | 113 | −40.386 | 104.439 | −38.148 | 1.00 | 44.96 | GZ00 C |
| ATOM | 5780 | CG | PRO | X | 113 | −41.754 | 103.943 | −38.377 | 1.00 | 46.92 | GZ00 C |
| ATOM | 5781 | CD | PRO | X | 113 | −42.098 | 103.123 | −37.162 | 1.00 | 47.64 | GZ00 C |
| ATOM | 5782 | N | LYS | X | 114 | −37.464 | 104.002 | −36.764 | 1.00 | 48.55 | GZ00 N |
| ATOM | 5783 | CA | LYS | X | 114 | −36.492 | 104.609 | −35.876 | 1.00 | 42.68 | GZ00 C |
| ATOM | 5784 | C | LYS | X | 114 | −36.864 | 106.065 | −35.628 | 1.00 | 49.83 | GZ00 C |
| ATOM | 5785 | O | LYS | X | 114 | −37.429 | 106.739 | −36.491 | 1.00 | 52.51 | GZ00 O |
| ATOM | 5786 | CB | LYS | X | 114 | −35.082 | 104.485 | −36.457 | 1.00 | 45.63 | GZ00 C |
| ATOM | 5787 | CG | LYS | X | 114 | −34.596 | 103.034 | −36.553 | 1.00 | 50.09 | GZ00 C |
| ATOM | 5788 | CD | LYS | X | 114 | −33.151 | 102.950 | −37.039 | 1.00 | 58.16 | GZ00 C |
| ATOM | 5789 | CE | LYS | X | 114 | −32.468 | 101.608 | −36.704 | 1.00 | 40.47 | GZ00 C |
| ATOM | 5790 | NZ | LYS | X | 114 | −30.975 | 101.802 | −36.780 | 1.00 | 37.72 | GZ00 N1+ |
| ATOM | 5791 | N | ALA | X | 115 | −36.559 | 106.540 | −34.424 | 1.00 | 48.82 | GZ00 N |
| ATOM | 5792 | CA | ALA | X | 115 | −36.951 | 107.875 | −33.987 | 1.00 | 42.61 | GZ00 C |
| ATOM | 5793 | C | ALA | X | 115 | −35.771 | 108.535 | −33.298 | 1.00 | 43.87 | GZ00 C |
| ATOM | 5794 | O | ALA | X | 115 | −35.255 | 108.014 | −32.302 | 1.00 | 42.55 | GZ00 O |
| ATOM | 5795 | CB | ALA | X | 115 | −38.151 | 107.809 | −33.040 | 1.00 | 37.00 | GZ00 C |
| ATOM | 5796 | N | ALA | X | 116 | −35.349 | 109.676 | −33.825 | 1.00 | 42.05 | GZ00 N |
| ATOM | 5797 | CA | ALA | X | 116 | −34.281 | 110.428 | −33.189 | 1.00 | 51.37 | GZ00 C |
| ATOM | 5798 | C | ALA | X | 116 | −34.776 | 111.034 | −31.871 | 1.00 | 46.85 | GZ00 C |
| ATOM | 5799 | O | ALA | X | 116 | −35.976 | 111.217 | −31.674 | 1.00 | 42.99 | GZ00 O |
| ATOM | 5800 | CB | ALA | X | 116 | −33.779 | 111.525 | −34.121 | 1.00 | 48.36 | GZ00 C |
| ATOM | 5801 | N | PRO | X | 117 | −33.881 | 111.279 | −30.922 | 1.00 | 47.49 | GZ00 N |
| ATOM | 5802 | CA | PRO | X | 117 | −34.320 | 111.846 | −29.642 | 1.00 | 49.41 | GZ00 C |
| ATOM | 5803 | C | PRO | X | 117 | −34.616 | 113.337 | −29.751 | 1.00 | 53.03 | GZ00 C |
| ATOM | 5804 | O | PRO | X | 117 | −33.903 | 114.088 | −30.426 | 1.00 | 49.88 | GZ00 O |
| ATOM | 5805 | CB | PRO | X | 117 | −33.120 | 111.582 | −28.721 | 1.00 | 48.21 | GZ00 C |
| ATOM | 5806 | CG | PRO | X | 117 | −31.929 | 111.617 | −29.651 | 1.00 | 40.15 | GZ00 C |
| ATOM | 5807 | CD | PRO | X | 117 | −32.431 | 110.999 | −30.939 | 1.00 | 47.80 | GZ00 C |
| ATOM | 5808 | N | SER | X | 118 | −35.660 | 113.776 | −29.048 | 1.00 | 43.61 | GZ00 N |
| ATOM | 5809 | CA | SER | X | 118 | −35.846 | 115.206 | −28.812 | 1.00 | 49.92 | GZ00 C |
| ATOM | 5810 | C | SER | X | 118 | −35.152 | 115.555 | −27.504 | 1.00 | 43.16 | GZ00 C |
| ATOM | 5811 | O | SER | X | 118 | −35.266 | 114.824 | −26.515 | 1.00 | 50.92 | GZ00 O |
| ATOM | 5812 | CB | SER | X | 118 | −37.325 | 115.608 | −28.770 | 1.00 | 47.75 | GZ00 C |
| ATOM | 5813 | OG | SER | X | 118 | −37.961 | 115.002 | −27.671 | 1.00 | 58.79 | GZ00 O |
| ATOM | 5814 | N | VAL | X | 119 | −34.377 | 116.627 | −27.528 | 1.00 | 41.52 | GZ00 N |
| ATOM | 5815 | CA | VAL | X | 119 | −33.512 | 117.022 | −26.426 | 1.00 | 44.89 | GZ00 C |
| ATOM | 5816 | C | VAL | X | 119 | −33.886 | 118.439 | −26.021 | 1.00 | 52.97 | GZ00 C |
| ATOM | 5817 | O | VAL | X | 119 | −33.914 | 119.338 | −26.869 | 1.00 | 55.14 | GZ00 O |
| ATOM | 5818 | CB | VAL | X | 119 | −32.030 | 116.957 | −26.837 | 1.00 | 42.97 | GZ00 C |
| ATOM | 5819 | CG1 | VAL | X | 119 | −31.122 | 117.319 | −25.668 | 1.00 | 42.13 | GZ00 C |
| ATOM | 5820 | CG2 | VAL | X | 119 | −31.694 | 115.590 | −27.416 | 1.00 | 46.14 | GZ00 C |
| ATOM | 5821 | N | THR | X | 120 | −34.183 | 118.644 | −24.741 | 1.00 | 53.84 | GZ00 N |
| ATOM | 5822 | CA | THR | X | 120 | −34.297 | 119.997 | −24.223 | 1.00 | 52.90 | GZ00 C |
| ATOM | 5823 | C | THR | X | 120 | −33.396 | 120.136 | −23.000 | 1.00 | 49.02 | GZ00 C |
| ATOM | 5824 | O | THR | X | 120 | −33.365 | 119.257 | −22.135 | 1.00 | 44.38 | GZ00 O |
| ATOM | 5825 | CB | THR | X | 120 | −35.779 | 120.402 | −23.935 | 1.00 | 46.21 | GZ00 C |
| ATOM | 5826 | OG1 | THR | X | 120 | −35.982 | 120.611 | −22.536 | 1.00 | 53.27 | GZ00 O |
| ATOM | 5827 | CG2 | THR | X | 120 | −36.767 | 119.365 | −24.468 | 1.00 | 51.58 | GZ00 C |
| ATOM | 5828 | N | LEU | X | 121 | −32.652 | 121.246 | −22.960 | 1.00 | 49.59 | GZ00 N |
| ATOM | 5829 | CA | LEU | X | 121 | −31.580 | 121.506 | −22.006 | 1.00 | 46.69 | GZ00 C |
| ATOM | 5830 | C | LEU | X | 121 | −31.926 | 122.718 | −21.147 | 1.00 | 49.22 | GZ00 C |
| ATOM | 5831 | O | LEU | X | 121 | −32.183 | 123.802 | −21.676 | 1.00 | 57.48 | GZ00 O |
| ATOM | 5832 | CB | LEU | X | 121 | −30.282 | 121.762 | −22.756 | 1.00 | 42.85 | GZ00 C |
| ATOM | 5833 | CG | LEU | X | 121 | −28.925 | 121.456 | −22.159 | 1.00 | 49.09 | GZ00 C |
| ATOM | 5834 | CD1 | LEU | X | 121 | −27.908 | 122.373 | −22.827 | 1.00 | 42.63 | GZ00 C |
| ATOM | 5835 | CD2 | LEU | X | 121 | −28.888 | 121.557 | −20.653 | 1.00 | 50.57 | GZ00 C |
| ATOM | 5836 | N | PHE | X | 122 | −31.952 | 122.534 | −19.834 | 1.00 | 51.49 | GZ00 N |
| ATOM | 5837 | CA | PHE | X | 122 | −32.197 | 123.630 | −18.917 | 1.00 | 48.21 | GZ00 C |
| ATOM | 5838 | C | PHE | X | 122 | −30.914 | 124.009 | −18.215 | 1.00 | 52.42 | GZ00 C |
| ATOM | 5839 | O | PHE | X | 122 | −30.201 | 123.122 | −17.727 | 1.00 | 47.78 | GZ00 O |
| ATOM | 5840 | CB | PHE | X | 122 | −33.245 | 123.263 | −17.872 | 1.00 | 44.54 | GZ00 C |
| ATOM | 5841 | CG | PHE | X | 122 | −34.637 | 123.136 | −18.419 | 1.00 | 55.06 | GZ00 C |
| ATOM | 5842 | CD1 | PHE | X | 122 | −35.407 | 124.269 | −18.664 | 1.00 | 49.10 | GZ00 C |
| ATOM | 5843 | CD2 | PHE | X | 122 | −35.197 | 121.885 | −18.648 | 1.00 | 51.91 | GZ00 C |
| ATOM | 5844 | CE1 | PHE | X | 122 | −36.697 | 124.155 | −19.151 | 1.00 | 52.05 | GZ00 C |
| ATOM | 5845 | CE2 | PHE | X | 122 | −36.487 | 121.766 | −19.133 | 1.00 | 44.48 | GZ00 C |
| ATOM | 5846 | CZ | PHE | X | 122 | −37.238 | 122.899 | −19.385 | 1.00 | 49.83 | GZ00 C |
| ATOM | 5847 | N | PRO | X | 123 | −30.613 | 125.302 | −18.116 | 1.00 | 55.21 | GZ00 N |
| ATOM | 5848 | CA | PRO | X | 123 | −29.470 | 125.760 | −17.316 | 1.00 | 49.75 | GZ00 C |
| ATOM | 5849 | C | PRO | X | 123 | −29.834 | 125.768 | −15.844 | 1.00 | 49.06 | GZ00 C |
| ATOM | 5850 | O | PRO | X | 123 | −31.016 | 125.607 | −15.493 | 1.00 | 43.82 | GZ00 O |
| ATOM | 5851 | CB | PRO | X | 123 | −29.233 | 127.183 | −17.842 | 1.00 | 55.50 | GZ00 C |
| ATOM | 5852 | CG | PRO | X | 123 | −30.612 | 127.648 | −18.178 | 1.00 | 51.07 | GZ00 C |
| ATOM | 5853 | CD | PRO | X | 123 | −31.353 | 126.426 | −18.710 | 1.00 | 47.80 | GZ00 C |
| ATOM | 5854 | N | PRO | X | 124 | −28.866 | 125.964 | −14.950 | 1.00 | 48.22 | GZ00 N |

TABLE 10.3-continued

| | | | | | | | | | | |
|---|---|---|---|---|---|---|---|---|---|---|
| ATOM | 5855 | CA | PRO | X | 124 | −29.212 | 126.031 | −13.526 | 1.00 | 50.20 | GZ00 C |
| ATOM | 5856 | C | PRO | X | 124 | −30.040 | 127.272 | −13.245 | 1.00 | 49.48 | GZ00 C |
| ATOM | 5857 | O | PRO | X | 124 | −29.819 | 128.331 | −13.832 | 1.00 | 60.15 | GZ00 O |
| ATOM | 5858 | CB | PRO | X | 124 | −27.850 | 126.075 | −12.822 | 1.00 | 45.39 | GZ00 C |
| ATOM | 5859 | CG | PRO | X | 124 | −26.917 | 126.606 | −13.838 | 1.00 | 51.55 | GZ00 C |
| ATOM | 5860 | CD | PRO | X | 124 | −27.423 | 126.159 | −15.178 | 1.00 | 47.41 | GZ00 C |
| ATOM | 5861 | N | SER | X | 125 | −31.021 | 127.122 | −12.367 | 1.00 | 47.01 | GZ00 N |
| ATOM | 5862 | CA | SER | X | 125 | −31.863 | 128.243 | −11.982 | 1.00 | 52.47 | GZ00 C |
| ATOM | 5863 | C | SER | X | 125 | −31.107 | 129.183 | −11.033 | 1.00 | 58.92 | GZ00 C |
| ATOM | 5864 | O | SER | X | 125 | −30.113 | 128.806 | −10.387 | 1.00 | 46.42 | GZ00 O |
| ATOM | 5865 | CB | SER | X | 125 | −33.156 | 127.749 | −11.322 | 1.00 | 46.03 | GZ00 C |
| ATOM | 5866 | OG | SER | X | 125 | −32.890 | 127.191 | −10.049 | 1.00 | 47.81 | GZ00 O |
| ATOM | 5867 | N | SER | X | 126 | −31.591 | 130.436 | −10.966 | 1.00 | 57.48 | GZ00 N |
| ATOM | 5868 | CA | SER | X | 126 | −30.955 | 131.426 | −10.096 | 1.00 | 51.60 | GZ00 C |
| ATOM | 5869 | C | SER | X | 126 | −31.069 | 131.029 | −8.631 | 1.00 | 45.30 | GZ00 C |
| ATOM | 5870 | O | SER | X | 126 | −30.103 | 131.177 | −7.870 | 1.00 | 56.73 | GZ00 O |
| ATOM | 5871 | CB | SER | X | 126 | −31.552 | 132.818 | −10.327 | 1.00 | 46.73 | GZ00 C |
| ATOM | 5872 | OG | SER | X | 126 | −32.956 | 132.793 | −10.192 | 1.00 | 64.48 | GZ00 O |
| ATOM | 5873 | N | GLU | X | 127 | −32.222 | 130.484 | −8.219 | 1.00 | 49.07 | GZ00 N |
| ATOM | 5874 | CA | GLU | X | 127 | −32.347 | 130.017 | −6.839 | 1.00 | 53.87 | GZ00 C |
| ATOM | 5875 | C | GLU | X | 127 | −31.302 | 128.962 | −6.507 | 1.00 | 55.39 | GZ00 C |
| ATOM | 5876 | O | GLU | X | 127 | −30.761 | 128.948 | −5.394 | 1.00 | 53.30 | GZ00 O |
| ATOM | 5877 | CB | GLU | X | 127 | −33.733 | 129.444 | −6.558 | 1.00 | 46.74 | GZ00 C |
| ATOM | 5878 | CG | GLU | X | 127 | −34.909 | 130.267 | −7.005 | 1.00 | 50.20 | GZ00 C |
| ATOM | 5879 | CD | GLU | X | 127 | −36.221 | 129.697 | −6.458 | 1.00 | 67.37 | GZ00 C |
| ATOM | 5880 | OE1 | GLU | X | 127 | −36.163 | 128.878 | −5.501 | 1.00 | 58.54 | GZ00 O |
| ATOM | 5881 | OE2 | GLU | X | 127 | −37.303 | 130.059 | −6.988 | 1.00 | 72.90 | GZ00 O1− |
| ATOM | 5882 | N | GLU | X | 128 | −30.978 | 128.088 | −7.466 | 1.00 | 52.88 | GZ00 N |
| ATOM | 5883 | CA | GLU | X | 128 | −30.012 | 127.035 | −7.162 | 1.00 | 58.48 | GZ00 C |
| ATOM | 5884 | C | GLU | X | 128 | −28.600 | 127.593 | −7.114 | 1.00 | 54.84 | GZ00 C |
| ATOM | 5885 | O | GLU | X | 128 | −27.778 | 127.141 | −6.305 | 1.00 | 50.17 | GZ00 O |
| ATOM | 5886 | CB | GLU | X | 128 | −30.100 | 125.882 | −8.171 | 1.00 | 51.98 | GZ00 C |
| ATOM | 5887 | CG | GLU | X | 128 | −29.266 | 124.683 | −7.739 | 1.00 | 50.39 | GZ00 C |
| ATOM | 5888 | CD | GLU | X | 128 | −29.022 | 123.641 | −8.841 | 1.00 | 56.66 | GZ00 C |
| ATOM | 5889 | OE1 | GLU | X | 128 | −28.576 | 122.533 | −8.481 | 1.00 | 51.79 | GZ00 O |
| ATOM | 5890 | OE2 | GLU | X | 128 | −29.257 | 123.912 | −10.044 | 1.00 | 50.04 | GZ00 O1− |
| ATOM | 5891 | N | LEU | X | 129 | −28.300 | 128.569 | −7.971 | 1.00 | 51.67 | GZ00 N |
| ATOM | 5892 | CA | LEU | X | 129 | −27.020 | 129.247 | −7.835 | 1.00 | 57.61 | GZ00 C |
| ATOM | 5893 | C | LEU | X | 129 | −26.899 | 129.856 | −6.440 | 1.00 | 54.69 | GZ00 C |
| ATOM | 5894 | O | LEU | X | 129 | −25.876 | 129.685 | −5.768 | 1.00 | 56.10 | GZ00 O |
| ATOM | 5895 | CB | LEU | X | 129 | −26.861 | 130.296 | −8.938 | 1.00 | 51.14 | GZ00 C |
| ATOM | 5896 | CG | LEU | X | 129 | −26.749 | 129.691 | −10.350 | 1.00 | 59.65 | GZ00 C |
| ATOM | 5897 | CD1 | LEU | X | 129 | −26.772 | 130.745 | −11.454 | 1.00 | 51.42 | GZ00 C |
| ATOM | 5898 | CD2 | LEU | X | 129 | −25.537 | 128.778 | −10.502 | 1.00 | 48.62 | GZ00 C |
| ATOM | 5899 | N | GLN | X | 130 | −27.979 | 130.476 | −5.947 | 1.00 | 51.64 | GZ00 N |
| ATOM | 5900 | CA | GLN | X | 130 | −27.987 | 131.040 | −4.600 | 1.00 | 54.55 | GZ00 C |
| ATOM | 5901 | C | GLN | X | 130 | −27.717 | 130.007 | −3.525 | 1.00 | 57.65 | GZ00 C |
| ATOM | 5902 | O | GLN | X | 130 | −27.308 | 130.384 | −2.425 | 1.00 | 62.14 | GZ00 O |
| ATOM | 5903 | CB | GLN | X | 130 | −29.325 | 131.707 | −4.308 | 1.00 | 49.30 | GZ00 C |
| ATOM | 5904 | CG | GLN | X | 130 | −29.494 | 133.013 | −5.001 | 1.00 | 55.98 | GZ00 C |
| ATOM | 5905 | CD | GLN | X | 130 | −29.020 | 134.140 | −4.135 | 1.00 | 68.65 | GZ00 C |
| ATOM | 5906 | OE1 | GLN | X | 130 | −27.848 | 134.527 | −4.169 | 1.00 | 64.86 | GZ00 O |
| ATOM | 5907 | NE2 | GLN | X | 130 | −29.925 | 134.657 | −3.313 | 1.00 | 63.69 | GZ00 N |
| ATOM | 5908 | N | ALA | X | 131 | −27.980 | 128.727 | −3.788 | 1.00 | 58.30 | GZ00 N |
| ATOM | 5909 | CA | ALA | X | 131 | −27.635 | 127.669 | −2.849 | 1.00 | 53.42 | GZ00 C |
| ATOM | 5910 | C | ALA | X | 131 | −26.223 | 127.155 | −3.057 | 1.00 | 55.16 | GZ00 C |
| ATOM | 5911 | O | ALA | X | 131 | −25.840 | 126.154 | −2.444 | 1.00 | 55.67 | GZ00 O |
| ATOM | 5912 | CB | ALA | X | 131 | −28.629 | 126.517 | −2.951 | 1.00 | 53.39 | GZ00 C |
| ATOM | 5913 | N | ASN | X | 132 | −25.445 | 127.820 | −3.909 | 1.00 | 57.80 | GZ00 N |
| ATOM | 5914 | CA | ASN | X | 132 | −24.062 | 127.430 | −4.188 | 1.00 | 65.38 | GZ00 C |
| ATOM | 5915 | C | ASN | X | 132 | −23.983 | 126.038 | −4.819 | 1.00 | 64.86 | GZ00 C |
| ATOM | 5916 | O | ASN | X | 132 | −23.125 | 125.221 | −4.474 | 1.00 | 58.78 | GZ00 O |
| ATOM | 5917 | CB | ASN | X | 132 | −23.198 | 127.502 | −2.930 | 1.00 | 57.21 | GZ00 C |
| ATOM | 5918 | CG | ASN | X | 132 | −21.742 | 127.673 | −3.259 | 1.00 | 66.70 | GZ00 C |
| ATOM | 5919 | OD1 | ASN | X | 132 | −21.389 | 128.368 | −4.221 | 1.00 | 68.31 | GZ00 O |
| ATOM | 5920 | ND2 | ASN | X | 132 | −20.880 | 127.021 | −2.485 | 1.00 | 71.71 | GZ00 N |
| ATOM | 5921 | N | LYS | X | 133 | −24.891 | 125.766 | −5.750 | 1.00 | 63.21 | GZ00 N |
| ATOM | 5922 | CA | LYS | X | 133 | −24.866 | 124.558 | −6.558 | 1.00 | 55.69 | GZ00 C |
| ATOM | 5923 | C | LYS | X | 133 | −25.304 | 124.950 | −7.959 | 1.00 | 58.70 | GZ00 C |
| ATOM | 5924 | O | LYS | X | 133 | −25.800 | 126.057 | −8.195 | 1.00 | 60.57 | GZ00 O |
| ATOM | 5925 | CB | LYS | X | 133 | −25.778 | 123.468 | −5.978 | 1.00 | 57.74 | GZ00 C |
| ATOM | 5926 | CG | LYS | X | 133 | −25.404 | 122.972 | −4.574 | 1.00 | 60.29 | GZ00 C |
| ATOM | 5927 | CD | LYS | X | 133 | −26.528 | 122.090 | −3.989 | 1.00 | 77.16 | GZ00 C |
| ATOM | 5928 | CE | LYS | X | 133 | −26.295 | 121.712 | −2.516 | 1.00 | 67.68 | GZ00 C |
| ATOM | 5929 | NZ | LYS | X | 133 | −27.578 | 121.494 | −1.757 | 1.00 | 61.53 | GZ00 N1+ |
| ATOM | 5930 | N | ALA | X | 134 | −25.128 | 124.033 | −8.899 | 1.00 | 57.91 | GZ00 N |
| ATOM | 5931 | CA | ALA | X | 134 | −25.550 | 124.292 | −10.273 | 1.00 | 57.46 | GZ00 C |
| ATOM | 5932 | C | ALA | X | 134 | −25.676 | 122.951 | −10.970 | 1.00 | 58.56 | GZ00 C |
| ATOM | 5933 | O | ALA | X | 134 | −24.715 | 122.173 | −10.980 | 1.00 | 56.94 | GZ00 O |
| ATOM | 5934 | CB | ALA | X | 134 | −24.546 | 125.194 | −10.994 | 1.00 | 46.64 | GZ00 C |

TABLE 10.3-continued

| ATOM | 5935 | N | THR | X | 135 | −26.850 | 122.650 | −11.519 | 1.00 | 55.26 | GZ00 N |
|---|---|---|---|---|---|---|---|---|---|---|---|
| ATOM | 5936 | CA | THR | X | 135 | −26.986 | 121.434 | −12.308 | 1.00 | 47.36 | GZ00 C |
| ATOM | 5937 | C | THR | X | 135 | −27.631 | 121.778 | −13.640 | 1.00 | 45.07 | GZ00 C |
| ATOM | 5938 | O | THR | X | 135 | −28.602 | 122.540 | −13.693 | 1.00 | 43.66 | GZ00 O |
| ATOM | 5939 | CB | THR | X | 135 | −27.779 | 120.335 | −11.579 | 1.00 | 46.59 | GZ00 C |
| ATOM | 5940 | OG1 | THR | X | 135 | −29.174 | 120.523 | −11.787 | 1.00 | 60.99 | GZ00 O |
| ATOM | 5941 | CG2 | THR | X | 135 | −27.487 | 120.331 | −10.088 | 1.00 | 40.51 | GZ00 C |
| ATOM | 5942 | N | LEU | X | 136 | −27.050 | 121.251 | −14.711 | 1.00 | 43.91 | GZ00 N |
| ATOM | 5943 | CA | LEU | X | 136 | −27.635 | 121.315 | −16.036 | 1.00 | 42.15 | GZ00 C |
| ATOM | 5944 | C | LEU | X | 136 | −28.501 | 120.080 | −16.231 | 1.00 | 50.30 | GZ00 C |
| ATOM | 5945 | O | LEU | X | 136 | −28.140 | 118.976 | −15.812 | 1.00 | 46.46 | GZ00 O |
| ATOM | 5946 | CB | LEU | X | 136 | −26.544 | 121.383 | −17.101 | 1.00 | 46.62 | GZ00 C |
| ATOM | 5947 | CG | LEU | X | 136 | −25.574 | 122.574 | −17.036 | 1.00 | 48.02 | GZ00 C |
| ATOM | 5948 | CD1 | LEU | X | 136 | −24.445 | 122.431 | −18.044 | 1.00 | 53.43 | GZ00 C |
| ATOM | 5949 | CD2 | LEU | X | 136 | −26.330 | 123.797 | −17.372 | 1.00 | 47.48 | GZ00 C |
| ATOM | 5950 | N | VAL | X | 137 | −29.654 | 120.270 | −16.849 | 1.00 | 48.09 | GZ00 N |
| ATOM | 5951 | CA | VAL | X | 137 | −30.643 | 119.214 | −16.962 | 1.00 | 49.70 | GZ00 C |
| ATOM | 5952 | C | VAL | X | 137 | −30.865 | 118.972 | −18.443 | 1.00 | 47.78 | GZ00 C |
| ATOM | 5953 | O | VAL | X | 137 | −31.364 | 119.852 | −19.156 | 1.00 | 46.56 | GZ00 O |
| ATOM | 5954 | CB | VAL | X | 137 | −31.951 | 119.574 | −16.249 | 1.00 | 41.53 | GZ00 C |
| ATOM | 5955 | CG1 | VAL | X | 137 | −32.927 | 118.433 | −16.354 | 1.00 | 38.78 | GZ00 C |
| ATOM | 5956 | CG2 | VAL | X | 137 | −31.677 | 119.926 | −14.782 | 1.00 | 37.08 | GZ00 C |
| ATOM | 5957 | N | CYS | X | 138 | −30.480 | 117.787 | −18.905 | 1.00 | 41.44 | GZ00 N |
| ATOM | 5958 | CA | CYS | X | 138 | −30.653 | 117.371 | −20.292 | 1.00 | 44.75 | GZ00 C |
| ATOM | 5959 | C | CYS | X | 138 | −31.717 | 116.286 | −20.316 | 1.00 | 42.51 | GZ00 C |
| ATOM | 5960 | O | CYS | X | 138 | −31.459 | 115.150 | −19.904 | 1.00 | 45.75 | GZ00 O |
| ATOM | 5961 | CB | CYS | X | 138 | −29.341 | 116.850 | −20.872 | 1.00 | 41.85 | GZ00 C |
| ATOM | 5962 | SG | CYS | X | 138 | −29.335 | 116.711 | −22.686 | 1.00 | 48.77 | GZ00 S |
| ATOM | 5963 | N | LEU | X | 139 | −32.904 | 116.627 | −20.803 | 1.00 | 40.25 | GZ00 N |
| ATOM | 5964 | CA | LEU | X | 139 | −33.998 | 115.670 | −20.918 | 1.00 | 44.13 | GZ00 C |
| ATOM | 5965 | C | LEU | X | 139 | −34.091 | 115.164 | −22.348 | 1.00 | 48.33 | GZ00 C |
| ATOM | 5966 | O | LEU | X | 139 | −34.096 | 115.956 | −23.296 | 1.00 | 49.49 | GZ00 O |
| ATOM | 5967 | CB | LEU | X | 139 | −35.323 | 116.286 | −20.469 | 1.00 | 40.97 | GZ00 C |
| ATOM | 5968 | CG | LEU | X | 139 | −35.163 | 116.830 | −19.046 | 1.00 | 45.88 | GZ00 C |
| ATOM | 5969 | CD1 | LEU | X | 139 | −34.991 | 118.304 | −19.121 | 1.00 | 55.62 | GZ00 C |
| ATOM | 5970 | CD2 | LEU | X | 139 | −36.336 | 116.513 | −18.183 | 1.00 | 56.00 | GZ00 C |
| ATOM | 5971 | N | ILE | X | 140 | −34.185 | 113.843 | −22.489 | 1.00 | 43.98 | GZ00 N |
| ATOM | 5972 | CA | ILE | X | 140 | −34.065 | 113.151 | −23.763 | 1.00 | 39.00 | GZ00 C |
| ATOM | 5973 | C | ILE | X | 140 | −35.287 | 112.261 | −23.897 | 1.00 | 41.08 | GZ00 C |
| ATOM | 5974 | O | ILE | X | 140 | −35.562 | 111.453 | −23.003 | 1.00 | 45.21 | GZ00 O |
| ATOM | 5975 | CB | ILE | X | 140 | −32.776 | 112.314 | −23.820 | 1.00 | 38.23 | GZ00 C |
| ATOM | 5976 | CG1 | ILE | X | 140 | −31.593 | 113.141 | −23.326 | 1.00 | 38.68 | GZ00 C |
| ATOM | 5977 | CG2 | ILE | X | 140 | −32.517 | 111.813 | −25.212 | 1.00 | 37.81 | GZ00 C |
| ATOM | 5978 | CD1 | ILE | X | 140 | −30.465 | 112.309 | −22.831 | 1.00 | 36.60 | GZ00 C |
| ATOM | 5979 | N | SER | X | 141 | −36.037 | 112.410 | −24.986 | 1.00 | 38.32 | GZ00 N |
| ATOM | 5980 | CA | SER | X | 141 | −37.296 | 111.688 | −25.062 | 1.00 | 41.71 | GZ00 C |
| ATOM | 5981 | C | SER | X | 141 | −37.616 | 111.305 | −26.496 | 1.00 | 42.47 | GZ00 C |
| ATOM | 5982 | O | SER | X | 141 | −37.050 | 111.841 | −27.451 | 1.00 | 41.57 | GZ00 O |
| ATOM | 5983 | CB | SER | X | 141 | −38.442 | 112.523 | −24.495 | 1.00 | 41.65 | GZ00 C |
| ATOM | 5984 | OG | SER | X | 141 | −38.508 | 113.735 | −25.214 | 1.00 | 44.00 | GZ00 C |
| ATOM | 5985 | N | ASP | X | 142 | −38.557 | 110.367 | −26.620 | 1.00 | 46.32 | GZ00 N |
| ATOM | 5986 | CA | ASP | X | 142 | −39.150 | 109.987 | −27.901 | 1.00 | 48.85 | GZ00 C |
| ATOM | 5987 | C | ASP | X | 142 | −38.129 | 109.382 | −28.860 | 1.00 | 51.47 | GZ00 C |
| ATOM | 5988 | O | ASP | X | 142 | −38.175 | 109.623 | −30.072 | 1.00 | 44.48 | GZ00 O |
| ATOM | 5989 | CB | ASP | X | 142 | −39.846 | 111.179 | −28.546 | 1.00 | 47.17 | GZ00 C |
| ATOM | 5990 | CG | ASP | X | 142 | −41.165 | 111.502 | −27.888 | 1.00 | 60.06 | GZ00 C |
| ATOM | 5991 | OD1 | ASP | X | 142 | −41.856 | 110.559 | −27.429 | 1.00 | 53.08 | GZ00 O |
| ATOM | 5992 | OD2 | ASP | X | 142 | −41.509 | 112.706 | −27.833 | 1.00 | 72.08 | GZ00 O1− |
| ATOM | 5993 | N | PHE | X | 143 | −37.183 | 108.607 | −28.329 | 1.00 | 42.34 | GZ00 N |
| ATOM | 5994 | CA | PHE | X | 143 | −36.209 | 107.975 | −29.202 | 1.00 | 50.27 | GZ00 C |
| ATOM | 5995 | C | PHE | X | 143 | −36.431 | 106.471 | −29.275 | 1.00 | 46.86 | GZ00 C |
| ATOM | 5996 | O | PHE | X | 143 | −36.969 | 105.852 | −28.352 | 1.00 | 43.04 | GZ00 O |
| ATOM | 5997 | CB | PHE | X | 143 | −34.773 | 108.296 | −28.793 | 1.00 | 38.71 | GZ00 C |
| ATOM | 5998 | CG | PHE | X | 143 | −34.426 | 107.944 | −27.388 | 1.00 | 40.75 | GZ00 C |
| ATOM | 5999 | CD1 | PHE | X | 143 | −33.898 | 106.698 | −27.084 | 1.00 | 36.49 | GZ00 C |
| ATOM | 6000 | CD2 | PHE | X | 143 | −34.537 | 108.889 | −26.377 | 1.00 | 38.84 | GZ00 C |
| ATOM | 6001 | CE1 | PHE | X | 143 | −33.510 | 106.389 | −25.788 | 1.00 | 41.99 | GZ00 C |
| ATOM | 6002 | CE2 | PHE | X | 143 | −34.161 | 108.588 | −25.078 | 1.00 | 39.59 | GZ00 C |
| ATOM | 6003 | CZ | PHE | X | 143 | −33.645 | 107.330 | −24.777 | 1.00 | 38.14 | GZ00 C |
| ATOM | 6004 | N | TYR | X | 144 | −36.071 | 105.909 | −30.422 | 1.00 | 41.60 | GZ00 N |
| ATOM | 6005 | CA | TYR | X | 144 | −36.247 | 104.485 | −30.675 | 1.00 | 40.98 | GZ00 C |
| ATOM | 6006 | C | TYR | X | 144 | −35.290 | 104.053 | −31.769 | 1.00 | 46.46 | GZ00 C |
| ATOM | 6007 | O | TYR | X | 144 | −35.237 | 104.680 | −32.843 | 1.00 | 42.13 | GZ00 O |
| ATOM | 6008 | CB | TYR | X | 144 | −37.685 | 104.146 | −31.067 | 1.00 | 43.87 | GZ00 C |
| ATOM | 6009 | CG | TYR | X | 144 | −37.912 | 102.658 | −31.265 | 1.00 | 41.93 | GZ00 C |
| ATOM | 6010 | CD1 | TYR | X | 144 | −38.183 | 101.821 | −30.184 | 1.00 | 44.51 | GZ00 C |
| ATOM | 6011 | CD2 | TYR | X | 144 | −37.838 | 102.090 | −32.527 | 1.00 | 35.71 | GZ00 C |
| ATOM | 6012 | CE1 | TYR | X | 144 | −38.379 | 100.445 | −30.358 | 1.00 | 40.63 | GZ00 C |
| ATOM | 6013 | CE2 | TYR | X | 144 | −38.050 | 100.733 | −32.717 | 1.00 | 40.34 | GZ00 C |
| ATOM | 6014 | CZ | TYR | X | 144 | −38.309 | 99.912 | −31.631 | 1.00 | 41.12 | GZ00 C |

TABLE 10.3-continued

| ATOM | 6015 | OH | TYR | X | 144 | −38.511 | 98.567 | −31.831 | 1.00 | 40.40 | GZ00 O |
| --- | --- | --- | --- | --- | --- | --- | --- | --- | --- | --- | --- |
| ATOM | 6016 | N | PRO | X | 145 | −34.530 | 102.974 | −31.511 | 1.00 | 40.55 | GZ00 N |
| ATOM | 6017 | CA | PRO | X | 145 | −34.563 | 102.164 | −30.284 | 1.00 | 43.72 | GZ00 C |
| ATOM | 6018 | C | PRO | X | 145 | −33.998 | 102.849 | −29.028 | 1.00 | 43.96 | GZ00 C |
| ATOM | 6019 | O | PRO | X | 145 | −33.489 | 103.965 | −29.115 | 1.00 | 40.33 | GZ00 O |
| ATOM | 6020 | CB | PRO | X | 145 | −33.699 | 100.937 | −30.644 | 1.00 | 43.12 | GZ00 C |
| ATOM | 6021 | CG | PRO | X | 145 | −32.956 | 101.292 | −31.849 | 1.00 | 42.92 | GZ00 C |
| ATOM | 6022 | CD | PRO | X | 145 | −33.714 | 102.356 | −32.570 | 1.00 | 40.02 | GZ00 C |
| ATOM | 6023 | N | GLY | X | 146 | −34.102 | 102.165 | −27.884 | 1.00 | 38.67 | GZ00 N |
| ATOM | 6024 | CA | GLY | X | 146 | −33.811 | 102.737 | −26.584 | 1.00 | 36.90 | GZ00 C |
| ATOM | 6025 | C | GLY | X | 146 | −32.366 | 102.660 | −26.134 | 1.00 | 38.27 | GZ00 C |
| ATOM | 6026 | O | GLY | X | 146 | −32.068 | 102.118 | −25.070 | 1.00 | 42.45 | GZ00 O |
| ATOM | 6027 | N | ALA | X | 147 | −31.462 | 103.201 | −26.930 | 1.00 | 33.88 | GZ00 N |
| ATOM | 6028 | CA | ALA | X | 147 | −30.063 | 103.278 | −26.560 | 1.00 | 36.10 | GZ00 C |
| ATOM | 6029 | C | ALA | X | 147 | −29.541 | 104.597 | −27.083 | 1.00 | 33.68 | GZ00 C |
| ATOM | 6030 | O | ALA | X | 147 | −29.858 | 105.007 | −28.203 | 1.00 | 39.90 | GZ00 O |
| ATOM | 6031 | CB | ALA | X | 147 | −29.225 | 102.121 | −27.118 | 1.00 | 29.64 | GZ00 C |
| ATOM | 6032 | N | VAL | X | 148 | −28.712 | 105.231 | −26.263 | 1.00 | 33.29 | GZ00 N |
| ATOM | 6033 | CA | VAL | X | 148 | −28.309 | 106.608 | −26.467 | 1.00 | 34.38 | GZ00 C |
| ATOM | 6034 | C | VAL | X | 148 | −27.005 | 106.806 | −25.702 | 1.00 | 44.52 | GZ00 C |
| ATOM | 6035 | O | VAL | X | 148 | −26.787 | 106.191 | −24.652 | 1.00 | 39.89 | GZ00 O |
| ATOM | 6036 | CB | VAL | X | 148 | −29.464 | 107.518 | −25.970 | 1.00 | 40.00 | GZ00 C |
| ATOM | 6037 | CG1 | VAL | X | 148 | −28.993 | 108.560 | −25.020 | 1.00 | 41.53 | GZ00 C |
| ATOM | 6038 | CG2 | VAL | X | 148 | −30.271 | 108.073 | −27.138 | 1.00 | 35.87 | GZ00 C |
| ATOM | 6039 | N | THR | X | 149 | −26.133 | 107.663 | −26.213 | 1.00 | 36.77 | GZ00 N |
| ATOM | 6040 | CA | THR | X | 149 | −24.987 | 108.051 | −25.409 | 1.00 | 38.57 | GZ00 C |
| ATOM | 6041 | C | THR | X | 149 | −24.960 | 109.563 | −25.294 | 1.00 | 44.30 | GZ00 C |
| ATOM | 6042 | O | THR | X | 149 | −25.353 | 110.287 | −26.217 | 1.00 | 42.08 | GZ00 O |
| ATOM | 6043 | CB | THR | X | 149 | −23.650 | 107.565 | −25.975 | 1.00 | 48.56 | GZ00 C |
| ATOM | 6044 | OG1 | THR | X | 149 | −23.455 | 108.130 | −27.276 | 1.00 | 56.60 | GZ00 O |
| ATOM | 6045 | CG2 | THR | X | 149 | −23.624 | 106.035 | −26.054 | 1.00 | 37.17 | GZ00 C |
| ATOM | 6046 | N | VAL | X | 150 | −24.503 | 110.036 | −24.146 | 1.00 | 43.54 | GZ00 N |
| ATOM | 6047 | CA | VAL | X | 150 | −24.564 | 111.452 | −23.836 | 1.00 | 47.15 | GZ00 C |
| ATOM | 6048 | C | VAL | X | 150 | −23.160 | 111.946 | −23.536 | 1.00 | 46.29 | GZ00 C |
| ATOM | 6049 | O | VAL | X | 150 | −22.484 | 111.422 | −22.642 | 1.00 | 44.10 | GZ00 O |
| ATOM | 6050 | CB | VAL | X | 150 | −25.519 | 111.726 | −22.663 | 1.00 | 42.61 | GZ00 C |
| ATOM | 6051 | CG1 | VAL | X | 150 | −25.584 | 113.212 | −22.388 | 1.00 | 45.14 | GZ00 C |
| ATOM | 6052 | CG2 | VAL | X | 150 | −26.919 | 111.152 | −22.975 | 1.00 | 37.35 | GZ00 C |
| ATOM | 6053 | N | ALA | X | 151 | −22.741 | 112.977 | −24.260 | 1.00 | 43.99 | GZ00 N |
| ATOM | 6054 | CA | ALA | X | 151 | −21.484 | 113.665 | −24.002 | 1.00 | 55.42 | GZ00 C |
| ATOM | 6055 | C | ALA | X | 151 | −21.769 | 115.133 | −23.706 | 1.00 | 56.11 | GZ00 C |
| ATOM | 6056 | O | ALA | X | 151 | −22.614 | 115.758 | −24.361 | 1.00 | 51.73 | GZ00 O |
| ATOM | 6057 | CB | ALA | X | 151 | −20.528 | 113.545 | −25.190 | 1.00 | 47.91 | GZ00 C |
| ATOM | 6058 | N | TRP | X | 152 | −21.091 | 115.665 | −22.693 | 1.00 | 48.76 | GZ00 N |
| ATOM | 6059 | CA | TRP | X | 152 | −21.207 | 117.064 | −22.312 | 1.00 | 52.98 | GZ00 C |
| ATOM | 6060 | C | TRP | X | 152 | −19.957 | 117.821 | −22.742 | 1.00 | 62.60 | GZ00 C |
| ATOM | 6061 | O | TRP | X | 152 | −18.840 | 117.307 | −22.638 | 1.00 | 63.13 | GZ00 O |
| ATOM | 6062 | CB | TRP | X | 152 | −21.402 | 117.202 | −20.798 | 1.00 | 54.47 | GZ00 C |
| ATOM | 6063 | CG | TRP | X | 152 | −22.732 | 116.706 | −20.310 | 1.00 | 55.93 | GZ00 C |
| ATOM | 6064 | CD1 | TRP | X | 152 | −23.070 | 115.415 | −20.021 | 1.00 | 50.45 | GZ00 C |
| ATOM | 6065 | CD2 | TRP | X | 152 | −23.908 | 117.493 | −20.059 | 1.00 | 54.33 | GZ00 C |
| ATOM | 6066 | NE1 | TRP | X | 152 | −24.380 | 115.350 | −19.603 | 1.00 | 45.37 | GZ00 N |
| ATOM | 6067 | CE2 | TRP | X | 152 | −24.919 | 116.608 | −19.624 | 1.00 | 49.73 | GZ00 C |
| ATOM | 6068 | CE3 | TRP | X | 152 | −24.205 | 118.856 | −20.162 | 1.00 | 49.64 | GZ00 C |
| ATOM | 6069 | CZ2 | TRP | X | 152 | −26.201 | 117.046 | −19.286 | 1.00 | 49.17 | GZ00 C |
| ATOM | 6070 | CZ3 | TRP | X | 152 | −25.488 | 119.290 | −19.834 | 1.00 | 47.92 | GZ00 C |
| ATOM | 6071 | CH2 | TRP | X | 152 | −26.464 | 118.390 | −19.400 | 1.00 | 49.61 | GZ00 C |
| ATOM | 6072 | N | LYS | X | 153 | −20.141 | 119.053 | −23.204 | 1.00 | 65.10 | GZ00 N |
| ATOM | 6073 | CA | LYS | X | 153 | −19.019 | 119.883 | −23.602 | 1.00 | 62.17 | GZ00 C |
| ATOM | 6074 | C | LYS | X | 153 | −19.122 | 121.266 | −22.971 | 1.00 | 70.98 | GZ00 C |
| ATOM | 6075 | O | LYS | X | 153 | −20.213 | 121.849 | −22.883 | 1.00 | 60.73 | GZ00 O |
| ATOM | 6076 | CB | LYS | X | 153 | −18.918 | 119.968 | −25.133 | 1.00 | 62.97 | GZ00 C |
| ATOM | 6077 | CG | LYS | X | 153 | −18.343 | 118.679 | −25.728 | 1.00 | 71.97 | GZ00 C |
| ATOM | 6078 | CD | LYS | X | 153 | −18.093 | 118.773 | −27.212 | 1.00 | 76.62 | GZ00 C |
| ATOM | 6079 | CE | LYS | X | 153 | −17.488 | 117.483 | −27.757 | 1.00 | 78.74 | GZ00 C |
| ATOM | 6080 | NZ | LYS | X | 153 | −17.470 | 117.510 | −29.257 | 1.00 | 82.65 | GZ00 N1+ |
| ATOM | 6081 | N | ALA | X | 154 | −17.966 | 121.767 | −22.517 | 1.00 | 68.61 | GZ00 N |
| ATOM | 6082 | CA | ALA | X | 154 | −17.783 | 123.138 | −22.053 | 1.00 | 70.61 | GZ00 C |
| ATOM | 6083 | C | ALA | X | 154 | −16.988 | 123.883 | −23.122 | 1.00 | 76.84 | GZ00 C |
| ATOM | 6084 | O | ALA | X | 154 | −15.785 | 123.645 | −23.282 | 1.00 | 70.93 | GZ00 O |
| ATOM | 6085 | CB | ALA | X | 154 | −17.057 | 123.158 | −20.709 | 1.00 | 58.77 | GZ00 C |
| ATOM | 6086 | N | ASP | X | 155 | −17.672 | 124.765 | −23.853 | 1.00 | 75.44 | GZ00 N |
| ATOM | 6087 | CA | ASP | X | 155 | −17.137 | 125.491 | −25.013 | 1.00 | 86.60 | GZ00 C |
| ATOM | 6088 | C | ASP | X | 155 | −16.167 | 124.618 | −25.821 | 1.00 | 88.28 | GZ00 C |
| ATOM | 6089 | O | ASP | X | 155 | −14.980 | 124.919 | −25.980 | 1.00 | 92.56 | GZ00 O |
| ATOM | 6090 | CB | ASP | X | 155 | −16.529 | 126.864 | −24.643 | 1.00 | 93.75 | GZ00 C |
| ATOM | 6091 | CG | ASP | X | 155 | −15.592 | 126.838 | −23.429 | 1.00 | 92.88 | GZ00 C |
| ATOM | 6092 | OD2 | ASP | X | 155 | −15.842 | 127.652 | −22.504 | 1.00 | 84.61 | GZ00 O1− |
| ATOM | 6093 | OD1 | ASP | X | 155 | −14.599 | 126.064 | −23.414 | 1.00 | 88.83 | GZ00 O |
| ATOM | 6094 | N | SER | X | 156 | −16.707 | 123.493 | −26.297 | 1.00 | 79.32 | GZ00 N |

TABLE 10.3-continued

| | | | | | | | | | |
|---|---|---|---|---|---|---|---|---|---|
| ATOM | 6095 | CA | SER | X | 156 | −16.051 | 122.520 | −27.174 | 1.00 | 78.60 GZ00 C |
| ATOM | 6096 | C | SER | X | 156 | −14.971 | 121.688 | −26.498 | 1.00 | 74.64 GZ00 C |
| ATOM | 6097 | O | SER | X | 156 | −14.249 | 120.963 | −27.189 | 1.00 | 84.36 GZ00 O |
| ATOM | 6098 | CB | SER | X | 156 | −15.436 | 123.186 | −28.416 | 1.00 | 73.87 GZ00 C |
| ATOM | 6099 | OG | SER | X | 156 | −16.405 | 123.895 | −29.165 | 1.00 | 81.66 GZ00 O |
| ATOM | 6100 | N | SER | X | 157 | −14.854 | 121.728 | −25.183 | 1.00 | 69.01 GZ00 N |
| ATOM | 6101 | CA | SER | X | 157 | −13.979 | 120.769 | −24.541 | 1.00 | 69.77 GZ00 C |
| ATOM | 6102 | C | SER | X | 157 | −14.813 | 119.693 | −23.873 | 1.00 | 80.18 GZ00 C |
| ATOM | 6103 | O | SER | X | 157 | −15.795 | 120.013 | −23.189 | 1.00 | 78.55 GZ00 O |
| ATOM | 6104 | CB | SER | X | 157 | −13.084 | 121.447 | −23.505 | 1.00 | 71.70 GZ00 C |
| ATOM | 6105 | OG | SER | X | 157 | −12.182 | 122.329 | −24.136 | 1.00 | 83.37 GZ00 O |
| ATOM | 6106 | N | PRO | X | 158 | −14.476 | 118.419 | −24.062 | 1.00 | 82.78 GZ00 N |
| ATOM | 6107 | CA | PRO | X | 158 | −15.228 | 117.349 | −23.395 | 1.00 | 76.46 GZ00 C |
| ATOM | 6108 | C | PRO | X | 158 | −15.217 | 117.510 | −21.881 | 1.00 | 71.70 GZ00 C |
| ATOM | 6109 | O | PRO | X | 158 | −14.185 | 117.812 | −21.277 | 1.00 | 72.61 GZ00 O |
| ATOM | 6110 | CB | PRO | X | 158 | −14.501 | 116.072 | −23.839 | 1.00 | 73.01 GZ00 C |
| ATOM | 6111 | CG | PRO | X | 158 | −13.220 | 116.534 | −24.487 | 1.00 | 79.70 GZ00 C |
| ATOM | 6112 | CD | PRO | X | 158 | −13.513 | 117.891 | −25.037 | 1.00 | 80.30 GZ00 C |
| ATOM | 6113 | N | VAL | X | 159 | −16.375 | 117.266 | −21.266 | 1.00 | 66.35 GZ00 N |
| ATOM | 6114 | CA | VAL | X | 159 | −16.548 | 117.386 | −19.823 | 1.00 | 62.00 GZ00 C |
| ATOM | 6115 | C | VAL | X | 159 | −16.401 | 116.006 | −19.204 | 1.00 | 69.04 GZ00 C |
| ATOM | 6116 | O | VAL | X | 159 | −17.189 | 115.099 | −19.491 | 1.00 | 77.71 GZ00 O |
| ATOM | 6117 | CB | VAL | X | 159 | −17.910 | 117.997 | −19.467 | 1.00 | 64.97 GZ00 C |
| ATOM | 6118 | CG1 | VAL | X | 159 | −18.084 | 118.013 | −17.959 | 1.00 | 62.71 GZ00 C |
| ATOM | 6119 | CG2 | VAL | X | 159 | −18.059 | 119.400 | −20.075 | 1.00 | 59.52 GZ00 C |
| ATOM | 6120 | N | LYS | X | 160 | −15.413 | 115.857 | −18.328 | 1.00 | 74.85 GZ00 N |
| ATOM | 6121 | CA | LYS | X | 160 | −14.967 | 114.550 | −17.867 | 1.00 | 79.58 GZ00 C |
| ATOM | 6122 | C | LYS | X | 160 | −15.580 | 114.124 | −16.535 | 1.00 | 75.16 GZ00 C |
| ATOM | 6123 | O | LYS | X | 160 | −15.412 | 112.964 | −16.143 | 1.00 | 82.11 GZ00 O |
| ATOM | 6124 | CB | LYS | X | 160 | −13.429 | 114.543 | −17.758 | 1.00 | 85.50 GZ00 C |
| ATOM | 6125 | CG | LYS | X | 160 | −12.723 | 113.330 | −18.377 | 1.00 | 89.99 GZ00 C |
| ATOM | 6126 | CD | LYS | X | 160 | −12.558 | 113.438 | −19.900 | 1.00 | 91.72 GZ00 C |
| ATOM | 6127 | CE | LYS | X | 160 | −11.807 | 112.217 | −20.463 | 1.00 | 101.89 GZ00 C |
| ATOM | 6128 | NZ | LYS | X | 160 | −11.786 | 112.147 | −21.960 | 1.00 | 92.33 GZ00 N1+ |
| ATOM | 6129 | N | ALA | X | 161 | −16.284 | 115.011 | −15.833 | 1.00 | 64.13 GZ00 N |
| ATOM | 6130 | CA | ALA | X | 161 | −16.778 | 114.677 | −14.503 | 1.00 | 64.11 GZ00 C |
| ATOM | 6131 | C | ALA | X | 161 | −18.053 | 115.454 | −14.206 | 1.00 | 60.81 GZ00 C |
| ATOM | 6132 | O | ALA | X | 161 | −18.346 | 116.472 | −14.836 | 1.00 | 59.19 GZ00 O |
| ATOM | 6133 | CB | ALA | X | 161 | −15.728 | 114.953 | −13.424 | 1.00 | 61.76 GZ00 C |
| ATOM | 6134 | N | GLY | X | 162 | −18.809 | 114.954 | −13.231 | 1.00 | 53.42 GZ00 N |
| ATOM | 6135 | CA | GLY | X | 162 | −20.048 | 115.575 | −12.823 | 1.00 | 55.17 GZ00 C |
| ATOM | 6136 | C | GLY | X | 162 | −21.273 | 115.133 | −13.595 | 1.00 | 59.06 GZ00 C |
| ATOM | 6137 | 0 | GLY | X | 162 | −22.353 | 115.706 | −13.396 | 1.00 | 55.42 GZ00 O |
| ATOM | 6138 | N | VAL | X | 163 | −21.147 | 114.128 | −14.458 | 1.00 | 52.82 GZ00 N |
| ATOM | 6139 | CA | VAL | X | 163 | −22.234 | 113.680 | −15.316 | 1.00 | 48.37 GZ00 C |
| ATOM | 6140 | C | VAL | X | 163 | −22.874 | 112.455 | −14.689 | 1.00 | 49.71 GZ00 C |
| ATOM | 6141 | O | VAL | X | 163 | −22.179 | 111.511 | −14.296 | 1.00 | 50.43 GZ00 O |
| ATOM | 6142 | CB | VAL | X | 163 | −21.738 | 113.364 | −16.737 | 1.00 | 45.16 GZ00 C |
| ATOM | 6143 | CG1 | VAL | X | 163 | −22.863 | 112.761 | −17.564 | 1.00 | 41.69 GZ00 C |
| ATOM | 6144 | CG2 | VAL | X | 163 | −21.220 | 114.622 | −17.401 | 1.00 | 46.72 GZ00 C |
| ATOM | 6145 | N | GLU | X | 164 | −24.197 | 112.468 | −14.599 | 1.00 | 47.13 GZ00 N |
| ATOM | 6146 | CA | GLU | X | 164 | −24.964 | 111.300 | −14.201 | 1.00 | 53.09 GZ00 C |
| ATOM | 6147 | C | GLU | X | 164 | −26.115 | 111.140 | −15.178 | 1.00 | 46.61 GZ00 C |
| ATOM | 6148 | O | GLU | X | 164 | −26.815 | 112.113 | −15.471 | 1.00 | 51.75 GZ00 O |
| ATOM | 6149 | CB | GLU | X | 164 | −25.447 | 111.448 | −12.757 | 1.00 | 51.29 GZ00 C |
| ATOM | 6150 | CG | GLU | X | 164 | −24.369 | 110.989 | −11.771 | 1.00 | 66.35 GZ00 C |
| ATOM | 6151 | CD | GLU | X | 164 | −24.588 | 111.481 | −10.349 | 1.00 | 80.34 GZ00 C |
| ATOM | 6152 | OE1 | GLU | X | 164 | −25.618 | 112.153 | −10.090 | 1.00 | 84.11 GZ00 O |
| ATOM | 6153 | OE2 | GLU | X | 164 | −23.723 | 111.189 | −9.486 | 1.00 | 74.82 GZ00 O1− |
| ATOM | 6154 | N | THR | X | 165 | −26.291 | 109.923 | −15.699 | 1.00 | 44.17 GZ00 N |
| ATOM | 6155 | CA | THR | X | 165 | −27.216 | 109.646 | −16.791 | 1.00 | 41.22 GZ00 C |
| ATOM | 6156 | C | THR | X | 165 | −28.051 | 108.419 | −16.450 | 1.00 | 43.11 GZ00 C |
| ATOM | 6157 | O | THR | X | 165 | −27.536 | 107.449 | −15.891 | 1.00 | 46.87 GZ00 O |
| ATOM | 6158 | CB | THR | X | 165 | −26.455 | 109.433 | −18.098 | 1.00 | 41.49 GZ00 C |
| ATOM | 6159 | OG1 | THR | X | 165 | −25.742 | 110.625 | −18.421 | 1.00 | 41.60 GZ00 O |
| ATOM | 6160 | CG2 | THR | X | 165 | −27.397 | 109.091 | −19.242 | 1.00 | 40.37 GZ00 C |
| ATOM | 6161 | N | THR | X | 166 | −29.352 | 108.492 | −16.712 | 1.00 | 45.39 GZ00 N |
| ATOM | 6162 | CA | THR | X | 166 | −30.228 | 107.356 | −16.466 | 1.00 | 48.92 GZ00 C |
| ATOM | 6163 | C | THR | X | 166 | −30.165 | 106.353 | −17.611 | 1.00 | 43.82 GZ00 C |
| ATOM | 6164 | O | THR | X | 166 | −29.861 | 106.689 | −18.756 | 1.00 | 48.48 GZ00 O |
| ATOM | 6165 | CB | THR | X | 166 | −31.684 | 107.786 | −16.285 | 1.00 | 42.46 GZ00 C |
| ATOM | 6166 | OG1 | THR | X | 166 | −32.133 | 108.501 | −17.446 | 1.00 | 42.85 GZ00 O |
| ATOM | 6167 | CG2 | THR | X | 166 | −31.833 | 108.639 | −15.075 | 1.00 | 49.93 GZ00 C |
| ATOM | 6168 | N | VAL | X | 167 | −30.481 | 105.109 | −17.287 | 1.00 | 43.83 GZ00 N |
| ATOM | 6169 | CA | VAL | X | 167 | −30.761 | 104.109 | −18.306 | 1.00 | 47.99 GZ00 C |
| ATOM | 6170 | C | VAL | X | 167 | −32.044 | 104.535 | −19.004 | 1.00 | 43.14 GZ00 C |
| ATOM | 6171 | O | VAL | X | 167 | −32.921 | 105.146 | −18.381 | 1.00 | 51.16 GZ00 O |
| ATOM | 6172 | CB | VAL | X | 167 | −30.905 | 102.716 | −17.689 | 1.00 | 47.80 GZ00 C |
| ATOM | 6173 | CG1 | VAL | X | 167 | −29.736 | 102.444 | −16.786 | 1.00 | 37.96 GZ00 C |
| ATOM | 6174 | CG2 | VAL | X | 167 | −32.215 | 102.646 | −16.913 | 1.00 | 51.34 GZ00 C |

TABLE 10.3-continued

| ATOM | 6175 | N | PRO | X | 168 | −32.201 | 104.266 | −20.280 | 1.00 | 44.56 | GZ00 N |
| --- | --- | --- | --- | --- | --- | --- | --- | --- | --- | --- | --- |
| ATOM | 6176 | CA | PRO | X | 168 | −33.464 | 104.616 | −20.934 | 1.00 | 41.00 | GZ00 C |
| ATOM | 6177 | C | PRO | X | 168 | −34.607 | 103.782 | −20.385 | 1.00 | 47.02 | GZ00 C |
| ATOM | 6178 | O | PRO | X | 168 | −34.429 | 102.648 | −19.941 | 1.00 | 49.69 | GZ00 O |
| ATOM | 6179 | CB | PRO | X | 168 | −33.202 | 104.334 | −22.419 | 1.00 | 43.99 | GZ00 C |
| ATOM | 6180 | CG | PRO | X | 168 | −31.908 | 103.574 | −22.452 | 1.00 | 46.78 | GZ00 C |
| ATOM | 6181 | CD | PRO | X | 168 | −31.141 | 103.904 | −21.227 | 1.00 | 39.42 | GZ00 C |
| ATOM | 6182 | N | SER | X | 169 | −35.784 | 104.384 | −20.368 | 1.00 | 47.67 | GZ00 N |
| ATOM | 6183 | CA | SER | X | 169 | −36.987 | 103.723 | −19.907 | 1.00 | 50.31 | GZ00 C |
| ATOM | 6184 | C | SER | X | 169 | −38.095 | 103.966 | −20.920 | 1.00 | 49.36 | GZ00 C |
| ATOM | 6185 | O | SER | X | 169 | −38.168 | 105.022 | −21.563 | 1.00 | 43.92 | GZ00 O |
| ATOM | 6186 | CB | SER | X | 169 | −37.417 | 104.225 | −18.517 | 1.00 | 43.96 | GZ00 C |
| ATOM | 6187 | OG | SER | X | 169 | −37.708 | 105.604 | −18.594 | 1.00 | 55.02 | GZ00 O |
| ATOM | 6188 | N | LYS | X | 170 | −38.955 | 102.967 | −21.057 | 1.00 | 52.10 | GZ00 N |
| ATOM | 6189 | CA | LYS | X | 170 | −39.974 | 102.986 | −22.090 | 1.00 | 53.24 | GZ00 C |
| ATOM | 6190 | C | LYS | X | 170 | −41.088 | 103.939 | −21.683 | 1.00 | 52.61 | GZ00 C |
| ATOM | 6191 | O | LYS | X | 170 | −41.529 | 103.938 | −20.531 | 1.00 | 55.96 | GZ00 O |
| ATOM | 6192 | CB | LYS | X | 170 | −40.491 | 101.563 | −22.339 | 1.00 | 57.92 | GZ00 C |
| ATOM | 6193 | CG | LYS | X | 170 | −41.220 | 101.352 | −23.678 | 1.00 | 61.39 | GZ00 C |
| ATOM | 6194 | CD | LYS | X | 170 | −41.730 | 99.902 | −23.841 | 1.00 | 60.71 | GZ00 C |
| ATOM | 6195 | CE | LYS | X | 170 | −40.545 | 98.928 | −24.020 | 1.00 | 68.36 | GZ00 C |
| ATOM | 6196 | NZ | LYS | X | 170 | −40.911 | 97.510 | −24.330 | 1.00 | 76.29 | GZ00 N1+ |
| ATOM | 6197 | N | GLN | X | 171 | −41.485 | 104.794 | −22.619 | 1.00 | 49.96 | GZ00 N |
| ATOM | 6198 | CA | GLN | X | 171 | −42.633 | 105.668 | −22.499 | 1.00 | 48.46 | GZ00 C |
| ATOM | 6199 | C | GLN | X | 171 | −43.897 | 104.888 | −22.851 | 1.00 | 55.64 | GZ00 C |
| ATOM | 6200 | O | GLN | X | 171 | −43.843 | 103.749 | −23.324 | 1.00 | 58.51 | GZ00 O |
| ATOM | 6201 | CB | GLN | X | 171 | −42.474 | 106.880 | −23.422 | 1.00 | 47.95 | GZ00 C |
| ATOM | 6202 | CG | GLN | X | 171 | −41.214 | 107.699 | −23.166 | 1.00 | 44.29 | GZ00 C |
| ATOM | 6203 | CD | GLN | X | 171 | −40.919 | 108.737 | −24.253 | 1.00 | 49.84 | GZ00 C |
| ATOM | 6204 | OE1 | GLN | X | 171 | −40.035 | 109.590 | −24.090 | 1.00 | 47.77 | GZ00 O |
| ATOM | 6205 | NE2 | GLN | X | 171 | −41.651 | 108.667 | −25.365 | 1.00 | 49.40 | GZ00 N |
| ATOM | 6206 | N | SER | X | 172 | −45.052 | 105.506 | −22.605 | 1.00 | 61.57 | GZ00 N |
| ATOM | 6207 | CA | SER | X | 172 | −46.313 | 104.841 | −22.927 | 1.00 | 67.22 | GZ00 C |
| ATOM | 6208 | C | SER | X | 172 | −46.410 | 104.535 | −24.419 | 1.00 | 65.89 | GZ00 C |
| ATOM | 6209 | O | SER | X | 172 | −46.922 | 103.477 | −24.808 | 1.00 | 65.81 | GZ00 O |
| ATOM | 6210 | CB | SER | X | 172 | −47.491 | 105.696 | −22.460 | 1.00 | 55.65 | GZ00 C |
| ATOM | 6211 | OG | SER | X | 172 | −47.391 | 106.989 | −23.016 | 1.00 | 65.82 | GZ00 O |
| ATOM | 6212 | N | ASN | X | 173 | −45.891 | 105.434 | −25.268 | 1.00 | 64.43 | GZ00 N |
| ATOM | 6213 | CA | ASN | X | 173 | −45.898 | 105.274 | −26.722 | 1.00 | 55.79 | GZ00 C |
| ATOM | 6214 | C | ASN | X | 173 | −44.815 | 104.319 | −27.236 | 1.00 | 60.52 | GZ00 C |
| ATOM | 6215 | O | ASN | X | 173 | −44.548 | 104.300 | −28.446 | 1.00 | 58.94 | GZ00 O |
| ATOM | 6216 | CB | ASN | X | 173 | −45.762 | 106.634 | −27.419 | 1.00 | 56.26 | GZ00 C |
| ATOM | 6217 | CG | ASN | X | 173 | −44.404 | 107.291 | −27.198 | 1.00 | 62.34 | GZ00 C |
| ATOM | 6218 | OD1 | ASN | X | 173 | −43.536 | 106.762 | −26.496 | 1.00 | 55.11 | GZ00 O |
| ATOM | 6219 | ND2 | ASN | X | 173 | −44.207 | 108.450 | −27.834 | 1.00 | 61.15 | GZ00 N |
| ATOM | 6220 | N | ASN | X | 174 | −44.162 | 103.573 | −26.348 | 1.00 | 57.78 | GZ00 N |
| ATOM | 6221 | CA | ASN | X | 174 | −43.139 | 102.573 | −26.649 | 1.00 | 62.92 | GZ00 C |
| ATOM | 6222 | C | ASN | X | 174 | −41.849 | 103.159 | −27.207 | 1.00 | 62.49 | GZ00 C |
| ATOM | 6223 | O | ASN | X | 174 | −40.923 | 102.390 | −27.512 | 1.00 | 56.92 | GZ00 O |
| ATOM | 6224 | CB | ASN | X | 174 | −43.647 | 101.485 | −27.598 | 1.00 | 64.96 | GZ00 C |
| ATOM | 6225 | CG | ASN | X | 174 | −44.491 | 100.463 | −26.877 | 1.00 | 72.73 | GZ00 C |
| ATOM | 6226 | OD1 | ASN | X | 174 | −44.329 | 100.265 | −25.673 | 1.00 | 66.54 | GZ00 O |
| ATOM | 6227 | ND2 | ASN | X | 174 | −45.394 | 99.809 | −27.599 | 1.00 | 78.95 | GZ00 N |
| ATOM | 6228 | N | LYS | X | 175 | −41.738 | 104.481 | −27.328 | 1.00 | 58.39 | GZ00 N |
| ATOM | 6229 | CA | LYS | X | 175 | −40.429 | 105.092 | −27.468 | 1.00 | 52.42 | GZ00 C |
| ATOM | 6230 | C | LYS | X | 175 | −39.796 | 105.219 | −26.086 | 1.00 | 49.60 | GZ00 C |
| ATOM | 6231 | O | LYS | X | 175 | −40.366 | 104.789 | −25.077 | 1.00 | 48.97 | GZ00 O |
| ATOM | 6232 | CB | LYS | X | 175 | −40.537 | 106.429 | −28.183 | 1.00 | 49.13 | GZ00 C |
| ATOM | 6233 | CG | LYS | X | 175 | −41.199 | 106.317 | −29.545 | 1.00 | 48.64 | GZ00 C |
| ATOM | 6234 | CD | LYS | X | 175 | −41.226 | 107.678 | −30.217 | 1.00 | 55.03 | GZ00 C |
| ATOM | 6235 | CE | LYS | X | 175 | −42.052 | 107.683 | −31.482 | 1.00 | 50.14 | GZ00 C |
| ATOM | 6236 | NZ | LYS | X | 175 | −41.863 | 108.996 | −32.147 | 1.00 | 65.58 | GZ00 N |
| ATOM | 6237 | N | TYR | X | 176 | −38.595 | 105.789 | −26.028 | 1.00 | 45.23 | GZ00 N |
| ATOM | 6238 | CA | TYR | X | 176 | −37.810 | 105.757 | −24.803 | 1.00 | 46.64 | GZ00 C |
| ATOM | 6239 | C | TYR | X | 176 | −37.405 | 107.159 | −24.375 | 1.00 | 46.24 | GZ00 C |
| ATOM | 6240 | O | TYR | X | 176 | −37.332 | 108.091 | −25.185 | 1.00 | 42.79 | GZ00 O |
| ATOM | 6241 | CB | TYR | X | 176 | −36.559 | 104.893 | −24.956 | 1.00 | 40.24 | GZ00 C |
| ATOM | 6242 | CG | TYR | X | 176 | −36.865 | 103.419 | −25.082 | 1.00 | 46.22 | GZ00 C |
| ATOM | 6243 | CD1 | TYR | X | 176 | −37.356 | 102.882 | −26.276 | 1.00 | 40.78 | GZ00 C |
| ATOM | 6244 | CD2 | TYR | X | 176 | −36.683 | 102.567 | −24.006 | 1.00 | 47.03 | GZ00 C |
| ATOM | 6245 | CE1 | TYR | X | 176 | −37.628 | 101.537 | −26.389 | 1.00 | 43.89 | GZ00 C |
| ATOM | 6246 | CE2 | TYR | X | 176 | −36.965 | 101.215 | −24.107 | 1.00 | 51.38 | GZ00 C |
| ATOM | 6247 | CZ | TYR | X | 176 | −37.439 | 100.706 | −25.294 | 1.00 | 52.19 | GZ00 C |
| ATOM | 6248 | OH | TYR | X | 176 | −37.713 | 99.359 | −25.380 | 1.00 | 57.66 | GZ00 O |
| ATOM | 6249 | N | ALA | X | 177 | −37.152 | 107.290 | −23.072 | 1.00 | 42.19 | GZ00 N |
| ATOM | 6250 | CA | ALA | X | 177 | −36.737 | 108.543 | −22.464 | 1.00 | 42.58 | GZ00 C |
| ATOM | 6251 | C | ALA | X | 177 | −35.553 | 108.309 | −21.543 | 1.00 | 39.64 | GZ00 C |
| ATOM | 6252 | O | ALA | X | 177 | −35.393 | 107.231 | −20.966 | 1.00 | 43.45 | GZ00 O |
| ATOM | 6253 | CB | ALA | X | 177 | −37.873 | 109.197 | −21.673 | 1.00 | 36.73 | GZ00 C |
| ATOM | 6254 | N | ALA | X | 178 | −34.735 | 109.339 | −21.397 | 1.00 | 35.05 | GZ00 N |

TABLE 10.3-continued

| | | | | | | | | | | |
|---|---|---|---|---|---|---|---|---|---|---|
| ATOM | 6255 | CA | ALA | X | 178 | −33.635 | 109.306 | −20.451 | 1.00 | 41.99 | GZ00 C |
| ATOM | 6256 | C | ALA | X | 178 | −33.310 | 110.743 | −20.087 | 1.00 | 37.98 | GZ00 C |
| ATOM | 6257 | O | ALA | X | 178 | −33.750 | 111.681 | −20.751 | 1.00 | 42.02 | GZ00 O |
| ATOM | 6258 | CB | ALA | X | 178 | −32.406 | 108.580 | −21.021 | 1.00 | 32.61 | GZ00 C |
| ATOM | 6259 | N | SER | X | 179 | −32.574 | 110.910 | −18.999 | 1.00 | 43.75 | GZ00 N |
| ATOM | 6260 | CA | SER | X | 179 | −32.093 | 112.230 | −18.639 | 1.00 | 42.28 | GZ00 C |
| ATOM | 6261 | C | SER | X | 179 | −30.654 | 112.109 | −18.170 | 1.00 | 40.65 | GZ00 C |
| ATOM | 6262 | O | SER | X | 179 | −30.220 | 111.051 | −17.713 | 1.00 | 48.12 | GZ00 O |
| ATOM | 6263 | CB | SER | X | 179 | −32.956 | 112.897 | −17.572 | 1.00 | 35.06 | GZ00 C |
| ATOM | 6264 | OG | SER | X | 179 | −33.250 | 112.013 | −16.525 | 1.00 | 37.63 | GZ00 O |
| ATOM | 6265 | N | SER | X | 180 | −29.921 | 113.202 | −18.326 | 1.00 | 41.05 | GZ00 N |
| ATOM | 6266 | CA | SER | X | 180 | −28.523 | 113.321 | −17.950 | 1.00 | 41.22 | GZ00 C |
| ATOM | 6267 | C | SER | X | 180 | −28.336 | 114.625 | −17.185 | 1.00 | 47.40 | GZ00 C |
| ATOM | 6268 | O | SER | X | 180 | −28.846 | 115.667 | −17.606 | 1.00 | 38.98 | GZ00 O |
| ATOM | 6269 | CB | SER | X | 180 | −27.628 | 113.305 | −19.187 | 1.00 | 42.77 | GZ00 C |
| ATOM | 6270 | OG | SER | X | 180 | −26.270 | 113.291 | −18.824 | 1.00 | 40.90 | GZ00 O |
| ATOM | 6271 | N | TYR | X | 181 | −27.616 | 114.556 | −16.062 | 1.00 | 49.96 | GZ00 N |
| ATOM | 6272 | CA | TYR | X | 181 | −27.366 | 115.685 | −15.179 | 1.00 | 43.04 | GZ00 C |
| ATOM | 6273 | C | TYR | X | 181 | −25.872 | 115.961 | −15.084 | 1.00 | 48.60 | GZ00 C |
| ATOM | 6274 | O | TYR | X | 181 | −25.089 | 115.054 | −14.778 | 1.00 | 50.29 | GZ00 O |
| ATOM | 6275 | CB | TYR | X | 181 | −27.922 | 115.419 | −13.778 | 1.00 | 32.89 | GZ00 C |
| ATOM | 6276 | CG | TYR | X | 181 | −29.417 | 115.274 | −13.722 | 1.00 | 40.29 | GZ00 C |
| ATOM | 6277 | CD2 | TYR | X | 181 | −30.224 | 116.358 | −13.413 | 1.00 | 36.67 | GZ00 C |
| ATOM | 6278 | CD1 | TYR | X | 181 | −30.030 | 114.053 | −13.999 | 1.00 | 41.31 | GZ00 C |
| ATOM | 6279 | CE2 | TYR | X | 181 | −31.614 | 116.238 | −13.366 | 1.00 | 40.95 | GZ00 C |
| ATOM | 6280 | CE1 | TYR | X | 181 | −31.402 | 113.909 | −13.951 | 1.00 | 38.36 | GZ00 C |
| ATOM | 6281 | CZ | TYR | X | 181 | −32.195 | 115.000 | −13.636 | 1.00 | 46.60 | GZ00 C |
| ATOM | 6282 | OH | TYR | X | 181 | −33.561 | 114.845 | −13.591 | 1.00 | 40.50 | GZ00 O |
| ATOM | 6283 | N | TEU | X | 182 | −25.488 | 117.220 | −15.298 | 1.00 | 46.12 | GZ00 N |
| ATOM | 6284 | CA | LEU | X | 182 | −24.119 | 117.692 | −15.092 | 1.00 | 47.69 | GZ00 C |
| ATOM | 6285 | C | LEU | X | 182 | −24.094 | 118.629 | −13.889 | 1.00 | 50.67 | GZ00 C |
| ATOM | 6286 | O | LEU | X | 182 | −24.748 | 119.679 | −13.906 | 1.00 | 45.67 | GZ00 O |
| ATOM | 6287 | CB | LEU | X | 182 | −23.582 | 118.410 | −16.332 | 1.00 | 50.05 | GZ00 C |
| ATOM | 6288 | CG | LEU | X | 182 | −22.207 | 119.070 | −16.145 | 1.00 | 51.24 | GZ00 C |
| ATOM | 6289 | CD1 | LEU | X | 182 | −21.143 | 118.063 | −15.726 | 1.00 | 46.82 | GZ00 C |
| ATOM | 6290 | CD2 | LEU | X | 182 | −21.779 | 119.815 | −17.399 | 1.00 | 48.62 | GZ00 C |
| ATOM | 6291 | N | SER | X | 183 | −23.382 | 118.231 | −12.839 | 1.00 | 44.73 | GZ00 N |
| ATOM | 6292 | CA | SER | X | 183 | −23.218 | 119.066 | −11.658 | 1.00 | 53.81 | GZ00 C |
| ATOM | 6293 | C | SER | X | 183 | −21.967 | 119.928 | −11.797 | 1.00 | 58.46 | GZ00 C |
| ATOM | 6294 | O | SER | X | 183 | −20.896 | 119.430 | −12.152 | 1.00 | 65.34 | GZ00 O |
| ATOM | 6295 | CB | SER | X | 183 | −23.124 | 118.218 | −10.393 | 1.00 | 46.16 | GZ00 C |
| ATOM | 6296 | OG | SER | X | 183 | −24.237 | 117.370 | −10.277 | 1.00 | 53.51 | GZ00 O |
| ATOM | 6297 | N | LEU | X | 184 | −22.104 | 121.208 | −11.480 | 1.00 | 52.70 | GZ00 N |
| ATOM | 6298 | CA | LEU | X | 184 | −21.025 | 122.174 | −11.566 | 1.00 | 59.11 | GZ00 C |
| ATOM | 6299 | C | LEU | X | 184 | −21.049 | 123.030 | −10.308 | 1.00 | 62.24 | GZ00 C |
| ATOM | 6300 | O | LEU | X | 184 | −22.011 | 123.007 | −9.537 | 1.00 | 61.48 | GZ00 O |
| ATOM | 6301 | CB | LEU | X | 184 | −21.178 | 123.079 | −12.796 | 1.00 | 57.83 | GZ00 C |
| ATOM | 6302 | CG | LEU | X | 184 | −21.196 | 122.468 | −14.189 | 1.00 | 57.44 | GZ00 C |
| ATOM | 6303 | CD1 | LEU | X | 184 | −21.426 | 123.563 | −15.208 | 1.00 | 52.24 | GZ00 C |
| ATOM | 6304 | CD2 | LEU | X | 184 | −19.901 | 121.740 | −14.475 | 1.00 | 62.82 | GZ00 C |
| ATOM | 6305 | N | THR | X | 185 | −19.978 | 123.805 | −10.106 | 1.00 | 64.47 | GZ00 N |
| ATOM | 6306 | CA | THR | X | 185 | −20.070 | 124.923 | −9.176 | 1.00 | 60.49 | GZ00 C |
| ATOM | 6307 | C | THR | X | 185 | −20.580 | 126.161 | −9.899 | 1.00 | 61.60 | GZ00 C |
| ATOM | 6308 | O | THR | X | 185 | −20.455 | 126.279 | −11.129 | 1.00 | 56.95 | GZ00 O |
| ATOM | 6309 | CB | THR | X | 185 | −18.710 | 125.225 | −8.555 | 1.00 | 61.74 | GZ00 C |
| ATOM | 6310 | OG1 | THR | X | 185 | −17.813 | 125.690 | −9.577 | 1.00 | 64.33 | GZ00 O |
| ATOM | 6311 | CG2 | THR | X | 185 | −18.149 | 124.005 | −7.840 | 1.00 | 49.10 | GZ00 C |
| ATOM | 6312 | N | PRO | X | 186 | −21.194 | 127.094 | −9.165 | 1.00 | 63.67 | GZ00 N |
| ATOM | 6313 | CA | PRO | X | 186 | −21.536 | 128.392 | −9.774 | 1.00 | 66.91 | GZ00 C |
| ATOM | 6314 | C | PRO | X | 186 | −20.364 | 129.034 | −10.512 | 1.00 | 66.84 | GZ00 C |
| ATOM | 6315 | O | PRO | X | 186 | −20.570 | 129.710 | −11.529 | 1.00 | 66.08 | GZ00 O |
| ATOM | 6316 | CB | PRO | X | 186 | −21.974 | 129.227 | −8.564 | 1.00 | 55.91 | GZ00 C |
| ATOM | 6317 | CG | PRO | X | 186 | −22.496 | 128.215 | −7.584 | 1.00 | 54.51 | GZ00 C |
| ATOM | 6318 | CD | PRO | X | 186 | −21.625 | 127.004 | −7.757 | 1.00 | 56.56 | GZ00 C |
| ATOM | 6319 | N | GLU | X | 187 | −19.133 | 128.818 | −10.030 | 1.00 | 69.10 | GZ00 N |
| ATOM | 6320 | CA | GLU | X | 187 | −17.938 | 129.365 | −10.676 | 1.00 | 76.90 | GZ00 C |
| ATOM | 6321 | C | GLU | X | 187 | −17.718 | 128.740 | −12.049 | 1.00 | 75.85 | GZ00 C |
| ATOM | 6322 | O | GLU | X | 187 | −17.599 | 129.450 | −13.059 | 1.00 | 69.16 | GZ00 O |
| ATOM | 6323 | CB | GLU | X | 187 | −16.708 | 129.124 | −9.791 | 1.00 | 78.07 | GZ00 C |
| ATOM | 6324 | CG | GLU | X | 187 | −17.004 | 128.966 | −8.297 | 1.00 | 81.84 | GZ00 C |
| ATOM | 6325 | CD | GLU | X | 187 | −17.761 | 130.158 | −7.714 | 1.00 | 100.11 | GZ00 C |
| ATOM | 6326 | OE1 | GLU | X | 187 | −17.435 | 131.317 | −8.086 | 1.00 | 95.34 | GZ00 O |
| ATOM | 6327 | OE2 | GLU | X | 187 | −18.692 | 129.930 | −6.901 | 1.00 | 102.20 | GZ00 O1− |
| ATOM | 6328 | N | GLN | X | 188 | −17.652 | 127.402 | −12.095 | 1.00 | 68.87 | GZ00 N |
| ATOM | 6329 | CA | GLN | X | 188 | −17.499 | 126.699 | −13.361 | 1.00 | 62.65 | GZ00 C |
| ATOM | 6330 | C | GLN | X | 188 | −18.597 | 127.093 | −14.333 | 1.00 | 65.88 | GZ00 C |
| ATOM | 6331 | O | GLN | X | 188 | −18.350 | 127.252 | −15.533 | 1.00 | 66.09 | GZ00 O |
| ATOM | 6332 | CB | GLN | X | 188 | −17.540 | 125.195 | −13.127 | 1.00 | 65.71 | GZ00 C |
| ATOM | 6333 | CG | GLN | X | 188 | −16.451 | 124.635 | −12.256 | 1.00 | 60.72 | GZ00 C |
| ATOM | 6334 | CD | GLN | X | 188 | −16.821 | 123.252 | −11.764 | 1.00 | 66.14 | GZ00 C |

TABLE 10.3-continued

| | | | | | | | | | | |
|---|---|---|---|---|---|---|---|---|---|---|
| ATOM | 6335 | OE1 | GLN | X | 188 | −17.996 | 122.941 | −11.617 | 1.00 | 70.69 GZ00 O |
| ATOM | 6336 | NE2 | GLN | X | 188 | −15.827 | 122.419 | −11.504 | 1.00 | 73.28 GZ00 N |
| ATOM | 6337 | N | TRP | X | 189 | −19.821 | 127.251 | −13.828 | 1.00 | 60.70 GZ00 N |
| ATOM | 6338 | CA | TRP | X | 189 | −20.941 | 127.588 | −14.695 | 1.00 | 61.89 GZ00 C |
| ATOM | 6339 | C | TRP | X | 189 | −20.728 | 128.932 | −15.381 | 1.00 | 66.39 GZ00 C |
| ATOM | 6340 | O | TRP | X | 189 | −20.889 | 129.048 | −16.601 | 1.00 | 69.50 GZ00 O |
| ATOM | 6341 | CB | TRP | X | 189 | −22.233 | 127.581 | −13.880 | 1.00 | 53.09 GZ00 C |
| ATOM | 6342 | CG | TRP | X | 189 | −23.388 | 128.262 | −14.520 | 1.00 | 48.26 GZ00 C |
| ATOM | 6343 | CD1 | TRP | X | 189 | −24.099 | 129.288 | −13.998 | 1.00 | 54.93 GZ00 C |
| ATOM | 6344 | CD2 | TRP | X | 189 | −23.972 | 127.976 | −15.799 | 1.00 | 53.12 GZ00 C |
| ATOM | 6345 | NE1 | TRP | X | 189 | −25.102 | 129.665 | −14.859 | 1.00 | 60.99 GZ00 N |
| ATOM | 6346 | CE2 | TRP | X | 189 | −25.047 | 128.878 | −15.976 | 1.00 | 52.94 GZ00 C |
| ATOM | 6347 | CE3 | TRP | X | 189 | −23.704 | 127.040 | −16.803 | 1.00 | 54.03 GZ00 C |
| ATOM | 6348 | CZ2 | TRP | X | 189 | −25.861 | 128.873 | −17.116 | 1.00 | 55.81 GZ00 C |
| ATOM | 6349 | CZ3 | TRP | X | 189 | −24.512 | 127.036 | −17.944 | 1.00 | 57.95 GZ00 C |
| ATOM | 6350 | CH2 | TRP | X | 189 | −25.577 | 127.953 | −18.090 | 1.00 | 55.87 GZ00 C |
| ATOM | 6351 | N | LYS | X | 190 | −20.337 | 129.957 | −14.619 | 1.00 | 75.20 GZ00 N |
| ATOM | 6352 | CA | LYS | X | 190 | −20.232 | 131.302 | −15.184 | 1.00 | 80.83 GZ00 C |
| ATOM | 6353 | C | LYS | X | 190 | −18.940 | 131.535 | −15.962 | 1.00 | 78.13 GZ00 C |
| ATOM | 6354 | O | LYS | X | 190 | −18.891 | 132.458 | −16.786 | 1.00 | 75.06 GZ00 O |
| ATOM | 6355 | CB | LYS | X | 190 | −20.398 | 132.357 | −14.081 | 1.00 | 73.65 GZ00 C |
| ATOM | 6356 | CG | LYS | X | 190 | −21.825 | 132.394 | −13.491 | 1.00 | 81.54 GZ00 C |
| ATOM | 6357 | CD | LYS | X | 190 | −21.973 | 133.326 | −12.286 | 1.00 | 80.94 GZ00 C |
| ATOM | 6358 | CE | LYS | X | 190 | −23.413 | 133.330 | −11.769 | 1.00 | 79.11 GZ00 C |
| ATOM | 6359 | NZ | LYS | X | 190 | −23.602 | 134.127 | −10.531 | 1.00 | 82.23 GZ00 N1+ |
| ATOM | 6360 | N | SER | X | 191 | −17.917 | 130.698 | −15.765 | 1.00 | 70.70 GZ00 N |
| ATOM | 6361 | CA | SER | X | 191 | −16.625 | 130.963 | −16.388 | 1.00 | 77.12 GZ00 C |
| ATOM | 6362 | C | SER | X | 191 | −16.645 | 130.672 | −17.891 | 1.00 | 80.54 GZ00 C |
| ATOM | 6363 | O | SER | X | 191 | −16.183 | 131.494 | −18.691 | 1.00 | 90.60 GZ00 O |
| ATOM | 6364 | CB | SER | X | 191 | −15.528 | 130.163 | −15.676 | 1.00 | 70.51 GZ00 C |
| ATOM | 6365 | OG | SER | X | 191 | −15.673 | 128.776 | −15.878 | 1.00 | 73.70 GZ00 O |
| ATOM | 6366 | N | HIS | X | 192 | −17.193 | 129.529 | −18.303 | 1.00 | 79.21 GZ00 N |
| ATOM | 6367 | CA | HIS | X | 192 | −17.144 | 129.148 | −19.709 | 1.00 | 68.99 GZ00 C |
| ATOM | 6368 | C | HIS | X | 192 | −18.216 | 129.880 | −20.503 | 1.00 | 68.52 GZ00 C |
| ATOM | 6369 | O | HIS | X | 192 | −19.228 | 130.326 | −19.959 | 1.00 | 75.08 GZ00 O |
| ATOM | 6370 | CB | HIS | X | 192 | −17.328 | 127.646 | −19.858 | 1.00 | 67.33 GZ00 C |
| ATOM | 6371 | CG | HIS | X | 192 | −16.211 | 126.849 | −19.270 | 1.00 | 72.96 GZ00 C |
| ATOM | 6372 | ND1 | HIS | X | 192 | −16.133 | 126.565 | −17.924 | 1.00 | 69.38 GZ00 N |
| ATOM | 6373 | CD2 | HIS | X | 192 | −15.134 | 126.260 | −19.844 | 1.00 | 69.24 GZ00 C |
| ATOM | 6374 | CE1 | HIS | X | 192 | −15.051 | 125.843 | −17.690 | 1.00 | 77.85 GZ00 C |
| ATOM | 6375 | NE2 | HIS | X | 192 | −14.427 | 125.644 | −18.839 | 1.00 | 78.93 GZ00 N |
| ATOM | 6376 | N | ARG | X | 193 | −17.980 | 130.015 | −21.811 | 1.00 | 67.36 GZ00 N |
| ATOM | 6377 | CA | ARG | X | 193 | −18.945 | 130.743 | −22.627 | 1.00 | 70.06 GZ00 C |
| ATOM | 6378 | C | ARG | X | 193 | −20.261 | 129.998 | −22.711 | 1.00 | 73.81 GZ00 C |
| ATOM | 6379 | O | ARG | X | 193 | −21.329 | 130.620 | −22.671 | 1.00 | 71.37 GZ00 O |
| ATOM | 6380 | CB | ARG | X | 193 | −18.411 | 131.013 | −24.033 | 1.00 | 83.17 GZ00 C |
| ATOM | 6381 | CG | ARG | X | 193 | −17.125 | 131.815 | −24.098 | 1.00 | 91.89 GZ00 C |
| ATOM | 6382 | CD | ARG | X | 193 | −16.644 | 131.932 | −25.540 | 1.00 | 98.59 GZ00 C |
| ATOM | 6383 | NE | ARG | X | 193 | −15.566 | 132.909 | −25.682 | 1.00 | 110.88 GZ00 N |
| ATOM | 6384 | CZ | ARG | X | 193 | −14.801 | 133.031 | −26.763 | 1.00 | 111.56 GZ00 C |
| ATOM | 6385 | NH1 | ARG | X | 193 | −13.838 | 133.947 | −26.798 | 1.00 | 100.02 GZ00 N1+ |
| ATOM | 6386 | NH2 | ARG | X | 193 | −15.019 | 132.260 | −27.824 | 1.00 | 112.85 GZ00 N |
| ATOM | 6387 | N | SER | X | 194 | −20.207 | 128.670 | −22.831 | 1.00 | 80.31 GZ00 N |
| ATOM | 6388 | CA | SER | X | 194 | −21.414 | 127.865 | −22.991 | 1.00 | 74.11 GZ00 C |
| ATOM | 6389 | C | SER | X | 194 | −21.137 | 126.416 | −22.618 | 1.00 | 71.90 GZ00 C |
| ATOM | 6390 | O | SER | X | 194 | −19.991 | 125.955 | −22.604 | 1.00 | 68.02 GZ00 O |
| ATOM | 6391 | CB | SER | X | 194 | −21.945 | 127.911 | −24.425 | 1.00 | 69.53 GZ00 C |
| ATOM | 6392 | OG | SER | X | 194 | −21.159 | 127.065 | −25.246 | 1.00 | 67.74 GZ00 O |
| ATOM | 6393 | N | TYR | X | 195 | −22.224 | 125.690 | −22.382 | 1.00 | 67.26 GZ00 N |
| ATOM | 6394 | CA | TYR | X | 195 | −22.180 | 124.258 | −22.168 | 1.00 | 63.57 GZ00 C |
| ATOM | 6395 | C | TYR | X | 195 | −23.120 | 123.573 | −23.142 | 1.00 | 64.49 GZ00 C |
| ATOM | 6396 | O | TYR | X | 195 | −24.117 | 124.154 | −23.584 | 1.00 | 56.47 GZ00 O |
| ATOM | 6397 | CB | TYR | X | 195 | −22.572 | 123.889 | −20.766 | 1.00 | 57.00 GZ00 C |
| ATOM | 6398 | CG | TYR | X | 195 | −21.519 | 124.195 | −19.752 | 1.00 | 60.50 GZ00 C |
| ATOM | 6399 | CD1 | TYR | X | 195 | −21.344 | 125.486 | −19.268 | 1.00 | 63.71 GZ00 C |
| ATOM | 6400 | CD2 | TYR | X | 195 | −20.712 | 123.184 | −19.254 | 1.00 | 60.86 GZ00 C |
| ATOM | 6401 | CE1 | TYR | X | 195 | −20.383 | 125.757 | −18.319 | 1.00 | 66.00 GZ00 C |
| ATOM | 6402 | CE2 | TYR | X | 195 | −19.756 | 123.440 | −18.310 | 1.00 | 67.49 GZ00 C |
| ATOM | 6403 | CZ | TYR | X | 195 | −19.588 | 124.727 | −17.850 | 1.00 | 65.78 GZ00 C |
| ATOM | 6404 | OH | TYR | X | 195 | −18.626 | 124.963 | −16.906 | 1.00 | 71.05 GZ00 O |
| ATOM | 6405 | N | SER | X | 196 | −22.786 | 122.326 | −23.470 | 1.00 | 62.79 GZ00 N |
| ATOM | 6406 | CA | SER | X | 196 | −23.538 | 121.568 | −24.453 | 1.00 | 61.48 GZ00 C |
| ATOM | 6407 | C | SER | X | 196 | −23.826 | 120.160 | −23.952 | 1.00 | 61.15 GZ00 C |
| ATOM | 6408 | O | SER | X | 196 | −23.001 | 119.525 | −23.279 | 1.00 | 54.07 GZ00 O |
| ATOM | 6409 | CB | SER | X | 196 | −22.791 | 121.504 | −25.783 | 1.00 | 63.75 GZ00 C |
| ATOM | 6410 | OG | SER | X | 196 | −22.721 | 122.789 | −26.372 | 1.00 | 69.20 GZ00 O |
| ATOM | 6411 | N | CYS | X | 197 | −25.014 | 119.690 | −24.294 | 1.00 | 52.83 GZ00 N |
| ATOM | 6412 | CA | CYS | X | 197 | −25.428 | 118.315 | −24.085 | 1.00 | 51.91 GZ00 C |
| ATOM | 6413 | C | CYS | X | 197 | −25.524 | 117.683 | −25.463 | 1.00 | 55.35 GZ00 C |
| ATOM | 6414 | O | CYS | X | 197 | −26.303 | 118.149 | −26.305 | 1.00 | 55.75 GZ00 O |

TABLE 10.3-continued

| | | | | | | | | | | |
|---|---|---|---|---|---|---|---|---|---|---|
| ATOM | 6415 | CB | CYS | X | 197 | −26.772 | 118.256 | −23.354 | 1.00 | 51.31 GZ00 C |
| ATOM | 6416 | SG | CYS | X | 197 | −27.349 | 116.579 | −23.083 | 1.00 | 51.29 GZ00 S |
| ATOM | 6417 | N | GLN | X | 198 | −24.716 | 116.655 | −25.704 | 1.00 | 49.43 GZ00 N |
| ATOM | 6418 | CA | GLN | X | 198 | −24.668 | 115.979 | −26.996 | 1.00 | 53.99 GZ00 C |
| ATOM | 6419 | C | GLN | X | 198 | −25.193 | 114.555 | −26.839 | 1.00 | 53.90 GZ00 C |
| ATOM | 6420 | O | GLN | X | 198 | −24.579 | 113.736 | −26.139 | 1.00 | 49.13 GZ00 O |
| ATOM | 6421 | CB | GLN | X | 198 | −23.245 | 115.967 | −27.554 | 1.00 | 51.29 GZ00 C |
| ATOM | 6422 | CG | GLN | X | 198 | −22.782 | 117.315 | −28.078 | 1.00 | 67.46 GZ00 C |
| ATOM | 6423 | CD | GLN | X | 198 | −21.293 | 117.357 | −28.388 | 1.00 | 69.14 GZ00 C |
| ATOM | 6424 | OE1 | GLN | X | 198 | −20.565 | 116.404 | −28.128 | 1.00 | 72.78 GZ00 O |
| ATOM | 6425 | NE2 | GLN | X | 198 | −20.838 | 118.470 | −28.943 | 1.00 | 73.70 GZ00 N |
| ATOM | 6426 | N | VAL | X | 199 | −26.299 | 114.256 | −27.519 | 1.00 | 45.97 GZ00 N |
| ATOM | 6427 | CA | VAL | X | 199 | −26.970 | 112.961 | −27.422 | 1.00 | 47.62 GZ00 C |
| ATOM | 6428 | C | VAL | X | 199 | −26.780 | 112.222 | −28.743 | 1.00 | 49.39 GZ00 C |
| ATOM | 6429 | O | VAL | X | 199 | −27.294 | 112.648 | −29.786 | 1.00 | 43.67 GZ00 O |
| ATOM | 6430 | CB | VAL | X | 199 | −28.465 | 113.117 | −27.091 | 1.00 | 38.03 GZ00 C |
| ATOM | 6431 | CG1 | VAL | X | 199 | −29.116 | 111.753 | −26.854 | 1.00 | 36.64 GZ00 C |
| ATOM | 6432 | CG2 | VAL | X | 199 | −28.642 | 114.009 | −25.881 | 1.00 | 43.16 GZ00 C |
| ATOM | 6433 | N | THR | X | 200 | −26.069 | 111.100 | −28.699 | 1.00 | 44.37 GZ00 N |
| ATOM | 6434 | CA | THR | X | 200 | −25.870 | 110.288 | −29.888 | 1.00 | 47.13 GZ00 C |
| ATOM | 6435 | C | THR | X | 200 | −26.837 | 109.107 | −29.884 | 1.00 | 46.93 GZ00 C |
| ATOM | 6436 | O | THR | X | 200 | −26.959 | 108.389 | −28.886 | 1.00 | 37.31 GZ00 O |
| ATOM | 6437 | CB | THR | X | 200 | −24.426 | 109.819 | −29.990 | 1.00 | 47.07 GZ00 C |
| ATOM | 6438 | OG1 | THR | X | 200 | −23.583 | 110.975 | −30.046 | 1.00 | 49.61 GZ00 O |
| ATOM | 6439 | CG2 | THR | X | 200 | −24.222 | 108.955 | −31.246 | 1.00 | 48.16 GZ00 C |
| ATOM | 6440 | N | HIS | X | 201 | −27.533 | 108.936 | −31.002 | 1.00 | 40.95 GZ00 N |
| ATOM | 6441 | CA | HIS | X | 201 | −28.533 | 107.899 | −31.163 | 1.00 | 45.21 GZ00 C |
| ATOM | 6442 | C | HIS | X | 201 | −28.414 | 107.309 | −32.559 | 1.00 | 45.62 GZ00 C |
| ATOM | 6443 | O | HIS | X | 201 | −28.609 | 108.023 | −33.549 | 1.00 | 41.52 GZ00 O |
| ATOM | 6444 | CB | HIS | X | 201 | −29.928 | 108.468 | −30.953 | 1.00 | 37.81 GZ00 C |
| ATOM | 6445 | CG | HIS | X | 201 | −31.009 | 107.472 | −31.174 | 1.00 | 40.25 GZ00 C |
| ATOM | 6446 | ND1 | HIS | X | 201 | −31.717 | 107.395 | −32.354 | 1.00 | 39.48 GZ00 N |
| ATOM | 6447 | CD2 | HIS | X | 201 | −31.492 | 106.492 | −30.372 | 1.00 | 32.60 GZ00 C |
| ATOM | 6448 | CE1 | HIS | X | 201 | −32.614 | 106.425 | −32.257 | 1.00 | 41.48 GZ00 C |
| ATOM | 6449 | NE2 | HIS | X | 201 | −32.500 | 105.865 | −31.063 | 1.00 | 36.04 GZ00 N |
| ATOM | 6450 | N | GLU | X | 202 | −28.100 | 106.014 | −32.636 | 1.00 | 40.07 GZ00 N |
| ATOM | 6451 | CA | GLU | X | 202 | −27.996 | 105.307 | −33.916 | 1.00 | 39.77 GZ00 C |
| ATOM | 6452 | C | GLU | X | 202 | −27.068 | 106.042 | −34.889 | 1.00 | 44.82 GZ00 C |
| ATOM | 6453 | O | GLU | X | 202 | −27.387 | 106.247 | −36.062 | 1.00 | 40.88 GZ00 O |
| ATOM | 6454 | CB | GLU | X | 202 | −29.376 | 105.095 | −34.535 | 1.00 | 36.52 GZ00 C |
| ATOM | 6455 | CG | GLU | X | 202 | −30.307 | 104.272 | −33.669 | 1.00 | 41.95 GZ00 C |
| ATOM | 6456 | CD | GLU | X | 202 | −29.852 | 102.821 | −33.573 | 1.00 | 51.67 GZ00 C |
| ATOM | 6457 | OE1 | GLU | X | 202 | −29.603 | 102.188 | −34.631 | 1.00 | 51.18 GZ00 O |
| ATOM | 6458 | OE2 | GLU | X | 202 | −29.735 | 102.316 | −32.433 | 1.00 | 49.62 GZ00 O1− |
| ATOM | 6459 | N | GLY | X | 203 | −25.911 | 106.464 | −34.381 | 1.00 | 41.22 GZ00 N |
| ATOM | 6460 | CA | GLY | X | 203 | −24.926 | 107.146 | −35.193 | 1.00 | 42.73 GZ00 C |
| ATOM | 6461 | C | GLY | X | 203 | −25.235 | 108.578 | −35.586 | 1.00 | 47.72 GZ00 C |
| ATOM | 6462 | O | GLY | X | 203 | −24.445 | 109.169 | −36.321 | 1.00 | 53.27 GZ00 O |
| ATOM | 6463 | N | SER | X | 206 | −26.322 | 109.176 | −35.101 | 1.00 | 52.11 GZ00 N |
| ATOM | 6464 | CA | SER | X | 206 | −26.642 | 110.577 | −35.375 | 1.00 | 50.86 GZ00 C |
| ATOM | 6465 | C | SER | X | 206 | −26.773 | 111.328 | −34.056 | 1.00 | 52.21 GZ00 C |
| ATOM | 6466 | O | SER | X | 206 | −27.448 | 110.853 | −33.136 | 1.00 | 52.48 GZ00 O |
| ATOM | 6467 | CB | SER | X | 206 | −27.944 | 110.707 | −36.167 | 1.00 | 47.57 GZ00 C |
| ATOM | 6468 | OG | SER | X | 206 | −27.838 | 110.125 | −37.454 | 1.00 | 59.00 GZ00 O |
| ATOM | 6469 | N | THR | X | 207 | −26.128 | 112.488 | −33.953 | 1.00 | 50.76 GZ00 N |
| ATOM | 6470 | CA | THR | X | 207 | −26.108 | 113.241 | −32.704 | 1.00 | 55.87 GZ00 C |
| ATOM | 6471 | C | THR | X | 207 | −27.025 | 114.462 | −32.764 | 1.00 | 57.12 GZ00 C |
| ATOM | 6472 | O | THR | X | 207 | −27.074 | 115.180 | −33.767 | 1.00 | 57.64 GZ00 O |
| ATOM | 6473 | CB | THR | X | 207 | −24.696 | 113.690 | −32.344 | 1.00 | 48.26 GZ00 C |
| ATOM | 6474 | OG1 | THR | X | 207 | −24.359 | 114.813 | −33.157 | 1.00 | 73.99 GZ00 O |
| ATOM | 6475 | CG2 | THR | X | 207 | −23.702 | 112.580 | −32.600 | 1.00 | 47.46 GZ00 C |
| ATOM | 6476 | N | VAL | X | 208 | −27.777 | 114.659 | −31.690 | 1.00 | 49.79 GZ00 N |
| ATOM | 6477 | CA | VAL | X | 208 | −28.598 | 115.842 | −31.472 | 1.00 | 52.71 GZ00 C |
| ATOM | 6478 | C | VAL | X | 208 | −27.951 | 116.636 | −30.343 | 1.00 | 55.59 GZ00 C |
| ATOM | 6479 | O | VAL | X | 208 | −27.557 | 116.063 | −29.317 | 1.00 | 52.08 GZ00 O |
| ATOM | 6480 | CB | VAL | X | 208 | −30.047 | 115.452 | −31.131 | 1.00 | 51.79 GZ00 C |
| ATOM | 6481 | CG1 | VAL | X | 208 | −30.880 | 116.672 | −30.802 | 1.00 | 49.77 GZ00 C |
| ATOM | 6482 | CG2 | VAL | X | 208 | −30.666 | 114.651 | −32.276 | 1.00 | 48.08 GZ00 C |
| ATOM | 6483 | N | GLU | X | 209 | −27.787 | 117.939 | −30.547 | 1.00 | 56.25 GZ00 N |
| ATOM | 6484 | CA | GLU | X | 209 | −27.107 | 118.778 | −29.571 | 1.00 | 56.90 GZ00 C |
| ATOM | 6485 | C | GLU | X | 209 | −27.976 | 119.957 | −29.174 | 1.00 | 58.39 GZ00 C |
| ATOM | 6486 | O | GLU | X | 209 | −28.692 | 120.525 | −30.005 | 1.00 | 55.14 GZ00 O |
| ATOM | 6487 | CB | GLU | X | 209 | −25.772 | 119.293 | −30.087 | 1.00 | 57.63 GZ00 C |
| ATOM | 6488 | CG | GLU | X | 209 | −25.088 | 120.229 | −29.113 | 1.00 | 64.92 GZ00 C |
| ATOM | 6489 | CD | GLU | X | 209 | −23.766 | 120.754 | −29.630 | 1.00 | 76.32 GZ00 C |
| ATOM | 6490 | OE1 | GLU | X | 209 | −22.869 | 119.942 | −29.932 | 1.00 | 78.95 GZ00 O |
| ATOM | 6491 | OE2 | GLU | X | 209 | −23.636 | 121.986 | −29.766 | 1.00 | 85.57 GZ00 O1− |
| ATOM | 6492 | N | LYS | X | 210 | −27.935 | 120.282 | −27.886 | 1.00 | 62.74 GZ00 N |
| ATOM | 6493 | CA | LYS | X | 210 | −28.467 | 121.522 | −27.345 | 1.00 | 53.79 GZ00 C |
| ATOM | 6494 | C | LYS | X | 210 | −27.379 | 122.171 | −26.505 | 1.00 | 56.56 GZ00 C |

TABLE 10.3-continued

| | | | | | | | | | | |
|---|---|---|---|---|---|---|---|---|---|---|
| ATOM | 6495 | O | LYS | X | 210 | −26.616 | 121.476 | −25.823 | 1.00 | 56.28 | GZ00 O |
| ATOM | 6496 | CB | LYS | X | 210 | −29.711 | 121.279 | −26.513 | 1.00 | 53.44 | GZ00 C |
| ATOM | 6497 | CG | LYS | X | 210 | −30.907 | 120.841 | −27.324 | 1.00 | 54.02 | GZ00 C |
| ATOM | 6498 | CD | LYS | X | 210 | −31.098 | 121.748 | −28.509 | 1.00 | 54.29 | GZ00 C |
| ATOM | 6499 | CE | LYS | X | 210 | −32.343 | 121.367 | −29.282 | 1.00 | 55.10 | GZ00 C |
| ATOM | 6500 | NZ | LYS | X | 210 | −33.545 | 121.832 | −28.528 | 1.00 | 61.72 | GZ00 N1+ |
| ATOM | 6501 | N | THR | X | 211 | −27.270 | 123.498 | −26.592 | 1.00 | 59.32 | GZ00 N |
| ATOM | 6502 | CA | THR | X | 211 | −26.267 | 124.229 | −25.828 | 1.00 | 59.32 | GZ00 C |
| ATOM | 6503 | C | THR | X | 211 | −26.946 | 125.341 | −25.039 | 1.00 | 55.85 | GZ00 C |
| ATOM | 6504 | O | THR | X | 211 | −27.984 | 125.869 | −25.443 | 1.00 | 52.37 | GZ00 O |
| ATOM | 6505 | CB | THR | X | 211 | −25.177 | 124.830 | −26.725 | 1.00 | 59.58 | GZ00 C |
| ATOM | 6506 | OG1 | THR | X | 211 | −25.586 | 126.134 | −27.141 | 1.00 | 68.27 | GZ00 O |
| ATOM | 6507 | CG2 | THR | X | 211 | −24.975 | 123.970 | −27.975 | 1.00 | 57.88 | GZ00 C |
| ATOM | 6508 | N | VAL | X | 212 | −26.348 | 125.706 | −23.911 | 1.00 | 52.69 | GZ00 N |
| ATOM | 6509 | CA | VAL | X | 212 | −26.936 | 126.709 | −23.035 | 1.00 | 63.41 | GZ00 C |
| ATOM | 6510 | C | VAL | X | 212 | −25.825 | 127.640 | −22.548 | 1.00 | 67.46 | GZ00 C |
| ATOM | 6511 | O | VAL | X | 212 | −24.665 | 127.233 | −22.408 | 1.00 | 65.23 | GZ00 O |
| ATOM | 6512 | CB | VAL | X | 212 | −27.702 | 126.029 | −21.866 | 1.00 | 57.88 | GZ00 C |
| ATOM | 6513 | CG1 | VAL | X | 212 | −26.783 | 125.712 | −20.700 | 1.00 | 44.64 | GZ00 C |
| ATOM | 6514 | CG2 | VAL | X | 212 | −28.897 | 126.846 | −21.442 | 1.00 | 65.99 | GZ00 C |
| ATOM | 6515 | N | ALA | X | 213 | −26.174 | 128.916 | −22.332 | 1.00 | 65.82 | GZ00 N |
| ATOM | 6516 | CA | ALA | X | 213 | −25.166 | 129.919 | −21.988 | 1.00 | 71.28 | GZ00 C |
| ATOM | 6517 | C | ALA | X | 213 | −25.503 | 130.667 | −20.702 | 1.00 | 73.86 | GZ00 C |
| ATOM | 6518 | O | ALA | X | 213 | −26.677 | 130.982 | −20.445 | 1.00 | 75.77 | GZ00 O |
| ATOM | 6519 | CB | ALA | X | 213 | −25.003 | 130.928 | −23.133 | 1.00 | 69.34 | GZ00 C |
| ATOM | 6520 | N | PRO | X | 214 | −24.486 | 130.994 | −19.889 | 1.00 | 70.92 | GZ00 N |
| ATOM | 6521 | CA | PRO | X | 214 | −24.746 | 131.692 | −18.614 | 1.00 | 72.76 | GZ00 C |
| ATOM | 6522 | C | PRO | X | 214 | −25.314 | 133.090 | −18.773 | 1.00 | 82.62 | GZ00 C |
| ATOM | 6523 | O | PRO | X | 214 | −25.933 | 133.596 | −17.827 | 1.00 | 89.01 | GZ00 O |
| ATOM | 6524 | CB | PRO | X | 214 | −23.366 | 131.732 | −17.943 | 1.00 | 66.71 | GZ00 C |
| ATOM | 6525 | CG | PRO | X | 214 | −22.637 | 130.585 | −18.525 | 1.00 | 65.72 | GZ00 C |
| ATOM | 6526 | CD | PRO | X | 214 | −23.119 | 130.445 | −19.944 | 1.00 | 70.60 | GZ00 C |
| ATOM | 6527 | N | THR | X | 215 | −25.149 | 133.725 | −19.928 | 1.00 | 84.77 | GZ00 N |
| ATOM | 6528 | CA | THR | X | 215 | −25.832 | 134.986 | −20.202 | 1.00 | 96.30 | GZ00 C |
| ATOM | 6529 | C | THR | X | 215 | −27.332 | 134.702 | −20.252 | 1.00 | 95.28 | GZ00 C |
| ATOM | 6530 | O | THR | X | 215 | −27.859 | 134.231 | −21.265 | 1.00 | 91.48 | GZ00 O |
| ATOM | 6531 | CB | THR | X | 215 | −25.328 | 135.593 | −21.510 | 1.00 | 97.14 | GZ00 C |
| ATOM | 6532 | OG1 | THR | X | 215 | −25.743 | 134.773 | −22.612 | 1.00 | 87.67 | GZ00 O |
| ATOM | 6533 | CG2 | THR | X | 215 | −23.793 | 135.691 | −21.507 | 1.00 | 90.01 | GZ00 C |
| ATOM | 6534 | N | GLU | X | 216 | −28.027 | 134.994 | −19.152 | 1.00 | 96.06 | GZ00 N |
| ATOM | 6535 | CA | GLU | X | 216 | −29.446 | 134.662 | −19.010 | 1.00 | 98.88 | GZ00 C |
| ATOM | 6536 | C | GLU | X | 216 | −30.325 | 135.917 | −18.923 | 1.00 | 99.86 | GZ00 C |
| ATOM | 6537 | O | GLU | X | 216 | −31.553 | 135.830 | −18.821 | 1.00 | 94.58 | GZ00 O |
| ATOM | 6538 | CB | GLU | X | 216 | −29.662 | 133.791 | −17.762 | 1.00 | 104.37 | GZ00 C |
| ATOM | 6539 | CG | GLU | X | 216 | −29.007 | 132.394 | −17.811 | 1.00 | 103.51 | GZ00 C |
| ATOM | 6540 | CD | GLU | X | 216 | −29.281 | 131.561 | −16.556 | 1.00 | 100.31 | GZ00 C |
| ATOM | 6541 | OE1 | GLU | X | 216 | −30.463 | 131.201 | −16.329 | 1.00 | 98.05 | GZ00 O |
| ATOM | 6542 | OE2 | GLU | X | 216 | −28.323 | 131.288 | −15.788 | 1.00 | 94.94 | GZ00 O1− |
| TER | | | | | | | | | | | |
| ATOM | 6543 | N | THR | E | 152 | −7.503 | 113.907 | 0.585 | 1.00 | 78.03 | B000 N |
| ATOM | 6544 | CA | THR | E | 152 | −7.804 | 113.632 | 1.990 | 1.00 | 91.98 | B000 C |
| ATOM | 6545 | C | THR | E | 152 | −6.989 | 112.446 | 2.537 | 1.00 | 87.18 | B000 C |
| ATOM | 6546 | O | THR | E | 152 | −5.914 | 112.642 | 3.113 | 1.00 | 87.17 | B000 O |
| ATOM | 6547 | CB | THR | E | 152 | −9.331 | 113.377 | 2.199 | 1.00 | 99.46 | B000 C |
| ATOM | 6548 | OG1 | THR | E | 152 | −9.547 | 112.614 | 3.396 | 1.00 | 103.56 | B000 O |
| ATOM | 6549 | CG2 | THR | E | 152 | −9.959 | 112.661 | 0.997 | 1.00 | 88.04 | B000 C |
| ATOM | 6550 | N | CYS | E | 153 | −7.511 | 111.230 | 2.378 | 1.00 | 83.15 | B000 N |
| ATOM | 6551 | CA | CYS | E | 153 | −6.804 | 109.997 | 2.699 | 1.00 | 86.88 | B000 C |
| ATOM | 6552 | C | CYS | E | 153 | −6.722 | 109.106 | 1.463 | 1.00 | 80.76 | B000 C |
| ATOM | 6553 | O | CYS | E | 153 | −7.463 | 109.278 | 0.486 | 1.00 | 71.27 | B000 O |
| ATOM | 6554 | CB | CYS | E | 153 | −7.471 | 109.227 | 3.860 | 1.00 | 86.61 | B000 C |
| ATOM | 6555 | SG | CYS | E | 153 | −6.738 | 109.471 | 5.513 | 1.00 | 90.81 | B000 S |
| ATOM | 6556 | N | CYS | E | 154 | −5.817 | 108.133 | 1.525 | 1.00 | 72.71 | B000 N |
| ATOM | 6557 | CA | CYS | E | 154 | −5.632 | 107.218 | 0.411 | 1.00 | 64.86 | B000 C |
| ATOM | 6558 | C | CYS | E | 154 | −6.850 | 106.311 | 0.243 | 1.00 | 66.48 | B000 C |
| ATOM | 6559 | O | CYS | E | 154 | −7.564 | 106.023 | 1.210 | 1.00 | 66.73 | B000 O |
| ATOM | 6560 | CB | CYS | E | 154 | −4.385 | 106.373 | 0.626 | 1.00 | 57.69 | B000 C |
| ATOM | 6561 | SG | CYS | E | 154 | −2.833 | 107.296 | 0.371 | 1.00 | 72.69 | B000 S |
| ATOM | 6562 | N | PRO | E | 155 | −7.115 | 105.854 | −0.978 | 1.00 | 56.60 | B000 N |
| ATOM | 6563 | CA | PRO | E | 155 | −8.220 | 104.914 | −1.192 | 1.00 | 57.19 | B000 C |
| ATOM | 6564 | C | PRO | E | 155 | −8.052 | 103.661 | −0.345 | 1.00 | 62.02 | B000 C |
| ATOM | 6565 | O | PRO | E | 155 | −7.012 | 103.404 | 0.267 | 1.00 | 60.28 | B000 O |
| ATOM | 6566 | CB | PRO | E | 155 | −8.143 | 104.589 | −2.687 | 1.00 | 52.85 | B000 C |
| ATOM | 6567 | CG | PRO | E | 155 | −7.332 | 105.677 | −3.277 | 1.00 | 56.95 | B000 C |
| ATOM | 6568 | CO | PRO | E | 155 | −6.392 | 106.158 | −2.220 | 1.00 | 54.57 | B000 C |
| ATOM | 6569 | N | VAL | E | 156 | −9.123 | 102.871 | −0.306 | 1.00 | 64.34 | B000 N |
| ATOM | 6570 | CA | VAL | E | 156 | −9.121 | 101.644 | 0.477 | 1.00 | 62.48 | B000 C |
| ATOM | 6571 | C | VAL | E | 156 | −8.013 | 100.726 | −0.021 | 1.00 | 57.31 | B000 C |
| ATOM | 6572 | O | VAL | E | 156 | −7.843 | 100.536 | −1.235 | 1.00 | 55.79 | B000 O |
| ATOM | 6573 | CB | VAL | E | 156 | −10.498 | 100.968 | 0.373 | 1.00 | 58.69 | B000 C |

TABLE 10.3-continued

| ATOM | 6574 | CG1 | VAL | E | 156 | -10.628 | 99.853 | 1.400 | 1.00 | 62.99 | B000 | C |
|---|---|---|---|---|---|---|---|---|---|---|---|---|
| ATOM | 6575 | CG2 | VAL | E | 156 | -11.612 | 102.013 | 0.508 | 1.00 | 72.16 | B000 | C |
| ATOM | 6576 | N | ASN | E | 157 | -7.244 | 100.163 | 0.915 | 1.00 | 49.37 | B000 | N |
| ATOM | 6577 | CA | ASN | E | 157 | -6.142 | 99.218 | 0.687 | 1.00 | 55.22 | B000 | C |
| ATOM | 6578 | C | ASN | E | 157 | -4.871 | 99.882 | 0.162 | 1.00 | 52.64 | B000 | C |
| ATOM | 6579 | O | ASN | E | 157 | -3.871 | 99.180 | -0.036 | 1.00 | 49.46 | B000 | O |
| ATOM | 6580 | CB | ASN | E | 157 | -6.513 | 98.075 | -0.276 | 1.00 | 51.75 | B000 | C |
| ATOM | 6581 | CG | ASN | E | 157 | -7.713 | 97.282 | 0.202 | 1.00 | 58.73 | B000 | C |
| ATOM | 6582 | OD1 | ASN | E | 157 | -7.839 | 97.001 | 1.392 | 1.00 | 60.67 | B000 | O |
| ATOM | 6583 | ND2 | ASN | E | 157 | -8.609 | 96.935 | -0.720 | 1.00 | 58.30 | B000 | N |
| ATOM | 6584 | N | TRP | E | 158 | -4.868 | 101.187 | -0.082 | 1.00 | 49.22 | B000 | N |
| ATOM | 6585 | CA | TRP | E | 158 | -3.644 | 101.885 | -0.433 | 1.00 | 45.78 | B000 | C |
| ATOM | 6586 | C | TRP | E | 158 | -2.983 | 102.464 | 0.818 | 1.00 | 47.63 | B000 | C |
| ATOM | 6587 | O | TRP | E | 158 | -3.618 | 102.655 | 1.855 | 1.00 | 53.96 | B000 | O |
| ATOM | 6588 | CB | TRP | E | 158 | -3.933 | 102.979 | -1.453 | 1.00 | 48.76 | B000 | C |
| ATOM | 6589 | CG | TRP | E | 158 | -4.381 | 102.473 | -2.793 | 1.00 | 40.31 | B000 | C |
| ATOM | 6590 | CD1 | TRP | E | 158 | -5.498 | 101.731 | -3.072 | 1.00 | 46.46 | B000 | C |
| ATOM | 6591 | CD2 | TRP | E | 158 | -3.718 | 102.683 | -4.043 | 1.00 | 35.79 | B000 | C |
| ATOM | 6592 | NE1 | TRP | E | 158 | -5.573 | 101.465 | -4.432 | 1.00 | 39.86 | B000 | N |
| ATOM | 6593 | CE2 | TRP | E | 158 | -4.495 | 102.050 | -5.047 | 1.00 | 45.74 | B000 | C |
| ATOM | 6594 | CE3 | TRP | E | 158 | -2.548 | 103.355 | -4.417 | 1.00 | 40.22 | B000 | C |
| ATOM | 6595 | CZ2 | TRP | E | 158 | -4.132 | 102.067 | -6.395 | 1.00 | 41.97 | B000 | C |
| ATOM | 6596 | CZ3 | TRP | E | 158 | -2.193 | 103.378 | -5.764 | 1.00 | 41.46 | B000 | C |
| ATOM | 6597 | CH2 | TRP | E | 158 | -2.980 | 102.727 | -6.732 | 1.00 | 40.39 | B000 | C |
| ATOM | 6598 | N | VAL | E | 159 | -1.689 | 102.734 | 0.702 | 1.00 | 44.22 | B000 | N |
| ATOM | 6599 | CA | VAL | E | 159 | -0.837 | 103.172 | 1.800 | 1.00 | 48.43 | B000 | C |
| ATOM | 6600 | C | VAL | E | 159 | -0.297 | 104.558 | 1.461 | 1.00 | 58.07 | B000 | C |
| ATOM | 6601 | O | VAL | E | 159 | 0.103 | 104.818 | 0.318 | 1.00 | 55.09 | B000 | O |
| ATOM | 6602 | CB | VAL | E | 159 | 0.330 | 102.189 | 2.039 | 1.00 | 52.63 | B000 | C |
| ATOM | 6603 | CG1 | VAL | E | 159 | 1.251 | 102.704 | 3.126 | 1.00 | 54.92 | B000 | C |
| ATOM | 6604 | CG2 | VAL | E | 159 | -0.184 | 100.818 | 2.407 | 1.00 | 53.05 | B000 | C |
| ATOM | 6605 | N | GLU | E | 160 | -0.275 | 105.443 | 2.456 | 1.00 | 57.15 | B000 | N |
| ATOM | 6606 | CA | GLU | E | 160 | 0.120 | 106.833 | 2.256 | 1.00 | 59.51 | B000 | C |
| ATOM | 6607 | C | GLU | E | 160 | 1.577 | 107.054 | 2.654 | 1.00 | 55.30 | B000 | C |
| ATOM | 6608 | O | GLU | E | 160 | 2.043 | 106.531 | 3.673 | 1.00 | 50.50 | B000 | O |
| ATOM | 6609 | CB | GLU | E | 160 | -0.809 | 107.756 | 3.046 | 1.00 | 51.43 | B000 | C |
| ATOM | 6610 | CG | GLU | E | 160 | -0.440 | 109.219 | 3.035 | 1.00 | 65.54 | B000 | C |
| ATOM | 6611 | CD | GLU | E | 160 | -1.336 | 110.058 | 3.952 | 1.00 | 77.96 | B000 | C |
| ATOM | 6612 | OE1 | GLU | E | 160 | -2.418 | 109.568 | 4.357 | 1.00 | 79.30 | B000 | O |
| ATOM | 6613 | OE2 | GLU | E | 160 | -0.951 | 111.203 | 4.281 | 1.00 | 75.66 | B000 | O1- |
| ATOM | 6614 | N | HIS | E | 161 | 2.304 | 107.801 | 1.822 | 1.00 | 53.62 | B000 | N |
| ATOM | 6615 | CA | HIS | E | 161 | 3.658 | 108.222 | 2.177 | 1.00 | 53.50 | B000 | C |
| ATOM | 6616 | C | HIS | E | 161 | 4.013 | 109.474 | 1.393 | 1.00 | 61.66 | B000 | C |
| ATOM | 6617 | O | HIS | E | 161 | 3.896 | 109.472 | 0.159 | 1.00 | 55.60 | B000 | O |
| ATOM | 6618 | CB | HIS | E | 161 | 4.656 | 107.120 | 1.884 | 1.00 | 50.97 | B000 | C |
| ATOM | 6619 | CG | HIS | E | 161 | 6.076 | 107.514 | 2.135 | 1.00 | 58.56 | B000 | C |
| ATOM | 6620 | ND1 | HIS | E | 161 | 6.845 | 108.173 | 1.196 | 1.00 | 62.19 | B000 | N |
| ATOM | 6621 | CD2 | HIS | E | 161 | 6.877 | 107.322 | 3.213 | 1.00 | 53.33 | B000 | C |
| ATOM | 6622 | CE1 | HIS | E | 161 | 8.056 | 108.376 | 1.687 | 1.00 | 63.04 | B000 | C |
| ATOM | 6623 | NE2 | HIS | E | 161 | 8.102 | 107.869 | 2.909 | 1.00 | 61.41 | B000 | N |
| ATOM | 6624 | N | GLU | E | 162 | 4.410 | 110.541 | 2.112 | 1.00 | 61.25 | B000 | N |
| ATOM | 6625 | CA | GLU | E | 162 | 4.767 | 111.850 | 1.561 | 1.00 | 55.02 | B000 | C |
| ATOM | 6626 | C | GLU | E | 162 | 3.975 | 112.247 | 0.322 | 1.00 | 62.64 | B000 | C |
| ATOM | 6627 | O | GLU | E | 162 | 4.537 | 112.301 | -0.778 | 1.00 | 75.86 | B000 | O |
| ATOM | 6628 | CB | GLU | E | 162 | 6.267 | 111.936 | 1.225 | 1.00 | 60.44 | B000 | C |
| ATOM | 6629 | CG | GLU | E | 162 | 7.223 | 111.633 | 2.366 | 1.00 | 61.24 | B000 | C |
| ATOM | 6630 | CD | GLU | E | 162 | 8.697 | 111.610 | 1.933 | 1.00 | 86.98 | B000 | C |
| ATOM | 6631 | OE1 | GLU | E | 162 | 9.025 | 111.099 | 0.822 | 1.00 | 83.67 | B000 | O |
| ATOM | 6632 | OE2 | GLU | E | 162 | 9.538 | 112.097 | 2.725 | 1.00 | 95.90 | B000 | O1- |
| ATOM | 6633 | N | ARG | E | 163 | 2.679 | 112.496 | 0.469 | 1.00 | 55.87 | B000 | N |
| ATOM | 6634 | CA | ARG | E | 163 | 1.819 | 113.000 | -0.602 | 1.00 | 76.66 | B000 | C |
| ATOM | 6635 | C | ARG | E | 163 | 1.554 | 112.012 | -1.738 | 1.00 | 68.88 | B000 | C |
| ATOM | 6636 | O | ARG | E | 163 | 0.922 | 112.388 | -2.739 | 1.00 | 65.44 | B000 | O |
| ATOM | 6637 | CB | ARG | E | 163 | 2.398 | 114.288 | -1.215 | 1.00 | 89.70 | B000 | C |
| ATOM | 6638 | CG | ARG | E | 163 | 2.928 | 115.328 | -0.208 | 1.00 | 98.04 | B000 | C |
| ATOM | 6639 | CD | ARG | E | 163 | 3.983 | 116.257 | -0.835 | 1.00 | 106.40 | B000 | C |
| ATOM | 6640 | NE | ARG | E | 163 | 3.452 | 117.044 | -1.950 | 1.00 | 124.58 | B000 | N |
| ATOM | 6641 | CZ | ARG | E | 163 | 3.588 | 116.723 | -3.236 | 1.00 | 120.88 | B000 | C |
| ATOM | 6642 | NH1 | ARG | E | 163 | 4.245 | 115.622 | -3.585 | 1.00 | 111.66 | B000 | N1+ |
| ATOM | 6643 | NH2 | ARG | E | 163 | 3.063 | 117.503 | -4.176 | 1.00 | 118.93 | B000 | N |
| ATOM | 6644 | N | SER | E | 164 | 1.973 | 110.758 | -1.622 | 1.00 | 63.49 | B000 | N |
| ATOM | 6645 | CA | SER | E | 164 | 1.606 | 109.768 | -2.620 | 1.00 | 57.22 | B000 | C |
| ATOM | 6646 | C | SER | E | 164 | 0.888 | 108.601 | -1.952 | 1.00 | 52.22 | B000 | C |
| ATOM | 6647 | O | SER | E | 164 | 1.071 | 108.329 | -0.761 | 1.00 | 49.98 | B000 | O |
| ATOM | 6648 | CB | SER | E | 164 | 2.823 | 109.290 | -3.411 | 1.00 | 56.71 | B000 | C |
| ATOM | 6649 | OG | SER | E | 164 | 3.161 | 110.233 | -4.411 | 1.00 | 65.04 | B000 | O |
| ATOM | 6650 | N | CYS | E | 165 | 0.066 | 107.913 | -2.740 | 1.00 | 50.88 | B000 | N |
| ATOM | 6651 | CA | CYS | E | 165 | -0.614 | 106.691 | -2.322 | 1.00 | 53.42 | B000 | C |
| ATOM | 6652 | C | CYS | E | 165 | -0.042 | 105.497 | -3.076 | 1.00 | 50.12 | B000 | C |
| ATOM | 6653 | O | CYS | E | 165 | 0.124 | 105.555 | -4.300 | 1.00 | 46.54 | B000 | O |

TABLE 10.3-continued

| | | | | | | | | | | |
|---|---|---|---|---|---|---|---|---|---|---|
| ATOM | 6654 | CB | CYS | E | 165 | −2.118 | 106.793 | −2.576 | 1.00 | 56.64 B000 C |
| ATOM | 6655 | SG | CYS | E | 165 | −2.945 | 108.028 | −1.541 | 1.00 | 67.86 B000 S |
| ATOM | 6656 | N | TYR | E | 166 | 0.226 | 104.410 | −2.350 | 1.00 | 52.80 B000 N |
| ATOM | 6657 | CA | TYR | E | 166 | 0.904 | 103.231 | −2.882 | 1.00 | 48.23 B000 C |
| ATOM | 6658 | C | TYR | E | 166 | 0.064 | 101.984 | −2.650 | 1.00 | 48.96 B000 C |
| ATOM | 6659 | O | TYR | E | 166 | −0.538 | 101.821 | −1.584 | 1.00 | 46.07 B000 O |
| ATOM | 6660 | CB | TYR | E | 166 | 2.265 | 103.033 | −2.222 | 1.00 | 45.49 B000 C |
| ATOM | 6661 | CG | TYR | E | 166 | 3.196 | 104.186 | −2.406 | 1.00 | 51.14 B000 C |
| ATOM | 6662 | CD1 | TYR | E | 166 | 3.000 | 105.382 | −1.709 | 1.00 | 50.78 B000 C |
| ATOM | 6663 | CD2 | TYR | E | 166 | 4.296 | 104.081 | −3.249 | 1.00 | 49.21 B000 C |
| ATOM | 6664 | CE1 | TYR | E | 166 | 3.859 | 106.442 | −1.867 | 1.00 | 52.01 B000 C |
| ATOM | 6665 | CE2 | TYR | E | 166 | 5.175 | 105.138 | −3.408 | 1.00 | 52.82 B000 C |
| ATOM | 6666 | CZ | TYR | E | 166 | 4.954 | 106.317 | −2.714 | 1.00 | 56.72 B000 C |
| ATOM | 6667 | OH | TYR | E | 166 | 5.829 | 107.368 | −2.874 | 1.00 | 55.75 B000 O |
| ATOM | 6668 | N | TRP | E | 167 | 0.064 | 101.085 | −3.634 | 1.00 | 43.75 B000 N |
| ATOM | 6669 | CA | TRP | E | 167 | −0.639 | 99.813 | −3.539 | 1.00 | 41.16 B000 C |
| ATOM | 6670 | C | TRP | E | 167 | 0.346 | 98.684 | −3.794 | 1.00 | 42.24 B000 C |
| ATOM | 6671 | O | TRP | E | 167 | 1.054 | 98.693 | −4.804 | 1.00 | 37.42 B000 O |
| ATOM | 6672 | CB | TRP | E | 167 | −1.804 | 99.743 | −4.530 | 1.00 | 42.53 B000 C |
| ATOM | 6673 | CG | TRP | E | 167 | −2.599 | 98.467 | −4.395 | 1.00 | 46.44 B000 C |
| ATOM | 6674 | CD1 | TRP | E | 167 | −3.662 | 98.242 | −3.560 | 1.00 | 49.81 B000 C |
| ATOM | 6675 | CD2 | TRP | E | 167 | −2.395 | 97.251 | −5.116 | 1.00 | 43.13 B000 C |
| ATOM | 6676 | NE1 | TRP | E | 167 | −4.114 | 96.955 | −3.706 | 1.00 | 51.07 B000 N |
| ATOM | 6677 | CE2 | TRP | E | 167 | −3.366 | 96.330 | −4.665 | 1.00 | 46.50 B000 C |
| ATOM | 6678 | CE3 | TRP | E | 167 | −1.491 | 96.852 | −6.103 | 1.00 | 40.37 B000 C |
| ATOM | 6679 | CZ2 | TRP | E | 167 | −3.455 | 95.041 | −5.165 | 1.00 | 36.86 B000 C |
| ATOM | 6680 | CZ3 | TRP | E | 167 | −1.587 | 95.579 | −6.604 | 1.00 | 39.69 B000 C |
| ATOM | 6681 | CH2 | TRP | E | 167 | −2.554 | 94.682 | −6.133 | 1.00 | 42.15 B000 C |
| ATOM | 6682 | N | PHE | E | 168 | 0.377 | 97.709 | −2.891 | 1.00 | 42.39 B000 N |
| ATOM | 6683 | CA | PHE | E | 168 | 1.369 | 96.645 | −2.921 | 1.00 | 39.44 B000 C |
| ATOM | 6684 | C | PHE | E | 168 | 0.718 | 95.320 | −3.300 | 1.00 | 41.71 B000 C |
| ATOM | 6685 | O | PHE | E | 168 | −0.056 | 94.762 | −2.515 | 1.00 | 39.56 B000 O |
| ATOM | 6686 | CB | PHE | E | 168 | 2.054 | 96.539 | −1.567 | 1.00 | 33.24 B000 C |
| ATOM | 6687 | CG | PHE | E | 168 | 2.834 | 97.745 | −1.209 | 1.00 | 45.15 B000 C |
| ATOM | 6688 | CD1 | PHE | E | 168 | 4.165 | 97.858 | −1.603 | 1.00 | 43.49 B000 C |
| ATOM | 6689 | CD2 | PHE | E | 168 | 2.251 | 98.776 | −0.472 | 1.00 | 43.18 B000 C |
| ATOM | 6690 | CE1 | PHE | E | 168 | 4.917 | 98.991 | −1.279 | 1.00 | 48.63 B000 C |
| ATOM | 6691 | CE2 | PHE | E | 168 | 2.986 | 99.913 | −0.135 | 1.00 | 49.01 B000 C |
| ATOM | 6692 | CZ | PHE | E | 168 | 4.326 | 100.026 | −0.541 | 1.00 | 48.19 B000 C |
| ATOM | 6693 | N | SER | E | 169 | 1.081 | 94.788 | −4.469 | 1.00 | 34.62 B000 N |
| ATOM | 6694 | CA | SER | E | 169 | 0.586 | 93.478 | −4.863 | 1.00 | 37.57 B000 C |
| ATOM | 6695 | C | SER | E | 169 | 1.143 | 92.402 | −3.936 | 1.00 | 34.54 B000 C |
| ATOM | 6696 | O | SER | E | 169 | 2.169 | 92.574 | −3.280 | 1.00 | 36.05 B000 O |
| ATOM | 6697 | CB | SER | E | 169 | 0.978 | 93.141 | −6.308 | 1.00 | 33.43 B000 C |
| ATOM | 6698 | OG | SER | E | 169 | 2.306 | 92.629 | −6.362 | 1.00 | 34.63 B000 O |
| ATOM | 6699 | N | ARG | E | 170 | 0.449 | 91.272 | −3.899 | 1.00 | 35.37 B000 N |
| ATOM | 6700 | CA | ARG | E | 170 | 0.918 | 90.093 | −3.184 | 1.00 | 37.90 B000 C |
| ATOM | 6701 | C | ARG | E | 170 | 0.997 | 88.896 | −4.131 | 1.00 | 35.62 B000 C |
| ATOM | 6702 | O | ARG | E | 170 | 0.924 | 87.742 | −3.715 | 1.00 | 37.12 B000 O |
| ATOM | 6703 | CB | ARG | E | 170 | 0.028 | 89.827 | −1.967 | 1.00 | 36.19 B000 C |
| ATOM | 6704 | CG | ARG | E | 170 | 0.216 | 90.900 | −0.870 | 1.00 | 40.70 B000 C |
| ATOM | 6705 | CD | ARG | E | 170 | −0.749 | 90.780 | 0.304 | 1.00 | 45.71 B000 C |
| ATOM | 6706 | NE | ARG | E | 170 | −2.082 | 91.308 | −0.011 | 1.00 | 51.47 B000 N |
| ATOM | 6707 | CZ | ARG | E | 170 | −3.156 | 91.221 | 0.782 | 1.00 | 53.18 B000 C |
| ATOM | 6708 | NH1 | ARG | E | 170 | −3.089 | 90.606 | 1.963 | 1.00 | 52.87 B000 N1+ |
| ATOM | 6709 | NH2 | ARG | E | 170 | −4.315 | 91.737 | 0.384 | 1.00 | 52.00 B000 N |
| ATOM | 6710 | N | SER | E | 171 | 1.194 | 89.177 | −5.414 | 1.00 | 34.01 B000 N |
| ATOM | 6711 | CA | SER | E | 171 | 1.334 | 88.153 | −6.435 | 1.00 | 37.47 B000 C |
| ATOM | 6712 | C | SER | E | 171 | 2.092 | 88.761 | −7.607 | 1.00 | 36.87 B000 C |
| ATOM | 6713 | O | SER | E | 171 | 2.269 | 89.978 | −7.692 | 1.00 | 35.85 B000 O |
| ATOM | 6714 | CB | SER | E | 171 | −0.030 | 87.625 | −6.873 | 1.00 | 33.20 B000 C |
| ATOM | 6715 | OG | SER | E | 171 | −0.796 | 88.688 | −7.418 | 1.00 | 38.78 B000 O |
| ATOM | 6716 | N | GLY | E | 172 | 2.519 | 87.895 | −8.521 | 1.00 | 30.60 B000 N |
| ATOM | 6717 | CA | GLY | E | 172 | 3.411 | 88.281 | −9.590 | 1.00 | 32.88 B000 C |
| ATOM | 6718 | C | GLY | E | 172 | 2.710 | 88.558 | −10.905 | 1.00 | 33.42 B000 C |
| ATOM | 6719 | O | GLY | E | 172 | 1.628 | 88.050 | −11.168 | 1.00 | 38.97 B000 O |
| ATOM | 6720 | N | LYS | E | 173 | 3.360 | 89.389 | −11.723 | 1.00 | 34.61 B000 N |
| ATOM | 6721 | CA | LYS | E | 173 | 2.968 | 89.700 | −13.090 | 1.00 | 31.95 B000 C |
| ATOM | 6722 | C | LYS | E | 173 | 4.217 | 90.055 | −13.875 | 1.00 | 32.50 B000 C |
| ATOM | 6723 | O | LYS | E | 173 | 5.168 | 90.618 | −13.327 | 1.00 | 29.30 B000 O |
| ATOM | 6724 | CB | LYS | E | 173 | 1.999 | 90.887 | −13.185 | 1.00 | 35.19 B000 C |
| ATOM | 6725 | CG | LYS | E | 173 | 0.540 | 90.586 | −12.876 | 1.00 | 36.71 B000 C |
| ATOM | 6726 | CD | LYS | E | 173 | −0.272 | 91.847 | −13.150 | 1.00 | 36.28 B000 C |
| ATOM | 6727 | CE | LYS | E | 173 | −1.752 | 91.726 | −12.775 | 1.00 | 37.38 B000 C |
| ATOM | 6728 | NZ | LYS | E | 173 | −2.515 | 90.874 | −13.720 | 1.00 | 40.13 B000 N1+ |
| ATOM | 6729 | N | ALA | E | 174 | 4.199 | 89.739 | −15.165 | 1.00 | 34.25 B000 N |
| ATOM | 6730 | CA | ALA | E | 174 | 5.174 | 90.319 | −16.074 | 1.00 | 31.99 B000 C |
| ATOM | 6731 | C | ALA | E | 174 | 5.058 | 91.834 | −16.026 | 1.00 | 33.17 B000 C |
| ATOM | 6732 | O | ALA | E | 174 | 3.962 | 92.387 | −15.834 | 1.00 | 28.18 B000 O |
| ATOM | 6733 | CB | ALA | E | 174 | 4.938 | 89.837 | −17.503 | 1.00 | 26.95 B000 C |

TABLE 10.3-continued

| | | | | | | | | | | |
|---|---|---|---|---|---|---|---|---|---|---|
| ATOM | 6734 | N | TRP | E | 175 | 6.199 | 92.506 | −16.231 | 1.00 | 27.62 B000 N |
| ATOM | 6735 | CA | TRP | E | 175 | 6.257 | 93.962 | −16.080 | 1.00 | 28.95 B000 C |
| ATOM | 6736 | C | TRP | E | 175 | 5.178 | 94.667 | −16.903 | 1.00 | 31.61 B000 C |
| ATOM | 6737 | O | TRP | E | 175 | 4.487 | 95.560 | −16.403 | 1.00 | 35.29 B000 O |
| ATOM | 6738 | CB | TRP | E | 175 | 7.641 | 94.464 | −16.472 | 1.00 | 34.77 B000 C |
| ATOM | 6739 | CG | TRP | E | 175 | 7.893 | 95.874 | −16.085 | 1.00 | 35.77 B000 C |
| ATOM | 6740 | CD1 | TRP | E | 175 | 8.505 | 96.308 | −14.950 | 1.00 | 35.08 B000 C |
| ATOM | 6741 | CD2 | TRP | E | 175 | 7.574 | 97.046 | −16.846 | 1.00 | 33.62 B000 C |
| ATOM | 6742 | NE1 | TRP | E | 175 | 8.582 | 97.688 | −14.946 | 1.00 | 39.22 B000 N |
| ATOM | 6743 | CE2 | TRP | E | 175 | 8.021 | 98.164 | −16.099 | 1.00 | 37.24 B000 C |
| ATOM | 6744 | CE3 | TRP | E | 175 | 6.965 | 97.259 | −18.086 | 1.00 | 30.92 B000 C |
| ATOM | 6745 | CZ2 | TRP | E | 175 | 7.878 | 99.471 | −16.550 | 1.00 | 34.67 B000 C |
| ATOM | 6746 | CZ3 | TRP | E | 175 | 6.812 | 98.559 | −18.531 | 1.00 | 41.35 B000 C |
| ATOM | 6747 | CH2 | TRP | E | 175 | 7.273 | 99.651 | −17.769 | 1.00 | 41.09 B000 C |
| ATOM | 6748 | N | ALA | E | 176 | 5.003 | 94.268 | −18.164 | 1.00 | 31.68 B000 N |
| ATOM | 6749 | CA | ALA | E | 176 | 4.017 | 94.938 | −19.011 | 1.00 | 34.92 B000 C |
| ATOM | 6750 | C | ALA | E | 176 | 2.598 | 94.731 | −18.504 | 1.00 | 42.84 B000 C |
| ATOM | 6751 | O | ALA | E | 176 | 1.760 | 95.625 | −18.637 | 1.00 | 44.50 B000 O |
| ATOM | 6752 | CB | ALA | E | 176 | 4.121 | 94.464 | −20.459 | 1.00 | 27.15 B000 C |
| ATOM | 6753 | N | ASP | E | 177 | 2.296 | 93.569 | −17.928 | 1.00 | 38.72 B000 N |
| ATOM | 6754 | CA | ASP | E | 177 | 0.959 | 93.397 | −17.376 | 1.00 | 38.20 B000 C |
| ATOM | 6755 | C | ASP | E | 177 | 0.800 | 94.189 | −16.085 | 1.00 | 37.56 B000 C |
| ATOM | 6756 | O | ASP | E | 177 | −0.277 | 94.742 | −15.824 | 1.00 | 35.06 B000 O |
| ATOM | 6757 | CB | ASP | E | 177 | 0.658 | 91.915 | −17.144 | 1.00 | 38.76 B000 C |
| ATOM | 6758 | CG | ASP | E | 177 | 0.524 | 91.144 | −18.441 | 1.00 | 44.40 B000 C |
| ATOM | 6759 | OD1 | ASP | E | 177 | −0.060 | 91.696 | −19.397 | 1.00 | 46.46 B000 O |
| ATOM | 6760 | OD2 | ASP | E | 177 | 1.027 | 90.000 | −18.513 | 1.00 | 46.19 B000 O1− |
| ATOM | 6761 | N | ALA | E | 178 | 1.851 | 94.231 | −15.255 | 1.00 | 34.06 B000 N |
| ATOM | 6762 | CA | ALA | E | 178 | 1.810 | 95.046 | −14.045 | 1.00 | 37.97 B000 C |
| ATOM | 6763 | C | ALA | E | 178 | 1.710 | 96.521 | −14.403 | 1.00 | 38.84 B000 C |
| ATOM | 6764 | O | ALA | E | 178 | 1.028 | 97.294 | −13.722 | 1.00 | 36.52 B000 O |
| ATOM | 6765 | CB | ALA | E | 178 | 3.040 | 94.776 | −13.174 | 1.00 | 36.54 B000 C |
| ATOM | 6766 | N | ASP | E | 179 | 2.391 | 96.921 | −15.471 | 1.00 | 38.85 B000 N |
| ATOM | 6767 | CA | ASP | E | 179 | 2.284 | 98.283 | −15.969 | 1.00 | 39.27 B000 C |
| ATOM | 6768 | C | ASP | E | 179 | 0.840 | 98.610 | −16.344 | 1.00 | 44.49 B000 C |
| ATOM | 6769 | O | ASP | E | 179 | 0.287 | 99.630 | −15.911 | 1.00 | 43.34 B000 O |
| ATOM | 6770 | CB | ASP | E | 179 | 3.233 | 98.437 | −17.155 | 1.00 | 41.76 B000 C |
| ATOM | 6771 | CG | ASP | E | 179 | 3.180 | 99.817 | −17.795 | 1.00 | 53.27 B000 C |
| ATOM | 6772 | OD1 | ASP | E | 179 | 3.353 | 100.836 | −17.081 | 1.00 | 46.80 B000 O |
| ATOM | 6773 | OD2 | ASP | E | 179 | 2.980 | 99.863 | −19.031 | 1.00 | 46.92 B000 O1− |
| ATOM | 6774 | N | ASN | E | 180 | 0.193 | 97.723 | −17.106 | 1.00 | 42.03 B000 N |
| ATOM | 6775 | CA | ASN | E | 180 | −1.199 | 97.957 | −17.482 | 1.00 | 44.06 B000 C |
| ATOM | 6776 | C | ASN | E | 180 | −2.105 | 97.976 | −16.261 | 1.00 | 47.76 B000 C |
| ATOM | 6777 | O | ASN | E | 180 | −3.071 | 98.746 | −16.212 | 1.00 | 47.34 B000 O |
| ATOM | 6778 | CB | ASN | E | 180 | −1.687 | 96.905 | −18.488 | 1.00 | 43.06 B000 C |
| ATOM | 6779 | CG | ASN | E | 180 | −1.015 | 97.046 | −19.870 | 1.00 | 67.38 B000 C |
| ATOM | 6780 | OD1 | ASN | E | 180 | −0.489 | 98.113 | −20.216 | 1.00 | 70.80 B000 O |
| ATOM | 6781 | ND2 | ASN | E | 180 | −1.053 | 95.971 | −20.670 | 1.00 | 65.59 B000 N |
| ATOM | 6782 | N | TYR | E | 181 | −1.826 | 97.126 | −15.271 | 1.00 | 39.12 B000 N |
| ATOM | 6783 | CA | TYR | E | 181 | −2.653 | 97.125 | −14.068 | 1.00 | 43.01 B000 C |
| ATOM | 6784 | C | TYR | E | 181 | −2.651 | 98.498 | −13.388 | 1.00 | 42.74 B000 C |
| ATOM | 6785 | O | TYR | E | 181 | −3.710 | 99.015 | −13.016 | 1.00 | 42.29 B000 O |
| ATOM | 6786 | CB | TYR | E | 181 | −2.191 | 96.021 | −13.109 | 1.00 | 37.06 B000 C |
| ATOM | 6787 | CG | TYR | E | 181 | −2.917 | 96.012 | −11.794 | 1.00 | 38.21 B000 C |
| ATOM | 6788 | CD1 | TYR | E | 181 | −2.558 | 96.897 | −10.772 | 1.00 | 34.22 B000 C |
| ATOM | 6789 | CD2 | TYR | E | 181 | −3.956 | 95.118 | −11.558 | 1.00 | 37.19 B000 C |
| ATOM | 6790 | CE1 | TYR | E | 181 | −3.234 | 96.912 | −9.562 | 1.00 | 38.89 B000 C |
| ATOM | 6791 | CE2 | TYR | E | 181 | −4.640 | 95.112 | −10.337 | 1.00 | 36.01 B000 C |
| ATOM | 6792 | CZ | TYR | E | 181 | −4.276 | 96.010 | −9.345 | 1.00 | 44.74 B000 C |
| ATOM | 6793 | OH | TYR | E | 181 | −4.927 | 95.998 | −8.128 | 1.00 | 40.18 B000 O |
| ATOM | 6794 | N | CYS | E | 182 | −1.472 | 99.100 | −13.203 | 1.00 | 38.84 B000 N |
| ATOM | 6795 | CA | CYS | E | 182 | −1.422 | 100.388 | −12.511 | 1.00 | 45.63 B000 C |
| ATOM | 6796 | C | CYS | E | 182 | −2.149 | 101.467 | −13.312 | 1.00 | 47.11 B000 C |
| ATOM | 6797 | O | CYS | E | 182 | −2.911 | 102.262 | −12.747 | 1.00 | 44.58 B000 O |
| ATOM | 6798 | CB | CYS | E | 182 | 0.031 | 100.804 | −12.239 | 1.00 | 42.50 B000 C |
| ATOM | 6799 | SG | CYS | E | 182 | 0.953 | 99.774 | −11.010 | 1.00 | 49.37 B000 S |
| ATOM | 6800 | N | ARG | E | 183 | −1.957 | 101.483 | −14.636 | 1.00 | 46.95 B000 N |
| ATOM | 6801 | CA | ARG | E | 183 | −2.612 | 102.478 | −15.481 | 1.00 | 44.11 B000 C |
| ATOM | 6802 | C | ARG | E | 183 | −4.130 | 102.366 | −15.394 | 1.00 | 50.00 B000 C |
| ATOM | 6803 | O | ARG | E | 183 | −4.833 | 103.386 | −15.359 | 1.00 | 44.76 B000 O |
| ATOM | 6804 | CB | ARG | E | 183 | −2.113 | 102.348 | −16.926 | 1.00 | 40.71 B000 C |
| ATOM | 6805 | CG | ARG | E | 183 | −0.821 | 103.153 | −17.173 | 1.00 | 63.11 B000 C |
| ATOM | 6806 | CD | ARG | E | 183 | 0.070 | 102.668 | −18.340 | 1.00 | 66.43 B000 C |
| ATOM | 6807 | NE | ARG | E | 183 | 1.428 | 103.228 | −18.202 | 1.00 | 85.06 B000 N |
| ATOM | 6808 | CZ | ARG | E | 183 | 2.473 | 102.943 | −18.989 | 1.00 | 82.14 B000 C |
| ATOM | 6809 | NH1 | ARG | E | 183 | 2.333 | 102.088 | −19.998 | 1.00 | 86.34 B000 N1+ |
| ATOM | 6810 | NH2 | ARG | E | 183 | 3.667 | 103.501 | −18.759 | 1.00 | 56.98 B000 N |
| ATOM | 6811 | N | LEU | E | 184 | −4.656 | 101.136 | −15.327 | 1.00 | 45.91 B000 N |
| ATOM | 6812 | CA | LEU | E | 184 | −6.094 | 100.958 | −15.156 | 1.00 | 43.34 B000 C |
| ATOM | 6813 | C | LEU | E | 184 | −6.575 | 101.442 | −13.804 | 1.00 | 44.25 B000 C |

TABLE 10.3-continued

| ATOM | 6814 | O | LEU | E | 184 | −7.769 | 101.694 | −13.646 | 1.00 | 51.06 | B000 | O |
|---|---|---|---|---|---|---|---|---|---|---|---|---|
| ATOM | 6815 | CB | LEU | E | 184 | −6.497 | 99.490 | −15.302 | 1.00 | 47.73 | B000 | C |
| ATOM | 6816 | CG | LEU | E | 184 | −6.471 | 98.840 | −16.680 | 1.00 | 54.62 | B000 | C |
| ATOM | 6817 | CD1 | LEU | E | 184 | −6.890 | 97.380 | −16.546 | 1.00 | 41.74 | B000 | C |
| ATOM | 6818 | CD2 | LEU | E | 184 | −7.353 | 99.606 | −17.678 | 1.00 | 43.16 | B000 | C |
| ATOM | 6819 | N | GLU | E | 185 | −5.685 | 101.579 | −12.827 | 1.00 | 49.85 | B000 | N |
| ATOM | 6820 | CA | GLU | E | 185 | −6.032 | 102.169 | −11.541 | 1.00 | 49.61 | B000 | C |
| ATOM | 6821 | C | GLU | E | 185 | −5.766 | 103.658 | −11.502 | 1.00 | 48.64 | B000 | C |
| ATOM | 6822 | O | GLU | E | 185 | −5.704 | 104.233 | −10.412 | 1.00 | 53.97 | B000 | O |
| ATOM | 6823 | CB | GLU | E | 185 | −5.258 | 101.484 | −10.416 | 1.00 | 52.10 | B000 | C |
| ATOM | 6824 | CG | GLU | E | 185 | −5.516 | 100.002 | −10.355 | 1.00 | 58.31 | B000 | C |
| ATOM | 6825 | CD | GLU | E | 185 | −6.899 | 99.698 | −9.827 | 1.00 | 64.50 | B000 | C |
| ATOM | 6826 | OE1 | GLU | E | 185 | −7.284 | 100.277 | −8.780 | 1.00 | 62.30 | B000 | O |
| ATOM | 6827 | OE2 | GLU | E | 185 | −7.614 | 98.911 | −10.485 | 1.00 | 74.36 | B000 | O1− |
| ATOM | 6828 | N | ASP | E | 186 | −5.571 | 104.286 | −12.662 | 1.00 | 44.48 | B000 | N |
| ATOM | 6829 | CA | ASP | E | 186 | −5.173 | 105.692 | −12.731 | 1.00 | 54.36 | B000 | C |
| ATOM | 6830 | C | ASP | E | 186 | −3.929 | 105.951 | −11.874 | 1.00 | 51.31 | B000 | C |
| ATOM | 6831 | O | ASP | E | 186 | −3.859 | 106.883 | −11.069 | 1.00 | 57.99 | B000 | O |
| ATOM | 6832 | CB | ASP | E | 186 | −6.337 | 106.604 | −12.332 | 1.00 | 56.91 | B000 | C |
| ATOM | 6833 | CG | ASP | E | 186 | −6.105 | 108.048 | −12.733 | 1.00 | 74.54 | B000 | C |
| ATOM | 6834 | OD1 | ASP | E | 186 | −5.482 | 108.279 | −13.798 | 1.00 | 78.01 | B000 | O |
| ATOM | 6835 | OD2 | ASP | E | 186 | −6.541 | 108.948 | −11.982 | 1.00 | 75.17 | B000 | O1− |
| ATOM | 6836 | N | ALA | E | 187 | −2.940 | 105.083 | −12.033 | 1.00 | 50.91 | B000 | N |
| ATOM | 6837 | CA | ALA | E | 187 | −1.713 | 105.165 | −11.265 | 1.00 | 42.37 | B000 | C |
| ATOM | 6838 | C | ALA | E | 187 | −0.593 | 104.718 | −12.183 | 1.00 | 37.72 | B000 | C |
| ATOM | 6839 | O | ALA | E | 187 | −0.810 | 104.469 | −13.372 | 1.00 | 44.89 | B000 | O |
| ATOM | 6840 | CB | ALA | E | 187 | −1.820 | 104.332 | −9.980 | 1.00 | 41.53 | B000 | C |
| ATOM | 6841 | N | HIS | E | 188 | 0.612 | 104.603 | −11.641 | 1.00 | 40.45 | B000 | N |
| ATOM | 6842 | CA | HIS | E | 188 | 1.724 | 104.095 | −12.422 | 1.00 | 40.26 | B000 | C |
| ATOM | 6843 | C | HIS | E | 188 | 2.622 | 103.249 | −11.526 | 1.00 | 42.46 | B000 | C |
| ATOM | 6844 | O | HIS | E | 188 | 2.526 | 103.288 | −10.296 | 1.00 | 40.81 | B000 | O |
| ATOM | 6845 | CB | HIS | E | 188 | 2.499 | 105.237 | −13.079 | 1.00 | 40.08 | B000 | C |
| ATOM | 6846 | CG | HIS | E | 188 | 2.996 | 106.266 | −12.107 | 1.00 | 47.93 | B000 | C |
| ATOM | 6847 | ND1 | HIS | E | 188 | 4.133 | 106.085 | −11.346 | 1.00 | 46.18 | B000 | N |
| ATOM | 6848 | CD2 | HIS | E | 188 | 2.508 | 107.486 | −11.772 | 1.00 | 40.80 | B000 | C |
| ATOM | 6849 | CE1 | HIS | E | 188 | 4.327 | 107.151 | −10.587 | 1.00 | 51.18 | B000 | C |
| ATOM | 6850 | NE2 | HIS | E | 188 | 3.358 | 108.017 | −10.829 | 1.00 | 50.42 | B000 | N |
| ATOM | 6851 | N | LEU | E | 189 | 3.518 | 102.490 | −12.157 | 1.00 | 37.36 | B000 | N |
| ATOM | 6852 | CA | LEU | E | 189 | 4.459 | 101.686 | −11.393 | 1.00 | 38.98 | B000 | C |
| ATOM | 6853 | C | LEU | E | 189 | 5.384 | 102.583 | −10.588 | 1.00 | 38.79 | B000 | C |
| ATOM | 6854 | O | LEU | E | 189 | 5.766 | 103.663 | −11.040 | 1.00 | 44.62 | B000 | O |
| ATOM | 6855 | CB | LEU | E | 189 | 5.264 | 100.782 | −12.324 | 1.00 | 42.15 | B000 | C |
| ATOM | 6856 | CG | LEU | E | 189 | 4.561 | 99.535 | −12.851 | 1.00 | 38.45 | B000 | C |
| ATOM | 6857 | CD1 | LEU | E | 189 | 5.376 | 98.948 | −13.979 | 1.00 | 31.59 | B000 | C |
| ATOM | 6858 | CD2 | LEU | E | 189 | 4.384 | 98.533 | −11.707 | 1.00 | 36.53 | B000 | C |
| ATOM | 6859 | N | VAL | E | 190 | 5.742 | 102.130 | −9.386 | 1.00 | 33.02 | B000 | N |
| ATOM | 6860 | CA | VAL | E | 190 | 6.360 | 103.022 | −8.410 | 1.00 | 37.67 | B000 | C |
| ATOM | 6861 | C | VAL | E | 190 | 7.627 | 103.653 | −8.977 | 1.00 | 41.59 | B000 | C |
| ATOM | 6862 | O | VAL | E | 190 | 8.477 | 102.978 | −9.571 | 1.00 | 39.37 | B000 | O |
| ATOM | 6863 | CB | VAL | E | 190 | 6.626 | 102.274 | −7.093 | 1.00 | 40.50 | B000 | C |
| ATOM | 6864 | CG1 | VAL | E | 190 | 7.570 | 101.068 | −7.292 | 1.00 | 36.01 | B000 | C |
| ATOM | 6865 | CG2 | VAL | E | 190 | 7.216 | 103.229 | −6.056 | 1.00 | 39.66 | B000 | C |
| ATOM | 6866 | N | VAL | E | 191 | 7.751 | 104.967 | −8.792 | 1.00 | 42.38 | B000 | N |
| ATOM | 6867 | CA | VAL | E | 191 | 8.934 | 105.734 | −9.169 | 1.00 | 38.93 | B000 | C |
| ATOM | 6868 | C | VAL | E | 191 | 9.618 | 106.183 | −7.886 | 1.00 | 41.89 | B000 | C |
| ATOM | 6869 | O | VAL | E | 191 | 8.994 | 106.850 | −7.054 | 1.00 | 49.00 | B000 | O |
| ATOM | 6870 | CB | VAL | E | 191 | 8.569 | 106.923 | −10.062 | 1.00 | 39.27 | B000 | C |
| ATOM | 6871 | CG1 | VAL | E | 191 | 9.802 | 107.734 | −10.381 | 1.00 | 41.98 | B000 | C |
| ATOM | 6872 | CG2 | VAL | E | 191 | 7.920 | 106.410 | −11.351 | 1.00 | 37.38 | B000 | C |
| ATOM | 6873 | N | VAL | E | 192 | 10.885 | 105.796 | −7.712 | 1.00 | 36.78 | B000 | N |
| ATOM | 6874 | CA | VAL | E | 192 | 11.606 | 106.006 | −6.456 | 1.00 | 43.13 | B000 | C |
| ATOM | 6875 | C | VAL | E | 192 | 12.466 | 107.255 | −6.601 | 1.00 | 46.90 | B000 | C |
| ATOM | 6876 | O | VAL | E | 192 | 13.429 | 107.274 | −7.375 | 1.00 | 45.02 | B000 | O |
| ATOM | 6877 | CB | VAL | E | 192 | 12.459 | 104.793 | −6.065 | 1.00 | 41.45 | B000 | C |
| ATOM | 6878 | CG1 | VAL | E | 192 | 13.073 | 105.013 | −4.679 | 1.00 | 35.87 | B000 | C |
| ATOM | 6879 | CG2 | VAL | E | 192 | 11.618 | 103.512 | −6.094 | 1.00 | 37.77 | B000 | C |
| ATOM | 6880 | N | THR | E | 193 | 12.117 | 108.311 | −5.870 | 1.00 | 47.21 | B000 | N |
| ATOM | 6881 | CA | THR | E | 193 | 12.800 | 109.589 | −6.012 | 1.00 | 54.54 | B000 | C |
| ATOM | 6882 | C | THR | E | 193 | 13.689 | 109.963 | −4.828 | 1.00 | 53.96 | B000 | C |
| ATOM | 6883 | O | THR | E | 193 | 14.342 | 111.005 | −4.886 | 1.00 | 57.35 | B000 | O |
| ATOM | 6884 | CB | THR | E | 193 | 11.775 | 110.701 | −6.279 | 1.00 | 47.81 | B000 | C |
| ATOM | 6885 | OG1 | THR | E | 193 | 10.889 | 110.829 | −5.158 | 1.00 | 54.26 | B000 | O |
| ATOM | 6886 | CG2 | THR | E | 193 | 10.954 | 110.359 | −7.522 | 1.00 | 49.33 | B000 | C |
| ATOM | 6887 | N | SER | E | 194 | 13.765 | 109.142 | −3.779 | 1.00 | 50.25 | B000 | N |
| ATOM | 6888 | CA | SER | E | 194 | 14.493 | 109.535 | −2.577 | 1.00 | 47.10 | B000 | C |
| ATOM | 6889 | C | SER | E | 194 | 14.737 | 108.321 | −1.701 | 1.00 | 54.45 | B000 | C |
| ATOM | 6890 | O | SER | E | 194 | 14.097 | 107.277 | −1.857 | 1.00 | 55.35 | B000 | O |
| ATOM | 6891 | CB | SER | E | 194 | 13.727 | 110.596 | −1.779 | 1.00 | 50.58 | B000 | C |
| ATOM | 6892 | OG | SER | E | 194 | 12.588 | 110.027 | −1.152 | 1.00 | 52.89 | B000 | O |
| ATOM | 6893 | N | TRP | E | 195 | 15.656 | 108.488 | −0.749 | 1.00 | 54.05 | B000 | N |

TABLE 10.3-continued

| | | | | | | | | | | | |
|---|---|---|---|---|---|---|---|---|---|---|---|
| ATOM | 6894 | CA | TRP | E | 195 | 15.954 | 107.418 | 0.196 | 1.00 | 53.90 | B000 | C |
| ATOM | 6895 | C | TRP | E | 195 | 14.742 | 107.048 | 1.047 | 1.00 | 56.80 | B000 | C |
| ATOM | 6896 | O | TRP | E | 195 | 14.512 | 105.862 | 1.323 | 1.00 | 53.39 | B000 | O |
| ATOM | 6897 | CB | TRP | E | 195 | 17.124 | 107.822 | 1.086 | 1.00 | 52.43 | B000 | C |
| ATOM | 6898 | CG | TRP | E | 195 | 18.407 | 107.331 | 0.552 | 1.00 | 62.39 | B000 | C |
| ATOM | 6899 | CD1 | TRP | E | 195 | 19.444 | 108.092 | 0.068 | 1.00 | 63.42 | B000 | C |
| ATOM | 6900 | CD2 | TRP | E | 195 | 18.804 | 105.965 | 0.402 | 1.00 | 65.61 | B000 | C |
| ATOM | 6901 | NE1 | TRP | E | 195 | 20.464 | 107.278 | −0.362 | 1.00 | 65.18 | B000 | N |
| ATOM | 6902 | CE2 | TRP | E | 195 | 20.100 | 105.969 | −0.170 | 1.00 | 69.72 | B000 | C |
| ATOM | 6903 | CE3 | TRP | E | 195 | 18.199 | 104.739 | 0.703 | 1.00 | 59.71 | B000 | C |
| ATOM | 6904 | CZ2 | TRP | E | 195 | 20.797 | 104.792 | −0.447 | 1.00 | 59.79 | B000 | C |
| ATOM | 6905 | CZ3 | TRP | E | 195 | 18.890 | 103.571 | 0.425 | 1.00 | 54.31 | B000 | C |
| ATOM | 6906 | CH2 | TRP | E | 195 | 20.174 | 103.605 | −0.142 | 1.00 | 59.74 | B000 | C |
| ATOM | 6907 | N | GLU | E | 196 | 13.961 | 108.038 | 1.487 | 1.00 | 55.10 | B000 | N |
| ATOM | 6908 | CA | GLU | E | 196 | 12.781 | 107.723 | 2.292 | 1.00 | 58.29 | B000 | C |
| ATOM | 6909 | C | GLU | E | 196 | 11.786 | 106.895 | 1.505 | 1.00 | 53.21 | B000 | C |
| ATOM | 6910 | O | GLU | E | 196 | 11.299 | 105.874 | 1.999 | 1.00 | 56.81 | B000 | O |
| ATOM | 6911 | CB | GLU | E | 196 | 12.127 | 108.987 | 2.849 | 1.00 | 67.43 | B000 | C |
| ATOM | 6912 | CG | GLU | E | 196 | 12.825 | 109.494 | 4.092 | 1.00 | 75.36 | B000 | C |
| ATOM | 6913 | CD | GLU | E | 196 | 14.139 | 110.132 | 3.758 | 1.00 | 90.49 | B000 | C |
| ATOM | 6914 | OE1 | GLU | E | 196 | 14.259 | 110.606 | 2.610 | 1.00 | 89.70 | B000 | O |
| ATOM | 6915 | OE2 | GLU | E | 196 | 15.055 | 110.128 | 4.613 | 1.00 | 94.74 | B000 | O1− |
| ATOM | 6916 | N | GLU | E | 197 | 11.460 | 107.326 | 0.281 | 1.00 | 51.77 | B000 | N |
| ATOM | 6917 | CA | GLU | E | 197 | 10.589 | 106.525 | −0.570 | 1.00 | 52.50 | B000 | C |
| ATOM | 6918 | C | GLU | E | 197 | 11.155 | 105.116 | −0.740 | 1.00 | 51.92 | B000 | C |
| ATOM | 6919 | O | GLU | E | 197 | 10.436 | 104.125 | −0.567 | 1.00 | 48.95 | B000 | O |
| ATOM | 6920 | CB | GLU | E | 197 | 10.376 | 107.217 | −1.920 | 1.00 | 44.93 | B000 | C |
| ATOM | 6921 | CG | GLU | E | 197 | 9.163 | 106.692 | −2.685 | 1.00 | 46.53 | B000 | C |
| ATOM | 6922 | CD | GLU | E | 197 | 8.827 | 107.482 | −3.949 | 1.00 | 48.66 | B000 | C |
| ATOM | 6923 | OE1 | GLU | E | 197 | 9.651 | 108.313 | −4.402 | 1.00 | 48.86 | B000 | O |
| ATOM | 6924 | OE2 | GLU | E | 197 | 7.727 | 107.257 | −4.507 | 1.00 | 50.40 | B000 | O1− |
| ATOM | 6925 | N | GLN | E | 198 | 12.462 | 105.006 | −1.006 | 1.00 | 45.93 | B000 | N |
| ATOM | 6926 | CA | GLN | E | 198 | 13.088 | 103.692 | −1.102 | 1.00 | 44.41 | B000 | C |
| ATOM | 6927 | C | GLN | E | 198 | 12.894 | 102.888 | 0.183 | 1.00 | 52.88 | B000 | C |
| ATOM | 6928 | O | GLN | E | 198 | 12.542 | 101.701 | 0.145 | 1.00 | 50.74 | B000 | O |
| ATOM | 6929 | CB | GLN | E | 198 | 14.572 | 103.831 | −1.416 | 1.00 | 39.60 | B000 | C |
| ATOM | 6930 | CG | GLN | E | 198 | 15.367 | 102.576 | −1.148 | 1.00 | 36.79 | B000 | C |
| ATOM | 6931 | CD | GLN | E | 198 | 15.210 | 101.541 | −2.254 | 1.00 | 42.68 | B000 | C |
| ATOM | 6932 | OE1 | GLN | E | 198 | 14.942 | 101.881 | −3.399 | 1.00 | 38.01 | B000 | O |
| ATOM | 6933 | NE2 | GLN | E | 198 | 15.359 | 100.273 | −1.906 | 1.00 | 40.53 | B000 | N |
| ATOM | 6934 | N | LYS | E | 199 | 13.135 | 103.512 | 1.337 | 1.00 | 51.74 | B000 | N |
| ATOM | 6935 | CA | LYS | E | 199 | 13.004 | 102.770 | 2.587 | 1.00 | 50.49 | B000 | C |
| ATOM | 6936 | C | LYS | E | 199 | 11.544 | 102.452 | 2.890 | 1.00 | 51.58 | B000 | C |
| ATOM | 6937 | O | LYS | E | 199 | 11.242 | 101.379 | 3.427 | 1.00 | 48.97 | B000 | O |
| ATOM | 6938 | CB | LYS | E | 199 | 13.670 | 103.539 | 3.731 | 1.00 | 53.77 | B000 | C |
| ATOM | 6939 | CG | LYS | E | 199 | 15.157 | 103.755 | 3.500 | 1.00 | 55.44 | B000 | C |
| ATOM | 6940 | CD | LYS | E | 199 | 15.992 | 103.547 | 4.755 | 1.00 | 75.31 | B000 | C |
| ATOM | 6941 | CE | LYS | E | 199 | 17.390 | 104.165 | 4.583 | 1.00 | 85.03 | B000 | C |
| ATOM | 6942 | NZ | LYS | E | 199 | 18.151 | 104.301 | 5.862 | 1.00 | 83.45 | B000 | N1+ |
| ATOM | 6943 | N | PHE | E | 200 | 10.631 | 103.358 | 2.531 | 1.00 | 48.81 | B000 | N |
| ATOM | 6944 | CA | PHE | E | 200 | 9.204 | 103.098 | 2.691 | 1.00 | 48.98 | B000 | C |
| ATOM | 6945 | C | PHE | E | 200 | 8.773 | 101.845 | 1.931 | 1.00 | 55.28 | B000 | C |
| ATOM | 6946 | O | PHE | E | 200 | 8.032 | 101.010 | 2.465 | 1.00 | 54.84 | B000 | O |
| ATOM | 6947 | CB | PHE | E | 200 | 8.406 | 104.312 | 2.224 | 1.00 | 46.91 | B000 | C |
| ATOM | 6948 | CG | PHE | E | 200 | 6.965 | 104.034 | 2.006 | 1.00 | 50.71 | B000 | C |
| ATOM | 6949 | CD1 | PHE | E | 200 | 6.112 | 103.847 | 3.085 | 1.00 | 53.71 | B000 | C |
| ATOM | 6950 | CD2 | PHE | E | 200 | 6.449 | 103.965 | 0.722 | 1.00 | 51.62 | B000 | C |
| ATOM | 6951 | CE1 | PHE | E | 200 | 4.756 | 103.588 | 2.891 | 1.00 | 52.00 | B000 | C |
| ATOM | 6952 | CE2 | PHE | E | 200 | 5.097 | 103.710 | 0.512 | 1.00 | 50.54 | B000 | C |
| ATOM | 6953 | CZ | PHE | E | 200 | 4.248 | 103.518 | 1.605 | 1.00 | 54.40 | B000 | C |
| ATOM | 6954 | N | VAL | E | 201 | 9.229 | 101.697 | 0.680 | 1.00 | 51.49 | B000 | N |
| ATOM | 6955 | CA | VAL | E | 201 | 8.826 | 100.553 | −0.137 | 1.00 | 48.07 | B000 | C |
| ATOM | 6956 | C | VAL | E | 201 | 9.420 | 99.254 | 0.413 | 1.00 | 49.06 | B000 | C |
| ATOM | 6957 | O | VAL | E | 201 | 8.706 | 98.253 | 0.569 | 1.00 | 46.98 | B000 | O |
| ATOM | 6958 | CB | VAL | E | 201 | 9.208 | 100.788 | −1.611 | 1.00 | 46.66 | B000 | C |
| ATOM | 6959 | CG1 | VAL | E | 201 | 9.067 | 99.495 | −2.434 | 1.00 | 41.41 | B000 | C |
| ATOM | 6960 | CG2 | VAL | E | 201 | 8.349 | 101.902 | −2.212 | 1.00 | 37.70 | B000 | C |
| ATOM | 6961 | N | GLN | E | 202 | 10.728 | 99.252 | 0.723 | 1.00 | 49.32 | B000 | N |
| ATOM | 6962 | CA | GLN | E | 202 | 11.380 | 98.063 | 1.284 | 1.00 | 50.74 | B000 | C |
| ATOM | 6963 | C | GLN | E | 202 | 10.622 | 97.528 | 2.481 | 1.00 | 51.55 | B000 | C |
| ATOM | 6964 | O | GLN | E | 202 | 10.464 | 96.310 | 2.640 | 1.00 | 56.45 | B000 | O |
| ATOM | 6965 | CB | GLN | E | 202 | 12.803 | 98.371 | 1.749 | 1.00 | 47.47 | B000 | C |
| ATOM | 6966 | CG | GLN | E | 202 | 13.739 | 98.831 | 0.710 | 1.00 | 55.69 | B000 | C |
| ATOM | 6967 | CD | GLN | E | 202 | 15.139 | 98.987 | 1.254 | 1.00 | 56.47 | B000 | C |
| ATOM | 6968 | OE1 | GLN | E | 202 | 15.907 | 99.831 | 0.790 | 1.00 | 57.62 | B000 | O |
| ATOM | 6969 | NE2 | GLN | E | 202 | 15.490 | 98.154 | 2.219 | 1.00 | 53.11 | B000 | N |
| ATOM | 6970 | N | HIS | E | 203 | 10.189 | 98.433 | 3.360 | 1.00 | 51.67 | B000 | N |
| ATOM | 6971 | CA | HIS | E | 203 | 9.452 | 98.030 | 4.546 | 1.00 | 53.23 | B000 | C |
| ATOM | 6972 | C | HIS | E | 203 | 8.230 | 97.215 | 4.173 | 1.00 | 58.75 | B000 | C |
| ATOM | 6973 | O | HIS | E | 203 | 7.901 | 96.227 | 4.840 | 1.00 | 59.40 | B000 | O |

TABLE 10.3-continued

| | | | | | | | | | | | |
|---|---|---|---|---|---|---|---|---|---|---|---|
| ATOM | 6974 | CB | HIS | E | 203 | 9.043 | 99.256 | 5.346 | 1.00 | 52.17 | B000 C |
| ATOM | 6975 | CG | HIS | E | 203 | 8.280 | 98.924 | 6.587 | 1.00 | 63.88 | B000 C |
| ATOM | 6976 | ND1 | HIS | E | 203 | 6.924 | 99.142 | 6.710 | 1.00 | 66.92 | B000 N |
| ATOM | 6977 | CD2 | HIS | E | 203 | 8.681 | 98.359 | 7.750 | 1.00 | 59.72 | B000 C |
| ATOM | 6978 | CE1 | HIS | E | 203 | 6.525 | 98.741 | 7.904 | 1.00 | 64.58 | B000 C |
| ATOM | 6979 | NE2 | HIS | E | 203 | 7.572 | 98.265 | 8.555 | 1.00 | 67.38 | B000 N |
| ATOM | 6980 | N | HIS | E | 204 | 7.548 | 97.609 | 3.105 | 1.00 | 51.87 | B000 N |
| ATOM | 6981 | CA | HIS | E | 204 | 6.320 | 96.930 | 2.742 | 1.00 | 47.42 | B000 C |
| ATOM | 6982 | C | HIS | E | 204 | 6.528 | 95.712 | 1.851 | 1.00 | 45.87 | B000 C |
| ATOM | 6983 | O | HIS | E | 204 | 5.734 | 94.781 | 1.934 | 1.00 | 46.13 | B000 O |
| ATOM | 6984 | CB | HIS | E | 204 | 5.375 | 97.925 | 2.086 | 1.00 | 43.64 | B000 C |
| ATOM | 6985 | CG | HIS | E | 204 | 4.761 | 98.864 | 3.071 | 1.00 | 55.52 | B000 C |
| ATOM | 6986 | ND1 | HIS | E | 204 | 5.277 | 100.116 | 3.331 | 1.00 | 62.43 | B000 N |
| ATOM | 6987 | CD2 | HIS | E | 204 | 3.719 | 98.703 | 3.917 | 1.00 | 51.63 | B000 C |
| ATOM | 6988 | CE1 | HIS | E | 204 | 4.551 | 100.702 | 4.265 | 1.00 | 56.76 | B000 C |
| ATOM | 6989 | NE2 | HIS | E | 204 | 3.598 | 99.867 | 4.634 | 1.00 | 58.19 | B000 N |
| ATOM | 6990 | N | ILE | E | 205 | 7.554 | 95.673 | 0.998 | 1.00 | 45.67 | B000 N |
| ATOM | 6991 | CA | ILE | E | 205 | 7.676 | 94.532 | 0.097 | 1.00 | 43.17 | B000 C |
| ATOM | 6992 | C | ILE | E | 205 | 8.408 | 93.363 | 0.749 | 1.00 | 43.69 | B000 C |
| ATOM | 6993 | O | ILE | E | 205 | 8.193 | 92.215 | 0.356 | 1.00 | 42.25 | B000 O |
| ATOM | 6994 | CB | ILE | E | 205 | 8.346 | 94.913 | −1.235 | 1.00 | 39.71 | B000 C |
| ATOM | 6995 | CG1 | ILE | E | 205 | 9.791 | 95.341 | −1.023 | 1.00 | 34.62 | B000 C |
| ATOM | 6996 | CG2 | ILE | E | 205 | 7.572 | 96.011 | −1.954 | 1.00 | 32.37 | B000 C |
| ATOM | 6997 | CD1 | ILE | E | 205 | 10.470 | 95.665 | −2.317 | 1.00 | 33.57 | B000 C |
| ATOM | 6998 | N | GLY | E | 206 | 9.273 | 93.616 | 1.728 | 1.00 | 45.56 | B000 N |
| ATOM | 6999 | CA | GLY | E | 206 | 10.038 | 92.555 | 2.352 | 1.00 | 38.77 | B000 C |
| ATOM | 7000 | C | GLY | E | 206 | 11.058 | 91.943 | 1.409 | 1.00 | 45.53 | B000 C |
| ATOM | 7001 | O | GLY | E | 206 | 11.640 | 92.616 | 0.551 | 1.00 | 53.68 | B000 O |
| ATOM | 7002 | N | PRO | E | 207 | 11.268 | 90.646 | 1.525 | 1.00 | 41.49 | B000 N |
| ATOM | 7003 | CA | PRO | E | 207 | 12.312 | 89.995 | 0.720 | 1.00 | 48.79 | B000 C |
| ATOM | 7004 | C | PRO | E | 207 | 11.816 | 89.452 | −0.616 | 1.00 | 39.32 | B000 C |
| ATOM | 7005 | O | PRO | E | 207 | 12.233 | 88.359 | −0.999 | 1.00 | 49.37 | B000 O |
| ATOM | 7006 | CB | PRO | E | 207 | 12.736 | 88.837 | 1.624 | 1.00 | 42.37 | B000 C |
| ATOM | 7007 | CG | PRO | E | 207 | 11.386 | 88.411 | 2.205 | 1.00 | 39.72 | B000 C |
| ATOM | 7008 | CD | PRO | E | 207 | 10.597 | 89.687 | 2.422 | 1.00 | 38.72 | B000 C |
| ATOM | 7009 | N | VAL | E | 208 | 10.949 | 90.169 | −1.333 | 1.00 | 40.46 | B000 N |
| ATOM | 7010 | CA | VAL | E | 208 | 10.315 | 89.659 | −2.546 | 1.00 | 37.68 | B000 C |
| ATOM | 7011 | C | VAL | E | 208 | 10.706 | 90.542 | −3.729 | 1.00 | 38.16 | B000 C |
| ATOM | 7012 | O | VAL | E | 208 | 10.561 | 91.767 | −3.665 | 1.00 | 39.77 | B000 O |
| ATOM | 7013 | CB | VAL | E | 208 | 8.785 | 89.601 | −2.383 | 1.00 | 40.03 | B000 C |
| ATOM | 7014 | CG1 | VAL | E | 208 | 8.133 | 88.976 | −3.608 | 1.00 | 32.03 | B000 C |
| ATOM | 7015 | CG2 | VAL | E | 208 | 8.427 | 88.819 | −1.106 | 1.00 | 41.62 | B000 C |
| ATOM | 7016 | N | ASN | E | 209 | 11.186 | 89.917 | −4.812 | 1.00 | 35.17 | B000 N |
| ATOM | 7017 | CA | ASN | E | 209 | 11.506 | 90.657 | −6.028 | 1.00 | 30.25 | B000 C |
| ATOM | 7018 | C | ASN | E | 209 | 10.268 | 91.389 | −6.522 | 1.00 | 39.60 | B000 C |
| ATOM | 7019 | O | ASN | E | 209 | 9.189 | 90.792 | −6.646 | 1.00 | 35.43 | B000 O |
| ATOM | 7020 | CB | ASN | E | 209 | 12.020 | 89.710 | −7.105 | 1.00 | 33.04 | B000 C |
| ATOM | 7021 | CG | ASN | E | 209 | 13.430 | 89.196 | −6.817 | 1.00 | 37.45 | B000 C |
| ATOM | 7022 | OD1 | ASN | E | 209 | 14.282 | 89.914 | −6.286 | 1.00 | 39.88 | B000 O |
| ATOM | 7023 | ND2 | ASN | E | 209 | 13.676 | 87.948 | −7.166 | 1.00 | 34.14 | B000 N |
| ATOM | 7024 | N | THR | E | 210 | 10.417 | 92.686 | −6.801 | 1.00 | 32.18 | B000 N |
| ATOM | 7025 | CA | THR | E | 210 | 9.258 | 93.553 | −6.998 | 1.00 | 34.27 | B000 C |
| ATOM | 7026 | C | THR | E | 210 | 9.571 | 94.589 | −8.068 | 1.00 | 34.48 | B000 C |
| ATOM | 7027 | O | THR | E | 210 | 10.533 | 95.349 | −7.932 | 1.00 | 31.68 | B000 O |
| ATOM | 7028 | CB | THR | E | 210 | 8.864 | 94.225 | −5.667 | 1.00 | 33.37 | B000 C |
| ATOM | 7029 | OG1 | THR | E | 210 | 8.661 | 93.210 | −4.675 | 1.00 | 35.38 | B000 O |
| ATOM | 7030 | CG2 | THR | E | 210 | 7.604 | 95.081 | −5.789 | 1.00 | 26.61 | B000 C |
| ATOM | 7031 | N | TRP | E | 211 | 8.743 | 94.626 | −9.112 | 1.00 | 29.97 | B000 N |
| ATOM | 7032 | CA | TRP | E | 211 | 8.933 | 95.562 | −10.208 | 1.00 | 27.14 | B000 C |
| ATOM | 7033 | C | TRP | E | 211 | 8.801 | 97.006 | −9.731 | 1.00 | 35.31 | B000 C |
| ATOM | 7034 | O | TRP | E | 211 | 7.981 | 97.316 | −8.863 | 1.00 | 35.67 | B000 O |
| ATOM | 7035 | CB | TRP | E | 211 | 7.887 | 95.312 | −11.297 | 1.00 | 30.90 | B000 C |
| ATOM | 7036 | CG | TRP | E | 211 | 8.066 | 94.071 | −12.124 | 1.00 | 34.50 | B000 C |
| ATOM | 7037 | CD1 | TRP | E | 211 | 7.104 | 93.138 | −12.433 | 1.00 | 29.56 | B000 C |
| ATOM | 7038 | CD2 | TRP | E | 211 | 9.267 | 93.640 | −12.788 | 1.00 | 34.63 | B000 C |
| ATOM | 7039 | NE1 | TRP | E | 211 | 7.630 | 92.160 | −13.254 | 1.00 | 28.60 | B000 N |
| ATOM | 7040 | CE2 | TRP | E | 211 | 8.955 | 92.439 | −13.482 | 1.00 | 35.28 | B000 C |
| ATOM | 7041 | CE3 | TRP | E | 211 | 10.575 | 94.146 | −12.860 | 1.00 | 35.02 | B000 C |
| ATOM | 7042 | CZ2 | TRP | E | 211 | 9.904 | 91.741 | −14.231 | 1.00 | 29.26 | B000 C |
| ATOM | 7043 | CZ3 | TRP | E | 211 | 11.518 | 93.452 | −13.602 | 1.00 | 36.35 | B000 C |
| ATOM | 7044 | CH2 | TRP | E | 211 | 11.177 | 92.251 | −14.275 | 1.00 | 30.95 | B000 C |
| ATOM | 7045 | N | MET | E | 212 | 9.605 | 97.895 | −10.316 | 1.00 | 32.55 | B000 N |
| ATOM | 7046 | CA | MET | E | 212 | 9.380 | 99.331 | −10.239 | 1.00 | 29.40 | B000 C |
| ATOM | 7047 | C | MET | E | 212 | 9.191 | 99.869 | −11.652 | 1.00 | 37.49 | B000 C |
| ATOM | 7048 | O | MET | E | 212 | 9.421 | 99.163 | −12.641 | 1.00 | 33.69 | B000 O |
| ATOM | 7049 | CB | MET | E | 212 | 10.532 | 100.045 | −9.538 | 1.00 | 32.77 | B000 C |
| ATOM | 7050 | CG | MET | E | 212 | 11.802 | 100.197 | −10.374 | 1.00 | 37.02 | B000 C |
| ATOM | 7051 | SD | MET | E | 212 | 13.201 | 100.683 | −9.319 | 1.00 | 36.83 | B000 S |
| ATOM | 7052 | CE | MET | E | 212 | 13.620 | 99.156 | −8.467 | 1.00 | 32.94 | B000 C |
| ATOM | 7053 | N | GLY | E | 213 | 8.730 | 101.124 | −11.741 | 1.00 | 37.19 | B000 N |

TABLE 10.3-continued

| | | | | | | | | | | |
|---|---|---|---|---|---|---|---|---|---|---|
| ATOM | 7054 | CA | GLY | E | 213 | 8.440 | 101.761 | −13.019 | 1.00 | 32.81 | B000 C |
| ATOM | 7055 | C | GLY | E | 213 | 9.662 | 102.269 | −13.761 | 1.00 | 40.32 | B000 C |
| ATOM | 7056 | O | GLY | E | 213 | 9.719 | 103.432 | −14.187 | 1.00 | 38.40 | B000 O |
| ATOM | 7057 | N | LEU | E | 214 | 10.634 | 101.380 | −13.941 | 1.00 | 34.17 | B000 N |
| ATOM | 7058 | CA | LEU | E | 214 | 11.934 | 101.714 | −14.503 | 1.00 | 39.27 | B000 C |
| ATOM | 7059 | C | LEU | E | 214 | 12.321 | 100.610 | −15.473 | 1.00 | 39.76 | B000 C |
| ATOM | 7060 | O | LEU | E | 214 | 12.335 | 99.431 | −15.100 | 1.00 | 41.29 | B000 O |
| ATOM | 7061 | CB | LEU | E | 214 | 12.988 | 101.877 | −13.395 | 1.00 | 36.55 | B000 C |
| ATOM | 7062 | CG | LEU | E | 214 | 14.450 | 102.064 | −13.797 | 1.00 | 42.98 | B000 C |
| ATOM | 7063 | CD1 | LEU | E | 214 | 14.624 | 103.269 | −14.744 | 1.00 | 38.04 | B000 C |
| ATOM | 7064 | CD2 | LEU | E | 214 | 15.305 | 102.224 | −12.529 | 1.00 | 37.75 | B000 C |
| ATOM | 7065 | N | HIS | E | 215 | 12.601 | 100.987 | −16.718 | 1.00 | 36.19 | B000 N |
| ATOM | 7066 | CA | HIS | E | 215 | 12.875 | 100.024 | −17.774 | 1.00 | 39.33 | B000 C |
| ATOM | 7067 | C | HIS | E | 215 | 13.746 | 100.691 | −18.829 | 1.00 | 41.39 | B000 C |
| ATOM | 7068 | O | HIS | E | 215 | 13.843 | 101.921 | −18.899 | 1.00 | 36.50 | B000 O |
| ATOM | 7069 | CB | HIS | E | 215 | 11.588 | 99.528 | −18.420 | 1.00 | 37.31 | B000 C |
| ATOM | 7070 | CG | HIS | E | 215 | 10.877 | 100.605 | −19.156 | 1.00 | 43.54 | B000 C |
| ATOM | 7071 | ND1 | HIS | E | 215 | 10.975 | 100.759 | −20.521 | 1.00 | 59.96 | B000 N |
| ATOM | 7072 | CD2 | HIS | E | 215 | 10.149 | 101.654 | −18.708 | 1.00 | 43.07 | B000 C |
| ATOM | 7073 | CE1 | HIS | E | 215 | 10.292 | 101.830 | −20.888 | 1.00 | 55.73 | B000 C |
| ATOM | 7074 | NE2 | HIS | E | 215 | 9.780 | 102.387 | −19.807 | 1.00 | 46.66 | B000 N |
| ATOM | 7075 | N | ASP | E | 216 | 14.341 | 99.858 | −19.680 | 1.00 | 35.15 | B000 N |
| ATOM | 7076 | CA | ASP | E | 216 | 15.301 | 100.290 | −20.686 | 1.00 | 39.15 | B000 C |
| ATOM | 7077 | C | ASP | E | 216 | 14.788 | 99.998 | −22.085 | 1.00 | 42.63 | B000 C |
| ATOM | 7078 | O | ASP | E | 216 | 15.571 | 99.773 | −23.004 | 1.00 | 42.03 | B000 O |
| ATOM | 7079 | CB | ASP | E | 216 | 16.648 | 99.600 | −20.467 | 1.00 | 41.75 | B000 C |
| ATOM | 7080 | CG | ASP | E | 216 | 16.632 | 98.097 | −20.849 | 1.00 | 44.42 | B000 C |
| ATOM | 7081 | OD1 | ASP | E | 216 | 15.551 | 97.505 | −21.130 | 1.00 | 37.16 | B000 O |
| ATOM | 7082 | OD2 | ASP | E | 216 | 17.732 | 97.502 | −20.848 | 1.00 | 43.61 | B000 O1− |
| ATOM | 7083 | N | GLN | E | 217 | 13.476 | 99.947 | −22.253 | 1.00 | 46.29 | B000 N |
| ATOM | 7084 | CA | GLN | E | 217 | 12.991 | 99.214 | −23.411 | 1.00 | 59.57 | B000 C |
| ATOM | 7085 | C | GLN | E | 217 | 13.208 | 99.957 | −24.721 | 1.00 | 65.22 | B000 C |
| ATOM | 7086 | O | GLN | E | 217 | 13.083 | 99.331 | −25.778 | 1.00 | 73.01 | B000 O |
| ATOM | 7087 | CB | GLN | E | 217 | 11.516 | 98.820 | −23.200 | 1.00 | 62.75 | B000 C |
| ATOM | 7088 | CG | GLN | E | 217 | 11.375 | 97.683 | −22.125 | 1.00 | 61.06 | B000 C |
| ATOM | 7089 | CD | GLN | E | 217 | 9.984 | 97.034 | −22.070 | 1.00 | 67.45 | B000 C |
| ATOM | 7090 | OE1 | GLN | E | 217 | 9.134 | 97.409 | −21.253 | 1.00 | 58.29 | B000 O |
| ATOM | 7091 | NE2 | GLN | E | 217 | 9.759 | 96.044 | −22.936 | 1.00 | 73.72 | B000 N |
| ATOM | 7092 | N | ASN | E | 218 | 13.622 | 101.226 | −24.688 | 1.00 | 54.85 | B000 N |
| ATOM | 7093 | CA | ASN | E | 218 | 14.065 | 101.896 | −25.900 | 1.00 | 56.88 | B000 C |
| ATOM | 7094 | C | ASN | E | 218 | 15.579 | 101.999 | −25.997 | 1.00 | 63.85 | B000 C |
| ATOM | 7095 | O | ASN | E | 218 | 16.099 | 102.476 | −27.010 | 1.00 | 65.96 | B000 O |
| ATOM | 7096 | CB | ASN | E | 218 | 13.440 | 103.283 | −25.982 | 1.00 | 68.65 | B000 C |
| ATOM | 7097 | CG | ASN | E | 218 | 11.988 | 103.230 | −26.379 | 1.00 | 76.18 | B000 C |
| ATOM | 7098 | OD1 | ASN | E | 218 | 11.117 | 103.732 | −25.663 | 1.00 | 80.28 | B000 O |
| ATOM | 7099 | ND2 | ASN | E | 218 | 11.710 | 102.603 | −27.524 | 1.00 | 70.77 | B000 N |
| ATOM | 7100 | N | GLY | E | 219 | 16.294 | 101.546 | −24.980 | 1.00 | 55.99 | B000 N |
| ATOM | 7101 | CA | GLY | E | 219 | 17.721 | 101.702 | −24.908 | 1.00 | 47.24 | B000 C |
| ATOM | 7102 | C | GLY | E | 219 | 18.086 | 102.395 | −23.615 | 1.00 | 46.37 | B000 C |
| ATOM | 7103 | O | GLY | E | 219 | 18.657 | 101.797 | −22.697 | 1.00 | 45.37 | B000 O |
| ATOM | 7104 | N | PRO | E | 220 | 17.760 | 103.679 | −23.515 | 1.00 | 47.23 | B000 N |
| ATOM | 7105 | CA | PRO | E | 220 | 18.027 | 104.396 | −22.266 | 1.00 | 48.53 | B000 C |
| ATOM | 7106 | C | PRO | E | 220 | 17.055 | 103.993 | −21.169 | 1.00 | 44.15 | B000 C |
| ATOM | 7107 | O | PRO | E | 220 | 15.875 | 103.736 | −21.413 | 1.00 | 47.26 | B000 O |
| ATOM | 7108 | CB | PRO | E | 220 | 17.875 | 105.872 | −22.658 | 1.00 | 43.34 | B000 C |
| ATOM | 7109 | CG | PRO | E | 220 | 17.055 | 105.868 | −23.864 | 1.00 | 50.66 | B000 C |
| ATOM | 7110 | CD | PRO | E | 220 | 17.359 | 104.593 | −24.598 | 1.00 | 46.49 | B000 C |
| ATOM | 7111 | N | TRP | E | 221 | 17.592 | 103.878 | −19.961 | 1.00 | 41.42 | B000 N |
| ATOM | 7112 | CA | TRP | E | 221 | 16.767 | 103.695 | −18.783 | 1.00 | 38.08 | B000 C |
| ATOM | 7113 | C | TRP | E | 221 | 15.871 | 104.916 | −18.561 | 1.00 | 43.21 | B000 C |
| ATOM | 7114 | O | TRP | E | 221 | 16.325 | 106.062 | −18.630 | 1.00 | 45.08 | B000 O |
| ATOM | 7115 | CB | TRP | E | 221 | 17.672 | 103.446 | −17.577 | 1.00 | 37.90 | B000 C |
| ATOM | 7116 | CG | TRP | E | 221 | 18.256 | 102.057 | −17.559 | 1.00 | 35.77 | B000 C |
| ATOM | 7117 | CD1 | TRP | E | 221 | 19.520 | 101.683 | −17.939 | 1.00 | 39.29 | B000 C |
| ATOM | 7118 | CD2 | TRP | E | 221 | 17.586 | 100.853 | −17.157 | 1.00 | 36.68 | B000 C |
| ATOM | 7119 | NE1 | TRP | E | 221 | 19.676 | 100.323 | −17.789 | 1.00 | 39.97 | B000 N |
| ATOM | 7120 | CE2 | TRP | E | 221 | 18.501 | 99.790 | −17.318 | 1.00 | 39.47 | B000 C |
| ATOM | 7121 | CE3 | TRP | E | 221 | 16.296 | 100.571 | −16.676 | 1.00 | 37.85 | B000 C |
| ATOM | 7122 | CZ2 | TRP | E | 221 | 18.176 | 98.469 | −16.997 | 1.00 | 34.61 | B000 C |
| ATOM | 7123 | CZ3 | TRP | E | 221 | 15.970 | 99.246 | −16.364 | 1.00 | 38.91 | B000 C |
| ATOM | 7124 | CH2 | TRP | E | 221 | 16.909 | 98.220 | −16.523 | 1.00 | 36.77 | B000 C |
| ATOM | 7125 | N | LYS | E | 222 | 14.591 | 104.666 | −18.298 | 1.00 | 42.42 | B000 N |
| ATOM | 7126 | CA | LYS | E | 222 | 13.600 | 105.715 | −18.110 | 1.00 | 45.91 | B000 C |
| ATOM | 7127 | C | LYS | E | 222 | 12.648 | 105.317 | −16.994 | 1.00 | 49.90 | B000 C |
| ATOM | 7128 | O | LYS | E | 222 | 12.383 | 104.131 | −16.772 | 1.00 | 45.80 | B000 O |
| ATOM | 7129 | CB | LYS | E | 222 | 12.766 | 105.968 | −19.368 | 1.00 | 48.31 | B000 C |
| ATOM | 7130 | CG | LYS | E | 222 | 13.519 | 106.492 | −20.561 | 1.00 | 57.72 | B000 C |
| ATOM | 7131 | CD | LYS | E | 222 | 12.640 | 106.357 | −21.800 | 1.00 | 65.32 | B000 C |
| ATOM | 7132 | CE | LYS | E | 222 | 12.661 | 104.903 | −22.305 | 1.00 | 75.88 | B000 C |
| ATOM | 7133 | NZ | LYS | E | 222 | 12.007 | 104.696 | −23.635 | 1.00 | 76.97 | B000 N1+ |

TABLE 10.3-continued

| | | | | | | | | | | | |
|---|---|---|---|---|---|---|---|---|---|---|---|
| ATOM | 7134 | N | TRP | E | 223 | 12.133 | 106.321 | −16.298 | 1.00 | 47.14 | B000 | N |
| ATOM | 7135 | CA | TRP | E | 223 | 11.031 | 106.134 | −15.372 | 1.00 | 41.03 | B000 | C |
| ATOM | 7136 | C | TRP | E | 223 | 9.714 | 106.314 | −16.124 | 1.00 | 47.51 | B000 | C |
| ATOM | 7137 | O | TRP | E | 223 | 9.617 | 107.117 | −17.056 | 1.00 | 50.81 | B000 | O |
| ATOM | 7138 | CB | TRP | E | 223 | 11.115 | 107.123 | −14.218 | 1.00 | 39.77 | B000 | C |
| ATOM | 7139 | CG | TRP | E | 223 | 12.293 | 106.912 | −13.328 | 1.00 | 40.93 | B000 | C |
| ATOM | 7140 | CD1 | TRP | E | 223 | 13.467 | 107.621 | −13.338 | 1.00 | 41.70 | B000 | C |
| ATOM | 7141 | CD2 | TRP | E | 223 | 12.410 | 105.957 | −12.270 | 1.00 | 41.60 | B000 | C |
| ATOM | 7142 | NE1 | TRP | E | 223 | 14.311 | 107.148 | −12.366 | 1.00 | 40.09 | B000 | N |
| ATOM | 7143 | CE2 | TRP | E | 223 | 13.688 | 106.129 | −11.692 | 1.00 | 39.35 | B000 | C |
| ATOM | 7144 | CE3 | TRP | E | 223 | 11.561 | 104.962 | −11.758 | 1.00 | 42.49 | B000 | C |
| ATOM | 7145 | CZ2 | TRP | E | 223 | 14.141 | 105.342 | −10.627 | 1.00 | 38.41 | B000 | C |
| ATOM | 7146 | CZ3 | TRP | E | 223 | 12.010 | 104.183 | −10.698 | 1.00 | 39.66 | B000 | C |
| ATOM | 7147 | CH2 | TRP | E | 223 | 13.291 | 104.374 | −10.147 | 1.00 | 37.68 | B000 | C |
| ATOM | 7148 | N | VAL | E | 224 | 8.693 | 105.555 | −15.715 | 1.00 | 38.47 | B000 | N |
| ATOM | 7149 | CA | VAL | E | 224 | 7.441 | 105.568 | −16.467 | 1.00 | 44.59 | B000 | C |
| ATOM | 7150 | C | VAL | E | 224 | 6.732 | 106.924 | −16.423 | 1.00 | 46.85 | B000 | C |
| ATOM | 7151 | O | VAL | E | 224 | 5.908 | 107.197 | −17.298 | 1.00 | 50.06 | B000 | O |
| ATOM | 7152 | CB | VAL | E | 224 | 6.487 | 104.458 | −15.967 | 1.00 | 42.40 | B000 | C |
| ATOM | 7153 | CG1 | VAL | E | 224 | 7.059 | 103.070 | −16.288 | 1.00 | 42.00 | B000 | C |
| ATOM | 7154 | CG2 | VAL | E | 224 | 6.227 | 104.600 | −14.475 | 1.00 | 34.29 | B000 | C |
| ATOM | 7155 | N | ASP | E | 225 | 7.017 | 107.790 | −15.444 | 1.00 | 48.54 | B000 | N |
| ATOM | 7156 | CA | ASP | E | 225 | 6.329 | 109.079 | −15.338 | 1.00 | 53.13 | B000 | C |
| ATOM | 7157 | C | ASP | E | 225 | 7.149 | 110.250 | −15.865 | 1.00 | 51.10 | B000 | C |
| ATOM | 7158 | O | ASP | E | 225 | 6.709 | 111.394 | −15.749 | 1.00 | 47.62 | B000 | O |
| ATOM | 7159 | CB | ASP | E | 225 | 5.898 | 109.358 | −13.886 | 1.00 | 39.25 | B000 | C |
| ATOM | 7160 | CG | ASP | E | 225 | 7.078 | 109.617 | −12.948 | 1.00 | 49.56 | B000 | C |
| ATOM | 7161 | OD1 | ASP | E | 225 | 8.244 | 109.417 | −13.352 | 1.00 | 47.55 | B000 | O |
| ATOM | 7162 | OD2 | ASP | E | 225 | 6.834 | 109.961 | −11.767 | 1.00 | 55.28 | B000 | O1− |
| ATOM | 7163 | N | GLY | E | 226 | 8.319 | 110.001 | −16.449 | 1.00 | 50.70 | B000 | N |
| ATOM | 7164 | CA | GLY | E | 226 | 9.118 | 111.058 | −17.029 | 1.00 | 50.75 | B000 | C |
| ATOM | 7165 | C | GLY | E | 226 | 10.206 | 111.608 | −16.128 | 1.00 | 49.85 | B000 | C |
| ATOM | 7166 | O | GLY | E | 226 | 11.083 | 112.321 | −16.614 | 1.00 | 55.13 | B000 | O |
| ATOM | 7167 | N | THR | E | 227 | 10.149 | 111.328 | −14.832 | 1.00 | 46.51 | B000 | N |
| ATOM | 7168 | CA | THR | E | 227 | 11.258 | 111.622 | −13.942 | 1.00 | 42.53 | B000 | C |
| ATOM | 7169 | C | THR | E | 227 | 12.579 | 111.301 | −14.624 | 1.00 | 50.97 | B000 | C |
| ATOM | 7170 | O | THR | E | 227 | 12.760 | 110.213 | −15.178 | 1.00 | 57.64 | B000 | O |
| ATOM | 7171 | CB | THR | E | 227 | 11.117 | 110.795 | −12.667 | 1.00 | 48.55 | B000 | C |
| ATOM | 7172 | OG1 | THR | E | 227 | 9.834 | 111.037 | −12.070 | 1.00 | 46.24 | B000 | O |
| ATOM | 7173 | CG2 | THR | E | 227 | 12.226 | 111.120 | −11.690 | 1.00 | 41.66 | B000 | C |
| ATOM | 7174 | N | ASP | E | 228 | 13.490 | 112.268 | −14.601 | 1.00 | 59.03 | B000 | N |
| ATOM | 7175 | CA | ASP | E | 228 | 14.770 | 112.131 | −15.280 | 1.00 | 45.94 | B000 | C |
| ATOM | 7176 | C | ASP | E | 228 | 15.624 | 111.088 | −14.580 | 1.00 | 51.75 | B000 | C |
| ATOM | 7177 | O | ASP | E | 228 | 15.872 | 111.182 | −13.374 | 1.00 | 56.28 | B000 | O |
| ATOM | 7178 | CB | ASP | E | 228 | 15.501 | 113.474 | −15.311 | 1.00 | 47.30 | B000 | C |
| ATOM | 7179 | CG | ASP | E | 228 | 16.845 | 113.379 | −15.998 | 1.00 | 56.00 | B000 | C |
| ATOM | 7180 | OD1 | ASP | E | 228 | 16.859 | 113.296 | −17.250 | 1.00 | 54.17 | B000 | O |
| ATOM | 7181 | OD2 | ASP | E | 228 | 17.881 | 113.348 | −15.290 | 1.00 | 56.42 | B000 | O1− |
| ATOM | 7182 | N | TYR | E | 229 | 16.112 | 110.114 | −15.350 | 1.00 | 52.14 | B000 | N |
| ATOM | 7183 | CA | TYR | E | 229 | 16.829 | 109.000 | −14.743 | 1.00 | 46.06 | B000 | C |
| ATOM | 7184 | C | TYR | E | 229 | 18.227 | 109.400 | −14.287 | 1.00 | 47.79 | B000 | C |
| ATOM | 7185 | O | TYR | E | 229 | 18.667 | 108.998 | −13.201 | 1.00 | 47.55 | B000 | O |
| ATOM | 7186 | CB | TYR | E | 229 | 16.901 | 107.830 | −15.729 | 1.00 | 43.66 | B000 | C |
| ATOM | 7187 | CG | TYR | E | 229 | 17.852 | 106.745 | −15.304 | 1.00 | 42.09 | B000 | C |
| ATOM | 7188 | CD1 | TYR | E | 229 | 17.523 | 105.882 | −14.269 | 1.00 | 38.14 | B000 | C |
| ATOM | 7189 | CD2 | TYR | E | 229 | 19.090 | 106.594 | −15.917 | 1.00 | 42.41 | B000 | C |
| ATOM | 7190 | CE1 | TYR | E | 229 | 18.387 | 104.882 | −13.864 | 1.00 | 40.35 | B000 | C |
| ATOM | 7191 | CE2 | TYR | E | 229 | 19.968 | 105.589 | −15.517 | 1.00 | 46.35 | B000 | C |
| ATOM | 7192 | CZ | TYR | E | 229 | 19.599 | 104.734 | −14.486 | 1.00 | 46.45 | B000 | C |
| ATOM | 7193 | OH | TYR | E | 229 | 20.450 | 103.738 | −14.064 | 1.00 | 40.57 | B000 | O |
| ATOM | 7194 | N | GLU | E | 230 | 18.954 | 110.170 | −15.103 | 1.00 | 49.15 | B000 | N |
| ATOM | 7195 | CA | GLU | E | 230 | 20.375 | 110.365 | −14.821 | 1.00 | 46.97 | B000 | C |
| ATOM | 7196 | C | GLU | E | 230 | 20.591 | 111.198 | −13.556 | 1.00 | 51.12 | B000 | C |
| ATOM | 7197 | O | GLU | E | 230 | 21.457 | 110.879 | −12.738 | 1.00 | 53.36 | B000 | O |
| ATOM | 7198 | CB | GLU | E | 230 | 21.082 | 110.992 | −16.017 | 1.00 | 50.20 | B000 | C |
| ATOM | 7199 | CG | GLU | E | 230 | 22.607 | 110.803 | −15.963 | 1.00 | 63.82 | B000 | C |
| ATOM | 7200 | CD | GLU | E | 230 | 23.021 | 109.363 | −15.585 | 1.00 | 76.02 | B000 | C |
| ATOM | 7201 | OE1 | GLU | E | 230 | 22.553 | 108.396 | −16.253 | 1.00 | 66.88 | B000 | O |
| ATOM | 7202 | OE2 | GLU | E | 230 | 23.821 | 109.201 | −14.625 | 1.00 | 79.76 | B000 | O1− |
| ATOM | 7203 | N | THR | E | 231 | 19.809 | 112.248 | −13.359 | 1.00 | 48.10 | B000 | N |
| ATOM | 7204 | CA | THR | E | 231 | 19.981 | 113.081 | −12.176 | 1.00 | 56.05 | B000 | C |
| ATOM | 7205 | C | THR | E | 231 | 19.161 | 112.602 | −10.988 | 1.00 | 60.28 | B000 | C |
| ATOM | 7206 | O | THR | E | 231 | 19.280 | 113.183 | −9.900 | 1.00 | 51.86 | B000 | O |
| ATOM | 7207 | CB | THR | E | 231 | 19.606 | 114.531 | −12.495 | 1.00 | 52.22 | B000 | C |
| ATOM | 7208 | OG1 | THR | E | 231 | 18.217 | 114.591 | −12.844 | 1.00 | 53.83 | B000 | O |
| ATOM | 7209 | CG2 | THR | E | 231 | 20.445 | 115.043 | −13.668 | 1.00 | 46.56 | B000 | C |
| ATOM | 7210 | N | GLY | E | 232 | 18.363 | 111.540 | −11.160 | 1.00 | 55.84 | B000 | N |
| ATOM | 7211 | CA | GLY | E | 232 | 17.470 | 111.077 | −10.123 | 1.00 | 48.35 | B000 | C |
| ATOM | 7212 | C | GLY | E | 232 | 18.105 | 110.067 | −9.184 | 1.00 | 48.84 | B000 | C |
| ATOM | 7213 | O | GLY | E | 232 | 19.249 | 109.642 | −9.345 | 1.00 | 44.82 | B000 | O |

TABLE 10.3-continued

| | | | | | | | | | | | |
|---|---|---|---|---|---|---|---|---|---|---|---|
| ATOM | 7214 | N | PHE | E | 233 | 17.313 | 109.679 | −8.185 | 1.00 | 47.45 | B000 N |
| ATOM | 7215 | CA | PHE | E | 233 | 17.724 | 108.672 | −7.218 | 1.00 | 45.48 | B000 C |
| ATOM | 7216 | C | PHE | E | 233 | 17.998 | 107.339 | −7.920 | 1.00 | 45.39 | B000 C |
| ATOM | 7217 | O | PHE | E | 233 | 17.309 | 106.963 | −8.870 | 1.00 | 43.33 | B000 O |
| ATOM | 7218 | CB | PHE | E | 233 | 16.627 | 108.531 | −6.141 | 1.00 | 43.07 | B000 C |
| ATOM | 7219 | CG | PHE | E | 233 | 16.952 | 107.537 | −5.062 | 1.00 | 49.50 | B000 C |
| ATOM | 7220 | CD1 | PHE | E | 233 | 17.819 | 107.865 | −4.031 | 1.00 | 49.13 | B000 C |
| ATOM | 7221 | CD2 | PHE | E | 233 | 16.393 | 106.267 | −5.077 | 1.00 | 46.36 | B000 C |
| ATOM | 7222 | CE1 | PHE | E | 233 | 18.130 | 106.941 | −3.043 | 1.00 | 56.48 | B000 C |
| ATOM | 7223 | CE2 | PHE | E | 233 | 16.703 | 105.332 | −4.089 | 1.00 | 43.16 | B000 C |
| ATOM | 7224 | CZ | PHE | E | 233 | 17.570 | 105.668 | −3.073 | 1.00 | 50.08 | B000 C |
| ATOM | 7225 | N | LYS | E | 234 | 19.027 | 106.631 | −7.461 | 1.00 | 43.29 | B000 N |
| ATOM | 7226 | CA | LYS | E | 234 | 19.350 | 105.304 | −7.964 | 1.00 | 42.55 | B000 C |
| ATOM | 7227 | C | LYS | E | 234 | 19.835 | 104.464 | −6.800 | 1.00 | 48.47 | B000 C |
| ATOM | 7228 | O | LYS | E | 234 | 20.501 | 104.989 | −5.904 | 1.00 | 44.87 | B000 O |
| ATOM | 7229 | CB | LYS | E | 234 | 20.433 | 105.329 | −9.047 | 1.00 | 43.84 | B000 C |
| ATOM | 7230 | CG | LYS | E | 234 | 20.093 | 106.096 | −10.319 | 1.00 | 43.53 | B000 C |
| ATOM | 7231 | CD | LYS | E | 234 | 21.305 | 106.028 | −11.250 | 1.00 | 42.53 | B000 C |
| ATOM | 7232 | CE | LYS | E | 234 | 21.235 | 107.016 | −12.398 | 1.00 | 46.96 | B000 C |
| ATOM | 7233 | NZ | LYS | E | 234 | 21.273 | 108.424 | −11.907 | 1.00 | 55.21 | B000 N1+ |
| ATOM | 7234 | N | ASN | E | 235 | 19.486 | 103.171 | −6.793 | 1.00 | 46.39 | B000 N |
| ATOM | 7235 | CA | ASN | E | 235 | 19.925 | 105.276 | −5.717 | 1.00 | 42.44 | B000 C |
| ATOM | 7236 | C | ASN | E | 235 | 20.263 | 100.885 | −6.277 | 1.00 | 41.99 | B000 C |
| ATOM | 7237 | O | ASN | E | 235 | 19.881 | 99.849 | −5.728 | 1.00 | 41.55 | B000 O |
| ATOM | 7238 | CB | ASN | E | 235 | 18.867 | 102.211 | −4.605 | 1.00 | 37.90 | B000 C |
| ATOM | 7239 | CG | ASN | E | 235 | 19.353 | 101.448 | −3.380 | 1.00 | 40.64 | B000 C |
| ATOM | 7240 | OD1 | ASN | E | 235 | 20.538 | 101.458 | −3.079 | 1.00 | 45.11 | B000 O |
| ATOM | 7241 | ND2 | ASN | E | 235 | 18.449 | 100.769 | −2.685 | 1.00 | 41.74 | B000 N |
| ATOM | 7242 | N | TRP | E | 236 | 21.051 | 100.853 | −7.346 | 1.00 | 39.52 | B000 N |
| ATOM | 7243 | CA | TRP | E | 236 | 21.407 | 99.599 | −7.994 | 1.00 | 37.91 | B000 C |
| ATOM | 7244 | C | TRP | E | 236 | 22.266 | 98.720 | −7.099 | 1.00 | 42.70 | B000 C |
| ATOM | 7245 | O | TRP | E | 236 | 23.054 | 99.199 | −6.281 | 1.00 | 46.72 | B000 O |
| ATOM | 7246 | CB | TRP | E | 236 | 22.178 | 99.848 | −9.299 | 1.00 | 34.60 | B000 C |
| ATOM | 7247 | CG | TRP | E | 236 | 21.377 | 100.494 | −10.396 | 1.00 | 43.16 | B000 C |
| ATOM | 7248 | CD1 | TRP | E | 236 | 21.452 | 101.794 | −10.810 | 1.00 | 36.82 | B000 C |
| ATOM | 7249 | CD2 | TRP | E | 236 | 20.363 | 99.873 | −11.207 | 1.00 | 38.15 | B000 C |
| ATOM | 7250 | NE1 | TRP | E | 236 | 20.565 | 102.017 | −11.839 | 1.00 | 41.26 | B000 N |
| ATOM | 7251 | CE2 | TRP | E | 236 | 19.884 | 100.857 | −12.103 | 1.00 | 39.75 | B000 C |
| ATOM | 7252 | CE3 | TRP | E | 236 | 19.831 | 98.581 | −11.273 | 1.00 | 36.10 | B000 C |
| ATOM | 7253 | CZ2 | TRP | E | 236 | 18.894 | 100.591 | −13.054 | 1.00 | 35.54 | B000 C |
| ATOM | 7254 | CZ3 | TRP | E | 236 | 18.850 | 98.311 | −12.219 | 1.00 | 35.95 | B000 C |
| ATOM | 7255 | CH2 | TRP | E | 236 | 18.389 | 99.317 | −13.096 | 1.00 | 41.76 | B000 C |
| ATOM | 7256 | N | ARG | E | 237 | 22.102 | 97.410 | −7.274 | 1.00 | 45.40 | B000 N |
| ATOM | 7257 | CA | ARG | E | 237 | 23.050 | 96.440 | −6.763 | 1.00 | 47.18 | B000 C |
| ATOM | 7258 | C | ARG | E | 237 | 24.449 | 96.720 | −7.314 | 1.00 | 51.81 | B000 C |
| ATOM | 7259 | O | ARG | E | 237 | 24.595 | 97.350 | −8.368 | 1.00 | 43.69 | B000 O |
| ATOM | 7260 | CB | ARG | E | 237 | 22.634 | 95.041 | −7.185 | 1.00 | 46.24 | B000 C |
| ATOM | 7261 | CG | ARG | E | 237 | 21.530 | 94.422 | −6.393 | 1.00 | 51.40 | B000 C |
| ATOM | 7262 | CD | ARG | E | 237 | 22.096 | 93.585 | −5.285 | 1.00 | 58.45 | B000 C |
| ATOM | 7263 | NE | ARG | E | 237 | 21.038 | 92.772 | −4.710 | 1.00 | 70.66 | B000 N |
| ATOM | 7264 | CZ | ARG | E | 237 | 21.262 | 91.703 | −3.961 | 1.00 | 72.34 | B000 C |
| ATOM | 7265 | NH1 | ARG | E | 237 | 20.232 | 90.990 | −3.494 | 1.00 | 63.81 | B000 N1+ |
| ATOM | 7266 | NH2 | ARG | E | 237 | 22.525 | 91.368 | −3.681 | 1.00 | 60.30 | B000 N |
| ATOM | 7267 | N | PRO | E | 238 | 25.489 | 96.240 | −6.628 | 1.00 | 52.18 | B000 N |
| ATOM | 7268 | CA | PRO | E | 238 | 26.853 | 96.359 | −7.163 | 1.00 | 56.03 | B000 C |
| ATOM | 7269 | C | PRO | E | 238 | 26.950 | 95.788 | −8.569 | 1.00 | 52.87 | B000 C |
| ATOM | 7270 | O | PRO | E | 238 | 26.528 | 94.660 | −8.830 | 1.00 | 56.32 | B000 O |
| ATOM | 7271 | CB | PRO | E | 238 | 27.694 | 95.545 | −6.171 | 1.00 | 52.68 | B000 C |
| ATOM | 7272 | CG | PRO | E | 238 | 26.934 | 95.614 | −4.891 | 1.00 | 56.74 | B000 C |
| ATOM | 7273 | CD | PRO | E | 238 | 25.473 | 95.617 | −5.291 | 1.00 | 58.40 | B000 C |
| ATOM | 7274 | N | GLU | E | 239 | 27.508 | 96.588 | −9.477 | 1.00 | 54.34 | B000 N |
| ATOM | 7275 | CA | GLU | E | 239 | 27.753 | 96.254 | −10.877 | 1.00 | 53.49 | B000 C |
| ATOM | 7276 | C | GLU | E | 239 | 26.481 | 96.144 | −11.711 | 1.00 | 55.15 | B000 C |
| ATOM | 7277 | O | GLU | E | 239 | 26.545 | 95.684 | −12.862 | 1.00 | 57.25 | B000 O |
| ATOM | 7278 | CB | GLU | E | 239 | 28.578 | 94.974 | −11.029 | 1.00 | 50.60 | B000 C |
| ATOM | 7279 | CG | GLU | E | 239 | 30.001 | 95.104 | −10.514 | 1.00 | 66.65 | B000 C |
| ATOM | 7280 | CD | GLU | E | 239 | 30.663 | 93.760 | −10.297 | 1.00 | 83.88 | B000 C |
| ATOM | 7281 | OE1 | GLU | E | 239 | 30.038 | 92.728 | −10.639 | 1.00 | 75.71 | B000 O |
| ATOM | 7282 | OE2 | GLU | E | 239 | 31.816 | 93.739 | −9.808 | 1.00 | 96.45 | B000 O1− |
| ATOM | 7283 | N | GLN | E | 240 | 25.336 | 96.571 | −11.187 | 1.00 | 42.77 | B000 N |
| ATOM | 7284 | CA | GLN | E | 240 | 24.126 | 96.666 | −11.990 | 1.00 | 44.13 | B000 C |
| ATOM | 7285 | C | GLN | E | 240 | 23.886 | 98.142 | −12.320 | 1.00 | 39.19 | B000 C |
| ATOM | 7286 | O | GLN | E | 240 | 24.353 | 99.013 | −11.600 | 1.00 | 37.74 | B000 O |
| ATOM | 7287 | CB | GLN | E | 240 | 22.931 | 96.054 | −11.253 | 1.00 | 41.92 | B000 C |
| ATOM | 7288 | CG | GLN | E | 240 | 23.174 | 94.638 | −10.737 | 1.00 | 41.56 | B000 C |
| ATOM | 7289 | CD | GLN | E | 240 | 23.857 | 93.758 | −11.761 | 1.00 | 47.34 | B000 C |
| ATOM | 7290 | OE1 | GLN | E | 240 | 23.461 | 93.713 | −12.927 | 1.00 | 45.90 | B000 O |
| ATOM | 7291 | NE2 | GLN | E | 240 | 24.908 | 93.071 | −11.336 | 1.00 | 53.15 | B000 N |
| ATOM | 7292 | N | PRO | E | 241 | 23.176 | 98.433 | −13.423 | 1.00 | 39.17 | B000 N |
| ATOM | 7293 | CA | PRO | E | 241 | 22.582 | 97.492 | −14.382 | 1.00 | 41.50 | B000 C |

TABLE 10.3-continued

| ATOM | 7294 | C | PRO | E | 241 | 23.654 | 96.945 | −15.327 | 1.00 | 39.88 | B000 | C |
|---|---|---|---|---|---|---|---|---|---|---|---|---|
| ATOM | 7295 | O | PRO | E | 241 | 24.800 | 97.332 | −15.130 | 1.00 | 47.11 | B000 | O |
| ATOM | 7296 | CB | PRO | E | 241 | 21.539 | 98.350 | −15.114 | 1.00 | 41.31 | B000 | C |
| ATOM | 7297 | CG | PRO | E | 241 | 22.116 | 99.770 | −15.042 | 1.00 | 40.16 | B000 | C |
| ATOM | 7298 | CD | PRO | E | 241 | 22.851 | 99.844 | −13.732 | 1.00 | 35.10 | B000 | C |
| ATOM | 7299 | N | ASP | E | 242 | 23.325 | 96.074 | −16.287 | 1.00 | 39.07 | B000 | N |
| ATOM | 7300 | CA | ASP | E | 242 | 24.337 | 95.571 | −17.221 | 1.00 | 42.10 | B000 | C |
| ATOM | 7301 | C | ASP | E | 242 | 25.112 | 96.732 | −17.827 | 1.00 | 45.64 | B000 | C |
| ATOM | 7302 | O | ASP | E | 242 | 24.512 | 97.697 | −18.317 | 1.00 | 42.87 | B000 | O |
| ATOM | 7303 | CB | ASP | E | 242 | 23.691 | 94.761 | −18.348 | 1.00 | 42.84 | B000 | C |
| ATOM | 7304 | CG | ASP | E | 242 | 22.886 | 93.568 | −17.852 | 1.00 | 43.37 | B000 | C |
| ATOM | 7305 | OD1 | ASP | E | 242 | 23.330 | 92.905 | −16.895 | 1.00 | 46.50 | B000 | O |
| ATOM | 7306 | OD2 | ASP | E | 242 | 21.800 | 93.308 | −18.430 | 1.00 | 43.11 | B000 | O1− |
| ATOM | 7307 | N | ASP | E | 243 | 26.448 | 96.634 | −17.808 | 1.00 | 39.31 | B000 | N |
| ATOM | 7308 | CA | ASP | E | 243 | 27.300 | 97.761 | −18.190 | 1.00 | 47.79 | B000 | C |
| ATOM | 7309 | C | ASP | E | 243 | 27.812 | 97.693 | −19.621 | 1.00 | 43.78 | B000 | C |
| ATOM | 7310 | O | ASP | E | 243 | 28.698 | 98.475 | −19.976 | 1.00 | 46.39 | B000 | O |
| ATOM | 7311 | CB | ASP | E | 243 | 28.506 | 97.880 | −17.250 | 1.00 | 43.08 | B000 | C |
| ATOM | 7312 | CG | ASP | E | 243 | 29.395 | 96.633 | −17.252 | 1.00 | 54.01 | B000 | C |
| ATOM | 7313 | OD1 | ASP | E | 243 | 29.151 | 95.676 | −18.025 | 1.00 | 56.31 | B000 | O |
| ATOM | 7314 | OD2 | ASP | E | 243 | 30.350 | 96.604 | −16.453 | 1.00 | 60.30 | B000 | O1− |
| ATOM | 7315 | N | TRP | E | 244 | 27.332 | 96.754 | −20.435 | 1.00 | 42.79 | B000 | N |
| ATOM | 7316 | CA | TRP | E | 244 | 27.941 | 96.563 | −21.742 | 1.00 | 44.21 | B000 | C |
| ATOM | 7317 | C | TRP | E | 244 | 27.283 | 97.361 | −22.860 | 1.00 | 43.63 | B000 | C |
| ATOM | 7318 | O | TRP | E | 244 | 27.674 | 97.194 | −24.018 | 1.00 | 43.92 | B000 | O |
| ATOM | 7319 | CB | TRP | E | 244 | 28.043 | 95.072 | −22.108 | 1.00 | 43.09 | B000 | C |
| ATOM | 7320 | CG | TRP | E | 244 | 26.891 | 94.182 | −21.886 | 1.00 | 44.80 | B000 | C |
| ATOM | 7321 | CD1 | TRP | E | 244 | 25.879 | 93.900 | −22.770 | 1.00 | 47.43 | B000 | C |
| ATOM | 7322 | CD2 | TRP | E | 244 | 26.668 | 93.355 | −20.746 | 1.00 | 43.82 | B000 | C |
| ATOM | 7323 | NE1 | TRP | E | 244 | 25.016 | 92.980 | −22.226 | 1.00 | 44.04 | B000 | N |
| ATOM | 7324 | CE2 | TRP | E | 244 | 25.482 | 92.621 | −20.987 | 1.00 | 46.21 | B000 | C |
| ATOM | 7325 | CE3 | TRP | E | 244 | 27.346 | 93.171 | −19.540 | 1.00 | 42.76 | B000 | C |
| ATOM | 7326 | CZ2 | TRP | E | 244 | 24.957 | 91.729 | −20.060 | 1.00 | 44.01 | B000 | C |
| ATOM | 7327 | CZ3 | TRP | E | 244 | 26.827 | 92.292 | −18.622 | 1.00 | 42.24 | B000 | C |
| ATOM | 7328 | CH2 | TRP | E | 244 | 25.641 | 91.579 | −18.883 | 1.00 | 49.08 | B000 | C |
| ATOM | 7329 | N | TYR | E | 245 | 26.330 | 98.242 | −22.550 | 1.00 | 43.45 | B000 | N |
| ATOM | 7330 | CA | TYR | E | 245 | 25.626 | 99.013 | −23.574 | 1.00 | 45.01 | B000 | C |
| ATOM | 7331 | C | TYR | E | 245 | 26.012 | 100.481 | −23.628 | 1.00 | 42.12 | B000 | C |
| ATOM | 7332 | O | TYR | E | 245 | 25.598 | 101.169 | −24.560 | 1.00 | 45.10 | B000 | O |
| ATOM | 7333 | CB | TYR | E | 245 | 24.099 | 98.947 | −23.366 | 1.00 | 42.26 | B000 | C |
| ATOM | 7334 | CG | TYR | E | 245 | 23.544 | 97.553 | −23.256 | 1.00 | 43.72 | B000 | C |
| ATOM | 7335 | CD1 | TYR | E | 245 | 23.355 | 96.770 | −24.391 | 1.00 | 40.29 | B000 | C |
| ATOM | 7336 | CD2 | TYR | E | 245 | 23.224 | 97.006 | −22.016 | 1.00 | 39.35 | B000 | C |
| ATOM | 7337 | CE1 | TYR | E | 245 | 22.841 | 95.500 | −24.301 | 1.00 | 39.08 | B000 | C |
| ATOM | 7338 | CE2 | TYR | E | 245 | 22.717 | 95.722 | −21.918 | 1.00 | 43.84 | B000 | C |
| ATOM | 7339 | CZ | TYR | E | 245 | 22.533 | 94.976 | −23.064 | 1.00 | 41.96 | B000 | C |
| ATOM | 7340 | OH | TYR | E | 245 | 22.036 | 93.706 | −22.975 | 1.00 | 45.97 | B000 | O |
| ATOM | 7341 | N | GLY | E | 246 | 26.710 | 101.001 | −22.638 | 1.00 | 41.64 | B000 | N |
| ATOM | 7342 | CA | GLY | E | 246 | 26.989 | 102.420 | −22.592 | 1.00 | 43.53 | B000 | C |
| ATOM | 7343 | C | GLY | E | 246 | 26.255 | 103.119 | −21.455 | 1.00 | 47.49 | B000 | C |
| ATOM | 7344 | O | GLY | E | 246 | 25.273 | 102.626 | −20.898 | 1.00 | 44.82 | B000 | O |
| ATOM | 7345 | N | HIS | E | 247 | 26.714 | 104.343 | −21.189 | 1.00 | 50.58 | B000 | N |
| ATOM | 7346 | CA | HIS | E | 247 | 26.284 | 105.118 | −20.030 | 1.00 | 42.87 | B000 | C |
| ATOM | 7347 | C | HIS | E | 247 | 24.783 | 105.367 | −20.033 | 1.00 | 44.35 | B000 | C |
| ATOM | 7348 | O | HIS | E | 247 | 24.236 | 105.933 | −20.985 | 1.00 | 45.35 | B000 | O |
| ATOM | 7349 | CB | HIS | E | 247 | 27.044 | 106.440 | −20.003 | 1.00 | 53.73 | B000 | C |
| ATOM | 7350 | CG | HIS | E | 247 | 26.584 | 107.373 | −18.933 | 1.00 | 56.75 | B000 | C |
| ATOM | 7351 | ND1 | HIS | E | 247 | 26.920 | 107.206 | −17.607 | 1.00 | 59.80 | B000 | N |
| ATOM | 7352 | CD2 | HIS | E | 247 | 25.799 | 108.476 | −18.991 | 1.00 | 55.82 | B000 | C |
| ATOM | 7353 | CE1 | HIS | E | 247 | 26.367 | 108.172 | −16.894 | 1.00 | 66.18 | B000 | C |
| ATOM | 7354 | NE2 | HIS | E | 247 | 25.682 | 108.956 | −17.710 | 1.00 | 63.47 | B000 | N |
| ATOM | 7355 | N | GLY | E | 248 | 24.117 | 104.949 | −18.954 | 1.00 | 45.02 | B000 | N |
| ATOM | 7356 | CA | GLY | E | 248 | 22.680 | 105.131 | −18.847 | 1.00 | 45.46 | B000 | C |
| ATOM | 7357 | C | GLY | E | 248 | 21.849 | 104.287 | −19.791 | 1.00 | 46.59 | B000 | C |
| ATOM | 7358 | O | GLY | E | 248 | 20.659 | 104.568 | −19.979 | 1.00 | 40.42 | B000 | O |
| ATOM | 7359 | N | LEU | E | 249 | 22.431 | 103.242 | −20.380 | 1.00 | 42.75 | B000 | N |
| ATOM | 7360 | CA | LEU | E | 249 | 21.760 | 102.493 | −21.430 | 1.00 | 42.93 | B000 | C |
| ATOM | 7361 | C | LEU | E | 249 | 21.579 | 101.026 | −21.050 | 1.00 | 42.71 | B000 | C |
| ATOM | 7362 | O | LEU | E | 249 | 22.327 | 100.466 | −20.239 | 1.00 | 35.38 | B000 | O |
| ATOM | 7363 | CB | LEU | E | 249 | 22.536 | 102.595 | −22.750 | 1.00 | 39.36 | B000 | C |
| ATOM | 7364 | CG | LEU | E | 249 | 22.689 | 104.006 | −23.343 | 1.00 | 42.86 | B000 | C |
| ATOM | 7365 | CD1 | LEU | E | 249 | 23.340 | 103.916 | −24.714 | 1.00 | 39.37 | B000 | C |
| ATOM | 7366 | CD2 | LEU | E | 249 | 21.350 | 104.700 | −23.442 | 1.00 | 40.64 | B000 | C |
| ATOM | 7367 | N | GLY | E | 250 | 20.569 | 100.410 | −21.653 | 1.00 | 40.13 | B000 | N |
| ATOM | 7368 | CA | GLY | E | 250 | 20.394 | 98.976 | −21.584 | 1.00 | 34.39 | B000 | C |
| ATOM | 7369 | C | GLY | E | 250 | 20.162 | 98.460 | −22.986 | 1.00 | 42.96 | B000 | C |
| ATOM | 7370 | O | GLY | E | 250 | 20.251 | 99.242 | −23.936 | 1.00 | 39.19 | B000 | O |
| ATOM | 7371 | N | GLY | E | 251 | 19.857 | 97.167 | −23.135 | 1.00 | 42.21 | B000 | N |
| ATOM | 7372 | CA | GLY | E | 251 | 19.622 | 96.533 | −24.418 | 1.00 | 38.08 | B000 | C |
| ATOM | 7373 | C | GLY | E | 251 | 18.179 | 96.437 | −24.892 | 1.00 | 41.51 | B000 | C |

TABLE 10.3-continued

| ATOM | 7374 | O | GLY | E | 251 | 17.932 | 95.813 | −25.932 | 1.00 | 47.66 | B000 | O |
|---|---|---|---|---|---|---|---|---|---|---|---|---|
| ATOM | 7375 | N | GLY | E | 252 | 17.209 | 97.010 | −24.169 | 1.00 | 45.08 | B000 | N |
| ATOM | 7376 | CA | GLY | E | 252 | 15.832 | 97.049 | −24.628 | 1.00 | 44.10 | B000 | C |
| ATOM | 7377 | C | GLY | E | 252 | 14.893 | 95.971 | −24.115 | 1.00 | 40.91 | B000 | C |
| ATOM | 7378 | O | GLY | E | 252 | 13.707 | 96.009 | −24.452 | 1.00 | 51.51 | B000 | O |
| ATOM | 7379 | N | GLU | E | 253 | 15.380 | 94.997 | −23.351 | 1.00 | 49.13 | B000 | N |
| ATOM | 7380 | CA | GLU | E | 253 | 14.569 | 93.886 | −22.849 | 1.00 | 44.54 | B000 | C |
| ATOM | 7381 | C | GLU | E | 253 | 14.410 | 93.867 | −21.335 | 1.00 | 40.80 | B000 | C |
| ATOM | 7382 | O | GLU | E | 253 | 13.844 | 92.902 | −20.810 | 1.00 | 43.41 | B000 | O |
| ATOM | 7383 | CB | GLU | E | 253 | 15.180 | 92.537 | −23.273 | 1.00 | 49.30 | B000 | C |
| ATOM | 7384 | CG | GLU | E | 253 | 15.553 | 92.443 | −24.748 | 1.00 | 58.40 | B000 | C |
| ATOM | 7385 | CD | GLU | E | 253 | 14.373 | 92.111 | −25.651 | 1.00 | 68.11 | B000 | C |
| ATOM | 7386 | OE1 | GLU | E | 253 | 13.919 | 90.934 | −25.628 | 1.00 | 71.69 | B000 | O |
| ATOM | 7387 | OE2 | GLU | E | 253 | 13.900 | 93.027 | −26.378 | 1.00 | 62.49 | B000 | O1− |
| ATOM | 7388 | N | ASP | E | 254 | 14.951 | 94.848 | −20.611 | 1.00 | 41.14 | B000 | N |
| ATOM | 7389 | CA | ASP | E | 254 | 15.056 | 94.754 | −19.159 | 1.00 | 36.67 | B000 | C |
| ATOM | 7390 | C | ASP | E | 254 | 14.148 | 95.742 | −18.448 | 1.00 | 37.02 | B000 | C |
| ATOM | 7391 | O | ASP | E | 254 | 13.733 | 96.776 | −18.990 | 1.00 | 37.00 | B000 | O |
| ATOM | 7392 | CB | ASP | E | 254 | 16.497 | 94.967 | −18.685 | 1.00 | 34.36 | B000 | C |
| ATOM | 7393 | CG | ASP | E | 254 | 17.333 | 93.693 | −18.779 | 1.00 | 37.96 | B000 | C |
| ATOM | 7394 | OD1 | ASP | E | 254 | 16.776 | 92.662 | −19.226 | 1.00 | 36.64 | B000 | O |
| ATOM | 7395 | OD2 | ASP | E | 254 | 18.547 | 93.740 | −18.453 | 1.00 | 41.46 | B000 | O1− |
| ATOM | 7396 | N | CYS | E | 255 | 13.822 | 95.368 | −17.219 | 1.00 | 35.51 | B000 | N |
| ATOM | 7397 | CA | CYS | E | 255 | 13.086 | 96.210 | −16.300 | 1.00 | 32.38 | B000 | C |
| ATOM | 7398 | C | CYS | E | 255 | 13.781 | 96.107 | −14.955 | 1.00 | 37.45 | B000 | C |
| ATOM | 7399 | O | CYS | E | 255 | 14.493 | 95.137 | −14.689 | 1.00 | 34.78 | B000 | O |
| ATOM | 7400 | CB | CYS | E | 255 | 11.612 | 95.789 | −16.219 | 1.00 | 34.76 | B000 | C |
| ATOM | 7401 | SG | CYS | E | 255 | 10.671 | 96.035 | −17.761 | 1.00 | 37.35 | B000 | S |
| ATOM | 7402 | N | ALA | E | 256 | 13.609 | 97.138 | −14.123 | 1.00 | 31.93 | B000 | N |
| ATOM | 7403 | CA | ALA | E | 256 | 14.263 | 97.192 | −12.823 | 1.00 | 34.86 | B000 | C |
| ATOM | 7404 | C | ALA | E | 256 | 13.329 | 96.663 | −11.744 | 1.00 | 35.59 | B000 | C |
| ATOM | 7405 | O | ALA | E | 256 | 12.138 | 96.994 | −11.720 | 1.00 | 30.92 | B000 | O |
| ATOM | 7406 | CB | ALA | E | 256 | 14.688 | 98.621 | −12.480 | 1.00 | 33.92 | B000 | C |
| ATOM | 7407 | N | HIS | E | 257 | 13.870 | 95.833 | −10.854 | 1.00 | 28.95 | B000 | N |
| ATOM | 7408 | CA | HIS | E | 257 | 13.097 | 95.348 | −9.721 | 1.00 | 35.16 | B000 | C |
| ATOM | 7409 | C | HIS | E | 257 | 13.897 | 95.485 | −8.434 | 1.00 | 35.13 | B000 | C |
| ATOM | 7410 | O | HIS | E | 257 | 15.130 | 95.402 | −8.425 | 1.00 | 34.18 | B000 | O |
| ATOM | 7411 | CB | HIS | E | 257 | 12.655 | 93.884 | −9.909 | 1.00 | 30.40 | B000 | C |
| ATOM | 7412 | CG | HIS | E | 257 | 13.789 | 92.909 | −10.005 | 1.00 | 36.00 | B000 | C |
| ATOM | 7413 | ND1 | HIS | E | 257 | 14.213 | 92.160 | −8.930 | 1.00 | 36.61 | B000 | N |
| ATOM | 7414 | CD2 | HIS | E | 257 | 14.576 | 92.547 | −11.050 | 1.00 | 29.26 | B000 | C |
| ATOM | 7415 | CE1 | HIS | E | 257 | 15.205 | 91.373 | −9.306 | 1.00 | 36.08 | B000 | C |
| ATOM | 7416 | NE2 | HIS | E | 257 | 15.444 | 91.589 | −10.588 | 1.00 | 41.23 | B000 | N |
| ATOM | 7417 | N | PHE | E | 258 | 13.178 | 95.722 | −7.344 | 1.00 | 32.98 | B000 | N |
| ATOM | 7418 | CA | PHE | E | 258 | 13.783 | 95.567 | −6.036 | 1.00 | 35.47 | B000 | C |
| ATOM | 7419 | C | PHE | E | 258 | 14.126 | 94.102 | −5.825 | 1.00 | 36.56 | B000 | C |
| ATOM | 7420 | O | PHE | E | 258 | 13.342 | 93.217 | −6.182 | 1.00 | 37.64 | B000 | O |
| ATOM | 7421 | CB | PHE | E | 258 | 12.828 | 96.024 | −4.943 | 1.00 | 34.07 | B000 | C |
| ATOM | 7422 | CG | PHE | E | 258 | 12.279 | 97.408 | −5.140 | 1.00 | 36.26 | B000 | C |
| ATOM | 7423 | CD1 | PHE | E | 258 | 12.991 | 98.528 | −4.707 | 1.00 | 31.80 | B000 | C |
| ATOM | 7424 | CD2 | PHE | E | 258 | 11.025 | 97.588 | −5.714 | 1.00 | 31.31 | B000 | C |
| ATOM | 7425 | CE1 | PHE | E | 258 | 12.469 | 99.798 | −4.865 | 1.00 | 33.16 | B000 | C |
| ATOM | 7426 | CE2 | PHE | E | 258 | 10.492 | 98.861 | −5.882 | 1.00 | 39.41 | B000 | C |
| ATOM | 7427 | CZ | PHE | E | 258 | 11.208 | 99.972 | −5.462 | 1.00 | 34.38 | B000 | C |
| ATOM | 7428 | N | THR | E | 259 | 15.302 | 93.853 | −5.249 | 1.00 | 37.86 | B000 | N |
| ATOM | 7429 | CA | THR | E | 259 | 15.716 | 92.540 | −4.772 | 1.00 | 42.13 | B000 | C |
| ATOM | 7430 | C | THR | E | 259 | 15.405 | 92.419 | −3.289 | 1.00 | 44.25 | B000 | C |
| ATOM | 7431 | O | THR | E | 259 | 14.879 | 93.339 | −2.660 | 1.00 | 47.92 | B000 | O |
| ATOM | 7432 | CB | THR | E | 259 | 17.209 | 92.303 | −4.996 | 1.00 | 42.54 | B000 | C |
| ATOM | 7433 | OG1 | THR | E | 259 | 17.953 | 93.161 | −4.117 | 1.00 | 44.35 | B000 | O |
| ATOM | 7434 | CG2 | THR | E | 259 | 17.579 | 92.593 | −6.433 | 1.00 | 39.50 | B000 | C |
| ATOM | 7435 | N | ASP | E | 260 | 15.785 | 91.280 | −2.712 | 1.00 | 46.15 | B000 | N |
| ATOM | 7436 | CA | ASP | E | 260 | 15.408 | 91.003 | −1.334 | 1.00 | 48.77 | B000 | C |
| ATOM | 7437 | C | ASP | E | 260 | 16.141 | 91.866 | −0.318 | 1.00 | 51.79 | B000 | C |
| ATOM | 7438 | O | ASP | E | 260 | 15.772 | 91.841 | 0.862 | 1.00 | 57.39 | B000 | O |
| ATOM | 7439 | CB | ASP | E | 260 | 15.627 | 89.530 | −1.002 | 1.00 | 48.59 | B000 | C |
| ATOM | 7440 | CG | ASP | E | 260 | 17.039 | 89.064 | −1.282 | 1.00 | 52.19 | B000 | C |
| ATOM | 7441 | OD1 | ASP | E | 260 | 17.934 | 89.890 | −1.563 | 1.00 | 54.71 | B000 | O |
| ATOM | 7442 | OD2 | ASP | E | 260 | 17.255 | 87.847 | −1.199 | 1.00 | 57.65 | B000 | O1− |
| ATOM | 7443 | N | ASP | E | 261 | 17.175 | 92.602 | −0.719 | 1.00 | 46.10 | B000 | N |
| ATOM | 7444 | CA | ASP | E | 261 | 17.795 | 93.567 | 0.177 | 1.00 | 47.68 | B000 | C |
| ATOM | 7445 | C | ASP | E | 261 | 17.411 | 95.007 | −0.158 | 1.00 | 43.64 | B000 | C |
| ATOM | 7446 | O | ASP | E | 261 | 17.959 | 95.938 | 0.434 | 1.00 | 50.15 | B000 | O |
| ATOM | 7447 | CB | ASP | E | 261 | 19.322 | 93.386 | 0.195 | 1.00 | 43.46 | B000 | C |
| ATOM | 7448 | CG | ASP | E | 261 | 20.013 | 93.851 | −1.092 | 1.00 | 51.38 | B000 | C |
| ATOM | 7449 | OD1 | ASP | E | 261 | 19.414 | 94.549 | −1.938 | 1.00 | 53.10 | B000 | O |
| ATOM | 7450 | OD2 | ASP | E | 261 | 21.201 | 93.523 | −1.249 | 1.00 | 61.28 | B000 | O1− |
| ATOM | 7451 | N | GLY | E | 262 | 16.490 | 95.208 | −1.098 | 1.00 | 41.82 | B000 | N |
| ATOM | 7452 | CA | GLY | E | 262 | 16.009 | 96.524 | −1.460 | 1.00 | 37.30 | B000 | C |
| ATOM | 7453 | C | GLY | E | 262 | 16.761 | 97.180 | −2.597 | 1.00 | 36.57 | B000 | C |

TABLE 10.3-continued

| | | | | | | | | | | | |
|---|---|---|---|---|---|---|---|---|---|---|---|
| ATOM | 7454 | O | GLY | E | 262 | 16.212 | 98.052 | −3.272 | 1.00 | 41.75 | B000 O |
| ATOM | 7455 | N | ARG | E | 263 | 18.012 | 96.804 | −2.802 | 1.00 | 38.36 | B000 N |
| ATOM | 7456 | CA | ARG | E | 263 | 18.764 | 97.311 | −3.928 | 1.00 | 41.20 | B000 C |
| ATOM | 7457 | C | ARG | E | 263 | 18.224 | 96.727 | −5.227 | 1.00 | 45.69 | B000 C |
| ATOM | 7458 | O | ARG | E | 263 | 17.553 | 95.687 | −5.250 | 1.00 | 42.28 | B000 O |
| ATOM | 7459 | CB | ARG | E | 263 | 20.242 | 96.991 | −3.749 | 1.00 | 41.55 | B000 C |
| ATOM | 7460 | CG | ARG | E | 263 | 20.841 | 97.820 | −2.615 | 1.00 | 42.80 | B000 C |
| ATOM | 7461 | CD | ARG | E | 263 | 22.274 | 97.464 | −2.375 | 1.00 | 42.94 | B000 C |
| ATOM | 7462 | NE | ARG | E | 263 | 22.431 | 96.060 | −2.029 | 1.00 | 50.20 | B000 N |
| ATOM | 7463 | CZ | ARG | E | 263 | 23.609 | 95.464 | −1.881 | 1.00 | 58.64 | B000 C |
| ATOM | 7464 | NH1 | ARG | E | 263 | 24.728 | 96.164 | −2.057 | 1.00 | 53.73 | B000 N1+ |
| ATOM | 7465 | NH2 | ARG | E | 263 | 23.670 | 94.172 | −1.573 | 1.00 | 56.41 | B000 N |
| ATOM | 7466 | N | TRP | E | 264 | 18.506 | 97.428 | −6.314 | 1.00 | 43.23 | B000 N |
| ATOM | 7467 | CA | TRP | E | 264 | 17.854 | 97.186 | −7.588 | 1.00 | 42.16 | B000 C |
| ATOM | 7468 | C | TRP | E | 264 | 18.687 | 96.288 | −8.491 | 1.00 | 43.43 | B000 C |
| ATOM | 7469 | O | TRP | E | 264 | 19.921 | 96.322 | −8.465 | 1.00 | 41.15 | B000 O |
| ATOM | 7470 | CB | TRP | E | 264 | 17.595 | 98.493 | −8.322 | 1.00 | 37.69 | B000 C |
| ATOM | 7471 | CG | TRP | E | 264 | 16.910 | 99.526 | −7.547 | 1.00 | 42.39 | B000 C |
| ATOM | 7472 | CD1 | TRP | E | 264 | 16.342 | 99.410 | −6.306 | 1.00 | 42.33 | B000 C |
| ATOM | 7473 | CD2 | TRP | E | 264 | 16.714 | 100.874 | −7.958 | 1.00 | 41.30 | B000 C |
| ATOM | 7474 | NE1 | TRP | E | 264 | 15.797 | 100.613 | −5.924 | 1.00 | 37.50 | B000 N |
| ATOM | 7475 | CE2 | TRP | E | 264 | 16.011 | 101.530 | −6.921 | 1.00 | 43.31 | B000 C |
| ATOM | 7476 | CE3 | TRP | E | 264 | 17.068 | 101.595 | −9.104 | 1.00 | 38.49 | B000 C |
| ATOM | 7477 | CZ2 | TRP | E | 264 | 15.649 | 102.882 | −6.999 | 1.00 | 46.31 | B000 C |
| ATOM | 7478 | CZ3 | TRP | E | 264 | 16.716 | 102.938 | −9.179 | 1.00 | 44.68 | B000 C |
| ATOM | 7479 | CH2 | TRP | E | 264 | 16.005 | 103.564 | −8.135 | 1.00 | 47.08 | B000 C |
| ATOM | 7480 | N | ASN | E | 265 | 17.986 | 95.533 | −9.339 | 1.00 | 40.37 | B000 N |
| ATOM | 7481 | CA | ASN | E | 265 | 18.601 | 94.718 | −10.374 | 1.00 | 38.67 | B000 C |
| ATOM | 7482 | C | ASN | E | 265 | 17.770 | 94.816 | −11.652 | 1.00 | 35.88 | B000 C |
| ATOM | 7483 | O | ASN | E | 265 | 16.561 | 95.055 | −11.608 | 1.00 | 33.72 | B000 O |
| ATOM | 7484 | CB | ASN | E | 265 | 18.731 | 93.267 | −9.899 | 1.00 | 40.88 | B000 C |
| ATOM | 7485 | CG | ASN | E | 265 | 19.363 | 92.369 | −10.940 | 1.00 | 49.30 | B000 C |
| ATOM | 7486 | OD1 | ASN | E | 265 | 20.484 | 92.622 | −11.373 | 1.00 | 46.08 | B000 O |
| ATOM | 7487 | ND2 | ASN | E | 265 | 18.667 | 91.288 | −11.315 | 1.00 | 49.35 | B000 N |
| ATOM | 7488 | N | ASP | E | 266 | 18.431 | 94.646 | −12.795 | 1.00 | 37.44 | B000 N |
| ATOM | 7489 | CA | ASP | E | 266 | 17.769 | 94.648 | −14.092 | 1.00 | 34.38 | B000 C |
| ATOM | 7490 | C | ASP | E | 266 | 17.585 | 93.211 | −14.559 | 1.00 | 35.40 | B000 C |
| ATOM | 7491 | O | ASP | E | 266 | 18.516 | 92.408 | −14.481 | 1.00 | 38.07 | B000 O |
| ATOM | 7492 | CB | ASP | E | 266 | 18.549 | 95.463 | −15.137 | 1.00 | 34.61 | B000 C |
| ATOM | 7493 | CG | ASP | E | 266 | 20.046 | 95.092 | −15.230 | 1.00 | 42.09 | B000 C |
| ATOM | 7494 | OD1 | ASP | E | 266 | 20.690 | 94.762 | −14.202 | 1.00 | 40.07 | B000 O |
| ATOM | 7495 | OD2 | ASP | E | 266 | 20.593 | 95.167 | −16.358 | 1.00 | 40.68 | B000 O1− |
| ATOM | 7496 | N | ASP | E | 267 | 16.372 | 92.880 | −15.001 | 1.00 | 37.34 | B000 N |
| ATOM | 7497 | CA | ASP | E | 267 | 16.034 | 91.524 | −15.412 | 1.00 | 36.69 | B000 C |
| ATOM | 7498 | C | ASP | E | 267 | 15.052 | 91.576 | −16.581 | 1.00 | 35.84 | B000 C |
| ATOM | 7499 | O | ASP | E | 267 | 14.431 | 92.609 | −16.843 | 1.00 | 37.16 | B000 O |
| ATOM | 7500 | CB | ASP | E | 267 | 15.448 | 90.748 | −14.230 | 1.00 | 33.55 | B000 C |
| ATOM | 7501 | CG | ASP | E | 267 | 15.724 | 89.244 | −14.319 | 1.00 | 44.66 | B000 C |
| ATOM | 7502 | OD1 | ASP | E | 267 | 16.128 | 88.792 | −15.410 | 1.00 | 43.90 | B000 O |
| ATOM | 7503 | OD2 | ASP | E | 267 | 15.535 | 88.518 | −13.301 | 1.00 | 45.36 | B000 O1− |
| ATOM | 7504 | N | VAL | E | 268 | 14.901 | 90.455 | −17.294 | 1.00 | 32.21 | B000 N |
| ATOM | 7505 | CA | VAL | E | 268 | 13.973 | 90.457 | −18.423 | 1.00 | 34.18 | B000 C |
| ATOM | 7506 | C | VAL | E | 268 | 12.553 | 90.719 | −17.928 | 1.00 | 37.30 | B000 C |
| ATOM | 7507 | O | VAL | E | 268 | 12.123 | 90.211 | −16.883 | 1.00 | 38.04 | B000 O |
| ATOM | 7508 | CB | VAL | E | 268 | 14.050 | 89.154 | −19.239 | 1.00 | 37.36 | B000 C |
| ATOM | 7509 | CG1 | VAL | E | 268 | 15.409 | 89.057 | −19.938 | 1.00 | 36.15 | B000 C |
| ATOM | 7510 | CG2 | VAL | E | 268 | 13.806 | 87.936 | −18.370 | 1.00 | 35.18 | B000 C |
| ATOM | 7511 | N | CYS | E | 269 | 11.809 | 91.513 | −18.697 | 1.00 | 36.57 | B000 N |
| ATOM | 7512 | CA | CYS | E | 269 | 10.538 | 92.045 | −18.240 | 1.00 | 36.70 | B000 C |
| ATOM | 7513 | C | CYS | E | 269 | 9.449 | 90.995 | −18.103 | 1.00 | 34.59 | B000 C |
| ATOM | 7514 | O | CYS | E | 269 | 8.418 | 91.294 | −17.500 | 1.00 | 35.91 | B000 O |
| ATOM | 7515 | CB | CYS | E | 269 | 10.088 | 93.163 | −19.185 | 1.00 | 42.38 | B000 C |
| ATOM | 7516 | SG | CYS | E | 269 | 11.267 | 94.591 | −19.164 | 1.00 | 53.92 | B000 S |
| ATOM | 7517 | N | GLN | E | 270 | 9.643 | 89.777 | −18.595 | 1.00 | 33.91 | B000 N |
| ATOM | 7518 | CA | GLN | E | 270 | 8.591 | 88.778 | −18.422 | 1.00 | 38.11 | B000 C |
| ATOM | 7519 | C | GLN | E | 270 | 8.652 | 88.057 | −17.086 | 1.00 | 33.78 | B000 C |
| ATOM | 7520 | O | GLN | E | 270 | 7.760 | 87.247 | −16.828 | 1.00 | 33.42 | B000 O |
| ATOM | 7521 | CB | GLN | E | 270 | 8.578 | 87.723 | −19.549 | 1.00 | 38.43 | B000 C |
| ATOM | 7522 | CG | GLN | E | 270 | 9.815 | 87.602 | −20.390 | 1.00 | 44.86 | B000 C |
| ATOM | 7523 | CD | GLN | E | 270 | 10.038 | 88.821 | −21.260 | 1.00 | 52.91 | B000 C |
| ATOM | 7524 | OE1 | GLN | E | 270 | 11.140 | 89.358 | −21.293 | 1.00 | 55.48 | B000 O |
| ATOM | 7525 | NE2 | GLN | E | 270 | 8.986 | 89.280 | −21.949 | 1.00 | 51.33 | B000 N |
| ATOM | 7526 | N | ARG | E | 271 | 9.649 | 88.338 | −16.229 | 1.00 | 31.87 | B000 N |
| ATOM | 7527 | CA | ARG | E | 271 | 9.677 | 87.758 | −14.889 | 1.00 | 29.54 | B000 C |
| ATOM | 7528 | C | ARG | E | 271 | 8.356 | 88.049 | −14.171 | 1.00 | 36.60 | B000 C |
| ATOM | 7529 | O | ARG | E | 271 | 7.873 | 89.192 | −14.210 | 1.00 | 35.38 | B000 O |
| ATOM | 7530 | CB | ARG | E | 271 | 10.829 | 88.325 | −14.050 | 1.00 | 28.67 | B000 C |
| ATOM | 7531 | CG | ARG | E | 271 | 12.220 | 87.973 | −14.479 | 1.00 | 27.89 | B000 C |
| ATOM | 7532 | CD | ARG | E | 271 | 12.418 | 86.476 | −14.518 | 1.00 | 31.48 | B000 C |
| ATOM | 7533 | NE | ARG | E | 271 | 13.822 | 86.098 | −14.676 | 1.00 | 33.37 | B000 N |

TABLE 10.3-continued

| | | | | | | | | | | | |
|---|---|---|---|---|---|---|---|---|---|---|---|
| ATOM | 7534 | CZ | ARG | E | 271 | 14.203 | 84.864 | −14.987 | 1.00 | 37.02 | B000 C |
| ATOM | 7535 | NH1 | ARG | E | 271 | 13.268 | 83.937 | −15.180 | 1.00 | 30.74 | B000 N1+ |
| ATOM | 7536 | NH2 | ARG | E | 271 | 15.492 | 84.540 | −15.076 | 1.00 | 29.23 | B000 N |
| ATOM | 7537 | N | PRO | E | 272 | 7.778 | 87.122 | −13.565 | 1.00 | 34.45 | B000 N |
| ATOM | 7538 | CA | PRO | E | 272 | 6.493 | 87.373 | −12.870 | 1.00 | 35.22 | B000 C |
| ATOM | 7539 | C | PRO | E | 272 | 6.670 | 87.925 | −11.455 | 1.00 | 35.16 | B000 C |
| ATOM | 7540 | O | PRO | E | 272 | 6.234 | 87.321 | −10.470 | 1.00 | 31.89 | B000 O |
| ATOM | 7541 | CB | PRO | E | 272 | 5.847 | 85.979 | −12.867 | 1.00 | 31.77 | B000 C |
| ATOM | 7542 | CG | PRO | E | 272 | 7.003 | 85.036 | −12.787 | 1.00 | 32.91 | B000 C |
| ATOM | 7543 | CD | PRO | E | 272 | 8.114 | 85.689 | −13.621 | 1.00 | 30.82 | B000 C |
| ATOM | 7544 | N | TYR | E | 273 | 7.295 | 89.101 | −11.344 | 1.00 | 31.62 | B000 N |
| ATOM | 7545 | CA | TYR | E | 273 | 7.555 | 89.672 | −10.028 | 1.00 | 32.44 | B000 C |
| ATOM | 7546 | C | TYR | E | 273 | 6.327 | 90.398 | −9.474 | 1.00 | 33.52 | B000 C |
| ATOM | 7547 | O | TYR | E | 273 | 5.355 | 90.667 | −10.183 | 1.00 | 33.94 | B000 O |
| ATOM | 7548 | CB | TYR | E | 273 | 8.752 | 90.615 | −10.089 | 1.00 | 32.72 | B000 C |
| ATOM | 7549 | CG | TYR | E | 273 | 10.050 | 89.893 | −10.371 | 1.00 | 34.81 | B000 C |
| ATOM | 7550 | CD1 | TYR | E | 273 | 10.215 | 88.558 | −10.004 | 1.00 | 30.34 | B000 C |
| ATOM | 7551 | CD2 | TYR | E | 273 | 11.125 | 90.546 | −10.996 | 1.00 | 34.47 | B000 C |
| ATOM | 7552 | CE1 | TYR | E | 273 | 11.428 | 87.883 | −10.249 | 1.00 | 31.47 | B000 C |
| ATOM | 7553 | CE2 | TYR | E | 273 | 12.329 | 89.879 | −11.245 | 1.00 | 31.66 | B000 C |
| ATOM | 7554 | CZ | TYR | E | 273 | 12.468 | 88.549 | −10.867 | 1.00 | 32.58 | B000 C |
| ATOM | 7555 | OH | TYR | E | 273 | 13.639 | 87.883 | −11.117 | 1.00 | 37.35 | B000 O |
| ATOM | 7556 | N | ARG | E | 274 | 6.356 | 90.671 | −8.170 | 1.00 | 34.37 | B000 N |
| ATOM | 7557 | CA | ARG | E | 274 | 5.350 | 91.549 | −7.579 | 1.00 | 32.60 | B000 C |
| ATOM | 7558 | C | ARG | E | 274 | 5.542 | 92.978 | −8.089 | 1.00 | 35.51 | B000 C |
| ATOM | 7559 | O | ARG | E | 274 | 6.533 | 93.300 | −8.757 | 1.00 | 31.65 | B000 O |
| ATOM | 7560 | CB | ARG | E | 274 | 5.426 | 91.519 | −6.048 | 1.00 | 31.74 | B000 C |
| ATOM | 7561 | CG | ARG | E | 274 | 5.044 | 90.177 | −5.455 | 1.00 | 35.22 | B000 C |
| ATOM | 7562 | CD | ARG | E | 274 | 4.922 | 90.200 | −3.952 | 1.00 | 36.81 | B000 C |
| ATOM | 7563 | NE | ARG | E | 274 | 4.320 | 88.966 | −3.474 | 1.00 | 36.66 | B000 N |
| ATOM | 7564 | CZ | ARG | E | 274 | 4.010 | 88.714 | −2.206 | 1.00 | 38.82 | B000 C |
| ATOM | 7565 | NH1 | ARG | E | 274 | 4.266 | 89.605 | −1.260 | 1.00 | 40.20 | B000 N1+ |
| ATOM | 7566 | NH2 | ARG | E | 274 | 3.432 | 87.563 | −1.886 | 1.00 | 37.93 | B000 N |
| ATOM | 7567 | N | TRP | E | 275 | 4.591 | 93.857 | −7.757 | 1.00 | 34.71 | B000 N |
| ATOM | 7568 | CA | TRP | E | 275 | 4.709 | 95.242 | −8.207 | 1.00 | 35.25 | B000 C |
| ATOM | 7569 | C | TRP | E | 275 | 4.038 | 96.177 | −7.209 | 1.00 | 33.77 | B000 C |
| ATOM | 7570 | O | TRP | E | 275 | 3.288 | 95.762 | −6.316 | 1.00 | 34.64 | B000 O |
| ATOM | 7571 | CB | TRP | E | 275 | 4.133 | 95.429 | −9.622 | 1.00 | 29.33 | B000 C |
| ATOM | 7572 | CG | TRP | E | 275 | 2.633 | 95.433 | −9.666 | 1.00 | 41.26 | B000 C |
| ATOM | 7573 | CD1 | TRP | E | 275 | 1.824 | 96.531 | −9.687 | 1.00 | 32.79 | B000 C |
| ATOM | 7574 | CD2 | TRP | E | 275 | 1.762 | 94.290 | −9.659 | 1.00 | 35.30 | B000 C |
| ATOM | 7575 | NE1 | TRP | E | 275 | 0.516 | 96.147 | −9.707 | 1.00 | 34.43 | B000 N |
| ATOM | 7576 | CE2 | TRP | E | 275 | 0.441 | 94.779 | −9.687 | 1.00 | 41.97 | B000 C |
| ATOM | 7577 | CE3 | TRP | E | 275 | 1.971 | 92.908 | −9.650 | 1.00 | 34.18 | B000 C |
| ATOM | 7578 | CZ2 | TRP | E | 275 | −0.681 | 93.928 | −9.698 | 1.00 | 39.53 | B000 C |
| ATOM | 7579 | CZ3 | TRP | E | 275 | 0.861 | 92.059 | −9.654 | 1.00 | 40.96 | B000 C |
| ATOM | 7580 | CH2 | TRP | E | 275 | −0.445 | 92.574 | −9.680 | 1.00 | 40.67 | B000 C |
| ATOM | 7581 | N | VAL | E | 276 | 4.345 | 97.453 | −7.367 | 1.00 | 32.75 | B000 N |
| ATOM | 7582 | CA | VAL | E | 276 | 3.827 | 98.520 | −6.528 | 1.00 | 36.54 | B000 C |
| ATOM | 7583 | C | VAL | E | 276 | 3.248 | 99.578 | −7.451 | 1.00 | 43.35 | B000 C |
| ATOM | 7584 | O | VAL | E | 276 | 3.916 | 99.998 | −8.404 | 1.00 | 39.24 | B000 O |
| ATOM | 7585 | CB | VAL | E | 276 | 4.932 | 99.125 | −5.636 | 1.00 | 39.71 | B000 C |
| ATOM | 7586 | CG1 | VAL | E | 276 | 4.364 | 100.226 | −4.708 | 1.00 | 36.15 | B000 C |
| ATOM | 7587 | CG2 | VAL | E | 276 | 5.626 | 98.033 | −4.830 | 1.00 | 33.07 | B000 C |
| ATOM | 7588 | N | CYS | E | 277 | 2.015 | 100.004 | −7.176 | 1.00 | 41.27 | B000 N |
| ATOM | 7589 | CA | CYS | E | 277 | 1.403 | 101.127 | −7.878 | 1.00 | 39.77 | B000 C |
| ATOM | 7590 | C | CYS | E | 277 | 1.513 | 102.387 | −7.022 | 1.00 | 46.66 | B000 C |
| ATOM | 7591 | O | CYS | E | 277 | 1.519 | 102.321 | −5.786 | 1.00 | 41.72 | B000 O |
| ATOM | 7592 | CB | CYS | E | 277 | −0.063 | 100.847 | −8.209 | 1.00 | 41.42 | B000 C |
| ATOM | 7593 | SG | CYS | E | 277 | −0.364 | 99.509 | −9.393 | 1.00 | 51.15 | B000 S |
| ATOM | 7594 | N | GLU | E | 278 | 1.622 | 103.536 | −7.698 | 1.00 | 43.54 | B000 N |
| ATOM | 7595 | CA | GLU | E | 278 | 1.776 | 104.841 | −7.069 | 1.00 | 38.79 | B000 C |
| ATOM | 7596 | C | GLU | E | 278 | 0.862 | 105.858 | −7.751 | 1.00 | 45.95 | B000 C |
| ATOM | 7597 | O | GLU | E | 278 | 0.782 | 105.914 | −8.988 | 1.00 | 39.44 | B000 O |
| ATOM | 7598 | CB | GLU | E | 278 | 3.243 | 105.302 | −7.137 | 1.00 | 47.37 | B000 C |
| ATOM | 7599 | CG | GLU | E | 278 | 3.523 | 106.665 | −6.506 | 1.00 | 54.07 | B000 C |
| ATOM | 7600 | CD | GLU | E | 278 | 4.983 | 107.122 | −6.640 | 1.00 | 55.74 | B000 C |
| ATOM | 7601 | OE1 | GLU | E | 278 | 5.813 | 106.384 | −7.214 | 1.00 | 49.09 | B000 O |
| ATOM | 7602 | OE2 | GLU | E | 278 | 5.299 | 108.234 | −6.158 | 1.00 | 63.05 | B000 O1− |
| ATOM | 7603 | N | THR | E | 279 | 0.194 | 106.677 | −6.933 | 1.00 | 44.07 | B000 N |
| ATOM | 7604 | CA | THR | E | 279 | −0.653 | 107.764 | −7.416 | 1.00 | 49.75 | B000 C |
| ATOM | 7605 | C | THR | E | 279 | −0.567 | 108.944 | −6.440 | 1.00 | 52.93 | B000 C |
| ATOM | 7606 | O | THR | E | 279 | 0.043 | 108.854 | −5.367 | 1.00 | 51.44 | B000 O |
| ATOM | 7607 | CB | THR | E | 279 | −2.103 | 107.288 | −7.604 | 1.00 | 51.62 | B000 C |
| ATOM | 7608 | OG1 | THR | E | 279 | −2.814 | 108.206 | −8.438 | 1.00 | 58.36 | B000 O |
| ATOM | 7609 | CG2 | THR | E | 279 | −2.815 | 107.204 | −6.271 | 1.00 | 48.77 | B000 C |
| ATOM | 7610 | N | GLU | E | 280 | −1.195 | 110.058 | −6.818 | 1.00 | 57.24 | B000 N |
| ATOM | 7611 | CA | GLU | E | 280 | −1.083 | 111.317 | −6.090 | 1.00 | 59.43 | B000 C |
| ATOM | 7612 | C | GLU | E | 280 | −2.071 | 111.410 | −4.922 | 1.00 | 60.25 | B000 C |
| ATOM | 7613 | O | GLU | E | 280 | −2.950 | 110.567 | −4.738 | 1.00 | 57.16 | B000 O |

TABLE 10.3-continued

| ATOM | 7614 | CB | GLU | E | 280 | −1.329 | 112.479 | −7.040 | 1.00 | 72.93 | B000 | C |
|---|---|---|---|---|---|---|---|---|---|---|---|---|
| ATOM | 7615 | CG | GLU | E | 280 | −1.062 | 112.139 | −8.487 | 1.00 | 81.08 | B000 | C |
| ATOM | 7616 | CD | GLU | E | 280 | −0.073 | 113.097 | −9.119 | 1.00 | 105.55 | B000 | C |
| ATOM | 7617 | OE1 | GLU | E | 280 | −0.010 | 114.263 | −8.665 | 1.00 | 104.59 | B000 | O |
| ATOM | 7618 | OE2 | GLU | E | 280 | 0.648 | 112.680 | −10.055 | 1.00 | 113.25 | B000 | O1− |
| ATOM | 7619 | N | LEU | E | 281 | −1.917 | 112.479 | −4.135 | 1.00 | 77.88 | B000 | N |
| ATOM | 7620 | CA | LEU | E | 281 | −2.807 | 112.826 | −3.011 | 1.00 | 70.25 | B000 | C |
| ATOM | 7621 | C | LEU | E | 281 | −2.681 | 111.825 | −1.876 | 1.00 | 67.47 | B000 | C |
| ATOM | 7622 | O | LEU | E | 281 | −2.139 | 112.153 | −0.819 | 1.00 | 68.88 | B000 | O |
| ATOM | 7623 | CB | LEU | E | 281 | −4.279 | 112.937 | −3.459 | 1.00 | 61.71 | B000 | C |
| ATOM | 7624 | CG | LEU | E | 281 | −4.707 | 114.296 | −4.035 | 1.00 | 80.45 | B000 | C |
| ATOM | 7625 | CD1 | LEU | E | 281 | −5.181 | 114.179 | −5.490 | 1.00 | 71.81 | B000 | C |
| ATOM | 7626 | CD2 | LEU | E | 281 | −5.774 | 114.969 | −3.143 | 1.00 | 70.21 | B000 | C |
| TER | | | | | | | | | | | | |
| ATOM | 7627 | O | THR | F | 152 | −18.909 | 43.540 | −2.518 | 1.00 | 85.67 | B000 | O |
| ATOM | 7628 | N | THR | F | 152 | −17.763 | 41.399 | −0.880 | 1.00 | 85.67 | B000 | N |
| ATOM | 7629 | CA | THR | F | 152 | −16.968 | 42.333 | −1.678 | 1.00 | 88.53 | B000 | C |
| ATOM | 7630 | C | THR | F | 152 | −17.777 | 43.608 | −2.017 | 1.00 | 91.37 | B000 | C |
| ATOM | 7631 | CB | THR | F | 152 | −16.431 | 41.637 | −2.979 | 1.00 | 92.20 | B000 | C |
| ATOM | 7632 | OG1 | THR | F | 152 | −15.806 | 42.597 | −3.844 | 1.00 | 90.90 | B000 | O |
| ATOM | 7633 | CG2 | THR | F | 152 | −17.541 | 40.894 | −3.731 | 1.00 | 84.33 | B000 | C |
| ATOM | 7634 | N | CYS | F | 153 | −17.202 | 44.774 | −1.715 | 1.00 | 87.63 | B000 | N |
| ATOM | 7635 | CA | CYS | F | 153 | −17.870 | 46.050 | −1.926 | 1.00 | 82.80 | B000 | C |
| ATOM | 7636 | C | CYS | F | 153 | −17.103 | 46.899 | −2.940 | 1.00 | 77.69 | B000 | C |
| ATOM | 7637 | O | CYS | F | 153 | −15.918 | 46.673 | −3.212 | 1.00 | 67.09 | B000 | O |
| ATOM | 7638 | CB | CYS | F | 153 | −18.029 | 46.817 | −0.596 | 1.00 | 79.27 | B000 | C |
| ATOM | 7639 | SG | CYS | F | 153 | −19.643 | 46.575 | 0.239 | 1.00 | 104.11 | B000 | S |
| ATOM | 7640 | N | CYS | F | 154 | −17.803 | 47.886 | −3.508 | 1.00 | 76.91 | B000 | N |
| ATOM | 7641 | CA | CYS | F | 154 | −17.185 | 48.793 | −4.462 | 1.00 | 59.34 | B000 | C |
| ATOM | 7642 | C | CYS | F | 154 | −16.202 | 49.711 | −3.745 | 1.00 | 54.16 | B000 | C |
| ATOM | 7643 | O | CYS | F | 154 | −16.398 | 50.041 | −2.575 | 1.00 | 63.36 | B000 | O |
| ATOM | 7644 | CB | CYS | F | 154 | −18.244 | 49.634 | −5.172 | 1.00 | 55.19 | B000 | C |
| ATOM | 7645 | SG | CYS | F | 154 | −19.186 | 48.756 | −6.443 | 1.00 | 69.85 | B000 | S |
| ATOM | 7646 | N | PRO | F | 155 | −15.156 | 50.163 | −4.429 | 1.00 | 53.28 | B000 | N |
| ATOM | 7647 | CA | PRO | F | 155 | −14.236 | 51.130 | −3.812 | 1.00 | 56.60 | B000 | C |
| ATOM | 7648 | C | PRO | F | 155 | −14.973 | 52.379 | −3.346 | 1.00 | 57.95 | B000 | C |
| ATOM | 7649 | O | PRO | F | 155 | −16.130 | 52.640 | −3.696 | 1.00 | 55.60 | B000 | O |
| ATOM | 7650 | CB | PRO | F | 155 | −13.243 | 51.459 | −4.932 | 1.00 | 48.00 | B000 | C |
| ATOM | 7651 | CG | PRO | F | 155 | −13.374 | 50.336 | −5.913 | 1.00 | 55.49 | B000 | C |
| ATOM | 7652 | CD | PRO | F | 155 | −14.777 | 49.826 | −5.811 | 1.00 | 51.46 | B000 | C |
| ATOM | 7653 | N | VAL | F | 156 | −14.268 | 53.174 | −2.539 | 1.00 | 56.46 | B000 | N |
| ATOM | 7654 | CA | VAL | F | 156 | −14.855 | 54.394 | −1.991 | 1.00 | 63.80 | B000 | C |
| ATOM | 7655 | C | VAL | F | 156 | −15.250 | 55.333 | −3.126 | 1.00 | 59.48 | B000 | C |
| ATOM | 7656 | O | VAL | F | 156 | −14.488 | 55.538 | −4.081 | 1.00 | 58.09 | B000 | O |
| ATOM | 7657 | CB | VAL | F | 156 | −13.873 | 55.058 | −1.014 | 1.00 | 62.21 | B000 | C |
| ATOM | 7658 | CG1 | VAL | F | 156 | −14.577 | 56.145 | −0.211 | 1.00 | 55.24 | B000 | C |
| ATOM | 7659 | CG2 | VAL | F | 156 | −13.256 | 54.002 | −0.096 | 1.00 | 73.19 | B000 | C |
| ATOM | 7660 | N | ASN | F | 157 | −16.460 | 55.891 | −3.031 | 1.00 | 53.19 | B000 | N |
| ATOM | 7661 | CA | ASN | F | 157 | −17.093 | 56.831 | −3.964 | 1.00 | 54.02 | B000 | C |
| ATOM | 7662 | C | ASN | F | 157 | −17.605 | 56.142 | −5.227 | 1.00 | 54.32 | B000 | C |
| ATOM | 7663 | O | ASN | F | 157 | −18.209 | 56.814 | −6.072 | 1.00 | 53.93 | B000 | 0 |
| ATOM | 7664 | CB | ASN | F | 157 | −16.170 | 57.985 | −4.387 | 1.00 | 49.92 | B000 | C |
| ATOM | 7665 | CG | ASN | F | 157 | −15.632 | 58.759 | −3.202 | 1.00 | 59.88 | B000 | C |
| ATOM | 7666 | OD1 | ASN | F | 157 | −16.357 | 59.008 | −2.236 | 1.00 | 56.12 | B000 | 0 |
| ATOM | 7667 | ND2 | ASN | F | 157 | −14.346 | 59.136 | −3.262 | 1.00 | 53.76 | B000 | N |
| ATOM | 7668 | N | TRP | F | 158 | −17.394 | 54.844 | −5.396 | 1.00 | 49.14 | B000 | N |
| ATOM | 7669 | CA | TRP | F | 158 | −18.015 | 54.160 | −6.516 | 1.00 | 47.06 | B000 | C |
| ATOM | 7670 | C | TRP | F | 158 | −19.353 | 53.577 | −6.080 | 1.00 | 46.07 | B000 | C |
| ATOM | 7671 | O | TRP | F | 158 | −19.629 | 53.429 | −4.891 | 1.00 | 48.01 | B000 | O |
| ATOM | 7672 | CB | TRP | F | 158 | −17.109 | 53.069 | −7.059 | 1.00 | 48.92 | B000 | C |
| ATOM | 7673 | CG | TRP | F | 158 | −15.830 | 53.586 | −7.632 | 1.00 | 42.48 | B000 | C |
| ATOM | 7674 | CD1 | TRP | F | 158 | −14.854 | 54.269 | −6.967 | 1.00 | 46.04 | B000 | C |
| ATOM | 7675 | CD2 | TRP | F | 158 | −15.364 | 53.425 | −8.975 | 1.00 | 40.30 | B000 | C |
| ATOM | 7676 | NE1 | TRP | F | 158 | −13.811 | 54.549 | −7.812 | 1.00 | 40.04 | B000 | N |
| ATOM | 7677 | CE2 | TRP | F | 158 | −14.098 | 54.047 | −9.053 | 1.00 | 40.63 | B000 | C |
| ATOM | 7678 | CE3 | TRP | F | 158 | −15.900 | 52.830 | −10.124 | 1.00 | 38.93 | B000 | C |
| ATOM | 7679 | CZ2 | TRP | F | 158 | −13.358 | 54.092 | −10.234 | 1.00 | 36.03 | B000 | C |
| ATOM | 7680 | CZ3 | TRP | F | 158 | −15.164 | 52.864 | −11.283 | 1.00 | 40.94 | B000 | C |
| ATOM | 7681 | CH2 | TRP | F | 158 | −13.908 | 53.499 | −11.336 | 1.00 | 38.94 | B000 | C |
| ATOM | 7682 | N | VAL | F | 159 | −20.207 | 53.303 | −7.065 | 1.00 | 48.15 | B000 | N |
| ATOM | 7683 | CA | VAL | F | 159 | −21.584 | 52.872 | −6.854 | 1.00 | 43.77 | B000 | C |
| ATOM | 7684 | C | VAL | F | 159 | −21.777 | 51.526 | −7.536 | 1.00 | 53.64 | B000 | C |
| ATOM | 7685 | O | VAL | F | 159 | −21.317 | 51.328 | −8.666 | 1.00 | 50.16 | B000 | O |
| ATOM | 7686 | CB | VAL | F | 159 | −22.571 | 53.918 | −7.409 | 1.00 | 47.04 | B000 | C |
| ATOM | 7687 | CG1 | VAL | F | 159 | −24.008 | 53.459 | −7.275 | 1.00 | 49.61 | B000 | C |
| ATOM | 7688 | CG2 | VAL | F | 159 | −22.361 | 55.239 | −6.711 | 1.00 | 48.78 | B000 | C |
| ATOM | 7689 | N | GLU | F | 160 | −22.478 | 50.611 | −6.864 | 1.00 | 57.06 | B000 | N |
| ATOM | 7690 | CA | GLU | F | 160 | −22.632 | 49.242 | −7.343 | 1.00 | 56.04 | B000 | C |
| ATOM | 7691 | C | GLU | F | 160 | −23.958 | 49.061 | −8.070 | 1.00 | 50.46 | B000 | C |
| ATOM | 7692 | O | GLU | F | 160 | −25.000 | 49.538 | −7.619 | 1.00 | 54.39 | B000 | O |

TABLE 10.3-continued

| | | | | | | | | | | |
|---|---|---|---|---|---|---|---|---|---|---|
| ATOM | 7693 | CB | GLU | F | 160 | −22.568 | 48.223 | −6.201 | 1.00 | 59.56 | B000 C |
| ATOM | 7694 | CG | GLU | F | 160 | −22.813 | 46.795 | −6.710 | 1.00 | 68.99 | B000 C |
| ATOM | 7695 | CD | GLU | F | 160 | −23.041 | 45.748 | −5.621 | 1.00 | 80.25 | B000 C |
| ATOM | 7696 | OE1 | GLU | F | 160 | −22.777 | 46.016 | −4.427 | 1.00 | 79.75 | B000 O |
| ATOM | 7697 | OE2 | GLU | F | 160 | −23.491 | 44.637 | −5.985 | 1.00 | 78.26 | B000 O1− |
| ATOM | 7698 | N | HIS | F | 161 | −23.912 | 48.328 | −9.175 | 1.00 | 51.49 | B000 N |
| ATOM | 7699 | CA | HIS | F | 161 | −25.104 | 47.913 | −9.892 | 1.00 | 49.49 | B000 C |
| ATOM | 7700 | C | HIS | F | 161 | −24.786 | 46.601 | −10.587 | 1.00 | 53.28 | B000 C |
| ATOM | 7701 | O | HIS | F | 161 | −23.801 | 46.508 | −11.332 | 1.00 | 47.92 | B000 O |
| ATOM | 7702 | CB | HIS | F | 161 | −25.561 | 48.959 | −10.901 | 1.00 | 47.30 | B000 C |
| ATOM | 7703 | CG | HIS | F | 161 | −26.699 | 48.503 | −11.759 | 1.00 | 52.32 | B000 C |
| ATOM | 7704 | ND1 | HIS | F | 161 | −26.511 | 47.794 | −12.930 | 1.00 | 49.15 | B000 N |
| ATOM | 7705 | CD2 | HIS | F | 161 | −28.039 | 48.641 | −11.611 | 1.00 | 49.74 | B000 C |
| ATOM | 7706 | CE1 | HIS | F | 161 | −27.687 | 47.540 | −13.478 | 1.00 | 52.61 | B000 C |
| ATOM | 7707 | NE2 | HIS | F | 161 | −28.630 | 48.037 | −12.696 | 1.00 | 54.26 | B000 N |
| ATOM | 7708 | N | GLU | F | 162 | −25.666 | 45.618 | −10.386 | 1.00 | 61.24 | B000 N |
| ATOM | 7709 | CA | GLU | F | 162 | −25.426 | 44.226 | −10.751 | 1.00 | 57.31 | B000 C |
| ATOM | 7710 | C | GLU | F | 162 | −24.028 | 43.809 | −10.315 | 1.00 | 59.22 | B000 C |
| ATOM | 7711 | O | GLU | F | 162 | −23.715 | 43.833 | −9.118 | 1.00 | 59.32 | B000 O |
| ATOM | 7712 | CB | GLU | F | 162 | −25.596 | 44.005 | −12.253 | 1.00 | 54.87 | B000 C |
| ATOM | 7713 | CG | GLU | F | 162 | −26.901 | 44.546 | −12.835 | 1.00 | 59.80 | B000 C |
| ATOM | 7714 | CD | GLU | F | 162 | −28.197 | 43.921 | −12.303 | 1.00 | 84.54 | B000 C |
| ATOM | 7715 | OE1 | GLU | F | 162 | −28.210 | 43.290 | −11.211 | 1.00 | 82.94 | B000 O |
| ATOM | 7716 | OE2 | GLU | F | 162 | −29.231 | 44.078 | −13.007 | 1.00 | 83.83 | B000 O1− |
| ATOM | 7717 | N | ARG | F | 163 | −23.163 | 43.459 | −11.263 | 1.00 | 55.56 | B000 N |
| ATOM | 7718 | CA | ARG | F | 163 | −21.811 | 43.028 | −10.919 | 1.00 | 70.50 | B000 C |
| ATOM | 7719 | C | ARG | F | 163 | −20.730 | 44.041 | −11.292 | 1.00 | 65.87 | B000 C |
| ATOM | 7720 | O | ARG | F | 163 | −19.541 | 43.699 | −11.301 | 1.00 | 61.99 | B000 O |
| ATOM | 7721 | CB | ARG | F | 163 | −21.533 | 41.645 | −11.517 | 1.00 | 71.43 | B000 C |
| ATOM | 7722 | CG | ARG | F | 163 | −22.636 | 40.621 | −11.170 | 1.00 | 84.91 | B000 C |
| ATOM | 7723 | CD | ARG | F | 163 | −23.371 | 40.027 | −12.366 | 1.00 | 94.82 | B000 C |
| ATOM | 7724 | NE | ARG | F | 163 | −23.213 | 38.571 | −12.447 | 1.00 | 110.28 | B000 N |
| ATOM | 7725 | CZ | ARG | F | 163 | −22.337 | 37.951 | −13.238 | 1.00 | 109.36 | B000 C |
| ATOM | 7726 | NH1 | ARG | F | 163 | −21.538 | 38.656 | −14.031 | 1.00 | 107.55 | B000 N1+ |
| ATOM | 7727 | NH2 | ARG | F | 163 | −22.266 | 36.625 | −13.245 | 1.00 | 108.51 | B000 N |
| ATOM | 7728 | N | SER | F | 164 | −21.104 | 45.289 | −11.551 | 1.00 | 62.99 | B000 N |
| ATOM | 7729 | CA | SER | F | 164 | −20.137 | 46.326 | −11.872 | 1.00 | 54.70 | B000 C |
| ATOM | 7730 | C | SER | F | 164 | −20.163 | 47.454 | −10.845 | 1.00 | 52.59 | B000 C |
| ATOM | 7731 | 0 | SER | F | 164 | −21.153 | 47.666 | −10.136 | 1.00 | 53.73 | B000 0 |
| ATOM | 7732 | CB | SER | F | 164 | −20.405 | 46.896 | −13.272 | 1.00 | 56.24 | B000 C |
| ATOM | 7733 | OG | SER | F | 164 | −19.909 | 46.041 | −14.287 | 1.00 | 65.36 | B000 0 |
| ATOM | 7734 | N | CYS | F | 165 | −19.036 | 48.161 | −10.771 | 1.00 | 51.69 | B000 N |
| ATOM | 7735 | CA | CYS | F | 165 | −18.866 | 49.373 | −9.981 | 1.00 | 51.61 | B000 C |
| ATOM | 7736 | C | CYS | F | 165 | −18.723 | 50.574 | −10.909 | 1.00 | 50.55 | B000 C |
| ATOM | 7737 | O | CYS | F | 165 | −18.004 | 50.511 | −11.912 | 1.00 | 48.71 | B000 0 |
| ATOM | 7738 | CB | CYS | F | 165 | −17.633 | 49.280 | −9.076 | 1.00 | 55.01 | B000 C |
| ATOM | 7739 | SG | CYS | F | 165 | −17.771 | 48.053 | −7.751 | 1.00 | 71.45 | B000 S |
| ATOM | 7740 | N | TYR | F | 166 | −19.410 | 51.670 | −10.577 | 1.00 | 48.64 | B000 N |
| ATOM | 7741 | CA | TYR | F | 166 | −19.481 | 52.838 | −11.449 | 1.00 | 45.58 | B000 C |
| ATOM | 7742 | C | TYR | F | 166 | −19.040 | 54.104 | −10.722 | 1.00 | 51.09 | B000 C |
| ATOM | 7743 | O | TYR | F | 166 | −19.325 | 54.283 | −9.533 | 1.00 | 49.78 | B000 O |
| ATOM | 7744 | CB | TYR | F | 166 | −20.886 | 53.045 | −11.982 | 1.00 | 39.51 | B000 C |
| ATOM | 7745 | CG | TYR | F | 166 | −21.427 | 51.889 | −12.777 | 1.00 | 45.13 | B000 C |
| ATOM | 7746 | CD1 | TYR | F | 166 | −21.884 | 50.732 | −12.151 | 1.00 | 50.08 | B000 C |
| ATOM | 7747 | CD2 | TYR | F | 166 | −21.471 | 51.945 | −14.159 | 1.00 | 46.42 | B000 C |
| ATOM | 7748 | CE1 | TYR | F | 166 | −22.393 | 49.667 | −12.887 | 1.00 | 48.67 | B000 C |
| ATOM | 7749 | CE2 | TYR | F | 166 | −21.968 | 50.892 | −14.902 | 1.00 | 52.75 | B000 C |
| ATOM | 7750 | CZ | TYR | F | 166 | −22.429 | 49.752 | −14.264 | 1.00 | 51.87 | B000 C |
| ATOM | 7751 | OH | TYR | F | 166 | −22.922 | 48.712 | −15.024 | 1.00 | 47.43 | B000 O |
| ATOM | 7752 | N | TRP | F | 167 | −18.358 | 54.989 | −11.446 | 1.00 | 41.54 | B000 N |
| ATOM | 7753 | CA | TRP | F | 167 | −17.941 | 56.279 | −10.914 | 1.00 | 39.17 | B000 C |
| ATOM | 7754 | C | TRP | F | 167 | −18.472 | 57.396 | −11.821 | 1.00 | 40.61 | B000 C |
| ATOM | 7755 | O | TRP | F | 167 | −18.300 | 57.352 | −13.048 | 1.00 | 39.85 | B000 O |
| ATOM | 7756 | CB | TRP | F | 167 | −16.408 | 56.328 | −10.776 | 1.00 | 39.26 | B000 C |
| ATOM | 7757 | CG | TRP | F | 167 | −15.921 | 57.583 | −10.131 | 1.00 | 47.81 | B000 C |
| ATOM | 7758 | CD1 | TRP | F | 167 | −15.728 | 57.812 | −8.787 | 1.00 | 43.33 | B000 C |
| ATOM | 7759 | CD2 | TRP | F | 167 | −15.599 | 58.806 | −10.799 | 1.00 | 36.88 | B000 C |
| ATOM | 7760 | NE1 | TRP | F | 167 | −15.292 | 59.110 | −8.588 | 1.00 | 37.39 | B000 N |
| ATOM | 7761 | CE2 | TRP | F | 167 | −15.191 | 59.735 | −9.807 | 1.00 | 42.60 | B000 C |
| ATOM | 7762 | CE3 | TRP | F | 167 | −15.593 | 59.202 | −12.140 | 1.00 | 35.30 | B000 C |
| ATOM | 7763 | CZ2 | TRP | F | 167 | −14.796 | 61.049 | −10.122 | 1.00 | 32.52 | B000 C |
| ATOM | 7764 | CZ3 | TRP | F | 167 | −15.177 | 60.506 | −12.455 | 1.00 | 41.65 | B000 C |
| ATOM | 7765 | CH2 | TRP | F | 167 | −14.805 | 61.415 | −11.442 | 1.00 | 34.25 | B000 C |
| ATOM | 7766 | N | PHE | F | 168 | −19.128 | 58.386 | −11.215 | 1.00 | 32.85 | B000 N |
| ATOM | 7767 | CA | PHE | F | 168 | −19.816 | 59.459 | −11.933 | 1.00 | 36.14 | B000 C |
| ATOM | 7768 | C | PHE | F | 168 | −19.062 | 60.768 | −11.757 | 1.00 | 33.17 | B000 C |
| ATOM | 7769 | O | PHE | F | 168 | −18.933 | 61.266 | −10.640 | 1.00 | 32.62 | B000 O |
| ATOM | 7770 | CB | PHE | F | 168 | −21.257 | 59.611 | −11.439 | 1.00 | 31.85 | B000 C |
| ATOM | 7771 | CG | PHE | F | 168 | −22.092 | 58.410 | −11.718 | 1.00 | 43.90 | B000 C |
| ATOM | 7772 | CD1 | PHE | F | 168 | −22.788 | 58.303 | −12.918 | 1.00 | 37.94 | B000 C |

TABLE 10.3-continued

| ATOM | 7773 | CD2 | PHE | F | 168 | −22.121 | 57.349 | −10.824 | 1.00 | 37.92 | B000 C |
| ATOM | 7774 | CE1 | PHE | F | 168 | −23.534 | 57.188 | −13.204 | 1.00 | 33.97 | B000 C |
| ATOM | 7775 | CE2 | PHE | F | 168 | −22.863 | 56.231 | −11.102 | 1.00 | 43.27 | B000 C |
| ATOM | 7776 | CZ | PHE | F | 168 | −23.576 | 56.147 | −12.299 | 1.00 | 39.89 | B000 C |
| ATOM | 7777 | N | SER | F | 169 | −18.544 | 61.311 | −12.851 | 1.00 | 34.64 | B000 N |
| ATOM | 7778 | CA | SER | F | 169 | −17.896 | 62.613 | −12.753 | 1.00 | 37.47 | B000 C |
| ATOM | 7779 | C | SER | F | 169 | −18.933 | 63.691 | −12.453 | 1.00 | 35.48 | B000 C |
| ATOM | 7780 | O | SER | F | 169 | −20.132 | 63.531 | −12.708 | 1.00 | 35.12 | B000 O |
| ATOM | 7781 | CB | SER | F | 169 | −17.154 | 62.974 | −14.046 | 1.00 | 31.74 | B000 C |
| ATOM | 7782 | OG | SER | F | 169 | −18.061 | 63.533 | −14.999 | 1.00 | 33.74 | B000 O |
| ATOM | 7783 | N | ARG | F | 170 | −18.454 | 64.810 | −11.921 | 1.00 | 32.66 | B000 N |
| ATOM | 7784 | CA | ARG | F | 170 | −19.292 | 65.983 | −11.718 | 1.00 | 35.64 | B000 C |
| ATOM | 7785 | C | ARG | F | 170 | −18.692 | 67.198 | −12.423 | 1.00 | 37.46 | B000 C |
| ATOM | 7786 | O | ARG | F | 170 | −18.918 | 68.347 | −12.037 | 1.00 | 32.51 | B000 O |
| ATOM | 7787 | CB | ARG | F | 170 | −19.527 | 66.211 | −10.228 | 1.00 | 30.96 | B000 C |
| ATOM | 7788 | CG | ARG | F | 170 | −20.457 | 65.128 | −9.645 | 1.00 | 33.93 | B000 C |
| ATOM | 7789 | CD | ARG | F | 170 | −20.628 | 65.237 | −8.142 | 1.00 | 36.53 | B000 C |
| ATOM | 7790 | NE | ARG | F | 170 | −19.466 | 64.712 | −7.440 | 1.00 | 46.87 | B000 N |
| ATOM | 7791 | CZ | ARG | F | 170 | −19.272 | 64.766 | −6.121 | 1.00 | 50.98 | B000 C |
| ATOM | 7792 | NH1 | ARG | F | 170 | −18.153 | 64.253 | −5.600 | 1.00 | 44.20 | B000 N1+ |
| ATOM | 7793 | NH2 | ARG | F | 170 | −20.184 | 65.325 | −5.321 | 1.00 | 43.86 | B000 N |
| ATOM | 7794 | N | SER | F | 171 | −17.935 | 66.933 | −13.484 | 1.00 | 32.24 | B000 N |
| ATOM | 7795 | CA | SER | F | 171 | −17.355 | 67.964 | −14.328 | 1.00 | 32.82 | B000 C |
| ATOM | 7796 | C | SER | F | 171 | −17.068 | 67.317 | −15.673 | 1.00 | 33.70 | B000 C |
| ATOM | 7797 | O | SER | F | 171 | −17.093 | 66.090 | −15.807 | 1.00 | 32.42 | B000 0 |
| ATOM | 7798 | CB | SER | F | 171 | −16.078 | 68.565 | −13.724 | 1.00 | 32.95 | B000 C |
| ATOM | 7799 | OG | SER | F | 171 | −15.041 | 67.584 | −13.595 | 1.00 | 37.93 | B000 0 |
| ATOM | 7800 | N | GLY | F | 172 | −16.766 | 68.160 | −16.662 | 1.00 | 27.87 | B000 N |
| ATOM | 7801 | CA | GLY | F | 172 | −16.607 | 67.725 | −18.032 | 1.00 | 30.72 | B000 C |
| ATOM | 7802 | C | GLY | F | 172 | −15.165 | 67.477 | −18.471 | 1.00 | 37.04 | B000 C |
| ATOM | 7803 | O | GLY | F | 172 | −14.203 | 68.006 | −17.891 | 1.00 | 31.19 | B000 0 |
| ATOM | 7804 | N | LYS | F | 173 | −15.039 | 66.642 | −19.510 | 1.00 | 31.65 | B000 N |
| ATOM | 7805 | CA | LYS | F | 173 | −13.782 | 66.382 | −20.205 | 1.00 | 34.23 | B000 C |
| ATOM | 7806 | C | LYS | F | 173 | −14.091 | 66.048 | −21.659 | 1.00 | 34.10 | B000 C |
| ATOM | 7807 | O | LYS | F | 173 | −15.137 | 65.468 | −21.967 | 1.00 | 27.67 | B000 0 |
| ATOM | 7808 | CB | LYS | F | 173 | −12.986 | 65.212 | −19.599 | 1.00 | 36.67 | B000 C |
| ATOM | 7809 | CG | LYS | F | 173 | −12.212 | 65.491 | −18.319 | 1.00 | 36.30 | B000 C |
| ATOM | 7810 | CD | LYS | F | 173 | −11.406 | 64.251 | −17.943 | 1.00 | 31.78 | B000 C |
| ATOM | 7811 | CE | LYS | F | 173 | −10.707 | 64.369 | −16.569 | 1.00 | 33.56 | B000 C |
| ATOM | 7812 | NZ | LYS | F | 173 | −9.556 | 65.313 | −16.523 | 1.00 | 45.73 | B000 N1+ |
| ATOM | 7813 | N | ALA | F | 174 | −13.167 | 66.400 | −22.557 | 1.00 | 31.22 | B000 N |
| ATOM | 7814 | CA | ALA | F | 174 | −13.226 | 65.821 | −23.890 | 1.00 | 31.29 | B000 C |
| ATOM | 7815 | C | ALA | F | 174 | −13.149 | 64.297 | −23.774 | 1.00 | 30.96 | B000 C |
| ATOM | 7816 | O | ALA | F | 174 | −12.525 | 63.758 | −22.851 | 1.00 | 33.23 | B000 O |
| ATOM | 7817 | CB | ALA | F | 174 | −12.099 | 66.364 | −24.763 | 1.00 | 29.41 | B000 C |
| ATOM | 7818 | N | TRP | F | 175 | −13.823 | 63.602 | −24.698 | 1.00 | 28.04 | B000 N |
| ATOM | 7819 | CA | TRP | F | 175 | −13.972 | 62.145 | −24.586 | 1.00 | 34.38 | B000 C |
| ATOM | 7820 | C | TRP | F | 175 | −12.623 | 61.449 | −24.421 | 1.00 | 37.26 | B000 C |
| ATOM | 7821 | O | TRP | F | 175 | −12.450 | 60.587 | −23.549 | 1.00 | 35.08 | B000 O |
| ATOM | 7822 | CB | TRP | F | 175 | −14.700 | 61.599 | −25.815 | 1.00 | 28.70 | B000 C |
| ATOM | 7823 | CG | TRP | F | 175 | −15.152 | 60.160 | −25.730 | 1.00 | 37.75 | B000 C |
| ATOM | 7824 | CD1 | TRP | F | 175 | −16.401 | 59.702 | −25.374 | 1.00 | 32.61 | B000 C |
| ATOM | 7825 | CD2 | TRP | F | 175 | −14.381 | 58.992 | −26.056 | 1.00 | 35.80 | B000 C |
| ATOM | 7826 | NE1 | TRP | F | 175 | −16.440 | 58.337 | −25.461 | 1.00 | 36.32 | B000 N |
| ATOM | 7827 | CE2 | TRP | F | 175 | −15.219 | 57.874 | −25.866 | 1.00 | 39.10 | B000 C |
| ATOM | 7828 | CE3 | TRP | F | 175 | −13.067 | 58.786 | −26.488 | 1.00 | 34.63 | B000 C |
| ATOM | 7829 | CZ2 | TRP | F | 175 | −14.788 | 56.573 | −26.097 | 1.00 | 34.59 | B000 C |
| ATOM | 7830 | CZ3 | TRP | F | 175 | −12.637 | 57.494 | −26.720 | 1.00 | 37.06 | B000 C |
| ATOM | 7831 | CH2 | TRP | F | 175 | −13.493 | 56.402 | −26.517 | 1.00 | 41.92 | B000 C |
| ATOM | 7832 | N | ALA | F | 176 | −11.637 | 61.842 | −25.230 | 1.00 | 31.21 | B000 N |
| ATOM | 7833 | CA | ALA | F | 176 | −10.356 | 61.158 | −25.149 | 1.00 | 35.56 | B000 C |
| ATOM | 7834 | C | ALA | F | 176 | −9.749 | 61.306 | −23.765 | 1.00 | 38.45 | B000 C |
| ATOM | 7835 | O | ALA | F | 176 | −9.108 | 60.373 | −23.270 | 1.00 | 39.51 | B000 O |
| ATOM | 7836 | CB | ALA | F | 176 | −9.403 | 61.684 | −26.229 | 1.00 | 24.62 | B000 C |
| ATOM | 7837 | N | ASP | F | 177 | −9.964 | 62.449 | −23.107 | 1.00 | 34.61 | B000 N |
| ATOM | 7838 | CA | ASP | F | 177 | −9.426 | 62.601 | −21.759 | 1.00 | 35.23 | B000 C |
| ATOM | 7839 | C | ASP | F | 177 | −10.233 | 61.808 | −20.751 | 1.00 | 37.46 | B000 C |
| ATOM | 7840 | O | ASP | F | 177 | −9.663 | 61.241 | −19.812 | 1.00 | 34.54 | B000 O |
| ATOM | 7841 | CB | ASP | F | 177 | −9.379 | 64.072 | −21.351 | 1.00 | 34.09 | B000 C |
| ATOM | 7842 | CG | ASP | F | 177 | −8.386 | 64.859 | −22.167 | 1.00 | 41.05 | B000 C |
| ATOM | 7843 | OD1 | ASP | F | 177 | −7.313 | 64.292 | −22.458 | 1.00 | 42.78 | B000 O |
| ATOM | 7844 | OD2 | ASP | F | 177 | −8.681 | 66.028 | −22.531 | 1.00 | 43.34 | B000 O1− |
| ATOM | 7845 | N | ALA | F | 178 | −11.561 | 61.775 | −20.907 | 1.00 | 34.72 | B000 N |
| ATOM | 7846 | CA | ALA | F | 178 | −12.357 | 60.941 | −20.010 | 1.00 | 40.52 | B000 C |
| ATOM | 7847 | C | ALA | F | 178 | −11.978 | 59.471 | −20.186 | 1.00 | 36.67 | B000 C |
| ATOM | 7848 | O | ALA | F | 178 | −11.853 | 58.724 | −19.208 | 1.00 | 36.37 | B000 O |
| ATOM | 7849 | CB | ALA | F | 178 | −13.850 | 61.165 | −20.268 | 1.00 | 32.74 | B000 C |
| ATOM | 7850 | N | ASP | F | 179 | −11.714 | 59.070 | −21.424 | 1.00 | 34.82 | B000 N |
| ATOM | 7851 | CA | ASP | F | 179 | −11.257 | 57.715 | −21.706 | 1.00 | 36.26 | B000 C |
| ATOM | 7852 | C | ASP | F | 179 | −9.957 | 57.397 | −20.955 | 1.00 | 42.39 | B000 C |

TABLE 10.3-continued

| ATOM | 7853 | O | ASP | F | 179 | −9.861 | 56.368 | −20.275 | 1.00 | 44.65 | B000 | O |
|---|---|---|---|---|---|---|---|---|---|---|---|---|
| ATOM | 7854 | CB | ASP | F | 179 | −11.107 | 57.584 | −23.221 | 1.00 | 41.84 | B000 | C |
| ATOM | 7855 | CG | ASP | F | 179 | −10.618 | 56.220 | −23.670 | 1.00 | 52.24 | B000 | C |
| ATOM | 7856 | OD1 | ASP | F | 179 | −11.237 | 55.192 | −23.304 | 1.00 | 48.91 | B000 | O |
| ATOM | 7857 | OD2 | ASP | F | 179 | −9.620 | 56.195 | −24.430 | 1.00 | 51.25 | B000 | O1− |
| ATOM | 7858 | N | ASN | F | 180 | −8.959 | 58.292 | −21.019 | 1.00 | 36.75 | B000 | N |
| ATOM | 7859 | CA | ASN | F | 180 | −7.704 | 58.044 | −20.302 | 1.00 | 37.14 | B000 | C |
| ATOM | 7860 | C | ASN | F | 180 | −7.923 | 58.008 | −18.796 | 1.00 | 39.01 | B000 | C |
| ATOM | 7861 | O | ASN | F | 180 | −7.306 | 57.205 | −18.089 | 1.00 | 45.89 | B000 | O |
| ATOM | 7862 | CB | ASN | F | 180 | −6.654 | 59.118 | −20.615 | 1.00 | 46.92 | B000 | C |
| ATOM | 7863 | CG | ASN | F | 180 | −6.153 | 59.087 | −22.053 | 1.00 | 58.49 | B000 | C |
| ATOM | 7864 | OD1 | ASN | F | 180 | −6.232 | 58.070 | −22.751 | 1.00 | 61.49 | B000 | O |
| ATOM | 7865 | ND2 | ASN | F | 180 | −5.630 | 60.232 | −22.507 | 1.00 | 67.59 | B000 | N |
| ATOM | 7866 | N | TYR | F | 181 | −8.782 | 58.887 | −18.283 | 1.00 | 43.70 | B000 | N |
| ATOM | 7867 | CA | TYR | F | 181 | −9.073 | 58.899 | −16.852 | 1.00 | 39.91 | B000 | C |
| ATOM | 7868 | C | TYR | F | 181 | −9.597 | 57.540 | −16.394 | 1.00 | 37.95 | B000 | C |
| ATOM | 7869 | O | TYR | F | 181 | −9.186 | 57.026 | −15.351 | 1.00 | 39.77 | B000 | O |
| ATOM | 7870 | CB | TYR | F | 181 | −10.089 | 60.009 | −16.524 | 1.00 | 38.63 | B000 | C |
| ATOM | 7871 | CG | TYR | F | 181 | −10.493 | 60.066 | −15.056 | 1.00 | 41.58 | B000 | C |
| ATOM | 7872 | CD1 | TYR | F | 181 | −11.438 | 59.167 | −14.527 | 1.00 | 31.11 | B000 | C |
| ATOM | 7873 | CD2 | TYR | F | 181 | −9.928 | 61.018 | −14.193 | 1.00 | 31.82 | B000 | C |
| ATOM | 7874 | CE1 | TYR | F | 181 | −11.782 | 59.205 | −13.193 | 1.00 | 31.20 | B000 | C |
| ATOM | 7875 | CE2 | TYR | F | 181 | −10.285 | 61.067 | −12.856 | 1.00 | 32.07 | B000 | C |
| ATOM | 7876 | CZ | TYR | F | 181 | −11.206 | 60.153 | −12.364 | 1.00 | 37.73 | B000 | C |
| ATOM | 7877 | OH | TYR | F | 181 | −11.565 | 60.192 | −11.049 | 1.00 | 44.00 | B000 | O |
| ATOM | 7878 | N | CYS | F | 182 | −10.545 | 56.962 | −17.133 | 1.00 | 38.33 | B000 | N |
| ATOM | 7879 | CA | CYS | F | 182 | −11.080 | 55.671 | −16.702 | 1.00 | 46.48 | B000 | C |
| ATOM | 7880 | C | CYS | F | 182 | −10.008 | 54.591 | −16.772 | 1.00 | 43.13 | B000 | C |
| ATOM | 7881 | O | CYS | F | 182 | −9.877 | 53.782 | −15.848 | 1.00 | 43.36 | B000 | O |
| ATOM | 7882 | CB | CYS | F | 182 | −12.309 | 55.282 | −17.529 | 1.00 | 39.09 | B000 | C |
| ATOM | 7883 | SG | CYS | F | 182 | −13.808 | 56.319 | −17.269 | 1.00 | 47.89 | B000 | S |
| ATOM | 7884 | N | ARG | F | 183 | −9.196 | 54.599 | −17.834 | 1.00 | 45.20 | B000 | N |
| ATOM | 7885 | CA | ARG | F | 183 | −8.147 | 53.596 | −17.968 | 1.00 | 43.53 | B000 | C |
| ATOM | 7886 | C | ARG | F | 183 | −7.166 | 53.667 | −16.806 | 1.00 | 46.41 | B000 | C |
| ATOM | 7887 | O | ARG | F | 183 | −6.782 | 52.629 | −16.254 | 1.00 | 47.85 | B000 | O |
| ATOM | 7888 | CB | ARG | F | 183 | −7.439 | 53.764 | −19.316 | 1.00 | 41.85 | B000 | C |
| ATOM | 7889 | CG | ARG | F | 183 | −8.193 | 53.051 | −20.444 | 1.00 | 61.73 | B000 | C |
| ATOM | 7890 | CD | ARG | F | 183 | −7.918 | 53.573 | −21.866 | 1.00 | 68.72 | B000 | C |
| ATOM | 7891 | NE | ARG | F | 183 | −8.968 | 53.099 | −22.784 | 1.00 | 81.47 | B000 | N |
| ATOM | 7892 | CZ | ARG | F | 183 | −9.062 | 53.405 | −24.082 | 1.00 | 84.12 | B000 | C |
| ATOM | 7893 | NH1 | ARG | F | 183 | −8.149 | 54.199 | −24.652 | 1.00 | 78.81 | B000 | N1+ |
| ATOM | 7894 | NH2 | ARG | F | 183 | −10.082 | 52.925 | −24.811 | 1.00 | 60.08 | B000 | N |
| ATOM | 7895 | N | LEU | F | 184 | −6.805 | 54.884 | −16.367 | 1.00 | 42.66 | B000 | N |
| ATOM | 7896 | CA | LEU | F | 184 | −5.910 | 55.030 | −15.220 | 1.00 | 41.52 | B000 | C |
| ATOM | 7897 | C | LEU | F | 184 | −6.542 | 54.558 | −13.921 | 1.00 | 45.58 | B000 | C |
| ATOM | 7898 | O | LEU | F | 184 | −5.822 | 54.349 | −12.944 | 1.00 | 51.35 | B000 | O |
| ATOM | 7899 | CB | LEU | F | 184 | −5.441 | 56.481 | −15.057 | 1.00 | 36.16 | B000 | C |
| ATOM | 7900 | CG | LEU | F | 184 | −4.410 | 57.032 | −16.056 | 1.00 | 52.39 | B000 | C |
| ATOM | 7901 | CD1 | LEU | F | 184 | −4.128 | 58.507 | −15.803 | 1.00 | 41.04 | B000 | C |
| ATOM | 7902 | CD2 | LEU | F | 184 | −3.105 | 56.258 | −15.999 | 1.00 | 43.74 | B000 | C |
| ATOM | 7903 | N | GLU | F | 185 | −7.862 | 54.403 | −13.875 | 1.00 | 49.78 | B000 | N |
| ATOM | 7904 | CA | GLU | F | 185 | −8.548 | 53.829 | −12.724 | 1.00 | 54.22 | B000 | C |
| ATOM | 7905 | C | GLU | F | 185 | −8.765 | 52.324 | −12.849 | 1.00 | 48.30 | B000 | C |
| ATOM | 7906 | O | GLU | F | 185 | −9.579 | 51.769 | −12.104 | 1.00 | 50.24 | B000 | O |
| ATOM | 7907 | CB | GLU | F | 185 | −9.905 | 54.506 | −12.523 | 1.00 | 53.96 | B000 | C |
| ATOM | 7908 | CG | GLU | F | 185 | −9.835 | 55.994 | −12.368 | 1.00 | 48.05 | B000 | C |
| ATOM | 7909 | CD | GLU | F | 185 | −9.246 | 56.395 | −11.042 | 1.00 | 60.24 | B000 | C |
| ATOM | 7910 | OE1 | GLU | F | 185 | −9.666 | 55.804 | −10.016 | 1.00 | 64.06 | B000 | O |
| ATOM | 7911 | OE2 | GLU | F | 185 | −8.376 | 57.300 | −11.033 | 1.00 | 63.60 | B000 | O1− |
| ATOM | 7912 | N | ASP | F | 186 | −8.062 | 51.659 | −13.765 | 1.00 | 48.69 | B000 | N |
| ATOM | 7913 | CA | ASP | F | 186 | −8.311 | 50.254 | −14.090 | 1.00 | 49.60 | B000 | C |
| ATOM | 7914 | C | ASP | F | 186 | −9.782 | 50.054 | −14.431 | 1.00 | 52.34 | B000 | C |
| ATOM | 7915 | O | ASP | F | 186 | −10.445 | 49.131 | −13.950 | 1.00 | 49.55 | B000 | O |
| ATOM | 7916 | CB | ASP | F | 186 | −7.889 | 49.319 | −12.951 | 1.00 | 53.42 | B000 | C |
| ATOM | 7917 | CG | ASP | F | 186 | −6.443 | 49.508 | −12.545 | 1.00 | 79.16 | B000 | C |
| ATOM | 7918 | OD1 | ASP | F | 186 | −5.652 | 50.034 | −13.366 | 1.00 | 85.17 | B000 | O |
| ATOM | 7919 | OD2 | ASP | F | 186 | −6.093 | 49.125 | −11.403 | 1.00 | 86.75 | B000 | O1− |
| ATOM | 7920 | N | ALA | F | 187 | −10.303 | 50.958 | −15.252 | 1.00 | 50.66 | B000 | N |
| ATOM | 7921 | CA | ALA | F | 187 | −11.705 | 50.915 | −15.627 | 1.00 | 43.40 | B000 | C |
| ATOM | 7922 | C | ALA | F | 187 | −11.822 | 51.404 | −17.061 | 1.00 | 39.32 | B000 | C |
| ATOM | 7923 | O | ALA | F | 187 | −10.822 | 51.623 | −17.752 | 1.00 | 42.43 | B000 | O |
| ATOM | 7924 | CB | ALA | F | 187 | −12.559 | 51.716 | −14.636 | 1.00 | 37.47 | B000 | C |
| ATOM | 7925 | N | HIS | F | 188 | −13.048 | 51.547 | −17.523 | 1.00 | 38.43 | B000 | N |
| ATOM | 7926 | CA | HIS | F | 188 | −13.273 | 52.036 | −18.864 | 1.00 | 42.96 | B000 | C |
| ATOM | 7927 | C | HIS | F | 188 | −14.539 | 52.878 | −18.839 | 1.00 | 39.88 | B000 | C |
| ATOM | 7928 | O | HIS | F | 188 | −15.291 | 52.871 | −17.865 | 1.00 | 47.38 | B000 | O |
| ATOM | 7929 | CB | HIS | F | 188 | −13.377 | 50.872 | −19.852 | 1.00 | 40.78 | B000 | C |
| ATOM | 7930 | CG | HIS | F | 188 | −14.461 | 49.901 | −19.512 | 1.00 | 40.48 | B000 | C |
| ATOM | 7931 | ND1 | HIS | F | 188 | −15.783 | 50.124 | −19.830 | 1.00 | 46.61 | B000 | N |
| ATOM | 7932 | CD2 | HIS | F | 188 | −14.427 | 48.716 | −18.858 | 1.00 | 45.33 | B000 | C |

TABLE 10.3-continued

| | | | | | | | | | | |
|---|---|---|---|---|---|---|---|---|---|---|
| ATOM | 7933 | CE1 | HIS | F | 188 | −16.515 | 49.109 | −19.403 | 1.00 | 45.57 | B000 C |
| ATOM | 7934 | NE2 | HIS | F | 188 | −15.716 | 48.241 | −18.811 | 1.00 | 46.51 | B000 N |
| ATOM | 7935 | N | LEU | F | 189 | −14.764 | 53.613 | −19.918 | 1.00 | 37.01 | B000 N |
| ATOM | 7936 | CA | LEU | F | 189 | −15.978 | 54.400 | −20.036 | 1.00 | 37.46 | B000 C |
| ATOM | 7937 | C | LEU | F | 189 | −17.191 | 53.475 | −20.121 | 1.00 | 43.07 | B000 C |
| ATOM | 7938 | O | LEU | F | 189 | −17.135 | 52.415 | −20.754 | 1.00 | 37.38 | B000 O |
| ATOM | 7939 | CB | LEU | F | 189 | −15.891 | 55.299 | −21.263 | 1.00 | 31.01 | B000 C |
| ATOM | 7940 | CG | LEU | F | 189 | −14.995 | 56.532 | −21.160 | 1.00 | 35.76 | B000 C |
| ATOM | 7941 | CD1 | LEU | F | 189 | −14.766 | 57.097 | −22.537 | 1.00 | 33.40 | B000 C |
| ATOM | 7942 | CD2 | LEU | F | 189 | −15.624 | 57.607 | −20.257 | 1.00 | 34.63 | B000 C |
| ATOM | 7943 | N | VAL | F | 190 | −18.301 | 53.904 | −19.502 | 1.00 | 37.96 | B000 N |
| ATOM | 7944 | CA | VAL | F | 190 | −19.417 | 53.006 | −19.237 | 1.00 | 34.67 | B000 C |
| ATOM | 7945 | C | VAL | F | 190 | −19.928 | 52.393 | −20.536 | 1.00 | 42.14 | B000 C |
| ATOM | 7946 | O | VAL | F | 190 | −20.044 | 53.064 | −21.573 | 1.00 | 40.38 | B000 O |
| ATOM | 7947 | CB | VAL | F | 190 | −20.551 | 53.722 | −18.477 | 1.00 | 36.38 | B000 C |
| ATOM | 7948 | CG1 | VAL | F | 190 | −21.205 | 54.857 | −19.319 | 1.00 | 31.50 | B000 C |
| ATOM | 7949 | CG2 | VAL | F | 190 | −21.573 | 52.718 | −18.006 | 1.00 | 38.12 | B000 C |
| ATOM | 7950 | N | VAL | F | 191 | −20.178 | 51.085 | −20.485 | 1.00 | 40.92 | B000 N |
| ATOM | 7951 | CA | VAL | F | 191 | −20.787 | 50.325 | −21.567 | 1.00 | 40.00 | B000 C |
| ATOM | 7952 | C | VAL | F | 191 | −22.162 | 49.884 | −21.082 | 1.00 | 41.46 | B000 C |
| ATOM | 7953 | O | VAL | F | 191 | −22.265 | 49.187 | −20.063 | 1.00 | 51.69 | B000 O |
| ATOM | 7954 | CB | VAL | F | 191 | −19.928 | 49.113 | −21.966 | 1.00 | 43.90 | B000 C |
| ATOM | 7955 | CG1 | VAL | F | 191 | −20.596 | 48.350 | −23.106 | 1.00 | 38.60 | B000 C |
| ATOM | 7956 | CG2 | VAL | F | 191 | −18.503 | 49.546 | −22.338 | 1.00 | 38.08 | B000 C |
| ATOM | 7957 | N | VAL | F | 192 | −23.209 | 50.284 | −21.805 | 1.00 | 39.60 | B000 N |
| ATOM | 7958 | CA | VAL | F | 192 | −24.603 | 50.091 | −21.402 | 1.00 | 40.55 | B000 C |
| ATOM | 7959 | C | VAL | F | 192 | −25.139 | 48.872 | −22.134 | 1.00 | 42.33 | B000 C |
| ATOM | 7960 | O | VAL | F | 192 | −25.454 | 48.955 | −23.326 | 1.00 | 43.63 | B000 O |
| ATOM | 7961 | CB | VAL | F | 192 | −25.464 | 51.319 | −21.747 | 1.00 | 43.28 | B000 C |
| ATOM | 7962 | CG1 | VAL | F | 192 | −26.869 | 51.182 | −21.155 | 1.00 | 32.94 | B000 C |
| ATOM | 7963 | CG2 | VAL | F | 192 | −24.772 | 52.629 | −21.333 | 1.00 | 35.84 | B000 C |
| ATOM | 7964 | N | THR | F | 193 | −25.341 | 47.762 | −21.429 | 1.00 | 48.94 | B000 N |
| ATOM | 7965 | CA | THR | F | 193 | −25.745 | 46.531 | −22.105 | 1.00 | 47.71 | B000 C |
| ATOM | 7966 | C | THR | F | 193 | −27.211 | 46.169 | −21.896 | 1.00 | 49.57 | B000 C |
| ATOM | 7967 | O | THR | F | 193 | −27.654 | 45.172 | −22.465 | 1.00 | 51.89 | B000 O |
| ATOM | 7968 | CB | THR | F | 193 | −24.866 | 45.344 | −21.673 | 1.00 | 37.74 | B000 C |
| ATOM | 7969 | OG1 | THR | F | 193 | −25.053 | 45.097 | −20.280 | 1.00 | 43.14 | B000 O |
| ATOM | 7970 | CG2 | THR | F | 193 | −23.361 | 45.624 | −21.935 | 1.00 | 34.77 | B000 C |
| ATOM | 7971 | N | SER | F | 194 | −27.986 | 46.957 | −21.143 | 1.00 | 45.16 | B000 N |
| ATOM | 7972 | CA | SER | F | 194 | −29.364 | 46.570 | −20.845 | 1.00 | 43.88 | B000 C |
| ATOM | 7973 | C | SER | F | 194 | −30.163 | 47.775 | −20.395 | 1.00 | 47.69 | B000 C |
| ATOM | 7974 | O | SER | F | 194 | −29.609 | 48.782 | −19.938 | 1.00 | 48.48 | B000 O |
| ATOM | 7975 | CB | SER | F | 194 | −29.443 | 45.506 | −19.738 | 1.00 | 52.95 | B000 C |
| ATOM | 7976 | OG | SER | F | 194 | −29.162 | 46.065 | −18.455 | 1.00 | 47.85 | B000 O |
| ATOM | 7977 | N | TRP | F | 195 | −31.488 | 47.622 | −20.464 | 1.00 | 48.46 | B000 N |
| ATOM | 7978 | CA | TRP | F | 195 | −32.386 | 48.680 | −20.012 | 1.00 | 44.88 | B000 C |
| ATOM | 7979 | C | TRP | F | 195 | −32.160 | 49.001 | −18.546 | 1.00 | 47.13 | B000 C |
| ATOM | 7980 | O | TRP | F | 195 | −32.238 | 50.165 | −18.133 | 1.00 | 45.99 | B000 O |
| ATOM | 7981 | CB | TRP | F | 195 | −33.843 | 48.288 | −20.250 | 1.00 | 41.25 | B000 C |
| ATOM | 7982 | CG | TRP | F | 195 | −34.410 | 48.910 | −21.469 | 1.00 | 54.27 | B000 C |
| ATOM | 7983 | CD1 | TRP | F | 195 | −34.863 | 48.275 | −22.601 | 1.00 | 50.60 | B000 C |
| ATOM | 7984 | CD2 | TRP | F | 195 | −34.541 | 50.319 | −21.716 | 1.00 | 55.13 | B000 C |
| ATOM | 7985 | NE1 | TRP | F | 195 | −35.307 | 49.212 | −23.521 | 1.00 | 52.12 | B000 N |
| ATOM | 7986 | CE2 | TRP | F | 195 | −35.114 | 50.470 | −23.005 | 1.00 | 54.46 | B000 C |
| ATOM | 7987 | CE3 | TRP | F | 195 | −34.246 | 51.467 | −20.964 | 1.00 | 50.27 | B000 C |
| ATOM | 7988 | CZ2 | TRP | F | 195 | −35.391 | 51.727 | −23.561 | 1.00 | 62.09 | B000 C |
| ATOM | 7989 | CZ3 | TRP | F | 195 | −34.530 | 52.721 | −21.513 | 1.00 | 54.11 | B000 C |
| ATOM | 7990 | CH2 | TRP | F | 195 | −35.091 | 52.837 | −22.804 | 1.00 | 59.63 | B000 C |
| ATOM | 7991 | N | GLU | F | 196 | −31.875 | 47.980 | −17.747 | 1.00 | 43.73 | B000 N |
| ATOM | 7992 | CA | GLU | F | 196 | −31.638 | 48.202 | −16.330 | 1.00 | 46.25 | B000 C |
| ATOM | 7993 | C | GLU | F | 196 | −30.421 | 49.094 | −16.133 | 1.00 | 48.83 | B000 C |
| ATOM | 7994 | O | GLU | F | 196 | −30.505 | 50.141 | −15.480 | 1.00 | 50.61 | B000 O |
| ATOM | 7995 | CB | GLU | F | 196 | −31.445 | 46.853 | −15.623 | 1.00 | 52.52 | B000 C |
| ATOM | 7996 | CG | GLU | F | 196 | −32.744 | 46.023 | −15.500 | 1.00 | 56.68 | B000 C |
| ATOM | 7997 | CD | GLU | F | 196 | −33.141 | 45.323 | −16.823 | 1.00 | 67.73 | B000 C |
| ATOM | 7998 | OE1 | GLU | F | 196 | −32.250 | 45.039 | −17.660 | 1.00 | 66.56 | B000 O |
| ATOM | 7999 | OE2 | GLU | F | 196 | −34.348 | 45.063 | −17.030 | 1.00 | 76.24 | B000 O1− |
| ATOM | 8000 | N | GLU | F | 197 | −29.293 | 48.717 | −16.744 | 1.00 | 40.21 | B000 N |
| ATOM | 8001 | CA | GLU | F | 197 | −28.089 | 49.533 | −16.666 | 1.00 | 46.56 | B000 C |
| ATOM | 8002 | C | GLU | F | 197 | −28.364 | 50.956 | −17.149 | 1.00 | 46.02 | B000 C |
| ATOM | 8003 | O | GLU | F | 197 | −27.964 | 51.927 | −16.494 | 1.00 | 39.09 | B000 O |
| ATOM | 8004 | CB | GLU | F | 197 | −26.965 | 48.881 | −17.475 | 1.00 | 41.68 | B000 C |
| ATOM | 8005 | CG | GLU | F | 197 | −25.566 | 49.351 | −17.097 | 1.00 | 46.61 | B000 C |
| ATOM | 8006 | CD | GLU | F | 197 | −24.465 | 48.581 | −17.830 | 1.00 | 49.56 | B000 C |
| ATOM | 8007 | OE1 | GLU | F | 197 | −24.781 | 47.861 | −18.816 | 1.00 | 45.94 | B000 O |
| ATOM | 8008 | OE2 | GLU | F | 197 | −23.283 | 48.692 | −17.413 | 1.00 | 45.17 | B000 O1− |
| ATOM | 8009 | N | GLN | F | 198 | −29.087 | 51.091 | −18.271 | 1.00 | 37.03 | B000 N |
| ATOM | 8010 | CA | GLN | F | 198 | −29.451 | 52.403 | −18.794 | 1.00 | 36.33 | B000 C |
| ATOM | 8011 | C | GLN | F | 198 | −30.217 | 53.231 | −17.769 | 1.00 | 44.55 | B000 C |
| ATOM | 8012 | O | GLN | F | 198 | −29.896 | 54.400 | −17.546 | 1.00 | 40.80 | B000 O |

TABLE 10.3-continued

| ATOM | 8013 | CB | GLN | F | 198 | −30.275 | 52.248 | −20.065 | 1.00 | 35.40 | B000 | C |
|---|---|---|---|---|---|---|---|---|---|---|---|---|
| ATOM | 8014 | CG | GLN | F | 198 | −31.035 | 53.513 | −20.445 | 1.00 | 35.73 | B000 | C |
| ATOM | 8015 | CD | GLN | F | 198 | −30.137 | 54.563 | −21.106 | 1.00 | 43.38 | B000 | C |
| ATOM | 8016 | OE1 | GLN | F | 198 | −29.107 | 54.240 | −21.704 | 1.00 | 38.10 | B000 | O |
| ATOM | 8017 | NE2 | GLN | F | 198 | −30.535 | 55.821 | −21.007 | 1.00 | 38.22 | B000 | N |
| ATOM | 8018 | N | LYS | F | 199 | −31.229 | 52.641 | −17.123 | 1.00 | 47.51 | B000 | N |
| ATOM | 8019 | CA | LYS | F | 199 | −32.018 | 53.399 | −16.154 | 1.00 | 44.51 | B000 | C |
| ATOM | 8020 | C | LYS | F | 199 | −31.196 | 53.714 | −14.918 | 1.00 | 39.60 | B000 | C |
| ATOM | 8021 | O | LYS | F | 199 | −31.308 | 54.805 | −14.351 | 1.00 | 43.02 | B000 | O |
| ATOM | 8022 | CB | LYS | F | 199 | −33.276 | 52.619 | −15.760 | 1.00 | 48.82 | B000 | C |
| ATOM | 8023 | CG | LYS | F | 199 | −34.257 | 52.311 | −16.891 | 1.00 | 50.78 | B000 | C |
| ATOM | 8024 | CD | LYS | F | 199 | −35.683 | 52.463 | −16.392 | 1.00 | 65.99 | B000 | C |
| ATOM | 8025 | CE | LYS | F | 199 | −36.698 | 51.763 | −17.281 | 1.00 | 72.04 | B000 | C |
| ATOM | 8026 | NZ | LYS | F | 199 | −38.023 | 51.636 | −16.575 | 1.00 | 76.98 | B000 | N1+ |
| ATOM | 8027 | N | PHE | F | 200 | −30.351 | 52.773 | −14.502 | 1.00 | 38.71 | B000 | N |
| ATOM | 8028 | CA | PHE | F | 200 | −29.447 | 53.007 | −13.388 | 1.00 | 38.04 | B000 | C |
| ATOM | 8029 | C | PHE | F | 200 | −28.557 | 54.224 | −13.641 | 1.00 | 47.55 | B000 | C |
| ATOM | 8030 | O | PHE | F | 200 | −28.381 | 55.073 | −12.761 | 1.00 | 42.70 | B000 | O |
| ATOM | 8031 | CB | PHE | F | 200 | −28.604 | 51.759 | −13.163 | 1.00 | 40.51 | B000 | C |
| ATOM | 8032 | CG | PHE | F | 200 | −27.381 | 51.999 | −12.347 | 1.00 | 41.69 | B000 | C |
| ATOM | 8033 | CD1 | PHE | F | 200 | −27.473 | 52.215 | −10.980 | 1.00 | 38.29 | B000 | C |
| ATOM | 8034 | CD2 | PHE | F | 200 | −26.130 | 52.027 | −12.953 | 1.00 | 37.96 | B000 | C |
| ATOM | 8035 | CE1 | PHE | F | 200 | −26.330 | 52.448 | −10.216 | 1.00 | 42.63 | B000 | C |
| ATOM | 8036 | CE2 | PHE | F | 200 | −24.978 | 52.252 | −12.205 | 1.00 | 39.67 | B000 | C |
| ATOM | 8037 | CZ | PHE | F | 200 | −25.076 | 52.466 | −10.830 | 1.00 | 44.08 | B000 | C |
| ATOM | 8038 | N | VAL | F | 201 | −27.984 | 54.328 | −14.842 | 1.00 | 43.83 | B000 | N |
| ATOM | 8039 | CA | VAL | F | 201 | −27.087 | 55.445 | −15.131 | 1.00 | 40.81 | B000 | C |
| ATOM | 8040 | C | VAL | F | 201 | −27.865 | 56.756 | −15.182 | 1.00 | 44.68 | B000 | C |
| ATOM | 8041 | O | VAL | F | 201 | −27.442 | 57.758 | −14.596 | 1.00 | 42.14 | B000 | O |
| ATOM | 8042 | CB | VAL | F | 201 | −26.313 | 55.196 | −16.438 | 1.00 | 40.73 | B000 | C |
| ATOM | 8043 | CG1 | VAL | F | 201 | −25.631 | 56.475 | −16.900 | 1.00 | 38.56 | B000 | C |
| ATOM | 8044 | CG2 | VAL | F | 201 | −25.297 | 54.053 | −16.260 | 1.00 | 34.68 | B000 | C |
| ATOM | 8045 | N | GLN | F | 202 | −29.005 | 56.768 | −15.894 | 1.00 | 37.85 | B000 | N |
| ATOM | 8046 | CA | GLN | F | 202 | −29.859 | 57.956 | −15.959 | 1.00 | 43.72 | B000 | C |
| ATOM | 8047 | C | GLN | F | 202 | −30.185 | 58.499 | −14.582 | 1.00 | 46.87 | B000 | C |
| ATOM | 8048 | O | GLN | F | 202 | −30.211 | 59.720 | −14.367 | 1.00 | 46.96 | B000 | O |
| ATOM | 8049 | CB | GLN | F | 202 | −31.184 | 57.645 | −16.634 | 1.00 | 43.62 | B000 | C |
| ATOM | 8050 | CG | GLN | F | 202 | −31.156 | 57.250 | −18.044 | 1.00 | 46.33 | B000 | C |
| ATOM | 8051 | CD | GLN | F | 202 | −32.572 | 57.120 | −18.537 | 1.00 | 50.37 | B000 | C |
| ATOM | 8052 | OE1 | GLN | F | 202 | −32.871 | 56.353 | −19.451 | 1.00 | 47.40 | B000 | O |
| ATOM | 8053 | NE2 | GLN | F | 202 | −33.469 | 57.864 | −17.901 | 1.00 | 48.25 | B000 | N |
| ATOM | 8054 | N | HIS | F | 203 | −30.503 | 57.603 | −13.654 | 1.00 | 41.20 | B000 | N |
| ATOM | 8055 | CA | HIS | F | 203 | −30.825 | 58.034 | −12.307 | 1.00 | 44.02 | B000 | C |
| ATOM | 8056 | C | HIS | F | 203 | −29.701 | 58.866 | −11.707 | 1.00 | 47.89 | B000 | C |
| ATOM | 8057 | O | HIS | F | 203 | −29.958 | 59.896 | −11.078 | 1.00 | 47.99 | B000 | O |
| ATOM | 8058 | CB | HIS | F | 203 | −31.106 | 56.827 | −11.421 | 1.00 | 40.71 | B000 | C |
| ATOM | 8059 | CG | HIS | F | 203 | −31.413 | 57.206 | −10.013 | 1.00 | 53.47 | B000 | C |
| ATOM | 8060 | ND1 | HIS | F | 203 | −30.514 | 57.028 | −8.982 | 1.00 | 56.30 | B000 | N |
| ATOM | 8061 | CD2 | HIS | F | 203 | −32.499 | 57.805 | −9.470 | 1.00 | 46.30 | B000 | C |
| ATOM | 8062 | CE1 | HIS | F | 203 | −31.044 | 57.478 | −7.858 | 1.00 | 55.89 | B000 | C |
| ATOM | 8063 | NE2 | HIS | F | 203 | −32.248 | 57.953 | −8.127 | 1.00 | 56.08 | B000 | N |
| ATOM | 8064 | N | HIS | F | 204 | −28.444 | 58.458 | −11.918 | 1.00 | 41.43 | B000 | N |
| ATOM | 8065 | CA | HIS | F | 204 | −27.328 | 59.148 | −11.283 | 1.00 | 39.37 | B000 | C |
| ATOM | 8066 | C | HIS | F | 204 | −26.814 | 60.355 | −12.055 | 1.00 | 40.69 | B000 | C |
| ATOM | 8067 | O | HIS | F | 204 | −26.317 | 61.291 | −11.426 | 1.00 | 42.64 | B000 | O |
| ATOM | 8068 | CB | HIS | F | 204 | −26.174 | 58.188 | −11.035 | 1.00 | 43.78 | B000 | C |
| ATOM | 8069 | CG | HIS | F | 204 | −26.401 | 57.295 | −9.864 | 1.00 | 48.22 | B000 | C |
| ATOM | 8070 | ND1 | HIS | F | 204 | −26.903 | 56.017 | −9.983 | 1.00 | 46.54 | B000 | N |
| ATOM | 8071 | CD2 | HIS | F | 204 | −26.255 | 57.524 | −8.538 | 1.00 | 40.29 | B000 | C |
| ATOM | 8072 | CE1 | HIS | F | 204 | −27.021 | 55.484 | −8.781 | 1.00 | 48.73 | B000 | C |
| ATOM | 8073 | NE2 | HIS | F | 204 | −26.638 | 56.378 | −7.887 | 1.00 | 42.03 | B000 | N |
| ATOM | 8074 | N | ILE | F | 205 | −26.916 | 60.374 | −13.387 | 1.00 | 37.14 | B000 | N |
| ATOM | 8075 | CA | ILE | F | 205 | −26.350 | 61.499 | −14.131 | 1.00 | 36.61 | B000 | C |
| ATOM | 8076 | C | ILE | F | 205 | −27.319 | 62.674 | −14.148 | 1.00 | 42.45 | B000 | C |
| ATOM | 8077 | O | ILE | F | 205 | −26.895 | 63.820 | −14.292 | 1.00 | 40.59 | B000 | O |
| ATOM | 8078 | CB | ILE | F | 205 | −25.950 | 61.116 | −15.576 | 1.00 | 34.16 | B000 | C |
| ATOM | 8079 | CG1 | ILE | F | 205 | −27.167 | 60.709 | −16.402 | 1.00 | 34.84 | B000 | C |
| ATOM | 8080 | CG2 | ILE | F | 205 | −24.871 | 60.040 | −15.609 | 1.00 | 29.47 | B000 | C |
| ATOM | 8081 | CD1 | ILE | F | 205 | −26.829 | 60.403 | −17.814 | 1.00 | 37.88 | B000 | C |
| ATOM | 8082 | N | GLY | F | 206 | −28.620 | 62.416 | −14.017 | 1.00 | 43.01 | B000 | N |
| ATOM | 8083 | CA | GLY | F | 206 | −29.611 | 63.456 | −14.094 | 1.00 | 36.11 | B000 | C |
| ATOM | 8084 | C | GLY | F | 206 | −29.691 | 64.031 | −15.491 | 1.00 | 41.59 | B000 | C |
| ATOM | 8085 | O | GLY | F | 206 | −29.511 | 63.335 | −16.493 | 1.00 | 41.37 | B000 | O |
| ATOM | 8086 | N | PRO | F | 207 | −29.950 | 65.320 | −15.574 | 1.00 | 36.32 | B000 | N |
| ATOM | 8087 | CA | PRO | F | 207 | −30.143 | 65.969 | −16.875 | 1.00 | 39.41 | B000 | C |
| ATOM | 8088 | C | PRO | F | 207 | −28.881 | 66.583 | −17.484 | 1.00 | 35.53 | B000 | C |
| ATOM | 8089 | O | PRO | F | 207 | −28.943 | 67.699 | −18.000 | 1.00 | 50.85 | B000 | O |
| ATOM | 8090 | CB | PRO | F | 207 | −31.148 | 67.068 | −16.531 | 1.00 | 38.74 | B000 | C |
| ATOM | 8091 | CG | PRO | F | 207 | −30.663 | 67.508 | −15.160 | 1.00 | 35.34 | B000 | C |
| ATOM | 8092 | CD | PRO | F | 207 | −30.199 | 66.246 | −14.457 | 1.00 | 39.53 | B000 | C |

TABLE 10.3-continued

| | | | | | | | | | | |
|---|---|---|---|---|---|---|---|---|---|---|
| ATOM | 8093 | N | VAL | F | 208 | −27.741 | 65.910 | −17.422 | 1.00 | 33.23 B000 N |
| ATOM | 8094 | CA | VAL | F | 208 | −26.468 | 66.469 | −17.858 | 1.00 | 39.13 B000 C |
| ATOM | 8095 | C | VAL | F | 208 | −25.919 | 65.604 | −18.985 | 1.00 | 35.96 B000 C |
| ATOM | 8096 | O | VAL | F | 208 | −25.881 | 64.378 | −18.856 | 1.00 | 36.23 B000 O |
| ATOM | 8097 | CB | VAL | F | 208 | −25.470 | 66.542 | −16.690 | 1.00 | 35.73 B000 C |
| ATOM | 8098 | CG1 | VAL | F | 208 | −24.205 | 67.239 | −17.130 | 1.00 | 31.91 B000 C |
| ATOM | 8099 | CG2 | VAL | F | 208 | −26.108 | 67.258 | −15.495 | 1.00 | 37.34 B000 C |
| ATOM | 8100 | N | ASN | F | 209 | −25.509 | 66.232 | −20.088 | 1.00 | 32.26 B000 N |
| ATOM | 8101 | CA | ASN | F | 209 | −24.855 | 65.476 | −21.157 | 1.00 | 32.97 B000 C |
| ATOM | 8102 | C | ASN | F | 209 | −23.617 | 64.755 | −20.626 | 1.00 | 34.25 B000 C |
| ATOM | 8103 | O | ASN | F | 209 | −22.796 | 65.346 | −19.917 | 1.00 | 33.13 B000 O |
| ATOM | 8104 | CB | ASN | F | 209 | −24.481 | 66.389 | −22.315 | 1.00 | 30.89 B000 C |
| ATOM | 8105 | CG | ASN | F | 209 | −25.679 | 66.764 | −23.167 | 1.00 | 37.35 B000 C |
| ATOM | 8106 | OD1 | ASN | F | 209 | −26.585 | 65.948 | −23.377 | 1.00 | 36.11 B000 O |
| ATOM | 8107 | ND2 | ASN | F | 209 | −25.682 | 67.989 | −23.685 | 1.00 | 31.49 B000 N |
| ATOM | 8108 | N | THR | F | 210 | −23.508 | 63.458 | −20.934 | 1.00 | 30.22 B000 N |
| ATOM | 8109 | CA | THR | F | 210 | −22.544 | 62.592 | −20.266 | 1.00 | 31.09 B000 C |
| ATOM | 8110 | C | THR | F | 210 | −21.985 | 61.559 | −21.244 | 1.00 | 34.46 B000 C |
| ATOM | 8111 | O | THR | F | 210 | −22.756 | 60.821 | −21.873 | 1.00 | 32.16 B000 O |
| ATOM | 8112 | CB | THR | F | 210 | −23.210 | 61.900 | −19.071 | 1.00 | 32.23 B000 C |
| ATOM | 8113 | OG1 | THR | F | 210 | −23.838 | 62.882 | −18.229 | 1.00 | 31.01 B000 O |
| ATOM | 8114 | CG2 | THR | F | 210 | −22.187 | 61.116 | −18.256 | 1.00 | 27.20 B000 C |
| ATOM | 8115 | N | TRP | F | 211 | −20.650 | 61.510 | −21.371 | 1.00 | 29.01 B000 N |
| ATOM | 8116 | CA | TRP | F | 211 | −19.987 | 60.567 | −22.278 | 1.00 | 30.78 B000 C |
| ATOM | 8117 | C | TRP | F | 211 | −20.208 | 59.116 | −21.857 | 1.00 | 33.57 B000 C |
| ATOM | 8118 | O | TRP | F | 211 | −20.215 | 58.792 | −20.667 | 1.00 | 33.68 B000 O |
| ATOM | 8119 | CB | TRP | F | 211 | −18.473 | 60.834 | −22.329 | 1.00 | 28.32 B000 C |
| ATOM | 8120 | CG | TRP | F | 211 | −18.041 | 62.091 | −23.074 | 1.00 | 29.99 B000 C |
| ATOM | 8121 | CD1 | TRP | F | 211 | −17.177 | 63.044 | −22.623 | 1.00 | 28.61 B000 C |
| ATOM | 8122 | CD2 | TRP | F | 211 | −18.423 | 62.498 | −24.404 | 1.00 | 30.26 B000 C |
| ATOM | 8123 | NE1 | TRP | F | 211 | −16.989 | 64.012 | −23.580 | 1.00 | 32.26 B000 N |
| ATOM | 8124 | CE2 | TRP | F | 211 | −17.742 | 63.709 | −24.681 | 1.00 | 29.27 B000 C |
| ATOM | 8125 | CE3 | TRP | F | 211 | −19.273 | 61.958 | −25.381 | 1.00 | 26.34 B000 C |
| ATOM | 8126 | CZ2 | TRP | F | 211 | −17.891 | 64.402 | −25.888 | 1.00 | 28.81 B000 C |
| ATOM | 8127 | CZ3 | TRP | F | 211 | −19.431 | 62.640 | −26.575 | 1.00 | 28.36 B000 C |
| ATOM | 8128 | CH2 | TRP | F | 211 | −18.739 | 63.866 | −26.818 | 1.00 | 34.89 B000 C |
| ATOM | 8129 | N | MET | F | 212 | −20.359 | 58.232 | −22.845 | 1.00 | 36.13 B000 N |
| ATOM | 8130 | CA | MET | F | 212 | −20.261 | 56.789 | −22.634 | 1.00 | 36.28 B000 C |
| ATOM | 8131 | C | MET | F | 212 | −19.149 | 56.198 | −23.506 | 1.00 | 41.20 B000 C |
| ATOM | 8132 | O | MET | F | 212 | −18.610 | 56.848 | −24.412 | 1.00 | 38.23 B000 O |
| ATOM | 8133 | CB | MET | F | 212 | −21.598 | 56.096 | −22.919 | 1.00 | 36.01 B000 C |
| ATOM | 8134 | CG | MET | F | 212 | −21.950 | 55.930 | −24.386 | 1.00 | 32.65 B000 C |
| ATOM | 8135 | SD | MET | F | 212 | −23.698 | 55.486 | −24.615 | 1.00 | 40.40 B000 S |
| ATOM | 8136 | CE | MET | F | 212 | −24.541 | 57.090 | −24.376 | 1.00 | 32.88 B000 C |
| ATOM | 8137 | N | GLY | F | 213 | −18.810 | 54.942 | −23.233 | 1.00 | 41.45 B000 N |
| ATOM | 8138 | CA | GLY | F | 213 | −17.729 | 54.287 | −23.952 | 1.00 | 36.96 B000 C |
| ATOM | 8139 | C | GLY | F | 213 | −18.090 | 53.824 | −25.345 | 1.00 | 39.99 B000 C |
| ATOM | 8140 | O | GLY | F | 213 | −17.905 | 52.645 | −25.677 | 1.00 | 38.24 B000 O |
| ATOM | 8141 | N | LEU | F | 214 | −18.614 | 54.732 | −26.173 | 1.00 | 34.09 B000 N |
| ATOM | 8142 | CA | LEU | F | 214 | −19.135 | 54.371 | −27.489 | 1.00 | 37.28 B000 C |
| ATOM | 8143 | C | LEU | F | 214 | −18.700 | 55.449 | −28.470 | 1.00 | 36.04 B000 C |
| ATOM | 8144 | O | LEU | F | 214 | −18.965 | 56.632 | −28.244 | 1.00 | 38.95 B000 O |
| ATOM | 8145 | CB | LEU | F | 214 | −20.673 | 54.216 | −27.453 | 1.00 | 36.90 B000 C |
| ATOM | 8146 | CG | LEU | F | 214 | −21.474 | 53.990 | −28.753 | 1.00 | 39.75 B000 C |
| ATOM | 8147 | CD1 | LEU | F | 214 | −20.997 | 52.758 | −29.501 | 1.00 | 40.07 B000 C |
| ATOM | 8148 | CD2 | LEU | F | 214 | −22.967 | 53.871 | −28.493 | 1.00 | 34.46 B000 C |
| ATOM | 8149 | N | HIS | F | 215 | −18.023 | 55.054 | −29.545 | 1.00 | 41.21 B000 N |
| ATOM | 8150 | CA | HIS | F | 215 | −17.454 | 56.028 | −30.471 | 1.00 | 43.32 B000 C |
| ATOM | 8151 | C | HIS | F | 215 | −17.360 | 55.421 | −31.860 | 1.00 | 44.63 B000 C |
| ATOM | 8152 | O | HIS | F | 215 | −17.496 | 54.209 | −32.041 | 1.00 | 41.89 B000 O |
| ATOM | 8153 | CB | HIS | F | 215 | −16.081 | 56.493 | −30.014 | 1.00 | 37.84 B000 C |
| ATOM | 8154 | CG | HIS | F | 215 | −15.059 | 55.406 | −30.023 | 1.00 | 48.13 B000 C |
| ATOM | 8155 | ND1 | HIS | F | 215 | −14.161 | 55.238 | −31.054 | 1.00 | 51.31 B000 N |
| ATOM | 8156 | CD2 | HIS | F | 215 | −14.806 | 54.416 | −29.137 | 1.00 | 50.71 B000 C |
| ATOM | 8157 | CE1 | HIS | F | 215 | −13.391 | 54.198 | −30.797 | 1.00 | 52.71 B000 C |
| ATOM | 8158 | NE2 | HIS | F | 215 | −13.760 | 53.683 | −29.639 | 1.00 | 46.57 B000 N |
| ATOM | 8159 | N | ASP | F | 216 | −17.144 | 56.288 | −32.853 | 1.00 | 40.97 B000 N |
| ATOM | 8160 | CA | ASP | F | 216 | −17.135 | 55.874 | −34.252 | 1.00 | 42.50 B000 C |
| ATOM | 8161 | C | ASP | F | 216 | −15.783 | 56.113 | −34.912 | 1.00 | 43.44 B000 C |
| ATOM | 8162 | O | ASP | F | 216 | −15.701 | 56.251 | −36.131 | 1.00 | 42.45 B000 O |
| ATOM | 8163 | CB | ASP | F | 216 | −18.241 | 56.589 | −35.029 | 1.00 | 40.42 B000 C |
| ATOM | 8164 | CG | ASP | F | 216 | −17.950 | 58.067 | −35.268 | 1.00 | 43.85 B000 C |
| ATOM | 8165 | OD1 | ASP | F | 216 | −16.970 | 58.617 | −34.703 | 1.00 | 43.41 B000 O |
| ATOM | 8166 | OD2 | ASP | F | 216 | −18.733 | 58.690 | −36.024 | 1.00 | 45.80 B000 O1− |
| ATOM | 8167 | N | GLN | F | 217 | −14.710 | 56.137 | −34.128 | 1.00 | 51.10 B000 N |
| ATOM | 8168 | CA | GLN | F | 217 | −13.512 | 56.817 | −34.600 | 1.00 | 58.50 B000 C |
| ATOM | 8169 | C | GLN | F | 217 | −12.746 | 56.030 | −35.663 | 1.00 | 59.01 B000 C |
| ATOM | 8170 | O | GLN | F | 217 | −11.858 | 56.600 | −36.302 | 1.00 | 64.06 B000 O |
| ATOM | 8171 | CB | GLN | F | 217 | −12.653 | 57.214 | −33.385 | 1.00 | 60.37 B000 C |
| ATOM | 8172 | CG | GLN | F | 217 | −13.415 | 58.358 | −32.581 | 1.00 | 65.68 B000 C |

TABLE 10.3-continued

| ATOM | 8173 | CD | GLN | F | 217 | −12.601 | 59.087 | −31.493 | 1.00 | 70.67 | B000 | C |
|---|---|---|---|---|---|---|---|---|---|---|---|---|
| ATOM | 8174 | OE1 | GLN | F | 217 | −12.640 | 58.714 | −30.307 | 1.00 | 52.11 | B000 | O |
| ATOM | 8175 | NE2 | GLN | F | 217 | −11.925 | 60.175 | −31.884 | 1.00 | 67.51 | B000 | N |
| ATOM | 8176 | N | ASN | F | 218 | −13.108 | 54.777 | −35.930 | 1.00 | 52.55 | B000 | N |
| ATOM | 8177 | CA | ASN | F | 218 | −12.597 | 54.084 | −37.103 | 1.00 | 58.15 | B000 | C |
| ATOM | 8178 | C | ASN | F | 218 | −13.615 | 53.968 | −38.223 | 1.00 | 65.45 | B000 | C |
| ATOM | 8179 | O | ASN | F | 218 | −13.292 | 53.430 | −39.289 | 1.00 | 62.69 | B000 | O |
| ATOM | 8180 | CB | ASN | F | 218 | −12.114 | 52.698 | −36.724 | 1.00 | 71.05 | B000 | C |
| ATOM | 8181 | CG | ASN | F | 218 | −10.817 | 52.743 | −35.976 | 1.00 | 81.96 | B000 | C |
| ATOM | 8182 | OD1 | ASN | F | 218 | −10.715 | 52.221 | −34.854 | 1.00 | 76.60 | B000 | O |
| ATOM | 8183 | ND2 | ASN | F | 218 | −9.816 | 53.410 | −36.568 | 1.00 | 58.18 | B000 | N |
| ATOM | 8184 | N | GLY | F | 219 | −14.834 | 54.440 | −38.007 | 1.00 | 51.95 | B000 | N |
| ATOM | 8185 | CA | GLY | F | 219 | −15.897 | 54.245 | −38.957 | 1.00 | 50.90 | B000 | C |
| ATOM | 8186 | C | GLY | F | 219 | −17.074 | 53.561 | −38.292 | 1.00 | 41.92 | B000 | C |
| ATOM | 8187 | O | GLY | F | 219 | −18.131 | 54.156 | −38.073 | 1.00 | 49.46 | B000 | O |
| ATOM | 8188 | N | PRO | F | 220 | −16.902 | 52.297 | −37.938 | 1.00 | 48.10 | B000 | N |
| ATOM | 8189 | CA | PRO | F | 220 | −17.984 | 51.582 | −37.251 | 1.00 | 50.76 | B000 | C |
| ATOM | 8190 | C | PRO | F | 220 | −18.125 | 52.032 | −35.803 | 1.00 | 45.49 | B000 | C |
| ATOM | 8191 | O | PRO | F | 220 | −17.137 | 52.233 | −35.095 | 1.00 | 50.03 | B000 | O |
| ATOM | 8192 | CB | PRO | F | 220 | −17.550 | 50.113 | −37.340 | 1.00 | 44.33 | B000 | C |
| ATOM | 8193 | CG | PRO | F | 220 | −16.058 | 50.172 | −37.501 | 1.00 | 53.78 | B000 | C |
| ATOM | 8194 | CD | PRO | F | 220 | −15.762 | 51.421 | −38.268 | 1.00 | 48.76 | B000 | C |
| ATOM | 8195 | N | TRP | F | 221 | −19.371 | 52.181 | −35.365 | 1.00 | 42.06 | B000 | N |
| ATOM | 8196 | CA | TRP | F | 221 | −19.631 | 52.403 | −33.953 | 1.00 | 44.69 | B000 | C |
| ATOM | 8197 | C | TRP | F | 221 | −19.168 | 51.194 | −33.147 | 1.00 | 38.24 | B000 | C |
| ATOM | 8198 | O | TRP | F | 221 | −19.473 | 50.053 | −33.498 | 1.00 | 49.53 | B000 | O |
| ATOM | 8199 | CB | TRP | F | 221 | −21.123 | 52.668 | −33.733 | 1.00 | 41.17 | B000 | C |
| ATOM | 8200 | CG | TRP | F | 221 | −21.529 | 54.055 | −34.121 | 1.00 | 43.26 | B000 | C |
| ATOM | 8201 | CD1 | TRP | F | 221 | −22.156 | 54.450 | −35.268 | 1.00 | 36.74 | B000 | C |
| ATOM | 8202 | CD2 | TRP | F | 221 | −21.300 | 55.244 | −33.355 | 1.00 | 34.96 | B000 | C |
| ATOM | 8203 | NE1 | TRP | F | 221 | −22.336 | 55.817 | −35.259 | 1.00 | 35.73 | B000 | N |
| ATOM | 8204 | CE2 | TRP | F | 221 | −21.824 | 56.322 | −34.089 | 1.00 | 37.88 | B000 | C |
| ATOM | 8205 | CE3 | TRP | F | 221 | −20.709 | 55.492 | −32.116 | 1.00 | 35.21 | B000 | C |
| ATOM | 8206 | CZ2 | TRP | F | 221 | −21.781 | 57.639 | −33.617 | 1.00 | 42.62 | B000 | C |
| ATOM | 8207 | CZ3 | TRP | F | 221 | −20.663 | 56.791 | −31.648 | 1.00 | 39.03 | B000 | C |
| ATOM | 8208 | CH2 | TRP | F | 221 | −21.194 | 57.848 | −32.395 | 1.00 | 38.23 | B000 | C |
| ATOM | 8209 | N | LYS | F | 222 | −18.432 | 51.450 | −32.065 | 1.00 | 41.84 | B000 | N |
| ATOM | 8210 | CA | LYS | F | 222 | −17.829 | 50.409 | −31.245 | 1.00 | 41.88 | B000 | C |
| ATOM | 8211 | C | LYS | F | 222 | −17.885 | 50.777 | −29.770 | 1.00 | 45.01 | B000 | C |
| ATOM | 8212 | O | LYS | F | 222 | −17.788 | 51.953 | −29.409 | 1.00 | 38.97 | B000 | O |
| ATOM | 8213 | CB | LYS | F | 222 | −16.367 | 50.176 | −31.639 | 1.00 | 47.29 | B000 | C |
| ATOM | 8214 | CG | LYS | F | 222 | −16.184 | 49.600 | −33.033 | 1.00 | 60.26 | B000 | C |
| ATOM | 8215 | CD | LYS | F | 222 | −14.729 | 49.672 | −33.464 | 1.00 | 61.80 | B000 | C |
| ATOM | 8216 | CE | LYS | F | 222 | −14.371 | 51.081 | −33.924 | 1.00 | 69.59 | B000 | C |
| ATOM | 8217 | NZ | LYS | F | 222 | −13.030 | 51.109 | −34.562 | 1.00 | 80.69 | B000 | N1+ |
| ATOM | 8218 | N | TRP | F | 223 | −18.007 | 49.751 | −28.918 | 1.00 | 43.07 | B000 | N |
| ATOM | 8219 | CA | TRP | F | 223 | −17.864 | 49.911 | −27.476 | 1.00 | 42.29 | B000 | C |
| ATOM | 8220 | C | TRP | F | 223 | −16.411 | 49.702 | −27.074 | 1.00 | 45.99 | B000 | C |
| ATOM | 8221 | O | TRP | F | 223 | −15.708 | 48.879 | −27.661 | 1.00 | 52.22 | B000 | O |
| ATOM | 8222 | CB | TRP | F | 223 | −18.762 | 48.940 | −26.696 | 1.00 | 41.28 | B000 | C |
| ATOM | 8223 | CG | TRP | F | 223 | −20.258 | 49.200 | −26.825 | 1.00 | 43.60 | B000 | C |
| ATOM | 8224 | CD1 | TRP | F | 223 | −21.155 | 48.512 | −27.605 | 1.00 | 41.95 | B000 | C |
| ATOM | 8225 | CD2 | TRP | F | 223 | −21.014 | 50.224 | −26.158 | 1.00 | 45.65 | B000 | C |
| ATOM | 8226 | NE1 | TRP | F | 223 | −22.422 | 49.047 | −27.462 | 1.00 | 42.77 | B000 | N |
| ATOM | 8227 | CE2 | TRP | F | 223 | −22.366 | 50.089 | −26.575 | 1.00 | 41.46 | B000 | C |
| ATOM | 8228 | CE3 | TRP | F | 223 | −20.684 | 51.237 | −25.249 | 1.00 | 40.03 | B000 | C |
| ATOM | 8229 | CZ2 | TRP | F | 223 | −23.376 | 50.933 | −26.118 | 1.00 | 42.16 | B000 | C |
| ATOM | 8230 | CZ3 | TRP | F | 223 | −21.695 | 52.075 | −24.792 | 1.00 | 38.55 | B000 | C |
| ATOM | 8231 | CH2 | TRP | F | 223 | −23.023 | 51.918 | −25.225 | 1.00 | 39.46 | B000 | C |
| ATOM | 8232 | N | VAL | F | 224 | −15.966 | 50.458 | −26.065 | 1.00 | 39.89 | B000 | N |
| ATOM | 8233 | CA | VAL | F | 224 | −14.557 | 50.478 | −25.696 | 1.00 | 41.43 | B000 | C |
| ATOM | 8234 | C | VAL | F | 224 | −14.084 | 49.166 | −25.090 | 1.00 | 43.72 | B000 | C |
| ATOM | 8235 | O | VAL | F | 224 | −12.878 | 48.924 | −25.048 | 1.00 | 41.80 | B000 | O |
| ATOM | 8236 | CB | VAL | F | 224 | −14.257 | 51.635 | −24.718 | 1.00 | 38.57 | B000 | C |
| ATOM | 8237 | CG1 | VAL | F | 224 | −14.434 | 52.978 | −25.419 | 1.00 | 35.91 | B000 | C |
| ATOM | 8238 | CG2 | VAL | F | 224 | −15.154 | 51.522 | −23.509 | 1.00 | 37.24 | B000 | C |
| ATOM | 8239 | N | ASP | F | 225 | −14.978 | 48.330 | −24.572 | 1.00 | 44.78 | B000 | N |
| ATOM | 8240 | CA | ASP | F | 225 | −14.559 | 47.074 | −23.971 | 1.00 | 40.21 | B000 | C |
| ATOM | 8241 | C | ASP | F | 225 | −14.719 | 45.908 | −24.924 | 1.00 | 47.22 | B000 | C |
| ATOM | 8242 | O | ASP | F | 225 | −14.534 | 44.763 | −24.513 | 1.00 | 49.29 | B000 | O |
| ATOM | 8243 | CB | ASP | F | 225 | −15.321 | 46.788 | −22.679 | 1.00 | 41.32 | B000 | C |
| ATOM | 8244 | CG | ASP | F | 225 | −16.790 | 46.487 | −22.914 | 1.00 | 46.80 | B000 | C |
| ATOM | 8245 | OD1 | ASP | F | 225 | −17.305 | 46.755 | −24.021 | 1.00 | 40.18 | B000 | O |
| ATOM | 8246 | OD2 | ASP | F | 225 | −17.426 | 45.946 | −21.982 | 1.00 | 55.82 | B000 | O1− |
| ATOM | 8247 | N | GLY | F | 226 | −15.078 | 46.173 | −26.181 | 1.00 | 46.15 | B000 | N |
| ATOM | 8248 | CA | GLY | F | 226 | −15.202 | 45.151 | −27.189 | 1.00 | 44.93 | B000 | C |
| ATOM | 8249 | C | GLY | F | 226 | −16.606 | 44.610 | −27.394 | 1.00 | 49.56 | B000 | C |
| ATOM | 8250 | O | GLY | F | 226 | −16.858 | 43.993 | −28.440 | 1.00 | 52.14 | B000 | O |
| ATOM | 8251 | N | THR | F | 227 | −17.522 | 44.843 | −26.443 | 1.00 | 45.78 | B000 | N |
| ATOM | 8252 | CA | THR | F | 227 | −18.938 | 44.496 | −26.585 | 1.00 | 38.28 | B000 | C |

TABLE 10.3-continued

| | | | | | | | | | | |
|---|---|---|---|---|---|---|---|---|---|---|
| ATOM | 8253 | C | THR | F | 227 | −19.437 | 44.781 | −27.996 | 1.00 | 49.56 | B000 C |
| ATOM | 8254 | O | THR | F | 227 | −19.216 | 45.868 | −28.544 | 1.00 | 51.44 | B000 O |
| ATOM | 8255 | CB | THR | F | 227 | −19.779 | 45.282 | −25.571 | 1.00 | 46.77 | B000 C |
| ATOM | 8256 | OG1 | THR | F | 227 | −19.284 | 45.062 | −24.244 | 1.00 | 49.45 | B000 O |
| ATOM | 8257 | CG2 | THR | F | 227 | −21.244 | 44.872 | −25.628 | 1.00 | 32.96 | B000 C |
| ATOM | 8258 | N | ASP | F | 228 | −20.089 | 43.791 | −28.594 | 1.00 | 48.42 | B000 N |
| ATOM | 8259 | CA | ASP | F | 228 | −20.557 | 43.942 | −29.964 | 1.00 | 52.56 | B000 C |
| ATOM | 8260 | C | ASP | F | 228 | −21.653 | 44.996 | −30.034 | 1.00 | 47.16 | B000 C |
| ATOM | 8261 | O | ASP | F | 228 | −22.638 | 44.926 | −29.297 | 1.00 | 54.76 | B000 O |
| ATOM | 8262 | CB | ASP | F | 228 | −21.080 | 42.609 | −30.513 | 1.00 | 52.04 | B000 C |
| ATOM | 8263 | CG | ASP | F | 228 | −21.620 | 42.741 | −31.938 | 1.00 | 51.96 | B000 C |
| ATOM | 8264 | OD1 | ASP | F | 228 | −20.800 | 42.871 | −32.867 | 1.00 | 55.04 | B000 O |
| ATOM | 8265 | OD2 | ASP | F | 228 | −22.857 | 42.731 | −32.133 | 1.00 | 53.62 | B000 O1− |
| ATOM | 8266 | N | TYR | F | 229 | −21.480 | 45.975 | −30.926 | 1.00 | 49.63 | B000 N |
| ATOM | 8267 | CA | TYR | F | 229 | −22.438 | 47.072 | −31.032 | 1.00 | 51.91 | B000 C |
| ATOM | 8268 | C | TYR | F | 229 | −23.725 | 46.641 | −31.741 | 1.00 | 51.02 | B000 C |
| ATOM | 8269 | O | TYR | F | 229 | −24.823 | 47.054 | −31.343 | 1.00 | 48.95 | B000 O |
| ATOM | 8270 | CB | TYR | F | 229 | −21.800 | 48.280 | −31.749 | 1.00 | 41.08 | B000 C |
| ATOM | 8271 | CG | TYR | F | 229 | −22.801 | 49.368 | −32.155 | 1.00 | 42.20 | B000 C |
| ATOM | 8272 | CD1 | TYR | F | 229 | −23.377 | 50.216 | −31.208 | 1.00 | 40.58 | B000 C |
| ATOM | 8273 | CD2 | TYR | F | 229 | −23.178 | 49.530 | −33.482 | 1.00 | 40.58 | B000 C |
| ATOM | 8274 | CE1 | TYR | F | 229 | −24.293 | 51.223 | −31.586 | 1.00 | 37.62 | B000 C |
| ATOM | 8275 | CE2 | TYR | F | 229 | −24.088 | 50.511 | −33.864 | 1.00 | 42.49 | B000 C |
| ATOM | 8276 | CZ | TYR | F | 229 | −24.634 | 51.359 | −32.910 | 1.00 | 40.45 | B000 C |
| ATOM | 8277 | OH | TYR | F | 229 | −25.527 | 52.323 | −33.311 | 1.00 | 45.55 | B000 O |
| ATOM | 8278 | N | GLU | F | 230 | −23.605 | 45.833 | −32.800 | 1.00 | 57.91 | B000 N |
| ATOM | 8279 | CA | GLU | F | 230 | −24.743 | 45.560 | −33.679 | 1.00 | 55.10 | B000 C |
| ATOM | 8280 | C | GLU | F | 230 | −25.831 | 44.782 | −32.956 | 1.00 | 53.04 | B000 C |
| ATOM | 8281 | O | GLU | F | 230 | −27.014 | 45.118 | −33.055 | 1.00 | 52.09 | B000 O |
| ATOM | 8282 | CB | GLU | F | 230 | −24.273 | 44.782 | −34.909 | 1.00 | 58.23 | B000 C |
| ATOM | 8283 | CG | GLU | F | 230 | −25.270 | 44.727 | −36.048 | 1.00 | 61.69 | B000 C |
| ATOM | 8284 | CD | GLU | F | 230 | −25.912 | 46.067 | −36.325 | 1.00 | 76.73 | B000 C |
| ATOM | 8285 | OE1 | GLU | F | 230 | −27.160 | 46.119 | −36.285 | 1.00 | 75.40 | B000 O |
| ATOM | 8286 | OE2 | GLU | F | 230 | −25.178 | 47.067 | −36.556 | 1.00 | 78.82 | B000 O1− |
| ATOM | 8287 | N | THR | F | 231 | −25.449 | 43.767 | −32.201 | 1.00 | 51.54 | B000 N |
| ATOM | 8288 | CA | THR | F | 231 | −26.410 | 42.954 | −31.478 | 1.00 | 55.16 | B000 C |
| ATOM | 8289 | C | THR | F | 231 | −26.687 | 43.461 | −30.072 | 1.00 | 58.68 | B000 C |
| ATOM | 8290 | O | THR | F | 231 | −27.516 | 42.866 | −29.371 | 1.00 | 54.74 | B000 O |
| ATOM | 8291 | CB | THR | F | 231 | −25.922 | 41.510 | −31.415 | 1.00 | 49.05 | B000 C |
| ATOM | 8292 | OG1 | THR | F | 231 | −24.684 | 41.463 | −30.698 | 1.00 | 52.11 | B000 O |
| ATOM | 8293 | CG2 | THR | F | 231 | −25.715 | 40.964 | −32.820 | 1.00 | 45.52 | B000 C |
| ATOM | 8294 | N | GLY | F | 232 | −26.030 | 44.546 | −29.646 | 1.00 | 55.48 | B000 N |
| ATOM | 8295 | CA | GLY | F | 232 | −26.155 | 45.022 | −28.285 | 1.00 | 46.35 | B000 C |
| ATOM | 8296 | C | GLY | F | 232 | −27.303 | 46.007 | −28.088 | 1.00 | 42.93 | B000 C |
| ATOM | 8297 | O | GLY | F | 232 | −27.997 | 46.417 | −29.016 | 1.00 | 45.48 | B000 O |
| ATOM | 8298 | N | PHE | F | 233 | −27.484 | 46.390 | −26.830 | 1.00 | 40.91 | B000 N |
| ATOM | 8299 | CA | PHE | F | 233 | −28.463 | 47.401 | −26.462 | 1.00 | 38.08 | B000 C |
| ATOM | 8300 | C | PHE | F | 233 | −28.162 | 48.738 | −27.146 | 1.00 | 45.77 | B000 C |
| ATOM | 8301 | O | PHE | F | 233 | −26.997 | 49.125 | −27.305 | 1.00 | 39.98 | B000 O |
| ATOM | 8302 | CB | PHE | F | 233 | −28.440 | 47.548 | −24.939 | 1.00 | 42.77 | B000 C |
| ATOM | 8303 | CG | PHE | F | 233 | −29.411 | 48.544 | −24.406 | 1.00 | 46.27 | B000 C |
| ATOM | 8304 | CD1 | PHE | F | 233 | −30.749 | 48.224 | −24.274 | 1.00 | 47.88 | B000 C |
| ATOM | 8305 | CD2 | PHE | F | 233 | −28.981 | 49.804 | −24.013 | 1.00 | 42.70 | B000 C |
| ATOM | 8306 | CE1 | PHE | F | 233 | −31.650 | 49.153 | −23.777 | 1.00 | 51.88 | B000 C |
| ATOM | 8307 | CE2 | PHE | F | 233 | −29.871 | 50.726 | −23.515 | 1.00 | 41.09 | B000 C |
| ATOM | 8308 | CZ | PHE | F | 233 | −31.206 | 50.404 | −23.391 | 1.00 | 45.56 | B000 C |
| ATOM | 8309 | N | LYS | F | 234 | −29.225 | 49.439 | −27.562 | 1.00 | 40.43 | B000 N |
| ATOM | 8310 | CA | LYS | F | 234 | −29.131 | 50.788 | −28.118 | 1.00 | 41.63 | B000 C |
| ATOM | 8311 | C | LYS | F | 234 | −30.309 | 51.634 | −27.654 | 1.00 | 46.34 | B000 C |
| ATOM | 8312 | O | LYS | F | 234 | −31.441 | 51.156 | −27.610 | 1.00 | 48.63 | B000 O |
| ATOM | 8313 | CB | LYS | F | 234 | −29.123 | 50.778 | −29.649 | 1.00 | 44.55 | B000 C |
| ATOM | 8314 | CG | LYS | F | 234 | −27.951 | 50.067 | −30.289 | 1.00 | 40.30 | B000 C |
| ATOM | 8315 | CD | LYS | F | 234 | −28.092 | 50.103 | −31.807 | 1.00 | 43.14 | B000 C |
| ATOM | 8316 | CE | LYS | F | 234 | −27.123 | 49.127 | −32.446 | 1.00 | 48.35 | B000 C |
| ATOM | 8317 | NZ | LYS | F | 234 | −27.471 | 47.729 | −32.045 | 1.00 | 53.70 | B000 N1+ |
| ATOM | 8318 | N | ASN | F | 235 | −30.060 | 52.909 | −27.362 | 1.00 | 47.83 | B000 N |
| ATOM | 8319 | CA | ASN | F | 235 | −31.120 | 53.815 | −26.906 | 1.00 | 38.15 | B000 C |
| ATOM | 8320 | C | ASN | F | 235 | −30.936 | 55.217 | −27.509 | 1.00 | 39.90 | B000 C |
| ATOM | 8321 | O | ASN | F | 235 | −30.978 | 56.235 | −26.819 | 1.00 | 38.13 | B000 O |
| ATOM | 8322 | CB | ASN | F | 235 | −31.154 | 53.827 | −25.376 | 1.00 | 37.57 | B000 C |
| ATOM | 8323 | CG | ASN | F | 235 | −32.291 | 54.652 | −24.816 | 1.00 | 44.55 | B000 C |
| ATOM | 8324 | OD1 | ASN | F | 235 | −33.337 | 54.797 | −25.445 | 1.00 | 47.07 | B000 O |
| ATOM | 8325 | ND2 | ASN | F | 235 | −32.088 | 55.204 | −23.620 | 1.00 | 46.24 | B000 N |
| ATOM | 8326 | N | TRP | F | 236 | −30.749 | 55.278 | −28.826 | 1.00 | 36.87 | B000 N |
| ATOM | 8327 | CA | TRP | F | 236 | −30.517 | 56.540 | −29.518 | 1.00 | 38.92 | B000 C |
| ATOM | 8328 | C | TRP | F | 236 | −31.753 | 57.439 | −29.510 | 1.00 | 41.60 | B000 C |
| ATOM | 8329 | O | TRP | F | 236 | −32.890 | 56.967 | −29.580 | 1.00 | 44.93 | B000 O |
| ATOM | 8330 | CB | TRP | F | 236 | −30.123 | 56.288 | −30.973 | 1.00 | 32.28 | B000 C |
| ATOM | 8331 | CG | TRP | F | 236 | −28.813 | 55.606 | −31.170 | 1.00 | 44.09 | B000 C |
| ATOM | 8332 | CD1 | TRP | F | 236 | −28.612 | 54.296 | −31.518 | 1.00 | 40.32 | B000 C |

TABLE 10.3-continued

| ATOM | 8333 | CD2 | TRP | F | 236 | −27.511 | 56.192 | −31.037 | 1.00 | 41.90 | B000 C |
| ATOM | 8334 | NE1 | TRP | F | 236 | −27.266 | 54.034 | −31.608 | 1.00 | 35.68 | B000 N |
| ATOM | 8335 | CE2 | TRP | F | 236 | −26.568 | 55.182 | −31.327 | 1.00 | 41.49 | B000 C |
| ATOM | 8336 | CE3 | TRP | F | 236 | −27.051 | 57.474 | −30.700 | 1.00 | 37.67 | B000 C |
| ATOM | 8337 | CZ2 | TRP | F | 236 | −25.183 | 55.420 | −31.300 | 1.00 | 41.56 | B000 C |
| ATOM | 8338 | CZ3 | TRP | F | 236 | −25.686 | 57.715 | −30.683 | 1.00 | 37.32 | B000 C |
| ATOM | 8339 | CH2 | TRP | F | 236 | −24.762 | 56.689 | −30.982 | 1.00 | 41.77 | B000 C |
| ATOM | 8340 | N | ARG | F | 237 | −31.508 | 58.757 | −29.481 | 1.00 | 35.83 | B000 N |
| ATOM | 8341 | CA | ARG | F | 237 | −32.537 | 59.734 | −29.801 | 1.00 | 44.59 | B000 C |
| ATOM | 8342 | C | ARG | F | 237 | −33.103 | 59.444 | −31.181 | 1.00 | 48.74 | B000 C |
| ATOM | 8343 | O | ARG | F | 237 | −32.434 | 58.828 | −32.017 | 1.00 | 49.21 | B000 O |
| ATOM | 8344 | CB | ARG | F | 237 | −31.976 | 61.164 | −29.788 | 1.00 | 36.97 | B000 C |
| ATOM | 8345 | CG | ARG | F | 237 | −31.858 | 61.766 | −28.411 | 1.00 | 45.68 | B000 C |
| ATOM | 8346 | CD | ARG | F | 237 | −33.080 | 62.584 | −28.086 | 1.00 | 53.50 | B000 C |
| ATOM | 8347 | NE | ARG | F | 237 | −32.997 | 63.225 | −26.778 | 1.00 | 54.24 | B000 N |
| ATOM | 8348 | CZ | ARG | F | 237 | −32.798 | 64.523 | −26.580 | 1.00 | 66.27 | B000 C |
| ATOM | 8349 | NH1 | ARG | F | 237 | −32.738 | 65.003 | −25.335 | 1.00 | 53.38 | B000 N1+ |
| ATOM | 8350 | NH2 | ARG | F | 237 | −32.650 | 65.337 | −27.621 | 1.00 | 69.85 | B000 N |
| ATOM | 8351 | N | PRO | F | 238 | −34.326 | 59.897 | −31.447 | 1.00 | 53.51 | B000 N |
| ATOM | 8352 | CA | PRO | F | 238 | −34.896 | 59.751 | −32.790 | 1.00 | 53.89 | B000 C |
| ATOM | 8353 | C | PRO | F | 238 | −33.963 | 60.284 | −33.869 | 1.00 | 55.90 | B000 C |
| ATOM | 8354 | O | PRO | F | 238 | −33.458 | 61.409 | −33.783 | 1.00 | 47.93 | B000 O |
| ATOM | 8355 | CB | PRO | F | 238 | −36.184 | 60.577 | −32.707 | 1.00 | 53.03 | B000 C |
| ATOM | 8356 | CG | PRO | F | 238 | −36.568 | 60.511 | −31.263 | 1.00 | 50.27 | B000 C |
| ATOM | 8357 | CD | PRO | F | 238 | −35.285 | 60.495 | −30.496 | 1.00 | 54.51 | B000 C |
| ATOM | 8358 | N | GLU | F | 239 | −33.727 | 59.454 | −34.887 | 1.00 | 48.36 | B000 N |
| ATOM | 8359 | CA | GLU | F | 239 | −32.951 | 59.792 | −36.076 | 1.00 | 55.08 | B000 C |
| ATOM | 8360 | C | GLU | F | 239 | −31.463 | 59.925 | −35.799 | 1.00 | 51.71 | B000 C |
| ATOM | 8361 | O | GLU | F | 239 | −30.717 | 60.378 | −36.673 | 1.00 | 53.39 | B000 O |
| ATOM | 8362 | CB | GLU | F | 239 | −33.471 | 61.081 | −36.715 | 1.00 | 54.02 | B000 C |
| ATOM | 8363 | CG | GLU | F | 239 | −34.894 | 60.933 | −37.217 | 1.00 | 64.17 | B000 C |
| ATOM | 8364 | CD | GLU | F | 239 | −35.603 | 62.267 | −37.357 | 1.00 | 82.12 | B000 C |
| ATOM | 8365 | OE1 | GLU | F | 239 | −34.947 | 63.318 | −37.174 | 1.00 | 79.31 | B000 O |
| ATOM | 8366 | OE2 | GLU | F | 239 | −36.828 | 62.260 | −37.609 | 1.00 | 90.31 | B000 O1− |
| ATOM | 8367 | N | GLN | F | 240 | −31.010 | 59.539 | −34.613 | 1.00 | 45.35 | B000 N |
| ATOM | 8368 | CA | GLN | F | 240 | −29.594 | 59.480 | −34.313 | 1.00 | 45.02 | B000 C |
| ATOM | 8369 | C | GLN | F | 240 | −29.207 | 58.001 | −34.305 | 1.00 | 40.34 | B000 C |
| ATOM | 8370 | O | GLN | F | 240 | −30.041 | 57.164 | −33.989 | 1.00 | 38.58 | B000 O |
| ATOM | 8371 | CB | GLN | F | 240 | −29.274 | 60.163 | −32.964 | 1.00 | 40.27 | B000 C |
| ATOM | 8372 | CG | GLN | F | 240 | −29.798 | 61.588 | −32.801 | 1.00 | 35.48 | B000 C |
| ATOM | 8373 | CD | GLN | F | 240 | −29.552 | 62.460 | −34.038 | 1.00 | 52.50 | B000 C |
| ATOM | 8374 | OE1 | GLN | F | 240 | −28.448 | 62.496 | −34.599 | 1.00 | 44.08 | B000 O |
| ATOM | 8375 | NE2 | GLN | F | 240 | −30.594 | 63.166 | −34.470 | 1.00 | 52.73 | B000 N |
| ATOM | 8376 | N | PRO | F | 241 | −27.933 | 57.680 | −34.609 | 1.00 | 41.65 | B000 N |
| ATOM | 8377 | CA | PRO | F | 241 | −26.875 | 58.646 | −34.945 | 1.00 | 36.96 | B000 C |
| ATOM | 8378 | C | PRO | F | 241 | −27.011 | 59.145 | −36.366 | 1.00 | 42.81 | B000 C |
| ATOM | 8379 | O | PRO | F | 241 | −27.998 | 58.769 | −37.004 | 1.00 | 45.53 | B000 O |
| ATOM | 8380 | CB | PRO | F | 241 | −25.586 | 57.853 | −34.749 | 1.00 | 38.94 | B000 C |
| ATOM | 8381 | CG | PRO | F | 241 | −25.986 | 56.428 | −34.992 | 1.00 | 43.27 | B000 C |
| ATOM | 8382 | CD | PRO | F | 241 | −27.423 | 56.298 | −34.511 | 1.00 | 38.99 | B000 C |
| ATOM | 8383 | N | ASP | F | 242 | −26.097 | 60.013 | −36.818 | 1.00 | 39.75 | B000 N |
| ATOM | 8384 | CA | ASP | F | 242 | −26.139 | 60.504 | −38.190 | 1.00 | 36.75 | B000 C |
| ATOM | 8385 | C | ASP | F | 242 | −26.229 | 59.323 | −39.143 | 1.00 | 43.99 | B000 C |
| ATOM | 8386 | O | ASP | F | 242 | −25.504 | 58.332 | −38.991 | 1.00 | 46.47 | B000 O |
| ATOM | 8387 | CB | ASP | F | 242 | −24.894 | 61.335 | −38.515 | 1.00 | 49.95 | B000 C |
| ATOM | 8388 | CG | ASP | F | 242 | −24.677 | 62.473 | −37.551 | 1.00 | 48.49 | B000 C |
| ATOM | 8389 | OD1 | ASP | F | 242 | −25.683 | 63.064 | −37.104 | 1.00 | 52.88 | B000 O |
| ATOM | 8390 | OD2 | ASP | F | 242 | −23.497 | 62.767 | −37.248 | 1.00 | 50.34 | B000 O |
| ATOM | 8391 | N | ASP | F | 243 | −27.147 | 59.405 | −40.097 | 1.00 | 38.82 | B000 N |
| ATOM | 8392 | CA | ASP | F | 243 | −27.412 | 58.269 | −40.967 | 1.00 | 51.83 | B000 C |
| ATOM | 8393 | C | ASP | F | 243 | −26.703 | 58.364 | −42.308 | 1.00 | 46.33 | B000 C |
| ATOM | 8394 | O | ASP | F | 243 | −26.951 | 57.526 | −43.172 | 1.00 | 49.46 | B000 O |
| ATOM | 8395 | CB | ASP | F | 243 | −28.919 | 58.079 | −41.193 | 1.00 | 42.32 | B000 C |
| ATOM | 8396 | CG | ASP | F | 243 | −29.605 | 59.327 | −41.786 | 1.00 | 64.08 | B000 C |
| ATOM | 8397 | OD1 | ASP | F | 243 | −28.935 | 60.346 | −42.070 | 1.00 | 56.96 | B000 O |
| ATOM | 8398 | OD2 | ASP | F | 243 | −30.842 | 59.286 | −41.971 | 1.00 | 77.59 | B000 O |
| ATOM | 8399 | N | TRP | F | 244 | −25.799 | 59.322 | −42.495 | 1.00 | 46.94 | B000 N |
| ATOM | 8400 | CA | TRP | F | 244 | −25.235 | 59.541 | −43.822 | 1.00 | 43.08 | B000 C |
| ATOM | 8401 | C | TRP | F | 244 | −24.046 | 58.643 | −44.134 | 1.00 | 41.86 | B000 C |
| ATOM | 8402 | O | TRP | F | 244 | −23.528 | 58.721 | −45.250 | 1.00 | 43.66 | B000 O |
| ATOM | 8403 | CB | TRP | F | 244 | −24.765 | 60.989 | −43.994 | 1.00 | 49.74 | B000 C |
| ATOM | 8404 | CG | TRP | F | 244 | −25.371 | 61.991 | −43.064 | 1.00 | 50.88 | B000 C |
| ATOM | 8405 | CD1 | TRP | F | 244 | −26.695 | 62.261 | −42.902 | 1.00 | 52.58 | B000 C |
| ATOM | 8406 | CD2 | TRP | F | 244 | −24.674 | 62.891 | −42.206 | 1.00 | 42.95 | B000 C |
| ATOM | 8407 | NE1 | TRP | F | 244 | −26.876 | 63.254 | −41.976 | 1.00 | 50.24 | B000 N |
| ATOM | 8408 | CE2 | TRP | F | 244 | −25.650 | 63.672 | −41.536 | 1.00 | 51.72 | B000 C |
| ATOM | 8409 | CE3 | TRP | F | 244 | −23.333 | 63.117 | −41.940 | 1.00 | 40.66 | B000 C |
| ATOM | 8410 | CZ2 | TRP | F | 244 | −25.322 | 64.660 | −40.608 | 1.00 | 34.70 | B000 C |
| ATOM | 8411 | CZ3 | TRP | F | 244 | −23.008 | 64.096 | −41.014 | 1.00 | 51.45 | B000 C |
| ATOM | 8412 | CH2 | TRP | F | 244 | −24.002 | 64.849 | −40.357 | 1.00 | 45.14 | B000 C |

TABLE 10.3-continued

| | | | | | | | | | | |
|---|---|---|---|---|---|---|---|---|---|---|
| ATOM | 8413 | N | TYR | F | 245 | −23.649 | 57.749 | −43.225 | 1.00 | 38.07 B000 N |
| ATOM | 8414 | CA | TYR | F | 245 | −22.447 | 56.950 | −43.423 | 1.00 | 34.89 B000 C |
| ATOM | 8415 | C | TYR | F | 245 | −22.709 | 55.483 | −43.712 | 1.00 | 44.67 B000 C |
| ATOM | 8416 | O | TYR | F | 245 | −21.778 | 54.779 | −44.103 | 1.00 | 52.17 B000 O |
| ATOM | 8417 | CB | TYR | F | 245 | −21.529 | 57.030 | −42.191 | 1.00 | 38.23 B000 C |
| ATOM | 8418 | CG | TYR | F | 245 | −21.240 | 58.429 | −41.761 | 1.00 | 43.82 B000 C |
| ATOM | 8419 | CD1 | TYR | F | 245 | −20.344 | 59.219 | −42.479 | 1.00 | 42.91 B000 C |
| ATOM | 8420 | CD2 | TYR | F | 245 | −21.868 | 58.976 | −40.638 | 1.00 | 38.95 B000 C |
| ATOM | 8421 | CE1 | TYR | F | 245 | −20.090 | 60.513 | −42.101 | 1.00 | 39.31 B000 C |
| ATOM | 8422 | CE2 | TYR | F | 245 | −21.616 | 60.266 | −40.249 | 1.00 | 40.49 B000 C |
| ATOM | 8423 | CZ | TYR | F | 245 | −20.719 | 61.032 | −40.978 | 1.00 | 43.99 B000 C |
| ATOM | 8424 | OH | TYR | F | 245 | −20.449 | 62.313 | −40.589 | 1.00 | 46.79 B000 O |
| ATOM | 8425 | N | GLY | F | 246 | −23.918 | 54.993 | −43.508 | 1.00 | 42.86 B000 N |
| ATOM | 8426 | CA | GLY | F | 246 | −24.172 | 53.575 | −43.641 | 1.00 | 47.08 B000 C |
| ATOM | 8427 | C | GLY | F | 246 | −24.546 | 52.918 | −42.321 | 1.00 | 48.63 B000 C |
| ATOM | 8428 | O | GLY | F | 246 | −24.464 | 53.502 | −41.238 | 1.00 | 46.31 B000 O |
| ATOM | 8429 | N | HIS | F | 247 | −25.011 | 51.682 | −42.461 | 1.00 | 45.64 B000 N |
| ATOM | 8430 | CA | HIS | F | 247 | −25.504 | 50.908 | −41.338 | 1.00 | 45.98 B000 C |
| ATOM | 8431 | C | HIS | F | 247 | −24.400 | 50.682 | −40.309 | 1.00 | 49.00 B000 C |
| ATOM | 8432 | O | HIS | F | 247 | −23.329 | 50.161 | −40.640 | 1.00 | 47.43 B000 O |
| ATOM | 8433 | CB | HIS | F | 247 | −26.052 | 49.570 | −41.836 | 1.00 | 48.96 B000 C |
| ATOM | 8434 | CG | HIS | F | 247 | −26.470 | 48.656 | −40.731 | 1.00 | 52.43 B000 C |
| ATOM | 8435 | ND1 | HIS | F | 247 | −27.650 | 48.819 | −40.037 | 1.00 | 52.47 B000 N |
| ATOM | 8436 | CD2 | HIS | F | 247 | −25.835 | 47.606 | −40.157 | 1.00 | 55.93 B000 C |
| ATOM | 8437 | CE1 | HIS | F | 247 | −27.737 | 47.891 | −39.102 | 1.00 | 55.95 B000 C |
| ATOM | 8438 | NE2 | HIS | F | 247 | −26.649 | 47.142 | −39.154 | 1.00 | 65.30 B000 N |
| ATOM | 8439 | N | GLY | F | 248 | −24.656 | 51.080 | −39.063 | 1.00 | 45.09 B000 N |
| ATOM | 8440 | CA | GLY | F | 248 | −23.694 | 50.884 | −37.992 | 1.00 | 43.43 B000 C |
| ATOM | 8441 | C | GLY | F | 248 | −22.442 | 51.723 | −38.086 | 1.00 | 44.64 B000 C |
| ATOM | 8442 | O | GLY | F | 248 | −21.463 | 51.431 | −37.391 | 1.00 | 45.17 B000 O |
| ATOM | 8443 | N | LEU | F | 249 | −22.449 | 52.777 | −38.907 | 1.00 | 44.92 B000 N |
| ATOM | 8444 | CA | LEU | F | 249 | −21.244 | 53.532 | −39.232 | 1.00 | 47.53 B000 C |
| ATOM | 8445 | C | LEU | F | 249 | −21.355 | 55.001 | −38.833 | 1.00 | 45.44 B000 C |
| ATOM | 8446 | O | LEU | F | 249 | −22.456 | 55.561 | −38.758 | 1.00 | 38.63 B000 O |
| ATOM | 8447 | CB | LEU | F | 249 | −20.942 | 53.464 | −40.737 | 1.00 | 45.64 B000 C |
| ATOM | 8448 | CG | LEU | F | 249 | −20.640 | 52.090 | −41.349 | 1.00 | 49.29 B000 C |
| ATOM | 8449 | CD1 | LEU | F | 249 | −20.212 | 52.237 | −42.809 | 1.00 | 41.47 B000 C |
| ATOM | 8450 | CD2 | LEU | F | 249 | −19.590 | 51.359 | −40.538 | 1.00 | 35.93 B000 C |
| ATOM | 8451 | N | GLY | F | 250 | −20.186 | 55.619 | −38.598 | 1.00 | 43.79 B000 N |
| ATOM | 8452 | CA | GLY | F | 250 | −20.033 | 57.062 | −38.423 | 1.00 | 40.09 B000 C |
| ATOM | 8453 | C | GLY | F | 250 | −18.890 | 57.625 | −39.262 | 1.00 | 46.39 B000 C |
| ATOM | 8454 | O | GLY | F | 250 | −18.312 | 56.892 | −40.068 | 1.00 | 46.10 B000 O |
| ATOM | 8455 | N | ALA | F | 251 | −18.553 | 58.910 | −39.081 | 1.00 | 38.76 B000 N |
| ATOM | 8456 | CA | ALA | F | 251 | −17.474 | 59.596 | −39.795 | 1.00 | 44.18 B000 C |
| ATOM | 8457 | C | ALA | F | 251 | −16.114 | 59.542 | −39.122 | 1.00 | 41.29 B000 C |
| ATOM | 8458 | O | ALA | F | 251 | −15.172 | 60.113 | −39.673 | 1.00 | 48.88 B000 O |
| ATOM | 8459 | CB | ALA | F | 251 | −17.762 | 61.085 | −39.974 | 1.00 | 67.76 B000 C |
| ATOM | 8460 | N | GLY | F | 252 | −15.989 | 58.946 | −37.942 | 1.00 | 43.97 B000 N |
| ATOM | 8461 | CA | GLY | F | 252 | −14.714 | 58.903 | −37.255 | 1.00 | 44.53 B000 C |
| ATOM | 8462 | C | GLY | F | 252 | −14.440 | 60.030 | −36.276 | 1.00 | 47.60 B000 C |
| ATOM | 8463 | O | GLY | F | 252 | −13.427 | 59.971 | −35.575 | 1.00 | 55.35 B000 O |
| ATOM | 8464 | N | GLU | F | 253 | −15.306 | 61.045 | −36.183 | 1.00 | 45.85 B000 N |
| ATOM | 8465 | CA | GLU | F | 253 | −15.090 | 62.165 | −35.268 | 1.00 | 42.89 B000 C |
| ATOM | 8466 | C | GLU | F | 253 | −16.069 | 62.200 | −34.096 | 1.00 | 42.96 B000 C |
| ATOM | 8467 | O | GLU | F | 253 | −15.975 | 63.117 | −33.272 | 1.00 | 41.71 B000 O |
| ATOM | 8468 | CB | GLU | F | 253 | −15.188 | 63.512 | −36.017 | 1.00 | 43.68 B000 C |
| ATOM | 8469 | CG | GLU | F | 253 | −14.363 | 63.614 | −37.321 | 1.00 | 57.15 B000 C |
| ATOM | 8470 | CD | GLU | F | 253 | −12.875 | 63.967 | −37.117 | 1.00 | 70.88 B000 C |
| ATOM | 8471 | OE1 | GLU | F | 253 | −12.568 | 65.139 | −36.771 | 1.00 | 71.64 B000 O |
| ATOM | 8472 | OE2 | GLU | F | 253 | −12.008 | 63.079 | −37.331 | 1.00 | 63.29 B000 O |
| ATOM | 8473 | N | ASP | F | 254 | −17.000 | 61.242 | −33.982 | 1.00 | 36.37 B000 N |
| ATOM | 8474 | CA | ASP | F | 254 | −18.107 | 61.378 | −33.045 | 1.00 | 37.71 B000 C |
| ATOM | 8475 | C | ASP | F | 254 | −17.988 | 60.412 | −31.877 | 1.00 | 36.53 B000 C |
| ATOM | 8476 | O | ASP | F | 254 | −17.374 | 59.349 | −31.973 | 1.00 | 36.91 B000 O |
| ATOM | 8477 | CB | ASP | F | 254 | −19.473 | 61.157 | −33.717 | 1.00 | 35.74 B000 C |
| ATOM | 8478 | CG | ASP | F | 254 | −20.006 | 62.400 | −34.396 | 1.00 | 38.14 B000 C |
| ATOM | 8479 | OD2 | ASP | F | 254 | −21.148 | 62.350 | −34.936 | 1.00 | 36.55 B000 O |
| ATOM | 8480 | OD1 | ASP | F | 254 | −19.280 | 63.427 | −34.386 | 1.00 | 41.05 B000 O1− |
| ATOM | 8481 | N | CYS | F | 255 | −18.603 | 60.799 | −30.769 | 1.00 | 38.85 B000 N |
| ATOM | 8482 | CA | CYS | F | 255 | −18.733 | 59.942 | −29.606 | 1.00 | 28.30 B000 C |
| ATOM | 8483 | C | CYS | F | 255 | −20.176 | 60.039 | −29.135 | 1.00 | 32.80 B000 C |
| ATOM | 8484 | O | CYS | F | 255 | −20.878 | 61.013 | −29.418 | 1.00 | 34.41 B000 O |
| ATOM | 8485 | CB | CYS | F | 255 | −17.749 | 60.342 | −28.515 | 1.00 | 32.19 B000 C |
| ATOM | 8486 | SG | CYS | F | 255 | −15.954 | 60.090 | −28.944 | 1.00 | 42.14 B000 S |
| ATOM | 8487 | N | ALA | F | 256 | −20.630 | 59.006 | −28.447 | 1.00 | 31.53 B000 N |
| ATOM | 8488 | CA | ALA | F | 256 | −22.004 | 58.933 | −27.991 | 1.00 | 30.16 B000 C |
| ATOM | 8489 | C | ALA | F | 256 | −22.096 | 59.438 | −26.562 | 1.00 | 34.02 B000 C |
| ATOM | 8490 | O | ALA | F | 256 | −21.281 | 59.074 | −25.706 | 1.00 | 31.73 B000 O |
| ATOM | 8491 | CB | ALA | F | 256 | −22.530 | 57.498 | −28.071 | 1.00 | 28.94 B000 C |
| ATOM | 8492 | N | HIS | F | 257 | −23.103 | 60.261 | −26.301 | 1.00 | 28.80 B000 N |

TABLE 10.3-continued

| | | | | | | | | | | |
|---|---|---|---|---|---|---|---|---|---|---|
| ATOM | 8493 | CA | HIS | F | 257 | −23.347 | 60.726 | −24.947 | 1.00 | 33.62 | B000 C |
| ATOM | 8494 | C | HIS | F | 257 | −24.822 | 60.589 | −24.608 | 1.00 | 29.12 | B000 C |
| ATOM | 8495 | O | HIS | F | 257 | −25.696 | 60.659 | −25.483 | 1.00 | 29.71 | B000 O |
| ATOM | 8496 | CB | HIS | F | 257 | −22.895 | 62.209 | −24.730 | 1.00 | 31.05 | B000 C |
| ATOM | 8497 | CG | HIS | F | 257 | −23.622 | 63.196 | −25.584 | 1.00 | 27.54 | B000 C |
| ATOM | 8498 | ND1 | HIS | F | 257 | −24.699 | 63.926 | −25.124 | 1.00 | 35.11 | B000 N |
| ATOM | 8499 | CD2 | HIS | F | 257 | −23.433 | 63.578 | −26.873 | 1.00 | 31.63 | B000 C |
| ATOM | 8500 | CE1 | HIS | F | 257 | −25.140 | 64.719 | −26.088 | 1.00 | 30.09 | B000 C |
| ATOM | 8501 | NE2 | HIS | F | 257 | −24.389 | 64.529 | −27.160 | 1.00 | 34.93 | B000 N |
| ATOM | 8502 | N | PHE | F | 258 | −25.083 | 60.369 | −23.324 | 1.00 | 31.39 | B000 N |
| ATOM | 8503 | CA | PHE | F | 258 | −26.433 | 60.529 | −22.810 | 1.00 | 37.72 | B000 C |
| ATOM | 8504 | C | PHE | F | 258 | −26.830 | 61.993 | −22.915 | 1.00 | 35.33 | B000 C |
| ATOM | 8505 | O | PHE | F | 258 | −26.020 | 62.879 | −22.636 | 1.00 | 37.08 | B000 O |
| ATOM | 8506 | CB | PHE | F | 258 | −26.519 | 60.088 | −21.354 | 1.00 | 31.41 | B000 C |
| ATOM | 8507 | CG | PHE | F | 258 | −26.032 | 58.691 | −21.094 | 1.00 | 30.94 | B000 C |
| ATOM | 8508 | CD1 | PHE | F | 258 | −26.884 | 57.598 | −21.263 | 1.00 | 34.60 | B000 C |
| ATOM | 8509 | CD2 | PHE | F | 258 | −24.750 | 58.465 | −20.612 | 1.00 | 31.04 | B000 C |
| ATOM | 8510 | CE1 | PHE | F | 258 | −26.449 | 56.297 | −20.988 | 1.00 | 35.62 | B000 C |
| ATOM | 8511 | CE2 | PHE | F | 258 | −24.295 | 57.160 | −20.350 | 1.00 | 37.38 | B000 C |
| ATOM | 8512 | CZ | PHE | F | 258 | −25.156 | 56.076 | −20.534 | 1.00 | 34.44 | B000 C |
| ATOM | 8513 | N | THR | F | 259 | −28.072 | 62.242 | −23.340 | 1.00 | 39.97 | B000 N |
| ATOM | 8514 | CA | THR | F | 259 | −28.683 | 63.565 | −23.297 | 1.00 | 37.91 | B000 C |
| ATOM | 8515 | C | THR | F | 259 | −29.508 | 63.699 | −22.023 | 1.00 | 38.85 | B000 C |
| ATOM | 8516 | O | THR | F | 259 | −29.572 | 62.785 | −21.197 | 1.00 | 42.20 | B000 O |
| ATOM | 8517 | CB | THR | F | 259 | −29.566 | 63.817 | −24.514 | 1.00 | 38.22 | B000 C |
| ATOM | 8518 | OG1 | THR | F | 259 | −30.726 | 62.979 | −24.427 | 1.00 | 40.99 | B000 O |
| ATOM | 8519 | CG2 | THR | F | 259 | −28.812 | 63.526 | −25.789 | 1.00 | 35.73 | B000 C |
| ATOM | 8520 | N | ASP | F | 260 | −30.176 | 64.845 | −21.874 | 1.00 | 41.22 | B000 N |
| ATOM | 8521 | CA | ASP | F | 260 | −30.859 | 65.107 | −20.611 | 1.00 | 45.54 | B000 C |
| ATOM | 8522 | C | ASP | F | 260 | −32.098 | 64.241 | −20.394 | 1.00 | 44.40 | B000 C |
| ATOM | 8523 | O | ASP | F | 260 | −32.576 | 64.175 | −19.260 | 1.00 | 47.44 | B000 O |
| ATOM | 8524 | CB | ASP | F | 260 | −31.211 | 66.595 | −20.486 | 1.00 | 42.85 | B000 C |
| ATOM | 8525 | CG | ASP | F | 260 | −32.026 | 67.112 | −21.654 | 1.00 | 50.76 | B000 C |
| ATOM | 8526 | OD1 | ASP | F | 260 | −32.520 | 66.298 | −22.465 | 1.00 | 48.72 | B000 O |
| ATOM | 8527 | OD2 | ASP | F | 260 | −32.156 | 68.351 | −21.769 | 1.00 | 54.59 | B000 O1− |
| ATOM | 8528 | N | ASP | F | 261 | −32.598 | 63.531 | −21.406 | 1.00 | 42.99 | B000 N |
| ATOM | 8529 | CA | ASP | F | 261 | −33.649 | 62.544 | −21.167 | 1.00 | 41.51 | B000 C |
| ATOM | 8530 | C | ASP | F | 261 | −33.118 | 61.115 | −21.152 | 1.00 | 43.32 | B000 C |
| ATOM | 8531 | O | ASP | F | 261 | −33.911 | 60.169 | −21.146 | 1.00 | 48.34 | B000 O |
| ATOM | 8532 | CB | ASP | F | 261 | −34.795 | 62.676 | −22.192 | 1.00 | 37.72 | B000 C |
| ATOM | 8533 | CG | ASP | F | 261 | −34.432 | 62.185 | −23.606 | 1.00 | 50.07 | B000 C |
| ATOM | 8534 | OD1 | ASP | F | 261 | −33.408 | 61.504 | −23.808 | 1.00 | 49.28 | B000 O |
| ATOM | 8535 | OD2 | ASP | F | 261 | −35.212 | 62.470 | −24.543 | 1.00 | 57.06 | B000 O1− |
| ATOM | 8536 | N | GLY | F | 262 | −31.801 | 60.929 | −21.192 | 1.00 | 37.84 | B000 N |
| ATOM | 8537 | CA | GLY | F | 262 | −31.223 | 59.600 | −21.120 | 1.00 | 39.30 | B000 C |
| ATOM | 8538 | C | GLY | F | 262 | −30.982 | 58.938 | −22.466 | 1.00 | 41.80 | B000 C |
| ATOM | 8539 | O | GLY | F | 262 | −30.102 | 58.076 | −22.575 | 1.00 | 39.59 | B000 O |
| ATOM | 8540 | N | ARG | F | 263 | −31.736 | 59.319 | −23.494 | 1.00 | 35.33 | B000 N |
| ATOM | 8541 | CA | ARG | F | 263 | −31.468 | 58.795 | −24.822 | 1.00 | 38.94 | B000 C |
| ATOM | 8542 | C | ARG | F | 263 | −30.159 | 59.370 | −25.357 | 1.00 | 41.24 | B000 C |
| ATOM | 8543 | O | ARG | F | 263 | −29.688 | 60.429 | −24.926 | 1.00 | 40.40 | B000 O |
| ATOM | 8544 | CB | ARG | F | 263 | −32.646 | 59.085 | −25.760 | 1.00 | 39.18 | B000 C |
| ATOM | 8545 | CG | ARG | F | 263 | −33.888 | 58.222 | −25.393 | 1.00 | 46.56 | B000 C |
| ATOM | 8546 | CD | ARG | F | 263 | −35.120 | 58.506 | −26.239 | 1.00 | 38.08 | B000 C |
| ATOM | 8547 | NE | ARG | F | 263 | −35.507 | 59.908 | −26.134 | 1.00 | 51.22 | B000 N |
| ATOM | 8548 | CZ | ARG | F | 263 | −36.495 | 60.464 | −26.827 | 1.00 | 58.02 | B000 C |
| ATOM | 8549 | NH1 | ARG | F | 263 | −37.218 | 59.731 | −27.673 | 1.00 | 52.64 | B000 N1+ |
| ATOM | 8550 | NH2 | ARG | F | 263 | −36.754 | 61.756 | −26.676 | 1.00 | 51.34 | B000 N |
| ATOM | 8551 | N | TRP | F | 264 | −29.579 | 58.655 | −26.311 | 1.00 | 35.20 | B000 N |
| ATOM | 8552 | CA | TRP | F | 264 | −28.211 | 58.875 | −26.746 | 1.00 | 33.30 | B000 C |
| ATOM | 8553 | C | TRP | F | 264 | −28.146 | 59.805 | −27.951 | 1.00 | 36.94 | B000 C |
| ATOM | 8554 | O | TRP | F | 264 | −29.059 | 59.860 | −28.785 | 1.00 | 39.27 | B000 O |
| ATOM | 8555 | CB | TRP | F | 264 | −27.546 | 57.555 | −27.110 | 1.00 | 32.18 | B000 C |
| ATOM | 8556 | CG | TRP | F | 264 | −27.593 | 56.508 | −26.057 | 1.00 | 35.42 | B000 C |
| ATOM | 8557 | CD1 | TRP | F | 264 | −28.003 | 56.652 | −24.766 | 1.00 | 40.13 | B000 C |
| ATOM | 8558 | CD2 | TRP | F | 264 | −27.196 | 55.143 | −26.203 | 1.00 | 36.70 | B000 C |
| ATOM | 8559 | NE1 | TRP | F | 264 | −27.880 | 55.459 | −24.095 | 1.00 | 37.06 | B000 N |
| ATOM | 8560 | CE2 | TRP | F | 264 | −27.388 | 54.516 | −24.960 | 1.00 | 38.24 | B000 C |
| ATOM | 8561 | CE3 | TRP | F | 264 | −26.688 | 54.387 | −27.270 | 1.00 | 40.49 | B000 C |
| ATOM | 8562 | CZ2 | TRP | F | 264 | −27.101 | 53.169 | −24.756 | 1.00 | 35.99 | B000 C |
| ATOM | 8563 | CZ3 | TRP | F | 264 | −26.407 | 53.045 | −27.061 | 1.00 | 32.82 | B000 C |
| ATOM | 8564 | CH2 | TRP | F | 264 | −26.613 | 52.457 | −25.819 | 1.00 | 37.82 | B000 C |
| ATOM | 8565 | N | ASN | F | 265 | −27.044 | 60.540 | −28.034 | 1.00 | 31.28 | B000 N |
| ATOM | 8566 | CA | ASN | F | 265 | −26.763 | 61.379 | −29.187 | 1.00 | 33.60 | B000 C |
| ATOM | 8567 | C | ASN | F | 265 | −25.275 | 61.280 | −29.513 | 1.00 | 33.44 | B000 C |
| ATOM | 8568 | O | ASN | F | 265 | −24.446 | 60.973 | −28.645 | 1.00 | 29.37 | B000 O |
| ATOM | 8569 | CB | ASN | F | 265 | −27.200 | 62.832 | −28.912 | 1.00 | 31.57 | B000 C |
| ATOM | 8570 | CG | ASN | F | 265 | −26.915 | 63.768 | −30.076 | 1.00 | 39.82 | B000 C |
| ATOM | 8571 | OD1 | ASN | F | 265 | −27.466 | 63.615 | −31.166 | 1.00 | 41.22 | B000 O |
| ATOM | 8572 | ND2 | ASN | F | 265 | −26.003 | 64.724 | −29.856 | 1.00 | 36.27 | B000 N |

TABLE 10.3-continued

| ATOM | 8573 | N | ASP | F | 266 | −24.950 | 61.494 | −30.786 | 1.00 | 31.29 | B000 | N |
| --- | --- | --- | --- | --- | --- | --- | --- | --- | --- | --- | --- | --- |
| ATOM | 8574 | CA | ASP | F | 266 | −23.572 | 61.488 | −31.255 | 1.00 | 31.23 | B000 | C |
| ATOM | 8575 | C | ASP | F | 266 | −23.107 | 62.919 | −31.488 | 1.00 | 32.82 | B000 | C |
| ATOM | 8576 | O | ASP | F | 266 | −23.788 | 63.693 | −32.166 | 1.00 | 30.42 | B000 | O |
| ATOM | 8577 | CB | ASP | F | 266 | −23.408 | 60.650 | −32.536 | 1.00 | 36.08 | B000 | C |
| ATOM | 8578 | CG | ASP | F | 266 | −24.411 | 61.018 | −33.661 | 1.00 | 40.88 | B000 | C |
| ATOM | 8579 | OD1 | ASP | F | 266 | −25.586 | 61.367 | −33.390 | 1.00 | 36.41 | B000 | O |
| ATOM | 8580 | OD2 | ASP | F | 266 | −24.013 | 60.933 | −34.844 | 1.00 | 40.99 | B000 | O1− |
| ATOM | 8581 | N | ASP | F | 267 | −21.943 | 63.261 | −30.935 | 1.00 | 35.94 | B000 | N |
| ATOM | 8582 | CA | ASP | F | 267 | −21.403 | 64.616 | −31.027 | 1.00 | 36.54 | B000 | C |
| ATOM | 8583 | C | ASP | F | 267 | −19.880 | 64.547 | −31.126 | 1.00 | 34.86 | B000 | C |
| ATOM | 8584 | O | ASP | F | 267 | −19.271 | 63.507 | −30.850 | 1.00 | 34.33 | B000 | O |
| ATOM | 8585 | CB | ASP | F | 267 | −21.835 | 65.470 | −29.834 | 1.00 | 30.38 | B000 | C |
| ATOM | 8586 | CG | ASP | F | 267 | −21.905 | 66.947 | −30.180 | 1.00 | 43.85 | B000 | C |
| ATOM | 8587 | OD1 | ASP | F | 267 | −21.377 | 67.294 | −31.265 | 1.00 | 39.52 | B000 | O |
| ATOM | 8588 | OD2 | ASP | F | 267 | −22.463 | 67.744 | −29.369 | 1.00 | 37.84 | B000 | O1− |
| ATOM | 8589 | N | VAL | F | 268 | −19.263 | 65.675 | −31.519 | 1.00 | 30.07 | B000 | N |
| ATOM | 8590 | CA | VAL | F | 268 | −17.811 | 65.692 | −31.674 | 1.00 | 34.19 | B000 | C |
| ATOM | 8591 | C | VAL | F | 268 | −17.155 | 65.408 | −30.331 | 1.00 | 32.91 | B000 | C |
| ATOM | 8592 | O | VAL | F | 268 | −17.605 | 65.876 | −29.277 | 1.00 | 34.33 | B000 | O |
| ATOM | 8593 | CB | VAL | F | 268 | −17.313 | 67.013 | −32.292 | 1.00 | 36.17 | B000 | C |
| ATOM | 8594 | CG1 | VAL | F | 268 | −17.784 | 67.114 | −33.734 | 1.00 | 30.93 | B000 | C |
| ATOM | 8595 | CG2 | VAL | F | 268 | −17.786 | 68.204 | −31.515 | 1.00 | 29.63 | B000 | C |
| ATOM | 8596 | N | CYS | F | 269 | −16.096 | 64.605 | −30.366 | 1.00 | 30.58 | B000 | N |
| ATOM | 8597 | CA | CYS | F | 269 | −15.512 | 64.059 | −29.147 | 1.00 | 32.39 | B000 | C |
| ATOM | 8598 | C | CYS | F | 269 | −14.819 | 65.101 | −28.276 | 1.00 | 35.95 | B000 | C |
| ATOM | 8599 | O | CYS | F | 269 | −14.508 | 64.795 | −27.110 | 1.00 | 34.91 | B000 | O |
| ATOM | 8600 | CB | CYS | F | 269 | −14.527 | 62.940 | −29.502 | 1.00 | 40.17 | B000 | C |
| ATOM | 8601 | SG | CYS | F | 269 | −15.360 | 61.521 | −30.340 | 1.00 | 50.58 | B000 | S |
| ATOM | 8602 | N | GLN | F | 270 | −14.605 | 66.326 | −28.768 | 1.00 | 30.41 | B000 | N |
| ATOM | 8603 | CA | GLN | F | 270 | −13.991 | 67.316 | −27.886 | 1.00 | 37.36 | B000 | C |
| ATOM | 8604 | C | GLN | F | 270 | −14.990 | 68.026 | −26.982 | 1.00 | 33.95 | B000 | C |
| ATOM | 8605 | O | GLN | F | 270 | −14.541 | 68.820 | −26.158 | 1.00 | 37.08 | B000 | O |
| ATOM | 8606 | CB | GLN | F | 270 | −13.179 | 68.371 | −28.659 | 1.00 | 34.85 | B000 | C |
| ATOM | 8607 | CG | GLN | F | 270 | −13.560 | 68.598 | −30.097 | 1.00 | 52.16 | B000 | C |
| ATOM | 8608 | CD | GLN | F | 270 | −13.134 | 67.433 | −30.977 | 1.00 | 59.41 | B000 | C |
| ATOM | 8609 | OE1 | GLN | F | 270 | −13.911 | 66.970 | −31.818 | 1.00 | 54.59 | B000 | O |
| ATOM | 8610 | NE2 | GLN | F | 270 | −11.912 | 66.916 | −30.748 | 1.00 | 48.02 | B000 | N |
| ATOM | 8611 | N | ARG | F | 271 | −16.302 | 67.744 | −27.083 | 1.00 | 27.57 | B000 | N |
| ATOM | 8612 | CA | ARG | F | 271 | −17.274 | 68.311 | −26.158 | 1.00 | 29.87 | B000 | C |
| ATOM | 8613 | C | ARG | F | 271 | −16.853 | 68.013 | −24.720 | 1.00 | 34.79 | B000 | C |
| ATOM | 8614 | O | ARG | F | 271 | −16.512 | 66.861 | −24.400 | 1.00 | 30.23 | B000 | O |
| ATOM | 8615 | CB | ARG | F | 271 | −18.688 | 67.750 | −26.374 | 1.00 | 30.54 | B000 | C |
| ATOM | 8616 | CG | ARG | F | 271 | −19.384 | 68.131 | −27.667 | 1.00 | 31.79 | B000 | C |
| ATOM | 8617 | CD | ARG | F | 271 | −19.505 | 69.613 | −27.794 | 1.00 | 33.75 | B000 | C |
| ATOM | 8618 | NE | ARG | F | 271 | −20.347 | 70.002 | −28.916 | 1.00 | 33.09 | B000 | N |
| ATOM | 8619 | CZ | ARG | F | 271 | −20.385 | 71.243 | −29.388 | 1.00 | 38.41 | B000 | C |
| ATOM | 8620 | NH1 | ARG | F | 271 | −19.614 | 72.177 | −28.817 | 1.00 | 34.05 | B000 | N1+ |
| ATOM | 8621 | NH2 | ARG | F | 271 | −21.173 | 71.556 | −30.417 | 1.00 | 29.00 | B000 | N |
| ATOM | 8622 | N | PRO | F | 272 | −16.862 | 68.955 | −23.879 | 1.00 | 32.65 | B000 | N |
| ATOM | 8623 | CA | PRO | F | 272 | −16.460 | 68.718 | −22.481 | 1.00 | 27.76 | B000 | C |
| ATOM | 8624 | C | PRO | F | 272 | −17.615 | 68.190 | −21.630 | 1.00 | 31.78 | B000 | C |
| ATOM | 8625 | O | PRO | F | 272 | −18.061 | 68.832 | −20.676 | 1.00 | 29.70 | B000 | O |
| ATOM | 8626 | CB | PRO | F | 272 | −15.983 | 70.111 | −22.042 | 1.00 | 28.08 | B000 | C |
| ATOM | 8627 | CG | PRO | F | 272 | −16.860 | 71.083 | −22.841 | 1.00 | 28.41 | B000 | C |
| ATOM | 8628 | CD | PRO | F | 272 | −17.059 | 70.391 | −24.190 | 1.00 | 31.14 | B000 | C |
| ATOM | 8629 | N | TYR | F | 273 | −18.129 | 67.005 | −21.987 | 1.00 | 32.02 | B000 | N |
| ATOM | 8630 | CA | TYR | F | 273 | −19.251 | 66.438 | −21.248 | 1.00 | 31.15 | B000 | C |
| ATOM | 8631 | C | TYR | F | 273 | −18.759 | 65.726 | −19.999 | 1.00 | 28.60 | B000 | C |
| ATOM | 8632 | O | TYR | F | 273 | −17.577 | 65.427 | −19.850 | 1.00 | 27.10 | B000 | O |
| ATOM | 8633 | CB | TYR | F | 273 | −20.061 | 65.473 | −22.113 | 1.00 | 28.19 | B000 | C |
| ATOM | 8634 | CG | TYR | F | 273 | −20.762 | 66.174 | −23.244 | 1.00 | 30.22 | B000 | C |
| ATOM | 8635 | CD1 | TYR | F | 273 | −21.111 | 67.519 | −23.133 | 1.00 | 29.80 | B000 | C |
| ATOM | 8636 | CD2 | TYR | F | 273 | −21.057 | 65.512 | −24.440 | 1.00 | 28.43 | B000 | C |
| ATOM | 8637 | CE1 | TYR | F | 273 | −21.765 | 68.193 | −24.178 | 1.00 | 29.36 | B000 | C |
| ATOM | 8638 | CE2 | TYR | F | 273 | −21.695 | 66.178 | −25.493 | 1.00 | 26.89 | B000 | C |
| ATOM | 8639 | CZ | TYR | F | 273 | −22.039 | 67.519 | −25.355 | 1.00 | 30.78 | B000 | C |
| ATOM | 8640 | OH | TYR | F | 273 | −22.668 | 68.191 | −26.375 | 1.00 | 33.01 | B000 | O |
| ATOM | 8641 | N | ARG | F | 274 | −19.688 | 65.469 | −19.083 | 1.00 | 31.67 | B000 | N |
| ATOM | 8642 | CA | ARG | F | 274 | −19.383 | 64.573 | −17.977 | 1.00 | 32.33 | B000 | C |
| ATOM | 8643 | C | ARG | F | 274 | −19.177 | 63.156 | −18.523 | 1.00 | 29.48 | B000 | C |
| ATOM | 8644 | O | ARG | F | 274 | −19.403 | 62.875 | −19.703 | 1.00 | 29.20 | B000 | O |
| ATOM | 8645 | CB | ARG | F | 274 | −20.501 | 64.618 | −16.931 | 1.00 | 33.56 | B000 | C |
| ATOM | 8646 | CG | ARG | F | 274 | −20.639 | 65.990 | −16.246 | 1.00 | 34.67 | B000 | C |
| ATOM | 8647 | CD | ARG | F | 274 | −21.615 | 65.998 | −15.050 | 1.00 | 38.53 | B000 | C |
| ATOM | 8648 | NE | ARG | F | 274 | −21.480 | 67.235 | −14.265 | 1.00 | 37.38 | B000 | N |
| ATOM | 8649 | CZ | ARG | F | 274 | −22.106 | 67.482 | −13.117 | 1.00 | 34.94 | B000 | C |
| ATOM | 8650 | NH1 | ARG | F | 274 | −22.944 | 66.591 | −12.600 | 1.00 | 33.17 | B000 | N1+ |
| ATOM | 8651 | NH2 | ARG | F | 274 | −21.886 | 68.623 | −12.476 | 1.00 | 31.06 | B000 | N |
| ATOM | 8652 | N | TRP | F | 275 | −18.741 | 62.250 | −17.662 | 1.00 | 29.84 | B000 | N |

TABLE 10.3-continued

| | | | | | | | | | | | |
|---|---|---|---|---|---|---|---|---|---|---|---|
| ATOM | 8653 | CA | TRP | F | 275 | −18.518 | 60.878 | −18.100 | 1.00 | 34.86 | B000 | C |
| ATOM | 8654 | C | TRP | F | 275 | −18.726 | 59.935 | −16.926 | 1.00 | 36.82 | B000 | C |
| ATOM | 8655 | O | TRP | F | 275 | −18.766 | 60.351 | −15.763 | 1.00 | 32.31 | B000 | O |
| ATOM | 8656 | CB | TRP | F | 275 | −17.112 | 60.684 | −18.679 | 1.00 | 28.66 | B000 | C |
| ATOM | 8657 | CG | TRP | F | 275 | −16.078 | 60.676 | −17.628 | 1.00 | 32.25 | B000 | C |
| ATOM | 8658 | CD1 | TRP | F | 275 | −15.531 | 59.586 | −17.019 | 1.00 | 34.72 | B000 | C |
| ATOM | 8659 | CD2 | TRP | F | 275 | −15.448 | 61.826 | −17.041 | 1.00 | 33.73 | B000 | C |
| ATOM | 8660 | NE1 | TRP | F | 275 | −14.587 | 59.989 | −16.085 | 1.00 | 33.65 | B000 | N |
| ATOM | 8661 | CE2 | TRP | F | 275 | −14.521 | 61.358 | −16.087 | 1.00 | 32.03 | B000 | C |
| ATOM | 8662 | CE3 | TRP | F | 275 | −15.575 | 63.203 | −17.238 | 1.00 | 32.63 | B000 | C |
| ATOM | 8663 | CZ2 | TRP | F | 275 | −13.732 | 62.217 | −15.334 | 1.00 | 34.54 | B000 | C |
| ATOM | 8664 | CZ3 | TRP | F | 275 | −14.798 | 64.057 | −16.476 | 1.00 | 32.70 | B000 | C |
| ATOM | 8665 | CH2 | TRP | F | 275 | −13.890 | 63.563 | −15.542 | 1.00 | 33.77 | B000 | C |
| ATOM | 8666 | N | VAL | F | 276 | −18.840 | 58.646 | −17.247 | 1.00 | 33.42 | B000 | N |
| ATOM | 8667 | CA | VAL | F | 276 | −19.034 | 57.591 | −16.256 | 1.00 | 37.19 | B000 | C |
| ATOM | 8668 | C | VAL | F | 276 | −17.985 | 56.504 | −16.480 | 1.00 | 41.17 | B000 | C |
| ATOM | 8669 | O | VAL | F | 276 | −17.762 | 56.073 | −17.620 | 1.00 | 38.26 | B000 | O |
| ATOM | 8670 | CB | VAL | F | 276 | −20.454 | 56.999 | −16.338 | 1.00 | 37.30 | B000 | C |
| ATOM | 8671 | CG1 | VAL | F | 276 | −20.677 | 55.983 | −15.212 | 1.00 | 34.94 | B000 | C |
| ATOM | 8672 | CG2 | VAL | F | 276 | −21.488 | 58.117 | −16.312 | 1.00 | 29.37 | B000 | C |
| ATOM | 8673 | N | CYS | F | 277 | −17.328 | 56.085 | −15.402 | 1.00 | 36.51 | B000 | N |
| ATOM | 8674 | CA | CYS | F | 277 | −16.406 | 54.958 | −15.437 | 1.00 | 39.62 | B000 | C |
| ATOM | 8675 | C | CYS | F | 277 | −17.094 | 53.700 | −14.909 | 1.00 | 45.76 | B000 | C |
| ATOM | 8676 | O | CYS | F | 277 | −17.945 | 53.759 | −14.015 | 1.00 | 44.66 | B000 | O |
| ATOM | 8677 | CB | CYS | F | 277 | −15.146 | 55.230 | −14.605 | 1.00 | 40.57 | B000 | C |
| ATOM | 8678 | SG | CYS | F | 277 | −14.058 | 56.553 | −15.196 | 1.00 | 50.52 | B000 | S |
| ATOM | 8679 | N | GLU | F | 278 | −16.695 | 52.557 | −15.462 | 1.00 | 39.15 | B000 | N |
| ATOM | 8680 | CA | GLU | F | 278 | −17.250 | 51.260 | −15.112 | 1.00 | 44.84 | B000 | C |
| ATOM | 8681 | C | GLU | F | 278 | −16.120 | 50.256 | −14.936 | 1.00 | 47.20 | B000 | C |
| ATOM | 8682 | O | GLU | F | 278 | −15.173 | 50.230 | −15.729 | 1.00 | 47.48 | B000 | O |
| ATOM | 8683 | CB | GLU | F | 278 | −18.203 | 50.751 | −16.194 | 1.00 | 38.93 | B000 | C |
| ATOM | 8684 | CG | GLU | F | 278 | −18.836 | 49.416 | −15.857 | 1.00 | 46.64 | B000 | C |
| ATOM | 8685 | CD | GLU | F | 278 | −19.732 | 48.897 | −16.963 | 1.00 | 49.83 | B000 | C |
| ATOM | 8686 | OE1 | GLU | F | 278 | −19.861 | 49.572 | −18.007 | 1.00 | 51.92 | B000 | O |
| ATOM | 8687 | OE2 | GLU | F | 278 | −20.316 | 47.813 | −16.790 | 1.00 | 61.81 | B000 | O1− |
| ATOM | 8688 | N | THR | F | 279 | −16.212 | 49.447 | −13.886 | 1.00 | 44.44 | B000 | N |
| ATOM | 8689 | CA | THR | F | 279 | −15.287 | 48.339 | −13.689 | 1.00 | 49.01 | B000 | C |
| ATOM | 8690 | C | THR | F | 279 | −16.035 | 47.205 | −13.000 | 1.00 | 55.21 | B000 | C |
| ATOM | 8691 | O | THR | F | 279 | −17.179 | 47.359 | −12.564 | 1.00 | 50.33 | B000 | O |
| ATOM | 8692 | CB | THR | F | 279 | −14.035 | 48.775 | −12.899 | 1.00 | 50.55 | B000 | C |
| ATOM | 8693 | OG1 | THR | F | 279 | −13.019 | 47.768 | −13.000 | 1.00 | 60.70 | B000 | O |
| ATOM | 8694 | CG2 | THR | F | 279 | −14.349 | 49.063 | −11.433 | 1.00 | 40.44 | B000 | C |
| ATOM | 8695 | N | GLU | F | 280 | −15.392 | 46.046 | −12.929 | 1.00 | 62.33 | B000 | N |
| ATOM | 8696 | CA | GLU | F | 280 | −16.042 | 44.856 | −12.389 | 1.00 | 60.95 | B000 | C |
| ATOM | 8697 | C | GLU | F | 280 | −15.846 | 44.774 | −10.881 | 1.00 | 59.82 | B000 | C |
| ATOM | 8698 | O | GLU | F | 280 | −14.755 | 45.070 | −10.384 | 1.00 | 61.25 | B000 | O |
| ATOM | 8699 | CB | GLU | F | 280 | −15.489 | 43.597 | −13.056 | 1.00 | 64.94 | B000 | C |
| ATOM | 8700 | CG | GLU | F | 280 | −13.982 | 43.637 | −13.300 | 1.00 | 75.16 | B000 | C |
| ATOM | 8701 | CD | GLU | F | 280 | −13.631 | 44.136 | −14.695 | 1.00 | 87.07 | B000 | C |
| ATOM | 8702 | OE1 | GLU | F | 280 | −14.294 | 43.684 | −15.660 | 1.00 | 92.63 | B000 | O |
| ATOM | 8703 | OE2 | GLU | F | 280 | −12.707 | 44.977 | −14.825 | 1.00 | 87.02 | B000 | O1− |
| ATOM | 8704 | N | GLU | F | 281 | −16.934 | 44.447 | −10.167 | 1.00 | 59.93 | B000 | N |
| ATOM | 8705 | CA | GLU | F | 281 | −16.960 | 43.756 | −8.848 | 1.00 | 67.16 | B000 | C |
| ATOM | 8706 | C | GLU | F | 281 | −18.241 | 44.090 | −8.095 | 1.00 | 67.27 | B000 | C |
| ATOM | 8707 | O | GLU | F | 281 | −18.257 | 44.100 | −6.862 | 1.00 | 68.70 | B000 | O |
| ATOM | 8708 | CB | GLU | F | 281 | −15.757 | 44.085 | −7.951 | 1.00 | 63.68 | B000 | C |
| ATOM | 8709 | CG | GLU | F | 281 | −15.131 | 42.885 | −7.230 | 1.00 | 68.36 | B000 | C |
| ATOM | 8710 | CD | GLU | F | 281 | −14.442 | 41.881 | −8.172 | 1.00 | 83.09 | B000 | C |
| ATOM | 8711 | OE1 | GLU | F | 281 | −15.127 | 41.287 | −9.037 | 1.00 | 77.83 | B000 | O |
| ATOM | 8712 | OE2 | GLU | F | 281 | −13.210 | 41.679 | −8.043 | 1.00 | 76.05 | B000 | O |
| TER | | | | | | | | | | | | |
| HETATM | 9170 | C1 | GAL | G | 401 | 19.131 | 84.986 | −13.073 | 1.00 | 67.87 | | C |
| HETATM | 9171 | O1 | GAL | G | 401 | 19.230 | 83.939 | −14.075 | 1.00 | 65.01 | | O |
| HETATM | 9172 | C2 | GAL | G | 401 | 19.826 | 84.527 | −11.743 | 1.00 | 63.05 | | C |
| HETATM | 9173 | O2 | GAL | G | 401 | 19.202 | 83.373 | −11.240 | 1.00 | 42.62 | | O |
| HETATM | 9174 | C3 | GAL | G | 401 | 19.822 | 85.673 | −10.639 | 1.00 | 71.79 | | C |
| HETATM | 9175 | O3 | GAL | G | 401 | 20.324 | 85.299 | −9.317 | 1.00 | 63.98 | | O |
| HETATM | 9176 | C4 | GAL | G | 401 | 20.547 | 86.954 | −11.192 | 1.00 | 74.66 | | C |
| HETATM | 9177 | O4 | GAL | G | 401 | 21.936 | 86.736 | −11.495 | 1.00 | 79.63 | | O |
| HETATM | 9178 | C5 | GAL | G | 401 | 19.774 | 87.370 | −12.469 | 1.00 | 75.84 | | C |
| HETATM | 9179 | O5 | GAL | G | 401 | 19.667 | 86.275 | −13.538 | 1.00 | 68.13 | | O |
| HETATM | 9180 | C6 | GAL | G | 401 | 20.270 | 88.659 | −13.125 | 1.00 | 68.64 | | C |
| HETATM | 9181 | O6 | GAL | G | 401 | 19.157 | 89.413 | −13.631 | 1.00 | 52.02 | | O |
| TER | | | | | | | | | | | | |
| HETATM | 9182 | C1 | GAL | G | 402 | −25.502 | 71.256 | −32.056 | 1.00 | 74.77 | | C |
| HETATM | 9183 | O1 | GAL | G | 402 | −24.812 | 72.366 | −32.713 | 1.00 | 60.32 | | O |
| HETATM | 9184 | C2 | GAL | G | 402 | −26.779 | 71.727 | −31.263 | 1.00 | 62.62 | | C |
| HETATM | 9185 | O2 | GAL | G | 402 | −26.494 | 72.728 | −30.323 | 1.00 | 41.25 | | O |
| HETATM | 9186 | C3 | GAL | G | 402 | −27.470 | 70.522 | −30.515 | 1.00 | 66.23 | | C |
| HETATM | 9187 | O3 | GAL | G | 402 | −28.624 | 70.910 | −29.737 | 1.00 | 63.41 | | O |

TABLE 10.3-continued

| | | | | | | | | | | | |
|---|---|---|---|---|---|---|---|---|---|---|---|
| HETATM | 9188 | C4 | GAL | G | | 402 | −27.905 | 69.432 | −31.526 | 1.00 | 75.11 | C |
| HETATM | 9189 | O4 | GAL | G | | 402 | −29.064 | 69.854 | −32.279 | 1.00 | 80.69 | O |
| HETATM | 9190 | C5 | GAL | G | | 402 | −26.702 | 69.051 | −32.464 | 1.00 | 82.81 | C |
| HETATM | 9191 | O5 | GAL | G | | 402 | −25.897 | 70.216 | −33.013 | 1.00 | 81.70 | O |
| HETATM | 9192 | C6 | GAL | G | | 402 | −27.102 | 68.166 | −33.664 | 1.00 | 85.18 | C |
| HETATM | 9193 | O6 | GAL | G | | 402 | −26.406 | 68.545 | −34.844 | 1.00 | 94.12 | O |
| TER | | | | | | | | | | | | |
| HETATM | 9194 | CA | CA | H | | 1 | 21.469 | 91.701 | −14.212 | 1.00 | 79.84 | Ca |
| TER | | | | | | | | | | | | |
| HETATM | 9195 | CA | CA | H | | 2 | −26.073 | 64.419 | −34.040 | 1.00 | 79.26 | Ca |
| TER | | | | | | | | | | | | |
| HETATM | 9196 | CA | CA | H | | 3 | −18.333 | 61.223 | −36.994 | 1.00 | 75.64 | Ca |
| HETATM | 9197 | CA | CA | H | | 4 | 18.240 | 94.784 | −21.928 | 1.00 | 73.55 | Ca |
| TER | | | | | | | | | | | | |

TABLE 10.4

| | | | | | | | | | | | |
|---|---|---|---|---|---|---|---|---|---|---|---|
| ATOM | 1 | O | GLN | A | 1 | −24.853 | −26.439 | 84.334 | 1.00 | 39.67 | O |
| ATOM | 2 | N | GLN | A | 1 | −23.947 | −29.300 | 85.222 | 1.00 | 49.60 | N |
| ATOM | 3 | CA | GLN | A | 1 | −24.872 | −28.345 | 85.852 | 1.00 | 56.88 | C |
| ATOM | 4 | C | GLN | A | 1 | −25.501 | −27.209 | 85.050 | 1.00 | 51.47 | C |
| ATOM | 5 | CB | GLN | A | 1 | −24.208 | −27.745 | 87.074 | 1.00 | 45.63 | C |
| ATOM | 6 | CG | GLN | A | 1 | −23.967 | −28.823 | 88.054 | 1.00 | 44.21 | C |
| ATOM | 7 | CD | GLN | A | 1 | −25.274 | −29.457 | 88.407 | 1.00 | 54.28 | C |
| ATOM | 8 | OE1 | GLN | A | 1 | −26.030 | −28.899 | 89.200 | 1.00 | 62.35 | O |
| ATOM | 9 | NE2 | GLN | A | 1 | −25.592 | −30.592 | 87.778 | 1.00 | 57.03 | N |
| ATOM | 10 | N | VAL | A | 2 | −26.812 | −27.135 | 85.264 | 1.00 | 51.10 | N |
| ATOM | 11 | CA | VAL | A | 2 | −27.671 | −26.124 | 84.683 | 1.00 | 42.93 | C |
| ATOM | 12 | C | VAL | A | 2 | −27.754 | −24.968 | 85.669 | 1.00 | 44.75 | C |
| ATOM | 13 | O | VAL | A | 2 | −28.236 | −25.134 | 86.793 | 1.00 | 42.04 | O |
| ATOM | 14 | CB | VAL | A | 2 | −29.061 | −26.696 | 84.378 | 1.00 | 39.51 | C |
| ATOM | 15 | CG1 | VAL | A | 2 | −29.809 | −25.773 | 83.468 | 1.00 | 44.64 | C |
| ATOM | 16 | CG2 | VAL | A | 2 | −28.948 | −28.065 | 83.754 | 1.00 | 39.26 | C |
| ATOM | 17 | N | GLN | A | 3 | −27.240 | −23.812 | 85.269 | 1.00 | 45.15 | N |
| ATOM | 18 | CA | GLN | A | 3 | −27.403 | −22.586 | 86.031 | 1.00 | 44.60 | C |
| ATOM | 19 | C | GLN | A | 3 | −28.455 | −21.725 | 85.355 | 1.00 | 34.85 | C |
| ATOM | 20 | O | GLN | A | 3 | −28.496 | −21.629 | 84.128 | 1.00 | 39.72 | O |
| ATOM | 21 | CB | GLN | A | 3 | −26.091 | −21.792 | 86.128 | 1.00 | 50.01 | C |
| ATOM | 22 | CG | GLN | A | 3 | −24.978 | −22.456 | 86.931 | 1.00 | 56.60 | C |
| ATOM | 23 | CD | GLN | A | 3 | −23.919 | −23.128 | 86.052 | 1.00 | 59.49 | C |
| ATOM | 24 | OE1 | GLN | A | 3 | −24.036 | −23.141 | 84.811 | 1.00 | 56.42 | O |
| ATOM | 25 | NE2 | GLN | A | 3 | −22.874 | −23.691 | 86.692 | 1.00 | 48.31 | N |
| ATOM | 26 | N | LEU | A | 4 | −29.296 | −21.109 | 86.161 | 1.00 | 34.42 | N |
| ATOM | 27 | CA | LEU | A | 4 | −30.179 | −20.024 | 85.752 | 1.00 | 31.59 | C |
| ATOM | 28 | C | LEU | A | 4 | −29.640 | −18.812 | 86.491 | 1.00 | 37.33 | C |
| ATOM | 29 | O | LEU | A | 4 | −29.854 | −18.673 | 87.696 | 1.00 | 44.24 | O |
| ATOM | 30 | CB | LEU | A | 4 | −31.634 | −20.283 | 86.124 | 1.00 | 31.99 | C |
| ATOM | 31 | CG | LEU | A | 4 | −32.309 | −21.572 | 85.670 | 1.00 | 34.73 | C |
| ATOM | 32 | CD1 | LEU | A | 4 | −33.852 | −21.433 | 85.729 | 1.00 | 32.19 | C |
| ATOM | 33 | CD2 | LEU | A | 4 | −31.838 | −21.916 | 84.287 | 1.00 | 30.49 | C |
| ATOM | 34 | N | GLN | A | 5 | −28.883 | −17.976 | 85.797 | 1.00 | 40.51 | N |
| ATOM | 35 | CA | GLN | A | 5 | −28.269 | −16.810 | 86.412 | 1.00 | 38.81 | C |
| ATOM | 36 | C | GLN | A | 5 | −29.203 | −15.614 | 86.259 | 1.00 | 37.64 | C |
| ATOM | 37 | O | GLN | A | 5 | −29.714 | −15.358 | 85.170 | 1.00 | 41.01 | O |
| ATOM | 38 | CB | GLN | A | 5 | −26.911 | −16.544 | 85.768 | 1.00 | 38.94 | C |
| ATOM | 39 | CG | GLN | A | 5 | −26.103 | −17.812 | 85.595 | 1.00 | 46.98 | C |
| ATOM | 40 | CD | GLN | A | 5 | −24.690 | −17.565 | 85.045 | 1.00 | 61.68 | C |
| ATOM | 41 | OE1 | GLN | A | 5 | −24.523 | −17.011 | 83.956 | 1.00 | 63.24 | O |
| ATOM | 42 | NE2 | GLN | A | 5 | −23.671 | −17.982 | 85.800 | 1.00 | 53.29 | N |
| ATOM | 43 | N | GLN | A | 6 | −29.465 | −14.912 | 87.348 | 1.00 | 37.71 | N |
| ATOM | 44 | CA | GLN | A | 6 | −30.413 | −13.810 | 87.326 | 1.00 | 37.43 | C |
| ATOM | 45 | C | GLN | A | 6 | −29.670 | −12.491 | 87.484 | 1.00 | 41.79 | C |
| ATOM | 46 | O | GLN | A | 6 | −28.694 | −12.405 | 88.237 | 1.00 | 42.07 | O |
| ATOM | 47 | CB | GLN | A | 6 | −31.445 | −13.932 | 88.448 | 1.00 | 34.57 | C |
| ATOM | 48 | CG | GLN | A | 6 | −32.083 | −15.276 | 88.561 | 1.00 | 37.33 | C |
| ATOM | 49 | CD | GLN | A | 6 | −33.308 | −15.279 | 89.458 | 1.00 | 36.27 | C |
| ATOM | 50 | OE1 | GLN | A | 6 | −33.695 | −16.319 | 89.966 | 1.00 | 30.06 | O |
| ATOM | 51 | NE2 | GLN | A | 6 | −33.920 | −14.117 | 89.653 | 1.00 | 32.89 | N |
| ATOM | 52 | N | TRP | A | 7 | −30.144 | −11.463 | 86.785 | 1.00 | 36.25 | N |
| ATOM | 53 | CA | TRP | A | 7 | −29.729 | −10.098 | 87.059 | 1.00 | 33.75 | C |
| ATOM | 54 | C | TRP | A | 7 | −30.876 | −9.160 | 86.714 | 1.00 | 37.39 | C |
| ATOM | 55 | O | TRP | A | 7 | −31.883 | −9.557 | 86.120 | 1.00 | 39.47 | O |
| ATOM | 56 | CB | TRP | A | 7 | −28.452 | −9.723 | 86.303 | 1.00 | 33.51 | C |
| ATOM | 57 | CG | TRP | A | 7 | −28.542 | −9.763 | 84.822 | 1.00 | 34.91 | C |
| ATOM | 58 | CD1 | TRP | A | 7 | −28.929 | −8.739 | 83.990 | 1.00 | 37.52 | C |
| ATOM | 59 | CD2 | TRP | A | 7 | −28.206 | −10.865 | 83.970 | 1.00 | 37.56 | C |
| ATOM | 60 | NE1 | TRP | A | 7 | −28.872 | −9.149 | 82.675 | 1.00 | 37.51 | N |

TABLE 10.4-continued

| | | | | | | | | | | |
|---|---|---|---|---|---|---|---|---|---|---|
| ATOM | 61 | CE2 | TRP | A | 7 | −28.425 | −10.446 | 82.635 | 1.00 | 36.81 | C |
| ATOM | 62 | CE3 | TRP | A | 7 | −27.737 | −12.160 | 84.204 | 1.00 | 43.59 | C |
| ATOM | 63 | CZ2 | TRP | A | 7 | −28.199 | −11.280 | 81.542 | 1.00 | 35.12 | C |
| ATOM | 64 | CZ3 | TRP | A | 7 | −27.517 | −12.993 | 83.112 | 1.00 | 48.14 | C |
| ATOM | 65 | CH2 | TRP | A | 7 | −27.754 | −12.547 | 81.797 | 1.00 | 43.93 | C |
| ATOM | 66 | N | GLY | A | 8 | −30.711 | −7.909 | 87.092 | 1.00 | 31.94 | N |
| ATOM | 67 | CA | GLY | A | 8 | −31.730 | −6.894 | 86.915 | 1.00 | 32.15 | C |
| ATOM | 68 | C | GLY | A | 8 | −31.597 | −6.027 | 88.146 | 1.00 | 36.03 | C |
| ATOM | 69 | O | GLY | A | 8 | −31.196 | −6.479 | 89.217 | 1.00 | 34.32 | O |
| ATOM | 70 | N | ALA | A | 9 | −31.911 | −4.745 | 87.991 | 1.00 | 39.30 | N |
| ATOM | 71 | CA | ALA | A | 9 | −31.830 | −3.844 | 89.129 | 1.00 | 40.16 | C |
| ATOM | 72 | C | ALA | A | 9 | −32.853 | −4.275 | 90.168 | 1.00 | 41.09 | C |
| ATOM | 73 | O | ALA | A | 9 | −34.026 | −4.460 | 89.845 | 1.00 | 43.60 | O |
| ATOM | 74 | CB | ALA | A | 9 | −32.073 | −2.399 | 88.690 | 1.00 | 33.25 | C |
| ATOM | 75 | N | GLY | A | 10 | −32.405 | −4.458 | 91.411 | 1.00 | 37.64 | N |
| ATOM | 76 | CA | GLY | A | 10 | −33.275 | −4.938 | 92.461 | 1.00 | 28.47 | C |
| ATOM | 77 | C | GLY | A | 10 | −33.861 | −3.889 | 93.382 | 1.00 | 36.57 | C |
| ATOM | 78 | O | GLY | A | 10 | −34.710 | −4.214 | 94.213 | 1.00 | 43.35 | O |
| ATOM | 79 | N | LEU | A | 11 | −33.418 | −2.638 | 93.273 | 1.00 | 36.99 | N |
| ATOM | 80 | CA | LEU | A | 11 | −33.946 | −1.533 | 94.067 | 1.00 | 34.54 | C |
| ATOM | 81 | C | LEU | A | 11 | −34.748 | −0.595 | 93.168 | 1.00 | 35.85 | C |
| ATOM | 82 | O | LEU | A | 11 | −34.244 | −0.129 | 92.144 | 1.00 | 38.05 | O |
| ATOM | 83 | CB | LEU | A | 11 | −32.818 | −0.764 | 94.760 | 1.00 | 36.89 | C |
| ATOM | 84 | CG | LEU | A | 11 | −33.040 | −0.447 | 96.238 | 1.00 | 40.06 | C |
| ATOM | 85 | CD1 | LEU | A | 11 | −31.989 | 0.520 | 96.748 | 1.00 | 38.21 | C |
| ATOM | 86 | CD2 | LEU | A | 11 | −34.443 | 0.097 | 96.487 | 1.00 | 39.59 | C |
| ATOM | 87 | N | LEU | A | 12 | −35.997 | −0.333 | 93.537 | 1.00 | 36.22 | N |
| ATOM | 88 | CA | LEU | A | 12 | −36.874 | 0.495 | 92.724 | 1.00 | 38.68 | C |
| ATOM | 89 | C | LEU | A | 12 | −37.710 | 1.388 | 93.624 | 1.00 | 37.27 | C |
| ATOM | 90 | O | LEU | A | 12 | −37.955 | 1.071 | 94.791 | 1.00 | 40.06 | O |
| ATOM | 91 | CB | LEU | A | 12 | −37.815 | −0.342 | 91.843 | 1.00 | 36.78 | C |
| ATOM | 92 | CG | LEU | A | 12 | −37.179 | −1.328 | 90.872 | 1.00 | 36.77 | C |
| ATOM | 93 | CD1 | LEU | A | 12 | −38.285 | −2.117 | 90.244 | 1.00 | 42.02 | C |
| ATOM | 94 | CD2 | LEU | A | 12 | −36.382 | −0.610 | 89.812 | 1.00 | 40.37 | C |
| ATOM | 95 | N | LYS | A | 13 | −38.164 | 2.508 | 93.053 | 1.00 | 36.92 | N |
| ATOM | 96 | CA | LYS | A | 13 | −39.141 | 3.391 | 93.665 | 1.00 | 36.42 | C |
| ATOM | 97 | C | LYS | A | 13 | −40.505 | 3.163 | 93.036 | 1.00 | 35.60 | C |
| ATOM | 98 | O | LYS | A | 13 | −40.605 | 2.637 | 91.921 | 1.00 | 39.97 | O |
| ATOM | 99 | CB | LYS | A | 13 | −38.711 | 4.848 | 93.499 | 1.00 | 41.56 | C |
| ATOM | 100 | CG | LYS | A | 13 | −37.227 | 5.088 | 93.781 | 1.00 | 52.81 | C |
| ATOM | 101 | CD | LYS | A | 13 | −36.541 | 5.678 | 92.538 | 1.00 | 68.42 | C |
| ATOM | 102 | CE | LYS | A | 13 | −35.056 | 5.297 | 92.399 | 1.00 | 70.40 | C |
| ATOM | 103 | NZ | LYS | A | 13 | −34.516 | 5.679 | 91.038 | 1.00 | 67.86 | N1+ |
| ATOM | 104 | N | PRO | A | 14 | −41.587 | 3.512 | 93.736 | 1.00 | 32.85 | N |
| ATOM | 105 | CA | PRO | A | 14 | −42.932 | 3.257 | 93.200 | 1.00 | 31.49 | C |
| ATOM | 106 | C | PRO | A | 14 | −43.114 | 3.852 | 91.806 | 1.00 | 38.32 | C |
| ATOM | 107 | O | PRO | A | 14 | −42.521 | 4.880 | 91.465 | 1.00 | 35.32 | O |
| ATOM | 108 | CB | PRO | A | 14 | −43.852 | 3.929 | 94.218 | 1.00 | 25.23 | C |
| ATOM | 109 | CG | PRO | A | 14 | −43.104 | 3.927 | 95.441 | 1.00 | 29.72 | C |
| ATOM | 110 | CD | PRO | A | 14 | −41.646 | 4.040 | 95.105 | 1.00 | 33.69 | C |
| ATOM | 111 | N | SER | A | 15 | −43.920 | 3.155 | 90.996 | 1.00 | 36.29 | N |
| ATOM | 112 | CA | SER | A | 15 | −44.274 | 3.500 | 89.622 | 1.00 | 33.19 | C |
| ATOM | 113 | C | SER | A | 15 | −43.184 | 3.147 | 88.614 | 1.00 | 34.56 | C |
| ATOM | 114 | O | SER | A | 15 | −43.472 | 3.106 | 87.414 | 1.00 | 34.31 | O |
| ATOM | 115 | CB | SER | A | 15 | −44.597 | 4.994 | 89.468 | 1.00 | 38.65 | C |
| ATOM | 116 | OG | SER | A | 15 | −43.421 | 5.751 | 89.168 | 1.00 | 34.68 | O |
| ATOM | 117 | N | GLU | A | 16 | −41.943 | 2.899 | 89.051 | 1.00 | 30.66 | N |
| ATOM | 118 | CA | GLU | A | 16 | −40.952 | 2.443 | 88.083 | 1.00 | 28.63 | C |
| ATOM | 119 | C | GLU | A | 16 | −41.330 | 1.055 | 87.551 | 1.00 | 33.32 | C |
| ATOM | 120 | O | GLU | A | 16 | −42.281 | 0.410 | 88.010 | 1.00 | 35.10 | O |
| ATOM | 121 | CB | GLU | A | 16 | −39.539 | 2.437 | 88.684 | 1.00 | 30.89 | C |
| ATOM | 122 | CG | GLU | A | 16 | −39.075 | 3.729 | 89.360 | 1.00 | 31.88 | C |
| ATOM | 123 | CD | GLU | A | 16 | −37.549 | 3.780 | 89.616 | 1.00 | 49.97 | C |
| ATOM | 124 | OE1 | GLU | A | 16 | −36.907 | 2.727 | 89.843 | 1.00 | 54.84 | O |
| ATOM | 125 | OE2 | GLU | A | 16 | −36.967 | 4.885 | 89.556 | 1.00 | 57.53 | O |
| ATOM | 126 | N | THR | A | 17 | −40.583 | 0.583 | 86.565 | 1.00 | 32.70 | N |
| ATOM | 127 | CA | THR | A | 17 | −40.829 | −0.744 | 86.034 | 1.00 | 35.01 | C |
| ATOM | 128 | C | THR | A | 17 | −39.637 | −1.655 | 86.318 | 1.00 | 38.16 | C |
| ATOM | 129 | O | THR | A | 17 | −38.473 | −1.238 | 86.259 | 1.00 | 36.52 | O |
| ATOM | 130 | CB | THR | A | 17 | −41.198 | −0.690 | 84.543 | 1.00 | 36.57 | C |
| ATOM | 131 | OG1 | THR | A | 17 | −40.325 | −1.515 | 83.766 | 1.00 | 34.00 | O |
| ATOM | 132 | CG2 | THR | A | 17 | −41.198 | 0.711 | 84.055 | 1.00 | 37.19 | C |
| ATOM | 133 | N | LEU | A | 18 | −39.955 | −2.874 | 86.733 | 1.00 | 35.90 | N |
| ATOM | 134 | CA | LEU | A | 18 | −38.969 | −3.873 | 87.100 | 1.00 | 33.49 | C |
| ATOM | 135 | C | LEU | A | 18 | −38.603 | −4.669 | 85.861 | 1.00 | 32.72 | C |
| ATOM | 136 | O | LEU | A | 18 | −39.482 | −5.056 | 85.082 | 1.00 | 30.94 | O |
| ATOM | 137 | CB | LEU | A | 18 | −39.537 | −4.770 | 88.209 | 1.00 | 34.34 | C |
| ATOM | 138 | CG | LEU | A | 18 | −38.899 | −6.037 | 88.790 | 1.00 | 34.31 | C |
| ATOM | 139 | CD1 | LEU | A | 18 | −39.067 | −7.231 | 87.855 | 1.00 | 31.61 | C |
| ATOM | 140 | CD2 | LEU | A | 18 | −37.433 | −5.823 | 89.128 | 1.00 | 34.33 | C |

TABLE 10.4-continued

| ATOM | 141 | N | SER | A | 19 | −37.309 | −4.88 | 85.660 | 1.00 | 31.86 | N |
|---|---|---|---|---|---|---|---|---|---|---|---|
| ATOM | 142 | CA | SER | A | 19 | −36.877 | −5.700 | 84.536 | 1.00 | 35.19 | C |
| ATOM | 143 | C | SER | A | 19 | −35.754 | 6.613 | 85.001 | 1.00 | 31.16 | C |
| ATOM | 144 | O | SER | A | 19 | −34.777 | −6.145 | 85.896 | 1.00 | 30.06 | O |
| ATOM | 145 | CB | SER | A | 19 | −36.449 | −4.841 | 83.346 | 1.00 | 33.07 | C |
| ATOM | 146 | OG | SER | A | 19 | −35.218 | −4.239 | 83.612 | 1.00 | 47.41 | O |
| ATOM | 147 | N | LEU | A | 20 | −35.934 | −7.916 | 84.768 | 1.00 | 25.55 | N |
| ATOM | 148 | CA | LEU | A | 20 | −35.022 | −8.962 | 85.214 | 1.00 | 28.53 | C |
| ATOM | 149 | C | LEU | A | 20 | −34.777 | −9.941 | 84.074 | 1.00 | 27.96 | C |
| ATOM | 150 | O | LEU | A | 20 | −35.643 | −10.142 | 83.220 | 1.00 | 27.00 | O |
| ATOM | 151 | CB | LEU | A | 20 | −35.596 | −9.712 | 86.425 | 1.00 | 26.52 | C |
| ATOM | 152 | CG | LEU | A | 20 | −35.939 | −8.899 | 87.678 | 1.00 | 29.44 | C |
| ATOM | 153 | CD1 | LEU | A | 20 | −36.684 | −9.780 | 88.650 | 1.00 | 34.23 | C |
| ATOM | 154 | CD2 | LEU | A | 20 | −34.683 | −8.369 | 88.365 | 1.00 | 31.36 | C |
| ATOM | 155 | N | THR | A | 21 | −33.589 | −10.552 | 84.061 | 1.00 | 28.15 | N |
| ATOM | 156 | CA | THR | A | 21 | −33.237 | −11.526 | 83.034 | 1.00 | 30.18 | C |
| ATOM | 157 | C | THR | A | 21 | −32.621 | −12.772 | 83.663 | 1.00 | 33.03 | C |
| ATOM | 158 | O | THR | A | 21 | −31.918 | −12.678 | 84.673 | 1.00 | 38.27 | O |
| ATOM | 159 | CB | THR | A | 21 | −32.240 | −10.913 | 82.023 | 1.00 | 32.85 | C |
| ATOM | 160 | OG1 | THR | A | 21 | −32.757 | −9.670 | 81.536 | 1.00 | 32.16 | O |
| ATOM | 161 | CG2 | THR | A | 21 | −31.977 | −11.866 | 80.841 | 1.00 | 28.45 | C |
| ATOM | 162 | N | CYS | A | 22 | −32.883 | −13.939 | 83.053 | 1.00 | 27.52 | N |
| ATOM | 163 | CA | CYS | A | 22 | −32.197 | −15.190 | 83.374 | 1.00 | 32.00 | C |
| ATOM | 164 | C | CYS | A | 22 | −31.452 | −15.675 | 82.149 | 1.00 | 29.74 | C |
| ATOM | 165 | O | CYS | A | 22 | −31.974 | −15.629 | 81.036 | 1.00 | 26.79 | O |
| ATOM | 166 | CB | CYS | A | 22 | −33.116 | −16.343 | 83.872 | 1.00 | 27.00 | C |
| ATOM | 167 | SG | CYS | A | 22 | −33.354 | −16.118 | 85.624 | 1.00 | 68.31 | S |
| ATOM | 168 | N | ALA | A | 23 | −30.228 | −16.135 | 82.379 | 1.00 | 32.24 | N |
| ATOM | 169 | CA | ALA | A | 23 | −29.397 | −16.762 | 81.370 | 1.00 | 32.34 | C |
| ATOM | 170 | C | ALA | A | 23 | −29.311 | −18.234 | 81.721 | 1.00 | 30.10 | C |
| ATOM | 171 | O | ALA | A | 23 | −29.020 | −18.577 | 82.867 | 1.00 | 34.73 | O |
| ATOM | 172 | CB | ALA | A | 23 | −28.004 | −16.125 | 81.339 | 1.00 | 32.68 | C |
| ATOM | 173 | N | VAL | A | 24 | −29.614 | −19.093 | 80.763 | 1.00 | 27.15 | N |
| ATOM | 174 | CA | VAL | A | 24 | −29.616 | −20.533 | 80.977 | 1.00 | 32.40 | C |
| ATOM | 175 | C | VAL | A | 24 | −28.371 | −21.124 | 80.342 | 1.00 | 32.49 | C |
| ATOM | 176 | O | VAL | A | 24 | −28.115 | −20.916 | 79.155 | 1.00 | 31.92 | O |
| ATOM | 177 | CB | VAL | A | 24 | −30.872 | −21.204 | 80.377 | 1.00 | 31.63 | C |
| ATOM | 178 | CG1 | VAL | A | 24 | −30.833 | −22.694 | 80.642 | 1.00 | 23.27 | C |
| ATOM | 179 | CG2 | VAL | A | 24 | −32.187 | −20.590 | 80.898 | 1.00 | 27.72 | C |
| ATOM | 180 | N | SER | A | 25 | −27.609 | −21.875 | 81.117 | 1.00 | 37.38 | N |
| ATOM | 181 | CA | SER | A | 25 | −26.471 | −22.620 | 80.602 | 1.00 | 34.69 | C |
| ATOM | 182 | C | SER | A | 25 | −26.544 | −24.037 | 81.136 | 1.00 | 37.68 | C |
| ATOM | 183 | O | SER | A | 25 | −27.107 | −24.279 | 82.206 | 1.00 | 45.11 | O |
| ATOM | 184 | CB | SER | A | 25 | −25.146 | −21.979 | 81.013 | 1.00 | 35.05 | C |
| ATOM | 185 | OG | SER | A | 25 | −25.168 | −21.665 | 82.396 | 1.00 | 40.52 | O |
| ATOM | 186 | N | GLY | A | 26 | −25.978 | −24.977 | 80.405 | 1.00 | 31.17 | N |
| ATOM | 187 | CA | GLY | A | 26 | −25.970 | −26.319 | 80.939 | 1.00 | 34.95 | C |
| ATOM | 188 | C | GLY | A | 26 | −26.773 | −27.339 | 80.181 | 1.00 | 44.75 | C |
| ATOM | 189 | O | GLY | A | 26 | −26.61 | −28.422 | 79.895 | 1.00 | 53.93 | O |
| ATOM | 190 | N | GLY | A | 27 | −28.035 | −27.049 | 79.897 | 1.00 | 43.99 | N |
| ATOM | 191 | CA | GLY | A | 27 | −28.827 | −28.022 | 79.179 | 1.00 | 39.13 | C |
| ATOM | 192 | C | GLY | A | 27 | −29.426 | −27.412 | 77.935 | 1.00 | 44.00 | C |
| ATOM | 193 | O | GLY | A | 27 | −28.940 | −26.394 | 77.426 | 1.00 | 44.61 | O |
| ATOM | 194 | N | SER | A | 28 | −30.525 | −27.991 | 77.475 | 1.00 | 48.00 | N |
| ATOM | 195 | CA | SER | A | 28 | −31.204 | −27.507 | 76.286 | 1.00 | 42.16 | C |
| ATOM | 196 | C | SER | A | 28 | −32.051 | −26.285 | 76.611 | 1.00 | 41.49 | C |
| ATOM | 197 | O | SER | A | 28 | −32.302 | −25.961 | 77.778 | 1.00 | 37.48 | O |
| ATOM | 198 | CB | SER | A | 28 | −32.071 | −28.605 | 75.684 | 1.00 | 39.00 | C |
| ATOM | 199 | OG | SER | A | 28 | −31.253 | −29.679 | 75.263 | 1.00 | 45.34 | O |
| ATOM | 200 | N | PHE | A | 29 | −32.448 | −25.569 | 75.552 | 1.00 | 39.22 | N |
| ATOM | 201 | CA | PHE | A | 29 | −33.327 | −24.425 | 75.695 | 1.00 | 34.42 | C |
| ATOM | 202 | C | PHE | A | 29 | −34.696 | −24.653 | 75.097 | 1.00 | 38.24 | C |
| ATOM | 203 | O | PHE | A | 29 | −35.628 | −23.923 | 75.439 | 1.00 | 40.29 | O |
| ATOM | 204 | CB | PHE | A | 29 | −32.710 | −23.181 | 75.041 | 1.00 | 30.96 | C |
| ATOM | 205 | CG | PHE | A | 29 | −33.191 | −21.874 | 75.633 | 1.00 | 31.50 | C |
| ATOM | 206 | CD1 | PHE | A | 29 | −33.148 | −21.663 | 77.004 | 1.00 | 33.59 | C |
| ATOM | 207 | CD2 | PHE | A | 29 | −33.660 | −20.850 | 74.823 | 1.00 | 28.85 | C |
| ATOM | 208 | CE1 | PHE | A | 29 | −33.578 | −20.450 | 77.564 | 1.00 | 31.05 | C |
| ATOM | 209 | CE2 | PHE | A | 29 | −34.073 | −19.653 | 75.359 | 1.00 | 29.76 | C |
| ATOM | 210 | CZ | PHE | A | 29 | −34.042 | −19.449 | 73.740 | 1.00 | 30.19 | C |
| ATOM | 211 | N | ARG | A | 30 | −34.855 | −25.653 | 74.242 | 1.00 | 41.39 | N |
| ATOM | 212 | CA | ARG | A | 30 | −36.009 | −25.653 | 73.362 | 1.00 | 44.20 | C |
| ATOM | 213 | C | ARG | A | 30 | −37.145 | −26.551 | 73.833 | 1.00 | 39.55 | C |
| ATOM | 214 | O | ARG | A | 30 | −38.265 | −26.412 | 73.331 | 1.00 | 42.77 | O |
| ATOM | 215 | CB | ARG | A | 30 | −35.568 | −26.002 | 71.939 | 1.00 | 31.85 | C |
| ATOM | 216 | CG | ARG | A | 30 | −35.075 | −27.382 | 71.728 | 1.00 | 39.91 | C |
| ATOM | 217 | CD | ARG | A | 30 | −34.814 | −27.548 | 70.245 | 1.00 | 43.27 | C |
| ATOM | 218 | NE | ARG | A | 30 | −33.604 | −28.305 | 69.892 | 1.00 | 49.24 | N |
| ATOM | 219 | CZ | ARG | A | 30 | −32.393 | −28.213 | 70.464 | 1.00 | 57.67 | C |
| ATOM | 220 | NH1 | ARG | A | 30 | −31.409 | −28.969 | 69.985 | 1.00 | 63.98 | N |

TABLE 10.4-continued

| ATOM | 221 | NH2 | ARG | A | 30 | −32.135 | −27.413 | 71.512 | 1.00 | 54.11 | N |
|---|---|---|---|---|---|---|---|---|---|---|---|
| ATOM | 222 | N | TYR | A | 31 | −36.902 | −27.434 | 74.789 | 1.00 | 36.60 | N |
| ATOM | 223 | CA | TYR | A | 31 | −37.940 | −28.340 | 75.264 | 1.00 | 40.80 | C |
| ATOM | 224 | C | TYR | A | 31 | −38.685 | −27.821 | 76.489 | 1.00 | 37.66 | C |
| ATOM | 225 | O | TYR | A | 31 | −39.628 | −28.470 | 76.946 | 1.00 | 36.93 | O |
| ATOM | 226 | CB | TYR | A | 31 | −37.334 | −29.699 | 75.619 | 1.00 | 37.87 | C |
| ATOM | 227 | CG | TYR | A | 31 | −36.422 | −30.240 | 74.573 | 1.00 | 39.45 | C |
| ATOM | 228 | CD1 | TYR | A | 31 | −36.888 | −30.500 | 73.300 | 1.00 | 42.59 | C |
| ATOM | 229 | CD2 | TYR | A | 31 | −35.088 | −30.528 | 74.861 | 1.00 | 44.81 | C |
| ATOM | 230 | CE1 | TYR | A | 31 | −36.047 | −31.005 | 72.325 | 1.00 | 45.84 | C |
| ATOM | 231 | CE2 | TYR | A | 31 | −34.240 | −31.049 | 73.890 | 1.00 | 43.49 | C |
| ATOM | 232 | CZ | TYR | A | 31 | −34.729 | −31.281 | 72.625 | 1.00 | 43.29 | C |
| ATOM | 233 | OH | TYR | A | 31 | −33.922 | −31.803 | 71.648 | 1.00 | 43.72 | O |
| ATOM | 234 | N | TYR | A | 32 | −38.302 | −26.677 | 77.027 | 1.00 | 39.36 | N |
| ATOM | 235 | CA | TYR | A | 32 | −38.735 | −26.280 | 78.350 | 1.00 | 34.43 | C |
| ATOM | 236 | C | TYR | A | 32 | −39.587 | −25.028 | 78.263 | 1.00 | 38.74 | C |
| ATOM | 237 | O | TYR | A | 32 | −39.501 | −24.256 | 77.305 | 1.00 | 39.83 | O |
| ATOM | 238 | CB | TYR | A | 32 | −37.533 | −26.028 | 79.265 | 1.00 | 33.39 | C |
| ATOM | 239 | CG | TYR | A | 32 | −36.634 | −27.226 | 79.343 | 1.00 | 38.75 | C |
| ATOM | 240 | CD2 | TYR | A | 32 | −35.377 | −27.236 | 78.750 | 1.00 | 32.24 | C |
| ATOM | 241 | CD1 | TYR | A | 32 | −37.061 | −28.368 | 80.004 | 1.00 | 38.64 | C |
| ATOM | 242 | CE2 | TYR | A | 32 | −34.570 | −28.364 | 78.823 | 1.00 | 39.82 | C |
| ATOM | 243 | CE1 | TYR | A | 32 | −36.270 | −29.495 | 80.088 | 1.00 | 40.18 | C |
| ATOM | 244 | CZ | TYR | A | 32 | −35.029 | −29.505 | 79.499 | 1.00 | 46.72 | C |
| ATOM | 245 | OH | TYR | A | 32 | −34.278 | −30.668 | 79.604 | 1.00 | 41.88 | O |
| ATOM | 246 | N | TYR | A | 33 | −40.420 | −24.842 | 79.282 | 1.00 | 31.10 | N |
| ATOM | 247 | CA | TYR | A | 33 | −41.042 | −23.558 | 79.529 | 1.00 | 30.58 | C |
| ATOM | 248 | C | TYR | A | 33 | −40.221 | −22.800 | 80.563 | 1.00 | 30.77 | C |
| ATOM | 249 | O | TYR | A | 33 | −39.686 | −23.392 | 81.507 | 1.00 | 29.88 | O |
| ATOM | 250 | CB | TYR | A | 33 | −42.491 | −23.726 | 79.987 | 1.00 | 30.38 | C |
| ATOM | 251 | CG | TYR | A | 33 | −43.440 | −23.801 | 78.834 | 1.00 | 33.35 | C |
| ATOM | 252 | CD2 | TYR | A | 33 | −44.211 | −22.698 | 78.485 | 1.00 | 33.18 | C |
| ATOM | 253 | CD1 | TYR | A | 33 | −43.550 | −24.966 | 78.059 | 1.00 | 33.82 | C |
| ATOM | 254 | CE2 | TYR | A | 33 | −45.080 | −22.746 | 77.407 | 1.00 | 36.40 | C |
| ATOM | 255 | CE1 | TYR | A | 33 | −44.430 | −25.030 | 76.976 | 1.00 | 33.85 | C |
| ATOM | 256 | CZ | TYR | A | 33 | −45.186 | −23.909 | 76.655 | 1.00 | 39.33 | C |
| ATOM | 257 | OH | TYR | A | 33 | −46.051 | −23.924 | 75.590 | 1.00 | 39.05 | O |
| ATOM | 258 | N | TRP | A | 34 | −40.133 | −21.490 | 80.381 | 1.00 | 25.37 | N |
| ATOM | 259 | CA | TRP | A | 34 | −39.285 | −20.639 | 81.189 | 1.00 | 25.30 | C |
| ATOM | 260 | C | TRP | A | 34 | −39.285 | −20.639 | 81.189 | 1.00 | 25.30 | C |
| ATOM | 261 | O | TRP | A | 34 | −41.013 | −18.993 | 81.328 | 1.00 | 28.04 | O |
| ATOM | 262 | CB | TRP | A | 34 | −38.242 | −19.932 | 80.310 | 1.00 | 27.04 | C |
| ATOM | 263 | CG | TRP | A | 34 | −37.375 | −20.952 | 79.641 | 1.00 | 28.16 | C |
| ATOM | 264 | CD1 | TRP | A | 34 | −37.436 | −21.371 | 78.333 | 1.00 | 31.12 | C |
| ATOM | 265 | CD2 | TRP | A | 34 | −36.525 | −22.375 | 78.110 | 1.00 | 27.45 | C |
| ATOM | 266 | NE1 | TRP | A | 34 | −35.881 | −22.653 | 79.287 | 1.00 | 31.81 | N |
| ATOM | 267 | CE2 | TRP | A | 34 | −35.881 | −22.653 | 79.287 | 1.00 | 31.81 | C |
| ATOM | 268 | CE3 | TRP | A | 34 | −35.920 | −21.875 | 81.587 | 1.00 | 28.15 | C |
| ATOM | 269 | CZ2 | TRP | A | 34 | −34.880 | −23.591 | 79.567 | 1.00 | 31.29 | C |
| ATOM | 270 | CZ3 | TRP | A | 34 | −34.911 | −22.807 | 81.864 | 1.00 | 29.29 | C |
| ATOM | 271 | CH2 | TRP | A | 34 | −34.411 | −23.654 | 80.858 | 1.00 | 25.81 | C |
| ATOM | 272 | N | SER | A | 35 | −39.993 | −19.608 | 83.268 | 1.00 | 28.16 | N |
| ATOM | 273 | CA | SER | A | 35 | −41.009 | −19.048 | 84.150 | 1.00 | 29.83 | C |
| ATOM | 274 | C | SER | A | 35 | −40.463 | −17.999 | 85.106 | 1.00 | 27.98 | C |
| ATOM | 275 | O | SER | A | 35 | −39.266 | −17.907 | 85.361 | 1.00 | 25.65 | O |
| ATOM | 276 | CB | SER | A | 35 | −41.677 | −20.145 | 84.957 | 1.00 | 25.41 | C |
| ATOM | 277 | OG | SER | A | 35 | −42.298 | −21.049 | 84.068 | 1.00 | 33.06 | O |
| ATOM | 278 | N | TRP | A | 36 | −41.388 | −17.224 | 85.655 | 1.00 | 26.15 | N |
| ATOM | 279 | CA | TRP | A | 36 | −41.091 | −16.278 | 86.712 | 1.00 | 23.95 | C |
| ATOM | 280 | C | TRP | A | 36 | −42.037 | −16.535 | 87.877 | 1.00 | 26.92 | C |
| ATOM | 281 | O | TRP | A | 36 | −43.249 | −16.680 | 87.693 | 1.00 | 24.36 | O |
| ATOM | 282 | CB | TRP | A | 36 | −41.200 | −14.847 | 86.204 | 1.00 | 21.96 | C |
| ATOM | 283 | CG | TRP | A | 36 | −40.123 | −14.545 | 85.243 | 1.00 | 27.15 | C |
| ATOM | 284 | CD1 | TRP | A | 36 | −40.208 | −14.586 | 83.880 | 1.00 | 28.66 | C |
| ATOM | 285 | CD2 | TRP | A | 36 | −38.764 | −14.186 | 85.550 | 1.00 | 30.43 | C |
| ATOM | 286 | NE1 | TRP | A | 36 | −38.998 | −14.263 | 83.319 | 1.00 | 28.45 | N |
| ATOM | 287 | CE2 | TRP | A | 36 | −38.092 | −14.011 | 84.318 | 1.00 | 31.09 | C |
| ATOM | 288 | CE3 | TRP | A | 36 | −38.051 | −13.988 | 86.744 | 1.00 | 26.18 | C |
| ATOM | 289 | CZ2 | TRP | A | 36 | −36.736 | −13.635 | 84.245 | 1.00 | 30.83 | C |
| ATOM | 290 | CZ3 | TRP | A | 36 | −36.710 | −13.624 | 86.669 | 1.00 | 31.94 | C |
| ATOM | 291 | CH2 | TRP | A | 36 | −36.065 | −13.444 | 85.426 | 1.00 | 27.34 | C |
| ATOM | 292 | N | ILE | A | 37 | −41.470 | −16.623 | 89.072 | 1.00 | 28.61 | N |
| ATOM | 293 | CA | ILE | A | 37 | −42.220 | −16.887 | 90.289 | 1.00 | 25.71 | C |
| ATOM | 294 | C | ILE | A | 37 | −41.703 | −15.924 | 91.344 | 1.00 | 26.51 | C |
| ATOM | 295 | O | ILE | A | 37 | −40.485 | −15.758 | 91.473 | 1.00 | 28.46 | O |
| ATOM | 296 | CB | ILE | A | 37 | −42.043 | −18.359 | 90.726 | 1.00 | 28.49 | C |
| ATOM | 297 | CG1 | ILE | A | 37 | −42.496 | −19.298 | 89.602 | 1.00 | 20.22 | C |
| ATOM | 298 | CG2 | ILE | A | 37 | −42.842 | −18.657 | 91.998 | 1.00 | 30.40 | C |
| ATOM | 299 | CD1 | ILE | A | 37 | −41.935 | −20.641 | 89.672 | 1.00 | 19.85 | C |
| ATOM | 300 | N | ARG | A | 38 | −42.608 | −15.271 | 92.089 | 1.00 | 27.82 | N |

TABLE 10.4-continued

| | | | | | | | | | | |
|---|---|---|---|---|---|---|---|---|---|---|
| ATOM | 301 | CA | ARG | A | 38 | −42.178 | −14.383 | 93.172 | 1.00 | 31.79 | C |
| ATOM | 302 | C | ARG | A | 38 | −42.654 | −14.877 | 94.535 | 1.00 | 29.28 | C |
| ATOM | 303 | O | ARG | A | 38 | −43.711 | −15.493 | 94.666 | 1.00 | 30.31 | O |
| ATOM | 304 | CB | ARG | A | 38 | −42.642 | −12.902 | 92.983 | 1.00 | 25.98 | C |
| ATOM | 305 | CG | ARG | A | 38 | −44.132 | −12.704 | 92.827 | 1.00 | 30.50 | C |
| ATOM | 306 | CD | ARG | A | 38 | −44.718 | −11.710 | 93.796 | 1.00 | 31.27 | C |
| ATOM | 307 | NE | ARG | A | 38 | −44.660 | −10.332 | 93.330 | 1.00 | 38.33 | N |
| ATOM | 308 | CZ | ARG | A | 38 | −45.723 | −9.550 | 93.118 | 1.00 | 40.05 | C |
| ATOM | 309 | NH1 | ARG | A | 38 | −46.967 | −9.987 | 93.311 | 1.00 | 29.85 | N1+ |
| ATOM | 310 | NH2 | ARG | A | 38 | −45.529 | −8.307 | 92.711 | 1.00 | 35.67 | N |
| ATOM | 311 | N | GLN | A | 39 | −41.874 | −14.544 | 95.561 | 1.00 | 29.83 | N |
| ATOM | 312 | CA | GLN | A | 39 | −42.189 | −14.894 | 96.940 | 1.00 | 29.44 | C |
| ATOM | 313 | C | GLN | A | 39 | −42.070 | −13.629 | 97.776 | 1.00 | 30.99 | C |
| ATOM | 314 | O | GLN | A | 39 | −40.945 | −13.189 | 98.072 | 1.00 | 30.65 | O |
| ATOM | 315 | CB | GLN | A | 39 | −41.278 | −15.997 | 97.467 | 1.00 | 26.80 | C |
| ATOM | 316 | CG | GLN | A | 39 | −41.737 | −16.561 | 98.799 | 1.00 | 29.10 | C |
| ATOM | 317 | CD | GLN | A | 39 | −41.020 | −17.825 | 99.195 | 1.00 | 32.69 | C |
| ATOM | 318 | OE1 | GLN | A | 39 | −39.808 | −17.945 | 99.051 | 1.00 | 34.15 | O |
| ATOM | 319 | NE2 | GLN | A | 39 | −41.773 | −18.787 | 99.702 | 1.00 | 36.84 | N |
| ATOM | 320 | N | PRO | A | 40 | −43.199 | −13.006 | 98.142 | 1.00 | 32.88 | N |
| ATOM | 321 | CA | PRO | A | 40 | −43.142 | −11.823 | 99.012 | 1.00 | 32.74 | C |
| ATOM | 322 | C | PRO | A | 40 | −42.699 | −12.202 | 100.414 | 1.00 | 37.01 | C |
| ATOM | 323 | O | PRO | A | 40 | −42.970 | −13.320 | 100.883 | 1.00 | 37.15 | O |
| ATOM | 324 | CB | PRO | A | 40 | −44.590 | −11.305 | 99.005 | 1.00 | 28.52 | C |
| ATOM | 325 | CG | PRO | A | 40 | −45.230 | −11.963 | 97.786 | 1.00 | 33.90 | C |
| ATOM | 326 | CD | PRO | A | 40 | −44.566 | −13.290 | 97.668 | 1.00 | 32.61 | C |
| ATOM | 327 | N | PRO | A | 41 | −42.011 | −11.304 | 101.120 | 1.00 | 41.34 | N |
| ATOM | 328 | CA | PRO | A | 41 | −41.405 | −11.689 | 102.405 | 1.00 | 35.97 | C |
| ATOM | 329 | C | PRO | A | 41 | −42.486 | −12.089 | 103.398 | 1.00 | 39.15 | C |
| ATOM | 330 | O | PRO | A | 41 | −43.499 | −11.400 | 103.564 | 1.00 | 39.19 | O |
| ATOM | 331 | CB | PRO | A | 41 | −40.643 | −10.430 | 102.834 | 1.00 | 35.82 | C |
| ATOM | 332 | CG | PRO | A | 41 | −41.378 | −9.304 | 102.151 | 1.00 | 36.54 | C |
| ATOM | 333 | CD | PRO | A | 41 | −41.862 | −9.861 | 100.839 | 1.00 | 32.74 | C |
| ATOM | 334 | N | GLY | A | 42 | −42.264 | −13.220 | 104.057 | 1.00 | 39.49 | N |
| ATOM | 335 | CA | GLY | A | 42 | −43.319 | −13.884 | 104.786 | 1.00 | 43.62 | C |
| ATOM | 336 | C | GLY | A | 42 | −44.017 | −14.964 | 103.996 | 1.00 | 43.06 | C |
| ATOM | 337 | O | GLY | A | 42 | −45.137 | −15.343 | 104.347 | 1.00 | 44.55 | O |
| ATOM | 338 | N | LYS | A | 43 | −43.392 | −15.449 | 102.924 | 1.00 | 49.76 | N |
| ATOM | 339 | CA | LYS | A | 43 | −43.711 | −16.719 | 102.276 | 1.00 | 46.50 | C |
| ATOM | 340 | C | LYS | A | 43 | −44.975 | −16.606 | 101.432 | 1.00 | 41.59 | C |
| ATOM | 341 | O | LYS | A | 43 | −45.732 | −15.629 | 101.536 | 1.00 | 39.86 | O |
| ATOM | 342 | CB | LYS | A | 43 | −43.844 | −17.858 | 103.320 | 1.00 | 55.91 | C |
| ATOM | 343 | CG | LYS | A | 43 | −42.513 | −18.447 | 103.914 | 1.00 | 45.31 | C |
| ATOM | 344 | CD | LYS | A | 43 | −41.860 | −19.485 | 102.968 | 1.00 | 46.63 | C |
| ATOM | 345 | CE | LYS | A | 43 | −41.212 | −20.692 | 103.684 | 1.00 | 40.96 | C |
| ATOM | 346 | NZ | LYS | A | 43 | −39.846 | −20.507 | 104.327 | 1.00 | 38.05 | N |
| ATOM | 347 | N | GLY | A | 44 | −45.192 | −17.625 | 100.601 | 1.00 | 39.58 | N |
| ATOM | 348 | CA | GLY | A | 44 | −46.241 | −17.682 | 99.609 | 1.00 | 36.71 | C |
| ATOM | 349 | C | GLY | A | 44 | −45.620 | −17.601 | 98.231 | 1.00 | 37.64 | C |
| ATOM | 350 | O | GLY | A | 44 | −44.862 | −16.666 | 97.961 | 1.00 | 40.33 | O |
| ATOM | 351 | N | LEU | A | 45 | −45.870 | −18.568 | 97.359 | 1.00 | 32.84 | N |
| ATOM | 352 | CA | LEU | A | 45 | −45.302 | −18.533 | 96.019 | 1.00 | 31.46 | C |
| ATOM | 353 | C | LEU | A | 45 | −46.409 | −18.152 | 95.047 | 1.00 | 32.57 | C |
| ATOM | 354 | O | LEU | A | 45 | −47.409 | −18.773 | 95.054 | 1.00 | 37.03 | O |
| ATOM | 355 | CB | LEU | A | 45 | −44.665 | −19.877 | 95.649 | 1.00 | 29.61 | C |
| ATOM | 356 | CG | LEU | A | 45 | −43.412 | −20.297 | 96.434 | 1.00 | 28.20 | C |
| ATOM | 357 | CD1 | LEU | A | 45 | −43.088 | −21.788 | 96.284 | 1.00 | 22.57 | C |
| ATOM | 358 | CD2 | LEU | A | 45 | −42.235 | −19.474 | 95.976 | 1.00 | 25.94 | C |
| ATOM | 359 | N | GLU | A | 46 | −46.150 | −17.152 | 94.201 | 1.00 | 27.39 | N |
| ATOM | 360 | CA | GLU | A | 46 | −47.092 | −16.747 | 93.168 | 1.00 | 31.51 | C |
| ATOM | 361 | C | GLU | A | 46 | −46.444 | −16.851 | 91.798 | 1.00 | 35.34 | C |
| ATOM | 362 | O | GLU | A | 46 | −45.360 | −16.303 | 91.565 | 1.00 | 32.92 | O |
| ATOM | 363 | CB | GLU | A | 46 | −47.602 | −15.323 | 93.347 | 1.00 | 29.82 | C |
| ATOM | 364 | CG | GLU | A | 46 | −47.130 | −14.572 | 94.552 | 1.00 | 39.23 | C |
| ATOM | 365 | CD | GLU | A | 46 | −47.805 | −13.180 | 94.638 | 1.00 | 55.69 | C |
| ATOM | 366 | OE1 | GLU | A | 46 | −48.162 | −12.613 | 93.554 | 1.00 | 51.35 | O |
| ATOM | 367 | OE2 | GLU | A | 46 | −48.001 | −12.680 | 95.784 | 1.00 | 52.13 | O1− |
| ATOM | 368 | N | TRP | A | 47 | −47.137 | −17.524 | 90.893 | 1.00 | 29.44 | N |
| ATOM | 369 | CA | TRP | A | 47 | −46.647 | −17.778 | 89.551 | 1.00 | 30.35 | C |
| ATOM | 370 | C | TRP | A | 47 | −46.982 | −16.605 | 88.644 | 1.00 | 32.75 | C |
| ATOM | 371 | O | TRP | A | 47 | −48.143 | −16.202 | 88.550 | 1.00 | 36.68 | O |
| ATOM | 372 | CB | TRP | A | 47 | −47.265 | −19.068 | 89.037 | 1.00 | 24.36 | C |
| ATOM | 373 | CG | TRP | A | 47 | −46.961 | −19.432 | 87.637 | 1.00 | 29.61 | C |
| ATOM | 374 | CD1 | TRP | A | 47 | −45.883 | −20.133 | 87.188 | 1.00 | 25.71 | C |
| ATOM | 375 | CD2 | TRP | A | 47 | −47.784 | −19.186 | 86.495 | 1.00 | 28.45 | C |
| ATOM | 376 | NE1 | TRP | A | 47 | −45.979 | −20.319 | 85.840 | 1.00 | 26.95 | N |
| ATOM | 377 | CE2 | TRP | A | 47 | −47.136 | −19.748 | 85.388 | 1.00 | 25.32 | C |
| ATOM | 378 | CE3 | TRP | A | 47 | −49.001 | −18.540 | 86.303 | 1.00 | 25.64 | C |
| ATOM | 379 | CZ2 | TRP | A | 47 | −47.662 | −19.687 | 84.112 | 1.00 | 26.63 | C |
| ATOM | 380 | CZ3 | TRP | A | 47 | −49.517 | −18.479 | 85.032 | 1.00 | 29.15 | C |

TABLE 10.4-continued

| | | | | | | | | | | |
|---|---|---|---|---|---|---|---|---|---|---|
| ATOM | 381 | CH2 | TRP | A | 47 | −48.853 | −19.054 | 83.953 | 1.00 | 27.51 | C |
| ATOM | 382 | N | PHE | A | 48 | −45.966 | −16.059 | 87.975 | 1.00 | 33.76 | N |
| ATOM | 383 | CA | PHE | A | 48 | −46.182 | −14.896 | 87.119 | 1.00 | 32.37 | C |
| ATOM | 384 | C | PHE | A | 48 | −46.601 | −15.253 | 85.708 | 1.00 | 32.57 | C |
| ATOM | 385 | O | PHE | A | 48 | −47.502 | −14.615 | 85.160 | 1.00 | 39.41 | O |
| ATOM | 386 | CB | PHE | A | 48 | −44.925 | −14.027 | 87.073 | 1.00 | 31.35 | C |
| ATOM | 387 | CG | PHE | A | 48 | −44.998 | −12.843 | 87.979 | 1.00 | 30.88 | C |
| ATOM | 388 | CD2 | PHE | A | 48 | −44.484 | −11.622 | 87.593 | 1.00 | 32.09 | C |
| ATOM | 389 | CD1 | PHE | A | 48 | −45.606 | −12.952 | 89.221 | 1.00 | 31.12 | C |
| ATOM | 390 | CE2 | PHE | A | 48 | −44.562 | −10.519 | 88.440 | 1.00 | 34.85 | C |
| ATOM | 391 | CE1 | PHE | A | 48 | −45.695 | −11.855 | 90.073 | 1.00 | 34.60 | C |
| ATOM | 392 | CZ | PHE | A | 48 | −45.165 | −10.639 | 89.683 | 1.00 | 36.89 | C |
| ATOM | 393 | N | GLY | A | 49 | −45.982 | −16.255 | 85.111 | 1.00 | 31.20 | N |
| ATOM | 394 | CA | GLY | A | 49 | −46.195 | −16.531 | 83.707 | 1.00 | 30.09 | C |
| ATOM | 395 | C | GLY | A | 49 | −45.089 | −17.418 | 83.178 | 1.00 | 31.55 | C |
| ATOM | 396 | O | GLY | A | 49 | −44.201 | −17.849 | 83.913 | 1.00 | 31.30 | O |
| ATOM | 397 | N | GLU | A | 50 | −45.176 | −17.704 | 81.881 | 1.00 | 28.58 | N |
| ATOM | 398 | CA | GLU | A | 50 | −44.233 | −18.608 | 81.247 | 1.00 | 27.28 | C |
| ATOM | 399 | C | GLU | A | 50 | −44.118 | −18.247 | 79.773 | 1.00 | 31.68 | C |
| ATOM | 400 | O | GLU | A | 50 | −45.015 | −17.630 | 79.199 | 1.00 | 32.98 | O |
| ATOM | 401 | CB | GLU | A | 50 | −44.669 | −20.060 | 81.434 | 1.00 | 26.85 | C |
| ATOM | 402 | CG | GLU | A | 50 | −46.040 | −20.348 | 80.874 | 1.00 | 29.78 | C |
| ATOM | 403 | CD | GLU | A | 50 | −46.438 | −21.812 | 81.020 | 1.00 | 35.37 | C |
| ATOM | 404 | OE1 | GLU | A | 50 | −47.350 | −22.259 | 80.271 | 1.00 | 37.88 | O |
| ATOM | 405 | OE2 | GLU | A | 50 | −45.834 | −22.514 | 81.875 | 1.00 | 28.88 | O |
| ATOM | 406 | N | ILE | A | 51 | −42.989 | −18.610 | 79.165 | 1.00 | 32.55 | N |
| ATOM | 407 | CA | ILE | A | 51 | −42.790 | −18.425 | 77.735 | 1.00 | 28.12 | C |
| ATOM | 408 | C | ILE | A | 51 | −42.187 | −19.702 | 77.167 | 1.00 | 34.07 | C |
| ATOM | 409 | O | ILE | A | 51 | −41.470 | −20.426 | 77.867 | 1.00 | 29.86 | O |
| ATOM | 410 | CB | ILE | A | 51 | −41.917 | −14.191 | 77.464 | 1.00 | 29.20 | C |
| ATOM | 411 | CG1 | ILE | A | 51 | −41.860 | −16.866 | 75.954 | 1.00 | 32.21 | C |
| ATOM | 412 | CG2 | ILE | A | 51 | −40.574 | −17.350 | 78.147 | 1.00 | 26.55 | C |
| ATOM | 413 | CD1 | ILE | A | 51 | −41.585 | −15.399 | 75.639 | 1.00 | 26.20 | C |
| ATOM | 414 | N | SER | A | 52 | −42.453 | −19.969 | 75.876 | 1.00 | 37.40 | N |
| ATOM | 415 | CA | SER | A | 52 | −42.398 | −21.343 | 75.378 | 1.00 | 41.14 | C |
| ATOM | 416 | C | SER | A | 52 | −41.162 | −21.701 | 74.563 | 1.00 | 43.60 | C |
| ATOM | 417 | O | SER | A | 52 | −40.851 | 22.904 | 74.473 | 1.00 | 56.16 | O |
| ATOM | 418 | CB | SER | A | 52 | −43.624 | −21.655 | 74.508 | 1.00 | 44.90 | C |
| ATOM | 419 | OG | SER | A | 52 | −43.499 | −21.091 | 73.211 | 1.00 | 42.47 | O |
| ATOM | 420 | N | HIS | A | 53 | −40.465 | −20.709 | 73.992 | 1.00 | 38.93 | N |
| ATOM | 421 | CA | HIS | A | 53 | −39.361 | −20.843 | 73.025 | 1.00 | 46.69 | C |
| ATOM | 422 | C | HIS | A | 53 | −39.838 | −20.322 | 71.682 | 1.00 | 40.68 | C |
| ATOM | 423 | O | HIS | A | 53 | −39.045 | −19.789 | 70.908 | 1.00 | 48.98 | O |
| ATOM | 424 | CB | HIS | A | 53 | −38.827 | −22.278 | 72.833 | 1.00 | 47.29 | C |
| ATOM | 425 | CG | HIS | A | 53 | −37.623 | −22.370 | 71.938 | 1.00 | 50.45 | C |
| ATOM | 426 | ND1 | HIS | A | 53 | −36.332 | −22.400 | 72.429 | 1.00 | 48.68 | N |
| ATOM | 427 | CD2 | HIS | A | 53 | −37.510 | −22.432 | 70.589 | 1.00 | 50.73 | C |
| ATOM | 428 | CE1 | HIS | A | 53 | −35.477 | −22.464 | 71.421 | 1.00 | 44.63 | C |
| ATOM | 429 | NE2 | HIS | A | 53 | −36.166 | −22.483 | 70.294 | 1.00 | 45.11 | N |
| ATOM | 430 | N | SER | A | 54 | −41.136 | −20.418 | 71.427 | 1.00 | 43.19 | N |
| ATOM | 431 | CA | SER | A | 54 | −41.723 | −19.986 | 70.163 | 1.00 | 37.71 | C |
| ATOM | 432 | C | SER | A | 54 | −41.978 | −18.486 | 69.934 | 1.00 | 41.91 | C |
| ATOM | 433 | O | SER | A | 54 | −42.167 | −18.132 | 68.783 | 1.00 | 58.83 | O |
| ATOM | 434 | CB | SER | A | 54 | −43.072 | −20.685 | 69.930 | 1.00 | 41.65 | C |
| ATOM | 435 | OG | SER | A | 54 | −43.284 | −21.786 | 70.799 | 1.00 | 58.13 | O |
| ATOM | 436 | N | GLY | A | 55 | −42.077 | −17.595 | 70.928 | 1.00 | 41.19 | N |
| ATOM | 437 | CA | GLY | A | 55 | −42.199 | −17.864 | 72.342 | 1.00 | 37.12 | C |
| ATOM | 438 | C | GLY | A | 55 | −43.565 | −17.363 | 72.782 | 1.00 | 38.09 | C |
| ATOM | 439 | O | GLY | A | 55 | −43.782 | −16.170 | 73.025 | 1.00 | 35.63 | O |
| ATOM | 440 | N | SER | A | 56 | −44.514 | −18.290 | 72.843 | 1.00 | 35.38 | N |
| ATOM | 441 | CA | SER | A | 56 | −45.839 | −17.960 | 73.328 | 1.00 | 36.92 | C |
| ATOM | 442 | C | SER | A | 56 | −45.838 | −17.864 | 74.851 | 1.00 | 39.87 | C |
| ATOM | 443 | O | SER | A | 56 | −45.057 | −18.536 | 75.536 | 1.00 | 38.19 | O |
| ATOM | 444 | CB | SER | A | 56 | −46.855 | −19.002 | 72.851 | 1.00 | 43.51 | C |
| ATOM | 445 | OG | SER | A | 56 | −46.477 | −20.320 | 73.214 | 1.00 | 52.12 | O |
| ATOM | 446 | N | THR | A | 57 | −46.745 | −17.035 | 75.381 | 1.00 | 36.78 | N |
| ATOM | 447 | CA | THR | A | 57 | −46.758 | −16.688 | 76.792 | 1.00 | 35.49 | C |
| ATOM | 448 | C | THR | A | 57 | −48.106 | −17.037 | 77.412 | 1.00 | 36.54 | C |
| ATOM | 449 | O | THR | A | 57 | −49.129 | −17.068 | 76.738 | 1.00 | 36.43 | O |
| ATOM | 450 | CB | THR | A | 57 | −46.464 | −15.195 | 77.048 | 1.00 | 34.28 | C |
| ATOM | 451 | OG1 | THR | A | 57 | −47.488 | −14.390 | 76.463 | 1.00 | 34.38 | O |
| ATOM | 452 | CG2 | THR | A | 57 | −45.110 | −14.791 | 76.511 | 1.00 | 32.77 | C |
| ATOM | 453 | N | ASN | A | 58 | −48.081 | −17.324 | 78.707 | 1.00 | 34.99 | N |
| ATOM | 454 | CA | ASN | A | 58 | −49.282 | −17.540 | 79.497 | 1.00 | 35.60 | C |
| ATOM | 455 | C | ASN | A | 58 | −49.013 | −16.847 | 80.812 | 1.00 | 38.61 | C |
| ATOM | 456 | O | ASN | A | 58 | −48.117 | −17.271 | 81.548 | 1.00 | 38.39 | O |
| ATOM | 457 | CB | ASN | A | 58 | −49.562 | −19.013 | 79.731 | 1.00 | 33.14 | C |
| ATOM | 458 | CG | ASN | A | 58 | −49.588 | −19.785 | 78.459 | 1.00 | 38.06 | C |
| ATOM | 459 | OD1 | ASN | A | 58 | −50.518 | −19.669 | 77.673 | 1.00 | 42.44 | O |
| ATOM | 460 | ND2 | ASN | A | 58 | −48.555 | −20.583 | 78.234 | 1.00 | 37.72 | N |

TABLE 10.4-continued

| | | | | | | | | | | |
|---|---|---|---|---|---|---|---|---|---|---|
| ATOM | 461 | N | TYR | A | 59 | −49.778 | −15.800 | 81.101 | 1.00 | 35.54 | N |
| ATOM | 462 | CA | TYR | A | 59 | −49.557 | −14.988 | 82.281 | 1.00 | 36.21 | C |
| ATOM | 463 | C | TYR | A | 59 | −50.617 | −15.291 | 83.325 | 1.00 | 34.45 | C |
| ATOM | 464 | O | TYR | A | 59 | −51.674 | −15.857 | 83.041 | 1.00 | 36.30 | O |
| ATOM | 465 | CB | TYR | A | 59 | −49.603 | −13.498 | 81.943 | 1.00 | 35.28 | C |
| ATOM | 466 | CG | TYR | A | 59 | −48.633 | −13.043 | 80.880 | 1.00 | 35.74 | C |
| ATOM | 467 | CD1 | TYR | A | 59 | −47.259 | −13.085 | 81.082 | 1.00 | 34.19 | C |
| ATOM | 468 | CD2 | TYR | A | 59 | −49.101 | −12.544 | 79.678 | 1.00 | 35.17 | C |
| ATOM | 469 | CE1 | TYR | A | 59 | −46.383 | −12.644 | 80.107 | 1.00 | 33.92 | C |
| ATOM | 470 | CE2 | TYR | A | 59 | −48.241 | −12.098 | 78.700 | 1.00 | 31.35 | C |
| ATOM | 471 | CZ | TYR | A | 59 | −46.888 | −12.143 | 78.912 | 1.00 | 37.17 | C |
| ATOM | 472 | OH | TYR | A | 59 | −46.055 | −11.690 | 77.915 | 1.00 | 33.15 | O |
| ATOM | 473 | N | ASN | A | 60 | −50.335 | −14.882 | 84.531 | 1.00 | 37.70 | N |
| ATOM | 474 | CA | ASN | A | 60 | −51.356 | −14.909 | 85.549 | 1.00 | 38.74 | C |
| ATOM | 475 | C | ASN | A | 60 | −52.356 | −13.791 | 85.274 | 1.00 | 42.68 | C |
| ATOM | 476 | O | ASN | A | 60 | −51.962 | −12.615 | 85.220 | 1.00 | 41.91 | O |
| ATOM | 477 | CB | ASN | A | 60 | −50.706 | −14.771 | 86.911 | 1.00 | 35.36 | C |
| ATOM | 478 | CG | ASN | A | 60 | −51.663 | −15.019 | 88.031 | 1.00 | 37.89 | C |
| ATOM | 479 | OD1 | ASN | A | 60 | −52.874 | −14.862 | 87.873 | 1.00 | 38.66 | O |
| ATOM | 480 | ND2 | ASN | A | 60 | −51.142 | −15.541 | 89.137 | 1.00 | 36.71 | N |
| ATOM | 481 | N | PRO | A | 61 | −53.642 | −14.102 | 82.084 | 1.00 | 43.65 | N |
| ATOM | 482 | CA | PRO | A | 61 | −54.609 | −13.045 | 84.741 | 1.00 | 37.57 | C |
| ATOM | 483 | C | PRO | A | 61 | −54.670 | −11.924 | 85.762 | 1.00 | 40.30 | C |
| ATOM | 484 | O | PRO | A | 61 | −54.997 | −10.786 | 85.405 | 1.00 | 42.33 | O |
| ATOM | 485 | CB | PRO | A | 61 | −55.931 | −13.820 | 84.677 | 1.00 | 32.38 | C |
| ATOM | 486 | CG | PRO | A | 61 | −55.502 | −15.207 | 84.249 | 1.00 | 39.32 | C |
| ATOM | 487 | CD | PRO | A | 61 | −54.273 | −15.439 | 85.092 | 1.00 | 39.25 | C |
| ATOM | 488 | N | SER | A | 62 | −54.321 | −12.218 | 87.016 | 1.00 | 40.22 | N |
| ATOM | 489 | CA | SER | A | 62 | −54.367 | −11.233 | 88.092 | 1.00 | 39.59 | C |
| ATOM | 490 | C | SER | A | 62 | −53.386 | −10.087 | 87.868 | 1.00 | 45.31 | C |
| ATOM | 491 | O | SER | A | 62 | −53.617 | −8.957 | 88.319 | 1.00 | 43.39 | O |
| ATOM | 492 | CB | SER | A | 62 | −54.058 | −11.920 | 89.419 | 1.00 | 40.43 | C |
| ATOM | 493 | OG | SER | A | 62 | −53.155 | −11.129 | 90.177 | 1.00 | 48.57 | O |
| ATOM | 494 | N | LEU | A | 63 | −52.237 | −10.383 | 87.272 | 1.00 | 45.35 | N |
| ATOM | 495 | CA | LEU | A | 63 | −51.297 | −9.329 | 86.930 | 1.00 | 44.69 | C |
| ATOM | 496 | C | LEU | A | 63 | −51.894 | −8.416 | 85.869 | 1.00 | 53.96 | C |
| ATOM | 497 | O | LEU | A | 63 | −51.658 | −7.201 | 85.861 | 1.00 | 54.71 | O |
| ATOM | 498 | CB | LEU | A | 63 | −50.001 | −9.971 | 86.440 | 1.00 | 43.57 | C |
| ATOM | 499 | CG | LEU | A | 63 | −49.158 | −10.633 | 87.535 | 1.00 | 43.51 | C |
| ATOM | 500 | CD1 | LEU | A | 63 | −47.844 | −11.134 | 86.978 | 1.00 | 40.31 | C |
| ATOM | 501 | CD2 | LEU | A | 63 | −48.888 | −9.663 | 88.691 | 1.00 | 43.97 | C |
| ATOM | 502 | N | LYS | A | 64 | −52.663 | −9.003 | 84.955 | 1.00 | 58.46 | N |
| ATOM | 503 | CA | LYS | A | 64 | −53.324 | −8.320 | 83.854 | 1.00 | 58.94 | C |
| ATOM | 504 | C | LYS | A | 64 | −52.277 | −7.745 | 82.912 | 1.00 | 51.96 | C |
| ATOM | 505 | O | LYS | A | 64 | −51.377 | −8.460 | 82.452 | 1.00 | 48.34 | O |
| ATOM | 506 | CB | LYS | A | 64 | −54.274 | −7.204 | 84.304 | 1.00 | 52.16 | C |
| ATOM | 507 | CG | LYS | A | 64 | −55.571 | −7.258 | 83.486 | 1.00 | 62.77 | C |
| ATOM | 508 | CD | LYS | A | 64 | −56.400 | −5.965 | 83.488 | 1.00 | 81.85 | C |
| ATOM | 509 | CE | LYS | A | 64 | −57.048 | −5.593 | 84.810 | 1.00 | 81.71 | C |
| ATOM | 510 | NZ | LYS | A | 64 | −57.659 | −4.226 | 84.694 | 1.00 | 73.63 | N |
| ATOM | 511 | N | ALA | A | 65 | −52.386 | −6.444 | 82.659 | 1.00 | 41.71 | N |
| ATOM | 512 | CA | ALA | A | 65 | −51.539 | −5.768 | 81.693 | 1.00 | 43.20 | C |
| ATOM | 513 | C | ALA | A | 65 | −50.168 | −5.367 | 82.231 | 1.00 | 38.62 | C |
| ATOM | 514 | O | ALA | A | 65 | −49.389 | −4.808 | 81.463 | 1.00 | 42.39 | O |
| ATOM | 515 | CB | ALA | A | 65 | −52.249 | −4.540 | 81.128 | 1.00 | 46.41 | C |
| ATOM | 516 | N | ARG | A | 66 | −49.867 | −5.542 | 83.523 | 1.00 | 38.64 | N |
| ATOM | 517 | CA | ARG | A | 66 | −48.595 | −5.016 | 84.025 | 1.00 | 34.40 | C |
| ATOM | 518 | C | ARG | A | 66 | −47.377 | −5.847 | 83.627 | 1.00 | 36.18 | C |
| ATOM | 519 | O | ARG | A | 66 | −46.249 | −5.349 | 83.752 | 1.00 | 31.12 | O |
| ATOM | 520 | CB | ARG | A | 66 | −48.586 | −4.863 | 85.546 | 1.00 | 33.68 | C |
| ATOM | 521 | CG | ARG | A | 66 | −49.764 | −4.132 | 86.091 | 1.00 | 40.09 | C |
| ATOM | 522 | CD | ARG | A | 66 | −49.537 | −3.649 | 87.519 | 1.00 | 40.22 | C |
| ATOM | 523 | NE | ARG | A | 66 | −49.265 | −4.663 | 88.539 | 1.00 | 35.47 | N |
| ATOM | 524 | CZ | ARG | A | 66 | −48.148 | −4.713 | 89.268 | 1.00 | 34.74 | C |
| ATOM | 525 | NH1 | ARG | A | 66 | −47.168 | −3.842 | 89.065 | 1.00 | 33.41 | N1+ |
| ATOM | 526 | NH2 | ARG | A | 66 | −48.004 | −5.640 | 90.205 | 1.00 | 40.56 | N |
| ATOM | 527 | N | VAL | A | 67 | −47.559 | −7.095 | 83.188 | 1.00 | 34.62 | N |
| ATOM | 528 | CA | VAL | A | 67 | −46.463 | −8.049 | 83.084 | 1.00 | 36.24 | C |
| ATOM | 529 | C | VAL | A | 67 | −46.186 | −8.411 | 81.626 | 1.00 | 36.09 | C |
| ATOM | 530 | O | VAL | A | 67 | −47.113 | −8.575 | 80.828 | 1.00 | 36.24 | O |
| ATOM | 531 | CB | VAL | A | 67 | −46.782 | −9.292 | 83.935 | 1.00 | 34.93 | C |
| ATOM | 532 | CG1 | VAL | A | 67 | −47.992 | −9.994 | 83.388 | 1.00 | 41.56 | C |
| ATOM | 533 | CG2 | VAL | A | 67 | −45.596 | −10.222 | 83.981 | 1.00 | 36.82 | C |
| ATOM | 534 | N | THR | A | 68 | −44.894 | −8.531 | 81.289 | 1.00 | 35.40 | N |
| ATOM | 535 | CA | THR | A | 68 | −44.405 | −8.998 | 79.998 | 1.00 | 33.94 | C |
| ATOM | 536 | C | THR | A | 68 | −43.267 | −9.973 | 80.231 | 1.00 | 33.46 | C |
| ATOM | 537 | O | THR | A | 68 | −42.412 | −9.739 | 81.087 | 1.00 | 34.05 | O |
| ATOM | 538 | CB | THR | A | 68 | −43.854 | −7.882 | 79.090 | 1.00 | 37.93 | C |
| ATOM | 539 | OG1 | THR | A | 68 | −44.745 | −6.763 | 79.052 | 1.00 | 38.69 | O |
| ATOM | 540 | CG2 | THR | A | 68 | −43.621 | −8.423 | 77.672 | 1.00 | 27.13 | C |

TABLE 10.4-continued

| ATOM | 541 | N   | ILE | A | 69 | −43.262 | −11.064 | 79.471 | 1.00 | 35.17 | N |
| --- | --- | --- | --- | --- | --- | --- | --- | --- | --- | --- | --- |
| ATOM | 542 | CA  | ILE | A | 69 | −42.163 | −12.021 | 79.455 | 1.00 | 31.25 | C |
| ATOM | 543 | C   | ILE | A | 69 | −41.710 | −12.169 | 78.008 | 1.00 | 37.24 | C |
| ATOM | 544 | O   | ILE | A | 69 | −42.541 | −12.313 | 77.103 | 1.00 | 33.89 | O |
| ATOM | 545 | CB  | ILE | A | 69 | −42.574 | −13.382 | 80.051 | 1.00 | 27.84 | C |
| ATOM | 546 | CG1 | ILE | A | 69 | −42.912 | −13.212 | 81.523 | 1.00 | 31.71 | C |
| ATOM | 547 | CG2 | ILE | A | 69 | −41.468 | −14.407 | 79.896 | 1.00 | 25.74 | C |
| ATOM | 548 | CD1 | ILE | A | 69 | −43.605 | −14.385 | 82.110 | 1.00 | 30.41 | C |
| ATOM | 549 | N   | SER | A | 70 | −40.401 | −12.101 | 77.789 | 1.00 | 32.26 | N |
| ATOM | 550 | CA  | SER | A | 70 | −39.826 | −12.197 | 76.460 | 1.00 | 29.37 | C |
| ATOM | 551 | C   | SER | A | 70 | −38.678 | −13.195 | 76.500 | 1.00 | 33.52 | C |
| ATOM | 552 | O   | SER | A | 70 | −38.103 | −13.470 | 77.557 | 1.00 | 32.58 | O |
| ATOM | 553 | CB  | SER | A | 70 | −39.322 | −10.841 | 75.963 | 1.00 | 30.41 | C |
| ATOM | 554 | OG  | SER | A | 70 | −38.395 | −10.282 | 76.88  | 1.00 | 41.93 | O |
| ATOM | 555 | N   | ILE | A | 71 | −38.333 | −13.724 | 75.331 | 1.00 | 30.14 | N |
| ATOM | 556 | CA  | ILE | A | 71 | −37.327 | −14.761 | 75.222 | 1.00 | 29.53 | C |
| ATOM | 557 | C   | ILE | A | 71 | −36.358 | −14.414 | 74.097 | 1.00 | 34.98 | C |
| ATOM | 558 | O   | ILE | A | 71 | −36.762 | −13.926 | 73.035 | 1.00 | 33.60 | O |
| ATOM | 559 | CB  | ILE | A | 71 | −37.992 | −16.132 | 75.000 | 1.00 | 29.32 | C |
| ATOM | 560 | CG1 | ILE | A | 71 | −37.001 | −17.267 | 75.279 | 1.00 | 29.60 | C |
| ATOM | 561 | CG2 | ILE | A | 71 | −38.575 | −16.224 | 73.606 | 1.00 | 30.62 | C |
| ATOM | 562 | CD1 | ILE | A | 71 | −37.644 | −18.637 | 75.331 | 1.00 | 29.78 | C |
| ATOM | 563 | N   | ASP | A | 72 | −35.076 | −14.658 | 74.339 | 1.00 | 33.23 | N |
| ATOM | 564 | CA  | ASP | A | 72 | −34.016 | −14.453 | 73.355 | 1.00 | 32.69 | C |
| ATOM | 565 | C   | ASP | A | 72 | −33.394 | −15.828 | 73.138 | 1.00 | 36.12 | C |
| ATOM | 566 | O   | ASP | A | 72 | −32.525 | −16.242 | 73.910 | 1.00 | 37.95 | O |
| ATOM | 567 | CB  | ASP | A | 72 | −33.008 | −13.415 | 73.862 | 1.00 | 31.36 | C |
| ATOM | 568 | CG  | ASP | A | 72 | −31.876 | −13.113 | 72.861 | 1.00 | 47.78 | C |
| ATOM | 569 | OD2 | ASP | A | 72 | −31.214 | −12.051 | 73.040 | 1.00 | 43.89 | O |
| ATOM | 570 | OD1 | ASP | A | 72 | −31.629 | −13.924 | 71.921 | 1.00 | 48.56 | O |
| ATOM | 571 | N   | THR | A | 73 | −33.847 | −16.547 | 72.100 | 1.00 | 39.39 | N |
| ATOM | 572 | CA  | THR | A | 73 | −33.375 | −17.916 | 71.888 | 1.00 | 36.77 | C |
| ATOM | 573 | C   | THR | A | 73 | −31.919 | −17.989 | 71.429 | 1.00 | 43.07 | C |
| ATOM | 574 | O   | THR | A | 73 | −31.301 | −19.055 | 71.535 | 1.00 | 46.66 | O |
| ATOM | 575 | CB  | THR | A | 73 | −34.251 | −18.621 | 70.868 | 1.00 | 36.60 | C |
| ATOM | 576 | OG1 | THR | A | 73 | −34.346 | −17.803 | 69.699 | 1.00 | 47.78 | O |
| ATOM | 577 | CG2 | THR | A | 73 | −35.625 | −18.860 | 71.428 | 1.00 | 33.19 | C |
| ATOM | 578 | N   | SER | A | 74 | −31.349 | −16.886 | 70.949 | 1.00 | 40.76 | N |
| ATOM | 579 | CA  | SER | A | 74 | −29.949 | −16.891 | 70.549 | 1.00 | 43.57 | C |
| ATOM | 580 | C   | SER | A | 74 | −29.032 | −16.974 | 71.758 | 1.00 | 50.46 | C |
| ATOM | 581 | O   | SER | A | 74 | −28.083 | −17.779 | 71.784 | 1.00 | 52.51 | O |
| ATOM | 582 | CB  | SER | A | 74 | −29.654 | −15.639 | 69.744 | 1.00 | 48.36 | C |
| ATOM | 583 | OG  | SER | A | 74 | −30.524 | −15.613 | 68.635 | 1.00 | 60.90 | O |
| ATOM | 584 | O   | LYS | A | 75 | −28.334 | −16.929 | 76.160 | 1.00 | 39.85 | O |
| ATOM | 585 | N   | LYS | A | 75 | −29.291 | −16.123 | 72.754 | 1.00 | 40.62 | N |
| ATOM | 586 | CA  | LYS | A | 75 | −28.494 | −15.995 | 73.967 | 1.00 | 44.56 | C |
| ATOM | 587 | C   | LYS | A | 75 | −28.929 | −16.951 | 75.076 | 1.00 | 39.19 | C |
| ATOM | 588 | CB  | LYS | A | 75 | −28.574 | −14.552 | 74.490 | 1.00 | 42.65 | C |
| ATOM | 589 | CG  | LYS | A | 75 | −28.087 | −13.508 | 73.502 | 1.00 | 48.05 | C |
| ATOM | 590 | CD  | LYS | A | 75 | −28.250 | −12.099 | 74.045 | 1.00 | 49.13 | C |
| ATOM | 591 | CE  | LYS | A | 75 | −28.043 | −11.079 | 72.924 | 1.00 | 55.25 | C |
| ATOM | 592 | NZ  | LYS | A | 75 | −27.500 | −9.765  | 73.364 | 1.00 | 55.09 | N |
| ATOM | 593 | N   | ASN | A | 76 | −29.936 | −17.793 | 74.823 | 1.00 | 43.17 | N |
| ATOM | 594 | CA  | ASN | A | 76 | −30.578 | −18.625 | 75.845 | 1.00 | 36.87 | C |
| ATOM | 595 | C   | ASN | A | 76 | −30.949 | −17.780 | 77.073 | 1.00 | 35.94 | C |
| ATOM | 596 | O   | ASN | A | 76 | −30.668 | −18.130 | 78.221 | 1.00 | 33.33 | O |
| ATOM | 597 | CB  | ASN | A | 76 | −29.696 | −19.823 | 76.213 | 1.00 | 32.65 | C |
| ATOM | 598 | CG  | ASN | A | 76 | −29.729 | −20.940 | 75.144 | 1.00 | 41.58 | C |
| ATOM | 599 | OD1 | ASN | A | 76 | −30.207 | −20.738 | 74.016 | 1.00 | 42.66 | O |
| ATOM | 600 | ND2 | ASN | A | 76 | −29.215 | −22.117 | 75.500 | 1.00 | 36.55 | N |
| ATOM | 601 | N   | GLN | A | 77 | −31.635 | −16.668 | 76.813 | 1.00 | 29.24 | N |
| ATOM | 602 | CA  | GLN | A | 77 | −32.064 | −15.729 | 77.828 | 1.00 | 28.20 | C |
| ATOM | 603 | C   | GLN | A | 77 | −33.578 | −15.515 | 77.767 | 1.00 | 32.38 | C |
| ATOM | 604 | O   | GLN | A | 77 | −34.233 | −15.760 | 76.747 | 1.00 | 32.97 | O |
| ATOM | 605 | CB  | GLN | A | 77 | −31.365 | −14.391 | 77.668 | 1.00 | 31.15 | C |
| ATOM | 606 | CG  | GLN | A | 77 | −29.894 | −14.376 | 78.032 | 1.00 | 35.97 | C |
| ATOM | 607 | CD  | GLN | A | 77 | −29.313 | −12.956 | 77.951 | 1.00 | 39.65 | C |
| ATOM | 608 | OE1 | GLN | A | 77 | −29.979 | −12.017 | 77.502 | 1.00 | 40.22 | O |
| ATOM | 609 | NE2 | GLN | A | 77 | −28.096 | −12.792 | 78.433 | 1.00 | 41.23 | N |
| ATOM | 610 | N   | PHE | A | 78 | −34.148 | −15.096 | 78.891 | 1.00 | 24.83 | N |
| ATOM | 611 | CA  | PHE | A | 78 | −35.544 | −14.682 | 78.904 | 1.00 | 30.44 | C |
| ATOM | 612 | C   | PHE | A | 78 | −35.711 | −13.657 | 80.014 | 1.00 | 28.14 | C |
| ATOM | 613 | O   | PHE | A | 78 | −34.863 | −13.544 | 80.899 | 1.00 | 29.63 | O |
| ATOM | 614 | CB  | PHE | A | 78 | −36.519 | −15.877 | 79.038 | 1.00 | 27.85 | C |
| ATOM | 615 | CG  | PHE | A | 78 | −36.399 | −16.648 | 80.334 | 1.00 | 29.82 | C |
| ATOM | 616 | CD1 | PHE | A | 78 | −35.434 | −17.641 | 80.482 | 1.00 | 28.03 | C |
| ATOM | 617 | CD2 | PHE | A | 78 | −37.290 | −16.414 | 81.385 | 1.00 | 27.75 | C |
| ATOM | 618 | CE1 | PHE | A | 78 | −35.334 | −18.366 | 81.658 | 1.00 | 28.84 | C |
| ATOM | 619 | CE2 | PHE | A | 78 | −37.201 | −17.127 | 82.571 | 1.00 | 29.25 | C |
| ATOM | 620 | CZ  | PHE | A | 78 | −36.224 | −18.108 | 82.713 | 1.00 | 31.58 | C |

TABLE 10.4-continued

| | | | | | | | | | | |
|---|---|---|---|---|---|---|---|---|---|---|
| ATOM | 621 | N | SER | A | 79 | −36.779 | −12.866 | 79.933 | 1.00 | 27.98 | N |
| ATOM | 622 | CA | SER | A | 79 | −36.845 | −11.640 | 80.717 | 1.00 | 29.89 | C |
| ATOM | 623 | C | SER | A | 79 | −38.230 | −11.432 | 81.299 | 1.00 | 27.88 | C |
| ATOM | 624 | O | SER | A | 79 | −39.225 | −11.992 | 80.827 | 1.00 | 27.43 | O |
| ATOM | 625 | CB | SER | A | 79 | −36.437 | −10.410 | 79.881 | 1.00 | 27.31 | C |
| ATOM | 626 | OG | SER | A | 79 | −35.076 | −10.523 | 79.495 | 1.00 | 33.81 | O |
| ATOM | 627 | N | LEU | A | 80 | −38.270 | −10.585 | 82.327 | 1.00 | 24.79 | N |
| ATOM | 628 | CA | LEU | A | 80 | −39.503 | −10.224 | 82.998 | 1.00 | 25.66 | C |
| ATOM | 629 | C | LEU | A | 80 | −39.605 | −8.711 | 83.069 | 1.00 | 30.62 | C |
| ATOM | 630 | O | LEU | A | 80 | −38.669 | −8.045 | 83.525 | 1.00 | 32.93 | O |
| ATOM | 631 | CB | LEU | A | 80 | −39.563 | −10.806 | 84.409 | 1.00 | 30.64 | C |
| ATOM | 632 | CG | LEU | A | 80 | −40.803 | −10.348 | 85.179 | 1.00 | 29.58 | C |
| ATOM | 633 | CD2 | LEU | A | 80 | −40.702 | −10.668 | 86.648 | 1.00 | 29.00 | C |
| ATOM | 634 | CD1 | LEU | A | 80 | −42.002 | −11.007 | 84.558 | 1.00 | 27.41 | C |
| ATOM | 635 | N | LYS | A | 81 | −40.750 | −8.174 | 82.655 | 1.00 | 30.10 | N |
| ATOM | 636 | CA | LYS | A | 81 | −41.086 | −6.769 | 82.845 | 1.00 | 30.96 | C |
| ATOM | 637 | C | LYS | A | 81 | −42.340 | −6.677 | 83.705 | 1.00 | 30.22 | C |
| ATOM | 638 | O | LYS | A | 81 | −43.320 | −7.382 | 83.453 | 1.00 | 32.80 | O |
| ATOM | 639 | CB | LYS | A | 81 | −41.299 | −6.065 | 81.499 | 1.00 | 30.39 | C |
| ATOM | 640 | CG | LYS | A | 81 | −40.033 | −5.832 | 80.708 | 1.00 | 30.35 | C |
| ATOM | 641 | CD | LYS | A | 81 | −39.381 | −4.518 | 81.077 | 1.00 | 41.11 | C |
| ATOM | 642 | CE | LYS | A | 81 | −38.053 | −4.352 | 80.368 | 1.00 | 43.35 | C |
| ATOM | 643 | NZ | LYS | A | 81 | −38.187 | −4.617 | 78.920 | 1.00 | 51.59 | N |
| ATOM | 644 | N | LEU | A | 82 | −42.298 | −5.837 | 84.739 | 1.00 | 30.39 | N |
| ATOM | 645 | CA | LEU | A | 82 | −43.450 | −5.573 | 85.601 | 1.00 | 29.80 | C |
| ATOM | 646 | C | LEU | A | 82 | −43.573 | −4.071 | 85.755 | 1.00 | 32.85 | C |
| ATOM | 647 | O | LEU | A | 82 | −42.697 | −3.440 | 86.352 | 1.00 | 31.95 | O |
| ATOM | 648 | CB | LEU | A | 82 | −43.304 | −6.239 | 86.968 | 1.00 | 32.00 | C |
| ATOM | 649 | CG | LEU | A | 82 | −44.442 | −6.002 | 87.959 | 1.00 | 32.12 | C |
| ATOM | 650 | CD1 | LEU | A | 82 | −45.711 | −6.714 | 87.526 | 1.00 | 26.83 | C |
| ATOM | 651 | CD2 | LEU | A | 82 | −44.016 | −6.435 | 89.349 | 1.00 | 28.77 | C |
| ATOM | 652 | N | ARG | A | 83 | −44.645 | −3.505 | 85.209 | 1.00 | 35.72 | N |
| ATOM | 653 | CA | ARG | A | 83 | −44.790 | −2.062 | 85.113 | 1.00 | 33.38 | C |
| ATOM | 654 | C | ARG | A | 83 | −45.506 | −1.514 | 86.344 | 1.00 | 34.77 | C |
| ATOM | 655 | O | ARG | A | 83 | −46.221 | −2.234 | 87.051 | 1.00 | 37.08 | O |
| ATOM | 656 | CB | ARG | A | 83 | −45.556 | −1.686 | 83.838 | 1.00 | 30.94 | C |
| ATOM | 657 | CG | ARG | A | 83 | −44.709 | −1.827 | 82.572 | 1.00 | 31.53 | C |
| ATOM | 658 | CD | ARG | A | 83 | −45.526 | −1.799 | 81.301 | 1.00 | 34.78 | C |
| ATOM | 659 | NE | ARG | A | 83 | −46.273 | −3.036 | 81.049 | 1.00 | 36.35 | N |
| ATOM | 660 | CZ | ARG | A | 83 | −45.806 | −4.149 | 80.484 | 1.00 | 32.43 | C |
| ATOM | 661 | NH1 | ARG | A | 83 | −46.625 | −5.178 | 80.327 | 1.00 | 35.09 | N |
| ATOM | 662 | NH2 | ARG | A | 83 | −44.550 | −4.257 | 80.084 | 1.00 | 29.31 | N |
| ATOM | 663 | N | SER | A | 84 | −45.335 | −0.214 | 86.571 | 1.00 | 37.19 | N |
| ATOM | 664 | CA | SER | A | 84 | −46.105 | 0.534 | 87.573 | 1.00 | 35.36 | C |
| ATOM | 665 | C | SER | A | 84 | −46.068 | −0.152 | 88.936 | 1.00 | 39.37 | C |
| ATOM | 666 | O | SER | A | 84 | −47.092 | −0.470 | 89.546 | 1.00 | 39.10 | O |
| ATOM | 667 | CB | SER | A | 84 | −47.548 | 0.713 | 87.111 | 1.00 | 33.54 | C |
| ATOM | 668 | OG | SER | A | 84 | −47.598 | 1.374 | 85.864 | 1.00 | 48.40 | O |
| ATOM | 669 | N | VAL | A | 85 | −44.868 | −0.296 | 89.432 | 1.00 | 35.87 | N |
| ATOM | 670 | CA | VAL | A | 85 | −44.588 | −1.159 | 90.568 | 1.00 | 36.45 | C |
| ATOM | 671 | C | VAL | A | 85 | −44.889 | −0.417 | 91.872 | 1.00 | 34.18 | C |
| ATOM | 672 | O | VAL | A | 85 | −44.767 | 0.807 | 91.943 | 1.00 | 36.97 | O |
| ATOM | 673 | CB | VAL | A | 85 | −43.117 | −1.606 | 90.424 | 1.00 | 35.38 | C |
| ATOM | 674 | CG1 | VAL | A | 85 | −42.214 | −0.855 | 91.349 | 1.00 | 36.25 | C |
| ATOM | 675 | CG2 | VAL | A | 85 | −42.981 | −3.082 | 90.543 | 1.00 | 34.41 | C |
| ATOM | 676 | N | THR | A | 86 | −45.346 | −1.130 | 92.907 | 1.00 | 36.49 | N |
| ATOM | 677 | CA | THR | A | 86 | −45.612 | −0.502 | 94.212 | 1.00 | 32.44 | C |
| ATOM | 678 | C | THR | A | 86 | −44.908 | −1.279 | 95.326 | 1.00 | 33.48 | C |
| ATOM | 679 | O | THR | A | 86 | −44.209 | −2.271 | 95.087 | 1.00 | 34.30 | O |
| ATOM | 680 | CB | THR | A | 86 | −47.107 | −0.413 | 94.556 | 1.00 | 32.14 | C |
| ATOM | 681 | OG1 | THR | A | 86 | −47.526 | −1.616 | 95.204 | 1.00 | 36.59 | O |
| ATOM | 682 | CG2 | THR | A | 86 | −47.956 | −0.200 | 93.321 | 1.00 | 27.41 | C |
| ATOM | 683 | N | ALA | A | 87 | −45.082 | −0.810 | 96.565 | 1.00 | 35.31 | N |
| ATOM | 684 | CA | ALA | A | 87 | −44.442 | −1.484 | 97.698 | 1.00 | 33.73 | C |
| ATOM | 685 | C | ALA | A | 87 | −44.927 | −2.921 | 97.822 | 1.00 | 31.88 | C |
| ATOM | 686 | O | ALA | A | 87 | −44.184 | −3.798 | 98.273 | 1.00 | 31.04 | O |
| ATOM | 687 | CB | ALA | A | 87 | −44.701 | −0.719 | 98.996 | 1.00 | 25.59 | C |
| ATOM | 688 | N | ALA | A | 88 | −46.161 | −3.186 | 97.408 | 1.00 | 30.13 | N |
| ATOM | 689 | CA | ALA | A | 88 | −46.689 | −4.537 | 97.438 | 1.00 | 27.33 | C |
| ATOM | 690 | C | ALA | A | 88 | −45.962 | −5.482 | 96.487 | 1.00 | 29.67 | C |
| ATOM | 691 | O | ALA | A | 88 | −46.226 | −6.681 | 96.532 | 1.00 | 32.42 | O |
| ATOM | 692 | CB | ALA | A | 88 | −48.185 | −4.510 | 97.113 | 1.00 | 20.61 | C |
| ATOM | 693 | N | ASP | A | 89 | −45.073 | −4.987 | 95.628 | 1.00 | 29.86 | N |
| ATOM | 694 | CA | ASP | A | 89 | −44.275 | −5.840 | 94.756 | 1.00 | 27.31 | C |
| ATOM | 695 | C | ASP | A | 89 | −42.892 | −6.166 | 95.332 | 1.00 | 29.16 | C |
| ATOM | 696 | O | ASP | A | 89 | −42.057 | −6.737 | 94.618 | 1.00 | 28.53 | O |
| ATOM | 697 | CB | ASP | A | 89 | −44.141 | −5.200 | 93.359 | 1.00 | 31.57 | C |
| ATOM | 698 | CG | ASP | A | 89 | −45.504 | −4.988 | 92.660 | 1.00 | 35.37 | C |
| ATOM | 699 | OD1 | ASP | A | 89 | −46.204 | −5.990 | 92.421 | 1.00 | 36.17 | O |
| ATOM | 700 | OD2 | ASP | A | 89 | −45.880 | −3.830 | 92.332 | 1.00 | 34.69 | O1− |

TABLE 10.4-continued

| | | | | | | | | | | |
|---|---|---|---|---|---|---|---|---|---|---|
| ATOM | 701 | N | THR | A | 90 | −42.616 | −5.798 | 93.590 | 1.00 | 31.96 | N |
| ATOM | 702 | CA | THR | A | 90 | −41.400 | −6.246 | 97.270 | 1.00 | 27.24 | C |
| ATOM | 703 | C | THR | A | 90 | −41.440 | −7.754 | 97.476 | 1.00 | 25.30 | C |
| ATOM | 704 | O | THR | A | 90 | −42.379 | −8.277 | 98.074 | 1.00 | 30.54 | O |
| ATOM | 705 | CB | THR | A | 90 | −41.237 | −5.541 | 98.604 | 1.00 | 25.80 | C |
| ATOM | 706 | OG1 | THR | A | 90 | −40.966 | −4.159 | 98.369 | 1.00 | 34.42 | O |
| ATOM | 707 | CG2 | THR | A | 90 | −40.111 | −6.162 | 99.391 | 1.00 | 23.83 | C |
| ATOM | 708 | N | ALA | A | 91 | −40.460 | −8.455 | 96.928 | 1.00 | 26.62 | N |
| ATOM | 709 | CA | ALA | A | 91 | −40.455 | −9.906 | 96.947 | 1.00 | 26.31 | C |
| ATOM | 710 | C | ALA | A | 91 | −39.136 | −10.402 | 96.385 | 1.00 | 31.03 | C |
| ATOM | 711 | O | ALA | A | 91 | −38.386 | −9.658 | 95.738 | 1.00 | 27.14 | O |
| ATOM | 712 | CB | ALA | A | 91 | −41.605 | −10.497 | 96.134 | 1.00 | 25.43 | C |
| ATOM | 713 | N | VAL | A | 92 | −38.876 | −11.680 | 96.632 | 1.00 | 31.34 | N |
| ATOM | 714 | CA | VAL | A | 92 | −37.860 | −12.385 | 95.875 | 1.00 | 31.22 | C |
| ATOM | 715 | C | VAL | A | 92 | −38.510 | −12.880 | 94.591 | 1.00 | 32.03 | C |
| ATOM | 716 | O | VAL | A | 92 | −39.615 | −13.429 | 94.616 | 1.00 | 32.99 | O |
| ATOM | 717 | CB | VAL | A | 92 | −37.243 | −13.525 | 96.695 | 1.00 | 25.83 | C |
| ATOM | 718 | CG1 | VAL | A | 92 | −36.306 | −14.333 | 95.817 | 1.00 | 27.86 | C |
| ATOM | 719 | CG2 | VAL | A | 92 | −36.479 | −12.962 | 97.892 | 1.00 | 20.30 | C |
| ATOM | 720 | N | TYR | A | 93 | −37.871 | −12.596 | 93.460 | 1.00 | 31.17 | N |
| ATOM | 721 | CA | TYR | A | 93 | −38.321 | −13.013 | 92.141 | 1.00 | 25.61 | C |
| ATOM | 722 | C | TYR | A | 93 | −37.385 | −14.112 | 91.680 | 1.00 | 27.44 | C |
| ATOM | 723 | O | TYR | A | 93 | −36.167 | −13.932 | 91.702 | 1.00 | 29.84 | O |
| ATOM | 724 | CB | TYR | A | 93 | −38.327 | −11.832 | 91.166 | 1.00 | 24.64 | C |
| ATOM | 725 | CG | TYR | A | 93 | −39.424 | −10.852 | 91.484 | 1.00 | 26.39 | C |
| ATOM | 726 | CD1 | TYR | A | 93 | −39.346 | −10.047 | 92.606 | 1.00 | 24.17 | C |
| ATOM | 727 | CD2 | TYR | A | 93 | −40.556 | −10.756 | 90.675 | 1.00 | 29.39 | C |
| ATOM | 728 | CE1 | TYR | A | 93 | −40.360 | −9.180 | 92.927 | 1.00 | 30.45 | C |
| ATOM | 729 | CE2 | TYR | A | 93 | −41.573 | −9.886 | 90.974 | 1.00 | 28.95 | C |
| ATOM | 730 | CZ | TYR | A | 93 | −41.470 | −9.096 | 92.108 | 1.00 | 30.87 | C |
| ATOM | 731 | OH | TYR | A | 93 | −42.478 | −8.228 | 92.442 | 1.00 | 29.44 | O |
| ATOM | 732 | N | TYR | A | 94 | −37.946 | −15.271 | 91.356 | 1.00 | 27.38 | N |
| ATOM | 733 | CA | TYR | A | 94 | −37.195 | −16.387 | 90.803 | 1.00 | 27.27 | C |
| ATOM | 734 | C | TYR | A | 94 | −37.582 | −16.602 | 89.347 | 1.00 | 27.79 | C |
| ATOM | 735 | O | TYR | A | 94 | −38.728 | −16.360 | 88.943 | 1.00 | 25.82 | O |
| ATOM | 736 | CB | TYR | A | 94 | −37.453 | −17.695 | 91.544 | 1.00 | 24.75 | C |
| ATOM | 737 | CG | TYR | A | 94 | −37.170 | −17.737 | 92.995 | 1.00 | 23.43 | C |
| ATOM | 738 | CD1 | TYR | A | 94 | −35.885 | −17.935 | 93.462 | 1.00 | 28.16 | C |
| ATOM | 739 | CD2 | TYR | A | 94 | −38.199 | −17.643 | 93.910 | 1.00 | 25.00 | C |
| ATOM | 740 | CE1 | TYR | A | 94 | −35.621 | −18.000 | 94.820 | 1.00 | 32.06 | C |
| ATOM | 741 | CE2 | TYR | A | 94 | −37.955 | −17.702 | 95.271 | 1.00 | 29.99 | C |
| ATOM | 742 | CZ | TYR | A | 94 | −36.666 | −17.881 | 95.720 | 1.00 | 33.84 | C |
| ATOM | 743 | OH | TYR | A | 94 | −36.428 | −17.954 | 97.069 | 1.00 | 39.80 | O |
| ATOM | 744 | N | CYS | A | 95 | −36.618 | −17.046 | 88.560 | 1.00 | 23.05 | N |
| ATOM | 745 | CA | CYS | A | 95 | −36.940 | −17.717 | 87.319 | 1.00 | 26.62 | C |
| ATOM | 746 | C | CYS | A | 95 | −36.809 | −19.212 | 87.547 | 1.00 | 27.72 | C |
| ATOM | 747 | O | CYS | A | 95 | −36.050 | −19.661 | 88.416 | 1.00 | 27.65 | O |
| ATOM | 748 | CB | CYS | A | 95 | −36.029 | −17.289 | 86.177 | 1.00 | 33.36 | C |
| ATOM | 749 | SG | CYS | A | 95 | −34.315 | −17.693 | 86.436 | 1.00 | 42.59 | S |
| ATOM | 750 | N | ALA | A | 96 | −37.549 | −19.988 | 86.766 | 1.00 | 25.63 | N |
| ATOM | 751 | CA | ALA | A | 96 | −37.488 | −21.432 | 86.941 | 1.00 | 24.92 | C |
| ATOM | 752 | C | ALA | A | 96 | −37.693 | −22.118 | 85.603 | 1.00 | 23.67 | C |
| ATOM | 753 | O | ALA | A | 96 | −38.234 | −21.545 | 84.650 | 1.00 | 22.72 | O |
| ATOM | 754 | CB | ALA | A | 96 | −38.514 | −21.933 | 87.971 | 1.00 | 20.77 | C |
| ATOM | 755 | N | ARG | A | 97 | −37.232 | −23.359 | 85.549 | 1.00 | 29.65 | N |
| ATOM | 756 | CA | ARG | A | 97 | −37.442 | −24.222 | 84.397 | 1.00 | 27.16 | C |
| ATOM | 757 | C | ARG | A | 97 | −38.707 | −25.049 | 84.601 | 1.00 | 25.26 | C |
| ATOM | 758 | O | ARG | A | 97 | −38.796 | −25.837 | 85.543 | 1.00 | 36.21 | O |
| ATOM | 759 | CB | ARG | A | 97 | −39.241 | −25.141 | 84.199 | 1.00 | 28.02 | C |
| ATOM | 760 | CG | ARG | A | 97 | −36.333 | −25.943 | 82.927 | 1.00 | 30.37 | C |
| ATOM | 761 | CD | ARG | A | 97 | −35.057 | −26.647 | 82.678 | 1.00 | 30.79 | C |
| ATOM | 762 | NE | ARG | A | 97 | −35.199 | −28.067 | 82.916 | 1.00 | 37.06 | N |
| ATOM | 763 | CZ | ARG | A | 97 | −34.181 | −28.869 | 83.182 | 1.00 | 41.04 | C |
| ATOM | 764 | NH1 | ARG | A | 97 | −32.962 | −28.358 | 83.257 | 1.00 | 44.36 | N |
| ATOM | 765 | NH2 | ARG | A | 97 | −34.378 | −30.172 | 83.387 | 1.00 | 43.81 | N |
| ATOM | 766 | N | ASP | A | 98 | −39.663 | −24.894 | 83.701 | 1.00 | 28.03 | N |
| ATOM | 767 | CA | ASP | A | 98 | −40.928 | −25.608 | 83.765 | 1.00 | 28.42 | C |
| ATOM | 768 | C | ASP | A | 98 | −40.781 | −26.830 | 82.871 | 1.00 | 29.02 | C |
| ATOM | 769 | O | ASP | A | 98 | −40.568 | −26.690 | 81.661 | 1.00 | 30.24 | O |
| ATOM | 770 | CB | ASP | A | 98 | −42.074 | −24.693 | 83.315 | 1.00 | 28.02 | C |
| ATOM | 771 | CG | ASP | A | 98 | −43.460 | −25.253 | 83.615 | 1.00 | 32.08 | C |
| ATOM | 772 | OD2 | ASP | A | 98 | −44.210 | −24.615 | 84.387 | 1.00 | 34.95 | O |
| ATOM | 773 | OD1 | ASP | A | 98 | −43.837 | −26.292 | 83.050 | 1.00 | 33.28 | O |
| ATOM | 774 | N | TYR | A | 99 | −40.940 | −28.023 | 83.458 | 1.00 | 30.78 | N |
| ATOM | 775 | CA | TYR | A | 99 | −40.738 | −29.329 | 82.815 | 1.00 | 30.04 | C |
| ATOM | 776 | C | TYR | A | 99 | −41.625 | −30.324 | 83.561 | 1.00 | 33.93 | C |
| ATOM | 777 | O | TYR | A | 99 | −41.159 | −31.204 | 84.293 | 1.00 | 38.31 | O |
| ATOM | 778 | CB | TYR | A | 99 | −39.272 | −29.767 | 82.827 | 1.00 | 29.21 | C |
| ATOM | 779 | CG | TYR | A | 99 | −38.929 | −30.840 | 81.794 | 1.00 | 34.85 | C |
| ATOM | 780 | CD1 | TYR | A | 99 | −39.322 | −30.698 | 80.458 | 1.00 | 35.04 | C |

TABLE 10.4-continued

| | | | | | | | | | | |
|---|---|---|---|---|---|---|---|---|---|---|
| ATOM | 781 | CD2 | TYR | A | 99 | −38.133 | −31.940 | 82.127 | 1.00 | 32.30 | C |
| ATOM | 782 | CE1 | TYR | A | 99 | −38.982 | −31.651 | 79.496 | 1.00 | 36.24 | C |
| ATOM | 783 | CE2 | TYR | A | 99 | −37.783 | −32.896 | 81.172 | 1.00 | 28.54 | C |
| ATOM | 784 | CZ | TYR | A | 99 | −38.209 | −32.749 | 79.865 | 1.00 | 35.98 | C |
| ATOM | 785 | OH | TYR | A | 99 | −37.874 | −33.692 | 78.917 | 1.00 | 34.12 | O |
| ATOM | 786 | N | GLY | A | 100 | −42.933 | −30.172 | 83.358 | 1.00 | 28.51 | N |
| ATOM | 787 | CA | GLY | A | 100 | −43.910 | −30.735 | 84.262 | 1.00 | 24.10 | C |
| ATOM | 788 | C | GLY | A | 100 | −44.030 | −29.821 | 85.465 | 1.00 | 27.81 | C |
| ATOM | 789 | O | GLY | A | 100 | −44.871 | −28.922 | 85.491 | 1.00 | 27.49 | O |
| ATOM | 790 | N | ALA | A | 101 | −43.179 | −30.038 | 86.462 | 1.00 | 27.49 | N |
| ATOM | 791 | CA | ALA | A | 101 | −43.007 | −29.155 | 87.602 | 1.00 | 27.47 | C |
| ATOM | 792 | C | ALA | A | 101 | −41.783 | −28.256 | 87.421 | 1.00 | 30.09 | C |
| ATOM | 793 | O | ALA | A | 101 | −41.094 | −28.287 | 86.395 | 1.00 | 27.64 | O |
| ATOM | 794 | CB | ALA | A | 101 | −42.895 | −29.967 | 88.884 | 1.00 | 25.99 | C |
| ATOM | 795 | N | PHE | A | 102 | −41.526 | −27.427 | 88.434 | 1.00 | 23.58 | N |
| ATOM | 796 | CA | PHE | A | 102 | −40.378 | −26.521 | 88.429 | 1.00 | 29.82 | C |
| ATOM | 797 | C | PHE | A | 102 | −39.181 | −27.242 | 89.042 | 1.00 | 28.21 | C |
| ATOM | 798 | O | PHE | A | 102 | −39.007 | −27.255 | 90.268 | 1.00 | 26.65 | O |
| ATOM | 799 | CB | PHE | A | 102 | −40.704 | −25.241 | 89.185 | 1.00 | 24.30 | C |
| ATOM | 800 | CG | PHE | A | 102 | −41.831 | −24.469 | 88.585 | 1.00 | 29.71 | C |
| ATOM | 801 | CD1 | PHE | A | 102 | −41.705 | −23.921 | 87.306 | 1.00 | 27.01 | C |
| ATOM | 802 | CD2 | PHE | A | 102 | −43.012 | −24.265 | 89.297 | 1.00 | 28.29 | C |
| ATOM | 803 | CE1 | PHE | A | 102 | −42.719 | −23.201 | 86.752 | 1.00 | 23.76 | C |
| ATOM | 804 | CE2 | PHE | A | 102 | −44.047 | −23.538 | 88.738 | 1.00 | 27.29 | C |
| ATOM | 805 | CZ | PHE | A | 102 | −43.897 | −23.010 | 87.461 | 1.00 | 27.69 | C |
| ATOM | 806 | N | ASP | A | 103 | −38.333 | −27.818 | 88.179 | 1.00 | 24.44 | N |
| ATOM | 807 | CA | ASP | A | 103 | −37.235 | −28.648 | 88.657 | 1.00 | 28.27 | C |
| ATOM | 808 | C | ASP | A | 103 | −35.943 | −27.887 | 88.873 | 1.00 | 27.03 | C |
| ATOM | 809 | O | ASP | A | 103 | −35.131 | −28.306 | 89.693 | 1.00 | 37.49 | O |
| ATOM | 810 | CB | ASP | A | 103 | −36.989 | −29.838 | 87.721 | 1.00 | 31.73 | C |
| ATOM | 811 | CG | ASP | A | 103 | −36.673 | −29.436 | 86.302 | 1.00 | 39.51 | C |
| ATOM | 812 | OD1 | ASP | A | 103 | −36.346 | −28.251 | 86.038 | 1.00 | 36.08 | O |
| ATOM | 813 | OD2 | ASP | A | 103 | −36.735 | −30.340 | 85.438 | 1.00 | 44.53 | O1− |
| ATOM | 814 | N | ILE | A | 104 | −35.734 | −26.768 | 88.205 | 1.00 | 32.07 | N |
| ATOM | 815 | CA | ILE | A | 104 | −34.562 | −25.951 | 88.461 | 1.00 | 32.48 | C |
| ATOM | 816 | C | ILE | A | 104 | −35.014 | −24.530 | 88.674 | 1.00 | 30.55 | C |
| ATOM | 817 | O | ILE | A | 104 | −35.832 | −24.011 | 87.910 | 1.00 | 32.04 | O |
| ATOM | 818 | CB | ILE | A | 104 | −33.537 | −25.999 | 87.318 | 1.00 | 33.95 | C |
| ATOM | 819 | CG1 | ILE | A | 104 | −33.052 | −27.421 | 87.124 | 1.00 | 31.05 | C |
| ATOM | 820 | CG2 | ILE | A | 104 | −32.357 | −25.103 | 87.642 | 1.00 | 29.90 | C |
| ATOM | 821 | CD1 | ILE | A | 104 | −32.035 | −27.491 | 86.097 | 1.00 | 37.82 | C |
| ATOM | 822 | N | TRP | A | 105 | −34.437 | −23.891 | 89.678 | 1.00 | 30.90 | N |
| ATOM | 823 | CA | TRP | A | 105 | −34.761 | −22.534 | 90.062 | 1.00 | 29.84 | C |
| ATOM | 824 | C | TRP | A | 105 | −33.493 | −21.703 | 90.002 | 1.00 | 35.42 | C |
| ATOM | 825 | O | TRP | A | 105 | −32.384 | −22.226 | 90.145 | 1.00 | 32.10 | O |
| ATOM | 826 | CB | TRP | A | 105 | −35.340 | −22.469 | 91.479 | 1.00 | 30.72 | C |
| ATOM | 827 | CG | TRP | A | 105 | −36.660 | −23.174 | 91.650 | 1.00 | 28.36 | C |
| ATOM | 828 | CD1 | TRP | A | 105 | −36.900 | −24.508 | 91.535 | 1.00 | 26.86 | C |
| ATOM | 829 | CD2 | TRP | A | 105 | −37.906 | −22.570 | 92.029 | 1.00 | 27.83 | C |
| ATOM | 830 | NE1 | TRP | A | 105 | −38.221 | −24.775 | 91.787 | 1.00 | 26.76 | N |
| ATOM | 831 | CE2 | TRP | A | 105 | −38.862 | −23.601 | 92.093 | 1.00 | 27.46 | C |
| ATOM | 832 | CE3 | TRP | A | 105 | −38.306 | −21.246 | 92.305 | 1.00 | 24.64 | C |
| ATOM | 833 | CZ2 | TRP | A | 105 | −40.203 | −23.359 | 92.425 | 1.00 | 26.14 | C |
| ATOM | 834 | CZ3 | TRP | A | 105 | −39.632 | −21.002 | 92.628 | 1.00 | 26.09 | C |
| ATOM | 835 | CH2 | TRP | A | 105 | −40.569 | −22.052 | 92.682 | 1.00 | 27.22 | C |
| ATOM | 836 | N | GLY | A | 106 | −33.675 | −20.409 | 89.739 | 1.00 | 36.95 | N |
| ATOM | 837 | CA | GLY | A | 106 | −32.621 | −19.444 | 89.932 | 1.00 | 30.80 | C |
| ATOM | 838 | C | GLY | A | 106 | −32.355 | −19.129 | 91.400 | 1.00 | 35.16 | C |
| ATOM | 839 | O | GLY | A | 106 | −33.108 | −19.455 | 92.312 | 1.00 | 36.82 | O |
| ATOM | 840 | N | GLN | A | 107 | −31.218 | −18.464 | 91.603 | 1.00 | 47.39 | N |
| ATOM | 841 | CA | GLN | A | 107 | −30.810 | −17.934 | 92.899 | 1.00 | 36.74 | C |
| ATOM | 842 | C | GLN | A | 107 | −31.901 | −17.089 | 93.533 | 1.00 | 39.96 | C |
| ATOM | 843 | O | GLN | A | 107 | −32.042 | −17.063 | 94.766 | 1.00 | 42.16 | O |
| ATOM | 844 | CB | GLN | A | 107 | −29.557 | −17.093 | 92.676 | 1.00 | 42.92 | C |
| ATOM | 845 | CG | GLN | A | 107 | −29.167 | −17.061 | 91.154 | 1.00 | 49.03 | C |
| ATOM | 846 | CD | GLN | A | 107 | −28.508 | −15.762 | 90.696 | 1.00 | 54.29 | C |
| ATOM | 847 | OE1 | GLN | A | 107 | −28.954 | −14.661 | 91.047 | 1.00 | 58.14 | O |
| ATOM | 848 | NE2 | GLN | A | 107 | −27.442 | −15.886 | 89.898 | 1.00 | 50.79 | N |
| ATOM | 849 | N | GLY | A | 108 | −32.681 | −16.410 | 92.707 | 1.00 | 31.86 | N |
| ATOM | 850 | CA | GLY | A | 108 | −33.598 | −15.378 | 93.128 | 1.00 | 27.03 | C |
| ATOM | 851 | C | GLY | A | 108 | −32.949 | −14.010 | 93.074 | 1.00 | 30.24 | C |
| ATOM | 852 | O | GLY | A | 108 | −31.729 | −13.864 | 93.142 | 1.00 | 37.43 | O |
| ATOM | 853 | N | THR | A | 109 | −33.797 | −12.994 | 92.950 | 1.00 | 25.96 | N |
| ATOM | 854 | CA | THR | A | 109 | −33.387 | −11.598 | 92.963 | 1.00 | 27.32 | C |
| ATOM | 855 | C | THR | A | 109 | −34.249 | −10.910 | 94.000 | 1.00 | 31.41 | C |
| ATOM | 856 | O | THR | A | 109 | −35.475 | −10.935 | 93.890 | 1.00 | 32.07 | O |
| ATOM | 857 | CB | THR | A | 109 | −33.582 | −10.910 | 91.604 | 1.00 | 34.49 | C |
| ATOM | 858 | OG1 | THR | A | 109 | −32.815 | −11.575 | 90.587 | 1.00 | 40.25 | O |
| ATOM | 859 | CG2 | THR | A | 109 | −33.151 | −9.449 | 91.696 | 1.00 | 26.29 | C |
| ATOM | 860 | N | MET | A | 110 | −33.618 | −10.317 | 95.010 | 1.00 | 34.98 | N |

TABLE 10.4-continued

| | | | | | | | | | | |
|---|---|---|---|---|---|---|---|---|---|---|
| ATOM | 861 | CA | MET | A | 110 | −34.341 | −9.610 | 96.058 | 1.00 | 32.57 | C |
| ATOM | 862 | C | MET | A | 110 | −34.744 | −8.234 | 95.546 | 1.00 | 36.42 | C |
| ATOM | 863 | O | MET | A | 110 | −33.881 | −7.407 | 95.236 | 1.00 | 38.21 | O |
| ATOM | 864 | CB | MET | A | 110 | −33.471 | −9.495 | 97.301 | 1.00 | 32.17 | C |
| ATOM | 865 | CG | MET | A | 110 | −34.222 | −9.231 | 98.593 | 1.00 | 40.32 | C |
| ATOM | 866 | SD | MET | A | 110 | −33.067 | −9.017 | 99.988 | 1.00 | 67.95 | S |
| ATOM | 867 | CE | MET | A | 110 | −31.758 | −10.224 | 99.627 | 1.00 | 33.01 | C |
| ATOM | 868 | N | VAL | A | 111 | −36.046 | −7.977 | 95.455 | 1.00 | 33.03 | N |
| ATOM | 869 | CA | VAL | A | 111 | −36.549 | −6.745 | 94.860 | 1.00 | 33.46 | C |
| ATOM | 870 | C | VAL | A | 111 | −37.261 | −5.962 | 95.940 | 1.00 | 32.80 | C |
| ATOM | 871 | O | VAL | A | 111 | −38.250 | −6.441 | 96.502 | 1.00 | 34.50 | O |
| ATOM | 872 | CB | VAL | A | 111 | −37.500 | −7.004 | 93.679 | 1.00 | 34.14 | C |
| ATOM | 873 | CG1 | VAL | A | 111 | −38.216 | −5.736 | 93.323 | 1.00 | 25.66 | C |
| ATOM | 874 | CG2 | VAL | A | 111 | −36.748 | −7.559 | 92.470 | 1.00 | 30.59 | C |
| ATOM | 875 | N | THR | A | 112 | −36.777 | −4.756 | 96.211 | 1.00 | 33.30 | N |
| ATOM | 876 | CA | THR | A | 112 | −37.383 | −3.856 | 97.176 | 1.00 | 31.95 | C |
| ATOM | 877 | C | THR | A | 112 | −37.950 | −2.664 | 96.425 | 1.00 | 36.12 | C |
| ATOM | 878 | O | THR | A | 112 | −37.249 | −2.038 | 95.621 | 1.00 | 37.45 | O |
| ATOM | 879 | CB | THR | A | 112 | −36.362 | −3.387 | 98.207 | 1.00 | 31.08 | C |
| ATOM | 880 | OG1 | THR | A | 112 | −35.660 | −4.523 | 98.708 | 1.00 | 33.39 | O |
| ATOM | 881 | CG2 | THR | A | 112 | −37.042 | −2.661 | 99.366 | 1.00 | 29.77 | C |
| ATOM | 882 | N | VAL | A | 113 | −39.210 | −2.344 | 96.684 | 1.00 | 31.43 | N |
| ATOM | 883 | CA | VAL | A | 113 | −39.827 | −1.173 | 96.089 | 1.00 | 36.35 | C |
| ATOM | 884 | C | VAL | A | 113 | −40.215 | −0.226 | 97.216 | 1.00 | 36.75 | C |
| ATOM | 885 | O | VAL | A | 113 | −41.039 | −0.569 | 98.072 | 1.00 | 39.18 | O |
| ATOM | 886 | CB | VAL | A | 113 | −41.043 | −1.550 | 95.234 | 1.00 | 34.86 | C |
| ATOM | 887 | CG1 | VAL | A | 113 | −41.651 | −0.305 | 94.602 | 1.00 | 34.99 | C |
| ATOM | 888 | CG2 | VAL | A | 113 | −40.631 | −2.533 | 94.188 | 1.00 | 34.01 | C |
| ATOM | 889 | N | SER | A | 114 | −39.653 | 0.974 | 97.192 | 1.00 | 36.38 | N |
| ATOM | 890 | CA | SER | A | 114 | −39.797 | 1.848 | 98.340 | 1.00 | 36.28 | C |
| ATOM | 891 | C | SER | A | 114 | −39.395 | 3.273 | 97.977 | 1.00 | 40.12 | C |
| ATOM | 892 | O | SER | A | 114 | −38.525 | 3.507 | 97.123 | 1.00 | 40.70 | O |
| ATOM | 893 | CB | SER | A | 114 | −38.954 | 1.341 | 99.507 | 1.00 | 31.28 | C |
| ATOM | 894 | OG | SER | A | 114 | −38.863 | 2.336 | 100.505 | 1.00 | 39.08 | O |
| ATOM | 895 | N | SER | A | 115 | −40.017 | 4.217 | 98.672 | 1.00 | 38.69 | N |
| ATOM | 896 | CA | SER | A | 115 | −39.621 | 5.613 | 98.576 | 1.00 | 42.10 | C |
| ATOM | 897 | C | SER | A | 115 | −38.296 | 5.892 | 99.267 | 1.00 | 46.74 | C |
| ATOM | 898 | O | SER | A | 115 | −37.675 | 6.920 | 98.973 | 1.00 | 42.92 | O |
| ATOM | 899 | CB | SER | A | 115 | −40.717 | 6.490 | 99.162 | 1.00 | 39.28 | C |
| ATOM | 900 | OG | SER | A | 115 | −41.885 | 6.392 | 98.349 | 1.00 | 47.59 | O |
| ATOM | 901 | N | ALA | A | 116 | −37.853 | 5.008 | 100.168 | 1.00 | 39.54 | N |
| ATOM | 902 | CA | ALA | A | 116 | −36.656 | 5.257 | 100.954 | 1.00 | 35.81 | C |
| ATOM | 903 | C | ALA | A | 116 | −35.417 | 5.270 | 100.067 | 1.00 | 37.57 | C |
| ATOM | 904 | O | ALA | A | 116 | −35.411 | 4.730 | 98.963 | 1.00 | 38.65 | O |
| ATOM | 905 | CB | ALA | A | 116 | −36.507 | 4.199 | 102.035 | 1.00 | 35.27 | C |
| ATOM | 906 | N | SER | A | 117 | −34.347 | 5.880 | 100.571 | 1.00 | 38.00 | N |
| ATOM | 907 | CA | SER | A | 117 | −33.079 | 5.924 | 99.855 | 1.00 | 40.96 | C |
| ATOM | 908 | C | SER | A | 117 | −32.040 | 5.082 | 100.572 | 1.00 | 39.82 | C |
| ATOM | 909 | O | SER | A | 117 | −32.108 | 4.893 | 101.790 | 1.00 | 40.84 | O |
| ATOM | 910 | CB | SER | A | 117 | −32.561 | 7.352 | 99.715 | 1.00 | 38.33 | C |
| ATOM | 911 | OG | SER | A | 117 | −33.448 | 8.084 | 98.896 | 1.00 | 52.15 | O |
| ATOM | 912 | N | THR | A | 118 | −31.078 | 4.576 | 99.803 | 1.00 | 34.77 | N |
| ATOM | 913 | CA | THR | A | 118 | −30.059 | 3.709 | 100.378 | 1.00 | 35.77 | C |
| ATOM | 914 | C | THR | A | 118 | −29.387 | 4.392 | 101.560 | 1.00 | 40.75 | C |
| ATOM | 915 | O | THR | A | 118 | −29.127 | 5.595 | 101.535 | 1.00 | 45.66 | O |
| ATOM | 916 | CB | THR | A | 118 | −29.030 | 3.346 | 99.320 | 1.00 | 33.58 | C |
| ATOM | 917 | OG1 | THR | A | 118 | −29.662 | 2.534 | 98.320 | 1.00 | 42.35 | O |
| ATOM | 918 | CG2 | THR | A | 118 | −27.854 | 2.607 | 99.941 | 1.00 | 35.40 | C |
| ATOM | 919 | N | LYS | A | 119 | −29.152 | 3.629 | 102.621 | 1.00 | 37.56 | N |
| ATOM | 920 | CA | LYS | A | 119 | −28.635 | 4.215 | 103.848 | 1.00 | 36.23 | C |
| ATOM | 921 | C | LYS | A | 119 | −28.000 | 3.126 | 104.697 | 1.00 | 36.78 | C |
| ATOM | 922 | O | LYS | A | 119 | −28.629 | 2.100 | 104.959 | 1.00 | 31.04 | O |
| ATOM | 923 | CB | LYS | A | 119 | −29.742 | 4.904 | 104.631 | 1.00 | 36.08 | C |
| ATOM | 924 | CG | LYS | A | 119 | −29.224 | 5.571 | 105.867 | 1.00 | 32.45 | C |
| ATOM | 925 | CD | LYS | A | 119 | −30.331 | 6.005 | 106.761 | 1.00 | 36.11 | C |
| ATOM | 926 | CE | LYS | A | 119 | −29.719 | 6.656 | 107.950 | 1.00 | 41.55 | C |
| ATOM | 927 | NZ | LYS | A | 119 | −28.719 | 5.693 | 108.485 | 1.00 | 40.27 | N1+ |
| ATOM | 928 | N | GLY | A | 120 | −26.761 | 3.351 | 105.115 | 1.00 | 32.34 | N |
| ATOM | 929 | CA | GLY | A | 120 | −26.058 | 2.407 | 105.937 | 1.00 | 32.74 | C |
| ATOM | 930 | C | GLY | A | 120 | −26.563 | 2.417 | 107.364 | 1.00 | 33.41 | C |
| ATOM | 931 | O | GLY | A | 120 | −27.264 | 3.331 | 107.801 | 1.00 | 34.70 | O |
| ATOM | 932 | N | PRO | A | 121 | −26.210 | 1.393 | 108.120 | 1.00 | 31.38 | N |
| ATOM | 933 | CA | PRO | A | 121 | −26.705 | 1.283 | 109.493 | 1.00 | 36.27 | C |
| ATOM | 934 | C | PRO | A | 121 | −25.863 | 2.075 | 110.478 | 1.00 | 29.36 | C |
| ATOM | 935 | O | PRO | A | 121 | −24.723 | 2.442 | 110.213 | 1.00 | 28.70 | O |
| ATOM | 936 | CB | PRO | A | 121 | −26.592 | −0.217 | 109.784 | 1.00 | 32.75 | C |
| ATOM | 937 | CG | PRO | A | 121 | −25.450 | −0.653 | 108.950 | 1.00 | 31.60 | C |
| ATOM | 938 | CD | PRO | A | 121 | −25.485 | 0.190 | 107.692 | 1.00 | 31.22 | C |
| ATOM | 939 | N | SER | A | 122 | −26.481 | 2.365 | 111.614 | 1.00 | 28.35 | N |
| ATOM | 940 | CA | SER | A | 122 | −25.790 | 2.748 | 112.834 | 1.00 | 27.65 | C |

TABLE 10.4-continued

| ATOM | 941 | C | SER | A | 122 | -25.766 | 1.529 | 113.743 | 1.00 | 28.89 | C |
| --- | --- | --- | --- | --- | --- | --- | --- | --- | --- | --- | --- |
| ATOM | 942 | O | SER | A | 122 | -26.780 | 0.843 | 113.874 | 1.00 | 33.72 | O |
| ATOM | 943 | CB | SER | A | 122 | -26.490 | 3.915 | 113.528 | 1.00 | 27.60 | C |
| ATOM | 944 | OG | SER | A | 122 | -26.537 | 5.035 | 112.665 | 1.00 | 32.84 | O |
| ATOM | 945 | N | VAL | A | 123 | -24.615 | 1.239 | 114.341 | 1.00 | 30.13 | N |
| ATOM | 946 | CA | VAL | A | 123 | -24.439 | 0.062 | 115.188 | 1.00 | 29.26 | C |
| ATOM | 947 | C | VAL | A | 123 | -24.266 | 0.513 | 116.638 | 1.00 | 28.50 | C |
| ATOM | 948 | O | VAL | A | 123 | -23.290 | 1.188 | 116.982 | 1.00 | 36.71 | O |
| ATOM | 949 | CB | VAL | A | 123 | -23.257 | -0.800 | 114.713 | 1.00 | 29.30 | C |
| ATOM | 950 | CG1 | VAL | A | 123 | -23.161 | -2.079 | 115.535 | 1.00 | 32.16 | C |
| ATOM | 951 | CG2 | VAL | A | 123 | -23.421 | -1.143 | 113.243 | 1.00 | 29.73 | C |
| ATOM | 952 | N | PHE | A | 124 | -25.204 | 0.154 | 117.477 | 1.00 | 29.11 | N |
| ATOM | 953 | CA | PHE | A | 124 | -25.117 | 0.453 | 118.892 | 1.00 | 30.43 | C |
| ATOM | 954 | C | PHE | A | 124 | -24.914 | -0.818 | 119.710 | 1.00 | 30.05 | C |
| ATOM | 955 | O | PHE | A | 124 | -25.432 | -1.871 | 119.341 | 1.00 | 28.55 | O |
| ATOM | 956 | CB | PHE | A | 124 | -26.387 | 1.149 | 119.375 | 1.00 | 29.02 | C |
| ATOM | 957 | CG | PHE | A | 124 | -26.765 | 2.328 | 118.559 | 1.00 | 31.89 | C |
| ATOM | 958 | CD1 | PHE | A | 124 | -25.952 | 3.448 | 118.525 | 1.00 | 37.36 | C |
| ATOM | 959 | CD2 | PHE | A | 124 | -27.948 | 2.345 | 117.848 | 1.00 | 33.36 | C |
| ATOM | 960 | CE1 | PHE | A | 124 | -26.309 | 4.550 | 117.784 | 1.00 | 33.03 | C |
| ATOM | 961 | CE2 | PHE | A | 124 | -28.307 | 3.451 | 117.112 | 1.00 | 32.67 | C |
| ATOM | 962 | CZ | PHE | A | 124 | -27.486 | 4.548 | 117.085 | 1.00 | 31.27 | C |
| ATOM | 963 | N | PRO | A | 125 | -24.212 | -0.744 | 120.845 | 1.00 | 34.75 | N |
| ATOM | 964 | CA | PRO | A | 125 | -23.997 | -1.942 | 121.663 | 1.00 | 33.50 | C |
| ATOM | 965 | C | PRO | A | 125 | -25.209 | -2.306 | 122.514 | 1.00 | 33.10 | C |
| ATOM | 966 | O | PRO | A | 125 | -25.956 | -1.452 | 122.991 | 1.00 | 31.28 | O |
| ATOM | 967 | CB | PRO | A | 125 | -22.808 | -1.549 | 122.546 | 1.00 | 27.55 | C |
| ATOM | 968 | CG | PRO | A | 125 | -22.913 | -0.105 | 122.656 | 1.00 | 24.38 | C |
| ATOM | 969 | CD | PRO | A | 125 | -23.459 | 0.407 | 121.378 | 1.00 | 30.67 | C |
| ATOM | 970 | N | LEU | A | 126 | -25.395 | -3.609 | 122.688 | 1.00 | 29.05 | N |
| ATOM | 971 | CA | LEU | A | 126 | -26.264 | -4.145 | 123.724 | 1.00 | 31.66 | C |
| ATOM | 972 | C | LEU | A | 126 | -25.315 | -4.627 | 124.801 | 1.00 | 33.65 | C |
| ATOM | 973 | O | LEU | A | 126 | -24.728 | -5.70 | 124.688 | 1.00 | 37.65 | O |
| ATOM | 974 | CB | LEU | A | 126 | -27.167 | -5.249 | 123.195 | 1.00 | 30.81 | C |
| ATOM | 975 | CG | LEU | A | 126 | -27.997 | -4.672 | 122.052 | 1.00 | 29.82 | C |
| ATOM | 976 | CD1 | LEU | A | 126 | -28.827 | -5.730 | 121.357 | 1.00 | 26.48 | C |
| ATOM | 977 | CD2 | LEU | A | 126 | -28.860 | -3.574 | 122.603 | 1.00 | 30.33 | C |
| ATOM | 978 | N | ALA | A | 127 | -25.143 | -3.805 | 125.835 | 1.00 | 38.61 | N |
| ATOM | 979 | CA | ALA | A | 127 | -24.053 | -4.011 | 126.768 | 1.00 | 36.09 | C |
| ATOM | 980 | C | ALA | A | 127 | -24.399 | -5.128 | 127.738 | 1.00 | 40.57 | C |
| ATOM | 981 | O | ALA | A | 127 | -25.510 | -5.137 | 128.289 | 1.00 | 36.21 | O |
| ATOM | 982 | CB | ALA | A | 127 | -23.763 | -2.733 | 127.529 | 1.00 | 35.02 | C |
| ATOM | 983 | N | PRO | A | 128 | -23.478 | -6.062 | 127.986 | 1.00 | 38.34 | N |
| ATOM | 984 | CA | PRO | A | 128 | -23.759 | -7.137 | 128.941 | 1.00 | 45.51 | C |
| ATOM | 985 | C | PRO | A | 128 | -24.091 | -6.569 | 130.309 | 1.00 | 56.56 | C |
| ATOM | 986 | O | PRO | A | 128 | -23.360 | -5.736 | 130.865 | 1.00 | 52.82 | O |
| ATOM | 987 | CB | PRO | A | 128 | -22.463 | -7.953 | 128.968 | 1.00 | 43.58 | C |
| ATOM | 988 | CG | PRO | A | 128 | -21.433 | -7.043 | 128.440 | 1.00 | 45.25 | C |
| ATOM | 989 | CD | PRO | A | 128 | -22.124 | -6.162 | 127.441 | 1.00 | 39.79 | C |
| ATOM | 990 | N | SER | A | 129 | -25.212 | -7.049 | 130.837 | 1.00 | 66.36 | N |
| ATOM | 991 | CA | SER | A | 129 | -25.759 | -6.677 | 132.128 | 1.00 | 72.65 | C |
| ATOM | 992 | C | SER | A | 129 | -24.673 | -6.810 | 133.195 | 1.00 | 76.84 | C |
| ATOM | 993 | O | SER | A | 129 | -24.175 | -7.914 | 133.453 | 1.00 | 78.41 | O |
| ATOM | 994 | CB | SER | A | 129 | -26.983 | -7.568 | 132.406 | 1.00 | 69.58 | C |
| ATOM | 995 | OG | SER | A | 129 | -27.910 | -7.001 | 133.309 | 1.00 | 70.69 | O |
| ATOM | 996 | N | SER | A | 130 | -24.252 | -5.681 | 133.776 | 1.00 | 77.98 | N |
| ATOM | 997 | CA | SER | A | 130 | -23.377 | -5.731 | 134.943 | 1.00 | 85.61 | C |
| ATOM | 998 | C | SER | A | 130 | -23.994 | -6.604 | 136.037 | 1.00 | 90.91 | C |
| ATOM | 999 | O | SER | A | 130 | -23.273 | -7.223 | 136.835 | 1.00 | 87.54 | O |
| ATOM | 1000 | CB | SER | A | 130 | -23.089 | -4.307 | 135.444 | 1.00 | 90.00 | C |
| ATOM | 1001 | OG | SER | A | 130 | -24.274 | -3.529 | 135.594 | 1.00 | 85.47 | O |
| ATOM | 1002 | N | LYS | A | 131 | -25.331 | -6.708 | 136.043 | 1.00 | 95.09 | N |
| ATOM | 1003 | CA | LYS | A | 131 | -26.101 | -7.524 | 136.974 | 1.00 | 92.61 | C |
| ATOM | 1004 | C | LYS | A | 131 | -26.337 | -8.936 | 136.436 | 1.00 | 92.99 | C |
| ATOM | 1005 | O | LYS | A | 131 | -27.391 | -9.540 | 136.695 | 1.00 | 88.38 | O |
| ATOM | 1006 | CB | LYS | A | 131 | -27.436 | -6.839 | 137.284 | 1.00 | 84.94 | C |
| ATOM | 1007 | CG | LYS | A | 131 | -27.308 | -5.523 | 138.053 | 1.00 | 86.39 | C |
| ATOM | 1008 | CD | LYS | A | 131 | -28.673 | -4.977 | 138.437 | 1.00 | 85.07 | C |
| ATOM | 1009 | CE | LYS | A | 131 | -28.583 | -4.070 | 139.646 | 1.00 | 74.74 | C |
| ATOM | 1010 | NZ | LYS | A | 131 | -29.939 | -3.594 | 140.022 | 1.00 | 70.33 | N1+ |
| ATOM | 1011 | N | SER | A | 132 | -25.386 | -9.453 | 135.655 | 1.00 | 91.67 | N |
| ATOM | 1012 | CA | SER | A | 132 | -25.423 | -10.837 | 135.210 | 1.00 | 89.98 | C |
| ATOM | 1013 | C | SER | A | 132 | -25.152 | -11.744 | 136.398 | 1.00 | 95.97 | C |
| ATOM | 1014 | O | SER | A | 132 | -24.296 | -11.439 | 137.237 | 1.00 | 97.89 | O |
| ATOM | 1015 | CB | SER | A | 132 | -24.366 | -11.076 | 134.130 | 1.00 | 80.08 | C |
| ATOM | 1016 | OG | SER | A | 132 | -24.779 | -10.567 | 132.876 | 1.00 | 75.09 | O |
| ATOM | 1017 | N | THR | A | 133 | -25.903 | -12.846 | 136.495 | 1.00 | 96.88 | N |
| ATOM | 1018 | CA | THR | A | 133 | -25.589 | -13.828 | 137.529 | 1.00 | 94.98 | C |
| ATOM | 1019 | C | THR | A | 133 | -24.133 | -14.276 | 137.346 | 1.00 | 90.31 | C |
| ATOM | 1020 | O | THR | A | 133 | -23.836 | -15.107 | 136.480 | 1.00 | 81.64 | O |

TABLE 10.4-continued

| | | | | | | | | | | |
|---|---|---|---|---|---|---|---|---|---|---|
| ATOM | 1021 | CB | THR | A | 133 | −26.595 | −15.001 | 137.481 | 1.00 | 90.13 | C |
| ATOM | 1022 | OG1 | THR | A | 133 | −26.943 | −15.313 | 136.117 | 1.00 | 86.99 | O |
| ATOM | 1023 | CG2 | THR | A | 133 | −27.872 | −14.664 | 138.271 | 1.00 | 77.20 | C |
| ATOM | 1024 | N | SER | A | 134 | −23.219 | −13.722 | 138.160 | 1.00 | 93.80 | N |
| ATOM | 1025 | CA | SER | A | 134 | −21.784 | −13.900 | 137.935 | 1.00 | 90.34 | C |
| ATOM | 1026 | C | SER | A | 134 | −21.364 | −15.323 | 138.275 | 1.00 | 87.03 | C |
| ATOM | 1027 | O | SER | A | 134 | −21.597 | −15.802 | 139.389 | 1.00 | 88.65 | O |
| ATOM | 1028 | CB | SER | A | 134 | −20.971 | −12.892 | 138.748 | 1.00 | 80.79 | C |
| ATOM | 1029 | OG | SER | A | 134 | −19.872 | −12.426 | 137.986 | 1.00 | 69.79 | O |
| ATOM | 1030 | N | GLY | A | 135 | −20.701 | −15.981 | 137.329 | 1.00 | 83.14 | N |
| ATOM | 1031 | CA | GLY | A | 135 | −20.552 | −17.418 | 137.366 | 1.00 | 79.97 | C |
| ATOM | 1032 | C | GLY | A | 135 | −21.634 | −18.150 | 136.607 | 1.00 | 75.17 | C |
| ATOM | 1033 | O | GLY | A | 135 | −21.672 | −19.387 | 136.643 | 1.00 | 70.13 | O |
| ATOM | 1034 | N | GLY | A | 136 | −22.531 | −17.411 | 135.954 | 1.00 | 73.84 | N |
| ATOM | 1035 | CA | GLY | A | 136 | −23.577 | −17.924 | 135.095 | 1.00 | 61.25 | C |
| ATOM | 1036 | C | GLY | A | 136 | −23.388 | −17.420 | 133.676 | 1.00 | 63.22 | C |
| ATOM | 1037 | O | GLY | A | 136 | −22.265 | −17.397 | 133.152 | 1.00 | 56.06 | O |
| ATOM | 1038 | N | THR | A | 137 | −24.476 | −16.996 | 133.040 | 1.00 | 59.59 | N |
| ATOM | 1039 | CA | THR | A | 137 | −24.446 | −16.674 | 131.626 | 1.00 | 48.48 | C |
| ATOM | 1040 | C | THR | A | 137 | −24.845 | −15.227 | 131.387 | 1.00 | 51.06 | C |
| ATOM | 1041 | O | THR | A | 137 | −25.789 | −14.712 | 132.002 | 1.00 | 56.26 | O |
| ATOM | 1042 | CB | THR | A | 137 | −25.342 | −17.624 | 130.849 | 1.00 | 47.89 | C |
| ATOM | 1043 | OG1 | THR | A | 137 | −24.756 | −18.935 | 130.893 | 1.00 | 52.57 | O |
| ATOM | 1044 | CG2 | THR | A | 137 | −25.461 | −17.182 | 129.398 | 1.00 | 39.41 | C |
| ATOM | 1045 | N | ALA | A | 138 | −24.088 | −14.574 | 130.510 | 1.00 | 44.74 | N |
| ATOM | 1046 | CA | ALA | A | 138 | −24.313 | −13.195 | 130.117 | 1.00 | 41.78 | C |
| ATOM | 1047 | C | ALA | A | 138 | −24.782 | −13.142 | 128.670 | 1.00 | 43.49 | C |
| ATOM | 1048 | O | ALA | A | 138 | −24.337 | −13.933 | 127.833 | 1.00 | 41.75 | O |
| ATOM | 1049 | CB | ALA | A | 138 | −23.036 | −12.369 | 130.273 | 1.00 | 44.03 | C |
| ATOM | 1050 | N | ALA | A | 139 | −25.689 | −12.215 | 128.384 | 1.00 | 43.46 | N |
| ATOM | 1051 | CA | ALA | A | 139 | −26.067 | −11.872 | 127.022 | 1.00 | 39.95 | C |
| ATOM | 1052 | C | ALA | A | 139 | −25.455 | −10.522 | 126.665 | 1.00 | 35.35 | C |
| ATOM | 1053 | O | ALA | A | 139 | −25.393 | −9.618 | 127.504 | 1.00 | 31.47 | O |
| ATOM | 1054 | CB | ALA | A | 139 | −27.593 | −11.827 | 126.865 | 1.00 | 27.83 | C |
| ATOM | 1055 | N | LEU | A | 140 | −25.005 | −10.399 | 125.419 | 1.00 | 30.62 | N |
| ATOM | 1056 | CA | LEU | A | 140 | −24.563 | −9.129 | 124.863 | 1.00 | 32.63 | C |
| ATOM | 1057 | C | LEU | A | 140 | −24.915 | −9.129 | 123.382 | 1.00 | 32.74 | C |
| ATOM | 1058 | O | LEU | A | 140 | −25.288 | −10.161 | 122.824 | 1.00 | 33.31 | O |
| ATOM | 1059 | CB | LEU | A | 140 | −23.067 | −8.925 | 125.098 | 1.00 | 36.31 | C |
| ATOM | 1060 | CG | LEU | A | 140 | −22.182 | −10.012 | 124.493 | 1.00 | 33.45 | C |
| ATOM | 1061 | CD1 | LEU | A | 140 | −21.538 | −9.500 | 123.223 | 1.00 | 31.90 | C |
| ATOM | 1062 | CD2 | LEU | A | 140 | −21.146 | −10.511 | 125.497 | 1.00 | 33.92 | C |
| ATOM | 1063 | N | GLY | A | 141 | −24.839 | −7.966 | 122.745 | 1.00 | 31.54 | N |
| ATOM | 1064 | CA | GLY | A | 141 | −25.151 | −7.940 | 121.332 | 1.00 | 28.33 | C |
| ATOM | 1065 | C | GLY | A | 141 | −24.948 | −6.589 | 120.690 | 1.00 | 27.25 | C |
| ATOM | 1066 | O | GLY | A | 141 | −24.461 | −5.640 | 121.304 | 1.00 | 31.88 | O |
| ATOM | 1067 | N | CYS | A | 142 | −25.353 | −6.529 | 119.428 | 1.00 | 25.30 | N |
| ATOM | 1068 | CA | CYS | A | 142 | −25.336 | −5.319 | 118.623 | 1.00 | 28.40 | C |
| ATOM | 1069 | C | CYS | A | 142 | −26.729 | −5.018 | 118.105 | 1.00 | 27.36 | C |
| ATOM | 1070 | O | CYS | A | 142 | −27.484 | −5.930 | 117.757 | 1.00 | 27.52 | O |
| ATOM | 1071 | CB | CYS | A | 142 | −24.402 | −5.447 | 117.435 | 1.00 | 30.69 | C |
| ATOM | 1072 | SG | CYS | A | 142 | −22.691 | −5.228 | 117.879 | 1.00 | 51.18 | S |
| ATOM | 1073 | N | LEU | A | 143 | −27.056 | −3.735 | 118.049 | 1.00 | 27.56 | N |
| ATOM | 1074 | CA | LEU | A | 143 | −28.293 | −3.248 | 117.460 | 1.00 | 27.81 | C |
| ATOM | 1075 | C | LEU | A | 143 | −27.931 | −2.565 | 116.145 | 1.00 | 27.63 | C |
| ATOM | 1076 | O | LEU | A | 143 | −27.155 | −1.613 | 116.136 | 1.00 | 31.79 | O |
| ATOM | 1077 | CB | LEU | A | 143 | −28.985 | −2.274 | 118.406 | 1.00 | 31.36 | C |
| ATOM | 1078 | CG | LEU | A | 143 | −30.346 | −1.766 | 117.963 | 1.00 | 31.23 | C |
| ATOM | 1079 | CD1 | LEU | A | 143 | −31.250 | −2.954 | 117.862 | 1.00 | 28.10 | C |
| ATOM | 1080 | CD2 | LEU | A | 143 | −30.899 | −0.706 | 118.886 | 1.00 | 32.28 | C |
| ATOM | 1081 | N | VAL | A | 144 | −28.436 | −3.083 | 115.036 | 1.00 | 30.74 | N |
| ATOM | 1082 | CA | VAL | A | 144 | −28.101 | −2.590 | 113.702 | 1.00 | 27.82 | C |
| ATOM | 1083 | C | VAL | A | 144 | −29.311 | −1.800 | 113.216 | 1.00 | 30.66 | C |
| ATOM | 1084 | O | VAL | A | 144 | −30.289 | −2.381 | 112.744 | 1.00 | 30.67 | O |
| ATOM | 1085 | CB | VAL | A | 144 | −27.732 | −3.744 | 112.769 | 1.00 | 28.14 | C |
| ATOM | 1086 | CG1 | VAL | A | 144 | −27.347 | −3.252 | 111.375 | 1.00 | 23.30 | C |
| ATOM | 1087 | CG2 | VAL | A | 144 | −26.591 | −4.541 | 113.411 | 1.00 | 25.34 | C |
| ATOM | 1088 | N | LYS | A | 145 | −29.269 | −0.470 | 113.374 | 1.00 | 33.19 | N |
| ATOM | 1089 | CA | LYS | A | 145 | −30.446 | 0.383 | 113.245 | 1.00 | 31.94 | C |
| ATOM | 1090 | C | LYS | A | 145 | −30.392 | 1.292 | 112.020 | 1.00 | 34.55 | C |
| ATOM | 1091 | O | LYS | A | 145 | −29.322 | 1.758 | 111.612 | 1.00 | 32.70 | O |
| ATOM | 1092 | CB | LYS | A | 145 | −30.637 | 1.229 | 114.504 | 1.00 | 34.83 | C |
| ATOM | 1093 | CG | LYS | A | 145 | −32.055 | 1.752 | 114.654 | 1.00 | 39.24 | C |
| ATOM | 1094 | CD | LYS | A | 145 | −32.309 | 2.302 | 116.035 | 1.00 | 37.76 | C |
| ATOM | 1095 | CE | LYS | A | 145 | −33.802 | 2.550 | 116.282 | 1.00 | 47.55 | C |
| ATOM | 1096 | NZ | LYS | A | 145 | −34.483 | 3.453 | 115.296 | 1.00 | 48.57 | N1+ |
| ATOM | 1097 | N | ASP | A | 146 | −31.564 | 1.494 | 111.414 | 1.00 | 35.65 | N |
| ATOM | 1098 | CA | ASP | A | 146 | −31.815 | 2.517 | 110.399 | 1.00 | 31.21 | C |
| ATOM | 1099 | C | ASP | A | 146 | −30.985 | 2.308 | 109.134 | 1.00 | 34.08 | C |
| ATOM | 1100 | O | ASP | A | 146 | −30.204 | 3.170 | 108.721 | 1.00 | 35.04 | O |

TABLE 10.4-continued

| ATOM | 1101 | CB | ASP | A | 146 | −31.568 | 3.919 | 110.960 | 1.00 | 31.93 | C |
|---|---|---|---|---|---|---|---|---|---|---|---|
| ATOM | 1102 | CG | ASP | A | 146 | −32.501 | 4.276 | 112.097 | 1.00 | 39.35 | C |
| ATOM | 1103 | OD1 | ASP | A | 146 | −33.621 | 3.731 | 112.154 | 1.00 | 37.78 | O |
| ATOM | 1104 | OD2 | ASP | A | 146 | −32.150 | 5.184 | 112.878 | 1.00 | 48.93 | O1− |
| ATOM | 1105 | N | TYR | A | 147 | −31.184 | 1.169 | 108.490 | 1.00 | 35.70 | N |
| ATOM | 1106 | CA | TYR | A | 147 | −30.527 | 0.965 | 107.205 | 1.00 | 32.13 | C |
| ATOM | 1107 | C | TYR | A | 147 | −31.548 | 0.662 | 106.127 | 1.00 | 30.25 | C |
| ATOM | 1108 | O | TYR | A | 147 | −32.711 | 0.385 | 106.401 | 1.00 | 34.62 | O |
| ATOM | 1109 | CB | TYR | A | 147 | −29.480 | −0.146 | 107.270 | 1.00 | 29.22 | C |
| ATOM | 1110 | CG | TYR | A | 147 | −30.026 | −1.497 | 107.584 | 1.00 | 31.09 | C |
| ATOM | 1111 | CD1 | TYR | A | 147 | −30.476 | −2.344 | 106.572 | 1.00 | 34.27 | C |
| ATOM | 1112 | CD2 | TYR | A | 147 | −30.068 | −1.953 | 108.896 | 1.00 | 31.93 | C |
| ATOM | 1113 | CE1 | TYR | A | 147 | −30.965 | −3.615 | 106.863 | 1.00 | 33.60 | C |
| ATOM | 1114 | CE2 | TYR | A | 147 | −30.547 | −3.216 | 109.201 | 1.00 | 34.30 | C |
| ATOM | 1115 | CZ | TYR | A | 147 | −30.998 | −4.039 | 108.186 | 1.00 | 35.75 | C |
| ATOM | 1116 | OH | TYR | A | 147 | −31.474 | −5.283 | 108.511 | 1.00 | 33.90 | O |
| ATOM | 1117 | N | PHE | A | 148 | −31.087 | 0.720 | 104.889 | 1.00 | 36.14 | N |
| ATOM | 1118 | CA | PHE | A | 148 | −31.931 | 0.444 | 103.740 | 1.00 | 36.37 | C |
| ATOM | 1119 | C | PHE | A | 148 | −31.063 | 0.353 | 102.506 | 1.00 | 35.17 | C |
| ATOM | 1120 | O | PHE | A | 148 | −30.171 | 1.168 | 102.324 | 1.00 | 40.37 | O |
| ATOM | 1121 | CB | PHE | A | 148 | −32.994 | 1.533 | 103.573 | 1.00 | 35.29 | C |
| ATOM | 1122 | CG | PHE | A | 148 | −33.914 | 1.300 | 102.429 | 1.00 | 38.94 | C |
| ATOM | 1123 | CD2 | PHE | A | 148 | −33.582 | 1.733 | 101.154 | 1.00 | 37.28 | C |
| ATOM | 1124 | CD1 | PHE | A | 148 | −35.116 | 0.633 | 102.619 | 1.00 | 43.66 | C |
| ATOM | 1125 | CE2 | PHE | A | 148 | −34.431 | 1.509 | 100.090 | 1.00 | 40.33 | C |
| ATOM | 1126 | CE1 | PHE | A | 148 | −35.980 | 0.405 | 101.558 | 1.00 | 40.99 | C |
| ATOM | 1127 | CZ | PHE | A | 148 | −35.632 | 0.843 | 100.288 | 1.00 | 41.29 | C |
| ATOM | 1128 | N | PRO | A | 149 | −31.317 | −0.641 | 101.646 | 1.00 | 38.61 | N |
| ATOM | 1129 | CA | PRO | A | 149 | −32.320 | −1.693 | 101.818 | 1.00 | 36.40 | C |
| ATOM | 1130 | C | PRO | A | 149 | −31.736 | −2.913 | 102.534 | 1.00 | 32.84 | C |
| ATOM | 1131 | O | PRO | A | 149 | −30.607 | −2.867 | 103.010 | 1.00 | 32.70 | O |
| ATOM | 1132 | CB | PRO | A | 149 | −32.679 | −2.036 | 100.378 | 1.00 | 36.43 | C |
| ATOM | 1133 | CG | PRO | A | 149 | −31.331 | −1.921 | 99.683 | 1.00 | 33.06 | C |
| ATOM | 1134 | CD | PRO | A | 149 | −30.649 | −0.743 | 100.332 | 1.00 | 34.54 | C |
| ATOM | 1135 | N | GLU | A | 150 | −32.499 | −3.995 | 102.601 | 1.00 | 33.19 | N |
| ATOM | 1136 | CA | GLU | A | 150 | −31.952 | −5.302 | 102.970 | 1.00 | 32.31 | C |
| ATOM | 1137 | C | GLU | A | 150 | −30.980 | −5.788 | 101.891 | 1.00 | 29.80 | C |
| ATOM | 1138 | O | GLU | A | 150 | −31.160 | −5.456 | 100.713 | 1.00 | 29.74 | O |
| ATOM | 1139 | CB | GLU | A | 150 | −33.087 | −6.301 | 103.166 | 1.00 | 28.58 | C |
| ATOM | 1140 | CG | GLU | A | 150 | −33.977 | −6.000 | 104.360 | 1.00 | 29.38 | C |
| ATOM | 1141 | CD | GLU | A | 150 | −33.563 | −6.767 | 105.602 | 1.00 | 39.48 | C |
| ATOM | 1142 | OE1 | GLU | A | 150 | −34.378 | −7.590 | 106.099 | 1.00 | 41.15 | O |
| ATOM | 1143 | OE2 | GLU | A | 150 | −32.413 | −6.566 | 106.065 | 1.00 | 41.49 | O1− |
| ATOM | 1144 | N | PRO | A | 151 | −29.992 | −6.630 | 102.263 | 1.00 | 31.91 | N |
| ATOM | 1145 | CA | PRO | A | 151 | −29.735 | −7.230 | 103.581 | 1.00 | 31.76 | C |
| ATOM | 1146 | C | PRO | A | 151 | −28.502 | −6.701 | 104.317 | 1.00 | 35.19 | C |
| ATOM | 1147 | O | PRO | A | 151 | −27.684 | −5.998 | 103.713 | 1.00 | 34.57 | O |
| ATOM | 1148 | CB | PRO | A | 151 | −29.510 | −8.690 | 103.223 | 1.00 | 23.34 | C |
| ATOM | 1149 | CG | PRO | A | 151 | −28.788 | −8.605 | 101.939 | 1.00 | 20.46 | C |
| ATOM | 1150 | CD | PRO | A | 151 | −29.218 | −7.334 | 101.225 | 1.00 | 25.12 | C |
| ATOM | 1151 | N | VAL | A | 152 | −28.379 | −7.046 | 105.602 | 1.00 | 30.30 | N |
| ATOM | 1152 | CA | VAL | A | 152 | −27.128 | −6.911 | 106.335 | 1.00 | 29.66 | C |
| ATOM | 1153 | C | VAL | A | 152 | −26.726 | −8.297 | 106.815 | 1.00 | 33.28 | C |
| ATOM | 1154 | O | VAL | A | 152 | −27.580 | −9.147 | 107.078 | 1.00 | 31.82 | O |
| ATOM | 1155 | CB | VAL | A | 152 | −27.221 | −5.959 | 107.550 | 1.00 | 31.08 | C |
| ATOM | 1156 | CG1 | VAL | A | 152 | −27.344 | −4.523 | 107.116 | 1.00 | 36.88 | C |
| ATOM | 1157 | CG2 | VAL | A | 152 | −28.382 | −6.349 | 108.403 | 1.00 | 32.42 | C |
| ATOM | 1158 | N | THR | A | 153 | −25.419 | −8.509 | 106.967 | 1.00 | 32.49 | N |
| ATOM | 1159 | CA | THR | A | 153 | −24.873 | −9.711 | 107.585 | 1.00 | 31.87 | C |
| ATOM | 1160 | C | THR | A | 153 | −24.123 | −9.336 | 108.858 | 1.00 | 33.40 | C |
| ATOM | 1161 | O | THR | A | 153 | −23.517 | −8.264 | 108.952 | 1.00 | 35.81 | O |
| ATOM | 1162 | CB | THR | A | 153 | −23.924 | −10.442 | 106.644 | 1.00 | 27.89 | C |
| ATOM | 1163 | OG1 | THR | A | 153 | −22.904 | −9.528 | 106.239 | 1.00 | 36.53 | O |
| ATOM | 1164 | CG2 | THR | A | 153 | −24.676 | −10.910 | 105.408 | 1.00 | 29.45 | C |
| ATOM | 1165 | N | VAL | A | 154 | −24.189 | −10.213 | 109.852 | 1.00 | 24.86 | N |
| ATOM | 1166 | CA | VAL | A | 154 | −23.508 | −10.013 | 111.116 | 1.00 | 27.57 | C |
| ATOM | 1167 | C | VAL | A | 154 | −22.745 | −11.281 | 111.472 | 1.00 | 29.28 | C |
| ATOM | 1168 | O | VAL | A | 154 | −23.316 | −12.374 | 111.480 | 1.00 | 35.29 | O |
| ATOM | 1169 | CB | VAL | A | 154 | −24.499 | −9.646 | 112.240 | 1.00 | 30.65 | C |
| ATOM | 1170 | CG1 | VAL | A | 154 | −23.770 | −9.393 | 113.542 | 1.00 | 30.74 | C |
| ATOM | 1171 | CG2 | VAL | A | 154 | −25.312 | −8.454 | 111.849 | 1.00 | 29.70 | C |
| ATOM | 1172 | N | SER | A | 155 | −21.463 | −11.137 | 111.766 | 1.00 | 29.75 | N |
| ATOM | 1173 | CA | SER | A | 155 | −20.720 | −12.183 | 112.446 | 1.00 | 32.79 | C |
| ATOM | 1174 | C | SER | A | 155 | −20.100 | −11.604 | 113.711 | 1.00 | 36.14 | C |
| ATOM | 1175 | O | SER | A | 155 | −20.134 | −10.393 | 113.961 | 1.00 | 34.64 | O |
| ATOM | 1176 | CB | SER | A | 155 | −16.648 | −12.800 | 111.550 | 1.00 | 28.09 | C |
| ATOM | 1177 | OG | SER | A | 155 | −18.682 | −11.839 | 111.164 | 1.00 | 32.25 | O |
| ATOM | 1178 | N | TRP | A | 156 | −19.522 | −12.495 | 114.504 | 1.00 | 28.20 | N |
| ATOM | 1179 | CA | TRP | A | 156 | −18.940 | −12.149 | 115.781 | 1.00 | 30.93 | C |
| ATOM | 1180 | C | TRP | A | 156 | −17.495 | −12.610 | 115.807 | 1.00 | 35.40 | C |

TABLE 10.4-continued

| | | | | | | | | | | |
|---|---|---|---|---|---|---|---|---|---|---|
| ATOM | 1181 | O | TRP | A | 156 | −17.202 | −13.750 | 115.427 | 1.00 | 34.28 | O |
| ATOM | 1182 | CB | TRP | A | 156 | −19.731 | −12.786 | 116.913 | 1.00 | 30.86 | C |
| ATOM | 1183 | CG | TRP | A | 156 | −20.988 | −12.046 | 117.160 | 1.00 | 32.29 | C |
| ATOM | 1184 | CD1 | TRP | A | 156 | −22.184 | −12.252 | 116.553 | 1.00 | 32.31 | C |
| ATOM | 1185 | CD2 | TRP | A | 156 | −21.168 | −10.939 | 118.048 | 1.00 | 31.77 | C |
| ATOM | 1186 | NE1 | TRP | A | 156 | −23.106 | −11.348 | 117.012 | 1.00 | 33.15 | N |
| ATOM | 1187 | CE2 | TRP | A | 156 | −22.508 | −10.529 | 117.933 | 1.00 | 31.90 | C |
| ATOM | 1188 | CE3 | TRP | A | 156 | −20.325 | −10.253 | 118.929 | 1.00 | 33.09 | C |
| ATOM | 1189 | CZ2 | TRP | A | 156 | −23.037 | −9.477 | 118.679 | 1.00 | 29.54 | C |
| ATOM | 1190 | CZ3 | TRP | A | 156 | −20.852 | −9.197 | 119.665 | 1.00 | 34.64 | C |
| ATOM | 1191 | CH2 | TRP | A | 156 | −22.199 | −8.828 | 119.539 | 1.00 | 31.80 | C |
| ATOM | 1192 | N | ASN | A | 157 | −16.603 | −11.723 | 116.262 | 1.00 | 28.12 | N |
| ATOM | 1193 | CA | ASN | A | 157 | −15.185 | −12.020 | 116.346 | 1.00 | 27.84 | C |
| ATOM | 1194 | C | ASN | A | 157 | −14.675 | −12.543 | 115.010 | 1.00 | 31.80 | C |
| ATOM | 1195 | O | ASN | A | 157 | −13.925 | −13.515 | 114.956 | 1.00 | 33.84 | O |
| ATOM | 1196 | CB | ASN | A | 157 | −14.888 | −13.031 | 117.461 | 1.00 | 29.77 | C |
| ATOM | 1197 | CG | ASN | A | 157 | −15.039 | −12.460 | 118.845 | 1.00 | 26.46 | C |
| ATOM | 1198 | OD1 | ASN | A | 157 | −15.346 | −11.294 | 119.024 | 1.00 | 30.29 | O |
| ATOM | 1199 | ND2 | ASN | A | 157 | −14.823 | −13.294 | 119.842 | 1.00 | 33.06 | N |
| ATOM | 1200 | N | SER | A | 158 | −15.102 | −11.898 | 113.922 | 1.00 | 31.97 | N |
| ATOM | 1201 | CA | SER | A | 158 | −14.661 | −12.248 | 112.570 | 1.00 | 33.51 | C |
| ATOM | 1202 | C | SER | A | 158 | −14.956 | −13.699 | 112.215 | 1.00 | 36.13 | C |
| ATOM | 1203 | O | SER | A | 158 | −14.224 | −14.307 | 111.438 | 1.00 | 42.62 | O |
| ATOM | 1204 | CB | SER | A | 158 | −13.170 | −11.972 | 112.375 | 1.00 | 28.57 | C |
| ATOM | 1205 | OG | SER | A | 158 | −12.839 | −10.678 | 112.818 | 1.00 | 41.72 | O |
| ATOM | 1206 | N | GLY | A | 159 | −16.007 | −14.278 | 112.791 | 1.00 | 36.17 | N |
| ATOM | 1207 | CA | GLY | A | 159 | −16.371 | −15.654 | 112.532 | 1.00 | 30.18 | C |
| ATOM | 1208 | C | GLY | A | 159 | −15.840 | −16.648 | 113.540 | 1.00 | 32.92 | C |
| ATOM | 1209 | O | GLY | A | 159 | −16.226 | −17.823 | 113.497 | 1.00 | 29.97 | O |
| ATOM | 1210 | N | ALA | A | 160 | −14.960 | −16.217 | 114.437 | 1.00 | 37.02 | N |
| ATOM | 1211 | CA | ALA | A | 160 | −14.420 | −17.132 | 115.431 | 1.00 | 32.79 | C |
| ATOM | 1212 | C | ALA | A | 160 | −15.442 | −17.476 | 116.505 | 1.00 | 34.92 | C |
| ATOM | 1213 | O | ALA | A | 160 | −15.345 | −18.540 | 117.121 | 1.00 | 48.32 | O |
| ATOM | 1214 | CB | ALA | A | 160 | −13.164 | −16.532 | 116.061 | 1.00 | 28.82 | C |
| ATOM | 1215 | N | LEU | A | 161 | −16.416 | −16.617 | 116.751 | 1.00 | 35.16 | N |
| ATOM | 1216 | CA | LEU | A | 161 | −17.432 | −16.878 | 117.759 | 1.00 | 33.95 | C |
| ATOM | 1217 | C | LEU | A | 161 | −18.713 | −17.278 | 117.047 | 1.00 | 32.88 | C |
| ATOM | 1218 | O | LEU | A | 161 | −19.239 | −16.519 | 116.234 | 1.00 | 35.85 | O |
| ATOM | 1219 | CB | LEU | A | 161 | −17.653 | −15.658 | 118.648 | 1.00 | 30.18 | C |
| ATOM | 1220 | CG | LEU | A | 161 | −18.778 | −15.719 | 119.683 | 1.00 | 35.02 | C |
| ATOM | 1221 | CD1 | LEU | A | 161 | −18.826 | −17.042 | 120.432 | 1.00 | 28.23 | C |
| ATOM | 1222 | CD2 | LEU | A | 161 | −18.673 | −14.517 | 120.661 | 1.00 | 33.30 | C |
| ATOM | 1223 | N | THR | A | 162 | −19.233 | −18.450 | 117.394 | 1.00 | 39.79 | N |
| ATOM | 1224 | CA | THR | A | 162 | −20.298 | −19.078 | 116.630 | 1.00 | 33.54 | C |
| ATOM | 1225 | C | THR | A | 162 | −21.336 | −19.691 | 117.569 | 1.00 | 32.35 | C |
| ATOM | 1226 | O | THR | A | 162 | −22.541 | −19.506 | 117.391 | 1.00 | 30.46 | O |
| ATOM | 1227 | CB | THR | A | 162 | −19.662 | −20.099 | 115.669 | 1.00 | 33.49 | C |
| ATOM | 1228 | OG1 | THR | A | 162 | −19.956 | −19.724 | 114.318 | 1.00 | 27.42 | O |
| ATOM | 1229 | CG2 | THR | A | 162 | −20.098 | −21.543 | 115.959 | 1.00 | 34.98 | C |
| ATOM | 1230 | N | SER | A | 163 | −20.885 | −20.391 | 118.598 | 1.00 | 34.58 | N |
| ATOM | 1231 | CA | SER | A | 163 | −21.813 | −20.925 | 119.583 | 1.00 | 35.61 | C |
| ATOM | 1232 | C | SER | A | 163 | −22.538 | −19.785 | 120.301 | 1.00 | 35.40 | C |
| ATOM | 1233 | O | SER | A | 163 | −21.925 | −18.781 | 120.681 | 1.00 | 37.87 | O |
| ATOM | 1234 | CB | SER | A | 163 | −21.044 | −21.799 | 120.578 | 1.00 | 35.71 | C |
| ATOM | 1235 | OG | SER | A | 163 | −21.864 | −22.247 | 121.633 | 1.00 | 43.49 | O |
| ATOM | 1236 | N | GLY | A | 164 | −23.856 | −19.911 | 120.442 | 1.00 | 28.98 | N |
| ATOM | 1237 | CA | GLY | A | 164 | −24.625 | −18.958 | 121.206 | 1.00 | 25.01 | C |
| ATOM | 1238 | C | GLY | A | 164 | −25.128 | −17.744 | 120.446 | 1.00 | 33.29 | C |
| ATOM | 1239 | O | GLY | A | 164 | −25.869 | −16.946 | 121.031 | 1.00 | 33.20 | O |
| ATOM | 1240 | N | VAL | A | 165 | −24.754 | −17.576 | 119.160 | 1.00 | 30.78 | N |
| ATOM | 1241 | CA | VAL | A | 165 | −25.156 | −16.414 | 118.374 | 1.00 | 25.26 | C |
| ATOM | 1242 | C | VAL | A | 165 | −26.588 | −16.586 | 117.885 | 1.00 | 31.13 | C |
| ATOM | 1243 | O | VAL | A | 165 | −26.998 | −17.679 | 117.480 | 1.00 | 36.05 | O |
| ATOM | 1244 | CB | VAL | A | 165 | −24.189 | −16.187 | 117.195 | 1.00 | 24.24 | C |
| ATOM | 1245 | CG1 | VAL | A | 165 | −24.660 | −15.030 | 116.320 | 1.00 | 26.94 | C |
| ATOM | 1246 | CG2 | VAL | A | 165 | −22.806 | −15.872 | 117.701 | 1.00 | 26.51 | C |
| ATOM | 1247 | N | HIS | A | 166 | −27.368 | −15.507 | 117.975 | 1.00 | 30.95 | N |
| ATOM | 1248 | CA | HIS | A | 166 | −28.639 | −15.358 | 117.275 | 1.00 | 527.16 | C |
| ATOM | 1249 | C | HIS | A | 166 | −28.634 | −14.011 | 116.567 | 1.00 | 29.61 | C |
| ATOM | 1250 | O | HIS | A | 166 | −28.486 | −12.968 | 117.218 | 1.00 | 28.82 | O |
| ATOM | 1251 | CB | HIS | A | 166 | −29.841 | −15.434 | 118.225 | 1.00 | 26.50 | C |
| ATOM | 1252 | CG | HIS | A | 166 | −29.913 | −16.697 | 119.017 | 1.00 | 29.14 | C |
| ATOM | 1253 | ND1 | HIS | A | 166 | −30.069 | −17.932 | 118.430 | 1.00 | 31.57 | N |
| ATOM | 1254 | CD2 | HIS | A | 166 | −29.894 | −16.914 | 120.349 | 1.00 | 29.50 | C |
| ATOM | 1255 | CE1 | HIS | A | 166 | −30.123 | −18.859 | 119.368 | 1.00 | 30.30 | C |
| ATOM | 1256 | NE2 | HIS | A | 166 | −30.025 | −18.267 | 120.541 | 1.00 | 29.10 | N |
| ATOM | 1257 | N | THR | A | 167 | −28.765 | −14.030 | 115.242 | 1.00 | 32.27 | N |
| ATOM | 1258 | CA | THR | A | 167 | −29.023 | −12.828 | 114.457 | 1.00 | 30.55 | C |
| ATOM | 1259 | C | THR | A | 167 | −30.473 | −12.820 | 113.997 | 1.00 | 29.36 | C |
| ATOM | 1260 | O | THR | A | 167 | −30.914 | −13.738 | 113.306 | 1.00 | 34.07 | O |

TABLE 10.4-continued

| | | | | | | | | | | |
|---|---|---|---|---|---|---|---|---|---|---|
| ATOM | 1261 | CB | THR | A | 167 | −28.089 | −12.737 | 113.264 | 1.00 | 24.74 | C |
| ATOM | 1262 | OG1 | THR | A | 167 | −26.740 | −12.697 | 113.745 | 1.00 | 35.43 | O |
| ATOM | 1263 | CG2 | THR | A | 167 | −28.377 | −11.481 | 112.509 | 1.00 | 23.22 | C |
| ATOM | 1264 | N | PHE | A | 168 | −31.182 | −11.797 | 114.351 | 1.00 | 28.41 | N |
| ATOM | 1265 | CA | PHE | A | 168 | −32.626 | −11.776 | 114.226 | 1.00 | 28.58 | C |
| ATOM | 1266 | C | PHE | A | 168 | −33.064 | −11.245 | 112.869 | 1.00 | 30.77 | C |
| ATOM | 1267 | O | PHE | A | 168 | −32.304 | −10.564 | 112.176 | 1.00 | 31.27 | O |
| ATOM | 1268 | CB | PHE | A | 168 | −33.222 | −10.953 | 115.358 | 1.00 | 22.95 | C |
| ATOM | 1269 | CG | PHE | A | 168 | −33.164 | −11.654 | 116.672 | 1.00 | 28.82 | C |
| ATOM | 1270 | CD1 | PHE | A | 168 | −34.177 | −12.526 | 117.052 | 1.00 | 30.01 | C |
| ATOM | 1271 | CD2 | PHE | A | 168 | −32.089 | −11.484 | 117.521 | 1.00 | 26.59 | C |
| ATOM | 1272 | CE1 | PHE | A | 168 | −34.120 | −13.192 | 118.269 | 1.00 | 26.13 | C |
| ATOM | 1273 | CE2 | PHE | A | 168 | −32.034 | −12.153 | 118.738 | 1.00 | 24.89 | C |
| ATOM | 1274 | CZ | PHE | A | 168 | −33.047 | −12.999 | 119.109 | 1.00 | 25.58 | C |
| ATOM | 1275 | N | PRO | A | 169 | −34.268 | −11.613 | 112.428 | 1.00 | 30.91 | N |
| ATOM | 1276 | CA | PRO | A | 169 | −34.825 | −10.991 | 111.221 | 1.00 | 28.45 | C |
| ATOM | 1277 | C | PRO | A | 169 | −35.017 | −9.500 | 111.445 | 1.00 | 30.28 | C |
| ATOM | 1278 | O | PRO | A | 169 | −35.392 | −9.063 | 112.534 | 1.00 | 26.91 | O |
| ATOM | 1279 | CB | PRO | A | 169 | −36.166 | −11.705 | 111.036 | 1.00 | 21.98 | C |
| ATOM | 1280 | CG | PRO | A | 169 | −36.064 | −12.951 | 111.870 | 1.00 | 25.73 | C |
| ATOM | 1281 | CD | PRO | A | 169 | −35.157 | −12.642 | 112.999 | 1.00 | 24.24 | C |
| ATOM | 1282 | N | ALA | A | 170 | −34.718 | −8.713 | 110.419 | 1.00 | 29.94 | N |
| ATOM | 1283 | CA | ALA | A | 170 | −34.909 | −7.277 | 110.530 | 1.00 | 28.66 | C |
| ATOM | 1284 | C | ALA | A | 170 | −36.397 | −6.962 | 110.631 | 1.00 | 24.51 | C |
| ATOM | 1285 | O | ALA | A | 170 | −37.231 | −7.715 | 110.147 | 1.00 | 20.86 | O |
| ATOM | 1286 | CB | ALA | A | 170 | −34.289 | −6.564 | 109.326 | 1.00 | 28.82 | C |
| ATOM | 1287 | N | VAL | A | 171 | −36.725 | −5.833 | 111.264 | 1.00 | 25.89 | N |
| ATOM | 1288 | CA | VAL | A | 171 | −38.070 | −5.279 | 111.200 | 1.00 | 24.76 | C |
| ATOM | 1289 | C | VAL | A | 171 | −38.012 | −4.012 | 110.358 | 1.00 | 28.48 | C |
| ATOM | 1290 | O | VAL | A | 171 | −36.997 | −3.307 | 110.326 | 1.00 | 27.98 | O |
| ATOM | 1291 | CB | VAL | A | 171 | −38.700 | −4.967 | 112.577 | 1.00 | 27.45 | C |
| ATOM | 1292 | CG1 | VAL | A | 171 | −38.882 | −6.245 | 113.387 | 1.00 | 27.65 | C |
| ATOM | 1293 | CG2 | VAL | A | 171 | −37.913 | −3.890 | 113.334 | 1.00 | 27.22 | C |
| ATOM | 1294 | N | LEU | A | 172 | −39.111 | −3.745 | 109.653 | 1.00 | 25.17 | N |
| ATOM | 1295 | CA | LEU | A | 172 | −39.301 | −2.534 | 108.867 | 1.00 | 27.51 | C |
| ATOM | 1296 | C | LEU | A | 172 | −40.092 | −1.517 | 109.692 | 1.00 | 31.05 | C |
| ATOM | 1297 | O | LEU | A | 172 | −41.270 | −1.730 | 109.995 | 1.00 | 33.68 | O |
| ATOM | 1298 | CB | LEU | A | 172 | −40.015 | −2.862 | 107.565 | 1.00 | 27.53 | C |
| ATOM | 1299 | CG | LEU | A | 172 | −40.360 | −1.652 | 106.713 | 1.00 | 31.73 | C |
| ATOM | 1300 | CD1 | LEU | A | 172 | −39.092 | −0.851 | 106.423 | 1.00 | 31.62 | C |
| ATOM | 1301 | CD2 | LE | A | 172 | −41.011 | −2.118 | 105.405 | 1.00 | 28.68 | C |
| ATOM | 1302 | N | GLN | A | 173 | −39.439 | −0.422 | 110.052 | 1.00 | 25.80 | N |
| ATOM | 1303 | CA | GLN | A | 173 | −40.029 | 0.612 | 110.877 | 1.00 | 31.71 | C |
| ATOM | 1304 | C | GLN | A | 173 | −40.841 | 1.595 | 110.033 | 1.00 | 34.79 | C |
| ATOM | 1305 | O | GLN | A | 173 | −40.706 | 1.669 | 108.805 | 1.00 | 31.87 | O |
| ATOM | 1306 | CB | GLN | A | 173 | −38.945 | 1.372 | 111.634 | 1.00 | 33.05 | C |
| ATOM | 1307 | CG | GLN | A | 173 | −37.969 | 0.495 | 112.392 | 1.00 | 33.17 | C |
| ATOM | 1308 | CD | GLN | A | 173 | −36.669 | 1.222 | 112.686 | 1.00 | 35.50 | C |
| ATOM | 1309 | OE1 | GLN | A | 173 | −36.309 | 1.424 | 113.850 | 1.00 | 39.44 | O |
| ATOM | 1310 | NE2 | GLN | A | 173 | −35.960 | 1.626 | 111.629 | 1.00 | 33.32 | N |
| ATOM | 1311 | N | SER | A | 174 | −41.681 | 2.378 | 110.726 | 1.00 | 34.71 | N |
| ATOM | 1312 | CA | SER | A | 174 | −42.563 | 3.323 | 110.049 | 1.00 | 30.21 | C |
| ATOM | 1313 | C | SER | A | 174 | −41.773 | 4.343 | 109.245 | 1.00 | 31.66 | C |
| ATOM | 1314 | O | SER | A | 174 | −42.322 | 4.937 | 108.314 | 1.00 | 34.94 | O |
| ATOM | 1315 | CB | SER | A | 174 | −43.461 | 4.017 | 111.063 | 1.00 | 31.49 | C |
| ATOM | 1316 | OG | SER | A | 174 | −42.708 | 4.905 | 111.882 | 1.00 | 40.96 | O |
| ATOM | 1317 | N | SER | A | 175 | −40.480 | 4.495 | 109.533 | 1.00 | 29.45 | N |
| ATOM | 1318 | CA | SER | A | 175 | −39.594 | 5.363 | 108.769 | 1.00 | 29.62 | C |
| ATOM | 1319 | C | SER | A | 175 | −39.270 | 4.831 | 107.374 | 1.00 | 37.39 | C |
| ATOM | 1320 | O | SER | A | 175 | −38.665 | 5.564 | 106.581 | 1.00 | 35.03 | O |
| ATOM | 1321 | CB | SER | A | 175 | −38.288 | 5.558 | 109.531 | 1.00 | 26.45 | C |
| ATOM | 1322 | OG | SER | A | 175 | −37.522 | 4.366 | 109.537 | 1.00 | 33.35 | O |
| ATOM | 1323 | N | GLY | A | 176 | −39.610 | 3.574 | 107.068 | 1.00 | 33.52 | N |
| ATOM | 1324 | CA | GLY | A | 176 | −39.139 | 2.922 | 105.865 | 1.00 | 26.71 | C |
| ATOM | 1325 | C | GLY | A | 176 | −37.767 | 2.308 | 105.988 | 1.00 | 28.94 | C |
| ATOM | 1326 | O | GLY | A | 176 | −37.323 | 1.632 | 105.061 | 1.00 | 33.48 | O |
| ATOM | 1327 | N | LEU | A | 177 | −37.105 | 2.482 | 107.118 | 1.00 | 31.53 | N |
| ATOM | 1328 | CA | LEU | A | 177 | −35.796 | 1.912 | 107.374 | 1.00 | 32.69 | C |
| ATOM | 1329 | C | LEU | A | 177 | −35.924 | 0.601 | 108.155 | 1.00 | 33.78 | C |
| ATOM | 1330 | O | LEU | A | 177 | −36.839 | 0.412 | 108.965 | 1.00 | 27.20 | O |
| ATOM | 1331 | CB | LEU | A | 177 | −34.937 | 2.932 | 108.138 | 1.00 | 30.37 | C |
| ATOM | 1332 | CG | LEU | A | 177 | −34.691 | 4.252 | 107.381 | 1.00 | 31.43 | C |
| ATOM | 1333 | CD1 | LEU | A | 177 | −33.897 | 5.220 | 108.180 | 1.00 | 29.09 | C |
| ATOM | 1334 | CD2 | LEU | A | 177 | −33.948 | 4.024 | 106.072 | 1.00 | 32.81 | C |
| ATOM | 1335 | N | TYR | A | 178 | −34.979 | −0.299 | 107.915 | 1.00 | 32.33 | N |
| ATOM | 1336 | CA | TYR | A | 178 | −34.938 | −1.580 | 108.601 | 1.00 | 31.28 | C |
| ATOM | 1337 | C | TYR | A | 178 | −34.061 | −1.480 | 109.848 | 1.00 | 31.26 | C |
| ATOM | 1338 | O | TYR | A | 178 | −33.221 | −0.589 | 109.975 | 1.00 | 30.90 | O |
| ATOM | 1339 | CB | TYR | A | 178 | −34.399 | −2.679 | 107.681 | 1.00 | 30.14 | C |
| ATOM | 1340 | CG | TYR | A | 178 | −35.311 | −3.040 | 106.535 | 1.00 | 29.91 | C |

TABLE 10.4-continued

| | | | | | | | | | | |
|---|---|---|---|---|---|---|---|---|---|---|
| ATOM | 1341 | CD2 | TYR | A | 178 | −35.140 | −2.470 | 105.275 | 1.00 | 30.71 | C |
| ATOM | 1342 | CD1 | TYR | A | 178 | −36.324 | −3.960 | 106.703 | 1.00 | 28.37 | C |
| ATOM | 1343 | CE2 | TYR | A | 178 | −35.966 | −2.793 | 104.226 | 1.00 | 32.21 | C |
| ATOM | 1344 | CE1 | TYR | A | 178 | −37.160 | −4.287 | 105.667 | 1.00 | 29.97 | C |
| ATOM | 1345 | CZ | TYR | A | 178 | −36.984 | −3.704 | 104.426 | 1.00 | 34.62 | C |
| ATOM | 1346 | OH | TYR | A | 178 | −37.822 | −4.043 | 103.385 | 1.00 | 35.36 | O |
| ATOM | 1347 | N | SER | A | 179 | −34.265 | −2.425 | 110.764 | 1.00 | 31.86 | N |
| ATOM | 1348 | CA | SER | A | 179 | −33.513 | −2.503 | 112.007 | 1.00 | 29.05 | C |
| ATOM | 1349 | C | SER | A | 179 | −33.405 | −3.960 | 112.453 | 1.00 | 30.76 | C |
| ATOM | 1350 | O | SER | A | 179 | −34.418 | −4.660 | 112.534 | 1.00 | 31.95 | O |
| ATOM | 1351 | CB | SER | A | 179 | −34.185 | −1.669 | 113.086 | 1.00 | 29.95 | C |
| ATOM | 1352 | OG | SER | A | 179 | −33.208 | −1.108 | 113.936 | 1.00 | 40.38 | O |
| ATOM | 1353 | N | LEU | A | 180 | −32.192 | −4.427 | 112.737 | 1.00 | 28.38 | N |
| ATOM | 1354 | CA | LEU | A | 180 | −32.044 | −5.768 | 113.282 | 1.00 | 31.63 | C |
| ATOM | 1355 | C | LEU | A | 180 | −31.118 | −5.768 | 114.492 | 1.00 | 29.92 | C |
| ATOM | 1356 | O | LEU | A | 180 | −30.388 | −4.810 | 114.763 | 1.00 | 25.79 | O |
| ATOM | 1357 | CB | LEU | A | 180 | −31.555 | −6.783 | 112.224 | 1.00 | 30.26 | C |
| ATOM | 1358 | CG | LEU | A | 180 | −30.143 | −7.049 | 111.701 | 1.00 | 31.57 | C |
| ATOM | 1359 | CD1 | LEU | A | 180 | −29.103 | −7.464 | 112.770 | 1.00 | 28.74 | C |
| ATOM | 1360 | CD2 | LEU | A | 180 | −30.291 | −8.158 | 110.658 | 1.00 | 28.38 | C |
| ATOM | 1361 | N | SER | A | 181 | −31.159 | −6.872 | 115.228 | 1.00 | 25.89 | N |
| ATOM | 1362 | CA | SER | A | 181 | −30.261 | −7.060 | 116.348 | 1.00 | 29.69 | C |
| ATOM | 1363 | C | SER | A | 181 | −29.651 | −8.454 | 116.283 | 1.00 | 34.25 | C |
| ATOM | 1364 | O | SER | A | 181 | −30.228 | −9.383 | 115.710 | 1.00 | 28.49 | O |
| ATOM | 1365 | CB | SER | A | 181 | −30.972 | −6.840 | 117.680 | 1.00 | 32.18 | C |
| ATOM | 1366 | OG | SER | A | 181 | −31.900 | −7.868 | 117.927 | 1.00 | 34.51 | O |
| ATOM | 1367 | N | SER | A | 182 | −28.451 | −8.572 | 116.852 | 1.00 | 34.33 | N |
| ATOM | 1368 | CA | SER | A | 182 | −27.720 | −9.826 | 116.939 | 1.00 | 31.79 | C |
| ATOM | 1369 | C | SER | A | 182 | −27.166 | −9.956 | 118.351 | 1.00 | 29.53 | C |
| ATOM | 1370 | O | SER | A | 182 | −26.634 | −8.992 | 118.899 | 1.00 | 29.22 | O |
| ATOM | 1371 | CB | SER | A | 182 | −26.589 | −9.875 | 115.889 | 1.00 | 28.22 | C |
| ATOM | 1372 | OG | SER | A | 182 | −25.793 | −11.040 | 116.033 | 1.00 | 32.19 | O |
| ATOM | 1373 | N | VAL | A | 183 | −27.302 | −11.140 | 118.946 | 1.00 | 31.33 | N |
| ATOM | 1374 | CA | VAL | A | 183 | −26.891 | −11.353 | 120.329 | 1.00 | 32.43 | C |
| ATOM | 1375 | C | VAL | A | 183 | −26.090 | −12.648 | 120.461 | 1.00 | 34.27 | C |
| ATOM | 1376 | O | VAL | A | 183 | −26.118 | −13.530 | 119.599 | 1.00 | 34.59 | O |
| ATOM | 1377 | CB | VAL | A | 183 | −28.100 | −11.386 | 121.290 | 1.00 | 34.07 | C |
| ATOM | 1378 | CG1 | VAL | A | 183 | −28.915 | −10.138 | 121.139 | 1.00 | 30.31 | C |
| ATOM | 1379 | CG2 | VAL | A | 183 | −28.962 | −12.619 | 121.027 | 1.00 | 34.20 | C |
| ATOM | 1380 | N | VAL | A | 184 | −25.370 | −12.750 | 121.567 | 1.00 | 30.31 | N |
| ATOM | 1381 | CA | VAL | A | 184 | −24.615 | −13.950 | 121.895 | 1.00 | 34.88 | C |
| ATOM | 1382 | C | VAL | A | 184 | −24.629 | −14.101 | 123.409 | 1.00 | 36.21 | C |
| ATOM | 1383 | O | VAL | A | 184 | −24.549 | −13.112 | 124.145 | 1.00 | 36.42 | O |
| ATOM | 1384 | CB | VAL | A | 184 | −23.172 | −13.893 | 121.322 | 1.00 | 36.52 | C |
| ATOM | 1385 | CG1 | VAL | A | 184 | −22.405 | −12.622 | 121.770 | 1.00 | 28.53 | C |
| ATOM | 1386 | CG2 | VAL | A | 184 | −22.413 | −15.146 | 121.668 | 1.00 | 28.44 | C |
| ATOM | 1387 | N | THR | A | 185 | −24.800 | −15.335 | 123.876 | 1.00 | 37.42 | N |
| ATOM | 1388 | CA | THR | A | 185 | −24.681 | −15.649 | 125.290 | 1.00 | 33.86 | C |
| ATOM | 1389 | C | THR | A | 185 | −23.296 | −16.235 | 125.522 | 1.00 | 36.91 | C |
| ATOM | 1390 | O | THR | A | 185 | −22.829 | −17.074 | 124.744 | 1.00 | 36.01 | O |
| ATOM | 1391 | CB | THR | A | 185 | −25.772 | −16.614 | 125.758 | 1.00 | 36.45 | C |
| ATOM | 1392 | OG1 | THR | A | 185 | −25.864 | −17.719 | 124.850 | 1.00 | 42.60 | O |
| ATOM | 1393 | CG2 | THR | A | 185 | −27.110 | −15.912 | 125.804 | 1.00 | 34.96 | C |
| ATOM | 1394 | N | VAL | A | 186 | −22.632 | −15.755 | 126.567 | 1.00 | 40.17 | N |
| ATOM | 1395 | CA | VAL | A | 186 | −21.268 | −16.144 | 126.917 | 1.00 | 38.85 | C |
| ATOM | 1396 | C | VAL | A | 186 | −21.196 | −16.288 | 128.432 | 1.00 | 47.21 | C |
| ATOM | 1397 | O | VAL | A | 186 | −22.080 | −15.806 | 129.155 | 1.00 | 45.09 | O |
| ATOM | 1398 | CB | VAL | A | 186 | −20.244 | −15.102 | 126.425 | 1.00 | 36.70 | C |
| ATOM | 1399 | CG1 | VAL | A | 186 | −20.351 | −14.919 | 124.902 | 1.00 | 33.73 | C |
| ATOM | 1400 | CG2 | VAL | A | 186 | −20.485 | −13.768 | 127.107 | 1.00 | 35.85 | C |
| ATOM | 1401 | N | PRO | A | 187 | −20.161 | −16.964 | 128.944 | 1.00 | 47.74 | N |
| ATOM | 1402 | CA | PRO | A | 187 | −20.031 | −17.090 | 130.404 | 1.00 | 46.98 | C |
| ATOM | 1403 | C | PRO | A | 187 | −19.776 | −15.738 | 131.058 | 1.00 | 48.85 | C |
| ATOM | 1404 | O | PRO | A | 187 | −19.016 | −14.922 | 130.538 | 1.00 | 46.36 | O |
| ATOM | 1405 | CB | PRO | A | 187 | −18.830 | −18.026 | 130.571 | 1.00 | 43.33 | C |
| ATOM | 1406 | CG | PRO | A | 187 | −18.751 | −18.759 | 129.303 | 1.00 | 39.13 | C |
| ATOM | 1407 | CO | PRO | A | 187 | −19.170 | −17.794 | 128.244 | 1.00 | 43.58 | C |
| ATOM | 1408 | N | SER | A | 188 | −20.423 | −15.509 | 132.208 | 1.00 | 50.33 | N |
| ATOM | 1409 | CA | SER | A | 188 | −20.194 | −14.283 | 132.972 | 1.00 | 47.34 | C |
| ATOM | 1410 | C | SER | A | 188 | −18.715 | −14.066 | 133.275 | 1.00 | 55.46 | C |
| ATOM | 1411 | O | SER | A | 188 | −18.208 | −12.942 | 133.158 | 1.00 | 49.43 | O |
| ATOM | 1412 | CB | SER | A | 188 | −21.001 | −14.310 | 134.262 | 1.00 | 52.91 | C |
| ATOM | 1413 | OG | SER | A | 188 | −22.363 | −14.112 | 133.973 | 1.00 | 59.47 | O |
| ATOM | 1414 | N | SER | A | 189 | −18.010 | −15.127 | 133.685 | 1.00 | 55.39 | N |
| ATOM | 1415 | CA | SER | A | 189 | −16.590 | −15.005 | 134.003 | 1.00 | 55.76 | C |
| ATOM | 1416 | C | SER | A | 189 | −15.769 | −14.513 | 132.811 | 1.00 | 58.34 | C |
| ATOM | 1417 | O | SER | A | 189 | −14.681 | −13.951 | 133.002 | 1.00 | 59.39 | O |
| ATOM | 1418 | CB | SER | A | 189 | −16.042 | −16.351 | 134.478 | 1.00 | 56.17 | C |
| ATOM | 1419 | OG | SER | A | 189 | −16.101 | −17.316 | 133.435 | 1.00 | 52.74 | O |
| ATOM | 1420 | N | SER | A | 190 | −16.276 | −14.687 | 131.590 | 1.00 | 53.51 | N |

TABLE 10.4-continued

| | | | | | | | | | | |
|---|---|---|---|---|---|---|---|---|---|---|
| ATOM | 1421 | CA | SER | A | 190 | −15.528 | −14.312 | 130.396 | 1.00 | 56.22 | C |
| ATOM | 1422 | C | SER | A | 190 | −15.594 | −12.816 | 130.086 | 1.00 | 54.08 | C |
| ATOM | 1423 | O | SER | A | 190 | −14.802 | −12.330 | 129.265 | 1.00 | 51.28 | O |
| ATOM | 1424 | CB | SER | A | 190 | −16.020 | −15.138 | 129.197 | 1.00 | 51.36 | C |
| ATOM | 1425 | OG | SER | A | 190 | −17.368 | −14.852 | 128.863 | 1.00 | 46.74 | O |
| ATOM | 1426 | N | LEU | A | 191 | −16.523 | −12.081 | 130.693 | 1.00 | 53.01 | N |
| ATOM | 1427 | CA | LEU | A | 191 | −16.577 | −10.644 | 130.464 | 1.00 | 53.09 | C |
| ATOM | 1428 | C | LEU | A | 191 | −15.339 | −9.981 | 131.058 | 1.00 | 54.27 | C |
| ATOM | 1429 | O | LEU | A | 191 | −14.790 | −10.428 | 132.071 | 1.00 | 58.30 | O |
| ATOM | 1430 | CB | LEU | A | 191 | −17.839 | −10.054 | 131.081 | 1.00 | 38.62 | C |
| ATOM | 1431 | CG | LEU | A | 191 | −19.093 | −10.795 | 130.646 | 1.00 | 45.96 | C |
| ATOM | 1432 | CD1 | LEU | A | 191 | −20.297 | −10.313 | 131.431 | 1.00 | 42.60 | C |
| ATOM | 1433 | CD2 | LEU | A | 191 | −19.308 | −10.675 | 129.131 | 1.00 | 40.49 | C |
| ATOM | 1434 | N | GLY | A | 192 | −14.896 | −8.905 | 130.421 | 1.00 | 50.04 | N |
| ATOM | 1435 | CA | GLY | A | 192 | −13.722 | −8.196 | 130.886 | 1.00 | 59.39 | C |
| ATOM | 1436 | C | GLY | A | 192 | −12.384 | −8.841 | 130.570 | 1.00 | 59.35 | C |
| ATOM | 1437 | O | GLY | A | 192 | −11.382 | −8.120 | 130.468 | 1.00 | 65.09 | O |
| ATOM | 1438 | N | THR | A | 193 | −12.332 | −10.163 | 130.376 | 1.00 | 50.42 | N |
| ATOM | 1439 | CA | THR | A | 193 | −11.152 | −10.830 | 129.835 | 1.00 | 51.34 | C |
| ATOM | 1440 | C | THR | A | 193 | −11.269 | −11.178 | 128.350 | 1.00 | 53.60 | C |
| ATOM | 1441 | O | THR | A | 193 | −10.257 | −11.147 | 127.651 | 1.00 | 57.09 | O |
| ATOM | 1442 | CB | THR | A | 193 | −10.822 | −12.109 | 130.622 | 1.00 | 56.32 | C |
| ATOM | 1443 | OG1 | THR | A | 193 | −11.943 | −12.512 | 131.418 | 1.00 | 57.77 | O |
| ATOM | 1444 | CG2 | THR | A | 193 | −9.595 | −11.892 | 131.523 | 1.00 | 48.53 | C |
| ATOM | 1445 | N | GLN | A | 194 | −12.451 | −11.519 | 127.838 | 1.00 | 53.81 | N |
| ATOM | 1446 | CA | GLN | A | 194 | −12.619 | −11.879 | 126.431 | 1.00 | 47.52 | C |
| ATOM | 1447 | C | GLN | A | 194 | −13.238 | −10.716 | 125.660 | 1.00 | 45.35 | C |
| ATOM | 1448 | O | GLN | A | 194 | −14.169 | −10.066 | 126.142 | 1.00 | 47.02 | O |
| ATOM | 1449 | CB | GLN | A | 194 | −13.512 | −13.111 | 126.292 | 1.00 | 46.52 | C |
| ATOM | 1450 | CG | GLN | A | 194 | −13.761 | −13.550 | 124.857 | 1.00 | 46.74 | C |
| ATOM | 1451 | CD | GLN | A | 194 | −12.496 | −13.985 | 124.141 | 1.00 | 53.73 | C |
| ATOM | 1452 | OE1 | GLN | A | 194 | −12.011 | −13.301 | 123.239 | 1.00 | 52.18 | O |
| ATOM | 1453 | NE2 | GLN | A | 194 | −11.967 | −15.148 | 124.528 | 1.00 | 50.74 | N |
| ATOM | 1454 | N | THR | A | 195 | −12.745 | −10.462 | 124.453 | 1.00 | 44.88 | N |
| ATOM | 1455 | CA | THR | A | 195 | −13.244 | −9.345 | 123.657 | 1.00 | 46.31 | C |
| ATOM | 1456 | C | THR | A | 195 | −14.325 | −9.802 | 122.680 | 1.00 | 43.67 | C |
| ATOM | 1457 | O | THR | A | 195 | −14.211 | −10.862 | 122.057 | 1.00 | 41.58 | O |
| ATOM | 1458 | CB | THR | A | 195 | −12.104 | −8.651 | 122.909 | 1.00 | 53.06 | C |
| ATOM | 1459 | OG1 | THR | A | 195 | −11.441 | −7.742 | 123.803 | 1.00 | 57.28 | O |
| ATOM | 1460 | CG2 | THR | A | 195 | −12.631 | −7.884 | 121.694 | 1.00 | 42.53 | C |
| ATOM | 1461 | N | TYR | A | 196 | −15.393 | −9.007 | 122.579 | 1.00 | 43.78 | N |
| ATOM | 1462 | CA | TYR | A | 196 | −16.551 | −9.321 | 121.750 | 1.00 | 36.48 | C |
| ATOM | 1463 | C | TYR | A | 196 | −16.798 | −8.201 | 120.755 | 1.00 | 34.63 | C |
| ATOM | 1464 | O | TYR | A | 196 | −17.090 | −7.066 | 121.139 | 1.00 | 34.38 | O |
| ATOM | 1465 | CB | TYR | A | 196 | −17.769 | −9.564 | 122.621 | 1.00 | 32.34 | C |
| ATOM | 1466 | CG | TYR | A | 196 | −17.567 | −10.773 | 123.470 | 1.00 | 38.36 | C |
| ATOM | 1467 | CD1 | TYR | A | 196 | −17.517 | −12.036 | 122.900 | 1.00 | 36.90 | C |
| ATOM | 1468 | CD2 | TYR | A | 196 | −17.359 | −10.655 | 124.830 | 1.00 | 39.09 | C |
| ATOM | 1469 | CE1 | TYR | A | 196 | −17.316 | −13.151 | 123.676 | 1.00 | 37.95 | C |
| ATOM | 1470 | CE2 | TYR | A | 196 | −17.147 | −11.755 | 125.605 | 1.00 | 39.61 | C |
| ATOM | 1471 | CZ | TYR | A | 196 | −17.129 | −13.001 | 125.028 | 1.00 | 39.92 | C |
| ATOM | 1472 | OH | TYR | A | 196 | −16.921 | −14.098 | 125.825 | 1.00 | 47.25 | O |
| ATOM | 1473 | N | ILE | A | 197 | −16.653 | −8.516 | 119.478 | 1.00 | 35.82 | N |
| ATOM | 1474 | CA | ILE | A | 197 | −16.831 | −7.548 | 118.405 | 1.00 | 36.37 | C |
| ATOM | 1475 | C | ILE | A | 197 | −17.841 | −8.108 | 117.422 | 1.00 | 30.22 | C |
| ATOM | 1476 | O | ILE | A | 197 | −17.783 | −9.287 | 117.065 | 1.00 | 32.67 | O |
| ATOM | 1477 | CB | ILE | A | 197 | −15.496 | −7.222 | 117.702 | 1.00 | 32.39 | C |
| ATOM | 1478 | CG1 | ILE | A | 197 | −14.528 | −6.609 | 118.709 | 1.00 | 32.03 | C |
| ATOM | 1479 | CG2 | ILE | A | 197 | −15.722 | −6.302 | 116.521 | 1.00 | 28.21 | C |
| ATOM | 1480 | CD1 | ILE | A | 197 | −13.138 | −6.617 | 118.246 | 1.00 | 30.83 | C |
| ATOM | 1481 | N | CYS | A | 198 | −18.784 | −7.287 | 117.016 | 1.00 | 34.51 | N |
| ATOM | 1482 | CA | CYS | A | 198 | −19.717 | −7.687 | 115.984 | 1.00 | 35.67 | C |
| ATOM | 1483 | C | CYS | A | 198 | −19.346 | −7.002 | 114.676 | 1.00 | 33.53 | C |
| ATOM | 1484 | O | CYS | A | 198 | −19.039 | −5.805 | 114.645 | 1.00 | 32.08 | O |
| ATOM | 1485 | CB | CYS | A | 198 | −21.157 | −7.379 | 116.404 | 1.00 | 36.62 | C |
| ATOM | 1486 | SG | CYS | A | 198 | −21.662 | −5.699 | 116.191 | 1.00 | 46.42 | S |
| ATOM | 1487 | N | ASN | A | 199 | −19.373 | −7.777 | 113.598 | 1.00 | 31.00 | N |
| ATOM | 1488 | CA | ASN | A | 199 | −18.952 | −7.325 | 112.279 | 1.00 | 34.62 | C |
| ATOM | 1489 | C | ASN | A | 199 | −20.212 | −7.179 | 111.438 | 1.00 | 30.03 | C |
| ATOM | 1490 | O | ASN | A | 199 | −20.926 | −8.157 | 111.205 | 1.00 | 33.61 | O |
| ATOM | 1491 | CB | ASN | A | 199 | −17.969 | −8.322 | 111.669 | 1.00 | 30.80 | C |
| ATOM | 1492 | CG | ASN | A | 199 | −16.998 | −8.861 | 112.691 | 1.00 | 33.45 | C |
| ATOM | 1493 | OD1 | ASN | A | 199 | −17.071 | −10.028 | 113.087 | 1.00 | 30.25 | O |
| ATOM | 1494 | ND2 | ASN | A | 199 | −16.090 | −8.004 | 113.146 | 1.00 | 31.39 | N |
| ATOM | 1495 | N | VAL | A | 200 | −20.530 | −5.961 | 111.036 | 1.00 | 25.18 | N |
| ATOM | 1496 | CA | VAL | A | 200 | −21.753 | −5.699 | 110.295 | 1.00 | 31.02 | C |
| ATOM | 1497 | C | VAL | A | 200 | −21.346 | −5.394 | 108.868 | 1.00 | 31.80 | C |
| ATOM | 1498 | O | VAL | A | 200 | −20.402 | −4.632 | 108.642 | 1.00 | 32.16 | O |
| ATOM | 1499 | CB | VAL | A | 200 | −22.581 | −4.546 | 110.896 | 1.00 | 26.09 | C |
| ATOM | 1500 | CG1 | VAL | A | 200 | −23.862 | −4.409 | 110.130 | 1.00 | 31.91 | C |

TABLE 10.4-continued

| ATOM | 1501 | CG2 | VAL | A | 200 | −22.900 | −4.792 | 112.348 | 1.00 | 27.12 | C |
|---|---|---|---|---|---|---|---|---|---|---|---|
| ATOM | 1502 | N | ASN | A | 201 | −22.022 | −6.016 | 107.910 | 1.00 | 31.12 | N |
| ATOM | 1503 | CA | ASN | A | 201 | −21.800 | −5.693 | 106.511 | 1.00 | 34.13 | C |
| ATOM | 1504 | C | ASN | A | 201 | −23.127 | −5.341 | 105.866 | 1.00 | 32.42 | C |
| ATOM | 1505 | O | ASN | A | 201 | −24.065 | −6.141 | 105.883 | 1.00 | 35.02 | O |
| ATOM | 1506 | CB | ASN | A | 201 | −21.122 | −6.839 | 105.767 | 1.00 | 36.09 | C |
| ATOM | 1507 | CG | ASN | A | 201 | −20.557 | −6.390 | 104.457 | 1.00 | 39.19 | C |
| ATOM | 1508 | OD1 | ASN | A | 201 | −20.860 | −5.296 | 104.000 | 1.00 | 43.01 | O |
| ATOM | 1509 | ND2 | ASN | A | 201 | −19.730 | −7.218 | 103.844 | 1.00 | 44.41 | N |
| ATOM | 1510 | N | HIS | A | 202 | −23.222 | −4.123 | 105.361 | 1.00 | 34.15 | N |
| ATOM | 1511 | CA | HIS | A | 202 | −24.349 | −3.682 | 104.561 | 1.00 | 33.64 | C |
| ATOM | 1512 | C | HIS | A | 202 | −23.801 | −3.403 | 103.168 | 1.00 | 39.81 | C |
| ATOM | 1513 | O | HIS | A | 202 | −23.463 | −2.264 | 102.836 | 1.00 | 37.99 | O |
| ATOM | 1514 | CB | HIS | A | 202 | −25.001 | −2.473 | 105.147 | 1.00 | 31.71 | C |
| ATOM | 1515 | CG | HIS | A | 202 | −26.244 | −2.052 | 104.425 | 1.00 | 37.75 | C |
| ATOM | 1516 | ND1 | HIS | A | 202 | −26.419 | −0.780 | 103.917 | 1.00 | 38.12 | N |
| ATOM | 1517 | CD2 | HIS | A | 202 | −27.377 | −2.735 | 104.129 | 1.00 | 32.94 | C |
| ATOM | 1518 | CE1 | HIS | A | 202 | −27.607 | −0.699 | 103.344 | 1.00 | 37.74 | C |
| ATOM | 1519 | NE2 | HIS | A | 202 | −28.210 | −1.871 | 103.463 | 1.00 | 34.91 | N |
| ATOM | 1520 | N | LYS | A | 203 | −23.690 | −4.461 | 102.359 | 1.00 | 34.79 | N |
| ATOM | 1521 | CA | LYS | A | 203 | −23.249 | −4.285 | 100.978 | 1.00 | 35.75 | C |
| ATOM | 1522 | C | LYS | A | 203 | −24.071 | −3.261 | 100.195 | 1.00 | 39.45 | C |
| ATOM | 1523 | O | LYS | A | 203 | −23.482 | −2.573 | 99.346 | 1.00 | 38.28 | O |
| ATOM | 1524 | CB | LYS | A | 203 | −23.166 | −5.647 | 100.266 | 1.00 | 29.77 | C |
| ATOM | 1525 | CG | LYS | A | 203 | −21.879 | −6.425 | 100.649 | 1.00 | 40.20 | C |
| ATOM | 1526 | CD | LYS | A | 203 | −20.652 | −5.726 | 99.988 | 1.00 | 63.25 | C |
| ATOM | 1527 | CE | LYS | A | 203 | −19.279 | −6.000 | 100.660 | 1.00 | 68.58 | C |
| ATOM | 1528 | NZ | LYS | A | 203 | −18.938 | −7.439 | 100.898 | 1.00 | 69.85 | N1+ |
| ATOM | 1529 | N | PRO | A | 204 | −25.392 | −3.108 | 100.390 | 1.00 | 41.00 | N |
| ATOM | 1530 | CA | PRO | A | 204 | −26.120 | −2.121 | 99.566 | 1.00 | 38.96 | C |
| ATOM | 1531 | C | PRO | A | 204 | −25.629 | −0.681 | 99.705 | 1.00 | 40.45 | C |
| ATOM | 1532 | O | PRO | A | 204 | −25.839 | 0.144 | 98.782 | 1.00 | 44.07 | O |
| ATOM | 1533 | CB | PRO | A | 204 | −27.568 | −2.272 | 100.043 | 1.00 | 36.97 | C |
| ATOM | 1534 | CG | PRO | A | 204 | −27.647 | −3.652 | 100.563 | 1.00 | 35.26 | C |
| ATOM | 1535 | CD | PRO | A | 204 | −26.327 | −3.952 | 101.168 | 1.00 | 33.30 | C |
| ATOM | 1536 | N | SER | A | 205 | −25.061 | −0.287 | 100.845 | 1.00 | 42.01 | N |
| ATOM | 1537 | CA | SER | A | 205 | −24.455 | 1.034 | 100.993 | 1.00 | 40.43 | C |
| ATOM | 1538 | C | SER | A | 205 | −22.931 | 0.956 | 101.094 | 1.00 | 39.05 | C |
| ATOM | 1539 | O | SER | A | 205 | −22.279 | 1.963 | 101.369 | 1.00 | 37.64 | O |
| ATOM | 1540 | CB | SER | A | 205 | −25.052 | 1.778 | 102.195 | 1.00 | 35.25 | C |
| ATOM | 1541 | CG | SER | A | 205 | −24.659 | 1.213 | 103.424 | 1.00 | 36.65 | O |
| ATOM | 1542 | N | ASN | A | 206 | −22.354 | −0.219 | 100.868 | 1.00 | 42.36 | N |
| ATOM | 1543 | CA | ASN | A | 206 | −20.919 | −0.449 | 101.017 | 1.00 | 44.31 | C |
| ATOM | 1544 | C | ASN | A | 206 | −20.414 | 0.021 | 102.382 | 1.00 | 46.67 | C |
| ATOM | 1545 | O | ASN | A | 206 | −19.385 | 0.680 | 102.506 | 1.00 | 50.37 | O |
| ATOM | 1546 | CB | ASN | A | 206 | −20.146 | 0.208 | 99.880 | 1.00 | 49.52 | C |
| ATOM | 1547 | CG | ASN | A | 206 | −19.229 | −0.766 | 99.187 | 1.00 | 61.70 | C |
| ATOM | 1548 | OD1 | ASN | A | 206 | −19.323 | −1.979 | 99.401 | 1.00 | 67.47 | O |
| ATOM | 1549 | ND2 | ASN | A | 206 | −18.336 | −0.253 | 98.352 | 1.00 | 70.26 | N |
| ATOM | 1550 | N | THR | A | 207 | −21.150 | −0.352 | 103.423 | 1.00 | 45.98 | N |
| ATOM | 1551 | CA | THR | A | 207 | −20.861 | 0.041 | 104.792 | 1.00 | 36.87 | C |
| ATOM | 1552 | C | THR | A | 207 | −20.417 | −1.180 | 105.574 | 1.00 | 37.03 | C |
| ATOM | 1553 | O | THR | A | 207 | −21.118 | −2.192 | 105.590 | 1.00 | 41.13 | O |
| ATOM | 1554 | CB | THR | A | 207 | −22.100 | 0.626 | 105.457 | 1.00 | 42.00 | C |
| ATOM | 1555 | OG1 | THR | A | 207 | −22.616 | 1.689 | 104.649 | 1.00 | 45.30 | O |
| ATOM | 1556 | CG2 | THR | A | 207 | −21.767 | 1.132 | 106.876 | 1.00 | 42.01 | C |
| ATOM | 1557 | N | LYS | A | 208 | −19.263 | −1.088 | 106.210 | 1.00 | 36.32 | N |
| ATOM | 1558 | CA | LYS | A | 208 | −18.793 | −2.110 | 107.127 | 1.00 | 32.74 | C |
| ATOM | 1559 | C | LYS | A | 208 | −18.511 | −1.465 | 108.478 | 1.00 | 34.61 | C |
| ATOM | 1560 | O | LYS | A | 208 | −18.088 | −0.307 | 108.545 | 1.00 | 39.61 | O |
| ATOM | 1561 | CB | LYS | A | 208 | −17.552 | −2.827 | 106.585 | 1.00 | 40.21 | C |
| ATOM | 1562 | CG | LYS | A | 208 | −17.865 | −3.863 | 105.502 | 1.00 | 39.11 | C |
| ATOM | 1563 | CD | LYS | A | 208 | −16.707 | −4.821 | 105.239 | 1.00 | 34.67 | C |
| ATOM | 1564 | CE | LYS | A | 208 | −15.518 | −4.128 | 104.606 | 1.00 | 49.09 | C |
| ATOM | 1565 | NZ | LYS | A | 208 | −14.349 | −5.076 | 104.456 | 1.00 | 57.65 | N1+ |
| ATOM | 1566 | N | VAL | A | 209 | −18.846 | −2.174 | 109.552 | 1.00 | 32.84 | N |
| ATOM | 1567 | CA | VAL | A | 209 | −18.671 | −1.684 | 110.917 | 1.00 | 32.20 | C |
| ATOM | 1568 | C | VAL | A | 209 | −18.247 | −2.844 | 111.797 | 1.00 | 34.40 | C |
| ATOM | 1569 | O | VAL | A | 209 | −18.906 | −3.889 | 111.817 | 1.00 | 38.11 | O |
| ATOM | 1570 | CB | VAL | A | 209 | −19.960 | −1.054 | 111.491 | 1.00 | 31.14 | C |
| ATOM | 1571 | CG1 | VAL | A | 209 | −19.816 | −0.826 | 112.974 | 1.00 | 27.96 | C |
| ATOM | 1572 | CG2 | VAL | A | 209 | −20.276 | 0.252 | 110.810 | 1.00 | 26.07 | C |
| ATOM | 1573 | N | ASP | A | 210 | −17.195 | −2.642 | 112.574 | 1.00 | 36.64 | N |
| ATOM | 1574 | CA | ASP | A | 210 | −16.821 | −3.545 | 113.659 | 1.00 | 33.62 | C |
| ATOM | 1575 | C | ASP | A | 210 | −17.053 | −2.791 | 114.962 | 1.00 | 30.39 | C |
| ATOM | 1576 | O | ASP | A | 210 | −16.490 | −1.718 | 115.159 | 1.00 | 32.48 | O |
| ATOM | 1577 | CB | ASP | A | 210 | −15.360 | −3.980 | 113.548 | 1.00 | 32.01 | C |
| ATOM | 1578 | CG | ASP | A | 210 | −15.084 | −4.843 | 112.325 | 1.00 | 42.55 | C |
| ATOM | 1579 | OD1 | ASP | A | 210 | −15.829 | −5.839 | 112.124 | 1.00 | 46.60 | O |
| ATOM | 1580 | OD2 | ASP | A | 210 | −14.119 | −4.527 | 111.570 | 1.00 | 34.51 | O1− |

TABLE 10.4-continued

| | | | | | | | | | | |
|---|---|---|---|---|---|---|---|---|---|---|
| ATOM | 1581 | N | LYS | A | 211 | −17.904 | −3.319 | 115.827 | 1.00 | 34.41 | N |
| ATOM | 1582 | CA | LYS | A | 211 | −18.270 | −2.654 | 117.073 | 1.00 | 28.87 | C |
| ATOM | 1583 | C | LYS | A | 211 | −17.832 | −3.519 | 118.243 | 1.00 | 33.13 | C |
| ATOM | 1584 | O | LYS | A | 211 | −18.283 | −4.661 | 118.374 | 1.00 | 31.45 | O |
| ATOM | 1585 | CB | LYS | A | 211 | −19.775 | −2.409 | 117.155 | 1.00 | 30.56 | C |
| ATOM | 1586 | CG | LYS | A | 211 | −20.246 | −1.799 | 118.460 | 1.00 | 33.07 | C |
| ATOM | 1587 | CD | LYS | A | 211 | −19.646 | −0.430 | 118.618 | 1.00 | 36.20 | C |
| ATOM | 1588 | CE | LYS | A | 211 | −20.539 | 0.467 | 119.407 | 1.00 | 33.18 | C |
| ATOM | 1589 | NZ | LYS | A | 211 | −20.169 | 1.877 | 119.156 | 1.00 | 35.41 | N1+ |
| ATOM | 1590 | N | LYS | A | 212 | −16.962 | −2.972 | 119.094 | 1.00 | 35.68 | N |
| ATOM | 1591 | CA | LYS | A | 212 | −16.654 | −3.617 | 120.354 | 1.00 | 28.26 | C |
| ATOM | 1592 | C | LYS | A | 212 | −17.806 | −3.349 | 121.296 | 1.00 | 30.86 | C |
| ATOM | 1593 | O | LYS | A | 212 | −18.409 | −2.271 | 121.278 | 1.00 | 33.51 | O |
| ATOM | 1594 | CB | LYS | A | 212 | −15.341 | −3.112 | 120.955 | 1.00 | 31.23 | C |
| ATOM | 1595 | CG | LYS | A | 212 | −14.740 | −4.080 | 121.984 | 1.00 | 38.53 | C |
| ATOM | 1596 | CD | LYS | A | 212 | −13.567 | −3.503 | 122.778 | 1.00 | 42.63 | C |
| ATOM | 1597 | CE | LYS | A | 212 | −13.088 | −4.492 | 123.847 | 1.00 | 44.88 | C |
| ATOM | 1598 | NZ | LYS | A | 212 | −12.001 | −3.960 | 124.723 | 1.00 | 54.61 | N1+ |
| ATOM | 1599 | N | VAL | A | 213 | −18.175 | −4.376 | 122.039 | 1.00 | 30.30 | N |
| ATOM | 1600 | CA | VAL | A | 213 | −19.246 | −4.322 | 123.012 | 1.00 | 34.60 | C |
| ATOM | 1601 | C | VAL | A | 213 | −18.589 | −4.663 | 124.336 | 1.00 | 35.78 | C |
| ATOM | 1602 | O | VAL | A | 213 | −18.141 | −5.795 | 124.530 | 1.00 | 39.34 | O |
| ATOM | 1603 | CB | VAL | A | 213 | −20.380 | −5.300 | 122.667 | 1.00 | 36.86 | C |
| ATOM | 1604 | CG1 | VAL | A | 213 | −21.521 | −5.226 | 123.700 | 1.00 | 37.67 | C |
| ATOM | 1605 | CG2 | VAL | A | 213 | −20.903 | −5.028 | 121.278 | 1.00 | 27.28 | C |
| ATOM | 1606 | N | GLU | A | 214 | −18.489 | −3.687 | 125.228 | 1.00 | 43.48 | N |
| ATOM | 1607 | CA | GLU | A | 214 | −17.839 | −3.878 | 126.521 | 1.00 | 42.79 | C |
| ATOM | 1608 | C | GLU | A | 214 | −18.866 | −3.868 | 127.636 | 1.00 | 39.79 | C |
| ATOM | 1609 | O | GLU | A | 214 | −19.925 | −3.250 | 127.508 | 1.00 | 39.59 | O |
| ATOM | 1610 | CB | GLU | A | 214 | −16.795 | −2.787 | 126.788 | 1.00 | 42.03 | C |
| ATOM | 1611 | CG | GLU | A | 214 | −15.715 | −2.770 | 125.730 | 1.00 | 43.61 | C |
| ATOM | 1612 | CD | GLU | A | 214 | −14.732 | −1.636 | 125.888 | 1.00 | 60.49 | C |
| ATOM | 1613 | OE1 | GLU | A | 214 | −13.614 | −1.878 | 126.391 | 1.00 | 64.12 | O |
| ATOM | 1614 | OE2 | GLU | A | 214 | −15.085 | −0.500 | 125.505 | 1.00 | 65.45 | O1− |
| ATOM | 1615 | N | PRO | A | 215 | −18.599 | −4.573 | 128.724 | 1.00 | 42.19 | N |
| ATOM | 1616 | CA | PRO | A | 215 | −19.495 | −4.496 | 129.882 | 1.00 | 47.10 | C |
| ATOM | 1617 | C | PRO | A | 215 | −19.546 | −3.089 | 130.452 | 1.00 | 54.06 | C |
| ATOM | 1618 | O | PRO | A | 215 | −18.521 | −2.414 | 130.566 | 1.00 | 56.58 | O |
| ATOM | 1619 | CB | PRO | A | 215 | −18.885 | −5.492 | 130.874 | 1.00 | 49.68 | C |
| ATOM | 1620 | CG | PRO | A | 215 | −17.567 | −5.950 | 130.264 | 1.00 | 48.26 | C |
| ATOM | 1621 | CD | PRO | A | 215 | −17.651 | −5.695 | 128.809 | 1.00 | 45.54 | C |
| ATOM | 1622 | N | LYS | A | 216 | −20.760 | −2.636 | 130.768 | 1.00 | 59.07 | N |
| ATOM | 1623 | CA | LYS | A | 216 | −21.008 | −1.289 | 131.272 | 1.00 | 66.58 | C |
| ATOM | 1624 | C | LYS | A | 216 | −21.516 | −1.355 | 132.710 | 1.00 | 80.80 | C |
| ATOM | 1625 | O | LYS | A | 216 | −22.468 | −2.092 | 133.005 | 1.00 | 75.99 | O |
| ATOM | 1626 | CB | LYS | A | 216 | −22.036 | −0.555 | 130.408 | 1.00 | 66.80 | C |
| ATOM | 1627 | CG | LYS | A | 216 | −22.360 | 0.859 | 130.899 | 1.00 | 73.54 | C |
| ATOM | 1628 | CD | LYS | A | 216 | −23.096 | 1.653 | 129.834 | 1.00 | 77.62 | C |
| ATOM | 1629 | CE | LYS | A | 216 | −23.325 | 3.092 | 130.255 | 1.00 | 75.50 | C |
| ATOM | 1630 | NZ | LYS | A | 216 | −23.769 | 3.921 | 129.103 | 1.00 | 65.88 | N1+ |
| ATOM | 1631 | N | SER | A | 217 | −20.927 | −0.528 | 133.580 | 1.00 | 90.64 | N |
| ATOM | 1632 | CA | SER | A | 217 | −21.323 | −0.451 | 134.994 | 1.00 | 92.77 | C |
| ATOM | 1633 | C | SER | A | 217 | −22.109 | 0.829 | 135.282 | 1.00 | 85.80 | C |
| ATOM | 1634 | O | SER | A | 217 | −23.332 | 0.797 | 135.455 | 1.00 | 82.11 | O |
| ATOM | 1635 | CB | SER | A | 217 | −20.096 | −0.528 | 135.915 | 1.00 | 84.71 | C |
| ATOM | 1636 | OG | SER | A | 217 | −19.239 | 0.585 | 135.722 | 1.00 | 86.75 | O |
| TER | | | | | | | | | | | |
| ATOM | 1637 | N | GLU | B | 1 | −59.401 | −19.548 | 88.941 | 1.00 | 32.61 | N |
| ATOM | 1638 | CA | GLU | B | 1 | −58.164 | −20.286 | 89.135 | 1.00 | 32.73 | C |
| ATOM | 1639 | C | GLU | B | 1 | −58.344 | −21.415 | 90.159 | 1.00 | 39.88 | C |
| ATOM | 1640 | O | GLU | B | 1 | −59.196 | −21.331 | 91.040 | 1.00 | 39.29 | O |
| ATOM | 1641 | CB | GLU | B | 1 | −57.054 | −19.366 | 89.613 | 1.00 | 32.87 | C |
| ATOM | 1642 | CG | GLU | B | 1 | −57.037 | −19.224 | 91.116 | 1.00 | 33.91 | C |
| ATOM | 1643 | CD | GLU | B | 1 | −56.083 | −18.160 | 91.599 | 1.00 | 44.88 | C |
| ATOM | 1644 | OE1 | GLU | B | 1 | −56.022 | −17.970 | 92.832 | 1.00 | 55.17 | O |
| ATOM | 1645 | OE2 | GLU | B | 1 | −55.378 | −17.536 | 90.763 | 1.00 | 44.77 | O1− |
| ATOM | 1646 | N | ILE | B | 2 | −57.536 | −22.470 | 90.052 | 1.00 | 36.20 | N |
| ATOM | 1647 | CA | ILE | B | 2 | −57.589 | −23.542 | 91.037 | 1.00 | 31.00 | C |
| ATOM | 1648 | C | ILE | B | 2 | −56.950 | −23.074 | 92.339 | 1.00 | 27.84 | C |
| ATOM | 1649 | O | ILE | B | 2 | −55.774 | −22.694 | 92.370 | 1.00 | 27.28 | O |
| ATOM | 1650 | CB | ILE | B | 2 | −56.893 | −24.797 | 90.521 | 1.00 | 30.83 | C |
| ATOM | 1651 | CG1 | ILE | B | 2 | −57.571 | −25.303 | 89.259 | 1.00 | 24.03 | C |
| ATOM | 1652 | CG2 | ILE | B | 2 | −56.832 | −25.856 | 91.649 | 1.00 | 24.77 | C |
| ATOM | 1653 | CD1 | ILE | B | 2 | −56.866 | −26.508 | 88.716 | 1.00 | 24.00 | C |
| ATOM | 1654 | N | VAL | B | 3 | −57.718 | −23.116 | 93.424 | 1.00 | 28.01 | N |
| ATOM | 1655 | CA | VAL | B | 3 | −57.227 | −22.750 | 94.748 | 1.00 | 31.60 | C |
| ATOM | 1656 | C | VAL | B | 3 | −56.810 | −24.011 | 95.498 | 1.00 | 30.30 | C |
| ATOM | 1657 | O | VAL | B | 3 | −57.580 | −24.976 | 95.602 | 1.00 | 30.30 | O |
| ATOM | 1658 | CB | VAL | B | 3 | −58.287 | −21.965 | 95.535 | 1.00 | 30.01 | C |
| ATOM | 1659 | CG1 | VAL | B | 3 | −57.782 | −21.724 | 96.916 | 1.00 | 23.45 | C |

TABLE 10.4-continued

| | | | | | | | | | |
|---|---|---|---|---|---|---|---|---|---|
| ATOM | 1660 | CG2 | VAL | B | 3 | −58.637 | −20.645 | 94.815 | 1.00 | 24.87 | C |
| ATOM | 1661 | N | LEU | B | 4 | −55.591 | −24.017 | 96.006 | 1.00 | 27.66 | N |
| ATOM | 1662 | CA | LEU | B | 4 | −55.047 | −25.168 | 96.709 | 1.00 | 27.72 | C |
| ATOM | 1663 | C | LEU | B | 4 | −54.941 | −24.793 | 98.170 | 1.00 | 30.07 | C |
| ATOM | 1664 | O | LEU | B | 4 | −54.281 | −23.805 | 98.509 | 1.00 | 34.25 | O |
| ATOM | 1665 | CB | LEU | B | 4 | −53.677 | −25.570 | 96.165 | 1.00 | 31.34 | C |
| ATOM | 1666 | CG | LEU | B | 4 | −53.596 | −26.025 | 94.711 | 1.00 | 30.78 | C |
| ATOM | 1667 | CD1 | LEU | B | 4 | −52.155 | −26.475 | 94.361 | 1.00 | 29.60 | C |
| ATOM | 1668 | CD2 | LEU | B | 4 | −54.571 | −27.161 | 94.511 | 1.00 | 23.79 | C |
| ATOM | 1669 | N | THR | B | 5 | −55.591 | −25.568 | 99.026 | 1.00 | 26.39 | N |
| ATOM | 1670 | CA | THR | B | 5 | −55.586 | −25.330 | 100.458 | 1.00 | 23.07 | C |
| ATOM | 1671 | C | THR | B | 5 | −54.765 | −26.407 | 101.130 | 1.00 | 26.07 | C |
| ATOM | 1672 | O | THR | B | 5 | −55.089 | −27.591 | 101.034 | 1.00 | 29.54 | O |
| ATOM | 1673 | CB | THR | B | 5 | −57.007 | −25.330 | 101.019 | 1.00 | 23.58 | C |
| ATOM | 1674 | OG1 | THR | B | 5 | −57.813 | −24.424 | 100.256 | 1.00 | 25.83 | O |
| ATOM | 1675 | CG2 | THR | B | 5 | −56.992 | −24.892 | 102.458 | 1.00 | 18.31 | C |
| ATOM | 1676 | N | GLN | B | 6 | −53.731 | −26.003 | 101.830 | 1.00 | 23.61 | N |
| ATOM | 1677 | CA | GLN | B | 6 | −52.920 | −26.943 | 102.569 | 1.00 | 25.57 | C |
| ATOM | 1678 | C | GLN | B | 6 | −53.328 | −26.929 | 104.024 | 1.00 | 24.28 | C |
| ATOM | 1679 | O | GLN | B | 6 | −53.585 | −25.871 | 104.592 | 1.00 | 28.38 | O |
| ATOM | 1680 | CB | GLN | B | 6 | −51.432 | −26.623 | 102.442 | 1.00 | 21.43 | C |
| ATOM | 1681 | CG | GLN | B | 6 | −50.866 | −27.125 | 101.172 | 1.00 | 25.09 | C |
| ATOM | 1682 | CD | GLN | B | 6 | −49.406 | −26.785 | 101.003 | 1.00 | 29.92 | C |
| ATOM | 1683 | OE1 | GLN | B | 6 | −49.065 | −25.856 | 100.258 | 1.00 | 30.10 | O |
| ATOM | 1684 | NE2 | GLN | B | 6 | −48.529 | −27.542 | 101.671 | 1.00 | 23.00 | N |
| ATOM | 1685 | N | SER | B | 7 | −53.388 | −28.113 | 104.609 | 1.00 | 28.46 | N |
| ATOM | 1686 | CA | SER | B | 7 | −53.526 | −28.273 | 106.046 | 1.00 | 32.14 | C |
| ATOM | 1687 | C | SER | B | 7 | −52.626 | −29.410 | 106.541 | 1.00 | 32.52 | C |
| ATOM | 1688 | O | SER | B | 7 | −52.238 | −30.294 | 105.774 | 1.00 | 31.45 | O |
| ATOM | 1689 | CB | SER | B | 7 | −54.960 | −28.558 | 106.404 | 1.00 | 26.70 | C |
| ATOM | 1690 | OG | SER | B | 7 | −55.208 | −29.883 | 106.045 | 1.00 | 39.01 | O |
| ATOM | 1691 | N | PRO | B | 8 | −52.242 | −29.367 | 107.816 | 1.00 | 35.79 | N |
| ATOM | 1692 | CA | PRO | B | 8 | −52.444 | −28.237 | 108.728 | 1.00 | 32.17 | C |
| ATOM | 1693 | C | PRO | B | 8 | −51.456 | −27.142 | 108.349 | 1.00 | 33.18 | C |
| ATOM | 1694 | O | PRO | B | 8 | −50.550 | −27.465 | 107.590 | 1.00 | 35.18 | O |
| ATOM | 1695 | CB | PRO | B | 8 | −52.119 | −28.837 | 110.103 | 1.00 | 26.39 | C |
| ATOM | 1696 | CG | PRO | B | 8 | −51.061 | −29.854 | 109.786 | 1.00 | 33.66 | C |
| ATOM | 1697 | CD | PRO | B | 8 | −51.426 | −30.438 | 108.422 | 1.00 | 30.11 | C |
| ATOM | 1698 | N | GLY | B | 9 | −51.584 | −25.920 | 108.877 | 1.00 | 35.12 | N |
| ATOM | 1699 | CA | GLY | B | 9 | −50.583 | −24.899 | 108.603 | 1.00 | 25.91 | C |
| ATOM | 1700 | C | GLY | B | 9 | −49.249 | −25.202 | 109.264 | 1.00 | 27.68 | C |
| ATOM | 1701 | O | GLY | B | 9 | −48.196 | −25.015 | 108.661 | 1.00 | 27.97 | O |
| ATOM | 1702 | N | THR | B | 10 | −49.274 | −25.726 | 110.487 | 1.00 | 26.27 | N |
| ATOM | 1703 | CA | THR | B | 10 | −48.056 | −26.118 | 111.179 | 1.00 | 27.02 | C |
| ATOM | 1704 | C | THR | B | 10 | −48.197 | −27.524 | 111.746 | 1.00 | 26.07 | C |
| ATOM | 1705 | O | THR | B | 10 | −49.251 | −27.890 | 112.264 | 1.00 | 30.58 | O |
| ATOM | 1706 | CB | THR | B | 10 | −47.725 | −25.143 | 112.310 | 1.00 | 26.29 | C |
| ATOM | 1707 | OG1 | THR | B | 10 | −47.699 | −23.812 | 111.789 | 1.00 | 30.87 | O |
| ATOM | 1708 | CG2 | THR | B | 10 | −46.368 | −25.480 | 112.929 | 1.00 | 18.58 | C |
| ATOM | 1709 | N | LEU | B | 11 | −47.117 | −28.296 | 111.669 | 1.00 | 28.05 | N |
| ATOM | 1710 | CA | LEU | B | 11 | −47.057 | −29.670 | 112.156 | 1.00 | 27.74 | C |
| ATOM | 1711 | C | LEU | B | 11 | −45.839 | −29.819 | 113.059 | 1.00 | 29.19 | C |
| ATOM | 1712 | O | LEU | B | 11 | −44.706 | −29.647 | 112.600 | 1.00 | 31.16 | O |
| ATOM | 1713 | CB | LEU | B | 11 | −46.954 | −30.632 | 110.978 | 1.00 | 33.49 | C |
| ATOM | 1714 | CG | LEU | B | 11 | −47.842 | −31.847 | 110.756 | 1.00 | 40.86 | C |
| ATOM | 1715 | CD1 | LEU | B | 11 | −47.188 | −32.642 | 109.625 | 1.00 | 33.69 | C |
| ATOM | 1716 | CD2 | LEU | B | 11 | −47.976 | −32.687 | 112.003 | 1.00 | 34.11 | C |
| ATOM | 1717 | N | SER | B | 12 | −46.055 | −30.135 | 114.336 | 1.00 | 32.77 | N |
| ATOM | 1718 | CA | SER | B | 12 | −44.956 | −30.381 | 115.271 | 1.00 | 30.27 | C |
| ATOM | 1719 | C | SER | B | 12 | −44.851 | −31.873 | 115.562 | 1.00 | 30.86 | C |
| ATOM | 1720 | O | SER | B | 12 | −45.793 | −32.475 | 116.083 | 1.00 | 35.59 | O |
| ATOM | 1721 | CB | SER | B | 12 | −45.145 | −29.592 | 116.560 | 1.00 | 27.94 | C |
| ATOM | 1722 | OG | SER | B | 12 | −45.372 | −28.227 | 116.236 | 1.00 | 38.87 | O |
| ATOM | 1723 | N | LEU | B | 13 | −43.694 | −32.453 | 115.245 | 1.00 | 31.96 | N |
| ATOM | 1724 | CA | LEU | B | 13 | −43.453 | −33.887 | 115.299 | 1.00 | 32.10 | C |
| ATOM | 1725 | C | LEU | B | 13 | −42.010 | −34.098 | 115.707 | 1.00 | 30.66 | C |
| ATOM | 1726 | O | LEU | B | 13 | −41.159 | −33.231 | 115.489 | 1.00 | 31.40 | O |
| ATOM | 1727 | CB | LEU | B | 13 | −43.690 | −34.572 | 113.949 | 1.00 | 32.81 | C |
| ATOM | 1728 | CG | LEU | B | 13 | −45.087 | −34.460 | 113.332 | 1.00 | 34.52 | C |
| ATOM | 1729 | CD1 | LEU | B | 13 | −45.085 | −35.018 | 111.924 | 1.00 | 32.83 | C |
| ATOM | 1730 | CD2 | LEU | B | 13 | −46.110 | −35.164 | 114.189 | 1.00 | 26.42 | C |
| ATOM | 1731 | N | SER | B | 14 | −41.745 | −35.232 | 116.316 | 1.00 | 28.88 | N |
| ATOM | 1732 | CA | SER | B | 14 | −40.359 | −35.534 | 116.639 | 1.00 | 32.75 | C |
| ATOM | 1733 | C | SER | B | 14 | −39.649 | −36.161 | 115.442 | 1.00 | 28.56 | C |
| ATOM | 1734 | O | SER | B | 14 | −40.281 | −36.766 | 114.580 | 1.00 | 31.22 | O |
| ATOM | 1735 | CB | SER | B | 14 | −40.292 | −36.469 | 117.838 | 1.00 | 36.49 | C |
| ATOM | 1736 | OG | SER | B | 14 | −40.626 | −35.749 | 119.019 | 1.00 | 44.98 | O |
| ATOM | 1737 | N | PRO | B | 15 | −38.341 | −36.015 | 115.345 | 1.00 | 29.37 | N |
| ATOM | 1738 | CA | PRO | B | 15 | −37.609 | −36.799 | 114.341 | 1.00 | 28.36 | C |
| ATOM | 1739 | C | PRO | B | 15 | −37.846 | −38.290 | 114.566 | 1.00 | 33.54 | C |

TABLE 10.4-continued

| | | | | | | | | | | |
|---|---|---|---|---|---|---|---|---|---|---|
| ATOM | 1740 | O   | PRO | B | 15 | −38.877 | −38.770 | 115.702 | 1.00 | 39.74 | O |
| ATOM | 1741 | CB  | PRO | B | 15 | −36.149 | −36.404 | 114.575 | 1.00 | 31.85 | C |
| ATOM | 1742 | CG  | PRO | B | 15 | −36.230 | −35.042 | 115.265 | 1.00 | 27.05 | C |
| ATOM | 1743 | CD  | PRO | B | 15 | −37.481 | −35.086 | 116.097 | 1.00 | 29.92 | C |
| ATOM | 1744 | N   | GLY | B | 16 | −37.994 | −39.032 | 113.467 | 1.00 | 34.12 | N |
| ATOM | 1745 | CA  | GLY | B | 16 | −38.362 | −40.428 | 113.500 | 1.00 | 30.27 | C |
| ATOM | 1746 | C   | GLY | B | 16 | −39.837 | −40.693 | 113.284 | 1.00 | 32.66 | C |
| ATOM | 1747 | O   | GLY | B | 16 | −40.204 | −41.796 | 112.862 | 1.00 | 38.35 | O |
| ATOM | 1748 | N   | GLU | B | 17 | −40.690 | −39.722 | 113.549 | 1.00 | 28.58 | N |
| ATOM | 1749 | CA  | GLU | B | 17 | −42.105 | −39.947 | 113.346 | 1.00 | 27.09 | C |
| ATOM | 1750 | C   | GLU | B | 17 | −42.502 | −39.762 | 111.878 | 1.00 | 32.66 | C |
| ATOM | 1751 | O   | GLU | B | 17 | −41.728 | −39.318 | 111.016 | 1.00 | 27.01 | O |
| ATOM | 1752 | CB  | GLU | B | 17 | −42.923 | −39.013 | 114.220 | 1.00 | 26.44 | C |
| ATOM | 1753 | CG  | GLU | B | 17 | −42.896 | −39.366 | 115.689 | 1.00 | 35.87 | C |
| ATOM | 1754 | CD  | GLU | B | 17 | −43.872 | −38.506 | 116.494 | 1.00 | 50.33 | C |
| ATOM | 1755 | OE1 | GLU | B | 17 | −43.659 | −37.269 | 116.602 | 1.00 | 47.95 | O |
| ATOM | 1756 | OE2 | GLU | B | 17 | −44.862 | −39.066 | 117.011 | 1.00 | 67.19 | O1− |
| ATOM | 1757 | N   | ARG | B | 18 | −43.757 | −40.098 | 111.626 | 1.00 | 28.24 | N |
| ATOM | 1758 | CA  | ARG | B | 18 | −44.377 | −40.060 | 110.321 | 1.00 | 29.25 | C |
| ATOM | 1759 | C   | ARG | B | 18 | −45.174 | −38.768 | 110.187 | 1.00 | 31.06 | C |
| ATOM | 1760 | O   | ARG | B | 18 | −45.801 | −38.322 | 111.151 | 1.00 | 28.90 | O |
| ATOM | 1761 | CB  | ARG | B | 18 | −45.273 | −41.278 | 110.169 | 1.00 | 28.93 | C |
| ATOM | 1762 | CG  | ARG | B | 18 | −46.000 | −41.420 | 108.875 | 1.00 | 35.84 | C |
| ATOM | 1763 | CD  | ARG | B | 18 | −46.955 | −42.591 | 109.004 | 1.00 | 33.74 | C |
| ATOM | 1764 | NE  | ARG | B | 18 | −47.724 | −42.806 | 107.792 | 1.00 | 42.81 | N |
| ATOM | 1765 | CZ  | ARG | B | 18 | −47.249 | −43.450 | 106.731 | 1.00 | 49.16 | C |
| ATOM | 1766 | NH1 | ARG | B | 18 | −45.993 | −43.927 | 106.747 | 1.00 | 44.51 | N1+ |
| ATOM | 1767 | NH2 | ARG | B | 18 | −48.021 | −43.606 | 105.656 | 1.00 | 37.48 | N |
| ATOM | 1768 | N   | ALA | B | 19 | −45.104 | −38.148 | 109.001 | 1.00 | 30.81 | N |
| ATOM | 1769 | CA  | ALA | B | 19 | −45.764 | −36.880 | 108.699 | 1.00 | 27.46 | C |
| ATOM | 1770 | C   | ALA | B | 19 | −46.674 | −37.020 | 107.488 | 1.00 | 27.67 | C |
| ATOM | 1771 | O   | ALA | B | 19 | −46.284 | −37.594 | 106.466 | 1.00 | 29.51 | O |
| ATOM | 1772 | CB  | ALA | B | 19 | −44.745 | −35.775 | 108.431 | 1.00 | 26.69 | C |
| ATOM | 1773 | N   | THR | B | 20 | −47.863 | −36.437 | 107.576 | 1.00 | 23.65 | N |
| ATOM | 1774 | CA  | THR | B | 20 | −48.833 | −36.478 | 106.489 | 1.00 | 28.01 | C |
| ATOM | 1775 | C   | THR | B | 20 | −49.374 | −35.076 | 106.258 | 1.00 | 29.74 | C |
| ATOM | 1776 | O   | THR | B | 20 | −49.974 | −34.477 | 107.155 | 1.00 | 31.62 | O |
| ATOM | 1777 | CB  | THR | B | 20 | −49.966 | −37.477 | 106.791 | 1.00 | 31.91 | C |
| ATOM | 1778 | OG1 | THR | B | 20 | −49.516 | −38.802 | 106.486 | 1.00 | 38.10 | O |
| ATOM | 1779 | CG2 | THR | B | 20 | −51.212 | −37.192 | 105.973 | 1.00 | 31.11 | C |
| ATOM | 1780 | N   | LEU | B | 21 | −49.163 | −34.561 | 105.054 | 1.00 | 28.91 | N |
| ATOM | 1781 | CA  | LEU | B | 21 | −49.541 | −33.209 | 104.693 | 1.00 | 27.86 | C |
| ATOM | 1782 | C   | LEU | B | 21 | −50.689 | −33.322 | 103.711 | 1.00 | 27.21 | C |
| ATOM | 1783 | O   | LEU | B | 21 | −50.742 | −34.261 | 102.921 | 1.00 | 27.15 | O |
| ATOM | 1784 | CB  | LEU | B | 21 | −48.377 | −32.459 | 104.031 | 1.00 | 24.41 | C |
| ATOM | 1785 | CG  | LEU | B | 21 | −46.975 | −32.345 | 104.643 | 1.00 | 26.45 | C |
| ATOM | 1786 | CD1 | LEU | B | 21 | −46.405 | −30.957 | 104.460 | 1.00 | 27.98 | C |
| ATOM | 1787 | CD2 | LEU | B | 21 | −46.871 | −32.762 | 106.081 | 1.00 | 28.98 | C |
| ATOM | 1788 | N   | SER | B | 22 | −51.620 | −32.390 | 103.764 | 1.00 | 27.44 | N |
| ATOM | 1789 | CA  | SER | B | 22 | −52.739 | −32.439 | 102.843 | 1.00 | 27.56 | C |
| ATOM | 1790 | C   | SER | B | 22 | −52.718 | −31.231 | 101.926 | 1.00 | 29.41 | C |
| ATOM | 1791 | O   | SER | B | 22 | −52.281 | −30.148 | 102.321 | 1.00 | 23.55 | O |
| ATOM | 1792 | CB  | SER | B | 22 | −54.067 | −32.506 | 103.571 | 1.00 | 22.71 | C |
| ATOM | 1793 | OG  | SER | B | 22 | −54.374 | −33.869 | 103.733 | 1.00 | 40.86 | O |
| ATOM | 1794 | N   | CYS | B | 23 | −53.188 | −31.445 | 100.693 | 1.00 | 24.46 | N |
| ATOM | 1795 | CA  | CYS | B | 23 | −53.456 | −30.379 | 99.735  | 1.00 | 26.64 | C |
| ATOM | 1796 | C   | CYS | B | 23 | −54.824 | −30.660 | 99.146  | 1.00 | 26.09 | C |
| ATOM | 1797 | O   | CYS | B | 23 | −55.034 | −31.718 | 98.547  | 1.00 | 30.05 | O |
| ATOM | 1798 | CB  | CYS | B | 23 | −52.392 | −30.330 | 98.623  | 1.00 | 29.42 | C |
| ATOM | 1799 | SG  | CYS | B | 23 | −52.509 | −28.931 | 97.438  | 1.00 | 45.36 | S |
| ATOM | 1800 | N   | ARG | B | 24 | −55.756 | −29.740 | 99.326  | 1.00 | 26.38 | N |
| ATOM | 1801 | CA  | ARG | B | 24 | −57.084 | −29.874 | 98.762  | 1.00 | 25.14 | C |
| ATOM | 1802 | C   | ARG | B | 24 | −57.249 | −28.870 | 97.633  | 1.00 | 27.66 | C |
| ATOM | 1803 | O   | ARG | B | 24 | −56.984 | −27.677 | 97.815  | 1.00 | 27.74 | O |
| ATOM | 1804 | CB  | ARG | B | 24 | −58.151 | −29.702 | 99.834  | 1.00 | 25.05 | C |
| ATOM | 1805 | CG  | ARG | B | 24 | −58.148 | −30.888 | 100.781 | 1.00 | 39.63 | C |
| ATOM | 1806 | CD  | ARG | B | 24 | −58.919 | −30.636 | 102.071 | 1.00 | 56.87 | C |
| ATOM | 1807 | NE  | ARG | B | 24 | −60.337 | −30.971 | 101.921 | 1.00 | 70.81 | N |
| ATOM | 1808 | CZ  | ARG | B | 24 | −60.899 | −32.091 | 102.373 | 1.00 | 75.66 | C |
| ATOM | 1809 | NH1 | ARG | B | 24 | −60.156 | −32.994 | 103.017 | 1.00 | 74.34 | N1+ |
| ATOM | 1810 | NH2 | ARG | B | 24 | −62.204 | −32.303 | 102.187 | 1.00 | 69.31 | N |
| ATOM | 1811 | N   | ALA | B | 25 | −57.657 | −29.371 | 96.465  | 1.00 | 25.97 | N |
| ATOM | 1812 | CA  | ALA | B | 25 | −57.809 | −28.586 | 95.252  | 1.00 | 24.73 | C |
| ATOM | 1813 | C   | ALA | B | 25 | −59.271 | −28.236 | 95.024  | 1.00 | 25.92 | C |
| ATOM | 1814 | O   | ALA | B | 25 | −60.147 | −29.102 | 95.093  | 1.00 | 27.92 | O |
| ATOM | 1815 | CB  | ALA | B | 25 | −57.263 | −29.344 | 94.042  | 1.00 | 25.78 | C |
| ATOM | 1816 | N   | SER | B | 26 | −59.524 | −26.969 | 94.744  | 1.00 | 28.48 | N |
| ATOM | 1817 | CA  | SER | B | 26 | −60.840 | −26.517 | 94.342  | 1.00 | 26.13 | C |
| ATOM | 1818 | C   | SER | B | 26 | −60.758 | −25.481 | 93.190  | 1.00 | 29.42 | C |
| ATOM | 1819 | O   | SER | B | 26 | −60.242 | −24.370 | 93.373  | 1.00 | 30.69 | O |

TABLE 10.4-continued

| | | | | | | | | | | |
|---|---|---|---|---|---|---|---|---|---|---|
| ATOM | 1820 | CB | SER | B | 26 | −61.562 | −25.932 | 95.549 | 1.00 | 24.33 | C |
| ATOM | 1821 | OG | SER | B | 26 | −62.823 | −25.420 | 95.178 | 1.00 | 39.40 | O |
| ATOM | 1822 | N | PRO | B | 27 | −61.248 | −25.87 | 91.994 | 1.00 | 27.29 | N |
| ATOM | 1823 | CA | PRO | B | 27 | −61.824 | −27.118 | 91.541 | 1.00 | 25.37 | C |
| ATOM | 1824 | C | PRO | B | 27 | −60.819 | −28.258 | 91.496 | 1.00 | 27.72 | C |
| ATOM | 1825 | O | PRO | B | 27 | −59.639 | −28.025 | 91.702 | 1.00 | 28.26 | O |
| ATOM | 1826 | CB | PRO | B | 27 | −62.331 | −26.806 | 90.123 | 1.00 | 22.36 | C |
| ATOM | 1827 | CG | PRO | B | 27 | −61.831 | −25.420 | 89.788 | 1.00 | 21.74 | C |
| ATOM | 1828 | CD | PRO | B | 27 | −61.584 | −24.724 | 91.085 | 1.00 | 22.47 | C |
| ATOM | 1829 | N | SER | B | 28 | −61.284 | −29.468 | 91.201 | 1.00 | 29.06 | N |
| ATOM | 1830 | CA | SER | B | 28 | −60.424 | −30.643 | 91.235 | 1.00 | 29.98 | C |
| ATOM | 1831 | C | SER | B | 28 | −59.291 | −30.567 | 90.206 | 1.00 | 31.92 | C |
| ATOM | 1832 | O | SER | B | 28 | −59.390 | −29.898 | 89.174 | 1.00 | 33.40 | O |
| ATOM | 1833 | CB | SER | B | 28 | −61.256 | −31.892 | 90.993 | 1.00 | 30.66 | C |
| ATOM | 1834 | OG | SER | B | 28 | −62.051 | −32.132 | 92.124 | 1.00 | 36.68 | O |
| ATOM | 1835 | N | VAL | B | 29 | −58.219 | −31.314 | 90.488 | 1.00 | 29.10 | N |
| ATOM | 1836 | CA | VAL | B | 29 | −57.081 | −31.501 | 89.588 | 1.00 | 27.86 | C |
| ATOM | 1837 | C | VAL | B | 29 | −57.110 | −32.960 | 89.140 | 1.00 | 34.14 | C |
| ATOM | 1838 | O | VAL | B | 29 | −56.339 | −33.796 | 89.630 | 1.00 | 31.49 | O |
| ATOM | 1839 | CB | VAL | B | 29 | −55.739 | −31.126 | 90.270 | 1.00 | 26.93 | C |
| ATOM | 1840 | CG1 | VAL | B | 29 | −54.536 | −31.343 | 89.352 | 1.00 | 31.84 | C |
| ATOM | 1841 | CG2 | VAL | B | 29 | −55.741 | −29.679 | 90.699 | 1.00 | 27.83 | C |
| ATOM | 1842 | N | ASN | B | 30 | −58.040 | −33.287 | 88.234 | 1.00 | 37.48 | N |
| ATOM | 1843 | CA | ASN | B | 30 | −58.225 | −34.670 | 87.784 | 1.00 | 33.93 | C |
| ATOM | 1844 | C | ASN | B | 30 | −57.128 | −35.163 | 86.860 | 1.00 | 28.81 | C |
| ATOM | 1845 | O | ASN | B | 30 | −57.130 | −36.351 | 86.526 | 1.00 | 35.16 | O |
| ATOM | 1846 | CB | ASN | B | 30 | −59.573 | −34.847 | 87.088 | 1.00 | 30.66 | C |
| ATOM | 1847 | CG | ASN | B | 30 | −60.750 | −34.648 | 88.034 | 1.00 | 32.10 | C |
| ATOM | 1848 | OD1 | ASN | B | 30 | −60.735 | −35.110 | 89.179 | 1.00 | 36.69 | O |
| ATOM | 1849 | ND2 | ASN | B | 30 | −61.763 | −33.952 | 87.564 | 1.00 | 29.33 | N |
| ATOM | 1850 | N | SER | B | 31 | −56.223 | −34.293 | 86.406 | 1.00 | 30.18 | N |
| ATOM | 1851 | CA | SER | B | 31 | −55.082 | −34.759 | 85.625 | 1.00 | 28.46 | C |
| ATOM | 1852 | C | SER | B | 31 | −54.004 | −35.394 | 86.484 | 1.00 | 30.09 | C |
| ATOM | 1853 | O | SER | B | 31 | −53.192 | −36.163 | 85.956 | 1.00 | 25.87 | O |
| ATOM | 1854 | CB | SER | B | 31 | −54.464 | −33.608 | 84.839 | 1.00 | 28.04 | C |
| ATOM | 1855 | OG | SER | B | 31 | −54.110 | −32.544 | 85.699 | 1.00 | 28.97 | O |
| ATOM | 1856 | N | GLY | B | 32 | −54.026 | −35.129 | 87.797 | 1.00 | 30.79 | N |
| ATOM | 1857 | CA | GLY | B | 32 | −52.930 | −35.453 | 88.685 | 1.00 | 23.28 | C |
| ATOM | 1858 | C | GLY | B | 32 | −51.708 | −34.581 | 88.501 | 1.00 | 25.51 | C |
| ATOM | 1859 | O | GLY | B | 32 | −50.636 | −34.931 | 88.982 | 1.00 | 24.92 | O |
| ATOM | 1860 | N | TYR | B | 33 | −51.838 | −33.436 | 87.830 | 1.00 | 25.51 | N |
| ATOM | 1861 | CA | TYR | B | 33 | −50.697 | −32.549 | 87.607 | 1.00 | 22.85 | C |
| ATOM | 1862 | C | TYR | B | 33 | −50.468 | −31.718 | 88.875 | 1.00 | 28.41 | C |
| ATOM | 1863 | O | TYR | B | 33 | −50.739 | −30.514 | 88.938 | 1.00 | 24.46 | O |
| ATOM | 1864 | CB | TYR | B | 33 | −50.934 | −31.657 | 86.394 | 1.00 | 25.72 | C |
| ATOM | 1865 | CG | TYR | B | 33 | −50.986 | −32.351 | 85.031 | 1.00 | 27.40 | C |
| ATOM | 1866 | CD1 | TYR | B | 33 | −50.607 | −33.684 | 84.869 | 1.00 | 25.12 | C |
| ATOM | 1867 | CD2 | TYR | B | 33 | −51.398 | −31.651 | 83.901 | 1.00 | 25.37 | C |
| ATOM | 1868 | CE1 | TYR | B | 33 | −50.659 | −34.306 | 83.618 | 1.00 | 27.61 | C |
| ATOM | 1869 | CE2 | TYR | B | 33 | −51.443 | −32.256 | 82.647 | 1.00 | 28.75 | C |
| ATOM | 1870 | CZ | TYR | B | 33 | −51.073 | −33.582 | 82.505 | 1.00 | 31.43 | C |
| ATOM | 1871 | CO | TYR | B | 33 | −51.108 | −34.164 | 81.251 | 1.00 | 25.68 | O |
| ATOM | 1872 | N | LEU | B | 34 | −49.964 | −32.400 | 89.908 | 1.00 | 26.49 | N |
| ATOM | 1873 | CA | LEU | B | 34 | −49.740 | −31.801 | 91.217 | 1.00 | 25.62 | C |
| ATOM | 1874 | C | LEU | B | 34 | −48.316 | −32.075 | 91.697 | 1.00 | 25.75 | C |
| ATOM | 1875 | O | LEU | B | 34 | −47.893 | −33.228 | 91.789 | 1.00 | 27.99 | O |
| ATOM | 1876 | CB | LEU | B | 34 | −50.742 | −32.328 | 92.239 | 1.00 | 25.15 | C |
| ATOM | 1877 | CG | LEU | B | 34 | −50.732 | −31.388 | 93.436 | 1.00 | 22.33 | C |
| ATOM | 1878 | CD1 | LEU | B | 34 | −52.055 | −30.748 | 93.532 | 1.00 | 24.71 | C |
| ATOM | 1879 | CD2 | LEU | B | 34 | −50.401 | −32.127 | 94.682 | 1.00 | 22.19 | C |
| ATOM | 1880 | N | ALA | B | 35 | −47.595 | −31.021 | 92.035 | 1.00 | 26.54 | N |
| ATOM | 1881 | CA | ALA | B | 35 | −46.221 | −31.114 | 92.497 | 1.00 | 27.18 | C |
| ATOM | 1882 | C | ALA | B | 35 | −46.154 | −30.759 | 93.973 | 1.00 | 25.51 | C |
| ATOM | 1883 | O | ALA | B | 35 | −47.050 | −30.117 | 94.516 | 1.00 | 24.44 | O |
| ATOM | 1884 | CB | ALA | B | 35 | −45.293 | −30.186 | 91.706 | 1.00 | 20.44 | C |
| ATOM | 1885 | N | TRP | B | 36 | −45.088 | −31.214 | 94.621 | 1.00 | 23.22 | N |
| ATOM | 1886 | CA | TRP | B | 36 | −44.790 | −30.852 | 95.995 | 1.00 | 26.05 | C |
| ATOM | 1887 | C | TRP | B | 36 | −43.368 | −30.316 | 96.037 | 1.00 | 25.42 | C |
| ATOM | 1888 | O | TRP | B | 36 | −42.462 | −30.896 | 95.429 | 1.00 | 26.45 | O |
| ATOM | 1889 | CB | TRP | B | 36 | −44.935 | −32.050 | 96.966 | 1.00 | 23.50 | C |
| ATOM | 1890 | CG | TRP | B | 36 | −46.328 | −32.470 | 97.286 | 1.00 | 23.73 | C |
| ATOM | 1891 | CD1 | TRP | B | 36 | −47.071 | −33.413 | 96.633 | 1.00 | 26.66 | C |
| ATOM | 1892 | CD2 | TRP | B | 36 | −47.144 | −32.006 | 98.375 | 1.00 | 28.12 | C |
| ATOM | 1893 | NE1 | TRP | B | 36 | −48.304 | −33.549 | 97.229 | 1.00 | 24.58 | N |
| ATOM | 1894 | CE2 | TRP | B | 36 | −48.374 | −32.709 | 98.306 | 1.00 | 26.57 | C |
| ATOM | 1895 | CE3 | TRP | B | 36 | −46.951 | −31.079 | 99.407 | 1.00 | 20.21 | C |
| ATOM | 1896 | CZ2 | TRP | B | 36 | −49.407 | −32.506 | 99.222 | 1.00 | 22.88 | C |
| ATOM | 1897 | CZ3 | TRP | B | 36 | −47.970 | −30.872 | 100.294 | 1.00 | 23.52 | C |
| ATOM | 1898 | CH2 | TRP | B | 36 | −49.190 | −31.584 | 100.203 | 1.00 | 24.77 | C |
| ATOM | 1899 | N | TYR | B | 37 | −43.173 | −29.219 | 96.764 | 1.00 | 25.12 | N |

TABLE 10.4-continued

| | | | | | | | | | | |
|---|---|---|---|---|---|---|---|---|---|---|
| ATOM | 1900 | CA | TYR | B | 37 | −41.858 | −28.628 | 96.947 | 1.00 | 23.85 | C |
| ATOM | 1901 | C | TYR | B | 37 | −41.551 | −28.525 | 98.427 | 1.00 | 27.32 | C |
| ATOM | 1902 | O | TYR | B | 37 | −42.446 | −28.279 | 99.247 | 1.00 | 28.76 | O |
| ATOM | 1903 | CB | TYR | B | 37 | −41.764 | −27.229 | 96.341 | 1.00 | 25.99 | C |
| ATOM | 1904 | CG | TYR | B | 37 | −42.052 | −27.217 | 94.879 | 1.00 | 25.68 | C |
| ATOM | 1905 | CD2 | TYR | B | 37 | −41.025 | −27.346 | 93.944 | 1.00 | 27.12 | C |
| ATOM | 1906 | CD1 | TYR | B | 37 | −43.346 | −27.106 | 94.426 | 1.00 | 20.71 | C |
| ATOM | 1907 | CE2 | TYR | B | 37 | −41.296 | −27.349 | 92.584 | 1.00 | 23.06 | C |
| ATOM | 1908 | CE1 | TYR | B | 37 | −43.622 | −27.112 | 93.088 | 1.00 | 25.67 | C |
| ATOM | 1909 | CZ | TYR | B | 37 | −42.598 | −27.241 | 92.170 | 1.00 | 22.19 | C |
| ATOM | 1910 | OH | TYR | B | 37 | −42.911 | −27.244 | 90.831 | 1.00 | 28.45 | O |
| ATOM | 1911 | N | GLN | B | 38 | −40.267 | −28.679 | 98.742 | 1.00 | 24.78 | N |
| ATOM | 1912 | CA | GLN | B | 38 | −39.708 | −28.428 | 100.061 | 1.00 | 26.12 | C |
| ATOM | 1913 | C | GLN | B | 38 | −38.871 | −27.147 | 100.017 | 1.00 | 23.99 | C |
| ATOM | 1914 | O | GLN | B | 38 | −38.168 | −26.890 | 99.034 | 1.00 | 22.68 | O |
| ATOM | 1915 | CB | GLN | B | 38 | −38.852 | −29.619 | 100.509 | 1.00 | 24.24 | C |
| ATOM | 1916 | CG | GLN | B | 38 | −38.144 | −29.399 | 101.826 | 1.00 | 22.10 | C |
| ATOM | 1917 | CD | GLN | B | 38 | −37.108 | −30.460 | 102.113 | 1.00 | 26.91 | C |
| ATOM | 1918 | OE1 | GLN | B | 38 | −36.023 | −30.439 | 101.532 | 1.00 | 33.75 | O |
| ATOM | 1919 | NE2 | GLN | B | 38 | −37.418 | −31.376 | 103.032 | 1.00 | 24.91 | N |
| ATOM | 1920 | N | GLN | B | 39 | −38.944 | −26.339 | 101.072 | 1.00 | 19.06 | N |
| ATOM | 1921 | CA | GLN | B | 39 | −38.193 | −25.085 | 101.113 | 1.00 | 24.00 | C |
| ATOM | 1922 | C | GLN | B | 39 | −37.632 | −24.846 | 102.498 | 1.00 | 23.43 | C |
| ATOM | 1923 | O | GLN | B | 39 | −38.389 | −24.722 | 103.462 | 1.00 | 21.25 | O |
| ATOM | 1924 | CB | GLN | B | 39 | −39.043 | −23.881 | 100.719 | 1.00 | 25.47 | C |
| ATOM | 1925 | CG | GLN | B | 39 | −38.226 | −22.610 | 100.620 | 1.00 | 25.34 | C |
| ATOM | 1926 | CD | GLN | B | 39 | −39.027 | −21.423 | 100.161 | 1.00 | 31.02 | C |
| ATOM | 1927 | OE1 | GLN | B | 39 | −40.183 | −21.244 | 100.538 | 1.00 | 34.04 | O |
| ATOM | 1928 | NE2 | GLN | B | 39 | −38.418 | −20.601 | 99.334 | 1.00 | 33.16 | N |
| ATOM | 1929 | N | LYS | B | 40 | −36.319 | −24.712 | 102.575 | 1.00 | 25.20 | N |
| ATOM | 1930 | CA | LYS | B | 40 | −35.694 | −24.322 | 103.822 | 1.00 | 25.84 | C |
| ATOM | 1931 | C | LYS | B | 40 | −35.497 | −22.813 | 103.870 | 1.00 | 27.20 | C |
| ATOM | 1932 | O | LYS | B | 40 | −35.478 | −22.145 | 102.827 | 1.00 | 26.37 | O |
| ATOM | 1933 | CB | LYS | B | 40 | −34.382 | −25.077 | 103.991 | 1.00 | 27.92 | C |
| ATOM | 1934 | CG | LYS | B | 40 | −34.624 | −26.487 | 104.544 | 1.00 | 30.32 | C |
| ATOM | 1935 | CD | LYS | B | 40 | −33.459 | −27.416 | 104.259 | 1.00 | 42.40 | C |
| ATOM | 1936 | CE | LYS | B | 40 | −33.761 | −28.834 | 104.704 | 1.00 | 39.36 | C |
| ATOM | 1937 | NZ | LYS | B | 40 | −33.984 | −28.911 | 106.185 | 1.00 | 42.39 | N1+ |
| ATOM | 1938 | N | PRO | B | 41 | −35.419 | −22.231 | 105.072 | 1.00 | 28.86 | N |
| ATOM | 1939 | CA | PRO | B | 41 | −35.467 | −20.757 | 105.192 | 1.00 | 27.65 | C |
| ATOM | 1940 | C | PRO | B | 41 | −34.345 | −20.077 | 104.416 | 1.00 | 27.79 | C |
| ATOM | 1941 | O | PRO | B | 41 | −33.168 | −20.420 | 104.558 | 1.00 | 30.55 | O |
| ATOM | 1942 | CB | PRO | B | 41 | −35.331 | −20.523 | 106.701 | 1.00 | 25.62 | C |
| ATOM | 1943 | CG | PRO | B | 41 | −35.861 | −21.785 | 107.321 | 1.00 | 23.53 | C |
| ATOM | 1944 | CD | PRO | B | 41 | −35.415 | −22.885 | 106.393 | 1.00 | 22.03 | C |
| ATOM | 1945 | N | GLY | B | 42 | −34.724 | −19.113 | 103.577 | 1.00 | 30.24 | N |
| ATOM | 1946 | CA | GLY | B | 42 | −33.743 | −18.444 | 102.750 | 1.00 | 26.94 | C |
| ATOM | 1947 | C | GLY | B | 42 | −33.131 | −19.294 | 101.657 | 1.00 | 34.34 | C |
| ATOM | 1948 | O | GLY | B | 42 | −32.033 | −18.976 | 101.191 | 1.00 | 29.82 | O |
| ATOM | 1949 | N | GLN | B | 43 | −33.790 | −20.388 | 101.254 | 1.00 | 29.49 | N |
| ATOM | 1950 | CA | GLN | B | 43 | −33.330 | −21.236 | 100.164 | 1.00 | 29.08 | C |
| ATOM | 1951 | C | GLN | B | 43 | −34.400 | −21.299 | 99.086 | 1.00 | 26.57 | C |
| ATOM | 1952 | O | GLN | B | 43 | −35.578 | −21.019 | 99.329 | 1.00 | 28.43 | O |
| ATOM | 1953 | CB | GLN | B | 43 | −32.994 | −22.665 | 100.622 | 1.00 | 33.38 | C |
| ATOM | 1954 | CG | GLN | B | 43 | −32.182 | −22.796 | 101.894 | 1.00 | 31.30 | C |
| ATOM | 1955 | CD | GLN | B | 43 | −30.769 | −22.262 | 101.737 | 1.00 | 45.21 | C |
| ATOM | 1956 | OE1 | GLN | B | 43 | −30.173 | −22.361 | 100.665 | 1.00 | 48.17 | O |
| ATOM | 1957 | NE2 | GLN | B | 43 | −30.215 | −21.713 | 102.818 | 1.00 | 50.07 | N |
| ATOM | 1958 | N | THR | B | 44 | −33.988 | −21.698 | 97.895 | 1.00 | 28.06 | N |
| ATOM | 1959 | CA | THR | B | 44 | −34.976 | −21.828 | 96.832 | 1.00 | 32.50 | C |
| ATOM | 1960 | C | THR | B | 44 | −35.755 | −23.142 | 97.000 | 1.00 | 29.43 | C |
| ATOM | 1961 | O | THR | B | 44 | −35.282 | −24.077 | 97.652 | 1.00 | 28.21 | O |
| ATOM | 1962 | CB | THR | B | 44 | −34.303 | −21.769 | 95.453 | 1.00 | 28.68 | C |
| ATOM | 1963 | OG1 | THR | B | 44 | −33.844 | −23.064 | 95.087 | 1.00 | 33.54 | O |
| ATOM | 1964 | CG2 | THR | B | 44 | −33.095 | −20.847 | 95.473 | 1.00 | 35.23 | C |
| ATOM | 1965 | N | PRO | B | 45 | −36.982 | −23.217 | 96.495 | 1.00 | 29.94 | N |
| ATOM | 1966 | CA | PRO | B | 45 | −37.745 | −24.456 | 96.658 | 1.00 | 27.80 | C |
| ATOM | 1967 | C | PRO | B | 45 | −37.021 | −25.614 | 95.982 | 1.00 | 24.29 | C |
| ATOM | 1968 | O | PRO | B | 45 | −36.256 | −25.428 | 95.042 | 1.00 | 28.45 | O |
| ATOM | 1969 | CB | PRO | B | 45 | −39.079 | −24.140 | 95.967 | 1.00 | 26.59 | C |
| ATOM | 1970 | CG | PRO | B | 45 | −39.175 | −22.670 | 95.983 | 1.00 | 23.14 | C |
| ATOM | 1971 | CD | PRO | B | 45 | −37.774 | −22.177 | 95.813 | 1.00 | 27.43 | C |
| ATOM | 1972 | N | ARG | B | 46 | −37.249 | −26.817 | 96.485 | 1.00 | 24.84 | N |
| ATOM | 1973 | CA | ARG | B | 46 | −36.741 | −28.036 | 95.863 | 1.00 | 27.05 | C |
| ATOM | 1974 | C | ARG | B | 46 | −37.920 | −28.935 | 95.516 | 1.00 | 28.13 | C |
| ATOM | 1975 | O | ARG | B | 46 | −38.743 | −29.258 | 96.385 | 1.00 | 27.30 | O |
| ATOM | 1976 | CB | ARG | B | 46 | −35.754 | −28.763 | 96.782 | 1.00 | 27.57 | C |
| ATOM | 1977 | CG | ARG | B | 46 | −35.323 | −30.144 | 96.305 | 1.00 | 35.27 | C |
| ATOM | 1978 | CD | ARG | B | 46 | −34.354 | −30.799 | 97.302 | 1.00 | 42.68 | C |
| ATOM | 1979 | NE | ARG | B | 46 | −33.035 | −30.146 | 97.316 | 1.00 | 59.78 | N |

TABLE 10.4-continued

| ATOM | 1980 | CZ | ARG | B | 46 | −32.623 | −29.218 | 98.197 | 1.00 | 64.38 | C |
|---|---|---|---|---|---|---|---|---|---|---|---|
| ATOM | 1981 | NH1 | ARG | B | 46 | −33.408 | −28.780 | 99.199 | 1.00 | 56.48 | N1+ |
| ATOM | 1982 | NH2 | ARG | B | 46 | −31.399 | −28.715 | 98.076 | 1.00 | 61.89 | N |
| ATOM | 1983 | N | LEU | B | 47 | −38.007 | −29.318 | 94.244 | 1.00 | 28.50 | N |
| ATOM | 1984 | CA | LEU | B | 47 | −39.058 | −30.216 | 93.781 | 1.00 | 25.28 | C |
| ATOM | 1985 | C | LEU | B | 47 | −38.930 | −31.576 | 94.455 | 1.00 | 25.95 | C |
| ATOM | 1986 | O | LEU | B | 47 | −37.851 | −32.175 | 94.457 | 1.00 | 30.65 | O |
| ATOM | 1987 | CB | LEU | B | 47 | −38.970 | −30.365 | 92.262 | 1.00 | 27.11 | C |
| ATOM | 1988 | CG | LEU | B | 47 | −39.935 | −31.368 | 91.643 | 1.00 | 27.81 | C |
| ATOM | 1989 | CD1 | LEU | B | 47 | −41.357 | −30.870 | 91.856 | 1.00 | 21.28 | C |
| ATOM | 1990 | CD2 | LEU | B | 47 | −39.622 | −31.533 | 90.175 | 1.00 | 24.15 | C |
| ATOM | 1991 | N | LEU | B | 48 | −40.027 | −32.055 | 95.040 | 1.00 | 22.73 | N |
| ATOM | 1992 | CA | LEU | B | 48 | −40.056 | −33.353 | 95.715 | 1.00 | 28.05 | C |
| ATOM | 1993 | C | LEU | B | 48 | −40.844 | −34.397 | 94.953 | 1.00 | 30.46 | C |
| ATOM | 1994 | O | LEU | B | 48 | −40.406 | −35.548 | 94.862 | 1.00 | 28.89 | O |
| ATOM | 1995 | CB | LEU | B | 48 | −40.685 | −33.237 | 97.112 | 1.00 | 29.74 | C |
| ATOM | 1996 | CG | LEU | B | 48 | −40.032 | −32.529 | 98.287 | 1.00 | 28.54 | C |
| ATOM | 1997 | CD1 | LEU | B | 48 | −40.954 | −32.632 | 99.462 | 1.00 | 25.93 | C |
| ATOM | 1998 | CD2 | LEU | B | 48 | −38.712 | −33.198 | 98.616 | 1.00 | 30.43 | C |
| ATOM | 1999 | N | ILE | B | 49 | −42.012 | −33.999 | 94.435 | 1.00 | 26.40 | N |
| ATOM | 2000 | CA | ILE | B | 49 | −42.988 | −34.879 | 93.804 | 1.00 | 26.75 | C |
| ATOM | 2001 | C | ILE | B | 49 | −43.560 | −34.161 | 92.594 | 1.00 | 24.70 | C |
| ATOM | 2002 | O | ILE | B | 49 | −43.809 | −32.958 | 92.648 | 1.00 | 22.99 | O |
| ATOM | 2003 | CB | ILE | B | 49 | −44.129 | −35.264 | 94.780 | 1.00 | 26.52 | C |
| ATOM | 2004 | CG1 | ILE | B | 49 | −43.583 | −35.980 | 96.018 | 1.00 | 21.26 | C |
| ATOM | 2005 | CG2 | ILE | B | 49 | −45.215 | −36.049 | 94.058 | 1.00 | 20.52 | C |
| ATOM | 2006 | CD1 | ILE | B | 49 | −43.212 | −37.429 | 95.770 | 1.00 | 22.03 | C |
| ATOM | 2007 | N | PHE | B | 50 | −43.749 | −34.888 | 91.491 | 1.00 | 26.33 | N |
| ATOM | 2008 | CA | PHE | B | 50 | −44.548 | −34.395 | 90.375 | 1.00 | 26.42 | C |
| ATOM | 2009 | C | PHE | B | 50 | −45.564 | −35.460 | 89.959 | 1.00 | 30.44 | C |
| ATOM | 2010 | O | PHE | B | 50 | −45.467 | −36.634 | 90.342 | 1.00 | 27.91 | O |
| ATOM | 2011 | CB | PHE | B | 50 | −43.678 | −33.982 | 89.184 | 1.00 | 21.93 | C |
| ATOM | 2012 | CG | PHE | B | 50 | −42.877 | −35.114 | 88.610 | 1.00 | 30.11 | C |
| ATOM | 2013 | CD1 | PHE | B | 50 | −43.407 | −35.919 | 87.609 | 1.00 | 27.24 | C |
| ATOM | 2014 | CD2 | PHE | B | 50 | −41.599 | −35.383 | 89.079 | 1.00 | 28.83 | C |
| ATOM | 2015 | CE1 | PHE | B | 50 | −42.682 | −36.965 | 87.085 | 1.00 | 34.14 | C |
| ATOM | 2016 | CE2 | PHE | B | 50 | −40.865 | −36.430 | 88.547 | 1.00 | 34.66 | C |
| ATOM | 2017 | CZ | PHE | B | 50 | −41.409 | −37.230 | 87.553 | 1.00 | 31.45 | C |
| ATOM | 2018 | N | GLY | B | 51 | −46.579 | −35.022 | 89.216 | 1.00 | 29.06 | N |
| ATOM | 2019 | CZ | GLY | B | 51 | −47.640 | −35.920 | 88.790 | 1.00 | 23.55 | C |
| ATOM | 2020 | C | GLY | B | 51 | −48.357 | −36.601 | 89.926 | 1.00 | 28.78 | C |
| ATOM | 2021 | O | GLY | B | 51 | −48.771 | −37.758 | 89.789 | 1.00 | 31.77 | O |
| ATOM | 2022 | N | ALA | B | 52 | −48.497 | −35.913 | 91.057 | 1.00 | 27.54 | N |
| ATOM | 2023 | CA | ALA | B | 52 | −49.180 | −36.389 | 92.253 | 1.00 | 27.65 | C |
| ATOM | 2024 | C | ALA | B | 52 | −48.403 | −37.468 | 92.995 | 1.00 | 27.89 | C |
| ATOM | 2025 | O | ALA | B | 52 | −48.422 | −37.465 | 94.231 | 1.00 | 25.68 | O |
| ATOM | 2026 | CB | ALA | B | 52 | −50.589 | −36.907 | 91.927 | 1.00 | 24.96 | C |
| ATOM | 2027 | N | SER | B | 53 | −47.679 | −38.358 | 92.289 | 1.00 | 24.53 | N |
| ATOM | 2028 | CA | SER | B | 53 | −47.036 | −39.468 | 93.002 | 1.00 | 27.35 | C |
| ATOM | 2029 | C | SER | B | 53 | −45.606 | −39.792 | 92.588 | 1.00 | 30.40 | C |
| ATOM | 2030 | O | SER | B | 53 | −44.970 | −40.616 | 93.257 | 1.00 | 31.18 | O |
| ATOM | 2031 | CB | SER | B | 53 | −47.855 | −40.745 | 92.844 | 1.00 | 27.15 | C |
| ATOM | 2032 | OG | SER | B | 53 | −48.178 | −40.933 | 91.485 | 1.00 | 33.66 | O |
| ATOM | 2033 | N | SER | B | 54 | −45.082 | −39.207 | 91.526 | 1.00 | 27.47 | N |
| ATOM | 2034 | CA | SER | B | 54 | −43.758 | −39.568 | 91.050 | 1.00 | 28.53 | C |
| ATOM | 2035 | C | SER | B | 54 | −42.717 | −38.787 | 91.833 | 1.00 | 28.97 | C |
| ATOM | 2036 | O | SER | B | 54 | −42.754 | −37.552 | 91.877 | 1.00 | 29.74 | O |
| ATOM | 2037 | CB | SER | B | 54 | −43.621 | −39.289 | 89.556 | 1.00 | 27.68 | C |
| ATOM | 2038 | OG | SER | B | 54 | −44.449 | −40.156 | 88.815 | 1.00 | 33.67 | O |
| ATOM | 2039 | N | ARG | B | 55 | −41.795 | −39.519 | 92.432 | 1.00 | 27.26 | N |
| ATOM | 2040 | CA | ARG | B | 55 | −40.657 | −38.955 | 93.138 | 1.00 | 32.14 | C |
| ATOM | 2041 | C | ARG | B | 55 | −39.710 | −38.275 | 92.152 | 1.00 | 30.42 | C |
| ATOM | 2042 | O | ARG | B | 55 | −39.438 | −38.817 | 91.084 | 1.00 | 34.35 | O |
| ATOM | 2043 | CB | ARG | B | 55 | −39.955 | −40.099 | 93.864 | 1.00 | 28.20 | C |
| ATOM | 2044 | CG | ARG | B | 55 | −39.168 | −39.786 | 95.061 | 1.00 | 33.52 | C |
| ATOM | 2045 | CD | ARG | B | 55 | −38.583 | −41.090 | 95.651 | 1.00 | 37.14 | C |
| ATOM | 2046 | NE | ARG | B | 55 | −39.581 | −41.791 | 96.442 | 1.00 | 41.03 | N |
| ATOM | 2047 | CZ | ARG | B | 55 | −40.134 | −42.948 | 96.118 | 1.00 | 41.47 | C |
| ATOM | 2048 | NH1 | ARG | B | 55 | −41.056 | −43.474 | 96.923 | 1.00 | 39.94 | N1+ |
| ATOM | 2049 | NH2 | ARG | B | 55 | −39.756 | −43.579 | 95.009 | 1.00 | 39.66 | N |
| ATOM | 2050 | N | ALA | B | 56 | −39.246 | −37.068 | 92.483 | 1.00 | 32.10 | N |
| ATOM | 2051 | CA | ALA | B | 56 | −38.216 | −36.416 | 91.686 | 1.00 | 34.96 | C |
| ATOM | 2052 | C | ALA | B | 56 | −36.843 | −37.013 | 91.987 | 1.00 | 37.35 | C |
| ATOM | 2053 | O | ALA | B | 56 | −36.647 | −37.718 | 92.975 | 1.00 | 43.05 | O |
| ATOM | 2054 | CB | ALA | B | 56 | −38.183 | −34.911 | 91.952 | 1.00 | 30.18 | C |
| ATOM | 2055 | N | THR | B | 57 | −35.892 | −36.740 | 91.111 | 1.00 | 37.37 | N |
| ATOM | 2056 | CA | THR | B | 57 | −34.521 | −37.183 | 91.324 | 1.00 | 38.34 | C |
| ATOM | 2057 | C | THR | B | 57 | −33.836 | −36.270 | 92.313 | 1.00 | 39.91 | C |
| ATOM | 2058 | O | THR | B | 57 | −34.179 | −35.087 | 92.386 | 1.00 | 46.64 | O |
| ATOM | 2059 | CB | THR | B | 57 | −33.716 | −37.185 | 90.020 | 1.00 | 45.59 | C |

TABLE 10.4-continued

| ATOM | 2060 | OG1 | THR | B | 57 | −34.516 | −36.612 | 88.969 | 1.00 | 40.75 | O |
|---|---|---|---|---|---|---|---|---|---|---|---|
| ATOM | 2061 | CG2 | THR | B | 57 | −33.271 | −38.620 | 89.674 | 1.00 | 44.70 | C |
| ATOM | 2062 | N | GLY | B | 58 | −32.937 | −36.780 | 93.143 | 1.00 | 39.76 | N |
| ATOM | 2063 | CA | GLY | B | 58 | −32.957 | −38.118 | 93.653 | 1.00 | 35.82 | C |
| ATOM | 2064 | C | GLY | B | 58 | −33.485 | −37.854 | 95.061 | 1.00 | 40.59 | C |
| ATOM | 2065 | O | GLY | B | 58 | −32.728 | −37.724 | 96.021 | 1.00 | 37.19 | O |
| ATOM | 2066 | N | ILE | B | 59 | −34.798 | −37.704 | 95.160 | 1.00 | 33.85 | N |
| ATOM | 2067 | CA | ILE | B | 59 | −35.455 | −37.513 | 96.450 | 1.00 | 31.14 | C |
| ATOM | 2068 | C | ILE | B | 59 | −35.518 | −38.865 | 97.158 | 1.00 | 38.31 | C |
| ATOM | 2069 | O | ILE | B | 59 | −35.890 | −39.859 | 96.524 | 1.00 | 35.35 | O |
| ATOM | 2070 | CB | ILE | B | 59 | −36.855 | −36.904 | 96.264 | 1.00 | 29.49 | C |
| ATOM | 2071 | CG1 | ILE | B | 59 | −36.817 | −35.375 | 96.109 | 1.00 | 29.46 | C |
| ATOM | 2072 | CG2 | ILE | B | 59 | −37.756 | −37.240 | 97.420 | 1.00 | 30.78 | C |
| ATOM | 2073 | CD1 | ILE | B | 59 | −35.937 | −34.826 | 95.062 | 1.00 | 37.31 | C |
| ATOM | 2074 | N | PRO | B | 60 | −35.097 | −38.960 | 98.459 | 1.00 | 38.88 | N |
| ATOM | 2075 | CA | PRO | B | 60 | −35.157 | −40.238 | 99.191 | 1.00 | 33.20 | C |
| ATOM | 2076 | C | PRO | B | 60 | −36.530 | −40.890 | 99.128 | 1.00 | 36.41 | C |
| ATOM | 2077 | O | PRO | B | 60 | −37.527 | −40.200 | 98.889 | 1.00 | 37.79 | O |
| ATOM | 2078 | CB | PRO | B | 60 | −34.831 | −39.817 | 100.629 | 1.00 | 34.92 | C |
| ATOM | 2079 | CG | PRO | B | 60 | −34.076 | −38.600 | 100.501 | 1.00 | 30.53 | C |
| ATOM | 2080 | CD | PRO | B | 60 | −34.609 | −37.876 | 99.320 | 1.00 | 31.01 | C |
| ATOM | 2081 | N | ASP | B | 61 | −36.626 | −42.202 | 99.320 | 1.00 | 33.86 | N |
| ATOM | 2082 | CA | ASP | B | 61 | −37.968 | −42.778 | 99.248 | 1.00 | 38.89 | C |
| ATOM | 2083 | C | ASP | B | 61 | −38.762 | −42.694 | 100.558 | 1.00 | 33.94 | C |
| ATOM | 2084 | O | ASP | B | 61 | −39.868 | −43.244 | 100.610 | 1.00 | 36.31 | O |
| ATOM | 2085 | CB | ASP | B | 61 | −37.897 | −44.220 | 98.751 | 1.00 | 43.25 | C |
| ATOM | 2086 | CG | ASP | B | 61 | −36.955 | −45.052 | 99.542 | 1.00 | 47.58 | C |
| ATOM | 2087 | OD1 | ASP | B | 61 | −36.741 | −44.735 | 100.731 | 1.00 | 49.56 | O |
| ATOM | 2088 | OD2 | ASP | B | 61 | −36.427 | −46.029 | 98.972 | 1.00 | 65.96 | O1− |
| ATOM | 2089 | N | ARG | B | 62 | −38.222 | −42.061 | 101.609 | 1.00 | 32.55 | N |
| ATOM | 2090 | CA | ARG | B | 62 | −39.015 | −41.532 | 102.717 | 1.00 | 32.36 | C |
| ATOM | 2091 | C | ARG | B | 62 | −40.241 | −40.805 | 102.198 | 1.00 | 29.63 | C |
| ATOM | 2092 | O | ARG | B | 62 | −41.318 | −40.850 | 102.794 | 1.00 | 30.70 | O |
| ATOM | 2093 | CB | ARG | B | 62 | −38.243 | −40.501 | 103.536 | 1.00 | 35.05 | C |
| ATOM | 2094 | CG | ARG | B | 62 | −37.041 | −40.958 | 104.180 | 1.00 | 36.82 | C |
| ATOM | 2095 | CD | ARG | B | 62 | −36.754 | −40.043 | 105.334 | 1.00 | 38.78 | C |
| ATOM | 2096 | NE | ARG | B | 62 | −36.191 | −38.739 | 105.001 | 1.00 | 39.12 | N |
| ATOM | 2097 | CZ | ARG | B | 62 | −35.001 | −38.571 | 104.422 | 1.00 | 39.01 | C |
| ATOM | 2098 | NH1 | ARG | B | 62 | −34.289 | −39.630 | 104.056 | 1.00 | 36.63 | N1+ |
| ATOM | 2099 | NH2 | ARG | B | 62 | −34.530 | −37.352 | 104.195 | 1.00 | 33.11 | N |
| ATOM | 2100 | N | PHE | B | 63 | −40.042 | −40.074 | 101.115 | 1.00 | 31.12 | N |
| ATOM | 2101 | CA | PHE | B | 63 | −41.075 | −39.242 | 100.534 | 1.00 | 35.11 | C |
| ATOM | 2102 | C | PHE | B | 63 | −41.916 | −40.080 | 99.586 | 1.00 | 34.68 | C |
| ATOM | 2103 | O | PHE | B | 63 | −41.373 | −40.790 | 98.729 | 1.00 | 30.34 | O |
| ATOM | 2104 | CB | PHE | B | 63 | −40.444 | −38.054 | 99.803 | 1.00 | 27.94 | C |
| ATOM | 2105 | CG | PHE | B | 63 | −39.701 | −37.135 | 100.713 | 1.00 | 28.72 | C |
| ATOM | 2106 | CD1 | PHE | B | 63 | −38.408 | −37.425 | 101.099 | 1.00 | 31.44 | C |
| ATOM | 2107 | CD2 | PHE | B | 63 | −40.308 | −36.008 | 101.227 | 1.00 | 30.94 | C |
| ATOM | 2108 | CE1 | PHE | B | 63 | −37.731 | −36.592 | 101.968 | 1.00 | 33.00 | C |
| ATOM | 2109 | CE2 | PHE | B | 63 | −39.630 | −35.178 | 102.097 | 1.00 | 29.25 | C |
| ATOM | 2110 | CZ | PHE | B | 63 | −38.344 | −35.471 | 102.464 | 1.00 | 27.63 | C |
| ATOM | 2111 | N | SER | B | 64 | −43.235 | −40.023 | 99.775 | 1.00 | 30.03 | N |
| ATOM | 2112 | CA | SER | B | 64 | −44.181 | −40.581 | 98.819 | 1.00 | 30.73 | C |
| ATOM | 2113 | C | SER | B | 64 | −45.432 | −39.715 | 98.844 | 1.00 | 27.36 | C |
| ATOM | 2114 | O | SER | B | 64 | −45.684 | −38.974 | 99.796 | 1.00 | 25.57 | O |
| ATOM | 2115 | CB | SER | B | 64 | −44.501 | −42.064 | 99.109 | 1.00 | 28.95 | C |
| ATOM | 2116 | OG | SER | B | 64 | −45.445 | −42.217 | 100.156 | 1.00 | 29.24 | O |
| ATOM | 2117 | N | ALA | B | 65 | −46.221 | −39.806 | 97.784 | 1.00 | 26.92 | N |
| ATOM | 2118 | CA | ALA | B | 65 | −47.407 | −38.974 | 97.723 | 1.00 | 30.37 | C |
| ATOM | 2119 | C | ALA | B | 65 | −48.448 | −39.670 | 96.870 | 1.00 | 30.47 | C |
| ATOM | 2120 | O | ALA | B | 65 | −48.134 | −40.578 | 96.096 | 1.00 | 31.92 | O |
| ATOM | 2121 | CB | ALA | B | 65 | −47.087 | −37.583 | 97.157 | 1.00 | 26.67 | C |
| ATOM | 2122 | N | SER | B | 66 | −49.692 | −39.216 | 97.007 | 1.00 | 27.32 | N |
| ATOM | 2123 | CA | SER | B | 66 | −50.792 | −39.781 | 96.242 | 1.00 | 30.42 | C |
| ATOM | 2124 | C | SER | B | 66 | −51.978 | −38.825 | 96.278 | 1.00 | 27.86 | C |
| ATOM | 2125 | O | SER | B | 66 | −51.955 | −37.788 | 96.938 | 1.00 | 30.99 | O |
| ATOM | 2126 | CB | SER | B | 66 | −51.165 | −41.164 | 96.778 | 1.00 | 32.05 | C |
| ATOM | 2127 | OG | SER | B | 66 | −51.732 | −41.026 | 98.065 | 1.00 | 42.20 | O |
| ATOM | 2128 | N | GLY | B | 67 | −53.025 | −39.190 | 95.559 | 1.00 | 32.79 | N |
| ATOM | 2129 | CA | GLY | B | 67 | −54.256 | −38.435 | 95.552 | 1.00 | 28.74 | C |
| ATOM | 2130 | C | GLY | B | 67 | −54.669 | −38.125 | 94.138 | 1.00 | 34.13 | C |
| ATOM | 2131 | O | GLY | B | 67 | −53.835 | −38.175 | 93.223 | 1.00 | 38.32 | O |
| ATOM | 2132 | N | SER | B | 68 | −55.943 | −37.795 | 93.936 | 1.00 | 35.14 | N |
| ATOM | 2133 | CA | SER | B | 68 | −56.352 | −37.221 | 92.663 | 1.00 | 35.12 | C |
| ATOM | 2134 | C | SER | B | 68 | −57.678 | −36.522 | 92.863 | 1.00 | 35.78 | C |
| ATOM | 2135 | O | SER | B | 68 | −58.409 | −36.804 | 93.810 | 1.00 | 40.40 | O |
| ATOM | 2136 | CB | SER | B | 68 | −56.473 | −38.268 | 91.551 | 1.00 | 42.92 | C |
| ATOM | 2137 | OG | SER | B | 68 | −56.634 | −37.637 | 90.276 | 1.00 | 47.38 | O |
| ATOM | 2138 | N | GLY | B | 69 | −57.990 | −35.635 | 91.924 | 1.00 | 38.09 | N |
| ATOM | 2139 | CA | GLY | B | 69 | −59.167 | −34.812 | 91.999 | 1.00 | 27.17 | C |

TABLE 10.4-continued

| | | | | | | | | | | |
|---|---|---|---|---|---|---|---|---|---|---|
| ATOM | 2140 | C | GLY | B | 69 | −59.015 | −33.747 | 93.048 | 1.00 | 30.94 | C |
| ATOM | 2141 | O | GLY | B | 69 | −58.281 | −32.775 | 92.867 | 1.00 | 32.99 | O |
| ATOM | 2142 | N | ALA | B | 70 | −59.712 | −33.901 | 94.161 | 1.00 | 36.50 | N |
| ATOM | 2143 | CA | ALA | B | 70 | −59.738 | −32.812 | 95.113 | 1.00 | 33.81 | C |
| ATOM | 2144 | C | ALA | B | 70 | −58.726 | −32.974 | 96.231 | 1.00 | 32.23 | C |
| ATOM | 2145 | O | ALA | B | 70 | −58.401 | −31.980 | 96.877 | 1.00 | 32.47 | O |
| ATOM | 2146 | CB | ALA | B | 70 | −61.137 | −32.661 | 95.704 | 1.00 | 27.91 | C |
| ATOM | 2147 | N | ASP | B | 71 | −58.216 | −34.184 | 96.471 | 1.00 | 28.53 | N |
| ATOM | 2148 | CA | ASP | B | 71 | −57.431 | −34.467 | 97.669 | 1.00 | 32.89 | C |
| ATOM | 2149 | C | ASP | B | 71 | −56.068 | −35.055 | 97.343 | 1.00 | 29.82 | C |
| ATOM | 2150 | O | ASP | B | 71 | −55.966 | −36.08 | 96.596 | 1.00 | 32.00 | O |
| ATOM | 2151 | CB | ASP | B | 71 | −58.176 | −35.394 | 98.631 | 1.00 | 29.01 | C |
| ATOM | 2152 | CG | ASP | B | 71 | −59.067 | −34.621 | 99.579 | 1.00 | 49.76 | C |
| ATOM | 2153 | OD1 | ASP | B | 71 | −58.492 | −34.037 | 100.529 | 1.00 | 51.82 | O |
| ATOM | 2154 | OD2 | ASP | B | 71 | −60.313 | −34.586 | 99.395 | 1.00 | 55.52 | O1− |
| ATOM | 2155 | N | PHE | B | 72 | −55.023 | −34.452 | 97.915 | 1.00 | 28.01 | N |
| ATOM | 2156 | CA | PHE | B | 72 | −53.651 | −34.911 | 97.756 | 1.00 | 26.76 | C |
| ATOM | 2157 | C | PHE | B | 72 | −52.964 | −34.963 | 99.110 | 1.00 | 24.59 | C |
| ATOM | 2158 | O | PHE | B | 72 | −53.217 | −34.129 | 99.987 | 1.00 | 27.45 | O |
| ATOM | 2159 | CB | PHE | B | 72 | −52.889 | −34.002 | 96.778 | 1.00 | 29.56 | C |
| ATOM | 2160 | CG | PHE | B | 72 | −53.477 | −34.000 | 95.391 | 1.00 | 29.36 | C |
| ATOM | 2161 | CD1 | PHE | B | 72 | −54.491 | −33.128 | 95.058 | 1.00 | 29.76 | C |
| ATOM | 2162 | CD2 | PHE | B | 72 | −53.050 | −34.917 | 94.441 | 1.00 | 28.24 | C |
| ATOM | 2163 | CE1 | PHE | B | 72 | −55.056 | −33.152 | 93.790 | 1.00 | 33.06 | C |
| ATOM | 2164 | CE2 | PHE | B | 72 | −53.606 | −34.935 | 93.163 | 1.00 | 29.21 | C |
| ATOM | 2165 | CZ | PHE | B | 72 | −54.619 | −34.058 | 92.846 | 1.00 | 27.62 | C |
| ATOM | 2166 | N | THR | B | 73 | −52.117 | −35.955 | 99.300 | 1.00 | 20.91 | N |
| ATOM | 2167 | CA | THR | B | 73 | −51.335 | −36.002 | 100.516 | 1.00 | 24.42 | C |
| ATOM | 2168 | C | THR | B | 73 | −49.884 | −36.323 | 100.180 | 1.00 | 25.69 | C |
| ATOM | 2169 | O | THR | B | 73 | −49.583 | −37.044 | 99.216 | 1.00 | 24.83 | O |
| ATOM | 2170 | CB | THR | B | 73 | −51.917 | −37.002 | 101.553 | 1.00 | 23.96 | C |
| ATOM | 2171 | OG1 | THR | B | 73 | −51.922 | −38.307 | 101.005 | 1.00 | 31.75 | O |
| ATOM | 2172 | CG2 | THR | B | 73 | −53.357 | −36.634 | 101.919 | 1.00 | 29.11 | C |
| ATOM | 2173 | N | LEU | B | 74 | −48.989 | −35.720 | 100.963 | 1.00 | 25.80 | N |
| ATOM | 2174 | CA | LEU | B | 74 | −47.565 | −36.023 | 100.955 | 1.00 | 26.02 | C |
| ATOM | 2175 | C | LEU | B | 74 | −47.252 | −36.738 | 102.262 | 1.00 | 25.39 | C |
| ATOM | 2176 | O | LEU | B | 74 | −47.701 | −36.303 | 103.322 | 1.00 | 25.96 | O |
| ATOM | 2177 | CB | LEU | B | 74 | −46.730 | −34.747 | 100.811 | 1.00 | 22.71 | C |
| ATOM | 2178 | CG | LEU | B | 74 | −45.217 | −34.943 | 100.997 | 1.00 | 27.97 | C |
| ATOM | 2179 | CD1 | LEU | B | 74 | −44.602 | −35.660 | 99.806 | 1.00 | 23.58 | C |
| ATOM | 2180 | CD2 | LEU | B | 74 | −44.486 | −33.635 | 101.264 | 1.00 | 25.42 | C |
| ATOM | 2181 | N | THR | B | 75 | −46.551 | −37.866 | 102.182 | 1.00 | 25.21 | N |
| ATOM | 2182 | CA | THR | B | 75 | −46.187 | −38.649 | 103.358 | 1.00 | 24.77 | C |
| ATOM | 2183 | C | THR | B | 75 | −44.676 | −38.773 | 103.458 | 1.00 | 29.94 | C |
| ATOM | 2184 | O | THR | B | 75 | −44.012 | −39.180 | 102.496 | 1.00 | 30.23 | O |
| ATOM | 2185 | CB | THR | B | 75 | −46.830 | −40.040 | 103.345 | 1.00 | 27.93 | C |
| ATOM | 2186 | OG1 | THR | B | 75 | −48.185 | −39.936 | 103.785 | 1.00 | 33.93 | O |
| ATOM | 2187 | CG2 | THR | B | 75 | −46.105 | −40.998 | 104.261 | 1.00 | 32.07 | C |
| ATOM | 2188 | N | ILE | B | 76 | −44.145 | −38.402 | 104.621 | 1.00 | 29.36 | N |
| ATOM | 2189 | CA | ILE | B | 76 | −42.760 | −38.649 | 105.003 | 1.00 | 29.13 | C |
| ATOM | 2190 | C | ILE | B | 76 | −42.807 | −39.727 | 106.074 | 1.00 | 29.72 | C |
| ATOM | 2191 | O | ILE | B | 76 | −43.436 | −39.537 | 107.122 | 1.00 | 30.62 | O |
| ATOM | 2192 | CB | ILE | B | 76 | −42.070 | −37.369 | 105.508 | 1.00 | 26.60 | C |
| ATOM | 2193 | CG1 | ILE | B | 76 | −42.336 | −36.210 | 104.551 | 1.00 | 32.41 | C |
| ATOM | 2194 | CG2 | ILE | B | 76 | −40.581 | −37.563 | 105.617 | 1.00 | 24.68 | C |
| ATOM | 2195 | CD1 | ILE | B | 76 | −41.949 | −34.861 | 105.118 | 1.00 | 27.44 | C |
| ATOM | 2196 | N | SER | B | 77 | −42.195 | −40.878 | 105.798 | 1.00 | 31.29 | N |
| ATOM | 2197 | CA | SER | B | 77 | −42.453 | −42.041 | 106.645 | 1.00 | 34.52 | C |
| ATOM | 2198 | C | SER | B | 77 | −41.647 | −42.001 | 107.937 | 1.00 | 36.39 | C |
| ATOM | 2199 | O | SER | B | 77 | −42.148 | −42.404 | 108.994 | 1.00 | 42.84 | O |
| ATOM | 2200 | CB | SER | B | 77 | −42.183 | −43.327 | 105.871 | 1.00 | 28.00 | C |
| ATOM | 2201 | OG | SER | B | 77 | −40.838 | −43.394 | 105.441 | 1.00 | 30.78 | O |
| ATOM | 2202 | N | ARG | B | 78 | −40.419 | −41.502 | 107.873 | 1.00 | 29.86 | N |
| ATOM | 2203 | CA | ARG | B | 78 | −39.567 | −41.274 | 109.032 | 1.00 | 29.69 | C |
| ATOM | 2204 | C | ARG | B | 78 | −38.973 | −39.882 | 108.882 | 1.00 | 32.92 | C |
| ATOM | 2205 | O | ARG | B | 78 | −38.317 | −39.601 | 107.879 | 1.00 | 33.41 | O |
| ATOM | 2206 | CB | ARG | B | 78 | −38.467 | −42.342 | 109.133 | 1.00 | 39.68 | C |
| ATOM | 2207 | CG | ARG | B | 78 | −37.255 | −41.895 | 109.982 | 1.00 | 45.90 | C |
| ATOM | 2208 | CD | ARG | B | 78 | −36.191 | −42.997 | 110.245 | 1.00 | 50.49 | C |
| ATOM | 2209 | NE | ARG | B | 78 | −35.401 | −42.741 | 111.473 | 1.00 | 56.24 | N |
| ATOM | 2210 | CZ | ARG | B | 78 | −35.796 | −43.031 | 112.717 | 1.00 | 51.76 | C |
| ATOM | 2211 | NH1 | ARG | B | 78 | −35.013 | −42.754 | 113.768 | 1.00 | 42.94 | N1+ |
| ATOM | 2212 | NH2 | ARG | B | 78 | −36.989 | −43.591 | 112.915 | 1.00 | 53.21 | N |
| ATOM | 2213 | N | LEU | B | 79 | −39.284 | −38.987 | 109.813 | 1.00 | 33.51 | N |
| ATOM | 2214 | CA | LEU | B | 79 | −38.785 | −37.612 | 109.757 | 1.00 | 30.48 | C |
| ATOM | 2215 | C | LEU | B | 79 | −37.289 | −37.545 | 110.092 | 1.00 | 31.79 | C |
| ATOM | 2216 | O | LEU | B | 79 | −36.893 | −37.791 | 111.233 | 1.00 | 34.10 | O |
| ATOM | 2217 | CB | LEU | B | 79 | −39.590 | −36.756 | 110.722 | 1.00 | 29.33 | C |
| ATOM | 2218 | CG | LEU | B | 79 | −40.492 | −35.683 | 110.136 | 1.00 | 29.23 | C |
| ATOM | 2219 | CD1 | LEU | B | 79 | −40.779 | −35.916 | 108.706 | 1.00 | 23.33 | C |

TABLE 10.4-continued

| | | | | | | | | | | |
|---|---|---|---|---|---|---|---|---|---|---|
| ATOM | 2220 | CD2 | LEU | B | 79 | −41.769 | −35.681 | 110.920 | 1.00 | 27.74 | C |
| ATOM | 2221 | N | GLU | B | 80 | −36.439 | −37.169 | 109.109 | 1.00 | 32.68 | N |
| ATOM | 2222 | CA | GLU | B | 80 | −35.028 | −36.892 | 109.360 | 1.00 | 33.86 | C |
| ATOM | 2223 | C | GLU | B | 80 | −34.836 | −35.408 | 109.665 | 1.00 | 35.88 | C |
| ATOM | 2224 | O | GLU | B | 80 | −35.701 | −34.593 | 109.339 | 1.00 | 34.51 | O |
| ATOM | 2225 | CB | GLU | B | 80 | −34.186 | −37.294 | 108.144 | 1.00 | 36.87 | C |
| ATOM | 2226 | CG | GLU | B | 80 | −34.116 | −38.792 | 107.876 | 1.00 | 36.11 | C |
| ATOM | 2227 | CD | GLU | B | 80 | −33.480 | −39.579 | 109.018 | 1.00 | 45.93 | C |
| ATOM | 2228 | OE1 | GLU | B | 80 | −33.946 | −40.719 | 109.264 | 1.00 | 47.66 | O |
| ATOM | 2229 | OE2 | GLU | B | 80 | −32.553 | −39.050 | 109.696 | 1.00 | 47.84 | O1− |
| ATOM | 2230 | N | PRO | B | 81 | −33.719 | −35.014 | 110.302 | 1.00 | 38.88 | N |
| ATOM | 2231 | CA | PRO | B | 81 | −33.544 | −33.588 | 110.659 | 1.00 | 34.21 | C |
| ATOM | 2232 | C | PRO | B | 81 | −33.719 | −32.635 | 109.488 | 1.00 | 36.66 | C |
| ATOM | 2233 | O | PRO | B | 81 | −34.340 | −31.574 | 109.634 | 1.00 | 35.85 | O |
| ATOM | 2234 | CB | PRO | B | 81 | −32.112 | −33.540 | 111.209 | 1.00 | 41.16 | C |
| ATOM | 2235 | CG | PRO | B | 81 | −31.881 | −34.922 | 111.747 | 1.00 | 43.24 | C |
| ATOM | 2236 | CD | PRO | B | 81 | −32.600 | −35.843 | 110.790 | 1.00 | 43.50 | C |
| ATOM | 2237 | N | GLU | B | 82 | −33.190 | −32.994 | 108.325 | 1.00 | 33.34 | N |
| ATOM | 2238 | CA | GLU | B | 82 | −33.310 | −32.225 | 107.093 | 1.00 | 34.68 | C |
| ATOM | 2239 | C | GLU | B | 82 | −34.704 | −32.235 | 106.492 | 1.00 | 36.53 | C |
| ATOM | 2240 | O | GLU | B | 82 | −34.861 | −31.767 | 105.360 | 1.00 | 32.72 | O |
| ATOM | 2241 | CB | GLU | B | 82 | −32.363 | −32.799 | 106.059 | 1.00 | 37.11 | C |
| ATOM | 2242 | CG | GLU | B | 82 | −32.783 | −34.160 | 105.573 | 1.00 | 41.97 | C |
| ATOM | 2243 | CD | GLU | B | 82 | −31.777 | −35.240 | 105.930 | 1.00 | 51.14 | C |
| ATOM | 2244 | OE1 | GLU | B | 82 | −31.259 | −35.252 | 107.093 | 1.00 | 45.81 | O |
| ATOM | 2245 | OE2 | GLU | B | 82 | −31.522 | −36.080 | 105.032 | 1.00 | 60.52 | O1− |
| ATOM | 2246 | N | ASP | B | 83 | −35.691 | −32.835 | 107.151 | 1.00 | 36.25 | N |
| ATOM | 2247 | CA | ASP | B | 83 | −37.045 | −32.856 | 106.622 | 1.00 | 30.47 | C |
| ATOM | 2248 | C | ASP | B | 83 | −37.924 | −31.782 | 107.227 | 1.00 | 26.07 | C |
| ATOM | 2249 | O | ASP | B | 83 | −39.029 | −31.554 | 106.726 | 1.00 | 22.59 | O |
| ATOM | 2250 | CB | ASP | B | 83 | −37.673 | −34.235 | 106.815 | 1.00 | 28.20 | C |
| ATOM | 2251 | CG | ASP | B | 83 | −36.966 | −35.300 | 105.987 | 1.00 | 37.30 | C |
| ATOM | 2252 | OD1 | ASP | B | 83 | −36.200 | −34.897 | 105.068 | 1.00 | 38.14 | O |
| ATOM | 2253 | OD2 | ASP | B | 83 | −37.177 | −36.519 | 106.234 | 1.00 | 37.91 | O1− |
| ATOM | 2254 | N | PHE | B | 84 | −37.420 | −31.069 | 108.221 | 1.00 | 22.98 | N |
| ATOM | 2255 | CA | PHE | B | 84 | −38.174 | −30.025 | 108.897 | 1.00 | 27.33 | C |
| ATOM | 2256 | C | PHE | B | 84 | −37.971 | −28.727 | 108.122 | 1.00 | 28.99 | C |
| ATOM | 2257 | O | PHE | B | 84 | −36.861 | −28.182 | 108.083 | 1.00 | 25.03 | O |
| ATOM | 2258 | CB | PHE | B | 84 | −37.721 | −29.926 | 110.346 | 1.00 | 27.37 | C |
| ATOM | 2259 | CG | PHE | B | 84 | −37.992 | −31.172 | 111.114 | 1.00 | 29.16 | C |
| ATOM | 2260 | CD2 | PHE | B | 84 | −39.193 | −31.337 | 111.794 | 1.00 | 27.59 | C |
| ATOM | 2261 | CD1 | PHE | B | 84 | −37.076 | −32.213 | 111.100 | 1.00 | 25.70 | C |
| ATOM | 2262 | CE2 | PHE | B | 84 | −39.456 | −32.507 | 112.497 | 1.00 | 31.00 | C |
| ATOM | 2263 | CE1 | PHE | B | 84 | −37.334 | −33.386 | 111.793 | 1.00 | 31.57 | C |
| ATOM | 2264 | CZ | PHE | B | 84 | −38.527 | −33.529 | 112.505 | 1.00 | 32.40 | C |
| ATOM | 2265 | N | ALA | B | 85 | −39.048 | −28.257 | 107.494 | 1.00 | 26.46 | N |
| ATOM | 2266 | CA | ALA | B | 85 | −39.022 | −27.288 | 106.408 | 1.00 | 23.46 | C |
| ATOM | 2267 | C | ALA | B | 85 | −40.457 | −26.866 | 106.126 | 1.00 | 23.53 | C |
| ATOM | 2268 | O | ALA | B | 85 | −41.404 | −27.329 | 106.771 | 1.00 | 22.25 | O |
| ATOM | 2269 | CB | ALA | B | 85 | −38.376 | −27.893 | 105.154 | 1.00 | 21.86 | C |
| ATOM | 2270 | N | VAL | B | 86 | −40.617 | −26.039 | 105.105 | 1.00 | 23.47 | N |
| ATOM | 2271 | CA | VAL | B | 86 | −41.936 | −25.680 | 104.600 | 1.00 | 23.19 | C |
| ATOM | 2272 | C | VAL | B | 86 | −42.201 | −26.477 | 103.330 | 1.00 | 22.81 | C |
| ATOM | 2273 | O | VAL | B | 86 | −41.314 | −26.672 | 102.500 | 1.00 | 22.61 | O |
| ATOM | 2274 | CB | VAL | B | 86 | −42.053 | −24.162 | 104.366 | 1.00 | 25.35 | C |
| ATOM | 2275 | CG1 | VAL | B | 86 | −43.330 | −23.837 | 103.664 | 1.00 | 26.56 | C |
| ATOM | 2276 | CG2 | VAL | B | 86 | −42.014 | −23.424 | 105.700 | 1.00 | 19.36 | C |
| ATOM | 2277 | N | TYR | B | 87 | −43.417 | −26.967 | 103.188 | 1.00 | 23.96 | N |
| ATOM | 2278 | CA | TYR | B | 87 | −43.798 | −27.738 | 102.021 | 1.00 | 25.43 | C |
| ATOM | 2279 | C | TYR | B | 87 | −44.915 | −27.002 | 101.304 | 1.00 | 27.51 | C |
| ATOM | 2280 | O | TYR | B | 87 | −45.806 | −26.452 | 101.949 | 1.00 | 24.76 | O |
| ATOM | 2281 | CB | TYR | B | 87 | −44.216 | −29.157 | 102.418 | 1.00 | 22.13 | C |
| ATOM | 2282 | CG | TYR | B | 87 | −43.036 | −29.940 | 102.943 | 1.00 | 26.73 | C |
| ATOM | 2283 | CD1 | TYR | B | 87 | −42.575 | −29.754 | 104.253 | 1.00 | 22.18 | C |
| ATOM | 2284 | CD2 | TYR | B | 87 | −42.355 | −30.833 | 102.129 | 1.00 | 22.28 | C |
| ATOM | 2285 | CE1 | TYR | B | 87 | −41.484 | −30.435 | 104.729 | 1.00 | 21.84 | C |
| ATOM | 2286 | CE2 | TYR | B | 87 | −41.256 | −31.533 | 102.612 | 1.00 | 25.81 | C |
| ATOM | 2287 | CZ | TYR | B | 87 | −40.816 | −31.334 | 103.906 | 1.00 | 25.45 | C |
| ATOM | 2288 | OH | TYR | B | 87 | −39.716 | −32.037 | 104.374 | 1.00 | 18.88 | O |
| ATOM | 2289 | N | PHE | B | 88 | −44.823 | −26.949 | 99.973 | 1.00 | 25.00 | N |
| ATOM | 2290 | CA | PHE | B | 88 | −45.780 | −26.258 | 99.124 | 1.00 | 26.03 | C |
| ATOM | 2291 | C | PHE | B | 88 | −46.299 | −27.240 | 98.077 | 1.00 | 30.78 | C |
| ATOM | 2292 | O | PHE | B | 88 | −45.519 | −28.026 | 97.519 | 1.00 | 30.24 | O |
| ATOM | 2293 | CB | PHE | B | 88 | −45.131 | −25.063 | 98.406 | 1.00 | 27.78 | C |
| ATOM | 2294 | CG | PHE | B | 88 | −44.809 | −23.887 | 99.307 | 1.00 | 31.23 | C |
| ATOM | 2295 | CD1 | PHE | B | 88 | −45.802 | −23.008 | 99.730 | 1.00 | 30.25 | C |
| ATOM | 2296 | CD2 | PHE | B | 88 | −43.494 | −23.634 | 99.690 | 1.00 | 30.31 | C |
| ATOM | 2297 | CE1 | PHE | B | 88 | −45.493 | −21.904 | 100.539 | 1.00 | 30.57 | C |
| ATOM | 2298 | CE2 | PHE | B | 88 | −43.185 | −22.549 | 100.489 | 1.00 | 34.11 | C |
| ATOM | 2299 | CZ | PHE | B | 88 | −44.197 | −21.678 | 100.917 | 1.00 | 34.33 | C |

TABLE 10.4-continued

| | | | | | | | | | | |
|---|---|---|---|---|---|---|---|---|---|---|
| ATOM | 2300 | N | CYS | B | 89 | −47.603 | −27.210 | 97.808 | 1.00 | 35.66 | N |
| ATOM | 2301 | CA | CYS | B | 89 | −48.130 | −27.930 | 96.660 | 1.00 | 24.07 | C |
| ATOM | 2302 | C | CYS | B | 89 | −48.355 | −26.953 | 95.513 | 1.00 | 23.52 | C |
| ATOM | 2303 | O | CYS | B | 89 | −48.402 | −25.739 | 95.708 | 1.00 | 21.13 | O |
| ATOM | 2304 | CB | CYS | B | 89 | −49.416 | −28.709 | 96.998 | 1.00 | 21.36 | C |
| ATOM | 2305 | SG | CYS | B | 89 | −50.748 | −27.800 | 97.719 | 1.00 | 30.20 | S |
| ATOM | 2306 | N | GLN | B | 90 | −48.451 | −27.502 | 94.302 | 1.00 | 22.98 | N |
| ATOM | 2307 | CA | GLN | B | 90 | −48.547 | −26.702 | 93.085 | 1.00 | 23.61 | C |
| ATOM | 2308 | C | GLN | B | 90 | −49.265 | −27.514 | 92.017 | 1.00 | 24.59 | C |
| ATOM | 2309 | O | GLN | B | 90 | −48.979 | −28.703 | 91.859 | 1.00 | 24.95 | O |
| ATOM | 2310 | CB | GLN | B | 90 | −47.153 | −26.272 | 92.588 | 1.00 | 23.03 | C |
| ATOM | 2311 | CG | GLN | B | 90 | −47.199 | −25.382 | 91.346 | 1.00 | 24.92 | C |
| ATOM | 2312 | CD | GLN | B | 90 | −46.481 | −25.971 | 90.137 | 1.00 | 26.13 | C |
| ATOM | 2313 | OE1 | GLN | B | 90 | −45.402 | −26.556 | 90.261 | 1.00 | 34.43 | O |
| ATOM | 2314 | NE2 | GLN | B | 90 | −47.093 | −25.847 | 88.969 | 1.00 | 23.23 | N |
| ATOM | 2315 | N | GLN | B | 91 | −50.221 | −26.897 | 91.319 | 1.00 | 22.59 | N |
| ATOM | 2316 | CA | GLN | B | 91 | −50.911 | −27.567 | 90.224 | 1.00 | 24.25 | C |
| ATOM | 2317 | C | GLN | B | 91 | −50.510 | −26.926 | 88.899 | 1.00 | 25.92 | C |
| ATOM | 2318 | O | GLN | B | 91 | −50.206 | −25.731 | 88.830 | 1.00 | 24.83 | O |
| ATOM | 2319 | CB | GLN | B | 91 | −52.449 | −27.564 | 90.405 | 1.00 | 19.74 | C |
| ATOM | 2320 | CG | GLN | B | 91 | −53.125 | −26.219 | 90.299 | 1.00 | 21.60 | C |
| ATOM | 2321 | CD | GLN | B | 91 | −53.417 | −25.811 | 88.871 | 1.00 | 24.32 | C |
| ATOM | 2322 | OE1 | GLN | B | 91 | −53.515 | −26.657 | 87.975 | 1.00 | 23.50 | O |
| ATOM | 2323 | NE2 | GLN | B | 91 | −53.561 | −24.499 | 88.648 | 1.00 | 23.44 | N |
| ATOM | 2324 | N | TYR | B | 92 | −50.462 | −27.737 | 87.850 | 1.00 | 24.33 | N |
| ATOM | 2325 | CA | TYR | B | 92 | −50.099 | −27.241 | 86.524 | 1.00 | 26.73 | C |
| ATOM | 2326 | C | TYR | B | 92 | −51.027 | −27.842 | 85.493 | 1.00 | 27.55 | C |
| ATOM | 2327 | O | TYR | B | 92 | −50.626 | −28.137 | 84.362 | 1.00 | 29.60 | O |
| ATOM | 2328 | CB | TYR | B | 92 | −48.610 | −27.501 | 86.194 | 1.00 | 23.03 | C |
| ATOM | 2329 | CG | TYR | B | 92 | −48.133 | −28.903 | 86.494 | 1.00 | 22.43 | C |
| ATOM | 2330 | CD1 | TYR | B | 92 | −47.776 | −29.257 | 87.789 | 1.00 | 22.77 | C |
| ATOM | 2331 | CD2 | TYR | B | 92 | −48.036 | −29.874 | 85.496 | 1.00 | 22.32 | C |
| ATOM | 2332 | CE1 | TYR | B | 92 | −47.349 | −30.533 | 88.095 | 1.00 | 22.69 | C |
| ATOM | 2333 | CE2 | TYR | B | 92 | −47.589 | −31.154 | 85.788 | 1.00 | 21.88 | C |
| ATOM | 2334 | CZ | TYR | B | 92 | −47.254 | −31.478 | 87.096 | 1.00 | 23.71 | C |
| ATOM | 2335 | OH | TYR | B | 92 | −46.820 | −32.729 | 87.444 | 1.00 | 20.44 | O |
| ATOM | 2336 | N | GLU | B | 93 | −52.289 | −28.031 | 85.880 | 1.00 | 27.99 | N |
| ATOM | 2337 | CA | GLU | B | 93 | −53.312 | −28.512 | 84.958 | 1.00 | 30.82 | C |
| ATOM | 2338 | C | GLU | B | 93 | −53.999 | −27.364 | 84.244 | 1.00 | 31.11 | C |
| ATOM | 2339 | O | GLU | B | 93 | −54.182 | −27.424 | 83.026 | 1.00 | 30.30 | O |
| ATOM | 2340 | CB | GLU | B | 93 | −54.360 | −29.364 | 85.691 | 1.00 | 30.98 | C |
| ATOM | 2341 | CG | GLU | B | 93 | −55.690 | −29.496 | 84.939 | 1.00 | 25.68 | C |
| ATOM | 2342 | CD | GLU | B | 93 | −56.678 | −30.425 | 85.629 | 1.00 | 33.12 | C |
| ATOM | 2343 | OE1 | GLU | B | 93 | −56.247 | −31.498 | 86.123 | 1.00 | 31.54 | O |
| ATOM | 2344 | OE2 | GLU | B | 93 | −57.889 | −30.090 | 85.680 | 1.00 | 32.74 | O1− |
| ATOM | 2345 | N | SER | B | 94 | −54.366 | −26.310 | 84.970 | 1.00 | 30.35 | N |
| ATOM | 2346 | CA | SER | B | 94 | −55.097 | −25.199 | 84.378 | 1.00 | 32.23 | C |
| ATOM | 2347 | C | SER | B | 94 | −54.388 | −23.888 | 84.703 | 1.00 | 28.38 | C |
| ATOM | 2348 | O | SER | B | 94 | −54.044 | −23.617 | 85.861 | 1.00 | 23.42 | O |
| ATOM | 2349 | CB | SER | B | 94 | −56.556 | −25.171 | 84.862 | 1.00 | 32.62 | C |
| ATOM | 2350 | OG | SER | B | 94 | −57.144 | −23.891 | 84.656 | 1.00 | 44.26 | O |
| ATOM | 2351 | N | SER | B | 95 | −54.180 | −23.077 | 83.678 | 1.00 | 29.26 | N |
| ATOM | 2352 | CA | SER | B | 95 | −53.498 | −21.814 | 83.854 | 1.00 | 28.94 | C |
| ATOM | 2353 | C | SER | B | 95 | −54.464 | −20.862 | 84.524 | 1.00 | 28.67 | C |
| ATOM | 2354 | O | SER | B | 95 | −55.645 | −20.897 | 84.219 | 1.00 | 29.79 | O |
| ATOM | 2355 | CB | SER | B | 95 | −53.015 | −21.271 | 82.514 | 1.00 | 23.10 | C |
| ATOM | 2356 | OG | SER | B | 95 | −52.370 | −20.022 | 82.690 | 1.00 | 38.38 | O |
| ATOM | 2357 | N | PRO | B | 96 | −53.976 | −20.029 | 85.458 | 1.00 | 27.09 | N |
| ATOM | 2358 | CA | PRO | B | 96 | −52.599 | −19.892 | 85.956 | 1.00 | 26.26 | C |
| ATOM | 2359 | C | PRO | B | 96 | −52.131 | −21.034 | 86.857 | 1.00 | 27.92 | C |
| ATOM | 2360 | O | PRO | B | 96 | −52.933 | −21.550 | 87.627 | 1.00 | 31.29 | O |
| ATOM | 2361 | CB | PRO | B | 96 | −52.658 | −18.601 | 86.768 | 1.00 | 25.28 | C |
| ATOM | 2362 | CG | PRO | B | 96 | −54.047 | −18.557 | 87.258 | 1.00 | 27.55 | C |
| ATOM | 2363 | CD | PRO | B | 96 | −54.892 | −19.111 | 86.148 | 1.00 | 23.84 | C |
| ATOM | 2364 | N | TRP | B | 97 | −50.858 | −21.419 | 86.786 | 1.00 | 26.30 | N |
| ATOM | 2365 | CA | TRP | B | 97 | −50.330 | −22.305 | 87.811 | 1.00 | 26.57 | C |
| ATOM | 2366 | C | TRP | B | 97 | −50.524 | −21.661 | 89.178 | 1.00 | 25.80 | C |
| ATOM | 2367 | O | TRP | B | 97 | −50.307 | −23.460 | 89.358 | 1.00 | 25.76 | O |
| ATOM | 2368 | CB | TRP | B | 97 | −48.847 | −22.617 | 87.594 | 1.00 | 25.63 | C |
| ATOM | 2369 | CG | TRP | B | 97 | −48.411 | −23.337 | 86.309 | 1.00 | 28.94 | C |
| ATOM | 2370 | CD1 | TRP | B | 97 | −47.124 | −23.541 | 85.926 | 1.00 | 29.48 | C |
| ATOM | 2371 | CD2 | TRP | B | 97 | −49.229 | −23.928 | 85.264 | 1.00 | 29.78 | C |
| ATOM | 2372 | NE1 | TRP | B | 97 | −47.073 | −24.216 | 84.733 | 1.00 | 32.61 | N |
| ATOM | 2373 | CE2 | TRP | B | 97 | −48.344 | −24.459 | 84.296 | 1.00 | 28.86 | C |
| ATOM | 2374 | CE3 | TRP | B | 97 | −50.608 | −24.072 | 85.061 | 1.00 | 29.91 | C |
| ATOM | 2375 | CZ2 | TRP | B | 97 | −48.789 | −25.116 | 83.134 | 1.00 | 31.43 | C |
| ATOM | 2376 | CZ3 | TRP | B | 97 | −51.054 | −24.724 | 83.902 | 1.00 | 28.75 | C |
| ATOM | 2377 | CH2 | TRP | B | 97 | −50.140 | −25.232 | 82.951 | 1.00 | 31.01 | C |
| ATOM | 2378 | N | THR | B | 98 | −50.931 | −22.460 | 90.148 | 1.00 | 21.99 | N |
| ATOM | 2379 | CA | THR | B | 98 | −51.167 | −21.932 | 91.472 | 1.00 | 23.81 | C |

TABLE 10.4-continued

| | | | | | | | | | | |
|---|---|---|---|---|---|---|---|---|---|---|
| ATOM | 2380 | C | THR | B | 98 | −50.474 | −22.819 | 92.488 | 1.00 | 23.94 | C |
| ATOM | 2381 | O | THR | B | 98 | −50.148 | −23.973 | 92.215 | 1.00 | 25.95 | O |
| ATOM | 2382 | CB | THR | B | 98 | −52.674 | −21.787 | 91.782 | 1.00 | 26.18 | C |
| ATOM | 2383 | OG1 | THR | B | 98 | −53.374 | −23.006 | 91.498 | 1.00 | 23.15 | O |
| ATOM | 2384 | CG2 | THR | B | 98 | −53.270 | −23.618 | 90.969 | 1.00 | 24.44 | C |
| ATOM | 2385 | N | PHE | B | 99 | −50.184 | −22.209 | 93.633 | 1.00 | 28.63 | N |
| ATOM | 2386 | CA | PHE | B | 99 | −49.511 | −22.803 | 94.776 | 1.00 | 26.82 | C |
| ATOM | 2387 | C | PHE | B | 99 | −50.436 | −22.773 | 95.988 | 1.00 | 29.46 | C |
| ATOM | 2388 | O | PHE | B | 99 | −51.311 | −21.912 | 96.089 | 1.00 | 31.15 | O |
| ATOM | 2389 | CB | PHE | B | 99 | −48.236 | −22.020 | 95.121 | 1.00 | 27.58 | C |
| ATOM | 2390 | CG | PHE | B | 99 | −47.123 | −22.166 | 94.115 | 1.00 | 26.17 | C |
| ATOM | 2391 | CD1 | PHE | B | 99 | −46.212 | −23.210 | 94.213 | 1.00 | 21.23 | C |
| ATOM | 2392 | CD2 | PHE | B | 99 | −46.970 | −21.236 | 93.096 | 1.00 | 26.56 | C |
| ATOM | 2393 | CE1 | PHE | B | 99 | −45.179 | −23.346 | 93.313 | 1.00 | 23.45 | C |
| ATOM | 2394 | CE2 | PHE | B | 99 | −45.935 | −21.362 | 92.177 | 1.00 | 28.21 | C |
| ATOM | 2395 | CZ | PHE | B | 99 | −45.028 | −22.420 | 92.291 | 1.00 | 25.30 | C |
| ATOM | 2396 | N | GLY | B | 100 | −50.252 | −23.722 | 96.909 | 1.00 | 29.01 | N |
| ATOM | 2397 | CA | GLY | B | 100 | −50.849 | −23.604 | 98.224 | 1.00 | 26.65 | C |
| ATOM | 2398 | C | GLY | B | 100 | −50.062 | −22.660 | 99.136 | 1.00 | 32.15 | C |
| ATOM | 2399 | O | GLY | B | 100 | −48.953 | −22.224 | 98.831 | 1.00 | 30.70 | O |
| ATOM | 2400 | N | GLN | B | 101 | −50.651 | −22.339 | 100.291 | 1.00 | 32.09 | N |
| ATOM | 2401 | CA | GLN | B | 101 | −49.953 | −21.455 | 101.219 | 1.00 | 27.63 | C |
| ATOM | 2402 | C | GLN | B | 101 | −48.788 | −22.134 | 101.926 | 1.00 | 31.28 | C |
| ATOM | 2403 | O | GLN | B | 101 | −47.993 | −21.430 | 102.555 | 1.00 | 31.67 | O |
| ATOM | 2404 | CB | GLN | B | 101 | −50.888 | −20.871 | 102.296 | 1.00 | 31.00 | C |
| ATOM | 2405 | CG | GLN | B | 101 | −52.371 | −21.297 | 102.285 | 1.00 | 41.04 | C |
| ATOM | 2406 | CD | GLN | B | 101 | −52.581 | −22.771 | 102.623 | 1.00 | 41.89 | C |
| ATOM | 2407 | OE1 | GLN | B | 101 | −52.927 | −23.567 | 101.736 | 1.00 | 36.09 | O |
| ATOM | 2408 | NE2 | GLN | B | 101 | −52.365 | −23.147 | 103.900 | 1.00 | 37.62 | N |
| ATOM | 2409 | N | GLY | B | 102 | −48.665 | −23.453 | 101.858 | 1.00 | 26.43 | N |
| ATOM | 2410 | CA | GLY | B | 102 | −47.548 | −24.085 | 102.535 | 1.00 | 24.50 | C |
| ATOM | 2411 | C | GLY | B | 102 | −47.895 | −24.678 | 103.898 | 1.00 | 27.19 | C |
| ATOM | 2412 | O | GLY | B | 102 | −48.800 | −24.215 | 104.600 | 1.00 | 27.42 | O |
| ATOM | 2413 | N | THR | B | 103 | −47.158 | −25.724 | 104.283 | 1.00 | 24.40 | N |
| ATOM | 2414 | CA | THR | B | 103 | −47.207 | −26.276 | 105.634 | 1.00 | 27.22 | C |
| ATOM | 2415 | C | THR | B | 103 | −45.806 | −26.259 | 106.239 | 1.00 | 25.76 | C |
| ATOM | 2416 | O | THR | B | 103 | −44.857 | −26.746 | 105.621 | 1.00 | 27.96 | O |
| ATOM | 2417 | CB | THR | B | 103 | −47.752 | −27.718 | 105.647 | 1.00 | 28.05 | C |
| ATOM | 2418 | OG1 | THR | B | 103 | −49.120 | −27.729 | 105.232 | 1.00 | 31.71 | O |
| ATOM | 2419 | CG2 | THR | B | 103 | −47.654 | −28.348 | 107.061 | 1.00 | 25.08 | C |
| ATOM | 2420 | N | LYS | B | 104 | −45.673 | −25.709 | 107.442 | 1.00 | 22.08 | N |
| ATOM | 2421 | CA | LYS | B | 104 | −44.409 | −25.758 | 108.159 | 1.00 | 26.19 | C |
| ATOM | 2422 | C | LYS | B | 104 | −44.360 | −27.021 | 109.014 | 1.00 | 27.07 | C |
| ATOM | 2423 | O | LYS | B | 104 | −45.205 | −27.212 | 109.889 | 1.00 | 28.44 | O |
| ATOM | 2424 | CB | LYS | B | 104 | −44.212 | −24.523 | 109.032 | 1.00 | 25.21 | C |
| ATOM | 2425 | CG | LYS | B | 104 | −42.846 | −24.510 | 109.709 | 1.00 | 26.78 | C |
| ATOM | 2426 | CD | LYS | B | 104 | −42.677 | −23.365 | 110.699 | 1.00 | 30.43 | C |
| ATOM | 2427 | CE | LYS | B | 104 | −41.301 | −23.463 | 111.391 | 1.00 | 45.22 | C |
| ATOM | 2428 | NZ | LYS | B | 104 | −40.967 | −22.316 | 112.301 | 1.00 | 44.27 | N1+ |
| ATOM | 2429 | N | VAL | B | 105 | −43.366 | −27.869 | 108.779 | 1.00 | 25.76 | N |
| ATOM | 2430 | CA | VAL | B | 105 | −43.119 | −29.033 | 109.624 | 1.00 | 29.32 | C |
| ATOM | 2431 | C | VAL | B | 105 | −42.005 | −28.664 | 110.597 | 1.00 | 27.51 | C |
| ATOM | 2432 | O | VAL | B | 105 | −40.841 | −28.516 | 110.211 | 1.00 | 25.98 | O |
| ATOM | 2433 | CB | VAL | B | 105 | −42.757 | −30.283 | 108.813 | 1.00 | 24.39 | C |
| ATOM | 2434 | CG1 | VAL | B | 105 | −42.488 | −31.445 | 109.776 | 1.00 | 26.12 | C |
| ATOM | 2435 | CG2 | VAL | B | 105 | −43.868 | −30.636 | 107.890 | 1.00 | 21.86 | C |
| ATOM | 2436 | N | GLU | B | 106 | −42.367 | −28.533 | 111.863 | 1.00 | 31.16 | N |
| ATOM | 2437 | CA | GLU | B | 106 | −41.473 | −28.092 | 112.919 | 1.00 | 28.93 | C |
| ATOM | 2438 | C | GLU | B | 106 | −41.144 | −29.242 | 113.875 | 1.00 | 33.11 | C |
| ATOM | 2439 | O | GLU | B | 106 | −41.922 | −30.197 | 114.030 | 1.00 | 30.26 | O |
| ATOM | 2440 | CB | GLU | B | 106 | −42.130 | −26.943 | 113.669 | 1.00 | 31.52 | C |
| ATOM | 2441 | CG | GLU | B | 106 | −41.324 | −26.435 | 114.830 | 1.00 | 41.69 | C |
| ATOM | 2442 | CD | GLU | B | 106 | −42.170 | −26.121 | 116.028 | 1.00 | 37.31 | C |
| ATOM | 2443 | OE1 | GLU | B | 106 | −42.903 | −27.027 | 116.485 | 1.00 | 37.32 | O |
| ATOM | 2444 | OE2 | GLU | B | 106 | −42.102 | −24.963 | 116.492 | 1.00 | 39.39 | O1− |
| ATOM | 2445 | N | ILE | B | 107 | −39.971 | −29.149 | 114.495 | 1.00 | 26.80 | N |
| ATOM | 2446 | CA | ILE | B | 107 | −39.486 | −30.168 | 115.421 | 1.00 | 28.39 | C |
| ATOM | 2447 | C | ILE | B | 107 | −40.205 | −30.038 | 116.755 | 1.00 | 32.03 | C |
| ATOM | 2448 | O | ILE | B | 107 | −40.118 | −29.003 | 117.420 | 1.00 | 27.69 | O |
| ATOM | 2449 | CB | ILE | B | 107 | −37.974 | −30.050 | 115.622 | 1.00 | 26.88 | C |
| ATOM | 2450 | CG1 | ILE | B | 107 | −37.240 | −30.423 | 114.344 | 1.00 | 27.26 | C |
| ATOM | 2451 | CG2 | ILE | B | 107 | −37.552 | −30.898 | 116.793 | 1.00 | 26.83 | C |
| ATOM | 2452 | CD1 | ILE | B | 107 | −35.799 | −30.043 | 114.347 | 1.00 | 30.15 | C |
| ATOM | 2453 | N | LYS | B | 108 | −40.866 | −31.106 | 117.182 | 1.00 | 31.78 | N |
| ATOM | 2454 | CA | LYS | B | 108 | −41.455 | −31.110 | 118.512 | 1.00 | 32.40 | C |
| ATOM | 2455 | C | LYS | B | 108 | −40.382 | −31.497 | 119.529 | 1.00 | 32.97 | C |
| ATOM | 2456 | O | LYS | B | 108 | −39.654 | −32.475 | 119.336 | 1.00 | 33.78 | O |
| ATOM | 2457 | CB | LYS | B | 108 | −42.649 | −32.069 | 118.567 | 1.00 | 34.38 | C |
| ATOM | 2458 | CG | LYS | B | 108 | −43.460 | −32.006 | 119.864 | 1.00 | 35.60 | C |
| ATOM | 2459 | CD | LYS | B | 108 | −44.379 | −33.223 | 120.000 | 1.00 | 34.87 | C |

TABLE 10.4-continued

| | | | | | | | | | | |
|---|---|---|---|---|---|---|---|---|---|---|
| ATOM | 2460 | CE | LYS | B | 108 | −45.671 | −32.857 | 120.690 | 1.00 | 39.16 | C |
| ATOM | 2461 | NZ | LYS | B | 108 | −45.560 | −31.457 | 121.228 | 1.00 | 41.36 | N1+ |
| ATOM | 2462 | N | ARG | B | 109 | −40.270 | −30.720 | 120.604 | 1.00 | 30.43 | N |
| ATOM | 2463 | CA | ARG | B | 109 | −39.298 | −30.996 | 121.651 | 1.00 | 27.95 | C |
| ATOM | 2464 | C | ARG | B | 109 | −39.942 | −30.659 | 122.985 | 1.00 | 29.25 | C |
| ATOM | 2465 | O | ARG | B | 109 | −41.117 | −30.284 | 123.040 | 1.00 | 33.46 | O |
| ATOM | 2466 | CB | ARG | B | 109 | −37.993 | −30.224 | 121.445 | 1.00 | 27.54 | C |
| ATOM | 2467 | CG | ARG | B | 109 | −38.128 | −28.705 | 121.378 | 1.00 | 29.91 | C |
| ATOM | 2468 | CD | ARG | B | 109 | −36.873 | −28.023 | 121.928 | 1.00 | 26.11 | C |
| ATOM | 2469 | NE | ARG | B | 109 | −36.853 | −28.173 | 123.386 | 1.00 | 32.71 | N |
| ATOM | 2470 | CZ | ARG | B | 109 | −35.751 | −28.189 | 124.126 | 1.00 | 27.84 | C |
| ATOM | 2471 | NH1 | ARG | B | 109 | −35.827 | −28.351 | 125.449 | 1.00 | 24.67 | N1+ |
| ATOM | 2472 | NH2 | ARG | B | 109 | −34.577 | −28.039 | 123.536 | 1.00 | 23.42 | N |
| ATOM | 2473 | N | THR | B | 110 | −39.191 | −30.838 | 124.073 | 1.00 | 27.37 | N |
| ATOM | 2474 | CA | THR | B | 110 | −39.762 | −30.554 | 125.385 | 1.00 | 28.62 | C |
| ATOM | 2475 | C | THR | B | 110 | −39.775 | −29.056 | 125.631 | 1.00 | 29.53 | C |
| ATOM | 2476 | O | THR | B | 110 | −38.878 | −28.311 | 125.203 | 1.00 | 26.75 | O |
| ATOM | 2477 | CB | THR | B | 110 | −39.006 | −31.227 | 126.546 | 1.00 | 27.19 | C |
| ATOM | 2478 | OG1 | THR | B | 110 | −37.641 | −30.803 | 126.570 | 1.00 | 31.87 | O |
| ATOM | 2479 | CG2 | THR | B | 110 | −39.052 | −32.727 | 126.445 | 1.00 | 25.84 | C |
| ATOM | 2480 | N | VAL | B | 111 | −40.796 | −28.630 | 126.367 | 1.00 | 31.89 | N |
| ATOM | 2481 | CA | VAL | B | 111 | −40.905 | −27.236 | 126.752 | 1.00 | 33.07 | C |
| ATOM | 2482 | C | VAL | B | 111 | −39.618 | −26.751 | 127.407 | 1.00 | 31.48 | C |
| ATOM | 2483 | O | VAL | B | 111 | −38.982 | −27.463 | 128.195 | 1.00 | 31.62 | O |
| ATOM | 2484 | CB | VAL | B | 111 | −42.112 | −27.056 | 127.683 | 1.00 | 30.76 | C |
| ATOM | 2485 | CG1 | VAL | B | 111 | −42.176 | −25.612 | 128.149 | 1.00 | 27.34 | C |
| ATOM | 2486 | CG2 | VAL | B | 111 | −43.381 | −27.478 | 126.949 | 1.00 | 24.38 | C |
| ATOM | 2487 | N | ALA | B | 112 | −39.223 | −25.532 | 127.044 | 1.00 | 29.57 | N |
| ATOM | 2488 | CA | ALA | B | 112 | −38.047 | −24.863 | 127.582 | 1.00 | 25.09 | C |
| ATOM | 2489 | C | ALA | B | 112 | −38.425 | −23.405 | 127.788 | 1.00 | 30.16 | C |
| ATOM | 2490 | O | ALA | B | 112 | −38.831 | −22.734 | 126.835 | 1.00 | 27.80 | O |
| ATOM | 2491 | CB | ALA | B | 112 | −36.844 | −24.984 | 126.639 | 1.00 | 23.34 | C |
| ATOM | 2492 | N | ALA | B | 113 | −38.318 | −22.928 | 129.029 | 1.00 | 32.01 | N |
| ATOM | 2493 | CA | ALA | B | 113 | −38.663 | −21.549 | 129.326 | 1.00 | 28.03 | C |
| ATOM | 2494 | C | ALA | B | 113 | −37.579 | −20.640 | 128.768 | 1.00 | 29.40 | C |
| ATOM | 2495 | O | ALA | B | 113 | −36.412 | −21.035 | 128.710 | 1.00 | 31.93 | O |
| ATOM | 2496 | CB | ALA | B | 113 | −38.799 | −21.325 | 130.830 | 1.00 | 23.97 | C |
| ATOM | 2497 | N | PRO | B | 114 | −37.934 | −19.422 | 128.353 | 1.00 | 27.52 | N |
| ATOM | 2498 | CA | PRO | B | 114 | −36.911 | −18.489 | 127.860 | 1.00 | 27.42 | C |
| ATOM | 2499 | C | PRO | B | 114 | −36.095 | −17.920 | 129.004 | 1.00 | 27.03 | C |
| ATOM | 2500 | O | PRO | B | 114 | −36.590 | −17.719 | 130.108 | 1.00 | 29.23 | O |
| ATOM | 2501 | CB | PRO | B | 114 | −37.731 | −17.386 | 127.186 | 1.00 | 27.64 | C |
| ATOM | 2502 | CG | PRO | B | 114 | −39.012 | −17.376 | 127.998 | 1.00 | 27.54 | C |
| ATOM | 2503 | CD | PRO | B | 114 | −39.274 | −18.806 | 128.403 | 1.00 | 24.48 | C |
| ATOM | 2504 | N | SER | B | 115 | −34.835 | −17.635 | 128.730 | 1.00 | 27.91 | N |
| ATOM | 2505 | CA | SER | B | 115 | −34.092 | −16.739 | 129.592 | 1.00 | 25.63 | C |
| ATOM | 2506 | C | SER | B | 115 | −34.236 | −15.331 | 129.028 | 1.00 | 25.72. | C |
| ATOM | 2507 | O | SER | B | 115 | −32.628 | −17.157 | 129.726 | 1.00 | 24.15 | C |
| ATOM | 2508 | CB | SER | B | 115 | −32.139 | −17.720 | 128.535 | 1.00 | 40.34 | O |
| ATOM | 2509 | OG | SER | B | 115 | −34.430 | −14.371 | 129.922 | 1.00 | 26.54 | N |
| ATOM | 2510 | N | VAL | B | 116 | −34.857 | −13.023 | 129.579 | 1.00 | 28.89 | C |
| ATOM | 2511 | CA | VAL | B | 116 | −33.762 | −12.037 | 129.979 | 1.00 | 26.93 | C |
| ATOM | 2512 | C | VAL | B | 116 | −33.243 | −12.093 | 131.094 | 1.00 | 31.62 | O |
| ATOM | 2513 | O | VAL | B | 116 | −36.203 | −12.695 | 130.259 | 1.00 | 28.35 | C |
| ATOM | 2514 | CB | VAL | B | 116 | −36.709 | −11.313 | 129.860 | 1.00 | 28.35 | C |
| ATOM | 2515 | CG1 | VAL | B | 116 | −37.212 | −13.740 | 129.882 | 1.00 | 18.89 | C |
| ATOM | 2516 | CG2 | VAL | B | 116 | −33.406 | −11.151 | 129.063 | 1.00 | 25.01 | N |
| ATOM | 2517 | N | PHE | B | 117 | −32.424 | −10.118 | 129.331 | 1.00 | 25.46 | C |
| ATOM | 2518 | CA | PHE | B | 117 | −32.963 | −8.826 | 128.726 | 1.00 | 28.62 | C |
| ATOM | 2519 | C | PHE | B | 117 | −33.533 | −8.832 | 127.632 | 1.00 | 31.30 | O |
| ATOM | 2520 | O | PHE | B | 117 | −31.081 | −10.413 | 128.650 | 1.00 | 25.62 | C |
| ATOM | 2521 | CB | PHE | B | 117 | −30.536 | −11.799 | 128.892 | 1.00 | 29.84 | C |
| ATOM | 2522 | CG | PHE | B | 117 | −30.935 | −12.876 | 128.093 | 1.00 | 24.22 | C |
| ATOM | 2523 | CD1 | PHE | B | 117 | −29.542 | −12.015 | 129.835 | 1.00 | 31.65 | C |
| ATOM | 2524 | CD2 | PHE | B | 117 | −29.542 | −12.015 | 129.835 | 1.00 | 31.65 | C |
| ATOM | 2525 | CE1 | PHE | B | 117 | −30.405 | −14.136 | 128.283 | 1.00 | 22.90 | C |
| ATOM | 2526 | CE2 | PHE | B | 117 | −28.998 | −13.290 | 130.013 | 1.00 | 29.63 | C |
| ATOM | 2527 | CZ | PHE | B | 117 | −29.430 | −14.339 | 129.234 | 1.00 | 24.06 | C |
| ATOM | 2528 | N | ILE | B | 118 | −32.755 | −7.717 | 129.428 | 1.00 | 28.33 | N |
| ATOM | 2529 | CA | ILE | B | 118 | −33.211 | −6.409 | 128.973 | 1.00 | 27.52 | C |
| ATOM | 2530 | C | ILE | B | 118 | −31.997 | −5.501 | 128.878 | 1.00 | 27.02 | C |
| ATOM | 2531 | O | ILE | B | 118 | −31.130 | −5.541 | 129.750 | 1.00 | 28.87 | O |
| ATOM | 2532 | CB | ILE | B | 118 | −34.280 | −5.811 | 129.911 | 1.00 | 29.46 | C |
| ATOM | 2533 | CG1 | ILE | B | 118 | −34.774 | −4.480 | 129.347 | 1.00 | 30.76 | C |
| ATOM | 2534 | CG2 | ILE | B | 118 | −33.752 | −5.639 | 131.343 | 1.00 | 25.68 | C |
| ATOM | 2535 | CD1 | ILE | B | 118 | −35.736 | −3.775 | 130.229 | 1.00 | 29.17 | C |
| ATOM | 2536 | N | PHE | B | 119 | −31.925 | −4.700 | 127.811 | 1.00 | 28.09 | N |
| ATOM | 2537 | CA | PHE | B | 119 | −30.765 | −3.875 | 127.503 | 1.00 | 24.90 | C |
| ATOM | 2538 | C | PHE | B | 119 | −31.149 | −2.406 | 127.478 | 1.00 | 29.17 | C |
| ATOM | 2539 | O | PHE | B | 119 | −32.037 | −2.018 | 126.706 | 1.00 | 31.62 | O |

TABLE 10.4-continued

| | | | | | | | | | | |
|---|---|---|---|---|---|---|---|---|---|---|
| ATOM | 2540 | CB | PHE | B | 119 | −30.163 | −4.224 | 126.148 | 1.00 | 26.03 | C |
| ATOM | 2541 | CG | PHE | B | 119 | −29.643 | −5.603 | 126.045 | 1.00 | 29.01 | C |
| ATOM | 2542 | CD1 | PHE | B | 119 | −28.383 | −5.913 | 126.505 | 1.00 | 26.67 | C |
| ATOM | 2543 | CD2 | PHE | B | 119 | −30.400 | −6.594 | 125.430 | 1.00 | 30.15 | C |
| ATOM | 2544 | CE1 | PHE | B | 119 | −27.897 | −7.200 | 126.403 | 1.00 | 29.34 | C |
| ATOM | 2545 | CE2 | PHE | B | 119 | −29.927 | −7.882 | 125.314 | 1.00 | 25.71 | C |
| ATOM | 2546 | CZ | PHE | B | 119 | −28.670 | −8.191 | 125.806 | 1.00 | 29.15 | C |
| ATOM | 2547 | N | PRO | B | 120 | −30.468 | −1.550 | 128.231 | 1.00 | 34.18 | N |
| ATOM | 2548 | CA | PRO | B | 120 | −30.747 | −0.106 | 128.152 | 1.00 | 34.68 | C |
| ATOM | 2549 | C | PRO | B | 120 | −30.251 | 0.460 | 126.834 | 1.00 | 34.50 | C |
| ATOM | 2550 | O | PRO | B | 120 | −29.378 | −0.140 | 126.188 | 1.00 | 36.34 | O |
| ATOM | 2551 | CB | PRO | B | 120 | −29.963 | 0.474 | 129.339 | 1.00 | 33.20 | C |
| ATOM | 2552 | CG | PRO | B | 120 | −29.568 | −0.746 | 130.190 | 1.00 | 37.48 | C |
| ATOM | 2553 | CD | PRO | B | 120 | −29.417 | −1.862 | 129.212 | 1.00 | 32.46 | C |
| ATOM | 2554 | N | PRO | B | 121 | −30.761 | 1.616 | 126.402 | 1.00 | 35.15 | N |
| ATOM | 2555 | CA | PRO | B | 121 | −30.200 | 2.248 | 125.203 | 1.00 | 34.06 | C |
| ATOM | 2556 | C | PRO | B | 121 | −28.766 | 2.697 | 125.452 | 1.00 | 32.75 | C |
| ATOM | 2557 | O | PRO | B | 121 | −28.410 | 3.117 | 126.551 | 1.00 | 34.53 | O |
| ATOM | 2558 | CB | PRO | B | 121 | −31.138 | 3.436 | 124.958 | 1.00 | 30.93 | C |
| ATOM | 2559 | CG | PRO | B | 121 | −31.733 | 3.718 | 126.279 | 1.00 | 29.12 | C |
| ATOM | 2560 | CD | PRO | B | 121 | −31.870 | 2.404 | 126.965 | 1.00 | 30.02 | C |
| ATOM | 2561 | N | SER | B | 122 | −27.930 | 2.583 | 124.431 | 1.00 | 35.60 | N |
| ATOM | 2562 | CA | SER | B | 122 | −26.558 | 3.043 | 124.576 | 1.00 | 40.70 | C |
| ATOM | 2563 | C | SER | B | 122 | −26.517 | 4.570 | 124.585 | 1.00 | 42.19 | C |
| ATOM | 2564 | O | SER | B | 122 | −27.311 | 5.239 | 123.913 | 1.00 | 40.94 | O |
| ATOM | 2565 | CB | SER | B | 122 | −25.677 | 2.503 | 123.437 | 1.00 | 38.69 | C |
| ATOM | 2566 | OG | SER | B | 122 | −25.921 | 3.200 | 122.223 | 1.00 | 33.97 | O |
| ATOM | 2567 | N | ASP | B | 123 | −25.550 | 5.120 | 125.328 | 1.00 | 41.84 | N |
| ATOM | 2568 | CA | ASP | B | 123 | −25.391 | 6.569 | 125.357 | 1.00 | 44.12 | C |
| ATOM | 2569 | C | ASP | B | 123 | −25.119 | 7.126 | 123.965 | 1.00 | 48.91 | C |
| ATOM | 2570 | O | ASP | B | 123 | −25.453 | 8.285 | 123.682 | 1.00 | 47.81 | O |
| ATOM | 2571 | CB | ASP | B | 123 | −24.267 | 6.968 | 126.311 | 1.00 | 47.34 | C |
| ATOM | 2572 | CG | ASP | B | 123 | −24.693 | 6.950 | 127.779 | 1.00 | 59.18 | C |
| ATOM | 2573 | OD1 | ASP | B | 123 | −25.864 | 7.272 | 128.086 | 1.00 | 59.74 | O |
| ATOM | 2574 | OD2 | ASP | B | 123 | −23.839 | 6.640 | 128.638 | 1.00 | 65.74 | O1− |
| ATOM | 2575 | N | GLU | B | 124 | −24.542 | 6.312 | 123.079 | 1.00 | 44.91 | N |
| ATOM | 2576 | CA | GLU | B | 124 | −24.273 | 6.776 | 121.722 | 1.00 | 48.45 | C |
| ATOM | 2577 | C | GLU | B | 124 | −25.559 | 7.001 | 120.919 | 1.00 | 48.55 | C |
| ATOM | 2578 | O | GLU | B | 124 | −25.649 | 7.962 | 120.145 | 1.00 | 48.61 | O |
| ATOM | 2579 | CB | GLU | B | 124 | −23.360 | 5.78 | 121.014 | 1.00 | 46.13 | C |
| ATOM | 2580 | CG | GLU | B | 124 | −22.949 | 6.279 | 119.661 | 1.00 | 52.72 | C |
| ATOM | 2581 | CD | GLU | B | 124 | −22.264 | 5.209 | 118.846 | 1.00 | 59.55 | C |
| ATOM | 2582 | OE1 | GLU | B | 124 | −22.167 | 5.408 | 117.608 | 1.00 | 50.04 | O |
| ATOM | 2583 | OE2 | GLU | B | 124 | −21.850 | 4.175 | 119.443 | 1.00 | 55.47 | O1− |
| ATOM | 2584 | N | GLN | B | 125 | −26.574 | 6.143 | 121.093 | 1.00 | 46.17 | N |
| ATOM | 2585 | CA | GLN | B | 125 | −27.839 | 6.369 | 120.391 | 1.00 | 41.17 | C |
| ATOM | 2586 | C | GLN | B | 125 | −28.632 | 7.506 | 121.018 | 1.00 | 44.73 | C |
| ATOM | 2587 | O | GLN | B | 125 | −29.391 | 8.187 | 120.315 | 1.00 | 41.05 | O |
| ATOM | 2588 | CB | GLN | B | 125 | −28.687 | 5.095 | 120.366 | 1.00 | 36.73 | C |
| ATOM | 2589 | CG | GLN | B | 125 | −30.012 | 5.222 | 119.593 | 1.00 | 33.48 | C |
| ATOM | 2590 | CD | GLN | B | 125 | −31.023 | 4.118 | 119.918 | 1.00 | 37.11 | C |
| ATOM | 2591 | OE1 | GLN | B | 125 | −30.936 | 3.430 | 120.947 | 1.00 | 35.61 | O |
| ATOM | 2592 | NE2 | GLN | B | 125 | −31.976 | 3.925 | 119.016 | 1.00 | 41.82 | N |
| ATOM | 2593 | N | LEU | B | 126 | −28.493 | 7.704 | 112.337 | 1.00 | 43.68 | N |
| ATOM | 2594 | CA | LEU | B | 126 | −29.168 | 8.813 | 123.006 | 1.00 | 45.10 | C |
| ATOM | 2595 | C | LEU | B | 126 | −28.719 | 10.152 | 122.434 | 1.00 | 49.62 | C |
| ATOM | 2596 | O | LEU | B | 126 | −29.526 | 11.085 | 122.313 | 1.00 | 49.20 | O |
| ATOM | 2597 | CB | LEU | B | 126 | −28.906 | 8.751 | 124.510 | 1.00 | 46.51 | C |
| ATOM | 2598 | CG | LEU | B | 126 | −29.691 | 7.699 | 125.300 | 1.00 | 44.00 | C |
| ATOM | 2599 | CD1 | LEU | B | 126 | −29.263 | 7.692 | 126.754 | 1.00 | 37.07 | C |
| ATOM | 2600 | CD2 | LEU | B | 126 | −31.208 | 7.898 | 125.167 | 1.00 | 36.79 | C |
| ATOM | 2601 | N | LYS | B | 127 | −27.428 | 10.263 | 122.083 | 1.00 | 47.40 | N |
| ATOM | 2602 | CA | LYS | B | 127 | −26.902 | 11.463 | 121.438 | 1.00 | 44.91 | C |
| ATOM | 2603 | C | LYS | B | 127 | −27.707 | 11.875 | 120.208 | 1.00 | 50.97 | C |
| ATOM | 2604 | O | LYS | B | 127 | −27.782 | 13.065 | 119.883 | 1.00 | 56.06 | O |
| ATOM | 2605 | CB | LYS | B | 127 | −25.441 | 11.244 | 121.060 | 1.00 | 53.95 | C |
| ATOM | 2606 | CG | LYS | B | 127 | −24.474 | 11.931 | 122.009 | 1.00 | 65.16 | C |
| ATOM | 2607 | CD | LYS | B | 127 | −24.039 | 11.038 | 123.160 | 1.00 | 60.17 | C |
| ATOM | 2608 | CE | LYS | B | 127 | −22.846 | 10.198 | 122.738 | 1.00 | 65.63 | C |
| ATOM | 2609 | NZ | LYS | B | 127 | −21.833 | 11.021 | 122.005 | 1.00 | 65.70 | N1+ |
| ATOM | 2610 | N | SER | B | 128 | −28.302 | 10.918 | 119.506 | 1.00 | 48.42 | N |
| ATOM | 2611 | CA | SER | B | 128 | −29.026 | 11.194 | 118.274 | 1.00 | 44.86 | C |
| ATOM | 2612 | C | SER | B | 128 | −30.527 | 11.393 | 118.485 | 1.00 | 48.97 | C |
| ATOM | 2613 | O | SER | B | 128 | −31.271 | 11.432 | 117.498 | 1.00 | 56.04 | O |
| ATOM | 2614 | CB | SER | B | 128 | −28.814 | 10.057 | 117.266 | 1.00 | 51.64 | C |
| ATOM | 2615 | OG | SER | B | 128 | −29.460 | 8.856 | 117.686 | 1.00 | 48.78 | O |
| ATOM | 2616 | N | GLY | B | 129 | −30.999 | 11.500 | 119.728 | 1.00 | 42.11 | N |
| ATOM | 2617 | CA | GLY | B | 129 | −32.383 | 11.859 | 119.953 | 1.00 | 39.56 | C |
| ATOM | 2618 | C | GLY | B | 129 | −33.356 | 10.703 | 120.071 | 1.00 | 47.15 | C |
| ATOM | 2619 | O | GLY | B | 129 | −34.553 | 10.945 | 120.312 | 1.00 | 45.83 | O |

TABLE 10.4-continued

| | | | | | | | | | | |
|---|---|---|---|---|---|---|---|---|---|---|
| ATOM | 2620 | N | THR | B | 130 | −32.894 | 9.459 | 119.903 | 1.00 | 44.00 | N |
| ATOM | 2621 | CA | THR | B | 130 | −33.745 | 8.278 | 119.983 | 1.00 | 37.83 | C |
| ATOM | 2622 | C | THR | B | 130 | −33.231 | 7.272 | 121.008 | 1.00 | 36.90 | C |
| ATOM | 2623 | O | THR | B | 130 | −32.023 | 7.117 | 121.190 | 1.00 | 41.23 | O |
| ATOM | 2624 | CB | THR | B | 130 | −33.871 | 7.637 | 118.606 | 1.00 | 40.93 | C |
| ATOM | 2625 | OG1 | THR | B | 130 | −34.572 | 8.543 | 117.740 | 1.00 | 34.84 | O |
| ATOM | 2626 | CG2 | THR | B | 130 | −34.617 | 6.297 | 118.679 | 1.00 | 44.09 | C |
| ATOM | 2627 | N | ALA | B | 131 | −34.155 | 6.598 | 121.686 | 1.00 | 35.77 | N |
| ATOM | 2628 | CA | ALA | B | 131 | −33.841 | 5.535 | 122.636 | 1.00 | 35.93 | C |
| ATOM | 2629 | C | ALA | B | 131 | −34.469 | 4.216 | 122.186 | 1.00 | 35.42 | C |
| ATOM | 2630 | O | ALA | B | 131 | −35.693 | 4.128 | 121.999 | 1.00 | 37.68 | O |
| ATOM | 2631 | CB | ALA | B | 131 | −34.346 | 5.896 | 124.039 | 1.00 | 33.77 | C |
| ATOM | 2632 | N | SER | B | 132 | −33.645 | 3.183 | 122.055 | 1.00 | 29.61 | N |
| ATOM | 2633 | CA | SER | B | 132 | −34.127 | 1.837 | 121.791 | 1.00 | 29.37 | C |
| ATOM | 2634 | C | SER | B | 132 | −33.845 | 0.960 | 122.999 | 1.00 | 24.73 | C |
| ATOM | 2635 | O | SER | B | 132 | −32.689 | 0.774 | 123.367 | 1.00 | 30.61 | O |
| ATOM | 2636 | CB | SER | B | 132 | −33.466 | 1.265 | 120.545 | 1.00 | 28.99 | C |
| ATOM | 2637 | OG | SER | B | 132 | −33.838 | 2.013 | 119.420 | 1.00 | 32.09 | O |
| ATOM | 2638 | N | VAL | B | 133 | −34.890 | 0.411 | 123.599 | 1.00 | 29.26 | N |
| ATOM | 2639 | CA | VAL | B | 133 | −34.753 | −0.593 | 124.654 | 1.00 | 30.39 | C |
| ATOM | 2640 | C | VAL | B | 133 | −35.021 | −1.960 | 124.044 | 1.00 | 28.40 | C |
| ATOM | 2641 | O | VAL | B | 133 | −35.963 | −2.123 | 123.264 | 1.00 | 30.58 | O |
| ATOM | 2642 | CB | VAL | B | 133 | −35.717 | −0.303 | 125.816 | 1.00 | 29.07 | C |
| ATOM | 2643 | CG1 | VAL | B | 133 | −35.309 | −1.095 | 127.049 | 1.00 | 27.89 | C |
| ATOM | 2644 | CG2 | VAL | B | 133 | −35.751 | 1.186 | 126.090 | 1.00 | 26.20 | C |
| ATOM | 2645 | N | VAL | B | 134 | −34.203 | −2.948 | 124.392 | 1.00 | 26.36 | N |
| ATOM | 2646 | CA | VAL | B | 134 | −34.262 | −4.261 | 123.762 | 1.00 | 28.94 | C |
| ATOM | 2647 | C | VAL | B | 134 | −34.505 | −5.315 | 124.830 | 1.00 | 29.71 | C |
| ATOM | 2648 | O | VAL | B | 134 | −33.851 | −5.305 | 125.880 | 1.00 | 30.17 | O |
| ATOM | 2649 | CB | VAL | B | 134 | −32.973 | −4.576 | 122.980 | 1.00 | 30.23 | C |
| ATOM | 2650 | CG1 | VAL | B | 134 | −33.115 | −5.912 | 122.281 | 1.00 | 22.43 | C |
| ATOM | 2651 | CG2 | VAL | B | 134 | −32.648 | −3.460 | 121.991 | 1.00 | 24.76 | C |
| ATOM | 2652 | N | CYS | B | 135 | −35.438 | −6.226 | 124.560 | 1.00 | 27.09 | N |
| ATOM | 2653 | CA | CYS | B | 135 | −35.688 | −7.373 | 125.423 | 1.00 | 30.29 | C |
| ATOM | 2654 | C | CYS | B | 135 | −35.351 | −8.641 | 124.645 | 1.00 | 30.83 | C |
| ATOM | 2655 | O | CYS | B | 135 | −35.841 | −8.828 | 123.528 | 1.00 | 31.86 | O |
| ATOM | 2656 | CB | CYS | B | 135 | −37.149 | −7.402 | 125.895 | 1.00 | 28.77 | C |
| ATOM | 2657 | SG | CYS | B | 135 | −37.549 | −8.569 | 127.279 | 1.00 | 36.90 | S |
| ATOM | 2658 | N | LEU | B | 136 | −34.537 | −9.514 | 125.236 | 1.00 | 28.65 | N |
| ATOM | 2659 | CA | LEU | B | 136 | −34.113 | −10.767 | 124.610 | 1.00 | 26.89 | C |
| ATOM | 2660 | C | LEU | B | 136 | −34.712 | −11.963 | 125.340 | 1.00 | 27.49 | C |
| ATOM | 2661 | O | LEU | B | 136 | −34.462 | −12.158 | 126.536 | 1.00 | 26.81 | O |
| ATOM | 2662 | CB | LEU | B | 136 | −32.587 | −10.874 | 124.591 | 1.00 | 23.26 | C |
| ATOM | 2663 | CG | LEU | B | 136 | −32.021 | −12.242 | 124.215 | 1.00 | 26.55 | C |
| ATOM | 2664 | CD1 | LEU | B | 136 | −32.394 | −12.677 | 122.784 | 1.00 | 29.37 | C |
| ATOM | 2665 | CD2 | LEU | B | 136 | −30.539 | −12.206 | 124.383 | 1.00 | 26.86 | C |
| ATOM | 2666 | N | LEU | B | 137 | −35.471 | −12.776 | 124.612 | 1.00 | 27.17 | N |
| ATOM | 2667 | CA | LEU | B | 137 | −36.003 | −14.046 | 125.109 | 1.00 | 24.46 | C |
| ATOM | 2668 | C | LEU | B | 137 | −35.244 | −15.151 | 124.412 | 1.00 | 25.24 | C |
| ATOM | 2669 | O | LEU | B | 137 | −35.476 | −15.416 | 123.232 | 1.00 | 27.19 | O |
| ATOM | 2670 | CB | LEU | B | 137 | −37.498 | −14.197 | 124.847 | 1.00 | 24.41 | C |
| ATOM | 2671 | CG | LEU | B | 137 | −38.513 | −13.411 | 125.671 | 1.00 | 26.56 | C |
| ATOM | 2672 | CD1 | LEU | B | 137 | −38.301 | −11.899 | 125.512 | 1.00 | 22.36 | C |
| ATOM | 2673 | CD2 | LEU | B | 137 | −39.922 | −13.845 | 125.275 | 1.00 | 24.34 | C |
| ATOM | 2674 | N | ASN | B | 138 | −34.374 | −15.820 | 125.147 | 1.00 | 27.07 | N |
| ATOM | 2675 | CA | ASN | B | 138 | −33.403 | −16.731 | 124.575 | 1.00 | 27.89 | C |
| ATOM | 2676 | C | ASN | B | 138 | −33.800 | −18.186 | 124.822 | 1.00 | 28.77 | C |
| ATOM | 2677 | O | ASN | B | 138 | −34.161 | −18.546 | 125.945 | 1.00 | 33.61 | O |
| ATOM | 2678 | CB | ASN | B | 138 | −32.033 | −16.411 | 125.163 | 1.00 | 31.08 | C |
| ATOM | 2679 | CG | ASN | B | 138 | −30.904 | −16.806 | 124.256 | 1.00 | 37.01 | C |
| ATOM | 2680 | OD1 | ASN | B | 138 | −30.870 | −16.438 | 123.076 | 1.00 | 34.03 | O |
| ATOM | 2681 | ND2 | ASN | B | 138 | −29.933 | −17.509 | 124.815 | 1.00 | 40.66 | N |
| ATOM | 2682 | N | ASN | B | 139 | −33.800 | −18.987 | 123.747 | 1.00 | 26.63 | N |
| ATOM | 2683 | CA | ASN | B | 139 | −33.861 | −20.463 | 123.722 | 1.00 | 26.50 | C |
| ATOM | 2684 | C | ASN | B | 139 | −35.075 | −21.037 | 124.462 | 1.00 | 25.84 | C |
| ATOM | 2685 | O | ASN | B | 139 | −34.958 | −21.778 | 125.436 | 1.00 | 30.08 | O |
| ATOM | 2686 | CB | ASN | B | 139 | −32.559 | −21.104 | 124.220 | 1.00 | 27.61 | C |
| ATOM | 2687 | CG | ASN | B | 139 | −31.415 | −20.897 | 123.232 | 1.00 | 35.63 | C |
| ATOM | 2688 | OD1 | ASN | B | 139 | −31.150 | −19.770 | 122.822 | 1.00 | 31.84 | O |
| ATOM | 2689 | ND2 | ASN | B | 139 | −30.785 | −21.990 | 122.787 | 1.00 | 33.37 | N |
| ATOM | 2690 | N | PHE | B | 140 | −36.249 | −20.756 | 123.903 | 1.00 | 27.05 | N |
| ATOM | 2691 | CA | PHE | B | 140 | −37.494 | −21.275 | 124.449 | 1.00 | 28.39 | C |
| ATOM | 2692 | C | PHE | B | 140 | −38.206 | −22.147 | 123.413 | 1.00 | 30.25 | C |
| ATOM | 2693 | O | PHE | B | 140 | −37.990 | −22.032 | 122.203 | 1.00 | 30.54 | O |
| ATOM | 2694 | CB | PHE | B | 140 | −38.430 | −20.144 | 124.905 | 1.00 | 25.56 | C |
| ATOM | 2695 | CG | PHE | B | 140 | −38.791 | −19.192 | 123.813 | 1.00 | 27.91 | C |
| ATOM | 2696 | CD1 | PHE | B | 140 | −37.989 | −18.086 | 123.541 | 1.00 | 25.72 | C |
| ATOM | 2697 | CD2 | PHE | B | 140 | −39.922 | −19.410 | 123.030 | 1.00 | 27.50 | C |
| ATOM | 2698 | CE1 | PHE | B | 140 | −38.309 | −17.202 | 122.515 | 1.00 | 24.13 | C |
| ATOM | 2699 | CE2 | PHE | B | 140 | −40.257 | −18.524 | 122.002 | 1.00 | 29.76 | C |

TABLE 10.4-continued

| ATOM | 2700 | CZ  | PHE | B | 140 | −39.438 | −17.415 | 121.744 | 1.00 | 27.82 | C   |
|------|------|-----|-----|---|-----|---------|---------|---------|------|-------|-----|
| ATOM | 2701 | N   | TYR | B | 141 | −39.054 | −23.030 | 123.914 | 1.00 | 27.15 | N   |
| ATOM | 2702 | CA  | TYR | B | 141 | −39.947 | −23.833 | 123.101 | 1.00 | 27.13 | C   |
| ATOM | 2703 | C   | TYR | B | 141 | −41.183 | −24.086 | 123.982 | 1.00 | 29.40 | C   |
| ATOM | 2704 | O   | TYR | B | 141 | −41.048 | −24.404 | 125.162 | 1.00 | 28.49 | O   |
| ATOM | 2705 | CB  | TYR | B | 141 | −39.278 | −25.150 | 122.634 | 1.00 | 27.47 | C   |
| ATOM | 2706 | CG  | TYR | B | 141 | −40.171 | −25.919 | 121.693 | 1.00 | 28.08 | C   |
| ATOM | 2707 | CD1 | TYR | B | 141 | −41.133 | −26.780 | 122.196 | 1.00 | 30.33 | C   |
| ATOM | 2708 | CD2 | TYR | B | 141 | −40.098 | −25.746 | 120.308 | 1.00 | 24.75 | C   |
| ATOM | 2709 | CE1 | TYR | B | 141 | −42.002 | −27.456 | 121.359 | 1.00 | 30.51 | C   |
| ATOM | 2710 | CE2 | TYR | B | 141 | −40.969 | −26.402 | 119.464 | 1.00 | 25.25 | C   |
| ATOM | 2711 | CZ  | TYR | B | 141 | −41.930 | −27.270 | 120.002 | 1.00 | 30.79 | C   |
| ATOM | 2712 | H   | TYR | B | 141 | −42.841 | −27.974 | 119.229 | 1.00 | 28.57 | O   |
| ATOM | 2713 | N   | PRO | B | 142 | −42.394 | −23.975 | 123.414 | 1.00 | 29.92 | N   |
| ATOM | 2714 | CA  | PRO | B | 142 | −42.663 | −23.735 | 121.996 | 1.00 | 28.29 | C   |
| ATOM | 2715 | C   | PRO | B | 142 | −42.638 | −22.263 | 121.586 | 1.00 | 29.24 | C   |
| ATOM | 2716 | O   | PRO | B | 142 | −42.345 | −21.399 | 122.404 | 1.00 | 30.25 | O   |
| ATOM | 2717 | CB  | PRO | B | 142 | −44.067 | −24.327 | 121.825 | 1.00 | 28.67 | C   |
| ATOM | 2718 | CG  | PRO | B | 142 | −44.726 | −24.029 | 123.121 | 1.00 | 25.40 | C   |
| ATOM | 2719 | CD  | PRO | B | 142 | −43.635 | −24.261 | 124.160 | 1.00 | 27.51 | C   |
| ATOM | 2720 | N   | ARG | B | 143 | −43.042 | −22.022 | 120.332 | 1.00 | 33.09 | N   |
| ATOM | 2721 | CA  | ARG | B | 143 | −42.828 | −20.754 | 119.634 | 1.00 | 32.76 | C   |
| ATOM | 2722 | C   | ARG | B | 143 | −43.567 | −19.587 | 120.289 | 1.00 | 33.19 | C   |
| ATOM | 2723 | O   | ARG | B | 143 | −43.061 | −18.461 | 120.295 | 1.00 | 34.09 | O   |
| ATOM | 2724 | CB  | ARG | B | 143 | −43.256 | −20.953 | 118.174 | 1.00 | 30.54 | C   |
| ATOM | 2725 | CG  | ARG | B | 143 | −43.343 | −19.750 | 117.269 | 1.00 | 30.54 | C   |
| ATOM | 2726 | CD  | ARG | B | 143 | −42.071 | −19.508 | 116.495 | 1.00 | 35.91 | C   |
| ATOM | 2727 | NE  | ARG | B | 143 | −42.253 | −18.751 | 115.239 | 1.00 | 36.61 | N   |
| ATOM | 2728 | CZ  | ARG | B | 143 | −42.878 | −17.569 | 115.45  | 1.00 | 37.84 | C   |
| ATOM | 2729 | NH1 | ARG | B | 143 | −43.464 | −17.009 | 116.203 | 1.00 | 40.08 | N1+ |
| ATOM | 2730 | NH2 | ARG | B | 143 | −42.943 | −16.947 | 113.987 | 1.00 | 35.58 | N   |
| ATOM | 2731 | N   | GLU | B | 144 | −44.743 | −19.837 | 120.856 | 1.00 | 31.25 | N   |
| ATOM | 2732 | CA  | GLU | B | 144 | −45.607 | −18.768 | 121.346 | 1.00 | 35.56 | C   |
| ATOM | 2733 | C   | GLU | B | 144 | −45.024 | −18.121 | 122.602 | 1.00 | 34.95 | C   |
| ATOM | 2734 | O   | GLU | B | 144 | −44.602 | −18.808 | 123.537 | 1.00 | 34.88 | O   |
| ATOM | 2735 | CB  | GLU | B | 144 | −47.021 | −19.299 | 121.646 | 1.00 | 30.65 | C   |
| ATOM | 2736 | CG  | GLU | B | 144 | −47.821 | −19.817 | 120.448 | 1.00 | 34.84 | C   |
| ATOM | 2737 | CD  | GLU | B | 144 | −47.385 | −21.206 | 119.951 | 1.00 | 44.49 | C   |
| ATOM | 2738 | OE1 | GLU | B | 144 | −47.117 | −22.107 | 120.783 | 1.00 | 41.20 | O   |
| ATOM | 2739 | OE2 | GLU | B | 144 | −47.333 | −21.404 | 118.716 | 1.00 | 47.18 | O1− |
| ATOM | 2740 | N   | ALA | B | 145 | −45.002 | −16.795 | 122.623 | 1.00 | 29.26 | N   |
| ATOM | 2741 | CA  | ALA | B | 145 | −44.486 | −16.077 | 123.774 | 1.00 | 34.47 | C   |
| ATOM | 2742 | C   | ALA | B | 145 | −45.102 | −14.691 | 123.756 | 1.00 | 33.83 | C   |
| ATOM | 2743 | O   | ALA | B | 145 | −45.457 | −14.194 | 122.684 | 1.00 | 35.59 | O   |
| ATOM | 2744 | CB  | ALA | B | 145 | −42.952 | −16.007 | 123.737 | 1.00 | 31.26 | C   |
| ATOM | 2745 | N   | LYS | B | 146 | −45.250 | −14.077 | 124.937 | 1.00 | 26.49 | N   |
| ATOM | 2746 | CA  | LYS | B | 146 | −45.754 | −12.707 | 125.026 | 1.00 | 28.76 | C   |
| ATOM | 2747 | C   | LYS | B | 146 | −44.766 | −11.790 | 125.756 | 1.00 | 32.11 | C   |
| ATOM | 2748 | O   | LYS | B | 146 | −44.336 | −12.085 | 126.880 | 1.00 | 25.51 | O   |
| ATOM | 2749 | CB  | LYS | B | 146 | −47.130 | −12.683 | 125.687 | 1.00 | 34.49 | C   |
| ATOM | 2750 | CG  | LYS | B | 146 | −47.879 | −11.354 | 125.547 | 1.00 | 44.62 | C   |
| ATOM | 2751 | CD  | LYS | B | 146 | −49.339 | −11.502 | 126.002 | 1.00 | 51.17 | C   |
| ATOM | 2752 | CE  | LYS | B | 146 | −50.157 | −10.231 | 125.771 | 1.00 | 55.61 | C   |
| ATOM | 2753 | NZ  | LYS | B | 146 | −51.627 | −10.552 | 125.678 | 1.00 | 51.90 | N1+ |
| ATOM | 2754 | N   | VAL | B | 147 | −44.417 | −10.672 | 125.113 | 1.00 | 32.22 | N   |
| ATOM | 2755 | CA  | VAL | B | 147 | −43.616 | −9.609  | 125.712 | 1.00 | 28.21 | C   |
| ATOM | 2756 | C   | VAL | B | 147 | −44.534 | −8.434  | 126.015 | 1.00 | 34.36 | C   |
| ATOM | 2757 | O   | VAL | B | 147 | −45.332 | −8.029  | 125.165 | 1.00 | 33.36 | O   |
| ATOM | 2758 | CB  | VAL | B | 147 | −42.464 | −9.160  | 124.794 | 1.00 | 27.98 | C   |
| ATOM | 2759 | CG1 | VAL | B | 147 | −41.768 | −7.931  | 125.372 | 1.00 | 29.12 | C   |
| ATOM | 2760 | CG2 | VAL | B | 147 | −41.472 | −10.275 | 124.560 | 1.00 | 32.19 | C   |
| ATOM | 2761 | N   | GLN | B | 148 | −44.444 | −7.904  | 127.230 | 1.00 | 35.67 | N   |
| ATOM | 2762 | CA  | GLN | B | 148 | −45.128 | −6.673  | 127.593 | 1.00 | 36.29 | C   |
| ATOM | 2763 | C   | GLN | B | 148 | −44.100 | −5.665  | 128.073 | 1.00 | 33.05 | C   |
| ATOM | 2764 | O   | GLN | B | 148 | −43.303 | −5.968  | 128.966 | 1.00 | 29.76 | O   |
| ATOM | 2765 | CB  | GLN | B | 148 | −46.192 | −6.913  | 128.676 | 1.00 | 36.98 | C   |
| ATOM | 2766 | CG  | GLN | B | 148 | −47.614 | −6.800  | 128.154 | 1.00 | 47.87 | C   |
| ATOM | 2767 | CD  | GLN | B | 148 | −48.651 | −7.188  | 129.192 | 1.00 | 64.59 | C   |
| ATOM | 2768 | OE1 | GLN | B | 148 | −48.420 | −7.050  | 130.398 | 1.00 | 64.90 | O   |
| ATOM | 2769 | NE2 | GLN | B | 148 | −49.806 | −7.674  | 128.728 | 1.00 | 58.09 | N   |
| ATOM | 2770 | N   | TRP | B | 149 | −44.099 | −4.485  | 127.465 | 1.00 | 34.92 | N   |
| ATOM | 2771 | CA  | TRP | B | 149 | −43.234 | −3.400  | 127.918 | 1.00 | 35.07 | C   |
| ATOM | 2772 | C   | TRP | B | 149 | −43.941 | −2.522  | 128.952 | 1.00 | 31.98 | C   |
| ATOM | 2773 | O   | TRP | B | 149 | −45.105 | −2.154  | 128.778 | 1.00 | 33.16 | O   |
| ATOM | 2774 | CB  | TRP | B | 149 | −42.797 | −2.549  | 126.730 | 1.00 | 28.25 | C   |
| ATOM | 2775 | CG  | TRP | B | 149 | −41.704 | −3.158  | 125.876 | 1.00 | 31.59 | C   |
| ATOM | 2776 | CD1 | TRP | B | 149 | −41.851 | −3.717  | 124.640 | 1.00 | 28.61 | C   |
| ATOM | 2777 | CD2 | TRP | B | 149 | −40.305 | −3.236  | 126.186 | 1.00 | 28.06 | C   |
| ATOM | 2778 | NE1 | TRP | B | 149 | −40.640 | −4.134  | 124.164 | 1.00 | 31.98 | N   |
| ATOM | 2779 | CE2 | TRP | B | 149 | −39.671 | −3.852  | 125.091 | 1.00 | 31.31 | C   |

TABLE 10.4-continued

| | | | | | | | | | | |
|---|---|---|---|---|---|---|---|---|---|---|
| ATOM | 2780 | CE3 | TRP | B | 149 | −39.529 | −2.842 | 127.280 | 1.00 | 32.39 | C |
| ATOM | 2781 | CZ2 | TRP | B | 149 | −38.289 | −4.080 | 125.048 | 1.00 | 29.16 | C |
| ATOM | 2782 | CZ3 | TRP | B | 149 | −38.159 | −3.066 | 127.242 | 1.00 | 36.30 | C |
| ATOM | 2783 | CH2 | TRP | B | 149 | −37.550 | −3.676 | 126.125 | 1.00 | 32.50 | C |
| ATOM | 2784 | N | LYS | B | 150 | −43.228 | −2.174 | 130.023 | 1.00 | 34.33 | N |
| ATOM | 2785 | CA | LYS | B | 150 | −43.736 | −1.240 | 131.030 | 1.00 | 35.21 | C |
| ATOM | 2786 | C | LYS | B | 150 | −42.711 | −0.143 | 131.257 | 1.00 | 36.04 | C |
| ATOM | 2787 | O | LYS | B | 150 | −41.534 | −0.433 | 131.489 | 1.00 | 40.23 | O |
| ATOM | 2788 | CB | LYS | B | 150 | −44.050 | −1.918 | 132.374 | 1.00 | 29.19 | C |
| ATOM | 2789 | CG | LYS | B | 150 | −45.326 | −2.755 | 132.421 | 1.00 | 32.86 | C |
| ATOM | 2790 | CD | LYS | B | 150 | −45.296 | −3.677 | 133.643 | 1.00 | 42.43 | C |
| ATOM | 2791 | CE | LYS | B | 150 | −46.327 | −4.800 | 133.536 | 1.00 | 54.13 | C |
| ATOM | 2792 | NZ | LYS | B | 150 | −46.598 | −5.502 | 134.839 | 1.00 | 48.84 | N1+ |
| ATOM | 2793 | N | VAL | B | 151 | −43.158 | 1.107 | 131.189 | 1.00 | 34.12 | N |
| ATOM | 2794 | CA | VAL | B | 151 | −42.355 | 2.270 | 131.559 | 1.00 | 34.61 | C |
| ATOM | 2795 | C | VAL | B | 151 | −43.003 | 2.921 | 132.784 | 1.00 | 36.08 | C |
| ATOM | 2796 | O | VAL | B | 151 | −44.118 | 3.448 | 132.699 | 1.00 | 35.70 | O |
| ATOM | 2797 | CB | VAL | B | 151 | −42.241 | 3.255 | 130.392 | 1.00 | 31.07 | C |
| ATOM | 2798 | CG1 | VAL | B | 151 | −41.307 | 4.377 | 130.732 | 1.00 | 31.60 | C |
| ATOM | 2799 | CG2 | VAL | B | 151 | −41.752 | 2.528 | 129.173 | 1.00 | 37.80 | C |
| ATOM | 2800 | N | ASP | B | 152 | −42.299 | 2.902 | 133.921 | 1.00 | 39.23 | N |
| ATOM | 2801 | CA | ASP | B | 152 | −42.854 | 3.340 | 135.217 | 1.00 | 38.88 | C |
| ATOM | 2802 | C | ASP | B | 152 | −44.243 | 2.743 | 135.428 | 1.00 | 37.74 | C |
| ATOM | 2803 | O | ASP | B | 152 | −45.194 | 3.412 | 135.836 | 1.00 | 35.76 | O |
| ATOM | 2804 | CB | ASP | B | 152 | −42.848 | 4.863 | 135.343 | 1.00 | 36.31 | C |
| ATOM | 2805 | CG | ASP | B | 152 | −41.451 | 5.404 | 135.628 | 1.00 | 44.31 | C |
| ATOM | 2806 | OD1 | ASP | B | 152 | −40.688 | 4.719 | 136.357 | 1.00 | 39.45 | O |
| ATOM | 2807 | OD2 | ASP | B | 152 | −41.093 | 6.479 | 135.094 | 1.00 | 46.68 | O1− |
| ATOM | 2808 | N | ASN | B | 153 | −44.333 | 1.457 | 135.097 | 1.00 | 38.94 | N |
| ATOM | 2809 | CA | ASN | B | 153 | −45.491 | 0.579 | 135.212 | 1.00 | 39.28 | C |
| ATOM | 2810 | C | ASN | B | 153 | −46.660 | 0.990 | 134.321 | 1.00 | 37.08 | C |
| ATOM | 2811 | O | ASN | B | 153 | −47.783 | 0.508 | 134.502 | 1.00 | 39.74 | O |
| ATOM | 2812 | CB | ASN | B | 153 | −45.933 | 0.433 | 136.666 | 1.00 | 37.94 | C |
| ATOM | 2813 | CG | ASN | B | 153 | −46.502 | −0.927 | 136.937 | 1.00 | 41.53 | C |
| ATOM | 2814 | OD1 | ASN | B | 153 | −47.693 | −1.071 | 137.197 | 1.00 | 48.49 | O |
| ATOM | 2815 | ND2 | ASN | B | 153 | −45.658 | −1.953 | 136.827 | 1.00 | 47.40 | N |
| ATOM | 2816 | N | ALA | B | 154 | −46.418 | 1.824 | 133.322 | 1.00 | 27.73 | N |
| ATOM | 2817 | CA | ALA | B | 154 | −47.403 | 2.060 | 132.281 | 1.00 | 31.59 | C |
| ATOM | 2818 | C | ALA | B | 154 | −47.152 | 1.064 | 131.145 | 1.00 | 35.73 | C |
| ATOM | 2819 | O | ALA | B | 154 | −46.034 | 1.006 | 130.611 | 1.00 | 34.76 | O |
| ATOM | 2820 | CB | ALA | B | 154 | −47.314 | 3.503 | 131.785 | 1.00 | 30.19 | C |
| ATOM | 2821 | N | LEU | B | 155 | −48.168 | 0.246 | 130.817 | 1.00 | 31.02 | N |
| ATOM | 2822 | CA | LEU | B | 155 | −48.092 | −0.680 | 129.680 | 1.00 | 29.47 | C |
| ATOM | 2823 | C | LEU | B | 155 | −47.940 | 0.045 | 128.364 | 1.00 | 29.26 | C |
| ATOM | 2824 | O | LEU | B | 155 | −48.816 | 0.809 | 127.967 | 1.00 | 32.19 | O |
| ATOM | 2825 | CB | LEU | B | 155 | −49.321 | −1.578 | 129.581 | 1.00 | 26.14 | C |
| ATOM | 2826 | CG | LEU | B | 155 | −49.137 | −2.963 | 130.188 | 1.00 | 41.59 | C |
| ATOM | 2827 | CD1 | LEU | B | 155 | −49.358 | −2.997 | 131.716 | 1.00 | 37.40 | C |
| ATOM | 2828 | CD2 | LEU | B | 155 | −49.966 | −3.985 | 129.430 | 1.00 | 49.03 | C |
| ATOM | 2829 | N | GLN | B | 156 | −46.891 | −0.293 | 127.632 | 1.00 | 32.37 | N |
| ATOM | 2830 | CA | GLN | B | 156 | −46.687 | 0.225 | 126.289 | 1.00 | 31.54 | C |
| ATOM | 2831 | C | GLN | B | 156 | −47.433 | −0.647 | 125.293 | 1.00 | 27.02 | C |
| ATOM | 2832 | O | GLN | B | 156 | −47.493 | −1.864 | 125.444 | 1.00 | 36.94 | O |
| ATOM | 2833 | CB | GLN | B | 156 | −45.193 | 0.270 | 125.966 | 1.00 | 31.74 | C |
| ATOM | 2834 | CG | GLN | B | 156 | −44.395 | 0.948 | 127.069 | 1.00 | 31.12 | C |
| ATOM | 2835 | CD | GLN | B | 156 | −44.877 | 2.358 | 127.299 | 1.00 | 33.29 | C |
| ATOM | 2836 | OE1 | GLN | B | 156 | −44.789 | 3.213 | 126.412 | 1.00 | 33.92 | O |
| ATOM | 2837 | NE2 | GLN | B | 156 | −45.445 | 2.599 | 128.470 | 1.00 | 34.06 | N |
| ATOM | 2838 | N | SER | B | 157 | −48.069 | −0.017 | 124.322 | 1.00 | 25.15 | N |
| ATOM | 2839 | CA | SER | B | 157 | −48.818 | −0.745 | 123.309 | 1.00 | 24.13 | C |
| ATOM | 2840 | C | SER | B | 157 | −48.684 | 0.008 | 121.998 | 1.00 | 28.91 | C |
| ATOM | 2841 | O | SER | B | 157 | −49.132 | 1.153 | 121.903 | 1.00 | 33.39 | O |
| ATOM | 2842 | CB | SER | B | 157 | −50.284 | −0.869 | 123.724 | 1.00 | 27.59 | C |
| ATOM | 2843 | OG | SER | B | 157 | −51.056 | −1.511 | 122.738 | 1.00 | 34.07 | O |
| ATOM | 2844 | N | GLY | B | 158 | −48.052 | −0.597 | 121.005 | 1.00 | 23.39 | N |
| ATOM | 2845 | CA | GLY | B | 158 | −47.959 | 0.017 | 119.698 | 1.00 | 22.69 | C |
| ATOM | 2846 | C | GLY | B | 158 | −46.630 | 0.665 | 119.370 | 1.00 | 26.97 | C |
| ATOM | 2847 | O | GLY | B | 158 | −46.467 | 1.166 | 118.256 | 1.00 | 30.74 | O |
| ATOM | 2848 | N | ASN | B | 159 | −45.695 | 0.721 | 120.312 | 1.00 | 26.14 | N |
| ATOM | 2849 | CA | ASN | B | 159 | −44.412 | 1.373 | 120.086 | 1.00 | 25.51 | C |
| ATOM | 2850 | C | ASN | B | 159 | −43.236 | 0.401 | 120.206 | 1.00 | 30.63 | C |
| ATOM | 2851 | O | ASN | B | 159 | −42.149 | 0.779 | 120.660 | 1.00 | 25.81 | O |
| ATOM | 2852 | CB | ASN | B | 159 | −44.236 | 2.542 | 121.043 | 1.00 | 22.42 | C |
| ATOM | 2853 | CG | ASN | B | 159 | −44.537 | 2.165 | 122.463 | 1.00 | 29.01 | C |
| ATOM | 2854 | OD1 | ASN | B | 159 | −44.940 | 1.021 | 122.757 | 1.00 | 30.10 | O |
| ATOM | 2855 | ND2 | ASN | B | 159 | −44.335 | 3.114 | 123.370 | 1.00 | 32.61 | N |
| ATOM | 2856 | N | SER | B | 160 | −43.439 | −0.859 | 119.819 | 1.00 | 27.65 | N |
| ATOM | 2857 | CA | SER | B | 160 | −42.360 | −1.827 | 119.814 | 1.00 | 29.05 | C |
| ATOM | 2858 | C | SER | B | 160 | −42.510 | −2.753 | 118.615 | 1.00 | 28.89 | C |
| ATOM | 2859 | O | SER | B | 160 | −43.602 | −2.939 | 118.089 | 1.00 | 29.48 | O |

TABLE 10.4-continued

| | | | | | | | | | |
|---|---|---|---|---|---|---|---|---|---|
| ATOM | 2860 | CB | SER | B | 160 | −42.328 | −2.626 | 121.112 | 1.00 | 26.29 | C |
| ATOM | 2861 | OG | SER | B | 160 | −43.447 | −3.475 | 121.181 | 1.00 | 31.67 | O |
| ATOM | 2862 | N | GLN | B | 161 | −41.400 | −3.357 | 118.197 | 1.00 | 28.03 | N |
| ATOM | 2863 | CA | GLN | B | 161 | −41.425 | −4.362 | 117.147 | 1.00 | 26.96 | C |
| ATOM | 2864 | C | GLN | B | 161 | −40.634 | −5.596 | 117.581 | 1.00 | 31.51 | C |
| ATOM | 2865 | O | GLN | B | 161 | −39.759 | −5.537 | 118.451 | 1.00 | 30.01 | O |
| ATOM | 2866 | CB | GLN | B | 161 | −40.871 | −3.794 | 115.850 | 1.00 | 27.24 | C |
| ATOM | 2867 | CG | GLN | B | 161 | −41.747 | −2.764 | 115.183 | 1.00 | 27.43 | C |
| ATOM | 2868 | CD | GLN | B | 161 | −41.064 | −2.142 | 113.976 | 1.00 | 35.97 | C |
| ATOM | 2869 | OE1 | GLN | B | 161 | −40.203 | −1.267 | 114.121 | 1.00 | 35.92 | O |
| ATOM | 2870 | NE2 | GLN | B | 161 | −41.418 | −2.607 | 112.782 | 1.00 | 30.28 | N |
| ATOM | 2871 | N | GLU | B | 162 | −40.938 | −6.720 | 116.938 | 1.00 | 31.79 | N |
| ATOM | 2872 | CA | GLU | B | 162 | −40.438 | −8.034 | 117.331 | 1.00 | 29.63 | C |
| ATOM | 2873 | C | GLU | B | 162 | −40.040 | −8.837 | 116.104 | 1.00 | 30.95 | C |
| ATOM | 2874 | O | GLU | B | 162 | −40.654 | −8.718 | 115.042 | 1.00 | 26.14 | O |
| ATOM | 2875 | CB | GLU | B | 162 | −41.503 | −8.877 | 117.989 | 1.00 | 23.86 | C |
| ATOM | 2876 | CG | GLU | B | 162 | −41.567 | −8.969 | 119.420 | 1.00 | 34.85 | C |
| ATOM | 2877 | CD | GLU | B | 162 | −42.807 | −9.765 | 119.781 | 1.00 | 41.65 | C |
| ATOM | 2878 | OE1 | GLU | B | 162 | −43.430 | −10.284 | 118.835 | 1.00 | 38.04 | O |
| ATOM | 2879 | OE2 | GLU | B | 162 | −43.177 | −9.858 | 120.973 | 1.00 | 45.93 | O1− |
| ATOM | 2880 | N | SER | B | 163 | −39.057 | −9.712 | 116.280 | 1.00 | 31.61 | N |
| ATOM | 2881 | CA | SER | B | 163 | −38.794 | −10.763 | 115.312 | 1.00 | 25.04 | C |
| ATOM | 2882 | C | SER | B | 163 | −38.348 | −11.995 | 116.088 | 1.00 | 28.10 | C |
| ATOM | 2883 | O | SER | B | 163 | −37.857 | −11.890 | 117.218 | 1.00 | 25.85 | O |
| ATOM | 2884 | CB | SER | B | 163 | −37.781 | −10.326 | 114.254 | 1.00 | 26.93 | C |
| ATOM | 2885 | OG | SER | B | 163 | −36.461 | −10.447 | 114.714 | 1.00 | 29.93 | O |
| ATOM | 2886 | N | VAL | B | 164 | −38.587 | −13.169 | 115.504 | 1.00 | 29.93 | N |
| ATOM | 2887 | CA | VAL | B | 164 | −38.200 | −14.441 | 116.104 | 1.00 | 26.45 | C |
| ATOM | 2888 | C | VAL | B | 164 | −37.323 | −15.214 | 115.130 | 1.00 | 23.48 | C |
| ATOM | 2889 | O | VAL | B | 164 | −37.520 | −15.156 | 113.918 | 1.00 | 28.17 | O |
| ATOM | 2890 | CB | VAL | B | 164 | −39.430 | −15.281 | 116.521 | 1.00 | 30.77 | C |
| ATOM | 2891 | CG1 | VAL | B | 164 | −40.375 | −14.468 | 117.392 | 1.00 | 26.66 | C |
| ATOM | 2892 | CG2 | VAL | B | 164 | −40.156 | −15.786 | 115.308 | 1.00 | 40.64 | C |
| ATOM | 2893 | N | THR | B | 165 | −36.328 | −15.908 | 115.663 | 1.00 | 28.51 | N |
| ATOM | 2894 | CA | THR | B | 165 | −35.442 | −16.716 | 114.848 | 1.00 | 27.61 | C |
| ATOM | 2895 | C | THR | B | 165 | −36.154 | −17.967 | 114.344 | 1.00 | 29.58 | C |
| ATOM | 2896 | O | THR | B | 165 | −37.279 | −18.300 | 114.751 | 1.00 | 28.80 | O |
| ATOM | 2897 | CB | THR | B | 165 | −34.195 | −17.113 | 115.641 | 1.00 | 28.32 | C |
| ATOM | 2898 | OG1 | THR | B | 165 | −34.575 | −17.596 | 116.939 | 1.00 | 33.79 | O |
| ATOM | 2899 | CG2 | THR | B | 165 | −33.275 | −15.942 | 115.795 | 1.00 | 25.22 | C |
| ATOM | 2900 | N | GLU | B | 166 | −35.489 | −18.634 | 113.402 | 1.00 | 28.57 | N |
| ATOM | 2901 | CA | GLU | B | 166 | −35.851 | −19.992 | 113.026 | 1.00 | 29.18 | C |
| ATOM | 2902 | C | GLU | B | 166 | −35.474 | −20.953 | 114.149 | 1.00 | 25.81 | C |
| ATOM | 2903 | O | GLU | B | 166 | −34.705 | −20.622 | 115.046 | 1.00 | 28.21 | O |
| ATOM | 2904 | CB | GLU | B | 166 | −35.158 | −20.398 | 111.722 | 1.00 | 25.69 | C |
| ATOM | 2905 | CG | GLU | B | 166 | −35.615 | −19.673 | 110.472 | 1.00 | 23.14 | C |
| ATOM | 2906 | CD | GLU | B | 166 | −37.112 | −19.776 | 110.263 | 1.00 | 35.69 | C |
| ATOM | 2907 | OE1 | GLU | B | 166 | −37.691 | −20.801 | 110.689 | 1.00 | 45.01 | O |
| ATOM | 2908 | OE2 | GLU | B | 166 | −37.715 | −18.853 | 109.661 | 1.00 | 37.00 | O1− |
| ATOM | 2909 | N | GLN | B | 167 | −36.061 | −22.138 | 114.120 | 1.00 | 29.35 | N |
| ATOM | 2910 | CA | GLN | B | 167 | −35.749 | −23.146 | 115.126 | 1.00 | 27.70 | C |
| ATOM | 2911 | C | GLN | B | 167 | −34.250 | −23.426 | 115.143 | 1.00 | 26.23 | C |
| ATOM | 2912 | O | GLN | B | 167 | −33.622 | −23.530 | 114.093 | 1.00 | 25.94 | O |
| ATOM | 2913 | CB | GLN | B | 167 | −36.538 | −24.406 | 114.823 | 1.00 | 25.14 | C |
| ATOM | 2914 | CG | GLN | B | 167 | −36.995 | −25.171 | 116.012 | 1.00 | 27.67 | C |
| ATOM | 2915 | CD | GLN | B | 167 | −38.037 | −26.211 | 115.661 | 1.00 | 25.13 | C |
| ATOM | 2916 | OE1 | GLN | B | 167 | −38.324 | −26.473 | 114.489 | 1.00 | 27.17 | O |
| ATOM | 2917 | NE2 | GLN | B | 167 | −38.591 | −26.819 | 116.672 | 1.00 | 23.92 | N |
| ATOM | 2918 | N | ASP | B | 168 | −33.660 | −23.496 | 116.338 | 1.00 | 30.80 | N |
| ATOM | 2919 | CA | ASP | B | 168 | −32.202 | −23.493 | 116.448 | 1.00 | 29.93 | C |
| ATOM | 2920 | C | ASP | B | 168 | −31.602 | −24.806 | 115.962 | 1.00 | 31.76 | C |
| ATOM | 2921 | O | ASP | B | 168 | −31.981 | −25.882 | 116.433 | 1.00 | 30.59 | O |
| ATOM | 2922 | CB | ASP | B | 168 | −31.771 | −23.268 | 117.895 | 1.00 | 31.58 | C |
| ATOM | 2923 | CG | ASP | B | 168 | −30.269 | −23.104 | 118.028 | 1.00 | 34.74 | C |
| ATOM | 2924 | OD1 | ASP | B | 168 | −29.610 | −24.086 | 118.410 | 1.00 | 36.21 | O1− |
| ATOM | 2925 | OD2 | ASP | B | 168 | −29.737 | −22.026 | 117.677 | 1.00 | 38.15 | O |
| ATOM | 2926 | N | SER | B | 169 | −30.583 | −24.714 | 115.101 | 1.00 | 37.85 | N |
| ATOM | 2927 | CA | SER | B | 169 | −30.001 | −25.906 | 114.488 | 1.00 | 32.86 | C |
| ATOM | 2928 | C | SER | B | 169 | −29.342 | −26.845 | 115.487 | 1.00 | 33.78 | C |
| ATOM | 2929 | O | SER | B | 169 | −29.068 | −27.992 | 115.126 | 1.00 | 37.40 | O |
| ATOM | 2930 | CB | SER | B | 169 | −28.999 | −25.515 | 113.412 | 1.00 | 35.71 | C |
| ATOM | 2931 | OG | SER | B | 169 | −27.919 | −24.817 | 113.973 | 1.00 | 45.05 | O |
| ATOM | 2932 | N | LYS | B | 170 | −29.105 | −26.415 | 116.725 | 1.00 | 35.30 | N |
| ATOM | 2933 | CA | LYS | B | 170 | −28.484 | −27.260 | 117.742 | 1.00 | 32.69 | C |
| ATOM | 2934 | C | LYS | B | 170 | −29.445 | −27.779 | 118.816 | 1.00 | 33.51 | C |
| ATOM | 2935 | O | LYS | B | 170 | −29.365 | −28.957 | 119.161 | 1.00 | 33.92 | O |
| ATOM | 2936 | CB | LYS | B | 170 | −27.311 | −26.510 | 118.389 | 1.00 | 32.22 | C |
| ATOM | 2937 | CG | LYS | B | 170 | −26.523 | −27.313 | 119.398 | 1.00 | 35.45 | C |
| ATOM | 2938 | CD | LYS | B | 170 | −25.696 | −26.399 | 120.284 | 1.00 | 39.33 | C |
| ATOM | 2939 | CE | LYS | B | 170 | −24.687 | −27.150 | 121.125 | 1.00 | 41.85 | C |

TABLE 10.4-continued

| | | | | | | | | | | |
|---|---|---|---|---|---|---|---|---|---|---|
| ATOM | 2940 | NZ | LYS | B | 170 | −23.466 | −26.291 | 121.260 | 1.00 | 49.14 | N1+ |
| ATOM | 2941 | N | ASP | B | 171 | −30.386 | −26.985 | 119.360 | 1.00 | 29.53 | N |
| ATOM | 2942 | CA | ASP | B | 171 | −31.298 | −27.535 | 120.366 | 1.00 | 24.51 | C |
| ATOM | 2943 | C | ASP | B | 171 | −32.772 | −27.335 | 120.036 | 1.00 | 25.46 | C |
| ATOM | 2944 | O | ASP | B | 171 | −33.615 | −27.519 | 120.926 | 1.00 | 22.30 | O |
| ATOM | 2945 | CB | ASP | B | 171 | −31.001 | −27.011 | 121.795 | 1.00 | 25.26 | C |
| ATOM | 2946 | CG | ASP | B | 171 | −31.151 | −25.471 | 121.965 | 1.00 | 35.81 | C |
| ATOM | 2947 | OD1 | ASP | B | 171 | −31.871 | −24.789 | 121.205 | 1.00 | 38.80 | O |
| ATOM | 2948 | OD2 | ASP | B | 171 | −30.555 | −24.925 | 122.927 | 1.00 | 42.26 | O1− |
| ATOM | 2949 | N | SER | B | 172 | −33.096 | −26.958 | 118.791 | 1.00 | 24.40 | N |
| ATOM | 2950 | CA | SER | B | 172 | −34.458 | −26.783 | 118.271 | 1.00 | 22.81 | C |
| ATOM | 2951 | C | SER | B | 172 | −35.296 | −25.735 | 119.023 | 1.00 | 29.46 | C |
| ATOM | 2952 | O | SER | B | 172 | −36.540 | −25.777 | 118.980 | 1.00 | 30.46 | O |
| ATOM | 2953 | CB | SER | B | 172 | −35.204 | −28.122 | 118.240 | 1.00 | 27.26 | C |
| ATOM | 2954 | OG | SER | B | 172 | −34.476 | −29.076 | 117.480 | 1.00 | 29.50 | O |
| ATOM | 2955 | N | THR | B | 173 | −34.685 | −24.758 | 119.688 | 1.00 | 26.53 | N |
| ATOM | 2956 | CA | THR | B | 173 | −35.479 | −23.750 | 120.371 | 1.00 | 30.13 | C |
| ATOM | 2957 | C | THR | B | 173 | −35.667 | −22.512 | 119.487 | 1.00 | 28.94 | C |
| ATOM | 2958 | O | THR | B | 173 | −35.137 | −22.397 | 118.377 | 1.00 | 28.80 | O |
| ATOM | 2959 | CB | THR | B | 173 | −34.869 | −23.380 | 121.742 | 1.00 | 29.06 | C |
| ATOM | 2960 | OG1 | THR | B | 173 | −33.536 | −22.886 | 121.592 | 1.00 | 27.56 | O |
| ATOM | 2961 | CG2 | THR | B | 173 | −34.849 | −24.577 | 122.671 | 1.00 | 23.15 | C |
| ATOM | 2962 | N | TYR | B | 174 | −36.479 | −21.598 | 119.989 | 1.00 | 27.86 | N |
| ATOM | 2963 | CA | TYR | B | 174 | −36.710 | −20.306 | 119.375 | 1.00 | 27.59 | C |
| ATOM | 2964 | C | TYR | B | 174 | −36.103 | −19.210 | 120.245 | 1.00 | 28.01 | C |
| ATOM | 2965 | O | TYR | B | 174 | −35.906 | −19.388 | 121.452 | 1.00 | 28.60 | O |
| ATOM | 2966 | CB | TYR | B | 174 | −38.210 | −20.069 | 119.181 | 1.00 | 27.30 | C |
| ATOM | 2967 | CG | TYR | B | 174 | −38.818 | −20.983 | 118.147 | 1.00 | 30.86 | C |
| ATOM | 2968 | CD1 | TYR | B | 174 | −38.743 | −20.672 | 116.791 | 1.00 | 26.78 | C |
| ATOM | 2969 | CD2 | TYR | B | 174 | −39.452 | −22.171 | 118.521 | 1.00 | 31.18 | C |
| ATOM | 2970 | CE1 | TYR | B | 174 | −39.283 | −21.496 | 115.842 | 1.00 | 27.76 | C |
| ATOM | 2971 | CE2 | TYR | B | 174 | −39.994 | −23.016 | 117.567 | 1.00 | 30.49 | C |
| ATOM | 2972 | CZ | TYR | B | 174 | −39.906 | −22.666 | 116.224 | 1.00 | 31.46 | C |
| ATOM | 2973 | OH | TYR | B | 174 | −40.448 | −23.480 | 115.262 | 1.00 | 32.46 | O |
| ATOM | 2974 | N | SER | B | 175 | −35.773 | −18.087 | 119.621 | 1.00 | 26.84 | N |
| ATOM | 2975 | CA | SER | B | 175 | −35.396 | −16.886 | 120.355 | 1.00 | 28.52 | C |
| ATOM | 2976 | C | SER | B | 175 | −36.172 | −15.696 | 119.814 | 1.00 | 28.84 | C |
| ATOM | 2977 | O | SER | B | 175 | −36.595 | −15.687 | 118.656 | 1.00 | 24.93 | O |
| ATOM | 2978 | CB | SER | B | 175 | −33.904 | −16.608 | 120.274 | 1.00 | 31.06 | C |
| ATOM | 2979 | OG | SER | B | 175 | −33.199 | −17.479 | 121.133 | 1.00 | 35.19 | O |
| ATOM | 2980 | N | LEU | B | 176 | −36.367 | −14.694 | 120.671 | 1.00 | 29.11 | N |
| ATOM | 2981 | CA | LEU | B | 176 | −37.165 | −13.529 | 120.323 | 1.00 | 27.58 | C |
| ATOM | 2982 | C | LEU | B | 176 | −36.445 | −12.262 | 120.739 | 1.00 | 24.37 | C |
| ATOM | 2983 | O | LEU | B | 176 | −35.796 | −12.218 | 121.779 | 1.00 | 27.04 | O |
| ATOM | 2984 | CB | LEU | B | 176 | −38.553 | −13.589 | 120.973 | 1.00 | 29.13 | C |
| ATOM | 2985 | CG | LEU | B | 176 | −39.558 | −12.517 | 120.560 | 1.00 | 30.07 | C |
| ATOM | 2986 | CD1 | LEU | B | 176 | −40.920 | −13.129 | 120.631 | 1.00 | 30.39 | C |
| ATOM | 2987 | CD2 | LEU | B | 176 | −39.485 | −11.303 | 121.483 | 1.00 | 24.93 | C |
| ATOM | 2988 | N | SER | B | 177 | −36.556 | −11.235 | 119.905 | 1.00 | 29.33 | N |
| ATOM | 2989 | CA | SER | B | 177 | −35.972 | −9.932 | 120.178 | 1.00 | 26.82 | C |
| ATOM | 2990 | C | SER | B | 177 | −37.041 | −8.863 | 119.992 | 1.00 | 27.17 | C |
| ATOM | 2991 | O | SER | B | 177 | −37.669 | −8.809 | 118.934 | 1.00 | 25.25 | O |
| ATOM | 2992 | CB | SER | B | 177 | −34.782 | −9.694 | 119.255 | 1.00 | 26.28 | C |
| ATOM | 2993 | OG | SER | B | 177 | −34.307 | −8.377 | 119.379 | 1.00 | 27.89 | O |
| ATOM | 2994 | N | SER | B | 178 | −37.232 | −8.006 | 121.013 | 1.00 | 25.92 | N |
| ATOM | 2995 | CA | SER | B | 178 | −38.255 | −6.966 | 121.020 | 1.00 | 23.84 | C |
| ATOM | 2996 | C | SER | B | 178 | −37.624 | −5.603 | 121.261 | 1.00 | 27.80 | C |
| ATOM | 2997 | O | SER | B | 178 | −36.822 | −5.443 | 122.189 | 1.00 | 29.43 | O |
| ATOM | 2998 | CB | SER | B | 178 | −39.308 | −7.226 | 122.096 | 1.00 | 28.27 | C |
| ATOM | 2999 | OG | SER | B | 178 | −40.307 | −6.215 | 122.090 | 1.00 | 26.54 | O |
| ATOM | 3000 | N | THR | B | 179 | −38.007 | −4.617 | 120.444 | 1.00 | 26.02 | N |
| ATOM | 3001 | CA | THR | B | 179 | −37.450 | −3.266 | 120.535 | 1.00 | 30.99 | C |
| ATOM | 3002 | C | THR | B | 179 | −38.536 | −2.247 | 120.809 | 1.00 | 25.23 | C |
| ATOM | 3003 | O | THR | B | 179 | −39.357 | −1.967 | 119.938 | 1.00 | 24.43 | O |
| ATOM | 3004 | CB | THR | B | 179 | −36.714 | −2.839 | 119.274 | 1.00 | 31.29 | C |
| ATOM | 3005 | OG1 | THR | B | 179 | −35.681 | −3.781 | 118.962 | 1.00 | 35.76 | O |
| ATOM | 3006 | CG2 | THR | B | 179 | −36.121 | −1.472 | 119.512 | 1.00 | 23.65 | C |
| ATOM | 3007 | N | LEU | B | 180 | −38.489 | −1.662 | 121.997 | 1.00 | 26.49 | N |
| ATOM | 3008 | CA | LEU | B | 180 | −39.263 | −0.482 | 122.349 | 1.00 | 28.48 | C |
| ATOM | 3009 | C | LEU | B | 180 | −38.502 | 0.769 | 121.939 | 1.00 | 24.67 | C |
| ATOM | 3010 | O | LEU | B | 180 | −37.356 | 0.949 | 122.350 | 1.00 | 26.90 | O |
| ATOM | 3011 | CB | LEU | B | 180 | −39.510 | −0.482 | 123.855 | 1.00 | 30.84 | C |
| ATOM | 3012 | CG | LEU | B | 180 | −40.291 | 0.643 | 124.498 | 1.00 | 34.83 | C |
| ATOM | 3013 | CD1 | LEU | B | 180 | −41.724 | 0.580 | 123.976 | 1.00 | 34.95 | C |
| ATOM | 3014 | CD2 | LEU | B | 180 | −40.215 | 0.471 | 126.015 | 1.00 | 31.30 | C |
| ATOM | 3015 | N | THR | B | 181 | −39.142 | 1.642 | 121.161 | 1.00 | 25.09 | N |
| ATOM | 3016 | CA | THR | B | 181 | −38.529 | 2.892 | 120.712 | 1.00 | 34.09 | C |
| ATOM | 3017 | C | THR | B | 181 | −39.245 | 4.090 | 121.341 | 1.00 | 40.80 | C |
| ATOM | 3018 | O | THR | B | 181 | −40.484 | 4.142 | 121.354 | 1.00 | 36.26 | O |
| ATOM | 3019 | CB | THR | B | 181 | −38.548 | 3.005 | 119.181 | 1.00 | 33.92 | C |

TABLE 10.4-continued

| | | | | | | | | | | |
|---|---|---|---|---|---|---|---|---|---|---|
| ATOM | 3020 | OG1 | THR | B | 181 | −37.870 | 1.881 | 118.610 | 1.00 | 36.57 | O |
| ATOM | 3021 | CG2 | THR | B | 181 | −37.793 | 4.230 | 118.744 | 1.00 | 36.41 | C |
| ATOM | 3022 | N | LEU | B | 182 | −38.452 | 5.031 | 121.882 | 1.00 | 36.61 | N |
| ATOM | 3023 | CA | LEU | B | 182 | −38.910 | 6.286 | 122.483 | 1.00 | 33.83 | C |
| ATOM | 3024 | C | LEU | B | 182 | −38.034 | 7.434 | 121.997 | 1.00 | 37.62 | C |
| ATOM | 3025 | O | LEU | B | 182 | −36.923 | 7.235 | 121.506 | 1.00 | 36.88 | O |
| ATOM | 3026 | CB | LEU | B | 182 | −38.837 | 6.287 | 124.017 | 1.00 | 39.93 | C |
| ATOM | 3027 | CG | LEU | B | 182 | −39.550 | 5.271 | 124.901 | 1.00 | 43.75 | C |
| ATOM | 3028 | CD1 | LEU | B | 182 | −39.188 | 5.503 | 126.364 | 1.00 | 42.80 | C |
| ATOM | 3029 | CD2 | LEU | B | 182 | −41.051 | 5.401 | 124.698 | 1.00 | 48.91 | C |
| ATOM | 3030 | N | SER | B | 183 | −38.515 | 8.653 | 122.183 | 1.00 | 40.17 | N |
| ATOM | 3031 | CA | SER | B | 183 | −37.616 | 9.784 | 122.023 | 1.00 | 39.39 | C |
| ATOM | 3032 | C | SER | B | 183 | −36.639 | 9.844 | 123.195 | 1.00 | 39.08 | C |
| ATOM | 3033 | O | SER | B | 183 | −36.882 | 9.278 | 124.259 | 1.00 | 39.26 | O |
| ATOM | 3034 | CB | SER | B | 183 | −38.401 | 11.088 | 121.963 | 1.00 | 38.95 | C |
| ATOM | 3035 | OG | SER | B | 183 | −39.031 | 11.322 | 123.210 | 1.00 | 35.92 | O |
| ATOM | 3036 | N | LYS | B | 184 | −35.510 | 10.530 | 122.986 | 1.00 | 42.26 | N |
| ATOM | 3037 | CA | LYS | B | 184 | −34.617 | 10.803 | 124.109 | 1.00 | 40.17 | C |
| ATOM | 3038 | C | LYS | B | 184 | −35.348 | 11.566 | 125.208 | 1.00 | 41.28 | C |
| ATOM | 3039 | O | LYS | B | 184 | −35.138 | 11.310 | 126.401 | 1.00 | 38.53 | O |
| ATOM | 3040 | CB | LYS | B | 184 | −33.405 | 11.605 | 123.646 | 1.00 | 42.87 | C |
| ATOM | 3041 | CG | LYS | B | 184 | −32.462 | 11.986 | 124.806 | 1.00 | 52.77 | C |
| ATOM | 3042 | CD | LYS | B | 184 | −31.228 | 12.771 | 124.339 | 1.00 | 51.17 | C |
| ATOM | 3043 | CE | LYS | B | 184 | −30.325 | 13.153 | 125.500 | 1.00 | 56.17 | C |
| ATOM | 3044 | NZ | LYS | B | 184 | −30.191 | 14.632 | 125.670 | 1.00 | 63.96 | N1+ |
| ATOM | 3045 | N | ALA | B | 185 | −36.219 | 12.500 | 124.816 | 1.00 | 39.51 | N |
| ATOM | 3046 | CA | ALA | B | 185 | −36.995 | 13.275 | 125.780 | 1.00 | 38.41 | C |
| ATOM | 3047 | C | ALA | B | 185 | −37.914 | 12.389 | 126.613 | 1.00 | 39.82 | C |
| ATOM | 3048 | O | ALA | B | 185 | −37.897 | 12.456 | 127.844 | 1.00 | 44.20 | O |
| ATOM | 3049 | CB | ALA | B | 185 | −37.806 | 14.346 | 125.057 | 1.00 | 33.82 | C |
| ATOM | 3050 | N | ASP | B | 186 | −38.764 | 11.591 | 125.959 | 1.00 | 42.91 | N |
| ATOM | 3051 | CA | ASP | B | 186 | −39.646 | 10.690 | 126.697 | 1.00 | 37.37 | C |
| ATOM | 3052 | C | ASP | B | 186 | −38.844 | 9.750 | 127.573 | 1.00 | 37.99 | C |
| ATOM | 3053 | O | ASP | B | 186 | −39.192 | 9.506 | 128.736 | 1.00 | 37.79 | O |
| ATOM | 3054 | CB | ASP | B | 186 | −40.512 | 9.876 | 125.739 | 1.00 | 42.26 | C |
| ATOM | 3055 | CG | ASP | B | 186 | −41.589 | 10.703 | 125.065 | 1.00 | 48.82 | C |
| ATOM | 3056 | OD1 | ASP | B | 186 | −42.264 | 11.496 | 125.752 | 1.00 | 49.68 | O |
| ATOM | 3057 | OD2 | ASP | B | 186 | −41.778 | 10.531 | 123.839 | 1.00 | 61.13 | O1− |
| ATOM | 3058 | N | TYR | B | 187 | −37.781 | 9.181 | 127.006 | 1.00 | 41.31 | N |
| ATOM | 3059 | CA | TYR | B | 187 | −36.932 | 8.262 | 127.745 | 1.00 | 37.24 | C |
| ATOM | 3060 | C | TYR | B | 187 | −36.398 | 8.907 | 129.016 | 1.00 | 35.05 | C |
| ATOM | 3061 | O | TYR | B | 187 | −36.349 | 8.272 | 130.075 | 1.00 | 36.76 | O |
| ATOM | 3062 | CB | TYR | B | 187 | −35.786 | 7.785 | 126.852 | 1.00 | 37.33 | C |
| ATOM | 3063 | CG | TYR | B | 187 | −34.823 | 6.915 | 127.604 | 1.00 | 37.18 | C |
| ATOM | 3064 | CD1 | TYR | B | 187 | −35.223 | 5.663 | 128.068 | 1.00 | 34.09 | C |
| ATOM | 3065 | CD2 | TYR | B | 187 | −33.539 | 7.359 | 127.900 | 1.00 | 27.91 | C |
| ATOM | 3066 | CE1 | TYR | B | 187 | −34.363 | 4.870 | 128.780 | 1.00 | 33.76 | C |
| ATOM | 3067 | CE2 | TYR | B | 187 | −32.678 | 6.577 | 128.618 | 1.00 | 30.33 | C |
| ATOM | 3068 | CZ | TYR | B | 187 | −33.090 | 5.328 | 129.058 | 1.00 | 31.48 | C |
| ATOM | 3069 | OH | TYR | B | 187 | −32.233 | 4.528 | 129.785 | 1.00 | 31.99 | O |
| ATOM | 3070 | N | GLU | B | 188 | −35.991 | 10.166 | 128.935 | 1.00 | 39.77 | N |
| ATOM | 3071 | CA | GLU | B | 188 | −35.344 | 10.782 | 130.083 | 1.00 | 44.77 | C |
| ATOM | 3072 | C | GLU | B | 188 | −36.325 | 11.334 | 131.097 | 1.00 | 40.36 | C |
| ATOM | 3073 | O | GLU | B | 188 | −35.879 | 11.832 | 132.131 | 1.00 | 41.81 | O |
| ATOM | 3074 | CB | GLU | B | 188 | −34.358 | 11.849 | 129.625 | 1.00 | 39.20 | C |
| ATOM | 3075 | CG | GLU | B | 188 | −32.978 | 11.224 | 129.620 | 1.00 | 45.15 | C |
| ATOM | 3076 | CD | GLU | B | 188 | −31.974 | 11.914 | 128.723 | 1.00 | 56.05 | C |
| ATOM | 3077 | OE1 | GLU | B | 188 | −32.317 | 12.924 | 128.049 | 1.00 | 48.75 | O |
| ATOM | 3078 | OE2 | GLU | B | 188 | −30.831 | 11.394 | 128.688 | 1.00 | 59.27 | O1− |
| ATOM | 3079 | N | LYS | B | 189 | −37.630 | 11.197 | 130.852 | 1.00 | 37.43 | N |
| ATOM | 3080 | CA | LYS | B | 189 | −38.687 | 11.560 | 131.788 | 1.00 | 38.07 | C |
| ATOM | 3081 | C | LYS | B | 189 | −39.236 | 10.363 | 132.579 | 1.00 | 40.62 | C |
| ATOM | 3082 | O | LYS | B | 189 | −40.315 | 10.465 | 133.167 | 1.00 | 46.60 | O |
| ATOM | 3083 | CB | LYS | B | 189 | −39.813 | 12.270 | 131.030 | 1.00 | 37.89 | C |
| ATOM | 3084 | CG | LYS | B | 189 | −39.327 | 13.568 | 130.380 | 1.00 | 51.23 | C |
| ATOM | 3085 | CD | LYS | B | 189 | −40.333 | 14.215 | 129.404 | 1.00 | 62.14 | C |
| ATOM | 3086 | CE | LYS | B | 189 | −39.717 | 15.470 | 128.720 | 1.00 | 60.71 | C |
| ATOM | 3087 | NZ | LYS | B | 189 | −40.587 | 16.123 | 127.684 | 1.00 | 51.31 | N1+ |
| ATOM | 3088 | N | HIS | B | 190 | −38.541 | 9.223 | 132.588 | 1.00 | 41.83 | N |
| ATOM | 3089 | CA | HIS | B | 190 | −39.025 | 8.026 | 133.271 | 1.00 | 35.94 | C |
| ATOM | 3090 | C | HIS | B | 190 | −37.865 | 7.259 | 133.879 | 1.00 | 35.72 | C |
| ATOM | 3091 | O | HIS | B | 190 | −36.701 | 7.484 | 133.543 | 1.00 | 36.41 | O |
| ATOM | 3092 | CB | HIS | B | 190 | −39.810 | 7.120 | 132.337 | 1.00 | 37.87 | C |
| ATOM | 3093 | CG | HIS | B | 190 | −41.069 | 7.745 | 131.840 | 1.00 | 37.33 | C |
| ATOM | 3094 | ND1 | HIS | B | 190 | −41.173 | 8.323 | 130.596 | 1.00 | 40.44 | N |
| ATOM | 3095 | CD2 | HIS | B | 190 | −42.264 | 7.926 | 132.442 | 1.00 | 37.28 | C |
| ATOM | 3096 | CE1 | HIS | B | 190 | −42.386 | 8.813 | 130.442 | 1.00 | 36.52 | C |
| ATOM | 3097 | NE2 | HIS | B | 190 | −43.068 | 8.583 | 131.548 | 1.00 | 42.61 | N |
| ATOM | 3098 | N | LYS | B | 191 | −38.188 | 6.365 | 134.806 | 1.00 | 32.95 | N |
| ATOM | 3099 | CA | LYS | B | 191 | −37.139 | 5.707 | 135.580 | 1.00 | 44.01 | C |

TABLE 10.4-continued

| | | | | | | | | | | |
|---|---|---|---|---|---|---|---|---|---|---|
| ATOM | 3100 | C | LYS | B | 191 | −37.065 | 4.204 | 135.352 | 1.00 | 37.37 | C |
| ATOM | 3101 | O | LYS | B | 191 | −35.988 | 3.687 | 135.032 | 1.00 | 37.81 | O |
| ATOM | 3102 | CB | LYS | B | 191 | −37.316 | 6.017 | 137.084 | 1.00 | 41.79 | C |
| ATOM | 3103 | CG | LYS | B | 191 | −36.346 | 5.312 | 138.042 | 1.00 | 43.26 | C |
| ATOM | 3104 | CD | LYS | B | 191 | −36.731 | 5.623 | 139.511 | 1.00 | 54.07 | C |
| ATOM | 3105 | CE | LYS | B | 191 | −35.668 | 5.177 | 140.515 | 1.00 | 56.60 | C |
| ATOM | 3106 | NZ | LYS | B | 191 | −36.031 | 5.546 | 141.905 | 1.00 | 51.73 | N1+ |
| ATOM | 3107 | N | VAL | B | 192 | −38.164 | 3.482 | 135.530 | 1.00 | 31.57 | N |
| ATOM | 3108 | CA | VAL | B | 192 | −38.156 | 2.027 | 135.503 | 1.00 | 34.89 | C |
| ATOM | 3109 | C | VAL | B | 192 | −38.596 | 1.564 | 134.126 | 1.00 | 35.04 | C |
| ATOM | 3110 | O | VAL | B | 192 | −39.687 | 1.918 | 133.661 | 1.00 | 35.31 | O |
| ATOM | 3111 | CB | VAL | B | 192 | −39.054 | 1.439 | 136.599 | 1.00 | 34.98 | C |
| ATOM | 3112 | CG1 | VAL | B | 192 | −39.122 | −0.073 | 136.464 | 1.00 | 30.15 | C |
| ATOM | 3113 | CG2 | VAL | B | 192 | −38.522 | 1.842 | 137.965 | 1.00 | 36.73 | C |
| ATOM | 3114 | N | TYR | B | 193 | −37.737 | 0.785 | 133.473 | 1.00 | 36.15 | N |
| ATOM | 3115 | CA | TYR | B | 193 | −38.019 | 0.172 | 132.181 | 1.00 | 35.85 | C |
| ATOM | 3116 | C | TYR | B | 193 | −38.078 | −1.327 | 132.381 | 1.00 | 29.50 | C |
| ATOM | 3117 | O | TYR | B | 193 | −37.178 | −1.898 | 132.995 | 1.00 | 31.86 | O |
| ATOM | 3118 | CB | TYR | B | 193 | −36.958 | 0.576 | 131.150 | 1.00 | 28.31 | C |
| ATOM | 3119 | CG | TYR | B | 193 | −37.137 | 2.020 | 130.781 | 1.00 | 32.21 | C |
| ATOM | 3120 | CD1 | TYR | B | 193 | −36.656 | 3.034 | 131.613 | 1.00 | 34.12 | C |
| ATOM | 3121 | CD2 | TYR | B | 193 | −37.831 | 2.384 | 129.628 | 1.00 | 32.20 | C |
| ATOM | 3122 | CE1 | TYR | B | 193 | −36.859 | 4.366 | 131.313 | 1.00 | 31.90 | C |
| ATOM | 3123 | CE2 | TYR | B | 193 | −38.023 | 3.724 | 129.299 | 1.00 | 38.14 | C |
| ATOM | 3124 | CZ | TYR | B | 193 | −37.536 | 4.707 | 130.163 | 1.00 | 37.14 | C |
| ATOM | 3125 | OH | TYR | B | 193 | −37.717 | 6.025 | 129.872 | 1.00 | 39.52 | O |
| ATOM | 3126 | N | ALA | B | 194 | −39.149 | −1.954 | 131.908 | 1.00 | 28.74 | N |
| ATOM | 3127 | CA | ALA | B | 194 | −39.300 | −3.384 | 132.148 | 1.00 | 34.71 | C |
| ATOM | 3128 | C | ALA | B | 194 | −39.970 | −4.081 | 130.963 | 1.00 | 33.72 | C |
| ATOM | 3129 | O | ALA | B | 194 | −40.748 | −3.479 | 130.211 | 1.00 | 34.66 | O |
| ATOM | 3130 | CB | ALA | B | 194 | −40.083 | −3.634 | 133.442 | 1.00 | 39.91 | C |
| ATOM | 3131 | N | CYS | B | 195 | −39.623 | −5.349 | 130.776 | 1.00 | 32.36 | N |
| ATOM | 3132 | CA | CYS | B | 195 | −40.382 | −6.251 | 139.919 | 1.00 | 37.46 | C |
| ATOM | 3133 | C | CYS | B | 195 | −40.814 | −7.461 | 130.732 | 1.00 | 40.08 | C |
| ATOM | 3134 | O | CYS | B | 195 | −40.045 | −8.000 | 131.544 | 1.00 | 39.11 | O |
| ATOM | 3135 | CB | CYS | B | 195 | −39.615 | −6.703 | 128.639 | 1.00 | 33.36 | C |
| ATOM | 3136 | SG | CYS | B | 195 | −37.984 | −7.394 | 128.903 | 1.00 | 49.70 | S |
| ATOM | 3137 | N | GLU | B | 196 | −42.077 | −7.822 | 130.550 | 1.00 | 36.65 | N |
| ATOM | 3138 | CA | GLU | B | 196 | −42.702 | −8.939 | 131.228 | 1.00 | 37.99 | C |
| ATOM | 3139 | C | GLU | B | 196 | −42.961 | −10.009 | 130.181 | 1.00 | 33.89 | C |
| ATOM | 3140 | O | GLU | B | 196 | −43.502 | −9.711 | 129.111 | 1.00 | 30.27 | O |
| ATOM | 3141 | CB | GLU | B | 196 | −43.986 | −8.481 | 131.926 | 1.00 | 37.34 | C |
| ATOM | 3142 | CG | GLU | B | 196 | −44.748 | −9.548 | 132.707 | 1.00 | 42.18 | C |
| ATOM | 3143 | CD | GLU | B | 196 | −46.068 | −9.008 | 133.278 | 1.00 | 51.19 | C |
| ATOM | 3144 | OE1 | GLU | B | 196 | −46.538 | −7.957 | 132.796 | 1.00 | 55.09 | O |
| ATOM | 3145 | OE2 | GLU | B | 196 | −46.618 | −9.605 | 134.234 | 1.00 | 54.09 | O1− |
| ATOM | 3146 | N | VAL | B | 197 | −42.549 | −11.236 | 130.491 | 1.00 | 33.59 | N |
| ATOM | 3147 | CA | VAL | B | 197 | −42.499 | −12.350 | 129.550 | 1.00 | 28.73 | C |
| ATOM | 3148 | C | VAL | B | 197 | −43.396 | −13.467 | 130.057 | 1.00 | 31.19 | C |
| ATOM | 3149 | O | VAL | B | 197 | −43.137 | −14.053 | 131.117 | 1.00 | 32.63 | O |
| ATOM | 3150 | CB | VAL | B | 197 | −41.057 | −12.851 | 129.355 | 1.00 | 29.79 | C |
| ATOM | 3151 | CG1 | VAL | B | 197 | −41.040 | −14.182 | 128.614 | 1.00 | 27.12 | C |
| ATOM | 3152 | CG2 | VAL | B | 197 | −40.238 | −11.808 | 128.589 | 1.00 | 28.85 | C |
| ATOM | 3153 | N | THR | B | 198 | −44.436 | −13.778 | 129.293 | 1.00 | 32.91 | N |
| ATOM | 3154 | CA | THR | B | 198 | −45.297 | −14.926 | 129.549 | 1.00 | 29.91 | C |
| ATOM | 3155 | C | THR | B | 198 | −45.009 | −16.037 | 128.547 | 1.00 | 32.14 | C |
| ATOM | 3156 | O | THR | B | 198 | −45.017 | −15.808 | 127.328 | 1.00 | 29.74 | O |
| ATOM | 3157 | CB | THR | B | 198 | −46.763 | −14.516 | 129.502 | 1.00 | 29.14 | C |
| ATOM | 3158 | OG1 | THR | B | 198 | −46.977 | −13.539 | 130.518 | 1.00 | 36.91 | O |
| ATOM | 3159 | CG2 | THR | B | 198 | −47.664 | −15.701 | 129.771 | 1.00 | 31.29 | C |
| ATOM | 3160 | N | HIS | B | 199 | −44.758 | −17.237 | 129.066 | 1.00 | 29.27 | N |
| ATOM | 3161 | CA | HIS | B | 199 | −44.464 | −18.393 | 128.233 | 1.00 | 32.48 | C |
| ATOM | 3162 | C | HIS | B | 199 | −44.929 | −19.638 | 128.964 | 1.00 | 34.28 | C |
| ATOM | 3163 | O | HIS | B | 199 | −44.998 | −19.645 | 130.194 | 1.00 | 35.68 | O |
| ATOM | 3164 | CB | HIS | B | 199 | −42.975 | −18.520 | 127.932 | 1.00 | 28.76 | C |
| ATOM | 3165 | CG | HIS | B | 199 | −42.659 | −19.599 | 126.950 | 1.00 | 31.19 | C |
| ATOM | 3166 | ND1 | HIS | B | 199 | −42.284 | −20.867 | 127.331 | 1.00 | 29.79 | N |
| ATOM | 3167 | CD2 | HIS | B | 199 | −42.657 | −19.594 | 125.595 | 1.00 | 31.07 | C |
| ATOM | 3168 | CE1 | HIS | B | 199 | −42.066 | −21.596 | 126.252 | 1.00 | 29.75 | C |
| ATOM | 3169 | NE2 | HIS | B | 199 | −42.280 | −20.845 | 125.185 | 1.00 | 26.47 | N |
| ATOM | 3170 | N | GLN | B | 200 | −45.239 | −20.693 | 128.204 | 1.00 | 28.40 | N |
| ATOM | 3171 | CA | GLN | B | 200 | −45.833 | −21.862 | 128.839 | 1.00 | 28.53 | C |
| ATOM | 3172 | C | GLN | B | 200 | −44.841 | −22.620 | 129.706 | 1.00 | 34.07 | C |
| ATOM | 3173 | O | GLN | B | 200 | −45.270 | −23.425 | 130.535 | 1.00 | 36.20 | O |
| ATOM | 3174 | CB | GLN | B | 200 | −46.471 | −22.791 | 127.805 | 1.00 | 34.90 | C |
| ATOM | 3175 | CG | GLN | B | 200 | −45.638 | −23.987 | 127.362 | 1.00 | 36.70 | C |
| ATOM | 3176 | CD | GLN | B | 200 | −46.492 | −25.092 | 126.712 | 1.00 | 43.78 | C |
| ATOM | 3177 | OE1 | GLN | B | 200 | −46.443 | −26.257 | 127.124 | 1.00 | 43.09 | O |
| ATOM | 3178 | NE2 | GLN | B | 200 | −47.268 | −24.723 | 125.692 | 1.00 | 41.04 | N |
| ATOM | 3179 | N | GLY | B | 201 | −43.538 | −22.378 | 129.558 | 1.00 | 35.51 | N |

TABLE 10.4-continued

| | | | | | | | | | | |
|---|---|---|---|---|---|---|---|---|---|---|
| ATOM | 3180 | CA | GLY | B | 201 | −42.576 | −22.968 | 130.464 | 1.00 | 29.44 | C |
| ATOM | 3181 | C | GLY | B | 201 | −42.338 | −22.163 | 131.720 | 1.00 | 33.22 | C |
| ATOM | 3182 | O | GLY | B | 201 | −41.524 | −22.553 | 132.563 | 1.00 | 33.63 | O |
| ATOM | 3183 | N | LEU | B | 202 | −43.062 | −21.058 | 131.884 | 1.00 | 32.15 | N |
| ATOM | 3184 | CA | LEU | B | 202 | −42.986 | −20.209 | 133.061 | 1.00 | 36.14 | C |
| ATOM | 3185 | C | LEU | B | 202 | −44.298 | −20.336 | 133.808 | 1.00 | 37.68 | C |
| ATOM | 3186 | O | LEU | B | 202 | −45.352 | −20.003 | 133.256 | 1.00 | 37.45 | O |
| ATOM | 3187 | CB | LEU | B | 202 | −42.765 | −18.743 | 132.669 | 1.00 | 36.59 | C |
| ATOM | 3188 | CG | LEU | B | 202 | −41.529 | −18.334 | 131.867 | 1.00 | 27.10 | C |
| ATOM | 3189 | CD1 | LEU | B | 202 | −41.560 | −16.866 | 131.516 | 1.00 | 29.06 | C |
| ATOM | 3190 | CD2 | LEU | B | 202 | −40.313 | −18.626 | 132.669 | 1.00 | 31.65 | C |
| ATOM | 3191 | N | SER | B | 203 | −44.227 | −20.741 | 135.082 | 1.00 | 42.21 | N |
| ATOM | 3192 | CA | SER | B | 203 | −45.444 | −20.866 | 135.880 | 1.00 | 41.93 | C |
| ATOM | 3193 | C | SER | B | 203 | −46.098 | −19.513 | 136.127 | 1.00 | 42.43 | C |
| ATOM | 3194 | O | SER | B | 203 | −47.312 | −19.458 | 136.334 | 1.00 | 41.82 | O |
| ATOM | 3195 | CB | SER | B | 203 | −45.145 | −21.561 | 137.214 | 1.00 | 44.30 | C |
| ATOM | 3196 | OG | SER | B | 203 | −44.114 | −20.886 | 137.919 | 1.00 | 57.08 | O |
| ATOM | 3197 | N | SER | B | 204 | −45.333 | −18.425 | 136.065 | 1.00 | 41.83 | N |
| ATOM | 3198 | CA | SER | B | 204 | −45.886 | −17.077 | 136.094 | 1.00 | 43.80 | C |
| ATOM | 3199 | C | SER | B | 204 | −44.928 | −16.136 | 135.369 | 1.00 | 41.32 | C |
| ATOM | 3200 | O | SER | B | 204 | −43.777 | −16.501 | 135.094 | 1.00 | 39.18 | O |
| ATOM | 3201 | CB | SER | B | 204 | −46.175 | −16.616 | 137.537 | 1.00 | 37.72 | C |
| ATOM | 3202 | OG | SER | B | 204 | −45.011 | −16.540 | 138.333 | 1.00 | 37.17 | O |
| ATOM | 3203 | N | PRO | B | 205 | −45.400 | −14.953 | 134.971 | 1.00 | 34.11 | N |
| ATOM | 3204 | CA | PRO | B | 205 | −44.574 | −14.046 | 134.171 | 1.00 | 33.10 | C |
| ATOM | 3205 | C | PRO | B | 205 | −43.256 | −13.665 | 134.836 | 1.00 | 39.09 | C |
| ATOM | 3206 | O | PRO | B | 205 | −43.148 | −13.550 | 136.053 | 1.00 | 45.40 | O |
| ATOM | 3207 | CB | PRO | B | 205 | −45.475 | −12.821 | 133.999 | 1.00 | 37.31 | C |
| ATOM | 3208 | CG | PRO | B | 205 | −46.835 | −13.372 | 134.001 | 1.00 | 39.03 | C |
| ATOM | 3209 | CD | PRO | B | 205 | −46.817 | −14.553 | 134.944 | 1.00 | 38.32 | C |
| ATOM | 3210 | N | VAL | B | 206 | −42.232 | −13.502 | 134.016 | 1.00 | 34.71 | N |
| ATOM | 3211 | CA | VAL | B | 206 | −40.922 | −13.075 | 134.467 | 1.00 | 35.91 | C |
| ATOM | 3212 | C | VAL | B | 206 | −40.692 | −11.645 | 133.984 | 1.00 | 38.85 | C |
| ATOM | 3213 | O | VAL | B | 206 | −40.938 | −11.328 | 132.811 | 1.00 | 36.12 | O |
| ATOM | 3214 | CB | VAL | B | 206 | −39.836 | −14.036 | 133.951 | 1.00 | 34.83 | C |
| ATOM | 3215 | CG1 | VAL | B | 206 | −38.475 | −13.474 | 134.183 | 1.00 | 32.65 | C |
| ATOM | 3216 | CG2 | VAL | B | 206 | −39.970 | −15.355 | 134.650 | 1.00 | 35.57 | C |
| ATOM | 3217 | N | THR | B | 207 | −40.236 | −10.774 | 134.883 | 1.00 | 38.08 | N |
| ATOM | 3218 | CA | THR | B | 207 | −39.870 | −9.416 | 134.504 | 1.00 | 40.84 | C |
| ATOM | 3219 | C | THR | B | 207 | −38.378 | −9.204 | 134.736 | 1.00 | 39.54 | C |
| ATOM | 3220 | O | THR | B | 207 | −37.836 | −9.618 | 135.761 | 1.00 | 42.64 | O |
| ATOM | 3221 | CB | THR | B | 207 | −40.678 | −8.361 | 135.276 | 1.00 | 37.84 | C |
| ATOM | 3222 | OG1 | THR | B | 207 | −45.077 | −8.538 | 135.017 | 1.00 | 43.59 | O |
| ATOM | 3223 | CG2 | THR | B | 207 | −40.291 | −6.972 | 134.837 | 1.00 | 32.49 | C |
| ATOM | 3224 | N | LYS | B | 208 | −37.715 | −8.590 | 133.762 | 1.00 | 38.06 | N |
| ATOM | 3225 | CA | LYS | B | 208 | −36.376 | −8.048 | 133.928 | 1.00 | 36.13 | C |
| ATOM | 3226 | C | LYS | B | 208 | −36.503 | −6.553 | 133.717 | 1.00 | 30.77 | C |
| ATOM | 3227 | O | LYS | B | 208 | −37.237 | −6.108 | 132.840 | 1.00 | 34.40 | O |
| ATOM | 3228 | CB | LYS | B | 208 | −35.349 | −8.617 | 132.922 | 1.00 | 32.55 | C |
| ATOM | 3229 | CG | LYS | B | 208 | −35.155 | −10.137 | 132.891 | 1.00 | 33.52 | C |
| ATOM | 3230 | CD | LYS | B | 208 | −34.907 | −10.808 | 134.236 | 1.00 | 35.71 | C |
| ATOM | 3231 | CE | LYS | B | 208 | −34.562 | −12.283 | 133.994 | 1.00 | 39.12 | C |
| ATOM | 3232 | NZ | LYS | B | 208 | −34.393 | −13.134 | 135.206 | 1.00 | 41.39 | N1+ |
| ATOM | 3233 | N | SER | B | 209 | −35.841 | −5.768 | 134.543 | 1.00 | 37.37 | N |
| ATOM | 3234 | CA | SER | B | 209 | −36.013 | −4.330 | 134.455 | 1.00 | 33.94 | C |
| ATOM | 3235 | C | SER | B | 209 | −34.700 | −3.653 | 134.776 | 1.00 | 29.43 | C |
| ATOM | 3236 | O | SER | B | 209 | −33.780 | −4.271 | 135.305 | 1.00 | 31.80 | O |
| ATOM | 3237 | CB | SER | B | 209 | −37.096 | −3.848 | 135.420 | 1.00 | 33.21 | C |
| ATOM | 3238 | OG | SER | B | 209 | −36.754 | −4.262 | 136.724 | 1.00 | 35.51 | O |
| ATOM | 3239 | N | PHE | B | 210 | −34.653 | −2.351 | 134.517 | 1.00 | 34.31 | N |
| ATOM | 3240 | CA | PHE | B | 210 | −33.559 | −1.507 | 134.978 | 1.00 | 37.85 | C |
| ATOM | 3241 | C | PHE | B | 210 | −34.108 | −0.121 | 135.302 | 1.00 | 39.37 | C |
| ATOM | 3242 | O | PHE | B | 210 | −35.098 | 0.319 | 134.705 | 1.00 | 33.58 | O |
| ATOM | 3243 | CB | PHE | B | 210 | −32.434 | −1.395 | 133.935 | 1.00 | 26.33 | C |
| ATOM | 3244 | CG | PHE | B | 210 | −32.827 | −0.647 | 132.698 | 1.00 | 33.39 | C |
| ATOM | 3245 | CD1 | PHE | B | 210 | −32.688 | 0.736 | 132.632 | 1.00 | 31.43 | C |
| ATOM | 3246 | CD2 | PHE | B | 210 | −33.342 | −1.321 | 131.597 | 1.00 | 32.75 | C |
| ATOM | 3247 | CE1 | PHE | B | 210 | −33.052 | 1.438 | 131.490 | 1.00 | 35.66 | C |
| ATOM | 3248 | CE2 | PHE | B | 210 | −33.702 | −0.630 | 130.436 | 1.00 | 33.47 | C |
| ATOM | 3249 | CZ | PHE | B | 210 | −33.559 | 0.752 | 130.380 | 1.00 | 34.55 | C |
| ATOM | 3250 | N | ASN | B | 211 | −33.475 | 0.547 | 136.284 | 1.00 | 42.75 | N |
| ATOM | 3251 | CA | ASN | B | 211 | −33.738 | 1.955 | 136.583 | 1.00 | 38.70 | C |
| ATOM | 3252 | C | ASN | B | 211 | −32.818 | 2.832 | 135.752 | 1.00 | 43.04 | C |
| ATOM | 3253 | O | ASN | B | 211 | −31.602 | 2.610 | 135.717 | 1.00 | 39.58 | O |
| ATOM | 3254 | CB | ASN | B | 211 | −33.515 | 2.295 | 138.054 | 1.00 | 48.54 | C |
| ATOM | 3255 | CG | ASN | B | 211 | −34.216 | 1.354 | 138.988 | 1.00 | 51.99 | C |
| ATOM | 3256 | OD1 | ASN | B | 211 | −35.237 | 0.765 | 138.642 | 1.00 | 48.81 | O |
| ATOM | 3257 | ND2 | ASN | B | 211 | −33.672 | 1.208 | 140.193 | 1.00 | 53.46 | N |
| ATOM | 3258 | N | ARG | B | 212 | −33.396 | 3.826 | 135.088 | 1.00 | 42.30 | N |
| ATOM | 3259 | CA | ARG | B | 212 | −32.585 | 4.725 | 134.279 | 1.00 | 44.00 | C |

TABLE 10.4-continued

| ATOM | 3260 | C | ARG | B | 212 | −31.547 | 5.416 | 135.166 | 1.00 | 53.42 | C |
|---|---|---|---|---|---|---|---|---|---|---|---|
| ATOM | 3261 | O | ARG | B | 212 | −31.838 | 5.807 | 136.304 | 1.00 | 49.38 | O |
| ATOM | 3262 | CB | ARG | B | 212 | −33.478 | 5.748 | 133.579 | 1.00 | 35.08 | C |
| ATOM | 3263 | CG | ARG | B | 212 | −32.768 | 6.567 | 132.543 | 1.00 | 35.57 | C |
| ATOM | 3264 | CD | ARG | B | 212 | −33.745 | 7.458 | 131.855 | 1.00 | 39.63 | C |
| ATOM | 3265 | NE | ARG | B | 212 | −34.383 | 8.298 | 132.850 | 1.00 | 48.56 | N |
| ATOM | 3266 | CZ | ARG | B | 212 | −33.927 | 9.489 | 133.210 | 1.00 | 47.89 | C |
| ATOM | 3267 | NH1 | ARG | B | 212 | −32.853 | 9.988 | 132.617 | 1.00 | 49.63 | N1+ |
| ATOM | 3268 | NH2 | ARG | B | 212 | −34.554 | 10.182 | 134.150 | 1.00 | 49.80 | N |
| ATOM | 3269 | N | GLY | B | 213 | −30.313 | 5.513 | 134.660 | 1.00 | 57.27 | N |
| ATOM | 3270 | CA | GLY | B | 213 | −29.233 | 6.174 | 135.372 | 1.00 | 56.62 | C |
| ATOM | 3271 | C | GLY | B | 213 | −28.594 | 5.389 | 136.502 | 1.00 | 64.15 | C |
| ATOM | 3272 | O | GLY | B | 213 | −27.852 | 5.979 | 137.297 | 1.00 | 72.50 | O |
| ATOM | 3273 | N | GLU | B | 214 | −28.872 | 4.093 | 136.624 | 1.00 | 62.54 | N |
| ATOM | 3274 | CA | GLU | B | 214 | −28.300 | 3.285 | 137.703 | 1.00 | 62.11 | C |
| ATOM | 3275 | C | GLU | B | 214 | −27.713 | 1.996 | 137.157 | 1.00 | 59.03 | C |
| ATOM | 3276 | O | GLU | B | 214 | −26.518 | 1.940 | 136.863 | 1.00 | 63.86 | O |
| ATOM | 3277 | N | GLU | B | 214 | −29.353 | 3.001 | 138.781 | 1.00 | 51.33 | C |
| ATOM | 3278 | CA | GLU | B | 214 | −29.912 | 4.302 | 139.342 | 1.00 | 61.22 | C |
| ATOM | 3279 | CD | GLU | B | 214 | −31.228 | 4.170 | 140.105 | 1.00 | 66.11 | C |
| ATOM | 3280 | OE1 | GLU | B | 214 | −31.496 | 3.123 | 140.751 | 1.00 | 61.27 | O |
| ATOM | 3281 | OE2 | GLU | B | 214 | −32.004 | 5.152 | 140.044 | 1.00 | 64.67 | O1− |
| TER | | | | | | | | | | | |
| ATOM | 3282 | N | GLN | C | 1 | −37.672 | −36.358 | 87.095 | 1.00 | 48.43 | N |
| ATOM | 3283 | CA | GLN | C | 1 | −37.796 | −35.842 | 85.733 | 1.00 | 53.92 | C |
| ATOM | 3284 | C | GLN | C | 1 | −36.907 | −36.762 | 84.921 | 1.00 | 48.53 | C |
| ATOM | 3285 | O | GLN | C | 1 | −37.375 | −37.531 | 84.085 | 1.00 | 49.71 | O |
| ATOM | 3286 | CB | GLN | C | 1 | −37.335 | −34.383 | 85.628 | 1.00 | 47.24 | C |
| ATOM | 3287 | CG | GLN | C | 1 | −37.925 | −33.494 | 86.693 | 1.00 | 41.90 | C |
| ATOM | 3288 | CD | GLN | C | 1 | −37.270 | −33.771 | 88.072 | 1.00 | 54.37 | C |
| ATOM | 3289 | OE1 | GLN | C | 1 | −37.245 | −34.914 | 88.549 | 1.00 | 44.69 | O |
| ATOM | 3290 | NE2 | GLN | C | 1 | −36.710 | −32.731 | 88.690 | 1.00 | 59.79 | N |
| ATOM | 3291 | N | VAL | C | 2 | −35.614 | −36.686 | 85.222 | 1.00 | 51.69 | N |
| ATOM | 3292 | CA | VAL | C | 2 | −34.607 | −37.545 | 84.617 | 1.00 | 47.55 | C |
| ATOM | 3293 | C | VAL | C | 2 | −34.423 | −38.731 | 85.545 | 1.00 | 47.63 | C |
| ATOM | 3294 | O | VAL | C | 2 | −33.898 | −38.581 | 86.647 | 1.00 | 46.25 | O |
| ATOM | 3295 | CB | VAL | C | 2 | −33.299 | −36.782 | 84.412 | 1.00 | 42.21 | C |
| ATOM | 3296 | CG1 | VAL | C | 2 | −32.374 | −37.549 | 83.497 | 1.00 | 38.77 | C |
| ATOM | 3297 | CG2 | VAL | C | 2 | −33.625 | −35.409 | 83.861 | 1.00 | 38.63 | C |
| ATOM | 3298 | N | GLN | C | 3 | −34.870 | −39.908 | 85.122 | 1.00 | 44.76 | N |
| ATOM | 3299 | CA | GLN | C | 3 | −34.623 | −41.114 | 85.894 | 1.00 | 46.20 | C |
| ATOM | 3300 | C | GLN | C | 3 | −33.571 | −41.955 | 85.194 | 1.00 | 38.10 | C |
| ATOM | 3301 | O | GLN | C | 3 | −33.475 | −41.955 | 83.965 | 1.00 | 39.47 | O |
| ATOM | 3302 | CB | GLN | C | 3 | −35.902 | −41.931 | 86.152 | 1.00 | 46.17 | C |
| ATOM | 3303 | CG | GLN | C | 3 | −36.857 | −42.057 | 84.981 | 1.00 | 54.72 | C |
| ATOM | 3304 | CD | GLN | C | 3 | −37.939 | −40.974 | 84.954 | 1.00 | 59.64 | C |
| ATOM | 3305 | OE1 | GLN | C | 3 | −38.022 | −40.180 | 83.996 | 1.00 | 55.09 | O |
| ATOM | 3306 | NE2 | GLN | C | 3 | −38.794 | −40.952 | 85.996 | 1.00 | 49.26 | N |
| ATOM | 3307 | N | LEU | C | 4 | −32.728 | −42.584 | 85.993 | 1.00 | 36.10 | N |
| ATOM | 3308 | CA | LEU | C | 4 | −31.834 | −43.639 | 85.548 | 1.00 | 36.24 | C |
| ATOM | 3309 | C | LEU | C | 4 | −32.349 | −44.892 | 86.234 | 1.00 | 38.70 | C |
| ATOM | 3310 | O | LEU | C | 4 | −32.006 | −45.155 | 87.383 | 1.00 | 41.03 | O |
| ATOM | 3311 | CB | LEU | C | 4 | −30.377 | −43.351 | 85.916 | 1.00 | 31.18 | C |
| ATOM | 3312 | CG | LEU | C | 4 | −29.695 | −42.051 | 85.479 | 1.00 | 32.11 | C |
| ATOM | 3313 | CD1 | LEU | C | 4 | −28.199 | −42.201 | 85.552 | 1.00 | 34.48 | C |
| ATOM | 3314 | CD2 | LEU | C | 4 | −30.085 | −41.672 | 84.084 | 1.00 | 36.90 | C |
| ATOM | 3315 | N | GLN | C | 5 | −33.149 | −45.677 | 85.525 | 1.00 | 44.15 | N |
| ATOM | 3316 | CA | GLN | C | 5 | −33.773 | −46.856 | 86.108 | 1.00 | 45.12 | C |
| ATOM | 3317 | C | GLN | C | 5 | −32.880 | −48.063 | 85.887 | 1.00 | 41.78 | C |
| ATOM | 3318 | O | GLN | C | 5 | −32.475 | −48.340 | 84.755 | 1.00 | 41.54 | O |
| ATOM | 3319 | CB | GLN | C | 5 | −35.152 | −47.084 | 85.489 | 1.00 | 49.54 | C |
| ATOM | 3320 | CG | GLN | C | 5 | −35.943 | −48.256 | 86.071 | 1.00 | 56.47 | C |
| ATOM | 3321 | CD | GLN | C | 5 | −37.440 | −48.116 | 85.797 | 1.00 | 74.65 | C |
| ATOM | 3322 | OE1 | GLN | C | 5 | −37.935 | −47.009 | 85.533 | 1.00 | 74.08 | O |
| ATOM | 3323 | NE2 | GLN | C | 5 | −38.166 | −49.236 | 85.850 | 1.00 | 70.76 | N |
| ATOM | 3324 | N | GLN | C | 6 | −32.592 | −48.786 | 86.963 | 1.00 | 36.00 | N |
| ATOM | 3325 | CA | GLN | C | 6 | −31.668 | −49.905 | 86.917 | 1.00 | 37.25 | C |
| ATOM | 3326 | C | GLN | C | 6 | −32.432 | −51.207 | 87.049 | 1.00 | 40.30 | C |
| ATOM | 3327 | O | GLN | C | 6 | −33.416 | −51.281 | 87.787 | 1.00 | 48.42 | O |
| ATOM | 3328 | CB | GLN | C | 6 | −30.617 | −49.841 | 88.032 | 1.00 | 37.59 | C |
| ATOM | 3329 | CG | GLN | C | 6 | −29.875 | −48.541 | 88.142 | 1.00 | 40.04 | C |
| ATOM | 3330 | CD | GLN | C | 6 | −28.646 | −48.621 | 89.041 | 1.00 | 38.65 | C |
| ATOM | 3331 | OE1 | GLN | C | 6 | −28.173 | −47.599 | 89.535 | 1.00 | 36.68 | O |
| ATOM | 3332 | NE2 | GLN | C | 6 | −28.111 | −49.834 | 89.239 | 1.00 | 31.43 | N |
| ATOM | 3333 | N | TRP | C | 7 | −31.969 | −52.228 | 86.334 | 1.00 | 36.46 | N |
| ATOM | 3334 | CA | TRP | C | 7 | −32.424 | −53.585 | 86.573 | 1.00 | 39.72 | C |
| ATOM | 3335 | C | TRP | C | 7 | −31.284 | −54.527 | 86.258 | 1.00 | 37.13 | C |
| ATOM | 3336 | O | TRP | C | 7 | −30.252 | −54.125 | 85.709 | 1.00 | 36.52 | O |
| ATOM | 3337 | CB | TRP | C | 7 | −33.669 | −53.937 | 85.756 | 1.00 | 36.24 | C |
| ATOM | 3338 | CG | TRP | C | 7 | −33.515 | −53.880 | 84.294 | 1.00 | 38.80 | C |

TABLE 10.4-continued

| | | | | | | | | | | |
|---|---|---|---|---|---|---|---|---|---|---|
| ATOM | 3339 | CD1 | TRP | C | 7 | −33.103 | −54.893 | 83.464 | 1.00 | 37.72 | C |
| ATOM | 3340 | CD2 | TRP | C | 7 | −33.812 | −52.760 | 83.446 | 1.00 | 41.40 | C |
| ATOM | 3341 | NE1 | TRP | C | 7 | −33.111 | −54.462 | 82.153 | 1.00 | 39.38 | N |
| ATOM | 3342 | CE2 | TRP | C | 7 | −33.544 | −53.159 | 82.113 | 1.00 | 39.28 | C |
| ATOM | 3343 | CE3 | TRP | C | 7 | −34.270 | −51.460 | 83.683 | 1.00 | 41.24 | C |
| ATOM | 3344 | CZ2 | TRP | C | 7 | −33.713 | −52.298 | 81.022 | 1.00 | 37.17 | C |
| ATOM | 3345 | CZ3 | TRP | C | 7 | −34.443 | −50.603 | 82.589 | 1.00 | 42.48 | C |
| ATOM | 3346 | CH2 | TRP | C | 7 | −34.164 | −51.032 | 81.278 | 1.00 | 38.07 | C |
| ATOM | 3347 | N | GLY | C | 8 | −31.479 | −55.779 | 86.640 | 1.00 | 30.53 | N |
| ATOM | 3348 | CZ | GLY | C | 8 | −30.480 | −56.819 | 86.491 | 1.00 | 29.00 | C |
| ATOM | 3349 | C | GLY | C | 8 | −30.542 | −57.704 | 87.715 | 1.00 | 28.80 | C |
| ATOM | 3350 | O | GLY | C | 8 | −30.936 | −57.284 | 88.802 | 1.00 | 35.52 | O |
| ATOM | 3351 | N | ALA | C | 9 | −30.175 | −58.964 | 87.536 | 1.00 | 31.95 | N |
| ATOM | 3352 | CA | ALA | C | 9 | −30.163 | −59.902 | 88.650 | 1.00 | 36.64 | C |
| ATOM | 3353 | C | ALA | C | 9 | −29.108 | −59.490 | 89.672 | 1.00 | 40.72 | C |
| ATOM | 3354 | O | ALA | C | 9 | −27.936 | −59.312 | 89.329 | 1.00 | 44.07 | O |
| ATOM | 3355 | CB | ALA | C | 9 | −29.893 | −61.324 | 88.152 | 1.00 | 32.88 | C |
| ATOM | 3356 | N | GLY | C | 10 | −29.528 | −59.350 | 90.927 | 1.00 | 40.53 | N |
| ATOM | 3357 | CA | GLY | C | 10 | −28.651 | −58.938 | 92.001 | 1.00 | 34.92 | C |
| ATOM | 3358 | C | GLY | C | 10 | −28.135 | −60.045 | 92.894 | 1.00 | 32.59 | C |
| ATOM | 3359 | O | GLY | C | 10 | −27.259 | −59.787 | 93.722 | 1.00 | 37.26 | O |
| ATOM | 3360 | N | LEU | C | 11 | −28.643 | −61.269 | 92.760 | 1.00 | 33.32 | N |
| ATOM | 3361 | CA | LEU | C | 11 | −28.155 | −62.401 | 93.550 | 1.00 | 35.63 | C |
| ATOM | 3362 | C | LEU | C | 11 | −27.388 | −63.330 | 92.625 | 1.00 | 37.18 | C |
| ATOM | 3363 | O | LEU | C | 11 | −27.945 | −63.835 | 91.641 | 1.00 | 40.37 | O |
| ATOM | 3364 | CB | LEU | C | 11 | −29.292 | −63.162 | 94.238 | 1.00 | 33.21 | C |
| ATOM | 3365 | CG | LEU | C | 11 | −29.045 | −63.745 | 95.639 | 1.00 | 35.68 | C |
| ATOM | 3366 | CD1 | LEU | C | 11 | −29.828 | −65.026 | 95.836 | 1.00 | 37.14 | C |
| ATOM | 3367 | CD2 | LEU | C | 11 | −27.589 | −63.991 | 95.974 | 1.00 | 34.37 | C |
| ATOM | 3368 | N | LEU | C | 12 | −26.125 | −63.573 | 92.957 | 1.00 | 33.96 | N |
| ATOM | 3369 | CA | LEU | C | 12 | −25.238 | −64.365 | 92.126 | 1.00 | 37.97 | C |
| ATOM | 3370 | C | LEU | C | 12 | −24.363 | −65.240 | 93.002 | 1.00 | 35.65 | C |
| ATOM | 3371 | O | LEU | C | 12 | −24.068 | −64.894 | 94.147 | 1.00 | 36.30 | O |
| ATOM | 3372 | CB | LEU | C | 12 | −24.331 | −63.494 | 91.246 | 1.00 | 34.37 | C |
| ATOM | 3373 | CG | LEU | C | 12 | −24.960 | −62.530 | 90.262 | 1.00 | 37.66 | C |
| ATOM | 3374 | CD1 | LEU | C | 12 | −23.856 | −61.733 | 89.638 | 1.00 | 43.23 | C |
| ATOM | 3375 | CD2 | LEU | C | 12 | −25.713 | −63.294 | 89.190 | 1.00 | 44.30 | C |
| ATOM | 3376 | N | LYS | C | 13 | −23.932 | −66.390 | 92.428 | 1.00 | 36.66 | N |
| ATOM | 3377 | CA | LYS | C | 13 | −22.957 | −67.321 | 92.963 | 1.00 | 38.43 | C |
| ATOM | 3378 | C | LYS | C | 13 | −21.606 | −67.082 | 92.306 | 1.00 | 39.27 | C |
| ATOM | 3379 | O | LYS | C | 13 | −21.543 | −66.620 | 91.160 | 1.00 | 39.31 | O |
| ATOM | 3380 | CB | LYS | C | 13 | −23.391 | −68.766 | 92.715 | 1.00 | 36.21 | C |
| ATOM | 3381 | CG | LYS | C | 13 | −24.872 | −68.896 | 92.517 | 1.00 | 42.22 | C |
| ATOM | 3382 | CD | LYS | C | 13 | −25.398 | −70.074 | 93.270 | 1.00 | 45.83 | C |
| ATOM | 3383 | CE | LYS | C | 13 | −25.107 | −69.921 | 94.743 | 1.00 | 45.08 | C |
| ATOM | 3384 | NZ | LYS | C | 13 | −25.676 | −71.073 | 95.499 | 1.00 | 49.42 | N1+ |
| ATOM | 3385 | N | PRO | C | 14 | −20.517 | −67.383 | 93.016 | 1.00 | 33.06 | N |
| ATOM | 3386 | CA | PRO | C | 14 | −19.180 | −67.135 | 92.464 | 1.00 | 31.17 | C |
| ATOM | 3387 | C | PRO | C | 14 | −19.019 | −67.705 | 91.063 | 1.00 | 35.18 | C |
| ATOM | 3388 | O | PRO | C | 14 | −19.621 | −68.717 | 90.712 | 1.00 | 37.79 | O |
| ATOM | 3389 | CB | PRO | C | 14 | −18.258 | −67.830 | 93.463 | 1.00 | 24.90 | C |
| ATOM | 3390 | CG | PRO | C | 14 | −19.016 | −67.795 | 94.737 | 1.00 | 29.59 | C |
| ATOM | 3391 | CD | PRO | C | 14 | −20.461 | −67.876 | 94.405 | 1.00 | 27.79 | C |
| ATOM | 3392 | N | SER | C | 15 | −18.235 | −66.995 | 90.251 | 1.00 | 38.99 | N |
| ATOM | 3393 | CA | SER | C | 15 | −17.811 | −67.278 | 88.882 | 1.00 | 33.18 | C |
| ATOM | 3394 | C | SER | C | 15 | −18.911 | −66.976 | 87.855 | 1.00 | 35.06 | C |
| ATOM | 3395 | O | SER | C | 15 | −18.601 | −66.892 | 86.661 | 1.00 | 34.68 | O |
| ATOM | 3396 | CB | SER | C | 15 | −17.276 | −68.717 | 88.689 | 1.00 | 35.00 | C |
| ATOM | 3397 | OG | SER | C | 15 | −18.279 | −69.665 | 88.363 | 1.00 | 36.60 | O |
| ATOM | 3398 | N | GLU | C | 16 | −20.172 | −66.781 | 88.266 | 1.00 | 33.98 | N |
| ATOM | 3399 | CA | GLU | C | 16 | −21.187 | −66.305 | 87.322 | 1.00 | 35.39 | C |
| ATOM | 3400 | C | GLU | C | 16 | −20.811 | −64.890 | 86.852 | 1.00 | 35.84 | C |
| ATOM | 3401 | O | GLU | C | 16 | −19.841 | −64.279 | 87.324 | 1.00 | 35.76 | O |
| ATOM | 3402 | CB | GLU | C | 16 | −22.590 | −66.308 | 87.953 | 1.00 | 33.60 | C |
| ATOM | 3403 | CG | GLU | C | 16 | −22.982 | −67.595 | 88.701 | 1.00 | 38.40 | C |
| ATOM | 3404 | CD | GLU | C | 16 | −24.487 | −67.720 | 89.061 | 1.00 | 49.48 | C |
| ATOM | 3405 | OE1 | GLU | C | 16 | −25.199 | −66.698 | 89.225 | 1.00 | 50.75 | O |
| ATOM | 3406 | OE2 | GLU | C | 16 | −24.950 | −68.866 | 89.261 | 1.00 | 51.03 | O1− |
| ATOM | 3407 | N | THR | C | 17 | −21.570 | −64.359 | 85.905 | 1.00 | 32.01 | N |
| ATOM | 3408 | CA | THR | C | 17 | −21.301 | −63.010 | 85.451 | 1.00 | 32.01 | C |
| ATOM | 3409 | C | THR | C | 17 | −22.463 | −62.094 | 85.818 | 1.00 | 39.55 | C |
| ATOM | 3410 | O | THR | C | 17 | −23.637 | −62.460 | 85.685 | 1.00 | 36.43 | O |
| ATOM | 3411 | CB | THR | C | 17 | −20.978 | −62.950 | 83.939 | 1.00 | 34.07 | C |
| ATOM | 3412 | OG1 | THR | C | 17 | −21.956 | −62.180 | 83.230 | 1.00 | 39.64 | O |
| ATOM | 3413 | CG2 | THR | C | 17 | −20.841 | −64.327 | 83.325 | 1.00 | 35.94 | C |
| ATOM | 3414 | N | LEU | C | 18 | −22.109 | −60.901 | 86.295 | 1.00 | 37.34 | N |
| ATOM | 3415 | CA | LEU | C | 18 | −23.065 | −59.889 | 86.703 | 1.00 | 30.52 | C |
| ATOM | 3416 | C | LEU | C | 18 | −23.481 | −59.095 | 85.476 | 1.00 | 34.01 | C |
| ATOM | 3417 | O | LEU | C | 18 | −22.639 | −58.717 | 84.651 | 1.00 | 35.55 | O |
| ATOM | 3418 | CB | LEU | C | 18 | −22.437 | −59.006 | 87.782 | 1.00 | 29.47 | C |

TABLE 10.4-continued

| | | | | | | | | | | |
|---|---|---|---|---|---|---|---|---|---|---|
| ATOM | 3419 | CG | LEU | C | 18 | −22.993 | −57.708 | 88.384 | 1.00 | 35.82 | C |
| ATOM | 3420 | CD1 | LEU | C | 18 | −22.732 | −56.524 | 87.491 | 1.00 | 32.88 | C |
| ATOM | 3421 | CD2 | LEU | C | 18 | −24.488 | −57.846 | 88.679 | 1.00 | 31.62 | C |
| ATOM | 3422 | N | SER | C | 19 | −24.783 | −58.870 | 85.340 | 1.00 | 31.00 | N |
| ATOM | 3423 | CA | SER | C | 19 | −25.301 | −58.146 | 84.187 | 1.00 | 36.91 | C |
| ATOM | 3424 | C | SER | C | 19 | −26.378 | −57.173 | 84.657 | 1.00 | 32.12 | C |
| ATOM | 3425 | O | SER | C | 19 | −27.371 | −57.593 | 85.262 | 1.00 | 30.22 | O |
| ATOM | 3426 | CB | SER | C | 19 | −25.835 | −59.143 | 83.141 | 1.00 | 33.82 | C |
| ATOM | 3427 | OG | SER | C | 19 | −26.265 | −58.506 | 81.963 | 1.00 | 42.48 | O |
| ATOM | 3428 | N | LEU | C | 20 | −26.175 | −55.877 | 84.364 | 1.00 | 30.42 | N |
| ATOM | 3429 | CA | LEU | C | 20 | −27.041 | −54.785 | 84.804 | 1.00 | 30.56 | C |
| ATOM | 3430 | C | LEU | C | 20 | −27.300 | −53.840 | 83.643 | 1.00 | 29.54 | C |
| ATOM | 3431 | O | LEU | C | 20 | −26.430 | −53.618 | 82.801 | 1.00 | 31.80 | O |
| ATOM | 3432 | CB | LEU | C | 20 | −26.416 | −53.973 | 85.970 | 1.00 | 25.88 | C |
| ATOM | 3433 | CG | LEU | C | 20 | −26.042 | −54.745 | 87.243 | 1.00 | 27.95 | C |
| ATOM | 3434 | CD1 | LEU | C | 20 | −25.312 | −53.866 | 88.232 | 1.00 | 25.17 | C |
| ATOM | 3435 | CD2 | LEU | C | 20 | −27.288 | −55.391 | 87.897 | 1.00 | 28.86 | C |
| ATOM | 3436 | N | THR | C | 21 | −28.479 | −53.236 | 83.636 | 1.00 | 29.19 | N |
| ATOM | 3437 | CA | THR | C | 21 | −28.844 | −52.262 | 82.616 | 1.00 | 32.34 | C |
| ATOM | 3438 | C | THR | C | 21 | −29.444 | −51.043 | 83.297 | 1.00 | 33.93 | C |
| ATOM | 3439 | O | THR | C | 21 | −30.059 | −51.155 | 84.360 | 1.00 | 41.09 | O |
| ATOM | 3440 | CB | THR | C | 21 | −29.833 | −52.839 | 81.576 | 1.00 | 32.67 | C |
| ATOM | 3441 | OG1 | THR | C | 21 | −29.282 | −54.034 | 81.016 | 1.00 | 29.98 | O |
| ATOM | 3442 | CG2 | THR | C | 21 | −30.116 | −51.832 | 80.457 | 1.00 | 28.76 | C |
| ATOM | 3443 | N | CYS | C | 22 | −29.221 | −49.880 | 82.686 | 1.00 | 28.26 | N |
| ATOM | 3444 | CA | CYS | C | 22 | −29.766 | −48.596 | 83.090 | 1.00 | 26.22 | C |
| ATOM | 3445 | C | CYS | C | 22 | −30.582 | −48.024 | 81.939 | 1.00 | 35.11 | C |
| ATOM | 3446 | O | CYS | C | 22 | −30.119 | −48.022 | 80.794 | 1.00 | 35.88 | O |
| ATOM | 3447 | CB | CYS | C | 22 | −28.601 | −47.671 | 83.441 | 1.00 | 34.45 | C |
| ATOM | 3448 | SG | CYS | C | 22 | −28.863 | −46.199 | 84.443 | 1.00 | 53.91 | S |
| ATOM | 3449 | N | ALA | C | 23 | −31.786 | −47.526 | 82.223 | 1.00 | 41.07 | N |
| ATOM | 3450 | CA | ALA | C | 23 | −32.593 | −46.849 | 81.211 | 1.00 | 32.31 | C |
| ATOM | 3451 | C | ALA | C | 23 | −32.715 | −45.377 | 81.565 | 1.00 | 38.18 | C |
| ATOM | 3452 | O | ALA | C | 23 | −33.077 | −45.034 | 82.693 | 1.00 | 40.40 | O |
| ATOM | 3453 | CB | ALA | C | 23 | −33.971 | −47.489 | 81.072 | 1.00 | 31.29 | C |
| ATOM | 3454 | N | VAL | C | 24 | −32.419 | −44.515 | 80.601 | 1.00 | 37.14 | N |
| ATOM | 3455 | CA | VAL | C | 24 | −32.433 | −43.067 | 80.777 | 1.00 | 34.17 | C |
| ATOM | 3456 | C | VAL | C | 24 | −33.726 | −42.531 | 80.183 | 1.00 | 39.79 | C |
| ATOM | 3457 | O | VAL | C | 24 | −34.063 | −42.841 | 79.033 | 1.00 | 44.85 | O |
| ATOM | 3458 | CB | VAL | C | 24 | −31.202 | −42.429 | 80.111 | 1.00 | 35.68 | C |
| ATOM | 3459 | CG1 | VAL | C | 24 | −31.194 | −40.927 | 80.274 | 1.00 | 33.16 | C |
| ATOM | 3460 | CG2 | VAL | C | 24 | −29.937 | −43.034 | 80.689 | 1.00 | 35.47 | C |
| ATOM | 3461 | N | SER | C | 25 | −34.433 | −41.694 | 80.936 | 1.00 | 40.19 | N |
| ATOM | 3462 | CA | SER | C | 25 | −35.722 | −41.217 | 80.453 | 1.00 | 37.50 | C |
| ATOM | 3463 | C | SER | C | 25 | −35.843 | −39.707 | 80.355 | 1.00 | 46.83 | C |
| ATOM | 3464 | O | SER | C | 25 | −36.323 | −39.206 | 79.339 | 1.00 | 56.63 | O |
| ATOM | 3465 | CB | SER | C | 25 | −36.842 | −41.735 | 81.372 | 1.00 | 39.57 | C |
| ATOM | 3466 | OG | SER | C | 25 | −36.448 | −42.914 | 82.077 | 1.00 | 44.46 | O |
| ATOM | 3467 | N | GLY | C | 26 | −35.362 | −38.958 | 81.342 | 1.00 | 46.38 | N |
| ATOM | 3468 | CA | GLY | C | 26 | −35.703 | −37.542 | 81.413 | 1.00 | 45.90 | C |
| ATOM | 3469 | C | GLY | C | 26 | −35.175 | −36.666 | 80.290 | 1.00 | 45.91 | C |
| ATOM | 3470 | O | GLY | C | 26 | −35.926 | −35.873 | 79.720 | 1.00 | 50.30 | O |
| ATOM | 3471 | N | GLY | C | 27 | −33.881 | −36.752 | 79.983 | 1.00 | 41.90 | N |
| ATOM | 3472 | CA | GLY | C | 27 | −33.299 | −35.764 | 79.082 | 1.00 | 33.59 | C |
| ATOM | 3473 | C | GLY | C | 27 | −32.626 | −36.313 | 77.847 | 1.00 | 35.39 | C |
| ATOM | 3474 | O | GLY | C | 27 | −33.065 | −37.324 | 77.298 | 1.00 | 41.91 | O |
| ATOM | 3475 | N | SER | C | 28 | −31.574 | −35.646 | 77.382 | 1.00 | 41.18 | N |
| ATOM | 3476 | CA | SER | C | 28 | −30.856 | −36.113 | 76.204 | 1.00 | 38.29 | C |
| ATOM | 3477 | C | SER | C | 28 | −29.975 | −37.312 | 76.538 | 1.00 | 36.07 | C |
| ATOM | 3478 | O | SER | C | 28 | −29.631 | −37.575 | 77.693 | 1.00 | 37.41 | O |
| ATOM | 3479 | CB | SER | C | 28 | −29.983 | −35.007 | 75.609 | 1.00 | 38.36 | C |
| ATOM | 3480 | OG | SER | C | 28 | −30.761 | −33.920 | 75.126 | 1.00 | 40.67 | O |
| ATOM | 3481 | N | PHE | C | 29 | −29.605 | −38.042 | 75.494 | 1.00 | 36.60 | N |
| ATOM | 3482 | CA | PHE | C | 29 | −28.717 | −39.178 | 75.630 | 1.00 | 36.41 | C |
| ATOM | 3483 | C | PHE | C | 29 | −27.350 | −38.932 | 75.015 | 1.00 | 41.79 | C |
| ATOM | 3484 | O | PHE | C | 29 | −26.408 | −39.669 | 75.329 | 1.00 | 42.57 | O |
| ATOM | 3485 | CB | PHE | C | 29 | −29.357 | −40.414 | 74.999 | 1.00 | 29.89 | C |
| ATOM | 3486 | CG | PHE | C | 29 | −28.843 | −41.712 | 75.541 | 1.00 | 31.96 | C |
| ATOM | 3487 | CD1 | PHE | C | 29 | −28.786 | −41.939 | 76.912 | 1.00 | 37.24 | C |
| ATOM | 3488 | CD2 | PHE | C | 29 | −28.466 | −42.735 | 74.682 | 1.00 | 32.71 | C |
| ATOM | 3489 | CE1 | PHE | C | 29 | −28.325 | −43.161 | 77.428 | 1.00 | 31.78 | C |
| ATOM | 3490 | CE2 | PHE | C | 29 | −28.010 | −43.953 | 75.182 | 1.00 | 32.65 | C |
| ATOM | 3491 | CZ | PHE | C | 29 | −27.946 | −44.167 | 76.558 | 1.00 | 31.78 | C |
| ATOM | 3492 | N | ARG | C | 30 | −27.207 | −37.893 | 74.190 | 1.00 | 36.62 | N |
| ATOM | 3493 | CA | ARG | C | 30 | −26.097 | −37.790 | 73.261 | 1.00 | 40.24 | C |
| ATOM | 3494 | C | ARG | C | 30 | −24.969 | −36.896 | 73.757 | 1.00 | 41.65 | C |
| ATOM | 3495 | O | ARG | C | 30 | −23.861 | −36.972 | 73.223 | 1.00 | 37.36 | O |
| ATOM | 3496 | CB | ARG | C | 30 | −26.601 | −37.249 | 71.922 | 1.00 | 37.58 | C |
| ATOM | 3497 | CG | ARG | C | 30 | −27.046 | −35.805 | 72.068 | 1.00 | 51.10 | C |
| ATOM | 3498 | CD | ARG | C | 30 | −27.335 | −35.130 | 70.748 | 1.00 | 52.17 | C |

TABLE 10.4-continued

| ATOM | 3499 | NE | ARG | C | 30 | −28.733 | −35.284 | 70.381 | 1.00 | 58.44 | N |
|------|------|----|-----|---|----|---------|---------|--------|------|-------|---|
| ATOM | 3500 | VZ | ARG | C | 30 | −29.297 | −34.695 | 69.334 | 1.00 | 65.83 | C |
| ATOM | 3501 | NH1 | ARG | C | 30 | −30.583 | −34.897 | 69.073 | 1.00 | 66.12 | N1+ |
| ATOM | 3502 | NH2 | ARG | C | 30 | −28.575 | −33.907 | 68.548 | 1.00 | 74.46 | N |
| ATOM | 3503 | N | TYR | C | 31 | −25.210 | −36.062 | 74.758 | 1.00 | 44.38 | N |
| ATOM | 3504 | CA | TYR | C | 31 | −24.179 | −35.148 | 75.227 | 1.00 | 38.68 | C |
| ATOM | 3505 | C | TYR | C | 31 | −23.376 | −35.702 | 76.382 | 1.00 | 38.31 | C |
| ATOM | 3506 | O | TYR | C | 31 | −22.476 | −35.022 | 76.876 | 1.00 | 37.88 | O |
| ATOM | 3507 | CB | TYR | C | 31 | −24.791 | −33.816 | 75.660 | 1.00 | 39.97 | C |
| ATOM | 3508 | CG | TYR | C | 31 | −25.693 | −33.157 | 74.646 | 1.00 | 38.66 | C |
| ATOM | 3509 | CD1 | TYR | C | 31 | −25.199 | −32.718 | 73.428 | 1.00 | 39.15 | C |
| ATOM | 3510 | CD2 | TYR | C | 31 | −27.032 | −32.967 | 74.913 | 1.00 | 40.52 | C |
| ATOM | 3511 | CE1 | TYR | C | 31 | −26.008 | −32.113 | 72.518 | 1.00 | 41.25 | C |
| ATOM | 3512 | CE2 | TYR | C | 31 | −27.852 | −32.352 | 74.011 | 1.00 | 45.11 | C |
| ATOM | 3513 | CZ | TYR | C | 31 | −27.342 | −31.928 | 72.814 | 1.00 | 48.11 | C |
| ATOM | 3514 | OH | TYR | C | 31 | −28.178 | −31.317 | 71.914 | 1.00 | 50.76 | O |
| ATOM | 3515 | N | TYR | C | 32 | −23.699 | −36.894 | 76.851 | 1.00 | 41.37 | N |
| ATOM | 3516 | CA | TYR | C | 32 | −23.187 | −37.357 | 78.121 | 1.00 | 33.57 | C |
| ATOM | 3517 | C | TYR | C | 32 | −22.357 | −38.615 | 77.953 | 1.00 | 35.33 | C |
| ATOM | 3518 | O | TYR | C | 32 | −22.466 | −39.346 | 76.967 | 1.00 | 39.05 | O |
| ATOM | 3519 | CB | TYR | C | 32 | −24.325 | −37.630 | 79.090 | 1.00 | 34.60 | C |
| ATOM | 3520 | CG | TYR | C | 32 | −25.238 | −36.454 | 79.258 | 1.00 | 38.37 | C |
| ATOM | 3521 | CD1 | TYR | C | 32 | −24.873 | −35.386 | 80.057 | 1.00 | 38.78 | C |
| ATOM | 3522 | CD2 | TYR | C | 32 | −26.472 | −36.408 | 78.610 | 1.00 | 37.80 | C |
| ATOM | 3523 | CE1 | TYR | C | 32 | −25.711 | −34.288 | 80.207 | 1.00 | 42.05 | C |
| ATOM | 3524 | CE2 | TYR | C | 32 | −27.310 | −35.329 | 78.749 | 1.00 | 41.43 | C |
| ATOM | 3525 | CZ | TYR | C | 32 | −26.927 | −34.266 | 79.551 | 1.00 | 45.45 | C |
| ATOM | 3526 | OH | TYR | C | 32 | −27.758 | −33.180 | 79.704 | 1.00 | 53.26 | O |
| ATOM | 3527 | N | TYR | C | 33 | −21.511 | −38.840 | 78.942 | 1.00 | 36.12 | N |
| ATOM | 3528 | CA | TYR | C | 33 | −20.902 | −40.133 | 79.185 | 1.00 | 33.30 | C |
| ATOM | 3529 | C | TYR | C | 33 | −21.731 | −40.841 | 80.236 | 1.00 | 29.90 | C |
| ATOM | 3530 | O | TYR | C | 33 | −22.282 | −40.201 | 81.135 | 1.00 | 34.09 | O |
| ATOM | 3531 | CB | TYR | C | 33 | −19.453 | −39.988 | 79.655 | 1.00 | 32.91 | C |
| ATOM | 3532 | CG | TYR | C | 33 | −18.490 | −39.876 | 78.500 | 1.00 | 32.64 | C |
| ATOM | 3533 | CD1 | TYR | C | 33 | −18.235 | −38.637 | 77.891 | 1.00 | 29.43 | C |
| ATOM | 3534 | CD2 | TYR | C | 33 | −17.843 | −41.004 | 78.005 | 1.00 | 32.78 | C |
| ATOM | 3535 | CE1 | TYR | C | 33 | −17.352 | −38.526 | 76.834 | 1.00 | 31.81 | C |
| ATOM | 3536 | CE2 | TYR | C | 33 | −16.947 | −40.905 | 76.954 | 1.00 | 37.66 | C |
| ATOM | 3537 | CZ | TYR | C | 33 | −16.714 | −39.671 | 76.363 | 1.00 | 36.45 | C |
| ATOM | 3538 | OH | TYR | C | 33 | −15.840 | −39.599 | 75.307 | 1.00 | 33.16 | O |
| ATOM | 3539 | N | TRP | C | 34 | −21.845 | −42.154 | 80.099 | 1.00 | 31.46 | N |
| ATOM | 3540 | CA | TRP | C | 34 | −22.687 | −42.974 | 80.957 | 1.00 | 28.61 | C |
| ATOM | 3541 | C | TRP | C | 34 | −21.790 | −43.981 | 81.658 | 1.00 | 31.34 | C |
| ATOM | 3542 | O | TRP | C | 34 | −20.997 | −44.666 | 80.994 | 1.00 | 26.44 | O |
| ATOM | 3543 | CB | TRP | C | 34 | −23.790 | −43.628 | 80.118 | 1.00 | 25.06 | C |
| ATOM | 3544 | CG | TRP | C | 34 | −24.610 | −42.557 | 79.485 | 1.00 | 31.01 | C |
| ATOM | 3545 | CD1 | TRP | C | 34 | −24.506 | −42.091 | 78.205 | 1.00 | 32.39 | C |
| ATOM | 3546 | CD2 | TRP | C | 34 | −25.632 | −41.770 | 80.113 | 1.00 | 33.17 | C |
| ATOM | 3547 | NE1 | TRP | C | 34 | −25.403 | −41.072 | 77.993 | 1.00 | 33.65 | N |
| ATOM | 3548 | CE2 | TRP | C | 34 | −26.108 | −40.853 | 79.145 | 1.00 | 34.22 | C |
| ATOM | 3549 | CE3 | TRP | C | 34 | −26.205 | −41.761 | 81.389 | 1.00 | 28.29 | C |
| ATOM | 3550 | CZ2 | TRP | C | 34 | −27.131 | −39.940 | 79.416 | 1.00 | 33.64 | C |
| ATOM | 3551 | CZ3 | TRP | C | 34 | −27.211 | −40.834 | 81.659 | 1.00 | 30.29 | C |
| ATOM | 3552 | CH2 | TRP | C | 34 | −27.660 | −39.944 | 80.682 | 1.00 | 29.13 | C |
| ATOM | 3553 | N | SER | C | 35 | −21.903 | −44.049 | 82.998 | 1.00 | 28.84 | N |
| ATOM | 3554 | CA | SER | C | 35 | −20.898 | −44.663 | 83.856 | 1.00 | 26.34 | C |
| ATOM | 3555 | C | SER | C | 35 | −21.495 | −45.683 | 84.815 | 1.00 | 25.62 | C |
| ATOM | 3556 | O | SER | C | 35 | −22.691 | −45.688 | 85.096 | 1.00 | 28.59 | O |
| ATOM | 3557 | CG | SER | C | 35 | −20.153 | −43.603 | 84.674 | 1.00 | 25.36 | C |
| ATOM | 3558 | OB | SER | C | 35 | −19.476 | −42.699 | 83.828 | 1.00 | 36.45 | O |
| ATOM | 3559 | N | TRP | C | 36 | −20.611 | −46.515 | 85.359 | 1.00 | 24.98 | N |
| ATOM | 3560 | CA | TRP | C | 36 | −20.914 | −47.468 | 86.419 | 1.00 | 22.69 | C |
| ATOM | 3561 | C | TRP | C | 36 | −19.937 | −47.262 | 87.567 | 1.00 | 26.01 | C |
| ATOM | 3562 | O | TRP | C | 36 | −18.723 | −47.189 | 87.354 | 1.00 | 30.88 | O |
| ATOM | 3563 | CB | TRP | C | 36 | −20.829 | −48.911 | 85.911 | 1.00 | 27.21 | C |
| ATOM | 3564 | CG | TRP | C | 36 | −21.922 | −49.263 | 84.951 | 1.00 | 31.29 | C |
| ATOM | 3565 | CD1 | TRP | C | 36 | −21.856 | −49.288 | 83.581 | 1.00 | 27.11 | C |
| ATOM | 3566 | CD2 | TRP | C | 36 | −23.263 | −49.599 | 85.293 | 1.00 | 28.28 | C |
| ATOM | 3567 | NE1 | TRP | C | 36 | −23.082 | −49.636 | 83.050 | 1.00 | 25.91 | N |
| ATOM | 3568 | CE2 | TRP | C | 36 | −23.959 | −49.843 | 84.083 | 1.00 | 31.98 | C |
| ATOM | 3569 | CE3 | TRP | C | 36 | −23.942 | −49.732 | 86.504 | 1.00 | 23.12 | C |
| ATOM | 3570 | CZ2 | TRP | C | 36 | −25.310 | −50.203 | 84.059 | 1.00 | 30.86 | C |
| ATOM | 3571 | CZ3 | TRP | C | 36 | −25.280 | −50.087 | 86.479 | 1.00 | 26.83 | C |
| ATOM | 3572 | CH2 | TRP | C | 36 | −25.954 | −50.315 | 85.266 | 1.00 | 26.13 | C |
| ATOM | 3573 | N | ILE | C | 37 | −20.469 | −47.181 | 88.779 | 1.00 | 27.24 | N |
| ATOM | 3574 | CA | ILE | C | 37 | −19.713 | −46.954 | 90.007 | 1.00 | 25.13 | C |
| ATOM | 3575 | C | ILE | C | 37 | −20.228 | −47.955 | 91.036 | 1.00 | 26.55 | C |
| ATOM | 3576 | O | ILE | C | 37 | −21.442 | −48.138 | 91.155 | 1.00 | 29.45 | O |
| ATOM | 3577 | CB | ILE | C | 37 | −19.904 | −45.502 | 90.503 | 1.00 | 24.76 | C |
| ATOM | 3578 | CG1 | ILE | C | 37 | −19.417 | −44.509 | 89.444 | 1.00 | 26.03 | C |

TABLE 10.4-continued

| | | | | | | | | | | |
|---|---|---|---|---|---|---|---|---|---|---|
| ATOM | 3579 | CG2 | ILE | C | 37 | −19.245 | −45.259 | 91.853 | 1.00 | 28.36 | C |
| ATOM | 3580 | CD1 | ILE | C | 37 | −20.031 | −43.142 | 89.552 | 1.00 | 27.83 | C |
| ATOM | 3581 | N | ARG | C | 38 | −19.328 | −48.630 | 91.755 | 1.00 | 21.22 | N |
| ATOM | 3582 | CA | ARG | C | 38 | −19.764 | −49.538 | 92.810 | 1.00 | 25.95 | C |
| ATOM | 3583 | C | ARG | C | 38 | −19.274 | −49.069 | 94.183 | 1.00 | 31.35 | C |
| ATOM | 3584 | O | ARG | C | 38 | −18.283 | −48.340 | 94.308 | 1.00 | 26.88 | O |
| ATOM | 3585 | CB | ARG | C | 38 | −19.314 | −50.993 | 92.559 | 1.00 | 23.96 | C |
| ATOM | 3586 | CG | ARG | C | 38 | −17.834 | −51.151 | 92.450 | 1.00 | 33.62 | C |
| ATOM | 3587 | CD | ARG | C | 38 | −17.312 | −52.176 | 93.382 | 1.00 | 31.96 | C |
| ATOM | 3588 | NE | ARG | C | 38 | −17.339 | −53.503 | 92.796 | 1.00 | 36.58 | N |
| ATOM | 3589 | CZ | ARG | C | 38 | −16.278 | −54.294 | 92.657 | 1.00 | 33.65 | C |
| ATOM | 3590 | NH1 | ARG | C | 38 | −15.072 | −53.910 | 93.057 | 1.00 | 31.68 | N1+ |
| ATOM | 3591 | NH2 | ARG | C | 38 | −16.436 | −55.483 | 92.123 | 1.00 | 28.23 | N |
| ATOM | 3592 | N | GLN | C | 39 | −20.015 | −49.467 | 95.215 | 1.00 | 27.22 | N |
| ATOM | 3593 | CA | GLN | C | 39 | −19.688 | −49.135 | 96.599 | 1.00 | 29.87 | C |
| ATOM | 3594 | C | GLN | C | 39 | −19.795 | −50.406 | 97.437 | 1.00 | 28.44 | C |
| ATOM | 3595 | O | GLN | C | 39 | −20.911 | −50.833 | 97.779 | 1.00 | 29.08 | O |
| ATOM | 3596 | CB | GLN | C | 39 | −20.621 | −48.042 | 97.105 | 1.00 | 24.56 | C |
| ATOM | 3597 | CG | GLN | C | 39 | −20.252 | −47.429 | 98.435 | 1.00 | 28.85 | C |
| ATOM | 3598 | CD | GLN | C | 39 | −21.101 | −46.198 | 98.718 | 1.00 | 36.48 | C |
| ATOM | 3599 | OE1 | GLN | C | 39 | −22.318 | −46.187 | 98.497 | 1.00 | 42.72 | O |
| ATOM | 3600 | NE2 | GLN | C | 39 | −20.459 | −45.144 | 99.169 | 1.00 | 38.36 | N |
| ATOM | 3601 | N | PRO | C | 40 | −18.674 | −51.040 | 97.791 | 1.00 | 30.67 | N |
| ATOM | 3602 | CA | PRO | C | 40 | −18.757 | −52.243 | 98.625 | 1.00 | 27.55 | C |
| ATOM | 3603 | C | PRO | C | 40 | −19.218 | −51.877 | 100.021 | 1.00 | 33.77 | C |
| ATOM | 3604 | O | PRO | C | 40 | −18.964 | −50.757 | 100.496 | 1.00 | 34.43 | O |
| ATOM | 3605 | CB | PRO | C | 40 | −17.315 | −52.776 | 98.621 | 1.00 | 27.60 | C |
| ATOM | 3606 | CG | PRO | C | 40 | −16.645 | −52.058 | 97.420 | 1.00 | 26.34 | C |
| ATOM | 3607 | CD | PRO | C | 40 | −17.294 | −50.736 | 97.371 | 1.00 | 28.79 | C |
| ATOM | 3608 | N | PRO | C | 41 | −19.933 | −52.772 | 100.711 | 1.00 | 38.11 | N |
| ATOM | 3609 | CA | PRO | C | 41 | −20.568 | −52.374 | 101.976 | 1.00 | 33.02 | C |
| ATOM | 3610 | C | PRO | C | 41 | −19.528 | −51.959 | 103.001 | 1.00 | 40.48 | C |
| ATOM | 3611 | O | PRO | C | 41 | −18.509 | −52.636 | 103.187 | 1.00 | 40.42 | O |
| ATOM | 3612 | CB | PRO | C | 41 | −21.327 | −53.631 | 102.408 | 1.00 | 37.98 | C |
| ATOM | 3613 | CG | PRO | C | 41 | −20.611 | −54.752 | 101.751 | 1.00 | 37.85 | C |
| ATOM | 3614 | CD | PRO | C | 41 | −20.123 | −54.207 | 100.431 | 1.00 | 37.87 | C |
| ATOM | 3615 | N | GLY | C | 42 | −19.761 | −50.786 | 103.604 | 1.00 | 40.56 | N |
| ATOM | 3616 | CA | GLY | C | 42 | −18.805 | −50.159 | 104.482 | 1.00 | 38.30 | C |
| ATOM | 3617 | C | GLY | C | 42 | −17.794 | −49.262 | 103.801 | 1.00 | 45.76 | C |
| ATOM | 3618 | O | GLY | C | 42 | −17.212 | −48.400 | 104.462 | 1.00 | 47.20 | O |
| ATOM | 3619 | N | LYS | C | 43 | −17.557 | −49.445 | 102.505 | 1.00 | 44.96 | N |
| ATOM | 3620 | CA | LYS | C | 43 | −16.391 | −48.889 | 101.836 | 1.00 | 42.23 | C |
| ATOM | 3621 | C | LYS | C | 43 | −16.754 | −47.617 | 101.060 | 1.00 | 40.08 | C |
| ATOM | 3622 | O | LYS | C | 43 | −17.835 | −47.040 | 101.222 | 1.00 | 39.81 | O |
| ATOM | 3623 | CB | LYS | C | 43 | −15.764 | −49.967 | 100.939 | 1.00 | 39.38 | C |
| ATOM | 3624 | CG | LYS | C | 43 | −15.348 | −51.222 | 101.710 | 1.00 | 43.20 | C |
| ATOM | 3625 | CD | LYS | C | 43 | −14.763 | −50.832 | 103.075 | 1.00 | 44.43 | C |
| ATOM | 3626 | CE | LYS | C | 43 | −14.563 | −52.031 | 103.993 | 1.00 | 51.32 | C |
| ATOM | 3627 | NZ | LYS | C | 43 | −13.263 | −52.735 | 103.784 | 1.00 | 55.64 | N1+ |
| ATOM | 3628 | N | GLY | C | 44 | −15.827 | −47.168 | 100.217 | 1.00 | 38.92 | N |
| ATOM | 3629 | CA | GLY | C | 44 | −16.003 | −45.991 | 99.404 | 1.00 | 38.32 | C |
| ATOM | 3630 | C | GLY | C | 44 | −16.454 | −46.330 | 98.000 | 1.00 | 39.62 | C |
| ATOM | 3631 | O | GLY | C | 44 | −17.012 | −47.402 | 97.737 | 1.00 | 42.04 | O |
| ATOM | 3632 | N | LEU | C | 45 | −16.159 | −45.425 | 97.075 | 1.00 | 32.83 | N |
| ATOM | 3633 | CA | LEU | C | 45 | −16.642 | −45.491 | 95.709 | 1.00 | 27.76 | C |
| ATOM | 3634 | C | LEU | C | 45 | −15.528 | −45.909 | 94.759 | 1.00 | 30.80 | C |
| ATOM | 3635 | O | LEU | C | 45 | −14.385 | −45.473 | 94.905 | 1.00 | 37.23 | O |
| ATOM | 3636 | CB | LEU | C | 45 | −17.213 | −44.134 | 95.309 | 1.00 | 28.31 | C |
| ATOM | 3637 | CG | LEU | C | 45 | −18.413 | −43.760 | 96.186 | 1.00 | 29.60 | C |
| ATOM | 3638 | CD1 | LEU | C | 45 | −18.761 | −42.284 | 96.033 | 1.00 | 25.47 | C |
| ATOM | 3639 | CD2 | LEU | C | 45 | −19.619 | −44.621 | 95.903 | 1.00 | 26.22 | C |
| ATOM | 3640 | N | GLU | C | 46 | −15.834 | −46.819 | 93.839 | 1.00 | 25.91 | N |
| ATOM | 3641 | CA | GLU | C | 46 | −14.895 | −47.185 | 92.791 | 1.00 | 30.55 | C |
| ATOM | 3642 | C | GLU | C | 46 | −15.566 | −47.029 | 91.433 | 1.00 | 35.38 | C |
| ATOM | 3643 | O | GLU | C | 46 | −16.677 | −47.523 | 91.215 | 1.00 | 35.98 | O |
| ATOM | 3644 | CB | GLU | C | 46 | −14.340 | −48.609 | 92.936 | 1.00 | 34.86 | C |
| ATOM | 3645 | CG | GLU | C | 46 | −14.868 | −49.426 | 94.118 | 1.00 | 42.88 | C |
| ATOM | 3646 | CD | GLU | C | 46 | −14.142 | −50.792 | 94.274 | 1.00 | 55.29 | C |
| ATOM | 3647 | OE1 | GLU | C | 46 | −13.692 | −51.365 | 93.231 | 1.00 | 52.24 | O |
| ATOM | 3648 | OE2 | GLU | C | 46 | −14.010 | −51.261 | 95.444 | 1.00 | 42.79 | O1− |
| ATOM | 3649 | N | TRP | C | 47 | −14.880 | −46.345 | 90.524 | 1.00 | 35.22 | N |
| ATOM | 3650 | CA | TRP | C | 47 | −15.389 | −46.093 | 89.189 | 1.00 | 31.80 | C |
| ATOM | 3651 | C | TRP | C | 47 | −15.070 | −47.293 | 88.313 | 1.00 | 32.40 | C |
| ATOM | 3652 | O | TRP | C | 47 | −13.919 | −47.720 | 88.238 | 1.00 | 34.10 | O |
| ATOM | 3653 | CB | TRP | C | 47 | −14.750 | −44.817 | 88.647 | 1.00 | 27.85 | C |
| ATOM | 3654 | CG | TRP | C | 47 | −15.028 | −44.369 | 87.213 | 1.00 | 29.38 | C |
| ATOM | 3655 | CD1 | TRP | C | 47 | −16.066 | −43.591 | 86.769 | 1.00 | 28.35 | C |
| ATOM | 3656 | CD2 | TRP | C | 47 | −14.194 | −44.605 | 86.072 | 1.00 | 31.89 | C |
| ATOM | 3657 | NE1 | TRP | C | 47 | −15.932 | −43.340 | 85.418 | 1.00 | 29.56 | N |
| ATOM | 3658 | CE2 | TRP | C | 47 | −14.792 | −43.954 | 84.970 | 1.00 | 29.80 | C |

TABLE 10.4-continued

| | | | | | | | | | | |
|---|---|---|---|---|---|---|---|---|---|---|
| ATOM | 3659 | CE3 | TRP | C | 47 | −12.996 | −45.312 | 85.873 | 1.00 | 29.70 | C |
| ATOM | 3660 | CZ2 | TRP | C | 47 | −14.234 | −43.990 | 83.699 | 1.00 | 30.22 | C |
| ATOM | 3661 | CZ3 | TRP | C | 47 | −12.455 | −45.356 | 84.615 | 1.00 | 26.84 | C |
| ATOM | 3662 | CH2 | TRP | C | 47 | −13.068 | −44.696 | 83.541 | 1.00 | 31.06 | C |
| ATOM | 3663 | N | PHE | C | 48 | −16.096 | −47.849 | 87.666 | 1.00 | 29.92 | N |
| ATOM | 3664 | CA | PHE | C | 48 | −15.868 | −48.990 | 86.792 | 1.00 | 29.20 | C |
| ATOM | 3665 | C | PHE | C | 48 | −15.444 | −48.547 | 85.397 | 1.00 | 29.36 | C |
| ATOM | 3666 | O | PHE | C | 48 | −14.536 | −49.142 | 84.808 | 1.00 | 30.45 | O |
| ATOM | 3667 | CB | PHE | C | 48 | −17.123 | −49.875 | 86.744 | 1.00 | 27.65 | C |
| ATOM | 3668 | CG | PHE | C | 48 | −17.029 | −51.079 | 87.638 | 1.00 | 30.68 | C |
| ATOM | 3669 | CD1 | PHE | C | 48 | −16.381 | −50.992 | 88.876 | 1.00 | 34.82 | C |
| ATOM | 3670 | CD2 | PHE | C | 48 | −17.539 | −52.300 | 87.246 | 1.00 | 31.72 | C |
| ATOM | 3671 | CE1 | PHE | C | 48 | −16.247 | −52.101 | 89.705 | 1.00 | 32.25 | C |
| ATOM | 3672 | CE2 | PHE | C | 48 | −17.423 | −53.420 | 88.075 | 1.00 | 30.94 | C |
| ATOM | 3673 | CZ | PHE | C | 48 | −16.775 | −53.319 | 89.298 | 1.00 | 33.98 | C |
| ATOM | 3674 | N | GLY | C | 49 | −16.078 | −47.519 | 84.858 | 1.00 | 28.11 | N |
| ATOM | 3675 | CA | GLY | C | 49 | −15.826 | −47.128 | 83.488 | 1.00 | 29.63 | C |
| ATOM | 3676 | C | GLY | C | 49 | −16.967 | −46.291 | 82.950 | 1.00 | 32.96 | C |
| ATOM | 3677 | O | GLY | C | 49 | −17.956 | −46.032 | 83.640 | 1.00 | 32.51 | O |
| ATOM | 3678 | N | GLU | C | 50 | −16.831 | −45.916 | 81.674 | 1.00 | 31.40 | N |
| ATOM | 3679 | CA | GLU | C | 50 | −17.768 | −45.012 | 81.011 | 1.00 | 31.61 | C |
| ATOM | 3680 | C | GLU | C | 50 | −17.854 | −45.334 | 79.519 | 1.00 | 30.45 | C |
| ATOM | 3681 | O | GLU | C | 50 | −16.891 | −45.819 | 78.920 | 1.00 | 31.68 | O |
| ATOM | 3682 | CB | GLU | C | 50 | −17.341 | −43.542 | 81.204 | 1.00 | 28.42 | C |
| ATOM | 3683 | CG | GLU | C | 50 | −15.895 | −43.237 | 80.715 | 1.00 | 27.97 | C |
| ATOM | 3684 | CD | GLU | C | 50 | −15.501 | −41.745 | 80.792 | 1.00 | 33.91 | C |
| ATOM | 3685 | OE1 | GLU | C | 50 | −14.488 | −41.342 | 80.144 | 1.00 | 32.01 | O |
| ATOM | 3686 | OE2 | GLU | C | 50 | −16.189 | −40.969 | 81.511 | 1.00 | 33.87 | O1− |
| ATOM | 3687 | N | ILE | C | 51 | −19.006 | −45.009 | 78.914 | 1.00 | 31.49 | N |
| ATOM | 3688 | CA | ILE | C | 51 | −19.254 | −45.162 | 77.481 | 1.00 | 29.58 | C |
| ATOM | 3689 | C | ILE | C | 51 | −19.904 | −43.883 | 76.949 | 1.00 | 36.19 | C |
| ATOM | 3690 | O | ILE | C | 51 | −20.636 | −43.193 | 77.666 | 1.00 | 32.17 | O |
| ATOM | 3691 | CB | ILE | C | 51 | −20.128 | −46.407 | 77.173 | 1.00 | 30.54 | C |
| ATOM | 3692 | CG1 | ILE | C | 51 | −20.175 | −46.709 | 75.357 | 1.00 | 30.91 | C |
| ATOM | 3693 | CG2 | ILE | C | 51 | −21.541 | −46.263 | 77.756 | 1.00 | 22.08 | C |
| ATOM | 3694 | CD1 | ILE | C | 51 | −20.472 | −48.177 | 75.340 | 1.00 | 21.13 | C |
| ATOM | 3695 | N | SER | C | 52 | −19.687 | −43.604 | 75.652 | 1.00 | 44.18 | N |
| ATOM | 3696 | CA | SER | C | 52 | −19.747 | −42.237 | 75.128 | 1.00 | 42.64 | C |
| ATOM | 3697 | C | SER | C | 52 | −21.001 | −41.880 | 74.342 | 1.00 | 41.94 | C |
| ATOM | 3698 | O | SER | C | 52 | −21.272 | −40.681 | 74.190 | 1.00 | 50.21 | O |
| ATOM | 3699 | CB | SER | C | 52 | −18.545 | −41.962 | 74.210 | 1.00 | 46.91 | C |
| ATOM | 3700 | OG | SER | C | 52 | −18.720 | −42.561 | 72.930 | 1.00 | 51.82 | O |
| ATOM | 3701 | N | HIS | C | 53 | −21.739 | −42.865 | 73.831 | 1.00 | 36.80 | N |
| ATOM | 3702 | CA | HIS | C | 53 | −22.860 | −42.688 | 72.900 | 1.00 | 46.33 | C |
| ATOM | 3703 | C | HIS | C | 53 | −22.439 | −43.129 | 71.515 | 1.00 | 45.86 | C |
| ATOM | 3704 | O | HIS | C | 53 | −23.241 | −43.704 | 70.781 | 1.00 | 49.43 | O |
| ATOM | 3705 | CB | HIS | C | 53 | −23.410 | −41.251 | 72.789 | 1.00 | 46.91 | C |
| ATOM | 3706 | CG | HIS | C | 53 | −24.569 | −41.127 | 71.846 | 1.00 | 52.45 | C |
| ATOM | 3707 | ND1 | HIS | C | 53 | −24.405 | −40.953 | 70.488 | 1.00 | 47.45 | N |
| ATOM | 3708 | CD2 | HIS | C | 53 | −25.907 | −41.185 | 72.059 | 1.00 | 50.31 | C |
| ATOM | 3709 | CE1 | HIS | C | 53 | −25.590 | −40.915 | 69.905 | 1.00 | 43.08 | C |
| ATOM | 3710 | NE2 | HIS | C | 53 | −26.519 | −41.054 | 70.835 | 1.00 | 45.78 | N |
| ATOM | 3711 | N | SER | C | 54 | −21.183 | −42.881 | 71.170 | 1.00 | 47.96 | N |
| ATOM | 3712 | CA | SER | C | 54 | −20.637 | −43.213 | 69.863 | 1.00 | 43.93 | C |
| ATOM | 3713 | C | SER | C | 54 | −20.189 | −44.668 | 69.568 | 1.00 | 48.52 | C |
| ATOM | 3714 | O | SER | C | 54 | −19.920 | −44.942 | 68.399 | 1.00 | 63.14 | O |
| ATOM | 3715 | CB | SER | C | 54 | −19.464 | −42.299 | 69.569 | 1.00 | 40.27 | C |
| ATOM | 3716 | OG | SER | C | 54 | −18.399 | −42.599 | 70.436 | 1.00 | 55.03 | O |
| ATOM | 3717 | N | GLY | C | 55 | −19.968 | −45.572 | 70.529 | 1.00 | 41.03 | N |
| ATOM | 3718 | CA | GLY | C | 55 | −19.813 | −45.352 | 71.953 | 1.00 | 41.92 | C |
| ATOM | 3719 | C | GLY | C | 55 | −18.437 | −45.851 | 72.360 | 1.00 | 42.37 | C |
| ATOM | 3720 | O | GLY | C | 55 | −18.224 | −47.051 | 72.578 | 1.00 | 27.61 | O |
| ATOM | 3721 | N | SER | C | 56 | −17.483 | −44.927 | 72.441 | 1.00 | 44.03 | N |
| ATOM | 3722 | CA | SER | C | 56 | −16.156 | −45.301 | 72.891 | 1.00 | 40.77 | C |
| ATOM | 3723 | C | SER | C | 56 | −16.173 | −45.524 | 74.394 | 1.00 | 39.74 | C |
| ATOM | 3724 | O | SER | C | 56 | −17.034 | −45.019 | 75.114 | 1.00 | 41.06 | O |
| ATOM | 3725 | CB | SER | C | 56 | −15.122 | −44.243 | 72.520 | 1.00 | 39.37 | C |
| ATOM | 3726 | OG | SER | C | 56 | −15.509 | −42.986 | 73.018 | 1.00 | 48.88 | O |
| ATOM | 3727 | N | THR | C | 57 | −15.206 | −46.299 | 74.857 | 1.00 | 38.23 | N |
| ATOM | 3728 | CA | THR | C | 57 | −15.193 | −46.845 | 76.196 | 1.00 | 29.07 | C |
| ATOM | 3729 | C | THR | C | 57 | −13.912 | −46.459 | 76.932 | 1.00 | 32.82 | C |
| ATOM | 3730 | O | THR | C | 57 | −12.865 | −46.266 | 76.312 | 1.00 | 34.18 | O |
| ATOM | 3731 | CB | THR | C | 57 | −15.325 | −48.352 | 76.054 | 1.00 | 31.23 | C |
| ATOM | 3732 | OG1 | THR | C | 57 | −16.527 | −48.801 | 76.681 | 1.00 | 34.61 | O |
| ATOM | 3733 | CG2 | THR | C | 57 | −14.109 | −49.052 | 76.571 | 1.00 | 31.55 | C |
| ATOM | 3734 | N | ASN | C | 58 | −14.002 | −46.318 | 78.257 | 1.00 | 31.01 | N |
| ATOM | 3735 | CA | ASN | C | 58 | −12.838 | −46.118 | 79.121 | 1.00 | 27.41 | C |
| ATOM | 3736 | C | ASN | C | 58 | −13.078 | −46.909 | 80.389 | 1.00 | 30.68 | C |
| ATOM | 3737 | O | ASN | C | 58 | −14.007 | −46.592 | 81.136 | 1.00 | 31.50 | O |
| ATOM | 3738 | CB | ASN | C | 58 | −12.590 | −44.649 | 79.491 | 1.00 | 24.84 | C |

TABLE 10.4-continued

| | | | | | | | | | | |
|---|---|---|---|---|---|---|---|---|---|---|
| ATOM | 3739 | CG | ASN | C | 58 | −12.449 | −43.760 | 78.297 | 1.00 | 28.91 | C |
| ATOM | 3740 | OD1 | ASN | C | 58 | −11.439 | −43.792 | 77.598 | 1.00 | 34.90 | O |
| ATOM | 3741 | ND2 | ASN | C | 58 | −13.458 | −42.937 | 78.055 | 1.00 | 33.30 | N |
| ATOM | 3742 | N | TYR | C | 59 | −12.249 | −47.915 | 80.640 | 1.00 | 29.82 | N |
| ATOM | 3743 | CA | TYR | C | 59 | −12.450 | −48.796 | 81.775 | 1.00 | 33.27 | C |
| ATOM | 3744 | C | TYR | C | 59 | −11.447 | −48.512 | 82.871 | 1.00 | 30.48 | C |
| ATOM | 3745 | O | TYR | C | 59 | −10.402 | −47.903 | 82.644 | 1.00 | 32.69 | O |
| ATOM | 3746 | CB | TYR | C | 59 | −12.326 | −50.263 | 81.379 | 1.00 | 31.17 | C |
| ATOM | 3747 | CG | TYR | C | 59 | −13.321 | −50.726 | 80.367 | 1.00 | 34.24 | C |
| ATOM | 3748 | CD1 | TYR | C | 59 | −14.679 | −50.757 | 80.670 | 1.00 | 35.71 | C |
| ATOM | 3749 | CD2 | TYR | C | 59 | −12.913 | −51.192 | 79.125 | 1.00 | 34.28 | C |
| ATOM | 3750 | CE1 | TYR | C | 59 | −15.611 | −51.214 | 79.741 | 1.00 | 37.87 | C |
| ATOM | 3751 | CE2 | TYR | C | 59 | −13.837 | −51.665 | 78.194 | 1.00 | 33.51 | C |
| ATOM | 3752 | CZ | TYR | C | 59 | −15.183 | −51.659 | 78.498 | 1.00 | 33.62 | C |
| ATOM | 3753 | OH | TYR | C | 59 | −16.095 | −52.115 | 77.572 | 1.00 | 34.03 | O |
| ATOM | 3754 | N | ASN | C | 60 | −11.765 | −48.993 | 84.060 | 1.00 | 29.37 | N |
| ATOM | 3755 | CA | ASN | C | 60 | −10.778 | −48.990 | 85.128 | 1.00 | 38.84 | C |
| ATOM | 3756 | C | ASN | C | 60 | −9.747 | −50.095 | 84.877 | 1.00 | 40.23 | C |
| ATOM | 3757 | O | ASN | C | 60 | −10.119 | −51.280 | 84.829 | 1.00 | 38.66 | O |
| ATOM | 3758 | CB | ASN | C | 60 | −11.437 | −49.191 | 86.480 | 1.00 | 32.03 | C |
| ATOM | 3759 | CG | ASN | C | 60 | −10.484 | −48.942 | 87.617 | 1.00 | 34.48 | C |
| ATOM | 3760 | OD1 | ASN | C | 60 | −9.270 | −48.906 | 87.422 | 1.00 | 34.69 | O |
| ATOM | 3761 | ND2 | ASN | C | 60 | −11.018 | −48.808 | 88.819 | 1.00 | 30.93 | N |
| ATOM | 3762 | N | PRO | C | 61 | −8.458 | −49.763 | 84.741 | 1.00 | 38.19 | N |
| ATOM | 3763 | CA | PRO | C | 61 | −7.459 | −50.799 | 84.419 | 1.00 | 38.23 | C |
| ATOM | 3764 | C | PRO | C | 61 | −7.385 | −51.943 | 85.412 | 1.00 | 36.76 | C |
| ATOM | 3765 | O | PRO | C | 61 | −6.981 | −53.047 | 85.035 | 1.00 | 42.26 | O |
| ATOM | 3766 | CB | PRO | C | 61 | −6.156 | −49.991 | 84.368 | 1.00 | 37.21 | C |
| ATOM | 3767 | CG | PRO | C | 61 | −6.609 | −48.658 | 83.864 | 1.00 | 35.33 | C |
| ATOM | 3768 | CD | PRO | C | 61 | −7.870 | −48.412 | 84.660 | 1.00 | 38.00 | C |
| ATOM | 3769 | N | SER | C | 62 | −7.766 | −51.718 | 86.663 | 1.00 | 37.94 | N |
| ATOM | 3770 | CA | SER | C | 62 | −7.755 | −52.781 | 87.665 | 1.00 | 41.69 | C |
| ATOM | 3771 | C | SER | C | 62 | −8.781 | −53.878 | 87.376 | 1.00 | 45.04 | C |
| ATOM | 3772 | O | SER | C | 62 | −8.587 | −55.025 | 87.790 | 1.00 | 52.57 | O |
| ATOM | 3773 | CB | SER | C | 62 | −8.016 | −52.197 | 89.039 | 1.00 | 36.72 | C |
| ATOM | 3774 | OG | SER | C | 62 | −9.370 | −51.807 | 89.106 | 1.00 | 43.47 | O |
| ATOM | 3775 | N | LEU | C | 63 | −9.927 | −53.530 | 86.792 | 1.00 | 39.84 | N |
| ATOM | 3776 | CA | LEU | C | 63 | −10.881 | −54.557 | 86.394 | 1.00 | 42.71 | C |
| ATOM | 3777 | C | LEU | C | 63 | −10.311 | −55.431 | 85.298 | 1.00 | 47.05 | C |
| ATOM | 3778 | O | LEU | C | 63 | −10.608 | −56.635 | 85.235 | 1.00 | 44.87 | O |
| ATOM | 3779 | CB | LEU | C | 63 | −12.177 | −53.929 | 85.914 | 1.00 | 39.14 | C |
| ATOM | 3780 | CG | LEU | C | 63 | −12.942 | −53.409 | 87.06 | 1.00 | 41.14 | C |
| ATOM | 3781 | CD1 | LEU | C | 63 | −14.324 | −52.965 | 86.651 | 1.00 | 39.64 | C |
| ATOM | 3782 | CD2 | LEU | C | 63 | −13.003 | −54.481 | 88.194 | 1.00 | 37.86 | C |
| ATOM | 3783 | N | LYS | C | 64 | −9.555 | −54.816 | 84.389 | 1.00 | 50.10 | N |
| ATOM | 3784 | CA | LYS | C | 64 | −8.831 | −55.520 | 83.346 | 1.00 | 45.99 | C |
| ATOM | 3785 | C | LYS | C | 64 | −9.797 | −56.175 | 82.376 | 1.00 | 46.14 | C |
| ATOM | 3786 | O | LYS | C | 64 | −10.663 | −55.500 | 81.805 | 1.00 | 47.95 | O |
| ATOM | 3787 | CB | LYS | C | 64 | −7.875 | −56.515 | 84.000 | 1.00 | 45.38 | C |
| ATOM | 3788 | CG | LYS | C | 64 | −6.494 | −56.522 | 83.397 | 1.00 | 56.60 | C |
| ATOM | 3789 | CD | LYS | C | 64 | −5.651 | −57.503 | 84.141 | 1.00 | 57.39 | C |
| ATOM | 3790 | CE | LYS | C | 64 | −5.450 | −56.943 | 85.551 | 1.00 | 64.49 | C |
| ATOM | 3791 | NZ | LYS | C | 64 | −4.775 | −57.891 | 86.483 | 1.00 | 75.39 | N1+ |
| ATOM | 3792 | N | ALA | C | 65 | −9.676 | −57.484 | 82.203 | 1.00 | 43.80 | N |
| ATOM | 3793 | CA | ALA | C | 65 | −10.484 | −58.168 | 81.210 | 1.00 | 43.71 | C |
| ATOM | 3794 | C | ALA | C | 65 | −11.908 | −58.474 | 81.670 | 1.00 | 40.71 | C |
| ATOM | 3795 | O | ALA | C | 65 | −12.730 | −58.856 | 80.830 | 1.00 | 46.79 | O |
| ATOM | 3796 | CB | ALA | C | 65 | −9.789 | −59.462 | 80.808 | 1.00 | 46.98 | C |
| ATOM | 3797 | N | ARG | C | 66 | −12.232 | −58.303 | 82.958 | 1.00 | 34.69 | N |
| ATOM | 3798 | CA | ARG | C | 66 | −13.508 | −58.800 | 83.490 | 1.00 | 35.91 | C |
| ATOM | 3799 | C | ARG | C | 66 | −14.721 | −57.969 | 83.088 | 1.00 | 34.48 | C |
| ATOM | 3800 | O | ARG | C | 66 | −15.841 | −58.467 | 83.207 | 1.00 | 34.86 | O |
| ATOM | 3801 | CB | ARG | C | 66 | −13.467 | −58.840 | 85.013 | 1.00 | 37.25 | C |
| ATOM | 3802 | CG | ARG | C | 66 | −12.241 | −59.497 | 85.584 | 1.00 | 41.56 | C |
| ATOM | 3803 | CD | ARG | C | 66 | −12.258 | −59.442 | 87.090 | 1.00 | 33.48 | C |
| ATOM | 3804 | NE | ARG | C | 66 | −13.537 | −59.870 | 87.586 | 1.00 | 36.42 | N |
| ATOM | 3805 | CZ | ARG | C | 66 | −14.096 | −59.444 | 88.710 | 1.00 | 31.00 | C |
| ATOM | 3806 | NH1 | ARG | C | 66 | −15.275 | −59.921 | 89.045 | 1.00 | 32.67 | N |
| ATOM | 3807 | NH2 | ARG | C | 66 | −13.499 | −58.556 | 89.483 | 1.00 | 29.13 | N |
| ATOM | 3808 | N | VAL | C | 67 | −14.545 | −56.720 | 82.650 | 1.00 | 36.81 | N |
| ATOM | 3809 | CA | VAL | C | 67 | −15.642 | −55.760 | 82.552 | 1.00 | 33.37 | C |
| ATOM | 3810 | C | VAL | C | 67 | −15.923 | −55.381 | 81.104 | 1.00 | 38.37 | C |
| ATOM | 3811 | O | VAL | C | 67 | −15.005 | −55.251 | 80.288 | 1.00 | 41.21 | O |
| ATOM | 3812 | CB | VAL | C | 67 | −15.353 | −54.501 | 83.391 | 1.00 | 36.36 | C |
| ATOM | 3813 | CG1 | VAL | C | 67 | −14.134 | −53.780 | 82.865 | 1.00 | 34.65 | C |
| ATOM | 3814 | CG2 | VAL | C | 67 | −16.552 | −53.582 | 83.346 | 1.00 | 36.14 | C |
| ATOM | 3815 | N | THR | C | 68 | −17.203 | −55.212 | 80.792 | 1.00 | 35.08 | N |
| ATOM | 3816 | CA | THR | C | 68 | −17.654 | −54.712 | 79.510 | 1.00 | 32.85 | C |
| ATOM | 3817 | C | THR | C | 68 | −18.769 | −53.715 | 79.758 | 1.00 | 29.58 | C |
| ATOM | 3818 | O | THR | C | 68 | −19.686 | −53.981 | 80.536 | 1.00 | 30.01 | O |

TABLE 10.4-continued

| ATOM | 3819 | CB | THR | C | 68 | −18.196 | −55.829 | 78.605 | 1.00 | 36.95 | C |
|---|---|---|---|---|---|---|---|---|---|---|---|
| ATOM | 3820 | OG1 | THR | C | 68 | −17.324 | −56.957 | 78.657 | 1.00 | 39.01 | O |
| ATOM | 3821 | CG2 | THR | C | 68 | −18.339 | −55.320 | 77.154 | 1.00 | 28.49 | C |
| ATOM | 3822 | N | ILE | C | 69 | −18.719 | −52.595 | 79.060 | 1.00 | 33.88 | N |
| ATOM | 3823 | CA | ILE | C | 69 | −19.792 | −51.617 | 79.088 | 1.00 | 33.76 | C |
| ATOM | 3824 | C | ILE | C | 69 | −20.257 | −51.398 | 77.658 | 1.00 | 34.31 | C |
| ATOM | 3825 | O | ILE | C | 69 | −19.439 | −51.192 | 76.757 | 1.00 | 34.33 | O |
| ATOM | 3826 | CB | ILE | C | 69 | −19.349 | −50.307 | 79.752 | 1.00 | 25.14 | C |
| ATOM | 3827 | CG1 | ILE | C | 69 | −19.047 | −50.590 | 81.218 | 1.00 | 24.64 | C |
| ATOM | 3828 | CG2 | ILE | C | 69 | −20.418 | −49.246 | 79.567 | 1.00 | 21.90 | C |
| ATOM | 3829 | CD1 | ILE | C | 69 | −18.299 | −49.486 | 81.965 | 1.00 | 29.90 | C |
| ATOM | 3830 | N | SER | C | 70 | −21.567 | −51.459 | 77.455 | 1.00 | 35.47 | N |
| ATOM | 3831 | CA | SER | C | 70 | −22.170 | −51.319 | 76.141 | 1.00 | 33.35 | C |
| ATOM | 3832 | C | SER | C | 70 | −23.321 | −50.323 | 76.226 | 1.00 | 31.43 | C |
| ATOM | 3833 | O | SER | C | 70 | −23.862 | −50.073 | 77.305 | 1.00 | 30.39 | O |
| ATOM | 3834 | CB | SER | C | 70 | −22.654 | −52.668 | 75.638 | 1.00 | 23.50 | C |
| ATOM | 3835 | OG | SER | C | 70 | −23.508 | −53.222 | 76.609 | 1.00 | 35.38 | O |
| ATOM | 3836 | N | ILE | C | 71 | −23.683 | −49.755 | 75.074 | 1.00 | 30.99 | N |
| ATOM | 3837 | CA | ILE | C | 71 | −24.705 | −48.722 | 74.981 | 1.00 | 30.48 | C |
| ATOM | 3838 | C | ILE | C | 71 | −25.660 | −49.058 | 73.838 | 1.00 | 34.95 | C |
| ATOM | 3839 | O | ILE | C | 71 | −25.246 | −49.587 | 72.806 | 1.00 | 34.86 | O |
| ATOM | 3840 | CB | ILE | C | 71 | −24.064 | −47.335 | 74.790 | 1.00 | 32.81 | C |
| ATOM | 3841 | CG1 | ILE | C | 71 | −25.061 | −46.237 | 75.120 | 1.00 | 29.16 | C |
| ATOM | 3842 | CG2 | ILE | C | 71 | −23.480 | −47.167 | 73.376 | 1.00 | 30.88 | C |
| ATOM | 3843 | CD1 | ILE | C | 71 | −24.442 | −44.876 | 75.149 | 1.00 | 30.80 | C |
| ATOM | 3844 | N | ASP | C | 72 | −26.949 | −48.798 | 74.042 | 1.00 | 39.76 | N |
| ATOM | 3845 | CA | ASP | C | 72 | −27.988 | −48.981 | 73.025 | 1.00 | 35.04 | C |
| ATOM | 3846 | C | ASP | C | 72 | −28.651 | −47.630 | 72.771 | 1.00 | 39.02 | C |
| ATOM | 3847 | O | ASP | C | 72 | −29.552 | −47.241 | 73.518 | 1.00 | 43.96 | O |
| ATOM | 3848 | CB | ASP | C | 72 | −29.012 | −50.011 | 73.491 | 1.00 | 37.61 | C |
| ATOM | 3849 | CG | ASP | C | 72 | −30.119 | −50.283 | 72.465 | 1.00 | 45.97 | C |
| ATOM | 3850 | OD1 | ASP | C | 72 | −30.612 | −49.345 | 71.798 | 1.00 | 48.11 | O |
| ATOM | 3851 | OD2 | ASP | C | 72 | −30.518 | −51.461 | 72.346 | 1.00 | 49.16 | O1− |
| ATOM | 3852 | N | THR | C | 73 | −28.231 | −46.910 | 71.726 | 1.00 | 38.09 | N |
| ATOM | 3853 | CA | THR | C | 73 | −28.807 | −45.586 | 71.501 | 1.00 | 40.83 | C |
| ATOM | 3854 | C | THR | C | 73 | −30.255 | −45.626 | 71.029 | 1.00 | 44.67 | C |
| ATOM | 3855 | O | THR | C | 73 | −30.892 | −44.568 | 70.997 | 1.00 | 48.41 | O |
| ATOM | 3856 | CB | THR | C | 73 | −27.996 | −44.759 | 70.502 | 1.00 | 39.06 | C |
| ATOM | 3857 | OG1 | THR | C | 73 | −27.774 | −45.521 | 69.308 | 1.00 | 46.00 | O |
| ATOM | 3858 | CG2 | THR | C | 73 | −26.679 | −44.327 | 71.114 | 1.00 | 40.64 | C |
| ATOM | 3859 | O | SER | C | 74 | −33.984 | −45.804 | 71.487 | 1.00 | 55.05 | O |
| ATOM | 3860 | N | SER | C | 74 | −30.781 | −46.782 | 70.622 | 1.00 | 41.41 | N |
| ATOM | 3861 | CA | SER | C | 74 | −32.194 | −46.829 | 70.244 | 1.00 | 49.65 | C |
| ATOM | 3862 | C | SER | C | 74 | −33.087 | −46.665 | 71.466 | 1.00 | 55.28 | C |
| ATOM | 3863 | CB | SER | C | 74 | −32.524 | −48.149 | 69.539 | 1.00 | 50.83 | C |
| ATOM | 3864 | OG | SER | C | 74 | −31.745 | −48.338 | 68.375 | 1.00 | 60.96 | O |
| ATOM | 3865 | O | LYS | C | 75 | −33.672 | −46.626 | 75.929 | 1.00 | 49.05 | O |
| ATOM | 3866 | N | LYS | C | 75 | −32.833 | −47.481 | 72.498 | 1.00 | 48.96 | N |
| ATOM | 3867 | CA | LYS | C | 75 | −33.603 | −47.551 | 73.730 | 1.00 | 48.48 | C |
| ATOM | 3868 | C | LYS | C | 75 | −33.120 | −46.598 | 74.819 | 1.00 | 45.98 | C |
| ATOM | 3869 | CB | LYS | C | 75 | −33.594 | −48.986 | 74.274 | 1.00 | 47.37 | C |
| ATOM | 3870 | CG | LYS | C | 75 | −34.202 | −49.988 | 73.320 | 1.00 | 54.32 | C |
| ATOM | 3871 | CD | LYS | C | 75 | −34.219 | −51.397 | 73.886 | 1.00 | 53.30 | C |
| ATOM | 3872 | CE | LYS | C | 75 | −34.656 | −52.383 | 72.819 | 1.00 | 62.19 | C |
| ATOM | 3873 | NZ | LYS | C | 75 | −35.421 | −53.518 | 73.409 | 1.00 | 63.45 | N |
| ATOM | 3874 | O | ASN | C | 76 | −31.622 | −45.589 | 77.918 | 1.00 | 39.83 | O |
| ATOM | 3875 | N | ASN | C | 76 | −32.109 | −45.772 | 74.550 | 1.00 | 41.83 | N |
| ATOM | 3876 | CA | ASN | C | 76 | −31.496 | −44.951 | 75.593 | 1.00 | 43.47 | C |
| ATOM | 3877 | C | ASN | C | 76 | −31.146 | −45.811 | 76.807 | 1.00 | 36.05 | C |
| ATOM | 3878 | CB | ASN | C | 76 | −32.402 | −43.771 | 75.976 | 1.00 | 36.10 | C |
| ATOM | 3879 | CG | ASN | C | 76 | −32.342 | −42.656 | 74.963 | 1.00 | 38.85 | C |
| ATOM | 3880 | OD1 | ASN | C | 76 | −31.821 | −42.833 | 73.857 | 1.00 | 46.14 | O |
| ATOM | 3881 | ND2 | ASN | C | 76 | −32.863 | −41.498 | 75.326 | 1.00 | 45.02 | N |
| ATOM | 3882 | N | GLN | C | 77 | −30.384 | −46.868 | 76.554 | 1.00 | 35.70 | N |
| ATOM | 3883 | CA | GLN | C | 77 | −29.976 | −47.812 | 77.580 | 1.00 | 35.90 | C |
| ATOM | 3884 | C | GLN | C | 77 | −28.472 | −48.013 | 77.506 | 1.00 | 36.92 | C |
| ATOM | 3885 | O | GLN | C | 77 | −27.858 | −47.827 | 76.452 | 1.00 | 34.91 | O |
| ATOM | 3886 | CB | GLN | C | 77 | −30.697 | −49.147 | 77.409 | 1.00 | 33.22 | C |
| ATOM | 3887 | CG | GLN | C | 77 | −32.184 | −49.061 | 77.707 | 1.00 | 37.44 | C |
| ATOM | 3888 | CD | GLN | C | 77 | −32.889 | −50.386 | 77.542 | 1.00 | 35.36 | C |
| ATOM | 3889 | OE1 | GLN | C | 77 | −32.301 | −51.358 | 77.088 | 1.00 | 30.09 | O |
| ATOM | 3890 | NE2 | GLN | C | 77 | −34.154 | −50.431 | 77.919 | 1.00 | 37.97 | N |
| ATOM | 3891 | N | PHE | C | 78 | −27.882 | −48.404 | 78.638 | 1.00 | 30.45 | N |
| ATOM | 3892 | CA | PHE | C | 78 | −26.495 | −48.839 | 78.650 | 1.00 | 28.00 | C |
| ATOM | 3893 | C | PHE | C | 78 | −26.342 | −49.884 | 79.739 | 1.00 | 32.46 | C |
| ATOM | 3894 | O | PHE | C | 78 | −27.128 | −49.933 | 80.686 | 1.00 | 33.14 | O |
| ATOM | 3895 | CB | PHE | C | 78 | −25.501 | −47.668 | 78.812 | 1.00 | 29.59 | C |
| ATOM | 3896 | CG | PHE | C | 78 | −25.617 | −46.911 | 80.109 | 1.00 | 29.92 | C |
| ATOM | 3897 | CD1 | PHE | C | 78 | −26.541 | −45.898 | 80.252 | 1.00 | 28.69 | C |
| ATOM | 3898 | CD2 | PHE | C | 78 | −24.767 | −47.182 | 81.160 | 1.00 | 29.77 | C |

TABLE 10.4-continued

| ATOM | 3899 | CE1 | PHE | C | 78 | −26.635 | −45.191 | 81.422 | 1.00 | 31.87 | C |
|---|---|---|---|---|---|---|---|---|---|---|---|
| ATOM | 3900 | CE2 | PHE | C | 78 | −24.865 | −46.484 | 82.343 | 1.00 | 32.84 | C |
| ATOM | 3901 | CZ | PHE | C | 78 | −25.800 | −45.481 | 82.475 | 1.00 | 32.57 | C |
| ATOM | 3902 | N | SER | C | 79 | −25.321 | −50.732 | 79.595 | 1.00 | 30.53 | N |
| ATOM | 3903 | CA | SER | C | 79 | −25.288 | −51.973 | 80.344 | 1.00 | 27.00 | C |
| ATOM | 3904 | C | SER | C | 79 | −23.887 | −52.250 | 80.869 | 1.00 | 29.56 | C |
| ATOM | 3905 | O | SER | C | 79 | −22.890 | −51.729 | 80.365 | 1.00 | 29.66 | O |
| ATOM | 3906 | CB | SER | C | 79 | −25.778 | −53.134 | 79.474 | 1.00 | 30.28 | C |
| ATOM | 3907 | OG | SER | C | 79 | −27.128 | −52.938 | 79.104 | 1.00 | 31.71 | O |
| ATOM | 3908 | N | LEU | C | 80 | −23.833 | −53.114 | 81.879 | 1.00 | 24.67 | N |
| ATOM | 3909 | CA | LEU | C | 80 | −22.595 | −53.502 | 82.522 | 1.00 | 26.25 | C |
| ATOM | 3910 | C | LEU | C | 80 | −22.509 | −55.012 | 82.551 | 1.00 | 31.30 | C |
| ATOM | 3911 | O | LEU | C | 80 | −23.454 | −55.677 | 82.982 | 1.00 | 32.63 | O |
| ATOM | 3912 | CB | LEU | C | 80 | −22.519 | −52.968 | 83.957 | 1.00 | 30.49 | C |
| ATOM | 3913 | CG | LEU | C | 80 | −21.310 | −53.471 | 84.764 | 1.00 | 31.84 | C |
| ATOM | 3914 | CD1 | LEU | C | 80 | −19.986 | −52.935 | 84.206 | 1.00 | 24.42 | C |
| ATOM | 3915 | CD2 | LEU | C | 80 | −21.459 | −53.149 | 86.240 | 1.00 | 29.26 | C |
| ATOM | 3916 | N | LYS | C | 81 | −21.377 | −55.549 | 82.111 | 1.00 | 29.00 | N |
| ATOM | 3917 | CA | LYS | C | 81 | −21.065 | −56.958 | 82.299 | 1.00 | 31.81 | C |
| ATOM | 3918 | C | LYS | C | 81 | −19.803 | −57.045 | 83.139 | 1.00 | 31.17 | C |
| ATOM | 3919 | O | LYS | C | 81 | −18.822 | −56.361 | 82.845 | 1.00 | 34.99 | O |
| ATOM | 3920 | CB | LYS | C | 81 | −20.864 | −57.684 | 80.964 | 1.00 | 28.39 | C |
| ATOM | 3921 | CG | LYS | C | 81 | −22.140 | −57.880 | 80.163 | 1.00 | 33.95 | C |
| ATOM | 3922 | CD | LYS | C | 81 | −22.873 | −59.151 | 80.545 | 1.00 | 40.33 | C |
| ATOM | 392 | CE | LYS | C | 81 | −24.202 | −59.282 | 79.817 | 1.00 | 42.26 | C |
| ATOM | 3924 | NZ | LYS | C | 81 | −24.025 | −59.096 | 78.349 | 1.00 | 53.78 | N1+ |
| ATOM | 3925 | N | LEU | C | 82 | −19.835 | −57.857 | 84.193 | 1.00 | 30.70 | N |
| ATOM | 3926 | CA | LEU | C | 82 | −18.652 | −58.141 | 85.004 | 1.00 | 28.52 | C |
| ATOM | 3927 | C | LEU | C | 82 | −18.571 | −59.645 | 85.180 | 1.00 | 31.87 | C |
| ATOM | 3928 | O | LEU | C | 82 | −19.434 | −60.247 | 85.824 | 1.00 | 37.82 | O |
| ATOM | 3929 | CB | LEU | C | 82 | −18.701 | −57.439 | 86.356 | 1.00 | 33.35 | C |
| ATOM | 3930 | CG | LEU | C | 82 | −17.543 | −57.699 | 87.330 | 1.00 | 35.28 | C |
| ATOM | 3931 | CD1 | LEU | C | 82 | −16.244 | −57.034 | 86.881 | 1.00 | 26.92 | C |
| ATOM | 3932 | CD2 | LEU | C | 82 | −17.950 | −57.297 | 88.741 | 1.00 | 25.50 | C |
| ATOM | 3933 | N | ARG | C | 83 | −17.554 | −60.251 | 84.600 | 1.00 | 36.83 | N |
| ATOM | 3934 | CA | ARG | C | 83 | −17.451 | −61.703 | 84.527 | 1.00 | 39.83 | C |
| ATOM | 3935 | C | ARG | C | 83 | −16.737 | −62.289 | 85.745 | 1.00 | 38.25 | C |
| ATOM | 3936 | O | ARG | C | 83 | −16.042 | −61.586 | 86.490 | 1.00 | 34.22 | O |
| ATOM | 3937 | CB | ARG | C | 83 | −16.745 | −62.101 | 83.221 | 1.00 | 31.30 | C |
| ATOM | 3938 | CG | ARG | C | 83 | −17.726 | −62.259 | 82.070 | 1.00 | 37.56 | C |
| ATOM | 3939 | CD | ARG | C | 83 | −17.165 | −62.116 | 80.661 | 1.00 | 34.40 | C |
| ATOM | 3940 | NE | ARG | C | 83 | −17.224 | −60.730 | 80.213 | 1.00 | 37.07 | N |
| ATOM | 3941 | CZ | ARG | C | 83 | −16.174 | −59.946 | 80.029 | 1.00 | 39.95 | C |
| ATOM | 3942 | NH1 | ARG | C | 83 | −16.359 | −58.701 | 79.618 | 1.00 | 31.66 | N1+ |
| ATOM | 3943 | NH2 | ARG | C | 83 | −14.947 | −60.412 | 80.249 | 1.00 | 46.34 | N |
| ATOM | 3944 | N | SER | C | 84 | −16.975 | −63.586 | 85.964 | 1.00 | 35.95 | N |
| ATOM | 3945 | CA | SER | C | 84 | −16.215 | −64.416 | 86.908 | 1.00 | 36.75 | C |
| ATOM | 3946 | C | SER | C | 84 | −16.089 | −63.725 | 88.271 | 1.00 | 37.32 | C |
| ATOM | 3947 | O | SER | C | 84 | −15.020 | −63.344 | 88.754 | 1.00 | 41.30 | O |
| ATOM | 3948 | CB | SER | C | 84 | −14.857 | −64.809 | 86.316 | 1.00 | 31.04 | C |
| ATOM | 3949 | OG | SER | C | 84 | −14.036 | −63.687 | 86.179 | 1.00 | 38.56 | O |
| ATOM | 3950 | N | VAL | C | 85 | −17.235 | −63.589 | 88.856 | 1.00 | 33.08 | N |
| ATOM | 3951 | CA | VAL | C | 85 | −17.473 | −62.751 | 90.014 | 1.00 | 32.08 | C |
| ATOM | 3952 | C | VAL | C | 85 | −17.088 | −63.499 | 91.292 | 1.00 | 32.80 | C |
| ATOM | 3953 | O | VAL | C | 85 | −17.190 | −64.723 | 91.359 | 1.00 | 32.85 | O |
| ATOM | 3954 | CB | VAL | C | 85 | −18.965 | −62.372 | 89.921 | 1.00 | 32.31 | C |
| ATOM | 3955 | CG1 | VAL | C | 85 | −19.791 | −63.006 | 90.981 | 1.00 | 35.43 | C |
| ATOM | 3956 | CG2 | VAL | C | 85 | −19.159 | −60.893 | 89.771 | 1.00 | 33.02 | C |
| ATOM | 3957 | N | THR | C | 86 | −16.596 | −62.785 | 92.310 | 1.00 | 36.06 | N |
| ATOM | 3958 | CA | THR | C | 86 | −16.263 | −63.389 | 93.614 | 1.00 | 32.42 | C |
| ATOM | 3959 | C | THR | C | 86 | −16.976 | −62.624 | 94.727 | 1.00 | 32.82 | C |
| ATOM | 3960 | O | THR | C | 86 | −17.644 | −61.619 | 94.485 | 1.00 | 32.02 | O |
| ATOM | 3961 | CB | THR | C | 86 | −14.760 | −63.395 | 93.919 | 1.00 | 32.77 | C |
| ATOM | 3962 | OG1 | THR | C | 86 | −14.390 | −62.115 | 94.438 | 1.00 | 35.84 | O |
| ATOM | 3963 | CG2 | THR | C | 86 | −13.914 | −63.727 | 92.683 | 1.00 | 31.07 | C |
| ATOM | 3964 | N | ALA | C | 87 | −16.813 | −63.084 | 95.972 | 1.00 | 34.97 | N |
| ATOM | 3965 | CA | ALA | C | 87 | −17.533 | −62.446 | 97.079 | 1.00 | 35.92 | C |
| ATOM | 3966 | C | ALA | C | 87 | −17.170 | −60.978 | 97.205 | 1.00 | 36.06 | C |
| ATOM | 3967 | O | ALA | C | 87 | −18.015 | −60.163 | 97.593 | 1.00 | 34.31 | O |
| ATOM | 3968 | CB | ALA | C | 87 | −17.241 | −63.146 | 98.407 | 1.00 | 24.03 | C |
| ATOM | 3969 | B | ALA | C | 88 | −15.927 | −60.626 | 96.853 | 1.00 | 32.27 | N |
| ATOM | 3970 | CA | ALA | C | 88 | −15.448 | −59.255 | 96.922 | 1.00 | 32.44 | C |
| ATOM | 3971 | C | ALA | C | 88 | −16.179 | −58.331 | 95.964 | 1.00 | 35.33 | C |
| ATOM | 3972 | O | ALA | C | 88 | −15.973 | −57.119 | 96.027 | 1.00 | 41.10 | O |
| ATOM | 3973 | CB | ALA | C | 88 | −13.953 | −59.211 | 96.632 | 1.00 | 26.07 | C |
| ATOM | 3974 | C | ASP | C | 89 | −17.024 | −58.861 | 95.090 | 1.00 | 31.77 | N |
| ATOM | 3975 | CA | ASP | C | 89 | −17.818 | −58.037 | 94.203 | 1.00 | 29.68 | C |
| ATOM | 3976 | C | ASP | C | 89 | −19.198 | −57.735 | 94.785 | 1.00 | 28.71 | C |
| ATOM | 3977 | O | ASP | C | 89 | −20.017 | −57.099 | 94.115 | 1.00 | 29.06 | O |
| ATOM | 3978 | CB | ASP | C | 89 | −17.943 | −58.712 | 92.825 | 1.00 | 36.29 | C |

TABLE 10.4-continued

| ATOM | 3979 | CG | ASP | C | 89 | −16.584 | −58.922 | 92.122 | 1.00 | 33.46 | C |
| --- | --- | --- | --- | --- | --- | --- | --- | --- | --- | --- | --- |
| ATOM | 3980 | OD1 | ASP | C | 89 | −15.893 | −57.927 | 91.817 | 1.00 | 37.02 | O |
| ATOM | 3981 | OD2 | ASP | C | 89 | −16.209 | −60.092 | 91.867 | 1.00 | 34.16 | O1− |
| ATOM | 3982 | N | THR | C | 90 | −19.454 | −58.137 | 96.028 | 1.00 | 27.76 | N |
| ATOM | 3983 | CA | THR | C | 90 | −20.653 | −57.712 | 96.747 | 1.00 | 34.87 | C |
| ATOM | 3984 | C | THR | C | 90 | −20.606 | −56.194 | 96.997 | 1.00 | 27.98 | C |
| ATOM | 3985 | O | THR | C | 90 | −19.694 | −55.699 | 97.659 | 1.00 | 27.17 | O |
| ATOM | 3986 | CB | THR | C | 90 | −20.747 | −58.492 | 98.058 | 1.00 | 32.97 | C |
| ATOM | 3987 | OG1 | THR | C | 90 | −20.912 | −59.884 | 97.753 | 1.00 | 34.09 | O |
| ATOM | 3988 | CG2 | THR | C | 90 | −21.914 | −58.010 | 98.823 | 1.00 | 24.31 | C |
| ATOM | 3989 | N | ALA | C | 91 | −21.575 | −55.456 | 96.461 | 1.00 | 24.84 | N |
| ATOM | 3990 | CA | ALA | C | 91 | −21.553 | −53.998 | 96.516 | 1.00 | 25.95 | C |
| ATOM | 3991 | C | ALA | C | 91 | −22.876 | −53.467 | 95.882 | 1.00 | 29.10 | C |
| ATOM | 3992 | O | ALA | C | 91 | −23.667 | −54.198 | 95.393 | 1.00 | 30.38 | O |
| ATOM | 3993 | CB | ALA | C | 91 | −20.408 | −53.408 | 95.698 | 1.00 | 27.41 | C |
| ATOM | 3994 | N | VAL | C | 92 | −23.121 | −52.183 | 96.249 | 1.00 | 28.41 | N |
| ATOM | 3995 | CA | VAL | C | 92 | −24.154 | −51.471 | 95.517 | 1.00 | 25.07 | C |
| ATOM | 3996 | C | VAL | C | 92 | −23.533 | −50.973 | 94.227 | 1.00 | 26.45 | C |
| ATOM | 3997 | O | VAL | C | 92 | −22.473 | −50.348 | 94.242 | 1.00 | 29.34 | O |
| ATOM | 3998 | CB | VAL | C | 92 | −24.746 | −50.313 | 96.338 | 1.00 | 25.04 | C |
| ATOM | 3999 | CG1 | VAL | C | 92 | −25.682 | −49.486 | 95.466 | 1.00 | 22.80 | C |
| ATOM | 4000 | CG2 | VAL | C | 92 | −25.542 | −50.843 | 97.503 | 1.00 | 26.44 | C |
| ATOM | 4001 | N | TYR | C | 93 | −24.177 | −51.270 | 93.107 | 1.00 | 29.41 | N |
| ATOM | 4002 | CA | TYR | C | 93 | −23.720 | −50.835 | 91.800 | 1.00 | 25.88 | C |
| ATOM | 4003 | C | TYR | C | 93 | −24.646 | −49.722 | 91.336 | 1.00 | 24.87 | C |
| ATOM | 4004 | O | TYR | C | 93 | −25.854 | −49.927 | 91.241 | 1.00 | 28.12 | O |
| ATOM | 4005 | CB | TYR | C | 93 | −23.703 | −52.015 | 90.826 | 1.00 | 23.05 | C |
| ATOM | 4006 | CG | TYR | C | 93 | −22.607 | −53.020 | 91.156 | 1.00 | 28.89 | C |
| ATOM | 4007 | CD1 | TYR | C | 93 | −22.704 | −53.859 | 92.280 | 1.00 | 24.24 | C |
| ATOM | 4008 | CD2 | TYR | C | 93 | −21.462 | −53.115 | 90.359 | 1.00 | 26.34 | C |
| ATOM | 4009 | CE1 | TYR | C | 93 | −21.702 | −54.752 | 92.593 | 1.00 | 23.55 | C |
| ATOM | 4010 | CE2 | TYR | C | 93 | −20.449 | −53.996 | 90.670 | 1.00 | 26.02 | C |
| ATOM | 4011 | CZ | TYR | C | 93 | −20.566 | −54.818 | 91.783 | 1.00 | 26.56 | C |
| ATOM | 4012 | OH | TYR | C | 93 | −19.535 | −55.695 | 92.078 | 1.00 | 23.40 | O |
| ATOM | 4013 | N | TYR | C | 94 | −24.085 | −48.550 | 91.070 | 1.00 | 23.22 | N |
| ATOM | 4014 | CA | TYR | C | 94 | −24.829 | −47.415 | 90.541 | 1.00 | 28.65 | C |
| ATOM | 4015 | C | TYR | C | 94 | −24.425 | −47.179 | 89.097 | 1.00 | 25.80 | C |
| ATOM | 4016 | O | TYR | C | 94 | −23.241 | −47.248 | 88.766 | 1.00 | 24.60 | O |
| ATOM | 4017 | CB | TYR | C | 94 | −24.547 | −46.097 | 91.309 | 1.00 | 25.22 | C |
| ATOM | 4018 | CG | TYR | C | 94 | −24.796 | −46.109 | 92.775 | 1.00 | 22.71 | C |
| ATOM | 4019 | CD1 | TYR | C | 94 | −26.082 | −45.978 | 93.280 | 1.00 | 24.72 | C |
| ATOM | 4020 | CD2 | TYR | C | 94 | −23.738 | −46.219 | 93.672 | 1.00 | 20.09 | C |
| ATOM | 4021 | CE1 | TYR | C | 94 | −26.311 | −45.997 | 94.640 | 1.00 | 22.52 | C |
| ATOM | 4022 | CE2 | TYR | C | 94 | −23.950 | −46.237 | 95.020 | 1.00 | 17.42 | C |
| ATOM | 4023 | CZ | TYR | C | 94 | −25.240 | −46.119 | 95.508 | 1.00 | 27.12 | C |
| ATOM | 4024 | OH | TYR | C | 94 | −25.463 | −46.130 | 96.877 | 1.00 | 35.58 | O |
| ATOM | 4025 | N | CYS | C | 95 | −25.391 | −46.795 | 88.272 | 1.00 | 25.05 | N |
| ATOM | 4026 | CA | CYS | C | 95 | −25.096 | −46.099 | 87.030 | 1.00 | 26.50 | C |
| ATOM | 4027 | C | CYS | C | 95 | −25.220 | −44.602 | 87.287 | 1.00 | 28.56 | C |
| ATOM | 4028 | O | CYS | C | 95 | −25.943 | −44.161 | 88.192 | 1.00 | 25.46 | O |
| ATOM | 4029 | CB | CYS | C | 95 | −26.022 | −46.563 | 85.883 | 1.00 | 27.62 | C |
| ATOM | 4030 | SG | CYS | C | 95 | −27.838 | −46.477 | 86.215 | 1.00 | 41.12 | S |
| ATOM | 4031 | N | ALA | C | 96 | −24.469 | −43.816 | 86.520 | 1.00 | 26.44 | N |
| ATOM | 4032 | CA | ALA | C | 96 | −24.522 | −42.377 | 86.723 | 1.00 | 27.54 | C |
| ATOM | 4033 | C | ALA | C | 96 | −24.302 | −41.656 | 85.408 | 1.00 | 32.97 | C |
| ATOM | 4034 | O | ALA | C | 96 | −23.727 | −42.202 | 84.464 | 1.00 | 34.61 | O |
| ATOM | 4035 | CB | ALA | C | 96 | −23.493 | −41.909 | 87.746 | 1.00 | 24.37 | C |
| ATOM | 4036 | N | ARG | C | 97 | −24.772 | −40.412 | 85.364 | 1.00 | 35.37 | N |
| ATOM | 4037 | CA | ARG | C | 97 | −24.529 | −39.520 | 84.244 | 1.00 | 26.30 | C |
| ATOM | 4038 | C | ARG | C | 97 | −23.290 | −38.679 | 84.524 | 1.00 | 28.79 | C |
| ATOM | 4039 | O | ARG | C | 97 | −23.208 | −38.000 | 85.551 | 1.00 | 27.36 | O |
| ATOM | 4040 | CB | ARG | C | 97 | −25.732 | −38.630 | 83.997 | 1.00 | 29.64 | C |
| ATOM | 4041 | CG | ARG | C | 97 | −25.581 | −37.755 | 82.773 | 1.00 | 32.76 | C |
| ATOM | 4042 | CD | ARG | C | 97 | −26.887 | −37.112 | 82.453 | 1.00 | 32.80 | C |
| ATOM | 4043 | NE | ARG | C | 97 | −26.856 | −35.720 | 82.854 | 1.00 | 39.43 | N |
| ATOM | 4044 | CZ | ARG | C | 97 | −27.927 | −34.974 | 83.090 | 1.00 | 37.66 | C |
| ATOM | 4045 | NH1 | ARG | C | 97 | −27.763 | −33.707 | 83.447 | 1.00 | 44.97 | N1+ |
| ATOM | 4046 | NH2 | ARG | C | 97 | −29.146 | −35.483 | 82.978 | 1.00 | 39.25 | N |
| ATOM | 4047 | N | ASP | C | 98 | −22.322 | −38.755 | 83.621 | 1.00 | 30.15 | N |
| ATOM | 4048 | CA | ASP | C | 98 | −21.054 | −38.053 | 83.724 | 1.00 | 29.73 | C |
| ATOM | 4049 | C | ASP | C | 98 | −21.145 | −36.751 | 82.929 | 1.00 | 33.62 | C |
| ATOM | 4050 | O | ASP | C | 98 | −21.487 | −36.781 | 81.742 | 1.00 | 31.03 | O |
| ATOM | 4051 | CB | ASP | C | 98 | −19.936 | −38.949 | 83.190 | 1.00 | 30.30 | C |
| ATOM | 4052 | CG | ASP | C | 98 | −18.555 | −38.414 | 83.490 | 1.00 | 31.40 | C |
| ATOM | 4053 | OD1 | ASP | C | 98 | −18.240 | −37.292 | 83.033 | 1.00 | 31.40 | O1− |
| ATOM | 4054 | OD2 | ASP | C | 98 | −17.779 | −39.139 | 84.160 | 1.00 | 32.47 | O |
| ATOM | 4055 | N | TYR | C | 99 | −20.901 | −35.610 | 83.601 | 1.00 | 32.07 | N |
| ATOM | 4056 | CA | TYR | C | 99 | −20.981 | −34.283 | 82.971 | 1.00 | 29.21 | C |
| ATOM | 4057 | C | TYR | C | 99 | −20.323 | −33.081 | 83.723 | 1.00 | 28.12 | C |
| ATOM | 4058 | O | TYR | C | 99 | −21.081 | −32.255 | 84.196 | 1.00 | 36.95 | O |

TABLE 10.4-continued

| | | | | | | | | | | |
|---|---|---|---|---|---|---|---|---|---|---|
| ATOM | 4059 | CB | TYR | C | 99 | −22.484 | −33.958 | 82.761 | 1.00 | 35.21 | C |
| ATOM | 4060 | CG | TYR | C | 99 | −22.884 | −32.899 | 81.729 | 1.00 | 37.19 | C |
| ATOM | 4061 | CD1 | TYR | C | 99 | −22.518 | −33.004 | 80.378 | 1.00 | 37.05 | C |
| ATOM | 4062 | CD2 | TYR | C | 99 | −23.629 | −31.784 | 82.114 | 1.00 | 38.73 | C |
| ATOM | 4063 | CE1 | TYR | C | 99 | −22.905 | −32.034 | 79.447 | 1.00 | 36.99 | C |
| ATOM | 4064 | CE2 | TYR | C | 99 | −24.008 | −30.801 | 81.195 | 1.00 | 32.76 | C |
| ATOM | 4065 | CZ | TYR | C | 99 | −23.652 | −30.924 | 79.871 | 1.00 | 40.53 | C |
| ATOM | 4066 | OH | TYR | C | 99 | −24.045 | −29.934 | 78.971 | 1.00 | 41.60 | O |
| ATOM | 4067 | N | GLY | C | 100 | −19.003 | −32.924 | 83.921 | 1.00 | 28.67 | N |
| ATOM | 4068 | CA | GLY | C | 100 | −17.960 | −33.926 | 83.970 | 1.00 | 29.97 | C |
| ATOM | 4069 | C | GLY | C | 100 | −17.825 | −34.458 | 85.387 | 1.00 | 28.43 | C |
| ATOM | 4070 | O | GLY | C | 100 | −17.023 | −35.343 | 85.668 | 1.00 | 35.72 | O |
| ATOM | 4071 | N | ALA | C | 101 | −18.638 | −33.941 | 86.294 | 1.00 | 28.13 | N |
| ATOM | 4072 | CA | ALA | C | 101 | −18.846 | −34.644 | 87.546 | 1.00 | 23.31 | C |
| ATOM | 4073 | C | ALA | C | 101 | −20.080 | −35.531 | 87.385 | 1.00 | 29.38 | C |
| ATOM | 4074 | O | ALA | C | 101 | −20.763 | −35.484 | 86.363 | 1.00 | 31.34 | O |
| ATOM | 4075 | CB | ALA | C | 101 | −19.026 | −33.659 | 88.689 | 1.00 | 26.55 | C |
| ATOM | 4076 | N | PHE | C | 102 | −20.379 | −36.347 | 88.395 | 1.00 | 25.69 | N |
| ATOM | 4077 | CA | PHE | C | 102 | −21.562 | −37.213 | 88.337 | 1.00 | 30.27 | C |
| ATOM | 4078 | C | PHE | C | 102 | −22.754 | −36.480 | 88.948 | 1.00 | 27.72 | C |
| ATOM | 4079 | O | PHE | C | 102 | −22.912 | −36.444 | 90.170 | 1.00 | 25.66 | O |
| ATOM | 4080 | CB | PHE | C | 102 | −21.314 | −38.547 | 89.035 | 1.00 | 28.00 | C |
| ATOM | 4081 | CG | PHE | C | 102 | −20.216 | −39.368 | 88.406 | 1.00 | 28.82 | C |
| ATOM | 4082 | CD1 | PHE | C | 102 | −20.377 | −39.915 | 87.135 | 1.00 | 26.74 | C |
| ATOM | 4083 | CD2 | PHE | C | 102 | −19.002 | −39.556 | 89.069 | 1.00 | 25.45 | C |
| ATOM | 4084 | CE1 | PHE | C | 102 | −19.376 | −40.658 | 86.548 | 1.00 | 23.07 | C |
| ATOM | 4085 | CE2 | PHE | C | 102 | −17.987 | −40.307 | 88.488 | 1.00 | 27.62 | C |
| ATOM | 4086 | CZ | PHE | C | 102 | −18.173 | −40.859 | 87.220 | 1.00 | 24.95 | C |
| ATOM | 4087 | N | ASP | C | 103 | −23.611 | −35.906 | 88.097 | 1.00 | 25.30 | N |
| ATOM | 4088 | CA | ASP | C | 103 | −24.746 | −35.131 | 88.591 | 1.00 | 29.00 | C |
| ATOM | 4089 | C | ASP | C | 103 | −26.021 | −35.943 | 88.801 | 1.00 | 32.32 | C |
| ATOM | 4090 | O | ASP | C | 103 | −26.862 | −35.523 | 89.596 | 1.00 | 36.85 | O |
| ATOM | 4091 | CB | ASP | C | 103 | −25.067 | −33.937 | 87.671 | 1.00 | 26.81 | C |
| ATOM | 4092 | CG | ASP | C | 103 | −25.328 | −34.341 | 86.198 | 1.00 | 41.22 | C |
| ATOM | 4093 | OD1 | ASP | C | 103 | −25.539 | −35.538 | 85.880 | 1.00 | 33.40 | O1− |
| ATOM | 4094 | OD2 | ASP | C | 103 | −25.333 | −33.419 | 85.338 | 1.00 | 51.21 | O |
| ATOM | 4095 | N | ILE | C | 104 | −26.213 | −37.077 | 88.127 | 1.00 | 29.34 | N |
| ATOM | 4096 | CA | ILE | C | 104 | −27.410 | −37.884 | 88.337 | 1.00 | 28.45 | C |
| ATOM | 4097 | C | ILE | C | 104 | −27.007 | −39.332 | 88.536 | 1.00 | 30.33 | C |
| ATOM | 4098 | O | ILE | C | 104 | −26.120 | −39.840 | 87.842 | 1.00 | 31.30 | O |
| ATOM | 4099 | CB | ILE | C | 104 | −28.406 | −37.758 | 87.170 | 1.00 | 31.09 | C |
| ATOM | 4100 | CG1 | ILE | C | 104 | −28.861 | −36.309 | 87.017 | 1.00 | 29.48 | C |
| ATOM | 4101 | CG2 | ILE | C | 104 | −29.583 | −38.689 | 87.387 | 1.00 | 25.98 | C |
| ATOM | 4102 | CD1 | ILE | C | 104 | −29.838 | −36.138 | 85.943 | 1.00 | 31.56 | C |
| ATOM | 4103 | N | TRP | C | 105 | −27.666 | −39.992 | 89.480 | 1.00 | 27.28 | N |
| ATOM | 4104 | CA | TRP | C | 105 | −27.361 | −41.357 | 89.855 | 1.00 | 27.66 | C |
| ATOM | 4105 | C | TRP | C | 105 | −28.599 | −42.236 | 89.754 | 1.00 | 29.36 | C |
| ATOM | 4106 | O | TRP | C | 105 | −29.720 | −41.789 | 90.005 | 1.00 | 31.41 | O |
| ATOM | 4107 | CB | TRP | C | 105 | −26.830 | −41.398 | 91.288 | 1.00 | 28.75 | C |
| ATOM | 4108 | CG | TRP | C | 105 | −25.559 | −40.624 | 91.483 | 1.00 | 27.49 | C |
| ATOM | 4109 | CD1 | TRP | C | 105 | −25.394 | −39.267 | 91.400 | 1.00 | 27.23 | C |
| ATOM | 4110 | CD2 | TRP | C | 105 | −24.276 | −41.167 | 91.802 | 1.00 | 25.31 | C |
| ATOM | 4111 | NE1 | TRP | C | 105 | −24.078 | −38.935 | 91.650 | 1.00 | 25.97 | N |
| ATOM | 4112 | CE2 | TRP | C | 105 | −23.373 | −40.083 | 91.900 | 1.00 | 25.23 | C |
| ATOM | 4113 | CE3 | TRP | C | 105 | −23.801 | −42.466 | 92.016 | 1.00 | 25.04 | C |
| ATOM | 4114 | CZ2 | TRP | C | 105 | −22.026 | −40.259 | 92.188 | 1.00 | 22.01 | C |
| ATOM | 4115 | CZ3 | TRP | C | 105 | −22.461 | −42.639 | 92.307 | 1.00 | 27.62 | C |
| ATOM | 4116 | CH2 | TRP | C | 105 | −21.586 | −41.532 | 92.389 | 1.00 | 24.95 | C |
| ATOM | 4117 | N | GLY | C | 106 | −28.381 | −43.504 | 89.436 | 1.00 | 29.88 | N |
| ATOM | 4118 | CA | GLY | C | 106 | −29.424 | −44.496 | 89.587 | 1.00 | 34.79 | C |
| ATOM | 4119 | C | GLY | C | 106 | −29.697 | −44.833 | 91.048 | 1.00 | 34.11 | C |
| ATOM | 4120 | O | GLY | C | 106 | −28.952 | −44.456 | 91.951 | 1.00 | 31.75 | O |
| ATOM | 4121 | N | GLN | C | 107 | −30.828 | −45.525 | 91.277 | 1.00 | 37.10 | N |
| ATOM | 4122 | CA | GLN | C | 107 | −31.137 | −46.052 | 92.607 | 1.00 | 33.95 | C |
| ATOM | 4123 | C | GLN | C | 107 | −30.005 | −46.904 | 93.124 | 1.00 | 30.12 | C |
| ATOM | 4124 | O | GLN | C | 107 | −29.773 | −46.956 | 94.331 | 1.00 | 31.44 | O |
| ATOM | 4125 | CB | GLN | C | 107 | −32.411 | −46.921 | 92.621 | 1.00 | 38.95 | C |
| ATOM | 4126 | CG | GLN | C | 107 | −33.442 | −46.732 | 91.485 | 1.00 | 53.38 | C |
| ATOM | 4127 | CD | GLN | C | 107 | −33.137 | −47.557 | 90.207 | 1.00 | 55.26 | C |
| ATOM | 4128 | OE1 | GLN | C | 107 | −33.665 | −48.666 | 89.992 | 1.00 | 51.28 | O |
| ATOM | 4129 | NE2 | GLY | C | 108 | −32.299 | −46.993 | 89.348 | 1.00 | 50.94 | N |
| ATOM | 4130 | N | GLY | C | 108 | −29.311 | −47.597 | 92.233 | 1.00 | 30.68 | N |
| ATOM | 4131 | CA | GLY | C | 108 | −28.376 | −48.619 | 92.628 | 1.00 | 25.20 | C |
| ATOM | 4132 | C | GLY | C | 108 | −29.039 | −49.981 | 92.689 | 1.00 | 28.53 | C |
| ATOM | 4133 | O | GLY | C | 108 | −30.254 | −50.110 | 92.792 | 1.00 | 32.61 | O |
| ATOM | 4134 | N | THR | C | 109 | −28.203 | −51.008 | 92.614 | 1.00 | 26.94 | N |
| ATOM | 4135 | CA | THR | C | 109 | −28.607 | −52.403 | 92.680 | 1.00 | 22.92 | C |
| ATOM | 4136 | C | THR | C | 109 | −27.757 | −53.086 | 93.740 | 1.00 | 30.47 | C |
| ATOM | 4137 | O | THR | C | 109 | −26.523 | −53.049 | 93.674 | 1.00 | 32.40 | O |
| ATOM | 4138 | CB | THR | C | 109 | −28.418 | −53.094 | 91.321 | 1.00 | 29.24 | C |

TABLE 10.4-continued

| | | | | | | | | | | |
|---|---|---|---|---|---|---|---|---|---|---|
| ATOM | 4139 | OG1 | THR | C | 109 | −29.226 | −52.453 | 90.327 | 1.00 | 29.50 | O |
| ATOM | 4140 | CG2 | THR | C | 109 | −28.754 | −54.591 | 91.395 | 1.00 | 25.49 | C |
| ATOM | 4141 | N | MET | C | 110 | −28.402 | −53.685 | 94.726 | 1.00 | 30.19 | N |
| ATOM | 4142 | CA | MET | C | 110 | −27.674 | −54.400 | 95.765 | 1.00 | 31.87 | C |
| ATOM | 4143 | C | MET | C | 110 | −27.271 | −55.749 | 95.187 | 1.00 | 30.25 | C |
| ATOM | 4144 | O | MET | C | 110 | −28.133 | −56.548 | 94.818 | 1.00 | 31.68 | O |
| ATOM | 4145 | CB | MET | C | 110 | −28.571 | −54.546 | 96.991 | 1.00 | 38.09 | C |
| ATOM | 4146 | CG | MET | C | 110 | −27.925 | −54.739 | 98.362 | 1.00 | 38.26 | C |
| ATOM | 4147 | SD | MET | C | 110 | −29.296 | −54.935 | 99.598 | 1.00 | 60.00 | S |
| ATOM | 4148 | CE | MET | C | 110 | −30.587 | −53.829 | 98.963 | 1.00 | 28.36 | C |
| ATOM | 4149 | N | VAL | C | 111 | −25.971 | −55.986 | 95.049 | 1.00 | 30.68 | N |
| ATOM | 4150 | CA | VAL | C | 111 | −25.467 | −57.191 | 94.399 | 1.00 | 30.46 | C |
| ATOM | 4151 | C | VAL | C | 111 | −24.685 | −57.989 | 95.422 | 1.00 | 30.94 | C |
| ATOM | 4152 | O | VAL | C | 111 | −23.698 | −57.495 | 95.978 | 1.00 | 34.81 | O |
| ATOM | 4153 | CB | VAL | C | 111 | −24.601 | −56.875 | 93.164 | 1.00 | 34.32 | C |
| ATOM | 4154 | CG1 | VAL | C | 111 | −23.821 | −58.100 | 92.745 | 1.00 | 28.86 | C |
| ATOM | 4155 | CG2 | VAL | C | 111 | −25.462 | −56.397 | 91.995 | 1.00 | 24.78 | C |
| ATOM | 4156 | N | THR | C | 112 | −25.136 | −59.214 | 95.676 | 1.00 | 33.49 | N |
| ATOM | 4157 | CA | THR | C | 112 | −24.495 | −60.147 | 96.593 | 1.00 | 29.04 | C |
| ATOM | 4158 | C | THR | C | 112 | −23.993 | −61.341 | 95.798 | 1.00 | 31.99 | C |
| ATOM | 4159 | O | THR | C | 112 | −24.749 | −61.926 | 95.013 | 1.00 | 28.19 | O |
| ATOM | 4160 | CB | THR | C | 112 | −25.483 | −60.629 | 97.670 | 1.00 | 27.70 | C |
| ATOM | 4161 | OG1 | THR | C | 112 | −26.126 | −59.513 | 98.275 | 1.00 | 27.51 | O |
| ATOM | 4162 | CG2 | THR | C | 112 | −24.800 | −61.447 | 98.736 | 1.00 | 30.55 | C |
| ATOM | 4163 | N | VAL | C | 113 | −22.726 | −61.696 | 95.985 | 1.00 | 29.97 | N |
| ATOM | 4164 | CA | VAL | C | 113 | −22.185 | −62.918 | 95.405 | 1.00 | 36.12 | C |
| ATOM | 4165 | C | VAL | C | 113 | −21.678 | −63.780 | 96.550 | 1.00 | 33.41 | C |
| ATOM | 4166 | O | VAL | C | 113 | −20.902 | −63.312 | 97.392 | 1.00 | 31.40 | O |
| ATOM | 4167 | CB | VAL | C | 113 | −21.119 | −62.648 | 94.319 | 1.00 | 37.87 | C |
| ATOM | 4168 | CG1 | VAL | C | 113 | −20.582 | −61.246 | 94.423 | 1.00 | 37.11 | C |
| ATOM | 4169 | CG2 | VAL | C | 113 | −20.016 | −63.719 | 94.288 | 1.00 | 28.90 | C |
| ATOM | 4170 | N | SER | C | 114 | −22.171 | −65.019 | 96.610 | 1.00 | 33.34 | N |
| ATOM | 4171 | CA | SER | C | 114 | −21.991 | −65.863 | 97.781 | 1.00 | 37.36 | C |
| ATOM | 4172 | C | SER | C | 114 | −22.309 | −67.316 | 97.449 | 1.00 | 34.25 | C |
| ATOM | 4173 | O | SER | C | 114 | −23.113 | −67.606 | 96.563 | 1.00 | 32.33 | O |
| ATOM | 4174 | CB | SER | C | 114 | −22.886 | −65.382 | 98.932 | 1.00 | 34.37 | C |
| ATOM | 4175 | OG | SER | C | 114 | −22.928 | −66.326 | 99.983 | 1.00 | 36.36 | O |
| ATOM | 4176 | N | SER | C | 115 | −21.682 | −68.224 | 98.195 | 1.00 | 38.98 | N |
| ATOM | 4177 | CA | SER | C | 115 | −22.065 | −69.629 | 98.129 | 1.00 | 38.55 | C |
| ATOM | 4178 | C | SER | C | 115 | −23.430 | −69.890 | 98.753 | 1.00 | 44.22 | C |
| ATOM | 4179 | O | SER | C | 115 | −24.069 | −70.889 | 98.410 | 1.00 | 48.62 | O |
| ATOM | 4180 | CB | SER | C | 115 | −21.032 | −70.491 | 98.847 | 1.00 | 40.98 | C |
| ATOM | 4181 | OG | SER | C | 115 | −19.794 | −70.465 | 98.158 | 1.00 | 57.58 | O |
| ATOM | 4182 | N | ALA | C | 116 | −23.912 | −69.003 | 99.620 | 1.00 | 34.12 | N |
| ATOM | 4183 | CA | ALA | C | 116 | −25.140 | −69.269 | 100.348 | 1.00 | 37.60 | C |
| ATOM | 4184 | C | ALA | C | 116 | −26.347 | −69.330 | 99.415 | 1.00 | 39.26 | C |
| ATOM | 4185 | O | ALA | C | 116 | −26.329 | −68.827 | 98.282 | 1.00 | 36.17 | O |
| ATOM | 4186 | CB | ALA | C | 116 | −25.366 | −68.194 | 101.413 | 1.00 | 33.12 | C |
| ATOM | 4187 | N | SER | C | 117 | −27.414 | −69.957 | 99.915 | 1.00 | 36.37 | N |
| ATOM | 4188 | CA | SER | C | 117 | −28.684 | −70.042 | 99.206 | 1.00 | 39.66 | C |
| ATOM | 4189 | C | SER | C | 117 | −29.745 | −69.252 | 99.960 | 1.00 | 36.99 | C |
| ATOM | 4190 | O | SER | C | 117 | −29.660 | −69.069 | 101.179 | 1.00 | 40.67 | O |
| ATOM | 4191 | CB | SER | C | 117 | −29.137 | −71.504 | 99.021 | 1.00 | 40.84 | C |
| ATOM | 4192 | OG | SER | C | 117 | −28.239 | −72.218 | 98.172 | 1.00 | 42.49 | O |
| ATOM | 4193 | N | THR | C | 118 | −30.735 | −68.770 | 99.215 | 1.00 | 35.22 | N |
| ATOM | 4194 | CA | THR | C | 118 | −31.796 | −67.963 | 99.796 | 1.00 | 34.00 | C |
| ATOM | 4195 | C | THR | C | 118 | −32.453 | −68.705 | 100.953 | 1.00 | 37.86 | C |
| ATOM | 4196 | O | THR | C | 118 | −32.680 | −69.912 | 100.889 | 1.00 | 37.72 | O |
| ATOM | 4197 | CB | THR | C | 118 | −32.829 | −67.600 | 98.724 | 1.00 | 27.84 | C |
| ATOM | 4198 | OG1 | THR | C | 118 | −32.225 | −66.729 | 97.771 | 1.00 | 31.08 | O |
| ATOM | 4199 | CG2 | THR | C | 118 | −34.051 | −66.887 | 99.332 | 1.00 | 36.20 | C |
| ATOM | 4200 | N | LYS | C | 119 | −32.740 | −67.973 | 102.024 | 1.00 | 38.37 | N |
| ATOM | 4201 | CA | LYS | C | 119 | −33.239 | −68.569 | 103.256 | 1.00 | 37.26 | C |
| ATOM | 4202 | C | LYS | C | 119 | −33.922 | −67.486 | 104.079 | 1.00 | 34.75 | C |
| ATOM | 4203 | O | LYS | C | 119 | −33.332 | −66.432 | 104.331 | 1.00 | 32.89 | O |
| ATOM | 4204 | CB | LYS | C | 119 | −32.093 | −69.201 | 104.040 | 1.00 | 32.21 | C |
| ATOM | 4205 | CG | LYS | C | 119 | −32.520 | −69.868 | 105.295 | 1.00 | 32.82 | C |
| ATOM | 4206 | CD | LYS | C | 119 | −31.299 | −70.193 | 106.108 | 1.00 | 34.06 | C |
| ATOM | 4207 | CE | LYS | C | 119 | −31.675 | −70.872 | 107.411 | 1.00 | 37.24 | C |
| ATOM | 4208 | NZ | LYS | C | 119 | −32.670 | −70.086 | 108.181 | 1.00 | 41.53 | N1+ |
| ATOM | 4209 | N | GLY | C | 120 | −35.166 | −67.738 | 104.474 | 1.00 | 34.46 | N |
| ATOM | 4210 | CA | GLY | C | 120 | −35.906 | −66.796 | 105.275 | 1.00 | 30.62 | C |
| ATOM | 4211 | C | GLY | C | 120 | −35.395 | −66.829 | 106.696 | 1.00 | 30.67 | C |
| ATOM | 4212 | O | GLY | C | 120 | −34.703 | −67.767 | 107.102 | 1.00 | 29.23 | O |
| ATOM | 4213 | N | PRO | C | 121 | −35.705 | −65.792 | 107.467 | 1.00 | 28.30 | N |
| ATOM | 4214 | CA | PRO | C | 121 | −35.198 | −65.683 | 108.838 | 1.00 | 30.58 | C |
| ATOM | 4215 | C | PRO | C | 121 | −36.084 | −66.380 | 109.863 | 1.00 | 30.35 | C |
| ATOM | 4216 | O | PRO | C | 121 | −37.286 | −66.554 | 109.668 | 1.00 | 31.40 | O |
| ATOM | 4217 | CB | PRO | C | 121 | −35.223 | −64.172 | 109.082 | 1.00 | 29.17 | C |
| ATOM | 4218 | CG | PRO | C | 121 | −36.377 | −63.701 | 108.245 | 1.00 | 27.47 | C |

TABLE 10.4-continued

| ATOM | 4219 | CD | PRO | C | 121 | −36.411 | −64.578 | 107.029 | 1.00 | 27.41 | C |
|---|---|---|---|---|---|---|---|---|---|---|---|
| ATOM | 4220 | N | SER | C | 122 | −35.465 | −66.726 | 110.991 | 1.00 | 27.52 | N |
| ATOM | 4221 | CA | SER | C | 122 | −36.176 | −67.066 | 112.219 | 1.00 | 26.31 | C |
| ATOM | 4222 | C | SER | C | 122 | −36.157 | −65.874 | 113.165 | 1.00 | 30.19 | C |
| ATOM | 4223 | O | SER | C | 122 | −35.108 | −65.263 | 113.389 | 1.00 | 33.03 | O |
| ATOM | 4224 | CB | SER | C | 122 | −35.553 | −68.272 | 112.920 | 1.00 | 33.10 | C |
| ATOM | 4225 | OG | SER | C | 122 | −35.607 | −69.425 | 112.115 | 1.00 | 42.58 | O |
| ATOM | 4226 | N | VAL | C | 123 | −37.305 | −65.555 | 113.736 | 1.00 | 30.40 | N |
| ATOM | 4227 | CA | VAL | C | 123 | −37.439 | −64.392 | 114.599 | 1.00 | 29.30 | C |
| ATOM | 4228 | C | VAL | C | 123 | −37.651 | −64.870 | 116.038 | 1.00 | 28.97 | C |
| ATOM | 4229 | O | VAL | C | 123 | −38.681 | −65.469 | 116.368 | 1.00 | 37.16 | O |
| ATOM | 4230 | CB | VAL | C | 123 | −38.576 | −63.481 | 114.123 | 1.00 | 27.97 | C |
| ATOM | 4231 | CG1 | VAL | C | 123 | −38.600 | −62.206 | 114.971 | 1.00 | 29.32 | C |
| ATOM | 4232 | CG2 | VAL | C | 123 | −38.448 | −63.196 | 112.593 | 1.00 | 23.94 | C |
| ATOM | 4233 | N | PHE | C | 124 | −36.703 | −64.598 | 116.890 | 1.00 | 27.59 | N |
| ATOM | 4234 | CA | PHE | C | 124 | −36.791 | −64.961 | 118.289 | 1.00 | 30.52 | C |
| ATOM | 4235 | C | PHE | C | 124 | −36.968 | −63.708 | 119.143 | 1.00 | 32.03 | C |
| ATOM | 4236 | O | PHE | C | 124 | −36.508 | −62.623 | 118.771 | 1.00 | 29.31 | O |
| ATOM | 4237 | CB | PHE | C | 124 | −35.539 | −65.723 | 118.760 | 1.00 | 34.19 | C |
| ATOM | 4238 | CG | PHE | C | 124 | −35.145 | −66.879 | 117.868 | 1.00 | 33.33 | C |
| ATOM | 4239 | CD1 | PHE | C | 124 | −35.968 | −67.985 | 117.730 | 1.00 | 37.57 | C |
| ATOM | 4240 | CD2 | PHE | C | 124 | −33.956 | −66.851 | 117.163 | 1.00 | 31.04 | C |
| ATOM | 4241 | CE1 | PHE | C | 124 | −35.618 | −69.033 | 116.892 | 1.00 | 34.49 | C |
| ATOM | 4242 | CE2 | PHE | C | 124 | −33.596 | −67.901 | 116.333 | 1.00 | 34.61 | C |
| ATOM | 4243 | CZ | PHE | C | 124 | −34.430 | −68.991 | 116.196 | 1.00 | 33.73 | C |
| ATOM | 4244 | N | PRO | C | 125 | −37.636 | −63.815 | 120.285 | 1.00 | 34.51 | N |
| ATOM | 4245 | CA | PRO | C | 125 | −37.839 | −62.633 | 121.124 | 1.00 | 30.32 | C |
| ATOM | 4246 | C | PRO | C | 125 | −36.613 | −62.280 | 121.951 | 1.00 | 32.51 | C |
| ATOM | 4247 | O | PRO | C | 125 | −35.832 | −63.136 | 122.369 | 1.00 | 36.65 | O |
| ATOM | 4248 | CB | PRO | C | 125 | −39.010 | −63.039 | 122.025 | 1.00 | 29.69 | C |
| ATOM | 4249 | CG | PRO | C | 125 | −38.894 | −64.526 | 122.107 | 1.00 | 32.87 | C |
| ATOM | 4250 | CD | PRO | C | 125 | −38.363 | −64.991 | 120.794 | 1.00 | 34.01 | C |
| ATOM | 4251 | N | LEU | C | 126 | −36.434 | −60.985 | 122.134 | 1.00 | 26.85 | N |
| ATOM | 4252 | CA | LEU | C | 126 | −35.595 | −60.422 | 123.175 | 1.00 | 26.86 | C |
| ATOM | 4253 | C | LEU | C | 126 | −36.568 | −59.902 | 124.234 | 1.00 | 31.33 | C |
| ATOM | 4254 | O | LEU | C | 126 | −37.153 | −58.825 | 124.081 | 1.00 | 27.81 | O |
| ATOM | 4255 | CB | LEU | C | 126 | −34.714 | −59.324 | 122.596 | 1.00 | 31.15 | C |
| ATOM | 4256 | CG | LEU | C | 126 | −33.839 | −59.786 | 121.435 | 1.00 | 29.11 | C |
| ATOM | 4257 | CD1 | LEU | C | 126 | −33.179 | −58.601 | 120.808 | 1.00 | 26.98 | C |
| ATOM | 4258 | CD2 | LEU | C | 126 | −32.786 | −60.749 | 121.950 | 1.00 | 28.83 | C |
| ATOM | 4259 | N | ALA | C | 127 | −36.784 | −60.706 | 125.302 | 1.00 | 34.13 | N |
| ATOM | 4260 | CA | ALA | C | 127 | −37.874 | −60.477 | 126.253 | 1.00 | 34.68 | C |
| ATOM | 4261 | C | ALA | C | 127 | −37.515 | −59.383 | 127.258 | 1.00 | 38.36 | C |
| ATOM | 4262 | O | ALA | C | 127 | −36.400 | −59.366 | 127.792 | 1.00 | 34.45 | O |
| ATOM | 4263 | CB | ALA | C | 127 | −38.229 | −61.756 | 126.999 | 1.00 | 34.71 | C |
| ATOM | 4264 | N | PRO | C | 128 | −38.453 | −58.480 | 127.552 | 1.00 | 43.79 | N |
| ATOM | 4265 | CA | PRO | C | 128 | −38.163 | −57.410 | 128.513 | 1.00 | 43.68 | C |
| ATOM | 4266 | C | PRO | C | 128 | −37.732 | −57.972 | 129.856 | 1.00 | 54.93 | C |
| ATOM | 4267 | O | PRO | C | 128 | −38.285 | −58.961 | 130.350 | 1.00 | 50.70 | O |
| ATOM | 4268 | CB | PRO | C | 128 | −39.481 | −56.625 | 128.600 | 1.00 | 40.46 | C |
| ATOM | 4269 | CG | PRO | C | 128 | −40.513 | −57.526 | 128.054 | 1.00 | 44.62 | C |
| ATOM | 4270 | CD | PRO | C | 128 | −39.823 | −58.379 | 127.020 | 1.00 | 37.96 | C |
| ATOM | 4271 | N | SER | C | 129 | −36.668 | −57.356 | 130.389 | 1.00 | 69.23 | N |
| ATOM | 4272 | CA | SER | C | 129 | −36.026 | −57.680 | 131.657 | 1.00 | 73.37 | C |
| ATOM | 4273 | C | SER | C | 129 | −37.065 | −57.798 | 132.767 | 1.00 | 80.23 | C |
| ATOM | 4274 | O | SER | C | 129 | −37.700 | −56.804 | 133.139 | 1.00 | 81.02 | O |
| ATOM | 4275 | CB | SER | C | 129 | −34.983 | −56.595 | 131.987 | 1.00 | 71.73 | C |
| ATOM | 4276 | OG | SER | C | 129 | −34.000 | −57.018 | 132.909 | 1.00 | 63.19 | O |
| ATOM | 4277 | N | SER | C | 130 | −37.246 | −59.018 | 133.289 | 1.00 | 83.03 | N |
| ATOM | 4278 | CA | SER | C | 130 | −38.109 | −59.226 | 134.446 | 1.00 | 85.79 | C |
| ATOM | 4279 | C | SER | C | 130 | −37.714 | −58.318 | 135.603 | 1.00 | 95.78 | C |
| ATOM | 4280 | O | SER | C | 130 | −38.566 | −57.941 | 136.424 | 1.00 | 93.56 | O |
| ATOM | 4281 | CB | SER | C | 130 | −38.040 | −60.696 | 134.882 | 1.00 | 88.42 | C |
| ATOM | 4282 | OG | SER | C | 130 | −36.688 | −61.134 | 135.021 | 1.00 | 84.37 | O |
| ATOM | 4283 | N | LYS | C | 131 | −36.428 | −57.953 | 135.673 | 1.00 | 96.01 | N |
| ATOM | 4284 | CA | LYS | C | 131 | −35.860 | −57.111 | 136.721 | 1.00 | 92.69 | C |
| ATOM | 4285 | C | LYS | C | 131 | −35.737 | −55.631 | 136.334 | 1.00 | 88.64 | C |
| ATOM | 4286 | O | LYS | C | 131 | −34.824 | −54.957 | 136.820 | 1.00 | 93.47 | O |
| ATOM | 4287 | CB | LYS | C | 131 | −34.490 | −57.660 | 137.135 | 1.00 | 85.98 | C |
| ATOM | 4288 | CG | LYS | C | 131 | −34.512 | −59.018 | 137.841 | 1.00 | 83.85 | C |
| ATOM | 4289 | CD | LYS | C | 131 | −33.113 | −59.398 | 138.328 | 1.00 | 86.44 | C |
| ATOM | 4290 | CE | LYS | C | 131 | −33.162 | −60.359 | 139.509 | 1.00 | 81.44 | C |
| ATOM | 4291 | NZ | LYS | C | 131 | −31.802 | −60.691 | 140.021 | 1.00 | 67.72 | N1+ |
| ATOM | 4292 | N | SER | C | 132 | −36.625 | −55.088 | 135.498 | 1.00 | 91.44 | N |
| ATOM | 4293 | CA | SER | C | 132 | −36.567 | −53.651 | 135.224 | 1.00 | 88.79 | C |
| ATOM | 4294 | C | SER | C | 132 | −36.967 | −52.857 | 136.461 | 1.00 | 93.64 | C |
| ATOM | 4295 | O | SER | C | 132 | −37.915 | −53.218 | 137.168 | 1.00 | 97.31 | O |
| ATOM | 4296 | CB | SER | C | 132 | −37.472 | −53.256 | 134.048 | 1.00 | 75.72 | C |
| ATOM | 4297 | OG | SER | C | 132 | −36.862 | −53.513 | 132.797 | 1.00 | 71.83 | O |
| ATOM | 4298 | N | THR | C | 133 | −36.229 | −51.769 | 136.723 | 1.00 | 99.77 | N |

TABLE 10.4-continued

| | | | | | | | | | |
|---|---|---|---|---|---|---|---|---|---|
| ATOM | 4299 | CA | THR | C | 133 | −36.569 | −50.845 | 137.806 | 1.00 | 97.90 | C |
| ATOM | 4300 | C | THR | C | 133 | −38.009 | −50.364 | 137.611 | 1.00 | 93.15 | C |
| ATOM | 4301 | O | THR | C | 133 | −38.291 | −49.593 | 136.684 | 1.00 | 89.44 | O |
| ATOM | 4302 | CB | THR | C | 133 | −35.563 | −49.669 | 137.882 | 1.00 | 87.55 | C |
| ATOM | 4303 | OG1 | THR | C | 133 | −35.179 | −49.234 | 136.565 | 1.00 | 83.45 | O |
| ATOM | 4304 | CG2 | THR | C | 133 | −34.303 | −50.077 | 138.653 | 1.00 | 84.85 | C |
| ATOM | 4305 | N | SER | C | 134 | −38.929 | −50.829 | 138.466 | 1.00 | 93.26 | N |
| ATOM | 4306 | CA | SER | C | 134 | −40.352 | −50.635 | 138.210 | 1.00 | 87.74 | C |
| ATOM | 4307 | C | SER | C | 134 | −40.679 | −49.153 | 138.274 | 1.00 | 85.43 | C |
| ATOM | 4308 | O | SER | C | 134 | −40.329 | −48.472 | 139.242 | 1.00 | 87.73 | O |
| ATOM | 4309 | CB | SER | C | 134 | −41.195 | −51.410 | 139.224 | 1.00 | 74.42 | C |
| ATOM | 4310 | OG | SER | C | 134 | −42.211 | −52.150 | 138.567 | 1.00 | 81.41 | O |
| ATOM | 4311 | N | GLY | C | 135 | −41.314 | −48.643 | 137.223 | 1.00 | 80.04 | N |
| ATOM | 4312 | CA | GLY | C | 135 | −41.395 | −47.211 | 137.051 | 1.00 | 78.15 | C |
| ATOM | 4313 | C | GLY | C | 135 | −40.279 | −46.614 | 136.227 | 1.00 | 80.05 | C |
| ATOM | 4314 | O | GLY | C | 135 | −40.186 | −45.381 | 136.144 | 1.00 | 77.05 | O |
| ATOM | 4315 | N | GLY | C | 136 | −39.414 | −47.444 | 135.639 | 1.00 | 72.87 | N |
| ATOM | 4316 | CA | GLY | C | 136 | −38.350 | −46.962 | 134.783 | 1.00 | 61.44 | C |
| ATOM | 4317 | C | GLY | C | 136 | −38.489 | −47.391 | 133.333 | 1.00 | 56.58 | C |
| ATOM | 4318 | O | GLY | C | 136 | −39.592 | −47.407 | 132.771 | 1.00 | 51.45 | O |
| ATOM | 4319 | N | THR | C | 137 | −37.382 | −47.773 | 132.713 | 1.00 | 53.14 | N |
| ATOM | 4320 | CA | THR | C | 137 | −37.361 | −48.017 | 131.279 | 1.00 | 47.91 | C |
| ATOM | 4321 | C | THR | C | 137 | −37.015 | −49.473 | 131.008 | 1.00 | 48.48 | C |
| ATOM | 4322 | O | THR | C | 137 | −36.090 | −50.028 | 131.617 | 1.00 | 47.97 | O |
| ATOM | 4323 | CB | THR | C | 137 | −36.370 | −47.081 | 130.592 | 1.00 | 48.09 | C |
| ATOM | 4324 | OG1 | THR | C | 137 | −36.886 | −45.745 | 130.650 | 1.00 | 54.06 | O |
| ATOM | 4325 | CG2 | THR | C | 137 | −36.140 | −47.485 | 129.123 | 1.00 | 43.01 | C |
| ATOM | 4326 | N | ALA | C | 138 | −37.781 | −50.087 | 130.110 | 1.00 | 38.89 | N |
| ATOM | 4327 | CA | ALA | C | 138 | −37.598 | −51.469 | 129.714 | 1.00 | 38.16 | C |
| ATOM | 4328 | C | ALA | C | 138 | −37.117 | −51.516 | 128.268 | 1.00 | 36.59 | C |
| ATOM | 4329 | O | ALA | C | 138 | −37.541 | −50.708 | 127.437 | 1.00 | 36.87 | O |
| ATOM | 4330 | CB | ALA | C | 138 | −38.908 | −52.249 | 129.871 | 1.00 | 31.25 | C |
| ATOM | 4331 | N | ALA | C | 139 | −36.232 | −52.454 | 127.964 | 1.00 | 33.10 | N |
| ATOM | 4332 | CA | ALA | C | 139 | −35.886 | −52.755 | 126.582 | 1.00 | 30.90 | C |
| ATOM | 4333 | C | ALA | C | 139 | −36.522 | −54.080 | 126.199 | 1.00 | 30.77 | C |
| ATOM | 4334 | O | ALA | C | 139 | −36.619 | −54.986 | 127.028 | 1.00 | 31.77 | O |
| ATOM | 4335 | CB | ALA | C | 139 | −34.371 | −52.823 | 126.376 | 1.00 | 25.95 | C |
| ATOM | 4336 | N | LEU | C | 140 | −36.978 | −54.176 | 124.952 | 1.00 | 29.69 | N |
| ATOM | 4337 | CA | LEU | C | 140 | −37.426 | −55.439 | 124.376 | 1.00 | 30.12 | C |
| ATOM | 4338 | C | LEU | C | 140 | −37.081 | −55.420 | 122.891 | 1.00 | 30.17 | C |
| ATOM | 4339 | O | LEU | C | 140 | −36.795 | −54.369 | 122.319 | 1.00 | 29.86 | O |
| ATOM | 4340 | CB | LEU | C | 140 | −38.930 | −55.666 | 124.605 | 1.00 | 29.80 | C |
| ATOM | 4341 | CG | LEU | C | 140 | −39.844 | −54.591 | 124.028 | 1.00 | 30.15 | C |
| ATOM | 4342 | CD1 | LEU | C | 140 | −40.427 | −55.049 | 122.720 | 1.00 | 29.13 | C |
| ATOM | 4343 | CD2 | LEU | C | 140 | −40.945 | −54.256 | 125.007 | 1.00 | 30.43 | C |
| ATOM | 4344 | N | GLY | C | 141 | −37.135 | −56.581 | 122.250 | 1.00 | 27.97 | N |
| ATOM | 4345 | CA | GLY | C | 141 | −36.809 | −56.584 | 120.844 | 1.00 | 27.01 | C |
| ATOM | 4346 | C | GLY | C | 141 | −37.043 | −57.919 | 120.174 | 1.00 | 30.67 | C |
| ATOM | 4347 | O | GLY | C | 141 | −37.628 | −58.835 | 120.754 | 1.00 | 31.90 | O |
| ATOM | 4348 | N | CYS | C | 142 | −36.604 | −57.978 | 118.908 | 1.00 | 28.16 | N |
| ATOM | 4349 | CA | CYS | C | 142 | −36.633 | −59.156 | 118.051 | 1.00 | 31.74 | C |
| ATOM | 4350 | C | CYS | C | 142 | −35.238 | −59.467 | 117.527 | 1.00 | 28.43 | C |
| ATOM | 4351 | O | CYS | C | 142 | −34.478 | −58.563 | 117.193 | 1.00 | 24.09 | O |
| ATOM | 4352 | CB | CYS | C | 142 | −37.563 | −58.947 | 116.858 | 1.00 | 32.06 | C |
| ATOM | 4353 | SG | CYS | C | 142 | −39.293 | −59.136 | 117.287 | 1.00 | 49.90 | S |
| ATOM | 4354 | N | LEU | C | 143 | −34.903 | −60.747 | 117.447 | 1.00 | 28.84 | N |
| ATOM | 4355 | CA | LEU | C | 143 | −33.651 | −61.187 | 116.845 | 1.00 | 26.55 | C |
| ATOM | 4356 | C | LEU | C | 143 | −33.989 | −61.904 | 115.550 | 1.00 | 27.72 | C |
| ATOM | 4357 | O | LEU | C | 143 | −34.719 | −62.892 | 115.562 | 1.00 | 29.16 | O |
| ATOM | 4358 | CB | LEU | C | 143 | −32.849 | −62.069 | 117.805 | 1.00 | 29.85 | C |
| ATOM | 4359 | CG | LEU | C | 143 | −31.504 | −62.623 | 117.312 | 1.00 | 31.81 | C |
| ATOM | 4360 | CD1 | LEU | C | 143 | −30.634 | −61.539 | 116.821 | 1.00 | 29.50 | C |
| ATOM | 4361 | CD2 | LEU | C | 143 | −30.809 | −63.273 | 118.476 | 1.00 | 34.71 | C |
| ATOM | 4362 | N | VAL | C | 144 | −33.506 | −61.374 | 114.434 | 1.00 | 24.21 | N |
| ATOM | 4363 | CA | VAL | C | 144 | −33.850 | −61.888 | 113.121 | 1.00 | 25.88 | C |
| ATOM | 4364 | C | VAL | C | 144 | −32.632 | −62.683 | 112.650 | 1.00 | 31.73 | C |
| ATOM | 4365 | O | VAL | C | 144 | −31.676 | −62.122 | 112.104 | 1.00 | 27.35 | O |
| ATOM | 4366 | CB | VAL | C | 144 | −34.237 | −60.756 | 112.162 | 1.00 | 29.39 | C |
| ATOM | 4367 | CG1 | VAL | C | 144 | −34.620 | −61.297 | 110.801 | 1.00 | 29.56 | C |
| ATOM | 4368 | CG2 | VAL | C | 144 | −35.395 | −59.939 | 112.721 | 1.00 | 21.42 | C |
| ATOM | 4369 | N | LYS | C | 145 | −32.658 | −64.003 | 112.849 | 1.00 | 26.44 | N |
| ATOM | 4370 | CA | LYS | C | 145 | −31.455 | −64.811 | 112.726 | 1.00 | 29.06 | C |
| ATOM | 4371 | C | LYS | C | 145 | −31.472 | −65.687 | 111.476 | 1.00 | 30.53 | C |
| ATOM | 4372 | O | LYS | C | 145 | −32.513 | −66.244 | 111.098 | 1.00 | 29.40 | O |
| ATOM | 4373 | CB | LYS | C | 145 | −31.253 | −65.686 | 113.974 | 1.00 | 29.44 | C |
| ATOM | 4374 | CG | LYS | C | 145 | −29.832 | −66.217 | 114.070 | 1.00 | 30.84 | C |
| ATOM | 4375 | CD | LYS | C | 145 | −29.511 | −66.818 | 115.405 | 1.00 | 37.83 | C |
| ATOM | 4376 | CE | LYS | C | 145 | −28.009 | −67.086 | 115.543 | 1.00 | 43.25 | C |
| ATOM | 4377 | NZ | LYS | C | 145 | −27.433 | −67.955 | 114.471 | 1.00 | 39.52 | N1+ |
| ATOM | 4378 | N | ASP | C | 146 | −30.298 | −65.782 | 110.837 | 1.00 | 28.14 | N |

TABLE 10.4-continued

| | | | | | | | | | | |
|---|---|---|---|---|---|---|---|---|---|---|
| ATOM | 4379 | CA | ASP | C | 146 | −30.003 | −66.758 | 109.784 | 1.00 | 33.06 | C |
| ATOM | 4380 | C | ASP | C | 146 | −30.862 | −66.564 | 108.531 | 1.00 | 33.58 | C |
| ATOM | 4381 | O | ASP | C | 146 | −31.584 | −67.465 | 108.102 | 1.00 | 36.23 | O |
| ATOM | 4382 | CB | ASP | C | 146 | −30.185 | −68.177 | 110.330 | 1.00 | 36.19 | C |
| ATOM | 4383 | CG | ASP | C | 146 | −29.226 | −68.502 | 111.441 | 1.00 | 38.83 | C |
| ATOM | 4384 | OD1 | ASP | C | 146 | −28.041 | −68.058 | 111.404 | 1.00 | 37.01 | O |
| ATOM | 4385 | OD2 | ASP | C | 146 | −29.716 | −69.135 | 112.405 | 1.00 | 41.05 | O1− |
| ATOM | 4386 | N | TYR | C | 147 | −30.735 | −65.405 | 107.905 | 1.00 | 29.04 | N |
| ATOM | 4387 | CA | TYR | C | 147 | −31.400 | −65.202 | 106.626 | 1.00 | 29.40 | C |
| ATOM | 4388 | C | TYR | C | 147 | −30.361 | −64.899 | 105.547 | 1.00 | 29.62 | C |
| ATOM | 4389 | O | TYR | C | 147 | −29.186 | −64.645 | 105.826 | 1.00 | 30.41 | O |
| ATOM | 4390 | CB | TYR | C | 147 | −32.443 | −64.080 | 106.711 | 1.00 | 26.97 | C |
| ATOM | 4391 | CG | TYR | C | 147 | −31.863 | −62.715 | 106.999 | 1.00 | 28.14 | C |
| ATOM | 4392 | CD1 | TYR | C | 147 | −31.628 | −62.304 | 108.303 | 1.00 | 28.44 | C |
| ATOM | 4393 | CD2 | TYR | C | 147 | −31.529 | −61.840 | 105.963 | 1.00 | 29.70 | C |
| ATOM | 4394 | CE1 | TYR | C | 147 | −31.098 | −61.071 | 108.575 | 1.00 | 30.16 | C |
| ATOM | 4395 | CE2 | TYR | C | 147 | −30.994 | −60.586 | 106.226 | 1.00 | 29.35 | C |
| ATOM | 4396 | CZ | TYR | C | 147 | −30.788 | −60.204 | 107.538 | 1.00 | 32.07 | C |
| ATOM | 4397 | OH | TYR | C | 147 | −30.269 | −58.954 | 107.832 | 1.00 | 32.73 | O |
| ATOM | 4398 | N | PHE | C | 148 | −30.808 | −64.941 | 104.298 | 1.00 | 31.56 | N |
| ATOM | 4399 | CA | PHE | C | 148 | −29.950 | −64.658 | 103.161 | 1.00 | 31.89 | C |
| ATOM | 4400 | C | PHE | C | 148 | −30.781 | −64.535 | 101.900 | 1.00 | 31.76 | C |
| ATOM | 4401 | O | PHE | C | 148 | −31.634 | −65.367 | 101.661 | 1.00 | 30.72 | O |
| ATOM | 4402 | CB | PHE | C | 148 | −28.910 | −65.765 | 102.977 | 1.00 | 30.49 | C |
| ATOM | 4403 | CG | PHE | C | 148 | −27.980 | −65.524 | 101.839 | 1.00 | 32.65 | C |
| ATOM | 4404 | CD1 | PHE | C | 148 | −28.316 | −65.923 | 100.550 | 1.00 | 30.37 | C |
| ATOM | 4405 | CD2 | PHE | C | 148 | −26.766 | −64.876 | 102.053 | 1.00 | 31.85 | C |
| ATOM | 4406 | CE1 | PHE | C | 148 | −27.460 | −65.681 | 99.502 | 1.00 | 33.92 | C |
| ATOM | 4407 | CE2 | PHE | C | 148 | −25.903 | −64.629 | 101.010 | 1.00 | 31.05 | C |
| ATOM | 4408 | CZ | PHE | C | 148 | −26.244 | −65.032 | 99.734 | 1.00 | 36.04 | C |
| ATOM | 4409 | N | PRO | C | 149 | −30.503 | −63.514 | 101.066 | 1.00 | 37.13 | N |
| ATOM | 4410 | CCA | PRO | C | 149 | −29.514 | −62.453 | 101.301 | 1.00 | 34.36 | C |
| ATOM | 4411 | C | PRO | C | 149 | −30.136 | −61.270 | 102.025 | 1.00 | 31.13 | C |
| ATOM | 4412 | O | PRO | C | 149 | −31.294 | −61.362 | 102.414 | 1.00 | 33.18 | O |
| ATOM | 4413 | CB | PRO | C | 149 | −29.116 | −62.050 | 99.885 | 1.00 | 28.19 | C |
| ATOM | 4414 | CG | PRO | C | 149 | −30.384 | −62.167 | 99.146 | 1.00 | 26.99 | C |
| ATOM | 4415 | CO | PRO | C | 149 | −31.093 | −63.390 | 99.717 | 1.00 | 27.60 | C |
| ATOM | 4416 | N | GLU | C | 150 | −29.394 | −60.176 | 102.157 | 1.00 | 27.31 | N |
| ATOM | 4417 | CA | GLU | C | 150 | −29.961 | −58.888 | 102.552 | 1.00 | 30.44 | C |
| ATOM | 4418 | C | GLU | C | 150 | −30.938 | −58.398 | 101.479 | 1.00 | 29.76 | C |
| ATOM | 4419 | O | GLU | C | 150 | −30.806 | −58.770 | 100.312 | 1.00 | 30.40 | O |
| ATOM | 4420 | CB | GLU | C | 150 | −28.839 | −57.872 | 102.761 | 1.00 | 29.87 | C |
| ATOM | 4421 | CG | GLU | C | 150 | −27.928 | −58.160 | 103.958 | 1.00 | 29.34 | C |
| ATOM | 4422 | CD | GLU | C | 150 | −28.365 | −57.400 | 105.210 | 1.00 | 38.78 | C |
| ATOM | 4423 | OE1 | GLU | C | 150 | −27.573 | −56.543 | 105.699 | 1.00 | 37.11 | O |
| ATOM | 4424 | OE2 | GLU | C | 150 | −29.512 | −57.629 | 105.680 | 1.00 | 39.42 | O1− |
| ATOM | 4425 | N | PRO | C | 151 | −31.930 | −57.571 | 101.855 | 1.00 | 28.20 | N |
| ATOM | 4426 | CA | PRO | C | 151 | −32.224 | −57.019 | 103.180 | 1.00 | 28.76 | C |
| ATOM | 4427 | C | PRO | C | 151 | −33.460 | −57.594 | 103.883 | 1.00 | 32.34 | C |
| ATOM | 4428 | O | PRO | C | 151 | −34.284 | −58.288 | 103.291 | 1.00 | 27.74 | O |
| ATOM | 4429 | CB | PRO | C | 151 | −32.488 | −55.554 | 102.867 | 1.00 | 21.65 | C |
| ATOM | 4430 | CG | PRO | C | 151 | −33.145 | −55.605 | 101.554 | 1.00 | 15.86 | C |
| ATOM | 4431 | CD | PRO | C | 151 | −32.640 | −56.807 | 100.810 | 1.00 | 20.18 | C |
| ATOM | 4432 | N | VAL | C | 152 | −33.572 | −57.269 | 105.165 | 1.00 | 31.09 | N |
| ATOM | 4433 | CA | VAL | C | 152 | −34.798 | −57.431 | 105.925 | 1.00 | 31.79 | C |
| ATOM | 4434 | C | VAL | C | 152 | −35.215 | −56.053 | 106.399 | 1.00 | 32.70 | C |
| ATOM | 4435 | O | VAL | C | 152 | −34.378 | −55.174 | 106.625 | 1.00 | 38.99 | O |
| ATOM | 4436 | CB | VAL | C | 152 | −34.616 | −58.366 | 107.130 | 1.00 | 32.39 | C |
| ATOM | 4437 | CG1 | VAL | C | 152 | −34.480 | −59.798 | 106.688 | 1.00 | 34.75 | |
| ATOM | 4438 | CG2 | VAL | C | 152 | −33.386 | −57.962 | 107.854 | 1.00 | 32.91 | |
| ATOM | 4439 | N | THR | C | 153 | −36.513 | −55.863 | 106.552 | 1.00 | 30.59 | N |
| ATOM | 4440 | CA | THR | C | 153 | −37.032 | −54.660 | 107.178 | 1.00 | 33.61 | C |
| ATOM | 4441 | C | THR | C | 153 | −37.799 | −55.060 | 108.426 | 1.00 | 32.20 | C |
| ATOM | 4442 | O | THR | C | 153 | −38.455 | −56.108 | 108.450 | 1.00 | 30.80 | O |
| ATOM | 4443 | CB | THR | C | 153 | −37.918 | −53.848 | 106.212 | 1.00 | 32.33 | C |
| ATOM | 4444 | OG1 | THR | C | 153 | −38.950 | −54.679 | 105.683 | 1.00 | 37.08 | O |
| ATOM | 4445 | CG2 | THR | C | 153 | −37.089 | −53.315 | 105.061 | 1.00 | 33.42 | C |
| ATOM | 4446 | N | VAL | C | 154 | −37.709 | −54.221 | 109.459 | 1.00 | 27.86 | N |
| ATOM | 4447 | CA | VAL | C | 154 | −38.401 | −54.438 | 110.727 | 1.00 | 29.82 | C |
| ATOM | 4448 | C | VAL | C | 154 | −39.162 | −53.168 | 111.090 | 1.00 | 26.12 | C |
| ATOM | 4449 | O | VAL | C | 154 | −38.574 | −52.085 | 111.121 | 1.00 | 30.95 | O |
| ATOM | 4450 | CB | VAL | C | 154 | −37.414 | −54.808 | 111.861 | 1.00 | 29.46 | C |
| ATOM | 4451 | CG1 | VAL | C | 154 | −38.155 | −55.064 | 113.142 | 1.00 | 29.26 | C |
| ATOM | 4452 | CG2 | VAL | C | 154 | −36.547 | −56.023 | 111.485 | 1.00 | 24.20 | C |
| ATOM | 4453 | N | SER | C | 155 | −40.459 | −53.293 | 111.373 | 1.00 | 28.07 | N |
| ATOM | 4454 | CA | SER | C | 155 | −41.207 | −52.221 | 112.033 | 1.00 | 29.61 | C |
| ATOM | 4455 | C | SER | C | 155 | −41.832 | −52.750 | 113.315 | 1.00 | 35.01 | C |
| ATOM | 4456 | O | SER | C | 155 | −41.790 | −53.949 | 113.616 | 1.00 | 36.17 | O |
| ATOM | 4457 | CB | SER | C | 155 | −42.310 | −51.632 | 111.151 | 1.00 | 25.87 | C |
| ATOM | 4458 | OG | SER | C | 155 | −43.302 | −52.591 | 110.859 | 1.00 | 28.75 | O |

TABLE 10.4-continued

| | | | | | | | | | | |
|---|---|---|---|---|---|---|---|---|---|---|
| ATOM | 4459 | N | TRP | C | 156 | −42.424 | −51.846 | 114.080 | 1.00 | 29.64 | N |
| ATOM | 4460 | CA | TRP | C | 156 | −43.029 | −52.229 | 115.344 | 1.00 | 33.60 | C |
| ATOM | 4461 | C | TRP | C | 156 | −44.490 | −51.793 | 115.369 | 1.00 | 34.15 | C |
| ATOM | 4462 | O | TRP | C | 156 | −44.813 | −50.652 | 115.017 | 1.00 | 33.36 | O |
| ATOM | 4463 | CB | TRP | C | 156 | −42.226 | −51.655 | 116.514 | 1.00 | 31.35 | C |
| ATOM | 4464 | CG | TRP | C | 156 | −40.969 | −52.463 | 116.781 | 1.00 | 31.98 | C |
| ATOM | 4465 | CD1 | TRP | C | 156 | −39.734 | −52.302 | 116.196 | 1.00 | 33.14 | C |
| ATOM | 4466 | CD2 | TRP | C | 156 | −40.836 | −53.564 | 117.686 | 1.00 | 30.45 | C |
| ATOM | 4467 | NE1 | TRP | C | 156 | −38.849 | −53.230 | 116.690 | 1.00 | 25.96 | N |
| ATOM | 4468 | CE2 | TRP | C | 156 | −39.498 | −54.008 | 117.616 | 1.00 | 30.62 | C |
| ATOM | 4469 | CE3 | TRP | C | 156 | −41.717 | −54.213 | 118.566 | 1.00 | 32.88 | C |
| ATOM | 4470 | CZ2 | TRP | C | 156 | −39.025 | −55.076 | 118.391 | 1.00 | 31.18 | C |
| ATOM | 4471 | CZ3 | TRP | C | 156 | −41.243 | −55.274 | 119.341 | 1.00 | 27.61 | C |
| ATOM | 4472 | CH2 | TRP | C | 156 | −39.914 | −55.694 | 119.242 | 1.00 | 30.88 | C |
| ATOM | 4473 | N | ASN | C | 157 | −45.370 | −52.719 | 115.757 | 1.00 | 34.57 | N |
| ATOM | 4474 | CA | ASN | C | 157 | −46.805 | −52.459 | 115.826 | 1.00 | 28.72 | C |
| ATOM | 4475 | C | ASN | C | 157 | −47.299 | −51.895 | 114.495 | 1.00 | 36.26 | C |
| ATOM | 4476 | O | ASN | C | 157 | −47.997 | −50.880 | 114.432 | 1.00 | 35.07 | O |
| ATOM | 4477 | CB | ASN | C | 157 | −47.133 | −51.515 | 116.989 | 1.00 | 31.99 | C |
| ATOM | 4478 | CG | ASN | C | 157 | −46.897 | −52.156 | 118.368 | 1.00 | 33.31 | C |
| ATOM | 4479 | OD1 | ASN | C | 157 | −46.496 | −53.318 | 118.479 | 1.00 | 34.80 | O |
| ATOM | 4480 | ND2 | ASN | C | 157 | −47.136 | −51.387 | 119.418 | 1.00 | 32.04 | N |
| ATOM | 4481 | N | SER | C | 158 | −46.870 | −52.540 | 113.410 | 1.00 | 39.26 | N |
| ATOM | 4482 | CA | SER | C | 158 | −47.310 | −52.190 | 112.062 | 1.00 | 36.22 | C |
| ATOM | 4483 | C | SER | C | 158 | −46.991 | −50.739 | 111.719 | 1.00 | 35.47 | C |
| ATOM | 4484 | O | SER | C | 158 | −47.673 | −50.119 | 110.908 | 1.00 | 39.31 | O |
| ATOM | 4485 | CB | SER | C | 158 | −48.807 | −52.459 | 111.895 | 1.00 | 33.86 | C |
| ATOM | 4486 | OG | SER | C | 158 | −49.145 | −53.743 | 112.399 | 1.00 | 43.34 | O |
| ATOM | 4487 | N | GLY | C | 159 | −45.938 | −50.192 | 112.306 | 1.00 | 35.45 | N |
| ATOM | 4488 | CA | GLY | C | 159 | −45.566 | −48.813 | 112.078 | 1.00 | 33.17 | C |
| ATOM | 4489 | C | GLY | C | 159 | −46.053 | −47.833 | 113.124 | 1.00 | 36.82 | C |
| ATOM | 4490 | O | GLY | C | 159 | −45.608 | −46.684 | 113.114 | 1.00 | 41.61 | O |
| ATOM | 4491 | N | ALA | C | 160 | −46.919 | −48.260 | 114.048 | 1.00 | 38.45 | N |
| ATOM | 4492 | CA | ALA | C | 160 | −47.469 | −47.347 | 115.047 | 1.00 | 32.99 | C |
| ATOM | 4493 | C | ALA | C | 160 | −46.449 | −46.967 | 116.108 | 1.00 | 41.51 | C |
| ATOM | 4494 | O | ALA | C | 160 | −46.566 | −45.903 | 116.718 | 1.00 | 49.03 | O |
| ATOM | 4495 | CB | ALA | C | 160 | −48.695 | −47.977 | 115.719 | 1.00 | 29.64 | C |
| ATOM | 4496 | N | LEU | C | 161 | −45.463 | −47.818 | 116.362 | 1.00 | 40.25 | N |
| ATOM | 4497 | CA | LEU | C | 161 | −44.450 | −47.562 | 117.372 | 1.00 | 30.64 | C |
| ATOM | 4498 | C | LEU | C | 161 | −43.161 | −47.174 | 116.659 | 1.00 | 33.32 | C |
| ATOM | 4499 | O | LEU | C | 161 | −42.702 | −47.877 | 115.757 | 1.00 | 31.89 | O |
| ATOM | 4500 | CB | LEU | C | 161 | −44.269 | −48.786 | 118.270 | 1.00 | 31.29 | C |
| ATOM | 4501 | CG | LEU | C | 161 | −43.229 | −48.759 | 119.395 | 1.00 | 38.45 | C |
| ATOM | 4502 | CD1 | LEU | C | 161 | −43.249 | −47.451 | 120.164 | 1.00 | 23.88 | C |
| ATOM | 4503 | CD2 | LEU | C | 161 | −43.494 | −49.922 | 120.328 | 1.00 | 32.82 | C |
| ATOM | 4504 | N | THR | C | 162 | −42.606 | −46.032 | 117.032 | 1.00 | 37.42 | N |
| ATOM | 4505 | CA | THR | C | 162 | −41.535 | −45.418 | 116.262 | 1.00 | 33.06 | C |
| ATOM | 4506 | C | THR | C | 162 | −40.497 | −44.859 | 117.219 | 1.00 | 29.92 | C |
| ATOM | 4507 | O | THR | C | 162 | −39.296 | −45.096 | 117.071 | 1.00 | 28.52 | O |
| ATOM | 4508 | CB | THR | C | 162 | −42.139 | −44.328 | 115.362 | 1.00 | 36.32 | C |
| ATOM | 4509 | OG1 | THR | C | 162 | −42.104 | −44.761 | 113.998 | 1.00 | 34.07 | O |
| ATOM | 4510 | CG2 | THR | C | 162 | −41.443 | −42.968 | 115.527 | 1.00 | 36.07 | C |
| ATOM | 4511 | N | SER | C | 163 | −40.981 | −44.153 | 118.234 | 1.00 | 30.45 | N |
| ATOM | 4512 | CA | SER | C | 163 | −40.121 | −43.634 | 119.272 | 1.00 | 26.52 | C |
| ATOM | 4513 | C | SER | C | 163 | −39.452 | −44.780 | 120.014 | 1.00 | 30.83 | C |
| ATOM | 4514 | O | SER | C | 163 | −40.117 | −45.724 | 120.461 | 1.00 | 32.58 | O |
| ATOM | 4515 | CB | SER | C | 163 | −40.954 | −42.786 | 120.226 | 1.00 | 28.23 | C |
| ATOM | 4516 | OG | SER | C | 163 | −40.230 | −42.404 | 121.384 | 1.00 | 40.32 | O |
| ATOM | 4517 | N | GLY | C | 164 | −38.137 | −44.673 | 120.178 | 1.00 | 30.58 | N |
| ATOM | 4518 | CA | GLY | C | 164 | −37.364 | −45.625 | 120.941 | 1.00 | 29.23 | C |
| ATOM | 4519 | C | GLY | C | 164 | −36.839 | −46.804 | 120.153 | 1.00 | 31.45 | C |
| ATOM | 4520 | O | GLY | C | 164 | −36.059 | −47.589 | 120.704 | 1.00 | 33.69 | O |
| ATOM | 4521 | N | VAL | C | 165 | −37.207 | −46.930 | 118.878 | 1.00 | 27.51 | N |
| ATOM | 4522 | CA | VAL | C | 165 | −36.793 | −48.069 | 118.070 | 1.00 | 28.93 | C |
| ATOM | 4523 | C | VAL | C | 165 | −35.357 | −47.887 | 117.587 | 1.00 | 28.12 | C |
| ATOM | 4524 | O | VAL | C | 165 | −34.979 | −46.831 | 117.081 | 1.00 | 37.17 | O |
| ATOM | 4525 | CB | VAL | C | 165 | −37.748 | −48.269 | 116.884 | 1.00 | 26.69 | C |
| ATOM | 4526 | CG1 | VAL | C | 165 | −37.278 | −49.432 | 116.023 | 1.00 | 24.04 | C |
| ATOM | 4527 | CG2 | VAL | C | 165 | −39.163 | −48.502 | 117.367 | 1.00 | 24.09 | C |
| ATOM | 4528 | N | HIS | C | 166 | −34.566 | −48.942 | 117.693 | 1.00 | 30.28 | N |
| ATOM | 4529 | CA | HIS | C | 166 | −33.290 | −49.052 | 116.999 | 1.00 | 27.00 | C |
| ATOM | 4530 | C | HIS | C | 166 | −33.270 | −50.379 | 116.259 | 1.00 | 23.79 | C |
| ATOM | 4531 | O | HIS | C | 166 | −33.286 | −51.436 | 116.895 | 1.00 | 25.39 | O |
| ATOM | 4532 | CB | HIS | C | 166 | −32.105 | −49.007 | 117.975 | 1.00 | 27.83 | C |
| ATOM | 4533 | CG | HIS | C | 166 | −32.009 | −47.759 | 118.809 | 1.00 | 31.08 | C |
| ATOM | 4534 | ND1 | HIS | C | 166 | −31.757 | −46.516 | 118.271 | 1.00 | 32.94 | N |
| ATOM | 4535 | CD2 | HIS | C | 166 | −32.070 | −47.578 | 120.153 | 1.00 | 30.56 | C |
| ATOM | 4536 | CE1 | HIS | C | 166 | −31.681 | −45.622 | 119.242 | 1.00 | 30.93 | C |
| ATOM | 4537 | NE2 | HIS | C | 166 | −31.861 | −46.242 | 120.395 | 1.00 | 27.04 | N |
| ATOM | 4538 | N | THR | C | 167 | −33.209 | −50.338 | 114.928 | 1.00 | 24.71 | N |

TABLE 10.4-continued

| | | | | | | | | | | |
|---|---|---|---|---|---|---|---|---|---|---|
| ATOM | 4539 | CA | THR | C | 167 | −32.896 | −51.526 | 114.139 | 1.00 | 22.25 | C |
| ATOM | 4540 | C | THR | C | 167 | −31.455 | −51.439 | 113.637 | 1.00 | 24.53 | C |
| ATOM | 4541 | O | THR | C | 167 | −31.093 | −50.498 | 112.927 | 1.00 | 26.79 | O |
| ATOM | 4542 | CB | THR | C | 167 | −33.857 | −51.694 | 112.980 | 1.00 | 20.41 | C |
| ATOM | 4543 | OG1 | THR | C | 167 | −35.176 | −51.829 | 113.501 | 1.00 | 28.97 | O |
| ATOM | 4544 | CG2 | THR | C | 167 | −33.529 | −52.967 | 112.219 | 1.00 | 21.90 | C |
| ATOM | 4545 | N | PHE | C | 168 | −30.658 | −52.417 | 113.986 | 1.00 | 25.58 | N |
| ATOM | 4546 | CA | PHE | C | 168 | −29.210 | −52.471 | 113.865 | 1.00 | 26.05 | C |
| ATOM | 4547 | C | PHE | C | 168 | −28.807 | −53.018 | 112.505 | 1.00 | 21.09 | C |
| ATOM | 4548 | O | PHE | C | 168 | −29.560 | −53.760 | 111.890 | 1.00 | 25.00 | O |
| ATOM | 4549 | CB | PHE | C | 168 | −28.623 | −53.352 | 114.969 | 1.00 | 23.55 | C |
| ATOM | 4550 | CG | PHE | C | 168 | −28.681 | −52.722 | 116.316 | 1.00 | 22.06 | C |
| ATOM | 4551 | CD1 | PHE | C | 168 | −29.812 | −52.855 | 117.113 | 1.00 | 23.76 | C |
| ATOM | 4552 | CD2 | PHE | C | 168 | −27.617 | −51.958 | 116.788 | 1.00 | 24.14 | C |
| ATOM | 4553 | CE1 | PHE | C | 168 | −29.892 | −52.232 | 118.390 | 1.00 | 24.66 | C |
| ATOM | 4554 | CE2 | PHE | C | 168 | −27.683 | −51.341 | 118.064 | 1.00 | 28.11 | C |
| ATOM | 4555 | CZ | PHE | C | 168 | −28.828 | −51.482 | 118.866 | 1.00 | 22.06 | C |
| ATOM | 4556 | N | PRO | C | 169 | −27.626 | −52.662 | 112.009 | 1.00 | 26.60 | N |
| ATOM | 4557 | CA | PRO | C | 169 | −27.121 | −53.295 | 110.778 | 1.00 | 25.79 | C |
| ATOM | 4558 | C | PRO | C | 169 | −26.907 | −54.793 | 110.988 | 1.00 | 26.33 | C |
| ATOM | 4559 | O | PRO | C | 169 | −26.457 | −55.228 | 112.050 | 1.00 | 23.48 | O |
| ATOM | 4560 | CB | PRO | C | 169 | −25.790 | −52.569 | 110.525 | 1.00 | 17.06 | C |
| ATOM | 4561 | CG | PRO | C | 169 | −25.829 | −51.348 | 111.350 | 1.00 | 17.09 | C |
| ATOM | 4562 | CD | PRO | C | 169 | −26.686 | −51.660 | 112.546 | 1.00 | 22.12 | C |
| ATOM | 4563 | N | ALA | C | 170 | −27.222 | −55.586 | 109.966 | 1.00 | 23.48 | N |
| ATOM | 4564 | CA | ALA | C | 170 | −27.009 | −57.027 | 110.064 | 1.00 | 26.56 | C |
| ATOM | 4565 | C | ALA | C | 170 | −25.523 | −57.369 | 110.178 | 1.00 | 25.54 | C |
| ATOM | 4566 | O | ALA | C | 170 | −24.650 | −56.604 | 109.782 | 1.00 | 26.69 | O |
| ATOM | 4567 | CB | ALA | C | 170 | −27.591 | −57.744 | 108.847 | 1.00 | 29.48 | C |
| ATOM | 4568 | N | VAL | C | 171 | −25.237 | −58.531 | 110.747 | 1.00 | 26.07 | N |
| ATOM | 4569 | CA | VAL | C | 171 | −23.899 | −59.104 | 110.683 | 1.00 | 24.19 | C |
| ATOM | 4570 | C | VAL | C | 171 | −23.934 | −60.333 | 109.789 | 1.00 | 26.45 | C |
| ATOM | 4571 | O | VAL | C | 171 | −24.935 | −61.047 | 109.711 | 1.00 | 31.14 | O |
| ATOM | 4572 | CB | VAL | C | 171 | −23.315 | −59.455 | 112.072 | 1.00 | 29.65 | C |
| ATOM | 4573 | CG1 | VAL | C | 171 | −23.042 | −58.193 | 112.858 | 1.00 | 27.11 | C |
| ATOM | 4574 | CG2 | VAL | C | 171 | −24.254 | −60.404 | 112.853 | 1.00 | 25.85 | C |
| ATOM | 4575 | N | LEU | C | 172 | −22.832 | −60.571 | 109.101 | 1.00 | 31.64 | N |
| ATOM | 4576 | CA | LEU | C | 172 | −22.658 | −61.767 | 108.288 | 1.00 | 28.57 | C |
| ATOM | 4577 | C | LEU | C | 172 | −21.868 | −62.750 | 109.143 | 1.00 | 26.67 | C |
| ATOM | 4578 | O | LEU | C | 172 | −20.718 | −62.492 | 109.489 | 1.00 | 30.87 | O |
| ATOM | 4579 | CB | LEU | C | 172 | −21.937 | −61.442 | 106.982 | 1.00 | 27.30 | C |
| ATOM | 4580 | CG | LEU | C | 172 | −21.662 | −62.583 | 105.992 | 1.00 | 32.63 | C |
| ATOM | 4581 | CD1 | LEU | C | 172 | −22.971 | −63.245 | 105.549 | 1.00 | 26.83 | C |
| ATOM | 4582 | CD2 | LEU | C | 172 | −20.839 | −62.101 | 104.772 | 1.00 | 28.21 | C |
| ATOM | 4583 | N | GLN | C | 173 | −22.503 | −63.845 | 109.522 | 1.00 | 27.90 | N |
| ATOM | 4584 | CA | GLN | C | 173 | −21.916 | −64.862 | 110.372 | 1.00 | 32.35 | C |
| ATOM | 4585 | C | GLN | C | 173 | −21.087 | −65.824 | 109.528 | 1.00 | 36.44 | C |
| ATOM | 4586 | O | GLN | C | 173 | −21.204 | −65.870 | 108.294 | 1.00 | 34.30 | O |
| ATOM | 4587 | CB | GLN | C | 173 | −23.010 | −65.632 | 111.111 | 1.00 | 33.56 | C |
| ATOM | 4588 | CG | GLN | C | 173 | −23.996 | −64.769 | 111.851 | 1.00 | 29.57 | C |
| ATOM | 4589 | CD | GLN | C | 173 | −25.319 | −65.478 | 112.079 | 1.00 | 34.07 | C |
| ATOM | 4590 | OE1 | GLN | C | 173 | −25.724 | −65.696 | 113.215 | 1.00 | 34.19 | O |
| ATOM | 4591 | NE2 | GLN | C | 173 | −26.002 | −65.836 | 110.991 | 1.00 | 32.53 | N |
| ATOM | 4592 | N | SER | C | 174 | −20.254 | −66.622 | 110.208 | 1.00 | 36.04 | N |
| ATOM | 4593 | CA | SER | C | 174 | −19.363 | −67.525 | 109.481 | 1.00 | 33.82 | C |
| ATOM | 4594 | C | SER | C | 174 | −20.138 | −68.509 | 108.622 | 1.00 | 32.65 | C |
| ATOM | 4595 | O | SER | C | 174 | −19.561 | −69.087 | 107.697 | 1.00 | 35.26 | O |
| ATOM | 4596 | CB | SER | C | 174 | −18.437 | −68.272 | 110.441 | 1.00 | 31.17 | C |
| ATOM | 4597 | OG | SER | C | 174 | −18.868 | −68.133 | 111.788 | 1.00 | 51.22 | O |
| ATOM | 4598 | N | SER | C | 175 | −31.438 | −68.678 | 108.879 | 1.00 | 30.00 | N |
| ATOM | 4599 | CA | SER | C | 175 | −22.267 | −69.541 | 108.055 | 1.00 | 23.99 | C |
| ATOM | 4600 | C | SER | C | 175 | −22.566 | −68.950 | 106.691 | 1.00 | 33.95 | C |
| ATOM | 4601 | O | SER | C | 175 | −23.018 | −69.689 | 105.810 | 1.00 | 36.33 | O |
| ATOM | 4602 | CB | SER | C | 175 | −23.588 | −69.851 | 108.767 | 1.00 | 31.25 | C |
| ATOM | 4603 | OG | SER | C | 175 | −24.482 | −68.743 | 108.809 | 1.00 | 33.60 | O |
| ATOM | 4604 | N | GLY | C | 176 | −22.299 | −67.659 | 106.473 | 1.00 | 34.11 | N |
| ATOM | 4605 | CA | GLY | C | 176 | −22.780 | −67.006 | 105.275 | 1.00 | 26.57 | C |
| ATOM | 4606 | C | GLY | C | 176 | −24.191 | −66.479 | 105.380 | 1.00 | 33.77 | C |
| ATOM | 4607 | O | GLY | C | 176 | −24.690 | −65.897 | 104.409 | 1.00 | 34.08 | O |
| ATOM | 4608 | N | LEU | C | 177 | −24.857 | −66.682 | 106.515 | 1.00 | 32.19 | N |
| ATOM | 4609 | CA | LEU | C | 177 | −26.185 | −66.145 | 106.765 | 1.00 | 30.75 | C |
| ATOM | 4610 | C | LEU | C | 177 | −26.072 | −64.870 | 107.584 | 1.00 | 33.31 | C |
| ATOM | 4611 | O | LEU | C | 177 | −25.122 | −64.683 | 108.347 | 1.00 | 33.18 | O |
| ATOM | 4612 | CB | LEU | C | 177 | −27.062 | −67.141 | 107.512 | 1.00 | 35.99 | C |
| ATOM | 4613 | CG | LEU | C | 177 | −27.316 | −68.487 | 106.843 | 1.00 | 34.64 | C |
| ATOM | 4614 | CD1 | LEU | C | 177 | −28.208 | −69.291 | 107.732 | 1.00 | 30.71 | C |
| ATOM | 4615 | CD2 | LEU | C | 177 | −27.932 | −68.291 | 105.469 | 1.00 | 29.23 | C |
| ATOM | 4616 | N | TYR | C | 178 | −27.048 | −63.992 | 107.413 | 1.00 | 32.29 | N |
| ATOM | 4617 | CA | TYR | C | 178 | −27.076 | −62.736 | 108.138 | 1.00 | 29.56 | C |
| ATOM | 4618 | C | TYR | C | 178 | −27.923 | −62.834 | 109.408 | 1.00 | 32.53 | C |

TABLE 10.4-continued

| | | | | | | | | | | |
|---|---|---|---|---|---|---|---|---|---|---|
| ATOM | 4619 | O | TYR | C | 178 | −28.819 | −63.665 | 109.535 | 1.00 | 33.61 | O |
| ATOM | 4620 | CB | TYR | C | 178 | −27.616 | −61.627 | 107.249 | 1.00 | 26.03 | C |
| ATOM | 4621 | CG | TYR | C | 178 | −26.708 | −61.260 | 106.096 | 1.00 | 32.82 | C |
| ATOM | 4622 | CD1 | TYR | C | 178 | −25.696 | −60.309 | 106.248 | 1.00 | 25.25 | C |
| ATOM | 4623 | CD2 | TYR | C | 178 | −26.874 | −61.855 | 104.843 | 1.00 | 28.59 | C |
| ATOM | 4624 | CE1 | TYR | C | 178 | −24.890 | −59.978 | 105.188 | 1.00 | 27.51 | C |
| ATOM | 4625 | CE2 | TYR | C | 178 | −26.075 | −61.526 | 103.785 | 1.00 | 25.14 | C |
| ATOM | 4626 | CZ | TYR | C | 178 | −25.085 | −60.589 | 103.952 | 1.00 | 33.10 | C |
| ATOM | 4627 | OH | TYR | C | 178 | −24.299 | −60.260 | 102.873 | 1.00 | 31.54 | O |
| ATOM | 4628 | N | SER | C | 179 | −27.674 | −61.906 | 110.316 | 1.00 | 30.12 | N |
| ATOM | 4629 | CA | SER | C | 179 | −28.377 | −61.836 | 111.580 | 1.00 | 26.37 | C |
| ATOM | 4630 | C | SER | C | 179 | −28.484 | −60.373 | 111.974 | 1.00 | 28.91 | C |
| ATOM | 4631 | O | SER | C | 179 | −27.473 | −59.669 | 112.014 | 1.00 | 33.49 | O |
| ATOM | 4632 | CB | SER | C | 179 | −27.616 | −62.615 | 112.653 | 1.00 | 31.79 | C |
| ATOM | 4633 | OG | SER | C | 179 | −28.434 | −63.550 | 113.310 | 1.00 | 36.87 | O |
| ATOM | 4634 | N | LEU | C | 180 | −29.693 | −59.908 | 112.244 | 1.00 | 24.41 | N |
| ATOM | 4635 | CA | LEU | C | 180 | −29.847 | −58.581 | 112.796 | 1.00 | 26.13 | C |
| ATOM | 4636 | C | LEU | C | 180 | −30.787 | −58.623 | 113.991 | 1.00 | 33.77 | C |
| ATOM | 4637 | O | LEU | C | 180 | −31.507 | −59.597 | 114.238 | 1.00 | 33.18 | O |
| ATOM | 4638 | CB | LEU | C | 180 | −30.340 | −57.570 | 111.757 | 1.00 | 32.63 | C |
| ATOM | 4639 | CG | LEU | C | 180 | −31.742 | −57.362 | 111.177 | 1.00 | 31.41 | C |
| ATOM | 4640 | CD1 | LEU | C | 180 | −32.886 | −57.085 | 112.196 | 1.00 | 23.59 | C |
| ATOM | 4641 | CD2 | LEU | C | 180 | −31.574 | −56.181 | 110.212 | 1.00 | 23.09 | C |
| ATOM | 4642 | N | SER | C | 181 | −30.773 | −57.531 | 114.735 | 1.00 | 33.23 | N |
| ATOM | 4643 | CA | SER | C | 181 | −31.662 | −57.356 | 115.859 | 1.00 | 28.03 | C |
| ATOM | 4644 | C | SER | C | 181 | −32.311 | −55.982 | 115.766 | 1.00 | 26.07 | C |
| ATOM | 4645 | O | SER | C | 181 | −31.777 | −55.063 | 115.154 | 1.00 | 28.63 | O |
| ATOM | 4646 | CB | SER | C | 181 | −30.906 | −57.540 | 117.184 | 1.00 | 30.44 | C |
| ATOM | 4647 | OG | SER | C | 181 | −29.984 | −56.493 | 117.391 | 1.00 | 31.22 | O |
| ATOM | 4648 | N | SER | C | 182 | −33.506 | −55.881 | 116.326 | 1.00 | 27.13 | N |
| ATOM | 4649 | CA | SER | C | 182 | −34.271 | −54.649 | 116.409 | 1.00 | 27.94 | C |
| ATOM | 4650 | C | SER | C | 182 | −34.805 | −54.551 | 117.827 | 1.00 | 28.64 | C |
| ATOM | 4651 | O | SER | C | 182 | −35.302 | −55.543 | 118.363 | 1.00 | 26.17 | O |
| ATOM | 4652 | CB | SER | C | 182 | −35.424 | −54.637 | 115.408 | 1.00 | 25.46 | C |
| ATOM | 4653 | OG | SER | C | 182 | −36.221 | −53.487 | 115.599 | 1.00 | 27.32 | O |
| ATOM | 4654 | N | VAL | C | 183 | −34.683 | −53.373 | 118.446 | 1.00 | 27.27 | N |
| ATOM | 4655 | CA | VAL | C | 183 | −35.089 | −53.201 | 119.837 | 1.00 | 30.94 | C |
| ATOM | 4656 | C | VAL | C | 183 | −35.878 | −51.909 | 120.005 | 1.00 | 30.82 | C |
| ATOM | 4657 | O | VAL | C | 183 | −35.875 | −51.032 | 119.142 | 1.00 | 33.72 | O |
| ATOM | 4658 | CB | VAL | C | 183 | −33.886 | −53.209 | 120.800 | 1.00 | 27.96 | C |
| ATOM | 4659 | CG1 | VAL | C | 183 | −33.091 | −54.486 | 120.621 | 1.00 | 17.87 | C |
| ATOM | 4660 | CG2 | VAL | C | 183 | −33.031 | −51.953 | 120.585 | 1.00 | 29.36 | C |
| ATOM | 4661 | N | VAL | C | 184 | −36.585 | −51.813 | 121.122 | 1.00 | 25.36 | N |
| ATOM | 4662 | CA | VAL | C | 184 | −37.315 | −50.601 | 121.452 | 1.00 | 29.08 | C |
| ATOM | 4663 | C | VAL | C | 184 | −37.320 | −50.459 | 122.968 | 1.00 | 33.22 | C |
| ATOM | 4664 | O | VAL | C | 184 | −37.476 | −51.444 | 123.700 | 1.00 | 34.38 | O |
| ATOM | 4665 | CB | VAL | C | 184 | −38.734 | −50.602 | 120.812 | 1.00 | 30.67 | C |
| ATOM | 4666 | CG1 | VAL | C | 184 | −39.523 | −51.866 | 121.135 | 1.00 | 28.94 | C |
| ATOM | 4667 | CG2 | VAL | C | 184 | −39.531 | −49.352 | 121.221 | 1.00 | 30.72 | C |
| ATOM | 4668 | N | THR | C | 185 | −37.102 | −49.234 | 123.440 | 1.00 | 31.38 | N |
| ATOM | 4669 | CA | THR | C | 185 | −37.213 | −48.922 | 124.854 | 1.00 | 2900 | C |
| ATOM | 4670 | C | THR | C | 185 | −38.591 | −48.319 | 125.074 | 1.00 | 30.90 | C |
| ATOM | 4671 | O | THR | C | 185 | −39.048 | −47.490 | 124.284 | 1.00 | 37.29 | O |
| ATOM | 4672 | CB | THR | C | 185 | −36.102 | −47.977 | 125.330 | 1.00 | 24.92 | C |
| ATOM | 4673 | OG1 | THR | C | 185 | −35.966 | −46.874 | 124.424 | 1.00 | 32.54 | O |
| ATOM | 4674 | CG2 | THR | C | 185 | −34.779 | −48.706 | 125.402 | 1.00 | 26.78 | C |
| ATOM | 4675 | N | VAL | C | 186 | −39.273 | −48.800 | 126.103 | 1.00 | 29.32 | N |
| ATOM | 4676 | CA | VAL | C | 186 | −40.625 | −48.377 | 126.458 | 1.00 | 34.69 | C |
| ATOM | 4677 | C | VAL | C | 186 | −40.698 | −48.292 | 127.970 | 1.00 | 36.57 | C |
| ATOM | 4678 | O | VAL | C | 186 | −39.835 | −48.836 | 128.675 | 1.00 | 34.20 | O |
| ATOM | 4679 | CB | VAL | C | 186 | −41.699 | −49.358 | 125.944 | 1.00 | 36.77 | C |
| ATOM | 4680 | CG1 | VAL | C | 186 | −41.645 | −49.516 | 124.421 | 1.00 | 27.93 | C |
| ATOM | 4681 | CG2 | VAL | C | 186 | −41.571 | −50.715 | 126.679 | 1.00 | 32.35 | C |
| ATOM | 4682 | N | PRO | C | 187 | −41.717 | −47.608 | 128.499 | 1.00 | 38.80 | N |
| ATOM | 4683 | CA | PRO | C | 187 | −41.851 | −47.521 | 129.958 | 1.00 | 40.40 | C |
| ATOM | 4684 | C | PRO | C | 187 | −42.128 | −48.886 | 130.574 | 1.00 | 43.67 | C |
| ATOM | 4685 | O | PRO | C | 187 | −42.872 | −49.703 | 130.024 | 1.00 | 42.12 | O |
| ATOM | 4686 | CB | PRO | C | 187 | −43.033 | −46.566 | 130.145 | 1.00 | 36.03 | C |
| ATOM | 4687 | CG | PRO | C | 187 | −43.095 | −45.798 | 128.889 | 1.00 | 29.12 | C |
| ATOM | 4688 | CD | PRO | C | 187 | −42.697 | −46.739 | 127.820 | 1.00 | 34.04 | C |
| ATOM | 4689 | N | SER | C | 188 | −41.501 | −49.128 | 131.728 | 1.00 | 47.08 | N |
| ATOM | 4690 | CA | SER | C | 188 | −41.753 | −50.348 | 132.489 | 1.00 | 48.24 | C |
| ATOM | 4691 | C | SER | C | 188 | −43.244 | −50.561 | 132.733 | 1.00 | 47.93 | C |
| ATOM | 4692 | O | SER | C | 188 | −43.776 | −51.660 | 132.523 | 1.00 | 45.02 | O |
| ATOM | 4693 | CB | SER | C | 188 | −41.011 | −50.260 | 133.813 | 1.00 | 50.96 | C |
| ATOM | 4694 | OG | SER | C | 188 | −39.631 | −50.377 | 133.576 | 1.00 | 59.84 | O |
| ATOM | 4695 | N | SER | C | 189 | −43.941 | −49.495 | 133.134 | 1.00 | 46.10 | N |
| ATOM | 4696 | CA | SER | C | 189 | −45.363 | −49.574 | 133.444 | 1.00 | 51.64 | C |
| ATOM | 4697 | C | SER | C | 189 | −46.222 | −50.037 | 132.263 | 1.00 | 51.86 | C |
| ATOM | 4698 | O | SER | C | 189 | −47.344 | −50.512 | 132.481 | 1.00 | 58.15 | O |

TABLE 10.4-continued

| | | | | | | | | | | |
|---|---|---|---|---|---|---|---|---|---|---|
| ATOM | 4699 | CB | SER | C | 189 | −45.834 | −48.218 | 133.976 | 1.00 | 51.35 | C |
| ATOM | 4700 | OG | SER | C | 189 | −45.680 | −47.208 | 133.001 | 1.00 | 55.98 | O |
| ATOM | 4701 | N | SER | C | 190 | −45.740 | −49.918 | 131.022 | 1.00 | 51.05 | N |
| ATOM | 4702 | CA | SER | C | 190 | −46.558 | −50.310 | 129.870 | 1.00 | 50.46 | C |
| ATOM | 4703 | C | SER | C | 190 | −46.527 | −51.807 | 129.570 | 1.00 | 49.06 | C |
| ATOM | 4704 | O | SER | C | 190 | −47.396 | −52.279 | 128.830 | 1.00 | 45.72 | O |
| ATOM | 4705 | CB | SER | C | 190 | −46.113 | −49.566 | 128.610 | 1.00 | 40.88 | C |
| ATOM | 4706 | OG | SER | C | 190 | −44.817 | −49.995 | 128.218 | 1.00 | 41.80 | O |
| ATOM | 4707 | N | LEU | C | 191 | −45.553 | −52.559 | 130.096 | 1.00 | 47.92 | N |
| ATOM | 4708 | CA | LEU | C | 191 | −45.508 | −53.993 | 129.838 | 1.00 | 42.80 | C |
| ATOM | 4709 | C | LEU | C | 191 | −46.706 | −54.670 | 130.475 | 1.00 | 48.54 | C |
| ATOM | 4710 | O | LEU | C | 191 | −47.206 | −54.244 | 131.517 | 1.00 | 56.38 | O |
| ATOM | 4711 | CB | LEU | C | 191 | −44.230 | −54.612 | 130.387 | 1.00 | 39.21 | C |
| ATOM | 4712 | CG | LEU | C | 191 | −42.884 | −54.023 | 129.982 | 1.00 | 44.80 | C |
| ATOM | 4713 | CD1 | LEU | C | 191 | −41.792 | −54.654 | 130.804 | 1.00 | 34.81 | C |
| ATOM | 4714 | CD2 | LEU | C | 191 | −42.634 | −54.240 | 128.501 | 1.00 | 37.00 | C |
| ATOM | 4715 | N | GLY | C | 192 | −47.170 | −55.743 | 129.856 | 1.00 | 48.62 | N |
| ATOM | 4716 | CA | GLY | C | 192 | −48.335 | −56.412 | 130.386 | 1.00 | 56.13 | C |
| ATOM | 4717 | C | GLY | C | 192 | −49.643 | −55.692 | 130.132 | 1.00 | 55.78 | C |
| ATOM | 4718 | O | GLY | C | 192 | −50.704 | −56.327 | 130.177 | 1.00 | 56.01 | O |
| ATOM | 4719 | N | THR | C | 193 | −49.601 | −54.388 | 129.869 | 1.00 | 48.97 | N |
| ATOM | 4720 | CA | THR | C | 193 | −50.727 | −53.607 | 129.378 | 1.00 | 49.79 | C |
| ATOM | 4721 | C | THR | C | 193 | −50.644 | −53.332 | 127.883 | 1.00 | 49.11 | C |
| ATOM | 4722 | O | THR | C | 193 | −51.669 | −53.324 | 127.197 | 1.00 | 53.12 | O |
| ATOM | 4723 | CB | THR | C | 193 | −50.780 | −52.266 | 130.114 | 1.00 | 58.23 | C |
| ATOM | 4724 | OG1 | THR | C | 193 | −50.126 | −52.405 | 131.385 | 1.00 | 58.05 | O |
| ATOM | 4725 | CG2 | THR | C | 193 | −52.227 | −51.790 | 130.293 | 1.00 | 53.04 | C |
| ATOM | 4726 | N | GLN | C | 194 | −49.443 | −53.103 | 127.361 | 1.00 | 48.44 | N |
| ATOM | 4727 | CA | GLN | C | 194 | −49.241 | −52.741 | 125.967 | 1.00 | 42.09 | C |
| ATOM | 4728 | C | GLN | C | 194 | −48.676 | −53.911 | 125.177 | 1.00 | 37.51 | C |
| ATOM | 4729 | O | GLN | C | 194 | −47.808 | −54.636 | 125.660 | 1.00 | 40.92 | O |
| ATOM | 4730 | CB | GLN | C | 194 | −48.324 | −51.517 | 125.873 | 1.00 | 43.18 | C |
| ATOM | 4731 | CG | GLN | C | 194 | −48.013 | −51.097 | 124.469 | 1.00 | 46.41 | C |
| ATOM | 4732 | CD | GLN | C | 194 | −49.252 | −50.772 | 123.679 | 1.00 | 49.54 | C |
| ATOM | 4733 | OE1 | GLN | C | 194 | −49.610 | −51.489 | 122.735 | 1.00 | 42.75 | O |
| ATOM | 4734 | NE2 | GLN | C | 194 | −49.939 | −49.707 | 124.080 | 1.00 | 49.73 | N |
| ATOM | 4735 | N | THR | C | 195 | −49.176 | −54.093 | 123.963 | 1.00 | 36.34 | N |
| ATOM | 4736 | CA | THR | C | 195 | −48.744 | −55.181 | 123.101 | 1.00 | 39.27 | C |
| ATOM | 4737 | C | THR | C | 195 | −47.657 | −54.704 | 122.151 | 1.00 | 39.62 | C |
| ATOM | 4738 | O | THR | C | 195 | −47.782 | −53.650 | 121.523 | 1.00 | 38.44 | O |
| ATOM | 4739 | CB | THR | C | 195 | −49.921 | −55.761 | 122.312 | 1.00 | 43.59 | C |
| ATOM | 4740 | OG1 | THR | C | 195 | −50.568 | −56.759 | 123.110 | 1.00 | 42.10 | O |
| ATOM | 4741 | CG2 | THR | C | 195 | −49.470 | −56.364 | 120.984 | 1.00 | 36.94 | C |
| ATOM | 4742 | N | TYR | C | 196 | −46.604 | −55.500 | 122.044 | 1.00 | 39.64 | N |
| ATOM | 4743 | CA | TYR | C | 196 | −45.452 | −55.182 | 121.224 | 1.00 | 31.97 | C |
| ATOM | 4744 | C | TYR | C | 196 | −45.224 | −56.327 | 120.252 | 1.00 | 32.44 | C |
| ATOM | 4745 | O | TYR | C | 196 | −44.912 | −57.445 | 120.668 | 1.00 | 28.81 | O |
| ATOM | 4746 | CB | TYR | C | 196 | −44.231 | −54.930 | 122.098 | 1.00 | 33.73 | C |
| ATOM | 4747 | CG | TYR | C | 196 | −44.426 | −53.737 | 123.002 | 1.00 | 38.32 | C |
| ATOM | 4748 | CD1 | TYR | C | 196 | −44.552 | −52.458 | 122.474 | 1.00 | 33.41 | C |
| ATOM | 4749 | CD2 | TYR | C | 196 | −44.483 | −53.884 | 124.380 | 1.00 | 37.95 | C |
| ATOM | 4750 | CE1 | TYR | C | 196 | −44.728 | −51.370 | 123.289 | 1.00 | 33.25 | C |
| ATOM | 4751 | CE2 | TYR | C | 196 | −44.660 | −52.788 | 125.201 | 1.00 | 36.63 | C |
| ATOM | 4752 | CZ | TYR | C | 196 | −44.781 | −51.541 | 124.647 | 1.00 | 33.58 | C |
| ATOM | 4753 | OH | TYR | C | 196 | −44.966 | −50.453 | 125.459 | 1.00 | 38.73 | O |
| ATOM | 4754 | N | ILE | C | 197 | −45.395 | −56.038 | 118.964 | 1.00 | 31.69 | N |
| ATOM | 4755 | CA | ILE | C | 197 | −45.176 | −56.988 | 117.885 | 1.00 | 31.54 | C |
| ATOM | 4756 | C | ILE | C | 197 | −44.163 | −56.386 | 116.919 | 1.00 | 33.20 | C |
| ATOM | 4757 | O | ILE | C | 197 | −44.321 | −55.239 | 116.484 | 1.00 | 33.69 | O |
| ATOM | 4758 | CB | ILE | C | 197 | −46.476 | −57.288 | 117.131 | 1.00 | 31.06 | C |
| ATOM | 4759 | CG1 | ILE | C | 197 | −47.516 | −57.886 | 118.042 | 1.00 | 33.48 | C |
| ATOM | 4760 | CG2 | ILE | C | 197 | −46.201 | −58.193 | 115.952 | 1.00 | 33.02 | C |
| ATOM | 4761 | CD1 | ILE | C | 197 | −48.862 | −57.783 | 117.425 | 1.00 | 24.92 | C |
| ATOM | 4762 | N | CYS | C | 198 | −43.163 | −57.165 | 116.533 | 1.00 | 28.72 | N |
| ATOM | 4763 | CA | CYS | C | 198 | −42.254 | −56.721 | 115.489 | 1.00 | 25.10 | C |
| ATOM | 4764 | C | CYS | C | 198 | −42.613 | −57.390 | 114.159 | 1.00 | 33.06 | C |
| ATOM | 4765 | O | CYS | C | 198 | −42.986 | −58.566 | 114.107 | 1.00 | 34.76 | O |
| ATOM | 4766 | CB | CYS | C | 198 | −40.798 | −56.986 | 115.869 | 1.00 | 35.03 | C |
| ATOM | 4767 | SG | CYS | C | 198 | −40.302 | −58.637 | 115.586 | 1.00 | 44.99 | S |
| ATOM | 4768 | N | ASN | C | 199 | −42.585 | −56.609 | 113.098 | 1.00 | 28.45 | N |
| ATOM | 4769 | CA | ASN | C | 199 | −43.018 | −57.057 | 111.786 | 1.00 | 29.27 | C |
| ATOM | 4770 | C | ASN | C | 199 | −41.775 | −57.159 | 110.921 | 1.00 | 28.88 | C |
| ATOM | 4771 | O | ASN | C | 199 | −41.126 | −56.148 | 110.645 | 1.00 | 34.72 | O |
| ATOM | 4772 | CB | ASN | C | 199 | −44.058 | −56.094 | 111.214 | 1.00 | 29.40 | C |
| ATOM | 4773 | CG | ASN | C | 199 | −45.068 | −55.631 | 112.274 | 1.00 | 35.22 | C |
| ATOM | 4774 | OD1 | ASN | C | 199 | −45.044 | −54.468 | 112.719 | 1.00 | 33.27 | O |
| ATOM | 4775 | ND2 | ASN | C | 199 | −45.951 | −56.546 | 112.693 | 1.00 | 28.65 | N |
| ATOM | 4776 | N | VAL | C | 200 | −41.435 | −58.381 | 110.521 | 1.00 | 26.15 | N |
| ATOM | 4777 | CA | VAL | C | 200 | −40.230 | −58.679 | 109.758 | 1.00 | 28.67 | C |
| ATOM | 4778 | C | VAL | C | 200 | −40.617 | −59.030 | 108.329 | 1.00 | 30.60 | C |

TABLE 10.4-continued

| | | | | | | | | | | |
|---|---|---|---|---|---|---|---|---|---|---|
| ATOM | 4779 | O | VAL | C | 200 | −41.478 | −59.890 | 108.106 | 1.00 | 28.53 | O |
| ATOM | 4780 | CB | VAL | C | 200 | −39.450 | −59.841 | 110.388 | 1.00 | 21.99 | C |
| ATOM | 4781 | CG1 | VAL | C | 200 | −38.183 | −60.065 | 109.624 | 1.00 | 27.77 | C |
| ATOM | 4782 | CG2 | VAL | C | 200 | −39.182 | −59.577 | 111.849 | 1.00 | 26.33 | C |
| ATOM | 4783 | N | ASN | C | 201 | −39.960 | −58.406 | 107.359 | 1.00 | 31.19 | N |
| ATOM | 4784 | CA | ASN | C | 201 | −40.153 | −58.800 | 105.970 | 1.00 | 33.45 | C |
| ATOM | 4785 | C | ASN | C | 201 | −38.805 | −59.085 | 105.341 | 1.00 | 35.94 | C |
| ATOM | 4786 | O | ASN | C | 201 | −37.952 | −58.195 | 105.238 | 1.00 | 38.25 | O |
| ATOM | 4787 | CB | ASN | C | 201 | −40.899 | −57.739 | 105.160 | 1.00 | 34.65 | C |
| ATOM | 4788 | CG | ASN | C | 201 | −41.430 | −58.284 | 103.832 | 1.00 | 38.40 | C |
| ATOM | 4789 | OD1 | ASN | C | 201 | −42.045 | −57.555 | 103.074 | 1.00 | 47.99 | O |
| ATOM | 4790 | ND2 | ASN | C | 201 | −41.203 | −59.568 | 103.557 | 1.00 | 39.32 | N |
| ATOM | 4791 | N | HIS | C | 202 | −38.630 | −60.310 | 104.893 | 1.00 | 35.27 | N |
| ATOM | 4792 | CA | HIS | C | 202 | −37.474 | −60.692 | 104.107 | 1.00 | 32.39 | C |
| ATOM | 4793 | C | HIS | C | 202 | −38.047 | −60.925 | 102.719 | 1.00 | 34.80 | C |
| ATOM | 4794 | O | HIS | C | 202 | −38.424 | −62.043 | 102.375 | 1.00 | 35.23 | O |
| ATOM | 4795 | CB | HIS | C | 202 | −36.777 | −61.922 | 104.669 | 1.00 | 29.35 | C |
| ATOM | 4796 | CG | HIS | C | 202 | −35.529 | −62.276 | 103.935 | 1.00 | 32.95 | C |
| ATOM | 4797 | ND1 | HIS | C | 202 | −35.318 | −63.520 | 103.385 | 1.00 | 37.12 | N |
| ATOM | 4798 | CD2 | HIS | C | 202 | −34.440 | −61.537 | 103.623 | 1.00 | 31.23 | C |
| ATOM | 4799 | CE1 | HIS | C | 202 | −34.145 | −63.538 | 102.778 | 1.00 | 33.20 | C |
| ATOM | 4800 | NE2 | HIS | C | 202 | −33.593 | −62.346 | 102.905 | 1.00 | 32.51 | N |
| ATOM | 4801 | N | LYS | C | 203 | −38.159 | −59.837 | 101.948 | 1.00 | 37.66 | N |
| ATOM | 4802 | CA | LYS | C | 203 | −38.635 | −59.928 | 100.569 | 1.00 | 34.00 | C |
| ATOM | 4803 | C | LYS | C | 203 | −37.907 | −60.983 | 99.750 | 1.00 | 36.61 | C |
| ATOM | 4804 | O | LYS | C | 203 | −38.585 | −61.707 | 99.002 | 1.00 | 36.77 | O |
| ATOM | 4805 | CB | LYS | C | 203 | −38.464 | −58.583 | 99.854 | 1.00 | 31.21 | C |
| ATOM | 4806 | CG | LYS | C | 203 | −39.438 | −57.458 | 100.162 | 1.00 | 39.44 | C |
| ATOM | 4807 | CD | LYS | C | 203 | −40.808 | −57.621 | 99.534 | 1.00 | 41.59 | C |
| ATOM | 4808 | CE | LYS | C | 203 | −41.815 | −56.681 | 100.199 | 1.00 | 47.06 | C |
| ATOM | 4809 | NZ | LYS | C | 203 | −41.248 | −55.297 | 100.259 | 1.00 | 45.84 | N1+ |
| ATOM | 4810 | N | PRO | C | 204 | −36.574 | −61.155 | 99.854 | 1.00 | 38.41 | N |
| ATOM | 4811 | CA | PRO | C | 204 | −35.907 | −62.124 | 98.962 | 1.00 | 33.23 | C |
| ATOM | 4812 | C | PRO | C | 204 | −36.392 | −63.552 | 99.111 | 1.00 | 37.59 | C |
| ATOM | 4813 | O | PRO | C | 204 | −36.358 | −64.297 | 98.129 | 1.00 | 44.57 | O |
| ATOM | 4814 | CB | PRO | C | 204 | −34.425 | −61.994 | 99.342 | 1.00 | 28.63 | C |
| ATOM | 4815 | CG | PRO | C | 204 | −34.306 | −60.634 | 99.898 | 1.00 | 32.37 | C |
| ATOM | 4816 | CD | PRO | C | 204 | −35.587 | −60.346 | 100.603 | 1.00 | 28.15 | C |
| ATOM | 4817 | N | SER | C | 205 | −36.857 | −63.964 | 100.287 | 1.00 | 37.25 | N |
| ATOM | 4818 | CA | SER | C | 205 | −37.381 | −65.312 | 100.469 | 1.00 | 37.14 | C |
| ATOM | 4819 | C | SER | C | 205 | −38.895 | −65.320 | 100.574 | 1.00 | 38.83 | C |
| ATOM | 4820 | O | SER | C | 205 | −39.480 | −66.367 | 100.869 | 1.00 | 37.58 | O |
| ATOM | 4821 | CB | SER | C | 205 | −36.771 | −65.936 | 101.709 | 1.00 | 37.91 | C |
| ATOM | 4822 | OG | SER | C | 205 | −37.253 | −65.348 | 102.893 | 1.00 | 33.36 | O |
| ATOM | 4823 | N | ASN | C | 206 | −39.532 | −64.173 | 100.334 | 1.00 | 40.37 | N |
| ATOM | 4824 | CA | ASN | C | 206 | −40.974 | −63.989 | 100.466 | 1.00 | 40.89 | C |
| ATOM | 4825 | C | ASN | C | 206 | −41.484 | −64.469 | 101.827 | 1.00 | 44.23 | C |
| ATOM | 4826 | O | ASN | C | 206 | −42.478 | −65.192 | 101.926 | 1.00 | 46.80 | O |
| ATOM | 4827 | CB | ASN | C | 206 | −41.703 | −64.684 | 99.332 | 1.00 | 49.25 | C |
| ATOM | 4828 | CG | ASN | C | 206 | −42.643 | −63.766 | 98.626 | 1.00 | 60.95 | C |
| ATOM | 4829 | OD1 | ASN | C | 206 | −42.272 | −63.130 | 97.632 | 1.00 | 64.04 | O |
| ATOM | 4830 | ND2 | ASN | C | 206 | −43.871 | −63.660 | 99.141 | 1.00 | 62.21 | N |
| ATOM | 4831 | N | THR | C | 207 | −40.773 | −64.069 | 102.880 | 1.00 | 37.63 | N |
| ATOM | 4832 | CA | THR | C | 207 | −41.070 | −64.446 | 104.256 | 1.00 | 33.70 | C |
| ATOM | 4833 | C | THR | C | 207 | −41.518 | −63.223 | 105.044 | 1.00 | 35.76 | C |
| ATOM | 4834 | O | THR | C | 207 | −40.806 | −62.218 | 105.096 | 1.00 | 34.16 | O |
| ATOM | 4835 | CB | THR | C | 207 | −39.844 | −65.055 | 104.920 | 1.00 | 30.61 | C |
| ATOM | 4836 | OG1 | THR | C | 207 | −39.390 | −66.163 | 104.140 | 1.00 | 32.93 | O |
| ATOM | 4837 | CG2 | THR | C | 207 | −40.164 | −65.490 | 106.323 | 1.00 | 30.98 | C |
| ATOM | 4838 | N | LYS | C | 208 | −42.686 | −63.311 | 105.663 | 1.00 | 35.22 | N |
| ATOM | 4839 | CA | LYS | C | 208 | −43.154 | −62.277 | 106.565 | 1.00 | 31.98 | C |
| ATOM | 4840 | C | LYS | C | 208 | −43.461 | −62.906 | 107.915 | 1.00 | 33.42 | C |
| ATOM | 4841 | O | LYS | C | 208 | −44.079 | −63.966 | 107.977 | 1.00 | 34.80 | O |
| ATOM | 4842 | CB | LYS | C | 208 | −44.375 | −61.587 | 105.990 | 1.00 | 29.96 | C |
| ATOM | 4843 | CG | LYS | C | 208 | −44.038 | −60.590 | 104.902 | 1.00 | 34.70 | C |
| ATOM | 4844 | CD | LYS | C | 208 | −45.215 | −59.721 | 104.524 | 1.00 | 37.48 | C |
| ATOM | 4845 | CE | LYS | C | 208 | −46.304 | −60.544 | 103.838 | 1.00 | 44.32 | C |
| ATOM | 4846 | NZ | LYS | C | 208 | −47.529 | −59.739 | 103.513 | 1.00 | 56.22 | N1+ |
| ATOM | 4847 | N | VAL | C | 209 | −43.064 | −62.232 | 108.994 | 1.00 | 29.95 | N |
| ATOM | 4848 | CA | VAL | C | 209 | −43.234 | −62.745 | 110.348 | 1.00 | 29.28 | C |
| ATOM | 4849 | C | VAL | C | 209 | −43.711 | −61.614 | 111.255 | 1.00 | 31.89 | C |
| ATOM | 4850 | O | VAL | C | 209 | −43.177 | −60.501 | 111.209 | 1.00 | 33.86 | O |
| ATOM | 4851 | CB | VAL | C | 209 | −41.930 | −63.382 | 110.883 | 1.00 | 29.99 | C |
| ATOM | 4852 | CG1 | VAL | C | 209 | −42.024 | −63.631 | 112.364 | 1.00 | 29.51 | C |
| ATOM | 4853 | CG2 | VAL | C | 209 | −41.659 | −64.720 | 110.193 | 1.00 | 28.13 | C |
| ATOM | 4854 | N | ASP | C | 210 | −44.744 | −61.888 | 112.051 | 1.00 | 32.06 | N |
| ATOM | 4855 | CA | ASP | C | 210 | −45.187 | −61.015 | 113.137 | 1.00 | 31.18 | C |
| ATOM | 4856 | C | ASP | C | 210 | −44.963 | −61.720 | 114.466 | 1.00 | 32.54 | C |
| ATOM | 4857 | O | ASP | C | 210 | −45.627 | −62.717 | 114.749 | 1.00 | 37.02 | O |
| ATOM | 4858 | CB | ASP | C | 210 | −46.667 | −60.664 | 112.988 | 1.00 | 32.07 | C |

TABLE 10.4-continued

| | | | | | | | | | | |
|---|---|---|---|---|---|---|---|---|---|---|
| ATOM | 4859 | CG | ASP | C | 210 | −46.950 | −59.774 | 111.779 | 1.00 | 38.99 | C |
| ATOM | 4860 | OD1 | ASP | C | 210 | −46.283 | −58.727 | 111.607 | 1.00 | 38.00 | O |
| ATOM | 4861 | OD2 | ASP | C | 210 | −47.851 | −60.125 | 110.993 | 1.00 | 43.24 | O1− |
| ATOM | 4862 | N | LYS | C | 211 | −44.090 | −61.171 | 115.307 | 1.00 | 28.18 | N |
| ATOM | 4863 | CA | LYS | C | 211 | −43.714 | −61.808 | 116.561 | 1.00 | 27.79 | C |
| ATOM | 4864 | C | LYS | C | 211 | −44.107 | −60.919 | 117.735 | 1.00 | 35.35 | C |
| ATOM | 4865 | O | LYS | C | 211 | −43.646 | −59.778 | 117.840 | 1.00 | 31.15 | O |
| ATOM | 4866 | CB | LYS | C | 211 | −42.214 | −62.112 | 116.591 | 1.00 | 30.51 | C |
| ATOM | 4867 | CG | LYS | C | 211 | −41.695 | −62.682 | 117.906 | 1.00 | 29.62 | C |
| ATOM | 4868 | CD | LYS | C | 211 | −42.354 | −64.008 | 118.183 | 1.00 | 35.84 | C |
| ATOM | 4869 | CE | LYS | C | 211 | −41.473 | −64.913 | 119.014 | 1.00 | 40.39 | C |
| ATOM | 4870 | NZ | LYS | C | 211 | −41.983 | −66.295 | 118.890 | 1.00 | 39.30 | N1+ |
| ATOM | 4871 | N | LYS | C | 212 | −44.971 | −61.439 | 118.608 | 1.00 | 33.29 | N |
| ATOM | 4872 | CA | LYS | C | 212 | −45.256 | −60.779 | 119.867 | 1.00 | 29.95 | C |
| ATOM | 4873 | C | LYS | C | 212 | −44.162 | −61.099 | 120.869 | 1.00 | 33.39 | C |
| ATOM | 4874 | O | LYS | C | 212 | −43.713 | −62.248 | 120.985 | 1.00 | 41.06 | O |
| ATOM | 4875 | CB | LYS | C | 212 | −46.621 | −61.213 | 120.394 | 1.00 | 33.65 | C |
| ATOM | 4876 | CG | LYS | C | 212 | −47.235 | −60.285 | 121.413 | 1.00 | 32.68 | C |
| ATOM | 4877 | CD | LYS | C | 212 | −48.491 | −60.893 | 122.040 | 1.00 | 34.32 | C |
| ATOM | 4878 | CE | LYS | C | 212 | −49.020 | −59.999 | 123.150 | 1.00 | 34.90 | C |
| ATOM | 4879 | NZ | LYS | C | 212 | −50.184 | −60.548 | 123.882 | 1.00 | 52.78 | N1+ |
| ATOM | 4880 | N | VAL | C | 213 | −43.742 | −60.078 | 121.602 | 1.00 | 29.81 | N |
| ATOM | 4881 | CA | VAL | C | 213 | −42.705 | −60.195 | 122.612 | 1.00 | 28.67 | C |
| ATOM | 4882 | C | VAL | C | 213 | −43.332 | −59.803 | 123.948 | 1.00 | 35.48 | C |
| ATOM | 4883 | O | VAL | C | 213 | −43.668 | −58.634 | 124.170 | 1.00 | 34.53 | O |
| ATOM | 4884 | CB | VAL | C | 213 | −41.493 | −59.313 | 122.281 | 1.00 | 34.29 | C |
| ATOM | 4885 | CG1 | VAL | C | 213 | −40.355 | −59.481 | 123.311 | 1.00 | 29.32 | C |
| ATOM | 4886 | CG2 | VAL | C | 213 | −41.022 | −59.563 | 120.861 | 1.00 | 28.07 | C |
| ATOM | 4887 | N | GLU | C | 214 | −43.503 | −60.781 | 124.833 | 1.00 | 43.40 | N |
| ATOM | 4888 | CA | GLU | C | 214 | −44.067 | −60.573 | 126.149 | 1.00 | 43.27 | C |
| ATOM | 4889 | C | GLU | C | 214 | −42.990 | −60.735 | 127.209 | 1.00 | 49.50 | C |
| ATOM | 4890 | O | GLU | C | 214 | −42.011 | −61.461 | 126.997 | 1.00 | 50.46 | O |
| ATOM | 4891 | CB | GLU | C | 214 | −45.206 | −61.558 | 126.434 | 1.00 | 48.02 | C |
| ATOM | 4892 | CG | GLU | C | 214 | −46.365 | −61.449 | 125.439 | 1.00 | 53.85 | C |
| ATOM | 4893 | CG | GLU | C | 214 | −47.489 | −62.450 | 125.686 | 1.00 | 57.28 | C |
| ATOM | 4894 | OE1 | GLU | C | 214 | −48.525 | −62.026 | 126.249 | 1.00 | 58.32 | O |
| ATOM | 4895 | OE2 | GLU | C | 214 | −47.343 | −63.644 | 125.318 | 1.00 | 60.40 | O1− |
| ATOM | 4896 | N | PRO | C | 215 | −43.109 | −60.039 | 128.338 | 1.00 | 50.15 | N |
| ATOM | 4897 | CA | PRO | C | 215 | −42.182 | −60.293 | 129.452 | 1.00 | 50.10 | C |
| ATOM | 4898 | C | PRO | C | 215 | −42.336 | −61.727 | 129.928 | 1.00 | 54.89 | C |
| ATOM | 4899 | O | PRO | C | 215 | −43.450 | −62.225 | 130.077 | 1.00 | 62.80 | O |
| ATOM | 4900 | CB | PRO | C | 215 | −42.606 | −59.277 | 130.515 | 1.00 | 49.74 | C |
| ATOM | 4901 | CG | PRO | C | 215 | −43.879 | −58.612 | 129.977 | 1.00 | 51.15 | C |
| ATOM | 4902 | CD | PRO | C | 215 | −43.892 | −58.805 | 128.515 | 1.00 | 47.22 | C |
| ATOM | 4903 | N | LYS | C | 216 | −41.208 | −62.402 | 130.137 | 1.00 | 59.54 | N |
| ATOM | 4904 | CA | LYS | C | 216 | −41.205 | −63.833 | 130.410 | 1.00 | 68.05 | C |
| ATOM | 4905 | C | LYS | C | 216 | −40.699 | −64.127 | 131.820 | 1.00 | 79.82 | C |
| ATOM | 4906 | O | LYS | C | 216 | −39.755 | −63.482 | 132.304 | 1.00 | 68.19 | O |
| ATOM | 4907 | CB | LYS | C | 216 | −40.371 | −64.581 | 129.359 | 1.00 | 67.81 | C |
| ATOM | 4908 | CG | LYS | C | 216 | −40.384 | −66.093 | 129.519 | 1.00 | 71.95 | C |
| ATOM | 4909 | CD | LYS | C | 216 | −39.957 | −66.793 | 128.233 | 1.00 | 73.44 | C |
| ATOM | 4910 | CE | LYS | C | 216 | −40.151 | −68.301 | 128.345 | 1.00 | 66.41 | C |
| ATOM | 4911 | NZ | LYS | C | 216 | −40.055 | −68.966 | 127.016 | 1.00 | 77.32 | N1+ |
| ATOM | 4912 | N | SER | C | 217 | −41.360 | −65.090 | 132.479 | 1.00 | 86.12 | N |
| ATOM | 4913 | CA | SER | C | 217 | −41.015 | −65.548 | 133.838 | 1.00 | 92.36 | C |
| ATOM | 4914 | C | SER | C | 217 | −40.297 | −66.901 | 133.836 | 1.00 | 83.50 | C |
| ATOM | 4915 | O | SER | C | 217 | −40.341 | −67.644 | 132.851 | 1.00 | 85.79 | O |
| ATOM | 4916 | CB | SER | C | 217 | −42.273 | −65.660 | 134.707 | 1.00 | 84.83 | C |
| ATOM | 4917 | OG | SER | C | 217 | −43.144 | −66.656 | 134.191 | 1.00 | 75.85 | O |
| TER | | | | | | | | | | | |
| ATOM | 4918 | N | GLU | D | 1 | −2.709 | −44.362 | 88.539 | 1.00 | 46.38 | N |
| ATOM | 4919 | CA | GLU | D | 1 | −3.927 | −43.604 | 88.796 | 1.00 | 40.18 | C |
| ATOM | 4920 | C | GLU | D | 1 | −3.692 | −42.543 | 89.882 | 1.00 | 40.43 | C |
| ATOM | 4921 | O | GLU | D | 1 | −2.818 | −42.704 | 90.730 | 1.00 | 41.89 | O |
| ATOM | 4922 | CB | GLU | D | 1 | −5.056 | −44.548 | 89.205 | 1.00 | 33.14 | C |
| ATOM | 4923 | CG | GLU | D | 1 | −5.071 | −44.860 | 90.693 | 1.00 | 34.96 | C |
| ATOM | 4924 | CD | GLU | D | 1 | −6.026 | −45.981 | 91.081 | 1.00 | 47.71 | C |
| ATOM | 4925 | OE1 | GLU | D | 1 | −6.745 | −46.523 | 90.207 | 1.00 | 56.37 | O |
| ATOM | 4926 | OE2 | GLU | D | 1 | −6.060 | −46.324 | 92.281 | 1.00 | 57.65 | O1− |
| ATOM | 4927 | N | ILE | D | 2 | −4.482 | −41.470 | 89.840 | 1.00 | 35.77 | N |
| ATOM | 4928 | CA | ILE | D | 2 | −4.431 | −40.417 | 90.844 | 1.00 | 30.01 | C |
| ATOM | 4929 | C | ILE | D | 2 | −5.055 | −40.916 | 92.141 | 1.00 | 34.99 | C |
| ATOM | 4930 | O | ILE | D | 2 | −6.246 | −41.247 | 92.184 | 1.00 | 35.20 | O |
| ATOM | 4931 | CB | ILE | D | 2 | −5.147 | −39.166 | 90.336 | 1.00 | 32.58 | C |
| ATOM | 4932 | CG1 | ILE | D | 2 | −4.425 | −38.645 | 89.088 | 1.00 | 29.66 | C |
| ATOM | 4933 | CG2 | ILE | D | 2 | −5.297 | −38.133 | 91.458 | 1.00 | 29.46 | C |
| ATOM | 4934 | CD1 | ILE | D | 2 | −5.026 | −37.400 | 88.488 | 1.00 | 28.66 | C |
| ATOM | 4935 | N | VAL | D | 3 | −4.263 | −40.933 | 93.219 | 1.00 | 34.76 | N |
| ATOM | 4936 | CA | VAL | D | 3 | −4.726 | −41.369 | 94.533 | 1.00 | 30.38 | C |
| ATOM | 4937 | C | VAL | D | 3 | −5.153 | −40.143 | 95.325 | 1.00 | 31.44 | C |

TABLE 10.4-continued

| | | | | | | | | | | |
|---|---|---|---|---|---|---|---|---|---|---|
| ATOM | 4938 | O | VAL | D | 3 | −4.409 | −39.155 | 95.403 | 1.00 | 31.03 | O |
| ATOM | 4939 | CB | VAL | D | 3 | −3.641 | −42.166 | 95.278 | 1.00 | 29.88 | C |
| ATOM | 4940 | CG1 | VAL | D | 3 | −4.089 | −42.450 | 96.695 | 1.00 | 25.14 | C |
| ATOM | 4941 | CG2 | VAL | D | 3 | −3.355 | −43.479 | 94.565 | 1.00 | 22.24 | C |
| ATOM | 4942 | N | LEU | D | 4 | −6.379 | −40.174 | 95.851 | 1.00 | 30.04 | N |
| ATOM | 4943 | CA | LEU | D | 4 | −6.942 | −39.055 | 96.604 | 1.00 | 28.75 | C |
| ATOM | 4944 | C | LEU | D | 4 | −7.087 | −39.490 | 98.050 | 1.00 | 29.11 | C |
| ATOM | 4945 | O | LEU | D | 4 | −7.809 | −40.450 | 98.337 | 1.00 | 37.17 | O |
| ATOM | 4946 | CB | LEU | D | 4 | −8.303 | −38.607 | 96.057 | 1.00 | 27.56 | C |
| ATOM | 4947 | CG | LEU | D | 4 | −8.478 | −38.095 | 94.619 | 1.00 | 27.56 | C |
| ATOM | 4948 | CD1 | LEU | D | 4 | −9.887 | −37.577 | 94.388 | 1.00 | 23.55 | C |
| ATOM | 4949 | CD2 | LEU | D | 4 | −7.477 | −37.038 | 94.270 | 1.00 | 27.03 | C |
| ATOM | 4950 | N | THR | D | 5 | −6.414 | −38.795 | 98.956 | 1.00 | 27.89 | N |
| ATOM | 4951 | CA | THR | D | 5 | −6.535 | −39.071 | 100.382 | 1.00 | 27.95 | C |
| ATOM | 4952 | C | THR | D | 5 | −7.291 | −37.915 | 101.020 | 1.00 | 27.80 | C |
| ATOM | 4953 | O | THR | D | 5 | −6.899 | −36.752 | 100.880 | 1.00 | 39.84 | O |
| ATOM | 4954 | CB | THR | D | 5 | −5.180 | −39.257 | 101.067 | 1.00 | 25.13 | C |
| ATOM | 4955 | OG1 | THR | D | 5 | −4.610 | −37.975 | 101.281 | 1.00 | 44.55 | O |
| ATOM | 4956 | CG2 | THR | D | 5 | −4.229 | −40.091 | 100.229 | 1.00 | 22.72 | C |
| ATOM | 4957 | N | GLN | D | 6 | −8.379 | −38.229 | 101.693 | 1.00 | 26.25 | N |
| ATOM | 4958 | CA | GLN | D | 6 | −9.154 | −37.231 | 102.401 | 1.00 | 29.68 | C |
| ATOM | 4959 | C | GLN | D | 6 | −8.770 | −37.227 | 103.870 | 1.00 | 29.42 | C |
| ATOM | 4960 | O | GLN | D | 6 | −8.596 | −38.287 | 104.475 | 1.00 | 0.59 | O |
| ATOM | 4961 | CB | GLN | D | 6 | −10.645 | −37.515 | 102.260 | 1.00 | 28.59 | C |
| ATOM | 4962 | CG | GLN | D | 6 | −11.199 | −37.068 | 100.946 | 1.00 | 26.38 | C |
| ATOM | 4963 | CD | GLN | D | 6 | −12.674 | −37.347 | 100.825 | 1.00 | 28.44 | C |
| ATOM | 4964 | OE1 | GLN | D | 6 | −13.063 | −38.310 | 100.182 | 1.00 | 30.52 | O |
| ATOM | 4965 | NE2 | GLN | D | 6 | −13.507 | −36.497 | 101.430 | 1.00 | 23.50 | N |
| ATOM | 4966 | N | SER | D | 7 | −8.646 | −36.032 | 104.442 | 1.00 | 32.95 | N |
| ATOM | 4967 | CA | SER | D | 7 | −8.474 | −35.923 | 105.893 | 1.00 | 34.15 | C |
| ATOM | 4968 | C | SER | D | 7 | −9.305 | −34.779 | 106.507 | 1.00 | 36.23 | C |
| ATOM | 4969 | O | SER | D | 7 | −9.692 | −33.818 | 105.822 | 1.00 | 34.31 | O |
| ATOM | 4970 | CB | SER | D | 7 | −7.007 | −35.732 | 106.234 | 1.00 | 32.05 | C |
| ATOM | 4971 | OG | SER | D | 7 | −6.622 | −34.406 | 105.965 | 1.00 | 36.70 | O |
| ATOM | 4972 | N | PRO | D | 8 | −9.657 | −34.917 | 107.791 | 1.00 | 35.26 | N |
| ATOM | 4973 | CA | PRO | D | 8 | −9.493 | −36.114 | 108.627 | 1.00 | 31.68 | C |
| ATOM | 4974 | C | PRO | D | 8 | −10.479 | −37.209 | 108.218 | 1.00 | 35.24 | C |
| ATOM | 4975 | O | PRO | D | 8 | −11.338 | −36.963 | 107.380 | 1.00 | 34.44 | O |
| ATOM | 4976 | CB | PRO | D | 8 | −9.812 | −35.599 | 110.022 | 1.00 | 31.95 | C |
| ATOM | 4977 | CG | PRO | D | 8 | −10.849 | −34.538 | 109.772 | 1.00 | 33.10 | C |
| ATOM | 4978 | CD | PRO | D | 8 | −10.446 | −33.874 | 108.471 | 1.00 | 32.84 | C |
| ATOM | 4979 | N | GLY | D | 9 | −10.345 | −38.409 | 108.776 | 1.00 | 36.77 | N |
| ATOM | 4980 | CA | GLY | D | 9 | −11.322 | −39.448 | 108.496 | 1.00 | 26.26 | C |
| ATOM | 4981 | C | GLY | D | 9 | −12.671 | −39.170 | 109.129 | 1.00 | 26.81 | C |
| ATOM | 4982 | O | GLY | D | 9 | −13.706 | −39.472 | 108.541 | 1.00 | 29.93 | O |
| ATOM | 4983 | N | THR | D | 10 | −12.681 | −38.619 | 110.349 | 1.00 | 29.94 | N |
| ATOM | 4984 | CA | THR | D | 10 | −13.909 | −38.207 | 111.025 | 1.00 | 29.91 | C |
| ATOM | 4985 | C | THR | D | 10 | −13.748 | −36.800 | 111.602 | 1.00 | 35.08 | C |
| ATOM | 4986 | O | THR | D | 10 | −12.672 | −36.421 | 112.072 | 1.00 | 37.12 | O |
| ATOM | 4987 | CB | THR | D | 10 | −14.324 | −39.175 | 112.138 | 1.00 | 28.55 | C |
| ATOM | 4988 | OG1 | THR | D | 10 | −14.423 | −40.503 | 111.612 | 1.00 | 29.83 | O |
| ATOM | 4989 | CG2 | THR | D | 10 | −15.682 | −38.775 | 112.712 | 1.00 | 26.70 | C |
| ATOM | 4990 | N | LEU | D | 11 | −14.823 | −36.022 | 111.527 | 1.00 | 33.72 | N |
| ATOM | 4991 | CA | LEU | D | 11 | −14.874 | −34.646 | 111.997 | 1.00 | 30.12 | C |
| ATOM | 4992 | C | LEU | D | 11 | −16.092 | −34.516 | 112.895 | 1.00 | 32.24 | C |
| ATOM | 4993 | O | LEU | D | 11 | −17.220 | −34.659 | 112.407 | 1.00 | 35.42 | O |
| ATOM | 4994 | CB | LEU | D | 11 | −15.010 | −33.702 | 110.811 | 1.00 | 31.05 | C |
| ATOM | 4995 | CG | LEU | D | 11 | −14.043 | −32.578 | 110.566 | 1.00 | 35.03 | C |
| ATOM | 4996 | CD1 | LEU | D | 11 | −14.736 | −31.626 | 109.611 | 1.00 | 32.51 | C |
| ATOM | 4997 | CD2 | LEU | D | 11 | −13.741 | −31.926 | 111.890 | 1.00 | 32.63 | C |
| ATOM | 4998 | N | SER | D | 12 | −15.880 | −34.220 | 114.183 | 1.00 | 27.22 | N |
| ATOM | 4999 | CA | SER | D | 12 | −16.969 | −34.041 | 115.149 | 1.00 | 31.54 | C |
| ATOM | 5000 | C | SER | D | 12 | −17.136 | −32.563 | 115.466 | 1.00 | 26.28 | C |
| ATOM | 5001 | O | SER | D | 12 | −16.200 | −31.925 | 115.940 | 1.00 | 31.22 | O |
| ATOM | 5002 | CB | SER | D | 12 | −16.711 | −34.815 | 116.443 | 1.00 | 30.19 | C |
| ATOM | 5003 | OG | SER | D | 12 | −16.413 | −36.172 | 116.169 | 1.00 | 30.39 | O |
| ATOM | 5004 | N | LEU | D | 13 | −18.320 | −32.023 | 115.209 | 1.00 | 28.43 | N |
| ATOM | 5005 | CA | LEU | D | 13 | −18.535 | −30.588 | 115.335 | 1.00 | 32.40 | C |
| ATOM | 5006 | C | LEU | D | 13 | −19.965 | −30.311 | 115.779 | 1.00 | 32.08 | C |
| ATOM | 5007 | O | LEU | D | 13 | −20.889 | −31.062 | 115.463 | 1.00 | 33.15 | O |
| ATOM | 5008 | CB | LEU | D | 13 | −18.229 | −29.860 | 114.013 | 1.00 | 29.60 | C |
| ATOM | 5009 | CG | LEU | D | 13 | −16.792 | −29.909 | 113.449 | 1.00 | 31.08 | C |
| ATOM | 5010 | CD1 | LEU | D | 13 | −16.740 | −29.357 | 112.045 | 1.00 | 34.57 | C |
| ATOM | 5011 | CD2 | LEU | D | 13 | −15.818 | −29.128 | 114.313 | 1.00 | 19.13 | C |
| ATOM | 5012 | N | SER | D | 14 | −20.148 | −29.201 | 116.468 | 1.00 | 33.43 | N |
| ATOM | 5013 | CA | SER | D | 14 | −21.515 | −28.841 | 116.784 | 1.00 | 34.69 | C |
| ATOM | 5014 | C | SER | D | 14 | −22.184 | −28.181 | 115.589 | 1.00 | 30.63 | C |
| ATOM | 5015 | O | SER | D | 14 | −21.528 | −27.507 | 114.789 | 1.00 | 26.53 | O |
| ATOM | 5016 | CB | SER | D | 14 | −21.563 | −27.869 | 117.963 | 1.00 | 40.13 | C |
| ATOM | 5017 | OG | SER | D | 14 | −21.315 | −28.526 | 119.189 | 1.00 | 49.17 | O |

TABLE 10.4-continued

| | | | | | | | | | | |
|---|---|---|---|---|---|---|---|---|---|---|
| ATOM | 5018 | N | PRO | D | 15 | −23.496 | −28.324 | 115.471 | 1.00 | 30.71 | N |
| ATOM | 5019 | CA | PRO | D | 15 | −24.231 | −27.513 | 114.495 | 1.00 | 30.71 | C |
| ATOM | 5020 | C | PRO | D | 15 | −23.981 | −26.030 | 114.753 | 1.00 | 33.52 | C |
| ATOM | 5021 | O | PRO | D | 15 | −23.778 | −25.598 | 115.892 | 1.00 | 30.44 | O |
| ATOM | 5022 | CB | PRO | D | 15 | −25.694 | −27.907 | 114.732 | 1.00 | 29.82 | C |
| ATOM | 5023 | CG | PRO | D | 15 | −25.633 | −29.250 | 115.357 | 1.00 | 27.19 | C |
| ATOM | 5024 | CD | PRO | D | 15 | −24.368 | −29.263 | 116.188 | 1.00 | 28.99 | C |
| ATOM | 5025 | N | GLY | D | 16 | −23.917 | −25.264 | 113.673 | 1.00 | 34.76 | N |
| ATOM | 5026 | CA | GLY | D | 16 | −23.561 | −23.872 | 113.725 | 1.00 | 30.06 | C |
| ATOM | 5027 | C | GLY | D | 16 | −22.093 | −23.615 | 113.489 | 1.00 | 32.57 | C |
| ATOM | 5028 | O | GLY | D | 16 | −21.728 | −22.532 | 113.024 | 1.00 | 34.09 | O |
| ATOM | 5029 | N | GLU | D | 17 | −21.243 | −24.599 | 113.748 | 1.00 | 30.04 | N |
| ATOM | 5030 | CA | GLU | D | 17 | −19.828 | −24.365 | 113.578 | 1.00 | 29.50 | C |
| ATOM | 5031 | C | GLU | D | 17 | −19.442 | −24.466 | 112.111 | 1.00 | 33.26 | C |
| ATOM | 5032 | O | GLU | D | 17 | −20.236 | −24.848 | 111.242 | 1.00 | 28.54 | O |
| ATOM | 5033 | CB | GLU | D | 17 | −18.997 | −25.365 | 114.370 | 1.00 | 30.61 | C |
| ATOM | 5034 | CG | GLU | D | 17 | −18.967 | −25.187 | 115.863 | 1.00 | 38.28 | C |
| ATOM | 5035 | CD | GLU | D | 17 | −17.955 | −26.152 | 116.491 | 1.00 | 47.48 | C |
| ATOM | 5036 | OE1 | GLU | D | 17 | −16.740 | −25.933 | 116.281 | 1.00 | 51.97 | O |
| ATOM | 5037 | OE2 | GLU | D | 17 | −18.365 | −27.154 | 117.43 | 1.00 | 47.45 | O1− |
| ATOM | 5038 | N | ARG | D | 18 | −18.183 | −24.132 | 111.861 | 1.00 | 33.39 | N |
| ATOM | 5039 | CA | ARG | D | 18 | −17.585 | −24.128 | 110.544 | 1.00 | 30.46 | C |
| ATOM | 5040 | C | ARG | D | 18 | −16.823 | −25.439 | 110.354 | 1.00 | 35.01 | C |
| ATOM | 5041 | O | ARG | D | 18 | −16.148 | −25.911 | 11.273 | 1.00 | 36.75 | O |
| ATOM | 5042 | B | ARG | D | 18 | −16.673 | −22.903 | 110.427 | 1.00 | 30.90 | C |
| ATOM | 5043 | CG | ARG | D | 18 | −15.935 | −22.722 | 109.136 | 1.00 | 33.87 | C |
| ATOM | 5044 | CD | ARG | D | 18 | −14.967 | −21.575 | 109.278 | 1.00 | 28.90 | C |
| ATOM | 5045 | NE | ARG | D | 18 | −14.168 | −21.350 | 108.073 | 1.00 | 42.50 | N |
| ATOM | 5046 | CZ | ARG | D | 18 | −14.603 | −20.689 | 106.995 | 1.00 | 46.47 | C |
| ATOM | 5047 | NH1 | ARG | D | 18 | −15.851 | −20.199 | 106.968 | 1.00 | 39.59 | N1+ |
| ATOM | 5048 | NH2 | ARG | D | 18 | −13.799 | −20.529 | 105.939 | 1.00 | 36.96 | N |
| ATOM | 5049 | N | ALA | D | 19 | −16.955 | −26.046 | 109.172 | 1.00 | 33.54 | N |
| ATOM | 5050 | CA | ALA | D | 19 | −16.302 | −27.317 | 108.864 | 1.00 | 31.96 | C |
| ATOM | 5051 | C | ALA | D | 19 | −15.394 | −27.131 | 107.661 | 1.00 | 27.02 | C |
| ATOM | 5052 | O | ALA | D | 19 | −15.760 | −26.443 | 106.707 | 1.00 | 28.38 | O |
| ATOM | 5053 | CB | ALA | D | 19 | −17.319 | −28.428 | 108.564 | 1.00 | 30.29 | C |
| ATOM | 5054 | N | THR | D | 20 | −14.203 | −27.715 | 107.720 | 1.00 | 24.79 | N |
| ATOM | 5055 | CA | THR | D | 20 | −13.250 | −27.647 | 106.619 | 1.00 | 25.95 | C |
| ATOM | 5056 | C | THR | D | 20 | −12.657 | −29.031 | 106.370 | 1.00 | 28.87 | C |
| ATOM | 5057 | O | THR | D | 20 | −12.056 | −29.619 | 107.272 | 1.00 | 27.37 | O |
| ATOM | 5058 | CB | THR | D | 20 | −12.160 | −26.618 | 106.920 | 1.00 | 33.57 | C |
| ATOM | 5059 | OG1 | THR | D | 20 | −12.678 | −25.302 | 106.669 | 1.00 | 35.59 | O |
| ATOM | 5060 | CG2 | THR | D | 20 | −10.942 | −26.842 | 106.026 | 1.00 | 35.30 | C |
| ATOM | 5061 | N | LEU | D | 21 | −12.845 | −29.553 | 105.153 | 1.00 | 27.92 | N |
| ATOM | 5062 | CA | LEU | D | 21 | −12.408 | −30.885 | 104.753 | 1.00 | 21.26 | C |
| ATOM | 5063 | C | LEU | D | 21 | −11.291 | −30.788 | 103.721 | 1.00 | 27.12 | C |
| ATOM | 5064 | O | LEU | D | 21 | −11.276 | −29.891 | 102.879 | 1.00 | 25.65 | O |
| ATOM | 5065 | CB | LEU | D | 21 | −13.567 | −31.688 | 104.171 | 1.00 | 24.71 | C |
| ATOM | 5066 | CG | LEU | D | 21 | −14.800 | −31.873 | 105.044 | 1.00 | 24.88 | C |
| ATOM | 5067 | CD1 | LEU | D | 21 | −15.745 | −32.804 | 104.393 | 1.00 | 25.75 | C |
| ATOM | 5068 | CD2 | LEU | D | 21 | −14.358 | −32.453 | 106.324 | 1.00 | 36.95 | C |
| ATOM | 5069 | N | SER | D | 22 | −10.364 | −31.732 | 103.777 | 1.00 | 25.30 | N |
| ATOM | 5070 | CA | SER | D | 22 | −9.207 | −31.718 | 102.906 | 1.00 | 29.86 | C |
| ATOM | 5071 | C | SER | D | 22 | −9.228 | −32.907 | 101.960 | 1.00 | 31.55 | C |
| ATOM | 5072 | O | SER | D | 22 | −9.637 | −34.010 | 102.338 | 1.00 | 32.22 | O |
| ATOM | 5073 | CB | SER | D | 22 | −7.908 | −31.743 | 103.711 | 1.00 | 29.48 | C |
| ATOM | 5074 | OG | SER | D | 22 | −7.484 | −30.430 | 103.983 | 1.00 | 48.01 | O |
| ATOM | 5075 | N | CYS | D | 23 | −8.748 | −32.668 | 100.743 | 1.00 | 23.08 | N |
| ATOM | 5076 | CA | CYS | D | 23 | −8.493 | −33.696 | 99.746 | 1.00 | 29.55 | C |
| ATOM | 5077 | C | CYS | D | 23 | −7.132 | −33.425 | 99.133 | 1.00 | 28.60 | C |
| ATOM | 5078 | O | CYS | D | 23 | −6.927 | −32.375 | 98.510 | 1.00 | 28.22 | O |
| ATOM | 5079 | CB | CYS | D | 23 | −9.577 | −33.692 | 98.661 | 1.00 | 32.45 | C |
| ATOM | 5080 | SG | CYS | D | 23 | −9.448 | −34.937 | 97.349 | 1.00 | 34.53 | S |
| ATOM | 5081 | N | ARG | D | 24 | −6.215 | −34.370 | 99.282 | 1.00 | 27.16 | N |
| ATOM | 5082 | CA | ARG | D | 24 | −4.896 | −34.261 | 98.682 | 1.00 | 30.26 | C |
| ATOM | 5083 | C | ARG | D | 24 | −4.755 | −35.243 | 97.517 | 1.00 | 29.93 | C |
| ATOM | 5084 | O | ARG | D | 24 | −5.021 | −36.442 | 97.663 | 1.00 | 32.04 | O |
| ATOM | 5085 | CB | ARG | D | 24 | −3.830 | −34.452 | 99.759 | 1.00 | 30.70 | C |
| ATOM | 5086 | CG | ARG | D | 24 | −3.797 | −33.212 | 100.656 | 1.00 | 40.46 | C |
| ATOM | 5087 | CD | ARG | D | 24 | −3.107 | −33.392 | 101.998 | 1.00 | 47.57 | C |
| ATOM | 5088 | NE | ARG | D | 24 | −2.760 | −32.094 | 102.596 | 1.00 | 64.41 | N |
| ATOM | 5089 | CA | ARG | D | 24 | −3.482 | −31.436 | 103.512 | 1.00 | 64.33 | C |
| ATOM | 5090 | NH1 | ARG | D | 24 | −4.626 | −31.944 | 103.967 | 1.00 | 59.49 | N1+ |
| ATOM | 5091 | NH2 | ARG | D | 24 | −3.054 | −30.259 | 103.979 | 1.00 | 59.83 | N |
| ATOM | 5092 | N | ALA | D | 25 | −4.379 | −34.715 | 96.351 | 1.00 | 25.59 | N |
| ATOM | 5093 | CA | ALA | D | 25 | −4.224 | −35.487 | 95.126 | 1.00 | 27.28 | C |
| ATOM | 5094 | C | ALA | D | 25 | −2.745 | −35.776 | 94.882 | 1.00 | 29.22 | C |
| ATOM | 5095 | O | ALA | D | 25 | −1.914 | −34.868 | 94.943 | 1.00 | 32.95 | O |
| ATOM | 5096 | CB | ALA | D | 25 | −4.810 | −34.736 | 93.927 | 1.00 | 31.36 | C |
| ATOM | 5097 | N | SER | D | 26 | −2.428 | −37.029 | 94.593 | 1.00 | 26.23 | N |

TABLE 10.4-continued

| ATOM | 5098 | CA | SER | D | 26 | −1.100 | −37.425 | 94.171 | 1.00 | 26.45 | C |
|---|---|---|---|---|---|---|---|---|---|---|---|
| ATOM | 5099 | C | SER | D | 26 | −1.179 | −38.425 | 93.014 | 1.00 | 36.59 | C |
| ATOM | 5100 | O | SER | D | 26 | −1.636 | −39.568 | 93.195 | 1.00 | 38.09 | O |
| ATOM | 5101 | CB | SER | D | 26 | −0.330 | −38.048 | 95.323 | 1.00 | 31.96 | C |
| ATOM | 5102 | OG | SER | D | 26 | 0.947 | −38.468 | 94.888 | 1.00 | 40.33 | O |
| ATOM | 5103 | N | PRO | D | 27 | −0.729 | −38.019 | 91.817 | 1.00 | 33.93 | N |
| ATOM | 5104 | CA | PRO | D | 27 | −0.176 | −36.725 | 91.413 | 1.00 | 32.59 | C |
| ATOM | 5105 | C | PRO | D | 27 | −1.180 | −35.587 | 91.464 | 1.00 | 31.97 | C |
| ATOM | 5106 | O | PRO | D | 27 | −2.361 | −35.800 | 91.744 | 1.00 | 29.04 | O |
| ATOM | 5107 | CB | PRO | D | 27 | 0.255 | −36.957 | 89.967 | 1.00 | 25.77 | C |
| ATOM | 5108 | CG | PRO | D | 27 | 0.295 | −38.395 | 89.799 | 1.00 | 30.50 | C |
| ATOM | 5109 | CD | PRO | D | 27 | −0.695 | −38.986 | 90.712 | 1.00 | 33.60 | C |
| ATOM | 5110 | N | SER | D | 28 | −0.691 | −34.384 | 91.176 | 1.00 | 29.51 | N |
| ATOM | 5611 | CA | SER | D | 28 | −1.531 | −33.204 | 91.247 | 1.00 | 33.06 | C |
| ATOM | 5612 | C | SER | D | 28 | −2.689 | −33.306 | 90.258 | 1.00 | 31.21 | C |
| ATOM | 5113 | O | SER | D | 28 | −2.658 | −34.064 | 89.292 | 1.00 | 32.08 | O |
| ATOM | 5114 | CB | SER | D | 28 | −0.708 | −31.948 | 90.968 | 1.00 | 30.39 | C |
| ATOM | 5115 | OG | SER | D | 28 | 0.122 | −31.650 | 92.075 | 1.00 | 39.06 | O |
| ATOM | 5116 | N | VAL | D | 29 | −3.741 | −32.552 | 90.537 | 1.00 | 31.26 | N |
| ATOM | 5117 | CA | VAL | D | 29 | −4.834 | −32.398 | 89.589 | 1.00 | 31.02 | C |
| ATOM | 5118 | C | VAL | D | 29 | −4.828 | −30.937 | 89.154 | 1.00 | 30.74 | C |
| ATOM | 5119 | O | VAL | D | 29 | −5.671 | −30.137 | 89.581 | 1.00 | 32.15 | O |
| ATOM | 5120 | CB | VAL | D | 29 | −6.180 | −32.849 | 90.199 | 1.00 | 28.79 | C |
| ATOM | 5121 | CG1 | VAL | D | 29 | −7.331 | −32.660 | 89.220 | 1.00 | 29.57 | C |
| ATOM | 5122 | CG2 | VAL | D | 29 | −6.092 | −34.296 | 90.584 | 1.00 | 28.20 | C |
| ATOM | 5123 | N | ASN | D | 30 | −3.867 | −30.579 | 88.300 | 1.00 | 29.06 | N |
| ATOM | 5124 | CA | ASN | D | 30 | −3.706 | −29.191 | 87.881 | 1.00 | 27.78 | C |
| ATOM | 5125 | C | ASN | D | 30 | −4.829 | −28.695 | 86.974 | 1.00 | 28.98 | C |
| ATOM | 5126 | O | ASN | D | 30 | −4.903 | −27.494 | 86.715 | 1.00 | 34.22 | O |
| ATOM | 5127 | CB | ASN | D | 30 | −2.371 | −29.012 | 87.165 | 1.00 | 25.95 | C |
| ATOM | 5128 | CG | ASN | D | 30 | −1.177 | −29.247 | 88.072 | 1.00 | 29.67 | C |
| ATOM | 5129 | OD1 | ASN | D | 30 | −1.142 | −28.823 | 89.232 | 1.00 | 38.01 | O |
| ATOM | 5130 | ND2 | ASN | D | 30 | −0.188 | −29.923 | 87.546 | 1.00 | 31.76 | N |
| ATOM | 5131 | N | SER | D | 31 | −5.715 | −29.565 | 86.496 | 1.00 | 32.77 | N |
| ATOM | 5132 | CA | SER | D | 31 | −6.854 | −29.076 | 85.733 | 1.00 | 29.44 | C |
| ATOM | 5133 | C | SER | D | 31 | −7.919 | −28.456 | 86.623 | 1.00 | 29.07 | C |
| ATOM | 5134 | O | SER | D | 31 | −8.807 | −27.763 | 86.115 | 1.00 | 30.00 | O |
| ATOM | 5135 | CB | SER | D | 31 | −7.480 | −30.207 | 84.911 | 1.00 | 30.70 | C |
| ATOM | 5136 | OG | SER | D | 31 | −7.863 | −31.300 | 85.728 | 1.00 | 28.68 | O |
| ATOM | 5137 | N | GLY | D | 32 | −7.865 | −28.708 | 87.928 | 1.00 | 26.73 | N |
| ATOM | 5138 | CA | GLY | D | 32 | −8.956 | −28.326 | 88.788 | 1.00 | 24.35 | C |
| ATOM | 5139 | C | GLY | D | 32 | −10.205 | −29.141 | 88.582 | 1.00 | 28.63 | C |
| ATOM | 5140 | O | GLY | D | 32 | −11.275 | −28.720 | 89.003 | 1.00 | 23.12 | O |
| ATOM | 5141 | N | TYR | D | 33 | −10.109 | −30.294 | 87.917 | 1.00 | 28.39 | N |
| ATOM | 5142 | CA | TYR | D | 33 | −11.280 | −31.144 | 87.695 | 1.00 | 27.10 | C |
| ATOM | 5143 | C | TYR | D | 33 | −11.513 | −31.989 | 88.947 | 1.00 | 25.88 | C |
| ATOM | 5144 | O | TYR | D | 33 | −11.254 | −33.194 | 88.991 | 1.00 | 26.06 | O |
| ATOM | 5145 | CB | TYR | D | 33 | −11.095 | −32.028 | 86.468 | 1.00 | 27.24 | C |
| ATOM | 5146 | CG | TYR | D | 33 | −11.026 | −31.318 | 85.121 | 1.00 | 30.30 | C |
| ATOM | 5147 | CD1 | TYR | D | 33 | −11.355 | −29.972 | 84.977 | 1.00 | 24.29 | C |
| ATOM | 5148 | CD2 | TYR | D | 33 | −10.625 | −32.014 | 83.988 | 1.00 | 29.73 | C |
| ATOM | 5149 | CE1 | TYR | D | 33 | −11.272 | −29.351 | 83.739 | 1.00 | 29.00 | C |
| ATOM | 5150 | CE2 | TYR | D | 33 | −10.535 | −31.403 | 82.757 | 1.00 | 27.95 | C |
| ATOM | 5151 | CZ | TYR | D | 33 | −10.851 | −30.083 | 82.626 | 1.00 | 29.77 | C |
| ATOM | 5152 | OH | TYR | D | 33 | −10.753 | −29.528 | 81.366 | 1.00 | 27.33 | O |
| ATOM | 5153 | N | LEU | D | 34 | −11.990 | −31.331 | 89.993 | 1.00 | 24.59 | N |
| ATOM | 5154 | CA | LEU | D | 34 | −12.197 | −32.008 | 91.264 | 1.00 | 22.23 | C |
| ATOM | 5155 | C | LEU | D | 34 | −13.626 | −31.783 | 91.730 | 1.00 | 22.58 | C |
| ATOM | 5156 | O | LEU | D | 34 | −14.082 | −30.644 | 91.811 | 1.00 | 30.13 | O |
| ATOM | 5157 | CB | LEU | D | 34 | −11.211 | −31.517 | 92.326 | 1.00 | 22.34 | C |
| ATOM | 5158 | CG | LEU | D | 34 | −11.174 | −32.540 | 93.472 | 1.00 | 25.73 | C |
| ATOM | 5159 | CD1 | LEU | D | 34 | −9.862 | −33.273 | 93.510 | 1.00 | 24.20 | C |
| ATOM | 5160 | CD2 | LEU | D | 34 | −11.517 | −31.936 | 94.803 | 1.00 | 22.15 | C |
| ATOM | 5161 | N | ALA | D | 35 | −14.331 | −32.856 | 92.019 | 1.00 | 19.87 | N |
| ATOM | 5162 | CA | ALA | D | 35 | −15.711 | −32.778 | 92.454 | 1.00 | 21.92 | C |
| ATOM | 5163 | C | ALA | D | 35 | −15.824 | −33.191 | 93.917 | 1.00 | 23.07 | C |
| ATOM | 5164 | O | ALA | D | 35 | −14.962 | −33.884 | 94.461 | 1.00 | 19.99 | O |
| ATOM | 5165 | CB | ALA | D | 35 | −16.614 | −33.657 | 91.593 | 1.00 | 18.13 | C |
| ATOM | 5166 | N | TRP | D | 36 | −16.908 | −32.743 | 94.544 | 1.00 | 22.34 | N |
| ATOM | 5167 | CA | TRP | D | 36 | −17.251 | −33.112 | 95.911 | 1.00 | 25.99 | C |
| ATOM | 5168 | C | TRP | D | 36 | −18.673 | −33.656 | 95.941 | 1.00 | 24.08 | C |
| ATOM | 5169 | O | TRP | D | 36 | −19.573 | −33.115 | 95.291 | 1.00 | 23.80 | O |
| ATOM | 5170 | CB | TRP | D | 36 | −17.138 | −31.920 | 96.890 | 1.00 | 24.75 | C |
| ATOM | 5171 | CG | TRP | D | 36 | −15.751 | −31.504 | 97.216 | 1.00 | 23.08 | C |
| ATOM | 5172 | CD1 | TRP | D | 36 | −15.013 | −30.555 | 96.564 | 1.00 | 27.42 | C |
| ATOM | 5173 | CD2 | TRP | D | 36 | −14.917 | −32.009 | 98.268 | 1.00 | 23.07 | C |
| ATOM | 5174 | NE1 | TRP | D | 36 | −13.774 | −30.439 | 97.142 | 1.00 | 26.35 | N |
| ATOM | 5175 | CE2 | TRP | D | 36 | −13.685 | −31.316 | 98.193 | 1.00 | 26.49 | C |
| ATOM | 5176 | CE3 | TRP | D | 36 | −15.096 | −32.959 | 99.275 | 1.00 | 23.59 | C |
| ATOM | 5177 | CZ2 | TRP | D | 36 | −12.630 | −31.546 | 99.092 | 1.00 | 24.68 | C |

TABLE 10.4-continued

| | | | | | | | | | | |
|---|---|---|---|---|---|---|---|---|---|---|
| ATOM | 5178 | CZ3 | TRP | D | 36 | −14.049 | −33.189 | 100.167 | 1.00 | 27.30 | C |
| ATOM | 5179 | CH2 | TRP | D | 36 | −12.829 | −32.484 | 100.064 | 1.00 | 27.81 | C |
| ATOM | 5180 | N | TYR | D | 37 | −18.861 | −34.737 | 96.689 | 1.00 | 22.56 | N |
| ATOM | 5181 | CA | TYR | D | 37 | −20.166 | −35.347 | 96.873 | 1.00 | 23.04 | C |
| ATOM | 5182 | C | TYR | D | 37 | −20.507 | −35.457 | 98.354 | 1.00 | 24.32 | C |
| ATOM | 5183 | O | TYR | D | 37 | −19.638 | −35.621 | 99.213 | 1.00 | 21.76 | O |
| ATOM | 5184 | CB | TYR | D | 37 | −20.222 | −36.732 | 96.232 | 1.00 | 22.03 | C |
| ATOM | 5185 | CG | TYR | D | 37 | −19.937 | −36.707 | 94.768 | 1.00 | 22.72 | C |
| ATOM | 5186 | CD1 | TYR | D | 37 | −18.634 | −36.802 | 94.302 | 1.00 | 19.01 | C |
| ATOM | 5187 | CD2 | TYR | D | 37 | −20.965 | −36.569 | 93.840 | 1.00 | 22.13 | C |
| ATOM | 5188 | CE1 | TYR | D | 37 | −18.355 | −36.772 | 92.962 | 1.00 | 20.66 | C |
| ATOM | 5189 | CE2 | TYR | D | 37 | −20.690 | −36.541 | 92.487 | 1.00 | 21.78 | C |
| ATOM | 5190 | CZ | TYR | D | 37 | −19.378 | −36.642 | 92.056 | 1.00 | 23.03 | C |
| ATOM | 5191 | OH | TYR | D | 37 | −19.071 | −36.606 | 90.716 | 1.00 | 26.68 | O |
| ATOM | 5192 | N | GLN | D | 38 | −21.790 | −35.368 | 98.640 | 1.00 | 24.80 | N |
| ATOM | 5193 | CA | GLN | D | 38 | −22.316 | −35.653 | 99.956 | 1.00 | 24.70 | C |
| ATOM | 5194 | C | GLN | D | 38 | −23.084 | −36.960 | 99.888 | 1.00 | 25.31 | C |
| ATOM | 5195 | O | GLN | D | 38 | −23.766 | −37.233 | 98.901 | 1.00 | 29.60 | O |
| ATOM | 5196 | CB | GLN | D | 38 | −23.231 | −34.524 | 100.429 | 1.00 | 26.48 | C |
| ATOM | 5197 | CG | GLN | D | 38 | −23.861 | −34.780 | 101.757 | 1.00 | 29.22 | C |
| ATOM | 5198 | CD | GLN | D | 38 | −24.925 | −33.785 | 102.068 | 1.00 | 32.98 | C |
| ATOM | 5199 | OE1 | GLN | D | 38 | −26.040 | −33.894 | 101.560 | 1.00 | 39.02 | O |
| ATOM | 5200 | NE2 | GLN | D | 38 | −24.591 | −32.780 | 102.888 | 1.00 | 28.25 | N |
| ATOM | 5201 | N | GLN | D | 39 | −22.956 | −37.781 | 100.916 | 1.00 | 22.53 | N |
| ATOM | 5202 | CA | GLN | D | 39 | −23.703 | −39.024 | 100.962 | 1.00 | 27.58 | C |
| ATOM | 5203 | C | GLN | D | 39 | −24.189 | −39.277 | 102.379 | 1.00 | 28.58 | C |
| ATOM | 5204 | O | GLN | D | 39 | −23.379 | −39.372 | 103.304 | 1.00 | 23.07 | O |
| ATOM | 5205 | CB | GLN | D | 39 | −22.875 | −40.207 | 100.468 | 1.00 | 26.29 | C |
| ATOM | 5206 | CG | GLN | D | 39 | −23.719 | −41.455 | 100.412 | 1.00 | 24.76 | C |
| ATOM | 5207 | CD | GLN | D | 39 | −23.000 | −42.610 | 99.847 | 1.00 | 27.83 | C |
| ATOM | 5208 | OE1 | GLN | D | 39 | −21.818 | −42.804 | 100.103 | 1.00 | 28.43 | O |
| ATOM | 5209 | NE2 | GLN | D | 39 | −23.697 | −43.390 | 99.042 | 1.00 | 31.88 | N |
| ATOM | 5210 | N | LYS | D | 40 | −25.520 | −39.390 | 102.538 | 1.00 | 28.80 | N |
| ATOM | 5211 | CA | LYS | D | 40 | −26.175 | −39.790 | 103.771 | 1.00 | 29.70 | C |
| ATOM | 5212 | C | LYS | D | 40 | −26.436 | −41.289 | 103.763 | 1.00 | 34.10 | C |
| ATOM | 5213 | O | LYS | D | 40 | −26.510 | −41.910 | 102.691 | 1.00 | 30.33 | O |
| ATOM | 5214 | CB | LYS | D | 40 | −27.478 | −39.021 | 103.946 | 1.00 | 31.38 | C |
| ATOM | 5215 | CG | LYS | D | 40 | −27.272 | −37.656 | 104.529 | 1.00 | 32.07 | C |
| ATOM | 5216 | CD | LYS | D | 40 | −28.432 | −36.768 | 104.221 | 1.00 | 42.17 | C |
| ATOM | 5217 | CE | LYS | D | 40 | −28.195 | −35.363 | 104.744 | 1.00 | 44.38 | C |
| ATOM | 5218 | NZ | LYS | D | 40 | −28.086 | −35.382 | 106.237 | 1.00 | 45.69 | N1+ |
| ATOM | 5219 | N | PRO | D | 41 | −26.551 | −41.899 | 104.951 | 1.00 | 33.47 | N |
| ATOM | 5220 | CA | PRO | D | 41 | −26.573 | −43.373 | 105.051 | 1.00 | 33.11 | C |
| ATOM | 5221 | C | PRO | D | 41 | −27.702 | −44.029 | 104.267 | 1.00 | 30.28 | C |
| ATOM | 5222 | O | PRO | D | 41 | −28.872 | −43.660 | 104.394 | 1.00 | 32.79 | O |
| ATOM | 5223 | CB | PRO | D | 41 | −26.726 | −43.612 | 106.558 | 1.00 | 34.12 | C |
| ATOM | 5224 | CG | PRO | D | 41 | −26.096 | −42.407 | 107.186 | 1.00 | 25.92 | C |
| ATOM | 5225 | CD | PRO | D | 41 | −26.471 | −41.265 | 106.280 | 1.00 | 26.33 | C |
| ATOM | 5226 | N | GLY | D | 42 | −27.342 | −45.026 | 103.460 | 1.00 | 29.14 | N |
| ATOM | 5227 | CA | GLY | D | 42 | −28.337 | −45.688 | 102.630 | 1.00 | 29.58 | C |
| ATOM | 5228 | C | GLY | D | 42 | −28.914 | −44.852 | 101.497 | 1.00 | 36.52 | C |
| ATOM | 5229 | O | GLY | D | 42 | −29.956 | −45.213 | 100.952 | 1.00 | 36.30 | O |
| ATOM | 5230 | N | GLN | D | 43 | −28.242 | −43.771 | 101.092 | 1.00 | 32.91 | N |
| ATOM | 5231 | CA | GLN | D | 43 | −28.685 | −42.898 | 100.016 | 1.00 | 27.04 | C |
| ATOM | 5232 | C | GLN | D | 43 | −27.619 | −42.825 | 98.930 | 1.00 | 27.93 | C |
| ATOM | 5233 | O | GLN | D | 43 | −29.452 | −43.162 | 99.153 | 1.00 | 27.99 | O |
| ATOM | 5234 | CB | GLN | D | 43 | −28.952 | −41.481 | 100.523 | 1.00 | 30.13 | C |
| ATOM | 5235 | CG | GLN | D | 43 | −29.659 | −41.422 | 101.838 | 1.00 | 33.40 | C |
| ATOM | 5236 | CD | GLN | D | 43 | −31.073 | −41.941 | 101.754 | 1.00 | 45.27 | C |
| ATOM | 5237 | OE1 | GLN | D | 43 | −31.760 | −41.731 | 100.750 | 1.00 | 42.82 | O |
| ATOM | 5238 | NE2 | GLN | D | 43 | −31.511 | −42.665 | 102.800 | 1.00 | 44.71 | N |
| ATOM | 5239 | N | THR | D | 44 | −28.032 | −42.367 | 97.742 | 1.00 | 25.68 | N |
| ATOM | 5240 | CA | THR | D | 44 | −27.045 | −42.187 | 96.692 | 1.00 | 30.33 | C |
| ATOM | 5241 | C | THR | D | 44 | −26.306 | −40.848 | 96.866 | 1.00 | 30.71 | C |
| ATOM | 5242 | O | THR | D | 44 | −26.834 | −39.904 | 97.464 | 1.00 | 26.05 | O |
| ATOM | 5243 | CB | THR | D | 44 | −27.702 | −42.278 | 95.303 | 1.00 | 28.63 | C |
| ATOM | 5244 | OG1 | THR | D | 44 | −28.240 | −41.013 | 94.924 | 1.00 | 32.11 | O |
| ATOM | 5245 | NE2 | THR | D | 44 | −28.834 | −43.319 | 95.292 | 1.00 | 29.12 | C |
| ATOM | 5246 | N | PRO | D | 45 | −25.070 | −40.756 | 96.375 | 1.00 | 25.93 | N |
| ATOM | 5247 | CA | PRO | D | 45 | −24.312 | −39.512 | 96.515 | 1.00 | 25.74 | C |
| ATOM | 5248 | C | PRO | D | 45 | −24.977 | −38.343 | 95.801 | 1.00 | 24.98 | C |
| ATOM | 5249 | O | PRO | D | 45 | −25.616 | −38.493 | 94.761 | 1.00 | 23.19 | O |
| ATOM | 5250 | CB | PRO | D | 45 | −22.962 | −39.857 | 95.878 | 1.00 | 28.44 | C |
| ATOM | 5251 | CG | PRO | D | 45 | −22.886 | −41.342 | 95.963 | 1.00 | 23.47 | C |
| ATOM | 5252 | CD | PRO | D | 45 | −24.265 | −41.8200 | 95.764 | 1.00 | 23.77 | C |
| ATOM | 5253 | N | ARG | D | 46 | −24.812 | −37.163 | 96.382 | 1.00 | 28.06 | N |
| ATOM | 5254 | CA | ARG | D | 46 | −25.306 | −35.910 | 95.824 | 1.00 | 26.21 | C |
| ATOM | 5255 | C | ARG | D | 46 | −24.120 | −35.028 | 95.449 | 1.00 | 27.60 | C |
| ATOM | 5256 | O | ARG | D | 46 | −23.212 | −34.814 | 96.265 | 1.00 | 24.95 | O |
| ATOM | 5257 | CB | ARG | D | 46 | −26.203 | −35.199 | 96.836 | 1.00 | 28.93 | C |

TABLE 10.4-continued

| | | | | | | | | | | |
|---|---|---|---|---|---|---|---|---|---|---|
| ATOM | 5258 | CG | ARG | D | 46 | −26.747 | −33.885 | 96.372 | 1.00 | 35.19 | C |
| ATOM | 5259 | CD | ARG | D | 46 | −28.129 | −33.660 | 96.926 | 1.00 | 42.94 | C |
| ATOM | 5260 | NE | ARG | D | 46 | −28.813 | −32.616 | 96.172 | 1.00 | 54.78 | N |
| ATOM | 5261 | CZ | ARG | D | 46 | −28.994 | −31.379 | 96.619 | 1.00 | 62.11 | C |
| ATOM | 5262 | NH1 | ARG | D | 46 | −29.621 | −30.481 | 95.858 | 1.00 | 53.78 | N1+ |
| ATOM | 5263 | NH2 | ARG | D | 46 | −28.553 | −31.045 | 97.837 | 1.00 | 63.79 | N |
| ATOM | 5264 | N | LEU | D | 47 | −24.116 | −34.535 | 94.216 | 1.00 | 26.63 | N |
| ATOM | 5265 | CA | LEU | D | 47 | −23.029 | −33.680 | 93.772 | 1.00 | 24.56 | C |
| ATOM | 5266 | C | LEU | D | 47 | −23.125 | −32.333 | 94.474 | 1.00 | 23.50 | C |
| ATOM | 5267 | O | LEU | D | 47 | −24.201 | −31.746 | 94.529 | 1.00 | 28.69 | O |
| ATOM | 5268 | CB | LEU | D | 47 | −23.083 | −33.508 | 92.264 | 1.00 | 21.59 | C |
| ATOM | 5269 | CG | LEU | D | 47 | −22.042 | −32.542 | 91.689 | 1.00 | 28.11 | C |
| ATOM | 5270 | CD1 | LEU | D | 47 | −20.587 | −33.047 | 91.831 | 1.00 | 23.37 | C |
| ATOM | 5271 | CD2 | LEU | D | 47 | −22.396 | −32.293 | 90.251 | 1.00 | 26.58 | C |
| ATOM | 5272 | N | LEU | D | 48 | −22.020 | −31.872 | 95.064 | 1.00 | 25.20 | N |
| ATOM | 5273 | CA | LEU | D | 48 | −21.967 | −30.576 | 95.756 | 1.00 | 29.85 | C |
| ATOM | 5274 | C | LEU | D | 48 | −21.153 | −29.530 | 95.021 | 1.00 | 28.28 | C |
| ATOM | 5275 | O | LEU | D | 48 | −21.553 | −28.371 | 94.962 | 1.00 | 26.16 | O |
| ATOM | 5276 | CB | LEU | D | 48 | −21.354 | −30.705 | 97.156 | 1.00 | 24.38 | C |
| ATOM | 5277 | CG | LEU | D | 48 | −22.032 | −31.429 | 98.300 | 1.00 | 29.64 | C |
| ATOM | 5278 | CD1 | LEU | D | 48 | −21.124 | −31.235 | 99.476 | 1.00 | 28.92 | C |
| ATOM | 5279 | CD2 | LEU | D | 48 | −23.421 | −30.868 | 98.604 | 1.00 | 30.54 | C |
| ATOM | 5280 | N | ILE | D | 49 | −19.998 | −29.933 | 94.505 | 1.00 | 24.89 | N |
| ATOM | 5281 | CA | ILE | D | 49 | −19.008 | −29.059 | 93.903 | 1.00 | 25.06 | C |
| ATOM | 5282 | C | ILE | D | 49 | −18.484 | −29.781 | 92.672 | 1.00 | 28.83 | C |
| ATOM | 5283 | O | ILE | D | 49 | −18.212 | −30.986 | 92.726 | 1.00 | 25.60 | O |
| ATOM | 5284 | CB | ILE | D | 49 | −17.833 | −28.787 | 94.879 | 1.00 | 27.73 | C |
| ATOM | 5285 | CG1 | ILE | D | 49 | −18.307 | −28.181 | 96.214 | 1.00 | 22.96 | C |
| ATOM | 5286 | CG2 | ILE | D | 49 | −16.678 | −28.055 | 94.176 | 1.00 | 21.77 | C |
| ATOM | 5287 | CD1 | ILE | D | 49 | −18.656 | −26.704 | 96.180 | 1.00 | 28.66 | C |
| ATOM | 5288 | N | PHE | D | 50 | −18.308 | −29.049 | 91.573 | 1.00 | 25.66 | N |
| ATOM | 5289 | CA | PHE | D | 50 | −17.533 | −29.563 | 90.460 | 1.00 | 23.52 | C |
| ATOM | 5290 | C | PHE | D | 50 | −16.420 | −28.576 | 90.149 | 1.00 | 30.77 | C |
| ATOM | 5291 | O | PHE | D | 50 | −16.505 | −27.377 | 90.451 | 1.00 | 26.94 | O |
| ATOM | 5292 | CB | PHE | D | 50 | −18.381 | −29.861 | 89.202 | 1.00 | 25.10 | C |
| ATOM | 5293 | CG | PHE | D | 50 | −19.084 | −28.669 | 88.645 | 1.00 | 29.89 | C |
| ATOM | 5294 | CD2 | PHE | D | 50 | −20.394 | −28.380 | 89.034 | 1.00 | 28.85 | C |
| ATOM | 5295 | CD1 | PHE | D | 50 | −18.460 | −27.848 | 87.720 | 1.00 | 26.32 | C |
| ATOM | 5296 | CE2 | PHE | D | 50 | −21.038 | −27.263 | 88.538 | 1.00 | 33.45 | C |
| ATOM | 5297 | CE1 | PHE | D | 50 | −19.111 | −26.747 | 87.212 | 1.00 | 31.34 | C |
| ATOM | 5298 | CZ | PHE | D | 50 | −20.412 | −26.457 | 87.616 | 1.00 | 33.07 | C |
| ATOM | 5299 | N | GLY | D | 51 | −15.381 | −29.125 | 89.536 | 1.00 | 29.64 | N |
| ATOM | 5300 | CA | GLY | D | 51 | −14.110 | −28.473 | 89.344 | 1.00 | 31.07 | C |
| ATOM | 5301 | C | GLY | D | 51 | −13.912 | −27.013 | 89.635 | 1.00 | 29.90 | C |
| ATOM | 5302 | O | GLY | D | 51 | −14.299 | −26.190 | 88.823 | 1.00 | 41.98 | O |
| ATOM | 5303 | N | ALA | D | 52 | −13.331 | −26.633 | 90.761 | 1.00 | 29.04 | N |
| ATOM | 5304 | CA | ALA | D | 52 | −13.045 | −27.404 | 91.963 | 1.00 | 27.42 | C |
| ATOM | 5305 | C | ALA | D | 52 | −13.634 | −26.483 | 93.033 | 1.00 | 31.29 | C |
| ATOM | 5306 | O | ALA | D | 52 | −13.389 | −26.630 | 94.242 | 1.00 | 26.21 | O |
| ATOM | 5307 | CB | ALA | D | 52 | −11.545 | −27.613 | 92.180 | 1.00 | 24.46 | C |
| ATOM | 5308 | N | SER | D | 53 | −14.356 | −25.473 | 92.528 | 1.00 | 25.45 | N |
| ATOM | 5309 | CA | SER | D | 53 | −14.951 | −24.408 | 93.321 | 1.00 | 29.64 | C |
| ATOM | 5310 | C | SER | D | 53 | −16.366 | −24.061 | 92.909 | 1.00 | 29.31 | C |
| ATOM | 5311 | O | SER | D | 53 | −17.001 | −23.251 | 93.595 | 1.00 | 29.52 | O |
| ATOM | 5312 | CB | SER | D | 53 | −14.102 | −23.144 | 93.229 | 1.00 | 24.22 | C |
| ATOM | 5313 | OG | SER | D | 53 | −13.751 | −22.931 | 91.878 | 1.00 | 30.08 | O |
| ATOM | 5314 | N | SER | D | 54 | −16.872 | −24.618 | 91.918 | 1.00 | 24.59 | N |
| ATOM | 5315 | CA | SER | D | 54 | −18.183 | −24.249 | 91.320 | 1.00 | 28.33 | C |
| ATOM | 5316 | C | SER | D | 54 | −19.261 | −25.017 | 92.073 | 1.00 | 29.42 | C |
| ATOM | 5317 | O | SER | D | 54 | −19.261 | −26.252 | 92.107 | 1.00 | 28.83 | O |
| ATOM | 5318 | CB | SER | D | 54 | −18.294 | −24.510 | 89.818 | 1.00 | 30.14 | C |
| ATOM | 5319 | OG | SER | D | 54 | −17.503 | −23.611 | 89.086 | 1.00 | 31.63 | O |
| ATOM | 5320 | N | ARG | D | 55 | −20.185 | −24.274 | 92.653 | 1.00 | 26.56 | N |
| ATOM | 5321 | CA | ARG | D | 55 | −21.342 | −24.858 | 93.293 | 1.00 | 26.99 | C |
| ATOM | 5322 | C | ARG | D | 55 | −22.293 | −25.465 | 92.261 | 1.00 | 31.42 | C |
| ATOM | 5323 | O | ARG | D | 55 | −22.594 | −24.854 | 91.230 | 1.00 | 34.25 | O |
| ATOM | 5324 | CB | ARG | D | 55 | −22.033 | −23.773 | 94.100 | 1.00 | 31.93 | C |
| ATOM | 5325 | CG | ARG | D | 55 | −22.782 | −24.249 | 95.296 | 1.00 | 39.96 | C |
| ATOM | 5326 | CD | ARG | D | 55 | −23.378 | −23.054 | 96.043 | 1.00 | 42.71 | C |
| ATOM | 5327 | NE | ARG | D | 55 | −22.393 | −22.357 | 96.853 | 1.00 | 39.62 | N |
| ATOM | 5328 | CZ | ARG | D | 55 | −21.943 | −21.142 | 96.574 | 1.00 | 42.81 | C |
| ATOM | 5329 | NH1 | ARG | D | 55 | −21.042 | −20.564 | 97.367 | 1.00 | 46.41 | N1+ |
| ATOM | 5330 | NH2 | ARG | D | 55 | −22.396 | −20.516 | 95.497 | 1.00 | 41.95 | N |
| ATOM | 5331 | N | ALA | D | 56 | −22.783 | −26.668 | 92.562 | 1.00 | 29.25 | N |
| ATOM | 5332 | CA | ALA | D | 56 | −23.814 | −27.344 | 91.783 | 1.00 | 34.27 | C |
| ATOM | 5333 | C | ALA | D | 56 | −25.176 | −26.678 | 91.997 | 1.00 | 36.12 | C |
| ATOM | 5334 | O | ALA | D | 56 | −25.355 | −25.830 | 92.877 | 1.00 | 36.11 | O |
| ATOM | 5335 | CB | ALA | D | 56 | −23.891 | −28.823 | 92.166 | 1.00 | 31.23 | C |
| ATOM | 5336 | N | THR | D | 57 | −26.154 | −27.081 | 91.184 | 1.00 | 36.05 | N |
| ATOM | 5337 | CA | THR | D | 57 | −27.475 | −26.471 | 91.274 | 1.00 | 46.10 | C |

TABLE 10.4-continued

| ATOM | 5338 | C | THR | D | 57 | −28.178 | −26.905 | 92.546 | 1.00 | 41.98 | C |
|---|---|---|---|---|---|---|---|---|---|---|---|
| ATOM | 5339 | O | THR | D | 57 | −28.091 | −28.063 | 92.960 | 1.00 | 44.69 | O |
| ATOM | 5340 | CB | THR | D | 57 | −28.345 | −26.861 | 90.081 | 1.00 | 48.23 | C |
| ATOM | 5341 | OG1 | THR | D | 57 | −27.504 | −27.188 | 88.968 | 1.00 | 51.51 | O |
| ATOM | 5342 | CG2 | THR | D | 57 | −29.281 | −25.707 | 89.713 | 1.00 | 39.36 | C |
| ATOM | 5343 | N | GLY | D | 58 | −28.898 | −25.966 | 93.148 | 1.00 | 36.11 | N |
| ATOM | 5344 | CA | GLY | D | 58 | −29.589 | −26.198 | 94.396 | 1.00 | 36.25 | C |
| ATOM | 5345 | C | GLY | D | 58 | −28.722 | −26.367 | 95.629 | 1.00 | 35.95 | C |
| ATOM | 5346 | O | GLY | D | 58 | −29.266 | −26.615 | 96.706 | 1.00 | 46.21 | O |
| ATOM | 5347 | N | ILE | D | 59 | −27.406 | −26.270 | 95.526 | 1.00 | 35.23 | N |
| ATOM | 5348 | CA | ILE | D | 59 | −26.552 | −26.443 | 96.707 | 1.00 | 37.35 | C |
| ATOM | 5349 | C | ILE | D | 59 | −26.499 | −25.124 | 97.480 | 1.00 | 32.79 | C |
| ATOM | 5350 | O | ILE | D | 59 | −26.110 | −24.102 | 96.902 | 1.00 | 34.26 | O |
| ATOM | 5351 | CB | ILE | D | 59 | −25.147 | −26.884 | 96.291 | 1.00 | 34.60 | C |
| ATOM | 5352 | CG1 | ILE | D | 59 | −25.150 | −28.289 | 95.658 | 1.00 | 33.46 | C |
| ATOM | 5353 | CG2 | ILE | D | 59 | −24.257 | −26.892 | 97.511 | 1.00 | 28.92 | C |
| ATOM | 5354 | CD1 | ILE | D | 59 | −25.990 | −29.321 | 96.371 | 1.00 | 33.20 | C |
| ATOM | 5355 | N | PRO | D | 60 | −26.822 | −25.098 | 98.776 | 1.00 | 35.94 | N |
| ATOM | 5356 | CA | PRO | D | 60 | −26.753 | −23.831 | 99.528 | 1.00 | 36.87 | C |
| ATOM | 5357 | C | PRO | D | 60 | −25.384 | −23.165 | 99.443 | 1.00 | 39.65 | C |
| ATOM | 5358 | O | PRO | D | 60 | −24.357 | −23.825 | 99.258 | 1.00 | 40.06 | O |
| ATOM | 5359 | CB | PRO | D | 60 | −27.068 | −24.261 | 100.967 | 1.00 | 39.32 | C |
| ATOM | 5360 | CG | PRO | D | 60 | −27.875 | −25.486 | 100.816 | 1.00 | 40.27 | C |
| ATOM | 5361 | CD | PRO | D | 60 | −27.346 | −26.199 | 99.601 | 1.00 | 37.18 | C |
| ATOM | 5362 | N | ASP | D | 61 | −25.355 | −21.841 | 99.615 | 1.00 | 37.82 | N |
| ATOM | 5363 | CA | ASP | D | 61 | −24.047 | −21.197 | 99.529 | 1.00 | 38.85 | C |
| ATOM | 5364 | C | ASP | D | 61 | −23.271 | −21.286 | 100.830 | 1.00 | 38.37 | C |
| ATOM | 5365 | O | ASP | D | 61 | −22.161 | −20.757 | 100.895 | 1.00 | 43.54 | OO |
| ATOM | 5366 | CB | ASP | D | 61 | −24.153 | −19.736 | 99.070 | 1.00 | 39.37 | C |
| ATOM | 5367 | CG | ASP | D | 61 | −25.124 | −18.914 | 99.898 | 1.00 | 54.57 | C |
| ATOM | 5368 | OD1 | ASP | D | 61 | −25.360 | −19.253 | 101.082 | 1.00 | 61.72 | O |
| ATOM | 5369 | OD2 | ASP | D | 61 | −25.635 | −17.901 | 99.363 | 1.00 | 51.55 | O1− |
| ATOM | 5370 | N | ARG | D | 62 | −23.833 | −21.947 | 101.850 | 1.00 | 39.40 | N |
| ATOM | 5371 | CA | ARG | D | 62 | −23.032 | −22.496 | 102.939 | 1.00 | 36.54 | C |
| ATOM | 5372 | C | ARG | D | 62 | −21.805 | −23.229 | 102.414 | 1.00 | 34.81 | C |
| ATOM | 5373 | O | ARG | D | 62 | −20.738 | −23.199 | 103.037 | 1.00 | 31.24 | O |
| ATOM | 5374 | CB | ARG | D | 62 | −23.837 | −23.511 | 103.745 | 1.00 | 37.64 | C |
| ATOM | 5375 | CG | ARG | D | 62 | −25.054 | −23.076 | 104.366 | 1.00 | 36.64 | C |
| ATOM | 5376 | CD | ARG | D | 62 | −25.298 | −24.006 | 105.536 | 1.00 | 40.91 | C |
| ATOM | 5377 | NE | ARG | D | 62 | −25.716 | −25.370 | 105.214 | 1.00 | 38.63 | N |
| ATOM | 5378 | CZ | ARG | D | 62 | −26.848 | −25.692 | 104.593 | 1.00 | 43.76 | C |
| ATOM | 5379 | NH1 | ARG | D | 62 | −27.662 | −24.743 | 104.160 | 1.00 | 45.94 | N1+ |
| ATOM | 5380 | NH2 | ARG | D | 62 | −27.159 | −26.964 | 104.383 | 1.00 | 41.39 | N |
| ATOM | 5381 | N | PHE | D | 63 | −21.980 | −23.979 | 101.323 | 1.00 | 34.78 | N |
| ATOM | 5382 | CA | PHE | D | 63 | −20.936 | −24.809 | 100.738 | 1.00 | 34.76 | C |
| ATOM | 5383 | C | PHE | D | 63 | −20.101 | −23.966 | 99.797 | 1.00 | 32.41 | C |
| ATOM | 5384 | O | PHE | D | 63 | −20.646 | −23.271 | 98.933 | 1.00 | 35.79 | O |
| ATOM | 5385 | CB | PHE | D | 63 | −21.536 | −26.013 | 99.992 | 1.00 | 29.42 | C |
| ATOM | 5386 | CG | PHE | D | 63 | −22.210 | −27.001 | 100.898 | 1.00 | 28.36 | C |
| ATOM | 5387 | CD1 | PHE | D | 63 | −23.504 | −26.790 | 101.344 | 1.00 | 31.54 | C |
| ATOM | 5388 | CD2 | PHE | D | 63 | −21.537 | −28.120 | 101.336 | 1.00 | 28.75 | C |
| ATOM | 5389 | CE1 | PHE | D | 63 | −24.117 | −27.686 | 102.190 | 1.00 | 29.90 | C |
| ATOM | 5390 | CE2 | PHE | D | 63 | −22.149 | −29.017 | 102.180 | 1.00 | 31.42 | C |
| ATOM | 5391 | CZ | PHE | D | 63 | −23.441 | −28.796 | 102.611 | 1.00 | 27.00 | C |
| ATOM | 5392 | N | SER | D | 64 | −18.783 | −24.021 | 99.986 | 1.00 | 32.03 | N |
| ATOM | 5393 | CA | SER | D | 64 | −17.815 | −23.408 | 99.081 | 1.00 | 33.91 | C |
| ATOM | 5394 | C | SER | D | 64 | −16.566 | −24.279 | 99.051 | 1.00 | 26.96 | C |
| ATOM | 5395 | O | SER | D | 64 | −16.345 | −25.111 | 99.934 | 1.00 | 29.99 | O |
| ATOM | 5396 | CB | SER | D | 64 | −17.482 | −21.975 | 99.511 | 1.00 | 31.16 | C |
| ATOM | 5397 | OG | SER | D | 64 | −16.576 | −21.995 | 100.592 | 1.00 | 35.76 | O |
| ATOM | 5398 | N | ALA | D | 65 | −15.766 | −24.128 | 98.007 | 1.00 | 21.94 | N |
| ATOM | 5399 | CA | ALA | D | 65 | −14.588 | −24.982 | 97.928 | 1.00 | 27.79 | C |
| ATOM | 5400 | C | ALA | D | 65 | −13.547 | −24.302 | 97.063 | 1.00 | 28.20 | C |
| ATOM | 5401 | O | ALA | D | 65 | −13.859 | −23.392 | 96.297 | 1.00 | 28.35 | O |
| ATOM | 5402 | CB | ALA | D | 65 | −14.930 | −26.370 | 97.382 | 1.00 | 26.70 | C |
| ATOM | 5403 | N | SER | D | 66 | −12.305 | −24.767 | 97.185 | 1.00 | 31.90 | N |
| ATOM | 5404 | CA | SER | D | 66 | −11.196 | −24.189 | 96.432 | 1.00 | 32.71 | C |
| ATOM | 5405 | C | SER | D | 66 | −10.001 | −25.141 | 96.468 | 1.00 | 32.60 | C |
| ATOM | 5406 | O | SER | D | 66 | −10.005 | −26.170 | 97.149 | 1.00 | 34.80 | O |
| ATOM | 5407 | CB | SER | D | 66 | −10.787 | −22.831 | 97.003 | 1.00 | 27.36 | C |
| ATOM | 5408 | OG | SER | D | 66 | −10.156 | −23.031 | 98.253 | 1.00 | 32.54 | O |
| ATOM | 5409 | N | GLY | D | 67 | −8.948 | −24.745 | 95.780 | 1.00 | 31.68 | N |
| ATOM | 5410 | CA | GLY | D | 67 | −7.719 | −25.498 | 95.795 | 1.00 | 28.89 | C |
| ATOM | 5411 | C | GLY | D | 67 | −7.316 | −25.711 | 94.364 | 1.00 | 38.37 | C |
| ATOM | 5412 | O | GLY | D | 67 | −8.135 | −25.485 | 93.466 | 1.00 | 39.57 | O |
| ATOM | 5413 | N | SER | D | 68 | −6.057 | −26.066 | 94.125 | 1.00 | 36.68 | N |
| ATOM | 5414 | CA | SER | D | 68 | −5.677 | −26.559 | 92.813 | 1.00 | 36.53 | C |
| ATOM | 5415 | C | SER | D | 68 | −4.366 | −27.296 | 92.959 | 1.00 | 30.07 | C |
| ATOM | 5416 | O | SER | D | 68 | −3.660 | −27.148 | 93.952 | 1.00 | 38.18 | O |
| ATOM | 5417 | CB | SER | D | 68 | −5.559 | −25.449 | 91.757 | 1.00 | 44.96 | C |

TABLE 10.4-continued

| ATOM | 5418 | OG | SER | D | 68 | −5.439 | −26.014 | 90.444 | 1.00 | 48.06 | O |
|------|------|----|----|---|----|--------|---------|--------|------|-------|---|
| ATOM | 5419 | N | GLY | D | 69 | −4.062 | −28.097 | 91.954 | 1.00 | 29.21 | N |
| ATOM | 5420 | CA | GLY | D | 69 | −2.896 | −28.929 | 91.987 | 1.00 | 29.40 | C |
| ATOM | 5421 | C | GLY | D | 69 | −3.069 | −30.067 | 92.949 | 1.00 | 31.99 | C |
| ATOM | 5422 | O | GLY | D | 69 | −3.815 | −31.018 | 92.687 | 1.00 | 33.63 | O |
| ATOM | 5423 | N | ALA | D | 70 | −2.379 | −29.966 | 94.080 | 1.00 | 31.64 | N |
| ATOM | 5424 | CA | ALA | D | 70 | −2.287 | −31.065 | 95.022 | 1.00 | 31.80 | C |
| ATOM | 5425 | C | ALA | D | 70 | −3.275 | −30.980 | 96.171 | 1.00 | 31.37 | C |
| ATOM | 5426 | O | ALA | D | 70 | −3.550 | −32.008 | 96.792 | 1.00 | 36.24 | O |
| ATOM | 5427 | CB | ALA | D | 70 | −0.868 | −31.140 | 95.594 | 1.00 | 28.13 | C |
| ATOM | 5428 | N | ASP | D | 71 | −3.817 | −29.803 | 96.471 | 1.00 | 30.57 | N |
| ATOM | 5429 | CA | ASP | D | 71 | −4.565 | −29.587 | 97.706 | 1.00 | 33.18 | C |
| ATOM | 5430 | C | ASP | D | 71 | −5.945 | −29.009 | 97.415 | 1.00 | 32.16 | C |
| ATOM | 5431 | O | ASP | D | 71 | −6.063 | −27.965 | 96.768 | 1.00 | 31.72 | O |
| ATOM | 5432 | CB | ASP | D | 71 | −3.800 | −28.638 | 98.622 | 1.00 | 31.72 | C |
| ATOM | 5433 | CG | ASP | D | 71 | −2.722 | −29.331 | 99.396 | 1.00 | 47.35 | C |
| ATOM | 5434 | OD1 | ASP | D | 71 | −3.025 | −30.000 | 100.408 | 1.00 | 54.93 | O |
| ATOM | 5435 | OD2 | ASP | D | 71 | −1.553 | −29.211 | 98.980 | 1.00 | 57.78 | O1− |
| ATOM | 5436 | N | PHE | D | 72 | −6.981 | −29.643 | 97.939 | 1.00 | 28.95 | N |
| ATOM | 5437 | CA | PHE | D | 72 | −8.335 | −29.145 | 97.771 | 1.00 | 25.33 | C |
| ATOM | 5438 | C | PHE | D | 72 | −8.994 | −29.122 | 99.135 | 1.00 | 24.96 | C |
| ATOM | 5439 | O | PHE | D | 72 | −8.687 | −29.939 | 100.005 | 1.00 | 21.64 | O |
| ATOM | 5440 | CB | PHE | D | 72 | −9.121 | −30.008 | 96.781 | 1.00 | 26.11 | C |
| ATOM | 5441 | CG | PHE | D | 72 | −8.492 | −30.051 | 95.425 | 1.00 | 30.35 | C |
| ATOM | 5442 | CD1 | PHE | D | 72 | −7.479 | −30.982 | 95.144 | 1.00 | 29.20 | C |
| ATOM | 5443 | CD2 | PHE | D | 72 | −8.862 | −29.139 | 94.444 | 1.00 | 27.0 | C |
| ATOM | 5444 | CE1 | PHE | D | 72 | −6.862 | −31.014 | 93.898 | 1.00 | 31.22 | C |
| ATOM | 5445 | CE2 | PHE | D | 72 | −8.250 | −29.161 | 93.189 | 1.00 | 30.03 | C |
| ATOM | 5446 | N | PHE | D | 72 | −7.251 | −30.105 | 92.813 | 1.00 | 29.83 | C |
| ATOM | 5447 | CA | THR | D | 73 | −9.842 | −28.133 | 99.354 | 1.00 | 29.98 | N |
| ATOM | 5448 | CA | THR | D | 73 | −10.593 | −28.118 | 100.589 | 1.00 | 27.63 | C |
| ATOM | 5449 | C | THR | D | 73 | −12.045 | −27.791 | 100.275 | 1.00 | 28.02 | C |
| ATOM | 5450 | O | THR | D | 73 | −12.363 | −27.129 | 99.275 | 1.00 | 25.48 | O |
| ATOM | 5451 | CB | THR | D | 73 | −9.993 | −27.156 | 101.661 | 1.00 | 32.96 | C |
| ATOM | 5452 | OG1 | THR | D | 73 | −10.611 | −25.872 | 101.585 | 1.00 | 38.47 | O |
| ATOM | 5453 | CG2 | THR | D | 73 | −8.473 | −26.987 | 101.511 | 1.00 | 24.84 | C |
| ATOM | 5454 | N | LEU | D | 74 | −12.926 | −28.368 | 101.090 | 1.00 | 30.82 | N |
| ATOM | 5455 | CA | LEU | D | 74 | −14.351 | −28.062 | 101.114 | 1.00 | 26.16 | C |
| ATOM | 5456 | C | LEU | D | 74 | −14.662 | −27.367 | 102.433 | 1.00 | 27.40 | C |
| ATOM | 5457 | O | LEU | D | 74 | −14.247 | −24.843 | 103.499 | 1.00 | 27.12 | O |
| ATOM | 5458 | CB | LEU | D | 74 | −15.184 | −29.336 | 100.953 | 1.00 | 21.42 | C |
| ATOM | 5459 | CG | LEU | D | 74 | −16.696 | −29.239 | 101.152 | 1.00 | 21.05 | C |
| ATOM | 5460 | CD1 | LEU | D | 74 | −17.360 | −28.535 | 100.013 | 1.00 | 24.58 | C |
| ATOM | 5461 | CD2 | LEU | D | 74 | −17.329 | −30.584 | 101.345 | 1.00 | 20.48 | C |
| ATOM | 5462 | N | THR | D | 75 | −15.378 | −26.243 | 102.365 | 1.00 | 24.12 | N |
| ATOM | 5463 | CA | THR | D | 75 | −15.762 | −25.486 | 103.548 | 1.00 | 24.98 | C |
| ATOM | 5464 | C | THR | D | 75 | −17.286 | −25.435 | 103.651 | 1.00 | 28.91 | C |
| ATOM | 5465 | O | THR | D | 75 | −17.971 | −25.077 | 102.687 | 1.00 | 33.13 | O |
| ATOM | 5466 | CB | THR | D | 75 | −15.167 | −24.066 | 103.513 | 1.00 | 29.48 | C |
| ATOM | 5467 | OG1 | THR | D | 75 | −13.776 | −24.123 | 103.842 | 1.00 | 31.85 | O |
| ATOM | 5468 | CG2 | THR | D | 75 | −15.840 | −23.161 | 104.544 | 1.00 | 30.01 | C |
| ATOM | 5469 | N | ILE | D | 76 | −17.820 | −25.840 | 104.799 | 1.00 | 25.85 | N |
| ATOM | 5470 | CA | ILE | D | 76 | −19.217 | −25.616 | 105.141 | 1.00 | 25.76 | C |
| ATOM | 5471 | C | ILE | D | 76 | −19.211 | −24.568 | 106.232 | 1.00 | 30.23 | C |
| ATOM | 5472 | O | ILE | D | 76 | −18.718 | −24.829 | 107.337 | 1.00 | 34.43 | O |
| ATOM | 5473 | CB | ILE | D | 76 | −19.922 | −26.893 | 105.619 | 1.00 | 28.28 | C |
| ATOM | 5474 | CG1 | ILE | D | 76 | −19.619 | −28.063 | 104.696 | 1.00 | 28.54 | C |
| ATOM | 5475 | CG2 | ILE | D | 76 | −21.443 | −26.672 | 105.686 | 1.00 | 28.62 | C |
| ATOM | 5476 | CD1 | ILE | D | 76 | −20.092 | −29.368 | 105.257 | 1.00 | 27.59 | C |
| ATOM | 5477 | N | SER | D | 77 | −19.775 | −23.395 | 105.945 | 1.00 | 30.77 | N |
| ATOM | 5478 | CA | SER | D | 77 | −19.475 | −22.251 | 106.803 | 1.00 | 33.53 | C |
| ATOM | 5479 | C | SER | D | 77 | −20.286 | −22.267 | 108.097 | 1.00 | 32.03 | C |
| ATOM | 5480 | O | SER | D | 77 | −19.781 | −21.840 | 109.141 | 1.00 | 35.78 | O |
| ATOM | 5481 | CB | SER | D | 77 | −19.681 | −20.943 | 106.038 | 1.00 | 25.30 | C |
| ATOM | 5482 | OG | SER | D | 77 | −21.029 | −20.795 | 105.672 | 1.00 | 30.61 | O |
| ATOM | 5483 | N | ARG | D | 78 | −21.539 | −22.727 | 108.051 | 1.00 | 34.30 | N |
| ATOM | 5484 | CA | ARG | D | 78 | −22.346 | −22.937 | 109.254 | 1.00 | 33.67 | C |
| ATOM | 5485 | C | ARG | D | 78 | −23.026 | −24.294 | 109.107 | 1.00 | 33.98 | C |
| ATOM | 5486 | O | ARG | D | 78 | −23.982 | −24.422 | 108.341 | 1.00 | 30.96 | O |
| ATOM | 5487 | CB | ARG | D | 78 | −23.387 | −21.830 | 109.423 | 1.00 | 34.14 | C |
| ATOM | 5488 | CG | ARG | D | 78 | −24.425 | −22.137 | 110.499 | 1.00 | 46.20 | C |
| ATOM | 5489 | CD | ARG | D | 78 | −25.375 | −20.962 | 110.761 | 1.00 | 46.68 | C |
| ATOM | 5490 | NE | ARG | D | 78 | −25.737 | −20.874 | 112.185 | 1.00 | 49.36 | N |
| ATOM | 5491 | CZ | ARG | D | 78 | −26.801 | −21.439 | 112.763 | 1.00 | 57.02 | C |
| ATOM | 5492 | NH1 | ARG | D | 78 | −27.008 | −21.283 | 114.074 | 1.00 | 54.06 | N1+ |
| ATOM | 5493 | NH2 | ARG | D | 78 | −27.666 | −22.153 | 112.047 | 1.00 | 59.27 | N |
| ATOM | 5494 | N | LEU | D | 79 | −22.616 | −25.273 | 109.904 | 1.00 | 31.63 | N |
| ATOM | 5495 | CA | LEU | D | 79 | −23.146 | −26.627 | 109.772 | 1.00 | 29.40 | C |
| ATOM | 5496 | C | LEU | D | 79 | −24.623 | −26.674 | 110.172 | 1.00 | 34.83 | C |
| ATOM | 5497 | O | LEU | D | 79 | −24.969 | −26.417 | 111.328 | 1.00 | 36.97 | O |

TABLE 10.4-continued

| ATOM | 5498 | CB  | LEU | D | 79 | −22.333 | −27.580 | 110.640 | 1.00 | 26.40 | C   |
|------|------|-----|-----|---|----|---------|---------|---------|------|-------|-----|
| ATOM | 5499 | CG  | LEU | D | 79 | −21.373 | −28.630 | 110.107 | 1.00 | 26.42 | C   |
| ATOM | 5500 | CD1 | LEU | D | 79 | −21.113 | −28.496 | 108.643 | 1.00 | 29.85 | C   |
| ATOM | 5501 | CD2 | LEU | D | 79 | −20.083 | −28.535 | 110.868 | 1.00 | 29.71 | C   |
| ATOM | 5502 | N   | GLU | D | 80 | −25.507 | −26.990 | 109.211 | 1.00 | 35.29 | N   |
| ATOM | 5503 | CA  | GLU | D | 80 | −26.911 | −27.234 | 109.503 | 1.00 | 33.25 | C   |
| ATOM | 5504 | C   | GLU | D | 80 | −27.130 | −28.711 | 109.784 | 1.00 | 37.31 | C   |
| ATOM | 5505 | O   | GLU | D | 80 | −26.269 | −29.536 | 109.472 | 1.00 | 34.23 | O   |
| ATOM | 5506 | CB  | GLU | D | 80 | −27.771 | −26.790 | 108.334 | 1.00 | 37.10 | C   |
| ATOM | 5507 | CG  | GLU | D | 80 | −27.822 | −25.300 | 108.123 | 1.00 | 37.33 | C   |
| ATOM | 5508 | CD  | GLU | D | 80 | −28.430 | −24.559 | 109.292 | 1.00 | 45.25 | C   |
| ATOM | 5509 | OE1 | GLU | D | 80 | −29.311 | −25.110 | 109.996 | 1.00 | 48.39 | O   |
| ATOM | 5510 | OE2 | GLU | D | 80 | −28.039 | −23.395 | 109.496 | 1.00 | 54.67 | O1− |
| ATOM | 5511 | N   | PRO | D | 81 | −28.261 | −29.088 | 110.403 | 1.00 | 43.56 | N   |
| ATOM | 5512 | CA  | PRO | D | 81 | −28.458 | −30.514 | 110.743 | 1.00 | 45.48 | C   |
| ATOM | 5513 | C   | PRO | D | 81 | −28.252 | −31.464 | 109.571 | 1.00 | 42.65 | C   |
| ATOM | 5514 | O   | PRO | D | 81 | −27.600 | −32.508 | 109.728 | 1.00 | 39.13 | O   |
| ATOM | 5515 | CB  | PRO | D | 81 | −29.909 | −30.547 | 111.254 | 1.00 | 44.07 | C   |
| ATOM | 5516 | CG  | PRO | D | 81 | −30.130 | −29.185 | 111.794 | 1.00 | 40.26 | C   |
| ATOM | 5517 | CD  | PRO | D | 81 | −29.382 | −28.259 | 110.884 | 1.00 | 41.88 | C   |
| ATOM | 5518 | N   | GLU | D | 82 | −28.761 | −31.107 | 108.389 | 1.00 | 40.42 | N   |
| ATOM | 5519 | CA  | GLU | D | 82 | −28.620 | −31.911 | 107.178 | 1.00 | 37.02 | C   |
| ATOM | 5520 | C   | GLU | D | 82 | −27.222 | −31.924 | 106.602 | 1.00 | 38.11 | C   |
| ATOM | 5521 | O   | GLU | D | 82 | −27.053 | −32.461 | 105.498 | 1.00 | 37.79 | O   |
| ATOM | 5522 | CB  | GLU | D | 82 | −29.528 | −31.396 | 106.079 | 1.00 | 34.91 | C   |
| ATOM | 5523 | CG  | GLU | D | 82 | −29.092 | −30.088 | 105.479 | 1.00 | 42.26 | C   |
| ATOM | 5524 | CD  | GLU | D | 82 | −30.094 | −28.977 | 105.612 | 1.00 | 49.69 | C   |
| ATOM | 5525 | OE1 | GLU | D | 82 | −30.683 | −28.801 | 106.716 | 1.00 | 59.37 | O   |
| ATOM | 5526 | OE2 | GLU | D | 82 | −30.297 | −28.286 | 104.582 | 1.00 | 55.07 | O1− |
| ATOM | 5527 | N   | ASP | D | 83 | −26.234 | −31.314 | 107.246 | 1.00 | 31.73 | N   |
| ATOM | 5528 | CA  | ASP | D | 83 | −24.893 | −31.308 | 106.690 | 1.00 | 31.81 | C   |
| ATOM | 5529 | C   | ASP | D | 83 | −24.033 | −32.399 | 107.278 | 1.00 | 27.67 | C   |
| ATOM | 5530 | O   | ASP | D | 83 | −22.905 | −32.577 | 106.833 | 1.00 | 28.90 | O   |
| ATOM | 5531 | CB  | ASP | D | 83 | −24.205 | −29.949 | 106.911 | 1.00 | 35.00 | C   |
| ATOM | 5532 | CG  | ASP | D | 83 | −24.923 | −28.802 | 106.203 | 1.00 | 36.30 | C   |
| ATOM | 5533 | OD1 | ASP | D | 83 | −25.767 | −29.091 | 105.334 | 1.00 | 39.93 | O   |
| ATOM | 5534 | OD2 | ASP | D | 83 | −24.663 | −27.615 | 106.524 | 1.00 | 33.84 | O1− |
| ATOM | 5535 | N   | PHE | D | 84 | −24.531 | −33.133 | 108.262 | 1.00 | 28.52 | N   |
| ATOM | 5536 | CA  | PHE | D | 84 | −23.736 | −34.160 | 108.921 | 1.00 | 27.69 | C   |
| ATOM | 5537 | C   | PHE | D | 84 | −23.892 | −35.469 | 108.164 | 1.00 | 27.68 | C   |
| ATOM | 5538 | O   | PHE | D | 84 | −24.963 | −36.083 | 108.176 | 1.00 | 27.12 | O   |
| ATOM | 5539 | CB  | PHE | D | 84 | −24.127 | −34.276 | 110.391 | 1.00 | 26.49 | C   |
| ATOM | 5540 | CG  | PHE | D | 84 | −23.758 | −33.065 | 111.194 | 1.00 | 27.03 | C   |
| ATOM | 5541 | CD1 | PHE | D | 84 | −22.520 | −32.992 | 111.822 | 1.00 | 27.26 | C   |
| ATOM | 5542 | CD2 | PHE | D | 84 | −24.628 | −31.981 | 111.289 | 1.00 | 30.67 | C   |
| ATOM | 5543 | CE1 | PHE | D | 84 | −22.156 | −31.865 | 112.562 | 1.00 | 31.27 | C   |
| ATOM | 5544 | CE2 | PHE | D | 84 | −24.281 | −30.849 | 112.016 | 1.00 | 29.02 | C   |
| ATOM | 5545 | CZ  | PHE | D | 84 | −23.039 | −30.794 | 112.667 | 1.00 | 32.36 | C   |
| ATOM | 5546 | N   | ALA | D | 85 | −22.815 | −35.890 | 107.516 | 1.00 | 25.77 | N   |
| ATOM | 5547 | CA  | ALA | D | 85 | −22.859 | −36.899 | 106.469 | 1.00 | 21.15 | C   |
| ATOM | 5548 | C   | ALA | D | 85 | −21.420 | −37.274 | 106.118 | 1.00 | 22.96 | C   |
| ATOM | 5549 | O   | ALA | D | 85 | −20.472 | −36.875 | 106.800 | 1.00 | 22.25 | O   |
| ATOM | 5550 | CB  | ALA | D | 85 | −23.660 | −36.381 | 105.275 | 1.00 | 25.38 | C   |
| ATOM | 5551 | N   | VAL | D | 86 | −21.251 | −38.069 | 105.059 | 1.00 | 25.06 | N   |
| ATOM | 5552 | CA  | VAL | D | 86 | −19.939 | −38.399 | 104.521 | 1.00 | 20.70 | C   |
| ATOM | 5553 | C   | VAL | D | 86 | −19.708 | −37.553 | 103.278 | 1.00 | 22.14 | C   |
| ATOM | 5554 | O   | VAL | D | 86 | −20.628 | −37.341 | 102.488 | 1.00 | 27.68 | O   |
| ATOM | 5555 | CB  | VAL | D | 86 | −19.841 | −39.901 | 104.217 | 1.00 | 19.64 | C   |
| ATOM | 5556 | CG1 | VAL | D | 86 | −18.533 | −40.230 | 103.523 | 1.00 | 22.34 | C   |
| ATOM | 5557 | CG2 | VAL | D | 86 | −19.953 | −40.660 | 105.485 | 1.00 | 16.64 | C   |
| ATOM | 5558 | N   | TYR | D | 87 | −18.497 | −37.033 | 103.120 | 1.00 | 21.19 | N   |
| ATOM | 5559 | CA  | TYR | D | 87 | −18.151 | −36.206 | 101.975 | 1.00 | 24.17 | C   |
| ATOM | 5560 | C   | TYR | D | 87 | −17.024 | −36.879 | 101.219 | 1.00 | 25.06 | C   |
| ATOM | 5561 | O   | TYR | D | 87 | −16.084 | −37.381 | 101.837 | 1.00 | 25.52 | O   |
| ATOM | 5562 | CB  | TYR | D | 87 | −17.765 | −34.766 | 102.410 | 1.00 | 25.82 | C   |
| ATOM | 5563 | CG  | TYR | D | 87 | −18.963 | −34.036 | 102.978 | 1.00 | 24.53 | C   |
| ATOM | 5564 | CD1 | TYR | D | 87 | −19.368 | −34.249 | 104.286 | 1.00 | 22.98 | C   |
| ATOM | 5565 | CD2 | TYR | D | 87 | −19.735 | −33.198 | 102.178 | 1.00 | 22.74 | C   |
| ATOM | 5566 | CE1 | TYR | D | 87 | −20.502 | −33.616 | 104.791 | 1.00 | 27.82 | C   |
| ATOM | 5567 | CE2 | TYR | D | 87 | −20.857 | −32.573 | 102.662 | 1.00 | 22.11 | C   |
| ATOM | 5568 | CZ  | TYR | D | 87 | −21.244 | −32.777 | 103.966 | 1.00 | 28.03 | C   |
| ATOM | 5569 | OH  | TYR | D | 87 | −22.379 | −32.154 | 104.449 | 1.00 | 29.25 | O   |
| ATOM | 5570 | N   | PHE | D | 88 | −17.140 | −36.897 | 99.885  | 1.00 | 22.99 | N   |
| ATOM | 5571 | CA  | PHE | D | 88 | −16.222 | −37.590 | 98.990  | 1.00 | 25.06 | C   |
| ATOM | 5572 | C   | PHE | D | 88 | −15.653 | −36.649 | 97.952  | 1.00 | 27.58 | C   |
| ATOM | 5573 | O   | PHE | D | 88 | −16.403 | −35.890 | 97.327  | 1.00 | 28.74 | O   |
| ATOM | 5574 | CB  | PHE | D | 88 | −16.920 | −38.715 | 98.216  | 1.00 | 29.50 | C   |
| ATOM | 5575 | CG  | PHE | D | 88 | −17.173 | −39.937 | 99.283  | 1.00 | 27.68 | C   |
| ATOM | 5576 | CD1 | PHE | D | 88 | −16.133 | −40.820 | 99.283  | 1.00 | 27.68 | C   |
| ATOM | 5577 | CD2 | PHE | D | 88 | −18.442 | −40.231 | 99.470  | 1.00 | 26.34 | C   |

TABLE 10.4-continued

| | | | | | | | | | | |
|---|---|---|---|---|---|---|---|---|---|---|
| ATOM | 5578 | CE1 | PHE | D | 88 | −16.354 | −41.984 | 100.003 | 1.00 | 31.19 | C |
| ATOM | 5579 | CE2 | PHE | D | 88 | −18.664 | −41.389 | 100.198 | 1.00 | 31.81 | C |
| ATOM | 5580 | CZ | PHE | D | 88 | −17.614 | −42.268 | 100.470 | 1.00 | 27.93 | C |
| ATOM | 5581 | N | CYS | D | 89 | −14.350 | −36.745 | 97.704 | 1.00 | 26.11 | N |
| ATOM | 5582 | CA | CYS | D | 89 | −13.809 | −36.023 | 96.567 | 1.00 | 24.60 | C |
| ATOM | 5583 | C | CYS | D | 89 | −13.561 | −36.988 | 95.406 | 1.00 | 25.26 | C |
| ATOM | 5584 | O | CYS | D | 89 | −13.464 | −38.206 | 95.575 | 1.00 | 23.50 | O |
| ATOM | 5585 | CB | CYS | D | 89 | −12.537 | −35.249 | 96.941 | 1.00 | 23.65 | C |
| ATOM | 5586 | SG | CYS | D | 89 | −11.143 | −36.170 | 97.584 | 1.00 | 38.72 | S |
| ATOM | 5587 | N | GLN | D | 90 | −13.489 | −36.424 | 94.208 | 1.00 | 21.35 | N |
| ATOM | 5588 | CA | GLN | D | 90 | −13.364 | −37.237 | 93.006 | 1.00 | 24.00 | C |
| ATOM | 5589 | C | GLN | D | 90 | −12.697 | −36.404 | 91.921 | 1.00 | 24.00 | C |
| ATOM | 5590 | O | GLN | D | 90 | −13.073 | −35.249 | 91.715 | 1.00 | 23.20 | O |
| ATOM | 5591 | CB | GLN | D | 90 | −14.732 | −37.733 | 92.536 | 1.00 | 21.84 | C |
| ATOM | 5592 | CG | GLN | D | 90 | −14.703 | −38.606 | 91.307 | 1.00 | 21.39 | C |
| ATOM | 5593 | CD | GLN | D | 90 | −15.439 | −37.976 | 90.144 | 1.00 | 26.00 | C |
| ATOM | 5594 | OE1 | GLN | D | 90 | −16.481 | −37.331 | 90.333 | 1.00 | 29.02 | O |
| ATOM | 5595 | NE2 | GLN | D | 90 | −14.915 | −38.158 | 88.933 | 1.00 | 21.45 | N |
| ATOM | 5596 | N | GLN | D | 91 | −11.714 | −36.984 | 91.236 | 1.00 | 22.35 | N |
| ATOM | 5597 | CA | GLN | D | 91 | −11.051 | −36.316 | 90.130 | 1.00 | 24.41 | C |
| ATOM | 5598 | C | GLN | D | 91 | −11.459 | −36.980 | 88.818 | 1.00 | 26.03 | C |
| ATOM | 5599 | O | GLN | D | 91 | −11.628 | −38.205 | 88.750 | 1.00 | 23.79 | O |
| ATOM | 5600 | CB | GLN | D | 91 | −9.520 | −36.329 | 90.308 | 1.00 | 21.11 | C |
| ATOM | 5601 | CG | GLN | D | 91 | −8.866 | −37.697 | 90.214 | 1.00 | 21.28 | C |
| ATOM | 5602 | CD | GLN | D | 91 | −8.585 | −39.091 | 88.785 | 1.00 | 26.27 | C |
| ATOM | 5603 | OE1 | GLN | D | 91 | −8.432 | −37.231 | 87.917 | 1.00 | 28.92 | O |
| ATOM | 5604 | NE2 | GLN | D | 91 | −8.567 | −39.384 | 88.514 | 1.00 | 26.42 | N |
| ATOM | 5605 | N | TYR | D | 92 | −11.588 | −36.162 | 87.776 | 1.00 | 22.58 | N |
| ATOM | 5606 | CA | TYR | D | 92 | −11.946 | −36.594 | 86.432 | 1.00 | 26.01 | C |
| ATOM | 5607 | C | TYR | D | 92 | −11.013 | −35.927 | 85.432 | 1.00 | 27.20 | C |
| ATOM | 5608 | O | TYR | D | 92 | −11.409 | −35.517 | 84.334 | 1.00 | 25.89 | O |
| ATOM | 5609 | CB | TYR | D | 92 | −13.413 | −36.300 | 86.093 | 1.00 | 22.29 | C |
| ATOM | 5610 | CG | TYR | D | 92 | −13.889 | −34.864 | 86.367 | 1.00 | 26.32 | C |
| ATOM | 5611 | CD1 | TYR | D | 92 | −14.320 | −34.475 | 87.646 | 1.00 | 21.74 | C |
| ATOM | 5612 | CD2 | TYR | D | 92 | −13.903 | −33.893 | 85.344 | 1.00 | 26.96 | C |
| ATOM | 5613 | CE1 | TYR | D | 92 | −14.755 | −33.186 | 87.894 | 1.00 | 22.81 | C |
| ATOM | 5614 | CE2 | TYR | D | 92 | −14.347 | −32.585 | 85.587 | 1.00 | 24.44 | C |
| ATOM | 5615 | CZ | TYR | D | 92 | −14.764 | −32.247 | 86.867 | 1.00 | 27.75 | C |
| ATOM | 5616 | OH | TYR | D | 92 | −15.189 | −30.972 | 87.141 | 1.00 | 29.35 | O |
| ATOM | 5617 | N | GLU | D | 93 | −9.755 | −35.782 | 85.826 | 1.00 | 27.70 | N |
| ATOM | 5618 | CA | GLU | D | 93 | −8.729 | −35.263 | 84.936 | 1.00 | 29.92 | C |
| ATOM | 5619 | C | GLU | D | 93 | −8.055 | −36.384 | 84.141 | 1.00 | 31.61 | C |
| ATOM | 5620 | O | GLU | D | 93 | −7.883 | −36.278 | 82.926 | 1.00 | 33.23 | O |
| ATOM | 5621 | CB | GLU | D | 93 | −7.687 | −34.482 | 85.744 | 1.00 | 25.29 | C |
| ATOM | 5622 | CG | GLU | D | 93 | −6.386 | −34.312 | 84.993 | 1.00 | 28.20 | C |
| ATOM | 5623 | CD | GLU | D | 93 | −5.369 | −33.447 | 85.700 | 1.00 | 32.11 | C |
| ATOM | 5624 | OE1 | GLU | D | 93 | −5.735 | −32.389 | 86.285 | 1.00 | 26.85 | O |
| ATOM | 5625 | OE2 | GLU | D | 93 | −4.183 | −33.828 | 85.637 | 1.00 | 36.40 | O1− |
| ATOM | 5626 | N | SER | D | 94 | −7.694 | −37.471 | 84.810 | 1.00 | 28.99 | N |
| ATOM | 5627 | CA | SER | D | 94 | −6.939 | −38.555 | 84.213 | 1.00 | 28.53 | C |
| ATOM | 5628 | C | SER | D | 94 | −7.651 | −39.859 | 84.514 | 1.00 | 28.50 | C |
| ATOM | 5629 | O | SER | D | 94 | −8.040 | −40.110 | 85.661 | 1.00 | 26.38 | O |
| ATOM | 5630 | CB | SER | D | 94 | −5.499 | −38.586 | 84.754 | 1.00 | 27.94 | C |
| ATOM | 5631 | OG | SER | D | 94 | −4.912 | −39.865 | 84.570 | 1.00 | 33.48 | O |
| ATOM | 5632 | N | SER | D | 95 | −7.844 | −40.669 | 83.487 | 1.00 | 25.22 | N |
| ATOM | 5633 | CA | SER | D | 95 | −8.488 | −41.943 | 83.683 | 1.00 | 29.13 | C |
| ATOM | 5634 | C | SER | D | 95 | −7.512 | −42.941 | 84.345 | 1.00 | 28.02 | C |
| ATOM | 5635 | O | SER | D | 95 | −6.324 | −42.923 | 84.083 | 1.00 | 28.38 | O |
| ATOM | 5636 | CB | SER | D | 95 | −9.012 | −42.479 | 82.363 | 1.00 | 30.42 | C |
| ATOM | 5637 | OG | SER | D | 95 | −9.598 | −43.754 | 82.570 | 1.00 | 42.60 | O |
| ATOM | 5638 | N | PRO | D | 96 | −8.018 | −43.796 | 85.228 | 1.00 | 25.83 | N |
| ATOM | 5639 | CA | PRO | D | 96 | −9.421 | −43.894 | 85.652 | 1.00 | 27.86 | C |
| ATOM | 5640 | C | PRO | D | 96 | −9.883 | −42.764 | 86.572 | 1.00 | 29.69 | C |
| ATOM | 5641 | O | PRO | D | 96 | −9.078 | −42.248 | 87.363 | 1.00 | 29.09 | O |
| ATOM | 5642 | CB | PRO | D | 96 | −9.454 | −45.229 | 86.397 | 1.00 | 32.44 | C |
| ATOM | 5643 | CG | PRO | D | 96 | −8.081 | −45.372 | 86.953 | 1.00 | 29.69 | C |
| ATOM | 5644 | CD | PRO | D | 96 | −7.169 | −44.788 | 85.901 | 1.00 | 25.85 | C |
| ATOM | 5645 | N | TRP | D | 97 | −11.153 | −42.369 | 86.470 | 1.00 | 27.79 | N |
| ATOM | 5646 | CA | TRP | D | 97 | −11.727 | −41.539 | 87.513 | 1.00 | 23.51 | C |
| ATOM | 5647 | C | TRP | D | 97 | −11.541 | −42.239 | 88.855 | 1.00 | 27.99 | C |
| ATOM | 5648 | O | TRP | D | 97 | −11.697 | −43.459 | 88.964 | 1.00 | 26.14 | O |
| ATOM | 5649 | CB | TRP | D | 97 | −13.205 | −41.292 | 87.265 | 1.00 | 26.18 | C |
| ATOM | 5650 | CG | TRP | D | 97 | −13.628 | −40.489 | 86.072 | 1.00 | 26.55 | C |
| ATOM | 5651 | CD1 | TRP | D | 97 | −14.907 | −40.229 | 85.726 | 1.00 | 23.15 | C |
| ATOM | 5652 | CD2 | TRP | D | 97 | −12.804 | −39.864 | 85.056 | 1.00 | 32.73 | C |
| ATOM | 5653 | NE1 | TRP | D | 97 | −14.953 | −39.474 | 84.583 | 1.00 | 28.40 | N |
| ATOM | 5654 | CE2 | TRP | D | 97 | −13.683 | −39.228 | 84.151 | 1.00 | 27.44 | C |
| ATOM | 5655 | CE3 | TRP | D | 97 | −11.419 | −39.760 | 84.835 | 1.00 | 25.48 | C |
| ATOM | 5656 | CZ2 | TRP | D | 97 | −13.232 | −38.510 | 83.046 | 1.00 | 28.49 | C |
| ATOM | 5657 | CZ3 | TRP | D | 97 | −10.975 | −39.045 | 83.734 | 1.00 | 23.95 | C |

TABLE 10.4-continued

| | | | | | | | | | | |
|---|---|---|---|---|---|---|---|---|---|---|
| ATOM | 5658 | CH2 | TRP | D | 97 | −11.876 | −38.438 | 82.849 | 1.00 | 28.01 | C |
| ATOM | 5659 | N | THR | D | 98 | −11.174 | −41.469 | 89.877 | 1.00 | 28.12 | N |
| ATOM | 5660 | CA | THR | D | 98 | −10.911 | −42.018 | 91.196 | 1.00 | 28.04 | C |
| ATOM | 5661 | C | THR | D | 98 | −11.606 | −41.178 | 92.255 | 1.00 | 27.40 | C |
| ATOM | 5662 | O | THR | D | 98 | −11.797 | −39.972 | 92.089 | 1.00 | 24.69 | O |
| ATOM | 5663 | CB | THR | D | 98 | −9.390 | −42.067 | 91.493 | 1.00 | 30.50 | C |
| ATOM | 5664 | OG1 | THR | D | 98 | −8.813 | −40.781 | 91.230 | 1.00 | 29.88 | O |
| ATOM | 5665 | CG2 | THR | D | 98 | −8.687 | −43.122 | 90.648 | 1.00 | 24.32 | C |
| ATOM | 5666 | N | PHE | D | 99 | −11.928 | −41.821 | 93.372 | 1.00 | 28.87 | N |
| ATOM | 5667 | CA | PHE | D | 99 | −12.603 | −41.187 | 94.492 | 1.00 | 28.08 | C |
| ATOM | 5668 | C | PHE | D | 99 | −11.686 | −41.223 | 95.704 | 1.00 | 31.16 | C |
| ATOM | 5669 | O | PHE | D | 99 | −10.854 | −42.128 | 95.835 | 1.00 | 28.56 | O |
| ATOM | 5690 | CB | PHE | D | 99 | −13.931 | −41.891 | 94.859 | 1.00 | 22.78 | C |
| ATOM | 5671 | CG | PHE | D | 99 | −15.028 | −41.690 | 93.863 | 1.00 | 25.65 | C |
| ATOM | 5672 | CD1 | PHE | D | 99 | −15.156 | −42.534 | 92.778 | 1.00 | 25.60 | C |
| ATOM | 5673 | CD2 | PHE | D | 99 | −15.945 | −40.658 | 94.015 | 1.00 | 25.03 | C |
| ATOM | 5674 | CE1 | PHE | D | 99 | −16.171 | −42.362 | 91.864 | 1.00 | 23.95 | C |
| ATOM | 5675 | CE2 | PHE | D | 99 | −16.957 | −40.474 | 93.100 | 1.00 | 25.16 | C |
| ATOM | 5676 | CZ | PHE | D | 99 | −17.066 | −41.336 | 92.011 | 1.00 | 23.49 | C |
| ATOM | 5677 | N | GLY | D | 100 | −11.852 | −40.218 | 96.597 | 1.00 | 26.03 | N |
| ATOM | 5678 | CA | GLY | D | 100 | −11.280 | −40.302 | 97.918 | 1.00 | 25.35 | C |
| ATOM | 5679 | C | GLY | D | 100 | −12.110 | −41.227 | 98.769 | 1.00 | 29.26 | C |
| ATOM | 5680 | O | GLY | D | 100 | −13.227 | −41.602 | 98.411 | 1.00 | 31.89 | O |
| ATOM | 5681 | N | GLN | D | 101 | −11.553 | −41.623 | 99.901 | 1.00 | 26.91 | N |
| ATOM | 5682 | CA | GLN | D | 101 | −12.213 | −42.607 | 100.740 | 1.00 | 29.14 | C |
| ATOM | 5683 | C | GLN | D | 101 | −13.218 | −42.004 | 101.718 | 1.00 | 33.18 | C |
| ATOM | 5684 | O | GLN | D | 101 | −13.871 | −42.757 | 102.446 | 1.00 | 31.79 | O |
| ATOM | 5685 | CB | GLN | D | 101 | −11.163 | −43.426 | 101.480 | 1.00 | 37.07 | C |
| ATOM | 5686 | CG | GLN | D | 101 | −10.254 | −44.203 | 100.497 | 1.00 | 50.48 | C |
| ATOM | 5687 | CD | GLN | D | 101 | −10.653 | −45.667 | 100.316 | 1.00 | 57.12 | C |
| ATOM | 5688 | OE1 | GLN | D | 101 | −10.139 | −46.549 | 101.022 | 1.00 | 66.11 | O |
| ATOM | 5689 | NE2 | GLN | D | 101 | −11.564 | −45.935 | 99.371 | 1.00 | 48.92 | N |
| ATOM | 5690 | N | GLY | D | 102 | −13.381 | −40.691 | 101.740 | 1.00 | 27.41 | N |
| ATOM | 5691 | CA | GLY | D | 102 | −14.489 | −40.090 | 102.452 | 1.00 | 24.59 | C |
| ATOM | 5692 | C | GLY | D | 102 | −14.084 | −39.542 | 103.806 | 1.00 | 24.13 | C |
| ATOM | 5693 | O | GLY | D | 102 | −13.158 | −40.032 | 104.454 | 1.00 | 30.96 | O |
| ATOM | 5694 | N | THR | D | 103 | −14.767 | −38.478 | 104.226 | 1.00 | 26.72 | N |
| ATOM | 5695 | CA | THR | D | 103 | −14.681 | −37.929 | 105.577 | 1.00 | 25.89 | C |
| ATOM | 5696 | C | THR | D | 103 | −16.080 | −37.902 | 106.164 | 1.00 | 25.39 | C |
| ATOM | 5697 | O | THR | D | 103 | −16.997 | −37.334 | 105.560 | 1.00 | 19.85 | O |
| ATOM | 5698 | CB | THR | D | 103 | −14.116 | −36.500 | 105.626 | 1.00 | 28.14 | C |
| ATOM | 5699 | OG1 | THR | D | 103 | −12.740 | −36.480 | 105.221 | 1.00 | 28.24 | O |
| ATOM | 5700 | CG2 | THR | D | 103 | −14.269 | −35.913 | 107.044 | 1.00 | 26.41 | C |
| ATOM | 5701 | N | LYS | D | 104 | −16.230 | −38.501 | 107.344 | 1.00 | 27.38 | N |
| ATOM | 5702 | CA | LYS | D | 104 | −17.489 | −38.491 | 108.073 | 1.00 | 27.31 | C |
| ATOM | 5703 | C | LYS | D | 104 | −17.515 | −37.253 | 108.966 | 1.00 | 28.48 | C |
| ATOM | 5704 | O | LYS | D | 104 | −16.604 | −37.032 | 109.773 | 1.00 | 28.70 | O |
| ATOM | 5705 | CB | LYS | D | 104 | −17.661 | −39.787 | 108.875 | 1.00 | 25.02 | C |
| ATOM | 5706 | CG | LYS | D | 104 | −19.009 | −39.923 | 109.600 | 1.00 | 29.05 | C |
| ATOM | 5707 | CD | LYS | D | 104 | −19.050 | −41.169 | 110.488 | 1.00 | 32.39 | C |
| ATOM | 5708 | CE | LYS | D | 104 | −20.386 | −41.319 | 111.265 | 1.00 | 49.50 | C |
| ATOM | 5709 | NZ | LYS | D | 104 | −20.557 | −42.613 | 112.082 | 1.00 | 40.68 | N1+ |
| ATOM | 5710 | N | VAL | D | 105 | −18.520 | −36.416 | 108.767 | 1.00 | 26.83 | N |
| ATOM | 5711 | CA | VAL | D | 105 | −18.791 | −35.267 | 109.621 | 1.00 | 27.60 | C |
| ATOM | 5712 | C | VAL | D | 105 | −19.905 | −35.666 | 110.574 | 1.00 | 25.51 | C |
| ATOM | 5713 | O | VAL | D | 105 | −21.054 | −35.808 | 110.157 | 1.00 | 24.45 | O |
| ATOM | 5714 | CB | VAL | D | 105 | −19.176 | −34.041 | 108.785 | 1.00 | 27.65 | C |
| ATOM | 5715 | CG1 | VAL | D | 105 | −19.528 | −32.864 | 109.682 | 1.00 | 29.48 | C |
| ATOM | 5716 | CG2 | VAL | D | 105 | −18.026 | −33.694 | 107.825 | 1.00 | 22.38 | C |
| ATOM | 5717 | N | GLU | D | 106 | −19.579 | −35.866 | 111.851 | 1.00 | 31.50 | N |
| ATOM | 5718 | CA | GLU | D | 106 | −20.568 | −36.309 | 112.826 | 1.00 | 28.01 | C |
| ATOM | 5719 | C | GLU | D | 106 | −20.867 | −35.198 | 113.826 | 1.00 | 31.26 | C |
| ATOM | 5720 | O | GLU | D | 106 | −20.043 | −34.311 | 114.068 | 1.00 | 29.59 | O |
| ATOM | 5721 | CB | GLU | D | 106 | −20.137 | −37.601 | 113.551 | 1.00 | 29.60 | C |
| ATOM | 5722 | CG | GLU | D | 106 | −18.949 | −37.531 | 114.521 | 1.00 | 33.75 | C |
| ATOM | 5723 | CD | GLU | D | 106 | −19.264 | −38.095 | 115.928 | 1.00 | 34.42 | C |
| ATOM | 5724 | OE1 | GLU | D | 106 | −19.053 | −37.378 | 116.921 | 1.00 | 40.25 | O |
| ATOM | 5725 | OE2 | GLU | D | 106 | −19.688 | −39.257 | 116.061 | 1.00 | 33.48 | O1− |
| ATOM | 5726 | N | ILE | D | 107 | −22.075 | −35.258 | 114.387 | 1.00 | 29.99 | N |
| ATOM | 5727 | CA | ILE | D | 107 | −22.541 | −34.269 | 115.347 | 1.00 | 27.29 | C |
| ATOM | 5728 | C | ILE | D | 107 | −21.815 | −34.467 | 116.668 | 1.00 | 32.55 | C |
| ATOM | 5729 | O | ILE | D | 107 | −21.916 | −35.529 | 117.291 | 1.00 | 29.14 | O |
| ATOM | 5730 | CB | ILE | D | 107 | −24.048 | −34.396 | 115.581 | 1.00 | 29.36 | C |
| ATOM | 5731 | CG1 | ILE | D | 107 | −24.859 | −33.985 | 114.363 | 1.00 | 29.05 | C |
| ATOM | 5732 | CG2 | ILE | D | 107 | −24.428 | −33.602 | 116.816 | 1.00 | 30.42 | C |
| ATOM | 5733 | CD1 | ILE | D | 107 | −26.308 | −34.346 | 114.489 | 1.00 | 29.83 | C |
| ATOM | 5734 | N | LYS | D | 108 | −21.120 | −33.428 | 117.121 | 1.00 | 35.45 | N |
| ATOM | 5735 | CA | LYS | D | 108 | −20.531 | −33.410 | 118.452 | 1.00 | 32.78 | C |
| ATOM | 5736 | C | LYS | D | 108 | −21.581 | −32.996 | 119.483 | 1.00 | 36.07 | C |
| ATOM | 5737 | O | LYS | D | 108 | −22.303 | −32.011 | 119.282 | 1.00 | 36.02 | O |

TABLE 10.4-continued

| | | | | | | | | | |
|---|---|---|---|---|---|---|---|---|---|
| ATOM | 5738 | CB | LYS | D | 108 | −19.355 | −32.445 | 118.484 | 1.00 | 34.28 | C |
| ATOM | 5739 | CG | LYS | D | 108 | −18.623 | −32.454 | 119.791 | 1.00 | 36.31 | C |
| ATOM | 5740 | CD | LYS | D | 108 | −17.705 | −31.273 | 119.907 | 1.00 | 36.98 | C |
| ATOM | 5741 | CE | LYS | D | 108 | −16.504 | −31.728 | 120.659 | 1.00 | 44.81 | C |
| ATOM | 5742 | NZ | LYS | D | 108 | −16.855 | −33.094 | 121.165 | 1.00 | 40.45 | N1+ |
| ATOM | 5743 | N | ARG | D | 109 | −21.682 | −33.760 | 120.572 | 1.00 | 31.47 | N |
| ATOM | 5744 | CA | ARG | D | 109 | −22.636 | −33.469 | 121.642 | 1.00 | 32.33 | C |
| ATOM | 5745 | C | ARG | D | 109 | −22.004 | −33.853 | 122.962 | 1.00 | 30.94 | C |
| ATOM | 5746 | O | ARG | D | 109 | −20.848 | −34.273 | 123.008 | 1.00 | 35.21 | O |
| ATOM | 5747 | CB | ARG | D | 109 | −23.957 | −34.203 | 121.464 | 1.00 | 26.67 | C |
| ATOM | 5748 | CG | ARG | D | 109 | −23.826 | −35.711 | 121.380 | 1.00 | 32.22 | C |
| ATOM | 5749 | CD | ARG | D | 109 | −25.081 | −36.397 | 121.890 | 1.00 | 28.47 | C |
| ATOM | 5750 | NE | ARG | D | 109 | −25.123 | −36.331 | 123.335 | 1.00 | 32.52 | N |
| ATOM | 5751 | CZ | ARG | D | 109 | −26.235 | −36.307 | 124.056 | 1.00 | 28.79 | C |
| ATOM | 5752 | NH1 | ARG | D | 109 | −26.159 | −36.242 | 125.377 | 1.00 | 28.77 | N1+ |
| ATOM | 5753 | NH2 | ARG | D | 109 | −27.406 | −36.312 | 123.460 | 1.00 | 25.19 | N |
| ATOM | 5754 | N | THR | D | 110 | −22.765 | −33.713 | 124.040 | 1.00 | 27.95 | N |
| ATOM | 5755 | CA | THR | D | 110 | −22.224 | −34.032 | 125.356 | 1.00 | 33.38 | C |
| ATOM | 5756 | C | THR | D | 110 | −22.147 | −35.538 | 125.572 | 1.00 | 32.27 | C |
| ATOM | 5757 | O | THR | D | 110 | −22.956 | −36.306 | 125.044 | 1.00 | 32.94 | O |
| ATOM | 5758 | CB | THR | D | 110 | −23.068 | −33.429 | 126.468 | 1.00 | 32.63 | C |
| ATOM | 5759 | OG1 | THR | D | 110 | −24.415 | −33.917 | 126.356 | 1.00 | 28.33 | O |
| ATOM | 5760 | CG2 | THR | D | 110 | −23.037 | −31.936 | 126.370 | 1.00 | 31.15 | C |
| ATOM | 5761 | N | VAL | D | 111 | −21.145 | −35.946 | 126.354 | 1.00 | 29.24 | N |
| ATOM | 5762 | CA | VAL | D | 111 | −20.999 | −37.339 | 126.750 | 1.00 | 29.80 | C |
| ATOM | 5763 | C | VAL | D | 111 | −22.298 | −37.861 | 127.374 | 1.00 | 31.10 | C |
| ATOM | 5764 | O | VAL | D | 111 | −22.978 | −37.165 | 128.137 | 1.00 | 36.10 | O |
| ATOM | 5765 | CB | VAL | D | 111 | −19.794 | −37.464 | 127.699 | 1.00 | 29.10 | C |
| ATOM | 5766 | CG1 | VAL | D | 111 | −19.627 | −38.899 | 128.181 | 1.00 | 32.56 | C |
| ATOM | 5767 | CG2 | VAL | D | 111 | −18.522 | −36.988 | 126.978 | 1.00 | 24.86 | C |
| ATOM | 5768 | N | ALA | D | 112 | −22.665 | −39.086 | 127.004 | 1.00 | 30.83 | N |
| ATOM | 5769 | CA | ALA | D | 112 | −23.886 | −39.735 | 127.460 | 1.00 | 27.58 | C |
| ATOM | 5770 | C | ALA | D | 112 | −23.597 | −41.211 | 127.684 | 1.00 | 30.58 | C |
| ATOM | 5771 | O | ALA | D | 112 | −23.169 | −41.899 | 126.759 | 1.00 | 35.39 | O |
| ATOM | 5772 | CB | ALA | D | 112 | −25.003 | −39.561 | 126.435 | 1.00 | 26.61 | C |
| ATOM | 5773 | N | ALA | D | 113 | −23.828 | −41.703 | 128.896 | 1.00 | 32.52 | N |
| ATOM | 5774 | CA | ALA | D | 113 | −23.548 | −43.102 | 129.185 | 1.00 | 31.32 | C |
| ATOM | 5775 | C | ALA | D | 113 | −24.588 | −44.017 | 128.544 | 1.00 | 31.91 | C |
| ATOM | 5776 | O | ALA | D | 113 | −25.757 | −43.648 | 128.414 | 1.00 | 30.66 | O |
| ATOM | 5777 | CB | ALA | D | 113 | −23.530 | −43.351 | 130.685 | 1.00 | 26.64 | C |
| ATOM | 5778 | N | PRO | D | 114 | −24.193 | −45.222 | 128.150 | 1.00 | 29.42 | N |
| ATOM | 5779 | CA | PRO | D | 114 | −25.182 | −46.176 | 127.649 | 1.00 | 29.26 | C |
| ATOM | 5780 | C | PRO | D | 114 | −26.021 | −46.730 | 128.781 | 1.00 | 29.73 | C |
| ATOM | 5781 | O | PRO | D | 114 | −25.589 | −46.804 | 129.925 | 1.00 | 28.84 | O |
| ATOM | 5782 | CB | PRO | D | 114 | −24.334 | −47.277 | 127.005 | 1.00 | 27.37 | C |
| ATOM | 5783 | CG | PRO | D | 114 | −23.042 | −47.236 | 127.766 | 1.00 | 30.02 | C |
| ATOM | 5784 | CD | PRO | D | 114 | −22.823 | −45.773 | 128.131 | 1.00 | 29.01 | C |
| ATOM | 5785 | N | SER | D | 115 | −27.255 | −47.068 | 128.454 | 1.00 | 28.42 | N |
| ATOM | 5786 | CA | SER | D | 115 | −28.020 | −47.994 | 129.254 | 1.00 | 24.77 | C |
| ATOM | 5787 | C | SER | D | 115 | −27.788 | −49.394 | 128.706 | 1.00 | 27.46 | C |
| ATOM | 5788 | O | SER | D | 115 | −27.741 | −49.606 | 127.489 | 1.00 | 25.81 | O |
| ATOM | 5789 | CB | SER | D | 115 | −29.502 | −47.638 | 129.221 | 1.00 | 27.83 | C |
| ATOM | 5790 | OG | SER | D | 115 | −29.644 | −46.253 | 129.452 | 1.00 | 30.47 | O |
| ATOM | 5791 | N | VAL | D | 16 | −27.612 | −50.342 | 129.612 | 1.00 | 26.91 | N |
| ATOM | 5792 | CA | VAL | D | 16 | −27.156 | −51.679 | 129.275 | 1.00 | 27.26 | C |
| ATOM | 5793 | C | VAL | D | 16 | −28.258 | −52.657 | 129.636 | 1.00 | 26.73 | C |
| ATOM | 5794 | O | VAL | D | 16 | −28.800 | −52.605 | 130.742 | 1.00 | 33.45 | O |
| ATOM | 5795 | CB | VAL | D | 16 | −25.850 | −52..032 | 130.010 | 1.00 | 29.29 | C |
| ATOM | 5796 | CG1 | VAL | D | 16 | −25.339 | −53.387 | 129.535 | 1.00 | 30.85 | C |
| ATOM | 5797 | CG2 | VAL | D | 16 | −24.814 | −50.930 | 129.803 | 1.00 | 24.64 | C |
| ATOM | 5798 | C | PHE | D | 117 | −28.591 | −53.535 | 128.703 | 1.00 | 25.90 | N |
| ATOM | 5799 | CA | PHE | D | 117 | −29.585 | −54.573 | 128.907 | 1.00 | 25.96 | C |
| ATOM | 5800 | C | PHE | D | 117 | −29.037 | −55.838 | 128.293 | 1.00 | 27.24 | C |
| ATOM | 5801 | O | PHE | D | 117 | −28.399 | −55.788 | 127.240 | 1.00 | 29.01 | O |
| ATOM | 5802 | CB | PHE | D | 117 | −30.930 | −54.282 | 128.244 | 1.00 | 26.04 | C |
| ATOM | 5803 | CG | PHE | D | 117 | −31.510 | −52.943 | 128.560 | 1.00 | 29.45 | C |
| ATOM | 5804 | CD1 | PHE | D | 117 | −31.119 | −51.810 | 127.851 | 1.00 | 28.96 | C |
| ATOM | 5805 | CD2 | PHE | D | 117 | −32.523 | −52.826 | 129.497 | 1.00 | 27.92 | C |
| ATOM | 5806 | CE1 | PHE | D | 117 | −31.698 | −50.590 | 128.119 | 1.00 | 31.67 | C |
| ATOM | 5807 | CE2 | PHE | D | 117 | −33.108 | −51.607 | 129.767 | 1.00 | 28.75 | C |
| ATOM | 5808 | CZ | PHE | D | 117 | −32.705 | −50.490 | 129.086 | 1.00 | 31.59 | C |
| ATOM | 5809 | N | ILE | D | 118 | −29.288 | −56.966 | 128.938 | 1.00 | 28.76 | N |
| ATOM | 5810 | CA | ILE | D | 118 | −28.835 | −58.252 | 128.429 | 1.00 | 30.93 | C |
| ATOM | 5811 | C | ILE | D | 118 | −30.053 | −59.149 | 128.291 | 1.00 | 27.51 | C |
| ATOM | 5812 | O | ILE | D | 118 | −30.949 | −59.115 | 129.134 | 1.00 | 28.60 | O |
| ATOM | 5813 | CB | ILE | D | 118 | −27.764 | −58.872 | 129.348 | 1.00 | 29.79 | C |
| ATOM | 5814 | CG1 | ILE | D | 118 | −27.230 | −60.167 | 128.757 | 1.00 | 33.20 | C |
| ATOM | 5815 | CG2 | ILE | D | 118 | −28.321 | −59.122 | 130.738 | 1.00 | 28.76 | C |
| ATOM | 5816 | CD1 | ILE | D | 118 | −26.243 | −60.873 | 129.679 | 1.00 | 35.26 | C |
| ATOM | 5817 | N | PHE | D | 119 | −30.108 | −59.909 | 127.204 | 1.00 | 28.10 | N |

TABLE 10.4-continued

| | | | | | | | | | | |
|---|---|---|---|---|---|---|---|---|---|---|
| ATOM | 5818 | CA | PHE | D | 119 | −31.241 | −60.753 | 126.853 | 1.00 | 27.79 | C |
| ATOM | 5819 | C | PHE | D | 119 | −30.812 | −62.209 | 126.778 | 1.00 | 32.91 | C |
| ATOM | 5820 | O | PHE | D | 119 | −29.869 | −62.544 | 126.044 | 1.00 | 31.43 | O |
| ATOM | 5821 | CB | PHE | D | 119 | −31.858 | −60.343 | 125.507 | 1.00 | 29.66 | C |
| ATOM | 5822 | CG | PHE | D | 119 | −32.413 | −58.970 | 125.513 | 1.00 | 31.25 | C |
| ATOM | 5823 | CD1 | PHE | D | 119 | −33.683 | −58.729 | 126.018 | 1.00 | 26.70 | C |
| ATOM | 5824 | CD2 | PHE | D | 119 | −31.659 | −57.909 | 125.051 | 1.00 | 27.96 | C |
| ATOM | 5825 | CE1 | PHE | D | 119 | −34.198 | −57.450 | 126.055 | 1.00 | 28.84 | C |
| ATOM | 5826 | CE2 | PHE | D | 119 | −32.165 | −56.635 | 125.086 | 1.00 | 30.39 | C |
| ATOM | 5827 | CZ | PHE | D | 119 | −33.445 | −56.399 | 125.584 | 1.00 | 27.28 | C |
| ATOM | 5828 | N | PRO | D | 120 | −31.482 | −63.097 | 127.497 | 1.00 | 35.56 | N |
| ATOM | 5829 | CA | PRO | D | 120 | −31.187 | −64.530 | 127.394 | 1.00 | 36.54 | C |
| ATOM | 5830 | C | PRO | D | 120 | −31.661 | −65.088 | 126.065 | 1.00 | 34.90 | C |
| ATOM | 5831 | O | PRO | D | 120 | −32.495 | −64.470 | 125.387 | 1.00 | 33.38 | O |
| ATOM | 5832 | CB | PRO | D | 120 | −31.987 | −65.138 | 128.557 | 1.00 | 36.73 | C |
| ATOM | 5833 | CG | PRO | D | 120 | −32.403 | −63.956 | 129.408 | 1.00 | 42.07 | C |
| ATOM | 5834 | CD | PRO | D | 120 | −32.546 | −62.814 | 128.466 | 1.00 | 32.56 | C |
| ATOM | 5835 | N | PRO | D | 121 | −31.155 | −66.248 | 125.655 | 1.00 | 33.49 | N |
| ATOM | 5836 | CA | PRO | D | 121 | −31.711 | −66.900 | 124.463 | 1.00 | 35.36 | C |
| ATOM | 5837 | C | PRO | D | 121 | −33.137 | −67.359 | 124.718 | 1.00 | 32.32 | C |
| ATOM | 5838 | O | PRO | D | 121 | −33.510 | −67.738 | 125.829 | 1.00 | 33.72 | O |
| ATOM | 5839 | CB | PRO | D | 121 | −30.772 | −68.091 | 124.225 | 1.00 | 34.18 | C |
| ATOM | 5840 | CG | PRO | D | 121 | −30.187 | −68.357 | 125.588 | 1.00 | 34.16 | C |
| ATOM | 5841 | CD | PRO | D | 121 | −30.062 | −67.026 | 126.262 | 1.00 | 28.95 | C |
| ATOM | 5842 | N | SER | D | 122 | −33.949 | −67.282 | 123.672 | 1.00 | 37.30 | N |
| ATOM | 5843 | CA | SER | D | 122 | −35.326 | −67.733 | 123.761 | 1.00 | 35.72 | C |
| ATOM | 5844 | C | SER | D | 122 | −35.386 | −69.261 | 123.796 | 1.00 | 40.60 | C |
| ATOM | 5845 | O | SER | D | 122 | −34.510 | −69.961 | 123.264 | 1.00 | 37.13 | O |
| ATOM | 5846 | CB | SER | D | 122 | −36.141 | −67.176 | 122.589 | 1.00 | 30.63 | C |
| ATOM | 5847 | OG | SER | D | 122 | −35.821 | −67.837 | 121.384 | 1.00 | 34.59 | O |
| ATOM | 5848 | N | ASP | D | 123 | −36.413 | −69.776 | 124.481 | 1.00 | 44.14 | N |
| ATOM | 5849 | CA | ASP | D | 123 | −36.631 | −71.221 | 124.525 | 1.00 | 47.46 | C |
| ATOM | 5850 | C | ASP | D | 123 | −36.913 | −71.793 | 123.142 | 1.00 | 46.92 | C |
| ATOM | 5851 | O | ASP | D | 123 | −36.606 | −72.964 | 122.884 | 1.00 | 49.21 | O |
| ATOM | 5852 | CB | ASP | D | 123 | −37.776 | −71.541 | 125.478 | 1.00 | 54.79 | C |
| ATOM | 5853 | CG | ASP | D | 123 | −37.352 | −71.471 | 126.921 | 1.00 | 61.77 | C |
| ATOM | 5854 | OD1 | ASP | D | 123 | −36.195 | −71.849 | 127.207 | 1.00 | 56.99 | O |
| ATOM | 5855 | OD2 | ASP | D | 123 | −38.161 | −71.015 | 127.763 | 1.00 | 71.23 | O1− |
| ATOM | 5856 | N | GLU | D | 124 | −37.480 | −70.978 | 122.241 | 1.00 | 45.60 | N |
| ATOM | 5857 | CA | GLU | D | 124 | −37.753 | −71.411 | 120.869 | 1.00 | 49.64 | C |
| ATOM | 5858 | C | GLU | D | 124 | −36.463 | −71.644 | 120.084 | 1.00 | 50.62 | C |
| ATOM | 5859 | O | GLU | D | 124 | −36.383 | −72.565 | 119.259 | 1.00 | 49.45 | O |
| ATOM | 5860 | CB | GLU | D | 124 | −38.613 | −70.365 | 120.168 | 1.00 | 45.37 | C |
| ATOM | 5861 | CG | GLU | D | 124 | −39.053 | −70.740 | 118.759 | 1.00 | 60.55 | C |
| ATOM | 5862 | CD | GLU | D | 124 | −39.635 | −69.542 | 117.988 | 1.00 | 74.03 | C |
| ATOM | 5863 | OE1 | GLU | D | 124 | −39.948 | −68.502 | 118.626 | 1.00 | 67.91 | O |
| ATOM | 5864 | OE2 | GLU | D | 124 | −39.760 | −69.633 | 116.740 | 1.00 | 80.45 | O1− |
| ATOM | 5865 | N | GLN | D | 125 | −35.452 | −70.799 | 120.309 | 1.00 | 44.68 | N |
| ATOM | 5866 | CA | GLN | D | 125 | −34.161 | −70.979 | 119.660 | 1.00 | 44.38 | C |
| ATOM | 5867 | C | GLN | D | 125 | −33.365 | −72.110 | 120.296 | 1.00 | 44.17 | C |
| ATOM | 5868 | O | GLN | D | 125 | −32.617 | −72.803 | 119.596 | 1.00 | 44.30 | O |
| ATOM | 5869 | CB | GLN | D | 125 | −33.353 | −69.677 | 119.726 | 1.00 | 38.62 | C |
| ATOM | 5870 | CG | GLN | D | 125 | −32.017 | −69.721 | 118.987 | 1.00 | 34.83 | C |
| ATOM | 5871 | CD | GLN | D | 125 | −31.067 | −68.656 | 119.471 | 1.00 | 36.06 | C |
| ATOM | 5872 | OE1 | GLN | D | 125 | −31.232 | −68.116 | 120.570 | 1.00 | 37.90 | O |
| ATOM | 5873 | NE2 | GLN | D | 125 | −30.080 | −68.328 | 118.652 | 1.00 | 40.51 | N |
| ATOM | 5874 | N | LEU | D | 126 | −33.515 | −72.316 | 121.606 | 1.00 | 39.87 | N |
| ATOM | 5875 | CA | LEU | D | 126 | −32.798 | −73.405 | 122.254 | 1.00 | 43.24 | C |
| ATOM | 5876 | C | LEU | D | 126 | −33.200 | −74.756 | 121.683 | 1.00 | 49.92 | C |
| ATOM | 5877 | O | LEU | D | 126 | −32.343 | −75.623 | 121.467 | 1.00 | 50.5 | O |
| ATOM | 5878 | CB | LEU | D | 126 | −33.035 | −73.372 | 123.755 | 1.00 | 37.51 | C |
| ATOM | 5879 | CG | LEU | D | 126 | −32.229 | −72.275 | 124.411 | 1.00 | 38.73 | C |
| ATOM | 5880 | CD1 | LEU | D | 126 | −32.542 | −72.240 | 125.881 | 1.00 | 34.97 | C |
| ATOM | 5881 | CD2 | LEU | D | 126 | −30.723 | −72.461 | 124.145 | 1.00 | 38.73 | C |
| ATOM | 5882 | N | LYS | D | 127 | −34.486 | −74.933 | 121.365 | 1.00 | 50.72 | N |
| ATOM | 5883 | CA | LYS | D | 127 | −34.931 | −76.193 | 120.777 | 1.00 | 50.42 | C |
| ATOM | 5884 | C | LYS | D | 127 | −34.041 | −76.636 | 119.621 | 1.00 | 50.52 | C |
| ATOM | 5885 | O | LYS | D | 127 | −33.827 | −77.838 | 119.434 | 1.00 | 61.34 | O |
| ATOM | 5886 | CB | LYS | D | 127 | −36.378 | −76.066 | 120.287 | 1.00 | 54.82 | C |
| ATOM | 5887 | CG | LYS | D | 127 | −37.364 | −75.491 | 121.309 | 1.00 | 56.44 | C |
| ATOM | 5888 | CD | LYS | D | 127 | −38.834 | −75.811 | 120.959 | 1.00 | 64.32 | C |
| ATOM | 5889 | CE | LYS | D | 127 | −39.297 | −75.170 | 119.628 | 1.00 | 72.71 | C |
| ATOM | 5890 | NZ | LYS | D | 127 | −39.699 | −76.161 | 118.571 | 1.00 | 64.97 | N1+ |
| ATOM | 5891 | N | SER | D | 128 | −33.470 | −75.687 | 118.880 | 1.00 | 50.62 | N |
| ATOM | 5892 | CA | SER | D | 128 | −32.691 | −75.949 | 117.674 | 1.00 | 48.62 | C |
| ATOM | 5893 | C | SER | D | 128 | −31.181 | −76.031 | 117.919 | 1.00 | 52.68 | C |
| ATOM | 5894 | O | SER | D | 128 | −30.403 | −76.019 | 116.957 | 1.00 | 53.36 | O |
| ATOM | 5895 | CB | SER | D | 128 | −32.998 | −74.877 | 116.626 | 1.00 | 51.45 | C |
| ATOM | 5896 | OG | SER | D | 128 | −32.539 | −73.605 | 117.065 | 1.00 | 54.76 | O |
| ATOM | 5897 | N | GLY | D | 129 | −30.742 | −76.074 | 119.169 | 1.00 | 49.90 | N |

TABLE 10.4-continued

| | | | | | | | | | | |
|---|---|---|---|---|---|---|---|---|---|---|
| ATOM | 5898 | CA | GLY | D | 129 | −29.355 | −76.368 | 119.452 | 1.00 | 48.29 | C |
| ATOM | 5899 | C | GLY | D | 129 | −28.416 | −75.187 | 119.533 | 1.00 | 52.26 | C |
| ATOM | 5900 | O | GLY | D | 129 | −27.243 | −75.382 | 119.882 | 1.00 | 50.58 | O |
| ATOM | 5901 | N | THR | D | 130 | −28.886 | −73.969 | 119.259 | 1.00 | 49.43 | N |
| ATOM | 5902 | CA | THR | D | 130 | −28.043 | −72.784 | 119.302 | 1.00 | 44.36 | C |
| ATOM | 5903 | C | THR | D | 130 | −28.614 | −71.774 | 120.285 | 1.00 | 44.57 | C |
| ATOM | 5904 | O | THR | D | 130 | −29.830 | −71.596 | 120.369 | 1.00 | 45.91 | O |
| ATOM | 5905 | CB | THR | D | 130 | −27.942 | −72.142 | 117.926 | 1.00 | 49.85 | C |
| ATOM | 5906 | OG1 | THR | D | 130 | −27.337 | −73.073 | 117.030 | 1.00 | 49.94 | O |
| ATOM | 5907 | CG2 | THR | D | 130 | −27.087 | −70.871 | 117.975 | 1.00 | 47.05 | C |
| ATOM | 5908 | N | ALA | D | 131 | −27.729 | −71.098 | 121.008 | 1.00 | 40.05 | N |
| ATOM | 5909 | CA | ALA | D | 131 | −28.104 | −70.036 | 121.924 | 1.00 | 38.97 | C |
| ATOM | 5910 | C | ALA | D | 131 | −27.432 | −68.727 | 121.512 | 1.00 | 37.81 | C |
| ATOM | 5911 | O | ALA | D | 131 | −26.209 | −68.683 | 121.329 | 1.00 | 38.34 | O |
| ATOM | 5912 | CB | ALA | D | 131 | −27.721 | −70.421 | 123.347 | 1.00 | 38.52 | C |
| ATOM | 5913 | N | SER | D | 132 | −28.224 | −67.667 | 121.359 | 1.00 | 33.37 | N |
| ATOM | 5914 | CA | SER | D | 132 | −27.707 | −66.314 | 121.152 | 1.00 | 30.63 | C |
| ATOM | 5915 | C | SER | D | 132 | −28.011 | −65.482 | 122.392 | 1.00 | 31.31 | C |
| ATOM | 5916 | O | SER | D | 132 | −29.166 | −65.369 | 122.800 | 1.00 | 39.28 | O |
| ATOM | 5917 | CB | SER | D | 132 | −28.321 | −65.659 | 119.913 | 1.00 | 31.88 | C |
| ATOM | 5918 | OG | SER | D | 132 | −27.968 | −66.338 | 118.727 | 1.00 | 32.64 | O |
| ATOM | 5919 | N | VAL | D | 133 | −26.999 | −64.942 | 123.008 | 1.00 | 32.01 | N |
| ATOM | 5920 | CA | VAL | D | 133 | −27.179 | −63.987 | 124.097 | 1.00 | 34.18 | C |
| ATOM | 5921 | C | VAL | D | 133 | −26.944 | −62.601 | 123.519 | 1.00 | 32.77 | C |
| ATOM | 5922 | O | VAL | D | 133 | −26.025 | −62.421 | 122.706 | 1.00 | 31.33 | O |
| ATOM | 5923 | CB | VAL | D | 133 | −26.213 | −64.294 | 125.261 | 1.00 | 34.59 | C |
| ATOM | 5924 | CG1 | VAL | D | 133 | −26.610 | −63.544 | 126.532 | 1.00 | 32.22 | C |
| ATOM | 5925 | CG2 | VAL | D | 133 | −26.180 | −65.792 | 125.517 | 1.00 | 30.53 | C |
| ATOM | 5926 | N | VAL | D | 134 | −27.781 | −61.625 | 123.893 | 1.00 | 27.21 | N |
| ATOM | 5927 | CA | VAL | D | 134 | −27.711 | −60.290 | 123.295 | 1.00 | 28.33 | C |
| ATOM | 5928 | C | VAL | D | 134 | −27.496 | −59.226 | 124.365 | 1.00 | 28.83 | C |
| ATOM | 5929 | O | VAL | D | 134 | −28.174 | −59.214 | 125.397 | 1.00 | 27.78 | O |
| ATOM | 5930 | CB | VAL | D | 134 | −28.950 | −59.955 | 122.450 | 1.00 | 27.75 | C |
| ATOM | 5931 | CG1 | VAL | D | 134 | −28.794 | −58.585 | 121.858 | 1.00 | 26.08 | C |
| ATOM | 5932 | CG2 | VAL | D | 134 | −29.096 | −60.957 | 121.319 | 1.00 | 30.78 | C |
| ATOM | 5933 | N | CYS | D | 135 | −26.565 | −58.313 | 124.092 | 1.00 | 27.54 | N |
| ATOM | 5934 | CA | CYS | D | 135 | −26.299 | −57.155 | 124.928 | 1.00 | 31.96 | C |
| ATOM | 5935 | C | CYS | D | 135 | −26.651 | −55.895 | 124.141 | 1.00 | 32.81 | C |
| ATOM | 5936 | O | CYS | D | 135 | −26.250 | −55.760 | 122.979 | 1.00 | 27.82 | O |
| ATOM | 5937 | CB | CYS | D | 135 | −24.827 | −57.154 | 125.365 | 1.00 | 32.75 | C |
| ATOM | 5938 | SG | CYS | D | 135 | −24.350 | −56.013 | 126.697 | 1.00 | 40.27 | S |
| ATOM | 5939 | N | LEU | D | 136 | −27.422 | −54.996 | 124.762 | 1.00 | 26.44 | N |
| ATOM | 5940 | CA | LEU | D | 136 | −27.826 | −53.726 | 124.161 | 1.00 | 24.84 | C |
| ATOM | 5941 | C | LEU | D | 136 | −27.168 | −52.559 | 124.898 | 1.00 | 28.43 | C |
| ATOM | 5942 | O | LEU | D | 136 | −27.375 | −52.380 | 126.107 | 1.00 | 27.53 | O |
| ATOM | 5943 | CB | LEU | D | 136 | −29.345 | −53.566 | 124.191 | 1.00 | 26.96 | C |
| ATOM | 5944 | CG | LEU | D | 136 | −29.908 | −52.191 | 123.787 | 1.00 | 30.11 | C |
| ATOM | 5945 | CD1 | LEU | D | 136 | −29.570 | −51.875 | 122.330 | 1.00 | 22.63 | C |
| ATOM | 5946 | CD2 | LEU | D | 136 | −31.439 | −52.087 | 124.042 | 1.00 | 23.90 | C |
| ATOM | 5947 | N | LEU | D | 137 | −26.403 | −51.746 | 124.169 | 1.00 | 27.96 | N |
| ATOM | 5948 | CA | LEU | D | 137 | −25.860 | −50.492 | 124.687 | 1.00 | 24.59 | C |
| ATOM | 5949 | C | LEU | D | 137 | −26.657 | −49.367 | 124.027 | 1.00 | 28.90 | C |
| ATOM | 5950 | O | LEU | D | 137 | −26.501 | −49.096 | 122.830 | 1.00 | 28.52 | O |
| ATOM | 5951 | CB | LEU | D | 137 | −24.364 | −50.380 | 124.419 | 1.00 | 20.03 | C |
| ATOM | 5952 | CG | LEU | D | 137 | −23.377 | −51.186 | 125.271 | 1.00 | 24.15 | C |
| ATOM | 5953 | CD1 | LEU | D | 137 | −23.602 | −52.697 | 125.252 | 1.00 | 20.47 | C |
| ATOM | 5954 | CD2 | LEU | D | 137 | −21.943 | −50.875 | 124.827 | 1.00 | 21.46 | C |
| ATOM | 5955 | N | ASN | D | 138 | −27.531 | −48.732 | 124.806 | 1.00 | 30.48 | N |
| ATOM | 5956 | CA | ASN | D | 138 | −28.551 | −47.836 | 124.285 | 1.00 | 28.96 | C |
| ATOM | 5957 | C | ASN | D | 138 | −28.215 | −46.368 | 124.560 | 1.00 | 31.63 | C |
| ATOM | 5958 | O | ASN | D | 138 | −27.933 | −45.994 | 125.705 | 1.00 | 33.79 | O |
| ATOM | 5959 | CB | ASN | D | 138 | −29.904 | −48.179 | 124.900 | 1.00 | 27.28 | C |
| ATOM | 5960 | CG | ASN | D | 138 | −31.052 | −47.802 | 124.004 | 1.00 | 31.25 | C |
| ATOM | 5961 | OD1 | ASN | D | 138 | −31.153 | −48.280 | 122.875 | 1.00 | 36.62 | O |
| ATOM | 5962 | ND2 | ASN | D | 138 | −31.880 | −46.874 | 124.463 | 1.00 | 36.73 | N |
| ATOM | 5963 | N | ASN | D | 139 | −28.258 | −45.549 | 123.495 | 1.00 | 33.24 | N |
| ATOM | 5964 | CA | ASN | D | 139 | −28.250 | −44.074 | 123.524 | 1.00 | 28.78 | C |
| ATOM | 5965 | C | ASN | D | 139 | −27.036 | −43.490 | 124.238 | 1.00 | 27.30 | C |
| ATOM | 5966 | O | ASN | D | 139 | −27.168 | −42.799 | 125.238 | 1.00 | 35.75 | O |
| ATOM | 5967 | CB | ASN | D | 139 | −29.520 | −43.529 | 124.171 | 1.00 | 27.41 | C |
| ATOM | 5968 | CG | ASN | D | 139 | −30.755 | −43.820 | 123.364 | 1.00 | 34.79 | C |
| ATOM | 5969 | OD1 | ASN | D | 139 | −30.693 | −44.255 | 122.215 | 1.00 | 31.67 | O |
| ATOM | 5970 | ND2 | ASN | D | 139 | −31.903 | −43.606 | 123.985 | 1.00 | 49.31 | N |
| ATOM | 5971 | N | PHE | D | 140 | −25.853 | −43.720 | 123.683 | 1.00 | 28.66 | N |
| ATOM | 5972 | CA | PHE | D | 140 | −24.631 | −43.200 | 124.279 | 1.00 | 30.52 | C |
| ATOM | 5973 | C | PHE | D | 140 | −23.895 | −42.295 | 123.301 | 1.00 | 30.45 | C |
| ATOM | 5974 | O | PHE | D | 140 | −24.127 | −42.323 | 122.089 | 1.00 | 31.04 | O |
| ATOM | 5975 | CB | PHE | D | 140 | −23.703 | −44.333 | 124.760 | 1.00 | 27.13 | C |
| ATOM | 5976 | CG | PHE | D | 140 | −23.324 | −45.299 | 123.685 | 1.00 | 30.02 | C |
| ATOM | 5977 | CD1 | PHE | D | 140 | −24.068 | −46.450 | 123.482 | 1.00 | 29.03 | C |

TABLE 10.4-continued

| | | | | | | | | | | |
|---|---|---|---|---|---|---|---|---|---|---|
| ATOM | 5978 | CD2 | PHE | D | 140 | −22.224 | −45.059 | 122.868 | 1.00 | 27.79 | C |
| ATOM | 5979 | CE1 | PHE | D | 140 | −23.724 | −47.344 | 122.477 | 1.00 | 28.63 | C |
| ATOM | 5980 | CE2 | PHE | D | 140 | −21.869 | −45.950 | 121.866 | 1.00 | 25.04 | C |
| ATOM | 5981 | CZ | PHE | D | 140 | −22.619 | −47.090 | 121.666 | 1.00 | 25.93 | C |
| ATOM | 5982 | N | TYR | D | 141 | −23.033 | −41.452 | 123.855 | 1.00 | 27.31 | N |
| ATOM | 5983 | CA | TYR | D | 141 | −22.138 | −40.640 | 123.059 | 1.00 | 29.62 | C |
| ATOM | 5984 | C | TYR | D | 141 | −20.895 | −40.416 | 123.882 | 1.00 | 30.14 | C |
| ATOM | 5985 | O | TYR | D | 141 | −21.002 | −40.131 | 125.060 | 1.00 | 31.98 | O |
| ATOM | 5986 | CB | TYR | D | 141 | −22.777 | −39.292 | 122.657 | 1.00 | 30.01 | C |
| ATOM | 5987 | CG | TYR | D | 141 | −21.868 | −38.536 | 121.719 | 1.00 | 28.91 | C |
| ATOM | 5988 | CD1 | TYR | D | 141 | −21.906 | −38.764 | 120.356 | 1.00 | 24.75 | C |
| ATOM | 5989 | CD2 | TYR | D | 141 | −20.915 | −37.652 | 122.207 | 1.00 | 33.08 | C |
| ATOM | 5990 | CE1 | TYR | D | 141 | −21.055 | −38.124 | 119.505 | 1.00 | 27.43 | C |
| ATOM | 5991 | CE2 | TYR | D | 141 | −20.049 | −36.991 | 121.353 | 1.00 | 32.86 | C |
| ATOM | 5992 | CZ | TYR | D | 141 | −20.123 | −37.233 | 119.999 | 1.00 | 31.49 | C |
| ATOM | 5993 | OH | TYR | D | 141 | −19.254 | −36.584 | 119.149 | 1.00 | 29.36 | O |
| ATOM | 5994 | N | PRO | D | 142 | −19.704 | −40.530 | 123.272 | 1.00 | 33.14 | N |
| ATOM | 5995 | CA | PRO | D | 142 | −19.424 | −40.777 | 121.853 | 1.00 | 31.33 | C |
| ATOM | 5996 | C | PRO | D | 142 | −19.435 | −42.241 | 121.404 | 1.00 | 31.01 | C |
| ATOM | 5997 | O | PRO | D | 142 | −19.806 | −43.143 | 122.140 | 1.00 | 30.96 | O |
| ATOM | 5998 | CB | PRO | D | 142 | −18.028 | −40.201 | 121.691 | 1.00 | 27.46 | C |
| ATOM | 5999 | CG | PRO | D | 142 | −17.393 | −40.495 | 123.007 | 1.00 | 28.61 | C |
| ATOM | 6000 | CD | PRO | D | 142 | −18.464 | −40.243 | 124.019 | 1.00 | 27.72 | C |
| ATOM | 6001 | N | ARG | D | 143 | −18.974 | −42.430 | 120.167 | 1.00 | 35.41 | N |
| ATOM | 6002 | CA | ARG | D | 143 | −19.142 | −43.686 | 119.441 | 1.00 | 32.43 | C |
| ATOM | 6003 | C | ARG | D | 143 | −18.410 | −44.842 | 120.111 | 1.00 | 35.51 | C |
| ATOM | 6004 | O | ARG | D | 143 | −18.897 | −45.974 | 120.120 | 1.00 | 39.91 | O |
| ATOM | 6005 | CB | ARG | D | 143 | −18.633 | −43.477 | 118.018 | 1.00 | 36.16 | C |
| ATOM | 6006 | CG | ARG | D | 143 | −18.522 | −44.686 | 117.126 | 1.00 | 44.24 | C |
| ATOM | 6007 | CD | ARG | D | 143 | −19.818 | −44.835 | 116.397 | 1.00 | 40.17 | C |
| ATOM | 6008 | NE | ARG | D | 143 | −19.792 | −45.523 | 115.101 | 1.00 | 38.57 | N |
| ATOM | 6009 | CZ | ARG | D | 143 | −19.299 | −46.736 | 114.883 | 1.00 | 38.79 | C |
| ATOM | 6010 | NH1 | ARG | D | 143 | −18.689 | −47.407 | 115.852 | 1.00 | 42.03 | N1+ |
| ATOM | 6011 | NH2 | ARG | D | 143 | −19.395 | −47.265 | 113.675 | 1.00 | 43.44 | N |
| ATOM | 6012 | N | GLU | D | 144 | −17.256 | −44.580 | 120.697 | 1.00 | 31.31 | N |
| ATOM | 6013 | CA | GLU | D | 144 | −16.406 | −45.662 | 121.160 | 1.00 | 30.73 | C |
| ATOM | 6014 | C | GLU | D | 144 | −16.975 | −46.318 | 122.418 | 1.00 | 29.58 | C |
| ATOM | 6015 | O | GLU | D | 144 | −17.308 | −45.649 | 123.397 | 1.00 | 32.43 | O |
| ATOM | 6016 | CB | GLU | D | 144 | −14.994 | −45.126 | 121.391 | 1.00 | 28.89 | C |
| ATOM | 6017 | CG | GLU | D | 144 | −14.361 | −44.583 | 120.090 | 1.00 | 45.09 | C |
| ATOM | 6018 | CD | GLU | D | 144 | −14.920 | −43.198 | 119.638 | 1.00 | 55.20 | C |
| ATOM | 6019 | OE1 | GLU | D | 144 | −15.083 | −42.301 | 120.513 | 1.00 | 49.33 | O |
| ATOM | 6020 | OE2 | GLU | D | 144 | −15.215 | −43.020 | 118.417 | 1.00 | 49.10 | O1− |
| ATOM | 6021 | N | ALA | D | 145 | −17.065 | −47.640 | 122.396 | 1.00 | 25.69 | N |
| ATOM | 6022 | CA | ALA | D | 145 | −17.552 | −48.390 | 123.535 | 1.00 | 29.57 | C |
| ATOM | 6023 | C | ALA | D | 145 | −16.972 | −49.792 | 123.452 | 1.00 | 31.44 | C |
| ATOM | 6024 | O | ALA | D | 145 | −16.702 | −50.304 | 122.364 | 1.00 | 37.00 | O |
| ATOM | 6025 | CB | ALA | D | 145 | −19.095 | −48.415 | 123.584 | 1.00 | 25.18 | C |
| ATOM | 6026 | N | LYS | D | 146 | −16.792 | −50.416 | 124.607 | 1.00 | 31.28 | N |
| ATOM | 6027 | CA | LYS | D | 146 | −16.278 | −51.775 | 124.678 | 1.00 | 35.67 | C |
| ATOM | 6028 | C | LYS | D | 146 | −17.308 | −52.687 | 125.339 | 1.00 | 38.62 | C |
| ATOM | 6029 | O | LYS | D | 146 | −17.790 | −52.390 | 126.436 | 1.00 | 36.49 | O |
| ATOM | 6030 | CB | LYS | D | 146 | −14.972 | −51.810 | 125.466 | 1.00 | 33.50 | C |
| ATOM | 6031 | CG | LYS | D | 146 | −14.242 | −53.136 | 125.440 | 1.00 | 40.82 | C |
| ATOM | 6032 | CD | LYS | D | 146 | −12.883 | −53.049 | 126.167 | 1.00 | 52.07 | C |
| ATOM | 6033 | CE | LYS | D | 146 | −12.130 | −54.385 | 126.127 | 1.00 | 60.61 | C |
| ATOM | 6034 | NZ | LYS | D | 146 | −10.663 | −54.265 | 126.375 | 1.00 | 71.34 | N1+ |
| ATOM | 6035 | N | VAL | D | 147 | −17.649 | −53.786 | 124.663 | 1.00 | 35.29 | N |
| ATOM | 6036 | CA | VAL | D | 147 | −18.415 | −54.883 | 125.242 | 1.00 | 37.00 | C |
| ATOM | 6037 | C | VAL | D | 147 | −17.443 | −56.024 | 125.497 | 1.00 | 36.93 | C |
| ATOM | 6038 | O | VAL | D | 147 | −16.711 | −56.436 | 124.593 | 1.00 | 43.76 | O |
| ATOM | 6039 | CB | VAL | D | 147 | −19.568 | −55.348 | 124.331 | 1.00 | 32.86 | C |
| ATOM | 6040 | CG1 | VAL | D | 147 | −20.166 | −56.646 | 124.849 | 1.00 | 30.69 | C |
| ATOM | 6041 | CG2 | VAL | D | 147 | −20.638 | −54.322 | 124.288 | 1.00 | 31.55 | C |
| ATOM | 6042 | N | GLN | D | 148 | −17.443 | −56.529 | 126.720 | 1.00 | 35.29 | N |
| ATOM | 6043 | CA | GLN | D | 148 | −16.699 | −57.714 | 127.106 | 1.00 | 36.02 | C |
| ATOM | 6044 | C | GLN | D | 148 | −17.719 | −58.707 | 127.647 | 1.00 | 37.18 | C |
| ATOM | 6045 | O | GLN | D | 148 | −18.459 | −58.386 | 128.579 | 1.00 | 35.76 | O |
| ATOM | 6046 | CB | GLN | D | 148 | −15.637 | −57.350 | 128.153 | 1.00 | 38.02 | C |
| ATOM | 6047 | CG | GLN | D | 148 | −14.870 | −58.512 | 128.744 | 1.00 | 45.95 | C |
| ATOM | 6048 | CD | GLN | D | 148 | −13.798 | −59.062 | 127.806 | 1.00 | 52.43 | C |
| ATOM | 6049 | OE1 | GLN | D | 148 | −13.806 | −60.255 | 127.467 | 1.00 | 49.60 | O |
| ATOM | 6050 | NE2 | GLN | D | 148 | −12.857 | −58.196 | 127.398 | 1.00 | 47.07 | N |
| ATOM | 6051 | N | TRP | D | 149 | −17.787 | −59.886 | 127.037 | 1.00 | 36.10 | N |
| ATOM | 6052 | CA | TRP | D | 149 | −18.680 | −60.955 | 127.473 | 1.00 | 37.96 | C |
| ATOM | 6053 | C | TRP | D | 149 | −17.977 | −61.861 | 128.481 | 1.00 | 35.95 | C |
| ATOM | 6054 | O | TRP | D | 149 | −16.799 | −62.191 | 128.318 | 1.00 | 37.64 | O |
| ATOM | 6055 | CB | TRP | D | 149 | −19.142 | −61.800 | 126.281 | 1.00 | 33.14 | C |
| ATOM | 6056 | CG | TRP | D | 149 | −20.226 | −61.240 | 125.409 | 1.00 | 34.49 | C |
| ATOM | 6057 | CD1 | TRP | D | 149 | −20.083 | −60.721 | 124.147 | 1.00 | 33.46 | C |

TABLE 10.4-continued

| | | | | | | | | | | |
|---|---|---|---|---|---|---|---|---|---|---|
| ATOM | 6058 | CD2 | TRP | D | 149 | −21.630 | −61.200 | 125.697 | 1.00 | 36.39 | C |
| ATOM | 6059 | NE1 | TRP | D | 149 | −21.301 | −60.343 | 123.643 | 1.00 | 29.56 | N |
| ATOM | 6060 | CE2 | TRP | D | 149 | −22.272 | −60.620 | 124.571 | 1.00 | 33.79 | C |
| ATOM | 6061 | CE3 | TRP | D | 149 | −22.406 | −61.584 | 126.795 | 1.00 | 31.81 | C |
| ATOM | 6062 | CZ2 | TRP | D | 149 | −23.653 | −60.408 | 124.518 | 1.00 | 28.35 | C |
| ATOM | 6063 | CZ3 | TRP | D | 149 | −23.777 | −61.367 | 126.741 | 1.00 | 37.34 | C |
| ATOM | 6064 | CH2 | TRP | D | 149 | −24.385 | −60.787 | 125.607 | 1.00 | 31.64 | C |
| ATOM | 6065 | N | LYS | D | 150 | −18.700 | −62.265 | 129.526 | 1.00 | 35.84 | N |
| ATOM | 6066 | CA | LYS | D | 150 | −18.195 | −63.242 | 130.494 | 1.00 | 39.20 | C |
| ATOM | 6067 | C | LYS | D | 150 | −19.214 | −64.355 | 130.710 | 1.00 | 34.68 | C |
| ATOM | 6068 | O | LYS | D | 150 | −20.391 | −64.086 | 130.979 | 1.00 | 33.70 | O |
| ATOM | 6069 | CB | LYS | D | 150 | −17.856 | −62.579 | 131.831 | 1.00 | 29.07 | C |
| ATOM | 6070 | CG | LYS | D | 150 | −16.601 | −61.761 | 131.779 | 1.00 | 33.89 | C |
| ATOM | 6071 | CD | LYS | D | 150 | −16.602 | −60.781 | 132.911 | 1.00 | 41.07 | C |
| ATOM | 6072 | CE | LYS | D | 150 | −15.607 | −59.667 | 132.710 | 1.00 | 43.52 | C |
| ATOM | 6073 | NZ | LYS | D | 150 | −15.402 | −58.953 | 134.001 | 1.00 | 45.35 | N1+ |
| ATOM | 6074 | N | VAL | D | 151 | −18.756 | −65.597 | 130.594 | 1.00 | 30.40 | N |
| ATOM | 6075 | CA | VAL | D | 151 | −19.524 | −66.777 | 130.977 | 1.00 | 36.11 | C |
| ATOM | 6076 | C | VAL | D | 151 | −18.820 | −67.400 | 132.176 | 1.00 | 36.86 | C |
| ATOM | 6077 | O | VAL | D | 151 | −17.662 | −67.816 | 132.061 | 1.00 | 34.20 | O |
| ATOM | 6078 | CB | VAL | D | 151 | −19.637 | −67.786 | 129.825 | 1.00 | 37.15 | C |
| ATOM | 6079 | CG1 | VAL | D | 151 | −20.568 | −68.901 | 130.211 | 1.00 | 34.22 | C |
| ATOM | 6080 | CG2 | VAL | D | 151 | −20.111 | −67.106 | 128.549 | 1.00 | 38.38 | C |
| ATOM | 6081 | N | ASP | D | 152 | −19.508 | −67.435 | 133.333 | 1.00 | 40.45 | N |
| ATOM | 6082 | CA | ASP | D | 152 | −18.928 | −67.863 | 134.626 | 1.00 | 35.46 | C |
| ATOM | 6083 | C | ASP | D | 152 | −17.564 | −67.218 | 134.854 | 1.00 | 37.61 | C |
| ATOM | 6084 | O | ASP | D | 152 | −16.602 | −67.868 | 135.265 | 1.00 | 40.92 | O |
| ATOM | 6085 | CB | ASP | D | 152 | −18.833 | −69.391 | 134.739 | 1.00 | 34.39 | C |
| ATOM | 6086 | CG | ASP | D | 152 | −20.200 | −70.051 | 134.992 | 1.00 | 43.58 | C |
| ATOM | 6087 | OD1 | ASP | D | 152 | −21.057 | −69.424 | 135.659 | 1.00 | 44.13 | O |
| ATOM | 6088 | OD2 | ASP | D | 152 | −20.411 | −71.206 | 134.549 | 1.00 | 44.21 | O1− |
| ATOM | 6089 | N | ASN | D | 153 | −17.493 | −65.920 | 134.560 | 1.00 | 36.04 | N |
| ATOM | 6090 | CA | ASN | D | 153 | −16.305 | −65.088 | 134.682 | 1.00 | 34.97 | C |
| ATOM | 6091 | C | ASN | D | 153 | −15.188 | −65.521 | 133.737 | 1.00 | 37.78 | C |
| ATOM | 6092 | O | ASN | D | 153 | −14.015 | −65.140 | 133.922 | 1.00 | 36.32 | O |
| ATOM | 6093 | CB | ASN | D | 153 | −15.802 | −65.009 | 136.126 | 1.00 | 33.76 | C |
| ATOM | 6094 | CG | ASN | D | 153 | −15.114 | −63.678 | 136.417 | 1.00 | 42.55 | C |
| ATOM | 6095 | OD1 | ASN | D | 153 | −15.704 | −62.598 | 136.248 | 1.00 | 42.84 | O |
| ATOM | 6096 | ND2 | ASN | D | 153 | −13.853 | −63.747 | 136.831 | 1.00 | 46.83 | N |
| ATOM | 6097 | N | ALA | D | 154 | −15.521 | −66.293 | 132.706 | 1.00 | 34.52 | N |
| ATOM | 6098 | CA | ALA | D | 154 | −14.577 | −66.555 | 131.629 | 1.00 | 35.50 | C |
| ATOM | 6099 | C | ALA | D | 154 | −14.784 | −65.526 | 130.521 | 1.00 | 38.64 | C |
| ATOM | 6100 | O | ALA | D | 154 | −15.880 | −65.417 | 129.954 | 1.00 | 35.76 | O |
| ATOM | 6101 | CB | ALA | D | 154 | −14.727 | −67.973 | 131.090 | 1.00 | 31.21 | C |
| ATOM | 6102 | N | LEU | D | 155 | −13.725 | −64.775 | 130.223 | 1.00 | 39.22 | N |
| ATOM | 6103 | CA | LEU | D | 155 | −13.728 | −63.839 | 129.108 | 1.00 | 34.49 | C |
| ATOM | 6104 | C | LEU | D | 155 | −13.970 | −64.578 | 127.815 | 1.00 | 31.95 | C |
| ATOM | 6105 | O | LEU | D | 155 | −13.276 | −65.550 | 127.518 | 1.00 | 33.49 | O |
| ATOM | 6106 | CB | LEU | D | 155 | −12.391 | −63.125 | 129.038 | 1.00 | 36.99 | C |
| ATOM | 6107 | CG | LEU | D | 155 | −12.350 | −61.800 | 129.779 | 1.00 | 48.06 | C |
| ATOM | 6108 | CD1 | LEU | D | 155 | −12.181 | −62.015 | 131.301 | 1.00 | 43.48 | C |
| ATOM | 6109 | CD2 | LEU | D | 155 | −11.219 | −60.978 | 129.190 | 1.00 | 51.82 | C |
| ATOM | 6110 | N | GLN | D | 156 | −14.996 | −64.166 | 127.080 | 1.00 | 36.40 | N |
| ATOM | 6111 | CA | GLN | D | 156 | −15.212 | −64.660 | 125.725 | 1.00 | 35.33 | C |
| ATOM | 6112 | C | GLN | D | 156 | −14.505 | −63.750 | 124.725 | 1.00 | 31.08 | C |
| ATOM | 6113 | O | GLN | D | 156 | −14.665 | −62.526 | 124.763 | 1.00 | 36.72 | O |
| ATOM | 6114 | CB | GLN | D | 156 | −16.703 | −64.738 | 125.398 | 1.00 | 32.10 | C |
| ATOM | 6115 | CG | GLN | D | 156 | −17.523 | −65.447 | 126.450 | 1.00 | 35.66 | C |
| ATOM | 6116 | CD | GLN | D | 156 | −17.059 | −66.878 | 126.701 | 1.00 | 36.63 | C |
| ATOM | 6117 | OE1 | GLN | D | 156 | −17.090 | −67.722 | 125.804 | 1.00 | 31.49 | O |
| ATOM | 6118 | NE2 | GLN | D | 156 | −16.638 | −67.153 | 127.929 | 1.00 | 35.80 | N |
| ATOM | 6119 | N | SER | D | 157 | −13.790 | −64.354 | 123.795 | 1.00 | 24.35 | N |
| ATOM | 6120 | CA | SER | D | 157 | −13.068 | −63.629 | 122.758 | 1.00 | 27.71 | C |
| ATOM | 6121 | C | SER | D | 157 | −13.201 | −64.434 | 121.474 | 1.00 | 29.57 | C |
| ATOM | 6122 | O | SER | D | 157 | −12.715 | −65.562 | 121.405 | 1.00 | 31.81 | O |
| ATOM | 6123 | CB | SER | D | 157 | −11.607 | −63.449 | 123.142 | 1.00 | 27.38 | C |
| ATOM | 6124 | OG | SER | D | 157 | −10.897 | −62.800 | 122.115 | 1.00 | 32.95 | O |
| ATOM | 6125 | N | GLY | D | 158 | −13.880 | −63.886 | 120.474 | 1.00 | 25.60 | N |
| ATOM | 6126 | CA | GLY | D | 158 | −13.995 | −64.518 | 119.171 | 1.00 | 23.02 | C |
| ATOM | 6127 | C | GLY | D | 158 | −15.329 | −65.156 | 118.862 | 1.00 | 31.71 | C |
| ATOM | 6128 | O | GLY | D | 158 | −15.544 | −65.567 | 117.710 | 1.00 | 30.83 | O |
| ATOM | 6129 | N | ASN | D | 159 | −16.253 | −65.223 | 119.824 | 1.00 | 28.19 | N |
| ATOM | 6130 | CA | ASN | D | 159 | −17.529 | −65.872 | 119.572 | 1.00 | 22.12 | C |
| ATOM | 6131 | C | ASN | D | 159 | −18.686 | −64.886 | 119.660 | 1.00 | 25.52 | C |
| ATOM | 6132 | O | ASN | D | 159 | −19.803 | −65.268 | 120.002 | 1.00 | 26.86 | O |
| ATOM | 6133 | CB | ASN | D | 159 | −17.749 | −67.054 | 120.516 | 1.00 | 25.99 | C |
| ATOM | 6134 | CG | ASN | D | 159 | −17.495 | −66.712 | 121.997 | 1.00 | 31.94 | C |
| ATOM | 6135 | OD1 | ASN | D | 159 | −17.103 | −65.589 | 120.002 | 1.00 | 26.86 | O |
| ATOM | 6136 | ND2 | ASN | D | 159 | −17.712 | −67.706 | 122.875 | 1.00 | 27.51 | N |
| ATOM | 6137 | N | SER | D | 160 | −18.445 | −63.625 | 119.295 | 1.00 | 27.33 | N |

TABLE 10.4-continued

| ATOM | 6138 | CA | SER | D | 160 | −19.484 | −62.606 | 119.297 | 1.00 | 26.68 | C |
|------|------|-----|-----|---|-----|---------|---------|---------|------|-------|----|
| ATOM | 6139 | C | SER | D | 160 | −19.310 | −61.677 | 118.099 | 1.00 | 24.99 | C |
| ATOM | 6140 | O | SER | D | 160 | −18.224 | −61.571 | 117.525 | 1.00 | 29.23 | O |
| ATOM | 6141 | CB | SER | D | 160 | −19.475 | −61.812 | 120.614 | 1.00 | 27.08 | C |
| ATOM | 6142 | OG | SER | D | 160 | −18.327 | −61.009 | 120.707 | 1.00 | 26.36 | O |
| ATOM | 6143 | N | GLN | D | 161 | −20.407 | −61.024 | 117.708 | 1.00 | 24.70 | N |
| ATOM | 6144 | CA | GLN | D | 161 | −20.404 | −59.998 | 116.667 | 1.00 | 24.60 | C |
| ATOM | 6145 | C | GLN | D | 161 | −21.192 | −58.766 | 117.128 | 1.00 | 29.81 | C |
| ATOM | 6146 | O | GLN | D | 161 | −21.972 | −58.818 | 118.082 | 1.00 | 31.67 | O |
| ATOM | 6147 | CB | GLN | D | 161 | −20.954 | −60.560 | 115.380 | 1.00 | 22.23 | C |
| ATOM | 6148 | CG | GLN | D | 161 | −20.025 | −61.563 | 114.752 | 1.00 | 24.49 | C |
| ATOM | 6149 | CD | GLN | D | 161 | −20.631 | −62.200 | 113.532 | 1.00 | 27.64 | C |
| ATOM | 6150 | OE1 | GLN | D | 161 | −21.466 | −63.098 | 113.629 | 1.00 | 32.76 | O |
| ATOM | 6151 | NE2 | GLN | D | 161 | −20.246 | −61.717 | 112.372 | 1.00 | 23.06 | N |
| ATOM | 6152 | N | GLU | D | 162 | −20.965 | −57.641 | 116.458 | 1.00 | 30.47 | N |
| ATOM | 6153 | CA | GLU | D | 162 | −21.462 | −56.341 | 116.919 | 1.00 | 24.77 | C |
| ATOM | 6154 | C | GLU | D | 162 | −21.983 | −55.478 | 115.772 | 1.00 | 30.23 | C |
| ATOM | 6155 | O | GLU | D | 162 | −21.425 | −55.485 | 114.678 | 1.00 | 26.53 | O |
| ATOM | 6156 | CB | GLU | D | 162 | −20.360 | −55.528 | 117.568 | 1.00 | 32.41 | C |
| ATOM | 6157 | CG | GLU | D | 162 | −20.266 | −55.519 | 119.031 | 1.00 | 32.77 | C |
| ATOM | 6158 | CD | GLU | D | 162 | −19.053 | −54.695 | 119.437 | 1.00 | 41.06 | C |
| ATOM | 6159 | OE1 | GLU | D | 162 | −18.443 | −54.075 | 118.530 | 1.00 | 38.20 | O |
| ATOM | 6160 | OE2 | GLU | D | 162 | −18.704 | −54.667 | 120.637 | 1.00 | 50.77 | O1− |
| ATOM | 6161 | N | SER | D | 163 | −22.953 | −54.617 | 116.084 | 1.00 | 27.60 | N |
| ATOM | 6162 | CA | SER | D | 163 | −23.426 | −53.583 | 115.170 | 1.00 | 27.13 | C |
| ATOM | 6163 | C | SER | D | 163 | −23.656 | −52.284 | 115.923 | 1.00 | 25.97 | C |
| ATOM | 6164 | O | SER | D | 163 | −24.105 | −52.299 | 117.068 | 1.00 | 26.91 | O |
| ATOM | 6165 | CB | SER | D | 163 | −24.781 | −53.931 | 114.531 | 1.00 | 29.47 | C |
| ATOM | 6166 | OG | SER | D | 163 | −24.662 | −54.692 | 113.366 | 1.00 | 32.02 | O |
| ATOM | 6167 | N | VAL | D | 164 | −23.422 | −51.161 | 115.243 | 1.00 | 20.54 | N |
| ATOM | 6168 | CA | VAL | D | 164 | −23.727 | −49.843 | 115.781 | 1.00 | 23.87 | C |
| ATOM | 6169 | C | VAL | D | 164 | −24.632 | −49.109 | 114.794 | 1.00 | 25.79 | C |
| ATOM | 6170 | O | VAL | D | 164 | −24.411 | −49.146 | 113.580 | 1.00 | 28.96 | O |
| ATOM | 6171 | CB | VAL | D | 164 | −22.451 | −49.022 | 116.079 | 1.00 | 27.40 | C |
| ATOM | 6172 | CG1 | VAL | D | 164 | −22.804 | −47.685 | 116.731 | 1.00 | 26.22 | C |
| ATOM | 6173 | CG2 | VAL | D | 164 | −21.543 | −49.782 | 116.997 | 1.00 | 25.86 | C |
| ATOM | 6174 | N | THR | D | 165 | −25.645 | −48.432 | 115.318 | 1.00 | 22.06 | N |
| ATOM | 6175 | CA | THR | D | 165 | −26.530 | −47.661 | 114.471 | 1.00 | 26.12 | C |
| ATOM | 6176 | C | THR | D | 165 | −25.845 | −46.376 | 113.991 | 1.00 | 27.66 | C |
| ATOM | 6177 | O | THR | D | 165 | −24.781 | −45.984 | 114.468 | 1.00 | 24.77 | O |
| ATOM | 6178 | CB | THR | D | 165 | −27.813 | −47.311 | 115.216 | 1.00 | 27.08 | C |
| ATOM | 6179 | OG1 | THR | D | 165 | −27.482 | −46.765 | 116.504 | 1.00 | 27.47 | O |
| ATOM | 6180 | CG2 | THR | D | 165 | −28.688 | −48.544 | 115.355 | 1.00 | 26.44 | C |
| ATOM | 6181 | N | GLU | D | 166 | −26.479 | −45.719 | 113.023 | 1.00 | 27.00 | N |
| ATOM | 6182 | CA | GLU | D | 166 | −26.079 | −44.370 | 112.686 | 1.00 | 27.71 | C |
| ATOM | 6183 | C | GLU | D | 166 | −26.495 | −43.432 | 113.817 | 1.00 | 33.03 | C |
| ATOM | 6184 | O | GLU | D | 166 | −27.359 | −43.761 | 114.640 | 1.00 | 33.28 | O |
| ATOM | 6185 | CB | GLU | D | 166 | −26.689 | −43.951 | 111.339 | 1.00 | 30.38 | C |
| ATOM | 6186 | CG | GLU | D | 166 | −26.119 | −44.711 | 110.120 | 1.00 | 25.40 | C |
| ATOM | 6187 | CD | GLU | D | 166 | −24.599 | −44.606 | 110.040 | 1.00 | 38.65 | C |
| ATOM | 6188 | OE1 | GLU | D | 166 | −24.038 | −43.552 | 110.423 | 1.00 | 46.73 | O |
| ATOM | 6189 | OE2 | GLU | D | 166 | −23.946 | −45.597 | 109.652 | 1.00 | 40.23 | O1− |
| ATOM | 6190 | N | GLN | D | 167 | −25.866 | −42.254 | 113.856 | 1.00 | 29.35 | N |
| ATOM | 6191 | CA | GLN | D | 167 | −26.181 | −41.280 | 114.885 | 1.00 | 27.68 | C |
| ATOM | 6192 | C | GLN | D | 167 | −27.675 | −40.977 | 114.888 | 1.00 | 30.18 | C |
| ATOM | 6193 | O | GLN | D | 167 | −28.273 | −40.743 | 113.841 | 1.00 | 28.88 | O |
| ATOM | 6194 | CB | GLN | D | 167 | −25.371 | −40.014 | 114.663 | 1.00 | 26.86 | C |
| ATOM | 6195 | CG | GLN | D | 167 | −25.050 | −39.318 | 115.952 | 1.00 | 30.75 | C |
| ATOM | 6196 | CD | GLN | D | 167 | −24.012 | −38.230 | 115.810 | 1.00 | 30.88 | C |
| ATOM | 6197 | OE1 | GLN | D | 167 | −23.630 | −37.851 | 114.707 | 1.00 | 26.28 | O |
| ATOM | 6198 | NE2 | GLN | D | 167 | −23.526 | −37.741 | 116.942 | 1.00 | 31.17 | N |
| ATOM | 6199 | N | ASP | D | 168 | −28.284 | −40.993 | 116.073 | 1.00 | 32.93 | N |
| ATOM | 6200 | CA | ASP | D | 168 | −29.740 | −40.995 | 116.145 | 1.00 | 30.89 | C |
| ATOM | 6201 | C | ASP | D | 168 | −30.322 | −39.647 | 115.730 | 1.00 | 32.78 | C |
| ATOM | 6202 | O | ASP | D | 168 | −29.864 | −38.588 | 116.175 | 1.00 | 32.90 | O |
| ATOM | 6203 | CB | ASP | D | 168 | −30.198 | −41.372 | 117.553 | 1.00 | 31.28 | C |
| ATOM | 6204 | CG | ASP | D | 168 | −31.716 | −41.521 | 117.659 | 1.00 | 38.67 | C |
| ATOM | 6205 | OD2 | ASP | D | 168 | −32.352 | −40.708 | 118.357 | 1.00 | 38.36 | O |
| ATOM | 6206 | OD1 | ASP | D | 168 | −32.272 | −42.488 | 117.088 | 1.00 | 46.18 | O1− |
| ATOM | 6207 | N | SER | D | 169 | −31.354 | −39.697 | 114.883 | 1.00 | 39.01 | N |
| ATOM | 6208 | CA | SER | D | 169 | −31.955 | −38.485 | 114.346 | 1.00 | 32.75 | C |
| ATOM | 6209 | C | SER | D | 169 | −32.582 | −37.588 | 115.413 | 1.00 | 37.05 | C |
| ATOM | 6210 | O | SER | D | 169 | −32.812 | −36.404 | 115.145 | 1.00 | 38.37 | O |
| ATOM | 6211 | CB | SER | D | 169 | −33.001 | −38.845 | 113.284 | 1.00 | 39.20 | C |
| ATOM | 6212 | OG | SER | D | 169 | −34.079 | −39.588 | 113.824 | 1.00 | 50.23 | O |
| ATOM | 6213 | N | LYS | D | 170 | −32.814 | −38.077 | 116.629 | 1.00 | 34.51 | N |
| ATOM | 6214 | CA | LYS | D | 170 | −33.421 | −37.203 | 117.625 | 1.00 | 34.07 | C |
| ATOM | 6215 | C | LYS | D | 170 | −32.468 | −36.701 | 118.701 | 1.00 | 33.50 | C |
| ATOM | 6216 | O | LYS | D | 170 | −32.589 | −35.552 | 119.108 | 1.00 | 37.46 | O |
| ATOM | 6217 | CB | LYS | D | 170 | −34.629 | −37.888 | 118.275 | 1.00 | 37.63 | C |

TABLE 10.4-continued

| | | | | | | | | | |
|---|---|---|---|---|---|---|---|---|---|
| ATOM | 6218 | CG | LYS | D | 170 | −35.389 | −37.006 | 119.243 | 1.00 | 37.03 | C |
| ATOM | 6219 | CD | LYS | D | 170 | −36.331 | −37.786 | 120.178 | 1.00 | 38.46 | C |
| ATOM | 6220 | CE | LYS | D | 170 | −37.575 | −38.283 | 119.424 | 1.00 | 45.87 | C |
| ATOM | 6221 | NZ | LYS | D | 170 | −38.639 | −38.916 | 120.302 | 1.00 | 39.82 | N1+ |
| ATOM | 6222 | N | ASP | D | 171 | −31.531 | −37.506 | 119.210 | 1.00 | 36.72 | N |
| ATOM | 6223 | CA | ASP | D | 171 | −30.652 | −37.034 | 120.285 | 1.00 | 30.44 | C |
| ATOM | 6224 | C | ASP | D | 171 | −29.163 | −37.175 | 119.956 | 1.00 | 31.83 | C |
| ATOM | 6225 | O | ASP | D | 171 | −28.327 | −37.027 | 120.864 | 1.00 | 24.40 | O |
| ATOM | 6226 | CB | ASP | D | 171 | −30.977 | −37.745 | 121.621 | 1.00 | 24.58 | C |
| ATOM | 6227 | CG | ASP | D | 171 | −30.724 | −39.290 | 121.598 | 1.00 | 37.38 | C |
| ATOM | 6228 | OD1 | ASP | D | 171 | −29.900 | −39.800 | 120.803 | 1.00 | 38.28 | O |
| ATOM | 6229 | OD2 | ASP | D | 171 | −31.345 | −40.026 | 122.402 | 1.00 | 44.17 | O1− |
| ATOM | 6230 | N | SER | D | 172 | −28.814 | −37.467 | 118.691 | 1.00 | 27.49 | N |
| ATOM | 6231 | CA | SER | D | 172 | −27.433 | −37.542 | 118.210 | 1.00 | 29.50 | C |
| ATOM | 6232 | C | SER | D | 172 | −26.575 | −38.575 | 118.954 | 1.00 | 33.88 | C |
| ATOM | 6233 | O | SER | D | 172 | −25.339 | −38.428 | 119.009 | 1.00 | 32.88 | O |
| ATOM | 6234 | CB | SER | D | 172 | −26.756 | −36.167 | 118.283 | 1.00 | 28.79 | C |
| ATOM | 6235 | OG | SER | D | 172 | −27.503 | −35.209 | 117.557 | 1.00 | 32.16 | O |
| ATOM | 6236 | N | THR | D | 173 | −27.185 | −39.602 | 119.550 | 1.00 | 25.27 | N |
| ATOM | 6237 | CA | THR | D | 173 | −26.443 | −40.663 | 120.214 | 1.00 | 26.81 | C |
| ATOM | 6238 | C | THR | D | 173 | −26.265 | −41.868 | 119.287 | 1.00 | 28.18 | C |
| ATOM | 6239 | O | THR | D | 173 | −26.791 | −41.932 | 118.163 | 1.00 | 26.72 | O |
| ATOM | 6240 | CB | THR | D | 173 | −27.127 | −41.101 | 121.529 | 1.00 | 29.20 | C |
| ATOM | 6241 | OG1 | THR | D | 173 | −28.454 | −41.578 | 121.279 | 1.00 | 26.42 | O |
| ATOM | 6242 | CG2 | THR | D | 173 | −27.181 | −39.948 | 122.547 | 1.00 | 27.06 | C |
| ATOM | 6243 | N | TYR | D | 174 | −25.492 | −42.824 | 119.787 | 1.00 | 24.11 | N |
| ATOM | 6244 | CA | TYR | D | 174 | −25.252 | −44.113 | 119.162 | 1.00 | 25.18 | C |
| ATOM | 6245 | C | TYR | D | 174 | −25.858 | −45.225 | 120.001 | 1.00 | 27.09 | C |
| ATOM | 6246 | O | TYR | D | 174 | −25.925 | −45.130 | 121.232 | 1.00 | 26.92 | O |
| ATOM | 6247 | CB | TYR | D | 174 | −23.740 | −44.371 | 118.993 | 1.00 | 24.71 | C |
| ATOM | 6248 | CG | TYR | D | 174 | −23.145 | −43.461 | 117.980 | 1.00 | 27.06 | C |
| ATOM | 6249 | CD1 | TYR | D | 174 | −23.212 | −43.778 | 116.625 | 1.00 | 23.86 | C |
| ATOM | 6250 | CD2 | TYR | D | 174 | −22.587 | −42.234 | 118.355 | 1.00 | 29.38 | C |
| ATOM | 6251 | CE1 | TYR | D | 174 | −22.697 | −42.931 | 115.671 | 1.00 | 28.55 | C |
| ATOM | 6252 | CE2 | TYR | D | 174 | −22.060 | −41.366 | 117.397 | 1.00 | 28.07 | C |
| ATOM | 6253 | CZ | TYR | D | 174 | −22.125 | −41.719 | 116.053 | 1.00 | 30.70 | C |
| ATOM | 6254 | OH | TYR | D | 174 | −21.626 | −40.882 | 115.081 | 1.00 | 29.66 | O |
| ATOM | 6255 | N | SER | D | 175 | −26.220 | −46.318 | 119.329 | 1.00 | 29.12 | N |
| ATOM | 6256 | CA | SER | D | 175 | −26.623 | −47.546 | 120.005 | 1.00 | 29.70 | C |
| ATOM | 6257 | C | SER | D | 175 | −25.851 | −48.723 | 119.437 | 1.00 | 27.77 | C |
| ATOM | 6258 | O | SER | D | 175 | −25.515 | −48.748 | 118.252 | 1.00 | 26.37 | O |
| ATOM | 6259 | CB | SER | D | 175 | −28.127 | −47.796 | 119.868 | 1.00 | 28.32 | C |
| ATOM | 6260 | OG | SER | D | 175 | −28.822 | −46.950 | 120.755 | 1.00 | 29.89 | O |
| ATOM | 6261 | N | LEU | D | 176 | −25.615 | −49.725 | 120.284 | 1.00 | 29.44 | N |
| ATOM | 6262 | CA | LEU | D | 176 | −24.808 | −50.884 | 119.918 | 1.00 | 26.61 | C |
| ATOM | 6263 | C | LEU | D | 176 | −25.499 | −52.174 | 120.346 | 1.00 | 25.01 | C |
| ATOM | 6264 | O | LEU | D | 176 | −26.055 | −52.255 | 121.444 | 1.00 | 25.06 | O |
| ATOM | 6265 | CB | LEU | D | 176 | −23.412 | −50.791 | 120.557 | 1.00 | 23.61 | C |
| ATOM | 6266 | CG | LEU | D | 176 | −22.361 | −51.831 | 120.176 | 1.00 | 26.86 | C |
| ATOM | 6267 | CD1 | LEU | D | 176 | −20.995 | −51.225 | 120.278 | 1.00 | 28.36 | C |
| ATOM | 6268 | CD2 | LEU | D | 176 | −22.428 | −53.052 | 121.099 | 1.00 | 25.35 | C |
| ATOM | 6269 | N | SER | D | 177 | −25.405 | −53.202 | 119.500 | 1.00 | 26.18 | N |
| ATOM | 6270 | CA | SER | D | 177 | −25.932 | −54.536 | 119.789 | 1.00 | 25.92 | C |
| ATOM | 6271 | C | SER | D | 177 | −24.840 | −55.587 | 119.589 | 1.00 | 25.55 | C |
| ATOM | 6272 | O | SER | D | 177 | −24.136 | −55.566 | 118.577 | 1.00 | 30.42 | O |
| ATOM | 6273 | CB | SER | D | 177 | −27.142 | −54.840 | 118.895 | 1.00 | 30.52 | C |
| ATOM | 6274 | OG | SER | D | 177 | −27.570 | −56.176 | 119.035 | 1.00 | 31.20 | O |
| ATOM | 6275 | N | SER | D | 178 | −24.668 | −56.474 | 120.574 | 1.00 | 28.18 | N |
| ATOM | 6276 | CA | SER | D | 178 | −23.659 | −57.527 | 120.542 | 1.00 | 25.27 | C |
| ATOM | 6277 | C | SER | D | 178 | −24.288 | −58.885 | 120.794 | 1.00 | 26.75 | C |
| ATOM | 6278 | O | SER | D | 178 | −25.102 | −59.040 | 121.705 | 1.00 | 31.18 | O |
| ATOM | 6279 | CB | SER | D | 178 | −22.560 | −57.312 | 121.568 | 1.00 | 30.71 | C |
| ATOM | 6280 | OG | SER | D | 178 | −21.592 | −58.348 | 121.447 | 1.00 | 32.24 | O |
| ATOM | 6281 | N | THR | D | 179 | −23.888 | −59.880 | 120.010 | 1.00 | 27.93 | N |
| ATOM | 6282 | CA | THR | D | 179 | −24.458 | −61.220 | 120.122 | 1.00 | 29.75 | C |
| ATOM | 6283 | C | THR | D | 179 | −23.379 | −62.248 | 120.444 | 1.00 | 31.38 | C |
| ATOM | 6284 | O | THR | D | 179 | −22.529 | −62.546 | 119.604 | 1.00 | 25.41 | O |
| ATOM | 6285 | CB | THR | D | 179 | −25.160 | −61.608 | 118.837 | 1.00 | 32.19 | C |
| ATOM | 6286 | OG1 | THR | D | 179 | −26.110 | −60.586 | 118.488 | 1.00 | 42.39 | O |
| ATOM | 6287 | CG2 | THR | D | 179 | −25.841 | −62.933 | 119.026 | 1.00 | 33.94 | C |
| ATOM | 6288 | N | LEU | D | 180 | −23.448 | −62.822 | 121.641 | 1.00 | 33.64 | N |
| ATOM | 6289 | CA | LEU | D | 180 | −22.651 | −63.988 | 121.989 | 1.00 | 26.84 | C |
| ATOM | 6290 | C | LEU | D | 180 | −23.377 | −65.233 | 121.509 | 1.00 | 28.96 | C |
| ATOM | 6291 | O | LEU | D | 180 | −24.576 | −65.383 | 121.759 | 1.00 | 33.24 | O |
| ATOM | 6292 | CB | LEU | D | 180 | −22.446 | −64.042 | 123.496 | 1.00 | 26.91 | C |
| ATOM | 6293 | CG | LEU | D | 180 | −21.584 | −65.169 | 124.035 | 1.00 | 32.83 | C |
| ATOM | 6294 | CD1 | LEU | D | 180 | −20.179 | −64.954 | 123.541 | 1.00 | 32.39 | C |
| ATOM | 6295 | CD2 | LEU | D | 180 | −21.624 | −65.196 | 125.566 | 1.00 | 35.83 | C |
| ATOM | 6296 | N | THR | D | 181 | −22.683 | −66.101 | 120.784 | 1.00 | 24.60 | N |
| ATOM | 6297 | CA | THR | D | 181 | −23.289 | −67.321 | 120.267 | 1.00 | 29.40 | C |

TABLE 10.4-continued

| ATOM | 6298 | C | THR | D | 181 | −22.656 | −68.546 | 120.928 | 1.00 | 35.38 | C |
|---|---|---|---|---|---|---|---|---|---|---|---|
| ATOM | 6299 | O | THR | D | 181 | −21.430 | −68.622 | 121.063 | 1.00 | 32.82 | O |
| ATOM | 6300 | CB | THR | D | 181 | −23.162 | −67.393 | 118.744 | 1.00 | 29.01 | C |
| ATOM | 6301 | OG1 | THR | D | 181 | −23.762 | −66.235 | 118.169 | 1.00 | 36.58 | O |
| ATOM | 6302 | CG2 | THR | D | 181 | −23.943 | −68.571 | 118.214 | 1.00 | 35.08 | C |
| ATOM | 6303 | N | LEU | D | 182 | −23.499 | −69.481 | 121.375 | 1.00 | 33.54 | N |
| ATOM | 6304 | CA | LEU | D | 182 | −23.061 | −70.743 | 121.957 | 1.00 | 31.73 | C |
| ATOM | 6305 | C | LEU | D | 182 | −23.908 | −71.860 | 121.379 | 1.00 | 38.06 | C |
| ATOM | 6306 | O | LEU | D | 182 | −25.010 | −71.638 | 120.866 | 1.00 | 39.76 | O |
| ATOM | 6307 | CB | LEU | D | 182 | −23.242 | −70.791 | 123.473 | 1.00 | 34.20 | C |
| ATOM | 6308 | CG | LEU | D | 182 | −22.667 | −69.731 | 124.395 | 1.00 | 37.93 | C |
| ATOM | 6309 | CD1 | LEU | D | 182 | −23.089 | −70.021 | 125.827 | 1.00 | 39.29 | C |
| ATOM | 6310 | CD2 | LEU | D | 182 | −21.154 | −69.692 | 124.276 | 1.00 | 41.23 | C |
| ATOM | 6311 | N | SER | D | 183 | −23.401 | −73.075 | 121.491 | 1.00 | 41.78 | N |
| ATOM | 6312 | CA | SER | D | 183 | −24.276 | −74.218 | 121.302 | 1.00 | 41.97 | C |
| ATOM | 6313 | C | SER | D | 183 | −25.171 | −74.354 | 122.533 | 1.00 | 40.93 | C |
| ATOM | 6314 | O | SER | D | 183 | −24.832 | −73.874 | 123.619 | 1.00 | 39.70 | O |
| ATOM | 6315 | CB | SER | D | 183 | −23.449 | −75.481 | 121.071 | 1.00 | 42.62 | C |
| ATOM | 6316 | OG | SER | D | 183 | −22.677 | −75.783 | 122.224 | 1.00 | 45.39 | O |
| ATOM | 6317 | N | LYS | D | 184 | −26.323 | −75.017 | 122.368 | 1.00 | 38.98 | N |
| ATOM | 6318 | CA | LYS | D | 184 | −27.172 | −75.267 | 123.536 | 1.00 | 46.77 | C |
| ATOM | 6319 | C | LYS | D | 184 | −26.428 | −76.067 | 124.602 | 1.00 | 45.69 | C |
| ATOM | 6320 | O | LYS | D | 184 | −26.586 | −75.820 | 125.806 | 1.00 | 44.13 | O |
| ATOM | 6321 | CB | LYS | D | 184 | −28.465 | −75.982 | 123.135 | 1.00 | 52.78 | C |
| ATOM | 6322 | CG | LYS | D | 184 | −29.383 | −76.279 | 124.334 | 1.00 | 45.82 | C |
| ATOM | 6323 | CD | LYS | D | 184 | −30.721 | −76.916 | 123.925 | 1.00 | 49.11 | C |
| ATOM | 6324 | CE | LYS | D | 184 | −30.567 | −78.342 | 123.414 | 1.00 | 56.53 | C |
| ATOM | 6325 | NZ | LYS | D | 184 | −31.811 | −78.834 | 122.761 | 1.00 | 58.33 | N1+ |
| ATOM | 6326 | N | ALA | D | 185 | −25.599 | −77.019 | 124.172 | 1.00 | 44.49 | N |
| ATOM | 6327 | CA | ALA | D | 185 | −24.835 | −77.822 | 125.116 | 1.00 | 44.16 | C |
| ATOM | 6328 | C | ALA | D | 185 | −23.903 | −76.953 | 125.958 | 1.00 | 46.66 | C |
| ATOM | 6329 | O | ALA | D | 185 | −23.932 | −77.018 | 127.193 | 1.00 | 48.01 | O |
| ATOM | 6330 | CB | ALA | D | 185 | −24.067 | −78.902 | 124.363 | 1.00 | 43.48 | C |
| ATOM | 6331 | N | ASP | D | 186 | −23.057 | −76.142 | 125.307 | 1.00 | 47.56 | N |
| ATOM | 6332 | CA | ASP | D | 186 | −22.203 | −75.208 | 126.042 | 1.00 | 43.67 | C |
| ATOM | 6333 | C | ASP | D | 186 | −23.040 | −74.263 | 126.887 | 1.00 | 41.82 | C |
| ATOM | 6334 | O | ASP | D | 186 | −22.744 | −74.029 | 128.065 | 1.00 | 43.44 | O |
| ATOM | 6335 | CB | ASP | D | 186 | −21.334 | −74.400 | 125.079 | 1.00 | 47.25 | C |
| ATOM | 6336 | CG | ASP | D | 186 | −20.218 | −75.210 | 124.472 | 1.00 | 49.80 | C |
| ATOM | 6337 | OD1 | ASP | D | 186 | −19.524 | −75.925 | 125.218 | 1.00 | 51.32 | O |
| ATOM | 6338 | OD2 | ASP | D | 186 | −20.038 | −75.131 | 123.241 | 1.00 | 59.81 | O1− |
| ATOM | 6339 | N | TYR | D | 187 | −24.100 | −73.713 | 126.296 | 1.00 | 42.10 | N |
| ATOM | 6340 | CA | TYR | D | 187 | −24.958 | −72.799 | 127.030 | 1.00 | 42.00 | C |
| ATOM | 6341 | C | TYR | D | 187 | −25.446 | −73.439 | 128.322 | 1.00 | 40.74 | C |
| ATOM | 6342 | O | TYR | D | 187 | −25.462 | −72.797 | 129.381 | 1.00 | 36.12 | O |
| ATOM | 6343 | CB | TYR | D | 187 | −26.148 | −72.356 | 126.154 | 1.00 | 35.24 | C |
| ATOM | 6344 | CG | TYR | D | 187 | −27.113 | −71.482 | 126.924 | 1.00 | 36.73 | C |
| ATOM | 6345 | CD1 | TYR | D | 187 | −26.712 | −70.236 | 127.403 | 1.00 | 33.83 | C |
| ATOM | 6346 | CD2 | TYR | D | 187 | −28.407 | −71.905 | 127.202 | 1.00 | 37.83 | C |
| ATOM | 6347 | CE1 | TYR | D | 187 | −27.570 | −69.443 | 128.137 | 1.00 | 35.37 | C |
| ATOM | 6348 | CE2 | TYR | D | 187 | −29.278 | −71.112 | 127.932 | 1.00 | 36.87 | C |
| ATOM | 6349 | CZ | TYR | D | 187 | −28.848 | −69.883 | 128.404 | 1.00 | 34.37 | C |
| ATOM | 6350 | OH | TYR | D | 187 | −29.704 | −69.082 | 129.125 | 1.00 | 33.53 | O |
| ATOM | 6351 | N | GLU | D | 188 | −25.818 | −74.715 | 128.266 | 1.00 | 44.28 | N |
| ATOM | 6352 | CA | GLU | D | 188 | −26.463 | −75.311 | 129.426 | 1.00 | 48.57 | C |
| ATOM | 6353 | C | GLU | D | 188 | −25.494 | −75.827 | 130.473 | 1.00 | 44.50 | C |
| ATOM | 6354 | O | GLU | D | 188 | −25.954 | −76.294 | 131.513 | 1.00 | 43.86 | O |
| ATOM | 6355 | CB | GLU | D | 188 | −27.384 | −76.431 | 128.984 | 1.00 | 46.87 | C |
| ATOM | 6356 | CG | GLU | D | 188 | −28.803 | −75.966 | 128.881 | 1.00 | 52.89 | C |
| ATOM | 6357 | CD | GLU | D | 188 | −29.586 | −76.862 | 127.993 | 1.00 | 60.48 | C |
| ATOM | 6358 | OE1 | GLU | D | 188 | −28.963 | −77.811 | 127.472 | 1.00 | 63.90 | O |
| ATOM | 6359 | OE2 | GLU | D | 188 | −30.800 | −76.623 | 127.817 | 1.00 | 70.92 | O1− |
| ATOM | 6360 | N | LYS | D | 189 | −24.184 | −75.709 | 130.249 | 1.00 | 42.41 | N |
| ATOM | 6361 | CA | LYS | D | 189 | −23.166 | −76.082 | 131.214 | 1.00 | 34.10 | C |
| ATOM | 6362 | C | LYS | D | 189 | −22.659 | −74.905 | 132.027 | 1.00 | 41.19 | C |
| ATOM | 6363 | O | LYS | D | 189 | −21.617 | −75.025 | 132.675 | 1.00 | 43.76 | O |
| ATOM | 6364 | CB | LYS | D | 189 | −21.981 | −76.727 | 130.501 | 1.00 | 42.21 | C |
| ATOM | 6365 | CG | LYS | D | 189 | −22.277 | −78.025 | 129.749 | 1.00 | 49.04 | C |
| ATOM | 6366 | CD | LYS | D | 189 | −21.065 | −78.418 | 128.889 | 1.00 | 50.62 | C |
| ATOM | 6367 | CE | LYS | D | 189 | −21.332 | −79.669 | 128.071 | 1.00 | 61.29 | C |
| ATOM | 6368 | NZ | LYS | D | 189 | −20.165 | −79.960 | 127.197 | 1.00 | 67.56 | N1+ |
| ATOM | 6369 | N | HIS | D | 190 | −23.349 | −73.768 | 132.011 | 1.00 | 40.38 | N |
| ATOM | 6370 | CA | HIS | D | 190 | −22.850 | −72.595 | 132.712 | 1.00 | 37.11 | C |
| ATOM | 6371 | C | HIS | D | 190 | −24.018 | −71.833 | 133.309 | 1.00 | 37.04 | C |
| ATOM | 6372 | O | HIS | D | 190 | −25.167 | −72.014 | 132.913 | 1.00 | 39.95 | O |
| ATOM | 6373 | CB | HIS | D | 190 | −22.044 | −71.702 | 131.782 | 1.00 | 41.03 | C |
| ATOM | 6374 | CG | HIS | D | 190 | −20.840 | −72.376 | 131.212 | 1.00 | 41.24 | C |
| ATOM | 6375 | ND1 | HIS | D | 190 | −19.759 | −72.747 | 131.983 | 1.00 | 41.48 | N |
| ATOM | 6376 | CD2 | HIS | D | 190 | −20.560 | −72.778 | 129.951 | 1.00 | 39.46 | C |
| ATOM | 6377 | CE1 | HIS | D | 190 | −18.856 | −73.333 | 131.218 | 1.00 | 36.30 | C |

TABLE 10.4-continued

| ATOM | 6378 | NE2 | HIS | D | 190 | −19.320 | −73.368 | 129.981 | 1.00 | 39.82 | N |
|---|---|---|---|---|---|---|---|---|---|---|---|
| ATOM | 6379 | N | LYS | D | 191 | −23.719 | −70.969 | 134.270 | 1.00 | 34.63 | N |
| ATOM | 6380 | CA | LYS | D | 191 | −24.775 | −70.340 | 135.046 | 1.00 | 45.76 | C |
| ATOM | 6381 | C | LYS | D | 191 | −24.874 | −68.842 | 134.790 | 1.00 | 46.36 | C |
| ATOM | 6382 | O | LYS | D | 191 | −25.944 | −68.357 | 134.407 | 1.00 | 46.07 | O |
| ATOM | 6383 | CB | LYS | D | 191 | −24.566 | −70.607 | 136.548 | 1.00 | 42.22 | C |
| ATOM | 6384 | CG | LYS | D | 191 | −25.568 | −69.875 | 137.451 | 1.00 | 49.74 | C |
| ATOM | 6385 | CD | LYS | D | 191 | −25.227 | −70.029 | 138.954 | 1.00 | 59.90 | C |
| ATOM | 6386 | CE | LYS | D | 191 | −26.350 | −69.510 | 139.853 | 1.00 | 60.67 | C |
| ATOM | 6387 | NZ | LYS | D | 191 | −26.031 | −69.671 | 141.293 | 1.00 | 66.07 | N1+ |
| ATOM | 6388 | N | VAL | D | 192 | −23.782 | −68.100 | 134.968 | 1.00 | 39.06 | N |
| ATOM | 6389 | CA | VAL | D | 192 | −23.809 | −66.644 | 134.941 | 1.00 | 38.75 | C |
| ATOM | 6390 | C | VAL | D | 192 | −23.378 | −66.173 | 133.553 | 1.00 | 39.96 | C |
| ATOM | 6391 | O | VAL | D | 192 | −22.277 | −66.490 | 133.091 | 1.00 | 41.97 | O |
| ATOM | 6392 | CB | VAL | D | 192 | −22.906 | −66.063 | 136.039 | 1.00 | 36.31 | C |
| ATOM | 6393 | CG1 | VAL | D | 192 | −22.876 | −64.544 | 135.989 | 1.00 | 34.38 | C |
| ATOM | 6394 | CG2 | VAL | D | 192 | −23.360 | −66.548 | 137.380 | 1.00 | 41.02 | C |
| ATOM | 6395 | N | TYR | D | 193 | −24.241 | −65.414 | 132.886 | 1.00 | 38.30 | N |
| ATOM | 6396 | CA | TYR | D | 193 | −23.924 | −64.789 | 131.608 | 1.00 | 35.90 | C |
| ATOM | 6397 | C | TYR | D | 193 | −23.862 | −63.290 | 131.845 | 1.00 | 33.90 | C |
| ATOM | 6398 | O | TYR | D | 193 | −24.747 | −62.734 | 132.487 | 1.00 | 36.52 | O |
| ATOM | 6399 | CB | TYR | D | 193 | −24.957 | −65.165 | 130.534 | 1.00 | 31.33 | C |
| ATOM | 6400 | CG | TYR | D | 193 | −24.828 | −66.629 | 130.183 | 1.00 | 35.91 | C |
| ATOM | 6401 | CD1 | TYR | D | 193 | −25.458 | −67.608 | 130.950 | 1.00 | 38.83 | C |
| ATOM | 6402 | CD2 | TYR | D | 193 | −23.971 | −67.049 | 129.171 | 1.00 | 38.88 | C |
| ATOM | 6403 | CE1 | TYR | D | 193 | −25.297 | −68.968 | 130.671 | 1.00 | 36.63 | C |
| ATOM | 6404 | CE2 | TYR | D | 193 | −23.799 | −68.410 | 128.885 | 1.00 | 39.70 | C |
| ATOM | 6405 | CZ | TYR | D | 193 | −24.461 | −69.359 | 129.646 | 1.00 | 36.21 | C |
| ATOM | 6406 | OH | TYR | D | 193 | −24.302 | −70.691 | 129.360 | 1.00 | 37.29 | O |
| ATOM | 6407 | N | ALA | D | 194 | −22.791 | −62.646 | 131.400 | 1.00 | 33.30 | N |
| ATOM | 6408 | CA | ALA | D | 194 | −22.654 | −61.226 | 131.670 | 1.00 | 34.22 | C |
| ATOM | 6409 | C | ALA | D | 194 | −22.000 | −60.510 | 130.488 | 1.00 | 36.04 | C |
| ATOM | 6410 | O | ALA | D | 194 | −21.164 | −61.083 | 129.782 | 1.00 | 35.02 | O |
| ATOM | 6411 | CB | ALA | D | 194 | −21.857 | −61.026 | 132.952 | 1.00 | 29.25 | C |
| ATOM | 6412 | N | CYS | D | 195 | −22.396 | −59.254 | 130.263 | 1.00 | 32.88 | N |
| ATOM | 6413 | CA | CYS | D | 195 | −21.638 | −58.361 | 129.389 | 1.00 | 39.71 | C |
| ATOM | 6414 | C | CYS | D | 195 | −21.246 | −57.121 | 130.170 | 1.00 | 37.39 | C |
| ATOM | 6415 | O | CYS | D | 195 | −22.084 | −56.498 | 130.839 | 1.00 | 33.62 | O |
| ATOM | 6416 | CB | CYS | D | 195 | −22.382 | −57.939 | 128.108 | 1.00 | 39.73 | C |
| ATOM | 6417 | SG | CYS | D | 195 | −23.983 | −57.183 | 128.349 | 1.00 | 55.69 | S |
| ATOM | 6418 | N | GLU | D | 196 | −19.981 | −56.753 | 130.035 | 1.00 | 33.07 | N |
| ATOM | 6419 | CA | GLU | D | 196 | −19.377 | −55.641 | 130.742 | 1.00 | 38.70 | C |
| ATOM | 6420 | C | GLU | D | 196 | −19.127 | −54.523 | 129.734 | 1.00 | 35.02 | C |
| ATOM | 6421 | O | GLU | D | 196 | −18.610 | −54.777 | 128.639 | 1.00 | 28.28 | O |
| ATOM | 6422 | CB | GLU | D | 196 | −18.078 | −56.104 | 131.410 | 1.00 | 35.85 | C |
| ATOM | 6423 | CG | GLU | D | 196 | −17.366 | −55.070 | 132.220 | 1.00 | 39.77 | C |
| ATOM | 6424 | CD | GLU | D | 196 | −15.962 | −55.516 | 132.610 | 1.00 | 46.03 | C |
| ATOM | 6425 | OE1 | GLU | D | 196 | −15.435 | −56.465 | 131.988 | 1.00 | 40.61 | O |
| ATOM | 6426 | OE2 | GLU | D | 196 | −15.373 | −54.880 | 133.511 | 1.00 | 57.77 | O1− |
| ATOM | 6427 | N | VAL | D | 197 | −19.512 | −53.297 | 130.097 | 1.00 | 34.66 | N |
| ATOM | 6428 | CA | VAL | D | 197 | −19.563 | −52.169 | 129.169 | 1.00 | 35.82 | C |
| ATOM | 6429 | C | VAL | D | 197 | −18.595 | −51.112 | 129.680 | 1.00 | 34.18 | C |
| ATOM | 6430 | O | VAL | D | 197 | −18.751 | −50.610 | 130.797 | 1.00 | 35.27 | O |
| ATOM | 6431 | CB | VAL | D | 197 | −20.993 | −51.601 | 129.024 | 1.00 | 31.64 | C |
| ATOM | 6432 | CG1 | VAL | D | 197 | −21.014 | −50.336 | 128.159 | 1.00 | 28.99 | C |
| ATOM | 6433 | CG2 | VAL | D | 197 | −21.944 | −52.640 | 128.462 | 1.00 | 28.78 | C |
| ATOM | 6434 | N | THR | D | 198 | −17.577 | −50.805 | 128.883 | 1.00 | 33.99 | N |
| ATOM | 6435 | CA | THR | D | 198 | −16.654 | −49.718 | 129.164 | 1.00 | 32.70 | C |
| ATOM | 6436 | C | THR | D | 198 | −16.983 | −48.563 | 128.229 | 1.00 | 40.52 | C |
| ATOM | 6437 | O | THR | D | 198 | −17.023 | −48.743 | 127.005 | 1.00 | 37.25 | O |
| ATOM | 6438 | CB | THR | D | 198 | −15.203 | −50.146 | 128.950 | 1.00 | 33.81 | C |
| ATOM | 6439 | OG1 | THR | D | 198 | −14.907 | −51.282 | 129.766 | 1.00 | 43.84 | O |
| ATOM | 6440 | CG2 | THR | D | 198 | −14.282 | −49.029 | 129.347 | 1.00 | 29.60 | C |
| ATOM | 6441 | N | HIS | D | 199 | −17.211 | −47.384 | 128.805 | 1.00 | 37.58 | N |
| ATOM | 6442 | CA | HIS | D | 199 | −17.528 | −46.198 | 128.030 | 1.00 | 31.22 | C |
| ATOM | 6443 | C | HIS | D | 199 | −17.075 | −44.973 | 128.805 | 1.00 | 34.53 | C |
| ATOM | 6444 | O | HIS | D | 199 | −17.002 | −44.999 | 130.033 | 1.00 | 35.60 | O |
| ATOM | 6445 | CB | HIS | D | 199 | −19.020 | −46.115 | 127.723 | 1.00 | 33.40 | C |
| ATOM | 6446 | CG | HIS | D | 199 | −19.383 | −44.969 | 126.828 | 1.00 | 34.76 | C |
| ATOM | 6447 | ND1 | HIS | D | 199 | −19.824 | −43.756 | 127.313 | 1.00 | 30.33 | N |
| ATOM | 6448 | CD2 | HIS | D | 199 | −19.360 | −44.849 | 125.479 | 1.00 | 32.19 | C |
| ATOM | 6449 | CE1 | HIS | D | 199 | −20.061 | −42.940 | 126.301 | 1.00 | 31.06 | C |
| ATOM | 6450 | NE2 | HIS | D | 199 | −19.778 | −43.575 | 125.178 | 1.00 | 31.67 | N |
| ATOM | 6451 | N | GLN | D | 200 | −16.786 | −43.888 | 128.085 | 1.00 | 29.72 | N |
| ATOM | 6452 | CA | GLN | D | 200 | −16.199 | −42.738 | 128.754 | 1.00 | 31.37 | C |
| ATOM | 6453 | C | GLN | D | 200 | −17.177 | −42.022 | 129.684 | 1.00 | 35.36 | C |
| ATOM | 6454 | O | GLN | D | 200 | −16.735 | −41.248 | 130.541 | 1.00 | 42.18 | O |
| ATOM | 6455 | CB | GLN | D | 200 | −15.629 | −41.779 | 127.723 | 1.00 | 33.74 | C |
| ATOM | 6456 | CG | GLN | D | 200 | −16.370 | −40.476 | 127.548 | 1.00 | 35.08 | C |
| ATOM | 6457 | CD | GLN | D | 200 | −15.538 | −39.467 | 126.778 | 1.00 | 39.26 | C |

TABLE 10.4-continued

| | | | | | | | | | | |
|---|---|---|---|---|---|---|---|---|---|---|
| ATOM | 6458 | OE1 | GLN | D | 200 | −15.357 | −38.324 | 127.205 | 1.00 | 44.14 | O |
| ATOM | 6459 | NE2 | GLN | D | 200 | −15.015 | −39.893 | 125.639 | 1.00 | 40.13 | N |
| ATOM | 6460 | N | GLY | D | 201 | −18.482 | −42.261 | 129.550 | 1.00 | 34.51 | N |
| ATOM | 6461 | CA | GLY | D | 201 | −19.496 | −41.749 | 130.451 | 1.00 | 32.88 | C |
| ATOM | 6462 | C | GLY | D | 201 | −19.793 | −42.624 | 131.658 | 1.00 | 34.93 | C |
| ATOM | 6463 | O | GLY | D | 201 | −20.740 | −42.333 | 132.397 | 1.00 | 30.85 | O |
| ATOM | 6464 | N | LEU | D | 202 | −19.050 | −43.719 | 131.838 | 1.00 | 30.30 | N |
| ATOM | 6465 | CA | LEU | D | 202 | −19.137 | −44.588 | 133.007 | 1.00 | 35.37 | C |
| ATOM | 6466 | C | LEU | D | 202 | −17.845 | −44.491 | 133.805 | 1.00 | 41.52 | C |
| ATOM | 6467 | O | LEU | D | 202 | −16.751 | −44.633 | 133.240 | 1.00 | 41.27 | O |
| ATOM | 6468 | CB | LEU | D | 202 | −19.405 | −46.046 | 132.624 | 1.00 | 36.42 | C |
| ATOM | 6469 | CG | LEU | D | 202 | −20.723 | −46.250 | 131.880 | 1.00 | 35.17 | C |
| ATOM | 6470 | CD1 | LEU | D | 202 | −20.916 | −47.704 | 131.503 | 1.00 | 29.43 | C |
| ATOM | 6471 | CD2 | LEU | D | 202 | −21.865 | −45.735 | 132.713 | 1.00 | 29.90 | C |
| ATOM | 6472 | N | SER | D | 203 | −17.973 | −44.219 | 135.113 | 1.00 | 44.01 | N |
| ATOM | 6473 | CA | SER | D | 203 | −16.802 | −44.095 | 135.978 | 1.00 | 39.30 | C |
| ATOM | 6474 | C | SER | D | 203 | −16.068 | −45.416 | 136.165 | 1.00 | 41.65 | C |
| ATOM | 6475 | O | SER | D | 203 | −14.867 | −45.408 | 136.460 | 1.00 | 49.60 | O |
| ATOM | 6476 | CB | SER | D | 203 | −17.213 | −43.537 | 137.323 | 1.00 | 34.65 | C |
| ATOM | 6477 | OG | SER | D | 203 | −18.227 | −44.369 | 137.839 | 1.00 | 55.55 | O |
| ATOM | 6478 | N | SER | D | 204 | −16.749 | −46.545 | 136.003 | 1.00 | 42.27 | N |
| ATOM | 6479 | CA | SER | D | 204 | −16.084 | −47.841 | 135.927 | 1.00 | 45.69 | C |
| ATOM | 6480 | C | SER | D | 204 | −16.989 | −48.788 | 135.149 | 1.00 | 36.06 | C |
| ATOM | 6481 | O | SER | D | 204 | −18.181 | −48.508 | 134.979 | 1.00 | 38.46 | O |
| ATOM | 6482 | CB | SER | D | 204 | −15.755 | −48.401 | 137.332 | 1.00 | 48.88 | C |
| ATOM | 6483 | OG | SER | D | 204 | −16.914 | −48.719 | 138.093 | 1.00 | 47.01 | O |
| ATOM | 6484 | N | PRO | D | 205 | −16.453 | −49.888 | 134.637 | 1.00 | 32.30 | N |
| ATOM | 6485 | CA | PRO | D | 205 | −17.271 | −50.768 | 133.791 | 1.00 | 36.16 | C |
| ATOM | 6486 | C | PRO | D | 205 | −18.534 | −51.253 | 134.498 | 1.00 | 37.49 | C |
| ATOM | 6487 | O | PRO | D | 205 | −18.503 | −51.695 | 135.642 | 1.00 | 46.01 | O |
| ATOM | 6488 | CB | PRO | D | 205 | −16.313 | −51.925 | 133.468 | 1.00 | 34.46 | C |
| ATOM | 6489 | CG | PRO | D | 205 | −14.973 | −51.268 | 133.442 | 1.00 | 33.52 | C |
| ATOM | 6490 | CD | PRO | D | 205 | −15.013 | −50.158 | 134.481 | 1.00 | 32.12 | C |
| ATOM | 6491 | N | VAL | D | 206 | −19.629 | −51.261 | 133.750 | 1.00 | 37.13 | N |
| ATOM | 6492 | CA | VAL | D | 206 | −20.952 | −51.648 | 134.217 | 1.00 | 32.96 | C |
| ATOM | 6493 | C | VAL | D | 206 | −21.270 | −53.027 | 133.650 | 1.00 | 35.67 | C |
| ATOM | 6494 | O | VAL | D | 206 | −21.071 | −53.272 | 132.456 | 1.00 | 33.93 | O |
| ATOM | 6495 | CB | VAL | D | 206 | −21.984 | −50.601 | 133.769 | 1.00 | 30.63 | C |
| ATOM | 6496 | CG1 | VAL | D | 206 | −23.390 | −51.059 | 134.005 | 1.00 | 30.69 | C |
| ATOM | 6497 | CG2 | VAL | D | 206 | −21.703 | −49.316 | 134.479 | 1.00 | 38.52 | C |
| ATOM | 6498 | N | THR | D | 207 | −21.748 | −53.932 | 134.503 | 1.00 | 40.16 | N |
| ATOM | 6499 | CA | THR | D | 207 | −22.093 | −55.285 | 134.087 | 1.00 | 33.00 | C |
| ATOM | 6500 | C | THR | D | 207 | −23.587 | −55.538 | 134.269 | 1.00 | 33.37 | C |
| ATOM | 6501 | O | THR | D | 207 | −24.188 | −55.112 | 135.255 | 1.00 | 34.36 | O |
| ATOM | 6502 | CB | THR | D | 207 | −21.271 | −56.317 | 134.871 | 1.00 | 32.59 | C |
| ATOM | 6503 | OG1 | THR | D | 207 | −19.872 | −56.064 | 134.67 | 1.00 | 35.95 | O |
| ATOM | 6504 | CG2 | THR | D | 207 | −21.585 | −57.744 | 134.412 | 1.00 | 31.54 | C |
| ATOM | 6505 | N | LYS | D | 208 | −24.194 | −56.172 | 133.277 | 1.00 | 38.08 | N |
| ATOM | 6506 | CA | LYS | D | 208 | −25.529 | −56.734 | 133.393 | 1.00 | 33.58 | C |
| ATOM | 6507 | C | LYS | D | 208 | −25.435 | −58.233 | 133.155 | 1.00 | 31.51 | C |
| ATOM | 6508 | O | LYS | D | 208 | −24.797 | −58.679 | 132.202 | 1.00 | 36.26 | O |
| ATOM | 6509 | CB | LYS | D | 208 | −26.510 | −56.072 | 132.395 | 1.00 | 32.49 | C |
| ATOM | 6510 | CG | LYS | D | 208 | −26.633 | −54.559 | 132.573 | 1.00 | 34.11 | C |
| ATOM | 6511 | CD | LYS | D | 208 | −26.879 | −54.180 | 134.030 | 1.00 | 32.10 | C |
| ATOM | 6512 | CE | LYS | D | 208 | −27.135 | −52.694 | 134.212 | 1.00 | 31.43 | C |
| ATOM | 6513 | NZ | LYS | D | 208 | −28.595 | −52.396 | 134.289 | 1.00 | 30.11 | N1+ |
| ATOM | 6514 | N | SER | D | 209 | −26.099 | −59.013 | 133.995 | 1.00 | 40.89 | N |
| ATOM | 6515 | CA | SER | D | 209 | −25.955 | −60.457 | 133.950 | 1.00 | 34.12 | C |
| ATOM | 6516 | C | SER | D | 209 | −27.289 | −61.121 | 134.250 | 1.00 | 35.96 | C |
| ATOM | 6517 | O | SER | D | 209 | −28.265 | −60.469 | 134.620 | 1.00 | 35.44 | O |
| ATOM | 6518 | CB | SER | D | 209 | −24.856 | −60.923 | 134.926 | 1.00 | 34.50 | C |
| ATOM | 6519 | OG | SER | D | 209 | −25.082 | −60.438 | 136.238 | 1.00 | 29.12 | O |
| ATOM | 6520 | N | PHE | D | 210 | −27.333 | −62.431 | 134.025 | 1.00 | 39.78 | N |
| ATOM | 6521 | CA | PHE | D | 210 | −28.424 | −63.272 | 134.488 | 1.00 | 37.92 | C |
| ATOM | 6522 | C | PHE | D | 210 | −27.883 | −64.670 | 134.767 | 1.00 | 42.87 | C |
| ATOM | 6523 | O | PHE | D | 210 | −26.994 | −65.149 | 134.055 | 1.00 | 42.97 | O |
| ATOM | 6524 | CB | PHE | D | 210 | −29.555 | −63.296 | 133.464 | 1.00 | 34.40 | C |
| ATOM | 6525 | CG | PHE | D | 210 | −29.193 | −63.943 | 132.160 | 1.00 | 40.31 | C |
| ATOM | 6526 | CD1 | PHE | D | 210 | −29.365 | −65.304 | 131.973 | 1.00 | 38.92 | C |
| ATOM | 6527 | CD2 | PHE | D | 210 | −28.702 | −63.182 | 131.109 | 1.00 | 37.04 | C |
| ATOM | 6528 | CE1 | PHE | D | 210 | −29.055 | −65.893 | 130.777 | 1.00 | 36.51 | C |
| ATOM | 6529 | CE2 | PHE | D | 210 | −28.393 | −63.765 | 129.913 | 1.00 | 35.57 | C |
| ATOM | 6530 | CZ | PHE | D | 210 | −28.568 | −65.125 | 129.745 | 1.00 | 36.28 | C |
| ATOM | 6531 | N | ASN | D | 211 | −28.433 | −65.331 | 135.796 | 1.00 | 41.98 | N |
| ATOM | 6532 | CA | ASN | D | 211 | −28.093 | −66.720 | 136.076 | 1.00 | 44.07 | C |
| ATOM | 6533 | C | ASN | D | 211 | −29.047 | −67.583 | 135.273 | 1.00 | 45.82 | C |
| ATOM | 6534 | O | ASN | D | 211 | −30.260 | −67.386 | 135.349 | 1.00 | 49.01 | O |
| ATOM | 6535 | CB | ASN | D | 211 | −28.194 | −67.060 | 137.568 | 1.00 | 42.88 | C |
| ATOM | 6536 | CG | ASN | D | 211 | −27.474 | −66.058 | 138.456 | 1.00 | 48.18 | C |
| ATOM | 6537 | OD1 | ASN | D | 211 | −26.529 | −65.407 | 138.034 | 1.00 | 55.66 | O |

TABLE 10.4-continued

| ATOM | 6538 | ND2 | ASN | D | 211 | −27.920 | −65.934 | 139.701 | 1.00 | 53.20 | | N |
|------|------|-----|-----|---|-----|---------|---------|---------|------|-------|---|---|
| ATOM | 6539 | N | ARG | D | 212 | −28.501 | −68.538 | 134.512 | 1.00 | 42.56 | | N |
| ATOM | 6540 | CA | ARG | D | 212 | −29.339 | −69.369 | 133.655 | 1.00 | 44.17 | | C |
| ATOM | 6541 | C | ARG | D | 212 | −30.389 | −70.120 | 134.460 | 1.00 | 52.65 | | C |
| ATOM | 6542 | O | ARG | D | 212 | −30.117 | −70.632 | 135.550 | 1.00 | 57.95 | | O |
| ATOM | 6543 | CB | ARG | D | 212 | −28.497 | −70.365 | 132.870 | 1.00 | 44.08 | | C |
| ATOM | 6544 | CG | ARG | D | 212 | −29.313 | −71.160 | 131.848 | 1.00 | 39.96 | | C |
| ATOM | 6545 | CD | ARG | D | 212 | −28.430 | −72.092 | 131.021 | 1.00 | 41.55 | | C |
| ATOM | 6546 | NE | ARG | D | 212 | −27.681 | −72.968 | 131.906 | 1.00 | 52.14 | | N |
| ATOM | 6547 | CZ | ARG | D | 212 | −28.121 | −74.138 | 132.360 | 1.00 | 52.75 | | C |
| ATOM | 6548 | NH1 | ARG | D | 212 | −29.310 | −74.604 | 131.997 | 1.00 | 55.42 | | N1+ |
| ATOM | 6549 | NH2 | ARG | D | 212 | −27.365 | −74.845 | 133.177 | 1.00 | 50.00 | | N |
| ATOM | 6550 | N | GLY | D | 213 | −31.606 | −70.150 | 133.923 | 1.00 | 55.21 | | N |
| ATOM | 6551 | CA | GLY | D | 213 | −32.710 | −70.874 | 134.521 | 1.00 | 61.80 | | C |
| ATOM | 6552 | C | GLY | D | 213 | −33.365 | −70.219 | 135.716 | 1.00 | 69.36 | | C |
| ATOM | 6553 | O | GLY | D | 213 | −34.221 | −70.844 | 136.350 | 1.00 | 78.60 | | O |
| ATOM | 6554 | N | GLU | D | 214 | −33.041 | −68.971 | 136.017 | 1.00 | 64.22 | | N |
| ATOM | 6555 | CA | GLU | D | 214 | −33.596 | −68.288 | 137.169 | 1.00 | 66.25 | | C |
| ATOM | 6556 | C | GLU | D | 214 | −34.131 | −66.936 | 136.710 | 1.00 | 74.30 | | C |
| ATOM | 6557 | O | GLU | D | 214 | −34.125 | −66.617 | 135.517 | 1.00 | 72.76 | | O |
| ATOM | 6558 | CB | GLU | D | 214 | −32.534 | −68.153 | 138.268 | 1.00 | 68.20 | | C |
| ATOM | 6559 | CG | GLU | D | 214 | −31.925 | −69.500 | 138.684 | 1.00 | 65.48 | | C |
| ATOM | 6560 | CD | GLU | D | 214 | −30.610 | −69.356 | 139.461 | 1.00 | 70.80 | | C |
| ATOM | 6561 | OE1 | GLU | D | 214 | −30.431 | −68.335 | 140.180 | 1.00 | 56.20 | | O |
| ATOM | 6562 | OE2 | GLU | D | 214 | −29.760 | −70.276 | 139.354 | 1.00 | 68.01 | | O1− |
| ATOM | 6563 | N | CYS | D | 215 | −34.599 | −66.138 | 137.668 | 1.00 | 83.83 | | N |
| ATOM | 6564 | CA | CYS | D | 215 | −35.238 | −64.844 | 137.389 | 1.00 | 81.44 | | C |
| ATOM | 6565 | C | CYS | D | 215 | −34.229 | −63.723 | 137.129 | 1.00 | 91.66 | | C |
| ATOM | 6566 | O | CYS | D | 215 | −33.764 | −63.051 | 138.055 | 1.00 | 89.67 | | O |
| ATOM | 6567 | CB | CYS | D | 215 | −36.153 | −64.449 | 138.554 | 1.00 | 37.78 | | C |
| ATOM | 6568 | SG | CYS | D | 215 | −35.402 | −64.679 | 140.202 | 1.00 | 106.03 | | S |
| TER | | | | | | | | | | | | |
| ATOM | 6569 | N | THR | I | 152 | −42.630 | −26.640 | 53.407 | 1.00 | 78.60 | D000 | N |
| ATOM | 6570 | CA | THR | I | 152 | −41.299 | −26.066 | 53.631 | 1.00 | 90.61 | D000 | C |
| ATOM | 6571 | C | THR | I | 152 | −41.155 | −25.369 | 55.096 | 1.00 | 90.48 | D000 | C |
| ATOM | 6572 | O | THR | I | 152 | −40.054 | −25.653 | 55.660 | 1.00 | 85.79 | D000 | O |
| ATOM | 6573 | CB | THR | I | 152 | −41.001 | −24.845 | 52.694 | 1.00 | 84.39 | D000 | C |
| ATOM | 6574 | OG1 | THR | I | 152 | −42.169 | −24.027 | 52.567 | 1.00 | 87.95 | D000 | O |
| ATOM | 6575 | CG2 | THR | I | 152 | −40.569 | −25.297 | 51.311 | 1.00 | 74.94 | D000 | C |
| ATOM | 6576 | N | CYS | I | 153 | −42.275 | −25.254 | 55.707 | 1.00 | 89.21 | D000 | N |
| ATOM | 6577 | CA | CYS | I | 153 | −42.264 | −24.807 | 57.092 | 1.00 | 81.53 | D000 | C |
| ATOM | 6578 | C | CYS | I | 153 | −43.556 | −25.234 | 57.776 | 1.00 | 76.72 | D000 | C |
| ATOM | 6579 | O | CYS | I | 153 | −44.575 | −25.496 | 57.128 | 1.00 | 77.13 | D000 | O |
| ATOM | 6580 | CB | CYS | I | 153 | −42.087 | −23.284 | 57.178 | 1.00 | 79.48 | D000 | C |
| ATOM | 6581 | SG | CYS | I | 153 | −40.357 | −22.736 | 57.167 | 1.00 | 91.46 | D000 | S |
| ATOM | 6582 | N | CYS | I | 154 | −43.494 | −25.316 | 59.112 | 1.00 | 68.58 | D000 | N |
| ATOM | 6583 | CA | CYS | I | 154 | −44.632 | −25.662 | 59.947 | 1.00 | 56.00 | D000 | C |
| ATOM | 6584 | C | CYS | I | 154 | −45.352 | −24.407 | 60.411 | 1.00 | 54.60 | D000 | C |
| ATOM | 6585 | O | CYS | I | 154 | −44.726 | −23.355 | 60.580 | 1.00 | 53.80 | D000 | O |
| ATOM | 6586 | CB | CYS | I | 154 | −44.181 | −26.474 | 61.153 | 1.00 | 48.63 | D000 | C |
| ATOM | 6587 | SG | CYS | I | 154 | −43.645 | −28.112 | 60.680 | 1.00 | 63.81 | D000 | S |
| ATOM | 6588 | N | PRO | I | 155 | −46.667 | −24.480 | 60.621 | 1.00 | 47.88 | D000 | N |
| ATOM | 6589 | CA | PRO | I | 155 | −47.397 | −23.284 | 61.039 | 1.00 | 41.43 | D000 | C |
| ATOM | 6590 | C | PRO | I | 155 | −46.878 | −22.765 | 62.371 | 1.00 | 47.89 | D000 | C |
| ATOM | 6591 | O | PRO | I | 155 | −46.206 | −23.471 | 63.130 | 1.00 | 43.34 | D000 | O |
| ATOM | 6592 | CB | PRO | I | 155 | −48.855 | −23.757 | 61.137 | 1.00 | 38.59 | D000 | C |
| ATOM | 6593 | CG | PRO | I | 155 | −48.818 | −25.245 | 61.066 | 1.00 | 40.42 | D000 | C |
| ATOM | 6594 | CD | PRO | I | 155 | −47.558 | −25.631 | 60.385 | 1.00 | 47.80 | D000 | C |
| ATOM | 6595 | N | VAL | I | 156 | −47.223 | −21.503 | 62.648 | 1.00 | 50.69 | D000 | N |
| ATOM | 6596 | CA | VAL | I | 156 | −46.805 | −20.823 | 63.868 | 1.00 | 49.74 | D000 | C |
| ATOM | 6597 | C | VAL | I | 156 | −47.161 | −21.667 | 65.084 | 1.00 | 50.63 | D000 | C |
| ATOM | 6598 | O | VAL | I | 156 | −48.294 | −22.142 | 65.215 | 1.00 | 49.76 | D000 | O |
| ATOM | 6599 | CB | VAL | I | 156 | −47.471 | −19.435 | 63.931 | 1.00 | 56.06 | D000 | C |
| ATOM | 6600 | CG1 | VAL | I | 156 | −46.956 | −18.628 | 65.112 | 1.00 | 48.56 | D000 | C |
| ATOM | 6601 | CG2 | VAL | I | 156 | −47.275 | −18.685 | 62.605 | 1.00 | 59.05 | D000 | C |
| ATOM | 6602 | N | ASN | I | 157 | −46.178 | −21.872 | 65.968 | 1.00 | 51.11 | D000 | N |
| ATOM | 6603 | CA | ASN | I | 157 | −46.292 | −22.645 | 67.205 | 1.00 | 44.19 | D000 | C |
| ATOM | 6604 | C | ASN | I | 157 | −46.372 | −24.144 | 66.981 | 1.00 | 40.81 | D000 | C |
| ATOM | 6605 | O | ASN | I | 157 | −46.737 | −24.864 | 67.902 | 1.00 | 42.83 | D000 | O |
| ATOM | 6606 | CB | ASN | I | 157 | −47.464 | −22.193 | 68.081 | 1.00 | 45.04 | D000 | C |
| ATOM | 6607 | CG | ASN | I | 157 | −47.278 | −20.791 | 68.601 | 1.00 | 50.02 | D000 | C |
| ATOM | 6608 | OD1 | ASN | I | 157 | −46.197 | −20.437 | 69.063 | 1.00 | 54.69 | D000 | O |
| ATOM | 6609 | ND2 | ASN | I | 157 | −48.315 | −19.979 | 68.513 | 1.00 | 59.66 | D000 | N |
| ATOM | 6610 | N | TRP | I | 158 | −46.085 | −24.633 | 65.778 | 1.00 | 40.56 | D000 | N |
| ATOM | 6611 | CA | TRP | I | 158 | −45.839 | −26.051 | 65.566 | 1.00 | 38.45 | D000 | C |
| ATOM | 6612 | C | TRP | I | 158 | −44.345 | −26.293 | 65.371 | 1.00 | 40.31 | D000 | C |
| ATOM | 6613 | O | TRP | I | 158 | −43.584 | −25.397 | 65.007 | 1.00 | 39.61 | D000 | O |
| ATOM | 6614 | CB | TRP | I | 158 | −46.629 | −26.590 | 64.371 | 1.00 | 40.79 | D000 | C |
| ATOM | 6615 | CG | TRP | I | 158 | −48.118 | −26.566 | 64.574 | 1.00 | 40.96 | D000 | C |
| ATOM | 6616 | CD1 | TRP | I | 158 | −48.892 | −25.473 | 64.883 | 1.00 | 39.11 | D000 | C |

TABLE 10.4-continued

| | | | | | | | | | | |
|---|---|---|---|---|---|---|---|---|---|---|
| ATOM | 6617 | CD2 | TRP | I | 158 | −49.025 | −27.667 | 64.427 | 1.00 | 36.12 | D000 C |
| ATOM | 6618 | NE1 | TRP | I | 158 | −50.213 | −25.840 | 64.971 | 1.00 | 35.50 | D000 N |
| ATOM | 6619 | CE2 | TRP | I | 158 | −50.325 | −27.175 | 64.688 | 1.00 | 32.39 | D000 C |
| ATOM | 6620 | CE3 | TRP | I | 158 | −48.867 | −29.017 | 64.101 | 1.00 | 36.76 | D000 C |
| ATOM | 6621 | CZ2 | TRP | I | 158 | −51.453 | −27.985 | 64.636 | 1.00 | 33.44 | D000 C |
| ATOM | 6622 | CZ3 | TRP | I | 158 | −49.993 | −29.826 | 64.048 | 1.00 | 36.91 | D000 C |
| ATOM | 6623 | CH2 | TRP | I | 158 | −51.271 | −29.308 | 64.321 | 1.00 | 34.08 | D000 C |
| ATOM | 6624 | N | VAL | I | 159 | −43.939 | −27.531 | 65.615 | 1.00 | 42.08 | D000 N |
| ATOM | 6625 | CA | VAL | I | 159 | −42.544 | −27.931 | 65.687 | 1.00 | 36.72 | D000 C |
| ATOM | 6626 | C | VAL | I | 159 | −42.284 | −28.942 | 64.582 | 1.00 | 40.42 | D000 C |
| ATOM | 6627 | O | VAL | I | 159 | −42.934 | −29.992 | 64.529 | 1.00 | 34.21 | D000 O |
| ATOM | 6628 | CB | VAL | I | 159 | −42.222 | −28.551 | 67.060 | 1.00 | 40.12 | D000 C |
| ATOM | 6629 | CG1 | VAL | I | 159 | −40.793 | −29.037 | 67.110 | 1.00 | 39.21 | D000 C |
| ATOM | 6630 | CG2 | VAL | I | 159 | −42.486 | −27.563 | 68.171 | 1.00 | 43.22 | D000 C |
| ATOM | 6631 | N | GLU | I | 160 | −41.300 | −28.660 | 63.739 | 1.00 | 45.25 | D000 N |
| ATOM | 6632 | CA | GLU | I | 160 | −40.975 | −29.588 | 62.671 | 1.00 | 43.30 | D000 C |
| ATOM | 6633 | C | GLU | I | 160 | −40.058 | −30.686 | 63.184 | 1.00 | 41.09 | D000 C |
| ATOM | 6634 | O | GLU | I | 160 | −39.201 | −30.447 | 64.036 | 1.00 | 44.54 | D000 O |
| ATOM | 6635 | CB | GLU | I | 160 | −40.309 | −28.861 | 61.510 | 1.00 | 49.23 | D000 C |
| ATOM | 6636 | CG | GLU | I | 160 | −40.396 | −29.626 | 60.191 | 1.00 | 61.45 | D000 C |
| ATOM | 6637 | CD | GLU | I | 160 | −39.556 | −28.996 | 59.095 | 1.00 | 74.24 | D000 C |
| ATOM | 6638 | OE1 | GLU | I | 160 | −40.073 | −28.128 | 58.350 | 1.00 | 75.44 | D000 O |
| ATOM | 6639 | OE1 | GLU | I | 160 | −38.365 | −29.367 | 58.996 | 1.00 | 82.31 | D000 O1− |
| ATOM | 6640 | N | HIS | I | 161 | −40.262 | −31.899 | 62.675 | 1.00 | 34.25 | D000 N |
| ATOM | 6641 | CA | HIS | I | 161 | −39.358 | −33.005 | 62.927 | 1.00 | 35.38 | D000 C |
| ATOM | 6642 | C | HIS | I | 161 | −39.634 | −34.146 | 61.950 | 1.00 | 44.04 | D000 C |
| ATOM | 6643 | O | HIS | I | 161 | −40.655 | −34.832 | 62.063 | 1.00 | 44.75 | D000 O |
| ATOM | 6644 | CB | HIS | I | 161 | −39.491 | −33.493 | 64.372 | 1.00 | 34.41 | D000 C |
| ATOM | 6645 | CG | HIS | I | 161 | −38.662 | −34.709 | 64.679 | 1.00 | 42.31 | D000 C |
| ATOM | 6646 | CD1 | HIS | I | 161 | −37.356 | −34.632 | 65.127 | 1.00 | 39.49 | D000 N |
| ATOM | 6647 | CD2 | HIS | I | 161 | −38.947 | −36.031 | 64.578 | 1.00 | 37.68 | D000 C |
| ATOM | 6648 | CE1 | HIS | I | 161 | −36.884 | −35.854 | 65.308 | 1.00 | 36.84 | D000 C |
| ATOM | 6649 | NE2 | HIS | I | 161 | −37.823 | −36.720 | 64.970 | 1.00 | 37.93 | D000 N |
| ATOM | 6650 | N | GLU | I | 162 | −38.726 | −34.358 | 60.992 | 1.00 | 48.09 | D000 N |
| ATOM | 6651 | CA | GLU | I | 162 | −38.750 | −35.513 | 60.090 | 1.00 | 42.19 | D000 C |
| ATOM | 6652 | C | GLU | I | 162 | −39.999 | −35.567 | 59.225 | 1.00 | 46.13 | D000 C |
| ATOM | 6653 | O | GLU | I | 162 | −40.676 | −36.597 | 59.149 | 1.00 | 46.71 | D000 O |
| ATOM | 6654 | CB | GLU | I | 162 | −38.576 | −36.822 | 60.852 | 1.00 | 38.57 | D000 C |
| ATOM | 6655 | CG | GLU | I | 162 | −37.232 | −36.891 | 61.474 | 1.00 | 49.45 | D000 C |
| ATOM | 6656 | CD | GLU | I | 162 | −36.178 | −37.369 | 60.479 | 1.00 | 67.10 | D000 C |
| ATOM | 6657 | OE1 | GLU | I | 162 | −36.210 | −38.565 | 60.098 | 1.00 | 74.81 | D000 O |
| ATOM | 6658 | OE2 | GLU | I | 162 | −35.341 | −36.533 | 60.050 | 1.00 | 59.37 | D000 O1− |
| ATOM | 6659 | N | ARG | I | 163 | −40.289 | −34.453 | 58.547 | 1.00 | 48.14 | D000 N |
| ATOM | 6660 | CA | ARG | I | 163 | −41.446 | −34.362 | 57.648 | 1.00 | 57.33 | D000 C |
| ATOM | 6661 | C | ARG | I | 163 | −42.768 | −34.545 | 58.387 | 1.00 | 53.34 | D000 C |
| ATOM | 6662 | O | ARG | I | 163 | −43.712 | −35.129 | 57.854 | 1.00 | 56.97 | D000 O |
| ATOM | 6663 | CB | ARG | I | 163 | −41.335 | −35.388 | 56.509 | 1.00 | 65.00 | D000 C |
| ATOM | 6664 | CG | ARG | I | 163 | −40.188 | −35.176 | 55.528 | 1.00 | 68.66 | D000 C |
| ATOM | 6665 | CD | ARG | I | 163 | −40.271 | −36.202 | 54.398 | 1.00 | 80.19 | D000 C |
| ATOM | 6666 | NE | ARG | I | 163 | −41.472 | −36.074 | 53.577 | 1.00 | 89.56 | D000 N |
| ATOM | 6667 | CZ | ARG | I | 163 | −41.971 | −37.066 | 52.841 | 1.00 | 92.42 | D000 C |
| ATOM | 6668 | NH1 | ARG | I | 163 | −43.077 | −36.881 | 52.123 | 1.00 | 78.10 | D000 N1+ |
| ATOM | 6669 | NH2 | ARG | I | 163 | −41.362 | −38.249 | 52.832 | 1.00 | 94.56 | D000 N |
| ATOM | 6670 | N | SER | I | 164 | −42.822 | −34.104 | 59.641 | 1.00 | 53.57 | D000 N |
| ATOM | 6671 | CA | SER | I | 164 | −44.059 | −33.988 | 60.400 | 1.00 | 46.49 | D000 C |
| ATOM | 6672 | C | SER | I | 164 | −44.026 | −32.697 | 61.203 | 1.00 | 51.04 | D000 C |
| ATOM | 6673 | O | SER | I | 164 | −42.965 | −32.279 | 61.679 | 1.00 | 50.06 | D000 O |
| ATOM | 6674 | CB | SER | I | 164 | −44.270 | −35.170 | 61.343 | 1.00 | 43.89 | D000 C |
| ATOM | 6675 | OG | SER | I | 164 | −44.907 | −36.249 | 60.692 | 1.00 | 50.01 | D000 O |
| ATOM | 6676 | N | CYS | I | 165 | −45.194 | −32.075 | 61.357 | 1.00 | 50.05 | D000 N |
| ATOM | 6677 | CA | CYS | I | 165 | −45.370 | −30.919 | 62.233 | 1.00 | 47.87 | D000 C |
| ATOM | 6678 | C | CYS | I | 165 | −46.135 | −31.340 | 63.489 | 1.00 | 43.11 | D000 C |
| ATOM | 6679 | O | CYS | I | 165 | −47.190 | −31.975 | 63.399 | 1.00 | 42.93 | D000 O |
| ATOM | 6680 | CB | CYS | I | 165 | −46.116 | −29.778 | 61.524 | 1.00 | 50.43 | D000 C |
| ATOM | 6681 | SG | CYS | I | 165 | −45.326 | −29.058 | 60.031 | 1.00 | 58.62 | D000 S |
| ATOM | 6682 | N | TYR | I | 166 | −45.622 | −30.957 | 64.656 | 1.00 | 43.41 | D000 N |
| ATOM | 6683 | CA | TYR | I | 166 | −46.198 | −31.350 | 65.934 | 1.00 | 35.17 | D000 C |
| ATOM | 6684 | C | TYR | I | 166 | −46.617 | −30.116 | 66.719 | 1.00 | 36.72 | D000 C |
| ATOM | 6685 | O | TYR | I | 166 | −45.937 | −29.084 | 66.683 | 1.00 | 35.81 | D000 O |
| ATOM | 6686 | CB | TYR | I | 166 | −45.214 | −32.158 | 66.761 | 1.00 | 28.42 | D000 C |
| ATOM | 6687 | CG | TYR | I | 166 | −44.766 | −33.439 | 66.120 | 1.00 | 35.36 | D000 C |
| ATOM | 6688 | CD1 | TYR | I | 166 | −43.703 | −33.461 | 65.194 | 1.00 | 40.74 | D000 C |
| ATOM | 6689 | CD2 | TYR | I | 166 | −45.379 | −34.629 | 66.435 | 1.00 | 28.15 | D000 C |
| ATOM | 6690 | CE1 | TYR | I | 166 | −43.280 | −34.646 | 64.614 | 1.00 | 31.55 | D000 C |
| ATOM | 6691 | CE2 | TYR | I | 166 | −44.966 | −35.813 | 65.864 | 1.00 | 35.33 | D000 C |
| ATOM | 6692 | CZ | TYR | I | 166 | −43.926 | −35.818 | 64.952 | 1.00 | 36.07 | D000 C |
| ATOM | 6693 | OH | TYR | I | 166 | −43.557 | −37.022 | 64.406 | 1.00 | 37.06 | D000 O |
| ATOM | 6694 | N | TRP | I | 167 | −47.735 | −30.235 | 67.438 | 1.00 | 33.78 | D000 N |
| ATOM | 6695 | CA | TRP | I | 167 | −48.213 | −29.191 | 68.335 | 1.00 | 33.91 | D000 C |
| ATOM | 6696 | C | TRP | I | 167 | −48.485 | −29.823 | 69.692 | 1.00 | 33.58 | D000 C |

TABLE 10.4-continued

| | | | | | | | | | | |
|---|---|---|---|---|---|---|---|---|---|---|
| ATOM | 6697 | O | TRP | I | 167 | −49.169 | −30.848 | 69.776 | 1.00 | 37.11 | D000 | O |
| ATOM | 6698 | CB | TRP | I | 167 | −49.478 | −28.509 | 67.776 | 1.00 | 37.58 | D000 | C |
| ATOM | 6699 | CG | TRP | I | 167 | −50.029 | −27.432 | 68.678 | 1.00 | 36.19 | D000 | C |
| ATOM | 6700 | CD1 | TRP | I | 167 | −49.648 | −26.122 | 68.725 | 1.00 | 37.64 | D000 | C |
| ATOM | 6701 | CD2 | TRP | I | 167 | −51.064 | −27.580 | 69.657 | 1.00 | 33.12 | D000 | C |
| ATOM | 6702 | NE1 | TRP | I | 167 | −50.365 | −25.452 | 69.692 | 1.00 | 32.45 | D000 | N |
| ATOM | 6703 | CE2 | TRP | I | 167 | −51.246 | −26.325 | 70.269 | 1.00 | 31.52 | D000 | C |
| ATOM | 6704 | CE3 | TRP | I | 167 | −51.846 | −28.659 | 70.083 | 1.00 | 35.72 | D000 | C |
| ATOM | 6705 | CZ2 | TRP | I | 167 | −52.183 | −26.116 | 71.277 | 1.00 | 34.14 | D000 | C |
| ATOM | 6706 | CZ3 | TRP | I | 167 | −52.782 | −28.447 | 71.087 | 1.00 | 32.27 | D000 | C |
| ATOM | 6707 | CH2 | TRP | I | 167 | −52.941 | −27.185 | 71.669 | 1.00 | 31.51 | D000 | C |
| ATOM | 6708 | N | PHE | I | 168 | −47.934 | −29.223 | 70.748 | 1.00 | 35.27 | D000 | N |
| ATOM | 6709 | CA | PHE | I | 168 | −47.963 | −29.784 | 72.101 | 1.00 | 31.67 | D000 | C |
| ATOM | 6710 | C | PHE | I | 168 | −48.837 | −28.898 | 72.975 | 1.00 | 31.00 | D000 | C |
| ATOM | 6711 | O | PHE | I | 168 | −48.468 | −27.757 | 73.263 | 1.00 | 28.23 | D000 | O |
| ATOM | 6712 | CB | PHE | I | 168 | −46.555 | −29.881 | 72.685 | 1.00 | 28.79 | D000 | C |
| ATOM | 6713 | CG | PHE | I | 168 | −45.609 | −30.707 | 71.860 | 1.00 | 29.81 | D000 | C |
| ATOM | 6714 | CD1 | PHE | I | 168 | −45.461 | −32.067 | 72.099 | 1.00 | 30.76 | D000 | C |
| ATOM | 6715 | CD2 | PHE | I | 168 | −44.881 | −30.129 | 70.836 | 1.00 | 27.05 | D000 | C |
| ATOM | 6716 | CE1 | PHE | I | 168 | −44.587 | −32.824 | 71.329 | 1.00 | 29.28 | D000 | C |
| ATOM | 6717 | CE2 | PHE | I | 168 | −44.009 | −30.878 | 70.073 | 1.00 | 27.44 | D000 | C |
| ATOM | 6718 | CZ | PHE | I | 168 | −43.869 | −32.224 | 70.310 | 1.00 | 26.73 | D000 | C |
| ATOM | 6719 | N | SER | I | 169 | −49.963 | −29.437 | 73.440 | 1.00 | 31.45 | D000 | N |
| ATOM | 6720 | CA | SER | I | 169 | −50.883 | −28.643 | 74.245 | 1.00 | 31.26 | D000 | C |
| ATOM | 6721 | C | SER | I | 169 | −50.266 | −28.259 | 75.591 | 1.00 | 25.88 | D000 | C |
| ATOM | 6722 | O | SER | I | 169 | −49.376 | −28.932 | 76.115 | 1.00 | 23.51 | D000 | O |
| ATOM | 6723 | CB | SER | I | 169 | −52.201 | −29.404 | 74.471 | 1.00 | 30.30 | D000 | C |
| ATOM | 6724 | OG | SER | I | 169 | −52.074 | −30.442 | 75.438 | 1.00 | 28.82 | D000 | O |
| ATOM | 6725 | N | ARG | I | 170 | −50.734 | −27.135 | 76.129 | 1.00 | 27.95 | D000 | N |
| ATOM | 6726 | CA | ARG | I | 170 | −50.447 | −26.722 | 77.495 | 1.00 | 34.22 | D000 | C |
| ATOM | 6727 | C | ARG | I | 170 | −51.671 | −26.846 | 78.392 | 1.00 | 33.58 | D000 | C |
| ATOM | 6728 | O | ARG | I | 170 | −51.627 | −26.414 | 79.546 | 1.00 | 31.86 | D000 | O |
| ATOM | 6729 | CB | ARG | I | 170 | −49.944 | −25.282 | 77.529 | 1.00 | 25.51 | D000 | C |
| ATOM | 6730 | CG | ARG | I | 170 | −48.455 | −25.122 | 77.693 | 1.00 | 33.77 | D000 | C |
| ATOM | 6731 | CD | ARG | I | 170 | −48.071 | −25.130 | 79.130 | 1.00 | 32.63 | D000 | C |
| ATOM | 6732 | NE | ARG | I | 170 | −47.020 | −26.113 | 79.328 | 1.00 | 38.28 | D000 | N |
| ATOM | 6733 | CZ | ARG | I | 170 | −46.005 | −25.992 | 80.166 | 1.00 | 33.99 | D000 | C |
| ATOM | 6734 | NH1 | ARG | I | 170 | −45.904 | −24.932 | 80.960 | 1.00 | 29.65 | D000 | N1+ |
| ATOM | 6735 | NH2 | ARG | I | 170 | −45.123 | −26.986 | 80.241 | 1.00 | 33.21 | D000 | N |
| ATOM | 6736 | N | SER | I | 171 | −52.760 | −27.420 | 77.888 | 1.00 | 27.31 | D000 | N |
| ATOM | 6737 | CA | SER | I | 171 | −53.943 | −27.684 | 78.682 | 1.00 | 24.95 | D000 | C |
| ATOM | 6738 | C | SER | I | 171 | −54.303 | −29.138 | 78.489 | 1.00 | 29.34 | D000 | C |
| ATOM | 6739 | O | SER | I | 171 | −53.693 | −29.847 | 77.682 | 1.00 | 31.49 | D000 | O |
| ATOM | 6740 | CB | SER | I | 171 | −55.119 | −26.815 | 78.277 | 1.00 | 21.97 | D000 | C |
| ATOM | 6741 | OG | SER | I | 171 | −55.427 | −27.085 | 76.932 | 1.00 | 35.69 | D000 | O |
| ATOM | 6742 | N | GLY | I | 172 | −55.301 | −29.577 | 79.252 | 1.00 | 29.63 | D000 | N |
| ATOM | 6743 | CA | GLY | I | 172 | −55.700 | −30.970 | 79.280 | 1.00 | 24.44 | D000 | C |
| ATOM | 6744 | C | GLY | I | 172 | −57.075 | −31.181 | 78.703 | 1.00 | 25.61 | D000 | C |
| ATOM | 6745 | O | GLY | I | 172 | −57.864 | −30.245 | 78.637 | 1.00 | 27.53 | D000 | O |
| ATOM | 6746 | N | LYS | I | 173 | −57.363 | −32.400 | 78.273 | 1.00 | 25.19 | D000 | N |
| ATOM | 6747 | CA | LYS | I | 173 | −58.629 | −32.726 | 77.650 | 1.00 | 27.09 | D000 | C |
| ATOM | 6748 | C | LYS | I | 173 | −58.823 | −34.231 | 77.752 | 1.00 | 33.35 | D000 | C |
| ATOM | 6749 | O | LYS | I | 173 | −57.854 | −34.995 | 77.672 | 1.00 | 29.52 | D000 | O |
| ATOM | 6750 | CB | LYS | I | 173 | −58.693 | −32.295 | 76.172 | 1.00 | 27.91 | D000 | C |
| ATOM | 6751 | CG | LYS | I | 173 | −58.975 | −30.805 | 75.865 | 1.00 | 25.52 | D000 | C |
| ATOM | 6752 | CD | LYS | I | 173 | −59.510 | −30.671 | 74.410 | 1.00 | 26.32 | D000 | C |
| ATOM | 6753 | CE | LYS | I | 173 | −59.494 | −29.257 | 73.861 | 1.00 | 19.84 | D000 | C |
| ATOM | 6754 | NZ | LYS | I | 173 | −60.449 | −28.327 | 74.536 | 1.00 | 27.70 | D000 | N1+ |
| ATOM | 6755 | N | ALA | I | 174 | −60.076 | −34.643 | 77.956 | 1.00 | 29.60 | D000 | N |
| ATOM | 6756 | CA | ALA | I | 174 | −60.433 | −36.038 | 77.791 | 1.00 | 32.67 | D000 | C |
| ATOM | 6757 | C | ALA | I | 174 | −60.003 | −36.509 | 76.401 | 1.00 | 33.60 | D000 | C |
| ATOM | 6758 | O | ALA | I | 174 | −59.996 | −35.730 | 75.441 | 1.00 | 31.75 | D000 | O |
| ATOM | 6759 | CB | ALA | I | 174 | −61.943 | −36.202 | 77.997 | 1.00 | 28.75 | D000 | C |
| ATOM | 6760 | N | TRP | I | 175 | −59.641 | −37.796 | 76.289 | 1.00 | 30.30 | D000 | N |
| ATOM | 6761 | CA | TRP | I | 175 | −59.069 | −38.288 | 75.033 | 1.00 | 32.92 | D000 | C |
| ATOM | 6762 | C | TRP | I | 175 | −59.946 | −37.956 | 73.824 | 1.00 | 35.10 | D000 | C |
| ATOM | 6763 | O | TRP | I | 175 | −59.441 | −37.507 | 72.790 | 1.00 | 38.08 | D000 | O |
| ATOM | 6764 | CB | TRP | I | 175 | −58.822 | −39.795 | 75.102 | 1.00 | 33.10 | D000 | C |
| ATOM | 6765 | CG | TRP | I | 175 | −58.056 | −40.337 | 73.893 | 1.00 | 38.61 | D000 | C |
| ATOM | 6766 | CD1 | TRP | I | 175 | −56.729 | −40.615 | 73.835 | 1.00 | 38.20 | D000 | C |
| ATOM | 6767 | CD2 | TRP | I | 175 | −58.584 | −40.653 | 72.579 | 1.00 | 43.49 | D000 | C |
| ATOM | 6768 | NE1 | TRP | I | 175 | −56.388 | −41.079 | 72.580 | 1.00 | 35.04 | D000 | N |
| ATOM | 6769 | CE2 | TRP | I | 175 | −57.505 | −41.113 | 71.793 | 1.00 | 38.92 | D000 | C |
| ATOM | 6770 | CE3 | TRP | I | 175 | −59.863 | −40.593 | 71.996 | 1.00 | 43.77 | D000 | C |
| ATOM | 6771 | CZ2 | TRP | I | 175 | −57.662 | −41.517 | 70.456 | 1.00 | 44.27 | D000 | C |
| ATOM | 6772 | CZ3 | TRP | I | 175 | −60.016 | −40.989 | 70.650 | 1.00 | 43.79 | D000 | C |
| ATOM | 6773 | CH2 | TRP | I | 175 | −58.925 | −41.448 | 69.906 | 1.00 | 44.29 | D000 | C |
| ATOM | 6774 | N | ALA | I | 176 | −61.260 | −38.156 | 73.936 | 1.00 | 33.82 | D000 | N |
| ATOM | 6775 | CA | ALA | I | 176 | −62.154 | −37.894 | 72.815 | 1.00 | 28.11 | D000 | C |
| ATOM | 6776 | C | ALA | I | 176 | −62.108 | −36.432 | 72.394 | 1.00 | 37.58 | D000 | C |

TABLE 10.4-continued

| ATOM | 6777 | O | ALA | I | 176 | −62.150 | −36.111 | 71.196 | 1.00 | 36.74 | D000 | O |
|---|---|---|---|---|---|---|---|---|---|---|---|---|
| ATOM | 6778 | CB | ALA | I | 176 | −63.578 | −38.275 | 73.199 | 1.00 | 27.93 | D000 | C |
| ATOM | 6779 | N | ASP | I | 177 | −92.043 | −35.528 | 73.370 | 1.00 | 35.00 | D000 | N |
| ATOM | 6780 | CA | ASP | I | 177 | −62.036 | −34.117 | 73.044 | 1.00 | 32.37 | D000 | C |
| ATOM | 6781 | C | ASP | I | 177 | −60.712 | −33.703 | 72.435 | 1.00 | 34.46 | D000 | C |
| ATOM | 6782 | O | ASP | I | 177 | −60.672 | −32.790 | 71.591 | 1.00 | 33.36 | D000 | O |
| ATOM | 6783 | CB | ASP | I | 177 | −62.355 | −33.298 | 74.290 | 1.00 | 36.16 | D000 | C |
| ATOM | 6784 | CG | ASP | I | 177 | −63.729 | −33.623 | 74.876 | 1.00 | 40.76 | D000 | C |
| ATOM | 6785 | OD1 | ASP | I | 177 | −64.648 | −33.982 | 74.097 | 1.00 | 35..33 | D000 | O |
| ATOM | 6786 | OD2 | ASP | I | 177 | −63.888 | −33.508 | 76.122 | 1.00 | 42.92 | D000 | O1− |
| ATOM | 6787 | N | ALA | I | 178 | −59.622 | −34.340 | 72.869 | 1.00 | 33.13 | D000 | N |
| ATOM | 6788 | CA | ALA | I | 178 | −58.325 | −34.082 | 72.255 | 1.00 | 34.80 | D000 | C |
| ATOM | 6789 | C | ALA | I | 178 | −58.313 | −34.585 | 70.812 | 1.00 | 35.86 | D000 | C |
| ATOM | 6790 | O | ALA | I | 178 | −57.887 | −33.873 | 69.898 | 1.00 | 30.16 | D000 | O |
| ATOM | 6791 | CB | ALA | I | 178 | −57.224 | −34.734 | 73.085 | 1.00 | 29.11 | D000 | C |
| ATOM | 6792 | N | ASP | I | 179 | −58.825 | −35.803 | 70.601 | 1.00 | 38.39 | D000 | N |
| ATOM | 6793 | CA | ASP | I | 179 | −59.085 | −36.343 | 69.268 | 1.00 | 35.65 | D000 | C |
| ATOM | 6794 | C | ASP | I | 179 | −59.826 | −35.347 | 68.401 | 1.00 | 37.02 | D000 | C |
| ATOM | 6795 | O | ASP | I | 179 | −59.397 | −35.030 | 67.286 | 1.00 | 39.99 | D000 | O |
| ATOM | 6796 | CB | ASP | I | 179 | −59.886 | −37.642 | 69.413 | 1.00 | 41.79 | D000 | C |
| ATOM | 6797 | CG | ASP | I | 179 | −60.149 | −38.338 | 68.094 | 1.00 | 42.90 | D000 | C |
| ATOM | 6798 | OD1 | ASP | I | 179 | −59.371 | −38.120 | 67.149 | 1.00 | 43.83 | D000 | O |
| ATOM | 6799 | OD2 | ASP | I | 179 | −61.096 | −39.163 | 68.035 | 1.00 | 43.02 | D000 | O1− |
| ATOM | 6800 | N | ASN | I | 180 | −60.934 | −34.820 | 68.911 | 1.00 | 39.12 | D000 | N |
| ATOM | 6801 | CA | ASN | I | 180 | −61.715 | −33.882 | 68.117 | 1.00 | 39.76 | D000 | C |
| ATOM | 6802 | C | ASN | I | 180 | −60.945 | −32.601 | 67.851 | 1.00 | 32.43 | D000 | C |
| ATOM | 6803 | O | ASN | I | 180 | −61.062 | −32.026 | 66.768 | 1.00 | 38.63 | D000 | O |
| ATOM | 6804 | CB | ASN | I | 180 | −63.053 | −33.580 | 68.801 | 1.00 | 34.44 | D000 | C |
| ATOM | 6805 | CG | ASN | I | 180 | −63.983 | −34.773 | 68.793 | 1.00 | 38.43 | D000 | C |
| ATOM | 6806 | OD1 | ASN | I | 180 | −63.692 | −35.795 | 68.162 | 1.00 | 43.96 | D000 | O |
| ATOM | 6807 | ND2 | ASN | I | 180 | −65.126 | −34.642 | 69.458 | 1.00 | 38.70 | D000 | N |
| ATOM | 6808 | N | TYR | I | 181 | −60.142 | −32.144 | 68.814 | 1.00 | 37.95 | D000 | N |
| ATOM | 6809 | CA | TYR | I | 181 | −59.388 | −30.900 | 68.623 | 1.00 | 36.10 | D000 | C |
| ATOM | 6810 | C | TYR | I | 181 | −58.390 | −31.012 | 67.470 | 1.00 | 36.90 | D000 | C |
| ATOM | 6811 | O | TYR | I | 181 | −58.240 | −30.077 | 66.667 | 1.00 | 35.28 | D000 | O |
| ATOM | 6812 | CB | TYR | I | 181 | −58.660 | −30.519 | 69.908 | 1.00 | 25.56 | D000 | C |
| ATOM | 6813 | CG | TYR | I | 181 | −57.826 | −29.264 | 69.780 | 1.00 | 28.66 | D000 | C |
| ATOM | 6814 | CD1 | TYR | I | 181 | −56.520 | −29.301 | 69.277 | 1.00 | 31.67 | D000 | C |
| ATOM | 6815 | CD2 | TYR | I | 181 | −58.336 | −28.043 | 70.162 | 1.00 | 25.48 | D000 | C |
| ATOM | 6816 | CE1 | TYR | I | 181 | −55.768 | −28.154 | 69.148 | 1.00 | 29.47 | D000 | C |
| ATOM | 6817 | CE2 | TYR | I | 181 | −57.579 | −26.897 | 70.054 | 1.00 | 29.61 | D000 | C |
| ATOM | 6818 | CZ | TYR | I | 181 | −56.299 | −26.952 | 69.546 | 1.00 | 33.58 | D000 | C |
| ATOM | 6819 | OH | TYR | I | 181 | −55.570 | −25.786 | 69.431 | 1.00 | 36.52 | D000 | O |
| ATOM | 6820 | N | CYS | I | 182 | −57.668 | −32.125 | 67.395 | 1.00 | 30.45 | D000 | N |
| ATOM | 6821 | CA | CYS | I | 182 | −56.669 | −32.250 | 66.346 | 1.00 | 39.92 | D000 | C |
| ATOM | 6822 | C | CYS | I | 182 | −57.323 | −32.304 | 64.964 | 1.00 | 42.48 | D000 | C |
| ATOM | 6823 | O | CYS | I | 182 | −56.879 | −31.607 | 64.034 | 1.00 | 37.23 | D000 | O |
| ATOM | 6824 | CB | CYS | I | 182 | −55.793 | −33.477 | 66.614 | 1.00 | 37.71 | D000 | C |
| ATOM | 6825 | SG | CYS | I | 182 | −54.685 | −33.283 | 68.064 | 1.00 | 42.44 | D000 | S |
| ATOM | 6826 | N | ARG | I | 183 | −58.413 | −33.073 | 64.832 | 1.00 | 33.83 | D000 | N |
| ATOM | 6827 | CA | ARG | I | 183 | −59.071 | −33.213 | 63.538 | 1.00 | 34.20 | D000 | C |
| ATOM | 6828 | C | ARG | I | 183 | −59.478 | −31.860 | 62.965 | 1.00 | 40.37 | D000 | C |
| ATOM | 6829 | O | ARG | I | 183 | −59.310 | −31.617 | 61.764 | 1.00 | 43.30 | D000 | O |
| ATOM | 6830 | CB | ARG | I | 183 | −60.275 | −34.128 | 63.670 | 1.00 | 36.10 | D000 | C |
| ATOM | 6831 | CG | ARG | I | 183 | −59.902 | −35.562 | 63.991 | 1.00 | 34.06 | D000 | C |
| ATOM | 6832 | CD | ARG | I | 183 | −61.081 | −36.236 | 64.587 | 1.00 | 39.52 | D000 | C |
| ATOM | 6833 | NE | ARG | I | 183 | −61.350 | −37.531 | 63.997 | 1.00 | 57.45 | D000 | N |
| ATOM | 6834 | CZ | ARG | I | 183 | −62.574 | −37.960 | 63.698 | 1.00 | 68.60 | D000 | C |
| ATOM | 6835 | NH1 | ARG | I | 183 | −63.619 | −37.172 | 63.920 | 1.00 | 55.03 | D000 | N1+ |
| ATOM | 6836 | NH2 | ARG | I | 183 | −62.754 | −39.165 | 63.159 | 1.00 | 76.79 | D000 | N |
| ATOM | 6837 | N | LEU | I | 184 | −59.980 | −30.952 | 63.805 | 1.00 | 34.08 | D000 | N |
| ATOM | 6838 | CA | LEU | I | 184 | −60.347 | −29.625 | 63.319 | 1.00 | 36.10 | D000 | C |
| ATOM | 6839 | C | LEU | I | 184 | −59.159 | −28.729 | 62.998 | 1.00 | 40.84 | D000 | C |
| ATOM | 6840 | O | LEU | I | 184 | −59.369 | −27.647 | 62.436 | 1.00 | 43.24 | D000 | O |
| ATOM | 6841 | CB | LEU | I | 184 | −61.207 | −28.901 | 64.344 | 1.00 | 42.44 | D000 | C |
| ATOM | 6842 | CG | LEU | I | 184 | −62.705 | −29.142 | 64.369 | 1.00 | 44.30 | D000 | C |
| ATOM | 6843 | CD1 | LEU | I | 184 | −62.982 | −30.550 | 64.684 | 1.00 | 40.77 | D000 | C |
| ATOM | 6844 | CD2 | LEU | I | 184 | −63.246 | −28.314 | 65.458 | 1.00 | 44.72 | D000 | C |
| ATOM | 6845 | N | GLU | I | 185 | −57.938 | −29.126 | 63.359 | 1.00 | 44.61 | D000 | N |
| ATOM | 6846 | CA | GLU | I | 185 | −56.714 | −28.453 | 62.938 | 1.00 | 42.87 | D000 | C |
| ATOM | 6847 | C | GLU | I | 185 | −56.132 | −29.068 | 61.664 | 1.00 | 45.96 | D000 | C |
| ATOM | 6848 | O | GLU | I | 185 | −55.000 | −28.744 | 61.284 | 1.00 | 41.44 | D000 | O |
| ATOM | 6849 | CB | GLU | I | 185 | −55.678 | −28.517 | 64.061 | 1.00 | 38.65 | D000 | C |
| ATOM | 6850 | CG | GLU | I | 185 | −56.035 | −27.729 | 65.294 | 1.00 | 42.71 | D000 | C |
| ATOM | 6851 | CD | GLU | I | 185 | −55.905 | −26.233 | 65.117 | 1.00 | 45.41 | D000 | C |
| ATOM | 6852 | OE1 | GLU | I | 185 | −54.995 | −25.799 | 64.379 | 1.00 | 49.20 | D000 | O |
| ATOM | 6853 | OE2 | GLU | I | 185 | −56.701 | −25.489 | 65.737 | 1.00 | 47.94 | D000 | O1− |
| ATOM | 6854 | N | ASP | I | 186 | −56.902 | −29.923 | 60.992 | 1.00 | 46.15 | D000 | N |
| ATOM | 6855 | CA | ASP | I | 186 | −56.421 | −30.765 | 59.904 | 1.00 | 46.32 | D000 | C |
| ATOM | 6856 | C | ASP | I | 186 | −55.202 | −31.570 | 60.344 | 1.00 | 45.43 | D000 | C |

TABLE 10.4-continued

| ATOM | 6857 | O   | ASP | I | 186 | −54.175 | −31.625 | 59.670 | 1.00 | 47.14 | D000 | O   |
|------|------|-----|-----|---|-----|---------|---------|--------|------|-------|------|-----|
| ATOM | 6858 | CB  | ASP | I | 186 | −56.136 | −29.951 | 58.642 | 1.00 | 54.37 | D000 | C   |
| ATOM | 6859 | CG  | ASP | I | 186 | −56.259 | −30.795 | 57.35  | 1.00 | 66.46 | D000 | C   |
| ATOM | 6860 | OD1 | ASP | I | 186 | −56.408 | −32.045 | 57.464 | 1.00 | 61.88 | D000 | O   |
| ATOM | 6861 | OD2 | ASP | I | 186 | −56.193 | −30.206 | 56.242 | 1.00 | 69.65 | D000 | O1− |
| ATOM | 6862 | N   | ALA | I | 187 | −55.318 | −32.197 | 61.505 | 1.00 | 42.36 | D000 | N   |
| ATOM | 6863 | CA  | ALA | I | 187 | −54.205 | −32.950 | 62.052 | 1.00 | 35.32 | D000 | C   |
| ATOM | 6864 | C   | ALA | I | 187 | −54.783 | −34.150 | 62.787 | 1.00 | 33.26 | D000 | C   |
| ATOM | 6865 | O   | ALA | I | 187 | −55.966 | −34.465 | 62.668 | 1.00 | 37.96 | D000 | O   |
| ATOM | 6866 | CB  | ALA | I | 187 | −53.337 | −32.044 | 62.933 | 1.00 | 32.84 | D000 | C   |
| ATOM | 6867 | N   | HIS | I | 188 | −53.962 | −34.816 | 63.567 | 1.00 | 30.88 | D000 | N   |
| ATOM | 6868 | CA  | HIS | I | 188 | −54.456 | −35.987 | 64.253 | 1.00 | 32.32 | D000 | C   |
| ATOM | 6869 | C   | HIS | I | 188 | −53.593 | −36.192 | 65.488 | 1.00 | 38.94 | D000 | C   |
| ATOM | 6870 | O   | HIS | I | 188 | −52.452 | −35.723 | 65.547 | 1.00 | 41.15 | D000 | O   |
| ATOM | 6871 | CB  | HIS | I | 188 | −54.419 | −37.199 | 63.331 | 1.00 | 28.57 | D000 | C   |
| ATOM | 6872 | CG  | HIS | I | 188 | −53.039 | −37.551 | 62.871 | 1.00 | 39.86 | D000 | C   |
| ATOM | 6873 | ND1 | HIS | I | 188 | −52.317 | −38.593 | 63.414 | 1.00 | 43.77 | D000 | N   |
| ATOM | 6874 | CD2 | HIS | I | 188 | −52.238 | −36.986 | 61.935 | 1.00 | 40.63 | D000 | C   |
| ATOM | 6875 | CE1 | HIS | I | 188 | −51.136 | −38.662 | 62.824 | 1.00 | 43.40 | D000 | C   |
| ATOM | 6876 | NE2 | HIS | I | 188 | −51.063 | −37.697 | 61.925 | 1.00 | 44.73 | D000 | N   |
| ATOM | 6877 | N   | LEU | I | 189 | −54.155 | −36.887 | 66.480 | 1.00 | 34.91 | D000 | N   |
| ATOM | 6878 | CA  | LEU | I | 189 | −53.389 | −37.240 | 67.667 | 1.00 | 36.57 | D000 | C   |
| ATOM | 6879 | C   | LEU | I | 189 | −52.134 | −38.003 | 67.269 | 1.00 | 36.22 | D000 | C   |
| ATOM | 6880 | O   | LEU | I | 189 | −52.181 | −38.892 | 66.414 | 1.00 | 36.87 | D000 | O   |
| ATOM | 6881 | CB  | LEU | I | 189 | −54.227 | −38.079 | 68.626 | 1.00 | 33.58 | D000 | C   |
| ATOM | 6882 | CG  | LEU | I | 189 | −55.332 | −37.326 | 69.361 | 1.00 | 32.53 | D000 | C   |
| ATOM | 6883 | CD1 | LEU | I | 189 | −56.060 | −38.310 | 70.251 | 1.00 | 31.98 | D000 | C   |
| ATOM | 6884 | CD2 | LEU | I | 189 | −54.785 | −36.156 | 70.127 | 1.00 | 32.11 | D000 | C   |
| ATOM | 6885 | N   | VAL | I | 190 | −51.006 | −37.639 | 67.889 | 1.00 | 34.36 | D000 | N   |
| ATOM | 6886 | CA  | VAL | I | 190 | −49.706 | −38.113 | 67.426 | 1.00 | 36.90 | D000 | C   |
| ATOM | 6887 | C   | VAL | I | 190 | −49.705 | −39.621 | 67.302 | 1.00 | 34.99 | D000 | C   |
| ATOM | 6888 | O   | VAL | I | 190 | −50.277 | −40.340 | 68.126 | 1.00 | 38.49 | D000 | O   |
| ATOM | 6889 | CB  | VAL | I | 190 | −48.565 | −37.658 | 68.355 | 1.00 | 40.36 | D000 | C   |
| ATOM | 6890 | CG1 | VAL | I | 190 | −48.720 | −38.264 | 69.755 | 1.00 | 36.50 | D000 | C   |
| ATOM | 6891 | CG2 | VAL | I | 190 | −47.214 | −38.026 | 67.743 | 1.00 | 36.89 | D000 | C   |
| ATOM | 6892 | N   | VAL | I | 191 | −49.097 | −40.091 | 66.224 | 1.00 | 38.67 | D000 | N   |
| ATOM | 6893 | CA  | VAL | I | 191 | −48.933 | −41.503 | 65.926 | 1.00 | 40.35 | D000 | C   |
| ATOM | 6894 | C   | VAL | I | 191 | −47.436 | −41.758 | 65.901 | 1.00 | 37.87 | D000 | C   |
| ATOM | 6895 | O   | VAL | I | 191 | −46.719 | −41.196 | 65.064 | 1.00 | 39.61 | D000 | O   |
| ATOM | 6896 | CB  | VAL | I | 191 | −49.589 | −41.882 | 64.586 | 1.00 | 42.11 | D000 | C   |
| ATOM | 6897 | CG1 | VAL | I | 191 | −49.208 | −43.319 | 64.164 | 1.00 | 36.05 | D000 | C   |
| ATOM | 6898 | CG2 | VAL | I | 191 | −51.109 | −41.663 | 64.648 | 1.00 | 38.64 | D000 | C   |
| ATOM | 6899 | N   | VAL | I | 192 | −46.969 | −42.599 | 66.805 | 1.00 | 36.01 | D000 | N   |
| ATOM | 6900 | CA  | VAL | I | 192 | −45.545 | −42.767 | 67.055 | 1.00 | 41.63 | D000 | C   |
| ATOM | 6901 | C   | VAL | I | 192 | −45.088 | −44.039 | 66.361 | 1.00 | 37.03 | D000 | C   |
| ATOM | 6902 | O   | VAL | I | 192 | −45.528 | −45.138 | 66.718 | 1.00 | 40.05 | D000 | O   |
| ATOM | 6903 | CB  | VAL | I | 192 | −45.264 | −42.808 | 68.565 | 1.00 | 40.06 | D000 | C   |
| ATOM | 6904 | CG1 | VAL | I | 192 | −43.805 | −43.021 | 68.828 | 1.00 | 43.89 | D000 | C   |
| ATOM | 6905 | CG2 | VAL | I | 192 | −45.723 | −40.516 | 69.199 | 1.00 | 30.23 | D000 | C   |
| ATOM | 6906 | N   | THR | I | 193 | −44.188 | −43.897 | 65.377 | 1.00 | 40.22 | D000 | N   |
| ATOM | 6907 | CA  | THR | I | 193 | −43.828 | −45.009 | 64.496 | 1.00 | 46.20 | D000 | C   |
| ATOM | 6908 | C   | THR | I | 193 | −42.371 | −45.451 | 64.595 | 1.00 | 48.77 | D000 | C   |
| ATOM | 6909 | O   | THR | I | 193 | −42.009 | −46.439 | 63.948 | 1.00 | 50.27 | D000 | O   |
| ATOM | 6910 | CB  | THR | I | 193 | −44.081 | −44.649 | 63.021 | 1.00 | 37.88 | D000 | C   |
| ATOM | 6911 | OG1 | THR | I | 193 | −43.196 | −43.588 | 62.655 | 1.00 | 46.69 | D000 | O   |
| ATOM | 6912 | CG2 | THR | I | 193 | −45.516 | −44.167 | 62.808 | 1.00 | 35.86 | D000 | C   |
| ATOM | 6913 | N   | SER | I | 194 | −41.529 | −44.758 | 65.364 | 1.00 | 47.04 | D000 | N   |
| ATOM | 6914 | CA  | SER | I | 194 | −40.107 | −45.072 | 65.443 | 1.00 | 47.61 | D000 | C   |
| ATOM | 6915 | C   | SER | I | 194 | −39.578 | −44.648 | 66.802 | 1.00 | 47.34 | D000 | C   |
| ATOM | 6916 | O   | SER | I | 194 | −40.228 | −43.898 | 67.531 | 1.00 | 48.44 | D000 | O   |
| ATOM | 6917 | CB  | SER | I | 194 | −39.292 | −44.369 | 64.357 | 1.00 | 44.10 | D000 | C   |
| ATOM | 6918 | OG  | SER | I | 194 | −39.457 | −42.964 | 64.442 | 1.00 | 48.66 | D000 | O   |
| ATOM | 6919 | N   | TRP | I | 195 | −38.388 | −45.147 | 67.143 | 1.00 | 44.89 | D000 | N   |
| ATOM | 6920 | CA  | TRP | I | 195 | −37.764 | −44.738 | 68.392 | 1.00 | 43.95 | D000 | C   |
| ATOM | 6921 | C   | TRP | I | 195 | −37.376 | −43.274 | 68.361 | 1.00 | 46.62 | D000 | C   |
| ATOM | 6922 | O   | TRP | I | 195 | −37.488 | −42.577 | 69.379 | 1.00 | 43.24 | D000 | O   |
| ATOM | 6923 | CB  | TRP | I | 195 | −36.552 | −45.605 | 68.717 | 1.00 | 48.92 | D000 | C   |
| ATOM | 6924 | CG  | TRP | I | 195 | −36.802 | −46.281 | 70.004 | 1.00 | 55.85 | D000 | C   |
| ATOM | 6925 | CD1 | TRP | I | 195 | −37.056 | −45.676 | 71.212 | 1.00 | 56.28 | D000 | C   |
| ATOM | 6926 | CD2 | TRP | I | 195 | −36.901 | −47.690 | 70.230 | 1.00 | 56.55 | D000 | C   |
| ATOM | 6927 | NE1 | TRP | I | 195 | −37.292 | −46.630 | 72.179 | 1.00 | 58.55 | D000 | N   |
| ATOM | 6928 | CE2 | TRP | I | 195 | −37.199 | −47.874 | 71.605 | 1.00 | 65.39 | D000 | C   |
| ATOM | 6929 | CE3 | TRP | I | 195 | −36.755 | −48.815 | 69.413 | 1.00 | 48.79 | D000 | C   |
| ATOM | 6930 | CZ2 | TRP | I | 195 | −37.353 | −49.140 | 72.174 | 1.00 | 63.33 | D000 | C   |
| ATOM | 6931 | CZ3 | TRP | I | 195 | −36.904 | −50.070 | 69.980 | 1.00 | 61.76 | D000 | C   |
| ATOM | 6932 | CH2 | TRP | I | 195 | −37.198 | −50.223 | 71.349 | 1.00 | 69.03 | D000 | C   |
| ATOM | 6933 | N   | GLU | I | 196 | −36.914 | −42.786 | 67.210 | 1.00 | 43.07 | D000 | N   |
| ATOM | 6934 | CA  | GLU | I | 196 | −36.579 | −41.374 | 67.119 | 1.00 | 38.64 | D000 | C   |
| ATOM | 6935 | C   | GLU | I | 196 | −37.818 | −40.526 | 67.331 | 1.00 | 38.66 | D000 | C   |
| ATOM | 6936 | O   | GLU | I | 196 | −37.782 | −39.540 | 68.074 | 1.00 | 41.67 | D000 | O   |

TABLE 10.4-continued

| | | | | | | | | | | | |
|---|---|---|---|---|---|---|---|---|---|---|---|
| ATOM | 6937 | CB | GLU | I | 196 | −35.919 | −41.061 | 65.783 | 1.00 | 37.74 | D000 C |
| ATOM | 6938 | CG | GLU | I | 196 | −36.000 | −42.187 | 64.776 | 1.00 | 52.87 | D000 C |
| ATOM | 6939 | CD | GLU | I | 196 | −35.141 | −43.397 | 65.156 | 1.00 | 66.98 | D000 C |
| ATOM | 6940 | OE1 | GLU | I | 196 | −35.717 | −44.504 | 65.378 | 1.00 | 59.55 | D000 O |
| ATOM | 6941 | OE2 | GLU | I | 196 | −33.899 | −43.224 | 65.260 | 1.00 | 74.05 | D000 O1− |
| ATOM | 6942 | N | GLU | I | 197 | −38.945 | −40.923 | 66.737 | 1.00 | 39.39 | D000 N |
| ATOM | 6943 | CA | GLU | I | 197 | −40.168 | −40.155 | 66.948 | 1.00 | 42.64 | D000 C |
| ATOM | 6944 | C | GLU | I | 197 | −40.599 | −40.215 | 68.410 | 1.00 | 37.64 | D000 C |
| ATOM | 6945 | O | GLU | I | 197 | −41.014 | −39.205 | 68.981 | 1.00 | 32.92 | D000 O |
| ATOM | 6946 | CB | GLU | I | 197 | −41.283 | −40.664 | 66.038 | 1.00 | 40.56 | D000 C |
| ATOM | 6947 | CG | GLU | I | 197 | −42.482 | −39.748 | 66.042 | 1.00 | 37.27 | D000 C |
| ATOM | 6948 | CD | GLU | I | 197 | −43.515 | −40.096 | 64.990 | 1.00 | 42.36 | D000 C |
| ATOM | 6949 | OE1 | GLU | I | 197 | −43.544 | −41.263 | 64.528 | 1.00 | 39.06 | D000 O |
| ATOM | 6950 | OE2 | GLU | I | 197 | −44.277 | −39.173 | 64.601 | 1.00 | 44.17 | D000 O1− |
| ATOM | 6951 | N | GLN | I | 198 | −40.485 | −41.396 | 69.026 | 1.00 | 37.19 | D000 N |
| ATOM | 6952 | CA | GLN | I | 198 | −40.810 | −41.562 | 70.435 | 1.00 | 33.73 | D000 C |
| ATOM | 6953 | C | GLN | I | 198 | −39.920 | −40.689 | 71.301 | 1.00 | 39.61 | D000 C |
| ATOM | 6954 | O | GLN | I | 198 | −40.401 | −39.995 | 72.206 | 1.00 | 35.04 | D000 O |
| ATOM | 6955 | CB | GLN | I | 198 | −40.659 | −43.026 | 70.832 | 1.00 | 32.87 | D000 C |
| ATOM | 6956 | CG | GLN | I | 198 | −40.502 | −43.235 | 72.323 | 1.00 | 37.28 | D000 C |
| ATOM | 6957 | CD | GLN | I | 198 | −41.830 | −43.123 | 73.085 | 1.00 | 35.70 | D000 C |
| ATOM | 6958 | OE1 | GLN | I | 198 | −42.902 | −43.371 | 72.539 | 1.00 | 30.32 | D000 O |
| ATOM | 6959 | NE2 | GLN | I | 198 | −41.749 | −42.729 | 74.345 | 1.00 | 35.65 | D000 N |
| ATOM | 6960 | N | LYS | I | 199 | −38.610 | −40.700 | 71.014 | 1.00 | 44.77 | D000 N |
| ATOM | 6961 | CA | LYS | I | 199 | −37.666 | −39.882 | 71.765 | 1.00 | 39.06 | D000 C |
| ATOM | 6962 | C | LYS | I | 199 | −37.934 | −38.405 | 71.551 | 1.00 | 32.39 | D000 C |
| ATOM | 6963 | O | LYS | I | 199 | −37.949 | −37.629 | 72.509 | 1.00 | 31.60 | D000 O |
| ATOM | 6964 | CB | LYS | I | 199 | −36.232 | −40.241 | 71.380 | 1.00 | 36.82 | D000 C |
| ATOM | 6965 | CG | LYS | I | 199 | −35.661 | −41.318 | 72.265 | 1.00 | 38.84 | D000 C |
| ATOM | 6966 | CD | LYS | I | 199 | −34.660 | −42.196 | 71.578 | 1.00 | 46.27 | D000 C |
| ATOM | 6967 | CE | LYS | I | 199 | −33.601 | −41.398 | 70.901 | 1.00 | 41.73 | D000 C |
| ATOM | 6968 | NZ | LYS | I | 199 | −32.530 | −42.355 | 70.568 | 1.00 | 49.72 | D000 N1+ |
| ATOM | 6969 | N | PHE | I | 200 | −38.200 | −38.011 | 70.309 | 1.00 | 34.30 | D000 N |
| ATOM | 6970 | CA | PHE | I | 200 | −38.496 | −36.613 | 70.030 | 1.00 | 32.36 | D000 C |
| ATOM | 6971 | C | PHE | I | 200 | −39.712 | −36.127 | 70.813 | 1.00 | 34.19 | D000 C |
| ATOM | 6972 | O | PHE | I | 200 | −39.724 | −34.995 | 71.313 | 1.00 | 32.22 | D000 O |
| ATOM | 6973 | CB | PHE | I | 200 | −38.719 | −36.408 | 68.539 | 1.00 | 28.30 | D000 C |
| ATOM | 6974 | CG | PHE | I | 200 | −39.389 | −35.123 | 68.221 | 1.00 | 29.58 | D000 C |
| ATOM | 6975 | CD1 | PHE | I | 200 | −38.661 | −33.950 | 68.167 | 1.00 | 34.42 | D000 C |
| ATOM | 6976 | CD2 | PHE | I | 200 | −40.750 | −35.070 | 67.988 | 1.00 | 32.89 | D000 C |
| ATOM | 6977 | CE1 | PHE | I | 200 | −39.278 | −32.727 | 67.878 | 1.00 | 36.14 | D000 C |
| ATOM | 6978 | CE2 | PHE | I | 200 | −41.373 | −33.582 | 67.708 | 1.00 | 32.23 | D000 C |
| ATOM | 6979 | CZ | PHE | I | 200 | −40.628 | −2.679 | 67.656 | 1.00 | 32.52 | D000 C |
| ATOM | 6980 | N | VAL | I | 201 | −40.766 | −36.949 | 70.896 | 1.00 | 34.21 | D000 N |
| ATOM | 6981 | CA | VAL | I | 201 | −41.963 | −36.512 | 71.604 | 1.00 | 32.09 | D000 C |
| ATOM | 6982 | C | VAL | I | 201 | −41.691 | −36.409 | 73.104 | 1.00 | 28.47 | D000 C |
| ATOM | 6983 | O | VAL | I | 201 | −42.112 | −35.445 | 73.745 | 1.00 | 29.67 | D000 O |
| ATOM | 6984 | CB | VAL | I | 201 | −43.166 | −37.423 | 71.280 | 1.00 | 33.84 | D000 C |
| ATOM | 6985 | CG1 | VAL | I | 201 | −44.371 | −37.069 | 72.171 | 1.00 | 26.65 | D000 C |
| ATOM | 6986 | CG2 | VAL | I | 201 | −43.564 | −37.259 | 69.826 | 1.00 | 29.93 | D000 C |
| ATOM | 6987 | N | GLN | I | 202 | −40.948 | −37.368 | 73.675 | 1.00 | 29.76 | D000 N |
| ATOM | 6988 | CA | GLN | I | 202 | −40.625 | −37.333 | 75.103 | 1.00 | 27.89 | D000 C |
| ATOM | 6989 | C | GLN | I | 202 | −39.957 | −36.027 | 75.500 | 1.00 | 30.88 | D000 C |
| ATOM | 6990 | O | GLN | I | 202 | −40.371 | −35.375 | 76.462 | 1.00 | 33.51 | D000 O |
| ATOM | 6991 | CB | GLN | I | 202 | −39.692 | −38.471 | 75.456 | 1.00 | 36.89 | D000 C |
| ATOM | 6992 | CG | GLN | I | 202 | −40.291 | −39.826 | 75.569 | 1.00 | 42.55 | D000 C |
| ATOM | 6993 | CD | GLN | I | 202 | −39.269 | −40.793 | 76.129 | 1.00 | 48.57 | D000 C |
| ATOM | 6994 | OE1 | GLN | I | 202 | −39.196 | −41.954 | 75.707 | 1.00 | 49.10 | D000 O |
| ATOM | 6995 | NE2 | GLN | I | 202 | −38.440 | −40.305 | 77.064 | 1.00 | 45.91 | D000 N |
| ATOM | 6996 | N | HIS | I | 203 | −38.934 | −35.620 | 74.748 | 1.00 | 28.33 | D000 N |
| ATOM | 6997 | CA | HIS | I | 203 | −38.244 | −34.367 | 74.998 | 1.00 | 28.20 | D000 C |
| ATOM | 6998 | C | HIS | I | 203 | −39.221 | −33.223 | 75.160 | 1.00 | 32.96 | D000 C |
| ATOM | 6999 | O | HIS | I | 203 | −39.085 | −32.395 | 76.066 | 1.00 | 38.66 | D000 O |
| ATOM | 7000 | CB | HIS | I | 203 | −37.308 | −34.053 | 73.837 | 1.00 | 38.51 | D000 C |
| ATOM | 7001 | CG | HIS | I | 203 | −35.942 | −34.622 | 73.991 | 1.00 | 45.00 | D000 C |
| ATOM | 7002 | ND1 | HIS | I | 203 | −35.086 | −34.222 | 74.994 | 1.00 | 43.86 | D000 N |
| ATOM | 7003 | CD2 | HIS | I | 203 | −35.274 | −35.544 | 73.260 | 1.00 | 44.53 | D000 C |
| ATOM | 7004 | CE1 | HIS | I | 203 | −33.951 | −34.887 | 74.882 | 1.00 | 48.63 | D000 C |
| ATOM | 7005 | NE2 | HIS | I | 203 | −34.043 | −35.701 | 73.843 | 1.00 | 52.83 | D000 N |
| ATOM | 7006 | N | HIS | I | 204 | −40.192 | −33.140 | 74.253 | 1.00 | 33.22 | D000 N |
| ATOM | 7007 | CA | HIS | I | 204 | −41.092 | −32.000 | 74.229 | 1.00 | 33.76 | D000 C |
| ATOM | 7008 | C | HIS | I | 204 | −42.207 | −32.107 | 75.257 | 1.00 | 30.31 | D000 C |
| ATOM | 7009 | O | HIS | I | 204 | −42.651 | −31.076 | 75.766 | 1.00 | 32.42 | D000 O |
| ATOM | 7010 | CB | HIS | I | 204 | −41.680 | −31.825 | 72.836 | 1.00 | 34.09 | D000 C |
| ATOM | 7011 | CG | HIS | I | 204 | −40.730 | −31.209 | 71.872 | 1.00 | 33.98 | D000 C |
| ATOM | 7012 | ND1 | HIS | I | 204 | −40.541 | −29.847 | 71.793 | 1.00 | 36.56 | D000 N |
| ATOM | 7013 | CD2 | HIS | I | 204 | −39.894 | −31.764 | 70.964 | 1.00 | 37.43 | D000 C |
| ATOM | 7014 | CE1 | HIS | I | 204 | −39.636 | −29.587 | 70.865 | 1.00 | 42.50 | D000 C |
| ATOM | 7015 | NE2 | HIS | I | 204 | −39.224 | −30.732 | 70.349 | 1.00 | 42.23 | D000 N |
| ATOM | 7016 | N | ILE | I | 205 | −42.658 | −33.313 | 75.609 | 1.00 | 27.51 | D000 N |

TABLE 10.4-continued

| | | | | | | | | | | | |
|---|---|---|---|---|---|---|---|---|---|---|---|
| ATOM | 7017 | CA | ILE | I | 205 | −43.735 | −33.386 | 76.587 | 1.00 | 30.86 | D000 | C |
| ATOM | 7018 | C | ILE | I | 205 | −43.220 | −33.433 | 78.017 | 1.00 | 29.89 | D000 | C |
| ATOM | 7019 | O | ILE | I | 205 | −43.958 | −33.056 | 78.934 | 1.00 | 35.65 | D000 | O |
| ATOM | 7020 | CB | ILE | I | 205 | −44.686 | −34.591 | 76.395 | 1.00 | 31.24 | D000 | C |
| ATOM | 7021 | CG1 | ILE | I | 205 | −43.981 | −35.940 | 76.592 | 1.00 | 26.46 | D000 | C |
| ATOM | 7022 | CG2 | ILE | I | 205 | −45.357 | −34.529 | 75.064 | 1.00 | 28.37 | D000 | C |
| ATOM | 7023 | CD1 | ILE | I | 205 | −44.943 | −37.086 | 76.633 | 1.00 | 25.80 | D000 | C |
| ATOM | 7024 | N | GLY | I | 206 | −41.978 | −33.852 | 78.238 | 1.00 | 28.95 | D000 | N |
| ATOM | 7025 | CA | GLY | I | 206 | −41.465 | −33.985 | 79.584 | 1.00 | 29.61 | D000 | C |
| ATOM | 7026 | C | GLY | I | 206 | −42.122 | −35.118 | 80.345 | 1.00 | 27.57 | D000 | C |
| ATOM | 7027 | O | GLY | I | 206 | −42.811 | −35.956 | 79.766 | 1.00 | 29.14 | D000 | O |
| ATOM | 7028 | N | PRO | I | 207 | −41.941 | −35.153 | 81.711 | 1.00 | 29.38 | D000 | N |
| ATOM | 7029 | CA | PRO | I | 207 | −42.433 | −36.295 | 82.509 | 1.00 | 32.33 | D000 | C |
| ATOM | 7030 | C | PRO | I | 207 | −43.904 | −36.143 | 82.896 | 1.00 | 35.00 | D000 | C |
| ATOM | 7031 | O | PRO | I | 207 | −44.262 | −36.029 | 84.077 | 1.00 | 27.86 | D000 | O |
| ATOM | 7032 | CB | PRO | I | 207 | −41.492 | −36.271 | 83.719 | 1.00 | 29.81 | D000 | C |
| ATOM | 7033 | CG | PRO | I | 207 | −41.194 | −34.812 | 83.899 | 1.00 | 30.51 | D000 | C |
| ATOM | 7034 | CD | PRO | I | 207 | −41.260 | −34.150 | 82.549 | 1.00 | 24.29 | D000 | C |
| ATOM | 7035 | N | VAL | I | 208 | −44.771 | −36.126 | 81.879 | 1.00 | 31.78 | D000 | N |
| ATOM | 7036 | CA | VAL | I | 208 | −46.167 | −35.726 | 81.999 | 1.00 | 26.40 | D000 | C |
| ATOM | 7037 | C | VAL | I | 208 | −47.040 | −36.722 | 81.258 | 1.00 | 27.82 | D000 | C |
| ATOM | 7038 | O | VAL | I | 208 | −46.764 | −37.034 | 80.098 | 1.00 | 30.68 | D000 | O |
| ATOM | 7039 | CB | VAL | I | 208 | −46.388 | −34.323 | 81.425 | 1.00 | 25.92 | D000 | C |
| ATOM | 7040 | CG1 | VAL | I | 208 | −47.832 | −33.981 | 81.495 | 1.00 | 28.17 | D000 | C |
| ATOM | 7041 | CG2 | VAL | I | 208 | −45.544 | −33.320 | 82.172 | 1.00 | 26.96 | D000 | C |
| ATOM | 7042 | N | ASN | I | 209 | −48.080 | −37.232 | 81.927 | 1.00 | 27.70 | D000 | N |
| ATOM | 7043 | CA | ASN | I | 209 | −49.054 | −38.093 | 81.264 | 1.00 | 25.54 | D000 | C |
| ATOM | 7044 | C | ASN | I | 209 | −49.688 | −37.350 | 80.096 | 1.00 | 29.53 | D000 | C |
| ATOM | 7045 | O | ASN | I | 209 | −50.263 | −36.271 | 80.277 | 1.00 | 30.75 | D000 | O |
| ATOM | 7046 | CB | ASN | I | 209 | −50.119 | −38.560 | 82.251 | 1.00 | 24.84 | D000 | C |
| ATOM | 7047 | CG | ASN | I | 209 | −49.588 | −39.606 | 83.223 | 1.00 | 31.55 | D000 | C |
| ATOM | 7048 | OD1 | ASN | I | 209 | −48.636 | −40.343 | 82.922 | 1.00 | 29.18 | D000 | O |
| ATOM | 7049 | ND2 | ASN | I | 209 | −50.193 | −39.667 | 84.407 | 1.00 | 32.11 | D000 | N |
| ATOM | 7050 | N | THR | I | 210 | −49.543 | −37.905 | 78.889 | 1.00 | 28.06 | D000 | N |
| ATOM | 7051 | CA | THR | I | 210 | −49.900 | −37.194 | 77.666 | 1.00 | 29.54 | D000 | C |
| ATOM | 7052 | C | THR | I | 210 | −50.593 | −38.164 | 76.716 | 1.00 | 30.18 | D000 | C |
| ATOM | 7053 | O | THR | I | 210 | −50.080 | −39.257 | 76.474 | 1.00 | 31.78 | D000 | O |
| ATOM | 7054 | CB | THR | I | 210 | −48.635 | −36.568 | 77.017 | 1.00 | 32.46 | D000 | C |
| ATOM | 7055 | OG1 | THR | I | 210 | −48.068 | −35.576 | 77.891 | 1.00 | 28.52 | D000 | O |
| ATOM | 7056 | CG2 | THR | I | 210 | −48.955 | −35.895 | 75.680 | 1.00 | 32.03 | D000 | C |
| ATOM | 7057 | N | TRP | I | 211 | −51.748 | −37.771 | 76.178 | 1.00 | 28.21 | D000 | N |
| ATOM | 7058 | CA | TRP | I | 211 | −52.484 | −38.637 | 75.257 | 1.00 | 30.26 | D000 | C |
| ATOM | 7059 | C | TRP | I | 211 | −51.777 | −38.768 | 73.915 | 1.00 | 34.53 | D000 | C |
| ATOM | 7060 | O | TRP | I | 211 | −51.243 | −37.784 | 73.388 | 1.00 | 36.53 | D000 | O |
| ATOM | 7061 | CB | TRP | I | 211 | −53.870 | −38.078 | 74.986 | 1.00 | 27.00 | D000 | C |
| ATOM | 7062 | CG | TRP | I | 211 | −54.837 | −38.105 | 76.098 | 1.00 | 29.16 | D000 | C |
| ATOM | 7063 | CD1 | TRP | I | 211 | −55.575 | −37.051 | 76.552 | 1.00 | 29.17 | D000 | C |
| ATOM | 7064 | CD2 | TRP | I | 211 | −55.232 | −39.235 | 76.871 | 1.00 | 27.40 | D000 | C |
| ATOM | 7065 | NE1 | TRP | I | 211 | −56.401 | −37.453 | 77.547 | 1.00 | 29.33 | D000 | N |
| ATOM | 7066 | CE2 | TRP | I | 211 | −56.208 | −38.791 | 77.777 | 1.00 | 31.18 | D000 | C |
| ATOM | 7067 | CE3 | TRP | I | 211 | −54.849 | −40.575 | 76.896 | 1.00 | 30.57 | D000 | C |
| ATOM | 7068 | CZ2 | TRP | I | 211 | −56.804 | −39.643 | 78.721 | 1.00 | 33.48 | D000 | C |
| ATOM | 7069 | CZ3 | TRP | I | 211 | −55.442 | −41.420 | 77.828 | 1.00 | 32.75 | D000 | C |
| ATOM | 7070 | CH2 | TRP | I | 211 | −56.414 | −40.952 | 78.721 | 1.00 | 31.65 | D000 | C |
| ATOM | 7071 | N | MET | I | 212 | −51.828 | −39.969 | 73.332 | 1.00 | 30.71 | D000 | N |
| ATOM | 7072 | CA | MET | I | 212 | −51.425 | −40.202 | 71.945 | 1.00 | 35.06 | D000 | C |
| ATOM | 7073 | C | MET | I | 212 | −52.588 | −40.816 | 71.166 | 1.00 | 34.50 | D000 | C |
| ATOM | 7074 | O | MET | I | 212 | −53.536 | −41.339 | 71.746 | 1.00 | 29.90 | D000 | O |
| ATOM | 7075 | CB | MET | I | 212 | −50.197 | −41.126 | 71.870 | 1.00 | 33.98 | D000 | C |
| ATOM | 7076 | CG | MET | I | 212 | −50.532 | −42.612 | 72.009 | 1.00 | 34.65 | D000 | C |
| ATOM | 7077 | SD | MET | I | 212 | −49.112 | −43.701 | 72.320 | 1.00 | 36.95 | D000 | S |
| ATOM | 7078 | CE | MET | I | 212 | −48.665 | −43.185 | 73.977 | 1.00 | 32.76 | D000 | C |
| ATOM | 7079 | N | GLY | I | 213 | −52.482 | −40.824 | 69.836 | 1.00 | 31.69 | D000 | N |
| ATOM | 7080 | CA | GLY | I | 213 | −53.575 | −41.340 | 69.027 | 1.00 | 34.66 | D000 | C |
| ATOM | 7081 | C | GLY | I | 213 | −53.764 | −42.849 | 68.974 | 1.00 | 32.70 | D000 | C |
| ATOM | 7082 | O | GLY | I | 213 | −53.862 | −43.424 | 67.900 | 1.00 | 36.23 | D000 | O |
| ATOM | 7083 | N | LEU | I | 214 | −53.871 | −43.509 | 70.116 | 1.00 | 34.81 | D000 | N |
| ATOM | 7084 | CA | LEU | I | 214 | −53.951 | −44.961 | 70.150 | 1.00 | 39.32 | D000 | C |
| ATOM | 7085 | C | LEU | I | 214 | −55.046 | −45.365 | 71.132 | 1.00 | 45.03 | D000 | C |
| ATOM | 7086 | O | LEU | I | 214 | −54.950 | −45.073 | 72.327 | 1.00 | 45.18 | D000 | O |
| ATOM | 7087 | CB | LEU | I | 214 | −52.589 | −45.544 | 70.557 | 1.00 | 39.33 | D000 | C |
| ATOM | 7088 | CG | LEU | I | 214 | −52.388 | −47.049 | 70.722 | 1.00 | 44.57 | D000 | C |
| ATOM | 7089 | CD1 | LEU | I | 214 | −52.448 | −47.717 | 69.369 | 1.00 | 42.58 | D000 | C |
| ATOM | 7090 | CD2 | LEU | I | 214 | −51.059 | −47.335 | 71.406 | 1.00 | 38.76 | D000 | C |
| ATOM | 7091 | N | HIS | I | 215 | −56.076 | −46.053 | 70.639 | 1.00 | 50.99 | D000 | N |
| ATOM | 7092 | CA | HIS | I | 215 | −57.202 | −46.449 | 71.479 | 1.00 | 54.24 | D000 | C |
| ATOM | 7093 | C | HIS | I | 215 | −57.809 | −47.741 | 70.957 | 1.00 | 53.49 | D000 | C |
| ATOM | 7094 | O | HIS | I | 215 | −57.726 | −48.039 | 69.766 | 1.00 | 59.77 | D000 | O |
| ATOM | 7095 | CB | HIS | I | 215 | −58.297 | −45.381 | 71.525 | 1.00 | 51.69 | D000 | C |
| ATOM | 7096 | CG | HIS | I | 215 | −58.991 | −45.169 | 70.220 | 1.00 | 53.16 | D000 | C |

TABLE 10.4-continued

| | | | | | | | | | | |
|---|---|---|---|---|---|---|---|---|---|---|
| ATOM | 7097 | ND1 | HIS | I | 215 | −60.319 | −44.814 | 70.139 | 1.00 | 61.14 | D000 | N |
| ATOM | 7098 | CD2 | HIS | I | 215 | −58.542 | −45.241 | 68.946 | 1.00 | 52.42 | D000 | C |
| ATOM | 7099 | CE1 | HIS | I | 215 | −60.664 | −44.692 | 68.868 | 1.00 | 60.68 | D000 | C |
| ATOM | 7100 | NE2 | HIS | I | 215 | −59.602 | −44.938 | 68.124 | 1.00 | 56.57 | D000 | N |
| ATOM | 7101 | N | ASP | I | 216 | −58.446 | −48.489 | 71.850 | 1.00 | 51.53 | D000 | N |
| ATOM | 7102 | CA | ASP | I | 216 | −59.163 | −49.708 | 71.488 | 1.00 | 63.11 | D000 | C |
| ATOM | 7103 | C | ASP | I | 216 | −60.629 | −49.629 | 71.897 | 1.00 | 70.32 | D000 | C |
| ATOM | 7104 | O | ASP | I | 216 | −61.218 | −50.615 | 72.345 | 1.00 | 73.44 | D000 | O |
| ATOM | 7105 | CB | ASP | I | 216 | −58.504 | −50.956 | 72.083 | 1.00 | 62.05 | D000 | C |
| ATOM | 7106 | CG | ASP | I | 216 | −58.816 | −51.157 | 73.565 | 1.00 | 63.11 | D000 | C |
| ATOM | 7107 | OD1 | ASP | I | 216 | −59.134 | −50.177 | 74.265 | 1.00 | 66.02 | D000 | O |
| ATOM | 7108 | OD2 | ASP | I | 216 | −58.783 | −52.313 | 74.025 | 1.00 | 71.37 | D000 | O1− |
| ATOM | 7109 | N | GLN | I | 217 | −61.243 | −48.448 | 71.761 | 1.00 | 68.81 | D000 | N |
| ATOM | 7110 | CA | GLN | I | 217 | −62.674 | −48.330 | 72.036 | 1.00 | 79.13 | D000 | C |
| ATOM | 7111 | C | GLN | I | 217 | −63.497 | −49.323 | 71.214 | 1.00 | 82.76 | D000 | C |
| ATOM | 7112 | O | GLN | I | 217 | −64.637 | −49.629 | 71.584 | 1.00 | 81.10 | D000 | O |
| ATOM | 7113 | CB | GLN | I | 217 | −63.136 | −46.885 | 71.804 | 1.00 | 78.37 | D000 | C |
| ATOM | 7114 | CG | GLN | I | 217 | −63.047 | −46.020 | 73.089 | 1.00 | 75.77 | D000 | C |
| ATOM | 7115 | CD | GLN | I | 217 | −62.642 | −44.570 | 72.825 | 1.00 | 67.80 | D000 | C |
| ATOM | 7116 | OE1 | GLN | I | 217 | −61.796 | −44.296 | 71.969 | 1.00 | 62.96 | D000 | O |
| ATOM | 7117 | NE2 | GLN | I | 217 | −63.220 | −43.637 | 73.591 | 1.00 | 56.15 | D000 | N |
| ATOM | 7118 | N | ASN | I | 218 | −62.634 | −49.838 | 70.118 | 1.00 | 81.51 | D000 | N |
| ATOM | 7119 | CA | ASN | I | 218 | −63.546 | −50.918 | 69.346 | 1.00 | 86.93 | D000 | C |
| ATOM | 7120 | C | ASN | I | 218 | −63.369 | −52.279 | 70.037 | 1.00 | 84.87 | D000 | C |
| ATOM | 7121 | O | ASN | I | 218 | −64.349 | −52.951 | 70.386 | 1.00 | 79.46 | D000 | O |
| ATOM | 7122 | CB | ASN | I | 218 | −62.928 | −50.932 | 67.942 | 1.00 | 92.18 | D000 | C |
| ATOM | 7123 | CG | ASN | I | 218 | −63.905 | −51.382 | 66.867 | 1.00 | 99.76 | D000 | C |
| ATOM | 7124 | OD1 | ASN | I | 218 | −63.626 | −51.249 | 65.669 | 1.00 | 98.33 | D000 | O |
| ATOM | 7125 | ND2 | ASN | I | 218 | −65.059 | −51.902 | 67.285 | 1.00 | 97.53 | D000 | N |
| ATOM | 7126 | N | GLY | I | 219 | −62.117 | −52.679 | 70.279 | 1.00 | 81.16 | D000 | N |
| ATOM | 7127 | CA | GLY | I | 219 | −61.786 | −54.004 | 70.763 | 1.00 | 72.74 | D000 | C |
| ATOM | 7128 | C | GLY | I | 219 | −60.286 | −54.248 | 70.697 | 1.00 | 71.27 | D000 | C |
| ATOM | 7129 | O | GLY | I | 219 | −59.631 | −54.504 | 71.715 | 1.00 | 64.68 | D000 | O |
| ATOM | 7130 | N | PRO | I | 220 | −59.715 | −54.165 | 69.493 | 1.00 | 71.97 | D000 | N |
| ATOM | 7131 | CA | PRO | I | 220 | −58.254 | −54.149 | 69.354 | 1.00 | 66.99 | D000 | C |
| ATOM | 7132 | C | PRO | I | 220 | −57.718 | −52.723 | 69.288 | 1.00 | 65.66 | D000 | C |
| ATOM | 7133 | O | PRO | I | 220 | −58.435 | −51.765 | 68.980 | 1.00 | 63.20 | D000 | O |
| ATOM | 7134 | CB | PRO | I | 220 | −58.025 | −54.861 | 68.014 | 1.00 | 60.23 | D000 | C |
| ATOM | 7135 | CG | PRO | I | 220 | −59.311 | −54.670 | 67.242 | 1.00 | 61.26 | D000 | C |
| ATOM | 7136 | CD | PRO | I | 220 | −60.369 | −54.114 | 68.172 | 1.00 | 66.08 | D000 | C |
| ATOM | 7137 | N | TRP | I | 221 | −56.429 | −52.596 | 69.586 | 1.00 | 55.14 | D000 | N |
| ATOM | 7138 | CA | TRP | I | 221 | −55.793 | −51.292 | 69.545 | 1.00 | 47.35 | D000 | C |
| ATOM | 7139 | C | TRP | I | 221 | −55.622 | −50.832 | 68.103 | 1.00 | 49.66 | D000 | C |
| ATOM | 7140 | O | TRP | I | 221 | −55.267 | −51.614 | 67.218 | 1.00 | 47.87 | D000 | O |
| ATOM | 7141 | CB | TRP | I | 221 | −54.450 | −51.345 | 70.262 | 1.00 | 52.11 | D000 | C |
| ATOM | 7142 | CG | TRP | I | 221 | −54.577 | −51.541 | 71.768 | 1.00 | 58.06 | D000 | C |
| ATOM | 7143 | CD1 | TRP | I | 221 | −54.489 | −52.721 | 72.456 | 1.00 | 56.76 | D000 | C |
| ATOM | 7144 | CD2 | TRP | I | 221 | −54.817 | −50.524 | 72.754 | 1.00 | 56.97 | D000 | C |
| ATOM | 7145 | NE1 | TRP | I | 221 | −54.650 | −52.500 | 73.800 | 1.00 | 58.53 | D000 | N |
| ATOM | 7146 | CE2 | TRP | I | 221 | −54.860 | −51.163 | 74.012 | 1.00 | 57.57 | D000 | C |
| ATOM | 7147 | CE3 | TRP | I | 221 | −54.999 | −49.136 | 72.695 | 1.00 | 53.29 | D000 | C |
| ATOM | 7148 | CZ2 | TRP | I | 221 | −55.078 | −50.464 | 75.201 | 1.00 | 53.89 | D000 | C |
| ATOM | 7149 | CZ3 | TRP | I | 221 | −55.211 | −48.447 | 73.874 | 1.00 | 50.92 | D000 | C |
| ATOM | 7150 | CH2 | TRP | I | 221 | −55.251 | −49.113 | 75.110 | 1.00 | 52.06 | D000 | C |
| ATOM | 7151 | N | LYS | I | 222 | −55.888 | −49.550 | 67.870 | 1.00 | 47.59 | D000 | N |
| ATOM | 7152 | CA | LYS | I | 222 | −55.833 | −48.951 | 66.546 | 1.00 | 47.00 | D000 | C |
| ATOM | 7153 | C | LYS | I | 222 | −55.218 | −47.565 | 66.654 | 1.00 | 47.01 | D000 | C |
| ATOM | 7154 | O | LYS | I | 222 | −55.421 | −46.869 | 67.650 | 1.00 | 48.52 | D000 | O |
| ATOM | 7155 | CB | LYS | I | 222 | −57.240 | −48.830 | 65.933 | 1.00 | 47.34 | D000 | C |
| ATOM | 7156 | CG | LYS | I | 222 | −58.076 | −50.090 | 66.018 | 1.00 | 46.82 | D000 | C |
| ATOM | 7157 | CD | LYS | I | 222 | −59.483 | −49.822 | 65.523 | 1.00 | 66.09 | D000 | C |
| ATOM | 7158 | CE | LYS | I | 222 | −60.297 | −51.108 | 65.437 | 1.00 | 78.89 | D000 | C |
| ATOM | 7159 | NZ | LYS | I | 222 | −61.575 | −50.950 | 64.682 | 1.00 | 75.65 | D000 | N1+ |
| ATOM | 7160 | N | TRP | I | 223 | −54.475 | −47.155 | 65.630 | 1.00 | 40.12 | D000 | N |
| ATOM | 7161 | CA | TRP | I | 223 | −54.033 | −45.768 | 65.562 | 1.00 | 42.18 | D000 | C |
| ATOM | 7162 | C | TRP | I | 223 | −55.057 | −44.910 | 64.815 | 1.00 | 40.82 | D000 | C |
| ATOM | 7163 | O | TRP | I | 223 | −55.674 | −45.348 | 63.843 | 1.00 | 42.00 | D000 | O |
| ATOM | 7164 | CB | TRP | I | 223 | −52.654 | −45.651 | 64.892 | 1.00 | 40.05 | D000 | C |
| ATOM | 7165 | CG | TRP | I | 223 | −51.497 | −46.261 | 65.689 | 1.00 | 43.88 | D000 | C |
| ATOM | 7166 | CD1 | TRP | I | 223 | −50.994 | −47.529 | 65.568 | 1.00 | 43.26 | D000 | C |
| ATOM | 7167 | CD2 | TRP | I | 223 | −50.711 | −45.620 | 66.718 | 1.00 | 45.79 | D000 | C |
| ATOM | 7168 | NE1 | TRP | I | 223 | −49.959 | −47.722 | 66.455 | 1.00 | 40.92 | D000 | N |
| ATOM | 7169 | CE2 | TRP | I | 223 | −49.761 | −46.570 | 67.171 | 1.00 | 42.07 | D000 | C |
| ATOM | 7170 | CE3 | TRP | I | 223 | −50.730 | −44.341 | 67.310 | 1.00 | 40.91 | D000 | C |
| ATOM | 7171 | CZ2 | TRP | I | 223 | −48.837 | −46.284 | 68.182 | 1.00 | 38.74 | D000 | C |
| ATOM | 7172 | CZ3 | TRP | I | 223 | −49.809 | −44.054 | 68.305 | 1.00 | 37.29 | D000 | C |
| ATOM | 7173 | CH2 | TRP | I | 223 | −48.872 | −45.027 | 68.730 | 1.00 | 42.40 | D000 | C |
| ATOM | 7174 | N | VAL | I | 224 | −55.158 | −43.642 | 65.220 | 1.00 | 35.57 | D000 | N |
| ATOM | 7175 | CA | VAL | I | 224 | −56.214 | −42.782 | 64.710 | 1.00 | 38.56 | D000 | C |
| ATOM | 7176 | C | VAL | I | 224 | −56.046 | −42.420 | 63.229 | 1.00 | 44.84 | D000 | C |

TABLE 10.4-continued

| | | | | | | | | | | | |
|---|---|---|---|---|---|---|---|---|---|---|---|
| ATOM | 7177 | O | VAL | I | 224 | −57.010 | −41.965 | 62.593 | 1.00 | 41.50 | D000 O |
| ATOM | 7178 | CB | VAL | I | 224 | −56.317 | −41.511 | 65.574 | 1.00 | 38.88 | D000 C |
| ATOM | 7179 | CG1 | VAL | I | 224 | −56.643 | −41.880 | 66.984 | 1.00 | 34.96 | D000 C |
| ATOM | 7180 | CG2 | VAL | I | 224 | −55.044 | −40.664 | 65.498 | 1.00 | 36.68 | D000 C |
| ATOM | 7181 | N | ASP | I | 225 | −54.854 | −42.575 | 62.657 | 1.00 | 47.42 | D000 N |
| ATOM | 7182 | CA | ASP | I | 225 | −54.634 | −42.202 | 61.264 | 1.00 | 45.07 | D000 C |
| ATOM | 7183 | C | ASP | I | 225 | −54.667 | −43.405 | 60.323 | 1.00 | 47.81 | D000 C |
| ATOM | 7184 | O | ASP | I | 225 | −54.433 | −43.248 | 59.117 | 1.00 | 47.18 | D000 O |
| ATOM | 7185 | CB | ASP | I | 225 | −53.316 | −41.416 | 61.120 | 1.00 | 43.11 | D000 C |
| ATOM | 7186 | CG | ASP | I | 225 | −52.062 | −42.297 | 61.130 | 1.00 | 45.43 | D000 C |
| ATOM | 7187 | OD1 | ASP | I | 225 | −52.115 | −43.489 | 61.519 | 1.00 | 41.39 | D000 O |
| ATOM | 7188 | OD2 | ASP | I | 225 | −50.996 | −41.765 | 60.728 | 1.00 | 46.94 | D000 O1− |
| ATOM | 7189 | N | GLY | I | 226 | −54.980 | −44.593 | 60.847 | 1.00 | 47.45 | D000 N |
| ATOM | 7190 | CA | GLY | I | 226 | −55.065 | −45.811 | 60.081 | 1.00 | 41.76 | D000 C |
| ATOM | 7191 | C | GLY | I | 226 | −53.833 | −46.683 | 60.170 | 1.00 | 52.00 | D000 C |
| ATOM | 7192 | O | GLY | I | 226 | −53.912 | −47.876 | 59.850 | 1.00 | 56.10 | D000 O |
| ATOM | 7193 | N | THR | I | 227 | −52.713 | −46.128 | 60.647 | 1.00 | 51.85 | D000 N |
| ATOM | 7194 | CA | THR | I | 227 | −51.473 | −46.886 | 60.769 | 1.00 | 46.63 | D000 C |
| ATOM | 7195 | C | THR | I | 227 | −51.717 | −48.209 | 61.476 | 1.00 | 39.30 | D000 C |
| ATOM | 7196 | O | THR | I | 227 | −52.498 | −48.293 | 62.422 | 1.00 | 45.35 | D000 O |
| ATOM | 7197 | CB | THR | I | 227 | −50.425 | −46.078 | 61.535 | 1.00 | 41.84 | D000 C |
| ATOM | 7198 | OG1 | THR | I | 227 | −50.284 | −44.782 | 60.931 | 1.00 | 39.58 | D000 O |
| ATOM | 7199 | CG2 | THR | I | 227 | −49.093 | −46.792 | 61.502 | 1.00 | 32.58 | D000 C |
| ATOM | 7200 | N | ASP | I | 228 | −51.097 | −46.259 | 60.965 | 1.00 | 42.37 | D000 N |
| ATOM | 7201 | CA | ASP | I | 228 | −51.312 | −50.564 | 61.553 | 1.00 | 43.67 | D000 C |
| ATOM | 7202 | C | ASP | I | 228 | −50.643 | −50.637 | 62.911 | 1.00 | 47.41 | D000 C |
| ATOM | 7203 | O | ASP | I | 228 | −49.510 | −50.182 | 63.090 | 1.00 | 48.24 | D000 O |
| ATOM | 7204 | CB | ASP | I | 228 | −50.780 | −51.670 | 60.657 | 1.00 | 44.10 | D000 C |
| ATOM | 7205 | CG | ASP | I | 228 | −50.886 | −53.024 | 61.317 | 1.00 | 47.63 | D000 C |
| ATOM | 7206 | OD1 | ASP | I | 228 | −52.011 | −53.436 | 61.652 | 1.00 | 48.15 | D000 O |
| ATOM | 7207 | OD2 | ASP | I | 228 | −49.842 | −53.674 | 61.519 | 1.00 | 56.59 | D000 O1− |
| ATOM | 7208 | N | TYR | I | 229 | −51.362 | −51.196 | 63.878 | 1.00 | 48.84 | D000 N |
| ATOM | 7209 | CA | TYR | I | 229 | −50.808 | −51.333 | 65.220 | 1.00 | 52.99 | D000 C |
| ATOM | 7210 | C | TYR | I | 229 | −49.895 | −52.557 | 65.345 | 1.00 | 52.23 | D000 C |
| ATOM | 7211 | O | TYR | I | 229 | −48.800 | −52.471 | 65.919 | 1.00 | 51.49 | D000 O |
| ATOM | 7212 | CB | TYR | I | 229 | −51.949 | −51.395 | 66.243 | 1.00 | 46.59 | D000 C |
| ATOM | 7213 | CG | TYR | I | 229 | −51.529 | −51.806 | 67.625 | 1.00 | 44.81 | D000 C |
| ATOM | 7214 | CD2 | TYR | I | 229 | −51.533 | −53.141 | 67.992 | 1.00 | 47.32 | D000 C |
| ATOM | 7215 | CD1 | TYR | I | 229 | −51.096 | −50.875 | 68.549 | 1.00 | 47.52 | D000 C |
| ATOM | 7216 | CE2 | TYR | I | 229 | −51.138 | −53.545 | 69.242 | 1.00 | 50.06 | D000 C |
| ATOM | 7217 | CE1 | TYR | I | 229 | −50.700 | −51.268 | 69.830 | 1.00 | 49.62 | D000 C |
| ATOM | 7218 | CZ | TYR | I | 229 | −50.723 | −52.613 | 70.161 | 1.00 | 51.78 | D000 C |
| ATOM | 7219 | OH | TYR | I | 229 | −50.341 | −53.044 | 71.407 | 1.00 | 41.13 | D000 O |
| ATOM | 7220 | N | GLU | I | 230 | −50.333 | −53.705 | 64.828 | 1.00 | 53.05 | D000 N |
| ATOM | 7221 | CA | GLU | I | 230 | −49.710 | −54.967 | 65.221 | 1.00 | 54.20 | D000 C |
| ATOM | 7222 | C | GLU | I | 230 | −48.276 | −55.102 | 64.708 | 1.00 | 52.15 | D000 C |
| ATOM | 7223 | O | GLU | I | 230 | −47.392 | −55.578 | 65.430 | 1.00 | 54.02 | D000 O |
| ATOM | 7224 | CB | GLU | I | 230 | −50.577 | −56.134 | 64.766 | 1.00 | 60.03 | D000 C |
| ATOM | 7225 | CG | GLU | I | 230 | −50.249 | −57.386 | 65.539 | 1.00 | 67.01 | D000 C |
| ATOM | 7226 | CD | GLU | I | 230 | −50.036 | −57.099 | 67.016 | 1.00 | 66.61 | D000 C |
| ATOM | 7227 | OE1 | GLU | I | 230 | −51.027 | −56.765 | 67.706 | 1.00 | 68.50 | D000 O |
| ATOM | 7228 | OE2 | GLU | I | 230 | −48.871 | −57.189 | 67.479 | 1.00 | 67.23 | D000 O1− |
| ATOM | 7229 | N | THR | I | 231 | −48.019 | −54.721 | 63.470 | 1.00 | 52.10 | D000 N |
| ATOM | 7230 | CA | THR | I | 231 | −46.651 | −54.762 | 62.968 | 1.00 | 54.05 | D000 C |
| ATOM | 7231 | C | THR | I | 231 | −45.864 | −53.483 | 63.276 | 1.00 | 50.36 | D000 C |
| ATOM | 7232 | O | THR | I | 231 | −44.664 | −53.426 | 62.977 | 1.00 | 52.95 | D000 O |
| ATOM | 7233 | CB | THR | I | 231 | −46.649 | −55.055 | 61.450 | 1.00 | 52.18 | D000 C |
| ATOM | 7234 | OG1 | THR | I | 231 | −47.303 | −53.996 | 60.732 | 1.00 | 44.52 | D000 O |
| ATOM | 7235 | CG2 | THR | I | 231 | −47.325 | −56.388 | 61.140 | 1.00 | 44.56 | D000 C |
| ATOM | 7236 | N | GLY | I | 232 | −46.494 | −52.478 | 63.907 | 1.00 | 46.91 | D000 N |
| ATOM | 7237 | CA | GLY | I | 232 | −45.878 | −51.180 | 64.126 | 1.00 | 47.37 | D000 C |
| ATOM | 7238 | C | GLY | I | 232 | −45.126 | −51.024 | 65.460 | 1.00 | 47.60 | D000 C |
| ATOM | 7239 | O | GLY | I | 232 | −45.082 | −51.911 | 66.317 | 1.00 | 49.36 | D000 O |
| ATOM | 7240 | N | PHE | I | 233 | −44.496 | −49.860 | 65.599 | 1.00 | 41.36 | D000 N |
| ATOM | 7241 | CA | PHE | I | 233 | −43.718 | −49.535 | 66.789 | 1.00 | 43.90 | D000 C |
| ATOM | 7242 | C | PHE | I | 233 | −44.583 | −49.581 | 68.043 | 1.00 | 44.53 | D000 C |
| ATOM | 7243 | O | PHE | I | 233 | −45.750 | −49.180 | 68.019 | 1.00 | 48.88 | D000 O |
| ATOM | 7244 | CB | PHE | I | 233 | −43.083 | −48.144 | 66.644 | 1.00 | 46.48 | D000 C |
| ATOM | 7245 | CG | PHE | I | 233 | −42.286 | −47.729 | 67.846 | 1.00 | 53.61 | D000 C |
| ATOM | 7246 | CD1 | PHE | I | 233 | −40.995 | −48.197 | 68.026 | 1.00 | 46.82 | D000 C |
| ATOM | 7247 | CD2 | PHE | I | 233 | −42.838 | −46.911 | 68.820 | 1.00 | 52.29 | D000 C |
| ATOM | 7248 | CE1 | PHE | I | 233 | −40.276 | −47.855 | 69.139 | 1.00 | 48.20 | D000 C |
| ATOM | 7249 | CE2 | PHE | I | 233 | −42.114 | −46.558 | 69.940 | 1.00 | 45.86 | D000 C |
| ATOM | 7250 | CZ | PHE | I | 233 | −40.831 | −47.029 | 70.096 | 1.00 | 50.22 | D000 C |
| ATOM | 7251 | N | LYS | I | 234 | −44.011 | −50.083 | 69.143 | 1.00 | 41.34 | D000 N |
| ATOM | 7252 | CA | LYS | I | 234 | −44.704 | −50.159 | 70.428 | 1.00 | 44.31 | D000 C |
| ATOM | 7253 | C | LYS | I | 234 | −43.739 | −49.876 | 71.575 | 1.00 | 45.74 | D000 C |
| ATOM | 7254 | O | LYS | I | 234 | −42.561 | −50.223 | 71.499 | 1.00 | 52.26 | D000 O |
| ATOM | 7255 | CB | LYS | I | 234 | −45.349 | −51.532 | 70.647 | 1.00 | 50.12 | D000 C |
| ATOM | 7256 | CG | LYS | I | 234 | −46.423 | −51.935 | 69.649 | 1.00 | 46.91 | D000 C |

TABLE 10.4-continued

| ATOM | 7257 | CD | LYS | I | 234 | −46.920 | −53.333 | 69.980 | 1.00 | 41.34 | D000 | C |
|---|---|---|---|---|---|---|---|---|---|---|---|---|
| ATOM | 7258 | CE | LYS | I | 234 | −47.495 | −53.986 | 68.756 | 1.00 | 52.95 | D000 | C |
| ATOM | 7259 | NZ | LYS | I | 234 | −46.449 | −54.101 | 67.706 | 1.00 | 54.61 | D000 | N1+ |
| ATOM | 7260 | N | ASN | I | 235 | −44.329 | −49.255 | 72.646 | 1.00 | 46.61 | D000 | N |
| ATOM | 7261 | CA | ASN | I | 235 | −43.386 | −48.905 | 73.785 | 1.00 | 40.27 | D000 | C |
| ATOM | 7262 | C | ASN | I | 235 | −44.180 | −48.890 | 75.098 | 1.00 | 44.39 | D000 | C |
| ATOM | 7263 | O | ASN | I | 235 | −44.138 | −47.925 | 75.865 | 1.00 | 45.23 | D000 | O |
| ATOM | 7264 | CB | ASN | I | 235 | −42.691 | −47.564 | 73.545 | 1.00 | 38.53 | D000 | C |
| ATOM | 7265 | CG | ASN | I | 235 | −41.620 | −47.270 | 74.577 | 1.00 | 40.11 | D000 | C |
| ATOM | 7266 | OD1 | ASN | I | 235 | −40.990 | −48.178 | 75.105 | 1.00 | 44.27 | D000 | O |
| ATOM | 7267 | ND2 | ASN | I | 235 | −41.420 | −46.000 | 74.879 | 1.00 | 41.29 | D000 | N |
| ATOM | 7268 | N | TRP | I | 236 | −44.905 | −49.971 | 75.387 | 1.00 | 43.99 | D000 | N |
| ATOM | 7269 | CA | TRP | I | 236 | −45.720 | −50.052 | 76.600 | 1.00 | 45.07 | D000 | C |
| ATOM | 7270 | C | TRP | I | 236 | −44.866 | −50.125 | 77.866 | 1.00 | 46.24 | D000 | C |
| ATOM | 7271 | O | TRP | I | 236 | −43.739 | −50.626 | 77.846 | 1.00 | 47.40 | D000 | O |
| ATOM | 7272 | CB | TRP | I | 236 | −46.614 | −51.289 | 76.550 | 1.00 | 44.75 | D000 | C |
| ATOM | 7273 | CG | TRP | I | 236 | −47.647 | −51.240 | 75.491 | 1.00 | 48.81 | D000 | C |
| ATOM | 7274 | CD1 | TRP | I | 236 | −47.616 | −51.876 | 74.288 | 1.00 | 46.27 | D000 | C |
| ATOM | 7275 | CD2 | TRP | I | 236 | −48.878 | −50.513 | 5.531 | 1.00 | 50.08 | D000 | C |
| ATOM | 7276 | NE1 | TRP | I | 236 | −48.749 | −51.591 | 73.573 | 1.00 | 46.50 | D000 | N |
| ATOM | 7277 | CE2 | TRP | I | 236 | −49.543 | −50.756 | 74.314 | 1.00 | 52.31 | D000 | C |
| ATOM | 7278 | CE3 | TRP | I | 236 | −49.482 | −49.680 | 76.480 | 1.00 | 48.48 | D000 | C |
| ATOM | 7279 | CZ2 | TRP | I | 236 | −50.787 | −50.195 | 74.018 | 1.00 | 53.44 | D000 | C |
| ATOM | 7280 | CZ3 | TRP | I | 236 | −50.708 | −49.126 | 76.192 | 1.00 | 49.54 | D000 | C |
| ATOM | 7281 | CH2 | TRP | I | 236 | −51.354 | −49.388 | 74.969 | 1.00 | 55.96 | D000 | C |
| ATOM | 7282 | N | ARG | I | 237 | −45.410 | −49.600 | 78.981 | 1.00 | 46.86 | D000 | N |
| ATOM | 7283 | CA | ARG | I | 237 | −44.869 | −49.924 | 80.304 | 1.00 | 52.81 | D000 | C |
| ATOM | 7284 | C | ARG | I | 237 | −45.128 | −51.400 | 80.593 | 1.00 | 57.44 | D000 | C |
| ATOM | 7285 | O | ARG | I | 237 | −46.167 | −51.926 | 80.193 | 1.00 | 65.84 | D000 | O |
| ATOM | 7286 | CB | ARG | I | 237 | −45.507 | −49.082 | 81.421 | 1.00 | 48.92 | D000 | C |
| ATOM | 7287 | CG | ARG | I | 237 | −45.148 | −47.579 | 81.479 | 1.00 | 52.62 | D000 | C |
| ATOM | 7288 | CD | ARG | I | 237 | −43.916 | −47.207 | 82.346 | 1.00 | 51.01 | D000 | C |
| ATOM | 7289 | NE | ARG | I | 237 | −44.221 | −47.118 | 83.786 | 1.00 | 55.72 | D000 | N |
| ATOM | 7290 | CZ | ARG | I | 237 | −44.309 | −45.995 | 84.513 | 1.00 | 52.55 | D000 | C |
| ATOM | 7291 | NH1 | ARG | I | 237 | −44.119 | −44.796 | 83.979 | 1.00 | 44.43 | D000 | N1+ |
| ATOM | 7292 | NH2 | ARG | I | 237 | −44.588 | −46.073 | 85.808 | 1.00 | 64.23 | D000 | N |
| ATOM | 7293 | N | PRO | I | 238 | −44.206 | −52.094 | 81.259 | 1.00 | 64.01 | D000 | N |
| ATOM | 7294 | CA | PRO | I | 238 | −44.450 | −53.500 | 81.615 | 1.00 | 65.03 | D000 | C |
| ATOM | 7295 | C | PRO | I | 238 | −45.771 | −53.685 | 82.356 | 1.00 | 74.35 | D000 | C |
| ATOM | 7296 | O | PRO | I | 238 | −46.138 | −52.874 | 83.210 | 1.00 | 79.19 | D000 | O |
| ATOM | 7297 | CB | PRO | I | 238 | −43.244 | −53.846 | 82.493 | 1.00 | 66.34 | D000 | C |
| ATOM | 7298 | CG | PRO | I | 238 | −42.143 | −53.019 | 81.911 | 1.00 | 66.55 | D000 | C |
| ATOM | 7299 | CD | PRO | I | 238 | −42.800 | −51.710 | 81.488 | 1.00 | 66.32 | D000 | C |
| ATOM | 7300 | N | GLU | I | 239 | −46.483 | −54.772 | 82.011 | 1.00 | 76.56 | D000 | N |
| ATOM | 7301 | CA | GLU | I | 239 | −47.850 | −55.186 | 82.415 | 1.00 | 81.96 | D000 | C |
| ATOM | 7302 | C | GLU | I | 239 | −48.960 | −54.622 | 81.521 | 1.00 | 85.73 | D000 | C |
| ATOM | 7303 | O | GLU | I | 239 | −50.134 | −54.970 | 81.747 | 1.00 | 90.20 | D000 | O |
| ATOM | 7304 | CB | GLU | I | 239 | −48.223 | −54.802 | 83.865 | 1.00 | 84.76 | D000 | C |
| ATOM | 7305 | CG | GLU | I | 239 | −48.026 | −55.831 | 84.975 | 1.00 | 89.72 | D000 | C |
| ATOM | 7306 | CD | GLU | I | 239 | −49.063 | −55.648 | 86.104 | 1.00 | 97.46 | D000 | C |
| ATOM | 7307 | OE1 | GLU | I | 239 | −50.264 | −55.495 | 85.787 | 1.00 | 95.00 | D000 | O |
| ATOM | 7308 | OE2 | GLU | I | 239 | −48.689 | −55.645 | 87.301 | 1.00 | 99.60 | D000 | O1− |
| ATOM | 7309 | N | GLN | I | 240 | −48.655 | −53.809 | 80.513 | 1.00 | 78.77 | D000 | N |
| ATOM | 7310 | CA | GLN | I | 240 | −49.716 | −53.126 | 79.762 | 1.00 | 74.65 | D000 | C |
| ATOM | 7311 | C | GLN | I | 240 | −49.744 | −53.472 | 78.266 | 1.00 | 75.43 | D000 | C |
| ATOM | 7312 | O | GLN | I | 240 | −48.690 | −53.736 | 77.678 | 1.00 | 70.27 | D000 | O |
| ATOM | 7313 | CB | GLN | I | 240 | −49.570 | −51.610 | 79.956 | 1.00 | 69.99 | D000 | C |
| ATOM | 7314 | CG | GLN | I | 240 | −49.627 | −51.179 | 81.421 | 1.00 | 73.64 | D000 | C |
| ATOM | 7315 | CD | GLN | I | 240 | −51.003 | −51.423 | 82.047 | 1.00 | 79.48 | D000 | C |
| ATOM | 7316 | OE1 | GLN | I | 240 | −51.278 | −52.503 | 82.587 | 1.00 | 78.83 | D000 | O |
| ATOM | 7317 | NE2 | GLN | I | 240 | −51.877 | −50.413 | 81.968 | 1.00 | 68.96 | D000 | N |
| ATOM | 7318 | N | PRO | I | 241 | −50.945 | −53.443 | 77.634 | 1.00 | 74.07 | D000 | N |
| ATOM | 7319 | CA | PRO | I | 241 | −52.250 | −53.045 | 78.188 | 1.00 | 70.37 | D000 | C |
| ATOM | 7320 | C | PRO | I | 241 | −52.840 | −54.061 | 79.178 | 1.00 | 75.66 | D000 | C |
| ATOM | 7321 | O | PRO | I | 241 | −53.904 | −54.638 | 78.940 | 1.00 | 82.05 | D000 | O |
| ATOM | 7322 | CB | PRO | I | 241 | −53.129 | −52.936 | 76.941 | 1.00 | 70.97 | D000 | C |
| ATOM | 7323 | CG | PRO | I | 241 | −52.543 | −53.932 | 75.998 | 1.00 | 67.57 | D000 | C |
| ATOM | 7324 | CD | PRO | I | 241 | −51.061 | −53.841 | 76.215 | 1.00 | 64.21 | D000 | C |
| ATOM | 7325 | N | GLY | I | 252 | −62.815 | −49.790 | 79.716 | 1.00 | 70.62 | D000 | N |
| ATOM | 7326 | CA | GLY | I | 252 | −62.424 | −49.267 | 81.017 | 1.00 | 74.95 | D000 | C |
| ATOM | 7327 | C | GLY | I | 252 | −61.035 | −48.648 | 81.048 | 1.00 | 70.30 | D000 | C |
| ATOM | 7328 | O | GLY | I | 252 | −60.698 | −47.871 | 81.940 | 1.00 | 66.65 | D000 | O |
| ATOM | 7329 | N | GLU | I | 253 | −60.214 | −49.020 | 80.065 | 1.00 | 73.32 | D000 | N |
| ATOM | 7330 | CA | GLU | I | 253 | −58.880 | −48.472 | 79.814 | 1.00 | 64.01 | D000 | C |
| ATOM | 7331 | C | GLU | I | 253 | −58.695 | −48.525 | 78.298 | 1.00 | 60.63 | D000 | C |
| ATOM | 7332 | O | GLU | I | 253 | −57.927 | −49.303 | 77.737 | 1.00 | 61.66 | D000 | O |
| ATOM | 7333 | CB | GLU | I | 253 | −57.775 | −49.234 | 80.548 | 1.00 | 65.40 | D000 | C |
| ATOM | 7334 | CG | GLU | I | 253 | −57.837 | −49.139 | 82.057 | 1.00 | 69.16 | D000 | C |
| ATOM | 7335 | CD | GLU | I | 253 | −57.007 | −50.206 | 82.724 | 1.00 | 72.49 | D000 | C |
| ATOM | 7336 | OE1 | GLU | I | 253 | −55.760 | −50.161 | 82.597 | 1.00 | 66.87 | D000 | O |

TABLE 10.4-continued

| | | | | | | | | | | | |
|---|---|---|---|---|---|---|---|---|---|---|---|
| ATOM | 7337 | OE2 | GLU | I | 253 | −57.610 | −51.095 | 83.367 | 1.00 | 87.80 | D000 O1− |
| ATOM | 7338 | N | ASP | I | 254 | −59.422 | −47.662 | 77.607 | 1.00 | 59.36 | D000 N |
| ATOM | 7339 | CA | ASP | I | 254 | −59.495 | −47.720 | 76.163 | 1.00 | 59.89 | D000 C |
| ATOM | 7340 | C | ASP | I | 254 | −58.603 | −46.688 | 75.471 | 1.00 | 54.78 | D000 C |
| ATOM | 7341 | O | ASP | I | 254 | −58.661 | −46.575 | 74.247 | 1.00 | 56.31 | D000 O |
| ATOM | 7342 | CB | ASP | I | 254 | −60.957 | −47.546 | 75.721 | 1.00 | 67.74 | D000 C |
| ATOM | 7343 | CG | ASP | I | 254 | −61.915 | −48.563 | 76.378 | 1.00 | 69.29 | D000 C |
| ATOM | 7344 | OD1 | ASP | I | 254 | −61.449 | −49.599 | 76.909 | 1.00 | 61.14 | D000 O |
| ATOM | 7345 | OD2 | ASP | I | 254 | −63.146 | −48.308 | 76.361 | 1.00 | 69.38 | D000 O1− |
| ATOM | 7346 | N | CYS | I | 255 | −57.789 | −45.925 | 76.210 | 1.00 | 47.78 | D000 N |
| ATOM | 7347 | CA | CYS | I | 255 | −56.967 | −44.877 | 75.608 | 1.00 | 41.04 | D000 C |
| ATOM | 7348 | C | CYS | I | 255 | −55.530 | −44.924 | 76.117 | 1.00 | 39.20 | D000 C |
| ATOM | 7349 | O | CYS | I | 255 | −55.295 | −45.211 | 77.290 | 1.00 | 41.84 | D000 O |
| ATOM | 7350 | CB | CYS | I | 255 | −57.559 | −43.510 | 75.866 | 1.00 | 41.88 | D000 C |
| ATOM | 7351 | SG | CYS | I | 255 | −59.123 | −43.260 | 75.028 | 1.00 | 54.50 | D000 S |
| ATOM | 7352 | N | ALA | I | 256 | −54.577 | −44.614 | 75.230 | 1.00 | 35.83 | D000 N |
| ATOM | 7353 | CA | ALA | I | 256 | −53.144 | −44.757 | 75.487 | 1.00 | 36.99 | D000 C |
| ATOM | 7354 | C | ALA | I | 256 | −52.466 | −43.414 | 75.756 | 1.00 | 31.83 | D000 C |
| ATOM | 7355 | O | ALA | I | 256 | −52.700 | −42.427 | 75.047 | 1.00 | 30.75 | D000 O |
| ATOM | 7356 | CB | ALA | I | 256 | −52.445 | −45.428 | 74.300 | 1.00 | 37.73 | D000 C |
| ATOM | 7357 | N | HIS | I | 257 | −51.584 | −43.386 | 76.754 | 1.00 | 31.20 | D000 N |
| ATOM | 7358 | CA | HIS | I | 257 | −50.871 | −42.153 | 77.060 | 1.00 | 31.95 | D000 C |
| ATOM | 7359 | C | HIS | I | 257 | −49.411 | −42.453 | 77.347 | 1.00 | 31.16 | D000 C |
| ATOM | 7360 | O | HIS | I | 257 | −49.056 | −43.554 | 77.782 | 1.00 | 30.03 | D000 O |
| ATOM | 7361 | CB | HIS | I | 257 | −51.523 | −41.373 | 78.240 | 1.00 | 28.18 | D000 C |
| ATOM | 7362 | CG | HIS | I | 257 | −51.545 | −42.119 | 79.546 | 1.00 | 35.85 | D000 C |
| ATOM | 7363 | ND1 | HIS | I | 257 | −50.561 | −41.985 | 80.501 | 1.00 | 32.60 | D000 N |
| ATOM | 7364 | CD2 | HIS | I | 257 | −52.433 | −43.010 | 80.051 | 1.00 | 37.79 | D000 C |
| ATOM | 7365 | CE1 | HIS | I | 257 | −50.842 | −42.756 | 81.535 | 1.00 | 33.70 | D000 C |
| ATOM | 7366 | NE2 | HIS | I | 257 | −51.975 | −43.385 | 81.290 | 1.00 | 38.87 | D000 N |
| ATOM | 7367 | N | PHE | I | 258 | −48.566 | −41.458 | 77.069 | 1.00 | 32.31 | D000 N |
| ATOM | 7368 | CA | PHE | I | 258 | −47.195 | −41.470 | 77.550 | 1.00 | 29.99 | D000 C |
| ATOM | 7369 | C | PHE | I | 258 | −47.186 | −41.294 | 79.066 | 1.00 | 32.50 | D000 C |
| ATOM | 7370 | O | PHE | I | 258 | −48.064 | −40.659 | 79.648 | 1.00 | 28.89 | D000 O |
| ATOM | 7371 | CB | PHE | I | 258 | −46.375 | −40.346 | 76.926 | 1.00 | 31.38 | D000 C |
| ATOM | 7372 | CG | PHE | I | 258 | −46.400 | −40.303 | 75.434 | 1.00 | 30.17 | D000 C |
| ATOM | 7373 | CD1 | PHE | I | 258 | −45.501 | −41.033 | 74.692 | 1.00 | 31.17 | D000 C |
| ATOM | 7374 | CD2 | PHE | I | 258 | −47.305 | −39.487 | 74.769 | 1.00 | 35.10 | D000 C |
| ATOM | 7375 | CE1 | PHE | I | 258 | −45.522 | −40.966 | 73.303 | 1.00 | 36.51 | D000 C |
| ATOM | 7376 | CE2 | PHE | I | 258 | −47.330 | −39.415 | 73.380 | 1.00 | 33.32 | D000 C |
| ATOM | 7377 | CZ | PHE | I | 258 | −46.440 | −40.152 | 72.648 | 1.00 | 29.52 | D000 C |
| ATOM | 7378 | N | THR | I | 259 | −46.212 | −41.900 | 79.709 | 1.00 | 33.00 | D000 N |
| ATOM | 7379 | CA | THR | I | 259 | −46.015 | −41.713 | 81.132 | 1.00 | 34.18 | D000 C |
| ATOM | 7380 | C | THR | I | 259 | −44.809 | −40.809 | 81.341 | 1.00 | 36.61 | D000 C |
| ATOM | 7381 | O | THR | I | 259 | −44.172 | −40.339 | 80.389 | 1.00 | 38.23 | D000 O |
| ATOM | 7382 | CB | THR | I | 259 | −45.834 | −43.049 | 81.856 | 1.00 | 36.60 | D000 C |
| ATOM | 7383 | OG1 | THR | I | 259 | −44.598 | −43.658 | 81.448 | 1.00 | 38.29 | D000 O |
| ATOM | 7384 | CG2 | THR | I | 259 | −47.006 | −43.966 | 81.583 | 1.00 | 32.69 | D000 C |
| ATOM | 7385 | N | ASP | I | 260 | −44.535 | −40.524 | 82.610 | 1.00 | 36.88 | D000 N |
| ATOM | 7386 | CA | ASP | I | 260 | −43.424 | −39.664 | 82.983 | 1.00 | 36.02 | D000 C |
| ATOM | 7387 | C | ASP | I | 260 | −42.065 | −40.201 | 82.520 | 1.00 | 37.71 | D000 C |
| ATOM | 7388 | O | ASP | I | 260 | −41.091 | −39.443 | 82.545 | 1.00 | 42.78 | D000 O |
| ATOM | 7389 | CB | ASP | I | 260 | −43.475 | −39.440 | 84.501 | 1.00 | 38.98 | D000 C |
| ATOM | 7390 | CG | ASP | I | 260 | −43.369 | −40.730 | 85.292 | 1.00 | 40.08 | D000 C |
| ATOM | 7391 | OD1 | ASP | I | 260 | −43.567 | −41.816 | 84.709 | 1.00 | 45.52 | D000 O |
| ATOM | 7392 | OD2 | ASP | I | 260 | −43.171 | −40.658 | 86.518 | 1.00 | 38.74 | D000 O1− |
| ATOM | 7393 | N | ASP | I | 261 | −41.964 | −41.467 | 82.099 | 1.00 | 33.98 | D000 N |
| ATOM | 7394 | CA | ASP | I | 261 | −40.713 | −42.008 | 81.579 | 1.00 | 35.49 | D000 C |
| ATOM | 7395 | C | ASP | I | 261 | −40.771 | −42.320 | 80.090 | 1.00 | 41.58 | D000 C |
| ATOM | 7396 | O | ASP | I | 261 | −39.833 | −42.910 | 79.550 | 1.00 | 41.61 | D000 O |
| ATOM | 7397 | CB | ASP | I | 261 | −40.289 | −43.240 | 82.374 | 1.00 | 31.38 | D000 C |
| ATOM | 7398 | CG | ASP | I | 261 | −41.194 | −44.433 | 82.150 | 1.00 | 44.50 | D000 C |
| ATOM | 7399 | OD1 | ASP | I | 261 | −42.145 | −44.348 | 81.338 | 1.00 | 49.19 | D000 O |
| ATOM | 7400 | OD2 | ASP | I | 261 | −40.992 | −45.454 | 82.454 | 1.00 | 82.843 | D000 O1− |
| ATOM | 7401 | N | GLY | I | 262 | −41.853 | −41.954 | 79.414 | 1.00 | 43.44 | D000 N |
| ATOM | 7402 | CA | GLY | I | 262 | −41.983 | −42.127 | 77.991 | 1.00 | 39.17 | D000 C |
| ATOM | 7403 | C | GLY | I | 262 | −42.711 | −43.389 | 77.570 | 1.00 | 36.69 | D000 C |
| ATOM | 7404 | O | GLY | I | 262 | −43.387 | −43.377 | 76.537 | 1.00 | 31.77 | D000 O |
| ATOM | 7405 | N | ARG | I | 263 | −42.625 | −44.459 | 78.358 | 1.00 | 32.80 | D000 N |
| ATOM | 7406 | CA | ARG | I | 263 | −43.300 | −45.692 | 77.987 | 1.00 | 40.54 | D000 C |
| ATOM | 7407 | C | ARG | I | 263 | −44.820 | −45.549 | 78.138 | 1.00 | 42.34 | D000 C |
| ATOM | 7408 | O | ARG | I | 263 | −45.335 | −44.731 | 78.905 | 1.00 | 38.87 | D000 O |
| ATOM | 7409 | CB | ARG | I | 263 | −42.773 | −46.854 | 78.822 | 1.00 | 43.57 | D000 C |
| ATOM | 7410 | CG | ARG | I | 263 | −41.309 | −47.117 | 78.559 | 1.00 | 42.00 | D000 C |
| ATOM | 7411 | CD | ARG | I | 263 | −40.789 | −48.259 | 79.373 | 1.00 | 43.37 | D000 C |
| ATOM | 7412 | NE | ARG | I | 263 | −41.000 | −48.089 | 80.802 | 1.00 | 47.00 | D000 N |
| ATOM | 7413 | CZ | ARG | I | 263 | −40.718 | −49.024 | 81.706 | 1.00 | 54.61 | D000 C |
| ATOM | 7414 | NH1 | ARG | I | 263 | −40.206 | −50.187 | 81.325 | 1.00 | 56.14 | D000 N1+ |
| ATOM | 7415 | NH2 | ARG | I | 263 | −40.954 | −48.806 | 82.995 | 1.00 | 57.34 | D000 N |
| ATOM | 7416 | N | TRP | I | 264 | −45.545 | −46.362 | 77.390 | 1.00 | 41.85 | D000 N |

TABLE 10.4-continued

| ATOM | 7417 | CA | TRP | I | 264 | −46.964 | −46.115 | 77.212 | 1.00 | 40.32 | D000 | C |
| --- | --- | --- | --- | --- | --- | --- | --- | --- | --- | --- | --- | --- |
| ATOM | 7418 | C | TRP | I | 264 | −47.801 | −46.797 | 78.282 | 1.00 | 39.94 | D000 | C |
| ATOM | 7419 | O | TRP | I | 264 | −47.377 | −47.759 | 78.922 | 1.00 | 45.09 | D000 | O |
| ATOM | 7420 | CB | TRP | I | 264 | −47.427 | −46.610 | 75.851 | 1.00 | 41.81 | D000 | C |
| ATOM | 7421 | CG | TRP | I | 264 | −46.709 | −46.051 | 74.695 | 1.00 | 36.80 | D000 | C |
| ATOM | 7422 | CD1 | TRP | I | 264 | −45.834 | −45.016 | 74.688 | 1.00 | 37.17 | D000 | C |
| ATOM | 7423 | CD2 | TRP | I | 264 | −46.807 | −46.512 | 73.349 | 1.00 | 41.41 | D000 | C |
| ATOM | 7424 | NE1 | TRP | I | 264 | −45.377 | −44.795 | 73.417 | 1.00 | 37.55 | D000 | N |
| ATOM | 7425 | CE2 | TRP | I | 264 | −45.957 | −45.707 | 72.574 | 1.00 | 42.77 | D000 | C |
| ATOM | 7426 | CE3 | TRP | I | 264 | −47.530 | −47.534 | 72.724 | 1.00 | 37.74 | D000 | C |
| ATOM | 7427 | CZ2 | TRP | I | 264 | −45.810 | −45.888 | 71.205 | 1.00 | 40.50 | D000 | C |
| ATOM | 7428 | CZ3 | TRP | I | 264 | −47.378 | −47.716 | 71.383 | 1.00 | 38.97 | D000 | C |
| ATOM | 7429 | CH2 | TRP | I | 264 | −46.536 | −46.894 | 70.631 | 1.00 | 44.66 | D000 | C |
| ATOM | 7430 | N | ASN | I | 265 | −49.029 | −46.309 | 78.432 | 1.00 | 37.04 | D000 | N |
| ATOM | 7431 | CA | ASN | I | 265 | −49.963 | −46.923 | 79.356 | 1.00 | 37.46 | D000 | C |
| ATOM | 7432 | C | ASN | I | 265 | −51.387 | −46.554 | 78.963 | 1.00 | 37.95 | D000 | C |
| ATOM | 7433 | O | ASN | I | 265 | −51.631 | −45.512 | 78.353 | 1.00 | 36.28 | D000 | O |
| ATOM | 7434 | CB | ASN | I | 265 | −49.655 | −46.518 | 80.791 | 1.00 | 40.53 | D000 | C |
| ATOM | 7435 | CG | ASN | I | 265 | −50.611 | −47.123 | 81.765 | 1.00 | 49.10 | D000 | C |
| ATOM | 7436 | OD1 | ASN | I | 265 | −50.635 | −48.337 | 81.939 | 1.00 | 51.66 | D000 | O |
| ATOM | 7437 | ND2 | ASN | I | 265 | −51.389 | −46.281 | 82.440 | 1.00 | 49.67 | D000 | N |
| ATOM | 7438 | N | ASP | I | 266 | −52.314 | −47.446 | 79.291 | 1.00 | 45.60 | D000 | N |
| ATOM | 7439 | CA | ASP | I | 266 | −53.738 | −47.257 | 79.058 | 1.00 | 45.74 | D000 | C |
| ATOM | 7440 | C | ASP | I | 266 | −54.403 | −46.761 | 80.331 | 1.00 | 47.12 | D000 | C |
| ATOM | 7441 | O | ASP | I | 266 | −54.070 | −47.212 | 81.429 | 1.00 | 52.08 | D000 | O |
| ATOM | 7442 | CB | ASP | I | 266 | −54.413 | −48.561 | 78.615 | 1.00 | 52.43 | D000 | C |
| ATOM | 7443 | CG | ASP | I | 266 | −54.095 | −49.732 | 79.538 | 1.00 | 60.22 | D000 | C |
| ATOM | 7444 | OD1 | ASP | I | 266 | −52.905 | −49.973 | 79.827 | 1.00 | 64.14 | D000 | O |
| ATOM | 7445 | OD2 | ASP | I | 266 | −55.035 | −50.421 | 79.977 | 1.00 | 67.69 | D000 | O1− |
| ATOM | 7446 | N | ASP | I | 267 | −55.347 | −45.838 | 80.176 | 1.00 | 44.83 | D000 | N |
| ATOM | 7447 | CA | ASP | I | 267 | −56.072 | −45.253 | 81.295 | 1.00 | 49.89 | D000 | C |
| ATOM | 7448 | C | ASP | I | 267 | −57.475 | −44.917 | 80.805 | 1.00 | 46.26 | D000 | C |
| ATOM | 7449 | O | ASP | I | 267 | −57.782 | −45.069 | 79.623 | 1.00 | 47.12 | D000 | O |
| ATOM | 7450 | CB | ASP | I | 267 | −55.339 | −44.020 | 81.860 | 1.00 | 46.24 | D000 | C |
| ATOM | 7451 | CG | ASP | I | 267 | −55.846 | −43.631 | 83.228 | 1.00 | 48.24 | D000 | C |
| ATOM | 7452 | OD1 | ASP | I | 267 | −56.671 | −44.391 | 83.773 | 1.00 | 56.95 | D000 | O |
| ATOM | 7453 | OD2 | ASP | I | 267 | −55.448 | −42.573 | 83.754 | 1.00 | 49.05 | D000 | O1− |
| ATOM | 7454 | N | VAL | I | 268 | −58.347 | −44.502 | 81.727 | 1.00 | 41.94 | D000 | N |
| ATOM | 7455 | CA | VAL | I | 268 | −59.707 | −44.168 | 81.328 | 1.00 | 44.09 | D000 | C |
| ATOM | 7456 | C | VAL | I | 268 | −59.676 | −42.946 | 80.419 | 1.00 | 44.94 | D000 | C |
| ATOM | 7457 | O | VAL | I | 268 | −58.896 | −42.007 | 80.629 | 1.00 | 44.57 | D000 | O |
| ATOM | 7458 | CB | VAL | I | 268 | −60.606 | −43.939 | 82.554 | 1.00 | 40.01 | D000 | C |
| ATOM | 7459 | CG1 | VAL | I | 268 | −60.463 | −45.079 | 83.506 | 1.00 | 42.61 | D000 | C |
| ATOM | 7460 | CG2 | VAL | I | 268 | −60.274 | −42.634 | 83.242 | 1.00 | 40.82 | D000 | C |
| ATOM | 7461 | N | CYS | I | 269 | −60.506 | −42.962 | 79.379 | 1.00 | 38.74 | D000 | N |
| ATOM | 7462 | CA | CYS | I | 269 | −60.422 | −41.901 | 78.385 | 1.00 | 41.24 | D000 | C |
| ATOM | 7463 | C | CYS | I | 269 | −60.908 | −40.569 | 78.913 | 1.00 | 35.89 | D000 | C |
| ATOM | 7464 | O | CYS | I | 269 | −60.800 | −39.554 | 78.219 | 1.00 | 40.53 | D000 | O |
| ATOM | 7465 | CB | CYS | I | 269 | −61.204 | −42.298 | 77.127 | 1.00 | 43.34 | D000 | C |
| ATOM | 7466 | SG | CYS | I | 269 | −60.582 | −43.835 | 76.370 | 1.00 | 57.52 | D000 | S |
| ATOM | 7467 | N | GLN | I | 270 | −61.422 | −40.534 | 80.127 | 1.00 | 37.09 | D000 | N |
| ATOM | 7468 | CA | GLN | I | 270 | −61.959 | −39.299 | 80.666 | 1.00 | 35.74 | D000 | C |
| ATOM | 7469 | C | GLN | I | 270 | −60.892 | −38.406 | 81.284 | 1.00 | 33.91 | D000 | C |
| ATOM | 7470 | O | GLN | I | 270 | −61.156 | −37.213 | 81.465 | 1.00 | 36.79 | D000 | O |
| ATOM | 7471 | CB | GLN | I | 270 | −63.029 | −39.618 | 81.709 | 1.00 | 43.76 | D000 | C |
| ATOM | 7472 | CG | GLN | I | 270 | −64.394 | −39.929 | 81.095 | 1.00 | 52.98 | D000 | C |
| ATOM | 7473 | CD | GLN | I | 270 | −64.451 | −41.352 | 80.534 | 1.00 | 53.45 | D000 | C |
| ATOM | 7474 | OE1 | GLN | I | 270 | −63.849 | −42.272 | 81.106 | 1.00 | 52.07 | D000 | O |
| ATOM | 7475 | NE2 | GLN | I | 270 | −65.156 | −41.535 | 79.407 | 1.00 | 46.18 | D000 | N |
| ATOM | 7476 | N | ARG | I | 271 | −59.698 | −38.940 | 81.589 | 1.00 | 33.55 | D000 | N |
| ATOM | 7477 | CA | ARG | I | 271 | −58.656 | −38.139 | 82.228 | 1.00 | 34.17 | D000 | C |
| ATOM | 7478 | C | ARG | I | 271 | −58.333 | −36.927 | 81.364 | 1.00 | 35.86 | D000 | C |
| ATOM | 7479 | O | ARG | I | 271 | −58.224 | −37.058 | 80.136 | 1.00 | 34.42 | D000 | O |
| ATOM | 7480 | CB | ARG | I | 271 | −57.380 | −38.947 | 82.464 | 1.00 | 36.48 | D000 | C |
| ATOM | 7481 | CG | ARG | I | 271 | −57.518 | −40.084 | 83.447 | 1.00 | 39.60 | D000 | C |
| ATOM | 7482 | CD | ARG | I | 271 | −57.065 | −39.699 | 84.838 | 1.00 | 45.14 | D000 | C |
| ATOM | 7483 | NE | ARG | I | 271 | −57.534 | −40.662 | 85.844 | 1.00 | 59.73 | D000 | N |
| ATOM | 7484 | CZ | ARG | I | 271 | −58.422 | −40.401 | 86.810 | 1.00 | 58.63 | D000 | C |
| ATOM | 7485 | NH1 | ARG | I | 271 | −58.962 | −39.185 | 96.947 | 1.00 | 54.22 | D000 | N1+ |
| ATOM | 7486 | NH2 | ARG | I | 271 | −58.758 | −41.360 | 87.660 | 1.00 | 55.45 | D000 | N |
| ATOM | 7487 | N | PRO | I | 272 | −58.230 | −35.749 | 81.936 | 1.00 | 32.00 | D000 | N |
| ATOM | 7488 | CA | PRO | I | 272 | −57.855 | −34.553 | 81.148 | 1.00 | 29.00 | D000 | C |
| ATOM | 7489 | C | PRO | I | 272 | −56.342 | −34.344 | 81.068 | 1.00 | 32.23 | D000 | C |
| ATOM | 7490 | O | PRO | I | 272 | −55.758 | −33.416 | 81.633 | 1.00 | 31.22 | D000 | O |
| ATOM | 7491 | CB | PRO | I | 272 | −58.583 | −33.433 | 81.892 | 1.00 | 26.05 | D000 | C |
| ATOM | 7492 | CG | PRO | I | 272 | −58.775 | −33.959 | 83.324 | 1.00 | 28.86 | D000 | C |
| ATOM | 7493 | CO | PRO | I | 272 | −58.499 | −35.435 | 83.347 | 1.00 | 27.78 | D000 | C |
| ATOM | 7494 | N | TYR | I | 273 | −55.680 | −35.225 | 80.325 | 1.00 | 32.52 | D000 | N |
| ATOM | 7495 | CA | TYR | I | 273 | −54.251 | −35.145 | 80.086 | 1.00 | 29.17 | D000 | C |
| ATOM | 7496 | C | TYR | I | 273 | −53.931 | −34.170 | 78.946 | 1.00 | 28.33 | D000 | C |

TABLE 10.4-continued

| | | | | | | | | | | | |
|---|---|---|---|---|---|---|---|---|---|---|---|
| ATOM | 7497 | O | TYR | I | 273 | −54.790 | −33.766 | 78.166 | 1.00 | 26.77 | D000 O |
| ATOM | 7498 | CB | TYR | I | 273 | −53.689 | −36.524 | 79.748 | 1.00 | 26.56 | D000 C |
| ATOM | 7499 | CG | TYR | I | 273 | −53.687 | −37.527 | 80.867 | 1.00 | 26.99 | D000 C |
| ATOM | 7500 | CD1 | TYR | I | 273 | −53.588 | −37.129 | 82.194 | 1.00 | 29.63 | D000 C |
| ATOM | 7501 | CD2 | TYR | I | 273 | −53.757 | −38.883 | 80.594 | 1.00 | 28.80 | D000 C |
| ATOM | 7502 | CE1 | TYR | I | 273 | −53.582 | −38.057 | 83.212 | 1.00 | 28.90 | D000 C |
| ATOM | 7503 | CE2 | TYR | I | 273 | −53.737 | −39.825 | 81.609 | 1.00 | 32.53 | D000 C |
| ATOM | 7504 | CZ | TYR | I | 273 | −53.656 | −39.404 | 82.911 | 1.00 | 29.59 | D000 C |
| ATOM | 7505 | OH | TYR | I | 273 | −53.634 | −40.338 | 83.910 | 1.00 | 29.82 | D000 O |
| ATOM | 7506 | N | ARG | I | 274 | −52.672 | −33.768 | 78.882 | 1.00 | 28.32 | D000 N |
| ATOM | 7507 | CA | ARG | I | 274 | −52.212 | −33.033 | 77.729 | 1.00 | 27.19 | D000 C |
| ATOM | 7508 | C | ARG | I | 274 | −52.169 | −33.971 | 76.536 | 1.00 | 26.48 | D000 C |
| ATOM | 7509 | O | ARG | I | 274 | −52.280 | −35.187 | 76.673 | 1.00 | 28.05 | D000 O |
| ATOM | 7510 | CB | ARG | I | 274 | −50.857 | −32.403 | 78.011 | 1.00 | 24.95 | D000 C |
| ATOM | 7511 | CG | ARG | I | 274 | −50.926 | −31.334 | 79.066 | 1.00 | 25.95 | D000 C |
| ATOM | 7512 | CD | ARG | I | 274 | −49.541 | −30.802 | 79.382 | 1.00 | 28.18 | D000 C |
| ATOM | 7513 | NE | ARG | I | 274 | −49.548 | −29.767 | 80.411 | 1.00 | 27.97 | D000 N |
| ATOM | 7514 | CZ | ARG | I | 274 | −48.464 | −29.347 | 81.063 | 1.00 | 29.49 | D000 C |
| ATOM | 7515 | NH1 | ARG | I | 274 | −47.274 | −29.877 | 80.802 | 1.00 | 24.44 | D000 N1+ |
| ATOM | 7516 | NH2 | ARG | I | 274 | −48.567 | −28.400 | 81.992 | 1.00 | 28.37 | D000 N |
| ATOM | 7517 | N | TRP | I | 275 | −52.038 | −33.395 | 75.344 | 1.00 | 27.91 | D000 N |
| ATOM | 7518 | CA | TRP | I | 275 | −52.039 | −34.203 | 74.138 | 1.00 | 28.85 | D000 C |
| ATOM | 7519 | C | TRP | I | 275 | −51.106 | −33.568 | 73.105 | 1.00 | 30.78 | D000 C |
| ATOM | 7520 | O | TRP | I | 275 | −50.671 | −32.410 | 73.241 | 1.00 | 27.47 | D000 O |
| ATOM | 7521 | CB | TRP | I | 275 | −53.473 | −34.368 | 73.600 | 1.00 | 23.59 | D000 C |
| ATOM | 7522 | CG | TRP | I | 275 | −54.009 | −33.123 | 72.979 | 1.00 | 26.26 | D000 C |
| ATOM | 7523 | CD1 | TRP | I | 275 | −53.991 | −32.808 | 71.648 | 1.00 | 26.24 | D000 C |
| ATOM | 7524 | CD2 | TRP | I | 275 | −54.629 | −32.005 | 73.643 | 1.00 | 27.84 | D000 C |
| ATOM | 7525 | NE1 | TRP | I | 275 | −54.549 | −31.571 | 71.442 | 1.00 | 27.63 | D000 N |
| ATOM | 7526 | CE2 | TRP | I | 275 | −54.959 | −31.059 | 72.646 | 1.00 | 29.00 | D000 C |
| ATOM | 7527 | CE3 | TRP | I | 275 | −54.949 | −31.718 | 74.971 | 1.00 | 27.22 | D000 C |
| ATOM | 7528 | CZ2 | TRP | I | 275 | −55.589 | −29.850 | 72.941 | 1.00 | 23.11 | D000 C |
| ATOM | 7529 | CZ3 | TRP | I | 275 | −55.572 | −30.511 | 75.258 | 1.00 | 26.94 | D000 C |
| ATOM | 7530 | CH2 | TRP | I | 275 | −55.876 | −29.595 | 74.248 | 1.00 | 27.13 | D000 C |
| ATOM | 7531 | N | VAL | I | 276 | −50.827 | −34.338 | 72.051 | 1.00 | 26.77 | D000 N |
| ATOM | 7532 | CA | VAL | I | 276 | −49.950 | −33.930 | 70.959 | 1.00 | 29.58 | D000 C |
| ATOM | 7533 | C | VAL | I | 276 | −50.723 | −34.063 | 69.650 | 1.00 | 29.99 | D000 C |
| ATOM | 7534 | O | VAL | I | 276 | −51.233 | −35.146 | 69.335 | 1.00 | 32.34 | D000 O |
| ATOM | 7535 | CB | VAL | I | 276 | −48.666 | −34.790 | 70.916 | 1.00 | 34.01 | D000 C |
| ATOM | 7536 | CG1 | VAL | I | 276 | −47.726 | −34.358 | 69.768 | 1.00 | 25.34 | D000 C |
| ATOM | 7537 | CG2 | VAL | I | 276 | −47.957 | −34.821 | 72.259 | 1.00 | 22.27 | D000 C |
| ATOM | 7538 | N | CYS | I | 277 | −50.815 | −32.973 | 68.892 | 1.00 | 30.05 | D000 N |
| ATOM | 7539 | CA | CYS | I | 277 | −51.289 | −33.032 | 67.507 | 1.00 | 36.56 | D000 C |
| ATOM | 7540 | C | CYS | I | 277 | −50.113 | −33.216 | 66.544 | 1.00 | 39.90 | D000 C |
| ATOM | 7541 | O | CYS | I | 277 | −49.037 | −32.638 | 66.739 | 1.00 | 34.93 | D000 O |
| ATOM | 7542 | CB | CYS | I | 277 | −52.054 | −31.764 | 67.111 | 1.00 | 33.98 | D000 C |
| ATOM | 7543 | SG | CYS | I | 277 | −53.711 | −31.466 | 67.812 | 1.00 | 42.15 | D000 S |
| ATOM | 7544 | N | GLU | I | 278 | −50.336 | −34.004 | 65.486 | 1.00 | 37.84 | D000 N |
| ATOM | 7545 | CA | GLU | I | 278 | −49.361 | −34.207 | 64.419 | 1.00 | 38.01 | D000 C |
| ATOM | 7546 | C | GLU | I | 278 | −49.980 | −33.930 | 63.054 | 1.00 | 40.54 | D000 C |
| ATOM | 7547 | O | GLU | I | 278 | −51.105 | −34.354 | 62.766 | 1.00 | 41.44 | D000 O |
| ATOM | 7548 | CB | GLU | I | 278 | −48.801 | −35.646 | 64.430 | 1.00 | 36.62 | D000 C |
| ATOM | 7549 | CG | GLU | I | 278 | −47.685 | −35.926 | 63.414 | 1.00 | 36.43 | D000 C |
| ATOM | 7550 | CD | GLU | I | 278 | −47.249 | −37.379 | 63.472 | 1.00 | 44.33 | D000 C |
| ATOM | 7551 | OE1 | GLU | I | 278 | −47.852 | −38.105 | 64.290 | 1.00 | 43.28 | D000 O |
| ATOM | 7552 | OE2 | GLU | I | 278 | −46.341 | −37.806 | 62.708 | 1.00 | 44.12 | D000 O1− |
| ATOM | 7553 | N | THR | I | 279 | −49.215 | −33.280 | 62.187 | 1.00 | 40.86 | D000 N |
| ATOM | 7554 | CA | THR | I | 279 | −49.596 | −33.153 | 60.789 | 1.00 | 45.51 | D000 C |
| ATOM | 7555 | C | THR | I | 279 | −48.349 | −33.290 | 59.921 | 1.00 | 50.70 | D000 C |
| ATOM | 7556 | O | THR | I | 279 | −47.274 | −32.791 | 60.269 | 1.00 | 52.15 | D000 O |
| ATOM | 7557 | CB | THR | I | 279 | −50.344 | −31.830 | 60.515 | 1.00 | 40.68 | D000 C |
| ATOM | 7558 | OG1 | THR | I | 279 | −50.995 | −31.916 | 59.247 | 1.00 | 46.37 | D000 O |
| ATOM | 7559 | CG2 | THR | I | 279 | −49.413 | −30.622 | 60.530 | 1.00 | 40.76 | D000 C |
| ATOM | 7560 | N | GLU | I | 280 | −48.502 | −33.993 | 58.801 | 1.00 | 51.69 | D000 N |
| ATOM | 7561 | CA | GLU | I | 280 | −47.419 | −34.287 | 57.872 | 1.00 | 49.36 | D000 C |
| ATOM | 7562 | C | GLU | I | 280 | −47.271 | −33.158 | 56.860 | 1.00 | 56.06 | D000 C |
| ATOM | 7563 | O | GLU | I | 280 | −48.253 | −32.530 | 56.466 | 1.00 | 60.37 | D000 O |
| ATOM | 7564 | CB | GLU | I | 280 | −47.687 | −35.615 | 57.154 | 1.00 | 46.67 | D000 C |
| ATOM | 7565 | CG | GLU | I | 280 | −47.603 | −36.893 | 58.036 | 1.00 | 52.72 | D000 C |
| ATOM | 7566 | CD | GLU | I | 280 | −48.756 | −37.083 | 59.067 | 1.00 | 61.50 | D000 C |
| ATOM | 7567 | OE1 | GLU | I | 280 | −49.701 | −36.259 | 59.124 | 1.00 | 55.57 | D000 O |
| ATOM | 7568 | OE2 | GLU | I | 280 | −48.724 | −38.095 | 59.816 | 1.00 | 65.48 | D000 O1− |
| ATOM | 7569 | N | LEU | I | 281 | −46.024 | −32.894 | 56.450 | 1.00 | 68.28 | D000 N |
| ATOM | 7570 | CA | LEU | I | 281 | −45.668 | −31.688 | 55.705 | 1.00 | 66.92 | D000 C |
| ATOM | 7571 | C | LEU | I | 281 | −45.742 | −31.880 | 54.192 | 1.00 | 77.57 | D000 C |
| ATOM | 7572 | O | LEU | I | 281 | −45.234 | −31.029 | 53.454 | 1.00 | 82.51 | D000 O |
| ATOM | 7573 | CB | LEU | I | 281 | −44.264 | −31.217 | 56.095 | 1.00 | 62.30 | D000 C |
| ATOM | 7574 | CG | LEU | I | 281 | −44.155 | −29.845 | 56.772 | 1.00 | 72.01 | D000 C |
| ATOM | 7575 | CD1 | LEU | I | 281 | −42.720 | −29.512 | 57.120 | 1.00 | 70.45 | D000 C |
| ATOM | 7576 | CD2 | LEU | I | 281 | −44.746 | −28.748 | 55.893 | 1.00 | 76.75 | D000 C |

TABLE 10.4-continued

| | | | | | | | | | | | |
|---|---|---|---|---|---|---|---|---|---|---|---|
| ATOM | 7577 | N | ASP | I | 282 | −46.399 | −32.958 | 53.737 | 1.00 | 85.50 | D000 N |
| ATOM | 7578 | CA | ASP | I | 282 | −46.623 | −33.356 | 52.326 | 1.00 | 86.01 | D000 C |
| ATOM | 7579 | C | ASP | I | 282 | −45.384 | −34.002 | 51.715 | 1.00 | 79.75 | D000 C |
| ATOM | 7580 | O | ASP | I | 282 | −45.258 | −35.228 | 51.711 | 1.00 | 78.04 | D000 O |
| ATOM | 7581 | CB | ASP | I | 282 | −47.092 | −32.180 | 51.440 | 1.00 | 96.47 | D000 C |
| ATOM | 7582 | CG | ASP | I | 282 | −48.461 | −31.617 | 51.857 | 1.00 | 96.65 | D000 C |
| ATOM | 7583 | OD1 | ASP | I | 282 | −48.811 | −31.701 | 53.055 | 1.00 | 90.88 | D000 O |
| ATOM | 7584 | OD2 | ASP | I | 282 | −49.190 | −31.087 | 50.977 | 1.00 | 93.64 | D000 O1− |
| TER | | | | | | | | | | | |
| ATOM | 7585 | N | THR | P | 152 | −18.008 | −35.866 | 53.223 | 1.00 | 83.74 | D000 N |
| ATOM | 7586 | CA | THR | P | 152 | −19.403 | −36.301 | 53.203 | 1.00 | 93.67 | D000 C |
| ATOM | 7587 | C | THR | P | 152 | −19.882 | −36.656 | 54.610 | 1.00 | 97.43 | D000 C |
| ATOM | 7588 | O | THR | P | 152 | −21.055 | −36.465 | 54.949 | 1.00 | 99.74 | D000 O |
| ATOM | 7589 | CB | THR | P | 152 | −19.616 | −37.526 | 52.274 | 1.00 | 95.00 | D000 C |
| ATOM | 7590 | OG1 | THR | P | 152 | −18.515 | −38.434 | 52.412 | 1.00 | 96.24 | D000 O |
| ATOM | 7591 | CG2 | THR | P | 152 | −19.745 | −37.100 | 50.820 | 1.00 | 89.07 | D000 C |
| ATOM | 7592 | N | CYS | P | 153 | −18.962 | −37.176 | 55.422 | 1.00 | 93.53 | D000 N |
| ATOM | 7593 | CA | CYS | P | 153 | −19.248 | −37.564 | 56.798 | 1.00 | 86.06 | D000 C |
| ATOM | 7594 | C | CYS | P | 153 | −18.009 | −37.320 | 57.642 | 1.00 | 73.09 | D000 C |
| ATOM | 7595 | O | CYS | P | 153 | −16.902 | −37.129 | 57.131 | 1.00 | 68.83 | D000 O |
| ATOM | 7596 | CB | CYS | P | 153 | −19.718 | −39.025 | 56.941 | 1.00 | 85.43 | D000 C |
| ATOM | 7597 | SG | CYS | P | 153 | −21.535 | −39.281 | 56.843 | 1.00 | 98.27 | D000 S |
| ATOM | 7598 | N | CYS | P | 154 | −18.209 | −37.292 | 58.847 | 1.00 | 71.85 | D000 N |
| ATOM | 7599 | CA | CYS | P | 154 | −17.147 | −37.059 | 59.803 | 1.00 | 58.19 | D000 C |
| ATOM | 7600 | C | CYS | P | 154 | −16.521 | −38.377 | 60.251 | 1.00 | 53.75 | D000 C |
| ATOM | 7601 | O | CYS | P | 154 | −17.198 | −39.409 | 60.291 | 1.00 | 57.74 | D000 O |
| ATOM | 7602 | CB | CYS | P | 154 | −17.697 | −36.208 | 61.010 | 1.00 | 51.76 | D000 C |
| ATOM | 7603 | SG | CYS | P | 154 | −18.273 | −34.615 | 60.600 | 1.00 | 60.05 | D000 S |
| ATOM | 7604 | N | PRO | P | 155 | −15.231 | −38.360 | 60.584 | 1.00 | 46.56 | D000 N |
| ATOM | 7605 | CA | PRO | P | 155 | −14.547 | −39.591 | 61.004 | 1.00 | 44.27 | D000 C |
| ATOM | 7606 | C | PRO | P | 155 | −15.153 | −40.210 | 62.258 | 1.00 | 48.95 | D000 C |
| ATOM | 7607 | O | PRO | P | 155 | −15.934 | −39.588 | 62.987 | 1.00 | 49.26 | D000 O |
| ATOM | 7608 | CB | PRO | P | 155 | −13.109 | −39.126 | 61.268 | 1.00 | 42.58 | D000 C |
| ATOM | 7609 | CG | PRO | P | 155 | −12.971 | −37.842 | 60.535 | 1.00 | 40.45 | D000 C |
| ATOM | 7610 | CD | PRO | P | 155 | −14.317 | −37.209 | 60.522 | 1.00 | 44.50 | D000 C |
| ATOM | 7611 | N | VAL | P | 156 | −14.786 | −41.475 | 62.492 | 1.00 | 50.73 | D000 N |
| ATOM | 7612 | CA | VAL | P | 156 | −15.268 | −42.191 | 63.670 | 1.00 | 48.55 | D000 C |
| ATOM | 7613 | C | VAL | P | 156 | −14.926 | −40.390 | 64.914 | 1.00 | 49.57 | D000 C |
| ATOM | 7614 | O | VAL | P | 156 | −13.791 | −40.923 | 65.071 | 1.00 | 49.11 | D000 O |
| ATOM | 7615 | CB | VAL | P | 156 | −14.658 | −43.599 | 63.733 | 1.00 | 49.04 | D000 C |
| ATOM | 7616 | CG1 | VAL | P | 156 | −15.733 | −44.639 | 63.993 | 1.00 | 37.71 | D000 C |
| ATOM | 7617 | CG2 | VAL | P | 156 | −13.879 | −43.914 | 62.449 | 1.00 | 56.31 | D000 C |
| ATOM | 7618 | N | ASN | P | 157 | −15.919 | −41.205 | 65.791 | 1.00 | 49.29 | D000 N |
| ATOM | 7619 | CA | ASN | P | 157 | −15.831 | −40.490 | 67.074 | 1.00 | 45.69 | D000 C |
| ATOM | 7620 | C | ASN | P | 157 | −15.791 | −38.976 | 66.917 | 1.00 | 42.84 | D000 C |
| ATOM | 7621 | O | ASN | P | 157 | −15.571 | −38.265 | 67.913 | 1.00 | 42.59 | D000 O |
| ATOM | 7622 | CB | ASN | P | 157 | −14.592 | −40.896 | 67.878 | 1.00 | 46.95 | D000 C |
| ATOM | 7623 | CG | ASN | P | 157 | −14.548 | −42.372 | 68.177 | 1.00 | 48.62 | D000 C |
| ATOM | 7624 | OD1 | ASN | P | 157 | −15.544 | −42.976 | 68.582 | 1.00 | 51.67 | D000 O |
| ATOM | 7625 | ND2 | ASN | P | 157 | −13.396 | −42.973 | 67.937 | 1.00 | 38.36 | D000 N |
| ATOM | 7626 | N | TRP | P | 158 | −16.009 | −38.453 | 65.719 | 1.00 | 42.42 | D000 N |
| ATOM | 7627 | CA | TRP | P | 158 | −16.226 | −37.030 | 65.523 | 1.00 | 41.39 | D000 C |
| ATOM | 7628 | C | TRP | P | 158 | −17.714 | −36.789 | 65.274 | 1.00 | 42.54 | D000 C |
| ATOM | 7629 | O | TRP | P | 158 | −18.454 | −37.697 | 64.895 | 1.00 | 47.35 | D000 O |
| ATOM | 7630 | CB | TRP | P | 158 | −15.395 | −36.490 | 64.348 | 1.00 | 38.79 | D000 C |
| ATOM | 7631 | CG | TRP | P | 158 | −13.877 | −36.545 | 64.488 | 1.00 | 37.39 | D000 C |
| ATOM | 7632 | CD1 | TRP | P | 158 | −13.107 | −37.655 | 64.704 | 1.00 | 39.44 | D000 C |
| ATOM | 7633 | CD2 | TRP | P | 158 | −12.955 | −35.444 | 64.366 | 1.00 | 35.99 | D000 C |
| ATOM | 7634 | NE1 | TRP | P | 158 | −11.763 | −37.316 | 64.728 | 1.00 | 31.69 | D000 N |
| ATOM | 7635 | CE2 | TRP | P | 158 | −11.644 | −35.969 | 64.524 | 1.00 | 34.45 | D000 C |
| ATOM | 7636 | CE3 | TRP | P | 158 | −13.107 | −34.070 | 64.140 | 1.00 | 35.66 | D000 C |
| ATOM | 7637 | CZ2 | TRP | P | 158 | −10.501 | −35.165 | 64.471 | 1.00 | 30.75 | D000 C |
| ATOM | 7638 | CZ3 | TRP | P | 158 | −11.970 | −33.273 | 64.083 | 1.00 | 35.96 | D000 C |
| ATOM | 7639 | CH2 | TRP | P | 158 | −10.681 | −33.827 | 64.247 | 1.00 | 31.46 | D000 C |
| ATOM | 7640 | N | VAL | P | 159 | −18.149 | −35.554 | 65.509 | 1.00 | 37.16 | D000 N |
| ATOM | 7641 | CA | VAL | P | 159 | −19.556 | −35.188 | 65.499 | 1.00 | 34.88 | D000 C |
| ATOM | 7642 | C | VAL | P | 159 | −19.788 | −34.115 | 64.443 | 1.00 | 38.07 | D000 C |
| ATOM | 7643 | O | VAL | P | 159 | −19.116 | −33.083 | 64.447 | 1.00 | 39.78 | D000 O |
| ATOM | 7644 | CB | VAL | P | 159 | −19.996 | −34.693 | 66.885 | 1.00 | 37.29 | D000 C |
| ATOM | 7645 | CG1 | VAL | P | 159 | −21.462 | −34.286 | 66.872 | 1.00 | 33.76 | D000 C |
| ATOM | 7646 | CG2 | VAL | P | 159 | −19.717 | −35.762 | 67.920 | 1.00 | 35.15 | D000 C |
| ATOM | 7647 | N | GLU | P | 160 | −20.747 | −34.346 | 63.548 | 1.00 | 44.59 | D000 N |
| ATOM | 7648 | CA | GLU | P | 160 | −21.060 | −33.351 | 62.529 | 1.00 | 41.41 | D000 C |
| ATOM | 7649 | C | GLU | P | 160 | −22.016 | −32.294 | 63.071 | 1.00 | 42.80 | D000 C |
| ATOM | 7650 | O | GLU | P | 160 | −22.890 | −32.577 | 63.894 | 1.00 | 40.17 | D000 O |
| ATOM | 7651 | CB | GLU | P | 160 | −21.661 | −34.005 | 61.284 | 1.00 | 46.52 | D000 C |
| ATOM | 7652 | CG | GLU | P | 160 | −21.512 | −33.122 | 60.047 | 1.00 | 56.68 | D000 C |
| ATOM | 7653 | CD | GLU | P | 160 | −22.207 | −33.644 | 58.800 | 1.00 | 66.43 | D000 C |
| ATOM | 7654 | OE1 | GLU | P | 160 | −22.148 | −34.876 | 58.533 | 1.00 | 67.75 | D000 O |
| ATOM | 7655 | OE2 | GLU | P | 160 | −22.785 | −32.796 | 58.074 | 1.00 | 67.82 | D000 O1− |

TABLE 10.4-continued

| | | | | | | | | | | | |
|---|---|---|---|---|---|---|---|---|---|---|---|
| ATOM | 7656 | N | HIS | P | 161 | −21.824 | −31.060 | 62.622 | 1.00 | 42.59 | D000 N |
| ATOM | 7657 | CA | HIS | P | 161 | −22.738 | −29.980 | 62.952 | 1.00 | 40.24 | D000 C |
| ATOM | 7658 | C | HIS | P | 161 | −22.456 | −28.824 | 62.011 | 1.00 | 43.60 | D000 C |
| ATOM | 7659 | O | HIS | P | 161 | −21.382 | −28.220 | 62.096 | 1.00 | 45.56 | D000 O |
| ATOM | 7660 | CB | HIS | P | 161 | −22.588 | −29.557 | 64.413 | 1.00 | 35.89 | D000 C |
| ATOM | 7661 | CG | HIS | P | 161 | −23.438 | −28.383 | 64.790 | 1.00 | 44.75 | D000 C |
| ATOM | 7662 | ND1 | HIS | P | 161 | −24.736 | −28.521 | 65.238 | 1.00 | 41.80 | D000 N |
| ATOM | 7663 | CD2 | HIS | P | 161 | −23.178 | −27.050 | 64.788 | 1.00 | 44.31 | D000 C |
| ATOM | 7664 | CE1 | HIS | P | 161 | −25.239 | −27.324 | 65.496 | 1.00 | 44.21 | D000 C |
| ATOM | 7665 | NE2 | HIS | P | 161 | −24.315 | −26.415 | 65.231 | 1.00 | 47.45 | D000 N |
| ATOM | 7666 | N | GLU | P | 162 | −23.391 | −28.535 | 61.098 | 1.00 | 46.24 | D000 N |
| ATOM | 7667 | CA | GLU | P | 162 | −23.294 | −27.382 | 60.201 | 1.00 | 47.89 | D000 C |
| ATOM | 7668 | C | GLU | P | 162 | −22.059 | −27.512 | 59.301 | 1.00 | 50.82 | D000 C |
| ATOM | 7669 | O | GLU | P | 162 | −21.272 | −26.573 | 59.127 | 1.00 | 44.74 | D000 O |
| ATOM | 7670 | CB | GLU | P | 162 | −23.249 | −26.082 | 61.009 | 1.00 | 53.01 | D000 C |
| ATOM | 7671 | CG | GLU | P | 162 | −24.485 | −25.787 | 61.849 | 1.00 | 58.08 | D000 C |
| ATOM | 7672 | CD | GLU | P | 162 | −25.529 | −24.958 | 61.127 | 1.00 | 70.25 | D000 C |
| ATOM | 7673 | OE1 | GLU | P | 162 | −25.288 | −23.740 | 60.921 | 1.00 | 71.49 | D000 O |
| ATOM | 7674 | OE2 | GLU | P | 162 | −26.575 | −25.529 | 60.746 | 1.00 | 76.35 | D000 O1− |
| ATOM | 7675 | N | ARG | P | 163 | −21.884 | −28.714 | 58.744 | 1.00 | 48.09 | D000 N |
| ATOM | 7676 | CA | ARG | P | 163 | −20.780 | −29.023 | 57.836 | 1.00 | 57.37 | D000 C |
| ATOM | 7677 | C | ARG | P | 163 | −19.428 | −28.733 | 58.490 | 1.00 | 57.98 | D000 C |
| ATOM | 7678 | O | ARG | P | 163 | −18.464 | −28.324 | 57.834 | 1.00 | 57.75 | D000 O |
| ATOM | 7679 | CB | ARG | P | 163 | −20.919 | −28.307 | 56.486 | 1.00 | 60.45 | D000 C |
| ATOM | 7680 | CG | ARG | P | 163 | −22.191 | −28.694 | 55.747 | 1.00 | 58.49 | D000 C |
| ATOM | 7681 | CD | ARG | P | 163 | −22.201 | −28.270 | 54.296 | 1.00 | 71.93 | D000 C |
| ATOM | 7682 | NE | ARG | P | 163 | −21.240 | −29.050 | 53.518 | 1.00 | 71.00 | D000 N |
| ATOM | 7683 | CZ | ARG | P | 163 | −20.116 | −28.576 | 52.983 | 1.00 | 75.19 | D000 C |
| ATOM | 7684 | NH1 | ARG | P | 163 | −19.331 | −29.398 | 52.298 | 1.00 | 77.55 | D000 N1+ |
| ATOM | 7685 | NH2 | ARG | P | 163 | −19.773 | −27.296 | 53.117 | 1.00 | 67.90 | D000 N |
| ATOM | 7686 | N | SER | P | 164 | −19.350 | −28.961 | 59.794 | 1.00 | 55.73 | D000 N |
| ATOM | 7687 | CA | SER | P | 164 | −18.096 | −28.955 | 60.520 | 1.00 | 45.84 | D000 C |
| ATOM | 7688 | C | SER | P | 164 | −18.058 | −30.235 | 61.329 | 1.00 | 47.92 | D000 C |
| ATOM | 7689 | O | SER | P | 164 | −19.103 | −30.761 | 61.727 | 1.00 | 45.64 | D000 O |
| ATOM | 7690 | CB | SER | P | 164 | −17.950 | −27.732 | 61.415 | 1.00 | 45.00 | D000 C |
| ATOM | 7691 | OG | SER | P | 164 | −17.414 | −26.645 | 60.673 | 1.00 | 53.08 | D000 O |
| ATOM | 7692 | N | CYS | P | 165 | −16.854 | −30.786 | 61.464 | 1.00 | 44.78 | D000 N |
| ATOM | 7693 | CA | CYS | P | 165 | −16.607 | −31.976 | 62.262 | 1.00 | 41.69 | D000 C |
| ATOM | 7694 | C | CYS | P | 165 | −15.855 | −31.593 | 63.523 | 1.00 | 41.12 | D000 C |
| ATOM | 7695 | O | CYS | P | 165 | −14.843 | −30.886 | 63.464 | 1.00 | 42.93 | D000 O |
| ATOM | 7696 | CB | CYS | P | 165 | −15.813 | −33.009 | 61.472 | 1.00 | 49.43 | D000 C |
| ATOM | 7697 | SG | CYS | P | 165 | −16.607 | −33.584 | 59.964 | 1.00 | 54.63 | D000 S |
| ATOM | 7698 | N | TYR | P | 166 | −16.342 | −32.073 | 64.651 | 1.00 | 38.95 | D000 N |
| ATOM | 7699 | CA | TYR | P | 166 | −15.815 | −31.709 | 65.949 | 1.00 | 35.52 | D000 C |
| ATOM | 7700 | C | TYR | P | 166 | −15.385 | −32.965 | 66.674 | 1.00 | 36.03 | D000 C |
| ATOM | 7701 | O | TYR | P | 166 | −16.004 | −34.021 | 66.524 | 1.00 | 35.78 | D000 O |
| ATOM | 7702 | CB | TYR | P | 166 | −16.857 | −30.955 | 66.776 | 1.00 | 34.96 | D000 C |
| ATOM | 7703 | CG | TYR | P | 166 | −17.320 | −29.668 | 66.153 | 1.00 | 36.68 | D000 C |
| ATOM | 7704 | CD1 | TYR | P | 166 | −18.334 | −29.650 | 65.195 | 1.00 | 32.91 | D000 C |
| ATOM | 7705 | CD2 | TYR | P | 166 | −16.732 | −28.461 | 66.513 | 1.00 | 33.68 | D000 C |
| ATOM | 7706 | CE1 | TYR | P | 166 | −18.753 | −28.447 | 64.630 | 1.00 | 36.09 | D000 C |
| ATOM | 7707 | CE2 | TYR | P | 166 | −17.141 | −27.259 | 65.953 | 1.00 | 30.23 | D000 C |
| ATOM | 7708 | CZ | TYR | P | 166 | −18.149 | −27.251 | 65.019 | 1.00 | 35.59 | D000 C |
| ATOM | 7709 | OH | TYR | P | 166 | −18.541 | −26.044 | 64.482 | 1.00 | 35.19 | D000 O |
| ATOM | 7710 | N | TRP | P | 167 | −14.307 | −32.851 | 67.435 | 1.00 | 34.48 | D000 N |
| ATOM | 7711 | CA | TRP | P | 167 | −13.853 | −33.934 | 68.284 | 1.00 | 32.86 | D000 C |
| ATOM | 7712 | C | TRP | P | 167 | −13.586 | −33.377 | 69.678 | 1.00 | 34.10 | D000 C |
| ATOM | 7713 | O | TRP | P | 167 | −12.924 | −32.339 | 69.820 | 1.00 | 34.23 | D000 O |
| ATOM | 7714 | CB | TRP | P | 167 | −12.613 | −34.593 | 67.695 | 1.00 | 31.80 | D000 C |
| ATOM | 7715 | CG | TRP | P | 167 | −12.104 | −35.731 | 68.511 | 1.00 | 33.09 | D000 C |
| ATOM | 7716 | CD1 | TRP | P | 167 | −12.489 | −37.025 | 68.430 | 1.00 | 33.37 | D000 C |
| ATOM | 7717 | CD2 | TRP | P | 167 | −11.128 | −35.664 | 69.554 | 1.00 | 28.44 | D000 C |
| ATOM | 7718 | NE1 | TRP | P | 167 | −11.793 | −37.780 | 69.336 | 1.00 | 29.92 | D000 N |
| ATOM | 7719 | CE2 | TRP | P | 167 | −10.948 | −36.966 | 70.036 | 1.00 | 29.30 | D000 C |
| ATOM | 7720 | CE3 | TRP | P | 167 | −10.351 | −34.629 | 70.091 | 1.00 | 31.68 | D000 C |
| ATOM | 7721 | CZ2 | TRP | P | 167 | −10.034 | −37.270 | 71.048 | 1.00 | 34.20 | D000 C |
| ATOM | 7722 | CZ3 | TRP | P | 167 | −9.442 | −34.929 | 71.100 | 1.00 | 32.44 | D000 C |
| ATOM | 7723 | CH2 | TRP | P | 167 | −9.294 | −36.236 | 71.570 | 1.00 | 30.38 | D000 C |
| ATOM | 7724 | N | PHE | P | 168 | −14.102 | −34.066 | 70.699 | 1.00 | 30.71 | D000 N |
| ATOM | 7725 | CA | PHE | P | 168 | −14.055 | −33.612 | 72.088 | 1.00 | 32.96 | D000 C |
| ATOM | 7726 | C | PHE | P | 168 | −13.115 | −34.503 | 72.884 | 1.00 | 29.97 | D000 C |
| ATOM | 7727 | O | PHE | P | 168 | −13.354 | −35.706 | 73.001 | 1.00 | 33.55 | D000 O |
| ATOM | 7728 | CB | PHE | P | 168 | −15.460 | −33.603 | 72.691 | 1.00 | 26.93 | D000 C |
| ATOM | 7729 | CG | PHE | P | 168 | −16.381 | −32.711 | 71.950 | 1.00 | 26.93 | D000 C |
| ATOM | 7730 | CD1 | PHE | P | 168 | −16.509 | −31.381 | 72.314 | 1.00 | 25.66 | D000 C |
| ATOM | 7731 | CD2 | PHE | P | 168 | −17.057 | −33.170 | 70.831 | 1.00 | 28.28 | D000 C |
| ATOM | 7732 | CE1 | PHE | P | 168 | −17.335 | −30.515 | 71.594 | 1.00 | 29.79 | D000 C |
| ATOM | 7733 | CE2 | PHE | P | 168 | −17.877 | −32.328 | 70.108 | 1.00 | 30.00 | D000 C |
| ATOM | 7734 | CZ | PHE | P | 168 | −18.025 | −30.988 | 70.490 | 1.00 | 26.93 | D000 C |
| ATOM | 7735 | N | SER | P | 169 | −12.026 | −33.922 | 73.385 | 1.00 | 30.64 | D000 N |

TABLE 10.4-continued

| | | | | | | | | | | | |
|---|---|---|---|---|---|---|---|---|---|---|---|
| ATOM | 7736 | CA | SER | P | 169 | −11.061 | −34.707 | 74.145 | 1.00 | 34.97 | D000 | C |
| ATOM | 7737 | C | SER | P | 169 | −11.675 | −35.155 | 75.471 | 1.00 | 27.83 | D000 | C |
| ATOM | 7738 | O | SER | P | 169 | −12.547 | −34.495 | 76.036 | 1.00 | 28.09 | D000 | O |
| ATOM | 7739 | CB | SER | P | 169 | −9.761 | −33.908 | 74.389 | 1.00 | 29.33 | D000 | C |
| ATOM | 7740 | OG | SER | P | 169 | −9.906 | −32.926 | 75.407 | 1.00 | 28.03 | D000 | O |
| ATOM | 7741 | N | ARG | P | 170 | −11.219 | −36.298 | 75.960 | 1.00 | 26.00 | D000 | N |
| ATOM | 7742 | CA | ARG | P | 170 | −11.564 | −36.758 | 77.295 | 1.00 | 37.89 | D000 | C |
| ATOM | 7743 | C | ARG | P | 170 | −10.359 | −36.735 | 78.233 | 1.00 | 33.73 | D000 | C |
| ATOM | 7744 | O | ARG | P | 170 | −10.416 | −37.279 | 79.337 | 1.00 | 35.93 | D000 | O |
| ATOM | 7745 | CB | ARG | P | 170 | −12.183 | −38.148 | 77.207 | 1.00 | 26.68 | D000 | C |
| ATOM | 7746 | CG | ARG | P | 170 | −12.874 | −38.607 | 78.430 | 1.00 | 33.68 | D000 | C |
| ATOM | 7747 | CD | ARG | P | 170 | −14.298 | −38.263 | 78.356 | 1.00 | 32.40 | D000 | C |
| ATOM | 7748 | NE | ARG | P | 170 | −15.029 | −38.782 | 79.492 | 1.00 | 28.94 | D000 | N |
| ATOM | 7749 | CZ | ARG | P | 170 | −15.923 | −38.060 | 80.155 | 1.00 | 29.78 | D000 | C |
| ATOM | 7750 | NH1 | ARG | P | 170 | −16.586 | −38.582 | 81.182 | 1.00 | 24.35 | D000 | N1+ |
| ATOM | 7751 | NH2 | ARG | P | 170 | −16.137 | −36.805 | 79.779 | 1.00 | 23.51 | D000 | N |
| ATOM | 7752 | N | SER | P | 171 | −9.256 | −36.149 | 77.801 | 1.00 | 29.68 | D000 | N |
| ATOM | 7753 | CA | SER | P | 171 | −8.088 | −35.943 | 78.633 | 1.00 | 26.30 | D000 | C |
| ATOM | 7754 | C | SER | P | 171 | −7.684 | −34.481 | 78.520 | 1.00 | 31.62 | D000 | C |
| ATOM | 7755 | O | SER | P | 171 | −8.299 | −33.707 | 77.774 | 1.00 | 33.43 | D000 | O |
| ATOM | 7756 | CB | SER | P | 171 | −6.959 | −36.886 | 78.220 | 1.00 | 36.16 | D000 | C |
| ATOM | 7757 | OG | SER | P | 171 | −6.679 | −36.700 | 76.857 | 1.00 | 32.31 | D000 | O |
| ATOM | 7758 | N | GLY | P | 172 | −6.662 | −34.095 | 79.290 | 1.00 | 28.87 | D000 | N |
| ATOM | 7759 | CA | GLY | P | 172 | −6.215 | −32.713 | 79.329 | 1.00 | 27.34 | D000 | C |
| ATOM | 7760 | C | GLY | P | 172 | −4.841 | −32.482 | 78.725 | 1.00 | 28.11 | D000 | C |
| ATOM | 7761 | O | GLY | P | 172 | −4.034 | −33.407 | 78.627 | 1.00 | 29.36 | D000 | O |
| ATOM | 7762 | N | LYS | P | 173 | −4.567 | −31.249 | 78.312 | 1.00 | 26.28 | D000 | N |
| ATOM | 7763 | CA | LYS | P | 173 | −3.311 | −30.891 | 77.669 | 1.00 | 28.99 | D000 | C |
| ATOM | 7764 | C | LYS | P | 173 | −3.133 | −29.390 | 77.801 | 1.00 | 31.16 | D000 | C |
| ATOM | 7765 | O | LYS | P | 173 | −4.101 | −28.640 | 77.686 | 1.00 | 26.89 | D000 | O |
| ATOM | 7766 | CB | LYS | P | 173 | −3.274 | −31.249 | 76.168 | 1.00 | 29.64 | D000 | C |
| ATOM | 7767 | CG | LYS | P | 173 | −3.023 | −32.712 | 75.792 | 1.00 | 25.52 | D000 | C |
| ATOM | 7768 | CD | LYS | P | 173 | −2.577 | −32.794 | 74.349 | 1.00 | 26.55 | D000 | C |
| ATOM | 7769 | CE | LYS | P | 173 | −2.684 | −34.206 | 73.811 | 1.00 | 33.01 | D000 | C |
| ATOM | 7770 | NZ | LYS | P | 173 | −1.755 | −35.154 | 74.459 | 1.00 | 35.05 | D000 | N1+ |
| ATOM | 7771 | N | ALA | P | 174 | −1.890 | −28.962 | 78.015 | 1.00 | 32.75 | D000 | N |
| ATOM | 7772 | CA | ALA | P | 174 | −1.556 | −27.556 | 77.874 | 1.00 | 30.91 | D000 | C |
| ATOM | 7773 | C | ALA | P | 174 | −1.960 | −27.069 | 76.483 | 1.00 | 32.66 | D000 | C |
| ATOM | 7774 | O | ALA | P | 174 | −1.967 | −27.838 | 75.511 | 1.00 | 28.87 | D000 | O |
| ATOM | 7775 | CB | ALA | P | 174 | −0.062 | −27.349 | 78.113 | 1.00 | 32.92 | D000 | C |
| ATOM | 7776 | N | TRP | P | 175 | −2.308 | −25.777 | 76.396 | 1.00 | 31.13 | D000 | N |
| ATOM | 7777 | CA | TRP | P | 175 | −2.873 | −25.232 | 75.157 | 1.00 | 35.20 | D000 | C |
| ATOM | 7778 | C | TRP | P | 175 | −1.991 | −25.526 | 73.942 | 1.00 | 35.94 | D000 | C |
| ATOM | 7779 | O | TRP | P | 175 | −2.491 | −25.919 | 72.884 | 1.00 | 31.80 | D000 | O |
| ATOM | 7780 | CB | TRP | P | 175 | −3.105 | −23.719 | 75.294 | 1.00 | 35.59 | D000 | C |
| ATOM | 7781 | CG | TRP | P | 175 | −3.896 | −23.089 | 74.131 | 1.00 | 42.77 | D000 | C |
| ATOM | 7782 | CD1 | TRP | P | 175 | −5.235 | −22.812 | 74.113 | 1.00 | 41.04 | D000 | C |
| ATOM | 7783 | CD2 | TRP | P | 175 | −3.387 | −22.650 | 72.846 | 1.00 | 48.23 | D000 | C |
| ATOM | 7784 | NE1 | TRP | P | 175 | −5.594 | −22.244 | 72.908 | 1.00 | 42.82 | D000 | N |
| ATOM | 7785 | CE2 | TRP | P | 175 | −4.483 | −22.130 | 72.115 | 1.00 | 46.08 | D000 | C |
| ATOM | 7786 | CE3 | TRP | P | 175 | −2.117 | −22.651 | 72.244 | 1.00 | 45.34 | D000 | C |
| ATOM | 7787 | CZ2 | TRP | P | 175 | −4.348 | −21.616 | 70.816 | 1.00 | 42.61 | D000 | C |
| ATOM | 7788 | CZ3 | TRP | P | 175 | −1.988 | −22.133 | 70.948 | 1.00 | 42.70 | D000 | C |
| ATOM | 7789 | CH2 | TRP | P | 175 | −3.095 | −21.626 | 70.256 | 1.00 | 41.85 | D000 | C |
| ATOM | 7790 | N | ALA | P | 176 | −0.677 | −25.331 | 74.076 | 1.00 | 34.88 | D000 | N |
| ATOM | 7791 | CA | ALA | P | 176 | 0.226 | −25.561 | 72.957 | 1.00 | 30.60 | D000 | C |
| ATOM | 7792 | C | ALA | P | 176 | 0.226 | −27.022 | 72.528 | 1.00 | 36.67 | D000 | C |
| ATOM | 7793 | O | ALA | P | 176 | 0.291 | −27.325 | 71.328 | 1.00 | 33.09 | D000 | O |
| ATOM | 7794 | CB | ALA | P | 176 | 1.632 | −25.111 | 73.326 | 1.00 | 30.07 | D000 | C |
| ATOM | 7795 | N | ASP | P | 177 | 0.176 | −27.949 | 73.490 | 1.00 | 34.27 | D000 | N |
| ATOM | 7796 | CA | ASP | P | 177 | 0.168 | −29.353 | 73.103 | 1.00 | 30.80 | D000 | C |
| ATOM | 7797 | C | ASP | P | 177 | −1.161 | −29.738 | 72.466 | 1.00 | 29.53 | D000 | C |
| ATOM | 7798 | O | ASP | P | 177 | −1.190 | −30.546 | 71.540 | 1.00 | 28.69 | D000 | O |
| ATOM | 7799 | CB | ASP | P | 177 | 0.466 | −30.238 | 74.315 | 1.00 | 33.82 | D000 | C |
| ATOM | 7800 | CG | ASP | P | 177 | 1.804 | −29.908 | 74.967 | 1.00 | 40.40 | D000 | C |
| ATOM | 7801 | OD1 | ASP | P | 177 | 2.724 | −29.448 | 74.243 | 1.00 | 40.31 | D000 | O |
| ATOM | 7802 | OD2 | ASP | P | 177 | 1.934 | −30.111 | 76.206 | 1.00 | 43.49 | D000 | O1− |
| ATOM | 7803 | N | ALA | P | 178 | −2.267 | −29.156 | 72.931 | 1.00 | 33.12 | D000 | N |
| ATOM | 7804 | CA | ALA | P | 178 | −3.558 | −29.421 | 72.307 | 1.00 | 31.89 | D000 | C |
| ATOM | 7805 | C | ALA | P | 178 | −3.617 | −28.832 | 70.899 | 1.00 | 35.82 | D000 | C |
| ATOM | 7806 | O | ALA | P | 178 | −4.104 | −29.487 | 69.969 | 1.00 | 35.46 | D000 | O |
| ATOM | 7807 | CB | ALA | P | 178 | −4.690 | −28.874 | 73.178 | 1.00 | 25.57 | D000 | C |
| ATOM | 7808 | N | ASP | P | 179 | −3.149 | −27.588 | 70.741 | 1.00 | 33.89 | D000 | N |
| ATOM | 7809 | CA | ASP | P | 179 | −2.957 | −26.971 | 69.429 | 1.00 | 35.32 | D000 | C |
| ATOM | 7810 | C | ASP | P | 179 | −2.204 | −27.905 | 68.481 | 1.00 | 38.70 | D000 | C |
| ATOM | 7811 | O | ASP | P | 179 | −2.660 | −28.182 | 67.365 | 1.00 | 37.15 | D000 | O |
| ATOM | 7812 | CB | ASP | P | 179 | −2.188 | −25.656 | 69.607 | 1.00 | 36.39 | D000 | C |
| ATOM | 7813 | CG | ASP | P | 179 | −2.089 | −24.840 | 68.331 | 1.00 | 45.78 | D000 | C |
| ATOM | 7814 | OD1 | ASP | P | 179 | −2.995 | −24.936 | 67.468 | 1.00 | 47.95 | D000 | O |
| ATOM | 7815 | OD2 | ASP | P | 179 | −1.093 | −24.096 | 68.191 | 1.00 | 50.66 | D000 | O1− |

TABLE 10.4-continued

| | | | | | | | | | | | |
|---|---|---|---|---|---|---|---|---|---|---|---|
| ATOM | 7816 | N | ASN | P | 180 | −1.049 | −28.410 | 68.918 | 1.00 | 32.54 | D000 N |
| ATOM | 7817 | CA | ASN | P | 180 | −0.271 | −29.285 | 68.052 | 1.00 | 37.32 | D000 C |
| ATOM | 7818 | C | ASN | P | 180 | −1.019 | −30.582 | 67.794 | 1.00 | 38.98 | D000 C |
| ATOM | 7819 | O | ASN | P | 180 | −0.911 | −31.163 | 66.707 | 1.00 | 43.91 | D000 O |
| ATOM | 7820 | CB | ASN | P | 180 | 1.118 | −29.563 | 68.660 | 1.00 | 33.88 | D000 C |
| ATOM | 7821 | CG | ASN | P | 180 | 2.023 | −28.309 | 68.713 | 1.00 | 36.32 | D000 C |
| ATOM | 7822 | OD1 | ASN | P | 180 | 1.696 | −27.243 | 68.174 | 1.00 | 45.19 | D000 O |
| ATOM | 7823 | ND2 | ASN | P | 180 | 3.160 | −28.445 | 69.372 | 1.00 | 35.02 | D000 N |
| ATOM | 7824 | N | TYR | P | 181 | −1.771 | −31.060 | 68.782 | 1.00 | 39.97 | D000 N |
| ATOM | 7825 | CA | TYR | P | 181 | −2.544 | −32.280 | 68.589 | 1.00 | 39.12 | D000 C |
| ATOM | 7826 | C | TYR | P | 181 | −3.578 | −32.097 | 67.471 | 1.00 | 38.18 | D000 C |
| ATOM | 7827 | O | TYR | P | 181 | −3.740 | −32.963 | 66.601 | 1.00 | 35.54 | D000 O |
| ATOM | 7828 | CB | TYR | P | 181 | −3.216 | −32.680 | 69.908 | 1.00 | 26.15 | D000 C |
| ATOM | 7829 | CG | TYR | P | 181 | −4.103 | −33.884 | 69.760 | 1.00 | 30.23 | D000 C |
| ATOM | 7830 | CD1 | TYR | P | 181 | −5.415 | −33.752 | 69.303 | 1.00 | 32.63 | D000 C |
| ATOM | 7831 | CD2 | TYR | P | 181 | −3.642 | −35.158 | 70.052 | 1.00 | 31.11 | D000 C |
| ATOM | 7832 | CE1 | TYR | P | 181 | −6.223 | −34.846 | 69.131 | 1.00 | 29.23 | D000 C |
| ATOM | 7833 | CE2 | TYR | P | 181 | −4.463 | −36.267 | 69.898 | 1.00 | 26.83 | D000 C |
| ATOM | 7834 | CZ | TYR | P | 181 | −5.750 | −36.093 | 69.433 | 1.00 | 27.61 | D000 C |
| ATOM | 7835 | OH | TYR | P | 181 | −6.587 | −37.157 | 69.283 | 1.00 | 34.40 | D000 O |
| ATOM | 7836 | N | CYS | P | 182 | −4.291 | −30.973 | 67.476 | 1.00 | 34.18 | D000 N |
| ATOM | 7837 | CA | CYS | P | 182 | −5.297 | −30.784 | 66.443 | 1.00 | 40.39 | D000 C |
| ATOM | 7838 | C | CYS | P | 182 | −4.643 | −30.653 | 65.076 | 1.00 | 39.40 | D000 C |
| ATOM | 7839 | O | CYS | P | 182 | −5.119 | −31.245 | 64.098 | 1.00 | 36.09 | D000 O |
| ATOM | 7840 | CB | CYS | P | 182 | −6.178 | −29.570 | 66.756 | 1.00 | 38.38 | D000 C |
| ATOM | 7841 | SG | CYS | P | 182 | −7.302 | −29.774 | 68.185 | 1.00 | 41.03 | D000 S |
| ATOM | 7842 | N | ARG | P | 183 | −3.541 | −29.899 | 64.997 | 1.00 | 38.60 | D000 N |
| ATOM | 7843 | CA | ARG | P | 183 | −2.855 | −29.714 | 63.724 | 1.00 | 36.47 | D000 C |
| ATOM | 7844 | C | ARG | P | 183 | −2.442 | −31.048 | 63.106 | 1.00 | 35.85 | D000 C |
| ATOM | 7845 | O | ARG | P | 183 | −2.647 | −31.265 | 61.908 | 1.00 | 36.71 | D000 O |
| ATOM | 7846 | CB | ARG | P | 183 | −1.648 | −28.802 | 63.900 | 1.00 | 36.20 | D000 C |
| ATOM | 7847 | CG | ARG | P | 183 | −1.953 | −27.334 | 64.191 | 1.00 | 35.03 | D000 C |
| ATOM | 7848 | CD | ARG | P | 183 | −0.707 | −26.729 | 64.791 | 1.00 | 45.48 | D000 C |
| ATOM | 7849 | NE | ARG | P | 183 | −0.297 | −25.461 | 64.189 | 1.00 | 63.54 | D000 N |
| ATOM | 7850 | CZ | ARG | P | 183 | 0.971 | −25.139 | 63.900 | 1.00 | 64.81 | D000 C |
| ATOM | 7851 | NH1 | ARG | P | 183 | 1.957 | −25.996 | 64.123 | 1.00 | 42.00 | D000 N1+ |
| ATOM | 7852 | NH2 | ARG | P | 183 | 1.259 | −23.956 | 63.368 | 1.00 | 73.94 | D000 N |
| ATOM | 7853 | N | LEU | P | 184 | −1.906 | −31.972 | 63.906 | 1.00 | 34.56 | D000 N |
| ATOM | 7854 | CA | LEU | P | 184 | −1.585 | −33.295 | 63.377 | 1.00 | 34.47 | D000 C |
| ATOM | 7855 | C | LEU | P | 184 | −2.812 | −34.158 | 63.104 | 1.00 | 43.39 | D000 C |
| ATOM | 7856 | O | LEU | P | 184 | −2.648 | −35.287 | 62.629 | 1.00 | 48.31 | D000 O |
| ATOM | 7857 | CB | LEU | P | 184 | −0.669 | −34.073 | 64.311 | 1.00 | 40.32 | D000 C |
| ATOM | 7858 | CG | LEU | P | 184 | 0.849 | −33.962 | 64.235 | 1.00 | 47.86 | D000 C |
| ATOM | 7859 | CD1 | LEU | P | 184 | 1.306 | −33.127 | 63.057 | 1.00 | 34.57 | D000 C |
| ATOM | 7860 | CD2 | LEU | P | 184 | 1.398 | −33.477 | 65.565 | 1.00 | 40.91 | D000 C |
| ATOM | 7861 | N | GLU | P | 185 | −4.016 | −33.714 | 63.463 | 1.00 | 43.99 | D000 N |
| ATOM | 7862 | CA | GLU | P | 185 | −5.220 | −34.401 | 63.011 | 1.00 | 42.68 | D000 C |
| ATOM | 7863 | C | GLU | P | 185 | −5.746 | −33.822 | 61.714 | 1.00 | 42.10 | D000 C |
| ATOM | 7864 | O | GLU | P | 185 | −6.877 | −34.117 | 61.325 | 1.00 | 41.36 | D000 O |
| ATOM | 7865 | CB | GLU | P | 185 | −6.314 | −34.365 | 64.076 | 1.00 | 40.55 | D000 C |
| ATOM | 7866 | CG | GLU | P | 185 | −5.941 | −35.182 | 65.257 | 1.00 | 41.11 | D000 C |
| ATOM | 7867 | CD | GLU | P | 185 | −5.903 | −36.635 | 64.898 | 1.00 | 46.25 | D000 C |
| ATOM | 7868 | OE1 | GLU | P | 185 | −6.722 | −37.051 | 64.048 | 1.00 | 49.14 | D000 O |
| ATOM | 7869 | OE2 | GLU | P | 185 | −5.032 | −37.350 | 65.434 | 1.00 | 47.23 | D000 O1− |
| ATOM | 7870 | N | ASP | P | 186 | −4.940 | −33.010 | 61.039 | 1.00 | 47.67 | D000 N |
| ATOM | 7871 | CA | ASP | P | 186 | −5.390 | −32.232 | 59.896 | 1.00 | 45.07 | D000 C |
| ATOM | 7872 | C | ASP | P | 186 | −6.621 | −31.416 | 60.279 | 1.00 | 43.94 | D000 C |
| ATOM | 7873 | O | ASP | P | 186 | −7.601 | −31.332 | 59.539 | 1.00 | 49.84 | D000 O |
| ATOM | 7874 | CB | ASP | P | 186 | −5.656 | −33.149 | 58.700 | 1.00 | 47.50 | D000 C |
| ATOM | 7875 | CG | ASP | P | 186 | −5.429 | −32.459 | 57.365 | 1.00 | 55.72 | D000 C |
| ATOM | 7876 | OD1 | ASP | P | 186 | −5.209 | −31.227 | 57.346 | 1.00 | 54.34 | D000 O |
| ATOM | 7877 | OD2 | ASP | P | 186 | −5.476 | −33.160 | 56.329 | 1.00 | 65.88 | D000 O1− |
| ATOM | 7878 | N | ALA | P | 187 | −6.558 | −30.797 | 61.453 | 1.00 | 43.57 | D000 N |
| ATOM | 7879 | CA | ALA | P | 187 | −7.683 | −30.054 | 62.009 | 1.00 | 40.06 | D000 C |
| ATOM | 7880 | C | ALA | P | 187 | −7.136 | −28.872 | 62.799 | 1.00 | 39.06 | D000 C |
| ATOM | 7881 | O | ALA | P | 187 | −5.965 | −28.502 | 62.673 | 1.00 | 41.54 | D000 O |
| ATOM | 7882 | CB | ALA | P | 187 | −8.559 | −30.971 | 62.871 | 1.00 | 37.26 | D000 C |
| ATOM | 7883 | N | HIS | P | 188 | −7.984 | −28.270 | 63.620 | 1.00 | 38.84 | D000 N |
| ATOM | 7884 | CA | HIS | P | 188 | −7.523 | −27.141 | 64.411 | 1.00 | 42.15 | D000 C |
| ATOM | 7885 | C | HIS | P | 188 | −8.399 | −26.992 | 65.655 | 1.00 | 44.84 | D000 C |
| ATOM | 7886 | O | HIS | P | 188 | −9.536 | −27.477 | 65.704 | 1.00 | 37.93 | D000 O |
| ATOM | 7887 | CB | HIS | P | 188 | −7.528 | −25.863 | 63.577 | 1.00 | 38.38 | D000 C |
| ATOM | 7888 | CG | HIS | P | 188 | −8.885 | −25.488 | 63.084 | 1.00 | 39.56 | D000 C |
| ATOM | 7889 | ND1 | HIS | P | 188 | −9.637 | −24.489 | 63.663 | 1.00 | 42.56 | D000 N |
| ATOM | 7890 | CD2 | HIS | P | 188 | −9.644 | −26.008 | 62.092 | 1.00 | 38.88 | D000 C |
| ATOM | 7891 | CE1 | HIS | P | 188 | −10.793 | −24.394 | 63.034 | 1.00 | 45.45 | D000 C |
| ATOM | 7892 | NE2 | HIS | P | 188 | −10.822 | −25.305 | 62.075 | 1.00 | 47.23 | D000 N |
| ATOM | 7893 | N | LEU | P | 189 | −7.834 | −26.338 | 66.673 | 1.00 | 39.67 | D000 N |
| ATOM | 7894 | CA | LEU | P | 189 | −8.599 | −26.011 | 67.860 | 1.00 | 36.17 | D000 C |
| ATOM | 7895 | C | LEU | P | 189 | −9.829 | −25.215 | 67.464 | 1.00 | 35.83 | D000 C |

TABLE 10.4-continued

| | | | | | | | | | | | |
|---|---|---|---|---|---|---|---|---|---|---|---|
| ATOM | 7896 | O | LEU | P | 189 | −9.731 | −24.279 | 66.669 | 1.00 | 34.94 | D000 O |
| ATOM | 7897 | CB | LEU | P | 189 | −7.733 | −25.219 | 68.832 | 1.00 | 37.51 | D000 C |
| ATOM | 7898 | CG | LEU | P | 189 | −6.682 | −25.973 | 69.637 | 1.00 | 36.68 | D000 C |
| ATOM | 7899 | CD1 | LEU | P | 189 | −5.830 | −25.001 | 70.439 | 1.00 | 36.06 | D000 C |
| ATOM | 7900 | CD2 | LEU | P | 189 | −7.377 | −26.952 | 70.569 | 1.00 | 34.22 | D000 C |
| ATOM | 7901 | N | VAL | P | 190 | −10.979 | −25.590 | 68.040 | 1.00 | 34.05 | D000 N |
| ATOM | 7902 | CA | VAL | P | 190 | −12.274 | −25.094 | 67.585 | 1.00 | 34.93 | D000 C |
| ATOM | 7903 | C | VAL | P | 190 | −12.304 | −23.565 | 67.518 | 1.00 | 35.33 | D000 C |
| ATOM | 7904 | O | VAL | P | 190 | −11.823 | −22.852 | 68.410 | 1.00 | 34.50 | D000 O |
| ATOM | 7905 | CB | VAL | P | 190 | −13.400 | −25.641 | 68.486 | 1.00 | 34.45 | D000 C |
| ATOM | 7906 | CG1 | VAL | P | 190 | −13.221 | −25.185 | 69.924 | 1.00 | 32.88 | D000 C |
| ATOM | 7907 | CG2 | VAL | P | 190 | −14.740 | −25.157 | 67.990 | 1.00 | 33.98 | D000 C |
| ATOM | 7908 | N | VAL | P | 191 | −12.889 | −23.066 | 66.438 | 1.00 | 34.01 | D000 N |
| ATOM | 7909 | CA | VAL | P | 191 | −13.051 | −2.6431 | 66.182 | 1.00 | 35.07 | D000 C |
| ATOM | 7910 | C | VAL | P | 191 | −14.544 | −21.382 | 66.161 | 1.00 | 36.61 | D000 C |
| ATOM | 7911 | O | VAL | P | 191 | −15.256 | −21.923 | 65.306 | 1.00 | 41.56 | D000 O |
| ATOM | 7912 | CB | VAL | P | 191 | −12.385 | −21.225 | 64.856 | 1.00 | 35.46 | D000 C |
| ATOM | 7913 | CG1 | VAL | P | 191 | −12.817 | −19.830 | 64.431 | 1.00 | 35.96 | D000 C |
| ATOM | 7914 | CG2 | VAL | P | 191 | −10.875 | −21.295 | 64.981 | 1.00 | 36.37 | D000 C |
| ATOM | 7915 | N | VAL | P | 192 | −15.021 | −20.581 | 67.111 | 1.00 | 35.79 | D000 N |
| ATOM | 7916 | CA | VAL | P | 192 | −16.450 | −20.417 | 67.355 | 1.00 | 37.67 | D000 C |
| ATOM | 7917 | C | VAL | P | 192 | −16.893 | −19.094 | 66.754 | 1.00 | 37.75 | D000 C |
| ATOM | 7918 | O | VAL | P | 192 | −16.442 | −18.024 | 67.186 | 1.00 | 38.75 | D000 O |
| ATOM | 7919 | CB | VAL | P | 192 | −16.776 | −20.473 | 68.854 | 1.00 | 38.25 | D000 C |
| ATOM | 7920 | CG1 | VAL | P | 192 | −18.267 | −20.314 | 69.053 | 1.00 | 35.90 | D000 C |
| ATOM | 7921 | CG2 | VAL | P | 192 | −16.282 | −21.774 | 69.455 | 1.00 | 37.22 | D000 C |
| ATOM | 7922 | N | THR | P | 193 | −17.795 | −19.159 | 65.778 | 1.00 | 36.90 | D000 N |
| ATOM | 7923 | CA | THR | P | 193 | −18.151 | −17.982 | 64.995 | 1.00 | 42.26 | D000 C |
| ATOM | 7924 | C | THR | P | 193 | −19.600 | −17.530 | 65.148 | 1.00 | 41.06 | D000 C |
| ATOM | 7925 | O | THR | P | 193 | −19.950 | −16.480 | 64.605 | 1.00 | 46.91 | D000 O |
| ATOM | 7926 | CB | THR | P | 193 | −17.813 | −18.204 | 63.503 | 1.00 | 40.10 | D000 C |
| ATOM | 7927 | OG1 | THR | P | 193 | −18.471 | −19.382 | 63.012 | 1.00 | 45.59 | D000 O |
| ATOM | 7928 | CG2 | THR | P | 193 | −16.302 | −18.323 | 63.286 | 1.00 | 36.33 | D000 C |
| ATOM | 7929 | N | SER | P | 194 | −20.440 | −18.252 | 65.892 | 1.00 | 39.77 | D000 N |
| ATOM | 7930 | CA | SER | P | 194 | −21.849 | −17.898 | 66.016 | 1.00 | 36.24 | D000 C |
| ATOM | 7931 | C | SER | P | 194 | −22.416 | −18.395 | 67.342 | 1.00 | 40.36 | D000 C |
| ATOM | 7932 | O | SER | P | 194 | −21.829 | −19.244 | 68.013 | 1.00 | 39.43 | D000 O |
| ATOM | 7933 | CB | SER | P | 194 | −22.666 | −18.470 | 64.855 | 1.00 | 32.78 | D000 C |
| ATOM | 7934 | OG | SER | P | 194 | −22.508 | −19.875 | 64.777 | 1.00 | 40.86 | D000 O |
| ATOM | 7935 | N | TRP | P | 195 | −23.589 | −17.862 | 67.714 | 1.00 | 44.41 | D000 N |
| ATOM | 7936 | CA | TRP | P | 195 | −24.275 | −18.381 | 68.894 | 1.00 | 41.04 | D000 C |
| ATOM | 7937 | C | TRP | P | 195 | −24.665 | −19.830 | 68.684 | 1.00 | 37.41 | D000 C |
| ATOM | 7938 | O | TRP | P | 195 | −24.633 | −20.639 | 69.618 | 1.00 | 38.72 | D000 O |
| ATOM | 7939 | CB | TRP | P | 195 | −25.519 | −17.557 | 69.216 | 1.00 | 44.82 | D000 C |
| ATOM | 7940 | CG | TRP | P | 195 | −25.243 | −16.309 | 70.020 | 1.00 | 51.32 | D000 C |
| ATOM | 7941 | CD1 | TRP | P | 195 | −25.307 | −15.008 | 69.586 | 1.00 | 46.03 | D000 C |
| ATOM | 7942 | CD2 | TRP | P | 195 | −24.854 | −16.251 | 71.395 | 1.00 | 47.53 | D000 C |
| ATOM | 7943 | NE1 | TRP | P | 195 | −24.987 | −14.148 | 70.610 | 1.00 | 47.20 | D000 N |
| ATOM | 7944 | CE2 | TRP | P | 195 | −24.706 | −14.885 | 71.733 | 1.00 | 51.18 | D000 C |
| ATOM | 7945 | CE3 | TRP | P | 195 | −24.614 | −17.221 | 72.375 | 1.00 | 46.44 | D000 C |
| ATOM | 7946 | CZ2 | TRP | P | 195 | −24.331 | −14.464 | 73.016 | 1.00 | 55.85 | D000 C |
| ATOM | 7947 | CZ3 | TRP | P | 195 | −24.241 | −16.801 | 73.654 | 1.00 | 53.40 | D000 C |
| ATOM | 7948 | CH2 | TRP | P | 195 | −24.105 | −15.435 | 73.961 | 1.00 | 52.97 | D000 C |
| ATOM | 7949 | N | GLU | P | 196 | −25.024 | −20.181 | 67.458 | 1.00 | 34.05 | D000 N |
| ATOM | 7950 | CA | GLU | P | 196 | −25.384 | −21.557 | 67.174 | 1.00 | 36.55 | D000 C |
| ATOM | 7951 | C | GLU | P | 196 | −24.200 | −22.484 | 67.430 | 1.00 | 37.31 | D000 C |
| ATOM | 7952 | O | GLU | P | 196 | −24.343 | −23.528 | 68.078 | 1.00 | 36.90 | D000 O |
| ATOM | 7953 | CB | GLU | P | 196 | −25.899 | −21.650 | 65.740 | 1.00 | 37.33 | D000 C |
| ATOM | 7954 | CG | GLU | P | 196 | −25.908 | −23.036 | 65.156 | 1.00 | 54.30 | D000 C |
| ATOM | 7955 | CD | GLU | P | 196 | −27.254 | −23.709 | 65.306 | 1.00 | 67.53 | D000 C |
| ATOM | 7956 | OE1 | GLU | P | 196 | −28.111 | −23.139 | 66.025 | 1.00 | 74.43 | D000 O |
| ATOM | 7957 | OE2 | GLU | P | 196 | −27.453 | −24.799 | 64.704 | 1.00 | 66.20 | D000 O1− |
| ATOM | 7958 | N | GLU | P | 197 | −23.008 | −22.101 | 66.961 | 1.00 | 37.44 | D000 N |
| ATOM | 7959 | CA | GLU | P | 197 | −21.837 | −22.949 | 67.173 | 1.00 | 37.15 | D000 C |
| ATOM | 7960 | C | GLU | P | 197 | −21.448 | −23.002 | 68.652 | 1.00 | 36.59 | D000 C |
| ATOM | 7961 | O | GLU | P | 197 | −21.077 | −24.064 | 69.166 | 1.00 | 34.20 | D000 O |
| ATOM | 7962 | CB | GLU | P | 197 | −20.674 | −22.458 | 66.315 | 1.00 | 32.94 | D000 C |
| ATOM | 7963 | CG | GLU | P | 197 | −19.417 | −23.347 | 66.343 | 1.00 | 35.50 | D000 C |
| ATOM | 7964 | CD | GLU | P | 197 | −18.383 | −22.948 | 65.292 | 1.00 | 41.89 | D000 C |
| ATOM | 7965 | OE1 | GLU | P | 197 | −18.466 | −21.807 | 64.772 | 1.00 | 45.12 | D000 O |
| ATOM | 7966 | OE2 | GLU | P | 197 | −17.486 | −23.771 | 64.985 | 1.00 | 41.03 | D000 O1− |
| ATOM | 7967 | N | GLN | P | 198 | −21.538 | −21.865 | 69.345 | 1.00 | 32.12 | D000 N |
| ATOM | 7968 | CA | GLN | P | 198 | −21.193 | −21.792 | 70.759 | 1.00 | 31.52 | D000 C |
| ATOM | 7969 | C | GLN | P | 198 | −22.083 | −22.703 | 71.598 | 1.00 | 35.74 | D000 C |
| ATOM | 7970 | O | GLN | P | 198 | −21.600 | −23.403 | 72.501 | 1.00 | 30.28 | D000 O |
| ATOM | 7971 | CB | GLN | P | 198 | −21.298 | −20.334 | 71.226 | 1.00 | 33.50 | D000 C |
| ATOM | 7972 | CG | GLN | P | 198 | −21.391 | −20.126 | 72.734 | 1.00 | 33.84 | D000 C |
| ATOM | 7973 | CD | GLN | P | 198 | −20.055 | −20.173 | 73.450 | 1.00 | 33.31 | D000 C |
| ATOM | 7974 | OE1 | GLN | P | 198 | −19.009 | −19.859 | 72.878 | 1.00 | 30.27 | D000 O |
| ATOM | 7975 | NE2 | GLN | P | 198 | −20.085 | −20.563 | 74.713 | 1.00 | 33.30 | D000 N |

TABLE 10.4-continued

| | | | | | | | | | | | |
|---|---|---|---|---|---|---|---|---|---|---|---|
| ATOM | 7976 | N | LYS | P | 199 | −23.393 | −22.694 | 71.320 | 1.00 | 35.11 | D000 N |
| ATOM | 7977 | CA | LYS | P | 199 | −24.328 | −23.523 | 72.070 | 1.00 | 32.09 | D000 C |
| ATOM | 7978 | C | LYS | P | 199 | −24.070 | −25.009 | 71.828 | 1.00 | 32.10 | D000 C |
| ATOM | 7979 | O | LYS | P | 199 | −24.103 | −25.811 | 72.767 | 1.00 | 31.39 | D000 O |
| ATOM | 7980 | CB | LYS | P | 199 | −25.753 | −23.142 | 71.692 | 1.00 | 31.90 | D000 C |
| ATOM | 7981 | CG | LYS | P | 199 | −26.283 | −21.993 | 72.497 | 1.00 | 34.02 | D000 C |
| ATOM | 7982 | CD | LYS | P | 199 | −27.260 | −21.182 | 71.709 | 1.00 | 36.65 | D000 C |
| ATOM | 7983 | CE | LYS | P | 199 | −28.314 | −22.071 | 71.096 | 1.00 | 40.59 | D000 C |
| ATOM | 7984 | NZ | LYS | P | 199 | −29.444 | −21.249 | 70.594 | 1.00 | 48.36 | D000 N1+ |
| ATOM | 7985 | N | PHE | P | 200 | −23.806 | −25.392 | 70.581 | 1.00 | 28.05 | D000 N |
| ATOM | 7986 | CA | PHE | P | 200 | −23.515 | −26.788 | 70.283 | 1.00 | 28.75 | D000 C |
| ATOM | 7987 | C | PHE | P | 200 | −22.286 | −27.284 | 71.036 | 1.00 | 32.43 | D000 C |
| ATOM | 7988 | O | PHE | P | 200 | −22.287 | −28.399 | 71.568 | 1.00 | 30.79 | D000 O |
| ATOM | 7989 | CB | PHE | P | 200 | −23.318 | −26.956 | 68.787 | 1.00 | 27.58 | D000 C |
| ATOM | 7990 | CG | PHE | P | 200 | −22.644 | −28.222 | 68.417 | 1.00 | 29.26 | D000 C |
| ATOM | 7991 | CD1 | PHE | P | 200 | −23.363 | −29.387 | 68.303 | 1.00 | 28.09 | D000 C |
| ATOM | 7992 | CD2 | PHE | P | 200 | −21.279 | −28.247 | 68.172 | 1.00 | 31.84 | D000 C |
| ATOM | 7993 | CE1 | PHE | P | 200 | −22.747 | −30.561 | 67.943 | 1.00 | 30.20 | D000 C |
| ATOM | 7994 | CE2 | PHE | P | 200 | −20.647 | −29.415 | 67.799 | 1.00 | 31.13 | D000 C |
| ATOM | 7995 | CZ | PHE | P | 200 | −21.385 | −30.577 | 67.682 | 1.00 | 33.34 | D000 C |
| ATOM | 7996 | N | VAL | P | 201 | −21.220 | −26.478 | 71.083 | 1.00 | 30.80 | D000 N |
| ATOM | 7997 | CA | VAL | P | 201 | −20.015 | −26.900 | 71.787 | 1.00 | 31.26 | D000 C |
| ATOM | 7998 | C | VAL | P | 201 | −20.277 | −26.989 | 73.295 | 1.00 | 31.79 | D000 C |
| ATOM | 7999 | O | VAL | P | 201 | −19.849 | −27.947 | 73.948 | 1.00 | 29.59 | D000 O |
| ATOM | 8000 | CB | VAL | P | 201 | −18.836 | −25.959 | 71.458 | 1.00 | 30.91 | D000 C |
| ATOM | 8001 | CG1 | VAL | P | 201 | −17.611 | −26.260 | 72.345 | 1.00 | 32.04 | D000 C |
| ATOM | 8002 | CG2 | VAL | P | 201 | −18.433 | −26.104 | 70.020 | 1.00 | 33.28 | D000 C |
| ATOM | 8003 | N | GLN | P | 202 | −21.001 | −26.012 | 73.862 | 1.00 | 30.50 | D000 N |
| ATOM | 8004 | CA | GLN | P | 202 | −21.323 | −26.044 | 75.290 | 1.00 | 30.37 | D000 C |
| ATOM | 8005 | C | GLN | P | 202 | −22.040 | −27.327 | 75.670 | 1.00 | 25.89 | D000 C |
| ATOM | 8006 | O | GLN | P | 202 | −21.755 | −27.903 | 76.719 | 1.00 | 33.97 | D000 O |
| ATOM | 8007 | CB | GLN | P | 202 | −22.203 | −24.865 | 75.701 | 1.00 | 35.09 | D000 C |
| ATOM | 8008 | CG | GLN | P | 202 | −21.566 | −23.520 | 75.783 | 1.00 | 35.69 | D000 C |
| ATOM | 8009 | CD | GLN | P | 202 | −22.490 | −22.528 | 76.480 | 1.00 | 47.70 | D000 C |
| ATOM | 8010 | OE1 | GLN | P | 202 | −22.615 | −21.351 | 76.078 | 1.00 | 41.49 | D000 O |
| ATOM | 8011 | NE2 | GLN | P | 202 | −23.110 | −22.990 | 77.575 | 1.00 | 49.12 | D000 N |
| ATOM | 8012 | N | HIS | P | 203 | −23.025 | −27.742 | 74.871 | 1.00 | 25.10 | D000 N |
| ATOM | 8013 | CA | HIS | P | 203 | −23.731 | −29.000 | 75.117 | 1.00 | 27.41 | D000 C |
| ATOM | 8014 | C | HIS | P | 203 | −22.780 | −30.154 | 75.316 | 1.00 | 32.74 | D000 C |
| ATOM | 8015 | O | HIS | P | 203 | −22.919 | −30.940 | 76.262 | 1.00 | 37.16 | D000 O |
| ATOM | 8016 | CB | HIS | P | 203 | −24.638 | −29.354 | 73.947 | 1.00 | 31.40 | D000 C |
| ATOM | 8017 | CG | HIS | P | 203 | −26.051 | −28.936 | 74.117 | 1.00 | 37.58 | D000 C |
| ATOM | 8018 | ND1 | HIS | P | 203 | −26.725 | −28.198 | 73.167 | 1.00 | 46.93 | D000 N |
| ATOM | 8019 | CD2 | HIS | P | 203 | −26.942 | −29.204 | 75.098 | 1.00 | 43.64 | D000 C |
| ATOM | 8020 | CE1 | HIS | P | 203 | −27.963 | −27.992 | 73.576 | 1.00 | 52.72 | D000 C |
| ATOM | 8021 | NE2 | HIS | P | 203 | −28.122 | −28.598 | 74.742 | 1.00 | 57.54 | D000 N |
| ATOM | 8022 | N | HIS | P | 204 | −21.809 | −30.280 | 74.406 | 1.00 | 33.87 | D000 N |
| ATOM | 8023 | CA | HIS | P | 204 | −20.952 | −31.453 | 74.375 | 1.00 | 32.62 | D000 C |
| ATOM | 8024 | C | HIS | P | 204 | −19.857 | −31.394 | 75.428 | 1.00 | 30.65 | D000 C |
| ATOM | 8025 | O | HIS | P | 204 | −19.399 | −32.445 | 75.880 | 1.00 | 27.67 | D000 O |
| ATOM | 8026 | CB | HIS | P | 204 | −20.373 | −31.635 | 72.969 | 1.00 | 25.37 | D000 C |
| ATOM | 8027 | CG | HIS | P | 204 | −21.341 | −32.234 | 71.995 | 1.00 | 29.38 | D000 C |
| ATOM | 8028 | ND1 | HIS | P | 204 | −21.525 | −33.593 | 71.869 | 1.00 | 30.92 | D000 N |
| ATOM | 8029 | CD2 | HIS | P | 204 | −22.217 | −31.661 | 71.137 | 1.00 | 32.57 | D000 C |
| ATOM | 8030 | CE1 | HIS | P | 204 | −22.445 | −33.835 | 70.953 | 1.00 | 28.23 | D000 C |
| ATOM | 8031 | NE2 | HIS | P | 204 | −22.883 | −32.678 | 70.494 | 1.00 | 34.46 | D000 N |
| ATOM | 8032 | N | ILE | P | 205 | −19.424 | −30.197 | 75.830 | 1.00 | 28.24 | D000 N |
| ATOM | 8033 | CA | ILE | P | 205 | −18.324 | −30.104 | 76.778 | 1.00 | 27.46 | D000 C |
| ATOM | 8034 | C | ILE | P | 205 | −18.778 | −30.056 | 78.220 | 1.00 | 33.06 | D000 C |
| ATOM | 8035 | O | ILE | P | 205 | −17.952 | −70.295 | 79.111 | 1.00 | 35.39 | D000 O |
| ATOM | 8036 | CB | ILE | P | 205 | −17.392 | −28.907 | 76.513 | 1.00 | 33.12 | D000 C |
| ATOM | 8037 | CG1 | ILE | P | 205 | −18.123 | −27.564 | 76.648 | 1.00 | 26.96 | D000 C |
| ATOM | 8038 | CG2 | ILE | P | 205 | −16.702 | −29.080 | 75.173 | 1.00 | 25.98 | D000 C |
| ATOM | 8039 | CD1 | ILE | P | 205 | −17.174 | −26.412 | 76.624 | 1.00 | 23.08 | D000 C |
| ATOM | 8040 | N | GLY | P | 206 | −20.043 | −29.713 | 78.482 | 1.00 | 35.40 | D000 N |
| ATOM | 8041 | CA | GLY | P | 206 | −20.536 | −29.649 | 79.837 | 1.00 | 29.75 | D000 C |
| ATOM | 8042 | C | GLY | P | 206 | −19.906 | −28.523 | 80.620 | 1.00 | 32.65 | D000 C |
| ATOM | 8043 | O | GLY | P | 206 | −19.313 | −27.601 | 80.053 | 1.00 | 35.11 | D000 O |
| ATOM | 8044 | N | PRO | P | 207 | −20.032 | −28.568 | 81.948 | 1.00 | 33.48 | D000 N |
| ATOM | 8045 | CA | PRO | P | 207 | −19.544 | −27.464 | 82.797 | 1.00 | 31.43 | D000 C |
| ATOM | 8046 | C | PRO | P | 207 | −18.059 | −27.610 | 83.123 | 1.00 | 36.17 | D000 C |
| ATOM | 8047 | O | PRO | P | 207 | −17.637 | −27.650 | 84.288 | 1.00 | 38.20 | D000 O |
| ATOM | 8048 | CB | PRO | P | 207 | −20.443 | −27.590 | 84.032 | 1.00 | 35.30 | D000 C |
| ATOM | 8049 | CG | PRO | P | 207 | −20.723 | −29.073 | 84.132 | 1.00 | 31.37 | D000 C |
| ATOM | 8050 | CD | PRO | P | 207 | −20.694 | −29.628 | 82.727 | 1.00 | 30.51 | D000 C |
| ATOM | 8051 | N | VAL | P | 208 | −17.242 | −27.622 | 82.071 | 1.00 | 35.28 | D000 N |
| ATOM | 8052 | CA | VAL | P | 208 | −15.854 | −28.057 | 82.127 | 1.00 | 31.19 | D000 C |
| ATOM | 8053 | C | VAL | P | 208 | −14.990 | −27.043 | 81.389 | 1.00 | 32.34 | D000 C |
| ATOM | 8054 | O | VAL | P | 208 | −15.252 | −26.754 | 80.217 | 1.00 | 30.13 | D000 O |
| ATOM | 8055 | CB | VAL | P | 208 | −15.733 | −29.454 | 81.493 | 1.00 | 24.39 | D000 C |

TABLE 10.4-continued

| | | | | | | | | | | | |
|---|---|---|---|---|---|---|---|---|---|---|---|
| ATOM | 8056 | CG1 | VAL | P | 208 | −14.304 | −29.927 | 81.433 | 1.00 | 19.72 | D000 C |
| ATOM | 8057 | CG2 | VAL | P | 208 | −16.623 | −30.417 | 82.259 | 1.00 | 26.85 | D000 C |
| ATOM | 8058 | N | ASN | P | 209 | −13.955 | −26.514 | 82.065 | 1.00 | 33.01 | D000 N |
| ATOM | 8059 | CA | ASN | P | 209 | −12.987 | −25.628 | 81.404 | 1.00 | 28.33 | D000 C |
| ATOM | 8060 | C | ASN | P | 209 | −12.325 | −26.339 | 80.224 | 1.00 | 28.70 | D000 C |
| ATOM | 8061 | O | ASN | P | 209 | −11.666 | −27.369 | 80.409 | 1.00 | 26.30 | D000 O |
| ATOM | 8062 | CB | ASN | P | 209 | −11.911 | −25.165 | 82.388 | 1.00 | 26.60 | D000 C |
| ATOM | 8063 | CG | ASN | P | 209 | −12.401 | −24.116 | 83.370 | 1.00 | 27.81 | D000 C |
| ATOM | 8064 | OD1 | ASN | P | 209 | −13.324 | −23.343 | 83.094 | 1.00 | 31.03 | D000 O |
| ATOM | 8065 | ND2 | ASN | P | 209 | −11.774 | −24.083 | 84.528 | 1.00 | 22.70 | D000 N |
| ATOM | 8066 | N | THR | P | 210 | −12.487 | −25.786 | 79.017 | 1.00 | 27.48 | D000 N |
| ATOM | 8067 | CA | THR | P | 210 | −12.049 | −26.451 | 77.790 | 1.00 | 27.53 | D000 C |
| ATOM | 8068 | C | THR | P | 210 | −11.385 | −25.441 | 76.860 | 1.00 | 29.97 | D000 C |
| ATOM | 8069 | O | THR | P | 210 | −11.918 | −24.350 | 76.656 | 1.00 | 28.86 | D000 O |
| ATOM | 8070 | CB | THR | P | 210 | −13.223 | −27.156 | 77.082 | 1.00 | 28.24 | D000 C |
| ATOM | 8071 | OG1 | THR | P | 210 | −13.710 | −28.226 | 77.908 | 1.00 | 30.12 | D000 O |
| ATOM | 8072 | CG2 | THR | P | 210 | −12.801 | −27.746 | 75.755 | 1.00 | 23.19 | D000 C |
| ATOM | 8073 | N | TRP | P | 211 | −10.219 | −25.797 | 76.313 | 1.00 | 29.85 | D000 N |
| ATOM | 8074 | CA | TRP | P | 211 | −9.514 | −24.902 | 75.399 | 1.00 | 31.37 | D000 C |
| ATOM | 8075 | C | TRP | P | 211 | −10.280 | −24.746 | 74.099 | 1.00 | 34.18 | D000 C |
| ATOM | 8076 | O | TRP | P | 211 | −10.884 | −25.707 | 73.604 | 1.00 | 32.26 | D000 O |
| ATOM | 8077 | CB | TRP | P | 211 | −8.122 | −25.430 | 75.046 | 1.00 | 26.53 | D000 C |
| ATOM | 8078 | CG | TRP | P | 211 | −7.115 | −25.421 | 76.131 | 1.00 | 30.84 | D000 C |
| ATOM | 8079 | CD1 | TRP | P | 211 | −6.341 | −26.470 | 76.523 | 1.00 | 29.48 | D000 C |
| ATOM | 8080 | CD2 | TRP | P | 211 | −6.740 | −24.312 | 76.959 | 1.00 | 29.42 | D000 C |
| ATOM | 8081 | NE1 | TRP | P | 211 | −5.507 | −26.084 | 77.538 | 1.00 | 29.42 | D000 N |
| ATOM | 8082 | CE2 | TRP | P | 211 | −5.740 | −24.768 | 77.832 | 1.00 | 29.17 | D000 C |
| ATOM | 8083 | CE3 | TRP | P | 211 | −7.150 | −22.979 | 77.041 | 1.00 | 31.34 | D000 C |
| ATOM | 8084 | CZ2 | TRP | P | 211 | −5.145 | −23.942 | 78.778 | 1.00 | 31.63 | D000 C |
| ATOM | 8085 | CZ3 | TRP | P | 211 | −6.563 | −22.163 | 77.977 | 1.00 | 28.33 | D000 C |
| ATOM | 8086 | CH2 | TRP | P | 211 | −5.568 | −22.642 | 78.830 | 1.00 | 30.22 | D000 C |
| ATOM | 8087 | N | MET | P | 212 | −10.227 | −23.530 | 73.540 | 1.00 | 33.06 | D000 N |
| ATOM | 8088 | CA | MET | P | 212 | −10.647 | −23.222 | 72.175 | 1.00 | 33.50 | D000 C |
| ATOM | 8089 | C | MET | P | 212 | −9.461 | −22.623 | 71.415 | 1.00 | 35.69 | D000 C |
| ATOM | 8090 | O | MET | P | 212 | −8.401 | −22.362 | 71.985 | 1.00 | 33.28 | D000 O |
| ATOM | 8091 | CB | MET | P | 212 | −11.841 | −22.265 | 72.153 | 1.00 | 27.35 | D000 C |
| ATOM | 8092 | CG | MET | P | 212 | −11.442 | −20.835 | 72.335 | 1.00 | 34.07 | D000 C |
| ATOM | 8093 | SD | MET | P | 212 | −12.807 | −19.717 | 72.680 | 1.00 | 33.50 | D000 S |
| ATOM | 8094 | CE | MET | P | 212 | −13.264 | −20.227 | 74.323 | 1.00 | 34.96 | D000 C |
| ATOM | 8095 | N | GLY | P | 213 | −9.615 | −22.465 | 70.099 | 1.00 | 38.96 | D000 N |
| ATOM | 8096 | CA | GLY | P | 213 | −8.538 | −21.941 | 69.266 | 1.00 | 36.71 | D000 C |
| ATOM | 8097 | C | GLY | P | 213 | −8.397 | −20.437 | 69.293 | 1.00 | 36.61 | D000 C |
| ATOM | 8098 | O | GLY | P | 213 | −8.265 | −19.807 | 68.237 | 1.00 | 34.15 | D000 O |
| ATOM | 8099 | N | LEU | P | 214 | −8.113 | −19.847 | 70.472 | 1.00 | 37.22 | D000 N |
| ATOM | 8100 | CA | LEU | P | 214 | −7.994 | −18.399 | 70.609 | 1.00 | 40.19 | D000 C |
| ATOM | 8101 | C | LEU | P | 214 | −6.897 | −18.065 | 71.618 | 1.00 | 44.61 | D000 C |
| ATOM | 8102 | O | LEU | P | 214 | −6.928 | −18.534 | 72.761 | 1.00 | 42.53 | D000 O |
| ATOM | 8103 | CB | LEU | P | 214 | −9.340 | −17.783 | 71.019 | 1.00 | 36.46 | D000 C |
| ATOM | 8104 | CG | LEU | P | 214 | −9.420 | −16.273 | 71.253 | 1.00 | 39.49 | D000 C |
| ATOM | 8105 | CD1 | LEU | P | 214 | −9.308 | −15.528 | 69.943 | 1.00 | 39.79 | D000 C |
| ATOM | 8106 | CD2 | LEU | P | 214 | −10.692 | −15.890 | 71.983 | 1.00 | 37.37 | D000 C |
| ATOM | 8107 | N | HIS | P | 215 | −5.914 | −17.274 | 71.191 | 1.00 | 47.99 | D000 N |
| ATOM | 8108 | CA | HIS | P | 215 | −4.787 | −16.902 | 72.042 | 1.00 | 53.52 | D000 C |
| ATOM | 8109 | C | HIS | P | 215 | −4.270 | −15.525 | 71.632 | 1.00 | 50.41 | D000 C |
| ATOM | 8110 | O | HIS | P | 215 | −4.496 | −15.076 | 70.506 | 1.00 | 50.05 | D000 O |
| ATOM | 8111 | CB | HIS | P | 215 | −3.668 | −17.936 | 71.988 | 1.00 | 48.40 | D000 C |
| ATOM | 8112 | CG | HIS | P | 215 | −3.026 | −18.112 | 70.645 | 1.00 | 51.27 | D000 C |
| ATOM | 8113 | ND1 | HIS | P | 215 | −1.709 | −18.488 | 70.490 | 1.00 | 52.99 | D000 N |
| ATOM | 8114 | CD2 | HIS | P | 215 | −3.517 | −17.937 | 69.394 | 1.00 | 48.48 | D000 C |
| ATOM | 8115 | CE1 | HIS | P | 215 | −1.417 | −18.539 | 69.203 | 1.00 | 55.12 | D000 C |
| ATOM | 8116 | NE2 | HIS | P | 215 | −2.496 | −18.205 | 68.517 | 1.00 | 52.31 | D000 N |
| ATOM | 8117 | N | ASP | P | 216 | −3.639 | −14.826 | 72.579 | 1.00 | 50.32 | D000 N |
| ATOM | 8118 | CA | ASP | P | 216 | −2.999 | −13.547 | 72.283 | 1.00 | 62.90 | D000 C |
| ATOM | 8119 | C | ASP | P | 216 | −1.529 | −13.584 | 72.680 | 1.00 | 66.62 | D000 C |
| ATOM | 8120 | O | ASP | P | 216 | −0.957 | −12.579 | 73.111 | 1.00 | 70.47 | D000 O |
| ATOM | 8121 | CB | ASP | P | 216 | −3.730 | −12.376 | 72.949 | 1.00 | 58.20 | D000 C |
| ATOM | 8122 | CG | ASP | P | 216 | −3.387 | −12.201 | 74.428 | 1.00 | 62.56 | D000 C |
| ATOM | 8123 | OD1 | ASP | P | 216 | −2.915 | −13.156 | 75.088 | 1.00 | 67.95 | D000 O |
| ATOM | 8124 | OD2 | ASP | P | 216 | −3.613 | −11.088 | 74.942 | 1.00 | 66.89 | D000 O1− |
| ATOM | 8125 | N | GLN | P | 217 | −0.907 | −14.751 | 72.520 | 1.00 | 64.97 | D000 N |
| ATOM | 8126 | CA | GLN | P | 217 | 0.521 | −14.866 | 72.771 | 1.00 | 76.33 | D000 C |
| ATOM | 8127 | C | GLN | P | 217 | 1.312 | −13.867 | 71.944 | 1.00 | 79.09 | D000 C |
| ATOM | 8128 | O | GLN | P | 217 | 2.439 | −13.521 | 72.314 | 1.00 | 84.36 | D000 O |
| ATOM | 8129 | CB | GLN | P | 217 | 0.981 | −16.309 | 72.509 | 1.00 | 76.19 | D000 C |
| ATOM | 8130 | CG | GLN | P | 217 | 0.950 | −17.206 | 73.776 | 1.00 | 69.70 | D000 C |
| ATOM | 8131 | CD | GLN | P | 217 | 0.539 | −18.645 | 73.498 | 1.00 | 61.34 | D000 C |
| ATOM | 8132 | OE1 | GLN | P | 217 | −0.353 | −18.897 | 72.690 | 1.00 | 62.21 | D000 O |
| ATOM | 8133 | NE2 | GLN | P | 217 | 1.177 | −19.597 | 74.185 | 1.00 | 61.50 | D000 N |
| ATOM | 8134 | N | ASN | P | 218 | 0.722 | −13.361 | 70.863 | 1.00 | 80.19 | D000 N |
| ATOM | 8135 | CA | ASN | P | 218 | 1.363 | −12.319 | 70.073 | 1.00 | 87.85 | D000 C |

TABLE 10.4-continued

| ATOM | 8136 | C | ASN | P | 218 | 1.275 | −10.964 | 70.775 | 1.00 | 79.48 | D000 | C |
|---|---|---|---|---|---|---|---|---|---|---|---|---|
| ATOM | 8137 | O | ASN | P | 218 | 2.294 | −10.367 | 71.140 | 1.00 | 80.45 | D000 | O |
| ATOM | 8138 | CB | ASN | P | 218 | 0.705 | −12.268 | 68.689 | 1.00 | 84.56 | D000 | C |
| ATOM | 8139 | CG | ASN | P | 218 | 1.684 | −11.916 | 67.594 | 1.00 | 89.88 | D000 | C |
| ATOM | 8140 | OD1 | ASN | P | 218 | 1.373 | −12.042 | 66.404 | 1.00 | 90.71 | D000 | O |
| ATOM | 8141 | ND2 | ASN | P | 218 | 2.891 | −11.507 | 67.986 | 1.00 | 84.53 | D000 | N |
| ATOM | 8142 | N | GLY | P | 219 | 0.059 | −10.514 | 71.040 | 1.00 | 74.18 | D000 | N |
| ATOM | 8143 | CA | GLY | P | 219 | −0.212 | −9.187 | 71.530 | 1.00 | 68.61 | D000 | C |
| ATOM | 8144 | C | GLY | P | 219 | −1.710 | −8.949 | 71.462 | 1.00 | 73.97 | D000 | C |
| ATOM | 8145 | O | GLY | P | 219 | −2.366 | −8.740 | 72.489 | 1.00 | 71.33 | D000 | O |
| ATOM | 8146 | N | PRO | P | 220 | −2.285 | −9.017 | 70.255 | 1.00 | 69.70 | D000 | N |
| ATOM | 8147 | CA | PRO | P | 220 | −3.745 | −9.029 | 70.112 | 1.00 | 69.83 | D000 | C |
| ATOM | 8148 | C | PRO | P | 220 | −4.304 | −10.446 | 70.009 | 1.00 | 67.70 | D000 | C |
| ATOM | 8149 | O | PRO | P | 220 | −3.608 | −11.402 | 69.652 | 1.00 | 66.31 | D000 | O |
| ATOM | 8150 | CB | PRO | P | 220 | −3.967 | −8.274 | 68.792 | 1.00 | 64.94 | D000 | C |
| ATOM | 8151 | CG | PRO | P | 220 | −2.674 | −8.444 | 68.009 | 1.00 | 60.23 | D000 | C |
| ATOM | 8152 | CD | PRO | P | 220 | −1.625 | −9.035 | 68.933 | 1.00 | 70.78 | D000 | C |
| ATOM | 8153 | N | TRP | P | 221 | −5.595 | −10.568 | 70.309 | 1.00 | 58.78 | D000 | N |
| ATOM | 8154 | CA | TRP | P | 221 | −6.244 | −11.868 | 70.228 | 1.00 | 52.55 | D000 | C |
| ATOM | 8155 | C | TRP | P | 221 | −6.415 | −12.290 | 68.778 | 1.00 | 51.19 | D000 | C |
| ATOM | 8156 | O | TRP | P | 221 | −6.795 | −11.486 | 67.920 | 1.00 | 53.28 | D000 | O |
| ATOM | 8157 | CB | TRP | P | 221 | −7.601 | −11.831 | 70.940 | 1.00 | 52.62 | D000 | C |
| ATOM | 8158 | CG | TRP | P | 221 | −7.438 | −11.729 | 72.425 | 1.00 | 50.70 | D000 | C |
| ATOM | 8159 | CD1 | TRP | P | 221 | −7.477 | −10.597 | 73.179 | 1.00 | 52.92 | D000 | C |
| ATOM | 8160 | CD2 | TRP | P | 221 | −7.164 | −12.807 | 73.332 | 1.00 | 48.63 | D000 | C |
| ATOM | 8161 | NE1 | TRP | P | 221 | −7.256 | −10.901 | 74.505 | 1.00 | 54.57 | D000 | N |
| ATOM | 8162 | CE2 | TRP | P | 221 | −7.058 | −12.251 | 74.624 | 1.00 | 49.93 | D000 | C |
| ATOM | 8163 | CE3 | TRP | P | 221 | −7.001 | −14.189 | 73.177 | 1.00 | 46.93 | D000 | C |
| ATOM | 8164 | CZ2 | TRP | P | 221 | −6.796 | −13.029 | 75.757 | 1.00 | 50.65 | D000 | C |
| ATOM | 8165 | CZ3 | TRP | P | 221 | −6.739 | −14.960 | 74.303 | 1.00 | 46.92 | D000 | C |
| ATOM | 8166 | CH2 | TRP | P | 221 | −6.643 | −14.377 | 75.575 | 1.00 | 48.14 | D000 | C |
| ATOM | 8167 | N | LYS | P | 222 | −6.132 | −13.568 | 68.51 | 1.00 | 50.38 | D000 | N |
| ATOM | 8168 | CA | LYS | P | 222 | −6.213 | −14.155 | 67.178 | 1.00 | 52.36 | D000 | C |
| ATOM | 8169 | C | LYS | P | 222 | −6.785 | −15.564 | 67.274 | 1.00 | 48.11 | D000 | C |
| ATOM | 8170 | O | LYS | P | 222 | −6.551 | −16.277 | 68.253 | 1.00 | 43.41 | D000 | O |
| ATOM | 8171 | CB | LYS | P | 222 | −4.842 | −14.247 | 66.473 | 1.00 | 48.15 | D000 | C |
| ATOM | 8172 | CG | LYS | P | 222 | −3.989 | −31.006 | 66.480 | 1.00 | 49.51 | D000 | C |
| ATOM | 8173 | CD | LYS | P | 222 | −2.623 | −13.343 | 65.879 | 1.00 | 63.49 | D000 | C |
| ATOM | 8174 | CE | LYS | P | 222 | −1.744 | −12.107 | 65.682 | 1.00 | 74.29 | D000 | C |
| ATOM | 8175 | NZ | LYS | P | 222 | −0.559 | −12.385 | 64.812 | 1.00 | 71.05 | D000 | N1+ |
| ATOM | 8176 | N | TRP | P | 223 | −7.518 | −15.967 | 66.239 | 1.00 | 46.69 | D000 | N |
| ATOM | 8177 | CA | TRP | P | 223 | −7.966 | −17.345 | 66.081 | 1.00 | 40.92 | D000 | C |
| ATOM | 8178 | C | TRP | P | 223 | −6.901 | −18.155 | 65.334 | 1.00 | 42.46 | D000 | C |
| ATOM | 8179 | O | TRP | P | 223 | −6.100 | −17.605 | 64.578 | 1.00 | 42.65 | D000 | O |
| ATOM | 8180 | CB | TRP | P | 223 | −9.314 | −17.398 | 65.346 | 1.00 | 38.25 | D000 | C |
| ATOM | 8181 | CG | TRP | P | 223 | −10.464 | −16.803 | 66.160 | 1.00 | 46.60 | D000 | C |
| ATOM | 8182 | CD1 | TRP | P | 223 | −10.918 | −15.508 | 66.115 | 1.00 | 44.78 | D000 | C |
| ATOM | 8183 | CD2 | TRP | P | 223 | −11.284 | −17.476 | 67.141 | 1.00 | 41.63 | D000 | C |
| ATOM | 8184 | NE1 | TRP | P | 223 | −11.954 | −15.337 | 67.003 | 1.00 | 45.05 | D000 | N |
| ATOM | 8185 | CE2 | TRP | P | 223 | −12.203 | −16.526 | 67.641 | 1.00 | 43.02 | D000 | C |
| ATOM | 8186 | CE3 | TRP | P | 223 | −11.328 | −18.786 | 67.644 | 1.00 | 40.53 | D000 | C |
| ATOM | 8187 | CZ2 | TRP | P | 223 | −13.152 | −16.843 | 68.628 | 1.00 | 38.24 | D000 | C |
| ATOM | 8188 | CZ3 | TRP | P | 223 | −12.271 | −19.097 | 68.619 | 1.00 | 38.15 | D000 | C |
| ATOM | 8189 | CH2 | TRP | P | 223 | −13.165 | −18.125 | 69.103 | 1.00 | 37.47 | D000 | C |
| ATOM | 8190 | N | VAL | P | 224 | −6.863 | −19.466 | 65.601 | 1.00 | 41.18 | D000 | N |
| ATOM | 8191 | CA | VAL | P | 224 | −5.813 | −20.316 | 65.049 | 1.00 | 40.27 | D000 | C |
| ATOM | 8192 | C | VAL | P | 224 | −5.952 | −20.568 | 63.553 | 1.00 | 43.70 | D000 | C |
| ATOM | 8193 | O | VAL | P | 224 | −4.977 | −20.993 | 62.918 | 1.00 | 45.37 | D000 | O |
| ATOM | 8194 | CB | VAL | P | 224 | −5.738 | −21.679 | 65.760 | 1.00 | 35.45 | D000 | C |
| ATOM | 8195 | CG1 | VAL | P | 224 | −5.402 | −21.490 | 67.200 | 1.00 | 39.13 | D000 | C |
| ATOM | 8196 | CG2 | VAL | P | 224 | −7.025 | −22.441 | 65.581 | 1.00 | 35.78 | D000 | C |
| ATOM | 8197 | N | ASP | P | 225 | −7.132 | −20.379 | 62.966 | 1.00 | 45.80 | D000 | N |
| ATOM | 8198 | CA | ASP | P | 225 | −7.297 | −20.628 | 61.535 | 1.00 | 47.35 | D000 | C |
| ATOM | 8199 | C | ASP | P | 225 | −7.260 | −19.343 | 60.721 | 1.00 | 44.18 | D000 | C |
| ATOM | 8200 | O | ASP | P | 225 | −7.418 | −19.380 | 59.496 | 1.00 | 41.75 | D000 | O |
| ATOM | 8201 | CB | ASP | P | 225 | −8.590 | −21.431 | 61.261 | 1.00 | 42.90 | D000 | C |
| ATOM | 8202 | CG | ASP | P | 225 | −9.864 | −20.593 | 61.367 | 1.00 | 45.62 | D000 | C |
| ATOM | 8203 | OD1 | ASP | P | 225 | −9.832 | −19.473 | 61.933 | 1.00 | 42.32 | D000 | O |
| ATOM | 8204 | OD2 | ASP | P | 225 | −10.912 | −21.079 | 60.878 | 1.00 | 49.08 | D000 | O1− |
| ATOM | 8205 | N | GLY | P | 226 | −7.023 | −18.215 | 61.373 | 1.00 | 42.84 | D000 | N |
| ATOM | 8206 | CA | GLY | P | 226 | −6.919 | −16.957 | 60.693 | 1.00 | 37.63 | D000 | C |
| ATOM | 8207 | C | GLY | P | 226 | −8.168 | −16.131 | 60.725 | 1.00 | 40.53 | D000 | C |
| ATOM | 8208 | O | GLY | P | 226 | −8.089 | −14.938 | 60.408 | 1.00 | 43.36 | D000 | O |
| ATOM | 8209 | N | THR | P | 227 | −9.315 | −16.725 | 61.089 | 1.00 | 42.48 | D000 | N |
| ATOM | 8210 | CA | THR | P | 227 | −10.562 | −15.973 | 61.156 | 1.00 | 39.26 | D000 | C |
| ATOM | 8211 | C | THR | P | 227 | −10.348 | −14.706 | 61.974 | 1.00 | 43.02 | D000 | C |
| ATOM | 8212 | O | THR | P | 227 | −9.666 | −14.722 | 63.005 | 1.00 | 41.15 | D000 | O |
| ATOM | 8213 | CB | THR | P | 227 | −11.684 | −16.819 | 61.760 | 1.00 | 38.82 | D000 | C |
| ATOM | 8214 | OG1 | THR | P | 227 | −11.803 | −18.060 | 61.044 | 1.00 | 45.33 | D000 | O |
| ATOM | 8215 | CG2 | THR | P | 227 | −13.015 | −16.065 | 61.694 | 1.00 | 30.94 | D000 | C |

TABLE 10.4-continued

| | | | | | | | | | | | |
|---|---|---|---|---|---|---|---|---|---|---|---|
| ATOM | 8216 | N | ASP | P | 228 | −10.899 | −13.600 | 61.485 | 1.00 | 35.97 | D000 N |
| ATOM | 8217 | CA | ASP | P | 228 | −10.647 | −12.323 | 62.128 | 1.00 | 43.82 | D000 C |
| ATOM | 8218 | C | ASP | P | 228 | −11.342 | −12.271 | 63.487 | 1.00 | 45.21 | D000 C |
| ATOM | 8219 | O | ASP | P | 228 | −12.534 | −12.577 | 63.606 | 1.00 | 44.16 | D000 O |
| ATOM | 8220 | CB | ASP | P | 228 | −11.127 | −11.167 | 61.243 | 1.00 | 38.78 | D000 C |
| ATOM | 8221 | CG | ASP | P | 228 | −10.940 | −9.817 | 61.909 | 1.00 | 49.28 | D000 C |
| ATOM | 8222 | OD1 | ASP | P | 228 | −9.775 | −9.419 | 62.162 | 1.00 | 54.97 | D000 O |
| ATOM | 8223 | OD2 | ASP | P | 228 | −11.958 | −9.175 | 62.242 | 1.00 | 50.80 | D000 O1− |
| ATOM | 8224 | N | TYR | P | 229 | −10.601 | −11.828 | 64.501 | 1.00 | 48.02 | D000 N |
| ATOM | 8225 | CA | TYR | P | 229 | −11.132 | −11.730 | 65.857 | 1.00 | 49.96 | D000 C |
| ATOM | 8226 | C | TYR | P | 229 | −11.979 | −10.481 | 66.041 | 1.00 | 49.04 | D000 C |
| ATOM | 8227 | O | TYR | P | 229 | −13.064 | −10.540 | 66.628 | 1.00 | 53.87 | D000 O |
| ATOM | 8228 | CB | TYR | P | 229 | −9.995 | −11.743 | 66.883 | 1.00 | 44.05 | D000 C |
| ATOM | 8229 | CG | TYR | P | 229 | −10.439 | −11.358 | 68.269 | 1.00 | 45.49 | D000 C |
| ATOM | 8230 | CD2 | TYR | P | 229 | −10.286 | −10.061 | 68.725 | 1.00 | 53.43 | D000 C |
| ATOM | 8231 | CD1 | TYR | P | 229 | −10.994 | −12.296 | 69.132 | 1.00 | 44.65 | D000 C |
| ATOM | 8232 | CE2 | TYR | P | 229 | −10.684 | −9.695 | 69.997 | 1.00 | 56.58 | D000 C |
| ATOM | 8233 | CE1 | TYR | P | 229 | −11.403 | −11.944 | 70.406 | 1.00 | 46.74 | D000 C |
| ATOM | 8234 | CZ | TYR | P | 229 | −11.243 | −10.638 | 70.838 | 1.00 | 52.93 | D000 C |
| ATOM | 8235 | OH | TYR | P | 229 | −11.634 | −10.250 | 72.104 | 1.00 | 43.44 | D000 O |
| ATOM | 8236 | N | GLU | P | 230 | −11.503 | −9.341 | 65.555 | 1.00 | 51.91 | D000 N |
| ATOM | 8237 | CA | GLU | P | 230 | −12.119 | −8.087 | 65.968 | 1.00 | 56.16 | D000 C |
| ATOM | 8238 | C | GLU | P | 230 | −13.560 | −7.995 | 65.476 | 1.00 | 54.64 | D000 C |
| ATOM | 8239 | O | GLU | P | 230 | −14.468 | −7.629 | 66.236 | 1.00 | 52.29 | D000 O |
| ATOM | 8240 | CB | GLU | P | 230 | −11.292 | −6.908 | 65.456 | 1.00 | 50.78 | D000 C |
| ATOM | 8241 | CG | GLU | P | 230 | −11.547 | −5.640 | 66.240 | 1.00 | 59.32 | D000 C |
| ATOM | 8242 | CD | GLU | P | 230 | −11.610 | −5.897 | 97.751 | 1.00 | 65.21 | D000 C |
| ATOM | 8243 | OE1 | GLU | P | 230 | −10.556 | −6.220 | 68.353 | 1.00 | 63.19 | D000 O |
| ATOM | 8244 | OE2 | GLU | P | 230 | −12.718 | −5.790 | 68.330 | 1.00 | 66.54 | D000 O1− |
| ATOM | 8245 | N | THR | P | 231 | −13.797 | −8.382 | 64.231 | 1.00 | 49.30 | D000 N |
| ATOM | 8246 | CA | THR | P | 231 | −15.125 | −8.335 | 63.651 | 1.00 | 49.06 | D000 C |
| ATOM | 8247 | C | THR | P | 231 | −15.943 | −9.595 | 63.913 | 1.00 | 48.66 | D000 C |
| ATOM | 8248 | O | THR | P | 231 | −17.084 | −9.685 | 63.450 | 1.00 | 46.72 | D000 O |
| ATOM | 8249 | CB | THR | P | 231 | −14.999 | −8.096 | 62.145 | 1.00 | 51.91 | D000 C |
| ATOM | 8250 | OG1 | THR | P | 231 | −14.418 | −9.247 | 61.519 | 1.00 | 49.55 | D000 O |
| ATOM | 8251 | CG2 | THR | P | 231 | −14.092 | −6.893 | 61.895 | 1.00 | 44.25 | D000 C |
| ATOM | 8252 | N | GLY | P | 232 | −15.374 | −10.596 | 64.593 | 1.00 | 53.28 | D000 N |
| ATOM | 8253 | CA | GLY | P | 232 | −16.057 | −11.861 | 64.770 | 1.00 | 51.71 | D000 C |
| ATOM | 8254 | C | GLY | P | 232 | −16.832 | −11.982 | 66.082 | 1.00 | 49.39 | D000 C |
| ATOM | 8255 | O | GLY | P | 232 | −16.750 | −11.136 | 66.974 | 1.00 | 45.77 | D000 O |
| ATOM | 8256 | N | PHE | P | 233 | −17.569 | −13.087 | 66.178 | 1.00 | 46.98 | D000 N |
| ATOM | 8257 | CA | PHE | P | 233 | −18.353 | −13.412 | 67.362 | 1.00 | 45.41 | D000 C |
| ATOM | 8258 | C | PHE | P | 233 | −17.477 | −13.478 | 68.610 | 1.00 | 43.09 | D000 C |
| ATOM | 8259 | O | PHE | P | 233 | −16.350 | −13.978 | 68.572 | 1.00 | 40.14 | D000 O |
| ATOM | 8260 | CB | PHE | P | 233 | −19.050 | −14.755 | 67.133 | 1.00 | 43.80 | D000 C |
| ATOM | 8261 | CG | PHE | P | 233 | −19.795 | −15.261 | 68.318 | 1.00 | 41.20 | D000 C |
| ATOM | 8262 | CD1 | PHE | P | 233 | −21.056 | −14.778 | 68.620 | 1.00 | 42.87 | D000 C |
| ATOM | 8263 | CD2 | PHE | P | 233 | −19.235 | −16.234 | 69.130 | 1.00 | 41.22 | D000 C |
| ATOM | 8264 | CE1 | PHE | P | 233 | −21.746 | −15.250 | 69.718 | 1.00 | 43.07 | D000 C |
| ATOM | 8265 | CE2 | PHE | P | 233 | −19.917 | −16.712 | 70.232 | 1.00 | 42.28 | D000 C |
| ATOM | 8266 | CZ | PHE | P | 233 | −21.179 | −16.221 | 70.526 | 1.00 | 42.72 | D000 C |
| ATOM | 8267 | N | LYS | P | 234 | −18.005 | −12.976 | 69.728 | 1.00 | 42.82 | D000 N |
| ATOM | 8268 | CA | LYS | P | 234 | −17.292 | −12.988 | 71.000 | 1.00 | 37.90 | D000 C |
| ATOM | 8269 | C | LYS | P | 234 | −18.268 | −13.294 | 72.133 | 1.00 | 41.60 | D000 C |
| ATOM | 8270 | O | LYS | P | 234 | −19.440 | −12.901 | 72.093 | 1.00 | 44.48 | D000 O |
| ATOM | 8271 | CB | LYS | P | 234 | −16.596 | −11.656 | 71.279 | 1.00 | 35.56 | D000 C |
| ATOM | 8272 | CG | LYS | P | 234 | −15.570 | −11.240 | 70.265 | 1.00 | 40.67 | D000 C |
| ATOM | 8273 | CD | LYS | P | 234 | −14.974 | −9.900 | 70.655 | 1.00 | 45.48 | D000 C |
| ATOM | 8274 | CE | LYS | P | 234 | −14.396 | −9.152 | 69.453 | 1.00 | 51.18 | D000 C |
| ATOM | 8275 | NZ | LYS | P | 234 | −15.432 | −8.815 | 68.436 | 1.00 | 50.83 | D000 N1+ |
| ATOM | 8276 | N | ASN | P | 235 | −17.770 | −13.978 | 73.161 | 1.00 | 41.60 | D000 N |
| ATOM | 8277 | CA | ASN | P | 235 | −18.619 | −14.402 | 74.273 | 1.00 | 37.71 | D000 C |
| ATOM | 8278 | C | ASN | P | 235 | −17.822 | −14.433 | 75.583 | 1.00 | 37.90 | D000 C |
| ATOM | 8279 | O | ASN | P | 235 | −17.903 | −15.379 | 76.370 | 1.00 | 37.72 | D000 O |
| ATOM | 8280 | CB | ASN | P | 235 | −19.249 | −15.757 | 73.947 | 1.00 | 35.17 | D000 C |
| ATOM | 8281 | CG | ASN | P | 235 | −20.286 | −16.187 | 74.963 | 1.00 | 40.71 | D000 C |
| ATOM | 8282 | OD1 | ASN | P | 235 | −20.393 | −17.373 | 75.280 | 1.00 | 40.09 | D000 O |
| ATOM | 8283 | ND2 | ASN | P | 235 | −21.034 | −15.228 | 75.504 | 1.00 | 41.85 | D000 N |
| ATOM | 8284 | N | TRP | P | 236 | −17.096 | −13.353 | 75.867 | 1.00 | 39.79 | D000 N |
| ATOM | 8285 | CA | TRP | P | 236 | −16.261 | −13.296 | 77.062 | 1.00 | 46.37 | D000 C |
| ATOM | 8286 | C | TRP | P | 236 | −17.096 | −13.235 | 78.337 | 1.00 | 41.70 | D000 C |
| ATOM | 8287 | O | TRP | P | 236 | −18.198 | −12.687 | 78.359 | 1.00 | 49.28 | D000 O |
| ATOM | 8288 | CB | TRP | P | 236 | −15.335 | −12.082 | 77.009 | 1.00 | 45.14 | D000 C |
| ATOM | 8289 | CG | TRP | P | 236 | −14.278 | −12.168 | 75.954 | 1.00 | 47.98 | D000 C |
| ATOM | 8290 | CD1 | TRP | P | 236 | −14.263 | −11.524 | 74.742 | 1.00 | 45.52 | D000 C |
| ATOM | 8291 | CD2 | TRP | P | 236 | −13.076 | −12.948 | 76.010 | 1.00 | 46.16 | D000 C |
| ATOM | 8292 | NE1 | TRP | P | 236 | −13.122 | −11.854 | 74.047 | 1.00 | 47.86 | D000 N |
| ATOM | 8293 | CE2 | TRP | P | 236 | −12.377 | −12.728 | 74.800 | 1.00 | 48.95 | D000 C |
| ATOM | 8294 | CE3 | TRP | P | 236 | −12.524 | −13.813 | 76.961 | 1.00 | 44.69 | D000 C |
| ATOM | 8295 | CZ2 | TRP | P | 236 | −11.155 | −13.347 | 74.517 | 1.00 | 41.16 | D000 C |

TABLE 10.4-continued

| | | | | | | | | | | |
|---|---|---|---|---|---|---|---|---|---|---|
| ATOM | 8296 | CZ3 | TRP | P | 236 | −11.303 | −14.427 | 76.679 | 1.00 | 46.91 | D000 C |
| ATOM | 8297 | CH2 | TRP | P | 236 | −10.630 | −14.180 | 75.469 | 1.00 | 44.61 | D000 C |
| ATOM | 8298 | N | ARG | P | 237 | −16.554 | −13.787 | 79.415 | 1.00 | 41.38 | D000 N |
| ATOM | 8299 | CA | ARG | P | 237 | −17.130 | −13.493 | 80.718 | 1.00 | 53.87 | D000 C |
| ATOM | 8300 | C | ARG | P | 237 | −16.928 | −12.007 | 80.992 | 1.00 | 61.28 | D000 C |
| ATOM | 8301 | O | ARG | P | 237 | −15.886 | −11.452 | 80.630 | 1.00 | 66.27 | D000 O |
| ATOM | 8302 | CB | ARG | P | 237 | −16.478 | −14.322 | 81.833 | 1.00 | 53.42 | D000 C |
| ATOM | 8303 | CG | ARG | P | 237 | −16.800 | −15.823 | 81.816 | 1.00 | 47.57 | D000 C |
| ATOM | 8304 | CD | ARG | P | 237 | −18.062 | −16.175 | 82.614 | 1.00 | 51.09 | D000 C |
| ATOM | 8305 | NE | ARG | P | 237 | −17.828 | −16.314 | 84.057 | 1.00 | 58.37 | D000 N |
| ATOM | 8306 | CZ | ARG | P | 237 | −17.838 | −17.466 | 84.735 | 1.00 | 56.45 | D000 C |
| ATOM | 8307 | NH1 | ARG | P | 237 | −18.083 | −18.621 | 84.123 | 1.00 | 48.82 | D000 N1+ |
| ATOM | 8308 | NH2 | ARG | P | 237 | −17.612 | −17.462 | 86.046 | 1.00 | 63.83 | D000 N |
| ATOM | 8309 | N | PRO | P | 238 | −17.893 | −11.331 | 81.605 | 1.00 | 62.76 | D000 N |
| ATOM | 8310 | CA | PRO | P | 238 | −17.707 | −9.908 | 81.907 | 1.00 | 69.38 | D000 C |
| ATOM | 8311 | C | PRO | P | 238 | −16.409 | −9.654 | 82.665 | 1.00 | 74.57 | D000 C |
| ATOM | 8312 | O | PRO | P | 238 | −16.040 | −10.408 | 83.571 | 1.00 | 71.66 | D000 O |
| ATOM | 8313 | CB | PRO | P | 238 | −18.842 | −9.573 | 82.746 | 1.00 | 64.98 | D000 C |
| ATOM | 8314 | CG | PRO | P | 238 | −19.987 | −10.474 | 82.171 | 1.00 | 64.63 | D000 C |
| ATOM | 8315 | CD | PRO | P | 238 | −19.285 | −11.760 | 81.814 | 1.00 | 57.83 | D000 C |
| ATOM | 8316 | N | GLU | P | 239 | −15.705 | −8.593 | 82.248 | 1.00 | 76.88 | D000 N |
| ATOM | 8317 | CA | GLU | P | 239 | −14.381 | −8.126 | 82.688 | 1.00 | 83.12 | D000 C |
| ATOM | 8318 | C | GLU | P | 239 | −13.208 | −8.804 | 81.960 | 1.00 | 80.80 | D000 C |
| ATOM | 8319 | O | GLU | P | 239 | −12.049 | −8.510 | 82.297 | 1.00 | 84.60 | D000 O |
| ATOM | 8320 | CB | GLU | P | 239 | −14.170 | −8.253 | 84.207 | 1.00 | 86.81 | D000 C |
| ATOM | 8321 | CG | GLU | P | 239 | −14.850 | −6.991 | 84.959 | 1.00 | 91.55 | D000 C |
| ATOM | 8322 | CD | GLU | P | 239 | −13.794 | −6.763 | 86.239 | 1.00 | 97.32 | D000 C |
| ATOM | 8323 | OE1 | GLU | P | 239 | −14.226 | −7.250 | 87.308 | 1.00 | 93.15 | D000 O |
| ATOM | 8324 | OE2 | GLU | P | 239 | −12.745 | −6.086 | 86.172 | 1.00 | 96.55 | D000 O1− |
| ATOM | 8325 | N | GLN | P | 240 | −13.452 | −9.674 | 80.980 | 1.00 | 74.55 | D000 N |
| ATOM | 8326 | CA | GLN | P | 240 | −12.388 | −10.436 | 80.304 | 1.00 | 70.87 | D000 C |
| ATOM | 8327 | C | GLN | P | 240 | −12.327 | −10.058 | 78.811 | 1.00 | 70.85 | D000 C |
| ATOM | 8328 | O | GLN | P | 240 | −13.346 | −9.637 | 78.253 | 1.00 | 75.89 | D000 O |
| ATOM | 8329 | CB | GLN | P | 240 | −12.619 | −11.949 | 80.462 | 1.00 | 68.58 | D000 C |
| ATOM | 8330 | CG | GLN | P | 240 | −12.717 | −12.433 | 81.899 | 1.00 | 68.41 | D000 C |
| ATOM | 8331 | CD | GLN | P | 240 | −11.414 | −12.251 | 82.660 | 1.00 | 75.96 | D000 C |
| ATOM | 8332 | OE1 | GLN | P | 240 | −10.466 | −13.018 | 82.480 | 1.00 | 70.60 | D000 O |
| ATOM | 8333 | NE2 | GLN | P | 240 | −11.359 | −11.226 | 83.518 | 1.00 | 77.27 | D000 N |
| ATOM | 8334 | N | PRO | P | 241 | −11.147 | −10.193 | 78.150 | 1.00 | 69.18 | D000 N |
| ATOM | 8335 | CA | PRO | P | 241 | −9.849 | −10.736 | 78.592 | 1.00 | 66.74 | D000 C |
| ATOM | 8336 | C | PRO | P | 241 | −9.056 | −9.841 | 79.559 | 1.00 | 73.69 | D000 C |
| ATOM | 8337 | O | PRO | P | 241 | −9.074 | −8.611 | 79.454 | 1.00 | 81.53 | D000 O |
| ATOM | 8338 | CB | PRO | P | 241 | −9.088 | −10.907 | 77.273 | 1.00 | 58.34 | D000 C |
| ATOM | 8339 | CG | PRO | P | 241 | −9.646 | −9.842 | 76.388 | 1.00 | 54.80 | D000 C |
| ATOM | 8340 | CD | PRO | P | 241 | −11.106 | −9.787 | 76.727 | 1.00 | 57.51 | D000 C |
| ATOM | 8341 | N | GLU | P | 253 | −1.712 | −15.376 | 81.188 | 1.00 | 57.88 | D000 N |
| ATOM | 8342 | CA | GLU | P | 253 | −3.063 | −15.516 | 80.648 | 1.00 | 58.93 | D000 C |
| ATOM | 8343 | C | GLU | P | 253 | −3.184 | −15.191 | 79.148 | 1.00 | 57.34 | D000 C |
| ATOM | 8344 | O | GLU | P | 253 | −3.809 | −14.204 | 78.771 | 1.00 | 60.57 | D000 O |
| ATOM | 8345 | CB | GLU | P | 253 | −4.028 | −14.606 | 81.410 | 1.00 | 67.05 | D000 C |
| ATOM | 8346 | CG | GLU | P | 253 | −4.239 | −14.925 | 82.886 | 1.00 | 65.01 | D000 C |
| ATOM | 8347 | CD | GLU | P | 253 | −4.871 | −13.746 | 83.619 | 1.00 | 78.11 | D000 C |
| ATOM | 8348 | OE1 | GLU | P | 253 | −6.039 | −13.406 | 83.290 | 1.00 | 74.19 | D000 O |
| ATOM | 8349 | OE2 | GLU | P | 253 | −4.210 | −13.174 | 84.525 | 1.00 | 80.72 | D000 O1− |
| ATOM | 8350 | N | ASP | P | 254 | −2.582 | −16.015 | 78.297 | 1.00 | 59.04 | D000 N |
| ATOM | 8351 | CA | ASP | P | 254 | −2.582 | −15.774 | 76.863 | 1.00 | 57.72 | D000 C |
| ATOM | 8352 | C | ASP | P | 254 | −3.509 | −16.705 | 76.087 | 1.00 | 51.09 | D000 C |
| ATOM | 8353 | O | ASP | P | 254 | −3.528 | −16.640 | 74.857 | 1.00 | 48.82 | D000 O |
| ATOM | 8354 | CB | ASP | P | 254 | −1.159 | −15.911 | 76.296 | 1.00 | 61.92 | D000 C |
| ATOM | 8355 | CG | ASP | P | 254 | −0.161 | −14.973 | 76.935 | 1.00 | 62.66 | D000 C |
| ATOM | 8356 | OD1 | ASP | P | 254 | −0.567 | −13.960 | 77.547 | 1.00 | 61.96 | D000 O |
| ATOM | 8357 | OD2 | ASP | P | 254 | 1.048 | −15.281 | 76.834 | 1.00 | 65.49 | D000 O1− |
| ATOM | 8358 | N | CYS | P | 255 | −4.265 | −17.574 | 76.753 | 1.00 | 47.05 | D000 N |
| ATOM | 8359 | CA | CYS | P | 255 | −5.063 | −18.571 | 76.051 | 1.00 | 41.26 | D000 C |
| ATOM | 8360 | C | CYS | P | 255 | −6.488 | −18.590 | 76.580 | 1.00 | 38.11 | D000 C |
| ATOM | 8361 | O | CYS | P | 255 | −6.716 | −18.454 | 77.783 | 1.00 | 39.54 | D000 O |
| ATOM | 8362 | CB | CYS | P | 255 | −4.450 | −19.956 | 76.186 | 1.00 | 44.58 | D000 C |
| ATOM | 8363 | SG | CYS | P | 255 | −2.846 | −20.164 | 75.353 | 1.00 | 52.24 | D000 S |
| ATOM | 8364 | N | ALA | P | 256 | −7.440 | −18.776 | 75.674 | 1.00 | 36.50 | D000 N |
| ATOM | 8365 | CA | ALA | P | 256 | −8.857 | −18.645 | 75.980 | 1.00 | 35.39 | D000 C |
| ATOM | 8366 | C | ALA | P | 256 | −9.527 | −20.010 | 76.077 | 1.00 | 31.26 | D000 C |
| ATOM | 8367 | O | ALA | P | 256 | −9.240 | −20.914 | 75.281 | 1.00 | 30.62 | D000 O |
| ATOM | 8368 | CB | ALA | P | 256 | −9.555 | −17.793 | 74.921 | 1.00 | 38.76 | D000 C |
| ATOM | 8369 | N | HIS | P | 257 | −10.412 | −20.157 | 77.066 | 1.00 | 30.17 | D000 N |
| ATOM | 8370 | CA | HIS | P | 257 | −11.139 | −21.406 | 77.272 | 1.00 | 32.66 | D000 C |
| ATOM | 8371 | C | HIS | P | 257 | −12.600 | −21.131 | 77.611 | 1.00 | 33.59 | D000 C |
| ATOM | 8372 | O | HIS | P | 257 | −12.962 | −20.057 | 78.108 | 1.00 | 31.39 | D000 O |
| ATOM | 8373 | CB | HIS | P | 257 | −10.517 | −22.263 | 78.384 | 1.00 | 28.03 | D000 C |
| ATOM | 8374 | CG | HIS | P | 257 | −10.526 | −21.604 | 79.727 | 1.00 | 34.24 | D000 C |
| ATOM | 8375 | ND1 | HIS | P | 257 | −11.562 | −21.751 | 80.621 | 1.00 | 34.37 | D000 N |

TABLE 10.4-continued

| | | | | | | | | | | | |
|---|---|---|---|---|---|---|---|---|---|---|---|
| ATOM | 8376 | CD2 | HIS | P | 257 | −9.620 | −20.802 | 80.335 | 1.00 | 38.40 | D000 C |
| ATOM | 8377 | CE1 | HIS | P | 257 | −11.298 | −21.068 | 81.718 | 1.00 | 34.64 | D000 C |
| ATOM | 8378 | NE2 | HIS | P | 257 | −10.128 | −20.479 | 81.569 | 1.00 | 37.12 | D000 N |
| ATOM | 8379 | N | PHE | P | 258 | −13.444 | −22.124 | 77.309 | 1.00 | 33.23 | D000 N |
| ATOM | 8380 | CA | PHE | P | 258 | −14.808 | −22.141 | 77.823 | 1.00 | 32.25 | D000 C |
| ATOM | 8381 | C | PHE | P | 258 | −14.773 | −22.392 | 79.319 | 1.00 | 32.26 | D000 C |
| ATOM | 8382 | O | PHE | P | 258 | −13.956 | −23.171 | 79.811 | 1.00 | 29.18 | D000 O |
| ATOM | 8383 | CB | PHE | P | 258 | −15.652 | −23.232 | 77.153 | 1.00 | 30.58 | D000 C |
| ATOM | 8384 | CG | PHE | P | 258 | −15.651 | −23.174 | 75.659 | 1.00 | 27.36 | D000 C |
| ATOM | 8385 | CD1 | PHE | P | 258 | −16.550 | −22.394 | 74.987 | 1.00 | 28.97 | D000 C |
| ATOM | 8386 | CD2 | PHE | P | 258 | −14.738 | −23.912 | 74.931 | 1.00 | 28.24 | D000 C |
| ATOM | 8387 | CE1 | PHE | P | 258 | −16.541 | −22.343 | 73.614 | 1.00 | 34.71 | D000 C |
| ATOM | 8388 | CE2 | PHE | P | 258 | −14.723 | −23.869 | 73.566 | 1.00 | 30.59 | D000 C |
| ATOM | 8389 | CZ | PHE | P | 258 | −15.623 | −23.079 | 72.902 | 1.00 | 33.75 | D000 C |
| ATOM | 8390 | N | THR | P | 259 | −15.684 | −21.742 | 80.033 | 1.00 | 36.07 | D000 N |
| ATOM | 8391 | CA | THR | P | 259 | −15.852 | −21.887 | 81.471 | 1.00 | 37.54 | D000 C |
| ATOM | 8392 | C | THR | P | 259 | −17.106 | −22.709 | 81.741 | 1.00 | 38.73 | D000 C |
| ATOM | 8393 | O | THR | P | 259 | −17.882 | −23.018 | 80.828 | 1.00 | 40.70 | D000 O |
| ATOM | 8394 | CB | THR | P | 259 | −15.949 | −20.510 | 82.147 | 1.00 | 41.98 | D000 C |
| ATOM | 8395 | OG1 | THR | P | 259 | −17.200 | −19.888 | 81.813 | 1.00 | 41.80 | D000 O |
| ATOM | 8396 | CG2 | THR | P | 259 | −14.799 | −19.598 | 81.696 | 1.00 | 30.57 | D000 C |
| ATOM | 8397 | N | ASP | P | 260 | −17.342 | −23.006 | 83.020 | 1.00 | 37.73 | D000 N |
| ATOM | 8398 | CA | ASP | P | 260 | −18.446 | −23.894 | 83.380 | 1.00 | 37.79 | D000 C |
| ATOM | 8399 | C | ASP | P | 260 | −19.814 | −23.404 | 82.896 | 1.00 | 38.90 | D000 C |
| ATOM | 8400 | O | ASP | P | 260 | −20.758 | −24.204 | 82.869 | 1.00 | 41.70 | D000 O |
| ATOM | 8401 | CB | ASP | P | 260 | −18.483 | −24.128 | 84.901 | 1.00 | 35.64 | D000 C |
| ATOM | 8402 | CG | ASP | P | 260 | −18.619 | −22.834 | 85.712 | 1.00 | 42.82 | D000 C |
| ATOM | 8403 | OD1 | ASP | P | 260 | −18.241 | −21.740 | 85.225 | 1.00 | 48.13 | D000 O |
| ATOM | 8404 | OD2 | ASP | P | 260 | −19.161 | −22.907 | 86.836 | 1.00 | 44.48 | D000 O1− |
| ATOM | 8405 | N | ASP | P | 261 | −19.955 | −22.136 | 82.499 | 1.00 | 41.54 | D000 N |
| ATOM | 8406 | CA | ASP | P | 261 | −21.226 | −21.648 | 81.973 | 1.00 | 42.82 | D000 C |
| ATOM | 8407 | C | ASP | P | 261 | −21.155 | −21.336 | 80.487 | 1.00 | 41.84 | D000 C |
| ATOM | 8408 | O | ASP | P | 261 | −22.099 | −20.769 | 79.939 | 1.00 | 43.69 | D000 O |
| ATOM | 8409 | CB | ASP | P | 261 | −21.727 | −20.412 | 82.738 | 1.00 | 43.58 | D000 C |
| ATOM | 8410 | CG | ASP | P | 261 | −20.950 | −19.119 | 82.416 | 1.00 | 49.58 | D000 C |
| ATOM | 8411 | OD1 | ASP | P | 261 | −19.993 | −19.120 | 81.605 | 1.00 | 52.04 | D000 O |
| ATOM | 8412 | OD2 | ASP | P | 261 | −21.333 | −18.065 | 82.974 | 1.00 | 48.73 | D000 O1− |
| ATOM | 8413 | N | GLY | P | 262 | −20.046 | −21.659 | 79.826 | 1.00 | 41.79 | D000 N |
| ATOM | 8414 | CA | GLY | P | 262 | −19.923 | −21.469 | 78.406 | 1.00 | 35.80 | D000 C |
| ATOM | 8415 | C | GLY | P | 262 | −19.239 | −20.181 | 78.005 | 1.00 | 34.51 | D000 C |
| ATOM | 8416 | O | GLY | P | 262 | −18.649 | −20.125 | 76.926 | 1.00 | 35.57 | D000 O |
| ATOM | 8417 | N | ARG | P | 263 | −19.315 | −19.141 | 78.829 | 1.00 | 35.18 | D000 N |
| ATOM | 8418 | CA | ARG | P | 263 | −18.644 | −17.901 | 78.475 | 1.00 | 39.45 | D000 C |
| ATOM | 8419 | C | ARG | P | 263 | −17.120 | −18.052 | 78.581 | 1.00 | 36.67 | D000 C |
| ATOM | 8420 | O | ARG | P | 263 | −16.588 | −18.949 | 79.235 | 1.00 | 34.59 | D000 O |
| ATOM | 8421 | CB | ARG | P | 263 | −19.177 | −16.755 | 79.332 | 1.00 | 39.46 | D000 C |
| ATOM | 8422 | CG | ARG | P | 263 | −20.633 | −16.427 | 79.008 | 1.00 | 41.29 | D000 C |
| ATOM | 8423 | CD | ARG | P | 263 | −21.171 | −15.300 | 79.852 | 1.00 | 41.58 | D000 C |
| ATOM | 8424 | NE | ARG | P | 263 | −21.060 | −15.629 | 81.269 | 1.00 | 57.11 | D000 N |
| ATOM | 8425 | CZ | ARG | P | 263 | −21.316 | −14.794 | 82.274 | 1.00 | 54.20 | D000 C |
| ATOM | 8426 | NH1 | ARG | P | 263 | −21.702 | −13.543 | 82.039 | 1.00 | 46.67 | D000 N1+ |
| ATOM | 8427 | NH2 | ARG | P | 263 | −21.168 | −15.216 | 83.524 | 1.00 | 49.65 | D000 N |
| ATOM | 8428 | N | TRP | P | 264 | −16.414 | −17.184 | 77.879 | 1.00 | 39.86 | D000 N |
| ATOM | 8429 | CA | TRP | P | 264 | −14.984 | −17.349 | 77.652 | 1.00 | 38.07 | D000 C |
| ATOM | 8430 | C | TRP | P | 264 | −14.144 | −16.707 | 78.750 | 1.00 | 36.92 | D000 C |
| ATOM | 8431 | O | TRP | P | 264 | −14.565 | −15.769 | 79.434 | 1.00 | 38.51 | D000 O |
| ATOM | 8432 | CB | TRP | P | 264 | −14.596 | −16.743 | 76.311 | 1.00 | 36.59 | D000 C |
| ATOM | 8433 | CG | TRP | P | 264 | −15.334 | −17.316 | 75.157 | 1.00 | 33.59 | D000 C |
| ATOM | 8434 | CD1 | TRP | P | 264 | −16.124 | −18.422 | 75.156 | 1.00 | 28.12 | D000 C |
| ATOM | 8435 | CD2 | TRP | P | 264 | −15.343 | −16.808 | 73.823 | 1.00 | 37.35 | D000 C |
| ATOM | 8436 | NE1 | TRP | P | 264 | −16.627 | −18.635 | 73.909 | 1.00 | 31.66 | D000 N |
| ATOM | 8437 | CE2 | TRP | P | 264 | −16.158 | −17.661 | 73.064 | 1.00 | 38.06 | D000 C |
| ATOM | 8438 | CE3 | TRP | P | 264 | −14.736 | −15.714 | 73.194 | 1.00 | 34.20 | D000 C |
| ATOM | 8439 | CZ2 | TRP | P | 264 | −16.384 | −17.455 | 71.697 | 1.00 | 36.24 | D000 C |
| ATOM | 8440 | CZ3 | TRP | P | 264 | −14.966 | −15.510 | 71.854 | 1.00 | 34.62 | D000 C |
| ATOM | 8441 | CH2 | TRP | P | 264 | −15.783 | −16.375 | 71.118 | 1.00 | 35.86 | D000 C |
| ATOM | 8442 | N | ASN | P | 265 | −12.908 | −17.179 | 78.854 | 1.00 | 32.60 | D000 N |
| ATOM | 8443 | CA | ASN | P | 265 | −11.991 | −16.649 | 79.844 | 1.00 | 35.02 | D000 C |
| ATOM | 8444 | C | ASN | P | 265 | −10.653 | −16.955 | 79.416 | 1.00 | 35.40 | D000 C |
| ATOM | 8445 | O | ASN | P | 265 | −10.303 | −17.966 | 78.762 | 1.00 | 34.37 | D000 O |
| ATOM | 8446 | CB | ASN | P | 265 | −12.302 | −17.268 | 81.206 | 1.00 | 41.49 | D000 C |
| ATOM | 8447 | CG | ASN | P | 265 | −11.391 | −16.785 | 82.295 | 1.00 | 45.67 | D000 C |
| ATOM | 8448 | OD1 | ASN | P | 265 | −11.470 | −15.634 | 82.725 | 1.00 | 46.99 | D000 O |
| ATOM | 8449 | ND2 | ASN | P | 265 | −10.486 | −17.660 | 82.730 | 1.00 | 42.25 | D000 N |
| ATOM | 8450 | N | ASP | P | 266 | −9.635 | −16.081 | 79.804 | 1.00 | 41.02 | D000 N |
| ATOM | 8451 | CA | ASP | P | 266 | −8.210 | −16.284 | 79.555 | 1.00 | 44.53 | D000 C |
| ATOM | 8452 | C | ASP | P | 266 | −7.533 | −16.874 | 80.790 | 1.00 | 44.46 | D000 C |
| ATOM | 8453 | O | ASP | P | 266 | −7.836 | −16.493 | 81.922 | 1.00 | 42.76 | D000 O |
| ATOM | 8454 | CB | ASP | P | 266 | −7.513 | −14.977 | 79.143 | 1.00 | 48.13 | D000 C |
| ATOM | 8455 | CG | ASP | P | 266 | −7.889 | −13.788 | 80.036 | 1.00 | 60.01 | D000 C |

TABLE 10.4-continued

| | | | | | | | | | | | |
|---|---|---|---|---|---|---|---|---|---|---|---|
| ATOM | 8456 | OD1 | ASP | P | 266 | −9.096 | −13.510 | 80.179 | 1.00 | 60.58 | D000 O |
| ATOM | 8457 | OD2 | ASP | P | 266 | −6.988 | −13.158 | 80.633 | 1.00 | 64.47 | D000 O1− |
| ATOM | 8458 | N | ASP | P | 267 | −6.622 | −17.815 | 80.563 | 1.00 | 44.24 | D000 N |
| ATOM | 8459 | CA | ASP | P | 267 | −5.909 | −18.469 | 81.647 | 1.00 | 42.61 | D000 C |
| ATOM | 8460 | C | ASP | P | 267 | −4.508 | −18.821 | 81.152 | 1.00 | 44.14 | D000 C |
| ATOM | 8461 | O | ASP | P | 267 | −4.233 | −18.787 | 79.952 | 1.00 | 41.89 | D000 O |
| ATOM | 8462 | CB | ASP | P | 267 | −6.688 | −19.697 | 82.122 | 1.00 | 38.52 | D000 C |
| ATOM | 8463 | CG | ASP | P | 267 | −6.223 | −20.188 | 83.464 | 1.00 | 45.95 | D000 C |
| ATOM | 8464 | OD1 | ASP | P | 267 | −5.365 | −19.510 | 84.068 | 1.00 | 48.74 | D000 O |
| ATOM | 8465 | OD2 | ASP | P | 267 | −6.710 | −21.244 | 83.919 | 1.00 | 43.95 | D000 O1− |
| ATOM | 8466 | N | VAL | P | 268 | −3.612 | −19.180 | 82.076 | 1.00 | 47.41 | D000 N |
| ATOM | 8467 | CA | VAL | P | 268 | −2.258 | −19.507 | 81.643 | 1.00 | 46.28 | D000 C |
| ATOM | 8468 | C | VAL | P | 268 | −2.306 | −20.765 | 80.793 | 1.00 | 45.81 | D000 C |
| ATOM | 8469 | O | VAL | P | 268 | −3.051 | −21.717 | 81.079 | 1.00 | 42.24 | D000 O |
| ATOM | 8470 | CB | VAL | P | 268 | −1.274 | −19.643 | 82.822 | 1.00 | 45.28 | D000 C |
| ATOM | 8471 | CG1 | VAL | P | 268 | −1.359 | −18.423 | 83.707 | 1.00 | 40.04 | D000 C |
| ATOM | 8472 | CG2 | VAL | P | 268 | −1.489 | −20.937 | 83.609 | 1.00 | 40.72 | D000 C |
| ATOM | 8473 | N | CYS | P | 269 | −1.525 | −20.756 | 79.717 | 1.00 | 45.30 | D000 N |
| ATOM | 8474 | CA | CYS | P | 269 | −1.620 | −21.777 | 78.695 | 1.00 | 34.95 | D000 C |
| ATOM | 8475 | C | CYS | P | 269 | −1.113 | −23.121 | 79.167 | 1.00 | 39.62 | D000 C |
| ATOM | 8476 | O | CYS | P | 269 | −1.267 | −24.107 | 78.438 | 1.00 | 44.44 | D000 O |
| ATOM | 8477 | CB | CYS | P | 269 | −0.849 | −21.317 | 77.456 | 1.00 | 47.03 | D000 C |
| ATOM | 8478 | SG | CYS | P | 269 | −1.435 | −19.698 | 76.766 | 1.00 | 60.08 | D000 S |
| ATOM | 8479 | N | GLN | P | 270 | −0.551 | −23.199 | 80.371 | 1.00 | 40.97 | D000 N |
| ATOM | 8480 | CA | GLN | P | 270 | 0.007 | −24.461 | 80.837 | 1.00 | 39.29 | D000 C |
| ATOM | 8481 | C | GLN | P | 270 | −1.038 | −25.378 | 81.448 | 1.00 | 33.15 | D000 C |
| ATOM | 8482 | O | GLN | P | 270 | −0.769 | −26.577 | 81.579 | 1.00 | 30.99 | D000 O |
| ATOM | 8483 | CB | GLN | P | 270 | 1.128 | −24.207 | 81.857 | 1.00 | 52.36 | D000 C |
| ATOM | 8484 | CG | GLN | P | 270 | 2.531 | −23.978 | 81.256 | 1.00 | 68.27 | D000 C |
| ATOM | 8485 | CD | GLN | P | 270 | 3.672 | −24.458 | 82.188 | 1.00 | 90.18 | D000 C |
| ATOM | 8486 | OE1 | GLN | P | 270 | 3.426 | −25.009 | 83.272 | 1.00 | 96.23 | D000 O |
| ATOM | 8487 | NE2 | GLN | P | 270 | 4.921 | −24.250 | 81.760 | 1.00 | 83.33 | D000 N |
| ATOM | 8488 | N | ARG | P | 271 | −2.213 | −24.847 | 81.803 | 1.00 | 35.97 | D000 N |
| ATOM | 8489 | CA | ARG | P | 271 | −3.258 | −25.641 | 82.453 | 1.00 | 35.38 | D000 C |
| ATOM | 8490 | C | ARG | P | 271 | −3.614 | −26.831 | 81.577 | 1.00 | 34.50 | D000 C |
| ATOM | 8491 | O | ARG | P | 271 | −3.835 | −26.657 | 80.369 | 1.00 | 35.09 | D000 O |
| ATOM | 8492 | CB | ARG | P | 271 | −4.533 | −24.825 | 82.699 | 1.00 | 32.78 | D000 C |
| ATOM | 8493 | CG | ARG | P | 271 | −4.404 | −23.700 | 83.663 | 1.00 | 35.79 | D000 C |
| ATOM | 8494 | CD | ARG | P | 271 | −4.885 | −24.052 | 85.062 | 1.00 | 38.85 | D000 C |
| ATOM | 8495 | NE | ARG | P | 271 | −4.351 | −23.079 | 86.026 | 1.00 | 53.17 | D000 N |
| ATOM | 8496 | CZ | ARG | P | 271 | −3.487 | −23.363 | 87.009 | 1.00 | 57.60 | D000 C |
| ATOM | 8497 | NH1 | ARG | P | 271 | −3.061 | −24.616 | 87.211 | 1.00 | 48.15 | D000 N1+ |
| ATOM | 8498 | NH2 | ARG | P | 271 | −3.054 | −22.387 | 87.805 | 1.00 | 54.98 | D000 N |
| ATOM | 8499 | N | PRO | P | 272 | −3.709 | −27.959 | 82.102 | 1.00 | 34.18 | D000 N |
| ATOM | 8500 | CA | PRO | P | 272 | −4.104 | −29.152 | 81.304 | 1.00 | 30.39 | D000 C |
| ATOM | 8501 | C | PRO | P | 272 | −5.617 | −29.326 | 81.191 | 1.00 | 30.82 | D000 C |
| ATOM | 8502 | O | PRO | P | 272 | −6.222 | −30.227 | 81.774 | 1.00 | 30.88 | D000 O |
| ATOM | 8503 | CB | PRO | P | 272 | −3.446 | −30.296 | 82.079 | 1.00 | 29.98 | D000 C |
| ATOM | 8504 | CG | PRO | P | 272 | −3.279 | −29.776 | 83.527 | 1.00 | 33.19 | D000 C |
| ATOM | 8505 | CD | PRO | P | 272 | −3.502 | −28.269 | 83.527 | 1.00 | 30.33 | D000 C |
| ATOM | 8506 | N | TYR | P | 273 | −6.260 | −28.438 | 80.435 | 1.00 | 29.69 | D000 N |
| ATOM | 8507 | CA | TYR | P | 273 | −7.685 | −28.556 | 80.183 | 1.00 | 26.06 | D000 C |
| ATOM | 8508 | C | TYR | P | 273 | −7.957 | −29.510 | 79.021 | 1.00 | 31.32 | D000 C |
| ATOM | 8509 | O | TYR | P | 273 | −7.075 | −29.834 | 78.220 | 1.00 | 34.09 | D000 O |
| ATOM | 8510 | CB | TYR | P | 273 | −8.289 | −27.199 | 79.848 | 1.00 | 29.36 | D000 C |
| ATOM | 8511 | CG | TYR | P | 273 | −8.313 | −26.189 | 80.968 | 1.00 | 31.45 | D000 C |
| ATOM | 8512 | CD1 | TYR | P | 273 | −8.404 | −26.586 | 82.310 | 1.00 | 29.10 | D000 C |
| ATOM | 8513 | CD2 | TYR | P | 273 | −8.243 | −24.832 | 80.685 | 1.00 | 26.14 | D000 C |
| ATOM | 8514 | CE1 | TYR | P | 273 | −8.422 | −25.650 | 83.325 | 1.00 | 23.99 | D000 C |
| ATOM | 8515 | CE2 | TYR | P | 273 | −8.275 | −23.900 | 81.688 | 1.00 | 30.08 | D000 C |
| ATOM | 8516 | CZ | TYR | P | 273 | −8.364 | −24.312 | 83.001 | 1.00 | 27.73 | D000 C |
| ATOM | 8517 | OH | TYR | P | 273 | −8.380 | −23.357 | 83.973 | 1.00 | 30.77 | D000 O |
| ATOM | 8518 | N | ARG | P | 274 | −9.208 | −29.949 | 78.931 | 1.00 | 28.38 | D000 N |
| ATOM | 8519 | CA | ARG | P | 274 | −9.699 | −30.608 | 77.733 | 1.00 | 26.38 | D000 C |
| ATOM | 8520 | C | ARG | P | 274 | −9.755 | −29.604 | 76.570 | 1.00 | 28.97 | D000 C |
| ATOM | 8521 | O | ARG | P | 274 | −9.693 | −28.383 | 76.762 | 1.00 | 29.05 | D000 O |
| ATOM | 8522 | CB | ARG | P | 274 | −11.090 | −31.183 | 78.003 | 1.00 | 26.93 | D000 C |
| ATOM | 8523 | CG | ARG | P | 274 | −11.108 | −32.298 | 78.990 | 1.00 | 27.16 | D000 C |
| ATOM | 8524 | CD | ARG | P | 274 | −12.512 | −32.728 | 79.284 | 1.00 | 29.23 | D000 C |
| ATOM | 8525 | NE | ARG | P | 274 | −12.531 | −33.815 | 80.262 | 1.00 | 31.79 | D000 N |
| ATOM | 8526 | CZ | ARG | P | 274 | −13.610 | −34.234 | 80.917 | 1.00 | 28.61 | D000 C |
| ATOM | 8527 | NH1 | ARG | P | 274 | −14.801 | −33.662 | 80.721 | 1.00 | 27.83 | D000 N1+ |
| ATOM | 8528 | NH2 | ARG | P | 274 | −13.495 | −35.241 | 81.767 | 1.00 | 30.68 | D000 N |
| ATOM | 8529 | N | TRP | P | 275 | −9.894 | −30.113 | 75.345 | 1.00 | 23.49 | D000 N |
| ATOM | 8530 | CA | TRP | P | 275 | −9.938 | −29.266 | 74.188 | 1.00 | 25.18 | D000 C |
| ATOM | 8531 | C | TRP | P | 275 | −10.855 | −29.837 | 73.136 | 1.00 | 28.35 | D000 C |
| ATOM | 8532 | O | TRP | P | 275 | −11.240 | −31.009 | 73.214 | 1.00 | 27.63 | D000 O |
| ATOM | 8533 | CB | TRP | P | 275 | −8.524 | −28.953 | 73.614 | 1.00 | 26.97 | D000 C |
| ATOM | 8534 | CG | TRP | P | 275 | −7.949 | −30.164 | 72.960 | 1.00 | 26.87 | D000 C |
| ATOM | 8535 | CD1 | TRP | P | 275 | −7.973 | −30.473 | 71.628 | 1.00 | 25.57 | D000 C |

TABLE 10.4-continued

| | | | | | | | | | | | |
|---|---|---|---|---|---|---|---|---|---|---|---|
| ATOM | 8536 | CD2 | TRP | P | 275 | −7.346 | −31.284 | 73.625 | 1.00 | 26.80 | D000 C |
| ATOM | 8537 | NE1 | TRP | P | 275 | −7.403 | −31.713 | 71.419 | 1.00 | 26.56 | D000 N |
| ATOM | 8538 | CE2 | TRP | P | 275 | −7.008 | −32.230 | 72.626 | 1.00 | 28.11 | D000 C |
| ATOM | 8539 | CE3 | TRP | P | 275 | −7.044 | −31.573 | 74.966 | 1.00 | 24.47 | D000 C |
| ATOM | 8540 | CZ2 | TRP | P | 275 | −6.388 | −33.439 | 72.926 | 1.00 | 26.32 | D000 C |
| ATOM | 8541 | CZ3 | TRP | P | 275 | −6.439 | −32.772 | 75.265 | 1.00 | 25.01 | D000 C |
| ATOM | 8542 | CH2 | TRP | P | 275 | −6.114 | −33.692 | 74.250 | 1.00 | 29.39 | D000 C |
| ATOM | 8543 | N | VAL | P | 276 | −11.186 | −29.023 | 72.135 | 1.00 | 27.49 | D000 N |
| ATOM | 8544 | CA | VAL | P | 276 | −12.064 | −29.405 | 71.039 | 1.00 | 29.28 | D000 C |
| ATOM | 8545 | C | VAL | P | 276 | −11.347 | −29.157 | 69.720 | 1.00 | 32.15 | D000 C |
| ATOM | 8546 | O | VAL | P | 276 | −11.010 | −28.009 | 69.399 | 1.00 | 30.70 | D000 O |
| ATOM | 8547 | CB | VAL | P | 276 | −13.381 | −28.615 | 71.076 | 1.00 | 32.24 | D000 C |
| ATOM | 8548 | CG1 | VAL | P | 276 | −14.255 | −28.997 | 69.881 | 1.00 | 28.45 | D000 C |
| ATOM | 8549 | CG2 | VAL | P | 276 | −14.099 | −28.838 | 72.418 | 1.00 | 27.44 | D000 C |
| ATOM | 8550 | N | CYS | P | 277 | −11.188 | −30.212 | 68.926 | 1.00 | 31.02 | D000 N |
| ATOM | 8551 | CA | CYS | P | 277 | −10.688 | −30.089 | 67.560 | 1.00 | 33.70 | D000 C |
| ATOM | 8552 | C | CYS | P | 277 | −11.856 | −29.883 | 66.594 | 1.00 | 36.60 | D000 C |
| ATOM | 8553 | O | CYS | P | 277 | −12.924 | −30.476 | 66.769 | 1.00 | 35.91 | D000 O |
| ATOM | 8554 | CB | CYS | P | 277 | −9.893 | −31.339 | 67.158 | 1.00 | 33.14 | D000 C |
| ATOM | 8555 | SG | CYS | P | 277 | −8.261 | −31.627 | 67.947 | 1.00 | 35.59 | D000 S |
| ATOM | 8556 | N | GLU | P | 278 | −11.644 | −29.037 | 65.572 | 1.00 | 36.89 | D000 N |
| ATOM | 8557 | CA | GLU | P | 278 | −12.627 | −28.753 | 64.525 | 1.00 | 39.14 | D000 C |
| ATOM | 8558 | C | GLU | P | 278 | −11.998 | −28.940 | 63.144 | 1.00 | 44.48 | D000 C |
| ATOM | 8559 | O | GLU | P | 278 | −10.812 | −28.657 | 62.944 | 1.00 | 39.34 | D000 O |
| ATOM | 8560 | CB | GLU | P | 278 | −13.201 | −27.309 | 64.639 | 1.00 | 33.16 | D000 C |
| ATOM | 8561 | CG | GLU | P | 278 | −14.353 | −26.998 | 63.675 | 1.00 | 36.59 | D000 C |
| ATOM | 8562 | CD | GLU | P | 278 | −14.820 | −25.530 | 63.719 | 1.00 | 44.66 | D000 C |
| ATOM | 8563 | OE1 | GLU | P | 278 | −14.202 | −24.714 | 64.445 | 1.00 | 39.06 | D000 O |
| ATOM | 8564 | OE2 | GLU | P | 278 | −15.829 | −25.200 | 63.049 | 1.00 | 41.28 | D000 O1− |
| ATOM | 8565 | N | THR | P | 279 | −12.790 | −29.443 | 62.197 | 1.00 | 50.44 | D000 N |
| ATOM | 8566 | CA | THR | P | 279 | −12.402 | −29.459 | 60.790 | 1.00 | 53.12 | D000 C |
| ATOM | 8567 | C | THR | P | 279 | −13.617 | −29.195 | 59.898 | 1.00 | 49.51 | D000 C |
| ATOM | 8568 | O | THR | P | 279 | −14.703 | −29.717 | 60.154 | 1.00 | 53.00 | D000 O |
| ATOM | 8569 | CB | THR | P | 279 | −11.717 | −30.798 | 60.436 | 1.00 | 45.79 | D000 C |
| ATOM | 8570 | OG1 | THR | P | 279 | −11.049 | −30.673 | 59.179 | 1.00 | 51.68 | D000 O |
| ATOM | 8571 | CG2 | THR | P | 279 | −12.709 | −31.937 | 60.373 | 1.00 | 41.88 | D000 C |
| ATOM | 8572 | N | GLU | P | 280 | −13.431 | −28.398 | 58.839 | 1.00 | 54.11 | D000 N |
| ATOM | 8573 | CA | GLU | P | 280 | −14.518 | −28.026 | 57.929 | 1.00 | 55.44 | D000 C |
| ATOM | 8574 | C | GLU | P | 280 | −14.664 | −29.061 | 56.808 | 1.00 | 60.78 | D000 C |
| ATOM | 8575 | O | GLU | P | 280 | −13.673 | −29.610 | 56.323 | 1.00 | 66.29 | D000 O |
| ATOM | 8576 | CB | GLU | P | 280 | −14.275 | −26.632 | 57.350 | 1.00 | 58.37 | D000 C |
| ATOM | 8577 | CG | GLU | P | 280 | −14.341 | −25.476 | 58.376 | 1.00 | 56.42 | D000 C |
| ATOM | 8578 | CD | GLU | P | 280 | −13.124 | −25.396 | 59.315 | 1.00 | 59.60 | D000 C |
| ATOM | 8579 | OE1 | GLU | P | 280 | −12.166 | −26.179 | 59.134 | 1.00 | 63.77 | D000 O |
| ATOM | 8580 | OE2 | GLU | P | 280 | −13.129 | −24.553 | 60.247 | 1.00 | 61.91 | D000 O1− |
| ATOM | 8581 | N | LEU | P | 281 | −15.911 | −29.308 | 56.389 | 1.00 | 64.56 | D000 N |
| ATOM | 8582 | CA | LEU | P | 281 | −16.292 | −30.535 | 55.682 | 1.00 | 69.60 | D000 C |
| ATOM | 8583 | C | LEU | P | 281 | −16.310 | −30.448 | 54.149 | 1.00 | 73.85 | D000 C |
| ATOM | 8584 | O | LEU | P | 281 | −16.945 | −31.306 | 53.521 | 1.00 | 77.45 | D000 O |
| ATOM | 8585 | CB | LEU | P | 281 | −17.662 | −31.015 | 56.164 | 1.00 | 60.03 | D000 C |
| ATOM | 8586 | CG | LEU | P | 281 | −17.690 | −32.374 | 56.863 | 1.00 | 56.08 | D000 C |
| ATOM | 8587 | CD1 | LEU | P | 281 | −19.116 | −32.776 | 57.171 | 1.00 | 66.41 | D000 C |
| ATOM | 8588 | CD2 | LEU | P | 281 | −17.006 | −33.448 | 56.066 | 1.00 | 58.00 | D000 C |
| ATOM | 8589 | N | ASP | P | 282 | −15.668 | −29.445 | 53.538 | 1.00 | 74.94 | D000 N |
| ATOM | 8590 | CA | ASP | P | 282 | −15.590 | −9.289 | 52.056 | 1.00 | 74.61 | D000 C |
| ATOM | 8591 | C | ASP | P | 282 | −16.879 | −28.715 | 51.457 | 1.00 | 69.05 | D000 C |
| ATOM | 8592 | O | ASP | P | 282 | −17.285 | −27.589 | 51.780 | 1.00 | 68.03 | D000 O |
| ATOM | 8593 | CB | ASP | P | 282 | −15.291 | −30.618 | 51.327 | 1.00 | 75.72 | D000 C |
| ATOM | 8594 | CG | ASP | P | 282 | −13.973 | −31.262 | 51.748 | 1.00 | 83.45 | D000 C |
| ATOM | 8595 | OD2 | ASP | P | 282 | −14.017 | −32.153 | 52.639 | 1.00 | 81.11 | D000 O |
| ATOM | 8596 | OD1 | ASP | P | 282 | −12.912 | −30.910 | 51.169 | 1.00 | 76.47 | D000 O1− |
| TER | | | | | | | | | | | |
| HETATM | 8597 | CA | CA | E | 1 | −46.046 | −40.018 | 63.255 | 1.00 | 40.77 | Ca |
| HETATM | 8598 | CA | CA | E | 2 | −15.968 | −22.911 | 63.354 | 1.00 | 43.19 | Ca |
| TER | | | | | | | | | | | |

TABLE 15

Antibody Constant Regions

| Designation | SEQ ID NO: | CL Domain Amino Acid Sequence |
|---|---|---|
| CL-1 | 32681 | GQPKANPTVTLFPPSSEELQANKATLVCLISDFYPGAVTVAWKADGSP VKAGVETTKPSKQSNNKYAASSYLSLTPEQWKSHRSYSCQVTHEGSTV EKTVAPTECS |

TABLE 15-continued

Antibody Constant Regions

| | | |
|---|---|---|
| CL-2 | 32682 | GQPKAAPSVTLFPPSSEELQANKATLVCLISDFYPGAVTVAWKADSSPV<br>KAGVETTTPSKQSNNKYAASSYLSLTPEQWKSHRSYSCQVTHEGSTVEK<br>TVAPTECS |
| CL-2.1 | 32683 | QPKAAPSVTLFPPSSEELQANKATLVCLISDFYPGAVTVAWKADSSPVK<br>AGVETTTPSKQSNNKYAASSYLSLTPEQWKSHRSYSCQVTHEGSTVEKT<br>VAPTECS |
| CL-3 | 32684 | GQPKAAPSVTLFPPSSEELQANKATLVCLISDFYPGAVTVAWKADSSPV<br>KAGVETTTPSKQSNNKYAASSYLSLTPEQWKSHSYSCQVTHEGSTVEK<br>TVAPTECS |
| CL-7 | 32685 | GQPKAAPSVTLFPPSSEELQANKATLVCLVSDFYPGAVTVAWKADGSP<br>VKVGVETTKPSKQSNNKYAASSYLSLTPEQWKSHRSYSCRVTHEGSTVE<br>KTVAPAECS |
| Human<br>kappa v1 | 32686 | TVAAPSVFIFPPSDEQLKSGTASVVCLLNNFYPREAKVQWKVDNALQS<br>GNSQESVTEQDSKDSTYSLSSTLTLSKADYEKHKVYACEVTHQGLSSPVT<br>KSFNRGEC |
| Human<br>kappa v2 | 32687 | RTVAAPSVFIFPPSDEQLKSGTASVVCLLNNFYPREAKVQWKVDNALQ<br>SGNSQESVTEQDSKDSTYSLSSTLTLSKADYEKHKVYACEVTHQGLSSPV<br>TKSFNRGEC |

| Ig isotype | SEQ ID NO: | Heavy Chain Constant Region Amino Acid Sequence |
|---|---|---|
| Human IgG1z | 32688 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |
| Human<br>IgG1za | 32689 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSRDELTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |
| Human IgG1f | 32690 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKRVEP<br>KSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |
| Human<br>IgG1fa | 32691 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKRVEP<br>KSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWL<br>NGKEYKCKVSNKALPAPIEKTISKAKGQPREPQVYTLPPSRDELTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |
| Human IgG2 | 32692 | ASTKGPSVFPLAPCSRSTSESTAALGCLVKDYFPEPVTVSWNSGALTSGV<br>HTFPAVLQSSGLYSLSSVVTVPSSNFGTQTYTCNVDHKPSNTKVDKTVER<br>KCCVECPPCPAPPVAGPSVFLFPPKPKDTLMISRTPEVTCVVVDVSHEDP<br>EVQFNWYVDGVEVHNAKTKPREEQFNSTFRVVSVLTVVHQDWLNGKE<br>YKCKVSNKGLPAPIEKTISKTKGQPREPQVYTLPPSREEMTKNQVSLTCL<br>VKGFYPSDIAVEWESNGQPENNYKTTPPMLDSDGSFFLYSKLTVDKSRW<br>QQGNVFSCSVMHEALHNHYTQKSLSLSPGK |
| Human IgG4 | 32693 | ASTKGPSVFPLAPCSRSTSESTAALGCLVKDYFPEPVTVSWNSGALTSGV<br>HTFPAVLQSSGLYSLSSVVTVPSSSLGTKTYTCNVDHKPSNTKVDKRVES<br>KYGPPCPSCPAPEFLGGPSVFLFPPKPKDTLMISRTPEVTCVVVDVSQED<br>PEVQFNWYVDGVEVHNAKTKPREEQFNSTYRVVSVLTVLHQDWLNGK<br>EYKCKVSNKGLPSSIEKTISKAKGQPREPQVYTLPPSQEEMTKNQVSLTC<br>LVKGFYPSDIAVEWESNGQPENNYKTTPPVLDSDGSFFLYSRLTVDKSRW<br>QEGNVFSCSVMHEALHNHYTQKSLSLSLGK |
| Human<br>IgG1-SEFL2 | 32694 | ASTKGPSVFPLAPSSKSTSGGTAALGCLVKDYFPEPVTVSWNSGALTSGV<br>HTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDK<br>SRWQQGNVFSCSVMHEALHNHYTQKSLSLSPGK |

Each reference cited herein is hereby incorporated by reference in its entirety for all that it teaches and for all purposes.

The present invention is not to be limited in scope by the specific embodiments described herein, which are intended as single illustrations of individual embodiments of the invention, and functionally equivalent methods and components are invention. Indeed, various modifications of the invention, in addition to those shown and described herein will become apparent to those skilled in the art from the foregoing description and accompanying drawings. Such modifications are intended to fall within the scope of the appended claims.

SEQUENCE LISTING (50750 sequences)

SEQ ID NO: 1 - protein, 284 aa, Mus sp.
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 2 - protein, 301 aa, Mus sp.
MEKDCQDIQQLDSEENDHQLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAQLEEKQQQLKADHSTLLFHLKHFPMDLRTLTCQLAYFQSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGGEDCAEILSDGHWNDNFCQQVNRWVCEKRRNITH

SEQ ID NO: 3 - protein, 222 aa, Mus sp.
SQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 4 - protein, 132 aa, Mus sp.
CPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKAN

SEQ ID NO: 5 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6 - protein, 287 aa, Homo sapiens
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 7 - protein, 228 aa, Homo sapiens
SQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 8 - protein, 138 aa, Homo sapiens
CPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 9 - protein, 227 aa, Homo sapiens
QSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 10 - protein, 135 aa, Homo sapiens
CPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 11 - protein, 129 aa, Homo sapiens
MCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETEL

SEQ ID NO: 12 - protein, 145 aa, Homo sapiens
MGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 13 - protein, 146 aa, Homo sapiens
MAGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 14 - protein, 130 aa, Homo sapiens
MACPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETEL

SEQ ID NO: 15 - protein, 96 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 16 - protein, 234 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 17 - protein, 94 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 18 - protein, 98 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAALQGNGSERTC

SEQ ID NO: 19 - protein, 88 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAA

SEQ ID NO: 20 - protein, 84 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAA

SEQ ID NO: 21 - protein, 86 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAA

SEQ ID NO: 22 - protein, 225 aa, Homo sapiens
MAGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELD

SEQ ID NO: 23 - protein, 232 aa, Homo sapiens
MAQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 24 - protein, 233 aa, Homo sapiens
MASQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 25 - protein, 236 aa, Homo sapiens
MAVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 26 - protein, 231 aa, Homo sapiens
MANSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 27 - protein, 231 aa, Homo sapiens
MAGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 28 - protein, 233 aa, Homo sapiens
MAVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 29 - protein, 230 aa, Homo sapiens
MASQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 30 - protein, 229 aa, Homo sapiens
MAQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 31 - protein, 228 aa, Homo sapiens
MASAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 32 - protein, 475 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 33 - protein, 490 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 34 - protein, 475 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 35 - protein, 490 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 36 - protein, 471 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 37 - protein, 486 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 38 - protein, 471 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 39 - protein, 486 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 40 - protein, 490 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 41 - protein, 505 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLG

SEQ ID NO: 42 - protein, 490 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 43 - protein, 505 aa, Artificial Sequence
  Description of Artificial Sequence: Synthetic polypeptide
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAGSGGGGSGGGGSGGGGSMDKDCEMKRTTLDSPLGKLELSGCEQGLHRIIFLGKGTSAADAVEVPAPAAVLGGPEPLIQATAWLNAYFHQPEAIEEFPVPALHHPVFQQESFTRQVLWKLLKVVKFGEVISESHLAALVGNPAATAAVNTALDGNPVPILIPCHRVVQGDSDVGPYLGGLAVKEWLLAHEGHRLGKPGLG

SEQ ID NO: 44 - protein, 291 aa, Homo sapiens; identical to SEQ ID NO: 5

SEQ ID NO: 45 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLL

SEQ ID NO: 46 - protein, 299 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLDYKDDDDK

SEQ ID NO: 47 - protein, 299 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLLDYKDDDDK

SEQ ID NO: 48 - protein, 291 aa, Macaca fascicularis
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 49 - protein, 291 aa, Macaca fascicularis
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLL

SEQ ID NO: 50 - protein, 299 aa, Artificial Sequence
  Description of Artificial Sequence: Synthetic polypeptide
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLLDYKDDDDK

SEQ ID NO: 51 - protein, 299 aa, Artificial Sequence
  Description of Artificial Sequence: Synthetic polypeptide
MTKEYQDLQHLDNEESDHHQLGKGPPPPQSLLRRLCSGPRLLLLSLGLSLLLLVVVCVIGSQNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPCRWVCETELDKASQEPPLLDYKDDDDK

SEQ ID NO: 52 - protein, 284 aa, Mus sp.; identical to SEQ ID NO: 1

SEQ ID NO: 53 - protein, 284 aa, Mus sp.
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKAN

SEQ ID NO: 54 - protein, 284 aa, Rattus sp.
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKAN

SEQ ID NO: 55 - protein, 284 aa, Rattus sp.
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPCRWVCETELGKAN

SEQ ID NO: 56 - protein, 292 aa, Artificial Sequence
  Description of Artificial Sequence: Synthetic polypeptide
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKANDYKDDDDK

SEQ ID NO: 57 - protein, 292 aa, Artificial Sequence
  Description of Artificial Sequence: Synthetic polypeptide
MTKDYQDFQHLDNDNDHHQLRRGPPPTPRLLQRLCSGSRLLLLSSSLSILLLVVVCVITSQNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPCRWVCETKLDKANDYKDDDDK

SEQ ID NO: 58 - protein, 292 aa, Artificial Sequence
  Description of Artificial Sequence: Synthetic polypeptide
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPYRWVCETELGKANDYKDDDDK

SEQ ID NO: 59 - protein, 292 aa, Artificial Sequence
  Description of Artificial Sequence: Synthetic polypeptide
MTKDYQDFQHLDNENDHHQLQRGPPPAPRLLQRLCSGFRLFLLSLGLSILLLVVVCVITSQNSQLREDLRVLRQNFSNFTVSTEDQVKALTTQGERVGRKMKLVESQLEKHQEDLREDHSRLLLHVKQLVSDVRSLSCQMAALRGNGSERICCPINWVEYEGSCYWFSSSVKPWTEADKYCQLENAHLVVVTSWEEQRFVQQHMGPLNTWIGLTDQNGPWKWVDGTDYETGFKNWRPGQPDDWYGHGLGGGEDCAHFTTDGHWNDDVCRRPCRWVCETELGKANDYKDDDDK

SEQ ID NO: 60 - protein, 287 aa, Homo sapiens; identical to SEQ ID NO: 6

SEQ ID NO: 61 - protein, 301 aa, Mus sp.; identical to SEQ ID NO: 2

SEQ ID NO: 62 - protein, 301 aa, Rattus sp.
MEKDFQDIQQLDSEENDHQLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITY

SEQ ID NO: 63 - protein, 293 aa, Artificial Sequence
  Description of Artificial Sequence: Synthetic polypeptide
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVAHHHHHH

SEQ ID NO: 64 - protein, 307 aa, Artificial Sequence
  Description of Artificial Sequence: Synthetic polypeptide
MEKDCQDIQQLDSEENDHQLSGDDEHGSHVQDPRIENPHWKGQPLSRPFPQRLCSTFRLSLLALAFNILLLVVICVVSSQSIQLQEEFRTLKETFSNFSSSTLMEFGALDTLGGSTNAILTSWLAQLEEKQQQLKADHSTLLFHLKHFPMDLRTLTCQLAYFQSNGTECCPVNWVEFGGSCYWFSRDGLTWAEADQYCQLENAHLLVINSREEQDFVVKHRSQFHIWIGLTDRDGSWKWVDGTDYRSNYRNWAFTQPDNWQGHEQGGGEDCAEILSDGHWNDNFCQQVNRWVCEKRRNITHHHHHHH

SEQ ID NO: 65 - protein, 307 aa, Artificial Sequence
  Description of Artificial Sequence: Synthetic polypeptide
MEKDFQDIQQLDSEENDHQLIGDEEQGSHVQNLRTENPRWGGQPPSRPFPQRLCSKFRLSLLALAFNILLLVVICVVSSQSMQLQKEFWTLKETLSNFSTTTLMEFKALDSHGGSRNDNLTSWETILEKKQKDIKADHSTLLFHLKHFPLDLRTLTCQLAFFLSNGTECCPVNWVEFGGSCYWFSRDGLTWAEADQYCQMENAHLLVINSREEQEFVVKHRGAFHIWIGLTDKDGSWKWVDGTEYRSNFKNWAFTQPDNWQGHEEGGSEDCAEILSDGLWNDNFCQQVNRWACERKRDITYHHHHHH

SEQ ID NO: 66 - protein, 308 aa, Artificial Sequence
  Description of Artificial Sequence: Synthetic polypeptide
MAKDCQDIQQLDSEDSDQQLGRGEGPGPRGHGPRREDRFCRRLPPHQPLLLQRLCSGYRLNLLVLGFNVLMLVAICVIGSQRAQLEEELRILKENFSHFSSGVLMELGVLLSDGGGASSQLTSLEAKLEKQQRDVKADHATLLLHLKHFPSDLRILTCQVAFFQSNGTDCCPVNWLEYEGSCYWFSRSGKTWEEAEKYCQLESAHLVVVNSREEQKFILQHTNPFDTWIGLTDSDGSWRWVDGTDYQQSYKNWAATQPDDWQGHEVGGGEDCAEVRANGRWNDNFCKQVQRWVCEMRRNVTGHHHHHH

SEQ ID NO: 67 - protein, 302 aa, Canis lupus familiaris
MAKDCQDIQQLDSEDSDQQLGRGEGPGPRGHGPRREDRFCRRLPPHQPLLLQRLCSGYRLNLLVLGFNVLMLVAICVIGSQRAQLEEELRILKENFSHFSSGVLMELGVLLSDGGGASSQLTSLEAKLEKQQRDVKADHATLLLHLKHFPSDLRILTCQVAFFQSNGTDCCPVNWLEYEGSCYWFSRSGKTWEEAEKYCQLESAHLVVVNSREEQKFILQHTNPFDTWIGLTDSDGSWRWVDGTDYQQSYKNWAATQPDDWQGHEVGGGEDCAEVRANGRWNDNFCKQVQRWVCEMRRNVTG

SEQ ID NO: 68 - protein, 306 aa, Macaca fascicularis
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNLFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 69 - protein, 312 aa, Artificial Sequence
  Description of Artificial Sequence: Synthetic polypeptide
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAAHHHHHH

SEQ ID NO: 70 - protein, 289 aa, Artificial Sequence
  Description of Artificial Sequence: Synthetic polypeptide
MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCQQVKRWVCEMKQNITMHHHHHH

SEQ ID NO: 71 - protein, 306 aa, Macaca fascicularis
MAKDFQDIQQLSSEENDHPFHRGEGPGPRGLNLRRGNPSLKGPPPAQPLAQRLCSMVRFSLLALSFNILLLVAICVIGSQSAQLQAELWSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 72 - protein, 283 aa, Sus sp.
MARDFQDIQQLDSEENDHQLGRGTPLPQPLVLQRLCSKLRLSLLVLGFNVLMLVAVCVVGSQRTQLQMELQTLKETFSNFSSSLLMEMLTLSTRGGSAGDKVTSLEAKMEKQQQDLKADHATLRLHLKHFPRDVRTLTCRLVFLQSNGTECCPVNWVDYEGSCYWFSRSGKAWAEAEKYCQLENAHLVVINSREEQKFIAQRTNPFQTWIGLTDSDGSWKWVDGTDYGNGYKNWGALQPDDWQGHELGGSEDCVEIQGDGRWNDDFCQQVKRWVCEMKQNITM

SEQ ID NO: 73 - protein, 284 aa, Canis lupus familiaris
MTNDYQDLQHLDNEDNDHHLRQVPPAPQPLLRRLCSGPCLLLLSLGLSVLLLVVVCVIGSQNSKLRGELQALRETFSNFTASTEVEVKALSSQGGNVGRKMKSLESQLEKQQKDLSEDHSDLLLHVKQFVSDLRSLSCQIAALHGNGSTLTCCPVNWLEYEGSCYWFSRSGKSWPEADKYCQLESAHLVVVNSREEQKFIQHHMGPVNTWMGLTDQSGPWKWVDGTDYETGFKNWRPEQPDDWYGHGLGGGEDCAHFTDDGRWNDDVCQRPYRWVCEAARDPAT

SEQ ID NO: 74 - protein, 286 aa, Sus sp.
MTKEYQDLQHLDNEENDQQHRKGPPPQPSLLRRLCSGPCLLLISMGLSLLLLVVVCVIGSQNSKLQEELQALRETFSNLTASTDAKVKTLSMQGGNVGRKMKSLESQLEKQQQDLSEDHSSLLLHVKQFVSDLRSLSCQMAVLQGNGSERTCCPVNWVGYEGSCYWFSRSGKPWPEAEKYCQLENAHLVVVGSWEEQKFIQHHVGPVNSWIGLTDQSGPWKWVDGTDYESGFKNWRPEQPDDWYGHGLGGGEDCAHFTEDGGWNDDICQRPYRWVCETQRDRDSGS

SEQ ID NO: 75 - protein, 292 aa, Artificial Sequence
  Description of Artificial Sequence: Synthetic polypeptide
MTNDYQDLQHLDNEDNDHHLRQVPPAPQPLLRRLCSGPCLLLLSLGLSVLLLVVVCVIGSQNSKLRGELQALRETFSNFTASTEVEVKALSSQGGNVGRKMKSLESQLEKQQKDLSEDHSDLLLHVKQFVSDLRSLSCQIAALHGNGSTLTCCPVNWLEYEGSCYWFSRSGKSWPEADKYCQLESAHLVVVNSREEQKFIQHHMGPVNTWMGLTDQSGPWKWVDGTDYETGFKNWRPEQPDDWYGHGLGGGEDCAHFTDDGRWNDDVCQRPYRWVCEAARDPATDYKDDDDK

SEQ ID NO: 76 - protein, 294 aa, Artificial Sequence
  Description of Artificial Sequence: Synthetic polypeptide
MTKEYQDLQHLDNEENDQQHRKGPPPQPSLLRRLCSGPCLLLISMGLSLLLLVVVCVIGSQNSKLQEELQALRETFSNLTASTDAKVKTLSMQGGNVGRKMKSLESQLEKQQQDLSEDHSSLLLHVKQFVSDLRSLSCQMAVLQGNGSERTCCPVNWVGYEGSCYWFSRSGKPWPEAEKYCQLENAHLVVVGSWEEQKFIQHHVGPVNSWIGLTDQSGPWKWVDGTDYESGFKNWRPEQPDDWYGHGLGGGEDCAHFTEDGGWNDDICQRPYRWVCETQRDRDSGSDYKDDDDK

SEQ ID NO: 77 - protein, 94 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQEAMWEER

SEQ ID NO: 78 - protein, 105 aa, Artificial Sequence
  Description of Artificial Sequence: Synthetic polypeptide
MTKEYQDLQHLDNEESDHHQLRKGPPPPQPLLQRLCSGPRLLLLSLGLSLLLLVVVCVIGSQNSQLQEELRGLRETFSNFTASTEAQEAMWEERGQQKLISEEDL

SEQ ID NO: 79 - DNA, 33 bp, Artificial Sequence
  Description of Artificial Sequence: Synthetic oligonucleotide
cgggcaagtcggagcgttagcagatatttaaat

SEQ ID NO: 80 - protein, 11 aa, Artificial Sequence
  Description of Artificial Sequence: Synthetic peptide
RASRSVSRYLN

SEQ ID NO: 81 - DNA, 51 bp, Artificial Sequence
  Description of Artificial Sequence: Synthetic oligonucleotide
aagtccagccagagtcttttaaagagctccaacaataagagctacttagct

SEQ ID NO: 82 - protein, 17 aa, Artificial Sequence
  Description of Artificial Sequence: Synthetic peptide
KSSQSLLKSSNNKSYLA

SEQ ID NO: 83 - DNA, 51 bp, Artificial Sequence
  Description of Artificial Sequence: Synthetic oligonucleotide
aagtccagccagagtgttttattcagctccaacaattataactacttagct

SEQ ID NO: 84 - protein, 17 aa, Artificial Sequence
  Description of Artificial Sequence: Synthetic peptide
KSSQSVLFSSNNYNYLA

SEQ ID NO: 85 - DNA, 48 bp, Artificial Sequence
  Description of Artificial Sequence: Synthetic oligonucleotide
aagtctagtcagagcctcctgcgtagtgatggaaagacccatttgtat

SEQ ID NO: 86 - protein, 16 aa, Artificial Sequence
  Description of Artificial Sequence: Synthetic peptide
KSSQSLLRSDGKTHLY

SEQ ID NO: 87 - DNA, 33 bp, Artificial Sequence
  Description of Artificial Sequence: Synthetic oligonucleotide
ccggcgagtcagggcattagcaattatttagct

SEQ ID NO: 88 - protein, 11 aa, Artificial Sequence
  Description of Artificial Sequence: Synthetic peptide
PASQGISNYLA

SEQ ID NO: 89 - DNA, 33 bp, Artificial Sequence
  Description of Artificial Sequence: Synthetic oligonucleotide
tctggagataaattgggtaataaatatgtttgt

SEQ ID NO: 90 - protein, 11 aa, Artificial Sequence
  Description of Artificial Sequence: Synthetic peptide
SGDKLGNKYVC

SEQ ID NO: 91 - DNA, 33 bp, Artificial Sequence
  Description of Artificial Sequence: Synthetic oligonucleotide
cgggggggtcagggtattagcacatggttagca

SEQ ID NO: 92 - protein, 11 aa, Artificial Sequence
  Description of Artificial Sequence: Synthetic peptide
RGGQGISTWLA

SEQ ID NO: 93 - DNA, 33 bp, Artificial Sequence
  Description of Artificial Sequence: Synthetic oligonucleotide
cggacaagtcagggcattagaaatgatttaggc

SEQ ID NO: 94 - protein, 11 aa, Artificial Sequence
  Description of Artificial Sequence: Synthetic peptide
RTSQGIRNDLG

SEQ ID NO: 95 - DNA, 33 bp, Artificial Sequence
  Description of Artificial Sequence: Synthetic oligonucleotide
cgggcgagtcagggtattagcaaatggttagcc

SEQ ID NO: 96 - protein, 11 aa, Artificial Sequence
  Description of Artificial Sequence: Synthetic peptide
RASQGISKWLA

SEQ ID NO: 97 - DNA, 33 bp, Artificial Sequence
  Description of Artificial Sequence: Synthetic oligonucleotide
cgggcgagtcagggtattagcaagtggttagcc

SEQ ID NO: 98 - protein, 11 aa, Artificial Sequence
  Description of Artificial Sequence: Synthetic peptide
RASQGISKWLA

SEQ ID NO: 99 - DNA, 36 bp, Artificial Sequence
  Description of Artificial Sequence: Synthetic oligonucleotide
agggccagtcagagtgttaacagcaactacttagcc

SEQ ID NO: 100 - protein, 12 aa, Artificial Sequence
  Description of Artificial Sequence: Synthetic peptide
RASQSVNSNYLA

SEQ ID NO: 101 - DNA, 33 bp, Artificial Sequence
  Description of Artificial Sequence: Synthetic oligonucleotide
cgggcaagtcgagacattagaaatgatttaggc

SEQ ID NO: 102 - protein, 11 aa, Artificial Sequence
  Description of Artificial Sequence: Synthetic peptide
RASRDIRNDLG

SEQ ID NO: 103 - DNA, 48 bp, Artificial Sequence
  Description of Artificial Sequence: Synthetic oligonucleotide
aagtctagtcagagcctcctgcatagtgaaggaaagacctatttgtat

SEQ ID NO: 104 - protein, 16 aa, Artificial Sequence
  Description of Artificial Sequence: Synthetic peptide
KSSQSLLHSEGKTYLY

SEQ ID NO: 105 - DNA, 33 bp, Artificial Sequence
  Description of Artificial Sequence: Synthetic oligonucleotide
cgggcgagtcagggcattagcaattatttagcc

SEQ ID NO: 106 - protein, 11 aa, Artificial Sequence
  Description of Artificial Sequence: Synthetic peptide
RASQGISNYLA

SEQ ID NO: 107 - DNA, 48 bp, Artificial Sequence
  Description of Artificial Sequence: Synthetic oligonucleotide
aagtctagtcagcgcctcctgcatggtgatggaaagacctatttgtat

SEQ ID NO: 108 - protein, 16 aa, Artificial Sequence
  Description of Artificial Sequence: Synthetic peptide
KSSQRLLHGDGKTYLY

SEQ ID NO: 109 - DNA, 33 bp, Artificial Sequence
  Description of Artificial Sequence: Synthetic oligonucleotide
cgggcaagtcagggcattagaaatgatttaggc

SEQ ID NO: 110 - protein, 11 aa, Artificial Sequence
  Description of Artificial Sequence: Synthetic peptide
RASQGIRNDLG

SEQ ID NO: 111 - DNA, 33 bp, Artificial Sequence; identical to SEQ ID NO: 109
  Description of Artificial Sequence: Synthetic oligonucleotide

SEQ ID NO: 112 - protein, 11 aa, Artificial Sequence
  Description of Artificial Sequence: Synthetic peptide
RASQGIRNDLG

SEQ ID NO: 113 - DNA, 33 bp, Artificial Sequence
  Description of Artificial Sequence: Synthetic oligonucleotide
cgggcaagtcagggcattagacatgatttaggc

SEQ ID NO: 114 - protein, 11 aa, Artificial Sequence
  Description of Artificial Sequence: Synthetic peptide
RASQGIRHDLG

SEQ ID NO: 115 - DNA, 33 bp, Artificial Sequence
  Description of Artificial Sequence: Synthetic oligonucleotide
agggccagtcagactgttaacagcaacttagcc

SEQ ID NO: 116 - protein, 11 aa, Artificial Sequence
  Description of Artificial Sequence: Synthetic peptide
RASQTVNSNLA

SEQ ID NO: 117 - DNA, 33 bp, Artificial Sequence
  Description of Artificial Sequence: Synthetic oligonucleotide
aggaccagtcagagtgtttggattagcgtagcc

SEQ ID NO: 118 - protein, 11 aa, Artificial Sequence
  Description of Artificial Sequence: Synthetic peptide
RTSQSVWISVA

SEQ ID NO: 119 - DNA, 33 bp, Artificial Sequence
  Description of Artificial Sequence: Synthetic oligonucleotide
cgggcaagtcaggacattagaaattatttaggc

SEQ ID NO: 120 - protein, 11 aa, Artificial Sequence
  Description of Artificial Sequence: Synthetic peptide
RASQDIRNYLG

SEQ ID NO: 121 - DNA, 36 bp, Artificial Sequence; identical to SEQ ID NO: 99
  Description of Artificial Sequence: Synthetic oligonucleotide

SEQ ID NO: 122 - protein, 12 aa, Artificial Sequence
  Description of Artificial Sequence: Synthetic peptide
RASQSVNSNYLA

SEQ ID NO: 123 - DNA, 33 bp, Artificial Sequence
  Description of Artificial Sequence: Synthetic oligonucleotide
cgggcaagtcagggcataagaaaagatttaggc

SEQ ID NO: 124 - protein, 11 aa, Artificial Sequence
  Description of Artificial Sequence: Synthetic peptide
RASQGIRKDLG

SEQ ID NO: 125 - DNA, 36 bp, Artificial Sequence
  Description of Artificial Sequence: Synthetic oligonucleotide
agggccagtcagagcgttaacagcaactacttagcc

SEQ ID NO: 126 - protein, 12 aa, Artificial Sequence
  Description of Artificial Sequence: Synthetic peptide
RASQSVNSNYLA

SEQ ID NO: 127 - DNA, 33 bp, Artificial Sequence; identical to SEQ ID NO: 109
  Description of Artificial Sequence: Synthetic oligonucleotide

SEQ ID NO: 128 - protein, 11 aa, Artificial Sequence
  Description of Artificial Sequence: Synthetic peptide
RASQGIRNDLG

SEQ ID NO: 129 - DNA, 36 bp, Artificial Sequence; identical to SEQ ID NO: 99
  Description of Artificial Sequence: Synthetic oligonucleotide

SEQ ID NO: 130 - protein, 12 aa, Artificial Sequence
  Description of Artificial Sequence: Synthetic peptide
RASQSVNSNYLA

SEQ ID NO: 131 - DNA, 33 bp, Artificial Sequence; identical to SEQ ID NO: 109
  Description of Artificial Sequence: Synthetic oligonucleotide

SEQ ID NO: 132 - protein, 11 aa, Artificial Sequence
  Description of Artificial Sequence: Synthetic peptide
RASQGIRNDLG

SEQ ID NO: 133 - DNA, 33 bp, Artificial Sequence
  Description of Artificial Sequence: Synthetic oligonucleotide
cgggcaagtcagggcattagaagtgatttaggc

SEQ ID NO: 134 - protein, 11 aa, Artificial Sequence
  Description of Artificial Sequence: Synthetic peptide
RASQGIRSDLG

SEQ ID NO: 135 - DNA, 33 bp, Artificial Sequence; identical to SEQ ID NO: 119
  Description of Artificial Sequence: Synthetic oligonucleotide

SEQ ID NO: 136 - protein, 11 aa, Artificial Sequence
  Description of Artificial Sequence: Synthetic peptide
RASQDIRNYLG

SEQ ID NO: 137 - DNA, 33 bp, Artificial Sequence
  Description of Artificial Sequence: Synthetic oligonucleotide
cgggcaagtcagaacattagcagctatttaaat

SEQ ID NO: 138 - protein, 11 aa, Artificial Sequence
  Description of Artificial Sequence: Synthetic peptide
RASQNISSYLN

SEQ ID NO: 139 - DNA, 51 bp, Artificial Sequence
  Description of Artificial Sequence: Synthetic oligonucleotide
aagtccagccagagtgttttatccagctccaacaataacaactacttagct

SEQ ID NO: 140 - protein, 17 aa, Artificial Sequence
  Description of Artificial Sequence: Synthetic peptide
KSSQSVLSSSNNNNYLA

SEQ ID NO: 141 - DNA, 51 bp, Artificial Sequence
  Description of Artificial Sequence: Synthetic oligonucleotide
aagtccagccagagtgttttatccaactccaacaataacaactacttagct

SEQ ID NO: 142 - protein, 17 aa, Artificial Sequence
  Description of Artificial Sequence: Synthetic peptide
KSSQSVLSNSNNNNYLA

SEQ ID NO: 143 - DNA, 48 bp, Artificial Sequence
  Description of Artificial Sequence: Synthetic oligonucleotide
aggtctggtcaaagcctcgtatacagtgatggaaacacctacttgaat

SEQ ID NO: 144 - protein, 16 aa, Artificial Sequence
  Description of Artificial Sequence: Synthetic peptide
RSGQSLVYSDGNTYLN

SEQ ID NO: 145 - DNA, 48 bp, Artificial Sequence
  Description of Artificial Sequence: Synthetic oligonucleotide
aggtctagtcaaagcctcgtttacagtgttggaaacacctccttgagt

SEQ ID NO: 146 - protein, 16 aa, Artificial Sequence
  Description of Artificial Sequence: Synthetic peptide
RSSQSLVYSVGNTSLS

SEQ ID NO: 147 - DNA, 33 bp, Artificial Sequence
  Description of Artificial Sequence: Synthetic oligonucleotide
cgggcaagtcggggcattagagatgatttaggc

SEQ ID NO: 148 - protein, 11 aa, Artificial Sequence
  Description of Artificial Sequence: Synthetic peptide
RASRGIRDDLG

SEQ ID NO: 149 - DNA, 33 bp, Artificial Sequence; identical to SEQ ID NO: 109
  Description of Artificial Sequence: Synthetic oligonucleotide

SEQ ID NO: 150 - protein, 11 aa, Artificial Sequence
  Description of Artificial Sequence: Synthetic peptide
RASQGIRNDLG

SEQ ID NO: 151 - DNA, 42 bp, Artificial Sequence
  Description of Artificial Sequence: Synthetic oligonucleotide
actggaaccagcagtgacgttggtggttataattttgtctcc

SEQ ID NO: 152 - protein, 14 aa, Artificial Sequence
  Description of Artificial Sequence: Synthetic peptide
TGTSSDVGGYNFVS

SEQ ID NO: 153 - DNA, 39 bp, Artificial Sequence
  Description of Artificial Sequence: Synthetic oligonucleotide
tctggaagcagctccaacatcggaagtaatactgtaaac

SEQ ID NO: 154 - protein, 13 aa, Artificial Sequence
  Description of Artificial Sequence: Synthetic peptide
SGSSSNIGSNTVN

SEQ ID NO: 155 - DNA, 33 bp, Artificial Sequence
  Description of Artificial Sequence: Synthetic oligonucleotide
actggagatgcaatgccgaaaaaatatgcttat

SEQ ID NO: 156 - protein, 11 aa, Artificial Sequence
  Description of Artificial Sequence: Synthetic peptide
TGDAMPKKYAY

SEQ ID NO: 157 - DNA, 33 bp, Artificial Sequence; identical to SEQ ID NO: 109
  Description of Artificial Sequence: Synthetic oligonucleotide

SEQ ID NO: 158 - protein, 11 aa, Artificial Sequence
  Description of Artificial Sequence: Synthetic peptide
RASQGIRNDLG

SEQ ID NO: 159 - DNA, 51 bp, Artificial Sequence
  Description of Artificial Sequence: Synthetic oligonucleotide
aagtccagccagagtgttttgtacagctccaacagtcacaactacttagct

SEQ ID NO: 160 - protein, 17 aa, Artificial Sequence
  Description of Artificial Sequence: Synthetic peptide
KSSQSVLYSSNSHNYLA

SEQ ID NO: 161 - DNA, 33 bp, Artificial Sequence
  Description of Artificial Sequence: Synthetic oligonucleotide
cgggcaagtcaggacattagagataatttaggc

SEQ ID NO: 162 - protein, 11 aa, Artificial Sequence
  Description of Artificial Sequence: Synthetic peptide
RASQDIRDNLG

SEQ ID NO: 163 - DNA, 33 bp, Artificial Sequence
  Description of Artificial Sequence: Synthetic oligonucleotide
tctggagataaattgggggataaatatgcttac

SEQ ID NO: 164 - protein, 11 aa, Artificial Sequence
  Description of Artificial Sequence: Synthetic peptide
SGDKLGDKYAY

SEQ ID NO: 165 - DNA, 48 bp, Artificial Sequence
  Description of Artificial Sequence: Synthetic oligonucleotide
aggtctagtcaaagcctcgtatacagtgatggaaacaccttcttgaat

SEQ ID NO: 166 - protein, 16 aa, Artificial Sequence
  Description of Artificial Sequence: Synthetic peptide
RSSQSLVYSDGNTFLN

SEQ ID NO: 167 - DNA, 42 bp, Artificial Sequence; identical to SEQ ID NO: 151
  Description of Artificial Sequence: Synthetic oligonucleotide

SEQ ID NO: 168 - protein, 14 aa, Artificial Sequence
  Description of Artificial Sequence: Synthetic peptide
TGTSSDVGGYNFVS

SEQ ID NO: 169 - DNA, 33 bp, Artificial Sequence; identical to SEQ ID NO: 133
  Description of Artificial Sequence: Synthetic oligonucleotide

SEQ ID NO: 170 - protein, 11 aa, Artificial Sequence
  Description of Artificial Sequence: Synthetic peptide
RASQGIRSDLG

SEQ ID NO: 171 - DNA, 33 bp, Artificial Sequence
  Description of Artificial Sequence: Synthetic oligonucleotide
cgggcgagtcagggtattagcagctggttagcc

SEQ ID NO: 172 - protein, 11 aa, Artificial Sequence
  Description of Artificial Sequence: Synthetic peptide
RASQGISSWLA

SEQ ID NO: 173 - DNA, 33 bp, Artificial Sequence
  Description of Artificial Sequence: Synthetic oligonucleotide
cgggcgagtcagggtattagcaggtggttagcc

SEQ ID NO: 174 - protein, 11 aa, Artificial Sequence
  Description of Artificial Sequence: Synthetic peptide
RASQGISRWLA

SEQ ID NO: 175 - DNA, 33 bp, Artificial Sequence; identical to SEQ ID NO: 109
  Description of Artificial Sequence: Synthetic oligonucleotide

SEQ ID NO: 176 - protein, 11 aa, Artificial Sequence
  Description of Artificial Sequence: Synthetic peptide
RASQGIRNDLG

SEQ ID NO: 177 - DNA, 33 bp, Artificial Sequence
  Description of Artificial Sequence: Synthetic oligonucleotide
tctggagataaattgggggataaatatgtttac

SEQ ID NO: 178 - protein, 11 aa, Artificial Sequence
  Description of Artificial Sequence: Synthetic peptide
SGDKLGDKYVY

SEQ ID NO: 179 - DNA, 48 bp, Artificial Sequence
  Description of Artificial Sequence: Synthetic oligonucleotide
aggtctagtcaaagcctcgtatccagtgatggaaacaccttcttgaat

SEQ ID NO: 180 - protein, 16 aa, Artificial Sequence
  Description of Artificial Sequence: Synthetic peptide
RSSQSLVSSDGNTFLN

SEQ ID NO: 181 - DNA, 33 bp, Artificial Sequence
  Description of Artificial Sequence: Synthetic oligonucleotide
tctggagataaattgggggataaatatacttac

SEQ ID NO: 182 - protein, 11 aa, Artificial Sequence
  Description of Artificial Sequence: Synthetic peptide
SGDKLGDKYTY

SEQ ID NO: 183 - DNA, 42 bp, Artificial Sequence
  Description of Artificial Sequence: Synthetic oligonucleotide
actggaaccagcagtgacgttggtggttataactatgtctcc

SEQ ID NO: 184 - protein, 14 aa, Artificial Sequence
  Description of Artificial Sequence: Synthetic peptide
TGTSSDVGGYNYVS

SEQ ID NO: 185 - DNA, 33 bp, Artificial Sequence
  Description of Artificial Sequence: Synthetic oligonucleotide
tctggagataaattggggaataaatatgcttgg

SEQ ID NO: 186 - protein, 11 aa, Artificial Sequence
  Description of Artificial Sequence: Synthetic peptide
SGDKLGNKYAW

SEQ ID NO: 187 - DNA, 33 bp, Artificial Sequence
  Description of Artificial Sequence: Synthetic oligonucleotide
tctggagataaattgggggaaaaatatgtttgc

SEQ ID NO: 188 - protein, 11 aa, Artificial Sequence
  Description of Artificial Sequence: Synthetic peptide
SGDKLGEKYVC

SEQ ID NO: 189 - DNA, 33 bp, Artificial Sequence
  Description of Artificial Sequence: Synthetic oligonucleotide
tctggagagaaattgggggataaatatgtttgt

SEQ ID NO: 190 - protein, 11 aa, Artificial Sequence
  Description of Artificial Sequence: Synthetic peptide
SGEKLGDKYVC

SEQ ID NO: 191 - DNA, 33 bp, Artificial Sequence
  Description of Artificial Sequence: Synthetic oligonucleotide
tctggagataaattgggggataaatatgcttcc

SEQ ID NO: 192 - protein, 11 aa, Artificial Sequence
  Description of Artificial Sequence: Synthetic peptide
SGDKLGDKYAS

SEQ ID NO: 193 - DNA, 33 bp, Artificial Sequence
  Description of Artificial Sequence: Synthetic oligonucleotide
gggggaaacaacattggaagtaaagctgtgcac

SEQ ID NO: 194 - protein, 11 aa, Artificial Sequence
  Description of Artificial Sequence: Synthetic peptide
GGNNIGSKAVH

SEQ ID NO: 195 - DNA, 36 bp, Artificial Sequence
  Description of Artificial Sequence: Synthetic oligonucleotide
accctaagcagtgagcacagcacctacaccatcgaa

SEQ ID NO: 196 - protein, 12 aa, Artificial Sequence
  Description of Artificial Sequence: Synthetic peptide
TLSSEHSTYTIE

SEQ ID NO: 197 - DNA, 33 bp, Artificial Sequence
  Description of Artificial Sequence: Synthetic oligonucleotide
tctggagatagattgggggataaatatgcttgg

SEQ ID NO: 198 - protein, 11 aa, Artificial Sequence
  Description of Artificial Sequence: Synthetic peptide
SGDRLGDKYAW

SEQ ID NO: 199 - DNA, 48 bp, Artificial Sequence
  Description of Artificial Sequence: Synthetic oligonucleotide
aagtctagtcagagcctcctgcatagtgatggaaagacccatttgaat

SEQ ID NO: 200 - protein, 16 aa, Artificial Sequence
  Description of Artificial Sequence: Synthetic peptide
KSSQSLLHSDGKTHLN

SEQ ID NO: 201 - DNA, 33 bp, Artificial Sequence; identical to SEQ ID NO: 105
  Description of Artificial Sequence: Synthetic oligonucleotide

SEQ ID NO: 202 - protein, 11 aa, Artificial Sequence
  Description of Artificial Sequence: Synthetic peptide
RASQGISNYLA

SEQ ID NO: 203 - DNA, 33 bp, Artificial Sequence; identical to SEQ ID NO: 109
  Description of Artificial Sequence: Synthetic oligonucleotide

SEQ ID NO: 204 - protein, 11 aa, Artificial Sequence
  Description of Artificial Sequence: Synthetic peptide
RASQGIRNDLG

SEQ ID NO: 205 - DNA, 33 bp, Artificial Sequence
  Description of Artificial Sequence: Synthetic oligonucleotide
cgggcaagtcaggacattagaaatgatttaggc

SEQ ID NO: 206 - protein, 11 aa, Artificial Sequence
  Description of Artificial Sequence: Synthetic peptide
RASQDIRNDLG

SEQ ID NO: 207 - DNA, 33 bp, Artificial Sequence; identical to SEQ ID NO: 109
  Description of Artificial Sequence: Synthetic oligonucleotide

SEQ ID NO: 208 - protein, 11 aa, Artificial Sequence
  Description of Artificial Sequence: Synthetic peptide
RASQGIRNDLG

SEQ ID NO: 209 - DNA, 33 bp, Artificial Sequence; identical to SEQ ID NO: 109
  Description of Artificial Sequence: Synthetic oligonucleotide

SEQ ID NO: 210 - protein, 11 aa, Artificial Sequence
  Description of Artificial Sequence: Synthetic peptide
RASQGIRNDLG

SEQ ID NO: 211 - DNA, 33 bp, Artificial Sequence; identical to SEQ ID NO: 109
  Description of Artificial Sequence: Synthetic oligonucleotide

SEQ ID NO: 212 - protein, 11 aa, Artificial Sequence
  Description of Artificial Sequence: Synthetic peptide
RASQGIRNDLG

SEQ ID NO: 213 - DNA, 33 bp, Artificial Sequence
  Description of Artificial Sequence: Synthetic oligonucleotide
cgggcaagtcaggacattagaaatcatttaggc

SEQ ID NO: 214 - protein, 11 aa, Artificial Sequence
  Description of Artificial Sequence: Synthetic peptide
RASQDIRNHLG

SEQ ID NO: 215 - DNA, 33 bp, Artificial Sequence; identical to SEQ ID NO: 133
  Description of Artificial Sequence: Synthetic oligonucleotide

SEQ ID NO: 216 - protein, 11 aa, Artificial Sequence
  Description of Artificial Sequence: Synthetic peptide
RASQGIRSDLG

SEQ ID NO: 217 - DNA, 33 bp, Artificial Sequence
  Description of Artificial Sequence: Synthetic oligonucleotide
cgggcaagtcagaccattagcaactatttaaat

SEQ ID NO: 218 - protein, 11 aa, Artificial Sequence
  Description of Artificial Sequence: Synthetic peptide
RASQTISNYLN

SEQ ID NO: 219 - DNA, 33 bp, Artificial Sequence
  Description of Artificial Sequence: Synthetic oligonucleotide
cgggcaagtcaggtcattagaaatgatttaggc

SEQ ID NO: 220 - protein, 11 aa, Artificial Sequence
  Description of Artificial Sequence: Synthetic peptide
RASQVIRNDLG

SEQ ID NO: 221 - DNA, 33 bp, Artificial Sequence; identical to SEQ ID NO: 109
  Description of Artificial Sequence: Synthetic oligonucleotide

SEQ ID NO: 222 - protein, 11 aa, Artificial Sequence
  Description of Artificial Sequence: Synthetic peptide
RASQGIRNDLG

SEQ ID NO: 223 - DNA, 33 bp, Artificial Sequence; identical to SEQ ID NO: 93
  Description of Artificial Sequence: Synthetic oligonucleotide

SEQ ID NO: 224 - protein, 11 aa, Artificial Sequence
  Description of Artificial Sequence: Synthetic peptide
RTSQGIRNDLG

SEQ ID NO: 225 - DNA, 33 bp, Artificial Sequence; identical to SEQ ID NO: 109
  Description of Artificial Sequence: Synthetic oligonucleotide

SEQ ID NO: 226 - protein, 11 aa, Artificial Sequence
  Description of Artificial Sequence: Synthetic peptide
RASQGIRNDLG

SEQ ID NO: 227 - DNA, 33 bp, Artificial Sequence; identical to SEQ ID NO: 109
  Description of Artificial Sequence: Synthetic oligonucleotide

SEQ ID NO: 228 - protein, 11 aa, Artificial Sequence
  Description of Artificial Sequence: Synthetic peptide
RASQGIRNDLG

SEQ ID NO: 229 - DNA, 33 bp, Artificial Sequence; identical to SEQ ID NO: 217
  Description of Artificial Sequence: Synthetic oligonucleotide

SEQ ID NO: 230 - protein, 11 aa, Artificial Sequence
  Description of Artificial Sequence: Synthetic peptide
RASQTISNYLN

SEQ ID NO: 231 - DNA, 33 bp, Artificial Sequence
  Description of Artificial Sequence: Synthetic oligonucleotide
cgggcgagtcagggtattggcaactggttagcc

SEQ ID NO: 232 - protein, 11 aa, Artificial Sequence
  Description of Artificial Sequence: Synthetic peptide
RASQGIGNWLA

SEQ ID NO: 233 - DNA, 33 bp, Artificial Sequence
  Description of Artificial Sequence: Synthetic oligonucleotide
cgggcaagtcagagcattaatacttatttaaat

SEQ ID NO: 234 - protein, 11 aa, Artificial Sequence
  Description of Artificial Sequence: Synthetic peptide
RASQSINTYLN

SEQ ID NO: 235 - DNA, 33 bp, Artificial Sequence; identical to SEQ ID NO: 109
  Description of Artificial Sequence: Synthetic oligonucleotide

SEQ ID NO: 236 - protein, 11 aa, Artificial Sequence
  Description of Artificial Sequence: Synthetic peptide
RASQGIRNDLG

SEQ ID NO: 237 - DNA, 33 bp, Artificial Sequence; identical to SEQ ID NO: 109
  Description of Artificial Sequence: Synthetic oligonucleotide

SEQ ID NO: 238 - protein, 11 aa, Artificial Sequence
  Description of Artificial Sequence: Synthetic peptide
RASQGIRNDLG

SEQ ID NO: 239 - DNA, 33 bp, Artificial Sequence; identical to SEQ ID NO: 109
  Description of Artificial Sequence: Synthetic oligonucleotide

SEQ ID NO: 240 - protein, 11 aa, Artificial Sequence
  Description of Artificial Sequence: Synthetic peptide
RASQGIRNDLG

SEQ ID NO: 241 - DNA, 33 bp, Artificial Sequence
  Description of Artificial Sequence: Synthetic oligonucleotide
cgggcaggtcagaacattatcaactatttaaat

SEQ ID NO: 242 - protein, 11 aa, Artificial Sequence
  Description of Artificial Sequence: Synthetic peptide
RAGQNIINYLN

SEQ ID NO: 243 - DNA, 33 bp, Artificial Sequence
  Description of Artificial Sequence: Synthetic oligonucleotide
cgggcaagtcagagcattatcacctatttaaat

SEQ ID NO: 244 - protein, 11 aa, Artificial Sequence
  Description of Artificial Sequence: Synthetic peptide
RASQSIITYLN

SEQ ID NO: 245 - DNA, 33 bp, Artificial Sequence; identical to SEQ ID NO: 109
  Description of Artificial Sequence: Synthetic oligonucleotide

SEQ ID NO: 246 - protein, 11 aa, Artificial Sequence
  Description of Artificial Sequence: Synthetic peptide
RASQGIRNDLG

SEQ ID NO: 247 - DNA, 33 bp, Artificial Sequence
  Description of Artificial Sequence: Synthetic oligonucleotide
cgggcaagtcagaacattagtagttatttaaat

SEQ ID NO: 248 - protein, 11 aa, Artificial Sequence
  Description of Artificial Sequence: Synthetic peptide
RASQNISSYLN

SEQ ID NO: 249 - DNA, 33 bp, Artificial Sequence; identical to SEQ ID NO: 109
  Description of Artificial Sequence: Synthetic oligonucleotide

SEQ ID NO: 250 - protein, 11 aa, Artificial Sequence
  Description of Artificial Sequence: Synthetic peptide
RASQGIRNDLG

SEQ ID NO: 251 - DNA, 33 bp, Artificial Sequence
  Description of Artificial Sequence: Synthetic oligonucleotide
cgggcaagtcagggcataagaaatgatttaggc

SEQ ID NO: 252 - protein, 11 aa, Artificial Sequence
  Description of Artificial Sequence: Synthetic peptide
RASQGIRNDLG

SEQ ID NO: 253 - DNA, 33 bp, Artificial Sequence
  Description of Artificial Sequence: Synthetic oligonucleotide
cgggcaagtcagagcattagtagttatttatat

SEQ ID NO: 254 - protein, 11 aa, Artificial Sequence
  Description of Artificial Sequence: Synthetic peptide
RASQSISSYLY

SEQ ID NO: 255 - DNA, 33 bp, Artificial Sequence; identical to SEQ ID NO: 109
  Description of Artificial Sequence: Synthetic oligonucleotide

SEQ ID NO: 256 - protein, 11 aa, Artificial Sequence
  Description of Artificial Sequence: Synthetic peptide
RASQGIRNDLG

SEQ ID NO: 257 - DNA, 33 bp, Artificial Sequence
  Description of Artificial Sequence: Synthetic oligonucleotide
cgggcgagtcaggccattaacacttatttagcc

SEQ ID NO: 258 - protein, 11 aa, Artificial Sequence
  Description of Artificial Sequence: Synthetic peptide
RASQAINTYLA

SEQ ID NO: 259 - DNA, 33 bp, Artificial Sequence; identical to SEQ ID NO: 109
  Description of Artificial Sequence: Synthetic oligonucleotide

SEQ ID NO: 260 - protein, 11 aa, Artificial Sequence
  Description of Artificial Sequence: Synthetic peptide
RASQGIRNDLG

SEQ ID NO: 261 - DNA, 33 bp, Artificial Sequence; identical to SEQ ID NO: 109
  Description of Artificial Sequence: Synthetic oligonucleotide

SEQ ID NO: 262 - protein, 11 aa, Artificial Sequence
  Description of Artificial Sequence: Synthetic peptide
RASQGIRNDLG

SEQ ID NO: 263 - DNA, 33 bp, Artificial Sequence; identical to SEQ ID NO: 109
  Description of Artificial Sequence: Synthetic oligonucleotide

SEQ ID NO: 264 - protein, 11 aa, Artificial Sequence
  Description of Artificial Sequence: Synthetic peptide
RASQGIRNDLG

SEQ ID NO: 265 - DNA, 33 bp, Artificial Sequence
  Description of Artificial Sequence: Synthetic oligonucleotide
cgggcgagtcaggacattagctattatttagcc

SEQ ID NO: 266 - protein, 11 aa, Artificial Sequence
  Description of Artificial Sequence: Synthetic peptide
RASQDISYYLA

SEQ ID NO: 267 - DNA, 33 bp, Artificial Sequence
  Description of Artificial Sequence: Synthetic oligonucleotide
cgggcaagtcagaacattatcaactatttaaat

SEQ ID NO: 268 - protein, 11 aa, Artificial Sequence
  Description of Artificial Sequence: Synthetic peptide
RASQNIINYLN

SEQ ID NO: 269 - DNA, 33 bp, Artificial Sequence
  Description of Artificial Sequence: Synthetic oligonucleotide
cgggcaagtcagagcattatcaactatttaaat

SEQ ID NO: 270 - protein, 11 aa, Artificial Sequence
  Description of Artificial Sequence: Synthetic peptide
RASQSIINYLN

SEQ ID NO: 271 - DNA, 33 bp, Artificial Sequence; identical to SEQ ID NO: 109
  Description of Artificial Sequence: Synthetic oligonucleotide

SEQ ID NO: 272 - protein, 11 aa, Artificial Sequence
  Description of Artificial Sequence: Synthetic peptide
RASQGIRNDLG

SEQ ID NO: 273 - DNA, 33 bp, Artificial Sequence
  Description of Artificial Sequence: Synthetic oligonucleotide
cgggcaagtcagaccattagtagttttttaaat

SEQ ID NO: 274 - protein, 11 aa, Artificial Sequence
  Description of Artificial Sequence: Synthetic peptide
RASQTISSFLN

SEQ ID NO: 275 - DNA, 33 bp, Artificial Sequence
  Description of Artificial Sequence: Synthetic oligonucleotide
cgggcaagtcggaccattaacaactatttaaat

SEQ ID NO: 276 - protein, 11 aa, Artificial Sequence
  Description of Artificial Sequence: Synthetic peptide
RASRTINNYLN

SEQ ID NO: 277 - DNA, 33 bp, Artificial Sequence; identical to SEQ ID NO: 109
  Description of Artificial Sequence: Synthetic oligonucleotide

SEQ ID NO: 278 - protein, 11 aa, Artificial Sequence
  Description of Artificial Sequence: Synthetic peptide
RASQGIRNDLG

SEQ ID NO: 279 - DNA, 33 bp, Artificial Sequence
  Description of Artificial Sequence: Synthetic oligonucleotide
cgggcgagtcagggcattagctattatttagcc

SEQ ID NO: 280 - protein, 11 aa, Artificial Sequence
  Description of Artificial Sequence: Synthetic peptide
RASQGISYYLA

SEQ ID NO: 281 - DNA, 33 bp, Artificial Sequence
  Description of Artificial Sequence: Synthetic oligonucleotide
cgggcaagtcagggcattagaactgatttaggc

SEQ ID NO: 282 - protein, 11 aa, Artificial Sequence
  Description of Artificial Sequence: Synthetic peptide
RASQGIRTDLG

SEQ ID NO: 283 - DNA, 33 bp, Artificial Sequence
  Description of Artificial Sequence: Synthetic oligonucleotide
cgggcgagtcaggacattagcaattatttagcc

SEQ ID NO: 284 - protein, 11 aa, Artificial Sequence
  Description of Artificial Sequence: Synthetic peptide
RASQDISNYLA

SEQ ID NO: 285 - DNA, 33 bp, Artificial Sequence; identical to SEQ ID NO: 109
  Description of Artificial Sequence: Synthetic oligonucleotide

SEQ ID NO: 286 - protein, 11 aa, Artificial Sequence
  Description of Artificial Sequence: Synthetic peptide
RASQGIRNDLG

SEQ ID NO: 287 - DNA, 48 bp, Artificial Sequence
  Description of Artificial Sequence: Synthetic oligonucleotide
aggtctagtcagagcctcctgcatagtaatgggaacaactctttggat

SEQ ID NO: 288 - protein, 16 aa, Artificial Sequence
  Description of Artificial Sequence: Synthetic peptide
RSSQSLLHSNGNNSLD

SEQ ID NO: 289 - DNA, 33 bp, Artificial Sequence
  Description of Artificial Sequence: Synthetic oligonucleotide
cgggcaagtcagagcattagtagttatttaaat

SEQ ID NO: 290 - protein, 11 aa, Artificial Sequence
  Description of Artificial Sequence: Synthetic peptide
RASQSISSYLN

SEQ ID NO: 291 - DNA, 33 bp, Artificial Sequence; identical to SEQ ID NO: 289
  Description of Artificial Sequence: Synthetic oligonucleotide

SEQ ID NO: 292 - protein, 11 aa, Artificial Sequence
  Description of Artificial Sequence: Synthetic peptide
RASQSISSYLN

SEQ ID NO: 293 - DNA, 33 bp, Artificial Sequence
  Description of Artificial Sequence: Synthetic oligonucleotide
cgggcgagtcagggcattaacaattatttagcc

SEQ ID NO: 294 - protein, 11 aa, Artificial Sequence
  Description of Artificial Sequence: Synthetic peptide
RASQGINNYLA

SEQ ID NO: 295 - DNA, 33 bp, Artificial Sequence; identical to SEQ ID NO: 171
  Description of Artificial Sequence: Synthetic oligonucleotide

SEQ ID NO: 296 - protein, 11 aa, Artificial Sequence
  Description of Artificial Sequence: Synthetic peptide
RASQGISSWLA

SEQ ID NO: 297 - DNA, 33 bp, Artificial Sequence
  Description of Artificial Sequence: Synthetic oligonucleotide
cgggcaagtcagaacattaacaattatttaaat

SEQ ID NO: 298 - protein, 11 aa, Artificial Sequence
  Description of Artificial Sequence: Synthetic peptide
RASQNINNYLN

SEQ ID NO: 299 - DNA, 33 bp, Artificial Sequence; identical to SEQ ID NO: 109
  Description of Artificial Sequence: Synthetic oligonucleotide

SEQ ID NO: 300 - protein, 11 aa, Artificial Sequence
  Description of Artificial Sequence: Synthetic peptide
RASQGIRNDLG

SEQ ID NO: 301 - DNA, 33 bp, Artificial Sequence
  Description of Artificial Sequence: Synthetic oligonucleotide
agggccagtcagagtgttagcagcaacttagcc

SEQ ID NO: 302 - protein, 11 aa, Artificial Sequence
  Description of Artificial Sequence: Synthetic peptide
RASQSVSSNLA

SEQ ID NO: 303 - DNA, 33 bp, Artificial Sequence
  Description of Artificial Sequence: Synthetic oligonucleotide
cgggcaagtcagaatattaacaactatttaaat

SEQ ID NO: 304 - protein, 11 aa, Artificial Sequence
  Description of Artificial Sequence: Synthetic peptide
RASQNINNYLN

SEQ ID NO: 305 - DNA, 33 bp, Artificial Sequence
  Description of Artificial Sequence: Synthetic oligonucleotide
cgggcaagtcagagcattatcagctatttaaat

SEQ ID NO: 306 - protein, 11 aa, Artificial Sequence
  Description of Artificial Sequence: Synthetic peptide
RASQSIISYLN

SEQ ID NO: 307 - DNA, 33 bp, Artificial Sequence; identical to SEQ ID NO: 109
  Description of Artificial Sequence: Synthetic oligonucleotide

SEQ ID NO: 308 - protein, 11 aa, Artificial Sequence
  Description of Artificial Sequence: Synthetic peptide
RASQGIRNDLG

SEQ ID NO: 309 - DNA, 33 bp, Artificial Sequence; identical to SEQ ID NO: 205
  Description of Artificial Sequence: Synthetic oligonucleotide

SEQ ID NO: 310 - protein, 11 aa, Artificial Sequence
  Description of Artificial Sequence: Synthetic peptide
RASQDIRNDLG

SEQ ID NO: 311 - DNA, 33 bp, Artificial Sequence; identical to SEQ ID NO: 109
  Description of Artificial Sequence: Synthetic oligonucleotide

SEQ ID NO: 312 - protein, 11 aa, Artificial Sequence
  Description of Artificial Sequence: Synthetic peptide
RASQGIRNDLG

SEQ ID NO: 313 - DNA, 33 bp, Artificial Sequence
  Description of Artificial Sequence: Synthetic oligonucleotide
cggacgagtcagggcattaacaattatttagtc

SEQ ID NO: 314 - protein, 11 aa, Artificial Sequence
  Description of Artificial Sequence: Synthetic peptide
RTSQGINNYLV

SEQ ID NO: 315 - DNA, 33 bp, Artificial Sequence
  Description of Artificial Sequence: Synthetic oligonucleotide
cgggcgagtcagggcattaataattatttagtc

SEQ ID NO: 316 - protein, 11 aa, Artificial Sequence
  Description of Artificial Sequence: Synthetic peptide
RASQGINNYLV

SEQ ID NO: 317 - DNA, 33 bp, Artificial Sequence; identical to SEQ ID NO: 109
  Description of Artificial Sequence: Synthetic oligonucleotide

SEQ ID NO: 318 - protein, 11 aa, Artificial Sequence
  Description of Artificial Sequence: Synthetic peptide
RASQGIRNDLG

SEQ ID NO: 319 - DNA, 33 bp, Artificial Sequence
  Description of Artificial Sequence: Synthetic oligonucleotide
cgggcaagtcagagcattactggttattcaaat

SEQ ID NO: 320 - protein, 11 aa, Artificial Sequence
  Description of Artificial Sequence: Synthetic peptide
RASQSITGYSN

SEQ ID NO: 321 - DNA, 33 bp, Artificial Sequence; identical to SEQ ID NO: 109
  Description of Artificial Sequence: Synthetic oligonucleotide

SEQ ID NO: 322 - protein, 11 aa, Artificial Sequence
  Description of Artificial Sequence: Synthetic peptide
RASQGIRNDLG

SEQ ID NO: 323 - DNA, 33 bp, Artificial Sequence
  Description of Artificial Sequence: Synthetic oligonucleotide
cgggcaagtcagagcattagtaattatttaaat

SEQ ID NO: 324 - protein, 11 aa, Artificial Sequence
  Description of Artificial Sequence: Synthetic peptide
RASQSISNYLN

SEQ ID NO: 325 - DNA, 33 bp, Artificial Sequence; identical to SEQ ID NO: 137
  Description of Artificial Sequence: Synthetic oligonucleotide

SEQ ID NO: 326 - protein, 11 aa, Artificial Sequence
  Description of Artificial Sequence: Synthetic peptide
RASQNISSYLN

SEQ ID NO: 327 - DNA, 33 bp, Artificial Sequence
  Description of Artificial Sequence: Synthetic oligonucleotide
cgggcaagtcagagcattttcagctatttaaat

SEQ ID NO: 328 - protein, 11 aa, Artificial Sequence
  Description of Artificial Sequence: Synthetic peptide
RASQSIFSYLN

SEQ ID NO: 329 - DNA, 33 bp, Artificial Sequence
  Description of Artificial Sequence: Synthetic oligonucleotide
cgggcaagtcagagcattagcaggtatttaaat

SEQ ID NO: 330 - protein, 11 aa, Artificial Sequence
  Description of Artificial Sequence: Synthetic peptide
RASQSISRYLN

SEQ ID NO: 331 - DNA, 33 bp, Artificial Sequence; identical to SEQ ID NO: 301
  Description of Artificial Sequence: Synthetic oligonucleotide

SEQ ID NO: 332 - protein, 11 aa, Artificial Sequence
  Description of Artificial Sequence: Synthetic peptide
RASQSVSSNLA

SEQ ID NO: 333 - DNA, 33 bp, Artificial Sequence
  Description of Artificial Sequence: Synthetic oligonucleotide
cgggcaagtcaccatattagcaactatttaaat

SEQ ID NO: 334 - protein, 11 aa, Artificial Sequence
  Description of Artificial Sequence: Synthetic peptide
RASHHISNYLN

SEQ ID NO: 335 - DNA, 33 bp, Artificial Sequence; identical to SEQ ID NO: 109
  Description of Artificial Sequence: Synthetic oligonucleotide

SEQ ID NO: 336 - protein, 11 aa, Artificial Sequence
  Description of Artificial Sequence: Synthetic peptide
RASQGIRNDLG

SEQ ID NO: 337 - DNA, 33 bp, Artificial Sequence; identical to SEQ ID NO: 109
  Description of Artificial Sequence: Synthetic oligonucleotide

SEQ ID NO: 338 - protein, 11 aa, Artificial Sequence
  Description of Artificial Sequence: Synthetic peptide
RASQGIRNDLG

SEQ ID NO: 339 - DNA, 33 bp, Artificial Sequence
  Description of Artificial Sequence: Synthetic oligonucleotide
cgggcgagtcaaggcattagcaaatatttagcc

SEQ ID NO: 340 - protein, 11 aa, Artificial Sequence
  Description of Artificial Sequence: Synthetic peptide
RASQGISKYLA

SEQ ID NO: 341 - DNA, 33 bp, Artificial Sequence
  Description of Artificial Sequence: Synthetic oligonucleotide
cgggcaagtcaggacattagaaataatttaggc

SEQ ID NO: 342 - protein, 11 aa, Artificial Sequence
  Description of Artificial Sequence: Synthetic peptide
RASQDIRNNLG

SEQ ID NO: 343 - DNA, 33 bp, Artificial Sequence; identical to SEQ ID NO: 109
  Description of Artificial Sequence: Synthetic oligonucleotide

SEQ ID NO: 344 - protein, 11 aa, Artificial Sequence
  Description of Artificial Sequence: Synthetic peptide
RASQGIRNDLG

SEQ ID NO: 345 - DNA, 33 bp, Artificial Sequence; identical to SEQ ID NO: 283
  Description of Artificial Sequence: Synthetic oligonucleotide

SEQ ID NO: 346 - protein, 11 aa, Artificial Sequence
  Description of Artificial Sequence: Synthetic peptide
RASQDISNYLA

SEQ ID NO: 347 - DNA, 33 bp, Artificial Sequence
  Description of Artificial Sequence: Synthetic oligonucleotide
cgggcgagtcagggcattggcatttatttagcc

SEQ ID NO: 348 - protein, 11 aa, Artificial Sequence
  Description of Artificial Sequence: Synthetic peptide
RASQGIGIYLA

SEQ ID NO: 349 - DNA, 51 bp, Artificial Sequence
  Description of Artificial Sequence: Synthetic oligonucleotide
aagtccagccagagtgttttatacacctccaacaataacaactacttaact

SEQ ID NO: 350 - protein, 17 aa, Artificial Sequence
  Description of Artificial Sequence: Synthetic peptide
KSSQSVLYTSNNNNYLT

SEQ ID NO: 351 - DNA, 33 bp, Artificial Sequence; identical to SEQ ID NO: 109
  Description of Artificial Sequence: Synthetic oligonucleotide

SEQ ID NO: 352 - protein, 11 aa, Artificial Sequence
  Description of Artificial Sequence: Synthetic peptide
RASQGIRNDLG

SEQ ID NO: 353 - DNA, 33 bp, Artificial Sequence; identical to SEQ ID NO: 109
  Description of Artificial Sequence: Synthetic oligonucleotide

SEQ ID NO: 354 - protein, 11 aa, Artificial Sequence
  Description of Artificial Sequence: Synthetic peptide
RASQGIRNDLG

SEQ ID NO: 355 - DNA, 33 bp, Artificial Sequence; identical to SEQ ID NO: 105
  Description of Artificial Sequence: Synthetic oligonucleotide

SEQ ID NO: 356 - protein, 11 aa, Artificial Sequence
  Description of Artificial Sequence: Synthetic peptide
RASQGISNYLA

SEQ ID NO: 357 - DNA, 33 bp, Artificial Sequence; identical to SEQ ID NO: 109
  Description of Artificial Sequence: Synthetic oligonucleotide

SEQ ID NO: 358 - protein, 11 aa, Artificial Sequence
  Description of Artificial Sequence: Synthetic peptide
RASQGIRNDLG

SEQ ID NO: 359 - DNA, 33 bp, Artificial Sequence; identical to SEQ ID NO: 109
  Description of Artificial Sequence: Synthetic oligonucleotide

SEQ ID NO: 360 - protein, 11 aa, Artificial Sequence
  Description of Artificial Sequence: Synthetic peptide
RASQGIRNDLG

SEQ ID NO: 361 - DNA, 33 bp, Artificial Sequence
  Description of Artificial Sequence: Synthetic oligonucleotide
cgggcaagtcagaacattatcagctatttaaat

SEQ ID NO: 362 - protein, 11 aa, Artificial Sequence
  Description of Artificial Sequence: Synthetic peptide
RASQNIISYLN

SEQ ID NO: 363 - DNA, 33 bp, Artificial Sequence; identical to SEQ ID NO: 109
  Description of Artificial Sequence: Synthetic oligonucleotide

SEQ ID NO: 364 - protein, 11 aa, Artificial Sequence
  Description of Artificial Sequence: Synthetic peptide
RASQGIRNDLG

SEQ ID NO: 365 - DNA, 33 bp, Artificial Sequence; identical to SEQ ID NO: 105
  Description of Artificial Sequence: Synthetic oligonucleotide

SEQ ID NO: 366 - protein, 11 aa, Artificial Sequence
  Description of Artificial Sequence: Synthetic peptide
RASQGISNYLA

SEQ ID NO: 367 - DNA, 33 bp, Artificial Sequence; identical to SEQ ID NO: 301
  Description of Artificial Sequence: Synthetic oligonucleotide

SEQ ID NO: 368 - protein, 11 aa, Artificial Sequence
  Description of Artificial Sequence: Synthetic peptide
RASQSVSSNLA

SEQ ID NO: 369 - DNA, 33 bp, Artificial Sequence; identical to SEQ ID NO: 329
  Description of Artificial Sequence: Synthetic oligonucleotide

SEQ ID NO: 370 - protein, 11 aa, Artificial Sequence
  Description of Artificial Sequence: Synthetic peptide
RASQSISRYLN

SEQ ID NO: 371 - DNA, 33 bp, Artificial Sequence
  Description of Artificial Sequence: Synthetic oligonucleotide
cgggcaagtcagggcattagaaatgatttagac

SEQ ID NO: 372 - protein, 11 aa, Artificial Sequence
  Description of Artificial Sequence: Synthetic peptide
RASQGIRNDLD

SEQ ID NO: 373 - DNA, 33 bp, Artificial Sequence
  Description of Artificial Sequence: Synthetic oligonucleotide
cgggcaagtcagaacattggtagttatttaaat

SEQ ID NO: 374 - protein, 11 aa, Artificial Sequence
  Description of Artificial Sequence: Synthetic peptide
RASQNIGSYLN

SEQ ID NO: 375 - DNA, 48 bp, Artificial Sequence
  Description of Artificial Sequence: Synthetic oligonucleotide
aagtctagtcagagcctcctgcatagtggtggaaagacctatttatat

SEQ ID NO: 376 - protein, 16 aa, Artificial Sequence
  Description of Artificial Sequence: Synthetic peptide
KSSQSLLHSGGKTYLY

SEQ ID NO: 377 - DNA, 33 bp, Artificial Sequence; identical to SEQ ID NO: 247
  Description of Artificial Sequence: Synthetic oligonucleotide

SEQ ID NO: 378 - protein, 11 aa, Artificial Sequence
  Description of Artificial Sequence: Synthetic peptide
RASQNISSYLN

SEQ ID NO: 379 - DNA, 33 bp, Artificial Sequence
  Description of Artificial Sequence: Synthetic oligonucleotide
cggacaagtcagaacagtaacagttatttaaat

SEQ ID NO: 380 - protein, 11 aa, Artificial Sequence
  Description of Artificial Sequence: Synthetic peptide
RTSQNSNSYLN

SEQ ID NO: 381 - DNA, 33 bp, Artificial Sequence
  Description of Artificial Sequence: Synthetic oligonucleotide
cgggcaagtcagggcatcagaaatgatttaggc

SEQ ID NO: 382 - protein, 11 aa, Artificial Sequence
  Description of Artificial Sequence: Synthetic peptide
RASQGIRNDLG

SEQ ID NO: 383 - DNA, 33 bp, Artificial Sequence; identical to SEQ ID NO: 205
  Description of Artificial Sequence: Synthetic oligonucleotide

SEQ ID NO: 384 - protein, 11 aa, Artificial Sequence
  Description of Artificial Sequence: Synthetic peptide
RASQDIRNDLG

SEQ ID NO: 385 - DNA, 33 bp, Artificial Sequence; identical to SEQ ID NO: 109
  Description of Artificial Sequence: Synthetic oligonucleotide

SEQ ID NO: 386 - protein, 11 aa, Artificial Sequence
  Description of Artificial Sequence: Synthetic peptide
RASQGIRNDLG

SEQ ID NO: 387 - DNA, 33 bp, Artificial Sequence; identical to SEQ ID NO: 105
  Description of Artificial Sequence: Synthetic oligonucleotide

SEQ ID NO: 388 - protein, 11 aa, Artificial Sequence
  Description of Artificial Sequence: Synthetic peptide
RASQGISNYLA

SEQ ID NO: 389 - DNA, 33 bp, Artificial Sequence
  Description of Artificial Sequence: Synthetic oligonucleotide
cgggcaagtcagaccattagcagccatttaaat

SEQ ID NO: 390 - protein, 11 aa, Artificial Sequence
  Description of Artificial Sequence: Synthetic peptide
RASQTISSHLN

SEQ ID NO: 391 - DNA, 33 bp, Artificial Sequence; identical to SEQ ID NO: 109
  Description of Artificial Sequence: Synthetic oligonucleotide

SEQ ID NO: 392 - protein, 11 aa, Artificial Sequence
  Description of Artificial Sequence: Synthetic peptide
RASQGIRNDLG

SEQ ID NO: 393 - DNA, 33 bp, Artificial Sequence; identical to SEQ ID NO: 93
  Description of Artificial Sequence: Synthetic oligonucleotide

SEQ ID NO: 394 - protein, 11 aa, Artificial Sequence
  Description of Artificial Sequence: Synthetic peptide
RTSQGIRNDLG

SEQ ID NO: 395 - DNA, 33 bp, Artificial Sequence
  Description of Artificial Sequence: Synthetic oligonucleotide
cgggcaagtcaggtcattagagatgatttaggc

SEQ ID NO: 396 - protein, 11 aa, Artificial Sequence
  Description of Artificial Sequence: Synthetic peptide
RASQVIRDDLG

SEQ ID NO: 397 - DNA, 33 bp, Artificial Sequence; identical to SEQ ID NO: 93
  Description of Artificial Sequence: Synthetic oligonucleotide

SEQ ID NO: 398 - protein, 11 aa, Artificial Sequence
  Description of Artificial Sequence: Synthetic peptide
RTSQGIRNDLG

SEQ ID NO: 399 - DNA, 33 bp, Artificial Sequence; identical to SEQ ID NO: 105
  Description of Artificial Sequence: Synthetic oligonucleotide

SEQ ID NO: 400 - protein, 11 aa, Artificial Sequence
  Description of Artificial Sequence: Synthetic peptide
RASQGISNYLA

SEQ ID NO: 401 - DNA, 33 bp, Artificial Sequence
  Description of Artificial Sequence: Synthetic oligonucleotide
cgggcgagtcagggcattagaaattatttagcc

SEQ ID NO: 402 - protein, 11 aa, Artificial Sequence
  Description of Artificial Sequence: Synthetic peptide
RASQGIRNYLA

SEQ ID NO: 403 - DNA, 33 bp, Artificial Sequence; identical to SEQ ID NO: 109
  Description of Artificial Sequence: Synthetic oligonucleotide

SEQ ID NO: 404 - protein, 11 aa, Artificial Sequence
  Description of Artificial Sequence: Synthetic peptide
RASQGIRNDLG

SEQ ID NO: 405 - DNA, 33 bp, Artificial Sequence; identical to SEQ ID NO: 205
  Description of Artificial Sequence: Synthetic oligonucleotide

SEQ ID NO: 406 - protein, 11 aa, Artificial Sequence
  Description of Artificial Sequence: Synthetic peptide
RASQDIRNDLG

SEQ ID NO: 407 - DNA, 33 bp, Artificial Sequence; identical to SEQ ID NO: 105
  Description of Artificial Sequence: Synthetic oligonucleotide

SEQ ID NO: 408 - protein, 11 aa, Artificial Sequence
  Description of Artificial Sequence: Synthetic peptide
RASQGISNYLA

SEQ ID NO: 409 - DNA, 33 bp, Artificial Sequence
  Description of Artificial Sequence: Synthetic oligonucleotide
cgggcaagtcagggcattaaaaataatttaggc

SEQ ID NO: 410 - protein, 11 aa, Artificial Sequence
  Description of Artificial Sequence: Synthetic peptide
RASQGIKNNLG

SEQ ID NO: 411 - DNA, 33 bp, Artificial Sequence
  Description of Artificial Sequence: Synthetic oligonucleotide
cgggcaagtcagagtattagtagttatttaaat

SEQ ID NO: 412 - protein, 11 aa, Artificial Sequence
  Description of Artificial Sequence: Synthetic peptide
RASQSISSYLN

SEQ ID NO: 413 - DNA, 33 bp, Artificial Sequence; identical to SEQ ID NO: 109
  Description of Artificial Sequence: Synthetic oligonucleotide

SEQ ID NO: 414 - protein, 11 aa, Artificial Sequence
  Description of Artificial Sequence: Synthetic peptide
RASQGIRNDLG

SEQ ID NO: 415 - DNA, 33 bp, Artificial Sequence; identical to SEQ ID NO: 283
  Description of Artificial Sequence: Synthetic oligonucleotide

SEQ ID NO: 416 - protein, 11 aa, Artificial Sequence
  Description of Artificial Sequence: Synthetic peptide
RASQDISNYLA

SEQ ID NO: 417 - DNA, 33 bp, Artificial Sequence; identical to SEQ ID NO: 109
  Description of Artificial Sequence: Synthetic oligonucleotide

SEQ ID NO: 418 - protein, 11 aa, Artificial Sequence
  Description of Artificial Sequence: Synthetic peptide
RASQGIRNDLG

SEQ ID NO: 419 - DNA, 48 bp, Artificial Sequence
  Description of Artificial Sequence: Synthetic oligonucleotide
aagtctagtcagagcctcctgcatagtgatggaaagacctttttgtat

SEQ ID NO: 420 - protein, 16 aa, Artificial Sequence
  Description of Artificial Sequence: Synthetic peptide
KSSQSLLHSDGKTFLY

SEQ ID NO: 421 - DNA, 36 bp, Artificial Sequence
  Description of Artificial Sequence: Synthetic oligonucleotide
agggccagtcagaatgtttacagcagctacttagcc

SEQ ID NO: 422 - protein, 12 aa, Artificial Sequence
  Description of Artificial Sequence: Synthetic peptide
RASQNVYSSYLA

SEQ ID NO: 423 - DNA, 33 bp, Artificial Sequence; identical to SEQ ID NO: 371
  Description of Artificial Sequence: Synthetic oligonucleotide

SEQ ID NO: 424 - protein, 11 aa, Artificial Sequence
  Description of Artificial Sequence: Synthetic peptide
RASQGIRNDLD

SEQ ID NO: 425 - DNA, 33 bp, Artificial Sequence
  Description of Artificial Sequence: Synthetic oligonucleotide
caggcgagtcaggacattaacaactatttaaat

SEQ ID NO: 426 - protein, 11 aa, Artificial Sequence
  Description of Artificial Sequence: Synthetic peptide
QASQDINNYLN

SEQ ID NO: 427 - DNA, 33 bp, Artificial Sequence; identical to SEQ ID NO: 109
  Description of Artificial Sequence: Synthetic oligonucleotide

SEQ ID NO: 428 - protein, 11 aa, Artificial Sequence
  Description of Artificial Sequence: Synthetic peptide
RASQGIRNDLG

SEQ ID NO: 429 - DNA, 33 bp, Artificial Sequence
  Description of Artificial Sequence: Synthetic oligonucleotide
cgggcaagtcagggcattggaaatgatttaggc

SEQ ID NO: 430 - protein, 11 aa, Artificial Sequence
  Description of Artificial Sequence: Synthetic peptide
RASQGIGNDLG

SEQ ID NO: 431 - DNA, 33 bp, Artificial Sequence
  Description of Artificial Sequence: Synthetic oligonucleotide
cgggcaagtcagagcattagcgactatttaaat

SEQ ID NO: 432 - protein, 11 aa, Artificial Sequence
  Description of Artificial Sequence: Synthetic peptide
RASQSISDYLN

SEQ ID NO: 433 - DNA, 33 bp, Artificial Sequence; identical to SEQ ID NO: 205
  Description of Artificial Sequence: Synthetic oligonucleotide

SEQ ID NO: 434 - protein, 11 aa, Artificial Sequence
  Description of Artificial Sequence: Synthetic peptide
RASQDIRNDLG

SEQ ID NO: 435 - DNA, 33 bp, Artificial Sequence; identical to SEQ ID NO: 137
  Description of Artificial Sequence: Synthetic oligonucleotide

SEQ ID NO: 436 - protein, 11 aa, Artificial Sequence
  Description of Artificial Sequence: Synthetic peptide
RASQNISSYLN

SEQ ID NO: 437 - DNA, 33 bp, Artificial Sequence; identical to SEQ ID NO: 109
  Description of Artificial Sequence: Synthetic oligonucleotide

SEQ ID NO: 438 - protein, 11 aa, Artificial Sequence
  Description of Artificial Sequence: Synthetic peptide
RASQGIRNDLG

SEQ ID NO: 439 - DNA, 33 bp, Artificial Sequence; identical to SEQ ID NO: 109
  Description of Artificial Sequence: Synthetic oligonucleotide

SEQ ID NO: 440 - protein, 11 aa, Artificial Sequence
  Description of Artificial Sequence: Synthetic peptide
RASQGIRNDLG

SEQ ID NO: 441 - DNA, 33 bp, Artificial Sequence; identical to SEQ ID NO: 109
  Description of Artificial Sequence: Synthetic oligonucleotide

SEQ ID NO: 442 - protein, 11 aa, Artificial Sequence
  Description of Artificial Sequence: Synthetic peptide
RASQGIRNDLG

SEQ ID NO: 443 - DNA, 51 bp, Artificial Sequence
  Description of Artificial Sequence: Synthetic oligonucleotide
aagtccagccagagtgttttatacagctccaacaataacaattatttagct

SEQ ID NO: 444 - protein, 17 aa, Artificial Sequence
  Description of Artificial Sequence: Synthetic peptide
KSSQSVLYSSNNNNYLA

SEQ ID NO: 445 - DNA, 48 bp, Artificial Sequence
  Description of Artificial Sequence: Synthetic oligonucleotide
aagtctagtcagagcctcctacatagtgaaggaaagacctatttgtat

SEQ ID NO: 446 - protein, 16 aa, Artificial Sequence
  Description of Artificial Sequence: Synthetic peptide
KSSQSLLHSEGKTYLY

SEQ ID NO: 447 - DNA, 33 bp, Artificial Sequence; identical to SEQ ID NO: 105
  Description of Artificial Sequence: Synthetic oligonucleotide

SEQ ID NO: 448 - protein, 11 aa, Artificial Sequence
  Description of Artificial Sequence: Synthetic peptide
RASQGISNYLA

SEQ ID NO: 449 - DNA, 33 bp, Artificial Sequence; identical to SEQ ID NO: 283
  Description of Artificial Sequence: Synthetic oligonucleotide

SEQ ID NO: 450 - protein, 11 aa, Artificial Sequence
  Description of Artificial Sequence: Synthetic peptide
RASQDISNYLA

SEQ ID NO: 451 - DNA, 33 bp, Artificial Sequence; identical to SEQ ID NO: 109
  Description of Artificial Sequence: Synthetic oligonucleotide

SEQ ID NO: 452 - protein, 11 aa, Artificial Sequence
  Description of Artificial Sequence: Synthetic peptide
RASQGIRNDLG

SEQ ID NO: 453 - DNA, 33 bp, Artificial Sequence
  Description of Artificial Sequence: Synthetic oligonucleotide
cgggcaagtcagggcgttagaaatgatttaggc

SEQ ID NO: 454 - protein, 11 aa, Artificial Sequence
  Description of Artificial Sequence: Synthetic peptide
RASQGVRNDLG

SEQ ID NO: 455 - DNA, 36 bp, Artificial Sequence
  Description of Artificial Sequence: Synthetic oligonucleotide
agggccagtcagagttttagcagcagctacttagcc

SEQ ID NO: 456 - protein, 12 aa, Artificial Sequence
  Description of Artificial Sequence: Synthetic peptide
RASQSFSSSYLA

SEQ ID NO: 457 - DNA, 33 bp, Artificial Sequence; identical to SEQ ID NO: 109
  Description of Artificial Sequence: Synthetic oligonucleotide

SEQ ID NO: 458 - protein, 11 aa, Artificial Sequence
  Description of Artificial Sequence: Synthetic peptide
RASQGIRNDLG

SEQ ID NO: 459 - DNA, 33 bp, Artificial Sequence
  Description of Artificial Sequence: Synthetic oligonucleotide
cgggcaagtcagaacatttttagttatttaaat

SEQ ID NO: 460 - protein, 11 aa, Artificial Sequence
  Description of Artificial Sequence: Synthetic peptide
RASQNIFSYLN

SEQ ID NO: 461 - DNA, 33 bp, Artificial Sequence; identical to SEQ ID NO: 109
  Description of Artificial Sequence: Synthetic oligonucleotide

SEQ ID NO: 462 - protein, 11 aa, Artificial Sequence
  Description of Artificial Sequence: Synthetic peptide
RASQGIRNDLG

SEQ ID NO: 463 - DNA, 33 bp, Artificial Sequence; identical to SEQ ID NO: 109
  Description of Artificial Sequence: Synthetic oligonucleotide

SEQ ID NO: 464 - protein, 11 aa, Artificial Sequence
  Description of Artificial Sequence: Synthetic peptide
RASQGIRNDLG

SEQ ID NO: 465 - DNA, 33 bp, Artificial Sequence; identical to SEQ ID NO: 109
  Description of Artificial Sequence: Synthetic oligonucleotide

SEQ ID NO: 466 - protein, 11 aa, Artificial Sequence
  Description of Artificial Sequence: Synthetic peptide
RASQGIRNDLG

SEQ ID NO: 467 - DNA, 33 bp, Artificial Sequence; identical to SEQ ID NO: 93
  Description of Artificial Sequence: Synthetic oligonucleotide

SEQ ID NO: 468 - protein, 11 aa, Artificial Sequence
  Description of Artificial Sequence: Synthetic peptide
RTSQGIRNDLG

SEQ ID NO: 469 - DNA, 33 bp, Artificial Sequence; identical to SEQ ID NO: 171
  Description of Artificial Sequence: Synthetic oligonucleotide

SEQ ID NO: 470 - protein, 11 aa, Artificial Sequence
  Description of Artificial Sequence: Synthetic peptide
RASQGISSWLA

SEQ ID NO: 471 - DNA, 33 bp, Artificial Sequence; identical to SEQ ID NO: 109
  Description of Artificial Sequence: Synthetic oligonucleotide

SEQ ID NO: 472 - protein, 11 aa, Artificial Sequence
  Description of Artificial Sequence: Synthetic peptide
RASQGIRNDLG

SEQ ID NO: 473 - DNA, 33 bp, Artificial Sequence; identical to SEQ ID NO: 109
  Description of Artificial Sequence: Synthetic oligonucleotide

SEQ ID NO: 474 - protein, 11 aa, Artificial Sequence
  Description of Artificial Sequence: Synthetic peptide
RASQGIRNDLG

SEQ ID NO: 475 - DNA, 33 bp, Artificial Sequence
  Description of Artificial Sequence: Synthetic oligonucleotide
cgggcaactcagaacattttcagctatttaaat

SEQ ID NO: 476 - protein, 11 aa, Artificial Sequence
  Description of Artificial Sequence: Synthetic peptide
RATQNIFSYLN

SEQ ID NO: 477 - DNA, 48 bp, Artificial Sequence
  Description of Artificial Sequence: Synthetic oligonucleotide
aggtctagtcagagcctcctccatagtgatggaaggacctatttgtat

SEQ ID NO: 478 - protein, 16 aa, Artificial Sequence
  Description of Artificial Sequence: Synthetic peptide
RSSQSLLHSDGRTYLY

SEQ ID NO: 479 - DNA, 51 bp, Artificial Sequence
  Description of Artificial Sequence: Synthetic oligonucleotide
aagtccagccagagtgttttatacagctcccacaataacaactacttagct

SEQ ID NO: 480 - protein, 17 aa, Artificial Sequence
  Description of Artificial Sequence: Synthetic peptide
KSSQSVLYSSHNNNYLA

SEQ ID NO: 481 - DNA, 48 bp, Artificial Sequence
  Description of Artificial Sequence: Synthetic oligonucleotide
aagtctagtcagagcctcctgcatggtgatggaaagacctatttgttt

SEQ ID NO: 482 - protein, 16 aa, Artificial Sequence
  Description of Artificial Sequence: Synthetic peptide
KSSQSLLHGDGKTYLF

SEQ ID NO: 483 - DNA, 33 bp, Artificial Sequence; identical to SEQ ID NO: 109
  Description of Artificial Sequence: Synthetic oligonucleotide

SEQ ID NO: 484 - protein, 11 aa, Artificial Sequence
  Description of Artificial Sequence: Synthetic peptide
RASQGIRNDLG

SEQ ID NO: 485 - DNA, 48 bp, Artificial Sequence
  Description of Artificial Sequence: Synthetic oligonucleotide
cggtctagtcaaagcctcgtatatagtgatggagacacctacttgaat

SEQ ID NO: 486 - protein, 16 aa, Artificial Sequence
  Description of Artificial Sequence: Synthetic peptide
RSSQSLVYSDGDTYLN

SEQ ID NO: 487 - DNA, 48 bp, Artificial Sequence
  Description of Artificial Sequence: Synthetic oligonucleotide
aagtctagtcagagcctcctgcatagtgatggaaagacctatttgtat

SEQ ID NO: 488 - protein, 16 aa, Artificial Sequence
  Description of Artificial Sequence: Synthetic peptide
KSSQSLLHSDGKTYLY

SEQ ID NO: 489 - DNA, 33 bp, Artificial Sequence; identical to SEQ ID NO: 109
  Description of Artificial Sequence: Synthetic oligonucleotide

SEQ ID NO: 490 - protein, 11 aa, Artificial Sequence
  Description of Artificial Sequence: Synthetic peptide
RASQGIRNDLG

SEQ ID NO: 491 - DNA, 33 bp, Artificial Sequence
  Description of Artificial Sequence: Synthetic oligonucleotide
cgggcaagtcaggacattagagatgatttaggc

SEQ ID NO: 492 - protein, 11 aa, Artificial Sequence
  Description of Artificial Sequence: Synthetic peptide
RASQDIRDDLG

SEQ ID NO: 493 - DNA, 33 bp, Artificial Sequence
  Description of Artificial Sequence: Synthetic oligonucleotide
cgggcaagtcaggacattagaagtgatttaggc

SEQ ID NO: 494 - protein, 11 aa, Artificial Sequence
  Description of Artificial Sequence: Synthetic peptide
RASQDIRSDLG

SEQ ID NO: 495 - DNA, 33 bp, Artificial Sequence; identical to SEQ ID NO: 205
  Description of Artificial Sequence: Synthetic oligonucleotide

SEQ ID NO: 496 - protein, 11 aa, Artificial Sequence
  Description of Artificial Sequence: Synthetic peptide
RASQDIRNDLG

SEQ ID NO: 497 - DNA, 33 bp, Artificial Sequence; identical to SEQ ID NO: 105
  Description of Artificial Sequence: Synthetic oligonucleotide

SEQ ID NO: 498 - protein, 11 aa, Artificial Sequence
  Description of Artificial Sequence: Synthetic peptide
RASQGISNYLA

SEQ ID NO: 499 - DNA, 33 bp, Artificial Sequence; identical to SEQ ID NO: 283
  Description of Artificial Sequence: Synthetic oligonucleotide

SEQ ID NO: 500 - protein, 11 aa, Artificial Sequence
  Description of Artificial Sequence: Synthetic peptide
RASQDISNYLA

SEQ ID NO: 501 - DNA, 33 bp, Artificial Sequence
  Description of Artificial Sequence: Synthetic oligonucleotide
cgggcaagtcagagcattagcagctatttaaat

SEQ ID NO: 502 - protein, 11 aa, Artificial Sequence
  Description of Artificial Sequence: Synthetic peptide
RASQSISSYLN

SEQ ID NO: 503 - DNA, 33 bp, Artificial Sequence
  Description of Artificial Sequence: Synthetic oligonucleotide
cgggcgagtcagggtattagtagttggttagcc

SEQ ID NO: 504 - protein, 11 aa, Artificial Sequence
  Description of Artificial Sequence: Synthetic peptide
RASQGISSWLA

SEQ ID NO: 505 - DNA, 33 bp, Artificial Sequence; identical to SEQ ID NO: 109
  Description of Artificial Sequence: Synthetic oligonucleotide

SEQ ID NO: 506 - protein, 11 aa, Artificial Sequence
  Description of Artificial Sequence: Synthetic peptide
RASQGIRNDLG

SEQ ID NO: 507 - DNA, 51 bp, Artificial Sequence
  Description of Artificial Sequence: Synthetic oligonucleotide
aagtccagccagagtgttttatacagctcccacaataactactacttaact

SEQ ID NO: 508 - protein, 17 aa, Artificial Sequence
  Description of Artificial Sequence: Synthetic peptide
KSSQSVLYSSHNNYYLT

SEQ ID NO: 509 - DNA, 33 bp, Artificial Sequence; identical to SEQ ID NO: 105
  Description of Artificial Sequence: Synthetic oligonucleotide

SEQ ID NO: 510 - protein, 11 aa, Artificial Sequence
  Description of Artificial Sequence: Synthetic peptide
RASQGISNYLA

SEQ ID NO: 511 - DNA, 33 bp, Artificial Sequence; identical to SEQ ID NO: 493
  Description of Artificial Sequence: Synthetic oligonucleotide

SEQ ID NO: 512 - protein, 11 aa, Artificial Sequence
  Description of Artificial Sequence: Synthetic peptide
RASQDIRSDLG

SEQ ID NO: 513 - DNA, 33 bp, Artificial Sequence
  Description of Artificial Sequence: Synthetic oligonucleotide
cgggcgagtcaggccattagcaattatttagcc

SEQ ID NO: 514 - protein, 11 aa, Artificial Sequence
  Description of Artificial Sequence: Synthetic peptide
RASQAISNYLA

SEQ ID NO: 515 - DNA, 33 bp, Artificial Sequence; identical to SEQ ID NO: 109
  Description of Artificial Sequence: Synthetic oligonucleotide

SEQ ID NO: 516 - protein, 11 aa, Artificial Sequence
  Description of Artificial Sequence: Synthetic peptide
RASQGIRNDLG

SEQ ID NO: 517 - DNA, 33 bp, Artificial Sequence; identical to SEQ ID NO: 133
  Description of Artificial Sequence: Synthetic oligonucleotide

SEQ ID NO: 518 - protein, 11 aa, Artificial Sequence
  Description of Artificial Sequence: Synthetic peptide
RASQGIRSDLG

SEQ ID NO: 519 - DNA, 33 bp, Artificial Sequence
  Description of Artificial Sequence: Synthetic oligonucleotide
cgggcaagtcaggccattagaaatgatttaggc

SEQ ID NO: 520 - protein, 11 aa, Artificial Sequence
  Description of Artificial Sequence: Synthetic peptide
RASQAIRNDLG

SEQ ID NO: 521 - DNA, 33 bp, Artificial Sequence; identical to SEQ ID NO: 105
  Description of Artificial Sequence: Synthetic oligonucleotide

SEQ ID NO: 522 - protein, 11 aa, Artificial Sequence
  Description of Artificial Sequence: Synthetic peptide
RASQGISNYLA

SEQ ID NO: 523 - DNA, 33 bp, Artificial Sequence; identical to SEQ ID NO: 109
  Description of Artificial Sequence: Synthetic oligonucleotide

SEQ ID NO: 524 - protein, 11 aa, Artificial Sequence
  Description of Artificial Sequence: Synthetic peptide
RASQGIRNDLG

SEQ ID NO: 525 - DNA, 33 bp, Artificial Sequence; identical to SEQ ID NO: 109
  Description of Artificial Sequence: Synthetic oligonucleotide

SEQ ID NO: 526 - protein, 11 aa, Artificial Sequence
  Description of Artificial Sequence: Synthetic peptide
RASQGIRNDLG

SEQ ID NO: 527 - DNA, 33 bp, Artificial Sequence; identical to SEQ ID NO: 493
  Description of Artificial Sequence: Synthetic oligonucleotide

SEQ ID NO: 528 - protein, 11 aa, Artificial Sequence
  Description of Artificial Sequence: Synthetic peptide
RASQDIRSDLG

SEQ ID NO: 529 - DNA, 33 bp, Artificial Sequence
  Description of Artificial Sequence: Synthetic oligonucleotide
cgggcaagtcagagcattagcaactatttaaat

SEQ ID NO: 530 - protein, 11 aa, Artificial Sequence
  Description of Artificial Sequence: Synthetic peptide
RASQSISNYLN

SEQ ID NO: 531 - DNA, 33 bp, Artificial Sequence; identical to SEQ ID NO: 493
  Description of Artificial Sequence: Synthetic oligonucleotide

SEQ ID NO: 532 - protein, 11 aa, Artificial Sequence
  Description of Artificial Sequence: Synthetic peptide
RASQDIRSDLG

SEQ ID NO: 533 - DNA, 33 bp, Artificial Sequence; identical to SEQ ID NO: 109
  Description of Artificial Sequence: Synthetic oligonucleotide

SEQ ID NO: 534 - protein, 11 aa, Artificial Sequence
  Description of Artificial Sequence: Synthetic peptide
RASQGIRNDLG

SEQ ID NO: 535 - DNA, 33 bp, Artificial Sequence
  Description of Artificial Sequence: Synthetic oligonucleotide
cgggcaagtcggggcattagaaatgatttaggc

SEQ ID NO: 536 - protein, 11 aa, Artificial Sequence
  Description of Artificial Sequence: Synthetic peptide
RASRGIRNDLG

SEQ ID NO: 537 - DNA, 51 bp, Artificial Sequence
  Description of Artificial Sequence: Synthetic oligonucleotide
aagtccagccagagtgttttataccgctccaacaattacaactacttagct

SEQ ID NO: 538 - protein, 17 aa, Artificial Sequence
  Description of Artificial Sequence: Synthetic peptide
KSSQSVLYRSNNYNYLA

SEQ ID NO: 539 - DNA, 48 bp, Artificial Sequence
  Description of Artificial Sequence: Synthetic oligonucleotide
aagtctagtcagaccctcctgcatggtgaaggaaagacctatttgtat

SEQ ID NO: 540 - protein, 16 aa, Artificial Sequence
  Description of Artificial Sequence: Synthetic peptide
KSSQTLLHGEGKTYLY

SEQ ID NO: 541 - DNA, 33 bp, Artificial Sequence
  Description of Artificial Sequence: Synthetic oligonucleotide
cgggcgagtcaggctatcaatgactggttagcc

SEQ ID NO: 542 - protein, 11 aa, Artificial Sequence
  Description of Artificial Sequence: Synthetic peptide
RASQAINDWLA

SEQ ID NO: 543 - DNA, 33 bp, Artificial Sequence; identical to SEQ ID NO: 109
  Description of Artificial Sequence: Synthetic oligonucleotide

SEQ ID NO: 544 - protein, 11 aa, Artificial Sequence
  Description of Artificial Sequence: Synthetic peptide
RASQGIRNDLG

SEQ ID NO: 545 - DNA, 33 bp, Artificial Sequence; identical to SEQ ID NO: 109
  Description of Artificial Sequence: Synthetic oligonucleotide

SEQ ID NO: 546 - protein, 11 aa, Artificial Sequence
  Description of Artificial Sequence: Synthetic peptide
RASQGIRNDLG

SEQ ID NO: 547 - DNA, 33 bp, Artificial Sequence
  Description of Artificial Sequence: Synthetic oligonucleotide
cgggcaagtcagaacatttacagctatttaaat

SEQ ID NO: 548 - protein, 11 aa, Artificial Sequence
  Description of Artificial Sequence: Synthetic peptide
RASQNIYSYLN

SEQ ID NO: 549 - DNA, 33 bp, Artificial Sequence; identical to SEQ ID NO: 493
  Description of Artificial Sequence: Synthetic oligonucleotide

SEQ ID NO: 550 - protein, 11 aa, Artificial Sequence
  Description of Artificial Sequence: Synthetic peptide
RASQDIRSDLG

SEQ ID NO: 551 - DNA, 33 bp, Artificial Sequence; identical to SEQ ID NO: 109
  Description of Artificial Sequence: Synthetic oligonucleotide

SEQ ID NO: 552 - protein, 11 aa, Artificial Sequence
  Description of Artificial Sequence: Synthetic peptide
RASQGIRNDLG

SEQ ID NO: 553 - DNA, 33 bp, Artificial Sequence
  Description of Artificial Sequence: Synthetic oligonucleotide
cgggcgagtcagggtattagcaactggttagcc

SEQ ID NO: 554 - protein, 11 aa, Artificial Sequence
  Description of Artificial Sequence: Synthetic peptide
RASQGISNWLA

SEQ ID NO: 555 - DNA, 48 bp, Artificial Sequence
  Description of Artificial Sequence: Synthetic oligonucleotide
aagtctagtcagagcctcctgcatagtgagggaaagacctatttgtat

SEQ ID NO: 556 - protein, 16 aa, Artificial Sequence
  Description of Artificial Sequence: Synthetic peptide
KSSQSLLHSEGKTYLY

SEQ ID NO: 557 - DNA, 33 bp, Artificial Sequence; identical to SEQ ID NO: 503
  Description of Artificial Sequence: Synthetic oligonucleotide

SEQ ID NO: 558 - protein, 11 aa, Artificial Sequence
  Description of Artificial Sequence: Synthetic peptide
RASQGISSWLA

SEQ ID NO: 559 - DNA, 33 bp, Artificial Sequence; identical to SEQ ID NO: 553
  Description of Artificial Sequence: Synthetic oligonucleotide

SEQ ID NO: 560 - protein, 11 aa, Artificial Sequence
  Description of Artificial Sequence: Synthetic peptide
RASQGISNWLA

SEQ ID NO: 561 - DNA, 33 bp, Artificial Sequence; identical to SEQ ID NO: 109
  Description of Artificial Sequence: Synthetic oligonucleotide

SEQ ID NO: 562 - protein, 11 aa, Artificial Sequence
  Description of Artificial Sequence: Synthetic peptide
RASQGIRNDLG

SEQ ID NO: 563 - DNA, 33 bp, Artificial Sequence
  Description of Artificial Sequence: Synthetic oligonucleotide
caggcgagtcagtacattagcaactatttaaat

SEQ ID NO: 564 - protein, 11 aa, Artificial Sequence
  Description of Artificial Sequence: Synthetic peptide
QASQYISNYLN

SEQ ID NO: 565 - DNA, 33 bp, Artificial Sequence; identical to SEQ ID NO: 109
  Description of Artificial Sequence: Synthetic oligonucleotide

SEQ ID NO: 566 - protein, 11 aa, Artificial Sequence
  Description of Artificial Sequence: Synthetic peptide
RASQGIRNDLG

SEQ ID NO: 567 - DNA, 33 bp, Artificial Sequence
  Description of Artificial Sequence: Synthetic oligonucleotide
cgggcgagtcagggtattaccagctggttaact

SEQ ID NO: 568 - protein, 11 aa, Artificial Sequence
  Description of Artificial Sequence: Synthetic peptide
RASQGITSWLT

SEQ ID NO: 569 - DNA, 33 bp, Artificial Sequence; identical to SEQ ID NO: 109
  Description of Artificial Sequence: Synthetic oligonucleotide

SEQ ID NO: 570 - protein, 11 aa, Artificial Sequence
  Description of Artificial Sequence: Synthetic peptide
RASQGIRNDLG

SEQ ID NO: 571 - DNA, 33 bp, Artificial Sequence
  Description of Artificial Sequence: Synthetic oligonucleotide
cgggcgagtcaggatattttcgactggttagcc

SEQ ID NO: 572 - protein, 11 aa, Artificial Sequence
  Description of Artificial Sequence: Synthetic peptide
RASQDIFDWLA

SEQ ID NO: 573 - DNA, 33 bp, Artificial Sequence; identical to SEQ ID NO: 281
  Description of Artificial Sequence: Synthetic oligonucleotide

SEQ ID NO: 574 - protein, 11 aa, Artificial Sequence
  Description of Artificial Sequence: Synthetic peptide
RASQGIRTDLG

SEQ ID NO: 575 - DNA, 48 bp, Artificial Sequence
  Description of Artificial Sequence: Synthetic oligonucleotide
aagtctagtcagagcctcctgcatggtgatggaaagacctatttgtat

SEQ ID NO: 576 - protein, 16 aa, Artificial Sequence
  Description of Artificial Sequence: Synthetic peptide
KSSQSLLHGDGKTYLY

SEQ ID NO: 577 - DNA, 33 bp, Artificial Sequence; identical to SEQ ID NO: 109
  Description of Artificial Sequence: Synthetic oligonucleotide

SEQ ID NO: 578 - protein, 11 aa, Artificial Sequence
  Description of Artificial Sequence: Synthetic peptide
RASQGIRNDLG

SEQ ID NO: 579 - DNA, 48 bp, Artificial Sequence
  Description of Artificial Sequence: Synthetic oligonucleotide
aagtctagtcagagcctcctacatggtgatggaaagacctatttgtat

SEQ ID NO: 580 - protein, 16 aa, Artificial Sequence
  Description of Artificial Sequence: Synthetic peptide
KSSQSLLHGDGKTYLY

SEQ ID NO: 581 - DNA, 33 bp, Artificial Sequence; identical to SEQ ID NO: 109
  Description of Artificial Sequence: Synthetic oligonucleotide

SEQ ID NO: 582 - protein, 11 aa, Artificial Sequence
  Description of Artificial Sequence: Synthetic peptide
RASQGIRNDLG

SEQ ID NO: 583 - DNA, 33 bp, Artificial Sequence; identical to SEQ ID NO: 491
  Description of Artificial Sequence: Synthetic oligonucleotide

SEQ ID NO: 584 - protein, 11 aa, Artificial Sequence
  Description of Artificial Sequence: Synthetic peptide
RASQDIRDDLG

SEQ ID NO: 585 - DNA, 33 bp, Artificial Sequence
  Description of Artificial Sequence: Synthetic oligonucleotide
cgggcaagtcagaggattagcagctatttaaat

SEQ ID NO: 586 - protein, 11 aa, Artificial Sequence
  Description of Artificial Sequence: Synthetic peptide
RASQRISSYLN

SEQ ID NO: 587 - DNA, 33 bp, Artificial Sequence
  Description of Artificial Sequence: Synthetic oligonucleotide
agggccagtcagagtgttagaagtaatttagcc

SEQ ID NO: 588 - protein, 11 aa, Artificial Sequence
  Description of Artificial Sequence: Synthetic peptide
RASQSVRSNLA

SEQ ID NO: 589 - DNA, 33 bp, Artificial Sequence
  Description of Artificial Sequence: Synthetic oligonucleotide
cgggcaagtcaggccattagagatgatttaggc

SEQ ID NO: 590 - protein, 11 aa, Artificial Sequence
  Description of Artificial Sequence: Synthetic peptide
RASQAIRDDLG

SEQ ID NO: 591 - DNA, 33 bp, Artificial Sequence; identical to SEQ ID NO: 109
  Description of Artificial Sequence: Synthetic oligonucleotide

SEQ ID NO: 592 - protein, 11 aa, Artificial Sequence
  Description of Artificial Sequence: Synthetic peptide
RASQGIRNDLG

SEQ ID NO: 593 - DNA, 33 bp, Artificial Sequence; identical to SEQ ID NO: 301
  Description of Artificial Sequence: Synthetic oligonucleotide

SEQ ID NO: 594 - protein, 11 aa, Artificial Sequence
  Description of Artificial Sequence: Synthetic peptide
RASQSVSSNLA

SEQ ID NO: 595 - DNA, 33 bp, Artificial Sequence; identical to SEQ ID NO: 109
  Description of Artificial Sequence: Synthetic oligonucleotide

SEQ ID NO: 596 - protein, 11 aa, Artificial Sequence
  Description of Artificial Sequence: Synthetic peptide
RASQGIRNDLG

SEQ ID NO: 597 - DNA, 33 bp, Artificial Sequence; identical to SEQ ID NO: 109
  Description of Artificial Sequence: Synthetic oligonucleotide

SEQ ID NO: 598 - protein, 11 aa, Artificial Sequence
  Description of Artificial Sequence: Synthetic peptide
RASQGIRNDLG

SEQ ID NO: 599 - DNA, 33 bp, Artificial Sequence; identical to SEQ ID NO: 491
  Description of Artificial Sequence: Synthetic oligonucleotide

SEQ ID NO: 600 - protein, 11 aa, Artificial Sequence
  Description of Artificial Sequence: Synthetic peptide
RASQDIRDDLG

SEQ ID NO: 601 - DNA, 33 bp, Artificial Sequence; identical to SEQ ID NO: 493
  Description of Artificial Sequence: Synthetic oligonucleotide

SEQ ID NO: 602 - protein, 11 aa, Artificial Sequence
  Description of Artificial Sequence: Synthetic peptide
RASQDIRSDLG

SEQ ID NO: 603 - DNA, 33 bp, Artificial Sequence
  Description of Artificial Sequence: Synthetic oligonucleotide
caggcgagtcaggacatttccaactttttaaat

SEQ ID NO: 604 - protein, 11 aa, Artificial Sequence
  Description of Artificial Sequence: Synthetic peptide
QASQDISNFLN

SEQ ID NO: 605 - DNA, 33 bp, Artificial Sequence
  Description of Artificial Sequence: Synthetic oligonucleotide
cgggcaagtcagagcattagcaggtatttaagt

SEQ ID NO: 606 - protein, 11 aa, Artificial Sequence
  Description of Artificial Sequence: Synthetic peptide
RASQSISRYLS

SEQ ID NO: 607 - DNA, 33 bp, Artificial Sequence; identical to SEQ ID NO: 547
  Description of Artificial Sequence: Synthetic oligonucleotide

SEQ ID NO: 608 - protein, 11 aa, Artificial Sequence
  Description of Artificial Sequence: Synthetic peptide
RASQNIYSYLN

SEQ ID NO: 609 - DNA, 33 bp, Artificial Sequence; identical to SEQ ID NO: 493
  Description of Artificial Sequence: Synthetic oligonucleotide

SEQ ID NO: 610 - protein, 11 aa, Artificial Sequence
  Description of Artificial Sequence: Synthetic peptide
RASQDIRSDLG

SEQ ID NO: 611 - DNA, 33 bp, Artificial Sequence; identical to SEQ ID NO: 493
  Description of Artificial Sequence: Synthetic oligonucleotide

SEQ ID NO: 612 - protein, 11 aa, Artificial Sequence
  Description of Artificial Sequence: Synthetic peptide
RASQDIRSDLG

SEQ ID NO: 613 - DNA, 33 bp, Artificial Sequence; identical to SEQ ID NO: 93
  Description of Artificial Sequence: Synthetic oligonucleotide

SEQ ID NO: 614 - protein, 11 aa, Artificial Sequence
  Description of Artificial Sequence: Synthetic peptide
RTSQGIRNDLG

SEQ ID NO: 615 - DNA, 33 bp, Artificial Sequence
  Description of Artificial Sequence: Synthetic oligonucleotide
cgggcaagtcaggacattagaaatgatgtaggc

SEQ ID NO: 616 - protein, 11 aa, Artificial Sequence
  Description of Artificial Sequence: Synthetic peptide
RASQDIRNDVG

SEQ ID NO: 617 - DNA, 33 bp, Artificial Sequence
  Description of Artificial Sequence: Synthetic oligonucleotide
tgggcgagtcagggcattaacagttatttagcc

SEQ ID NO: 618 - protein, 11 aa, Artificial Sequence
  Description of Artificial Sequence: Synthetic peptide
WASQGINSYLA

SEQ ID NO: 619 - DNA, 33 bp, Artificial Sequence
  Description of Artificial Sequence: Synthetic oligonucleotide
cgggcgagtcagggtattagtaagtggttagcc

SEQ ID NO: 620 - protein, 11 aa, Artificial Sequence
  Description of Artificial Sequence: Synthetic peptide
RASQGISKWLA

SEQ ID NO: 621 - DNA, 33 bp, Artificial Sequence
  Description of Artificial Sequence: Synthetic oligonucleotide
cgggcaagtcagaacattaggaactttttaaat

SEQ ID NO: 622 - protein, 11 aa, Artificial Sequence
  Description of Artificial Sequence: Synthetic peptide
RASQNIRNFLN

SEQ ID NO: 623 - DNA, 33 bp, Artificial Sequence; identical to SEQ ID NO: 95
  Description of Artificial Sequence: Synthetic oligonucleotide

SEQ ID NO: 624 - protein, 11 aa, Artificial Sequence
  Description of Artificial Sequence: Synthetic peptide
RASQGISKWLA

SEQ ID NO: 625 - DNA, 33 bp, Artificial Sequence
  Description of Artificial Sequence: Synthetic oligonucleotide
cgggcgagtcagggtattagcagatggttagcc

SEQ ID NO: 626 - protein, 11 aa, Artificial Sequence
  Description of Artificial Sequence: Synthetic peptide
RASQGISRWLA

SEQ ID NO: 627 - DNA, 51 bp, Artificial Sequence
  Description of Artificial Sequence: Synthetic oligonucleotide
aagtccatccagagtgttttatacagatccaacaataagaactacttaact

SEQ ID NO: 628 - protein, 17 aa, Artificial Sequence
  Description of Artificial Sequence: Synthetic peptide
KSIQSVLYRSNNKNYLT

SEQ ID NO: 629 - DNA, 33 bp, Artificial Sequence
  Description of Artificial Sequence: Synthetic oligonucleotide
cgggcgagtcagggcattagcaattacttagcc

SEQ ID NO: 630 - protein, 11 aa, Artificial Sequence
  Description of Artificial Sequence: Synthetic peptide
RASQGISNYLA

SEQ ID NO: 631 - DNA, 33 bp, Artificial Sequence; identical to SEQ ID NO: 305
  Description of Artificial Sequence: Synthetic oligonucleotide

SEQ ID NO: 632 - protein, 11 aa, Artificial Sequence
  Description of Artificial Sequence: Synthetic peptide
RASQSIISYLN

SEQ ID NO: 633 - DNA, 33 bp, Artificial Sequence; identical to SEQ ID NO: 109
  Description of Artificial Sequence: Synthetic oligonucleotide

SEQ ID NO: 634 - protein, 11 aa, Artificial Sequence
  Description of Artificial Sequence: Synthetic peptide
RASQGIRNDLG

SEQ ID NO: 635 - DNA, 33 bp, Artificial Sequence; identical to SEQ ID NO: 493
  Description of Artificial Sequence: Synthetic oligonucleotide

SEQ ID NO: 636 - protein, 11 aa, Artificial Sequence
  Description of Artificial Sequence: Synthetic peptide
RASQDIRSDLG

SEQ ID NO: 637 - DNA, 33 bp, Artificial Sequence
  Description of Artificial Sequence: Synthetic oligonucleotide
cgggcgagtcagggtattagccggtggttagcc

SEQ ID NO: 638 - protein, 11 aa, Artificial Sequence
  Description of Artificial Sequence: Synthetic peptide
RASQGISRWLA

SEQ ID NO: 639 - DNA, 33 bp, Artificial Sequence; identical to SEQ ID NO: 305
  Description of Artificial Sequence: Synthetic oligonucleotide

SEQ ID NO: 640 - protein, 11 aa, Artificial Sequence
  Description of Artificial Sequence: Synthetic peptide
RASQSIISYLN

SEQ ID NO: 641 - DNA, 33 bp, Artificial Sequence
  Description of Artificial Sequence: Synthetic oligonucleotide
cggacaagtcaggacattagaagtgatttaggc

SEQ ID NO: 642 - protein, 11 aa, Artificial Sequence
  Description of Artificial Sequence: Synthetic peptide
RTSQDIRSDLG

SEQ ID NO: 643 - DNA, 33 bp, Artificial Sequence; identical to SEQ ID NO: 493
  Description of Artificial Sequence: Synthetic oligonucleotide

SEQ ID NO: 644 - protein, 11 aa, Artificial Sequence
  Description of Artificial Sequence: Synthetic peptide
RASQDIRSDLG

SEQ ID NO: 645 - DNA, 33 bp, Artificial Sequence
  Description of Artificial Sequence: Synthetic oligonucleotide
cggacaagtcaggacatcagaaatgatttaggc

SEQ ID NO: 646 - protein, 11 aa, Artificial Sequence
  Description of Artificial Sequence: Synthetic peptide
RTSQDIRNDLG

SEQ ID NO: 647 - DNA, 33 bp, Artificial Sequence
  Description of Artificial Sequence: Synthetic oligonucleotide
cgggcaagtcagaacattaacaggtatttaaat

SEQ ID NO: 648 - protein, 11 aa, Artificial Sequence
  Description of Artificial Sequence: Synthetic peptide
RASQNINRYLN

SEQ ID NO: 649 - DNA, 33 bp, Artificial Sequence; identical to SEQ ID NO: 493
  Description of Artificial Sequence: Synthetic oligonucleotide

SEQ ID NO: 650 - protein, 11 aa, Artificial Sequence
  Description of Artificial Sequence: Synthetic peptide
RASQDIRSDLG

SEQ ID NO: 651 - DNA, 33 bp, Artificial Sequence; identical to SEQ ID NO: 173
  Description of Artificial Sequence: Synthetic oligonucleotide

SEQ ID NO: 652 - protein, 11 aa, Artificial Sequence
  Description of Artificial Sequence: Synthetic peptide
RASQGISRWLA

SEQ ID NO: 653 - DNA, 33 bp, Artificial Sequence; identical to SEQ ID NO: 529
  Description of Artificial Sequence: Synthetic oligonucleotide

SEQ ID NO: 654 - protein, 11 aa, Artificial Sequence
  Description of Artificial Sequence: Synthetic peptide
RASQSISNYLN

SEQ ID NO: 655 - DNA, 33 bp, Artificial Sequence
  Description of Artificial Sequence: Synthetic oligonucleotide
cgggcgagtcagcttattagcaagtggttagcc

SEQ ID NO: 656 - protein, 11 aa, Artificial Sequence
  Description of Artificial Sequence: Synthetic peptide
RASQLISKWLA

SEQ ID NO: 657 - DNA, 33 bp, Artificial Sequence; identical to SEQ ID NO: 205
  Description of Artificial Sequence: Synthetic oligonucleotide

SEQ ID NO: 658 - protein, 11 aa, Artificial Sequence
  Description of Artificial Sequence: Synthetic peptide
RASQDIRNDLG

SEQ ID NO: 659 - DNA, 33 bp, Artificial Sequence
  Description of Artificial Sequence: Synthetic oligonucleotide
cgggcgagtcaggccattagtaattatttagcc

SEQ ID NO: 660 - protein, 11 aa, Artificial Sequence
  Description of Artificial Sequence: Synthetic peptide
RASQAISNYLA

SEQ ID NO: 661 - DNA, 33 bp, Artificial Sequence; identical to SEQ ID NO: 305
  Description of Artificial Sequence: Synthetic oligonucleotide

SEQ ID NO: 662 - protein, 11 aa, Artificial Sequence
  Description of Artificial Sequence: Synthetic peptide
RASQSIISYLN

SEQ ID NO: 663 - DNA, 33 bp, Artificial Sequence; identical to SEQ ID NO: 109
  Description of Artificial Sequence: Synthetic oligonucleotide

SEQ ID NO: 664 - protein, 11 aa, Artificial Sequence
  Description of Artificial Sequence: Synthetic peptide
RASQGIRNDLG

SEQ ID NO: 665 - DNA, 33 bp, Artificial Sequence; identical to SEQ ID NO: 493
  Description of Artificial Sequence: Synthetic oligonucleotide

SEQ ID NO: 666 - protein, 11 aa, Artificial Sequence
  Description of Artificial Sequence: Synthetic peptide
RASQDIRSDLG

SEQ ID NO: 667 - DNA, 33 bp, Artificial Sequence; identical to SEQ ID NO: 493
  Description of Artificial Sequence: Synthetic oligonucleotide

SEQ ID NO: 668 - protein, 11 aa, Artificial Sequence
  Description of Artificial Sequence: Synthetic peptide
RASQDIRSDLG

SEQ ID NO: 669 - DNA, 33 bp, Artificial Sequence; identical to SEQ ID NO: 109
  Description of Artificial Sequence: Synthetic oligonucleotide

SEQ ID NO: 670 - protein, 11 aa, Artificial Sequence
  Description of Artificial Sequence: Synthetic peptide
RASQGIRNDLG

SEQ ID NO: 671 - DNA, 33 bp, Artificial Sequence; identical to SEQ ID NO: 637
  Description of Artificial Sequence: Synthetic oligonucleotide

SEQ ID NO: 672 - protein, 11 aa, Artificial Sequence
  Description of Artificial Sequence: Synthetic peptide
RASQGISRWLA

SEQ ID NO: 673 - DNA, 33 bp, Artificial Sequence
  Description of Artificial Sequence: Synthetic oligonucleotide
cgggcaagtcagagaattatcagctatttaaat

SEQ ID NO: 674 - protein, 11 aa, Artificial Sequence
  Description of Artificial Sequence: Synthetic peptide
RASQRIISYLN

SEQ ID NO: 675 - DNA, 33 bp, Artificial Sequence
  Description of Artificial Sequence: Synthetic oligonucleotide
cgggcaagtcagatcattatcagctatttaaat

SEQ ID NO: 676 - protein, 11 aa, Artificial Sequence
  Description of Artificial Sequence: Synthetic peptide
RASQIIISYLN

SEQ ID NO: 677 - DNA, 33 bp, Artificial Sequence
  Description of Artificial Sequence: Synthetic oligonucleotide
caggcgagtcaggacattttcaactatttaaat

SEQ ID NO: 678 - protein, 11 aa, Artificial Sequence
  Description of Artificial Sequence: Synthetic peptide
QASQDIFNYLN

SEQ ID NO: 679 - DNA, 33 bp, Artificial Sequence; identical to SEQ ID NO: 625
  Description of Artificial Sequence: Synthetic oligonucleotide

SEQ ID NO: 680 - protein, 11 aa, Artificial Sequence
  Description of Artificial Sequence: Synthetic peptide
RASQGISRWLA

SEQ ID NO: 681 - DNA, 33 bp, Artificial Sequence; identical to SEQ ID NO: 293
  Description of Artificial Sequence: Synthetic oligonucleotide

SEQ ID NO: 682 - protein, 11 aa, Artificial Sequence
  Description of Artificial Sequence: Synthetic peptide
RASQGINNYLA

SEQ ID NO: 683 - DNA, 48 bp, Artificial Sequence; identical to SEQ ID NO: 487
  Description of Artificial Sequence: Synthetic oligonucleotide

SEQ ID NO: 684 - protein, 16 aa, Artificial Sequence
  Description of Artificial Sequence: Synthetic peptide
KSSQSLLHSDGKTYLY

SEQ ID NO: 685 - DNA, 33 bp, Artificial Sequence; identical to SEQ ID NO: 493
  Description of Artificial Sequence: Synthetic oligonucleotide

SEQ ID NO: 686 - protein, 11 aa, Artificial Sequence
  Description of Artificial Sequence: Synthetic peptide
RASQDIRSDLG

SEQ ID NO: 687 - DNA, 33 bp, Artificial Sequence; identical to SEQ ID NO: 501
  Description of Artificial Sequence: Synthetic oligonucleotide

SEQ ID NO: 688 - protein, 11 aa, Artificial Sequence
  Description of Artificial Sequence: Synthetic peptide
RASQSISSYLN

SEQ ID NO: 689 - DNA, 33 bp, Artificial Sequence
  Description of Artificial Sequence: Synthetic oligonucleotide
cggacaagtcaggacattagaaatgatttaggc

SEQ ID NO: 690 - protein, 11 aa, Artificial Sequence
  Description of Artificial Sequence: Synthetic peptide
RTSQDIRNDLG

SEQ ID NO: 691 - DNA, 33 bp, Artificial Sequence; identical to SEQ ID NO: 171
  Description of Artificial Sequence: Synthetic oligonucleotide

SEQ ID NO: 692 - protein, 11 aa, Artificial Sequence
  Description of Artificial Sequence: Synthetic peptide
RASQGISSWLA

SEQ ID NO: 693 - DNA, 33 bp, Artificial Sequence
  Description of Artificial Sequence: Synthetic oligonucleotide
tctggagataaattgggggataaatatgcttgc

SEQ ID NO: 694 - protein, 11 aa, Artificial Sequence
  Description of Artificial Sequence: Synthetic peptide
SGDKLGDKYAC

SEQ ID NO: 695 - DNA, 33 bp, Artificial Sequence; identical to SEQ ID NO: 163
  Description of Artificial Sequence: Synthetic oligonucleotide

SEQ ID NO: 696 - protein, 11 aa, Artificial Sequence
  Description of Artificial Sequence: Synthetic peptide
SGDKLGDKYAY

SEQ ID NO: 697 - DNA, 33 bp, Artificial Sequence
  Description of Artificial Sequence: Synthetic oligonucleotide
tctggagataaattgggggaaaaatatgcttgc

SEQ ID NO: 698 - protein, 11 aa, Artificial Sequence
  Description of Artificial Sequence: Synthetic peptide
SGDKLGEKYAC

SEQ ID NO: 699 - DNA, 36 bp, Artificial Sequence; identical to SEQ ID NO: 195
  Description of Artificial Sequence: Synthetic oligonucleotide

SEQ ID NO: 700 - protein, 12 aa, Artificial Sequence
  Description of Artificial Sequence: Synthetic peptide
TLSSEHSTYTIE

SEQ ID NO: 701 - DNA, 33 bp, Artificial Sequence
  Description of Artificial Sequence: Synthetic oligonucleotide
tctggagataaattggggaataaatatgcttgc

SEQ ID NO: 702 - protein, 11 aa, Artificial Sequence
  Description of Artificial Sequence: Synthetic peptide
SGDKLGNKYAC

SEQ ID NO: 703 - DNA, 33 bp, Artificial Sequence
  Description of Artificial Sequence: Synthetic oligonucleotide
tctggagataaattgggggagaaatatgcttac

SEQ ID NO: 704 - protein, 11 aa, Artificial Sequence
  Description of Artificial Sequence: Synthetic peptide
SGDKLGEKYAY

SEQ ID NO: 705 - DNA, 39 bp, Artificial Sequence
  Description of Artificial Sequence: Synthetic oligonucleotide
tctggaaccaactccaacatcggaagttatactgtaaac

SEQ ID NO: 706 - protein, 13 aa, Artificial Sequence
  Description of Artificial Sequence: Synthetic peptide
SGTNSNIGSYTVN

SEQ ID NO: 707 - DNA, 33 bp, Artificial Sequence; identical to SEQ ID NO: 693
  Description of Artificial Sequence: Synthetic oligonucleotide

SEQ ID NO: 708 - protein, 11 aa, Artificial Sequence
  Description of Artificial Sequence: Synthetic peptide
SGDKLGDKYAC

SEQ ID NO: 709 - DNA, 33 bp, Artificial Sequence
  Description of Artificial Sequence: Synthetic oligonucleotide
tctggagataaattgggggagaaatatgcttgc

SEQ ID NO: 710 - protein, 11 aa, Artificial Sequence
  Description of Artificial Sequence: Synthetic peptide
SGDKLGEKYAC

SEQ ID NO: 711 - DNA, 33 bp, Artificial Sequence
  Description of Artificial Sequence: Synthetic oligonucleotide
tctggatataaattgggggataaatatgcttgc

SEQ ID NO: 712 - protein, 11 aa, Artificial Sequence
  Description of Artificial Sequence: Synthetic peptide
SGYKLGDKYAC

SEQ ID NO: 713 - DNA, 33 bp, Artificial Sequence
  Description of Artificial Sequence: Synthetic oligonucleotide
tctggagataaattgggggagaaatatgtttcc

SEQ ID NO: 714 - protein, 11 aa, Artificial Sequence
  Description of Artificial Sequence: Synthetic peptide
SGDKLGEKYVS

SEQ ID NO: 715 - DNA, 33 bp, Artificial Sequence; identical to SEQ ID NO: 693
  Description of Artificial Sequence: Synthetic oligonucleotide

SEQ ID NO: 716 - protein, 11 aa, Artificial Sequence
  Description of Artificial Sequence: Synthetic peptide
SGDKLGDKYAC

SEQ ID NO: 717 - DNA, 33 bp, Artificial Sequence; identical to SEQ ID NO: 693
  Description of Artificial Sequence: Synthetic oligonucleotide

SEQ ID NO: 718 - protein, 11 aa, Artificial Sequence
  Description of Artificial Sequence: Synthetic peptide
SGDKLGDKYAC

SEQ ID NO: 719 - DNA, 33 bp, Artificial Sequence; identical to SEQ ID NO: 697
  Description of Artificial Sequence: Synthetic oligonucleotide

SEQ ID NO: 720 - protein, 11 aa, Artificial Sequence
  Description of Artificial Sequence: Synthetic peptide
SGDKLGEKYAC

SEQ ID NO: 721 - DNA, 33 bp, Artificial Sequence; identical to SEQ ID NO: 693
  Description of Artificial Sequence: Synthetic oligonucleotide

SEQ ID NO: 722 - protein, 11 aa, Artificial Sequence
  Description of Artificial Sequence: Synthetic peptide
SGDKLGDKYAC

SEQ ID NO: 723 - DNA, 33 bp, Artificial Sequence
  Description of Artificial Sequence: Synthetic oligonucleotide
tctggagataaattgggggaaaaatatgcttac

SEQ ID NO: 724 - protein, 11 aa, Artificial Sequence
  Description of Artificial Sequence: Synthetic peptide
SGDKLGEKYAY

SEQ ID NO: 725 - DNA, 33 bp, Artificial Sequence; identical to SEQ ID NO: 693
  Description of Artificial Sequence: Synthetic oligonucleotide

SEQ ID NO: 726 - protein, 11 aa, Artificial Sequence
  Description of Artificial Sequence: Synthetic peptide
SGDKLGDKYAC

SEQ ID NO: 727 - DNA, 33 bp, Artificial Sequence; identical to SEQ ID NO: 193
  Description of Artificial Sequence: Synthetic oligonucleotide

SEQ ID NO: 728 - protein, 11 aa, Artificial Sequence
  Description of Artificial Sequence: Synthetic peptide
GGNNIGSKAVH

SEQ ID NO: 729 - DNA, 33 bp, Artificial Sequence; identical to SEQ ID NO: 693
  Description of Artificial Sequence: Synthetic oligonucleotide

SEQ ID NO: 730 - protein, 11 aa, Artificial Sequence
  Description of Artificial Sequence: Synthetic peptide
SGDKLGDKYAC

SEQ ID NO: 731 - DNA, 33 bp, Artificial Sequence
  Description of Artificial Sequence: Synthetic oligonucleotide
gggggaaacaacattggaagtaaaagtgtgcac

SEQ ID NO: 732 - protein, 11 aa, Artificial Sequence
  Description of Artificial Sequence: Synthetic peptide
GGNNIGSKSVH

SEQ ID NO: 733 - DNA, 33 bp, Artificial Sequence; identical to SEQ ID NO: 177
  Description of Artificial Sequence: Synthetic oligonucleotide

SEQ ID NO: 734 - protein, 11 aa, Artificial Sequence
  Description of Artificial Sequence: Synthetic peptide
SGDKLGDKYVY

SEQ ID NO: 735 - DNA, 33 bp, Artificial Sequence
  Description of Artificial Sequence: Synthetic oligonucleotide
tctggagataaattgggtaataaatatgcttgc

SEQ ID NO: 736 - protein, 11 aa, Artificial Sequence
  Description of Artificial Sequence: Synthetic peptide
SGDKLGNKYAC

SEQ ID NO: 737 - DNA, 33 bp, Artificial Sequence
  Description of Artificial Sequence: Synthetic oligonucleotide
tctggagataaattgggggataaatttgtttat

SEQ ID NO: 738 - protein, 11 aa, Artificial Sequence
  Description of Artificial Sequence: Synthetic peptide
SGDKLGDKFVY

SEQ ID NO: 739 - DNA, 33 bp, Artificial Sequence
  Description of Artificial Sequence: Synthetic oligonucleotide
tctggagataaattgggggataaatatgtttgc

SEQ ID NO: 740 - protein, 11 aa, Artificial Sequence
  Description of Artificial Sequence: Synthetic peptide
SGDKLGDKYVC

SEQ ID NO: 741 - DNA, 33 bp, Artificial Sequence; identical to SEQ ID NO: 697
  Description of Artificial Sequence: Synthetic oligonucleotide

SEQ ID NO: 742 - protein, 11 aa, Artificial Sequence
  Description of Artificial Sequence: Synthetic peptide
SGDKLGEKYAC

SEQ ID NO: 743 - DNA, 33 bp, Artificial Sequence
  Description of Artificial Sequence: Synthetic oligonucleotide
tctggagataaattgggaaataaatatgcttgc

SEQ ID NO: 744 - protein, 11 aa, Artificial Sequence
  Description of Artificial Sequence: Synthetic peptide
SGDKLGNKYAC

SEQ ID NO: 745 - DNA, 33 bp, Artificial Sequence; identical to SEQ ID NO: 163
  Description of Artificial Sequence: Synthetic oligonucleotide

SEQ ID NO: 746 - protein, 11 aa, Artificial Sequence
  Description of Artificial Sequence: Synthetic peptide
SGDKLGDKYAY

SEQ ID NO: 747 - DNA, 39 bp, Artificial Sequence; identical to SEQ ID NO: 705
  Description of Artificial Sequence: Synthetic oligonucleotide

SEQ ID NO: 748 - protein, 13 aa, Artificial Sequence
  Description of Artificial Sequence: Synthetic peptide
SGTNSNIGSYTVN

SEQ ID NO: 749 - DNA, 42 bp, Artificial Sequence
  Description of Artificial Sequence: Synthetic oligonucleotide
actggagccagcagtgacgttggtgattataactctgtctcc

SEQ ID NO: 750 - protein, 14 aa, Artificial Sequence
  Description of Artificial Sequence: Synthetic peptide
TGASSDVGDYNSVS

SEQ ID NO: 751 - DNA, 33 bp, Artificial Sequence; identical to SEQ ID NO: 739
  Description of Artificial Sequence: Synthetic oligonucleotide

SEQ ID NO: 752 - protein, 11 aa, Artificial Sequence
  Description of Artificial Sequence: Synthetic peptide
SGDKLGDKYVC

SEQ ID NO: 753 - DNA, 33 bp, Artificial Sequence; identical to SEQ ID NO: 185
  Description of Artificial Sequence: Synthetic oligonucleotide

SEQ ID NO: 754 - protein, 11 aa, Artificial Sequence
  Description of Artificial Sequence: Synthetic peptide
SGDKLGNKYAW

SEQ ID NO: 755 - DNA, 51 bp, Artificial Sequence
  Description of Artificial Sequence: Synthetic oligonucleotide
aggtccagccagactattttacacagctccaacaattacaactacttagct

SEQ ID NO: 756 - protein, 17 aa, Artificial Sequence
  Description of Artificial Sequence: Synthetic peptide
RSSQTILHSSNNYNYLA

SEQ ID NO: 757 - DNA, 33 bp, Artificial Sequence; identical to SEQ ID NO: 693
  Description of Artificial Sequence: Synthetic oligonucleotide

SEQ ID NO: 758 - protein, 11 aa, Artificial Sequence
  Description of Artificial Sequence: Synthetic peptide
SGDKLGDKYAC

SEQ ID NO: 759 - DNA, 36 bp, Artificial Sequence
  Description of Artificial Sequence: Synthetic oligonucleotide
agggccagtcagagtgttagcagcagctacttagcc

SEQ ID NO: 760 - protein, 12 aa, Artificial Sequence
  Description of Artificial Sequence: Synthetic peptide
RASQSVSSSYLA

SEQ ID NO: 761 - DNA, 33 bp, Artificial Sequence; identical to SEQ ID NO: 109
  Description of Artificial Sequence: Synthetic oligonucleotide

SEQ ID NO: 762 - protein, 11 aa, Artificial Sequence
  Description of Artificial Sequence: Synthetic peptide
RASQGIRNDLG

SEQ ID NO: 763 - DNA, 33 bp, Artificial Sequence; identical to SEQ ID NO: 109
  Description of Artificial Sequence: Synthetic oligonucleotide

SEQ ID NO: 764 - protein, 11 aa, Artificial Sequence
  Description of Artificial Sequence: Synthetic peptide
RASQGIRNDLG

SEQ ID NO: 765 - DNA, 33 bp, Artificial Sequence; identical to SEQ ID NO: 109
  Description of Artificial Sequence: Synthetic oligonucleotide

SEQ ID NO: 766 - protein, 11 aa, Artificial Sequence
  Description of Artificial Sequence: Synthetic peptide
RASQGIRNDLG

SEQ ID NO: 767 - DNA, 33 bp, Artificial Sequence
  Description of Artificial Sequence: Synthetic oligonucleotide
cgggcgagtcagggtattagcacctggttagcc

SEQ ID NO: 768 - protein, 11 aa, Artificial Sequence
  Description of Artificial Sequence: Synthetic peptide
RASQGISTWLA

SEQ ID NO: 769 - DNA, 33 bp, Artificial Sequence; identical to SEQ ID NO: 109
  Description of Artificial Sequence: Synthetic oligonucleotide

SEQ ID NO: 770 - protein, 11 aa, Artificial Sequence
  Description of Artificial Sequence: Synthetic peptide
RASQGIRNDLG

SEQ ID NO: 771 - DNA, 33 bp, Artificial Sequence; identical to SEQ ID NO: 93
  Description of Artificial Sequence: Synthetic oligonucleotide

SEQ ID NO: 772 - protein, 11 aa, Artificial Sequence
  Description of Artificial Sequence: Synthetic peptide
RTSQGIRNDLG

SEQ ID NO: 773 - DNA, 33 bp, Artificial Sequence; identical to SEQ ID NO: 519
  Description of Artificial Sequence: Synthetic oligonucleotide

SEQ ID NO: 774 - protein, 11 aa, Artificial Sequence
  Description of Artificial Sequence: Synthetic peptide
RASQAIRNDLG

SEQ ID NO: 775 - DNA, 33 bp, Artificial Sequence; identical to SEQ ID NO: 109
  Description of Artificial Sequence: Synthetic oligonucleotide

SEQ ID NO: 776 - protein, 11 aa, Artificial Sequence
  Description of Artificial Sequence: Synthetic peptide
RASQGIRNDLG

SEQ ID NO: 777 - DNA, 33 bp, Artificial Sequence; identical to SEQ ID NO: 109
  Description of Artificial Sequence: Synthetic oligonucleotide

SEQ ID NO: 778 - protein, 11 aa, Artificial Sequence
  Description of Artificial Sequence: Synthetic peptide
RASQGIRNDLG

SEQ ID NO: 779 - DNA, 33 bp, Artificial Sequence; identical to SEQ ID NO: 109
  Description of Artificial Sequence: Synthetic oligonucleotide

SEQ ID NO: 780 - protein, 11 aa, Artificial Sequence
  Description of Artificial Sequence: Synthetic peptide
RASQGIRNDLG

SEQ ID NO: 781 - DNA, 33 bp, Artificial Sequence; identical to SEQ ID NO: 247
  Description of Artificial Sequence: Synthetic oligonucleotide

SEQ ID NO: 782 - protein, 11 aa, Artificial Sequence
  Description of Artificial Sequence: Synthetic peptide
RASQNISSYLN

SEQ ID NO: 783 - DNA, 33 bp, Artificial Sequence; identical to SEQ ID NO: 109
  Description of Artificial Sequence: Synthetic oligonucleotide

SEQ ID NO: 784 - protein, 11 aa, Artificial Sequence
  Description of Artificial Sequence: Synthetic peptide
RASQGIRNDLG

SEQ ID NO: 785 - DNA, 33 bp, Artificial Sequence; identical to SEQ ID NO: 109
  Description of Artificial Sequence: Synthetic oligonucleotide

SEQ ID NO: 786 - protein, 11 aa, Artificial Sequence
  Description of Artificial Sequence: Synthetic peptide
RASQGIRNDLG

SEQ ID NO: 787 - DNA, 33 bp, Artificial Sequence; identical to SEQ ID NO: 109
  Description of Artificial Sequence: Synthetic oligonucleotide

SEQ ID NO: 788 - protein, 11 aa, Artificial Sequence
  Description of Artificial Sequence: Synthetic peptide
RASQGIRNDLG

SEQ ID NO: 789 - DNA, 33 bp, Artificial Sequence; identical to SEQ ID NO: 109
  Description of Artificial Sequence: Synthetic oligonucleotide

SEQ ID NO: 790 - protein, 11 aa, Artificial Sequence
  Description of Artificial Sequence: Synthetic peptide
RASQGIRNDLG

SEQ ID NO: 791 - DNA, 33 bp, Artificial Sequence; identical to SEQ ID NO: 105
  Description of Artificial Sequence: Synthetic oligonucleotide

SEQ ID NO: 792 - protein, 11 aa, Artificial Sequence
  Description of Artificial Sequence: Synthetic peptide
RASQGISNYLA

SEQ ID NO: 793 - DNA, 33 bp, Artificial Sequence; identical to SEQ ID NO: 109
  Description of Artificial Sequence: Synthetic oligonucleotide

SEQ ID NO: 794 - protein, 11 aa, Artificial Sequence
  Description of Artificial Sequence: Synthetic peptide
RASQGIRNDLG

SEQ ID NO: 795 - DNA, 33 bp, Artificial Sequence
  Description of Artificial Sequence: Synthetic oligonucleotide
cgggcaagtcagagtattctcagctatttaaat

SEQ ID NO: 796 - protein, 11 aa, Artificial Sequence
  Description of Artificial Sequence: Synthetic peptide
RASQSILSYLN

SEQ ID NO: 797 - DNA, 33 bp, Artificial Sequence
  Description of Artificial Sequence: Synthetic oligonucleotide
cgggcaagtcagaacatttacaggtatttaaat

SEQ ID NO: 798 - protein, 11 aa, Artificial Sequence
  Description of Artificial Sequence: Synthetic peptide
RASQNIYRYLN

SEQ ID NO: 799 - DNA, 33 bp, Artificial Sequence
  Description of Artificial Sequence: Synthetic oligonucleotide
cgggcaattcagaacattagcagctatttaaat

SEQ ID NO: 800 - protein, 11 aa, Artificial Sequence
  Description of Artificial Sequence: Synthetic peptide
RAIQNISSYLN

SEQ ID NO: 801 - DNA, 33 bp, Artificial Sequence; identical to SEQ ID NO: 547
  Description of Artificial Sequence: Synthetic oligonucleotide

SEQ ID NO: 802 - protein, 11 aa, Artificial Sequence
  Description of Artificial Sequence: Synthetic peptide
RASQNIYSYLN

SEQ ID NO: 803 - DNA, 33 bp, Artificial Sequence
  Description of Artificial Sequence: Synthetic oligonucleotide
ctggcaagtcagggcattagaaatgatttaggc

SEQ ID NO: 804 - protein, 11 aa, Artificial Sequence
  Description of Artificial Sequence: Synthetic peptide
LASQGIRNDLG

SEQ ID NO: 805 - DNA, 33 bp, Artificial Sequence; identical to SEQ ID NO: 371
  Description of Artificial Sequence: Synthetic oligonucleotide

SEQ ID NO: 806 - protein, 11 aa, Artificial Sequence
  Description of Artificial Sequence: Synthetic peptide
RASQGIRNDLD

SEQ ID NO: 807 - DNA, 33 bp, Artificial Sequence
  Description of Artificial Sequence: Synthetic oligonucleotide
cgggcaagtcagaacattattagttatttaaat

SEQ ID NO: 808 - protein, 11 aa, Artificial Sequence
  Description of Artificial Sequence: Synthetic peptide
RASQNIISYLN

SEQ ID NO: 809 - DNA, 33 bp, Artificial Sequence
  Description of Artificial Sequence: Synthetic oligonucleotide
cgggcaagtcggggcatcagaggtgatttaggt

SEQ ID NO: 810 - protein, 11 aa, Artificial Sequence
  Description of Artificial Sequence: Synthetic peptide
RASRGIRGDLG

SEQ ID NO: 811 - DNA, 33 bp, Artificial Sequence; identical to SEQ ID NO: 109
  Description of Artificial Sequence: Synthetic oligonucleotide

SEQ ID NO: 812 - protein, 11 aa, Artificial Sequence
  Description of Artificial Sequence: Synthetic peptide
RASQGIRNDLG

SEQ ID NO: 813 - DNA, 33 bp, Artificial Sequence
  Description of Artificial Sequence: Synthetic oligonucleotide
cgggcaagtcagaacattagaaattatttaaat

SEQ ID NO: 814 - protein, 11 aa, Artificial Sequence
  Description of Artificial Sequence: Synthetic peptide
RASQNIRNYLN

SEQ ID NO: 815 - DNA, 33 bp, Artificial Sequence
  Description of Artificial Sequence: Synthetic oligonucleotide
cgggcgagtcaggacattagcaatcatttagtc

SEQ ID NO: 816 - protein, 11 aa, Artificial Sequence
  Description of Artificial Sequence: Synthetic peptide
RASQDISNHLV

SEQ ID NO: 817 - DNA, 33 bp, Artificial Sequence; identical to SEQ ID NO: 109
  Description of Artificial Sequence: Synthetic oligonucleotide

SEQ ID NO: 818 - protein, 11 aa, Artificial Sequence
  Description of Artificial Sequence: Synthetic peptide
RASQGIRNDLG

SEQ ID NO: 819 - DNA, 33 bp, Artificial Sequence; identical to SEQ ID NO: 109
  Description of Artificial Sequence: Synthetic oligonucleotide

SEQ ID NO: 820 - protein, 11 aa, Artificial Sequence
  Description of Artificial Sequence: Synthetic peptide
RASQGIRNDLG

SEQ ID NO: 821 - DNA, 33 bp, Artificial Sequence
  Description of Artificial Sequence: Synthetic oligonucleotide
cgggcaagtcagggcattagaaatgatttaggg

SEQ ID NO: 822 - protein, 11 aa, Artificial Sequence
  Description of Artificial Sequence: Synthetic peptide
RASQGIRNDLG

SEQ ID NO: 823 - DNA, 33 bp, Artificial Sequence; identical to SEQ ID NO: 303
  Description of Artificial Sequence: Synthetic oligonucleotide

SEQ ID NO: 824 - protein, 11 aa, Artificial Sequence
  Description of Artificial Sequence: Synthetic peptide
RASQNINNYLN

SEQ ID NO: 825 - DNA, 33 bp, Artificial Sequence; identical to SEQ ID NO: 109
  Description of Artificial Sequence: Synthetic oligonucleotide

SEQ ID NO: 826 - protein, 11 aa, Artificial Sequence
  Description of Artificial Sequence: Synthetic peptide
RASQGIRNDLG

SEQ ID NO: 827 - DNA, 33 bp, Artificial Sequence; identical to SEQ ID NO: 109
  Description of Artificial Sequence: Synthetic oligonucleotide

SEQ ID NO: 828 - protein, 11 aa, Artificial Sequence
  Description of Artificial Sequence: Synthetic peptide
RASQGIRNDLG

SEQ ID NO: 829 - DNA, 33 bp, Artificial Sequence; identical to SEQ ID NO: 109
  Description of Artificial Sequence: Synthetic oligonucleotide

SEQ ID NO: 830 - protein, 11 aa, Artificial Sequence
  Description of Artificial Sequence: Synthetic peptide
RASQGIRNDLG

SEQ ID NO: 831 - DNA, 33 bp, Artificial Sequence
  Description of Artificial Sequence: Synthetic oligonucleotide
cgggcaagtcagggcattagaaatgatttaggt

SEQ ID NO: 832 - protein, 11 aa, Artificial Sequence
  Description of Artificial Sequence: Synthetic peptide
RASQGIRNDLG

SEQ ID NO: 833 - DNA, 33 bp, Artificial Sequence
  Description of Artificial Sequence: Synthetic oligonucleotide
cgggcaagtcagagcattagaagttatttaaat

SEQ ID NO: 834 - protein, 11 aa, Artificial Sequence
  Description of Artificial Sequence: Synthetic peptide
RASQSIRSYLN

SEQ ID NO: 835 - DNA, 33 bp, Artificial Sequence
  Description of Artificial Sequence: Synthetic oligonucleotide
cgggcaagtcataccattagaacctatttaaac

SEQ ID NO: 836 - protein, 11 aa, Artificial Sequence
  Description of Artificial Sequence: Synthetic peptide
RASHTIRTYLN

SEQ ID NO: 837 - DNA, 33 bp, Artificial Sequence
  Description of Artificial Sequence: Synthetic oligonucleotide
caggcgagtcaggacattagcaactatttaaat

SEQ ID NO: 838 - protein, 11 aa, Artificial Sequence
  Description of Artificial Sequence: Synthetic peptide
QASQDISNYLN

SEQ ID NO: 839 - DNA, 33 bp, Artificial Sequence; identical to SEQ ID NO: 105
  Description of Artificial Sequence: Synthetic oligonucleotide

SEQ ID NO: 840 - protein, 11 aa, Artificial Sequence
  Description of Artificial Sequence: Synthetic peptide
RASQGISNYLA

SEQ ID NO: 841 - DNA, 33 bp, Artificial Sequence; identical to SEQ ID NO: 105
  Description of Artificial Sequence: Synthetic oligonucleotide

SEQ ID NO: 842 - protein, 11 aa, Artificial Sequence
  Description of Artificial Sequence: Synthetic peptide
RASQGISNYLA

SEQ ID NO: 843 - DNA, 33 bp, Artificial Sequence
  Description of Artificial Sequence: Synthetic oligonucleotide
cgggcaagtcagaccattagtagttatttaaat

SEQ ID NO: 844 - protein, 11 aa, Artificial Sequence
  Description of Artificial Sequence: Synthetic peptide
RASQTISSYLN

SEQ ID NO: 845 - DNA, 33 bp, Artificial Sequence
  Description of Artificial Sequence: Synthetic oligonucleotide
cgggcaagtcagaacatttacagttatttaaat

SEQ ID NO: 846 - protein, 11 aa, Artificial Sequence
  Description of Artificial Sequence: Synthetic peptide
RASQNIYSYLN

SEQ ID NO: 847 - DNA, 33 bp, Artificial Sequence; identical to SEQ ID NO: 93
  Description of Artificial Sequence: Synthetic oligonucleotide

SEQ ID NO: 848 - protein, 11 aa, Artificial Sequence
  Description of Artificial Sequence: Synthetic peptide
RTSQGIRNDLG

SEQ ID NO: 849 - DNA, 33 bp, Artificial Sequence; identical to SEQ ID NO: 361
  Description of Artificial Sequence: Synthetic oligonucleotide

SEQ ID NO: 850 - protein, 11 aa, Artificial Sequence
  Description of Artificial Sequence: Synthetic peptide
RASQNIISYLN

SEQ ID NO: 851 - DNA, 33 bp, Artificial Sequence
  Description of Artificial Sequence: Synthetic oligonucleotide
agggccagtcagactgttagcagcaacttagcc

SEQ ID NO: 852 - protein, 11 aa, Artificial Sequence
  Description of Artificial Sequence: Synthetic peptide
RASQTVSSNLA

SEQ ID NO: 853 - DNA, 33 bp, Artificial Sequence; identical to SEQ ID NO: 493
  Description of Artificial Sequence: Synthetic oligonucleotide

SEQ ID NO: 854 - protein, 11 aa, Artificial Sequence
  Description of Artificial Sequence: Synthetic peptide
RASQDIRSDLG

SEQ ID NO: 855 - DNA, 33 bp, Artificial Sequence
  Description of Artificial Sequence: Synthetic oligonucleotide
caggcgaatcaggacattaccaactttttaaat

SEQ ID NO: 856 - protein, 11 aa, Artificial Sequence
  Description of Artificial Sequence: Synthetic peptide
QANQDITNFLN

SEQ ID NO: 857 - DNA, 33 bp, Artificial Sequence; identical to SEQ ID NO: 855
  Description of Artificial Sequence: Synthetic oligonucleotide

SEQ ID NO: 858 - protein, 11 aa, Artificial Sequence
  Description of Artificial Sequence: Synthetic peptide
QANQDITNFLN

SEQ ID NO: 859 - DNA, 33 bp, Artificial Sequence; identical to SEQ ID NO: 293
  Description of Artificial Sequence: Synthetic oligonucleotide

SEQ ID NO: 860 - protein, 11 aa, Artificial Sequence
  Description of Artificial Sequence: Synthetic peptide
RASQGINNYLA

SEQ ID NO: 861 - DNA, 33 bp, Artificial Sequence; identical to SEQ ID NO: 109
  Description of Artificial Sequence: Synthetic oligonucleotide

SEQ ID NO: 862 - protein, 11 aa, Artificial Sequence
  Description of Artificial Sequence: Synthetic peptide
RASQGIRNDLG

SEQ ID NO: 863 - DNA, 33 bp, Artificial Sequence; identical to SEQ ID NO: 797
  Description of Artificial Sequence: Synthetic oligonucleotide

SEQ ID NO: 864 - protein, 11 aa, Artificial Sequence
  Description of Artificial Sequence: Synthetic peptide
RASQNIYRYLN

SEQ ID NO: 865 - DNA, 33 bp, Artificial Sequence; identical to SEQ ID NO: 109
  Description of Artificial Sequence: Synthetic oligonucleotide

SEQ ID NO: 866 - protein, 11 aa, Artificial Sequence
  Description of Artificial Sequence: Synthetic peptide
RASQGIRNDLG

SEQ ID NO: 867 - DNA, 33 bp, Artificial Sequence
  Description of Artificial Sequence: Synthetic oligonucleotide
cgggcaagtcagaccattatcagctatttaaat

SEQ ID NO: 868 - protein, 11 aa, Artificial Sequence
  Description of Artificial Sequence: Synthetic peptide
RASQTIISYLN

SEQ ID NO: 869 - DNA, 33 bp, Artificial Sequence; identical to SEQ ID NO: 109
  Description of Artificial Sequence: Synthetic oligonucleotide

SEQ ID NO: 870 - protein, 11 aa, Artificial Sequence
  Description of Artificial Sequence: Synthetic peptide
RASQGIRNDLG

SEQ ID NO: 871 - DNA, 33 bp, Artificial Sequence
  Description of Artificial Sequence: Synthetic oligonucleotide
cgggcaagtcaaaacattatcagctatttaaat

SEQ ID NO: 872 - protein, 11 aa, Artificial Sequence
  Description of Artificial Sequence: Synthetic peptide
RASQNIISYLN

SEQ ID NO: 873 - DNA, 33 bp, Artificial Sequence; identical to SEQ ID NO: 797
  Description of Artificial Sequence: Synthetic oligonucleotide

SEQ ID NO: 874 - protein, 11 aa, Artificial Sequence
  Description of Artificial Sequence: Synthetic peptide
RASQNIYRYLN

SEQ ID NO: 875 - DNA, 33 bp, Artificial Sequence; identical to SEQ ID NO: 109
  Description of Artificial Sequence: Synthetic oligonucleotide

SEQ ID NO: 876 - protein, 11 aa, Artificial Sequence
  Description of Artificial Sequence: Synthetic peptide
RASQGIRNDLG

SEQ ID NO: 877 - DNA, 33 bp, Artificial Sequence
  Description of Artificial Sequence: Synthetic oligonucleotide
cgggcaagtcagagcattagcagttatttaaat

SEQ ID NO: 878 - protein, 11 aa, Artificial Sequence
  Description of Artificial Sequence: Synthetic peptide
RASQSISSYLN

SEQ ID NO: 879 - DNA, 33 bp, Artificial Sequence
  Description of Artificial Sequence: Synthetic oligonucleotide
cgggcaagtcagagcattagcggctatttaaat

SEQ ID NO: 880 - protein, 11 aa, Artificial Sequence
  Description of Artificial Sequence: Synthetic peptide
RASQSISGYLN

SEQ ID NO: 881 - DNA, 51 bp, Artificial Sequence
  Description of Artificial Sequence: Synthetic oligonucleotide
aagtccagccagagtgttttatacagctccaacaataacaactacttaact

SEQ ID NO: 882 - protein, 17 aa, Artificial Sequence
  Description of Artificial Sequence: Synthetic peptide
KSSQSVLYSSNNNNYLT

SEQ ID NO: 883 - DNA, 33 bp, Artificial Sequence; identical to SEQ ID NO: 213
  Description of Artificial Sequence: Synthetic oligonucleotide

SEQ ID NO: 884 - protein, 11 aa, Artificial Sequence
  Description of Artificial Sequence: Synthetic peptide
RASQDIRNHLG

SEQ ID NO: 885 - DNA, 33 bp, Artificial Sequence
  Description of Artificial Sequence: Synthetic oligonucleotide
cgggcgagtcaggacattagtaattatttagcc

SEQ ID NO: 886 - protein, 11 aa, Artificial Sequence
  Description of Artificial Sequence: Synthetic peptide
RASQDISNYLA

SEQ ID NO: 887 - DNA, 33 bp, Artificial Sequence; identical to SEQ ID NO: 109
  Description of Artificial Sequence: Synthetic oligonucleotide

SEQ ID NO: 888 - protein, 11 aa, Artificial Sequence
  Description of Artificial Sequence: Synthetic peptide
RASQGIRNDLG

SEQ ID NO: 889 - DNA, 33 bp, Artificial Sequence; identical to SEQ ID NO: 697
  Description of Artificial Sequence: Synthetic oligonucleotide

SEQ ID NO: 890 - protein, 11 aa, Artificial Sequence
  Description of Artificial Sequence: Synthetic peptide
SGDKLGEKYAC

SEQ ID NO: 891 - DNA, 33 bp, Artificial Sequence; identical to SEQ ID NO: 293
  Description of Artificial Sequence: Synthetic oligonucleotide

SEQ ID NO: 892 - protein, 11 aa, Artificial Sequence
  Description of Artificial Sequence: Synthetic peptide
RASQGINNYLA

SEQ ID NO: 893 - DNA, 33 bp, Artificial Sequence; identical to SEQ ID NO: 173
  Description of Artificial Sequence: Synthetic oligonucleotide

SEQ ID NO: 894 - protein, 11 aa, Artificial Sequence
  Description of Artificial Sequence: Synthetic peptide
RASQGISRWLA

SEQ ID NO: 895 - DNA, 33 bp, Artificial Sequence; identical to SEQ ID NO: 431
  Description of Artificial Sequence: Synthetic oligonucleotide

SEQ ID NO: 896 - protein, 11 aa, Artificial Sequence
  Description of Artificial Sequence: Synthetic peptide
RASQSISDYLN

SEQ ID NO: 897 - DNA, 33 bp, Artificial Sequence; identical to SEQ ID NO: 109
  Description of Artificial Sequence: Synthetic oligonucleotide

SEQ ID NO: 898 - protein, 11 aa, Artificial Sequence
  Description of Artificial Sequence: Synthetic peptide
RASQGIRNDLG

SEQ ID NO: 899 - DNA, 33 bp, Artificial Sequence; identical to SEQ ID NO: 109
  Description of Artificial Sequence: Synthetic oligonucleotide

SEQ ID NO: 900 - protein, 11 aa, Artificial Sequence
  Description of Artificial Sequence: Synthetic peptide
RASQGIRNDLG

SEQ ID NO: 901 - DNA, 33 bp, Artificial Sequence; identical to SEQ ID NO: 109
  Description of Artificial Sequence: Synthetic oligonucleotide

SEQ ID NO: 902 - protein, 11 aa, Artificial Sequence
  Description of Artificial Sequence: Synthetic peptide
RASQGIRNDLG

SEQ ID NO: 903 - DNA, 33 bp, Artificial Sequence
  Description of Artificial Sequence: Synthetic oligonucleotide
cggacaagtcagaacattatcagctatttaaat

SEQ ID NO: 904 - protein, 11 aa, Artificial Sequence
  Description of Artificial Sequence: Synthetic peptide
RTSQNIISYLN

SEQ ID NO: 905 - DNA, 33 bp, Artificial Sequence; identical to SEQ ID NO: 429
  Description of Artificial Sequence: Synthetic oligonucleotide

SEQ ID NO: 906 - protein, 11 aa, Artificial Sequence
  Description of Artificial Sequence: Synthetic peptide
RASQGIGNDLG

SEQ ID NO: 907 - DNA, 33 bp, Artificial Sequence; identical to SEQ ID NO: 105
  Description of Artificial Sequence: Synthetic oligonucleotide

SEQ ID NO: 908 - protein, 11 aa, Artificial Sequence
  Description of Artificial Sequence: Synthetic peptide
RASQGISNYLA

SEQ ID NO: 909 - DNA, 33 bp, Artificial Sequence
  Description of Artificial Sequence: Synthetic oligonucleotide
cgggcaagtcagggcattagaaacgatttaggc

SEQ ID NO: 910 - protein, 11 aa, Artificial Sequence
  Description of Artificial Sequence: Synthetic peptide
RASQGIRNDLG

SEQ ID NO: 911 - DNA, 33 bp, Artificial Sequence; identical to SEQ ID NO: 109
  Description of Artificial Sequence: Synthetic oligonucleotide

SEQ ID NO: 912 - protein, 11 aa, Artificial Sequence
  Description of Artificial Sequence: Synthetic peptide
RASQGIRNDLG

SEQ ID NO: 913 - DNA, 33 bp, Artificial Sequence; identical to SEQ ID NO: 109
  Description of Artificial Sequence: Synthetic oligonucleotide

SEQ ID NO: 914 - protein, 11 aa, Artificial Sequence
  Description of Artificial Sequence: Synthetic peptide
RASQGIRNDLG

SEQ ID NO: 915 - DNA, 33 bp, Artificial Sequence; identical to SEQ ID NO: 109
  Description of Artificial Sequence: Synthetic oligonucleotide

SEQ ID NO: 916 - protein, 11 aa, Artificial Sequence
  Description of Artificial Sequence: Synthetic peptide
RASQGIRNDLG

SEQ ID NO: 917 - DNA, 33 bp, Artificial Sequence
  Description of Artificial Sequence: Synthetic oligonucleotide
cggacaagtcagagcattagtacttatttaaat

SEQ ID NO: 918 - protein, 11 aa, Artificial Sequence
  Description of Artificial Sequence: Synthetic peptide
RTSQSISTYLN

SEQ ID NO: 919 - DNA, 33 bp, Artificial Sequence
  Description of Artificial Sequence: Synthetic oligonucleotide
cgggcaagtcagggcattagaagtaatttaggc

SEQ ID NO: 920 - protein, 11 aa, Artificial Sequence
  Description of Artificial Sequence: Synthetic peptide
RASQGIRSNLG

SEQ ID NO: 921 - DNA, 33 bp, Artificial Sequence; identical to SEQ ID NO: 109
  Description of Artificial Sequence: Synthetic oligonucleotide

SEQ ID NO: 922 - protein, 11 aa, Artificial Sequence
  Description of Artificial Sequence: Synthetic peptide
RASQGIRNDLG

SEQ ID NO: 923 - DNA, 33 bp, Artificial Sequence; identical to SEQ ID NO: 109
  Description of Artificial Sequence: Synthetic oligonucleotide

SEQ ID NO: 924 - protein, 11 aa, Artificial Sequence
  Description of Artificial Sequence: Synthetic peptide
RASQGIRNDLG

SEQ ID NO: 925 - DNA, 33 bp, Artificial Sequence
  Description of Artificial Sequence: Synthetic oligonucleotide
cgggcgagtcaggacattaggaattatttagcc

SEQ ID NO: 926 - protein, 11 aa, Artificial Sequence
  Description of Artificial Sequence: Synthetic peptide
RASQDIRNYLA

SEQ ID NO: 927 - DNA, 33 bp, Artificial Sequence; identical to SEQ ID NO: 109
  Description of Artificial Sequence: Synthetic oligonucleotide

SEQ ID NO: 928 - protein, 11 aa, Artificial Sequence
  Description of Artificial Sequence: Synthetic peptide
RASQGIRNDLG

SEQ ID NO: 929 - DNA, 33 bp, Artificial Sequence; identical to SEQ ID NO: 279
  Description of Artificial Sequence: Synthetic oligonucleotide

SEQ ID NO: 930 - protein, 11 aa, Artificial Sequence
  Description of Artificial Sequence: Synthetic peptide
RASQGISYYLA

SEQ ID NO: 931 - DNA, 33 bp, Artificial Sequence
  Description of Artificial Sequence: Synthetic oligonucleotide
cgggcaagtcaggccattagaaatgatttagac

SEQ ID NO: 932 - protein, 11 aa, Artificial Sequence
  Description of Artificial Sequence: Synthetic peptide
RASQAIRNDLD

SEQ ID NO: 933 - DNA, 33 bp, Artificial Sequence; identical to SEQ ID NO: 109
  Description of Artificial Sequence: Synthetic oligonucleotide

SEQ ID NO: 934 - protein, 11 aa, Artificial Sequence
  Description of Artificial Sequence: Synthetic peptide
RASQGIRNDLG

SEQ ID NO: 935 - DNA, 33 bp, Artificial Sequence; identical to SEQ ID NO: 109
  Description of Artificial Sequence: Synthetic oligonucleotide

SEQ ID NO: 936 - protein, 11 aa, Artificial Sequence
  Description of Artificial Sequence: Synthetic peptide
RASQGIRNDLG

SEQ ID NO: 937 - DNA, 33 bp, Artificial Sequence; identical to SEQ ID NO: 837
  Description of Artificial Sequence: Synthetic oligonucleotide

SEQ ID NO: 938 - protein, 11 aa, Artificial Sequence
  Description of Artificial Sequence: Synthetic peptide
QASQDISNYLN

SEQ ID NO: 939 - DNA, 33 bp, Artificial Sequence; identical to SEQ ID NO: 109
  Description of Artificial Sequence: Synthetic oligonucleotide

SEQ ID NO: 940 - protein, 11 aa, Artificial Sequence
  Description of Artificial Sequence: Synthetic peptide
RASQGIRNDLG

SEQ ID NO: 941 - DNA, 33 bp, Artificial Sequence; identical to SEQ ID NO: 425
  Description of Artificial Sequence: Synthetic oligonucleotide

SEQ ID NO: 942 - protein, 11 aa, Artificial Sequence
  Description of Artificial Sequence: Synthetic peptide
QASQDINNYLN

SEQ ID NO: 943 - DNA, 33 bp, Artificial Sequence
  Description of Artificial Sequence: Synthetic oligonucleotide
caggcgagtcaggacattaccaactatttaaat

SEQ ID NO: 944 - protein, 11 aa, Artificial Sequence
  Description of Artificial Sequence: Synthetic peptide
QASQDITNYLN

SEQ ID NO: 945 - DNA, 33 bp, Artificial Sequence; identical to SEQ ID NO: 109
  Description of Artificial Sequence: Synthetic oligonucleotide

SEQ ID NO: 946 - protein, 11 aa, Artificial Sequence
  Description of Artificial Sequence: Synthetic peptide
RASQGIRNDLG

SEQ ID NO: 947 - DNA, 33 bp, Artificial Sequence; identical to SEQ ID NO: 283
  Description of Artificial Sequence: Synthetic oligonucleotide

SEQ ID NO: 948 - protein, 11 aa, Artificial Sequence
  Description of Artificial Sequence: Synthetic peptide
RASQDISNYLA

SEQ ID NO: 949 - DNA, 33 bp, Artificial Sequence; identical to SEQ ID NO: 305
  Description of Artificial Sequence: Synthetic oligonucleotide

SEQ ID NO: 950 - protein, 11 aa, Artificial Sequence
  Description of Artificial Sequence: Synthetic peptide
RASQSIISYLN

SEQ ID NO: 951 - DNA, 33 bp, Artificial Sequence; identical to SEQ ID NO: 289
  Description of Artificial Sequence: Synthetic oligonucleotide

SEQ ID NO: 952 - protein, 11 aa, Artificial Sequence
  Description of Artificial Sequence: Synthetic peptide
RASQSISSYLN

SEQ ID NO: 953 - DNA, 33 bp, Artificial Sequence
  Description of Artificial Sequence: Synthetic oligonucleotide
cgggcaagtcagagcattttcagctacttaaat

SEQ ID NO: 954 - protein, 11 aa, Artificial Sequence
  Description of Artificial Sequence: Synthetic peptide
RASQSIFSYLN

SEQ ID NO: 955 - DNA, 33 bp, Artificial Sequence; identical to SEQ ID NO: 105
  Description of Artificial Sequence: Synthetic oligonucleotide

SEQ ID NO: 956 - protein, 11 aa, Artificial Sequence
  Description of Artificial Sequence: Synthetic peptide
RASQGISNYLA

SEQ ID NO: 957 - DNA, 33 bp, Artificial Sequence; identical to SEQ ID NO: 109
  Description of Artificial Sequence: Synthetic oligonucleotide

SEQ ID NO: 958 - protein, 11 aa, Artificial Sequence
  Description of Artificial Sequence: Synthetic peptide
RASQGIRNDLG

SEQ ID NO: 959 - DNA, 33 bp, Artificial Sequence; identical to SEQ ID NO: 137
  Description of Artificial Sequence: Synthetic oligonucleotide

SEQ ID NO: 960 - protein, 11 aa, Artificial Sequence
  Description of Artificial Sequence: Synthetic peptide
RASQNISSYLN

SEQ ID NO: 961 - DNA, 33 bp, Artificial Sequence; identical to SEQ ID NO: 109
  Description of Artificial Sequence: Synthetic oligonucleotide

SEQ ID NO: 962 - protein, 11 aa, Artificial Sequence
  Description of Artificial Sequence: Synthetic peptide
RASQGIRNDLG

SEQ ID NO: 963 - DNA, 33 bp, Artificial Sequence; identical to SEQ ID NO: 105
  Description of Artificial Sequence: Synthetic oligonucleotide

SEQ ID NO: 964 - protein, 11 aa, Artificial Sequence
  Description of Artificial Sequence: Synthetic peptide
RASQGISNYLA

SEQ ID NO: 965 - DNA, 33 bp, Artificial Sequence; identical to SEQ ID NO: 425
  Description of Artificial Sequence: Synthetic oligonucleotide

SEQ ID NO: 966 - protein, 11 aa, Artificial Sequence
  Description of Artificial Sequence: Synthetic peptide
QASQDINNYLN

SEQ ID NO: 967 - DNA, 33 bp, Artificial Sequence
  Description of Artificial Sequence: Synthetic oligonucleotide
cgggcaagtcagggcattcgaaatcatttaggc

SEQ ID NO: 968 - protein, 11 aa, Artificial Sequence
  Description of Artificial Sequence: Synthetic peptide
RASQGIRNHLG

SEQ ID NO: 969 - DNA, 33 bp, Artificial Sequence
  Description of Artificial Sequence: Synthetic oligonucleotide
caggcgagtcagggcattagcaactctttaaat

SEQ ID NO: 970 - protein, 11 aa, Artificial Sequence
  Description of Artificial Sequence: Synthetic peptide
QASQGISNSLN

SEQ ID NO: 971 - DNA, 33 bp, Artificial Sequence; identical to SEQ ID NO: 109
  Description of Artificial Sequence: Synthetic oligonucleotide

SEQ ID NO: 972 - protein, 11 aa, Artificial Sequence
  Description of Artificial Sequence: Synthetic peptide
RASQGIRNDLG

SEQ ID NO: 973 - DNA, 33 bp, Artificial Sequence; identical to SEQ ID NO: 109
  Description of Artificial Sequence: Synthetic oligonucleotide

SEQ ID NO: 974 - protein, 11 aa, Artificial Sequence
  Description of Artificial Sequence: Synthetic peptide
RASQGIRNDLG

SEQ ID NO: 975 - DNA, 33 bp, Artificial Sequence
  Description of Artificial Sequence: Synthetic oligonucleotide
cgggcaagtcagagtattaataattatttaaat

SEQ ID NO: 976 - protein, 11 aa, Artificial Sequence
  Description of Artificial Sequence: Synthetic peptide
RASQSINNYLN

SEQ ID NO: 977 - DNA, 33 bp, Artificial Sequence; identical to SEQ ID NO: 109
  Description of Artificial Sequence: Synthetic oligonucleotide

SEQ ID NO: 978 - protein, 11 aa, Artificial Sequence
  Description of Artificial Sequence: Synthetic peptide
RASQGIRNDLG

SEQ ID NO: 979 - DNA, 33 bp, Artificial Sequence; identical to SEQ ID NO: 425
  Description of Artificial Sequence: Synthetic oligonucleotide

SEQ ID NO: 980 - protein, 11 aa, Artificial Sequence
  Description of Artificial Sequence: Synthetic peptide
QASQDINNYLN

SEQ ID NO: 981 - DNA, 33 bp, Artificial Sequence; identical to SEQ ID NO: 109
  Description of Artificial Sequence: Synthetic oligonucleotide

SEQ ID NO: 982 - protein, 11 aa, Artificial Sequence
  Description of Artificial Sequence: Synthetic peptide
RASQGIRNDLG

SEQ ID NO: 983 - DNA, 33 bp, Artificial Sequence
  Description of Artificial Sequence: Synthetic oligonucleotide
cgggcaagtcagagcattgccagttatttaaat

SEQ ID NO: 984 - protein, 11 aa, Artificial Sequence
  Description of Artificial Sequence: Synthetic peptide
RASQSIASYLN

SEQ ID NO: 985 - DNA, 33 bp, Artificial Sequence; identical to SEQ ID NO: 109
  Description of Artificial Sequence: Synthetic oligonucleotide

SEQ ID NO: 986 - protein, 11 aa, Artificial Sequence
  Description of Artificial Sequence: Synthetic peptide
RASQGIRNDLG

SEQ ID NO: 987 - DNA, 33 bp, Artificial Sequence; identical to SEQ ID NO: 279
  Description of Artificial Sequence: Synthetic oligonucleotide

SEQ ID NO: 988 - protein, 11 aa, Artificial Sequence
  Description of Artificial Sequence: Synthetic peptide
RASQGISYYLA

SEQ ID NO: 989 - DNA, 33 bp, Artificial Sequence; identical to SEQ ID NO: 109
  Description of Artificial Sequence: Synthetic oligonucleotide

SEQ ID NO: 990 - protein, 11 aa, Artificial Sequence
  Description of Artificial Sequence: Synthetic peptide
RASQGIRNDLG

SEQ ID NO: 991 - DNA, 33 bp, Artificial Sequence; identical to SEQ ID NO: 109
  Description of Artificial Sequence: Synthetic oligonucleotide

SEQ ID NO: 992 - protein, 11 aa, Artificial Sequence
  Description of Artificial Sequence: Synthetic peptide
RASQGIRNDLG

SEQ ID NO: 993 - DNA, 48 bp, Artificial Sequence
  Description of Artificial Sequence: Synthetic oligonucleotide
aggtctagtcagagcctcctccatagtaatggatacaactatttggat

SEQ ID NO: 994 - protein, 16 aa, Artificial Sequence
  Description of Artificial Sequence: Synthetic peptide
RSSQSLLHSNGYNYLD

SEQ ID NO: 995 - DNA, 33 bp, Artificial Sequence; identical to SEQ ID NO: 109
  Description of Artificial Sequence: Synthetic oligonucleotide

SEQ ID NO: 996 - protein, 11 aa, Artificial Sequence
  Description of Artificial Sequence: Synthetic peptide
RASQGIRNDLG

SEQ ID NO: 997 - DNA, 51 bp, Artificial Sequence
  Description of Artificial Sequence: Synthetic oligonucleotide
aagtccaaccagagagttttatccagctccaacaatcacaactacttagct

SEQ ID NO: 998 - protein, 17 aa, Artificial Sequence
  Description of Artificial Sequence: Synthetic peptide
KSNQRVLSSSNNHNYLA

SEQ ID NO: 999 - DNA, 33 bp, Artificial Sequence; identical to SEQ ID NO: 109
  Description of Artificial Sequence: Synthetic oligonucleotide

SEQ ID NO: 1000 - protein, 11 aa, Artificial Sequence
  Description of Artificial Sequence: Synthetic peptide
RASQGIRNDLG

SEQ ID NO: 1001 - DNA, 33 bp, Artificial Sequence
  Description of Artificial Sequence: Synthetic oligonucleotide
cgggcaagtcagggcattagagatattttaggc

SEQ ID NO: 1002 - protein, 11 aa, Artificial Sequence
  Description of Artificial Sequence: Synthetic peptide
RASQGIRDILG

SEQ ID NO: 1003 - DNA, 48 bp, Artificial Sequence
  Description of Artificial Sequence: Synthetic oligonucleotide
aggtctagtcagagcctcctgcatagtaagggatacaactatttggat

SEQ ID NO: 1004 - protein, 16 aa, Artificial Sequence
  Description of Artificial Sequence: Synthetic peptide
RSSQSLLHSKGYNYLD

SEQ ID NO: 1005 - DNA, 33 bp, Artificial Sequence; identical to SEQ ID NO: 109
  Description of Artificial Sequence: Synthetic oligonucleotide

SEQ ID NO: 1006 - protein, 11 aa, Artificial Sequence
  Description of Artificial Sequence: Synthetic peptide
RASQGIRNDLG

SEQ ID NO: 1007 - DNA, 33 bp, Artificial Sequence; identical to SEQ ID NO: 109
  Description of Artificial Sequence: Synthetic oligonucleotide

SEQ ID NO: 1008 - protein, 11 aa, Artificial Sequence
  Description of Artificial Sequence: Synthetic peptide
RASQGIRNDLG

SEQ ID NO: 1009 - DNA, 33 bp, Artificial Sequence; identical to SEQ ID NO: 323
  Description of Artificial Sequence: Synthetic oligonucleotide

SEQ ID NO: 1010 - protein, 11 aa, Artificial Sequence
  Description of Artificial Sequence: Synthetic peptide
RASQSISNYLN

SEQ ID NO: 1011 - DNA, 33 bp, Artificial Sequence; identical to SEQ ID NO: 109
  Description of Artificial Sequence: Synthetic oligonucleotide

SEQ ID NO: 1012 - protein, 11 aa, Artificial Sequence
  Description of Artificial Sequence: Synthetic peptide
RASQGIRNDLG

SEQ ID NO: 1013 - DNA, 33 bp, Artificial Sequence; identical to SEQ ID NO: 425
  Description of Artificial Sequence: Synthetic oligonucleotide

SEQ ID NO: 1014 - protein, 11 aa, Artificial Sequence
  Description of Artificial Sequence: Synthetic peptide
QASQDINNYLN

SEQ ID NO: 1015 - DNA, 33 bp, Artificial Sequence; identical to SEQ ID NO: 305
  Description of Artificial Sequence: Synthetic oligonucleotide

SEQ ID NO: 1016 - protein, 11 aa, Artificial Sequence
  Description of Artificial Sequence: Synthetic peptide
RASQSIISYLN

SEQ ID NO: 1017 - DNA, 51 bp, Artificial Sequence
  Description of Artificial Sequence: Synthetic oligonucleotide
aagtccagccagaatgttttatacaactccaacaataacaactacttagct

SEQ ID NO: 1018 - protein, 17 aa, Artificial Sequence
  Description of Artificial Sequence: Synthetic peptide
KSSQNVLYNSNNNNYLA

SEQ ID NO: 1019 - DNA, 33 bp, Artificial Sequence
  Description of Artificial Sequence: Synthetic oligonucleotide
cgggcaagtcagaacatttatagttatttaaat

SEQ ID NO: 1020 - protein, 11 aa, Artificial Sequence
  Description of Artificial Sequence: Synthetic peptide
RASQNIYSYLN

SEQ ID NO: 1021 - DNA, 33 bp, Artificial Sequence; identical to SEQ ID NO: 133
  Description of Artificial Sequence: Synthetic oligonucleotide

SEQ ID NO: 1022 - protein, 11 aa, Artificial Sequence
  Description of Artificial Sequence: Synthetic peptide
RASQGIRSDLG

SEQ ID NO: 1023 - DNA, 33 bp, Artificial Sequence; identical to SEQ ID NO: 109
  Description of Artificial Sequence: Synthetic oligonucleotide

SEQ ID NO: 1024 - protein, 11 aa, Artificial Sequence
  Description of Artificial Sequence: Synthetic peptide
RASQGIRNDLG

SEQ ID NO: 1025 - DNA, 33 bp, Artificial Sequence; identical to SEQ ID NO: 109
  Description of Artificial Sequence: Synthetic oligonucleotide

SEQ ID NO: 1026 - protein, 11 aa, Artificial Sequence
  Description of Artificial Sequence: Synthetic peptide
RASQGIRNDLG

SEQ ID NO: 1027 - DNA, 33 bp, Artificial Sequence; identical to SEQ ID NO: 109
  Description of Artificial Sequence: Synthetic oligonucleotide

SEQ ID NO: 1028 - protein, 11 aa, Artificial Sequence
  Description of Artificial Sequence: Synthetic peptide
RASQGIRNDLG

SEQ ID NO: 1029 - DNA, 33 bp, Artificial Sequence; identical to SEQ ID NO: 109
  Description of Artificial Sequence: Synthetic oligonucleotide

SEQ ID NO: 1030 - protein, 11 aa, Artificial Sequence
  Description of Artificial Sequence: Synthetic peptide
RASQGIRNDLG

SEQ ID NO: 1031 - DNA, 33 bp, Artificial Sequence
  Description of Artificial Sequence: Synthetic oligonucleotide
tctggagataaattggggaataaatatgcttac

SEQ ID NO: 1032 - protein, 11 aa, Artificial Sequence
  Description of Artificial Sequence: Synthetic peptide
SGDKLGNKYAY

SEQ ID NO: 1033 - DNA, 33 bp, Artificial Sequence; identical to SEQ ID NO: 177
  Description of Artificial Sequence: Synthetic oligonucleotide

SEQ ID NO: 1034 - protein, 11 aa, Artificial Sequence
  Description of Artificial Sequence: Synthetic peptide
SGDKLGDKYVY

SEQ ID NO: 1035 - DNA, 33 bp, Artificial Sequence
  Description of Artificial Sequence: Synthetic oligonucleotide
cggtcaagtcagagcattaacagctatttaaat

SEQ ID NO: 1036 - protein, 11 aa, Artificial Sequence
  Description of Artificial Sequence: Synthetic peptide
RSSQSINSYLN

SEQ ID NO: 1037 - DNA, 33 bp, Artificial Sequence
  Description of Artificial Sequence: Synthetic oligonucleotide
cgggcaagtcagaacattaacgactatttaaat

SEQ ID NO: 1038 - protein, 11 aa, Artificial Sequence
  Description of Artificial Sequence: Synthetic peptide
RASQNINDYLN

SEQ ID NO: 1039 - DNA, 33 bp, Artificial Sequence; identical to SEQ ID NO: 105
  Description of Artificial Sequence: Synthetic oligonucleotide

SEQ ID NO: 1040 - protein, 11 aa, Artificial Sequence
  Description of Artificial Sequence: Synthetic peptide
RASQGISNYLA

SEQ ID NO: 1041 - DNA, 33 bp, Artificial Sequence
  Description of Artificial Sequence: Synthetic oligonucleotide
cggacaagtcagaatattagcaactatttaaat

SEQ ID NO: 1042 - protein, 11 aa, Artificial Sequence
  Description of Artificial Sequence: Synthetic peptide
RTSQNISNYLN

SEQ ID NO: 1043 - DNA, 33 bp, Artificial Sequence
  Description of Artificial Sequence: Synthetic oligonucleotide
cgggcgagtcgggacattagcaattatttagcc

SEQ ID NO: 1044 - protein, 11 aa, Artificial Sequence
  Description of Artificial Sequence: Synthetic peptide
RASRDISNYLA

SEQ ID NO: 1045 - DNA, 33 bp, Artificial Sequence; identical to SEQ ID NO: 109
  Description of Artificial Sequence: Synthetic oligonucleotide

SEQ ID NO: 1046 - protein, 11 aa, Artificial Sequence
  Description of Artificial Sequence: Synthetic peptide
RASQGIRNDLG

SEQ ID NO: 1047 - DNA, 33 bp, Artificial Sequence
  Description of Artificial Sequence: Synthetic oligonucleotide
cgggcaagtcataccattaccagctatttaaat

SEQ ID NO: 1048 - protein, 11 aa, Artificial Sequence
  Description of Artificial Sequence: Synthetic peptide
RASHTITSYLN

SEQ ID NO: 1049 - DNA, 33 bp, Artificial Sequence; identical to SEQ ID NO: 693
  Description of Artificial Sequence: Synthetic oligonucleotide

SEQ ID NO: 1050 - protein, 11 aa, Artificial Sequence
  Description of Artificial Sequence: Synthetic peptide
SGDKLGDKYAC

SEQ ID NO: 1051 - DNA, 33 bp, Artificial Sequence; identical to SEQ ID NO: 1031
  Description of Artificial Sequence: Synthetic oligonucleotide

SEQ ID NO: 1052 - protein, 11 aa, Artificial Sequence
  Description of Artificial Sequence: Synthetic peptide
SGDKLGNKYAY

SEQ ID NO: 1053 - DNA, 33 bp, Artificial Sequence
  Description of Artificial Sequence: Synthetic oligonucleotide
cgggcgagtcagggcattaggaattttttagcc

SEQ ID NO: 1054 - protein, 11 aa, Artificial Sequence
  Description of Artificial Sequence: Synthetic peptide
RASQGIRNFLA

SEQ ID NO: 1055 - DNA, 42 bp, Artificial Sequence
  Description of Artificial Sequence: Synthetic oligonucleotide
actggaaccagcagtgacgttggtggttataactctgtctcc

SEQ ID NO: 1056 - protein, 14 aa, Artificial Sequence
  Description of Artificial Sequence: Synthetic peptide
TGTSSDVGGYNSVS

SEQ ID NO: 1057 - DNA, 51 bp, Artificial Sequence
  Description of Artificial Sequence: Synthetic oligonucleotide
aagtccagccagagtgttttacacagctccaacaataacaactacttagct

SEQ ID NO: 1058 - protein, 17 aa, Artificial Sequence
  Description of Artificial Sequence: Synthetic peptide
KSSQSVLHSSNNNNYLA

SEQ ID NO: 1059 - DNA, 33 bp, Artificial Sequence; identical to SEQ ID NO: 709
  Description of Artificial Sequence: Synthetic oligonucleotide

SEQ ID NO: 1060 - protein, 11 aa, Artificial Sequence
  Description of Artificial Sequence: Synthetic peptide
SGDKLGEKYAC

SEQ ID NO: 1061 - DNA, 33 bp, Artificial Sequence; identical to SEQ ID NO: 283
  Description of Artificial Sequence: Synthetic oligonucleotide

SEQ ID NO: 1062 - protein, 11 aa, Artificial Sequence
  Description of Artificial Sequence: Synthetic peptide
RASQDISNYLA

SEQ ID NO: 1063 - DNA, 33 bp, Artificial Sequence
  Description of Artificial Sequence: Synthetic oligonucleotide
cgggcgagtcagggtattaccaagtggttagcc

SEQ ID NO: 1064 - protein, 11 aa, Artificial Sequence
  Description of Artificial Sequence: Synthetic peptide
RASQGITKWLA

SEQ ID NO: 1065 - DNA, 33 bp, Artificial Sequence
  Description of Artificial Sequence: Synthetic oligonucleotide
tctggagaaaaattgggggataaatatgtttgt

SEQ ID NO: 1066 - protein, 11 aa, Artificial Sequence
  Description of Artificial Sequence: Synthetic peptide
SGEKLGDKYVC

SEQ ID NO: 1067 - DNA, 51 bp, Artificial Sequence
  Description of Artificial Sequence: Synthetic oligonucleotide
aagtccagccagagtattttattcagctccaacaataacaactacttagct

SEQ ID NO: 1068 - protein, 17 aa, Artificial Sequence
  Description of Artificial Sequence: Synthetic peptide
KSSQSILFSSNNNNYLA

SEQ ID NO: 1069 - DNA, 48 bp, Artificial Sequence
  Description of Artificial Sequence: Synthetic oligonucleotide
aggtctagtcaaagcctcgtatacagtgatggaaacacctacttgaat

SEQ ID NO: 1070 - protein, 16 aa, Artificial Sequence
  Description of Artificial Sequence: Synthetic peptide
RSSQSLVYSDGNTYLN

SEQ ID NO: 1071 - DNA, 51 bp, Artificial Sequence
  Description of Artificial Sequence: Synthetic oligonucleotide
aagtccagccagagtgttttatacagctccaacaataagaactacttagct

SEQ ID NO: 1072 - protein, 17 aa, Artificial Sequence
  Description of Artificial Sequence: Synthetic peptide
KSSQSVLYSSNNKNYLA

SEQ ID NO: 1073 - DNA, 51 bp, Artificial Sequence
  Description of Artificial Sequence: Synthetic oligonucleotide
aagtccagccagagtgttttataccactccaacaattacaactacttagct

SEQ ID NO: 1074 - protein, 17 aa, Artificial Sequence
  Description of Artificial Sequence: Synthetic peptide
KSSQSVLYHSNNYNYLA

SEQ ID NO: 1075 - DNA, 51 bp, Artificial Sequence; identical to SEQ ID NO: 1071
  Description of Artificial Sequence: Synthetic oligonucleotide

SEQ ID NO: 1076 - protein, 17 aa, Artificial Sequence
  Description of Artificial Sequence: Synthetic peptide
KSSQSVLYSSNNKNYLA

SEQ ID NO: 1077 - DNA, 33 bp, Artificial Sequence; identical to SEQ ID NO: 95
  Description of Artificial Sequence: Synthetic oligonucleotide

SEQ ID NO: 1078 - protein, 11 aa, Artificial Sequence
  Description of Artificial Sequence: Synthetic peptide
RASQGISKWLA

SEQ ID NO: 1079 - DNA, 51 bp, Artificial Sequence
  Description of Artificial Sequence: Synthetic oligonucleotide
aagtccagccagagtgttttatacagctccaacaattacaactacttagct

SEQ ID NO: 1080 - protein, 17 aa, Artificial Sequence
  Description of Artificial Sequence: Synthetic peptide
KSSQSVLYSSNNYNYLA

SEQ ID NO: 1081 - DNA, 51 bp, Artificial Sequence
  Description of Artificial Sequence: Synthetic oligonucleotide
aagtccagccagagtgttttacacagctccaacaataagaactacttagct

SEQ ID NO: 1082 - protein, 17 aa, Artificial Sequence
  Description of Artificial Sequence: Synthetic peptide
KSSQSVLHSSNNKNYLA

SEQ ID NO: 1083 - DNA, 33 bp, Artificial Sequence; identical to SEQ ID NO: 105
  Description of Artificial Sequence: Synthetic oligonucleotide

SEQ ID NO: 1084 - protein, 11 aa, Artificial Sequence
  Description of Artificial Sequence: Synthetic peptide
RASQGISNYLA

SEQ ID NO: 1085 - DNA, 33 bp, Artificial Sequence
  Description of Artificial Sequence: Synthetic oligonucleotide
cgggcaagtcaggacatgagaagtgatttaggc

SEQ ID NO: 1086 - protein, 11 aa, Artificial Sequence
  Description of Artificial Sequence: Synthetic peptide
RASQDMRSDLG

SEQ ID NO: 1087 - DNA, 48 bp, Artificial Sequence
  Description of Artificial Sequence: Synthetic oligonucleotide
aggtcaagtcaaagcctcgtatacagtgatggaaacacctacttgaat

SEQ ID NO: 1088 - protein, 16 aa, Artificial Sequence
  Description of Artificial Sequence: Synthetic peptide
RSSQSLVYSDGNTYLN

SEQ ID NO: 1089 - DNA, 33 bp, Artificial Sequence
  Description of Artificial Sequence: Synthetic oligonucleotide
cgggcgagtcaggacattagcaattatttggcc

SEQ ID NO: 1090 - protein, 11 aa, Artificial Sequence
  Description of Artificial Sequence: Synthetic peptide
RASQDISNYLA

SEQ ID NO: 1091 - DNA, 33 bp, Artificial Sequence; identical to SEQ ID NO: 493
  Description of Artificial Sequence: Synthetic oligonucleotide

SEQ ID NO: 1092 - protein, 11 aa, Artificial Sequence
  Description of Artificial Sequence: Synthetic peptide
RASQDIRSDLG

SEQ ID NO: 1093 - DNA, 33 bp, Artificial Sequence
  Description of Artificial Sequence: Synthetic oligonucleotide
cgggcaagtcagagcattagaagctatttaaat

SEQ ID NO: 1094 - protein, 11 aa, Artificial Sequence
  Description of Artificial Sequence: Synthetic peptide
RASQSIRSYLN

SEQ ID NO: 1095 - DNA, 51 bp, Artificial Sequence; identical to SEQ ID NO: 1079
  Description of Artificial Sequence: Synthetic oligonucleotide

SEQ ID NO: 1096 - protein, 17 aa, Artificial Sequence
  Description of Artificial Sequence: Synthetic peptide
KSSQSVLYSSNNYNYLA

SEQ ID NO: 1097 - DNA, 33 bp, Artificial Sequence; identical to SEQ ID NO: 493
  Description of Artificial Sequence: Synthetic oligonucleotide

SEQ ID NO: 1098 - protein, 11 aa, Artificial Sequence
  Description of Artificial Sequence: Synthetic peptide
RASQDIRSDLG

SEQ ID NO: 1099 - DNA, 36 bp, Artificial Sequence; identical to SEQ ID NO: 195
  Description of Artificial Sequence: Synthetic oligonucleotide

SEQ ID NO: 1100 - protein, 12 aa, Artificial Sequence
  Description of Artificial Sequence: Synthetic peptide
TLSSEHSTYTIE

SEQ ID NO: 1101 - DNA, 33 bp, Artificial Sequence; identical to SEQ ID NO: 693
  Description of Artificial Sequence: Synthetic oligonucleotide

SEQ ID NO: 1102 - protein, 11 aa, Artificial Sequence
  Description of Artificial Sequence: Synthetic peptide
SGDKLGDKYAC

SEQ ID NO: 1103 - DNA, 33 bp, Artificial Sequence; identical to SEQ ID NO: 109
  Description of Artificial Sequence: Synthetic oligonucleotide

SEQ ID NO: 1104 - protein, 11 aa, Artificial Sequence
  Description of Artificial Sequence: Synthetic peptide
RASQGIRNDLG

SEQ ID NO: 1105 - DNA, 33 bp, Artificial Sequence; identical to SEQ ID NO: 105
  Description of Artificial Sequence: Synthetic oligonucleotide

SEQ ID NO: 1106 - protein, 11 aa, Artificial Sequence
  Description of Artificial Sequence: Synthetic peptide
RASQGISNYLA

SEQ ID NO: 1107 - DNA, 33 bp, Artificial Sequence; identical to SEQ ID NO: 625
  Description of Artificial Sequence: Synthetic oligonucleotide

SEQ ID NO: 1108 - protein, 11 aa, Artificial Sequence
  Description of Artificial Sequence: Synthetic peptide
RASQGISRWLA

SEQ ID NO: 1109 - DNA, 33 bp, Artificial Sequence; identical to SEQ ID NO: 693
  Description of Artificial Sequence: Synthetic oligonucleotide

SEQ ID NO: 1110 - protein, 11 aa, Artificial Sequence
  Description of Artificial Sequence: Synthetic peptide
SGDKLGDKYAC

SEQ ID NO: 1111 - DNA, 33 bp, Artificial Sequence
  Description of Artificial Sequence: Synthetic oligonucleotide
cgggcaagtcagggcattagaaattatttaggc

SEQ ID NO: 1112 - protein, 11 aa, Artificial Sequence
  Description of Artificial Sequence: Synthetic peptide
RASQGIRNYLG

SEQ ID NO: 1113 - DNA, 33 bp, Artificial Sequence; identical to SEQ ID NO: 697
  Description of Artificial Sequence: Synthetic oligonucleotide

SEQ ID NO: 1114 - protein, 11 aa, Artificial Sequence
  Description of Artificial Sequence: Synthetic peptide
SGDKLGEKYAC

SEQ ID NO: 1115 - DNA, 33 bp, Artificial Sequence
  Description of Artificial Sequence: Synthetic oligonucleotide
cgggcgagtcaggacataagtaattatttagcc

SEQ ID NO: 1116 - protein, 11 aa, Artificial Sequence
  Description of Artificial Sequence: Synthetic peptide
RASQDISNYLA

SEQ ID NO: 1117 - DNA, 33 bp, Artificial Sequence; identical to SEQ ID NO: 293
  Description of Artificial Sequence: Synthetic oligonucleotide

SEQ ID NO: 1118 - protein, 11 aa, Artificial Sequence
  Description of Artificial Sequence: Synthetic peptide
RASQGINNYLA

SEQ ID NO: 1119 - DNA, 33 bp, Artificial Sequence
  Description of Artificial Sequence: Synthetic oligonucleotide
cgggcgagtcagggcattgccaattatttagcc

SEQ ID NO: 1120 - protein, 11 aa, Artificial Sequence
  Description of Artificial Sequence: Synthetic peptide
RASQGIANYLA

SEQ ID NO: 1121 - DNA, 33 bp, Artificial Sequence; identical to SEQ ID NO: 109
  Description of Artificial Sequence: Synthetic oligonucleotide

SEQ ID NO: 1122 - protein, 11 aa, Artificial Sequence
  Description of Artificial Sequence: Synthetic peptide
RASQGIRNDLG

SEQ ID NO: 1123 - DNA, 33 bp, Artificial Sequence; identical to SEQ ID NO: 547
  Description of Artificial Sequence: Synthetic oligonucleotide

SEQ ID NO: 1124 - protein, 11 aa, Artificial Sequence
  Description of Artificial Sequence: Synthetic peptide
RASQNIYSYLN

SEQ ID NO: 1125 - DNA, 33 bp, Artificial Sequence
  Description of Artificial Sequence: Synthetic oligonucleotide
cgggcaagtcagggcattaggagtgatttaggc

SEQ ID NO: 1126 - protein, 11 aa, Artificial Sequence
  Description of Artificial Sequence: Synthetic peptide
RASQGIRSDLG

SEQ ID NO: 1127 - DNA, 33 bp, Artificial Sequence; identical to SEQ ID NO: 709
  Description of Artificial Sequence: Synthetic oligonucleotide

SEQ ID NO: 1128 - protein, 11 aa, Artificial Sequence
  Description of Artificial Sequence: Synthetic peptide
SGDKLGEKYAC

SEQ ID NO: 1129 - DNA, 51 bp, Artificial Sequence
  Description of Artificial Sequence: Synthetic oligonucleotide
aagtccagccagagtattttacacagctccaacaataacaactacttagct

SEQ ID NO: 1130 - protein, 17 aa, Artificial Sequence
  Description of Artificial Sequence: Synthetic peptide
KSSQSILHSSNNNNYLA

SEQ ID NO: 1131 - DNA, 51 bp, Artificial Sequence; identical to SEQ ID NO: 1129
  Description of Artificial Sequence: Synthetic oligonucleotide

SEQ ID NO: 1132 - protein, 17 aa, Artificial Sequence
  Description of Artificial Sequence: Synthetic peptide
KSSQSILHSSNNNNYLA

SEQ ID NO: 1133 - DNA, 33 bp, Artificial Sequence; identical to SEQ ID NO: 163
  Description of Artificial Sequence: Synthetic oligonucleotide

SEQ ID NO: 1134 - protein, 11 aa, Artificial Sequence
  Description of Artificial Sequence: Synthetic peptide
SGDKLGDKYAY

SEQ ID NO: 1135 - DNA, 48 bp, Artificial Sequence
  Description of Artificial Sequence: Synthetic oligonucleotide
aggtctagtcaaagcctcatatacagtgatggaaacaccttcttgaat

SEQ ID NO: 1136 - protein, 16 aa, Artificial Sequence
  Description of Artificial Sequence: Synthetic peptide
RSSQSLIYSDGNTFLN

SEQ ID NO: 1137 - DNA, 51 bp, Artificial Sequence
  Description of Artificial Sequence: Synthetic oligonucleotide
aagtccagccagagtgttttacacagctccaacaattataactacttagct

SEQ ID NO: 1138 - protein, 17 aa, Artificial Sequence
  Description of Artificial Sequence: Synthetic peptide
KSSQSVLHSSNNYNYLA

SEQ ID NO: 1139 - DNA, 51 bp, Artificial Sequence; identical to SEQ ID NO: 479
  Description of Artificial Sequence: Synthetic oligonucleotide

SEQ ID NO: 1140 - protein, 17 aa, Artificial Sequence
  Description of Artificial Sequence: Synthetic peptide
KSSQSVLYSSHNNNYLA

SEQ ID NO: 1141 - DNA, 33 bp, Artificial Sequence; identical to SEQ ID NO: 871
  Description of Artificial Sequence: Synthetic oligonucleotide

SEQ ID NO: 1142 - protein, 11 aa, Artificial Sequence
  Description of Artificial Sequence: Synthetic peptide
RASQNIISYLN

SEQ ID NO: 1143 - DNA, 33 bp, Artificial Sequence; identical to SEQ ID NO: 95
  Description of Artificial Sequence: Synthetic oligonucleotide

SEQ ID NO: 1144 - protein, 11 aa, Artificial Sequence
  Description of Artificial Sequence: Synthetic peptide
RASQGISKWLA

SEQ ID NO: 1145 - DNA, 33 bp, Artificial Sequence; identical to SEQ ID NO: 171
  Description of Artificial Sequence: Synthetic oligonucleotide

SEQ ID NO: 1146 - protein, 11 aa, Artificial Sequence
  Description of Artificial Sequence: Synthetic peptide
RASQGISSWLA

SEQ ID NO: 1147 - DNA, 51 bp, Artificial Sequence
  Description of Artificial Sequence: Synthetic oligonucleotide
aagtccagccagactgttttattcagctccaacaataaccactacttagca

SEQ ID NO: 1148 - protein, 17 aa, Artificial Sequence
  Description of Artificial Sequence: Synthetic peptide
KSSQTVLFSSNNNHYLA

SEQ ID NO: 1149 - DNA, 33 bp, Artificial Sequence; identical to SEQ ID NO: 109
  Description of Artificial Sequence: Synthetic oligonucleotide

SEQ ID NO: 1150 - protein, 11 aa, Artificial Sequence
  Description of Artificial Sequence: Synthetic peptide
RASQGIRNDLG

SEQ ID NO: 1151 - DNA, 33 bp, Artificial Sequence; identical to SEQ ID NO: 519
  Description of Artificial Sequence: Synthetic oligonucleotide

SEQ ID NO: 1152 - protein, 11 aa, Artificial Sequence
  Description of Artificial Sequence: Synthetic peptide
RASQAIRNDLG

SEQ ID NO: 1153 - DNA, 33 bp, Artificial Sequence; identical to SEQ ID NO: 547
  Description of Artificial Sequence: Synthetic oligonucleotide

SEQ ID NO: 1154 - protein, 11 aa, Artificial Sequence
  Description of Artificial Sequence: Synthetic peptide
RASQNIYSYLN

SEQ ID NO: 1155 - DNA, 33 bp, Artificial Sequence; identical to SEQ ID NO: 361
  Description of Artificial Sequence: Synthetic oligonucleotide

SEQ ID NO: 1156 - protein, 11 aa, Artificial Sequence
  Description of Artificial Sequence: Synthetic peptide
RASQNIISYLN

SEQ ID NO: 1157 - DNA, 51 bp, Artificial Sequence
  Description of Artificial Sequence: Synthetic oligonucleotide
aagtccagccagagtgttttacacaactccaacaattataactatttagct

SEQ ID NO: 1158 - protein, 17 aa, Artificial Sequence
  Description of Artificial Sequence: Synthetic peptide
KSSQSVLHNSNNYNYLA

SEQ ID NO: 1159 - DNA, 33 bp, Artificial Sequence; identical to SEQ ID NO: 109
  Description of Artificial Sequence: Synthetic oligonucleotide

SEQ ID NO: 1160 - protein, 11 aa, Artificial Sequence
  Description of Artificial Sequence: Synthetic peptide
RASQGIRNDLG

SEQ ID NO: 1161 - DNA, 33 bp, Artificial Sequence
  Description of Artificial Sequence: Synthetic oligonucleotide
cgggcgagtcagggtattagcgactggttagcc

SEQ ID NO: 1162 - protein, 11 aa, Artificial Sequence
  Description of Artificial Sequence: Synthetic peptide
RASQGISDWLA

SEQ ID NO: 1163 - DNA, 33 bp, Artificial Sequence; identical to SEQ ID NO: 109
  Description of Artificial Sequence: Synthetic oligonucleotide

SEQ ID NO: 1164 - protein, 11 aa, Artificial Sequence
  Description of Artificial Sequence: Synthetic peptide
RASQGIRNDLG

SEQ ID NO: 1165 - DNA, 33 bp, Artificial Sequence; identical to SEQ ID NO: 293
  Description of Artificial Sequence: Synthetic oligonucleotide

SEQ ID NO: 1166 - protein, 11 aa, Artificial Sequence
  Description of Artificial Sequence: Synthetic peptide
RASQGINNYLA

SEQ ID NO: 1167 - DNA, 33 bp, Artificial Sequence
  Description of Artificial Sequence: Synthetic oligonucleotide
cgggcgagtcagggtattatcaactggttagcc

SEQ ID NO: 1168 - protein, 11 aa, Artificial Sequence
  Description of Artificial Sequence: Synthetic peptide
RASQGIINWLA

SEQ ID NO: 1169 - DNA, 33 bp, Artificial Sequence; identical to SEQ ID NO: 109
  Description of Artificial Sequence: Synthetic oligonucleotide

SEQ ID NO: 1170 - protein, 11 aa, Artificial Sequence
  Description of Artificial Sequence: Synthetic peptide
RASQGIRNDLG

SEQ ID NO: 1171 - DNA, 51 bp, Artificial Sequence
  Description of Artificial Sequence: Synthetic oligonucleotide
aagtccagccagagtgttttaatgacctccaacgataagaactacttaact

SEQ ID NO: 1172 - protein, 17 aa, Artificial Sequence
  Description of Artificial Sequence: Synthetic peptide
KSSQSVLMTSNDKNYLT

SEQ ID NO: 1173 - DNA, 33 bp, Artificial Sequence; identical to SEQ ID NO: 553
  Description of Artificial Sequence: Synthetic oligonucleotide

SEQ ID NO: 1174 - protein, 11 aa, Artificial Sequence
  Description of Artificial Sequence: Synthetic peptide
RASQGISNWLA

SEQ ID NO: 1175 - DNA, 33 bp, Artificial Sequence; identical to SEQ ID NO: 109
  Description of Artificial Sequence: Synthetic oligonucleotide

SEQ ID NO: 1176 - protein, 11 aa, Artificial Sequence
  Description of Artificial Sequence: Synthetic peptide
RASQGIRNDLG

SEQ ID NO: 1177 - DNA, 33 bp, Artificial Sequence
  Description of Artificial Sequence: Synthetic oligonucleotide
cgggcgagtcaggatattagcagctggttagcc

SEQ ID NO: 1178 - protein, 11 aa, Artificial Sequence
  Description of Artificial Sequence: Synthetic peptide
RASQDISSWLA

SEQ ID NO: 1179 - DNA, 48 bp, Artificial Sequence
  Description of Artificial Sequence: Synthetic oligonucleotide
aagtctagtcagagcctcctgcacagtgatggaaggacctatttgtat

SEQ ID NO: 1180 - protein, 16 aa, Artificial Sequence
  Description of Artificial Sequence: Synthetic peptide
KSSQSLLHSDGRTYLY

SEQ ID NO: 1181 - DNA, 33 bp, Artificial Sequence; identical to SEQ ID NO: 109
  Description of Artificial Sequence: Synthetic oligonucleotide

SEQ ID NO: 1182 - protein, 11 aa, Artificial Sequence
  Description of Artificial Sequence: Synthetic peptide
RASQGIRNDLG

SEQ ID NO: 1183 - DNA, 33 bp, Artificial Sequence; identical to SEQ ID NO: 109
  Description of Artificial Sequence: Synthetic oligonucleotide

SEQ ID NO: 1184 - protein, 11 aa, Artificial Sequence
  Description of Artificial Sequence: Synthetic peptide
RASQGIRNDLG

SEQ ID NO: 1185 - DNA, 33 bp, Artificial Sequence
  Description of Artificial Sequence: Synthetic oligonucleotide
cgggcaagtcagggcattagagatgatttaggc

SEQ ID NO: 1186 - protein, 11 aa, Artificial Sequence
  Description of Artificial Sequence: Synthetic peptide
RASQGIRDDLG

SEQ ID NO: 1187 - DNA, 33 bp, Artificial Sequence; identical to SEQ ID NO: 1161
  Description of Artificial Sequence: Synthetic oligonucleotide

SEQ ID NO: 1188 - protein, 11 aa, Artificial Sequence
  Description of Artificial Sequence: Synthetic peptide
RASQGISDWLA

SEQ ID NO: 1189 - DNA, 33 bp, Artificial Sequence
  Description of Artificial Sequence: Synthetic oligonucleotide
cgggcaagtcaggacattagaaaagatttaggc

SEQ ID NO: 1190 - protein, 11 aa, Artificial Sequence
  Description of Artificial Sequence: Synthetic peptide
RASQDIRKDLG

SEQ ID NO: 1191 - DNA, 36 bp, Artificial Sequence
  Description of Artificial Sequence: Synthetic oligonucleotide
agggccagtcagagtgttagtggaagctacttagcc

SEQ ID NO: 1192 - protein, 12 aa, Artificial Sequence
  Description of Artificial Sequence: Synthetic peptide
RASQSVSGSYLA

SEQ ID NO: 1193 - DNA, 33 bp, Artificial Sequence; identical to SEQ ID NO: 109
  Description of Artificial Sequence: Synthetic oligonucleotide

SEQ ID NO: 1194 - protein, 11 aa, Artificial Sequence
  Description of Artificial Sequence: Synthetic peptide
RASQGIRNDLG

SEQ ID NO: 1195 - DNA, 33 bp, Artificial Sequence; identical to SEQ ID NO: 109
  Description of Artificial Sequence: Synthetic oligonucleotide

SEQ ID NO: 1196 - protein, 11 aa, Artificial Sequence
  Description of Artificial Sequence: Synthetic peptide
RASQGIRNDLG

SEQ ID NO: 1197 - DNA, 48 bp, Artificial Sequence
  Description of Artificial Sequence: Synthetic oligonucleotide
aagtctagtcagagcctcctgcatagtgagggaaggacctatttgtat

SEQ ID NO: 1198 - protein, 16 aa, Artificial Sequence
  Description of Artificial Sequence: Synthetic peptide
KSSQSLLHSEGRTYLY

SEQ ID NO: 1199 - DNA, 33 bp, Artificial Sequence; identical to SEQ ID NO: 1185
  Description of Artificial Sequence: Synthetic oligonucleotide

SEQ ID NO: 1200 - protein, 11 aa, Artificial Sequence
  Description of Artificial Sequence: Synthetic peptide
RASQGIRDDLG

SEQ ID NO: 1201 - DNA, 33 bp, Artificial Sequence; identical to SEQ ID NO: 1161
  Description of Artificial Sequence: Synthetic oligonucleotide

SEQ ID NO: 1202 - protein, 11 aa, Artificial Sequence
  Description of Artificial Sequence: Synthetic peptide
RASQGISDWLA

SEQ ID NO: 1203 - DNA, 48 bp, Artificial Sequence
  Description of Artificial Sequence: Synthetic oligonucleotide
aggtctagtcagagcctcctgcatagtaatggatacagctatttggag

SEQ ID NO: 1204 - protein, 16 aa, Artificial Sequence
  Description of Artificial Sequence: Synthetic peptide
RSSQSLLHSNGYSYLE

SEQ ID NO: 1205 - DNA, 33 bp, Artificial Sequence; identical to SEQ ID NO: 553
  Description of Artificial Sequence: Synthetic oligonucleotide

SEQ ID NO: 1206 - protein, 11 aa, Artificial Sequence
  Description of Artificial Sequence: Synthetic peptide
RASQGISNWLA

SEQ ID NO: 1207 - DNA, 33 bp, Artificial Sequence; identical to SEQ ID NO: 93
  Description of Artificial Sequence: Synthetic oligonucleotide

SEQ ID NO: 1208 - protein, 11 aa, Artificial Sequence
  Description of Artificial Sequence: Synthetic peptide
RTSQGIRNDLG

SEQ ID NO: 1209 - DNA, 33 bp, Artificial Sequence; identical to SEQ ID NO: 109
  Description of Artificial Sequence: Synthetic oligonucleotide

SEQ ID NO: 1210 - protein, 11 aa, Artificial Sequence
  Description of Artificial Sequence: Synthetic peptide
RASQGIRNDLG

SEQ ID NO: 1211 - DNA, 33 bp, Artificial Sequence; identical to SEQ ID NO: 1185
  Description of Artificial Sequence: Synthetic oligonucleotide

SEQ ID NO: 1212 - protein, 11 aa, Artificial Sequence
  Description of Artificial Sequence: Synthetic peptide
RASQGIRDDLG

SEQ ID NO: 1213 - DNA, 33 bp, Artificial Sequence; identical to SEQ ID NO: 1177
  Description of Artificial Sequence: Synthetic oligonucleotide

SEQ ID NO: 1214 - protein, 11 aa, Artificial Sequence
  Description of Artificial Sequence: Synthetic peptide
RASQDISSWLA

SEQ ID NO: 1215 - DNA, 33 bp, Artificial Sequence; identical to SEQ ID NO: 491
  Description of Artificial Sequence: Synthetic oligonucleotide

SEQ ID NO: 1216 - protein, 11 aa, Artificial Sequence
  Description of Artificial Sequence: Synthetic peptide
RASQDIRDDLG

SEQ ID NO: 1217 - DNA, 33 bp, Artificial Sequence; identical to SEQ ID NO: 1161
  Description of Artificial Sequence: Synthetic oligonucleotide

SEQ ID NO: 1218 - protein, 11 aa, Artificial Sequence
  Description of Artificial Sequence: Synthetic peptide
RASQGISDWLA

SEQ ID NO: 1219 - DNA, 33 bp, Artificial Sequence
  Description of Artificial Sequence: Synthetic oligonucleotide
cgggcgagtcaggatattagcgactggttagct

SEQ ID NO: 1220 - protein, 11 aa, Artificial Sequence
  Description of Artificial Sequence: Synthetic peptide
RASQDISDWLA

SEQ ID NO: 1221 - DNA, 33 bp, Artificial Sequence; identical to SEQ ID NO: 293
  Description of Artificial Sequence: Synthetic oligonucleotide

SEQ ID NO: 1222 - protein, 11 aa, Artificial Sequence
  Description of Artificial Sequence: Synthetic peptide
RASQGINNYLA

SEQ ID NO: 1223 - DNA, 33 bp, Artificial Sequence; identical to SEQ ID NO: 109
  Description of Artificial Sequence: Synthetic oligonucleotide

SEQ ID NO: 1224 - protein, 11 aa, Artificial Sequence
  Description of Artificial Sequence: Synthetic peptide
RASQGIRNDLG

SEQ ID NO: 1225 - DNA, 48 bp, Artificial Sequence
  Description of Artificial Sequence: Synthetic oligonucleotide
aagtctagtcagagcctcctgcatggtgatggaaagacatatttgtat

SEQ ID NO: 1226 - protein, 16 aa, Artificial Sequence
  Description of Artificial Sequence: Synthetic peptide
KSSQSLLHGDGKTYLY

SEQ ID NO: 1227 - DNA, 33 bp, Artificial Sequence; identical to SEQ ID NO: 1185
  Description of Artificial Sequence: Synthetic oligonucleotide

SEQ ID NO: 1228 - protein, 11 aa, Artificial Sequence
  Description of Artificial Sequence: Synthetic peptide
RASQGIRDDLG

SEQ ID NO: 1229 - DNA, 33 bp, Artificial Sequence
  Description of Artificial Sequence: Synthetic oligonucleotide
cgggcaagtcagggcattagaaaagatttaggc

SEQ ID NO: 1230 - protein, 11 aa, Artificial Sequence
  Description of Artificial Sequence: Synthetic peptide
RASQGIRKDLG

SEQ ID NO: 1231 - DNA, 33 bp, Artificial Sequence
  Description of Artificial Sequence: Synthetic oligonucleotide
cggacaagtcaggacattagaaaagatttaggc

SEQ ID NO: 1232 - protein, 11 aa, Artificial Sequence
  Description of Artificial Sequence: Synthetic peptide
RTSQDIRKDLG

SEQ ID NO: 1233 - DNA, 33 bp, Artificial Sequence; identical to SEQ ID NO: 553
  Description of Artificial Sequence: Synthetic oligonucleotide

SEQ ID NO: 1234 - protein, 11 aa, Artificial Sequence
  Description of Artificial Sequence: Synthetic peptide
RASQGISNWLA

SEQ ID NO: 1235 - DNA, 33 bp, Artificial Sequence; identical to SEQ ID NO: 109
  Description of Artificial Sequence: Synthetic oligonucleotide

SEQ ID NO: 1236 - protein, 11 aa, Artificial Sequence
  Description of Artificial Sequence: Synthetic peptide
RASQGIRNDLG

SEQ ID NO: 1237 - DNA, 33 bp, Artificial Sequence; identical to SEQ ID NO: 1229
  Description of Artificial Sequence: Synthetic oligonucleotide

SEQ ID NO: 1238 - protein, 11 aa, Artificial Sequence
  Description of Artificial Sequence: Synthetic peptide
RASQGIRKDLG

SEQ ID NO: 1239 - DNA, 48 bp, Artificial Sequence; identical to SEQ ID NO: 555
  Description of Artificial Sequence: Synthetic oligonucleotide

SEQ ID NO: 1240 - protein, 16 aa, Artificial Sequence
  Description of Artificial Sequence: Synthetic peptide
KSSQSLLHSEGKTYLY

SEQ ID NO: 1241 - DNA, 33 bp, Artificial Sequence; identical to SEQ ID NO: 109
  Description of Artificial Sequence: Synthetic oligonucleotide

SEQ ID NO: 1242 - protein, 11 aa, Artificial Sequence
  Description of Artificial Sequence: Synthetic peptide
RASQGIRNDLG

SEQ ID NO: 1243 - DNA, 33 bp, Artificial Sequence; identical to SEQ ID NO: 205
  Description of Artificial Sequence: Synthetic oligonucleotide

SEQ ID NO: 1244 - protein, 11 aa, Artificial Sequence
  Description of Artificial Sequence: Synthetic peptide
RASQDIRNDLG

SEQ ID NO: 1245 - DNA, 48 bp, Artificial Sequence
  Description of Artificial Sequence: Synthetic oligonucleotide
acgtctagtcagagcctcctgcatagtgaaggaaagacctatttgtat

SEQ ID NO: 1246 - protein, 16 aa, Artificial Sequence
  Description of Artificial Sequence: Synthetic peptide
TSSQSLLHSEGKTYLY

SEQ ID NO: 1247 - DNA, 33 bp, Artificial Sequence; identical to SEQ ID NO: 109
  Description of Artificial Sequence: Synthetic oligonucleotide

SEQ ID NO: 1248 - protein, 11 aa, Artificial Sequence
  Description of Artificial Sequence: Synthetic peptide
RASQGIRNDLG

SEQ ID NO: 1249 - DNA, 48 bp, Artificial Sequence
  Description of Artificial Sequence: Synthetic oligonucleotide
aggtctagtcagagcctcctgcatagtaatggatacaactatttggaa

SEQ ID NO: 1250 - protein, 16 aa, Artificial Sequence
  Description of Artificial Sequence: Synthetic peptide
RSSQSLLHSNGYNYLE

SEQ ID NO: 1251 - DNA, 48 bp, Artificial Sequence
  Description of Artificial Sequence: Synthetic oligonucleotide
aagtctagtcagagcctcctgcatagtgatggaaggacctatttgtat

SEQ ID NO: 1252 - protein, 16 aa, Artificial Sequence
  Description of Artificial Sequence: Synthetic peptide
KSSQSLLHSDGRTYLY

SEQ ID NO: 1253 - DNA, 33 bp, Artificial Sequence; identical to SEQ ID NO: 553
  Description of Artificial Sequence: Synthetic oligonucleotide

SEQ ID NO: 1254 - protein, 11 aa, Artificial Sequence
  Description of Artificial Sequence: Synthetic peptide
RASQGISNWLA

SEQ ID NO: 1255 - DNA, 33 bp, Artificial Sequence; identical to SEQ ID NO: 93
  Description of Artificial Sequence: Synthetic oligonucleotide

SEQ ID NO: 1256 - protein, 11 aa, Artificial Sequence
  Description of Artificial Sequence: Synthetic peptide
RTSQGIRNDLG

SEQ ID NO: 1257 - DNA, 33 bp, Artificial Sequence; identical to SEQ ID NO: 93
  Description of Artificial Sequence: Synthetic oligonucleotide

SEQ ID NO: 1258 - protein, 11 aa, Artificial Sequence
  Description of Artificial Sequence: Synthetic peptide
RTSQGIRNDLG

SEQ ID NO: 1259 - DNA, 33 bp, Artificial Sequence
  Description of Artificial Sequence: Synthetic oligonucleotide
cgggcaagtcagagcattagcagctatttaatt

SEQ ID NO: 1260 - protein, 11 aa, Artificial Sequence
  Description of Artificial Sequence: Synthetic peptide
RASQSISSYLI

SEQ ID NO: 1261 - DNA, 33 bp, Artificial Sequence; identical to SEQ ID NO: 147
  Description of Artificial Sequence: Synthetic oligonucleotide

SEQ ID NO: 1262 - protein, 11 aa, Artificial Sequence
  Description of Artificial Sequence: Synthetic peptide
RASRGIRDDLG

SEQ ID NO: 1263 - DNA, 33 bp, Artificial Sequence
  Description of Artificial Sequence: Synthetic oligonucleotide
cgggcaagtcagagcattatcagctatttaatt

SEQ ID NO: 1264 - protein, 11 aa, Artificial Sequence
  Description of Artificial Sequence: Synthetic peptide
RASQSIISYLI

SEQ ID NO: 1265 - DNA, 33 bp, Artificial Sequence
  Description of Artificial Sequence: Synthetic oligonucleotide
cgggcgagtcaaaatattaccagctggttagcc

SEQ ID NO: 1266 - protein, 11 aa, Artificial Sequence
  Description of Artificial Sequence: Synthetic peptide
RASQNITSWLA

SEQ ID NO: 1267 - DNA, 33 bp, Artificial Sequence; identical to SEQ ID NO: 109
  Description of Artificial Sequence: Synthetic oligonucleotide

SEQ ID NO: 1268 - protein, 11 aa, Artificial Sequence
  Description of Artificial Sequence: Synthetic peptide
RASQGIRNDLG

SEQ ID NO: 1269 - DNA, 33 bp, Artificial Sequence
  Description of Artificial Sequence: Synthetic oligonucleotide
cgggcaagtcagagcattaggaagtatttaaat

SEQ ID NO: 1270 - protein, 11 aa, Artificial Sequence
  Description of Artificial Sequence: Synthetic peptide
RASQSIRKYLN

SEQ ID NO: 1271 - DNA, 33 bp, Artificial Sequence; identical to SEQ ID NO: 109
  Description of Artificial Sequence: Synthetic oligonucleotide

SEQ ID NO: 1272 - protein, 11 aa, Artificial Sequence
  Description of Artificial Sequence: Synthetic peptide
RASQGIRNDLG

SEQ ID NO: 1273 - DNA, 33 bp, Artificial Sequence; identical to SEQ ID NO: 1269
  Description of Artificial Sequence: Synthetic oligonucleotide

SEQ ID NO: 1274 - protein, 11 aa, Artificial Sequence
  Description of Artificial Sequence: Synthetic peptide
RASQSIRKYLN

SEQ ID NO: 1275 - DNA, 33 bp, Artificial Sequence; identical to SEQ ID NO: 1269
  Description of Artificial Sequence: Synthetic oligonucleotide

SEQ ID NO: 1276 - protein, 11 aa, Artificial Sequence
  Description of Artificial Sequence: Synthetic peptide
RASQSIRKYLN

SEQ ID NO: 1277 - DNA, 33 bp, Artificial Sequence; identical to SEQ ID NO: 371
  Description of Artificial Sequence: Synthetic oligonucleotide

SEQ ID NO: 1278 - protein, 11 aa, Artificial Sequence
  Description of Artificial Sequence: Synthetic peptide
RASQGIRNDLD

SEQ ID NO: 1279 - DNA, 48 bp, Artificial Sequence
  Description of Artificial Sequence: Synthetic oligonucleotide
aagtctagtcagagcctcctgcatagggaaggaaagacctatttgtac

SEQ ID NO: 1280 - protein, 16 aa, Artificial Sequence
  Description of Artificial Sequence: Synthetic peptide
KSSQSLLHREGKTYLY

SEQ ID NO: 1281 - DNA, 33 bp, Artificial Sequence
  Description of Artificial Sequence: Synthetic oligonucleotide
cgggcgagtcgggatattaacggctggttagcc

SEQ ID NO: 1282 - protein, 11 aa, Artificial Sequence
  Description of Artificial Sequence: Synthetic peptide
RASRDINGWLA

SEQ ID NO: 1283 - DNA, 48 bp, Artificial Sequence; identical to SEQ ID NO: 103
  Description of Artificial Sequence: Synthetic oligonucleotide

SEQ ID NO: 1284 - protein, 16 aa, Artificial Sequence
  Description of Artificial Sequence: Synthetic peptide
KSSQSLLHSEGKTYLY

SEQ ID NO: 1285 - DNA, 33 bp, Artificial Sequence
  Description of Artificial Sequence: Synthetic oligonucleotide
cgggcgagtcagggttttagcacctggttagcc

SEQ ID NO: 1286 - protein, 11 aa, Artificial Sequence
  Description of Artificial Sequence: Synthetic peptide
RASQGFSTWLA

SEQ ID NO: 1287 - DNA, 33 bp, Artificial Sequence; identical to SEQ ID NO: 109
  Description of Artificial Sequence: Synthetic oligonucleotide

SEQ ID NO: 1288 - protein, 11 aa, Artificial Sequence
  Description of Artificial Sequence: Synthetic peptide
RASQGIRNDLG

SEQ ID NO: 1289 - DNA, 48 bp, Artificial Sequence
  Description of Artificial Sequence: Synthetic oligonucleotide
aagtctagtcagatcttcttgcatagtgaaggaaagacctatttgtat

SEQ ID NO: 1290 - protein, 16 aa, Artificial Sequence
  Description of Artificial Sequence: Synthetic peptide
KSSQIFLHSEGKTYLY

SEQ ID NO: 1291 - DNA, 48 bp, Artificial Sequence
  Description of Artificial Sequence: Synthetic oligonucleotide
aagtctaatcagagcctcgtgcataatgaaggaaagacctatttgtat

SEQ ID NO: 1292 - protein, 16 aa, Artificial Sequence
  Description of Artificial Sequence: Synthetic peptide
KSNQSLVHNEGKTYLY

SEQ ID NO: 1293 - DNA, 33 bp, Artificial Sequence; identical to SEQ ID NO: 173
  Description of Artificial Sequence: Synthetic oligonucleotide

SEQ ID NO: 1294 - protein, 11 aa, Artificial Sequence
  Description of Artificial Sequence: Synthetic peptide
RASQGISRWLA

SEQ ID NO: 1295 - DNA, 33 bp, Artificial Sequence
  Description of Artificial Sequence: Synthetic oligonucleotide
cggtcaagtcagagcattagtacctatttaatg

SEQ ID NO: 1296 - protein, 11 aa, Artificial Sequence
  Description of Artificial Sequence: Synthetic peptide
RSSQSISTYLM

SEQ ID NO: 1297 - DNA, 33 bp, Artificial Sequence; identical to SEQ ID NO: 109
  Description of Artificial Sequence: Synthetic oligonucleotide

SEQ ID NO: 1298 - protein, 11 aa, Artificial Sequence
  Description of Artificial Sequence: Synthetic peptide
RASQGIRNDLG

SEQ ID NO: 1299 - DNA, 33 bp, Artificial Sequence; identical to SEQ ID NO: 1259
  Description of Artificial Sequence: Synthetic oligonucleotide

SEQ ID NO: 1300 - protein, 11 aa, Artificial Sequence
  Description of Artificial Sequence: Synthetic peptide
RASQSISSYLI

SEQ ID NO: 1301 - DNA, 33 bp, Artificial Sequence
  Description of Artificial Sequence: Synthetic oligonucleotide
cgggcaagtcagggcattagaaataatttaggc

SEQ ID NO: 1302 - protein, 11 aa, Artificial Sequence
  Description of Artificial Sequence: Synthetic peptide
RASQGIRNNLG

SEQ ID NO: 1303 - DNA, 33 bp, Artificial Sequence
  Description of Artificial Sequence: Synthetic oligonucleotide
cgggcaagtcagagcatttacagctatttaatt

SEQ ID NO: 1304 - protein, 11 aa, Artificial Sequence
  Description of Artificial Sequence: Synthetic peptide
RASQSIYSYLI

SEQ ID NO: 1305 - DNA, 33 bp, Artificial Sequence; identical to SEQ ID NO: 109
  Description of Artificial Sequence: Synthetic oligonucleotide

SEQ ID NO: 1306 - protein, 11 aa, Artificial Sequence
  Description of Artificial Sequence: Synthetic peptide
RASQGIRNDLG

SEQ ID NO: 1307 - DNA, 33 bp, Artificial Sequence; identical to SEQ ID NO: 289
  Description of Artificial Sequence: Synthetic oligonucleotide

SEQ ID NO: 1308 - protein, 11 aa, Artificial Sequence
  Description of Artificial Sequence: Synthetic peptide
RASQSISSYLN

SEQ ID NO: 1309 - DNA, 48 bp, Artificial Sequence; identical to SEQ ID NO: 555
  Description of Artificial Sequence: Synthetic oligonucleotide

SEQ ID NO: 1310 - protein, 16 aa, Artificial Sequence
  Description of Artificial Sequence: Synthetic peptide
KSSQSLLHSEGKTYLY

SEQ ID NO: 1311 - DNA, 33 bp, Artificial Sequence
  Description of Artificial Sequence: Synthetic oligonucleotide
caggcgagtcgggacattaccttctatttaaat

SEQ ID NO: 1312 - protein, 11 aa, Artificial Sequence
  Description of Artificial Sequence: Synthetic peptide
QASRDITFYLN

SEQ ID NO: 1313 - DNA, 33 bp, Artificial Sequence; identical to SEQ ID NO: 109
  Description of Artificial Sequence: Synthetic oligonucleotide

SEQ ID NO: 1314 - protein, 11 aa, Artificial Sequence
  Description of Artificial Sequence: Synthetic peptide
RASQGIRNDLG

SEQ ID NO: 1315 - DNA, 33 bp, Artificial Sequence; identical to SEQ ID NO: 105
  Description of Artificial Sequence: Synthetic oligonucleotide

SEQ ID NO: 1316 - protein, 11 aa, Artificial Sequence
  Description of Artificial Sequence: Synthetic peptide
RASQGISNYLA

SEQ ID NO: 1317 - DNA, 33 bp, Artificial Sequence
  Description of Artificial Sequence: Synthetic oligonucleotide
cgggcgagtcaggatgttaacaactacttagcc

SEQ ID NO: 1318 - protein, 11 aa, Artificial Sequence
  Description of Artificial Sequence: Synthetic peptide
RASQDVNNYLA

SEQ ID NO: 1319 - DNA, 33 bp, Artificial Sequence
  Description of Artificial Sequence: Synthetic oligonucleotide
cgggcgagtcaggatattagcagttggttagcc

SEQ ID NO: 1320 - protein, 11 aa, Artificial Sequence
  Description of Artificial Sequence: Synthetic peptide
RASQDISSWLA

SEQ ID NO: 1321 - DNA, 33 bp, Artificial Sequence; identical to SEQ ID NO: 173
  Description of Artificial Sequence: Synthetic oligonucleotide

SEQ ID NO: 1322 - protein, 11 aa, Artificial Sequence
  Description of Artificial Sequence: Synthetic peptide
RASQGISRWLA

SEQ ID NO: 1323 - DNA, 33 bp, Artificial Sequence
  Description of Artificial Sequence: Synthetic oligonucleotide
cgggcaagtcagggcattagaaatgatttgggc

SEQ ID NO: 1324 - protein, 11 aa, Artificial Sequence
  Description of Artificial Sequence: Synthetic peptide
RASQGIRNDLG

SEQ ID NO: 1325 - DNA, 33 bp, Artificial Sequence
  Description of Artificial Sequence: Synthetic oligonucleotide
cgggcgagtcagggtattagcagttggttagcc

SEQ ID NO: 1326 - protein, 11 aa, Artificial Sequence
  Description of Artificial Sequence: Synthetic peptide
RASQGISSWLA

SEQ ID NO: 1327 - DNA, 33 bp, Artificial Sequence
  Description of Artificial Sequence: Synthetic oligonucleotide
cgggcaagtcagggcattaggactgatttaggc

SEQ ID NO: 1328 - protein, 11 aa, Artificial Sequence
  Description of Artificial Sequence: Synthetic peptide
RASQGIRTDLG

SEQ ID NO: 1329 - DNA, 33 bp, Artificial Sequence
  Description of Artificial Sequence: Synthetic oligonucleotide
cgggcaagtcagagcattagtacctatttaatg

SEQ ID NO: 1330 - protein, 11 aa, Artificial Sequence
  Description of Artificial Sequence: Synthetic peptide
RASQSISTYLM

SEQ ID NO: 1331 - DNA, 33 bp, Artificial Sequence; identical to SEQ ID NO: 93
  Description of Artificial Sequence: Synthetic oligonucleotide

SEQ ID NO: 1332 - protein, 11 aa, Artificial Sequence
  Description of Artificial Sequence: Synthetic peptide
RTSQGIRNDLG

SEQ ID NO: 1333 - DNA, 33 bp, Artificial Sequence; identical to SEQ ID NO: 109
  Description of Artificial Sequence: Synthetic oligonucleotide

SEQ ID NO: 1334 - protein, 11 aa, Artificial Sequence
  Description of Artificial Sequence: Synthetic peptide
RASQGIRNDLG

SEQ ID NO: 1335 - DNA, 33 bp, Artificial Sequence
  Description of Artificial Sequence: Synthetic oligonucleotide
cgggcgagtcaggatattcgcacctggttagcc

SEQ ID NO: 1336 - protein, 11 aa, Artificial Sequence
  Description of Artificial Sequence: Synthetic peptide
RASQDIRTWLA

SEQ ID NO: 1337 - DNA, 33 bp, Artificial Sequence; identical to SEQ ID NO: 109
  Description of Artificial Sequence: Synthetic oligonucleotide

SEQ ID NO: 1338 - protein, 11 aa, Artificial Sequence
  Description of Artificial Sequence: Synthetic peptide
RASQGIRNDLG

SEQ ID NO: 1339 - DNA, 33 bp, Artificial Sequence
  Description of Artificial Sequence: Synthetic oligonucleotide
cgggcgagtcagaatattaccaactggttagcc

SEQ ID NO: 1340 - protein, 11 aa, Artificial Sequence
  Description of Artificial Sequence: Synthetic peptide
RASQNITNWLA

SEQ ID NO: 1341 - DNA, 33 bp, Artificial Sequence; identical to SEQ ID NO: 105
  Description of Artificial Sequence: Synthetic oligonucleotide

SEQ ID NO: 1342 - protein, 11 aa, Artificial Sequence
  Description of Artificial Sequence: Synthetic peptide
RASQGISNYLA

SEQ ID NO: 1343 - DNA, 33 bp, Artificial Sequence
  Description of Artificial Sequence: Synthetic oligonucleotide
caggcgagtcaggacattagtaactatttacat

SEQ ID NO: 1344 - protein, 11 aa, Artificial Sequence
  Description of Artificial Sequence: Synthetic peptide
QASQDISNYLH

SEQ ID NO: 1345 - DNA, 33 bp, Artificial Sequence; identical to SEQ ID NO: 109
  Description of Artificial Sequence: Synthetic oligonucleotide

SEQ ID NO: 1346 - protein, 11 aa, Artificial Sequence
  Description of Artificial Sequence: Synthetic peptide
RASQGIRNDLG

SEQ ID NO: 1347 - DNA, 48 bp, Artificial Sequence; identical to SEQ ID NO: 103
  Description of Artificial Sequence: Synthetic oligonucleotide

SEQ ID NO: 1348 - protein, 16 aa, Artificial Sequence
  Description of Artificial Sequence: Synthetic peptide
KSSQSLLHSEGKTYLY

SEQ ID NO: 1349 - DNA, 33 bp, Artificial Sequence
  Description of Artificial Sequence: Synthetic oligonucleotide
cgggcgagtcagggtattagtaattatttaggc

SEQ ID NO: 1350 - protein, 11 aa, Artificial Sequence
  Description of Artificial Sequence: Synthetic peptide
RASQGISNYLG

SEQ ID NO: 1351 - DNA, 33 bp, Artificial Sequence
  Description of Artificial Sequence: Synthetic oligonucleotide
cgggcgagtcaggatattaacagttggttagcc

SEQ ID NO: 1352 - protein, 11 aa, Artificial Sequence
  Description of Artificial Sequence: Synthetic peptide
RASQDINSWLA

SEQ ID NO: 1353 - DNA, 33 bp, Artificial Sequence
  Description of Artificial Sequence: Synthetic oligonucleotide
cgggcaagtcagggcataagaaataatttaggc

SEQ ID NO: 1354 - protein, 11 aa, Artificial Sequence
  Description of Artificial Sequence: Synthetic peptide
RASQGIRNNLG

SEQ ID NO: 1355 - DNA, 33 bp, Artificial Sequence; identical to SEQ ID NO: 109
  Description of Artificial Sequence: Synthetic oligonucleotide

SEQ ID NO: 1356 - protein, 11 aa, Artificial Sequence
  Description of Artificial Sequence: Synthetic peptide
RASQGIRNDLG

SEQ ID NO: 1357 - DNA, 33 bp, Artificial Sequence; identical to SEQ ID NO: 109
  Description of Artificial Sequence: Synthetic oligonucleotide

SEQ ID NO: 1358 - protein, 11 aa, Artificial Sequence
  Description of Artificial Sequence: Synthetic peptide
RASQGIRNDLG

SEQ ID NO: 1359 - DNA, 33 bp, Artificial Sequence
  Description of Artificial Sequence: Synthetic oligonucleotide
cgggcaagtcagagttttagccactatttaaat

SEQ ID NO: 1360 - protein, 11 aa, Artificial Sequence
  Description of Artificial Sequence: Synthetic peptide
RASQSFSHYLN

SEQ ID NO: 1361 - DNA, 33 bp, Artificial Sequence
  Description of Artificial Sequence: Synthetic oligonucleotide
caggcgagtcaggacattagcaactatttacat

SEQ ID NO: 1362 - protein, 11 aa, Artificial Sequence
  Description of Artificial Sequence: Synthetic peptide
QASQDISNYLH

SEQ ID NO: 1363 - DNA, 33 bp, Artificial Sequence
  Description of Artificial Sequence: Synthetic oligonucleotide
cgggcgagtcaggtcattagcaattatttagcc

SEQ ID NO: 1364 - protein, 11 aa, Artificial Sequence
  Description of Artificial Sequence: Synthetic peptide
RASQVISNYLA

SEQ ID NO: 1365 - DNA, 33 bp, Artificial Sequence
  Description of Artificial Sequence: Synthetic oligonucleotide
cgggcaagtcagtacagtagcgactatttaaat

SEQ ID NO: 1366 - protein, 11 aa, Artificial Sequence
  Description of Artificial Sequence: Synthetic peptide
RASQYSSDYLN

SEQ ID NO: 1367 - DNA, 33 bp, Artificial Sequence; identical to SEQ ID NO: 109
  Description of Artificial Sequence: Synthetic oligonucleotide

SEQ ID NO: 1368 - protein, 11 aa, Artificial Sequence
  Description of Artificial Sequence: Synthetic peptide
RASQGIRNDLG

SEQ ID NO: 1369 - DNA, 33 bp, Artificial Sequence
  Description of Artificial Sequence: Synthetic oligonucleotide
caggcgagtcaagacattaccaactatttagat

SEQ ID NO: 1370 - protein, 11 aa, Artificial Sequence
  Description of Artificial Sequence: Synthetic peptide
QASQDITNYLD

SEQ ID NO: 1371 - DNA, 33 bp, Artificial Sequence; identical to SEQ ID NO: 173
  Description of Artificial Sequence: Synthetic oligonucleotide

SEQ ID NO: 1372 - protein, 11 aa, Artificial Sequence
  Description of Artificial Sequence: Synthetic peptide
RASQGISRWLA

SEQ ID NO: 1373 - DNA, 36 bp, Artificial Sequence
  Description of Artificial Sequence: Synthetic oligonucleotide
agggccagtcagagtattacaagcagctacttagcc

SEQ ID NO: 1374 - protein, 12 aa, Artificial Sequence
  Description of Artificial Sequence: Synthetic peptide
RASQSITSSYLA

SEQ ID NO: 1375 - DNA, 33 bp, Artificial Sequence; identical to SEQ ID NO: 109
  Description of Artificial Sequence: Synthetic oligonucleotide

SEQ ID NO: 1376 - protein, 11 aa, Artificial Sequence
  Description of Artificial Sequence: Synthetic peptide
RASQGIRNDLG

SEQ ID NO: 1377 - DNA, 33 bp, Artificial Sequence; identical to SEQ ID NO: 109
  Description of Artificial Sequence: Synthetic oligonucleotide

SEQ ID NO: 1378 - protein, 11 aa, Artificial Sequence
  Description of Artificial Sequence: Synthetic peptide
RASQGIRNDLG

SEQ ID NO: 1379 - DNA, 33 bp, Artificial Sequence; identical to SEQ ID NO: 171
  Description of Artificial Sequence: Synthetic oligonucleotide

SEQ ID NO: 1380 - protein, 11 aa, Artificial Sequence
  Description of Artificial Sequence: Synthetic peptide
RASQGISSWLA

SEQ ID NO: 1381 - DNA, 33 bp, Artificial Sequence
  Description of Artificial Sequence: Synthetic oligonucleotide
cgggcaagtcaggacattagaaatattttaggc

SEQ ID NO: 1382 - protein, 11 aa, Artificial Sequence
  Description of Artificial Sequence: Synthetic peptide
RASQDIRNILG

SEQ ID NO: 1383 - DNA, 48 bp, Artificial Sequence; identical to SEQ ID NO: 555
  Description of Artificial Sequence: Synthetic oligonucleotide

SEQ ID NO: 1384 - protein, 16 aa, Artificial Sequence
  Description of Artificial Sequence: Synthetic peptide
KSSQSLLHSEGKTYLY

SEQ ID NO: 1385 - DNA, 33 bp, Artificial Sequence; identical to SEQ ID NO: 109
  Description of Artificial Sequence: Synthetic oligonucleotide

SEQ ID NO: 1386 - protein, 11 aa, Artificial Sequence
  Description of Artificial Sequence: Synthetic peptide
RASQGIRNDLG

SEQ ID NO: 1387 - DNA, 33 bp, Artificial Sequence; identical to SEQ ID NO: 109
  Description of Artificial Sequence: Synthetic oligonucleotide

SEQ ID NO: 1388 - protein, 11 aa, Artificial Sequence
  Description of Artificial Sequence: Synthetic peptide
RASQGIRNDLG

SEQ ID NO: 1389 - DNA, 33 bp, Artificial Sequence
  Description of Artificial Sequence: Synthetic oligonucleotide
cgggcgagtcaggttattagccgctggttagcc

SEQ ID NO: 1390 - protein, 11 aa, Artificial Sequence
  Description of Artificial Sequence: Synthetic peptide
RASQVISRWLA

SEQ ID NO: 1391 - DNA, 33 bp, Artificial Sequence
  Description of Artificial Sequence: Synthetic oligonucleotide
agggccagtcagagtgttagcagcgacttagcc

SEQ ID NO: 1392 - protein, 11 aa, Artificial Sequence
  Description of Artificial Sequence: Synthetic peptide
RASQSVSSDLA

SEQ ID NO: 1393 - DNA, 48 bp, Artificial Sequence
  Description of Artificial Sequence: Synthetic oligonucleotide
aaatctagtcagagcctcctgcatagtgaaggaaagacctatttgtat

SEQ ID NO: 1394 - protein, 16 aa, Artificial Sequence
  Description of Artificial Sequence: Synthetic peptide
KSSQSLLHSEGKTYLY

SEQ ID NO: 1395 - DNA, 48 bp, Artificial Sequence
  Description of Artificial Sequence: Synthetic oligonucleotide
aagtctagtcagagcctcgtgcatagtgaaggaaagacctatttgtat

SEQ ID NO: 1396 - protein, 16 aa, Artificial Sequence
  Description of Artificial Sequence: Synthetic peptide
KSSQSLVHSEGKTYLY

SEQ ID NO: 1397 - DNA, 33 bp, Artificial Sequence; identical to SEQ ID NO: 109
  Description of Artificial Sequence: Synthetic oligonucleotide

SEQ ID NO: 1398 - protein, 11 aa, Artificial Sequence
  Description of Artificial Sequence: Synthetic peptide
RASQGIRNDLG

SEQ ID NO: 1399 - DNA, 33 bp, Artificial Sequence
  Description of Artificial Sequence: Synthetic oligonucleotide
cgggcgagtcaggacattagcaattatttaatc

SEQ ID NO: 1400 - protein, 11 aa, Artificial Sequence
  Description of Artificial Sequence: Synthetic peptide
RASQDISNYLI

SEQ ID NO: 1401 - DNA, 33 bp, Artificial Sequence; identical to SEQ ID NO: 519
  Description of Artificial Sequence: Synthetic oligonucleotide

SEQ ID NO: 1402 - protein, 11 aa, Artificial Sequence
  Description of Artificial Sequence: Synthetic peptide
RASQAIRNDLG

SEQ ID NO: 1403 - DNA, 48 bp, Artificial Sequence
  Description of Artificial Sequence: Synthetic oligonucleotide
aagtctagtcaaagcctcctgcatagtgaaggaaagacctatttgtat

SEQ ID NO: 1404 - protein, 16 aa, Artificial Sequence
  Description of Artificial Sequence: Synthetic peptide
KSSQSLLHSEGKTYLY

SEQ ID NO: 1405 - DNA, 33 bp, Artificial Sequence
  Description of Artificial Sequence: Synthetic oligonucleotide
caggcgagtcaagacattagcaactatttagat

SEQ ID NO: 1406 - protein, 11 aa, Artificial Sequence
  Description of Artificial Sequence: Synthetic peptide
QASQDISNYLD

SEQ ID NO: 1407 - DNA, 33 bp, Artificial Sequence
  Description of Artificial Sequence: Synthetic oligonucleotide
cgggcaagtcagagcattctcagctatttgaat

SEQ ID NO: 1408 - protein, 11 aa, Artificial Sequence
  Description of Artificial Sequence: Synthetic peptide
RASQSILSYLN

SEQ ID NO: 1409 - DNA, 33 bp, Artificial Sequence
  Description of Artificial Sequence: Synthetic oligonucleotide
cgggcgagtcaggatattagcagctggttggcc

SEQ ID NO: 1410 - protein, 11 aa, Artificial Sequence
  Description of Artificial Sequence: Synthetic peptide
RASQDISSWLA

SEQ ID NO: 1411 - DNA, 33 bp, Artificial Sequence; identical to SEQ ID NO: 109
  Description of Artificial Sequence: Synthetic oligonucleotide

SEQ ID NO: 1412 - protein, 11 aa, Artificial Sequence
  Description of Artificial Sequence: Synthetic peptide
RASQGIRNDLG

SEQ ID NO: 1413 - DNA, 33 bp, Artificial Sequence
  Description of Artificial Sequence: Synthetic oligonucleotide
caggcgagtcaggacattaccaactttttaaat

SEQ ID NO: 1414 - protein, 11 aa, Artificial Sequence
  Description of Artificial Sequence: Synthetic peptide
QASQDITNFLN

SEQ ID NO: 1415 - DNA, 33 bp, Artificial Sequence
  Description of Artificial Sequence: Synthetic oligonucleotide
cgggcgagtcaggacattaacatttatttagcc

SEQ ID NO: 1416 - protein, 11 aa, Artificial Sequence
  Description of Artificial Sequence: Synthetic peptide
RASQDINIYLA

SEQ ID NO: 1417 - DNA, 51 bp, Artificial Sequence
  Description of Artificial Sequence: Synthetic oligonucleotide
aagtccagccagagtgttttacatagttccaacaataagaactacttagtt

SEQ ID NO: 1418 - protein, 17 aa, Artificial Sequence
  Description of Artificial Sequence: Synthetic peptide
KSSQSVLHSSNNKNYLV

SEQ ID NO: 1419 - DNA, 33 bp, Artificial Sequence; identical to SEQ ID NO: 341
  Description of Artificial Sequence: Synthetic oligonucleotide

SEQ ID NO: 1420 - protein, 11 aa, Artificial Sequence
  Description of Artificial Sequence: Synthetic peptide
RASQDIRNNLG

SEQ ID NO: 1421 - DNA, 33 bp, Artificial Sequence; identical to SEQ ID NO: 1359
  Description of Artificial Sequence: Synthetic oligonucleotide

SEQ ID NO: 1422 - protein, 11 aa, Artificial Sequence
  Description of Artificial Sequence: Synthetic peptide
RASQSFSHYLN

SEQ ID NO: 1423 - DNA, 33 bp, Artificial Sequence
  Description of Artificial Sequence: Synthetic oligonucleotide
cgggcaagtcaggacattagaaatcttttaggc

SEQ ID NO: 1424 - protein, 11 aa, Artificial Sequence
  Description of Artificial Sequence: Synthetic peptide
RASQDIRNLLG

SEQ ID NO: 1425 - DNA, 33 bp, Artificial Sequence
  Description of Artificial Sequence: Synthetic oligonucleotide
cgggcgagtcagggtattaggaagtggttagcc

SEQ ID NO: 1426 - protein, 11 aa, Artificial Sequence
  Description of Artificial Sequence: Synthetic peptide
RASQGIRKWLA

SEQ ID NO: 1427 - DNA, 33 bp, Artificial Sequence
  Description of Artificial Sequence: Synthetic oligonucleotide
cgggcaagtcagagcattttcagatatttaaat

SEQ ID NO: 1428 - protein, 11 aa, Artificial Sequence
  Description of Artificial Sequence: Synthetic peptide
RASQSIFRYLN

SEQ ID NO: 1429 - DNA, 33 bp, Artificial Sequence; identical to SEQ ID NO: 171
  Description of Artificial Sequence: Synthetic oligonucleotide

SEQ ID NO: 1430 - protein, 11 aa, Artificial Sequence
  Description of Artificial Sequence: Synthetic peptide
RASQGISSWLA

SEQ ID NO: 1431 - DNA, 33 bp, Artificial Sequence
  Description of Artificial Sequence: Synthetic oligonucleotide
cgggtgagtcaggatattagcaaatggttagcc

SEQ ID NO: 1432 - protein, 11 aa, Artificial Sequence
  Description of Artificial Sequence: Synthetic peptide
RVSQDISKWLA

SEQ ID NO: 1433 - DNA, 33 bp, Artificial Sequence; identical to SEQ ID NO: 109
  Description of Artificial Sequence: Synthetic oligonucleotide

SEQ ID NO: 1434 - protein, 11 aa, Artificial Sequence
  Description of Artificial Sequence: Synthetic peptide
RASQGIRNDLG

SEQ ID NO: 1435 - DNA, 33 bp, Artificial Sequence; identical to SEQ ID NO: 109
  Description of Artificial Sequence: Synthetic oligonucleotide

SEQ ID NO: 1436 - protein, 11 aa, Artificial Sequence
  Description of Artificial Sequence: Synthetic peptide
RASQGIRNDLG

SEQ ID NO: 1437 - DNA, 48 bp, Artificial Sequence
  Description of Artificial Sequence: Synthetic oligonucleotide
aagtctagtcagagcctccagcatggtgaaggaaagacctatttgtat

SEQ ID NO: 1438 - protein, 16 aa, Artificial Sequence
  Description of Artificial Sequence: Synthetic peptide
KSSQSLQHGEGKTYLY

SEQ ID NO: 1439 - DNA, 33 bp, Artificial Sequence; identical to SEQ ID NO: 1229
  Description of Artificial Sequence: Synthetic oligonucleotide

SEQ ID NO: 1440 - protein, 11 aa, Artificial Sequence
  Description of Artificial Sequence: Synthetic peptide
RASQGIRKDLG

SEQ ID NO: 1441 - DNA, 48 bp, Artificial Sequence; identical to SEQ ID NO: 103
  Description of Artificial Sequence: Synthetic oligonucleotide

SEQ ID NO: 1442 - protein, 16 aa, Artificial Sequence
  Description of Artificial Sequence: Synthetic peptide
KSSQSLLHSEGKTYLY

SEQ ID NO: 1443 - DNA, 33 bp, Artificial Sequence; identical to SEQ ID NO: 109
  Description of Artificial Sequence: Synthetic oligonucleotide

SEQ ID NO: 1444 - protein, 11 aa, Artificial Sequence
  Description of Artificial Sequence: Synthetic peptide
RASQGIRNDLG

SEQ ID NO: 1445 - DNA, 33 bp, Artificial Sequence; identical to SEQ ID NO: 109
  Description of Artificial Sequence: Synthetic oligonucleotide

SEQ ID NO: 1446 - protein, 11 aa, Artificial Sequence
  Description of Artificial Sequence: Synthetic peptide
RASQGIRNDLG

SEQ ID NO: 1447 - DNA, 51 bp, Artificial Sequence; identical to SEQ ID NO: 1071
  Description of Artificial Sequence: Synthetic oligonucleotide

SEQ ID NO: 1448 - protein, 17 aa, Artificial Sequence
  Description of Artificial Sequence: Synthetic peptide
KSSQSVLYSSNNKNYLA

SEQ ID NO: 1449 - DNA, 33 bp, Artificial Sequence; identical to SEQ ID NO: 629
  Description of Artificial Sequence: Synthetic oligonucleotide

SEQ ID NO: 1450 - protein, 11 aa, Artificial Sequence
  Description of Artificial Sequence: Synthetic peptide
RASQGISNYLA

SEQ ID NO: 1451 - DNA, 33 bp, Artificial Sequence
  Description of Artificial Sequence: Synthetic oligonucleotide
cgggcgagtcaggtcattaagaattatttagtc

SEQ ID NO: 1452 - protein, 11 aa, Artificial Sequence
  Description of Artificial Sequence: Synthetic peptide
RASQVIKNYLV

SEQ ID NO: 1453 - DNA, 33 bp, Artificial Sequence; identical to SEQ ID NO: 109
  Description of Artificial Sequence: Synthetic oligonucleotide

SEQ ID NO: 1454 - protein, 11 aa, Artificial Sequence
  Description of Artificial Sequence: Synthetic peptide
RASQGIRNDLG

SEQ ID NO: 1455 - DNA, 33 bp, Artificial Sequence
  Description of Artificial Sequence: Synthetic oligonucleotide
agggccagtcagagtgttagcagttccttagcc

SEQ ID NO: 1456 - protein, 11 aa, Artificial Sequence
  Description of Artificial Sequence: Synthetic peptide
RASQSVSSSLA

SEQ ID NO: 1457 - DNA, 33 bp, Artificial Sequence
  Description of Artificial Sequence: Synthetic oligonucleotide
cgggcgagtcaggttattagcaactggttagcc

SEQ ID NO: 1458 - protein, 11 aa, Artificial Sequence
  Description of Artificial Sequence: Synthetic peptide
RASQVISNWLA

SEQ ID NO: 1459 - DNA, 48 bp, Artificial Sequence; identical to SEQ ID NO: 555
  Description of Artificial Sequence: Synthetic oligonucleotide

SEQ ID NO: 1460 - protein, 16 aa, Artificial Sequence
  Description of Artificial Sequence: Synthetic peptide
KSSQSLLHSEGKTYLY

SEQ ID NO: 1461 - DNA, 33 bp, Artificial Sequence; identical to SEQ ID NO: 501
  Description of Artificial Sequence: Synthetic oligonucleotide

SEQ ID NO: 1462 - protein, 11 aa, Artificial Sequence
  Description of Artificial Sequence: Synthetic peptide
RASQSISSYLN

SEQ ID NO: 1463 - DNA, 33 bp, Artificial Sequence; identical to SEQ ID NO: 501
  Description of Artificial Sequence: Synthetic oligonucleotide

SEQ ID NO: 1464 - protein, 11 aa, Artificial Sequence
  Description of Artificial Sequence: Synthetic peptide
RASQSISSYLN

SEQ ID NO: 1465 - DNA, 33 bp, Artificial Sequence; identical to SEQ ID NO: 1229
  Description of Artificial Sequence: Synthetic oligonucleotide

SEQ ID NO: 1466 - protein, 11 aa, Artificial Sequence
  Description of Artificial Sequence: Synthetic peptide
RASQGIRKDLG

SEQ ID NO: 1467 - DNA, 33 bp, Artificial Sequence; identical to SEQ ID NO: 1185
  Description of Artificial Sequence: Synthetic oligonucleotide

SEQ ID NO: 1468 - protein, 11 aa, Artificial Sequence
  Description of Artificial Sequence: Synthetic peptide
RASQGIRDDLG

SEQ ID NO: 1469 - DNA, 48 bp, Artificial Sequence; identical to SEQ ID NO: 103
  Description of Artificial Sequence: Synthetic oligonucleotide

SEQ ID NO: 1470 - protein, 16 aa, Artificial Sequence
  Description of Artificial Sequence: Synthetic peptide
KSSQSLLHSEGKTYLY

SEQ ID NO: 1471 - DNA, 51 bp, Artificial Sequence
  Description of Artificial Sequence: Synthetic oligonucleotide
aagtccagccagagtgttttacacatctccaacaataacaattacttagct

SEQ ID NO: 1472 - protein, 17 aa, Artificial Sequence
  Description of Artificial Sequence: Synthetic peptide
KSSQSVLHISNNNNYLA

SEQ ID NO: 1473 - DNA, 51 bp, Artificial Sequence
  Description of Artificial Sequence: Synthetic oligonucleotide
aagtccagccagagtgttttatacagctccaacaataacaactccttaact

SEQ ID NO: 1474 - protein, 17 aa, Artificial Sequence
  Description of Artificial Sequence: Synthetic peptide
KSSQSVLYSSNNNNSLT

SEQ ID NO: 1475 - DNA, 33 bp, Artificial Sequence
  Description of Artificial Sequence: Synthetic oligonucleotide
cgggcaagtcagagcattaccaactttttaaat

SEQ ID NO: 1476 - protein, 11 aa, Artificial Sequence
  Description of Artificial Sequence: Synthetic peptide
RASQSITNFLN

SEQ ID NO: 1477 - DNA, 33 bp, Artificial Sequence; identical to SEQ ID NO: 429
  Description of Artificial Sequence: Synthetic oligonucleotide

SEQ ID NO: 1478 - protein, 11 aa, Artificial Sequence
  Description of Artificial Sequence: Synthetic peptide
RASQGIGNDLG

SEQ ID NO: 1479 - DNA, 48 bp, Artificial Sequence
  Description of Artificial Sequence: Synthetic oligonucleotide
aggtctagtcagagcctcctacatagtaatggatacaactatttggat

SEQ ID NO: 1480 - protein, 16 aa, Artificial Sequence
  Description of Artificial Sequence: Synthetic peptide
RSSQSLLHSNGYNYLD

SEQ ID NO: 1481 - DNA, 33 bp, Artificial Sequence
  Description of Artificial Sequence: Synthetic oligonucleotide
cgggcaagtcagaacattttcagctatttaaat

SEQ ID NO: 1482 - protein, 11 aa, Artificial Sequence
  Description of Artificial Sequence: Synthetic peptide
RASQNIFSYLN

SEQ ID NO: 1483 - DNA, 33 bp, Artificial Sequence
  Description of Artificial Sequence: Synthetic oligonucleotide
cgggcaagtcagagcattatcagttatttaaat

SEQ ID NO: 1484 - protein, 11 aa, Artificial Sequence
  Description of Artificial Sequence: Synthetic peptide
RASQSIISYLN

SEQ ID NO: 1485 - DNA, 33 bp, Artificial Sequence; identical to SEQ ID NO: 109
  Description of Artificial Sequence: Synthetic oligonucleotide

SEQ ID NO: 1486 - protein, 11 aa, Artificial Sequence
  Description of Artificial Sequence: Synthetic peptide
RASQGIRNDLG

SEQ ID NO: 1487 - DNA, 33 bp, Artificial Sequence; identical to SEQ ID NO: 341
  Description of Artificial Sequence: Synthetic oligonucleotide

SEQ ID NO: 1488 - protein, 11 aa, Artificial Sequence
  Description of Artificial Sequence: Synthetic peptide
RASQDIRNNLG

SEQ ID NO: 1489 - DNA, 33 bp, Artificial Sequence; identical to SEQ ID NO: 109
  Description of Artificial Sequence: Synthetic oligonucleotide

SEQ ID NO: 1490 - protein, 11 aa, Artificial Sequence
  Description of Artificial Sequence: Synthetic peptide
RASQGIRNDLG

SEQ ID NO: 1491 - DNA, 33 bp, Artificial Sequence
  Description of Artificial Sequence: Synthetic oligonucleotide
agggccagtcagagtgttaacagcaacttagcc

SEQ ID NO: 1492 - protein, 11 aa, Artificial Sequence
  Description of Artificial Sequence: Synthetic peptide
RASQSVNSNLA

SEQ ID NO: 1493 - DNA, 33 bp, Artificial Sequence; identical to SEQ ID NO: 519
  Description of Artificial Sequence: Synthetic oligonucleotide

SEQ ID NO: 1494 - protein, 11 aa, Artificial Sequence
  Description of Artificial Sequence: Synthetic peptide
RASQAIRNDLG

SEQ ID NO: 1495 - DNA, 33 bp, Artificial Sequence; identical to SEQ ID NO: 1177
  Description of Artificial Sequence: Synthetic oligonucleotide

SEQ ID NO: 1496 - protein, 11 aa, Artificial Sequence
  Description of Artificial Sequence: Synthetic peptide
RASQDISSWLA

SEQ ID NO: 1497 - DNA, 33 bp, Artificial Sequence
  Description of Artificial Sequence: Synthetic oligonucleotide
cgggcgagtcagggcattagcacttatttagcc

SEQ ID NO: 1498 - protein, 11 aa, Artificial Sequence
  Description of Artificial Sequence: Synthetic peptide
RASQGISTYLA

SEQ ID NO: 1499 - DNA, 33 bp, Artificial Sequence; identical to SEQ ID NO: 205
  Description of Artificial Sequence: Synthetic oligonucleotide

SEQ ID NO: 1500 - protein, 11 aa, Artificial Sequence
  Description of Artificial Sequence: Synthetic peptide
RASQDIRNDLG

SEQ ID NO: 1501 - DNA, 33 bp, Artificial Sequence
  Description of Artificial Sequence: Synthetic oligonucleotide
cgggcaagtcagggcattagaaatgctttaggc

SEQ ID NO: 1502 - protein, 11 aa, Artificial Sequence
  Description of Artificial Sequence: Synthetic peptide
RASQGIRNALG

SEQ ID NO: 1503 - DNA, 33 bp, Artificial Sequence; identical to SEQ ID NO: 501
  Description of Artificial Sequence: Synthetic oligonucleotide

SEQ ID NO: 1504 - protein, 11 aa, Artificial Sequence
  Description of Artificial Sequence: Synthetic peptide
RASQSISSYLN

SEQ ID NO: 1505 - DNA, 33 bp, Artificial Sequence
  Description of Artificial Sequence: Synthetic oligonucleotide
agggccagtcagagtgttagcagcagcttagcc

SEQ ID NO: 1506 - protein, 11 aa, Artificial Sequence
  Description of Artificial Sequence: Synthetic peptide
RASQSVSSSLA

SEQ ID NO: 1507 - DNA, 33 bp, Artificial Sequence; identical to SEQ ID NO: 109
  Description of Artificial Sequence: Synthetic oligonucleotide

SEQ ID NO: 1508 - protein, 11 aa, Artificial Sequence
  Description of Artificial Sequence: Synthetic peptide
RASQGIRNDLG

SEQ ID NO: 1509 - DNA, 33 bp, Artificial Sequence
  Description of Artificial Sequence: Synthetic oligonucleotide
cgggcgagtcaggatattagcaactggttagcc

SEQ ID NO: 1510 - protein, 11 aa, Artificial Sequence
  Description of Artificial Sequence: Synthetic peptide
RASQDISNWLA

SEQ ID NO: 1511 - DNA, 33 bp, Artificial Sequence; identical to SEQ ID NO: 219
  Description of Artificial Sequence: Synthetic oligonucleotide

SEQ ID NO: 1512 - protein, 11 aa, Artificial Sequence
  Description of Artificial Sequence: Synthetic peptide
RASQVIRNDLG

SEQ ID NO: 1513 - DNA, 33 bp, Artificial Sequence; identical to SEQ ID NO: 173
  Description of Artificial Sequence: Synthetic oligonucleotide

SEQ ID NO: 1514 - protein, 11 aa, Artificial Sequence
  Description of Artificial Sequence: Synthetic peptide
RASQGISRWLA

SEQ ID NO: 1515 - DNA, 33 bp, Artificial Sequence; identical to SEQ ID NO: 1391
  Description of Artificial Sequence: Synthetic oligonucleotide

SEQ ID NO: 1516 - protein, 11 aa, Artificial Sequence
  Description of Artificial Sequence: Synthetic peptide
RASQSVSSDLA

SEQ ID NO: 1517 - DNA, 33 bp, Artificial Sequence; identical to SEQ ID NO: 429
  Description of Artificial Sequence: Synthetic oligonucleotide

SEQ ID NO: 1518 - protein, 11 aa, Artificial Sequence
  Description of Artificial Sequence: Synthetic peptide
RASQGIGNDLG

SEQ ID NO: 1519 - DNA, 33 bp, Artificial Sequence; identical to SEQ ID NO: 553
  Description of Artificial Sequence: Synthetic oligonucleotide

SEQ ID NO: 1520 - protein, 11 aa, Artificial Sequence
  Description of Artificial Sequence: Synthetic peptide
RASQGISNWLA

SEQ ID NO: 1521 - DNA, 51 bp, Artificial Sequence
  Description of Artificial Sequence: Synthetic oligonucleotide
aagtccagccaaagtgttttacacagctccaacaattataactacttagct

SEQ ID NO: 1522 - protein, 17 aa, Artificial Sequence
  Description of Artificial Sequence: Synthetic peptide
KSSQSVLHSSNNYNYLA

SEQ ID NO: 1523 - DNA, 51 bp, Artificial Sequence
  Description of Artificial Sequence: Synthetic oligonucleotide
aagtccagccagagtgttttattcagctccaacaattacaattacttagct

SEQ ID NO: 1524 - protein, 17 aa, Artificial Sequence
  Description of Artificial Sequence: Synthetic peptide
KSSQSVLFSSNNYNYLA

SEQ ID NO: 1525 - DNA, 33 bp, Artificial Sequence; identical to SEQ ID NO: 1391
  Description of Artificial Sequence: Synthetic oligonucleotide

SEQ ID NO: 1526 - protein, 11 aa, Artificial Sequence
  Description of Artificial Sequence: Synthetic peptide
RASQSVSSDLA

SEQ ID NO: 1527 - DNA, 33 bp, Artificial Sequence; identical to SEQ ID NO: 1391
  Description of Artificial Sequence: Synthetic oligonucleotide

SEQ ID NO: 1528 - protein, 11 aa, Artificial Sequence
  Description of Artificial Sequence: Synthetic peptide
RASQSVSSDLA

SEQ ID NO: 1529 - DNA, 33 bp, Artificial Sequence; identical to SEQ ID NO: 109
  Description of Artificial Sequence: Synthetic oligonucleotide

SEQ ID NO: 1530 - protein, 11 aa, Artificial Sequence
  Description of Artificial Sequence: Synthetic peptide
RASQGIRNDLG

SEQ ID NO: 1531 - DNA, 51 bp, Artificial Sequence
  Description of Artificial Sequence: Synthetic oligonucleotide
aagtccggccagagtattttatacagctccaacaataacaactacttagct

SEQ ID NO: 1532 - protein, 17 aa, Artificial Sequence
  Description of Artificial Sequence: Synthetic peptide
KSGQSILYSSNNNNYLA

SEQ ID NO: 1533 - DNA, 33 bp, Artificial Sequence
  Description of Artificial Sequence: Synthetic oligonucleotide
agggccagtcagagtgttagcagctccttagcc

SEQ ID NO: 1534 - protein, 11 aa, Artificial Sequence
  Description of Artificial Sequence: Synthetic peptide
RASQSVSSSLA

SEQ ID NO: 1535 - DNA, 33 bp, Artificial Sequence
  Description of Artificial Sequence: Synthetic oligonucleotide
cgggcaagtcagggcattagaagtgatttagac

SEQ ID NO: 1536 - protein, 11 aa, Artificial Sequence
  Description of Artificial Sequence: Synthetic peptide
RASQGIRSDLD

SEQ ID NO: 1537 - DNA, 33 bp, Artificial Sequence
  Description of Artificial Sequence: Synthetic oligonucleotide
agggccagtcagagtgttagcagcgacttagtc

SEQ ID NO: 1538 - protein, 11 aa, Artificial Sequence
  Description of Artificial Sequence: Synthetic peptide
RASQSVSSDLV

SEQ ID NO: 1539 - DNA, 48 bp, Artificial Sequence; identical to SEQ ID NO: 555
  Description of Artificial Sequence: Synthetic oligonucleotide

SEQ ID NO: 1540 - protein, 16 aa, Artificial Sequence
  Description of Artificial Sequence: Synthetic peptide
KSSQSLLHSEGKTYLY

SEQ ID NO: 1541 - DNA, 51 bp, Artificial Sequence
  Description of Artificial Sequence: Synthetic oligonucleotide
aagtccagccagagtgttttatacagctccaacaataacaactacttagct

SEQ ID NO: 1542 - protein, 17 aa, Artificial Sequence
  Description of Artificial Sequence: Synthetic peptide
KSSQSVLYSSNNNNYLA

SEQ ID NO: 1543 - DNA, 36 bp, Artificial Sequence
  Description of Artificial Sequence: Synthetic oligonucleotide
tgggccagtcagagtgtttacagcagcttcttagcc

SEQ ID NO: 1544 - protein, 12 aa, Artificial Sequence
  Description of Artificial Sequence: Synthetic peptide
WASQSVYSSFLA

SEQ ID NO: 1545 - DNA, 33 bp, Artificial Sequence; identical to SEQ ID NO: 305
  Description of Artificial Sequence: Synthetic oligonucleotide

SEQ ID NO: 1546 - protein, 11 aa, Artificial Sequence
  Description of Artificial Sequence: Synthetic peptide
RASQSIISYLN

SEQ ID NO: 1547 - DNA, 36 bp, Artificial Sequence
  Description of Artificial Sequence: Synthetic oligonucleotide
agggccagtcagagtgttagcagcatctacttagcc

SEQ ID NO: 1548 - protein, 12 aa, Artificial Sequence
  Description of Artificial Sequence: Synthetic peptide
RASQSVSSIYLA

SEQ ID NO: 1549 - DNA, 33 bp, Artificial Sequence; identical to SEQ ID NO: 109
  Description of Artificial Sequence: Synthetic oligonucleotide

SEQ ID NO: 1550 - protein, 11 aa, Artificial Sequence
  Description of Artificial Sequence: Synthetic peptide
RASQGIRNDLG

SEQ ID NO: 1551 - DNA, 33 bp, Artificial Sequence; identical to SEQ ID NO: 109
  Description of Artificial Sequence: Synthetic oligonucleotide

SEQ ID NO: 1552 - protein, 11 aa, Artificial Sequence
  Description of Artificial Sequence: Synthetic peptide
RASQGIRNDLG

SEQ ID NO: 1553 - DNA, 33 bp, Artificial Sequence; identical to SEQ ID NO: 501
  Description of Artificial Sequence: Synthetic oligonucleotide

SEQ ID NO: 1554 - protein, 11 aa, Artificial Sequence
  Description of Artificial Sequence: Synthetic peptide
RASQSISSYLN

SEQ ID NO: 1555 - DNA, 33 bp, Artificial Sequence; identical to SEQ ID NO: 205
  Description of Artificial Sequence: Synthetic oligonucleotide

SEQ ID NO: 1556 - protein, 11 aa, Artificial Sequence
  Description of Artificial Sequence: Synthetic peptide
RASQDIRNDLG

SEQ ID NO: 1557 - DNA, 51 bp, Artificial Sequence
  Description of Artificial Sequence: Synthetic oligonucleotide
aagtccagccagactgttttatacaggtccaacaattacaactacttagct

SEQ ID NO: 1558 - protein, 17 aa, Artificial Sequence
  Description of Artificial Sequence: Synthetic peptide
KSSQTVLYRSNNYNYLA

SEQ ID NO: 1559 - DNA, 33 bp, Artificial Sequence; identical to SEQ ID NO: 327
  Description of Artificial Sequence: Synthetic oligonucleotide

SEQ ID NO: 1560 - protein, 11 aa, Artificial Sequence
  Description of Artificial Sequence: Synthetic peptide
RASQSIFSYLN

SEQ ID NO: 1561 - DNA, 33 bp, Artificial Sequence; identical to SEQ ID NO: 327
  Description of Artificial Sequence: Synthetic oligonucleotide

SEQ ID NO: 1562 - protein, 11 aa, Artificial Sequence
  Description of Artificial Sequence: Synthetic peptide
RASQSIFSYLN

SEQ ID NO: 1563 - DNA, 33 bp, Artificial Sequence; identical to SEQ ID NO: 105
  Description of Artificial Sequence: Synthetic oligonucleotide

SEQ ID NO: 1564 - protein, 11 aa, Artificial Sequence
  Description of Artificial Sequence: Synthetic peptide
RASQGISNYLA

SEQ ID NO: 1565 - DNA, 33 bp, Artificial Sequence; identical to SEQ ID NO: 171
  Description of Artificial Sequence: Synthetic oligonucleotide

SEQ ID NO: 1566 - protein, 11 aa, Artificial Sequence
  Description of Artificial Sequence: Synthetic peptide
RASQGISSWLA

SEQ ID NO: 1567 - DNA, 33 bp, Artificial Sequence
  Description of Artificial Sequence: Synthetic oligonucleotide
cgggcaagtcagagcattttcagctatttacat

SEQ ID NO: 1568 - protein, 11 aa, Artificial Sequence
  Description of Artificial Sequence: Synthetic peptide
RASQSIFSYLH

SEQ ID NO: 1569 - DNA, 33 bp, Artificial Sequence; identical to SEQ ID NO: 109
  Description of Artificial Sequence: Synthetic oligonucleotide

SEQ ID NO: 1570 - protein, 11 aa, Artificial Sequence
  Description of Artificial Sequence: Synthetic peptide
RASQGIRNDLG

SEQ ID NO: 1571 - DNA, 33 bp, Artificial Sequence; identical to SEQ ID NO: 109
  Description of Artificial Sequence: Synthetic oligonucleotide

SEQ ID NO: 1572 - protein, 11 aa, Artificial Sequence
  Description of Artificial Sequence: Synthetic peptide
RASQGIRNDLG

SEQ ID NO: 1573 - DNA, 33 bp, Artificial Sequence
  Description of Artificial Sequence: Synthetic oligonucleotide
cgggcaagtcagaacattaagaaatatttaaat

SEQ ID NO: 1574 - protein, 11 aa, Artificial Sequence
  Description of Artificial Sequence: Synthetic peptide
RASQNIKKYLN

SEQ ID NO: 1575 - DNA, 33 bp, Artificial Sequence; identical to SEQ ID NO: 109
  Description of Artificial Sequence: Synthetic oligonucleotide

SEQ ID NO: 1576 - protein, 11 aa, Artificial Sequence
  Description of Artificial Sequence: Synthetic peptide
RASQGIRNDLG

SEQ ID NO: 1577 - DNA, 48 bp, Artificial Sequence
  Description of Artificial Sequence: Synthetic oligonucleotide
aagtctagtcagagcctccttcatggtgatggaaagacctatttgttt

SEQ ID NO: 1578 - protein, 16 aa, Artificial Sequence
  Description of Artificial Sequence: Synthetic peptide
KSSQSLLHGDGKTYLF

SEQ ID NO: 1579 - DNA, 33 bp, Artificial Sequence; identical to SEQ ID NO: 171
  Description of Artificial Sequence: Synthetic oligonucleotide

SEQ ID NO: 1580 - protein, 11 aa, Artificial Sequence
  Description of Artificial Sequence: Synthetic peptide
RASQGISSWLA

SEQ ID NO: 1581 - DNA, 33 bp, Artificial Sequence; identical to SEQ ID NO: 109
  Description of Artificial Sequence: Synthetic oligonucleotide

SEQ ID NO: 1582 - protein, 11 aa, Artificial Sequence
  Description of Artificial Sequence: Synthetic peptide
RASQGIRNDLG

SEQ ID NO: 1583 - DNA, 33 bp, Artificial Sequence
  Description of Artificial Sequence: Synthetic oligonucleotide
cgggcgagtcaggacattagcaattatttaaat

SEQ ID NO: 1584 - protein, 11 aa, Artificial Sequence
  Description of Artificial Sequence: Synthetic peptide
RASQDISNYLN

SEQ ID NO: 1585 - DNA, 33 bp, Artificial Sequence
  Description of Artificial Sequence: Synthetic oligonucleotide
cgggcgagtcagaatattaccacctggttagcc

SEQ ID NO: 1586 - protein, 11 aa, Artificial Sequence
  Description of Artificial Sequence: Synthetic peptide
RASQNITTWLA

SEQ ID NO: 1587 - DNA, 33 bp, Artificial Sequence
  Description of Artificial Sequence: Synthetic oligonucleotide
cgggcgagtcaggtcattagcagttatttacat

SEQ ID NO: 1588 - protein, 11 aa, Artificial Sequence
  Description of Artificial Sequence: Synthetic peptide
RASQVISSYLH

SEQ ID NO: 1589 - DNA, 33 bp, Artificial Sequence; identical to SEQ ID NO: 171
  Description of Artificial Sequence: Synthetic oligonucleotide

SEQ ID NO: 1590 - protein, 11 aa, Artificial Sequence
  Description of Artificial Sequence: Synthetic peptide
RASQGISSWLA

SEQ ID NO: 1591 - DNA, 33 bp, Artificial Sequence
  Description of Artificial Sequence: Synthetic oligonucleotide
cgggcgagtcaggacattaacaattatttagcc

SEQ ID NO: 1592 - protein, 11 aa, Artificial Sequence
  Description of Artificial Sequence: Synthetic peptide
RASQDINNYLA

SEQ ID NO: 1593 - DNA, 33 bp, Artificial Sequence; identical to SEQ ID NO: 1491
  Description of Artificial Sequence: Synthetic oligonucleotide

SEQ ID NO: 1594 - protein, 11 aa, Artificial Sequence
  Description of Artificial Sequence: Synthetic peptide
RASQSVNSNLA

SEQ ID NO: 1595 - DNA, 33 bp, Artificial Sequence
  Description of Artificial Sequence: Synthetic oligonucleotide
cgggcgagtcaggacattagcacttatttagcc

SEQ ID NO: 1596 - protein, 11 aa, Artificial Sequence
  Description of Artificial Sequence: Synthetic peptide
RASQDISTYLA

SEQ ID NO: 1597 - DNA, 33 bp, Artificial Sequence; identical to SEQ ID NO: 171
  Description of Artificial Sequence: Synthetic oligonucleotide

SEQ ID NO: 1598 - protein, 11 aa, Artificial Sequence
  Description of Artificial Sequence: Synthetic peptide
RASQGISSWLA

SEQ ID NO: 1599 - DNA, 33 bp, Artificial Sequence; identical to SEQ ID NO: 171
  Description of Artificial Sequence: Synthetic oligonucleotide

SEQ ID NO: 1600 - protein, 11 aa, Artificial Sequence
  Description of Artificial Sequence: Synthetic peptide
RASQGISSWLA

SEQ ID NO: 1601 - DNA, 33 bp, Artificial Sequence
  Description of Artificial Sequence: Synthetic oligonucleotide
cgggcgagtcagggcattagcaattatttacat

SEQ ID NO: 1602 - protein, 11 aa, Artificial Sequence
  Description of Artificial Sequence: Synthetic peptide
RASQGISNYLH

SEQ ID NO: 1603 - DNA, 33 bp, Artificial Sequence; identical to SEQ ID NO: 1481
  Description of Artificial Sequence: Synthetic oligonucleotide

SEQ ID NO: 1604 - protein, 11 aa, Artificial Sequence
  Description of Artificial Sequence: Synthetic peptide
RASQNIFSYLN

SEQ ID NO: 1605 - DNA, 33 bp, Artificial Sequence
  Description of Artificial Sequence: Synthetic oligonucleotide
cgggcaagtcaggacattagaaatgttttaggc

SEQ ID NO: 1606 - protein, 11 aa, Artificial Sequence
  Description of Artificial Sequence: Synthetic peptide
RASQDIRNVLG

SEQ ID NO: 1607 - DNA, 33 bp, Artificial Sequence; identical to SEQ ID NO: 519
  Description of Artificial Sequence: Synthetic oligonucleotide

SEQ ID NO: 1608 - protein, 11 aa, Artificial Sequence
  Description of Artificial Sequence: Synthetic peptide
RASQAIRNDLG

SEQ ID NO: 1609 - DNA, 33 bp, Artificial Sequence; identical to SEQ ID NO: 831
  Description of Artificial Sequence: Synthetic oligonucleotide

SEQ ID NO: 1610 - protein, 11 aa, Artificial Sequence
  Description of Artificial Sequence: Synthetic peptide
RASQGIRNDLG

SEQ ID NO: 1611 - DNA, 33 bp, Artificial Sequence
  Description of Artificial Sequence: Synthetic oligonucleotide
cgggagagtcagggtattagcatctggttagcc

SEQ ID NO: 1612 - protein, 11 aa, Artificial Sequence
  Description of Artificial Sequence: Synthetic peptide
RESQGISIWLA

SEQ ID NO: 1613 - DNA, 33 bp, Artificial Sequence; identical to SEQ ID NO: 1491
  Description of Artificial Sequence: Synthetic oligonucleotide

SEQ ID NO: 1614 - protein, 11 aa, Artificial Sequence
  Description of Artificial Sequence: Synthetic peptide
RASQSVNSNLA

SEQ ID NO: 1615 - DNA, 33 bp, Artificial Sequence; identical to SEQ ID NO: 171
  Description of Artificial Sequence: Synthetic oligonucleotide

SEQ ID NO: 1616 - protein, 11 aa, Artificial Sequence
  Description of Artificial Sequence: Synthetic peptide
RASQGISSWLA

SEQ ID NO: 1617 - DNA, 33 bp, Artificial Sequence; identical to SEQ ID NO: 109
  Description of Artificial Sequence: Synthetic oligonucleotide

SEQ ID NO: 1618 - protein, 11 aa, Artificial Sequence
  Description of Artificial Sequence: Synthetic peptide
RASQGIRNDLG

SEQ ID NO: 1619 - DNA, 33 bp, Artificial Sequence; identical to SEQ ID NO: 279
  Description of Artificial Sequence: Synthetic oligonucleotide

SEQ ID NO: 1620 - protein, 11 aa, Artificial Sequence
  Description of Artificial Sequence: Synthetic peptide
RASQGISYYLA

SEQ ID NO: 1621 - DNA, 33 bp, Artificial Sequence; identical to SEQ ID NO: 1301
  Description of Artificial Sequence: Synthetic oligonucleotide

SEQ ID NO: 1622 - protein, 11 aa, Artificial Sequence
  Description of Artificial Sequence: Synthetic peptide
RASQGIRNNLG

SEQ ID NO: 1623 - DNA, 33 bp, Artificial Sequence; identical to SEQ ID NO: 109
  Description of Artificial Sequence: Synthetic oligonucleotide

SEQ ID NO: 1624 - protein, 11 aa, Artificial Sequence
  Description of Artificial Sequence: Synthetic peptide
RASQGIRNDLG

SEQ ID NO: 1625 - DNA, 33 bp, Artificial Sequence; identical to SEQ ID NO: 109
  Description of Artificial Sequence: Synthetic oligonucleotide

SEQ ID NO: 1626 - protein, 11 aa, Artificial Sequence
  Description of Artificial Sequence: Synthetic peptide
RASQGIRNDLG

SEQ ID NO: 1627 - DNA, 33 bp, Artificial Sequence
  Description of Artificial Sequence: Synthetic oligonucleotide
cgggcaggtcagaccatttacaattatttaaat

SEQ ID NO: 1628 - protein, 11 aa, Artificial Sequence
  Description of Artificial Sequence: Synthetic peptide
RAGQTIYNYLN

SEQ ID NO: 1629 - DNA, 33 bp, Artificial Sequence
  Description of Artificial Sequence: Synthetic oligonucleotide
cgggcgagtcagggtgttagcaggtggttagcc

SEQ ID NO: 1630 - protein, 11 aa, Artificial Sequence
  Description of Artificial Sequence: Synthetic peptide
RASQGVSRWLA

SEQ ID NO: 1631 - DNA, 33 bp, Artificial Sequence; identical to SEQ ID NO: 1491
  Description of Artificial Sequence: Synthetic oligonucleotide

SEQ ID NO: 1632 - protein, 11 aa, Artificial Sequence
  Description of Artificial Sequence: Synthetic peptide
RASQSVNSNLA

SEQ ID NO: 1633 - DNA, 33 bp, Artificial Sequence; identical to SEQ ID NO: 95
  Description of Artificial Sequence: Synthetic oligonucleotide

SEQ ID NO: 1634 - protein, 11 aa, Artificial Sequence
  Description of Artificial Sequence: Synthetic peptide
RASQGISKWLA

SEQ ID NO: 1635 - DNA, 33 bp, Artificial Sequence
  Description of Artificial Sequence: Synthetic oligonucleotide
cggacaagtcagagcattttcaactatttaaat

SEQ ID NO: 1636 - protein, 11 aa, Artificial Sequence
  Description of Artificial Sequence: Synthetic peptide
RTSQSIFNYLN

SEQ ID NO: 1637 - DNA, 51 bp, Artificial Sequence
  Description of Artificial Sequence: Synthetic oligonucleotide
aagtccagccagagtgttttatacagctccaacaataacaactacttggct

SEQ ID NO: 1638 - protein, 17 aa, Artificial Sequence
  Description of Artificial Sequence: Synthetic peptide
KSSQSVLYSSNNNNYLA

SEQ ID NO: 1639 - DNA, 33 bp, Artificial Sequence
  Description of Artificial Sequence: Synthetic oligonucleotide
cgggcaagtcagggcattagaaaggatttaggc

SEQ ID NO: 1640 - protein, 11 aa, Artificial Sequence
  Description of Artificial Sequence: Synthetic peptide
RASQGIRKDLG

SEQ ID NO: 1641 - DNA, 33 bp, Artificial Sequence; identical to SEQ ID NO: 1177
  Description of Artificial Sequence: Synthetic oligonucleotide

SEQ ID NO: 1642 - protein, 11 aa, Artificial Sequence
  Description of Artificial Sequence: Synthetic peptide
RASQDISSWLA

SEQ ID NO: 1643 - DNA, 33 bp, Artificial Sequence; identical to SEQ ID NO: 171
  Description of Artificial Sequence: Synthetic oligonucleotide

SEQ ID NO: 1644 - protein, 11 aa, Artificial Sequence
  Description of Artificial Sequence: Synthetic peptide
RASQGISSWLA

SEQ ID NO: 1645 - DNA, 33 bp, Artificial Sequence
  Description of Artificial Sequence: Synthetic oligonucleotide
cgggcaagtcagggcattaacaataatttaaac

SEQ ID NO: 1646 - protein, 11 aa, Artificial Sequence
  Description of Artificial Sequence: Synthetic peptide
RASQGINNNLN

SEQ ID NO: 1647 - DNA, 33 bp, Artificial Sequence
  Description of Artificial Sequence: Synthetic oligonucleotide
cgtgcaagtcagggcattagaaatgatttagga

SEQ ID NO: 1648 - protein, 11 aa, Artificial Sequence
  Description of Artificial Sequence: Synthetic peptide
RASQGIRNDLG

SEQ ID NO: 1649 - DNA, 51 bp, Artificial Sequence
  Description of Artificial Sequence: Synthetic oligonucleotide
aagtccagccagagtgttttacacagctccaacaataacaactacttagat

SEQ ID NO: 1650 - protein, 17 aa, Artificial Sequence
  Description of Artificial Sequence: Synthetic peptide
KSSQSVLHSSNNNNYLD

SEQ ID NO: 1651 - DNA, 33 bp, Artificial Sequence
  Description of Artificial Sequence: Synthetic oligonucleotide
cgggcaagtcagggcattagaaatgatttagat

SEQ ID NO: 1652 - protein, 11 aa, Artificial Sequence
  Description of Artificial Sequence: Synthetic peptide
RASQGIRNDLD

SEQ ID NO: 1653 - DNA, 33 bp, Artificial Sequence
  Description of Artificial Sequence: Synthetic oligonucleotide
cgggcaagtcagggcattagaaatgttttaggc

SEQ ID NO: 1654 - protein, 11 aa, Artificial Sequence
  Description of Artificial Sequence: Synthetic peptide
RASQGIRNVLG

SEQ ID NO: 1655 - DNA, 33 bp, Artificial Sequence; identical to SEQ ID NO: 171
  Description of Artificial Sequence: Synthetic oligonucleotide

SEQ ID NO: 1656 - protein, 11 aa, Artificial Sequence
  Description of Artificial Sequence: Synthetic peptide
RASQGISSWLA

SEQ ID NO: 1657 - DNA, 33 bp, Artificial Sequence; identical to SEQ ID NO: 1651
  Description of Artificial Sequence: Synthetic oligonucleotide

SEQ ID NO: 1658 - protein, 11 aa, Artificial Sequence
  Description of Artificial Sequence: Synthetic peptide
RASQGIRNDLD

SEQ ID NO: 1659 - DNA, 33 bp, Artificial Sequence; identical to SEQ ID NO: 137
  Description of Artificial Sequence: Synthetic oligonucleotide

SEQ ID NO: 1660 - protein, 11 aa, Artificial Sequence
  Description of Artificial Sequence: Synthetic peptide
RASQNISSYLN

SEQ ID NO: 1661 - DNA, 33 bp, Artificial Sequence
  Description of Artificial Sequence: Synthetic oligonucleotide
cgggcgagtcagggcattagcagttatttaaat

SEQ ID NO: 1662 - protein, 11 aa, Artificial Sequence
  Description of Artificial Sequence: Synthetic peptide
RASQGISSYLN

SEQ ID NO: 1663 - DNA, 33 bp, Artificial Sequence; identical to SEQ ID NO: 171
  Description of Artificial Sequence: Synthetic oligonucleotide

SEQ ID NO: 1664 - protein, 11 aa, Artificial Sequence
  Description of Artificial Sequence: Synthetic peptide
RASQGISSWLA

SEQ ID NO: 1665 - DNA, 33 bp, Artificial Sequence; identical to SEQ ID NO: 553
  Description of Artificial Sequence: Synthetic oligonucleotide

SEQ ID NO: 1666 - protein, 11 aa, Artificial Sequence
  Description of Artificial Sequence: Synthetic peptide
RASQGISNWLA

SEQ ID NO: 1667 - DNA, 33 bp, Artificial Sequence; identical to SEQ ID NO: 109
  Description of Artificial Sequence: Synthetic oligonucleotide

SEQ ID NO: 1668 - protein, 11 aa, Artificial Sequence
  Description of Artificial Sequence: Synthetic peptide
RASQGIRNDLG

SEQ ID NO: 1669 - DNA, 33 bp, Artificial Sequence
  Description of Artificial Sequence: Synthetic oligonucleotide
cgggcaagtcaggacatcagaaatgatttaggc

SEQ ID NO: 1670 - protein, 11 aa, Artificial Sequence
  Description of Artificial Sequence: Synthetic peptide
RASQDIRNDLG

SEQ ID NO: 1671 - DNA, 33 bp, Artificial Sequence; identical to SEQ ID NO: 109
  Description of Artificial Sequence: Synthetic oligonucleotide

SEQ ID NO: 1672 - protein, 11 aa, Artificial Sequence
  Description of Artificial Sequence: Synthetic peptide
RASQGIRNDLG

SEQ ID NO: 1673 - DNA, 36 bp, Artificial Sequence
  Description of Artificial Sequence: Synthetic oligonucleotide
agggcccgtcagaatgttgacagcagctacttagcc

SEQ ID NO: 1674 - protein, 12 aa, Artificial Sequence
  Description of Artificial Sequence: Synthetic peptide
RARQNVDSSYLA

SEQ ID NO: 1675 - DNA, 36 bp, Artificial Sequence
  Description of Artificial Sequence: Synthetic oligonucleotide
agggccagtcagaatatttacagcaactacctagcc

SEQ ID NO: 1676 - protein, 12 aa, Artificial Sequence
  Description of Artificial Sequence: Synthetic peptide
RASQNIYSNYLA

SEQ ID NO: 1677 - DNA, 51 bp, Artificial Sequence; identical to SEQ ID NO: 1079
  Description of Artificial Sequence: Synthetic oligonucleotide

SEQ ID NO: 1678 - protein, 17 aa, Artificial Sequence
  Description of Artificial Sequence: Synthetic peptide
KSSQSVLYSSNNYNYLA

SEQ ID NO: 1679 - DNA, 51 bp, Artificial Sequence
  Description of Artificial Sequence: Synthetic oligonucleotide
aagtccagccagagtgttttacacagctccaacaataacaattacttagcc

SEQ ID NO: 1680 - protein, 17 aa, Artificial Sequence
  Description of Artificial Sequence: Synthetic peptide
KSSQSVLHSSNNNNYLA

SEQ ID NO: 1681 - DNA, 36 bp, Artificial Sequence
  Description of Artificial Sequence: Synthetic oligonucleotide
agggccagtcagagtgttagcagcagctacttagtc

SEQ ID NO: 1682 - protein, 12 aa, Artificial Sequence
  Description of Artificial Sequence: Synthetic peptide
RASQSVSSSYLV

SEQ ID NO: 1683 - DNA, 51 bp, Artificial Sequence
  Description of Artificial Sequence: Synthetic oligonucleotide
aagtccagccagagtgttttacacagctccaacaataagaactacttaact

SEQ ID NO: 1684 - protein, 17 aa, Artificial Sequence
  Description of Artificial Sequence: Synthetic peptide
KSSQSVLHSSNNKNYLT

SEQ ID NO: 1685 - DNA, 51 bp, Artificial Sequence
  Description of Artificial Sequence: Synthetic oligonucleotide
aagtccagccagagtgttttatacagctccaacaatgcgaactacttagct

SEQ ID NO: 1686 - protein, 17 aa, Artificial Sequence
  Description of Artificial Sequence: Synthetic peptide
KSSQSVLYSSNNANYLA

SEQ ID NO: 1687 - DNA, 33 bp, Artificial Sequence
  Description of Artificial Sequence: Synthetic oligonucleotide
agggccagtgtgagtgttgtcaacagcttagcc

SEQ ID NO: 1688 - protein, 11 aa, Artificial Sequence
  Description of Artificial Sequence: Synthetic peptide
RASVSVVNSLA

SEQ ID NO: 1689 - DNA, 51 bp, Artificial Sequence
  Description of Artificial Sequence: Synthetic oligonucleotide
aagtccagccagagtgttttacacagctccaacaattacaactacttagct

SEQ ID NO: 1690 - protein, 17 aa, Artificial Sequence
  Description of Artificial Sequence: Synthetic peptide
KSSQSVLHSSNNYNYLA

SEQ ID NO: 1691 - DNA, 33 bp, Artificial Sequence; identical to SEQ ID NO: 109
  Description of Artificial Sequence: Synthetic oligonucleotide

SEQ ID NO: 1692 - protein, 11 aa, Artificial Sequence
  Description of Artificial Sequence: Synthetic peptide
RASQGIRNDLG

SEQ ID NO: 1693 - DNA, 51 bp, Artificial Sequence
  Description of Artificial Sequence: Synthetic oligonucleotide
aagtccagccagagtgttttattcagctccaacaattataattacttagct

SEQ ID NO: 1694 - protein, 17 aa, Artificial Sequence
  Description of Artificial Sequence: Synthetic peptide
KSSQSVLFSSNNYNYLA

SEQ ID NO: 1695 - DNA, 36 bp, Artificial Sequence
  Description of Artificial Sequence: Synthetic oligonucleotide
agggccagtcagaatatttacagcagttacttagcc

SEQ ID NO: 1696 - protein, 12 aa, Artificial Sequence
  Description of Artificial Sequence: Synthetic peptide
RASQNIYSSYLA

SEQ ID NO: 1697 - DNA, 36 bp, Artificial Sequence
  Description of Artificial Sequence: Synthetic oligonucleotide
agggccagtcagagtgtttacagcagctacttagcc

SEQ ID NO: 1698 - protein, 12 aa, Artificial Sequence
  Description of Artificial Sequence: Synthetic peptide
RASQSVYSSYLA

SEQ ID NO: 1699 - DNA, 36 bp, Artificial Sequence; identical to SEQ ID NO: 1697
  Description of Artificial Sequence: Synthetic oligonucleotide

SEQ ID NO: 1700 - protein, 12 aa, Artificial Sequence
  Description of Artificial Sequence: Synthetic peptide
RASQSVYSSYLA

SEQ ID NO: 1701 - DNA, 33 bp, Artificial Sequence; identical to SEQ ID NO: 109
  Description of Artificial Sequence: Synthetic oligonucleotide

SEQ ID NO: 1702 - protein, 11 aa, Artificial Sequence
  Description of Artificial Sequence: Synthetic peptide
RASQGIRNDLG

SEQ ID NO: 1703 - DNA, 36 bp, Artificial Sequence; identical to SEQ ID NO: 99
  Description of Artificial Sequence: Synthetic oligonucleotide

SEQ ID NO: 1704 - protein, 12 aa, Artificial Sequence
  Description of Artificial Sequence: Synthetic peptide
RASQSVNSNYLA

SEQ ID NO: 1705 - DNA, 51 bp, Artificial Sequence
  Description of Artificial Sequence: Synthetic oligonucleotide
aagtccagccagagtgtattacacagctccaacagttacaactacttagct

SEQ ID NO: 1706 - protein, 17 aa, Artificial Sequence
  Description of Artificial Sequence: Synthetic peptide
KSSQSVLHSSNSYNYLA

SEQ ID NO: 1707 - DNA, 51 bp, Artificial Sequence
  Description of Artificial Sequence: Synthetic oligonucleotide
aagtccagccagagtattttatacaactccaacaataacaactacttagct

SEQ ID NO: 1708 - protein, 17 aa, Artificial Sequence
  Description of Artificial Sequence: Synthetic peptide
KSSQSILYNSNNNNYLA

SEQ ID NO: 1709 - DNA, 36 bp, Artificial Sequence; identical to SEQ ID NO: 759
  Description of Artificial Sequence: Synthetic oligonucleotide

SEQ ID NO: 1710 - protein, 12 aa, Artificial Sequence
  Description of Artificial Sequence: Synthetic peptide
RASQSVSSSYLA

SEQ ID NO: 1711 - DNA, 36 bp, Artificial Sequence; identical to SEQ ID NO: 1681
  Description of Artificial Sequence: Synthetic oligonucleotide

SEQ ID NO: 1712 - protein, 12 aa, Artificial Sequence
  Description of Artificial Sequence: Synthetic peptide
RASQSVSSSYLV

SEQ ID NO: 1713 - DNA, 36 bp, Artificial Sequence
  Description of Artificial Sequence: Synthetic oligonucleotide
agggccagtccgagtgttgacagcagctacttagcc

SEQ ID NO: 1714 - protein, 12 aa, Artificial Sequence
  Description of Artificial Sequence: Synthetic peptide
RASPSVDSSYLA

SEQ ID NO: 1715 - DNA, 36 bp, Artificial Sequence
  Description of Artificial Sequence: Synthetic oligonucleotide
aggaccagtccgaatgttgacagcagctacttagcc

SEQ ID NO: 1716 - protein, 12 aa, Artificial Sequence
  Description of Artificial Sequence: Synthetic peptide
RTSPNVDSSYLA

SEQ ID NO: 1717 - DNA, 36 bp, Artificial Sequence
  Description of Artificial Sequence: Synthetic oligonucleotide
agggccagtcagagtgttagcagcaggtacttagcc

SEQ ID NO: 1718 - protein, 12 aa, Artificial Sequence
  Description of Artificial Sequence: Synthetic peptide
RASQSVSSRYLA

SEQ ID NO: 1719 - DNA, 51 bp, Artificial Sequence
  Description of Artificial Sequence: Synthetic oligonucleotide
aagtccagccagactgttttacacagctccaacaattataactacttagct

SEQ ID NO: 1720 - protein, 17 aa, Artificial Sequence
  Description of Artificial Sequence: Synthetic peptide
KSSQTVLHSSNNYNYLA

SEQ ID NO: 1721 - DNA, 36 bp, Artificial Sequence; identical to SEQ ID NO: 1681
  Description of Artificial Sequence: Synthetic oligonucleotide

SEQ ID NO: 1722 - protein, 12 aa, Artificial Sequence
  Description of Artificial Sequence: Synthetic peptide
RASQSVSSSYLV

SEQ ID NO: 1723 - DNA, 36 bp, Artificial Sequence
  Description of Artificial Sequence: Synthetic oligonucleotide
agggccagtcagagtgttagcagcagttacttatcc

SEQ ID NO: 1724 - protein, 12 aa, Artificial Sequence
  Description of Artificial Sequence: Synthetic peptide
RASQSVSSSYLS

SEQ ID NO: 1725 - DNA, 36 bp, Artificial Sequence
  Description of Artificial Sequence: Synthetic oligonucleotide
agggccagtcagaatatttacagcaactacttagcc

SEQ ID NO: 1726 - protein, 12 aa, Artificial Sequence
  Description of Artificial Sequence: Synthetic peptide
RASQNIYSNYLA

SEQ ID NO: 1727 - DNA, 33 bp, Artificial Sequence
  Description of Artificial Sequence: Synthetic oligonucleotide
cgggcgagtcagggcattggcaagtatttagcc

SEQ ID NO: 1728 - protein, 11 aa, Artificial Sequence
  Description of Artificial Sequence: Synthetic peptide
RASQGIGKYLA

SEQ ID NO: 1729 - DNA, 33 bp, Artificial Sequence
  Description of Artificial Sequence: Synthetic oligonucleotide
agggccagtctgagtgttgtcaacagcttagcc

SEQ ID NO: 1730 - protein, 11 aa, Artificial Sequence
  Description of Artificial Sequence: Synthetic peptide
RASLSVVNSLA

SEQ ID NO: 1731 - DNA, 48 bp, Artificial Sequence
  Description of Artificial Sequence: Synthetic oligonucleotide
aggtctagtcagagcctcctgcatagtaatggacacaactatttggat

SEQ ID NO: 1732 - protein, 16 aa, Artificial Sequence
  Description of Artificial Sequence: Synthetic peptide
RSSQSLLHSNGHNYLD

SEQ ID NO: 1733 - DNA, 36 bp, Artificial Sequence; identical to SEQ ID NO: 99
  Description of Artificial Sequence: Synthetic oligonucleotide

SEQ ID NO: 1734 - protein, 12 aa, Artificial Sequence
  Description of Artificial Sequence: Synthetic peptide
RASQSVNSNYLA

SEQ ID NO: 1735 - DNA, 51 bp, Artificial Sequence
  Description of Artificial Sequence: Synthetic oligonucleotide
aagtcccgccagagtgttttacacagctccaacaattacaactacttagct

SEQ ID NO: 1736 - protein, 17 aa, Artificial Sequence
  Description of Artificial Sequence: Synthetic peptide
KSRQSVLHSSNNYNYLA

SEQ ID NO: 1737 - DNA, 51 bp, Artificial Sequence
  Description of Artificial Sequence: Synthetic oligonucleotide
aagtccagccagagtattttatacagctccaacaataataactacttagct

SEQ ID NO: 1738 - protein, 17 aa, Artificial Sequence
  Description of Artificial Sequence: Synthetic peptide
KSSQSILYSSNNNNYLA

SEQ ID NO: 1739 - DNA, 36 bp, Artificial Sequence; identical to SEQ ID NO: 1697
  Description of Artificial Sequence: Synthetic oligonucleotide

SEQ ID NO: 1740 - protein, 12 aa, Artificial Sequence
  Description of Artificial Sequence: Synthetic peptide
RASQSVYSSYLA

SEQ ID NO: 1741 - DNA, 36 bp, Artificial Sequence; identical to SEQ ID NO: 1697
  Description of Artificial Sequence: Synthetic oligonucleotide

SEQ ID NO: 1742 - protein, 12 aa, Artificial Sequence
  Description of Artificial Sequence: Synthetic peptide
RASQSVYSSYLA

SEQ ID NO: 1743 - DNA, 48 bp, Artificial Sequence
  Description of Artificial Sequence: Synthetic oligonucleotide
aggtctagtcagagcctcctgcatagtagtggatacaactatttggat

SEQ ID NO: 1744 - protein, 16 aa, Artificial Sequence
  Description of Artificial Sequence: Synthetic peptide
RSSQSLLHSSGYNYLD

SEQ ID NO: 1745 - DNA, 36 bp, Artificial Sequence
  Description of Artificial Sequence: Synthetic oligonucleotide
agggccagtccgagtgttaacagctactacttagcc

SEQ ID NO: 1746 - protein, 12 aa, Artificial Sequence
  Description of Artificial Sequence: Synthetic peptide
RASPSVNSYYLA

SEQ ID NO: 1747 - DNA, 33 bp, Artificial Sequence; identical to SEQ ID NO: 1505
  Description of Artificial Sequence: Synthetic oligonucleotide

SEQ ID NO: 1748 - protein, 11 aa, Artificial Sequence
  Description of Artificial Sequence: Synthetic peptide
RASQSVSSSLA

SEQ ID NO: 1749 - DNA, 36 bp, Artificial Sequence
  Description of Artificial Sequence: Synthetic oligonucleotide
agggccagtcagagtgttgacagcaactacttagcc

SEQ ID NO: 1750 - protein, 12 aa, Artificial Sequence
  Description of Artificial Sequence: Synthetic peptide
RASQSVDSNYLA

SEQ ID NO: 1751 - DNA, 33 bp, Artificial Sequence
  Description of Artificial Sequence: Synthetic oligonucleotide
cgggcgagtcagggcattagcaagtatttagcc

SEQ ID NO: 1752 - protein, 11 aa, Artificial Sequence
  Description of Artificial Sequence: Synthetic peptide
RASQGISKYLA

SEQ ID NO: 1753 - DNA, 51 bp, Artificial Sequence; identical to SEQ ID NO: 1719
  Description of Artificial Sequence: Synthetic oligonucleotide

SEQ ID NO: 1754 - protein, 17 aa, Artificial Sequence
  Description of Artificial Sequence: Synthetic peptide
KSSQTVLHSSNNYNYLA

SEQ ID NO: 1755 - DNA, 36 bp, Artificial Sequence
  Description of Artificial Sequence: Synthetic oligonucleotide
agggccagtcagagtgtttacagcagctacttagcg

SEQ ID NO: 1756 - protein, 12 aa, Artificial Sequence
  Description of Artificial Sequence: Synthetic peptide
RASQSVYSSYLA

SEQ ID NO: 1757 - DNA, 36 bp, Artificial Sequence; identical to SEQ ID NO: 1697
  Description of Artificial Sequence: Synthetic oligonucleotide

SEQ ID NO: 1758 - protein, 12 aa, Artificial Sequence
  Description of Artificial Sequence: Synthetic peptide
RASQSVYSSYLA

SEQ ID NO: 1759 - DNA, 36 bp, Artificial Sequence; identical to SEQ ID NO: 759
  Description of Artificial Sequence: Synthetic oligonucleotide

SEQ ID NO: 1760 - protein, 12 aa, Artificial Sequence
  Description of Artificial Sequence: Synthetic peptide
RASQSVSSSYLA

SEQ ID NO: 1761 - DNA, 36 bp, Artificial Sequence; identical to SEQ ID NO: 1717
  Description of Artificial Sequence: Synthetic oligonucleotide

SEQ ID NO: 1762 - protein, 12 aa, Artificial Sequence
  Description of Artificial Sequence: Synthetic peptide
RASQSVSSRYLA

SEQ ID NO: 1763 - DNA, 36 bp, Artificial Sequence; identical to SEQ ID NO: 1681
  Description of Artificial Sequence: Synthetic oligonucleotide

SEQ ID NO: 1764 - protein, 12 aa, Artificial Sequence
  Description of Artificial Sequence: Synthetic peptide
RASQSVSSSYLV

SEQ ID NO: 1765 - DNA, 36 bp, Artificial Sequence
  Description of Artificial Sequence: Synthetic oligonucleotide
agggccagtcagagtgttcacagcaggtacttagcc

SEQ ID NO: 1766 - protein, 12 aa, Artificial Sequence
  Description of Artificial Sequence: Synthetic peptide
RASQSVHSRYLA

SEQ ID NO: 1767 - DNA, 51 bp, Artificial Sequence
  Description of Artificial Sequence: Synthetic oligonucleotide
aagtccagccagagtgttttatacacctccaacaataacaactacttagct

SEQ ID NO: 1768 - protein, 17 aa, Artificial Sequence
  Description of Artificial Sequence: Synthetic peptide
KSSQSVLYTSNNNNYLA

SEQ ID NO: 1769 - DNA, 36 bp, Artificial Sequence; identical to SEQ ID NO: 1681
  Description of Artificial Sequence: Synthetic oligonucleotide

SEQ ID NO: 1770 - protein, 12 aa, Artificial Sequence
  Description of Artificial Sequence: Synthetic peptide
RASQSVSSSYLV

SEQ ID NO: 1771 - DNA, 36 bp, Artificial Sequence
  Description of Artificial Sequence: Synthetic oligonucleotide
agggccaggcagagtgttgacagcagttatttagcc

SEQ ID NO: 1772 - protein, 12 aa, Artificial Sequence
  Description of Artificial Sequence: Synthetic peptide
RARQSVDSSYLA

SEQ ID NO: 1773 - DNA, 51 bp, Artificial Sequence
  Description of Artificial Sequence: Synthetic oligonucleotide
aggtccagccagagtgttttatacagctccaacaattataactacttagct

SEQ ID NO: 1774 - protein, 17 aa, Artificial Sequence
  Description of Artificial Sequence: Synthetic peptide
RSSQSVLYSSNNYNYLA

SEQ ID NO: 1775 - DNA, 33 bp, Artificial Sequence
  Description of Artificial Sequence: Synthetic oligonucleotide
cgggcgagtcaggtcattagcaagtatttagcc

SEQ ID NO: 1776 - protein, 11 aa, Artificial Sequence
  Description of Artificial Sequence: Synthetic peptide
RASQVISKYLA

SEQ ID NO: 1777 - DNA, 51 bp, Artificial Sequence
  Description of Artificial Sequence: Synthetic oligonucleotide
aagtccagccagagtgttttacacagctctaataaaaagaactacttagct

SEQ ID NO: 1778 - protein, 17 aa, Artificial Sequence
  Description of Artificial Sequence: Synthetic peptide
KSSQSVLHSSNKKNYLA

SEQ ID NO: 1779 - DNA, 51 bp, Artificial Sequence; identical to SEQ ID NO: 1767
  Description of Artificial Sequence: Synthetic oligonucleotide

SEQ ID NO: 1780 - protein, 17 aa, Artificial Sequence
  Description of Artificial Sequence: Synthetic peptide
KSSQSVLYTSNNNNYLA

SEQ ID NO: 1781 - DNA, 33 bp, Artificial Sequence
  Description of Artificial Sequence: Synthetic oligonucleotide
agggccagtcagagtgttagcagaaatttagcc

SEQ ID NO: 1782 - protein, 11 aa, Artificial Sequence
  Description of Artificial Sequence: Synthetic peptide
RASQSVSRNLA

SEQ ID NO: 1783 - DNA, 33 bp, Artificial Sequence
  Description of Artificial Sequence: Synthetic oligonucleotide
agggccagtcagagtgttgccagcagcttagcc

SEQ ID NO: 1784 - protein, 11 aa, Artificial Sequence
  Description of Artificial Sequence: Synthetic peptide
RASQSVASSLA

SEQ ID NO: 1785 - DNA, 36 bp, Artificial Sequence
  Description of Artificial Sequence: Synthetic oligonucleotide
agggccagtcagagttttagcagcgcctacttagcc

SEQ ID NO: 1786 - protein, 12 aa, Artificial Sequence
  Description of Artificial Sequence: Synthetic peptide
RASQSFSSAYLA

SEQ ID NO: 1787 - DNA, 51 bp, Artificial Sequence; identical to SEQ ID NO: 159
  Description of Artificial Sequence: Synthetic oligonucleotide

SEQ ID NO: 1788 - protein, 17 aa, Artificial Sequence
  Description of Artificial Sequence: Synthetic peptide
KSSQSVLYSSNSHNYLA

SEQ ID NO: 1789 - DNA, 36 bp, Artificial Sequence
  Description of Artificial Sequence: Synthetic oligonucleotide
agggccagtcagaatgttgacagcaactacttagcc

SEQ ID NO: 1790 - protein, 12 aa, Artificial Sequence
  Description of Artificial Sequence: Synthetic peptide
RASQNVDSNYLA

SEQ ID NO: 1791 - DNA, 51 bp, Artificial Sequence; identical to SEQ ID NO: 1719
  Description of Artificial Sequence: Synthetic oligonucleotide

SEQ ID NO: 1792 - protein, 17 aa, Artificial Sequence
  Description of Artificial Sequence: Synthetic peptide
KSSQTVLHSSNNYNYLA

SEQ ID NO: 1793 - DNA, 51 bp, Artificial Sequence
  Description of Artificial Sequence: Synthetic oligonucleotide
aagtccagccagagtgttttatacagcttcaacaattacaactacttagct

SEQ ID NO: 1794 - protein, 17 aa, Artificial Sequence
  Description of Artificial Sequence: Synthetic peptide
KSSQSVLYSFNNYNYLA

SEQ ID NO: 1795 - DNA, 51 bp, Artificial Sequence; identical to SEQ ID NO: 83
  Description of Artificial Sequence: Synthetic oligonucleotide

SEQ ID NO: 1796 - protein, 17 aa, Artificial Sequence
  Description of Artificial Sequence: Synthetic peptide
KSSQSVLFSSNNYNYLA

SEQ ID NO: 1797 - DNA, 51 bp, Artificial Sequence
  Description of Artificial Sequence: Synthetic oligonucleotide
aagtccagccagactgttttacacagcttcaacaattataactacttagct

SEQ ID NO: 1798 - protein, 17 aa, Artificial Sequence
  Description of Artificial Sequence: Synthetic peptide
KSSQTVLHSFNNYNYLA

SEQ ID NO: 1799 - DNA, 36 bp, Artificial Sequence; identical to SEQ ID NO: 1697
  Description of Artificial Sequence: Synthetic oligonucleotide

SEQ ID NO: 1800 - protein, 12 aa, Artificial Sequence
  Description of Artificial Sequence: Synthetic peptide
RASQSVYSSYLA

SEQ ID NO: 1801 - DNA, 36 bp, Artificial Sequence; identical to SEQ ID NO: 1697
  Description of Artificial Sequence: Synthetic oligonucleotide

SEQ ID NO: 1802 - protein, 12 aa, Artificial Sequence
  Description of Artificial Sequence: Synthetic peptide
RASQSVYSSYLA

SEQ ID NO: 1803 - DNA, 51 bp, Artificial Sequence
  Description of Artificial Sequence: Synthetic oligonucleotide
aagtccagccagagtgttttatacagttccaacaataataactacttagct

SEQ ID NO: 1804 - protein, 17 aa, Artificial Sequence
  Description of Artificial Sequence: Synthetic peptide
KSSQSVLYSSNNNNYLA

SEQ ID NO: 1805 - DNA, 33 bp, Artificial Sequence; identical to SEQ ID NO: 1751
  Description of Artificial Sequence: Synthetic oligonucleotide

SEQ ID NO: 1806 - protein, 11 aa, Artificial Sequence
  Description of Artificial Sequence: Synthetic peptide
RASQGISKYLA

SEQ ID NO: 1807 - DNA, 36 bp, Artificial Sequence
  Description of Artificial Sequence: Synthetic oligonucleotide
agggccagtcagatttttagcagcagctacttagcc

SEQ ID NO: 1808 - protein, 12 aa, Artificial Sequence
  Description of Artificial Sequence: Synthetic peptide
RASQIFSSSYLA

SEQ ID NO: 1809 - DNA, 33 bp, Artificial Sequence; identical to SEQ ID NO: 1729
  Description of Artificial Sequence: Synthetic oligonucleotide

SEQ ID NO: 1810 - protein, 11 aa, Artificial Sequence
  Description of Artificial Sequence: Synthetic peptide
RASLSVVNSLA

SEQ ID NO: 1811 - DNA, 51 bp, Artificial Sequence
  Description of Artificial Sequence: Synthetic oligonucleotide
atgtccagccagagtgttttacacagcttcaacaataagaactacttaact

SEQ ID NO: 1812 - protein, 17 aa, Artificial Sequence
  Description of Artificial Sequence: Synthetic peptide
MSSQSVLHSFNNKNYLT

SEQ ID NO: 1813 - DNA, 51 bp, Artificial Sequence; identical to SEQ ID NO: 159
  Description of Artificial Sequence: Synthetic oligonucleotide

SEQ ID NO: 1814 - protein, 17 aa, Artificial Sequence
  Description of Artificial Sequence: Synthetic peptide
KSSQSVLYSSNSHNYLA

SEQ ID NO: 1815 - DNA, 51 bp, Artificial Sequence; identical to SEQ ID NO: 1737
  Description of Artificial Sequence: Synthetic oligonucleotide

SEQ ID NO: 1816 - protein, 17 aa, Artificial Sequence
  Description of Artificial Sequence: Synthetic peptide
KSSQSILYSSNNNNYLA

SEQ ID NO: 1817 - DNA, 36 bp, Artificial Sequence; identical to SEQ ID NO: 1697
  Description of Artificial Sequence: Synthetic oligonucleotide

SEQ ID NO: 1818 - protein, 12 aa, Artificial Sequence
  Description of Artificial Sequence: Synthetic peptide
RASQSVYSSYLA

SEQ ID NO: 1819 - DNA, 51 bp, Artificial Sequence; identical to SEQ ID NO: 1693
  Description of Artificial Sequence: Synthetic oligonucleotide

SEQ ID NO: 1820 - protein, 17 aa, Artificial Sequence
  Description of Artificial Sequence: Synthetic peptide
KSSQSVLFSSNNYNYLA

SEQ ID NO: 1821 - DNA, 36 bp, Artificial Sequence; identical to SEQ ID NO: 1771
  Description of Artificial Sequence: Synthetic oligonucleotide

SEQ ID NO: 1822 - protein, 12 aa, Artificial Sequence
  Description of Artificial Sequence: Synthetic peptide
RARQSVDSSYLA

SEQ ID NO: 1823 - DNA, 36 bp, Artificial Sequence; identical to SEQ ID NO: 1697
  Description of Artificial Sequence: Synthetic oligonucleotide

SEQ ID NO: 1824 - protein, 12 aa, Artificial Sequence
  Description of Artificial Sequence: Synthetic peptide
RASQSVYSSYLA

SEQ ID NO: 1825 - DNA, 51 bp, Artificial Sequence
  Description of Artificial Sequence: Synthetic oligonucleotide
aagtccagccagagtattttatacagctccaacaattacaactacttagct

SEQ ID NO: 1826 - protein, 17 aa, Artificial Sequence
  Description of Artificial Sequence: Synthetic peptide
KSSQSILYSSNNYNYLA

SEQ ID NO: 1827 - DNA, 36 bp, Artificial Sequence; identical to SEQ ID NO: 1697
  Description of Artificial Sequence: Synthetic oligonucleotide

SEQ ID NO: 1828 - protein, 12 aa, Artificial Sequence
  Description of Artificial Sequence: Synthetic peptide
RASQSVYSSYLA

SEQ ID NO: 1829 - DNA, 36 bp, Artificial Sequence; identical to SEQ ID NO: 1697
  Description of Artificial Sequence: Synthetic oligonucleotide

SEQ ID NO: 1830 - protein, 12 aa, Artificial Sequence
  Description of Artificial Sequence: Synthetic peptide
RASQSVYSSYLA

SEQ ID NO: 1831 - DNA, 36 bp, Artificial Sequence; identical to SEQ ID NO: 1697
  Description of Artificial Sequence: Synthetic oligonucleotide

SEQ ID NO: 1832 - protein, 12 aa, Artificial Sequence
  Description of Artificial Sequence: Synthetic peptide
RASQSVYSSYLA

SEQ ID NO: 1833 - DNA, 36 bp, Artificial Sequence; identical to SEQ ID NO: 1681
  Description of Artificial Sequence: Synthetic oligonucleotide

SEQ ID NO: 1834 - protein, 12 aa, Artificial Sequence
  Description of Artificial Sequence: Synthetic peptide
RASQSVSSSYLV

SEQ ID NO: 1835 - DNA, 51 bp, Artificial Sequence; identical to SEQ ID NO: 1767
  Description of Artificial Sequence: Synthetic oligonucleotide

SEQ ID NO: 1836 - protein, 17 aa, Artificial Sequence
  Description of Artificial Sequence: Synthetic peptide
KSSQSVLYTSNNNNYLA

SEQ ID NO: 1837 - DNA, 36 bp, Artificial Sequence; identical to SEQ ID NO: 1697
  Description of Artificial Sequence: Synthetic oligonucleotide

SEQ ID NO: 1838 - protein, 12 aa, Artificial Sequence
  Description of Artificial Sequence: Synthetic peptide
RASQSVYSSYLA

SEQ ID NO: 1839 - DNA, 51 bp, Artificial Sequence
  Description of Artificial Sequence: Synthetic oligonucleotide
aagtccagccagagtgttttacacaggtccaacaattacaactacttagcg

SEQ ID NO: 1840 - protein, 17 aa, Artificial Sequence
  Description of Artificial Sequence: Synthetic peptide
KSSQSVLHRSNNYNYLA

SEQ ID NO: 1841 - DNA, 36 bp, Artificial Sequence
  Description of Artificial Sequence: Synthetic oligonucleotide
agggccagtcagaatatttacagcagctacttagcc

SEQ ID NO: 1842 - protein, 12 aa, Artificial Sequence
  Description of Artificial Sequence: Synthetic peptide
RASQNIYSSYLA

SEQ ID NO: 1843 - DNA, 36 bp, Artificial Sequence
  Description of Artificial Sequence: Synthetic oligonucleotide
agggccagtcagagtgttgacagcggctacttagcc

SEQ ID NO: 1844 - protein, 12 aa, Artificial Sequence
  Description of Artificial Sequence: Synthetic peptide
RASQSVDSGYLA

SEQ ID NO: 1845 - DNA, 36 bp, Artificial Sequence
  Description of Artificial Sequence: Synthetic oligonucleotide
agggccagtcagagtattaacagcaactacttagcc

SEQ ID NO: 1846 - protein, 12 aa, Artificial Sequence
  Description of Artificial Sequence: Synthetic peptide
RASQSINSNYLA

SEQ ID NO: 1847 - DNA, 51 bp, Artificial Sequence
  Description of Artificial Sequence: Synthetic oligonucleotide
aagtccagacagagtgttttatacagctccaacaattacaactacttaact

SEQ ID NO: 1848 - protein, 17 aa, Artificial Sequence
  Description of Artificial Sequence: Synthetic peptide
KSRQSVLYSSNNYNYLT

SEQ ID NO: 1849 - DNA, 51 bp, Artificial Sequence; identical to SEQ ID NO: 1767
  Description of Artificial Sequence: Synthetic oligonucleotide

SEQ ID NO: 1850 - protein, 17 aa, Artificial Sequence
  Description of Artificial Sequence: Synthetic peptide
KSSQSVLYTSNNNNYLA

SEQ ID NO: 1851 - DNA, 36 bp, Artificial Sequence
  Description of Artificial Sequence: Synthetic oligonucleotide
agggccagtcagagtgttgacagcagctacttagcc

SEQ ID NO: 1852 - protein, 12 aa, Artificial Sequence
  Description of Artificial Sequence: Synthetic peptide
RASQSVDSSYLA

SEQ ID NO: 1853 - DNA, 33 bp, Artificial Sequence; identical to SEQ ID NO: 1727
  Description of Artificial Sequence: Synthetic oligonucleotide

SEQ ID NO: 1854 - protein, 11 aa, Artificial Sequence
  Description of Artificial Sequence: Synthetic peptide
RASQGIGKYLA

SEQ ID NO: 1855 - DNA, 33 bp, Artificial Sequence
  Description of Artificial Sequence: Synthetic oligonucleotide
cgggcgagtcagggcattggcaggtatttagcc

SEQ ID NO: 1856 - protein, 11 aa, Artificial Sequence
  Description of Artificial Sequence: Synthetic peptide
RASQGIGRYLA

SEQ ID NO: 1857 - DNA, 36 bp, Artificial Sequence; identical to SEQ ID NO: 1697
  Description of Artificial Sequence: Synthetic oligonucleotide

SEQ ID NO: 1858 - protein, 12 aa, Artificial Sequence
  Description of Artificial Sequence: Synthetic peptide
RASQSVYSSYLA

SEQ ID NO: 1859 - DNA, 36 bp, Artificial Sequence; identical to SEQ ID NO: 759
  Description of Artificial Sequence: Synthetic oligonucleotide

SEQ ID NO: 1860 - protein, 12 aa, Artificial Sequence
  Description of Artificial Sequence: Synthetic peptide
RASQSVSSSYLA

SEQ ID NO: 1861 - DNA, 36 bp, Artificial Sequence; identical to SEQ ID NO: 1697
  Description of Artificial Sequence: Synthetic oligonucleotide

SEQ ID NO: 1862 - protein, 12 aa, Artificial Sequence
  Description of Artificial Sequence: Synthetic peptide
RASQSVYSSYLA

SEQ ID NO: 1863 - DNA, 36 bp, Artificial Sequence; identical to SEQ ID NO: 1697
  Description of Artificial Sequence: Synthetic oligonucleotide

SEQ ID NO: 1864 - protein, 12 aa, Artificial Sequence
  Description of Artificial Sequence: Synthetic peptide
RASQSVYSSYLA

SEQ ID NO: 1865 - DNA, 51 bp, Artificial Sequence; identical to SEQ ID NO: 1693
  Description of Artificial Sequence: Synthetic oligonucleotide

SEQ ID NO: 1866 - protein, 17 aa, Artificial Sequence
  Description of Artificial Sequence: Synthetic peptide
KSSQSVLFSSNNYNYLA

SEQ ID NO: 1867 - DNA, 51 bp, Artificial Sequence; identical to SEQ ID NO: 1767
  Description of Artificial Sequence: Synthetic oligonucleotide

SEQ ID NO: 1868 - protein, 17 aa, Artificial Sequence
  Description of Artificial Sequence: Synthetic peptide
KSSQSVLYTSNNNNYLA

SEQ ID NO: 1869 - DNA, 36 bp, Artificial Sequence; identical to SEQ ID NO: 759
  Description of Artificial Sequence: Synthetic oligonucleotide

SEQ ID NO: 1870 - protein, 12 aa, Artificial Sequence
  Description of Artificial Sequence: Synthetic peptide
RASQSVSSSYLA

SEQ ID NO: 1871 - DNA, 36 bp, Artificial Sequence; identical to SEQ ID NO: 1697
  Description of Artificial Sequence: Synthetic oligonucleotide

SEQ ID NO: 1872 - protein, 12 aa, Artificial Sequence
  Description of Artificial Sequence: Synthetic peptide
RASQSVYSSYLA

SEQ ID NO: 1873 - DNA, 36 bp, Artificial Sequence; identical to SEQ ID NO: 759
  Description of Artificial Sequence: Synthetic oligonucleotide

SEQ ID NO: 1874 - protein, 12 aa, Artificial Sequence
  Description of Artificial Sequence: Synthetic peptide
RASQSVSSSYLA

SEQ ID NO: 1875 - DNA, 36 bp, Artificial Sequence
  Description of Artificial Sequence: Synthetic oligonucleotide
agggccagtgagagtgttagcagcagctacttagtc

SEQ ID NO: 1876 - protein, 12 aa, Artificial Sequence
  Description of Artificial Sequence: Synthetic peptide
RASESVSSSYLV

SEQ ID NO: 1877 - DNA, 36 bp, Artificial Sequence; identical to SEQ ID NO: 1875
  Description of Artificial Sequence: Synthetic oligonucleotide

SEQ ID NO: 1878 - protein, 12 aa, Artificial Sequence
  Description of Artificial Sequence: Synthetic peptide
RASESVSSSYLV

SEQ ID NO: 1879 - DNA, 36 bp, Artificial Sequence; identical to SEQ ID NO: 1697
  Description of Artificial Sequence: Synthetic oligonucleotide

SEQ ID NO: 1880 - protein, 12 aa, Artificial Sequence
  Description of Artificial Sequence: Synthetic peptide
RASQSVYSSYLA

SEQ ID NO: 1881 - DNA, 36 bp, Artificial Sequence; identical to SEQ ID NO: 759
  Description of Artificial Sequence: Synthetic oligonucleotide

SEQ ID NO: 1882 - protein, 12 aa, Artificial Sequence
  Description of Artificial Sequence: Synthetic peptide
RASQSVSSSYLA

SEQ ID NO: 1883 - DNA, 33 bp, Artificial Sequence; identical to SEQ ID NO: 205
  Description of Artificial Sequence: Synthetic oligonucleotide

SEQ ID NO: 1884 - protein, 11 aa, Artificial Sequence
  Description of Artificial Sequence: Synthetic peptide
RASQDIRNDLG

SEQ ID NO: 1885 - DNA, 36 bp, Artificial Sequence; identical to SEQ ID NO: 1697
  Description of Artificial Sequence: Synthetic oligonucleotide

SEQ ID NO: 1886 - protein, 12 aa, Artificial Sequence
  Description of Artificial Sequence: Synthetic peptide
RASQSVYSSYLA

SEQ ID NO: 1887 - DNA, 36 bp, Artificial Sequence; identical to SEQ ID NO: 1681
  Description of Artificial Sequence: Synthetic oligonucleotide

SEQ ID NO: 1888 - protein, 12 aa, Artificial Sequence
  Description of Artificial Sequence: Synthetic peptide
RASQSVSSSYLV

SEQ ID NO: 1889 - DNA, 51 bp, Artificial Sequence; identical to SEQ ID NO: 1767
  Description of Artificial Sequence: Synthetic oligonucleotide

SEQ ID NO: 1890 - protein, 17 aa, Artificial Sequence
  Description of Artificial Sequence: Synthetic peptide
KSSQSVLYTSNNNNYLA

SEQ ID NO: 1891 - DNA, 51 bp, Artificial Sequence; identical to SEQ ID NO: 1767
  Description of Artificial Sequence: Synthetic oligonucleotide

SEQ ID NO: 1892 - protein, 17 aa, Artificial Sequence
  Description of Artificial Sequence: Synthetic peptide
KSSQSVLYTSNNNNYLA

SEQ ID NO: 1893 - DNA, 36 bp, Artificial Sequence; identical to SEQ ID NO: 1875
  Description of Artificial Sequence: Synthetic oligonucleotide

SEQ ID NO: 1894 - protein, 12 aa, Artificial Sequence
  Description of Artificial Sequence: Synthetic peptide
RASESVSSSYLV

SEQ ID NO: 1895 - DNA, 36 bp, Artificial Sequence; identical to SEQ ID NO: 1843
  Description of Artificial Sequence: Synthetic oligonucleotide

SEQ ID NO: 1896 - protein, 12 aa, Artificial Sequence
  Description of Artificial Sequence: Synthetic peptide
RASQSVDSGYLA

SEQ ID NO: 1897 - DNA, 36 bp, Artificial Sequence; identical to SEQ ID NO: 1755
  Description of Artificial Sequence: Synthetic oligonucleotide

SEQ ID NO: 1898 - protein, 12 aa, Artificial Sequence
  Description of Artificial Sequence: Synthetic peptide
RASQSVYSSYLA

SEQ ID NO: 1899 - DNA, 51 bp, Artificial Sequence; identical to SEQ ID NO: 1719
  Description of Artificial Sequence: Synthetic oligonucleotide

SEQ ID NO: 1900 - protein, 17 aa, Artificial Sequence
  Description of Artificial Sequence: Synthetic peptide
KSSQTVLHSSNNYNYLA

SEQ ID NO: 1901 - DNA, 36 bp, Artificial Sequence
  Description of Artificial Sequence: Synthetic oligonucleotide
agggccagtccgagtgttcacagcaactacttagcc

SEQ ID NO: 1902 - protein, 12 aa, Artificial Sequence
  Description of Artificial Sequence: Synthetic peptide
RASPSVHSNYLA

SEQ ID NO: 1903 - DNA, 51 bp, Artificial Sequence
  Description of Artificial Sequence: Synthetic oligonucleotide
aagtccagacagagtgttttacacagctccaacaattacaactacttagct

SEQ ID NO: 1904 - protein, 17 aa, Artificial Sequence
  Description of Artificial Sequence: Synthetic peptide
KSRQSVLHSSNNYNYLA

SEQ ID NO: 1905 - DNA, 51 bp, Artificial Sequence; identical to SEQ ID NO: 1719
  Description of Artificial Sequence: Synthetic oligonucleotide

SEQ ID NO: 1906 - protein, 17 aa, Artificial Sequence
  Description of Artificial Sequence: Synthetic peptide
KSSQTVLHSSNNYNYLA

SEQ ID NO: 1907 - DNA, 33 bp, Artificial Sequence; identical to SEQ ID NO: 1775
  Description of Artificial Sequence: Synthetic oligonucleotide

SEQ ID NO: 1908 - protein, 11 aa, Artificial Sequence
  Description of Artificial Sequence: Synthetic peptide
RASQVISKYLA

SEQ ID NO: 1909 - DNA, 36 bp, Artificial Sequence; identical to SEQ ID NO: 1845
  Description of Artificial Sequence: Synthetic oligonucleotide

SEQ ID NO: 1910 - protein, 12 aa, Artificial Sequence
  Description of Artificial Sequence: Synthetic peptide
RASQSINSNYLA

SEQ ID NO: 1911 - DNA, 33 bp, Artificial Sequence
  Description of Artificial Sequence: Synthetic oligonucleotide
agggccagtcaggatgttatcacctacttagcc

SEQ ID NO: 1912 - protein, 11 aa, Artificial Sequence
  Description of Artificial Sequence: Synthetic peptide
RASQDVITYLA

SEQ ID NO: 1913 - DNA, 51 bp, Artificial Sequence; identical to SEQ ID NO: 1777
  Description of Artificial Sequence: Synthetic oligonucleotide

SEQ ID NO: 1914 - protein, 17 aa, Artificial Sequence
  Description of Artificial Sequence: Synthetic peptide
KSSQSVLHSSNKKNYLA

SEQ ID NO: 1915 - DNA, 36 bp, Artificial Sequence; identical to SEQ ID NO: 1697
  Description of Artificial Sequence: Synthetic oligonucleotide

SEQ ID NO: 1916 - protein, 12 aa, Artificial Sequence
  Description of Artificial Sequence: Synthetic peptide
RASQSVYSSYLA

SEQ ID NO: 1917 - DNA, 36 bp, Artificial Sequence; identical to SEQ ID NO: 1697
  Description of Artificial Sequence: Synthetic oligonucleotide

SEQ ID NO: 1918 - protein, 12 aa, Artificial Sequence
  Description of Artificial Sequence: Synthetic peptide
RASQSVYSSYLA

SEQ ID NO: 1919 - DNA, 36 bp, Artificial Sequence
  Description of Artificial Sequence: Synthetic oligonucleotide
aggtccagtcagagtgttagcagcagctacttagtc

SEQ ID NO: 1920 - protein, 12 aa, Artificial Sequence
  Description of Artificial Sequence: Synthetic peptide
RSSQSVSSSYLV

SEQ ID NO: 1921 - DNA, 36 bp, Artificial Sequence; identical to SEQ ID NO: 1717
  Description of Artificial Sequence: Synthetic oligonucleotide

SEQ ID NO: 1922 - protein, 12 aa, Artificial Sequence
  Description of Artificial Sequence: Synthetic peptide
RASQSVSSRYLA

SEQ ID NO: 1923 - DNA, 36 bp, Artificial Sequence; identical to SEQ ID NO: 1713
  Description of Artificial Sequence: Synthetic oligonucleotide

SEQ ID NO: 1924 - protein, 12 aa, Artificial Sequence
  Description of Artificial Sequence: Synthetic peptide
RASPSVDSSYLA

SEQ ID NO: 1925 - DNA, 36 bp, Artificial Sequence; identical to SEQ ID NO: 1841
  Description of Artificial Sequence: Synthetic oligonucleotide

SEQ ID NO: 1926 - protein, 12 aa, Artificial Sequence
  Description of Artificial Sequence: Synthetic peptide
RASQNIYSSYLA

SEQ ID NO: 1927 - DNA, 36 bp, Artificial Sequence; identical to SEQ ID NO: 99
  Description of Artificial Sequence: Synthetic oligonucleotide

SEQ ID NO: 1928 - protein, 12 aa, Artificial Sequence
  Description of Artificial Sequence: Synthetic peptide
RASQSVNSNYLA

SEQ ID NO: 1929 - DNA, 51 bp, Artificial Sequence; identical to SEQ ID NO: 1839
  Description of Artificial Sequence: Synthetic oligonucleotide

SEQ ID NO: 1930 - protein, 17 aa, Artificial Sequence
  Description of Artificial Sequence: Synthetic peptide
KSSQSVLHRSNNYNYLA

SEQ ID NO: 1931 - DNA, 36 bp, Artificial Sequence
  Description of Artificial Sequence: Synthetic oligonucleotide
agggccagtcagagtgtttggagcggctacttagcc

SEQ ID NO: 1932 - protein, 12 aa, Artificial Sequence
  Description of Artificial Sequence: Synthetic peptide
RASQSVWSGYLA

SEQ ID NO: 1933 - DNA, 51 bp, Artificial Sequence
  Description of Artificial Sequence: Synthetic oligonucleotide
aagtccagccagagtgttttgtacagctccaacagtcacaacttcttagct

SEQ ID NO: 1934 - protein, 17 aa, Artificial Sequence
  Description of Artificial Sequence: Synthetic peptide
KSSQSVLYSSNSHNFLA

SEQ ID NO: 1935 - DNA, 36 bp, Artificial Sequence; identical to SEQ ID NO: 1919
  Description of Artificial Sequence: Synthetic oligonucleotide

SEQ ID NO: 1936 - protein, 12 aa, Artificial Sequence
  Description of Artificial Sequence: Synthetic peptide
RSSQSVSSSYLV

SEQ ID NO: 1937 - DNA, 36 bp, Artificial Sequence; identical to SEQ ID NO: 1697
  Description of Artificial Sequence: Synthetic oligonucleotide

SEQ ID NO: 1938 - protein, 12 aa, Artificial Sequence
  Description of Artificial Sequence: Synthetic peptide
RASQSVYSSYLA

SEQ ID NO: 1939 - DNA, 36 bp, Artificial Sequence; identical to SEQ ID NO: 1697
  Description of Artificial Sequence: Synthetic oligonucleotide

SEQ ID NO: 1940 - protein, 12 aa, Artificial Sequence
  Description of Artificial Sequence: Synthetic peptide
RASQSVYSSYLA

SEQ ID NO: 1941 - DNA, 51 bp, Artificial Sequence
  Description of Artificial Sequence: Synthetic oligonucleotide
aagtccagccagagtgttttgcacagatccaacaattataattacttagct

SEQ ID NO: 1942 - protein, 17 aa, Artificial Sequence
  Description of Artificial Sequence: Synthetic peptide
KSSQSVLHRSNNYNYLA

SEQ ID NO: 1943 - DNA, 36 bp, Artificial Sequence; identical to SEQ ID NO: 1697
  Description of Artificial Sequence: Synthetic oligonucleotide

SEQ ID NO: 1944 - protein, 12 aa, Artificial Sequence
  Description of Artificial Sequence: Synthetic peptide
RASQSVYSSYLA

SEQ ID NO: 1945 - DNA, 36 bp, Artificial Sequence; identical to SEQ ID NO: 1749
  Description of Artificial Sequence: Synthetic oligonucleotide

SEQ ID NO: 1946 - protein, 12 aa, Artificial Sequence
  Description of Artificial Sequence: Synthetic peptide
RASQSVDSNYLA

SEQ ID NO: 1947 - DNA, 36 bp, Artificial Sequence; identical to SEQ ID NO: 1697
  Description of Artificial Sequence: Synthetic oligonucleotide

SEQ ID NO: 1948 - protein, 12 aa, Artificial Sequence
  Description of Artificial Sequence: Synthetic peptide
RASQSVYSSYLA

SEQ ID NO: 1949 - DNA, 33 bp, Artificial Sequence; identical to SEQ ID NO: 105
  Description of Artificial Sequence: Synthetic oligonucleotide

SEQ ID NO: 1950 - protein, 11 aa, Artificial Sequence
  Description of Artificial Sequence: Synthetic peptide
RASQGISNYLA

SEQ ID NO: 1951 - DNA, 36 bp, Artificial Sequence; identical to SEQ ID NO: 1697
  Description of Artificial Sequence: Synthetic oligonucleotide

SEQ ID NO: 1952 - protein, 12 aa, Artificial Sequence
  Description of Artificial Sequence: Synthetic peptide
RASQSVYSSYLA

SEQ ID NO: 1953 - DNA, 36 bp, Artificial Sequence; identical to SEQ ID NO: 759
  Description of Artificial Sequence: Synthetic oligonucleotide

SEQ ID NO: 1954 - protein, 12 aa, Artificial Sequence
  Description of Artificial Sequence: Synthetic peptide
RASQSVSSSYLA

SEQ ID NO: 1955 - DNA, 51 bp, Artificial Sequence
  Description of Artificial Sequence: Synthetic oligonucleotide
aagtccagccagagtgttttacacagctccaacaatatgaactacttagct

SEQ ID NO: 1956 - protein, 17 aa, Artificial Sequence
  Description of Artificial Sequence: Synthetic peptide
KSSQSVLHSSNNMNYLA

SEQ ID NO: 1957 - DNA, 36 bp, Artificial Sequence; identical to SEQ ID NO: 1697
  Description of Artificial Sequence: Synthetic oligonucleotide

SEQ ID NO: 1958 - protein, 12 aa, Artificial Sequence
  Description of Artificial Sequence: Synthetic peptide
RASQSVYSSYLA

SEQ ID NO: 1959 - DNA, 51 bp, Artificial Sequence
  Description of Artificial Sequence: Synthetic oligonucleotide
aagtccagccagagtgttttacacagctccaacaattacaactacttaact

SEQ ID NO: 1960 - protein, 17 aa, Artificial Sequence
  Description of Artificial Sequence: Synthetic peptide
KSSQSVLHSSNNYNYLT

SEQ ID NO: 1961 - DNA, 36 bp, Artificial Sequence; identical to SEQ ID NO: 1697
  Description of Artificial Sequence: Synthetic oligonucleotide

SEQ ID NO: 1962 - protein, 12 aa, Artificial Sequence
  Description of Artificial Sequence: Synthetic peptide
RASQSVYSSYLA

SEQ ID NO: 1963 - DNA, 51 bp, Artificial Sequence; identical to SEQ ID NO: 1767
  Description of Artificial Sequence: Synthetic oligonucleotide

SEQ ID NO: 1964 - protein, 17 aa, Artificial Sequence
  Description of Artificial Sequence: Synthetic peptide
KSSQSVLYTSNNNNYLA

SEQ ID NO: 1965 - DNA, 51 bp, Artificial Sequence
  Description of Artificial Sequence: Synthetic oligonucleotide
aagtccagccagagtgttttatacatctccaacaataataattacttagct

SEQ ID NO: 1966 - protein, 17 aa, Artificial Sequence
  Description of Artificial Sequence: Synthetic peptide
KSSQSVLYISNNNNYLA

SEQ ID NO: 1967 - DNA, 33 bp, Artificial Sequence; identical to SEQ ID NO: 109
  Description of Artificial Sequence: Synthetic oligonucleotide

SEQ ID NO: 1968 - protein, 11 aa, Artificial Sequence
  Description of Artificial Sequence: Synthetic peptide
RASQGIRNDLG

SEQ ID NO: 1969 - DNA, 36 bp, Artificial Sequence; identical to SEQ ID NO: 1697
  Description of Artificial Sequence: Synthetic oligonucleotide

SEQ ID NO: 1970 - protein, 12 aa, Artificial Sequence
  Description of Artificial Sequence: Synthetic peptide
RASQSVYSSYLA

SEQ ID NO: 1971 - DNA, 36 bp, Artificial Sequence; identical to SEQ ID NO: 1697
  Description of Artificial Sequence: Synthetic oligonucleotide

SEQ ID NO: 1972 - protein, 12 aa, Artificial Sequence
  Description of Artificial Sequence: Synthetic peptide
RASQSVYSSYLA

SEQ ID NO: 1973 - DNA, 36 bp, Artificial Sequence; identical to SEQ ID NO: 1697
  Description of Artificial Sequence: Synthetic oligonucleotide

SEQ ID NO: 1974 - protein, 12 aa, Artificial Sequence
  Description of Artificial Sequence: Synthetic peptide
RASQSVYSSYLA

SEQ ID NO: 1975 - DNA, 51 bp, Artificial Sequence
  Description of Artificial Sequence: Synthetic oligonucleotide
aagtccagccagagtgttttacacagctccaacaattggaattacttagct

SEQ ID NO: 1976 - protein, 17 aa, Artificial Sequence
  Description of Artificial Sequence: Synthetic peptide
KSSQSVLHSSNNWNYLA

SEQ ID NO: 1977 - DNA, 36 bp, Artificial Sequence; identical to SEQ ID NO: 1697
  Description of Artificial Sequence: Synthetic oligonucleotide

SEQ ID NO: 1978 - protein, 12 aa, Artificial Sequence
  Description of Artificial Sequence: Synthetic peptide
RASQSVYSSYLA

SEQ ID NO: 1979 - DNA, 48 bp, Artificial Sequence; identical to SEQ ID NO: 1743
  Description of Artificial Sequence: Synthetic oligonucleotide

SEQ ID NO: 1980 - protein, 16 aa, Artificial Sequence
  Description of Artificial Sequence: Synthetic peptide
RSSQSLLHSSGYNYLD

SEQ ID NO: 1981 - DNA, 36 bp, Artificial Sequence; identical to SEQ ID NO: 1697
  Description of Artificial Sequence: Synthetic oligonucleotide

SEQ ID NO: 1982 - protein, 12 aa, Artificial Sequence
  Description of Artificial Sequence: Synthetic peptide
RASQSVYSSYLA

SEQ ID NO: 1983 - DNA, 36 bp, Artificial Sequence; identical to SEQ ID NO: 99
  Description of Artificial Sequence: Synthetic oligonucleotide

SEQ ID NO: 1984 - protein, 12 aa, Artificial Sequence
  Description of Artificial Sequence: Synthetic peptide
RASQSVNSNYLA

SEQ ID NO: 1985 - DNA, 36 bp, Artificial Sequence; identical to SEQ ID NO: 1697
  Description of Artificial Sequence: Synthetic oligonucleotide

SEQ ID NO: 1986 - protein, 12 aa, Artificial Sequence
  Description of Artificial Sequence: Synthetic peptide
RASQSVYSSYLA

SEQ ID NO: 1987 - DNA, 36 bp, Artificial Sequence
  Description of Artificial Sequence: Synthetic oligonucleotide
agggccagtcagagtgttgacagcaacttcttagcc

SEQ ID NO: 1988 - protein, 12 aa, Artificial Sequence
  Description of Artificial Sequence: Synthetic peptide
RASQSVDSNFLA

SEQ ID NO: 1989 - DNA, 36 bp, Artificial Sequence; identical to SEQ ID NO: 1697
  Description of Artificial Sequence: Synthetic oligonucleotide

SEQ ID NO: 1990 - protein, 12 aa, Artificial Sequence
  Description of Artificial Sequence: Synthetic peptide
RASQSVYSSYLA

SEQ ID NO: 1991 - DNA, 36 bp, Artificial Sequence; identical to SEQ ID NO: 1697
  Description of Artificial Sequence: Synthetic oligonucleotide

SEQ ID NO: 1992 - protein, 12 aa, Artificial Sequence
  Description of Artificial Sequence: Synthetic peptide
RASQSVYSSYLA

SEQ ID NO: 1993 - DNA, 36 bp, Artificial Sequence; identical to SEQ ID NO: 1697
  Description of Artificial Sequence: Synthetic oligonucleotide

SEQ ID NO: 1994 - protein, 12 aa, Artificial Sequence
  Description of Artificial Sequence: Synthetic peptide
RASQSVYSSYLA

SEQ ID NO: 1995 - DNA, 33 bp, Artificial Sequence; identical to SEQ ID NO: 109
  Description of Artificial Sequence: Synthetic oligonucleotide

SEQ ID NO: 1996 - protein, 11 aa, Artificial Sequence
  Description of Artificial Sequence: Synthetic peptide
RASQGIRNDLG

SEQ ID NO: 1997 - DNA, 51 bp, Artificial Sequence; identical to SEQ ID NO: 1719
  Description of Artificial Sequence: Synthetic oligonucleotide

SEQ ID NO: 1998 - protein, 17 aa, Artificial Sequence
  Description of Artificial Sequence: Synthetic peptide
KSSQTVLHSSNNYNYLA

SEQ ID NO: 1999 - DNA, 51 bp, Artificial Sequence
  Description of Artificial Sequence: Synthetic oligonucleotide
aagtccagccagagtgttttacacaactccaacaataataactacttggct

SEQ ID NO: 2000 - protein, 17 aa, Artificial Sequence
  Description of Artificial Sequence: Synthetic peptide
KSSQSVLHNSNNNNYLA

SEQ ID NO: 2001 - DNA, 36 bp, Artificial Sequence; identical to SEQ ID NO: 1697
  Description of Artificial Sequence: Synthetic oligonucleotide

SEQ ID NO: 2002 - protein, 12 aa, Artificial Sequence
  Description of Artificial Sequence: Synthetic peptide
RASQSVYSSYLA

SEQ ID NO: 2003 - DNA, 48 bp, Artificial Sequence
  Description of Artificial Sequence: Synthetic oligonucleotide
aggtatagtcagagcctcgtgcatagtagtggatacaactatttggat

SEQ ID NO: 2004 - protein, 16 aa, Artificial Sequence
  Description of Artificial Sequence: Synthetic peptide
RYSQSLVHSSGYNYLD

SEQ ID NO: 2005 - DNA, 51 bp, Artificial Sequence; identical to SEQ ID NO: 1767
  Description of Artificial Sequence: Synthetic oligonucleotide

SEQ ID NO: 2006 - protein, 17 aa, Artificial Sequence
  Description of Artificial Sequence: Synthetic peptide
KSSQSVLYTSNNNNYLA

SEQ ID NO: 2007 - DNA, 36 bp, Artificial Sequence; identical to SEQ ID NO: 1697
  Description of Artificial Sequence: Synthetic oligonucleotide

SEQ ID NO: 2008 - protein, 12 aa, Artificial Sequence
  Description of Artificial Sequence: Synthetic peptide
RASQSVYSSYLA

SEQ ID NO: 2009 - DNA, 36 bp, Artificial Sequence; identical to SEQ ID NO: 1697
  Description of Artificial Sequence: Synthetic oligonucleotide

SEQ ID NO: 2010 - protein, 12 aa, Artificial Sequence
  Description of Artificial Sequence: Synthetic peptide
RASQSVYSSYLA

SEQ ID NO: 2011 - DNA, 36 bp, Artificial Sequence; identical to SEQ ID NO: 1697
  Description of Artificial Sequence: Synthetic oligonucleotide

SEQ ID NO: 2012 - protein, 12 aa, Artificial Sequence
  Description of Artificial Sequence: Synthetic peptide
RASQSVYSSYLA

SEQ ID NO: 2013 - DNA, 36 bp, Artificial Sequence; identical to SEQ ID NO: 1697
  Description of Artificial Sequence: Synthetic oligonucleotide

SEQ ID NO: 2014 - protein, 12 aa, Artificial Sequence
  Description of Artificial Sequence: Synthetic peptide
RASQSVYSSYLA

SEQ ID NO: 2015 - DNA, 51 bp, Artificial Sequence; identical to SEQ ID NO: 1767
  Description of Artificial Sequence: Synthetic oligonucleotide

SEQ ID NO: 2016 - protein, 17 aa, Artificial Sequence
  Description of Artificial Sequence: Synthetic peptide
KSSQSVLYTSNNNNYLA

SEQ ID NO: 2017 - DNA, 36 bp, Artificial Sequence; identical to SEQ ID NO: 1755
  Description of Artificial Sequence: Synthetic oligonucleotide

SEQ ID NO: 2018 - protein, 12 aa, Artificial Sequence
  Description of Artificial Sequence: Synthetic peptide
RASQSVYSSYLA

SEQ ID NO: 2019 - DNA, 36 bp, Artificial Sequence
  Description of Artificial Sequence: Synthetic oligonucleotide
agggccagtcagagtgttggcagcaactacttagcc

SEQ ID NO: 2020 - protein, 12 aa, Artificial Sequence
  Description of Artificial Sequence: Synthetic peptide
RASQSVGSNYLA

SEQ ID NO: 2021 - DNA, 48 bp, Artificial Sequence
  Description of Artificial Sequence: Synthetic oligonucleotide
aggtctagtcagagcctcgtgcatagtagtggatacaactatttggat

SEQ ID NO: 2022 - protein, 16 aa, Artificial Sequence
  Description of Artificial Sequence: Synthetic peptide
RSSQSLVHSSGYNYLD

SEQ ID NO: 2023 - DNA, 33 bp, Artificial Sequence
  Description of Artificial Sequence: Synthetic oligonucleotide
cgggccagtcaggatgttatcacctacttagcc

SEQ ID NO: 2024 - protein, 11 aa, Artificial Sequence
  Description of Artificial Sequence: Synthetic peptide
RASQDVITYLA

SEQ ID NO: 2025 - DNA, 36 bp, Artificial Sequence; identical to SEQ ID NO: 1697
  Description of Artificial Sequence: Synthetic oligonucleotide

SEQ ID NO: 2026 - protein, 12 aa, Artificial Sequence
  Description of Artificial Sequence: Synthetic peptide
RASQSVYSSYLA

SEQ ID NO: 2027 - DNA, 51 bp, Artificial Sequence
  Description of Artificial Sequence: Synthetic oligonucleotide
aagtccagtcagaatattttatccagctccaacaataagaactacttaact

SEQ ID NO: 2028 - protein, 17 aa, Artificial Sequence
  Description of Artificial Sequence: Synthetic peptide
KSSQNILSSSNNKNYLT

SEQ ID NO: 2029 - DNA, 36 bp, Artificial Sequence; identical to SEQ ID NO: 1697
  Description of Artificial Sequence: Synthetic oligonucleotide

SEQ ID NO: 2030 - protein, 12 aa, Artificial Sequence
  Description of Artificial Sequence: Synthetic peptide
RASQSVYSSYLA

SEQ ID NO: 2031 - DNA, 51 bp, Artificial Sequence; identical to SEQ ID NO: 1839
  Description of Artificial Sequence: Synthetic oligonucleotide

SEQ ID NO: 2032 - protein, 17 aa, Artificial Sequence
  Description of Artificial Sequence: Synthetic peptide
KSSQSVLHRSNNYNYLA

SEQ ID NO: 2033 - DNA, 36 bp, Artificial Sequence; identical to SEQ ID NO: 1697
  Description of Artificial Sequence: Synthetic oligonucleotide

SEQ ID NO: 2034 - protein, 12 aa, Artificial Sequence
  Description of Artificial Sequence: Synthetic peptide
RASQSVYSSYLA

SEQ ID NO: 2035 - DNA, 36 bp, Artificial Sequence; identical to SEQ ID NO: 1697
  Description of Artificial Sequence: Synthetic oligonucleotide

SEQ ID NO: 2036 - protein, 12 aa, Artificial Sequence
  Description of Artificial Sequence: Synthetic peptide
RASQSVYSSYLA

SEQ ID NO: 2037 - DNA, 36 bp, Artificial Sequence
  Description of Artificial Sequence: Synthetic oligonucleotide
agggccagtcagagtgttgacagcagctacctagcc

SEQ ID NO: 2038 - protein, 12 aa, Artificial Sequence
  Description of Artificial Sequence: Synthetic peptide
RASQSVDSSYLA

SEQ ID NO: 2039 - DNA, 36 bp, Artificial Sequence; identical to SEQ ID NO: 1717
  Description of Artificial Sequence: Synthetic oligonucleotide

SEQ ID NO: 2040 - protein, 12 aa, Artificial Sequence
  Description of Artificial Sequence: Synthetic peptide
RASQSVSSRYLA

SEQ ID NO: 2041 - DNA, 33 bp, Artificial Sequence; identical to SEQ ID NO: 589
  Description of Artificial Sequence: Synthetic oligonucleotide

SEQ ID NO: 2042 - protein, 11 aa, Artificial Sequence
  Description of Artificial Sequence: Synthetic peptide
RASQAIRDDLG

SEQ ID NO: 2043 - DNA, 51 bp, Artificial Sequence; identical to SEQ ID NO: 1719
  Description of Artificial Sequence: Synthetic oligonucleotide

SEQ ID NO: 2044 - protein, 17 aa, Artificial Sequence
  Description of Artificial Sequence: Synthetic peptide
KSSQTVLHSSNNYNYLA

SEQ ID NO: 2045 - DNA, 51 bp, Artificial Sequence
  Description of Artificial Sequence: Synthetic oligonucleotide
aagtccagccagagtgttttacacaactccaacaattacaactacttaact

SEQ ID NO: 2046 - protein, 17 aa, Artificial Sequence
  Description of Artificial Sequence: Synthetic peptide
KSSQSVLHNSNNYNYLT

SEQ ID NO: 2047 - DNA, 51 bp, Artificial Sequence; identical to SEQ ID NO: 1693
  Description of Artificial Sequence: Synthetic oligonucleotide

SEQ ID NO: 2048 - protein, 17 aa, Artificial Sequence
  Description of Artificial Sequence: Synthetic peptide
KSSQSVLFSSNNYNYLA

SEQ ID NO: 2049 - DNA, 51 bp, Artificial Sequence; identical to SEQ ID NO: 1839
  Description of Artificial Sequence: Synthetic oligonucleotide

SEQ ID NO: 2050 - protein, 17 aa, Artificial Sequence
  Description of Artificial Sequence: Synthetic peptide
KSSQSVLHRSNNYNYLA

SEQ ID NO: 2051 - DNA, 36 bp, Artificial Sequence; identical to SEQ ID NO: 1755
  Description of Artificial Sequence: Synthetic oligonucleotide

SEQ ID NO: 2052 - protein, 12 aa, Artificial Sequence
  Description of Artificial Sequence: Synthetic peptide
RASQSVYSSYLA

SEQ ID NO: 2053 - DNA, 36 bp, Artificial Sequence; identical to SEQ ID NO: 1697
  Description of Artificial Sequence: Synthetic oligonucleotide

SEQ ID NO: 2054 - protein, 12 aa, Artificial Sequence
  Description of Artificial Sequence: Synthetic peptide
RASQSVYSSYLA

SEQ ID NO: 2055 - DNA, 33 bp, Artificial Sequence
  Description of Artificial Sequence: Synthetic oligonucleotide
agggccagtatgagtgttgtcaacagcttagcc

SEQ ID NO: 2056 - protein, 11 aa, Artificial Sequence
  Description of Artificial Sequence: Synthetic peptide
RASMSVVNSLA

SEQ ID NO: 2057 - DNA, 51 bp, Artificial Sequence
  Description of Artificial Sequence: Synthetic oligonucleotide
aagtccagccagagtgttttattcagatccaacaattataattacttagct

SEQ ID NO: 2058 - protein, 17 aa, Artificial Sequence
  Description of Artificial Sequence: Synthetic peptide
KSSQSVLFRSNNYNYLA

SEQ ID NO: 2059 - DNA, 36 bp, Artificial Sequence; identical to SEQ ID NO: 1697
  Description of Artificial Sequence: Synthetic oligonucleotide

SEQ ID NO: 2060 - protein, 12 aa, Artificial Sequence
  Description of Artificial Sequence: Synthetic peptide
RASQSVYSSYLA

SEQ ID NO: 2061 - DNA, 36 bp, Artificial Sequence; identical to SEQ ID NO: 1755
  Description of Artificial Sequence: Synthetic oligonucleotide

SEQ ID NO: 2062 - protein, 12 aa, Artificial Sequence
  Description of Artificial Sequence: Synthetic peptide
RASQSVYSSYLA

SEQ ID NO: 2063 - DNA, 36 bp, Artificial Sequence; identical to SEQ ID NO: 1697
  Description of Artificial Sequence: Synthetic oligonucleotide

SEQ ID NO: 2064 - protein, 12 aa, Artificial Sequence
  Description of Artificial Sequence: Synthetic peptide
RASQSVYSSYLA

SEQ ID NO: 2065 - DNA, 51 bp, Artificial Sequence; identical to SEQ ID NO: 1685
  Description of Artificial Sequence: Synthetic oligonucleotide

SEQ ID NO: 2066 - protein, 17 aa, Artificial Sequence
  Description of Artificial Sequence: Synthetic peptide
KSSQSVLYSSNNANYLA

SEQ ID NO: 2067 - DNA, 36 bp, Artificial Sequence
  Description of Artificial Sequence: Synthetic oligonucleotide
agggccagtcagagcgttagcagcagctacttagct

SEQ ID NO: 2068 - protein, 12 aa, Artificial Sequence
  Description of Artificial Sequence: Synthetic peptide
RASQSVSSSYLA

SEQ ID NO: 2069 - DNA, 51 bp, Artificial Sequence; identical to SEQ ID NO: 1777
  Description of Artificial Sequence: Synthetic oligonucleotide

SEQ ID NO: 2070 - protein, 17 aa, Artificial Sequence
  Description of Artificial Sequence: Synthetic peptide
KSSQSVLHSSNKKNYLA

SEQ ID NO: 2071 - DNA, 33 bp, Artificial Sequence; identical to SEQ ID NO: 109
  Description of Artificial Sequence: Synthetic oligonucleotide

SEQ ID NO: 2072 - protein, 11 aa, Artificial Sequence
  Description of Artificial Sequence: Synthetic peptide
RASQGIRNDLG

SEQ ID NO: 2073 - DNA, 33 bp, Artificial Sequence; identical to SEQ ID NO: 205
  Description of Artificial Sequence: Synthetic oligonucleotide

SEQ ID NO: 2074 - protein, 11 aa, Artificial Sequence
  Description of Artificial Sequence: Synthetic peptide
RASQDIRNDLG

SEQ ID NO: 2075 - DNA, 51 bp, Artificial Sequence
  Description of Artificial Sequence: Synthetic oligonucleotide
aagtccagccagagtgttttgcacagctccaacaattataattacttagct

SEQ ID NO: 2076 - protein, 17 aa, Artificial Sequence
  Description of Artificial Sequence: Synthetic peptide
KSSQSVLHSSNNYNYLA

SEQ ID NO: 2077 - DNA, 51 bp, Artificial Sequence; identical to SEQ ID NO: 159
  Description of Artificial Sequence: Synthetic oligonucleotide

SEQ ID NO: 2078 - protein, 17 aa, Artificial Sequence
  Description of Artificial Sequence: Synthetic peptide
KSSQSVLYSSNSHNYLA

SEQ ID NO: 2079 - DNA, 33 bp, Artificial Sequence; identical to SEQ ID NO: 105
  Description of Artificial Sequence: Synthetic oligonucleotide

SEQ ID NO: 2080 - protein, 11 aa, Artificial Sequence
  Description of Artificial Sequence: Synthetic peptide
RASQGISNYLA

SEQ ID NO: 2081 - DNA, 51 bp, Artificial Sequence; identical to SEQ ID NO: 2027
  Description of Artificial Sequence: Synthetic oligonucleotide

SEQ ID NO: 2082 - protein, 17 aa, Artificial Sequence
  Description of Artificial Sequence: Synthetic peptide
KSSQNILSSSNNKNYLT

SEQ ID NO: 2083 - DNA, 36 bp, Artificial Sequence; identical to SEQ ID NO: 1697
  Description of Artificial Sequence: Synthetic oligonucleotide

SEQ ID NO: 2084 - protein, 12 aa, Artificial Sequence
  Description of Artificial Sequence: Synthetic peptide
RASQSVYSSYLA

SEQ ID NO: 2085 - DNA, 51 bp, Artificial Sequence; identical to SEQ ID NO: 1767
  Description of Artificial Sequence: Synthetic oligonucleotide

SEQ ID NO: 2086 - protein, 17 aa, Artificial Sequence
  Description of Artificial Sequence: Synthetic peptide
KSSQSVLYTSNNNNYLA

SEQ ID NO: 2087 - DNA, 36 bp, Artificial Sequence; identical to SEQ ID NO: 1697
  Description of Artificial Sequence: Synthetic oligonucleotide

SEQ ID NO: 2088 - protein, 12 aa, Artificial Sequence
  Description of Artificial Sequence: Synthetic peptide
RASQSVYSSYLA

SEQ ID NO: 2089 - DNA, 33 bp, Artificial Sequence
  Description of Artificial Sequence: Synthetic oligonucleotide
cgggcgagtcagggtattaacaactggttagtc

SEQ ID NO: 2090 - protein, 11 aa, Artificial Sequence
  Description of Artificial Sequence: Synthetic peptide
RASQGINNWLV

SEQ ID NO: 2091 - DNA, 33 bp, Artificial Sequence; identical to SEQ ID NO: 109
  Description of Artificial Sequence: Synthetic oligonucleotide

SEQ ID NO: 2092 - protein, 11 aa, Artificial Sequence
  Description of Artificial Sequence: Synthetic peptide
RASQGIRNDLG

SEQ ID NO: 2093 - DNA, 33 bp, Artificial Sequence; identical to SEQ ID NO: 431
  Description of Artificial Sequence: Synthetic oligonucleotide

SEQ ID NO: 2094 - protein, 11 aa, Artificial Sequence
  Description of Artificial Sequence: Synthetic peptide
RASQSISDYLN

SEQ ID NO: 2095 - DNA, 48 bp, Artificial Sequence; identical to SEQ ID NO: 575
  Description of Artificial Sequence: Synthetic oligonucleotide

SEQ ID NO: 2096 - protein, 16 aa, Artificial Sequence
  Description of Artificial Sequence: Synthetic peptide
KSSQSLLHGDGKTYLY

SEQ ID NO: 2097 - DNA, 51 bp, Artificial Sequence; identical to SEQ ID NO: 1541
  Description of Artificial Sequence: Synthetic oligonucleotide

SEQ ID NO: 2098 - protein, 17 aa, Artificial Sequence
  Description of Artificial Sequence: Synthetic peptide
KSSQSVLYSSNNNNYLA

SEQ ID NO: 2099 - DNA, 36 bp, Artificial Sequence
  Description of Artificial Sequence: Synthetic oligonucleotide
agggccagtcagaatattatcagcagctatttagcc

SEQ ID NO: 2100 - protein, 12 aa, Artificial Sequence
  Description of Artificial Sequence: Synthetic peptide
RASQNIISSYLA

SEQ ID NO: 2101 - DNA, 33 bp, Artificial Sequence; identical to SEQ ID NO: 553
  Description of Artificial Sequence: Synthetic oligonucleotide

SEQ ID NO: 2102 - protein, 11 aa, Artificial Sequence
  Description of Artificial Sequence: Synthetic peptide
RASQGISNWLA

SEQ ID NO: 2103 - DNA, 51 bp, Artificial Sequence
  Description of Artificial Sequence: Synthetic oligonucleotide
aagtccagccagagtgttttacacagctccaacaattataattacttagct

SEQ ID NO: 2104 - protein, 17 aa, Artificial Sequence
  Description of Artificial Sequence: Synthetic peptide
KSSQSVLHSSNNYNYLA

SEQ ID NO: 2105 - DNA, 33 bp, Artificial Sequence; identical to SEQ ID NO: 431
  Description of Artificial Sequence: Synthetic oligonucleotide

SEQ ID NO: 2106 - protein, 11 aa, Artificial Sequence
  Description of Artificial Sequence: Synthetic peptide
RASQSISDYLN

SEQ ID NO: 2107 - DNA, 51 bp, Artificial Sequence
  Description of Artificial Sequence: Synthetic oligonucleotide
aagtccagccagaatattttacacagctccaacaataacaactacttagct

SEQ ID NO: 2108 - protein, 17 aa, Artificial Sequence
  Description of Artificial Sequence: Synthetic peptide
KSSQNILHSSNNNNYLA

SEQ ID NO: 2109 - DNA, 33 bp, Artificial Sequence; identical to SEQ ID NO: 109
  Description of Artificial Sequence: Synthetic oligonucleotide

SEQ ID NO: 2110 - protein, 11 aa, Artificial Sequence
  Description of Artificial Sequence: Synthetic peptide
RASQGIRNDLG

SEQ ID NO: 2111 - DNA, 33 bp, Artificial Sequence
  Description of Artificial Sequence: Synthetic oligonucleotide
cgggcaagtcaggacattagaaataattttggc

SEQ ID NO: 2112 - protein, 11 aa, Artificial Sequence
  Description of Artificial Sequence: Synthetic peptide
RASQDIRNNFG

SEQ ID NO: 2113 - DNA, 48 bp, Artificial Sequence; identical to SEQ ID NO: 103
  Description of Artificial Sequence: Synthetic oligonucleotide

SEQ ID NO: 2114 - protein, 16 aa, Artificial Sequence
  Description of Artificial Sequence: Synthetic peptide
KSSQSLLHSEGKTYLY

SEQ ID NO: 2115 - DNA, 36 bp, Artificial Sequence
  Description of Artificial Sequence: Synthetic oligonucleotide
agggccagtcagagtgttggcagcagctacttagcc

SEQ ID NO: 2116 - protein, 12 aa, Artificial Sequence
  Description of Artificial Sequence: Synthetic peptide
RASQSVGSSYLA

SEQ ID NO: 2117 - DNA, 36 bp, Artificial Sequence
  Description of Artificial Sequence: Synthetic oligonucleotide
agggccagtcagagtgttatcagtagctacttagcc

SEQ ID NO: 2118 - protein, 12 aa, Artificial Sequence
  Description of Artificial Sequence: Synthetic peptide
RASQSVISSYLA

SEQ ID NO: 2119 - DNA, 51 bp, Artificial Sequence; identical to SEQ ID NO: 1689
  Description of Artificial Sequence: Synthetic oligonucleotide

SEQ ID NO: 2120 - protein, 17 aa, Artificial Sequence
  Description of Artificial Sequence: Synthetic peptide
KSSQSVLHSSNNYNYLA

SEQ ID NO: 2121 - DNA, 51 bp, Artificial Sequence; identical to SEQ ID NO: 1541
  Description of Artificial Sequence: Synthetic oligonucleotide

SEQ ID NO: 2122 - protein, 17 aa, Artificial Sequence
  Description of Artificial Sequence: Synthetic peptide
KSSQSVLYSSNNNNYLA

SEQ ID NO: 2123 - DNA, 33 bp, Artificial Sequence; identical to SEQ ID NO: 147
  Description of Artificial Sequence: Synthetic oligonucleotide

SEQ ID NO: 2124 - protein, 11 aa, Artificial Sequence
  Description of Artificial Sequence: Synthetic peptide
RASRGIRDDLG

SEQ ID NO: 2125 - DNA, 51 bp, Artificial Sequence
  Description of Artificial Sequence: Synthetic oligonucleotide
aagtccagccagagtgttttatacagctccaacagtaacaactacttagct

SEQ ID NO: 2126 - protein, 17 aa, Artificial Sequence
  Description of Artificial Sequence: Synthetic peptide
KSSQSVLYSSNSNNYLA

SEQ ID NO: 2127 - DNA, 48 bp, Artificial Sequence
  Description of Artificial Sequence: Synthetic oligonucleotide
aagactagtcagagcctcctgcatagtgaaggaaagacctatttgtat

SEQ ID NO: 2128 - protein, 16 aa, Artificial Sequence
  Description of Artificial Sequence: Synthetic peptide
KTSQSLLHSEGKTYLY

SEQ ID NO: 2129 - DNA, 36 bp, Artificial Sequence
  Description of Artificial Sequence: Synthetic oligonucleotide
agggccagtcagagaattttcagcaactacttagcc

SEQ ID NO: 2130 - protein, 12 aa, Artificial Sequence
  Description of Artificial Sequence: Synthetic peptide
RASQRIFSNYLA

SEQ ID NO: 2131 - DNA, 33 bp, Artificial Sequence; identical to SEQ ID NO: 1591
  Description of Artificial Sequence: Synthetic oligonucleotide

SEQ ID NO: 2132 - protein, 11 aa, Artificial Sequence
  Description of Artificial Sequence: Synthetic peptide
RASQDINNYLA

SEQ ID NO: 2133 - DNA, 33 bp, Artificial Sequence
  Description of Artificial Sequence: Synthetic oligonucleotide
cgggcgagtcagaatattagcaactggttaacc

SEQ ID NO: 2134 - protein, 11 aa, Artificial Sequence
  Description of Artificial Sequence: Synthetic peptide
RASQNISNWLT

SEQ ID NO: 2135 - DNA, 33 bp, Artificial Sequence; identical to SEQ ID NO: 553
  Description of Artificial Sequence: Synthetic oligonucleotide

SEQ ID NO: 2136 - protein, 11 aa, Artificial Sequence
  Description of Artificial Sequence: Synthetic peptide
RASQGISNWLA

SEQ ID NO: 2137 - DNA, 48 bp, Artificial Sequence
  Description of Artificial Sequence: Synthetic oligonucleotide
aagtctagtcagagcctcctgcatggtgatggaaagacctatttttat

SEQ ID NO: 2138 - protein, 16 aa, Artificial Sequence
  Description of Artificial Sequence: Synthetic peptide
KSSQSLLHGDGKTYFY

SEQ ID NO: 2139 - DNA, 33 bp, Artificial Sequence; identical to SEQ ID NO: 553
  Description of Artificial Sequence: Synthetic oligonucleotide

SEQ ID NO: 2140 - protein, 11 aa, Artificial Sequence
  Description of Artificial Sequence: Synthetic peptide
RASQGISNWLA

SEQ ID NO: 2141 - DNA, 51 bp, Artificial Sequence
  Description of Artificial Sequence: Synthetic oligonucleotide
aagtccagccaacgtgttttacacagctccaacaattataactacttagct

SEQ ID NO: 2142 - protein, 17 aa, Artificial Sequence
  Description of Artificial Sequence: Synthetic peptide
KSSQRVLHSSNNYNYLA

SEQ ID NO: 2143 - DNA, 33 bp, Artificial Sequence; identical to SEQ ID NO: 269
  Description of Artificial Sequence: Synthetic oligonucleotide

SEQ ID NO: 2144 - protein, 11 aa, Artificial Sequence
  Description of Artificial Sequence: Synthetic peptide
RASQSIINYLN

SEQ ID NO: 2145 - DNA, 48 bp, Artificial Sequence; identical to SEQ ID NO: 103
  Description of Artificial Sequence: Synthetic oligonucleotide

SEQ ID NO: 2146 - protein, 16 aa, Artificial Sequence
  Description of Artificial Sequence: Synthetic peptide
KSSQSLLHSEGKTYLY

SEQ ID NO: 2147 - DNA, 33 bp, Artificial Sequence
  Description of Artificial Sequence: Synthetic oligonucleotide
cgggcgagtcagggcattagcaaatatttagcc

SEQ ID NO: 2148 - protein, 11 aa, Artificial Sequence
  Description of Artificial Sequence: Synthetic peptide
RASQGISKYLA

SEQ ID NO: 2149 - DNA, 51 bp, Artificial Sequence
  Description of Artificial Sequence: Synthetic oligonucleotide
aagtccagccagagtgctttacacagctccaacaattacaactacttagct

SEQ ID NO: 2150 - protein, 17 aa, Artificial Sequence
  Description of Artificial Sequence: Synthetic peptide
KSSQSALHSSNNYNYLA

SEQ ID NO: 2151 - DNA, 33 bp, Artificial Sequence
  Description of Artificial Sequence: Synthetic oligonucleotide
cgggcaagtcagagcattagtaactatttaaat

SEQ ID NO: 2152 - protein, 11 aa, Artificial Sequence
  Description of Artificial Sequence: Synthetic peptide
RASQSISNYLN

SEQ ID NO: 2153 - DNA, 48 bp, Artificial Sequence; identical to SEQ ID NO: 575
  Description of Artificial Sequence: Synthetic oligonucleotide

SEQ ID NO: 2154 - protein, 16 aa, Artificial Sequence
  Description of Artificial Sequence: Synthetic peptide
KSSQSLLHGDGKTYLY

SEQ ID NO: 2155 - DNA, 48 bp, Artificial Sequence; identical to SEQ ID NO: 555
  Description of Artificial Sequence: Synthetic oligonucleotide

SEQ ID NO: 2156 - protein, 16 aa, Artificial Sequence
  Description of Artificial Sequence: Synthetic peptide
KSSQSLLHSEGKTYLY

SEQ ID NO: 2157 - DNA, 33 bp, Artificial Sequence; identical to SEQ ID NO: 109
  Description of Artificial Sequence: Synthetic oligonucleotide

SEQ ID NO: 2158 - protein, 11 aa, Artificial Sequence
  Description of Artificial Sequence: Synthetic peptide
RASQGIRNDLG

SEQ ID NO: 2159 - DNA, 33 bp, Artificial Sequence
  Description of Artificial Sequence: Synthetic oligonucleotide
cgggcaagtcagggcattagaaatgccttaggc

SEQ ID NO: 2160 - protein, 11 aa, Artificial Sequence
  Description of Artificial Sequence: Synthetic peptide
RASQGIRNALG

SEQ ID NO: 2161 - DNA, 48 bp, Artificial Sequence; identical to SEQ ID NO: 2137
  Description of Artificial Sequence: Synthetic oligonucleotide

SEQ ID NO: 2162 - protein, 16 aa, Artificial Sequence
  Description of Artificial Sequence: Synthetic peptide
KSSQSLLHGDGKTYFY

SEQ ID NO: 2163 - DNA, 33 bp, Artificial Sequence; identical to SEQ ID NO: 109
  Description of Artificial Sequence: Synthetic oligonucleotide

SEQ ID NO: 2164 - protein, 11 aa, Artificial Sequence
  Description of Artificial Sequence: Synthetic peptide
RASQGIRNDLG

SEQ ID NO: 2165 - DNA, 51 bp, Artificial Sequence
  Description of Artificial Sequence: Synthetic oligonucleotide
aagtccagccagagtgttttatacagtcccaacaataacaactacttagct

SEQ ID NO: 2166 - protein, 17 aa, Artificial Sequence
  Description of Artificial Sequence: Synthetic peptide
KSSQSVLYSPNNNNYLA

SEQ ID NO: 2167 - DNA, 33 bp, Artificial Sequence; identical to SEQ ID NO: 877
  Description of Artificial Sequence: Synthetic oligonucleotide

SEQ ID NO: 2168 - protein, 11 aa, Artificial Sequence
  Description of Artificial Sequence: Synthetic peptide
RASQSISSYLN

SEQ ID NO: 2169 - DNA, 51 bp, Artificial Sequence
  Description of Artificial Sequence: Synthetic oligonucleotide
aagtccagccagactgttttacacaactccaataatcacaattactttgct

SEQ ID NO: 2170 - protein, 17 aa, Artificial Sequence
  Description of Artificial Sequence: Synthetic peptide
KSSQTVLHNSNNHNYFA

SEQ ID NO: 2171 - DNA, 51 bp, Artificial Sequence
  Description of Artificial Sequence: Synthetic oligonucleotide
aagtccagccagagtgttttatccagctccaacgataacaactacttagct

SEQ ID NO: 2172 - protein, 17 aa, Artificial Sequence
  Description of Artificial Sequence: Synthetic peptide
KSSQSVLSSSNDNNYLA

SEQ ID NO: 2173 - DNA, 33 bp, Artificial Sequence; identical to SEQ ID NO: 2159
  Description of Artificial Sequence: Synthetic oligonucleotide

SEQ ID NO: 2174 - protein, 11 aa, Artificial Sequence
  Description of Artificial Sequence: Synthetic peptide
RASQGIRNALG

SEQ ID NO: 2175 - DNA, 33 bp, Artificial Sequence
  Description of Artificial Sequence: Synthetic oligonucleotide
cgggcgagtcagggtattatcagttggttagcc

SEQ ID NO: 2176 - protein, 11 aa, Artificial Sequence
  Description of Artificial Sequence: Synthetic peptide
RASQGIISWLA

SEQ ID NO: 2177 - DNA, 33 bp, Artificial Sequence; identical to SEQ ID NO: 553
  Description of Artificial Sequence: Synthetic oligonucleotide

SEQ ID NO: 2178 - protein, 11 aa, Artificial Sequence
  Description of Artificial Sequence: Synthetic peptide
RASQGISNWLA

SEQ ID NO: 2179 - DNA, 36 bp, Artificial Sequence
  Description of Artificial Sequence: Synthetic oligonucleotide
agggccagtcagagtattatcagcaactacttagcc

SEQ ID NO: 2180 - protein, 12 aa, Artificial Sequence
  Description of Artificial Sequence: Synthetic peptide
RASQSIISNYLA

SEQ ID NO: 2181 - DNA, 33 bp, Artificial Sequence; identical to SEQ ID NO: 553
  Description of Artificial Sequence: Synthetic oligonucleotide

SEQ ID NO: 2182 - protein, 11 aa, Artificial Sequence
  Description of Artificial Sequence: Synthetic peptide
RASQGISNWLA

SEQ ID NO: 2183 - DNA, 33 bp, Artificial Sequence; identical to SEQ ID NO: 535
  Description of Artificial Sequence: Synthetic oligonucleotide

SEQ ID NO: 2184 - protein, 11 aa, Artificial Sequence
  Description of Artificial Sequence: Synthetic peptide
RASRGIRNDLG

SEQ ID NO: 2185 - DNA, 33 bp, Artificial Sequence; identical to SEQ ID NO: 2133
  Description of Artificial Sequence: Synthetic oligonucleotide

SEQ ID NO: 2186 - protein, 11 aa, Artificial Sequence
  Description of Artificial Sequence: Synthetic peptide
RASQNISNWLT

SEQ ID NO: 2187 - DNA, 33 bp, Artificial Sequence; identical to SEQ ID NO: 109
  Description of Artificial Sequence: Synthetic oligonucleotide

SEQ ID NO: 2188 - protein, 11 aa, Artificial Sequence
  Description of Artificial Sequence: Synthetic peptide
RASQGIRNDLG

SEQ ID NO: 2189 - DNA, 51 bp, Artificial Sequence
  Description of Artificial Sequence: Synthetic oligonucleotide
aagtccagccagagtgttttatacagatccaacagtaagaaatacttaact

SEQ ID NO: 2190 - protein, 17 aa, Artificial Sequence
  Description of Artificial Sequence: Synthetic peptide
KSSQSVLYRSNSKKYLT

SEQ ID NO: 2191 - DNA, 33 bp, Artificial Sequence; identical to SEQ ID NO: 429
  Description of Artificial Sequence: Synthetic oligonucleotide

SEQ ID NO: 2192 - protein, 11 aa, Artificial Sequence
  Description of Artificial Sequence: Synthetic peptide
RASQGIGNDLG

SEQ ID NO: 2193 - DNA, 33 bp, Artificial Sequence
  Description of Artificial Sequence: Synthetic oligonucleotide
cgggcgagtcagggtattaacaactggttagcc

SEQ ID NO: 2194 - protein, 11 aa, Artificial Sequence
  Description of Artificial Sequence: Synthetic peptide
RASQGINNWLA

SEQ ID NO: 2195 - DNA, 51 bp, Artificial Sequence
  Description of Artificial Sequence: Synthetic oligonucleotide
aagtccagccagaatgttttatacagctcccacaataacaactacttagct

SEQ ID NO: 2196 - protein, 17 aa, Artificial Sequence
  Description of Artificial Sequence: Synthetic peptide
KSSQNVLYSSHNNNYLA

SEQ ID NO: 2197 - DNA, 33 bp, Artificial Sequence; identical to SEQ ID NO: 109
  Description of Artificial Sequence: Synthetic oligonucleotide

SEQ ID NO: 2198 - protein, 11 aa, Artificial Sequence
  Description of Artificial Sequence: Synthetic peptide
RASQGIRNDLG

SEQ ID NO: 2199 - DNA, 33 bp, Artificial Sequence
  Description of Artificial Sequence: Synthetic oligonucleotide
cgggcgagtcagggcattagccattatttagcc

SEQ ID NO: 2200 - protein, 11 aa, Artificial Sequence
  Description of Artificial Sequence: Synthetic peptide
RASQGISHYLA

SEQ ID NO: 2201 - DNA, 48 bp, Artificial Sequence
  Description of Artificial Sequence: Synthetic oligonucleotide
aagtctagtcagagcctcgtgcatggtgatggaaagacctatttgtat

SEQ ID NO: 2202 - protein, 16 aa, Artificial Sequence
  Description of Artificial Sequence: Synthetic peptide
KSSQSLVHGDGKTYLY

SEQ ID NO: 2203 - DNA, 33 bp, Artificial Sequence; identical to SEQ ID NO: 501
  Description of Artificial Sequence: Synthetic oligonucleotide

SEQ ID NO: 2204 - protein, 11 aa, Artificial Sequence
  Description of Artificial Sequence: Synthetic peptide
RASQSISSYLN

SEQ ID NO: 2205 - DNA, 48 bp, Artificial Sequence; identical to SEQ ID NO: 555
  Description of Artificial Sequence: Synthetic oligonucleotide

SEQ ID NO: 2206 - protein, 16 aa, Artificial Sequence
  Description of Artificial Sequence: Synthetic peptide
KSSQSLLHSEGKTYLY

SEQ ID NO: 2207 - DNA, 33 bp, Artificial Sequence; identical to SEQ ID NO: 431
  Description of Artificial Sequence: Synthetic oligonucleotide

SEQ ID NO: 2208 - protein, 11 aa, Artificial Sequence
  Description of Artificial Sequence: Synthetic peptide
RASQSISDYLN

SEQ ID NO: 2209 - DNA, 33 bp, Artificial Sequence
  Description of Artificial Sequence: Synthetic oligonucleotide
agggccagtcagagtattaacatcaatatagcc

SEQ ID NO: 2210 - protein, 11 aa, Artificial Sequence
  Description of Artificial Sequence: Synthetic peptide
RASQSININIA

SEQ ID NO: 2211 - DNA, 48 bp, Artificial Sequence; identical to SEQ ID NO: 107
  Description of Artificial Sequence: Synthetic oligonucleotide

SEQ ID NO: 2212 - protein, 16 aa, Artificial Sequence
  Description of Artificial Sequence: Synthetic peptide
KSSQRLLHGDGKTYLY

SEQ ID NO: 2213 - DNA, 33 bp, Artificial Sequence
  Description of Artificial Sequence: Synthetic oligonucleotide
cgggcaagtcagagcattagcaactttttaaat

SEQ ID NO: 2214 - protein, 11 aa, Artificial Sequence
  Description of Artificial Sequence: Synthetic peptide
RASQSISNFLN

SEQ ID NO: 2215 - DNA, 33 bp, Artificial Sequence; identical to SEQ ID NO: 1751
  Description of Artificial Sequence: Synthetic oligonucleotide

SEQ ID NO: 2216 - protein, 11 aa, Artificial Sequence
  Description of Artificial Sequence: Synthetic peptide
RASQGISKYLA

SEQ ID NO: 2217 - DNA, 48 bp, Artificial Sequence; identical to SEQ ID NO: 575
  Description of Artificial Sequence: Synthetic oligonucleotide

SEQ ID NO: 2218 - protein, 16 aa, Artificial Sequence
  Description of Artificial Sequence: Synthetic peptide
KSSQSLLHGDGKTYLY

SEQ ID NO: 2219 - DNA, 33 bp, Artificial Sequence; identical to SEQ ID NO: 431
  Description of Artificial Sequence: Synthetic oligonucleotide

SEQ ID NO: 2220 - protein, 11 aa, Artificial Sequence
  Description of Artificial Sequence: Synthetic peptide
RASQSISDYLN

SEQ ID NO: 2221 - DNA, 51 bp, Artificial Sequence
  Description of Artificial Sequence: Synthetic oligonucleotide
aagtccagccagagtgttttacacagctccaacaattacaactacttagtt

SEQ ID NO: 2222 - protein, 17 aa, Artificial Sequence
  Description of Artificial Sequence: Synthetic peptide
KSSQSVLHSSNNYNYLV

SEQ ID NO: 2223 - DNA, 51 bp, Artificial Sequence
  Description of Artificial Sequence: Synthetic oligonucleotide
aagtccagccagagtgttttgcacagctccaacaattacaactacttaact

SEQ ID NO: 2224 - protein, 17 aa, Artificial Sequence
  Description of Artificial Sequence: Synthetic peptide
KSSQSVLHSSNNYNYLT

SEQ ID NO: 2225 - DNA, 51 bp, Artificial Sequence; identical to SEQ ID NO: 1079
  Description of Artificial Sequence: Synthetic oligonucleotide

SEQ ID NO: 2226 - protein, 17 aa, Artificial Sequence
  Description of Artificial Sequence: Synthetic peptide
KSSQSVLYSSNNYNYLA

SEQ ID NO: 2227 - DNA, 33 bp, Artificial Sequence; identical to SEQ ID NO: 431
  Description of Artificial Sequence: Synthetic oligonucleotide

SEQ ID NO: 2228 - protein, 11 aa, Artificial Sequence
  Description of Artificial Sequence: Synthetic peptide
RASQSISDYLN

SEQ ID NO: 2229 - DNA, 48 bp, Artificial Sequence
  Description of Artificial Sequence: Synthetic oligonucleotide
aagtctagtcagagcctccggcatggtgatggaaagacctatttgact

SEQ ID NO: 2230 - protein, 16 aa, Artificial Sequence
  Description of Artificial Sequence: Synthetic peptide
KSSQSLRHGDGKTYLT

SEQ ID NO: 2231 - DNA, 36 bp, Artificial Sequence
  Description of Artificial Sequence: Synthetic oligonucleotide
agggccagtcagagtgttatcagcagctacttagcc

SEQ ID NO: 2232 - protein, 12 aa, Artificial Sequence
  Description of Artificial Sequence: Synthetic peptide
RASQSVISSYLA

SEQ ID NO: 2233 - DNA, 33 bp, Artificial Sequence; identical to SEQ ID NO: 109
  Description of Artificial Sequence: Synthetic oligonucleotide

SEQ ID NO: 2234 - protein, 11 aa, Artificial Sequence
  Description of Artificial Sequence: Synthetic peptide
RASQGIRNDLG

SEQ ID NO: 2235 - DNA, 33 bp, Artificial Sequence; identical to SEQ ID NO: 1509
  Description of Artificial Sequence: Synthetic oligonucleotide

SEQ ID NO: 2236 - protein, 11 aa, Artificial Sequence
  Description of Artificial Sequence: Synthetic peptide
RASQDISNWLA

SEQ ID NO: 2237 - DNA, 33 bp, Artificial Sequence; identical to SEQ ID NO: 109
  Description of Artificial Sequence: Synthetic oligonucleotide

SEQ ID NO: 2238 - protein, 11 aa, Artificial Sequence
  Description of Artificial Sequence: Synthetic peptide
RASQGIRNDLG

SEQ ID NO: 2239 - DNA, 51 bp, Artificial Sequence; identical to SEQ ID NO: 1071
  Description of Artificial Sequence: Synthetic oligonucleotide

SEQ ID NO: 2240 - protein, 17 aa, Artificial Sequence
  Description of Artificial Sequence: Synthetic peptide
KSSQSVLYSSNNKNYLA

SEQ ID NO: 2241 - DNA, 33 bp, Artificial Sequence; identical to SEQ ID NO: 553
  Description of Artificial Sequence: Synthetic oligonucleotide

SEQ ID NO: 2242 - protein, 11 aa, Artificial Sequence
  Description of Artificial Sequence: Synthetic peptide
RASQGISNWLA

SEQ ID NO: 2243 - DNA, 33 bp, Artificial Sequence; identical to SEQ ID NO: 431
  Description of Artificial Sequence: Synthetic oligonucleotide

SEQ ID NO: 2244 - protein, 11 aa, Artificial Sequence
  Description of Artificial Sequence: Synthetic peptide
RASQSISDYLN

SEQ ID NO: 2245 - DNA, 48 bp, Artificial Sequence
  Description of Artificial Sequence: Synthetic oligonucleotide
aagtctagtcagagcctcctgcatggtgatggaaagacctatttatat

SEQ ID NO: 2246 - protein, 16 aa, Artificial Sequence
  Description of Artificial Sequence: Synthetic peptide
KSSQSLLHGDGKTYLY

SEQ ID NO: 2247 - DNA, 51 bp, Artificial Sequence
  Description of Artificial Sequence: Synthetic oligonucleotide
acgtccagccagagtattttacacagctccaataattacaactacttagct

SEQ ID NO: 2248 - protein, 17 aa, Artificial Sequence
  Description of Artificial Sequence: Synthetic peptide
TSSQSILHSSNNYNYLA

SEQ ID NO: 2249 - DNA, 33 bp, Artificial Sequence; identical to SEQ ID NO: 1363
  Description of Artificial Sequence: Synthetic oligonucleotide

SEQ ID NO: 2250 - protein, 11 aa, Artificial Sequence
  Description of Artificial Sequence: Synthetic peptide
RASQVISNYLA

SEQ ID NO: 2251 - DNA, 48 bp, Artificial Sequence; identical to SEQ ID NO: 2229
  Description of Artificial Sequence: Synthetic oligonucleotide

SEQ ID NO: 2252 - protein, 16 aa, Artificial Sequence
  Description of Artificial Sequence: Synthetic peptide
KSSQSLRHGDGKTYLT

SEQ ID NO: 2253 - DNA, 36 bp, Artificial Sequence; identical to SEQ ID NO: 2231
  Description of Artificial Sequence: Synthetic oligonucleotide

SEQ ID NO: 2254 - protein, 12 aa, Artificial Sequence
  Description of Artificial Sequence: Synthetic peptide
RASQSVISSYLA

SEQ ID NO: 2255 - DNA, 51 bp, Artificial Sequence; identical to SEQ ID NO: 1071
  Description of Artificial Sequence: Synthetic oligonucleotide

SEQ ID NO: 2256 - protein, 17 aa, Artificial Sequence
  Description of Artificial Sequence: Synthetic peptide
KSSQSVLYSSNNKNYLA

SEQ ID NO: 2257 - DNA, 48 bp, Artificial Sequence; identical to SEQ ID NO: 487
  Description of Artificial Sequence: Synthetic oligonucleotide

SEQ ID NO: 2258 - protein, 16 aa, Artificial Sequence
  Description of Artificial Sequence: Synthetic peptide
KSSQSLLHSDGKTYLY

SEQ ID NO: 2259 - DNA, 51 bp, Artificial Sequence
  Description of Artificial Sequence: Synthetic oligonucleotide
aagtccagccagagtgttttatacagctccaacaattacaagtacttagct

SEQ ID NO: 2260 - protein, 17 aa, Artificial Sequence
  Description of Artificial Sequence: Synthetic peptide
KSSQSVLYSSNNYKYLA

SEQ ID NO: 2261 - DNA, 51 bp, Artificial Sequence
  Description of Artificial Sequence: Synthetic oligonucleotide
aagtccagccagagtgttttacacagttccaacaattacaactatttagct

SEQ ID NO: 2262 - protein, 17 aa, Artificial Sequence
  Description of Artificial Sequence: Synthetic peptide
KSSQSVLHSSNNYNYLA

SEQ ID NO: 2263 - DNA, 33 bp, Artificial Sequence; identical to SEQ ID NO: 1509
  Description of Artificial Sequence: Synthetic oligonucleotide

SEQ ID NO: 2264 - protein, 11 aa, Artificial Sequence
  Description of Artificial Sequence: Synthetic peptide
RASQDISNWLA

SEQ ID NO: 2265 - DNA, 51 bp, Artificial Sequence
  Description of Artificial Sequence: Synthetic oligonucleotide
aggtcaagccagagtgttttacacagctccaacaattataactacttagct

SEQ ID NO: 2266 - protein, 17 aa, Artificial Sequence
  Description of Artificial Sequence: Synthetic peptide
RSSQSVLHSSNNYNYLA

SEQ ID NO: 2267 - DNA, 33 bp, Artificial Sequence; identical to SEQ ID NO: 553
  Description of Artificial Sequence: Synthetic oligonucleotide

SEQ ID NO: 2268 - protein, 11 aa, Artificial Sequence
  Description of Artificial Sequence: Synthetic peptide
RASQGISNWLA

SEQ ID NO: 2269 - DNA, 33 bp, Artificial Sequence; identical to SEQ ID NO: 1509
  Description of Artificial Sequence: Synthetic oligonucleotide

SEQ ID NO: 2270 - protein, 11 aa, Artificial Sequence
  Description of Artificial Sequence: Synthetic peptide
RASQDISNWLA

SEQ ID NO: 2271 - DNA, 33 bp, Artificial Sequence; identical to SEQ ID NO: 501
  Description of Artificial Sequence: Synthetic oligonucleotide

SEQ ID NO: 2272 - protein, 11 aa, Artificial Sequence
  Description of Artificial Sequence: Synthetic peptide
RASQSISSYLN

SEQ ID NO: 2273 - DNA, 48 bp, Artificial Sequence; identical to SEQ ID NO: 575
  Description of Artificial Sequence: Synthetic oligonucleotide

SEQ ID NO: 2274 - protein, 16 aa, Artificial Sequence
  Description of Artificial Sequence: Synthetic peptide
KSSQSLLHGDGKTYLY

SEQ ID NO: 2275 - DNA, 51 bp, Artificial Sequence
  Description of Artificial Sequence: Synthetic oligonucleotide
aagtccagccagagtgttttatccagctccaacaataataattatttagct

SEQ ID NO: 2276 - protein, 17 aa, Artificial Sequence
  Description of Artificial Sequence: Synthetic peptide
KSSQSVLSSSNNNNYLA

SEQ ID NO: 2277 - DNA, 51 bp, Artificial Sequence
  Description of Artificial Sequence: Synthetic oligonucleotide
aagtccagccagagtgttttacacagctccaataattacaactacttagct

SEQ ID NO: 2278 - protein, 17 aa, Artificial Sequence
  Description of Artificial Sequence: Synthetic peptide
KSSQSVLHSSNNYNYLA

SEQ ID NO: 2279 - DNA, 33 bp, Artificial Sequence
  Description of Artificial Sequence: Synthetic oligonucleotide
agggccagtcagagtgttagtagtaacttagcc

SEQ ID NO: 2280 - protein, 11 aa, Artificial Sequence
  Description of Artificial Sequence: Synthetic peptide
RASQSVSSNLA

SEQ ID NO: 2281 - DNA, 33 bp, Artificial Sequence; identical to SEQ ID NO: 109
  Description of Artificial Sequence: Synthetic oligonucleotide

SEQ ID NO: 2282 - protein, 11 aa, Artificial Sequence
  Description of Artificial Sequence: Synthetic peptide
RASQGIRNDLG

SEQ ID NO: 2283 - DNA, 51 bp, Artificial Sequence; identical to SEQ ID NO: 1541
  Description of Artificial Sequence: Synthetic oligonucleotide

SEQ ID NO: 2284 - protein, 17 aa, Artificial Sequence
  Description of Artificial Sequence: Synthetic peptide
KSSQSVLYSSNNNNYLA

SEQ ID NO: 2285 - DNA, 33 bp, Artificial Sequence; identical to SEQ ID NO: 501
  Description of Artificial Sequence: Synthetic oligonucleotide

SEQ ID NO: 2286 - protein, 11 aa, Artificial Sequence
  Description of Artificial Sequence: Synthetic peptide
RASQSISSYLN

SEQ ID NO: 2287 - DNA, 33 bp, Artificial Sequence; identical to SEQ ID NO: 105
  Description of Artificial Sequence: Synthetic oligonucleotide

SEQ ID NO: 2288 - protein, 11 aa, Artificial Sequence
  Description of Artificial Sequence: Synthetic peptide
RASQGISNYLA

SEQ ID NO: 2289 - DNA, 33 bp, Artificial Sequence
  Description of Artificial Sequence: Synthetic oligonucleotide
cgggcgagtcaggacattagcaattatttagtc

SEQ ID NO: 2290 - protein, 11 aa, Artificial Sequence
  Description of Artificial Sequence: Synthetic peptide
RASQDISNYLV

SEQ ID NO: 2291 - DNA, 33 bp, Artificial Sequence; identical to SEQ ID NO: 109
  Description of Artificial Sequence: Synthetic oligonucleotide

SEQ ID NO: 2292 - protein, 11 aa, Artificial Sequence
  Description of Artificial Sequence: Synthetic peptide
RASQGIRNDLG

SEQ ID NO: 2293 - DNA, 33 bp, Artificial Sequence
  Description of Artificial Sequence: Synthetic oligonucleotide
cgggcaagtcagaacattagcagttatttaaat

SEQ ID NO: 2294 - protein, 11 aa, Artificial Sequence
  Description of Artificial Sequence: Synthetic peptide
RASQNISSYLN

SEQ ID NO: 2295 - DNA, 33 bp, Artificial Sequence; identical to SEQ ID NO: 105
  Description of Artificial Sequence: Synthetic oligonucleotide

SEQ ID NO: 2296 - protein, 11 aa, Artificial Sequence
  Description of Artificial Sequence: Synthetic peptide
RASQGISNYLA

SEQ ID NO: 2297 - DNA, 33 bp, Artificial Sequence; identical to SEQ ID NO: 109
  Description of Artificial Sequence: Synthetic oligonucleotide

SEQ ID NO: 2298 - protein, 11 aa, Artificial Sequence
  Description of Artificial Sequence: Synthetic peptide
RASQGIRNDLG

SEQ ID NO: 2299 - DNA, 33 bp, Artificial Sequence; identical to SEQ ID NO: 293
  Description of Artificial Sequence: Synthetic oligonucleotide

SEQ ID NO: 2300 - protein, 11 aa, Artificial Sequence
  Description of Artificial Sequence: Synthetic peptide
RASQGINNYLA

SEQ ID NO: 2301 - DNA, 33 bp, Artificial Sequence
  Description of Artificial Sequence: Synthetic oligonucleotide
cgggcaagtcagagctttagcagctatttaaat

SEQ ID NO: 2302 - protein, 11 aa, Artificial Sequence
  Description of Artificial Sequence: Synthetic peptide
RASQSFSSYLN

SEQ ID NO: 2303 - DNA, 33 bp, Artificial Sequence; identical to SEQ ID NO: 109
  Description of Artificial Sequence: Synthetic oligonucleotide

SEQ ID NO: 2304 - protein, 11 aa, Artificial Sequence
  Description of Artificial Sequence: Synthetic peptide
RASQGIRNDLG

SEQ ID NO: 2305 - DNA, 33 bp, Artificial Sequence
  Description of Artificial Sequence: Synthetic oligonucleotide
cgggcgagtcaggacattagcaattttttagcc

SEQ ID NO: 2306 - protein, 11 aa, Artificial Sequence
  Description of Artificial Sequence: Synthetic peptide
RASQDISNFLA

SEQ ID NO: 2307 - DNA, 48 bp, Artificial Sequence; identical to SEQ ID NO: 2245
  Description of Artificial Sequence: Synthetic oligonucleotide

SEQ ID NO: 2308 - protein, 16 aa, Artificial Sequence
  Description of Artificial Sequence: Synthetic peptide
KSSQSLLHGDGKTYLY

SEQ ID NO: 2309 - DNA, 33 bp, Artificial Sequence; identical to SEQ ID NO: 109
  Description of Artificial Sequence: Synthetic oligonucleotide

SEQ ID NO: 2310 - protein, 11 aa, Artificial Sequence
  Description of Artificial Sequence: Synthetic peptide
RASQGIRNDLG

SEQ ID NO: 2311 - DNA, 33 bp, Artificial Sequence
  Description of Artificial Sequence: Synthetic oligonucleotide
cgggcgagtcagggcattaccaattatttagcc

SEQ ID NO: 2312 - protein, 11 aa, Artificial Sequence
  Description of Artificial Sequence: Synthetic peptide
RASQGITNYLA

SEQ ID NO: 2313 - DNA, 33 bp, Artificial Sequence
  Description of Artificial Sequence: Synthetic oligonucleotide
cgggcaagtcagggcattagaaatgattttggc

SEQ ID NO: 2314 - protein, 11 aa, Artificial Sequence
  Description of Artificial Sequence: Synthetic peptide
RASQGIRNDFG

SEQ ID NO: 2315 - DNA, 33 bp, Artificial Sequence; identical to SEQ ID NO: 109
  Description of Artificial Sequence: Synthetic oligonucleotide

SEQ ID NO: 2316 - protein, 11 aa, Artificial Sequence
  Description of Artificial Sequence: Synthetic peptide
RASQGIRNDLG

SEQ ID NO: 2317 - DNA, 33 bp, Artificial Sequence
  Description of Artificial Sequence: Synthetic oligonucleotide
cgggcaagtcaggacattagaaaggatttaggc

SEQ ID NO: 2318 - protein, 11 aa, Artificial Sequence
  Description of Artificial Sequence: Synthetic peptide
RASQDIRKDLG

SEQ ID NO: 2319 - DNA, 33 bp, Artificial Sequence
  Description of Artificial Sequence: Synthetic oligonucleotide
cgggcaagtcagaacattagaaagtatttacat

SEQ ID NO: 2320 - protein, 11 aa, Artificial Sequence
  Description of Artificial Sequence: Synthetic peptide
RASQNIRKYLH

SEQ ID NO: 2321 - DNA, 33 bp, Artificial Sequence; identical to SEQ ID NO: 109
  Description of Artificial Sequence: Synthetic oligonucleotide

SEQ ID NO: 2322 - protein, 11 aa, Artificial Sequence
  Description of Artificial Sequence: Synthetic peptide
RASQGIRNDLG

SEQ ID NO: 2323 - DNA, 33 bp, Artificial Sequence
  Description of Artificial Sequence: Synthetic oligonucleotide
cgggcaagtcagggcatgagaattgatttaggg

SEQ ID NO: 2324 - protein, 11 aa, Artificial Sequence
  Description of Artificial Sequence: Synthetic peptide
RASQGMRIDLG

SEQ ID NO: 2325 - DNA, 33 bp, Artificial Sequence; identical to SEQ ID NO: 133
  Description of Artificial Sequence: Synthetic oligonucleotide

SEQ ID NO: 2326 - protein, 11 aa, Artificial Sequence
  Description of Artificial Sequence: Synthetic peptide
RASQGIRSDLG

SEQ ID NO: 2327 - DNA, 33 bp, Artificial Sequence; identical to SEQ ID NO: 205
  Description of Artificial Sequence: Synthetic oligonucleotide

SEQ ID NO: 2328 - protein, 11 aa, Artificial Sequence
  Description of Artificial Sequence: Synthetic peptide
RASQDIRNDLG

SEQ ID NO: 2329 - DNA, 51 bp, Artificial Sequence
  Description of Artificial Sequence: Synthetic oligonucleotide
aagtccagccagaatgttttacacagctccaacaataacaactacttaact

SEQ ID NO: 2330 - protein, 17 aa, Artificial Sequence
  Description of Artificial Sequence: Synthetic peptide
KSSQNVLHSSNNNNYLT

SEQ ID NO: 2331 - DNA, 33 bp, Artificial Sequence; identical to SEQ ID NO: 293
  Description of Artificial Sequence: Synthetic oligonucleotide

SEQ ID NO: 2332 - protein, 11 aa, Artificial Sequence
  Description of Artificial Sequence: Synthetic peptide
RASQGINNYLA

SEQ ID NO: 2333 - DNA, 33 bp, Artificial Sequence
  Description of Artificial Sequence: Synthetic oligonucleotide
cgggcaagtcagcgcgtcagaaatgatttaggc

SEQ ID NO: 2334 - protein, 11 aa, Artificial Sequence
  Description of Artificial Sequence: Synthetic peptide
RASQRVRNDLG

SEQ ID NO: 2335 - DNA, 33 bp, Artificial Sequence
  Description of Artificial Sequence: Synthetic oligonucleotide
cgggcaagtcagagcattagcaaatatttaaat

SEQ ID NO: 2336 - protein, 11 aa, Artificial Sequence
  Description of Artificial Sequence: Synthetic peptide
RASQSISKYLN

SEQ ID NO: 2337 - DNA, 33 bp, Artificial Sequence
  Description of Artificial Sequence: Synthetic oligonucleotide
caggcgagtcaggacattagcgactatttaaat

SEQ ID NO: 2338 - protein, 11 aa, Artificial Sequence
  Description of Artificial Sequence: Synthetic peptide
QASQDISDYLN

SEQ ID NO: 2339 - DNA, 33 bp, Artificial Sequence; identical to SEQ ID NO: 93
  Description of Artificial Sequence: Synthetic oligonucleotide

SEQ ID NO: 2340 - protein, 11 aa, Artificial Sequence
  Description of Artificial Sequence: Synthetic peptide
RTSQGIRNDLG

SEQ ID NO: 2341 - DNA, 33 bp, Artificial Sequence
  Description of Artificial Sequence: Synthetic oligonucleotide
cgggcaagtcaggacattagaaaggatttaggg

SEQ ID NO: 2342 - protein, 11 aa, Artificial Sequence
  Description of Artificial Sequence: Synthetic peptide
RASQDIRKDLG

SEQ ID NO: 2343 - DNA, 33 bp, Artificial Sequence
  Description of Artificial Sequence: Synthetic oligonucleotide
cgggcaagtcgggacattggaaatgatttaggc

SEQ ID NO: 2344 - protein, 11 aa, Artificial Sequence
  Description of Artificial Sequence: Synthetic peptide
RASRDIGNDLG

SEQ ID NO: 2345 - DNA, 33 bp, Artificial Sequence
  Description of Artificial Sequence: Synthetic oligonucleotide
cgggcgagtcagggcattagcaaatatttagtc

SEQ ID NO: 2346 - protein, 11 aa, Artificial Sequence
  Description of Artificial Sequence: Synthetic peptide
RASQGISKYLV

SEQ ID NO: 2347 - DNA, 48 bp, Artificial Sequence
  Description of Artificial Sequence: Synthetic oligonucleotide
aagtctagtcagagcctcctgcatggtgatgggaagacctatttctat

SEQ ID NO: 2348 - protein, 16 aa, Artificial Sequence
  Description of Artificial Sequence: Synthetic peptide
KSSQSLLHGDGKTYFY

SEQ ID NO: 2349 - DNA, 33 bp, Artificial Sequence; identical to SEQ ID NO: 1591
  Description of Artificial Sequence: Synthetic oligonucleotide

SEQ ID NO: 2350 - protein, 11 aa, Artificial Sequence
  Description of Artificial Sequence: Synthetic peptide
RASQDINNYLA

SEQ ID NO: 2351 - DNA, 33 bp, Artificial Sequence; identical to SEQ ID NO: 205
  Description of Artificial Sequence: Synthetic oligonucleotide

SEQ ID NO: 2352 - protein, 11 aa, Artificial Sequence
  Description of Artificial Sequence: Synthetic peptide
RASQDIRNDLG

SEQ ID NO: 2353 - DNA, 33 bp, Artificial Sequence; identical to SEQ ID NO: 109
  Description of Artificial Sequence: Synthetic oligonucleotide

SEQ ID NO: 2354 - protein, 11 aa, Artificial Sequence
  Description of Artificial Sequence: Synthetic peptide
RASQGIRNDLG

SEQ ID NO: 2355 - DNA, 33 bp, Artificial Sequence; identical to SEQ ID NO: 1591
  Description of Artificial Sequence: Synthetic oligonucleotide

SEQ ID NO: 2356 - protein, 11 aa, Artificial Sequence
  Description of Artificial Sequence: Synthetic peptide
RASQDINNYLA

SEQ ID NO: 2357 - DNA, 33 bp, Artificial Sequence; identical to SEQ ID NO: 109
  Description of Artificial Sequence: Synthetic oligonucleotide

SEQ ID NO: 2358 - protein, 11 aa, Artificial Sequence
  Description of Artificial Sequence: Synthetic peptide
RASQGIRNDLG

SEQ ID NO: 2359 - DNA, 51 bp, Artificial Sequence
  Description of Artificial Sequence: Synthetic oligonucleotide
aagtccagccagagtgttttacacagctccaacaataataactacttagct

SEQ ID NO: 2360 - protein, 17 aa, Artificial Sequence
  Description of Artificial Sequence: Synthetic peptide
KSSQSVLHSSNNNNYLA

SEQ ID NO: 2361 - DNA, 33 bp, Artificial Sequence; identical to SEQ ID NO: 2341
  Description of Artificial Sequence: Synthetic oligonucleotide

SEQ ID NO: 2362 - protein, 11 aa, Artificial Sequence
  Description of Artificial Sequence: Synthetic peptide
RASQDIRKDLG

SEQ ID NO: 2363 - DNA, 33 bp, Artificial Sequence; identical to SEQ ID NO: 109
  Description of Artificial Sequence: Synthetic oligonucleotide

SEQ ID NO: 2364 - protein, 11 aa, Artificial Sequence
  Description of Artificial Sequence: Synthetic peptide
RASQGIRNDLG

SEQ ID NO: 2365 - DNA, 33 bp, Artificial Sequence
  Description of Artificial Sequence: Synthetic oligonucleotide
cgggcgagtcaggacattagtaattatttagtc

SEQ ID NO: 2366 - protein, 11 aa, Artificial Sequence
  Description of Artificial Sequence: Synthetic peptide
RASQDISNYLV

SEQ ID NO: 2367 - DNA, 33 bp, Artificial Sequence; identical to SEQ ID NO: 109
  Description of Artificial Sequence: Synthetic oligonucleotide

SEQ ID NO: 2368 - protein, 11 aa, Artificial Sequence
  Description of Artificial Sequence: Synthetic peptide
RASQGIRNDLG

SEQ ID NO: 2369 - DNA, 48 bp, Artificial Sequence
  Description of Artificial Sequence: Synthetic oligonucleotide
aagtctagtcagagcctcctgcacggtgatggaaagacctatttgtat

SEQ ID NO: 2370 - protein, 16 aa, Artificial Sequence
  Description of Artificial Sequence: Synthetic peptide
KSSQSLLHGDGKTYLY

SEQ ID NO: 2371 - DNA, 33 bp, Artificial Sequence
  Description of Artificial Sequence: Synthetic oligonucleotide
aggtccagtcagagtgttaacagcaacttagcc

SEQ ID NO: 2372 - protein, 11 aa, Artificial Sequence
  Description of Artificial Sequence: Synthetic peptide
RSSQSVNSNLA

SEQ ID NO: 2373 - DNA, 33 bp, Artificial Sequence
  Description of Artificial Sequence: Synthetic oligonucleotide
caggcgagtcaggacatttacaattatttaaat

SEQ ID NO: 2374 - protein, 11 aa, Artificial Sequence
  Description of Artificial Sequence: Synthetic peptide
QASQDIYNYLN

SEQ ID NO: 2375 - DNA, 33 bp, Artificial Sequence; identical to SEQ ID NO: 1323
  Description of Artificial Sequence: Synthetic oligonucleotide

SEQ ID NO: 2376 - protein, 11 aa, Artificial Sequence
  Description of Artificial Sequence: Synthetic peptide
RASQGIRNDLG

SEQ ID NO: 2377 - DNA, 33 bp, Artificial Sequence
  Description of Artificial Sequence: Synthetic oligonucleotide
caggcgagtcaggacatttacaaccatttaagt

SEQ ID NO: 2378 - protein, 11 aa, Artificial Sequence
  Description of Artificial Sequence: Synthetic peptide
QASQDIYNHLS

SEQ ID NO: 2379 - DNA, 33 bp, Artificial Sequence; identical to SEQ ID NO: 1323
  Description of Artificial Sequence: Synthetic oligonucleotide

SEQ ID NO: 2380 - protein, 11 aa, Artificial Sequence
  Description of Artificial Sequence: Synthetic peptide
RASQGIRNDLG

SEQ ID NO: 2381 - DNA, 33 bp, Artificial Sequence; identical to SEQ ID NO: 2341
  Description of Artificial Sequence: Synthetic oligonucleotide

SEQ ID NO: 2382 - protein, 11 aa, Artificial Sequence
  Description of Artificial Sequence: Synthetic peptide
RASQDIRKDLG

SEQ ID NO: 2383 - DNA, 33 bp, Artificial Sequence; identical to SEQ ID NO: 109
  Description of Artificial Sequence: Synthetic oligonucleotide

SEQ ID NO: 2384 - protein, 11 aa, Artificial Sequence
  Description of Artificial Sequence: Synthetic peptide
RASQGIRNDLG

SEQ ID NO: 2385 - DNA, 33 bp, Artificial Sequence; identical to SEQ ID NO: 109
  Description of Artificial Sequence: Synthetic oligonucleotide

SEQ ID NO: 2386 - protein, 11 aa, Artificial Sequence
  Description of Artificial Sequence: Synthetic peptide
RASQGIRNDLG

SEQ ID NO: 2387 - DNA, 51 bp, Artificial Sequence
  Description of Artificial Sequence: Synthetic oligonucleotide
aagtccaaccatagtgttttatacaggtccaacaataatcaatacttagct

SEQ ID NO: 2388 - protein, 17 aa, Artificial Sequence
  Description of Artificial Sequence: Synthetic peptide
KSNHSVLYRSNNNQYLA

SEQ ID NO: 2389 - DNA, 51 bp, Artificial Sequence; identical to SEQ ID NO: 2329
  Description of Artificial Sequence: Synthetic oligonucleotide

SEQ ID NO: 2390 - protein, 17 aa, Artificial Sequence
  Description of Artificial Sequence: Synthetic peptide
KSSQNVLHSSNNNNYLT

SEQ ID NO: 2391 - DNA, 48 bp, Artificial Sequence
  Description of Artificial Sequence: Synthetic oligonucleotide
aagtctactcagagcctcctgcatggtgatggaaagacctatttgtat

SEQ ID NO: 2392 - protein, 16 aa, Artificial Sequence
  Description of Artificial Sequence: Synthetic peptide
KSTQSLLHGDGKTYLY

SEQ ID NO: 2393 - DNA, 33 bp, Artificial Sequence; identical to SEQ ID NO: 283
  Description of Artificial Sequence: Synthetic oligonucleotide

SEQ ID NO: 2394 - protein, 11 aa, Artificial Sequence
  Description of Artificial Sequence: Synthetic peptide
RASQDISNYLA

SEQ ID NO: 2395 - DNA, 33 bp, Artificial Sequence; identical to SEQ ID NO: 205
  Description of Artificial Sequence: Synthetic oligonucleotide

SEQ ID NO: 2396 - protein, 11 aa, Artificial Sequence
  Description of Artificial Sequence: Synthetic peptide
RASQDIRNDLG

SEQ ID NO: 2397 - DNA, 33 bp, Artificial Sequence; identical to SEQ ID NO: 2289
  Description of Artificial Sequence: Synthetic oligonucleotide

SEQ ID NO: 2398 - protein, 11 aa, Artificial Sequence
  Description of Artificial Sequence: Synthetic peptide
RASQDISNYLV

SEQ ID NO: 2399 - DNA, 33 bp, Artificial Sequence; identical to SEQ ID NO: 491
  Description of Artificial Sequence: Synthetic oligonucleotide

SEQ ID NO: 2400 - protein, 11 aa, Artificial Sequence
  Description of Artificial Sequence: Synthetic peptide
RASQDIRDDLG

SEQ ID NO: 2401 - DNA, 33 bp, Artificial Sequence; identical to SEQ ID NO: 341
  Description of Artificial Sequence: Synthetic oligonucleotide

SEQ ID NO: 2402 - protein, 11 aa, Artificial Sequence
  Description of Artificial Sequence: Synthetic peptide
RASQDIRNNLG

SEQ ID NO: 2403 - DNA, 51 bp, Artificial Sequence; identical to SEQ ID NO: 1683
  Description of Artificial Sequence: Synthetic oligonucleotide

SEQ ID NO: 2404 - protein, 17 aa, Artificial Sequence
  Description of Artificial Sequence: Synthetic peptide
KSSQSVLHSSNNKNYLT

SEQ ID NO: 2405 - DNA, 33 bp, Artificial Sequence
  Description of Artificial Sequence: Synthetic oligonucleotide
cgggcgagtcaggacattagccattatttagcc

SEQ ID NO: 2406 - protein, 11 aa, Artificial Sequence
  Description of Artificial Sequence: Synthetic peptide
RASQDISHYLA

SEQ ID NO: 2407 - DNA, 48 bp, Artificial Sequence
  Description of Artificial Sequence: Synthetic oligonucleotide
aagtctagtcagagcctcctgcacggtgatgggaagacctatttgtat

SEQ ID NO: 2408 - protein, 16 aa, Artificial Sequence
  Description of Artificial Sequence: Synthetic peptide
KSSQSLLHGDGKTYLY

SEQ ID NO: 2409 - DNA, 48 bp, Artificial Sequence; identical to SEQ ID NO: 2369
  Description of Artificial Sequence: Synthetic oligonucleotide

SEQ ID NO: 2410 - protein, 16 aa, Artificial Sequence
  Description of Artificial Sequence: Synthetic peptide
KSSQSLLHGDGKTYLY

SEQ ID NO: 2411 - DNA, 33 bp, Artificial Sequence; identical to SEQ ID NO: 293
  Description of Artificial Sequence: Synthetic oligonucleotide

SEQ ID NO: 2412 - protein, 11 aa, Artificial Sequence
  Description of Artificial Sequence: Synthetic peptide
RASQGINNYLA

SEQ ID NO: 2413 - DNA, 33 bp, Artificial Sequence
  Description of Artificial Sequence: Synthetic oligonucleotide
cgggctagtcagggcattagaaatgatttaggc

SEQ ID NO: 2414 - protein, 11 aa, Artificial Sequence
  Description of Artificial Sequence: Synthetic peptide
RASQGIRNDLG

SEQ ID NO: 2415 - DNA, 51 bp, Artificial Sequence
  Description of Artificial Sequence: Synthetic oligonucleotide
aagtccagccagagtgttttatacatctccaacaataaaaactacttagct

SEQ ID NO: 2416 - protein, 17 aa, Artificial Sequence
  Description of Artificial Sequence: Synthetic peptide
KSSQSVLYISNNKNYLA

SEQ ID NO: 2417 - DNA, 48 bp, Artificial Sequence
  Description of Artificial Sequence: Synthetic oligonucleotide
aggtctagtcagagcctcctgcataataatggatacaagtatttggat

SEQ ID NO: 2418 - protein, 16 aa, Artificial Sequence
  Description of Artificial Sequence: Synthetic peptide
RSSQSLLHNNGYKYLD

SEQ ID NO: 2419 - DNA, 33 bp, Artificial Sequence; identical to SEQ ID NO: 109
  Description of Artificial Sequence: Synthetic oligonucleotide

SEQ ID NO: 2420 - protein, 11 aa, Artificial Sequence
  Description of Artificial Sequence: Synthetic peptide
RASQGIRNDLG

SEQ ID NO: 2421 - DNA, 51 bp, Artificial Sequence; identical to SEQ ID NO: 2415
  Description of Artificial Sequence: Synthetic oligonucleotide

SEQ ID NO: 2422 - protein, 17 aa, Artificial Sequence
  Description of Artificial Sequence: Synthetic peptide
KSSQSVLYISNNKNYLA

SEQ ID NO: 2423 - DNA, 48 bp, Artificial Sequence; identical to SEQ ID NO: 2417
  Description of Artificial Sequence: Synthetic oligonucleotide

SEQ ID NO: 2424 - protein, 16 aa, Artificial Sequence
  Description of Artificial Sequence: Synthetic peptide
RSSQSLLHNNGYKYLD

SEQ ID NO: 2425 - DNA, 33 bp, Artificial Sequence; identical to SEQ ID NO: 109
  Description of Artificial Sequence: Synthetic oligonucleotide

SEQ ID NO: 2426 - protein, 11 aa, Artificial Sequence
  Description of Artificial Sequence: Synthetic peptide
RASQGIRNDLG

SEQ ID NO: 2427 - DNA, 33 bp, Artificial Sequence; identical to SEQ ID NO: 283
  Description of Artificial Sequence: Synthetic oligonucleotide

SEQ ID NO: 2428 - protein, 11 aa, Artificial Sequence
  Description of Artificial Sequence: Synthetic peptide
RASQDISNYLA

SEQ ID NO: 2429 - DNA, 33 bp, Artificial Sequence; identical to SEQ ID NO: 283
  Description of Artificial Sequence: Synthetic oligonucleotide

SEQ ID NO: 2430 - protein, 11 aa, Artificial Sequence
  Description of Artificial Sequence: Synthetic peptide
RASQDISNYLA

SEQ ID NO: 2431 - DNA, 33 bp, Artificial Sequence; identical to SEQ ID NO: 1185
  Description of Artificial Sequence: Synthetic oligonucleotide

SEQ ID NO: 2432 - protein, 11 aa, Artificial Sequence
  Description of Artificial Sequence: Synthetic peptide
RASQGIRDDLG

SEQ ID NO: 2433 - DNA, 48 bp, Artificial Sequence; identical to SEQ ID NO: 481
  Description of Artificial Sequence: Synthetic oligonucleotide

SEQ ID NO: 2434 - protein, 16 aa, Artificial Sequence
  Description of Artificial Sequence: Synthetic peptide
KSSQSLLHGDGKTYLF

SEQ ID NO: 2435 - DNA, 33 bp, Artificial Sequence; identical to SEQ ID NO: 105
  Description of Artificial Sequence: Synthetic oligonucleotide

SEQ ID NO: 2436 - protein, 11 aa, Artificial Sequence
  Description of Artificial Sequence: Synthetic peptide
RASQGISNYLA

SEQ ID NO: 2437 - DNA, 33 bp, Artificial Sequence; identical to SEQ ID NO: 109
  Description of Artificial Sequence: Synthetic oligonucleotide

SEQ ID NO: 2438 - protein, 11 aa, Artificial Sequence
  Description of Artificial Sequence: Synthetic peptide
RASQGIRNDLG

SEQ ID NO: 2439 - DNA, 33 bp, Artificial Sequence; identical to SEQ ID NO: 535
  Description of Artificial Sequence: Synthetic oligonucleotide

SEQ ID NO: 2440 - protein, 11 aa, Artificial Sequence
  Description of Artificial Sequence: Synthetic peptide
RASRGIRNDLG

SEQ ID NO: 2441 - DNA, 33 bp, Artificial Sequence; identical to SEQ ID NO: 109
  Description of Artificial Sequence: Synthetic oligonucleotide

SEQ ID NO: 2442 - protein, 11 aa, Artificial Sequence
  Description of Artificial Sequence: Synthetic peptide
RASQGIRNDLG

SEQ ID NO: 2443 - DNA, 33 bp, Artificial Sequence; identical to SEQ ID NO: 109
  Description of Artificial Sequence: Synthetic oligonucleotide

SEQ ID NO: 2444 - protein, 11 aa, Artificial Sequence
  Description of Artificial Sequence: Synthetic peptide
RASQGIRNDLG

SEQ ID NO: 2445 - DNA, 33 bp, Artificial Sequence; identical to SEQ ID NO: 281
  Description of Artificial Sequence: Synthetic oligonucleotide

SEQ ID NO: 2446 - protein, 11 aa, Artificial Sequence
  Description of Artificial Sequence: Synthetic peptide
RASQGIRTDLG

SEQ ID NO: 2447 - DNA, 33 bp, Artificial Sequence
  Description of Artificial Sequence: Synthetic oligonucleotide
cgggcgagtcaggacattggcaattgtttagcc

SEQ ID NO: 2448 - protein, 11 aa, Artificial Sequence
  Description of Artificial Sequence: Synthetic peptide
RASQDIGNCLA

SEQ ID NO: 2449 - DNA, 51 bp, Artificial Sequence; identical to SEQ ID NO: 1689
  Description of Artificial Sequence: Synthetic oligonucleotide

SEQ ID NO: 2450 - protein, 17 aa, Artificial Sequence
  Description of Artificial Sequence: Synthetic peptide
KSSQSVLHSSNNYNYLA

SEQ ID NO: 2451 - DNA, 33 bp, Artificial Sequence; identical to SEQ ID NO: 109
  Description of Artificial Sequence: Synthetic oligonucleotide

SEQ ID NO: 2452 - protein, 11 aa, Artificial Sequence
  Description of Artificial Sequence: Synthetic peptide
RASQGIRNDLG

SEQ ID NO: 2453 - DNA, 33 bp, Artificial Sequence; identical to SEQ ID NO: 281
  Description of Artificial Sequence: Synthetic oligonucleotide

SEQ ID NO: 2454 - protein, 11 aa, Artificial Sequence
  Description of Artificial Sequence: Synthetic peptide
RASQGIRTDLG

SEQ ID NO: 2455 - DNA, 33 bp, Artificial Sequence; identical to SEQ ID NO: 109
  Description of Artificial Sequence: Synthetic oligonucleotide

SEQ ID NO: 2456 - protein, 11 aa, Artificial Sequence
  Description of Artificial Sequence: Synthetic peptide
RASQGIRNDLG

SEQ ID NO: 2457 - DNA, 33 bp, Artificial Sequence
  Description of Artificial Sequence: Synthetic oligonucleotide
cgggcgagtcagggtgttaacgactggttagcc

SEQ ID NO: 2458 - protein, 11 aa, Artificial Sequence
  Description of Artificial Sequence: Synthetic peptide
RASQGVNDWLA

SEQ ID NO: 2459 - DNA, 48 bp, Artificial Sequence
  Description of Artificial Sequence: Synthetic oligonucleotide
aggtctagtcagagcctcctgtatcataatggatacaactatttggat

SEQ ID NO: 2460 - protein, 16 aa, Artificial Sequence
  Description of Artificial Sequence: Synthetic peptide
RSSQSLLYHNGYNYLD

SEQ ID NO: 2461 - DNA, 33 bp, Artificial Sequence; identical to SEQ ID NO: 553
  Description of Artificial Sequence: Synthetic oligonucleotide

SEQ ID NO: 2462 - protein, 11 aa, Artificial Sequence
  Description of Artificial Sequence: Synthetic peptide
RASQGISNWLA

SEQ ID NO: 2463 - DNA, 33 bp, Artificial Sequence
  Description of Artificial Sequence: Synthetic oligonucleotide
cgggcgagtcaggatattaccacctggttagcc

SEQ ID NO: 2464 - protein, 11 aa, Artificial Sequence
  Description of Artificial Sequence: Synthetic peptide
RASQDITTWLA

SEQ ID NO: 2465 - DNA, 33 bp, Artificial Sequence; identical to SEQ ID NO: 1301
  Description of Artificial Sequence: Synthetic oligonucleotide

SEQ ID NO: 2466 - protein, 11 aa, Artificial Sequence
  Description of Artificial Sequence: Synthetic peptide
RASQGIRNNLG

SEQ ID NO: 2467 - DNA, 33 bp, Artificial Sequence; identical to SEQ ID NO: 2413
  Description of Artificial Sequence: Synthetic oligonucleotide

SEQ ID NO: 2468 - protein, 11 aa, Artificial Sequence
  Description of Artificial Sequence: Synthetic peptide
RASQGIRNDLG

SEQ ID NO: 2469 - DNA, 48 bp, Artificial Sequence
  Description of Artificial Sequence: Synthetic oligonucleotide
aagtctagtcagagcctcctgcatggtgatggaaagacctatttctat

SEQ ID NO: 2470 - protein, 16 aa, Artificial Sequence
  Description of Artificial Sequence: Synthetic peptide
KSSQSLLHGDGKTYFY

SEQ ID NO: 2471 - DNA, 33 bp, Artificial Sequence; identical to SEQ ID NO: 453
  Description of Artificial Sequence: Synthetic oligonucleotide

SEQ ID NO: 2472 - protein, 11 aa, Artificial Sequence
  Description of Artificial Sequence: Synthetic peptide
RASQGVRNDLG

SEQ ID NO: 2473 - DNA, 51 bp, Artificial Sequence; identical to SEQ ID NO: 1057
  Description of Artificial Sequence: Synthetic oligonucleotide

SEQ ID NO: 2474 - protein, 17 aa, Artificial Sequence
  Description of Artificial Sequence: Synthetic peptide
KSSQSVLHSSNNNNYLA

SEQ ID NO: 2475 - DNA, 33 bp, Artificial Sequence
  Description of Artificial Sequence: Synthetic oligonucleotide
cgtgcaagtcagaccattagcaactatttaaat

SEQ ID NO: 2476 - protein, 11 aa, Artificial Sequence
  Description of Artificial Sequence: Synthetic peptide
RASQTISNYLN

SEQ ID NO: 2477 - DNA, 48 bp, Artificial Sequence; identical to SEQ ID NO: 575
  Description of Artificial Sequence: Synthetic oligonucleotide

SEQ ID NO: 2478 - protein, 16 aa, Artificial Sequence
  Description of Artificial Sequence: Synthetic peptide
KSSQSLLHGDGKTYLY

SEQ ID NO: 2479 - DNA, 48 bp, Artificial Sequence
  Description of Artificial Sequence: Synthetic oligonucleotide
aagtctagtcagagcctcctgcatagtgagggaaagacctacttgtat

SEQ ID NO: 2480 - protein, 16 aa, Artificial Sequence
  Description of Artificial Sequence: Synthetic peptide
KSSQSLLHSEGKTYLY

SEQ ID NO: 2481 - DNA, 33 bp, Artificial Sequence; identical to SEQ ID NO: 109
  Description of Artificial Sequence: Synthetic oligonucleotide

SEQ ID NO: 2482 - protein, 11 aa, Artificial Sequence
  Description of Artificial Sequence: Synthetic peptide
RASQGIRNDLG

SEQ ID NO: 2483 - DNA, 51 bp, Artificial Sequence
  Description of Artificial Sequence: Synthetic oligonucleotide
aagtccagccagagtgtattacacagctccaacaattacaactacttaact

SEQ ID NO: 2484 - protein, 17 aa, Artificial Sequence
  Description of Artificial Sequence: Synthetic peptide
KSSQSVLHSSNNYNYLT

SEQ ID NO: 2485 - DNA, 33 bp, Artificial Sequence; identical to SEQ ID NO: 553
  Description of Artificial Sequence: Synthetic oligonucleotide

SEQ ID NO: 2486 - protein, 11 aa, Artificial Sequence
  Description of Artificial Sequence: Synthetic peptide
RASQGISNWLA

SEQ ID NO: 2487 - DNA, 33 bp, Artificial Sequence; identical to SEQ ID NO: 1185
  Description of Artificial Sequence: Synthetic oligonucleotide

SEQ ID NO: 2488 - protein, 11 aa, Artificial Sequence
  Description of Artificial Sequence: Synthetic peptide
RASQGIRDDLG

SEQ ID NO: 2489 - DNA, 33 bp, Artificial Sequence; identical to SEQ ID NO: 281
  Description of Artificial Sequence: Synthetic oligonucleotide

SEQ ID NO: 2490 - protein, 11 aa, Artificial Sequence
  Description of Artificial Sequence: Synthetic peptide
RASQGIRTDLG

SEQ ID NO: 2491 - DNA, 33 bp, Artificial Sequence
  Description of Artificial Sequence: Synthetic oligonucleotide
cgggcgagtcaggacattagcaatgatttagcc

SEQ ID NO: 2492 - protein, 11 aa, Artificial Sequence
  Description of Artificial Sequence: Synthetic peptide
RASQDISNDLA

SEQ ID NO: 2493 - DNA, 33 bp, Artificial Sequence
  Description of Artificial Sequence: Synthetic oligonucleotide
cgggcgagtcagggcattgggaattatttagcc

SEQ ID NO: 2494 - protein, 11 aa, Artificial Sequence
  Description of Artificial Sequence: Synthetic peptide
RASQGIGNYLA

SEQ ID NO: 2495 - DNA, 33 bp, Artificial Sequence
  Description of Artificial Sequence: Synthetic oligonucleotide
cgggcgagtcagggtattaccgactggttagcc

SEQ ID NO: 2496 - protein, 11 aa, Artificial Sequence
  Description of Artificial Sequence: Synthetic peptide
RASQGITDWLA

SEQ ID NO: 2497 - DNA, 51 bp, Artificial Sequence; identical to SEQ ID NO: 1541
  Description of Artificial Sequence: Synthetic oligonucleotide

SEQ ID NO: 2498 - protein, 17 aa, Artificial Sequence
  Description of Artificial Sequence: Synthetic peptide
KSSQSVLYSSNNNNYLA

SEQ ID NO: 2499 - DNA, 33 bp, Artificial Sequence
  Description of Artificial Sequence: Synthetic oligonucleotide
cgggcaagtcagaccattggcaactatttaaat

SEQ ID NO: 2500 - protein, 11 aa, Artificial Sequence
  Description of Artificial Sequence: Synthetic peptide
RASQTIGNYLN

SEQ ID NO: 2501 - DNA, 48 bp, Artificial Sequence; identical to SEQ ID NO: 575
  Description of Artificial Sequence: Synthetic oligonucleotide

SEQ ID NO: 2502 - protein, 16 aa, Artificial Sequence
  Description of Artificial Sequence: Synthetic peptide
KSSQSLLHGDGKTYLY

SEQ ID NO: 2503 - DNA, 48 bp, Artificial Sequence; identical to SEQ ID NO: 2417
  Description of Artificial Sequence: Synthetic oligonucleotide

SEQ ID NO: 2504 - protein, 16 aa, Artificial Sequence
  Description of Artificial Sequence: Synthetic peptide
RSSQSLLHNNGYKYLD

SEQ ID NO: 2505 - DNA, 33 bp, Artificial Sequence; identical to SEQ ID NO: 109
  Description of Artificial Sequence: Synthetic oligonucleotide

SEQ ID NO: 2506 - protein, 11 aa, Artificial Sequence
  Description of Artificial Sequence: Synthetic peptide
RASQGIRNDLG

SEQ ID NO: 2507 - DNA, 33 bp, Artificial Sequence; identical to SEQ ID NO: 109
  Description of Artificial Sequence: Synthetic oligonucleotide

SEQ ID NO: 2508 - protein, 11 aa, Artificial Sequence
  Description of Artificial Sequence: Synthetic peptide
RASQGIRNDLG

SEQ ID NO: 2509 - DNA, 33 bp, Artificial Sequence; identical to SEQ ID NO: 2311
  Description of Artificial Sequence: Synthetic oligonucleotide

SEQ ID NO: 2510 - protein, 11 aa, Artificial Sequence
  Description of Artificial Sequence: Synthetic peptide
RASQGITNYLA

SEQ ID NO: 2511 - DNA, 33 bp, Artificial Sequence; identical to SEQ ID NO: 109
  Description of Artificial Sequence: Synthetic oligonucleotide

SEQ ID NO: 2512 - protein, 11 aa, Artificial Sequence
  Description of Artificial Sequence: Synthetic peptide
RASQGIRNDLG

SEQ ID NO: 2513 - DNA, 33 bp, Artificial Sequence
  Description of Artificial Sequence: Synthetic oligonucleotide
cgggcaagtcaggacattagcaatgatttaggc

SEQ ID NO: 2514 - protein, 11 aa, Artificial Sequence
  Description of Artificial Sequence: Synthetic peptide
RASQDISNDLG

SEQ ID NO: 2515 - DNA, 48 bp, Artificial Sequence; identical to SEQ ID NO: 107
  Description of Artificial Sequence: Synthetic oligonucleotide

SEQ ID NO: 2516 - protein, 16 aa, Artificial Sequence
  Description of Artificial Sequence: Synthetic peptide
KSSQRLLHGDGKTYLY

SEQ ID NO: 2517 - DNA, 51 bp, Artificial Sequence
  Description of Artificial Sequence: Synthetic oligonucleotide
aagtccagccagagtgttttacacagctccaacaataacaactacttaact

SEQ ID NO: 2518 - protein, 17 aa, Artificial Sequence
  Description of Artificial Sequence: Synthetic peptide
KSSQSVLHSSNNNNYLT

SEQ ID NO: 2519 - DNA, 33 bp, Artificial Sequence; identical to SEQ ID NO: 553
  Description of Artificial Sequence: Synthetic oligonucleotide

SEQ ID NO: 2520 - protein, 11 aa, Artificial Sequence
  Description of Artificial Sequence: Synthetic peptide
RASQGISNWLA

SEQ ID NO: 2521 - DNA, 33 bp, Artificial Sequence
  Description of Artificial Sequence: Synthetic oligonucleotide
cgggcgagtcaggatattactgactggttagcc

SEQ ID NO: 2522 - protein, 11 aa, Artificial Sequence
  Description of Artificial Sequence: Synthetic peptide
RASQDITDWLA

SEQ ID NO: 2523 - DNA, 33 bp, Artificial Sequence; identical to SEQ ID NO: 109
  Description of Artificial Sequence: Synthetic oligonucleotide

SEQ ID NO: 2524 - protein, 11 aa, Artificial Sequence
  Description of Artificial Sequence: Synthetic peptide
RASQGIRNDLG

SEQ ID NO: 2525 - DNA, 48 bp, Artificial Sequence; identical to SEQ ID NO: 575
  Description of Artificial Sequence: Synthetic oligonucleotide

SEQ ID NO: 2526 - protein, 16 aa, Artificial Sequence
  Description of Artificial Sequence: Synthetic peptide
KSSQSLLHGDGKTYLY

SEQ ID NO: 2527 - DNA, 33 bp, Artificial Sequence
  Description of Artificial Sequence: Synthetic oligonucleotide
cgggcgagtcaggatattagcgactggttagcc

SEQ ID NO: 2528 - protein, 11 aa, Artificial Sequence
  Description of Artificial Sequence: Synthetic peptide
RASQDISDWLA

SEQ ID NO: 2529 - DNA, 48 bp, Artificial Sequence
  Description of Artificial Sequence: Synthetic oligonucleotide
aaatctagtcagagcctcctgcatagtgagggaaagacctacttgtat

SEQ ID NO: 2530 - protein, 16 aa, Artificial Sequence
  Description of Artificial Sequence: Synthetic peptide
KSSQSLLHSEGKTYLY

SEQ ID NO: 2531 - DNA, 33 bp, Artificial Sequence
  Description of Artificial Sequence: Synthetic oligonucleotide
cgggcgagtcaggatattaccagctggttagcc

SEQ ID NO: 2532 - protein, 11 aa, Artificial Sequence
  Description of Artificial Sequence: Synthetic peptide
RASQDITSWLA

SEQ ID NO: 2533 - DNA, 48 bp, Artificial Sequence; identical to SEQ ID NO: 575
  Description of Artificial Sequence: Synthetic oligonucleotide

SEQ ID NO: 2534 - protein, 16 aa, Artificial Sequence
  Description of Artificial Sequence: Synthetic peptide
KSSQSLLHGDGKTYLY

SEQ ID NO: 2535 - DNA, 33 bp, Artificial Sequence; identical to SEQ ID NO: 109
  Description of Artificial Sequence: Synthetic oligonucleotide

SEQ ID NO: 2536 - protein, 11 aa, Artificial Sequence
  Description of Artificial Sequence: Synthetic peptide
RASQGIRNDLG

SEQ ID NO: 2537 - DNA, 33 bp, Artificial Sequence
  Description of Artificial Sequence: Synthetic oligonucleotide
cgggcaagtcagaccattctcagctatttaaat

SEQ ID NO: 2538 - protein, 11 aa, Artificial Sequence
  Description of Artificial Sequence: Synthetic peptide
RASQTILSYLN

SEQ ID NO: 2539 - DNA, 48 bp, Artificial Sequence; identical to SEQ ID NO: 575
  Description of Artificial Sequence: Synthetic oligonucleotide

SEQ ID NO: 2540 - protein, 16 aa, Artificial Sequence
  Description of Artificial Sequence: Synthetic peptide
KSSQSLLHGDGKTYLY

SEQ ID NO: 2541 - DNA, 33 bp, Artificial Sequence; identical to SEQ ID NO: 105
  Description of Artificial Sequence: Synthetic oligonucleotide

SEQ ID NO: 2542 - protein, 11 aa, Artificial Sequence
  Description of Artificial Sequence: Synthetic peptide
RASQGISNYLA

SEQ ID NO: 2543 - DNA, 33 bp, Artificial Sequence
  Description of Artificial Sequence: Synthetic oligonucleotide
cgggcaagtcacagcattagcaactatttaaat

SEQ ID NO: 2544 - protein, 11 aa, Artificial Sequence
  Description of Artificial Sequence: Synthetic peptide
RASHSISNYLN

SEQ ID NO: 2545 - DNA, 51 bp, Artificial Sequence; identical to SEQ ID NO: 1959
  Description of Artificial Sequence: Synthetic oligonucleotide

SEQ ID NO: 2546 - protein, 17 aa, Artificial Sequence
  Description of Artificial Sequence: Synthetic peptide
KSSQSVLHSSNNYNYLT

SEQ ID NO: 2547 - DNA, 33 bp, Artificial Sequence; identical to SEQ ID NO: 109
  Description of Artificial Sequence: Synthetic oligonucleotide

SEQ ID NO: 2548 - protein, 11 aa, Artificial Sequence
  Description of Artificial Sequence: Synthetic peptide
RASQGIRNDLG

SEQ ID NO: 2549 - DNA, 48 bp, Artificial Sequence; identical to SEQ ID NO: 575
  Description of Artificial Sequence: Synthetic oligonucleotide

SEQ ID NO: 2550 - protein, 16 aa, Artificial Sequence
  Description of Artificial Sequence: Synthetic peptide
KSSQSLLHGDGKTYLY

SEQ ID NO: 2551 - DNA, 33 bp, Artificial Sequence; identical to SEQ ID NO: 2531
  Description of Artificial Sequence: Synthetic oligonucleotide

SEQ ID NO: 2552 - protein, 11 aa, Artificial Sequence
  Description of Artificial Sequence: Synthetic peptide
RASQDITSWLA

SEQ ID NO: 2553 - DNA, 33 bp, Artificial Sequence; identical to SEQ ID NO: 837
  Description of Artificial Sequence: Synthetic oligonucleotide

SEQ ID NO: 2554 - protein, 11 aa, Artificial Sequence
  Description of Artificial Sequence: Synthetic peptide
QASQDISNYLN

SEQ ID NO: 2555 - DNA, 33 bp, Artificial Sequence
  Description of Artificial Sequence: Synthetic oligonucleotide
cgggcaagtcggaacatcagcaactatttaaat

SEQ ID NO: 2556 - protein, 11 aa, Artificial Sequence
  Description of Artificial Sequence: Synthetic peptide
RASRNISNYLN

SEQ ID NO: 2557 - DNA, 36 bp, Artificial Sequence
  Description of Artificial Sequence: Synthetic oligonucleotide
agggccagtccgagtgttagcagcagattcttagcc

SEQ ID NO: 2558 - protein, 12 aa, Artificial Sequence
  Description of Artificial Sequence: Synthetic peptide
RASPSVSSRFLA

SEQ ID NO: 2559 - DNA, 33 bp, Artificial Sequence
  Description of Artificial Sequence: Synthetic oligonucleotide
cgggccagtcagagtattggtagtaacttacac

SEQ ID NO: 2560 - protein, 11 aa, Artificial Sequence
  Description of Artificial Sequence: Synthetic peptide
RASQSIGSNLH

SEQ ID NO: 2561 - DNA, 33 bp, Artificial Sequence
  Description of Artificial Sequence: Synthetic oligonucleotide
cggacgagtcagggcattggcaattatttagcc

SEQ ID NO: 2562 - protein, 11 aa, Artificial Sequence
  Description of Artificial Sequence: Synthetic peptide
RTSQGIGNYLA

SEQ ID NO: 2563 - DNA, 33 bp, Artificial Sequence
  Description of Artificial Sequence: Synthetic oligonucleotide
agggccagtcagagttttcgcatcaacttagcc

SEQ ID NO: 2564 - protein, 11 aa, Artificial Sequence
  Description of Artificial Sequence: Synthetic peptide
RASQSFRINLA

SEQ ID NO: 2565 - DNA, 33 bp, Artificial Sequence
  Description of Artificial Sequence: Synthetic oligonucleotide
cgggccagtcagaacattggtagtagcttacac

SEQ ID NO: 2566 - protein, 11 aa, Artificial Sequence
  Description of Artificial Sequence: Synthetic peptide
RASQNIGSSLH

SEQ ID NO: 2567 - DNA, 33 bp, Artificial Sequence; identical to SEQ ID NO: 2561
  Description of Artificial Sequence: Synthetic oligonucleotide

SEQ ID NO: 2568 - protein, 11 aa, Artificial Sequence
  Description of Artificial Sequence: Synthetic peptide
RTSQGIGNYLA

SEQ ID NO: 2569 - DNA, 48 bp, Artificial Sequence
  Description of Artificial Sequence: Synthetic oligonucleotide
aagtctagtcagagcctcctccatagtgatggaaggacctatttgtat

SEQ ID NO: 2570 - protein, 16 aa, Artificial Sequence
  Description of Artificial Sequence: Synthetic peptide
KSSQSLLHSDGRTYLY

SEQ ID NO: 2571 - DNA, 33 bp, Artificial Sequence
  Description of Artificial Sequence: Synthetic oligonucleotide
cgggccagtcagagtattggtagtagcttacac

SEQ ID NO: 2572 - protein, 11 aa, Artificial Sequence
  Description of Artificial Sequence: Synthetic peptide
RASQSIGSSLH

SEQ ID NO: 2573 - DNA, 33 bp, Artificial Sequence; identical to SEQ ID NO: 1229
  Description of Artificial Sequence: Synthetic oligonucleotide

SEQ ID NO: 2574 - protein, 11 aa, Artificial Sequence
  Description of Artificial Sequence: Synthetic peptide
RASQGIRKDLG

SEQ ID NO: 2575 - DNA, 33 bp, Artificial Sequence; identical to SEQ ID NO: 105
  Description of Artificial Sequence: Synthetic oligonucleotide

SEQ ID NO: 2576 - protein, 11 aa, Artificial Sequence
  Description of Artificial Sequence: Synthetic peptide
RASQGISNYLA

SEQ ID NO: 2577 - DNA, 33 bp, Artificial Sequence; identical to SEQ ID NO: 1727
  Description of Artificial Sequence: Synthetic oligonucleotide

SEQ ID NO: 2578 - protein, 11 aa, Artificial Sequence
  Description of Artificial Sequence: Synthetic peptide
RASQGIGKYLA

SEQ ID NO: 2579 - DNA, 33 bp, Artificial Sequence
  Description of Artificial Sequence: Synthetic oligonucleotide
cggacgagtcagggcattggcaagtatttagcc

SEQ ID NO: 2580 - protein, 11 aa, Artificial Sequence
  Description of Artificial Sequence: Synthetic peptide
RTSQGIGKYLA

SEQ ID NO: 2581 - DNA, 48 bp, Artificial Sequence
  Description of Artificial Sequence: Synthetic oligonucleotide
aggtctagtcagagcctcctgcatagtgatggaaagacctatttgttt

SEQ ID NO: 2582 - protein, 16 aa, Artificial Sequence
  Description of Artificial Sequence: Synthetic peptide
RSSQSLLHSDGKTYLF

SEQ ID NO: 2583 - DNA, 51 bp, Artificial Sequence
  Description of Artificial Sequence: Synthetic oligonucleotide
aggtccagccagagtgttttacacagctccaacaattacaactacttagct

SEQ ID NO: 2584 - protein, 17 aa, Artificial Sequence
  Description of Artificial Sequence: Synthetic peptide
RSSQSVLHSSNNYNYLA

SEQ ID NO: 2585 - DNA, 36 bp, Artificial Sequence
  Description of Artificial Sequence: Synthetic oligonucleotide
agggccagtcagagtattagcctcaacttcttagcc

SEQ ID NO: 2586 - protein, 12 aa, Artificial Sequence
  Description of Artificial Sequence: Synthetic peptide
RASQSISLNFLA

SEQ ID NO: 2587 - DNA, 33 bp, Artificial Sequence; identical to SEQ ID NO: 105
  Description of Artificial Sequence: Synthetic oligonucleotide

SEQ ID NO: 2588 - protein, 11 aa, Artificial Sequence
  Description of Artificial Sequence: Synthetic peptide
RASQGISNYLA

SEQ ID NO: 2589 - DNA, 36 bp, Artificial Sequence
  Description of Artificial Sequence: Synthetic oligonucleotide
agggccagtcagagtattcgcagcagcttcttagcc

SEQ ID NO: 2590 - protein, 12 aa, Artificial Sequence
  Description of Artificial Sequence: Synthetic peptide
RASQSIRSSFLA

SEQ ID NO: 2591 - DNA, 36 bp, Artificial Sequence; identical to SEQ ID NO: 2589
  Description of Artificial Sequence: Synthetic oligonucleotide

SEQ ID NO: 2592 - protein, 12 aa, Artificial Sequence
  Description of Artificial Sequence: Synthetic peptide
RASQSIRSSFLA

SEQ ID NO: 2593 - DNA, 36 bp, Artificial Sequence
  Description of Artificial Sequence: Synthetic oligonucleotide
agggccggtcaaagtattagaaccaacttcttagcc

SEQ ID NO: 2594 - protein, 12 aa, Artificial Sequence
  Description of Artificial Sequence: Synthetic peptide
RAGQSIRTNFLA

SEQ ID NO: 2595 - DNA, 48 bp, Artificial Sequence; identical to SEQ ID NO: 2569
  Description of Artificial Sequence: Synthetic oligonucleotide

SEQ ID NO: 2596 - protein, 16 aa, Artificial Sequence
  Description of Artificial Sequence: Synthetic peptide
KSSQSLLHSDGRTYLY

SEQ ID NO: 2597 - DNA, 51 bp, Artificial Sequence
  Description of Artificial Sequence: Synthetic oligonucleotide
aagtccagccagagtgttttacacagctccaacagttacaactacttagct

SEQ ID NO: 2598 - protein, 17 aa, Artificial Sequence
  Description of Artificial Sequence: Synthetic peptide
KSSQSVLHSSNSYNYLA

SEQ ID NO: 2599 - DNA, 33 bp, Artificial Sequence; identical to SEQ ID NO: 1229
  Description of Artificial Sequence: Synthetic oligonucleotide

SEQ ID NO: 2600 - protein, 11 aa, Artificial Sequence
  Description of Artificial Sequence: Synthetic peptide
RASQGIRKDLG

SEQ ID NO: 2601 - DNA, 33 bp, Artificial Sequence; identical to SEQ ID NO: 2561
  Description of Artificial Sequence: Synthetic oligonucleotide

SEQ ID NO: 2602 - protein, 11 aa, Artificial Sequence
  Description of Artificial Sequence: Synthetic peptide
RTSQGIGNYLA

SEQ ID NO: 2603 - DNA, 33 bp, Artificial Sequence
  Description of Artificial Sequence: Synthetic oligonucleotide
cgggcgagtcaggggattggcaatcatttagcc

SEQ ID NO: 2604 - protein, 11 aa, Artificial Sequence
  Description of Artificial Sequence: Synthetic peptide
RASQGIGNHLA

SEQ ID NO: 2605 - DNA, 33 bp, Artificial Sequence
  Description of Artificial Sequence: Synthetic oligonucleotide
cgggccaatcagagcattggtagtagcttacac

SEQ ID NO: 2606 - protein, 11 aa, Artificial Sequence
  Description of Artificial Sequence: Synthetic peptide
RANQSIGSSLH

SEQ ID NO: 2607 - DNA, 36 bp, Artificial Sequence
  Description of Artificial Sequence: Synthetic oligonucleotide
agggccagtcagagtgttagcagcaggttcttagcc

SEQ ID NO: 2608 - protein, 12 aa, Artificial Sequence
  Description of Artificial Sequence: Synthetic peptide
RASQSVSSRFLA

SEQ ID NO: 2609 - DNA, 33 bp, Artificial Sequence
  Description of Artificial Sequence: Synthetic oligonucleotide
cgggccagtcagagcattggtagtagcttacac

SEQ ID NO: 2610 - protein, 11 aa, Artificial Sequence
  Description of Artificial Sequence: Synthetic peptide
RASQSIGSSLH

SEQ ID NO: 2611 - DNA, 33 bp, Artificial Sequence; identical to SEQ ID NO: 401
  Description of Artificial Sequence: Synthetic oligonucleotide

SEQ ID NO: 2612 - protein, 11 aa, Artificial Sequence
  Description of Artificial Sequence: Synthetic peptide
RASQGIRNYLA

SEQ ID NO: 2613 - DNA, 48 bp, Artificial Sequence; identical to SEQ ID NO: 2569
  Description of Artificial Sequence: Synthetic oligonucleotide

SEQ ID NO: 2614 - protein, 16 aa, Artificial Sequence
  Description of Artificial Sequence: Synthetic peptide
KSSQSLLHSDGRTYLY

SEQ ID NO: 2615 - DNA, 33 bp, Artificial Sequence
  Description of Artificial Sequence: Synthetic oligonucleotide
cgggcgagtcaggacattggcagatatttagcc

SEQ ID NO: 2616 - protein, 11 aa, Artificial Sequence
  Description of Artificial Sequence: Synthetic peptide
RASQDIGRYLA

SEQ ID NO: 2617 - DNA, 33 bp, Artificial Sequence; identical to SEQ ID NO: 2193
  Description of Artificial Sequence: Synthetic oligonucleotide

SEQ ID NO: 2618 - protein, 11 aa, Artificial Sequence
  Description of Artificial Sequence: Synthetic peptide
RASQGINNWLA

SEQ ID NO: 2619 - DNA, 33 bp, Artificial Sequence; identical to SEQ ID NO: 105
  Description of Artificial Sequence: Synthetic oligonucleotide

SEQ ID NO: 2620 - protein, 11 aa, Artificial Sequence
  Description of Artificial Sequence: Synthetic peptide
RASQGISNYLA

SEQ ID NO: 2621 - DNA, 33 bp, Artificial Sequence; identical to SEQ ID NO: 109
  Description of Artificial Sequence: Synthetic oligonucleotide

SEQ ID NO: 2622 - protein, 11 aa, Artificial Sequence
  Description of Artificial Sequence: Synthetic peptide
RASQGIRNDLG

SEQ ID NO: 2623 - DNA, 33 bp, Artificial Sequence; identical to SEQ ID NO: 109
  Description of Artificial Sequence: Synthetic oligonucleotide

SEQ ID NO: 2624 - protein, 11 aa, Artificial Sequence
  Description of Artificial Sequence: Synthetic peptide
RASQGIRNDLG

SEQ ID NO: 2625 - DNA, 33 bp, Artificial Sequence; identical to SEQ ID NO: 105
  Description of Artificial Sequence: Synthetic oligonucleotide

SEQ ID NO: 2626 - protein, 11 aa, Artificial Sequence
  Description of Artificial Sequence: Synthetic peptide
RASQGISNYLA

SEQ ID NO: 2627 - DNA, 33 bp, Artificial Sequence; identical to SEQ ID NO: 105
  Description of Artificial Sequence: Synthetic oligonucleotide

SEQ ID NO: 2628 - protein, 11 aa, Artificial Sequence
  Description of Artificial Sequence: Synthetic peptide
RASQGISNYLA

SEQ ID NO: 2629 - DNA, 48 bp, Artificial Sequence
  Description of Artificial Sequence: Synthetic oligonucleotide
aagtctagtcagagcctcctgcatggtgatggaaagacctatttgtgt

SEQ ID NO: 2630 - protein, 16 aa, Artificial Sequence
  Description of Artificial Sequence: Synthetic peptide
KSSQSLLHGDGKTYLC

SEQ ID NO: 2631 - DNA, 33 bp, Artificial Sequence; identical to SEQ ID NO: 2531
  Description of Artificial Sequence: Synthetic oligonucleotide

SEQ ID NO: 2632 - protein, 11 aa, Artificial Sequence
  Description of Artificial Sequence: Synthetic peptide
RASQDITSWLA

SEQ ID NO: 2633 - DNA, 33 bp, Artificial Sequence; identical to SEQ ID NO: 105
  Description of Artificial Sequence: Synthetic oligonucleotide

SEQ ID NO: 2634 - protein, 11 aa, Artificial Sequence
  Description of Artificial Sequence: Synthetic peptide
RASQGISNYLA

SEQ ID NO: 2635 - DNA, 33 bp, Artificial Sequence
  Description of Artificial Sequence: Synthetic oligonucleotide
cgggcgaatcaggatatttccagctggttagcc

SEQ ID NO: 2636 - protein, 11 aa, Artificial Sequence
  Description of Artificial Sequence: Synthetic peptide
RANQDISSWLA

SEQ ID NO: 2637 - DNA, 33 bp, Artificial Sequence; identical to SEQ ID NO: 105
  Description of Artificial Sequence: Synthetic oligonucleotide

SEQ ID NO: 2638 - protein, 11 aa, Artificial Sequence
  Description of Artificial Sequence: Synthetic peptide
RASQGISNYLA

SEQ ID NO: 2639 - DNA, 48 bp, Artificial Sequence
  Description of Artificial Sequence: Synthetic oligonucleotide
atgtctagtcagagcctcctgcatggtgatggaaagacctatttatat

SEQ ID NO: 2640 - protein, 16 aa, Artificial Sequence
  Description of Artificial Sequence: Synthetic peptide
MSSQSLLHGDGKTYLY

SEQ ID NO: 2641 - DNA, 48 bp, Artificial Sequence; identical to SEQ ID NO: 481
  Description of Artificial Sequence: Synthetic oligonucleotide

SEQ ID NO: 2642 - protein, 16 aa, Artificial Sequence
  Description of Artificial Sequence: Synthetic peptide
KSSQSLLHGDGKTYLF

SEQ ID NO: 2643 - DNA, 51 bp, Artificial Sequence
  Description of Artificial Sequence: Synthetic oligonucleotide
aagtccagccagagtgttttattcaactccaacaataagaactacttagct

SEQ ID NO: 2644 - protein, 17 aa, Artificial Sequence
  Description of Artificial Sequence: Synthetic peptide
KSSQSVLFNSNNKNYLA

SEQ ID NO: 2645 - DNA, 36 bp, Artificial Sequence
  Description of Artificial Sequence: Synthetic oligonucleotide
agggccagtcagaatataaggagcaacttcttagcc

SEQ ID NO: 2646 - protein, 12 aa, Artificial Sequence
  Description of Artificial Sequence: Synthetic peptide
RASQNIRSNFLA

SEQ ID NO: 2647 - DNA, 33 bp, Artificial Sequence; identical to SEQ ID NO: 1229
  Description of Artificial Sequence: Synthetic oligonucleotide

SEQ ID NO: 2648 - protein, 11 aa, Artificial Sequence
  Description of Artificial Sequence: Synthetic peptide
RASQGIRKDLG

SEQ ID NO: 2649 - DNA, 33 bp, Artificial Sequence
  Description of Artificial Sequence: Synthetic oligonucleotide
cgggcgagtcagggtcttaacaactggttagcc

SEQ ID NO: 2650 - protein, 11 aa, Artificial Sequence
  Description of Artificial Sequence: Synthetic peptide
RASQGLNNWLA

SEQ ID NO: 2651 - DNA, 36 bp, Artificial Sequence; identical to SEQ ID NO: 2589
  Description of Artificial Sequence: Synthetic oligonucleotide

SEQ ID NO: 2652 - protein, 12 aa, Artificial Sequence
  Description of Artificial Sequence: Synthetic peptide
RASQSIRSSFLA

SEQ ID NO: 2653 - DNA, 36 bp, Artificial Sequence
  Description of Artificial Sequence: Synthetic oligonucleotide
agggccagtcagagtgttagaagcaacttcttagcc

SEQ ID NO: 2654 - protein, 12 aa, Artificial Sequence
  Description of Artificial Sequence: Synthetic peptide
RASQSVRSNFLA

SEQ ID NO: 2655 - DNA, 51 bp, Artificial Sequence; identical to SEQ ID NO: 1689
  Description of Artificial Sequence: Synthetic oligonucleotide

SEQ ID NO: 2656 - protein, 17 aa, Artificial Sequence
  Description of Artificial Sequence: Synthetic peptide
KSSQSVLHSSNNYNYLA

SEQ ID NO: 2657 - DNA, 33 bp, Artificial Sequence; identical to SEQ ID NO: 2559
  Description of Artificial Sequence: Synthetic oligonucleotide

SEQ ID NO: 2658 - protein, 11 aa, Artificial Sequence
  Description of Artificial Sequence: Synthetic peptide
RASQSIGSNLH

SEQ ID NO: 2659 - DNA, 33 bp, Artificial Sequence; identical to SEQ ID NO: 1229
  Description of Artificial Sequence: Synthetic oligonucleotide

SEQ ID NO: 2660 - protein, 11 aa, Artificial Sequence
  Description of Artificial Sequence: Synthetic peptide
RASQGIRKDLG

SEQ ID NO: 2661 - DNA, 33 bp, Artificial Sequence; identical to SEQ ID NO: 109
  Description of Artificial Sequence: Synthetic oligonucleotide

SEQ ID NO: 2662 - protein, 11 aa, Artificial Sequence
  Description of Artificial Sequence: Synthetic peptide
RASQGIRNDLG

SEQ ID NO: 2663 - DNA, 51 bp, Artificial Sequence; identical to SEQ ID NO: 2643
  Description of Artificial Sequence: Synthetic oligonucleotide

SEQ ID NO: 2664 - protein, 17 aa, Artificial Sequence
  Description of Artificial Sequence: Synthetic peptide
KSSQSVLFNSNNKNYLA

SEQ ID NO: 2665 - DNA, 51 bp, Artificial Sequence
  Description of Artificial Sequence: Synthetic oligonucleotide
aagtccagccagagtgttttatccagctccaacaattacaactatttagtt

SEQ ID NO: 2666 - protein, 17 aa, Artificial Sequence
  Description of Artificial Sequence: Synthetic peptide
KSSQSVLSSSNNYNYLV

SEQ ID NO: 2667 - DNA, 48 bp, Artificial Sequence; identical to SEQ ID NO: 2569
  Description of Artificial Sequence: Synthetic oligonucleotide

SEQ ID NO: 2668 - protein, 16 aa, Artificial Sequence
  Description of Artificial Sequence: Synthetic peptide
KSSQSLLHSDGRTYLY

SEQ ID NO: 2669 - DNA, 33 bp, Artificial Sequence; identical to SEQ ID NO: 2609
  Description of Artificial Sequence: Synthetic oligonucleotide

SEQ ID NO: 2670 - protein, 11 aa, Artificial Sequence
  Description of Artificial Sequence: Synthetic peptide
RASQSIGSSLH

SEQ ID NO: 2671 - DNA, 33 bp, Artificial Sequence; identical to SEQ ID NO: 2561
  Description of Artificial Sequence: Synthetic oligonucleotide

SEQ ID NO: 2672 - protein, 11 aa, Artificial Sequence
  Description of Artificial Sequence: Synthetic peptide
RTSQGIGNYLA

SEQ ID NO: 2673 - DNA, 33 bp, Artificial Sequence; identical to SEQ ID NO: 2609
  Description of Artificial Sequence: Synthetic oligonucleotide

SEQ ID NO: 2674 - protein, 11 aa, Artificial Sequence
  Description of Artificial Sequence: Synthetic peptide
RASQSIGSSLH

SEQ ID NO: 2675 - DNA, 33 bp, Artificial Sequence; identical to SEQ ID NO: 1727
  Description of Artificial Sequence: Synthetic oligonucleotide

SEQ ID NO: 2676 - protein, 11 aa, Artificial Sequence
  Description of Artificial Sequence: Synthetic peptide
RASQGIGKYLA

SEQ ID NO: 2677 - DNA, 36 bp, Artificial Sequence
  Description of Artificial Sequence: Synthetic oligonucleotide
agggccggtcaaagtattagaaccgacttcttagcc

SEQ ID NO: 2678 - protein, 12 aa, Artificial Sequence
  Description of Artificial Sequence: Synthetic peptide
RAGQSIRTDFLA

SEQ ID NO: 2679 - DNA, 33 bp, Artificial Sequence
  Description of Artificial Sequence: Synthetic oligonucleotide
aggcccagtcagagttttagcagaaacttagcc

SEQ ID NO: 2680 - protein, 11 aa, Artificial Sequence
  Description of Artificial Sequence: Synthetic peptide
RPSQSFSRNLA

SEQ ID NO: 2681 - DNA, 33 bp, Artificial Sequence
  Description of Artificial Sequence: Synthetic oligonucleotide
cgggccagtcagagtattggtagtagtttacac

SEQ ID NO: 2682 - protein, 11 aa, Artificial Sequence
  Description of Artificial Sequence: Synthetic peptide
RASQSIGSSLH

SEQ ID NO: 2683 - DNA, 33 bp, Artificial Sequence; identical to SEQ ID NO: 1727
  Description of Artificial Sequence: Synthetic oligonucleotide

SEQ ID NO: 2684 - protein, 11 aa, Artificial Sequence
  Description of Artificial Sequence: Synthetic peptide
RASQGIGKYLA

SEQ ID NO: 2685 - DNA, 33 bp, Artificial Sequence; identical to SEQ ID NO: 1727
  Description of Artificial Sequence: Synthetic oligonucleotide

SEQ ID NO: 2686 - protein, 11 aa, Artificial Sequence
  Description of Artificial Sequence: Synthetic peptide
RASQGIGKYLA

SEQ ID NO: 2687 - DNA, 51 bp, Artificial Sequence; identical to SEQ ID NO: 2643
  Description of Artificial Sequence: Synthetic oligonucleotide

SEQ ID NO: 2688 - protein, 17 aa, Artificial Sequence
  Description of Artificial Sequence: Synthetic peptide
KSSQSVLFNSNNKNYLA

SEQ ID NO: 2689 - DNA, 33 bp, Artificial Sequence; identical to SEQ ID NO: 2561
  Description of Artificial Sequence: Synthetic oligonucleotide

SEQ ID NO: 2690 - protein, 11 aa, Artificial Sequence
  Description of Artificial Sequence: Synthetic peptide
RTSQGIGNYLA

SEQ ID NO: 2691 - DNA, 33 bp, Artificial Sequence
  Description of Artificial Sequence: Synthetic oligonucleotide
cgggcgaatcagggcattaacaattatttagcc

SEQ ID NO: 2692 - protein, 11 aa, Artificial Sequence
  Description of Artificial Sequence: Synthetic peptide
RANQGINNYLA

SEQ ID NO: 2693 - DNA, 33 bp, Artificial Sequence; identical to SEQ ID NO: 105
  Description of Artificial Sequence: Synthetic oligonucleotide

SEQ ID NO: 2694 - protein, 11 aa, Artificial Sequence
  Description of Artificial Sequence: Synthetic peptide
RASQGISNYLA

SEQ ID NO: 2695 - DNA, 33 bp, Artificial Sequence
  Description of Artificial Sequence: Synthetic oligonucleotide
cgggcgagtcagggtataagtagttggatagcc

SEQ ID NO: 2696 - protein, 11 aa, Artificial Sequence
  Description of Artificial Sequence: Synthetic peptide
RASQGISSWIA

SEQ ID NO: 2697 - DNA, 36 bp, Artificial Sequence
  Description of Artificial Sequence: Synthetic oligonucleotide
agggccagtcagagtgttcgcagcagcttccttgcc

SEQ ID NO: 2698 - protein, 12 aa, Artificial Sequence
  Description of Artificial Sequence: Synthetic peptide
RASQSVRSSFLA

SEQ ID NO: 2699 - DNA, 33 bp, Artificial Sequence; identical to SEQ ID NO: 105
  Description of Artificial Sequence: Synthetic oligonucleotide

SEQ ID NO: 2700 - protein, 11 aa, Artificial Sequence
  Description of Artificial Sequence: Synthetic peptide
RASQGISNYLA

SEQ ID NO: 2701 - DNA, 36 bp, Artificial Sequence
  Description of Artificial Sequence: Synthetic oligonucleotide
agggccagtcagagtgttagcagcaacttcttagcc

SEQ ID NO: 2702 - protein, 12 aa, Artificial Sequence
  Description of Artificial Sequence: Synthetic peptide
RASQSVSSNFLA

SEQ ID NO: 2703 - DNA, 33 bp, Artificial Sequence
  Description of Artificial Sequence: Synthetic oligonucleotide
cgggcgagtcagggcattggcaattatttagcc

SEQ ID NO: 2704 - protein, 11 aa, Artificial Sequence
  Description of Artificial Sequence: Synthetic peptide
RASQGIGNYLA

SEQ ID NO: 2705 - DNA, 33 bp, Artificial Sequence; identical to SEQ ID NO: 283
  Description of Artificial Sequence: Synthetic oligonucleotide

SEQ ID NO: 2706 - protein, 11 aa, Artificial Sequence
  Description of Artificial Sequence: Synthetic peptide
RASQDISNYLA

SEQ ID NO: 2707 - DNA, 33 bp, Artificial Sequence
  Description of Artificial Sequence: Synthetic oligonucleotide
cgggccagtcagagcattggtaggagtttacac

SEQ ID NO: 2708 - protein, 11 aa, Artificial Sequence
  Description of Artificial Sequence: Synthetic peptide
RASQSIGRSLH

SEQ ID NO: 2709 - DNA, 33 bp, Artificial Sequence; identical to SEQ ID NO: 109
  Description of Artificial Sequence: Synthetic oligonucleotide

SEQ ID NO: 2710 - protein, 11 aa, Artificial Sequence
  Description of Artificial Sequence: Synthetic peptide
RASQGIRNDLG

SEQ ID NO: 2711 - DNA, 33 bp, Artificial Sequence; identical to SEQ ID NO: 2561
  Description of Artificial Sequence: Synthetic oligonucleotide

SEQ ID NO: 2712 - protein, 11 aa, Artificial Sequence
  Description of Artificial Sequence: Synthetic peptide
RTSQGIGNYLA

SEQ ID NO: 2713 - DNA, 33 bp, Artificial Sequence; identical to SEQ ID NO: 1229
  Description of Artificial Sequence: Synthetic oligonucleotide

SEQ ID NO: 2714 - protein, 11 aa, Artificial Sequence
  Description of Artificial Sequence: Synthetic peptide
RASQGIRKDLG

SEQ ID NO: 2715 - DNA, 33 bp, Artificial Sequence; identical to SEQ ID NO: 105
  Description of Artificial Sequence: Synthetic oligonucleotide

SEQ ID NO: 2716 - protein, 11 aa, Artificial Sequence
  Description of Artificial Sequence: Synthetic peptide
RASQGISNYLA

SEQ ID NO: 2717 - DNA, 36 bp, Artificial Sequence
  Description of Artificial Sequence: Synthetic oligonucleotide
agggccagtcagagtattagcagcagctacttagcc

SEQ ID NO: 2718 - protein, 12 aa, Artificial Sequence
  Description of Artificial Sequence: Synthetic peptide
RASQSISSSYLA

SEQ ID NO: 2719 - DNA, 33 bp, Artificial Sequence; identical to SEQ ID NO: 2561
  Description of Artificial Sequence: Synthetic oligonucleotide

SEQ ID NO: 2720 - protein, 11 aa, Artificial Sequence
  Description of Artificial Sequence: Synthetic peptide
RTSQGIGNYLA

SEQ ID NO: 2721 - DNA, 48 bp, Artificial Sequence; identical to SEQ ID NO: 2569
  Description of Artificial Sequence: Synthetic oligonucleotide

SEQ ID NO: 2722 - protein, 16 aa, Artificial Sequence
  Description of Artificial Sequence: Synthetic peptide
KSSQSLLHSDGRTYLY

SEQ ID NO: 2723 - DNA, 33 bp, Artificial Sequence; identical to SEQ ID NO: 1727
  Description of Artificial Sequence: Synthetic oligonucleotide

SEQ ID NO: 2724 - protein, 11 aa, Artificial Sequence
  Description of Artificial Sequence: Synthetic peptide
RASQGIGKYLA

SEQ ID NO: 2725 - DNA, 33 bp, Artificial Sequence; identical to SEQ ID NO: 529
  Description of Artificial Sequence: Synthetic oligonucleotide

SEQ ID NO: 2726 - protein, 11 aa, Artificial Sequence
  Description of Artificial Sequence: Synthetic peptide
RASQSISNYLN

SEQ ID NO: 2727 - DNA, 33 bp, Artificial Sequence; identical to SEQ ID NO: 1727
  Description of Artificial Sequence: Synthetic oligonucleotide

SEQ ID NO: 2728 - protein, 11 aa, Artificial Sequence
  Description of Artificial Sequence: Synthetic peptide
RASQGIGKYLA

SEQ ID NO: 2729 - DNA, 36 bp, Artificial Sequence
  Description of Artificial Sequence: Synthetic oligonucleotide
agggccagtcagagtgtcagaagcgacttcttagcc

SEQ ID NO: 2730 - protein, 12 aa, Artificial Sequence
  Description of Artificial Sequence: Synthetic peptide
RASQSVRSDFLA

SEQ ID NO: 2731 - DNA, 36 bp, Artificial Sequence; identical to SEQ ID NO: 2653
  Description of Artificial Sequence: Synthetic oligonucleotide

SEQ ID NO: 2732 - protein, 12 aa, Artificial Sequence
  Description of Artificial Sequence: Synthetic peptide
RASQSVRSNFLA

SEQ ID NO: 2733 - DNA, 36 bp, Artificial Sequence; identical to SEQ ID NO: 2653
  Description of Artificial Sequence: Synthetic oligonucleotide

SEQ ID NO: 2734 - protein, 12 aa, Artificial Sequence
  Description of Artificial Sequence: Synthetic peptide
RASQSVRSNFLA

SEQ ID NO: 2735 - DNA, 33 bp, Artificial Sequence; identical to SEQ ID NO: 2193
  Description of Artificial Sequence: Synthetic oligonucleotide

SEQ ID NO: 2736 - protein, 11 aa, Artificial Sequence
  Description of Artificial Sequence: Synthetic peptide
RASQGINNWLA

SEQ ID NO: 2737 - DNA, 36 bp, Artificial Sequence; identical to SEQ ID NO: 2589
  Description of Artificial Sequence: Synthetic oligonucleotide

SEQ ID NO: 2738 - protein, 12 aa, Artificial Sequence
  Description of Artificial Sequence: Synthetic peptide
RASQSIRSSFLA

SEQ ID NO: 2739 - DNA, 36 bp, Artificial Sequence
  Description of Artificial Sequence: Synthetic oligonucleotide
agggccggtcaaagtattagaaccgacttcttagtc

SEQ ID NO: 2740 - protein, 12 aa, Artificial Sequence
  Description of Artificial Sequence: Synthetic peptide
RAGQSIRTDFLV

SEQ ID NO: 2741 - DNA, 33 bp, Artificial Sequence
  Description of Artificial Sequence: Synthetic oligonucleotide
cggccgagtcagggcattagcatttatttagcc

SEQ ID NO: 2742 - protein, 11 aa, Artificial Sequence
  Description of Artificial Sequence: Synthetic peptide
RPSQGISIYLA

SEQ ID NO: 2743 - DNA, 51 bp, Artificial Sequence
  Description of Artificial Sequence: Synthetic oligonucleotide
aagtccagccagagtgttttatacagctccaacaattataactacttgact

SEQ ID NO: 2744 - protein, 17 aa, Artificial Sequence
  Description of Artificial Sequence: Synthetic peptide
KSSQSVLYSSNNYNYLT

SEQ ID NO: 2745 - DNA, 33 bp, Artificial Sequence; identical to SEQ ID NO: 821
  Description of Artificial Sequence: Synthetic oligonucleotide

SEQ ID NO: 2746 - protein, 11 aa, Artificial Sequence
  Description of Artificial Sequence: Synthetic peptide
RASQGIRNDLG

SEQ ID NO: 2747 - DNA, 33 bp, Artificial Sequence; identical to SEQ ID NO: 2609
  Description of Artificial Sequence: Synthetic oligonucleotide

SEQ ID NO: 2748 - protein, 11 aa, Artificial Sequence
  Description of Artificial Sequence: Synthetic peptide
RASQSIGSSLH

SEQ ID NO: 2749 - DNA, 36 bp, Artificial Sequence
  Description of Artificial Sequence: Synthetic oligonucleotide
agggccagtcagagtgttaggagcggttacttagcc

SEQ ID NO: 2750 - protein, 12 aa, Artificial Sequence
  Description of Artificial Sequence: Synthetic peptide
RASQSVRSGYLA

SEQ ID NO: 2751 - DNA, 36 bp, Artificial Sequence; identical to SEQ ID NO: 2593
  Description of Artificial Sequence: Synthetic oligonucleotide

SEQ ID NO: 2752 - protein, 12 aa, Artificial Sequence
  Description of Artificial Sequence: Synthetic peptide
RAGQSIRTNFLA

SEQ ID NO: 2753 - DNA, 33 bp, Artificial Sequence; identical to SEQ ID NO: 1727
  Description of Artificial Sequence: Synthetic oligonucleotide

SEQ ID NO: 2754 - protein, 11 aa, Artificial Sequence
  Description of Artificial Sequence: Synthetic peptide
RASQGIGKYLA

SEQ ID NO: 2755 - DNA, 33 bp, Artificial Sequence; identical to SEQ ID NO: 109
  Description of Artificial Sequence: Synthetic oligonucleotide

SEQ ID NO: 2756 - protein, 11 aa, Artificial Sequence
  Description of Artificial Sequence: Synthetic peptide
RASQGIRNDLG

SEQ ID NO: 2757 - DNA, 36 bp, Artificial Sequence; identical to SEQ ID NO: 2589
  Description of Artificial Sequence: Synthetic oligonucleotide

SEQ ID NO: 2758 - protein, 12 aa, Artificial Sequence
  Description of Artificial Sequence: Synthetic peptide
RASQSIRSSFLA

SEQ ID NO: 2759 - DNA, 36 bp, Artificial Sequence
  Description of Artificial Sequence: Synthetic oligonucleotide
agggccagtcagagtataaggaccaacttcttagcc

SEQ ID NO: 2760 - protein, 12 aa, Artificial Sequence
  Description of Artificial Sequence: Synthetic peptide
RASQSIRTNFLA

SEQ ID NO: 2761 - DNA, 33 bp, Artificial Sequence
  Description of Artificial Sequence: Synthetic oligonucleotide
cgggcgagtcagggcgttagcaatcatttagcc

SEQ ID NO: 2762 - protein, 11 aa, Artificial Sequence
  Description of Artificial Sequence: Synthetic peptide
RASQGVSNHLA

SEQ ID NO: 2763 - DNA, 36 bp, Artificial Sequence
  Description of Artificial Sequence: Synthetic oligonucleotide
agggccagtcagagtgttagaaccaacttcttagcc

SEQ ID NO: 2764 - protein, 12 aa, Artificial Sequence
  Description of Artificial Sequence: Synthetic peptide
RASQSVRTNFLA

SEQ ID NO: 2765 - DNA, 33 bp, Artificial Sequence; identical to SEQ ID NO: 2707
  Description of Artificial Sequence: Synthetic oligonucleotide

SEQ ID NO: 2766 - protein, 11 aa, Artificial Sequence
  Description of Artificial Sequence: Synthetic peptide
RASQSIGRSLH

SEQ ID NO: 2767 - DNA, 33 bp, Artificial Sequence; identical to SEQ ID NO: 105
  Description of Artificial Sequence: Synthetic oligonucleotide

SEQ ID NO: 2768 - protein, 11 aa, Artificial Sequence
  Description of Artificial Sequence: Synthetic peptide
RASQGISNYLA

SEQ ID NO: 2769 - DNA, 36 bp, Artificial Sequence
  Description of Artificial Sequence: Synthetic oligonucleotide
agggccagtccgagtgttagcagcagctacttagcc

SEQ ID NO: 2770 - protein, 12 aa, Artificial Sequence
  Description of Artificial Sequence: Synthetic peptide
RASPSVSSSYLA

SEQ ID NO: 2771 - DNA, 36 bp, Artificial Sequence; identical to SEQ ID NO: 2589
  Description of Artificial Sequence: Synthetic oligonucleotide

SEQ ID NO: 2772 - protein, 12 aa, Artificial Sequence
  Description of Artificial Sequence: Synthetic peptide
RASQSIRSSFLA

SEQ ID NO: 2773 - DNA, 33 bp, Artificial Sequence; identical to SEQ ID NO: 1505
  Description of Artificial Sequence: Synthetic oligonucleotide

SEQ ID NO: 2774 - protein, 11 aa, Artificial Sequence
  Description of Artificial Sequence: Synthetic peptide
RASQSVSSSLA

SEQ ID NO: 2775 - DNA, 33 bp, Artificial Sequence; identical to SEQ ID NO: 105
  Description of Artificial Sequence: Synthetic oligonucleotide

SEQ ID NO: 2776 - protein, 11 aa, Artificial Sequence
  Description of Artificial Sequence: Synthetic peptide
RASQGISNYLA

SEQ ID NO: 2777 - DNA, 33 bp, Artificial Sequence; identical to SEQ ID NO: 2559
  Description of Artificial Sequence: Synthetic oligonucleotide

SEQ ID NO: 2778 - protein, 11 aa, Artificial Sequence
  Description of Artificial Sequence: Synthetic peptide
RASQSIGSNLH

SEQ ID NO: 2779 - DNA, 36 bp, Artificial Sequence
  Description of Artificial Sequence: Synthetic oligonucleotide
agggccagtcggggtgttagcaacatctacttagcc

SEQ ID NO: 2780 - protein, 12 aa, Artificial Sequence
  Description of Artificial Sequence: Synthetic peptide
RASRGVSNIYLA

SEQ ID NO: 2781 - DNA, 48 bp, Artificial Sequence; identical to SEQ ID NO: 2569
  Description of Artificial Sequence: Synthetic oligonucleotide

SEQ ID NO: 2782 - protein, 16 aa, Artificial Sequence
  Description of Artificial Sequence: Synthetic peptide
KSSQSLLHSDGRTYLY

SEQ ID NO: 2783 - DNA, 36 bp, Artificial Sequence; identical to SEQ ID NO: 2593
  Description of Artificial Sequence: Synthetic oligonucleotide

SEQ ID NO: 2784 - protein, 12 aa, Artificial Sequence
  Description of Artificial Sequence: Synthetic peptide
RAGQSIRTNFLA

SEQ ID NO: 2785 - DNA, 36 bp, Artificial Sequence
  Description of Artificial Sequence: Synthetic oligonucleotide
agggccagtcagagtattagaagcaacttcttagcc

SEQ ID NO: 2786 - protein, 12 aa, Artificial Sequence
  Description of Artificial Sequence: Synthetic peptide
RASQSIRSNFLA

SEQ ID NO: 2787 - DNA, 33 bp, Artificial Sequence; identical to SEQ ID NO: 2147
  Description of Artificial Sequence: Synthetic oligonucleotide

SEQ ID NO: 2788 - protein, 11 aa, Artificial Sequence
  Description of Artificial Sequence: Synthetic peptide
RASQGISKYLA

SEQ ID NO: 2789 - DNA, 33 bp, Artificial Sequence; identical to SEQ ID NO: 173
  Description of Artificial Sequence: Synthetic oligonucleotide

SEQ ID NO: 2790 - protein, 11 aa, Artificial Sequence
  Description of Artificial Sequence: Synthetic peptide
RASQGISRWLA

SEQ ID NO: 2791 - DNA, 36 bp, Artificial Sequence
  Description of Artificial Sequence: Synthetic oligonucleotide
agggccagtccgagtgttaacagcggctacttagcc

SEQ ID NO: 2792 - protein, 12 aa, Artificial Sequence
  Description of Artificial Sequence: Synthetic peptide
RASPSVNSGYLA

SEQ ID NO: 2793 - DNA, 33 bp, Artificial Sequence; identical to SEQ ID NO: 109
  Description of Artificial Sequence: Synthetic oligonucleotide

SEQ ID NO: 2794 - protein, 11 aa, Artificial Sequence
  Description of Artificial Sequence: Synthetic peptide
RASQGIRNDLG

SEQ ID NO: 2795 - DNA, 33 bp, Artificial Sequence; identical to SEQ ID NO: 105
  Description of Artificial Sequence: Synthetic oligonucleotide

SEQ ID NO: 2796 - protein, 11 aa, Artificial Sequence
  Description of Artificial Sequence: Synthetic peptide
RASQGISNYLA

SEQ ID NO: 2797 - DNA, 33 bp, Artificial Sequence
  Description of Artificial Sequence: Synthetic oligonucleotide
cgggcgagtcagggcattggcaagtatttagca

SEQ ID NO: 2798 - protein, 11 aa, Artificial Sequence
  Description of Artificial Sequence: Synthetic peptide
RASQGIGKYLA

SEQ ID NO: 2799 - DNA, 36 bp, Artificial Sequence
  Description of Artificial Sequence: Synthetic oligonucleotide
agggccagtccgagtgttaacagtaactacttagcc

SEQ ID NO: 2800 - protein, 12 aa, Artificial Sequence
  Description of Artificial Sequence: Synthetic peptide
RASPSVNSNYLA

SEQ ID NO: 2801 - DNA, 33 bp, Artificial Sequence; identical to SEQ ID NO: 173
  Description of Artificial Sequence: Synthetic oligonucleotide

SEQ ID NO: 2802 - protein, 11 aa, Artificial Sequence
  Description of Artificial Sequence: Synthetic peptide
RASQGISRWLA

SEQ ID NO: 2803 - DNA, 33 bp, Artificial Sequence; identical to SEQ ID NO: 2609
  Description of Artificial Sequence: Synthetic oligonucleotide

SEQ ID NO: 2804 - protein, 11 aa, Artificial Sequence
  Description of Artificial Sequence: Synthetic peptide
RASQSIGSSLH

SEQ ID NO: 2805 - DNA, 33 bp, Artificial Sequence; identical to SEQ ID NO: 2579
  Description of Artificial Sequence: Synthetic oligonucleotide

SEQ ID NO: 2806 - protein, 11 aa, Artificial Sequence
  Description of Artificial Sequence: Synthetic peptide
RTSQGIGKYLA

SEQ ID NO: 2807 - DNA, 36 bp, Artificial Sequence; identical to SEQ ID NO: 2589
  Description of Artificial Sequence: Synthetic oligonucleotide

SEQ ID NO: 2808 - protein, 12 aa, Artificial Sequence
  Description of Artificial Sequence: Synthetic peptide
RASQSIRSSFLA

SEQ ID NO: 2809 - DNA, 33 bp, Artificial Sequence; identical to SEQ ID NO: 105
  Description of Artificial Sequence: Synthetic oligonucleotide

SEQ ID NO: 2810 - protein, 11 aa, Artificial Sequence
  Description of Artificial Sequence: Synthetic peptide
RASQGISNYLA

SEQ ID NO: 2811 - DNA, 33 bp, Artificial Sequence; identical to SEQ ID NO: 123
  Description of Artificial Sequence: Synthetic oligonucleotide

SEQ ID NO: 2812 - protein, 11 aa, Artificial Sequence
  Description of Artificial Sequence: Synthetic peptide
RASQGIRKDLG

SEQ ID NO: 2813 - DNA, 33 bp, Artificial Sequence; identical to SEQ ID NO: 2609
  Description of Artificial Sequence: Synthetic oligonucleotide

SEQ ID NO: 2814 - protein, 11 aa, Artificial Sequence
  Description of Artificial Sequence: Synthetic peptide
RASQSIGSSLH

SEQ ID NO: 2815 - DNA, 33 bp, Artificial Sequence; identical to SEQ ID NO: 2609
  Description of Artificial Sequence: Synthetic oligonucleotide

SEQ ID NO: 2816 - protein, 11 aa, Artificial Sequence
  Description of Artificial Sequence: Synthetic peptide
RASQSIGSSLH

SEQ ID NO: 2817 - DNA, 51 bp, Artificial Sequence; identical to SEQ ID NO: 2643
  Description of Artificial Sequence: Synthetic oligonucleotide

SEQ ID NO: 2818 - protein, 17 aa, Artificial Sequence
  Description of Artificial Sequence: Synthetic peptide
KSSQSVLFNSNNKNYLA

SEQ ID NO: 2819 - DNA, 33 bp, Artificial Sequence; identical to SEQ ID NO: 2193
  Description of Artificial Sequence: Synthetic oligonucleotide

SEQ ID NO: 2820 - protein, 11 aa, Artificial Sequence
  Description of Artificial Sequence: Synthetic peptide
RASQGINNWLA

SEQ ID NO: 2821 - DNA, 51 bp, Artificial Sequence
  Description of Artificial Sequence: Synthetic oligonucleotide
aagtccagccagagtattttattcagctccaacaataagaggtacttagct

SEQ ID NO: 2822 - protein, 17 aa, Artificial Sequence
  Description of Artificial Sequence: Synthetic peptide
KSSQSILFSSNNKRYLA

SEQ ID NO: 2823 - DNA, 51 bp, Artificial Sequence; identical to SEQ ID NO: 2643
  Description of Artificial Sequence: Synthetic oligonucleotide

SEQ ID NO: 2824 - protein, 17 aa, Artificial Sequence
  Description of Artificial Sequence: Synthetic peptide
KSSQSVLFNSNNKNYLA

SEQ ID NO: 2825 - DNA, 33 bp, Artificial Sequence; identical to SEQ ID NO: 171
  Description of Artificial Sequence: Synthetic oligonucleotide

SEQ ID NO: 2826 - protein, 11 aa, Artificial Sequence
  Description of Artificial Sequence: Synthetic peptide
RASQGISSWLA

SEQ ID NO: 2827 - DNA, 33 bp, Artificial Sequence
  Description of Artificial Sequence: Synthetic oligonucleotide
cgggcaagtcagcgcattcacagctatttaaat

SEQ ID NO: 2828 - protein, 11 aa, Artificial Sequence
  Description of Artificial Sequence: Synthetic peptide
RASQRIHSYLN

SEQ ID NO: 2829 - DNA, 33 bp, Artificial Sequence
  Description of Artificial Sequence: Synthetic oligonucleotide
cgggcgaatcaggccattagcaattatttagcc

SEQ ID NO: 2830 - protein, 11 aa, Artificial Sequence
  Description of Artificial Sequence: Synthetic peptide
RANQAISNYLA

SEQ ID NO: 2831 - DNA, 51 bp, Artificial Sequence; identical to SEQ ID NO: 1057
  Description of Artificial Sequence: Synthetic oligonucleotide

SEQ ID NO: 2832 - protein, 17 aa, Artificial Sequence
  Description of Artificial Sequence: Synthetic peptide
KSSQSVLHSSNNNNYLA

SEQ ID NO: 2833 - DNA, 33 bp, Artificial Sequence
  Description of Artificial Sequence: Synthetic oligonucleotide
cgggcgagtcagggtattagcaactgcttagcc

SEQ ID NO: 2834 - protein, 11 aa, Artificial Sequence
  Description of Artificial Sequence: Synthetic peptide
RASQGISNCLA

SEQ ID NO: 2835 - DNA, 33 bp, Artificial Sequence; identical to SEQ ID NO: 173
  Description of Artificial Sequence: Synthetic oligonucleotide

SEQ ID NO: 2836 - protein, 11 aa, Artificial Sequence
  Description of Artificial Sequence: Synthetic peptide
RASQGISRWLA

SEQ ID NO: 2837 - DNA, 33 bp, Artificial Sequence; identical to SEQ ID NO: 109
  Description of Artificial Sequence: Synthetic oligonucleotide

SEQ ID NO: 2838 - protein, 11 aa, Artificial Sequence
  Description of Artificial Sequence: Synthetic peptide
RASQGIRNDLG

SEQ ID NO: 2839 - DNA, 36 bp, Artificial Sequence
  Description of Artificial Sequence: Synthetic oligonucleotide
agggccagtccgagtgttagcaacagcttcttagcc

SEQ ID NO: 2840 - protein, 12 aa, Artificial Sequence
  Description of Artificial Sequence: Synthetic peptide
RASPSVSNSFLA

SEQ ID NO: 2841 - DNA, 33 bp, Artificial Sequence
  Description of Artificial Sequence: Synthetic oligonucleotide
cgggcaagtcagggcattagaaatgatctaggc

SEQ ID NO: 2842 - protein, 11 aa, Artificial Sequence
  Description of Artificial Sequence: Synthetic peptide
RASQGIRNDLG

SEQ ID NO: 2843 - DNA, 36 bp, Artificial Sequence; identical to SEQ ID NO: 2653
  Description of Artificial Sequence: Synthetic oligonucleotide

SEQ ID NO: 2844 - protein, 12 aa, Artificial Sequence
  Description of Artificial Sequence: Synthetic peptide
RASQSVRSNFLA

SEQ ID NO: 2845 - DNA, 33 bp, Artificial Sequence; identical to SEQ ID NO: 2561
  Description of Artificial Sequence: Synthetic oligonucleotide

SEQ ID NO: 2846 - protein, 11 aa, Artificial Sequence
  Description of Artificial Sequence: Synthetic peptide
RTSQGIGNYLA

SEQ ID NO: 2847 - DNA, 33 bp, Artificial Sequence
  Description of Artificial Sequence: Synthetic oligonucleotide
cgggcgagtcagggcattggcaatcatttagcc

SEQ ID NO: 2848 - protein, 11 aa, Artificial Sequence
  Description of Artificial Sequence: Synthetic peptide
RASQGIGNHLA

SEQ ID NO: 2849 - DNA, 36 bp, Artificial Sequence; identical to SEQ ID NO: 2589
  Description of Artificial Sequence: Synthetic oligonucleotide

SEQ ID NO: 2850 - protein, 12 aa, Artificial Sequence
  Description of Artificial Sequence: Synthetic peptide
RASQSIRSSFLA

SEQ ID NO: 2851 - DNA, 51 bp, Artificial Sequence
  Description of Artificial Sequence: Synthetic oligonucleotide
aggtccagccagagtgttttacacagcttcaacaattacaactacttagct

SEQ ID NO: 2852 - protein, 17 aa, Artificial Sequence
  Description of Artificial Sequence: Synthetic peptide
RSSQSVLHSFNNYNYLA

SEQ ID NO: 2853 - DNA, 33 bp, Artificial Sequence
  Description of Artificial Sequence: Synthetic oligonucleotide
cgggcgagtcagggcattggcaaatatttagcc

SEQ ID NO: 2854 - protein, 11 aa, Artificial Sequence
  Description of Artificial Sequence: Synthetic peptide
RASQGIGKYLA

SEQ ID NO: 2855 - DNA, 51 bp, Artificial Sequence; identical to SEQ ID NO: 2583
  Description of Artificial Sequence: Synthetic oligonucleotide

SEQ ID NO: 2856 - protein, 17 aa, Artificial Sequence
  Description of Artificial Sequence: Synthetic peptide
RSSQSVLHSSNNYNYLA

SEQ ID NO: 2857 - DNA, 51 bp, Artificial Sequence
  Description of Artificial Sequence: Synthetic oligonucleotide
aagtccagccagagtgttttacacagttccaacaataagaactacttagct

SEQ ID NO: 2858 - protein, 17 aa, Artificial Sequence
  Description of Artificial Sequence: Synthetic peptide
KSSQSVLHSSNNKNYLA

SEQ ID NO: 2859 - DNA, 48 bp, Artificial Sequence
  Description of Artificial Sequence: Synthetic oligonucleotide
aagtctagtcagaacctcctgcatagtgatggaaagacctatttgtat

SEQ ID NO: 2860 - protein, 16 aa, Artificial Sequence
  Description of Artificial Sequence: Synthetic peptide
KSSQNLLHSDGKTYLY

SEQ ID NO: 2861 - DNA, 33 bp, Artificial Sequence; identical to SEQ ID NO: 553
  Description of Artificial Sequence: Synthetic oligonucleotide

SEQ ID NO: 2862 - protein, 11 aa, Artificial Sequence
  Description of Artificial Sequence: Synthetic peptide
RASQGISNWLA

SEQ ID NO: 2863 - DNA, 33 bp, Artificial Sequence; identical to SEQ ID NO: 109
  Description of Artificial Sequence: Synthetic oligonucleotide

SEQ ID NO: 2864 - protein, 11 aa, Artificial Sequence
  Description of Artificial Sequence: Synthetic peptide
RASQGIRNDLG

SEQ ID NO: 2865 - DNA, 33 bp, Artificial Sequence
  Description of Artificial Sequence: Synthetic oligonucleotide
cgggcgagtcagggcattaacaagtatttatcc

SEQ ID NO: 2866 - protein, 11 aa, Artificial Sequence
  Description of Artificial Sequence: Synthetic peptide
RASQGINKYLS

SEQ ID NO: 2867 - DNA, 33 bp, Artificial Sequence; identical to SEQ ID NO: 2561
  Description of Artificial Sequence: Synthetic oligonucleotide

SEQ ID NO: 2868 - protein, 11 aa, Artificial Sequence
  Description of Artificial Sequence: Synthetic peptide
RTSQGIGNYLA

SEQ ID NO: 2869 - DNA, 36 bp, Artificial Sequence; identical to SEQ ID NO: 2593
  Description of Artificial Sequence: Synthetic oligonucleotide

SEQ ID NO: 2870 - protein, 12 aa, Artificial Sequence
  Description of Artificial Sequence: Synthetic peptide
RAGQSIRTNFLA

SEQ ID NO: 2871 - DNA, 36 bp, Artificial Sequence
  Description of Artificial Sequence: Synthetic oligonucleotide
agggccagtcagagtataaggagcaacttcttagcc

SEQ ID NO: 2872 - protein, 12 aa, Artificial Sequence
  Description of Artificial Sequence: Synthetic peptide
RASQSIRSNFLA

SEQ ID NO: 2873 - DNA, 36 bp, Artificial Sequence
  Description of Artificial Sequence: Synthetic oligonucleotide
agggccagtcagagtgttagaagcagctacttagcc

SEQ ID NO: 2874 - protein, 12 aa, Artificial Sequence
  Description of Artificial Sequence: Synthetic peptide
RASQSVRSSYLA

SEQ ID NO: 2875 - DNA, 33 bp, Artificial Sequence; identical to SEQ ID NO: 2703
  Description of Artificial Sequence: Synthetic oligonucleotide

SEQ ID NO: 2876 - protein, 11 aa, Artificial Sequence
  Description of Artificial Sequence: Synthetic peptide
RASQGIGNYLA

SEQ ID NO: 2877 - DNA, 33 bp, Artificial Sequence; identical to SEQ ID NO: 123
  Description of Artificial Sequence: Synthetic oligonucleotide

SEQ ID NO: 2878 - protein, 11 aa, Artificial Sequence
  Description of Artificial Sequence: Synthetic peptide
RASQGIRKDLG

SEQ ID NO: 2879 - DNA, 48 bp, Artificial Sequence
  Description of Artificial Sequence: Synthetic oligonucleotide
aagtctagtcagagcctcctctatagtgatggaaggacctatttgtat

SEQ ID NO: 2880 - protein, 16 aa, Artificial Sequence
  Description of Artificial Sequence: Synthetic peptide
KSSQSLLYSDGRTYLY

SEQ ID NO: 2881 - DNA, 36 bp, Artificial Sequence; identical to SEQ ID NO: 2589
  Description of Artificial Sequence: Synthetic oligonucleotide

SEQ ID NO: 2882 - protein, 12 aa, Artificial Sequence
  Description of Artificial Sequence: Synthetic peptide
RASQSIRSSFLA

SEQ ID NO: 2883 - DNA, 36 bp, Artificial Sequence; identical to SEQ ID NO: 2589
  Description of Artificial Sequence: Synthetic oligonucleotide

SEQ ID NO: 2884 - protein, 12 aa, Artificial Sequence
  Description of Artificial Sequence: Synthetic peptide
RASQSIRSSFLA

SEQ ID NO: 2885 - DNA, 33 bp, Artificial Sequence; identical to SEQ ID NO: 109
  Description of Artificial Sequence: Synthetic oligonucleotide

SEQ ID NO: 2886 - protein, 11 aa, Artificial Sequence
  Description of Artificial Sequence: Synthetic peptide
RASQGIRNDLG

SEQ ID NO: 2887 - DNA, 33 bp, Artificial Sequence; identical to SEQ ID NO: 1751
  Description of Artificial Sequence: Synthetic oligonucleotide

SEQ ID NO: 2888 - protein, 11 aa, Artificial Sequence
  Description of Artificial Sequence: Synthetic peptide
RASQGISKYLA

SEQ ID NO: 2889 - DNA, 33 bp, Artificial Sequence; identical to SEQ ID NO: 2679
  Description of Artificial Sequence: Synthetic oligonucleotide

SEQ ID NO: 2890 - protein, 11 aa, Artificial Sequence
  Description of Artificial Sequence: Synthetic peptide
RPSQSFSRNLA

SEQ ID NO: 2891 - DNA, 33 bp, Artificial Sequence; identical to SEQ ID NO: 123
  Description of Artificial Sequence: Synthetic oligonucleotide

SEQ ID NO: 2892 - protein, 11 aa, Artificial Sequence
  Description of Artificial Sequence: Synthetic peptide
RASQGIRKDLG

SEQ ID NO: 2893 - DNA, 36 bp, Artificial Sequence; identical to SEQ ID NO: 2759
  Description of Artificial Sequence: Synthetic oligonucleotide

SEQ ID NO: 2894 - protein, 12 aa, Artificial Sequence
  Description of Artificial Sequence: Synthetic peptide
RASQSIRTNFLA

SEQ ID NO: 2895 - DNA, 36 bp, Artificial Sequence; identical to SEQ ID NO: 2873
  Description of Artificial Sequence: Synthetic oligonucleotide

SEQ ID NO: 2896 - protein, 12 aa, Artificial Sequence
  Description of Artificial Sequence: Synthetic peptide
RASQSVRSSYLA

SEQ ID NO: 2897 - DNA, 33 bp, Artificial Sequence; identical to SEQ ID NO: 501
  Description of Artificial Sequence: Synthetic oligonucleotide

SEQ ID NO: 2898 - protein, 11 aa, Artificial Sequence
  Description of Artificial Sequence: Synthetic peptide
RASQSISSYLN

SEQ ID NO: 2899 - DNA, 33 bp, Artificial Sequence; identical to SEQ ID NO: 205
  Description of Artificial Sequence: Synthetic oligonucleotide

SEQ ID NO: 2900 - protein, 11 aa, Artificial Sequence
  Description of Artificial Sequence: Synthetic peptide
RASQDIRNDLG

SEQ ID NO: 2901 - DNA, 33 bp, Artificial Sequence
  Description of Artificial Sequence: Synthetic oligonucleotide
cgggccagtcagaacattggtaataccttgcac

SEQ ID NO: 2902 - protein, 11 aa, Artificial Sequence
  Description of Artificial Sequence: Synthetic peptide
RASQNIGNTLH

SEQ ID NO: 2903 - DNA, 51 bp, Artificial Sequence; identical to SEQ ID NO: 1057
  Description of Artificial Sequence: Synthetic oligonucleotide

SEQ ID NO: 2904 - protein, 17 aa, Artificial Sequence
  Description of Artificial Sequence: Synthetic peptide
KSSQSVLHSSNNNNYLA

SEQ ID NO: 2905 - DNA, 33 bp, Artificial Sequence; identical to SEQ ID NO: 2559
  Description of Artificial Sequence: Synthetic oligonucleotide

SEQ ID NO: 2906 - protein, 11 aa, Artificial Sequence
  Description of Artificial Sequence: Synthetic peptide
RASQSIGSNLH

SEQ ID NO: 2907 - DNA, 33 bp, Artificial Sequence
  Description of Artificial Sequence: Synthetic oligonucleotide
cgggcaactcagggcattagaaaagatttaggc

SEQ ID NO: 2908 - protein, 11 aa, Artificial Sequence
  Description of Artificial Sequence: Synthetic peptide
RATQGIRKDLG

SEQ ID NO: 2909 - DNA, 36 bp, Artificial Sequence
  Description of Artificial Sequence: Synthetic oligonucleotide
agggccagtcagaatattcgcagcagcttcttagcc

SEQ ID NO: 2910 - protein, 12 aa, Artificial Sequence
  Description of Artificial Sequence: Synthetic peptide
RASQNIRSSFLA

SEQ ID NO: 2911 - DNA, 33 bp, Artificial Sequence; identical to SEQ ID NO: 109
  Description of Artificial Sequence: Synthetic oligonucleotide

SEQ ID NO: 2912 - protein, 11 aa, Artificial Sequence
  Description of Artificial Sequence: Synthetic peptide
RASQGIRNDLG

SEQ ID NO: 2913 - DNA, 33 bp, Artificial Sequence
  Description of Artificial Sequence: Synthetic oligonucleotide
cgggcaagtcagggcattaggaatgatttaggc

SEQ ID NO: 2914 - protein, 11 aa, Artificial Sequence
  Description of Artificial Sequence: Synthetic peptide
RASQGIRNDLG

SEQ ID NO: 2915 - DNA, 36 bp, Artificial Sequence
  Description of Artificial Sequence: Synthetic oligonucleotide
agggccagtccgagtattaacagcggcttcttagcc

SEQ ID NO: 2916 - protein, 12 aa, Artificial Sequence
  Description of Artificial Sequence: Synthetic peptide
RASPSINSGFLA

SEQ ID NO: 2917 - DNA, 39 bp, Artificial Sequence
  Description of Artificial Sequence: Synthetic oligonucleotide
tctggaagcaactccaacatcggaagtaatattgtaacc

SEQ ID NO: 2918 - protein, 13 aa, Artificial Sequence
  Description of Artificial Sequence: Synthetic peptide
SGSNSNIGSNIVT

SEQ ID NO: 2919 - DNA, 33 bp, Artificial Sequence
  Description of Artificial Sequence: Synthetic oligonucleotide
agggccagtcagaatattaaaaacaacttagcc

SEQ ID NO: 2920 - protein, 11 aa, Artificial Sequence
  Description of Artificial Sequence: Synthetic peptide
RASQNIKNNLA

SEQ ID NO: 2921 - DNA, 36 bp, Artificial Sequence
  Description of Artificial Sequence: Synthetic oligonucleotide
agggccagtcagagtgttagcagcaactacttagcc

SEQ ID NO: 2922 - protein, 12 aa, Artificial Sequence
  Description of Artificial Sequence: Synthetic peptide
RASQSVSSNYLA

SEQ ID NO: 2923 - DNA, 33 bp, Artificial Sequence
  Description of Artificial Sequence: Synthetic oligonucleotide
cgggccagtcagaacattggtcgtagtttacac

SEQ ID NO: 2924 - protein, 11 aa, Artificial Sequence
  Description of Artificial Sequence: Synthetic peptide
RASQNIGRSLH

SEQ ID NO: 2925 - DNA, 33 bp, Artificial Sequence; identical to SEQ ID NO: 109
  Description of Artificial Sequence: Synthetic oligonucleotide

SEQ ID NO: 2926 - protein, 11 aa, Artificial Sequence
  Description of Artificial Sequence: Synthetic peptide
RASQGIRNDLG

SEQ ID NO: 2927 - DNA, 33 bp, Artificial Sequence
  Description of Artificial Sequence: Synthetic oligonucleotide
cgggcaagtcacaacattaacagctatttaaat

SEQ ID NO: 2928 - protein, 11 aa, Artificial Sequence
  Description of Artificial Sequence: Synthetic peptide
RASHNINSYLN

SEQ ID NO: 2929 - DNA, 48 bp, Artificial Sequence
  Description of Artificial Sequence: Synthetic oligonucleotide
aggtctagtcagagcctcctccataataatagatacaaccatttggat

SEQ ID NO: 2930 - protein, 16 aa, Artificial Sequence
  Description of Artificial Sequence: Synthetic peptide
RSSQSLLHNNRYNHLD

SEQ ID NO: 2931 - DNA, 33 bp, Artificial Sequence; identical to SEQ ID NO: 109
  Description of Artificial Sequence: Synthetic oligonucleotide

SEQ ID NO: 2932 - protein, 11 aa, Artificial Sequence
  Description of Artificial Sequence: Synthetic peptide
RASQGIRNDLG

SEQ ID NO: 2933 - DNA, 33 bp, Artificial Sequence
  Description of Artificial Sequence: Synthetic oligonucleotide
aggtccagtcagaatattaaaagcaacttagcc

SEQ ID NO: 2934 - protein, 11 aa, Artificial Sequence
  Description of Artificial Sequence: Synthetic peptide
RSSQNIKSNLA

SEQ ID NO: 2935 - DNA, 33 bp, Artificial Sequence
  Description of Artificial Sequence: Synthetic oligonucleotide
agggccagtcagagaattaacaacaacttagcc

SEQ ID NO: 2936 - protein, 11 aa, Artificial Sequence
  Description of Artificial Sequence: Synthetic peptide
RASQRINNNLA

SEQ ID NO: 2937 - DNA, 48 bp, Artificial Sequence
  Description of Artificial Sequence: Synthetic oligonucleotide
aggtctagtcagagcctcctgcataataataaatacaaccatttggat

SEQ ID NO: 2938 - protein, 16 aa, Artificial Sequence
  Description of Artificial Sequence: Synthetic peptide
RSSQSLLHNNKYNHLD

SEQ ID NO: 2939 - DNA, 36 bp, Artificial Sequence
  Description of Artificial Sequence: Synthetic oligonucleotide
agggccagtcagagtgttaacagcggctacttagcc

SEQ ID NO: 2940 - protein, 12 aa, Artificial Sequence
  Description of Artificial Sequence: Synthetic peptide
RASQSVNSGYLA

SEQ ID NO: 2941 - DNA, 33 bp, Artificial Sequence
  Description of Artificial Sequence: Synthetic oligonucleotide
agggccagtcagagtgttctgaacaacttagcc

SEQ ID NO: 2942 - protein, 11 aa, Artificial Sequence
  Description of Artificial Sequence: Synthetic peptide
RASQSVLNNLA

SEQ ID NO: 2943 - DNA, 33 bp, Artificial Sequence; identical to SEQ ID NO: 2703
  Description of Artificial Sequence: Synthetic oligonucleotide

SEQ ID NO: 2944 - protein, 11 aa, Artificial Sequence
  Description of Artificial Sequence: Synthetic peptide
RASQGIGNYLA

SEQ ID NO: 2945 - DNA, 33 bp, Artificial Sequence; identical to SEQ ID NO: 2927
  Description of Artificial Sequence: Synthetic oligonucleotide

SEQ ID NO: 2946 - protein, 11 aa, Artificial Sequence
  Description of Artificial Sequence: Synthetic peptide
RASHNINSYLN

SEQ ID NO: 2947 - DNA, 33 bp, Artificial Sequence; identical to SEQ ID NO: 113
  Description of Artificial Sequence: Synthetic oligonucleotide

SEQ ID NO: 2948 - protein, 11 aa, Artificial Sequence
  Description of Artificial Sequence: Synthetic peptide
RASQGIRHDLG

SEQ ID NO: 2949 - DNA, 33 bp, Artificial Sequence; identical to SEQ ID NO: 109
  Description of Artificial Sequence: Synthetic oligonucleotide

SEQ ID NO: 2950 - protein, 11 aa, Artificial Sequence
  Description of Artificial Sequence: Synthetic peptide
RASQGIRNDLG

SEQ ID NO: 2951 - DNA, 51 bp, Artificial Sequence
  Description of Artificial Sequence: Synthetic oligonucleotide
aagtccagccagagtgtttttttccactcgaacaataagaactacttagct

SEQ ID NO: 2952 - protein, 17 aa, Artificial Sequence
  Description of Artificial Sequence: Synthetic peptide
KSSQSVFFHSNNKNYLA

SEQ ID NO: 2953 - DNA, 51 bp, Artificial Sequence
  Description of Artificial Sequence: Synthetic oligonucleotide
aagtccagccagagtgttttatacagttccaacaataagaactacttagtt

SEQ ID NO: 2954 - protein, 17 aa, Artificial Sequence
  Description of Artificial Sequence: Synthetic peptide
KSSQSVLYSSNNKNYLV

SEQ ID NO: 2955 - DNA, 33 bp, Artificial Sequence; identical to SEQ ID NO: 109
  Description of Artificial Sequence: Synthetic oligonucleotide

SEQ ID NO: 2956 - protein, 11 aa, Artificial Sequence
  Description of Artificial Sequence: Synthetic peptide
RASQGIRNDLG

SEQ ID NO: 2957 - DNA, 33 bp, Artificial Sequence; identical to SEQ ID NO: 2927
  Description of Artificial Sequence: Synthetic oligonucleotide

SEQ ID NO: 2958 - protein, 11 aa, Artificial Sequence
  Description of Artificial Sequence: Synthetic peptide
RASHNINSYLN

SEQ ID NO: 2959 - DNA, 33 bp, Artificial Sequence
  Description of Artificial Sequence: Synthetic oligonucleotide
agggccagtcagaatattaaaagcaacttagcc

SEQ ID NO: 2960 - protein, 11 aa, Artificial Sequence
  Description of Artificial Sequence: Synthetic peptide
RASQNIKSNLA

SEQ ID NO: 2961 - DNA, 33 bp, Artificial Sequence
  Description of Artificial Sequence: Synthetic oligonucleotide
cgggcaagtcggagcgttcacacctatttaaat

SEQ ID NO: 2962 - protein, 11 aa, Artificial Sequence
  Description of Artificial Sequence: Synthetic peptide
RASRSVHTYLN

SEQ ID NO: 2963 - DNA, 33 bp, Artificial Sequence; identical to SEQ ID NO: 2561
  Description of Artificial Sequence: Synthetic oligonucleotide

SEQ ID NO: 2964 - protein, 11 aa, Artificial Sequence
  Description of Artificial Sequence: Synthetic peptide
RTSQGIGNYLA

SEQ ID NO: 2965 - DNA, 33 bp, Artificial Sequence
  Description of Artificial Sequence: Synthetic oligonucleotide
cgggcgagtcagggcataagtaatcatttagcc

SEQ ID NO: 2966 - protein, 11 aa, Artificial Sequence
  Description of Artificial Sequence: Synthetic peptide
RASQGISNHLA

SEQ ID NO: 2967 - DNA, 33 bp, Artificial Sequence; identical to SEQ ID NO: 109
  Description of Artificial Sequence: Synthetic oligonucleotide

SEQ ID NO: 2968 - protein, 11 aa, Artificial Sequence
  Description of Artificial Sequence: Synthetic peptide
RASQGIRNDLG

SEQ ID NO: 2969 - DNA, 36 bp, Artificial Sequence
  Description of Artificial Sequence: Synthetic oligonucleotide
agggccagtcagaatgttagttacagctacttagcc

SEQ ID NO: 2970 - protein, 12 aa, Artificial Sequence
  Description of Artificial Sequence: Synthetic peptide
RASQNVSYSYLA

SEQ ID NO: 2971 - DNA, 33 bp, Artificial Sequence
  Description of Artificial Sequence: Synthetic oligonucleotide
cgggcgagtcaggccattagtaatcatttagcc

SEQ ID NO: 2972 - protein, 11 aa, Artificial Sequence
  Description of Artificial Sequence: Synthetic peptide
RASQAISNHLA

SEQ ID NO: 2973 - DNA, 33 bp, Artificial Sequence; identical to SEQ ID NO: 2959
  Description of Artificial Sequence: Synthetic oligonucleotide

SEQ ID NO: 2974 - protein, 11 aa, Artificial Sequence
  Description of Artificial Sequence: Synthetic peptide
RASQNIKSNLA

SEQ ID NO: 2975 - DNA, 33 bp, Artificial Sequence; identical to SEQ ID NO: 2703
  Description of Artificial Sequence: Synthetic oligonucleotide

SEQ ID NO: 2976 - protein, 11 aa, Artificial Sequence
  Description of Artificial Sequence: Synthetic peptide
RASQGIGNYLA

SEQ ID NO: 2977 - DNA, 36 bp, Artificial Sequence
  Description of Artificial Sequence: Synthetic oligonucleotide
agggccagtcagagtgttttcagcaactacttagcc

SEQ ID NO: 2978 - protein, 12 aa, Artificial Sequence
  Description of Artificial Sequence: Synthetic peptide
RASQSVFSNYLA

SEQ ID NO: 2979 - DNA, 48 bp, Artificial Sequence
  Description of Artificial Sequence: Synthetic oligonucleotide
aggtctagtcagagcctcctgcataataatagatacaaccatttggat

SEQ ID NO: 2980 - protein, 16 aa, Artificial Sequence
  Description of Artificial Sequence: Synthetic peptide
RSSQSLLHNNRYNHLD

SEQ ID NO: 2981 - DNA, 33 bp, Artificial Sequence
  Description of Artificial Sequence: Synthetic oligonucleotide
agggccagtcagagtgttaatagctacttagcc

SEQ ID NO: 2982 - protein, 11 aa, Artificial Sequence
  Description of Artificial Sequence: Synthetic peptide
RASQSVNSYLA

SEQ ID NO: 2983 - DNA, 33 bp, Artificial Sequence; identical to SEQ ID NO: 109
  Description of Artificial Sequence: Synthetic oligonucleotide

SEQ ID NO: 2984 - protein, 11 aa, Artificial Sequence
  Description of Artificial Sequence: Synthetic peptide
RASQGIRNDLG

SEQ ID NO: 2985 - DNA, 36 bp, Artificial Sequence; identical to SEQ ID NO: 1845
  Description of Artificial Sequence: Synthetic oligonucleotide

SEQ ID NO: 2986 - protein, 12 aa, Artificial Sequence
  Description of Artificial Sequence: Synthetic peptide
RASQSINSNYLA

SEQ ID NO: 2987 - DNA, 33 bp, Artificial Sequence; identical to SEQ ID NO: 2927
  Description of Artificial Sequence: Synthetic oligonucleotide

SEQ ID NO: 2988 - protein, 11 aa, Artificial Sequence
  Description of Artificial Sequence: Synthetic peptide
RASHNINSYLN

SEQ ID NO: 2989 - DNA, 33 bp, Artificial Sequence
  Description of Artificial Sequence: Synthetic oligonucleotide
cgggccagtcagagcattggtcgtagcttacac

SEQ ID NO: 2990 - protein, 11 aa, Artificial Sequence
  Description of Artificial Sequence: Synthetic peptide
RASQSIGRSLH

SEQ ID NO: 2991 - DNA, 33 bp, Artificial Sequence; identical to SEQ ID NO: 2927
  Description of Artificial Sequence: Synthetic oligonucleotide

SEQ ID NO: 2992 - protein, 11 aa, Artificial Sequence
  Description of Artificial Sequence: Synthetic peptide
RASHNINSYLN

SEQ ID NO: 2993 - DNA, 33 bp, Artificial Sequence; identical to SEQ ID NO: 401
  Description of Artificial Sequence: Synthetic oligonucleotide

SEQ ID NO: 2994 - protein, 11 aa, Artificial Sequence
  Description of Artificial Sequence: Synthetic peptide
RASQGIRNYLA

SEQ ID NO: 2995 - DNA, 33 bp, Artificial Sequence; identical to SEQ ID NO: 109
  Description of Artificial Sequence: Synthetic oligonucleotide

SEQ ID NO: 2996 - protein, 11 aa, Artificial Sequence
  Description of Artificial Sequence: Synthetic peptide
RASQGIRNDLG

SEQ ID NO: 2997 - DNA, 33 bp, Artificial Sequence; identical to SEQ ID NO: 113
  Description of Artificial Sequence: Synthetic oligonucleotide

SEQ ID NO: 2998 - protein, 11 aa, Artificial Sequence
  Description of Artificial Sequence: Synthetic peptide
RASQGIRHDLG

SEQ ID NO: 2999 - DNA, 48 bp, Artificial Sequence; identical to SEQ ID NO: 2937
  Description of Artificial Sequence: Synthetic oligonucleotide

SEQ ID NO: 3000 - protein, 16 aa, Artificial Sequence
  Description of Artificial Sequence: Synthetic peptide
RSSQSLLHNNKYNHLD

SEQ ID NO: 3001 - DNA, 36 bp, Artificial Sequence; identical to SEQ ID NO: 2921
  Description of Artificial Sequence: Synthetic oligonucleotide

SEQ ID NO: 3002 - protein, 12 aa, Artificial Sequence
  Description of Artificial Sequence: Synthetic peptide
RASQSVSSNYLA

SEQ ID NO: 3003 - DNA, 33 bp, Artificial Sequence; identical to SEQ ID NO: 2927
  Description of Artificial Sequence: Synthetic oligonucleotide

SEQ ID NO: 3004 - protein, 11 aa, Artificial Sequence
  Description of Artificial Sequence: Synthetic peptide
RASHNINSYLN

SEQ ID NO: 3005 - DNA, 36 bp, Artificial Sequence
  Description of Artificial Sequence: Synthetic oligonucleotide
agggccagtcagagtgttagcaacaactacttagcc

SEQ ID NO: 3006 - protein, 12 aa, Artificial Sequence
  Description of Artificial Sequence: Synthetic peptide
RASQSVSNNYLA

SEQ ID NO: 3007 - DNA, 33 bp, Artificial Sequence; identical to SEQ ID NO: 2927
  Description of Artificial Sequence: Synthetic oligonucleotide

SEQ ID NO: 3008 - protein, 11 aa, Artificial Sequence
  Description of Artificial Sequence: Synthetic peptide
RASHNINSYLN

SEQ ID NO: 3009 - DNA, 33 bp, Artificial Sequence; identical to SEQ ID NO: 109
  Description of Artificial Sequence: Synthetic oligonucleotide

SEQ ID NO: 3010 - protein, 11 aa, Artificial Sequence
  Description of Artificial Sequence: Synthetic peptide
RASQGIRNDLG

SEQ ID NO: 3011 - DNA, 33 bp, Artificial Sequence; identical to SEQ ID NO: 113
  Description of Artificial Sequence: Synthetic oligonucleotide

SEQ ID NO: 3012 - protein, 11 aa, Artificial Sequence
  Description of Artificial Sequence: Synthetic peptide
RASQGIRHDLG

SEQ ID NO: 3013 - DNA, 33 bp, Artificial Sequence; identical to SEQ ID NO: 93
  Description of Artificial Sequence: Synthetic oligonucleotide

SEQ ID NO: 3014 - protein, 11 aa, Artificial Sequence
  Description of Artificial Sequence: Synthetic peptide
RTSQGIRNDLG

SEQ ID NO: 3015 - DNA, 33 bp, Artificial Sequence
  Description of Artificial Sequence: Synthetic oligonucleotide
agggccagtcagagtgttaaaagcaacttagcc

SEQ ID NO: 3016 - protein, 11 aa, Artificial Sequence
  Description of Artificial Sequence: Synthetic peptide
RASQSVKSNLA

SEQ ID NO: 3017 - DNA, 33 bp, Artificial Sequence; identical to SEQ ID NO: 2927
  Description of Artificial Sequence: Synthetic oligonucleotide

SEQ ID NO: 3018 - protein, 11 aa, Artificial Sequence
  Description of Artificial Sequence: Synthetic peptide
RASHNINSYLN

SEQ ID NO: 3019 - DNA, 33 bp, Artificial Sequence
  Description of Artificial Sequence: Synthetic oligonucleotide
cgggcgagtcagggtattagcatctggttagcc

SEQ ID NO: 3020 - protein, 11 aa, Artificial Sequence
  Description of Artificial Sequence: Synthetic peptide
RASQGISIWLA

SEQ ID NO: 3021 - DNA, 48 bp, Artificial Sequence
  Description of Artificial Sequence: Synthetic oligonucleotide
aggtctagtcagagcctcctgcattataatggacacaactttttggat

SEQ ID NO: 3022 - protein, 16 aa, Artificial Sequence
  Description of Artificial Sequence: Synthetic peptide
RSSQSLLHYNGHNFLD

SEQ ID NO: 3023 - DNA, 33 bp, Artificial Sequence; identical to SEQ ID NO: 2703
  Description of Artificial Sequence: Synthetic oligonucleotide

SEQ ID NO: 3024 - protein, 11 aa, Artificial Sequence
  Description of Artificial Sequence: Synthetic peptide
RASQGIGNYLA

SEQ ID NO: 3025 - DNA, 33 bp, Artificial Sequence
  Description of Artificial Sequence: Synthetic oligonucleotide
cgggcgagtcaggccattgggaaacatttagcc

SEQ ID NO: 3026 - protein, 11 aa, Artificial Sequence
  Description of Artificial Sequence: Synthetic peptide
RASQAIGKHLA

SEQ ID NO: 3027 - DNA, 36 bp, Artificial Sequence
  Description of Artificial Sequence: Synthetic oligonucleotide
agggccagtcagagtgttagcagcagcttcttagcc

SEQ ID NO: 3028 - protein, 12 aa, Artificial Sequence
  Description of Artificial Sequence: Synthetic peptide
RASQSVSSSFLA

SEQ ID NO: 3029 - DNA, 33 bp, Artificial Sequence; identical to SEQ ID NO: 1727
  Description of Artificial Sequence: Synthetic oligonucleotide

SEQ ID NO: 3030 - protein, 11 aa, Artificial Sequence
  Description of Artificial Sequence: Synthetic peptide
RASQGIGKYLA

SEQ ID NO: 3031 - DNA, 33 bp, Artificial Sequence
  Description of Artificial Sequence: Synthetic oligonucleotide
cgggcgagtcagggcattagcagatatttagcc

SEQ ID NO: 3032 - protein, 11 aa, Artificial Sequence
  Description of Artificial Sequence: Synthetic peptide
RASQGISRYLA

SEQ ID NO: 3033 - DNA, 48 bp, Artificial Sequence; identical to SEQ ID NO: 993
  Description of Artificial Sequence: Synthetic oligonucleotide

SEQ ID NO: 3034 - protein, 16 aa, Artificial Sequence
  Description of Artificial Sequence: Synthetic peptide
RSSQSLLHSNGYNYLD

SEQ ID NO: 3035 - DNA, 33 bp, Artificial Sequence
  Description of Artificial Sequence: Synthetic oligonucleotide
cgggcgagtcagggcattagcaatcatttagcc

SEQ ID NO: 3036 - protein, 11 aa, Artificial Sequence
  Description of Artificial Sequence: Synthetic peptide
RASQGISNHLA

SEQ ID NO: 3037 - DNA, 33 bp, Artificial Sequence; identical to SEQ ID NO: 3035
  Description of Artificial Sequence: Synthetic oligonucleotide

SEQ ID NO: 3038 - protein, 11 aa, Artificial Sequence
  Description of Artificial Sequence: Synthetic peptide
RASQGISNHLA

SEQ ID NO: 3039 - DNA, 33 bp, Artificial Sequence
  Description of Artificial Sequence: Synthetic oligonucleotide
cgggcgagtcagggcattagcagttatttagcc

SEQ ID NO: 3040 - protein, 11 aa, Artificial Sequence
  Description of Artificial Sequence: Synthetic peptide
RASQGISSYLA

SEQ ID NO: 3041 - DNA, 33 bp, Artificial Sequence; identical to SEQ ID NO: 1783
  Description of Artificial Sequence: Synthetic oligonucleotide

SEQ ID NO: 3042 - protein, 11 aa, Artificial Sequence
  Description of Artificial Sequence: Synthetic peptide
RASQSVASSLA

SEQ ID NO: 3043 - DNA, 33 bp, Artificial Sequence
  Description of Artificial Sequence: Synthetic oligonucleotide
cgggcgagtcagggcattagcaattatttagac

SEQ ID NO: 3044 - protein, 11 aa, Artificial Sequence
  Description of Artificial Sequence: Synthetic peptide
RASQGISNYLD

SEQ ID NO: 3045 - DNA, 33 bp, Artificial Sequence; identical to SEQ ID NO: 109
  Description of Artificial Sequence: Synthetic oligonucleotide

SEQ ID NO: 3046 - protein, 11 aa, Artificial Sequence
  Description of Artificial Sequence: Synthetic peptide
RASQGIRNDLG

SEQ ID NO: 3047 - DNA, 33 bp, Artificial Sequence; identical to SEQ ID NO: 3025
  Description of Artificial Sequence: Synthetic oligonucleotide

SEQ ID NO: 3048 - protein, 11 aa, Artificial Sequence
  Description of Artificial Sequence: Synthetic peptide
RASQAIGKHLA

SEQ ID NO: 3049 - DNA, 33 bp, Artificial Sequence; identical to SEQ ID NO: 3035
  Description of Artificial Sequence: Synthetic oligonucleotide

SEQ ID NO: 3050 - protein, 11 aa, Artificial Sequence
  Description of Artificial Sequence: Synthetic peptide
RASQGISNHLA

SEQ ID NO: 3051 - DNA, 33 bp, Artificial Sequence; identical to SEQ ID NO: 1727
  Description of Artificial Sequence: Synthetic oligonucleotide

SEQ ID NO: 3052 - protein, 11 aa, Artificial Sequence
  Description of Artificial Sequence: Synthetic peptide
RASQGIGKYLA

SEQ ID NO: 3053 - DNA, 33 bp, Artificial Sequence
  Description of Artificial Sequence: Synthetic oligonucleotide
cgggcgagtcaggccattaggaattatttagcc

SEQ ID NO: 3054 - protein, 11 aa, Artificial Sequence
  Description of Artificial Sequence: Synthetic peptide
RASQAIRNYLA

SEQ ID NO: 3055 - DNA, 33 bp, Artificial Sequence; identical to SEQ ID NO: 3025
  Description of Artificial Sequence: Synthetic oligonucleotide

SEQ ID NO: 3056 - protein, 11 aa, Artificial Sequence
  Description of Artificial Sequence: Synthetic peptide
RASQAIGKHLA

SEQ ID NO: 3057 - DNA, 33 bp, Artificial Sequence; identical to SEQ ID NO: 3035
  Description of Artificial Sequence: Synthetic oligonucleotide

SEQ ID NO: 3058 - protein, 11 aa, Artificial Sequence
  Description of Artificial Sequence: Synthetic peptide
RASQGISNHLA

SEQ ID NO: 3059 - DNA, 51 bp, Artificial Sequence
  Description of Artificial Sequence: Synthetic oligonucleotide
aagtccagccagaatgttttagacatctccaacaataagaattccttaggt

SEQ ID NO: 3060 - protein, 17 aa, Artificial Sequence
  Description of Artificial Sequence: Synthetic peptide
KSSQNVLDISNNKNSLG

SEQ ID NO: 3061 - DNA, 51 bp, Artificial Sequence
  Description of Artificial Sequence: Synthetic oligonucleotide
aagtccagccagaatgttttaaagacctccaacaataggaactacttagct

SEQ ID NO: 3062 - protein, 17 aa, Artificial Sequence
  Description of Artificial Sequence: Synthetic peptide
KSSQNVLKTSNNRNYLA

SEQ ID NO: 3063 - DNA, 33 bp, Artificial Sequence; identical to SEQ ID NO: 2703
  Description of Artificial Sequence: Synthetic oligonucleotide

SEQ ID NO: 3064 - protein, 11 aa, Artificial Sequence
  Description of Artificial Sequence: Synthetic peptide
RASQGIGNYLA

SEQ ID NO: 3065 - DNA, 33 bp, Artificial Sequence; identical to SEQ ID NO: 105
  Description of Artificial Sequence: Synthetic oligonucleotide

SEQ ID NO: 3066 - protein, 11 aa, Artificial Sequence
  Description of Artificial Sequence: Synthetic peptide
RASQGISNYLA

SEQ ID NO: 3067 - DNA, 33 bp, Artificial Sequence
  Description of Artificial Sequence: Synthetic oligonucleotide
cgggccagtcagagcattggtgttagcttacac

SEQ ID NO: 3068 - protein, 11 aa, Artificial Sequence
  Description of Artificial Sequence: Synthetic peptide
RASQSIGVSLH

SEQ ID NO: 3069 - DNA, 33 bp, Artificial Sequence; identical to SEQ ID NO: 3035
  Description of Artificial Sequence: Synthetic oligonucleotide

SEQ ID NO: 3070 - protein, 11 aa, Artificial Sequence
  Description of Artificial Sequence: Synthetic peptide
RASQGISNHLA

SEQ ID NO: 3071 - DNA, 33 bp, Artificial Sequence; identical to SEQ ID NO: 109
  Description of Artificial Sequence: Synthetic oligonucleotide

SEQ ID NO: 3072 - protein, 11 aa, Artificial Sequence
  Description of Artificial Sequence: Synthetic peptide
RASQGIRNDLG

SEQ ID NO: 3073 - DNA, 33 bp, Artificial Sequence; identical to SEQ ID NO: 109
  Description of Artificial Sequence: Synthetic oligonucleotide

SEQ ID NO: 3074 - protein, 11 aa, Artificial Sequence
  Description of Artificial Sequence: Synthetic peptide
RASQGIRNDLG

SEQ ID NO: 3075 - DNA, 33 bp, Artificial Sequence; identical to SEQ ID NO: 109
  Description of Artificial Sequence: Synthetic oligonucleotide

SEQ ID NO: 3076 - protein, 11 aa, Artificial Sequence
  Description of Artificial Sequence: Synthetic peptide
RASQGIRNDLG

SEQ ID NO: 3077 - DNA, 33 bp, Artificial Sequence; identical to SEQ ID NO: 109
  Description of Artificial Sequence: Synthetic oligonucleotide

SEQ ID NO: 3078 - protein, 11 aa, Artificial Sequence
  Description of Artificial Sequence: Synthetic peptide
RASQGIRNDLG

SEQ ID NO: 3079 - DNA, 33 bp, Artificial Sequence; identical to SEQ ID NO: 3035
  Description of Artificial Sequence: Synthetic oligonucleotide

SEQ ID NO: 3080 - protein, 11 aa, Artificial Sequence
  Description of Artificial Sequence: Synthetic peptide
RASQGISNHLA

SEQ ID NO: 3081 - DNA, 33 bp, Artificial Sequence; identical to SEQ ID NO: 3035
  Description of Artificial Sequence: Synthetic oligonucleotide

SEQ ID NO: 3082 - protein, 11 aa, Artificial Sequence
  Description of Artificial Sequence: Synthetic peptide
RASQGISNHLA

SEQ ID NO: 3083 - DNA, 33 bp, Artificial Sequence
  Description of Artificial Sequence: Synthetic oligonucleotide
cgggccagtcagagcatcggtgttagcttacac

SEQ ID NO: 3084 - protein, 11 aa, Artificial Sequence
  Description of Artificial Sequence: Synthetic peptide
RASQSIGVSLH

SEQ ID NO: 3085 - DNA, 36 bp, Artificial Sequence
  Description of Artificial Sequence: Synthetic oligonucleotide
agggccagtcagaggattaccaccaacttcttagct

SEQ ID NO: 3086 - protein, 12 aa, Artificial Sequence
  Description of Artificial Sequence: Synthetic peptide
RASQRITTNFLA

SEQ ID NO: 3087 - DNA, 33 bp, Artificial Sequence; identical to SEQ ID NO: 109
  Description of Artificial Sequence: Synthetic oligonucleotide

SEQ ID NO: 3088 - protein, 11 aa, Artificial Sequence
  Description of Artificial Sequence: Synthetic peptide
RASQGIRNDLG

SEQ ID NO: 3089 - DNA, 33 bp, Artificial Sequence
  Description of Artificial Sequence: Synthetic oligonucleotide
cggacgagtcaggacattggcaattatttagcc

SEQ ID NO: 3090 - protein, 11 aa, Artificial Sequence
  Description of Artificial Sequence: Synthetic peptide
RTSQDIGNYLA

SEQ ID NO: 3091 - DNA, 36 bp, Artificial Sequence
  Description of Artificial Sequence: Synthetic oligonucleotide
agggccagtcagagtgttagcagcagcttcttagct

SEQ ID NO: 3092 - protein, 12 aa, Artificial Sequence
  Description of Artificial Sequence: Synthetic peptide
RASQSVSSSFLA

SEQ ID NO: 3093 - DNA, 33 bp, Artificial Sequence
  Description of Artificial Sequence: Synthetic oligonucleotide
agggccagtcagagtgttaacaacaacttagcc

SEQ ID NO: 3094 - protein, 11 aa, Artificial Sequence
  Description of Artificial Sequence: Synthetic peptide
RASQSVNNNLA

SEQ ID NO: 3095 - DNA, 36 bp, Artificial Sequence; identical to SEQ ID NO: 3027
  Description of Artificial Sequence: Synthetic oligonucleotide

SEQ ID NO: 3096 - protein, 12 aa, Artificial Sequence
  Description of Artificial Sequence: Synthetic peptide
RASQSVSSSFLA

SEQ ID NO: 3097 - DNA, 33 bp, Artificial Sequence; identical to SEQ ID NO: 109
  Description of Artificial Sequence: Synthetic oligonucleotide

SEQ ID NO: 3098 - protein, 11 aa, Artificial Sequence
  Description of Artificial Sequence: Synthetic peptide
RASQGIRNDLG

SEQ ID NO: 3099 - DNA, 33 bp, Artificial Sequence; identical to SEQ ID NO: 109
  Description of Artificial Sequence: Synthetic oligonucleotide

SEQ ID NO: 3100 - protein, 11 aa, Artificial Sequence
  Description of Artificial Sequence: Synthetic peptide
RASQGIRNDLG

SEQ ID NO: 3101 - DNA, 33 bp, Artificial Sequence; identical to SEQ ID NO: 2609
  Description of Artificial Sequence: Synthetic oligonucleotide

SEQ ID NO: 3102 - protein, 11 aa, Artificial Sequence
  Description of Artificial Sequence: Synthetic peptide
RASQSIGSSLH

SEQ ID NO: 3103 - DNA, 33 bp, Artificial Sequence; identical to SEQ ID NO: 109
  Description of Artificial Sequence: Synthetic oligonucleotide

SEQ ID NO: 3104 - protein, 11 aa, Artificial Sequence
  Description of Artificial Sequence: Synthetic peptide
RASQGIRNDLG

SEQ ID NO: 3105 - DNA, 33 bp, Artificial Sequence; identical to SEQ ID NO: 2703
  Description of Artificial Sequence: Synthetic oligonucleotide

SEQ ID NO: 3106 - protein, 11 aa, Artificial Sequence
  Description of Artificial Sequence: Synthetic peptide
RASQGIGNYLA

SEQ ID NO: 3107 - DNA, 33 bp, Artificial Sequence; identical to SEQ ID NO: 3025
  Description of Artificial Sequence: Synthetic oligonucleotide

SEQ ID NO: 3108 - protein, 11 aa, Artificial Sequence
  Description of Artificial Sequence: Synthetic peptide
RASQAIGKHLA

SEQ ID NO: 3109 - DNA, 33 bp, Artificial Sequence; identical to SEQ ID NO: 109
  Description of Artificial Sequence: Synthetic oligonucleotide

SEQ ID NO: 3110 - protein, 11 aa, Artificial Sequence
  Description of Artificial Sequence: Synthetic peptide
RASQGIRNDLG

SEQ ID NO: 3111 - DNA, 33 bp, Artificial Sequence; identical to SEQ ID NO: 109
  Description of Artificial Sequence: Synthetic oligonucleotide

SEQ ID NO: 3112 - protein, 11 aa, Artificial Sequence
  Description of Artificial Sequence: Synthetic peptide
RASQGIRNDLG

SEQ ID NO: 3113 - DNA, 33 bp, Artificial Sequence; identical to SEQ ID NO: 109
  Description of Artificial Sequence: Synthetic oligonucleotide

SEQ ID NO: 3114 - protein, 11 aa, Artificial Sequence
  Description of Artificial Sequence: Synthetic peptide
RASQGIRNDLG

SEQ ID NO: 3115 - DNA, 33 bp, Artificial Sequence; identical to SEQ ID NO: 3043
  Description of Artificial Sequence: Synthetic oligonucleotide

SEQ ID NO: 3116 - protein, 11 aa, Artificial Sequence
  Description of Artificial Sequence: Synthetic peptide
RASQGISNYLD

SEQ ID NO: 3117 - DNA, 36 bp, Artificial Sequence
  Description of Artificial Sequence: Synthetic oligonucleotide
agggccagtcagagtattagccgcagccacttagtc

SEQ ID NO: 3118 - protein, 12 aa, Artificial Sequence
  Description of Artificial Sequence: Synthetic peptide
RASQSISRSHLV

SEQ ID NO: 3119 - DNA, 33 bp, Artificial Sequence; identical to SEQ ID NO: 109
  Description of Artificial Sequence: Synthetic oligonucleotide

SEQ ID NO: 3120 - protein, 11 aa, Artificial Sequence
  Description of Artificial Sequence: Synthetic peptide
RASQGIRNDLG

SEQ ID NO: 3121 - DNA, 33 bp, Artificial Sequence; identical to SEQ ID NO: 171
  Description of Artificial Sequence: Synthetic oligonucleotide

SEQ ID NO: 3122 - protein, 11 aa, Artificial Sequence
  Description of Artificial Sequence: Synthetic peptide
RASQGISSWLA

SEQ ID NO: 3123 - DNA, 33 bp, Artificial Sequence; identical to SEQ ID NO: 105
  Description of Artificial Sequence: Synthetic oligonucleotide

SEQ ID NO: 3124 - protein, 11 aa, Artificial Sequence
  Description of Artificial Sequence: Synthetic peptide
RASQGISNYLA

SEQ ID NO: 3125 - DNA, 33 bp, Artificial Sequence; identical to SEQ ID NO: 171
  Description of Artificial Sequence: Synthetic oligonucleotide

SEQ ID NO: 3126 - protein, 11 aa, Artificial Sequence
  Description of Artificial Sequence: Synthetic peptide
RASQGISSWLA

SEQ ID NO: 3127 - DNA, 33 bp, Artificial Sequence; identical to SEQ ID NO: 171
  Description of Artificial Sequence: Synthetic oligonucleotide

SEQ ID NO: 3128 - protein, 11 aa, Artificial Sequence
  Description of Artificial Sequence: Synthetic peptide
RASQGISSWLA

SEQ ID NO: 3129 - DNA, 51 bp, Artificial Sequence
  Description of Artificial Sequence: Synthetic oligonucleotide
aagtccagccagagtgttttgaaaagttccaaccataggaactacttagct

SEQ ID NO: 3130 - protein, 17 aa, Artificial Sequence
  Description of Artificial Sequence: Synthetic peptide
KSSQSVLKSSNHRNYLA

SEQ ID NO: 3131 - DNA, 33 bp, Artificial Sequence
  Description of Artificial Sequence: Synthetic oligonucleotide
cgggcgagtcagggcattagcaattatttggcc

SEQ ID NO: 3132 - protein, 11 aa, Artificial Sequence
  Description of Artificial Sequence: Synthetic peptide
RASQGISNYLA

SEQ ID NO: 3133 - DNA, 33 bp, Artificial Sequence
  Description of Artificial Sequence: Synthetic oligonucleotide
cgggcaagtcagaacattagtaattatgttaat

SEQ ID NO: 3134 - protein, 11 aa, Artificial Sequence
  Description of Artificial Sequence: Synthetic peptide
RASQNISNYVN

SEQ ID NO: 3135 - DNA, 36 bp, Artificial Sequence
  Description of Artificial Sequence: Synthetic oligonucleotide
agggccagtcagagtgtttacagcaactacttagcc

SEQ ID NO: 3136 - protein, 12 aa, Artificial Sequence
  Description of Artificial Sequence: Synthetic peptide
RASQSVYSNYLA

SEQ ID NO: 3137 - DNA, 33 bp, Artificial Sequence; identical to SEQ ID NO: 171
  Description of Artificial Sequence: Synthetic oligonucleotide

SEQ ID NO: 3138 - protein, 11 aa, Artificial Sequence
  Description of Artificial Sequence: Synthetic peptide
RASQGISSWLA

SEQ ID NO: 3139 - DNA, 33 bp, Artificial Sequence; identical to SEQ ID NO: 3133
  Description of Artificial Sequence: Synthetic oligonucleotide

SEQ ID NO: 3140 - protein, 11 aa, Artificial Sequence
  Description of Artificial Sequence: Synthetic peptide
RASQNISNYVN

SEQ ID NO: 3141 - DNA, 33 bp, Artificial Sequence; identical to SEQ ID NO: 3131
  Description of Artificial Sequence: Synthetic oligonucleotide

SEQ ID NO: 3142 - protein, 11 aa, Artificial Sequence
  Description of Artificial Sequence: Synthetic peptide
RASQGISNYLA

SEQ ID NO: 3143 - DNA, 33 bp, Artificial Sequence
  Description of Artificial Sequence: Synthetic oligonucleotide
cgggtgagtcagggtattagcagctggttagcc

SEQ ID NO: 3144 - protein, 11 aa, Artificial Sequence
  Description of Artificial Sequence: Synthetic peptide
RVSQGISSWLA

SEQ ID NO: 3145 - DNA, 51 bp, Artificial Sequence
  Description of Artificial Sequence: Synthetic oligonucleotide
aagtccagccagagtattttactcagctccaacaataagaactacttagct

SEQ ID NO: 3146 - protein, 17 aa, Artificial Sequence
  Description of Artificial Sequence: Synthetic peptide
KSSQSILLSSNNKNYLA

SEQ ID NO: 3147 - DNA, 33 bp, Artificial Sequence
  Description of Artificial Sequence: Synthetic oligonucleotide
cgggcgagtcagggcattagtaattatttggcc

SEQ ID NO: 3148 - protein, 11 aa, Artificial Sequence
  Description of Artificial Sequence: Synthetic peptide
RASQGISNYLA

SEQ ID NO: 3149 - DNA, 33 bp, Artificial Sequence
  Description of Artificial Sequence: Synthetic oligonucleotide
cgggcaagtcagggcattgaaaatgatttaggc

SEQ ID NO: 3150 - protein, 11 aa, Artificial Sequence
  Description of Artificial Sequence: Synthetic peptide
RASQGIENDLG

SEQ ID NO: 3151 - DNA, 33 bp, Artificial Sequence
  Description of Artificial Sequence: Synthetic oligonucleotide
cgggcaagtcagggcattagtaatgatttaggc

SEQ ID NO: 3152 - protein, 11 aa, Artificial Sequence
  Description of Artificial Sequence: Synthetic peptide
RASQGISNDLG

SEQ ID NO: 3153 - DNA, 33 bp, Artificial Sequence; identical to SEQ ID NO: 1185
  Description of Artificial Sequence: Synthetic oligonucleotide

SEQ ID NO: 3154 - protein, 11 aa, Artificial Sequence
  Description of Artificial Sequence: Synthetic peptide
RASQGIRDDLG

SEQ ID NO: 3155 - DNA, 48 bp, Artificial Sequence
  Description of Artificial Sequence: Synthetic oligonucleotide
aagtctggtcagagcctcctgcatagtgatggaaagacctttttgtct

SEQ ID NO: 3156 - protein, 16 aa, Artificial Sequence
  Description of Artificial Sequence: Synthetic peptide
KSGQSLLHSDGKTFLS

SEQ ID NO: 3157 - DNA, 33 bp, Artificial Sequence; identical to SEQ ID NO: 205
  Description of Artificial Sequence: Synthetic oligonucleotide

SEQ ID NO: 3158 - protein, 11 aa, Artificial Sequence
  Description of Artificial Sequence: Synthetic peptide
RASQDIRNDLG

SEQ ID NO: 3159 - DNA, 33 bp, Artificial Sequence; identical to SEQ ID NO: 109
  Description of Artificial Sequence: Synthetic oligonucleotide

SEQ ID NO: 3160 - protein, 11 aa, Artificial Sequence
  Description of Artificial Sequence: Synthetic peptide
RASQGIRNDLG

SEQ ID NO: 3161 - DNA, 51 bp, Artificial Sequence
  Description of Artificial Sequence: Synthetic oligonucleotide
aagtccagccagagtgttttatacagctccaacaatttcaactacttaact

SEQ ID NO: 3162 - protein, 17 aa, Artificial Sequence
  Description of Artificial Sequence: Synthetic peptide
KSSQSVLYSSNNFNYLT

SEQ ID NO: 3163 - DNA, 33 bp, Artificial Sequence; identical to SEQ ID NO: 171
  Description of Artificial Sequence: Synthetic oligonucleotide

SEQ ID NO: 3164 - protein, 11 aa, Artificial Sequence
  Description of Artificial Sequence: Synthetic peptide
RASQGISSWLA

SEQ ID NO: 3165 - DNA, 48 bp, Artificial Sequence; identical to SEQ ID NO: 419
  Description of Artificial Sequence: Synthetic oligonucleotide

SEQ ID NO: 3166 - protein, 16 aa, Artificial Sequence
  Description of Artificial Sequence: Synthetic peptide
KSSQSLLHSDGKTFLY

SEQ ID NO: 3167 - DNA, 51 bp, Artificial Sequence; identical to SEQ ID NO: 1071
  Description of Artificial Sequence: Synthetic oligonucleotide

SEQ ID NO: 3168 - protein, 17 aa, Artificial Sequence
  Description of Artificial Sequence: Synthetic peptide
KSSQSVLYSSNNKNYLA

SEQ ID NO: 3169 - DNA, 51 bp, Artificial Sequence
  Description of Artificial Sequence: Synthetic oligonucleotide
aagtccagccagagtgttttatacaattccaacaataagaactacttagct

SEQ ID NO: 3170 - protein, 17 aa, Artificial Sequence
  Description of Artificial Sequence: Synthetic peptide
KSSQSVLYNSNNKNYLA

SEQ ID NO: 3171 - DNA, 33 bp, Artificial Sequence; identical to SEQ ID NO: 109
  Description of Artificial Sequence: Synthetic oligonucleotide

SEQ ID NO: 3172 - protein, 11 aa, Artificial Sequence
  Description of Artificial Sequence: Synthetic peptide
RASQGIRNDLG

SEQ ID NO: 3173 - DNA, 48 bp, Artificial Sequence; identical to SEQ ID NO: 419
  Description of Artificial Sequence: Synthetic oligonucleotide

SEQ ID NO: 3174 - protein, 16 aa, Artificial Sequence
  Description of Artificial Sequence: Synthetic peptide
KSSQSLLHSDGKTFLY

SEQ ID NO: 3175 - DNA, 51 bp, Artificial Sequence
  Description of Artificial Sequence: Synthetic oligonucleotide
aagtccagccagagtgttttatccagctccaacaatcacaactacttagct

SEQ ID NO: 3176 - protein, 17 aa, Artificial Sequence
  Description of Artificial Sequence: Synthetic peptide
KSSQSVLSSSNNHNYLA

SEQ ID NO: 3177 - DNA, 48 bp, Artificial Sequence; identical to SEQ ID NO: 419
  Description of Artificial Sequence: Synthetic oligonucleotide

SEQ ID NO: 3178 - protein, 16 aa, Artificial Sequence
  Description of Artificial Sequence: Synthetic peptide
KSSQSLLHSDGKTFLY

SEQ ID NO: 3179 - DNA, 33 bp, Artificial Sequence; identical to SEQ ID NO: 1185
  Description of Artificial Sequence: Synthetic oligonucleotide

SEQ ID NO: 3180 - protein, 11 aa, Artificial Sequence
  Description of Artificial Sequence: Synthetic peptide
RASQGIRDDLG

SEQ ID NO: 3181 - DNA, 36 bp, Artificial Sequence
  Description of Artificial Sequence: Synthetic oligonucleotide
agggccagtcagaatcttagcagcagctacttaggc

SEQ ID NO: 3182 - protein, 12 aa, Artificial Sequence
  Description of Artificial Sequence: Synthetic peptide
RASQNLSSSYLG

SEQ ID NO: 3183 - DNA, 51 bp, Artificial Sequence
  Description of Artificial Sequence: Synthetic oligonucleotide
aagtccagccagagtgttttatatagctccaacaataagaactacttagct

SEQ ID NO: 3184 - protein, 17 aa, Artificial Sequence
  Description of Artificial Sequence: Synthetic peptide
KSSQSVLYSSNNKNYLA

SEQ ID NO: 3185 - DNA, 48 bp, Artificial Sequence; identical to SEQ ID NO: 419
  Description of Artificial Sequence: Synthetic oligonucleotide

SEQ ID NO: 3186 - protein, 16 aa, Artificial Sequence
  Description of Artificial Sequence: Synthetic peptide
KSSQSLLHSDGKTFLY

SEQ ID NO: 3187 - DNA, 51 bp, Artificial Sequence; identical to SEQ ID NO: 1017
  Description of Artificial Sequence: Synthetic oligonucleotide

SEQ ID NO: 3188 - protein, 17 aa, Artificial Sequence
  Description of Artificial Sequence: Synthetic peptide
KSSQNVLYNSNNNNYLA

SEQ ID NO: 3189 - DNA, 33 bp, Artificial Sequence
  Description of Artificial Sequence: Synthetic oligonucleotide
cgggcaagtcagggcatgagaaaagatttaggc

SEQ ID NO: 3190 - protein, 11 aa, Artificial Sequence
  Description of Artificial Sequence: Synthetic peptide
RASQGMRKDLG

SEQ ID NO: 3191 - DNA, 33 bp, Artificial Sequence; identical to SEQ ID NO: 109
  Description of Artificial Sequence: Synthetic oligonucleotide

SEQ ID NO: 3192 - protein, 11 aa, Artificial Sequence
  Description of Artificial Sequence: Synthetic peptide
RASQGIRNDLG

SEQ ID NO: 3193 - DNA, 36 bp, Artificial Sequence; identical to SEQ ID NO: 1697
  Description of Artificial Sequence: Synthetic oligonucleotide

SEQ ID NO: 3194 - protein, 12 aa, Artificial Sequence
  Description of Artificial Sequence: Synthetic peptide
RASQSVYSSYLA

SEQ ID NO: 3195 - DNA, 33 bp, Artificial Sequence; identical to SEQ ID NO: 109
  Description of Artificial Sequence: Synthetic oligonucleotide

SEQ ID NO: 3196 - protein, 11 aa, Artificial Sequence
  Description of Artificial Sequence: Synthetic peptide
RASQGIRNDLG

SEQ ID NO: 3197 - DNA, 51 bp, Artificial Sequence; identical to SEQ ID NO: 1541
  Description of Artificial Sequence: Synthetic oligonucleotide

SEQ ID NO: 3198 - protein, 17 aa, Artificial Sequence
  Description of Artificial Sequence: Synthetic peptide
KSSQSVLYSSNNNNYLA

SEQ ID NO: 3199 - DNA, 51 bp, Artificial Sequence; identical to SEQ ID NO: 1079
  Description of Artificial Sequence: Synthetic oligonucleotide

SEQ ID NO: 3200 - protein, 17 aa, Artificial Sequence
  Description of Artificial Sequence: Synthetic peptide
KSSQSVLYSSNNYNYLA

SEQ ID NO: 3201 - DNA, 51 bp, Artificial Sequence
  Description of Artificial Sequence: Synthetic oligonucleotide
aagtccagccagagtgttttatacagctccaacaatcagaactacttagct

SEQ ID NO: 3202 - protein, 17 aa, Artificial Sequence
  Description of Artificial Sequence: Synthetic peptide
KSSQSVLYSSNNQNYLA

SEQ ID NO: 3203 - DNA, 51 bp, Artificial Sequence
  Description of Artificial Sequence: Synthetic oligonucleotide
aagtccagccagagtgttttatacaactccaacaataacaactacttagct

SEQ ID NO: 3204 - protein, 17 aa, Artificial Sequence
  Description of Artificial Sequence: Synthetic peptide
KSSQSVLYNSNNNNYLA

SEQ ID NO: 3205 - DNA, 48 bp, Artificial Sequence; identical to SEQ ID NO: 575
  Description of Artificial Sequence: Synthetic oligonucleotide

SEQ ID NO: 3206 - protein, 16 aa, Artificial Sequence
  Description of Artificial Sequence: Synthetic peptide
KSSQSLLHGDGKTYLY

SEQ ID NO: 3207 - DNA, 48 bp, Artificial Sequence; identical to SEQ ID NO: 579
  Description of Artificial Sequence: Synthetic oligonucleotide

SEQ ID NO: 3208 - protein, 16 aa, Artificial Sequence
  Description of Artificial Sequence: Synthetic peptide
KSSQSLLHGDGKTYLY

SEQ ID NO: 3209 - DNA, 33 bp, Artificial Sequence; identical to SEQ ID NO: 109
  Description of Artificial Sequence: Synthetic oligonucleotide

SEQ ID NO: 3210 - protein, 11 aa, Artificial Sequence
  Description of Artificial Sequence: Synthetic peptide
RASQGIRNDLG

SEQ ID NO: 3211 - DNA, 51 bp, Artificial Sequence
  Description of Artificial Sequence: Synthetic oligonucleotide
aggtccagccagagtattttatacatctccaacaataagaactacttagct

SEQ ID NO: 3212 - protein, 17 aa, Artificial Sequence
  Description of Artificial Sequence: Synthetic peptide
RSSQSILYISNNKNYLA

SEQ ID NO: 3213 - DNA, 51 bp, Artificial Sequence; identical to SEQ ID NO: 1825
  Description of Artificial Sequence: Synthetic oligonucleotide

SEQ ID NO: 3214 - protein, 17 aa, Artificial Sequence
  Description of Artificial Sequence: Synthetic peptide
KSSQSILYSSNNYNYLA

SEQ ID NO: 3215 - DNA, 48 bp, Artificial Sequence; identical to SEQ ID NO: 575
  Description of Artificial Sequence: Synthetic oligonucleotide

SEQ ID NO: 3216 - protein, 16 aa, Artificial Sequence
  Description of Artificial Sequence: Synthetic peptide
KSSQSLLHGDGKTYLY

SEQ ID NO: 3217 - DNA, 33 bp, Artificial Sequence
  Description of Artificial Sequence: Synthetic oligonucleotide
cgggcaagtcagggcattgggaatgatttaggc

SEQ ID NO: 3218 - protein, 11 aa, Artificial Sequence
  Description of Artificial Sequence: Synthetic peptide
RASQGIGNDLG

SEQ ID NO: 3219 - DNA, 48 bp, Artificial Sequence; identical to SEQ ID NO: 419
  Description of Artificial Sequence: Synthetic oligonucleotide

SEQ ID NO: 3220 - protein, 16 aa, Artificial Sequence
  Description of Artificial Sequence: Synthetic peptide
KSSQSLLHSDGKTFLY

SEQ ID NO: 3221 - DNA, 33 bp, Artificial Sequence; identical to SEQ ID NO: 109
  Description of Artificial Sequence: Synthetic oligonucleotide

SEQ ID NO: 3222 - protein, 11 aa, Artificial Sequence
  Description of Artificial Sequence: Synthetic peptide
RASQGIRNDLG

SEQ ID NO: 3223 - DNA, 48 bp, Artificial Sequence; identical to SEQ ID NO: 419
  Description of Artificial Sequence: Synthetic oligonucleotide

SEQ ID NO: 3224 - protein, 16 aa, Artificial Sequence
  Description of Artificial Sequence: Synthetic peptide
KSSQSLLHSDGKTFLY

SEQ ID NO: 3225 - DNA, 48 bp, Artificial Sequence; identical to SEQ ID NO: 419
  Description of Artificial Sequence: Synthetic oligonucleotide

SEQ ID NO: 3226 - protein, 16 aa, Artificial Sequence
  Description of Artificial Sequence: Synthetic peptide
KSSQSLLHSDGKTFLY

SEQ ID NO: 3227 - DNA, 48 bp, Artificial Sequence; identical to SEQ ID NO: 419
  Description of Artificial Sequence: Synthetic oligonucleotide

SEQ ID NO: 3228 - protein, 16 aa, Artificial Sequence
  Description of Artificial Sequence: Synthetic peptide
KSSQSLLHSDGKTFLY

SEQ ID NO: 3229 - DNA, 51 bp, Artificial Sequence
  Description of Artificial Sequence: Synthetic oligonucleotide
aagtccagccagaatgttttacacagctccaacagtaataactacttagtt

SEQ ID NO: 3230 - protein, 17 aa, Artificial Sequence
  Description of Artificial Sequence: Synthetic peptide
KSSQNVLHSSNSNNYLV

SEQ ID NO: 3231 - DNA, 48 bp, Artificial Sequence; identical to SEQ ID NO: 419
  Description of Artificial Sequence: Synthetic oligonucleotide

SEQ ID NO: 3232 - protein, 16 aa, Artificial Sequence
  Description of Artificial Sequence: Synthetic peptide
KSSQSLLHSDGKTFLY

SEQ ID NO: 3233 - DNA, 33 bp, Artificial Sequence; identical to SEQ ID NO: 93
  Description of Artificial Sequence: Synthetic oligonucleotide

SEQ ID NO: 3234 - protein, 11 aa, Artificial Sequence
  Description of Artificial Sequence: Synthetic peptide
RTSQGIRNDLG

SEQ ID NO: 3235 - DNA, 51 bp, Artificial Sequence
  Description of Artificial Sequence: Synthetic oligonucleotide
aagtccagccagaatgttttatacagttccaacaataacaactacttagct

SEQ ID NO: 3236 - protein, 17 aa, Artificial Sequence
  Description of Artificial Sequence: Synthetic peptide
KSSQNVLYSSNNNNYLA

SEQ ID NO: 3237 - DNA, 48 bp, Artificial Sequence
  Description of Artificial Sequence: Synthetic oligonucleotide
aagtctagtaagaccctcctgcatagtgatggaaagacctttttgtat

SEQ ID NO: 3238 - protein, 16 aa, Artificial Sequence
  Description of Artificial Sequence: Synthetic peptide
KSSKTLLHSDGKTFLY

SEQ ID NO: 3239 - DNA, 48 bp, Artificial Sequence; identical to SEQ ID NO: 419
  Description of Artificial Sequence: Synthetic oligonucleotide

SEQ ID NO: 3240 - protein, 16 aa, Artificial Sequence
  Description of Artificial Sequence: Synthetic peptide
KSSQSLLHSDGKTFLY

SEQ ID NO: 3241 - DNA, 48 bp, Artificial Sequence; identical to SEQ ID NO: 419
  Description of Artificial Sequence: Synthetic oligonucleotide

SEQ ID NO: 3242 - protein, 16 aa, Artificial Sequence
  Description of Artificial Sequence: Synthetic peptide
KSSQSLLHSDGKTFLY

SEQ ID NO: 3243 - DNA, 33 bp, Artificial Sequence; identical to SEQ ID NO: 109
  Description of Artificial Sequence: Synthetic oligonucleotide

SEQ ID NO: 3244 - protein, 11 aa, Artificial Sequence
  Description of Artificial Sequence: Synthetic peptide
RASQGIRNDLG

SEQ ID NO: 3245 - DNA, 33 bp, Artificial Sequence; identical to SEQ ID NO: 1167
  Description of Artificial Sequence: Synthetic oligonucleotide

SEQ ID NO: 3246 - protein, 11 aa, Artificial Sequence
  Description of Artificial Sequence: Synthetic peptide
RASQGIINWLA

SEQ ID NO: 3247 - DNA, 33 bp, Artificial Sequence; identical to SEQ ID NO: 205
  Description of Artificial Sequence: Synthetic oligonucleotide

SEQ ID NO: 3248 - protein, 11 aa, Artificial Sequence
  Description of Artificial Sequence: Synthetic peptide
RASQDIRNDLG

SEQ ID NO: 3249 - DNA, 51 bp, Artificial Sequence
  Description of Artificial Sequence: Synthetic oligonucleotide
aagtccagccagagtgttttatacagctccaacgataagaactacttagct

SEQ ID NO: 3250 - protein, 17 aa, Artificial Sequence
  Description of Artificial Sequence: Synthetic peptide
KSSQSVLYSSNDKNYLA

SEQ ID NO: 3251 - DNA, 51 bp, Artificial Sequence
  Description of Artificial Sequence: Synthetic oligonucleotide
aggtccagccagattgttttatccgactccaacaataacaactacttagct

SEQ ID NO: 3252 - protein, 17 aa, Artificial Sequence
  Description of Artificial Sequence: Synthetic peptide
RSSQIVLSDSNNNNYLA

SEQ ID NO: 3253 - DNA, 48 bp, Artificial Sequence; identical to SEQ ID NO: 419
  Description of Artificial Sequence: Synthetic oligonucleotide

SEQ ID NO: 3254 - protein, 16 aa, Artificial Sequence
  Description of Artificial Sequence: Synthetic peptide
KSSQSLLHSDGKTFLY

SEQ ID NO: 3255 - DNA, 51 bp, Artificial Sequence; identical to SEQ ID NO: 1057
  Description of Artificial Sequence: Synthetic oligonucleotide

SEQ ID NO: 3256 - protein, 17 aa, Artificial Sequence
  Description of Artificial Sequence: Synthetic peptide
KSSQSVLHSSNNNNYLA

SEQ ID NO: 3257 - DNA, 51 bp, Artificial Sequence
  Description of Artificial Sequence: Synthetic oligonucleotide
aagtccagccagagtgttttacacagttccaacaataataactacttagct

SEQ ID NO: 3258 - protein, 17 aa, Artificial Sequence
  Description of Artificial Sequence: Synthetic peptide
KSSQSVLHSSNNNNYLA

SEQ ID NO: 3259 - DNA, 48 bp, Artificial Sequence
  Description of Artificial Sequence: Synthetic oligonucleotide
tggtctagtcagagcctcctgcatagtaatggatacaactatttggat

SEQ ID NO: 3260 - protein, 16 aa, Artificial Sequence
  Description of Artificial Sequence: Synthetic peptide
WSSQSLLHSNGYNYLD

SEQ ID NO: 3261 - DNA, 33 bp, Artificial Sequence; identical to SEQ ID NO: 109
  Description of Artificial Sequence: Synthetic oligonucleotide

SEQ ID NO: 3262 - protein, 11 aa, Artificial Sequence
  Description of Artificial Sequence: Synthetic peptide
RASQGIRNDLG

SEQ ID NO: 3263 - DNA, 33 bp, Artificial Sequence; identical to SEQ ID NO: 191
  Description of Artificial Sequence: Synthetic oligonucleotide

SEQ ID NO: 3264 - protein, 11 aa, Artificial Sequence
  Description of Artificial Sequence: Synthetic peptide
SGDKLGDKYAS

SEQ ID NO: 3265 - DNA, 33 bp, Artificial Sequence; identical to SEQ ID NO: 191
  Description of Artificial Sequence: Synthetic oligonucleotide

SEQ ID NO: 3266 - protein, 11 aa, Artificial Sequence
  Description of Artificial Sequence: Synthetic peptide
SGDKLGDKYAS

SEQ ID NO: 3267 - DNA, 33 bp, Artificial Sequence; identical to SEQ ID NO: 191
  Description of Artificial Sequence: Synthetic oligonucleotide

SEQ ID NO: 3268 - protein, 11 aa, Artificial Sequence
  Description of Artificial Sequence: Synthetic peptide
SGDKLGDKYAS

SEQ ID NO: 3269 - DNA, 39 bp, Artificial Sequence
  Description of Artificial Sequence: Synthetic oligonucleotide
tctggaagcagctcctacatcggaagtaatactgtagac

SEQ ID NO: 3270 - protein, 13 aa, Artificial Sequence
  Description of Artificial Sequence: Synthetic peptide
SGSSSYIGSNTVD

SEQ ID NO: 3271 - DNA, 33 bp, Artificial Sequence
  Description of Artificial Sequence: Synthetic oligonucleotide
tctggagataaattgggggataaatttgcttgc

SEQ ID NO: 3272 - protein, 11 aa, Artificial Sequence
  Description of Artificial Sequence: Synthetic peptide
SGDKLGDKFAC

SEQ ID NO: 3273 - DNA, 33 bp, Artificial Sequence; identical to SEQ ID NO: 191
  Description of Artificial Sequence: Synthetic oligonucleotide

SEQ ID NO: 3274 - protein, 11 aa, Artificial Sequence
  Description of Artificial Sequence: Synthetic peptide
SGDKLGDKYAS

SEQ ID NO: 3275 - DNA, 33 bp, Artificial Sequence; identical to SEQ ID NO: 739
  Description of Artificial Sequence: Synthetic oligonucleotide

SEQ ID NO: 3276 - protein, 11 aa, Artificial Sequence
  Description of Artificial Sequence: Synthetic peptide
SGDKLGDKYVC

SEQ ID NO: 3277 - DNA, 33 bp, Artificial Sequence
  Description of Artificial Sequence: Synthetic oligonucleotide
tctggagataaattgggggataaatatgtttcc

SEQ ID NO: 3278 - protein, 11 aa, Artificial Sequence
  Description of Artificial Sequence: Synthetic peptide
SGDKLGDKYVS

SEQ ID NO: 3279 - DNA, 33 bp, Artificial Sequence
  Description of Artificial Sequence: Synthetic oligonucleotide
tctggagataaattgggtaataaatatgtttgc

SEQ ID NO: 3280 - protein, 11 aa, Artificial Sequence
  Description of Artificial Sequence: Synthetic peptide
SGDKLGNKYVC

SEQ ID NO: 3281 - DNA, 33 bp, Artificial Sequence
  Description of Artificial Sequence: Synthetic oligonucleotide
tctggagatgaattggggaataaatatgcttgc

SEQ ID NO: 3282 - protein, 11 aa, Artificial Sequence
  Description of Artificial Sequence: Synthetic peptide
SGDELGNKYAC

SEQ ID NO: 3283 - DNA, 33 bp, Artificial Sequence; identical to SEQ ID NO: 693
  Description of Artificial Sequence: Synthetic oligonucleotide

SEQ ID NO: 3284 - protein, 11 aa, Artificial Sequence
  Description of Artificial Sequence: Synthetic peptide
SGDKLGDKYAC

SEQ ID NO: 3285 - DNA, 33 bp, Artificial Sequence; identical to SEQ ID NO: 191
  Description of Artificial Sequence: Synthetic oligonucleotide

SEQ ID NO: 3286 - protein, 11 aa, Artificial Sequence
  Description of Artificial Sequence: Synthetic peptide
SGDKLGDKYAS

SEQ ID NO: 3287 - DNA, 33 bp, Artificial Sequence; identical to SEQ ID NO: 191
  Description of Artificial Sequence: Synthetic oligonucleotide

SEQ ID NO: 3288 - protein, 11 aa, Artificial Sequence
  Description of Artificial Sequence: Synthetic peptide
SGDKLGDKYAS

SEQ ID NO: 3289 - DNA, 39 bp, Artificial Sequence
  Description of Artificial Sequence: Synthetic oligonucleotide
tctggaagcagctccaacatcggaagttatgctgtaaac

SEQ ID NO: 3290 - protein, 13 aa, Artificial Sequence
  Description of Artificial Sequence: Synthetic peptide
SGSSSNIGSYAVN

SEQ ID NO: 3291 - DNA, 39 bp, Artificial Sequence
  Description of Artificial Sequence: Synthetic oligonucleotide
tctggaagcagctccaacatcggaagtaattctataaac

SEQ ID NO: 3292 - protein, 13 aa, Artificial Sequence
  Description of Artificial Sequence: Synthetic peptide
SGSSSNIGSNSIN

SEQ ID NO: 3293 - DNA, 39 bp, Artificial Sequence
  Description of Artificial Sequence: Synthetic oligonucleotide
tctggaagcagctccaacatcggaagtaatgctgtaaac

SEQ ID NO: 3294 - protein, 13 aa, Artificial Sequence
  Description of Artificial Sequence: Synthetic peptide
SGSSSNIGSNAVN

SEQ ID NO: 3295 - DNA, 33 bp, Artificial Sequence; identical to SEQ ID NO: 191
  Description of Artificial Sequence: Synthetic oligonucleotide

SEQ ID NO: 3296 - protein, 11 aa, Artificial Sequence
  Description of Artificial Sequence: Synthetic peptide
SGDKLGDKYAS

SEQ ID NO: 3297 - DNA, 33 bp, Artificial Sequence; identical to SEQ ID NO: 3277
  Description of Artificial Sequence: Synthetic oligonucleotide

SEQ ID NO: 3298 - protein, 11 aa, Artificial Sequence
  Description of Artificial Sequence: Synthetic peptide
SGDKLGDKYVS

SEQ ID NO: 3299 - DNA, 33 bp, Artificial Sequence
  Description of Artificial Sequence: Synthetic oligonucleotide
tctggagataaattggggaataaatatgtttgc

SEQ ID NO: 3300 - protein, 11 aa, Artificial Sequence
  Description of Artificial Sequence: Synthetic peptide
SGDKLGNKYVC

SEQ ID NO: 3301 - DNA, 33 bp, Artificial Sequence
  Description of Artificial Sequence: Synthetic oligonucleotide
tctggagataaattgggggataaatttgcttcc

SEQ ID NO: 3302 - protein, 11 aa, Artificial Sequence
  Description of Artificial Sequence: Synthetic peptide
SGDKLGDKFAS

SEQ ID NO: 3303 - DNA, 39 bp, Artificial Sequence; identical to SEQ ID NO: 3293
  Description of Artificial Sequence: Synthetic oligonucleotide

SEQ ID NO: 3304 - protein, 13 aa, Artificial Sequence
  Description of Artificial Sequence: Synthetic peptide
SGSSSNIGSNAVN

SEQ ID NO: 3305 - DNA, 33 bp, Artificial Sequence
  Description of Artificial Sequence: Synthetic oligonucleotide
tctggatataaattggggtataaatatgtttgc

SEQ ID NO: 3306 - protein, 11 aa, Artificial Sequence
  Description of Artificial Sequence: Synthetic peptide
SGYKLGYKYVC

SEQ ID NO: 3307 - DNA, 33 bp, Artificial Sequence
  Description of Artificial Sequence: Synthetic oligonucleotide
tctggaaataaattgggggataaatatgcttcc

SEQ ID NO: 3308 - protein, 11 aa, Artificial Sequence
  Description of Artificial Sequence: Synthetic peptide
SGNKLGDKYAS

SEQ ID NO: 3309 - DNA, 42 bp, Artificial Sequence
  Description of Artificial Sequence: Synthetic oligonucleotide
accttacgcagtggcatcactgttactacctataggatatac

SEQ ID NO: 3310 - protein, 14 aa, Artificial Sequence
  Description of Artificial Sequence: Synthetic peptide
TLRSGITVTTYRIY

SEQ ID NO: 3311 - DNA, 33 bp, Artificial Sequence; identical to SEQ ID NO: 191
  Description of Artificial Sequence: Synthetic oligonucleotide

SEQ ID NO: 3312 - protein, 11 aa, Artificial Sequence
  Description of Artificial Sequence: Synthetic peptide
SGDKLGDKYAS

SEQ ID NO: 3313 - DNA, 33 bp, Artificial Sequence
  Description of Artificial Sequence: Synthetic oligonucleotide
tctggagataaattggggaataaatatgtttcc

SEQ ID NO: 3314 - protein, 11 aa, Artificial Sequence
  Description of Artificial Sequence: Synthetic peptide
SGDKLGNKYVS

SEQ ID NO: 3315 - DNA, 33 bp, Artificial Sequence; identical to SEQ ID NO: 3281
  Description of Artificial Sequence: Synthetic oligonucleotide

SEQ ID NO: 3316 - protein, 11 aa, Artificial Sequence
  Description of Artificial Sequence: Synthetic peptide
SGDELGNKYAC

SEQ ID NO: 3317 - DNA, 33 bp, Artificial Sequence; identical to SEQ ID NO: 191
  Description of Artificial Sequence: Synthetic oligonucleotide

SEQ ID NO: 3318 - protein, 11 aa, Artificial Sequence
  Description of Artificial Sequence: Synthetic peptide
SGDKLGDKYAS

SEQ ID NO: 3319 - DNA, 39 bp, Artificial Sequence; identical to SEQ ID NO: 3293
  Description of Artificial Sequence: Synthetic oligonucleotide

SEQ ID NO: 3320 - protein, 13 aa, Artificial Sequence
  Description of Artificial Sequence: Synthetic peptide
SGSSSNIGSNAVN

SEQ ID NO: 3321 - DNA, 33 bp, Artificial Sequence; identical to SEQ ID NO: 191
  Description of Artificial Sequence: Synthetic oligonucleotide

SEQ ID NO: 3322 - protein, 11 aa, Artificial Sequence
  Description of Artificial Sequence: Synthetic peptide
SGDKLGDKYAS

SEQ ID NO: 3323 - DNA, 33 bp, Artificial Sequence; identical to SEQ ID NO: 739
  Description of Artificial Sequence: Synthetic oligonucleotide

SEQ ID NO: 3324 - protein, 11 aa, Artificial Sequence
  Description of Artificial Sequence: Synthetic peptide
SGDKLGDKYVC

SEQ ID NO: 3325 - DNA, 33 bp, Artificial Sequence; identical to SEQ ID NO: 191
  Description of Artificial Sequence: Synthetic oligonucleotide

SEQ ID NO: 3326 - protein, 11 aa, Artificial Sequence
  Description of Artificial Sequence: Synthetic peptide
SGDKLGDKYAS

SEQ ID NO: 3327 - DNA, 33 bp, Artificial Sequence; identical to SEQ ID NO: 693
  Description of Artificial Sequence: Synthetic oligonucleotide

SEQ ID NO: 3328 - protein, 11 aa, Artificial Sequence
  Description of Artificial Sequence: Synthetic peptide
SGDKLGDKYAC

SEQ ID NO: 3329 - DNA, 33 bp, Artificial Sequence; identical to SEQ ID NO: 191
  Description of Artificial Sequence: Synthetic oligonucleotide

SEQ ID NO: 3330 - protein, 11 aa, Artificial Sequence
  Description of Artificial Sequence: Synthetic peptide
SGDKLGDKYAS

SEQ ID NO: 3331 - DNA, 33 bp, Artificial Sequence
  Description of Artificial Sequence: Synthetic oligonucleotide
tctggagataatttgggggataaatatgcttcc

SEQ ID NO: 3332 - protein, 11 aa, Artificial Sequence
  Description of Artificial Sequence: Synthetic peptide
SGDNLGDKYAS

SEQ ID NO: 3333 - DNA, 33 bp, Artificial Sequence; identical to SEQ ID NO: 693
  Description of Artificial Sequence: Synthetic oligonucleotide

SEQ ID NO: 3334 - protein, 11 aa, Artificial Sequence
  Description of Artificial Sequence: Synthetic peptide
SGDKLGDKYAC

SEQ ID NO: 3335 - DNA, 33 bp, Artificial Sequence; identical to SEQ ID NO: 191
  Description of Artificial Sequence: Synthetic oligonucleotide

SEQ ID NO: 3336 - protein, 11 aa, Artificial Sequence
  Description of Artificial Sequence: Synthetic peptide
SGDKLGDKYAS

SEQ ID NO: 3337 - DNA, 33 bp, Artificial Sequence; identical to SEQ ID NO: 191
  Description of Artificial Sequence: Synthetic oligonucleotide

SEQ ID NO: 3338 - protein, 11 aa, Artificial Sequence
  Description of Artificial Sequence: Synthetic peptide
SGDKLGDKYAS

SEQ ID NO: 3339 - DNA, 33 bp, Artificial Sequence
  Description of Artificial Sequence: Synthetic oligonucleotide
tctggcgataaattgggaaataaatatgcttgc

SEQ ID NO: 3340 - protein, 11 aa, Artificial Sequence
  Description of Artificial Sequence: Synthetic peptide
SGDKLGNKYAC

SEQ ID NO: 3341 - DNA, 33 bp, Artificial Sequence; identical to SEQ ID NO: 693
  Description of Artificial Sequence: Synthetic oligonucleotide

SEQ ID NO: 3342 - protein, 11 aa, Artificial Sequence
  Description of Artificial Sequence: Synthetic peptide
SGDKLGDKYAC

SEQ ID NO: 3343 - DNA, 33 bp, Artificial Sequence
  Description of Artificial Sequence: Synthetic oligonucleotide
tctggaagtaaattgggtaataaatatgtttgc

SEQ ID NO: 3344 - protein, 11 aa, Artificial Sequence
  Description of Artificial Sequence: Synthetic peptide
SGSKLGNKYVC

SEQ ID NO: 3345 - DNA, 33 bp, Artificial Sequence; identical to SEQ ID NO: 693
  Description of Artificial Sequence: Synthetic oligonucleotide

SEQ ID NO: 3346 - protein, 11 aa, Artificial Sequence
  Description of Artificial Sequence: Synthetic peptide
SGDKLGDKYAC

SEQ ID NO: 3347 - DNA, 33 bp, Artificial Sequence; identical to SEQ ID NO: 739
  Description of Artificial Sequence: Synthetic oligonucleotide

SEQ ID NO: 3348 - protein, 11 aa, Artificial Sequence
  Description of Artificial Sequence: Synthetic peptide
SGDKLGDKYVC

SEQ ID NO: 3349 - DNA, 33 bp, Artificial Sequence; identical to SEQ ID NO: 191
  Description of Artificial Sequence: Synthetic oligonucleotide

SEQ ID NO: 3350 - protein, 11 aa, Artificial Sequence
  Description of Artificial Sequence: Synthetic peptide
SGDKLGDKYAS

SEQ ID NO: 3351 - DNA, 33 bp, Artificial Sequence
  Description of Artificial Sequence: Synthetic oligonucleotide
tctggagataaattgggaaataaatatgtttgt

SEQ ID NO: 3352 - protein, 11 aa, Artificial Sequence
  Description of Artificial Sequence: Synthetic peptide
SGDKLGNKYVC

SEQ ID NO: 3353 - DNA, 33 bp, Artificial Sequence; identical to SEQ ID NO: 191
  Description of Artificial Sequence: Synthetic oligonucleotide

SEQ ID NO: 3354 - protein, 11 aa, Artificial Sequence
  Description of Artificial Sequence: Synthetic peptide
SGDKLGDKYAS

SEQ ID NO: 3355 - DNA, 33 bp, Artificial Sequence; identical to SEQ ID NO: 693
  Description of Artificial Sequence: Synthetic oligonucleotide

SEQ ID NO: 3356 - protein, 11 aa, Artificial Sequence
  Description of Artificial Sequence: Synthetic peptide
SGDKLGDKYAC

SEQ ID NO: 3357 - DNA, 39 bp, Artificial Sequence
  Description of Artificial Sequence: Synthetic oligonucleotide
tctggaagcagctccaacatcggaaataatgctgtaagc

SEQ ID NO: 3358 - protein, 13 aa, Artificial Sequence
  Description of Artificial Sequence: Synthetic peptide
SGSSSNIGNNAVS

SEQ ID NO: 3359 - DNA, 42 bp, Artificial Sequence
  Description of Artificial Sequence: Synthetic oligonucleotide
actgggagcagctccaatatcggggcaggttatgatgtacac

SEQ ID NO: 3360 - protein, 14 aa, Artificial Sequence
  Description of Artificial Sequence: Synthetic peptide
TGSSSNIGAGYDVH

SEQ ID NO: 3361 - DNA, 33 bp, Artificial Sequence
  Description of Artificial Sequence: Synthetic oligonucleotide
tctggagataagttgggggataaatatgtttgc

SEQ ID NO: 3362 - protein, 11 aa, Artificial Sequence
  Description of Artificial Sequence: Synthetic peptide
SGDKLGDKYVC

SEQ ID NO: 3363 - DNA, 33 bp, Artificial Sequence; identical to SEQ ID NO: 739
  Description of Artificial Sequence: Synthetic oligonucleotide

SEQ ID NO: 3364 - protein, 11 aa, Artificial Sequence
  Description of Artificial Sequence: Synthetic peptide
SGDKLGDKYVC

SEQ ID NO: 3365 - DNA, 33 bp, Artificial Sequence; identical to SEQ ID NO: 3277
  Description of Artificial Sequence: Synthetic oligonucleotide

SEQ ID NO: 3366 - protein, 11 aa, Artificial Sequence
  Description of Artificial Sequence: Synthetic peptide
SGDKLGDKYVS

SEQ ID NO: 3367 - DNA, 33 bp, Artificial Sequence; identical to SEQ ID NO: 3277
  Description of Artificial Sequence: Synthetic oligonucleotide

SEQ ID NO: 3368 - protein, 11 aa, Artificial Sequence
  Description of Artificial Sequence: Synthetic peptide
SGDKLGDKYVS

SEQ ID NO: 3369 - DNA, 39 bp, Artificial Sequence
  Description of Artificial Sequence: Synthetic oligonucleotide
tctggaagcagctccaacatcggaagtaatactgtaaat

SEQ ID NO: 3370 - protein, 13 aa, Artificial Sequence
  Description of Artificial Sequence: Synthetic peptide
SGSSSNIGSNTVN

SEQ ID NO: 3371 - DNA, 33 bp, Artificial Sequence; identical to SEQ ID NO: 739
  Description of Artificial Sequence: Synthetic oligonucleotide

SEQ ID NO: 3372 - protein, 11 aa, Artificial Sequence
  Description of Artificial Sequence: Synthetic peptide
SGDKLGDKYVC

SEQ ID NO: 3373 - DNA, 33 bp, Artificial Sequence; identical to SEQ ID NO: 739
  Description of Artificial Sequence: Synthetic oligonucleotide

SEQ ID NO: 3374 - protein, 11 aa, Artificial Sequence
  Description of Artificial Sequence: Synthetic peptide
SGDKLGDKYVC

SEQ ID NO: 3375 - DNA, 33 bp, Artificial Sequence; identical to SEQ ID NO: 739
  Description of Artificial Sequence: Synthetic oligonucleotide

SEQ ID NO: 3376 - protein, 11 aa, Artificial Sequence
  Description of Artificial Sequence: Synthetic peptide
SGDKLGDKYVC

SEQ ID NO: 3377 - DNA, 33 bp, Artificial Sequence; identical to SEQ ID NO: 739
  Description of Artificial Sequence: Synthetic oligonucleotide

SEQ ID NO: 3378 - protein, 11 aa, Artificial Sequence
  Description of Artificial Sequence: Synthetic peptide
SGDKLGDKYVC

SEQ ID NO: 3379 - DNA, 33 bp, Artificial Sequence
  Description of Artificial Sequence: Synthetic oligonucleotide
tctggagatagattgggggataaatatgtttgc

SEQ ID NO: 3380 - protein, 11 aa, Artificial Sequence
  Description of Artificial Sequence: Synthetic peptide
SGDRLGDKYVC

SEQ ID NO: 3381 - DNA, 33 bp, Artificial Sequence; identical to SEQ ID NO: 739
  Description of Artificial Sequence: Synthetic oligonucleotide

SEQ ID NO: 3382 - protein, 11 aa, Artificial Sequence
  Description of Artificial Sequence: Synthetic peptide
SGDKLGDKYVC

SEQ ID NO: 3383 - DNA, 33 bp, Artificial Sequence
  Description of Artificial Sequence: Synthetic oligonucleotide
tctggagataaattgggtgataaatatgcttgc

SEQ ID NO: 3384 - protein, 11 aa, Artificial Sequence
  Description of Artificial Sequence: Synthetic peptide
SGDKLGDKYAC

SEQ ID NO: 3385 - DNA, 33 bp, Artificial Sequence; identical to SEQ ID NO: 3383
  Description of Artificial Sequence: Synthetic oligonucleotide

SEQ ID NO: 3386 - protein, 11 aa, Artificial Sequence
  Description of Artificial Sequence: Synthetic peptide
SGDKLGDKYAC

SEQ ID NO: 3387 - DNA, 33 bp, Artificial Sequence
  Description of Artificial Sequence: Synthetic oligonucleotide
tctggagataaattgggggataaatatgttcac

SEQ ID NO: 3388 - protein, 11 aa, Artificial Sequence
  Description of Artificial Sequence: Synthetic peptide
SGDKLGDKYVH

SEQ ID NO: 3389 - DNA, 33 bp, Artificial Sequence
  Description of Artificial Sequence: Synthetic oligonucleotide
tctggagataaattgggggataaatatgtttgt

SEQ ID NO: 3390 - protein, 11 aa, Artificial Sequence
  Description of Artificial Sequence: Synthetic peptide
SGDKLGDKYVC

SEQ ID NO: 3391 - DNA, 33 bp, Artificial Sequence; identical to SEQ ID NO: 3389
  Description of Artificial Sequence: Synthetic oligonucleotide

SEQ ID NO: 3392 - protein, 11 aa, Artificial Sequence
  Description of Artificial Sequence: Synthetic peptide
SGDKLGDKYVC

SEQ ID NO: 3393 - DNA, 33 bp, Artificial Sequence
  Description of Artificial Sequence: Synthetic oligonucleotide
tctggagataaattggggggaaaatatgcttcc

SEQ ID NO: 3394 - protein, 11 aa, Artificial Sequence
  Description of Artificial Sequence: Synthetic peptide
SGDKLGGKYAS

SEQ ID NO: 3395 - DNA, 33 bp, Artificial Sequence; identical to SEQ ID NO: 693
  Description of Artificial Sequence: Synthetic oligonucleotide

SEQ ID NO: 3396 - protein, 11 aa, Artificial Sequence
  Description of Artificial Sequence: Synthetic peptide
SGDKLGDKYAC

SEQ ID NO: 3397 - DNA, 39 bp, Artificial Sequence
  Description of Artificial Sequence: Synthetic oligonucleotide
acccgcagcagtggcagcattaccggcaactatgtgcag

SEQ ID NO: 3398 - protein, 13 aa, Artificial Sequence
  Description of Artificial Sequence: Synthetic peptide
TRSSGSITGNYVQ

SEQ ID NO: 3399 - DNA, 33 bp, Artificial Sequence
  Description of Artificial Sequence: Synthetic oligonucleotide
tctggagataaattgggggataaatattcttgc

SEQ ID NO: 3400 - protein, 11 aa, Artificial Sequence
  Description of Artificial Sequence: Synthetic peptide
SGDKLGDKYSC

SEQ ID NO: 3401 - DNA, 33 bp, Artificial Sequence
  Description of Artificial Sequence: Synthetic oligonucleotide
tctggagataaattgggggataaatatgcttgt

SEQ ID NO: 3402 - protein, 11 aa, Artificial Sequence
  Description of Artificial Sequence: Synthetic peptide
SGDKLGDKYAC

SEQ ID NO: 3403 - DNA, 33 bp, Artificial Sequence; identical to SEQ ID NO: 3393
  Description of Artificial Sequence: Synthetic oligonucleotide

SEQ ID NO: 3404 - protein, 11 aa, Artificial Sequence
  Description of Artificial Sequence: Synthetic peptide
SGDKLGGKYAS

SEQ ID NO: 3405 - DNA, 33 bp, Artificial Sequence
  Description of Artificial Sequence: Synthetic oligonucleotide
caaggagacagcctcagaagctattatgcaagc

SEQ ID NO: 3406 - protein, 11 aa, Artificial Sequence
  Description of Artificial Sequence: Synthetic peptide
QGDSLRSYYAS

SEQ ID NO: 3407 - DNA, 33 bp, Artificial Sequence; identical to SEQ ID NO: 693
  Description of Artificial Sequence: Synthetic oligonucleotide

SEQ ID NO: 3408 - protein, 11 aa, Artificial Sequence
  Description of Artificial Sequence: Synthetic peptide
SGDKLGDKYAC

SEQ ID NO: 3409 - DNA, 33 bp, Artificial Sequence
  Description of Artificial Sequence: Synthetic oligonucleotide
caaggagacagcctcagaaactattatgtaagc

(The sequence listing continues in the following parts.)

What is claimed is:

1. A method of treating or preventing a cardiovascular disease comprising administering to a patient in need thereof a therapeutically effective dose of an isolated antigen binding protein that binds to ASGR-1 (asialoglycoprotein receptor 1), wherein the isolated antigen binding protein is a neutralizing antibody or a neutralizing antigen binding fragment thereof.

2. The method of claim 1, wherein said cardiovascular disease is coronary artery disease or myocardial infarction.

3. The method of claim 1, wherein the cardiovascular disease is thereby treated.

4. The method of claim 1, wherein the cardiovascular disease is thereby prevented.

5. A method of reducing LDL (low density lipoprotein) cholesterol levels in a patient comprising administering to a patient in need thereof a therapeutically effective dose of an isolated antigen binding protein that binds to ASGR-1 (asialoglycoprotein receptor 1), wherein the isolated antigen binding protein is a neutralizing antibody or a neutralizing antigen binding fragment thereof.

6. The method of claim 5, wherein LDL is reduced by at least 20%.

7. The method of claim 5, wherein the patient has coronary artery disease or myocardial infarction.

8. A method of reducing non-HDL (non-high density lipoprotein) cholesterol levels in a patient comprising administering to a patient in need thereof a therapeutically effective dose of an isolated antigen binding protein that binds to ASGR-1 (asialoglycoprotein receptor 1), wherein the isolated antigen binding protein is a neutralizing antibody or a neutralizing antigen binding fragment thereof.

9. The method of claim 8, wherein non-HDL is reduced by at least 20%.

10. The method of claim 8, wherein the patient has coronary artery disease or myocardial infarction.

11. A method of increasing ALP (alkaline phosphatase) levels in a patient comprising administering to a patient in need thereof a therapeutically effective dose of an isolated antigen binding protein that binds to ASGR-1 (asialoglycoprotein receptor 1), wherein the isolated antigen binding protein is a neutralizing antibody or a neutralizing antigen binding fragment thereof.

12. The method of claim 11, wherein ALP is increased by at least 40%.

13. The method of claim 11, wherein the patient has coronary artery disease or myocardial infarction.

14. The method of claim 1, wherein the isolated antigen binding protein is administered sequentially with at least one agent that lowers cholesterol.

15. The method of claim 14, wherein the at least one agent is a statin, an anti-PCSK9 inhibitor or a combination thereof.

16. The method of claim 5, wherein the isolated antigen binding protein is administered sequentially with at least one agent that lowers cholesterol.

17. The method of claim 16, wherein the at least one agent is a statin, an anti-PCSK9 inhibitor or a combination thereof.

18. The method of claim 8, wherein the isolated antigen binding protein is administered sequentially with at least one agent that lowers cholesterol.

19. The method of claim 18, wherein the at least one agent is a statin, an anti-PCSK9 inhibitor or a combination thereof.

20. The method of claim 11, wherein the isolated antigen binding protein is administered sequentially with at least one agent that lowers cholesterol.

21. The method of claim 20, wherein the at least one agent is a statin, an anti-PCSK9 inhibitor or a combination thereof.

22. The method of claim 1, wherein the ASGR-1 (asialoglycoprotein receptor 1) is a human ASGR-1 having the sequence in SEQ ID NO: 32699.

23. The method of claim 5, wherein the ASGR-1 (asialoglycoprotein receptor 1) is a human ASGR-1 having the sequence in SEQ ID NO: 32699.

24. The method of claim 8, wherein the ASGR-1 (asialoglycoprotein receptor 1) is a human ASGR-1 having the sequence in SEQ ID NO: 32699.

25. The method of claim 11, wherein the ASGR-1 (asialoglycoprotein receptor 1) is a human ASGR-1 having the sequence in SEQ ID NO: 32699.

26. The method of claim 1, wherein the isolated antigen binding protein is administered parenterally.

27. The method of claim 5, wherein the isolated antigen binding protein is administered parenterally.

28. The method of claim 8, wherein the isolated antigen binding protein is administered parenterally.

29. The method of claim 11, wherein the isolated antigen binding protein is administered parenterally.

30. The method of claim 1, wherein the isolated antigen binding protein is the neutralizing antibody.

31. The method of claim 5, wherein the isolated antigen binding protein is the neutralizing antibody.

32. The method of claim 8, wherein the isolated antigen binding protein is the neutralizing antibody.

33. The method of claim 11, wherein the isolated antigen binding protein is the neutralizing antibody.

34. The method of claim 1, wherein the isolated antigen binding protein is a neutralizing human antibody.

35. The method of claim 5, wherein the isolated antigen binding protein is a neutralizing human antibody.

36. The method of claim 8, wherein the isolated antigen binding protein is a neutralizing human antibody.

37. The method of claim 11, wherein the isolated antigen binding protein is a neutralizing human antibody.

38. The method of claim 1, wherein the isolated antigen binding protein is the neutralizing antigen binding fragment of the antibody.

39. The method of claim 5, wherein the isolated antigen binding protein is the neutralizing antigen binding fragment of the antibody.

40. The method of claim 8, wherein the isolated antigen binding protein is the neutralizing antigen binding fragment of the antibody.

41. The method of claim 11, wherein the isolated antigen binding protein is the neutralizing antigen binding fragment of the antibody.

42. The method of claim 1, wherein the isolated antigen binding protein competes with an antibody having a heavy chain CDR1 sequence of SEQ ID NO: 4780, a heavy chain CDR2 sequence of SEQ ID NO: 12792, a heavy chain CDR3 sequence of SEQ ID NO: 20804, a light chain CDR1 sequence of SEQ ID NO: 772, a light chain CDR2 sequence of SEQ ID NO: 8784, and a light chain CDR3 sequence of SEQ ID NO: 16796.

43. The method of claim 5, wherein the isolated antigen binding protein competes with an antibody having a heavy chain CDR1 sequence of SEQ ID NO: 4780, a heavy chain CDR2 sequence of SEQ ID NO: 12792, a heavy chain CDR3 sequence of SEQ ID NO: 20804, a light chain CDR1 sequence of SEQ ID NO: 772, a light chain CDR2 sequence of SEQ ID NO: 8784, and 50213, and a light chain CDR3 sequence of SEQ ID NO: 16796.

44. The method of claim 8, wherein the isolated antigen binding protein competes with an antibody having a heavy chain CDR1 sequence of SEQ ID NO: 4780, a heavy chain CDR2 sequence of SEQ ID NO: 12792, a heavy chain CDR3 sequence of SEQ ID NO: 20804, a light chain CDR1 sequence of SEQ ID NO: 772, a light chain CDR2 sequence of SEQ ID NO: 8784, and a light chain CDR3 sequence of SEQ ID NO: 16796.

45. The method of claim 11, wherein the isolated antigen binding protein competes with an antibody having a heavy chain CDR1 sequence of SEQ ID NO: 4780, a heavy chain CDR2 sequence of SEQ ID NO: 12792, a heavy chain CDR3 sequence of SEQ ID NO: 20804, a light chain CDR1 sequence of SEQ ID NO: 772, a light chain CDR2 sequence of SEQ ID NO: 8784, and a light chain CDR3 sequence of SEQ ID NO: 16796.

46. A method of treating a cardiovascular disease, the method comprising administering to a patient in need thereof a therapeutically effective dose of an isolated antigen binding protein that binds to ASGR-1 (asialoglycoprotein receptor 1), wherein said cardiovascular disease is coronary artery disease or myocardial infarction, and wherein the isolated antigen binding protein is a neutralizing antibody or a neutralizing antigen binding fragment thereof.

47. The method of claim 46, wherein the isolated antigen binding protein competes with an antibody having a heavy chain CDR1 sequence of SEQ ID NO: 4780, a heavy chain CDR2 sequence of SEQ ID NO: 12792, a heavy chain CDR3 sequence of SEQ ID NO: 20804, a light chain CDR1 sequence of SEQ ID NO: 772, a light chain CDR2 sequence of SEQ ID NO: 8784, and a light chain CDR3 sequence of SEQ ID NO: 16796.

\* \* \* \* \*

UNITED STATES PATENT AND TRADEMARK OFFICE
CERTIFICATE OF CORRECTION

PATENT NO. : 11,066,472 B2
APPLICATION NO. : 16/230356
DATED : July 20, 2021
INVENTOR(S) : Paul Nioi et al.

It is certified that error appears in the above-identified patent and that said Letters Patent is hereby corrected as shown below:

In the Claims

In Column 850, Line 2, Claim 43, delete "8784, and 50213," and insert --8784,--.

Signed and Sealed this
Fourteenth Day of February, 2023

Katherine Kelly Vidal
*Director of the United States Patent and Trademark Office*